US007939087B2

(12) United States Patent
Telford et al.

(10) Patent No.: US 7,939,087 B2
(45) Date of Patent: May 10, 2011

(54) **NUCLEIC ACIDS AND PROTEINS FROM *STREPTOCOCCUS* GROUPS A & B**

(75) Inventors: John Telford, Monteriggioni (IT); Vega Masignani, Siena (IT); Maria Scarselli, Siena (IT); Guido Grandi, Segrate (IT); Herve Tettelin, Rockville, MD (US); Claire Fraser, Clarksville, MD (US)

(73) Assignee: Novartis Vaccines and Diagnostics, Inc., Emeryville, CA (US)

( * ) Notice: Subject to any disclaimer, the term of this patent is extended or adjusted under 35 U.S.C. 154(b) by 1096 days.

(21) Appl. No.: 10/415,182

(22) PCT Filed: Oct. 29, 2001

(86) PCT No.: PCT/GB01/04789
§ 371 (c)(1),
(2), (4) Date: Oct. 14, 2003

(87) PCT Pub. No.: WO02/34771
PCT Pub. Date: May 2, 2002

(65) Prior Publication Data
US 2010/0105865 A1    Apr. 29, 2010

(30) Foreign Application Priority Data

Oct. 27, 2000  (GB) .................................. 0026333.5
Nov. 24, 2000  (GB) .................................. 0028727.6
Mar. 7, 2001   (GB) .................................. 0105640.7

(51) Int. Cl.
*A61K 39/09* (2006.01)
*A61K 39/38* (2006.01)
*A61K 39/02* (2006.01)
*C07H 21/04* (2006.01)
*C12P 21/06* (2006.01)
*C12P 21/04* (2006.01)
*C12N 15/00* (2006.01)

(52) U.S. Cl. ............... 424/244.1; 424/184.1; 424/201.1; 424/203.1; 424/242.1; 435/69.1; 435/69.7; 435/320.1; 536/23.1; 536/23.7; 530/350; 530/388.4

(58) Field of Classification Search ........................ None
See application file for complete search history.

(56) References Cited

U.S. PATENT DOCUMENTS

| | | | |
|---|---|---|---|
| 4,454,121 A | 6/1984 | Beachey |
| 5,098,827 A | 3/1992 | Boyle et al. |
| 5,354,846 A | 10/1994 | Kehoe |
| 5,378,620 A | 1/1995 | Adams et al. |
| 5,391,712 A | 2/1995 | Adams et al. |
| 5,445,820 A | 8/1995 | Seidel et al. |
| 5,585,098 A | 12/1996 | Coleman |
| 5,700,648 A | 12/1997 | Kehoe |
| 5,821,088 A | 10/1998 | Darzins et al. |
| 5,846,547 A | 12/1998 | Cleary |
| 5,968,763 A | 10/1999 | Fischetti et al. |
| 6,174,528 B1 | 1/2001 | Cooper et al. |
| 6,372,222 B1 | 4/2002 | Michon et al. |
| 6,406,883 B1 | 6/2002 | Lutticken et al. |
| 6,420,152 B1 | 7/2002 | Adams et al. |
| 6,426,074 B1 | 7/2002 | Michel et al. |
| 6,579,711 B1 | 6/2003 | Gaier et al. |
| 6,635,623 B1 | 10/2003 | Hoogeveen et al. |
| 6,669,703 B2 | 12/2003 | Shue |
| 6,737,521 B1 | 5/2004 | Fischetti et al. |
| 6,747,437 B2 | 6/2004 | Chiu |
| 6,777,547 B1 | 8/2004 | Podbielski |
| 6,833,356 B1 | 12/2004 | Koenig et al. |
| 6,936,252 B2 | 8/2005 | Gilbert et al. |
| 7,033,765 B1 | 4/2006 | Dime et al. |
| 7,041,814 B1 | 5/2006 | Weinstock et al. |
| 7,098,182 B2 | 8/2006 | Le Page et al. |
| 7,101,692 B2 | 9/2006 | Schneewind et al. |
| 7,128,918 B1 | 10/2006 | Hamel et al. |
| 7,128,919 B2 | 10/2006 | Adderson et al. |
| 7,169,902 B2 | 1/2007 | Podbielski |
| 7,247,308 B2 | 7/2007 | Martin et al. |
| 7,348,006 B2 | 3/2008 | Contorni et al. |
| 7,407,664 B2 | 8/2008 | Beall et al. |
| 7,438,912 B2 | 10/2008 | Meinke et al. |
| 7,485,710 B2 | 2/2009 | Reinscheid et al. |
| 2002/0025516 A1 | 2/2002 | Black et al. |
| 2002/0045737 A1 | 4/2002 | Choi et al. |
| 2002/0061569 A1 | 5/2002 | Haselbeck et al. |
| 2002/0086023 A1 | 7/2002 | Dale |
| 2003/0035805 A1 | 2/2003 | Michel et al. |
| 2003/0109690 A1 | 6/2003 | Ruben et al. |

(Continued)

FOREIGN PATENT DOCUMENTS

EP    0369825    5/1990
(Continued)

OTHER PUBLICATIONS

Borovec et al. J Virol. Jun. 1993; 67(6): 3095-3102.*
Areschoug et al. Infection and Immunity, Dec. 1999, p. 6350-6357.*
Bork P. Genome Research 2000 10:398-400.*
Bowie et al (Science, 1990, 257:1306-1310).*
Lazar et al. (Molecular and Cellular Biology, 1988, 8:1247-1252).*
Brodeur et al. Infection and Immunity, Oct. 2000.*
Areschoug et al. Infection and Immunity, Dec. 1999.*
Larsson et al. Vaccine, 1999, 17:454-458.*
Ellis, R.W. (Chapter 29 of "Vaccines" [Plotkin, S.A. et al. (eds) published by W. B. Saunders company (Philadelphia) in 1988.*
Burgess et al (J. of Cell Bio. 111:2129-2138, 1990).*

(Continued)

*Primary Examiner* — Robert Mondesi
*Assistant Examiner* — Oluwatosin Ogunbiyi
(74) *Attorney, Agent, or Firm* — Banner & Witcoff, Ltd.

(57) ABSTRACT

The invention provides proteins from group B *streptococcus* (*Streptococcus agalactiae*) and group A *streptococcus* (*Streptococcus pyogenes*), including amino acid sequences and the corresponding nucleotide sequences. Data are given to show that the proteins are useful antigens for vaccines, immunogenic compositions, and/or diagnostics. The proteins are also targets for antibiotics.

40 Claims, 95 Drawing Sheets

U.S. PATENT DOCUMENTS

| | | |
|---|---|---|
| 2003/0157122 A1 | 8/2003 | Dale |
| 2003/0171337 A1 | 9/2003 | Aylward et al. |
| 2004/0029129 A1 | 2/2004 | Wang et al. |
| 2004/0101536 A1 | 5/2004 | Teti et al. |
| 2004/0219639 A1 | 11/2004 | Potter et al. |
| 2004/0236072 A1 | 11/2004 | Olmsted et al. |
| 2005/0019345 A1 | 1/2005 | Podbielski |
| 2005/0020813 A1 | 1/2005 | Masignani et al. |
| 2005/0181388 A1 | 8/2005 | Edwards et al. |
| 2005/0214918 A1 | 9/2005 | Edwards et al. |
| 2005/0288866 A1 | 12/2005 | Sachdeva et al. |
| 2006/0039922 A1 | 2/2006 | Mizzen et al. |
| 2006/0041961 A1 | 2/2006 | Abad et al. |
| 2006/0073530 A1 | 4/2006 | Schneewind et al. |
| 2006/0115479 A1 | 6/2006 | Reinscheid et al. |
| 2006/0160121 A1 | 7/2006 | Mounts et al. |
| 2006/0165716 A1 | 7/2006 | Telford et al. |
| 2006/0194751 A1 | 8/2006 | Meinke et al. |
| 2006/0210579 A1 | 9/2006 | Telford et al. |
| 2006/0210580 A1 | 9/2006 | Telford et al. |
| 2006/0210581 A1 | 9/2006 | Telford et al. |
| 2006/0210582 A1 | 9/2006 | Telford et al. |
| 2006/0258849 A1 | 11/2006 | Telford et al. |
| 2006/0269541 A1 | 11/2006 | Meinke et al. |
| 2006/0275315 A1 | 12/2006 | Telford et al. |
| 2007/0036828 A1 | 2/2007 | Rappuoli et al. |
| 2007/0053924 A1 | 3/2007 | Tettelin et al. |
| 2007/0065464 A1 | 3/2007 | Grandi et al. |
| 2007/0098737 A1 | 5/2007 | Dale |
| 2007/0116712 A1 | 5/2007 | Hamel et al. |
| 2007/0128210 A1 | 6/2007 | Olmsted et al. |
| 2007/0128211 A1 | 6/2007 | Olmsted et al. |
| 2007/0128229 A1 | 6/2007 | Olmsted et al. |
| 2007/0141635 A1 | 6/2007 | James |
| 2008/0038268 A1 | 2/2008 | Martin et al. |
| 2008/0220010 A1 | 9/2008 | Telford et al. |
| 2009/0022753 A1 | 1/2009 | Olmsted et al. |

FOREIGN PATENT DOCUMENTS

| | | |
|---|---|---|
| EP | 0613947 | 1/1994 |
| EP | 555438 | 1/1997 |
| EP | 555439 | 10/1997 |
| EP | 1770171 | 4/2007 |
| GB | 2233977 | 1/1991 |
| WO | WO9305155 | 3/1993 |
| WO | WO9305156 | 3/1993 |
| WO | WO 98 01561 | 1/1998 |
| WO | WO9818931 | 5/1998 |
| WO | WO9818931 A2 * | 5/1998 |
| WO | WO9819689 | 5/1998 |
| WO | WO 98 23631 | 6/1998 |
| WO | WO9803677 | 8/1998 |
| WO | WO9913084 | 3/1999 |
| WO | WO 99 16882 | 4/1999 |
| WO | WO9926969 | 6/1999 |
| WO | WO9942588 | 8/1999 |
| WO | WO9954457 | 10/1999 |
| WO | WO0006736 | 2/2000 |
| WO | WO0006737 | 2/2000 |
| WO | WO0023456 | 4/2000 |
| WO | WO0078787 | 12/2000 |
| WO | WO 01 32882 | 5/2001 |
| WO | WO 0212294 | 2/2002 |
| WO | WO02075507 | 9/2002 |
| WO | WO02077183 | 10/2002 |
| WO | WO 02/092818 | 11/2002 |
| WO | WO03068813 | 8/2003 |
| WO | WO03087353 | 10/2003 |
| WO | WO03093306 | 11/2003 |
| WO | WO 03093306 | 11/2003 |
| WO | WO 2004/018646 | 3/2004 |
| WO | WO2004041157 | 5/2004 |
| WO | WO2004078907 | 9/2004 |
| WO | WO 2004/099242 | 11/2004 |
| WO | WO2005013666 | 2/2005 |
| WO | WO 2004/035618 | 3/2005 |
| WO | WO2005028618 | 3/2005 |
| WO | WO2005032582 | 4/2005 |
| WO | PCT/US2005/10954 | 7/2005 |
| WO | WO 2005076010 | 8/2005 |
| WO | WO2005108419 | 11/2005 |
| WO | WO2006035311 | 4/2006 |
| WO | WO2006042027 | 4/2006 |
| WO | WO2006069200 | 6/2006 |
| WO | WO2006078318 | 7/2006 |
| WO | WO2006082527 | 8/2006 |
| WO | WO2006082530 | 8/2006 |
| WO | WO2006130328 | 12/2006 |
| WO | WO2007018563 | 2/2007 |
| WO | WO2007039319 | 4/2007 |
| WO | WO2007052168 | 5/2007 |
| WO | WO2008020335 | 2/2008 |
| WO | WO2008108830 | 9/2008 |
| WO | WO2008003515 | 10/2008 |

OTHER PUBLICATIONS

Abbas et al. Cellular and Molecular Immunolgoy. 2000 Chapter 15 p. 360-362.*

Invitrogen product catalog 1997—Primers for First-strand cDNA synthesis -Under CDNA synthesis and Libraries Chapter.*

Segura et al FEMS Immunology and Medical Microbiology 21:189-195 (1998).*

New England Biolabs Catalog, 1996/1997 p. 111—Random primers.*

Sequence alignment result—8 pages.*

Lindahl et al. Clinical and Microbiology Reviews, Jan. 2005, p. 102-107.*

Chapter 29 p. 568-575 of "Vaccines" [Plotkin, S.A. et al. (eds) published by W. B. Saunders company (Philadelphia) in 1988.*

Abbas et al. Cellular and Molecular Immunology 4th edition, 2000 Chapter 15 p. 360-362).*

Collins et al. PNAS vol. 92, p. 8306-8040, 1995.*

Blackburn et al. Nature Structural Biology vol. 7 p. 847-849.*

Greenspan et al Nature Biotechnology 7:936-937, 1999.*

Molling et al. J Mol. Med 91997) 75: 242-246.*

Tighe et al. Immunology Today vol. 19, p. 89-97.*

Dittmer et al Current Opinion in Microbiology vol. 6 Oct. 2003 p. 472-477.*

Greenspan et al. (Nature Biotechnology 7: 936-937, 1999).*

Harlow et al , Antibodies A Laboratory Manual, Cold Spring Harbor Laboratory Press Inc., 1988, pp. 23-25, 27-33.*

Colman et al. Research in Immunology 145: 33-36, 1994, p. 33 col. 2, p. 35 col. 1.*

Houghten et al. (New Approaches to Immunization, Vaccines 86, Cold Spring Harbor Laboratory, p. 21-25, 1986).*

Rubens et al. Molecular Microbiology (1993) 8(5), 843-855.*

Grandi, "Genomics and Proteomics in Reverse Vaccines," in *Microbial Proteomics: Functional Biology of Whole Organisms*, Humphery-Smith & Hecker, eds., John Wiley & Sons, chapter 20, 2006.

Lauer et al., "Genome Analysis Reveals Pili in Group B *Streptococcus*," *Science 309*, 105, Jul. 1, 2005.

Maione et al., "Identification of a Universal Group B *Streptococcus* Vaccine by Multiple Genome Screen," *Science 309*, 148-50, Jul. 1, 2005.

Spellerberg et al: "Identification of genetic determinants for the hemolytic activity of *Streptococcus agalactiae* by ISSI transposition"; J. Bacteriol.; vol. 181, No. 10, May 1999; pp. 212-3219.

Ton-That & Schneewind, "Assembly of pili on the surface of *Corynebacterium diphtheriae*," *Mol. Microbiol. 50*, 1429-38, 2003.

Ton-That et al., "Sortases and pilin elements involved in pilus assembly of *Corynebacterium diphtheriae*," *Mol. Microbiol. 53*, 251-61, 2004.

Madoff et al., "Maternal Immunization of Mice with Group B Streptococcal Type III Polysaccharide-Beta C Protein Conjugate Elicits Protective Antibody to Multiple Serotypes," *J. Clin. Invest. 94*, 286-92, Jul. 1994.

Paoletti et al., "Surface Structures of Group B *Streptococcus* Important in Human Immunity," in *Gram-Positive Pathogens*, Frischetti et al., eds., ASM Press, Washington, D.C., 2000, pp. 137-153.

Rodewald et al., "Neonatal Mouse Model of Group B Streptococcal Infection," *J. Infectious Diseases 166*, 635-39, 1992.
Amara et al., "Molecular detection of methionine in rat brain using specific antibodies," Neurosci. Lett. 185, 147-50, Feb. 13, 1995.
Banks et al., "Progress toward characterization of the Group A *Streptococcus metagenome*: Complete genome sequence of a macrolide-resistant serotype M6 strain," *J. Infectious Diseases 190*, 727-38, Aug. 15, 2004.
Barnett & Scott, "Differential recognition of surface proteins in *Streptococcus pyogenes* by two sortase gene homologs," J. Bacteriol. 184, 2181-91, 2002.
Barnett et al., "A Novel Sortase, SrtC2, from *Streptococcus pyogenes* Anchors a Surface Protein Containing a QVPTGV Motif to the Cell Wall," *Journal of Bacteriology*, vol. 186, No. 17, pp. 5865-5875, Sep. 2004.
Beckmann et al., "Identification of Novel Adhesins from Group B *Streptococci* by Use of Phage Display Reveals that C5a Peptidase Mediates Fibronectin Binding," *Inf. Immun. 70*, 2869-76, Jun. 2002.
Bessen et al., "Genomic Localization of a T Serotype Locus to a Recombinatorial Zone Ending Extracellular Matrix-Binding Proteins in *Streptococcus pyogenes*," Infection and Immunity, vol. 70, No. 3, pp. 1159-1167, Mar. 2002.
Chung et al., "Chlorosome protein," NCBI Accession No. 2115394F, Jul. 10, 1992.
Clancy et al., "Cloning and Characterization of a Novel Macrolide Efflux Gene, mreA, from *Streptococcus agalactiae*," Antimicrobial Agents and Chemotherapy 41, 2719-23, 1997.
Dale et al., "New Protective Antigen of Gorup A *Streptococci*," J. Clin. Invest. 103, 1261-68, May 1999.
Dale et al., "Recombinant, octavalent group A streptococcal M protein vaccine," Vaccine 14, 944-48, 1996.
Dale, "Group A Streptococcal Vaccines," Infectious Disease Clinics of North America 13, 227-43, Mar. 1999.
Dale, "Multivalent group A streptococcal vaccine designed to optimize the immunogenicity of six tandem M protein fragments," Vaccine 17, 193-200, 1999.
Database EMBL, Accession No. AAX13129, *Enterococcus faecalis* genome contig SEQ ID No. 192, Mar. 19, 1999.
Database EPO Proteins, EBI Accession No. AX605513, "Sequence 3442 from W00209818," Feb. 17, 2003.
Database Geneseq, "Group B *Streptococcus* protein sequence SEQ ID No. 49," EBI Accession No. GSP:AAY91320, May 30, 2000.
Database Geneseq, "*Streptococcus agalactiae* protein, SEQ ID 2382," EBI Accession No. GSP:ADV81242, Feb. 24, 2005.
Database Geneseq, "Fibrinogen-binding polypeptide, SEQ ID No. 17," EBI Accession No. GSP: ADS93952, Dec. 2, 2004; revised in 2007.
Database Geneseq, EBI Accession No. GSP: ABP30134, "*Streptococcus* polypeptide SEQ ID No. 9444," Jul. 2, 2002.
Database Geneseq, EBI Accession No. GSP: ABP27285, "*Streptococcus* polypeptide SEQ ID No. 3746," Jul. 2, 2002; revised in 2007.
Database Genseq, "Protein encoded by Prokaryotic essential gene #319788," Accession No. ABU46451, Jun. 13, 2003.
Database JPO Proteins, "Nucleic acid and protein originating in group B *Streptococcus*," EBI Accession No. JPOP:BD629260, Jul. 17, 2003.
Database Swissprot[Online] Oct. 1, 2002, accession No. EBI, Database accession No. Q9PGX9, Hypothetical protein XF0167.
Database UniProt [Online] Mar. 1, 2003, "Cell wall surface anchor family protein," retrieved from EBI accession No. UNIPROT: Q8DYR5, Database accession No. Q8DYR5.
Database UniProt [Online], Nov. 22, 2005, "Cell wall surface anchor family protein," retrieved from EBI accession No. UNIPROT: Q3D2D6.
De Boever et al., "*Enterococcus faecalis* conjugative plasmid pAM373. Complete nucleotide sequence and genetic analyses of sec phermone response," Mol. Microbiol. 37, 1327-41, 2000.
Examination Report for NZ 560966, Mar. 4, 2009, 2 pages.
Ferretti et al., "Complete genome sequence of an M1 strain of *Streptococcus pyogenes*," Proc. Natl. Acad. Sci. USA 98, 4658-63, Apr. 10, 2001.

Ferretti et al., "Putative surface exclusion protein," GENBANK Accession No. Q9A1H3, Oct. 31, 2006.
Glaser et al., "Genome sequence of *Streptococcus agalactiae*, a pathogen causing invasive neonatal disease," Mol. Moicrobiol. 45, 1499-1513, 2002.
Grandi & Zagursky, "The impact of genomics in vaccine discovery: achievements and lessons," Expert. Rev. Vaccines 3, 621-23, 2004.
Gutekunst et al., "Analysis of RogB-Controlled Virulence Mechanisms and Gene Expression in *Streptococcus agalactiae*," *Inf. Immun. 71*, 5056-64, Sep. 2003.
Gutierrez et al., "insertional Mutagenesis and Recovery of Interrupted Genes of Streptococcus mutans by Using Transposon Tn917: Preliminary Characterization of Mutants Displaying Acid Sensitivity and Nutritional Requirements," J. Bacteriol. 178, 4166-75, Jul. 1996.
Guzman et al., "Protective immune response against *Streptococcus pyogenes* in mice after intranasal vaccination with the fibronectin-binding protein Sfbl," J. Infectious Disease 179, 901-06, 1999.
Holmes, "PSMA specific antibodies and their diagnostic and therapeutic use," Exp. Opin. Invest. Drugs 10, 511-10, 2001.
Hong, "unnamed protein product [*Streptococcus pyogenes*]," NCBI Accession No. BAB1603, one page, Oct. 3, 2000.
Horvath et al., "Toward the development of a synthetic group a streptococcal vaccine of high purity and broad protective coverage," J Med Chem. Jul. 29, 2004;47(16):4100-4.
Hughs et al., "Identification of Major Outer surface Proteins of *Streptococcus agalactiae*," *Inf. Immun. 70*, 1254-59, Mar. 2002.
International Preliminary Examination Report for PCT/GB01/04789 (published as WO 02/34771) dated Feb. 17, 2003.
International Preliminary Examination Report for PCT/GB2003/001882 (published as WO 03/093306) dated Aug. 18, 2004.
International Preliminary Examination Report for PCT/IB2005/036009 (published as WO 06/042027) dated Apr. 11, 2007.
International Preliminary Examination Report for PCT/US2003/029167 (published as WO 04/041157) dated Mar. 5, 2005.
International Preliminary Examination Report for PCT/US2004/024868 (published as WO 05/032582) dated Feb. 6, 2006.
International Preliminary Examination Report for PCT/US2004/030032 (published as WO 05/028618) dated Mar. 16, 2006.
International Search Report for PCT/GB01/04789 (published as WO 02/34771) dated Aug. 27, 2002.
International Search Report for PCT/GB2003/001882 (published as WO 03/093306) dated Nov. 14, 2002.
International Search Report for PCT/IB2005/036009 (published as WO 06/042027) dated Jun. 20, 2006.
International Search Report for PCT/US05/046491 dated Jun. 26, 2007 (published as WO 2006/069200).
International Search Report for PCT/US2003/029167 (published as WO 04/041157) dated Aug. 2, 2004.
International Search Report for PCT/US2004/024868 (published as WO 05/032582) dated Oct. 28, 2005.
International Search Report for PCT/US2004/030032 (published as WO 05/028618) dated Dec. 6, 2005.
International Search Report for PCT/US2005/027239 (published as WO 06/078318) dated Aug. 25, 2008.
International Search Report for PCT/US2007/022838 (published as WO 08/108830) dated Oct. 9, 2008.
Jobling et al., "Analysis of structure and function of the B subunit of cholera toxin by the use of site-directed mutagenesis," Mol. Microbiol. 5, 1755-67, 1991.
Kalman et al., "Comparative genomes of *Chlamydia pneumoniae* and *C. trachomatis*," Nature Genetics 21, 385-89, Apr. 1999.
Kehoe et al., "Nucleotide Sequence of the Streptolysin 0 (SLO) Gene: Structural Homologies between SLO and Other Membrane-Damaging, Thiol-Activated Toxins," Inf. Immun. 55, 3228-32, Dec. 1987.
Koch et al., "Complexity and expression patterns of the desmosomal adherins," Proc. Natl. Acad. Sci. USA 89, 353-57, Jan. 1992.
Kunst et al., "The complete genome sequence of the Gram positive bacterium *Bacillus subtilis*," NCBI Accession No. CAB14964, Nov. 20, 1997.
Lachenauer et al., "A protective surface protein from the Type V Group B Streptococcus shares N-terminal sequence homology with the Alpha C Protein," Inf. Immun. 64, 4255-60, Oct. 1996.

Lei et al., "Identification and immunogenicity of group A streptococcus culture supernatant proteins," Inf. Immunity 68, 6807-18, 2000.

Lewis, "Riddle of Biofilm Resistance," *Antimicrobial Agents and Chemotherapy*, vol. 45, No. 4, pp. 999-1007, Apr. 2001.

McMillan et al., "Identification and assessment of new vaccine candidates for group A streptococcal infections," *Vaccine 22*, 2783-90, 2004.

McMillan et al., "Prospecting for new group A streptococcal vaccine candidates," *Indian J. Med. Res. 119*, 121-25, May 2004.

Meinke et al., "S. pyogenes hyperimmune system reactive antigen Spy0269," EBI Accession No. ADR83896, Dec. 2, 2004; revised Jun. 15, 2007.

Mora et al., "Group A Streptococcus produce pilus-like structures containing protective antigens and Lancefield T antigens," Proc. Natl. Acad. Sci. USA 102, 15641-46, Oct. 25, 2005.

Musser, "The Next Chapter in Reverse Vaccinology," Nat. Biotechnol. 24, 157-58, 2006.

Nakagawa et al., "Genome sequence of an M3 strain of *Streptococcus pyogenes* reveals a large-scale genomic rearrangement in invasive strains and new insights into phage evolution," *Genome Res.* 13, 1042-55, Jun. 2003.

Nakata et al., "MsmR, a specific positive regulator of the *Streptococcus pyogenes* FCT pathogenicity region and cytolysin-mediated translocation system genes," Mol. Microbiol. 57, 786-803, 2005.

Navarre et al., "Surface Proteins of Gram-Positive Bacteria and Mechanisms of Their Targeting to the Cell Wall Envelope," *Microbiology and Molecular Biology Reviews*, vol. 63, No. 1, pp. 174-229, Mar. 1999.

NCBI News, table on p. 4, "Microbial Genomes Available for BLAST Search," Jul. 1998.

Olive et al., "Protection of mice from group A streptococcal infection by intranasal immunization with a peptide vaccine that contains a conserved M protein B cell epitope and lacks a T cell autoepitope," Vaccine 20, 2816-25, 2002.

Orefici et al., "Possible virulence marker for *Streptococcus agalactiae* (Lancefiled Group B)," J. Clin. Microbiol. Infectious Diseases 7, 302-05, 1988.

Paoletti et al., "Neonatal mouse protection against infection with multiple group B streptococcal (GBS) serotypes by maternal immunization with a tetravalent GBS polysaccharide-tetanus toxoid conjugate vaccine," Inf. Immun. 62, 3236-43, 1994.

Pournaras et al., "Pheromone responses and high-level aminoglycoside resistance of conjugative plasmids of *Enterococcus faecalis* from Greece," J. Antimicrobial Chemotherapy 46, 1013-16, 2000.

Proft et al., "Identification and Characterization of Novel Superantigens from *Streptococcus pyogenes*," J. Exp. Med. 189, 89-101, Jan. 4, 1999.

Quinn, "The response of rheumatic and non-rheumatic children to streptolysin O concentrate," J. Clin. Invest. 36, 793-802, Jun. 1957.

Ramachandran et al., "Two Distinct Genotypes of *prtF2*, Encoding a Fibronectin Binding Protein, and Evolution of the Gene Family in *Streptococcus pyogenes*," *Journal of Bacteriology*, vol. 186, No. 22, pp. 7601-7609, Nov. 2004.

Rodriguez-Ortega et al., "Characterization and identification of vaccine candidate proteins through analysis of the group A Streptococcus surface proteome," Nature Biotechnol. 24, 191-97, 2006.

Roitt et al., Structure of Antigens, *Immunology*, 4th ed., Mosby, London, pp. 7.7 and 7.8, 1998.

Rosini et al., "Identification of novel genomic islands coding for antigenic pilus-like structures in *Streptococcus agalactiae*," Mol. Microbiol. 61, 126-41, 2006.

Rudenko et al., "Selection for activation of a new variant surface glycoprotein gene expression site in *Trypanosoma brucei* can result in deletion of the old one," Mol. Biochem. Parisitol. 95, 97-109, 1998; NCBI Accession No. CAD21770.

Rudinger et al., "Characteristics of the amino acids as components of a peptide hormone sequence," in *Peptide Hormones*, Parsons, ed., University Park Press, Jun. 1976, pp. 1-7.

Schneewind et al., "Sequence and Structural Characteristics of the Trypsin-Resistant T6 Surface Protein of Group A Streptococci," *Journal of Bacteriology*, vol. 172, No. 6, pp. 3310-3317, Jun. 1990.

Schneewind, "Structure of the Cell Wall anchor of Surface Proteins in *Staphylococcus aureus*," Science 268, 103-06, Apr. 7, 1995.

Seizen, "Multi-domain, cell envelope proteases of lactic acid bacteria," Antonie von Leeuwenhoek 76, 139-55, 1999.

Smoot et al., "Genome sequence and comparative microarray analysis of serotype M18 group A Streptococcus strains associated with acute rheumatic fever outbreaks," *Proc. Natl. Acad. Sci. USA 99*, 4668-73, Apr. 2, 2002.

Stephenson et al., "The Fap1 fimbrial adhesin is a glycoprotein: antibodies specific for the glycan moiety block the adhesion of *Streptococcus parasanguis* in an in vitro tooth model," *Mol. Microbiol.* 43, 147-57, 2002.

Su et al., "Identification of a Xenopus cDNA that prevents mitotic catastrophe in the fission yeast *Schizosaccharomyces pombe*," Gene 145, 155-56, 1994.

Supplementary Search report for EP 03799822 (corresponding to WO 04/041157) dated Jan. 21, 2008.

Surovov & Ferretti, "Physical and Genetic Chromosomal Map of an M Type 1 Strain of *Streptococcus pyogenes*," J. Bacteriol. 178, 5546-49, Sep. 1996.

Takami et al., "Two component sensor histidine kinase involved in phosphate regulation," NCBI Accession No. NP_244022.1, Sep. 10, 2001.

Telford et al., Sequence 7466 from WO 02/34771, EBI Accession No. CQ650509, Feb. 2, 2004; modified May 31, 2006.

Telford et al., "Streptococcus polypeptide SEQ ID No. 9188" of WO 02/34771, EBI Accession No. ABP300006, Jul. 2, 2002; revised Jun. 15, 1007.

Tettelin et al., "Complete genome sequence of a virulent isolate of *Streptococcus pneumoniae*," Science 293, 498-506, 2001.

Tettelin et al., Database EMBL, Accession No. AE014193, *Streptococcus agalactiae* 2603V/R section 3 of 100 of the complete genome, Sep. 2, 2002.

Tettelin et al., Swiss-Prot Accession No. Q3DV91 for *Streptococcus agalactiae* strain 18R21, Nov. 22, 2005.

Todd, "Antigenic Streptococcal Hemolysin," J. Exp. Med. 55, 267-80, 1932.

UniProt Accession No. A7CNQ7, Jul. 5, 2004.

UniProt Accession No. Q5XEL1, Nov. 23, 2004.

UniProt Accession No. Q8P318, Oct. 1, 2002.

Vallet et al., "The chaperone/usher pathways of *Pseudomonas aeruginosa*: Identification of fimbrial gene clusters (cup) and their involvement in biofilm formation," *PNAS*, vol. 98, No. 12, pp. 6911-6916, Jun. 2001.

Wang et al., "Protein encoded by prokaryotic essential gene #31978," EBI Accession No. ABU46451, Jun. 19, 2003; revised Jun. 15, 2007.

Watnick et al., "Steps in the development of a *Vibrio cholerae* EI Tor biofilm," *Molecular Microbiology*, vol. 34, No. 3, pp. 586-595, 1999.

Wessels et al., "Stimulation of protective antibodies against type 1a and 1b group B streptococci by a type 1a polysaccharide-tetanus toxoid conjugate vaccine," Inf. Immun. 61, 4760-66, 1993.

Woodson et al., "Analysis of a ribose transport operon from *Bacillus subtilis*," Microbiology 140, 1829-38, 1994.

Zhong et al., "Hypothetical protein of *Arabidpsis thaliana*," NCBI Accession No. AAD29767, May 11, 1999.

Simpson et al: "Xy lella fastidiosa 9a5c, section 136 of 229 of the complete genome"; Database Accession No. AE003990, Jul. 18 2000.

Black et al: "*Streptococcus oneumoniae* polypeptide coding region"; Database Accession No. AAV42990, Nov. 9, 1998.

Meehan et al: "Sequence 1 from Patent WO 98 01561"; DATABASE Accession No. A68631, May 6, 1999.

Michel et al: "Cloned alpha and beta C-protein antigens of group B Streptococci elicit protective immunity"; Infection and Immunity; vol. 59, No. 6, Jun. 1991; pp. 2023-2028.

Stalhammar-Carlemalm et al: "The R28 Protein of *Streptococcus pyogenes* is related to several group B streptococcal surface proteins, confer protective immunity and promotes binding to human epithelial cells"; Molecular Microbiol.; vol. 33, No. 1, Jul. 1999, pp. 208-219.

Le Page et al: "Sequence 217 of Patent WO 01 32882"; Database Accession No. AX134653, May 29, 2001.

Ferretti et al: "*Streptococcus pyogenes* M1 GAS strain SF370, section 87 oF 167 of the complete genome" Database Accession No. AE006558, Apr. 16, 2001.

Pritzlaff et al: "*Streptococcus agalactiae* cyl gene cluster, partial sequence", Database Accession No. AF157015, Jul. 28, 1999.

Spellerberg et al: "*Streptococcus agalactiae* cyl gene cluster, complete sequence", Database Accession No. AF093787, May 25, 1999.

Duez et al: "*Enterococcus hirae* mraR, pbp3s, mraY, murD, murG, ftsQ and ftsA genes, mraW, yllC and ftsZ partial genes"; Database Accession No. Y13922, Jun. 25, 1997.

Guitierez et al: "*Streptococcus mutans* ProX (pouABC) gene, partial cds; YlxM (ylxM) gene, complete cds; Ffh (ffh) gene, complete cds, alternatively spliced; SatC (satC) and SatD (satD) gene, complete cds; and SatE (satE) gene, partical cds"; Database Accession No. U88582, Feb. 27, 1997.

Pucci et al: "*Enterococcus faecalis* strain A24836 cell wall/cell division gene cluster, yllB, yllc, yllD, pbpC, mraY, murD, murG, divIB, ftsA and fitsZ genes, complete cds"; Database Accession No. U94707, Jun. 4, 1997.

\* cited by examiner

FIGURE 87
FIGURE 87A
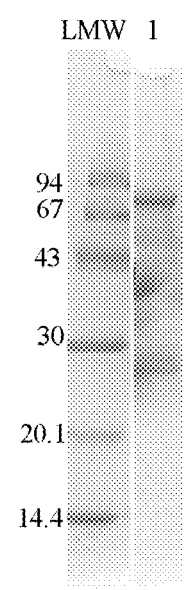
FIGURE 87B
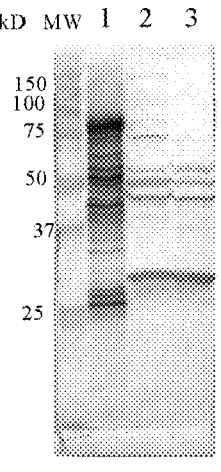
FIGURE 88
FIGURE 88A
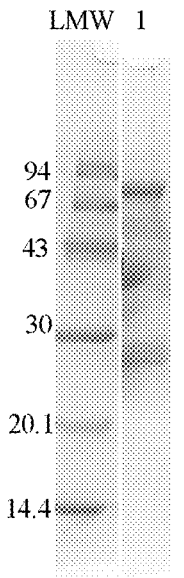
FIGURE 88B
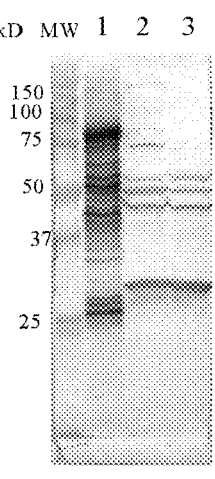

FIGURE 89
FIGURE 89A
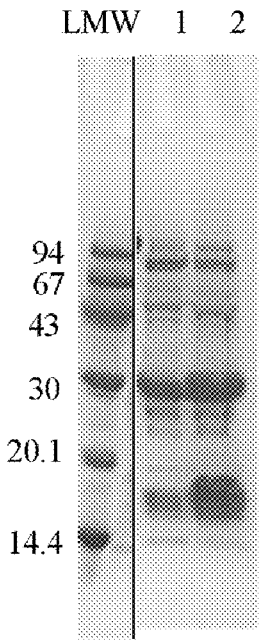
FIGURE 89B
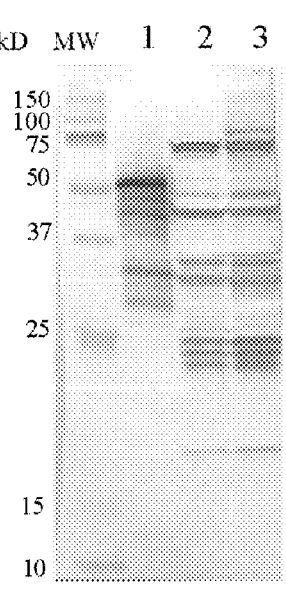

FIGURE 90
FIGURE 90A
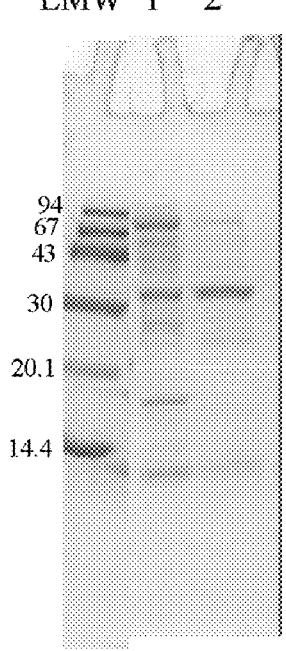
FIGURE 90B
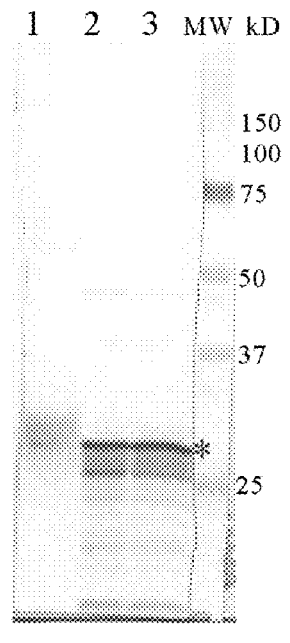
FIGURE 90C
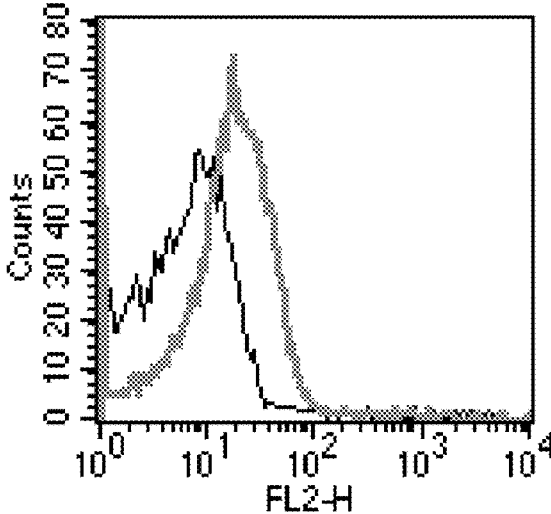

FIGURE 91
FIGURE 91A
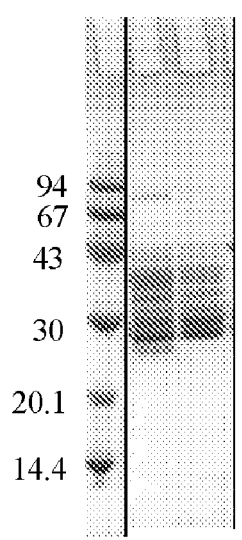
FIGURE 91B
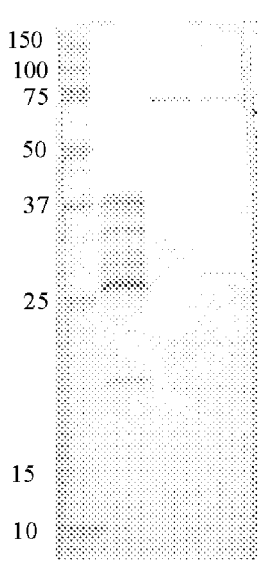
FIGURE 91C
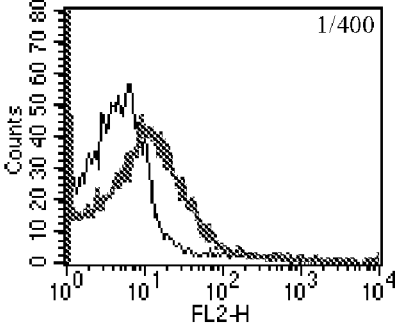

FIGURE 92
FIGURE 92A
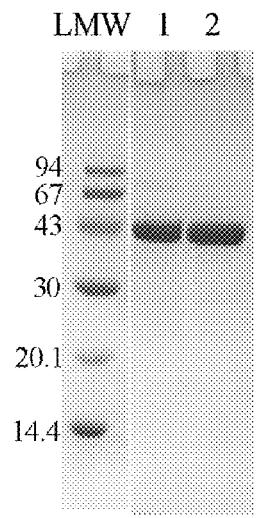
FIGURE 92B
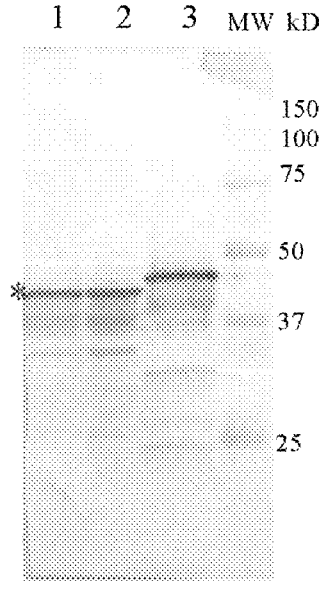
FIGURE 92C
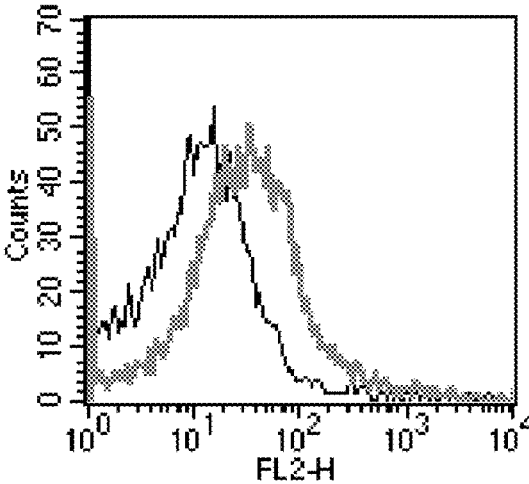

FIGURE 93
FIGURE 93A
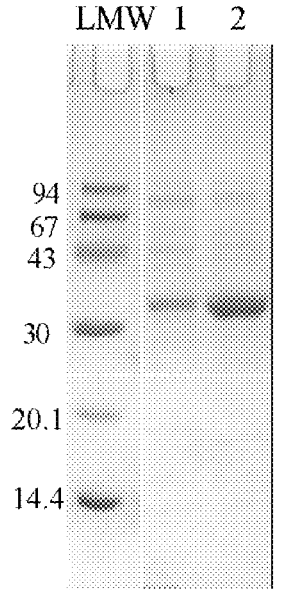
FIGURE 93B
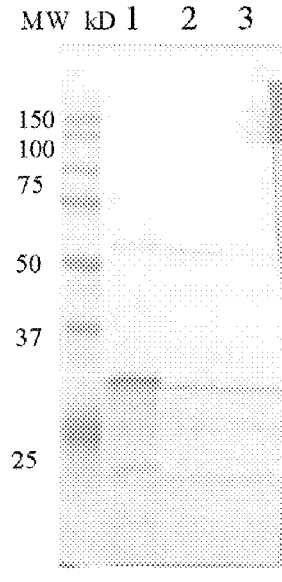
FIGURE 93C
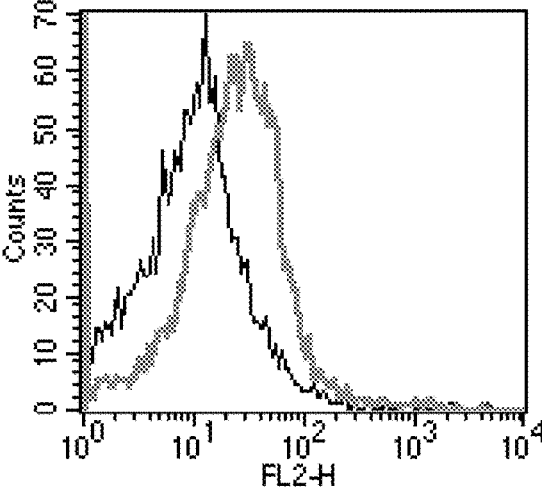

FIGURE 94
FIGURE 94A
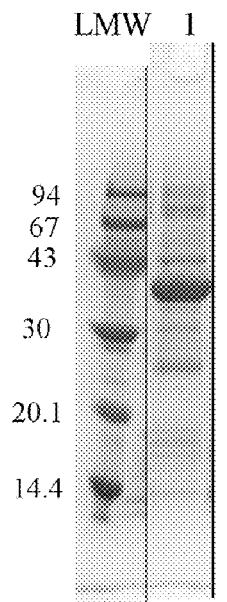
FIGURE 94B
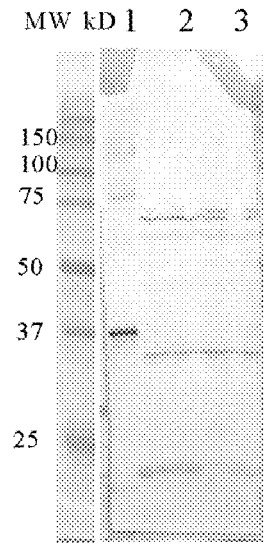
FIGURE 94C
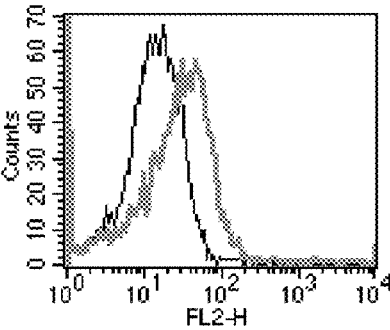

FIGURE 95
FIGURE 95A
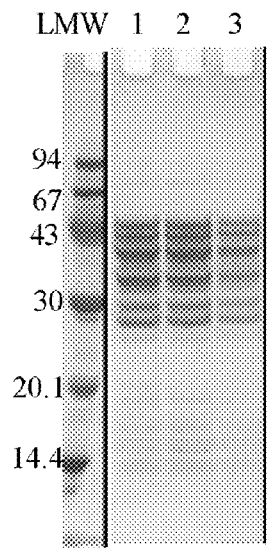
FIGURE 95B
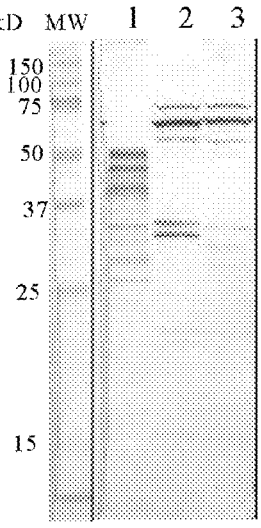
FIGURE 95C
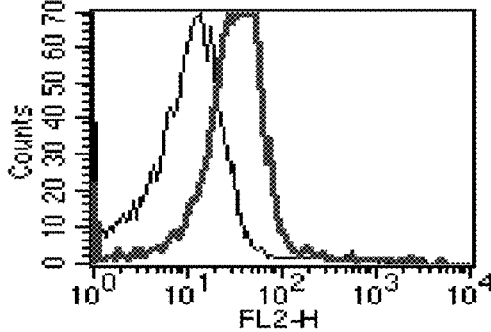

FIGURE 96
FIGURE 96A
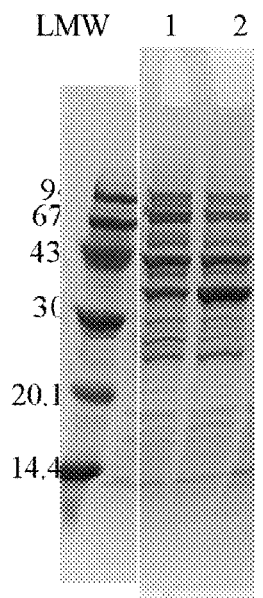
FIGURE 96B
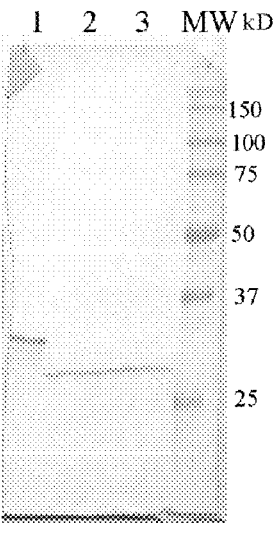
FIGURE 96C
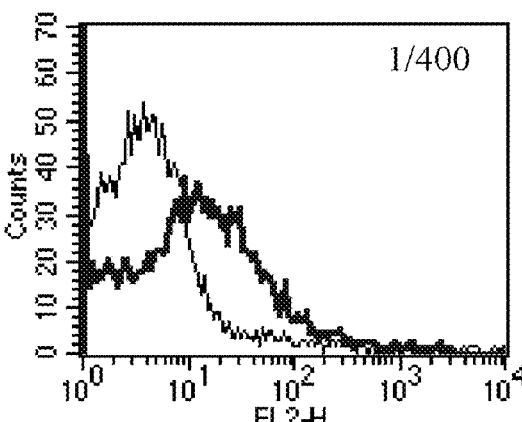

FIGURE 97
FIGURE 97A
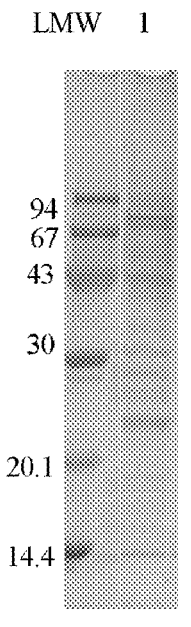
FIGURE 97B
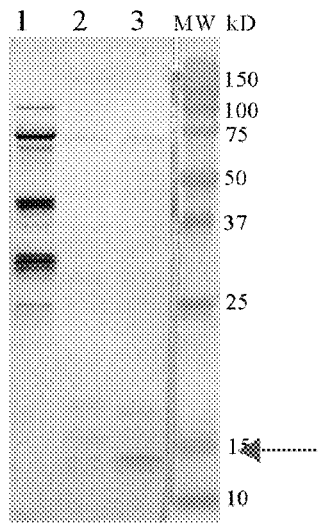
FIGURE 97C
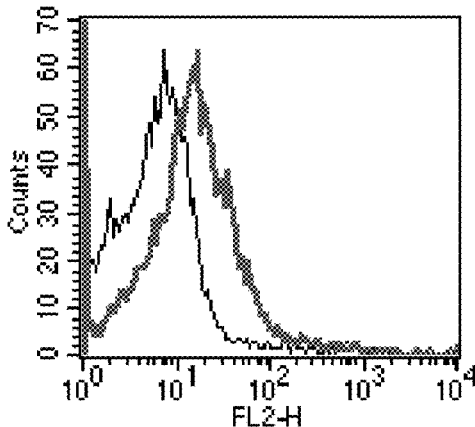

FIGURE 98
FIGURE 98A
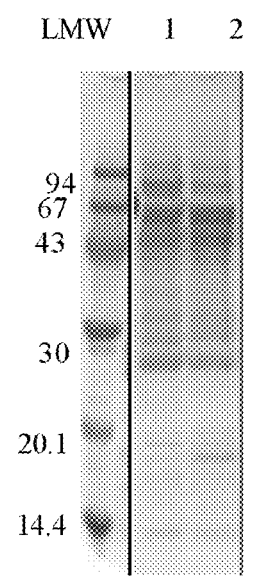
FIGURE 98B
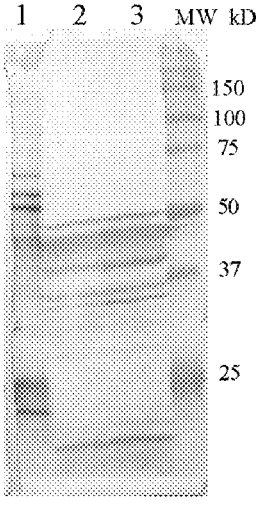
FIGURE 98C
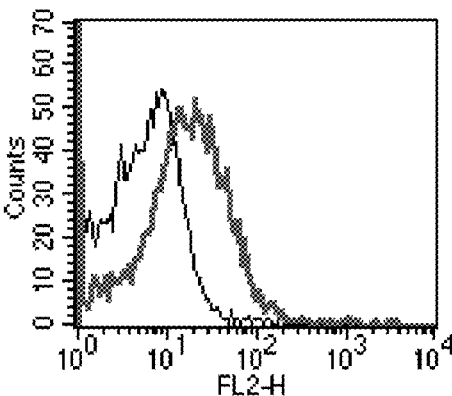

FIGURE 99
FIGURE 99A
FIGURE 99B
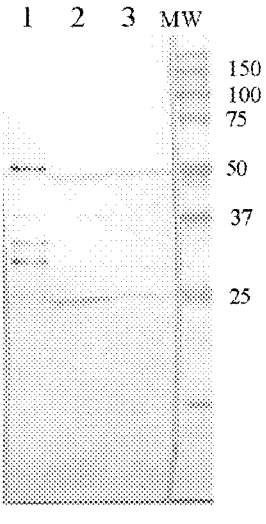
FIGURE 99C
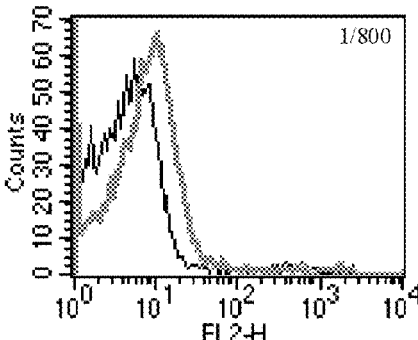

FIGURE 100
FIGURE 100A
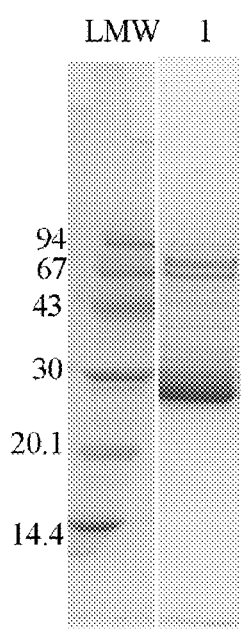
FIGURE 100B
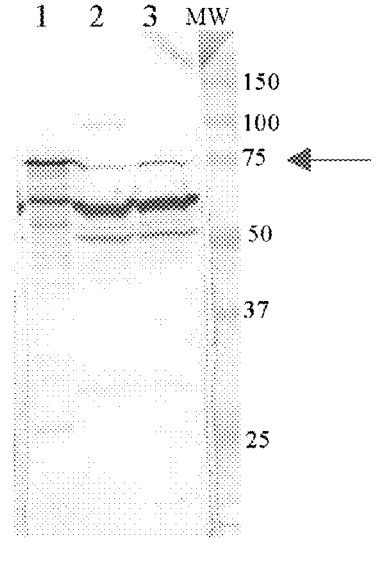
FIGURE 100C
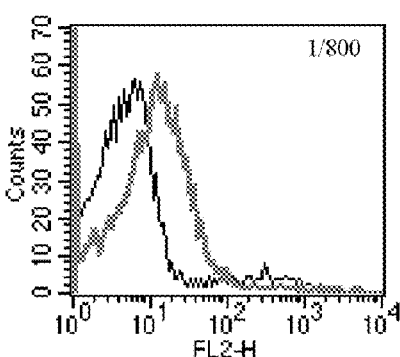

FIGURE 101
FIGURE 101A
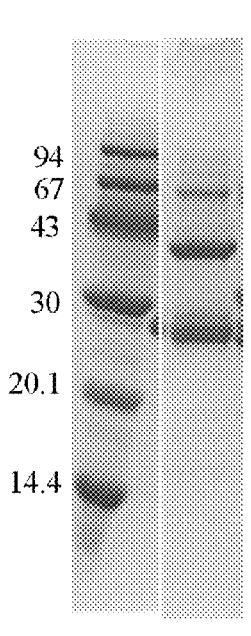
FIGURE 101B
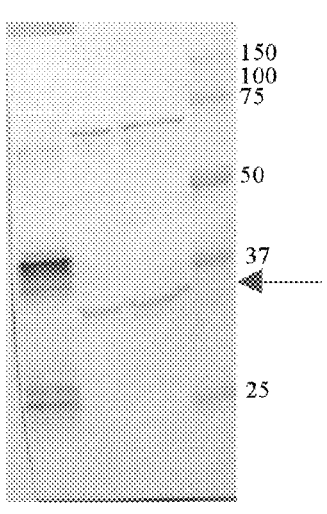
FIGURE 101C
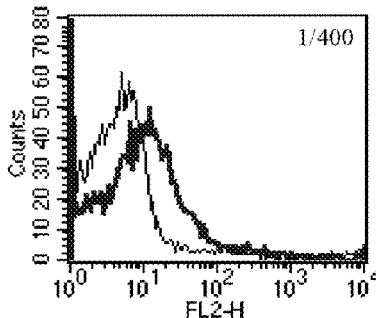

FIGURE 102
FIGURE 102A
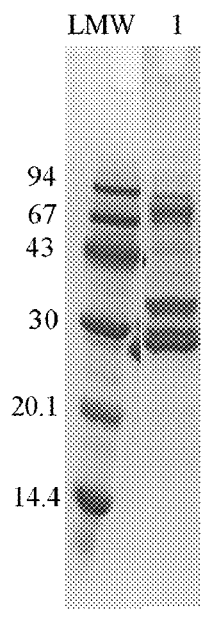
FIGURE 102B
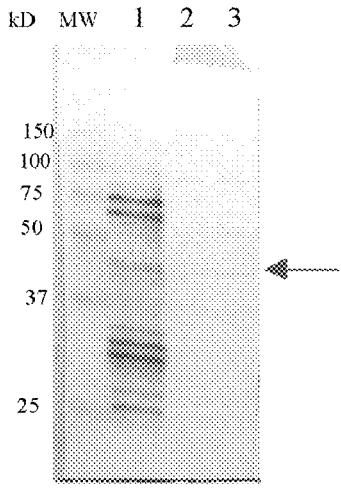
FIGURE 103
FIGURE 103A
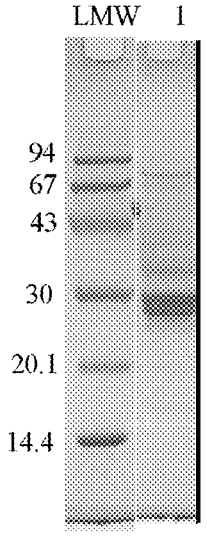
FIGURE 103B
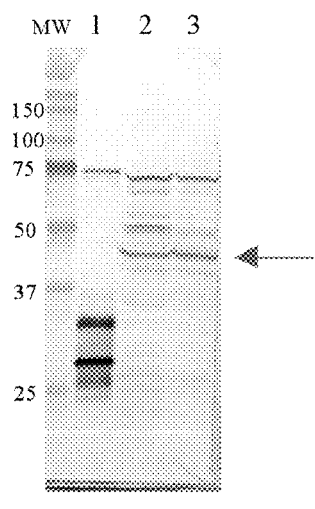

FIGURE 103C
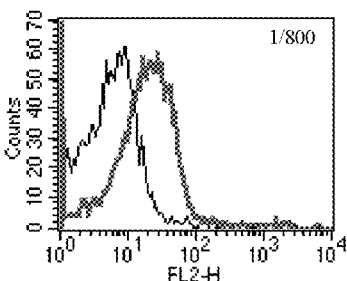
FIGURE 104
FIGURE 104A
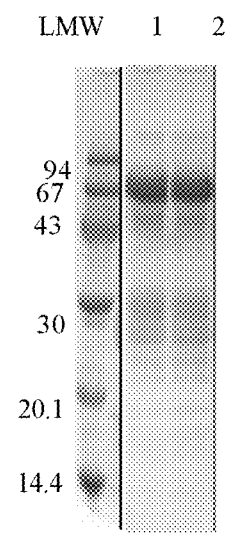
FIGURE 104B
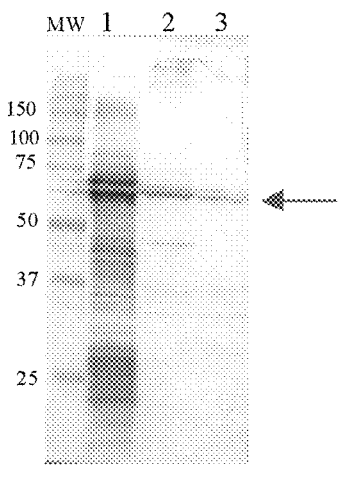
FIGURE 104C
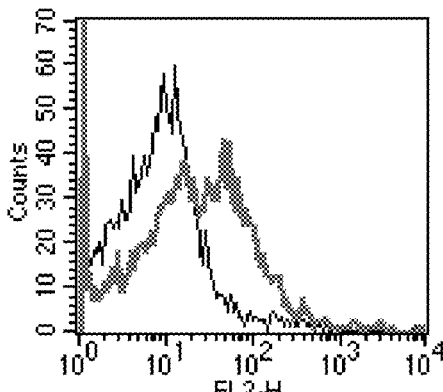

FIGURE 105
FIGURE 105A
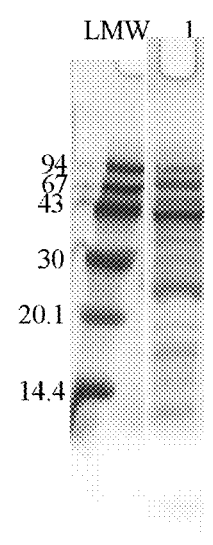
FIGURE 105B
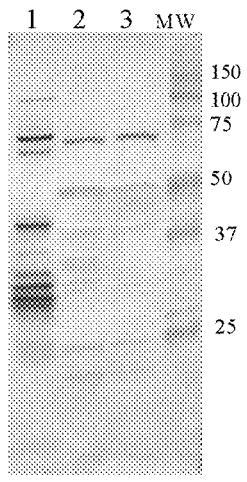
FIGURE 105C
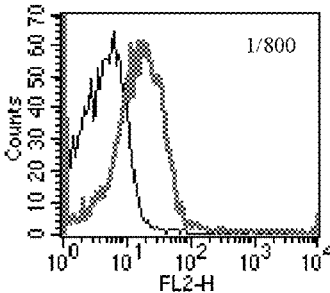

FIGURE 106
FIGURE 106A
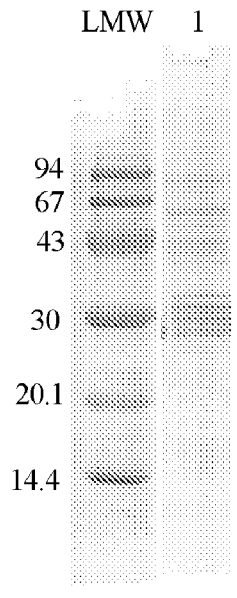
FIGURE 106B
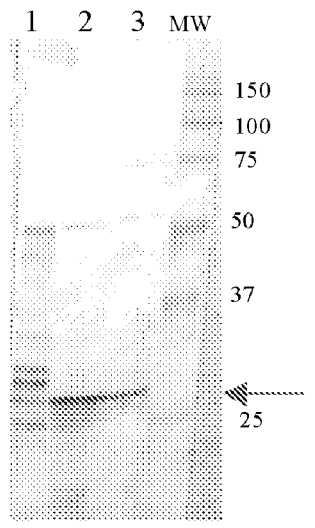
FIGURE 106C
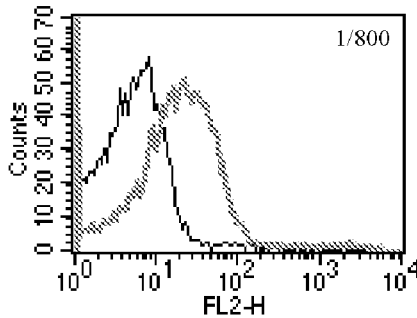

FIGURE 107
FIGURE 107A
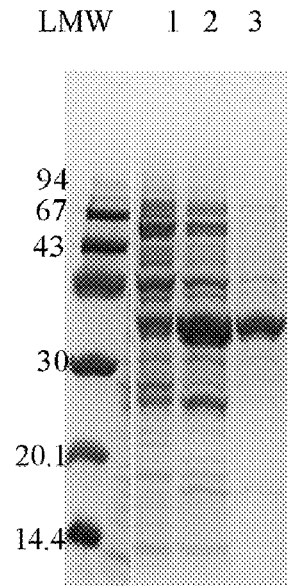
FIGURE 107B
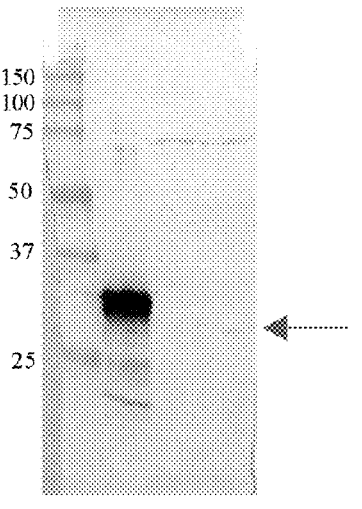
FIGURE 107C
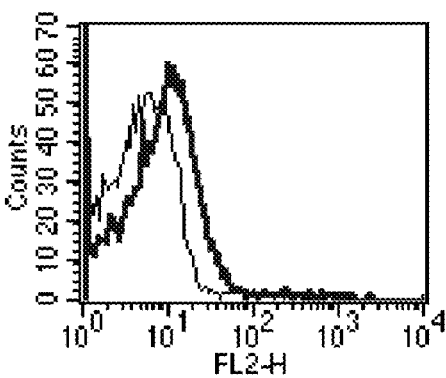

FIGURE 108
FIGURE 108A
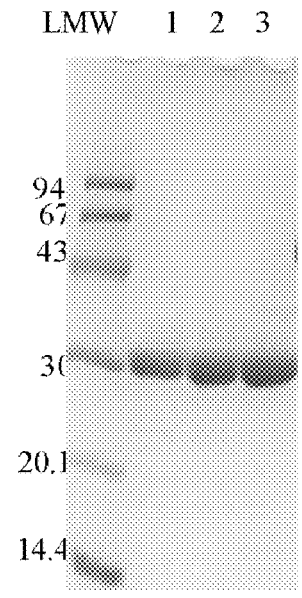
FIGURE 108B
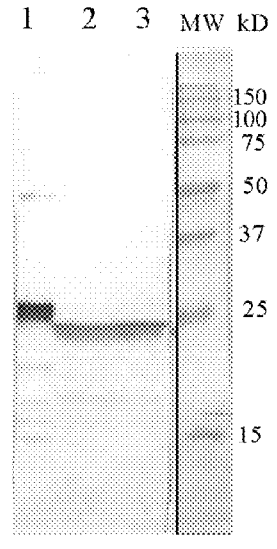
FIGURE 108C
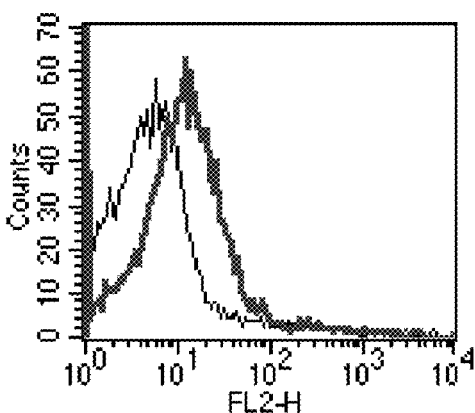

FIGURE 109
FIGURE 109A
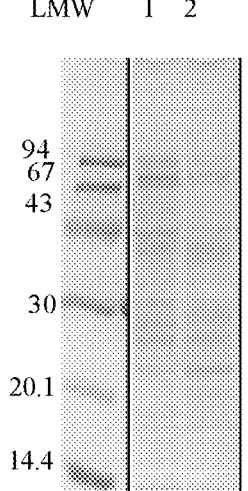
FIGURE 109B
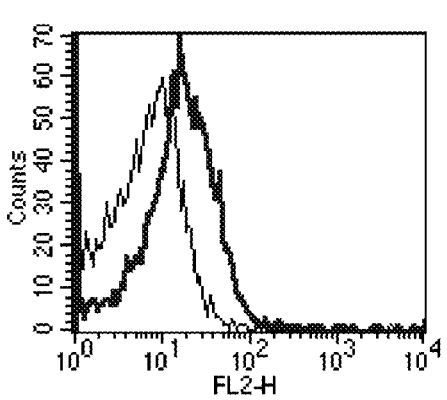
FIGURE 110
FIGURE 110A
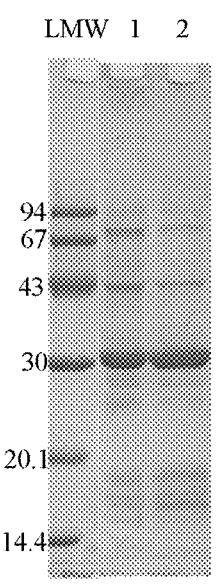
FIGURE 110B
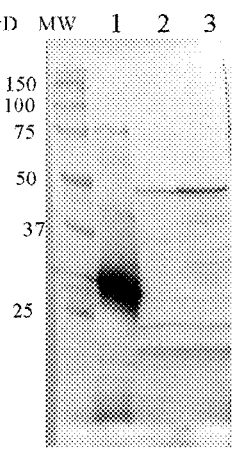

FIGURE 112
FIGURE 112A
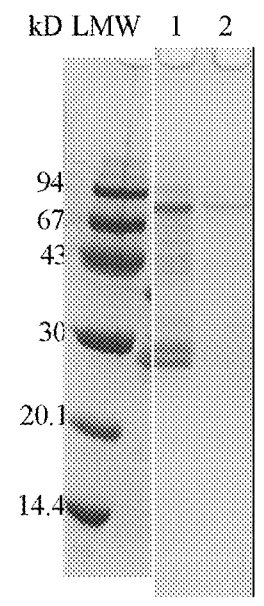
FIGURE 112B
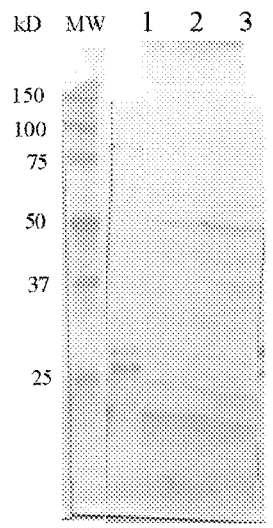
FIGURE 114
FIGURE 114A
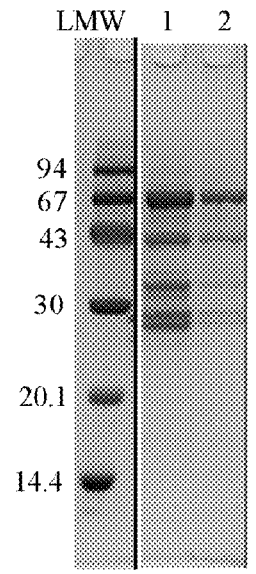
FIGURE 114B
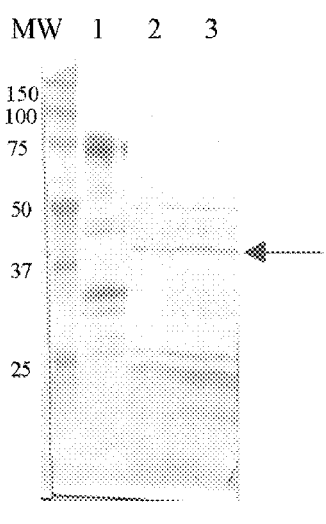

FIGURE 115
FIGURE 115A
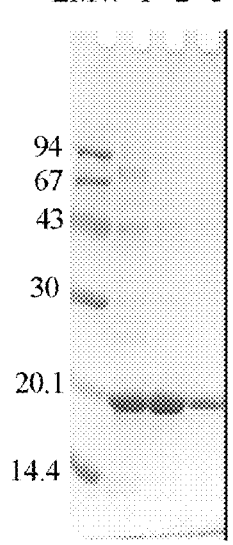
FIGURE 115B
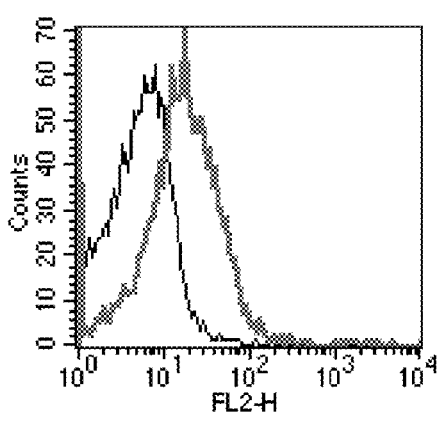
FIGURE 116
FIGURE 116A
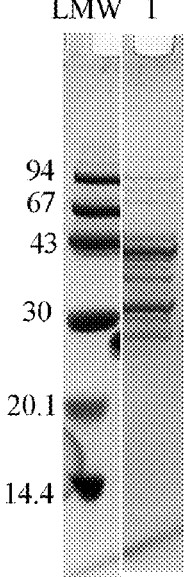

FIGURE 117
FIGURE 117A
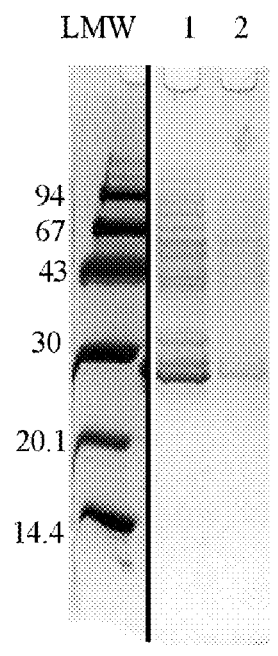
FIGURE 117B
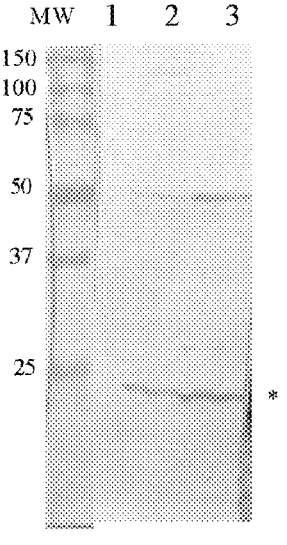
FIGURE 117C
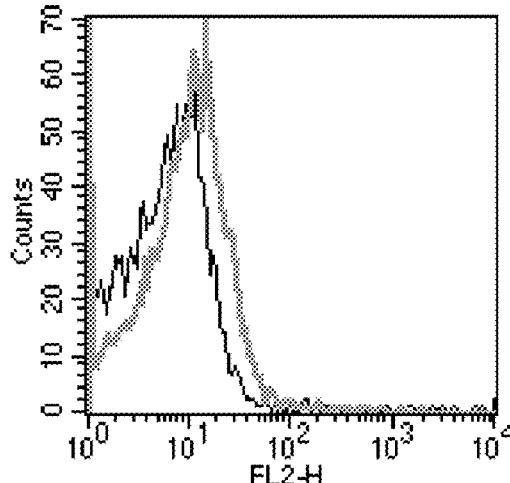

FIGURE 248
FIGURE 248A
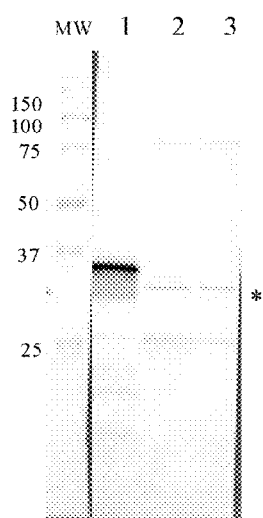
FIGURE 248B
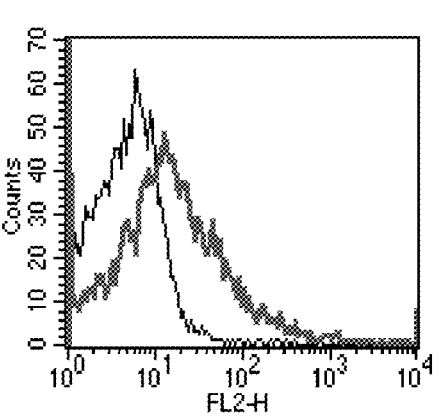
FIGURE 249
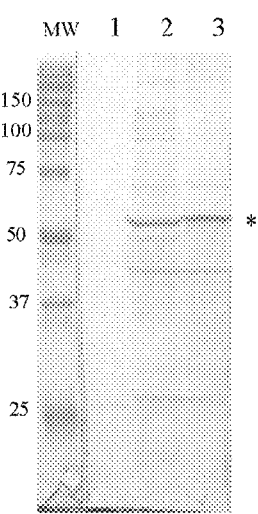
FIGURE 250
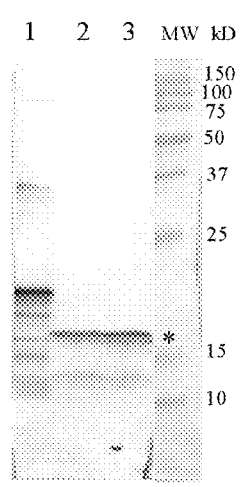
FIGURE 251
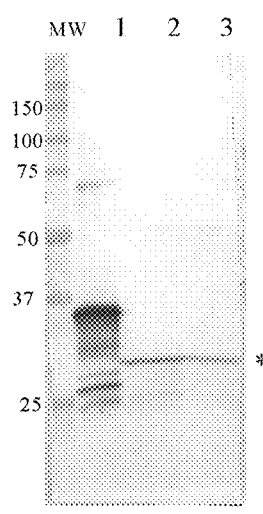

FIGURE 252
FIGURE 252A
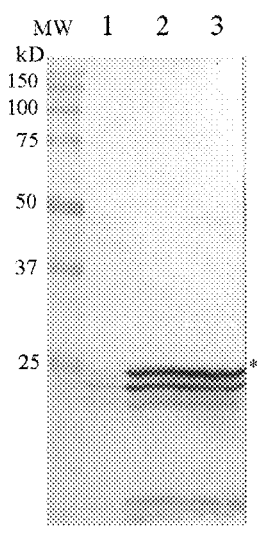
FIGURE 252B
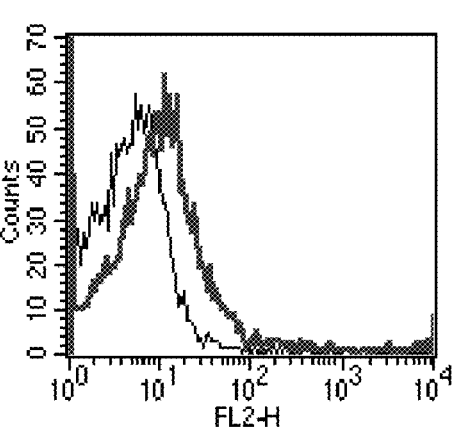
FIGURE 253
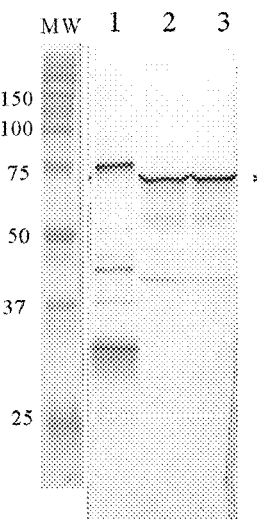

FIGURE 254
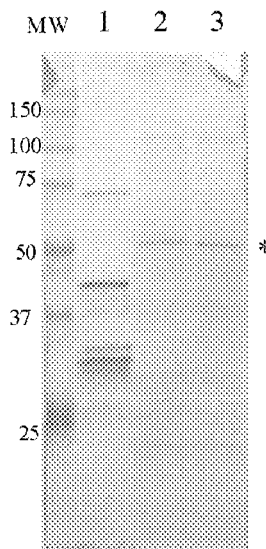
FIGURE 255
FIGURE 255A
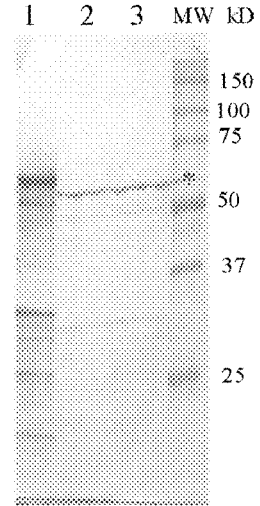
FIGURE 255B
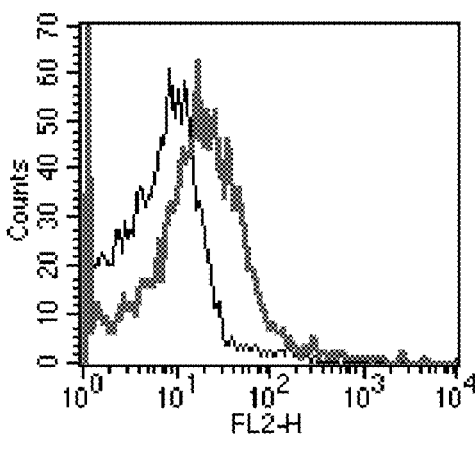

FIGURE 256
FIGURE 256A
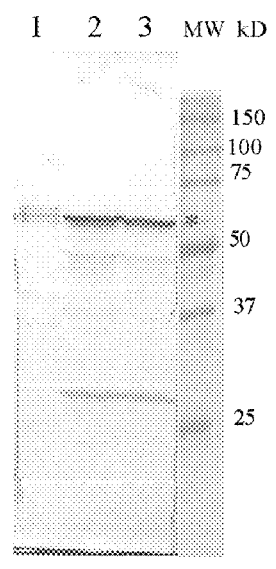
FIGURE 256B
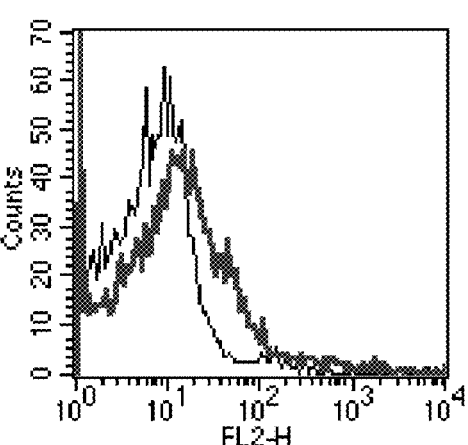
FIGURE 257
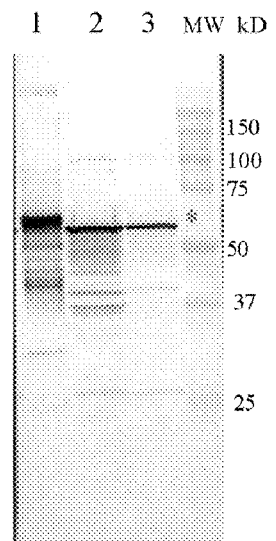
FIGURE 258
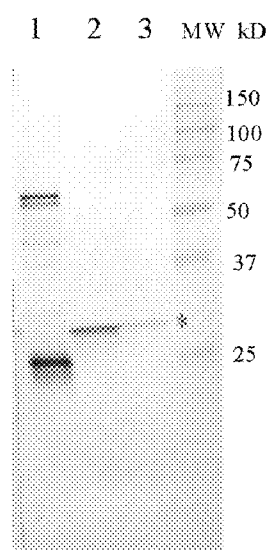

NUCLEIC ACIDS AND PROTEINS FROM *STREPTOCOCCUS* GROUPS A & B

CROSS REFERENCE TO RELATED APPLICATIONS

This application is a National Stage application of co-pending PCT application PCT/GB01/04789 filed Oct. 29, 2001, which was published in English under PCT Article 21(2) on May 2, 2002, which claims the benefit of Great Britain applications Serial No. GB0026333.5 filed Oct. 27, 2000, Serial No. GB0028727.6 filed Nov. 24, 2000, and Serial No. GB0105640.7 filed Mar. 7, 2001. These applications are incorporated herein by reference in their entireties.

REFERENCE TO A "SEQUENCE LISTING"

This application incorporates by reference a 21.0 MB text file created on Nov. 27, 2009 and labeled "10415182_sequence_listing.txt," which is the listing for this application.

All documents cited herein are incorporated by reference in their entirety.

TECHNICAL FIELD

This invention relates to nucleic acid and proteins from the bacteria *Streptococcus agalactiae* (GBS) and *Streptococcus pyogenes* (GAS).

BACKGROUND ART

Once thought to infect only cows, the Gram-positive bacterium *Streptococcus agalactiae* (or "group B *streptococcus*", abbreviated to "GBS") is now known to cause serious disease, bacteremia and meningitis, in immunocompromised individuals and in neonates. There are two types of neonatal infection. The first (early onset, usually within 5 days of birth) is manifested by bacteremia and pneumonia. It is contracted vertically as a baby passes through the birth canal. GBS colonises the vagina of about 25% of young women, and approximately 1% of infants born via a vaginal birth to colonised mothers will become infected. Mortality is between 50-70%. The second is a meningitis that occurs 10 to 60 days after birth. If pregnant women are vaccinated with type III capsule so that the infants are passively immunised, the incidence of the late onset meningitis is reduced but is not entirely eliminated.

The "B" in "GBS" refers to the Lancefield classification, which is based on the antigenicity of a carbohydrate which is soluble in dilute acid and called the C carbohydrate. Lancefield identified 13 types of C carbohydrate, designated A to O, that could be serologically differentiated. The organisms that most commonly infect humans are found in groups A, B, D, and G. Within group B, strains can be divided into 8 serotypes (Ia, Ib, Ia/c, II, III, IV, V, and VI) based on the structure of their polysaccharide capsule.

Group A *streptococcus* ("GAS", *S. pyogenes*) is a frequent human pathogen, estimated to be present in between 5-15% of normal individuals without signs of disease. When host defenses are compromised, or when the organism is able to exert its virulence, or when it is introduced to vulnerable tissues or hosts, however, an acute infection occurs. Diseases include puerperal fever, scarlet fever, erysipelas, pharyngitis, impetigo, necrotising fasciitis, myositis and streptococcal toxic shock syndrome.

*S. pyogenes* is typically treated using antibiotics. Although *S. agalactiae* is inhibited by antibiotics, however, it is not killed by penicillin as easily as GAS. Prophylactic vaccination is thus preferable.

Current GBS vaccines are based on polysaccharide antigens, although these suffer from poor immunogenicity. Anti-idiotypic approaches have also been used (e.g. WO99/54457). There remains a need, however, for effective adult vaccines against *S. agalactiae* infection. There also remains a need for vaccines against *S. pyogenes* infection.

It is an object of the invention to provide proteins which can be used in the development of such vaccines. The proteins may also be useful for diagnostic purposes, and as targets for antibiotics.

DISCLOSURE OF THE INVENTION

The invention provides proteins comprising the *S. agalactiae* amino acid sequences disclosed in the examples, and proteins comprising the *S. pyogenes* amino acid sequences disclosed in the examples. These amino acid sequences are the even SEQ IDs between 1 and 10960.

It also provides proteins comprising amino acid sequences having sequence identity to the *S. agalactiae* amino acid sequences disclosed in the examples, and proteins comprising amino acid sequences having sequence identity to the *S. pyogenes* amino acid sequences disclosed in the examples. Depending on the particular sequence, the degree of sequence identity is preferably greater than 50% (e.g. 60%, 70%, 80%, 90%, 95%, 99% or more). These proteins include homologs, orthologs, allelic variants and functional mutants. Typically, 50% identity or more between two proteins is considered to be an indication of functional equivalence. Identity between proteins is preferably determined by the Smith-Waterman homology search algorithm as implemented in the MPSRCH program (Oxford Molecular), using an affine gap search with parameters gap open penalty=12 and gap extension penalty=1.

Preferred proteins of the invention are GBS1 to GBS689 (see Table IV).

The invention further provides proteins comprising fragments of the *S. agalactiae* amino acid sequences disclosed in the examples, and proteins comprising fragments of the *S. pyogenes* amino acid sequences disclosed in the examples. The fragments should comprise at least n consecutive amino acids from the sequences and, depending on the particular sequence, n is 7 or more (e.g. 8, 10, 12, 14, 16, 18, 20, 30, 40, 50, 60, 70, 80, 90, 100 or more). Preferably the fragments comprise one or more epitopes from the sequence. Other preferred fragments are (a) the N-terminal signal peptides of the proteins disclosed in the examples, (b) the proteins disclosed in the examples, but without their N-terminal signal peptides, (c) fragments common to the related GAS and GBS proteins disclosed in the examples, and (d) the proteins disclosed in the examples, but without their N-terminal amino acid residue.

The proteins of the invention can, of course, be prepared by various means (e.g. recombinant expression, purification from GAS or GBS, chemical synthesis etc.) and in various forms (e.g. native, fusions, glycosylated, non-glycosylated etc.). They are preferably prepared in substantially pure form (i.e. substantially free from other streptococcal or host cell proteins) or substantially isolated form. Proteins of the invention are preferably streptococcal proteins.

According to a further aspect, the invention provides antibodies which bind to these proteins. These may be polyclonal or monoclonal and may be produced by any suitable means (e.g. by recombinant expression). To increase compatibility with the human immune system, the antibodies may be chimeric or humanised (e.g. Breedveld (2000) *Lancet* 355(9205):735-740; Gorman & Clark (1990) *Semin. Immunol.* 2:457-466), or fully human antibodies may be used. The antibodies may include a detectable label (e.g. for diagnostic assays).

According to a further aspect, the invention provides nucleic acid comprising the *S. agalactiae* nucleotide sequences disclosed in the examples, and nucleic acid comprising the *S. pyogenes* nucleotide sequences disclosed in the examples. These nucleic acid sequences are the odd SEQ IDs between 1 and 10966.

In addition, the invention provides nucleic acid comprising nucleotide sequences having sequence identity to the *S. agalactiae* nucleotide sequences disclosed in the examples, and nucleic acid comprising nucleotide sequences having sequence identity to the *S. pyogenes* nucleotide sequences disclosed in the examples. Identity between sequences is preferably determined by the Smith-Waterman homology search algorithm as described above.

Furthermore, the invention provides nucleic acid which can hybridise to the *S. agalactiae* nucleic acid disclosed in the examples, and nucleic acid which can hybridise to the *S. pyogenes* nucleic acid disclosed in the examples preferably under 'high stringency' conditions (e.g. 65° C. in 0.1×SSC, 0.5% SDS solution).

Nucleic acid comprising fragments of these sequences are also provided. These should comprise at least n consecutive nucleotides from the *S. agalactiae* or *S. pyogenes* sequences and, depending on the particular sequence, n is 10 or more (e.g. 12, 14, 15, 18, 20, 25, 30, 35, 40, 50, 60, 70, 80, 90, 100, 150, 200 or more). The fragments may comprise sequences which are common to the related GAS and GBS sequences disclosed in the examples.

According to a further aspect, the invention provides nucleic acid encoding the proteins and protein fragments of the invention.

The invention also provides: nucleic acid comprising nucleotide sequence SEQ ID 10967; nucleic acid comprising nucleotide sequences having sequence identity to SEQ ID 10967; nucleic acid which can hybridise to SEQ ID 10967 (preferably under 'high stringency' conditions); nucleic acid comprising a fragment of at least n consecutive nucleotides from SEQ ID 10967, wherein n is 10 or more e.g. 12, 14, 15, 18, 20, 25, 30, 35, 40, 50, 60, 70, 80, 90, 100, 150, 200, 250, 300, 350, 400, 450, 500, 600, 700, 800, 900, 1000, 1500, 2000, 3000, 4000, 5000, 10000, 100000, 1000000 or more Nucleic acids of the invention can be used in hybridisation reactions (e.g. Northern or Southern blots, or in nucleic acid microarrays or 'gene chips') and amplification reactions (e.g. PCR, SDA, SSSR, LCR, TMA, NASBA etc.) and other nucleic acid techniques.

It should also be appreciated that the invention provides nucleic acid comprising sequences complementary to those described above (e.g. for antisense or probing, or for use as primers).

Nucleic acid according to the invention can, of course, be prepared in many ways (e.g. by chemical synthesis, from genomic or cDNA libraries, from the organism itself etc.) and can take various forms (e.g. single stranded, double stranded, vectors, primers, probes, labelled etc.). The nucleic acid is preferably in substantially isolated form.

Nucleic acid according to the invention may be labelled e.g. with a radioactive or fluorescent label. This is particularly useful where the nucleic acid is to be used in nucleic acid detection techniques e.g. where the nucleic acid is a primer or as a probe for use in techniques such as PCR, LCR, TMA, NASBA etc.

In addition, the term "nucleic acid" includes DNA and RNA, and also their analogues, such as those containing modified backbones, and also peptide nucleic acids (PNA) etc.

According to a further aspect, the invention provides vectors comprising nucleotide sequences of the invention (e.g. cloning or expression vectors) and host cells transformed with such vectors.

According to a further aspect, the invention provides compositions comprising protein, antibody, and/or nucleic acid according to the invention. These compositions may be suitable as immunogenic compositions, for instance, or as diagnostic reagents, or as vaccines.

The invention also provides nucleic acid, protein, or antibody according to the invention for use as medicaments (e.g. as immunogenic compositions or as vaccines) or as diagnostic reagents. It also provides the use of nucleic acid, protein, or antibody according to the invention in the manufacture of: (i) a medicament for treating or preventing disease and/or infection caused by *streptococcus*; (ii) a diagnostic reagent for detecting the presence of *streptococcus* or of antibodies raised against *streptococcus*; and/or (iii) a reagent which can raise antibodies against *streptococcus*. Said *streptococcus* may be any species, group or strain, but is preferably *S. agalactiae*, especially serotype III or V, or *S. pyogenes*. Said disease may be bacteremia, meningitis, puerperal fever, scarlet fever, erysipelas, pharyngitis, impetigo, necrotising fasciitis, myositis or toxic shock syndrome.

The invention also provides a method of treating a patient, comprising administering to the patient a therapeutically effective amount of nucleic acid, protein, and/or antibody of the invention. The patient may either be at risk from the disease themselves or may be a pregnant woman ('maternal immunisation' e.g. Glezen & Alpers (1999) *Clin. Infect. Dis.* 28:219-224).

Administration of protein antigens is a preferred method of treatment for inducing immunity.

Administration of antibodies of the invention is another preferred method of treatment. This method of passive immunisation is particularly useful for newborn children or for pregnant women. This method will typically use monoclonal antibodies, which will be humanised or fully human.

The invention also provides a kit comprising primers (e.g. PCR primers) for amplifying a template sequence contained within a *Streptococcus* (e.g. *S. pyogenes* or *S. agalactiae*) nucleic acid sequence, the kit comprising a first primer and a second primer, wherein the first primer is substantially complementary to said template sequence and the second primer is substantially complementary to a complement of said template sequence, wherein the parts of said primers which have substantial complementarity define the termini of the template sequence to be amplified. The first primer and/or the second primer may include a detectable label (e.g. a fluorescent label).

The invention also provides a kit comprising first and second single-stranded oligonucleotides which allow amplification of a *Streptococcus* template nucleic acid sequence contained in a single- or double-stranded nucleic acid (or mixture thereof), wherein: (a) the first oligonucleotide comprises a primer sequence which is substantially complementary to said template nucleic acid sequence; (b) the second oligonucleotide comprises a primer sequence which is substantially complementary to the complement of said template nucleic acid sequence; (c) the first oligonucleotide and/or the second oligonucleotide comprise(s) sequence which is not complementary to said template nucleic acid; and (d) said primer sequences define the termini of the template sequence to be amplified. The non-complementary sequence(s) of feature (c) are preferably upstream of (i.e. 5' to) the primer sequences. One or both of these (c) sequences may comprise a restriction site (e.g. EP-B-0509612) or a promoter sequence (e.g. EP-B-0505012). The first oligonucleotide and/or the second oligonucleotide may include a detectable label (e.g. a fluorescent label).

The template sequence may be any part of a genome sequence (e.g. SEQ ID 10967). For example, it could be a rRNA gene (e.g. Turenne et al. (2000) *J. Clin. Microbiol.* 38:513-520; SEQ IDs 12018-12024 herein) or a protein-coding gene. The template sequence is preferably specific to GBS.

The invention also provides a computer-readable medium (e.g. a floppy disk, a hard disk, a CD-ROM, a DVD etc.) and/or a computer database containing one or more of the sequences in the sequence listing. The medium preferably contains SEQ ID 10967.

The invention also provides a hybrid protein represented by the formula $NH_2$-A-[-X-L-]$_n$-B—COOH, wherein X is a protein of the invention, L is an optional linker amino acid sequence, A is an optional N-terminal amino acid sequence, B is an optional C-terminal amino acid sequence, and n is an integer greater than 1. The value of n is between 2 and x, and the value of x is typically 3, 4, 5, 6, 7, 8, 9 or 10. Preferably n is 2, 3 or 4; it is more preferably 2 or 3; most preferably, n=2. For each n instances, —X— may be the same or different. For each n instances of [-X-L-], linker amino acid sequence -L- may be present or absent. For instance, when n=2 the hybrid may be $NH_2$—$X_1$-$L_1$-$X_2$-$L_2$-COOH, $NH_2$—$X_1$-$X_2$—COOH, $NH_2$—$X_1$-$L_1$-$X_2$—COOH, $NH_2$—$X_1$-$X_2$-$L_2$-COOH, etc. Linker amino acid sequence(s) -L- will typically be short (e.g. 20 or fewer amino acids i.e. 19, 18, 17, 16, 15, 14, 13, 12, 11, 10, 9, 8, 7, 6, 5, 4, 3, 2, 1). Examples include short peptide sequences which facilitate cloning, poly-glycine linkers (i.e. Gly$_n$ where n=2, 3, 4, 5, 6, 7, 8, 9, 10 or more), and histidine tags (i.e. His$_n$ where n=3, 4, 5, 6, 7, 8, 9, 10 or more). Other suitable linker amino acid sequences will be apparent to those skilled in the art. -A- and —B— are optional sequences which will typically be short (e.g. 40 or fewer amino acids i.e. 39, 38, 37, 36, 35, 34, 33, 32, 31, 30, 29, 28, 27, 26, 25, 24, 23, 22, 21, 20, 19, 18, 17, 16, 15, 14, 13, 12, 11, 10, 9, 8, 7, 6, 5, 4, 3, 2, 1). Examples include leader sequences to direct protein trafficking, or short peptide sequences which facilitate cloning or purification (e.g. histidine tags i.e. His$_n$ where n=3, 4, 5, 6, 7, 8, 9, 10 or more). Other suitable N-terminal and C-terminal amino acid sequences will be apparent to those skilled in the art. In some embodiments, each X will be a GBS sequence; in others, mixtures of GAS and GBS will be used.

According to further aspects, the invention provides various processes.

A process for producing proteins of the invention is provided, comprising the step of culturing a host cell of to the invention under conditions which induce protein expression.

A process for producing protein or nucleic acid of the invention is provided, wherein the protein or nucleic acid is synthesised in part or in whole using chemical means.

A process for detecting polynucleotides of the invention is provided, comprising the steps of: (a) contacting a nucleic probe according to the invention with a biological sample under hybridising conditions to form duplexes; and (b) detecting said duplexes.

A process for detecting *Streptococcus* in a biological sample (e.g. blood) is also provided, comprising the step of contacting nucleic acid according to the invention with the biological sample under hybridising conditions. The process may involve nucleic acid amplification (e.g. PCR, SDA, SSSR, LCR, TMA, NASBA etc.) or hybridisation (e.g. microarrays, blots, hybridisation with a probe in solution etc.). PCR detection of *Streptococcus* in clinical samples, in particular *S. pyogenes*, has been reported [see e.g. Louie et al. (2000) *CMAJ* 163:301-309; Louie et al. (1998) *J. Clin. Microbiol.* 36:1769-1771]. Clinical assays based on nucleic acid are described in general in Tang et al. (1997) *Clin. Chem.* 43:2021-2038.

A process for detecting proteins of the invention is provided, comprising the steps of: (a) contacting an antibody of the invention with a biological sample under conditions suitable for the formation of an antibody-antigen complexes; and (b) detecting said complexes.

A process for identifying an amino acid sequence is provided, comprising the step of searching for putative open reading frames or protein-coding regions within a genome sequence of *S. agalactiae*. This will typically involve in silico searching the sequence for an initiation codon and for an in-frame termination codon in the downstream sequence. The region between these initiation and termination codons is a putative protein-coding sequence. Typically, all six possible reading frames will be searched. Suitable software for such analysis includes ORFFINDER (NCBI), GENEMARK [Borodovsky & McIninch (1993) *Computers Chem.* 17:122-133), GLIMMER [Salzberg et al. (1998) *Nucleic Acids Res.* 26:544-548; Salzberg et al. (1999) *Genomics* 59:24-31; Delcher et al. (1999) *Nucleic Acids Res.* 27:4636-4641], or other software which uses Markov models [e.g. Shmatkov et al. (1999) *Bioinformatics* 15:874-876]. The invention also provides a protein comprising the identified amino acid sequence. These proteins can then expressed using conventional techniques.

The invention also provides a process for determining whether a test compound binds to a protein of the invention. If a test compound binds to a protein of the invention and this binding inhibits the life cycle of the GBS bacterium, then the test compound can be used as an antibiotic or as a lead compound for the design of antibiotics. The process will typically comprise the steps of contacting a test compound with a protein of the invention, and determining whether the test compound binds to said protein. Preferred proteins of the invention for use in these processes are enzymes (e.g. tRNA synthetases), membrane transporters and ribosomal proteins. Suitable test compounds include proteins, polypeptides, carbohydrates, lipids, nucleic acids (e.g. DNA, RNA, and modified forms thereof), as well as small organic compounds (e.g. MW between 200 and 2000 Da). The test compounds may be provided individually, but will typically be part of a library (e.g. a combinatorial library). Methods for detecting a binding interaction include NMR, filter-binding assays, gel-retardation assays, displacement assays, surface plasmon resonance, reverse two-hybrid etc. A compound which binds to a protein of the invention can be tested for antibiotic activity by contacting the compound with GBS bacteria and then monitoring for inhibition of growth. The invention also provides a compound identified using these methods.

The invention also provides a composition comprising a protein or the invention and one or more of the following antigens:

a protein antigen from *Helicobacter pylori* such as VacA, CagA, NAP, HopX, HopY [e.g. WO98/04702] and/or urease.

a protein antigen from *N. meningitidis* serogroup B, such as those in WO99/24578, WO99/36544, WO99/57280, WO00/22430, Tettelin et al. (2000) *Science* 287:1809-1815, Pizza et al. (2000) *Science* 287:1816-1820 and WO96/29412, with protein '287' and derivatives being particularly preferred.

an outer-membrane vesicle (OMV) preparation from *N. meningitidis* serogroup B, such as those disclosed in WO01/52885; Bjune et al. (1991) *Lancet* 338(8775): 1093-1096; Fukasawa et al. (1999) *Vaccine* 17:2951-2958; Rosenqvist et al. (1998) *Dev. Biol. Stand.* 92:323-333 etc.

a saccharide antigen from *N. meningitidis* serogroup A, C, W135 and/or Y, such as the oligosaccharide disclosed in Costantino et al. (1992) *Vaccine* 10:691-698 from serogroup C [see also Costantino et al. (1999) *Vaccine* 17:1251-1263].

a saccharide antigen from *Streptococcus pneumoniae* [e.g. Watson (2000) *Pediatr Infect Dis J* 19:331-332; Rubin (2000) *Pediatr Clin North Am* 47:269-285, v; Jedrzejas (2001) *Microbiol Mol Biol Rev* 65:187-207].

an antigen from hepatitis A virus, such as inactivated virus [e.g. Bell (2000) *Pediatr Infect Dis J* 19:1187-1188; Iwarson (1995) *APMIS* 103:321-326].

an antigen from hepatitis B virus, such as the surface and/or core antigens [e.g. Gerlich et al. (1990) *Vaccine* 8 Suppl: S63-68 & 79-80].

an antigen from hepatitis C virus [e.g. Hsu et al. (1999) *Clin Liver Dis* 3:901-915].

an antigen from *Bordetella pertussis*, such as pertussis holotoxin (PT) and filamentous haemagglutinin (FHA) from *B. pertussis*, optionally also in combination with pertactin and/or agglutinogens 2 and 3 [e.g. Gustafsson et al. (1996) *N. Engl. J. Med.* 334:349-355; Rappuoli et al. (1991) *TIBTECH* 9:232-238].

a diphtheria antigen, such as a diphtheria toxoid [e.g. chapter 3 of Vaccines (1988) eds. Plotkin & Mortimer. ISBN 0-7216-1946-0] e.g. the $CRM_{197}$ mutant [e.g. Del Guidice et al. (1998) *Molecular Aspects of Medicine* 19:1-70].

a tetanus antigen, such as a tetanus toxoid [e.g. chapter 4 of Plotkin & Mortimer].

a saccharide antigen from *Haemophilus influenzae* B.

an antigen from *N. gonorrhoeae* [e.g. WO99/24578, WO99/36544, WO99/57280].

an antigen from *Chlamydia pneumoniae* [e.g. PCT/IB01/01445; Kalman et al. (1999) *Nature Genetics* 21:385-389; Read et al. (2000) *Nucleic Acids Res* 28:1397-406; Shirai et al. (2000) *J. Infect. Dis.* 181(Suppl 3):S524-S527; WO99/27105; WO00/27994; WO00/37494].

an antigen from *Chlamydia trachomatis* [e.g. WO99/28475].

an antigen from *Porphyromonas gingivalis* [e.g. Ross et al. (2001) *Vaccine* 19:4135-4142].

polio antigen(s) [e.g. Sutter et al. (2000) *Pediatr Clin North Am* 47:287-308; Zimmerman & Spann (1999) *Am Fam Physician* 59:113-118, 125-126] such as IPV or OPV.

rabies antigen(s) [e.g. Dreesen (1997) *Vaccine* 15 Suppl: S2-6] such as lyophilised inactivated virus [e.g. MMWR Morb Mortal Wkly Rep 1998 Jan. 16; 47(1):12, 19; RabAvert™].

measles, mumps and/or rubella antigens [e.g. chapters 9, 10 & 11 of Plotkin & Mortimer].

influenza antigen(s) [e.g. chapter 19 of Plotkin & Mortimer], such as the haemagglutinin and/or neuramimidase surface proteins.

an antigen from *Moraxella catarrhalis* [e.g. McMichael (2000) *Vaccine* 19 Suppl 1:S101-107].

an antigen from *Staphylococcus aureus* [e.g. Kuroda et al. (2001) *Lancet* 357(9264): 1225-1240; see also pages 1218-1219].

Where a saccharide or carbohydrate antigen is included, it is preferably conjugated to a carrier protein in order to enhance immunogenicity [e.g. Ramsay et al. (2001) *Lancet* 357(9251):195-196; Lindberg (1999) *Vaccine* 17 Suppl 2:S28-36; Conjugate Vaccines (eds. Cruse et al.) ISBN 3805549326, particularly vol. 10:48-114 etc.]. Preferred carrier proteins are bacterial toxins or toxoids, such as diphtheria or tetanus toxoids. The $CRM_{197}$ diphtheria toxoid is particularly preferred. Other suitable carrier proteins include the *N. meningitidis* outer membrane protein [e.g. EP-0372501], synthetic peptides [e.g. EP-0378881, EP-0427347], heat shock proteins [e.g. WO93/17712], pertussis proteins [e.g. WO98/58668; EP-0471177], protein D from *H. influenzae* [e.g. WO00/56360], toxin A or B from *C. difficile* [e.g. WO00/61761], etc. Any suitable conjugation reaction can be used, with any suitable linker where necessary.

Toxic protein antigens may be detoxified where necessary (e.g. detoxification of pertussis toxin by chemical and/or genetic means).

Where a diphtheria antigen is included in the composition it is preferred also to include tetanus antigen and pertussis antigens. Similarly, where a tetanus antigen is included it is preferred also to include diphtheria and pertussis antigens. Similarly, where a pertussis antigen is included it is preferred also to include diphtheria and tetanus antigens.

Antigens are preferably adsorbed to an aluminium salt.

Antigens in the composition will typically be present at a concentration of at least 1 µg/ml each. In general, the concentration of any given antigen will be sufficient to elicit an immune response against that antigen.

The invention also provides compositions comprising two or more proteins of the present invention.

The two or more proteins may comprise GBS sequences or may comprise GAS and GBS sequences.

A summary of standard techniques and procedures which may be employed to perform the invention (e.g. to utilise the disclosed sequences for vaccination or diagnostic purposes) follows. This summary is not a limitation on the invention but, rather, gives examples that may be used, but are not required.

General

The practice of the present invention will employ, unless otherwise indicated, conventional techniques of molecular biology, microbiology, recombinant DNA, and immunology, which are within the skill of the art. Such techniques are explained fully in the literature eg. Sambrook *Molecular Cloning, A Laboratory Manual, Second Edition* (1989); *DNA Cloning, Volumes I and II* (D. N Glover ed. 1985); *Oligonucleotide Synthesis* (M. J. Gait ed, 1984); *Nucleic Acid Hybridization* (B. D. Hames & S. J. Higgins eds. 1984); *Transcription and Translation* (B. D. Hames & S. J. Higgins eds. 1984); *Animal Cell Culture* (R. I. Freshney ed. 1986); *Immobilized Cells and Enzymes* (IRL Press, 1986); B. Perbal, *A Practical Guide to Molecular Cloning* (1984); the *Methods in Enzymology* series (Academic Press, Inc.), especially volumes 154 & 155; *Gene Transfer Vectors for Mammalian Cells* (J. H. Miller and M. P. Calos eds. 1987, Cold Spring Harbor Laboratory); Mayer and Walker, eds. (1987), *Immunochemical Methods in Cell and Molecular Biology* (Academic Press, London); Scopes, (1987) *Protein Purification: Principles and Practice*, Second Edition (Springer-Verlag, N.Y.), and *Handbook of Experimental Immunology*, Volumes I-IV (D. M. Weir and C. C. Blackwell eds 1986).

Standard abbreviations for nucleotides and amino acids are used in this specification.

DEFINITIONS

A composition containing X is "substantially free of" Y when at least 85% by weight of the total X+Y in the composition is X. Preferably, X comprises at least about 90% by weight of the total of X+Y in the composition, more preferably at least about 95% or even 99% by weight.

The term "comprising" means "including" as well as "consisting" e.g. a composition "comprising" X may consist exclusively of X or may include something additional e.g. X+Y.

The term "heterologous" refers to two biological components that are not found together in nature. The components may be host cells, genes, or regulatory regions, such as promoters. Although the heterologous components are not found together in nature, they can function together, as when a promoter heterologous to a gene is operably linked to the gene. Another example is where a *streptococcus* sequence is heterologous to a mouse host cell. A further examples would be two epitopes from the same or different proteins which have been assembled in a single protein in an arrangement not found in nature.

An "origin of replication" is a polynucleotide sequence that initiates and regulates replication of polynucleotides, such as an expression vector. The origin of replication behaves as an autonomous unit of polynucleotide replication within a cell, capable of replication under its own control. An origin of replication may be needed for a vector to replicate in a particular host cell. With certain origins of replication, an expression vector can be reproduced at a high copy number in the presence of the appropriate proteins within the cell. Examples of origins are the autonomously replicating sequences, which are effective in yeast; and the viral T-antigen, effective in COS-7 cells.

A "mutant" sequence is defined as DNA, RNA or amino acid sequence differing from but having sequence identity with the native or disclosed sequence. Depending on the particular sequence, the degree of sequence identity between the native or disclosed sequence and the mutant sequence is preferably greater than 50% (eg. 60%, 70%, 80%, 90%, 95%, 99% or more, calculated using the Smith-Waterman algorithm as described above). As used herein, an "allelic variant" of a nucleic acid molecule, or region, for which nucleic acid sequence is provided herein is a nucleic acid molecule, or region, that occurs essentially at the same locus in the genome of another or second isolate, and that, due to natural variation caused by, for example, mutation or recombination, has a similar but not identical nucleic acid sequence. A coding region allelic variant typically encodes a protein having similar activity to that of the protein encoded by the gene to which it is being compared. An allelic variant can also comprise an alteration in the 5' or 3' untranslated regions of the gene, such as in regulatory control regions (eg. see U.S. Pat. No. 5,753, 235).

Expression Systems

The *streptococcus* nucleotide sequences can be expressed in a variety of different expression systems; for example those used with mammalian cells, baculoviruses, plants, bacteria, and yeast.

i. Mammalian Systems

Mammalian expression systems are known in the art. A mammalian promoter is any DNA sequence capable of binding mammalian RNA polymerase and initiating the downstream (3') transcription of a coding sequence (eg. structural gene) into mRNA. A promoter will have a transcription initiating region, which is usually placed proximal to the 5' end of the coding sequence, and a TATA box, usually located 25-30 base pairs (bp) upstream of the transcription initiation site. The TATA box is thought to direct RNA polymerase II to begin RNA synthesis at the correct site. A mammalian promoter will also contain an upstream promoter element, usually located within 100 to 200 bp upstream of the TATA box. An upstream promoter element determines the rate at which transcription is initiated and can act in either orientation [Sambrook et al. (1989) "Expression of Cloned Genes in Mammalian Cells." In *Molecular Cloning: A Laboratory Manual, 2nd ed]*.

Mammalian viral genes are often highly expressed and have a broad host range; therefore sequences encoding mammalian viral genes provide particularly useful promoter sequences. Examples include the SV40 early promoter, mouse mammary tumor virus LTR promoter, adenovirus major late promoter (Ad MLP), and herpes simplex virus promoter. In addition, sequences derived from non-viral genes, such as the murine metallotheionein gene, also provide useful promoter sequences. Expression may be either constitutive or regulated (inducible), depending on the promoter can be induced with glucocorticoid in hormone-responsive cells.

The presence of an enhancer element (enhancer), combined with the promoter elements described above, will usually increase expression levels. An enhancer is a regulatory DNA sequence that can stimulate transcription up to 1000-fold when linked to homologous or heterologous promoters, with synthesis beginning at the normal RNA start site. Enhancers are also active when they are placed upstream or downstream from the transcription initiation site, in either normal or flipped orientation, or at a distance of more than 1000 nucleotides from the promoter [Maniatis et al. (1987) *Science* 236:1237; Alberts et al. (1989) *Molecular Biology of the Cell,* 2nd ed.]. Enhancer elements derived from viruses may be particularly useful, because they usually have a broader host range. Examples include the SV40 early gene enhancer [Dijkema et al (1985) *EMBO J.* 4:761] and the enhancer/promoters derived from the long terminal repeat (LTR) of the Rous Sarcoma Virus [Gorman et al. (1982b) *Proc. Natl. Acad. Sci.* 79:6777] and from human cytomegalovirus [Boshart et al. (1985) *Cell* 41:521]. Additionally, some enhancers are regulatable and become active only in the presence of an inducer, such as a hormone or metal ion [Sassone-Corsi and Borelli (1986) *Trends Genet.* 2:215; Maniatis et al. (1987) *Science* 236:1237].

A DNA molecule may be expressed intracellularly in mammalian cells. A promoter sequence may be directly linked with the DNA molecule, in which case the first amino acid at the N-terminus of the recombinant protein will always be a methionine, which is encoded by the ATG start codon. If desired, the N-terminus may be cleaved from the protein by in vitro incubation with cyanogen bromide.

Alternatively, foreign proteins can also be secreted from the cell into the growth media by creating chimeric DNA molecules that encode a fusion protein comprised of a leader sequence fragment that provides for secretion of the foreign protein in mammalian cells. Preferably, there are processing sites encoded between the leader fragment and the foreign gene that can be cleaved either in vivo or in vitro. The leader sequence fragment usually encodes a signal peptide comprised of hydrophobic amino acids which direct the secretion of the protein from the cell. The adenovirus triparite leader is an example of a leader sequence that provides for secretion of a foreign protein in mammalian cells.

Usually, transcription termination and polyadenylation sequences recognized by mammalian cells are regulatory regions located 3' to the translation stop codon and thus, together with the promoter elements, flank the coding sequence. The 3' terminus of the mature mRNA is formed by site-specific post-transcriptional cleavage and polyadenylation [Birnstiel et al. (1985) *Cell* 41:349; Proudfoot and Whitelaw (1988) "Termination and 3' end processing of eukaryotic RNA. In *Transcription and splicing* (ed. B. D. Hames and D. M. Glover); Proudfoot (1989) *Trends Biochem. Sci.* 14:105]. These sequences direct the transcription of an mRNA which can be translated into the polypeptide encoded by the DNA. Examples of transcription terminater/polyadenylation signals include those derived from SV40 [Sambrook et al (1989) "Expression of cloned genes in cultured mammalian cells." In *Molecular Cloning: A Laboratory Manual*].

Usually, the above described components, comprising a promoter, polyadenylation signal, and transcription termination sequence are put together into expression constructs. Enhancers, introns with functional splice donor and acceptor sites, and leader sequences may also be included in an expression construct, if desired. Expression constructs are often maintained in a replicon, such as an extrachromosomal element (eg. plasmids) capable of stable maintenance in a host, such as mammalian cells or bacteria. Mammalian replication systems include those derived from animal viruses, which require trans-acting factors to replicate. For example, plasmids containing the replication systems of papovaviruses, such as SV40 [Gluzman (1981) *Cell* 23:175] or polyomavirus, replicate to extremely high copy number in the presence of the appropriate viral T antigen. Additional examples of mammalian replicons include those derived from bovine papillomavirus and Epstein-Barr virus. Additionally, the replicon may have two replication systems, thus allowing it to be maintained, for example, in mammalian cells for expression and in a prokaryotic host for cloning and amplification. Examples of such mammalian-bacteria shuttle vectors include pMT2 [Kaufman et al. (1989) *Mol. Cell. Biol.* 9:946] and pHEBO [Shimizu et al. (1986) *Mol. Cell. Biol.* 6:1074].

The transformation procedure used depends upon the host to be transformed. Methods for introduction of heterologous polynucleotides into mammalian cells are known in the art and include dextran-mediated transfection, calcium phosphate precipitation, polybrene mediated transfection, protoplast fusion, electroporation, encapsulation of the polynucleotide(s) in liposomes, and direct microinjection of the DNA into nuclei.

Mammalian cell lines available as hosts for expression are known in the art and include many immortalized cell lines available from the American Type Culture Collection (ATCC), including but not limited to, Chinese hamster ovary (CHO) cells, HeLa cells, baby hamster kidney (BHK) cells, monkey kidney cells (COS), human hepatocellular carcinoma cells (eg. Hep G2), and a number of other cell lines.

ii. Baculovirus Systems

The polynucleotide encoding the protein can also be inserted into a suitable insect expression vector, and is operably linked to the control elements within that vector. Vector construction employs techniques which are known in the art. Generally, the components of the expression system include a transfer vector, usually a bacterial plasmid, which contains both a fragment of the baculovirus genome, and a convenient restriction site for insertion of the heterologous gene or genes to be expressed; a wild type baculovirus with a sequence homologous to the baculovirus-specific fragment in the transfer vector (this allows for the homologous recombination of the heterologous gene in to the baculovirus genome); and appropriate insect host cells and growth media.

After inserting the DNA sequence encoding the protein into the transfer vector, the vector and the wild type viral genome are transfected into an insect host cell where the vector and viral genome are allowed to recombine. The packaged recombinant virus is expressed and recombinant plaques are identified and purified. Materials and methods for baculovirus/insect cell expression systems are commercially available in kit form from, inter alia, Invitrogen, San Diego Calif. ("MaxBac" kit). These techniques are generally known to those skilled in the art and fully described in Summers and Smith, *Texas Agricultural Experiment Station Bulletin No. 1555* (1987) (hereinafter "Summers and Smith").

Prior to inserting the DNA sequence encoding the protein into the baculovirus genome, the above described components, comprising a promoter, leader (if desired), coding sequence, and transcription termination sequence, are usually assembled into an intermediate transplacement construct (transfer vector). This may contain a single gene and operably linked regulatory elements; multiple genes, each with its owned set of operably linked regulatory elements; or multiple genes, regulated by the same set of regulatory elements. Intermediate transplacement constructs are often maintained in a replicon, such as an extra-chromosomal element (e.g. plasmids) capable of stable maintenance in a host, such as a bacterium. The replicon will have a replication system, thus allowing it to be maintained in a suitable host for cloning and amplification.

Currently, the most commonly used transfer vector for introducing foreign genes into AcNPV is pAc373. Many other vectors, known to those of skill in the art, have also been designed. These include, for example, pVL985 (which alters the polyhedrin start codon from ATG to ATT, and which introduces a BamHI cloning site 32 basepairs downstream from the ATT; see Luckow and Summers, *Virology* (1989) 17:31.

The plasmid usually also contains the polyhedrin polyadenylation signal (Miller et al. (1988) *Ann. Rev. Microbiol.*, 42:177) and a prokaryotic ampicillin-resistance (amp) gene and origin of replication for selection and propagation in *E. coli*.

Baculovirus transfer vectors usually contain a baculovirus promoter. A baculovirus promoter is any DNA sequence capable of binding a baculovirus RNA polymerase and initiating the downstream (5' to 3') transcription of a coding sequence (eg. structural gene) into mRNA. A promoter will have a transcription initiation region which is usually placed proximal to the 5' end of the coding sequence. This transcription initiation region usually includes an RNA polymerase binding site and a transcription initiation site. A baculovirus transfer vector may also have a second domain called an enhancer, which, if present, is usually distal to the structural gene. Expression may be either regulated or constitutive.

Structural genes, abundantly transcribed at late times in a viral infection cycle, provide particularly useful promoter sequences. Examples include sequences derived from the gene encoding the viral polyhedron protein, Friesen et al., (1986) "The Regulation of Baculovirus Gene Expression," in: *The Molecular Biology of Baculoviruses* (ed. Walter Doerfler); EPO Publ. Nos. 127 839 and 155 476; and the gene encoding the p10 protein, Vlak et al., (1988), *J. Gen. Virol.* 69:765.

DNA encoding suitable signal sequences can be derived from genes for secreted insect or baculovirus proteins, such as the baculovirus polyhedrin gene (Carbonell et al. (1988) *Gene*, 73:409). Alternatively, since the signals for mammalian cell posttranslational modifications (such as signal peptide cleavage, proteolytic cleavage, and phosphorylation) appear to be recognized by insect cells, and the signals required for secretion and nuclear accumulation also appear to be conserved between the invertebrate cells and vertebrate cells, leaders of non-insect origin, such as those derived from genes encoding human α-interferon, Maeda et al., (1985), *Nature* 315:592; human gastrin-releasing peptide, Lebacq-Verheyden et al., (1988), *Molec. Cell. Biol.* 8:3129; human IL-2, Smith et al., (1985) *Proc. Nat'l Acad. Sci. USA,* 82:8404; mouse IL-3, (Miyajima et al., (1987) *Gene* 58:273; and human glucocerebrosidase, Martin et al. (1988) *DNA,* 7:99, can also be used to provide for secretion in insects.

A recombinant polypeptide or polyprotein may be expressed intracellularly or, if it is expressed with the proper regulatory sequences, it can be secreted. Good intracellular expression of nonfused foreign proteins usually requires heterologous genes that ideally have a short leader sequence containing suitable translation initiation signals preceding an ATG start signal. If desired, methionine at the N-terminus may be cleaved from the mature protein by in vitro incubation with cyanogen bromide.

Alternatively, recombinant polyproteins or proteins which are not naturally secreted can be secreted from the insect cell by creating chimeric DNA molecules that encode a fusion protein comprised of a leader sequence fragment that provides for secretion of the foreign protein in insects. The leader sequence fragment usually encodes a signal peptide comprised of hydrophobic amino acids which direct the translocation of the protein into the endoplasmic reticulum.

After insertion of the DNA sequence and/or the gene encoding the expression product precursor of the protein, an insect cell host is co-transformed with the heterologous DNA of the transfer vector and the genomic DNA of wild type baculovirus—usually by co-transfection. The promoter and transcription termination sequence of the construct will usually comprise a 2-5 kb section of the baculovirus genome. Methods for introducing heterologous DNA into the desired site in the baculovirus virus are known in the art. (See Summers and Smith supra; Ju et al. (1987); Smith et al., *Mol. Cell. Biol.* (1983) 3:2156; and Luckow and Summers (1989)). For example, the insertion can be into a gene such as the polyhedrin gene, by homologous double crossover recombination; insertion can also be into a restriction enzyme site engineered into the desired baculovirus gene. Miller et al., (1989), *Bioessays* 4:91. The DNA sequence, when cloned in place of the polyhedrin gene in the expression vector, is flanked both 5' and 3' by polyhedrin-specific sequences and is positioned downstream of the polyhedrin promoter.

The newly formed baculovirus expression vector is subsequently packaged into an infectious recombinant baculovirus. Homologous recombination occurs at low frequency (between about 1% and about 5%); thus, the majority of the virus produced after cotransfection is still wild-type virus. Therefore, a method is necessary to identify recombinant viruses. An advantage of the expression system is a visual screen allowing recombinant viruses to be distinguished. The polyhedrin protein, which is produced by the native virus, is produced at very high levels in the nuclei of infected cells at late times after viral infection. Accumulated polyhedrin protein forms occlusion bodies that also contain embedded particles. These occlusion bodies, up to 15 µm in size, are highly refractile, giving them a bright shiny appearance that is readily visualized under the light microscope. Cells infected with recombinant viruses lack occlusion bodies. To distinguish recombinant virus from wild-type virus, the transfection supernatant is plaqued onto a monolayer of insect cells by techniques known to those skilled in the art. Namely, the plaques are screened under the light microscope for the presence (indicative of wild-type virus) or absence (indicative of recombinant virus) of occlusion bodies. "Current Protocols in Microbiology" Vol. 2 (Ausubel et al. eds) at 16.8 (Supp. 10, 1990); Summers and Smith, supra; Miller et al. (1989).

Recombinant baculovirus expression vectors have been developed for infection into several insect cells. For example, recombinant baculoviruses have been developed for, inter alia: *Aedes aegypti, Autographa californica, Bombyx mori, Drosophila melanogaster, Spodoptera frugiperda,* and *Trichoplusia ni* (WO 89/046699; Carbonell et al., (1985) *J. Virol.* 56:153; Wright (1986) *Nature* 321:718; Smith et al., (1983) *Mol. Cell. Biol.* 3:2156; and see generally, Fraser, et al. (1989) *In Vitro Cell. Dev. Biol.* 25:225).

Cells and cell culture media are commercially available for both direct and fusion expression of heterologous polypeptides in a baculovirus/expression system; cell culture technology is generally known to those skilled in the art. See, eg. Summers and Smith supra.

The modified insect cells may then be grown in an appropriate nutrient medium, which allows for stable maintenance of the plasmid(s) present in the modified insect host. Where the expression product gene is under inducible control, the host may be grown to high density, and expression induced. Alternatively, where expression is constitutive, the product will be continuously expressed into the medium and the nutrient medium must be continuously circulated, while removing the product of interest and augmenting depleted nutrients. The product may be purified by such techniques as chromatography, eg HPLC, affinity chromatography, ion exchange chromatography, etc.; electrophoresis; density gradient centrifugation; solvent extraction, etc. As appropriate, the product may be further purified, as required, so as to remove substantially any insect proteins which are also present in the medium, so as to provide a product which is at least substantially free of host debris, eg. proteins, lipids and polysaccharides.

In order to obtain protein expression, recombinant host cells derived from the transformants are incubated under conditions which allow expression of the recombinant protein encoding sequence. These conditions will vary, dependent upon the host cell selected. However, the conditions are readily ascertainable to those of ordinary skill in the art, based upon what is known in the art.

iii. Plant Systems

There are many plant cell culture and whole plant genetic expression systems known in the art. Exemplary plant cellular genetic expression systems include those described in patents, such as: U.S. Pat. Nos. 5,693,506; 5,659,122; and 5,608,143. Additional examples of genetic expression in plant cell culture has been described by Zenk, *Phytochemistry* 30:3861-3863 (1991). Descriptions of plant protein signal peptides may be found in addition to the references described above in Vaulcombe et al., *Mol. Gen. Genet.* 209:33-40 (1987); Chandler et al., *Plant Molecular Biology* 3:407-418 (1984); Rogers, *J. Biol. Chem.* 260:3731-3738 (1985); Rothstein et al., *Gene* 55:353-356 (1987); Whittier et al., Nucleic Acids Research 15:2515-2535 (1987); Wirsel et al., *Molecular Microbiology* 3:3-14 (1989); Yu et al., *Gene* 122:247-253 (1992). A description of the regulation of plant gene expression by the phytohormone, gibberellic acid and secreted enzymes induced by gibberellic acid can be found in R. L. Jones and J. MacMillin, Gibberellins: in: *Advanced Plant Physiology,* Malcolm B. Wilkins, ed., 1984 Pitman Publishing Limited, London, pp. 21-52. References that describe other metabolically-regulated genes: Sheen, *Plant Cell,*

2:1027-1038 (1990); Maas et al., *EMBO J.* 9:3447-3452 (1990); Benkel and Hickey, *Proc. Natl. Acad. Sci.* 84:1337-1339 (1987).

Typically, using techniques known in the art, a desired polynucleotide sequence is inserted into an expression cassette comprising genetic regulatory elements designed for operation in plants. The expression cassette is inserted into a desired expression vector with companion sequences upstream and downstream from the expression cassette suitable for expression in a plant host. The companion sequences will be of plasmid or viral origin and provide necessary characteristics to the vector to permit the vectors to move DNA from an original cloning host, such as bacteria, to the desired plant host. The basic bacterial/plant vector construct will preferably provide a broad host range prokaryote replication origin; a prokaryote selectable marker; and, for *Agrobacterium* transformations, T DNA sequences for *Agrobacterium*-mediated transfer to plant chromosomes. Where the heterologous gene is not readily amenable to detection, the construct will preferably also have a selectable marker gene suitable for determining if a plant cell has been transformed. A general review of suitable markers, for example for the members of the grass family, is found in Wilmink and Dons, 1993, *Plant Mol. Biol. Reptr,* 11(2):165-185.

Sequences suitable for permitting integration of the heterologous sequence into the plant genome are also recommended. These might include transposon sequences and the like for homologous recombination as well as Ti sequences which permit random insertion of a heterologous expression cassette into a plant genome. Suitable prokaryote selectable markers include resistance toward antibiotics such as ampicillin or tetracycline. Other DNA sequences encoding additional functions may also be present in the vector, as is known in the art.

The nucleic acid molecules of the subject invention may be included into an expression cassette for expression of the protein(s) of interest. Usually, there will be only one expression cassette, although two or more are feasible. The recombinant expression cassette will contain in addition to the heterologous protein encoding sequence the following elements, a promoter region, plant 5' untranslated sequences, initiation codon depending upon whether or not the structural gene comes equipped with one, and a transcription and translation termination sequence. Unique restriction enzyme sites at the 5' and 3' ends of the cassette allow for easy insertion into a pre-existing vector.

A heterologous coding sequence may be for any protein relating to the present invention. The sequence encoding the protein of interest will encode a signal peptide which allows processing and translocation of the protein, as appropriate, and will usually lack any sequence which might result in the binding of the desired protein of the invention to a membrane. Since, for the most part, the transcriptional initiation region will be for a gene which is expressed and translocated during germination, by employing the signal peptide which provides for translocation, one may also provide for translocation of the protein of interest. In this way, the protein(s) of interest will be translocated from the cells in which they are expressed and may be efficiently harvested. Typically secretion in seeds are across the aleurone or scutellar epithelium layer into the endosperm of the seed. While it is not required that the protein be secreted from the cells in which the protein is produced, this facilitates the isolation and purification of the recombinant protein.

Since the ultimate expression of the desired gene product will be in a eucaryotic cell it is desirable to determine whether any portion of the cloned gene contains sequences which will be processed out as introns by the host's splicosome machinery. If so, site-directed mutagenesis of the "intron" region may be conducted to prevent losing a portion of the genetic message as a false intron code, Reed and Maniatis, *Cell* 41:95-105, 1985.

The vector can be microinjected directly into plant cells by use of micropipettes to mechanically transfer the recombinant DNA. Crossway, *Mol. Gen. Genet,* 202:179-185, 1985. The genetic material may also be transferred into the plant cell by using polyethylene glycol, Krens, et al., *Nature,* 296, 72-74, 1982. Another method of introduction of nucleic acid segments is high velocity ballistic penetration by small particles with the nucleic acid either within the matrix of small beads or particles, or on the surface, Klein, et al., *Nature,* 327, 70-73, 1987 and Knudsen and Muller, 1991, *Planta,* 185:330-336 teaching particle bombardment of barley endosperm to create transgenic barley. Yet another method of introduction would be fusion of protoplasts with other entities, either minicells, cells, lysosomes or other fusible lipid-surfaced bodies, Fraley, et al., *Proc. Natl. Acad. Sci. USA,* 79, 1859-1863, 1982.

The vector may also be introduced into the plant cells by electroporation. (Fromm et al., *Proc. Natl. Acad. Sci. USA* 82:5824, 1985). In this technique, plant protoplasts are electroporated in the presence of plasmids containing the gene construct. Electrical impulses of high field strength reversibly permeabilize biomembranes allowing the introduction of the plasmids. Electroporated plant protoplasts reform the cell wall, divide, and form plant callus.

All plants from which protoplasts can be isolated and cultured to give whole regenerated plants can be transformed by the present invention so that whole plants are recovered which contain the transferred gene. It is known that practically all plants can be regenerated from cultured cells or tissues, including but not limited to all major species of sugarcane, sugar beet, cotton, fruit and other trees, legumes and vegetables. Some suitable plants include, for example, species from the genera *Fragaria, Lotus, Medicago, Onobrychis, Trifolium, Trigonella, Vigna, Citrus, Linum, Geranium, Manihot, Daucus, Arabidopsis, Brassica, Raphanus, Sinapis, Atropa, Capsicum, Datura, Hyoscyamus, Lycopersion, Nicotiana, Solanum, Petunia, Digitalis, Majorana, Cichorium, Helianthus, Lactuca, Bromus, Asparagus, Antirrhinum, Hererocallis, Nemesia, Pelargonium, Panicum, Pennisetum, Ranunculus, Senecio, Salpiglossis, Cucumis, Browaalia, Glycine, Lolium, Zea, Triticum, Sorghum,* and *Datura.*

Means for regeneration vary from species to species of plants, but generally a suspension of transformed protoplasts containing copies of the heterologous gene is first provided. Callus tissue is formed and shoots may be induced from callus and subsequently rooted. Alternatively, embryo formation can be induced from the protoplast suspension. These embryos germinate as natural embryos to form plants. The culture media will generally contain various amino acids and hormones, such as auxin and cytokinins. It is also advantageous to add glutamic acid and proline to the medium, especially for such species as corn and alfalfa. Shoots and roots normally develop simultaneously. Efficient regeneration will depend on the medium, on the genotype, and on the history of the culture. If these three variables are controlled, then regeneration is fully reproducible and repeatable.

In some plant cell culture systems, the desired protein of the invention may be excreted or alternatively, the protein may be extracted from the whole plant. Where the desired protein of the invention is secreted into the medium, it may be collected. Alternatively, the embryos and embryoless-half seeds or other plant tissue may be mechanically disrupted to release any secreted protein between cells and tissues. The mixture may be suspended in a buffer solution to retrieve soluble proteins. Conventional protein isolation and purification methods will be then used to purify the recombinant protein. Parameters of time, temperature pH, oxygen, and volumes will be adjusted through routine methods to optimize expression and recovery of heterologous protein.

iv. Bacterial Systems

Bacterial expression techniques are known in the art. A bacterial promoter is any DNA sequence capable of binding bacterial RNA polymerase and initiating the downstream (3') transcription of a coding sequence (eg. structural gene) into mRNA. A promoter will have a transcription initiation region which is usually placed proximal to the 5' end of the coding sequence. This transcription initiation region usually includes an RNA polymerase binding site and a transcription initiation site. A bacterial promoter may also have a second domain called an operator, that may overlap an adjacent RNA polymerase binding site at which RNA synthesis begins. The operator permits negative regulated (inducible) transcription, as a gene repressor protein may bind the operator and thereby inhibit transcription of a specific gene. Constitutive expression may occur in the absence of negative regulatory elements, such as the operator. In addition, positive regulation may be achieved by a gene activator protein binding sequence, which, if present is usually proximal (5') to the RNA polymerase binding sequence. An example of a gene activator protein is the catabolite activator protein (CAP), which helps initiate transcription of the lac operon in *Escherichia coli* (*E. coli*) [Raibaud et al. (1984) *Annu. Rev. Genet.* 18:173]. Regulated expression may therefore be either positive or negative, thereby either enhancing or reducing transcription.

Sequences encoding metabolic pathway enzymes provide particularly useful promoter sequences. Examples include promoter sequences derived from sugar metabolizing enzymes, such as galactose, lactose (lac) [Chang et al. (1977) *Nature* 198:1056], and maltose. Additional examples include promoter sequences derived from biosynthetic enzymes such as tryptophan (trp) [Goeddel et al. (1980) *Nuc. Acids Res.* 8:4057; Yelverton et al. (1981) *Nucl. Acids Res.* 9:731; U.S. Pat. No. 4,738,921; EP-A-0036776 and EP-A-0121775]. The g-laotamase (bla) promoter system [Weissmann (1981) "The cloning of interferon and other mistakes." In *Interferon* 3 (ed. I. Gresser)], bacteriophage lambda PL [Shimatake et al. (1981) *Nature* 292:128] and T5 [U.S. Pat. No. 4,689,406] promoter systems also provide useful promoter sequences.

In addition, synthetic promoters which do not occur in nature also function as bacterial promoters. For example, transcription activation sequences of one bacterial or bacteriophage promoter may be joined with the operon sequences of another bacterial or bacteriophage promoter, creating a synthetic hybrid promoter [U.S. Pat. No. 4,551,433]. For example, the tac promoter is a hybrid trp-lac promoter comprised of both trp promoter and lac operon sequences that is regulated by the lac repressor [Amann et al. (1983) *Gene* 25:167; de Boer et al. (1983) *Proc. Natl. Acad. Sci.* 80:21]. Furthermore, a bacterial promoter can include naturally occurring promoters of non-bacterial origin that have the ability to bind bacterial RNA polymerase and initiate transcription. A naturally occurring promoter of non-bacterial origin can also be coupled with a compatible RNA polymerase to produce high levels of expression of some genes in prokaryotes. The bacteriophage T7 RNA polymerase/promoter system is an example of a coupled promoter system [Studier et al. (1986) *J. Mol. Biol.* 189:113; Tabor et al. (1985) *Proc Natl. Acad. Sci.* 82:1074]. In addition, a hybrid promoter can also be comprised of a bacteriophage promoter and an *E. coli* operator region (EPO-A-0 267 851).

In addition to a functioning promoter sequence, an efficient ribosome binding site is also useful for the expression of foreign genes in prokaryotes. In *E. coli*, the ribosome binding site is called the Shine-Dalgarno (SD) sequence and includes an initiation codon (ATG) and a sequence 3-9 nucleotides in length located 3-11 nucleotides upstream of the initiation codon [Shine et al. (1975) *Nature* 254:34]. The SD sequence is thought to promote binding of mRNA to the ribosome by the pairing of bases between the SD sequence and the 3' and of *E. coli* 16S rRNA [Steitz et al. (1979) "Genetic signals and nucleotide sequences in messenger RNA." In *Biological Regulation and Development: Gene Expression* (ed. R. F. Goldberger)]. To express eukaryotic genes and prokaryotic genes with weak ribosome-binding site [Sambrook et al. (1989) "Expression of cloned genes in *Escherichia coli*." In *Molecular Cloning: A Laboratory Manual*].

A DNA molecule may be expressed intracellularly. A promoter sequence may be directly linked with the DNA molecule, in which case the first amino acid at the N-terminus will always be a methionine, which is encoded by the ATG start codon. If desired, methionine at the N-terminus may be cleaved from the protein by in vitro incubation with cyanogen bromide or by either in vivo on in vitro incubation with a bacterial methionine N-terminal peptidase (EP-A-0 219 237).

Fusion proteins provide an alternative to direct expression. Usually, a DNA sequence encoding the N-terminal portion of an endogenous bacterial protein, or other stable protein, is fused to the 5' end of heterologous coding sequences. Upon expression, this construct will provide a fusion of the two amino acid sequences. For example, the bacteriophage lambda cell gene can be linked at the 5' terminus of a foreign gene and expressed in bacteria. The resulting fusion protein preferably retains a site for a processing enzyme (factor Xa) to cleave the bacteriophage protein from the foreign gene [Nagai et al. (1984) *Nature* 309:810]. Fusion proteins can also be made with sequences from the lacZ [Jia et al. (1987) *Gene* 60:197], trpE [Allen et al. (1987) *J. Biotechnol.* 5:93; Makoff et al. (1989) *J. Gen. Microbiol.* 135:11], and Chey [EP-A-0 324 647] genes. The DNA sequence at the junction of the two amino acid sequences may or may not encode a cleavable site. Another example is a ubiquitin fusion protein. Such a fusion protein is made with the ubiquitin region that preferably retains a site for a processing enzyme (eg. ubiquitin specific processing-protease) to cleave the ubiquitin from the foreign protein. Through this method, native foreign protein can be isolated [Miller et al. (1989) *Bio/Technology* 7:698].

Alternatively, foreign proteins can also be secreted from the cell by creating chimeric DNA molecules that encode a fusion protein comprised of a signal peptide sequence fragment that provides for secretion of the foreign protein in bacteria [U.S. Pat. No. 4,336,336]. The signal sequence fragment usually encodes a signal peptide comprised of hydrophobic amino acids which direct the secretion of the protein from the cell. The protein is either secreted into the growth media (gram-positive bacteria) or into the periplasmic space, located between the inner and outer membrane of the cell (gram-negative bacteria). Preferably there are processing sites, which can be cleaved either in vivo or in vitro encoded between the signal peptide fragment and the foreign gene.

DNA encoding suitable signal sequences can be derived from genes for secreted bacterial proteins, such as the *E. coli* outer membrane protein gene (ompA) [Masui et al. (1983), in: *Experimental Manipulation of Gene Expression*; Ghrayeb et al. (1984) *EMBO J.* 3:2437] and the *E. coli* alkaline phosphatase signal sequence (phoA) [Oka et al. (1985) *Proc. Natl.*

*Acad. Sci.* 82:7212]. As an additional example, the signal sequence of the alpha-amylase gene from various *Bacillus* strains can be used to secrete heterologous proteins from *B. subtilis* [Palva et al. (1982) *Proc. Natl. Acad. Sci. USA* 79:5582; EP-A-0 244 042].

Usually, transcription termination sequences recognized by bacteria are regulatory regions located 3' to the translation stop codon, and thus together with the promoter flank the coding sequence. These sequences direct the transcription of an mRNA which can be translated into the polypeptide encoded by the DNA. Transcription termination sequences frequently include DNA sequences of about 50 nucleotides capable of forming stem loop structures that aid in terminating transcription. Examples include transcription termination sequences derived from genes with strong promoters, such as the trp gene in *E. coli* as well as other biosynthetic genes.

Usually, the above described components, comprising a promoter, signal sequence (if desired), coding sequence of interest, and transcription termination sequence, are put together into expression constructs. Expression constructs are often maintained in a replicon, such as an extrachromosomal element (eg. plasmids) capable of stable maintenance in a host, such as bacteria. The replicon will have a replication system, thus allowing it to be maintained in a prokaryotic host either for expression or for cloning and amplification. In addition, a replicon may be either a high or low copy number plasmid. A high copy number plasmid will generally have a copy number ranging from about 5 to about 200, and usually about 10 to about 150. A host containing a high copy number plasmid will preferably contain at least about 10, and more preferably at least about 20 plasmids. Either a high or low copy number vector may be selected, depending upon the effect of the vector and the foreign protein on the host.

Alternatively, the expression constructs can be integrated into the bacterial genome with an integrating vector. Integrating vectors usually contain at least one sequence homologous to the bacterial chromosome that allows the vector to integrate. Integrations appear to result from recombinations between homologous DNA in the vector and the bacterial chromosome. For example, integrating vectors constructed with DNA from various *Bacillus* strains integrate into the *Bacillus* chromosome (EP-A-0 127 328). Integrating vectors may also be comprised of bacteriophage or transposon sequences.

Usually, extrachromosomal and integrating expression constructs may contain selectable markers to allow for the selection of bacterial strains that have been transformed. Selectable markers can be expressed in the bacterial host and may include genes which render bacteria resistant to drugs such as ampicillin, chloramphenicol, erythromycin, kanamycin (neomycin), and tetracycline [Davies et al. (1978) *Annu. Rev. Microbiol.* 32:469]. Selectable markers may also include biosynthetic genes, such as those in the histidine, tryptophan, and leucine biosynthetic pathways.

Alternatively, some of the above described components can be put together in transformation vectors. Transformation vectors are usually comprised of a selectable market that is either maintained in a replicon or developed into an integrating vector, as described above.

Expression and transformation vectors, either extra-chromosomal replicons or integrating vectors, have been developed for transformation into many bacteria. For example, expression vectors have been developed for, inter alia, the following bacteria: *Bacillus subtilis* [Palva et al. (1982) *Proc. Natl. Acad. Sci. USA* 79:5582; EP-A-0 036 259 and EP-A-0 063 953; WO 84/04541], *Escherichia coli* [Shimatake et al. (1981) *Nature* 292:128; Amann et al. (1985) *Gene* 40:183; Studier et al. (1986) *J. Mol. Biol.* 189:113; EP-A-0 036 776, EP-A-0 136 829 and EP-A-0 136 907], *Streptococcus cremoris* [Powell et al. (1988) *Appl. Environ. Microbiol.* 54:655]; *Streptococcus lividans* [Powell et al. (1988) *Appl. Environ. Microbiol.* 54:655], *Streptomyces lividans* [U.S. Pat. No. 4,745,056].

Methods of introducing exogenous DNA into bacterial hosts are well-known in the art, and usually include either the transformation of bacteria treated with $CaCl_2$ or other agents, such as divalent cations and DMSO. DNA can also be introduced into bacterial cells by electroporation. Transformation procedures usually vary with the bacterial species to be transformed. See eg. [Masson et al. (1989) *FEMS Microbiol. Lett.* 60:273; Palva et al. (1982) *Proc. Natl. Acad. Sci. USA* 79:5582; EP-A-0 036 259 and EP-A-0 063 953; WO 84/04541, *Bacillus*], [Miller et al. (1988) *Proc. Natl. Acad. Sci.* 85:856; Wang et al. (1990) *J. Bacteriol.* 172:949, *Campylobacter*], [Cohen et al. (1973) *Proc. Natl. Acad. Sci.* 69:2110; Dower et al. (1988) *Nucleic Acids Res.* 16:6127; Kushner (1978) "An improved method for transformation of *Escherichia coli* with ColE1-derived plasmids. In *Genetic Engineering: Proceedings of the International Symposium on Genetic Engineering* (eds. H. W. Boyer and S. Nicosia); Mandel et al. (1970) *J. Mol. Biol.* 53:159; Taketo (1988) *Biochim. Biophys. Acta* 949:318; *Escherichia*], [Chassy et al. (1987) *FEMS Microbiol. Lett.* 44:173 *Lactobacillus*]; [Fiedler et al. (1988) *Anal. Biochem* 170:38, *Pseudomonas*]; [Augustin et al. (1990) *FEMS Microbiol. Lett.* 66:203, *Staphylococcus*], [Barany et al. (1980) *J. Bacteriol.* 144:698; Harlander (1987) "Transformation of *Streptococcus lactis* by electroporation, in: *Streptococcal Genetics* (ed. J. Ferretti and R. Curtiss III); Perry et al. (1981) *Infect. Immun.* 32:1295; Powell et al. (1988) *Appl. Environ. Microbiol.* 54:655; Somkuti et al. (1987) *Proc. 4th Evr. Cong. Biotechnology* 1:412, *Streptococcus*].

v. Yeast Expression

Yeast expression systems are also known to one of ordinary skill in the art. A yeast promoter is any DNA sequence capable of binding yeast RNA polymerase and initiating the downstream (3') transcription of a coding sequence (eg. structural gene) into mRNA. A promoter will have a transcription initiation region which is usually placed proximal to the 5' end of the coding sequence. This transcription initiation region usually includes an RNA polymerase binding site (the "TATA Box") and a transcription initiation site. A yeast promoter may also have a second domain called an upstream activator sequence (UAS), which, if present, is usually distal to the structural gene. The UAS permits regulated (inducible) expression. Constitutive expression occurs in the absence of a UAS. Regulated expression may be either positive or negative, thereby either enhancing or reducing transcription.

Yeast is a fermenting organism with an active metabolic pathway, therefore sequences encoding enzymes in the metabolic pathway provide particularly useful promoter sequences. Examples include alcohol dehydrogenase (ADH) (EP-A-0 284 044), enolase, glucokinase, glucose-6-phosphate isomerase, glyceraldehyde-3-phosphate-dehydrogenase (GAP or GAPDH), hexokinase, phosphofructokinase, 3-phosphoglycerate mutase, and pyruvate kinase (PyK) (EPO-A-0 329 203). The yeast PHO5 gene, encoding acid phosphatase, also provides useful promoter sequences [Myanohara et al. (1983) *Proc. Natl. Acad. Sci. USA* 80: 1].

In addition, synthetic promoters which do not occur in nature also function as yeast promoters. For example, UAS sequences of one yeast promoter may be joined with the transcription activation region of another yeast promoter, creating a synthetic hybrid promoter. Examples of such hybrid promoters include the ADH regulatory sequence linked to the GAP transcription activation region (U.S. Pat. Nos. 4,876, 197 and 4,880,734). Other examples of hybrid promoters include promoters which consist of the regulatory sequences of either the ADH2, GAL4, GAL10, OR PHO5 genes, combined with the transcriptional activation region of a glycolytic enzyme gene such as GAP or PyK (EP-A-0 164 556). Furthermore, a yeast promoter can include naturally occurring promoters of non-yeast origin that have the ability to bind yeast RNA polymerase and initiate transcription. Examples of such promoters include, inter alia, [Cohen et al. (1980) *Proc. Natl. Acad. Sci. USA* 77:1078; Henikoff et al. (1981) *Nature* 283:835; Hollenberg et al. (1981) *Curr. Topics Microbiol. Immunol.* 96:119; Hollenberg et al. (1979) "The Expression of Bacterial Antibiotic Resistance Genes in the Yeast *Saccharomyces cerevisiae*," in: *Plasmids of Medical, Environmental and Commercial Importance* (eds. K. N. Timmis and A. Puhler); Mercerau-Puigalon et al. (1980) *Gene* 11:163; Panthier et al. (1980) *Curr. Genet.* 2:109;].

A DNA molecule may be expressed intracellularly in yeast. A promoter sequence may be directly linked with the DNA molecule, in which case the first amino acid at the N-terminus of the recombinant protein will always be a methionine, which is encoded by the ATG start codon. If desired, methionine at the N-terminus may be cleaved from the protein by in vitro incubation with cyanogen bromide.

Fusion proteins provide an alternative for yeast expression systems, as well as in mammalian, baculovirus, and bacterial expression systems. Usually, a DNA sequence encoding the N-terminal portion of an endogenous yeast protein, or other stable protein, is fused to the 5' end of heterologous coding sequences. Upon expression, this construct will provide a fusion of the two amino acid sequences. For example, the yeast or human superoxide dismutase (SOD) gene, can be linked at the 5' terminus of a foreign gene and expressed in yeast. The DNA sequence at the junction of the two amino acid sequences may or may not encode a cleavable site. See eg. EP-A-0 196 056. Another example is a ubiquitin fusion protein. Such a fusion protein is made with the ubiquitin region that preferably retains a site for a processing enzyme (eg. ubiquitin-specific processing protease) to cleave the ubiquitin from the foreign protein. Through this method, therefore, native foreign protein can be isolated (eg. WO88/024066).

Alternatively, foreign proteins can also be secreted from the cell into the growth media by creating chimeric DNA molecules that encode a fusion protein comprised of a leader sequence fragment that provide for secretion in yeast of the foreign protein. Preferably, there are processing sites encoded between the leader fragment and the foreign gene that can be cleaved either in vivo or in vitro. The leader sequence fragment usually encodes a signal peptide comprised of hydrophobic amino acids which direct the secretion of the protein from the cell.

DNA encoding suitable signal sequences can be derived from genes for secreted yeast proteins, such as the yeast invertase gene (EP-A-0 012 873; JPO. 62,096,086) and the A-factor gene (U.S. Pat. No. 4,588,684). Alternatively, leaders of non-yeast origin, such as an interferon leader, exist that also provide for secretion in yeast (EP-A-0 060 057).

A preferred class of secretion leaders are those that employ a fragment of the yeast alpha-factor gene, which contains both a "pre" signal sequence, and a "pro" region. The types of alpha-factor fragments that can be employed include the full-length pre-pro alpha factor leader (about 83 amino acid residues) as well as truncated alpha-factor leaders (usually about 25 to about 50 amino acid residues) (U.S. Pat. Nos. 4,546,083 and 4,870,008; EP-A-0 324 274). Additional leaders employing an alpha-factor leader fragment that provides for secretion include hybrid alpha-factor leaders made with a presequence of a first yeast, but a pro-region from a second yeast alphafactor. (eg. see WO 89/02463.)

Usually, transcription termination sequences recognized by yeast are regulatory regions located 3' to the translation stop codon, and thus together with the promoter flank the coding sequence. These sequences direct the transcription of an mRNA which can be translated into the polypeptide encoded by the DNA. Examples of transcription terminator sequence and other yeast-recognized termination sequences, such as those coding for glycolytic enzymes.

Usually, the above described components, comprising a promoter, leader (if desired), coding sequence of interest, and transcription termination sequence, are put together into expression constructs. Expression constructs are often maintained in a replicon, such as an extrachromosomal element (eg. plasmids) capable of stable maintenance in a host, such as yeast or bacteria. The replicon may have two replication systems, thus allowing it to be maintained, for example, in yeast for expression and in a prokaryotic host for cloning and amplification. Examples of such yeast-bacteria shuttle vectors include YEp24 [Botstein et al. (1979) *Gene* 8:17-24], pCl/1 [Brake et al. (1984) *Proc. Natl. Acad. Sci USA* 81:4642-4646], and YRp17 [Stinchcomb et al. (1982) *J. Mol. Biol.* 158:157]. In addition, a replicon may be either a high or low copy number plasmid. A high copy number plasmid will generally have a copy number ranging from about 5 to about 200, and usually about 10 to about 150. A host containing a high copy number plasmid will preferably have at least about 10, and more preferably at least about 20. Enter a high or low copy number vector may be selected, depending upon the effect of the vector and the foreign protein on the host. See eg. Brake et al., supra.

Alternatively, the expression constructs can be integrated into the yeast genome with an integrating vector. Integrating vectors usually contain at least one sequence homologous to a yeast chromosome that allows the vector to integrate, and preferably contain two homologous sequences flanking the expression construct. Integrations appear to result from recombinations between homologous DNA in the vector and the yeast chromosome [Orr-Weaver et al. (1983) *Methods in Enzymol.* 101:228-245]. An integrating vector may be directed to a specific locus in yeast by selecting the appropriate homologous sequence for inclusion in the vector. See Orr-Weaver et al., supra. One or more expression construct may integrate, possibly affecting levels of recombinant protein produced [Rine et al. (1983) *Proc. Natl. Acad. Sci. USA* 80:6750]. The chromosomal sequences included in the vector can occur either as a single segment in the vector, which results in the integration of the entire vector, or two segments homologous to adjacent segments in the chromosome and flanking the expression construct in the vector, which can result in the stable integration of only the expression construct.

Usually, extrachromosomal and integrating expression constructs may contain selectable markers to allow for the selection of yeast strains that have been transformed. Selectable markers may include biosynthetic genes that can be expressed in the yeast host, such as ADE2, HIS4, LEU2, TRP1, and ALG7, and the G418 resistance gene, which confer resistance in yeast cells to tunicamycin and G418, respectively. In addition, a suitable selectable marker may also provide yeast with the ability to grow in the presence of toxic compounds, such as metal. For example, the presence of CUP1 allows yeast to grow in the presence of copper ions [Butt et al. (1987) *Microbiol, Rev.* 51:351].

Alternatively, some of the above described components can be put together into transformation vectors. Transformation vectors are usually comprised of a selectable marker that is either maintained in a replicon or developed into an integrating vector, as described above.

Expression and transformation vectors, either extrachromosomal replicons or integrating vectors, have been developed for transformation into many yeasts. For example, expression vectors have been developed for, inter alia, the following yeasts: *Candida albicans* [Kurtz, et al. (1986) *Mol. Cell. Biol.* 6:142], *Candida maltosa* [Kunze, et al. (1985) *J. Basic Microbiol.* 25:141]. *Hansenula polymorpha* [Gleeson, et al. (1986) *J. Gen. Microbiol.* 132:3459; Roggenkamp et al. (1986) *Mol. Gen. Genet.* 202:302], *Kluyveromyces fragilis* [Das, et al. (1984) *J. Bacteriol.* 158:1165], *Kluyveromyces lactis* [De Louvencourt et al. (1983) *J. Bacteriol.* 154:737; Van den Berg et al. (1990) *Bio/Technology* 8:135], *Pichia guillerimondii* [Kunze et al. (1985) *J. Basic Microbiol.* 25:141], *Pichia pastoris* [Cregg, et al. (1985) *Mol. Cell. Biol.* 5:3376; U.S. Pat. Nos. 4,837,148 and 4,929,555], *Saccharomyces cerevisiae* [Hinnen et al. (1978) *Proc. Natl. Acad. Sci. USA* 75:1929; Ito et al. (1983) *J. Bacteriol.* 153:163], *Schizosaccharomyces pombe* [Beach and Nurse (1981) *Nature* 300:706], and *Yarrowia lipolytica* [Davidow, et al. (1985) *Curr. Genet.* 10:380471 Gaillardin, et al. (1985) *Curr. Genet.* 10:49].

Methods of introducing exogenous DNA into yeast hosts are well-known in the art, and usually include either the transformation of spheroplasts or of intact yeast cells treated with alkali cations. Transformation procedures usually vary with the yeast species to be transformed. See eg. [Kurtz et al. (1986) *Mol. Cell. Biol.* 6:142; Kunze et al. (1985) *J. Basic Microbiol.* 25:141; *Candida*]; [Gleeson et al. (1986) *J. Gen. Microbiol.* 132:3459; Roggenkamp et al. (1986) *Mol. Gen. Genet.* 202:302; *Hansenula*]; [Das et al. (1984) *J. Bacteriol.* 158:1165; De Louvencourt et al. (1983) *J. Bacteriol.* 154: 1165; Van den Berg et al. (1990) *Bio/Technology* 8:135; *Kluyveromyces*]; [Cregg et al. (1985) *Mol. Cell. Biol.* 5:3376; Kunze et al. (1985) *J. Basic Microbiol.* 25:141; U.S. Pat. Nos. 4,837,148 and 4,929,555; *Pichia*]; [Hinnen et al. (1978) *Proc. Natl. Acad. Sci. USA* 75; 1929; Ito et al. (1983) *J. Bacteriol.* 153:163 *Saccharomyces*]; [Beach and Nurse (1981) *Nature* 300:706; *Schizosaccharomyces*]; [Davidow et al. (1985) *Curr. Genet.* 10:39; Gaillardin et al. (1985) *Curr. Genet.* 10:49; *Yarrowia]*.

Antibodies

As used herein, the term "antibody" refers to a polypeptide or group of polypeptides composed of at least one antibody combining site. An "antibody combining site" is the three-dimensional binding space with an internal surface shape and charge distribution complementary to the features of an epitope of an antigen, which allows a binding of the antibody with the antigen. "Antibody" includes, for example, vertebrate antibodies, hybrid antibodies, chimeric antibodies, humanised antibodies, altered antibodies, univalent antibodies, Fab proteins, and single domain antibodies.

Antibodies against the proteins of the invention are useful for affinity chromatography, immunoassays, and distinguishing/identifying *streptococcus* proteins.

Antibodies to the proteins of the invention, both polyclonal and monoclonal, may be prepared by conventional methods. In general, the protein is first used to immunize a suitable animal, preferably a mouse, rat, rabbit or goat. Rabbits and goats are preferred for the preparation of polyclonal sera due to the volume of serum obtainable, and the availability of labeled anti-rabbit and anti-goat antibodies. Immunization is generally performed by mixing or emulsifying the protein in saline, preferably in an adjuvant such as Freund's complete adjuvant, and injecting the mixture or emulsion parenterally (generally subcutaneously or intramuscularly). A dose of 50-200 μg/injection is typically sufficient. Immunization is generally boosted 2-6 weeks later with one or more injections of the protein in saline, preferably using Freund's incomplete adjuvant. One may alternatively generate antibodies by in vitro immunization using methods known in the art, which for the purposes of this invention is considered equivalent to in vivo immunization. Polyclonal antisera is obtained by bleeding the immunized animal into a glass or plastic container, incubating the blood at 25° C. for one hour, followed by incubating at 4° C. for 2-18 hours. The serum is recovered by centrifugation (eg. 1,000 g for 10 minutes). About 20-50 ml per bleed may be obtained from rabbits.

Monoclonal antibodies are prepared using the standard method of Kohler & Milstein [*Nature* (1975) 256:495-96], or a modification thereof. Typically, a mouse or rat is immunized as described above. However, rather than bleeding the animal to extract serum, the spleen (and optionally several large lymph nodes) is removed and dissociated into single cells. If desired, the spleen cells may be screened (after removal of nonspecifically adherent cells) by applying a cell suspension to a plate or well coated with the protein antigen. B-cells expressing membrane-bound immunoglobulin specific for the antigen bind to the plate, and are not rinsed away with the rest of the suspension. Resulting B-cells, or all dissociated spleen cells, are then induced to fuse with myeloma cells to form hybridomas, and are cultured in a selective medium (eg. hypoxanthine, aminopterin, thymidine medium, "HAT"). The resulting hybridomas are plated by limiting dilution, and are assayed for production of antibodies which bind specifically to the immunizing antigen (and which do not bind to unrelated antigens). The selected MAb-secreting hybridomas are then cultured either in vitro (eg. in tissue culture bottles or hollow fiber reactors), or in vivo (as ascites in mice).

If desired, the antibodies (whether polyclonal or monoclonal) may be labeled using conventional techniques. Suitable labels include fluorophores, chromophores, radioactive atoms (particularly $^{32}P$ and $^{125}I$), electron-dense reagents, enzymes, and ligands having specific binding partners. Enzymes are typically detected by their activity. For example, horseradish peroxidase is usually detected by its ability to convert 3,3',5,5'-tetramethylbenzidine (TMB) to a blue pigment, quantifiable with a spectrophotometer. "Specific binding partner" refers to a protein capable of binding a ligand molecule with high specificity, as for example in the case of an antigen and a monoclonal antibody specific therefor. Other specific binding partners include biotin and avidin or streptavidin, IgG and protein A, and the numerous receptor-ligand couples known in the art. It should be understood that the above description is not meant to categorize the various labels into distinct classes, as the same label may serve in several different modes. For example, $^{125}I$ may serve as a radioactive label or as an electron-dense reagent. HRP may serve as enzyme or as antigen for a MAb. Further, one may combine various labels for desired effect. For example, MAbs and avidin also require labels in the practice of this invention: thus, one might label a MAb with biotin, and detect its presence with avidin labeled with $^{125}I$, or with an anti-biotin MAb labeled with HRP. Other permutations and possibilities will be readily apparent to those of ordinary skill in the art, and are considered as equivalents within the scope of the instant invention.

Pharmaceutical Compositions

Pharmaceutical compositions can comprise either polypeptides, antibodies, or nucleic acid of the invention. The pharmaceutical compositions will comprise a therapeutically effective amount of either polypeptides, antibodies, or polynucleotides of the claimed invention.

The term "therapeutically effective amount" as used herein refers to an amount of a therapeutic agent to treat, ameliorate, or prevent a desired disease or condition, or to exhibit a detectable therapeutic or preventative effect. The effect can be detected by, for example, chemical markers or antigen levels. Therapeutic effects also include reduction in physical symptoms, such as decreased body temperature. The precise effective amount for a subject will depend upon the subject's size and health, the nature and extent of the condition, and the therapeutics or combination of therapeutics selected for administration. Thus, it is not useful to specify an exact effective amount in advance. However, the effective amount for a given situation can be determined by routine experimentation and is within the judgement of the clinician.

For purposes of the present invention, an effective dose will be from about 0.01 mg/kg to 50 mg/kg or 0.05 mg/kg to about 10 mg/kg of the molecule of the invention in the individual to which it is administered.

A pharmaceutical composition can also contain a pharmaceutically acceptable carrier. The term "pharmaceutically acceptable carrier" refers to a carrier for administration of a therapeutic agent, such as antibodies or a polypeptide, genes, and other therapeutic agents. The term refers to any pharmaceutical carrier that does not itself induce the production of antibodies harmful to the individual receiving the composition, and which may be administered without undue toxicity. Suitable carriers may be large, slowly metabolized macromolecules such as proteins, polysaccharides, polylactic acids, polyglycolic acids, polymeric amino acids, amino acid copolymers, and inactive virus particles. Such carriers are well known to those of ordinary skill in the art.

Pharmaceutically acceptable salts can be used therein, for example, mineral acid salts such as hydrochlorides, hydrobromides, phosphates, sulfates, and the like; and the salts of organic acids such as acetates, propionates, malonates, benzoates, and the like. A thorough discussion of pharmaceutically acceptable excipients is available in Remington's Pharmaceutical Sciences (Mack Pub. Co., N.J. 1991).

Pharmaceutically acceptable carriers in therapeutic compositions may contain liquids such as water, saline, glycerol and ethanol. Additionally, auxiliary substances, such as wetting or emulsifying agents, pH buffering substances, and the like, may be present in such vehicles. Typically, the therapeutic compositions are prepared as injectables, either as liquid solutions or suspensions; solid forms suitable for solution in, or suspension in, liquid vehicles prior to injection may also be prepared. Liposomes are included within the definition of a pharmaceutically acceptable carrier.

Delivery Methods

Once formulated, the compositions of the invention can be administered directly to the subject. The subjects to be treated can be animals; in particular, human subjects can be treated.

Direct delivery of the compositions will generally be accomplished by injection, either subcutaneously, intraperitoneally, intravenously or intramuscularly or delivered to the interstitial space of a tissue. The compositions can also be administered into a lesion. Other modes of administration include oral and pulmonary administration, suppositories, and transdermal or transcutaneous applications (eg. see WO98/20734), needles, and gene guns or hyposprays. Dosage treatment may be a single dose schedule or a multiple dose schedule.

Vaccines

Vaccines according to the invention may either be prophylactic (ie. to prevent infection) or therapeutic (ie. to treat disease after infection).

Such vaccines comprise immunising antigen(s), immunogen(s), polypeptide(s), protein(s) or nucleic acid, usually in combination with "pharmaceutically acceptable carriers," which include any carrier that does not itself induce the production of antibodies harmful to the individual receiving the composition. Suitable carriers are typically large, slowly metabolized macromolecules such as proteins, polysaccharides, polylactic acids, polyglycolic acids, polymeric amino acids, amino acid copolymers, lipid aggregates (such as oil droplets or liposomes), and inactive virus particles. Such carriers are well known to those of ordinary skill in the art. Additionally, these carriers may function as immunostimulating agents ("adjuvants"). Furthermore, the antigen or immunogen may be conjugated to a bacterial toxoid, such as a toxoid from diphtheria, tetanus, cholera, *H. pylori*, etc. pathogens.

Preferred adjuvants to enhance effectiveness of the composition include, but are not limited to: (1) oil-in-water emulsion formulations (with or without other specific immunostimulating agents such as muramyl peptides (see below) or bacterial cell wall components), such as for example (a) MF59™ (WO90/14837; Chapter 10 in *Vaccine Design—the subunit and adjuvant approach* (1995) ed. Powell & Newman), containing 5% Squalene, 0.5% Tween 80, and 0.5% Span 85 (optionally containing MTP-PE) formulated into submicron particles using a microfluidizer, (b) SAF, containing 10% Squalane, 0.4% Tween 80, 5% pluronic-blocked polymer L121, and thr-MDP either microfluidized into a submicron emulsion or vortexed to generate a larger particle size emulsion, and (c) Ribi™ adjuvant system (RAS), (Ribi Immunochem, Hamilton, Mont.) containing 2% Squalene, 0.2% Tween 80, and one or more bacterial cell wall components from the group consisting of monophosphorylipid A (MPL), trehalose dimycolate (TDM), and cell wall skeleton (CWS), preferably MPL+CWS (Detox™); (2) saponin adjuvants, such as QS21 or Stimulon™ (Cambridge Bioscience, Worcester, Mass.) may be used or particles generated therefrom such as ISCOMs (immunostimulating complexes), which ISCOMS may be devoid of additional detergent e.g. WO00/07621; (3) Complete Freund's Adjuvant (CFA) and Incomplete Freund's Adjuvant (IFA); (4) cytokines, such as interleukins (e.g. IL-1, IL-2, IL-4, IL-5, IL-6, IL-7, IL-12 (WO99/44636), etc.), interferons (e.g. gamma interferon), macrophage colony stimulating factor (M-CSF), tumor necrosis factor (TNF), etc.; (5) monophosphoryl lipid A (MPL) or 3-O-deacylated MPL (3dMPL) e.g. GB-2220221, EP-A-0689454; (6) combinations of 3dMPL with, for example, QS21 and/or oil-in-water emulsions e.g. EP-A-0835318, EP-A-0735898, EP-A-0761231; (7) oligonucleotides comprising CpG motifs [Krieg Vaccine 2000, 19, 618-622; Krieg *Curr opin Mol Ther* 2001 3:15-24; Roman et al., *Nat. Med.*, 1997, 3, 849-854; Weiner et al., *PNAS USA*, 1997, 94, 10833-10837; Davis et al., *J. Immunol.*, 1998, 160, 870-876; Chu et al., *J. Exp. Med.*, 1997, 186, 1623-1631; Lipford et al., *Eur. J. Immunol.*, 1997, 27, 2340-2344; Moldoveanu et al., *Vaccine*, 1988, 16, 1216-1224, Krieg et al., *Nature*, 1995, 374, 546-549; Klinman et al., *PNAS USA*, 1996, 93, 2879-2883; Ballas et al., *J. Immunol.*, 1996, 157, 1840-1845; Cowdery et al., *J. Immunol.*, 1996, 156, 4570-4575; Halpern et al., *Cell. Immunol.*, 1996, 167, 72-78; Yamamoto et al., *Jpn. J.*

Cancer Res., 1988, 79, 866-873; Stacey et al., *J. Immunol.*, 1996, 157, 2116-2122; Messina et al., *J. Immunol.*, 1991, 147, 1759-1764; Yi et al., *J. Immunol.*, 1996, 157, 4918-4925; Yi et al., *J. Immunol.*, 1996, 157, 5394-5402; Yi et al., *J. Immunol.*, 1998, 160, 4755-4761; and Yi et al., *J. Immunol.*, 1998, 160, 5898-5906; International patent applications WO96/02555, WO98/16247, WO98/18810, WO98/40100, WO98/55495, WO98/37919 and WO98/52581] i.e. containing at least one CG dinucleotide, with 5-methylcytosine optionally being used in place of cytosine; (8) a polyoxyethylene ether or a polyoxyethylene ester e.g. WO99/52549; (9) a polyoxyethylene sorbitan ester surfactant in combination with an octoxynol (e.g. WO01/21207) or a polyoxyethylene alkyl ether or ester surfactant in combination with at least one additional non-ionic surfactant such as an octoxynol (e.g. WO01/21152); (10) an immunostimulatory oligonucleotide (e.g. a CpG oligonucleotide) and a saponin e.g. WO00/62800; (11) an immunostimulant and a particle of metal salt e.g. WO00/23105; (12) a saponin and an oil-in-water emulsion e.g. WO99/11241; (13) a saponin (e.g. QS21)+3dMPL+IL-12 (optionally+a sterol) e.g. WO98/57659; (14) aluminium salts, preferably hydroxide or phosphate, but any other suitable salt may also be used (e.g. hydroxyphosphate, oxyhydroxide, orthophosphate, sulphate etc. [e.g. see chapters 8 & 9 of Powell & Newman]). Mixtures of different aluminium salts may also be used. The salt may take any suitable form (e.g. gel, crystalline, amorphous etc.); (15) other substances that act as immunostimulating agents to enhance the efficacy of the composition. Aluminium salts and/or MF59™ are preferred.

As mentioned above, muramyl peptides include, but are not limited to, N-acetyl-muramyl-L-threonyl-D-isoglutamine (thr-MDP), N-acetyl-normuramyl-L-alanyl-D-isoglutamine (nor-MDP), N-acetylmuramyl-L-alanyl-D-isoglutaminyl-L-alanine-2-(1'-2'-dipalmitoyl-sn-glycero-3-hydroxyphosphoryloxy)-ethylamine (MTP-PE), etc.

The immunogenic compositions (eg. the immunising antigen/immunogen/polypeptide/protein/nucleic acid, pharmaceutically acceptable carrier, and adjuvant) typically will contain diluents, such as water, saline, glycerol, ethanol, etc. Additionally, auxiliary substances, such as wetting or emulsifying agents, pH buffering substances, and the like, may be present in such vehicles.

Typically, the immunogenic compositions are prepared as injectables, either as liquid solutions or suspensions; solid forms suitable for solution in, or suspension in, liquid vehicles prior to injection may also be prepared. The preparation also may be emulsified or encapsulated in liposomes for enhanced adjuvant effect, as discussed above under pharmaceutically acceptable carriers.

Immunogenic compositions used as vaccines comprise an immunologically effective amount of the antigenic or immunogenic polypeptides, as well as any other of the above-mentioned components, as needed. By "immunologically effective amount", it is meant that the administration of that amount to an individual, either in a single dose or as part of a series, is effective for treatment or prevention. This amount varies depending upon the health and physical condition of the individual to be treated, the taxonomic group of individual to be treated (eg. nonhuman primate, primate, etc.), the capacity of the individual's immune system to synthesize antibodies, the degree of protection desired, the formulation of the vaccine, the treating doctor's assessment of the medical situation, and other rel-evant factors. It is expected that the amount will fall in a relatively broad range that can be determined through routine trials.

The immunogenic compositions are conventionally administered parenterally, eg. by injection, either subcutaneously, intramuscularly, or transdermally/transcutaneously (eg. WO98/20734). Additional formulations suitable for other modes of administration include oral and pulmonary formulations, suppositories, and transdermal applications. Dosage treatment may be a single dose schedule or a multiple dose schedule. The vaccine may be administered in conjunction with other immunoregulatory agents.

As an alternative to protein-based vaccines, DNA vaccination may be used [eg. Robinson & Torres (1997) *Seminars in Immunol* 9:271-283; Donnelly et al. (1997) *Annu Rev Immunol* 15:617-648; later herein].

Gene Delivery Vehicles

Gene therapy vehicles for delivery of constructs including a coding sequence of a therapeutic of the invention, to be delivered to the mammal for expression in the mammal, can be administered either locally or systemically. These constructs can utilize viral or non-viral vector approaches in in vivo or ex vivo modality. Expression of such coding sequence can be induced using endogenous mammalian or heterologous promoters. Expression of the coding sequence in vivo can be either constitutive or regulated.

The invention includes gene delivery vehicles capable of expressing the contemplated nucleic acid sequences. The gene delivery vehicle is preferably a viral vector and, more preferably, a retroviral, adenoviral, adeno-associated viral (AAV), herpes viral, or alphavirus vector. The viral vector can also be an astrovirus, coronavirus, orthomyxovirus, papovavirus, paramyxovirus, parvovirus, picornavirus, poxvirus, or togavirus viral vector. See generally, Jolly (1994) *Cancer Gene Therapy* 1:51-64; Kimura (1994) *Human Gene Therapy* 5:845-852; Connelly (1995) *Human Gene Therapy* 6:185-193; and Kaplitt (1994) *Nature Genetics* 6:148-153.

Retroviral vectors are well known in the art and we contemplate that any retroviral gene therapy vector is employable in the invention, including B, C and D type retroviruses, xenotropic retroviruses (for example, NZB-X1, NZB-X2 and NZB9-1 (see O'Neill (1985) *J. Virol.* 53:160) polytropic retroviruses eg. MCF and MCF-MLV (see Kelly (1983) *J. Virol.* 45:291), spumaviruses and lentiviruses. See RNA Tumor Viruses, Second Edition, Cold Spring Harbor Laboratory, 1985.

Portions of the retroviral gene therapy vector may be derived from different retroviruses. For example, retrovector LTRs may be derived from a Murine Sarcoma Virus, a tRNA binding site from a Rous Sarcoma Virus, a packaging signal from a Murine Leukemia Virus, and an origin of second strand synthesis from an Avian Leukosis Virus.

These recombinant retroviral vectors may be used to generate transduction competent retroviral vector particles by introducing them into appropriate packaging cell lines (see U.S. Pat. No. 5,591,624). Retrovirus vectors can be constructed for site-specific integration into host cell DNA by incorporation of a chimeric integrase enzyme into the retroviral particle (see WO96/37626). It is preferable that the recombinant viral vector is a replication defective recombinant virus.

Packaging cell lines suitable for use with the above-described retrovirus vectors are well known in the art, are readily prepared (see WO95/30763 and WO92/05266), and can be used to create producer cell lines (also termed vector cell lines or "VCLs") for the production of recombinant vector particles. Preferably, the packaging cell lines are made from human parent cells (eg. HT1080 cells) or mink parent cell lines, which eliminates inactivation in human serum.

Preferred retroviruses for the construction of retroviral gene therapy vectors include Avian Leukosis Virus, Bovine Leukemia, Virus, Murine Leukemia Virus, Mink-Cell Focus-Inducing Virus, Murine Sarcoma Virus, Reticuloendotheliosis Virus and Rous Sarcoma Virus. Particularly preferred Murine Leukemia Viruses include 4070A and 1504A (Hartley and Rowe (1976) *J Virol* 19:19-25), Abelson (ATCC No. VR-999), Friend (ATCC No. VR-245), Graffi, Gross (ATCC Nol VR-590), Kirsten, Harvey Sarcoma Virus and Rauscher (ATCC No. VR-998) and Moloney Murine Leukemia Virus (ATCC No. VR-190). Such retroviruses may be obtained from depositories or collections such as the American Type Culture Collection ("ATCC") in Rockville, Md. or isolated from known sources using commonly available techniques.

Exemplary known retroviral gene therapy vectors employable in this invention include those described in patent applications GB2200651, EP0415731, EP0345242, EP0334301, WO89/02468; WO89/05349, WO89/09271, WO90/02806, WO90/07936, WO94/03622, WO93/25698, WO93/25234, WO93/11230, WO93/10218, WO91/02805, WO91/02825, WO95/07994, U.S. Pat. No. 5,219,740, U.S. Pat. Nos. 4,405,712, 4,861,719, 4,980,289, 4,777,127, 5,591,624. See also Vile (1993) *Cancer Res* 53:3860-3864; Vile (1993) *Cancer Res* 53:962-967; Ram (1993) *Cancer Res* 53 (1993) 83-88; Takamiya (1992) *J Neurosci Res* 33:493-503; Baba (1993) *J Neurosurg* 79:729-735; Mann (1983) *Cell* 33:153; Cane (1984) *Proc Natl Acad Sci* 81:6349; and Miller (1990) *Human Gene Therapy* 1.

Human adenoviral gene therapy vectors are also known in the art and employable in this invention. See, for example, Berkner (1988) *Biotechniques* 6:616 and Rosenfeld (1991) *Science* 252:431, and WO93/07283, WO93/06223, and WO93/07282. Exemplary known adenoviral gene therapy vectors employable in this invention include those described in the above referenced documents and in WO94/12649, WO93/03769, WO93/19191, WO94/28938, WO95/11984, WO95/00655, WO95/27071, WO95/29993, WO95/34671, WO96/05320, WO94/08026, WO94/11506, WO93/06223, WO94/24299, WO95/14102, WO95/24297, WO95/02697, WO94/28152, WO94/24299, WO95/09241, WO95/25807, WO95/05835, WO94/18922 and WO95/09654. Alternatively, administration of DNA linked to killed adenovirus as described in Curiel (1992) *Hum. Gene Ther.* 3:147-154 may be employed. The gene delivery vehicles of the invention also include adenovirus associated virus (AAV) vectors. Leading and preferred examples of such vectors for use in this invention are the AAV-2 based vectors disclosed in Srivastava, WO93/09239. Most preferred AAV vectors comprise the two AAV inverted terminal repeats in which the native D-sequences are modified by substitution of nucleotides, such that at least 5 native nucleotides and up to 18 native nucleotides, preferably at least 10 native nucleotides up to 18 native nucleotides, most preferably 10 native nucleotides are retained and the remaining nucleotides of the D-sequence are deleted or replaced with non-native nucleotides. The native D-sequences of the AAV inverted terminal repeats are sequences of 20 consecutive nucleotides in each AAV inverted terminal repeat (ie. there is one sequence at each end) which are not involved in HP formation. The non-native replacement nucleotide may be any nucleotide other than the nucleotide found in the native D-sequence in the same position. Other employable exemplary AAV vectors are pWP-19, pWN-1, both of which are disclosed in Nahreini (1993) *Gene* 124:257-262. Another example of such an AAV vector is psub201 (see Samulski (1987) *J. Virol.* 61:3096). Another exemplary AAV vector is the Double-D ITR vector. Construction of the Double-D ITR vector is disclosed in U.S. Pat. No. 5,478,745.

Still other vectors are those disclosed in Carter U.S. Pat. No. 4,797,368 and Muzyczka U.S. Pat. No. 5,139,941, Chartejee U.S. Pat. No. 5,474,935, and Kotin WO94/288157. Yet a further example of an AAV vector employable in this invention is SSV9AFABTKneo, which contains the AFP enhancer and albumin promoter and directs expression predominantly in the liver. Its structure and construction are disclosed in Su (1996) *Human Gene Therapy* 7:463-470. Additional AAV gene therapy vectors are described in U.S. Pat. Nos. 5,354,678, 5,173,414, 5,139,941, and 5,252,479.

The gene therapy vectors of the invention also include herpes vectors. Leading and preferred examples are herpes simplex virus vectors containing a sequence encoding a thymidine kinase polypeptide such as those disclosed in U.S. Pat. No. 5,288,641 and EP0176170 (Roizman). Additional exemplary herpes simplex virus vectors include HFEM/ICP6-LacZ disclosed in WO95/04139 (Wistar Institute), pHSVlac described in Geller (1988) *Science* 241:1667-1669 and in WO90/09441 and WO92/07945, HSV Us3::pgC-lacZ described in Fink (1992) *Human Gene Therapy* 3:11-19 and HSV 7134, 2 RH 105 and GAL4 described in EP 0453242 (Breakefield), and those deposited with the ATCC with accession numbers VR-977 and VR-260.

Also contemplated are alpha virus gene therapy vectors that can be employed in this invention. Preferred alpha virus vectors are Sindbis viruses vectors. Togaviruses, Semliki Forest virus (ATCC VR-67; ATCC VR-1247), Middleberg virus (ATCC VR-370), Ross River virus (ATCC VR-373; ATCC VR-1246), Venezuelan equine encephalitis virus (ATCC VR923; ATCC VR-1250; ATCC VR-1249; ATCC VR-532), and those described in U.S. Pat. Nos. 5,091,309, 5,217,879, and WO92/10578. More particularly, those alpha virus vectors described in U.S. Ser. No. 08/405,627, filed Mar. 15, 1995, WO94/21792, WO92/10578, WO95/07994, U.S. Pat. Nos. 5,091,309 and 5,217,879 are employable. Such alpha viruses may be obtained from depositories or collections such as the ATCC in Rockville, Md. or isolated from known sources using commonly available techniques. Preferably, alphavirus vectors with reduced cytotoxicity are used (see U.S. Ser. No. 08/679,640).

DNA vector systems such as eukaryotic layered expression systems are also useful for expressing the nucleic acids of the invention. See WO95/07994 for a detailed description of eukaryotic layered expression systems. Preferably, the eukaryotic layered expression systems of the invention are derived from alphavirus vectors and most preferably from Sindbis viral vectors.

Other viral vectors suitable for use in the present invention include those derived from poliovirus, for example ATCC VR-58 and those described in Evans, Nature 339 (1989) 385 and Sabin (1973) *J. Biol. Standardization* 1:115; rhinovirus, for example ATCC VR-1110 and those described in Arnold (1990) *J Cell Biochem* L401; pox viruses such as canary pox virus or vaccinia virus, for example ATCC VR-111 and ATCC VR-2010 and those described in Fisher-Hoch (1989) *Proc Natl Acad Sci* 86:317; Flexner (1989) *Ann NY Acad Sci* 569:86, Flexner (1990) *Vaccine* 8:17; in U.S. Pat. No. 4,603,112 and U.S. Pat. No. 4,769,330 and WO89/01973; SV40 virus, for example ATCC VR-305 and those described in Mulligan (1979) *Nature* 277:108 and Madzak (1992) *J Gen Virol* 73:1533; influenza virus, for example ATCC VR-797 and recombinant influenza viruses made employing reverse genetics techniques as described in U.S. Pat. No. 5,166,057 and in Enami (1990) *Proc Natl Acad Sci* 87:3802-3805; Enami & Palese (1991) *J Virol* 65:2711-2713 and Luytjes (1989) *Cell* 59:110, (see also McMichael (1983) *NEJ Med* 309:13, and Yap (1978) *Nature* 273:238 and Nature (1979)

277:108); human immunodeficiency virus as described in EP-0386882 and in Buchschacher (1992) *J. Virol.* 66:2731; measles virus, for example ATCC VR-67 and VR-1247 and those described in EP-0440219; Aura virus, for example ATCC VR-368; Bebaru virus, for example ATCC VR-600 and ATCC VR-1240; Cabassou virus, for example ATCC VR-922; Chikungunya virus, for example ATCC VR-64 and ATCC VR-1241; Fort Morgan Virus, for example ATCC VR-924; Getah virus, for example ATCC VR-369 and ATCC VR-1243; Kyzylagach virus, for example ATCC VR-927; Mayaro virus, for example ATCC VR-66; Mucambo virus, for example ATCC VR-580 and ATCC VR-1244; Ndumu virus, for example ATCC VR-371; Pixuna virus, for example ATCC VR-372 and ATCC VR-1245; Tonate virus, for example ATCC VR-925; Triniti virus, for example ATCC VR-469; Una virus, for example ATCC VR-374; Whataroa virus, for example ATCC VR-926; Y-62-33 virus, for example ATCC VR-375; O'Nyong virus, Eastern encephalitis virus, for example ATCC VR-65 and ATCC VR-1242; Western encephalitis virus, for example ATCC VR-70, ATCC VR-1251, ATCC VR-622 and ATCC VR-1252; and coronavirus, for example ATCC VR-740 and those described in Hamre (1966) *Proc Soc Exp Biol Med* 121:190.

Delivery of the compositions of this invention into cells is not limited to the above mentioned viral vectors. Other delivery methods and media may be employed such as, for example, nucleic acid expression vectors, polycationic condensed DNA linked or unlinked to killed adenovirus alone, for example see U.S. Ser. No. 08/366,787, filed Dec. 30, 1994 and Curiel (1992) *Hum Gene Ther* 3:147-154 ligand linked DNA, for example see Wu (1989) *J Biol Chem* 264:16985-16987, eucaryotic cell delivery vehicles cells, for example see U.S. Ser. No. 08/240,030, filed May 9, 1994, and U.S. Ser. No. 08/404,796, deposition of photopolymerized hydrogel materials, hand-held gene transfer particle gun, as described in U.S. Pat. No. 5,149,655, ionizing radiation as described in U.S. Pat. No. 5,206,152 and in WO92/11033, nucleic charge neutralization or fusion with cell membranes. Additional approaches are described in Philip (1994) *Mol Cell Biol* 14:2411-2418 and in Woffendin (1994) *Proc Natl Acad Sci* 91:1581-1585.

Particle mediated gene transfer may be employed, for example see U.S. Ser. No. 60/023,867. Briefly, the sequence can be inserted into conventional vectors that contain conventional control sequences for high level expression, and then be incubated with synthetic gene transfer molecules such as polymeric DNA-binding cations like polylysine, protamine, and albumin, linked to cell targeting ligands such as asialoorosomucoid, as described in Wu & Wu (1987) *J. Biol. Chem.* 262:4429-4432, insulin as described in Hucked (1990) *Biochem Pharmacol* 40:253-263, galactose as described in Plank (1992) *Bioconjugate Chem* 3:533-539, lactose or transferrin.

Naked DNA may also be employed. Exemplary naked DNA introduction methods are described in WO 90/11092 and U.S. Pat. No. 5,580,859. Uptake efficiency may be improved using biodegradable latex beads. DNA coated latex beads are efficiently transported into cells after endocytosis initiation by the beads. The method may be improved further by treatment of the beads to increase hydrophobicity and thereby facilitate disruption of the endosome and release of the DNA into the cytoplasm.

Liposomes that can act as gene delivery vehicles are described in U.S. Pat. No. 5,422,120, WO95/13796, WO94/23697, WO91/14445 and EP-524,968. As described in U.S. Ser. No. 60/023,867, on non-viral delivery, the nucleic acid sequences encoding a polypeptide can be inserted into conventional vectors that contain conventional control sequences for high level expression, and then be incubated with synthetic gene transfer molecules such as polymeric DNA-binding cations like polylysine, protamine, and albumin, linked to cell targeting ligands such as asialoorosomucoid, insulin, galactose, lactose, or transferrin. Other delivery systems include the use of liposomes to encapsulate DNA comprising the gene under the control of a variety of tissue-specific or ubiquitously-active promoters. Further non-viral delivery suitable for use includes mechanical delivery systems such as the approach described in Woffendin et al (1994) *Proc. Natl. Acad. Sci. USA* 91(24):11581-11585. Moreover, the coding sequence and the product of expression of such can be delivered through deposition of photopolymerized hydrogel materials. Other conventional methods for gene delivery that can be used for delivery of the coding sequence include, for example, use of hand-held gene transfer particle gun, as described in U.S. Pat. No. 5,149,655; use of ionizing radiation for activating transferred gene, as described in U.S. Pat. No. 5,206,152 and WO92/11033

Exemplary liposome and polycationic gene delivery vehicles are those described in U.S. Pat. Nos. 5,422,120 and 4,762,915; in WO 95/13796; WO94/23697; and WO91/14445; in EP-0524968; and in Stryer, Biochemistry, pages 236-240 (1975) W.H. Freeman, San Francisco; Szoka (1980) *Biochem Biophys Acta* 600:1; Bayer (1979) *Biochem Biophys Acta* 550:464; Rivnay (1987) *Meth Enzymol* 149:119; Wang (1987) *Proc Natl Acad Sci* 84:7851; Plant (1989) *Anal Biochem* 176:420.

A polynucleotide composition can comprises therapeutically effective amount of a gene therapy vehicle, as the term is defined above. For purposes of the present invention, an effective dose will be from about 0.01 mg/kg to 50 mg/kg or 0.05 mg/kg to about 10 mg/kg of the DNA constructs in the individual to which it is administered.

Delivery Methods

Once formulated, the polynucleotide compositions of the invention can be administered (1) directly to the subject; (2) delivered ex vivo, to cells derived from the subject; or (3) in vitro for expression of recombinant proteins. The subjects to be treated can be mammals or birds. Also, human subjects can be treated.

Direct delivery of the compositions will generally be accomplished by injection, either subcutaneously, intraperitoneally, intravenously or intramuscularly or delivered to the interstitial space of a tissue. The compositions can also be administered into a lesion. Other modes of administration include oral and pulmonary administration, suppositories, and transdermal or transcutaneous applications (eg. see WO98/20734), needles, and gene guns or hyposprays. Dosage treatment may be a single dose schedule or a multiple dose schedule.

Methods for the ex vivo delivery and reimplantation of transformed cells into a subject are known in the art and described in eg. WO93/14778. Examples of cells useful in ex vivo applications include, for example, stem cells, particularly hematopoetic, lymph cells, macrophages, dendritic cells, or tumor cells.

Generally, delivery of nucleic acids for both ex vivo and in vitro applications can be accomplished by the following procedures, for example, dextran-mediated transfection, calcium phosphate precipitation, polybrene mediated transfection, protoplast fusion, electroporation, encapsulation of the polynucleotide(s) in liposomes, and direct microinjection of the DNA into nuclei, all well known in the art.

Polynucleotide and Polypeptide Pharmaceutical Compositions

In addition to the pharmaceutically acceptable carriers and salts described above, the following additional agents can be used with polynucleotide and/or polypeptide compositions.

A. Polypeptides

One example are polypeptides which include, without limitation: asioloorosomucoid (ASOR); transferrin; asialoglycoproteins; antibodies; antibody fragments; ferritin; interleukins; interferons, granulocyte, macrophage colony stimulating factor (GM-CSF), granulocyte colony stimulating factor (G-CSF), macrophage colony stimulating factor (M-CSF), stem cell factor and erythropoietin. Viral antigens, such as envelope proteins, can also be used. Also, proteins from other invasive organisms, such as the 17 amino acid peptide from the circumsporozoite protein of *plasmodium falciparum* known as RII.

B. Hormones, Vitamins, etc.

Other groups that can be included are, for example: hormones, steroids, androgens, estrogens, thyroid hormone, or vitamins, folic acid.

C. Polyalkylenes, Polysaccharides. Etc.

Also, polyalkylene glycol can be included with the desired polynucleotides/polypeptides. In a preferred embodiment, the polyalkylene glycol is polyethlylene glycol. In addition, mono-, di-, or polysaccharides can be included. In a preferred embodiment of this aspect, the polysaccharide is dextran or DEAE-dextran. Also, chitosan and poly(lactide-co-glycolide)

D. Lipids, and Liposomes

The desired polynucleotide/polypeptide can also be encapsulated in lipids or packaged in liposomes prior to delivery to the subject or to cells derived therefrom.

Lipid encapsulation is generally accomplished using liposomes which are able to stably bind or entrap and retain nucleic acid. The ratio of condensed polynucleotide to lipid preparation can vary but will generally be around 1:1 (mg DNA:micromoles lipid), or more of lipid. For a review of the use of liposomes as carriers for delivery of nucleic acids, see, Hug and Sleight (1991) *Biochim. Biophys. Acta.* 1097:1-17; Straubinger (1983) *Meth. Enzymol.* 101:512-527.

Liposomal preparations for use in the present invention include cationic (positively charged), anionic (negatively charged) and neutral preparations. Cationic liposomes have been shown to mediate intracellular delivery of plasmid DNA (Felgner (1987) *Proc. Natl. Acad. Sci. USA* 84:7413-7416); mRNA (Malone (1989) *Proc. Natl. Acad. Sci. USA* 86:6077-6081); and purified transcription factors (Debs (1990) *J. Biol. Chem.* 265:10189-10192), in functional form.

Cationic liposomes are readily available. For example, N[1-2,3-dioleyloxy)propyl]-N,N,N-triethyl-ammonium (DOTMA) liposomes are available under the trademark Lipofectin, from GIBCO BRL, Grand Island, N.Y. (See, also, Felgner supra). Other commercially available liposomes include transfectace (DDAB/DOPE) and DOTAP/DOPE (Boerhinger). Other cationic liposomes can be prepared from readily available materials using techniques well known in the art. See, eg. Szoka (1978) *Proc. Natl. Acad. Sci. USA* 75:4194-4198; WO90/11092 for a description of the synthesis of DOTAP (1,2-bis(oleoyloxy)-3-(trimethylammonio) propane) liposomes.

Similarly, anionic and neutral liposomes are readily available, such as from Avanti Polar Lipids (Birmingham, Ala.), or can be easily prepared using readily available materials. Such materials include phosphatidyl choline, cholesterol, phosphatidyl ethanolamine, dioleoylphosphatidyl choline (DOPC), dioleoylphosphatidyl glycerol (DOPG), dioleoylphoshatidyl ethanolamine (DOPE), among others. These materials can also be mixed with the DOTMA and DOTAP starting materials in appropriate ratios. Methods for making liposomes using these materials are well known in the art.

The liposomes can comprise multilammelar vesicles (MLVs), small unilamellar vesicles (SUVs), or large unilamellar vesicles (LUVs). The various liposome-nucleic acid complexes are prepared using methods known in the art. See eg. Straubinger (1983) *Meth. Immunol.* 101:512-527; Szoka (1978) *Proc. Natl. Acad. Sci. USA* 75:4194-4198; Papahadjopoulos (1975) *Biochim. Biophys. Acta* 394:483; Wilson (1979) *Cell* 17:77); Deamer & Bangham (1976) *Biochim. Biophys. Acta* 443:629; Ostro (1977) *Biochem. Biophys. Res. Commun.* 76:836; Fraley (1979) *Proc. Natl. Acad. Sci. USA* 76:3348); Enoch & Strittmatter (1979) *Proc. Natl. Acad. Sci. USA* 76:145; Fraley (1980) *J. Biol. Chem.* (1980) 255:10431; Szoka & Papahadjopoulos (1978) *Proc. Natl. Acad. Sci. USA* 75:145; and Schaefer-Ridder (1982) *Science* 215:166.

E. Lipoproteins

In addition, lipoproteins can be included with the polynucleotide/polypeptide to be delivered. Examples of lipoproteins to be utilized include: chylomicrons, HDL, IDL, LDL, and VLDL. Mutants, fragments, or fusions of these proteins can also be used. Also, modifications of naturally occurring lipoproteins can be used, such as acetylated LDL. These lipoproteins can target the delivery of polynucleotides to cells expressing lipoprotein receptors. Preferably, if lipoproteins are including with the polynucleotide to be delivered, no other targeting ligand is included in the composition.

Naturally occurring lipoproteins comprise a lipid and a protein portion. The protein portion are known as apoproteins. At the present, apoproteins A, B, C, D, and E have been isolated and identified. At least two of these contain several proteins, designated by Roman numerals, AI, AII, AIV; CI, CII, CIII.

A lipoprotein can comprise more than one apoprotein. For example, naturally occurring chylomicrons comprises of A, B, C & E, over time these lipoproteins lose A and acquire C & E. VLDL comprises A, B, C & E apoproteins, LDL comprises apoprotein B; and HDL comprises apoproteins A, C, & E.

The amino acid of these apoproteins are known and are described in, for example, Breslow (1985) *Annu Rev. Biochem* 54:699; Law (1986) *Adv. Exp Med. Biol.* 151:162; Chen (1986) *J Biol Chem* 261:12918; Kane (1980) *Proc Natl Acad Sci USA* 77:2465; and Utermann (1984) *Hum Genet* 65:232.

Lipoproteins contain a variety of lipids including, triglycerides, cholesterol (free and esters), and phospholipids. The composition of the lipids varies in naturally occurring lipoproteins. For example, chylomicrons comprise mainly triglycerides. A more detailed description of the lipid content of naturally occurring lipoproteins can be found, for example, in *Meth. Enzymol.* 128 (1986). The composition of the lipids are chosen to aid in conformation of the apoprotein for receptor binding activity. The composition of lipids can also be chosen to facilitate hydrophobic interaction and association with the polynucleotide binding molecule.

Naturally occurring lipoproteins can be isolated from serum by ultracentrifugation, for instance. Such methods are described in *Meth. Enzymol.* (supra); Pitas (1980) *J. Biochem.* 255:5454-5460 and Mahey (1979) *J. Clin. Invest* 64:743-750. Lipoproteins can also be produced by in vitro or recombinant methods by expression of the apoprotein genes in a desired host cell. See, for example, Atkinson (1986) *Annu Rev Biophys Chem* 15:403 and Radding (1958) *Biochim Biophys Acta* 30:443. Lipoproteins can also be purchased from commercial suppliers, such as Biomedical Techniologies, Inc., Stoughton, Mass., USA. Further description of lipoproteins can be found in WO98/06437.

F. Polycationic Agents

Polycationic agents can be included, with or without lipoprotein, in a composition with the desired polynucleotide/polypeptide to be delivered.

Polycationic agents, typically, exhibit a net positive charge at physiological relevant pH and are capable of neutralizing the electrical charge of nucleic acids to facilitate delivery to a desired location. These agents have both in vitro, ex vivo, and in vivo applications. Polycationic agents can be used to deliver nucleic acids to a living subject either intramuscularly, subcutaneously, etc.

The following are examples of useful polypeptides as polycationic agents: polylysine, polyarginine, polyornithine, and protamine. Other examples include histones, protamines, human serum albumin, DNA binding proteins, non-histone chromosomal proteins, coat proteins from DNA viruses, such as (X174, transcriptional factors also contain domains that bind DNA and therefore may be useful as nucleic aid condensing agents. Briefly, transcriptional factors such as C/CEBP, c-jun, c-fos, AP-1, AP-2, AP-3, CPF, Prot-1, Sp-1, Oct-1, Oct-2, CREP, and TFIID contain basic domains that bind DNA sequences.

Organic polycationic agents include: spermine, spermidine, and purtrescine.

The dimensions and of the physical properties of a polycationic agent can be extrapolated from the list above, to construct other polypeptide polycationic agents or to produce synthetic polycationic agents.

Synthetic polycationic agents which are useful include, for example, DEAE-dextran, polybrene. Lipofectin™, and lipofectAMINE™ are monomers that form polycationic complexes when combined with polynucleotides/polypeptides.

Immunodiagnostic Assays

*Streptococcus* antigens of the invention can be used in immunoassays to detect antibody levels (or, conversely, anti-*streptococcus* antibodies can be used to detect antigen levels). Immunoassays based on well defined, recombinant antigens can be developed to replace invasive diagnostics methods. Antibodies to *streptococcus* proteins within biological samples, including for example, blood or serum samples, can be detected. Design of the immunoassays is subject to a great deal of variation, and a variety of these are known in the art. Protocols for the immunoassay may be based, for example, upon competition, or direct reaction, or sandwich type assays. Protocols may also, for example, use solid supports, or may be by immunoprecipitation. Most assays involve the use of labeled antibody or polypeptide; the labels may be, for example, fluorescent, chemiluminescent, radioactive, or dye molecules. Assays which amplify the signals from the probe are also known; examples of which are assays which utilize biotin and avidin, and enzyme-labeled and mediated immunoassays, such as ELISA assays.

Kits suitable for immunodiagnosis and containing the appropriate labeled reagents are constructed by packaging the appropriate materials, including the compositions of the invention, in suitable containers, along with the remaining reagents and materials (for example, suitable buffers, salt solutions, etc.) required for the conduct of the assay, as well as suitable set of assay instructions.

Nucleic Acid Hybridisation

"Hybridization" refers to the association of two nucleic acid sequences to one another by hydrogen bonding. Typically, one sequence will be fixed to a solid support and the other will be free in solution. Then, the two sequences will be placed in contact with one another under conditions that favor hydrogen bonding. Factors that affect this bonding include: the type and volume of solvent; reaction temperature; time of hybridization; agitation; agents to block the non-specific attachment of the liquid phase sequence to the solid support (Denhardt's reagent or BLOTTO); concentration of the sequences; use of compounds to increase the rate of association of sequences (dextran sulfate or polyethylene glycol); and the stringency of the washing conditions following hybridization. See Sambrook et al. [supra] Volume 2, chapter 9, pages 9.47 to 9.57.

"Stringency" refers to conditions in a hybridization reaction that favor association of very similar sequences over sequences that differ. For example, the combination of temperature and salt concentration should be chosen that is approximately 120 to 200° C. below the calculated Tm of the hybrid under study. The temperature and salt conditions can often be determined empirically in preliminary experiments in which samples of genomic DNA immobilized on filters are hybridized to the sequence of interest and then washed under conditions of different stringencies. See Sambrook et al. at page 9.50.

Variables to consider when performing, for example, a Southern blot are (1) the complexity of the DNA being blotted and (2) the homology between the probe and the sequences being detected. The total amount of the fragment(s) to be studied can vary a magnitude of 10, from 0.1 to 1 µg for a plasmid or phage digest to $10^{-9}$ to $10^{-8}$ g for a single copy gene in a highly complex eukaryotic genome. For lower complexity polynucleotides, substantially shorter blotting, hybridization, and exposure times, a smaller amount of starting polynucleotides, and lower specific activity of probes can be used. For example, a single-copy yeast gene can be detected with an exposure time of only 1 hour starting with 1 µg of yeast DNA, blotting for two hours, and hybridizing for 4-8 hours with a probe of $10^8$ cpm/µg. For a single-copy mammalian gene a conservative approach would start with 10 µg of DNA, blot overnight, and hybridize overnight in the presence of 10% dextran sulfate using a probe of greater than $10^8$ cpm/µg, resulting in an exposure time of ~24 hours.

Several factors can affect the melting temperature (Tm) of a DNA-DNA hybrid between the probe and the fragment of interest, and consequently, the appropriate conditions for hybridization and washing. In many cases the probe is not 100% homologous to the fragment. Other commonly encountered variables include the length and total G+C content of the hybridizing sequences and the ionic strength and formamide content of the hybridization buffer. The effects of all of these factors can be approximated by a single equation:

$$Tm=81+16.6(\log_{10}Ci)+0.4[\%(G+C)]-0.6(\% \text{ formamide})-600/n-1.5(\% \text{ mismatch}).$$

where Ci is the salt concentration (monovalent ions) and n is the length of the hybrid in base pairs (slightly modified from Meinkoth & Wahl (1984) *Anal. Biochem.* 138: 267-284).

In designing a hybridization experiment, some factors affecting nucleic acid hybridization can be conveniently altered. The temperature of the hybridization and washes and the salt concentration during the washes are the simplest to adjust. As the temperature of the hybridization increases (ie. stringency), it becomes less likely for hybridization to occur between strands that are nonhomologous, and as a result, background decreases. If the radiolabeled probe is not completely homologous with the immobilized fragment (as is frequently the case in gene family and interspecies hybridization experiments), the hybridization temperature must be reduced, and background will increase. The temperature of the washes affects the intensity of the hybridizing band and the degree of background in a similar manner. The stringency of the washes is also increased with decreasing salt concentrations.

In general, convenient hybridization temperatures in the presence of 50% formamide are 42° C. for a probe with is 95% to 100% homologous to the target fragment, 37° C. for 90% to 95% homology, and 32° C. for 85% to 90% homology. For lower homologies, formamide content should be lowered and temperature adjusted accordingly, using the equation above. If the homology between the probe and the target fragment are not known, the simplest approach is to start with both hybridization and wash conditions which are nonstringent. If non-specific bands or high background are observed after autoradiography, the filter can be washed at high stringency and reexposed. If the time required for exposure makes this approach impractical, several hybridization and/or washing stringencies should be tested in parallel.

Nucleic Acid Probe Assays

Methods such as PCR, branched DNA probe assays, or blotting techniques utilizing nucleic acid probes according to the invention can determine the presence of cDNA or mRNA. A probe is said to "hybridize" with a sequence of the invention if it can form a duplex or double stranded complex, which is stable enough to be detected.

The nucleic acid probes will hybridize to the *streptococcus* nucleotide sequences of the invention (including both sense and antisense strands). Though many different nucleotide sequences will encode the amino acid sequence, the native *streptococcus* sequence is preferred because it is the actual sequence present in cells. mRNA represents a coding sequence and so a probe should be complementary to the coding sequence; single-stranded cDNA is complementary to mRNA, and so a cDNA probe should be complementary to the non-coding sequence.

The probe sequence need not be identical to the *streptococcus* sequence (or its complement)—some variation in the sequence and length can lead to increased assay sensitivity if the nucleic acid probe can form a duplex with target nucleotides, which can be detected. Also, the nucleic acid probe can include additional nucleotides to stabilize the formed duplex. Additional *streptococcus* sequence may also be helpful as a label to detect the formed duplex. For example, a non-complementary nucleotide sequence may be attached to the 5' end of the probe, with the remainder of the probe sequence being complementary to a *streptococcus* sequence. Alternatively, non-complementary bases or longer sequences can be interspersed into the probe, provided that the probe sequence has sufficient complementarity with the a *streptococcus* sequence in order to hybridize therewith and thereby form a duplex which can be detected.

The exact length and sequence of the probe will depend on the hybridization conditions (e.g. temperature, salt condition etc.). For example, for diagnostic applications, depending on the complexity of the analyte sequence, the nucleic acid probe typically contains at least 10-20 nucleotides, preferably 15-25, and more preferably at least 30 nucleotides, although it may be shorter than this. Short primers generally require cooler temperatures to form sufficiently stable hybrid complexes with the template.

Probes may be produced by synthetic procedures, such as the triester method of Matteucci et al. [*J. Am. Chem. Soc.* (1981) 103:3185], or according to Urdea et al. [*Proc. Natl. Acad. Sci. USA* (1983) 80: 7461], or using commercially available automated oligonucleotide synthesizers.

The chemical nature of the probe can be selected according to preference. For certain applications, DNA or RNA are appropriate. For other applications, modifications may be incorporated eg. backbone modifications, such as phosphorothioates or methylphosphonates, can be used to increase in vivo half-life, alter RNA affinity, increase nuclease resistance etc. [eg. see Agrawal & Iyer (1995) *Curr Opin Biotechnol* 6:12-19; Agrawal (1996) *TIBTECH* 14:376-387]; analogues such as peptide nucleic acids may also be used [eg. see Corey (1997) *TIBTECH* 15:224-229; Buchardt et al. (1993) *TIBTECH* 11:384-386].

Alternatively, the polymerase chain reaction (PCR) is another well-known means for detecting small amounts of target nucleic acid. The assay is described in Mullis et al. [*Meth. Enzymol.* (1987) 155:335-350] & U.S. Pat. Nos. 4,683,195 & 4,683,202. Two "primer" nucleotides hybridize with the target nucleic acids and are used to prime the reaction. The primers can comprise sequence that does not hybridize to the sequence of the amplification target (or its complement) to aid with duplex stability or, for example, to incorporate a convenient restriction site. Typically, such sequence will flank the desired *streptococcus* sequence.

A thermostable polymerase creates copies of target nucleic acids from the primers using the original target nucleic acids as a template. After a threshold amount of target nucleic acids are generated by the polymerase, they can be detected by more traditional methods, such as Southern blots. When using the Southern blot method, the labelled probe will hybridize to the *streptococcus* sequence (or its complement).

Also, mRNA or cDNA can be detected by traditional blotting techniques described in Sambrook et al [supra]. mRNA, or cDNA generated from mRNA using a polymerase enzyme, can be purified and separated using gel electrophoresis. The nucleic acids on the gel are then blotted onto a solid support, such as nitrocellulose. The solid support is exposed to a labelled probe and then washed to remove any unhybridized probe. Next, the duplexes containing the labeled probe are detected. Typically, the probe is labelled with a radioactive moiety.

BRIEF DESCRIPTION OF DRAWINGS

FIGS. 88 to 118 and 247 to 319 show protein characterisation data for various proteins of the invention.

MODES FOR CARRYING OUT THE INVENTION

Figure 1:
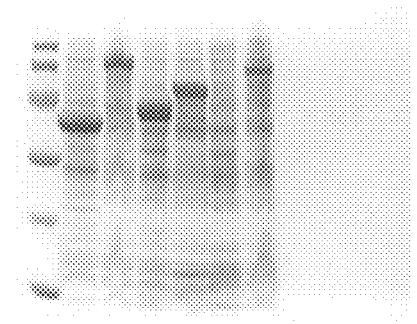
FIGS. 1 to 85, 119 to 188, 238 and 239 show SDS-PAGE analysis of total cell extracts from cultures of recombinant *E. coli* expressing GBS proteins of the invention. Lane 1 in each gel (except for FIG. 185) contains molecular weight markers. These are 94, 67, 43, 30, 20.1 & 14.4 kDa (except for FIGS. 7, 8, 10, 11, 13, 14, 15 and 119-170, which use 250, 150, 100, 75, 50, 37, 25, 15 & 10 kDa).

The following examples describe nucleic acid sequences which have been identified in *Streptococcus*, along with their inferred translation products. The examples are generally in the following format:

a nucleotide sequence which has been identified in *Streptococcus*
   the inferred translation product of this sequence
   a computer analysis (e.g. PSORT output) of the translation product, indicating antigenicity Most examples describe nucleotide sequences from *S. agalactiae*. The specific strain which was sequenced was from serotype V, and is a clinical strain isolated in Italy which expresses the R antigen (ISS/Rome/Italy collection, strain.2603 V/R). For several of these examples, the corresponding sequences from *S. pyogenes* are also given. Where GBS and GAS show homology in this way, there is conservation between species which suggests an essential function and also gives good cross-species reactivity.

In contrast, several examples describe nucleotide sequences from GAS for which no homolog in GBS has been identified. This lack of homology gives molecules which are useful for distinguishing GAS from GBS and for making GAS-specific products. The same is true for GBS sequences which lack GAS homologs e.g. these are useful for making GBS-specific products.

The examples typically include details of homology to sequences in the public databases. Proteins that are similar in sequence are generally similar in both structure and function, and the homology often indicates a common evolutionary origin. Comparison with sequences of proteins of known function is widely used as a guide for the assignment of putative protein function to a new sequence and has proved particularly useful in whole-genome analyses.

Various tests can be used to assess the in vivo immunogenicity of the proteins identified in the examples. For example, the proteins can be expressed recombinantly and used to screen patient sera by immunoblot. A positive reaction between the protein and patient serum indicates that the patient has previously mounted an immune response to the protein in question i.e. the protein is an immunogen. This method can also be used to identify immunodominant proteins. The mouse model used in the examples can also be used.

The recombinant protein can also be conveniently used to prepare antibodies e.g. in a mouse. These can be used for direct confirmation that a protein is located on the cell-surface. Labelled antibody (e.g. fluorescent labelling for FACS) can be incubated with intact bacteria and the presence of label on the bacterial surface confirms the location of the protein.

For many GBS proteins, the following data are given:
SDS-PAGE analysis of total recombinant *E. coli* cell extracts for GBS protein expression
SDS-PAGE analysis after the protein purification
Western-blot analysis of GBS total cell extract using antisera raised against recombinant proteins
FACS and ELISA analysis against GBS using antisera raise against recombinant proteins
Results of the in vivo passive protection assay
Details of experimental techniques used are presented below:

Sequence Analysis

Open reading frames (ORFs) within nucleotide sequences were predicted using the GLIMMER program [Salzberg et al. (1998) *Nucleic Acids Res* 26:544-8]. Where necessary, start codons were modified and corrected manually on the basis of the presence of ribosome-binding sites and promoter regions on the upstream DNA sequence.

ORFs were then screened against the non-redundant protein databases using the programs BLASTp [Altschul et al. (1990) *J. Mol. Biol.* 215:403-410] and PRAZE, a modification of the Smith-Waterman algorithm [Smith & Waterman (1981) *J Mol Biol* 147:195-7; see Fleischmann et al (1995) *Science* 269:496-512].

Leader peptides within the ORFs were located using three different approaches: (i) PSORT [Nakai (1991) *Bull. Inst. Chem. Res., Kyoto Univ.* 69:269-291; Horton & Nakai (1996) *Intellig. Syst. Mol. Biol.* 4:109-115; Horton & Nakai (1997) *Intellig. Syst. Mol. Biol.* 5:147-152]; (ii) SignalP [Nielsen & Krogh (1998) in *Proceedings of the Sixth International Conference on Intelligent Systems for Molecular Biology (ISMB 6)*, AAAI Press, Menlo Park, Calif., pp. 122-130; Nielsen et al. (1999) *Protein Engineering* 12:3-9; Nielsen et al. (1997). *Int. J. Neural Sys.* 8:581-599]; and (iii) visual inspection of the ORF sequences. Where a signal sequences is given a "possible site" value, the value represents the C-terminus residue of the signal peptide e.g. a "possible site" of 26 means that the signal sequence consists of amino acids 1-26.

Lipoprotein-specific signal peptides were located using three different approaches: (i) PSORT [see above]; (ii) the "prokaryotic membrane lipoprotein lipid attachment site" PROSITE motif [Hofmann et al. (1999) *Nucleic Acids Res.* 27:215-219; Bucher & Bairoch (1994) in *Proceedings 2nd International Conference on Intelligent Systems for Molecular Biology* (ISMB-94), AAAI Press, pages 53-61]; and (iii) the FINDPATTERNS program available in the GCG Wisconsin Package, using the pattern (M, L, V)x{9, 35} LxxCx.

Transmembrane domains were located using two approaches: (i) PSORT [see above]; (ii) TopPred [von Heijne (1992) *J. Mol. Biol.* 225:487-494].

LPXTG motifs, characteristic of cell-wall attached proteins in Gram-positive bacteria [Fischetti et al. (1990) *Mol Microbiol* 4:1603-5] were located, with FINDPATTERNS using the pattern (L, I, V, M, Y, F)Px(T, A, S, G)(G, N, S, T, A, L).

RGD motifs, characteristic of cell-adhesion molecules [D'Souza et al. (1991) *Trends Biochem Sci* 16:246-50] were located using FINDPATTERNS.

Enzymes belonging to the glycolytic pathway were also selected as antigens, because these have been found experimentally expressed on the surface of Streptococci [e.g. Pancholi & Fischetti (1992) *J Exp Med* 176:415-26; Pancholi & Fischetti (1998) *J Biol Chem* 273:14503-15].

Cloning, Expression and Purification of Proteins

GBS genes were cloned to facilitate expression in *E. coli* as two different types of fusion proteins:
a) proteins having a hexa-histidine tag at the amino-terminus (His-gbs)
b) proteins having a GST fusion partner at the amino-terminus (Gst-gbs)

Cloning was performed using the Gateway™ technology (Life Technologies), which is based on the site-specific recombination reactions that mediate integration and excision of phage lambda into and from the *E. coli* genome. A single cloning experiment included the following steps:
1—Amplification of GBS chromosomal DNA to obtain a PCR product coding for a single ORF flanked by attB recombination sites.
2—Insertion of the PCR product into a pDONR vector (containing attP sites) through a BP reaction (attB×attP sites). This reaction gives a so called 'pEntry' vector, which now contains attL sites flanking the insert.
3—Insertion of the GBS gene into *E. coli* expression vectors (pDestination vectors, containing attR sites) through a LR reaction between pEntry and pDestination plasmids (attL×attR sites).

A) Chromosomal DNA Preparation

For chromosomal DNA preparation, GBS strain 2603 V/R (Istituto Superiore Sanita, Rome) was grown to exponential phase in 2 liters TH Broth (Difco) at 37° C., harvested by centrifugation, and dissolved in 40 ml TES (50 mM Tris pH 8, 5 mM EDTA pH 8, 20% sucrose). After addition of 2.5 ml lysozyme solution (25 mg/ml in TES) and 0.5 ml mutanolysin (Sigma M-9901, 25000 U/ml in $H_2O$), the suspension was incubated at 37° C. for 1 hour. 1 ml RNase (20 mg/ml) and 0.1 ml proteinase K (20 mg/ml) were added and incubation was continued for 30 min. at 37° C.

Cell lysis was obtained by adding 5 ml sarkosyl solution (10% N-laurylsarcosine in 250 mM EDTA pH 8.0), and incubating 1 hour at 37° C. with frequent inversion. After sequential extraction with phenol, phenol-chloroform and chloroform, DNA was precipitated with 0.3M sodium acetate pH 5.2 and 2 volumes of absolute ethanol. The DNA pellet was rinsed with 70% ethanol and dissolved in TE buffer (10 mM Tris-HCl, 1 mM EDTA, pH 8). DNA concentration was evaluated by $OD_{260}$.

B) Oligonucleotide Design

Synthetic oligonucleotide primers were designed on the basis of the coding sequence of each ORF. The aim was to express the protein's extracellular region. Accordingly, predicted signal peptides were omitted (by deducing the 5' end amplification primer sequence immediately downstream from the predicted leader sequence) and C-terminal cell-wall ancoring regions were removed (e.g. LPXTG motifs and downstream amino acids). Where additional nucleotides have been deleted, this is indicated by the suffix 'd' (e.g. 'GBS352d'—see Table V). Conversely, a suffix 'L' refers to expression without these deletions. Deletions of C- or N-terminal residues were also sometimes made, as indicated by a 'C' or 'N' suffix.

The amino acid sequences of the expressed GBS proteins (including 'd' and 'L' forms etc.) are definitively defined by the sequences of the oligonucleotides primers given in Table II.

5' tails of forward primers and 3' tails of reverse primers included attB1 and attB2 sites respectively:

Forward primers: 5'-GGGGACAAGTTTGTACAAAAAA GCAGGCTCT-ORF in frame-3' (the TCT sequence preceding the ORF was omitted when the ORF's first coding triplet began with T).

Reverse primers: 5'-GGGGACCACTTTGTACAAGAA AGCTGGGTT-ORF reverse complement-3'.

The number of nucleotides which hybridized to the sequence to be amplified depended on the melting temperature of the primers, which was determined as described by Breslauer et al. [*PNAS USA* (1986) 83:3746-50]. The average melting temperature of the selected oligos was 50-55° C. for the hybridizing region and 80-85° C. for the whole oligos.

C) Amplification

The standard PCR protocol was as follows: 50 ng genomic DNA were used as template in the presence of 0.5 μM each primer, 200 μM each dNTP, 1.5 mM $MgCl_2$, 1× buffer minus $Mg^{++}$ (Gibco-BRL) and 2 units of Taq DNA polymerase (Platinum Taq, Gibco-BRL) in a final volume of 100 μl. Each sample underwent a double-step of amplification: 5 cycles performed using as the hybridizing temperature 50° C., followed by 25 cycles at 68° C.

The standard cycles were as follows:

| | |
|---|---|
| | Denaturation: 94° C., 2 min |
| 5 cycles: | Denaturation: 94° C., 30 seconds |
| | Hybridization: 50° C., 50 seconds |
| | Elongation: 72° C., 1 min. or 2 min. and 40 sec. |
| 25 cycles: | Denaturation: 94° C., 30 seconds |
| | Hybridization: 68° C., 50 seconds |
| | Elongation: 72° C., 1 min. or 2 min. and 40 sec. |

Elongation time was 1 minute for ORFs shorter than 2000 bp and 2:40 minutes for ORFs longer than 2000 bp. Amplifications were performed using a Gene Amp PCR system 9600 (Perkin Elmer).

To check amplification results, 2 μl of each PCR product were loaded onto 1-1.5 agarose gel and the size of amplified fragments was compared with DNA molecular weight standards (DNA marker IX Roche, 1 kb DNA ladder Biolabs).

Single band PCR products were purified by PEG precipitation: 300 μl of TE buffer and 200 μl of 30% PEG 8000/30 mM $MgCl_2$ were added to 100 μl PCR reaction. After vortexing, the DNA was centrifuged for 20 min at 10000 g, washed with 1 vol. 70% ethanol and the pellet dissolved in 30 μl TE. PCR products smaller than 350 bp were purified using a PCR purification Kit (Qiagen) and eluted with 30 μl of the provided elution buffer.

In order to evaluate the yield, 2 μl of the purified DNA were subjected to agarose gel electrophoresis and compared to titrated molecular weight standards.

D) Cloning of PCR Products into Expression Vectors

Cloning was performed following the Gateway™ technology's "one-tube protocol", which consists of a two step reaction (BP and LR) for direct insertion of PCR products into expression vectors.

BP reaction (attB×attP sites): The reaction allowed insertion of the PCR product into a pDONR vector. The pDONR™ 201 vector we used contains the killer toxin gene ccdB between attP1 and attP2 sites to minimize background colonies lacking the PCR insert, and a selectable marker gene for kanamycin resistance. The reaction resulted in a so called pEntry vector, in which the GBS gene was located between attL1 and attL2 sites.

60 fmol of PCR product and 100 ng of pDONR™ 201 vector were incubated with 2.5 μl of BP Clonase™ in a final volume of 12.5 μl for 4 hours at 25° C.

Figure 86A:
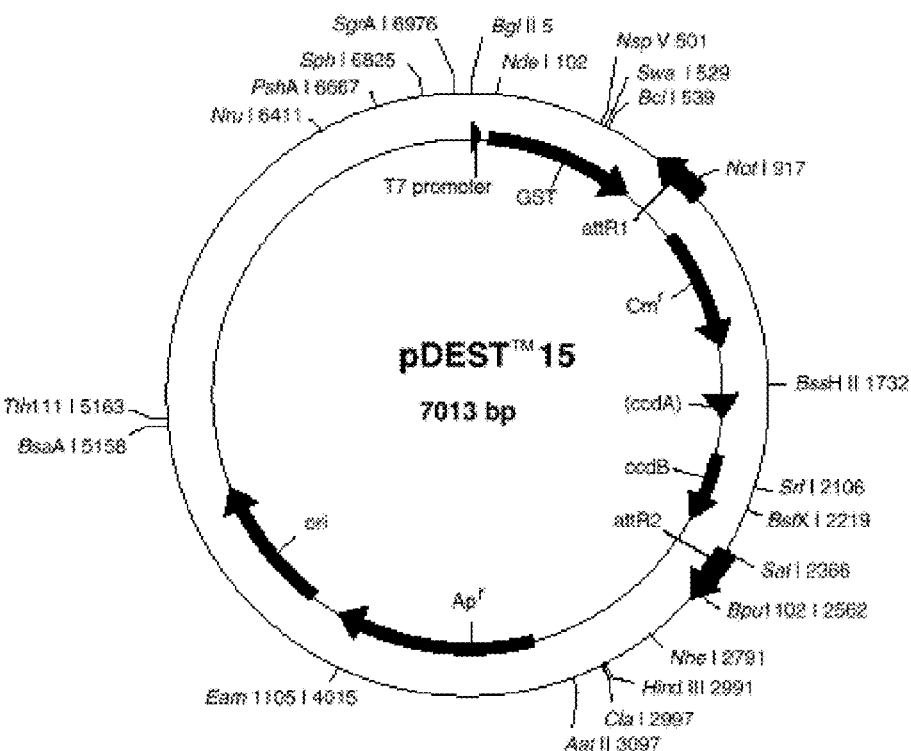
FIG. 86A shows the pDEST15 vector and FIG. 86B shows the pDEST17-1 vector.
Figure 86B:
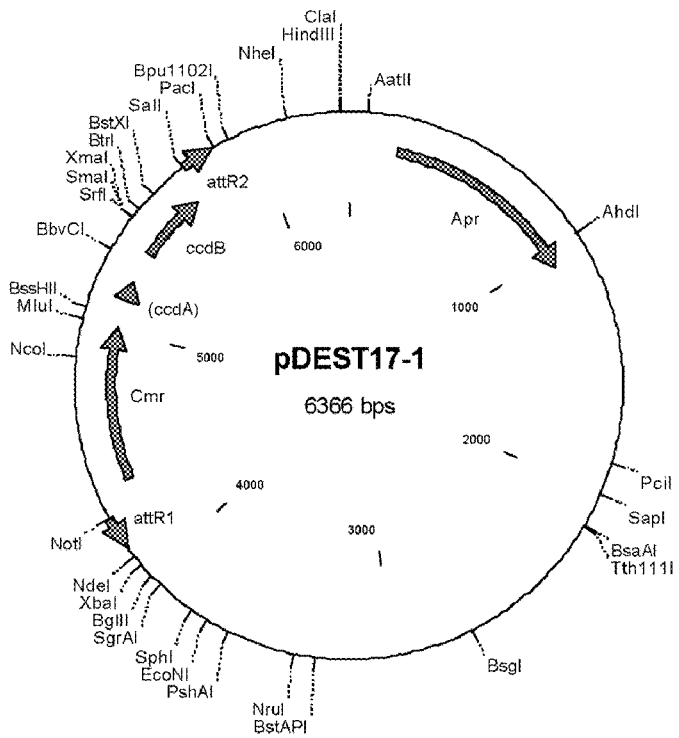

LR reaction (attL×attR sites): The reaction allowed the insertion of the GBS gene, now present in the pEntry vector, into *E. coli* expression vectors (pDestination vectors, containing attR sites). Two pDestination vectors were used (PDEST15 for N-terminal GST fusions—FIG. 86; and pDEST17-1 for N-terminal His-tagged fusions—FIG. 87). Both allow transcription of the ORF fusion coding mRNA under T7 RNA polymerase promoter [Studier et al (1990) *Meth. Enzymol* 185: 60ff].

To 5 μl of BP reaction were added 0.25 μl of 0.75 M NaCl, 100 ng of destination vector and 1.5 μl of LR Clonase™. The reaction was incubated at 25° C. for 2 hours and stopped with 1 μl of 1 mg/ml proteinase K solution at 37° C. for 15 min.

1 μl of the completed reaction was used to transform 50 μl electrocompetent BL21-SI™ cells (0.1 cm, 200 ohms, 25 μF). BL21-SI cells contain an integrated T7 RNA polymerase gene under the control of the salt-inducible prU promoter [Gowrishankar (1985) *J. Bacteriol.* 164:434ff]. After electroporation cells were diluted in 1 ml SOC medium (20 g/l bacto-tryptone, 5 g/l yeast extract, 0.58 g/l NaCl, 0.186 g/l KCl, 20 mM glucose, 10 mM $MgCl_2$) and incubated at 37° C. for 1 hour. 200 μl cells were plated onto LBON plates (Luria Broth medium without NaCl) containing 100 μg/ml ampicillin. Plates were then incubated for 16 hours at 37° C.

Entry clones: In order to allow the future preparation of Gateway compatible pEntry plasmids containing genes which might turn out of interest after immunological assays, 2.5 μl of BP reaction were incubated for 15 min in the presence of 3 μl 0.15 mg/ml proteinase K solution and then kept at −20° C. The reaction was in this way available to transform *E. coli* competent cells so as to produce Entry clones for future introduction of the genes in other Destination vectors.

E) Protein Expression

Single colonies derived from the transformation of LR reactions were inoculated as small-scale cultures in 3 ml LBON 100 μg/ml ampicillin for overnight growth at 25° C.

50-200 µl of the culture was inoculated in 3 ml LBON/Amp to an initial OD600 of 0.1. The cultures were grown at 37° C. until OD600 0.4-0.6 and recombinant protein expression was induced by adding NaCl to a final concentration of 0.3 M. After 2 hour incubation the final OD was checked and the cultures were cooled on ice. 0.5 $OD_{600}$ of cells were harvested by centrifugation. The cell pellet was suspended in 50 µl of protein Loading Sample Buffer (50 mM TRIS-HCl pH 6.8, 0.5% w/v SDS, 2.5% v/v glycerin, 0.05% w/v Bromophenol Blue, 100 mM DTT) and incubated at 100 IC for 5 min. 10 µl of sample was analyzed by SDS-PAGE and Coomassie Blue staining to verify the presence of induced protein band.

F) Purification of the Recombinant Proteins

Single colonies were inoculated in 25 ml LBON 100 µg/ml ampicillin and grown at 25° C. overnight. The overnight culture was inoculated in 500 ml LBON/amp and grown under shaking at 25 IC until $OD_{600}$ values of 0.4-0.6. Protein expression was then induced by adding NaCl to a final concentration of 0.3 M. After 3 hours incubation at 25 IC the final $OD_{600}$ was checked and the cultures were cooled on ice. After centrifugation at 6000 rpm (JA10 rotor, Beckman) for 20 min., the cell pellet was processed for purification or frozen at −20° C.

Proteins were purified in 1 of 3 ways depending on the fusion partner and the protein's solubility:

Purification of Soluble His-Tagged Proteins from *E. coli*
1. Transfer pellets from −20° C. to ice bath and reconstitute each pellet with 10 ml B-PER™ solution (Bacterial-Protein Extraction Reagent, Pierce cat. 78266), 10 µl of a 100 mM $MgCl_2$ solution, 50 µl of DNAse I (Sigma D-4263, 100 Kunits in PBS) and 100 µl of 100 mg/ml lysozyme in PBS (Sigma L-7651, final concentration 1 mg/ml).
2. Transfer resuspended pellets in 50 ml centrifuge tubes and leave at room temperature for 30-40 minutes, vortexing 3-4 times.
3. Centrifuge 15-20 minutes at about 30-40000×g.
4. Prepare Poly-Prep (Bio-Rad) columns containing 1 ml of Fast Flow Ni-activated Chelating Sepharose (Pharmacia). Equilibrate with 50 mM phosphate buffer, 300 mM NaCl, pH 8.0.
5. Store the pellet at −20° C., and load the supernatant on to the columns.
6. Discard the flow through.
7. Wash with 10 ml 20 mM imidazole buffer, 50 mM phosphate, 300 mM NaCl, pH 8.0.
8. Elute the proteins bound to the columns with 4.5 ml (1.5 ml+1.5 ml+1.5 ml) 250 mM imidazole buffer, 50 mM phosphate, 300 mM NaCl, pH 8.0 and collect three fractions of ~1.5 ml each. Add to each tube 15 µl DTT 200 mM (final concentration 2 mM).
9. Measure the protein concentration of the collected fractions with the Bradford method and analyse the proteins by SDS-PAGE.
10. Store the collected fractions at +4° C. while waiting for the results of the SDS-PAGE analysis.
11. For immunisation prepare 4-5 aliquots of 20-100 µg each in 0.5 ml in 40% glycerol. The dilution buffer is the above elution buffer, plus 2 mM DTT. Store the aliquots at −20° C. until immunisation.

Purification of His-Tagged Proteins from Inclusion Bodies
1. Bacteria are collected from 500 ml cultures by centrifugation. If required store bacterial pellets at −20° C. Transfer the pellets from −20° C. to room temperature and reconstitute each pellet with 10 ml B-PER™ solution, 10 µl of a 100 mM $MgCl_2$ solution (final 1 mM), 50 µl of DNAse 1 equivalent to 100 Kunits units in PBS and 100 µl of a 100 mg/ml lysozime (Sigma L-7651) solution in PBS (equivalent to 10 mg, final concentration 1 mg/ml).
2. Transfer the resuspended pellets in 50 ml centrifuge tubes and let at room temperature for 30-40 minutes, vortexing 3-4 times.
3. Centrifuge 15 minutes at 30-4000×g and collect the pellets.
4. Dissolve the pellets with 50 mM TRIS-HCl, 1 mM TCEP {Tris(2-carboxyethyl)-phosphine hydrochloride, Pierce}, 6M guanidine hydrochloride, pH 8.5. Stir for ~10 min. with a magnetic bar.
5. Centrifuge as described above, and collect the supernatant.
6. Prepare Poly-Prep (Bio-Rad) columns containing 1 ml of Fast Flow Ni-activated Chelating Sepharose (Pharmacia). Wash the columns twice with 5 ml of $H_2O$ and equilibrate with 50 mM TRIS-HCl, 1 mM TCEP, 6M guanidine hydrochloride, pH 8.5.
7. Load the supernatants from step 5 onto the columns, and wash with 5 ml of 50 mM TRIS-HCl buffer, 1 mM TCEP, 6M urea, pH 8.5
8. Wash the columns with 10 ml of 20 mM imidazole, 50 mM TRIS-HCl, 6M urea, 1 mM TCEP, pH 8.5. Collect and set aside the first 5 ml for possible further controls.
9. Elute proteins bound to columns with 4.5 ml buffer containing 250 mM imidazole, 50 mM TRIS-HCl, 6M urea, 1 mM TCEP, pH 8.5. Add the elution buffer in three 1.5 ml aliquots, and collect the corresponding three fractions. Add to each fraction 15 µl DTT (final concentration 2 mM).
10. Measure eluted protein concentration with Bradford method and analyse proteins by SDS-PAGE.
11. Dialyse overnight the selected fraction against 50 mM Na phosphate buffer, pH 8.8, containing 10% glycerol, 0.5 M arginine, 5 mM reduced glutathione, 0.5 mM oxidized glutathione, 2 M urea.
12. Dialyse against 50 mM Na phosphate buffer, pH 8.8, containing 10% glycerol, 0.5 M arginine, 5 mM reduced glutathione, 0.5 mM oxidized glutathione.
13. Clarify the dialysed protein preparation by centrifugation and discard the non-soluble material and measure the protein concentration with the Bradford method.
14. For each protein destined to the immunization prepare 4-5 aliquot of 20-100 µg each in 0.5 ml after having adjusted the glycerol content up to 40%. Store the prepared aliquots at −20° C. until immunization.

Purification of GST-Fusion Proteins from *E. coli*
1. Bacteria are collected from 500 ml cultures by centrifugation. If required store bacterial pellets at −20° C. Transfer the pellets from −20° C. to room temperature and reconstitute each pellet with 10 ml B-PER™ solution, 10 µl of a 100 mM $MgCl_2$ solution (final 1 mM), 50 µl of DNAse 1 equivalent to 100 Kunits units in PBS and 100 µl of a 100 mg/ml lysozime (Sigma L-7651) solution in PBS (equivalent to 10 mg, final concentration 1 mg/ml).
2. Transfer the resuspended pellets in 50 ml centrifuge tubes and let at room temperature for 30-40 minutes, vortexing 3-4 times.
3. Centrifuge 15-20 minutes at about 30-40000×g.
4. Discard centrifugation pellets and load supernatants onto the chromatography columns, as follows.
5. Prepare Poly-Prep (Bio-Rad) columns containing 0.5 ml of Glutathione-Sepharose 4B resin. Wash the columns twice with 1 ml of $H_2O$ and equilibrate with 10 ml PBS, pH 7.4.

6. Load supernatants on to the columns and discard the flow through.
7. Wash the columns with 10 ml PBS, pH 7.4.
8. Elute proteins bound to columns with 4.5 ml of 50 mM TRIS buffer, 10 mM reduced glutathione, pH 8.0, adding 1.5 ml+1.5 ml+1.5 ml and collecting the respective 3 fractions of ~1.5 ml each.
9. Measure protein concentration of the fractions with the Bradford method and analyse the proteins by SDS-PAGE.
10. Store the collected fractions at +4° C. while waiting for the results of the SDS-PAGE analysis.
11. For each protein destined for immunisation prepare 4-5 aliquots of 20-100 μg each in 0.5 ml of 40% glycerol. The dilution buffer is 50 mM TRIS-HCl, 2 mM DTT, pH 8.0. Store the aliquots at −20° C. until immunisation.

FIGS. 167 to 170 and 238 to 239

Figure 238:
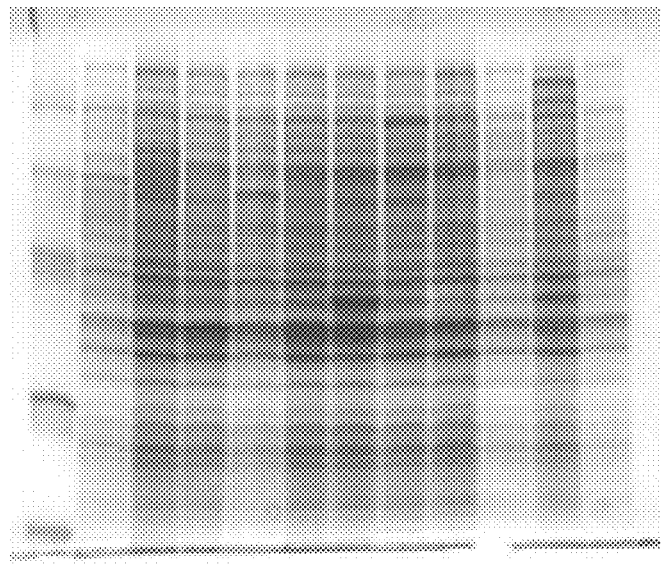
Figure 239:
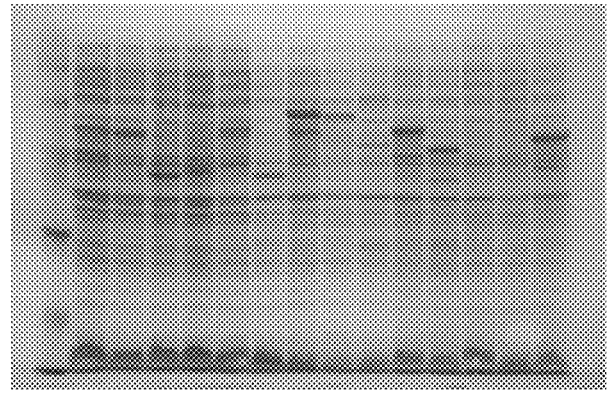

For the experiments shown in FIGS. 167 to 170, FIG. 238 and lanes 2-6 of FIG. 239, the GBS proteins were fused at the N-terminus to thioredoxin and at C-terminus to a poly-His tail. The plasmid used for cloning is pBAD-DEST49 (Invitrogen Gateway™ technology) and expression is under the control of an L(+)-Arabinose dependent promoter. For the production of these GBS antigens, bacteria are grown on RM medium (6 g/l $Na_2HPO_4$, 3 g/l $KH_2PO_4$, 0.5 g/l NaCl, 1 g/l $NH_4Cl$, pH7.4, 2% casaminoacids, 0.2% glucose, 1 mM $MgCl_2$) containing 100 μg/ml ampicillin. After incubation at 37° C. until cells reach $OD_{600}$=0.5, protein expression is induced by adding 0.2% (v/v) L(+)Arabinose for 3 hours.

Immunisations with GBS Proteins

The purified proteins were used to immunise groups of four CD-1 mice intraperitoneally. 20 μg of each purified protein was injected in Freund's adjuvant at days 1, 21 & 35. Immune responses were monitored by using samples taken on day 0 & 49. Sera were analysed as pools of sera from each group of mice.

FACScan Bacteria Binding Assay Procedure.

GBS serotype V 2603 V/R strain was plated on TSA blood agar plates and incubated overnight at 37° C. Bacterial colonies were collected from the plates using a sterile dracon swab and inoculated into 100 ml Todd Hewitt Broth. Bacterial growth was monitored every 30 minutes by following $OD_{600}$. Bacteria were grown until $OD_{600}$=0.7-0.8. The culture was centrifuged for 20 minutes at 5000 rpm. The supernatant was discarded and bacteria were washed once with PBS, resuspended in ½ culture volume of PBS containing 0.05% paraformaldehyde, and incubated for 1 hour at 37° C. and then overnight at 4° C.

50 μl bacterial cells ($OD_{600}$ 0.1) were washed once with PBS and resuspended in 20 μl blocking serum (Newborn Calf Serum, Sigma) and incubated for 20 minutes at room temperature. The cells were then incubated with 100 μl diluted sera (1:200) in dilution buffer (20% Newborn Calf Serum 0.1% BSA in PBS) for 1 hour at 4° C. Cells were centrifuged at 5000 rpm, the supernatant aspirated and cells washed by adding 200 μl washing buffer (0.1% BSA in PBS). 50 μl R-Phicoerytrin conjugated F(ab)₂ goat anti-mouse, diluted 1:100 in dilution buffer, was added to each sample and incubated for 1 hour at 4° C. Cells were spun down by centrifugation at 5000 rpm and washed by adding 200 μl of washing buffer. The supernatant was aspirated and cells resuspended in 200 μl PBS. Samples were transferred to FACScan tubes and read. The condition for FACScan setting were: FL2 on; FSC-H threshold:54; FSC PMT Voltage: E 02; SSC PMT: 516; Amp. Gains 2.63; FL-2 PMT: 728. Compensation values: 0.

Samples were considered as positive if they had a Δ mean values>50 channel values.

Whole Extracts Preparation

GBS serotype III COH1 strain and serotype V 2603 V/R strain cells were grown overnight in Todd Hewitt Broth. 1 ml of the culture was inoculated into 100 ml Todd Hewitt Broth. Bacterial growth was monitored every 30 minutes by following $OD_{600}$. The bacteria were grown until the OD reached 0.7-0.8. The culture was centrifuged for 20 minutes at 5000 rpm. The supernatant was discarded and bacteria were washed once with PBS, resuspended in 2 ml 50 mM Tris-HCl, pH 6.8 adding 400 units of Mutanolysin (Sigma-Aldrich) and incubated 3 hrs at 37° C. After 3 cycles of freeze/thaw, cellular debris were removed by centrifugation at 14000 g for 15 minutes and the protein concentration of the supernatant was measured by the Bio-Rad Protein assay, using BSA as a standard.

Western Blotting

Purified proteins (50 ng) and total cell extracts (25 μg) derived from GBS serotype III COH1 strain and serotype V 2603 V/R strain were loaded on 12% or 15% SDS-PAGE and transferred to a nitrocellulose membrane. The transfer was performed for 1 hours at 100V at 4° C., in transferring buffer (25 mM Tris base, 192 mM glycine, 20% methanol). The membrane was saturated by overnight incubation at 4° C. in saturation buffer (5% skimmed milk, 0.1% Tween 20 in PBS). The membrane was incubated for 1 hour at room temperature with 1:1000 mouse sera diluted in saturation buffer. The membrane was washed twice with washing buffer (3% skimmed milk, 0.1% Tween 20 in PBS) and incubated for 1 hour with a 1:5000 dilution of horseradish peroxidase labelled anti-mouse Ig (Bio-Rad). The membrane was washed twice with 0.1% Tween 20 in PBS and developed with the Opti-4CN Substrate Kit (Bio-Rad). The reaction was stopped by adding water.

Unless otherwise indicated, lanes 1, 2 and 3 of blots in the drawings are: (1) the purified protein; (2) GBS-III extracts; and (3) GBS-V extracts. Molecular weight markers are also shown.

In Vivo Passive Protection Assay in Neonatal Sepsis Mouse model.

The immune sera collected from the CD1 immunized mice were tested in a mouse neonatal sepsis model to verify their protective efficacy in mice challenged with GBS serotype III. Newborn Balb/C littermates were randomly divided in two groups within 24 hrs from birth and injected subcutaneously with 25 μl of diluted sera (1:15) from immunized CD1 adult mice. One group received preimmune sera, the other received immune sera. Four hours later all pups were challenged with a 75% lethal dose of the GBS serotype III COH1 strain. The challenge dose obtained diluting a mid log phase culture was administered subcutaneously in 25 μl of saline. The number of pups surviving GBS infection was assessed every 12 hours for 4 days. Results are in Table III.

EXAMPLE 1

A DNA sequence (GBSx1402) was identified in *S. agalactiae* <SEQ ID I> which encodes the amino acid sequence <SEQ ID 2>. Analysis of this protein sequence reveals the following:

```
Possible site: 27
>>> Seems to have an uncleavable N-term signal seq
INTEGRAL    Likelihood = -0.48       Transmembrane     169-185     (169-185)

----- Final Results -----
              bacterial membrane --- Certainty = 0.1192 (Affirmative) < succ>
               bacterial outside --- Certainty = 0.0000 (Not Clear)   < succ>
             bacterial cytoplasm --- Certainty = 0.0000 (Not Clear)   < succ>
```

The protein has homology with the following sequences in the GENPEPT database.

```
>GP: CAB88235 GB: AL353012 hypothetical serine-rich repeat protein
[Schizosaccharomyces pombe]
Identities = 41/152 (26%), Positives = 75/152 (48%), Gaps = 4/152 (2%)

Query:   22 SSIGYADTSDKNTDTSVVTTTLSEEKRSDELDQSSTGSSSENESSSSSEPETNPSTNPPT    81
            SS   +++S +++D+S  ++    E  S+  D SS+ SSSE+ESSS      ++ S++  +
Sbjct:  132 SSDSESESSSEDSDSSSSSDSESESSSEGSDSSSSSSSSESESSSEDNDSSSSSSDSES   191

Query:   82 TEPSQPSPSEENKPDGRTKTE---IGNNKDISSGTKVLISEDSIKNFSKASSDQEEVDRD   138
            S+  S  S   +  D  +++       ++  SS      SED+  + S + S+  E    D
Sbjct:  192 ESSSEDSDSSSSSSDSESESSSEGSDSSSSSSSSESESSSEDNDSSSSSSDSESESSSED   251

Query:  139 ESSSSKANDGK-KGHSKPKKELPKTGDSHSDT                              169
            SSS ++D + +  SK         + DS  D+
Sbjct:  252 SDSSSSSSDSESESSSKDSDSSSNSSDSEDDS                              283
```

There is also homology to SEQ ID 1984.

A related GBS gene <SEQ ID 8785> and protein <SEQ ID 8786> were also identified. Analysis of this protein sequence reveals the following:

```
Lipop: Possible site: -1   Crend: 5
McG: Discrim Score: 6.72
GvH: Signal Score (-7.5): -4.34
Possible site: 27
>>> Seems to have an uncleavable N-term signal seq
ALOM program count: 1 value: -0.48                     threshold: 0.0
INTEGRAL            Likelihood = -0.48 Transmembrane 169-185      (169-185)
PERIPHERAL          Likelihood =  0.16 7
modified ALOM score: 0.60

*** Reasoning Step: 3

----- Final Results -----
              bacterial membrane --- Certainty = 0.1192 (Affirmative) < succ>
               bacterial outside --- Certainty = 0.0000 (Not Clear)   < succ>
             bacterial cytoplasm --- Certainty = 0.0000 (Not Clear)   < succ>
```

Figure 9:
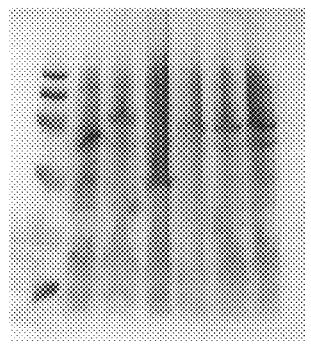
Figure 12:
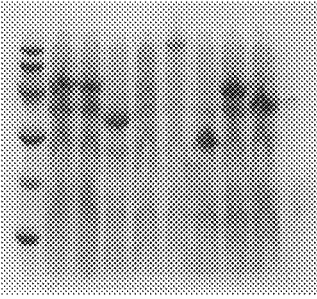

SEQ ID 2 (GBS4) was expressed in *E. coli* as a GST-fusion product. SDS-PAGE analysis of total cell extract is shown in FIG. 9 (lane 3; MW 43.1 kDa) and FIG. 63 (lane 4; MW 50 kDa). It was also expressed in *E. coli* as a His-fusion product. SDS-PAGE analysis of total cell extract is shown in FIG. 12 (lane 7; MW 30 kDa), FIG. 63 (lane 3; MW 30 kDa) and in FIG. 178 (lane 3; MW 30 kDa).

Figure 190:
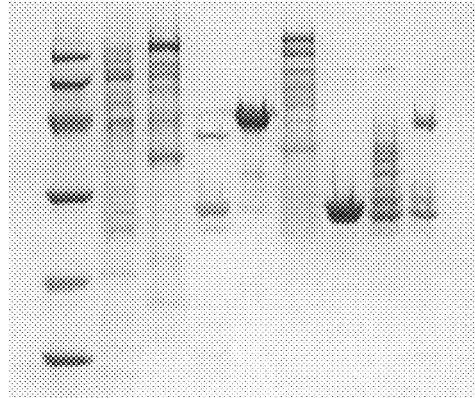
Figure 209:
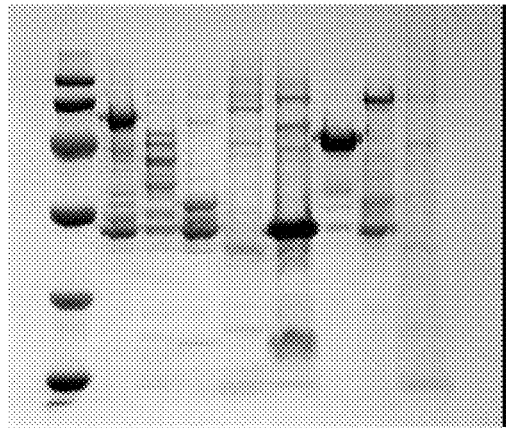

GBS4-GST was purified as shown in FIG. 190 (lane 6) and FIG. 209 (lane 8).

Figure 191:
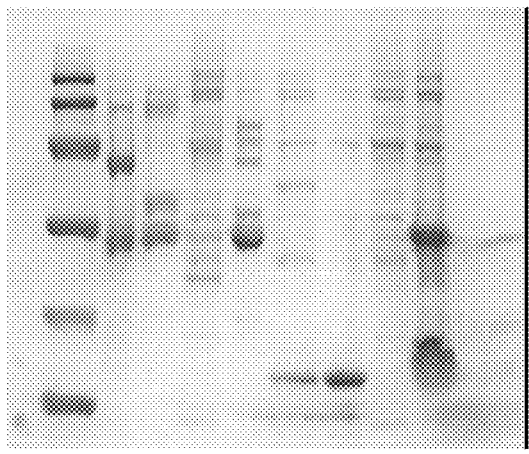

Purified GBS4-His is shown in FIGS. 89A, 191 (lane 10), 209 (lane 7) and 228 (lanes 9 & 10).

The purified GBS4-His fusion product was used to immunise mice (lane 2 product; 20 μg/mouse). The resulting antiserum was used for Western blot (FIG. 89B), FACS, and in the in vivo passive protection assay (Table III). These tests confirm that the protein is immunoaccessible on GBS bacteria and that it is an effective protective immunogen.

Based on this analysis, it was predicted that these proteins and their epitopes could be useful antigens for vaccines or diagnostics.

EXAMPLE 2

A DNA sequence (GBSx1100) was identified in *S. agalactiae* <SEQ ID 3> which encodes the amino acid sequence <SEQ ID 4>. This protein is predicted to be aggregation promoting protein. Analysis of this protein sequence reveals the following:

```
Possible site: 33
>>> Seems to have a cleavable N-term signal seq.

----- Final Results -----
              bacterial outside --- Certainty = 0.3000 (Affirmative) < succ>
```

```
                bacterial membrane --- Certainty = 0.0000 (Not Clear) < succ>
                bacterial cytoplasm --- Certainty = 0.0000 (Not Clear) < succ>
```

The protein has homology with the following sequences in the GENPEPT database.

```
>GP:CAA69725 GB:Y08498 aggregation promoting protein
[Lactobacillus gasseri]
Identities = 56/103 (54%), Positives = 69/103 (66%), Gaps = 5/103 (4%)
Query:  82 TASQAEAKSQPT-----IENSMNSSSNLSSSDSAAKEEIARRESNGSYTAQNGQYYGRYQ 136
           T S A A+ Q T      + + + + N S S++AAK  +A RES G Y+A NGQY G+YQ
Subj: 195 TYSTASAQKQTTQVAQKTQTTTSYTLNASGSEAAAKAWMAGRESGGPYSAGNGQYIGKYQ 254

Query: 137 LSQSYLNGDLSPENQEKVADNYVVSRYGSWSAALSFWNSNGWY                  179
           LS SYL GD S  NQE+VADNYV SRYGSW+ A   FW +NGWY
Sbjct: 255 LSASYLGGDYSAANQERVADNYVKSRYGSWTGAQKFWQTNGWY                  297
```

No corresponding DNA sequence was identified in *S. pyogenes*.

A related GBS gene <SEQ ID 8709> and protein <SEQ ID 8710> were also identified. Analysis of this protein sequence reveals the following:

```
Lipop: Possible site: -1    Crend: 9
McG: Discrim Score: 2.59
GvH: Signal Score (-7.5): -0.42
Possible site: 33
>>> Seems to have a cleavable N-term signal seq.
ALOM program count: 0          value: 6.79           threshold: 0.0
PERIPHERAL                     Likelihood = 6.79     59
modified ALOM score: -1.86

*** Reasoning Step: 3

----- Final Results -----
                bacterial outside  --- Certainty = 0.3000 (Affirmative) < succ>
                bacterial membrane --- Certainty = 0.0000 (Not Clear)   < succ>
                bacterial cytoplasm --- Certainty = 0.0000 (Not Clear)  < succ>
```

The protein has homology with the following sequences in the databases:

```
57.5/71.3% over 92aa
Lactobacillus gasseri
EGAD|154417| aggregation promoting protein Insert characterized
GP|1619598|emb|CAA69725.1||Y08498 aggregation promoting protein Insert
characterized
ORF01056(547-837 of 1137)
EGAD|154417|164788(205-297 of 297)aggregation promoting protein{Lactobacillus
gasseri}GP|1619598|emb|CAA69725.1||Y08498 aggregation
promoting protein{Lactobacillus gasseri}
% Match = 14.6
% Identity = 57.4    % Similarity = 71.3
Matches = 54  Mismatches = 26  Conservative Sub.s = 13
   507       537       567       597       627       657       687       717
SLNSISNADVISIGDVLKLDNSTASQAEAKSQPTIENSMNSSSNLSSSDSAAKEEIARRESNGSYTAQNGQYYGRYQLSQ
 ::    :  |              :|   |:|     ::|:|        |::|||   :| ||| |:| ||||:|||
NVQRTYSAPVQQRTYSYASAQKQTTQVAQKTQTTTSYTLNASG----SEAAAKAWMAGRESGGPYSAGNGQYIGKYQLSA
           200       210       220       230       240       250
   747       777       807       837       867       897       927       957
SYLNGDLSPENQEKVADNYVVSRYGSWSAALSFWNSNGWY**KLIKQRDLLKIKSLCNIFNIYSTAR*QIKYNIGNMNKR
||| || |   |||:||||||| |||||:  |  || :|||
SYLGGDYSAANQERVADNYVKSRYGSWTGAQKFWQTNGWY
           270       280       290
```

A related GBS gene <SEQ ID 8711> and protein <SEQ ID 8712> were also identified. Analysis of this protein sequence reveals the following:

```
Lipop: Possible site: -1 Crend: 9
McG: Discrim Score: 2.59
GvH: Signal Score (-7.5): -0.42
      Possible site: 33
>>> Seems to have a cleavable N-term signal seq.
ALOM program count: 0 value: 6.79 threshold: 0.0
   PERIPHERAL Likelihood = 6.79 59
modified ALOM score: -1.86
*** Reasoning Step: 3

----- Final Results -----
              bacterial outside --- Certainty = 0.3000(Affirmative) < succ>
              bacterial membrane --- Certainty = 0.0000(Not Clear) < succ>
              bacterial cytoplasm --- Certainty = 0.0000(Not Clear) < succ>
```

The protein has homology with the following sequences in the databases:

```
44.0/62.0% over 115aa
Bacillus subtilis
EGAD|108478| hypothetical protein Insert characterized OMNI|NT01BS1100 p60-
related protein Insert characterized
GP|2226145|emb|CAA74437.1||Y14079 hypothetical protein Insert characterized
GP|2633272|emb|CAB12776.1||Z99109 similar to cell wall-binding protein Insert
characterized
PIR|B69825|B69825 cell wall-binding protein homolog yhdD - Insert characterized ORF01746(340-633 of 954)
EGAD|108478|BS0936(57-172 of 488) hypothetical protein {Bacillus subtilis}
OMNI|NT01BS1100 p60-related proteinGP|2226145|emb|CAA74437.1||Y14079
hypothetical protein {Bacillus subtilis}GP|2633272|emb|CAB12776.1||Z99109 similar
to cell wall-binding protein {Bacillus subtilis}PIR|B69825|B69825 cell wall-
binding protein homolog yhdD - Bacillus subtilis
% Match = 9.0
% Indentity = 44.0    % Similarity = 62.0
Matches = 44  Mismatches = 35  Conservative Sub.s = 18

120        150       180        210       240       270       300       330
*DQFMVLAFSFI*CEKLNNFT*RKLKIVFWRPFLY*FTIYLISSKAKQLVIFTRYDSTRINKRAYIMSITSVKKSK

MKKKLAAGLTASAIVGTTLVVTPAEAATIKVKSGDSLWKLAQTYNTSVAALTS
                                10        20        30        40        50

360        390                  435       465       495       525
PFKLGVAGLLVGASLALPLSVSAAS---------------YTVKSGDTLSAIAKNHKTTVQELVSLNSISNADVISIGDV
   |     | :| :|  | | | :|               |||||||:| ||  ||||| || :| :|:| |
ANHLSTTVLSIGQTLTIPGSKSSTSSSTSSSTTMKSGSSVYTVKSGDSLWLIANEFKMTVQELKKLNGLS-SDLIRAGQK
                   70        80        90       100       110       120       130

543        573       603       633       663       693       723       753
LKLD----NSTASQAEAKSQPTIENSMNSSSNLSSSDSAAKEEIASS*IKXVVILHRMDNIMEDINCLNLT*MATYLLKI
||:     :|::|   ::    :   :|    |||| |||  |::             |:      :        :  :
LKVSGTVSSSSSSSKKSNSNKSSSSSSKSSSNKSSSSSSSTGTYKVQLGDSLWKIANKVNMSIAELKVLNNLKSDTIYVN
             150       160       170       180       190       200       210
```

Figure 30:
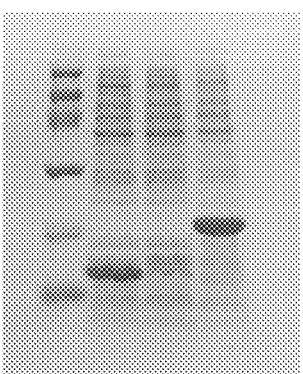

SEQ ID 8712 (GBS166) was expressed in *E. coli* as a His-fusion product. SDS-PAGE analysis of total cell extract is shown in FIG. 30 (lane 2; MW 13.1 kDa).

Figure 315:
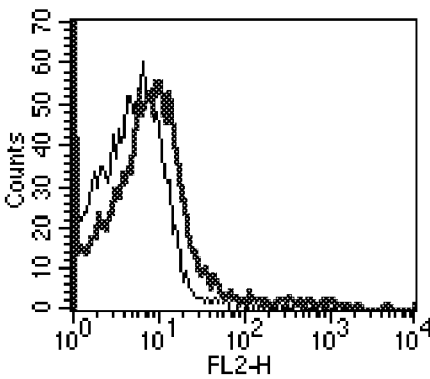

The GBS166-His fusion product was purified (FIG. 200, lane 10) and used to immunise mice. The resulting antiserum was used for FACS (FIG. 315), which confirmed that the protein is immunoaccessible on GBS bacteria.

Figure 10:
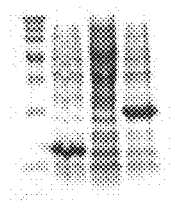
Figure 66:
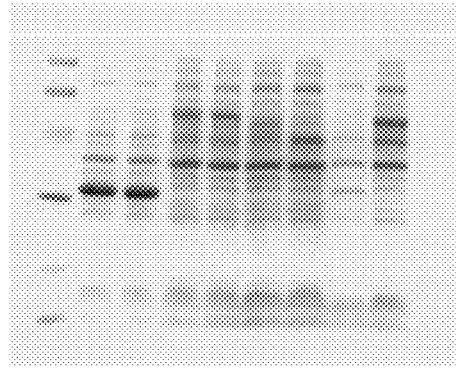
Figure 185:
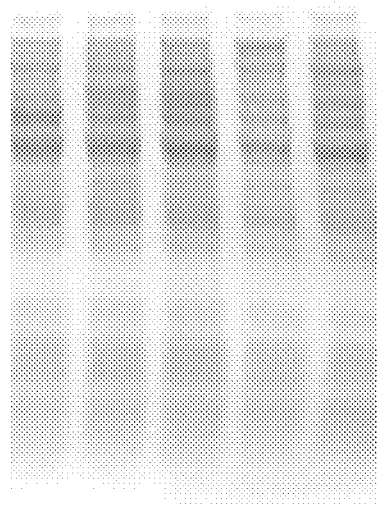

SEQ ID 4 (GBS15) was expressed in *E. coli* as a GST-fusion product. SDS-PAGE analysis of total cell extract is shown in FIG. 9 (lane 5; MW 44.8 kDa), FIG. 63 (lane 5; MW 44.8 kDa) and FIG. 66 (lane 7; MW 45 kDa). It was also expressed in *E. coli* as a His-fusion product. SDS-PAGE analysis of total cell extract is shown in FIG. 10 (lane 4; MW 22.3 kDa). It was also expressed as GBS15L, with SDS-PAGE analysis of total cell extract is shown in FIG. 185 (lane 1; MW 50 kDa).

Figure 210:
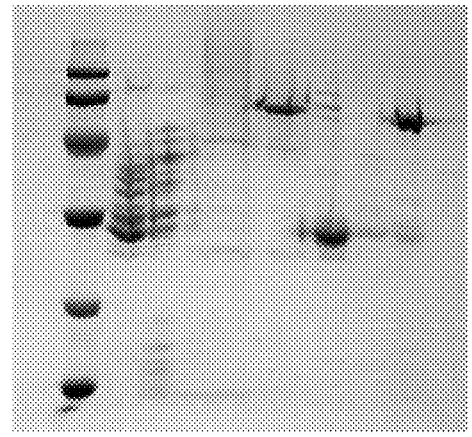
Figure 245:
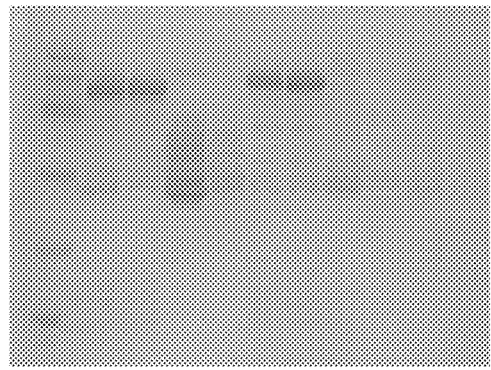

Purified GBS15-GST is shown in FIG. 91A, FIG. 190 (lane 9), FIG. 210 (lane 4) and FIG. 245 (lanes 4 & 5).

The purified GBS15-GST fusion product was used to immunise mice (lane 1+2 products; 20 μg/mouse). The resulting antiserum was used for Western blot (FIG. 91B), FACS (FIG. 91C), and in the in vivo passive protection assay (Table III). These tests confirm that the protein is immunoaccessible on GBS bacteria and that it is an effective protective immunogen.

Based on this analysis, it was predicted that these proteins and their epitopes could be useful antigens for vaccines or diagnostics.

EXAMPLE 3

A DNA sequence (GBSx0091) was identified in *S. agalactiae* <SEQ ID 303> which encodes the amino acid sequence <SEQ ID 304>. Analysis of this protein sequence reveals the following:

Possible site: 32
>>> Seems to have no N-terminal signal sequence
     INTEGRAL    Likelihood = -9.66    Transmembrane    22-38 (15-41)

----- Final Results -----
            bacterial membrane --- Certainty = 0.4864(Affirmative) < succ>
            bacterial outside  --- Certainty = 0.0000(Not Clear)   < succ>
            bacterial cytoplasm --- Certainty = 0.0000(Not Clear)  < succ>

The protein has homology with the following sequences in the GENPEPT database:

```
>GP: CAA72096 GB: Y11213 hypothetical protein [Streptococcus thermophilus]
Identities = 149/274 (54%), Positives = 208/274 (75%), Gaps = 9/274 (3%)

Query:  23 FLVSLLLSFGIFSLIIPKSNP--KLTKKDFLTKKVIPLNYVALGDSLTEGVGDTTSQGGF   80
           F + LL GI   IIP S+   K++ K    KK   + YVA+GDSLT+GVGD+++QGGF
Sbjct:   5 FFLLFLLFVGILIFIIPSSHQSSKISDKIRSVKKE-KVTYVAIGDSLTQGVGDSSNQGGF   63

Query:  81 VPLLSESLHNRYSYQVTSVNYGVSGNTSQQILKRMTTDPQIEKDLEKADLLTLTVGGNDV  140
           VP+LS++L +  +++QVT  NYG++GNTS QILKRM     I++DL+KA  L+TLTVGGNDV
Sbjct:  64 VPVLSQALESDFNWQVTPRNYGIAGNTSNQILKRMQEKKDIKRDLKKAKLMTLTVGGNDV  123

Query: 141 LAVIRKELSHLSLNSFEKPAEAYKERLKEILAKARQDNPKLPIYVLGIYNPFYLNFPQLT  200
            + VI+  +++L++N+F K A  Y++RL++I+  AR++N   LPIY++GIYNPFYLNEP++T
Sbjct: 124 IHVIKDNITNLNVNTFSKAAVDYQKRLRQIIELARKENKTLPIYIIGIYNPFYLNFPEMT  183

Query: 201 KMQTVIDNWNKATKEVVDASENVYFVPINDRLYKGINGKEGITES------SNSQASITN  254
           +MQT++DNWN++T+EV    +NVYFVP+ND LYKGINGK G+T S       + S    N
Sbjct: 184 EMQTIVDNWNRSTEEVSKEYDNVYFVPVNDLLYKGINGKGGVTSSDETSQPTKSSQDSLN  243

Query: 255 DALFTGDHFHPNNIGYQIMSNAVMEKINETRKNW                           288
           DALF  DHFHPNN GYQIMS+A++++IN+T+K W
Sbjct: 244 DALFEEDHFNPNNTGYQIMSDAILKRINQTKKEW                           277
```

A related DNA sequence was identified in *S. pyogenes* <SEQ ID 305> which encodes the amino acid sequence <SEQ ID 306>. Analysis of this protein sequence reveals the following:

Possible site: 39
>>> Seems to have en uncleavable N-term signal seq
     INTEGRAL    Likelihood = -12.05    Transmembrane    18-34 (10-37)

----- Final Results -----
            bacterial membrane --- Certainty = 0.5819(Affirmative) < succ>
            bacterial outside  --- Certainty = 0.0000(Not Clear)   < succ>
            bacterial cytoplasm --- Certainty = 0.0000(Not Clear)  < succ>

A related sequence was also identified in GAS <SEQ ID 9123> which encodes the amino acid sequence <SEQ ID 9124>. Analysis of this protein sequence reveals the following:

Possible site: 33
>>> Seems to have an uncleavable N-term signal seq
     INTEGRAL    Likelihood = -12.05    Transmembrane    12-28

----- Final Results -----
            bacterial membrane --- Certainty = 0.5819(Affirmative) < succ>
            bacterial outside  --- Certainty = 0.0000(Not Clear)   < succ>
            bacterial cytoplasm --- Certainty = 0.0000(Not Clear)  < succ>

An alignment of the GAS and GBS proteins is shown below:

```
Identities = 178/282 (63%), Positives = 218/282 (77%)

Query:   5 LLLWFVMNKKKILTGLSFFLVSLLLSFGIFSLIIPKSNPKLTKKDFLTKKVIPLNYVALG   64
           L LWFVMN + + +G+ FF++SL L+F + ++IIPKSN +L K DFL K+ + + YVA+G
Sbjct:   1 LRLWFVMNNRHLFSGIFFFVISLCLAFLLLNIIIPKSNSRLKKSDFLKKEQVAIQYVAIG   60
```

```
Query:   65 DSLTEGVGDTTSQGGFVPLLSESLHNRYSYQVTSVNYGVSGNTSQQILKRMTTDPQIEKD 124
            DSLTEGVGD T QGGFVPLL+   L   +    V   NYGVSG+TSQQIL RM    QI+
Sbjct:   61 DSLTEGVGDLTHQGGFVPLLTNDLSEYFKANVNHQNYGVSGDTSQQILDRMIKQKQIQLS 120

Query:  125 LEKADLLTLTVGGNDVLAVIRKELSHLSLNSFEKPAEAYKERLKEILAKARQDNPKLPIY 184
            L+KAD++TLTVGGNDV+AVIRK L+ L ++SF KPA   Y++RL++I+  AR+DN  LPI+
Sbjct:  121 LKKADIMTLTVGGNDVMAVIRKNLADLQVSSFRKPARQYQKRLRQIIELARKDNKDLPIF 180

Query:  185 VLGIYNPFYLNFPQLTKMQTVIDNWNKATKEVVDASENVYFVPINDRLYKGINGKEGITE 244
            +LGIYNPFYLNFP+LT MQ VID+WN  TKEVV  + VYFVPIND LYKGING+EGI
Sbjct:  181 ILGIYNPFYLNFPELTDMQKVIDDWNTKTKEVVGEYDRVYFVPINDLLYKGINGQEGIVH 240

Query:  245 SSNSQASITNDALFTGDHFHPNNIGYQIMSNAVMEKINETRK                  286
            SS  Q +I NDALFTGDHFHPNN GYQIMSNAVMEKI +  K
Sbjct:  241 SSGDQTTIVNDALFTGDHFHPNNTGYQIMSNAVMEKIKKHEK                  282
```

15

A related GBS gene <SEQ ID 5> and protein <SEQ ID 6> were also identified. Analysis of this protein sequence reveals the following:

```
Lipop: Possible site: -1 Crend: 4
SRCFLG: 0
McG: Length of UR: 24
     Peak Value of UR: 3.02
     Net Charge of CR: 3
McG: Discrim Score: 12.27
GvH: Signal Score (-7.5): -3.44
     Possible site: 22
>>> Seems to have an uncleavable N-term signal seq
Amino Acid Composition: calculated from 1
ALOM program Count: 1 value: -9.66 threshold: 0.0
     INTEGRAL        Likelihood = 9.66      Transmembrane    12-28 (5-31)
     PERIPHERAL      Likelihood = 1.96      118
modified ALOM score: 2.43
icm1 HYPID: 7 CFP: 0.486
*** Reasoning Step: 3

----- Final Results -----
             bacterial membrane  --- Certainty = 0.4864(Affirmative) < succ>
             bacterial outside   --- Certainty = 0.0000(Not Clear)   < succ>
             bacterial cytoplasm --- Certainty = 0.0000(Not Clear)   < succ>
```

The protein has homology with the following sequences in the databases:

```
56.0/80.3% over 272aa
GP|1850894| hypothetical protein Insert characterized

ORF02006(367-1164 of 1467)
GP|1850894|emb|CAA72096.1||Y11213(5-277 of 280) hypothetical protein
{Streptococcus thermophilus}
% Match = 30.8
% Identity = 56.0    % Similarity = 80.2
Matches = 150   Mismatches = 49   Conservative Sub.s = 65

141       171       201       231       261       291       321       351
AV*RPSANG*IILLKVPKHEKLLKLASPTVVKLIWLITLEKN*LF*VLLYPF*KLAQSSKLILVRMHLLLWFVMNKKKIL 381       411       435       465       495       525       555       585
TGLSFFLVSLLLSFGIFSLIIPKSN--PKLTKKDFLTKKVIPLNYVALGDSLTEGVGDTTSQGGFVPLLSESLHNRYSYQ
  :: |::  :||   || :|||  |:      |:: |    ||   |||:||||:||||:::||||||:||::|  : :::|
SFAGFFLLFLLFVGILIFIIPSSHQSSKISDKIRSVKK-EKVTYVAIGDSLTQGVGDSSNQGGFVPVLSQALESDFNWQ
     10        20        30        40        50         60        70

615       645       675       705       735       765       795       825
VTSVNYGVSGNTSQQILKRMTTDPQIEKDLEKADLLTLTVGGNDVLAVIRKELSHLSLNSFEKPAEAYKERLKEILAKAR
|| |||::|||| ||||||       |::||:|| |:|||||||||: ||   :::::|:| |  | |::||:|::|  ||
VTPRNYGIAGNTSNQILKRMQEKKDIKRDLKKAKLMTLTVGGNDVIHVIKDNITNLNVNTFSKAAVDYQKRLRQIIELAR
      90       100       110       120       130       140       150
```

```
855        885       915       945       975      1005                 1044
QDNPKLPIYVLGIYNPFYLNFPQLTKMQTVIDNWNKATKEVVDASENVYFVPINDRLYKGINGKEGIT------ESSNS
: :|   ||||::|||||||||||::|:|||::|||:|:||    :|||||:||  ||||||||  |:|        : :|
KENKTLPIYIIGIYNPFYLNFPEMTEMQTIVDNWNRSTEEVSKEYDNVYFVPVNDLLYKGINGKGGVTSSDETSQPTKSS
           170       180       190       200      210       220       230

1074       1104      1134      1164      1194     1224      1254      1284
QASITNDALFTGDHFHPNNIGYQIMSNAVMEKINETRKNWP*FKFLEMGISLIVGN*PFLHSSDCKSLNSST*A*YRKNF
| |: |||||  |||||||  ||||||:|:::::||:|:|  |
QDSL-NDALFEEDHFHPNNTGYQIMSDAILKRINQTKKEWSGE
           250       260       270       280
```

Figure 36:
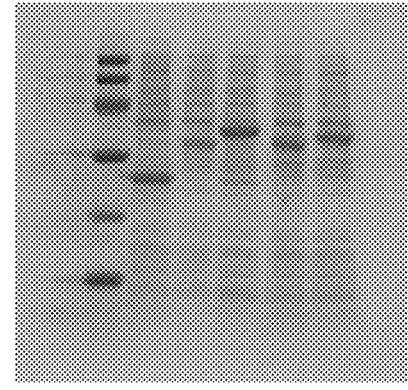

SEQ ID 6 (GBS103) was expressed in *E. coli* as a His-fusion product. SDS-PAGE analysis of total cell extract is shown in FIG. 36 (lane 4; MW 32 kDa).

The GBS103-His fusion product was purified (FIG. 107A; see also FIG. 201, lane 9) and used to immunise mice (lane 2+3 product; 18.5 µg/mouse). The resulting antiserum was used for Western blot (FIG. 107B), FACS (FIG. 107C) and in the in vivo passive protection assay (Table III). These tests confirm that the protein is immunoaccessible on GBS bacteria and that it is an effective protective immunogen.

Based on this analysis, it was predicted that these proteins and their epitopes could be useful antigens for vaccines or diagnostics.

EXAMPLE 4

Figure 24:
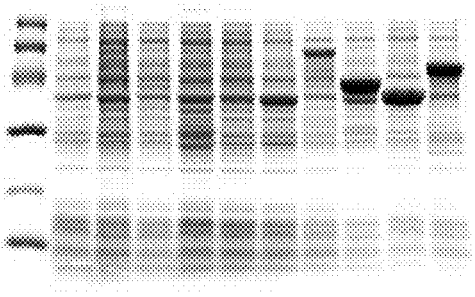
Figure 31:
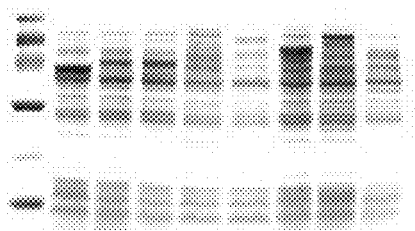

A DNA sequence (GBSx1316) was identified in *S. agalactiae* <SEQ ID 3837> which encodes the amino acid sequence <SEQ ID 3838>. Analysis of this protein sequence reveals the following:

SEQ ID 8 (GBS195) was expressed in *E. coli* as a His-fusion product. SDS-PAGE analysis of total cell extract is shown in FIG. 24 (lane 8). It was also expressed in *E. coli* as a GST-fusion product. SDS-PAGE analysis of total cell extract is shown in FIG. 31 (lane 5).

Figure 175:
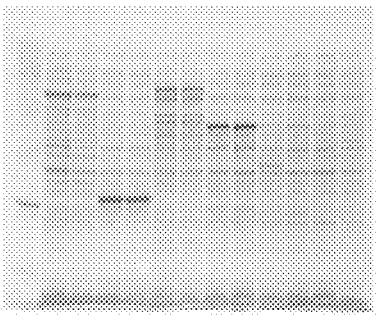

GBS195C was expressed in *E. coli* as a GST-fusion product. SDS-PAGE analysis of total cell extract is shown in FIG. 175 (lane 6 & 7; MW 81 kDa).

Figure 83:
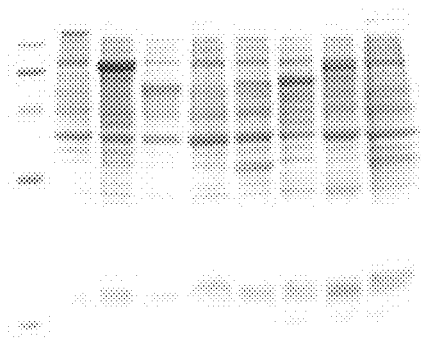

GBS195L was expressed in *E. coli* as a His-fusion product. SDS-PAGE analysis of total cell extract is shown in FIG. 83 (lane 2; MW 123 kDa).

GBS195LN was expressed in *E. coli* as a His-fusion product. SDS-PAGE analysis of total cell extract is shown in FIG. 83 (lane 3; MW 66 kDa).

Figure 198:
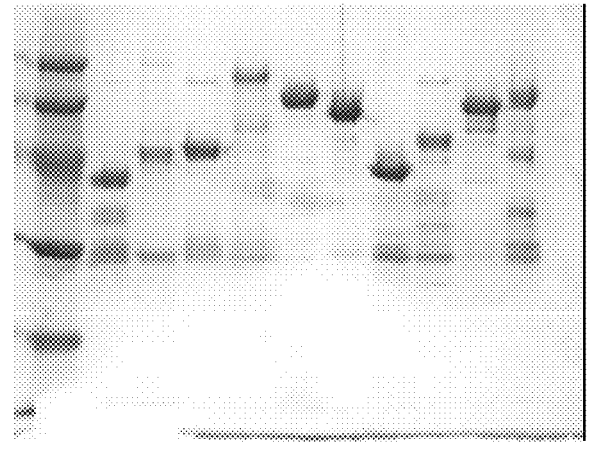
Figure 222:
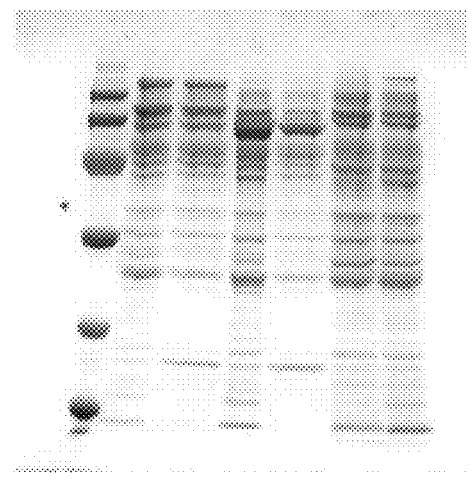

GBS195-GST was purified as shown in FIG. 198, lane 5. GBS195-His was purified as shown in FIG. 222, lane 4-5. GBS195N-His was purified as shown in FIG. 222, lane 6-7.

The GBS195-GST fusion product was purified (FIG. 87A) and used to immunise mice (lane 1 product; 13.6 µg/mouse). The resulting antiserum was used for Western blot (FIG.

```
Possible site: 23
>>> Seems to have no N-terminal signal sequence
    INTEGRAL    Likelihood = -4.30    Transmembrane    1058-1074 (1056-1075)

----- Final Results -----
              bacterial membrane --- Certainty = 0.2720(Affirmative) < succ>
              bacterial outside  --- Certainty = 0.0000(Not Clear)   < succ>
              bacterial cytoplasm --- Certainty = 0.0000(Not Clear)  < succ>
```

The protein has no significant homology with any sequences in the GENPEPT database.

No corresponding DNA sequence was identified in *S. pyogenes*.

A related GBS gene <SEQ ID 7> and protein <SEQ ID 8> were also identified. Analysis of this protein sequence reveals the following:

87B), FACS, and in the in vivo passive protection assay (Table III). These tests confirm that the protein is immunoaccessible on GBS bacteria and that it is an effective protective immunogen.

Based on this analysis, it was predicted that these proteins and their epitopes could be useful antigens for vaccines or diagnostics.

```
Lipop: Possible site: -1 Crend: 10
McG: Discrim Score: -13.26
GvH: Signal Score (-7.5): -5.76
    Possible site: 41
>>> Seems to have no N-terminal signal sequence
ALOM program count: 1 value: -4.30 threshold: 0.0
    INTEGRAL     Likelihood = -4.30    Transmembrane    489-505 (487-506)
    PERIPHERAL   Likelihood = 3.71     97
modified ALOM score: 1.36
*** Reasoning Step: 3

----- Final Results -----
              bacterial membrane --- Certainty = 0.2720(Affirmative) < succ>
              bacterial outside  --- Certainty = 0.0000(Not Clear)   < succ>
              bacterial cytoplasm --- Certainty = 0.0000(Not Clear)  < succ>

LPXTG motif: 478-482
```

EXAMPLE 5

A DNA sequence (GBSx0002) was identified in *S. agalactiae* <SEQ ID 4043> which encodes the amino acid sequence <SEQ ID 4044>. This protein is predicted to be lipoprotein MtsA. Analysis of this protein sequence reveals the following:

```
Possible site: 19
>>> Seems to have no N-terminal signal sequence

----- Final Results -----
            bacterial cytoplasm --- Certainty = 0.3361(Affirmative) < succ>
            bacterial membrane  --- Certainty = 0.0000(Not Clear)   < succ>
             bacterial outside  --- Certainty = 0.0000(Not Clear)   < succ>
```

A related GBS nucleic acid sequence <SEQ ID 9403> which encodes amino acid sequence <SEQ ID 9404> was also identified.

A related DNA sequence was identified in *S. pyogenes* <SEQ ID 3177> which encodes the amino acid sequence <SEQ ID 3178>. Analysis of this protein sequence reveals the following:

```
Possible site: 13
>>> Seems to have no N-terminal signal sequence

----- Final Results -----
            bacterial cytoplasm --- Certainty = 0.2412 (Affirmative) < succ>
            bacterial membrane  --- Certainty = 0.0000 (Not Clear)   < succ>
             bacterial outside  --- Certainty = 0.0000 (Not Clear)   < succ>
```

An alignment of the GAS and GBS proteins is shown below:

```
Identities = 146/168 (86%), Positives = 161/168 (94%)

Query:    1 MNLENGIIYSKNIAKQLIAKDPKNKATYEKNRDAYVAKLEKLDKEAKSKFNAIPANKKLI   60
            +NLENGIIYSKNIAKQLIAKDPKNK TYEKN  AYVAKLEKLDKEAKSKF+AI  NKKLI
Sbjct:  107 LNLENGIIYSKNIAKQLIAKDPKNKETYEKNLKAYVAKLEKLDKEAKSKFDAIAENKKLI  166

Query:   61 VTSEGCFKYFSKAYGVPSAYIWEINTEEEGTPDQITSLVKKLKQVRPSALFVESSVDKRP  120
            VTSEGCFKYFSKAYGVPSAYIWEINTEEEGTPDQI+SL++KLK ++PSALFVESSVD+RP
Sbjct:  167 VTSEGCFKYFSKAYGVPSAYIWEINTEEEGTPDQISSLIEKLKVIKPSALFVESSVDRRP  226

Query:  121 MKSVSRESGIPIYAEIFTDSIAKKGQKGDSYYAMMKWNLDKIAEGLAK              168
            M++VS++SGIPIY+EIFTDSIAKKG+ GDSYYAMMKWNLDKI+EGLAK
Sbjct:  227 METVSKDSGIPIYSEIFTDSIAKKGKPGDSYYAMMKWNLDKISEGLAK              274
```

Figure 164:
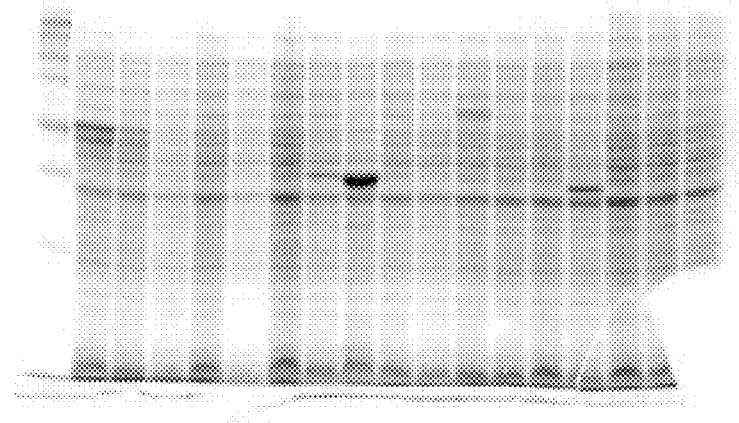
Figure 242:
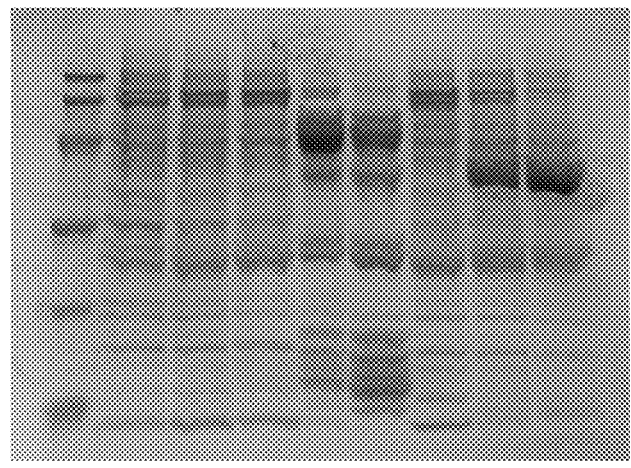

SEQ ID 9404 (GBS679) was expressed in *E. coli* as a His-fusion product. SDS-PAGE analysis of total cell extract is shown in FIG. 164 (lane 7-9; MW 36 kDa) and in FIG. 188 (lane 8; MW 36 kDa). Purified protein is shown in FIG. 242, lanes 9 & 10.

Based on this analysis, it was predicted that these proteins and their epitopes could be useful antigens for vaccines or diagnostics.

EXAMPLE 6

A DNA sequence (GBSx0003) was identified in *S. agalactiae* <SEQ ID 8485> which encodes the amino acid sequence <SEQ ID 8486>. This protein is predicted to be ATP-binding protein MtsB. Analysis of this protein sequence reveals the following:

```
Possible site: 55
>>> Seems to have no N-terminal signal sequence

----- Final Results -----
            bacterial cytoplasm --- Certainty = 0.2097 (Affirmative) < succ>
            bacterial membrane  --- Certainty = 0.0000 (Not Clear)   < succ>
             bacterial outside  --- Certainty = 0.0000 (Not Clear)   < succ>
```

A related DNA sequence was identified in *S. pyogenes* <SEQ ID 8765> which encodes the amino acid sequence <SEQ ID 8766>. Analysis of this protein sequence reveals the following:

```
Possible site: 29
>>> Seems to have no N-terminal signal sequence

----- Final Results -----
          bacterial cytoplasm --- Certainty = 0.1929 (Affirmative) < succ>
          bacterial membrane  --- Certainty = 0.0000 (Not Clear)   < succ>
           bacterial outside  --- Certainty = 0.0000 (Not Clear)   < succ>
```

An alignment of the GAS and GBS proteins is shown below:

```
Identities = 143/238 (60%), Positives = 186/238 (78%), Gaps = 2/238 (0%)

Query:   1 MIISKHLSVSYDNNL-VLEDINLRLEGSGIIGILGPNGAGKSTLMKALLGLVDSTGESGI   59
           MI + +L V+YD N   LE IN+ +EG  I+GI+GPNGAGKST MKA+L L+D  G   +
Sbjct:  10 MITTNNLCVTYDGNSNALEAINVTIEGPSIVGIIGPNGAGKSTFMKAILNLIDYQGHVTV   69

Query:  60 GG-DLLPLMGRVAYVEQKTNIDYQFPITVGECVSLGLYKERGLFKRLSKTDWEKVSRVID  118
            G D   L    VAYVEQ++ IDY FPITV ECV+LG Y + GLF+R+ K  +E+V +V+
Sbjct:  70 DGKDGRKLGHTVAYVEQRSMIDYNFPITVKECVALGTYSKLGLFRRVGKKQFEQVDKVLK  129

Query: 119 QVGLRGFENRPINALSGGQFQRMLMARCLVQEADYIFLDEPFVGIDSISEQIIVNLLKKL  178
           QVGL  F +RPI +LSGGQFQRML+ARCL+QE+DYIFLDEPFVGIDS+SE+IIV+LLK+L
Sbjct: 130 QVGLEDFGHRPIKSLSGGQFQRMLVARCLIQESDYIFLDEPFVGIDSVSEKIIVDLLKEL  189

Query: 179 SKAGKLILVVHHDLSKVDHYFDQVIILNRHLIACGPIDQAFTRENLSAAYGDAILLGQ    236
            AGK IL+VHHDLSKV+HYFD+++ILN+HL+A G + + FT + LS AYG+ ++LG+
Sbjct: 190 KMAGKTILIVHHDLSKVEHYFDKLMILNKHLVAYGNVCEVFTVDTLSKAYGNHLILGK    247
```

Based on this analysis, it was predicted that these proteins and their epitopes could be useful antigens for vaccines or diagnostics.

EXAMPLE 7

A DNA sequence (GBSx0004) was identified in *S. agalactiae* <SEQ ID 9> which encodes the amino acid sequence <SEQ ID 10>. Analysis of this protein sequence reveals the following:

```
Possible site: 28
>>> Seems to have an uncleavable N-term signal seq

----- Final Results -----
           bacterial membrane  --- Certainty = 0.0000 (Not Clear) < succ>
            bacterial outside  --- Certainty = 0.0000 (Not Clear) < succ>
          bacterial cytoplasm --- Certainty = 0.0000 (Not Clear) < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 8

A DNA sequence (GBSx0005) was identified in *S. agalactiae* <SEQ ID 11> which encodes the amino acid sequence <SEQ ID 12>. This protein is predicted to be integral membrane protein MtsC (znuB). Analysis of this protein sequence reveals the following:

```
Lipop: Possible site: -1 Crend: 6
McG: Discrim Score: 3.77
GvH: Signal Score (-7.5): -0.47
     Possible site: 45
>>> Seems to have a cleavable N-term signal seq.
     INTEGRAL      Likelihood = -10.83   Transmembrane   138-154  (134-162)
     INTEGRAL      Likelihood =  -7.96   Transmembrane    60-76   (50-86)
     INTEGRAL      Likelihood =  -6.95   Transmembrane    95-111  (93-118)
     INTEGRAL      Likelihood =  -5.79   Transmembrane   180-196  (174-216)
     INTEGRAL      Likelihood =  -4.35   Transmembrane   198-214  (197-216)
```

```
    INTEGRAL      Likelihood = -4.30     Transmembrane    250-266 (246-268)
    INTEGRAL      Likelihood = -3.93     Transmembrane    222-238 (221-241)
    PERIPHERAL    Likelihood =  5.94     116
modified ALOM score: 2.67
*** Reasoning Step: 3

----- Final Results -----
             bacterial membrane  --- Certainty = 0.5331(Affirmative) < succ>
             bacterial outside   --- Certainty = 0.0000(Not Clear)   < succ>
             bacterial cytoplasm --- Certainty = 0.0000(Not Clear)   < succ>
```

A related DNA sequence was identified in *S. pyogenes* <SEQ ID 13> which encodes the amino acid sequence <SEQ ID 14>. Analysis of this protein sequence reveals the following:

```
Possible site: 45
>>> Seems to have a cleavable N-term signal seq.
    INTEGRAL      Likelihood = -11.25    Transmembrane    138-154 (134-163)
    INTEGRAL      Likelihood =  -9.08    Transmembrane     66-82  (50-86)
    INTEGRAL      Likelihood =  -6.79    Transmembrane     95-111 (93-118)
    INTEGRAL      Likelihood =  -5.63    Transmembrane    180-196 (176-216)
    INTEGRAL      Likelihood =  -4.73    Transmembrane    221-237 (218-241)
    INTEGRAL      Likelihood =  -4.35    Transmembrane    250-266 (246-268)
    INTEGRAL      Likelihood =  -4.35    Transmembrane    198-214 (197-216)
    INTEGRAL      Likelihood =  -2.81    Transmembrane     48-64  (47-64)

----- Final Results -----
             bacterial membrane  --- Certainty = 0.5501(Affirmative) < succ>
             bacterial outside   --- Certainty = 0.0000(Not Clear)   < succ>
             bacterial cytoplasm --- Certainty = 0.0000(Not Clear)   < succ>
```

An alignment of the GAS and GBS proteins is shown below:

```
Identities = 224/275 (81%), Positives = 255/275 (92%)

Query:   1 MFTKFFEGLLTYHFLQNAFITAIVIGIVAGAVGCFIILRSMSLMGDAISHAVLPGVAISF   60
           M  KFFEGL++YHFLQNA ITA+VIGIV+GAVGCFIILRSMSLMGDAISHAVLPGVA+SF
Sbjct:   1 MSMKFFEGLMSYHFLQNALITAVVIGIVSGAVGCFIILRSMSLMGDAISHAVLPGVALSF   60

Query:  61 ILGINFFIGAIVFGLLSSIIITYIKENSVIKGDTAIGITFSSFLALGIILIGLANSTTDL  120
           ILG+NFFIGAI+FGLL+S+IITYIKENSVIKGDTAIGITFSSFLALG+ILIG+ANS+TDL
Sbjct:  61 ILGVNFFIGAIIFGLLASVIITYIKENSVIKGDTAIGITFSSFLALGVILIGVANSSTDL  120

Query: 121 FHILFGNILAVQDSDKYMTIIVGLIVLTLITIFFKELLLTSFDPVLAKSMGMRVSFYHYL  180
           FHILFGNILAVQDSDK++TI V + VL +I++FFKELLLTSFDP+LAKSMG++V+ YHYL
Sbjct: 121 FHILFGNILAVQDSDKWITIGVSIFVLVVISLFFKELLLTSFDPILAKSMGVKVNAYHYL  180

Query: 181 LMILLTLVAVTAMQSVGTILIVALLITPAATAYLYVKSLRTMLFLSSALGAVASVLGLYI  240
           LM+LLTLVAVTAMQSVGTILIVALLITPAATAYLY  SL+ ML +SS LGA+ASVLGLY+
Sbjct: 181 LMVLLTLVAVTAMQSVGTILIVALLITPAATAYLYANSLKVMLVMSSLLGALASVLGLYL  240

Query: 241 GYTFNIAAGSSIVLTSTFMFLLAFLFSPKQSLFKK                          275
           GYTFN+AAGSSIVLTS  MFL++F  SPKQ   K+
Sbjct: 241 GYTFNVAAGSSIVLTSAMMFLISFFVSPKQGYLKR                          275
```

Based on this analysis, it was predicted that these proteins and their epitopes could be useful antigens for vaccines or diagnostics.

EXAMPLE 9

A DNA sequence (GBSx0006) was identified in *S. agalactiae* <SEQ ID 15> which encodes the amino acid sequence <SEQ ID 16>. Analysis of this protein sequence reveals the following:

```
Possible site: 38
>>> Seems to have no N-terminal signal sequence

----- Final Results -----
            bacterial cytoplasm --- Certainty = 0.1280(Affirmative) < succ>
             bacterial membrane --- Certainty = 0.0000(Not Clear) < succ>
              bacterial outside --- Certainty = 0.0000(Not Clear) < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 10

A DNA sequence (GBSx0007) was identified in *S. agalactiae* <SEQ ID 17> which encodes the amino acid sequence <SEQ ID 18>. This protein is predicted to be peptidyl-prolyl cis-trans isomerase 10 (rotamase). Analysis of this protein sequence reveals the following:

```
Lipop Possible site: 19 Crend: 2
McG: Discrim Score: 5.27
GvH: Signal Score (-7.5): -4.14
Possible site: 19
>>> May be a lipoprotein
ALOM program count: 0 value: 9.34   threshold: 0.0
PERIPHERAL Likelihood = 9.34 89
modified ALOM score: -2.37

*** Reasoning Step: 3

----- Final Results -----
             bacterial membrane --- Certainty = 0.0000 (Not Clear) < succ>
              bacterial outside --- Certainty = 0.0000 (Not Clear) < succ>
            bacterial cytoplasm --- Certainty = 0.0000 (Not Clear) < succ>
```

The protein has homology with the following sequences in the GENPEPT database:

```
>GP: CAA19257 GB: AL023704 putative Cyclophilin-type peptidyl-prolyl
cis-trans isomerase protein [Schizosaccharomyces pombe]
Identities = 88/224 (39%), Positives = 123/224 (54%), Gaps = 46/224 (20%)

Query:  50 NKKTKQALKADKKAFPQLDKAVAKNEAQ-----------VLIKTSKGDINIKLFPKYAPL   98
            N  TK  L +D+  + +      V   NE +            +I T++GDI+IKL+P+  AP
Sbjct: 419 NMSTKFTL-SDRDVYNEQVLPVTNNEGRQENGNILLGKAAIIHTTQGDISIKLYPEEAPK  477

Query:  99 AVENFLTHAKEGYYNGLSFHRVIKDFMIQSGDPNGDTGGKSIWNSKDKKKDSGNGFVNE   158
           AV+NF THA+ GYY+    FHR+IK+FMIQ GDP GDTGG+SIW      KKD    F +E
Sbjct: 478 AVQNFTTHAENGYYDNTIFHRIIKNFMIQGGDPLGDTGGESIW-----KKD----FEDE   528

Query: 159 ISPYLYNIRG-SLAMANAGADTNGSQFFINQSQQDHSKQLSDKKVPKVIIKAYSEGGNPS  217
           ISP L + R   +++MAN+G +TNGSQFFI                              P
Sbjct: 529 ISPNLKHDRPFTVSMANSGPNTNGSQFFITTDL----------------------TPW   564

Query: 218 LDGGYTVFGQVISGMETVDKIASVEVTKSDQPKEKITITSIKVI                 261
           LDG +T+F +   +G++ V +I    E   K D+P  E     I +I ++
Sbjct: 565 LDGKHTIFARAYAGLDVVHRIEQGETDKYDRPLEPTKIINISIV                 608
```

A related DNA sequence was identified in *S. pyogenes* <SEQ ID 19> which encodes the amino acid sequence <SEQ ID 20>. Analysis of this protein sequence reveals the following:

Possible site: 19
>>> May be a lipoprotein

----- Final Results -----
            bacterial membrane --- Certainty = 0.0000 (Not Clear) < succ>
             bacterial outside --- Certainty = 0.0000 (Not Clear) < succ>
            bacterial cytoplasm --- Certainty = 0.0000 (Not Clear) < succ>

The protein has homology with the following sequences in the databases:

```
>GP: CAB88542 GB: AL353818 putative protein [Arabidopsis thaliana]
Identities = 83/186 (44%), Positives = 104/186 (55%), Gaps = 34/186 (18%)

Query:  78 VVMRTSQGDITLKLFPKYAPLAVENFLTHAKKGYYDNLTFHRVINDFMIQSGDPKGDGTG  137
           V+M T+ GDI +KL+P+  P  VENF TH + GYYDN  FHRVI  FMIQ+GDP GDGTG
Sbjct: 476 VIMHTTLGDIHMKLYPEECPKTVENFTTHCRNGYYDNHLFHRVIRGFMIQTGDPLGDGTG  535

Query: 138 GESIWKGKDPKKDAGNGFVNEISPFLYHIRG-ALAMANAGANTNGSQFYINQNKKNQSKG  196
           G+SIW        G F +E    L H R   L+MANAG NTNGSQF+I
Sbjct: 536 GQSIW---------GREFEDEFHKSLRHDRPFTLSMANAGPNTNGSQFFITT--------  578

Query: 197 LSSTNYPKPIISAYEHGGNPSLDGGYTVFGQVIDGMDVVDKIAATSINQNDKPEQDITIT  256
                            P LD  +TVFG+V+ GMDVV  I      ++ND+P QD+ I
Sbjct: 579 ----------------VATPWLDNKHTVFGRVVKGMDVVQGIEKVKTDKNDRPYQDVKIL  622

Query: 257 SIDIVK  262
           ++ + K
Sbjct: 623 NVTVPK  628
```

An alignment of the GAS and GBS proteins is shown below:

```
Identities = 172/267 (64%), Positives 221/267 (82%)

Query:   1 MKKIIYLGLACVSILTLSGCESIERSLKGDRYVDQKLAENSSKEATEQLNKKTKQALKAD   60
           MKK++ L L +S+L LS CES++R++KGD+Y+D+K A+  S+ A++   + ++ALKAD
Sbjct:   1 MKKLLSLSLVAISLLNLSACESVDRAIKGDKYIDEKTAKEESEAASKAYEESIQKALKAD   60

Query:  61 KKAFPQLDKAVAKNEAQVLIKTSKGDINIKLFPKYAPLAVENFLTHAKEGYYNGLSFHRV  120
              FPQL K V K EA+V+++TS+GDI +KLFPKYAPLAVENFLTHAK+GYY+ L+FHRV
Sbjct:  61 ASQFPQLTKEVGKEEAKVVMRTSQGDITLKLFPKYAPLAVENFLTHAKKGYYDNLTFHRV  120

Query: 121 IKDFMIQSGDPNGDTGGKSIWNSKDKKKDSGNGFVNEISPYLYNIRGSLAMANAGADTN  180
           I DFMIQSGDP GDTGG+SIW  KD KKD+GNGFVNEISP+LY+IRG+LAMANAGA+TN
Sbjct: 121 INDFMIQSGDPKGDTGGESIWKGKDPKKDAGNGFVNEISPFLYHIRGALAMANAGANTN  180

Query: 181 GSQFFINQSQQDHSKQLSDKKVPKVIIKAYSEGGNPSLDGGYTVFGQVISGMETVDKIAS  240
           GSQF+INQ++++ SK LS   PK II AY  GGNPSLDGGYTVFGQVI GM+ VDKIA+
Sbjct: 181 GSQFYINQNKKNQSKGLSSTNYPKPIISAYEHGGNPSLDGGYTVFGQVIDGMDVVDKIAA  240

Query: 241 VEVTKSDQPKEKITITSIKVIKDYKFK  267
           + ++D+P++ ITITSI ++KDY+FK
Sbjct: 241 TSINQNDKPEQDITITSIDIVKDYRFK  267
```

Figure 51:
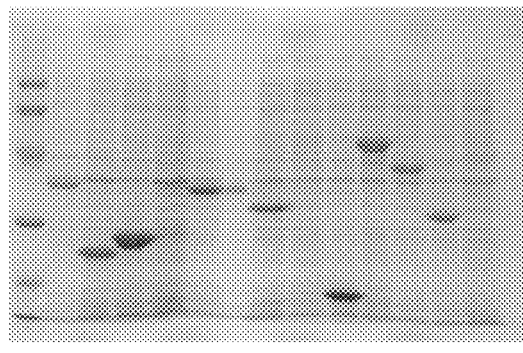

SEQ ID 18 (GBS205) was expressed in *E. coli* as a His-fusion product. SDS-PAGE analysis of total cell extract is shown in FIG. 51 (lane 13; MW 31 kDa).

Figure 206:
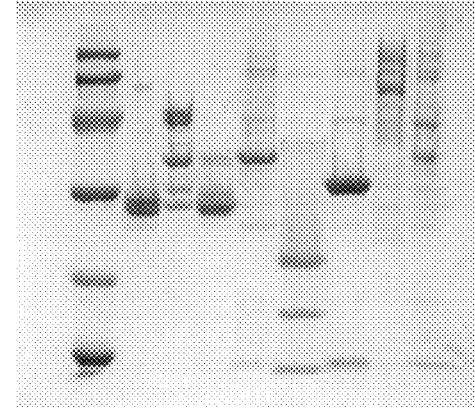

GBS205-His was purified as shown in FIG. 206, lane 8.

Based on this analysis, it was predicted that these proteins and their epitopes could be useful antigens for vaccines or diagnostics.

EXAMPLE 11

A DNA sequence (GBSx0008) was identified in *S. agalactiae* <SEQ ID 21> which encodes the amino acid sequence <SEQ ID 22>. This protein is predicted to be sporulation protein SpoIIIE (ftsK). Analysis of this protein sequence reveals the following:

```
Lipop Possible site: -1  Crend: 10
McG: Discrim Score: -22.83
GvH: Signal Score (-7.5): -7.13
   Possible site: 39
>>> Seems to have no N-terminal signal sequence
ALOM program   count: 5  value: -9.24  threshold: 0.0
    INTEGRAL    Likelihood = -9.24      Transmembrane    (27-60)
                                        36-52
    INTEGRAL    Likelihood = -9.18      Transmembrane    (154-188)
                                        162-178
    INTEGRAL    Likelihood = -4.04      Transmembrane    (595-615)
                                        597-613
    INTEGRAL    Likelihood = -3.77      Transmembrane    (58-83)
                                        63-79
    INTEGRAL    Likelihood = -2.60      Transmembrane    (88-108)
                                        90-106
    PERIPHERAL  Likelihood = -1.32      136
modified ALOM score: 2.35

*** Reasoning Step: 3
----- Final Results -----
             bacterial membrane --- Certainty = 0.4694 (Affirmative) < succ>
              bacterial outside --- Certainty = 0.0000 (Not Clear)   < succ>
             bacterial cytoplasm --- Certainty = 0.0000 (Not Clear)  < succ>
```

A related GBS nucleic acid sequence <SEQ ID 10035> which encodes amino acid sequence <SEQ ID 10036> was also identified.

The protein has homology with the following sequences in the GENPEPT database:

```
>GP:CAB13553 FB:Z99112 DNA translocase [Bacillus subtilis]
 Identities = 352/822 (42%), Positives = 508/822 (60%), Gaps = 70/822 (8%)

Query: 14   KTRRPTKAEIERQRAIQRMITALVLTIILFFGIIRLGIFGITVYNVIRFMVGSLAYLFIA  73
            K +R ++ + +Q I+ + L+   I   I++LG+ G T   + RF  G      L +
Sbjct: 3    KKKRKSRKKQAKQLNIKYELNGLLCIAISIIAILQLGVVGQTFIYLFRFFAGEWFILCLL  62

Query: 74   ATLIYLYFFKWLRKKDSLV----AGFLIASLGLLIEWHAYLFS----MPILKDKEILRST  125
            L+        W +K   SL+       AG       +L+  H  LF       ++   ++R+T
Sbjct: 63   GLLVLGVSLFWKKKTPSLLTRRKAGLYCIIASILLLSHVQLFKNLTHKGSIESASVVRNT  122

Query: 126  ARLIVSDLMQFKITVFAGGGMLGALIYKPIAFLFSNIGAYMIGVLFIILGLFLMSSLEVY  185
             L + D+      +     GGGM+GAL++    FLF++ G+ ++  ++   I++G+ L++       +
Sbjct: 123  WELFLMDMNGSSASPDLGGGMIGALLFAASHFLFASTGSQIMAIVMILIGMILVTGRSLQ  182

Query: 186  DIVE--------FIR----AFKN--KVAEKHEQNKKERFAKREMKKAIAEQERIERQKAE  231
            + ++                    FI+      AF +   K  + Q+ K+     A  ++K    +++++E +  +
Sbjct: 183  ETLKKWMSPIGRFIKEQWLAFIDDMKSFKSNMQSSKKTKAPSKKQKPARKKQQMEPEPPD  242

Query: 232  EEAYLASVNVDPETGEILEDQAEDNLDDALPPEVSETSTPVFEP-EILAYETSPQNDPLP  290
            EE    +V+  +  I+    ++ N ++   P + +   PV +P  +    ET  Q + +
Sbjct: 243  EEGDYETVSPLIHSEPIISSFSDRNEEEE-SPVIEKRAEPVSKPLQDIQPETGDQ-ETVS  300

Query: 291  VEPTIYLEDYDSPIPNMRENDEEMVYDLDDDVDDSDIENVDFTPKTTLVYKLPTIDLFAP  350
                 P  + E                            +EN D         Y++P++DL A
Sbjct: 301  APPMTFTE--------------------------LENKD--------YEMPSLDLLAD  324

Query: 351  DKPKNQSKEKDLVRKNIRVLEETFRSFGIDVKVERAEIGPSVTKYEIKPAVGVRVNRISN  410
              K   Q  +K + +N R  LE TF+SFG+   KV +   +GP+VTKYE+  P VGV+V+++I N
Sbjct: 325  PKHTGQQADKKNIYENARKLERTFQSFGVKAKVTQVHLGPAVTKYEVYPDVGVKVSKIVN  384

Query: 411  LSDDLALALAAKDVRIETPIPGKSLIGIEVPNSEIATVSFRELWEQS-DANPENLLEVPL  469
            LSDDLALALAAKD+RIE PIPGKS IGIEVPN+E+A VS +E+   E   + P+  + + L
Sbjct: 385  LSDDLALALAAKDIRIEAPIPGKSAIGIEVPNAEVAMVSLKEVLESKLNDRPDANVLIGL  444

Query: 470  GKAVNGNARSFNLARMPHLLVAGSTGSGKSVAVNGIISSILMKARPDQVKFMMIDPKMVE  529
            G+ ++G A    L +MPHLLVAG+TGSGKSV VNGII+SILM+A+P  +VK MMIDPKMVE
Sbjct: 445  GRNISGEAVLAELNKMPHLLVAGATGSGKSVCVNGIITSILMRAKPHEVKMMMIDPKMVE  504
```

-continued

```
Query:  530 LSVYNDIPHLLIPVVTNPRKASKALQKVVDEMENRYELFSKIGVRNIAGYNTKVEEFNAS 589
             L+VYN IPHLL PVVT+P+KAS+AL+KVV+EME RYELFS  G RNI GYN  ++  N
Sbjct:  505 LNVYNGIPHLLAPVVTDPKKASQALKKVVNEMERRYELFSHTGTRNIEGYNDYIKRANNE 564

Query:  590 SEQKQIPLPLIVVIVDELADLMMVASKEVEDAIIRLGQKARAAGIHMILATQRPSVDVIS 649
                KQ  LP IVVIVDELADLMMVAS +VED+I RL Q ARAAGIH+I+ATQRPSVDVI+
Sbjct:  565 EGAKQPELPYIVVIVDELADLMMVASSDVEDSITRLSQMARAAGIHLIIATQRPSVDVIT 624

Query:  650 GLIKANVPSRIAFAVSSGTDSRTILDENGAEKLLGRGDMLFKPIDENHPVRLQGSFISDD 709
             G+IKAN+PSRIAF+VSS TDSRTILD  GAEKLLGRGDMLF P+  N PVR+QG F+SDD
Sbjct:  625 GVIKANIPSRIAFSVSSQTDSRTILDMGGAEKLLGRGDMLFLPVGANKPVRVQGAFLSDD 684

Query:  710 DVERIVGFIKDQAEADYDDAFDPGEVSETDNGSGGGGGVPESDPLFEEAKGLVLETQKAS 769
             +VE++V +  Q +A Y +   P E +ET +          +D L++EA  L++  Q AS
Sbjct:  685 EVEKVVDHVITQQKAQYQEEMIPEETTETHS--------EVTDELYDEAVELIVGMQTAS 736

Query:  770 ASMIQRRLSVGFNRATRLMEELEAAGVIGPAEGTKPRKVLMT 811
              SM+QRR  +G+ RA RL++  +E  GV+GP EG+KPR+VL++
Sbjct:  737 VSMLQRRFRIGYTRAARLIDAMEERGVVGPYEGSKPREVLLS 778
46.5/66/5% over 775aa
OMNI|NT01BS1964| sporulation protein SpoIIIE Insert characterized
ORF01349(340-2733 of 3048
OMNI|NT01BS1964(6-781 of 790) sporulation protein SpoIIIE
% Match = 29.6
% identity = 46.4    % Similarity = 66.5
Matches = 352  Mismatches = 243  Conservative Sub.s = 152
         90       120       150       180       210       240       270       300
TLN*LATT*S*YTDTG*TKINNFFHTYSLIKLLR*LYFIINF*IIYKSK**TYWGTC*NYDRIV*HELIEKVRNKYFT*N 330       360       390       420       450       480       510       540
MVFPMANKKKTKGKKTRRPTKAEIERQRAIQRMITALVLTIILFFGIIRLGIFGITVYNVIRFMVGSLAYLFIAATLIYLY
              |:|  :: :  :|   |:    |:        |  |:  ||  ||   |   ||      ||
            VMSVAKKKRKSRKKQAKQLNIKYELNGLLCIAISIIAILQLGVVGQTFIYLFRFFAGEWFILCLLGLLVLGV
                       10        20        30        40        50        60        70

570      588       618       648       666       696       726       756
FFKWLRKKDSLV----AGFLIASLGLLIEWHAYLFSMPILK----DKEILRSTARLIVSDLMQFKITVFAGGGMLGALIY
 :  |  :|  ||    ||:     ||:   ||:   |  ||   :|:       ||      |||    :|||:|||:
SLFWKKKTPSLLTRRKAGLYCIIASILLLSHVQLFKNLTHKGSIESASVVRNTWELFLMDMNGSSASPDLGGGMIGALLF
          90       100       110       120       130       140       150

786       816       846                  894         924       954
KPIAFLFSNIGAYMIGVLFIILGLFLMSSLEVYDIVE--------FIR----AF--KNKVAEKHEQNKKERFAKREMKKA
   |||::  |:  ::  ::  |::|  |::       :       ||:    ||       |    |: |:     |  ::|
AASHFLFASTGSQIMAIVMILIGMILVTGRSLQETLKKWMSPIGRFIKEQWLAFIDDMKSFKSNMQSSKKTKAPSKKQKP
              170       180       190       200       210       220       230

984      1014      1044      1074      1104      1134      1164      1194
IAEQERIERQKAEEEAYLASVNVDPETGEILEDQAEDNLDDALPPEVSETSTPVFEPEILAYETSPQNDPLPVEPTIYLE
 ::::| :  :|       :|   |:      ::    | :: :  |
ARKKQQMEPEPPPDEEGDYETVSPLIHSEPIISSFSDRN-EEEESPVIEKRAEPVSKP----------------------
              250       260       270       280

1224      1254      1281      1326      1356      1386      1416
DYDSPIPNMRENDEEMVYDLDD-DVDDSDIENVDFTPKT-----TLVYKLPTIDLFAPDKPKNQSKEKDLVRKNIRVLEE
||   |:| |||  |  |       |:::||:|       |::|::|:|  |  ::    |   |
-----------------LQDIQPETGDQETVSAPPMTFTELENKDYEMPSLDLLADPKHTGQQADKKNIYENARKLER
                                290       300       310       320       330       340

1446      1476      1506      1536      1566      1596      1626      1656
TFRSFGIDVKVERAEIGPSVTKYEIKPAVGVRVNRISNLSDDLALALAAKDVRIETPIPGKSLIGIEVPNSEIATVSFRE
|| :||:   ||   : :|||||||| | |||:|:| |||||||||||||:|  |||||| | ||||||:| || ::|
TFQSFGVKAKVTQVHLGPAVTKYEVYPDVGVKVSKIVNLSDDLALALAAKDIRIEAPIPGKSAIGIEVPNABVAMVSLKE
              360       370       380       390       400       410       420

1683      1713      1743      1773      1803      1833      1863      1893
LWEQS-DANPENLLEVPLGKAVNGNARSFNLARMPHLLVAGSTGSGKSVAVNGIISSILMKARPDQVKFMMIDPKMVELS
:  |   : |: :: ::  ||  ::| |  | :||||||||:|||||||| ||||:|::  :||  ||||||||||||:
VLESKLNDRPDANVLIGLGRNISGEAVLAELNKMPHLLVAGATGSGKSVCVNGIITSILMRAKPHEVKMMMIDPKMVELN
              440       450       460       470       480       490       500

1923      1953      1983      2013      2043      2073      2103      2133
VYNDIPHLLIPVVTNPRKASKALQKVVDEMENRYELFSKIGVRNIAGYNTKVEEFNASSEQKQIPLPLIVVIVDELADLM
|||  |||||| |||:|:|||:|:|||:|||| |||||  | ||  ||  ::   |  |     ||  || ||||||||
VYNGIPHLLAPVVTDPKKASQALKKVVNEMERRYELFSHTGTRNIEGYNDYIKRANNEEGAKQPELPYIVVIVDELADLM
              520       530       540       550       560       570       580
```

```
                                                  -continued
2163      2193      2223      2253      2283      2313      2343      2373
MVASKEVEDAIIRLGQKARAAGIHMILATQRPSVDVISGLIKANVPSRIAFAVSSGTDSRTILDENGAEKLLLGRGDMLFK
|||| :|||:|  || |  |||||||||||:|:||||||||||:|:||||:||||||:|||  ||||||||  ||||||||||||
MVASSDVEDSITRLSQMARAAGIHLIIATQRPSVDVITGVIKANIPSRIAFSVSSQTDSRTILDMGGAEKLLLGRGDMLFL
          600       610       620       630       640       650       660

2403      2433      2463      2493      2523      2553      2583      2613
PIDENHPVRLQGSFISDDDVERIVGFIKDQAEADYDDAFDPGEVSETDNGSGGGGGVPESDPLFEEAKGLVLETQKASAS
|:  |  |||:||:|:||||:||::|   :  |  :|  |  :  |  |  ||          :|  |::||  |:::  |  ||  |
PVGANKPVRVQGAFLSDDEVEKVVDHVITQQKAQYQEEMIPEETTET--------HSEVTDELYDEAVELIVGMQTASVS
          680       690       700       710                720       730       740

2643      2673      2703      2733      2763      2793      2823      2853
MIQRRLSVGFNRATRLMEELEAAGVIGPAEGTKPRKVLMTPTPSE*EKTNLTRNCRISFLCYNEANR*RRRLRMHIETVI
|:|||:  :|:  ||  ||::  :|   ||:||  ||:|||:||::         :      :
MLQRRFRIGYTRAARLIDAMEERGVVGPYEGSKPREVLLSKEKYDELSS
                760       770       780       790
```

A related DNA sequence was identified in *S. pyogenes* <SEQ ID 23> which encodes the amino acid sequence <SEQ ID 24>. Analysis of this protein sequence reveals the following:

```
Possible site: 51
>>> Seems to have no N-terminal signal sequence
INTEGRAL   Likelihood = -9.45   Transmembrane    31-47     (25-55)
INTEGRAL   Likelihood = -7.17   Transmembrane   160-176   (153-183)
INTEGRAL   Likelihood = -4.99   Transmembrane    93-109    (86-111)
INTEGRAL   Likelihood = -4.04   Transmembrane   586-602   (584-604)
INTEGRAL   Likelihood = -1.22   Transmembrane    64-80     (64-80)

----- Final Results -----
             bacterial membrane --- Certainty = 0.4779 (Affirmative) < succ>
              bacterial outside --- Certainty = 0.0000 (Not Clear)  < succ>
             bacterial cytoplasm --- Certainty = 0.0000 (Not Clear)  < succ>
```

The protein has homology with the following sequences in the databases:

```
!GB:Z99112 DNA translocase [Bacil-   601 e-170
lus subtilis]
Identities = 354/816 (43%), Positives = 499/816 (60%),
Gaps = 69/816 (8%)

Query:   11 APKKRLTKAEVEKQRAIKRMILSVLMALLLIFAMLRLGVFGVTTYNMIRFLVGSLAYPFM   70
            A KKR ++ +  KQ  IK +  +L    + I A+L+LGV G T    + RF  G        +
Sbjct:    2 AKKKRKSRKKQAKQLNIKYELNGLLCIAISIIAILQLGVVGQTFIYLFRFFAGEWFILCL   61

Query:   71 FAWLIYLFCFKWLRQKDGMI----AGVVIAFLGLLVEWHAFLFA----MPRMLDQDIFLG  122
               L+      W ++     ++      AG+     +L+  H LF          +      +
Sbjct:   62 LGLLVLGVSLFWKKKTPSLLTRRKAGLYCIIASILLLSHVQLFKNLTHKGSIESASVVRN  121

Query:  123 TARLITRDLLALRVTEFVGGGMLGALLYKPIAFLFSNIGSYFIGFLFILLGLFLMTPWDI  182
            T L  D+   +  +GGGM+GALL+    FLF++ GS  +  + IL+G+ L+T      +
Sbjct:  122 TWELFLMDMNGSSASPDLGGGMIGALLFAASHFLFASTGSQIMAIVMILIGMILVTGRSL  181

Query:  183 YD--------VSHFVKEA----VDKLAVAYQENKEKRFIKREEHRLQAEKEALEKQAQEE  230
                       +    F+KE    +D +  +++ N +    K+  +    +K A +KQ  E
Sbjct:  182 QETLKKWMSPIGRFIKEQWLAFIDDMK-SFKSNMQSS--KKTKAPSKKQKPARKKQQMEP  238

Query:  231 EKRLAELTVDPETGEIVEDSQSQVSYDLAEDMT-KEPEILAYDSHLKDDETSLFDQ----  285
            E           E G+            Y+   +  EP I ++   +++E+ + ++
Sbjct:  239 EP-------PDEEGD----------YETVSPLIHSEPIISSFSDRNEEEESPVIEKRAEP  281

Query:  286 --EDLAYAHEEIGAYDSLSALASSEDEMDMDEPVEVDFTPKTHLLYKLPTIDLFAPDKPK  343
              +L    E G  +++SA  +  E++  +                 Y++P++DL A  K
Sbjct:  282 VSKPLQDIQPETGDQETVSAPPMTFTELENKD-------------YEMPSLDLLADPKHT  328

Query:  344 NQSKEKNLVRKNIKVLEDTFQSFGIDVKVERAEIGPSVTKYEIKPAVGVRVNRISNLADD  403
               Q +K  +N + LE TFQSFG+   KV +  +GP+VTKYE+ P VGV+V+++ NL+DD
Sbjct:  329 GQQADKKNIYENARKLERTFQSFGVKAKVTQVHLGPAVTKYEVYPDVGVKVSKIVNLSDD  388
```

```
-continued
Query: 404 LALALAAKDVRIEAPIPGKSLIGIEVPNSEIATVSFRELWEQS-DANPENLLEVPLGKAV 462
            LALALAAKD+RIEAPIPGKS IGIEVPN+E+A VS +E+ E   + P+ + + LG+ +
Sbjct: 389 LALALAAKDIRIEAPIPGKSAIGIEVPNAEVAMVSLKEVLESKLNDRPDANVLIGLGRNI 448

Query: 463 NGNARSFNLARMPHLLVAGSTGSGKSVAVNGIISSILMKARPDQVKFMMIDPKMVELSVY 522
            +G A    L +MPHLLVAG+TGSGKSV VNGII+SILM+A+P +VK MMIDPKMVEL+VY
Sbjct: 449 SGEAVLAELNKMPHLLVAGATGSGKSVCVNGIITSILMRAKPHEVKMMMIDPKMVELNVY 508

Query: 523 NDIPHLLIPVVTNPRKASKALQKVVDEMENRYELFSKIGVRNIAGYNTKVEEFNASSEQK 582
            N IPHLL PVVT+P+KAS+AL+KVV+EME RYELFS   G RNI GYN ++  N     K
Sbjct: 509 NGIPHLLAPVVTDPKKASQALKKVVNEMERRYELFSHTGTRNIEGYNDYIKRANNEEGAK 568

Query: 583 QIPLPLIVVIVDELADLMMVASKEVEDAIIRLGQKARAAGIHMILATQRPSVDVISGLIK 642
            Q  LP IVVIVDELADLMMVAS +VED+I RL Q ARAAGIH+I ATQRPSVDVI+G+IK
Sbjct: 569 QPELPYIVVIVDELADLMMVASSDVEDSITRLSQMARAAGIHLIIATQRPSVDVITGVIK 628

Query: 643 ANVPSRMAFAVSSGTDSRTILDENGAEKLLGRGDMLFKPIDENHPVRLQGSFISDDDVER 702
            AN+PSR+AF+VSS TDSRTILD  GAEKLLGRGDMLF P+  N PVR+QG+F+SDD+VE+
Sbjct: 629 ANIPSRIAFSVSSQTDSRTILDMGGAEKLLGRGDMLFLPVGANKPVRVQGAFLSDDEVEK 688

Query: 703 IVNFIKDQTEADYDDAFDPGEVSDNDPGFSGNGGAAEGDPLFEEAKALVLETQKASASMI 762
            +V+ + Q +A Y +    P E ++      +   D L++EA L++  Q AS SM+
Sbjct: 689 VVDHVITQQKAQYQEEMIPEETTETHSEVT--------DELYDEAVELIVGMQTASVSML 740

Query: 763 QRRLSVGFNRATRLMDELEEAGVIGPAEGTKPRKVL                         798
            QRR  +G+ RA RL+D +EE GV+GP EG+KPR+VL
Sbjct: 741 QRRFRIGYTRAARLIDAMEERGVVGPYEGSKPREVL                         776
```

An alignment of the GAS and GBS proteins is shown below:

```
Identities = 620/818 (75%), Positives = 701/818 (84%), Gaps = 25/818 (3%)

Query:   1 MVFMANKKKTKGKKTRRPTKAEIERQRAIQRMITALVLTIILFFGIIRLGIFGITVYNVI  60
           MV   +KK+ KK  R TKAE+E+QRAI+RMI ++++ ++L F ++RLG+FG+T YN+I
Sbjct:   1 MVKRNQRKKSAPKK--RLTKAEVEKQRAIKRMILSVLMALLLIFAMLRLGVFGVTTYNMI  58

Query:  61 RFMVGSLAYLFIAATLIYLYFFKWLRKKDSLVAGFLIASLGLLIEWHAYLFSMPILKDKE 120
           RF+VGSLAY F+ A LIYL+ FKWLR+KD ++AG +IA LGLL+EWHA+LF+MP + D++
Sbjct:  59 RFLVGSLAYPFMFAWLIYLFCFKWLRQKDGMIAGVVIAFLGLLVEWHAFLFAMPRMLDQD 118

Query: 121 ILRSTARLIVSDLMQFKITVFAGGGMLGALIYKPIAFLFSNIGAYMIGVLFIILGLFLMS 180
           I    TARLI  DL+  ++T F GGGMLGAL+YKPIAFLFSNIG+Y IG LFI+LGLFLM+
Sbjct: 119 IFLGTARLITRDLLALRVTEFVGGGMLGALLYKPIAFLFSNIGSYFIGFLFILLGLFLMT 178

Query: 181 SLEVYDIVEFIRAFKNKVAEKHEQNKKERFAKREMKKAIAEQERIERQKAEEEAYLASVN 240
             +YD+  F++  +K+A   +++NK+++RF KRE + AE+E +E+Q  EEE  LA +
Sbjct: 179 PWDIYDVSHFVKEAVDKLAVAYQENKEKRFIKREEHRLQAEKEALEKQAQEEEKRLAELT 238

Query: 241 VDPETGEILEDQAEDNLDDALPPEVSETSTPVFEPEILAYETSPQNDPLPV---EPTIYL 297
           VDPETGEI+ED          +++E  T   EPEILAY++ +D   +    E    Y
Sbjct: 239 VDPETGEIVEDSQSQ-----VSYDLAEDMTK--EPEILAYDSHLKDDETSLFDQEDLAYA 291

Query: 298 ED----YDSPIPNMRENDEEMVYDLDDDVDDSDIENVDFTPKTTLVYKLPTIDLFAPDKP 353
           +      YDS + +   +++EM D+D+ V+       VDFTPKT L+YKLPTIDLFAPDKP
Sbjct: 292 HEEIGAYDS-LSALASSEDEM--DMDEPVE------VDFTPKTHLLYKLPTIDLFAPDKP 342

Query: 354 KNQSKEKDLVRKNIRVLEETFRSFGIDVKVERAEIGPSVTKYEIKPAVGVRVNRISNLSD 413
           KNQSKEK+LVRKNI+VLE+TF+SFGIDVKVERAEIGPSVTKYEIKPAVGVRVNRISNL+D
Sbjct: 343 KNQSKEKNLVRKNIKVLEDTFQSFGIDVKVERAEIGPSVTKYEIKPAVGVRVNRISNLAD 402

Query: 414 DLALALAAKDVRIETPIPGKSLIGIEVPNSEIATVSFRELWEQSDANPENLLEVPLGKAV 473
           DLALALAAKDVRIE PIPGKSLIGIEVPNSEIATVSFRELWEQSDANPENLLEVPLGKAV
Sbjct: 403 DLALALAAKDVRIEAPIPGKSLIGIEVPNSEIATVSFRELWEQSDANPENLLEVPLGKAV 462

Query: 474 NGNARSFNLARMPHLLVAGSTGSGKSVAVNGIISSILMKARPDQVKFMMIDPKMVELSVY 533
           NGNARSFNLARMPHLLVAGSTGSGKSVAVNGIISSILMKARPDQVKFMMIDPKMVELSVY
Sbjct: 463 NGNARSFNLARMPHLLVAGSTGSGKSVAVNGIISSILMKARPDQVKFMMIDPKMVELSVY 522

Query: 534 NDIPHLLIPVVTNPRKASKALQKVVDEMENRYELFSKIGVRNIAGYNTKVEEFNASSEQK 593
           NDIPHLLIPVVTNPRKASKALQKVVDEMENRYELFSKIGVRNIAGYNTKVEEFNASSEQK
Sbjct: 523 NDIPHLLIPVVTNPRKASKALQKVVDEMENRYELFSKIGVRNIAGYNTKVEEFNASSEQK 582

Query: 594 QIPLPLIVVIVDELADLMMVASKEVEDAIIRLGQKARAAGIHMILATQRPSVDVISGLIK 653
           QIPLPLIVVIVDELADLMMVASKEVEDAIIRLGQKARAAGIHMILATQRPSVDVISGLIK
Sbjct: 583 QIPLPLIVVIVDELADLMMVASKEVEDAIIRLGQKARAAGIHMILATQRPSVDVISGLIK 642
```

```
Query:  654 ANVPSRIAFAVSSGTDSRTILDENGAEKLLGRGDMLFKPIDENHPVRLQGSFISDDDVER  713
            ANVPSR+AFAVSSGTDSRTILDENGAEKLLGRGDMLFKPIDENHPVRLQGSFISDDDVER
Sbjct:  643 ANVPSRMAFAVSSGTDSRTILDENGAEKLLGRGDMLFKPIDENHPVRLQGSFISDDDVER  702

Query:  714 IVGFIKDQAEADYDDAFDPGEVSETDNGSGGGGGVPESDPLFEEAKGLVLETQKASASMI  773
            IV FIKDQ EADYDDAFDPGEVS+ D G  G GG  E DPLFEEAK LVLETQKASASMI
Sbjct:  703 IVNFIKDQTEADYDDAFDPGEVSDNDPGFSGNGGAAEGDPLFEEAKALVLETQKASASMI  762

Query:  774 QRRLSVGFNRATRLMEELEAAGVIGPAEGTKPRKVLMT                       811
            QRRLSVGFNRATRLM+ELE AGVIGPAEGTKPRKVL T
Sbjct:  763 QRRLSVGFNRATRLMDELEEAGVIGPAEGTKPRKVLQT                       800
```

Figure 147:
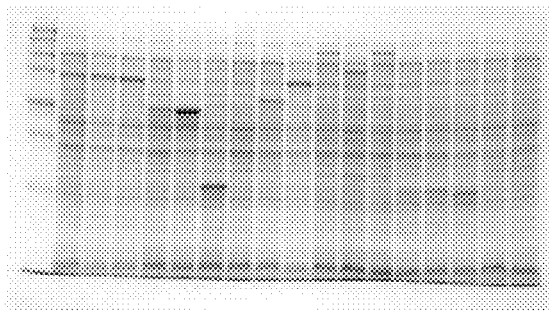

SEQ ID 22 (GBS272d) was expressed in *E. coli* as a GST-fusion product. SDS-PAGE analysis of total cell extract is shown in FIG. 147 (lane 9; MW 55 kDa+lane 10; MW 70 kDa). It was also expressed in *E. coli* as a His-fusion product. SDS-PAGE analysis of total cell extract is shown in FIG. 147 (lane 11 & 13; MW 85 kDa+lane 12; MW 74 kDa).

Based on this analysis, it was predicted that these proteins and their epitopes could be useful antigens for vaccines or diagnostics.

EXAMPLE 12

A DNA sequence (GBSx0009) was identified in *S. agalactiae* <SEQ ID 25> which encodes the amino acid sequence <SEQ ID 26>. This protein is predicted to be para-aminobenzoate synthetase (pabB) (pabB). Analysis of this protein sequence reveals the following:

```
Possible site: 61
>>> Seems to have no N-terminal signal sequence

----- Final Results -----
         bacterial cytoplasm --- Certainty = 0.4073 (Affirmative) < succ>
          bacterial membrane --- Certainty = 0.0000 (Not Clear)   < succ>
           bacterial outside --- Certainty = 0.0000 (Not Clear)   < succ>
```

The protein has homology with the following sequences in the GENPEPT database:

```
>GP: AAD07357 GB: AE000547 para-aminobenzoate synthetase (pabB)
[Helicobacter pylori 26695]
Identities = 204/580 (35%), Positives = 325/580 (55%), Gaps = 50/580 (8%)

Query:   16 YRFKNPTKELIADTLEQVLEVIKEVDYYQSQNYYVVGYLSYEASAAF-DSHFKVSQQKLA   74
            ++++    K+L A  L ++    +   +   Y+V GYL YEA  AF D +F+      L
Sbjct:    6 FKYQKSVKKLTATNLNELKNALDFISQNRGNGYFV-GYLLYEARLAFLDENFQSQTPFLY   64

Query:   75 GEHLAY---FTVHKDCENEAFPLSYENVRLADNWTANVSEQEYQEAIANIKGQIRQGNTY  131
             E         +++   E+  +P +           +++ ++ Y +     +K +++ G+TY
Sbjct:   65 FEQFLERKKYSLEPLKEHAFYPKIH----------SSLDQKTYFKQFKAVKERLKNGDTY  114

Query:  132 QVNYTLELSQQLCSDPFSVYERLMVEQGAGYNAYIAYDDKRILSVSPELFFKKK--DEVL  189
            QVN T++L    + P V++ ++  Q   + A+I  +   +LS SPELFF+ +  D  +
Sbjct:  115 QVNLTMDLFLDTKAKPKRVFKEVVHNQNTPFKAFIENEFGSVLSFSPELFFELEFLDTAI  174

Query:  190 T--TRPMKGTSARKPTYQEDVAERDWLANDPKNRSENMMIVDLLRNDMGRICDVGTVKVK  247
                T+PMKGT AR    D   R +L ND KNRSEN+MIVDLLRND+ R+       +VKV
Sbjct:  175 KIITKPMKGTIARSKNPLIDEKNRLFLQNDDKNRSENVMIVDLLRNDLSRLALKNSVKVN  234

Query:  248 KLCQVEQYATVWQMTSTIEGVLSPEVTLMSIFQALYPCGSITGAPKISTMAIINELEKRP  307
            +L ++       +V+QM S IE L  + +L  IF+AL+PCGS+TG PKI TM II  LEKRP
Sbjct:  235 QLFEIISLPSVYQMISEIEAKLPLKTSLFEIFKALFPCGSVTGCPKIKTMQIIESLEKRP  294

Query:  308 RGIYCGTIGLCMPDGQAIFNVPIRTVQMKGQQ--AYYGVGGGITWESQTDSEYEETRQKS  365
            RG+YCG IG+ + +  +A+F+VPIRT++ +   + +   GVG G+T++S+     EYEE+  KS
Sbjct:  295 RGVYCGAIGM-VEEKKALFSVPIRTLEKRVHENFLHLGVGSGVTYKSKAPKEYEESFLKS  353

Query:  366 -AVLTRVNPKFQLITTGRV--TENKLLFSQQ--HVERLVESASYFAYSFDKSKFERELKK  420
             V+ ++    +F+++ T ++    + KL  + +   H ERL+ S   YF + +D+++     + EL
Sbjct:  354 FFVVMPKI--EFEIVETMKIIKKDQKLEINNKNAHKERLMNSTRYFNFKYDENLLDFEL--  409

Query:  421 YLHQLDEKDYRLKIMLDKTGKVTFEVKQLVNLSKKFLTAEVVVQDYPI-KLSPFTYFKTS  479
                      +EK+  L+++L+K GK+   E K L     L        + E+ + +  PI K + F Y KT+
Sbjct:  410 ------EKEGVLRVLLNKKGKLIKEYKTLEPLK----SLEIRLSEAPIDKRNDFLYHKTT  459

Query:  480 YRPHIIEGQN--------EKIFVSPEGLLLETSIGNIVLEKNGRFLTPDLSEGGLNGIYR  531
              Y P    + +           ++IF + +     L E +   N+VLE + R  LTP  S G LNG
Sbjct:  460 YAPFYQKARALIKKGVMFDEIFYNQDLELTEGARSNLVLEIHNRLLTPYFSAGALNGTGV  519
```

```
Query:  532 RHLLKNQKVIEAPLTLKDLESADAIYACNAVRGLYPLNLK              571
             LLK   V  APL L+DL+ A  IY  NA+ GL  + +K
Sbjct:  520 VGLLKKGLVGHAPLKLQDLQKASKIYCINALYGLVEVKIK              559
```

A related DNA sequence was identified in *S. pyogenes* <SEQ ID 27> which encodes the amino acid sequence <SEQ ID 28>. Analysis of this protein sequence reveals the following:

```
Possible site: 31
>>> Seems to have no N-terminal signal sequence

----- Final Results -----
         bacterial cytoplasm --- Certainty = 0.2669 (Affirmative) < succ>
         bacterial membrane  --- Certainty = 0.0000 (Not Clear)   < succ>
         bacterial outside   --- Certainty = 0.0000 (Not Clear)   < succ>
```

An alignment of the GAS and GBS proteins is shown below:

```
Identities = 303/572 (52%), Positives = 406/572 (70%), Gaps = 1/572 (0%)

Query:    1 MHIETVIDFKELGKRYRFKNPTKELIADTLEQVLEVIKEVDYYQSQNYYVVGYLSYEASA   60
            MH +T+IDFKELG+RY F  P  EL+A +L+QV  VI++V +YQ   YYVVGYLSYEA+A
Sbjct:    3 MHRKTIIDFKELGQRYLFDEPLVELVAKSLDQVGPVIEKVQHYQQLGYYVVGYLSYEAAA   62

Query:   61 AFDSHFKVSQQKLAGEHLAYFTVHKDCENEAFPLSYENVRLADNWTANVSEQEYQEAIAN  120
            FD+ +    +L E+LAYFTVHK C+ +  PL Y+++ + + W +   ++ YQ+AI
Sbjct:   63 FFDNALQTHNDRLGNEYLAYFTVHKTCQKKDLPLDYDSITIPNQWVSATQKEAYQKAIET  122

Query:  121 IKGQIRQGNTYQVNYTLELSQQL-CSDPFSVYERLMVEQGAGYNAYIAYDDKRILSVSPE  179
            I   +++QGNTYQVNYTL+L+Q+L   +D   ++Y +L+VEQ AGYNAYIA+D+   ++S SPE
Sbjct:  123 IHREMQQGNTYQVNYTLQLTQELNAADSLAIYNKLVVEQAAGYNAYIAHDEFAVISASPE  182

Query:  180 LFFKKKDEVLTTRPMKGTSARKPTYQEDVAERDWLANDPKNRSENMMIVDLLRNDMGRIC  239
            LFFK++    LTTRPMKGT+ R     D  E DWL  D KNRSENMMIVDLLRNDMG+IC
Sbjct:  183 LFFKQEGNRLTTRPMKGTTKRGVNSWLDQQEHDWLQADGKNRSENMMIVDLLRNDMGKIC  242

Query:  240 DVGTVKVKKLCQVEQYATVWQMTSTIEGVLSPEVTLMSIFQALYPCGSITGAPKISTMAI  299
              G+V+V +LC+VE+Y+TVWQMTSTI G L  +  L+ I +AL+PCGSITGAPK+STMAI
Sbjct:  243 QTGSVRVDRLCEVERYSTVWQMTSTIVGDLKADCDLIDILKALFPCGSITGAPKVSTMAI  302

Query:  300 INELEKRPRGIYCGTIGLCMPDGQAIFNVPIRTVQMKGQQAYYGVGGGITWESQTDSEYE  359
            I  LE +PRGIYCG+IG+C+PDG+  FNVPIRT+Q+    QA YGVGGGITW+S+ +  EYE
Sbjct:  303 ITSLEPKPRGIYCGSIGICLPDGRRFFNVPIRTIQLSHNQATYGVGGGITWQSKWEDEYE  362

Query:  360 ETRQKSAVLTRVNPKFQLITTGRVTENKLLFSQQHVERLVESASYFAYSFDKSKFERELK  419
            E  QK+A L R   F L TT +V  K+ F +QH+ RL E+A+YFAY +++    +++L
Sbjct:  363 EVHQKTAFLYRHKQIFDLKTTAKVEHKKIAFLEQHLNRLKEAATYFAYPYNEKALQKQLS  422

Query:  420 KYLHQLDEKDYRLKIMLDKTGKVTFEVKQLVNLSKKFLTAEVVVQDYPIKLSPFTYFKTS  479
               YL  +    YRL I L K GK++  +  L LS    FLTA++ +Q   +  SPFTYFKTS
Sbjct:  423 TYLENKNNAAYRLMIRLSKDGKISLSDQPLEPLSADFLTAQLSLQKKDVTASPFTYFKTS  482

Query:  480 YRPHIIEGQNEKIFVSPEGLLLETSIGNIVLEKNGRFLTPDLSEGGLNGIYRRHLLKNQK  539
            YRPHI +  E++F+  G LLETSIGN+ ++      TP ++ G L G++R+ LL   +
Sbjct:  483 YRPHIEQKSYEQLFYNQAGQLLETSIGNLFVQLGQTLYTPPVAVGILPGLFRQELLATGQ  542

Query:  540 VIEAPLTLKDLESADAIYACNAVRGLYPLNLK                             571
             E   +TL DL+ A AI+  NAVRGLYPLNL+
Sbjct:  543 AQEKEVTLADLKEASAIFGGNAVRGLYPLNLE                             574
```

Based on this analysis, it was predicted that these proteins and their epitopes could be useful antigens for vaccines or diagnostics.

EXAMPLE 13

A DNA sequence (GBSx0010) was identified in *S. agalactiae* <SEQ ID 29> which encodes the amino acid sequence <SEQ ID 30>. Analysis of this protein sequence reveals the following:

```
Possible site: 20
>>> Seems to have no N-terminal signal sequence

----- Final Results -----
            bacterial cytoplasm --- Certainty = 0.1564(Affirmative) < succ>
             bacterial membrane --- Certainty = 0.0000(Not Clear)   < succ>
              bacterial outside --- Certainty = 0.0000(Not Clear)   < succ>
```

A related DNA sequence was identified in *S. pyogenes* <SEQ ID 31> which encodes the amino acid sequence <SEQ ID 32>. Analysis of this protein sequence reveals the following:

```
Possible site: 13
>>> Seems to have no N-terminal signal sequence

----- Final Results -----
            bacterial cytoplasm --- Certainty = 0.5335(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below:

```
Identities = 220/267 (82%), Positives = 243/267 (90%)

Query:   10 LLLEITKIARATYYYQLKKLNKPNKDKAIKSDIQSIYDEHRGNYGYRRIYLELRNRGFVI   69
            +LLEI  ++R+TYYYQ+K+L +  +KD   +K   I+ IYDEH+GNYGYRRI++ELRNRGFV+
Sbjct:    1 MLLEILDLSRSTYYYQVKRLAQGDKDIELKHVIREIYDEHKGNYGYRRIHMELRNRGFVV   60

Query:   70 NHKRVQGLMKSMGLTARIRRKRKYASYKGEVGKKADNLIQRQFEGSKPYEKCYTDVTEFA  129
            NHK+VQ LMK MGL ARIRRKRKY+SYKGEVGKKADNLI+R FEGSKPYEKCYTDVTE A
Sbjct:   61 NHKKVQRLMKVMGLAARIRRKRKYSSYKGEVGKKADNLIKRHFEGSKPYEKCYTDVTELA  120

Query:  130 LPEGKLYLSPVLDGYNSEIIDFTLSRSPDLKQVQTMLEBAFPAASYSETILHSDQGWQYQ  189
            LPEGKLYLSPVLDGYNSEIIDFTLSRSP+LKQVQTMLE+ FPA SYS TILHSDQGWQYQ
Sbjct:  121 LPEGKLYLSPVLDGYNSEIIDFTLSRSPNLKQVQTMLEKTFPADSYSGTILHSDQGWQYQ  180

Query:  190 HKSYHQFLEDKGIRPSMSRKGNSPDNGMMESFFGILKSEMFYGLEKSYKSLDDLEQAITD  249
            H+SYH  FLE KGI  SMSRKGNSPDNGMMESFFGILKSEMFYGLE +Y+SLD LE+AITD
Sbjct:  181 HQSYHDFLESKGILASMSRKGNSPDNGMMESFFGILKSEMFYGLETTYQSLDKLEEAITD  240

Query:  250 YIFYYNNKRIKAKLKGLSPVQYRTKSF                                  276
            YIFYYNNKRIKAKLKG SPVQYRTKSF
Sbjct:  241 YIFYYNNKRIKAKLKGFSPVQYRTKSF                                  267
```

Based on this analysis, it was predicted that these proteins and their epitopes could be useful antigens for vaccines or diagnostics.

EXAMPLE 14

A DNA sequence (GBSx0011; GBSx2234) was identified in *S. agalactiae* <SEQ ID 33> which encodes the amino acid sequence <SEQ ID 34>. Analysis of this protein sequence reveals the following:

```
Possible site: 27
>>> Seems to have no N-terminal signal sequence

----- Final Results -----
            bacterial cytoplasm --- Certainty = 0.3578(Affirmative) < succ>
             bacterial membrane --- Certainty = 0.0000(Not Clear)   < succ>
              bacterial outside --- Certainty = 0.0000(Not Clear)   < succ>
```

A related DNA sequence was identified in *S. pyogenes* <SEQ ID 35> which encodes the amino acid sequence <SEQ ID 36>. Analysis of this protein sequence reveals the following:

```
Possible site: 25
>>> Seems to have no N-terminal signal sequence

----- Final Results -----
            bacterial cytoplasm --- Certainty = 0.3869(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below:

```
Identities = 107/170 (62%), Positives = 134/170 (77%)

Query:   1 MKLSYEDKLEIYELRKIGMSWSQISQRYDVRISNLKYMIKLMDRYGVEIVEKGRNEYYPP  60
           MK + E K++IYELR++G S    IS+++D+   S+LKYMI+L+DRYGV  IV+K +N YY P
Sbjct:   1 MKFNQETKVKIYELRQMGESIKSISKKFDMAESDLKYMIRLIDRYGVTIVQKCKNHYYSP  60

Query:  61 ELKQEMIDKVLIHGCSQLSVSLDYALSNCSILTNWLSQFKKNGYTIVEKTRGRPSKMGRK 120
           ELKQE+I+KVLI G SQ    SLDYAL    S+L+  W++Q+KKNGYTI+EK RGRPSKMGRK
Sbjct:  61 ELKQEIINKVLIDGQSQKQTSLDYALPTSSMLSRWIAQYKKNGYTILEKPRGRPSKMGRK 120

Query: 121 RKKTWEEMTELERLQEENERLRTENAFLKKLRDLRLRDEALQSERQKQLE          170
           RKK   EEMTE+ERLQ+E E  R ENA LKKLR+ RLRDEA     E+QK  +
Sbjct: 121 RKKNLEEMTEVERLQKELEYPRAENAVLKKLREYRLRDEAKLKEQQKSFK          170
```

Based on this analysis, it was predicted that these proteins and their epitopes could be useful antigens for vaccines or diagnostics.

EXAMPLE 15

A DNA sequence (GBSx0012) was identified in *S. agalactiae* <SEQ ID 37> which encodes the amino acid sequence <SEQ ID 38>. This protein is predicted to be oxyR protein. Analysis of this protein sequence reveals the following:

```
Possible site: 22
>>> Seems to have no N-terminal signal sequence

----- Final Results -----
            bacterial cytoplasm --- Certainty = 0.1323(Affirmative) < succ>
             bacterial membrane --- Certainty = 0.0000(Not Clear)   < succ>
              bacterial outside --- Certainty = 0.0000(Not Clear)   < succ>
```

A related GBS nucleic acid sequence <SEQ ID 10033> which encodes amino acid sequence <SEQ ID 10034> was also identified.

The protein has homology with the following sequences in the GENPEPT database:

```
>GP:CAA91664 GB:Z67753 former trsE (rbcR homolog) [Odontella sinensis]
Identities = 72/259 (27%), Positives = 127/259 (48%), Gaps = 7/259 (2%)

Query:   5 QKLMYLESIELYSNITKAAAMLFISQPYLSKVIKQLENELEIKLIQSQGHQTFLTYAGQR  64
           Q+L  L++I   + T+AA  LF+SQP LSK IK LE+ L I L+ + +    LT AG+
Sbjct:   8 QQLRILKAIATEKSFTRAAEVLFVSQPSLSKQIKTLESRLNISLLNRENNIVSLTQAGKL  67

Query:  65 YLFYLKEIDMIERQMAKELYLIRSDKKGEITLGINSGLASSILANVLPKFNLEHPEISVK 124
           +L Y + I  +   + +L   +++  +G ++G ++G +   + ++  VL  F    HP+I+++
Sbjct:  68 FLEYSERILALCEESCRVLNDLKTGDRGNLIVGASQTIGTYLMPRVLALFAQNHPQINIE 127

Query: 125 LLENNQNISEQLVASGDIDLAV--GMAPILYKDGIASTTIYRDELFLMIPTTSQLYNAEK 182
           +  ++    + V  GDID+AV  G P  +     +    DEL L+IP +     +K
Sbjct: 128 VHVDSTRKIAKRVLEGDIDIAVVGGNIPEEIEKNLKVEDFVNDELILIIPKSHPFALKKK 187

Query: 183 RGQIIPFEYPISVLD-NEPLILTPLEYGIGKTIAQFYELHHMSLNQMITTSTVPTAASLS 241
                +    Y ++ +  N     +  L  I   IA F      + Q+ +      + TA SL
Sbjct: 188 KKINKDDLYHLNFITLNSNSTIRKLIDNILIQIA-FEPKQFNIIMQLNSIEAIKTAVSL- 245

Query: 242 LSGMGATFVPQTLIHRYLD                                          260
           G+GA FV   + I  + ++
Sbjct: 246 --GLGAAFVSSSAIEKEIE                                          262
```

A related DNA sequence was identified in *S. pyogenes* <SEQ ID 39> which encodes the amino acid sequence <SEQ ID 40>. Analysis of this protein sequence reveals the following:

```
Possible site: 30
>>> Seems to have no N-terminal signal sequence
    INTEGRAL    Likelihood = -1.28    Transmembrane    109-125 (109-126)
    INTEGRAL    Likelihood = -0.27    Transmembrane    146-162 (146-162)

----- Final Results -----
            bacterial membrane --- Certainty = 0.1510(Affirmative) < succ>
            bacterial outside  --- Certainty = 0.0000(Not Clear)   < succ>
            bacterial cytoplasm --- Certainty = 0.0000(Not Clear)  < succ>
```

The protein has homology with the following sequences in the databases:

```
>GP:AAC22434 GB:U32761 transcriptional regulator [Haemophilus
influenzae Rd]
Identities = 157/303 (51%), Positives = 221/303 (72%)

Query:    2 IRQGESYLDIKQIRYFIAIVENHFNLSQAAELLYVSQPTLSMMINDFEKRENVKLFKRKR   61
            + +G   +DI+ +RYF++IV+N FNLS+A++ LYVSQP LSMMI +FE REN+++FKR
Sbjct:    9 VLRGVKMMDIRHLRYFVSIVDNDFNLSRASQNLYVSQPALSMMITEFENRENIQIFKRAS  68

Query:   62 GRIIGLTYLGDNYYKDAQKVLSLYDDMFLKLHDHSKGLKGSINIGIPPLILSVVFSEVMP  121
            G+IIGLT+ G+NYY+DA++V+  Y+DM    L+      KG+I IGIPPL+LS VFS V+P
Sbjct:   69 GKIIGLTFAGENYYRDAKEVIKRYNDMRTNLYKSKDCKKGTITIGIPPLVLSAVFSSVLP  128

Query:  122 KLILENPGIQFNVKEIGAYQLKNELLVGNVDVAVLLSPTGIADNLVETYEIQRSELSVCL  181
            LIL+NP I F +KEIGAY LK+ELL+  VD+AVLL P  I+ N++++ EI  SEL++ L
Sbjct:  129 HLILKNPDINFIIKEIGAYALKSELLLDKVDLAVLLYPERISKNIIDSIEIHSSELALFL  188

Query:  182 SPRHRLASKKVIQWEDLTDEQLALFDPSFMVHHLVLEACERHQVRPNIILTSSSWDFMLN  241
            SP+H LA K+ I W DL +++A+FD +FM+HH + EA ER+   P+I+L SS WDF+L+
Sbjct:  189 SPKHVLAKKQQITWADLHQQKMAIFDQTFMIHHHLKEAFERNNCYPDIVLDSSCWDFLLS  248

Query:  242 STKINHNVLTICPKPITELYQLKDIKCIPMERPISWRVVLTRLRKKSYSEIEAYIMDDLL  301
            + K N +LTI P P+ ELY K+  C  +E P+ W+V L R RK  Y+ +E YI D LL
Sbjct:  249 AVKTNKELLTILPLPMAELYHSKEFLCRKIESPVPWKVTLCRQRKTVYTHLEEYIFDKLL  308

Query:  302 QSF  304
            ++F
Sbjct:  309 EAF  311
```

An alignment of the GAS and GBS proteins is shown below:

```
Identities = 61/227 (26%), Positives = 111/227 (48%), Gaps = 10/227 (4%)

Query:    9 YLESIELYSNITKAAAHLFISQPYLSKVIKQLENELEIKLIQ-SQGHQTFLTYAGQRYLF   67
            ++  +E + N+++AA  L++SQP LS +I  E   +KL +  +G    LTY G  Y
Sbjct:   17 FIAIVENHFNLSQAAELLYVSQPTLSDMMINDFEKRENVKLFKRKRGRIIGLTYLGDNYYK  76

Query:   68 YLKEIDMIERQMAKELYLIRSDKKGEITLGINSGLASSILANVLPKFNLEHPEISVKLLE  127
            +++  +  M +L+      KG I +GI  + S + V+PK  LE+P I  + E
Sbjct:   77 DAQKVLSLYDDMFLKLHDHSKGLKGSINIGIPPLILSVVFSEVMPKLILENPGIQFNVKE  136

Query:  128 NNQNISEQLVASGDIDLAVGMAPILYKDGIAST-TIYRDELFLMIPTTSQLYNAEKRGQI  186
            + +    G++D+AV ++P   D +  T  I R EL + +    +L  A K+ +
Sbjct:  137 IGAYQLKNELLVGNVDVAVLLSPTGIADNLVETYEIQRSELSVCLSPRHRL--ASKK--V  192

Query:  187 IPFEYPISVLDNEPLILTPLEYGIGKTIAQFYELHHMSLNQMITTST              233
            I +E     L +E L  L    +   +   E H + N ++T+S+
Sbjct:  193 IQWE----DLTDEQLALFDPSFMVHHLVLEACERHQVRPNIILTSSS              235
```

Based on this analysis, it was predicted that these proteins and their epitopes could be useful antigens for vaccines or diagnostics.

EXAMPLE 16

A DNA sequence (GBSx0013) was identified in *S. agalactiae* <SEQ ID 41> which encodes the amino acid sequence <SEQ ID 42>. This protein is predicted to be aminoacylase (cpsA). Analysis of this protein sequence reveals the following:

```
Possible site: 43
>>> Seems to have no N-terminal signal sequence
     INTEGRAL    Likelihood = -0.75    Transmembrane    385-401 (385-401)

----- Final Results -----
              bacterial membrane --- Certainty = 0.1298(Affirmative) < succ>
              bacterial outside  --- Certainty = 0.0000(Not Clear)   < succ>
           bacterial cytoplasm   --- Certainty = 0.0000(Not Clear)   < succ>
```

The protein has homology with the following sequences in the GENPEPT database:

```
>GP: AAF36227 GB: AF168363 aminoacylase [Lactococcus lactis]
Identities = 201/395 (50%), Positives = 274/395 (68%), Gaps = 5/395 (1%)

Query:   6 LRHQLFEKLDQKCDQMVAIRRYLHENPELSFKETKTAAYISDFYKGKDCHVQTQFGGMNG   65
           L + L    L Q  ++M+ IRR+LH+ PE+SF+E +T   YI   FYK  DC  +    G G
Sbjct:   3 LLNNLLTSLTQYENEMIQIRRHLHQYPEISFQEKETFKYIMGFYKELDCEPKLIGKGF-G   61

Query:  66 VVVDIYGDKATDKPIKHIALRADFDALPIQEETGLSFASKTAGVMHACGHDAHTAYLLIL  125
           ++VDI G K+       K +ALRADFDAL I E+   LSF S     GVMHACGHDAHTAYL++L
Sbjct:  62 IIVDIEGGKSG----KTLALRADFDALAIFEDNDLSFKSVNPGVMHACGHDAHTAYLMVL  117

Query: 126 AESLIELKSEFSGHIRILHQPAEEVPPGGAKAMIEAGCLDGIDAVLGIHVMSTMEEGTVQ  185
           A  L+++K E  G +RI+HQPAEEV PGGAK+MI+AG LDG+D ++G+HVM+T++ G +
Sbjct: 118 ARELVKIKQELPGRVRIVHQPAEEVSPGGAKSMIKAGALDGVDNMIGVHVMTTIKTGVIA  177

Query: 186 YHAGPIQTGRATFKVILQGKGGHGSMPHRANDTIVAASSFVMAAQTIVSRRVNPFDTAVV  245
           YH    QTGR+ F + ++G GGH SMP  +ND IVAAS FV    QT++SRR++PFD    V
Sbjct: 178 YHNKETQTGRSNFTITIKGNGGHASMPQLSNDAIVAASYFVTELQTVISRRIDPFDMGTV  237

Query: 246 TIGSWDGKGSANVIKDSVTLEGDVRVMSEETRGVVEEEFKRILDGIAQTYGVSYQLDYQN  305
           TIGSFDG GS N I+D V L+GDVR+M E TR V+ ++ K+I  G  T+GV  +DY +
Sbjct: 238 TIGSFDGAGSFNAIQDKVLLKGDVRMMKETTRKVIRDQVKQIAKGVGVTFGVEVIVDYDD  297

Query: 306 DYPVLVNNSEVTQKVANSLKSVAIKEILDVIDCDPQTPSEDFAYYAQTIPACFFYVGAHE  365
           +YPVL N+  +T  V +SLK   I E+ +++D  PQ PSEDF YY Q +P+ FFY+GA
Sbjct: 298 NYPVLFNSENLTHFVVDSLKDQNISEVNNIVDLGPQNPSEDFSYYGQVVPSTFFYIGAQP  357

Query: 366 EGQPYYPHHHPKFQIAESSLMVSAKSMATAALAML                          400
           E    YPHH P F++ E S++++AK++AT  +  L
Sbjct: 358 EDGGNYPHHSPLFKMNEKSILIAAKAVATVTINYL                          392
```

No corresponding DNA sequence was identified in *S. pyogenes*.

Based on this analysis, it was predicted that this protein and its epitopes, could be useful antigens for vaccines or diagnostics.

EXAMPLE 17

A DNA sequence (GBSx0014) was identified in *S. agalactiae* <SEQ ID 43> which encodes the amino acid sequence <SEQ ID 44>. This protein is predicted to be drug transporter. Analysis of this protein sequence reveals the following:

```
Lipop: Possible Site: -1 Crend: 8
McG: Discrim Score: 6.19
GvH: Signal Score (-7.5): -0.899999
     Possible site: 31
>>> Seems to have a cleavable N-term signal seq.
ALOM program count: 11 value: -12.15 threshold: 0.0
     INTEGRAL    Likelihood = -12.15   Transmembrane   169-185 (166-190)
     INTEGRAL    Likelihood =  -8.86   Transmembrane   229-245 (224-250)
     INTEGRAL    Likelihood =  -8.65   Transmembrane    82- 98 ( 78-111)
     INTEGRAL    Likelihood =  -8.60   Transmembrane   436-452 (428-457)
     INTEGRAL    Likelihood =  -7.48   Transmembrane   202-218 (198-222)
     INTEGRAL    Likelihood =  -4.99   Transmembrane   334-350 (332-352)
```

```
       INTEGRAL      Likelihood = -4.88    Transmembrane    358-374  (354-376)
       INTEGRAL      Likelihood = -4.09    Transmembrane    301-317  (301-317)
       INTEGRAL      Likelihood = -2.81    Transmembrane    102-118  (101-119)
       INTEGRAL      Likelihood = -2.71    Transmembrane     52-68    (50-70)
       INTEGRAL      Likelihood = -1.70    Transmembrane    271-287  (270-288)
       PERIPHERAL    Likelihood =  0.32                     401
modified ALOM score: 2.93
*** Reasoning Step: 3

----- Final Results -----
                 bacterial membrane --- Certainty = 0.5861(Affirmative) < succ>
                  bacterial outside --- Certainty = 0.0000(Not Clear)   < succ>
                bacterial cytoplasm --- Certainty = 0.0000(Not Clear)   < succ>
```

The protein has homology with the following sequences in the GENPEPT database:

```
>GP: CAB02058 GB: Z79702 hypothetical protein Rv2333c [Mycobacterium
tuberculosis]
Identities = 118/405 (29%), Positives = 199/405 (49%), Gaps = 9/405 (2%)

Query:  13 KLLVGIVLAVLSFWLFAQS-ILNMG-PDVQSSLGISSGAMDIGVSSTALFSGLFIVVTGG    70
           +LL   I   +  F +F   + I+N+  PD+Q S +       V+S +L    +FI+
Sbjct:   5 QLLTLIATGLGLFMIFLDALIVNVALPDIQRSFAVGEDGLQWVVASYSLGMAVFIMSAAT    64

Query:  71 LADKLGRVKFTFIGLCLNIIGSLLIVLANGAVLFIMGRIFQGLAAAFIMPSTMALVKTYY   130
           LAD  GR ++  IG+ L  +GS+  LA  +    R  QGL AA +  +++ALV   +
Sbjct:  65 LADLDGRRRWYLIGVSLFTLGSIACGLAPSIAVLTTARGAQGLGAAAVSVTSLALVSAAF   124

Query: 131 -DGKDRQRAVSFWSIGSWGGSGLCSYFGGAVASTLGWRYVFIFSI-IASVVSFLLILGTP   188
            +  K++ RA+   W+  +   G+       GG  +  GWR +F   ++ + ++V FL +
Sbjct: 125 PEAKEKAPAIGIWTAIASIGTTTGPTLGGLLVDQWGWRSIFYVNLPMGALVLFLTLCYVE   184

Query: 189 ESKNVGQRTHFDYLGLIIFIISMLSLNIGISMAQEHGLMNVIPLSLFTVMLIGFVLFYYV   248
           ES N  +    FD  G  ++FI+++  +L   +   + G   +V  +    +G  LF ++
Sbjct: 185 ESCN-ERARRFDLSGQLLFIVAVGALVYAVIEGPQIGWTSVQTIVMLWTAAVGCALFVWL   243

Query: 249 ETRKSNSFIDFHLFENRFY-LGATISNFLLNAVAGTLIVINTYMQQGRQLTPKVAGEMSL   307
           E  + SN  +D  LF +   Y L        +  AV G L++   ++Q  R   TP V G  M   L
Sbjct: 244 ERRSSNPMMDLTLFRDTSYALAIATICTVFFAVYGMLLLTTQFLQNVRGYTPSVTGLMIL   303

Query: 308 GYLVCVLIAIRVGEKILQRFGARKPMLLGAMSTFVGIFLMTLVNIQGPLYLVLVFVGYAL   367
                + V I   +    ++ R GAR P+L G      +G+ ++      +    LV VG  L
Sbjct: 304 PFSAAVAIVSPLVGHLVGRIGARVPILAGLCMLMLGLLMLIFSEHRSS---ALVLVGLGL   360

Query: 368 FGTGLGIYATPSTDTAISSIPNEKVGSASGIYKMASSLGGAIGVA                412
           G+G+ +  TP T  A++++P E+ G ASGI     ++G  IG A
Sbjct: 361 CGSGVALCLTPITTVAMTAVPAERAGMASGIMSAQRAIGSTIGFA                405
```

A related DNA sequence was identified in *S. pyogenes* <SEQ ID 45> which encodes the amino acid sequence <SEQ ID 46>. Analysis of this protein sequence reveals the following:

```
Possible site: 61
>>> Seems to have an uncleavable N-term signal seq
       INTEGRAL      Likelihood = -8.28    Transmembrane    169-185  (165-189)
       INTEGRAL      Likelihood = -8.23    Transmembrane     12-28    (11-32)
       INTEGRAL      Likelihood = -8.17    Transmembrane    429-445  (423-450)
       INTEGRAL      Likelihood = -6.64    Transmembrane    203-219  (200-222)
       INTEGRAL      Likelihood = -5.41    Transmembrane    227-243  (225-245)
       INTEGRAL      Likelihood = -3.72    Transmembrane     82-98    (80-99)
       INTEGRAL      Likelihood = -3.72    Transmembrane    136-152  (135-155)
       INTEGRAL      Likelihood = -2.92    Transmembrane    302-318  (299-319)
       INTEGRAL      Likelihood = -2.55    Transmembrane    261-277  (261-277)
       INTEGRAL      Likelihood = -2.07    Transmembrane    331-347  (331-347)
       INTEGRAL      Likelihood = -1.06    Transmembrane     56-72    (56-72)
       INTEGRAL      Likelihood = -0.96    Transmembrane    351-367  (351-368)
       INTEGRAL      Likelihood = -0.37    Transmembrane    104-120  (103-120)

----- Final Results -----
                 bacterial membrane --- Certainty = 0.4312(Affirmative) < succ>
                  bacterial outside --- Certainty = 0.0000(Not Clear)   < succ>
                bacterial cytoplasm --- Certainty = 0.0000(Not Clear)   < succ>
```

The protein has homology with the following sequences in the databases:

```
!GB: AJ250422 ORFC [Oenococcus oeni] 271 1e-71
Identities = 152/445 (34%), Positives = 248/445 (55%), Gaps = 7/445 (1%)

Query:   1 MSHHQQTVSKQTIMAIIAIALIGFSGILSETSMNVTFPTLMSVYQLPLNSLQWMTTIYLL   60
           M   Q VS  +AI+ +A + F G+L ETSMNVTFPTLM + + LN +QW+TT YLL
Sbjct:   1 MQKDNQPVSLHVKLAILGLAGLAFCGVLIETSMNVTFPTLMQQFSISLNKVQWLTTAYLL   60

Query:  61 AVAIMMTTSATLKKNVRERPLFFMATGLFTFGTILAVLTQSFAIMLLARIFQGIGTGLVM  120
            VA ++ +A ++K    + +FF A LF   G I + L  +F I+L+ R+ Q + TGL +
Sbjct:  61 LVAATISIAAFIEKRFIFKKIFFWAGLLFIIGVICSALAPNFLILLIGRLIQALSTGLAI  120

Query: 121 PQMFNIILERVPMHKVGLFMGFAGLIISLAPAFGPTYGGFMISHFSWQWIFICILPVPLI  180
           P +    I++++P  K G +M     ++    P+ GPTYGG +    SW+ IF  +LP+ LI
Sbjct: 121 PLLITEIMQQIPQKKQGSYMELVEWLLLWQPSLGPTYGGVITQDLSWRLIFWFVLPIGLI  180

Query: 181 AGILAYYYLEDSPVSEKVPFDWLAFIALSISLTSALLAITSLE-NGSVNLYYLGLFILSF  239
           A ++   ++E      K+PF W FI+L ++L S  +A+ +    G  ++ + G  +++
Sbjct: 181 AWLIGLSFIEQKSSPSKIPFAWKQFISLILALLSITVAVNNAGIYGWTSIKFYGFLLIAV  240

Query: 240 IL---FLYKNLTAKQPFLDIRILKIPSLTFGLIPFFVFQLINLGINFLTPNFIVMEKIAN  296
           IL   F+ + + ++Q + I I K     L+ +F+ Q I L +FL PN+ +
Sbjct: 241 ILLIVFIKLSTNSRQALISISIFKKWEFVCPLLIYFLIQFIQLSTFLLPNYAQLILKKG   300

Query: 297 SSQAGMVLLPGTLLGALLAPAFGKLYDQKGARLSLYLGNALFSLSLIIMTLQTRHFMLLP  356
             +G++LL G+L+ A+L P  G++ D    ++ L+G       S I   T+ R+   +
Sbjct: 301 VMISGIMLLCGSLISAILQPLTGRMLDSFSVKIPLVIGAFFLITSTISFTIFQRYLSVFL  360

Query: 357 FTLLYILFTFGRNMGFNNSLATAIRELPAEKNADATAIFQMMQQFAGALGTAMAS-LIAN  415
             LY+++  G +  FNNSL A+++LP + +D  A+F  +QQ+AG+LGT++AS L+AN
Sbjct: 361 IAALYVIYMIGFSFVFNNSLTYALQKLPLKLISDGNAVFNTLQQYAGSLGTSVASALLAN  420

Query: 416 SQAEFTSGVQSVYLLFTIFALLDFI                                     440
             T G QS Y       +L+FI
Sbjct: 421 GIG--TDGKQSNYTGSRHIFILNFI                                     443
```

An alignment of the GAS and GBS proteins is shown below:

```
Identities = 91/369 (24%), Positives = 160/369 (42%), Gaps = 14/369 (3%)

Query:  82 FIGLCLNIIGSLLIVLANGAVLFIMGRIFQGLAAAFIMPSTMALVKTYYDGKDRQRAVSF  141
           F+   L  G++L VL   + ++ RIFQG+   +MP  ++            + F
Sbjct:  83 FMATGLFTFGTILAVLTQSFAIMLLARIFQGIGTGLVMPQMFNIILERVPMHKVGLFMGF  142

Query: 142 WSIGSWGGSGLCSYFGGAVASTLGWRYVFIFSIIASVVSFLLILGTPESKNVGQKTHFDY  201
             +                +GG + S  W+++FI  +   +++ +L     E   V +K  FD+
Sbjct: 143 AGLIISLAPAFGPTYGGFMISHFSWQWIFICILPVPLIAGILAYYYLEDSPVSEKVPFDW  202

Query: 202 LGLIIFIISMLSLNIGISMAQEHGLMNVIPLSLFTVMLIGFVLFYYVETRKSNSFIDFHL  261
           L   I   IS+ S + I+ + E+G +N+  L LF   ++ F+LF Y       F+D +
Sbjct: 203 LAFIALSISLTSALLAIT-SLENGSVNLYYLGLF---ILSFILFLYKNLTAKQPFLDIRI  258

Query: 262 FENRFYLGATISNFLLNAV-AGTLIVINTYMQQGRQLTPKVAGEMSL-GYLVCVLIAIRV  319
            +         I  F+ +   G  + ++   ++        AG + LG L+   L+ A
Sbjct: 259 LKIPSLTFGLIPFFVFQLINLGINFLTPNFIVMEKIANSSQAGMVLLPGTLLGALLAPAF  318

Query: 320 GEKILQRFGARKPMLLGAMSTFVGIFLMTLVNIQGPLYLVLVF-VGYALFGTGLGIYATP  378
           G  K+  + GAR  +LG      + +MTL Q      +++L F  Y LF  G  +
Sbjct: 319 G-KLYDQKGARLSLYLGNALFSLSLIIMTL---QTRHFMLLPFTLLYILFTFGRNMGFNN  374

Query: 379 STDTAISSIPNEKVGSASGIYKMASSLGGAIGVATSIAIYHAFSGNADFHKAALCGLILN  438
           S  TAI  +P EK   A+  I++M    GA+G A + I     A+F            +L
Sbjct: 375 SLATAIRELPAEKNADATAIFQMMQQFAGALGTAMASLIANS---QAEFTSGVQSVYLLF  431

Query: 439 LVFCSLSIL                                                    447
           +F   L +
Sbjct: 432 TIFALLDFI                                                    440
```

Based on this analysis, it was predicted that these proteins and their epitopes could be useful antigens for vaccines or diagnostics.

EXAMPLE 18

A DNA sequence (GBSx0015) was identified in *S. agalactiae* <SEQ ID 47> which encodes the amino acid sequence <SEQ ID 48>. This protein is predicted to be transposase. Analysis of this protein sequence reveals the following:

```
Possible site: 45
>>> Seems to have no N-terminal signal sequence

----- Final Results -----
            bacterial cytoplasm --- Certainty = 0.3116(Affirmative) < succ>
            bacterial membrane  --- Certainty = 0.0000(Not Clear)   < succ>
             bacterial outside  --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 19

A DNA sequence (GBSx0016) was identified in *S. agalactiae* <SEQ ID 49> which encodes the amino acid sequence <SEQ ID 50>. This protein is predicted to be L11 protein (rplK). Analysis of this protein sequence reveals the following:

```
Possible site: 21
>>> Seems to have no N-terminal signal sequence

----- Final Results -----
            bacterial cytoplasm --- Certainty = 0.1859(Affirmative) < succ>
            bacterial membrane  --- Certainty = 0.0000(Not Clear)   < succ>
             bacterial outside  --- Certainty = 0.0000(Not Clear)   < succ>
```

The protein has homology with the following sequences in the GENPEPT database:

```
>GP: CAA53739 GB: X76134 L11 protein [Staphylococcus carnosus]
Identities = 117/139 (84%), Positives = 129/139 (92%)

Query:    1 MAKKVEKLVKLQIPAGKATPAPPVGPALGQAGINIMGFTKEFNARTADQAGMIIPVVISV   60
            MAKKVEK+VKLQIPAGKA PAPPVGPALGQAG+NIMGF KEFNART +QAG+IIPV ISV
Sbjct:    1 MAKKVEKVVKLQIPAGKANPAPPVGPALGQAGVNIMGFCKEFNARTQEQAGLIIPVEISV   60

Query:   61 YEDKSFDFITKTPPAAVLLKKAAGVEKGSGEPNKTKVATITRAQVQEIAETKMPDLNAAN  120
            YED+SF FITKTPPA VLLKKAAGVEKGSGEPNK KVAT+T+ QV+EIA+TKMPDLNAA+
Sbjct:   61 YEDRSFTFITKTPPAPVLLKKAAGVEKGSGEPNKNKVATVTKDQVREIAQTKMPDLNAAD  120

Query:  121 LESAMRMIEGTARSMGFTV                                           139
            +E+AMR+IEGTARSMG TV
Sbjct:  121 EEAAMRIIEGTARSMGITV                                           139
```

A related DNA sequence was identified in *S. pyogenes* <SEQ ID 51> which encodes the amino acid sequence <SEQ ID 52>. Analysis of this protein sequence reveals the following:

```
Possible site: 45
>>> Seems to have no N-terminal signal sequence

----- Final Results -----
            bacterial cytoplasm --- Certainty = 0.4276(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below:

```
Identities = 136/141 (96%), Positives = 139/141 (98%)

Query:   1 MAKKVEKLVKLQIPAGKATPAPPVGPALGQAGINIMGFTKEFNARTADQAGMIIPVVISV   60
           MAKKVEKLVKLQIPAGKATPAPPVGPALGQAGINIMGFTKEFNARTADQAGMIIPVVISV
Sbjct:  25 MAKKVEKLVKLQIPAGKATPAPPVGPALGQAGINIMGFTKEFNARTADQAGMIIPVVISV   84

Query:  61 YEDKSFDFITKTPPAAVLLKKAAGVEKGSGEPNKTKVATITRAQVQEIAETKMPDLNAAN  120
           YEDKSFDFITKTPPAAVLLKKAAGVEKGSG PN TKVAT+TRAQVQEIAETKMPDLNAAN
Sbjct:  85 YEDKSFDFITKTPPAAVLLKKAAGVEKGSGTPNTTKVATVTRAQVQEIAETKNPDLNAAN  144

Query: 121 LESAMRMIEGTARSMGFTVTD                                        141
           +E+AMRMIEGTARSMGFTVTD
Sbjct: 145 IEAAMRMIEGTARSMGFTVTD                                        165
```

Based on this analysis, it was predicted that these proteins and their epitopes could be useful antigens for vaccines or diagnostics.

EXAMPLE 20

A DNA sequence (GBSx0017) was identified in *S. agalactiae* <SEQ ID 53> which encodes the amino acid sequence <SEQ ID 54>. This protein is predicted to be ribosomal protein L1 (rplA). Analysis of this protein sequence reveals the following:

```
Possible site: 30
>>> Seems to have no N-terminal signal sequence

----- Final Results -----
            bacterial cytoplasm --- Certainty = 0.2285(Affirmative) < succ>
             bacterial membrane --- Certainty = 0.0000(Not Clear)   < succ>
              bacterial outside --- Certainty = 0.0000(Not Clear)   < succ>
```

The protein has homology with the following sequences in the GENPEPT database:

```
>GP:CAB11879 GB:Z99104 ribosomal protein L1 (BL1) [Bacillus subtilis]
Identities = 144/228 (63%), Positives = 177/228 (77%)

Query:   1 MAKKSKNLRAALEKIDSTKAYSVEEAVALAKETNFAKFDATVEVSYNLNIDVKKADQQIR   60
           MAKK K    A + +D +KAY V EAVAL K+TN AKFDATVEV++ L +D  K  QQIR
Sbjct:   1 MAKKGKKYVEAAKLVDHSKAYDVSEAVALVKKTNTAKFDATVEVAFRLGVDPSKNHQQIR   60

Query:  61 GAMVLPAGTGKTSRVLVFARGAKAEEEAKAAGADFVGEDDLVAKIQGGWLDFDVVIATPDM  120
           GA+VLP GTGKT RVLVFA+G KA+EA+AAGADFVG+ D + KIQ GW DFDV++ATPDM
Sbjct:  61 GAVVLPNGTGKTQRVLVFAKGEKAKEAEAAGADFVGDTDYINKIQQGWFDFDVIVATPDM  120

Query: 121 MALVGRLGRVLGPRNLMPNPKTGTVTMDVAKAVEESKGGKITYRADKAGNVQALIGKVSF  180
           M  VG++GRVLGP+ LMPNPKTGTVT +V KA+ E K GK+ YR DKAGN+   IGKVSF
Sbjct: 121 MGEVGKIGRVLGPKGLMPNPKTGTVTFEVEKAIGEIKAGKVEYRVDKAGNIHVPIGKVSF  180

Query: 181 DDAKLVDNFKAFNDVIVKAKPATAKGTYITNLSITTTQGVGIKVDPNS             228
           +D KLV+NF    D I+KAKPA AKG Y+ N+++T+T G G+KVD ++
Sbjct: 181 EDEKLVENFTTMYDTILKAKPAAAKGVYVKNVAVTSTMGPGVKVDSST             228
```

A related DNA sequence was identified in *S. pyogenes* <SEQ ID 55> which encodes the amino acid sequence <SEQ ID 56>. Analysis of this protein sequence reveals the following:

```
Possible site: 22
>>> Seems to have no N-terminal signal sequence

----- Final Results -----
             bacterial cytoplasm --- Certainty = 0.2309(Affirmative) < succ>
              bacterial membrane --- Certainty = 0.0000(Not Clear)   < succ>
               bacterial outside --- Certainty = 0.0000(Not Clear)   < succ>
```

An alignment of the GAS and GBS proteins is shown below:

```
Identities = 208/229 (90%), Positives = 220/229 (95%)

Query:    1 MAKKSKNLRAALEKIDSTKAYSVEEAVALAKETNFAKFDATVEVSYNLNIDVKKADQQIR    60
            MAKKSK +RAALEK+DSTKAYSVEEAVAL KETNFAKFDA+VEV+YNLNIDV+KADQQIR
Sbjct:    1 MAKKSKQMRAALEKVDSTKAYSVEEAVALVKETNFAKFDASVEVAYNLNIDVRKADQQIR    60

Query:   61 GAMVLPAGTGKTSRVLVFARGAKAEEEAKAAGADFVGEDDLVAKIQGGWLDFDVVIATPDM   120
            GAMVLP GTGKT RVLVFARGAKAEEEAKAAGADFVGEDDLVAKI GGWLDFDVVIATPDM
Sbjct:   61 GAMVLPNGTGKTQRVLVFARGAKAEEEAKAAGADFVGEDDLVAKINGGWLDFDVVIATPDM   120

Query:  121 MALVGRLGRVLGPRNLMPNPKTGTVTMDVAKAVEESKGGKITYRADKAGNVQALIGKVSF   180
            MA+VGRLGRVLGPRNLMPNPKTGTVTMDVAKAVEESKGGKITYRADKAGNVQALIGKVSF
Sbjct:  121 MAIVGRLGRVLGPRNLMPNPKTGTVTMDVAKAVEESKGGKITYRADKAGNVQALIGKVSF   180

Query:  181 DDAKLVDNFKAFNDVIVKAKPATAKGTYITNLSITTTQGVGIKVDPNSL             229
            D   KLV+NFKAF+DV+ KAKPATAKGTY+ N+SIT+TQGVGIKVDPNSL
Sbjct:  181 DADKLVENFKAFHDVMAKAKPATAKGTYMANVSITSTQGVGIKVDPNSL             229
```

Based on this analysis, it was predicted that these proteins and their epitopes could be useful antigens for vaccines or diagnostics.

EXAMPLE 21

A DNA sequence (GBSx0018) was identified in *S. agalactiae* <SEQ ID 57> which encodes the amino acid sequence <SEQ ID 58>. Analysis of this protein sequence reveals the following:

```
Possible site: 25
>>> May be a lipoprotein

----- Final Results -----
              bacterial membrane --- Certainty = 0.0000(Not Clear) < succ>
               bacterial outside --- Certainty = 0.0000(Not Clear) < succ>
             bacterial cytoplasm --- Certainty = 0.0000(Not Clear) < succ>
```

A related GBS nucleic acid sequence <SEQ ID 10029> which encodes amino acid sequence <SEQ ID 10030> was also identified.

The protein has homology with the following sequences in the GENPEPT database:

```
>GP:BAB04286 GB:AP001509 nickel transport system (nickel-binding
protein) [Bacillus halodurans]
Identities = 209/541 (38%), Positives = 324/541 (59%), Gaps = 14/541 (2%)

Query:    5 RRNILLSITCLLMVTLTACHSQDS----KSHKLNSDK-LTLAWGEDFGDVNPHRYNPDQF    59
            R+ ILL +  L+   L  C +S          + N++K +T +W   D G +NPH YNP Q
Sbjct:    6 RKLILLFVISLISSILVGCAESESGTVSNEGEENTEKSITFSWPRDIGPMNPHVYNPSQL    65

Query:   60 VIQDMVYEGLVRYGDNGKIEPALAKSWSISQDGKTYTFKLRNA-KYSDGSNFNAANVKRN   118
            Q M+YE LV Y + G+++P LA SW+IS+DGK YTFKLR    ++SDG+ FNA  VK+N
Sbjct:   66 FAQSMIYEPLVSYTEGGELQPHLADSWTISEDGKEYTFKLREGVQFSDGTPFNAEIVKKN   125

Query:  119 FDSIFSKSNRGNHNWFNLTNQLENYRALNQSTFEIKLKQAYSATLYDLSMIRPIRFLSDS   178
            FD+    S+   H+W  + N LE     +++ TF++ LK+ Y   L DL+++RP+RFL ++
Sbjct:  126 FDTWIEHSSL--HSWLGVMNVLEKTEVVDEFTFKMVLKEPYYPALQDLAVVRPVRFLGEA   183
```

```
-continued
Query:  179 AFPKGDDTTKKNVKKPIGTGQWVVKSKKQNEYITFKRNENYWGKKPKLKEVTVKVIPDAQ  238
            FP   DT++  +K+PIGTG W++    KQ+EY  F RN NYWG+ PK+ +VTVK+IPDA+
Sbjct:  184 GFPDDGDTSQ-GIKEPIGTGPWMLSDYKQDEYAVFTRNPNYWGESPKIDKVTVKIIPDAE  242

Query:  239 TRALAFESGDVDLIYGNGIIGLDTFAQYTKDKKYVTAISQPMSTRLLLLNAKESIFQDKK  298
            TR LAFESG++DLI+G G+I +D F Q  +  +Y T +S+P+ TR LLLN     D +
Sbjct:  243 TRVLAFESGELDLIFGEGVISMDAFNQLKESGQYGTDLSEPVGTRSLLLNTSNEKLADLR  302

Query:  299 VRQAMNHAIDKVSIAKNTFRGTEKPADTIFSKSTSHSDAKLNPYSYNVDKANQLLDQAGW  358
            VR A++H  +K ++ +    G E+ AD I S +  ++D  + P  Y+V++AN  LD+AGW
Sbjct:  303 VRLALHHGFNKQAMVEGVTLGLEEKADNILSTNFPYTDIDVEPIEYDVEQANAYLDEAGW  362

Query:  359 KMGKDK-VREKDGKTLTLRLPYIATKATDKDLVTYFQGEWRKIGINVSLIAMEEDDYWAN  417
            ++    K VREK+G+ L L L Y  T     K +    Q EW   IG+ + +    +E
Sbjct:  363 ELPAGKTVREKNGEQLELELIYDKTDPLQKAMAETMQAEWAAIGVKLDITGLELTTQIQR  422

Query:  418 AKKGNFDMMLTYSWGAPWDPHAWMSALTAKADHGHPENIALENLATKTEMDRLIKSALVD  477
              + G+FD+     Y++GAP+DPH++++ + A+A  G   E   A  NL+  K E+D   +++  L
Sbjct:  423 RRAGDFDVDFWYNYGAPYDPHSFIN-VVAEAGWGVAE--AHSNLSMKEELDEQVRATLAS  479

Query:  478 PKEENVDRDYKKVLELLHDEAVYIPLTYQSVISVYRKGDFKTMRFAPEENSFPLRYIEKNN  538
             E      Y  +L  L +++V++P++Y      VY++ +     F    +  P   I+ +N
Sbjct:  480 TDETERQELYGSILNTLQEQSVFVPISYIKKTVVYQE-NVNEFIFPANRDEHPFNGIDVSN  539
```

A related DNA sequence was identified in *S. pyogenes* <SEQ ID 59> which encodes the amino acid sequence <SEQ ID 60>. Analysis of this protein sequence reveals the following:

```
Possible site: 24
>>> May be a lipoprotein

----- Final Results -----
          bacterial membrane --- Certainty = 0.0000(Not Clear) < succ>
           bacterial outside --- Certainty = 0.0000(Not Clear) < succ>
         bacterial cytoplasm --- Certainty = 0.0000(Not Clear) < succ>
```

An alignment of the GAS and GBS proteins is shown below:

```
Identities = 131/497 (26%), Positives = 220/497 (43%),
Gaps = 55/497 (11%)

Query:    8 ILLSITCLLMVTLTACHSQDSKSHKLN-----SDKLTLAWGEDFGDVNPHRYNP-DQFVI   61
            I L +T L++V  AC  Q  ++ +        D+L ++  G    PH ++P D++ +
Sbjct:   13 ITLFLTGLILV---ACQQQKPQTKERQRKQRPKDELVVSMGAKL----PHEFDPKDRYGV   65

Query:   62 QD---MVYEGLVRYGDNGKIEPALAKSWSISQDGKTYTFKLRNA-KYSDGSNFNAANVKR  117
             +    + + L++      I+  LAK++ +S+DG T++F L +   K+S+G    A +VK
Sbjct:   66 HNEGNITHSTLLKRSPELDIKGELAKTYHLSEDGLTWSFDLHDDFKFSNGEPVTADDVKF  125

Query:  118 NFDSIFSKSNRGNHNWFNLTNQLENYRALNQSTFEIKLKQAYSATLYDLSMIRPIRFLSD  177
              +D +    + +   ++LT  ++N    + ++   I L +A+S      L+ I PI
Sbjct:  126 TYDML-----KADGKAWDLTF-IKNVEVVGKNQVNIHLTEAHSTFTAQLTEI-PI-----  173

Query:  178 SAFPKG--DDTTKKNVKKPIGTGQWVVKSKKQNEYITFKRNENYWGKKPKLKEVTVKVIP  235
              PK   +D  K N    PIG+G  ++VK  K E    F RN  + GKKP  K+ T  V+
Sbjct:  174 --VPKKHYNDKYKSN---PIGSGPYMVKEYKAGEQAIFVRNPYWHGKKPYFKKWT-WVLL  227

Query:  236 DAQTRALAFESGDVDLIYGNGIIGLDTFAQYTK----DKKYVTAISQPMSTRLLLLNAKE  291
            D   T   A  ESGDVD+IY    +  D   + T+       V +S P   + ++ ++ +
Sbjct:  228 DENTALAALESGDVDMIYATPELA-DKKVKGTRLLDIPSNDVRGLSLPYVKKGVITDSPD  286

Query:  292 ------SIFQDKKVRQAMNHAIDKVSIAKNTFRGTEKPADTIFSKSTSHSDAKLNPYSYN  345
                    + D +R+A+  +++ +      G   KPA +I  K T     + K
Sbjct:  287 GYPVGNDVTSDPAIRKALTIGLNRQKVLDTVLNGYGKPAYSIIDK-TPFWNPKTAIKDNK  345

Query:  346 VDKANQLLDQAGWKMGKDKVREKDGKTLTLRLPYIATKATDKDLVTYFQGEWRKIGINVS  405
            V KA QLL +AGWK    D  R+K        L Y         +L     + + +GI +
Sbjct:  346 VAKAKQLLTKAGWKEQADGSRKKGDLDAAFDLYYPTNDQLRANLAVEVAEQAKALGITIK  405
```

```
-continued
Query:  406 LIAMEEDDYWANAKKGNFDMMLTYSWGAPWDPHAWMSALTAKADHGHPENIALENLATKT  465
            L A       W      + D   L Y+ G       + S   + A G   NI    N T T
Sbjct:  406 LKASN----WDEMATKSHDSALLYAGGRHHAQQFYESHHPSLAGKGW-TNITFYNNPTVT  460

Query:  466 E-MDRLIKSALVDPKEE                                             481
            + +D+ + S+ +D    E
Sbjct:  461 KYLDKADMTSSDLDKANE                                            477
```

A related GBS gene <SEQ ID 8469> and protein <SEQ ID 8470> were also identified. Analysis of this protein sequence reveals the following:

```
Lipop: Possible site: 22 Crend: 5
McG: Discrim Score: 7.69
GvH: Signal Score (-7.5): -3.34
     Possible site: 25
>>> May be a lipoprotein
ALOM program count: 0 value: 7.21 threshold: 0.0
    PERIPHERAL Likelihood = 7.21 273
modified ALOM score: -1.94
*** Reasoning Step: 3

----- Final Results -----
            bacterial membrane --- Certainty = 0.0000(Not Clear) < succ>
            bacterial outside  --- Certainty = 0.0000(Not Clear) < succ>
            bacterial cytoplasm --- Certainty = 0.0000(Not Clear) < succ>
```

The protein has homology with the following sequences in the databases:

```
Escherichia coli
EGAD|8250| nickel-binding periplasmic protein precursor Insert characterized
OMNI|NT01EC4139 oligopeptide transporter putative substrate binding
domain, putative Insert characterized
SP|P33590|NIKA_ECOLI NICKEL-BINDING PERIPLASMIC PROTEIN PRECURSOR.  Edit
characterized
GP|404845|emb|CAA51659.1||X73143 NikA Insert characterized
GP|466612|gb|AAB18451.1||U00039 nikA Insert characterized
GP|1789887|gb|AAC76501.1||AE000423 periplasmic binding protein for nickel Insert
characterized
PIR|S39594|S39594 nickel-binding periplasmic protein precursor - Escheri Insert
characterized ORF02080(391-1905 of 2223)
EGAD|8250|EC3476(21-520 of 524) nickel-binding periplasmic protein precursor
{Escherichia coli} OMNI|NT01EC4139 oligopeptide transporter putative substrate
binding domain, putativeSP|P33590|NIKA_ECOLI NICKEL-BINDING PERIPLASMIC PROTEIN
PRECURSOR.GP|404845|emb|CAA51659.1||X73143 NikA {Escherichia coli}
GP|466612|gb|AAB18451.1||U00039 nikA {Escherichia coli}
GP|1789887|gb|AAC76501.1||AE000423 periplasmic binding protein for nickel
{Escherichia coli} PIR|S39594|S39594 nickel-binding periplasmic protein
precursor-Escheri
% Match = 26.9
% Identity = 41.3   % Similarity = 63.7
Matches = 208   Mismatches = 175   Conservative Sub.s = 113

147        177        207        237        267        297        327        357
         SP*IIDTYTLSQSVYSHNFLLRRMQNQYNVGNTSSVDYHKLXX*LIXXXCLKK*LTKLKRKLVKMRRNILLSITCLLMVT
                                                                                 MLSTLRRTL
         387        417        447        477        507        537        567        597
         LTACHSQDSKSHKLNSDKLTLAWGEDFGDVNPHRYNPDQFVIQDMVYEGLVRYGDNGKIEPALAKSWSISQDGKTYTFKL
         :          |    |::| ||    : |  :|||| |:|    | |||| ||:|   :| :   | |||||: |:||||:|| |
         FALLACASFIVHAAAPDEITTAWPVNVGPLNPHLYTPNQMFAQSMVYEPLVKYQADGSVIPWLAKSWTHSEDGKTWTFTL
                    20         30         40         50         60         70         80

624        654        684        714        744        774        804        834
         RN-AKYSDGSNFNAANVKRNFDSIFSKSNRGNHNWFNLTNQLENYRALNQSTFEIKLKQAYSATLYDLSMIRPIRFLSDS
         |:   |:|:|    |:|    ||  :::     ||   | |:  | ||: :||::::  :|   ||   ||   | :|:: ||  ||::    |
         RDDVKFSNGEPFDAEAAAENFRAVL--DNRQRHAWLELANQIVDVKALSKTELQITLKSAYYPFLQELALPRPFRFIAPS
                    100        110        120        130        140        150        160
```

```
864       894       924       954       984       1014      1044      1071
AFPKGDDTTKKNVKKPIGTGQWVVKSKKQNEYITFKRNENYWGKKPKLKEVTVKVIPDAQTRALAFESGDVDLIYGN-GI
 | :  |   : ||||| |:::   | |:| | |||||||:|| :|::| |||| |||:|||:||:|||| |:
QF--KNHETMNGIKAPIGTGPWILQESKLNQYDVFVRNENYWGEKPAIKKITFNVIPDPTTRAVAFETGDIDLLYGNEGL
         180       190       200       210       220       230       240

1101      1131      1161      1191      1221      1251      1281      1311
IGLDTFAQYTKDKKYVTAISQPMSTRLLLLNAKESIFQDKKVRQAMNHAIDKVSIAKNTFRGTEKPADTIFSKSTSHSDA
: ||||::::: |   | :|||:   | :| || ::   :  ||:|:|:|::| |:  |  |  ||:: |||:|:  | :::
LPLDTFARFSQNPAYHTQLSQPIETVMLALNTAKAPTNELAVREALNYAVNKKSLIDNALYGTQQVADTLFAPSVPYANL
         260       270       280       290       300       310       320

1341      1371      1395      1425      1455      1485      1515      1545
KLNPYSYNVDKANQLLDQAGWKM--GKDKVREKDGKTLTLRLPYIATKATDKDLVTYFQGEWRKIGINVSLIAMEEDDYW
 | |  |: || ||::||| :  |||  :|||:|: | :  :| | |  |:  | :|| :|||| || :
GLKPSQYDPQKAKALLEKAGWTLPAGKD-IREKNGQPLRIELSFIGTDALSKSMAEIIQADMRQIGADVSLIGEEESSIY
         340       350       360       370       380       390       400

1575      1605      1635      1665      1695      1725      1755      1785
ANAKKGNFDMMLTYSWGAPWDPHAWMSALTAKADHGHPENIALENLATKTEMDRLIKSALVDPKEENVDRDYKKVLELLH
 |  | |   :  :||||:|||::|:  |  | :: | | | | :|: | |     |   |:|  ||
ARQRDGRFGMIFHRTWGAPYDPHAFLSSM---RVPSHADFQAQQGLADKPLIDKEIGEVLATHDETQRQALYRDILTRLH
         420       430       440       450       460       470       480

1815      1845      1875      1905      1935      1965      1995      2025
DEAVYIPLTYQSVISVYRKGDFKTMRFAPEENSFPLRYIEKNNVSK*FDHQKNIVSFFGIVFHITSNIYSYQTINS*FSR
||||| |:::| |:: | | :: :|| |:   |:
DEAVYLPISYISMMVV-SKPELGNIPYAPIATEIPFEQIKPVKP
         500       510       520
```

There is also homology to SEQ ID 318. An alignment of
the GAS and GBS sequences follows:

```
Identities = 44/186 (23%), Positives = 78/186 (41%), Gaps = 27/186 (14%)

Query:  65 VITQMV-DGLLENDEYGNLVPSLAKDWKVSKDGLTYTYTLRDGVSWYTADGEEYAPVTAE  123
           VI  MV +GL+   + G + P+LAK W +S+DG TYT+ LR+      +DG  +       +
Sbjct:  57 VIQDMVYEGLVRYGDNGKIEPALAKSWSISQDGKTYTFKLRNA---KYSDGSNFNAANVK  113

Query: 124 DFVTGLKHAVDDKSDALYVVEDSIKNLKAYQNGEVDFKEVGVKALDDKTVQYTLNKPESY  183
              +         +    + + + ++N            +AL+   T +  L    ++Y
Sbjct: 114 RNFDSIFSKSNRGNHNWFNLTNQLEN---------------YRALNQSTFEIKLK--QAY  156

Query: 184 WNSKTTYSVLFPVNAKFLKS----KGKDFGTTDPSSILVNGAYFLSAFTSKSSMEFHKNE  239
              S  T Y +     +FL       KG D    +    G + +     + F +NE
Sbjct: 157 --SATLYDLSMIRPIRFLSDSAFPKGDDTTKKNVKKPIGTGQWVVKSKKQNEYITFKRNE  214

Query: 240 NYWDAK                                                       245
           NYW  K
Sbjct: 215 NYWGKK                                                       220
```

Figure 35:
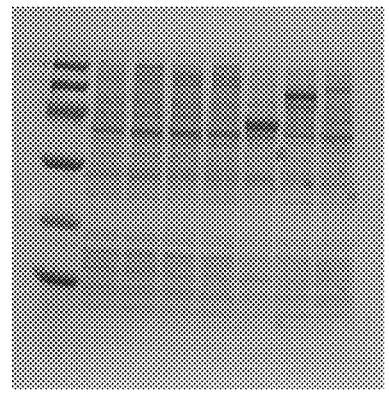
Figure 41:
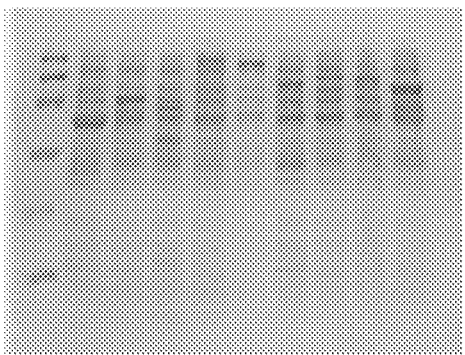

SEQ ID 8470 (GBS186) was expressed in *E. coli* as a His-fusion product. SDS-PAGE analysis of total cell extract is shown in FIG. 35 (lane 7; MW 60 kDa). It was also expressed in *E. coli* as a GST-fusion product. SDS-PAGE analysis of total cell extract is shown in FIG. 41 (lane 6; MW 85.7 kDa).

Figure 202:
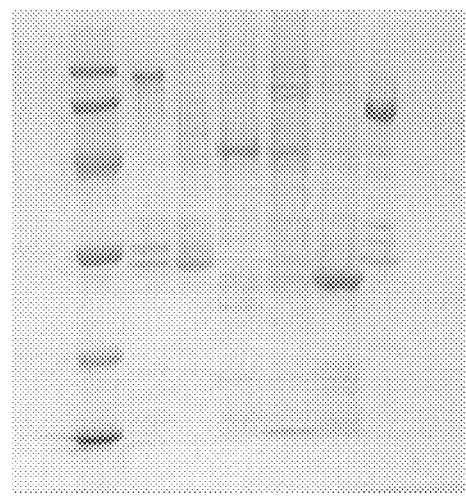

GBS186-GST was purified as shown in FIG. 202, lane 4.

Based on this analysis, it was predicted that these proteins and their epitopes could be useful antigens for vaccines or diagnostics.

EXAMPLE 22

A DNA sequence (GBSx0019) was identified in *S. agalactiae* <SEQ ID 61> which encodes the amino acid sequence <SEQ ID 62>. Analysis of this protein sequence reveals the following:

```
Possible site: 37
>>> Seems to have a cleavable N-term signal seq.
      INTEGRAL    Likelihood = -5.95    Transmembrane    101-117 (99-123)
      INTEGRAL    Likelihood = -4.73    Transmembrane    276-292 (275-293)
      INTEGRAL    Likelihood = -1.12    Transmembrane    232-248 (232-248)
      INTEGRAL    Likelihood = -0.96    Transmembrane    151-167 (150-169)

----- Final Results -----
               bacterial membrane  --- Certainty = 0.3378(Affirmative)
  < succ>
               bacterial outside   --- Certainty = 0.0000(Not Clear) < succ>
               bacterial cytoplasm --- Certainty = 0.0000(Not Clear) < succ>
```

The protein has homology with the following sequences in the GENPEPT database:

```
>GP: BAB04287 GB: AP001509 nickel transport system (permease)
[Bacillus halodurans]
Identities = 119/304 (39%), Positives = 174/304 (57%)

Query:    5 SSIIKKILSAFLALFFISLLTFILIKLSTVNSAENYLRLSKISVSPEALKEAEHYLGLDK   64
            S I K+I +   + F   + F+ I+LS V+ AE YL  + I  + E L E   H  GLD+
Sbjct:    3 SYIAKRIFAVIPIVLFAIFIMFVFIRLSPVDPAEAYLTAANIHPTEELLAEKRHEFGLDQ   62

Query:   65 PLWKQYWLWFQKALTGDFGYSYVLRLPVLDLVLQRFLATLFLGTSAFLLIVTISTPLGVW  124
            P+   QY      K   DFG+SYV   PV D V  R  ATL L  S+   L V IS PLG
Sbjct:   63 PMAVQYVQTIVKVFQLDFGHSYVTNQPVWDEVTARMPATLQLAVSSIFLAVLISIPLGFL  122

Query:  125 AGLHESARSDHLIRFLSFSSVSMPNFWVAYLLMLLFSAKLNLLPVSGGNDLQSLILPSIT  184
            +  +++++   D    R LS+     S+P FW+ YLL+   FS KLNL PV G        L+LP++T
Sbjct:  123 SAIYKNSLIDRFSRLLSYLGASIPQFWLGYLLIFFFSVKLNLFPVEGRGSWAHLVLPTVT  182

Query:  185 LSFSTVGQYIALIRKAISQENRSLNVENARLRGVKERYIVTHHLLRNALPAIMTALSLTW  244
            LS + +    Y   L+R  ++  ++ +       V   AR RG+KE+  I+   H+L+  A+  ++T L  +
Sbjct:  183 LSLALIAIYTRLLRASVLEQMQESYVLYARTRGIKEKVIMVKHVLKLAISPVITGLGMNV  242

Query:  245 VYLLTGSIIVEEIFSWNGIGRLFVTSLRTSDLPVIQACMLIFGTLFLANNFMTQCFMNWV  304
                LLTG+IIVE++FSW G GR FV ++    D+PVIQ  +L+      LF+  N +           +
Sbjct:  243 GKLLTGTIIVEQVFSWPGFGRYFVDAIFNRDIPVIQCYVLLAACLFIVCNLIVDLVQLAM  302

Query:  305 DPRL                                                         308
            DPR+
Sbjct:  303 DPRI                                                         306
```

A related DNA sequence was identified in *S. pyogenes* <SEQ ID 63> which encodes the amino acid sequence <SEQ ID 64>. Analysis of this protein sequence reveals the following:

```
Possible site: 40
>>> Seems to have an uncleavable N-term signal seq
    INTEGRAL    Likelihood = -7.27    Transmembrane    290-306  (287-313)
    INTEGRAL    Likelihood = -6.37    Transmembrane     12-28   (4-33)
    INTEGRAL    Likelihood = -5.89    Transmembrane    105-121  (100-128)
    INTEGRAL    Likelihood = -5.26    Transmembrane    145-161  (142-172)
    INTEGRAL    Likelihood = -2.39    Transmembrane    191-207  (190-208)

----- Final Results -----
          bacterial membrane  --- Certainty = 0.3909(Affirmative) < succ>
          bacterial outside   --- Certainty = 0.0000(Not Clear)   < succ>
          bacterial cytoplasm --- Certainty = 0.0000(Not Clear)   < succ>
```

An alignment of the GAS and GBS proteins is shown below:

```
Identities = 102/324 (31%), Positives = 167/324 (51%), Gaps = 28/324 (8%)

Query:    7 IIKKILSAFLALFFISLLTFILIKLSTVN---SAENYLRLSKISVSPEALKEAEHYLGLD   63
            II KI+     +F +S+LTF+L+K S V+    ++ NY        S++P    K  H+ GLD
Sbjct:    8 IIWKIIRCVTLIFGVSVLTFVLLKQSPVDPVMASVNY----DTSLTPAQYKAIAHHYGLD   63

Query:   64 KPLWKQYWLWFQKALTGDFGYSYVLRLPVLDLVLQRFLATLFLGTSAFLLIVTISTPLGV  123
            KP    QY++W +   + GD G S V R PV D++  R  A+  L   +++L  I    LG
Sbjct:   64 KPALVQYFIWLKNVIQGDLGTSLVYRQPVSDIIRSRAGASFILMGLSWILSGLIGFILGT  123

Query:  124 WAGLHESARSDHLIRFLSFSSVSMPNFWVAYLLMLLFSAKLNLLPVSGGNDL--------  175
             +   H+    D  ++R+ S+   +S+P FW+ +  +L+FS +L    P+  +  +
Sbjct:  124 LSAFHQGKLLDRVVRWFSYLQISVPTFWIGLIFLLIFSVQLGWFPIGISSPIGTLSQDIT  183

Query:  176 -----QSLILPSITLSFSTVGQYIALIRKAISQENRSLNVENARLRGVKERYIVTHHLLR  230
                 + L+LP  TLS   +       R  +       S V  AR RG  +  I  HH LR
Sbjct:  184 LADRVKHLMLPVFTLSILGIANVTLHTRTKMMSVLSSEYVLFARARGETQWQIFKHHCLR  243

Query:  231 NALPAIMTALSLTWVY---LLTGSIIVEEIFSWNGIGRLFVTSLRTSDLPVIQACMLIFG  287
            N    AI+ A++L + Y      L    GS++  E++FS+ G+G          +  SD P++  A ++I G
Sbjct:  244 N---AIVPAITLHFSYFGELFGGSVLAEQVFSYPGLGSTLTEAGLKSDTPLLLAIVMI-G  299
```

```
                             -continued
Query: 288 TLFL-ANNFMTQCFMNWVDPRLRK                                       310
           TLF+ A N +       + ++P+LR+
Sbjct: 300 TLFVFAGNLIADILNSIINPQLRR                                       323
```

Based on this analysis, it was predicted that these proteins and their epitopes could be useful antigens for vaccines or diagnostics.

EXAMPLE 23

A DNA sequence (GBSx0020) was identified in *S. agalactiae* <SEQ ID 65> which encodes the amino acid sequence <SEQ ID 66>. This protein is predicted to be nickel transport system (permease). Analysis of this protein sequence reveals the following:

```
Possible site: 14
>>> Seems to have a cleavable N-term signal seq.
      INTEGRAL      Likelihood = -7.64      Transmembrane     57-73   (51-80)
      INTEGRAL      Likelihood = -6.85      Transmembrane   173-189  (169-194)
      INTEGRAL      Likelihood = -5.79      Transmembrane    94-110   (86-112)
      INTEGRAL      Likelihood = -1.44      Transmembrane   221-237  (221-238)
      INTEGRAL      Likelihood = -1.33      Transmembrane   118-134  (118-134)

----- Final Results -----
              bacterial membrane --- Certainty = 0.4057(Affirmative) < succ>
              bacterial outside  --- Certainty = 0.0000(Not Clear)   < succ>
            bacterial cytoplasm  --- Certainty = 0.0000(Not Clear)   < succ>
```

The protein has homology with the following sequences in the GENPEPT database:

```
>GP: BAB04288 GB: AP001509 nickel transport system (permease)
[Bacillus halodurans]
Identities = 103/239 (43%), Positives = 157/239 (65%)

Query:   6 AIFAPILSSFDPQYVDLSQKLLAPNNVHLLGTDQLGRDVLSRLLYGARYSLFLAIIISLL   65
           AI AP ++  DP V+L+ KLL P+ + LGTDQLGR  LSRLL+GAR SL  A +I +
Sbjct:  29 AILAPWIAPHDPIQVNLALKLLPPSWEYPLGTDQLGRCNLSRLLFGARVSLGFATLIFIS   88

Query:  66 ELTIGMFVGLIVGWYQGKLENLFLWIANIILAFPSFLLSLATVGILGHGLGNLIFAIVFV  125
              L IG+ VG I G+   G ++++ +    ++AFP+ +L L  VG+ G GL  ++ A+V V
Sbjct:  89 SLGIGLLVGAIAGYRGGWIDSVLMRFCEGVMAFPNLVLVLGLVGLFGPGLWQVVLALVMV  148

Query: 126 EWVYYAKLMTNLVKSAKKEPYVINAQIMGLSVWHILRKHIFPFVYQPILVMVLMNIGNII  185
           +WVYYA++  +++ S K++ ++   A+I G S W I+R+HI P V  PI+V+  + +G   I
Sbjct: 149 QWVYYARMFRSMIVSLKEQNFITAARISGSSPWKIIRRHIIPNVLPPIVVIGTLEMGWAI  208

Query: 186 LMISGFSFLGIGVQPNVTEWGMMLHDARGYFRTATWMMLSPGIAIFLTVFSFNTLGDAI  244
           + IS  SFLG+G+QP     EWG M+H+ + + R+     +ML PGI  I L V +FN LG+++
Sbjct: 209 MDISALSFLGLGIQPPTPEWGAMIHEGKSFIRSHPELMLYPGIMILLVVMTFNVLGESL  267
```

A related DNA sequence was identified in *S. pyogenes* <SEQ ID 67> which encodes the amino acid sequence <SEQ ID 68>. Analysis of this protein sequence reveals the following:

```
Possible site: 39
>>> Seems to have an uncleavable N-term signal seq
      INTEGRAL      Likelihood = -7.80      Transmembrane   182-198  (180-204)
      INTEGRAL      Likelihood = -7.38      Transmembrane    77-93    (69-98)
      INTEGRAL      Likelihood = -7.06      Transmembrane   112-128  (104-132)
      INTEGRAL      Likelihood = -6.16      Transmembrane     8-24    (7-31)
      INTEGRAL      Likelihood = -5.10      Transmembrane   239-255  (235-258)

----- Final Results -----
              bacterial membrane --- Certainty = 0.4121(Affirmative) < succ>
              bacterial outside  --- Certainty = 0.0000(Not Clear)   < succ>
            bacterial cytoplasm  --- Certainty = 0.0000(Not Clear)   < succ>
```

An alignment of the GAS and GBS proteins is shown below:

```
Identities = 61/246 (24%), Positives = 127/246 (50%), Gaps = 1/246 (0%)

Query:    2 LVISAIFAPILSSFDPQYVDLSQKLLAPNNVHLLGTDQLGRDVLSRLLYGARYSLFLAII   61
            L++S +  +     P  + + + LAP+  HL GTD LGRD+  R + G  +SL + ++
Sbjct:   19 LILSILALNLYFYRTPLETNAALRNLAPSLNHLFGTDGLGRDMFVRTIRGLYFSLQVGLL   78

Query:   62 ISLLELTIGMFVGLIVGWYQGKLENLFLWIANIILAFPSFLLSLATVGILGHGLGNLIFA  121
            +L+ + +     G++ G    ++ + W+ ++ +  P  +    ++G G   +I A
Sbjct:   79 GALMGVFLATVFGVLAGLGNSLIDKIIAWLVDLFIGMPHLIFMILISFVVGKGAQGVIIA  138

Query:  122 IVFVEWVYYAKLMTNLVKSAKREPYVINAQIMGLSVWHILRKHIFPFVYQPILVMVLMNI  181
               W   A+L+ N V   K + +V  ++ MG + ++I+R HI P +   I +  ++
Sbjct:  139 TAVTHWPSLARLIRNEVYDLKNKAFVQLSKSMGKTPYYIVRHHILPLIASQIFIGFILLF  198

Query:  182 GNIILMISGFSFLGIGVQPNVTEWGMMLHDARGYFRTAT-WMMLSPGIAIFLTVFSFNTL  240
             ++IL  +  +FLG G+        G++L +A  +       W+++ PG+ +  L V +F+T+
Sbjct:  199 PHVILHEASMTFLGFGLSAEQPSVGIILSEAAKHISLGNWWLVIFPGLYLILVVNAFDTI  258

Query:  241 GDAIDK                                                        246
            G+++ K
Sbjct:  259 GESLKK                                                        264
```

A related GBS gene <SEQ ID 8473> and protein <SEQ ID 8474> were also identified. Analysis of this protein sequence reveals the following:

```
Lipop: Possible site: -1 Crend: 0
McG: Discrim Score: 7.56
GvH: Signal Score (-7.5): -1.15
     Possible site: 14
>>> Seems to have a cleavable N-term signal seq.
ALOM program count: 5 value: -7.64 threshold: 0.0
     INTEGRAL      Likelihood = -7.64    Transmembrane     57-73   (51-80)
     INTEGRAL      Likelihood = -6.85    Transmembrane    173-189 (169-194)
     INTEGRAL      Likelihood = -5.79    Transmembrane     94-110  (86-112)
     INTEGRAL      Likelihood = -1.44    Transmembrane    221-237 (221-238)
     INTEGRAL      Likelihood = -1.33    Transmembrane    118-134 (118-134)
     PERIPHERAL    Likelihood =  4.72    145
modified ALOM score: 2.03
*** Reasoning Step: 3

----- Final Results -----
              bacterial membrane --- Certainty = 0.4057(Affirmative) < succ>
               bacterial outside --- Certainty = 0.0000(Not Clear)   < succ>
              bacterial cytoplasm --- Certainty = 0.0000(Not Clear)   < succ>
```

The protein has homology with the following sequences in the databases:

```
ORF02082(292-1053 of 1365)
EGAD|89511|HP0300(23-283 of 285) dipeptide ABC transporter, permease protein
{Helicobacter pylori} OMNI|HP0300 dipeptide ABC transporter, permease protein
(dppC) GP|2313398|gb|AAD07369.1||AE000548 dipeptide ABC transporter, permease
protein (dppC) {Helicobacter pylori 26695} PIR|D64557|D64557 dipeptide ABC
transporter, permease protein - Helicobacter pylori (strain 26695)
% Match = 20.5
% Identity = 43.4  % Similarity = 63.3
Matches = 111  Mismatches = 92  Conservative Sub.s = 51

30        60        90       120       150       180       210       240
P*KCLTCDNDST*LDLGLLINRINYC*RNFFMEWNRTFICDQSKNFRSSSNTSLYANFWNLIFS**FYDTVFYELG*SSV

MESFR
     270       300       330       360             402       432       462
TKVKGEIISKRIYFSSSLLVLLVISAIFAPILSSFDPQYVDLSQKLLAP------NNVHLLGTDQLGRDVLSRLLYGARY
               :::|||| |||||:|:  ||    :  :|| |           |  :|||| ||||:||||:||||
EFIQQFKKNKAAVVGAWIVLLLVICAIFAPLLAPHDPYVQNAQDRLLKPIWEHGGNAKYLLGTDDLGRDILSRLIYGARI
            20        30        40        50        60        70        80
```

```
492        522        552        582        612        642        672        702
SLFLAIIISLLELTIGMFVGLIVGWYQGKLENLFLWIANIILAFPSFLLSLATVGILGHGLGNLIFAIVFVEWVYYAKLM
 ||  |:     :  :     |   :|||  |::  ||  :  : :  |  :|::|:|| ||  :   |:||  | |  ::||  ||     :|:|:
SLTIGIVSMGIAVFFGTILGLIAGYFGGKTDAIIMRIMDIMFALPSILLIVIVVAVLGPSLTNAMLAIGFVGIPGFARLV
           100        110        120        130        140        150        160

732        762        792        822        852        882        912        942
TNLVKSAKKEPYVINAQIMGLSVWHILRKHIFPPFVYQPILVMVLMNIGNIILMISGFSFLGIGVQPNVTEWGMMLHDARG
 :  |      |:: |||  ::|  |  |       ::  |  |||       |::|     |     : :|   : :||||:| ||     ||| ||  ::
RSSVLGEKEKEYVIASKINGSSHLRLMCKVIFPNCIIPLIVQTTMGFASTVLEAAALSFLGLGAQPPKPEWGAMLMNSMQ
           180        190        200        210        220        230        240

972        1002       1032       1059       1089       1119       1149
YFRTATWMMLSPGIAIFLTVFSFNTLGDAI-DKKDWKRQWNS*K*ENCHYR*ERSLY*EILVVK*IWENR*LLLVRVV
|   ||  ||::  ||:   |||||  |||  :||   |    | ||
YIATAPWMLVFPGVMIFLTVMSFNLVGDGIMDALDPKRTS
           260        270        280
```

Based on this analysis, it was predicted that these proteins and their epitopes could be useful antigens for vaccines or diagnostics.

EXAMPLE 24

A DNA sequence (GBSx0021) was identified in *S. agalactiae* <SEQ ID 69> which encodes the amino acid sequence <SEQ ID 70>. This protein is predicted to be peptide ABC transporter, ATP-binding protein. Analysis of this protein sequence reveals the following:

```
Possible site: 60
>>> Seems to have no N-terminal signal sequence
    INTEGRAL    Likelihood = -0.32    Transmembrane    161-177 (161-177)

----- Final Results -----
              bacterial membrane --- Certainty = 0.1128(Affirmative) < succ>
               bacterial outside --- Certainty = 0.0000(Not Clear)   < succ>
             bacterial cytoplasm --- Certainty = 0.0000(Not Clear)   < succ>
```

A related GBS nucleic acid sequence <SEQ ID 10027> which encodes amino acid sequence <SEQ ID 10028> was also identified.

The protein has homology with the following sequences in the GENPEPT database:

```
>GP: AAF73561 GB: AE002315 peptide ABC transporter, ATP-binding
protein [Chlamydia muridarum]
Identities = 86/253 (33%), Positives = 154/253 (59%), Gaps = 2/253 (0%)

Query:    1 METTMEQLEIRKLSLQIGEVPVLRDFSCKIDMGESLTIIGESGSGKTLLAKLLVGHIPQG    60
            M   T+ ++E    ++++       ++    S   I    +SL ++GE+GSGKT  ++K  ++G  +P
Sbjct:    1 MSKTLLKIENLVVAIKESNQRLVNHLSLTIKQRQSLALVGENGSGKTTVSKAILGFLPDN    60

Query:   61 MTVR-GNIFFKGVDLGKLTVKQWQKLRGRDIAYLVQNPMSMFNPFQKIEAHILETILSHE   119
            ++   G  IF+  G  D+   +L+  K++Q  +RG+   I+ +   QN M       P    ++      I+ET+    H
Sbjct:   61 CCIQSGKIFYSGTDITRLSRKEFQSIRGKKISTIFQNAMGTLTPSMRVGTQIIETLRHHF   120

Query:  120 KCSKRVALSKALEWMKRLNLDDAISLLKKYPFELSGGMLQRIMLATILSLDPQVIILDEP   179
                SK   A  +KA E +   ++++          L+ YPFELSGGM  QR+ +A   L+  +P++II DEP
Sbjct:  121 VMSKEEAFAKARELLVSVHIESPDRCLQLYPFELSGGMCQRVSIAIALATNPELIIADEP   180

Query:  180 TSAVDCHNCSTISAILQEL-QNNGKTLITVTHDYQLARDLGGQLLVISEGEVVEQGQTQA   238
            ++A+D   + + +   +L+++ QNN      L+ +TH+   L   +L    ++  +I    GE+VEQG
Sbjct:  181 STALDSISQAQVLRVLKQIHQNNNTALLLITHNLALVSELCEEMAIIHHGEIVEQGPVHE   240

Query:  239 ILSNPQHNYTKAL                                                 251
            +L  +P H  YT+ L
Sbjct:  241 LLRSPSHPYTQKL                                                 253
```

A related DNA sequence was identified in *S. pyogenes* <SEQ ID 71> which encodes the amino acid sequence <SEQ ID 72>. Analysis of this protein sequence reveals the following:

```
Possible site: 55
>>> Seems to have no N-terminal signal sequence
    INTEGRAL    Likelihood = -2.50    Transmembrane    168-184 (167-184)
    INTEGRAL    Likelihood = -1.70    Transmembrane    211-227 (211-227)

----- Final Results -----
            bacterial membrane --- Certainty = 0.1999(Affirmative) < succ>
             bacterial outside --- Certainty = 0.0000(Not Clear)   < succ>
           bacterial cytoplasm --- Certainty = 0.0000(Not Clear)   < succ>
```

An alignment of the GAS and GBS proteins is shown below:

```
Identities = 87/232 (37%), Positives = 138/232 (58%), Gaps = 3/232 (1%)

Query:   23 LRDFSCKIDMGESLTIIGESGSGKTLLAKLLVGHIPQ-GMTVRGNIFFKGVDLGKL-TVK    80
            +R+ S ++  GE L +GESGSGK++L K   G +    G    G+I ++G +L   L T K
Sbjct:   28 IRNVSLELVEGEVLAFVGESGSGKSVLTKTFTGMLESNGRIANGSIVYRGQELTDLKTNK    87

Query:   81 QWQKLRGRDIAYLVQNPMSMFNPFQKIEAHILETILSHEKCSKRVALSKALEWMKRLNLD   140
            +W K+RG  IA + Q+PM+  +P + I + I E I+ H+K S    A    AL++M ++ +
Sbjct:   88 EWAKIRGSKIATIFQDPMTSLSPIKTIGSQITEVIIKHQKVSHAKAKEMALDYMNKVGIP   147

Query:  141 DAISLLKKYPFELSGGMLQRIMLATILSLDPQVIILDEPTSAVDCHNCSTISAILQELQN   200
            +A    + YPFE SGGM QRI++A  L+  P ++I DEPT+A+D    + I  +L+ LQ
Sbjct:  148 NAKKRFEDYPFEYSGGMRQRIVIAIALACRPDILICDEPTTALDVTIQAQIVELLKSLQR   207

Query:  201 NGK-TLITVTHDYQLARDLGGQLLVISEGEVVEQGQTQAILSNPQHNYTKAL          251
                T+I +THD +  +  ++ V+  GE+VE G  + I   +P+H YT +L
Sbjct:  208 EYHFTIIFITHDLGVVASIADKVAVMYAGEIVEFGTVEEIFYDPRHPYTWSL          259
```

Based on this analysis, it was predicted that these proteins and their epitopes could be useful antigens for vaccines or diagnostics.

EXAMPLE 25

A DNA sequence (GBSx0022) was identified in *S. agalactiae* <SEQ ID 73> which encodes the amino acid sequence <SEQ ID 74>. This protein is predicted to be peptide ABC transporter, ATP-binding protein. Analysis of this protein sequence reveals the following:

```
Possible site: 50
>>> Seems to have an uncleavable N-term signal seq

----- Final Results -----
            bacterial membrane --- Certainty = 0.0000(Not Clear) < succ>
             bacterial outside --- Certainty = 0.0000(Not Clear) < succ>
           bacterial cytoplasm --- Certainty = 0.0000(Not Clear) < succ>
```

A related GBS nucleic acid sequence <SEQ ID 10025> which encodes amino acid sequence <SEQ ID 10026> was also identified.

The protein has homology with the following sequences in the GENPEPT database:

```
>GP: BAB05797 GB: AP001514 oligopeptide ABC transporter (ATP-binding
protein) [Bacillus halodurans]
Identities = 82/199 (41%), Positives = 130/199 (65%), Gaps = 2/199 (1%)

Query:   19 RQEVLKDCHFHLKRGEIIGIMGKSGSGKSSLARLIIGLIDSPTCGSIYFQG-KIYTPKDGK    77
            +Q++L    F + GE +GI+G+SGSGKS+L RL++G++  P   G IYF+G K+
Sbjct:   21 KQKILNHISFECRHGECLGIIGESGSGKSTLGRLLLGIEKPDRGHIYFEGNKVEERSVRS    80

Query:   78 AQIILVFQDALSSVNPYFSIEEILNEAFYGKKTT-FELCQILEAVGLDGTYLKYKARQLS   136
            +    I  VFQD    SS+NP+F++ +  + E     GKK     ++  +L+  VGL  +Y K     +LS
Sbjct:   81 GNISAVFQDYTSSINPFFTVETAIMEPLKGKKAAKSKVDYLLKQVGLHPSYKKKYPHELS   140

Query:  137 GGQLQRVCIARALLLKPKIIIFDESLSGLDPVTQIKMLRLLQKIKRRYELSFIMISHDPK   196
            GG++QRVCIARA+   +PK I+  DE++S LD    Q  ++L LL ++KR Y++S++  I+HD +
Sbjct:  141 GGEVQRVCIARAISTEPKCIVLDEAISSLDVSIQTQVLDLLIELKRIYQMSYLFITHDIQ   200
```

```
Query:  197 ICQAICNRVFLIKNGYLVE                                         215
            IC+R+ + ++G + E
Sbjct:  201 AAAYICDRIMIFRHGQIEE                                         219
```

A related DNA sequence was identified in *S. pyogenes* <SEQ ID 75> which encodes the amino acid sequence <SEQ ID 76>. Analysis of this protein sequence reveals the following:

```
Possible site: 60
>>> Seems to have no N-terminal signal sequence

----- Final Results -----
            bacterial cytoplasm --- Certainty = 0.3195(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below:

```
Identities = 91/238 (38%), Positives = 137/238 (57%), Gaps = 21/238 (8%)

Query:   1 MKEIFLMLVCNHVGKTFGRQ----EVLKDCHFHLKRGEIIGIMGKSGSGKSSLARLIIGL   56
           M E  + L  +H+  TF ++     E +KD   H+ +G+I GI+G SG+GKS+L R+I  L
Sbjct:   1 MNEAIIQL--DHIDITFRQKKRVIEAVKDVTVHINQGDIYGIVGYSGAGKSTLVRVINLL   58

Query:  57 DSPTCGSI-------YFQGKIYTPKDGKAQ----IILVFQ--DALSSVNPYFSIEEILNE  103
           +PT G I        + QGKI     D   Q    I ++FQ  + ++         ++  L
Sbjct:  59 QAPTNGKITVDGDVTFDQGKIQLSADALRQKRRDIGMIFQHFNLMAQKTAKENVAFALRH  118

Query: 104 AFYGK-KTTFELCQILEAVGLDGTYLKYKARQLSGGQLQRVCIARALLLKPKIIIFDESL  162
             +  K +  ++ ++LE VGL      Y A QLSGGQ QRV IARAL   PKI+I DE+
Sbjct: 119 SSLSKTEKEHKVIELLELVGLSERADNYPA-QLSGGQKQRVAIARALANDPKILISDEAT  177

Query: 163 SGLDPVTQIKMLRLLQKIKRRYELSFIMISHDPKICQAICNRVFLIKNGYLVEDNEFL   220
           S LDP T  ++L LLQ++ R+  L+ +MI+H+ +I + ICNRV  +++NG L+E+    L
Sbjct: 178 SALDPKTTKQILALLQELNRKLGLTIVMITHEMQIVKDICNRVAVMQNGVLIEEGSVL   235
```

Based on this analysis, it was predicted that these proteins and their epitopes could be useful antigens for vaccines or diagnostics.

EXAMPLE 26

A DNA sequence (GBSx0023) was identified in *S. agalactiae* <SEQ ID 77> which encodes the amino acid sequence <SEQ ID 78>. This protein is predicted to be UMP kinase (pyrH). Analysis of this protein sequence reveals the following:

```
Possible site: 18
>>> Seems to have no N-terminal signal sequence

----- Final Results -----
            bacterial cytoplasm --- Certainty = 0.1935(Affirmative) < succ>
             bacterial membrane --- Certainty = 0.0000(Not Clear)   < succ>
              bacterial outside --- Certainty = 0.0000(Not Clear)   < succ>
```

The protein has homology with the following sequences in the GENPEPT database:

```
>GP: CAB13524 GB: Z99112 uridylate kinase [Bacillus subtilis]
Identities = 143/238 (60%), Positives = 193/238 (81%)

Query:  2 EPKYQRILIKLSGEALAGDKGVGIDIPTVQSIAKEIAEVHNSGVQIALVIGGGNLWRGEP  61
          +PKY+RI++KLSGEALAG++G GI+   +QSIAK++ E+     V++A+V+GGGN    +
Sbjct:  3 KPKYKRIVLKLSGEALAGEQGNGINPTVIQSIAKQVKEIAELEVEVAVVVGGGNYGAEKT  62
```

```
                             -continued
Query:   62 AAEAGMDRVQADYTGMLGTVMNALVMADSLQQYGVDTRVQTAIPMQTVAEPYVRGRALRH    121
            ++ GMDR  ADY GML TVMN+L + DSL+   G+ +RVQT+I M+ VAEPY+R +A+RH
Sbjct:   63 GSDLGMDRATADYMGMLATVMNSLALQDSLETLGIQSRVQTSIEMRQVAEPYIRRKAIRH    122

Query:  122 LEKNRIVVFGAGIGSPYFSTDTTAALRAAEIEAEAILMAKNGVDGVYNADPKKDANAVKF    181
            LEK R+V+F AG G+PYFSTDTTAALRAAEIEA+ ILMAKN VDGVYNADP+KD +AVK+
Sbjct:  123 LEKKRVVIFAAGTGNPYFSTDTTAALRAAEIEADVILMAKNNVDGVYNADPRKDESAVKY    182

Query:  182 DELTHVEVIKRGLKIMDATASTISMDNDIDLVVFNMNETGNIKRVVLGEQIGTTVSNK     239
            + L++++V+K GL++MD+TAS++ MDNDI L+VF++ E GNIKR V+GE IGT V  K
Sbjct:  183 ESLSYLDVLKDGLEVMDSTASSLCMDNDIPLIVFSIMEEGNIKRAVIGESIGTIVRGK    240
```

A related DNA sequence was identified in *S. pyogenes* <SEQ ID 79> which encodes the amino acid sequence <SEQ ID 80>. Analysis of this protein sequence reveals the following:

```
Possible site: 18
>>> Seems to have no N-terminal signal sequence

----- Final Results -----
              bacterial cytoplasm --- Certainty = 0.1955(Affirmative) < succ>
               bacterial membrane --- Certainty = 0.0000(Not Clear)   < succ>
                 bacterial outside --- Certainty = 0.0000(Not Clear)   < succ>
```

An alignment of the GAS and GBS proteins is shown below:

```
Identities = 224/242 (92%), Positives = 233/242 (95%)

Query:    1 MEPKYQRILIKLSGEALAGDKGVGIDIPTVQSIAKEIAEVHNSGVQIALVIGGGNLWRGE    60
            +EPKYQRILIKLSGEALAG+KGVGIDIPTVQ+IAKEIAEVH SGVQIALVIGGGNLWRGE
Sbjct:    1 VEPKYQRILIKLSGEALAGEKGVGIDIPTVQAIAKEIAEVHVSGVQIALVIGGGNLWRGE    60

Query:   61 PAAEAGMDRVQADYTGMLGTVMNALVMADSLQQYGVDTRVQTAIPMQTVAEPYVRGRALR   120
            PAA+AGMDRVQADYTGMLGTVMNALVMADSLQ YGVDTRVQTAIPMQ VAEPY+RGRALR
Sbjct:   61 PAADAGMDRVQADYTGMLGTVMNALVMADSLQHYGVDTRVQTAIPMQNVAEPYIRGRALR   120

Query:  121 HLEKNRIVVFGAGIGSPYFSTDTTAALRAAEIEAEAILMAKNGVDGVYNADPKKDANAVK   180
            HLEKNRIVVFGAGIGSPYFSTDTTAALRAAEIEA+AILMAKNGVDGVYNADPKKDANAVK
Sbjct:  121 HLEKNRIVVFGAGIGSPYFSTDTTAALRAAEIEADAILMAKNGVDGVYNADPKKDANAVK   180

Query:  181 FDELTHVEVIKRGLKIMDATASTISMDNDIDLVVFNMNETGNIKRVVLGEQIGTTVSNKA   240
            FDELTH EVIKRGLKIMDATAST+SMDNDIDLVVFNMNE GNI+RVV GE IGTTVSNK
Sbjct:  181 FDELTHGEVIKRGLKIMDATASTLSMDNDIDLVVFNMNEAGNIQRVVFGEHIGTTVSNKV   240

Query:  241 SE   242
            +
Sbjct:  241 CD   242
```

Based on this analysis, it was predicted that these proteins and their epitopes could be useful antigens for vaccines or diagnostics.

EXAMPLE 27

A DNA sequence (GBSx0024) was identified in *S. agalactiae* <SEQ ID 81> which encodes the amino acid sequence <SEQ ID 82>. Analysis of this protein sequence reveals the following:

```
Possible site: 22
>>> Seems to have no N-terminal signal sequence

----- Final Results -----
              bacterial cytoplasm --- Certainty = 0.3712(Affirmative) < succ>
               bacterial membrane --- Certainty = 0.0000(Not Clear)   < succ>
                 bacterial outside --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 28

A DNA sequence (GBSx0025) was identified in *S. agalactiae* <SEQ ID 83> which encodes the amino acid sequence <SEQ ID 84>. This protein is predicted to be ribosome recycling factor (frr). Analysis of this protein sequence reveals the following:

```
Possible site: 34
>>> Seems to have no N-terminal signal sequence

----- Final Results -----
            bacterial cytoplasm --- Certainty = 0.3522(Affirmative) < succ>
            bacterial membrane  --- Certainty = 0.0000(Not Clear)   < succ>
             bacterial outside  --- Certainty = 0.0000(Not Clear)   < succ>
```

The protein has homology with the following sequences in the GENPEPT database:

```
>GP: BAB06143 GB: AP001515 ribosome recycling factor [Bacillus halodurans]
Identities = 112/185 (60%), Positives = 149/185 (80%)

Query:   1 MTKEIVTKAQERFEQSHQSLSREFAGIRAGRANASLLDRIQVEYYGAPTPLNQLASITVP   60
            M+KE++   A++R   ++ ++L RE A +RAGRAN ++LDRI VEYYGA TPLNQLA+I+VP
Sbjct:   1 MSKEVLNDAEQRMTKATEALGRELAKLRAGRANPAMLDRITVEYYGAETPLNQLATISVP   60

Query:  61 EARVLLISPFDKSSIKDIERAINESDLGINPANDGSVIRLVIPALTEETRRDLAKEVKKV  120
            EAR+L+I PFDKSSI DIERAI +SDLG+ P+NDG+VIR+ IP LTEE RRDL K VKK
Sbjct:  61 EARLLVIQPFDKSSISDIERAIQKSDLGLTPSNDGTVIRITIPPLTEERRRDLTKLVKKS  120

Query: 121 GENAKIAIRNIRRDAMDEAKKQEKNKEITEDDLKSLEKDIQKATDDAVKHIDEMTANKEK  180
              E AK+A+RNIRRDA D+ KK++K+ E+TEDDL+ + +D+QK TD  ++ ID+    KEK
Sbjct: 121 AEEAKVAVRNIRRDANDDLKKRQKDGELTEDDLRRVTEDVQKLTDKYIEQIDQKAEAKEK  180

Query: 181 ELLEV                                                        185
            E++EV
Sbjct: 181 EIMEV                                                        185
```

A related DNA sequence was identified in *S. pyogenes* <SEQ ID 85> which encodes the amino acid sequence <SEQ ID 86>. Analysis of this protein sequence reveals the following:

```
Possible site: 21
>>> Seems to have no N-terminal signal sequence

----- Final Results -----
            bacterial cytoplasm --- Certainty = 0.4462(Affirmative) < succ>
            bacterial membrane  --- Certainty = 0.0000(Not Clear)   < succ>
             bacterial outside  --- Certainty = 0.0000(Not Clear)   < succ>
```

An alignment of the GAS and GBS proteins is shown below:

```
Identities = 160/185 (86%), Positives = 171/185 (91%)

Query:    1 MTKEIVTKAQERFEQSHQSLSREFAGIRAGRANASLLDRIQVEYYGAPTPLNQLASITVP   60
             M   I+   A+ERF QSHQSLSRE+A IRAGRANASLLDRIQV+YYGAPTPLNQLASITVP
Sbjct:    1 MANAIIETAKERFAQSHQSLSREYASIRAGRANASLLDRIQVDYYGAPTPLNQLASITVP   60

Query:   61 EARVLLISPFDKSSIKDIERAINESDLGINPANDGSVIRLVIPALTEETRRDLAKEVKKV  120
             EARVLLISPFDKSSI DIERA+N SDLGI PANDGSVIRLVIPALTEETR++LAKEVKKV
Sbjct:   61 EARVLLISPFDKSSIKDIERALNASDLGITPANDGSVIRLVIPALTEETRKELAKEVKKV  120

Query:  121 GENAKIAIRNIRRDAMDEAKKQEKNKEITEDDLKSLEKDIQKATDDAVKHIDEMTANKEK  180
             GENAKIAIRNIRRDAMD+AKKQEK KEITED+LK+LEKDIQKATDDA+K ID MTA KEK
Sbjct:  121 GENAKIAIRNIRRDAMDDAKKQEKAKEITEDELKTLEKDIQKATDDAIKEIDRMTAEKEK  180

Query:  181 ELLEV                                                        185
             ELL V
Sbjct:  181 ELLSV                                                        185
```

Based on this analysis, it was predicted that these proteins and their epitopes could be useful antigens for vaccines or diagnostics.

EXAMPLE 29

A DNA sequence (GBSx0026) was identified in *S. agalactiae* <SEQ ID 87> which encodes the amino acid sequence <SEQ ID 88>. Analysis of this protein sequence reveals the following:

```
Possible site: 44
>>> Seems to have no N-terminal signal sequence

----- Final Results -----
            bacterial cytoplasm --- Certainty = 0.1356(Affirmative) < succ>
             bacterial membrane --- Certainty = 0.0000(Not Clear)   < succ>
              bacterial outside --- Certainty = 0.0000(Not Clear)   < succ>
```

A related GBS nucleic acid sequence <SEQ ID 10023> which encodes amino acid sequence <SEQ ID 10024> was also identified.

The protein has homology with the following sequences in the GENPEPT database:

```
>GP: CAB12943 GB: Z99109 yitL [Bacillus subtilis]
Identities = 107/269 (39%), Positives = 155/269 (56%), Gaps = 6/269 (2%)

Query:  42 LVTDENKDF-YFIQKDGFTFALSKSEGEHHIGEM--VKGFAYTDMQQKARLTTKETFATR  98
           L  D  DF YF+    T L SE    I +  V+ F Y D Q++   T K     +
Sbjct:  25 LSIDHQTDFGYFLTDGEDTILLHNSEMTEDIEDRDEVEVFIYVDQQERLAATMKIPIISA  84

Query:  99 DHYGWGTVTEVRKDLGVFLDTGLPDKQVVVSLDVLPELKELWPKKGDRLYVCLDVDKKDR 158
           D YGW V +  +D+GVF+D GL  K  +V+ +  LP   +++WP+KGD+LY    L V  + R
Sbjct:  85 DEYGWVEVVDKVEDMGVFVDVGL-SKDALVATEHLPPYEDVWPQKGDKLYCMLKVTNRGR 143

Query: 159 LWALPADPEVFQRMATPAYNNMQNQNWPAIVYRLKLSGTFVYLPENNMLGFIHPSERYSE 218
            ++A PA ++   + T A  ++ N+      VYRL  SG+FV + ++ +  FIHPSER  E
Sbjct: 144 MFAKPAPEDIISELFTDASEDLMNKELTGTVYRLIASGSFV-ITDDGIRCFIHPSERKEE 202

Query: 219 PRLGQVLDARVIGFREVDRTLNLSLKPRSFEMLENDAQMILTYLESNGGFMTLNDKSSPE 278
           PRLG    + RVI   +E D  ++NLSL PR   + +  DA+   ILTY+      G M  +DKS P+
Sbjct: 203 PRLGSRVTGRVIQVKE-DGSVNLSLLPRKQDAMSVDAECILTYMRMRNGAMPYSDKSQPD 261

Query: 279 EIKATFGISKGQFKKALGGLMKAKKIKQD                                307
           +I+   F  +SK   FK+ALG LMK    K+ Q+
Sbjct: 262 DIRERFNMSKAAFKRALGHLMKNGKVYQE                                290
```

A related DNA sequence was identified in *S. pyogenes* <SEQ ID 89> which encodes the amino acid sequence <SEQ ID 90>. Analysis of this protein sequence reveals the following:

```
Possible site: 51
>>> Seems to have no N-terminal signal sequence

----- Final Results -----
            bacterial cytoplasm --- Certainty = 0.0811(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below:

```
Identities = 235/284 (82%), Positives = 265/284 (92%)

Query:  31 MNTLLATVITGLVTDENKDFYFIQKDGFTFALSKSEGEHHIGEMVKGFAYTDMQQKARLT  90
           MN LLATVITGL+ +EN + YFI K+GFTF LSK+EGE   IG+MV GFAYTD++QKARLT
Sbjct:   1 MNDLLATVITGLIKEENANDYFIHKEGFTFTLSKAEGERQIGDMVTGFAYTDIEQKARLT  60
```

```
                                    -continued
Query:   91 TKETFATRDHYGWGTVTEVRKDLGVFLDTGLPDKQVVVSLDVLPELKELWPKKGDRLYVC  150
            TKE  +TR  YGWG VTEVR+DLGVF+DTG+P+K++VVSLDVLPE+KELWPKKGD+LY+
Sbjct:   61 TKEIRSTRTSYGWGEVTEVRRDLGVFVDTGIPNKEIVVSLDVLPEMKELWPKKGDKLYIR  120

Query:  151 LDVDKKDRLWALPADPEVFQRMATPAYNNMQNQNWPAIVYRLKLSGTFVYLPENNMLGFI  210
            LDVDKKDR+W LPA+PEVFQ+MA+PAYNNMQNQ+WPAIVYRLKL+GTFVYLPENNMLGFI
Sbjct:  121 LDVDKKDRIWGLPAEPEVFQKMASPAYNNMQNQHWPAIVYRLKLTGTFVYLPENNMLGFI  180

Query:  211 HPSERYSEPRLGQVLDARVIGFREVDRTLNLSLKPRSFEMLENDAQMILTYLESNGGFMT  270
            H SERY+EPRLGQVLDARVIGFREVDRTLNLSLKPRSFEMLENDAQMI+TYLE+NGGFMT
Sbjct:  181 HSSERYAEPRLGQVLDARVIGFREVDRTLNLSLKPRSFEMLENDAQMIVTYLEANGGFMT  240

Query:  271 LNDKSSPEEIKATFGISKGQFKKALGGLMKAKKIKQDQLGTELL                 314
            LNDKSSPEEIKA+FGISKGQFKKALGGLMKAK+IKQD  GTEL+
Sbjct:  241 LNDKSSPEEIKASFGISKGQFKKALGGLMKAKRIKQDATGTELI                 284
```

Based on this analysis, it was predicted that these proteins and their epitopes could be useful antigens for vaccines or diagnostics.

EXAMPLE 30

A DNA sequence (GBSx0028) was identified in *S. agalactiae* <SEQ ID 91> which encodes the amino acid sequence <SEQ ID 92>. This protein is predicted to be peptide methionine sulfoxide reductase (msrA). Analysis of this protein sequence reveals the following:

```
Possible site: 33
>>> Seems to have no N-terminal signal sequence

----- Final Results -----
            bacterial cytoplasm --- Certainty = 0.0866(Affirmative) < succ>
            bacterial membrane  --- Certainty = 0.0000(Not Clear)   < succ>
             bacterial outside  --- Certainty = 0.0000(Not Clear)   < succ>
```

A related GBS nucleic acid sequence <SEQ ID 10021> which encodes amino acid sequence <SEQ ID 10022> was also identified.

The protein has homology with the following sequences in the GENPEPT database:

```
>GP: BAB05167 GB: AP001512 peptide methionine sulfoxide reductase
[Bacillus halodurans]
Identities = 102/173 (58%), Positives = 126/173 (71%), Gaps = 2/173 (1%)

Query:   14 ENDMERAIFAGGCFWCMVQPFEELDGIESVLSGYTGGHVENPTYKEVCSKTTGHTEAVEI   73
            E+     A FAGGCFWCMV PFEE  GI  V+SGYTGGH ENPTYKEVCS+TTGH EAV+I
Sbjct:    3 ESKWALATFAGGCFWCMVSPFEEEPGIHQVVSGYTGGHTENPTYKEVCSETTGHYEAVQI   62

Query:   74 IFNPEKISYADLVELYWAQTDPTDAFGQFEDRGDNYRPVIFYENEEQRQIAQKSKDKLQA  133
             F+PE   Y  L+E+YW Q DPTD  GQF DRGD+YR   IFY +E+Q+Q A   SK KL+
Sbjct:   63 SFDPEVFPYEKLLEIYWTQIDPTDPGGQFHDRGDSYRTAIFYHDEQQKQAADASKQKLEE  122

Query:  134 SGRFDRPIVTSIEPADTFYPAEDYHQAFYRTNPARYAL--SSARRHAFLEENW         184
            SG+F+ PIVT I PA  FYPAE+YHQ +++ NP Y +    + R AF++++W
Sbjct:  123 SGKFNAPIVTRILPAKPFYPAEEYHQKYHKKNPFHYKMYRHGSGREAFIKQHW         175
```

A related DNA sequence was identified in *S. pyogenes* <SEQ ID 93> which encodes the amino acid sequence <SEQ ID 94>. Analysis of this protein sequence reveals the following:

```
Possible site: 17
>>> Seems to have no N-terminal signal sequence

----- Final Results -----
            bacterial cytoplasm --- Certainty = 0.0084(Affirmative) < succ>
            bacterial membrane  --- Certainty = 0.0000(Not Clear)   < succ>
             bacterial outside  --- Certainty = 0.0000(Not Clear)   < succ>
RGD motif: 89-91
```

The protein has homology with the following sequences in the databases:

```
>GP: BAB05167 GB: AP001512 peptide methionine sulfoxide reductase
[Bacillus halodurans]
Identities = 98/168 (58%), Positives = 125/168 (74%), Gaps = 4/168 (2%)

Query:    4 AIFAGGCFWCMVQPFEEQAGILSVRSGYTGGHLPNPSYEQVCAKTTGHTEAVEIIFDPKQ    63
            A FAGGCFWCMV PFEE+ GI  V SGYTGGH  NP+Y++VC++TTGH EAV+I FDP+
Sbjct:    9 ATFAGGCFWCMVSPFEEEPGIHQVVSGYTGGHTENPTYKEVCSETTGHYEAVQISFDPEV   68

Query:   64 IAYKDLVELYWTQTDPTDAFGQFEDRGDNYRPVIYYTTERQKEIAEQSKANLQASGRFDQ   123
            Y+ L+E+YWTQ DPTD  GQF DRGD+YR  I+Y  E+QK+ A+ SK  L+ SG+F+
Sbjct:   69 FPYEKLLEIYWTQIDPTDPGGQFHDRGDSYRTAIFYHDEQQKQAADASKQKLEESGKFNA  128

Query:  124 PIVTTIEPAEPFYLAEDYHQGFYKKNP---KRYAQSSAIRHQFLEENW              168
            PIVT I PA+PFY AE+YHQ ++KKNP   K Y   S  R F++++W
Sbjct:  129 PIVTRILPAKPFYPAEEYHQKYHKKNPFHYKMYRHGSG-REAFIKQHW              175
```

An alignment of the GAS and GBS proteins is shown below:

```
Identities = 130/168 (77%), Positives = 148/168 (87%)

Query:   17 MERAIFAGGCFWCMVQPFEELDGIESVLSGYTGGHVENPTYKEVCSKTTGHTEAVEIIFN    76
            MERAIFAGGCFWCMVQPFEE  GI SV SGYTGGH+ NP+Y++VC+KTTGHTEAVEIIF+
Sbjct:    1 MERAIFAGGCFWCMVQPFEEQAGILSVRSGYTGGHLPNPSYEQVCAKTTGHTEAVEIIFD   60

Query:   77 PEKISYADLVELYWAQTDPTDAFGQFEDRGDNYRPVIFYENEEQRQIAQKSKDKLQASGR   136
            P++I+Y DLVELYW QTDPTDAFGQFEDRGDNYRPVI+Y  E Q++IA++SK  LQASGR
Sbjct:   61 PKQIAYKDLVELYWTQTDPTDAFGQFEDRGDNYRPVIYYTTERQKEIAEQSKANLQASGR  120

Query:  137 FDRPIVTSIEPADTFYPAEDYHQAFYRTNPARYALSSARRHAFLEENW              184
            FD+PIVT+IEPA+ FY AEDYHQ FY+ NP RYA SSA RH FLEENW
Sbjct:  121 FDQPIVTTIEPAEPFYLAEDYHQGFYKKNPKRYAQSSAIRHQFLEENW              168
```

Based on this analysis, it was predicted that these proteins and their epitopes could be useful antigens for vaccines or diagnostics.

EXAMPLE 31

A DNA sequence (GBSx0029) was identified in *S. agalactiae* <SEQ ID 95> which encodes the amino acid sequence <SEQ ID 96>. Analysis of this protein sequence reveals the following:

```
Possible site: 55
>>> Seems to have no N-terminal signal sequence

----- Final Results -----
           bacterial cytoplasm --- Certainty = 0.2727(Affirmative) < succ>
           bacterial membrane  --- Certainty = 0.0000(Not Clear)   < succ>
           bacterial outside   --- Certainty = 0.0000(Not Clear)   < succ>
```

The protein has homology with the following sequences in the GENPEPT database:

```
>GP: CAB13859 GB: Z99114 yozE [Bacillus subtilis]
Identities = 24/66 (36%), Positives = 42/66 (63%)

Query:    3 KSFYSWLMTQRNPKSNEPVAILADYAFDETTFPKHSSDFETVSRYLEDEASFSFNLTDFD    62
            KSFY +L+  R+PK  + ++  A+ A+++ +FPK S+D+  +S YLE  A +    + FD
Sbjct:    2 KSFYHYLLKYRHPKPKDSISEFANQAYEDHSFPKTSTDYHEISSYLELNADYLHTMATFD   61

Query:   63 DIWEDY   68
            + W+ Y
Sbjct:   62 EAWDQY   67
```

A related DNA sequence was identified in *S. pyogenes* <SEQ ID 97> which encodes the amino acid sequence <SEQ ID 98>. Analysis of this protein sequence reveals the following:

```
Possible site: 57
>>> Seems to have no N-terminal signal sequence

----- Final Results -----
            bacterial cytoplasm --- Certainty = 0.2571(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below:

```
Identities = 59/71 (83%), Positives = 65/71 (91%)

Query:  1 MRKSFYSWLMTQRNPKSNEPVAILADYAFDETTFPKHSSDFETVSRYLEDEASFSFNLTD  60
          MRKSFYSWLMTQRNPKSNEPVAILAD  FD+TTFPKH++DFE +SRYLED+ASFSFNL
Sbjct:  3 MRKSFYSWLMTQRNPKSNEPVAILADLVFDDTTFPKHTNDFELISRYLEDQASFSFNLGQ  62

Query: 61 FDDIWEDYLNH                                                  71
          FD+IWEDYL H
Sbjct: 63 FDEIWEDYLAH                                                  73
```

Based on this analysis, it was predicted that these proteins and their epitopes could be useful antigens for vaccines or diagnostics.

EXAMPLE 32

A DNA sequence (GBSx0030) was identified in *S. agalactiae* <SEQ ID 99> which encodes the amino acid sequence <SEQ ID 100>. This protein is predicted to be antigen, 67 kDa (myosin-crossreactive). Analysis of this protein sequence reveals the following:

```
Possible site: 14
>>> Seems to have no N-terminal signal sequence
     INTEGRAL    Likelihood = -4.57     Transmembrane    28-44 (26-45)

----- Final Results -----
             bacterial membrane --- Certainty = 0.2826(Affirmative) < succ>
              bacterial outside --- Certainty = 0.0000(Not Clear)   < succ>
            bacterial cytoplasm --- Certainty = 0.0000(Not Clear)   < succ>
```

A related DNA sequence was identified in *S. pyogenes* <SEQ ID 101> which encodes the amino acid sequence <SEQ ID 102>. Analysis of this protein sequence reveals the following:

```
Possible site: 26
>>> Seems to have an uncleavable N-term signal seq
     INTEGRAL    Likelihood = -4.62     Transmembrane    40-56 (38-57)

----- Final Results -----
             bacterial membrane --- Certainty = 0.2848(Affirmative) < succ>
              bacterial outside --- Certainty = 0.0000(Not Clear)   < succ>
            bacterial cytoplasm --- Certainty = 0.0000(Not Clear)   < succ>
```

A related sequence was also identified in GAS <SEQ ID 9109> which encodes the amino acid sequence <SEQ ID 9110>. Analysis of this protein sequence reveals the following:

```
Possible cleavage site: 50
>>> Seems to have no N-terminal signal sequence

----- Final Results -----
             bacterial membrane --- Certainty = 0.285(Affirmative) < succ>
              bacterial outside --- Certainty = 0.000(Not Clear)   < succ>
            bacterial cytoplasm --- Certainty = 0.000(Not Clear)   < succ>
```

An alignment of the GAS and GBS proteins is shown below:

```
Identities = 477/590 (80%), Positives = 542/590 (91%)

Query:    3 MRYTNGNFEAFARPRKPEGVDKKSAYIVGSGLAGLAAAVFLIRDGQMDGQRIHIFEELPL   62
            M YT+GN+EAFA PRKPEGVD+KSAYIVG+GLAGLAAAVFLIRDG M G+RIH+FEELPL
Sbjct:   15 MYYTSGNYEAFATPRKPEGVDQKSAYIVGTGLAGLAAAVFLIRDGHMAGERIHLFEELPL   74

Query:   63 SGGSLDGVKRPDIGFVTRGGREMENHFECMWDMYRSIPSLEVPDASYLDEFYWLDKDDPN  122
            +GGSLDG+++P +GFVTRGGREMENHFECMWDMYRSIPSLE+P ASYLDEFYWLDKDDPN
Sbjct:   75 AGGSLDGIEKPHLGFVTRGGREMENHFECMWDMYRSIPSLEIPGASYLDEFYWLDKDDPN  134

Query:  123 SSNCRLIHKQGNRLESDGDFTLGTHSKELVKLVMETEESLGAKTIEEVFSKEFFESNFWT  182
            SSNCRLIHK+GNR++ DG +TLG  SKEL+ L+M+TEESLG +TIEE FS++FF+SNFW
Sbjct:  135 SSNCRLIHKRGNRVDDDGQYTLGKQSKELIHLIMKTEESLGDQTIEEFFSEDFFKSNFWV  194

Query:  183 YWGTMFAFEKWHSAIEMRRYAMRFIHHIGGLPDFTSLKFNKYNQYDSMVKPIISYLESHN  242
            YW TMFAFEKWHSA+EMRRYAMRFIHHI GLPDFTSLKFNKYNQYDSMVKPII+YLESH+
Sbjct:  195 YWATMFAFEKWHSAVEMRRYAMRFIHHIDGLPDFTSLKFNKYNQYDSMVKPIIAYLESHD  254

Query:  243 VDVQFDSKVTNISVDFKNGQKLAKAIHLTVGGEAKTIDLTPNDFVFVTNGSITESTNYGS  302
            VD+QFD+KVT+I V+   G+K+AK IH+TV GEAK I+LTP+D VFVTNGSITES+ YGS
Sbjct:  255 VDIQFDTKVTDIQVEQTAGKKVAKTIHMTVSGEAKAIELTPDDLVFVTNGSITESSTYGS  314

Query:  303 HDTVAKPNTDLGGSWNLWENLAAQSDEFGHPKVFYKDIPKESWFVSATATIKDPAIEPYI  362
            H  VAKP   LGGSWNLWENLAAQSD+FGHPKVFY+D+P ESWFVSATATIK PAIEPYI
Sbjct:  315 HHEVAKPTKALGGSWNLWENLAAQSDDFGHPKVFYQDLPAESWFVSATATIKHPAIEPYI  374

Query:  363 ERLTHRDLHDGKVNTGGIVTVTDSNWMMSFAIHRQPHFKEQKENETIVWIYGLYSNVEGN  422
            ERLTHRDLHDGKVNTGGI+T+TDSNWMMSFAIHRQPHFKEQKENET VWIYGLYSN EGN
Sbjct:  375 ERLTHRDLHDGKVNTGGIITITDSNWMMSFAIHRQPHFKEQKENETTVWIYGLYSNSEGN  434

Query:  423 YIKKPIEECTGREITEEWLYHLGVPEMKIHDLSDKQYVSTVPVYMPYITSYFMPRVKGDR  482
            Y+ K IEECTG+EITEEWLYHLGVP  KI DL+ + Y++TVPVYMPYITSYFMPRVKGDR
Sbjct:  435 YVHKKIEECTGQEITEEWLYHLGVPVDKIKDLASQDYINTVPVYMPYITSYFMPRVKGDR  494

Query:  483 PDVIPQGSVNLAFIGNPAESPSRDTVFTTEYSIRTAMEAVYTFLNIERGVPEVFNSAFDI  542
            P VIP GSVNLAFIGNPAESPSRDTVFTTEYSIRTAMEAVY+FLN+ERG+PEVFNSA+DI
Sbjct:  495 PKVIPDGSVNLAFIGNPAESPSRDTVFTTEYSIRTAMEAVYSFLNVERGIPEVFNSAYDI  554

Query:  543 RVLLQSLYYLNDKKSVEDMDLPIPALMRKVGMKKIRGTYLEELLREAHLL           592
            R LL++ YYLNDKK+++DMDLPIPAL+ K+G KKI+ T++EELL++A+L+
Sbjct:  555 RELLKAFYYLNDKKAIKDMDLPIPALIEKIGHKKIKDTFIEELLKDANLM           604
```

A related GBS gene <SEQ ID 8475> and protein <SEQ ID 8476> were also identified. Analysis of this protein sequence reveals the following:

```
Lipop: Possible site: -1 Crend: 10
McG: Discrim Score: -19.82
GvH: Signal Score (-7.5): -1.16
     Possible site: 14
>>> Seems to have no N-terminal signal sequence
ALOM program count: 1 value: -4.57 threshold: 0.0
     INTEGRAL      Likelihood = -4.57    Transmembrane    26-42 (26-45)
     PERIPHERAL    Likelihood =  6.79    378
modified ALOM score: 1.41
*** Reasoning Step: 3

----- Final Results -----
            bacterial membrane  --- Certainty = 0.2826(Affirmative) < succ>
            bacterial outside   --- Certainty = 0.0000(Not Clear)   < succ>
            bacterial cytoplasm --- Certainty = 0.0000(Not Clear)
```

Figure 18:
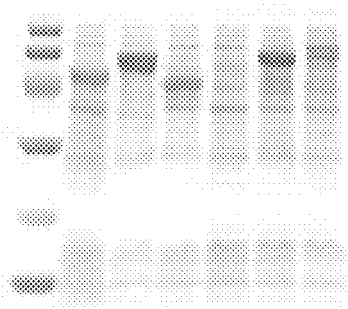

SEQ ID 8476 (GBS90) was expressed in *E. coli* as a His-fusion product. SDS-PAGE analysis of total cell extract is shown in FIG. 18 (lane 6; MW 68.5 kDa).

The GBS90-His fusion product was purified (FIG. 194, lane 11) and used to immunise mice. The resulting antiserum was used for Western blot (FIG. 256A), FACS (FIG. 256B), and in the in vivo passive protection assay (Table III). These tests confirm that the protein is immunoaccessible on GBS bacteria and that it is an effective protective immunogen.

Based on this analysis, it was predicted that these proteins and their epitopes could be useful antigens for vaccines or diagnostics.

EXAMPLE 33

A DNA sequence (GBSx0031) was identified in *S. agalactiae* <SEQ ID 103> which encodes the amino acid sequence <SEQ ID 104>. This protein is predicted to be phoh-like protein (phoH). Analysis of this protein sequence reveals the following:

```
Possible site: 38
>>> Seems to have no N-terminal signal sequence

----- Final Results -----
             bacterial cytoplasm --- Certainty = 0.2339(Affirmative) < succ>
              bacterial membrane --- Certainty = 0.0000(Not Clear)   < succ>
                bacterial outside --- Certainty = 0.0000(Not Clear)  < succ>
```

The protein has homology with the following sequences in the GENPEPT database:

```
>GP: CAB14476 GB: Z99117 phosphate starvation-induced protein
[Bacillus subtilis]
Identities = 191/305 (62%), Positives = 241/305 (78%), Gaps = 1/305 (0%)

Query:  27 LQHPDDMMSLFGSNERHLKLIEENLDVIIHARTERVQVLGDSEEAVETARLTIEALLVLV    86
           L++PD+ +SLFG+ +  LKL+E++L++ I  R E + V GD +E+ + A   + +LL L+
Sbjct:  12 LKNPDEALSLFGNQDSFLKLMEKDLNLNIITRGETIYVSGD-DESFQIADRLLGSLLALI   70

Query:  87 NRGMTVNTSDVVTALSMAQNGSIDKFVALYEEEIIKDSYGKPIRVKTLGQKIYVDSVKNH   146
            +G+ ++   DV+ A+ MA+   ++ F ++YEEEI K++ GK IRVKT+GQ+ YV ++K +
Sbjct:  71 RKGIEISERDVIYAIKMAKKNELEYFESMYEEEITKNAKGKSIRVKTMGQREYVAAMKRN  130

Query: 147 DVVFGIGPAGTGKTFLAVTLAVTALKRGQVKRIILTRPAVEAGESLGFLPGDLKEKVDPY   206
           D+VFGIGPAGTGKT+LAV  AV ALK G +K+IILTRPAVEAGESLGFLPGDLKEKVDPY
Sbjct: 131 DLVFGIGPAGTGKTYLAVVKAVHALKNGHIKKIILTRPAVEAGESLGFLPGDLKEKVDPY  190

Query: 207 LRPVYDALYQILGKEQTSRLMEREIIEIAPLAYMRGRTLDDAFVILDEAQNTTIMQMKMF   266
           LRP+YDAL+ +LG + T RLMER IIEIAPLAYMRGRTLDDA+VILDEAQNTT  QMKMF
Sbjct: 191 LRPLYDALHDVLGADHTERLMERGIIEIAPLAYMRGRTLDDAYVILDEAQNTTPAQMKMF  250

Query: 267 LTRLGFNSKMIVNGDVSQIDLPKNVKSGLIDAVEKLRNIKKIDFIHLSAKDVVRHPVVAE   326
           LTRLGF+SKMI+ GDVSQIDLPK VKSGL A E L+ I  I L   DVVRHP+VA+
Sbjct: 251 LTRLGFSSKMIITGDVSQIDLPKGVKSGLAVAKEMLKGIDGISMIELDQTDVVRHPLVAK  310

Query: 327 IINAY   331
           II AY
Sbjct: 311 IIEAY   315
```

A related DNA sequence was identified in *S. pyogenes* <SEQ ID 105> which encodes the amino acid sequence <SEQ ID 106>. Analysis of this protein sequence reveals the following:

```
Possible site: 42
>>> Seems to have no N-terminal signal sequence
    INTEGRAL     Likelihood = -0.85    Transmembrane     54-70 (54-70)

----- Final Results -----
             bacterial membrane --- Certainty = 0.1341(Affirmative) < succ>
              bacterial outside --- Certainty = 0.0000(Not Clear)   < succ>
            bacterial cytoplasm --- Certainty = 0.0000(Not Clear)   < succ>
```

An alignment of the GAS and GBS proteins is shown below:

```
Identities = 274/322 (85%), Positives = 298/322 (92%)

Query:  18 LQEYSIEITLQHPDDMMSLFGSNERHLKLIEENLDVIIHARTERVQVLGDSEEAVETARL    77
           LQEYSI+ITL HPDD+++LFGSNERHLKLIE +L VI+HARTERVQV+GD EEAVE ARL
Sbjct:   1 LQEYSIDITLTHPDDVLALFGSNERHLKLIEAHLGVIVHARTERVQVIGDDEEAVELARL   60

Query:  78 TIEALLVLVNRGMTVNTSDVVTALSMAQNGSIDKFVALYEEEIIKDSYGKPIRVKTLGQK   137
           TI+ALLVLV RGM VNTSDVVTALSMA++  ID+F+ALYEEEIIKD+YGK IRVKTLGQK
Sbjct:  61 TIKALLVLVGRGMVVNTSDVVTALSMAESHQIDQFMALYEEEIIKDNYGKAIRVKTLGQK  120

Query: 138 IYVDSVKNHDVVFGIGPAGTGKTFLAVTLAVTALKRGQVKRIILTRPAVEAGESLGFLPG   197
            YVDSVK HDVVFG+GPAGTGKTFLAVTLAVTALKRGQVKRIILTRPAVEAGESLGFLPG
Sbjct: 121 TYVDSVKRHDVVFGVGPAGTGKTFLAVTLAVTALKRGQVKRIILTRPAVEAGESLGFLPG  180

Query: 198 DLKEKVDPYLRPVYDALYQILGKEQTSRLMEREIIEIAPLAYMRGRTLDDAFVILDEAQN   257
           DLKEKVDPYLRPVYDALY ILGKEQT+RLMER++IEIAPLAYMRGRTLDDAFVILDEAQN
Sbjct: 181 DLKEKVDPYLRPVYDALYHILGKEQTTRLMERDVIEIAPLAYMRGRTLDDAFVILDEAQN  240
```

-continued

```
Query:  258 TTIMQMKMFLTRLGFNSKMIVNGDVSQIDLPKNVKSGLIDAVEKLRNIKKIDFIHLSAKD  317
            TTIMQMKMFLTRLGFNSKMIVNGD SQIDLP+NVKSGLIDA +KL+ IK+IDF++ SAKD
Sbjct:  241 TTIMQMKMFLTRLGFNSKMIVNGDTSQIDLPRNVKSGLIDATQKLQGIKQIDFVYFSAKD  300

Query:  318 VVRHPVVAEIINAYSDSESSHK  339
            VVRHPVVA+II AY  S    K
Sbjct:  301 VVRHPVVADIIKAYETSSEEMMK  322
```

Based on this analysis, it was predicted that these proteins and their epitopes could be useful antigens for vaccines or diagnostics.

EXAMPLE 34

A DNA sequence (GBSx0032) was identified in *S. agalactiae* <SEQ ID 107> which encodes the amino acid sequence <SEQ ID 108>. Analysis of this protein sequence reveals the following:

```
Possible site: 30
>>> Seems to have no N-terminal signal sequence

----- Final Results -----
          bacterial cytoplasm --- Certainty = 0.0275(Affirmative) < succ>
          bacterial membrane  --- Certainty = 0.0000(Not Clear)   < succ>
           bacterial outside  --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 35

A DNA sequence (GBSx0033) was identified in *S. agalactiae* <SEQ ID 109> which encodes the amino acid sequence <SEQ ID 110>. This protein is predicted to be MutT/nudix family protein. Analysis of this protein sequence reveals the following:

```
Possible site: 46
>>> Seems to have no N-terminal signal sequence

----- Final Results -----
          bacterial cytoplasm --- Certainty = 0.2383(Affirmative) < succ>
          bacterial membrane  --- Certainty = 0.0000(Not Clear)   < succ>
           bacterial outside  --- Certainty = 0.0000(Not Clear)   < succ>
```

The protein has homology with the following sequences in the GENPEPT database:

```
>Gp: AAF09597 GB: AE001864 MutT/nudix family
protein [Deinococcus radiodurans]
Identities = 49/136 (36%), Positives = 69/136 (50%), Gaps = 8/136 (5%)

Query:    5 YISYIRSKVGHETIFLTYSGGILTDGKGRVLLQLRADKNSWGIIGGCMELGESSVDTLKR   64
            Y+S +R+  GH +         +L D GRVLLQ R D   WGI+GG +E GE  +    R
Sbjct:    6 YLSELRAVWGHRALPAAGVSVLLQDETGRVLLQRRGDDGQWGILGGGLEPGEDFLIAAHR   65

Query:   65 EFFEETGLRVEPIRLLNVY------TNFQDSYPNGDKAQTVGFIYEVSCPKPVNIEGFHN  118
            E  EETGLR  +R L +               F   YPNGD+   VG  E + P  +  +
Sbjct:   66 ELLEETGLRCPNLRPLPLSEGLVSGPQFWHRYPNGDEVYLVGLRTEGTVPAAALTDACPD  125

Query:  119 E--ETLQLDYFSKEDV  132
            +   ETL+L +F+ +D+
Sbjct:  126 DGGETLELRWFALDDL  141
```

A related DNA sequence was identified in *S. pyogenes* <SEQ ID 111> which encodes the amino acid sequence <SEQ ID 112>. Analysis of this protein sequence reveals the following:

```
Possible site: 61
>>> Seems to have no N-terminal signal sequence

----- Final Results -----
            bacterial cytoplasm --- Certainty = 0.4375(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below:

```
Identities = 93/157 (59%), Positives = 123/157 (78%)

Query:    1 MKQDYISYIRSKVGHETIFLTYSGGILTDGKGRVLLQLRADKNSWGIIGGCMELGESSVD   60
            M QDYISYIRSKVGH+ I L ++GGILT+  G+VL+QLR DK +W I GG MELGESS++
Sbjct:   16 MPQDYISYIRSKVGHDKIILNFAGGILTNDDGKVLMQLRGDKKTWTIPGGTMELGESSLE   75

Query:   61 TLKREFFEETGLRVEPIRLLNVYTNFQDSYPNGDKAQTVGFIYEVSCPKPVNIEGFHNEE  120
            T KREF EETG+ VE +RLLNVYT+F++ YPNGD  QT+ FIYE++    + I+ FHNEE
Sbjct:   76 TCKREFLEETGIEVEAVRLLNVYTHFEEVYPNGDAVQTIVFIYELTAVSDMAIDNFHNEE  135

Query:  121 TLQLDYFSKEDVKNITIVNEQHQLILDEYFSQTFQMG                        157
            TL+L +FS E++   + V+ +H+L+L+EYFS +F MG
Sbjct:  136 TLKLQFFSHEEIAELESVSAKHRLMLEEYFSDSFAMG                        172
```

Based on this analysis, it was predicted that these proteins and their epitopes could be useful antigens for vaccines or diagnostics.

EXAMPLE 36

A DNA sequence (GBSx0034) was identified in *S. agalactiae* <SEQ ID 113> which encodes the amino acid sequence <SEQ ID 114>. Analysis of this protein sequence reveals the following:

```
Possible site: 13
>>> Seems to have no N-terminal signal sequence

----- Final Results -----
            bacterial cytoplasm --- Certainty = 0.3690 (Affirmative) < succ>
             bacterial membrane --- Certainty = 0.0000 (Not Clear)   < succ>
              bacterial outside --- Certainty = 0.0000 (Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 37

A DNA sequence (GBSx0035) was identified in *S. agalactiae* <SEQ ID 115> which encodes the amino acid sequence <SEQ ID 116>. Analysis of this protein sequence reveals the following:

```
Possible site: 25
>>> Seems to have a cleavable N-term signal seq.

----- Final Results -----
              bacterial outside --- Certainty = 0.3000 (Affirmative) < succ>
             bacterial membrane --- Certainty = 0.0000 (Not Clear)   < succ>
            bacterial cytoplasm --- Certainty = 0.0000 (Not Clear)   < succ>
```

The protein has homology with the following sequences in the GENPEPT database:

```
>GP:AAG05249 GB:AE004612 hypothetical protein [Pseudomonas aeruginosa]
Identities = 70/254 (27%), Positives = 127/254 (49%), Gaps = 2/254 (0%)

Query:    2 KITLHGVAETLLITLYIRAKDAMAKHPILNDQKSLAIVEQIEYDFDKFDNSEASFYATLA   61
            +ITL G +TLLITLY +A D+       IL+D+ +   V QI++DF +    + + A
Sbjct:    5 RITLTGEKQTLLITLYAKALDSRLDDSILHDRFAEEAVRQIDFDFSRVALGKGNERALAM   64

Query:   62 RIRVMDREIKKFIRENPNSQILSIGCGLDTRFERVD-NGQIRWYNLDLPEVMEIRKLFFE  120
            R    D+  ++F+  +P  Q+L++GCGLD+R   RVD    ++  W++LD  PEVM++R+  +
Sbjct:   65 RSHYFDQACREFLGRHPEGQVLNLGCGLDSRIYRVDPPAELPWFDLDYPEVMDLRERLYP  124

Query:  121 EHERVTNIAKSALDETWTREVNPQNAPFLIVSEGVLMFLKEDDVETFLHILTNSFSQFMA  180
            + ++D+    +  P+   P  L+++EG++ +L+E   V    +   L +
Sbjct:  125 PRAGAYRALRHSVDDDGWLQGVPRERPALVLAEGLMPYLRESQVRRLVERLVDHLGSGEL  184

Query:  181 QFDLCHKEMINKGKQHDTVKYMDTEFQFGITDGHEIVDLDPKLKQINLINFTDEMSKFEL  240
             FD    + I   + + ++    +     + I D   E+      P L+ I     +  D     +L
Sbjct:  185 LFDGYGRLGIMLLRLYPPLRETGAQVHWSIDDPRELERWHPALRFIEEVTDYDPQDVAKL  244

Query:  241 -GTLRSLLPTIRKF                                              253
             + R +LP     F
Sbjct:  245 PQSSRLMLPIYNGF                                               258
```

No corresponding DNA sequence was identified in *S. pyogenes*.

A related GBS gene <SEQ ID 8477> and protein <SEQ ID 8478> were also identified. Analysis of this protein sequence reveals the following:

```
Lipop: Possible site: -1 Crend: 9
McG: Discrim Score: 0.37
GvH: Signal Score (-7.5): -0.97
Possible site: 25
>>> Seems to have a cleavable N-term signal seq.
ALOM program count: 0 value: 4.35 threshold: 0.0
PERIPHERAL Likelihood =  4.35       143
modified ALOM score: -1.37

*** Reasoning Step: 3

----- Final Results -----
            bacterial outside  --- Certainty = 0.3000 (Affirmative) < succ>
            bacterial membrane --- Certainty = 0.0000 (Not Clear) < succ>
            bacterial cytoplasm ---Certainty = 0.0000 (Not Clear) < succ>
```

The protein has homology with the following sequences in the databases:

```
27.6/51.6% over 253aa
Pseudomonas aeruginosa
GP|9947849| hypothetical protein Insert characterized ORF02096(304-1059 of 1404)
GP|9947849|gb|AAG05249.1|AE004612_3|AE004612(5-258 of 275) hypothetical protein
{Pseudomonas aeruginosa}
% Match = 11.6
% Identity = 27.6   % Similarity = 51.6
Matches = 70   Mismatches = 121   Conservative Sub.s = 61

255       285       315       345       375       405       435       465
E*YT*RNPVLEIQISK*NSIKESR*MKITLHGVAETLLITLYIRAKDAMAKHPILNDQKSLAIVEQIEYDFDKFDNSEAS
                          :||| |  :||||||| :| |:       ||:|:   |  ||:||  :  :
                         MPGHRITLTGEKQTLLITLYAKALDSRLDDSILHDRFAEEAVRQIDFDFSRVALGKGN
                              10        20        30        40        50
```

```
495       525       555       585       612       642       672       702
FYATLARXRVMDREIKKFIRENPNSQILSIGCGLDTRFERVDN-GQIRWYNLDLPEVMEIRKLFFEEHERVTNIAKSALD
 |    |     |:   ::|:   :|    |:|::|||||:|    |||    ::  |::||  ||||::|: ::          : ::|
ERALAMRSHYFDQACREFLGRHPEGQVLNLGCGLDSRIYRVDPPAELPWFDLDYPEVMDLRERLYPPRAGAYRALRHSVD
         70        80        90       100       110       120       130

732       762       792       822       852       882       912       942
ETWTREVNPQNAPFLIVSEGVLMFLKEDDVETFLHILTNSFSQFMAQFDLCHKEMINKGKQHDTVKYMDTEFQFGITDGH
 :    :   |:   |  |:::||::  :|:|    |    ::    |  :    ||   :  |    : :  ::        : ::   | |
DDGWLQGVPRERPALVLAEGLMPYLRESQVRRLVERLVDHLGSGELLFDGYGRLGIMLLRLYPPLRETGAQVHWSIDDPR
         150       160       170       180       190       200       210

972       1002      1029      1059      1089      1119      1149      1179
EIVDLDPKLKQINLINFTDEMSKFELG-TLRSLLPTIRKFNNCLGVYEYKASEKK*QKSIYIKRHSKCKFVIIVIAFVAL
|:      | |:   :    |       :|    :|   :|  :||       |     :
ELERWHPALRFIEEVTDYDPQDVAKLPQSSRLMLPIYNGFAFLRRMGRLIRYRWPRV
         230       240       250       260       270
```

SEQ ID 8478 (GBS176) was expressed in *E. coli* as a His-fusion product. SDS-PAGE analysis of total cell extract is shown in FIG. 36 (lane 5 & 6; MW 30 kDa). It was also expressed in *E. coli* as a GST-fusion product. SDS-PAGE analysis of total cell extract is shown in FIG. 41 (lane 7; MW 55.4 kDa).

The GBS176-GST fusion product was purified (FIG. 117A; see also FIG. 202, lane 5) and used to immunise mice (lane 1+2 product; 13.5 µg/mouse). The resulting antiserum was used for Western blot (FIG. 117B), FACS (FIG. 117C), and in the in vivo passive protection assay (Table III). These tests confirm that the protein is immunoaccessible on GBS bacteria and that it is an effective protective immunogen.

Based on this analysis, it was predicted that these proteins and their epitopes could be useful antigens for vaccines or diagnostics.

EXAMPLE 38

A DNA sequence (GBSx0036) was identified in *S. agalactiae* <SEQ ID 117> which encodes the amino acid sequence <SEQ ID 118>. Analysis of this protein sequence reveals the following:

```
Possible site: 32
>>> Seems to have no N-terminal signal sequence

----- Final Results -----
            bacterial cytoplasm --- Certainty = 0.3712(Affirmative) < succ>
            bacterial membrane  --- Certainty = 0.0000(Not Clear)   < succ>
            bacterial outside   --- Certainty = 0.0000(Not Clear)   < succ>
```

A related GBS nucleic acid sequence <SEQ ID 10019> which encodes amino acid sequence <SEQ ID 10020> was also identified.

The protein has homology with the following sequences in the GENPEPT database:

```
>GP: AAC38046 GB: AF000954 No definition line found [Streptococcus mutans]
Identities = 140/164 (85%), Positives = 157/164 (95%)

Query:    1 MYVEMIDETGQVSEDIKKQTLDLLEFAAQKTGKENKEMAVTFVTNERSHELNLEYRDTDR   60
            MY+EMIDET QVSE IK QTLD+LEFAAQKTGKE+KEMAVTFVTNERSHELNL+YRDT+R
Sbjct:    1 MYIEMIDETNQVSEGIKNQTLDILEFAAQKTGKEDKEMAVTFVTNERSHELNLKYRDTNR   60

Query:   61 PTDVISLEYKPEVDISFDEEDLAENPELAEMLEDFDSYIGELFISIDKAKEQAEEYGHSY  120
            PTDVISLEYKPE   +SFDEEDLA++P+LAE+L  +FD+YIGELFIS+DKA+EQA+EYGHS+
Sbjct:   61 PTDVISLEYKPESSLSFDEEDLADDPDLAEVLTEFDAYIGELFISVDKAREQAQEYGHSF  120

Query:  121 EREMGFLAVHGFLHINGYDHYTPEEEKEMFSLQEEILTAYGLKR                  164
            EREMGFLAVHGFLHINGYDHYTP+EEKEMFSLQEEIL AYGLKR
Sbjct:  121 EREMGFLAVHGFLHINGYDHYTPQEEKEMFSLQEEILDAYGLKR                  164
```

A related DNA sequence was identified in *S. pyogenes* <SEQ ID 119> which encodes the amino acid sequence <SEQ ID 120>. Analysis of this protein sequence reveals the following:

```
Possible site: 49
>>> Seems to have no N-terminal signal sequence

----- Final Results -----
            bacterial cytoplasm --- Certainty = 0.1145(Affirmative) < succ>
            bacterial membrane  --- Certainty = 0.0000(Not Clear)   < succ>
            bacterial outside   --- Certainty = 0.0000(Not Clear)   < succ>
```

An alignment of the GAS and GBS proteins is shown below:

```
Identities = 138/165 (83%), Positives = 153/165 (92%)

Query:    1 MYVEMIDETGQVSEDIKKQTLDLLEFAAQKTGKENKEMAVTFVTNERSHELNLEYRDTDR    60
            MY+EMIDETGQVS++I +QTLDLL FAAQKTGKE KEM+VTFVTNERSHELNLEYRDTDR
Sbjct:   18 MYIEMIDETGQVSQEIMEQTLDLLNFAAQKTGKEEKEMSVTFVTNERSHELNLEYRDTDR    77

Query:   61 PTDVISLEYKPEVDISFDEEDLAENPELAEMLEDFDSYIGELFISIDKAKEQAEEYGHSY   120
            PTDVISLEYKPE  I F +EDLA +P LAEM+ +FD+YIGELFISIDKA+EQ++EYGHS+
Sbjct:   78 PTDVISLEYKPETPILFSQEDLAADPSLAEMMAEFDAYIGELFISIDKAREQSQEYGHSF   137

Query:  121 EREMGFLAVHGFLHINGYDHYTPEEEKEMFSLQEEILTAYGLKRQ                 165
            EREMGFLAVHGFLHINGYDHYT EEEKEMF+LQEEILTAYGL RQ
Sbjct:  138 EREMGFLAVHGFLHINGYDHYTLEEEKEMFTLQEEILTAYGLTRQ                 182
```

Based on this analysis, it was predicted that these proteins and their epitopes could be useful antigens for vaccines or diagnostics.

EXAMPLE 39

A DNA sequence (GBSx0038) was identified in *S. agalactiae* <SEQ ID 121> which encodes the amino acid sequence <SEQ ID 122>. This protein is predicted to be phosphoglycerate dehydrogenase (serA) (serA). Analysis of this protein sequence reveals the following:

```
Possible site: 59
>>> Seems to have no N-terminal signal sequence

----- Final Results -----
            bacterial cytoplasm --- Certainty = 0.2817(Affirmative) < succ>
            bacterial membrane  --- Certainty = 0.0000(Not Clear)   < succ>
            bacterial outside   --- Certainty = 0.0000(Not Clear)   < succ>
```

The protein has homology with the following sequences in the GENPEPT database:

```
>GP:AAB99020 GB:U67544 phosphoglycerate dehydrogenase (serA)
[Methanococcus jannaschii]
Identities = 82/232 (35%), Positives = 132/232 (56%),
Gaps = 14/232 (6%)

Query:    3 ENPDAYIIRSQNLHNQDF---PSNLKAIARAGAGTNNIPIEEASAQGIVVFNTPGANANA    59
            ++ D  ++RS    +D       LK I RAG G +NI +E A+ +GI+V N P A++ +
Sbjct:   40 KDADVLVVRSGTKVTRDVIEKAEKLKVIGRAGVGVDNIDVEAATEKGIIVVNAPDASSIS    99

Query:   60 VKEAVIAALLLSARDYLGANRWVNTLTGTDIPKQIEAGKKAFAGNEIAGKKLGVIGLGAI   119
            V E + +L +AR         N  T   K+ E  +K F G E+ GK LGVIGLG I
Sbjct:  100 VAELTMGLMLAAAR---------NIPQATASLKRGEWDRKRFKGIELYGKTLGVIGLGRI   150

Query:  120 GARIANDARRLGMTVLGYDPYVSIETAWNISSHVQRVKEIKDIFETCDYITIHVPLTNET   179
            G ++    A+  GM ++GYDPY+  E A ++     V+ V +I ++ + D+IT+HVPLT +T
Sbjct:  151 GQQVVKRAKAFGMNIIGYDPYIPKEVAESMG--VELVDDINELCKRADFITLHVPLTPKT   208

Query:  180 KHTFDAKAFSIMKKGTTIINFARAELVNNQELFEAIETGVVKRYITDFGDKE           231
            +H  + ++MKK   I+N AR  L++ + L+EA++ G ++     D  ++E
Sbjct:  209 RHIIGREQIALMKKNAIIVNCARGGLIDEKALYEALKEGKIRAAALDVFEEE           260
```

A related DNA sequence was identified in *S. pyogenes* <SEQ ID 123> which encodes the amino acid sequence <SEQ ID 124>. Analysis of this protein sequence reveals the following:

```
Possible site: 52
>>> Seems to have no N-terminal signal sequence

----- Final Results -----
            bacterial cytoplasm --- Certainty = 0.2384(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below:

```
Identities = 52/198 (26%), Positives = 93/198 (46%), Gaps = 14/198 (7%)

Query:   24 LKAIARAGAGTNNIPIEEASAQGIVVFNTPGANANAVKEAVIAALLLSARDYLGANRWVN  83
            +K IA+  A +   ++ A+   I++ N P  +  ++ E  +  +L   R
Sbjct:   70 IKQIAQHSASVDMYNLDLATENDIIITNVPSYSPESIAEFTVTIVLNLIRHV--------  121

Query:   84 TLTGTDIPKQIEAGKKAFAGNEIAGKKLGVIGLGAIGARIANDARRLGMTVLGYDPYVSI  143
             L   ++ KQ          G +    ++IG G IG   A   +  G  V+GYD Y S
Sbjct:  122 ELIRENVKKQNFTWGLPIRGRVLGDMTVAIIGTGRIGLATAKIFKGFGCKVVGYDIYQS-  180

Query:  144 ETAWNISSHVQRVKE-IKDIFETCDYITIHVPLTNETKHTFDAKAFSIMKKGTTIINFAR  202
             + A  +  + V+E IKD        D +++H+P T E   H F++   F   KKG  ++N AR
Sbjct:  181 DAAKAVLDYKESVEEAIKD----ADLVSLHMPPTAENTHLFNSDLFKSFKKGAILMNMAR  236

Query:  203 AELVNNQELFEAIETGVV                                          220
            ++   Q+L +A++ G++
Sbjct:  237 GAVIETQDLLDALDAGLL                                          254
```

Based on this analysis, it was predicted that these proteins and their epitopes could be useful antigens for vaccines or diagnostics.

EXAMPLE 40

A DNA sequence (GBSx0039) was identified in *S. agalactiae* <SEQ ID 125> which encodes the amino acid sequence <SEQ ID 126>. This protein is predicted to be alpha-glycerophosphate oxidase. Analysis of this protein sequence reveals the following:

```
Possible site: 50
>>> Seems to have no N-terminal signal sequence

----- Final Results -----
            bacterial cytoplasm --- Certainty = 0.2067(Affirmative) < succ>
             bacterial membrane --- Certainty = 0.0000(Not Clear)   < succ>
              bacterial outside --- Certainty = 0.0000(Not Clear)   < succ>
```

The protein has homology with the following sequences in the GENPEPT database:

```
>GP:AAC34740 GB:U94770 alpha-glycerophosphate oxidase [Streptococcus pneumoniae]
Identities = 24/49 (48%), Positives = 37/49 (74%)

Query:    1 MLFMRDNLDSLIQPVIDEMAKHYQWSDQDKTFYEEELHETLKDNDLAAL            49
            MLFMRD+LDS+++PV+DEM + Y W++++K  Y  ++    L +NDLA L
Sbjct:  558 MLFMRDSLDSIVEPVLDEMGRFYDWTEEEKATYRADVEAALANNDLAEL           606
```

A related DNA sequence was identified in *S. pyogenes* <SEQ ID 127> which encodes the amino acid sequence <SEQ ID 128>. Analysis of this protein sequence reveals the following:

```
Possible site: 40
>>> Seems to have no N-terminal signal sequence
    INTEGRAL        Likelihood = -1.81    Transmembrane     20-36 (20-36)

----- Final Results -----
                 bacterial membrane --- Certainty = 0.1723(Affirmative) < succ>
                  bacterial outside --- Certainty = 0.0000(Not Clear)   < succ>
                bacterial cytoplasm --- Certainty = 0.0000(Not Clear)   < succ>
```

The protein has homology with the following sequences in the databases:

```
>GP: AAC34740 GB: U94770 alpha-glycerophosphate oxidase
[Streptococcus pneumonia]
Identities = 462/607 (76%), Positives = 539/607 (88%)

Query:    1 MEFSRETRRLALQKMQERDLDLLIIGGGITGAGVALQAAASGLDTGLIEMQDFAQGTSSR    60
            MEFS++TR L+++KMQER LDLLIIGGGITGAGVALQAAASGL+TGLIEMQDFA+GTSSR
Sbjct:    1 MEFSKKTRELSIKKMQERTLDLLIIGGGITGAGVALQAAASGLETGLIEMQDFAEGTSSR    60

Query:   61 STKLVHGGLRYLKQFDVEVVSDTVSERAVVQQIAPHIPKPDPMLLPVYDEPGSTFSMFRL   120
            STKLVHGGLRYLKQFDVEVVSDTVSERAVVQQIAPHIPKPDPMLLPVYDE G+TFS+FRL
Sbjct:   61 STKLVHGGLRYLKQFDVEVVSDTVSERAVVQQIAPHIPKPDPMLLPVYDEDGATFSLFRL   120

Query:  121 KVAMDLYDLLAGVSNTPAANKVLTKEEVLKREPDLKQEGLLGGGVYLDFRNNDARLVIEN   180
            KVAMDLYDLLAGVSNTP ANKVL+K++VL+R+P+LK+EGL+GGGVYLDFRNNDARLVIEN
Sbjct:  121 KVAMDLYDLLAGVSNTPTANKVLSKDQVLERQPNLKKEGLVGGGVYLDFRNNDARLVIEN   180

Query:  181 IKRANRDGALIASHVKAEDFLLDDNGKIIGVKARDLLSDQEIIIKAKLVINTTGPWSDEI   240
            IKRAN+DGALIA+HVKAE FL D++GKI GV ARDLL+DQ  IKA+LVINTTGPWSD++
Sbjct:  181 IKRANQDGALIANHVKAEGFLFDESGKITGVVARDLLTDQVFEIKARLVINTTGPWSDKV   240

Query:  241 RQFSHKGQPIHQMRPTKGVHLVVDRQKLPVSQPVYVDTGLNDGRMVFVLPREEKTYFGTT   300
              R  S+KG   QMRPTKGVHLVVD  K+ VSQPVY DTGL DGRMVFVLPRE KTYFGTT
Sbjct:  241 RNLSNKGTQFSQMRPTKGVHLVVDSSKIKVSQPVYFDTGLGDGRMVFVLPRENKTYFGTT   300

Query:  301 DTDYTGDLEHPQVTQEDVDYLLGVVNNRFPNANVTIDDIESSWAGLRPLLSGNSASDYNG   360
            DTDYTGDLEHP+VTQEDVDYLLG+VNNRFP +N+TIDDIESSWAGLRPL++GNSASDYNG
Sbjct:  301 DTDYTGDLEHPKVTQEDVDYLLGIVNNRFPESNITIDDIESSWAGLRPLIAGNSASDYNG   360

Query:  361 GNSGKVSDDSFDHLVDTVKAYINHEDSREAVEKAIKQVETSTSEKELDPSAVSRGSSFER   420
            GN+G +SD+SFD+L+ TV++Y++ E +RE VE A+ ++E+STSEK LDPSAVSRGSS +R
Sbjct:  361 GNNGTISDESFDNLIATVESYLSKEKTREDVESAVSKLESSTSEKHLDPSAVSRGSSLDR   420

Query:  421 DENGLFTLAGGKITDYRKMAEGALTGIIQILKEEFGKSFKLINSKTYPVSGGEINPANVD   480
            D+NGL TLAGGKITDYRKMAEGA+  ++ ILK EF +SFKLINSKTYPVSGGE+NPANVD
Sbjct:  421 DDNGLLTLAGGKITDYRKMAEGAMERVVDILKAEFDRSFKLINSKTYPVSGGELNPANVD   480

Query:  481 SEIEAYAQLGTLSGLSMDDARYLANLYGSNAPKVFALTRQLTAAEGLSLAETLSLHYAMD   540
            SEIEA+AQLG   GL  +A YLANLYGSNAPKVFAL   L A GLSLA+TLSLHYAM
Sbjct:  481 SEIEAFAQLGVSRGLDSKEAHYLANLYGSNAPKVFALAHSLEQAPGLSLADTLSLHYAMR   540

Query:  541 YEMALKPTDYFLRRTNHLLFMRDSLDALIDPVINEMAKHFEWSDQERVAQEDDLRRVIAD   600
            E+AL P D+ LRRTNH+LFMRDSLD++++PV++EM  ++W+++E+    D+    +A+
Sbjct:  541 NELALSPVDFLLRRTNHMLFMRDSLDSIVEPVLDEMGRFYDWTEEEKATYRADVEAALAN   600

Query:  601 NDLSALK                                                        607
            NDL+ LK
Sbjct:  601 NDLAELK                                                        607
```

An alignment of the GAS and GBS proteins is shown below:

```
Identities = 29/49 (59%), Positives = 41/49 (83%)

Query:    1 MLFMRDNLDSLIQPVIDEMAKHYQWSDQDKTFYEEELHETLKDNDLAAL   49
            +LFMRD+LD+LI PVI+EMAKH++WSDQ++   E++L   + DNDL+AL
Sbjct:  558 LLFMRDSLDALIDPVINEMAKHFEWSDQERVAQEDDLRRVIADNDLSAL   606
```

Based on this analysis, it was predicted that these proteins and their epitopes could be useful antigens for vaccines or diagnostics.

EXAMPLE 41

A DNA sequence (GBSx0040) was identified in *S. agalactiae* <SEQ ID 129> which encodes the amino acid sequence <SEQ ID 130>. Analysis of this protein sequence reveals the following:

```
Possible site: 40
>>> Seems to have no N-terminal signal sequence

----- Final Results -----
             bacterial cytoplasm --- Certainty = 0.1011(Affirmative) < succ>
              bacterial membrane --- Certainty = 0.0000(Not Clear) < succ>
               bacterial outside --- Certainty = 0.0000(Not Clear) < succ>
```

The protein has homology with the following sequences in the GENPEPT database:

```
>GP: BAB06309 GB: AP001516 unknown conserved protein [Bacillus halodurans]
Identities = 70/160 (43%), Positives = 106/160 (65%), Gaps = 3/160 (1%)

Query:    5 TRPTTDKVKGAIFNMIGPFFEGGRVLDLFSGSGSLAIEAISRGMDQAVLVEKDRRAQVVI    64
            TRPTTDKVK AIFNMIGPFF+GG  LDL+ GSG L IEA+SRG+++ + V++ +RA    I
Sbjct:   21 TRPTTDKVKEAIFNMIGPFFDGGIGLDLYGGSGGLGIEALSRGVERMIFVDQQKRAIETI    80

Query:   65 QENIAMTKSPEQFQLLKMEANRALEQLTGQ---FDLVLLDPPYAKEEIVKQIQIMDSKGL   121
            ++N++      + ++ + +A RAL+ LT +    F  V LDPPYAK+ I   + I+ + GL
Sbjct:   81 KQNLSHCGLEGRAEVYRNDAKRALQVLTKRGIVFAYVFLDPPYAKQTIKNDLAILANHGL   140

Query:  122 LGDDIMIACETDKSVDLPEEIASFGIWKQKIYGISKVTVY                      161
            L +  ++ CE D+    LP++I     K++ YG + +T+Y
Sbjct:  141 LEEGGVVVCEHDRDTMLPDQIEYAVKHKEETYGDTMITIY                      180
```

A related DNA sequence was identified in *S. pyogenes* <SEQ ID 131> which encodes the amino acid sequence <SEQ ID 132>. Analysis of this protein sequence reveals the following:

```
Possible site: 58
>>> Seems to have no N-terminal signal sequence

----- Final Results -----
             bacterial cytoplasm --- Certainty = 0.3814(Affirmative) < succ>
              bacterial membrane --- Certainty = 0.0000(Not Clear) < succ>
               bacterial outside --- Certainty = 0.0000(Not Clear) < succ>
```

An alignment of the GAS and GBS proteins is shown below:

```
Identities = 111/160 (69%), Positives = 136/160 (84%)

Query:    3 RTTRPTTDKVKGAIFNMIGPFFEGGRVLDLFSGSGSLAIEAISRGMDQAVLVEKDRRAQV    62
            + TRPT+DKV+GAIFNMIGP+F GGRVLDLF+GSG LAIEA+SRGM  AVLVEK+R+AQ
Sbjct:   19 KITRPTSDKVRGAIFNMIGPYFNGGRVLDLFAGSGGLAIEAVSRGMSAAVLVEKNRKAQA    78

Query:   63 VIQENIAMTKSPEQFQLLKMEANRALEQLTGQFDLVLLDPPYAKEEIVKQIQIMDSKGLL   122
            +IQ+NI MTK+  +F LLKMEA RA++ LTG+FDLV LDPPYAKE IV + + +K LL
Sbjct:   79 IIQDNIIMTKAENRFTLLKMEAERAIDCLTGRFDLVFLDPPYAKETIVATIEALAAKNLL   138

Query:  123 GDDIMIACETDKSVDLPEEIASFGIWKQKIYGISKVTVYV                      162
            + +M+ CETDK+V LP+EIA+ GIWK+KIYGISKVTVYV
Sbjct:  139 SEQVMVVCETDKTVLLPKEIATLGIWKEKIYGISKVTVYV                      178
```

Based on this analysis, it was predicted that these proteins and their epitopes could be useful antigens for vaccines or diagnostics.

EXAMPLE 42

A DNA sequence (GBSx0041) was identified in *S. agalactiae* <SEQ ID 133> which encodes the amino acid sequence <SEQ ID 134>. This protein is predicted to be lipopolysaccharide core biosynthesis protein kdtB (kdtB). Analysis of this protein sequence reveals the following:

```
Possible site: 17
>>> Seems to have no N-terminal signal sequence

----- Final Results -----
            bacterial cytoplasm --- Certainty = 0.1937(Affirmative) < succ>
            bacterial membrane  --- Certainty = 0.0000(Not Clear)   < succ>
            bacterial outside   --- Certainty = 0.0000(Not Clear)   < succ>
```

The protein has homology with the following sequences in the GENPEPT database:

```
>GP:BAB13272 GB:AP001119 lipopolysaccharide core biosynthesis
protein kdtB [Buchnera sp. APS]
Identities = 56/149 (37%), Positives = 94/149 (62%)

Query:   1 MTKKALFTGSFDPVTNGHLDIIERASYLFDHVYIGLFYNLEKQGYFSIECRKKMLEEAIR   60
           M K A++ G+FDP+T GHLDII RA+ +FD + I +  N  K+  F+++ R ++   +
Sbjct:   1 MNKTAIYPGTFDPITYGHLDIITRATKIFDSITIAISNNFTKKPIFNLKERIELTRKVTL  60

Query:  61 QFKNVSVLVAQDRLAVDLAREVGAKYFVRGLRNSQDFDYEANLEFFNKQLADDIETVYLS 120
              KNV ++  + L +LA++ A   +RG+R   DFDYE  L   NKQ+ D+++++L
Sbjct:  61 HLKNVKKILGFNDLLANLAKKEKANILIRGVRTIFDFDYEIKLAAINKQIYPDLDSIFLL 120

Query: 121 TSPSLSPISSSRIRELIHFKASVKPFVPK                                149
           +S  +S ISSS ++E+  +K  +KP++PK
Sbjct: 121 SSKEVSFISSSFVKEIAKYKGDIKPYLPK                                149
```

A related DNA sequence was identified in *S. pyogenes* <SEQ ID 135> which encodes the amino acid sequence <SEQ ID 136>. Analysis of this protein sequence reveals the following:

```
Possible site: 61
>>> Seems to have no N-terminal signal sequence

----- Final Results -----
            bacterial cytoplasm --- Certainty = 0.1862(Affirmative) < succ>
            bacterial membrane  --- Certainty = 0.0000(Not Clear)   < succ>
            bacterial outside   --- Certainty = 0.0000(Not Clear)   < succ>
```

An alignment of the GAS and GBS proteins is shown below:

```
Identities = 88/161 (54%), Positives = 124/161 (76%)

Query:   1 MTKKALFTGSFDPVTNGHLDIIERASYLFDHVYIGLFYNLEKQGYFSIECRKKMLEEAIR   60
           +TK  L+TGSFDPVTNGHLDI++RAS LFD +Y+G+F N  K+ YF +E RK ML +A+
Sbjct:   2 LTKIGLYTGSFDPVTNGHLDIVKRASGLFDQIYVGIFDNPTKKSYFKLEVRKAMLTQALA  61

Query:  61 QFKNVSVLVAQDRLAVDLAREVGAKYFVRGLRNSQDFDYEANLEFFNKQLADDIETVYLS 120
             F NV V+ +  +RLA+D+A+E+    + +RGLRN+ DF+YE NLE+FN  LA +IETVYL
Sbjct:  62 DFTNVIVVTSHERLAIDVAKELRVTHLIRGLRNATDFEYEENLEYFNHLLAPNIETVYLI 121

Query: 121 TSPSLSPISSSRIRELIHFKASVKPFVPKSVVREVEKMSEE                    161
           +         +SSSR+RELIHF++S++   VP+SV+ +VEKM+E+
Sbjct: 122 SRNKWQALSSSRVRELIHFQSSLEGLVPQSVIAQVEKMNEK                    162
```

Based on this analysis, it was predicted that these proteins and their epitopes could be useful antigens for vaccines or diagnostics.

EXAMPLE 43

A DNA sequence (GBSx0042) was identified in *S. agalactiae* <SEQ ID 137> which encodes the amino acid sequence <SEQ ID 138>. Analysis of this protein sequence reveals the following:

```
Possible site: 15
>>> Seems to have no N-terminal signal sequence

----- Final Results -----
            bacterial cytoplasm --- Certainty = 0.1126(Affirmative) < succ>
             bacterial membrane --- Certainty = 0.0000(Not Clear)   < succ>
              bacterial outside --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 44

A DNA sequence (GBSx0043) was identified in *S. agalactiae* <SEQ ID 139> which encodes the amino acid sequence <SEQ ID 140>. Analysis of this protein sequence reveals the following:

```
Possible site: 25
>>> Seems to have an uncleavable N-term signal seq
     INTEGRAL    Likelihood = -11.04      Transmembrane      20-36 (12-43)

----- Final Results -----
              bacterial membrane --- Certainty = 0.5416(Affirmative) < succ>
               bacterial outside --- Certainty = 0.0000(Not Clear)   < succ>
             bacterial cytoplasm --- Certainty = 0.0000(Not Clear)   < succ>
```

The protein has homology with the following sequences in the GENPEPT database:

```
>GP:CAB13378 GB:Z99111 ylbL [Bacillus subtilis]
Identities = 124/344 (36%), Positives = 199/344 (57%), Gaps = 21/344 (6%)

Query:   20 WIIGFAFLLLVLASLVVRLPYYLEMPGGAYDIRSVLKVNKKADKAKGSYNFVAVSVSQAT   79
            W++      L+ VL+   ++LPYY+  PG A ++ S++KV     + KGS + + V V  A
Sbjct:    9 WMLVILILIAVLS--FIKLPYYITKPGEATELASLIKVEGGYPE-KGSLSLMTVKVGPAN   65

Query:   80 PAQVLYAWLTPFTEL----SSKEETTGGFSNDDYLRINQFYMETSQNESIYQALKLANKQ  135
            P   ++A + P+ E+     S KEE   G S+ +Y++      M++SQ  ++  A + A K+
Sbjct:   66 PFTYVWAKMHPYYEIVPDESIKEE---GESDKEYMKRQLQMMKSSQENAVIAAYQKAGKK  122

Query:  136 VSLTYKGVYVLNLAKNSTFKDRLHLADTVTGVNGKSFKNSSQLIKYVAALHLGDKVKVQY  195
            VS ++ G+Y  ++ +N    K ++ + D +    +GK+++++ +LI Y+++    GDKV ++
Sbjct:  123 VSYSFNGIYASSVVENMPAKGKIEVGDKIISADGKNYQSAEKLIDYISSKKAGDKVTLKI  182

Query:  196 TSQGKKKESVGKVIKLSNGKNGIGIGLTDHTE--VLSDVPVDFNTEGVGGPSAGLMFTLA  253
             + K+K    + +  + +   GIG++ +T+  V  +  +DF  E +GGPSAGLM +L
Sbjct:  183 EREEKEKRVTLTLKQFPDEPDRAGIGVSLYTDRNVKVEPDIDFEIENIGGPSAGLMMSLE  242

Query:  254 IYDQLVKEDLRKGRKIAGTGTIEQNGHVGDIGGAGLKVVSAAKKGMDIFFVPNNPIDKNA  313
            IY+QL K D   KG   IAGTGTI+ +G VG IGG    KVV+A K G DIFF PN       N
Sbjct:  243 IYNQLTKPDETKGYDIAGTGTIDVDGKVGPIGGIDQKVVAADKAGKDIFFAPNQNGASN-  301

Query:  314 KKGKTKVQTNYQEAKAAAKRLGTKMKIVPVQNVQQAIDYLKKTK                  357
                  ++Y+ A    AK + + MKIVPV  +Q AIDYL K K
Sbjct:  302 --------SDYKNAVKTAKDIDSNMKIVPVDTMQDAIDYLNKLK                  337
```

A related DNA sequence was identified in *S. pyogenes* <SEQ ID 141> which encodes the amino acid sequence <SEQ ID 142>. Analysis of this protein sequence reveals the following:

```
Possible site: 23
>>> Seems to have an uncleavable N-term signal seq
    INTEGRAL    Likelihood = -10.24    Transmembrane    10-26 (6-34)

----- Final Results -----
            bacterial membrane  --- Certainty = 0.5097(Affirmative) < succ>
            bacterial outside   --- Certainty = 0.0000(Not Clear)   < succ>
            bacterial cytoplasm --- Certainty = 0.0000(Not Clear)   < succ>
```

The protein has homology with the following sequences in the databases:

```
>GP:CAB13378 GB:Z99111 ylbL [Bacillus subtilis]
Identities = 132/348 (37%), Positives = 198/348 (55%), Gaps = 16/348 (4%)

Query:    1 MKRLKKIKWWLVGLLALISLLLALFFPLPYYIEMPGGAYDIRTVLQVNGKEDKRKGAYQF   60
            M R K   W LV +L LI++L    F  LPYYI  PG A ++ ++++V G   + KG+
Sbjct:    1 MLRKKHFSWMLV-ILILIAVLS--FIKLPYYITKPGEATELASLIKVEGGYPE-KGSLSL  56

Query:   61 VAVGISRASLAQLLYAWLTPFTEISTAEDTTG-GYSDADFLRINQFYMETSQNAAIYQAL  119
            + V +  A+    ++A + P+ EI  E    G SD ++++    M++SQ  A+   A
Sbjct:   57 MTVKVGPANPFTYVWAKMHPYYEIVPDESIKEEGESDKEYMKRQLQMMKSSQENAVIAAY  116

Query:  120 SLAGKPVTLDYKGVYVLDVNNESTFKGTLHLADTVTGVNGKQFTSSAELIDYVSHLKLGD  179
              AGK V+   + G+Y    V       KG + + D +    +GK + S+ +LIDY+S  K GD
Sbjct:  117 QKAGKKVSYSFNGIYASSVVENMPAKGKIEVGDKIISADGKNYQSAEKLIDYISSKKAGD  176

Query:  180 EVTVQFTSDNKPKKGVGRIIKLKN--GKNGIGIALTDHTSVNSEDTVIFSTKGVGGPSAG  237
            +VT++    + K K+   + +  +   + GIG++L   +V E   + F  +GGPSAG
Sbjct:  177 KVTLKIEREEKEKRVTLTLKQFPDEPDRAGIGVSLYTDRNVKVEPDIDFEIENIGGPSAG  236

Query:  238 LMFTLDIYDQITKEDLRKGRTIAGTGTIGKDGEVGDIGGAGLKVVAAAEAGADIFFVPNN  297
            LM +L+IY+Q+TK D   KG  IAGTGTI   DG+VG IGG    KVVAA +AG DIFF PN
Sbjct:  237 LMMSLEIYNQLTKPDETKGYDIAGTGTIDVDGKVGPIGGIDQKVVAADKAGKDIFFAPNQ  296

Query:  298 PVDKEIKKVNPNAISNYEEAKRAAKRLKTKMKIVPVTTVQEALVYLRK             345
               N   + S+Y+ A + AK + +  MKIVPV T+Q+A+  YL K
Sbjct:  297 ---------NGASNSDYKNAVKTAKDIDSNMKIVPVDTMQDAIDYLNK              335
```

An alignment of the GAS and GBS proteins is shown below:

```
Identities = 229/339 (67%), Positives = 276/339 (80%)

Query:   17 LKWWIIGFAFLLLVLASLVVRLPYYLEMPGGAYDIRSVLKVNKKADKAKGSYNFVAVSVS   76
            +KWW++G   L+ +L +L    LPYY+EMPGGAYDIR+VL+VN K DK  KG+Y FVAV +S
Sbjct:    7 IKWWLVGLLALISLLLALFFPLPYYIEMPGGAYDIRTVLQVNGKEDKRKGAYQFVAVGIS   66

Query:   77 QATPAQVLYAWLTPFTELSSKEETTGGFSNDDYLRINQFYMETSQNESIYQALKLANKQV  136
            +A+   Q+LYAWLTPFTE+S+  E+TTGG+S+   D+LRINQFYMETSQN +IYQAL  LA K V
Sbjct:   67 RASLAQLLYAWLTPFTEISTAEDTTGGYSDADFLRINQFYMETSQNAAIYQALSLAGKPV  126

Query:  137 SLTYKGVYVLNLAKNSTFKDRLHLADTVTGVNGKSFKNSSQLIKYVAALHLGDKVKVQYT  196
            +L YKGVYVL++    STFK  LHLADTVTGVNGK F +S++LI YV+ L LGD+V VQ+T
Sbjct:  127 TLDYKGVYVLDVNNESTFKGTLHLADTVTGVNGKQFTSSAELIDYVSHLKLGDEVTVQFT  186

Query:  197 SQGKKKESVGKVIKLSNGKNGIGIGLTDHTEVLSDVPVDFNTEGVGGPSAGLMFTLAIYD  256
            S   K K+   VG++IKL NGKNGIGI LTDHT V S+   V F+T+GVGGPSAGLMFTL IYD
Sbjct:  187 SDNKPKKGVGRIIKLKNGKNGIGIALTDHTSVNSEDTVIFSTKGVGGPSAGLMFTLDIYD  246

Query:  257 QLVKEDLRKGRKIAGTGTIEQNGHVGDIGGAGLKVVSAAKKGMDIFFVPNNPIDKNAKKG  316
            Q+ KEDLRKGR IAGTGTI ++G VGDIGGAGLKVV+AA  G DIFFVPNNP DK  KK
Sbjct:  247 QITKEDLRKGRTIAGTGTIGKDGEVGDIGGAGLKVVAAAEAGADIFFVPNNPVDKEIKKV  306

Query:  317 KTKVQTNYQEAKAAAKRLGTKMKIVPVQNVQQAIDYLKK                      355
             +NY+EAK AAKRL TKMKIVPV  VQ+A+ YL K
Sbjct:  307 NPNAISNYEEAKRAAKRLKTKMKIVPVTTVQEALVYLRK                      345
```

A related GBS gene <SEQ ID 8479> and protein <SEQ ID 8480> were also identified. Analysis of this protein sequence reveals the following:

```
Lipop: Possible site: -1 Crend: 10
McG: Discrim Score: 8.26
GvH: Signal Score (-7.5): -4.04
     Possible site: 25
>>> Seems to have an uncleavable N-term signal seq
ALOM program count: 1 value: -11.04 threshold: 0.0
    INTEGRAL        Likelihood = -11.04      Transmembrane     20-36 (12-43)
    PERIPHERAL      Likelihood =   4.51      70
modified ALOM score: 2.71
*** Reasoning Step: 3

----- Final Results -----
              bacterial membrane  --- Certainty = 0.5416(Affirmative) < succ>
              bacterial outside   --- Certainty = 0.0000(Not Clear)   < succ>
              bacterial cytoplasm --- Certainty = 0.0000(Not Clear)   < succ>
```

The protein has homology with the following sequences in the databases:

```
GP|5531383| putative secreted protein {Streptomyces coelicolor A3(2)} Insert
characterized
PIR|T36157|T36157 probable secreted protein - Streptomyces coelicolor Insert
characterized ORF01344(361-1362 of 1671)
GP|5531383|emb|CAB51015.1||AL096852(13-247 of 259) putative secreted protein
{Streptomyces coelicolor A3(2)} PIR|T36157|T36157 probable secreted protein -
Streptomyces coelicolor
% Match = 7.1
% Identity = 38.4    % Similarity = 57.6
Matches = 58  Mismatches = 61  Conservative Sub.s = 29

312       342       372       402       432       462       492
EKWRK*VKNRDPKRKHKSLLGLLKWWIIGFAFLLLVLASLVVRLPYYLEMPGGAYDIRSVLKVNKKADKAKGSYNFV~~~
                   | :|: :|: :|  || : ||  |:
                   MLSRLTRPQFLAVCGLPVVALLATALFAPLPFSVAQPGLTADV---------------------~~~
                    10        20        30        40

924       954       984                                              1002
~KKKESVGKVIKLSNGKNGIGIGLTDHTEVLS--------------------~~~--------------------DVPV
                   :|     ||::                                         || |
~-------------------LGKNRGAEVITISGAPTHATSGQLRMTTIEA~~~~KESQDSATTAALRYLRMDKGDVDV
                   50        60        70              130       140

1032      1062      1092      1122      1152      1182      1212      1242
DFNTEGVGGPSAGLMFTLAIYDQLVKEDLRKGRKIAGTGTIEQNGHVGDIGGAGLKVVSAAKKGMDIFFVPNNPIDKNAK
 :  |  ||||||||:|:|  |  |:|   ||   |: :|||||   |||  :||   ||   :|   :  |  :|:||
KLRLEDVGGPSAGLLFSLGIVDKLGAGDLTGGKVVAGTGTITDGGKVGAVGGVPLKTQAARRDGATVFLVPK--------
         160       170       180       190       200       210

1272      1302      1332      1362      1392      1422      1452      1482
KGKTKVQTNYQEAKAAAKRLGTKMKIVPVQNVQQAIDYLKKTK*TQRVRASARLFCFATFDYQSAKMIV*QSL*EYYI*M
     |    |    :::::||  ::  |:|  ||         :          :
----------AECSDAQAELPKGLRLIPVTTLEGAVDSLKALESGKGDVPAC
         220       230       240       250
```

SEQ ID 8480 (GBS39) was expressed in *E. coli* as a GST-fusion product. SDS-PAGE analysis of total cell extract is shown in FIG. 12 (lane 9; MW 65.2 kDa) and FIG. 15 (lane 3; MW 40 kDa).

Based on this analysis, it was predicted that these proteins and their epitopes could be useful antigens for vaccines or diagnostics.

EXAMPLE 45

A DNA sequence (GBSx0044) was identified in *S. agalactiae* <SEQ ID 143> which encodes the amino acid sequence <SEQ ID 144>. This protein is predicted to be UDP-sugar hydrolase. Analysis of this protein sequence reveals the following:

```
Possible site: 17
>>> Seems to have no N-terminal signal sequence

----- Final Results -----
              bacterial cytoplasm --- Certainty = 0.3908(Affirmative) < succ>
               bacterial membrane --- Certainty = 0.0000(Not Clear)  < succ>
                bacterial outside --- Certainty = 0.0000(Not Clear)  < succ>
```

The protein has homology with the following sequences in the GENPEPT database:

```
>GP:CAB15227 GB:Z99120 similar to hypothetical proteins [Bacillus subtilis]
Identities = 114/280 (40%), Positives = 173/280 (61%), Gaps = 9/280 (3%)

Query:   1 MTELIRILHLNDLHSHFENFPKVKRFFH----DNQAQPIETISLDLGDNIDKSHPLTEAS      56
           M E +R+ H NDLHSHFEN+PK+ +        ++Q+   ET+ D+GD++D+   +TEA+
Sbjct:   1 MKEKLRLYHTNDLHSHFENWPKIVDYIEQKRKEHQSDGEETLVFDIGDHLDRFQFVTEAT      60

Query:  57 SGKANVQLMNELGIELATIGNNEGVGLSKKDLDQVYKDSDFTVIVGNLKD-NIIEPSWAK     115
             GKANV L+N L I+ A IGNNEG+ L  ++L  +Y  ++F VIV NL D N PSWA
Sbjct:  61 FGKANVDLLNRLHIDGAAIGNNEGITLPHEELAALYDNAEFPVIVSNLFDKNGNRPSWAV     120

Query: 116 PYIIYETQQGTKLAFLAYTFPYYKTYEPNGWTIEDPIDCLKCHLQINEIK-EANCRILMS     174
           PY I   + G  +AFL   T PYY Y+   GWT+ D ++ +K    I E+K +A+  +L+S
Sbjct: 121 PYHIKSLKNGMSIAFLGVTVPYYPVYDKLGWTVTDALESIK--ETILEVKGQADIIVLLS     178

Query: 175 HLGIRFDTRIAQEFSEIDLIIGAHTHHLFEEGELINGTYLAAAGKYGRFVGSIDITFDNH     234
           HLGI  D  +A+    EID+I+ +HTHHL E+G+++NG  LA+A KYG +VG ++IT D+
Sbjct: 179 HLGILDDQAVAEAVPEIDVILESHTHHLLEDGQVVNGVLLASAEKYGHYVGCVEITVDS-     237

Query: 235 TLKDILISTCDTKQLTGYPSDSDWLRRLSQKVKNSLEKKV                         274
           + I   T  ++ +  +S   +     + +    E+K+
Sbjct: 238 VQRSINSKTASVQNMAEWTGESAETKAFLNEKEREAEEKL                        277
```

No corresponding DNA sequence was identified in *S. pyogenes*.

Based on this analysis, it was predicted that this protein and its epitopes, could be useful antigens for vaccines or diagnostics.

EXAMPLE 46

A DNA sequence (GBSx0045) was identified in *S. agalactiae* <SEQ ID 145> which encodes the amino acid sequence <SEQ ID 146>. This protein is predicted to be UDP-sugar hydrolase. Analysis of this protein sequence reveals the following:

```
Possible site: 44
>>> Seems to have no N-terminal signal sequence
       INTEGRAL      Likelihood = -0.48      Transmembrane     5-21 (5-21)

----- Final Results -----
              bacterial membrane --- Certainty = 0.1192(Affirmative) < succ>
               bacterial outside --- Certainty = 0.0000(Not Clear)  < succ>
             bacterial cytoplasm --- Certainty = 0.0000(Not Clear)  < succ>
```

A related GBS nucleic acid sequence <SEQ ID 9605> which encodes amino acid sequence <SEQ ID 9606> was also identified.

The protein has homology with the following sequences in the GENPEPT database:

```
>GP: CAB15227 GB: Z99120 similar to hypothetical proteins [Bacillus subtilis]
Identities = 29/137 (21%), Positives = 71/137 (51%), Gaps = 13/137 (9%)

Query:   3 AMLFYAGADVAIINSGLIVQPFEKD-FSRKNLHESLPHQMRLAKLTVSSQELLEIYETIY      61
           A+  +  D++++NSG+I+ P +    ++ +LH   PH +    + ++ +EL  E     ++
Sbjct: 305 ALKEWCETDISMVNSGVILGPLKAGPVTKLDLHRICPHPINPVAVRLTGEELKETI--VH     362
```

```
-continued
Query:   62 QQGQFLAQQKIHGMGFRGKCFGEVLHSGFDYKN----------GKIVYNEKDIDAKEEVI  111
            + + Q +I G+GFRG+   G+++++G + +            +I  N +DI+  ++
Sbjct:  363 AASEQMEQLRIKGLGFRGEVMGKMVYAGVEVETKRLDDGITHVTRITLNGEDIEKHKQYS  422

Query:  112 LVIVDQYYFASYFECLK                                             128
            + ++D +     F  ++
Sbjct:  423 VAVLDMFTLGKLFPLIR                                             439
```

No corresponding DNA sequence was identified in *S. pyogenes*.

Based on this analysis, it was predicted that this protein and its epitopes, could be useful antigens for vaccines or diagnostics.

EXAMPLE 47

A DNA sequence (GBSx0046) was identified in *S. agalactiae* <SEQ ID 147> which encodes the amino acid sequence <SEQ ID 148>. This protein is predicted to be unnamed protein product. Analysis of this protein sequence reveals the following:

```
Possible site: 29
>>> Seems to have no N-terminal signal sequence

----- Final Results -----
            bacterial cytoplasm --- Certainty = 0.3567(Affirmative) < succ>
            bacterial membrane  --- Certainty = 0.0000(Not Clear)   < succ>
            bacterial outside   --- Certainty = 0.0000(Not Clear)   < succ>
```

The protein differs from AX026665 at the C-terminus:

```
        Query:    181     SAKQHFVIRKK     191
                          SAKQH +  +K
        Sbjct:    181     SAKQHLLFVRK     191
```

A related DNA sequence was identified in *S. pyogenes* <SEQ ID 149> which encodes the amino acid sequence <SEQ ID 150>. Analysis of this protein sequence reveals the following:

```
Possible site: 37
>>> Seems to have no N-terminal signal sequence

----- Final Results -----
            bacterial cytoplasm --- Certainty = 0.3974(Affirmative) < succ>
            bacterial membrane  --- Certainty = 0.0000(Not Clear)   < succ>
            bacterial outside   --- Certainty = 0.0000(Not Clear)   < succ>
```

An alignment of the GAS and GBS proteins is shown below:

```
Identities = 110/205 (53%), Positives = 147/205 (71%), Gaps = 15/205 (7%)

Query:    1 MRKEVTPEMLNYNKYPGPQFIHFENIVKSDDIEFQLVINEKSAFDVTVFGQRFSEILLKY   60
            M+KE++PEM NYNK+PGP+FIHFE  VK++ I+  L+ + K+AFD T FGQR++E+LLKY
Sbjct:    9 MKKEISPEMYNYNKFPGPKFIHFEEQVKAEGIDLLLLEDVKNAFDTTSFGQRYTEVLLKY   68

Query:   61 DFIVGDWGNEQLRLRGFYKDASTIRKNSRISRLEDYIKEYCNFGCAYFVLENPNPRDIKF  120
            D+IVGDWGNEQLRL+GFYKD+   I+K +RISRLEDYIKE+CNFGCAYFVLEN +P+DIKF
Sbjct:   69 DYIVGDWGNEQLRLKGFYKDSDDIKKTNRISRLEDYIKEFCNFGCAYFVLENLHPQDIKF  128

Query:  121 DDERPHKRRKS------RSKSQSSKSQTRNNRSQSNA--------NAHFTSKKRKDTKRR  166
            ++ER  +R+KS      R K  S Q    +S+S          N  FTS+KR+  +
Sbjct:  129 EEERQPRRKKSPKSKSNRRKPNYSNQQPATPKSKSKRASKEKQPENQAFTSQKRRSNTKH  188

Query:  167 QERHIKEEQDKEMTSAKQHFVIRKK                                    191
            +E+   K  Q ++ +    HF+IRKK
Sbjct:  189 KEKS-KRNQTSQLNTKISHFIIRKK                                    212
```

Based on this analysis, it was predicted that these proteins and their epitopes could be useful antigens for vaccines or diagnostics.

EXAMPLE 48

A DNA sequence (GBSx0047) was identified in *S. agalactiae* <SEQ ID 151> which encodes the amino acid sequence <SEQ ID 152>. Analysis of this protein sequence reveals the following:

```
Possible site: 32
>>> Seems to have no N-terminal signal sequence

----- Final Results -----
            bacterial cytoplasm --- Certainty = 0.3627(Affirmative) < succ>
             bacterial membrane --- Certainty = 0.0000(Not Clear)   < succ>
              bacterial outside --- Certainty = 0.0000(Not Clear)   < succ>
```

A related GBS nucleic acid sequence <SEQ ID 9607> which encodes amino acid sequence <SEQ ID 9608> was also identified.

The protein has homology with the following sequences in the GENPEPT database:

```
>GP: BAB06225 GB: AP001515 unknown conserved protein [Bacillus halodurans]
Identities = 205/349 (58%), Positives = 258/349 (73%), Gaps = 5/349 (1%)

Query:  18 PSIYSLTRDELIAWAIEHGEKKFRASQIWDWLYKKRVQSFDEMTNISKDFIALLNENFVV   77
           PSIY+L  +EL  W  E GE KFRA+QI++WLY+KRV+ F EMTN+SKD  A L ++F +
Sbjct:  17 PSIYTLQFEELEMWLKEQGEPKFRATQIFEWLYEKRVKQFQEMTNLSKDLRAKLEKHFNL   76

Query:  78 NPLKQRIVQESADGTVKYLFELPDGMLIETVLMRQHYGLSVCVTTQVGCNIGCTFCASGL  137
           LK    Q+S+DGT+K+LFEL DG   IETV+MR +YG SVCVTTQVGC +GCTFCAS L
Sbjct:  77 TTLKTVTKQQSSDGTIKFLFELHDGYSIETVVMRHNYGNSVCVTTQVGCRLGCTFCASTL  136

Query: 138 IKKQRDLNNGEITAQIMLVQKYFDERGQGERVSHIVVMGIGEPFDNYTNVLKFLRTVNDD  197
             +R+L  GEI AQ++  Q+  DE  QGERV  IVVMGIGEPFDNY  ++ FL+TVN D
Sbjct: 137 GGLKRNLEAGEIVAQVVEAQRAMDE--QGERVGSIVVMGIGEPFDNYQALMPFLKTVNHD  194

Query: 198 NGLAIGARHITVSTSGLAHKIREFANEGVQVNLAVSLHAPNNDLRSSIMRINRSFPLEKL  257
            GL IGARHITVSTSG+  KI +FA+EG+Q+N A+SLHAPN +LRS +M +NR++PL KL
Sbjct: 195 KGLNIGARHITVSTSGVVPKIYQFADEGLQINFAISLHAPNTELRSKLMPVNRAWPLPKL  254

Query: 258 FAAIEYYIETTNRRVTFEYIMLNGVNDTPENAQELADLTKKIRKLSYVNLIPYNPVSEHD  317
              AI YYI+ T RRVTFEY +  G ND  E+A+ELADL K I+    +VNLIP N V E D
Sbjct: 255 MDAIRYYIDKTGRRVTFEYGLFGGENDQVEHAEELADLIKDIK--CHVNLIPVNYVPERD  312

Query: 318 QYSRSPKERVEAFYDVLKKNGVNCVVRQEHGTDIDAACGQLRSNTMKRD            366
            Y R+P++++ AF    LK+ GVN  +R+E G DIDAACGQLR+    K +
Sbjct: 313 -YVRTPRDQIFAFERTLKERGVNVTIRREQGHDIDAACGQLRAKERKEE            360
```

A related DNA sequence was identified in *S. pyogenes* <SEQ ID 153> which encodes the amino acid sequence <SEQ ID 154>. Analysis of this protein sequence reveals the following:

```
Possible site: 17
>>> Seems to have no N-terminal signal sequence

----- Final Results -----
            bacterial cytoplasm --- Certainty = 0.2320(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below:

```
Identities = 316/353 (89%), Positives = 339/353 (95%)

Query:    17 KPSIYSLTRDELIAWAIEHGEKKFRASQIWDWLYKKRVQSFDEMTNISKDFIALLNENFV   76
             KPSIYSLTRDELIAWA+E G+K+FRA+QIWDWLYKKRVQSF+EMTNISKDF+++LN++F
Sbjct:     2 KPSIYSLTRDELIAWAVERGQKQFRATQIWDWLYKKRVQSFEEMTNISKDFVSILNDSFC   61

Query:    77 VNPLKQRIVQESADGTVKYLFELPDGMLIETVLMRQHYGLSVCVTTQVGCNIGCTFCASG  136
             VNPLKQR+VQESADGTVKYLFELPDGMLIETVLMRQHYG SVCVTTQVGCNIGCTFCASG
Sbjct:    62 VNPLKQRVVQESADGTVKYLFELPDGMLIETVLMRQHYGHSVCVTTQVGCNIGCTFCASG  121

Query:   137 LIKKQRDLNNGEITAQIMLVQKYFDERGQGERVSHIVVMGIGEPFDNYTNVLKFLRTVND  196
             LIKKQRDLN+GEITAQIMLVQKYFD+R QGERVSH+VVMGIGEPFDNY NV+ FLR +ND
Sbjct:   122 LIKKQRDLNSGEITAQIMLVQKYFDDRKQGERVSHVVVMGIGEPFDNYKNVMCFLRVIND  181

Query:   197 DNGLAIGARHITVSTSGLAHKIREFANEGVQVNLAVSLHAPNNDLRSSIMRINRSFPLEK  256
             DNGLAIGARHITVSTSGLAHKIR+FANEGVQVNLAVSLHAPNNDLRSSIMR+NRSFPLEK
Sbjct:   182 DNGLAIGARHITVSTSGLAHKIRDFANEGVQVNLAVSLHAPNNDLRSSIMRVNRSFPLEK  241

Query:   257 LFAAIEYYIETTNRRVTFEYIMLNGVNDTPENAQELADLTKKIRKLSYVNLIPYNPVSEH  316
             LF+AIEYYIE TNRRVTFEYIMLN VND+ + AQELADLTK IRKLSYVNLIPYNPVSEH
Sbjct:   242 LFSAIEYYIEKTNRRVTFEYIMLNEVNDSIKQAQELADLTKTIRKLSYVNLIPYNPVSEH  301

Query:   317 DQYSRSPKERVEAFYDVLKKNGVNCVVRQEHGTDIDAACGQLRSNTMKRDRQK         369
             DQYSRSPKERV AFYDVLKKNGVNCVVRQEHGTDIDAACGQLRS TMK+DR+K
Sbjct:   302 DQYSRSPKERVLAFYDVLKKNGVNCVVRQEHGTDIDAACGQLRSKTMKKDREK         354
```

Based on this analysis, it was predicted that these proteins and their epitopes could be useful antigens for vaccines or diagnostics.

EXAMPLE 49

A DNA sequence (GBSx0048) was identified in *S. agalactiae* <SEQ ID 155> which encodes the amino acid sequence <SEQ ID 156>. This protein is predicted to be VanZF. Analysis of this protein sequence reveals the following:

```
Possible site: 47
>>> Seems to have an uncleavable N-term signal seq
      INTEGRAL    Likelihood = -9.61    Transmembrane    86-102 (77-106)
      INTEGRAL    Likelihood = -8.60    Transmembrane    19-35  (15-42)
      INTEGRAL    Likelihood = -5.15    Transmembrane    113-129 (109-134)

----- Final Results -----
          bacterial membrane --- Certainty = 0.4843(Affirmative) < succ>
          bacterial outside  --- Certainty = 0.0000(Not Clear)   < succ>
          bacterial cytoplasm --- Certainty = 0.0000(Not Clear)  < succ>
```

The protein has homology with the following sequences in the GENPEPT database:

```
>GP:AAF36806 GB:AF155139 VanZF [Paenibacillus popilliae]
Identities = 45/154 (29%), Positives = 68/154 (43%), Gaps = 36/154 (23%)

Query:    17 RRFVWMLVIIYCLIIVRMCFGPQIMIEGVSTPNVQRFGRIVAL-------LVPFNSFRSL   69
             R F+W+ V ++ L +V M G              NV  GR  L        L+PF+S
Sbjct:    36 RHFLWVYVFLFYLALVYMMTG---------IGNVWVGRYETLIRVSEINLLPFSS----   82

Query:    70 DQLTSFKEIFWVIGQNVVNILLLFPLIIGLLSLKPSLRKYKSVILLAFLMSIFIECTQVV  129
             + +T++            ++NI+L  PL   L ++ P   R    K+     F   S+ IE TQ++
Sbjct:    83 EGVTTY----------ILNIILFMPLGFLLPTIWPQFRTIKNTACTGFFFSLAIELTQLL  132

Query:   130 LDILIDANRVFEIDDLWTNTLGGPFALWTYRNIK                            163
                +R+ +IDDL  NTLG         YR  K
Sbjct:   133 ------NHRITDIDDLLMNTLGAIIGYLLYRAFK                            160
```

No corresponding DNA sequence was identified in *S. pyogenes*.

Based on this analysis, it was predicted that this protein and its epitopes, could be useful antigens for vaccines or diagnostics.

EXAMPLE 50

A DNA sequence (GBSx0049) was identified in *S. agalactiae* <SEQ ID 157> which encodes the amino acid sequence <SEQ ID 158>. This protein is predicted to be multidrug resistance-like ATP-binding protein mdl. Analysis of this protein sequence reveals the following:

```
Possible site: 30
>>> Seems to have no N-terminal signal sequence
    INTEGRAL    Likelihood = -6.79    Transmembrane    18-34   (17-36)
    INTEGRAL    Likelihood = -5.15    Transmembrane    247-263 (242-268)
    INTEGRAL    Likelihood = -2.81    Transmembrane    160-176 (158-176)
    INTEGRAL    Likelihood = -2.71    Transmembrane    141-157 (134-158)
    INTEGRAL    Likelihood = -1.12    Transmembrane    56-72   (56-73)
    INTEGRAL    Likelihood = -0.69    Transmembrane    278-294 (277-294)

----- Final Results -----
              bacterial membrane  --- Certainty = 0.3718(Affirmative) < succ>
              bacterial outside   --- Certainty = 0.0000(Not Clear)   < succ>
              bacterial cytoplasm --- Certainty = 0.0000(Not Clear)   < succ>
```

The protein has homology with the following sequences in the GENPEPT database:

```
>GP:BAB06055 ABC transporter (ATP-binding protein) [Bacillus halodurans]
Identities = 284/575 (49%), Positives = 406/575 (70%), Gaps = 2/575 (0%)

Query:    1 MSIIKNLWWFFKEEKKRYLIGILSLSLVAVLNLIPPKIMGSVIDAITTGKLTRPQLLWNL    60
            M +  +LWWFFK+EKK Y  GI+ L++V++L L+PP+++G ++D I   G LT P LL   +
Sbjct:    1 MKVFVDLWWFFKQEKKSYGFGIVMLAIVSLLTLVPPRVVGIIVDHIYEGTLTMPVLLQWI    60

Query:   61 LGLVLSALAMYGLRYIWRMYILGTSYKLGQVVRYRLFEHFTKMSPSFYQKYRTGDLMAHA   120
               L   AL +Y  RY+WR+   G S +L  +++R  L+ HFT M+    FYQK+RTGDLMAHA
Sbjct:   61 GVLAALALIVYVARYLWRVMIFGASLRLARLLRNQLYTHFTNMAAPFYQKHRTGDLMAHA   120

Query:  121 TNDINSLTRLAGGGVMSAVDASITALVTLITMFFTISWQMTLIAVIPLPLMALATSKLGR   180
            TNDI ++    AG GV++ VD+         ++TM   TISW++TLI+++P+PLMAL TS  G
Sbjct:  121 TNDIRAIQATAGQGVLTLVDSLTMGGFVILTMAITISWELTLISLLPMPLMALLTSYYGS   180

Query:  181 KTHETFKESQAAFSELNNKVQESVSGVKVTKSFGYQEQEIASFQEVNQMTFVKNMRTMTY   240
                H+ F  +QAAFS LN+KVQESV GV+VTK+FG +EQ+I +F++ +       KN+
Sbjct:  181 LLHKRFHHAQAAFSSLNDKVQESVTGVRVTKAFGQEEQDIEAFRKQSDDVVKKNVAVARV   240

Query:  241 DVMFDPLVLLFIGASYVLTLAMGAFMISKGQVTVGDLVTFVTYLDMLVWPLMAIGFLFNM   300
            D +FDP + L +G SY L +   GA +    Q+T+G L +F  YL  +L+WP++A GFLFN+
Sbjct:  241 DALFDPTISLIVGLSYFLAIVFGARFVIAEQLTIGQLTSFTIYLGLLIWPMLAFGFLFNI   300

Query:  301 VQRGSVSYNRINSLLEQESDITDPLNPIRPVVNGTLRYDIDFFRYDN--EETLADIHFTL   358
            V+RG  SYNR++ LL+ +  +ITD      I    G +    ID F Y N   E   LAD+ F L
Sbjct:  301 VERGRASYNRVSQLLQAKQEITDSRARIHVPPTGHVDVAIDQFVYPNQKEPALADVQFEL   360

Query:  359 EKGQTLGLVGQTGSGKTSLIKLLLREHDVTQGKITLNKHDIRDYRLSELRQLIGYVPQDQ   418
             +G+TLG+VG+TG+GKT+L++LL  RE+D+ QG I L+       I  Y L   L+   G VPQD
Sbjct:  361 SEGETLGIVGKTGAGKTTLLRLLQREYDIKQGTIILDGRPIEHYTLDALKAAFGTVPQDH   420

Query:  419 FLFATSILENVRFGNPTLSINAVKKATKLAHVYDDIKQMPAGFETLIGEKGVSLSGGQKQ   478
            FLF+  +I +N+ F P   +I+ + + ++LAH++DDI Q    G++T++GE+GV+LSGGQKQ
Sbjct:  421 FLFSATIADNIAFAKPDATISEIIQVSQLAHIHDDIIQFEQGYDTVVGERGVTLSGGQKQ   480

Query:  479 RIAMSRAMILDPDILILDDSLSAVDAKTEHAIIENLKTNRQGKSTIISAHRLSAVVHADL   538
            R+++++RA++ +P+ILILDDSLSAVDAKTE AI+ +L+  R+GK+TII+AHRLSA+ HAD
Sbjct:  481 RVSIARALLANPNILILDDSLSAVDAKTEEAILSSLRAERKGKTTIITAHRLSAIKHADH   540

Query:  539 ILVMQDGRVIERGQHQELLNKGGWYAETYASQQLE                          573
            ILVM DGR++ERG H+ L+  GGWY   Y  QQLE
Sbjct:  541 ILVMDDGRIVERGTHETLMEAGGWYRNMYERQQLE                          575
```

There is also homology to SEQ ID 8.
A related DNA sequence was identified in *S. pyogenes* <SEQ ID 159> which encodes the amino acid sequence <SEQ ID 160>. Analysis of this protein sequence reveals the following:

```
Possible site: 23
>>> Seems to have an uncleavable N-term signal seq
    INTEGRAL    Likelihood = -7.75    Transmembrane    176-192 (173-197)
    INTEGRAL    Likelihood = -4.78    Transmembrane    267-283 (265-285)
    INTEGRAL    Likelihood = -4.09    Transmembrane    18-34   (15-40)
    INTEGRAL    Likelihood = -2.13    Transmembrane    151-167 (150-169)
    INTEGRAL    Likelihood = -0.69    Transmembrane    85-101  (85-101)
```

-continued
```
----- Final Results -----
            bacterial membrane --- Certainty = 0.4100(Affirmative) < succ>
             bacterial outside --- Certainty = 0.0000(Not Clear) < succ>
           bacterial cytoplasm --- Certainty = 0.0000(Not Clear) < succ>
```

An alignment of the GAS and GBS proteins is shown below:

```
Identities = 172/609 (28%), Positives = 315/609 (51%), Gaps = 58/609 (9%)

Query:   1 MSIIKNLWWFFKEEKKRYLIGILSLSLVAVLNLIPPKIMGSVIDAITTGKLTRPQLLWNL   60
           M   +  W++FK  +  + +  +++ L    L +  P  +G  +   GK+ +    +  +
Sbjct:   2 MKTARFFWFYFKRYRFSFTVIAVAVILATYLQVKAPVFLGESLTEL--GKIGQAYYVAKM   59

Query:  61 LGLV-----LSAL--AMYGLRYIWRMYILGT---SYKLGQVV-------RYRLFEHFTKM  103
             G        LSA    M+  L   +L      S+  L +VV         R  LF   ++
Sbjct:  60 SGQTHFSPDLSAFNAVMFKLLMTYFFTVLANLIYSFLLTRVVSHSTNRMRKGLFGKLERL  119

Query: 104 SPSFYQKYRTGDLMAHATNDINSLTRLAGGGVMSAVDASITALVTLITMFFTISWQM---  160
           + +F+ +++ G++++   T+D+++         + ++++ S+  +VT I ++  + W M
Sbjct: 120 TVAFFDRHKDGEILSRFTSDLDN--------IQNSLNQSLIQVVTNIALYIGLVWMMFRQ  171

Query: 161 ------TLIAVIPLPLMALATS-KLGRKTHETFKESQAAFSELNNKVQESVSGVKVTKSF  213
                 IA P+ L+  +  +L RK       Q    S LN    + E++SG  K
Sbjct: 172 DSRLALLTIASTPVALIFLVINIRLARKYTNI---QQQEVSALNAFMDETISGQKAIIVQ  228

Query: 214 GYQEQEIASF----QEVNQMTFVKNMRT------MTYDVMFDPLVLLFIGASYVLT-LAM  262
           G QE  +F       + V Q TF + + +         M    + +  +++F+G++ VL+  +M
Sbjct: 229 GVQEDTMTAFLKHNERVRQATFKRRLFSGQLFPVMNGMSLINTAIVIFVGSTIVLSDKSM  288

Query: 263 GAFMISKGQVTVGDLVTFVTYLDMLVWPLMAIGFLFNMVQRGSVSYNRINSLLEQESDIT  322
           A                +G  +VTFV Y      P+M I   + +Q       +RI  + ++  ++
Sbjct: 289 PA------AAALGLVVTFVQYSQQYYQPMMQIASSWGELQLAFTGAHRIQEMFDETEEVR  342

Query: 323 DPLNPIRPVVNGTLRYD-IDFFRYDNEETLADIHFTLEKGQTLGLVGQTGSGKTSLIKLL  381
             P   +   +   +  +DF    ++ L+D+       KG+  +  +VG TGSGKT+++  L+
Sbjct: 343 PQNAPAFTSLKEAVAINHVDFGYLPGQKVLSDVSIVAPKGKMIAVVGPTGSGKTTIMNLI  402

Query: 382 LREHDVTQGKITLHKHDIRDYRLSELRQLIGYVPQDQFLFATSILENVRFGNPTLSINAV  441
             R  +DV   G IT +    DIRDY L   LRQ +G V  Q+    LF+  +I  +N+RFG+  T+S + V
Sbjct: 403 NRFYDVDAGSITFDGRDIRDYDLDSLRQKVGIVLQESVLFSGTITDNIRFGDQTISQDMV  462

Query: 442 KKATKLAHVYDDIKQMPAGFETLIGEKGVSLSGGQKQRIAMSRAMILDPDILILDDSLSA  501
            +  A  +   H++D I   +P G+ T + +            S  GQKQ I+++R ++  DP++LILD++  S
Sbjct: 463 ETAARATHIHDFIMSLPKGYNTYVSDDDNVFSTGQKQLISIARTLLTDPEVLILDEATSN  522

Query: 502 VDAKTEHAIIENLKTNRQGKSTIISAHRLSAVVHADLILVMQDGRVIERGQHQELLNKGG  561
           VD  TE  I  ++       G+++ +   AHRL   +++AD I+V++DG+VIE+G  H  ELL++  G
Sbjct: 523 VDTVTESKIQRAMEAIVAGRTSFVIAHRLKTILNADHIIVLKDGKVIEQGNHHELLHQKG  582

Query: 562 WYAETYASQ                                                      570
           +YAE Y +Q
Sbjct: 583 FYAELYHNQ                                                      591
```

Based on this analysis, it was predicted that these proteins and their epitopes could be useful antigens for vaccines or diagnostics.

EXAMPLE 51

A DNA sequence (GBSx0050) was identified in *S. agalactiae* <SEQ ID 161> which encodes the amino acid sequence <SEQ ID 162>. This protein is predicted to be mdlB (ATP-bindingprot). Analysis of this protein sequence reveals the following:

```
Possible site: 39
>>> Seems to have no N-terminal signal sequence
    INTEGRAL    Likelihood = -8.65    Transmembrane    164-180 (155-183)
    INTEGRAL    Likelihood = -5.15    Transmembrane     25-41  (21-46)
    INTEGRAL    Likelihood = -4.88    Transmembrane    143-159 (133-163)
    INTEGRAL    Likelihood = -1.49    Transmembrane    251-267 (251-270)
    INTEGRAL    Likelihood = -1.33    Transmembrane     61-77  (61-77)
```

-continued

----- Final Results -----
            bacterial membrane --- Certainty = 0.4461(Affirmative) < succ>
            bacterial outside --- Certainty = 0.0000(Not Clear) < succ>
          bacterial cytoplasm --- Certainty = 0.0000(Not Clear) < succ>

The protein has homology with the following sequences in the GENPEPT database:

```
>GP:BAB06054 ABC transporter (ATP-binding protein) [Bacillus halodurans]
Identities = 278/582 (47%), Positives = 398/582 (67%), Gaps = 6/582 (1%)

Query:   1 MMKSNQWQVFKRLISYLRPYKWFTVLALSLLLLTTVVKNIIPLIASHFIDHYLT-NVNQT  59
           +     Q   VFKRL+SY   YK   ++A  LL + T  + +P+I    FID YLT     T
Sbjct:   9 LSSKEQRTVFKRLLSYAAHYKGQLMVAFLLLFIATGAQLLGPIIVKIFIDDYLTPRYFPT 68

Query:  60 AVLILVG--YYSMYVLQTLIQYFGNLFFARVSYSIVRDIRRDAFANMERLGMSYFDRTPA 117
           VL L+G   Y   +++   +I Y+     F +V+ SIV+ +R  D P++++RLG+S+FD+TPA
Sbjct:  69 DVLFLLGAGYLVLHLTAVIIDYYQLFLFQKVALSIVQRLRIDVFSSVQRLGLSFFDQTPA 128

Query: 118 GSIVSRITNDTEAISDMFSGILSSFISAIFIPTVTLYTMLMLDIKLTGLVALLLPVIFIL 177
           G +VSRITNDTE+I +++   +L++F+   I          M  L++ L    +LLP+IF L
Sbjct: 129 GGLVSRITNDTESIKELYVTVLATFVQNIIFLIGIFAAMFYLNVTLAIYCLVLLPLIFAL 188

Query: 178 VNVYRKKSVTVIAKTRSLLSDINSKLSESIEGIRIVQAFGQEERLKTEFEEINKEHVVYA 237
           + VYRK S   A      LS +N +++ESI+G+ I+Q F QE R++ EF  IN EH +
Sbjct: 189 MQVYRKYSSRFYADMSEKLSLLNGRINESIQGMAIIQMFRQERRMKEFSAINDEHFLAG 248

Query: 238 NRSMALDSLFLRPAMSLLKLLAYAVLMAYFGFTGVKGGLTAGLMYAFIQYVNRLFDPLIE 297
              +SM LD L LRPA+ +L +LA  ++++YFG  +    + G++YAF+ Y++R F+P+ +
Sbjct: 249 MKSMKLDGLLLRPAVDVLSILALMLILSYFGIMSMDTAVEIGVVYAFVNYLDRFFEPVNQ 308

Query: 298 VTQNFSTLQTSMVSAGRVFDLIDETGFEPSQKNTE--AFVREGNIEFKNVSFSYDGKKQI 355
           +     S Q ++VSAGRVF L+D      P ++  E  A  + EGN+EF+NVSFSYDGK  +
Sbjct: 309 MMMRLSMFQQAIVSAGRVFKLMDHRELAPDREGNEHPAIIGEGNVEFRNVSFSYDGKTNV 368

Query: 356 LDNVSFSVKKGETIAFVGATGSGKSSIINVFMRFYEFQSGQVLLDGKDIRDYSQEQLRKN 415
           L N+SF+VKKGET+A VG TGSGK+SIINV MRFY  Q G++L+DGK +      +LR
Sbjct: 369 LKNISFTVKKGETVALVGHTGSGKTSIINVLMRFYPLQDGEILIDGKPLTSFENNELRAK 428

Query: 416 IGLVLQDPFLYHGTIKSNIKMY-QDITDQEVQDAAEFVDADQFIQKLPDKYDAAVSERGS 474
           +GLVLQDPFLY GTI SNI++Y Q I+D    ++ AA FV AD FI++L    Y+  V+ERG+
Sbjct: 429 VGLVLQDPFLYTGTIASNIRLYDQAISDDRIKRAASFVRADGFIERLSHGYETKVTERGA 488

Query: 475 SFSTGQRQLLAFARTVASKPKILILDEATANIDSETEQIVQDSLAKMRQGRTTIAIAHRL 534
           +FS+GQRQLL+FART+   +P ILILDEATA++D+ETE+  +Q++L M+QGRTTIAIAHRL
Sbjct: 489 TFSSGQRQLLSFARTMVREPAILILDEATASVDTETEEAIQEALERMKQGRTTIAIAHRL 548

Query: 535 STIQDANCIYVLDRGKIIESGNHESLLDLKGTYYRMYQLQAG                  576
           STI+DA+  I VL +G+I+E G H+ L+   KG Y +MY LQ G
Sbjct: 549 STIKDADQILVLHQGEIVERGTHDELIAKKGLYQKMYVLQKG                  590
```

There is also homology to SEQ ID 160.

A related GBS gene <SEQ ID 8481> and protein <SEQ ID 8482> were also identified. Analysis of this protein sequence reveals the following:

```
Lipop: Possible site: -1 Crend: 10
McG: Discrim Score: -4.63
GvH: Signal Score (-7.5): -5.85
Possible site: 39
>>>Seems to have no N-terminal signal sequence
ALOM program count: 5 value: -8.65 threshold: 0.0
INTEGRAL Likelihood = -8.65 Transmembrane    164-180 (155-183)
INTEGRAL Likelihood = -5.15 Transmembrane     25-41  (21-46)
INTEGRAL Likelihood = -4.88 Transmembrane    143-159 (133-163)
INTEGRAL Likelihood = -1.49 Transmembrane    251-267 (251-270)
INTEGRAL Likelihood = -1.33 Transmembrane     61-77  (61-77)
PERIPHERAL  Likelihood =  3.02 483
modified ALOM score: 2.23

*** Reasoning Step: 3

----- Final Results -----
            bacterial membrane --- Certainty =0.4461 (Affirmative) < succ>
            bacterial outside --- Certainty =0.0000 (Not Clear) < succ>
          bacterial cytoplasm --- Certainty =0.0000 (Not Clear) < succ>
```

The protein has homology with the following sequences in the databases:

```
ORF01277(322-2028 of 2340)
EGAD|108578|BS0971(2-667 of 673)hypothetical protein{Bacillus subtilis}
OMNI|NT01BS1137 conserved hypothetical protein GP|2226165|emb|CAA74449.1||Y14080
hypothetical protein {Bacillus subtilis}GP|2633307|emb|CAB12811.1||Z99109 similar
to ABC transporter (ATP-binding protein){Bacillus subtilis}PIR|H69828|H69828 ABC
transporter(ATP-binding protein)homolog yheH-Bacillus subtilis
% Match = 28.5
% Identity = 40.8    % Similarity = 69.1
Matches = 234    Mismatches = 171    Conservative Sub.s = 162
        162       192       222       252       282       312       342       372
        RLLFQHIDYQLLCTQTLS*LCKTAESSSEVSIKSC*IKVVGMLKRMPHSN*KWRKHLMKSNQWQVFKRLISYLRPYKWFT
                                                                  ::  |   |   |   |:   :
                                                                  MKIGKTLWRYALLYRKLL
                                                                  10
        402       432       462                                   480
        VLALSLLLLTTVVKNIIPLIASHFIDHYLTNVNQT-----------------------------------------A
        : |: ||  :     :  |:|      || ::    : :|
        ITAVLLLTVAVGAELTGPFIGKKMIDDHILGIEKTWYEAAEKDKNAVQFHGVSYV~~~~AAEKLTKQELFQFYQPEIKGM
        30        40        50        60        70                140
        510       540       570       600       630       660       690       720
        VLILVGYYSMYVLQTLIQYFGNLFFARVSYSIVRDIRRDAFANMERLGMSYFDRTPAGSIVSRITNDTEAISDMFSGILS
        ||::     |    : |:    :      ||  :  ::      |::  :|:| |::::: :   |||   ||| :|:||||||||||  |::    :||
        VLLICLYGGLLVFSVFFQYGQHYLLQMSANRIIQKMRQDVFSHIQKMPIRYFDNLPAGKVVARITNDTEAIRDLYVTVLS
        160       170       180       190       200       210       220
        750       777       807       837       867       897       927       957
        SFISAIFIFTVTLYTML-MLDIKLTGLVALLLPVIFILVNVYRKKSVTVIAKTRSLLSDINSKLSESIEGIRIVQAFGQE
        :|::   |:     ::|    |   :|||:||        ::|:|:|   |:|||:||       :  |:|||     |:|||  ::
        TFVTS-GIYMFGIFTALFLLDVKLAFVCLAIVPIIWLWSVIYRRYASYYNQKIRSINSDINAKMNESIQGMTIIQAFRHQ
        240       250       260       270       280       290       300
        987       1017      1047      1077      1107      1131      1161      1191
        ERLKTEFEEINKEHVVYANRSMALDSLFLRPAMSLLKLLAYAVLMAYFGFTGVK--GGLTAGLMYAFIQYVNRLFDPLIE
        :     ||||:|:   |   :  ||   : |:|        :::::  ||     :|  :||    :     |::  |::|||  |:||||  |:
        KETMREFEELNESHFYFQNRMLNLNSLMSHNLVNVIRNLAFVCLIWHFGGASLNAAGIVSIGVLYAFVDYLNRLFQPITG
        320       330       340       350       360       370       380
        1221      1251      1281      1311      1341      1371      1401      1431
        VTQNFSTLQTSMVSAGRVFDLIDETGFEPSQKNTEAFVREGNIEFKNVSFSYDGKKQILDNVSFSVKKGETIAFVGATGS
        :    ||  |: |  ||||||||:::|      |  :    :       :   :  :||:|||    :  :::  :|||||:|:|  |||
        IVNQFSKLELARVSAGRVFELLEEKNTEEAGEPAKERAL-GRVEFRDVSFAYQEGEEVLKHISFTAQKGETVALVGHTGS
        400       410       420       430       440       450       460
        1461      1491      1521      1551      1581      1611      1638      1668
        GKSSIINVFMRFYEFQSGQVLLDGKDIRDYSQEQLRKNIGLVLQDPFLYHGTIKSNIKMYQD-ITDQEVQDAAEFVDADQ
        |||||:::   |||:   |  |  ||:||| :  |:::|| ::|:||||||:|  |||  ||:  ::  :|::|::::|        |  |:
        GKSSILNLLFRFYDAQKGDVLIDGKSIYNMSRQELRSHMGIVLQDPYLFSGTIGSNVSLDDERMTEEEIKNALRQVGAEP
        480       490       500       510       520       530       540
        1698      1728      1758      1788      1818      1848      1878      1908
        FIQKLPDKYDAAVSERGSSFSTGQRQLLAFARTVASKPKILILDEATANIDSETEQIVQDSLAKMRQGRTTIAIAHRLST
        :::|||     :   |  |:|::|:|:|||::|||    :|   |    ||||||||:||:|||   ::|     ::|||||      |||||||
        LLKKLPKGINEPVIEKGSTLSSGERQLISFARALAFDPAILILDEATAHIDTETEAVIQKALDVVKQGRTTFVIAHRLST
        560       570       580       590       600       610       620
        1938      1968      1998      2028      2058      2088      2118      2148
        IQDANCIYVLDRGKIIESGNHESLLDLKGTYYRMYQLQAGMMEV*KI*TIQKA*SVRFRGWSSYSSKPFLYFTISV**GQ
        |::|:   |  |||:|:|  ||||  |:  |:|||||  |:  |:|||:||:|| |
        IRNADQILVLDKGEIVERGNHEELMALEGQYYQMYELQKGQKHSIA
        640       650       660       670
```

There is also homology to SEQ IDs 330, 4634 and 5788.

Based on this analysis, it was predicted that these proteins and their epitopes could be useful antigens for vaccines or diagnostics.

EXAMPLE 52

A DNA sequence (GBSx0051) was identified in *S. agalactiae* <SEQ ID 163> which encodes the amino acid sequence <SEQ ID 164>. Analysis of this protein sequence reveals the following:

```
Possible site: 25
>>> Seems to have no N-terminal signal sequence

----- Final Results -----
        bacterial cytoplasm --- Certainty = 0.0635(Affirmative) < succ>
        bacterial membrane  --- Certainty = 0.0000(Not Clear)   < succ>
        bacterial outside   --- Certainty = 0.0000(Not Clear)   < succ>
```

A related GBS nucleic acid sequence <SEQ ID 9609> which encodes amino acid sequence <SEQ ID 9610> was also identified.

The protein has homology with the following sequences in the GENPEPT database:

```
>GP: AAA25224 GB: M87483 anthranilate synthase beta subunit
[Lactococcus lactis]
Identities = 101/191 (52%), Positives = 133/191 (68%), Gaps = 4/191 (2%)

Query:   14 MLLLVDNYDSFTYNLKQYLSVYKEVFVIKNDVPNLFLLAESAEAIVLSPGPGHPKDAGKM   73
            M+L++DNYDSFTYNL QY+ V  +V V+KND  +L  +AE A+A++ SPGPG P DAGKM
Sbjct:    1 MILIIDNYDSFTYNLVQYVGVLTDVAVVKNDDDSLGNMAEKADALIFSPGPGWPADAGKM   60

Query:   74 VELINQFIGKKPILGICLGHQALAECLGGRLNLANHVMHGKQSWVTINDHTSLFKGIDSP  133
            LI QF G+KPILGICLG QA+ E  GG+L LA+ VMHGK S V       +F  + S
Sbjct:   61 ETLIQQFAGQKPILGICLGFQAIVEVFGGKLRLAHQVMHGKNSQVRQTSGNLIFNHLPSK  120

Query:  134 TQVMRYHSLVVTD---LPENIAVIARSNEDNEIMAFHCPSLKVYAMQFHPESIGSIDGMK  190
            VMRYHS+V+ +    LP+  A+ A + +D EIMA      ++Y +QFHPESIG++DGM
Sbjct:  121 FLVMRYHSIVMDEAVALPD-FAITAVATDDGEIMAIENEKEQIYGLQFHPESIGTLDGMT  179

Query:  191 MIENFLTLIND                                                  201
            MIENF+  +N+
Sbjct:  180 MIENFVNQVNE                                                  190
```

A related DNA sequence was identified in *S. pyogenes* <SEQ ID 165> which encodes the amino acid sequence <SEQ ID 166>. Analysis of this protein sequence reveals the following:

```
Possible site: 57
>>> Seems to have no N-terminal signal sequence

----- Final Results -----
         bacterial cytoplasm --- Certainty = 0.3183(Affirmative) < succ>
          bacterial membrane --- Certainty = 0.0000(Not Clear)   < succ>
           bacterial outside --- Certainty = 0.0000(Not Clear)   < succ>
```

An alignment of the GAS and GBS proteins is shown below:

```
Identities = 104/186 (55%), Positives = 131/186 (69%)

Query:   14 MLLLVDNYDSFTYNLKQYLSVYKEVFVIKNDVPNLFLLAESAEAIVLSPGPGHPKDAGKM   73
            M+LL+DNYDSFTYNL QYLS + E  V+ N  PNL+ +A+ A A+VLSPGPG PK+A +M
Sbjct:    1 MILLIDNYDSFTYNLAQYLSEFDETIVLYNQDPNLYDMAKKANALVLSPGPGWPKEANQM   60

Query:   74 VELINQFIGKKPILGICLGHQALAECLGGRLNLANHVMHGKQSWVTINDHTSLFKGIDSP  133
             +LI  F   KPILG+CLGHQA+AE LGG L LA  VMHG+QS +      SLF+  +
Sbjct:   61 PKLIQDFYQTKPILGVCLGHQAIAETLGGTLRLAKRVMHGRQSTIETQGPASLFRSLPQE  120

Query:  134 TQVMRYHSLVVTDLPENIAVIARSNEDNEIMAFHCPSLKVYAMQFHPESIGSIDGMKMIE  193
             VMRYHS+VV  LP+  +V AR +D EIMAF   +L ++ +QFHPESIG+ DGM MI
Sbjct:  121 ITVMRYHSIVVDQLPKGFSVTARDCDDQEIMAFEHHTLPLFGLQFHPESIGTPDGMTMIA  180

Query:  194 NFLTLI                                                       199
            NF+  I
Sbjct:  181 NFIAAI                                                       186
```

Based on this analysis, it was predicted that these proteins and their epitopes could be useful antigens for vaccines or diagnostics.

EXAMPLE 53

A DNA sequence (GBSx0052) was identified in *S. agalactiae* <SEQ ID 167> which encodes the amino acid sequence <SEQ ID 168>. Analysis of this protein sequence reveals the following:

```
Possible site: 58
>>> Seems to have a cleavable N-term signal seq.
     INTEGRAL    Likelihood = -8.17    Transmembrane    117-133 (108-140)
     INTEGRAL    Likelihood = -1.70    Transmembrane    150-166 (150-166)

----- Final Results -----
             bacterial membrane  --- Certainty = 0.4270(Affirmative) < succ>
             bacterial outside   --- Certainty = 0.0000(Not Clear)   < succ>
             bacterial cytoplasm --- Certainty = 0.0000(Not Clear)   < succ>
```

The protein has homology with the following sequences in the GENPEPT database:

```
>GP: CAB12877 GB: Z99109 similar to biotin biosynthesis [Bacillus subtilis]
Identities = 70/168 (41%), Positives = 106/168 (62%)

Query:    8 YIALMVALLIVLGFIPGIPLGFIPVPIVLQNLGVMLAGALLGSRKGFLAVAIFLLLVAIG    67
            +IA+    AL+ VLGF+P + L F PVPI LQ LGVMLAG++L   +   FL+   +FLLLVA G
Sbjct:    9 HIAIFTALMAVLGFMPPLFLSFTPVPITLQTLGVMLAGSILRPKSAFLSQLVFLLLVAFG    68

Query:   68 APFLPGGRSGLVTLFGPTAGYLLTYPFAAFFIGLGLEKVKTTKLWVQFLIIWIFGVLLID   127
            AP LPGGR G     FGP+AG+L+ YP A++ I L   +++   +    F    +FG++ I
Sbjct:   69 APLLPGGRGGFGVFFGPSAGFLIAYPLASWLISLAANRLRKVTVLRLFFTHIVFGIIFIY   128

Query:  128 ICGSIVLSFQTSLPLTKSLFSNLIFIPGDTLKASICLIIYRKFANRLT              175
            + G  V +F   + L+++ F +L ++PGD +KA++   +   K    L+
Sbjct:  129 LLGIPVQAFIMHIDLSQAAFMSLAYVPGDLIKAAVSAFLAIKITQALS              176
```

A related DNA sequence was identified in *S. pyogenes* <SEQ ID 169> which encodes the amino acid sequence <SEQ ID 170>. Analysis of this protein sequence reveals the following:

```
Possible site: 51
>>> Seems to have an uncleavable N-term signal seq
     INTEGRAL    Likelihood = -10.03   Transmembrane    113-129 (109-139)
     INTEGRAL    Likelihood = -8.97    Transmembrane     55-71  (52-76)
     INTEGRAL    Likelihood = -7.54    Transmembrane     10-26  (6-38)
     INTEGRAL    Likelihood = -5.79    Transmembrane     86-102 (81-105)
     INTEGRAL    Likelihood = -2.87    Transmembrane     33-49  (28-51)
     INTEGRAL    Likelihood = -1.97    Transmembrane    150-166 (150-168)

----- Final Results -----
             bacterial membrane  --- Certainty = 0.5012(Affirmative) < succ>
             bacterial outside   --- Certainty = 0.0000(Not Clear)   < succ>
             bacterial cytoplasm --- Certainty = 0.0000(Not Clear)   < succ>
```

An alignment of the GAS and GBS proteins is shown below:

```
Identities = 80/168 (47%), Positives = 108/168 (63%), Gaps = 1/168 (0%)

Query:    3 TRTTTYIALMVALLIVLGFIPGIPLGFIPVPIVLQNLGVMLAGALLGSRKGFLAVAIFLL    62
            T+    +A+M  L+I+LGFIP IPLGFIPVPIVLQNLGVMLAG +LG +KG L+V +F L
Sbjct:    4 TKELVKVAMMTTLIIILGFIPAIPLGFIPVPIVLQNLGVMLAGLMLGGKKGTLSVFLF-L    62

Query:   63 LVAIGAPFLPGGRSGLVTLFGPTAGYLLTYPFAAFFIGLGLEKVKTTKLWVQFLIIWIFG   122
            ++ +   P   G R+ +  L GP+AGY++  Y  L     +     + FL + I G
Sbjct:   63 VIGLFLPVFSGSRTTIPVLMGPSAGYVIAYLLVPIVFSLLYRNWFSKSTPLAFLALLISG   122

Query:  123 VLLIDICGSIVLSFQTSLPLTKSLFSNLIFIPGDTLKASICLIIYRKF              170
            V+L+D+  G+I LS  T + L  SL SNL+FIPGDT+KA I    II  K+
Sbjct:  123 VVLVDVLGAIWLSAYTGMSLVTSLLSNLVFIPGDTIKAIIATIIAVKY              170
```

Based on this analysis, it was predicted that these proteins and their epitopes could be useful antigens for vaccines or diagnostics.

EXAMPLE 54

A DNA sequence (GBSx0053) was identified in *S. agalactiae* <SEQ ID 171> which encodes the amino acid sequence <SEQ ID 172>. Analysis of this protein sequence reveals the following:

```
Possible site: 17
>>> Seems to have no N-terminal signal sequence

----- Final Results -----
          bacterial cytoplasm --- Certainty = 0.3914(Affirmative) < succ>
           bacterial membrane --- Certainty = 0.0000(Not Clear)   < succ>
            bacterial outside --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 55

A DNA sequence (GBSx0054) was identified in *S. agalactiae* <SEQ ID 173> which encodes the amino acid sequence <SEQ ID 174>. Analysis of this protein sequence reveals the following:

```
Possible site: 15
>>> Seems to have no N-terminal signal sequence

----- Final Results -----
          bacterial cytoplasm --- Certainty = 0.1864(Affirmative) < succ>
           bacterial membrane --- Certainty = 0.0000(Not Clear)   < succ>
            bacterial outside --- Certainty = 0.0000(Not Clear)   < succ>
```

A related GBS nucleic acid sequence <SEQ ID 9611> which encodes amino acid sequence <SEQ ID 9612> was also identified.

The protein has homology with the following sequences in the GENPEPT database:

```
>GP: BAB05467 GB: AP001513 biotin synthase [Bacillus halodurans]
Identities = 133/316 (42%), Positives = 201/316 (63%), Gaps = 2/316 (0%)

Query:  17 NYIHLADEILSGKTSISYEQALEILNS-DENWWEIYAAALYLKNQVSRNNIRLNVLLSAK   75
           N+I LA E++ GK  IS  +AL ILNS D+    + A  ++         ++LN++++AK
Sbjct:   2 NWIQLAQEVIEGKR-ISENEALAILNSPDDELLLLLQGAFTIRQTYYGKKVKLNMIMNAK   60

Query:  76 QGLCAENCGYCSQSKESTADIDKFGLLPQNVILKQAIVAHQNGASVFCIAMSGTKPSKRE  135
              G C ENCGYCSQS  S A ID + ++ +   IL+ A  AH+     +CI   SG P+ R+
Sbjct:  61 SGFCPENCGYCSQSSISKAPIDAYPMVNKETILEGAKRAHELNVGTYCIVASGRGPTNRD  120

Query: 136 IEQLCQVIPEIKKSLPLEICLTAGFLDREQLHQLKQAGIDRINHNLNTPEENYPNIATTH  195
           I+ + + + EIK +   L+IC    G L   EQ  QLK AG+DR NHN+NT    ++  I T+H
Sbjct: 121 IDHVTEAVREIKDTYGLKICACLGILKPEQAEQLKAAGVDRYNHNVNTSARHHDQITTSH  180

Query: 196 SFKDRCDTLERIHNEDIDVCSGFICGMGESDEGLITLAFRLKELDPYSIPVNFLLAVEGT  255
           +++DR +T+E + +  I   CSG I GM E+ E ++ +AF+L+ELD   SIPVNFL A++GT
Sbjct: 181 TYEDRVNTVEVVKHSGISPCSGVIVGMKETKEDVVDMAFQLRELDADSIPVNFLHAIDGT  240

Query: 256 PLGKYNYLTPIKCLKIMAMLRFVFPFKELRLSAGREVHFENFESLVTLLVDSTFLGNYLT  315
           PL   + LTPI CLK++++    R+V P  KE+R+S GREV+ ++ + + L    +S F+G+YLT
Sbjct: 241 PLQGVHELTPIYCLKVLSLFRYVCPTKEIRISGGREVNLKSLQPLGLYAANSIFIGDYLT  300
```

```
Query:  316 EGGRNQHTDIEFLEKL                                                  331
            G+ +   D + L+ L
Sbjct:  301 TAGQEETADHQILKDL                                                  316
```

No corresponding DNA sequence was identified in S. pyogenes.

Based on this analysis, it was predicted that this protein and its epitopes, could be useful antigens for vaccines or diagnostics.

EXAMPLE 56

A DNA sequence (GBSx0055) was identified in S. agalactiae <SEQ ID 175> which encodes the amino acid sequence <SEQ ID 176>. Analysis of this protein sequence reveals the following:

```
Possible site: 24
>>> Seems to have no N-terminal signal sequence

----- Final Results -----
          bacterial cytoplasm --- Certainty = 0.3440(Affirmative) < succ>
          bacterial membrane  --- Certainty = 0.0000(Not Clear)   < succ>
           bacterial outside  --- Certainty = 0.0000(Not Clear)   < succ>
```

A related GBS nucleic acid sequence <SEQ ID 9613> which encodes amino acid sequence <SEQ ID 9614> was also identified.

The protein has no significant homology with any sequences in the GENPEPT database.

No corresponding DNA sequence was identified in S. pyogenes.

Based on this analysis, it was predicted that this protein and its epitopes, could be useful antigens for vaccines or diagnostics.

EXAMPLE 57

A DNA sequence (GBSx0056) was identified in S. agalactiae <SEQ ID 177> which encodes the amino acid sequence <SEQ ID 178>. Analysis of this protein sequence reveals the following:

```
Possible site: 15
>>> Seems to have no N-terminal signal sequence

----- Final Results -----
          bacterial cytoplasm --- Certainty = 0.1985(Affirmative) < succ>
          bacterial membrane  --- Certainty = 0.0000(Not Clear)   < succ>
           bacterial outside  --- Certainty = 0.0000(Not Clear)   < succ>
```

The protein has no significant homology with any sequences in the GENPEPT database.

No corresponding DNA sequence was identified in S. pyogenes.

Based on this analysis, it was predicted that this protein and its epitopes, could be useful antigens for vaccines or diagnostics.

EXAMPLE 58

A DNA sequence (GBSx0057) was identified in S. agalactiae <SEQ ID 179> which encodes the amino acid sequence <SEQ ID 180>. Analysis of this protein sequence reveals the following:

```
Possible site: 32
>>> Seems to have no N-terminal signal sequence
       INTEGRAL     Likelihood = -0.11   Transmembrane   347-363 (347-363)

----- Final Results -----
           bacterial membrane  --- Certainty = 0.1044(Affirmative) < succ>
            bacterial outside  --- Certainty = 0.0000(Not Clear)   < succ>
          bacterial cytoplasm  --- Certainty = 0.0000(Not Clear)   < succ>
```

The protein has homology with the following sequences in the GENPEPT database:

```
>GP: CAC11722 GB: AL445064 acetyl-CoA acetyltransferase related
protein [Thermoplasma acidophilum]
Identities = 113/388 (29%), Positives = 181/388 (46%), Gaps = 31/388 (7%)

Query:    4 RDVYIGFGLRTPIGIKGKQFKHYR-PELLGAHLLNQIKKIESESNID-----SIICGNTV   57
            RDV+I   RT IG G+ F  + P+L GA     IK +  E+++D      +I GN +
Sbjct:    2 RDVFIVAAKRTAIGKFGRSFSKLKAPQLGGA----AIKAVMDEAHVDPASVEEVIMGNVI   57

Query:   58 --GTGGNIGRLMTLFSDYESYIPVQTIDMQCASSSSALFFGYLKISTGINEKVLVGGIES  115
              G G N         + +    T+++ CAS   A+    +I+ G  + V+ GG+ES
Sbjct:   58 QAGNGQNPAGQAAFHGGLPNSVLKYTVNVVCASGMLAVESAAREIALGERDLVIAGGMES  117

Query:  116 SSLQPMR-----RYAKEDNRNGEYTVAQ-FSPDSYAETVMLE----GAQRVCQKYGFRRE  165
             S  P      R+ +  + Y +   D   +  E    A+R  +K+G  RE
Sbjct:  118 MSNAPFLLPADLRWGPKHLLHKNYKIDDAMLTDGLLDAFYFEHMGVSAERTSRKFGITRE  177

Query:  166 MLDKLAFLSHKRALTAKQGGYLEEVILPMEGM-RDQGVRKLKETFFQKLPRLMENSPLLT  224
            M D+ +  S++RA+  A + G   + I+  EG+  D+G+RK    +LP  + + +LT
Sbjct:  178 MADEYSVQSYERAIRATESGEFADEIVQFEGLDHDEGIRKTTMEDLARLPPAFDKNGILT  237

Query:  225 IGNVCLMHDAAAFLTLQSQKT--EFRIVHIVEVAG------DPKLSPELVHTATEKLLTE  276
               GH    + D  + L  + S+K   E+ +  I + G       DP     E   AT KLL +
Sbjct:  238 AGNSAQLSDGGSALMIASEKAINEYGLKPIARITGYEQASLDPLDFVEAPIPATRKLLEK  297

Query:  277 THTKISDYDAIEWNEPFAAIDALFNHYYPEEREKFNIFGGTLAYGHPYACSGIINILHLM  336
            H I  YD +E NE F+   + +    + E+FN+ GG +A GHP    SG   I+ LM
Sbjct:  298 QHKSIDYYDLVEHNEAFSIASVIVRNELKIDNERFNVNGGAVAIGHPIGNSGARIIVTLM  357

Query:  337 QALKYKNKPMGLTAIAGAGGVGMAISIE                                 364
             ALK+++    GL +    GG    +++E
Sbjct:  358 NALKHRHLKTGLATLCHGGGGAHTLTLE                                 385
```

30

A related DNA sequence was identified in *S. pyogenes* <SEQ ID 181> which encodes the amino acid sequence <SEQ ID 182>. Analysis of this protein sequence reveals the following:

```
Possible site: 22
>>> Seems to have no N-terminal signal sequence
    INTEGRAL    Likelihood = -1.28    Transmembrane     345-361 (345-361)

----- Final Results -----
              bacterial membrane --- Certainty = 0.1510(Affirmative) < succ>
               bacterial outside --- Certainty = 0.0000(Not Clear)   < succ>
             bacterial cytoplasm --- Certainty = 0.0000(Not Clear)   < succ>
```

The protein has homology with the following sequences in the databases:

```
>GP: BAB03328 GB: AB035449 acetyl-CoA c-acetyltransferase
[Staphylococcus aureus]
Identities = 115/382 (30%), Positives = 184/382 (48%), Gaps = 29/382 (7%)

Query:    1 MTDVYIAAGLRTPIGLVGKQFAKEQPEILGAKLINALQNKYPV---PIDQVICGNTVGTG   57
            M    I A RT  G  G   +  +PE L   L  + KYP     ID V+ GN VG G
Sbjct:    1 MNQAVIVAAKRTAFGKYGGTLKHLEPEQLLKPLFQHFKEKYPEVISKIDDVVLGNVVGNG   60

Query:   58 GNIGRLMTLYSHLGESVSALTVDMQCASAGAALSVGYAKIKAGMASNLLVGGIESSS---  114
            GNI R   L + L +S+   +T+D QC S   ++      I+AG    + GG+ES+S
Sbjct:   61 GNIARKALLEAGLKDSIPGVTIDRQCGSGLESVQYACRMIQAGAGKVYIAGGVESTSRAP  120

Query:  115 ---LQPESVYASADWRQGAYKVAQFSPDSISPFAMIEGAERVAREHGFTKEYLNHWTLRS  171
               +P SVY +A     Y+ A F+P+   P +MI+GAE VA+ +  ++E  +  RS
Sbjct:  121 WKIKRPHSVYETA--LPEFYERASFAPEMSDP-SMIQGAENVAKMYDVSRELQDEFAYRS  177

Query:  172 HQKASYCQEQALLADLILDLSGA-----SDQGIRPRLSSKVLSKVPPILGEGHVISAANA  226
            HQ  +    +  IL ++      +D+ ++  +       P++  +G  ++AAN+
Sbjct:  178 HQLTAENVKNGNISQEILPITVKGEIFNTDESLKSHIPKDNFGRFKPVI-KGGTVTAANS  236

Query:  227 CLTHDAAAFLQLSSQPSAFKL--------IDVVEVAGDPQRSPLMVIKASQVLLEKHGLG  278
            C+ +D A  L + + A++L        D V V D     + A   LL+++ L
Sbjct:  237 CMKNDGAVLLLIMEKDMAYELGFEHGLLFKDGVTVGVDSNFPGIGPVPAISNLLKRNQLT  296
```

-continued

```
Query: 279 MADMTAIEWNEAFAVIDGLFETHYPDLLDRYNIFGGALAYGHPYGASAAIIILHLMRALE 338
            + ++  IE NEAF+     +        + NI+GGALA GHPYGAS A ++  L     +
Sbjct: 297 IENIEVIEINEAFSAQVVACQQALNISNTQLNIWGGALASGHPYGASGAQLVTRLFYMFD 356

Query: 339 IKNGRYGIAAIAAAGGQGFAVL                                       360
            +      IA++   GG G A L
Sbjct: 357 KET---MIASMGIGGGLGNAAL                                       375
```

An alignment of the GAS and GBS proteins is shown below:

```
Identities = 182/362 (50%), Positives = 243/362 (66%), Gaps = 2/362 (0%)

Query:   5 DVYIGFGLRTPIGIKGKQFKHYRPELLGAHLLNQIKKIESESNIDSIICGNTVGTGGNIG   64
           DVYI  GLRTPIG+ GKQF    +PE+LGA L+N ++  +    ID +ICGNTVGTGGNIG
Sbjct:   3 DVYIAAGLRTPIGLVGKQFAKEQPEILGAKLINALQN-KYPVPIDQVICGNTVGTGGNIG   61

Query:  65 RLMTLFSDYESYIPVQTIDMQCASSSSALFFGYLKISTGINEKVLVGGIESSSLQPMRRY  124
           RLMTL+S     +   T+DMQCAS+ +AL  GY KI  G+    +LVGGIESSSLQP  Y
Sbjct:  62 RLMTLYSHLGESVSALTVDMQCASAGAALSVGYAKIKAGMASNLLVGGIESSSLQPESVY  121

Query: 125 AKEDNRNGEYTVAQFSPDSYAETVMLEGAQRVCQKYGFRREMLDKLAFLSHKRALTAKQG  184
              A  D R G Y VAQFSPDS +    M+EGA+RV +++GF +E L+     SH++A  ++
Sbjct: 122 ASADWRQGAYKVAQFSPDSISPFAMIEGAERVAREHGFTKEYLNHWTLRSHQKASYCQEQ  181

Query: 185 GYLEEVILPMEGMRDQGVR-KLKETFFQKLPRLMENSPLLTIGNVCLMHDAAAFLTLQSQ  243
               L ++IL + G  DQG+R +L      K+P ++     +++  N CL HDAAAFL L SQ
Sbjct: 182 ALLADLILDLSGASDQGIRPRLSSKVLSKVPPILGEGHVISAANACLTHDAAAFLQLSSQ  241

Query: 244 KTEFRIVHIVEVAGDPKLSPELVHTATEKLLTETHTKISDYDAIEWNEPFAAIDALFNHY  303
             + F+++ +VEVAGDP+ SP +V  A++ LL +      ++D  AIEWNE FA ID LF  +
Sbjct: 242 PSAFKLIDVVEVAGDPQRSPLMVIKASQVLLEKHGLGMADMTAIEWNEAFAVIDGLFETH  301

Query: 304 YPEEREKFNIFGGTLAYGHPYACSGIINILHLMQALKYKNKPMGLTAIAGAGGVGMAISIEY  365
           YP+   +++NIFGG LAYGHPY  S  I ILHLM+AL+  KN   G+ AIA AGG G A+  ++Y
Sbjct: 302 YPDLLDRYNIFGGALAYGHPYGASAAIIILHLMRALEIKNGRYGIAAIAAAGGQGFAVLLKY  363
```

Based on this analysis, it was predicted that these proteins and their epitopes could be useful antigens for vaccines or diagnostics.

EXAMPLE 59

A DNA sequence (GBSx0058) was identified in *S. agalactiae* <SEQ ID 183> which encodes the amino acid sequence <SEQ ID 184>. Analysis of this protein sequence reveals the following:

```
Possible site: 13
>>> Seems to have no N-terminal signal sequence
      INTEGRAL    Likelihood = -3.82    Transmembrane    149-165 (148-165)

----- Final Results -----
              bacterial membrane --- Certainty = 0.2529(Affirmative) < succ>
               bacterial outside --- Certainty = 0.0000(Not Clear) < succ>
              bacterial cytoplasm --- Certainty = 0.0000(Not Clear) < succ>
```

The protein has homology with the following sequences in the GENPEPT database:

```
>GP: CAB12876 GB: Z99109 similar to long-chain fatty-acid-CoA ligase
[Bacillus subtilis]
Identities = 90/382 (23%), Positives = 158/382 (40%), Gaps = 24/382 (6%)

Query:  47 ISTHSLLNQLVRFVSKLCQKALPIICKPNLTHNEISRLEKEV--QYAPQLADFGVLSSGT  104
           IS   L+  L F +KL    P++   N +IS   +    P+   + +SG+
Sbjct:  95 ISNADLVVTLAFFKNKLTDSQTPVVLLDNCMA-DISEAAADPLPTIDPEHPFYMGFTSGS  153

Query: 105 TADAKLLWRSFTSWSDFFSIQNAYFSVTSNSKLFIQGDFSFTGNLNLALSLLLLGGTLVV  164
           T   K   RS  SW + F+    FS++S+ K+ I G     +   L A+S L LGGT+ +
Sbjct: 154 TGKPKAFTRSHRSWMESFTCTETDFSISSDDKVLIPGALMSSHFLYGAVSTLFLGGTVCL  213
```

```
Query: 165 TQKNSVKYWQTLWEKTGVTHLYLLPSYLKLVEQYSKETALDNKTIITSSQYVSDSLLEGL  224
            +K S     +      +  ++ LY +P+    + +           K I  +  +  ++S   + L
Sbjct: 214 LKKFSPAKAKEWLCRESISVLYTVPTMTDALARIEGFPDSPVKIISSGADWPAES-KKKL  272

Query: 225 YRKHPKVSVKIFYGASELNYVSWYDGRDIRDKPQYVGEIVPNVAVRIKE-----------  273
                 P + +  FYG SEL++V++      D + KP     G     NV + I+
Sbjct: 273 AAAWPHLKLYDFYGTSELSFVTFSSPEDSKRKPHSAGRPFHNVRIEIRNAGGERCQPGEI  332

Query: 274 GRIFVKTPYSICG-----LSSEYCAGDYGELID--GKLYLFGRGGDWCNQSGIKLYLPRL  326
            G+IFVK+P    G          E+    D    +D  G LY+ GR       G+ ++    +
Sbjct: 333 GKIFVKSPMRFSGYVNGSTPDEWMTVDDMGYVDEEGFLYISGRENGMIVYGGLNIFPEEI  392

Query: 327 IEKIKTCPYIKDAVAFTKESQSHGQESHCCIVLIENQMQQECLKWLSEHFEKKYGFKHYH  386
              +    CP ++ A           +  G+ +        V++ N     +      W  +         K +
Sbjct: 393 ERVLLACPEVESAAVVGIPDEYWGEIA--VAVILGNANARTLKAWCKQKLASYKIPKKWV  450

Query: 387 IVSKIPLMPSGKIDYQQLKRQL                                       408
                   +P    SGKI    ++K+  L
Sbjct: 451 FADSLPETSSGKIARSRVKKWL                                       472
```

A related DNA sequence was identified in *S. pyogenes* <SEQ ID 185> which encodes the amino acid sequence <SEQ ID 186>. Analysis of this protein sequence reveals the following:

```
Possible site: 52
>>> Seems to have no N-terminal signal sequence

----- Final Results -----
            bacterial cytoplasm --- Certainty = 0.2487(Affirmative) < succ>
            bacterial membrane --- Certainty = 0.0000(Not Clear)   < succ>
             bacterial outside --- Certainty = 0.0000(Not Clear)   < succ>
```

An alignment of the GAS and GBS proteins is shown below:

```
Identities = 154/413 (37%), Positives = 235/413 (56%), Gaps = 9/413 (2%)

Query:   1 MLESLKTIVKTNSDKKLFDGD-LQVSYGEFYNLVR-QDMASQDNRKHVISTHSLLNQLVR   58
           ML  L+   K   +KK    D + ++Y E +  V   +D    +D+  ++IS    LNQL+
Sbjct:   1 MLTKLEYWAKQCPNKKAIVADQISLTYQELWQAVLIKDQTIKDSVPYIISHSRYLNQLLS   60

Query:  59 FVSKLCQKALPIICKPNLT---HNEISRLEKEVQYAPQLADFGVLSSGTTADAKLLWRSF  115
           F+  L + + PII  PN++      +I  ++ E+    + ADF VLSSGTT  AKL WR
Sbjct:  61 FLRGLKEGSCPIILHPNISGTFQQQIKHVDGELL---KKADFAVLSSGTTGKAKLFWRRL  117

Query: 116 TSWSDFFSIQNAYFSVTSNSKLFIQGDFSFTGNLNLALSLLLLGGTLVVTQKNSVKYWQT  175
           ++W+   F   QN  F +T NS LF+  G FSFTGNLNLAL+  L   GG LV++QK S+K W +
Sbjct: 118 STWTRLFDYQNKVFGMTGNSCLFLHGSFSFTGNLNLALAQLWAGGCLVLSQKLSLKTWLS  177

Query: 176 LWEKTGVTHLYLLPSYLKLVEQYSKETALDNKTIITSSQYVSDSLLEGLYRKHPKVSVKI  235
           LW+     V+HLYLLP+YL   +  Y   +  +    ++TSSQ +S  LL    Y+K P++ + I
Sbjct: 178 LWQAKKVSHLYLLPTYLNRLLPYLTKNNMTATHLLTSSQMISQELLRHYYKKFPQLEIVI  237

Query: 236 FYGASELNYVSWYDGRDIRDKPQYVGEIVPNVAVRIKEGRIFVKTPYSICGLSSEYCAGD  295
           FYGASEL++++W +GR         VG+   P+V++    K+   IFV+TPYS+  G+S  Y     D
Sbjct: 238 FYGASELSFITWCNGRAAVKINGLVGQPFPDVSISFKDKEIFVETPYSVEGMSQPYSVSD  297

Query: 296 YGELIDGKLYLFGRGGDWCNQSGIKLYLPRLIEKIKTCPYIKDAVAFTKESQSHGQESHC  355
             G++        L  L GR  DW  NQ G+K  +LP L+E          P +K+A  A    K  +            +
Sbjct: 298 LGKMSPAGLILEGRQDDWVNQRGVKCHLPSLVELAHQAPNVKEAHAL-KIGKGENETLIL  356

Query: 356 CIVLIENQMQQECLKWLSEHFEKKYGFKHYHIVSKIPLMPSGKIDYQQLKRQL         408
            +VL +            +L+  +         K+Y ++    +PL  +GKI+  +  L  ++
Sbjct: 357 VLVLTKKDCLAPIKDFLALYLNSGQLPKYYLVIDCLPLKDNGKINREVLLNKI         409
```

Based on this analysis, it was predicted that these proteins and their epitopes could be useful antigens for vaccines or diagnostics.

EXAMPLE 60

A DNA sequence (GBSx0059) was identified in *S. agalactiae* <SEQ ID 187> which encodes the amino acid sequence <SEQ ID 188>. This protein is predicted to be endonuclease III (pdg). Analysis of this protein sequence reveals the following:

Possible site: 46
>>> Seems to have no N-terminal signal sequence
     INTEGRAL     Likelihood = -0.00    Transmembrane     25-41 (25-41)

----- Final Results -----
              bacterial membrane --- Certainty = 0.1001(Affirmative) < succ>
               bacterial outside --- Certainty = 0.0000(Not Clear)   < succ>
             bacterial cytoplasm --- Certainty = 0.0000(Not Clear)   < succ>

The protein has homology with the following sequences in the GENPEPT database:

>GP: BAB05417 GB: AP001512 endonuclease III (DNA repair) [*Bacillus halodurans*]
Identities = 95/202 (47%), Positives = 134/202 (66%)

```
Query:    1 MLSKAKSRYIIREIIKLFPDAKPSLDFTNVFELLVAVMLSAQTTDAAVNKVTPALFERFP    60
            ML+K +++  +  I  ++PDA+  L  +N FELL+AV+LSAQ TDA VNKVTP LF ++
Sbjct:    1 MLTKKQTQEALAVIADMYPDAECELTHSNPFELLIAVVLSAQCTDALVNKVTPRLFAKYK    60

Query:   61 NPLVLAQADPKEIEPYISKIGLYRNKARFLNQCAKQLIEHFDGKVPRTRQELESLAGVGR   120
            P        +E+E  I  IGLYRNKA+ + +  + L+E + G+VP+ R EL   LAGVGR
Sbjct:   61 TPEDYIAVPLEELEQDIRSIGLYRNKAKNIKKLCQSLLEQYGGEVPQDRDELVKLAGVGR   120

Query:  121 KTANVVMSVGFGIPAFAVDTHVTRICKHHQICKQSASPLEIEKRVMEVLPPEEWLAAHQS   180
            KTANVV  SV FG+PA AVDTHV R+ K     IC+  +   ++E+ +M+ +P +EW   +H
Sbjct:  121 KTANVVASVAFGVPAIAVDTHVERVSKRLGICRWKDNVTQVEQTLMKKIPMDEWSISHHR   180

Query:  181 MIYFGRAICHPKNPKCDQYPQL                                       202
            +I+FGR  C   +NP+CD  P L
Sbjct:  181 LIFFGRYHCKAQNPQCDICPLL                                       202
```

A related DNA sequence was identified in *S. pyogenes*
<SEQ ID 189> which encodes the amino acid sequence
<SEQ ID 190>. Analysis of this protein sequence reveals the
following:

Possible site: 44
>>> Seems to have a cleavable N-term signal seq.

----- Final Results -----
               bacterial outside --- Certainty = 0.3000(Affirmative) < succ>
              bacterial membrane --- Certainty = 0.0000(Not Clear)   < succ>
             bacterial cytoplasm --- Certainty = 0.0000(Not Clear)   < succ>

An alignment of the GAS and GBS proteins is shown below:

Identities = 91/199 (45%), Positives = 133/199 (66%)

```
Query:    2 LSKAKSRYIIREIIKLFPDAKPSLDFTNVFELLVAVMLSAQTTDAAVNKVTPALFERFPN    61
            + KA+  ++  I  ++FP+AK  LD+   F+LL+AV+LSAQTTD AVNKVTP L++ +P
Sbjct:    3 IGKARLAKVLTIIGQMFPEAKGELDWETPFQLLIAVILSAQTTDKAVNKVTPGLWQSYPE    62

Query:   62 PLVLAQADPKEIEPYISKIGLYRNKARFLNQCAKQLIEHFDGKVPRTRQELESLAGVGRK   121
              LA A+   ++E +  IGLY+NKA+ +  + A+ +  +  F G+VP+T +ELESL GVGRK
Sbjct:   63 IEDLAFAELSDVENALRTIGLYKNKAKNIIKTAQAIRDDFKGQVPKTHKELESLPGVGRK   122

Query:  122 TANVVMSVGFGIPAFAVDTHVTRICKHHQICKQSASPLEIEKRVMEVLPPEEWLAAHQSM   181
            TANVV++  +G+PA AVDTHV R+ K   I    A    +IE +M  +P ++W+   H  +
Sbjct:  123 TANVVLAEVYGVPAIAVDTHVARVSKRLNISSPDADVKQIEADLMAKIPKKDWIITHHRL   182

Query:  182 IYFGRAICHPKNPKCDQYP                                          200
            I+FGR  C   K PKC+  P
Sbjct:  183 IFFGRYHCLAKKPKCEICP                                          201
```

Based on this analysis, it was predicted that these proteins and their epitopes could be useful antigens for vaccines or diagnostics.

EXAMPLE 61

A DNA sequence (GBSx0060) was identified in *S. agalactiae* <SEQ ID 191> which encodes the amino acid sequence <SEQ ID 192>. Analysis of this protein sequence reveals the following:

```
Possible site: 51
>>> Seems to have no N-terminal signal sequence

----- Final Results -----
             bacterial cytoplasm --- Certainty = 0.2264 (Affirmative) < succ>
             bacterial membrane  --- Certainty = 0.0000 (Not Clear)   < succ>
              bacterial outside  --- Certainty = 0.0000 (Not Clear)   < succ>
```

The protein has homology with the following sequences in the GENPEPT database:

```
>GP:BAA96473 GB:AB036428 hypothetical 8.3 kDa protein [Streptococcus mutans]
Identities = 53/67 (79%), Positives = 62/67 (92%)

Query:   1 MKVLFDVQNLLKKFGIYVYIGKRLYDIEVMKIELQRLYDNGLISRDDYLKAELILRREHR   60
           MK L+DVQ LLK+FGI+VY+GKRLYDIE+MKIEL+RLYDNGLIS+ DYL AELILRREHR
Sbjct:   1 MKTLYDVQRLLKQFGIFVYLGKRLYDIEMMKIELERLYDNGLISKSDYLHAELILRREHR   60

Query:  61 LELEKEN                                                       67
           +E E+EN
Sbjct:  61 IEKEREN                                                       67
```

A related DNA sequence was identified in *S. pyogenes* <SEQ ID 193> which encodes the amino acid sequence <SEQ ID 194>. Analysis of this protein sequence reveals the following:

```
Possible site: 57
>>> Seems to have no N-terminal signal sequence

----- Final Results -----
             bacterial cytoplasm --- Certainty = 0.1962 (Affirmative) < succ>
             bacterial membrane  --- Certainty = 0.0000 (Not Clear)   < succ>
              bacterial outside  --- Certainty = 0.0000 (Not Clear)   < succ>
```

An alignment of the GAS and GBS proteins is shown below:

```
Identities = 53/66 (80%), Positives = 60/66 (90%)

Query:   1 MKVLFDVQNLLKKFGIYVYIGKRLYDIEVMKIELQRLYDNGLISRDDYLKAELILRREHR   60
           MK L+DVQ LLK FGI+VY+GKRLYDIE+MKIELQRLYD+GL+ + DYL AELILRREHR
Sbjct:   7 MKTLYDVQQLLKNFGIFVYLGKRLYDIEMMKIELQRLYDSGLLDKRDYLNAELILRREHR   66

Query:  61 LELEKE                                                        66
           LELEKE
Sbjct:  67 LELEKE                                                        72
```

Based on this analysis, it was predicted that these proteins and their epitopes could be useful antigens for vaccines or diagnostics.

EXAMPLE 62

A DNA sequence (GBSx0061) was identified in *S. agalactiae* <SEQ ID 195> which encodes the amino acid sequence <SEQ ID 196>. Analysis of this protein sequence reveals the following:

```
Possible site: 31
>>> Seems to have no N-terminal signal sequence
     INTEGRAL    Likelihood = -0.06   Transmembrane   133-149 (133-150)

----- Final Results -----
              bacterial membrane --- Certainty = 0.1022(Affirmative) < succ>
               bacterial outside --- Certainty = 0.0000(Not Clear)   < succ>
             bacterial cytoplasm --- Certainty = 0.0000(Not Clear)   < succ>
```

The protein has homology with the following sequences in the GENPEPT database:

```
>GP: BAB05144 GB: AP001512 glucose kinase [Bacillus halodurans]
Identities = 145/315 (46%), Positives = 209/315 (66%), Gaps = 2/315 (0%)

Query:   6 LGIDLGGTTIKFGILTLEGEVQEKWAIETNTLENGRHIVSDIVESLKHRLSLYGLTKDDF   65
           +G+D+GGTTIK    LT  GE+ +KW I TN  + G   I ++I ++L  RLS +  +K D
Sbjct:   7 VGVDVGGTTIKMAFLTTAGEIVDKWEIPTNKQDGGALITTNIADALDKRLSGHHKSKSDL   66

Query:  66 LGIGMGSPGAVDRTSKTVTGAFNLNWADTQEVGSVIEKEVGIPFFIDNDANVAALGERWV  125
           +GIG+G+PG ++  +   A N+ W D    +E+E  +P  +DNDAN+AALGE W
Sbjct:  67 IGIGLGAPGFIEMDTGFIYHAVNIGWRDFP-LKDKLEEETKLPVIVDNDANIAALGEMWK  125

Query: 126 GAGANNPDVVFVTLGTGVGGGVIADGNLIHGVAGAGGEIGHMIVDPENGFTCTCGNKGCL  185
            GAG    +++ +TLGTGVGGG++A+GN++HGV G  GEIGH+  V PE  G  C CG   GCL
Sbjct: 126 GAGDGAKNMLLITLGTGVGGGIVANGNILHGVNGMAGEIGHITVIPEGGAPCNCGKTGCL  185

Query: 186 ETVASATGVVRVARQLAEQYEGSSAIKAAIDNGDTVTSKDIFIAAEDGDKFANSVVERVS  245
            ETVASATG+  R+A +    +++  S +      D    +T+KD+F AA+   D  FA SVV+ ++
Sbjct: 186 ETVASATGIARIATEGVTEHK-ESQLALDYDKHGVLTAKDVFSAADASDAFALSVVDHIA  244

Query: 246 RYLGLAAANISNILNPDSVVIGGGVSAAGEFLRSRVEKYFVTFAFPQVKKSTKIKIAELG  305
            YLG A AN++N LNP+ +VIGGGVS AG+ L   ++++F  +A P+V   + +IA LG
Sbjct: 245 YYLGFAIANLANALNPEKIVIGGGVSKAGDTLLKPIKQHFEAYALPRVADGAEFRIATLG  304

Query: 306 NDAGIIGAASLANQQ                                              320
           NDAG+IG   L    QQ
Sbjct: 305 NDAGVIGGGWLVKQQ                                              319
```

35

A related DNA sequence was identified in *S. pyogenes* <SEQ ID 197> which encodes the amino acid sequence <SEQ ID 198>. Analysis of this protein sequence reveals the following:

```
Possible site: 23
>>> Seems to have no N-terminal signal sequence

----- Final Results -----
             bacterial cytoplasm --- Certainty = 0.1060(Affirmative) < succ>
              bacterial membrane --- Certainty = 0.0000(Not Clear)   < succ>
               bacterial outside --- Certainty = 0.0000(Not Clear)   < succ>
```

An alignment of the GAS and GBS proteins is shown below:

```
Identities = 270/319 (84%), Positives = 292/319 (90%)

Query:   1 MSKKLLGIDLGGTTIKFGILTLEGEVQEKWAIETNTLENGRHIVSDIVESLKHRLSLYGL   60
           MS+KLLGIDLGGTTIKFGILT  GEVQEKWAIETN LE G+HIV DI+ S+KHRL LYGL
Sbjct:   1 MSQKLLGIDLGGTTIKFGILTAAGEVQEKWAIETNILEGGKHIVPDIIASIKHRLDLYGL   60

Query:  61 TKDDFLGIGMGSPGAVDRTSKTVTGAFNLNWADTQEVGSVIEKEVGIPFFIDNDANVAAL  120
           +   DF+GIGMGSPGAVDR +  TVTGAFNLNW +TQEVGSV+EKE+GIPF IDNDANVAAL
Sbjct:  61 SSADFVGIGMGSPGAVDRDTNTVTGAFNLNWKETQEVGSVVEKELGIPFAIDNDANVAAL  120

Query: 121 GERWVGAGANNPDVVFVTLGTGVGGGVIADGNLIHGVAGAGGEIGHMIVDPENGFTCTCG  180
           GERWVGAG NNPDVVF+TLGTGVGGG+IADGNLIHGVAGAGGEIGHMIV+PENGF CTCG
Sbjct: 121 GERWVGAGENNPDVVFMTLGTGVGGGIIADGNLIHGVAGAGGEIGHMIVEPENGFACTCG  180

Query: 181 NKGCLETVASATGVVRVARQLAEQYEGSSAIKAAIDNGDTVTSKDIFIAAEDGDKFANSV  240
           + GCLETVASATGVV+VAR LAE YEG SAIKAAIDNG+ VTSKDIF+AAE GD FA+SV
Sbjct: 181 SHGCLETVASATGVVKVARLLAEAYEGDSAIKAAIDNGEGVTSKDIFMAAEAGDSFADSV  240
```

-continued

```
Query: 241 VERVSRYLGLAAANISNILNPDSVVIGGGVSAAGEFLRSRVEKYFVTFAFPQVKKSTKIK 300
            VE+V  YLGLA+ANISNILNPDSVVIGGGVSAAGEFLRSR+EKYFVTF FPQV+ STKIK
Sbjct: 241 VEKVGYYLGLASANISNILNPDSVVIGGGVSAAGEFLRSRIEKYFVTFTFPQVRYSTKIK 300

Query: 301 IAELGNDAGIIGAASLANQ                                         319
            IAELGNDAGIIGAASLA Q
Sbjct: 301 IAELGNDAGIIGAASLARQ                                         319
```

Based on this analysis, it was predicted that these proteins and their epitopes could be useful antigens for vaccines or diagnostics.

EXAMPLE 63

A DNA sequence (GBSx0062) was identified in *S. agalactiae* <SEQ ID 199> which encodes the amino acid sequence <SEQ ID 200>. Analysis of this protein sequence reveals the following:

```
Possible site: 19
>>> Seems to have a cleavable N-term signal seq.

----- Final Results -----
              bacterial outside --- Certainty = 0.3000(Affirmative) < succ>
              bacterial membrane --- Certainty = 0.0000(Not Clear) < succ>
              bacterial cytoplasm --- Certainty = 0.0000(Not Clear) < succ>
```

The protein has homology with the following sequences in the GENPEPT database:

```
>GP: CAB14385 GB: Z99116 similar to hypothetical proteins [Bacillus
subtilis]
Identities = 51/124 (41%), Positives = 71/124 (57%), Gaps = 1/124 (0%)

Query:   3 MSVILIIVILLAFVAWASWNYWRVRRAAKFLDNESFQKEMSRGQLIDIREAGAFHRKHIL   62
           MS +++++I  AF+ +   +Y  +R  K L  E F+     + QLID+RE    F   HIL
Sbjct:   1 MSNMIVLIIFPAFIIYMIASYVYQQRIMKTLTEEEFRAGYRKAQLIDVREPNEFEGGHIL   60

Query:  63 GARNIPASQFKVALSALRKDKPVLLYDASRGQSIPRIVLLLRKEGFNQLYVLKDGFNYWT  122
           GARNIP SQ K   + +R DKPV LY   +S  R    LRK G ++Y LK GF  W
Sbjct:  61 GARNIPLSQLKQRKNEIRTDKPVYLYCQNSVRS-GRAAQTLRKNGCTEIYNLKGGFKKWG  119

Query: 123 GRVK                                                         126
           G++K
Sbjct: 120 GKIK                                                         123
```

A related DNA sequence was identified in *S. pyogenes* <SEQ ID 201> which encodes the amino acid sequence <SEQ ID 202>. Analysis of this protein sequence reveals the following:

```
Possible site: 30
>>> Seems to have an uncleavable N-term signal seq
     INTEGRAL    Likelihood = -4.41    Transmembrane    4-20 (1-22)

----- Final Results -----
              bacterial membrane --- Certainty = 0.2763 (Affirmative) < succ>
              bacterial outside --- Certainty = 0.0000 (Not Clear) < succ>
              bacterial cytoplasm --- Certainty = 0.0000 (Not Clear) < succ>
```

The protein has homology with the following sequences in the databases:

```
>GP:BAB06532 GB:AP001516 unknown conserved protein [Bacillus halodurans]
Identities = 46/120 (38%), Positives = 64/120 (53%)

Query:   8 LWLLLVGIVGYYTWNYFSFRKMAKQVDNETFKDVMRQGQLIDLREPAAFRTKHILGARNF   67
           +WL+L+ ++ Y +      K  K + E F    R+ QLID+REP + + HILGARN
Sbjct:   5 VWLVLLALLVYVLFKRLYTPKYLKTLTQEEFIQGYRKAQLIDVREPREYDSGHILGARNI   64
```

```
Query:  68 PAQQFDAAIKGLRKDKPVLIYENMRPQYRVPAVKKLKKAGFEDVYVLKDGIDYWDGKVKQ 127
           P  Q    +K +R D+PV +Y     + R  A     KK G EDV  LK G   W GK+K+
Sbjct:  65 PLSQLKQRLKEVRTDQPVYLYCQSGARSRQAAAILKKKHGVEDVNHLKGGFRKWTGKIKK 124
```

An alignment of the GAS and GBS proteins is shown below:

```
Identities = 63/126 (50%), Positives = 85/126 (67%)

Query:    1 MDMSVILIIVILLAFVAWASWNYWRVRRAAKFLDNESFQKEMSRGQLIDIREAGAFHRKH   60
            M    +++ ++L+  V + +WNY+  R+ AK +DNE+F+  M +GQLID+RE  AF  KH
Sbjct:    1 MSPITLILWLLLVGIVGYYTWNYFSFRKMAKQVDNETFKDVMRQGQLIDLREPAAFRTKH   60

Query:   61 ILGARNIPASQFKVALSALRKDKPVLLYDASRGQSIPRIVLLLRKEGFNQLYVLKDGFNY  120
            ILGARN PA QF  A+  LRKDKPVL+Y+  R Q     V  L+K GF  +YVLKDG +Y
Sbjct:   61 ILGARNFPAQQFDAAIKGLRKDKPVLIYENMRPQYRVPAVKKLKKAGFEDVYVLKDGIDY  120

Query:  121 WTGRVK                                                       126
            W G+VK
Sbjct:  121 WDGKVK                                                       126
```

A related GBS gene <SEQ ID 8483> and protein <SEQ ID 8484> were also identified. Analysis of this protein sequence reveals the following:

```
Lipop: Possible site: -1 Crend: 1
McG: Discrim Score: 17.55
GvH: Signal Score (-7.5): 3.36
Possible site: 17
>>> Seems to have a cleavable N-term signal seq.
ALOM program count: 0 value: 8.86 threshold: 0.0
PERIPHERAL  Likelihood = 8.86  99
modified ALOM score: -2.27

*** Reasoning Step: 3

----- Final Results -----
             bacterial outside --- Certainty = 0.3000 (Affirmative) < succ>
             bacterial membrane --- Certainty = 0.0000 (Not Clear)  < succ>
```

The protein has homology with the following sequences in the databases:

```
40.4/56.5% over 12aa
Bacillus subtilis
EGAD|45852|hypothetical 14.6 kd protein in gcvt-spoiiiaa intergenic region Insert
characterized
SP|P54510|YQHL_BACSU HYPOTHETICAL 14.6 KDA PROTEIN IN GCVT_SPOIIIAA INTERGENIC
REGION. Insert characterized
GP|1303563|dbj|BAA12549.1||D84432 YghL Insert characterized
GP|2634888|emb|CAB14385.1||Z99116 similar to hypothetical proteins Insert
characterized
PIR|C69959|C69959 glpE protein homolog yqhL-Insert characterized ORF00659(307-678 of 978)
EGAD|45852|BS2449(1-123)hypothetical 14.6 kd protein in gvct-spoiiiaa
intergenic region{Bacillus subtilis}SP|P54510|YQHL_
BACSU HYPOTHETICAL 14.6 KDA PROTEIN IN GCVT-SPOIIIAA INTERGENIC
REGION.GP|1303893|dbj|BAA12549.1||D84432 YghL{Bacillus subtilis}GP|
263488|emb|CAB14385.1||Z99116 similar to hypothetical proteins{Bacillus
subtilis}PIR|C69959|C69959 glpE protein homolog yqhL-
Bacillus subtilis
% Match = 13.3
% Identity = 40.3   % Similarity = 56.5
Matches = 50    Mismatches = 53    Conservative Sub.s = 20
```

-continued

```
108          138          168          198          228          258          288          318
NISNILNPDSVVIGWRCLSSR*IFT*SR*EILCHICFPTS*KVN*N*DC*TR**CWYYWCSKLSQSTSKLRR*GMDMSVI
                                                                              || :
                                                                              MSNM 348          378          408          438          468          498          528          558
LIIVILLAFVAWASWNYWRVRRAAKFLDNESFQKEMSRGQLIDIREAGAFHRKHILGARNIPASQFKVALSALRKDKPVL
::::|:  ||:  :     :|    :|     |  |  |:    :   ||||:||    |    |||||||||| ||:|   :  :|  ||||
IVLIIFPAFIIYMIASYVYQQRIMKTLTEEEFRAGYRKAQLIDVREPNEFEGGHILGARNIPLSQLKQRKNEIRTDKPVY
        20           30           40           50           60           70           80

588     618     648     678     708     738     768     798
LYDASRGQSIPRIVLLLRKEGFNQLYVLKDGFNYWTGRVK*YTKERVTINNSLHFL*K*IKLKKVENKWHK**NDEKFSY
||       |       |||  |    ::|  ||  ||    |  |::|
LY-CQNSVRSGRAAQTLRKNGCTEIYNLKGGFKKWGGKIKAKK
              100          110          120
```

Figure 3:
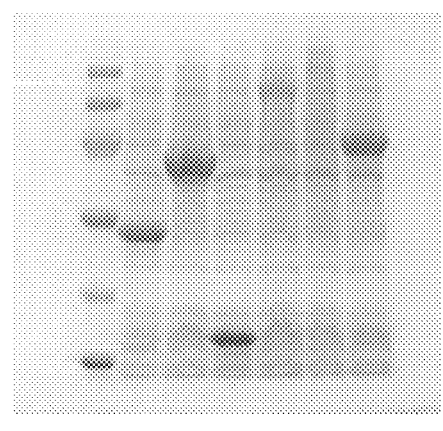

SEQ ID 8484 (GBS13) was expressed in *E. coli* as a His-fusion product. SDS-PAGE analysis of total cell extract is shown in FIG. 3 (lane 4; MW 16 kDa). It was also expressed in *E. coli* as a GST-fusion product. SDS-PAGE analysis of total cell extract is shown in FIG. 9 (lane 2; MW 40.5 kDa).

The GST-fusion protein was purified as shown in FIG. 190, lane 5.

Based on this analysis, it was predicted that these proteins and their epitopes could be useful antigens for vaccines or diagnostics.

EXAMPLE 64

A DNA sequence (GBSx0063) was identified in *S. agalactiae* <SEQ ID 203> which encodes the amino acid sequence <SEQ ID 204>. This protein is predicted to be regulatory protein TypA (typA). Analysis of this protein sequence reveals the following:

```
Possible Site: 36
>>> Seems to have no N-terminal signal sequence

----- Final Results -----
    bacterial cytoplasm --- Certainty = 0.1738 (Affirmative)  <succ>
      bacterial membrane --- Certainty = 0.0000 (Not Clear)   <succ>
        bacterial outside --- Certainty = 0.0000 (Not Clear)  <succ>
```

The protein has homology with the following sequences in the GENPEPT database:

```
>GP:CAB13350 GB:Z99111 similar to GTP-binding elongation factor
[Bacillus subtilis]
Identities = 455/609 (74%), Positives = 534/609 (86%), Gaps = 2/609 (0%)

Query:    4  LRTDIRNVAIIAHVDHGKTTLVDELLKQSHTLDERKELEERAMDSNDIEKERGITILAKN    63
             LR D+RN+AIIAHVDHGKTTLVD+LL Q+ T    +++ ERAMDSND+E+ERGITILAKN
Sbjct:    3  LRNDLRNIAIIAHVDHGKTTLVDQLLHQAGTFRANEQVAERAMDSNDLERERGITILAKN    62

Query:   64  TAVAYNDVRINIMDTPGHADFGGEVERIMKMVDGVVLVVDAYEGTMPQTRFVLKKALEQN   123
             TA+ Y D RINI+DTPGHADFGGEVERIMKMVDGVVLVVDAYEG MPQTRFVLKKALEQN
Sbjct:   63  TAINYKDTRINILDTPGHADFGGEVERIMKMVDGVVLVVDAYEGCMPQTRFVLKKALEQN   122

Query:  124  LIPIVVVNKIDKPSARPSEVVDEVLELFIELGADDDQLDFPVVYASAINGTSSMSDDPSD   183
             L P+VVVNKID+  ARP EV+DEVL+LFIEL A+++QL+FPVVYASAINGT+S+   DP
Sbjct:  123  LNPVVVVNKIDRDFARPEEVIDEVLDLFIELDANEEQLEFPVVYASAINGTASL--DPKQ   180

Query:  184  QEKTMAPIFDTIIDHIPAPVDNSEEPLQFQVSLLDYNDFVGRIGIGRVFRGTVKVGDQVT   243
             Q++ M  +++TII H+PAPVDN EEPLQFQV+LLDYND+VGRIGIGRVFRGT+KVG QV+
Sbjct:  181  QDENMEALYETIIKHVPAPVDNAEEPLQFQVALLDYNDYVGRIGIGRVFRGTMKVGQQVS   240

Query:  244  LSKLDGTTKNFRVTKLFGFFGLERKEIQEAKAGDLIAVSGMEDIFVGETVTPTDAIEPLP   303
             L KLDGT K+FRVTK+FGF GL+R EI+EAKAGDL+AVSGMEDI VGETV P D +PLP
Sbjct:  241  LMKLDGTAKSFRVTKIFGFQGLKRVEIEEAKAGDLVAVSGMEDINVGETVCPVDHQDPLP   300
```

```
-continued
Query: 304 VLRIDEPTLQMTFLVNNSPFAGREGKWITSRKVEERLLAELQTDVSLRVDPTDSPDKWTV 363
            VLRIDEPTLQMTF+VNNSPFAGREGK++T+RK+EERL ++LQTDVSLRV+PT SPD W V
Sbjct: 301 VLRIDEPTLQMTFVVNNSPFAGREGKYVTARKIEERLQSQLQTDVSLRVEPTASPDAWVV 360

Query: 364 SGRGELHLSILIETMRREGYELQVSRPEVIIKEIDGVQCEPFERVQIDTPEEYQGAIIQS 423
            SGRGELHLSILIE MRREGYELQVS+PEVIIKEIDGV+CEP ERVQID PEE+ G++++S
Sbjct: 361 SGRGELHLSILIENMRREGYELQVSKPEVIIKEIDGVRCEPVERVQIDVPEEHTGSVMES 420

Query: 424 LSERKGDMLDMQMVGNGQTRLIFLIPARGLIGYSTEFLSMTRGYGIMNHTFDQYLPVVQG 483
            +   RKG+M+DM   GNGQ RLIF +P+RGLIGYSTEFLS+TRG+GI+NHTFD Y P+  G
Sbjct: 421 MGARKGEMVDMINNGNGQVRLIFTVPSRGLIGYSTEFLSLTRGFGILNHTFDSYQPMQAG 480

Query: 484 EIGGRHRGALVSIENGKATTYSIMRIEERGTIFVNPGIEVYEGMIVGENSRDNDLGVNIT 543
            ++GGR +G LVS+ENGKAT+Y I  IE+RG IFV PG EVYEGMIVGE++RDNDL VN++
Sbjct: 481 QVGGRRQGVLVSMENGKATSYGIQGIEDRGVIFVEPGTEVYEGMIVGEHNRDNDLVVNVS 540

Query: 544 TAKQMTNVRSATKDQTAVIKTPRILTLEESLEFLADDEYMEVTPESIRLRKQILNKAARD 603
               KQ TNVRSATKDQT   IK  RI++LEESLE+L +DEY EVTPESIRLRK+ILNK  R+
Sbjct: 541 KMKQQTNVRSATKDQTTTIKKARIMSLEESLEYLNEDEYCEVTPESIRLRKKILNKNERE 600

Query: 604 KANKKKKSA                                                   612
            KA KKKK+A
Sbjct: 601 KAAKKKKTA                                                   609
```

A related DNA sequence was identified in *S. pyogenes* <SEQ ID 205> which encodes the amino acid sequence <SEQ ID 206>. Analysis of this protein sequence reveals the following:

```
Possible site: 36
>>> Seems to have no N-terminal signal sequence

----- Final Results -----
    bacterial cytoplasm --- Certainty = 0.1738 (Affirmative) <succ>
      bacterial membrane --- Certainty = 0.0000 (Not Clear)   <succ>
     bacterial outside --- Certainty = 0.0000 (Not Clear)   <succ>
```

An alignment of the GAS and GBS proteins is shown below:

```
Identities = 594/613 (96%), Positives = 607/613 (98%)

Query:    1 MTNLRTDIRNVAIIAHVDHGKTTLVDELLKQSHTLDERKELEERAMDSNDIEKERGITIL   60
            MTNLR DIRNVAIIAHVDHGKTTLVDELLKQSHTLDERKEL+ERAMDSND+EKERGITIL
Sbjct:    1 MTNLRNDIRNVAIIAHVDHGKTTLVDELLKQSHTLDERKELQERAMDSNDLEKERGITIL   60

Query:   61 AKNTAVAYNDVRINIMDTPGHADFGGEVERIMKMVDGVVLVVDAYEGTMPQTRFVLKKAL  120
            AKNTAVAYNDVRINIMDTPGHADFGGEVERIMKMVDGVVLVVDAYEGTMPQTRFVLKKAL
Sbjct:   61 AKNTAVAYNDVRINIMDTPGHADFGGEVERIMKMVDGVVLVVDAYEGTMPQTRFVLKKAL  120

Query:  121 EQNLIPIVVVNKIDKPSARPSEVVDEVLELFIELGADDDQLDFPVVYASAINGTSSMSDD  180
            EQNLIPIVVVNKIDKPSARP+EVVDEVLELFIELGADD+QL+FPVVYASAINGTSS+SDD
Sbjct:  121 EQNLIPIVVVNKIDKPSARPAEVVDEVLELFIELGADDEQLEFPVVYASAINGTSSLSDD  180

Query:  181 PSDQEKTMAPIFDTIIDHIPAPVDNSEEPLQFQVSLLDYNDFVGRIGIGRVFRGTVKVGD  240
            P+DQE TMAPIFDTIIDHIPAPVDNS+EPLQFQVSLLDYNDFVGRIGIGRVFRGTVKVGD
Sbjct:  181 PADQEHTMAPIFDTIIDHIPAPVDNSDEPLQFQVSLLDYNDFVGRIGIGRVFRGTVKVGD  240

Query:  241 QVTLSKLDGTTKNFRVTKLFGFFGLERKEIQEAKAGDLIAVSGMEDIFVGETVTPTDAIE  300
            QVTLSKLDGTTKNFRVTKLFGFFGLER+EIQEAKAGDLIAVSGMEDIFVGET+TPTD +E
Sbjct:  241 QVTLSKLDGTTKNFRVTKLFGFFGLERREIQEAKAGDLIAVSGMEDIFVGETITPTDCVE  300

Query:  301 PLPVLRIDEPTLQMTFLVNNSPFAGREGKWITSRKVEERLLAELQTDVSLRVDPTDSPDK  360
            LP+LRIDEPTLQMTFLVNNSPFAGREGKWITSRKVEERLLAELQTDVSLRVDPTDSPDK
Sbjct:  301 ALPILRIDEPTLQMTFLVNNSPFAGREGKWITSRKVEERLLAELQTDVSLRVDPTDSPDK  360

Query:  361 WTVSGRGELHLSILIETMRREGYELQVSRPEVIIKEIDGVQCEPFERVQIDTPEEYQGAI  420
            WTVSGRGELHLSILIETMRREGYELQVSRPEVIIKEIDGV+CEPFERVQIDTPEEYQGAI
Sbjct:  361 WTVSGRGELHLSILIETMRREGYELQVSRPEVIIKEIDGVKCEPFERVQIDTPEEYQGAI  420

Query:  421 IQSLSERKGDMLDMQMVGNGQTRLIFLIPARGLIGYSTEFLSMTRGYGIMNHTFDQYLPV  480
            IQSLSERKGDMLDMQMVGNGQTRLIFLIPARGLIGYSTEFLSMTRGYGIMNHTFDQYLPV
Sbjct:  421 IQSLSERKGDMLDMQMVGNGQTRLIFLIPARGLIGYSTEFLSMTRGYGIMNHTFDQYLPV  480
```

```
                     -continued
Query:  481 VQGEIGGRHRGALVSIENGKATTYSIMRIEERGTIFVNPGIEVYEGMIVGENSRDNDLGV  540
            VQGEIGGRHRGALVSIENGKATTYSIMRIEERGTIFVNPG EVYEGMIVGENSRDNDLGV
Sbjct:  481 VQGEIGGRHRGALVSIENGKATTYSIMRIEERGTIFVNPGTEVYEGMIVGENSRDNDLGV  540

Query:  541 NITTAKQMTNVRSATKDQTAVIKTPRILTLEESLEFLADDEYMEVTPESIRLRKQILNKA  600
            NITTAKQMTNVRSATKDQTAVIKTPRILTLEESLEFL DDEYMEVTPESIRLRKQILNKA
Sbjct:  541 NITTAKQMTNVRSATKDQTAVIKTPRILTLEESLEFLNDDEYMEVTPESIRLRKQILNKA  600

Query:  601 ARDKANKKKKSAE                                                613
            ARDKANKKKKSAE
Sbjct:  601 ARDKANKKKKSAE                                                613
```

Based on this analysis, it was predicted that these proteins and their epitopes could be useful antigens for vaccines or diagnostics.

EXAMPLE 65

A DNA sequence (GBSx0065) was identified in *S. agalactiae* <SEQ ID 207> which encodes the amino acid sequence <SEQ ID 208>. This protein is predicted to be D-glutamic acid adding enzyme MurD (murD). Analysis of this protein sequence reveals the following:

```
RGD motif 441-443
Possible site: 29
>>> Seems to have no N-terminal signal sequence ----- Final Results -----
            bacterial membrane --- Certainty = 0.0000(Not Clear) < succ>
            bacterial outside  --- Certainty = 0.0000(Not Clear) < succ>
            bacterial cytoplasm --- Certainty = 0.0000(Not Clear) < succ>
```

A related GBS nucleic acid sequence <SEQ ID 9615> which encodes amino acid sequence <SEQ ID 9616> was also identified.

The protein has homology with the following sequences in the GENPEPT database:

```
>GP: AAC95449 GB: AF068902 D-glutamic acid enzyme MurD [Streptococcus pneu-
moniae]
Identities = 341/449 (75%), Positives = 394/449 (86%)

Query:    5 MKTITTFENKKVLVLGLARSGEAAARLLAKLGAIVTVNDGKPFDENPTAQSLLEEGIKVV   64
            MK I  F+NKKVLVLGLA+SGE+AARLL KLGAIVTVNDGKPF++NP AQ LLEEGIKV+
Sbjct:    1 MKVIDQFKNKKVLVLGLAKSGESAARLLDKLGAIVTVNDGKPFEDNPAAQCLLEEGIKVI   60

Query:   65 CGSHPLELLDEDFCYMIKNPGIPYNNPMVKKALEKQIPVLTEVELAYLVSESQLIGITGS  124
            G HPLELLDE+F  M+KNPGIPY+NPM++KAL K IPVLTEVELAYL+SE+ +IGITGS
Sbjct:   61 TGGHPLELLDEEFALMVKNPGIPYSNPMIEKALAKGIPVLTEVELAYLISEAPIIGITGS  120

Query:  125 NGKTTTTTMIAEVLNAGGQRGLLAGNIGFPASEVVQAANDKDTLVMELSSFQLMGVKEFR  184
            NGKTTTTTMI EVL A GQ GLL+GNIG+PAS+V Q A DK+TLVMELSSFQLMGV+EF
Sbjct:  121 NGKTTTTTMIGEVLTAAGQHGLLSGNIGYPASQVAQIATDKNTLVMELSSFQLMGVQEFH  180

Query:  185 PHIAVITNLMPTHLDYHGSFEDYVAAKWNIQNQMSSSDFLVLNFNQGISKELAKTTKATI  244
            P IAVITNLMPTH+DYHG FE+YVAAKWNIQN+M+++DFLVLNFNQ + K+LA  T+AT+
Sbjct:  181 PEIAVITNLMPTHIDYHGLFEEYVAAKWNIQNKMTAADFLVLNFNQDLVKDLASKTEATV  240

Query:  245 VPFSTTEKVDGAYVQDKQLFYKGENIMSVDDIGVPGSHNVENALATIAVAKLAGISNQVI  304
            VPFST EKVDGAY++D QL+++GE +M+ ++IGVPGSHNVENALATIAVAKL G+ NQ I
Sbjct:  241 VPFSTLEKVDGAYLEDGQLYFRGEVVMAANEIGVPGSHNVENALATIAVAKLRGVDNQTI  300

Query:  305 RETLSNFGGVKHRLQSLGKVHGISFYNDSKSTNILATQKALSGFDNTKVILIAGGLDRGN  364
            +ETLS FGGVKHRLQ +  G+ FYNDSKSTNILATQKALSGFDN+KV+LIAGGLDRGN
Sbjct:  301 KETLSAFGGVKHRLQFVDDIKGVKFYNDSKSTNILATQKALSGFDNSKVVLIAGGLDRGN  360

Query:  365 EFDELIPDITGLKHMVVLGESASRVKRAAQKAGVTYSDALDVRDAVHKAYEVAQQGDVIL  424
            EFDEL+PDITGLK MV+LG+SA RVKRAA KAGV Y +A D+ DA  KAYE+A QGDV+L
Sbjct:  361 EFDELVPDITGLKKMVILGQSAERVKRAADKAGVAYVEATDIADATRKAYELATQGDVVL  420

Query:  425 LSPANASWDMYKNFEVRGDEFIDTFESLR                                453
            LSPANASWDMY NFEVRGD FIDT   L+
Sbjct:  421 LSPANASWDMYANFEVRGDLFIDTVAELK                                449
```

A related DNA sequence was identified in *S. pyogenes* <SEQ ID 209> which encodes the amino acid sequence <SEQ ID 210>. Analysis of this protein sequence reveals the following:

```
Possible site: 25
>>> Seems to have a cleavable N-term signal seq.

----- Final Results -----
              bacterial outside --- Certainty = 0.3000(Affirmative) < succ>
              bacterial membrane --- Certainty = 0.0000(Not Clear) < succ>
              bacterial cytoplasm --- Certainty = 0.0000(Not Clear) < succ>
RGD motif: 436-438
```

An alignment of the GAS and GBS proteins is shown below:

```
Identities = 329/451 (72%), Positives = 397/451 (87%)

Query:    5 MKTITTFENKKVLVLGLARSGEAAARLLAKLGAIVTVNDGKPFDENPTAQSLLEEGIKVV   64
            MK I+ F+NKK+L+LGLA+SGEAAA+LL KLGA+VTVND KPFD+NP AQ+LLEEGIKV+
Sbjct:    1 MKVISNFQNKKILILGLAKSGEAAAKLLTKLGALVTVNDSKPFDQNPAAQALLEEGIKVI   60

Query:   65 CGSHPLELLDEDFCYMIKNPGIPYNNPMVKKALEKQIPVLTEVELAYLVSESQLIGITGS  124
            CGSHP+ELLDE+F YM+KNPGIPY+NPMVK+AL K+IP+LTEVELAY VSE+ +IGITGS
Sbjct:   61 CGSHPVELLDENFEYMVKNPGIPYDNPMVKRALAKEIPILTEVELAYFVSEAPIIGITGS  120

Query:  125 NGKTTTTTMIAEVLNAGGQRGLLAGNIGFPASEVVQAANDKDTLVMELSSFQLMGVKEFR  184
            NGKTTTTTMIA+VLNAGGQ  LL+GNIG+PAS+VVQ A   DTLVMELSSFQL+GV  FR
Sbjct:  121 NGKTTTTTMIADVLNAGGQSALLSGNIGYPASKVVQKAIAGDTLVMELSSFQLVGVNAFR  180

Query:  185 PHIAVITNLMPTHLDYHGSFEDYVAAKWNIQNQMSSSDFLVLNFNQGISKELAKTTKATI  244
            PHIAVITNLMPTHLDYHGSFEDYVAAKW IQ QM+ SD+L+LN NQ IS  LAKTTKAT+
Sbjct:  181 PHIAVITNLMPTHLDYHGSFEDYVAAKWMIQAQMTESDYLILNANQEISATLAKTTKATV  240

Query:  245 VPFSTTEKVDGAYVQDKQLFYKGENIMSVDDIGVPGSHNVENALATIAVAKLAGISNQVI  304
            +PFST + VDGAY++D  L++K + I++  D+GVPGSHN+ENALATIAVAKL+GI++ +I
Sbjct:  241 IPFSTQKVVDGAYLKDGILYFKEQAIIAATDLGVPGSHNIENALATIAVAKLSGIADDII  300

Query:  305 RETLSNFGGVKHRLQSLGKVHGISFYNDSKSTNILATQKALSGFDNTKVILIAGGLDRGN  364
             + LS+FGGVKHRLQ +G++  I+FYNDSKSTNILATQKALSGFDN+++ILIAGGLDRGN
Sbjct:  301 AQCLSHFGGVKHRLQRVGQIKDITFYNDSKSTNILATQKALSGFDNSRLILIAGGLDRGN  360

Query:  365 EFDELIPDITGLKHMVVLGESASRVKRAAQKAGVTYSDALDVRDAVHKAYEVAQQGDVIL  424
            EFD+L+PD+ GLK M++LGESA R+KRAA KA V+Y +A +V +A  A+++AQ GD IL
Sbjct:  361 EFDDLVPDLLGLKQMIILGESAERMKRAANKAEVSYLEARNVAEATELAFKLAQTGDTIL  420

Query:  425 LSPANASWDMYKNFEVRGDEFIDTFESLRGE                              455
            LSPANASWDMY NFEVRGDEF+ TF+ LRG+
Sbjct:  421 LSPANASWDMYPNFEVRGDEFLATFDCLRGD                              451
```

Figure 56:
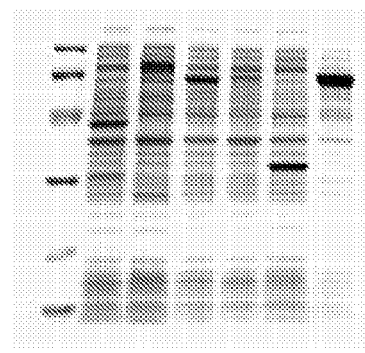

SEQ ID 208 (GBS305) was expressed in *E. coli* as a His-fusion product. SDS-PAGE analysis of total cell extract is shown in FIG. 51 (lane 11; MW 53.7 kDa). It was also expressed in *E. coli* as a GST-fusion product. SDS-PAGE analysis of total cell extract is shown in FIG. 56 (lane 3; MW 79 kDa).

Figure 270:
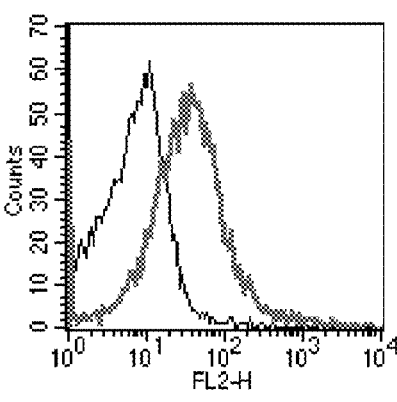

The GBS305-GST fusion product was purified (FIG. 207, lane 8) and used to immunise mice. The resulting antiserum was used for FACS (FIG. 270), which confirmed that the protein is immunoaccessible on GBS bacteria.

Based on this analysis, it was predicted that these proteins and their epitopes could be useful antigens for vaccines or diagnostics.

EXAMPLE 66

A DNA sequence (GBSx0066) was identified in *S. agalactiae* <SEQ ID 211> which encodes the amino acid sequence <SEQ ID 212>. Analysis of this protein sequence reveals the following:

```
RGD motif 285-287
Possible site: 60
>>> Seems to have no N-terminal signal sequence
       INTEGRAL    Likelihood = -1.65    Transmembrane    74-90 (73-93)

----- Final Results -----
              bacterial membrane --- Certainty = 0.1659(Affirmative) < succ>
              bacterial outside  --- Certainty = 0.0000(Not Clear) < succ>
              bacterial cytoplasm --- Certainty = 0.0000(Not Clear) < succ>
```

A related DNA sequence was identified in *S. pyogenes* <SEQ ID 213> which encodes the amino acid sequence <SEQ ID 214>. Analysis of this protein sequence reveals the following:

```
Possible site: 37
>>> Seems to have no N-terminal signal sequence
     INTEGRAL    Likelihood = -1.33    Transmembrane     81-97 (80-100)
     INTEGRAL    Likelihood = -0.16    Transmembrane    272-288 (271-288)

----- Final Results -----
              bacterial membrane --- Certainty = 0.1532(Affirmative) < succ>
               bacterial outside --- Certainty = 0.0000(Not Clear)   < succ>
             bacterial cytoplasm --- Certainty = 0.0000(Not Clear)   < succ>
```

A related sequence was also identified in GAS <SEQ ID 9141> which encodes the amino acid sequence <SEQ ID 9142>. Analysis of this protein sequence reveals the following:

```
Possible site: 37
>>> Seems to have no N-terminal signal sequence
      INTEGRAL    Likelihood = -1.33     Transmembrane      74-90
      INTEGRAL    Likelihood = -0.16     Transmembrane     265-281

----- Final Results -----
              bacterial membrane --- Certainty = 0.1532(Affirmative) < succ>
               bacterial outside --- Certainty = 0.0000(Not Clear)   < succ>
             bacterial cytoplasm --- Certainty = 0.0000(Not Clear)   < succ>
RGD motif: 286-288
```

An alignment of the GAS and GBS proteins is shown below:

```
Identities = 249/358 (69%), Positives = 293/358 (81%), Gaps = 1/358 (0%)

Query:    1 MGKKIVFTGGGTVGHVTLNLILIPKFIKDGWEVHYIGDKNGIEHEQINQSGLDITFHSIA     60
            M KKI+FTGGGTVGHVTLNLILIPKFIKDGWEVHYIGDKNGIEH +I +SGLD+TFH+IA
Sbjct:    8 MPKKILFTGGGTVGHVTLNLILIPKFIKDGWEVHYIGDKNGIEHTEIEKSGLDVTFHAIA     67

Query:   61 TGKLRRYFSWQNMLDVFKVGVGVLQSIAIIAKLRPQALFSKGGFVSVPPVVAARLLKVPV    120
            TGKLRRYFSWQN+ DVFKV +G+LQS+ I+AKLRPQALFSKGGFVSVPPVVAA+LL PV
Sbjct:   68 TGKLRRYFSWQNLADVFKVALGLLQSLFIVAKLRPQALFSKGGFVSVPPVVAAKLLGKPV    127

Query:  121 FVHESDLSMGLANKIAYKFATIMYTTFEQSKDLIKTKHIGAVTKVM-DCKKSFENTDLTS    179
            F+HESD SMGLANKIAYKFAT MYTTFEQ L K KH+GAVTKV D + E+T L +
Sbjct:  128 FIHESDRSMGLANKIAYKFATTMYTTFEQEDQLSKVKHLGAVTKVFKDANQMPESTQLEA    187

Query:  180 IKEAFDPNLKTLLFIGGSAGAKVFNDFITQTPELEEKYNVINISGDSSLNRLKKNLYRVD    239
            +KE F +LKTLLFIGGSAGA VFN FI+ PEL+++YN+INI+GD LN L +LYRVD
Sbjct:  188 VKEYFSRDLKTLLFIGGSAGAHVFNQFISDHPELKQRYNIINITGDPHLNELSSHLYRVD    247

Query:  240 YVTDLYQPLMNLADVVVTRGGSNTIFELVAMKKLHLIIPLGREASRGDQLENAAYFEEKG    299
            YVTDLYQPLM +AD+VVTRGGSNT+FEL+AM KLHLI+PLG+EASRGDQLENA YFE++G
Sbjct:  248 YVTDLYQPLMAMADLVVTRGGSNTLFELLAMAKLHLIVPLGKEASRGDQLENATYFEKRG    307

Query:  300 YALQLPESELNINTLEKQINLLISNSESYEKNMSQSSEIKSQDEFYQLLIDDMAKVTK     357
            YA QL E +L ++ ++ + L + YE M + EI+S D FY LL  D++ K
Sbjct:  308 YAKQLQEPDLTLHNFDQAMADLFEHQADYEATMLATKEIQSPDFFYDLLRADISSAIK    365
```

SEQ ID 212 (GBS306) was expressed in *E. coli* as a His-fusion product. SDS-PAGE analysis of total cell extract is shown in FIG. 51 (lane 12; MW 43 kDa). It was also expressed in *E. coli* as a GST-fusion product. SDS-PAGE analysis of total cell extract is shown in FIG. 56 (lane 4; MW 68 kDa).

Figure 207:
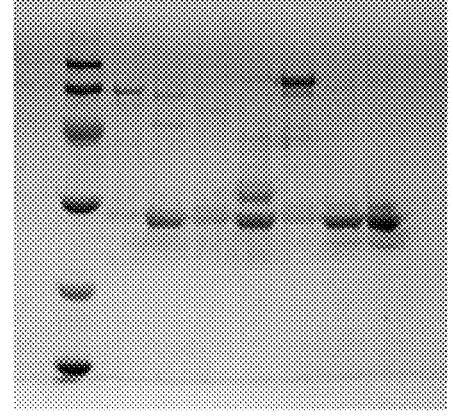

GBS306-GST was purified as shown in FIG. 207, lane 9.

Based on this analysis, it was predicted that these proteins and their epitopes could be useful antigens for vaccines or diagnostics.

EXAMPLE 67

A DNA sequence (GBSx0067) was identified in *S. agalactiae* <SEQ ID 215> which encodes the amino acid sequence <SEQ ID 216>. This protein is predicted to be cell division protein DivIB. Analysis of this protein sequence reveals the following:

```
Possible site: 58
>>> Seems to have no N-terminal signal sequence
     INTEGRAL    Likelihood = -14.33    Transmembrane    103-119 (96-124)

----- Final Results -----
             bacterial membrane --- Certainty = 0.6731(Affirmative) < succ>
              bacterial outside --- Certainty = 0.0000(Not Clear)   < succ>
            bacterial cytoplasm --- Certainty = 0.0000(Not Clear)   < succ>
```

The protein has homology with the following sequences in the GENPEPT database:

```
>GP:AAC95451 GB:AF068902 cell division protein DivIB [Streptococcus pneumoniae]
Identities = 119/396 (30%), Positives = 214/396 (53%), Gaps = 38/396 (9%)

Query:    3 KKKSDTPEKEEVV-LTEWQKRNLEFLKKRKEDEE---EQKRINEKLRLDKRS-----KLN      53
            KK   D EE+   L+EWQKRN E+LKK+ E+E E+K + R+ + S K +
Sbjct:    5 KKNEDKEILEELKELSEWQKRNQEYLKKKAEEEAALAEEKEKERQARMGEESEKSEDKQD     64

Query:   54 ISSPEEPQNTTKIKKLHFPKIS------------RPKIEKKQKKEKIVNSLAKTNR----     97
            S   + +++  K+ K++  P+ ++K++++K ++  A    +
Sbjct:   65 QESETDQEDSESAKEESEEKVASSEADKEKEEKEEPESKEKEEQDKKLSKKATKEKPAKA    124

Query:   98 -------IRTAPIFVVAFLVILVSVFLLTPFSKQKTITVSGNQHTPDDILIEKTNIQKND    150
                   +R I + L+++VS +LL+P++ K I V G T  D + + + IQ +D
Sbjct:  125 KIPGIHILRAFTILFPSLLLLIVSAYLLSPYATMKDIRVEGTVQTTADDIRQASGIQDSD    184

Query:  151 YFFSLIFKHKAIEQRLAAEDVWVKTAQMTYQFPNKFHIQVQENKIIAYAHTKQGYQPVLE    210
            Y +L+  E+++ + + WV++AQ+ YQFP  KF  I+V+E I+AY + + + P+L
Sbjct:  185 YTINLLLDKAKYEKQIKS-NYWVESAQLVYQFPTKFTIKVKEYDIVAYYISGENHYPILS    243

Query:  211 TGK-KADPVNSSELPKHFLTINLDKEDSIKLLIKDLKALDPDLISEIQVISLADSKTTPD    269
            +G+ + V+ + LP+ +L++ + + IK+ + +L   P+L + IQ + LA SK T  D
Sbjct:  244 SGQLETSSVSLNSLPETYLSVLFNDSEQIKVFVSELAQISPELKAAIQKVELAPSKVTSD    303

Query:  270 LLLLDMHDGNSIRIPLSKFKERLPFYKQIKKNLKEPSIVDMEVGVYTTTNTIESTPVKAE    329
            L+  L  M+D + + +PLS+   ++LP+Y +IK   L  EPS+VDME  G+Y+   T + E
Sbjct:  304 LIRLTMNDSDEVLVPLSEMSKKLPYYSKIKPQLSEPSVVDMEAGIYSYTVADKLIMEVEE    363

Query:  330 DTKNKSTDKTQTQNGQVAENSQGQTNNSNTNQQGQQ                          365
              K ++  +  + Q E   + Q SN NQ  Q+
Sbjct:  364 KAKQEAKEAEKKQE----EEQKKQEEESNRNQTTQR                          395
```

A related DNA sequence was identified in *S. pyogenes* <SEQ ID 217> which encodes the amino acid sequence <SEQ ID 218>. Analysis of this protein sequence reveals the following:

```
Possible site: 59
>>> Seems to have no N-terminal signal sequence
     INTEGRAL    Likelihood = -9.45    Transmembrane    106-122 (102-125)

----- Final Results -----
             bacterial membrane --- Certainty = 0.4779(Affirmative) < succ>
              bacterial outside --- Certainty = 0.0000(Not Clear)   < succ>
            bacterial cytoplasm --- Certainty = 0.0000(Not Clear)   < succ>
```

An alignment of the GAS and GBS proteins is shown below:

```
Identities = 152/381 (39%), Positives = 232/381 (59%), Gaps = 14/381 (3%)

Query:    4  KKSDTPEKEEVVLTEWQKRNLEFLKKRKEDEEEQKRINEKLRLDKRSKLNISSPEEP---   60
             K +    +++VLTEWQKRN+EFLKK+K+  EE+K++  EKL   DK+++    +   E
Sbjct:    3  KDKEKQSDDKLVLTEWQKRNIEFLKKKKQQAEEEKKLKEKLLSDKKAQQQAQNASEAVEL   62
```

```
Query:   61 --QNTTKIKKLHFPKISRPKIEKK--QKKEKIVNSLAKTNRIRTAPIFVVAFLVILVSVF  116
            T  +++     S+PK KK  Q KEK    +A    ++ P+ + A L++ VS+F
Sbjct:   63 KTDEKTDSQEIESETTSKPKKTKKVRQPKEKSATQIAFQ---KSLPVLLGALLLMAVSIF  119

Query:  117 LLTPFSKQKTITVSGNQHTPDDILIEKTNIQKNDYFFSLIFKHKAIEQRLAAEDVWVKTA  176
            ++TP+SK+K  +V GN  T  D LI+ +  ++ +DY+ +L+     E+ +     WVK+
Sbjct:  120 MITPYSKKKEFSVRGNHQTNLDELIKASKVKASDYWLTLLTSPGQYERPILRTIPWVKSV  179

Query:  177 QMTYQFPNKFHIQVQENKIIAYAHTKQGYQPVLETGKKADPVNSSELPKHFLTINLDKED  236
            ++YQFPN F   V E +IIAYA  + G+QP+LE GK+ D V +SELPK FL +NL  E
Sbjct:  180 HLSYQFPNHFLFNVIEFEIIAYAQVENGFQPILENGKRVDKVRASELPKSFLILNLKDEK  239

Query:  237 SIKLLIKDLKALDPDLISEIQVISLADSKTTPDLLLLDMHDGNSIRIPLSRFKERLPFYK  296
            +I+ L+K L  L     L+  I+ +SLA+SKTT DLLL++MHDGN +R+P S+    +LP+Y+
Sbjct:  240 AIQQLVKQLTTLPKKLVKNIKSVSLANSKTTADLLLIEMHDGNVVRVPQSQLTLKLPYYQ  299

Query:  297 QIKKNLKEPSIVDMEVGVYTTTNTIESTPVKAEDTKNKSTDKTQTQNGQVAENSQGQTNN  356
            ++KKNL+   SIVDMEVG+YTTT  IE+ P     +  + DK   + G+     Q QT+N
Sbjct:  300 KLKKNLENDSIVDMEVGIYTTTQEIENQPEVPLTPEQNAADKEGDKPGE----HQEQTDN  355

Query:  357 SNTNQQGQQIATEQAPNPQNV                                        377
            +     Q    + P+P+ V
Sbjct:  356 DSETPANQSSPQQTPPSPETV                                        376
```

Figure 17:
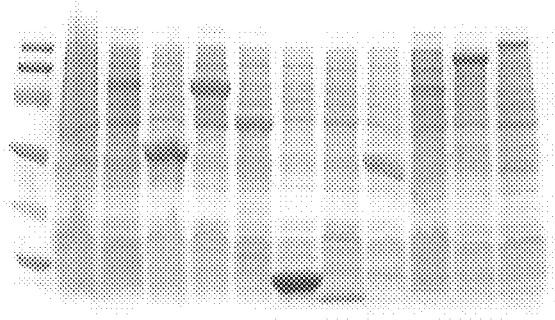

SEQ ID 216 (GBS85) was expressed in E. coli as a His-fusion product. SDS-PAGE analysis of total cell extract is shown in FIG. 17 (lane 10; MW 45.2 kDa).

The GBS85-His fusion product was purified (FIG. 105A; see also FIG. 193, lane 5) and used to immunise mice (lane 1 product; 20 µg/mouse). The resulting antiserum was used for Western blot (FIG. 105B), FACS (FIG. 105C), and in the in vivo passive protection assay (Table III). These tests confirm that the protein is immunoaccessible on GBS bacteria and that it is an effective protective immunogen.

Based on this analysis, it was predicted that these proteins and their epitopes could be useful antigens for vaccines or diagnostics.

EXAMPLE 68

A DNA sequence (GBSx0068) was identified in S. agalactiae <SEQ ID 219> which encodes the amino acid sequence <SEQ ID 220>. This protein is predicted to be cell division protein FtsA (ftsA). Analysis of this protein sequence reveals the following:

```
Possible site: 56
>>> Seems to have an uncleavable N-term signal seq
    INTEGRAL      Likelihood = -3.19    Transmembrane    322-338 (321-338)

----- Final Results -----
            bacterial membrane --- Certainty = 0.2275(Affirmative) < succ>
            bacterial outside  --- Certainty = 0.0000(Not Clear)   < succ>
            bacterial cytoplasm --- Certainty = 0.0000(Not Clear)  < succ>
```

The protein has homology with the following sequences in the GENPEPT database:

```
>GP:AAC95439 GB:AF068901 cell division protein FtsA [Streptococcus pneumoniae]
Identities = 292/457 (63%), Positives = 366/457 (79%), Gaps = 1/457 (0%)

Query:    1 MARNGFFTGLDIGTSSIKVLVAEFIANEMNVIGVSNVPSSGVKDGIIIDIEAAATAIKEA   60
            MAR GFFTGLDIGTSS+KVLVAE    E+NVIGVSN S GVKDGI+DI+AAATAIK A
Sbjct:    1 MAREGFFTGLDIGTSSVKVLVAEQRNGELNVIGVSNAKSKGVKDGIIVDIDAAATAIKSA   60

Query:   61 VKQAEEKAGITIDKINVGLPANLLQIEPTQGMIPVPNESKEIKDEDVESVVKSALTKSIT  120
            + QAEEKAGI+I  +NVGLP NLLQ+EPTQGMIPV +++KEI D+DVE+VVKSALTKS+T
Sbjct:   61 ISQAEEKAGISIKSVNVGLPGNLLQVEPTQGMIPVTSDTKEITDQDVENVVKSALTKSMT  120

Query:  121 PEREVISLIPLEFIVDGFQGIRDPRGMMGIRLEMRGLIYTGPTTILHNLRKTVERAGIKV  180
            P+REVI+ IP EFIVDGFQGIRDPRGMMG+RLEMRGL+YTGP TILHNLRKTVERAG++V
Sbjct:  121 PDREVITFIPLEFIVDGFQGIRDPRGMMGVRLEMRGLLYTGPRTILHNLRKTVERAGVQV  180

Query:  181 EHVVIAPLALAKSVLNEGEREFGATVIDMGGGQTTVASMRNQELQYTNIYSEGSDYVTKD  240
            E+V+I+PLA+ +SVLNEGEREFGATVIDMG GQTTVA++RNQELQ+T+I  EG DYVTKD
Sbjct:  181 ENVIISPLAMVQSVLNEGEREFGATVIDMGAGQTTVATIRNQELQFTHILQEGGDYVTKD  240

Query:  241 ISKVLRTTVEIAEALKFNFGQANVEEASTSDTVQVNVVGNEEPVEITESYLSQIISGRIR  300
            ISKVL+T+ ++AE LK N+G+A   AS  +T QV V+G  E VE+TE+YLS+IIS RI+
Sbjct:  241 ISKVLKTSRKLAEGLKLNYGEAYPPLAS-KETFQVEVIGEVEAVEVTEAYLSEIISARIK  299
```

-continued

```
Query:  301 QILEHVKQDLGRGRLLDLPGGIILVGGGAIMPGVVEVAQQIFGTRVKLHVPNQVGIRNPM  360
            ILE +KQ+L R RLLDLPGGI+L+GG AI+PG+VE+AQ++FG RVKL+VPNQVGIRNP
Sbjct:  300 HILEQIKQELDRRRLLDLPGGIVLIGGNAILPGMVELAQEVFGVRVKLYVPNQVGIRNPA  359

Query:  361 FANVISIVDYVGMMSEVDIIAQHAVTGDEMLRHKPVDFDYKEKTNTMSTMPYSEPLTSSM  420
            FA+VIS+ ++ G ++EV+++AQ A+ G+  L H+P+ F     +              +
Sbjct:  360 FAHVISLSEFAGQLTEVNLLAQGAIKGENDLSHQPISFGGMLQKTAQFVQSTPVQPAPAP  419

Query:  421 EDSNLEPIRARENAQEPTEPKANIGERIRGIFGSMFD                        457
            E   +P      + Q+ ++ K  + +R RG+ GSMFD
Sbjct:  420 EVEPVAPTEPMADFQQASQNKPKLADRFRGLIGSMFD                        456
```

A related DNA sequence was identified in *S. pyogenes* <SEQ ID 221> which encodes the amino acid sequence <SEQ ID 222>. Analysis of this protein sequence reveals the following:

```
Possible site: 55
>>> Seems to have no N-terminal signal sequence
    INTEGRAL       Likelihood = -3.35    Transmembrane    313-329 (312-329)

----- Final Results -----
              bacterial membrane --- Certainty = 0.2338(Affirmative) < succ>
               bacterial outside --- Certainty = 0.0000(Not Clear)   < succ>
             bacterial cytoplasm --- Certainty = 0.0000(Not Clear)   < succ>
```

The protein has homology with the following sequences in the databases:

```
>GP:AAC95439 GB:AF068901 cell division protein FtsA [Streptococcus pneumoniae]
Identities = 299/448 (66%), Positives = 368/448 (81%), Gaps = 4/448 (0%)

Query:    1 LDIGTSSIKVLVAEFISGEMNVIGVSNVPSTGVKDGIIIDIEAAATAIKTAVEQAEEKAG   60
            LDIGTSS+KVLVAE  +GE+NVIGVSN  S GVKDGII+DI+AAATAIK+A+ QAEEKAG
Sbjct:   10 LDIGTSSVKVLVAEQRNGELNVIGVSNAKSKGVKDGIIVDIDAAATAIKSAISQAEEKAG   69

Query:   61 MTIEKVNVGLPANLLQIEPTQGMIPVPSESKEIKDEDVDSVVKSALTKSITPERSVISLV  120
            ++I+ VNVGLP NLLQ+EPTQGMIPV S++KEI D+DV++VVKSALTKS+TP+REVI+ +
Sbjct:   70 ISIKSVNVGLPGNLLQVEPTQGMIPVTSDTKEITDQDVENVVKSALTKSMTPDREVITFI  129

Query:  121 PEEFIVDGFQGIRDPRGMMGIRLEMRGLIYTGPSTILHNLRKTVERAGIKVENIIISPLA  180
            PEEFIVDGFQGIRDPRGMMG+RLEMRGL+YTGP TILHNLRKTVERAG++VEN+IISPLA
Sbjct:  130 PEEFIVDGFQGIRDPRGMMGVRLEMRGLLYTGPRTILHNLRKTVERAGVQVENVIISPLA  189

Query:  181 MAKTILNEGEREFGATVIDMGGGQTTVASMRAQELQYTNIYAEGGEYITKDISKVLKTSL  240
            M +++LNEGEREFGATVIDMG GQTTVA++R QELQ+T+I   EGG+Y+TKDISKVLKTS
Sbjct:  190 MVQSVLNEGEREFGATVIDMGAGQTTVATIRNQELQFTHILQEGGDYVTKDISKVLKTSR  249

Query:  241 AIAEALKFNFGQAEISEASITETVKVDVVGSEEPVEVTERYLSEIISARIRHILDRVKQD  300
             +AE LK N+G+A    AS  ET +V+V+G E VEVTE YLSEIISARI+HIL+++KQ+
Sbjct:  250 KLAEGLKLNYGEAYPPLAS-KETFQVEVIGEVEAVEVTEAYLSEIISARIKHILEQIKQE  308

Query:  301 LERGRLLDLPGGIVLIGGGAIMPGVVEIAQEIFGVTVKLHVPNQVGIRNPMFSNVISLVE  360
            L+R RLLDLPGGIVLIGG AI+PG+VE+AQE+FGV VKL+VPNQVGIRNP F++VISL E
Sbjct:  309 LDRRRLLDLPGGIVLIGGNAILPGMVELAQEVFGVRVKLYVPNQVGIRNPAFAHVISLSE  368

Query:  361 YVGMMSEVDVLAQTAVSGEELLRRKPIDFSGQESYLPDYDDSRRPESTIGYEQQ---ASQ  417
            + G ++EV++LAQ A+ GE L +PI F G    + S  +   E +   ++
Sbjct:  369 FAGQLTEVNLLAQGAIKGENDLSHQPISFGGMLQKTAQFVQSTPVQPAPAPEVEPVAPTE  428

Query:  418 TAYDSQVPSDPKQKISERVRGIFGSMFD                                445
             D Q S  K K+++R RG+ GSMFD
Sbjct:  429 PMADFQQASQNKPKLADRFRGLIGSMFD                                456
```

An alignment of the GAS and GBS proteins is shown below:

```
Identities = 349/456 (76%), Positives = 402/456 (87%), Gaps = 19/456 (4%)

Query:   10 LDIGTSSIKVLVAEFIANEMNVIGVSNVPSSGVKDGIIIDIEAAATAIKEAVKQAEEKAG   69
            LDIGTSSIKVLVAEFI+ EMNVIGVSNVPS+GVKDGIIIDIEAAATAIK AV+QAEEKAG
Sbjct:    1 LDIGTSSIKVLVAEFISGEMNVIGVSNVPSTGVKDGIIIDIEAAATAIKTAVEQAEEKAG   60
```

```
Query:  70 ITIDKINVGLPANLLQIEPTQGMIPVPNESKEIKDEDVESVVKSALTKSITPEREVISLI 129
           +TI+K+NVGLPANLLQIEPTQGMIPVP+ESKEIKDEDV+SVVKSALTKSITPEREVISL+
Sbjct:  61 MTIEKVNVGLPANLLQIEPTQGMIPVPSESKEIKDEDVDSVVKSALTKSITPEREVISLV 120

Query: 130 PLEFIVDGFQGIRDPRGMMGIRLEMRGLIYTGPTTILHNLRKTVERAGIKVEHVVIAPLA 189
           P EFIVDGFQGIRDPRGMMGIRLEMRGLIYTGP+TILHNLRKTVERAGIKVE+++I+PLA
Sbjct: 121 PEEFIVDGFQGIRDPRGMMGIRLEMRGLIYTGPSTILHNLRKTVERAGIKVENIIISPLA 180

Query: 190 LAKSVLNEGEREFGATVIDMGGGQTTVASMRNQELQYTNIYSEGSDYVTKDISKVLRTTV 249
           +AK++LNEGEREFGATVIDMGGGQTTVASMR QELQYTNIY+EG +Y+TKDISKVL+T++
Sbjct: 181 MAKTILNEGEREFGATVIDMGGGQTTVASMRAQELQYTNIYAEGGEYITKDISKVLKTSL 240

Query: 250 EIAEALKFNFGQANVEEASTSDTVQVNVVGNEEPVEITESYLSQIISGRIRQILEHVKQD 309
              IAEALKFNFGQA + EAS ++TV+V+VVG+EEPVE+TE YLS+IIS RIR IL+ VKQD
Sbjct: 241 AIAEALKFNFGQAEISEASITETVKVDVVGSEEPVEVTERYLSEIISARIRHILDRVKQD 300

Query: 310 LGRGRLLDLPGGIILVGGGAIMPGVVEVAQQIFGTRVKLHVPNQVGIRNPMFANVISIVD 369
           L RGRLLDLPGGI+L+GGGAIMPGVVE+AQ+IFG   VKLHVPNQVGIRNPMF+NVIS+V+
Sbjct: 301 LERGRLLDLPGGIVLIGGGAIMPGVVEIAQEIFGVTVKLHVPNQVGIRNPMFSNVISLVE 360

Query: 370 YVGMMSEVDIIAQHAVTGDEMLRHKPVDF--------DYKEKTNTMSTMPYSEPLTSSME 421
           YVGMMSEVD++AQ AV+G+E+LR KP+DF        DY +     ST+ Y +  + +
Sbjct: 361 YVGMMSEVDVLAQTAVSGEELLRRKPIDFSGQESYLPDYDDSRRPESTIGYEQQASQTAY 420

Query: 422 DSNLEPIRARENAQEPTEPKANIGERIRGIFGSMFD                         457
           DS           Q P++PK  I ER+RGIFGSMFD
Sbjct: 421 DS-----------QVPSDPKQKISERVRGIFGSMFD                         445
```

Figure 20:
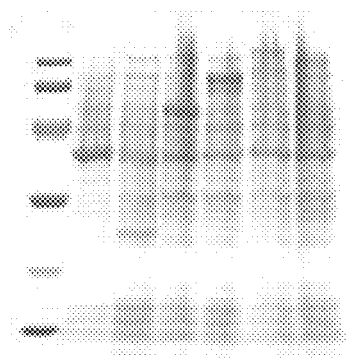

SEQ ID 220 (GBS73) was expressed in *E. coli* as a His-fusion product. SDS-PAGE analysis of total cell extract is shown in FIG. 17 (lane 5; MW 47.8 kDa). It was also expressed in *E. coli* as a GST-fusion product. SDS-PAGE analysis of total cell extract is shown in FIG. 20 (lane 5; MW 70.1 kDa).

Figure 197:
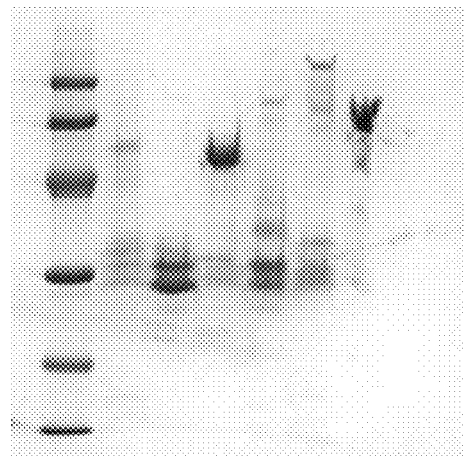

GBS73-GST was purified as shown in FIG. 197, lane 7.

The GBS73-His fusion product was purified (FIG. 103A) and used to immunise mice (lane 1 product; 20 μg/mouse). The resulting antiserum was used for Western blot (FIG. 103B), FACS (FIG. 103C) and in the in vivo passive protection assay (Table III). These tests confirm that the protein is immunoaccessible on GBS bacteria and that it is an effective protective immunogen.

Based on this analysis, it was predicted that these proteins and their epitopes could be useful antigens for vaccines or diagnostics.

EXAMPLE 69

A DNA sequence (GBSx0069) was identified in *S. agalactiae* <SEQ ID 223> which encodes the amino acid sequence <SEQ ID 224>. This protein is predicted to be cell division protein FtsZ (ftsz). Analysis of this protein sequence reveals the following:

```
Possible site: 56
>>> Seems to have a cleavable N-term signal seq.
        INTEGRAL   Likelihood = -1.97   Transmembrane   117-133 (117-133)

----- Final Results -----
                   bacterial membrane  --- Certainty = 0.1786 (Affirmative) < succ>
                   bacterial outside   --- Certainty = 0.0000 (Not Clear)   < succ>
                   bacterial cytoplasm --- Certainty = 0.0000 (Not Clear)   < succ>
```

The protein has homology with the following sequences in the GENPEPT database:

```
>GP:AAC95440 GB:AF068901 cell division protein FtsZ [Streptococcus pneumoniae]
Identities = 327/426 (76%), Positives = 363/426 (84%), Gaps = 7/426 (1%)

Query:    1 MVFSFDTASVQGAVIKVIGVGGGGNAINRMIDEGVAGVEFIAANTDIQALSSSKAETVI    60
            M FSFDTA+ QGAVIKVIGVGGGGNAINRM+DEGV GVEFIAANTD+QALSS+KAETVI
Sbjct:    1 MTFSFDTAAAQGAVIKVIGVGGGGNAINRMVDEGVTGVEFIAANTDVQALSSTKAETVI    60

Query:   61 QLGPKLTRGLGAGGQPEVGRKAAEESEEVLTEALTGADMVFITAGMGGGSGTGAAPVIAR  120
            QLGPKLTRGLGAGGQPEVGRKAAEESEE LTEA++GADMVFITAGMGGGSGTGAAPVIAR
Sbjct:   61 QLGPKLTRGLGAGGQPEVGRKAAEESEETLTEAISGADMVFITAGMGGGSGTGAAPVIAR  120

Query:  121 IAKSLGALTVAVITRPFGFEGNKRSNFAIEGIQELREQVDTLLIISNNNLLEIVDKKTPL  180
            IAK LGALTV V+TRPFGFEG+KR  FA+EGI +LRE VDTLLIISNNNLLEIVDKKTPL
Sbjct:  121 IAKDLGALTVGVVTRPFGFEGSKRGQFAVEGINQLREHVDTLLIISNNNLLEIVDKKTPL  180

Query:  181 LEALSEADNVLRQGVQGITDLITNPGLINLDFADVKTVMANKGNALMGIGIGSGEERITE  240
            LEALSEADNVLRQGVQGITDLITNPGLINLDFADVKTVMANKGNALMGIGIGSGEER+ E
Sbjct:  181 LEALSEADNVLRQGVQGITDLITNPGLINLDFADVKTVMANKGNALMGIGIGSGEERVVE  240

Query:  241 AARKAIYSPLLETTIDGAEDVIVNVTGGMDMTLTEAEEASEIVSQAAGKGVNIWLGTSID  300
            AARKAIYSPLLETTIDGAEDVIVNVTGG+D+TL EAEEAS+IV+QAAG+GVNIWLGTSID
Sbjct:  241 AARKAIYSPLLETTIDGAEDVIVNVTGGLDLTLIEAEEASQIVNQAAGQGVNIWLGTSID  300

Query:  301 MDMKDEIRVTVVATGVRKDKTNQVSGFTTSAPTNQAPSERQSTSNSNFDRRGNFDMTESR  360
              M+DEIRVTVVATGVR+D+  +V      + TN   + + + S+   FDR   +FDM E+
Sbjct:  301 ESMRDEIRVTVVATGVRQDRVEKVVAPQARSATNYRETVKPAHSH-GFDR--HFDMAETA  357

Query:  361 ENPTQQNQPHAQNQQQSSAFGNWDLRRDNISRPTEGELDSKLSMSTFSENDDMDDELETP  420
            E+P Q   P      Q+SAFG+WDLRR++I R T+  +             D  +DEL+TP
Sbjct:  358 ELPKQ--NPRRLEPTQASAFGDWDLRRESIVRTTDSVVSPVERFEAPISQD--EDELDTP  413

Query:  421 PFFKNR  426
            PFFKNR
Sbjct:  414 PFFKNR  419
```

A related DNA sequence was identified in *S. pyogenes* <SEQ ID 225> which encodes the amino acid sequence <SEQ ID 226>. Analysis of this protein sequence reveals the following:

```
Possible site: 56
>>> Seems to have a cleavable N-term signal seq.
      INTEGRAL    Likelihood = -1.81    Transmembrane   117-133 (117-133)

----- Final Results -----
              bacterial membrane --- Certainty = 0.1723 (Affirmative) < succ>
               bacterial outside --- Certainty = 0.0000 (Not Clear) < succ>
             bacterial cytoplasm --- Certainty = 0.0000 (Not Clear) < succ>
```

An alignment of the GAS and GBS proteins is shown below:

```
Identities = 372/439 (84%), Positives = 391/439 (88%), Gaps = 13/439 (2%)

Query:    1 MVFSFDTASVQGAVIKVIGVGGGGNAINRMIDEGVAGVEFIAANTDIQALSSSKAETVI    60
            M FSFDTAS+QGA+IKVIGVGGGGNAINRMIDEGVAGVEFIAANTDIQALSSSKAETVI
Sbjct:    1 MAFSFDTASIQGAIIKVIGVGGGGNAINRMIDEGVAGVEFIAANTDIQALSSSKAETVI    60

Query:   61 QLGPKLTRGLGAGGQPEVGRKAAEESEEVLTEALTGADMVFITAGMGGGSGTGAAPVIAR  120
            QLGPKLTRGLGAGGQPEVGRKAAEESEE+LTEALTGADMVFITAGMGGGSGTGAAPVIAR
Sbjct:   61 QLGPKLTRGLGAGGQPEVGRKAAEESEEILTEALTGADMVFITAGMGGGSGTGAAPVIAR  120

Query:  121 IAKSLGALTVAVITRPFGFEGNKRSNFAIEGIQELREQVDTLLIISNNNLLEIVDKKTPL  180
            IAKSLGALTVAV+TRPFGFEGNKR NFAIEGI+ELREQVDTLLIISNNNLLEIVDKKTPL
Sbjct:  121 IAKSLGALTVAVVTRPFGFEGNKRGNFAIEGIEELREQVDTLLIISNNNLLEIVDKKTPL  180

Query:  181 LEALSEADNVLRQGVQGITDLITNPGLINLDFADVKTVMANKGNALMGIGIGSGEERITE  240
            LEALSEADNVLRQGVQGITDLIT+PGLINLDFADVKTVMANKGNALMGIGIGSGEERI E
Sbjct:  181 LEALSEADNVLRQGVQGITDLITSPGLINLDFADVKTVMANKGNALMGIGIGSGEERIVE  240
```

-continued

```
Query:   241 AARKAIYSPLLETTIDGAEDVIVNVTGGMDMTLTEAEEASEIVSQAAGKGVNIWLGTSID   300
             AARKAIYSPLLETTIDGA+DVIVNVTGG+DMTLTEAEEASEIV QAAG+GVNIWLGTSID
Sbjct:   241 AARKAIYSPLLETTIDGAQDVIVNVTGGLDMTLTEAEEASEIVGQAAGQGVNIWLGTSID   300

Query:   301 MDMKDEIRVTVVATGVRKDKTNQVSGF---TTSAPTN--------QAPSERQSTSNSNFD   349
               MKD+IRVTVVATGVR++K QVSGF   T  TN         A  + + +    FD
Sbjct:   301 DTMKDDIRVTVVATGVRQEKAEQVSGFRQPRTFTQTNAQQVAGAQYASDQAKQSVQPGFD   360

Query:   350 RRGN--FDMTESREMPTQQNQPHAQNQQQSSAFGNWDLRRDNISRPTEGELDSKLSMSTF   407
             RR N   FDM ESRE+P+ Q      NQ Q SAFGNWDLRRDNISRPTEGELD+ L+MSTF
Sbjct:   361 RRSNFDFDMGESREIPSAQKVISNHNQNQGSAFGNWDLRRDNISRPTEGELDNHLNMSTF   420

Query:   408 SENDDMDDELETPPFFKNR                                          426
             S NDD DDELETPPFFKNR
Sbjct:   421 SANDDSDDELETPPFFKNR                                          439
```

Figure 28:
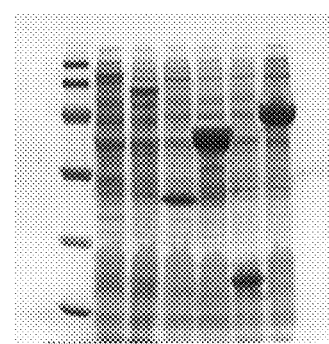
Figure 34:
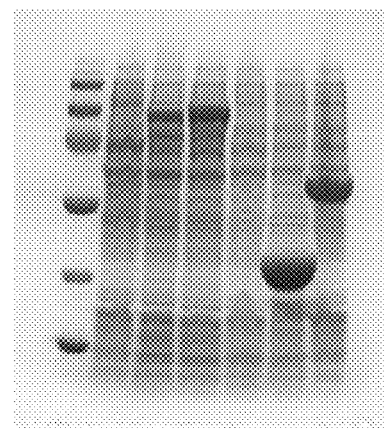

SEQ ID 224 (GBS163) was expressed in *E. coli* as a His-fusion product. SDS-PAGE analysis of total cell extract is shown in FIG. 28 (lane 7; MW 44 kDa). It was also expressed in *E. coli* as a GST-fusion product. SDS-PAGE analysis of total cell extract is shown in FIG. 34 (lane 4; MW 69 kDa).

The GBS163-GST fusion product was purified (FIG. 114A; see also FIG. 198, lane 11) and used to immunise mice (lane 1 product; 20 μg/mouse). The resulting antiserum was used for Western blot (FIG. 114B), FACS and in the in vivo passive protection assay (Table III). These tests confirm that the protein is immunoaccessible on GBS bacteria and that it is an effective protective immunogen.

Based on this analysis, it was predicted that these proteins and their epitopes could be useful antigens for vaccines or diagnostics.

EXAMPLE 70

A DNA sequence (GBSx0070) was identified in *S. agalactiae* <SEQ ID 227> which encodes the amino acid sequence <SEQ ID 228>. Analysis of this protein sequence reveals the following:

```
Possible site: 21
>>> Seems to have no N-terminal signal sequence

----- Final Results -----
          bacterial cytoplasm --- Certainty = 0.2750 (Affirmative) < succ>
          bacterial membrane  --- Certainty = 0.0000 (Not Clear)   < succ>
          bacterial outside   --- Certainty = 0.0000 (Not Clear)   < succ>
```

The protein has homology with the following sequences in the GENPEPT database:

```
>GP:AAC95441 GB:AF068901 YlmE [Streptococcus pneumoniae]
Identities = 140/223 (62%), Positives = 177/223 (78%)

Query:     2 MNLQENKTAIFDNVSKLALKAGRAHESVHIVAVTKYVNCQTTEALIRTGVNHIGENRVDK    61
             MN++EN   +F V++ +L A R   SV ++AVTKYV+   T EAL+  GV+HIGENRVDK
Sbjct:     1 MNVKENTELVFREVAEASLSAHRESGSVSVIAVTKYVDVPTAEALLPLGVHHIGENRVDK    60

Query:    62 FLEKYQALKDEKLTWHLIGSLQRRKVKDVINYVDYFHALDSVKLAAEIQKHAQKLIKCFL   121
             FLEKY+ALKD  +TWHLIG+LQRRKVKDVI YVDYFHALDSVKLA EIQK + ++IKCFL
Sbjct:    61 FLEKYEALKDRDVTWHLIGTLQRRKVKDVIQYVDYFHALDSVKLAGEIQKRSDRVIKCFL   120

Query:   122 QVNISREDSKHGFTIEQIDDALNLISRYDKIELIGIMTMAPLKATKEEISSIFEETESLR   181
             QVNIS+E+SKHGF+ E++ + L  ++R DKIE +G+MTMAP +A+ E++   IF+  + L+
Sbjct:   121 QVNISKEESKHGFSREELLEILPELARLDKIEYVGLMTMAPFEASSEQLKEIFKAAQDLQ   180

Query:   182 KRLQARNIERMPFTELSMGMSRDYDIAIQNGSTFVRIGTSFFK                  224
             + +Q + I  MP TELSMGMSRDY  AIQ GSTFVRIGTSFFK
Sbjct:   181 REIQEKQIPNMPMTELSMGMSRDYKEAIQFGSTFVRIGTSFFK                  223
```

A related DNA sequence was identified in *S. pyogenes* <SEQ ID 229> which encodes the amino acid sequence <SEQ ID 230>. Analysis of this protein sequence reveals the following:

```
Possible site: 20
>>> Seems to have no N-terminal signal sequence

----- Final Results -----
            bacterial cytoplasm --- Certainty = 0.2451(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below:

```
Identities = 133/222 (59%), Positives = 164/222 (72%)

Query:    2 MNLQENKTAIFDNVSKLALKAGRAHESVHIVAVTKYVNCQTTEALIRTGVNHIGENRVDK   61
            M+L  NK IF+ +      A R ++SV ++AVTKYV+      LI  G+ HI ENRVDK
Sbjct:    1 MDLLTNKKKIFETIRLSTEAANRTNDSVSVIAVTKYVDSTIAGQLIEAGIEHIAENRVDK   60

Query:   62 FLEKYQALKDEKLTWHLIGSLQRRKVKDVINYVDYFHALDSVKLAAEIQKHAQKLIKCFL  121
            FLEKY  ALK   + WHLIG+LQRRKVK+VINYVDYFHALDSV+LA EI K A   +KCFL
Sbjct:   61 FLEKYDALKYMPVKWHLIGTLQRRKVKEVINYVDYFHALDSVRLALEINKRADHPVKCFL  120

Query:  122 QVNISREDSKHGFTIEQIDDALNLISRYDKIELIGIMTMAPLKATKEEISSIFEETESLR  181
            QVNIS+E+SKHGF I +ID+A+  I + +KI+L+G+MTMAP  A+KE I +IF +    LR
Sbjct:  121 QVNISKEESKHGFNISEIDEAIGEIGKMEKIQLVGLMTMAPANASKESIITIFRQANQLR  180

Query:  182 KRLQARNIERMPFTELSMGMSRDYDIAIQNGSTFVRIGTSFF                    223
            K LQ +  + MPFTELSMGMS DY IAIQ GSTF+RIG +FF
Sbjct:  181 KNLQLKKRKNMPFTELSMGMSNDYPIAIQEGSTFIRIGRAEF                    222
```

Based on this analysis, it was predicted that these proteins and their epitopes could be useful antigens for vaccines or diagnostics.

EXAMPLE 71

A DNA sequence (GBSx0071) was identified in *S. agalactiae* <SEQ ID 231> which encodes the amino acid sequence <SEQ ID 232>. This protein is predicted to be YlmF. Analysis of this protein sequence reveals the following:

```
Possible site: 58
>>> Seems to have no N-terminal signal sequence

----- Final Results -----
            bacterial cytoplasm --- Certainty = 0.2194(Affirmative) < succ>
             bacterial membrane --- Certainty = 0.0000(Not Clear)   < succ>
              bacterial outside --- Certainty = 0.0000(Not Clear)   < succ>
```

A related GBS nucleic acid sequence <SEQ ID 9617> which encodes amino acid sequence <SEQ ID 9618> was also identified.

The protein has homology with the following sequences in the GENPEPT database:

```
>GP:AAC95442 GB:AF068901 YlmF [Streptococcus pneumoniae]
Identities = 86/200 (43%), Positives = 120/200 (60%), Gaps = 25/200 (12%)

Query:    5 MALKDRFDKIISYFDTDDVSENEVHEVQERTSVQRDSRAATAQEASQRSHMTNSASEEMI   64
            M+LKDRFD+ I YF T+D  +  +E       +RD   T+  +SQ    +    +
Sbjct:    1 MSLKDRFDRFIDYF-TEDEDSSLPYE-------KRDEPVFTSVNSSQEPALPMNQPSQSA   52

Query:   65 GSRPRTYTYDPNRQERQRVQRDNAYQQATPRVQNKDSVRQQREQVTIALKYPRKYEDAQE  124
            G++      T    RQ+    + N   Q+AT             ++V I  ++YPRKYEDA E
Sbjct:   53 GTKENNITRLHARQQ----ELANQSQRAT-------------DKVIIDVRYPRKYEDATE   95

Query:  125 IVDLLIVNECVLIDFQYMLDAQARRCLDYIDGASRVLYGSLQKVGSSMFLLTPANVMVDI  184
            IVDLL   NE +LIDFQYM +  QARRCLDY+DGA   VL G+L+KV S+M+LLTP NV+V++
```

```
-continued
Sbjct:  96 IVDLLAGNESILIDFQYMTEVQARRCLDYLDGACHVLAGNLKKVASTMYLLTPVNVIVNV  155

Query: 185 EEMNIPKTGQETSFDFDMKR                                         204
           E++ +P   Q+  F FDMKR
Sbjct: 156 EDIRLPDEDQQGEFGFDMKR                                         175
```

A related DNA sequence was identified in *S. pyogenes* <SEQ ID 233> which encodes the amino acid sequence <SEQ ID 234>. Analysis of this protein sequence reveals the following:

```
Possible site: 49
>>> Seems to have no N-terminal signal sequence
    INTEGRAL     Likelihood = -0.64    Transmembrane    142-158 (142-158)

----- Final Results -----
              bacterial membrane --- Certainty = 0.1256(Affirmative) < succ>
                bacterial outside --- Certainty = 0.0000(Not Clear) < succ>
              bacterial cytoplasm --- Certainty = 0.0000(Not Clear) < succ>
```

The protein has homology with the following sequences in the databases:

```
>GP: AAC95442 GB: AF068901 YlmF [Streptococcus pneumoniae]
Identities = 82/219 (37%), Positives = 113/219 (51%), Gaps = 46/219 (21%)

Query:   5 MAFKDTFNKMISYFDTDEVNEVEEDVAASTDNVIP--RSQQSVRASSHPKQEPRNNHVQQ  62
           M+ KD F++ I YF DE             D+ +P +  + V S +  QEP      Q
Sbjct:   1 MSLKDRFDRFIDYFTEDE-----------DSSLPYEKRDEPVFTSVNSSQEPALPMNQP  48

Query:  63 DHQARSQEQTRSQMHPKHGTSERYYQQSQPKEGHEMVDRRKRMSTSSIANRREQYQQSTC 122
             A ++E   +++H +                         +AN      Q
Sbjct:  49 SQSAGTKENNITRLHARQ-------------------------QELAN-----QSQRA   76

Query: 123 SDQTTIALKYPRKYEDAQEIVDLLIVNECVLIDFQFMLDAQARRCLDFIDGASKVLYGSL 182
           +D+  I  ++YPRKYEDA EIVDLL  NE +LIDFQ+M + QARRCLD++DGA  VL G+L
Sbjct:  77 TDKVIIDVRYPRKYEDATEIVDLLAGNESILIDFQYMTEVQARRCLDYLDGACHVLAGNL 136

Query: 183 QKVGSSMYLLAPSNVSVNIEEMTIPHTTQDIGFDFDMKR                      221
           +KV S+MYLL P NV VN+E++ +P   Q   F FDMKR
Sbjct: 137 KKVASTMYLLTPVNVIVNVEDIRLPDEDQQGEFGFDMKR                      175
```

An alignment of the GAS and GBS proteins is shown below:

```
Identities = 118/222 (53%), Positives = 145/222 (65%), Gaps = 17/222 (7%)

Query:   1 MEGNMALKDRFDKIISYFDTDDVSENEVHEVQERTSV----QRDSRAATAQEAS------  50
           ME  MA KD F+K+ISYFDTD+V+E E       +V    Q+   RA++  +
Sbjct:   1 MENKMAFKDTFNKMISYFDTDEVNEVEEDVAASTDNVIPRSQQSVRASSHPKQEPRNNHV  60

Query:  51 QRSHMTNSAEEEMIGSRPRTYTYDPNRQERQRVQR----DNAYQQATPRVQNKDSVRQQR 106
           Q+ H   S E+        P+  T +    Q+ Q +      D   ++T + N+    QQ
Sbjct:  61 QQDHQARSQEQTRSQMHPKHGTSERYYQQSQPKEGHEMVDRRKRMSTSSIANRREQYQQS 120

Query: 107 ---EQVTIALKYPRKYEDAQEIVDLLIVNECVLIDFQYMLDAQARRCLDYIDGASRVLYG 163
              +Q TIALKYPRKYEDAQEIVDLLIVNECVLIDFQ+MLDAQARRCLD+IDGAS+VLYG
Sbjct: 121 TCSDQTTIALKYPRKYEDAQEIVDLLIVNECVLIDFQFMLDAQARRCLDFIDGASKVLYG 180

Query: 164 SLQKVGSSMFLLTPANVMVDIEEMNIPKTGQETSFDFDMKRR                   205
           SLQKVGSSM+LL P+NV V+IEEM IP T Q+   FDFDMKRR
Sbjct: 181 SLQKVGSSMYLLAPSNVSVNIEEMTIPHTTQDIGFDFDMKRR                   222
```

Based on this analysis, it was predicted that these proteins and their epitopes could be useful antigens for vaccines or diagnostics.

EXAMPLE 72

A DNA sequence (GBSx0072) was identified in *S. agalactiae* <SEQ ID 235> which encodes the amino acid sequence <SEQ ID 236>. This protein is predicted to be YlmH. Analysis of this protein sequence reveals the following:

```
Possible site: 35
>>> Seems to have no N-terminal signal sequence

----- Final Results -----
            bacterial cytoplasm --- Certainty = 0.3956(Affirmative) < succ>
             bacterial membrane --- Certainty = 0.0000(Not Clear)   < succ>
              bacterial outside --- Certainty = 0.0000(Not Clear)   < succ>
```

The protein has homology with the following sequences in the GENPEPT database:

```
>GP: AAC95444 GB: AF068901 YlmH [Streptococcus pneumoniae]
Identities = 101/255 (39%), Positives = 161/255 (62%)

Query:    6 IYQHFRPEEYAFIHKIDHLAQYVENTYSFITTEFLNPREFKILESVLERRGSHYYTSGQY   65
            IYQHF  E+  F+ K     + VE++Y+   T F+NP + K+L+ + +  G    +SG++
Sbjct:    5 IYQHFSIEDRPFLDKGMEWIKKVEDSYAPFLTPFINPHQEKLLKILAKTYGLACSSSGEF   64

Query:   66 FQTEYVKVIIAPEYYQLDMADFNLSLIEIKYNAKFNHLTHAKIMGTLLNYLGVKRSILGD  125
              +EYV+V++  P+Y+Q +  +DF +SL EI  Y+ KF HLTHAKI+GT++N LG++R + GD
Sbjct:   65 VSSEYVRVLLYPDYFQPEFSDFEISLQEIVYSNKFEHLTHAKILGTVINQLGIERKLFGD  124

Query:  126 ILVEEGCAQVLVDSQMTNHLVHSVTKIGTASVQLAEVPLSKLLTPKQDIQKLTVIASSLR  185
            ILV+E  AQ++++  Q         + KIG    V L E P ++ +    + ++L +  SS R
Sbjct:  125 ILVDEERAQIMINQQFLLLFQDGLKKIGRIPVSLEERPFTEKIDKLEQYRELDLSVSSFR  184

Query:  186 LDKILATILKISRTQSTKLIEADKVKVNYATVNRVSEQLVEGDLISVRGYGRFTLNHNLG  245
            LD +L+ +LK+SR Q+ +LIE    V+VNY V++    +   GDLISVR +GR  L + G
Sbjct:  185 LDVLLSNVLKLSRNQANQLIEKKLVQVNYHVVDKSDYTVQVGDLISVRKFGRLRLLQDKG  244

Query:  246 LTKNQKYKLEVDKMI                                              260
            TK +K K+ V  ++
Sbjct:  245 QTKKEKKKITVQLLL                                              259
```

A related DNA sequence was identified in *S. pyogenes* <SEQ ID 237> which encodes the amino acid sequence <SEQ ID 238>. Analysis of this protein sequence reveals the following:

```
Possible site: 56
>>> Seems to have no N-terminal signal sequence
     INTEGRAL      Likelihood = -0.69      Transmembrane      46-62 (46-62)

----- Final Results -----
             bacterial membrane --- Certainty = 0.1277(Affirmative) < succ>
              bacterial outside --- Certainty = 0.0000(Not Clear)   < succ>
            bacterial cytoplasm --- Certainty = 0.0000(Not Clear)   < succ>
```

The protein has homology with the following sequences in the databases:

```
>GP: AAC95444 GB: AF068901 YlmH [Streptococcus pneumoniae]
Identities = 110/257 (42%), Positives = 161/257 (61%)
Query:    7 IYQHFHQEEYPFIDRMSDMINRVEDYYLLEVTEFLNPREVMILKSLIALTDLKMFVSTDY   66
            IYQHF  E+ PF+D+   + I +VED Y    +T F+NP +   +LK L     L   S ++
Sbjct:    5 IYQHFSIEDRPFLDKGMEWIKKVEDSYAPFLTPFINPHQEKLLKILAKTYGLACSSSGEF   64

Query:   67 YPSEYGRVIIAPGYYDLEQSDFQIALVEISYQAKFNQLTHSQILGTLINELGVKRNLFGD  126
              SEY RV++  P Y+   E  SDF+I+L EI  Y  KF   LTH++ILGT+IN LG++R LFGD
Sbjct:   65 VSSEYVRVLLYPDYFQPEFSDFEISLQEIVYSNKFEHLTHAKILGTVINQLGIERKLFGD  124
```

```
                              -continued
Query: 127 VFVEMGYAQLMIKRELLDYFLGTITKIAKTSVKLREVNFDQLIRSIDNSQTLDILVSSFR  186
           + V+   AQ+MI ++ L  F   + KI +   V L E  F + I  ++  + LD+ VSSFR
Sbjct: 125 ILVDEERAQIMINQQFLLLFQDGLKKIGRIPVSLEERPFTEKIDKLEQYRELDLSVSSFR  184

Query: 187 LDGVVATILKKSRTQVIALIEANKIKVNYRVANKASDNLVIGDMVSIRGHGRFTLLADNG  246
           LD +++  +LK SR Q     LIE   ++VNY V +K+    + +GD++S+R  GR  LL D G
Sbjct: 185 LDVLLSNVLKLSRNQANQLIEKKLVQVNYHVVDKSDYTVQVGDLISVRKFGRLRLLQDKG  244

Query: 247 VTKHGKQKITLSKMIHK                                            263
            TK   K+KIT+  ++  K
Sbjct: 245 QTKKEKKKITVQLLLSK                                            261
```

An alignment of the GAS and GBS proteins is shown below:

```
Identities = 123/256 (48%), Positives = 177/256 (69%)
Query:    6 IYQHFRPEEYAFIHKIDHLAQYVENTYSFITTEFLNPREFKILESVLERRGSHYYTSGQY   65
            IYQHF   EEY FI ++  +    VE+ Y    TEFLNPRE  IL+S++       + S  Y
Sbjct:    7 IYQHFHQEEYPFIDRMSDMINRVEDYYLLEVTEFLNPREVMILKSLIALTDLKMFVSTDY   66

Query:   66 FQTEYVKVIIAPEYYQLDMADFNLSLIEIKYNAKFNHLTHAKIMGTLLNYLGVKRSILGD  125
            + +EY +VIIAP YY L+ +DF ++L+EI Y AKFN  LTH++I+GTL+N LGVKR++ GD
Sbjct:   67 YPSEYGRVIIAPGYYDLEQSDFQIALVEISYQAKFNQLTHSQILGTLINELGVKRNLFGD  126

Query:  126 ILVEEGCAQVLVDSQMTNHLVHSVTKIGTASVQLAEVPLSKLLTPKQDIQKLTVIASSLR  185
            + VE G AQ+++  ++ ++ +  ++TKI       SV+L EV     +L+     + Q L  ++ SS R
Sbjct:  127 VFVEMGYAQLMIKRELLDYFLGTITKIAKTSVKLREVNFDQLIRSIDNSQTLDILVSSFR  186

Query:  186 LDKILATILKISRTQSTKLIEADKVKVNYATVNRVSEQLVEGDLISVRGYGRFTLNHNLG  245
            LD ++ATILK SRTQ     LIEA+K+KVNY   N+ S+ LV GD++S+RG+GRFTL  + G
Sbjct:  187 LDGVVATILKKSRTQVIALIEANKIKVNYRVANKASDNLVIGDMVSIRGHGRFTLLADNG  246

Query:  246 LTKNQKYKLEVDKMIH                                             261
            +TK+  K K+ +  KMIH
Sbjct:  247 VTKHGKQKITLSKMIH                                             262
```

Based on this analysis, it was predicted that these proteins and their epitopes could be useful antigens for vaccines or diagnostics.

EXAMPLE 73

A DNA sequence (GBSx0073) was identified in *S. agalactiae* <SEQ ID 239> which encodes the amino acid sequence <SEQ ID 240>. This protein is predicted to be cell division protein DivIVA (septumplacement). Analysis of this protein sequence reveals the following:

```
Possible site: 14
>>> Seems to have no N-terminal signal sequence

----- Final Results -----
            bacterial cytoplasm --- Certainty = 0.5418 (Affirmative) <
succ>
              bacterial membrane --- Certainty = 0.0000 (Not Clear) < succ>
                bacterial outside --- Certainty = 0.0000 (Not Clear) < succ>
```

The protein has homology with the following sequences in the GENPEPT database:

```
>GP: AAC95445 GB: AF068901 cell division protein DivIVA [Streptococcus pneumoniae]
Identities = 132/227 (58%), Positives = 179/227 (78%), Gaps = 2/227 (0%)
Query:    1 MPLTALEIKDKTFSSKFRGYSEEEVNEFLEIVVDDYEDLIRRNREQEQYIKDLEEKIAYF   60
            MP+T+LEIKDKTF ++FRG+  EEV+EFL+IVV DYEDL+R N ++   IK LEE+++YF
Sbjct:    1 MPITSLEIKDKTFGTRFRGFDPEEVDEFLDIVVRDYEDLVRANHDKNLRIKSLEERLSYF   60

Query:   61 NEMKESLSQSVILAQETAERVKISAQDEASNLMGKATFDAQHLIDEAKLKANQILRDATD  120
            +E+K+SLSQSV++AQ+TAERVK +A +  ++N++   +A   DAQ L++EAK  KAN+ILR ATD
Sbjct:   61 DEIKDSLSQSVLIAQDTAERVKQAAHERSNNIIHQAEQDAQRLLEEAKYKANEILRQATD  120

Query:  121 DAKRVAIETEDLKRQSRVFHQRLLSELEGQLKLANSSAWEELLKPTAIYLQNSDASFKEV  180
            +AK+VA+ETE+LK +SRVFHQRL S +E QL +    SS WE++L+PTA YLQ SD +FKEV
```

```
                            -continued
Sbjct: 121 NAKKVAVETEELKNKSRVFHQRLKSTIESQLAIVESSDWEDILRPTATYLQTSDEAFKEV    180

Query: 181 VEKVLDEDDALPVVDDTESFDATRQFSPDEMEELQRRVEESNKQLEE                  227
           V +VL E     P+   + E  D TRQFS    EM ELQ R+E ++K+L E
Sbjct: 181 VSEVLGEPIPAPI--EEEPIDMTRQFSQAEMAELQARIEVADKELSE                  225
```

A related DNA sequence was identified in *S. pyogenes* <SEQ ID 241> which encodes the amino acid sequence <SEQ ID 242>. Analysis of this protein sequence reveals the following:

```
Possible site: 14
>>> Seems to have no N-terminal signal sequence

----- Final Results -----
              bacterial cytoplasm --- Certainty = 0.6272 (Affirmative) < succ>
               bacterial membrane --- Certainty = 0.0000 (Not Clear)   < succ>
                bacterial outside --- Certainty = 0.0000 (Not Clear)   < succ>
```

An alignment of the GAS and GBS proteins is shown below:

```
Identities = 180/254 (70%), Positives = 217/254 (84%), Gaps = 2/254 (0%)
Query:   1 MPLTALEIKDKTFSSKFRGYSEEEVNEFLEIVVDDYEDLIRRNREQEQYIKDLEEKIAYF    60
           M LT LEIKDKTF +KFRGY EEEVNEFL+IVVDDYE L+R+NR+ E  IKDLEEK++YF
Sbjct:   1 MALTTLEIKDKTFKTKFRGYCEEEVNEFLDIVVDDYEALVRKNRDNEARIKDLEEKLSYF    60

Query:  61 NEMKESLSQSVILAQETAERVKISAQDEASNLMGKATFDAQHLIDEAKLKANQILRDATD   120
           +EMKESLSQSVILAQETAE+VK +A  EA+NL+ KAT+DAQHL+DE+K KANQ+LRDATD
Sbjct:  61 DEMKESLSQSVILAQETAEKVKATANAEATNLVSKATYDAQHLLDESKAKANQMLRDATD   120

Query: 121 DAKRVAIETEDLKRQSRVFHQRLLSELEGQLKLANSSAWEELLKPTAIYLQNSDASFKEV   180
           +AKRVAIETE+LKRQ+RVFHQRL+S +E QL L+NS   W+ELL+PTAIYLQNSD +FKEV
Sbjct: 121 EAKRVAIETEELKRQTRVFHQRLISSIESQLSLSNSPEWDELLQPTAIYLQNSDDAFKEV   180

Query: 181 VEKVLDEDDALPVVDDTESFDATRQFSPDEMEELQRRVEESNKQLEESGLLDTNNFQMEE   240
           V+ VL+ED  +P  DD+ SFDATRQF+P+E+EELQRRV+ESNK+LE    L  ++   E
Sbjct: 181 VKTVLNED--IPESDDSASFDATRQFTPEELEELQRRVDESNKELEAYQLDSQSDSTTEP   238

Query: 241 PINLGETQTFKLNI                                                 254
            +NL ETQTFKLNI
Sbjct: 239 EVNLSETQTFKLNI                                                 252
```

Based on this analysis, it was predicted that these proteins and their epitopes could be useful antigens for vaccines or diagnostics.

EXAMPLE 74

A DNA sequence (GBSx0074) was identified in *S. agalactiae* <SEQ ID 243> which encodes the amino acid sequence <SEQ ID 244>. Analysis of this protein sequence reveals the following:

```
Possible site: 61
>>> Seems to have no N-terminal signal sequence
INTEGRAL Likelihood = -0.43 Transmembrane 841-857 (841-857)

----- Final Results -----
               bacterial membrane --- Certainty = 0.1171 (Affirmative) < succ>
                bacterial outside --- Certainty = 0.0000 (Not Clear)   < succ>
              bacterial cytoplasm --- Certainty = 0.0000 (Not Clear)   < succ>
```

The protein has homology with the following sequences in the GENPEPT database:

```
>GP: AAC95446 GB: AF068901 isoleucine-tRNA synthetase [Streptococcus pneumoniae]
Identities = 730/929 (78%), Positives = 822/929 (87%), Gaps = 1/929 (0%)
Query:   1 MKLKETLNLGQTAFPMRAGLPNKEPQWQEAWDQADIYKKRQALNEGKPAFHLHDGPPYAN    60
           MKLK+TLNLG+T FPMRAGLP KEP WQ+ W+ A +Y++RQ LN+GKP F LHDGPPYAN
Sbjct:   1 MKLKDTLNLGKTEFPMRAGLPTKEPVWQKEWEDAKLYQRRQELNQGKPHFTLHDGPPYAN    60

Query:  61 GNIHVGHALNKISKDIIVRSKSMSGFRAPYVPGWDTHGLPIEQVLAKKGVKRKEMDLAEY   120
           GNIHVGHA+NKISKDIIVRSKSMSGF AP++PGWDTHGLPIEQVL+K+GVKRKEMDL EY
Sbjct:  61 GNIHVGHAMNKISKDIIVRSKSMSGFYAPFIPGWDTHGLPIEQVLSRQGVKRKEMDLVEY   120

Query: 121 LEMCRDYALSQVDKQRDDFKRLGVSADWENPYITLTPDYEADQVRVFGAMADKGYIYRGA   180
           L++CR+YALSQVDKQR+DFKRLGVS DWENPY+TLTPDYEA Q+RVFG MA+KGYIYRGA
Sbjct: 121 LKLCREYALSQVDKQREDFKRLGVSGDWENPYVTLTPDYEAAQIRVFGEMANKGYIYRGA   180

Query: 181 KPVYWSWSSESALAEAEIEYHDIDSTSLYYANKVKDGKGILDTDTYIVVWTTTPFTVTAS   240
           KPVYWSWSSESALAEAEIEYHD+ STSLYYANKVKDGKG+LDTDTYIVVWTTTPFT+TAS
Sbjct: 181 KPVYWSWSSESALAEAEIEYHDLVSTSLYYANKVKDGKGVLDTDTYIVVWTTTPFTITAS   240

Query: 241 RGLTVGPDMEYVVVVPVGSERKYLLAEVLVDSLAAKFGWENFEIVTHHTGKELNHIVTEH   300
           RGLTVG D++YV+V PVG RK+++A  L+ SL+ KFGW + +++  + G+ELNHIVTEH
Sbjct: 241 RGLTVGADIDYVLVQPVGEARKFVVAAELLTSLSEKFGWADVQVLETYRGQELNHIVTEH   300

Query: 301 PWDTEVEELVILGDHVTTDSGTGIVHTAPGFGEDDYNVGIANGLDVVVTVDSRGLMMENA   360
           PWDT VEELVILGDHVTTDSGTGIVHTAPGFGEDDYNVGIAN L+V VTVD RG+MM+NA
Sbjct: 301 PWDTAVEELVILGDHVTTDSGTGIVHTAPGFGEDDYNVGIANNLEVAVTVDERGIMMKNA   360

Query: 361 GPDFEGQFYDKVTPLVKEKLGDLLLASEVINHSYPFDWRTKKPIIWRAVPQWFASVSKFR   420
           GP+FEGQFY+KV P V EKLG+LLLA E I+HSYPFDWRTKKPIIWRAVPQWFASVSKFR
Sbjct: 361 GPEFEGQFYEKVVPTVIEKLGNLLLAQEEISHSYPFDWRTKKPIIWRAVPQWFASVSKFR   420

Query: 421 QEILDEIEKTNFQPEWGKKRLYNMIRDRGDWVISRQRAWGVPLPIFYAEDGTAIMTKEVT   480
           QEILDETEK  F  EWGK RLYNMIRDRGDWVISRQR WGVPLPIFYAEDGTAIM  E
Sbjct: 421 QEILDEIEKVKFHSEWGKVRLYNMIRDRGDWVISRQRTWGVPLPIFYAEDGTAIMVAETI   480

Query: 481 DHVADLFAEYGSIVWWQRDAKDLLPAGYTHPGSPNGLFEKETDIMDVWFDSGSSWNGVMN   540
           +HVA LF ++GS +WW+RDAKDLLP G+THPGSPNG F+KETDIMDVWFDSGSSWNGV+
Sbjct: 481 EHVAQLFSKHGSSIWWERDAKDLLPEGFTHPGSPNGEFKKETDIMDVWFDSGSSWNGVVV   540

Query: 541 ARENLSYPADLYLEGSDQYRGWFNSSLITSVAVNGHAPYKAVLSQGFVLDGKGEKMSKSL   600
           R  L+YPADLYLEGSDQYRGWFNSSLITSVA +G APYK +LSQGF LDGKGEKMSKSL
Sbjct: 541 NRPELTYPADLYLEGSDQYRGWFNSSLITSVANHGVAPYKQILSQGFALDGKGEKMSKSL   600

Query: 601 GNTILPSDVEKQFGAEILRLWVTSVDSSNDVRISMDILEQTSETYRKIRNTLRFLIANTS   660
           GNTI PSDVEKQFGAEILRLWVTSVDSSNDVRISMDIL Q SETYRKIRNTLRFLIANTS
Sbjct: 601 GNTIAPSDVEKQFGAEILRLWVTSVDSSNDVRISMDILSQVSETYRKIRNTLRFLIANTS   660

Query: 661 DFNPKQDAVAYENLGAVDRYMTIKFNQVVDTINKAYAAYDFMAIYKAVVNFVTVDLSAFY   720
           DFNP QD VAY+ L +VD+YMTI+FNQ+V TI  AYA ++F+  IYKA+VNF VDLSAFY
Sbjct: 661 DFNPAQDTVAYDELRSVDKYMTIRFNQLVKTIRDAYADFEFLTIYKALVNFINVDLSAFY   720

Query: 721 LDFAKDVVYIEAANSPERRPMQTVFYDILVKLTKLLTPILPHTAEEIWSYLEHEEEEFVQ   780
           LDFAKDVVYIE A S ERR+MQTVFYDILVK+TKLLTPILPHTAEEIWSYLE E E+FVQ
Sbjct: 721 LDFAKDVVYIEGAKSLERRQMQTVFYDILVKITKLLTPILPHTAEEIWSYLEFETEDFVQ   780

Query: 781 LAEMPVAQTFSGQEEILEEWSAFMTLRTQAQKALEEARNAKVIGKSLEAHLTIYASQEVK   840
           L+E+P  QTF+ QEEIL+ W+AFM  R QAQKALEEARNAKVIGKSLEAHLT+Y ++ VK
Sbjct: 781 LSELPEVQTFANQEEILDTWAAFMDFRGQAQKALEEARNAKVIGKSLEAHLTVYPNEVVK   840

Query: 841 TLLTALNSDIALLMIVSQLTIADEADKPADSVSFEGVAFTVEHAEGEVCERSRRIDPTTK   900
           TLL A+NS++A L+IVS+LTIA+E    P  +SFE VAFTVE A GEVC+R RRIDPTT
Sbjct: 841 TLLEAVNSNVAQLLIVSELTIAEE-PAPEAALSFEDVAFTVERAAGEVCDRCRRIDPTTA   899

Query: 901 MRSYGVAVCDASAAIIEQYYPEAVAQGFE                                929
           RSY   +CD A+I+E+ + +AVA+GFE
Sbjct: 900 ERSYQAVICDHCASIVEENFADAVAEGFE                                928
```

A related DNA sequence was identified in *S. pyogenes* <SEQ ID 245> which encodes the amino acid sequence <SEQ ID 246>. Analysis of this protein sequence reveals the following:

```
Possible site: 61
>>> Seems to have no N-terminal signal sequence
INTEGRAL Likelihood = -1.70 Transmembrame 849-865 (848-867)

----- Final Results -----
           bacterial membrane --- Certainty = 0.1680 (Affirmative) < succ>
             bacterial outside --- Certainty = 0.0000 (Not Clear) < succ>
           bacterial cytoplasm --- Certainty = 0.0000 (Not Clear) < succ>
```

An alignment of the GAS and GBS proteins is shown below:

```
Identities = 798/929 (85%), Positives = 857/929 (91%)
Query:    1 MKLKETLNLGQTAFPMRAGLPNKEPQWQEAWDQADIYKKRQALNEGKPAFHLHDGPPYAN   60
            MKLKETLNLG+TAFPMRAGLPNKEPQWQ AW+QA++YKKRQ LN GKPAFHLHDGPPYAN
Sbjct:    1 MKLKETLNLGKTAFPMRAGLPNKEPQWQAAWEQAELYKKRQELNAGKPAFHLHDGPPYAN   60

Query:   61 GNIHVGHALNKISKDIIVRSKSMSGFRAPYVPGWDTHGLPIEQVLAKKGVKRKEMDLAEY  120
            GNIHVGHALNKISKDIIVRSKSMSGF+APYVPGWDTHGLPIEQVLAK+G+KRKEMDLAEY
Sbjct:   61 GNIHVGHALNKISKDIIVRSKSMSGFQAPYVPGWDTHGLPIEQVLAKQGIKRKEMDLAEY  120

Query:  121 LEMCRDYALSQVDKQRDDFKRLGVSADWENPYITLTPDYEADQVRVFGAMADKGYIYRGA  180
            LEMCR YALSQVDKQRDDFKRLGVSADWENPY+TL P +EADQ+RVFGAMA+KGYIYRGA
Sbjct:  121 LEMCRQYALSQVDKQRDDFKRLGVSADWENPYVTLDPQFEADQIRVFGAMAEKGYIYRGA  180

Query:  181 KPVYWSWSSESALAEAEIEYHDIDSTSLYYANKVKDGKGILDTDTYIVVWTTTPFTVTAS  240
            KPVYWSWSSESALAEAEIEYHDIDSTSLYYANKVKDGKGILDT+TYIVVWTTTPFTVTAS
Sbjct:  181 KPVYWSWSSESALAEAEIEYHDIDSTSLYYANKVKDGKGILDTNTYIVVWTTTPFTVTAS  240

Query:  241 RGLTVGPDMEYVVVVPVGSERKYLLAEVLVDSLAAKFGWENFEIVTHHTGKELNHIVTEH  300
            RGLTVGPDM+Y+VV P GS+R+Y++AE L+DSLA KFGWE+FE +  H G +L +IVTEH
Sbjct:  241 RGLTVGPDMDYLVVKPAGSDRQYVVAEGLLDSLAGKFGWESFETLASHKGADLEYIVTEH  300

Query:  301 PWDTEVEELVILGDHVTTDSGTGIVHTAPGFGEDDYNVGIANGLDVVVTVDSRGLMMENA  360
            PWDT+VEELVILGDHVT +SGTGIVHTAPGFGEDDYNVG    L+V VTVD RGLMMENA
Sbjct:  301 PWDTDVEELVILGDHVTLSSGTGIVHTAPGFGEDDYNVGTKYKLEVAVTVDERGLMMENA  360

Query:  361 GPDFEGQFYDKVTPLVKEKLGDLLLASEVINHSYPFDWRTKKPIIWRAVPQWFASVSKFR  420
            GPDF GQFY+KVTP+V +KLGDLLLA EVINHSYPFDWRTKKPIIWRAVPQWFASVS FR
Sbjct:  361 GPDFHGQFYNKVTPIVIDKLGDLLLAQEVINHSYPFDWRTKKPIIWRAVPQWFASVSDFR  420

Query:  421 QEILDEIEKTNFQFEWGKKRLYNMIRDRGDWVISRQRAWGVPLPIFYAEDGTAIMTKEVT  480
            Q+ILDEIEKT F P WG+ RLYNMIRDRGDWVISRQRAWGVPLPIFYAEDGTAIMTKEVT
Sbjct:  421 QDILDEIEKTTFHPSWGETRLYNMIRDRGDWVISRQRAWGVPLPIFYAEDGTAIMTKEVT  480

Query:  481 DHVADLFAEYGSIVWWQRDARDLLPAGYTHPGSPNGLFEKETDIMDVWFDSGSSWNGVMN  540
            DHVADLF E GSI+WWQ++AKDLLP G+THPGSPNG F KETDIMDVWFDSGSSWNGVMN
Sbjct:  481 DHVADLFQENGSIIWWQKEAKDLLPEGFTHPGSPNGEFTKETDIMDVWFDSGSSWNGVMN  540

Query:  541 ARENLSYPADLYLEGSDQYRGWFNSSLITSVAVNGHAPYKAVLSQGFVLDGKEKNSKSL   600
             +ENLSYPADLYLEGSDQYRGWFNSSLITSVAVNGHAPYKA+LSQGFVLDGKEKMSRS
Sbjct:  541 TKENLSYPADLYLEGSDQYRGWFNSSLITSVAVNGHAPYKAILSQGFVLDGKEKMSKSK  600

Query:  601 GNTILPSDVEKQFGAEILRLWVTSVDSSNDVRISMDILKQTSETYRKIRNTLRFLIANTS  660
            GN I P+DV KQ+GA+ILRLWV SVD+ NDVR+SM+IL Q SETYRKIRNTLRFLIANTS
Sbjct:  601 GNIISPNDVAKQYGADILRLWVASVDTDNDVRVSMEILGQVSETYRKIRNTLRFLIANTS  660

Query:  661 DFNPKQDAVAYENLGAVDRYMTIKFNQVVDTINKAYAAYDFMAIYKAVVNFVTVDLSAFY  720
            DFNP  D VAY +LG VD+YMTI FNQ+V TI  AY  YDFMAIYKAVVNFVTVDLSAFY
Sbjct:  661 DFNPATDTVAYADLGTVDKYMTIVFNQLVATITDAYERYDFMAIYKAVVNFVTVDLSAFY  720

Query:  721 LDFAKDVVYIEAANSPERRRMQTVFYDILVKLTKLLTPILPHTAEEIWSYLEHEEEEFVQ  780
            LDFAKDVVYIEAANS ERRRMQTVFYDILVK+TKLLTPILPHT EEIWSYLEHE E FVQ
Sbjct:  721 LDFAKDVVYIEAANSLERRRMQTVFYDILVKITKLLTPILPHTTEEIWSYLEHESEAFVQ  780

Query:  781 LAEMPVAQTFSGQEEILEEWSAFMTLRTQAQKALEEARNAKVIGKSLEAHLTIYASQEVK  840
            LAEMPVA+TFS QE+ILE WSAFMTLRTQAQKALEEARNAK+IGKSLEAHLTIYAS+EVK
Sbjct:  781 LAEMPVAETFSAQEDILEAWSAFMTLRTQAQKALEEARNAKIIGKSLEAHLTIYASEEVK  840

Query:  841 TLLTALNSDIALLMIVSQLTIADEADKPADSVSFEGVAFTVEHAEGEVCERSRRIDPTTK  900
            TLLTAL+SDIALL+IVSQLTIAD AD PAD+V+FEGVAF VEHA GEVCERSRRIDPTT+
```

```
                             -continued
Sbjct: 841 TLLTALDSDIALLLIVSQLTIADLADAPADAVAFEGVAFIVEHAIGEVCERSRRIDPTTR  900

Query: 901 MRSYGVAVCDASAAIIEQYYPEAVAQGFE                                929
           MRSY   VCD SA IIE+ +PEAVA+GFE
Sbjct: 901 MRSYNAFVCDHSAKIIEENFPEAVAEGFE                                929
```

Based on this analysis, it was predicted that these proteins and their epitopes could be useful antigens for vaccines or diagnostics.

EXAMPLE 75

A DNA sequence (GBSx0075) was identified in *S. agalactiae* <SEQ ID 247> which encodes the amino acid sequence <SEQ ID 248>. Analysis of this protein sequence reveals the following:

```
Possible site: 39
>>> Seems to have no N-terminal signal sequence

----- Final Results -----
             bacterial cytoplasm --- Certainty = 0.3425(Affirmative) < succ>
             bacterial membrane  --- Certainty = 0.0000(Not Clear)   < succ>
             bacterial outside   --- Certainty = 0.0000(Not Clear)   < succ>
```

The protein has no significant homology with any sequences in the GENPEPT database.

A related DNA sequence was identified in *S. pyogenes* <SEQ ID 249> which encodes the amino acid sequence <SEQ ID 250>. Analysis of this protein sequence reveals the following:

```
Possible site: 32
>>> Seems to have no N-terminal signal sequence

----- Final Results -----
             bacterial cytoplasm --- Certainty = 0.3467(Affirmative) < succ>
             bacterial membrane  --- Certainty = 0.0000(Not Clear)   < succ>
             bacterial outside   --- Certainty = 0.0000(Not Clear)   < succ>
```

An alignment of the GAS and GBS proteins is shown below:

```
Identities = 77/99 (77%), Positives = 89/99 (89%)

Query:   1 MRLINTTSSHPELVRNQLQNTDAKLVEVYSAGNTDVVFTKAPKHYELLISNKYRAIKDEE   60
           MRLINTTSSHPEL++NQL+NTDA LVEVYSAGNTDV+FT+APKHYELLISNKYRAIK++E
Sbjct:   1 MRLINTTSSHPELIKNQLKNTDAYLVEVYSAGNTDVIFTQAPKHYELLISNKYRAIKEDE   60

Query:  61 LEAIREFFLKRKIDQSIIQEQMKSLHTAKLIEISYPTT                        99
           L+ IREFFLKRKID I+I Q K+LHT  LIEIS+ T+
Sbjct:  61 LDIIREFFLKRKIDPRIVIPGQSKTLHTNNLIEISFQTS                       99
```

Based on this analysis, it was predicted that these proteins and their epitopes could be useful antigens for vaccines or diagnostics.

EXAMPLE 76

A DNA sequence (GBSx0076) was identified in *S. agalactiae* <SEQ ID 251> which encodes the amino acid sequence <SEQ ID 252>. This protein is predicted to be AP4A hydrolase. Analysis of this protein sequence reveals the following:

```
Possible site: 42
>>> Seems to have no N-terminal signal sequence

----- Final Results -----
              bacterial cytoplasm --- Certainty = 0.1714(Affirmative) < succ>
              bacterial membrane  --- Certainty = 0.0000(Not Clear)   < succ>
              bacterial outside   --- Certainty = 0.0000(Not Clear)   < succ>
```

The protein has homology with the following sequences in the GENPEPT database:

```
>GP: AAC06510 GB: AE000676 AP4A hydrolase [Aquifex aeolicus]
Identities = 30/101 (29%), Positives = 48/101 (46%),
Gaps = 2/101 (1%)

Query:  32 KIILVQAPNGAWFLPGGEIEENENHLEALTRELIEELGYSATIGHYYGQADEYFYSRHRD    91
           +++L++ P+  W  P G IE  E    E  RE+ EE G    I  Y G+    Y+Y+   +
Sbjct:  16 EVLLIKTPSNVWSFPKGNIEPGEKPEETAVREVWEETGVKGEILDYIGEI-HYWYTLKGE    74

Query:  92 TYYYNPAYIYEVTAYHKDQAPLEDFNHLAWFPIQEAKEKLK                     132
            +     Y Y +     + P +       +FPI+EAK+ LK
Sbjct:  75 RIFKTVKY-YLMKYKEGEPRPSWEVKDAKFFPIKEAKKLLK                     114
```

A related DNA sequence was identified in *S. pyogenes* <SEQ ID 253> which encodes the amino acid sequence <SEQ ID 254>. Analysis of this protein sequence reveals the following:

```
Possible site: 47
>>> Seems to have no N-terminal signal sequence

----- Final Results -----
              bacterial cytoplasm --- Certainty = 0.1954(Affirmative) < succ>
              bacterial membrane  --- Certainty = 0.0000(Not Clear)   < succ>
              bacterial outside   --- Certainty = 0.0000(Not Clear)   < succ>
```

An alignment of the GAS and GBS proteins is shown below:

```
Identities = 102/149 (68%), Positives = 118/149 (78%)

Query:    1 MTNPTFGEKIDNVNYRSRFGVYAIIPNPTHDKIILVQAPNGAWFLPGGEIEENENHLEAL    60
            M  PTFG K  + +Y +R+GVYAIIPN    KIILVQAPNG+WFLPGGEIE  E  L+AL
Sbjct:    1 MMIPTFGHKNAHKDYVTRYGVYAIIPNHEQTKIILVQAPNGSWFLPGGEIEAGEGQLQAL    60

Query:   61 TRELIEELGYSATIGHYYGQADEYFYSRHRDTYYYNPAYIYEVTAYHKDQAPLEDFNHLA   120
             RELIEELG+SATIG YYGQADEYFYSRHRDT++Y PAY+YEVTA+    PLEDFN+L
Sbjct:   61 ERELIEELGFSATIGSYYGQADEYFYSRHRDTHFYHPAYLYEVTAFQAVSKPLEDFNNLG   120

Query:  121 WFPIQEAKEKLKRGSHRWGVQAWEKNHHS                                149
            WF  EA  KLKR SH+WGV+ W+K HHS
Sbjct:  121 WFSPIEAIAKLKRESHQWGVKEWQKKHHS                                149
```

Based on this analysis, it was predicted that these proteins and their epitopes could be useful antigens for vaccines or diagnostics.

EXAMPLE 77

A DNA sequence (GBSx0077) was identified in *S. agalactiae* <SEQ ID 255> which encodes the amino acid sequence <SEQ ID 256>. This protein is predicted to be ClpE (clpB-1). Analysis of this protein sequence reveals the following:

```
Possible site: 54
>>> Seems to have no N-terminal signal sequence

----- Final Results -----
              bacterial cytoplasm --- Certainty = 0.2882(Affirmative) < succ>
               bacterial membrane --- Certainty = 0.0000(Not Clear) < succ>
                bacterial outside --- Certainty = 0.0000(Not Clear) < succ>
```

The protein has homology with the following sequences in the GENPEPT database:

```
>GP: AAD01782 GB: AF023421 ClpE [Lactococcus lactis]
Identities = 560/752 (74%), Positives = 647/752 (85%), Gaps = 12/752 (1%)

Query:    1 MLCQNCKLNESTIHLYTNVNGKQKQVDLCQNCYQIIKTDPNNPLFSGLNHVS-HAPGGIN   59
            MLCQNC +NE+TIHLYT+VNG++KQ+DLCQNCYQI+K+         LF  N  + ++      N
Sbjct:    1 MLCQNCNINEATIHLYTSVNGQKKQIDLCQNCYQIMKSGGQEALFGAGNASNGNSDEPFN   60

Query:   60 PFFDDFFGDLNNFRAFNGQDLPNTPPTQSGGNRGGGNGNGRNNNRNQTATPSQAKGILEE  119
            PF +D F  L    + FNG     TPPTQ+GG     G  N R         Q KG+LEE
Sbjct:   61 PF-NDIFSALQG-QDFNGAASNQTPPTQTGGRGPRGPQNPR---------AKQPKGMLEE  109

Query:  120 FGINVTEIARHGDIDPVIGRDSEIIRVIEILNRRTKNNPVLIGEPGVGKTAVVEGLAQKI  179
            FGIN+TE AR G+IDPVIGRD EI RVIEILNRRTKNNPVLIGEPGVGKTAVVEGLAQKI
Sbjct:  110 FGINITESARRGEIDPVIGRDEEIKRVIEILNRRTKNNPVLIGEPGVGKTAVVEGLAQKI  169

Query:  180 VDGNVPHKLQGKQVIRLDVVSLVQGTGIRGQFEERMQKLMEEIRQRQDVILFIDEIHEIV  239
                VDG+VP KLQ K+VIRLDVVSLVQGTGIRGQFEERMQKLM+EIR+R DVI+FIDEIHEIV
Sbjct:  170 VDGDVPQKLQNKEVIRLDVVSLVQGTGIRGQFEERMQKLMDEIRKRNDVIMFIDEIHEIV  229

Query:  240 GAGTAGEGSMDAGNILKPALARGELQLVGATTLNEYRIIEKDAALERRMQPVKVDEPSVE  299
            GAG+AG+G+MDAGNILKPALARGELQLVGATTLNEYRIIEKDAALERRMQPVKVDEPSV+
Sbjct:  230 GAGSAGDGNMDAGNILKPALARGELQLVGATTLNEYRIIEKDAALERRMQPVKVDEPSVD  289

Query:  300 ETITILKGIQKKYEDYHHVKYNNDAIEAAAVLSNRYIQDRFLPDKAIDLLDEAGSKMNLT  359
            ETITIL+GIQ +YEDYHHVKY ++AIEAAA LSNRYIQDRFLPDKAIDLLDE+GSK NLT
Sbjct:  290 ETITILRGIQARYEDYHHVKYTDEAIEAAAHLSNRYIQDRFLPDKAIDLLDESGSKKNLT  349

Query:  360 LNFVDPKEIDQRLIEAENLKAQATREEDYERAAYFRDQIAKYKEMQQQKVDDQDTPIITE  419
            L FVDP++I++R+ +AE+ K +AT+ ED+E+AA+FRDQI+K +E+Q+Q+V D+D P+ITE
Sbjct:  350 LKFVDPEDINRRIADAESKKNEATKAEDFEKAAHFRDQISKLRELQKQEVTDEDMPVITE  409

Query:  420 KTIEHIIEEKTNIPVGDLKEKEQSQLINLADDLKQHVIGQDDAVVKIAKAIRRNRVGLGS  479
            K IE I+E+KT IPVGDLKEKEQ+QLINLADDLK HVIGQD+AV KI+KAIRR+RVGLG
Sbjct:  410 KDIEQIVEQKTQIPVGDLKEKEQTQLINLADDLKAHVIGQDEAVDKISKAIRRSRVGLGK  469

Query:  480 PNRPIGSFLFVGPTGVGKTELSKQLAIELFGSADSMIRFDMSEYMEKHAVAKLVGAPPGY  539
            PNRPIG FLFVGPTGVGKTEL+KQLA ELFGS++SMIRFDMSEYMEKH+VAKL+GAPPGY
Sbjct:  470 PNRPIGFFLFVGPTGVGKTELAKQLAKELFGSSESMIRFDMSEYMEKHSVAKLIGAPPGY  529

Query:  540 VGYEEAGQLTEKVRRNPYSLILLDEIEKAHPDVMHMFLQVLDDGRLTDGQGRTVSFKDTI  599
            VGYEEAGQLTE+VRRNPYSLILLDEIEKAHPDVMHMFLQ+L+DGRLTD QGRTVSFKD++
Sbjct:  530 VGYEEAGQLTERVRRNPYSLILLDEIEKAHPDVMHMFLQILEDGRLTDAQGRTVSFKDSL  589

Query:  600 IIMTSNAGSGKTEASVGFGASREGRTNSVLGQLGNFFSPEFMNRFDGIIEFKALDKENLL  659
            IIMTSNAG+GK EASVGFGA+REGRT SVLGQLG+FFSPEFMNRFDGIIEF AL KENLL
Sbjct:  590 IIMTSNAGTGKVEASVGFGAAREGRTKSVLGQLGDFFSPEFMNRFDGIIEFSALSKENLL  649

Query:  660 NIVDIMLSDVNARLAINGIHLDVTDKVKEKLVDGLYDPKMGARPLRRTIQEHIEDAITDY  719
            IVD+ML +VN ++  N IHL  VT   KEKLVDLGY+P MGARPLRR IQE+IED+I D+
```

```
                            -continued
Sbjct: 650 KIVDLMLDEVNEQIGRNDIHLSVTQAAKEKLVDLGYNPAMGARPLRRIIQENIEDSIADF 709

Query: 720 YLENPSEKELRAIMTSNGNIIIKSSKKTEEST                             751
           Y+E+P  K+L A +   +  +I    +++T E+T
Sbjct: 710 YIEHPEYKQLVADLIDDKIVISNQTQETAETT                             741
```

A related DNA sequence was identified in *S. pyogenes* <SEQ ID 257> which encodes the amino acid sequence <SEQ ID 258>. Analysis of this protein sequence reveals the following:

```
Possible site: 43
>>> Seems to have no N-terminal signal sequence

----- Final Results -----
              bacterial cytoplasm --- Certainty = 0.3104(Affirmative) < succ>
               bacterial membrane --- Certainty = 0.0000(Not Clear)   < succ>
                bacterial outside --- Certainty = 0.0000(Not Clear)   < succ>
```

An alignment of the GAS and GBS proteins is shown below:

```
Identities = 640/751 (85%), Positives = 691/751 (91%), Gaps = 7/751 (0%)

Query:   1 MLCQNCKLNESTIHLYTNVNGKQKQVDLCQNCYQIIKTDPNNPLFSGLNHVSHAPG-GIN   59
           MLCQNC LNESTIHLYT+VNGKQ+QVDLCQNCYQI+K+DP N + +GL       A    +
Sbjct:   1 MLCQNCNLNESTIHLYTSVNGKQRQVDLCQNCYQIMKSDPANSILNGLTPGYRAQDRSTS  60

Query:  60 PFFDDFFGDLNNFRAFNGQDLPNTPPTQSGGNRGGGNGNGRNNNRNQTATPS----QAKG 115
           PFFDDFFGDLNNFRAF  +LPNTPPTQ+G N  GG    G N N  + A P     QAKG
Sbjct:  61 PFFDDFFGDLNNFRAFG--NLPNTPPTQAGQNGNGGGRYGGNYNGQRPAQPQTPNQQAKG 118

Query: 116 ILEEFGINVTEIARHGDIDPVIGRDSEIIRVIEILNRRTKNNPVLIGEPGVGKTAVVEGL 175
           +LEEFGINVT+IAR+G+IDPVIGRD EI RVIEILNRRTKNNPVLIGEPGVGKTAVVEGL
Sbjct: 119 LLEEFGINVTDIARNGNIDPVIGRDEEITRVIEILNRRTKNNPVLIGEPGVGKTAVVEGL 178

Query: 176 AQKIVDGNVPHKLQGKQVIRLDVVSLVQGTGIRGQFEERMQKLMEEIRQRQDVILFIDEI 235
           AQKI+DG VP KLQGKQVIRLDVVSLVQGTGIRGQFEERMQKLMEEIR R+DVILFIDEI
Sbjct: 179 AQKIIDGTVPQKLQGKQVIRLDVVSLVQGTGIRGQFEERMQKLMEEIRNRKDVILFIDEI 238

Query: 236 HEIVGAGTAGEGSMDAGNILKPALARGELQLVGATTLNEYRIIEKDAALERRMQPVKVDE 295
           HEIVGAG+AG+G+MDAGNILKPALARGELQLVGATTLNEYRIIEKDAALERRMQPVKVDE
Sbjct: 239 HEIVGAGSAGDGNMDAGNILKPALARGELQLVGATTLNEYRIIEKDAALERRMQPVKVDE 298

Query: 296 PSVEETITILKGIQKKYEDYHHVKYNNDAIEAAAVLSNRYIQDRFLPDKAIDLLDEAGSK 355
           PSVEETITILKGIQ KYEDYHHVKY+  AIEAAA LSNRYIQDRFLPDKAIDLLDEAGSK
Sbjct: 299 PSVEETITILKGIQPKYEDYHHVKYSPAAIEAAAHLSNRYIQDRFLPDKAIDLLDEAGSK 358

Query: 356 MNLTLNFVDPKEIDQRLIEAENLKAQATREEDYERAAYFRDQIAKYKEMQQQKVDDQDTP 415
           MNLTLNFVDPKEID+RLIEAENLKAQATR+EDYERAAYFRDQI KYKEMQ QKVD+QD P
Sbjct: 359 MNLTLNFVDPKEIDKRLIEAENLKAQATRDEDYERAAYFRDQITKYKEMQAQKVDEQDIP 418

Query: 416 IITEKTIEHIIEEKTNIPVGDLKEKEQSQLINLADDLKQHVIGQDDAVVKIAKAIRRNRV 475
           IITEKTIE I+E+KTNIPVGDLKEKEQSQL+NLA+DLK HVIGQDDAV KIAKAIRRNRV
Sbjct: 419 IITEKTIEAIVEQKTNIPVGDLKEKEQSQLVNLANDLKAHVIGQDDAVDKIAKAIRRNRV 478

Query: 476 GLGSPNRPIGSFLFVGPTGVGKTELSKQLAIELFGSADSMIRFDMSEYMEKHAVAKLVGA 535
           GLG+PNRPIGSFLFVGPTGVGKTELSKQLAIELFGS ++MIRFDMSEYMEKHAVAKLVGA
Sbjct: 479 GLGTPNRPIGSFLFVGPTGVGKTELSKQLAIELFGSTNNMIRFDMSEYMEKHAVAKLVGA 538

Query: 536 PPGYVGYEEAGQLTEKVRRNPYSLILLDEIEKAHPDVMHMFLQVLDDGRLTDGQGRTVSF 595
           PPGY+GYEEAGQLTE+VRRNPYSLILLDE+EKAHPDVMHMFLQVLDDGRLTDGQGRTVSF
Sbjct: 539 PPGYIGYEEAGQLTEQVRRNPYSLILLDEVEKAHPDVMHMFLQVLDDGRLTDGQGRTVSF 598

Query: 596 KDTIIIMTSNAGSGKTEASVGFGASREGRTNSVLGQLGNFFSPEFMNRFDGIIEFKALDK 655
           KDTIIIMTSNAG+GK EASVGFGA+REGRT+SVLG+L NFFSPEFMNRFDGIIEFKAL K
Sbjct: 599 KDTIIIMTSNAGTGKSEASVGFGAAREGRTSSVLGELSNFFSPEFMNRFDGIIEFKALSK 658

Query: 656 ENLLNIVDIMLSDVNARLAINGIHLDVTDKVKEKLVDLGYDPKMGARPLRRTIQEHIEDA 715
           E+LL+IVD+ML DVN RL  NGIHLDVT KVKEKLVDLGYDPKMGARPLRRTIQ++IEDA
```

```
                            -continued
Sbjct: 659 EHLLHIVDLMLEDVNERLGYNGIHLDVTQKVKEKLVDLGYDPKMGARPLRRTIQDYIEDA 718

Query: 716 ITDYYLENPSEKELRAIMTSNGNIIIKSSKK                              746
           ITDYYLE+P+EK+LRA+MT++ NI IK+ K+
Sbjct: 719 ITDYYLEHPTEKQLRALMTNSENITIKAVKE                              749
```

Based on this analysis, it was predicted that these proteins and their epitopes could be useful antigens for vaccines or diagnostics.

EXAMPLE 78

A DNA sequence (GBSx0078) was identified in *S. agalactiae* <SEQ ID 259> which encodes the amino acid sequence <SEQ ID 260>. This protein is predicted to be glutamine ABC transporter, permease protein (glnP). Analysis of this protein sequence reveals the following:

```
Possible site: 61
>>> Seems to have an uncleavable N-term signal seq
      INTEGRAL    Likelihood = -9.92    Transmembrane    27-43  (15-46)
      INTEGRAL    Likelihood = -2.50    Transmembrane    200-216 (196-217)

----- Final Results -----
              bacterial membrane --- Certainty = 0.4970(Affirmative) < succ>
              bacterial outside  --- Certainty = 0.0000(Not Clear)  < succ>
              bacterial cytoplasm --- Certainty = 0.0000(Not Clear)  < succ>
```

A related GBS nucleic acid sequence <SEQ ID 9619> which encodes amino acid sequence <SEQ ID 9620> was also identified.

The protein has homology with the following sequences in the GENPEPT database:

```
>GP: AAB91000 GB: AE001090 glutamine ABC transporter, permease protein
(glnP) [Archaeoglobus fulgidus]
Identities = 92/209 (44%), Positives = 129/209 (61%), Gaps = 10/209 (4%)
Query:  17 YGVMVTIMISTCVVFFGTIIGVLIALVKRTNLHFLTILANFYVWVFRGTPMVVQIMIAFA
                                                                         76
           +G  VT+ ++   +FFG IIG +  L + +        ++ YV V RGTP++VQI+I +
Sbjct:  21 FGASVTLKLTLISIFFGLIIGTIAGLGRVSKNPLPFAISTAYVEVIRGTPLLVQILIVYF  80

Query:  77 WMHFNNLPTISFGVLDLDFTRLLPGIIIISLNSGAYISEIVRAGIEAVPSGQIEAAYSLG  136
                     LP I  +           GII +S+ SGAYI+EIVRAGIE++P GQ+EAA SLG
Sbjct:  81 -----GLPAIGINLQPEP-----AGIIALSICSGAYIAEIVRAGIESIPIGQMEAARSLG  130

Query: 137 IRPKNTLRYVILPQAFKNILPALGNEFITIIKDSALLQTIGVMELWNGAQSVVTATYSPV  196
              +   +RYVI PQAF+NILPALGNEFI ++KDS+LL   I ++EL   + +V  T++
Sbjct: 131 MTYLQAMRYVIFPQAFRNILPALGNEFIALLKDSSLLSVISIVELTRVGRQIVNTTFNAW  190

Query: 197 APLLFAAFYYLMLTTILSALLKQMEKYLG                                225
              P  L  A +YLM+T   LS L+    +K LG
Sbjct: 191 TPFLGVALFYLMMTIPLSRLVAYSQKKLG                                219
```

A related DNA sequence was identified in *S. pyogenes* <SEQ ID 261> which encodes the amino acid sequence <SEQ ID 262>. Analysis of this protein sequence reveals the following:

```
Possible site: 30
>>> Seems to have an uncleavable N-term signal seq
    INTEGRAL    Likelihood = -9.08    Transmembrane    25-41 (11-44)
    INTEGRAL    Likelihood = -1.91    Transmembrane    202-218 (201-218)

----- Final Results -----
              bacterial membrane --- Certainty = 0.4630(Affirmative) < succ>
              bacterial outside  --- Certainty = 0.0000(Not Clear)   < succ>
              bacterial cytoplasm --- Certainty = 0.0000(Not Clear)  < succ>
```

The protein has homology with the following sequences in the databases:

```
>GP: AAB91000 GB: AE001090 glutamine ABC transporter, permease protein
(glnP) [Archaeoglobus fulgidus]
Identities = 91/209 (43%), Positives = 138/209 (65%), Gaps = 12/209 (5%)
Query:  15 YGVLVTIMISVSVVFFGTLIGVLVTLIKRSHVKPLTWVVNL-YVWIFRGTPMVVQIMIAF   73
           +G  VT+ +++  +FFG +IG +  L + S    PL + ++  YV + RGTP++VQI+I +
Sbjct:  21 FGASVTLKLTLISIFFGLIIGTIAGLGRVSK-NPLPFAISTAYVEVIRGTPLLVQILIVY   79

Query:  74 AWMHFNNMPTIGFGVLDLDFSRLLPGIIIISLNSGAYISEIVRAGIEAVPKGQLEAAYSL  133
              +P IG       ++    GII +S+ SGAYI+EIVRAGIE++P GQ+EAA SL
Sbjct:  80 F-----GLPAIG-----INLQPEPAGIIALSICSGAYIAEIVRAGIESIPIGQMEAARSL  129

Query: 134 GIRPQNAMRYVILPQAFKNILPALGNEFITIIKDSALLQTIGVMELWNGAQSVVTATYSP  193
           G+     AMRYVI PQAF+NILPALGNEFI ++KDS+LL  I ++EL    + +V  T++
Sbjct: 130 GMTYLQAMRYVIFPQAFRNILPALGNEFIALLKDSSLLSVISIVELTRVGRQIVNTTFNA  189

Query: 194 ISPLLVAAFYYLMVTTVMAQLLAVLERHM                                222
           +P L  A +YLM+T  +++L+A ++ +
Sbjct: 190 WTPFLGVALFYLMMTIPLSRLVAYSQKKL                                218
```

An alignment of the GAS and GBS proteins is shown below:

```
Identities = 180/225 (80%), Positives = 208/225 (92%)
Query:   3 MNFSFLPQYWSYFNYGVMVTIMISTCVVFFGTIIGVLIALVKRTNLHFLTILANFYVWVF   62
           M+ SFLP+YW+YFNYGV+VTIMIS  VVFFGT+IGVL+ L+KR+++  LT + N YVW+F
Sbjct:   1 MDLSFLPKYWAYFNYGVLVTIMISVSVVFFGTLIGVLVTLIKRSHVKPLTWVVNLYVWIF   60

Query:  63 RGTPMVVQIMIAFAWMHFNNLPTISFGVLDLDFTRLLPGIIIISLNSGAYISEIVRAGIE  122
           RGTPMVVQIMIAFAWMHFNN+PTI FGVLDLDF+RLLPGIIIISLNSGAYISEIVRAGIE
Sbjct:  61 RGTPMVVQIMIAFAWMHFNNMPTIGFGVLDLDFSRLLPGIIIISLNSGAYISEIVRAGIE  120

Query: 123 AVPSGQIEAAYSLGIRPKNTLRYVILPQAFKNILPALGNEFITIIKDSALLQTIGVMELW  182
           AVP GQ+EAAYSLGIRP+N +RYVILPQAFKNILPALGNEFITIIKDSALLQTIGVMELW
Sbjct: 121 AVPKGQLEAAYSLGIRPQNAMRYVILPQAFKNILPALGNEFITIIKDSALLQTIGVMELW  180

Query: 183 NGAQSVVTATYSPVAPLLFAAFYYLMLTTILSALLKQMEKYLGKG                227
           NGAQSVVTATYSP++PLL AAFYYLM+TT+++ LL  +E+++ +G
Sbjct: 181 NGAQSVVTATYSPISPLLVAAFYYLMVTTVMAQLLAVLERHMAQG                225
```

Based on this analysis, it was predicted that these proteins and their epitopes could be useful antigens for vaccines or diagnostics.

EXAMPLE 79

A DNA sequence (GBSx0079) was identified in *S. agalactiae* <SEQ ID 263> which encodes the amino acid sequence <SEQ ID 264>. This protein is predicted to be phosphomannomutase (manB). Analysis of this protein sequence reveals the following:

```
Possible site: 60
>>> Seems to have no N-terminal signal sequence

----- Final Results -----
            bacterial cytoplasm --- Certainty = 0.5400(Affirmative) < succ>
             bacterial membrane --- Certainty = 0.0000(Not Clear)   < succ>
              bacterial outside --- Certainty = 0.0000(Not Clear)   < succ>
```

A related GBS nucleic acid sequence <SEQ ID 9621> which encodes amino acid sequence <SEQ ID 9622> was also identified.

The protein has homology with the following sequences in the GENPEPT database:

```
>GP: BAB04825 GB: AP001510 phosphomannomutase [Bacillus halodurans]
Identities = 239/548 (43%), Positives = 344/548 (62%), Gaps = 14/548 (2%)
Query:    4 MNYKEIYQEWLENDSLGKDIKSDLEAIKGDESEIQDRFYKTLEFGTAGLRGKLGAGTNRN    63
            M++++ Y++W   + L  ++K  LEAI GD +++D FYK LEFGT G+RG++G G NRN
Sbjct:    1 MSWRQRYEKWKGFNELELELKQSLEAIGGDEQQLEDCFYKNLEFGTGGMRGEIGPGPNRM    60

Query:   64 NTYMVGKAAQALANTIIDHGPEAIARGIAVSYDVRYQSKEFAELTCSIMAANGIKSYIYK   123
            NTY + KA++  A  +++ G    A+G+ ++YD  R++S EFA        +  +GIK+Y+++
Sbjct:   61 NTYTIRKASEGFARYLLEQGEHVKAQGVVIAYDSRHKSPEFAREAALTIGKHGIKAYLFE   120

Query:  124 GIRPTPMCSYAIRALGCVSGVMITASHNPQAYNGYKAYWKEGSQILDDIADQIANHMDAI   183
             +RPTP   S+A+R LG   G++ITASHNP  YNG+K Y  +G  Q+   +  A+++    ++ I
Sbjct:  121 ELRPTPELSFAVRKLGAAGGIVITASHNPPEYNGFKVYGSDGCQLPPEPANRLVKFVNEI   180

Query:  184 TDYQQIKQIPFEEALASGSASYIDESIEEAYKKEVLGLTINDTNID---KSVRVVYTPLN   240
              D    I   E     +G+    I E ++ AY + +   + +N       ++   K VR+V+TPL+
Sbjct:  181 EDELVIPVGDERELKENGTLEMIGEEVDVAYHEALKTIIVNPELLEASAKDVRIVFTPLH   240

Query:  241 GVGNLPVREVLRRRGFENVYVVPEQEMPDPDFTTVGYPNPEVPKAFAYSESLGKSVDADI   300
            G  NLPVR VL    GFENV VV EQE+PDP F+TV  PNPE   AFA +    GK +AD+
Sbjct:  241 GTANLPVRRVLEAVGFENVTVVKEQELPDPQFSTVKAPNPEEHAAFALAIEYGKKTEADV   300

Query:  301 LLATDPDCDRVALEVKDSKGEYIFLNGNKIGALLSYYIFSQRCALGNLPHHPVLVKSIVT   360
            L+ATDPD DRV + V++  GEYI L GN+ G L+ +Y+ SQ+    G LP + +  +K+IVT
Sbjct:  301 LIATDPDADRVGVAVQNQAGEYIVLTGNQTGGLMLHYLLSQKKEKGQLPVNGIALKTIVT   360

Query:  361 GDLSKVIADKYNIETVETLTGFKNICGKANEYDISKDKTYLFGYEESIGFCYGTFVRDKD   420
              +  + IA+ + I  V+TLTGFK I  K  EY + S +   +LFGYEES G+   G FVRDKD
Sbjct:  361 SEFGRAIAEDFGIPMVDTLTGFKFIGEKIKEYEQSGEHQFLFGYEESYGYLIGDFVRDKD   420

Query:  421 AVSASMMVVEMTAYYKERGQTLLDVLQTIYDKFGYYNERQFSLELEGAEGQERISRIMED   480
            AV A  ++   EMTAYYK RG TL D L  ++D++GYY E    S+ L+G  G E+I ++
Sbjct:  421 AVQACLLAAEMTAYYKSRGMTLYDGLLELFDRYGYYREGLTSITLKGKVGVEKIQHVLSQ   480

Query:  481 FRQDPILQVGEMTLENSIDFKDGYK----------DFPKQNCLKYYFNEGSWYALRPSG   529
            FRQ P  QV +  +   D++   K              P N LKY  +GSW+ LRPSG
Sbjct:  481 FRQSPPKQVNDQQVVVIEDYQTKEKVSVKERTVEAITLPTSNVLKYMLEDGSWFCLRPSG   540

Query:  530 TEPKIKCY                                                      537
            TEPK+K Y
Sbjct:  541 TEPKLKIY                                                      548
```

A related DNA sequence was identified in *S. pyogenes* <SEQ ID 265> which encodes the amino acid sequence <SEQ ID 266>. Analysis of this protein sequence reveals the following:

```
Possible site: 35
>>> Seems to have no N-terminal signal sequence

----- Final Results -----
            bacterial cytoplasm --- Certainty = 0.5487(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below:

```
Identities = 470/564 (83%), Positives = 517/564 (91%)
Query:    1 MSHMNYKEIYQEWLENDSLGKDIKSDLEAIKGDESEIQDRFYKTLEFGTAGLRGKLGAGT   60
            MS+M Y E+YQEWL N+ L  DIK+DL AIK +E+EIQDRFYKTLEFGTAGLRGKLGAGT
Sbjct:    1 MSNMTYNEVYQEWLHNNDLSDDIKADLAAIKDNEAEIQDRFYKTLEFGTAGLRGKLGAGT   60

Query:   61 NRMNTYMVGKAAQALANTIIDHGPEAIARGIAVSYDVRYQSKEFAELTCSIMAANGIKSY  120
            NRMNTYMVGKAAQALANTIIDHGPEA+ +GIAVSYDVRYQS+ FAELTCSIMAANGIK+Y
Sbjct:   61 NRMNTYMVGKAAQALANTIIDHGPEAVKKGIAVSYDVRYQSRTFAELTCSIMAANGIKAY  120

Query:  121 IYKGIRPTPMCSYAIRALGCVSGVMITASHNPQAYNGYKAYWKEGSQILDDIADQIANHM  180
            +YKGIRPTPMCSYAIRALGC+SGVMITASHNPQAYNGYKAYW+EGSQILDDIADQIA HM
Sbjct:  121 LYKGIRPTPMCSYAIRALGCISGVMITASHNPQAYNGYKAYWQEGSQILDDIADQIAQHM  180

Query:  181 DAITDYQQIKQIPFEEALASGSASYIDESIEEAYKKEVLGLTINDTNIDKSVRVVYTPLN  240
            +A+T YQ+IKQ+PFE+AL SG   +YIDESIEEAYKKEVLGLTINDT+IDKSVRVVYTPLN
Sbjct:  181 AALTQYQEIKQMPFEKALDSGLVTYIDESIEEAYKKEVLGLTINDTDIDKSVRVVYTPLN  240

Query:  241 GVGNLPVREVLRRRGFENVYVVPEQEMPDPDFTTVGYPNPEVPKAFAYSESLGKSVDADI  300
            GVGNLPVREVLRRRGFENVYVVPEQEMPDPDFTTVGYPNPEVPK FAYSE LGK+VDADI
Sbjct:  241 GVGNLPVREVLRRRGFENVYVVPEQEMPDPDFTTVGYPNPEVPKTFAYSEKLGKAVDADI  300

Query:  301 LLATDPDCDRVALEVKDSKGEYIFLNGNKIGALLSYYIFSQRCALGNLPHHPVLVKSIVT  360
            L+ATDPDCDRVALEVK++ G+Y+FLNGNKIGALLSYYIFSQR  LGNLP +PVLVKSIVT
Sbjct:  301 LIATDPDCDRVALEVKNAVGDYVFLNGNKIGALLSYYIFSQRFDLGNLPANPVLVKSIVT  360

Query:  361 GDLSKVIADKYNIETVETLTGFKNICGKANEYDISKDKTYLFGYEESIGFCYGTFVRDKD  420
            GDLS+ IA  Y IETVETLTGFKNICGKANEYD++K K YLFGYEESIGFCYGTFVRDKD
Sbjct:  361 GDLSRAIASHYGIETVETLTGFKNICGKANEYDVTKQKNYLFGYEESIGFCYGTFVRDKD  420

Query:  421 AVSASMMVVEMTAYYKERGQTLLDVLQTIYDKFGYYNERQFSLELEGAEGQERISRIMED  480
            AVSASMM+VEM AYYK++GQ LLDVLQTIY  FGYYNERQ +LELEG EGQ+RI+RIMED
Sbjct:  421 AVSASMMIVEMAAYYKKKGQNLLDVLQTIYATFGYYNERQIALELEGIEGQKRIARIMED  480

Query:  481 FRQDPILQVGEMTLENSIDFKDGYKDFPKQNCLKYYFNEGSWYALRPSGTEPKIKCYLYT  540
            FRQ PI  V EM L+ +IDF DGY+DFPKQNCLK+Y ++GSWYALRPSGTEPKIK YLYT
Sbjct:  481 FRQTPIASVAEMALDKTIDFIDGYQDFPKQNCLKFYLDDGSWYALRPSGTEPKIKFYLYT  540

Query:  541 IGCTEADSLSKLNAIESACRAKMN                                     564
            IG T+ +S +KL+AIE+ACR K+N
Sbjct:  541 IGQTQENSATKLDAIEAACRTKIN                                     564
```

Based on this analysis, it was predicted that these proteins and their epitopes could be useful antigens for vaccines or diagnostics.

EXAMPLE 80

A DNA sequence (GBSx0080) was identified in *S. agalactiae* <SEQ ID 267> which encodes the amino acid sequence <SEQ ID 268>. This protein is predicted to be methylenetetrahydrofolate dehydrogenase (folD). Analysis of this protein sequence reveals the following:

```
Possible site: 48
>>> Seems to have no N-terminal signal sequence

----- Final Results -----
              bacterial cytoplasm --- Certainty = 0.4672(Affirmative) < succ>
              bacterial membrane  --- Certainty = 0.0000(Not Clear)   < succ>
              bacterial outside   --- Certainty = 0.0000(Not Clear)   < succ>
```

The protein has homology with the following sequences in the GENPEPT database:

```
>GP: AAC44612 GB: U58210 tetrahydrofolate dehydrogenase/cyclohydrolase
[Streptococcus thermophilus]
Identities = 209/282 (74%), Positives = 248/282 (87%)

Query:    1 MTELIDGKALSQKMQAELGRKVERLKEQHGIIPGLAVILVGDNPASQVYVRNKERSALEA   60
            M  ++DGKAL+  MQ +L  KV RLKE+  I+PGL VI+VG+NPASQVYVRNKER+A +A
Sbjct:    1 MAIIMDGKALAVNMQEQLQEKVARLKEKEWIVPGLVVIMVGENPASQVYVRNKERAAKKA   60

Query:   61 GFKSETLRLSESISQEELIDIIHQYNEDKSIHGILVQLPLPQHINDKKIILAIDPKKDVD  120
            GF S+T+ LSESIS+EELI++I +YN++   HGILVQLPLP HIN+ +I+LAIDPKKDVD
Sbjct:   61 GFHSKTVNLSESISEEELIEVIEKYNQNPLFHGILVQLPLPNHINEMRILLAIDPKKDVD  120

Query:  121 GFHPMNTGHLWSGRPMMVPCTPAGIMEMFREYHVDLEGKHAVIIGRSNIVGKPMAQLLLD  180
            GFHPMNTG+LW+GRP MVPCTPAGIME+ REY V+LEGK AVIIGRSNIVGKPMAQLLL+
Sbjct:  121 GFHPMNTGNLWNGRPQMVPCTPAGIMEILREYNVELEGKTAVIIGRSNIVGKPMAQLLLE  180

Query:  181 KNATVTLTHSRTRNLSEVTKEADILIVAIGQGHFVTKDFVKEGAVVIDVGMNRDENGKLI  240
            KNATVTLTHSRT +L++V  +AD+LIVAIG+   FVT++FVKEGAVVIDVG+NRDE GKL
Sbjct:  181 KNATVTLTHSRTPHLAKVCNKADVLIVAIGRAKFVTEEFVKEGAVVIDVGINRDEEGKLC  240

Query:  241 GDVVFEQVAEVASMITPVPGGVGPMTITMLLEQTYQAALRSV                    282
            GDV F+QV E   SMITPVPGGVGPMTITML+EQTYQAALRS+
Sbjct:  241 GDVDFDQVKEKVSMITPVPGGVGPMTITMLMEQTYQAALRSL                    282
```

A related DNA sequence was identified in *S. pyogenes* <SEQ ID 269> which encodes the amino acid sequence <SEQ ID 270>. Analysis of this protein sequence reveals the following:

```
Possible site: 22
>>> Seems to have no N-terminal signal sequence

----- Final Results -----
              bacterial cytoplasm --- Certainty = 0.3368(Affirmative) < succ>
              bacterial membrane  --- Certainty = 0.0000(Not Clear)   < succ>
              bacterial outside   --- Certainty = 0.0000(Not Clear)   < succ>
```

An alignment of the GAS and GBS proteins is shown below:

```
Identities = 230/281 (81%), Positives = 257/281 (90%)

Query:    1 MTELIDGKALSQKMQAELGRKVERLKEQHGIIPGLAVILVGDNPASQVYVRNKERSALEA   60
            MTELIDGKAL+QKMQ EL  KV  LK++ GI+PGLAVILVGD+PASQVYVRNKER+AL
Sbjct:    3 MTELIDGKALAQKMQQELAAKVNNLKQKKGIVPGLAVILVGDDPASQVYVRNKERAALTV  62

Query:   61 GFKSETLRLSESISQEELIDIIHQYNEDKSIHGILVQLPLPQHINDKKIILAIDPKKDVD  120
            GFKSET+RLSE I QEELI +I +YN D +IHGILVQLPLP HINDKKIILAIDPKKDVD
Sbjct:   63 GFKSETVRLSEFICQEELIAVIERYNADNTIHGILVQLPLPNHINDKKIILAIDPKKDVD 122

Query:  121 GFHPMNTGHLWSGRPMMVPCTPAGIMEMFREYHVDLEGKHAVIIGRSNIVGKPMAQLLLD  180
            GFHPMNTGHLWSGRP+MVPCTP+GIME+ REY+V+LEGKHAVIIGRSNIVGKPMAQLLLD
Sbjct:  123 GFHPMNTGHLWSGRPLMVPCTPSGIMELLREYNVNLEGKHAVIIGRSNIVGKPMAQLLLD 182

Query:  181 KNATVTLTHSRTRNLSEVTKEADILIVAIGQGHFVTKDFVKEGAVVIDVGMNRDENGKLI  240
            KNATVTLTHSRTR L EV + AD+LIVAIGQGHF+TK ++K+GA+VIDVGMNRD+NGKLI
Sbjct:  183 KNATVTLTHSRTRQLEEVCRCADVLIVAIGQGHFITKQYIKDGAIVIDVGMNRDDNGKLI 242

Query:  241 GDVVFEQVAEVASMITPVPGGVGPMTITMLLEQTYQAALRS                    281
            GDV F++VAEVA+ ITPVPGGVGPMTI MLLEQTYQ+ALRS
Sbjct:  243 GDVAFDEVAEVAAKITPVPGGVGPMTIAMLLEQTYQSALRS                    283
```

Based on this analysis, it was predicted that these proteins and their epitopes could be useful antigens for vaccines or diagnostics.

EXAMPLE 81

A DNA sequence (GBSx0081) was identified in *S. agalactiae* <SEQ ID 271> which encodes the amino acid sequence <SEQ ID 272>. Analysis of this protein sequence reveals the following:

```
Possible site: 39
>>> Seems to have no N-terminal signal sequence
      INTEGRAL     Likelihood = -3.24      Transmembrane    39-55 (38-58)

----- Final Results -----
             bacterial membrane --- Certainty = 0.2296(Affirmative) < succ>
              bacterial outside --- Certainty = 0.0000(Not Clear)   < succ>
            bacterial cytoplasm --- Certainty = 0.0000(Not Clear)   < succ>
```

A related GBS nucleic acid sequence <SEQ ID 9623> which encodes amino acid sequence <SEQ ID 9624> was also identified.

The protein has homology with the following sequences in the GENPEPT database:

```
>GP:AAC44613 GB:U58210 orf1091 [Streptococcus thermophilus]
Identities = 149/277 (53%), Positives = 191/277 (68%)

Query:    1 MIVGEQEARALIKPRPKSSHKGDYGSVLLIGGFYPYGGAIIMAALACVKTGAGLVTVATQ   60
            M V +   R +I+PR + SHKG YG VLL+GG YPYGGAIIMAA+ACV +GAGLVTVAT
Sbjct:    1 MKVDDDLVRQVIRPRLRGSHKGSYGRVLLVGGLYPYGGAIIMAAIACVNSGAGLVTVATD  60

Query:   61 SCNIPSLHSQLPEVMAFDSDDYKWLEKSIVQSDVIVIGPGLGVSESSRKILNQTMEKIQS  120
            +NI +LH+ LPE MAFD + +     + +DVI+IG GLG  E++    L   + I+S
Sbjct:   61 RENIIALHAHLPEAMAFDLRETERFLDKLRAADVILIGSGLGEEETADWALELVLANIRS 120

Query:  121 HQSVILDGSALTLLSEGAFPQTKAKNLVLTPHQKEWERLSGIAVSQQTKENTQTALKSFP  180
            +Q++++DGSAL LL++             +L+LTPHQKEWERLSG+A+S+Q+  NTQ AL+ F
Sbjct:  121 NQNLVVDGSALNLLAKKNQSSLPKCHLILTPHQKEWERLSGLAISEQSVSNTQRALEEFQ 180

Query:  181 KGTILVAKSSHTRIFQDLDEKEIIVGGPYQATGGMGDTLCGMIAGMLAQFKEASPLDKVS  240
            GTILVAKS  T ++Q  +  + VGGPYQATGGMGDTL GM+AG LAQF          V
Sbjct:  181 SGTILVAKSHKTAVYQGAEVTHLEVGGPYQATGGMGDTLAGMVAGFLAQFASTDSYKAVI 240

Query:  241 VGVYLHSAIAQGLSKEAYVVLPTTISDEIPKEMARLS                        277
            V  +LHSAIA  +++ AYVVLPT IS   IP  M +LS
Sbjct:  241 VATWLHSAIADNIAENAYVVLPTRISKAIPSWMKKLS                        277
```

No corresponding DNA sequence was identified in *S. pyogenes*.

Figure 79:
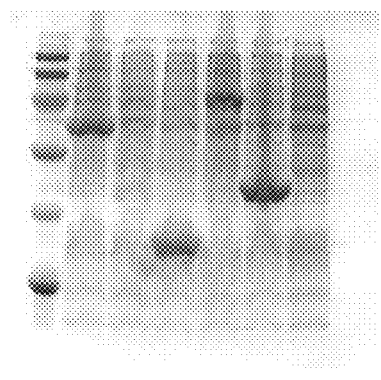
Figure 171:
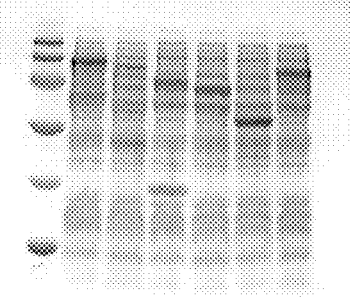

SEQ ID 272 (GBS413) was expressed in *E. coli* as a His-fusion product. SDS-PAGE analysis of total cell extract is shown in FIG. 79 (lane 2; MW 34.2 kDa). It was also expressed in *E. coli* as a GST-fusion product. SDS-PAGE analysis of total cell extract is shown in FIG. 171 (lane 7; MW 59 kDa).

Figure 218:
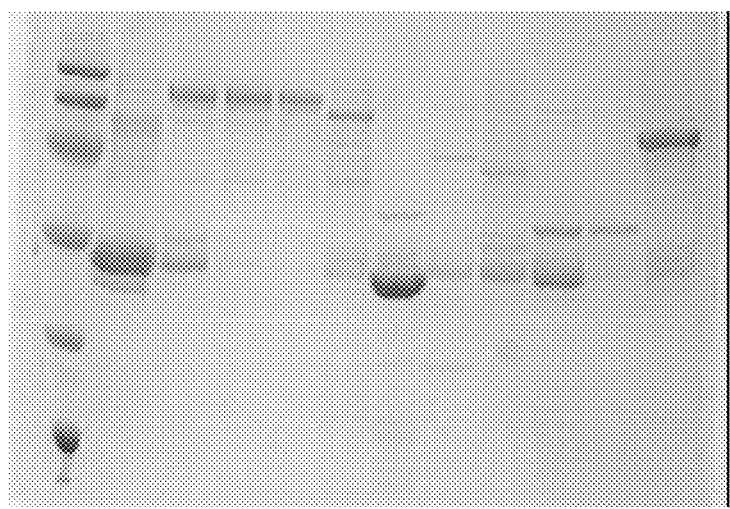

GBS413-GST was purified as shown in FIG. 218, lane 12. Based on this analysis, it was predicted that these proteins and their epitopes could be useful antigens for vaccines or diagnostics.

EXAMPLE 82

A DNA sequence (GBSx0082) was identified in *S. agalactiae* <SEQ ID 273> which encodes the amino acid sequence <SEQ ID 274>. This protein is predicted to be Exonuclease VII large subunit (xseA). Analysis of this protein sequence reveals the following:

```
Possible site: 36
>>> Seems to have no N-terminal signal sequence

----- Final Results -----
            bacterial cytoplasm --- Certainty = 0.3172(Affirmative) < succ>
            bacterial membrane  --- Certainty = 0.0000(Not Clear)   < succ>
            bacterial outside   --- Certainty = 0.0000(Not Clear)   < succ>
```

The protein has homology with the following sequences in the GENPEPT database:

```
>GP:CAB14361 GB:Z99116 similar to exodeoxyribonuclease VII (large
subunit) [Bacillus subtilis]
Identities = 193/446 (43%), Positives = 283/446 (63%), Gaps = 10/446 (2%)

Query:    4 YLSVSTLTKYLKLKFDKDPYLERVYLTGQVSNFR-RRPNHQYFSLKDDKSVIQATMWSGH    62
            Y++VS LTKY+K KFD DP+LE +++ G++SN +      H YF+LK+ K  +Q+ M++
Sbjct:    6 YVTVSALTKYIKRKFDVDPHLENIWIKGELSNVKIHTRGHIYFTLKERKGRMQSVMFARQ    65

Query:   63 FKKLGFELEEGMKVNVVGRVQLYEPSGSYSIIVEKAEPDGIGALAIQFEQLKKKLSQAGY   122
            ++L F+ E GMKV V G + +YEPSG+Y +   ++ +PDG+GAL  +E+LKKKL+  G
Sbjct:   66 SERLPFKPENGMKVLVRGGISVYEPSGNYQLYAKEMQPDGVGALYLAYEELKKKLAGEGL   125

Query:  123 FDDRHKQLIPQFVRKIGVVTSPSGAVIRDIITTVSRRFPGVEILLFPTKVQGEGAAQEIA   182
            FDDR+K+ IP F   IGVVTSP+GA +RD+ITT+ RR+P V++++ P  VQGE A++ I
Sbjct:  126 FDDRYKKQIPAFPATIGVVTSPTGAAVRDVITTLKRRYPLVKVIVLPALVQGENASRSIV   185

Query:  183 QTIALANEKKDLDLLIVGRGGGSIEDLWAFNEECVVEAIFESRLPVISSVGHETDTTLAD   242
            +  I  ANEK+  D+LIVGRGGGSIE+LWAFNEE V  AIF S +P+IS+VGHETD T++D
Sbjct:  186 TRIEEANEKEICDVLIVGRGGGSIEELWAFNEEIVARAIFASNIPIISAVGHETDFTISD   245

Query:  243 FVADRRAATPTAAAELATPVTKIDILSWITERENRMYQSSLRLIRTKEERLQKSKQSVIF   302
            FVAD RAATPT AAE+A P T  D++      E RM ++  +  ++ R+Q  + S   F
Sbjct:  246 FVADIRAATPTGAAEIAVPHT-TDLIERTKTAEVRMTRAMQQHLGQEKGRIQTLQSSYAF   304

Query:  303 RQPERLYDGFLQKLD----NLNQQLTYSMRDKLQTVRQKQGLLHQKLQGIDLKQRIHIYQ   358
            R P+RLY    Q+ D        QLT  +  K + ++       L    LKQ     YQ
Sbjct:  305 RFPKRLYAQKEQQFDLAYQQFQAQLTALLDRKSRQLERETYRLEALHPHEQLKQARTRYQ   364

Query:  359 ERVVQSRRLLSSTMTSQYDSKLARFEKAQDALISLDSSRIVARGYAIIEKNHTLVSTTNG   418
            E+  Q R+     M Q      ++F+      L +L    +++ RGY++   K   L+ + +
Sbjct:  365 EQTNQLRK----NMNIQMKQLHSQFQTVLGKLNALSPLQVMERGYSLAYKEDKLIKSVSQ   420

Query:  419 INEGDHLQVKMQDGLLEVEVKDVRQE                                   444
            I  E D  L++K++DG+L  EV + R E
Sbjct:  421 IEEQDRLEIKLKDGVLTCEVLEKRGE                                   446
```

A related DNA sequence was identified in *S. pyogenes* <SEQ ID 275> which encodes the amino acid sequence <SEQ ID 276>. Analysis of this protein sequence reveals the following:

```
Possible site: 61
>>> Seems to have no N-terminal signal sequence

----- Final Results -----
            bacterial cytoplasm --- Certainty = 0.3275(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below:

```
Identities = 321/446 (71%), Positives = 386/446 (85%)

Query:    1 MSDYLSVSTLTKYLKLKFDKDPYLERVYLTGQVSNFRRRPNHQYFSLKDDKSVIQATMWS   60
            M+DYL+V+ LTKYLKLKFD+DPYLERVYLTGQVSNFR+RP HQYFSLKD+ +VIQATMW+
Sbjct:    6 MADYLTVTHLTKYLKLKFDRDPYLERVYLTGQVSNFRKRPTHQYFSLKDESAVIQATMWA   65

Query:   61 GHFKKLGFELEEGMKVNVVGRVQLYEPSGSYSIIVEKAEPDGIGALAIQFEQLKKKLSQA  120
            G +KKLGF+LEEGMK+NV+GRVQLYEPSGSYSI++EKAEPDGIGALA+QFEQLKKKL+
Sbjct:   66 GVYKKLGFDLEEGMKINVIGRVQLYEPSGSYSIVIEKAEPDGIGALALQFEQLKKKLTAE  125

Query:  121 GYFDDRHKQLIPQFVRKIGVVTSPSGAVIRDIITTVSRRFPGVEILLFPTKVQGEGAAQE  180
            GYF+ +HKQ +PQFV KIGV+TSPSGAVIRDIITTVSRRFPGVEILLFPTKVQG+GAAQE
Sbjct:  126 GYFEQKHKQPLPQFVSKIGVITSPSGAVIRDIITTVSRRFPGVEILLFPTKVQGDGAAQE  185

Query:  181 IAQTIALANEKKDLDLLIVGRGGGSIEDLWAFNEECVVEAIFESRLPVISSVGHETDTTL  240
             +   I  AN+++DLDLLIVGRGGGSIEDLWAFNEE VV+AIFES+LPVISSVGHETDTTL
Sbjct:  186 VVANIRRANQREDLDLLIVGRGGGSIEDLWAFNEEIVVQAIFESQLPVISSVGHETDTTL  245

Query:  241 ADFVADRRAATPTAAAELATPVTKIDILSWITERENRMYQSSLRLIRTKEERLQKSKQSV  300
            ADFVADRRAATPTAAAELATP+TK D++SWI ER+NR YQ+ LR I+ ++E + K  QSV
Sbjct:  246 ADFVADRRAATPTAAAELATPITKTDLMSWIVERQNRSYQACLRRIKQRQEWVDKLSQSV  305

Query:  301 IFRQPERLYDGFLQKLDNLNQQLTYSMRDKLQTVRQKQGLLHQKLQGIDLKQRIHIYQER  360
            IFRQPERLYD +LQK+D L+  L  +M+D+L + ++ +   L      L+ +I  YQ+R
Sbjct:  306 IFRQPERLYDAYLQKIDRLSMTLMNTMKDRLSSAKENKVQLDHALANSQLQTKIERYQDR  365

Query:  361 VVQSRRLLSSTMTSQYDSKLARFEKAQDALISLDSSRIVARGYAIIEKNHTLVSTTNGIN  420
            V  ++RLL + M SQYDS+LARFEKAQDAL+SLD+SRI+ARGYA+IEKN  LV++ + I
Sbjct:  366 VATAKRLLMANMASQYDSQLARFEKAQDALLSLDASRIIARGYAMIEKNQALVASVSQIT  425

Query:  421 EGDHLQVKMQDGLLEVEVKDVRQENI                                   446
            +GD L +KM+DG L+VEVKDV+ ENI
Sbjct:  426 KGDQLTIKMRDGQLDVEVKDVKNENI                                   451
```

Based on this analysis, it was predicted that these proteins and their epitopes could be useful antigens for vaccines or diagnostics.

EXAMPLE 83

A DNA sequence (GBSx0083) was identified in *S. agalactiae* <SEQ ID 277> which encodes the amino acid sequence <SEQ ID 278>. Analysis of this protein sequence reveals the following:

```
Possible site: 33
>>> Seems to have no N-terminal signal sequence

----- Final Results -----
            bacterial cytoplasm --- Certainty = 0.2913(Affirmative) < succ>
             bacterial membrane --- Certainty = 0.0000(Not Clear)   < succ>
              bacterial outside --- Certainty = 0.0000(Not Clear)   < succ>
```

The protein has homology with the following sequences in the GENPEPT database:

```
>GP:AAG07429 GB:AE004821 exodeoxyribonuclease VII small subunit
[Pseudomonas aeruginosa]
Identities = 26/66 (39%), Positives = 51/66 (76%), Gaps = 2/66 (3%)

Query:   1 MSDKKT--FEENLQELETIVSRLETGDVALEDAIAEFQKGMLISKELQRTLKEAEETLVK    58
           M+ KKT   FE++L EL+T+V RLE+G+++LE+++  F++G+ +++E Q +L +AE+ +
Sbjct:   1 MARKKTLDFEQSLTELQTLVERLESGELSLEESLGAFEQGIRLTRECQTSLSQAEQKVQI   60

Query:  59 VMQADG                                                        64
           +++ DG
Sbjct:  61 LLERDG                                                        66
```

A related DNA sequence was identified in *S. pyogenes* <SEQ ID 279> which encodes the amino acid sequence <SEQ ID 280>. Analysis of this protein sequence reveals the following:

```
Possible site: 51
>>> Seems to have no N-terminal signal sequence

----- Final Results -----
            bacterial cytoplasm --- Certainty = 0.2796(Affirmative) < succ>
            bacterial membrane  --- Certainty = 0.0000(Not Clear)   < succ>
            bacterial outside   --- Certainty = 0.0000(Not Clear)   < succ>
```

An alignment of the GAS and GBS proteins is shown below:

```
Identities = 55/70 (78%), Positives = 65/70 (92%)

Query:   1 MSDKKTFEENLQELETIVSRLETGDVALEDAIAEFQKGMLISKELQRTLKEAEETLVKVM   60
           MS  KTFEENLQ+LETIV++LE GDV LE+AI+EFQKGML+SKELQ+TL+ AE+TLVKVM
Sbjct:   1 MSKTKTFEENLQDLETIVNKLENGDVPLEEAISEFQKGMLLSKELQKTLQAAEKTLVKVM   60

Query:  61 QADGTEVEMD                                                    70
           QADGTEV+MD
Sbjct:  61 QADGTEVDMD                                                    70
```

Based on this analysis, it was predicted that these proteins and their epitopes could be useful antigens for vaccines or diagnostics.

EXAMPLE 84

A DNA sequence (GBSx0084) was identified in *S. agalactiae* <SEQ ID 281> which encodes the amino acid sequence <SEQ ID 282>. Analysis of this protein sequence reveals the following:

```
Possible site: 58
>>> Seems to have no N-terminal signal sequence

----- Final Results -----
            bacterial cytoplasm --- Certainty = 0.2614(Affirmative) < succ>
            bacterial membrane  --- Certainty = 0.0000(Not Clear)   < succ>
            bacterial outside   --- Certainty = 0.0000(Not Clear)   < succ>
```

The protein has homology with the following sequences in the GENPEPT database:

```
>GP: BAA25265 GB: AB003187 farnesyl diphosphate synthase [Micrococcus
luteus]
Identities = 126/258 (48%), Positives = 175/258 (66%), Gaps = 2/258 (0%)

Query:   27 LIKAILYSVDGGGKRIRPRILLEILEGFGVELIDGHYDVAAALEMIHTGSLIHDDLPAMD   86
            L +AI YS+  GGKRIRP ++L L+ G   DG     ALEMIHT SLIHDDLPAMD
Sbjct:   31 LHEAINYSLSAGGKRIRPLLVLTTLDSLGGNAHDG-LPFGIALEMIHTYSLIHDDLPAMD   89

Query:   87 NDDFRRGRLTNHKKFDEATAVLAGDSLFLDPFDLVVKAGFKADVTVRLIELLSMSAGSFG  146
            NDD+RRG+LTNHK+FDEATA+LAGD+L  D F  ++     A++ + LI LLS ++GS G
Sbjct:   90 NDDYRRGKLTNHKRFDEATAILAGDALLTDAFQCILNTQLNAEIKLSLINLLSTASGSNG  149

Query:  147 MVGGQMLDMKGENKVLSIDDLSLIHINKTGRLLAYPFVAAGILAEKSEEVKGKLHQAGLL  206
            MV GQMLDM+GE+K L++++L  IHI+KTG L+      V+AGI+   ++    +L+ G
Sbjct:  150 MVYGQMLDMQGEHKTLTLNELERIHIHKTGELIRAAIVSAGIIMNFNDAQIEQLNIIGKN  209

Query:  207 IGHAFQVRDDILDVTASFEELGKTPNKDIVAEKTTYPNLLGLDKSQEILDDTLKKAQAIF  266
            +G  FQ++DDILDV  SFE +GKT   D+  +K+TY +LLGL+ S+++L+D L +
Sbjct:  210 VGLMFQIKDDILDVEGSFENIGKTVGSDLNNDKSTYVSLLGLEASKQLLNDKLTETYDAL  269

Query:  267 QNLEKKANFNARKIIDII                                           284
            + L+   N N + +I  I
Sbjct:  270 KTLQ-PINDNLKTLITYI                                           286
```

A related DNA sequence was identified in *S. pyogenes* <SEQ ID 283> which encodes the amino acid sequence <SEQ ID 284>. Analysis of this protein sequence reveals the following:

```
Possible site: 38
>>> Seems to have no N-terminal signal sequence

----- Final Results -----
            bacterial cytoplasm --- Certainty = 0.3887(Affirmative) < succ>
             bacterial membrane --- Certainty = 0.0000(Not Clear) < succ>
              bacterial outside --- Certainty = 0.0000(Not Clear) < succ>
```

An alignment of the GAS and GBS proteins is shown below:

```
Identities = 192/289 (66%), Positives = 237/289 (81%)

Query:    2 MVTIEKIDEAIHRYYKQTHSVVSPDLIKAILYSVDGGGKRIRPRILLEILEGFGVELIDG   61
            M  + +IDEAI RYYK T + VS +LI AILYSVD GGKRIRP ILLE++EGFGV L +
Sbjct:    1 MDKLARIDEAIRRYYKTTSNGVSEELIDAILYSVDSGGKRIRPLILLEMIEGFGVSLQNA   60

Query:   62 HYDVAAALEMIHTGSLIHDDLPAMDNDDFRRGRLTNHKKFDEATAVLAGDSLFLDPFDLV  121
            H+D+AAALEMIHTGSLIHDDLPAMDNDD+RRGRLTNHK+F EATA+LAGDSLFLDPF L+
Sbjct:   61 HFDLAAALEMIHTGSLIHDDLPAMDNDDYRRGRLTNHKQFGEATAILAGDSLFLDPFGLI  120

Query:  122 VKAGFKADVTVRLIELLSMSAGSFGMVGGQMLDMKGENKVLSIDDLSLIHINKTGRLLAY  181
             +A   ++V V LI+ LS+++G+FGMVGGQMLDMKGEN+  LS+  LSLIH+NKTG+LLA+
Sbjct:  121 AQAELNSEVKVALIQELSLASGTFGMVGGQMLDMKGENQALSLPQLSIHLNKTGKLLAF  180

Query:  182 PFVAAGILAEKSEEVKGKLHQAGLLIGHAFQVRDDILDVTASFEELGKTPNKDIVAEKTT  241
            PF AA ++ E++  V+ +L QAG+LIGHAFQ+RDDILDVTASFE+LGKTP KD+ AEK T
Sbjct:  181 PFKAAALITEQAMTVRQQLEQAGMLIGHAFQIRDDILDVTASFEDLGKTPKKDLFAEKAT  240

Query:  242 YPNLLGLDKSQEILDDTLKKAQAIFQNLEKKANFNARKIIDIIEGLRLN             290
            YP+LLGL+ S ++L +A  IFQ LE    F + I  +IEGLRLN
Sbjct:  241 YPSLLGLEASYQLLTESLDQALTIFQTLESDVGFKPQIITKLIEGLRLN             289
```

Based on this analysis, it was predicted that these proteins and their epitopes could be useful antigens for vaccines or diagnostics.

EXAMPLE 85

A DNA sequence (GBSx0085) was identified in *S. agalactiae* <SEQ ID 285> which encodes the amino acid sequence <SEQ ID 286>. This protein is predicted to be hemolysin-like protein (tly). Analysis of this protein sequence reveals the following:

```
Possible site: 37
>>> Seems to have no N-terminal signal sequence
     INTEGRAL     Likelihood = -0.75    Transmembrane    152-168 (151-168)

----- Final Results -----
              bacterial membrane --- Certainty = 0.1298(Affirmative) < succ>
                bacterial outside --- Certainty = 0.0000(Not Clear) < succ>
              bacterial cytoplasm --- Certainty = 0.0000(Not Clear) < succ>
```

The protein has homology with the following sequences in the GENPEPT database:

```
>GP: BAB06497 GB: AP001516 hemolysin-like protein [Bacillus halodurans]
Identities = 162/270 (60%), Positives = 202/270 (74%), Gaps = 3/270 (1%)
Query:    3 KERVDVLAYKQGLFDTREQAKRGVMAGMVINVINGERYDKPGEKVADDTELKLKGEKLKY   62
            KERVDVL  ++GL +TRE+AKR +MAG+V +    ER DKPG KV  DT L +KGE L Y
Sbjct:    4 KERVDVLLVERGLMETREKAKRSIMAGLVFS--GHERVDKPGLKVDRDTPLSVKGEVLPY   61

Query:   63 VSRGGLKLEKALQVFEISVADKLTIDIGASTGGFTDVMLQSGARLVYAVDVGTNQLVWKL  122
            VSRGGLKLEKA++ F++ + D++ +DIGASTGGFTD  LQ+GA  VYAVDVG NQL WKL
Sbjct:   62 VSRGGLKLEKAIRAFDLHLTDRVVLDIGASTGGFTDCALQNGATFVYAVDVGYNQLAWKL  121

Query:  123 RQDHRVRSMEQYNFRYAQKEDFKEGLPEFASIDVSFISLNLILPALKEILVDGGQVVALI  182
            RQD RV  ME+ NFRY + E  + GLP  A+IDVSFISL LILP LK +L++   VVAL+
Sbjct:  122 RQDERVVVMERTNFRYLKPEVLERGLPNMATIDVSFISLKLILPVLKTMLLENSDVVALV  181

Query:  183 KPQFEAGREQIGKNGIVKDKLVHEKVLTTVTNFTKDYGYTVKHLDFSPIQGGHGNIEFLM  242
            KPQFEAGRE++GK GIV+DK VH+KVL+T+  F    GY V  LDFSPI GG GNIEFL+
Sbjct:  182 KPQFEAGREEVGKKGIVRDKSVHQKVLSTIVEFALKEGYAVGGLDFSPITGGEGNIEFLL  241

Query:  243 HLQKCQDPQNLV-LDQIQDVIEKAHKEFKK                               271
            HL   +D ++ +  + I+D +E+AH E KK
Sbjct:  242 HLMWRKDKESFISQEMIRDTVERAHLELKK                               271
```

A related DNA sequence was identified in *S. pyogenes* <SEQ ID 287> which encodes the amino acid sequence <SEQ ID 288>. Analysis of this protein sequence reveals the following:

```
Possible site: 37
>>> Seems to have no N-terminal signal sequence
     INTEGRAL     Likelihood = -2.92    Transmembrane    150-166 (149-168)

----- Final Results -----
              bacterial membrane --- Certainty = 0.2168(Affirmative) < succ>
                bacterial outside --- Certainty = 0.0000(Not Clear) < succ>
              bacterial cytoplasm --- Certainty = 0.0000(Not Clear) < succ>
```

The protein has homology with the following sequences in the databases:

```
>GP: BAB06497 GB: AP001516 hemolysin-like protein [Bacillus halodurans]
Identities = 156/270 (57%), Positives = 196/270 (71%), Gaps = 3/270 (1%)
Query:    3 KERVDVLAYKQGLFETREQAKRGVMAGLVVSVINGQRYDKPGDKIDDGTELKLKGEKLKY   62
            KERVDVL  ++GL ETRE+AKR +MAGLV S    +R DKPG K+D  T L +KGE L Y
Sbjct:    4 KERVDVLLVERGLMETREKAKRSIMAGLVFS--GHERVDKPGLKVDRDTPLSVKGEVLPY   61

Query:   63 VSRGGLKLEKGLHVFGVSVANQIGIDIGASTGGFTDVMLQDGAKLVYAVDVGTNQLVWKL  122
            VSRGGLKLEK +  F + + +++ +DIGASTGGFTD  LQ+GA  VYAVDVG NQL WKL
Sbjct:   62 VSRGGLKLEKAIRAFDLHLTDRVVLDIGASTGGFTDCALQNGATFVYAVDVGYNQLAWKL  121
```

```
                                   -continued
Query: 123 RQDPRVRSMEQYNFRYAQPEDFNEGQPVFASIDVSFISLSLILPALHNVLSDQGQVIALI  182
           RQD RV  ME+ NFRY +PE     G P  A+IDVSFISL LILP L  +L +   V+AL+
Sbjct: 122 RQDERVVVMERTNFRYLKPEVLERGLPNMATIDVSFISLKLILPVLKTMLLENSDVVALV  181

Query: 183 KPQFEAGREQIGKKGIVKDKQIHEKVIQKVMDFASGYGFTVKGLDFSPIQGGHGNIEFLA  242
           KPQFEAGRE++GKKGIV+DK +H+KV+   +++FA   G+ V GLDFSPI GG GNIEFL
Sbjct: 182 KPQFEAGREEVGKKGIVRDKSVHQKVLSTIVEFALKEGYAVGGLDFSPITGGEGNIEFLL  241

Query: 243 HLAKSQTPET-LAPHLIQKVVAKAHKEFEK                               271
           HL    +  E+ ++   +I+   V +AH E +K
Sbjct: 242 HLMWRKDKESFISQEMIRDTVERAHLELKK                               271
```

An alignment of the GAS and GBS proteins is shown below:

```
Identities = 214/275 (77%), Positives = 238/275 (85%)
Query:   1 MAKERVDVLAYKQGLFDTREQAKRGVMAGMVINVINGERYDKPGEKVADDTELKLKGEKL  60
           M KERVDVLAYKQGLF+TREQAKRGVMAG+V++VING+RYDKPG+K+ D TELKLKGEKL
Sbjct:   1 MPKERVDVLAYKQGLFETREQAKRGVMAGLVVSVINGQRYDKPGDKIDDGTELKLKGEKL  60

Query:  61 KYVSRGGLKLEKALQVFEISVADKLTIDIGASTGGFTDVMLQSGARLVYAVDVGTNQLVW  120
           KYVSRGGLKLEK L VF +SVA+++ IDIGASTGGFTDVMLQ GA+LVYAVDVGTNQLVW
Sbjct:  61 KYVSRGGLKLEKGLHVFGVSVANQIGIDIGASTGGFTDVMLQDGAKLVYAVDVGTNQLVW  120

Query: 121 KLRQDHRVRSMEQYNFRYAQKEDFKEGLPEFASIDVSFISLNLILPALKEILVDGGQVVA  180
           KLRQD RVRSMEQYNFRYAQ EDF  EG P FASIDVSFISL+LILPAL  +L D GQV+A
Sbjct: 121 KLRQDPRVRSMEQYNFRYAQPEDFNEGQPVFASIDVSFISLSLILPALHNVLSDQGQVIA  180

Query: 181 LIKPQFEAGREQIGKNGIVKDKLVHEKVLTTVTNFTKDYGYTVKHLDFSPIQGGHGNIEF  240
           LIKPQFEAGREQIGK GIVKDK +HEKV  V +F   YG+TVK LDFSPIQGGHGNIEF
Sbjct: 181 LIKPQFEAGREQIGKKGIVKDKQIHEKVIQKVMDFASGYGFTVKGLDFSPIQGGHGNIEF  240

Query: 241 LMHLQKCQDPQNLVLDQIQDVIEKAHKEFKKNEEE                          275
           L HL K Q P+ L    IQ V+ KAHKEF+K+E+E
Sbjct: 241 LAHLAKSQTPETLAPHLIQKVVAKAHKEFEKHEKE                          275
```

Figure 57:
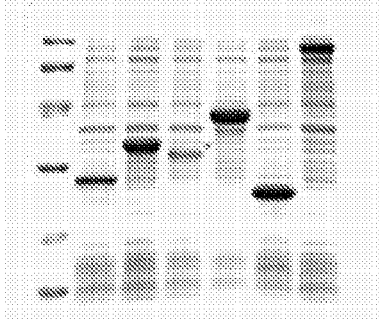
Figure 61:
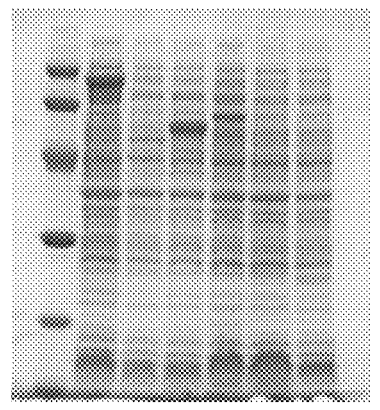

SEQ ID 286 (GBS310) was expressed in *E. coli* as a His-fusion product. SDS-PAGE analysis of total cell extract is shown in FIG. 57 (lane 3; MW 34 kDa). It was also expressed in *E. coli* as a GST-fusion product. SDS-PAGE analysis of total cell extract is shown in FIG. 61 (lane 4; MW 58.8 kDa).

Figure 282:
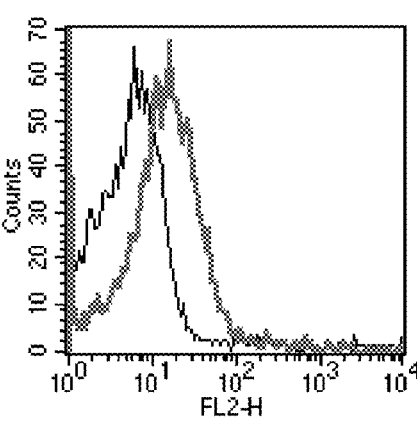

The GBS310-GST fusion product was purified (FIG. 210, lane 10) and used to immunise mice. The resulting antiserum was used for FACS (FIG. 282), which confirmed that the protein is immunoaccessible on GBS bacteria.

Based on this analysis, it was predicted that these proteins and their epitopes could be useful antigens for vaccines or diagnostics.

EXAMPLE 86

A DNA sequence (GBSx0086) was identified in *S. agalactiae* <SEQ ID 289> which encodes the amino acid sequence <SEQ ID 290>. Analysis of this protein sequence reveals the following:

```
           Possible site: 18
           >>> Seems to have no N-terminal signal sequence ----- Final Results -----
                       bacterial cytoplasm --- Certainty = 0.1966(Affirmative) < succ>
                       bacterial membrane  --- Certainty = 0.0000(Not Clear)   < succ>
                       bacterial outside   --- Certainty = 0.0000(Not Clear)   < succ>
```

The protein has homology with the following sequences in the GENPEPT database:

```
>GP: CAA09426 GB: AJ010954 arginine repressor [Bacillus
stearothermophilus]
Identities = 49/153 (32%), Positives = 84/153 (54%), Gaps = 4/153 (2%)
Query:    1 MKKSERLNLIKQIVLNHAVETQHELLRRLEAYGVTLTQATISRDMNEIGIIKVPSAKGRY   60
            M K +R   I++I++NH +ETQ EL+  L+  G  +TQAT+SRD+ E+ ++KVP A GRY
Sbjct:    1 MNKGQRHIKIREIIMNHEIETQDELVDMLKKAGFNVTQATVSRDIKELQLVKVPMANGRY   60

Query:   61 IYGLSNENDPIFTTAVAKPIKTSILSISDKLLGLEQFININVIPGNSQLIKTFIMSHCQE  120
            Y L  +D  F     + +K +++   KL G    + +  +PGN+  I    + +
Sbjct:   61 KYSL--PSDQRFNP--TQKLKRALMDAFVKLDGSGNLLVLKTLPGNAHAIGVLLDNLDWN  116

Query:  121 HIFSLTADDNSLLLIAKSEADADHIRQSMIAML                            153
            I      D++ L+I ++  DA+ +   ++ ML
Sbjct:  117 EIVGTICGDDTCLIICRTAEDAEKVSGQLLGML                            149
```

A related DNA sequence was identified in *S. pyogenes* <SEQ ID 291> which encodes the amino acid sequence <SEQ ID 292>. Analysis of this protein sequence reveals the following:

```
Possible site: 50
>>> Seems to have no N-terminal signal sequence

----- Final Results -----
            bacterial cytoplasm --- Certainty = 0.1717(Affirmative) < succ>
            bacterial membrane  --- Certainty = 0.0000(Not Clear)   < succ>
            bacterial outside   --- Certainty = 0.0000(Not Clear)   < succ>
```

An alignment of the GAS and GBS proteins is shown below:

```
Identities = 87/154 (56%), Positives = 118/154 (76%), Gaps = 1/154 (0%)

Query:    1 MKKSERLNLIKQIVLNHAVETQHELLRRLEAYGVTLTQATISRDMNEIGIIKVPSARGRY   60
            MKKSERL LIK++VL H +ETQH+LLR L  +G+ LTQATISRDMNEIGI+K+PS  GRY
Sbjct:   12 MKKSERLELIKKMVLTHPIETQHDLLRLLAEHGLELTQATISRDMNEIGIVKIPSGSGRY   71

Query:   61 IYGLSNENDPIFTTAVAKPIKTSILSISDKLLGLEQFININVIPGNSQLIKTFIMSHCQE  120
            IYGLS ++         + IK++IL++SDK  GLEQ + + V+PGNS+LIK ++++   +
Sbjct:   72 IYGLSQDSGKKIVQG-PRSIKSTILAVSDKTKGLEQHLYLKVVPGNSKLIKRYLLADFSK  130

Query:  121 HIFSLTADDNSLLLIAKSEADADHIRQSMIAMLE                           154
             IFSL ADD+SLLLIAKS ++AD IRQ ++  ++
Sbjct:  131 AIFSLIADDDSLLLIAKSPSEADMIRQEILLWMQ                           164
```

Based on this analysis, it was predicted that these proteins and their epitopes could be useful antigens for vaccines or diagnostics.

EXAMPLE 87

A DNA sequence (GBSx0088) was identified in *S. agalactiae* <SEQ ID 293> which encodes the amino acid sequence <SEQ ID 294>. Analysis of this protein sequence reveals the following:

```
Possible site: 15
>>> Seems to have no N-terminal signal sequence

----- Final Results -----
            bacterial cytoplasm --- Certainty = 0.3339(Affirmative) < succ>
            bacterial membrane  --- Certainty = 0.0000(Not Clear)   < succ>
            bacterial outside   --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 88

A DNA sequence (GBSx0089) was identified in *S. agalactiae* <SEQ ID 295> which encodes the amino acid sequence <SEQ ID 296>. This protein is predicted to be DNA repair protein recn (recN). Analysis of this protein sequence reveals the following:

```
Possible site: 50
>>> Seems to have no N-terminal signal sequence

----- Final Results -----
            bacterial cytoplasm --- Certainty = 0.1651 (Affirmative) <
succ>
             bacterial membrane --- Certainty = 0.0000 (Not Clear) < succ>
              bacterial outside --- Certainty = 0.0000 (Not Clear) < succ>
```

The protein has homology with the following sequences in the GENPEPT database:

```
>GP: CAB14355 GB: Z99116 recN [Bacillus subtilis]
Identities = 244/567 (43%), Positives = 366/567 (64%), Gaps = 18/567 (3%)
    Query:   1 MLLEISIKNFAIIEEISLNFETGMTVLTGETGAGKSIIIDAMNMMLGSRASVEVIRHGAN    60
               ML E+SIKNFAIIEE++++FE G+TVLTGETGAGKSIIIDA+++++G R S E +R+G
    Sbjct:   1 MLAELSIKNFAIIEELTVSFERGLTVLTGETGAGKSIIIDAISLLVGGRGSSEFVRYGEA    60

Query:  61 KAEIEGFFSVEKNQSLVQLLEENGIELADELII-RREIFQNGRSVSRINGQMVNLSTLKA   119
               KAE+EG F +E  ++ +   E GI+++DE+I+ RR+I  +G+SV R+NG++V +++L+
    Sbjct:  61 KAELEGLFLLESGHPVLGVCAEQGIDVSDEMIVMRRDISTSGKSVCRVNGKLVTIASLRE   120

Query: 120 VGHYLVDIYGQHDQEELMKPNMHILMLDEFGNTEFNVIKERYQSLFDAYRQLRKRVLDKQ   179
               +G  L+DI+GQHD + LM+   H+ +LD+F  E     + YQ   Y +L K++
    Sbjct: 121 IGRLLLDIHGQHDNQLLMEDENHLQLLDKFAGAEVESALKTYQEGYQRYVKLLKKLKQLS   180

Query: 180 KNEQENKSRIEMLEFQIAEIESVALKSDEDQTLLKQRDKLMNHKNIADTLTNAYLMLDNE   239
               ++EQE    +++++FQ+ EIES  L+  +ED  L ++R  N + I ++L NAY  L +E
    Sbjct: 181 ESEQEMAHCLDLIQFQLEEIESAKLELNEDEQLQEERQQISNFEKIYESLQNAYNALRSE   240

Query: 240 EFSSLSNVRSAMNDLMALEEFDREYKDLSTNLSEAYYVIEEVTKRLGDVIDDLDFDAGLL   299
               +     L    V  A    L +++ +      K +S ++S +YY++E+  T ++  +++D+L+FD    L
    Sbjct: 241 Q-GGLDWVGMASAQLEDISDINEPLKKMSESVSNSYYLLEDATFQMRNMLDELEFDPERL   299

Query: 300 QEIENRLDVINTITRKYGGDVNDVLDYFDNITKEYSLLTGSEESSDALEKELKILEHDLI   359
                  IE RL+  I + RKYG  V D+L+Y   I +E    +     +L+KEL  + D+
    Sbjct: 300 NYIETRLNEIKQLKRKYGATVEDILEYASKIEEEIDQIENRDSHLQSLKKELDSVGKDVA   359

Query: 360 ESANQLSLERHKLAKQLENEIKQELTELYMEKADFQVQFTKG----------------KF   403
                   A +S  R   AK+L +EI +EL  LYMEK+ F  +F                 +
    Sbjct: 360 VEAANVSQIRKTWAKKLADEIHRELKSLYMEKSTFDTEFKVRTASRNEEAPLVNGQPVQL   419

Query: 404 NKEGNEIVEFYISTNPGEGFKPLVKVASGGELSRLMLAIKSAFSRKEDKTSIVFDEVDTG   463
                ++G ++V+F ISTN GE   K L KVASGGELSR+MLAIKS FS   ++D TSI+FDEVDTG
    Sbjct: 420 TEQGIDLVKFLISTNTGEPLKSLSKVASGGELSRVMLAIKSIFSSQQDVTSIIFDEVDTG   479

Query: 464 VSGRVAQAIAQKIHKIGSHGQVLAISHLAQVIAIADYQYFIEKISSDSSTVSTVRLLSYE   523
               VSGRVAQAIA+KIHK+    QVL I+HL QV A+AD   +I K   D  T +V+ LS +
    Sbjct: 480 VSGRVAQAIAEKIHKVSIGSQVLCITHLPQVAAMADTHLYIAKELKDGRTTTRVKPLSKQ   539

Query: 524 ERVEEIAKMLAGNNVTDTARTQAKELL                                  550
               E+V EI + +AG  VTD  + AKELL
    Sbjct: 540 EKVAEIERSIAGVEVTDLTKRHAKELL                                  566
```

A related DNA sequence was identified in *S. pyogenes* <SEQ ID 297> which encodes the amino acid sequence <SEQ ID 298>. Analysis of this protein sequence reveals the following:

```
Possible site: 51
>>> Seems to have no N-terminal signal sequence

----- Final Results -----
            bacterial cytoplasm --- Certainty = 0.1215 (Affirmative) <
succ>
             bacterial membrane --- Certainty = 0.0000 (Not Clear) < succ>
              bacterial outside --- Certainty = 0.0000 (Not Clear) < succ>
```

An alignment of the GAS and GBS proteins is shown below:

```
Identities = 403/550 (73%), Positives = 472/550 (85%)
Query:    1 MLLEISIKNFAIIEEISLNFETGMTVLTGETGAGKSIIIDAMNMMLGSRASVEVIRHGAN   60
            MLLEISIKNFAII+EISLNFE GMTVLTGETGAGKSIIIDAMNMMLG+RAS EVIR GAN
Sbjct:    2 MLLEISIKNFAIIDEISLNFENGMTVLTGETGAGKSIIIDAMNMMLGARASTEVIRRGAN   61

Query:   61 KAEIEGFFSVEKNQSLVQLLEENGIELADELIIRREIFQNGRSVSRINGQMVNLSTLKAV  120
            KAEIEGFFSV+     LV LE +GI + +ELIIRR+IF NGRSVSRINGQMVNL+TLK V
Sbjct:   62 KAEIEGFFSVDATPELVACLESSGIAMEEELIIRRDIFANGRSVSRINGQMVNLATLKQV  121

Query:  121 GHYLVDIYGQHDQEELMKPNMHILMLDEFGNTEFNVIKERYQSLFDAYRQLRKRVLDKQK  180
            G +LVDI+GQHDQEELM+P +H   +LD FG+    F  +KE YQ +FD Y+ LR++V+DKQK
Sbjct:  122 GQFLVDIHGQHDQEELMRPQLHQQILDAFGDKAFEQLKENYQLIFDRYKSLRRQVIDKQK  181

Query:  181 NEQENKSRIEMLEFQIAEIESVALKSDEDQTLLKQRDKLMNHKNIADTLTNAYLMLDNEE  240
            NE+E+K RI+ML FQIAEIE+ AL   ED  L  ++RD+LMNHK IADTLTNAY+MLDN++
Sbjct:  182 NEKEHKDRIDMLAFQIAEIEAAALSRGEDDRLNQERDRLMNHKQIADTLTNAYVMLDNDD  241

Query:  241 FSSLSNVRSAMNDLMALEEFDREYKDLSTNLSEAYYVIEEVTKRLGDVIDDLDFDAGLLQ  300
            FSSLSN+RS+MNDL+++E FD EYK +ST++SEAYY++EEV+K+L D ID LDFD G LQ
Sbjct:  242 FSSLSNIRSSMNDLLSIEQFDSEYKGMSTSISEAYYILEEVSKQLSDTIDQLDFDGGRLQ  301

Query:  301 EIENRLDVINTITRKYGGDVNDVLDYFDNITKEYSLLTGSEESSDALEKELKILEHDLIE  360
            EIE RLD++N++TRKYGG+VNDVLDY+DNI KEY LLTG + SS  LE ELK LE  L+
Sbjct:  302 EIEFRLDILNSLTRKYGGNVNDVLDYYDNIVKEYQLLTGDDLSSGDLEAELKSLEKQLVA  361

Query:  361 SANQLSLERHKLAKQLENEIKQELTELYMEKADFQVQFTKGKFNKEGNEIVEFYISTNPG  420
            +A++LS+ RH+LA+QLE EIK EL ELYMEKADF+V FT  KFN++GNE +EFYISTNPG
Sbjct:  362 AASELSVSRHQLAEQLEAEIKAELKELYMEKADFKVHFTTSKFNRDGNESLEFYISTNPG  421

Query:  421 EGFKPLVKVASGGELSRLMLAIKSAFSRKEDKTSIVFDEVDTGVSGRVAQAIAQKIHKIG  480
            EGFKPLVKVASGGELSRLMLAIK+A SRKEDKTSIVFDEVDTGVSGRVAQAIAQKI+KIG
Sbjct:  422 EGFKPLVKVASGGELSRLMLAIKAAISRKEDKTSIVFDEVDTGVSGRVAQAIAQKIYKIG  481

Query:  481 SHGQVLAISHLAQVIAIADYQYFIEKISSDSSTVSTVRLLSYEERVEEIAKMLAGNNVTD  540
             HGQVLAISHL QVIAIADYQYFI K S + STVS VRLL+ EERVEEIA M+AG ++T
Sbjct:  482 RHGQVLAISHLPQVIAIADYQYFISKESKEESTVSKVRLLTPEERVEEIASMIAGTDMTQ  541

Query:  541 TARTQAKELL                                                   550
              A TQA+ELL
Sbjct:  542 AALTQARELL                                                   551
```

Based on this analysis, it was predicted that these proteins and their epitopes could be useful antigens for vaccines or diagnostics.

EXAMPLE 89

A DNA sequence (GBSx0090) was identified in *S. agalactiae* <SEQ ID 299> which encodes the amino acid sequence <SEQ ID 300>. This protein is predicted to be degV protein. Analysis of this protein sequence reveals the following:

```
Possible site: 38
>>> Seems to have no N-terminal signal sequence
    INTEGRAL    Likelihood = -0.96    Transmembrane    246-262 (246-262)

----- Final Results -----
              bacterial membrane --- Certainty = 0.1383 (Affirmative) < succ>
                bacterial outside --- Certainty = 0.0000 (Not Clear) < succ>
              bacterial cytoplasm --- Certainty = 0.0000 (Not Clear) < succ>
```

The protein has homology with the following sequences in the GENPEPT database:

```
>GP:BAB07346 GB:AP001519 unknown conserved protein
[Bacillus halodurans]
Identities = 93/277 (33%), Positives = 152/277 (54%), Gaps = 4/277 (1%)

Query:    1 MSKIKIVTDSSITIEPELIKELDITVVPLSVMIDGTLYSDNDLKAQGEFLNLMRGSKELP    60
            M+KI IVTDS+ + P+ KEL + VVPLSV+       Y +     +F  ++  ++LP
Sbjct:    1 MTKIAIVTDSTAYLGPKRAKELGVIVVPLSVVFGEEAYQEEVELSSADFYERLKHEEKLP    60

Query:   61 KTSQPPVGVFAEIYEKLMNEGVEHIIAIHLTHTLSGTIE-ASRQGANIAGADVTVIDSTF   119
             TSQP VG+F E +E+L  EG E +I+IHL+  +SGT + A    G+ + G +V   DS
Sbjct:   61 TTSQPAVGLFVETFERLAKEGFEVVISIHLSSKISGTYQSALTAGSMVEGIEVIGYDSGI   120

Query:  120 TDQCQKFQVVEAAKLAKEGADLDTILARVEEVRQKSELFIGVSTLENLVKGGRIGRVTGL   179
            + + Q    V EAAKL KEGAD  TI+  ++EV++++      V   L +L +GGR+     +
Sbjct:  121 SCEPQANFVAEAAKLVKEGADPQTIIDHLDEVKKRTNALFVVHDLSHLHRGGRLNAAQLV   180

Query:  180 LSSLLNIKVIMELTNHELVPIVKGR-GLKTFSKWLDNFVESAQTRKIAEIGISYCGKADM   238
             + SLL IK I+     +VP+ K R     K +++  + F E A +     +  +  + D
Sbjct:  181 VGSLLKIKPILHFEDGSIVPLEKVRTEKKAWARVKELFAEEASSASSVKATVIHANRLDG   240

Query:  239 ANNFREKL-AVLGAPISVLETGSIIQTHTGEDAFAV                          273
            A     +++       +S+   G +I TH GE +  +
Sbjct:  241 AEKLADEIRSQFSHVDVSISHFGPVIGTHLGEGSIGL                         277
```

A related DNA sequence was identified in *S. pyogenes* <SEQ ID 301> which encodes the amino acid sequence <SEQ ID 302>. Analysis of this protein sequence reveals the following:

```
Possible site: 37
>>> Seems to have no N-terminal signal sequence
      INTEGRAL    Likelihood = -1.54    Transmembrane    180-196 (180-196)
      INTEGRAL    Likelihood = -0.16    Transmembrane     21-37  (21-38)

----- Final Results -----
              bacterial membrane --- Certainty = 0.1617(Affirmative) < succ>
                bacterial outside --- Certainty = 0.0000(Not Clear) < succ>
              bacterial cytoplasm --- Certainty = 0.0000(Not Clear) < succ>
```

An alignment of the GAS and GBS proteins is shown below:

```
Identities = 197/279 (70%), Positives = 226/279 (80%), Gaps = 1/279 (0%)

Query:    1 MSKIKIVTDSSITIEPELIKELDITVVPLSVMIDGTLYSDNDLKAQGEFLNLMRGSKELP    60
            M  IKIVTDSSITIEPELIK LDITVVPLSVMID  LYSDNDLK +G FL+LM+ SK LP
Sbjct:    5 MGTIKIVTDSSITIEPELIKALDITVVPLSVMIDSKLYSDNDLKEEGHFLSLMKASKSLP    64

Query:   61 KTSQPPVGVFAEIYEKLMNEGVEHIIAIHLTHTLSGTIEASRQGANIAGADVTVIDSTFT   120
            KTSQPPVG+FAE YE L+ +GV  I+AIHL+  LSGTIEASRQGA IA A VTV+DS FT
Sbjct:   65 KTSQPPVGLFAETYENLVKKGVTDIVAIHLSPALSGTIEASRQGAEIAEAPVTVLDSGFT   124

Query:  121 DQCQKFQVVEAAKLAKEGADLDTILARVEEVRQKSELFIGVSTLENLVKGGRIGRVTGLL   180
            DQ  KFQVVEAAK+AK GA L+ ILA V+ ++ K+EL+IGVSTLENLVKGGRIGRVTG+L
Sbjct:  125 DQAMKFQVVEAAKMAKAGASLNEILAAVQAIKSKTELYIGVSTLENLVKGGRIGRVTGVL   184

Query:  181 SSLLNIKVIMELTNHELVPIVKGRGLKTFSKWLDNFVESAQTRKIAEIGISYCGKADMAN   240
            SSLLN+KV+M L N EL  +VKGRG KTF+KWLD+++     R IAEI ISY G+A +A
Sbjct:  185 SSLLNVKVVMALKNDELKTLVKGRGNKTFTKWLDSYLAKNSHRPIAEIAISYAGEASLAL   244

Query:  241 NFREKLAV-LGAPISVLETGSIIQTHTGEDAFAVMVRYE                       278
             +E++A     ISVLETGSIIQTHTGE AFAVMVRYE
Sbjct:  245 TLKERIAAYYNHSISVLETGSIIQTHTGEGAFAVMVRYE                       283
```

Figure 201:
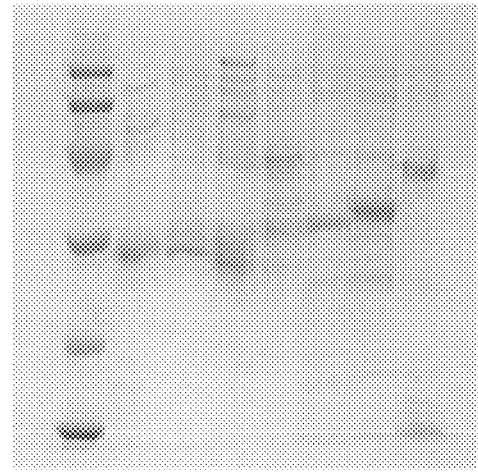

SEQ ID 300 (GBS113) was expressed in *E. coli* as a His-fusion product. Purified protein is shown in FIG. 201, lane 8.

Based on this analysis, it was predicted that these proteins and their epitopes could be useful antigens for vaccines or diagnostics.

EXAMPLE 90

A DNA sequence (GBSx0092) was identified in *S. agalactiae* <SEQ ID 307> which encodes the amino acid sequence <SEQ ID 308>. Analysis of this protein sequence reveals the following:

```
Possible site: 28
>>> Seems to have a cleavable N-term signal seq.

----- Final Results -----
            bacterial outside --- Certainty = 0.3000(Affirmative) < succ>
           bacterial membrane --- Certainty = 0.0000(Not Clear)   < succ>
           bacterial cytoplasm --- Certainty = 0.0000(Not Clear)  < succ>
```

The protein has homology with the following sequences in the GENPEPT database:

```
>GP: CAA72097 GB: Y11213 hypothetical protein [Streptococcus thermophilus]

Identities = 75/185 (40%), Positives = 116/185 (62%), Gaps = 3/185 (1%)

Query:   13 WKWAFLLLLAINLSFTAVIASRLIQVREPNTGKISTGVQDKVKVGTFTTNKSQLNKTIAL    72
            WKW FL LLA+NL+ +V+ R++   E +   G   K+G ++ +K +L++++
Sbjct:    5 WKWLFLGLLALNLALISVVTVRIMTPVETSPVSLPKGA---TKIGKYSMSKEELDESLRG    61

Query:   73 YLKQYQTKKMNYKIYAASSSILFEGSYQLLGYEVPLYIYFEPYRLTNGAVQLKVTSFSVG   132
            + + Y T KM +K+   +S I+FE SY++LG+ VPLY+YF P   +GAV L+ +  S G
Sbjct:   62 FAQDYSTDKMRFKVKVTNSKIVFESSYKVLGHAVPLYVYFTPLVSESGAVVLQESELSAG   121

Query:  133 TLPLPEKDVLQYIKSSYKLPNFVDIKPKKSVININLQDLKNKEGIYLKATAIDLVNDNFS   192
            TL LP  D L  IK S KLP+++  I   KK   +N+Q +KN +GI  +A + DLVND
Sbjct:  122 TLKLPILDALNMIKRSTKLPDYIVIDSKKGKVILNIQSMKNDKGITARAQSFDLVNDRSE   181

Query:  193 FDIFK                                                         197
            FDI+K
Sbjct:  182 FDIYK                                                         186
```

A related DNA sequence was identified in *S. pyogenes* <SEQ ID 309> which encodes the amino acid sequence <SEQ ID 310>. Analysis of this protein sequence reveals the following:

```
Possible site: 29
>>> Seems to have a cleavable N-term signal seq.

----- Final Results -----
              bacterial outside --- Certainty = 0.3000(Affirmative) < succ>
              bacterial membrane --- Certainty = 0.0000(Not Clear) < succ>
              bacterial cytoplasm --- Certainty = 0.0000(Not Clear) < succ>
```

The protein has homology with the following sequences in the databases:

```
>GP: CAA72097 GB: Y11213 hypothetical protein [Streptococcus thermophilus]
Identities = 73/185 (39%), Positives = 112/185 (60%), Gaps = 3/185 (1%)
Query:  10 WKWSFLCLLAFNTAFLMVIASRLIQVREPESELIAKKPVKNIKIGTFVTTREQLNETVAS   69
           WKW FL LLA N A + V+ R++    E     + K   K    IG +   ++E+L+E++
Sbjct:   5 WKWLFLGLLALNLALISVVTVRIMTPVETSPVSLPKGATK---IGKYSMSKEELDESLRG  61

Query:  70 YLKDYQTEKMSYKFYATSSSILFEGTYQLLGYEVPLYIYFQPHRLENGAVQLQVISFSVG  129
           + +DY T+KM +K    T+S I+FE +Y++LG+ VPLY+YF P   E+GAV LQ    S G
Sbjct:  62 FAQDYSTDKMRFKVKVTNSKIVFESSYKVLGHAVPLYVYFTPLVSESGAVVLQESELSAG 121

Query: 130 TLPLPEKDVLQYLKSSYKLPSFVKVMPNQSAIVVNLQDIQNDAKVYLKAKKIDLFNDEIS 189
           TL LP  D L  +K S KLP ++ +       +++N+Q ++ND    +A+   DL  ND
Sbjct: 122 TLKLPILDALNMIKRSTKLPDYIVIDSKKGKVILNIQSMKNDKGITARAQSFDLVNDRSE 181

Query: 190 FNIYK 194
           F+IYK
Sbjct: 182 FDIYK 186
```

An alignment of the GAS and GBS proteins is shown below:

```
Identities = 129/194 (66%), Positives = 155/194 (79%)
Query:   5 KTGRNLNFWKWAFLLLLAINLSFTAVIASRLIQVREPNTGKISTGVQDKVKVGTFTTNKS  64
           K   NLN+WKW+FL LLA N +F  VIASRLIQVREP + +     +K+GTF T +
Sbjct:   2 KKKSNLNWWKWSFLCLLAFNTAFLMVIASRLIQVREPESELIAKKPVKNIKIGTFVTTRE  61

Query:  65 QLNKTIALYLKQYQTKKMNYKIYAASSSILFEGSYQLLGYEVPLYIYFEPYRLTNGAVQL 124
           QLN+T+A YLK YQT+KM+YK YA SSSILFEG+YQLLGYEVPLYIYF+P+RL NGAVQL
Sbjct:  62 QLNETVASYLKDYQTEKMSYKFYATSSSILFEGTYQLLGYEVPLYIYFQPHRLENGAVQL 121

Query: 125 KVTSFSVGTLPLPEKDVLQYIKSSYKLPNFVDIKPKKSVININLQDLKNKEGIYLKATAI 184
           +V SFSVGTLPLPEKDVLQY+KSSYKLP+FV + P +S I +NLQD++N    +YLKA  I
Sbjct: 122 QVISFSVGTLPLPEKDVLQYLKSSYKLPSFVKVMPNQSAIVVNLQDIQNDAKVYLKAKKI 181

Query: 185 DLVNDNFSFDIFKK 198
           DL ND  SF+I+KK
Sbjct: 182 DLFNDEISFNIYKK 195
```

Based on this analysis, it was predicted that these proteins and their epitopes could be useful antigens for vaccines or diagnostics.

A related GBS gene <SEQ ID 8487> and protein <SEQ ID 8488> were also identified. Analysis of this protein sequence reveals the following:

```
Lipop: Possible site: -1 Crend: 7
McG: Discrim Score: 7.47
GvH: Signal Score (-7.5): 2.42
    Possible site: 28
>>> Seems to have a cleavable N-term signal seq.
ALOM program count: 0 value: 5.89 threshold: 0.0
PERIPHERAL Likelihood = 5.89 120
modified ALOM score: -1.68
*** Reasoning Step: 3

----- Final Results -----
              bacterial outside --- Certainty = 0.3000(Affirmative) < succ>
              bacterial membrane --- Certainty = 0.0000(Not Clear) < succ>
              bacterial cytoplasm --- Certainty = 0.0000(Not Clear) < succ>
```

Figure 4:
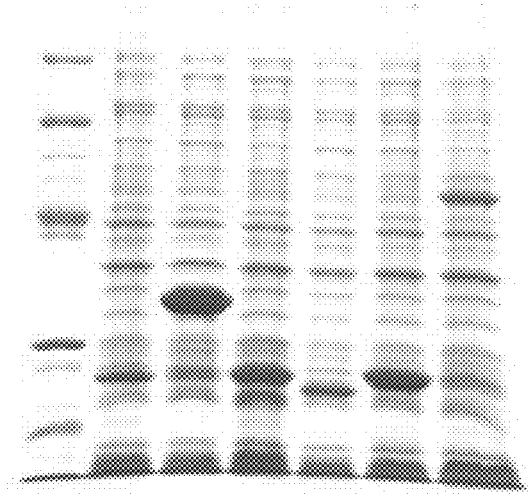
Figure 244:
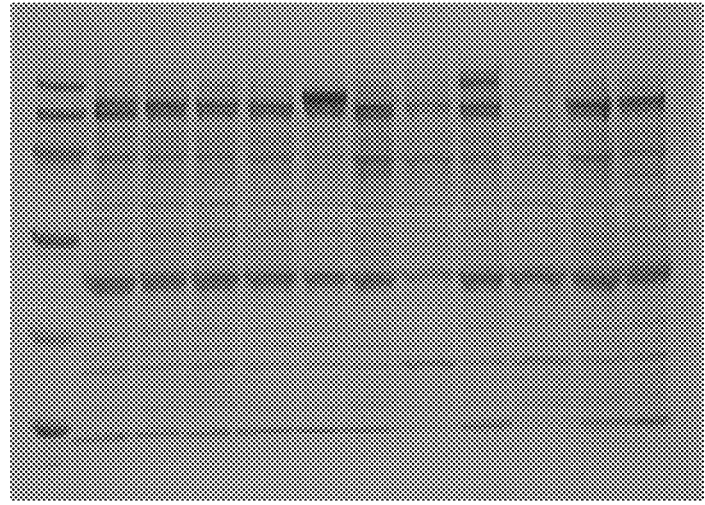

SEQ ID 308 (GBS20) was expressed in *E. coli* as a His-fusion product. SDS-PAGE analysis of total cell extract is shown in FIG. 4 (lane 5; MW 25 kDa) and in FIG. 167 (lane 12-14; MW 37 kDa—thioredoxin fusion). It was also expressed in *E. coli* as a GST-fusion product. SDS-PAGE analysis of total cell extract is shown in FIG. 9 (lane 7; MW 47.6 kDa). Purified Thio-GBS20-His is shown in FIG. 244, lane 12.

EXAMPLE 91

A DNA sequence (GBSx0093) was identified in *S. agalactiae* <SEQ ID 311> which encodes the amino acid sequence <SEQ ID 312>. This protein is predicted to be histone-like DNA-binding protein. Analysis of this protein sequence reveals the following:

```
Possible site: 40
>>> Seems to have no N-terminal signal sequence

----- Final Results -----
        bacterial cytoplasm --- Certainty = 0.2768(Affirmative) < succ>
        bacterial membrane  --- Certainty = 0.0000(Not Clear)   < succ>
        bacterial outside   --- Certainty = 0.0000(Not Clear)   < succ>
```

A related GBS nucleic acid sequence <SEQ ID 9313> which encodes amino acid sequence <SEQ ID 9314> was also identified.

The protein has homology with the following sequences in the GENPEPT database:

```
>GP: AAD40810 GB: L40355 histone-like DNA-binding protein
[Streptococcus mutans]
Identities = 43/47 (91%), Positives = 46/47 (97%)
Query: 1 MANKQDLIAKVAEATELTKKDSAAAVDAVFAAVADYLAEGEKVQLIG  47
           MANKQDLIAKVAEATELTKKDSAAAVDAVF+AV+ YLA+GEKVQLIG
Sbjct: 1 MANKQDLIAKVAEATELTKKDSAAAVDAVFSAVSSYLAKGEKVQLIG  47
```

A related DNA sequence was identified in *S. pyogenes* <SEQ ID 313> which encodes the amino acid sequence <SEQ ID 314>. Analysis of this protein sequence reveals the following:

```
Possible site: 25
>>> Seems to have no N-terminal signal sequence

----- Final Results -----
        bacterial cytoplasm --- Certainty = 0.2834(Affirmative) < succ>
        bacterial membrane  --- Certainty = 0.0000(Not Clear)   < succ>
        bacterial outside   --- Certainty = 0.0000(Not Clear)   < succ>
```

An alignment of the GAS and GBS proteins is shown below:

```
Identities = 41/47 (87%), Positives = 44/47 (93%)

1 MANKQDLIAKVAEATELTKKDSAAAVDAVFAAVADYLAEGEKVQLIG  47
Query:
           MANKQDLIAKVAEATELTKKDSAAAVDAVF+  +  +LAEGEKVQLIG
Sbjct:   1 MANKQDLIAKVAEATELTKKDSAAAVDAVFSTIEAFLAEGEKVQLIG  47
```

Based on this analysis, it was predicted that these proteins and their epitopes could be useful antigens for vaccines or diagnostics.

EXAMPLE 92

A DNA sequence (GBSx0094) was identified in *S. agalactiae* <SEQ ID 315> which encodes the amino acid sequence <SEQ ID 316>. Analysis of this protein sequence reveals the following:

```
Possible site: 54
>>> Seems to have no N-terminal signal sequence

----- Final Results -----
            bacterial cytoplasm --- Certainty = 0.2722(Affirmative) < succ>
             bacterial membrane --- Certainty = 0.0000(Not Clear)   < succ>
              bacterial outside --- Certainty = 0.0000(Not Clear)   < succ>
```

A related GBS nucleic acid sequence <SEQ ID 9293> which encodes amino acid sequence <SEQ ID 9294> was also identified. A further related GBS nucleic acid sequence <SEQ ID 10793> which encodes amino acid sequence <SEQ ID 10794> was also identified.

The protein has homology with the following sequences in the GENPEPT database:

```
>GP: AAD17886 GB: AF100456 hyaluronate-associated protein precursor
[Streptococcus equi]
Identities = 303/435 (69%), Positives = 360/435 (82%), Gaps = 1/435 (0%)
Query:   1 MATKVDVSKDGLTYTATLRKGLKWSDGSKLTAKDFVYSWQRLVDPKTASQYAYLAVEGHV    60
           +A KVDVS+DGLTYTATLR GLKWSDGS LTA+DFVYSWQR+VDPKTAS+YAYLA E H+
Sbjct:  87 LAEKVDVSEDGLTYTATLRDGLKWSDGSDLTAEDFVYSWQRMVDPKTASEYAYLATESHL   146

Query:  61 LNADKINEGQEKDLNKLGVKAEGDDKVVITLSSPSPQFIYYLAFTNFMPQKQEVVEKYGK   120
              NA+ IN G+   DL+ LGVKA+G+ KV+ TL+ P+PQF   L+F+NF+PQK+   V+   GK
Sbjct: 147 KNAEDINSGKNPDLDSLGVKADGN-KVIFTLTEPAPQFKSLLSFSNFVPQKESFVKDAGK   205

Query: 121 DYATTSKNTVYSGPYTVEGWNGSNGTFTLKKNKNYWDAKNVKTKEVRIQTVKKPDTAVQM   180
           DY TTS+   +YSGPY V+ WNG++GTF L KNKNYWDAKNVKT+ V +QTVKKPDTAVQM
Sbjct: 206 DYGTTSEKQIYSGPYIVKDWNGTSGTFKLVKNKNYWDAKNVKTETVNVQTVKKPDTAVQM   265

Query: 181 YKRGELDAANISNTSAIYQANKNNKDVTDVLEATTAYMEYNTTGSVKGLDNVKIRRALNL   240
           YK+G+LD ANIS TSAIY ANK +KDV  VLEATTAY+ YN TG+++GL+++KIR+ALNL
Sbjct: 266 YKQGKLDFANISGTSAIYNANKKHKDVVPVLEATTAYIVYNQTGAIEGLNSLKIRQALNL   325

Query: 241 ATNRKGVVQAAVDTGSKPAIAFAPTGLAKTPDGTDLAKYVAPGYEYNKTEAAKLFKEGLA   300
           AT+RKG+V AAVDTGSKPA A   PTGLAK  DGTDL ++VAPGY+Y+  EAAKLFKEGLA
Sbjct: 326 ATDRKGIVSAAVDTGSKPATALVPTGLAKLSDGTDLTEHVAPGYKYDDKEAAKLFKEGLA   385

Query: 301 ESGLTKLKLTITADADAPAAKNSVDYIKSTWEAALPGLTVEEKFVTFKQRLEDSRKQNFD   360
            E G   L +TITADADAPAAK++VDYIK TWE ALPGLTVEEKFV FKQRLED++ QNF+
Sbjct: 386 ELGKDALTITITADADAPAAKSAVDYIKETWETALPGLTVEEKFVPFKQRLEDTKNQNFE   445

Query: 361 IVVSLWGGDYPEGSTFYGLFKSDSQNNDGKFANKDYDAAYNKAISEDAMKPAESAKDYKE   420
           + V LWGGDYP+GSTFYGLFKS S   N GKF N DYDAAYNKA++ DA+     +A DYK
Sbjct: 446 VAVVLWGGDYPKGSTFYGLFKSGSAYNYGKFTNADYDAAYNKALTTDALNTDAAADDYKA   505

Query: 421 AEKILFEQGAYNPLY                                               435
           AEK L++    YNPLY
Sbjct: 506 AEKALYDNALYNPLY                                               520
```

A related GBS gene <SEQ ID 8489> and protein <SEQ ID 8490> were also identified. Analysis of this protein sequence reveals the following:

```
Lipop:Possible site:21 Crend:4
      Sequence Pattern:CGSK
SRCFLG:0
McG:Length of UR:19
     Peak Value of UR:2.34
     Net Charge of CR:3
McG:Discrim Score:5.94
GvH:Signal Score (-7.5):0.6
     Possible site:20
>>> May be a lipoprotein
Amino Acid Composition:calculated from 22
ALOM program count:0 value:5.14 threshold:0.0
   PERIPHERAL Likelihood = 5.14 166
modified ALOM score:-1.53
*** Reasoning Step:3

----- Final Results -----
             bacterial membrane --- Certainty = 0.0000(Not Clear) < succ>
              bacterial outside --- Certainty = 0.0000(Not Clear) < succ>
             bacterial cytoplasm --- Certainty = 0.0000(Not Clear) < succ>
```

The protein has homology with the following sequences in the databases:

```
>GP|4336671|gb|AAD17886.1||AF100456 hyaluronate-associated protein
precursor {Streptococcus equi}
Score = 721 bits (1840), Expect = 0.0
Identities = 354/515 (68%), Positives = 417/515 (80%), Gaps = 2/515 (0%)

Query:   1 KNWRRVGVGVLTLASVATLAACGSK-SASQDSNGAINWAIPTEINTLDLSKVTDTYSNLA   59
           K  +R+G+ +TLASVA L ACG+K SAS D   INW PTEI TLD+SK TDTYS LA
Sbjct:   7 KACKRLGLAAVTLASVAALMACGNKQSASTDKKSEINWYTPTEIITLDISKNTDTYSALA   66

Query:  60 IGNSSSNFLRLDKDGKTRPDLATKVDVSKDGLTYTATLRKGLKWSDGSKLTAKDFVYSWQ  119
           IGNS SN LR D  GK +PDLA KVDVS+DGLTYTATLR GLKWSDGS LTA+DFVYSWQ
Sbjct:  67 IGNSGSNLLRADAKGKLQPDLAEKVDVSEDGLTYTATLRDGLKWSDGSDLTAEDFVYSWQ  126

Query: 120 RLVDPKTASQYAYLAVEGHVLNADKINEGQEKDLNKLGVKAEGDDKVVITLSSPSPQFIY  179
           R+VDPKTAS+YAYLA E H+ NA+ IN G+  DL+ LGVKA+G+ KV+ TL+ P+PQF
Sbjct: 127 RMVDPKTASEYAYLATESHLKNAEDINSGKNPDLDSLGVKADGN-KVIFTLTEPAPQFKS  185

Query: 180 YLAFTNFMPQKQEVVEKYGKDYATTSKNTVYSGPYTVEGWNGSNGTFTLKKNKNYWDAKN  239
           L+F+NF+PQK+ V+ GKDY TTS+ +YSGPY V+ WNG++GTF L KNKNYWDAKN
Sbjct: 186 LLSFSNFVPQKESFVKDAGKDYGTTSEKQIYSGPYIVKDWNGTSGTFKLVKNKNYWDAKN  245

Query: 240 VKTKEVRIQTVKKPDTAVQMYKRGELDAANISNTSAIYQANKNNKDVTDVLEATTAYMEY  299
           VKT+ V +QTVKKPDTAVQMYK+G+LD ANIS TSAIY ANK +KDV  VLEATTAY+ Y
Sbjct: 246 VKTETVNVQTVKKPDTAVQMYKQGKLDFANISGTSAIYNANKKHKDVVPVLEATTAYIVY  305

Query: 300 NTTGSVKGLDNVKIRRALNLATNRKGVVQAAVDTGSKPAIAFAPTGLAKTPDGTDLAKYV  359
           N TG+++GL+++KIR+ALNLAT+RKG+V AAVDTGSKPA A  PTGLAK  DGTDL ++V
Sbjct: 306 NQTGAIEGLNSLKIRQALNLATDRKGIVSAAVDTGSKPATALVPTGLAKLSDGTDLTEHV  365

Query: 360 APGYEYNKTEAAKLFKEGLAESGLTKLKLTITADADAPAAKNSVDYIKSTWEAALPGLTV  419
           APGY+Y+  EAAKLFKEGLAE G   L +TITADADAPAAK++VDYIK TWE ALPGLTV
Sbjct: 366 APGYKYDDKEAAKLFKEGLAELGKDALTITITADADAPAAKSAVDYIKETWETALPGLTV  425

Query: 420 EEKFVTFKQRLEDSRKQNFDIVVSLWGGDYPEGSTFYGLFKSDSQNNDGKFANKDYDAAY  479
           EEKFV FKQRLED++ QNF++ V LWGGDYP+GSTFYGLFKS S  N GKF N DYDAAY
Sbjct: 426 EEKFVPFKQRLEDTKNQNFEVAVVLWGGDYPKGSTFYGLFKSGSAYNYGKFTNADYDAAY  485

Query: 480 NKAISEDAMKPAESAKDYKEAEKILFEQGAYNPLY                          514
           NKA++ DA+   +A DYK AEK L++   YNPLY
Sbjct: 486 NKALTTDALNTDAAADDYKAAEKALYDNALYNPLY                          520
```

A related DNA sequence was identified in *S. pyogenes* <SEQ ID 317> which encodes the amino acid sequence <SEQ ID 318>. Analysis of this protein sequence reveals the following:

```
Possible site: 24
>>> May be a lipoprotein

----- Final Results -----
            bacterial membrane --- Certainty = 0.0000(Not Clear) < succ>
             bacterial outside --- Certainty = 0.0000(Not Clear) < succ>
            bacterial cytoplasm --- Certainty = 0.0000(Not Clear) < succ>
```

An alignment of the GAS and GBS proteins is shown below:

```
Identities = 114/428 (26%), Positives = 185/428 (42%), Gaps = 63/428 (14%)

Query:     7 VSKDGLTYTATLRKGLKW--SDGSK---LTAKDFVYSWQRLVDPKTASQYAYLAVEGHVL   61
             VSKDGLTYT TLR G+ W  +DG +   +TA+DFV   + VD K+ + Y    VE +
Sbjct:    92 VSKDGLTYTYTLRDGVSWYTADGEEYAPVTAEDFVTGLKHAVDDKSDALY---VVEDSIK  148

Query:    62 NADKINEGQEKDLNKLGVKAEGDDKVVITLSSPSPQFIYYLAFTNFMPQKQEVVEKYGKD  121
              N     G E D ++GVKA  D V  TL+ P     ++   P    + ++   GKD
Sbjct:   149 NLKAYQNG-EVDFKEVGVKALDDKTVQYTLNKPESYWNSKTTYSVLFPVNAKFLKSKGKD  207

Query:   122 YATTSKNTV-YSGPYTVEGWNGSNGTFTLKKNKNYWDAKNVKTKEVRI--QTVKKPDTAV  178
             + TT +++ +G Y +  + S +    KN+NYWDAKNV + V++      P +
Sbjct:   208 FGTTDPSSILVNGAYFLSAFT-SKSSMEFHKNENYWDAKNVGIESVKLTYSDGSDPGSFY  266

Query:   179 QMYKRGELDAANISNTSAIYQANKNN--KDVT-DVLEATTAYMEYNTT------------  223
              + + +GE   A +       Y++ K N   ++T  +L       ++ +N
Sbjct:   267 KNFDKGEFSVARLYPNDPTYKSAKKNYADNITYGMLTGDIRHLTWNLNRTSFKNTKKDPA  326

Query:   224 ---GSVKGLDNVKIRRALNLATNRKGVVQAAVDTGSKPA----IAFAPT--GLAKTPDGT  274
                K L+N  R+A+  A +R              +K       +   PT  + ++  G+
Sbjct:   327 QQDAGKKALNNKDFRQAIQFAFDRASFQAQTAGQDAKTKALRNMLVPPTFVTIGESDFGS  386

Query:   275 DLAKYVAP-GYE-------------YNKTEAAKLF---KEGLAESGLT-KLKLTITADAD  316
             ++ K +A G E             YN +A  F   KE L  G+T ++L    D
Sbjct:   387 EVEKEMAKLGDEWKDVNLADAQDGFYNPEKAKAEFAKAKEALTAEGVTFPVQLDYPVDQA  446

Query:   317 APAAKNSVDYIKSTWEAALPGLTV-----EEKFVTFKQR---LEDSRKQNFDIVVSLWGG  368
              A      K + EA+L     V      E +  T + +       E    +Q++DI+ S WG
Sbjct:   447 NAATVQEAQSFKQSVEASLGKENVIVNVLETETSTHEAQGFYAETPEQQDYDIISSWWGP  506

Query:   369 DYPEGSTF                                                      376
             DY + T+
Sbjct:   507 DYQDPRTY                                                      514
```

Figure 137:
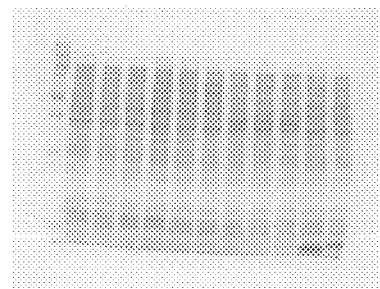
Figure 138:
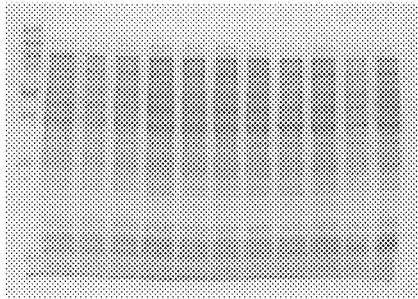
Figure 179:
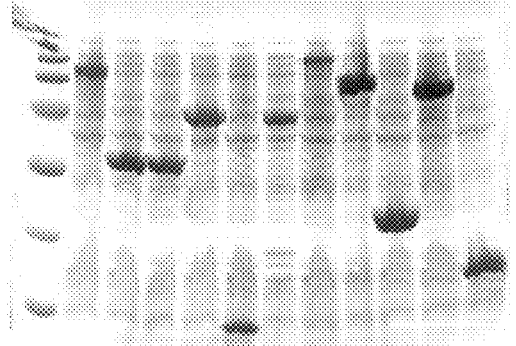
Figure 231:
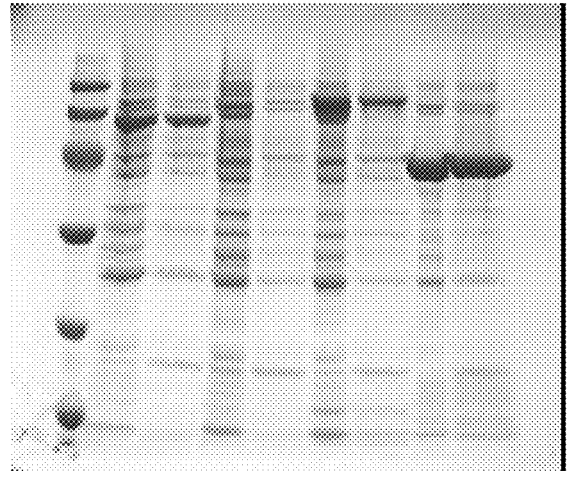

SEQ ID 9294 (GBS663) was expressed in *E. coli* as a GST-fusion product. SDS-PAGE analysis of total cell extract is shown in FIG. 137 (lane 3; MW 89.5 kDa). It was also expressed in *E. coli* as a His-fusion product. SDS-PAGE analysis of total cell extract is shown in FIG. 137 (lane 5-7; MW 64.5 kDa), in FIG. 179 (lane 11; MW 65 kDa) and in FIG. 65 (lane 2; MW 61 kDa). Purified GBS663-His is shown in FIG. 231, lane 34. Purified GBS324-His is shown in lane 6 of FIG. 210.

Based on this analysis, it was predicted that these proteins and their epitopes could be useful antigens for vaccines or diagnostics.

EXAMPLE 93

A DNA sequence (GBSx0095) was identified in *S. agalactiae* <SEQ ID 319> which encodes the amino acid sequence <SEQ ID 320>. This protein is predicted to be transmembrane protein OppB (oppB). Analysis of this protein sequence reveals the following:

```
Possible site: 37
>>> Seems to have no N-terminal signal sequence
         INTEGRAL    Likelihood = -10.77    Transmembrane    293-309 (281-313)
         INTEGRAL    Likelihood =  -9.77    Transmembrane     21-37  (14-46)
         INTEGRAL    Likelihood =  -6.32    Transmembrane    115-131 (105-132)
         INTEGRAL    Likelihood =  -4.88    Transmembrane    144-160 (140-166)
         INTEGRAL    Likelihood =  -3.03    Transmembrane    238-254 (237-255)
```

----- Final Results -----
                bacterial membrane --- Certainty = 0.5310(Affirmative) < succ>
                bacterial outside  --- Certainty = 0.0000(Not Clear)   < succ>
                bacterial cytoplasm --- Certainty = 0.0000(Not Clear)  < succ>

A related GBS nucleic acid sequence <SEQ ID 8491> which encodes amino acid sequence <SEQ ID 8492> was also identified.

The protein has homology with the following sequences in the GENPEPT database:

```
>GP: AAF73091 GB: AF103793 transmembrane protein
OppB [Listeria monocytogenes]
Identities = 147/304 (48%), Positives = 221/304 (72%), Gaps = 1/304 (0%)
Query:  13 MIKYILKRVAILLVTLWVVITLSFFLMQILPGTPYNNP-KLTEEMIALLNKQYGLDKPVW   71
           M+KY LKRV  +L+TL+++ +++F LM+ LPGTPY N  KL++E I + N++YGL+  +
Sbjct:   1 MVKYTLKRVLYMLITLFIIASVTFVLMKFLPGTPYRNQEKLSDEQIHMTNEKYGLNDSIP  60

Query:  72 QQYLTYLWNVLHGDFGTSYQSVNQPVSRMISLRLGVSVHLGVQALVFGVLGGILVGAISA  131
            QY  Y+  ++ GD G S+Q  N+PVS ++S  +G SV L ++A+ FGV+ GIL+G I+A
Sbjct:  61 VQYFNYMTGLVKGDLGVSFQLDNRPVSEILSALIGPSVQLALEAMAFGVIFGILLGVIAA  120

Query: 132 RHKNDKVDGILSVIATLGISMPSFIIGILLLDYFGFKWNLLPLSGWGTFSQTILPSLALG  191
            ++N  D   + IA LG S+PSF+   +L  + G K  + P++GWGTF+ TILP+ AL
Sbjct: 121 MYQNRWPDYTSTFIAILGKSVPSFVFATVLQYWLGAKLQIFPVAGWGTFADTILPAFALA  180

Query: 192 LPTLASVSRFFRSEMIETLNSDYVQLARSKGMTIRQVTRKHAYRNSMIPILTLIGPLAAG  251
             + LA+ +RF R+E+I+   SDYV LA++KG +  +V  KHA RN++IP++T++GPL++
Sbjct: 181 MFPLATAARFMRTELIDVFASDYVLLAKAKGNSRTEVAVKHAIRNALIPLITVLGPLSVA  240

Query: 252 LLTGSALIEQIFSIPGIGQQFVTSIPTKDYPVIMGTTIVYAVMLMVAILITDVVISIVDP  311
           L+TGS +IE I+SIPGIG QFV+SI T DYPVIMGTTI++AVML+  IL+ D++  ++DP
Sbjct: 241 LMTGSLVIENIYSIPGIGSQFVSSIQTNDYPVIMGTTILFAVMLVFVILVVDILYGLIDP  300

Query: 312 RVRL   315
           R+R+
Sbjct: 301 RIRV   304
```

There is also homology to SEQ ID 64.

A related DNA sequence was identified in *S. pyogenes* <SEQ ID 9069> which encodes amino acid sequence <SEQ ID 9070>. Analysis of this protein sequence reveals the following:

```
Possible site: 25
>>> Seems to have an uncleavable N-term signal seq
    INTEGRAL    Likelihood = -8.81    Transmembrane    466-482 (463-493)
    INTEGRAL    Likelihood = -5.10    Transmembrane    419-435 (418-440)
    INTEGRAL    Likelihood = -4.78    Transmembrane    328-344 (322-348)
    INTEGRAL    Likelihood = -4.41    Transmembrane    366-382 (365-384)
    INTEGRAL    Likelihood = -4.09    Transmembrane    290-306 (287-311)
    INTEGRAL    Likelihood = -2.97    Transmembrane     17-33  (13-36)

----- Final Results -----
                bacterial membrane --- Certainty = 0.4524(Affirmative) < succ>
                bacterial outside  --- Certainty = 0.0000(Not Clear)   < succ>
                bacterial cytoplasm --- Certainty = 0.0000(Not Clear)  < succ>
```

An alignment of the GAS and GBS sequences follows:

```
Score = 117 bits (291), Expect = 3e-28
Identities = 61/208 (29%), Positives = 121/208 (57%), Gaps = 4/208 (1%)
Query: 291 IGFFGVMFSYIVGLPLGLFMARFKNTYFDSFSTATMTFMLALPSIAV-IYVVRFLGGMVG  349
           +G  ++F  + G+ +G     AR KN  D  +    T +++PS  + I ++ + G
Sbjct:  99 LGVQALVFGVLGGILVGAISARHKNDKVDGILSVIATLGISMPSFIIGILLLDYFGFKWN  158

Query: 350 LPDSFPMLGASDPKSYILPALILGILNIPTTVIWFRRYLVDLQASDWVRFARSKGLSESE  409
           L    P+ G           ILP+L LG+ + +  +FR +++   SD+V+ ARSKG++ +
Sbjct: 159 L---LPLSGWGTFSQTILPSLALGLPTLASVSRFFRSEMIETLNSDYVQLARSKGMTIRQ  215

Query: 410 IYRGHLFKNAMVPIVSGVPASIILAIGGATLTETVFAFPGMGKMLIDSIKSANNSMIVGL  469
           + R H ++N+M+PI++ +     + G+ L E +F+ PG+G+   SI + +  +I+G
Sbjct: 216 VTRKHAYRNSMIPILTLIGPLAAGLLTGSALIEQIFSIPGIGQQFVTSIPTKDYPVIMGT  275
```

```
Query:  470 TFIFTVLSIVSLLLGDIVMTLVDPRIKL                                497
            T ++ V+ +V++L+ D+V+++VDPR++L
Sbjct:  276 TIVYAVMLMVAILITDVVISIVDPRVRL                                303
```

Based on this analysis, it was predicted that these proteins and their epitopes could be useful antigens for vaccines or diagnostics.

EXAMPLE 94

A DNA sequence (GBSx0096) was identified in *S. agalactiae* <SEQ ID 321> which encodes the amino acid sequence <SEQ ID 322>. This protein is predicted to be transmembrane protein OppC (oppC). Analysis of this protein sequence reveals the following:

```
Possible site: 59
>>> Seems to have no N-terminal signal sequence
     INTEGRAL      Likelihood = -11.52    Transmembrane   311-327 (307-333)
     INTEGRAL      Likelihood =  -7.80    Transmembrane    42-58  (40-65)
     INTEGRAL      Likelihood =  -7.43    Transmembrane   142-158 (131-165)
     INTEGRAL      Likelihood =  -4.73    Transmembrane   182-198 (179-214)
     INTEGRAL      Likelihood =  -3.50    Transmembrane   257-273 (257-276)

----- Final Results -----
               bacterial membrane  --- Certainty = 0.5607(Affirmative) < succ>
                bacterial outside  --- Certainty = 0.0000(Not Clear)   < succ>
              bacterial cytoplasm  --- Certainty = 0.0000(Not Clear)   < succ>
```

The protein has homology with the following sequences in the GENPEPT database:

```
>GP: AAF73092 GB: AF103793 transmembrane protein OppC
[Listeria monocytogenes]
Identities = 157/325 (48%), Positives = 219/325 (67%),
Gaps = 4/325 (1%)

Query:   20 EKIEKPALSFMQDAWRRLKKNKLAVVSLYLLALLLTFSLASNLFVTQKDANGFDSKKVTT  79
            EKI +P+L+F+QD+W R++KNK A+VSL +LAL++  ++            ++++T
Sbjct:   22 EKINRPSLTFLQDSWLRIRKNKAALVSLIVLALVIIMAIVGPYLSQNLGPEHNINRQITE  81

Query:   80 YRNLPPKLSS--NLPFWNGSIKYAGNTESTDAYKSQNVPEKVKYALGTDSLGRSVAKRII 137
             +LPPK+     N+PFWNG   G  E  D YK   N+ E    Y LG+D+LGR    RI
Sbjct:   82 NASLPPEVQGFENMPFWNGHQSIGG--EDVDIYKQNNIKEGTYYWLGSDTLGRDQFARIW 139

Query:  138 VGIRISLLVAIAATFIDLIIGVTYGLVSGFAGGRLDTLMQRIVEVISSIPNLVIVTMLGL 197
            G R+SL++A+ A    DL+IGV YGL+SG+ GGR+D  MQR++EVI +IPNLV+V ++ L
Sbjct:  140 AGTRVSLIIAVVAALCDLVIGVAYGLISGYVGGRVDNFMQRVLEVIGAIPNLVVVILMML 199

Query:  198 VLGNGITAIISIAFTGWTSMSRQVRNLTLSYREREFVLAARSLGESPIKIAFKHILPNI  257
            +L  GI +III+IA T W +M+R VR   L  + +EFV+A+  +LGES   KI  KH++PNI
Sbjct:  200 ILEPGIVSIIIAIAMTSWITMARVVRGQVLKRKNQEFVMASMTLGESTPKILIKHLIPNI 259

Query:  258 SGIIIVQIMMTIPSAIMYEAVLSAINLGVKPPTASLGSLISDAQENLQYYPYQVILPALA 317
            SGIII+ IM +IPSAI +EA LS I LG+   P ASLG L++D   + LQ  PY ++ P +
Sbjct:  260 SGIIIINIMFSIPSAIFFEAFLSFIGLGLPAPAASLGVLVNDGYKTLQVLPYMILYPCIV 319

Query:  318 LVMISLAFILLGDGLRDAFDPKSSD                                    342
            L +I +AF L+ DGLRDAFDPK  D
Sbjct:  320 LCIIMIAFNLIADGLRDAFDPKMRD                                    344
```

A related DNA sequence was identified in *S. pyogenes* <SEQ ID 323> which encodes the amino acid sequence <SEQ ID 324>. Analysis of this protein sequence reveals the following:

```
Possible site: 59
>>> Seems to have no N-terminal signal sequence
    INTEGRAL      Likelihood = -10.30    Transmembrane      43-59   (37-65)
    INTEGRAL      Likelihood = -8.49     Transmembrane     111-127  (109-135)
    INTEGRAL      Likelihood = -6.26     Transmembrane     279-295  (270-298)
    INTEGRAL      Likelihood = -3.88     Transmembrane     172-188  (172-188)
    INTEGRAL      Likelihood = -3.61     Transmembrane     145-161  (145-165)
    INTEGRAL      Likelihood = -1.49     Transmembrane     223-239  (223-239)

----- Final Results -----
              bacterial membrane  --- Certainty = 0.5118(Affirmative) < succ>
               bacterial outside  --- Certainty = 0.0000(Not Clear)   < succ>
             bacterial cytoplasm  --- Certainty = 0.0000(Not Clear)   < succ>
```

An alignment of the GAS and GBS proteins is shown below:

```
Identities = 91/325 (28%), Positives = 156/325 (48%),
Gaps = 34/325 (10%)

Query:   16 SSTQEKIEKPALSFMQDAWRRLKKNKLAVVSLYLLALLLTFSLASNLFVTQKDANGFDSK   75
            S   E I+ PA S+ +  +R+      K   V   L +L  +L  S     +F       +D
Sbjct:   16 SEASEVIDTPAYSYWKSVFRQFFSKKSTVFMLVILVTVLMMSFIYPMFAN------YDFN   69

Query:   76 KVTTYRNLPPKLSSNLPFWNGSIKYAGNTESTDAYKSQNVPEKVKYALGTDSLGRSVAKR  135
            V+    +                         + + +      +Y  GTD  G+S+
Sbjct:   70 DVSNIND-------------------------FSKRYIWPNAEYWFGTDKNGQSLFDG   102

Query:  136 IIVGIRISLLVAIAATFIDLIIGVTYGLVSGFAGGRLDTLMQRIVEVISSIPNLVIVTML  195
              +   G R  S+L+++ AT I++ IGV    G + G +     D +M  I   +IS+IP+++I+ +L
Sbjct:  103 VWYGARNSILISVIATLINITIGVVLGAIWGVSKA-FDKVMIEIYNIISNIPSMLIIIVL  161

Query:  196 GLVLGNGITAIIISIAFTGWTSMSRQVRNLTLSYREREFVLAARSLGESPIKIAFKHILP  255
              LG G  +I++    TGW  ++   +R     L  YR+ E+  LA+++LG     KIA K++LP
Sbjct:  162 TYSLGAGFWNLILAFCITGWIGVAYSIRVQILRYRDLEYNLASQTLGTPMYKIAVKNLLP  221

Query:  256 NISGIIIVQIMMTIPSAIMYEAVLSAINLGVKPPTASLGSLISDAQENLQYYPYQVILPA  315
               +   +I+ +   +P +   EA LS  +G+    T  SLG  I++     NL    Y   +P
Sbjct:  222 QLVSVIMTMLSQMLPVYVSSEAFLSFFGIGLPTTTPSLGRFIANYSSNLTTNAYLFWIPL  281

Query:  316 LALVMISLAFILLGDGLRDAFDPKS                                   340
            + L+++SL    ++G   L DA DP+S
Sbjct:  282 VTLILVSLPLYIVGQNLADASDPRS                                   306
```

Based on this analysis, it was predicted that these proteins and their epitopes could be useful antigens for vaccines or diagnostics.

EXAMPLE 95

A DNA sequence (GBSx0097) was identified in *S. agalactiae* <SEQ ID 325> which encodes the amino acid sequence <SEQ ID 326>. This protein is predicted to be ATPase OppD (oppD). Analysis of this protein sequence reveals the following:

```
Possible site: 20
>>> Seems to have no N-terminal signal sequence
    INTEGRAL      Likelihood = -0.85     Transmembrane     164-180  (163-180)

----- Final Results -----
              bacterial membrane  --- Certainty = 0.1341(Affirmative) < succ>
               bacterial outside  --- Certainty = 0.0000(Not Clear)   < succ>
             bacterial cytoplasm  --- Certainty = 0.0000(Not Clear)   < succ>
```

The protein has homology with the following sequences in the GENPEPT database:

```
>GP: AAF73093 GB: AF103793 ATPase OppD [Listeria monocytogenes]
Identities = 230/342 (67%), Positives = 283/342 (82%), Gaps = 2/342 (0%)

Query:     4 ETILSVNNLHVDFHTYAGEVKAIRDVNFELKKGETLAIVGESGSGKSVTTRTLIGLNAK-   62
             E +L V +L++ FHTYAGEVKAIR VNF+L KGETLAIVGESGSGKSVTT++++ L  +
Sbjct:     2 EKLLEVKDLNISFHTYAGEVKAIRGVNFDLYKGETLAIVGESGSGKSVTTKSIMRLLPEG   61

Query:    63 NSEI-SGNVQFKGRNLVELSEEEWTKVRGNEISMIFQDPMTSLDPTMKIGMQIAEPMMIH  121
             NSEI SG + F G ++ +  E++  K+RG +I+MIFQDPMTSL+PTM IG QI+EP++ H
Sbjct:    62 NSEIKSGQILFNGMDIAKAHEKQMQKIRGKDIAMIFQDPMTSLNPTMTIGKQISEPLIKH  121

Query:   122 QKISKKDALKLALELMKDVGIPNAEEHINDYPHQWSGGMRQRAVIAIALAADPEILIADE  181
             QKISK +A K AL L++ VGI NAEE I  YPHQ+SGGMRQR VIAI+LA +P+ILIADE
Sbjct:   122 QKISKHEAHKTALRLLQLVGIANAEERIKQYPHQFSGGMRQRVVIAISLACNPQILIADE  181

Query:   182 PTTALDVTIQAQILNLMKKIQAERDSSIVFITHDLGVVAGMADRVAVMYAGKIVEFGTVD  241
             PTTALDVTIQAQIL+LMK +Q + D+SI+FITHDLGVVA +ADRVAVMY GKIVE GTVD
Sbjct:   182 PTTALDVTIQAQILDLMKDLQKKIDTSIIFITHDLGVVANVADRVAVMYGGKIVEIGTVD  241

Query:   242 EVFYNPQHPYTWGLLNSMPTTDTESGSLESIPGTPPDLLNPPKGDAFAARNEFALDIDHE  301
             E+FYNPQHPYTWGL++SMPT DT+   L  IPGTPPDLL+PPKGDAFAARN++A+ ID E
Sbjct:   242 EIFYNPQHPYTWGLISSMPTLDTDDEELFVIPGTPPDLLHPKGDAFAARNKYAMQIDLE  301

Query:   302 EEPPYFKVSETHFAATWLLDERSPKVLPPLPIQKRWEKWNEI                   343
             EEPP FKVS+TH+AATWLL   +P+V PP   + +R E++ E+
Sbjct:   302 EEPPLFKVSDTHYAATWLLHPDAPEVTPPDAVLRRQEQFAEL                   343
```

There is also homology to SEQ ID 72.

Figure 64:
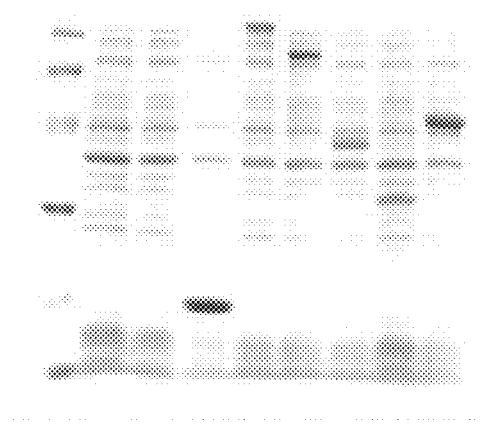
Figure 71:
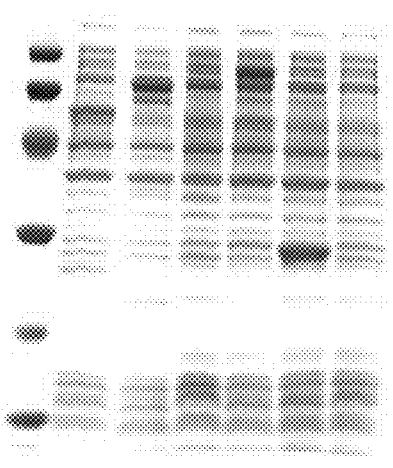

SEQ ID 326 (GBS375) was expressed in *E. coli* as a His-fusion product. SDS-PAGE analysis of total cell extract is shown in FIG. 64 (lane 9; MW 42 kDa). It was also expressed in *E. coli* as a GST-fusion product. SDS-PAGE analysis of total cell extract is shown in FIG. 71 (lane 3; MW 67 kDa).

Figure 215:
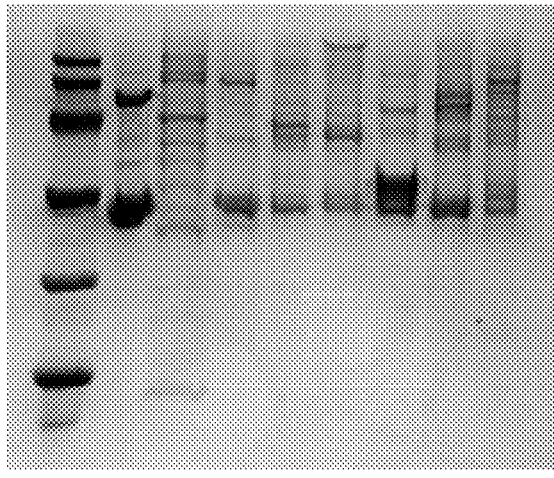

GBS375-GST was purified as shown in FIG. 215, lane 10. Based on this analysis, it was predicted that this protein and its epitopes, could be useful antigens for vaccines or diagnostics.

EXAMPLE 96

A DNA sequence (GBSx0098) was identified in *S. agalactiae* <SEQ ID 327> which encodes the amino acid sequence <SEQ ID 328>. Analysis of this protein sequence reveals the following:

```
Possible site: 28
>>> Seems to have no N-terminal signal sequence

----- Final Results -----
            bacterial cytoplasm --- Certainty = 0.3060 (Affirmative) <
succ>
            bacterial membrane  --- Certainty = 0.0000 (Not Clear) < succ>
            bacterial outside   --- Certainty = 0.0000 (Not Clear) < succ>
```

The protein has homology with the following sequences in the GENPEPT database:

```
>GP: AAA62692 GB: M57689 sporulation protein [Bacillus subtilis]
Identities = 195/308 (63%), Positives = 245/308 (79%), Gaps = 4/308 (1%)

Query:     1 MTENRKKLVEVKNVSLTFNKGKANEVRAIDNVSFDIYEGEVFGLVGESGSGKTTVGRSIL   60
             M E  +KL+E+K++    F   +   V+A+D++SFDIY+GE  GLVGESG GK+T GRSI+
Sbjct:     1 MNELTEKLLEIKHLKQHFVTPRGT-VKAVDDLSFDIYKGETLGLVGESGCGKSTTGRSII   59

Query:    61 KLYDISDGEITFNGEVISHLKG-KALHSFRKDAQMIFQDPQASLNGRMKIRDIVAEGLDI  119
             +LY+ +DGE+ FNGE +   K  K L  F + QMIFQDP ASLN RM  +DI+AEGLDI
Sbjct:    60 RLYEATDGEVLFNGENVHGRKSRKKLLEFNRKMQMIFQDPYASLNPRMTVADIIAEGLDI  119
```

```
Query:  120 HKLAKSKSDRDSKVQALLDLVGLNKDHLTRYPHEFSGGQRQRIGIARALAVEPKFIIADE  179
            HKLAK+K +R   +V   LL+ VGLNK+H  RYPHEFSGGQRQRIGIARALA+P+FIIADE
Sbjct:  120 HKLAKTKKERMQRVHELLETVGLNKEHANRYPHEFSGGQRQRIGIARALAVDPEFIIADE  179

Query:  180 PISALDVSIQAQVVNLMQKLQREQGLTYLFIAHDLSMVKYISDRIGVMHWGKLLEVGTSD  239
            PISALDVSIQAQVVNLM++LQ+E+GLTYLFIAHDLSMVKYISDRIGVM++GKL+E+   +D
Sbjct:  180 PISALDVSIQAQVVNLMKELQKEKGLTYLFIAHDLSMVKYISDRIGVMYFGKLVELAPAD  239

Query:  240 DVYNNPIHPYTKSLLSAIPEPDPESERQRVHQPYNPAIEQ--DGQERQMHEITPGHFVLS  297
            ++Y NP+HPYTKSLLSAIP PDP+ ER RV Q Y+P++ Q   DG+  +  E+ PGHFV+
Sbjct:  240 ELYENPLHPYTKSLLSAIPLPDPDYERNRVRQKYDPSVHQLKDGETMEFREVKPGHFVMC  299

Query:  298 TPQEAEEY                                                     305
            T  E + +
Sbjct:  300 TEAEFKAF                                                     307
```

A related DNA sequence was identified in *S. pyogenes* <SEQ ID 329> which encodes the amino acid sequence <SEQ ID 330>. Analysis of this protein sequence reveals the following:

```
Possible site: 47
>>> Seems to have no N-terminal signal sequence

----- Final Results -----
            bacterial cytoplasm --- Certainty = 0.3900(Affirmative) < succ>
             bacterial membrane --- Certainty = 0.0000(Not Clear)  < succ>
              bacterial outside --- Certainty = 0.0000(Not Clear)  < succ>
```

An alignment of the GAS and GBS proteins is shown below:

```
Identities = 164/306 (53%), Positives = 228/306 (73%), Gaps = 3/306 (0%)

Query:    6 KKLVEVKNVSLTFNKGKANEVRAIDNVSFDIYEGEVFGLVGESGSGKTTVGRSILKLYDI   65
            +KLVEVK++ ++F +GK    V A+ N +F I +GE F LVGESGSGKTT+GR+I+ L D
Sbjct:    3 EKLVEVKDLEISFGEGKKKFV-AVKNANFFIKKGETFSLVGESGSGKTTIGRAIIGLNDT   61

Query:   66 SDGEITFNGEVISHLKGKA-LHSFRKDAQMIFQDPQASLNGRMKIRDIVAEGLDIHKLAK  124
            S G+I ++G+VI+   K K+   +    + QMIFQDP ASLN R   + I++EGL    L K
Sbjct:   62 SSGQILYDGKVINGRKSKSEANELIRKIQMIFQDPAASLNERATVDYIISEGLYNFNLFK  121

Query:  125 SKSDRDSKVQALLDLVGLNKDHLTRYPHEFSGGQRQRIGIARALAVEPKFIIADEPISAL  184
            ++ +R  K++ ++   VGL  +HLTRYPHEFSGGQRQRIGIARAL + P+F+IADEPISAL
Sbjct:  122 TEEERKEKIKNMMAEVGLLSEHLTRYPHEFSGGQRQRIGIARALVMNPEFVIADEPISAL  181

Query:  185 DVSIQAQVVNLMQKLQREQGLTYLFIAHDLSMVKYISDRIGVMHWGKLLEVGTSDDVYNN  244
            DVS++AQV+NL++++Q E+GLTYLFIAHDLS+V++ISDRI V+H G ++EV +++++NN
Sbjct:  182 DVSVRAQVLNLLKRMQAEKGLTYLFIAHDLSVVRFISDRIAVIHKGVIVEVAETEELFNN  241

Query:  245 PIHPYTKSLLSAIPEPDPESERQRVHQPYNPAIEQDGQER-QMHEITPGHFVLSTPQEAE  303
            PIHPYT+SLLSA+P PDP  ERQ+    Y+P         ++ M EI P HFV +    E E
Sbjct:  242 PIHPYTQSLLSAVPIPDPILERQKELVVYHPDQHDYTLDKPSMVEIKPNHFVWANQAEIE  301

Query:  304 EYKKQI                                                       309
            +Y+K++
Sbjct:  302 KYQKEL                                                       307
```

Based on this analysis, it was predicted that these proteins and their epitopes could be useful antigens for vaccines or diagnostics.

EXAMPLE 97

A repeated DNA sequence (GBSx0099) was identified in *S. agalactiae* <SEQ ID 331> which encodes the amino acid sequence <SEQ ID 332>. Analysis of this protein sequence reveals the following:

```
Possible site: 28
>>> Seems to have no N-terminal signal sequence

----- Final Results -----
            bacterial cytoplasm --- Certainty = 0.3021(Affirmative) < succ>
             bacterial membrane --- Certainty = 0.0000(Not Clear)   < succ>
              bacterial outside --- Certainty = 0.0000(Not Clear)   < succ>
```

The protein has no significant homology with any sequences in the GENPEPT database.

No corresponding DNA sequence was identified in S. pyogenes.

Based on this analysis, it was predicted that this protein and its epitopes, could be useful antigens for vaccines or diagnostics.

EXAMPLE 98

A repeated DNA sequence (GBSx0100) was identified in S. agalactiae <SEQ ID 333> which encodes the amino acid sequence <SEQ ID 334>. Analysis of this protein sequence reveals the following:

```
Possible site: 24
>>> Seems to have no N-terminal signal sequence

----- Final Results -----
            bacterial cytoplasm --- Certainty = 0.0352(Affirmative) < succ>
             bacterial membrane --- Certainty = 0.0000(Not Clear)   < succ>
              bacterial outside --- Certainty = 0.0000(Not Clear)   < succ>
```

The protein has no significant homology with any sequences in the GENPEPT database.

No corresponding DNA sequence was identified in S. pyogenes.

Based on this analysis, it was predicted that this protein and its epitopes, could be useful antigens for vaccines or diagnostics.

EXAMPLE 99

A repeated DNA sequence (GBSx0101) was identified in S. agalactiae <SEQ ID 335> which encodes the amino acid sequence <SEQ ID 336>. Analysis of this protein sequence reveals the following:

```
Possible site: 23
>>> Seems to have no N-terminal signal sequence

----- Final Results -----
            bacterial cytoplasm --- Certainty = 0.5857(Affirmative) < succ>
             bacterial membrane --- Certainty = 0.0000(Not Clear)   < succ>
              bacterial outside --- Certainty = 0.0000(Not Clear)   < succ>
```

The protein has no significant homology with any sequences in the GENPEPT database.

No corresponding DNA sequence was identified in S. pyogenes.

Based on this analysis, it was predicted that this protein and its epitopes, could be useful antigens for vaccines or diagnostics.

EXAMPLE 100

A repeated DNA sequence (GBSx0103) was identified in S. agalactiae <SEQ ID 337> which encodes the amino acid sequence <SEQ ID 338>. Analysis of this protein sequence reveals the following:

```
Possible site: 14
>>> Seems to have no N-terminal signal sequence

----- Final Results -----
            bacterial cytoplasm --- Certainty = 0.1472(Affirmative) < succ>
            bacterial membrane  --- Certainty = 0.0000(Not Clear)   < succ>
             bacterial outside  --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 101

A repeated DNA sequence (GBSx0104) was identified in *S. agalactiae* <SEQ ID 339> which encodes the amino acid sequence <SEQ ID 340>. Analysis of this protein sequence reveals the following:

```
Possible site: 13
>>> Seems to have no N-terminal signal sequence

----- Final Results -----
            bacterial cytoplasm --- Certainty = 0.0111(Affirmative) < succ>
            bacterial membrane  --- Certainty = 0.0000(Not Clear)   < succ>
             bacterial outside  --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 102

A repeated DNA sequence (GBSx0105) was identified in *S. agalactiae* <SEQ ID 341> which encodes the amino acid sequence <SEQ ID 342>. Analysis of this protein sequence reveals the following:

```
Possible site: 20
>>> Seems to have no N-terminal signal sequence

----- Final Results -----
            bacterial cytoplasm --- Certainty = 0.5628(Affirmative) < succ>
            bacterial membrane  --- Certainty = 0.0000(Not Clear)   < succ>
             bacterial outside  --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 103

A repeated DNA sequence (GBSx0106) was identified in *S. agalactiae* <SEQ ID 343> which encodes the amino acid sequence <SEQ ID 344>. Analysis of this protein sequence reveals the following:

```
Possible site: 39
>>> Seems to have no N-terminal signal sequence

----- Final Results -----
            bacterial cytoplasm --- Certainty = 0.2059(Affirmative) < succ>
            bacterial membrane  --- Certainty = 0.0000(Not Clear)   < succ>
             bacterial outside  --- Certainty = 0.0000(Not Clear)   < succ>
```

The protein has no significant homology with any sequences in the GENPEPT database;

No corresponding DNA sequence was identified in *S. pyogenes*.

Based on this analysis, it was predicted that this protein and its epitopes, could be useful antigens for vaccines or diagnostics.

EXAMPLE 104

A repeated DNA sequence (GBSx0107) was identified in *S. agalactiae* <SEQ ID 345> which encodes the amino acid sequence <SEQ ID 346>. Analysis of this protein sequence reveals the following:

```
Possible site: 21
>>> Seems to have no N-terminal signal sequence

----- Final Results -----
            bacterial cytoplasm --- Certainty = 0.2045(Affirmative) < succ>
            bacterial membrane  --- Certainty = 0.0000(Not Clear)   < succ>
            bacterial outside   --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 105

A DNA sequence (GBSx0108) was identified in *S. agalactiae* <SEQ ID 347> which encodes the amino acid sequence <SEQ ID 348>. Analysis of this protein sequence reveals the following:

```
Possible site: 36
>>> Seems to have no N-terminal signal sequence

----- Final Results -----
            bacterial cytoplasm --- Certainty = 0.3031(Affirmative) < succ>
            bacterial membrane  --- Certainty = 0.0000(Not Clear)   < succ>
            bacterial outside   --- Certainty = 0.0000(Not Clear)   < succ>
```

The protein has homology with the following sequences in the GENPEPT database:

```
>GP: CAB11822 GB: Z99104 similar to hypothetical proteins [Bacillus
subtilis]
Identities = 125/282 (44%), Positives = 184/282 (64%)

Query:   1 MKIFEKAPAKLNLGLDIKGRCDDGYHELAMIMVSIDLNDYVTISELKEDCIVIDSDSSKM   60
           M+I EKAPAK+NL LD+  +  DGYHE+ MIM +IDL D + ++EL ED + + S +  +
Sbjct:   1 MRILEKAPAKINLSLDVTRKRPDGYHEVEMIMTTIDLADRIELTELAEDEVRVSSHNRFV   60

Query:  61 PLNNDNDVFKAADIIKNQYGINKGVHIRLEKSIPVCAGLGGGSTDAAATIRALNRLWNLQ  120
           P +  N  ++AA +IK++Y +  KGV I + K IPV AGL GGS+DAAAT+R LNRLWNL
Sbjct:  61 PDDQRNLAYQAAKLIKDRYNVKKGVSIMITKVIPVAAGLAGGSSDAAATLRGLNRLWNLN  120

Query: 121 MDYDEMVAIGFKIGSDVPYCLGGGCSLVLGKGEIVKPLPTLRPCWIVLVKPDFGISTKSI  180
           +  +   +G +IGSDV +C+ GG +L  G+GE +K + T   CW++L KP G+ST +
Sbjct: 121 LSAETLAELGAEIGSDVSFCVYGGTALATGRGEKIKHISTPPHCWVILAKPTIGVSTAEV  180

Query: 181 FRDIDCKSISRVDIDLLKSAILSSDYQLMVKSMGNSLEDITITKNPVISTIKERMLNSGA  240
           +R +    I   D+ +  AI      +Q M   +GN LE +T+  +P ++ IK +M   GA
```

```
-continued
Sbjct: 181 YRALKLDGIEHPDVQGMIEAIEEKSFQKMCSRLGNVLESVTLDMHPEVAMIKNQMKRFGA 240

Query: 241 DVALMTGSGPTVFSMCSTEKKADRVFNSMKGFCKEVYKVRLL               282
           D  LM+GSGPTVF +   E K  R++N ++GFC +VY VR++
Sbjct: 241 DAVLMSGSGPTVFGLVQYESKVQRIYNGLRGFCDQVYAVRMI               282
```

A related DNA sequence was identified in *S. pyogenes* <SEQ ID 349> which encodes the amino acid sequence <SEQ ID 350>. Analysis of this protein sequence reveals the following:

```
Possible site: 44
>>> Seems to have no N-terminal signal sequence
      INTEGRAL     Likelihood = -2.87     Transmembrane     28-44 (27-45)

----- Final Results -----
            bacterial membrane --- Certainty = 0.2147(Affirmative) < succ>
              bacterial outside --- Certainty = 0.0000(Not Clear) < succ>
            bacterial cytoplasm --- Certainty = 0.0000(Not Clear) < succ>
```

An alignment of the GAS and GBS proteins is shown below:

```
Identities = 33/52 (63%), Positives = 38/52 (72%)

Query: 126 MVAIGFKIGSDVPYCLGGGCSLVLGKGEIVKPLPTLRPCWIVLVKPDFGIST  177
           M+ IG  IGSDVPYCL  GC+ V GKGE+V  +  L   W+VLVKPDFGIST
Sbjct:   1 MMDIGIPIGSDVPYCLLSGCAQVTGKGEVVCRILGLLSSWVVLVKPDFGIST   52
```

Based on this analysis, it was predicted that these proteins and their epitopes could be useful antigens for vaccines or diagnostics.

EXAMPLE 106

A DNA sequence (GBSx0109) was identified in *S. agalactiae* <SEQ ID 351> which encodes the amino acid sequence <SEQ ID-352>. This protein is predicted to be AdcR protein. Analysis of this protein sequence reveals the following:

```
Possible site: 19
>>> Seems to have no N-terminal signal sequence

----- Final Results -----
            bacterial cytoplasm --- Certainty = 0.1264(Affirmative) < succ>
              bacterial membrane --- Certainty = 0.0000(Not Clear) < succ>
              bacterial outside --- Certainty = 0.0000(Not Clear) < succ>
```

The protein has homology with the following sequences in the GENPEPT database:

```
>GP: CAA96184 GB: Z71552 AdcR protein [Streptococcus pneumoniae]
Identities = 77/146 (52%), Positives = 117/146 (79%)

Query:   1 MTVLEQKLDHLVSQILLKAENQHELLFGTCQSDVKLTNTQEHILMLLSQEQLTNSDLAKK   60
           M  L + ++  +++++L+AENQHE+L G C S+V LTNTQEHILMLLS+E LTNS+LA++
Sbjct:   1 MRQLAKDINAFLNEVILQAENQHEILIGHCTSEVALTNTQEHILMLLSEESLTNSELARR   60

Query:  61 LNISQAAVTKAVKSLISQDMLKANKDSKDARITYFELSELAKPIADEHTHHHDNTLGVYG  120
           LN+SQAAVTKA+KSL+ + ML+ +KDSKDAR+ ++L++LA+PIA+EH HHH++TL   Y
Sbjct:  61 LNVSQAAVTKAIKSLVKEGMLETSKDSKDARVIFYQLTDLARPIAEEHHHHHEHTLLTYE  120

Query: 121 RLVNHFSKDEKVVLERFLDLFSRELE                                  146
           ++    F+  +E+ V++RFL      E++
Sbjct: 121 QVATQFTPNEQKVIQRFLTALVGEIK                                  146
```

A related DNA sequence was identified in *S. pyogenes* <SEQ ID 353> which encodes the amino acid sequence <SEQ ID 354>. Analysis of this protein sequence reveals the following:

```
Possible site: 28
>>> Seems to have no N-terminal signal sequence

----- Final Results -----
            bacterial cytoplasm --- Certainty = 0.1536(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below:

```
Identities = 106/147 (72%), Positives = 126/147 (85%)

Query:    1 MTVLEQKLDHLVSQILLKAENQHELLFGTCQSDVKLTNTQEHILMLLSQEQLTNSDLAKK    60
            M +LE+KLD+LV+ ILLKAENQHELLFG CQSDVKLTNTQEHILMLLSQ++LTN+DLAK
Sbjct:    1 MGILEKKLDNLVNTILLKAENQHELLFGACQSDVKLTNTQEHILMLLSQQRLTNTDLAKA    60

Query:   61 LNISQAAVTKAVKSLISQDMLKANKDSKDARITYFELSELAKPIADEHTHHHDNTLGVYG   120
            LNISQAAVTKA+KSL+ QDML   KD+ DAR+TYFEL+ELAKPIA EHTHHHD TL VY
Sbjct:   61 LNISQAAVTKAIKSLVKQDMLAGTKDTVDARVTYFELTELAKPIASEHTHHHDETLNVYN   120

Query:  121 RLVNHFSKDEKVVLERFLDLFSRELEG                                   147
            RL+   FS E  ++++F+ +F+ ELEG
Sbjct:  121 RLLQKFSAKELEIVDKFVTVFAEELEG                                   147
```

Based on this analysis, it was predicted that these proteins and their epitopes could be useful antigens for vaccines or diagnostics.

EXAMPLE 107

A DNA sequence (GBSx0110) was identified in *S. agalactiae* <SEQ ID 355> which encodes the amino acid sequence <SEQ ID 356>. This protein is predicted to be AdcC protein. Analysis of this protein sequence reveals the following:

```
Possible site: 43
>>> Seems to have no N-terminal signal sequence

----- Final Results -----
            bacterial cytoplasm --- Certainty = 0.1089(Affirmative) < succ>
             bacterial membrane --- Certainty = 0.0000(Not Clear)   < succ>
              bacterial outside --- Certainty = 0.0000(Not Clear)   < succ>
```

The protein has homology with the following sequences in the GENPEPT database:

```
>GP: CAA96186 GB: Z71552 AdcC protein [Streptococcus pneumoniae]
Identities = 182/231 (78%), Positives = 206/231 (88%)

Query:    1 MRYITVSGLTFQYDSDPVLEGVNYHLDSGEFVTLTGENGAAKSTLIKATLGILTPKVGTV    60
            MRYITV   L+F YD +PVLE +NY +DSGEFVTLTGENGAAK+TLIKA+LGIL P++G V
Sbjct:    1 MRYITVEDLSFYYDKEPVLEHINYCVDSGEFVTLTGENGAAKTTLIKASLGILQPRIGKV    60

Query:   61 NISKENKEGKKLRIAYLPQQIASFNAGFPSSVYEFVKSGRYPRNGWFRRLTKHDEEHIRV   120
            ISK N +GKKLRIAYLPQQIASFNAGFPS+VYEFVKSGRYPR GWFRRL  HDEEHI+
Sbjct:   61 AISKTNTQGKKLRIAYLPQQIASFNAGFPSTVYEFVKSGRYPRKGWFRRLNAHDEEHIKA   120

Query:  121 SLEAVGMWDNRHKKIGSLSGGQKQRAVIARMFASDPDIFVLDEPTTGMDAGTTEKFYELM   180
            SL++VGMW++R K++GSLSGGQKQRAVIARMFASDPD+F+LDEPTTGMDAG+  +FYELM
Sbjct:  121 SLDSVGMWEHRDKRLGSLSGGQKQRAVIARMFASDPDVFILDEPTTGMDAGSKNEFYELM   180

Query:  181 HHNAHKHGKSVLMITHDPDEVKGYADRNIHLVRNQSLPWRCFNVHTNEMEV           231
            HH+AH HGK+VLMITHDP+EVK YADRNIHLVRNQ  PWRCFNVH N  EV
Sbjct:  181 HHSAHHHGKAVLMITHDPEEVKDYADRNIHLVRNQDSPWRCFNVHENGQEV           231
```

A related DNA sequence was identified in *S. pyogenes* <SEQ ID 357> which encodes the amino acid sequence <SEQ ID 358>. Analysis of this protein sequence reveals the following:

```
Possible Site: 43
>>> Seems to have no N-terminal signal sequence

----- Final Results -----
            bacterial cytoplasm --- Certainty = 0.2722(Affirmative) < succ>
            bacterial membrane  --- Certainty = 0.0000(Not Clear)   < succ>
            bacterial outside   --- Certainty = 0.0000(Not Clear)   < succ>
```

An alignment of the GAS and GBS proteins is shown below:

```
Identities = 190/232 (81%), Positives = 214/232 (91%)

Query:    1 MRYITVSGLTFQYDSDPVLEGVNYHLDSGEFVTLTGENGAAKSTLIKATLGILTPKVGTV   60
            MRYI+V  L+FQY+S+PVLEG+ YHLDSGEFVT+TGENGAAKSTLIKATLGIL PK G V
Sbjct:    1 MRYISVKNLSFQYESEPVLEGITYHLDSGEFVTMTGENGAAKSTLIKATLGILQPKAGRV   60

Query:   61 NISKENKEGKKLRIAYLPQQIASFNAGFPSSVYEFVKSGRYPRNGWFRRLTKHDEEHIRV  120
            I+K+NK+GK+LRIAYLPQQ+ASFNAGFPS+VYEFVKSGRYPR+GWFR L KHDEEH++
Sbjct:   61 TIAKKNKDGKQLRIAYLPQQVASFNAGFPSTVYEFVKSGRYPRSGWFRHLNKHDEEHVQA  120

Query:  121 SLEAVGMWDNRHKKIGSLSGGQKQRAVIARMFASDPDIFVLDEPTTGMDAGTTEKFYELM  180
            SLEAVGMW+NRHK+IGSLSGGQKQR VIARMFASDPDIFVLDEPTTGMD+GTT+ FYELM
Sbjct:  121 SLEAVGMWENRHKRIGSLSGGQKQRVVIARMFASDPDIFVLDEPTTGMDSGTTDTFYELM  180

Query:  181 HHNAHKHGKSVLMITHDPDEVKGYADRNIHLVRNQSLPWRCFNVHTNEMEVE          232
            HH+AH+HGKSVLMITHDP+EVK YADRNIHLVRNQ LPWRCFN+H  E + E
Sbjct:  181 HHSAHQHGKSVLMITHDPEEVKAYADRNIHLVRNQKLPWRCFNIHEAETDDE          232
```

Based on this analysis, it was predicted that these proteins and their epitopes could be useful antigens for vaccines or diagnostics.

EXAMPLE 108

A DNA sequence (GBSx0111) was identified in *S. agalactiae* <SEQ ID 359> which encodes the amino acid sequence <SEQ ID 360>. Analysis of this protein sequence reveals the following:

```
Possible site: 36
>>> Seems to have no N-terminal signal sequence

----- Final Results -----
            bacterial cytoplasm --- Certainty = 0.2299(Affirmative) < succ>
            bacterial membrane  --- Certainty = 0.0000(Not Clear)   < succ>
            bacterial outside   --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 109

A DNA sequence (GBSx0112) was identified in *S. agalactiae* <SEQ ID 361> which encodes the amino acid sequence <SEQ ID 362>. This protein is predicted to be AdcB protein (znuB). Analysis of this protein sequence reveals the following:

```
Possible site: 36
>>> Seems to have no N-terminal signal sequence
    INTEGRAL    Likelihood = -14.33    Transmembrane   145-161 (136-172)
    INTEGRAL    Likelihood = -11.57    Transmembrane    29-45  (20-47)
    INTEGRAL    Likelihood = -10.56    Transmembrane   261-277 (255-280)
    INTEGRAL    Likelihood =  -8.70    Transmembrane   231-247 (227-253)
    INTEGRAL    Likelihood =  -5.63    Transmembrane   101-117 (99-121)
    INTEGRAL    Likelihood =  -4.94    Transmembrane   186-202 (183-225)
    INTEGRAL    Likelihood =  -3.82    Transmembrane    55-71  (54-74)
```

```
   INTEGRAL      Likelihood = -3.61      Transmembrane     206-222  (203-225)
   INTEGRAL      Likelihood = -3.03      Transmembrane      78- 94  ( 75- 94)

----- Final Results -----
             bacterial membrane --- Certainty = 0.6731(Affirmative) < succ>
              bacterial outside --- Certainty = 0.0000(Not Clear)   < succ>
            bacterial cytoplasm --- Certainty = 0.0000(Not Clear)   < succ>
```

A related GBS nucleic acid sequence <SEQ ID 9487> which encodes amino acid sequence <SEQ ID 9488> was also identified.

The protein has homology with the following sequences in the GENPEPT database:

```
>GP: CAA96187 GB: Z71552 AdcB protein [Streptococcus pneumoniae]
Identities = 197/263 (74%), Positives = 236/263 (88%)

Query:  13 LLDMLSYDFMQRALLAVVAISIFAPILGIFLILRRQSLMSDTLSHVSLAGVALGVVLGIS   72
           +L +LSYDF+QRA LAV+A+S+F+P+LG FLILRRQSLMSDTLSHVSL+GVA G+VLGIS
Sbjct:   1 MLSLLSYDFIQRAFLAVIAMSLFSPVLGTFLILRRQSLMSDTLSHVSLSGVAFGLVLGIS   60

Query:  73 PTWSTIFVVTLAAVVLEYLRTVYKHYMEISTAILMSMGLAISLIVMSKAHNVGNVSLEQY  132
           PT STI +V +AAV LEYLRTVYK +MEI TAILMS GLA+SLIVMSK +   ++SL+QY
Sbjct:  61 PTVSTIAIVLIAAVFLEYLRTVYKSFMEIGTAILMSTGLAVSLIVMSKGKSSSSMSLDQY  120

Query: 133 LFGSIITIGKEQVIALFVIALITFILTILFIRPMYILTFDEDTAFVDGLPVRTMSILFNV  192
           LFGSI+TI +EQVI+LFVIA +   ILT LF+RPMYILTFDEDTAFVDGLPVRTMSILFN+
Sbjct: 121 LFGSIVTISEEQVISLFVIAAVVLILTFLFLRPMYILTFDEDTAFVDGLPVRTMSILFNM  180

Query: 193 VTGIAIALTIPAAGALLVSTIMVLPASIAMRLGRNFKTVIFLGMLIGFVGMVAGIFLSYY  252
           VTG+AIAL IPAAGALLVSTIMVLPASIA+RLG+NFK+V+ L   IGF+GMVAG+++SYY
Sbjct: 181 VTGVAIALMIPAAGALLVSTIMVLPASIALRLGKNFKSVMLLASAIGFLGMVAGLYISYY  240

Query: 253 WETPASATITMIFIGIFLLVSLV                                      275
            ETPASA+IT+IF+ +F+L+SLV
Sbjct: 241 AETPASASITIIFVTVFILISLV                                      263
```

A related DNA sequence was identified in *S. pyogenes* <SEQ ID 363> which encodes the amino acid sequence <SEQ ID 364>. Analysis of this protein sequence reveals the following:

```
Possible site: 18
>>> Seems to have a cleavable N-term signal seq.
   INTEGRAL      Likelihood = -14.97     Transmembrane     135-151  (123-162)
   INTEGRAL      Likelihood =  -9.08     Transmembrane      68- 84  ( 44- 86)
   INTEGRAL      Likelihood =  -6.95     Transmembrane      20- 36  ( 19- 37)
   INTEGRAL      Likelihood =  -6.90     Transmembrane     251-267  (245-270)
   INTEGRAL      Likelihood =  -6.58     Transmembrane     221-237  (217-243)
   INTEGRAL      Likelihood =  -6.42     Transmembrane      91-107  ( 89-111)
   INTEGRAL      Likelihood =  -4.78     Transmembrane     176-192  (171-215)
   INTEGRAL      Likelihood =  -3.82     Transmembrane      45- 61  ( 44- 67)
   INTEGRAL      Likelihood =  -3.61     Transmembrane     196-212  (193-215)

----- Final Results -----
             bacterial membrane --- Certainty = 0.6986(Affirmative) < succ>
              bacterial outside --- Certainty = 0.0000(Not Clear)   < succ>
            bacterial cytoplasm --- Certainty = 0.0000(Not Clear)   < succ>
```

The protein has homology with the following sequences in the databases:

```
>GP: CAA96187 GB: Z71552 AdcB protein [Streptococcus pneumoniae]
Identities = 195/262 (74%), Positives = 239/262 (90%)

Query:   3 MLDILFYDFMQRAVMAVVAISIFAPILGIFLILRRQSLMSDTLSHVSLAGVALGVVLGIS   62
           ML +L YDF+QRA +AV+A+S+F+P+LG FLILRRQSLMSDTLSHVSL+GVA G+VLGIS
Sbjct:   1 MLSLLSYDFIQRAFLAVIAMSLFSPVLGTFLILRRQSLMSDTLSHVSLSGVAFGLVLGIS   60

Query:  63 PTITTIIVVVLAAILLEYLRVVYKHYMEISTAILMSLGLALSLIIMSKSHSSSSMSLEQY  122
           PT++TI +V++AA+ LEYLR VYK +MEI TAILMS GLA+SLI+MSK  SSSMSL+QY
Sbjct:  61 PTVSTIAIVLIAAVFLEYLRTVYKSFMEIGTAILMSTGLAVSLIVMSKGKSSSSMSLDQY  120
```

-continued

```
Query: 123 LFGSIITISMEQVVALFAIAAIILILTVLFIRPMYILTFDEDTAFVDGLPVRLMSVLFNI 182
            LFGSI+TIS EQV++LF IAA++LILT LF+RPMYILTFDEDTAFVDGLPVR MS+LFN+
Sbjct: 121 LFGSIVTISEEQVISLFVIAAVVLILTFLFLRPMYILTFDEDTAFVDGLPVRTMSILFNM 180

Query: 183 VTGVAIALTIPAAGALLVSTIMVLPASIAMRLGKNFKTVILLGIVIGFSGMLSGIFLSYF 242
            VTGVAIAL IPAAGALLVSTIMVLPASIA+RLGKNFK+V+LL   IGF GM++G+++SY+
Sbjct: 181 VTGVAIALMIPAAGALLVSTIMVLPASIALRLGKNFKSVMLLASAIGFLGMVAGLYISYY 240

Query: 243 FETPASATITMIFISIFLLVSL                                       264
            ETPASA+IT+IF+++F+L+SL
Sbjct: 241 AETPASASITIIFVTVFILISL                                       262
```

An alignment of the GAS and GBS proteins is shown below:

```
Identities = 223/270 (82%), Positives = 252/270 (92%)

Query:  12 MLLDMLSYDFMQRALLAVVAISIFAPILGIFLILRRQSLMSDTLSHVSLAGVALGVVLGI  71
           ++LD+L YDFMQRA++AVVAISIFAPILGIFLILRRQSLMSDTLSHVSLAGVALGVVLGI
Sbjct:   2 VMLDILFYDFMQRAVMAVVAISIFAPILGIFLILRRQSLMSDTLSHVSLAGVALGVVLGI  61

Query:  72 SPTWSTIFVVTLAAVVLEYLRTVYKHYMEISTAILMSMGLAISLIVMSKAHNVGNVSLEQ 131
           SPT +TI VV LAA++LEYLR VYKHYMEISTAILMS+GLA+SLI+MSK+H+   ++SLEQ
Sbjct:  62 SPTITTIIVVVLAAILLEYLRVVYKHYMEISTAILMSLGLALSLIIMSKSHSSSSMSLEQ 121

Query: 132 YLFGSIITIGKEQVIALFVIALITFILTILFIRPMYILTFDEDTAFVDGLPVRTMSILFN 191
           YLFGSIITI  EQV+ALF IA I  ILT+LFIRPMYILTFDEDTAFVDGLPVR MS+LFN
Sbjct: 122 YLFGSIITISMEQVVALFAIAAIILILTVLFIRPMYILTFDEDTAFVDGLPVRLMSVLFN 181

Query: 192 VVTGIAIALTIPAAGALLVSTIMVLPASIAMRLGRNFKTVIFLGMLIGFVGMVAGIFLSY 251
           +VTG+AIALTIPAAGALLVSTIMVLPASIAMRLG+NFKTVI LG++IGF GM++GIFLSY
Sbjct: 182 IVTGVAIALTIPAAGALLVSTIMVLPASIAMRLGKNFKTVILLGIVIGFSGMLSGIFLSY 241

Query: 252 YWETPASATITMIFIGIFLLVSLVGLLRKR                              281
           ++ETPASATITMIFI IFLLVSL G+L+KR
Sbjct: 242 FFETPASATITMIFISIFLLVSLGGMLKKR                              271
```

Based on this analysis, it was predicted that these proteins and their epitopes could be useful antigens for vaccines or diagnostics.

EXAMPLE 110

A DNA sequence (GBSx0113) was identified in *S. agalactiae* <SEQ ID 365> which encodes the amino acid sequence <SEQ ID 366>. This protein is predicted to be streptodornase. Analysis of this protein sequence reveals the following:

```
Possible site: 59
>>> Seems to have no N-terminal signal sequence

----- Final Results -----
           bacterial cytoplasm --- Certainty = 0.2601(Affirmative) < succ>
            bacterial membrane --- Certainty = 0.0000(Not Clear) < succ>
             bacterial outside --- Certainty = 0.0000(Not Clear) < succ>
```

The protein has homology with the following sequences in the GENPEPT database:

```
>GP: CAA59264 GB: X84793 streptodornase [Streptococcus pyogenes]
Identities = 58/167 (34%), Positives = 85/167 (50%),
Gaps = 30/167 (17%)

Query:   2 TPIYEGNNLVPSRVELQYVGIDKQGKLLEIKLGGGKEQVDEYGVTTVTLENTSPLAKIDY  61
           TP+Y+G+ L+P V + +  D              +DE    TV + N      IDY
Sbjct: 245 TPVYQGSELLPRAVLVSALSSDGF--------------IDE----TVRVFNNVAGFNIDY 286

Query:  62 KTGMLIKEDGKQAEEGEDPNSDADENEAAIE-SASDIEENTNTNTSESDTNNVAPQNRIV 120
           + G L+ E        P ++ D  E  +E +   IE+  +T+T + D  N++  Q + V
Sbjct: 287 QNGGLLTES---------PVTETDNVEENVEDNIETIEDEVDTDTLKKDDENISLQ-KTV 336
```

-continued

```
Query: 121 YVANKGRSNTYWYSLENI-KNANTANIVQMTEQEALNQHKHHSTTEA       166
           YVA+ G SN YWYS EN+ KN N    +V+M+EQ AL + KHHS   EA
Sbjct: 337 YVASSGLSNVYWYSKENMPKNVNLDKVVEMSEQTALARGKHHSAQEA       383
```

A related DNA sequence was identified in *S. pyogenes* <SEQ ID 367> which encodes the amino acid sequence <SEQ ID 368>. Analysis of this protein sequence reveals the following:

```
Possible site: 31
>>> Seems to have a cleavable N-term signal seq.

----- Final Results -----
           bacterial outside --- Certainty = 0.3000(Affirmative) < succ>
          bacterial membrane --- Certainty = 0.0000(Not Clear)   < succ>
         bacterial cytoplasm --- Certainty = 0.0000(Not Clear)   < succ>
```

An alignment of the GAS and GBS proteins is shown below:

```
Identities = 51/90 (56%), Positives = 66/90 (72%), Gaps = 4/90 (4%)

Query:   1 MTPIYEGNNLVPSRVELQYVGIDKQGKLLEIKLGGGKEQVDEYGVTTVTLENTSPLAKID   60
           +TP+Y  N LVP +V LQYVGID+ G LL+IKLG  KE VD +GVT+VTL+N SPLA++D
Sbjct: 182 VTPVYHKNELVPRQVVLQYVGIDENGDLLQIKLGSEKESVDNFGVTSVTLDNVSPLAELD  241

Query:  61 YKTGMLIKEDGKQAEEGEDPNSDADENEAA                                90
           Y+TGM++    D  Q E  ED N + +E E A
Sbjct: 242 YQTGMML--DSTQNE--EDSNLETEEFEEA                               267
```

Based on this analysis, it was predicted that these proteins and their epitopes could be useful antigens for vaccines or diagnostics.

EXAMPLE 111

A DNA sequence (GBSx0114) was identified in *S. agalactiae* <SEQ ID 369> which encodes the amino acid sequence <SEQ ID 370>. This protein is predicted to be tyrosyl-tRNA synthetase (tyrS-1). Analysis of this protein sequence reveals the following:

```
Possible site: 60
>>> Seems to have no N-terminal signal sequence

----- Final Results -----
         bacterial cytoplasm --- Certainty = 0.3618(Affirmative) < succ>
          bacterial membrane --- Certainty = 0.0000(Not Clear)   < succ>
           bacterial outside --- Certainty = 0.0000(Not Clear)   < succ>
```

The protein has homology with the following sequences in the GENPEPT database:

```
>GP: AAC00303 GB: AF008220 tyrosine tRNA synthetase [Bacillus subtilis]
Identities = 234/420 (55%), Positives = 311/420 (73%), Gaps = 2/420 (0%)

Query:   2 NIFDELKERGLVFQTTDEDALRKALEEGSVSYYTGYDPTADSLHLGHLVAILTSRRLQLA   61
           N+ ++L  RGL+ Q TDE+ L K L E  +  Y+G+DPTADSLH+GHL+ ILT RR QLA
Sbjct:   3 NLLEDLSFRGLIQQMTDEEGLNKQLNEEKIRLYSGFDPTADSLHIGHLLPILTLRRFQLA   62

Query:  62 GHKPYALVGGATGLIGDPSFKDVERSLQTKKTVVSWGNKIRGQLSNFLEFETGDNKAVLV  121
           GH P ALVGGATGLIGDPS K  ER+L T    V  W  KI+ QLS FL+FE  +N AV+
Sbjct:  63 GHHPIALVGGATGLIGDPSGKKAERTLNTADIVSEWSQKIKNQLSRFLDFEAAENPAVIA  122

Query: 122 NNYDWFSNISFIDFLRDVGKYFTVNYMMSKESVKKRIETGISYTEFAYQIMQGYDFYELN  181
           NN+DW   ++ IDFLRDVGK F +NYM++K++V  RIE+GISYTEF+Y I+Q YDF  L
Sbjct: 123 NNFDWIGKMNVIDFLRDVGKNFGINYMLAKDTVSSRIESGISYTEFSYMILQSYDFLNLY  182
```

```
-continued
Query:  182 KNYNVTLQIGGSDQWGNMTAGTELIRR--KSNGVSHVMTVPLITDSTGKKFGKSEGNAVW 239
            ++ N  LQIGGSDQWGN+TAG ELIR+  +     +  +T+PL+T + G KFGK+EG A+W
Sbjct:  183 RDKNCKLQIGGSDQWGNITAGLELIRKSEEEGAKAFGLTIPLVTKADGTKFGKTEGGAIW 242

Query:  240 LDADKTSPYEMYQFWLNVMDADAVRFLKIFTFLSLKEIEDIRIQFEEAPHQRLAQKTLAR 299
            LD +KTSPYE YQFW+N  D D V++LK FTFLS +EIE    + E AP +R AQK LA
Sbjct:  243 LDKEKTSPYEFYQFWINTDDRDVVKYLKYFTFLSKEEIEAYAEKTETAPEKREAQKRLAE 302

Query:  300 EVVTLVHGEKAYKEAVNITEQLFAGNIKGLSVKELKQGLRGVPNYHVQTEDNLNIIDLLV 359
            EV +LVHG +A ++A+NI++ LF+GNIK LS +++K G + VP+   V +   L+++D+LV
Sbjct:  303 EVTSLVHGREALEQAINISQALFSGNIKELSAQDVKVGFKDVPSMEVDSTQELSLVDVLV 362

Query:  360 TSGVVNSKRQAREDVSNGAIYINGDRIQDLEYTISENDKLENEITVIRRGKKKYFVLNFK 419
            S +   SKRQARED+ NGA+YING+R  ++ YT+S  D++EN+ TV+RRGKKKYF++ +K
Sbjct:  363 QSKLSPSKRQAREDIQNGAVYINGERQTEINYTLSGEDRIENQFTVLRRGKKKYFLVTYK 422
```

A related DNA sequence was identified in *S. pyogenes* <SEQ ID 371> which encodes the amino acid sequence <SEQ ID 372>. Analysis of this protein sequence reveals the following:

```
Possible site: 37
>>> Seems to have no N-terminal signal sequence

----- Final Results -----
        bacterial cytoplasm --- Certainty = 0.2340(Affirmative) < succ>
        bacterial membrane  --- Certainty = 0.0000(Not Clear)   < succ>
         bacterial outside  --- Certainty = 0.0000(Not Clear)   < succ>
```

An alignment of the GAS and GBS proteins is shown below:

```
Identities = 344/418 (82%), Positives = 377/418 (89%)

Query:    1 MNIFDELKERGLVFQTTDEDALRKALEEGSVSYYTGYDPTADSLHLGHLVAILTSRRLQL   60
            MNIF+ELK RGLVFQTTDE AL KAL EG VSYYTGYDPTADSLHLGHLVAILTSRRLQL
Sbjct:    1 MNIFEELKARGLVFQTTDEQALVKALTEGQVSYYTGYDPTADSLHLGHLVAILTSRRLQL   60

Query:   61 AGHKPYALVGGATGLIGDPSFKDVERSLQTKKTVVSWGNKIRGQLSNFLEFETGDNKAVL  120
            AGHKPYALVGGATGLIGDPSFKD ERSLQTK+TV+ W +KI+GQLS FL+FE GDNKA L
Sbjct:   61 AGHKPYALVGGATGLIGDPSFKDAERSLQTKETVLEWSDKIKGQLSTFLDFENGDNKAEL  120

Query:  121 VNNYDWFSNISFIDFLRDVGKYFTVNYMMSKESVKKRIETGISYTEFAYQIMQGYDFYEL  180
            VNNYDWFS ISFIDFLRDVGKYFTVNYM+SK+SVKKRIETGISYTEFAYQIMQGYDFYEL
Sbjct:  121 VNNYDWFSQISFIDFLRDVGKYFTVNYMMSKDSVKKRIETGISYTEFAYQIMQGYDFYEL  180

Query:  181 NKYNVTLQIGGSDQWGNMTAGTELIRRKSNGVSHVMTVPLITDSTGKKFGKSEGNAVWL  240
            N +NVTLQIGGSDQWGNMTAGTEL+R+K++   HVMTVPLITDSTGKKFGKSEGNAVWL
Sbjct:  181 NDKHNVTLQIGGSDQWGNMTAGTELLRKKADKTGHVMTVPLITDSTGKKFGKSEGNAVWL  240

Query:  241 DADKTSPYEMYQEWLNVMDADAVRFLKIFTFLSLKEIEDIRIQFEEAPHQRLAQKTLARE  300
            DADKTSPYEMYQFWLNVMD DAVRFLKIFTFLSL EI +I  QF  A H+RLAQKTLARE
Sbjct:  241 DADKTSPYEMYQFWLNVMDDDAVRFLKIFTFLSLDEIAEIETQFNAARHERLAQKTLARE  300

Query:  301 VVTLVHGEKAYKEAVNITEQLFAGNIKGLSVKELKQGLRGVPNYHVQTEDNLNIIDLLVT  360
            VVTLVHGE+AYK+A+NITEQLFAGNIK LS  ELKQGL  VPNYHVQ+ DN NI+++LV
Sbjct:  301 VVTLVHGEEAYKQALNITEQLFAGNIKNLSANELKQGLSNVPNYHVQSIDNHNIVEILVA  360

Query:  361 SGVVNSKRQAREDVSNGAIYINGDRIQDLEYTISENDKLENEITVIRRGKKKYFVLNF   418
            + +  SKRQAREDV NGAIYINGDR+QDL+Y +S +DK+++++TVIRRGKKKY VL +
Sbjct:  361 AKISPSKRQAREDVQNGAIYINGDRVQDLDYQLSNDDKIDDQLTVIRRGKKKYAVLTY   418
```

Based on this analysis, it was predicted that these proteins and their epitopes could be useful antigens for vaccines or diagnostics.

EXAMPLE 112

A DNA sequence (GBSx0115) was identified in *S. agalactiae* <SEQ ID 373> which encodes the amino acid sequence <SEQ ID 374>. Analysis of this protein sequence reveals the following:

```
Possible site: 53
>>> Seems to have no N-terminal signal sequence
      INTEGRAL    Likelihood = -12.21      Transmembrane      36-52 (23-59)

----- Final Results -----
              bacterial membrane --- Certainty = 0.5883(Affirmative) < succ>
               bacterial outside --- Certainty = 0.0000(Not Clear)   < succ>
             bacterial cytoplasm --- Certainty = 0.0000(Not Clear)   < succ>
```

The protein has homology with the following sequences in the GENPEPT database:

```
>GP: AAF04736 GB: AF101781 penicillin-binding protein 1b
[Streptococcus pneumoniae]
Identities = 445/769 (57%), Positives = 581/769 (74%), Gaps = 9/769 (1%)

Query:   3 KGNKKLNSSKLGDYTP----LEFGSIFLRI---VKLLSDFIYVIILLFVMLGVGLAVGYL    55
           K K    KG T     L+  +IF I   +K L + ++V+  L  MLG G+A+GY
Sbjct:  21 KNKKSARPGKKGSSTKKSKTLDKSAIFPAILLSIKALFNLLFVLGFLGGMLGAGIALGYG    80

Query:  56 ASQVDSVKVPSKNSLVTQVNTLTRVSRLTYSDKSQISEIATDLQRTPVAKDAISDNIKKA   115
           +   D V+VP    LV QV  ++  +S +TYSD + I+ I +DL RT ++ + IS+N+KKA
Sbjct:  81 VALFDKVRVPQTEELVNQVKDISSISEITYSDGTVIASIESDLLRTSISSEQISENLKKA   140

Query: 116 IIATEDENFNDHKGVVPKAVLRAAAGSVLGFGESSGGSTLTQQLLKQQILGDDPSFKRKS   175
           IIATEDE+F +HKGVVPKAV+RA   G  +G G SSGGSTLTQQL+KQQ++GD P+ RK+
Sbjct: 141 IIATEDEHFKEHKGVVPKAVIRATLGKFVGLGSSSGGSTLTQQLIKQQVVGDAPTLARKA   200

Query: 176 KEIIYALALERYMDKDSILSDYLNVSPFGRNNKGQNIAGIEEAAQGIFGVSAKDLTIPQA   235
            EI+ ALALER M+KD IL+ YLN++PFGRNNKGQNIAG +AA+GIFGV A  LT+PQA
Sbjct: 201 AEIVDALALERAMNKDEILTTYLNVAPFGRNNKGQNIAGARQAAEGIFGVDASQLTVPQA   260

Query: 236 AFLAGLPQSPIVYSPYTADAQLKSDKDLSFGIKRQKNVLYNMYRTRALTKDEYKSYKDYD   295
           AFLAGLPQSPI YSPY    +LKSD+DL G++R K VLY+MYRT AL+KDEY  YKDYD
Sbjct: 261 AFLAGLPQSPITYSPYENTGELKSDEDLEIGLRRAKAVLYSMYRTGALSKDEYSQYKDYD   320

Query: 296 IKKDFIKPAVATTNHHDYLYYSALSEAQKVMYNYLIKKDNVSEHDLKNDETRATYRHRAI   355
           +K+DF+     T    DYLY++ L+EAQ+ MY+YL ++DNVS  +LKN+ T+  YR  A
Sbjct: 321 LKQDFLPSGTVTGISRDYLYFTTLAEAQERMYDYLAQRDNVSAKELKNEATQKFYRDLAA   380

Query: 356 EEIQQGGYTIKTTINKSVYQAMQDAAAQYGGLLDDGTGKVQMGNVLTDNSSGAIIGFIGG   415
           +EI+ GGY I  TTI++ ++ AMQ A A YG LLDDGTG+V++GNVL DN +GAI GF+GG
Sbjct: 381 KEIENGGYKITTTIDQKIHSAMQSAVADYGYLLDDGTGRVEVGNVLMDNQTGAILGFVGG   440

Query: 416 RNYSENQNNHAFDTARSPGSSIKPILPYGIAIDQGMLGSGSVLSNYPTTYSSGEKIMHAD   475
           RNY ENQNNHAFDT RSP S+  KP+L YGIAIDQG++GS ++LSNYPT  ++G   IM+A+
Sbjct: 441 RNYQENQNNHAFDTKRSPASTTKPLLAYGIAIDQGLMGSETILSNYPTNFANGNPIMYAN   500

Query: 476 EEGTAMVNLQESLDISWNIPAFWTYKMLRDRGVDKNYMEKLDYPIENFGIESLPLGGGI   535
           + GT M+ L E+L+ SWNIPA+WTY+MLR  GVDVK YMEK+ Y I  +GIESLP+GGGI
Sbjct: 501 SKGTGMMTLGEALNYSWNIPAYWTYRMLRENGVDVKGYMEKMGYEIPEYGIESLPMGGGI   560

Query: 536 DTSVAQQTNLYQMIANGGVYHKQYMIESIEDSNGKVIYNHESKPVRVFSKATATILQQLL   595
             + +VAQ TN YQ  +AN GVYH+++++I  IE  +G+V+ ++  KPV V+SKATATI+Q LL
Sbjct: 561 EVTVAQHTNGYQTLANNGVYHQKHVISKIEAADGRVVYEYQDKPVQVYSKATATIMQGLL   620

Query: 596 HGPINSGKTTTFKNRLQGLNSGLAGVDWIGKTGTTNSTSDVWLMLSTPKVTLGGWAGHDN   655
             ++S   TTTFK+ L   LN   LA  DWIGKTGTTN    ++WLMLSTP++TLGGW GHD+
Sbjct: 621 REVLSSRVTTTFKSNLTSLNPTLANADWIGKTGTTNQDENMWLMLSTPRLTLGGWIGHDD   680

Query: 656 NASLAKLTGYNNNANYMAHLVNAINNADGNTFGKSERFRLDDSVIKAKVLKSTGLQPGVV   715
           N SL++   GY+NN+NYMAHLVNAI  A  +G +ERF LD SV+K++VLKSTG +PG V
Sbjct: 681 NHSLSRRAGYSNNSNYMAHLVNAIQQASPSIWG-NERFALDPSVVKSEVLKSTGQKPGKV   739

Query: 716 TVNGRRITVGGESTTSYWA-KNGPGTMTYRFAIGGTDSDYQKAWSTLGG             763
            +V G+  + V G + TSYWA K+G     +YRFAIGG+D+DYQ AWS++ G
Sbjct: 740 SVEGKEVEVTGSTVTSYWANKSGAPATSYRFAIGGSDADYQNAWSSIVG             788
```

A related DNA sequence was identified in *S. pyogenes* <SEQ ID 375> which encodes the amino acid sequence <SEQ ID 376>. Analysis of this protein sequence reveals the following:

```
Possible site: 57
>>> Seems to have no N-terminal signal sequence
    INTEGRAL      Likelihood = -4.83      Transmembrane      39-55 (32-60)

----- Final Results -----
            bacterial membrane --- Certainty = 0.2932(Affirmative) < succ>
            bacterial outside  --- Certainty = 0.0000(Not Clear)   < succ>
            bacterial cytoplasm --- Certainty = 0.0000(Not Clear)  < succ>
```

The protein has homology with the following sequences in the databases:

```
>GP: AAF04736 GB: AF101781 penicillin-binding protein 1b
[Streptococcus pneumoniae]
Identities = 438/739 (59%), Positives = 580/739 (78%), Gaps = 2/739 (0%)

Query:  27 PVLLRTLRLLSNFFYIVIFLFGMMGFGMAFGYLASQIESVKVPSKESLVKQVESLTMISQ   86
           P +L +++ L N  +++ FL GM+G G+A GY +  + V+VP  E LV QV+ ++ IS+
Sbjct:  48 PAILLSIKALFNLLFVLGFLGGMLGAGIALGYGVALFDKVRVPQTEELVNQVKDISSISE  107

Query:  87 MNYSDNSLISTLDTDLLRTPVANDAISENIKKAIVSTEDEHFQEHKGIVPKAVFRATLAS  146
           + YSD ++I+++++DLLRT ++++ ISEN+KKAI++TEDEHF+EHKG +VPKAV RATL
Sbjct: 108 ITYSDGTVIASIESDLLRTSISSEQISENLKKAIIATEDEHFKEHKGVVPKAVIRATLGK  167

Query: 147 VLGFGEASGGSTLTQQLVKQQVLGDDPTFKRKSKEIVYALALERYMSKDNILCDYLNVSP  206
           +G G +SGGSTLTQQL+KQQV+GD PT  RK+ EIV ALALER M+KD IL   YLNV+P
Sbjct: 168 FVGLGSSSGGSTLTQQLIKQQVVGDAPTLARKAAEIVDALALERAMNKDEILTTYLNVAP  227

Query: 207 FGRNNKGQNIAGVEEAARGIFGVSAKDLTVPQAAFLAGLPQSPIVYSPYLSTGQLKSEKD  266
           FGRNNKGQNIAG +AA GIFGV A  LTVPQAAFLAGLPQSPI YSPY +TG+LKS++D
Sbjct: 228 FGRNNKGQNIAGARQAAEGIFGVDASQLTVPQAAFLAGLPQSPITYSPYENTGELKSDED  287

Query: 267 MAYGIKRQQNVLFNMYRTGVLSKKEYEDYKAYPIQKDFIQPGSAIVNNHDYLYYTVLADA  326
           +  G++R + VL++MYRTG LSK EY  YK Y +++DF+  G+    + DYLY+T LA+A
Sbjct: 288 LEIGLRRAKAVLYSMYRTGALSKDEYSQYKDYDLKQDFLPSGTVTGISRDYLYFTTLAEA  347

Query: 327 KKAMYSYLIKRDKVSSRDLKNDETKAAYEERALTELQQGGYTITTTINKPIYNAMQTAAA  386
           ++ MY YL +RD VS+++LKN+ T+  Y + A  E++ GGY ITTTI++ I++AMQ+A A
Sbjct: 348 QERMYDYLAQRDNVSAKELKNEATQKFYRDLAAKEIENGGYKITTTIDQKIHSAMQSAVA  407

Query: 387 QFGGLLDDGTGTVQMGNVLTDNATGAVLGFVGGRDYALNQNNHAFNTVRSPGSSIKPIIA  446
           +G LLDDGTG V++GNVL DN TGA+LGFVGGR Y  NQNNHAF+T RSP S+ KP++A
Sbjct: 408 DYGYLLDDGTGRVEVGNVLMDNQTGAILGFVGGRNYQENQNNHAFDTKRSPASTTKPLLA  467

Query: 447 YGPAIDQGLMGSASVLSNYPTTYSSGQKIMHADSEGTAMMPLQEALNTSWNIPAFWTQKL  506
           YG AIDQGLMGS ++LSNYPT +++G  IM+A+S+GT MM L EALN SWNIPA+WT ++
Sbjct: 468 YGIAIDQGLMGSETILSNYPTNFANGNPIMYANSKGTGMMTLGEALNYSWNIPAYWTYRM  527

Query: 507 LREKGVDVENYMTKMGYKIADYSIESLPLGGGIEVSAQQTNAYQMLSNNGLYQKQYIVD  566
           LRE GVDV+ YM KMGY+I +Y IESLP+GGGIEV+AQ TN YQ L+NNG+Y +++++
Sbjct: 528 LRENGVDVKGYMEKMGYEIPEYGIESLPMGGGIEVTAQHTNGYQTLANNGVYHQKHVIS  587

Query: 567 KITASDGTVVYKHENKPIRIFSAATATILQELLRGPITSGATTTFKNRLAAINPWLANAD  626
           KI A+DG VVY++++KP++++S ATATI+Q LLR  ++S  TTTFK+ L ++NP LANAD
Sbjct: 588 KIEAADGRVVYEYQDKPVQVYSKATATIMQGLLREVLSSRVTTTFKSNLTSLNPTLANAD  647

Query: 627 WIGKTGTTENYTDVWLVLSTPKVTLGGWAGHDDNTSLAPLTGYNNNSNYLAYLANAINQA  686
           WIGKTGTT    ++WL+LSTP++TLGGW GHDDN SL+   GY+NNSNY+A+L NAI QA
Sbjct: 648 WIGKTGTTNQDENMWLMLSTPRLTLGGWIGHDDNHSLSRRAGYSNNSNYMAHLVNAIQQA  707

Query: 687 DPNVIGVGQRFNLDPGVIKANVLKSTGLQPGTVNVNGHTFSVGGEMTTSLWSQK-GPGAM  745
            P++ G  +RF LDP V+K+ VLKSTG +PG V+V G     V G   TS W+ K G  A
Sbjct: 708 SPSIWG-NERFALDPSVVKSEVLKSTGQKPGKVSVEGKEVEVTGSTVTSYWANKSGAPAT  766

Query: 746 TYRFAIGGTDADYQKAWGN                                           764
           +YRFAIGG+DADYQ AW +
Sbjct: 767 SYRFAIGGSDADYQNAWSS                                           785
```

An alignment of the GAS and GBS proteins is shown below:

```
Identities = 531/760 (69%), Positives = 639/760 (83%), Gaps = 3/760 (0%)

Query:    6 KKLNSSKLGDYTPLEFGSIFLRIVKLLSDFIYVIILLFVMLGVGLAVGYLASQVDSVKVP   65
            K+++  +LG     L+ G + LR ++LLS+F Y++I LF M+G G+A GYLASQ++SVKVP
Sbjct:   13 KRISHQRLG---LLDLGPVLLRTLRLLSNFFYIVIFLFGMMGFGMAFGYLASQIESVKVP   69

Query:   66 SKNSLVTQVNTLTRVSRLTYSDKSQISEIATDLQRTPVAKDAISDNIKKAIIATEDENFN  125
            SK SLV QV +LT +S++ YSD S IS + TDL RTPVA DAIS+NIKKAI++TEDE+F
Sbjct:   70 SKESLVKQVESLTMISQMNYSDNSLISTLDTDLLRTPVANDAISENIKKAIVSTEDEHFQ  129

Query:  126 DHKGVVPKAVLRAAAGSVLGFGESSGGSTLTQQLLKQQILGDDPSFKRKSKEIIYALALE  185
            +HKG+VPKAV RA   SVLGFGE+SGGSTLTQQL+KQQ+LGDDP+FKRKSKEI+YALALE
Sbjct:  130 EHKGIVPKAVFRATLASVLGFGEASGGSTLTQQLVKQQVLGDDPTFKRKSKEIVYALALE  189

Query:  186 RYMDKDSILSDYLNVSPFGRNNKGQNIAGIEEAAQGIFGVSAKDLTIPQAAFLAGLPQSP  245
            RYM KD+IL DYLNVSPFGRNNKGQNIAG+EEAA+GIFGVSAKDLT+PQAAFLAGLPQSP
Sbjct:  190 RYMSKDNILCDYLNVSPFGRNNKGQNIAGVEEAARGIFGVSAKDLTVPQAAFLAGLPQSP  249

Query:  246 IVYSPYTADAQLKSDKDLSFGIKRQKNVLYNMYRTRALTKDEYKSYKDYDIKKDFIKPAV  305
            IVYSPY +   QLKS+KD+++GIKRQ+NVL+NMYRT  L+K EY+ YK Y I+KDFI+P
Sbjct:  250 IVYSPYLSTGQLKSEKDMAYGIKRQQNVLFNMYRTGVLSKKEYEDYKAYPIQKDFIQPGS  309

Query:  306 ATTNHHDYLYYSALSEAQKVMYNYLIKKDNVSEHDLKNDETRATYRHRAIEEIQQGGYTI  365
            A  N+HDYLYY+ L++A+K MY+YLIK+D VS  DLKNDET+A Y  RA+ E+QQGGYTI
Sbjct:  310 AIVNNHDYLYYTVLADAKKAMYSYLIKRDKVSSRDLKNDETKAAYEERALTELQQGGYTI  369

Query:  366 KTTINKSVYQAMQDAAAQYGGLLDDGTGKVQMGNVLTDNSSGAIIGFIGGRNYSENQNNH  425
             TTINK +Y AMQ AAAQ+GGLLDDGTG VQMGNVLTDN++GA++GF+GGR+Y+ NQNNH
Sbjct:  370 TTTINKPIYNAMQTAAAQFGGLLDDGTGTVQMGNVLTDNATGAVLGFVGGRDYALNQNNH  429

Query:  426 AFDTARSPGSSIKPILPYGIAIDQGMLGSGSVLSNYPTTYSSGEKIMHADEEGTAMVNLQ  485
            AF+T RSPGSSIKPI+ YG AIDQG++GS SVLSNYPTTYSSG+KIMHAD EGTAM+ LQ
Sbjct:  430 AFNTVRSPGSSIKPIIAYGPAIDQGLMGSASVLSNYPTTYSSGQKIMHADSEGTAMMPLQ  489

Query:  486 ESLDISWNIPAFWTYKMLRDRGVDVKNYMEKLDYPIENFGIESLPLGGGIDTSVAQQTNL  545
            E+L+  SWNIPAFWT K+LR++GVDV+NYM K+ Y I ++ IESLPLGGGI+ SVAQQTN
Sbjct:  490 EALNTSWNIPAFWTQKLLREKGVDVENYMTKMGYKIADYSIESLPLGGGIEVSVAQQTNA  549

Query:  546 YQMIANGGVYHKQYMIESIEDSNGKVIYNHESKPVRVFSKATATILQQLLHGPINSGKTT  605
            YQM++N G+Y KQY+++  I   S+G V+Y HE+KP+R+FS ATATILQ+LL GPI SG TT
Sbjct:  550 YQMLSNNGLYQKQYIVDKITASDGTVVYKHENKPIRIFSAATATILQELLRGPITSGATT  609

Query:  606 TFKNRLQGLNSGLAGVDWIGKTGTTNSTSDVWLMLSTPKVTLGGWAGHDNNASLAKLTGY  665
            TFKNRL  +N  LA  DWIGKTGTT + +DVWL+LSTPKVTLGGWAGHD+N SLA LTGY
Sbjct:  610 TFKNRLAAINPWLANADWIGKTGTTENYTDVWLVLSTPKVTLGGWAGHDDNTSLAPLTGY  669

Query:  666 NNNANYMAHLVNAINNADGNTFGKSERFRLDDSVIKAKVLKSTGLQPGVVTVNGRRITVG  725
            NNN+NY+A+L NAIN AD N G  +RF LD  VIKA VLKSTGLQPG V VNG   +VG
Sbjct:  670 NNNSNYLAYLANAINQADPNVIGVGQRFNLDPGVIKANVLKSTGLQPGTVNVNGHTFSVG  729

Query:  726 GESTTSYWAKNGPGTMTYRFAIGGTDSDYQKAWSTLGGKR                     765
            GE TTS W++ GPG MTYRFAIGGTD+DYQKAW   G ++
Sbjct:  730 GEMTTSLWSQKGPGAMTYRFAIGGTDADYQKAWGNFGFRK                     769
```

Figure 120:
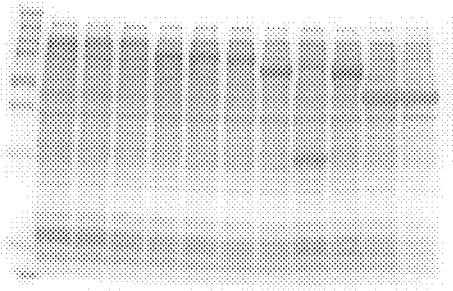

SEQ ID 374 (GBS64d) was expressed in *E. coli* as a GST-fusion product. SDS-PAGE analysis of total cell extract is shown in FIG. 120 (lane 24; MW 107 kDa). It was also expressed in *E. coli* as a His-fusion product. SDS-PAGE analysis of total cell extract is shown in FIG. 120 (lane 5-7; MW 82 kDa) and in FIG. 179 (lane 2; MW 82 kDa).

GBS64d-His was purified as shown in FIG. 231, lane 7-8.

Based on this analysis, it was predicted that these proteins and their epitopes could be useful antigens for vaccines or diagnostics.

EXAMPLE 113

A DNA sequence (GBSx0116) was identified in *S. agalactiae* <SEQ ID 377> which encodes the amino acid sequence <SEQ ID 378>. This protein is predicted to be DNA-dependent RNA polymerase subunit beta (rpoB). Analysis of this protein sequence reveals the following:

```
Possible site: 61
>>> Seems to have no N-terminal signal sequence

----- Final Results -----
            bacterial cytoplasm --- Certainty = 0.3505(Affirmative) < succ>
            bacterial membrane  --- Certainty = 0.0000(Not Clear)  < succ>
            bacterial outside   --- Certainty = 0.0000(Not Clear)  < succ>
```

The protein has homology with the following sequences in the GENPEPT database:

```
>GP: CAB56706 GB: Y16468 DNA-dependent RNA polymerase subunit beta
[Listeria monocytogenes]
Identities = 814/1173 (69%), Positives = 978/1173 (82%), Gaps = 17/1173 (1%)

Query:    2 AGHEVQYGKHRTRRSFSRIKEVLDLPNLIEIQTDSFQDFLDAGLKEVFEDVLPISNFTDT   61
            +GH+V+YG+HRTRRSF+RI EVL+LPNLIEIQT S+Q FLD GL+E+F D+ PI +F
Sbjct:    5 SGHDVKYGRHRTRRSFARISEVLELPNLIEIQTASYQWFLDEGLREMFRDISPIEDFAGN   64

Query:   62 MDLEFVGYELKEPKYTLEEARIHDASYSAPIFVTFRLVNKETGEIKTQEVFFGDFPIMTE  121
            + LEF+ Y+L EPKY++EE++  DA+Y+AP+ V  RL+NKETGE+K QEVF GDFP+MTE
Sbjct:   65 LSLEFIDYDLGEPKYSVEESKNRDANYAAPLRVKLRLINKETGEVKDQEVFMGDFPLMTE  124

Query:  122 MGTFIINGGERIIVSQLVRSPGVYFNDKVDKNGKVGYGSTVIPNRGAWLELETDAKDIAY  181
            MGTFIING ER+IVSQLVRSPGVYFN K+DKNGK G+GSTVIPNRGAWLE ETDAKD+ +
Sbjct:  125 MGTFIINGAERVIVSQLVRSPGVYFNGKLDKNGKKGFGSTVIPNRGAWLEYETDAKDVVH  184

Query:  182 TRIDRTRKIPFTTLVRALGFSGDDEIVDIFGDSELVRNTIEKDIHKNPSDSRTDEALKEI  241
              RIDRTRK+P T L+RALGF D EI+D+ GD++ +RNT+EKD   N     ++AL EI
Sbjct:  185 VRIDRTRKLPVTVLLRALGFSGDQEIIDLIGDNDYLRNTLEKDNTDN-----AEKALLEI  239

Query:  242 YERLRPGEPKTADSSRSLLVARFFDPRRYDLAAVGRYKINKKLNLKTRLLNQTIAENLVD  301
            YERLRPGEP T D++RSLLV+RFFDP+RYDLA+VGRYKINKKL+LK RL NQT+AE LVD
Sbjct:  240 YERLRPGEPPTVDNARSLLVSRFFDPKRYDLASVGRYKINKKLHLKNRLFNQTLAETLVD  299

Query:  302 GETGEILVEAGTVMTRDVIDSIAEHIDGDLNKFVYTPNDYAVVTEPVILQKFKVVAPTDP  361
            ETGEI+   G ++ R +D I  +++ +       P D  V+ + V++Q K+ AP D
Sbjct:  300 PETGEIIASKGDILDRRNLDQIIPNLENGVGFRTLRPTD-GVMEDSVLVQSIKIYAPNDE  358

Query:  362 DRVVTIVGNSNPEDKVRALTPADILAEMSYFLNLAEGIGKVDDIDHLGNRRIRAVGELLA  421
            ++ + I+GN+  E+ V+ +TP+DI++ +SYF NL  G+G  DDIDHLGNRR+R+VGELL
Sbjct:  359 EKEINIIGNAYIEENVKHITPSDIISSISYFFNLLHGVGDTDDIDHLGNRRLRSVGELLQ  418

Query:  422 NQFRIGLARMERNVRERMSVQDNEVLTPQQIINIRPVTAAVKEFFGSSQLSQFMDQHNPL  481
            NQFRIGL+RMER VRERMS+QD  +TPQQ+INIRPV A++KEFFGSSQLSQFMDQ NPL
Sbjct:  419 NQFRIGLSRMERVVRERMSIQDMTTITPQQLINIRPVVASIKEFFGSSQLSQFMDQTNPL  478

Query:  482 SELSHKRRLSALGPGGLTRDRAGYEVRDVHYTHYGRMCPIETPEGPNIGLINNLSSFGHL  541
             EL+HKRRLSALGPGGLTR+RAGYEVRDVHY+HYGRMCPIETPEGPNIGLIN+LSSF +
Sbjct:  479 GELTHKRRLSALGPGGLTRERAGYEVRDVHYSHYGRMCPIETPEGPNIGLINSLSSFAKV  538

Query:  542 NKYGFIQTPYRKVDRSTGAVTNEIVWLTADEEDEFTVAQANSKLNEDGTFAEEIVMGRHQ  601
            NK+GFI TPYR+VD  T  VT++I +LTADEED + VAQANSKL+E GTF EE VM R +
Sbjct:  539 NKFGFIETPYRRVDPETNRVTDKIDYLTADEEDNYVVAQANSKLDEQGTFTEEEVMARFR  598

Query:  602 GNNQEFPSSIVDFVDVSPKQVVAVATACIPFLENDDSNRALMGANMQRQAVPLIDPKAPY  661
                 N      +D++DVSPKQVV+VATACIPFLENDDSNRALMGANMQRQAVPL+ P+AP+
Sbjct:  599 SENLAVEKERIDYMDVSPKQVVSVATACIPFLENDDSNRALMGANMQRQAVPLMHPEAPF  658

Query:  662 VGTGMEYQAAHDSGAAVIAKHDGRVIFSDAEKVEVRRED--------GSLDVYHVQKFRR  713
            VGTGME+ +A DSGAAV AKHDG V   +A ++ VRR         G +D Y ++KF R
Sbjct:  659 VGTGMEHVSAKDSGAAVTAKHDGIVEHVEAREIWVRRVSLVDGKEVTGGIDKYTLRKFVR  718

Query:  714 SNSGTAYNQRTLVKVGDLVEKGDFIADGPSMENGEMALGQNPVVAYMTWEGYNFEDAVIM  773
            SN GT YNQR V GD V KG+ + +GPSM++GE+ALG+N +VA+MTW+GYN+EDA +M
Sbjct:  719 SNQGTCYNQRPNVAEGDRVVKGEILGNGPSMDSGELALGRNVLVAFMTWDGYNYEDAIIM  778

Query:  774 SERLVKEDVYTSVHLEEFESETRDTKLGPEEITREIPNVGEDSLRDLDEMGIIRIGAEVK  833
            SERLVK+DVYTS+H+EEFESE RDTKLGPEE+TR+IPNVGED+LRDLDE GIIR+GAEVK
Sbjct:  779 SERLVKDDVYTSIHIEEFESEARDTKLGPEEMTRDIPNVGEDALRDLDERGIIRVGAEVK  838

Query:  834 EGDILVGKVTPKGEKDLSAEERLLHAIFGDKSREVRDTSLRVPHGGDGVVRDVKIFTRAN  893
            + D+LVGKVTPKG  +L+AEERLLHAIFG+K+REVRDTSLRVPHGG G+V DVKIFTR
Sbjct:  839 DNDLLVGKVTPKGVTELTAEERLLHAIFGEKAREVRDTSLRVPHGGGGIVLDVKIFTREA  898

Query:  894 GDELQSGVNMLVRVYIAQKRKIKVGDKMAGRHGNKGVVSRIVPVEDMPYLPDGTPVDIML  953
            GDEL  GVN LVRVYI QKRKI GDKMAGRHGNKGV+SRI P EDMP++PDGTPVDIML
Sbjct:  899 GDELPPGVNQLVRVYIVQKRKIHEGDKMAGRHGNKGVISRILPEEDMPFMPDGTPVDIML  958

Query:  954 NPLGVPSRMNIGQVMELHLGMAARNLGIHIATPVFDGASSEDLWETVQEAGMDSDAKTVL  1013
            NPLGVPSRMNIGQV+ELHLGMAAR LGIH+ATPVFDGA+ ED+W TV+EAGM DAKT+L
Sbjct:  959 NPLGVPSRMNIGQVLELHLGMAARALGIHVATPVFDGANEEDVWSTVEEAGMARDAKTIL  1018

Query: 1014 YDGRTGEPFDNRVSVGVMYMIKLHHMVDDKLHARSVGPYSLVTQQPLGGKAQFGGQRFGE  1073
            YDGR+GE FDNR+SVGVMYMIKL HMVDDKLHARS GPYSLVTQQPLGGKAQFGGQRFGE
Sbjct: 1019 YDGRSGEAFDNRISVGVMYMIKLAHMVDDKLHARSTGPYSLVTQQPLGGKAQFGGQRFGE  1078

Query: 1074 MEVWALEAYGASNVLQEILTYKSDDVTGRLKAYEAITKGKPIPKPGVPESFRVLVKELQS  1133
            MEVWALEAYGA+   LQEILT KSDDV GR+K YEAI KG+ +P+PGVPESF+VL+KELQS
```

```
                                  -continued
Sbjct:  1079 MEVWALEAYGAAYTLQEILTIKSDDVVGRVKTYEAIVKGESVPEPGVPESFKVLIKELQS  1138

Query:  1134 LGLDMRVLDEDDNEVELRDLDEGEDDDVMHVDD                             1166
             LG+D+++L  D+ E+E+RD+D   DDD  + +D
Sbjct:  1139 LGMDVKMLSADEEEIEMRDMD---DDDFTNQND                             1168
```

A related DNA sequence was identified in *S. pyogenes* <SEQ ID 379> which encodes the amino acid sequence <SEQ ID 380>. Analysis of this protein sequence reveals the following:

```
Possible site: 61
>>> Seems to have no N-terminal signal sequence

----- Final Results -----
              bacterial cytoplasm --- Certainty = 0.3392(Affirmative) < succ>
              bacterial membrane  --- Certainty = 0.0000(Not Clear)   < succ>
              bacterial outside   --- Certainty = 0.0000(Not Clear)   < succ>
```

An alignment of the GAS and GBS proteins is shown below:

```
Identities = 1129/1190 (94%), Positives = 1168/1190 (97%), Gaps = 3/1190 (0%)

Query:     1 MAGHEVQYGKHRTRRSFSRIKEVLDLPNLIEIQTDSFQDFLDAGLKEVFEDVLPISNFTD    60
             +AGHEV+YGKHRTRRSFSRIKEVLDLPNLIEIQTDSFQDFLD+GLKEVFEDVLPISNFTD
Sbjct:     1 LAGHEVRYGKHRTRRSFSRIKEVLDLPNLIEIQTDSFQDFLDSGLKEVFEDVLPISNFTD    60

Query:    61 TMDLEFVGYELKEPKYTLEEARIHDASYSAPIFVTFRLVNKETGEIKTQEVFFGDFPIMT   120
             TM+LEFVGYE KEPKYTLEEARIHDASYSAPIFVTFRLVNKETGEIKTQEVFFGDFPIMT
Sbjct:    61 TMELEFVGYEFKEPKYTLEEARIHDASYSAPIFVTFRLVNKETGEIKTQEVFFGDFPIMT   120

Query:   121 EMGTFIINGGERIIVSQLVRSPGVYFNDKVDKNGKVGYGSTVIPNRGAWLELETDAKDIA   180
             EMGTFIINGGERIIVSQLVRSPGVYFNDKVDKNGKVGYGSTVIPNRGAWLELETD+KDIA
Sbjct:   121 EMGTFIINGGERIIVSQLVRSPGVYFNDKVDKNGKVGYGSTVIPNRGAWLELETDSKDIA   180

Query:   181 YTRIDRTRKIPFTTLVRALGFSGDDEIVDIFGDSELVRNTIEKDIHKNPSDSRTDEALKE   240
             YTRIDRTRKIPFTTLVRALGFSGDDEIVDIFG+S+LVRNTIEKDIHKNPSDSRTDEALKE
Sbjct:   181 YTRIDRTRKIPFTTLVRALGFSGDDEIVDIFGESDLVRNTIEKDIHKNPSDSRTDEALKE   240

Query:   241 IYERLRPGEPKTADSSRSLLVARFFDPRRYDLAAVGRYKINKKLNLKTRLLNQTIAENLV   300
             IYERLRPGEPKTADSSRSLL+ARFFD RRYDLAAVGRYK+NKKLN+KTRLLNQ IAENLV
Sbjct:   241 IYERLRPGEPKTADSSRSLLIARFFDARRYDLAAVGRYKVNKKLNIKTRLLNQIIAENLV   300

Query:   301 DGETGEILVEAGTVMTRDVIDSIAEHIDGDLNKFVYTPNDYAVVTEPVILQKFKVVAPTD   360
             D ETGEILVEAGT MTR VI+SI EH+DGDLNKFVYTPNDYAVVTEPV+LQKFKVV+P D
Sbjct:   301 DAETGEILVEAGTEMTRSVIESIEEHLDGDLNKFVYTPNDYAVVTEPVVLQKFKVVSPID   360

Query:   361 PDRVVTIVGNSNPEDKVRALTPADILAEMSYFLNLAEGIGKVDDIDHLGNRRIRAVGELL   420
             PDRVVTIVGN+NP+DKVRALTPADILAEMSYFLNLAEG+GKVDDIDHLGNRRIRAVGELL
Sbjct:   361 PDRVVTIVGNANPDDKVRALTPADILAEMSYFLNLAEGLGKVDDIDHLGNRRIRAVGELL   420

Query:   421 ANQFRIGLARMERNVRERMSVQDNEVLTPQQIINIRPVTAAVKEFFGSSQLSQFMDQHNP   480
             ANQFRIGLARMERNVRERMSVQDN+VLTPQQIINIRPVTAAVKEFFGSSQLSQFMDQHNP
Sbjct:   421 ANQFRIGLARMERNVRERMSVQDNDVLTPQQIINIRPVTAAVKEFFGSSQLSQFMDQHNP   480

Query:   481 LSELSHKRRLSALGPGGLTRDRAGYEVRDVHYTHYGRMCPIETPEGPNIGLINNLSSFGH   540
             LSELSHKRRLSALGPGGLTRDRAGYEVRDVHYTHYGRMCPIETPEGPNIGLINNLSSFGH
Sbjct:   481 LSELSHKRRLSALGPGGLTRDRAGYEVRDVHYTHYGRMCPIETPEGPNIGLINNLSSFGH   540

Query:   541 LNKYGFIQTPYRKVDRSTGAVTNEIVWLTADEEDEFTVAQANSKLNEDGTFAEEIVMGRH   600
             LNKYGFIQTPYRKVDR+TG VTNEIVWLTADEEDE+TVAQANSKLNEDGTFAEEIVMGRH
Sbjct:   541 LNKYGFIQTPYRKVDRATGTVTNEIVWLTADEEDEYTVAQANSKLNEDGTFAEEIVMGRH   600

Query:   601 QGNNQEFPSSIVDFVDVSPKQVVAVATACIPFLENDDSNRALMGANMRQAVPLIDPKAP   660
             QGNNQEF +S+VDFVDVSPKQVVAVATACIPFLENDDSNRALMGANMRQAVPLIDP+AP
Sbjct:   601 QGNNQEFSASVVDFVDVSPKQVVAVATACIPFLENDDSNRALMGANMRQAVPLIDPRAP   660

Query:   661 YVGTGMEYQAAHDSGAAVIAKHDGRVIFSDAEKVEVRREDGSLDVYHVQKFRRSNSGTAY   720
             YVGTGMEYQAAHDSGAAVIA+ +G+V+FSDAEKVE+RR+DGSLDVYH+ KFRRSNSGTAY
Sbjct:   661 YVGTGMEYQAAHDSGAAVIAQQNGKVVFSDAEKVEIRRQDGSLDVYHITKFRRSNSGTAY   720

Query:   721 NQRTLVKVGDLVEKGDFIADGPSMENGEMALGQNPVVAYMTWEGYNFEDAVIMSERLVKE   780
             NQRTLVKVGD+VEKGDFIADGPSMENGEMALGQNPVVAYMTWEGYNFEDAVIMSERLVKE
Sbjct:   721 NQRTLVKVGDIVEKGDFIADGPSMENGEMALGQNPVVAYMTWEGYNFEDAVIMSERLVKE   780
```

-continued

```
Query:    781 DVYTSVHLEEFESETRDTKLGPEEITREIPNVGEDSLRDLDEMGIIRIGAEVKEGDILVG   840
              DVYTSVHLEEFESETRDTKLGPEEITREIPNVGE++L+DLDEMGIIRIGAEVKEGDILVG
Sbjct:    781 DVYTSVHLEEFESETRDTKLGPEEITREIPNVGEEALKDLDEMGIIRIGAEVKEGDILVG   840

Query:    841 KVTPKGEKDLSAEERLLHAIFGDKSREVRDTSLRVPHGGDGVVRDVKIFTRANGDELQSG   900
              KVTPKGEKDLSAEERLLHAIFGDKSREVRDTSLRVPHGGDG+VRDVKIFTRANGDELQSG
Sbjct:    841 KVTPKGEKDLSAEERLLHAIFGDKSREVRDTSLRVPHGGDGIVRDVIKFTRANGDELQSG   900

Query:    901 VNMLVRVYIAQKRKIKVGDKMAGRHGNKGVVSRIVPVEDMPYLPDGTPVDIMLNPLGVPS   960
              VNMLVRVYIAQKRKIKVGDKMAGRHGNKGVVSRIVPVEDMPYLPDGTPVDIMLNPLGVPS
Sbjct:    901 VNMLVRVYIAQKRKIKVGDKMAGRHGNKGVVSRIVPVEDMPYLPDGTPVDIMLNPLGVPS   960

Query:    961 RMNIGQVMELHLGMAARNLGIHIATPVFDGASSEDLWETVQEAGMDSDAKTVLYDGRTGE  1020
              RMNIGQVMELHLGMAARNLGIHIATPVFDGASSEDLW+TV+EAGMDSDAKTVLYDGRTGE
Sbjct:    961 RMNIGQVMELHLGMAARNLGIHIATPVFDGASSEDLWDTVREAGMDSDAKTVLYDGRTGE  1020

Query:   1021 PFDNRVSVGVMYMIKLHHMVDDKLHARSVGPYSLVTQQPLGGKAQFGGQRFGEMEVWALE  1080
              PFDNRVSVGVMYMIKLHHMVDDKLHARSVGPYSLVTQQPLGGKAQFGGQRFGEMEVWALE
Sbjct:   1021 PFDNRVSVGVMYMIKLHHMVDDKLHARSVGPYSLVTQQPLGGKAQFGGQRFGEMEVWALE  1080

Query:   1081 AYGASNVLQEILTYKSDDVTGRLKAYEAITKGKPIPKPGVPESFRVLVKELQSLGLDMRV  1140
              AYGASNVLQEILTYKSDDVTGRLKAYEAITKGKPIPKPGVPESFRVLVKELQSLGLDMRV
Sbjct:   1081 AYGASNVLQEILTYKSDDVTGRLKAYEAITKGKPIPKPGVPESERVLVKELQSLGLDNRV  1140

Query:   1141 LDEDDNEVELRDLDEGEDDDVMHVDDLEKARVKQEAEEKQAEQVSEVVQE            1190
              LDEDDNEVELRDLDEGEDDD+MHVDDLEKAR KQ E    ++VSE    E
Sbjct:   1141 LDEDDNEVELRDLDEGEDDDIMHVDDLEKAREKQAQE---TQEVSETTDE            1187
```

Based on this analysis, it was predicted that these proteins and their epitopes could be useful antigens for vaccines or diagnostics.

EXAMPLE 114

A DNA sequence (GBSx0118) was identified in *S. agalactiae* <SEQ ID 381> which encodes the amino acid sequence <SEQ ID 382>. This protein is predicted to be DNA-directed RNA polymerase, beta subunit (rpoC). Analysis of this protein sequence reveals the following:

```
Possible site: 32
>>> Seems to have no N-terminal signal sequence

----- Final Results -----
         bacterial cytoplasm --- Certainty = 0.1892 (Affirmative) < succ>
          bacterial membrane --- Certainty = 0.0000 (Not Clear)   < succ>
           bacterial outside --- Certainty = 0.0000 (Not Clear)   < succ>
```

A related DNA sequence was identified in *S. pyogenes* <SEQ ID 383> which encodes the amino acid sequence <SEQ ID 384>. Analysis of this protein sequence reveals the following:

```
Possible site: 22
>>> Seems to have no N-terminal signal sequence

----- Final Results -----
         bacterial cytoplasm --- Certainty = 0.2128 (Affirmative) < succ>
          bacterial membrane --- Certainty = 0.0000 (Not Clear)   < succ>
           bacterial outside --- Certainty = 0.0000 (Not Clear)   < succ>
```

An alignment of the GAS and GBS proteins is shown below:

```
Identities = 1148/1205 (95%), Positives = 1177/1205 (97%)

Query:     11 VVDVNRFKSMQITLASPSKVRSWSYGEVKKPETINYRTLKPEREGLFDEVIFGPTKDWEC    70
              VVDVNRFKSMQITLASPSKVRSWSYGEVKKPETINYRTLKPEREGLFDEVIFGPTKDWEC
Sbjct:      1 VVDVNRFKSMQITLASPSKVRSWSYGEVKKPETINYRTLKPEREGLFDEVIFGPTKDWEC    60
```

```
Query:   71 ACGKYKRIRYKGIICDRCGVEVTRAKVRRERMGHIELKAPVSHIWYFKGIPSRMGLTLDM  130
            ACGKYKRIRYKGI+CDRCGVEVTRAKVRRERMGHIELKAPVSHIWYFKGIPSRMGLTLDM
Sbjct:   61 ACGKYKRIRYKGIVCDRCGVEVTRAKVRRERMGHIELKAPVSHIWYFKGIPSRMGLTLDM  120

Query:  131 SPRALEEVIYFAAYVVIDPMDTPLEPKSLLTEREYREKLQEYGYGSFVAKMGAEAIQDLL  190
            SPRALEEVIYFAAYVVIDP DTPLEPKSLLTEREYREKLQEYG+GSFVAKMGAEAIQDLL
Sbjct:  121 SPRALEEVIYFAAYVVIDPKDTPLEPKSLLTEREYREKLQEYGHGSFVAKMGAEAIQDLL  180

Query:  191 KRVDLDAEIAVLKEELKSATGQKRVKAVRRLDVLDAFKKSGNKPEWMVLNILPVIPPDLR  250
            KRVDL AEIA LKEELKSA+GQKR+KAVRRLDVLDAF KSGNKPEWMVLNILPVIPPDLR
Sbjct:  181 KRVDLAAEIAELKEELKSASGQKRIKAVRRLDVLDAFNKSGNKPEWMVLNILPVIPPDLR  240

Query:  251 PMVQLDGGRFAASDLNDLYRRVINRNNRLARLLELNAPGIIVQNEKRMLQEAVDALIDNG  310
            PMVQLDGGRFAASDLNDLYRRVINRNNRLARLLELNAPGIIVQNEKRMLQEAVDALIDNG
Sbjct:  241 PMVQLDGGRFAASDLNDLYRRVINRNNRLARLLELNAPGIIVQNEKRMLQEAVDALIDNG  300

Query:  311 RRGRPITGPGSRPLKSLSHMLKGKQGRFRQNLLGKRVDFSGRSVIAVGPTLKMYQCGVPR  370
            RRGRPITGPGSRPLKSLSHMLKGKQGRFRQNLLGKRVDFSGRSVIAVGPTLKMYQCGVPR
Sbjct:  301 RRGRPITGPGSRPLKSLSHMLKGKQGRFRQNLLGKRVDFSGRSVIAVGPTLKMYQCGVPR  360

Query:  371 EMAIELFKPFVMREIVARDLAGNVKAAKRMVERGDERIWDILEEVIKEHPVLLNRAPTLH  430
            EMAIELFKPFVMREIVA++ AGNVKAAKRMVERGDERIWDILEEVIKEHPVLLNRAPTLH
Sbjct:  361 EMAIELFKPFVMREIVAKEYAGNVKAAKRMVERGDERIWDILEEVIKEHPVLLNRAPTLH  420

Query:  431 RLGIQAFEPVLIDGKALRLHPLVCEAYNADFDGDQMAIHVPLSEEAQAEARLLMLAAEHI  490
            RLGIQAFEPVLIDGKALRLHPLVCEAYNADFDGDQMAIHVPLSEEAQAEARLLMLAAEHI
Sbjct:  421 RLGIQAFEPVLIDGKALRLHPLVCEAYNADFDGDQMAIHVPLSEEAQAEARLLMLAAEHI  480

Query:  491 LNPKDGKPVVTPSQDMVLGNYYLTMEDAGREGEGMIFKDHDEAVMAYQNGYVHLHTRVGI  550
            LNPKDGKPVVTPSQDMVLGNYYLTMEDAGREGEGMIFKD DEAVMAY+NGY HLH+RVGI
Sbjct:  481 LNPKDGKPVVTPSQDMVLGNYYLTMEDAGREGEGMIFKDKDEAVMAYRNGYAHLHSRVGI  540

Query:  551 AVDSMPNKPWTEEQKHKIMVTTVGKILFNDIMPEDLPYLIEPNNANLTEKTPDKYFLEPG  610
            AVDSMPNKPW + Q+HKIMVTTVGKILFNDIMPEDLPYL EPNNANLTE TPDKYFLEPG
Sbjct:  541 AVDSMPNKPWKDNQRHKIMVTTVGKILFNDIMPEDLPYLQEPNNANLTEGTPDKYFLEPG  600

Query:  611 QDIQAVIDNLEINIPFKKKNLGNIIAETFKRFRTTETSAFLDRLKDLGYYHSTLAGLTVG  670
            QDIQ VID L+IN+PFKKKNLGNIIAETFKRFRTTETSAFLDRLKDLGYYHSTLAGLTVG
Sbjct:  601 QDIQEVIDRLDINVPFKKKNLGNIIAETFKRFRTTETSAFLDRLKDLGYYHSTLAGLTVG  660

Query:  671 IADIPVIDNKAEIIDAAHHRVEDINKAFRRGLMTEEDRYVAVTTTWREAKEALEKRLIET  730
            IADIPVIDNKAEIIDAAHHRVE+INKAFRRGLMT++DRYVAVTTTWREAKEALEKRLIET
Sbjct:  661 IADIPVIDNKAEIIDAAHHRVEEINKAFRRGLMTDDDRYVAVTTTWREAKEALEKRLIET  720

Query:  731 QDPKNPIVMMMDSGARGNISNFSQLAGMRGLMAAPNGRIMELPILSNFREGLSVLEMFFS  790
            QDPKNPIVMMMDSGARGNISNFSQLAGMRGLMAAPNGRIMELPILSNFREGLSVLEMFFS
Sbjct:  721 QDPKNPIVMMMDSGARGNISNFSQLAGMRGLMAAPNGRIMELPILSNFREGLSVLEMFFS  780

Query:  791 THGARKGMTDTALKTADSGYLTRRLVDVAQDVIIREDDCGTDRGLTITAITDGKEVTETL  850
            THGARKGMTDTALKTADSGYLTRRLVDVAQDVIIREDDCGTDRGL I AITDGKEVTETL
Sbjct:  781 THGARKGMTDTALKTADSGYLTRRLVDVAQDVIIREDDCGTDRGLLIRAITDGKEVTETL  840

Query:  851 EERLIGRYTKKSIKHPETGEILVGADTLITEDMAAKVVKAGVEEVTIRSVFTCNTRHGVC  910
            EERL GRYT+KS+KHPETGE+L+GAD LITEDMA K+V AGVEEVTIRSVFTC TRHGVC
Sbjct:  841 EERLQGRYTRKSVKHPETGEVLIGADQLITEDMARKIVDAGVEEVTIRSVFTCATRHGVC  900

Query:  911 RHCYGINLATGDAVEVGEAVGTIAAQSIGEPGTQLTMRTFHTGGVASNTDITQGLPRIQE  970
            RHCYGINLATGDAVEVGEAVGTIAAQSIGEPGTQLTMRTFHTGGVASNTDITQGLPRIQE
Sbjct:  901 RHCYGINLATGDAVEVGEAVGTIAAQSIGEPGTQLTMRTFHTGGVASNTDITQGLPRIQE  960

Query:  971 IFEARNPKGEAVITEVKGEVVAIEEDSSTRTKKVFVKGQTGEGEYVVPFTARMKVEVGDE  1030
            IFEARNPKGEAVITEVKG VV IEED+STRTKKV V+G TG GEYV+PFTARMKVEVGDE
Sbjct:  961 IFEARNPKGEAVITEVKGNVVEIEEDASTRTKKVYVQGKTGMGEYVIPFTARMKVEVGDE  1020

Query: 1031 VARGAALTEGSIQPKRLLEVRDTLSVETYLLAEVQKVYRSQGVEIGDKHVEVMVRQMLRK  1090
            V RGAALTEGSIQPKRLLEVRDTLSVETYLLAEVQKVYRSQGVEIGDKHVEVMVRQMLRK
Sbjct: 1021 VNRGAALTEGSIQPKRLLEVRDTLSVETYLLAEVQKVYRSQGVEIGDKHVEVMVRQMLRK  1080

Query: 1091 VRVMDPGDTDLLPGTLMDISDFTDANKDIVISGGIPATSRPVLMGITKASLETNSFLSAA  1150
            VRVMDPGDTDLLPGTLMDISDFTDANKDIVISGGIPATSRPVLMGITKASLETNSFLSAA
Sbjct: 1081 VRVMDPGDTDLLPGTLMDISDFTDANKDIVISGGIPATSRPVLMGITKASLETNSFLSAA  1140

Query: 1151 SFQETTRVLTDAAIRGKKDHLLGLKENVIIGKIIPAGTGMARYRNIEPLAVNEVEIIEGT  1210
            SFQETTRVLTDAAIRGKKDHLLGLKENVIIGKIIPAGTGMARYRNIEP A+NE+E+I+ T
Sbjct: 1141 SFQETTRVLTDAAIRGKKDHLLGLKENVIIGKIIPAGTGMARYRNIEPQAMNEIEVIDHT  1200

Query: 1211 PVDAE                                                        1215
             V AE
Sbjct: 1201 EVSAE                                                        1205
```

Based on this analysis, it was predicted that these proteins and their epitopes could be useful antigens for vaccines or diagnostics.

EXAMPLE 115

A DNA sequence (GBSx0120) was identified in *S. agalactiae* <SEQ ID 385> which encodes the amino acid sequence <SEQ ID 386>. This protein is predicted to be a DNA binding protein. Analysis of this protein sequence reveals the following:

```
Possible site: 19
>>> Seems to have no N-terminal signal sequence

----- Final Results -----
            bacterial cytoplasm --- Certainty = 0.4727(Affirmative) < succ>
             bacterial membrane --- Certainty = 0.0000(Not Clear)   < succ>
              bacterial outside --- Certainty = 0.0000(Not Clear)   < succ>
```

The protein has homology with the following sequences in the GENPEPT database:

```
>GP: AAC45309 GB: U81957 putative DNA binding protein
[Streptococcus gordonii]
Identities = 42/99 (42%), Positives = 75/99 (75%)

Query:   1 MYQVVKMFGDWEPWWFIEGWEEDITEIAEYDTLSEALLYFQEEWDRGQEKWPYFQSKSSL    60
           MY+VV+M+GD+EPWWF++GWE DI +    ++    +AL +++ +W + + ++  ++S+S L
Sbjct:   1 MYRVVEMYGDFEPWWFLDGWENDIIQEQRFEKYYDALKFYKIQWLKLETEFKEYKSRSDL    60

Query:  61 LATFWSIKEKRWCEECDEYLQQYHSLMLLKEWQEIPKEE                        99
           + FW+  ++RWCEECD+Y+QQY S++LL++ + IPK +
Sbjct:  61 MTVFWNENDQRWCEECDDYVQQYRSIILLEDEKVIPKSK                        99
```

A related DNA sequence was identified in *S. pyogenes* <SEQ ID 387> which encodes the amino acid sequence <SEQ ID 388>. Analysis of this protein sequence reveals the following:

```
Possible site: 36
>>> Seems to have no N-terminal signal sequence

----- Final Results -----
            bacterial cytoplasm --- Certainty = 0.4741(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below:

```
Identities = 61/121 (50%), Positives = 83/121 (68%)

Query:   1 MYQVVKMFGDWEPWWFIEGWEEDITEIAEYDTLSEALLYFQEEWDRGQEKWPYFQSKSSL    60
           MYQV+KM+GDWEPWWFI+GW++DI +  ++     EAL YF +EW R +  +P + S+ +L
Sbjct:   1 MYQVIKMYGDWEPWWFIDGWQDDIIDEQQFSDWQEALDYFNQEWQRMKAIFPSYHSQKNL    60

Query:  61 LATFWSIKEKRWCEECDEYLQQYHSLMLLKEWQEIPKEESIERFEVFNKIAELPSACSLNL   121
           LATFW  ++KRWCE+CDE LQQ+HSL+LLK    +P    I  FE N   ++    C LNL
Sbjct:  61 LATFWEKEDKRWCEDCDEDLQQFHSLLLLKNKDIVPSNNYIPEFEQRNDSPQVAYLCKLNL   121
```

Based on this analysis, it was predicted that these proteins and their epitopes could be useful antigens for vaccines or diagnostics.

EXAMPLE 116

A DNA sequence (GBSx0121) was identified in *S. agalactiae* <SEQ ID 389> which encodes the amino acid sequence <SEQ ID 390>. Analysis of this protein sequence reveals the following:

```
Possible site: 18
>>> Seems to have no N-terminal signal sequence

----- Final Results -----
              bacterial cytoplasm --- Certainty= 0.2433(Affirmative) < succ>
               bacterial membrane --- Certainty = 0.0000(Not Clear)  < succ>
                 bacterial outside --- Certainty = 0.0000(Not Clear)  < succ>
```

The protein has homology with the following sequences in the GENPEPT database:

```
>GP: AAC45310 GB: U81957 putative ABC transporter subunit ComYA
[Streptococcus gordonii]
Identities = 203/319 (63%), Positives = 255/319 (79%), Gaps = 1/319 (0%)

Query:    1 MVQSLAKQVIHQAVEVNAQDIYIIPKGDCYELYMRIDDERRFIDVFEFNRMASLISHFKF   60
            MVQ +A+ ++ QA E  AQDIY +PK DCYELYMRI DERRFI ++F+++A++ISHFKF
Sbjct:    1 MVQKIAQAIVRQAKEECAQDIYFVPKDDCYELYMRIGDERRFIQTYDFDQLAAVISHFKF   60

Query:   61 VAGMNVGEKRRSQLGSCDYELSEGRLVSLRLSSVGDYRGQESLVIRILYSGHQDLKYWFD  120
            +AGMNVGEKRRSQLGSCDY  + +  S+RLS+VGDYRG ESLVIR+L+    +LK+WF
Sbjct:   61 LAGMNVGEKRRSQLGSCDYRDD-KETSIRLSTVGDYRGYESLVIRLLHDEETELKFWFT  119

Query:  121 NIKQMKEVLGIRGLYLFSGPVGSGKTTLMYQLASEVFKNKQIITIEDPVEIKNDKMLQLQ  180
              +  +++E    RGLYLFSGPVGSGKTTLM+QLA   FK +Q+++IEDPVEIK + MLQLQ
Sbjct:  120 HFPELREKFKDRGLYLFSGPVGSGKTTLMHQLAQLKFKGQQVMSIEDPVEIKQEDMLQLQ  179

Query:  181 LNEDIGMTYDALIKLSLRHRPDILIIGEIRDQATARAVIRASLTGVMVFSTIHAKSIPGV  240
            LNE IG+TY++LIKLSLRHRPD+LIIGEIRD  TARAV+RASLTG  VFSTIHAKSIPGV
Sbjct:  180 LNETIGLTYESLIKLSLRHRPDLLIIGEIRDSETARAVVRASLTGATVFSTIHAKSIPGV  239

Query:  241 YDRLIELGVNYQELENSLKLIAYQRLIGGGSLIDFETGNFKKHSSDKWNRQVDILAEEGH  300
            Y+RL+ELGV+ +EL+  L+ I YQRLIGGG +IDF + N+++H    WN+Q+D L   GH
Sbjct:  240 YERLLELGVSEEELKIVLQGICYQRLIGGGGVIDFASDNYQEHEPTVWNQQIDQLLAAGH  299

Query:  301 ISKKQAQVEKIIPQETTES                                          319
            I  +QA+ EKI  Q+    S
Sbjct:  300 IHPEQAEAEKIRNQQAKTS                                          318
```

A related DNA sequence was identified in *S. pyogenes* <SEQ ID 391> which encodes the amino acid sequence <SEQ ID 392>. Analysis of this protein sequence reveals the following:

```
Possible site: 18
>>> Seems to have no N-terminal signal sequence

----- Final Results -----
              bacterial cytoplasm --- Certainty = 0.1846(Affirmative) < succ>
               bacterial membrane --- Certainty = 0.0000(Not Clear)  < succ>
                 bacterial outside --- Certainty = 0.0000(Not Clear)  < succ>
```

An alignment of the GAS and GBS proteins is shown below:

```
Identities = 207/312 (66%), Positives = 257/312 (82%)

Query:    1 MVQSLAKQVIHQAVEVNAQDIYIIPKGDCYELYMRIDDERRFIDVFEFNRMASLISHFKF   60
            MVQ+LAK ++ +A +V+AQDIYI+P+ D Y+L++RI DERR +DV++QSDRMA LISHFKF
Sbjct:    1 MVQALAKAILAKAEQVHAQDIYILPRADQYDLFLRIGDERRLVDVYQSDRMAPLISHFKF   60

Query:   61 VAGMNVGEKRRSQLGSCDYELSEGRLVSLRLSSVGDYRGQESLVIRILYSGHQDLKYWFD  120
            VAGM VGEKRR Q+GSCDY+LS+ + +SLRLSSVGDYRGQESLVIR+L+  ++ + YWFD
Sbjct:   61 VAGMIVGEKRRCQVGSCDYKLSKDKQLSLRLSSVGDYRGQESLVIRLLHHQNKSVHYWFD  120

Query:  121 NIKQMKEVLGIRGLYLFSGPVGSGKTTLMYQLASEVFKNKQIITIEDPVEIKNDKMLQLQ  180
             + ++  +G RGLYLF+GPVGSGKTTLMYQL S   + Q+I+IEDPVEIKN ++LQLQ
Sbjct:  121 GLTKVANQVGGRGLYLFAGPVGSGKTTLMYQLISNYHQEAQVISIEDPVEIKNHQILQLQ  180

Query:  181 LNEDIGMTYDALIKLSLRHRPDILIIGEIRDQATARAVIRASLTGVMVFSTIHAKSIPGV  240
            +N+DIGMTYD LIKLSLRHRPDIL+IGEIRD  TARAVIRASLTG MVFST+HAKSI GV
Sbjct:  181 VNDDIGMTYDNLIKLSLRHRPDILVIGEIRDSQTARAVIRASLTGAMVFSTVHAKSISGV  240
```

```
                                -continued
Query:  241 YDRLIELGVNYQELENSLKLIAYQRLIGGGSLIDFETGNFKKHSSDKWNRQVDILAEEGH  300
            Y RL+ELGV   EL N L LIAYQRL+ GG+LID   F+ +SS WN+Q+D L E GH
Sbjct:  241 YARLLELGVTKAELSNCLALIAYQRLLNGGALIDSTQNEFEYYSSSNWNQQIDQLLEAGH  300

Query:  301 ISKKQAQVEKII  312
            ++ KQA++EKII
Sbjct:  301 LNPKQAKLEKII  312
```

Figure 5:
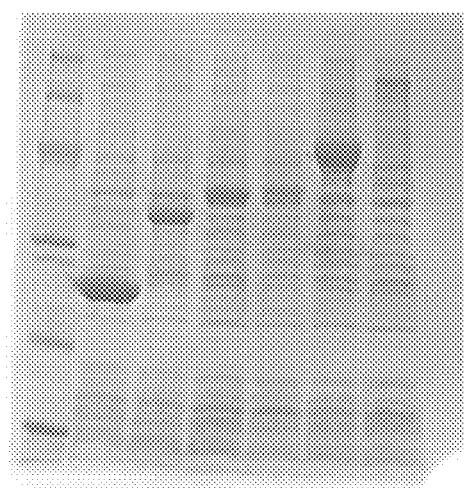
Figure 13:
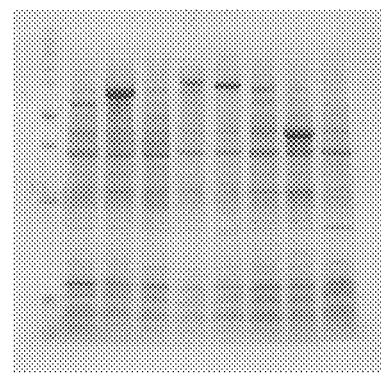

SEQ ID 390 (GBS63) was expressed in E. coli as a His-fusion product. SDS-PAGE analysis of total cell extract is shown in FIG. 5 (lane 5; MW 39 kDa). It was also expressed in E. coli as a GST-fusion product. SDS-PAGE analysis of total cell extract is shown in FIG. 13 (lane 2; MW 64 kDa).

The GBS63-GST fusion product was purified (FIG. 101A; see also FIG. 191, lane 3) and used to immunise mice (lane 1 product; 20 µg/mouse). The resulting antiserum was used for Western blot (FIG. 101B), FACS (FIG. 101C), and in the in vivo passive protection assay (Table III). These tests confirm that the protein is immunoaccessible on GBS bacteria and that it is an effective protective immunogen.

Based on this analysis, it was predicted that these proteins and their epitopes could be useful antigens for vaccines or diagnostics.

EXAMPLE 117

A DNA sequence (GBSx0122) was identified in S. agalactiae <SEQ ID 393> which encodes the amino acid sequence <SEQ ID 394>. This protein is predicted to be competence protein (mshG). Analysis of this protein sequence reveals the following:

```
Possible site: 49
>>> Seems to have no N-terminal signal sequence
    INTEGRAL    Likelihood = -14.65    Transmembrane    123-139 (113-144)
    INTEGRAL    Likelihood = -13.53    Transmembrane    272-288 (264-295)
    INTEGRAL    Likelihood =  -8.55    Transmembrane     79-95  (75-102)
    INTEGRAL    Likelihood =  -0.00    Transmembrane    146-162 (146-162)

----- Final Results -----
            bacterial membrane --- Certainty = 0.6859(Affirmative) < succ>
            bacterial outside  --- Certainty = 0.0000(Not Clear)   < succ>
            bacterial cytoplasm --- Certainty = 0.0000(Not Clear)  < succ>
```

A related GBS nucleic acid sequence <SEQ ID 9489> which encodes amino acid sequence <SEQ ID 9490> was also identified.

The protein has homology with the following sequences in the GENPEPT database:

```
>GP: AAC45311 GB: U81957 putative ABC transporter subunit ComYB
[Streptococcus gordonii]
Identities = 161/280 (57%), Positives = 219/280 (77%)

Query:   19 MNKALLEGKDLSKMLGELGFSDTVITQVALADLHGNISRSLLKIESYLANLLLVRKKVIE   78
            M + L G+   S+++  LGFSD V+TQ++LA+LHGN+S +LLKIE YL NL  V+KK+IE
Sbjct:    1 MRQGLANGQAFSEIMASLGFSDAVVTQLSLAELHGNLSLALLKIEEYLDNLAKVKKKLIE   60

Query:   79 VATYPLILLSFLVLIMIGLRNYLMPQLGENNFATRLITNVPNIFLLLLAVVLIFSLIFYI  138
            VATYP++LL FLVLIMIGLRNYL+PQL  NFAT+LI ++P IFLL + ++L +    Y+
Sbjct:   61 VATYPMMLLGFLVLIMIGLRNYLLPQLSSQNFATQLIGHLPTIFLLTVMLLGLTGAIYL  120

Query:  139 IQKRLSRIKVACFLTTIPLVGSYVKLYLTAYYAREWGNLLSQGIELDQIVKVMQNQKSKL  198
            + K   RI V  FL  +P VGS+V+++YLTAYYAREWGN++ QG+EL QI ++MQ Q+S L
Sbjct:  121 VFKGQKRIPVYSFLARLPFVGSFVRIYLTAYYAREWGNMIGQGLELSQIFQIMQEQRSVL  180

Query:  199 FREIGYDMEEGFLSGKAFHQKVLDYPFFLTELSLMIEYGQVKAKLGTELDIYADEKWEDF  258
            F+EIG D+ +  +G+ F  K+  YPFF  ELSL+IEYG+VK+KLG+EL IYA + WE+F
Sbjct:  181 FQEIGQDLGQALQNGQEFSDKIASYPFFKKELSLIIEYGEVKSKLGSELEIYALKTWEEF  240

Query:  259 FTKLARATQLIQPVIFIFVALIIVMIYAAMLLPMYQNMEI                      298
            F ++ R   LIQP++F+FVAL+IV++YAAMLLP+YQNME+
Sbjct:  241 FGRVNRTMNLIQPLVFVFVALMIVLLYAAMLLPLYQNMEV                      280
```

A related DNA sequence was identified in *S. pyogenes* <SEQ ID 395> which encodes the amino acid sequence <SEQ ID 396>. Analysis of this protein sequence reveals the following:

```
Possible site: 43
>>> Seems to have no N-terminal signal sequence
     INTEGRAL    Likelihood = -12.52    Transmembrane   317-333 (309-339)
     INTEGRAL    Likelihood = -10.14    Transmembrane   123-139 (119-147)
     INTEGRAL    Likelihood =  -6.95    Transmembrane   164-180 (161-183)

----- Final Results -----
             bacterial membrane --- Certainty = 0.6010(Affirmative) < succ>
              bacterial outside --- Certainty = 0.0000(Not Clear)   < succ>
             bacterial cytoplasm --- Certainty = 0.0000(Not Clear)  < succ>
```

The protein has homology with the following sequences in the databases:

```
>GP: AAC45311 GB: U81957 putative ABC transporter subunit ComYB
[Streptococcus gordonii]
Identities = 139/278 (50%), Positives = 207/278 (74%)

Query:  63 MEESLLKGQGLADMLSGLGFSDAILTQISLADRHGNIETTLVAIQHYLNQMARIRRKTVE  122
            M + L  GQ  +++++ LGFSDA++TQ+SLA+ HGN+   L+ I+ YL+ +A++++K +E
Sbjct:   1 MRQGLANGQAFSEIMASLGFSDAVVTQLSLAELHGNLSLALLKIEEYLDNLAKVKKKLIE   60

Query: 123 VITYPLILLLFLFVMMLGLRRYLVPQLETQNQITYFLNHFPAFFIGFCSGLILLFGMVWL  182
            V  TYP++LL FL ++M+GLR  YL+PQL +QN  T  + H P  F+    L+ L G ++L
Sbjct:  61 VATYPMMLLGFLVLIMIGLRNYLLPQLSSQNFATQLIGHLPTIFLLTVLMLLGLTGAIYL  120

Query: 183 RWRSQSRLKLYSRLSRYPFLGKLLKQYLTSYYAREWGTLIGQGLDLMTILDIMAIEKSSL  242
            ++ Q R+ +YS L+R PF+G  ++ YLT+YYAREWG +IGQGL+L  I   IM  ++S L
Sbjct: 121 VFKGQKRIPVYSFLARLPFVGSFVRIYLTAYYAREWGNMIGQGLELSQIFQIMQEQRSVL  180

Query: 243 MKELAEDIRMSLLEGQAFHIKVATYPFFKKELSLMIEYGEIKSKLGAELEIYAQESWEQF  302
             +E+ +D+  +L  GQ F  K+A+YPFFKKELSL+IEYGE+KSKLG+ELEIYA ++WE+F
Sbjct: 181 FQEIGQDLGQALQNGQEFSDKIASYPFFKKELSLIIEYGEVKSKLGSELEIYALKTWEEF  240

Query: 303 FSQLYQVTQLIQPAIFLVVAVTIVMIYAAILLPIYQNM                       340
            F ++ +    LIQP +F+ VA+ IV++YAA+LLP+YQNM
Sbjct: 241 FGRVNRTMNLIQPLVFVFVALMIVLLYAAMLLPLYQNM                       278
```

An alignment of the GAS and GBS proteins is shown below:

```
Identities = 148/297 (49%), Positives = 209/297 (69%), Gaps = 2/297 (0%)

Query:    1 MVTFLKRSKLLSDCYTDSMNKALLEGKDLSKMLGELGFSDTVITQVALADLHGNISRSLL   60
            ++ FLKRS+LL    Y  M ++LL+G+ L+ ML LGFSD ++TQ++LAD HGNI  +L+
Sbjct:   45 VIAFLKRSQLLQLDYVLKMEESLLKGQGLADMLSGLGFSDAILTQISLADRHGNIETTLV  104

Query:   61 KIESYLANLLLVRKKVIEVATYPLILLSFLVLIMIGLRNYLMPQLGENNFATRLITNVPN  120
            +I+ YL   + +R+K +EV TYPLILL FL ++M+GLR YL+PQL    N  T + + P
Sbjct:  105 AIQHYLNQMARIRRKTVEVITYPLILLLFLFVMMLGLRRYLVPQLETQNQITYFLNHFPA  164

Query:  121 IFL-LLLAVVLIFSLIFYIIQKRLSRIKVACFLTTIPLVGSYVKLYLTAYYAREWGNLLS  179
             F+      ++L+F ++ ++   +  SR+K+    L+   P  +G   +K YLT+YYAREWG L+
Sbjct:  165 FFIGFCSGLILLFGMV-WLRWRSQSRLKLYSRLSRYPFLGKLLKQYLTSYYAREWGTLIG  223

Query:  180 QGIELDQIVKVMQNQKSKLFREIGYDMEEGFLSGKAFHQKVLDYPFFLTELSLMIEYGQV  239
            QG++L  I+ +M +KS L +E+  D+    L G+AFH KV  YPFF   ELSLMIEYG++
Sbjct:  224 QGLDLMTILDIMAIEKSSLMKELAEDIRMSLLEGQAFHIKVATYPFFKKELSLMIEYGEI  283

Query:  240 KAKLGTELDIYADEKWEDFFTKLARATQLIQPVIFIFVALIIVMIYAAMLLPMYQNM    296
            K+KLG EL+IYA E WE FF++L + TQLIQP IF+ VA+ IVMIYAA+LLP+YQNM
Sbjct:  284 KSKLGAELEIYAQESWEQFFSQLYQVTQLIQPAIFLVVAVTIVMIYAAILLPIYQNM    340
```

A related GBS gene <SEQ ID 8493> and protein <SEQ ID 8494> were also identified. Analysis of this protein sequence reveals the following:

```
Lipop: Possible site: -1 Crend: 9
SRCFLG: 0
McG: Length of UR: 2
Peak Value of UR: 1.24
Net Charge of CR: 0
McG: Discrim Score: -8.94
GvH: Signal Score (-7.5): -4.08
Possible site: 31
>>> Seems to have no N-terminal signal sequence
Amino Acid Composition: calculated from 1
ALOM program count: 4 value: -14.65 threshold: 0.0
INTEGRAL Likelihood = -14.65 Transmembrane 105-121 (95-126)
INTEGRAL Likelihood = -13.53 Transmembrane 254-270 (246-277)
INTEGRAL Likelihood =  -8.55 Transmembrane   61-77 (57-84)
PERIPHERAL Likelihood =  5.09 14
modified ALOM score: 3.43
icm1 HYPID: 7 CFP: 0.686

*** Reasoning Step: 3

----- Final Results -----
         bacterial membrane --- Certainty = 0.6859 (Affirmative) < succ>
         bacterial outside  --- Certainty = 0.0000 (Not Clear)   < succ>
         bacterial cytoplasm --- Certainty = 0.0000 (Not Clear)  < succ>
```

The protein has homology with the following sequences in the databases:

```
57.5/79.7% over 279aa
Streptococcus gordonii
GP|2058545|putative ABC transporter subunit ComYB Insert characterized ORF00008(355-1194 of 1500)
GP|2058545|gb|AAC45311.1||081957(1-280 of 282)putative ABC transporter subunit
ComYB{Streptococcus gordonii}
% Match = 33.5
% Identity = 57.5   % Similarity = 79.6
Matches = 161   Mismatches = 57   Conservative Sub.s = 62

144       174       204       234       264       294       324       354
TLRQVILKNTHQTSGIDKWISWLKKDISVRNRHKSKKLSLKKQRKVVQLFNNLFASGFSLTDMVTFLKRSKLLSDCYTDS 384       414       444       474       504       534       564       594
MNKALLEGKDLSKMLGELGFSDTVITQVALADLHGNISRSLLKIESYLANLLLVRKKVIEVATYPLILLSFLVLIMIGLR
 | :  |  |:  :|:::   ||||  |:|::||:||||:  :|||||  || ||   |:|:||||||||::|  |||||||||||
MRQGLANGQAFSEIMASLGFSDAVVTQLSLAELHGNLSLALLKIEEYLDNLAKVKKKLIEVATYPMMLLGFLVLIMIGLR
          10        20        30        40        50        60        70        80

624       654       684       714       744       774       804       834
NYLMPQLGENNFATRLITNVPNIFLLLLAVVLIFSLIFYIIQKRLSRIKVACFLTTIPLVGSYVKLYLTAYYAREWBNLL
|||:|||   ||||:|| ::| |||| ::| ::   |:: |   || |  :|:|||:|:||||||||||||::
NYLLPQLSSQNFATQLIGHLPTIFLLTVLMLLGLTGAIYLVFKGQKRIPVYSFLARLPFVGSFVRIYLTAYYAREWGNMI
          90       100       110       120       130       140       150       160

864       894       924       954       984      1014      1044      1074
SQGIELDQIVKVMQNQKSKLFREIGYDMEEGFLSGKAFHQKVLDYPFFLTELSLMIEYGQVKAKLGTELDIYADEKWEDF
  ||:||  ||  ::||   |::|   |:  ||::||:| |  |:  |    ||||  |:|||:||::|||:|||||||| : ||:|
GQGLELSQIFQIMQEQRSVLFQEIGQDLGQALQNGQEFSDKIASYPPFKKELSLIIEYGEVKSKLGSELEIYALKTWEEF
         170       180       190       200       210       220       230       240

1104      1134      1164      1194      1224      1254      1284      1314
FTKLARATQLIQPVIFIFVALIIVMIYAAMLLPMYQNMEILS*KIYC*NVRIRRLKHLHF*NVW*HWLQSQELY*FIKD*
|  ::  |   ||||::|:||||:||||||||||:|||||
FGRVNRTMNLIQPLVFVFVALMIVLLYAAMLLPLYQNMEVHL
         250       260       270       280
```

Figure 11:
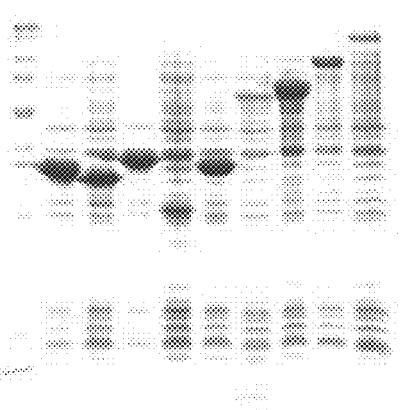
Figure 15:
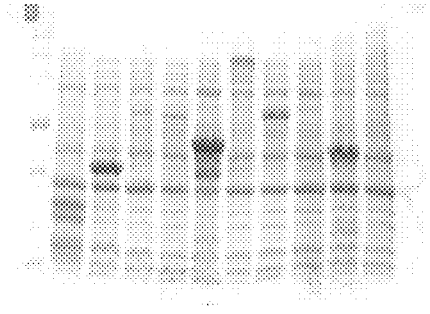

SEQ ID 8494 (GBS49) was expressed in *E. coli* as a His-fusion product. SDS-PAGE analysis of total cell extract is shown in FIG. 11 (lane 5; MW 15 kDa). It was also was expressed in *E. coli* as a GST-fusion product. SDS-PAGE analysis of total cell extract is shown in FIG. 15 (lane 5; MW 60 kDa).

Based on this analysis, it was predicted that these proteins and their epitopes could be useful antigens for vaccines or diagnostics.

EXAMPLE 118

A DNA sequence (GBSx0123) was identified in *S. agalactiae* <SEQ ID 397> which encodes the amino acid sequence <SEQ ID 398>. This protein is predicted to be ComYD or ComGD. Analysis of this protein sequence reveals the following:

```
Possible site: 55
>>> Seems to have a cleavable N-term signal seq.

----- Final Results -----
        bacterial outside --- Certainty = 0.3000 (Affirmative) < succ>
        bacterial membrane --- Certainty = 0.0000 (Not Clear)   < succ>
        bacterial cytoplasm --- Certainty = 0.0000 (Not Clear)   < succ>
```

The protein has homology with the following sequences in the GENPEPT database:

```
>GP: CAA75315 GB: Y15043 homology to ComYD from Streptococcus gordonii,
and ComGD from Bacillus subtilis [Lactococcus lactis subsp. cremoris]
Identities = 56/138 (40%), Positives = 92/138 (66%), Gaps = 2/138 (1%)

Query:   12 KVKAFTLLECLVALVTITGALLVYQGLTKLLAQQIVVMSSSSQSEWVLLTQQLNAEFEGA   71
            K++AFTLLECLVAL+ I+G++LV  GLT+++ +Q+ +  + S+ +W +   +Q+ +E  GA
Sbjct:   13 KIRAFTLLECLVALLAISGSVLVISGLTRMIEEQMKISQNDSRKDWQIFCEQMRSELSGA   72

Query:   72 HLEYLRQNKLYLRKQDKIVTFGKSNKDDFRKTGYDGRGYQPMVYGLDNCQMSQTKSMVKL  131
            L+ + QN LY+ K DK + FG    DDFRK+    G+GYQPM+Y L    ++   ++++K+
Sbjct:   73 KLDNVNQNFLYVTK-DKKLRFGLVG-DDFRKSDDKGQGYQPMLYDLKGAKIQAEENLIKI  130

Query:  132 VFYFKDGLKRTFYYDFKE                                            149
             F +G +R  F Y F +
Sbjct:  131 TIDFDNGGERVFIYRFTD                                            148
```

A related DNA sequence was identified in *S. pyogenes* <SEQ ID 399> which encodes the amino acid sequence <SEQ ID 400>. Analysis of this protein sequence reveals the following:

```
Possible site: 28
>>> Seems to have a cleavable N-term signal seq.

----- Final Results -----
        bacterial outside --- Certainty = 0.3000 (Affirmative) < succ>
        bacterial membrane --- Certainty = 0.0000 (Not Clear)   < succ>
        bacterial cytoplasm --- Certainty = 0.0000 (Not Clear)   < succ>
```

The protein has homology with the following sequences in the databases:

```
>GP: CAA75315 GB: Y15043 homology to ComYD from Streptococcus gordonii,
and ComGD from Bacillus subtilis [Lactococcus lactis subsp. cremoris]
Identities = 65/137 (47%), Positives = 84/137 (60%), Gaps = 2/137 (1%)

Query:    8 IKAFTLLEALIALLVISGSLLVYQGLTRTLLKHSHYLARHDQDNWLLFSHQLREELSGAR   67
            I+AFTLLE L+ALL ISGS+LV  GLTR + +         + +W +F  Q+R ELSGA+
Sbjct:   14 IRAFTLLECLVALLAISGSVLVISGLTRMIEEQMKISQNDSRKDWQIFCEQMRSELSGAK   73

Query:   68 FYKVADNKLYVEKGKKVLAFGQFKSHDFRKSASNGKGYQPMLFGISRSHIHIEQSQICIT  127
            + V +N LYV K KK L FG     DFRKS   G+GYQPML+  +  + I  E++ I IT
Sbjct:   74 LDNVNQNFLYVTKDKK-LRFG-LVGDDFRKSDDKGQGYQPMLYDLKGAKIQAEENLIKIT  131

Query:  128 LKWKSGLERTFYYAFQD                                            144
              + + +G ER  F Y   F D
Sbjct:  132 IDFDNGGERVFIYRFTD                                            148
```

An alignment of the GAS and GBS proteins is shown below:

```
Identities = 58/137 (42%), Positives = 88/137 (63%)

Query:   13 VKAFTLLECLVALVTITGALLVYQGLTKLLAQQIVVMSSSSQSEWVLLTQQLNAEFEGAH    72
            +KAFTLLE L+AL+ I+G+LLVYQGLT+ L +    ++   Q  W+L + QL   E   GA
Sbjct:    8 IKAFTLLEALIALLVISGSLLVYQGLTRTLLKHSHYLARHDQDNWLLFSHQLREELSGAR    67

Query:   73 LEYLRQNKLYLRKQDKIVTFGKSNKDDFRKTGYDGRGYQPMVYGLDNCQMSQTKSMVKLV   132
            +    NKLY+  K   K++ FG+       DFRK+   +G+GYQPM++G+    +    +S + +
Sbjct:   68 FYKVADNKLYVEKGKKVLAFGQFKSHDFRKSASNGKGYQPMLFGISRSHIHIEQSQICIT   127

Query:  133 FYFKDGLKRTFYYDFKE                                             149
            +K GL+RTFYY F++
Sbjct:  128 LKWKSGLERTFYYAFQD                                             144
                                          15
```

A related GBS gene <SEQ ID 8495> and protein <SEQ ID 8496> were also identified. Analysis of this protein sequence reveals the following:

```
Lipop: Possible site: -1 Crend: 10
McG: Discrim Score: 4.86
GvH: Signal Score (-7.5): -0.22
Possible site: 55
>>> Seems to have a cleavable N-term signal seq.
ALOM program count: 0 value: 12.47 threshold: 0.0
PERIPHERAL Likelihood = 12.47 127
modified ALOM score: -2.99

*** Reasoning Step: 3

----- Final Results -----
          bacterial outside  --- Certainty = 0.3000 (Affirmative) < succ>
          bacterial membrane --- Certainty = 0.0000 (Not Clear)   < succ>
          bacterial cytoplasm --- Certainty = 0.0000 (Not Clear)  < succ>
```

The protein has homology with the following sequences in the databases:

```
GP|3287181| homology to ComYD from Streptococcus gordonii, and ComGD from
Bacillus subtillus {Lactococcus lactis subsp. cremoris} Insert
characterized ORF00009(334-747 of 1053)
GP|3287181|emb|CAA75315.1||Y15043(13-148 of 150)homology to ComYD from
Steptococcus gordonii, and ComGD from Bacillus subtillus
{Lactococcus lactis subsp. cremoris}
% Match = 15.9
% Identity = 40.6    % Similarity = 68.1
Matches = 56   Mismatches = 42    Conservative Sub.s = 38
       177       207       237       267       297       327       357       387
IC**EVGGFFYKIS*SDPVNPTRYFYFCSSYHCYDLCSNAVTNVSKYGDIIMKNLLLKCKDKKVKAFTLLECLVALVTIT
  :         :          |::|||||||||||: |:
                                      MTMERKFCDLKLKIRAFTLLECLVALLAIS
                                       10        20        30

417       447       477       507       537       567       597       627
GALLVYQGLTKLLAQQIVVMSSSSQSEWVLLTQQLNAEFEGAHLEYLRQNKLYLRKQDKIVTFGKSNKDDFRKTGYDGRG
|::||   |||:::  :|:   :  |: :|: :|:  ||  |: |  || :|    |||||    |:|
GSVLVISGLTRMIEEQMKISQNDSRKDWQIFCEQMRSELSGAKLDNVNQNFLYVTK-DKKLRFGLVG-DDFRKSDDKGQG 657       687       717       747       777       807       837       867
YQPMVYGLDNCQMSQTKSMVKLVFYFKDGLKRTFYYDFKEET*SWHPFASYCIGCCIYTRLTVLSSKNIGNRKTVS*PN*
||||:|    ::    ::::|:    |  :| :|||| :
YQPMLYDLKGAKIQAEENLIKITIDFDNGGERVFIYRFTDTK
         120       130       140       150
```

Figure 2:
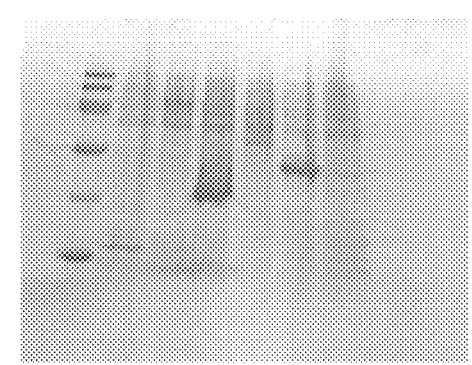
Figure 260:
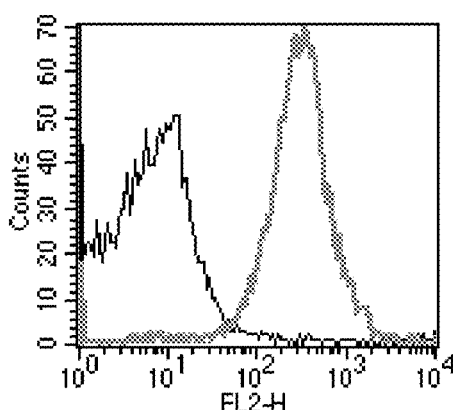

SEQ ID 398 (GBS6) was expressed in *E. coli* as a GST-fusion product. SDS-PAGE analysis of total cell extract is shown in FIG. 1 (lane 2; MW 40 kDa). It was also expressed in *E. coli* as a His-fusion product. SDS-PAGE analysis of total cell extract is shown in FIG. 2 (lane 2; MW 15 kDa). The GBS6-GST fusion product was purified (FIG. 189, lane 2) and used to immunise mice. The resulting antiserum was used for FACS (FIG. 260), which confirmed that the protein is immunoaccessible on GBS bacteria.

Based on this analysis, it was predicted that these proteins and their epitopes could be useful antigens for vaccines or diagnostics.

EXAMPLE 119

A DNA sequence (GBSx0124) was identified in *S. agalactiae* <SEQ ID 401> which encodes the amino acid sequence <SEQ ID 402>. Analysis of this protein sequence reveals the following:

```
Possible site: 43
>>> Seems to have no N-terminal signal sequence

----- Final Results -----
            bacterial cytoplasm --- Certainty = 0.3831(Affirmative) < succ>
             bacterial membrane --- Certainty = 0.0000(Not Clear)   < succ>
              bacterial outside --- Certainty = 0.0000(Not Clear)   < succ>
```

The protein has homology with the following sequences in the GENPEPT database:

```
>GP: AAC00317 GB: AF008220 YtxK [Bacillus subtilis]
Identities = 106/329 (32%), Positives = 176/329 (53%), Gaps = 17/329 (5%)

Query:    1 MNFEKIETAYELILENIQTIENQLKTHIYDALIEQNSYYLGSSCDLDMVVVNNQKLRQLD    60
            M + +    YEL+ E    I+N+L+    +AL E    Y      D + +  +QK +QL
Sbjct:    1 MQKDHVGAVYELLNEAAIMIKNELQISYIEALAEAGEMYFLEKTD-QLKLPADQKTKQLQ   59

Query:   61 LSQE---------EW-RRTFQFIFIKSAQTEQLQANHQFTPDSIGFILLFLLEE-LTSQE   109
            E            EW R+ FQ    +K  + +   N Q TPD+IG  + +L+ + +  ++
Sbjct:   60 ALLEKAEFGTYEHEWVRKAFQLAVLKGMK-DISHPNRQMTPDTIGLFISYLVNKFMADKK   118

Query:  110 TVDVLEIGSGTGNLAQTLLNN-SSKELNYMGIEVDDLLIDLSASIAEIIGSSAQFIQEDA   168
               + +L+    GTGNL  T+LN  S K  N    GIE+DD+L+ ++ + A ++      +   +D+
Sbjct:  119 ELTILDPALGTGNLLFTVLNQLSEKTANSFGIEIDDVLLKIAYAQANLLKKELELFHQDS   178

Query:  169 VRPQILKESDVIISDLPVGYYPNDGIAKRYAVSSSKEHTYAHHLLMEQSLKYLKKDGIAI   228
              + P +    D +I DLPVGYYPND  A+ + + + + H++AHHL +EQS+K+  K  G
Sbjct:  179 LEPLFIDPVDTVICDLPVGYYPNDEGAEAFELKADEGHSFAHHLFIEQSVKHTKPGGYLF   238

Query:  229 FLAPENLLTSPQSDLLKEWLKGYADVIAVLTPETIFGSRQNAKSIFVLKKQAEQKP---   285
            F+ P +L   S QS   LK++ K    + A+L LP++IF     +AKSI VL+KQ E
Sbjct:  239 FMIPNHLFESSQSGKLKQFFKDKVHINALLQLPKSIFKDEAHAKSILVLQKQGENTKAPG   298

Query:  286 ETFVYPLTDLQNRENMANFIENFQKWSRE                                314
            +  +  L     N++ M + +  F +W ++
Sbjct:  299 QILLANLPSFSNQKAMLDMMAQFDEWFKK                                327
```

A related DNA sequence was identified in *S. pyogenes* <SEQ ID 403> which encodes the amino acid sequence <SEQ ID 404>. Analysis of this protein sequence reveals the following:

```
Possible site: 57
>>> Seems to have an uncleavable N-term signal seq

----- Final Results -----
             bacterial membrane --- Certainty = 0.0000(Not Clear)   < succ>
              bacterial outside --- Certainty = 0.0000(Not Clear)   < succ>
            bacterial cytoplasm --- Certainty = 0.0000(Not Clear)   < succ>
```

An alignment of the GAS and GBS proteins is shown below:

```
Identities = 223/315 (70%), Positives = 270/315 (84%)

Query:    1 MNFEKIETAYELILENIQTIENQLKTHIYDALIEQNSYYLGSSCDLDMVVVNNQKLRQLD    60
            M FEKIE AY+L+LEN Q IEN LKTHIYDA++EQNS+YLG+       V  N+ KL+ L
Sbjct:   16 MTFEKIEEAYQLLLENCQLIENDLKTHIYDAIVEQNSFYLGAEGASPQVAQNSDKLKALC   75

Query:   61 LSQEEWRRTFQFIFIKSAQTEQLQANHQFTPDSIGFILLFLLEELTSQETVDVLEIGSGT   120
            L++EEWR+  +QF+FIK+AQTEQLQANHQFTPD+IGFILL+LLE+L+  ++ +++VLEIGSGT
Sbjct:   76 LTKEEWRKAYQFLFIKAAQTEQLQANHQFTPDAIGFILLYLLEQLSDKDSLEVLEIGSGT   135

Query:  121 GNLAQTLLNNSSKELNYMGIEVDDLLIDLSASIAEIIGSSAQFIQEDAVRPQILKESDVI   180
            GNLAQTLLNN+SK L+Y+GIE+DDLLIDLSASIAEI+ SSA FIQEDAVRPQ+LKESD++
```

```
                            -continued
Sbjct: 136 GNLAQTLLNNTSKSLDYVGIELDDLLIDLSASIAEIMDSSAHFIQEDAVRPQLLKESDIV 195

Query: 181 ISDLPVGYYPNDGIAKRYAVSSSKEHTYAHHLLMEQSLKYLKKDGIAIFLAPENLLTSPQ 240
           ISDLPVGYYPND IAKRY V+SS +HTYAHHLLMEQSLKYLKKDG AIFLAP NLLTSPQ
Sbjct: 196 ISDLPVGYYPNDDIAKRYKVASSDKHTYAHHLLMEQSLKYLKKDGFAIFLAPVNLLTSPQ 255

Query: 241 SDLLKEWLKGYADVIAVLTLPETIFGSRQNAKSIFVLKKQAEQKPETFVYPLTDLQNREN 300
           S LLK+WLK YA V+ ++TLP++IFG   NAKSI VL+KQ +    ETFVYP+ DL+  EN
Sbjct: 256 SQLLKQWLKDYAQVVTLITLPDSIFGHPSNAKSIIVLQKQTDHPMETFVYPIRDLKLAEN 315

Query: 301 MANFIENFQKWSREN                                              315
           + +F+ENF+KW   N
Sbjct: 316 IHDFMENFKKWKLSN                                              330
```

Based on this analysis, it was predicted that these proteins and their epitopes could be useful antigens for vaccines or diagnostics.

EXAMPLE 120

A DNA sequence (GBSx0125) was identified in *S. agalactiae* <SEQ ID 405> which encodes the amino acid sequence <SEQ ID 406>. This protein is predicted to be acetate kinase (ackA-1). Analysis of this protein sequence reveals the following:

```
Possible site: 15
>>> Seems to have no N-terminal signal sequence

----- Final Results -----
            bacterial cytoplasm --- Certainty = 0.2384(Affirmative) < succ>
             bacterial membrane --- Certainty = 0.0000(Not Clear)   < succ>
              bacterial outside --- Certainty = 0.0000(Not Clear)   < succ>
```

The protein has homology with the following sequences in the GENPEPT database:

```
>GP: AAC36857 GB: L17320 acetate kinase [Bacillus subtilis]
Identities = 223/395 (56%), Positives = 293/395 (73%), Gaps = 3/395 (0%)

Query:   1 MSKTIAINAGSSSLKWQLYEMPEEKVVAKGIIERIGLKDSISTVKFDDKKDEQILDIVDH  60
           MSK IAINAGSSSLK+QL+EMP E V+ KG++ERIG+ DS+ T+  +K+ ++ DI DH
Sbjct:   1 MSKIIAINAGSSSLKFQLFEMPSETVLTKGLVERIGIADSVFTISVNGEKNTEVTDIPDH  60

Query:  61 TQAVKILLEDLTKHGIIKDFNEITGVGHRVVAGGEYFKESALVDDKVVEQVEELSALAPL 120
              AVK+LL  LT+ GIIKD NEI G+GHRVV GGE F +S L+ D+ ++++E++S LAPL
Sbjct:  61 AVAVKMLLNKLTEFGIIKDLNEIDGIGHRVVHGGEKFSDSVLLTDETIKEIEDISELAPL 120

Query: 121 HNPAAAAGIRAFREILPDITSVCVFDTAFHTTMQPHTYLYPIPQKYYTDYKVRKYGAHGT 180
           HNPA    GI+AF+E+LP++ +V VFDTAFH TM   +YLY +P +YY  + +RKYG HGT
Sbjct: 121 HNPANIVGIKAFKEVLPNVPAVAVFDTAFHQTMPEQSYLYSLPYEYYEKFGIRKYGFHGT 180

Query: 181 SHQYVAQEAAKQLGRPLEELKLITAHVGNGVSITANYHGQSIDTSMGFTPLAGPMMGTRS 240
           SH+YV + AA+ LGRPL++L+LI+ H GNG SI A    G+SIDTSMGFTPLAG  MGTRS
Sbjct: 181 SHKYVTERAAELLGRPLKDLRLISCHLGNGASIAAVEGGKSIDTSMGFTPLAGVAMGTRS 240

Query: 241 GDIDPAIIPYLVANDPELEDAAAVVNMLNKQSGLLGVSGTSSDMRDIEAGLQSKDPNAVL 300
           G+IDPA+IPY++     D   V+N LNK+SGLLG+SG SSD+RDI    +    +   A
Sbjct: 241 GNIDPALIPYIMEKTGQTAD--EVLNTLNKKSGLLGISGFSSDLRDIVEATKEGNERAET 298

Query: 301 AYNVFIDRIKKFIGQYLAVLNGADAIIFTAGMGENAPLMRQDVIAGLSWFGIELDPE-KN 359
           A   VF  RI K+IG Y A ++G DAIIFTAG+GEN+  +R+ V+ GL + G+  DP  N
Sbjct: 299 ALEVFASRIHKYIGSYAARMSGVDAIIFTAGIGENSVEVRERVLRGLEFMGVYWDPALNN 358

Query: 360 VFGYFGDITKPDSKVKVLVIPTDEELMIARDVERL                          394
           V G   I+ P S VKV++IPTDEE+MIARDV RL
Sbjct: 359 VRGEEAFISYPHSPVKVMIIPTDEEVMIARDVVRL                          393
```

A related DNA sequence was identified in *S. pyogenes* <SEQ ID 407> which encodes the amino acid sequence <SEQ ID 408>. Analysis of this protein sequence reveals the following:

```
Possible site: 28
>>> Seems to have no N-terminal signal sequence
INTEGRAL Likelihood = -0.22 Transmembrane 63-79 (63-79)

----- Final Results -----
         bacterial membrane --- Certainty = 0.1086 (Affirmative) < succ>
         bacterial outside  --- Certainty = 0.0000 (Not Clear)   < succ>
         bacterial cytoplasm --- Certainty = 0.0000 (Not Clear)  < succ>
```

The protein has homology with the following sequences in the databases:

```
>GP: AAC36857 GB: L17320 acetate kinase [Bacillus subtilis]
Identities = 218/395 (55%), Positives = 293/395 (73%), Gaps = 3/395 (0%)

Query:   1 MSKTIAINAGSSSLKWQLYQMPEEAVLAQGIIERIGLKDSISTVKYDGKKEEQILDIHDH    60
           MSK IAINAGSSSLK+QL++MP E VL +G++ERIG+ DS+ T+  +G+K  ++ DI DH
Sbjct:   1 MSKIIAINAGSSSLKFQLFEMPSETVLTKGLVERIGIADSVFTISVNGEKNTEVTDIPDH    60

Query:  61 TEAVKILLNDLIHFGIIAAYDEITGVGHRVVAGGELFKESVVVNDKVLEQIEELSVLAPL   120
              AVK+LLN L   FGII   +EI G+GHRVV GGE F +SV++ D+ +++IE++S LAPL
Sbjct:  61 AVAVKMLLNKLTEFGIIKDLNEIDGIGHRVVHGGEKFSDSVLLTDETIKEIEDISELAPL   120

Query: 121 HNPGAAAGIRAFRDILPDITSVCVFDTSFHTSMAKHTYLYPIPQKYYTDYKVRKYGAHGT   180
           HNP    GI+AF+++LP++ +V VFDT+FH +M + +YLY +P +YY  + +RKYG HGT
Sbjct: 121 HNPANIVGIKAFKEVLPNVPAVAVFDTAFHQTMPEQSYLYSLPYEYYEKFGIRKYGFHGT   180

Query: 181 SHKYVAQEAAKMLGRPLEELKLITAHIGNGVSITANYHGKSVDTSMGFTPLAGPMMGTRS   240
           SHKYV + AA++LGRPL++L+LI+ H+GNG SI A   GKS+DTSMGFTPLAG  MGTRS
Sbjct: 181 SHKYVTERAAELLGRPLKDLRLISCHLGNGASIAAVEGGKSIDTSMGFTPLAGVAMGTRS   240

Query: 241 GDIDPAIIPYLIEQDPELKDAADVVNMLNKKSGLSGVSGISSDMRDIEAGLQEDNPDAVL   300
           G+IDPA+IPY++E+   D  +V+N LNKKSGL G+SG SSD+RDI    +E N   A
Sbjct: 241 GNIDPALIPYIMEKTGQTAD--EVLNTLNKKSGLLGISGFSSDLRDIVEATKEGNERAET   298

Query: 301 AYNIFIDRIKKCIGQYFAVLNGADALVFTAGMGENAPLMRQDVIGGLTWFGMDIDPE-KN   359
           A  +F  RI K  IG Y A ++G DA++FTAG+GEN+  +R+ V+ GL + G+  DP   N
Sbjct: 299 ALEVFASRIHKYIGSYAARMSGVDAIIFTAGIGENSVEVRERVLRGLEFMGVYWDPALNN   358

Query: 360 VFGYRGDISTPESKVKVLVISTDEELCIARDVERL                            394
            V G   IS P S VKV++I TDEE+ IARDV RL
Sbjct: 359 VRGEEAFISYPHSPVKVMIIPTDEEVMIARDVVRL                            393
```

An alignment of the GAS and GBS proteins is shown below:

```
Identities = 332/395 (84%), Positives = 365/395 (92%)

Query:   1 MSKTIAINAGSSSLKWQLYEMPEEKVVAKGIIERIGLKDSISTVKFDDKKDEQILDIVDH    60
           MSKTIAINAGSSSLKWQLY+MPEE V+A+GIIERIGLKDSISTVK+D KK+EQILDI DH
Sbjct:   1 MSKTIAINAGSSSLKWQLYQMPEEAVLAQGIIERIGLKDSISTVKYDGKKEEQILDIHDH    60

Query:  61 TQAVKILLEDLTKHGIIKDFNEITGVGHRVVAGGEYFKESALVDDKVVEQVEELSALAPL   120
           T+AVKILL DL   GII  ++EITGVGHRVVAGGE FKES +V+DKV EQ+EELS LAPL
Sbjct:  61 TEAVKILLNDLIHFGIIAAYDEITGVGHRVVAGGELFKESVVVNDKVLEQIEELSVLAPL   120

Query: 121 HNPAAAAGIRAFREILPDITSVCVFDTAFHTTMQPHTYLYPIPQKYYTDYKVRKYGAHGT   180
           HNP AAAGIRAFR+ILPDITSVCVFDT+FHT+M  HTYLYPIPQKYYTDYKVRKYGAHGT
Sbjct: 121 HNPGAAAGIRAFRDILPDITSVCVFDTSFHTSMAKHTYLYPIPQKYYTDYKVRKYGAHGT   180

Query: 181 SHQYVAQEAAKQLGRPLEELKLITAHVGNGVSITANYHGQSIDTSMGFTPLAGPMMGTRS   240
           SH+YVAQEAAK LGRPLEELKLITAH+GNGVSITANYHG+S+DTSMGFTPLAGPMMGTRS
Sbjct: 181 SHKYVAQEAAKMLGRPLEELKLITAHIGNGVSITANYHGKSVDTSMGFTPLAGPMMGTRS   240

Query: 241 GDIDPAIIPYLVANDPELEDAAAVVNMLNKQSGLLGVSGTSSDMRDIEAGLQSKDPNAVL   300
           GDIDPAIIPYL+  DPEL+DAA VVNMLNK+SGL GVSG SSDMRDIEAGLQ  +P+AVL
Sbjct: 241 GDIDPAIIPYLIEQDPELKDAADVVNMLNKKSGLSGVSGISSDMRDIEAGLQEDNPDAVL   300

Query: 301 AYNVFIDRIKKFIGQYLAVLNGADAIIFTAGMGENAPLMRQDVIAGLSWFGIELDPEKNV   360
           AYN+FIDRIKK IGQY AVLNGADA++FTAGMGENAPLMRQDVI GL+WFG+++DPEKNV
```

```
                                    -continued
Sbjct: 301 AYNIFIDRIKKCIGQYFAVLNGADALVFTAGMGENAPLMRQDVIGGLTWFGMDIDPEKNV 360

Query: 361 FGYFGDITKPDSKVKVLVIPTDEELMIARDVERLK                            395
           FGY GDI+ P+SKVKVLVI TDEEL IARDVERLK
Sbjct: 361 FGYRGDISTPESKVKVLVISTDEELCIARDVERLK                            395
```

Based on this analysis, it was predicted that these proteins and their epitopes could be useful antigens for vaccines or diagnostics.

EXAMPLE 121

A DNA sequence (GBSx0126) was identified in *S. agalactiae* <SEQ ID 409> which encodes the amino acid sequence <SEQ ID 410>. This protein is predicted to be repressor protein. Analysis of this protein sequence reveals the following:

```
Possible site: 17
>>> Seems to have an uncleavable N-term signal seq

----- Final Results -----
              bacterial membrane --- Certainty = 0.0000(Not Clear) < succ>
              bacterial outside  --- Certainty = 0.0000(Not Clear) < succ>
              bacterial cytoplasm --- Certainty = 0.0000(Not Clear) < succ>
```

The protein has homology with the following sequences in the GENPEPT database:

```
>GP: CAB49550 GB: AJ248284 repressor protein, putative [Pyrococcus
abyssi]
Identities = 39/64 (60%), Positives = 49/64 (75%)

Query:  1 MKNSLQKLRKSRKLSQAELAVALGVTRQTIISLEKEKYTASLELAFKIARYFDKQIEEVF  60
          MKN L++ R+   L+Q ELA  LGVTRQTII++EK KY  SL LAFKIAR+F  +IE++F
Sbjct:  1 MKNRLREFREKYGLTQEELARILGVTRQTIIAIEKGKYDPSLRLAFKIARFFGVRIEDIF  60

Query: 61 IYTE  64
          IY E
Sbjct: 61 IYEE  64
```

A related DNA sequence was identified in *S. pyogenes* <SEQ ID 411> which encodes the amino acid sequence <SEQ ID 412>. Analysis of this protein sequence reveals the following:

```
Possible site: 40
>>> Seems to have no N-terminal signal sequence

----- Final Results -----
              bacterial cytoplasm --- Certainty = 0.4344(Affirmative) < succ>
              bacterial membrane  --- Certainty = 0.0000(Not Clear)   < succ>
              bacterial outside   --- Certainty = 0.0000(Not Clear)   < succ>
```

An alignment of the GAS and GBS proteins is shown below:

```
Identities = 29/66 (43%), Positives = 44/66 (65%)

Query:  1 MKNSLQKLRKSRKLSQAELAVALGVTRQTIISLEKEKYTASLELAFKIARYFDKQIEEVF  60
          +KN L++LR   ++Q E+A   GV+RQTI  +E+ +YT S+ +A KIA+ F + +EEVF
Sbjct: 10 LKNRLKELRARDGINQTEMAKLAGVSRQTISLIERNEYTPSVIIAMKIAKVFQEPVEEVF  69

Query: 61 IYTESE  66
           E E
Sbjct: 70 RLVEVE  75
```

Based on this analysis, it was predicted that these proteins and their epitopes could be useful antigens for vaccines or diagnostics.

EXAMPLE 122

A DNA sequence (GBSx0127) was identified in *S. agalactiae* <SEQ ID 413> which encodes the amino acid sequence <SEQ ID 414>. Analysis of this protein sequence reveals the following:

```
Possible site: 32
>>> Seems to have an uncleavable N-term signal seq
     INTEGRAL    Likelihood = -8.97    Transmembrane    45-61  (41-66)
     INTEGRAL    Likelihood = -8.65    Transmembrane    14-30  (11-37)
     INTEGRAL    Likelihood = -7.80    Transmembrane   123-139 (118-145)
     INTEGRAL    Likelihood = -3.24    Transmembrane   177-193 (177-194)
     INTEGRAL    Likelihood = -0.85    Transmembrane    81-97  (81-97)

----- Final Results -----
            bacterial membrane --- Certainty = 0.4588(Affirmative) < succ>
             bacterial outside --- Certainty = 0.0000(Not Clear)   < succ>
           bacterial cytoplasm --- Certainty = 0.0000(Not Clear)   < succ>
```

A related GBS nucleic acid sequence <SEQ ID 9491> which encodes amino acid sequence <SEQ ID 9492> was also identified.

The protein has homology with the following sequences in the GENPEPT database:

```
>GP: BAA11325 GB: D78257 ORF8 [Enterococcus faecalis]
Identities = 48/120 (40%), Positives = 69/120 (57%), Gaps = 5/120 (4%)

Query: 104 MQGVKDTANQTVIMELTKQLPLALMLIFAIIGAPIMEEIIFRYIIPKELFAKHQKWGFVI  163
           MQG  TAN + +++L   +   L+++   I APIMEEI+FR  I   L   +    +I
Sbjct:   1 MQGHTTTANDSTLIKLFSGVSPVLVVLLLGIAAPIMEEIVFRGGIIGYLVENNALLAILI   60

Query: 164 GTLAFALIHSPSDIGSFIIYAGMGAILSFVYYKTEHLEYSIMIHFINN-----ALAYSVL  218
            + F +IH P++  SF +Y  MG ILS  YYKT+ L  SI IHF+NN     A+AY ++
Sbjct:  61 SSFLFGIIHGPTNFISFGMYFFMGIILSVSYYKTKDLRVSISIHFLNNLFPAIAIAYGLI  120
```

A related DNA sequence was identified in *S. pyogenes* <SEQ ID 415> which encodes the amino acid sequence <SEQ ID 416>. Analysis of this protein sequence reveals the following:

```
Possible site: 24
>>> Seems to have an uncleavable N-term signal seq
     INTEGRAL    Likelihood = -11.41   Transmembrane    12-28  (1-30)
     INTEGRAL    Likelihood =  -9.98   Transmembrane    41-57  (33-64)
     INTEGRAL    Likelihood =  -8.33   Transmembrane   128-144 (121-151)
     INTEGRAL    Likelihood =  -7.96   Transmembrane    83-99  (76-103)
     INTEGRAL    Likelihood =  -3.77   Transmembrane   208-224 (207-230)
     INTEGRAL    Likelihood =  -2.13   Transmembrane   182-198 (182-199)

----- Final Results -----
            bacterial membrane --- Certainty = 0.5564(Affirmative) < succ>
             bacterial outside --- Certainty = 0.0000(Not Clear)   < succ>
           bacterial cytoplasm --- Certainty = 0.0000(Not Clear)   < succ>
```

The protein has homology with the following sequences in the databases:

```
>GP: BAA11325 GB: D78257 ORF8 [Enterococcus faecalis]
Identities = 47/120 (39%), Positives = 70/120 (58%), Gaps = 8/120 (6%)

Query: 105 GQQVSANDAAIHTLARLIKGGFPLYTALFVLVIAFIAPIMEELVFRGFPMIDLFKGKSLK  164
           G   +AND+   TL +L  G P+   L VL++    APIMEE+VFRG + L + +L
Sbjct:   3 GHTTTANDS---TLIKLFSGVSPV---LVVLLLGIAAPIMEEIVFRGGIIGYLVENNAL-   55
```

-continued

```
Query: 165 VAGLVTSLVFALPHA-TNSVEFIMYSCMGIFLFVAYQRRGNLKDAILLHIFNNLIEVILL 223
            +A L++S +F + H  TN + F MY  MGI L V+Y +  +L+ +I +H NNL  I +
Sbjct:  56 LAILISSFLFGIIHGPTNFISFGMYFFMGIILSVSYYKTKDLRVSISIHFLNNLFPAIAI 115
```

An alignment of the GAS and GBS proteins is shown below:

```
Identities = 72/229 (31%), Positives = 114/229 (49%), Gaps = 24/229 (10%)

Query:  11 KGKILALLIAFLVINQLV-PILAVWLLKNHYQTPFTSILLIGL-------ELLIIALFLY  62
           KG I  L IA L+I +V +L + LL+ + P       IG+         +LI+   LY
Sbjct:   2 KGFINYLKIAVLIILAMVFNVLPMILLQKQHDIPMVLNWGIGIFYLVIVGSVLIVLWGLY  61

Query:  63 YAKVKQIIRWKALLTRKALVT---ILLGWLSLRVPQIIGYLIMTM-QGVKDTANQTVIME 118
           AK      I+ + +     LV    + L WL +RV  I+G L+  +  G + +AN   I
Sbjct:  62 QAKQDTFIKQQKM----RLVDWGYLALFWLIIRVIAIVGTLVNQLWSGQQVSANDAAIHT 117

Query: 119 LTKQL----PLALMLIFAIIG--APIMEEIIFRYIIPKELF-AKHQKWGFVIGTLAFALI 171
           L + +     PL   L  +I   APIMEE++FR     +LF  K     K  ++ +L FAL
Sbjct: 118 LARLIKGGFPLYTALFVLVIAFIAPIMEELVFRGFPMIDLFKGKSLKVAGLVTSLVFALP 177

Query: 172 HSPSDIGSFIIYAGMGAILSFVYYKTEHLEYSIMIHFINNALAYSVLIS            220
           H+ + +   FI+Y+ MG  L   Y +  +L+ +I++H  NN +    +L+S
Sbjct: 178 HATNSV-EFIMYSCMGIFLFVAYQRRGNLKDAILLHIFNNLIEVILLMS            225
```

Based on this analysis, it was predicted that these proteins and their epitopes could be useful antigens for vaccines or diagnostics.

EXAMPLE 123

A DNA sequence (GBSx0128) was identified in *S. agalactiae* <SEQ ID 417> which encodes the amino acid sequence <SEQ ID 418>. Analysis of this protein sequence reveals the following:

```
Possible site: 14
>>> Seems to have no N-terminal signal sequence

----- Final Results -----
            bacterial cytoplasm --- Certainty = 0.0826(Affirmative) < succ>
            bacterial membrane --- Certainty = 0.0000(Not Clear)   < succ>
             bacterial outside --- Certainty = 0.0000(Not Clear)   < succ>
```

The protein has homology with the following sequences in the GENPEPT database:

```
>GP: AAC06504 GB: AE000676 pyrroline carboxylate reductase [Aquifex
aeolicus]
Identities = 97/259 (37%), Positives = 159/259 (60%), Gaps = 4/259 (1%)

Query:   1 MKIGIIGVGKM--ASAIIQGLKQTQHDIIISGSCLERSKEIAERLDVTYAESHQSLINQA  58
           M++GI+G G M  A A+    K  +II++    E+ + +A  + +A    + L + +
Sbjct:   8 MRVGIVGFGNMGQAFALCFSKKLGKENIIVTDKVQEK-RNLATEMGIAFASDVKFLADNS  66

Query:  59 DIIMLGIKPQLFEKVLLPLDITKPII-SMAAGISLARLSQLTRSDLPLIRIMPNINAQIL 117
           D++++ +KP+   ++VL L  K II S+ AG+S+ ++ +     D ++R+MPN+N  +
Sbjct:  67 DVVLVAVKPKDSQEVLQKLKDYKGIILSIMAGVSIEKMEKILGKDKKIVRVMPNVNVAVG 126

Query: 118 QSCTAICYNNHVSDELRQLAKEITDSFGSSFDIAETNFDTFTALAGSSPAYIYLFIEALA 177
              AI   N ++S+E R    +E+   S G+ + I E   FD FTALAGS PA+++ FI+ALA
Sbjct: 127 SGVMAITDNGNLSEEERSKVEELLLSCGTLYRIEERLFDAFTALAGSGPAFVFSFIDALA 186

Query: 178 KAGVKYGFPKEQALSIVGQTVLASSQNLLQGQNSTSDLIDNICSPGGTTIAGLLDLEKNG 237
            AGV  GF   EQAL I   TV+ S++  L Q +  ++LI +  SPGGTTI G+  LE+ G
Sbjct: 187 LAGVHQGFSYEQALRIALDTVMGSAKLLKEFQVNPNELIAKVTSPGGTTIEGIKYLEEKG 246

Query: 238 LTHSVISAIDATIEKAKKL                                          256
              +V+  I+  T +KAKKL
Sbjct: 247 FKGTVMECINRTSQKAKKL                                          265
```

A related DNA sequence was identified in *S. pyogenes* <SEQ ID 419> which encodes the amino acid sequence <SEQ ID 420>. Analysis of this protein sequence reveals the following:

```
Possible site: 50
>>> Seems to have no N-terminal signal sequence

----- Final Results -----
             bacterial cytoplasm --- Certainty = 0.1043(Affirmative) < succ>
              bacterial membrane --- Certainty = 0.0000(Not Clear)   < succ>
               bacterial outside --- Certainty = 0.0000(Not Clear)   < succ>
```

An alignment of the GAS and GBS proteins is shown below:

```
Identities = 180/256 (70%), Positives = 208/256 (80%)

Query:    1 MKIGIIGVGKMASAIIQGLKQTQHDIIISGSCLERSKEIAERLDVTYAESHQSLINQADI   60
            MKIGIIGVGKMASAII+GLKQT H++IISGS LERSKEIAE+L + YA SHQ LI+Q D+
Sbjct:    1 MKIGIIGVGKMASAIIKGLKQTPHELIISGSSLERSKEIAEQLALPYAMSHQDLIDQVDL   60

Query:   61 IMLGIKPQLFEKVLLPLDITKPIISMAAGISLARLSQLTRSDLPLIRIMPNINAQILQSC  120
            ++LGIKPQLFE VL PL  +PIISMAAGISL RL+     DLPL+RIMPN+NAQILQS
Sbjct:   61 VILGIKPQLFETVLKPLHFKQPIISMAAGISLQRLATFVGQDLPLLRIMPNMNAQILQSS  120

Query:  121 TAICYNNHVSDELRQLAKEITDSFGSSFDIAETNFDTFTALAGSSPAYIYLFIEALAKAG  180
            TA+  N  VS EL+   +++TDSFGS+FDI+E +FDTFTALAGSSPAYIYLFIEALAKAG
Sbjct:  121 TALTGNALVSQELQARVRDLTDSFGSTFDISEKDFDTFTALAGSSPAYIYLFIEALAKAG  180

Query:  181 VKYGFPKEQALSIVGQTVLASSQNLLQGQNSTSDLIDNICSPGGTTIAGLLDLEKNGLTH  240
            VK G PK +AL IV QTVLAS+ NL    S  D ID ICSPGGTTIAGL++LE+ GLT
Sbjct:  181 VKNGIPKAKALEIVTQTVLASASNLKTSSQSPHDFIDAICSPGGTTIAGLMELERLGLTA  240

Query:  241 SVISAIDATIEKAKKL                                              256
            +V SAID TI+KAK L
Sbjct:  241 TVSSAIDKTIDKAKSL                                              256
```

Based on this analysis, it was predicted that these proteins and their epitopes could be useful antigens for vaccines or diagnostics.

EXAMPLE 124

A DNA sequence (GBSx0129) was identified in *S. agalactiae* <SEQ ID 421> which encodes the amino acid sequence <SEQ ID 422>. Analysis of this protein sequence reveals the following:

```
Possible site: 58
>>> Seems to have no N-terminal signal sequence

----- Final Results -----
             bacterial cytoplasm --- Certainty = 0.3405(Affirmative) < succ>
              bacterial membrane --- Certainty = 0.0000(Not Clear)   < succ>
               bacterial outside --- Certainty = 0.0000(Not Clear)   < succ>
```

The protein has homology with the following sequences in the GENPEPT database:

```
>GP:CAA56994 GB:X81089 glutamyl-aminopeptidase [Lactococcus lactis]
Identities = 219/354 (61%), Positives = 273/354 (76%), Gaps = 1/354 (0%)

Query:    3 DLFNKIKTVTELDGIAGYEHNIRNFLRQEITPLVDQVETDGLGGIFGVKNTHETNAPKVM   62
            +LF+K+K +TE+   +G+E  +R++L+   +   L  Q E DGLGGIF  K +   NAP++M
Sbjct:    2 ELFDKVKALTEIQATSGFEGPVRDYLKARMVELGYQPEFDGLGGIFVTKASKVENAPRIM   61

Query:   63 VAAHMDEVGFMVSHIQPDGTFRVLEVGGWNPLVVSSQRFTLYTRSGDAIPVISGSVPPHF  122
            VAAHMDEVGFMVS I+  DGTFRV+ +GGWNPLVVS QRFTL+TR+G  IPV++G +PPH
Sbjct:   62 VAAHMDEVGFMVSSIKADGTFRVVPLGGWNPLVVSGQRFTLFTRTGKKIPVVTGGLPPHL  121
```

```
Query:  123 LRGQSGGTTLPKISDIVFDGGFTDKNEAESFGIAPGDIIVPKSETILTANQKHIMSKAWD 182
            LRG     +P ISDI+FDG F +  KA  FGIA GD+I+P++ETIL+AN K+I+SKAWD
Sbjct:  122 LRGTGVTPQIPAISDIIFDGAFENAAEAAEFGIAQGDLIIPETETILSANGKNIISKAWD 181

Query:  183 NRYGVLMVTELLKSLKDQSLSNTLIAGANVQEEVGLRGAHVSTTKFNPDIFLAVDCSPAG 242
            NRYG LM+ ELL+ L D+ L  TLI GANVQEEVGLRGA VSTTKFNPD+F AVDCSPA
Sbjct:  182 NRYGCLMILELLEFLADKELPVTLIIGANVQEEVGLRGAKVSTTKFNPDLFFAVDCSPAS 241

Query:  243 DIYG-EQGKIGEGTLIRFYDPGHIMLKDMRDFLLTTAEEAGIKYQYYAANGGTDAGAAHL 301
            D +G + G++GEGT +RF+DPGHIML  M++FLL TA  A +K Q Y A GGTDAGAAHL
Sbjct:  242 DTFGDDNGRLGEGTTLRFFDPGHIMLPGMKNFLLDTANHAKVKTQVYMAKGGTDAGAAHL 301

Query:  302 KNSGIPSTTIGVCARYIHSHQTLYAMDDFLQAQAYLQAIVNKLDRSTVDIIKGY        355
             N G+PSTTIGV ARYIHSHQT++ +DDFLQAQ +L+AI+  L+     V  IK Y
Sbjct:  302 ANGGVPSTTIGVVARYIHSHQTIFNIDDFLQAQTFLRAIITSLNTEKVAEIKNY        355
```

A related DNA sequence was identified in *S. pyogenes* <SEQ ID 423> which encodes the amino acid sequence <SEQ ID 424>. Analysis of this protein sequence reveals the following:

```
Possible site: 55
>>> Seems to have no N-terminal signal sequence

----- Final Results -----
        bacterial cytoplasm --- Certainty = 0.2747(Affirmative) < succ>
         bacterial membrane --- Certainty = 0.0000(Not Clear)  < succ>
          bacterial outside --- Certainty = 0.0000(Not Clear)  < succ>
```

An alignment of the GAS and GBS proteins is shown below:

```
Identities = 276/355 (77%), Positives = 322/355 (89%)

Query:    1 MSDLFNKIKTVTELDGIAGYEHNIRNFLRQEITPLVDQVETDGLGGIFGVKNTHETNAPK  60
            M+DLF+KIK VTELDGIAGYEH++R++LR +ITPLVD+VETDGLGGIFG++++    AP+
Sbjct:    1 MTDLFSKIKEVTELDGIAGYEHSVRDYLRTKITPLVDRVETDGLGGIFGIRDSKAEKAPR  60

Query:   61 VMVAAHMDEVGFMVSHIQPDGTFRVLEVGGWNPLVVSSQRFTLYTRSGDAIPVISGSVPP 120
            ++VAAHMDEVGFMVS I+ DGT RV+ +GGWNPLVVSSQRFTLYTR+G  IP+ISGSVPP
Sbjct:   61 ILVAAHMDEVGFMVSDIKVDGTLRVVGIGGWNPLVVSSQRFTLYTRTGQVIPLISGSVPP 120

Query:  121 HFLRGQSGGTTLPKISDIVFDGGFTDKNEAESFGIAPGDIIVPKSETILTANQKHIMSKA 180
            HFLRG +G   +LP I DIVFDGGFTDK  EAE FGI PGDII+P+SETILTANQK+I+SKA
Sbjct:  121 HFLRGANGSASLPHIEDIVFDGGFTDKAEAERFGITPGDIIIPQSETILTANQKNIISKA 180

Query:  181 WDNRYGVLMVTELLKSLKDQSLSNTLIAGANVQEEVGLRGAHVSTTKFNPDIFLAVDCSP 240
            WDNRYGVLM+TE+L++LK Q L+NTLIAGANVQEEVGLRGAHVSTTKF+P++F AVDCSP
Sbjct:  181 WDNRYGVLMITEMLEALKGQDLNNTLIAGANVQEEVGLRGAHVSTTKFDPELFFAVDCSP 240

Query:  241 AGDIYGEQGKIGEGTLIRFYDPGHIMLKDMRDFLLTTAEEAGIKYQYYAANGGTDAGAAH 300
            AGDIYG  G  IG+GTL+RFYDPGH+MLKDMRDFLLTTAEEAG+ +QYY   GGTDAGAAH
Sbjct:  241 AGDIYGNPGTIGDGTLLRFYDPGHVMLKDMRDFLLTTAEEAGVNFQYYCGKGGTDAGAAH 300

Query:  301 LKNSGIPSTTIGVCARYIHSHQTLYAMDDFLQAQAYLQAIVNKLDRSTVDIIKGY       355
            L+N G+PSTTIGVCARYIHSHQTLYAMDDF++AQA+LQAI+  KLDRSTVD+IK Y
Sbjct:  301 LQNGGVPSTTIGVCARYIHSHQTLYAMDDFVEAQAFLQAIIKKLDRSTVDLIKCY       355
```

Based on this analysis, it was predicted that these proteins and their epitopes could be useful antigens for vaccines or diagnostics.

EXAMPLE 125

A DNA sequence (GBSx0130) was identified in *S. agalactiae* <SEQ ID 425> which encodes the amino acid sequence <SEQ ID 426>. Analysis of this protein sequence reveals the following:

```
Possible site: 26
>>> Seems to have no N-terminal signal sequence

----- Final Results -----
            bacterial cytoplasm --- Certainty = 0.1672(Affirmative) < succ>
             bacterial membrane --- Certainty = 0.0000(Not Clear)   < succ>
              bacterial outside --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 126

A DNA sequence (GBSx0131) was identified in *S. agalactiae* <SEQ ID 427> which encodes the amino acid sequence <SEQ ID 428>. Analysis of this protein sequence reveals the following:

```
Possible site: 31
>>> Seems to have no N-terminal signal sequence
      INTEGRAL    Likelihood = -2.28      Transmembrane    18-34 (17-34)

----- Final Results -----
             bacterial membrane --- Certainty = 0.1914(Affirmative) < succ>
              bacterial outside --- Certainty = 0.0000(Not Clear)   < succ>
            bacterial cytoplasm --- Certainty = 0.0000(Not Clear)   < succ>
```

The protein has no significant homology with any sequences in the GENPEPT database.

A related DNA sequence was identified in *S. pyogenes* <SEQ ID 429> which encodes the amino acid sequence <SEQ ID 430>. Analysis of this protein sequence reveals the following:

```
Possible site: 21
>>> Seems to have an uncleavable N-term signal seq
      INTEGRAL    Likelihood = -6.16      Transmembrane    12-28 (8-30)

----- Final Results -----
             bacterial membrane --- Certainty = 0.3463(Affirmative) < succ>
              bacterial outside --- Certainty = 0.0000(Not Clear)   < succ>
            bacterial cytoplasm --- Certainty = 0.0000(Not Clear)   < succ>
```

The protein has no significant homology with any sequences in the GENPEPT database.

An alignment of the GAS and GBS proteins is shown below:

```
Identities = 30/91 (32%), Positives = 48/91 (51%)

Query:  13 MKNKKILFGTGLAGVGLLAAAGYTLTKKVTDYKRQQITQTLREFFSQMGDIQVFYFNEFE     72
           M  KKI   +G+ G  L    G  +       D +R+Q+T+ LR FFS +G I+V Y N  +
Sbjct:   4 MSKKKIGMISGIFGFSLAIGLGIVIKDYCQDRQRRQMTRDLRTFFSPLGQIEVLYINPCQ     63

Query:  73 SDIKMTSGGLVLEDGRIFEFIYRQGVLDYVE                                  103
              SGG+V+ +G+ ++F Y   + + E
Sbjct:  64 VKQDYISGGVVMSNGKQYQFTYHSRQISFEE                                   94
```

A related GBS gene <SEQ ID 8497> and protein <SEQ ID 8498> were also identified. Analysis of this protein sequence reveals the following:

```
Lipop Possible site: -1 Crend: 4
SRCFLG: 0
McG: Length of UR: 21
     Peak Value of UR: 2.30
     Net Charge of CR: 3
McG: Discrim Score: 6.28
GvH: Signal Score (-7.5): -1.46
     Possible site: 19
>>> Seems to have a cleavable N-term signal seq.
Amino Acid Composition: calculated from 20
ALOM program count: 0 value: 22.60 threshold: 0.0
   PERIPHERAL Likelihood = 22.60 29
modified ALOM score: -5.02
*** Reasoning Step: 3
Rule gpo1

----- Final Results -----
            bacterial outside --- Certainty = 0.3000(Affirmative) < succ>
            bacterial membrane --- Certainty = 0.0000(Not Clear) < succ>
           bacterial cytoplasm --- Certainty = 0.0000(Not Clear) < succ>
```

Figure 40:
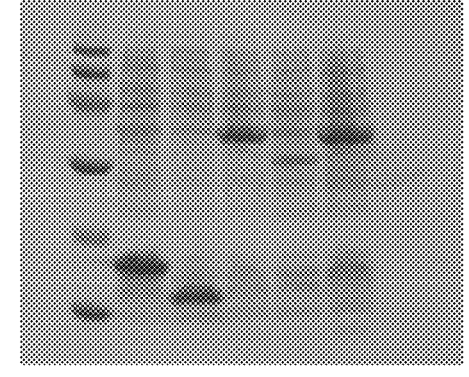
Figure 46:
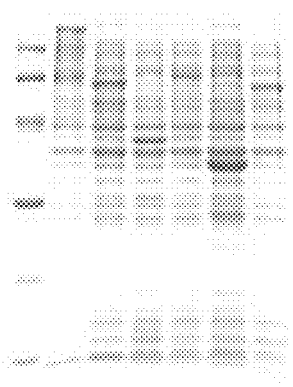

SEQ ID 8498 (GBS214) was expressed in *E. coli* as a His-fusion product. SDS-PAGE analysis of total cell extract is shown in FIG. 40 (lane 3; MW 13.9 kDa). It was also expressed in *E. coli* as a GST-fusion product. SDS-PAGE analysis of total cell extract is shown in FIG. 46 (lane 6; MW 39 kDa).

Based on this analysis, it was predicted that these proteins and their epitopes could be useful antigens for vaccines or diagnostics.

EXAMPLE 127

A DNA sequence (GBSx0132) was identified in *S. agalactiae* <SEQ ID 431> which encodes the amino acid sequence <SEQ ID 432>. This protein is predicted to be thioredoxin H1 (trxA). Analysis of this protein sequence reveals the following:

```
Possible site: 40
>>> Seems to have no N-terminal signal sequence

----- Final Results -----
           bacterial cytoplasm --- Certainty = 0.2350(Affirmative) < succ>
            bacterial membrane --- Certainty = 0.0000(Not Clear) < succ>
             bacterial outside --- Certainty = 0.0000(Not Clear) < succ>
```

The protein has homology with the following sequences in the GENPEPT database:

```
>GP:BAB06972 GB:AP001518 thioredoxin H1 [Bacillus halodurans]
Identities = 47/90 (52%), Positives = 66/90 (73%)

Query:  14 IDSTKKVVFFFTADWCPDCQFIYPVMPSIEKDFSDFVFVRVNRDDYIELAQQWNIFGIPS  73
           + + + VVF F+ADWCPDC+ I P +P +E+ + ++ F  VNRDD+IEL Q+ +IFGIPS
Sbjct:  13 VKNQENVVFLFSADWCPDCRVIEPFLPELEQTYDEYQFYYVNRDDFIELCQELDIFGIPS  72

Query:  74 FVVVENGQELGRLVNKNRKTKAEITKFLAE  103
           F+   NG+E  R V+K+RKTK EI +FL E
Sbjct:  73 FLFYSNGEERSRFVSKDRKTKEEIERFLTE  102
```

A related DNA sequence was identified in *S. pyogenes* <SEQ ID 433> which encodes the amino acid sequence <SEQ ID 434>. Analysis of this protein sequence reveals the following:

```
Possible site: 35
>>> Seems to have no N-terminal signal sequence

----- Final Results -----
           bacterial cytoplasm --- Certainty = 0.1997(Affirmative) < succ>
            bacterial membrane --- Certainty = 0.0000(Not Clear) < succ>
             bacterial outside --- Certainty = 0.0000(Not Clear) < succ>
```

An alignment of the GAS and GBS proteins is shown below:

```
Identities = 70/102 (68%), Positives = 81/102 (78%)

Query:   1 MILPESYEEIAAYIDSTKKVVFFFTADWCPDCQFIYPVMPSIEKDFSDFVFVRVNRDDYI   60
           MI P SYE +A  I+   K+V FFTADWCPDCQFIYP+MP IE + +D  FV VNRD +I
Sbjct:   1 MIRPTSYESLATLIEKEDKLVLFFTADWCPDCQFIYPIMPEIEAELTDMTFVCVNRDQFI   60

Query:  61 ELAQQWNIFGIPSFVVVENGQELGRLVNKNRKTKAEITKFLA                   102
           E+AQ+WNIFGIPSFVV+E GQE+GRLVNK RKTK EI   FLA
Sbjct:  61 EVAQKWNIFGIPSFVVIEKGQEVGRLVNKMRKTKTEIMHFLA                   102
```

Based on this analysis, it was predicted that these proteins and their epitopes could be useful antigens for vaccines or diagnostics.

EXAMPLE 128

A DNA sequence (GBSx0133) was identified in *S. agalactiae* <SEQ ID 435> which encodes the amino acid sequence <SEQ ID 436>. This protein is predicted to be phenylalanyl-tRNA synthetase beta subunit, non-spirochete. Analysis of this protein sequence reveals the following:

```
Possible site: 47
>>> Seems to have no N-terminal signal sequence

----- Final Results -----
             bacterial cytoplasm --- Certainty = 0.1310(Affirmative) < succ>
             bacterial membrane  --- Certainty = 0.0000(Not Clear)   < succ>
              bacterial outside  --- Certainty = 0.0000(Not Clear)   < succ>
```

The protein has homology with the following sequences in the GENPEPT database:

```
>GP:AAC00291 GB:AF008220 YtpR [Bacillus subtilis]
Identities = 78/196 (39%), Positives = 125/196 (62%), Gaps = 1/196 (0%)

Query:   5 YNREHVGDTLMVIVKDSQGAKLDVDRRGQVARVYLQDSKETVAWNIFEVSSLIVIEGAGQ    64
           YN+E VGDTL++ ++D    +L  ++ G V +++   ++KET  +NIF  SS + I+  G
Sbjct:   5 YNKEGVGDTLLISLQDVTREQLGYEKHGDVVKIFNNETKETTGFNIFNASSYLTIDENGP    64

Query:  65 ITLSDQDIKILNAELLKEGFEDSLVNNIEPTFVVAQIKEIIDHPDSDHLHICQAEINDGK   124
           + LS+   ++ +N    L + G E++LV ++  P FVV   ++       HP++D L +C+  + + +
Sbjct:  65 VALSETFVQDVNEILNRNGVEETLVVDLSPKFVVGYVESKEKHPNADKLSVCKVNVGE-E   123

Query: 125 TVQIVCGAPNASVGLKTVAALPGAMMPNGSLIFPGKLRGEDSFGMLCSARELALPNAPQV   184
           T+QIVCGAPN    G K V A  GA+MP+G +I    +LRG  S GM+CSA+EL LP+AP
Sbjct: 124 TLQIVCGAPNVDQGQKVVVAKVGAVMPSGLVIKDAELRGVPSSGMICSAKELDLPDAPAE   183

Query: 185 RGIIELSDQVIVGESF                                              200
           +GI+ L    G++F
Sbjct: 184 KGILVLEGDYEAGDAF                                              199
```

A related DNA sequence was identified in *S. pyogenes* <SEQ ID 437> which encodes the amino acid sequence <SEQ ID 438>. Analysis of this protein sequence reveals the following:

```
Possible site: 47
>>> Seems to have no N-terminal signal sequence
     INTEGRAL    Likelihood = -1.49    Transmembrane   90-106 (90-107)

----- Final Results -----
              bacterial membrane  --- Certainty = 0.1595(Affirmative) < succ>
               bacterial outside  --- Certainty = 0.0000(Not Clear)   < succ>
             bacterial cytoplasm  --- Certainty = 0.0000(Not Clear)   < succ>
```

The protein has homology with the following sequences in the databases:

```
>GP: BAB06970 GB: AP001518 phenylalanyl-tRNA synthetase (beta subunit)
[Bacillus halodurans]
Identities = 84/196 (42%), Positives = 124/196 (62%), Gaps = 1/196 (0%)

Query:     5 YNKEQVGDVLMVILQDTKDIKRQVERKGKVARVFAEESGKTLAWNIFEASSLITIEGNGQ    64
             YN++ +GD +++++ + +   R   ER+G V R++    +GKT  +N+F AS      G G
Sbjct:     5 YNEKGIGDTILIVIDEVEPANRAYERQGDVVRIYHLGTGKTTGYNLFHASKYGEFNGQGL   64

Query:    65 IFLTDENLARLNAELAKEGFSERLEPIVGPVFVVGQIVEMVAHPDSDHLNICQVAIGEDQ   124
             + LTD  +A L     K G +   LE  + P FVVG +        HP++D L+IC+V  +G D
Sbjct:    65 LELTDSLVATLEQAFQKNGVNWTLEVDLSPKFVVGFVQSKDKHPNADKLSICKVDVGSD-   123

Query:   125 TVQIVAGAPNAALGLKTIVALPGAIMPNGSLIFPGKLRGEESYGMMCSPRELALPNAPQK   184
             T+QIV GAPN   G K +VAL GA+MP+G +I P    LRG  S GM+CS +ELALP+AP++
Sbjct:   124 TLQIVCGAPNVEAGQKVVVALEGAVMPSGLVIKPTSLRGVSSTGMICSAKELALPDAPEE   183

Query:   185 RGIIEFDESAVVGEAF                                              200
             +GI+   D+S  VG +F
Sbjct:   184 KGILVLDDSYEVGTSF                                              199
```

An alignment of the GAS and GBS proteins is shown below:

```
Identities = 133/207 (64%), Positives = 167/207 (80%)

Query:     1 MIFTYNREHVGDTLMVIVKDSQGAKLDVDRRGQVARVYLQDSKETVAWNIFEVSSLIVIE    60
             MIF YN+E VGD LMVI++D++  K   V+R+G+VARV+ ++S +T+AWNIFE SSLI IE
Sbjct:     1 MIFAYNKEQVGDVLMVILQDTKDIKRQVERKGKVARVFAEESGKTLAWNIFEASSLITIE   60

Query:    61 GAGQITLSDQDIKILNAELLKEGFEDSLVNNIEPTFVVAQIKEIIDHPDSDHLHICQAEI   120
             G GQI L+D+++ LNAEL KEGF + L   + P FVV QI E++ HPDSDHL+ICQ  I
Sbjct:    61 GNGQIFLTDENLARLNAELAKEGFSERLEPIVGPVFVVGQIVEMVAHPDSDHLNICQVAI   120

Query:   121 NDGKTVQIVCGAPNASVGLKTVAALPGAMMPNGSLIFPGKLRGEDSFGMLCSARELALPN   180
             + +TVQIV GAPNA++GLKT+ ALPGA+MPNGSLIFPGKLRGE+S+GM+CS RELALPN
Sbjct:   121 GEDQTVQIVAGAPNAALGLKTIVALPGAIMPNGSLIFPGKLRGEESYGMMCSPRELALPN   180

Query:   181 APQVRGIIELSDQVIVGESFDANKHWK                                   207
             APQ RGIIE  + +VGE+FD  KHWK
Sbjct:   181 APQKRGIIEFDESAVVGEAFDPAKHWK                                   207
```

Based on this analysis, it was predicted that these proteins and their epitopes could be useful antigens for vaccines or diagnostics.

EXAMPLE 129

A DNA sequence (GBSx0135) was identified in *S. agalactiae* <SEQ ID 439> which encodes the amino acid sequence <SEQ ID 440>. Analysis of this protein sequence reveals the following:

```
Possible site: 30
>>> Seems to have no N-terminal signal sequence

----- Final Results -----
            bacterial cytoplasm --- Certainty = 0.3052(Affirmative) < succ>
            bacterial membrane  --- Certainty = 0.0000(Not Clear)  < succ>
            bacterial outside   --- Certainty = 0.0000(Not Clear)  < succ>
```

The protein has homology with the following sequences in the GENPEPT database:

```
>GP: AAB81904 GB: U92974 unknown [Lactococcus lactis]
Identities = 69/241 (28%), Positives = 117/241 (47%), Gaps = 15/241 (6%)

Query:     7 YKEMLAKPWGKIQYEITFAQL--SHIKNQNVLDFGAGFCLTEQHLAKEN-NVTAIEPNPK    63
             Y E+  KPWG++ Y++ F QL  +   K+ +L FG+GF  TE  L ++   VT EP+ +
Sbjct:    23 YAEVFEKPWGRMFYDLLFPQLLPNLTKDSKILSFGSGFGRTETFLEEQGFEVTGYEPDVE    82

Query:    64 LLYDNQSDNIYKILGSYEALRD-LPDQSFDTIICHNVLEYIDKHNHPAYFDEFSRLLKPN   122
             L          ++ G+++  + + ++ +D I+ HNVLEY+   +    +    LL
Sbjct:    83 KLEMMSDQTFRQLTGTFDDFAETVKNERYDVILIHNVLEYV--LDRKVVLELLLSLLTDG   140

Query:   123 GELSLIKHNITGKILQSVIFSNDTSTAMELLTGEANFKSASFDQGNIYT-----LEELKQ   177
             G LS++KH+ G +++       ++    A+++  EA    AS + G+I      L +
Sbjct:   141 GTLSIVKHSKYGSMIEMAAGRDNPQAALDVYENEA---VASHNHGDILVYDDDWLTDFVA   197

Query:   178 NTNLLVERYQGIRTFYSLQPN-HFKTETGWLNKMLAIELSVADKAPYKDIAFLQHITLKKS   237
             N  L ++   GIR FY +  N     K    W   ML +E  VA      +A L H+  KKS
Sbjct:   198 NYKLKLQEKFGIRHFYGISQNAEIKETENWYQPMLKLEQKVAKDQTLYPVARLHHLIFKKS   258
```

Based on this analysis, it was predicted that this protein and its epitopes, could be useful antigens for vaccines or diagnostics.

EXAMPLE 130

A DNA sequence (GBSx0136) was identified in *S. agalactiae* <SEQ ID 441> which encodes the amino acid sequence <SEQ ID 442>. Analysis of this protein sequence reveals the following:

```
Possible site: 58
>>> Seems to have no N-terminal signal sequence

----- Final Results -----
            bacterial cytoplasm --- Certainty = 0.3479(Affirmative) < succ>
            bacterial membrane  --- Certainty = 0.0000(Not Clear)   < succ>
             bacterial outside  --- Certainty = 0.0000(Not Clear)   < succ>
```

The protein has homology with the following sequences in the GENPEPT database:

```
>GP: AAF74079 GB: AF212845 putative single stranded binding protein
[Lactococcus lactis bacteriophage ul36]
Identities = 64/141 (45%), Positives = 92/141 (64%), Gaps = 10/141 (7%)

Query:     1 MYNKVIMIGRLTAKPEMVKTPTDKSVTRATVAVNRRFKGSNGEREADFINVVMWGRLAET    60
             M N V ++GR+T +PE+   TP +K+V  T+AVNR FK +NGEREADFI+ V+WG+ AE
Sbjct:     1 MINNVTLVGRITKEPELRYTPQNKAVATFTLAVNRAFKNANGEREADFISCVIWGKSAEN    60

Query:    61 LASYGTKGSLISIDGELRTRKYE-KDGQTHYITEVLASSFQLLESRAQ---------RAM   110
             LA++   KG LI + G ++TR YE + GQ   YITEV+AS+FQ+LE     Q              +
Sbjct:    61 LANWTHKGQLIGVIGNIQTRNYENQQGQRVYITEVVASNFQVLEKSNQANGERISNPASK   120

Query:   111 RENNVSGDLSDLVLEEEELPF                                          131
             +NN S     + + +++LPF
Sbjct:   121 PQNNDSFGSDPMEISDDDLPF                                          141
```

A related DNA sequence was identified in *S. pyogenes* <SEQ ID 443> which encodes the amino acid sequence <SEQ ID 444>. Analysis of this protein sequence reveals the following:

```
Possible site: 32
>>> Seems to have no N-terminal signal sequence

----- Final Results -----
            bacterial cytoplasm --- Certainty = 0.1817(Affirmative) < succ>
            bacterial membrane  --- Certainty = 0.0000(Not Clear)   < succ>
             bacterial outside  --- Certainty = 0.0000(Not Clear)   < succ>
```

An alignment of the GAS and GBS proteins is shown below:

```
Identities = 102/131 (77%), Positives = 116/131 (87%)

Query:    1 MYNKVIMIGRLTAKPEMVKTPTDKSVTRATVAVNRRFKGSNGEREADFINVVMWGRLAET   60
            MYNKVI IGRL AKPE+VKT TDK V R ++AVNRRFK ++GEREADFI+VV+WG+LAET
Sbjct:    1 MYNKVIAIGRLVAKPELVKTATDKHVARLSLAVNRRFKNASGEREADFISVVVWGKLAET   60

Query:   61 LASYGTKGSLISIDGELRTRKYEKDGQTHYITEVLASSFQLLESRAQRAMRENNVSGDLS  120
            L SY +KGSL+SIDGELRTRKY+KDGQ HY+TEVL  SFQLLESRAQRAMRENNV+ DL
Sbjct:   61 LVSYASKGSLMSIDGELRTRKYDKDGQVHYVTEVLCQSFQLLESRAQRAMRENNVTNDLV  120

Query:  121 DLVLEEEELPF                                                  131
            DLVLEE+ LPF
Sbjct:  121 DLVLEEDTLPF                                                  131
```

Based on this analysis, it was predicted that these proteins and their epitopes could be useful antigens for vaccines or diagnostics.

EXAMPLE 131

A DNA sequence (GBSx0037) was identified in *S. agalactiae* <SEQ ID 445> which encodes the amino acid sequence <SEQ ID 446>. Analysis of this protein sequence reveals the following:

```
Possible site: 49
>>> Seems to have no N-terminal signal sequence

----- Final Results -----
            bacterial cytoplasm --- Certainty = 0.2235(Affirmative) < succ>
            bacterial membrane  --- Certainty = 0.0000(Not Clear)   < succ>
            bacterial outside   --- Certainty = 0.0000(Not Clear)   < succ>
```

A related GBS nucleic acid sequence <SEQ ID 9493> which encodes amino acid sequence <SEQ ID 9494> was also identified.

The protein has homology with the following sequences in the GENPEPT database:

```
>GP: CAC13072 GB: AL445503 putative hydrolase [Streptomyces
coelicolor]
Identities = 63/179 (35%), Positives = 91/179 (50%), Gaps = 2/179 (1%)

Query:   33 IIFDMDGVIVDSEYTFLDNKTEMLREEGI-DTDVSYQYQYMGTTFEFMWQAMKEEFGLPK   91
            +IFD+DG +VDSE + +    L E G+ D   +    Y+G + +      K   +GL
Sbjct:   12 VIFDLDGTLVDSEPHYYEAGRRTLAEYGVPDFSWADHEAYVGISTQETVADWKRRYGLRA   71

Query:   92 TVKEYIAEMNRRRQAIVARDGVRPIKGAQRLIHWLHQHGYRLAVASSSPMVDIKRNLKEL  151
            TV+E +A  NR    + AR   R    ++ +   L   G  +AVAS S      I   L
Sbjct:   72 TVEELLAVKNRHYLGL-ARTSARAYPEMRKFVELLAGEGVPMAVASGSSPEAIAAILART  130

Query:  152 GVTECFEYMVTGEDVSSSKPAPDVFLRAAELLDVDPKVCIVIEDTRNGSLAAKAAGMYC   210
            G+       +V+ ++V+   KPAPDVFL AA  L  +P  C+V+ED    G+ AA AAGM C
Sbjct:  131 GLDAHLRTVVSADEVARGKPAPDVFLEAARRLGTEPARCVVLEDAAPGAAAAHAAGMRC   189
```

A related DNA sequence was identified in *S. pyogenes* <SEQ ID 447> which encodes the amino acid sequence <SEQ ID 448>. Analysis of this protein sequence reveals the following:

```
Possible site: 25
>>> Seems to have no N-terminal signal sequence

----- Final Results -----
            bacterial cytoplasm --- Certainty = 0.3706(Affirmative) < succ>
            bacterial membrane  --- Certainty = 0.0000(Not Clear)   < succ>
            bacterial outside   --- Certainty = 0.0000(Not Clear)   < succ>
```

An alignment of the GAS and GBS proteins is shown below:

```
Identities = 62/202 (30%), Positives = 100/202 (48%), Gaps = 1/202 (0%)

Query:  29 MEKVIIFDMDGVIVDSEYTFLDNKTEMLREEGIDTDVSYQYQYMGTTFEFMWQAMKEEFG   88
           M K IIFDMDGV+ D+E +L + + + +GI D       ++G   + +W+ + +
Sbjct:   3 MIKGIIFDMDGVLFDTEPFYLRRREDFFKTKGIPIDHLNSKDFIGGNLQELWKELLGKNR   62

Query:  89 LPKTVKEYIAEMNRRRQAIVARDGVRPIKGAQRLIHWLHQHGYRLAVASSSPMVDIKRNL  148
              VK   + +  +QA        I    +  L + G +LAVAS+S   D+    L
Sbjct:  63 DDAIVKAITTDYDAYKQAHKPPYQKLLITEVNSCLEQLEKQGIKLAVASNSKRQDVLLAL  122

Query: 149 KELGVTECFEYMVTGEDVSSSKPAPDVFLRAAELLDVDPKVCIVIEDTRNGSLAAKAAGM  208
              +  + + FE ++   EDVS   KP PD++ +A + L +    K   +V+ED++ G   AAKAA +
Sbjct: 123 ETTQIKDYFEIILAREDVSRGKPYPDIYNKAVQKLGLQKKQLLVVEDSQKGIAAAKAANL  182

Query: 209 YCFGFANPDYPPQDLSMADKVI                                       230
              F   + Y   D S AD I
Sbjct: 183 TVFAITDYRY-GIDQSQADHKI                                       203
```

Based on this analysis, it was predicted that these proteins and their epitopes could be useful antigens for vaccines or diagnostics.

EXAMPLE 132

A DNA sequence (GBSx0138) was identified in *S. agalactiae* <SEQ ID 449> which encodes the amino acid sequence <SEQ ID 450>. Analysis of this protein sequence reveals the following:

```
Possible site: 20
>>> Seems to have no N-terminal signal sequence
    INTEGRAL    Likelihood = -0.22    Transmembrane   16-32 (16-32)

----- Final Results -----
            bacterial membrane --- Certainty = 0.1086(Affirmative) < succ>
             bacterial outside --- Certainty = 0.0000(Not Clear)   < succ>
            bacterial cytoplasm --- Certainty = 0.0000(Not Clear)  < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 133

A DNA sequence (GBSx0139) was identified in *S. agalactiae* <SEQ ID 451> which encodes the amino acid sequence <SEQ ID 452>. Analysis of this protein sequence reveals the following:

```
Possible site: 34
>>> Seems to have an uncleavable N-term signal seq
    INTEGRAL    Likelihood = 5.04    Transmembrane    28-44 (27-45)

----- Final Results -----
            bacterial membrane --- Certainty = 0.3017(Affirmative) < succ>
             bacterial outside --- Certainty = 0.0000(Not Clear)   < succ>
            bacterial cytoplasm --- Certainty = 0.0000(Not Clear)  < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 134

A DNA sequence (GBSx0140) was identified in *S. agalactiae* <SEQ ID 453> which encodes the amino acid sequence <SEQ ID 454>. Analysis of this protein sequence reveals the following:

```
Possible site: 17
>>> Seems to have an uncleavable N-term signal seq
    INTEGRAL      Likelihood = -10.72     Transmembrane    38-54  (34-60)
    INTEGRAL      Likelihood =  -7.70     Transmembrane     4-20  (1-22)
    INTEGRAL      Likelihood =  -4.99     Transmembrane   153-169 (150-171)
    INTEGRAL      Likelihood =  -2.55     Transmembrane   179-195 (178-198)
    INTEGRAL      Likelihood =  -2.39     Transmembrane    93-109 (93-109)
    INTEGRAL      Likelihood =  -1.17     Transmembrane   116-132 (116-133)
    INTEGRAL      Likelihood =  -0.43     Transmembrane   344-360 (344-360)

----- Final Results -----
             bacterial membrane  --- Certainty = 0.5288(Affirmative) < succ>
             bacterial outside   --- Certainty = 0.0000(Not Clear)   < succ>
             bacterial cytoplasm --- Certainty = 0.0000(Not Clear)   < succ>
```

The protein has homology with the following sequences in the GENPEPT database:

```
>GP: CAB14853 GB: Z99118 two-component sensor histidine kinase
[Bacillus subtilis]
Identities = 254/585 (43%), Positives = 371/585 (63%),
Gaps = 9/585 (1%)

Query:    2 LMVLLFQRLGIIMILAFLLVNNSYFRQLIEERSK-RETVVLVIIFGLFVIISNITGIEIK   60
            LM+++ +R+GII+IL F+L +   FRQ ++ +     +L+ IF LF IISN TGIEI+
Sbjct:    4 LMIMMLERVGIIVILGFILAHTKLFRQALQNQDGYKGKAILISIFSLFSIISNYTGIEIQ   63

Query:   61 GDRSLVERPFLTTISHSDSLANTRTLVITTASLVGGPLVGSIVGFIGGVHRFFQGSFSGS  120
               + +V   ++ TI  S S+ANTR L +    L+GGP VG+ +G + G+HRF  G   +
Sbjct:   64 RNM-IVNNDWVFTIDPSGSIANTRILGVEIGGLLGGPFVGAGIGILAGLHRFSLGGSTAL  122

Query:  121 FYIVSSVLVGIVSGKIGDKLKENHLYPSTSQVILISIIAESIQMLFVGIFT-----GWEL  175
                   VSS+L G+++G IG    +   P+     L+ I  ES+QM+ + +       WEL
Sbjct:  123 SCAVSSILAGVLAGLIGRYFTKRYRMPTPRIAALVGIGMESLQMIIILLMAKPFSDAWEL  182

Query:  176 VKMIVIPMMILNSLGSTLFLAILKTYLSNESQLRAVQTRDVLELTRQTLPYLRQGLTPQS  235
              V MI IPM+++N GS +FL+I++  +   E Q RA++T  VL +  QTLP+ RQGL    S
Sbjct:  183 VSMIGIPMILINGTGSFIFLSIIQAIIRKEEQARALETHRVLTIADQTLPFFRQGLNENS  242

Query:  236 ARSVCEIIKRHTNFDAVGLTDRSNVLAHIGVGHDHHIAGQPVKTDLSKSVIFDGEPRIAQ  295
             +SV  II + T DAV LTD+  +LAH+G G DHHI + +  T LSK VI  G      A
Sbjct:  243 CKSVAAIIHKLTGTDAVSLTDKEKILAHVGAGMDHHIPSKSLITGLSKKVIKTGHIMKAI  302

Query:  296 DKAAISCPDHNCQLNSAIVVPLKINDKTVGALKMYFAGDKTMSEVEENLVLGLAQIFSGQ  355
            +   I C      C L++AIV+PL  N  T+G LKMYF      +S+VEE L  GLA +FS Q
Sbjct:  303 SQEEIECTHAECPLHAAIVLPLTSNGNTIGTLKMYFKSPAGLSQVEEELAEGLAMLFSTQ  362

Query:  356 LAMGITEEQNKLASMAEIKALQAQINPHFFFNAINTISALIRIDSDKARYALMQLSTFFR  415
            L +G  E Q+KL   AEIKALQAQ+NPHF FNAINTISAL R D +K R  L+QLS +FR
Sbjct:  363 LELGEAELQSKLLKDAEIKALQAQVNPHFLFNAINTISALCRTDVEKTRKLLLQLSVYFR  422

Query:  416 TSLQGGQDREVTLEQEKSHVDAYMNVEKLRFPDKYQLSYDI-SAPEKMKLPPFGLQVLVE  474
             ++LQG +    + L +E +H++ AY+++E+ RFP KY++   +I S     E++++PPF LQVLVE
Sbjct:  423 SNLQGARQLLIPLSKELNHLNAYLSLEQARFPGKYKIELNIDSRLEQIEIPPFVLQVLVE  482

Query:  475 NAVRHAFKERKTDNHILVQIKPDGHYYCVSVSDNGQGISDTIIDKLGQETVAESKGTGTA  534
            NA+RHAF +++        + V +  D      + V+DNG+GI    ++ +LG++       +GTGTA
Sbjct:  483 NALRHAFPKKQDICKVTVCVLSDDASVYMKVADNGRGIPPDVLPELGKKPFPSKEGTGTA  542

Query:  535 LVNLNNRLNLLYGSVSCLHFSSD-KNGTKVWYRIPNRIREDEHEN                578
            L NLN RL L+G + LH SS+   GT+V +++P +  ++ E+
Sbjct:  543 LYNLNQRLIGLFGQQAALHISSEVHKGTEVSFQVPMQQMKEGEEH                587
```

A related DNA sequence was identified in *S. pyogenes* <SEQ ID 455> which encodes the amino acid sequence <SEQ ID 456>. Analysis of this protein sequence reveals the following:

```
Possible site: 23
>>> Seems to have no N-terminal signal sequence

----- Final Results -----
          bacterial cytoplasm --- Certainty = 0.1771(Affirmative) < succ>
          bacterial membrane  --- Certainty = 0.0000(Not Clear)   < succ>
          bacterial outside   --- Certainty = 0.0000(Not Clear)   < succ>
```

An alignment of the GAS and GBS proteins is shown below:

```
Identities = 75/245 (30%), Positives = 117/245 (47%), Gaps = 22/245 (8%)

Query: 348 LAQIFSGQL-----AMGITEEQNKLASMAEIKALQAQINPHFFFNAINTISALIRI-DSD  401
           LAQ F+ L         M    ++ K       ++AL +QINPHF +N ++TI  +    DS
Sbjct:   4 LAQQFNALLDQIDSLMVAVADKEKAIGQYRLQALASQINPHFLYNTLDTIIWMAEFNDSK   63

Query: 402 KARYALMQLSTFFRTSLQGGQDREVTLEQEKSHVDAYMNVEKLRFPDKYQLSYDISAPE-  460
             +       L+ +FR +L  G +  + L   E   HV  Y+ ++K R+ DK  LSY++   +
Sbjct:  64 RVVEVTKSLAKYFRLALNQGNEY-IRLADELDHVSQYLFIQKQRYGDK--LSYEVQGLDV  120

Query: 461 --KMKLPPFGLQVLVENAVRHAFKERKTDNHILVQIKPDGHYYCVSVSDNGQGISDTIID  518
               +P    LQ LVENA+ H  KE         I V +     +  ++V DNG+GI D+ +
Sbjct: 121 YADFVIPKLILQPLVENAIYHGIKEVDRKGMIKVTVSDTAQHLMLTVWDNGKGIEDSSLT  180

Query: 519 KLGQETVAESKGTGTALVNLNNRLNLLYGS--VSCLHFSSDKNGTKVWYRIPNR---IRE  573
            Q +A    G   L N++ RL L YG       +H   SD+   T++   +P     +  +
Sbjct: 181 N-SQSLLARG---GVGLKNVDQRLKLHYGEGYHMTIHSQSDQ-FTEIQLSLPKMHELMAD  235

Query: 574 DEHEN  578
           D  EN
Sbjct: 236 DTQEN  240
```

Figure 124:
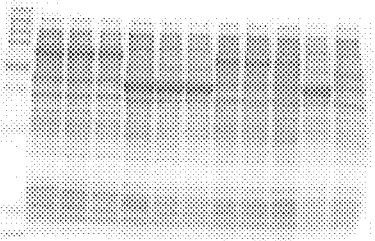
Figure 125:
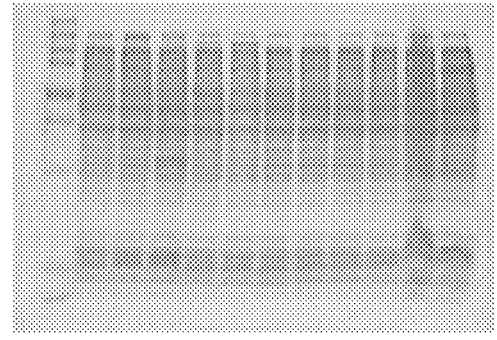
Figure 180:
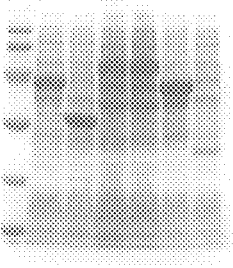

SEQ ID 454 (GBS248d) was expressed in *E. coli* as a GST-fusion product. SDS-PAGE analysis of total cell extract is shown in FIG. 124 (lane 2-4; MW 71 kDa). It was also expressed in *E. coli* as a His-fusion product. SDS-PAGE analysis of total cell extract is shown in FIG. 124 (lane 5-7; MW 46 kDa) and in FIG. 180 (lane 2; MW 46 kDa).

Figure 234:
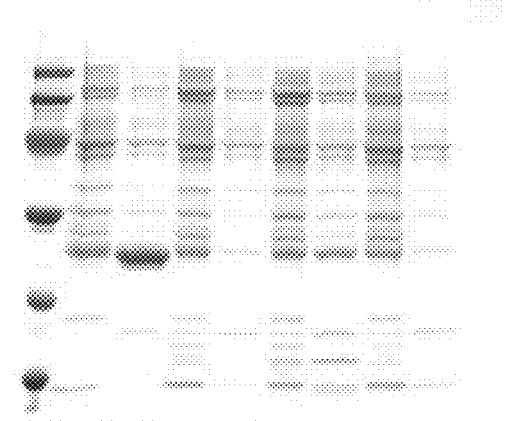

GBS248d-His was purified as shown in FIG. 234, lane 3-4.

Based on this analysis, it was predicted that these proteins and their epitopes could be useful antigens for vaccines or diagnostics.

EXAMPLE 135

A DNA sequence (GBSx0141) was identified in *S. agalactiae* <SEQ ID 457> which encodes the amino acid sequence <SEQ ID 458>. This protein is predicted to be two-component response regulator (lytT). Analysis of this protein sequence reveals the following:

```
Possible site: 61
>>> Seems to have no N-terminal signal sequence

----- Final Results -----
          bacterial cytoplasm --- Certainty = 0.3230(Affirmative) < succ>
          bacterial membrane  --- Certainty = 0.0000(Not Clear)   < succ>
          bacterial outside   --- Certainty = 0.0000(Not Clear)   < succ>
```

A related GBS nucleic acid sequence <SEQ ID 9495> which encodes amino acid sequence <SEQ ID 9496> was also identified.

The protein has homology with the following sequences in the GENPEPT database:

```
>GP: CAB14852 GB: Z99118 two-component response
regulator [Bacillus subtilis]
Identities = 105/244 (43%), Positives = 157/244 (64%),
Gaps = 6/244 (2%)

Query:   3 MKILILDDEMFARQELSFLVEHSQEVDNPEIFQAEDISEAEKILFRQQIDLIFLDISLSE   62
           +++LI+DDEM AR EL++L++ +   D  EI +AE+I  A   +  Q+ DL+FLD+ LS
Sbjct:   2 LRVLIVDDEMLARDELAYLLKRTN--DEMEINEAENIESAFDQMMDQKPDLLFLDVDLSG   59
```

-continued

```
Query:   63 ENGFTLANQLSQLAHPPLVVFATAYDNYAVKAFESNAVDYIMKPFEQQRVDMALSKVKKL  122
            ENGF +A +L ++ HPP +VFATAYD  YA+KAFE +A+DY+ KPF+++R+    L K KK+
Sbjct:   60 ENGFDIAKRLKKMKHPPAIVFATAYDQYALKAFEVDALDYLTKPFDEERIQQTLKKYKKV  119

Query:  123 SQLTTASDVEQAIPKKASVELLTLTLSDRSVVVKMQDIVAASVEDGELTVSTVQKTYTIR  182
            ++       VE   A    L L++ +  V+V  +DI+ A  EDG + V T    +YT+
Sbjct:  120 NR----DIVETEQNSHAGQHKLALSVGESIVIVDTKDIIYAGTEDGHVNVKTFDHSYTVS  175

Query:  183 KTLNWFKSRAVAPYFLQIHRNTVINLEMIEEIQPWFNHTLLLIMSNGEKFPVGRSYLKDL  242
             TL   + +        F+++HR+ V+N E I+EIQPWFN T  LIM +G K PV R+Y K+L
Sbjct:  176 DTLVVIEKKLPDSDFIRVHRSFVVNTEYIKEIQPWFNSTYNLIMKDGSKIPVSRTYAKEL  235

Query:  243 NEHL                                                          246
             + L
Sbjct:  236 KKLL                                                          239
```

A related DNA sequence was identified in *S. pyogenes* <SEQ ID 459> which encodes the amino acid sequence <SEQ ID 460>. Analysis of this protein sequence reveals the following:

```
Possible site: 27
>>> Seems to have no N-terminal signal sequence

----- Final Results -----
           bacterial cytoplasm --- Certainty = 0.3818(Affirmative) < succ>
           bacterial membrane  --- Certainty = 0.0000(Not Clear)   < succ>
           bacterial outside   --- Certainty = 0.0000(Not Clear)   < succ>
```

An alignment of the GAS and GBS proteins is shown below:

```
Identities = 44/148 (29%), Positives = 84/148 (56%), Gaps = 5/148 (3%)

Query:    5 ILILDDEMFARQELSFLVEHSQ-EVDNPEIFQAEDISEAEKILFRQQIDLIFLDISLSEE   63
            +LI++DE  RQ +  LV+ SQ ++D   + +AE+    A +   ++   D++  DI++ +
Sbjct:    4 LLIVEDEYLVRQGIRSLVDFSQFKIDR--VNEAENGQLAWDLFQKEPYDIVLTDINMPKL   61

Query:   64 NGFTLANQLSQLAHPPLVVFATAYD--NYAVKAFESNAVDYIMKPFEQQRVDMALSKVKK  121
            NG  LA + Q +     +VF T YD  NYA+ A +  A DY++KPF +   V+  L K++K
Sbjct:   62 NGIQLAELIKQESPQTHLVFLTGYDDFNYALSALKLGADDYLLKPFSKADVEDMLGKLRK  121

Query:  122 LSQLTTASDVEQAIPKKASVELLTLTLS                                  149
            +L+  ++  Q + ++    E+   + ++
Sbjct:  122 KLELSKKTETIQELVEQPQKEVSAIAMA                                  149
```

Based on this analysis, it was predicted that these proteins and their epitopes could be useful antigens for vaccines or diagnostics.

EXAMPLE 136

A DNA sequence (GBSx0142) was identified in *S. agalactiae* <SEQ ID 461> which encodes the amino acid sequence <SEQ ID 462>. Analysis of this protein sequence reveals the following:

```
Possible site: 18
>>> Seems to have no N-terminal signal sequence

----- Final Results -----
           bacterial cytoplasm --- Certainty = 0.0266(Affirmative) < succ>
           bacterial membrane  --- Certainty = 0.0000(Not Clear)   < succ>
           bacterial outside   --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 137

A DNA sequence (GBSx0143) was identified in *S. agalactiae* <SEQ ID 463> which encodes the amino acid sequence <SEQ ID 464>. Analysis of this protein sequence reveals the following:

```
Possible site: 37
>>> Seems to have no N-terminal signal sequence
    INTEGRAL     Likelihood = -11.89    Transmembrane    104-120  (99-134)
    INTEGRAL     Likelihood = -5.89     Transmembrane     47-63   (46-65)
    INTEGRAL     Likelihood = -3.29     Transmembrane     22-38   (21-39)
    INTEGRAL     Likelihood = -2.81     Transmembrane     74-90   (70-92)

----- Final Results -----
            bacterial membrane  --- Certainty = 0.5755(Affirmative) < succ>
             bacterial outside  --- Certainty = 0.0000(Not Clear)   < succ>
           bacterial cytoplasm  --- Certainty = 0.0000(Not Clear)   < succ>
```

A related GBS nucleic acid sequence <SEQ ID 8499> which encodes amino acid sequence <SEQ ID 8500> was also identified.

The protein has homology with the following sequences in the GENPEPT database:

```
>GP: CAB14851 GB: Z99118 similar to hypothetical proteins from
B. subtilis [Bacillus subtilis]
Identities = 50/110 (45%), Positives = 82/110 (74%),
Gaps = 2/110 (1%)

Query:  20 QMSIYAAILLVSQMISMLLPKSLPIPTTVIGLVLMYVLLTAKIIKVEWVDSFGALMISMI    79
           Q  I+A I+LVS MI+ ++P  +PIP +V+GLVL+++LL   K+IK+E V++ G  + S+I
Sbjct:  12 QAFIFAVIMLVSNMIAAIVP--IPIPASVVGLVLLFLLLCLKVIKLEQVETLGTSLTSLI    69

Query:  80 GFMFVPSGISVAANLDILKAEGLQLVAVITISTVVMLVVAYVARLILAI              129
           GF+FVPSGISV +L +++  GLQ+V VI ++T+++L       ++LIL++
Sbjct:  70 GFLFVPSGISVMNSLGVMQQYGLQIVLVILLATIILLGATGLFSQLILSL              119
```

Based on this analysis, it was predicted that these proteins and their epitopes could be useful antigens for vaccines or diagnostics.

EXAMPLE 138

A DNA sequence (GBSx0144) was identified in *S. agalactiae* <SEQ ID 465> which encodes the amino acid sequence <SEQ ID 466>. Analysis of this protein sequence reveals the following:

```
Possible site: 44
>>> Seems to have a cleavable N-term signal seq.
INTEGRAL Likelihood = -12.21 Transmembrane 219-235 (208-241)
INTEGRAL Likelihood = -11.94 Transmembrane 103-119 (99-133)
INTEGRAL Likelihood = -5.57  Transmembrane 157-173 (154-175)
INTEGRAL Likelihood = -1.70  Transmembrane  73-89  (73-89)

----- Final Results -----
        bacterial membrane  --- Certainty = 0.5883 (Affirmative) < succ>
         bacterial outside  --- Certainty = 0.0000 (Not Clear)   < succ>
       bacterial cytoplasm  --- Certainty = 0.0000 (Not Clear)   < succ>
```

The protein has homology with the following sequences in the GENPEPT database:

```
>GP: CAB14850 GB: Z99118 similar to hypothetical proteins [Bacillus
subtilis]

Identities = 120/240 (50%), Positives = 159/240 (66%), Gaps = 10/240 (4%)
```

```
Query:    1 MELLKTPIFGICFSLILYTIGEHLFKKSKGFFLLQPLFFAMVSGIVILWLMSKGLGTDVK   60
            ME  +P FGI  SL  + IG  LFKK+KGFFL  PLF AMV GI  L           +
Sbjct:    1 MESTMSPYFGIVVSLAAFGIGTFLFKKTKGFFLFTPLFVAMVLGIAFL---------KIG   51

Query:   61 TFYTQAYKPGGDLIFWFLNPATIAFAVPLYKKNDVVKKYWVEILSSLVIGMIVSLILIVA  120
             F    Y   GG++I +FL PATIAFA+PLYK+ D +KKYW +I++S++ G I S+ ++
Sbjct:   52 GFSYADYNNGGEIIKFFLEPATIAFAIPLYKQRDKLKKYWWQIMASIIAGSICSVTIVYL  111

Query:  121 ISKMVGLSQVGIASMLPQAATTAIALPITAAIGGNTAVTAMACILNAVIIYALGKKLVSF  180
            ++K + L   +  SMLPQAATTAIALP++  IGG +  +TA A I  NAVI+YALG   +
Sbjct:  112 LAKGIHLDSAVMKSMLPQAATTAIALPLSKGIGGISDITAFAVIFNAVIVYALGALFLKV  171

Query:  181 FHLNDSKIGAGLGLGTSGHTVGAAFALELGELQGAMAAIAVVVIGLVVDLVIPIFSHLIG  240
             F +  + I   GL LGTSGH +G A   +E+GE++ AMA+IAVVV+G+V  LVIP+F   LIG
Sbjct:  172 FKVK-NPISKGLALGTSGHALGVAVGIEMGEVEAAMASIAVVVVGVVTVLVIPVFVQLIG  230
```

No corresponding DNA sequence was identified in *S. pyogenes*.

Based on this analysis, it was predicted that these proteins and their epitopes could be useful antigens for vaccines or diagnostics.

EXAMPLE 139

A DNA sequence (GBSx0145) was identified in *S. agalactiae* <SEQ ID 467> which encodes the amino acid sequence <SEQ ID 468>. Analysis of this protein sequence reveals the following:

```
Possible site: 22
>>> May be a lipoprotein

----- Final Results -----
        bacterial membrane --- Certainty = 0.0000 (Not Clear) < succ>
         bacterial outside --- Certainty = 0.0000 (Not Clear) < succ>
        bacterial cytoplasm --- Certainty = 0.0000 (Not Clear) < succ>
```

An alignment of the GAS and GBS proteins is shown below:

```
Identities = 508/542 (93%), Positives = 523/542 (95%)

Query:    1 MTKYLKYISFVALFLASIFLVACQNQNSQTKERTRKQRPKDELVVSMGAKLPHEFDPKDR   60
            ++KYLKY S + LFL  + LVACQ Q  QTKER RKQRPKDELVVSMGAKLPHEFDPKDR
Sbjct:    3 VSKYLKYFSIITLFLTGLILVACQQQKPQTKERQRKQRPKDELVVSMGAKLPHEFDPKDR   62

Query:   61 YGIHNEGNITHSTLLKRSPELDIKGELAKKYKISKDGLTWSFDLNDDFKFSNGEPVTADD  120
            YG+HNEGNITHSTLLKRSPELDIKGELAK Y +S+DGLTWSFDL+DDFKFSNGEPVTADD
Sbjct:   63 YGVHNEGNITHSTLLKRSPELDIKGELAKTYHLSEDGLTWSFDLHDDFKFSNGEPVTADD  122

Query:  121 VKFTYDMLKADGKAWDLTFIKNVEVVGKNQVNIHLTEAHSTFTAQLTEIPIVPKKHYNDK  180
            VKFTYDMLKADGKAWDLTFIKNVEVVGKNQVNIHLTEAHSTFTAQLTEIPIVPKKHYNDK
Sbjct:  123 VKFTYDMLKADGKAWDLTFIKNVEVVGKNQVNIHLTEAHSTFTAQLTEIPIVPKKHYNDK  182

Query:  181 YKSNPIGSGPYMVKEYKAGEQAIFVRNPYWHGKKPYFKKWTWVLLDENTALAALESGDVD  240
            YKSNPIGSGPYMVKEYKAGEQAIFVRNPYWHGKKPYFKKWTWVLLDENTALAALESGDVD
Sbjct:  183 YKSNPIGSGPYMVKEYKAGEQAIFVRNPYWHGKKPYFKKWTWVLLDENTALAALESGDVD  242

Query:  241 MIYATPELASKKVKGTRLLDIASNDVRGLSLPYVKKGVVKNSPDGYPVGNDVTSDPAIRK  300
            MIYATPELA KKVKGTRLLDI SNDVRGLSLPYVKKGV+ +SPDGYPVGNDVTSDPAIRK
Sbjct:  243 MIYATPELADKKVKGTRLLDIPSNDVRGLSLPYVKKGVITDSPDGYPVGNDVTSDPAIRK  302

Query:  301 ALTIGLNRQKVLDTVLNGYGKPAYSIIDRTPFWNPKTAIKDNKVAKAKQLLTKAGWKEQA  360
            ALTIGLNRQKVLDTVLNGYGKPAYSIID+TPFWNPKTAIKDNKVAKAKQLLTKAGWKEQA
Sbjct:  303 ALTIGLNRQKVLDTVLNGYGKPAYSIIDKTPFWNPKTAIKDNKVAKAKQLLTKAGWKEQA  362

Query:  361 DGSRKKGNLKSEFDLYYPTNDQLRANLAVEVAEQAKALGITIKLKASNWDEMATKSHDSA  420
            DGSRKKG+L + FDLYYPTNDQLRANLAVEVAEQAKALGITIKLKASNWDEMATKSHDSA
Sbjct:  363 DGSRKKGDLDAAFDLYYPTNDQLRANLAVEVAEQAKALGITIKLKASNWDEMATKSHDSA  422

Query:  421 LLYAGGRHHAQQFYESHYPSLAGKGWTNITFYNNPTVTKYLDKAMTSPDLDKANKYWKLA  480
            LLYAGGRHHAQQFYESH+PSLAGKGWTNITFYNNPTVTKYLDKAMTS DLDKAN+YWKLA
Sbjct:  423 LLYAGGRHHAQQFYESHHPSLAGKGWTNITFYNNPTVTKYLDKAMTSSDLDKANEYWKLA  482
```

```
                       -continued
Query:  481 QWDGKTGASTLGDLPNVWLVSLNHTYIGDKRINVGKQGVHSHGHDWSLLTNIAEWTWDES  540
            QWDGKTGASTLGDLPNVWLVSLNHTYIGDKRINVGKQGVHSHGHDWSLLTNIAEWTWDES
Sbjct:  483 QWDGKTGASTLGDLPNVWLVSLNHTYIGDKRINVGKQGVHSHGHDWSLLTNIAEWTWDES  542

Query:  541 AK                                                           542
            K
Sbjct:  543 TK                                                           544
```

There is also homology to SEQ ID 60.

A related GBS gene <SEQ ID 8501> and protein <SEQ ID 8502> were also identified. Analysis of this protein sequence reveals the following:

```
Lipop: Possible site: 22 Crend: 5
McG: Discrim Score: 10.46
GvH: Signal Score (-7.5): -1.29
Possible site: 22
>>> May be a lipoprotein
ALOM program count: 0 value: 7.27 threshold: 0.0
PERIPHERAL  Likelihood = 7.27  386
modified ALOM score: -1.95

*** Reasoning Step: 3

----- Final Results -----
        bacterial membrane --- Certainty = 0.0000 (Not Clear) < succ>
         bacterial outside -- Certainty = 0.0000 (Not Clear) < succ>
        bacterial cytoplasm --- Certainty = 0.0000 (Not Clear) < succ>
```

SEQ ID 8502 (GBS106) was expressed in *E. coli* as a His-fusion product. SDS-PAGE analysis of total cell extract is shown in FIG. 18 (lane 3; MW 61 kDa).

The GBS106-His fusion product was purified (FIG. 194, lane 2) and used to immunise mice. The resulting antiserum was used for Western blot (FIG. 255A), FACS (FIG. 255B), and in the in vivo passive protection assay (Table III). These tests confirm that the protein is immunoaccessible on GBS bacteria and that it is an effective protective immunogen.

Based on this analysis, it was predicted that these proteins and their epitopes could be useful antigens for vaccines or diagnostics.

EXAMPLE 140

A DNA sequence (GBSx0146) was identified in *S. agalactiae* <SEQ ID 469> which encodes the amino acid sequence <SEQ ID 470>. Analysis of this protein sequence reveals the following:

```
Possible site: 41
>>> Seems to have no N-terminal signal sequence

----- Final Results -----
     bacterial cytoplasm --- Certainty = 0.4862 (Affirmative) < succ>
       bacterial membrane --- Certainty = 0.0000 (Not Clear) < succ>
       bacterial outside --- Certainty = 0.0000 (Not Clear) < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 141

A DNA sequence (GBSx0147) was identified in *S. agalactiae* <SEQ ID 471> which encodes the amino acid sequence <SEQ ID 472>. Analysis of this protein sequence reveals the following:

```
Possible site: 19
>>> Seems to have no N-terminal signal sequence
INTEGRAL Likelihood = -7.27 Transmembrane     252-268 (249-275)
INTEGRAL Likelihood = -5.73 Transmembrane      67-83 (62-90)
INTEGRAL Likelihood = -5.26 Transmembrane     107-123 (104-134)
INTEGRAL Likelihood = -3.77 Transmembrane     153-169 (152-170)

----- Final Results -----
          bacterial membrane --- Certainty = 0.3909 (Affirmative) < succ>
           bacterial outside --- Certainty = 0.0000 (Not Clear) < succ>
          bacterial cytoplasm --- Certainty = 0.0000 (Not Clear) < succ>
```

A related GBS nucleic acid sequence <SEQ ID 9295> which encodes amino acid sequence <SEQ ID 9296> was also identified.

The protein differs from U78968 at the N-terminus:

```
Query:   1 MASVNYDTSLTPVQYKAIAHHYGLDKPAPVQYFIWLKNFIQGHLGTSLVYRQPVIDIIRS  60
           MASVNYDTSLTP QYKAIAHHYGLDKPA VQYFIWLKN IQG LGTSLVYRQPV DIIRS
Sbjct:  39 MASVNYDTSLTPAQYKAIAHHYGLDKPALVQYFIWLKNVIQGDLGTSLVYRQPVSDIIRS  98
```

There is also homology to SEQ ID 64.

A related GBS gene <SEQ ID 8471> and protein <SEQ ID 8472> were also identified. Analysis of this protein sequence reveals the following:

```
Lipop: Possible site: -1 Crend: 10
McG: Discrim Score: 3.72
GvH: Signal Score (-7.5): -5.37
Possible site: 40
>>> Seems to have an uncleavable N-term signal seq
ALOM program count: 5 value: -7.27 threshold: 0.0
INTEGRAL Likelihood = -7.27 Transmembrane     290-306 (287-313)
INTEGRAL Likelihood = -5.89 Transmembrane      12-28 (11-33)
INTEGRAL Likelihood = -5.73 Transmembrane     105-121 (100-128)
INTEGRAL Likelihood = -5.26 Transmembrane     145-161 (142-172)
INTEGRAL Likelihood = -3.77 Transmembrane     191-207 (190-208)
PERIPHERAL Likelihood = 2.97  245
modified ALOM score: 1.95

*** Reasoning Step: 3

----- Final Results -----
          bacterial membrane --- Certainty = 0.3909 (Affirmative) < succ>
           bacterial outside --- Certainty = 0.0000 (Not Clear) < succ>
          bacterial cytoplasm --- Certainty = 0.0000 (Not Clear) < succ>
```

Figure 173:
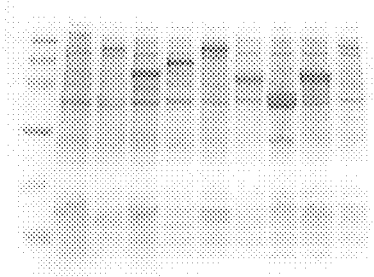

SEQ ID 8472 (GBS436) was expressed in *E. coli* as a GST-fusion product. SDS-PAGE analysis of total cell extract is shown in FIG. 173 (lane 9; MW 54 kDa).

Based on this analysis, it was predicted that these proteins and their epitopes could be useful antigens for vaccines or diagnostics.

EXAMPLE 142

A DNA sequence (GBSx0148) was identified in *S. agalactiae* <SEQ ID 473> which encodes the amino acid sequence <SEQ ID 474>. This protein is predicted to be transmembrane transport protein DppC (oppC). Analysis of this protein sequence reveals the following:

```
Possible site: 39
>>> Seems to have a cleavable N-term signal seq.
       INTEGRAL   Likelihood = -8.28   Transmembrane    77-93 (68-101)
       INTEGRAL   Likelihood = -7.80   Transmembrane   182-198 (180-204)
       INTEGRAL   Likelihood = -7.06   Transmembrane   112-128 (104-132)
       INTEGRAL   Likelihood = -5.10   Transmembrane   239-255 (235-258)
```

```
----- Final Results -----
         bacterial membrane --- Certainty = 0.4312(Affirmative) < succ>
         bacterial outside  --- Certainty = 0.0000(Not Clear)   < succ>
         bacterial cytoplasm --- Certainty = 0.0000(Not Clear)  < succ>
```

There is homology to SEQ ID 68.

Based on this analysis, it was predicted that this protein and its epitopes, could be useful antigens for vaccines or diagnostics.

EXAMPLE 143

A DNA sequence (GBSx0149) was identified in *S. agalactiae* <SEQ ID 475> which encodes the amino acid sequence <SEQ ID 476>. This protein is predicted to be ATPase protein DppD. Analysis of this protein sequence reveals the following:

```
Possible site: 59
>>> Seems to have no N-terminal signal sequence

----- Final Results -----
         bacterial cytoplasm --- Certainty = 0.1957(Affirmative) < succ>
         bacterial membrane  --- Certainty = 0.0000(Not Clear)   < succ>
         bacterial outside   --- Certainty = 0.0000(Not Clear)   < succ>
```

The protein differs from U78968 at the C-terminus:

```
Query:  241 QTEFARSLWRSLPQQEFLKGVTHDLRG  267
            QTEFAR LWR+LPQQ+FLKGVTHDLRG
Sbjct:  241 QTEFARRLWRTLPQQDFLKGVTHDLRG  267
```

A related DNA sequence was identified in *S. pyogenes* <SEQ ID 477> which encodes the amino acid sequence <SEQ ID 478>. Analysis of this protein sequence reveals the following:

```
Possible site: 59
>>> Seems to have no N-terminal signal sequence

----- Final Results -----
         bacterial cytoplasm --- Certainty = 0.1957(Affirmative) < succ>
         bacterial membrane  --- Certainty = 0.0000(Not Clear)   < succ>
         bacterial outside   --- Certainty = 0.0000(Not Clear)   < succ>
```

An alignment of the GAS and GBS proteins is shown below:

```
Identities = 255/267 (95%), Positives = 262/267 (97%)

Query:    1 MTETLLSIKDLSITFTQYGRFLKPFQSTPIQALNLEIKKGELLAIIGASGSGKSLLAHAI   60
            MTETLLSIKDLSITFTQYGRFLKPFQSTPIQALNLE+KKGELLAIIGASGSGKSLLAHAI
Sbjct:    1 MTETLLSIKDLSITFTQYGRFLKPFQSTPIQALNLEVKKGELLAIIGASGSGKSLLAHAI   60

Query:   61 MDILPKNASVTGDMIYRGQSLNSKRIKQLRGKDITLIPQSVNYLDPSTKVKHQVRLGISE  120
            MDILPKNA+VTGDMIYRGQSL SKRIKQLRGK++TLIPQSVNYLDPS KVKHQVRLGISE
Sbjct:   61 MDILPKNAAVTGDMIYRGQSLTSKRIKQLRGKEMTLIPQSVNYLDPSMKVKHQVRLGISE  120

Query:  121 NSKATQEGLFQQFGLKESDGDLYPFQLSGGMLRRVLFTTCISDKVSLIIADEPTPGLHPD  180
            N+KATQEGLFQQFGLKESDGDLYPFQLSGGMLRRVLFTTCISD VSLIIADEPTPGLHPD
Sbjct:  121 NAKATQEGLFQQFGLKESDGDLYPFQLSGGMLRRVLFTTCISDTVSLIIADEPTPGLHPD  180

Query:  181 ALQMVLDQLRSFADKGISVIFITHDIVAASQIADRITIFKEGKAIETAPASFFSGNGEQL  240
            ALQMVLDQLRSFADKGISVIFITHDIVAASQIADRITIFKEGKAIETAPASFFSG GEQL
Sbjct:  181 ALQMVLDQLRSFADKGISVIFITHDIVAASQIADRITIFKEGKAIETAPASFFSGGGEQL  240

Query:  241 QTEFARSLWRSLPQQEFLKGVTHDLRG                                  267
            QTEFAR LWR+LPQQ+FLKGVTHDLRG
Sbjct:  241 QTEFARRLWRTLPQQDFLKGVTHDLRG                                  267
```

Based on this analysis, it was predicted that these proteins and their epitopes could be useful antigens for vaccines or diagnostics.

EXAMPLE 144

A DNA sequence (GBSx0150) was identified in *S. agalactiae* <SEQ ID 479> which encodes the amino acid sequence <SEQ ID 480>. This protein is predicted to be ATPase protein DppE. Analysis of this protein sequence reveals the following:

```
Possible site: 41
>>> Seems to have no N-terminal signal sequence

----- Final Results -----
            bacterial cytoplasm --- Certainty = 0.3783(Affirmative) < succ>
             bacterial membrane --- Certainty = 0.0000(Not Clear) < succ>
              bacterial outside --- Certainty = 0.0000(Not Clear) < succ>
```

A related DNA sequence was identified in *S. pyogenes* <SEQ ID 481> which encodes the amino acid sequence <SEQ ID 482>. Analysis of this protein sequence reveals the following:

```
Possible site: 41
>>> Seems to have no N-terminal signal sequence

----- Final Results -----
            bacterial cytoplasm --- Certainty = 0.3383(Affirmative) < succ>
             bacterial membrane --- Certainty = 0.0000(Not Clear) < succ>
              bacterial outside --- Certainty = 0.0000(Not Clear) < succ>
```

An alignment of the GAS and GBS proteins is shown below:

```
Identities = 188/205 (91%), Positives = 197/205 (95%)

Query:    1 MTLEAKKLGFYHKKDQWLFKEINLEVAPGQVLGIFGQSGCGKTSLSRVLAGFLHPKSGEV    60
            MTLEAKKLGFYHKKDQWLFKEI+LEVAPGQ+LGIFGQSGCGKTSLSRVLAGFL PKSGEV
Sbjct:    1 MTLEAKKLGFYHKKDQWLFKEIDLEVAPGQILGIFGQSGCGKTSLSRVLAGFLQPKSGEV    60

Query:   61 LVDGSNLPSKAFRPVQLIQQHPEKTMNPLWPMKKSLEEAYYPSRDLLDAFGIQEKWLNRR   120
            LVDGS+LP+KAFRPVQLIQQHPE+TMNPLWPMKKSLEEAYYPS+DL DAFGIQEKWL RR
Sbjct:   61 LVDGSHLPNKAFRPVQLIQQHPEQTMNPLWPMKKSLEEAYYPSQDLRDAFGIQEKWLKRR   120

Query:  121 PSELSGGELQRFSIVRSLHPETKYLIADEMTTMLDSITQASVWKSLLEIVKDRNLGLIVI   180
            PSELSGGELQRFSIVRSLHPETKYLIADEMTTMLDSITQASVWKSLLEIVKDRNLGLI+I
Sbjct:  121 PSELSGGELQRFSIVRSLHPETKYLIADEMTTMLDSITQASVWKSLLEIVKDRNLGLIII   180

Query:  181 SHDFAMLEKLCNQCYMIEENRIVSF                                     205
            SH+F MLEKLC+ CYMIEENR  F
Sbjct:  181 SHEFDMLEKLCDACYMIEENRTQLF                                     205
```

Based on this analysis, it was predicted that these proteins and their epitopes could be useful antigens for vaccines or diagnostics.

EXAMPLE 145

A DNA sequence (GBSx0151) was identified in *S. agalactiae* <SEQ ID 483> which encodes the amino acid sequence <SEQ ID 484>. This protein is predicted to be PTS system, trehalose-specific IIBC component (treB). Analysis of this protein sequence reveals the following:

```
Possible site: 59
>>> Seems to have no N-terminal signal sequence
    INTEGRAL    Likelihood = -10.14    Transmembrane    468-484 (462-489)
    INTEGRAL    Likelihood =  -8.23    Transmembrane    279-295 (275-306)
    INTEGRAL    Likelihood =  -6.05    Transmembrane    112-128 (105-130)
```

```
            -continued
INTEGRAL    Likelihood = -3.35    Transmembrane    204-220  (203-222)
INTEGRAL    Likelihood = -1.75    Transmembrane    255-271  (255-271)
INTEGRAL    Likelihood = -1.54    Transmembrane    327-343  (326-344)
INTEGRAL    Likelihood = -0.37    Transmembrane    422-438  (422-438)
INTEGRAL    Likelihood = -0.06    Transmembrane    304-320  (304-320)

----- Final Results -----
              bacterial membrane --- Certainty = 0.5055(Affirmative) < succ>
              bacterial outside  --- Certainty = 0.0000(Not Clear)   < succ>
           bacterial cytoplasm   --- Certainty = 0.0000(Not Clear)   < succ>
```

The protein has homology with the following sequences in the GENPEPT database:

```
>GP: AAF94072 GB: AE004175 PTS system, trehalose-specific IIBC
component [Vibrio cholerae]
Identities = 225/484 (46%), Positives = 318/484 (65%), Gaps = 28/484 (5%)

Query:    5 KHDAKALLEAIGGKENISAVTHCATRMRFVLNDSSKAKVKVIEELPSVKGTFTNAGQFQV   64
            K D   L+E +GG+ NI++VTHC TR+RFVLN   +A    +E L  VKG FTNAGQFQV
Sbjct:   10 KQDVTRLIELVGGESNIASVTHCLTRLRFVLNQPEQADKAGLEALSMVKGCFTNAGQFQV   69

Query:   65 IIGNDVPIFYNAFVAVSGIEGVSKEAAKSAAQKNQNPLQRVLTMLAEIFTPIIPAIIVGG  124
            +IG +V   Y  +  +G + VSK+ AK AA++N N L+R ++ LAEIF P++PAII GG
Sbjct:   70 VIGTEVDQVYKMLLEQTGKQAVSKDDAKVAARQNMNVLERGISHLAEIFVPLLPAIITGG  129

Query:  125 LILGFRNILDAVPFEFLGQKVVDGVRQVDSSGHPIWNTLVDVSTFWSGVDSFLWLPGEAI  184
            LILGFRN++  +        ++ DG             TL ++S FW+ V +FLWL GEAI
Sbjct:  130 LILGFRNVIGDI-------RMFDG------------KTLTEISQFWASVHAFLWLIGEAI  170

Query:  185 FHFLPVGIVWSVTRKMGTTQILGIVLGICLVSPQLLNAYSVASTSAADIAKNWSWNFGYF  244
            F FLPVG+ WS +K+G T ILGI LG+ LVSPQL+NAY +              W+FG F
Sbjct:  171 FFFLPVGVCWSTVKKLGGTPILGITLGVTLVSPQLMNAYLIGKEVPE------VWDFGLF  224

Query:  245 TVQKIGYQAQVIPALLAGLSLSYLEIFWRKHIPEVVSMIFVPFLSLVPAIILAHTVLGPI  304
             ++K+GYQAQVIPA+LAG++L++++E   R+ +P  + ++ VPF+S++ +++LAH +GP
Sbjct:  225 AIEKVGYQAQVIPAILAGVALAFIENNLRRVVPSYLYLVVVPFVSIIVSVVLAHAFIGPF  284

Query:  305 GWTLGKWISAIVLIGLTGPVKWLFGAIFGALYAPFVITGLHHMTNAIDTQLIADTKTHTT  364
            G   +G ++        +TG     +FG +YAP VITG+HH TNA+D QL+ +       T
Sbjct:  285 GRVIGDGVAFAAKAAMTGDFAVIGSTLFGFMYAPLVITGIHHTTNAVDLQLMQE--LGGT  342

Query:  365 GLWPMIALSNIAQGSAVLAYYFMHRHDEKEAQISLPAAISAYLGVTEPALFGVNVKYIYP  424
            G +WP+IALSNIAQ SAV+   +  +  E   IS+PAAISAYLGVTEPA++G+N+KY +P
Sbjct:  343 PIWPLIALSNIAQASAVVGIIIISK-KQGERDISVPAAISAYLGVTEPAMYGINLKYKFP  401

Query:  425 FVAGMIGSSVAGLLATTFNVQANSIGVGGLPGFLSINVKYMGYFFICMAVAIFIPLFLTL  484
             +  ++ MIGS++A  +    + V AN IGVGGLPG LSI  ++   + +M +AI +P   LTL
Sbjct:  402 MLSAMIGSALAAAVCGSAGVMANGIGVGGLPGILSIQPQFWSIYLVAMLIAILVPAALTL  461

Query:  485 FFKK                                                          488
              K
Sbjct:  462 LMYK                                                          465
```

A related DNA sequence was identified in *S. pyogenes* <SEQ ID 485> which encodes the amino acid sequence <SEQ ID 486>. Analysis of this protein sequence reveals the following:

```
Possible site: 59
>>> Seems to have no N-terminal signal sequence
    INTEGRAL    Likelihood = -9.61    Transmembrane    466-482  (457-488)
    INTEGRAL    Likelihood = -8.01    Transmembrane    279-295  (275-306)
    INTEGRAL    Likelihood = -6.05    Transmembrane    112-128  (105-130)
    INTEGRAL    Likelihood = -3.35    Transmembrane    204-220  (203-222)
    INTEGRAL    Likelihood = -3.13    Transmembrane    255-271  (255-272)
    INTEGRAL    Likelihood = -2.07    Transmembrane    327-343  (325-344)
    INTEGRAL    Likelihood = -0.59    Transmembrane    422-438  (422-438)

----- Final Results -----
              bacterial membrane --- Certainty = 0.4843(Affirmative) < succ>
              bacterial outside  --- Certainty = 0.0000(Not Clear)   < succ>
           bacterial cytoplasm   --- Certainty = 0.0000(Not Clear)   < succ>
```

The protein has homology with the following sequences in the databases:

```
>GP: AAF94072 GB: AE004175 PTS system, trehalose-specific IIBC
component [Vibrio cholerae]
Identities = 231/484 (47%), Positives = 322/484 (65%), Gaps = 28/484 (5%)

Query:   5 EQDAKSLLTAIGGKENIKVVTHCATRMRFVLNDNNKANVKEIEKISVVKGTFTNAGQFQV   64
           +QD   L+  +GG+ NI  VTHC TR+RFVLN   +A+   +E +S+VKG FTNAGQFQV
Sbjct:  10 KQDVTRLIELVGGESNIASVTHCLTRLRFVLNQPEQADKAGLEALSMVKGCFTNAGQFQV   69

Query:  65 IIGNDVPVFYNDFTAVSSIEGVSKEAAKSAAKSNQNALQRVMTMLAEIFTPIIPAIIVGG  124
           +IG +V   Y       +  + VSK+ AK AA+ N N L+R ++ LAEIF P++PAII GG
Sbjct:  70 VIGTEVDQVYKMLLEQTGKQAVSKDDAKVAARQNMNVLERGISHLAEIFVPLLPAIITGG  129

Query: 125 LILGFRNILESVPFEFLGQQVEKGKLVFDAAGDPVWNTIVRVSPFWSGVNHFLWLPGEAI  184
           LILGFRN++  +             +FD         T+  +S FW+ V+ FLWL GEAI
Sbjct: 130 LILGFRNVIGDI-------------RMFDG------KTLTEISQFWASVHAFLWLIGEAI  170

Query: 185 FHFLPVGITWSVTRKMGTTQILGIVLGICLVSPQLLNAYAVAGTPAAEIAKNWVWDFGFF  244
           F FLPVG+ WS +K+G T ILGI LG+ LVSPQL+NAY + G    E     VWDFG F
Sbjct: 171 FFFLPVGVCWSTVKKLGGTPILGITLGVTLVSPQLMNAYLI-GKEVPE-----VWDFGLF  224

Query: 245 TINRIGYQAQVIPALLAGLSLAYLEIFWRKRIPEVVSMIFVPFLSLIPALILAHTVLGPI  304
              I  ++GYQAQVIPA+LAG++LA++E   R+  +P  + ++ VPF+S+I +++LAH  +GP
Sbjct: 225 AIEKVGYQAQVIPAILAGVALAFIENNLRRVVPSYLYLVVVPFVSIIVSVVLAHAFIGPF  284

Query: 305 GWTIGKGISFVVLAGLTGPVKWLFGAIFGALYAPLVITGLHHMTNAIDTQLIADTATRTT  364
           G   IG G++F   A +TG      +FG +YAPLVITG+HH TNA+D QL+ +      T
Sbjct: 285 GRVIGDGVAFAAKAAMTGDFAVIGSTLFGFMYAPLVITGIHHTTNAVDLQLMQELG--GT  342

Query: 365 GLWPMIALSNIAQGSAVFAYYLMNRHEEREAEISLPAAISAYLGVTEPALFGVNVKYVYP  424
           +WP+IALSNIAQ SAV     ++++ ++ E  +IS+PAAISAYLGVTEPA++G+N+KY +P
Sbjct: 343 PIWPLIALSNIAQASAVVGIIIISK-KQGERDISVPAAISAYLGVTEPAMYGINLKYKFP  401

Query: 425 FVAGMIGSSGIAGLLSTTFNVQANSIGVGGLPGFMAINVKYMIPFFICMAVAIVVPMFLTF  484
           ++ MIGS +A  +  + V AN IGVGGLPG ++I  ++   + + M +AI+VP  LT
Sbjct: 402 MLSAMIGSALAAAVCGSAGVMANGIGVGGLPGILSIQPQFWSIYLVAMLIAILVPAALTL  461

Query: 485 FFRK  488
            K
Sbjct: 462 LMYK  465
```

An alignment of the GAS and GBS proteins is shown below:

```
Identities = 501/675 (74%), Positives = 573/675 (84%), Gaps = 2/675 (0%)

Query:   1 MEQFKHDAKALLEAIGGKENISAVTHCATRMRFVLNDSSKAKVKVIEELPSVKGTFTNAG   60
           M +F+ DAK+LL AIGGKENI  VTHCATRMRFVLND++KA VK IE++ VKGTFTNAG
Sbjct:   1 MGKFEQDAKSLLTAIGGKENIKVVTHCATRMRFVLNDNNKANVKEIEKISVVKGTFTNAG   60

Query:  61 QFQVIIGNDVPIFYNAFVAVSGIEGVSKEAAKSAAQKNQNPLQRVLTMLAEIFTPIIPAI  120
           QFQVIIGNDVP+FYN F AVS IEGVSKEAAKSAA+ NQN LQRV+TMLAEIFTPIIPAI
Sbjct:  61 QFQVIIGNDVPVFYNDFTAVSSIEGVSKEAAKSAAKSNQNALQRVMTMLAEIFTPIIPAI  120

Query: 121 IVGGLILGFRNILDAVPFEFLGQRVVDGVRQVDSSGHPIWNTLVDVSTFWSGVDSFLWLP  180
           IVGGLILGFRNIL++VPFEFLGQ+V  G    D++G P+WNT+V VS FWSGV+ FLWLP
Sbjct: 121 IVGGLILGFRNILESVPFEFLGQQVEKGKLVFDAAGDPVWNTIVRVSPFWSGVNHFLWLP  180

Query: 181 GEAIFHFLPVGIVWSVTRKMGTTQILGIVLGICLVSPQLLNAYSVASTSAADIAKNWSWN  240
           GEAIFHFLPVGI WSVTRK GTTQILGIVLGICLVSPQLLNAY+VA T  A +IAKNW W+
Sbjct: 181 GEAIFHFLPVGITWSVTRKMGTTQILGIVLGICLVSPQLLNAYAVAGTPAAEIAKNWVWD  240

Query: 241 FGYFTVQKIGYQAQVIPALLAGLSLSYLEIFWRKHIPEVVSMIFVPFLSLVPAIILAHTV  300
           FG+FT+ +IGYQAQVIPALLAGLSL+YLEIFWRK IPEVVSMIFVPFLSL+PA+ILAHTV
Sbjct: 241 FGFFTINRIGYQAQVIPALLAGLSLAYLEIFWRKRIPEVVSMIFVPFLSLIPALILAHTV  300

Query: 301 LGPIGWTLGKWISAIVLIGLTGPVKWLFGAIFGALYAPFVITGLHHMTNAIDTQLIADTK  360
           LGPIGWT+GK IS +VL GLTGPVKWLFGAIFGALYAP VITGLHHMTNAIDTQLIADT
Sbjct: 301 LGPIGWTIGKGISFVVLAGLTGPVKWLFGAIFGALYAPLVITGLHHMTNAIDTQLIADTA  360

Query: 361 THTTGLWPMIALSNIAQGSAVLAYYFMHRDEKEAQISLPAAISAYLGVTEPALFGVNVK  420
           T TTGLWPMIALSNIAQGSAV  AYY M+RH+E+EA ISLPAAISAYLGVTEPALFGVNVK
Sbjct: 361 TRTTGLWPMIALSNIAQGSAVFAYYLMNRHEEREAEISLPAAISAYLGVTEPALFGVNVK  420

Query: 421 YIYPFVAGMIGSSVAGLLATTFNVQANSIGVGGLPGFLSINVKYMGYFFICMAVAIFIPL  480
           Y+YPFVAGMIGS +AGLL+TTFNVQANSIGVGGLPGF++INVKYM  FFICMAVAI +P+
```

-continued

```
Sbjct: 421 YVYPFVAGMIGSGIAGLLSTTFNVQANSIGVGGLPGFMAINVKYMIPFFICMAVAIVVPM 480

Query: 481 FLTLFFKKSGILTKTEEEKLVPDAVIASTTETKSAKEKAVVSGTKLSVVSPLSGLAKPLD 540
           FLT FF+KS I+TKTE+E  +P+  + S      +A  K  + GT +++ SPL+G  K L
Sbjct: 481 FLTFFFRKSHIMTKTEDEAKLPETPV-SDAPVATAPHK- TMQGTVITLTSPLTGEVKALS 538

Query: 541 QASDPVFSQGIMGKGVVIDPSDGELVSPVDATVSVLFPTKHAIGLLTSEGVEFLIHIGMD 600
           +A DPVF+QG+MG+G ++ P++G LV+P DA VSVLFPTKHAI L+T+EG+E L+HIGMD
Sbjct: 539 EAVDPVFAQGVMGQGALLQPTEGVLVAPCDAEVSVLFPTKHAICLVTTEGLELLMHIGMD 598

Query: 601 TVNLEGKGFTSHVAQGDTVKVGDKLITFDIPMIKEEGYIVETPILITNQQEFRPEELIDL 660
           TVNL+G+GF + V QGD VK G  LI FDI  I E GY  ETP+++TNQ  F       L
Sbjct: 599 TVNLDGQGFEALVKQGDQVKAGQTLIQFDIAAISEAGYATETPLVVTNQDVFTVTVEGSL 658

Query: 661 PKQIKRGQALMVAKK                                              675
           P+QIK    L VA K
Sbjct: 659 PRQIKVNDKLAVAVK                                              673
```

Based on this analysis, it was predicted that these proteins and their epitopes could be useful antigens for vaccines or diagnostics.

EXAMPLE 146

A DNA sequence (GBSx0052) was identified in *S. agalactiae* <SEQ ID 487> which encodes the amino acid sequence <SEQ ID 488>. This protein is predicted to be dextran glucosidase DexS (treC). Analysis of this protein sequence reveals the following:

```
Possible site: 48
>>> Seems to have no N-terminal signal sequence

----- Final Results -----
            bacterial cytoplasm --- Certainty = 0.3493(Affirmative) < succ>
             bacterial membrane --- Certainty = 0.0000(Not Clear)   < succ>
              bacterial outside --- Certainty = 0.0000(Not Clear)   < succ>
```

The protein has homology with the following sequences in the GENPEPT database:

```
>GP: AAB65079 GB: U35633 dextran glucosidase DexS [Streptococcus suis]
Identities = 383/547 (70%), Positives = 439/547 (80%), Gaps = 13/547 (2%)

Query:   1 MTIDKRKVVYQIYPKSYKDTTGNGVGDLRGIIEKLPYLAELGIDMVWLNPFYPSPQRDNG   60
           MTIDKRKVVYQIYPKSYKDTTGNGVGDLRGIIEKLPYL ELGIDM+WLNPFYPSPQRDNG
Sbjct:   1 MTIDKRKVVYQIYPKSYKDTTGNGVGDLRGIIEKLPYLKELGIDMIWLNPFYPSPQRDNG   60

Query:  61 YDISDYTAINPDFGTMDDFEEMIEVGRQYRIDFMLDMVLNHCSIEHEWFKKALAGDRYYQ  120
           YDISDYTA+NPDFGTM DFEEM+ VG++  I+FMLDMVLNHCS +HEWF+KAL+GD+YYQ
Sbjct:  61 YDISDYTAVNPDFGTMADFEEMVTVGKELGIEFMLDMVLNHCSTDHEWFQKALSGDQYYQ  120

Query: 121 DFFILRDNPTDWVSKFGGNAWAPFGDTGKYYLHLFDITQADLNWRNADVRKELFKVVNFW  180
           DFFILRD PTDWVSKFGGNAWAPFGDTGKYYLHLFD+TQADLNWRN +R+ELFKVVNFW
Sbjct: 121 DFFILRDQPTDWVSKFGGNAWAPFGDTGKYYLHLFDVTQADLNWRNPHIREELFKVVNFW  180

Query: 181 RDKGVKGFRFDVINLIGKDEILENCPINDGKPAYTDRPITHDYLKMLNNASFGQDDSFMT  240
           +DKGVKGFRFDVINLIGKDE   E+CPINDGKPAYTDRPITHDYLKM+NNA+FG +  FMT
Sbjct: 181 KDKGVKGFRFDVINLIGKDEAREDCPINDGKPAYTDRPITHDYLKMMNNATFGSEKGFMT  240

Query: 241 VGEMSSTTIANCILYTAPEREELSMAFNFHHLKVDYKDGQKWTIMAFDFPALRDLFHSWG  300
           VGEMS+TTI NCILYTAPER+ELSMAFNFHHLKVDYKDGQKWTIM FDF  L+ LFH+WG
Sbjct: 241 VGEMSATTIENCILYTAPERKELSMAFNFHHLKVDYKDGQKWTIMDFDFEELKHLFHTWG  300

Query: 301 EGMSEGNGWNALFYNNHDQPRALNRFVDVKRFRNEGATMLAASIHLSRGTPYIYMGEEIG  360
           E MS GNGWNALFYNNHDQPRALNRF+DV+ FR EGATMLAASIHLSRG
Sbjct: 301 EEMSVGNGWNALFYNNHDQPRALNRFIDVENFRKEGATMLAASIHLSRGNNLTST-----  355

Query: 361 MLDPDYSSMDDYVDIESLNAYQIMLDEGKSQEEAFSIIRAKSRDNSRVPMQWDDS-----  415
              +    SS  +    +++    S   +  R   SR +    P+
Sbjct: 356 WVRRSVSSTLTTIAWTTTWTWSLSMPTRCSWTKVTRLSR-PSRLSRPSPVTIPAPRCNGT  414

Query: 416 --TNAGFSEGAPWLKVGKSYKEINVAKEKTGLIFTFYQELIRLRKQLPIIADGNYKAAFK  473
               T    +  PWLK GKSY+ INV +EKTG IFTFY+    LRK+LP+I++G+YKAA+K
Sbjct: 415 LLTMQASQQATPWLKAGKSYQTINVEQEKTGPIFTFYKRTHPLRKELPLISEGDYKAAYK  474
```

```
Query: 474 DNEKVYAFERHLDKEKLLVLNNFFAEKVKIKLPENYLQGQVLLSNYKDVTLDETVTLQPY 533
           D++KVYAFER L+ EKLLVLNNFFAE+V++ L ++Y  GQVL+SNY D  L + + L+PY
Sbjct: 475 DSQKVYAFERLLNDEKLLVLNNFFAEEVELDLADDYAHGQVLISNYPDNKLGKKIILKPY 534

Query: 534 QTLAILV                                                     540
           Q LAI V
Sbjct: 535 QALAIQV                                                     541
```

A related DNA sequence was identified in *S. pyogenes* <SEQ ID 489> which encodes the amino acid sequence <SEQ ID 490>. Analysis of this protein sequence reveals the following:

```
Possible site: 56
>>> Seems to have no N-terminal signal sequence

----- Final Results -----
         bacterial cytoplasm --- Certainty = 0.3631(Affirmative) < succ>
         bacterial membrane  --- Certainty = 0.0000(Not Clear)   < succ>
         bacterial outside   --- Certainty = 0.0000(Not Clear)   < succ>
```

An alignment of the GAS and GBS proteins is shown below:

```
Identities = 431/539 (79%), Positives = 486/539 (89%)

Query:   1 MTIDKRKVVYQIYPKSYKDTTGNGVGDLRGIIEKLPYLAELGIDMVWLNPFYPSPQRDNG  60
           MTIDK+KVVYQIYPKSYKDTTGNGVGDL GII+KLPYL ELGIDM+WLNPFYPSPQRDNG
Sbjct:   1 MTIDKKKVVYQIYPKSYKDTTGNGVGDLLGIIDKLPYLQELGIDMIWLNPFYPSPQRDNG  60

Query:  61 YDISDYTAINPDFGTMDDFEEMIEVGRQYRIDFMLDMVLNHCSIEHEWFKKALAGDRYYQ 120
           YD+SDYTA+NPDFGTM DFE +++  ++++I+ MLDMVLNHCS +HEWF+KALAGD YYQ
Sbjct:  61 YDVSDYTAVNPDFGTMADFENLVKAAKEHQIELMLDMVLNHCSTDHEWFQKALAGDPYYQ 120

Query: 121 DFFILRDNPTDWVSKFGGNAWAPFGDTGKYYLHLFDITQADLNWRNADVRKELFKVVNFW 180
           DFFILRD PTDWVSKFGGNAWAPFGDTGKYYLHLFD+TQADLNWRN  VR+EL KVVNFW
Sbjct: 121 DFFILRDQPTDWVSKFGGNAWAPFGDTGKYYLHLFDVTQADLNWRNPHVREELAKVVNFW 180

Query: 181 RDKGVKGFRFDVINLIGKDEILENCPINDGKPAYTDRPITHDYLKMLNNASFGQDDSFMT 240
           RDKGVKGFRFDVINLIGKDE L +CP+NDGKPAYTDRPITH YL  LN ASFGQDDSFMT
Sbjct: 181 RDKGVKGFRFDVINLIGKDEELVDCPVNDGKPAYTDRPITHTYLHDLNQASFGQDDSFMT 240

Query: 241 VGEMSSTTIANCILYTAPEREELSMAFNFHHLKVDYKDGQKWTIMAFDFPALRDLFHSWG 300
           VGEMS+TTI NC+LYTAPEREELSMAFNFHHLKVDY++GQKWTIMAFDF ALRDLFH+WG
Sbjct: 241 VGEMSATTIDNCLLYTAPEREELSMAFNFHHLKVDYENGQKWTIMAFDFAALRDLFHAWG 300

Query: 301 EGMSEGNGWNALFYNNHDQPRALNRFVDVKRFRNEGATMLAASIHLSRGTPYIYMGEEIG 360
           EGMS+GNGWNALFYNNHDQPRALNRFVDV  FRNEGATMLAASIHLSRGTPYIYMGEEIG
Sbjct: 301 EGMSQGNGWNALFYNNHDQPRALNRFVDVTHFRNEGATMLAASIHLSRGTPYIYMGEEIG 360

Query: 361 MLDPDYSSMDDYVDIESLNAYQIMLDEGKSQEEAFSIIRAKSRDNSRVPMQWDDSTNAGF 420
           MLDPD+ SMDDYVD+ESLNAY +L  GKS EEAF+II+AKSRDN+R PMQWD S +AGF
Sbjct: 361 MLDPDFDSMDDYVDVESLNAYSSLLVSGKSAEEAFAIIKAKSRDNARTPMQWDASEHAGF 420

Query: 421 SEGAPWLKVGKSYKEINVAKEKTGLIFTFYQELIRLRKQLPIIADGNYKAAFKDNEKVYA 480
            + G PWL+VGKSY++INV  EK G IF FYQ LI LRK+LPIIA+G+Y+AAFKD++ VYA
Sbjct: 421 TTGKPWLEVGKSYRDINVETEKEGRIFPFYQRLIALRKELPIIAEGDYRAAFKDSQAVYA 480

Query: 481 FERHLDKEKLLVLNNFFAEKVKIKLPENYLQGQVLLSNYKDVTLDETVTLQPYQTLAIL  539
           FERHL +  LLVLN+F+A++V+++LP Y  GQVL+SNY+ V++ E V L+PYQTLAIL
Sbjct: 481 FERHLGDQCLLVLNHFYADEVELELPPRYQHGQVLISNYEKVSICEKVILKPYQTLAIL  539
```

Based on this analysis, it was predicted that these proteins and their epitopes could be useful antigens for vaccines or diagnostics.

EXAMPLE 147

A DNA sequence (GBSx0153) was identified in *S. agalactiae* <SEQ ID 491> which encodes the amino acid sequence <SEQ ID 492>. Analysis of this protein sequence reveals the following:

```
Possible site: 29
>>> Seems to have an uncleavable N-term signal seq
       INTEGRAL    Likelihood = -3.03    Transmembrane    8-24 (8-25)

----- Final Results -----
              bacterial membrane --- Certainty = 0.2211(Affirmative) < succ>
              bacterial outside  --- Certainty = 0.0000(Not Clear)   < succ>
              bacterial cytoplasm --- Certainty = 0.0000(Not Clear)  < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 148

A DNA sequence (GBSx0154) was identified in *S. agalactiae* <SEQ ID 493> which encodes the amino acid sequence <SEQ ID 494>. Analysis of this protein sequence reveals the following:

```
Possible site: 57
>>> Seems to have a cleavable N-term signal seq.

----- Final Results -----
              bacterial outside  --- Certainty = 0.3000(Affirmative) < succ>
              bacterial membrane --- Certainty = 0.0000(Not Clear)   < succ>
              bacterial cytoplasm --- Certainty = 0.0000(Not Clear)  < succ>
```

The protein has homology with the following sequences in the GENPEPT database:

```
>GP: BAB03939 GB: AP001507 unknown conserved protein
[Bacillus halodurans]
Identities = 190/639 (29%), Positives = 331/639 (51%), Gaps = 34/639 (5%)

Query:   6 TVVIMLVFLARKNLSLYELTVQTKFSIKVIIEQINYLNSFLAKNHLPAIAHSAGRYQLLG  65
           T ++  +  AR  L + ELT +    S + +    + +NS+L + L A+ +      L+
Sbjct:   8 TFILTQLLHARSYLPIQELTQKLNVSRRTVYNDLEKINSWLEEQGLKAV-YKVRSQGLIL  66

Query:  66 DEKEHDKI---VSLLEAEQFYLTQEERVCLIYLYSFCRREFVSNVHYQDFLKVSKNTTLS 122
           DE+ ++I   + L++ +  + +ER  ++Y   R E +   H  D    VS+NTT+
Sbjct:  67 DERAKEEIPTKLRSLKSWHYEYSAQERKAWVVIYLLTRLEPLFLEHLMDRTGVSRNTTID 126

Query: 123 DIKMLRSKLAKRGISLTYTRAKGYSLVGDEMDKHQVAFQMITQLLE--------SPIGFW 174
           DIK L+ +L    ++L + R  GY++ GDE DK +    ++Q L         SPI  +
Sbjct: 127 DIKCLKDELNNFHLALEFERKDGYTISGDETDKRKALVYYLSQALPQQNWETELSPIRIF 186

Query: 175 SLNYILSSWKFALSYEKLEKTVEYFYESFQLSPIQ---DRLEKSLYFIILILCRYQRSVD 231
               +  F + E+L+K +   ES ++ IQ    D L       +L + R +
Sbjct: 187 LRTKRDNGRIFTI--EELQKVYDVISESEKVLKIQYTDDVLHSLSLRFLLFMKRVAKG--  242

Query: 232 RVLQGSPIVSEQLK-----ELTTIIVTNLSQDISLSKPLDQKEKDYITLILSGCF----- 281
            + ++  P+ + LK       E  ++  L Q  + P D++      T ILS
Sbjct: 243 KFIKVHPLEKQVLKGTKEYEAAKVMSFKLEQAFGVHYP-DEEVLYLTTHILSSKINYANG  301

Query: 282 EGEGTKDDDFFEALAKAIVDEMETVSLLNFSNKEELLQGLKRHIIPAYFRLKYGLTGDSG 341
           E E  K+      +  ++V++ +  + + F  KE L + L   HI  PA++R+KYGL ++
Sbjct: 302 EIESRKESQELTHIVTSMVNDFQKYACVVFEEKELLEKNLFFHIKPAFYRIKYGLEVENN  361

Query: 342 YTQNIKEHYSDLFLLVKKALRPLEEQVGL-IPDSEISYFVIHFGGYLRQSGGTQSMSYKA 400
           ++IK Y +LFLL +K + LE  VG  +D+E+++  +HF G++R+  G    + KA
Sbjct: 362 IAESIKTSYPELFLLTRKVVHYLERYVGKSVNDNEVAFITMHFVGWMRREGTIPTKRKKA 421

Query: 401 LILCPNGVSSSLVIKEKLRGLFPQIHFHRVSKIEQLKLIDNQTYDMVFSTIFVETKKPNY 460
           LI+C NGV +S   +K +L GLFP +  +  I + +     ++ +T   E    P +
Sbjct: 422 LIVCANGVGTSQFLKNQLEGLFPAVDIIKTCSIREYEKTPVEVDFIISTTSIPEKNVPIF 481

Query: 461 LVSLMMT-AEQVQQLKELVISDFPKACLDDFQLDQLIATIKKYAHVHCEEELKLALRTMV 519
            +V+ ++T  E+ + LK + ++      +  + ++ L+  IK++ +V  E+ L   LR
```

```
                           -continued
Sbjct: 482 IVNPILTETEKERLLKSVHVALDELGAMKGYSIEGLMDVIKRHGNVDDEKALYQDLRRFF 541

Query: 520 KQD--ILRKDVRPLLHQLITEETYQTSSEQMNWKEAIRLAAKPLLASGKITESYPEAMIE 577
               Q    I  K  +P L+QL+TE+   Q   +  +W+EAI+LAAKPLL   G +TESY + MI+
Sbjct: 542 TQPTPIGPKQEKPDLNQLLTEDMIQLREQVTHWQEAIQLAAKPLLLKGMVTESYVKKMIK 601

Query: 578 KVEEFGPFINLGKGIAIPHARPEDGVNSVGMSMLVLEQP                      616
               +E+FGP++ +     AIPHA+PEDGV  +GMS+L L++P
Sbjct: 602 NIEKFGPYMIIAPHFAIPHAKPEDGVRQLGMSLLWLKKP                      640
```

A related DNA sequence was identified in *S. pyogenes* <SEQ ID 495> which encodes the amino acid sequence <SEQ ID 496>. Analysis of this protein sequence reveals the following:

```
Possible site: 57 or 61
>>> Seems to have no N-terminal signal sequence
    INTEGRAL      Likelihood = -0.64    Transmembrane    123-139 (123-139)

----- Final Results -----
                bacterial membrane --- Certainty = 0.1256(Affirmative) < succ>
                 bacterial outside --- Certainty = 0.0000(Not Clear)   < succ>
                bacterial cytoplasm --- Certainty = 0.0000(Not Clear)  < succ>
```

An alignment of the GAS and GBS proteins is shown below:

```
Identities = 187/624 (29%), Positives = 327/624 (51%), Gaps = 20/624 (3%)

Query:   1 MVDNKTVVIMLVFLARKNLSLYELTVQTKFSIKVIIEQINYLNSFLAKNHLPAIAHSAGR   60
             M+ ++ +     +F   K  SL      K S + I+   I  +N  L+    LP IA
Sbjct:  35 MLSHELIRNYQLFSKYKGHSLEAFESILKASKRHILADIAKINDTLSLYQLPLIALDR--   92

Query:  61 YQLL--GDEKEHDKIVSLLEAEQFYLTQEERVCLIYLYSFCRREFVSNVHYQDFLKVSKN  118
             QL+    D   E D +   +L       YL Q+ER+ +I +Y       +EF+S  H +   L++S+N
Sbjct:  93 -QLVYPPDLTEKDLLNRMLPTLDDYLFQDERLDMIIIYIMMAKEFISINHLESLLRLSRN  151

Query: 119 TTLSDIKMLRSKLAKRGISLTYTRAKGYSLVGDEMDKHQVAFQMITQLLESPIGFWSLNY  178
             + ++D+ ++R ++    ++L Y R  GY   G+ +   ++     ++ LL+    G W  +Y
Sbjct: 152 SVIADLNLVRDRVQAFQVTLAYNRQDGYFFEGEPLALRRLLESAVSSLLQVTSGPWVFSY  211

Query: 179 ILSSWKFALSYEKLEKTVEYFYESFQLSPIQDRLEKSLYFIILILCR-YQRSVD-RVLQG  236
             +L         + +   T+E       L+ I ++L     +YF  L+  R + R+V     +
Sbjct: 212 LLHELGLPDQKKVMAATLEELSRENHLTFISEKLRDLIYFFCLLAHRPFSRNVRAEAVDT  271

Query: 237 SPIVSEQLKELTTIIVTNLSQDISLSKPLDQKEKDYITLILSGCFEG--EGTKDDDFFEA  294
             P+ S  ++  +    ++N         P    +EK    L GC +G   E          ++
Sbjct: 272 FPPLASPAVETMVDQLLVNF--------PSLTEEKYLVQSRLLGCIQGDLELVFQQPIYDI  323

Query: 295 LAKAIVDEMETVSLLNFSNKEELLQGLKRHIIPAYFRLKYGLTGDSGYTQNIKEHYSDLF  354
             +  + I++ +    + L+ ++    EL Q L  H++PAY+RL Y +       + IK+ Y  LF
Sbjct: 324 MEE-IINSVAVNTGLSITDTPELRQNLYSHLLPAYYRLYYDINLTNPLKEQIKQDYESLF  382

Query: 355 LLVKKALRPLEEQVGL-IPDSEISYFVIHFGGYLRQSGGTQSMSYKALILCPNGVSSSLV  413
             L+VK++L  PLE+Q+G   + +   E++YF IHFG +L+         S    AL +CPNG+SSSL+
Sbjct: 383 YLVKRSLSPLEKQLGKSVNEDEVAYFTIHFGRWLQAPKKRPSNQLVALSVCPNGISSSLM  442

Query: 414 IKEKLRGLFPQIHFHRVSKIEQLKLIDNQTYDMVFSTIFVETKKPNYLVSLMMTAEQVQQ  473
             ++   L+ LFPQ+ F R+    +++++KL+D  ++D++FST+    +  KP Y+   +M       +
Sbjct: 443 LEATLKELFPQLQFIRIHQLDKIKLLDPASFDLIFSTVAFDCAKPVYVTQALMGPVEKMM  502

Query: 474 LKELVISDFPKACLDDFQLDQLIATIKKYAHVHCEEELKLAL-RTMVKQDILRKDVRPLL  532
             LK++V  DF   + F LD L++ I K+      +E L    L R ++      +      L
Sbjct: 503 LKKMVCDDFHLPLSEQFALDDLLSIIHKHTTITNKEGLVSDLSRYLIGNHLTIEKGGLGL  562

Query: 533 HQLITEETYQTSSEQMNWKEAIRLAAKPLLASGKITESYPEAMIEKVEEFGPFINLGKGI  592
             L+T +   + +      +W+EAIRLAA+PLL    I  SY +  MI+ V E G +I L    +
Sbjct: 563 LDLLTADFIRQADAVSDWQEAIRLAAQPLLEHQMIETSYIDGMIDSVNELGAYIVLAPKV  622

Query: 593 AIPHARPEDGVNSVGMSMLVLEQP                                     616
             A+PHA PE G   +GMS+L L++P
Sbjct: 623 AVPHAAPEKGTRQLGMSLLQLKEP                                     646
```

Based on this analysis, it was predicted that these proteins and their epitopes could be useful antigens for vaccines or diagnostics.

EXAMPLE 149

A DNA sequence (GBSx0155) was identified in *S. agalactiae* <SEQ ID 497> which encodes the amino acid sequence <SEQ ID 498>. Analysis of this protein sequence reveals the following:

```
Possible site: 22
>>> Seems to have no N-terminal signal sequence

----- Final Results -----
          bacterial cytoplasm --- Certainty = 0.3665(Affirmative) < succ>
          bacterial membrane  --- Certainty = 0.0000(Not Clear)   < succ>
          bacterial outside   --- Certainty = 0.0000(Not Clear)   < succ>
```

The protein has no significant homology with any sequences in the GENPEPT database.

A related DNA sequence was identified in *S. pyogenes* <SEQ ID 499> which encodes the amino acid sequence <SEQ ID 500>. Analysis of this protein sequence reveals the following:

```
Possible site: 22
>>> Seems to have no N-terminal signal sequence

----- Final Results -----
          bacterial cytoplasm --- Certainty = 0.3665(Affirmative) < succ>
          bacterial membrane  --- Certainty = 0.0000(Not Clear)   < succ>
          bacterial outside   --- Certainty = 0.0000(Not Clear)   < succ>
```

An alignment of the GAS and GBS proteins is shown below:

```
Identities = 33/35 (94%), Positives = 35/35 (99%)

Query:  1 MEKEAKQIIDLKRNLFKIDVRAQKDEEKVFMRTAW 35
          +EKEAKQ+IDLKRNLFKIDVRAQKDEEKVFMRTAW
Sbjct:  1 LEKEAKQMIDLKRNLFKIDVRAQKDEEKVFMRTAW 35
```

Based on this analysis, it was predicted that these proteins and their epitopes could be useful antigens for vaccines or diagnostics.

EXAMPLE 150

A repeated DNA sequence (GBSx0156) was identified in *S. agalactiae* <SEQ ID 501> which encodes the amino acid sequence <SEQ ID 502>. This protein is predicted to be a repeat-associated protein in rhsc-phrb intergenic region. Analysis of this protein sequence reveals the following:

```
Possible site: 44
>>> Seems to have no N-terminal signal sequence

INTEGRAL    Likelihood = -4.57    Transmembrane    29-45 (28-48)

----- Final Results -----
          bacterial membrane  --- Certainty = 0.2826(Affirmative) < succ>
          bacterial outside   --- Certainty = 0.0000(Not Clear)   < succ>
          bacterial cytoplasm --- Certainty = 0.0000(Not Clear)   < succ>
```

A closely-related DNA sequence was identified in *S. agalactiae* <SEQ ID 1035> which encodes the amino acid sequence <SEQ ID 1036>. Further related GBS sequences are: <SEQ ID 9067>, <SEQ ID 9068>, <SEQ ID 9497>, <SEQ ID 9498>, <SEQ ID 9733>, <SEQ ID 9734>

A related repeated DNA sequence was identified in *S. pyogenes* <SEQ ID 503> which encodes the amino acid sequence <SEQ ID 504>. Analysis of this protein sequence reveals the following:

```
Possible site: 44
>>> Seems to have no N-terminal signal sequence
       INTEGRAL    Likelihood = -4.57    Transmembrane    29-45 (28-48)
```

```
----- Final Results -----
            bacterial membrane --- Certainty = 0.2826(Affirmative) < succ>
            bacterial outside  --- Certainty = 0.0000(Not Clear)   < succ>
            bacterial cytoplasm --- Certainty = 0.0000(Not Clear)  < succ>
```

A related GBS gene <SEQ ID 8547> and protein <SEQ ID 8548> were also identified. Analysis of this protein sequence reveals the following:

```
Lipop Possible site: -1 Crend: 5
McG: Discrim Score: -7.73
GvH: Signal Score (-7.5): -3.88
     Possible site: 44
>>> Seems to have no N-terminal signal sequence
ALOM program count: 1 value: -4.57 threshold: 0.0
     INTEGRAL        Likelihood = -4.57    Transmembrane   26-42 (25-45)
     PERIPHERAL      Likelihood = 2.12     334
modified ALOM score: 1.41
*** Reasoning Step: 3

----- Final Results -----
            bacterial membrane --- Certainty = 0.2826(Affirmative) < succ>
            bacterial outside  --- Certainty = 0.0000(Not Clear)   < succ>
            bacterial cytoplasm --- Certainty = 0.0000(Not Clear)  < succ>
```

A related DNA sequence was identified in *S. pyogenes* <SEQ ID 7071> which encodes the amino acid sequence <SEQ ID 7072>. An alignment of the GAS and GBS sequences follows:

```
Score = 767 bits (1960), Expect = 0.0
Identities = 375/377 (99%), Positives = 375/377 (99%)

Query:   4 MIDFIISIDDCAVELDSRQSWKIRSPLSTILFLVFVCQLAGIETWKEMEDFIEMNEPLFA   63
           MIDFIISIDDCAVELDSRQSWKIR PLSTILFLVFVCQLAGIETWKEMEDFIEMNEPLFA
Sbjct:   1 MIDFIISIDDCAVELDSRQSWKIRYPLSTILFLVFVCQLAGIETWKEMEDFIEMNEPLFA   60

Query:  64 TYVDLSEGCSSHDTLERVISLVNSDRLKELKVQFEQSLTSLDAVHQLISVDGKTIRGNRG  123
           TYVDLSEGC SHDTLERVISLVNSDRLKELKVQFEQSLTSLDAVHQLISVDGKTIRGNRG
Sbjct:  61 TYVDLSEGCPSHDTLERVISLVNSDRLKELKVQFEQSLTSLDAVHQLISVDGKTIRGNRG  120

Query: 124 KNQKPVHIVTAYDGGHHLSLGQVAVEEKSNEIVAIPQLLRTIDIRKSIVTIDAMGTQTAI  183
           KNQKPVHIVTAYDGGHHLSLGQVAVEEKSNEIVAIPQLLRTIDIRKSIVTIDAMGTQTAI
Sbjct: 121 KNQKPVHIVTAYDGGHHLSLGQVAVEEKSNEIVAIPQLLRTIDIRKSIVTIDAMGTQTAI  180

Query: 184 VDTIIKGKADYCLAVKGNQETLYDDIALYFSDVNLLEELQENAQYYQTVEKSRGQIEVRE  243
           VDTIIKGKADYCLAVKGNQETLYDDIALYFSDVNLLEELQENAQYYQTVEKSRGQIEVRE
Sbjct: 181 VDTIIKGKADYCLAVKGNQETLYDDIALYFSDVNLLEELQENAQYYQTVEKSRGQIEVRE  240

Query: 244 YWVSSDIKWLCQNHPKWHKLRGIGMTRNTIDKDGQLSQENRYFIFSFKPDVLTFANCVRG  303
           YWVSSDIKWLCQNHPKWHKLRGIGMTRNTIDKDGQLSQENRYFIFSFKPDVLTFANCVRG
Sbjct: 241 YWVSSDIKWLCQNHPKWHKLRGIGMTRNTIDKDGQLSQENRYFIFSFKPDVLTFANCVRG  300

Query: 304 HWQIESMHWLLDVVYHEDHHQTLDKRAAFNLNLIRKMCLYFLKVMVFPKKDLSYRRKQRY  363
           HWQIESMHWLLDVVYHEDHHQTLDKRAAFNLNLIRKMCLYFLKVMVFPKKDLSYRRKQRY
Sbjct: 301 HWQIESMHWLLDVVYHEDHHQTLDKRAAFNLNLIRKMCLYFLKVMVFPKKDLSYRRKQRY  360

Query: 364 ISVHLEDYLVQLFGERG                                            380
           ISVHLEDYLVQLFGERG
Sbjct: 361 ISVHLEDYLVQLFGERG                                            377
```

A further related DNA sequence was identified in *S. pyogenes* <SEQ ID 9087> which encodes the amino acid sequence <SEQ ID 9088>. A further related DNA sequence was identified in *S. pyogenes* <SEQ ID 9089> which encodes the amino acid sequence <SEQ ID 9090>. The GAS and GBS proteins are 100% identical.

There is also homology to SEQ IDs 7018 and 8548.

SEQ ID 8548 (GBS318) was expressed in *E. coli* as a GST-fusion product. SDS-PAGE analysis of total cell extract is shown in FIG. 46 (lane 5; MW 70 kDa).

Figure 203:
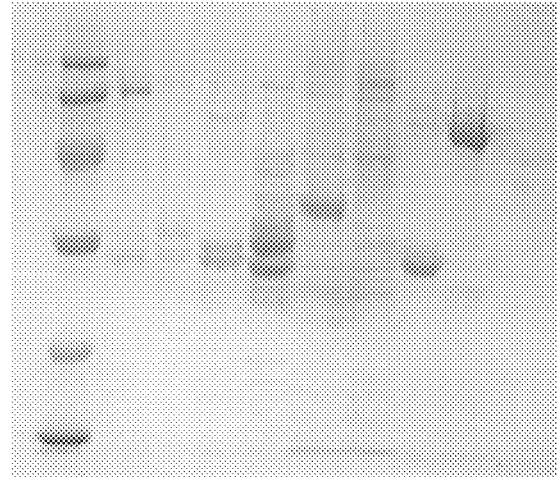

GBS318-GST was purified as shown in FIG. 203, lane 3.

Based on this analysis, it was predicted that these proteins and their epitopes could be useful antigens for vaccines or diagnostics.

EXAMPLE 151

A DNA sequence (GBSx0157) was identified in *S. agalactiae* <SEQ ID 505> which encodes the amino acid sequence <SEQ ID 506>. Analysis of this protein sequence reveals the following:

```
Possible site: 34
>>> Seems to have an uncleavable N-term signal seq

----- Final Results -----
          bacterial membrane --- Certainty = 0.0000(Not Clear) < succ>
          bacterial outside  --- Certainty = 0.0000(Not Clear) < succ>
          bacterial cytoplasm --- Certainty = 0.0000(Not Clear) < succ>
```

The protein has no significant homology with any sequences in the GENPEPT database, but there is homology to SEQ ID 496.

Based on this analysis, it was predicted that this protein and its epitopes, could be useful antigens for vaccines or diagnostics.

EXAMPLE 152

A repeated DNA sequence (GBSx0158) was identified in *S. agalactiae* <SEQ ID 507> which encodes the amino acid sequence <SEQ ID 508>. Analysis of this protein sequence reveals the following:

```
Possible site: 48
>>> Seems to have no N-terminal signal sequence

----- Final Results -----
          bacterial cytoplasm --- Certainty = 0.1054(Affirmative) < succ>
          bacterial membrane  --- Certainty = 0.0000(Not Clear)   < succ>
          bacterial outside   --- Certainty = 0.0000(Not Clear)   < succ>
```

The protein has homology with the following sequences in the GENPEPT database:

```
>GP: BAB03941 GB: AP001507 unknown conserved protein [Bacillus halodurans]
Identities = 26/82 (31%), Positives = 52/82 (62%), Gaps = 2/82 (2%)

Query:  2 LRIGTACGSGLGSSFMVQMNIESILKDLGVSDVEVEHYDLGGADPSAADVWIVGRDLEDS   61
          ++I   CG G G+S +++MN+E++L  LG++  +V++ D+  A    +D  I  ++L +S
Sbjct:  1 MKILCVCGLGQGTSLILKMNVETVLSQLGIA-ADVDNTDVSSASSEQSDFIITSKELAES   59

Query: 62 -AGHLGDVRILNSIIDMDELRE                                         82
           A H    + I+N+  DM+E+++
Sbjct: 60 LASHPSKIVIVNNYFDMEEIKQ                                         81
```

A related DNA sequence was identified in *S. pyogenes* <SEQ ID 509> which encodes the amino acid sequence <SEQ ID 510>. Analysis of this protein sequence reveals the following:

```
Possible site: 48
>>> Seems to have an uncleavable N-term signal seq

----- Final Results -----
          bacterial membrane  --- Certainty = 0.0000(Not Clear) < succ>
          bacterial outside   --- Certainty = 0.0000(Not Clear) < succ>
          bacterial cytoplasm --- Certainty = 0.0000(Not Clear) < succ>
```

An alignment of the GAS and GBS proteins is shown below:

```
Identities = 27/90 (30%), Positives = 51/90 (56%), Gaps = 1/90 (1%)

Query:  1 MLRIGTACGSGLGSSFMVQMNIESILKDLGVSDVEVEHYDLGGADPSAADVWIVGRDLED   60
          M++I T CG+G+GSS +++M +E+I   LG+ DV+ E  D   A    AD+++  ++ +D
Sbjct:  8 MIKIVTVCGNGIGSSLLLRMKVEAIASSLGI-DVDAESCDSNAAVGKGADLFVTVKEFKD   66

Query: 61 SAGHLGDVRILNSIIDMDELRELVTGICQE                                90
            V  I+ S  +  ++ E +   + +E
Sbjct: 67 IFPEDAKVCIVKSYTNRKKIEEDLVPVLKE                                96
```

Based on this analysis, it was predicted that these proteins and their epitopes could be useful antigens for vaccines or diagnostics.

EXAMPLE 153

A DNA sequence (GBSx0159) was identified in *S. agalactiae* <SEQ ID 511> which encodes the amino acid sequence <SEQ ID 512>. Analysis of this protein sequence reveals the following:

```
Possible site: 20
>>> Seems to have an uncleavable N-term signal seq

----- Final Results -----
            bacterial membrane --- Certainty = 0.0000(Not Clear) < succ>
            bacterial outside  --- Certainty = 0.0000(Not Clear) < succ>
           bacterial cytoplasm --- Certainty = 0.0000(Not Clear) < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 154

A DNA sequence (GBSx0160) was identified in *S. agalactiae* <SEQ ID 513> which encodes the amino acid sequence <SEQ ID 514>. This protein is predicted to be sgaT. Analysis of this protein sequence reveals the following:

```
Possible site: 16
>>> Seems to have a cleavable N-term signal seq.
      INTEGRAL    Likelihood = -14.97    Transmembrane    424-440  (411-447)
      INTEGRAL    Likelihood =  -8.86    Transmembrane    224-240  (221-248)
      INTEGRAL    Likelihood =  -7.27    Transmembrane    134-150  (124-167)
      INTEGRAL    Likelihood =  -7.11    Transmembrane    321-337  (314-349)
      INTEGRAL    Likelihood =  -6.64    Transmembrane    379-395  (370-397)
      INTEGRAL    Likelihood =  -6.21    Transmembrane     96-112  (94-115)
      INTEGRAL    Likelihood =  -6.05    Transmembrane    267-283  (257-289)
      INTEGRAL    Likelihood =  -3.13    Transmembrane     18-34   (17-35)
      INTEGRAL    Likelihood =  -2.55    Transmembrane    151-167  (151-167)
      INTEGRAL    Likelihood =  -0.32    Transmembrane     42-58   (42-58)

----- Final Results -----
            bacterial membrane --- Certainty = 0.6986(Affirmative) < succ>
            bacterial outside  --- Certainty = 0.0000(Not Clear)   < succ>
           bacterial cytoplasm --- Certainty = 0.0000(Not Clear)   < succ>
```

The protein has homology with the following sequences in the GENPEPT database:

```
>GP: CAB52363 GB: AL109747 putative integral membrane protein
[Streptomyces coelicolor A3(2)]
Identities = 202/453 (44%), Positives = 292/453 (63%), Gaps = 22/453 (4%)

Query:    7 FLVN-IASTPAILVALIAIIGLVLQKKGVPDIVKGGIKTFVGFLVVSGGTGIVQNSLNPF    65
            FLVN I  S PA L+ +I  +GL    KK V   V G IK  +G L+V  G G+V +SL+P
Sbjct:   10 FLVNEILSQPAYLIGIITAVGLAALKKSVGQTVGGAIKATLGLLLVGAGAGLVSSSLDPL    69

Query:   66 GKMFEHAFHLVGVVPNNEAIVAVALTKYGSATALIMLAGMIFNILIARFTKFKYIFLTGH   125
            G+M +      GV+P NEAIV +A +++G+  A +M+ G + ++ +ARFT  +Y+FLTGH
Sbjct:   70 GRMIQGTTGTHGVIPTNEAIVGIAQSEFGARVAWLMILGFLVSLALARFTPLRYVFLTGH   129

Query:  126 HTLYMACMIAVIFAVAGFTSFSLILFGGLALGIIMSVSPAFVQKYMIQLTGNDKVALGHF   185
              H  L+MA  ++  ++  A  AG    S   +++L  GG+  +GI++    PAF  +   ++TGND +A+GHF
Sbjct:  130 HMLFMATLLTIVMATAGQGSVAVVLGGGVLVGILLVALPAFAHPWTKKVTGNDTLAIGHF   189
```

-continued

```
Query: 186 GSLGYWLSGFIGGIVGDKSKSTEDIKFPKSLSFLRDSTVSITISMAIIYLIVAV------ 239
           G+ GY +SG  G +VG  S+STE++K P+ L FLRDS V+  +SM +IYL++++
Sbjct: 190 GTAGYIVSGATGQLVGKNSRSTEEMKLPEGLRFLRDSMVATALSMVLIYLVMSLLFLAKV 249

Query: 240 --------FAGEAYIAKEISNGVNGLVYALQLAGQFAAGVFVILAGVRLILGEIVPAFKG 291
                   FAG       ++ N L+ ++   QF  GV VIL GVR ILGE+VPAF+G
Sbjct: 250 GQDAAFKAFAGSG--GDPAADVGNYLMQSVMQGLQFGIGVAVILFGVRTILGELVPAFQG 307

Query: 292 ISEKLVPNSKPALDCPIVYPYAPNAVLIGFISSFVGGLVSMIVMI-----VTGTTVILPG 346
           I+  ++VP +KPALD PIV+PYA NAVLIGFI SF+GGL  + +I          G ++LPG
Sbjct: 308 IAGRVVPGAKPALDAPIVFPYAQNAVLIGFIFSFLGGLTGLAALIWVFNPAFGLALVLPG 367

Query: 347 VVPHFFCGATAGVIGNASGGVRGATIGAFVQGILISFLPIFLMPVLGGLGFKGSTFSDAD 406
           +VPHFF G   AGV GNA+GG RGA +G+F+ G+LI+FLP  L+    LG  G   +TF DAD
Sbjct: 368 LVPHFFTGGAAGVYGNATGGRRGAAVGSFLNGLLITFLPAILLKALGSFGEANTTFGDAD 427

Query: 407 FGLTGIILGALNHVGGAIAIVIGIVVILIGLFG                            439
           FG   G +LG++  + G   ++   ++    L+  L G
Sbjct: 428 FGWFGAVLGSIGKLDGTAGLIGMLIFGLLILAG                            460
```

A related DNA sequence was identified in *S. pyogenes* <SEQ ID 515> which encodes the amino acid sequence <SEQ ID 516>. Analysis of this protein sequence reveals the following:

```
Possible site: 34
>>> Seems to have a cleavable N-term signal seq.
    INTEGRAL    Likelihood = -8.33    Transmembrane    330-346 (315-353)
    INTEGRAL    Likelihood = -8.17    Transmembrane    227-243 (221-246)
    INTEGRAL    Likelihood = -4.62    Transmembrane    127-143 (126-145)
    INTEGRAL    Likelihood = -4.25    Transmembrane    269-285 (266-291)
    INTEGRAL    Likelihood = -3.77    Transmembrane     43-59  (41-62)
    INTEGRAL    Likelihood = -3.66    Transmembrane     98-114 (91-116)
    INTEGRAL    Likelihood = -2.76    Transmembrane    146-162 (145-163)
    INTEGRAL    Likelihood = -1.59    Transmembrane    308-324 (308-324)

----- Final Results -----
            bacterial membrane --- Certainty = 0.4333(Affirmative) < succ>
             bacterial outside --- Certainty = 0.0000(Not Clear)   < succ>
            bacterial cytoplasm --- Certainty = 0.0000(Not Clear)   < succ>
```

The protein has homology with the following sequences in the databases:

```
>GP: CAB52363 GB: AL109747 putative integral membrane protein
[Streptomyces coelicolor A3(2)]
Identities = 162/387 (41%), Positives = 245/387 (62%), Gaps = 17/387 (4%)

Query:   8 IRDILKEPAFLMGLIAFAGLVALKTPAHKVLTGTLGPILGYLMLVAGAGVIVTNLDPLAK  67
           + +IL +PA+L+G+I   GL ALK    + + G +  LG L++ AGAG++ ++LDPL +
Sbjct:  12 VNEILSQPAYLIGIITAVGLAALKKSVGQTVGGAIKATLGLLLVGAGAGLVSSSLDPLGR  71

Query:  68 LIEHGFSITGVVPNNEAVTSVAQKILGVETMSILVVGLLLNLAFARFTRFKYIFLTGHHS 127
           +I+      GV+P NEA+  +AQ  G     ++++G L++LA ARFT +Y+FLTGHH
Sbjct:  72 MIQGTTGTHGVIPTNEAIVGIAQSEFGARVAWLMILGFLVSLALARFTPLRYVFLTGHHM 131

Query: 128 FFMACLLSAVLGAVGFKGSLLIIL-DGFLLGAWSAISPAIGQQYTLKVTDGDEIAMGHFG 186
           FMA LL+ V+  G +GS+ ++L  G L+G      PA    +T KVT D +A+GHFG
Sbjct: 132 LFMATLLTIVMATAG-QGSVAVVLGGGVLVGILLVALPAFAHPWTKKVTGNDTLAIGHFG 190

Query: 187 SLGYYLSAWVGSKVGKDSKDTEDLQISEKWSFLRNTTISTGLIMVIFYLVAT---VASVL 243
           + GY +S  G  VGK+S+ TE++++ E    FLR++ ++T L MV+ YLV +     +A V
Sbjct: 191 TAGYIVSGATGQLVGKNSRSTEEMKLPEGLRFLRDSMVATALSMVLIYLVMSLLFLAKVG 250

Query: 244 RNASVAEELAAGQNP-------FIFAIKSGLTFAVGVAIVYAGVRMILADLIPAFQGIAN 296
           ++A+       +G +P        + ++  GL F +GVA++  GVR IL +L+PAFQGIA
Sbjct: 251 QDAAFKAFAGSGGDPAADVGNYLMQSVMQGLQFGIGVAVILFGVRTILGELVPAFQGIAG 310

Query: 297 KLIPNAIPAVDCAVFFPYAPTAVIIGFASSFVGGLLGMLIL-----GVAGGVLIIPGMVP 351
           +++P A PA+D +  FPYA  AV+IGF SF+GGL G+ L       G L++PG+VP
Sbjct: 311 RVVPGAKPALDAPIVFPYAQNAVLIGFIFSFLGGLTGLAALIWVFNPAFGLALVLPGLVP 370

Query: 352 HFFCGATAEIFGNSTGGRRGAMIGASL                                 378
           HFF G  A  +GN+TGGRRGA +G+ L
Sbjct: 371 HFFTGGAAGVYGNATGGRRGAAVGSFL                                 397
```

An alignment of the GAS and GBS proteins is shown below:

```
Identities = 174/376 (46%), Positives = 258/376 (68%), Gaps = 2/376 (0%)

Query:   1 MKGLLDFLVNIASTPAILVALIAIIGLVLQKKGVPDIVKGGIKTFVGFLVVSGGTGIVQN  60
           M+ LL F+ +I  PA L+ LIA  GLV K     ++ G +  +G+L++  G G++
Sbjct:   1 MEALLSFIRDILKEPAFLMGLIAFAGLVALKTPAHKVLTGTLGPILGYLMLVAGAGVIVT  60

Query:  61 SLNPFGKMFEHAFHLVGVVPNNEAIVAVALTKYGSATALIMLAGMIFNILIARFTKFKYI 120
           +L+P  K+ EH F + GVVPNNEA+ +VA     G  T   I++ G++ N+  ARFT+FKYI
Sbjct:  61 NLDPLAKLIEHGFSITGVVPNNEAVTSVAQKILGVETMSILVVGLLLNLAFARFTRFKYI 120

Query: 121 FLTGHHTLYMACMIAVIFAVAGFTSFSLILFGGLALGIIMSVSPAFVQKYMIQLTGNDKV 180
           FLTGHH+ +MAC+++ +    GF    LI+  G  LG    ++SPA Q+Y +++T D++
Sbjct: 121 FLTGHHSFFMACLLSAVLGAVGFKGSLLIILDGFLLGAWSAISPAIGQQYTLKVTDGDEI 180

Query: 181 ALGHFGSLGYWLSGFIGGIVGDKSKSTEDIKFPKSLSFLRDSTVSITISMAIIYLI--VA 238
           A+GHFGSLGY+LS ++G  VG  SK TED++  +   SFLR++T+S  + M I YL+  VA
Sbjct: 181 AMGHFGSLGYYLSAWVGSKVGKDSKDTEDLQISEKWSFLRNTTISTGLIMVIFYLVATVA 240

Query: 239 VFAGEAYIAKEISNGVNGLVYALQLAGQFAAGVFVILAGVRLILGEIVPAFKGISEKLVP 298
                A +A+E++ G N  ++A++     FA GV ++  AGVR+IL +++PAF+GI+  KL+P
Sbjct: 241 SVLRNASVAEELAAGQNPFIFAIKSGLTFAVGVAIVYAGVRMILADLIPAFQGIANKLIP 300

Query: 299 NSKPALDCPIVYPYAPNAVLIGFISSFVGGLVSMIVMIVTGTTVILPGVVPHFFCGATAG 358
           N+ PA+DC + +PYAP AV+IGF SSFVGGL+ M+++ V G  +I+PG+VPHFFCGATA
Sbjct: 301 NAIPAVDCAVFFPYAPTAVIIGFASSFVGGLLGMLILGVAGGVLIIPGMVPHFFCGATAE 360

Query: 359 VIGNASGGVRGATIGA                                             374
           + GN++GG RGA IGA
Sbjct: 361 IFGNSTGGRRGAMIGA                                             376
```

Based on this analysis, it was predicted that these proteins and their epitopes could be useful antigens for vaccines or diagnostics.

EXAMPLE 155

A DNA sequence (GBSx0161) was identified in *S. agalactiae* <SEQ ID 517> which encodes the amino acid sequence <SEQ ID 518>. This protein is predicted to be transketolase, N-terminal subunit (tkt). Analysis of this protein sequence reveals the following:

```
Possible site: 45
>>> Seems to have no N-terminal signal sequence

----- Final Results -----
          bacterial cytoplasm --- Certainty = 0.3680(Affirmative) < succ>
          bacterial membrane --- Certainty = 0.0000(Not Clear)   < succ>
           bacterial outside --- Certainty = 0.0000(Not Clear)   < succ>
```

The protein has homology with the following sequences in the GENPEPT database:

```
>GP: AAB98676 GB: U67515 transketolase' [Methanococcus jannaschii]
Identities = 106/269 (39%), Positives = 158/269 (58%), Gaps = 4/269 (1%)

Query:  11 LRRFATEIRLNTLETLNHLGFGHYGGSLSIVEALAVLYGDIMDINPEKFKESDRDYMVLS  70
           L + A ++R N ++ +     GH GGSLS + +   LY +M+ +P+    + DRD  VLS
Sbjct:  10 LEKIAKKVRYNIVKMVGLAKSGHPGGSLSATDIIVALYFKLMNYSPDNPYKKDRDRFVLS  69

Query:  71 KGHAGPALYSTLYLKGFFDKTFLHSLNTNGTKLPSHPDRNLTPGIDVTTGSLGQGISIAT 130
           KGHA PALY+  L   G ++   L  L        KL  HP  + TPG+++  TGSLGQG S A
Sbjct:  70 KGHAAPALYAVLSELGIIEEEELWKLRRLEGKLQGHPSMD-TPGVEICTGSLGQGFSAAV 128

Query: 131 GIAYAQKIENSSYYTYTIVGDELNEGQCWEAIQFAAHHQLHHLIVFVDDNKKQLDGLTA 190
           G+A    +++  + Y Y ++GDGE  EG   WEA   AAH++L +LI F+D NK Q+DG T
Sbjct: 129 GMALGCRLDKLNNYVYVLLGDGECQEGIVWEAAMAAAHYKLDNLIAFIDRNKLQIDGCTE 188

Query: 191 DICNPGDFVAKFEAFGFDAVRVKGDDIEAIDKAIKTFQDSNSVRPKCIVLDSIKGQGVKE 250
           D+ +   GD   AKFEAFG+D     + G + E I  ++ +    + +PK I+  ++KG+GV
Sbjct: 189 DVMSLGDIKAKFEAFGWDVFEIDGHNFEEIINTVEKAKSMKNGKPKMIIAYTVKGKGVSF 248
```

```
Query: 251 LEELASNHHLRPDLQQKTMLERALISLRE                                  279
            +E   + H    P+ +Q   L++AL  L E
Sbjct: 249 MENNVAFHGKAPNEEQ---LKQALEELSE                                   274
```

A related DNA sequence was identified in *S. pyogenes* <SEQ ID 519> which encodes the amino acid sequence <SEQ ID 520>. Analysis of this protein sequence reveals the following:

```
Possible site: 26
>>> Seems to have an uncleavable N-term signal seq
     INTEGRAL    Likelihood = -0.75    Transmembrane    58-74 (57-74)

----- Final Results -----
              bacterial membrane --- Certainty = 0.1298(Affirmative) < succ>
               bacterial outside --- Certainty = 0.0000(Not Clear)   < succ>
             bacterial cytoplasm --- Certainty = 0.0000(Not Clear)   < succ>
```

A related sequence was also identified in GAS <SEQ ID 9165> which encodes the amino acid sequence <SEQ ID 9166>. Analysis of this protein sequence reveals the following:

```
Possible site: 54
>>> Seems to have an uncleavable N-term signal seq
     INTEGRAL    Likelihood = -0.75    Transmembrane    40-56 (39-56)

----- Final Results -----
              bacterial membrane --- Certainty = 0.130(Affirmative) < succ>
               bacterial outside --- Certainty = 0.0000(Not Clear)  < succ>
             bacterial cytoplasm --- Certainty = 0.0000(Not Clear)  < succ>
```

An alignment of the GAS and GBS proteins is shown below:

```
Identities = 82/246 (33%), Positives = 129/246 (52%), Gaps = 15/246 (6%)

Query:  18 IRLNTLETLNHLGFGHYGGSLSIVEALAVLYGDIMDINPEKFKE-SDRDYMVLSKGHAGP   76
           +R +++ +    GH G +       VL+  M+INP+  + S+RD  +LS GH
Sbjct:  82 VRTLSMDAIQAANSGHPGLPMGAAPMAYVLWNHFMNINPKTSRNWSNRDRFILSAGHSA  141

Query:  77 ALYSTLYLKGF-FDKTFLHSLNTNGTKLPSHPDRNLTPGIDVTTGSLGQGISIATGIAYA  135
           LYS L+L G+       L +    G+K P HP+ N T G++ TTG LGQGI+ A G+A A
Sbjct: 142 MLYSLLHLAGYDLSVEDLKNFRQWGSKTPGHPEVNHTDGVEATTGPLGQGIANAVGMAMA  201

Query: 136 QK----------IENSSYYTYTIVGDGELNEGQCWEAIQFAAHHQLHHLIVFVDDNKKQL  185
            +            +   +YT+ + GDG+L EG  EA    A H +L  L++  D N   L
Sbjct: 202 EAHLAAKFNKPGFDIVDHYTFALNGDGDLMEGVSQEAASMAGHLKLGKLVLLYDSNDISL  261

Query: 186 DGLTADICNPGDFVAKFEAFGFDAVRVK-GDDIEAIDKAIKTFQDSNSVRPKCIVLDSIK  244
           DG T+ +    D   +FEA+G+  + VK G+D+E I  AI+  + + +P  I  +I
Sbjct: 262 DGPTS-MAFTEDVKGRFEAYGWQHILVKDGNDLEEIAAAIEAAK-AETEKPTIIEVKTII  319

Query: 245 GQGVKE                                                        250
           G G ++
Sbjct: 320 GFGAEK                                                        325
```

Based on this analysis, it was predicted that these proteins and their epitopes could be useful antigens for vaccines or diagnostics.

EXAMPLE 156

A DNA sequence (GBSx0162) was identified in *S. agalactiae* <SEQ ID 521> which encodes the amino acid sequence <SEQ ID 522>. Analysis of this protein sequence reveals the following:

```
Possible site: 43
>>> Seems to have no N-terminal signal sequence
INTEGRAL Likelihood = -0.27 Transmembrane 53-69 (53-69)
```

```
----- Final Results -----
         bacterial membrane --- Certainty = 0.1107 (Affirmative) < succ>
          bacterial outside --- Certainty = 0.0000 (Not Clear) < succ>
         bacterial cytoplasm --- Certainty = 0.0000 (Not Clear) < succ>
```

A related GBS nucleic acid sequence <SEQ ID 9499> which encodes amino acid sequence <SEQ ID 9500> was also identified.

The protein has homology with the following sequences in the GENPEPT database:

```
>GP: AAB98674 GB: U67515 transketolase'' [Methanococcus jannaschii]
Identities = 100/301 (33%), Positives = 171/301 (56%), Gaps = 7/301 (2%)

Query:    6 KEMRLVYRDFLLQANQENKQITVLEADLSSSMSTNALASEFGKRYINLGIMEAEMVGLAA    65
            K MR  Y + L++  ++ + + VL+ADLS S   T    A EF +R+ N G+ E  M+G+AA
Sbjct:    9 KGMRKGYGETLIELGKKYENLVVLDADLSGSTQTAMFAKEFPERFFNAGVAEQNMIGMAA    68

Query:   66 GLAIKGYKPYLHTFGPFASRRVFDQVFLSLGYSQLSATIIGSDAGISAEMNGGTHMPFEE   125
            GLA  G   +  +F  FAS R ++ +   + Y +L+  I+ + AGI+    +G +H   E+
Sbjct:   69 GLATTGKIVFASSFSMFASGRAWEIIRNLVAYPKLNVKIVATHAGITVGEDGASHQMCED   128

Query:  126 LGLLRLIPKATIFEVSDDIQFEAILKQTLSIDGLKYIRTIRKAPTAVYEGRE----DFSK   181
            + ++R IP  +   +D    +++       G  Y+R R+    +YE  E     +  K
Sbjct:  129 IAIMRAIPNMVVIAPTDYYHTKNVIRTIAEYKGPVYVRMPRRDTEIIYENEEEATFEIGK   188

Query:  182 GFIQLRQGKDITLVASGIMVSRAIEAADYLKELGIEASVIDLFKIKPLPEELKPLLIDQS   241
              G I L  G+D+T++A+G  V  A+ A + LKE GI A ++++   IKP+ EE+      D
Sbjct:  189 GKI-LVDGEDLTIIATGEEVPEALRAGEILKENGISAEIVEMATIKPIDEEIIKKSKD-F   246

Query:  242 IVTIENHNRIGGIGSALCEWL-SMEKDTTVSRMGIDERFGQVGQMEYLLEEYGLAVKDIVQ   301
            +VT+E+H+  IGG+G A+  E  + S    +    + R+GI++ FG+ G+ +  LL+ YGL  + I +
Sbjct:  247 VVTVEDHSIIGGLGGAVAEVIASNGLNKKLLRIGINDVFGRSGKADELLKYYGLDGESIAK   307
```

There is also homology to SEQ ID 520.

Based on this analysis, it was predicted that these proteins and their epitopes could be useful antigens for vaccines or diagnostics.

EXAMPLE 157

A DNA sequence (GBSx0163) was identified in *S. agalactiae* <SEQ ID 523> which encodes the amino acid sequence <SEQ ID 524>. Analysis of this protein sequence reveals the following:

```
Possible site: 24
>>> Seems to have no N-terminal signal sequence

----- Final Results -----
         bacterial cytoplasm --- Certainty = 0.2517 (Affirmative) < succ>
          bacterial membrane --- Certainty = 0.0000 (Not Clear) < succ>
           bacterial outside --- Certainty = 0.0000 (Not Clear) < succ>
```

The protein has no significant homology with any sequences in the GENPEPT database.

No corresponding DNA sequence was identified in *S. pyogenes*.

Based on this analysis, it was predicted that this protein and its epitopes could be useful antigens for vaccines or diagnostics.

EXAMPLE 158

A DNA sequence (GBSx0164) was identified in *S. agalactiae* <SEQ ID 525> which encodes the amino acid sequence <SEQ ID 526>. Analysis of this protein sequence reveals the following:

```
Possible site: 35
>>> Seems to have no N-terminal signal sequence
INTEGRAL Likelihood = -6.42 Transmembrane 119-135 (114-145)
INTEGRAL Likelihood = -5.10 Transmembrane  33-49  (32-50)
INTEGRAL Likelihood = -4.30 Transmembrane  94-110 (94-111)
INTEGRAL Likelihood = -3.66 Transmembrane  67-83  (60-83)

----- Final Results -----
```

```
              bacterial membrane --- Certainty = 0.3569 (Affirmative) < succ>
               bacterial outside --- Certainty = 0.0000 (Not Clear)  < succ>
              bacterial cytoplasm --- Certainty = 0.0000 (Not Clear) < succ>
```

No corresponding DNA sequence was identified in S. pyogenes.

A related GBS gene <SEQ ID 8503> and protein <SEQ ID 8504> were also identified. Analysis of this protein sequence reveals the following:

```
Lipop: Possible site: -1 Crend: 4
SRCFLG: 0
McG: Length of UR: 22
    Peak Value of UR: 2.96
    Net Charge of CR: 2
McG: Discrim Score: 10.55
GvH: Signal Score (-7.5): -4.31
    Possible site: 22
>>> Seems to have an uncleavable N-term signal seq
Amino Acid Composition: calculated from 1
ALOM program count: 6 value:      threshold: 0.0
                      -6.42
INTEGRAL Likelihood = -6.42 Transmembrane 154-170 (149-180)
INTEGRAL Likelihood = -5.10 Transmembrane  68-84  (67-85)
INTEGRAL Likelihood = -5.04 Transmembrane   6-22  (2-24)
INTEGRAL Likelihood = -4.30 Transmembrane 129-145 (129-146)
INTEGRAL Likelihood = -3.66 Transmembrane 102-118 (95-118)
INTEGRAL Likelihood = -3.56 Transmembrane  29-45  (29-46)
PERIPHERAL  Likelihood =  0.79 285
modified ALOM score: 1.78
icm1 HYPID: 7 CFP: 0.357

*** Reasoning Step: 3

----- Final Results -----
              bacterial membrane --- Certainty = 0.3569 (Affirmative) < succ>
               bacterial outside --- Certainty = 0.0000 (Not Clear)  < succ>
              bacterial cytoplasm --- Certainty = 0.0000 (Not Clear) < succ>
```

The protein has homology with the following sequences in the databases:

```
ORF01B68(391-1575 of 1938)
GP|9946413|GB|AAG03934.1|AE004491_1|AE004491(5-434 OF 434)hypothetical protein
{Pseudomonas aeruginosa}
% Match = 8.1
%Identity = 26.1,   % Similarity = 48.6
Matches = 105   Mismatches = 192   Conservative Sub.s = 91
171        201       231       261       291       321       351       381
DTTVSRMGIDERFGQVGQMEYLLEEYGLAVKDIVQHCKSIYKS*QKGNIGVAFLLFSEIFKFCISILWYFILTKNKGVVV
                                                                               M
411        441       471      480      507      537       567       597
MRAWKGIVLILSSIVVTLVAWQNAGLSEFVV-------PGLALTSL-SLTFLLSTKFRILESYFQGIENMYFYHKVMAVF
   |  :   |::  :||       ||  :||      |:|  :| ||  ||:   ||  |:::  ||  ||    ::
KLLWGVLAAALAAWGLTLAVDPPASLDIWVVRKQAILLTGVASFALMSLIMLLAVRPVWLEKPLDGLDRMYRLHKWAGIL
              20        30        40        50        60        70        80
627        657                        687       717       747       777
SMILLLLHKIGLGQGGHGSEF------------------AKTIGSAGLYLFLSIVFVAYFGNFLKYEIWRPIHRFVYL
:::| ||| :     |   :                  || :|   :::  :::| :   : | :|| ::| :  |
AIVLGLLHYLLELAGPWLAGIVGKPVKGPRVETFLDVFRGSAKELGEWSAWILGGMLLVTLW-QRFPYHLWRYVHKALAL
              100       110       120       130       140       150       160
807        837       867       897      924       951       981      1011
AYILGLVHTFMILGDRILGNTLLSLIVLGYAVIGVISGFYIIFLYSRM-RFRR-VGYVQKVTHLNHDTTEIEIAMKRPYR
 |::      |: :::|        :     :| |::||       :| |:|  |: | ||  |     :   ::  :
VYLVLAFHS-VVLAPASYWSQPAGWLVAACALLGSACA--LLSLSGRIGRTRRHAGVVTAVERHGESLLEVTCRLQGDWS
           170       180       190       200       210       220       230
1041       1071      1101      1125      1155      1185      1215     1242
YDYGQFTFFKIYQAGFESAAHPFSISGGHDRV--IFLTVKASGDYTKSIYKQLKVGTKIALDRAYGHMLFDKD-KKEQVW
: |||  |      ||||:|:        :   : :::|| |||:    |:|| ::  ||      ||       |||
HRAGQFAF---LTCDRLEGAHPFTIASADRGCGEVRFSIKALGDYTRRLQDNLEVGARVEVEGPYGCFDFRRGLAGRQVW
           250       260       270       280       290       300       310
1272       1293      1323      1353      1383      1413      1443     1461
IAGGIGITPFISFI---RENSILTKRVDFFYTFSNQDNLIYQDMLESYAKANPNFKLHLNNSSLKGRLDFSQ----SVFE
:| ||| :|||::    :       |::    |    |:   |  |  |:   |: ||:  |  |: | |:    |
VAAGIGVTPFIAWLESLQAAPESAPSVELHYCVRNSQEALFAGRLRELCEHLPSVTLHIRYSDEQGKPQAAQLGVLKSAE
              330       340       350       360       370       380       390
```

-continued

```
1488      1518      1548      1575           1605      1635      1665      1695
GQ-PTIFMCGPTSMTSTYAKVFRQKDAKSRLVY-EGFSFRDSWLSIFLLKTFDKVYSNLIK*EGL*DKPTFSWF*ECQS*
|: |::: |||   :   :  :|::       || : |  |    |
GRWPSVWFCGPQGLADSLRRDLRRQGMPLRLFHQEAFRMR
             410       420       430
```

Based on this analysis, it was predicted that these proteins and their epitopes could be useful antigens for vaccines or diagnostics.

EXAMPLE 159

A DNA sequence (GBSx0165) was identified in *S. agalactiae* <SEQ ID 527> which encodes the amino acid sequence <SEQ ID 528>. This protein is predicted to be 30S ribosomal protein S15 (rpsO). Analysis of this protein sequence reveals the following:

```
Possible site: 24
>>> Seems to have no N-terminal signal sequence

----- Final Results -----
          bacterial cytoplasm --- Certainty = 0.4074(Affirmative) < succ>
           bacterial membrane --- Certainty = 0.0000(Not Clear)   < succ>
            bacterial outside --- Certainty = 0.0000(Not Clear)   < succ>
```

The protein has homology with the following sequences in the GENPEPT database:

```
>GP: CAB13541 GB: Z99112 ribosomal protein S15 (BS18) [Bacillus subtilis]
Identities = 55/89 (61%), Positives = 71/89 (78%)

Query:   1 MAISKEKKNEIIAQYARHEGDTGSVEVQVAVLTWEINHLNDHIKQHKKDHATYRGLMKKI   60
           MAI++E+KN++I ++  HE DTGS EVQ+A+LT  IN+LN+H++ HKKDH + RGL+K +
Sbjct:   1 MAITQERKNQLINEFKTHESDTGSPEVQIAILTDSINNLNEHLRTHKKDHHSRRGLLKMV   60

Query:  61 GHRRNLLAYLRRTDVNRYRELIQSLGLRR                                 89
           G RRNLL YLR  DV RYRELI  LGLRR
Sbjct:  61 GKRRNLLTYLRNKDVTRYRELINKLGLRR                                 89
```

A related DNA sequence was identified in *S. pyogenes* <SEQ ID 529> which encodes the amino acid sequence <SEQ ID 530>. Analysis of this protein sequence reveals the following:

```
Possible site: 41
>>> Seems to have no N-terminal signal sequence

----- Final Results -----
          bacterial cytoplasm --- Certainty = 0.3746(Affirmative) < succ>
           bacterial membrane --- Certainty = 0.0000(Not Clear)   < succ>
            bacterial outside --- Certainty = 0.0000(Not Clear)   < succ>
```

An alignment of the GAS and GBS proteins is shown below:

```
Identities = 88/89 (98%), Positives = 88/89 (98%)

Query:   1 MAISKEKKNEIIAQYARHEGDTGSVEVQVAVLTWEINHLNDHIKQHKKDHATYRGLMKKI   60
           MAISKEKKNEIIAQYARHEGDTGSVEVQVAVLTWEINHLN HIKQHKKDHATYRGLMKKI
Sbjct:   1 MAISKEKKNEIIAQYARHEGDTGSVEVQVAVLTWEINHLNSHIKQHKKDHATYRGLMKKI   60

Query:  61 GHRRNLLAYLRRTDVNRYRELIQSLGLRR                                 89
           GHRRNLLAYLRRTDVNRYRELIQSLGLRR
Sbjct:  61 GHRRNLLAYLRRTDVNRYRELIQSLGLRR                                 89
```

Based on this analysis, it was predicted that these proteins and their epitopes could be useful antigens for vaccines or diagnostics.

EXAMPLE 160

A DNA sequence (GBSx0166) was identified in *S. agalactiae* <SEQ ID 531> which encodes the amino acid sequence <SEQ ID 532>. This protein is predicted to be polyribonucleotide nucleotidyltransferase (pnp). Analysis of this protein sequence reveals the following:

```
Possible site: 46
>>> Seems to have no N-terminal signal sequence
      INTEGRAL    Likelihood = -0.64    Transmembrane    448-464 (448-464)

----- Final Results -----
              bacterial membrane --- Certainty = 0.1256(Affirmative) < succ>
               bacterial outside --- Certainty = 0.0000(Not Clear)   < succ>
             bacterial cytoplasm --- Certainty = 0.0000(Not Clear)   < succ>
```

A related GBS nucleic acid sequence <SEQ ID 9501> which encodes amino acid sequence <SEQ ID 9502> was also identified.

The protein has homology with the following sequences in the GENPEPT database:

```
>GP: AAC43595 GB: U29668 polynucleotide phosphorylase [Bacillus subtilis]
Identities = 428/694 (61%), Positives = 532/694 (75%), Gaps = 4/694 (0%)

Query:    7 KQVFEMIFAGKKLVVETGQVAKQANGSVVVRYGDSTVLTAAVMSKKMSTGDFFPLQVNYE    66
            K VF + +AG+ L VETGQ+AKQANG+V++RYGD+ VL+ A  SK+     DFFPL VNYE
Sbjct:    5 KHVFTIDWAGRTLTVETGQLAKQANGAVMIRYGDTAVLSTATASKEPKPLDFFPLTVNYE   64

Query:   67 EKMYAAGKFPGGFNKREGRPSTDATLTARLIDRPIRPMFAEGFRNEVQVINTVLSFDENA  126
            E++YA GK PGGF KREGRPS  A L +RLIDRPIRP+FA+GFRNEVQVI+ V+S D+N
Sbjct:   65 ERLYAVGKIPGGFIKREGRPSEKAVLASRLIDRPIRPLFADGFRNEVQVISIVMSVDQNC  124

Query:  127 SAPMAAMFGSSLALSISDIPFNGPIAGVQVAYVDGNFIINPTAQEQEASALELTVAGTKE  186
            S+  MAAMFGSSLALS+SDIPF GPIAGV V  +D   FIINPT  + E S + L VAGTK+
Sbjct:  125 SSEMAAMFGSSLALSVSDIPFEGPIAGVTVGRIDDQFIINPTVDQLEKSDINLVVAGTKD  184

Query:  187 AINMVESGAKELSEEIMLEALLKGHEAVCELIAFQEEIVTAIGKEKAEVELLQVDPELQA  246
            AINMVE+GA E+ EEIMLEA++ GHE +  LIAFQEEIV A+GKEK+E++L ++D EL
Sbjct:  185 AINMVEAGADEVPEEIMLEAIMFGHEEIKRLIAFQEEIVAAVGKEKSEIKLFEIDEELNE  244

Query:  247 EIIATHNIALQAAVQVEEKKAREAATEAVKEVVIGEYEARYAEHEEYDRIMRDVAEILEQ  306
            ++ A     L  A+QV EK ARE A   VK V+ ++E     EH+E    ++ V +IL +
Sbjct:  245 KVKALAEEDLLKAIQVHEKHAREDAINEVKNAVVAKFEDE--EHDE--DTIKQVKQILSK  300

Query:  307 MEHAEVRRLITEDKIRPDGRRVDEIRPLDAEIDFLPQVHGSGLFTRGQTQALSVLTLAPM  366
            +    EVRRLITE+K+RPDGR VD+IRPL +E+    LP+ HGSGLFTRGQTQALSV TL  +
Sbjct:  301 LVKNEVRRLITEEKVRPDGRGVDQIRPLSSEVGLLPRTHGSGLFTRGQTQALSVCTLGAL  360

Query:  367 GEAQIIDGLTPEYKKRFMHHYNFPQYSVGETGRYGAAGRREIGHGALGERALEQVLPRLE  426
            G+ QI+DGL  E  KRFMHHYNFPQ+SVGETG    GRREIGHGALGERALE V+P  +
Sbjct:  361 GDVQILDGLGVEESKRFMHHYNFPQFSVGETGPMRGPGRREIGHGALGERALEPVIPSEK  420

Query:  427 EFPYAIRLVAEVLESNGSSSQASICAGTLALMAGGVPIKAPVAGIAMGLISDGTNYTVLT  486
            +FPY +RLV+EVLESNGS+SQASICA TLA+M  GVPIKAPVAGIAMGL+  G +YTVLT
Sbjct:  421 DFPYTVRLVSEVLESNGSTSQASICASTLAMMDAGVPIKAPVAGIAMGLVKSGEHYTVLT  480

Query:  487 DIQGLEDHFGDMDFKVAGTREGITALQMDIKIEGITPQILEEALAQAKKARFEILDVLHG  546
            DIQG+ED GDMDFKVAGT +G+TALQMDIKIEG++ +ILEEAL QAKK R EIL+ +
Sbjct:  481 DIQGMEDALGDMDFKVAGTEKGVTALQMDIKIEGLSREILEEALQQAKKGRMEILNSMLA  540

Query:  547 AIAEPRPQLAPTAPKIDMIKIDVDKIKVVIGKGGETIDKIIAETGVKIDIDEEGNVSIFS  606
              ++E R +L+   APKI  + I+ DKI+ VIG  G+ I+KII ETGVKIDI+++G + I S
Sbjct:  541 TLSESRKELSRYAPKILTMTINPDKIRDVIGPSGKQINKIIEETGVKIDIEQDGTIFISS  600

Query:  607 SDQAAIDRTKDIIASLVREAKVGEVYHAKVVRIEKFGAFVNLFDKTDALVHISEIAWTRT  666
             +D++   + K II   LVRE +VG++Y  KV RIEKFGAFV +F    D LVHISE+A  R
Sbjct:  601 TDESGNQKAKKIIEDLVREVEVGQLYLGKVKRIEKFGAFVEIFSGKDGLVHISELALERV  660

Query:  667 ANVADVLEIGEEVDVKVIKIDDKGRVDASMKALL                           700
             V DV++IG+E+ VKV +ID +GRV S KA+L
Sbjct:  661 GKVEDVVKIGDEILVKVTEIDKQGRVNLSRKAVL                           694
```

A related DNA sequence was identified in *S. pyogenes* <SEQ ID 533> which encodes the amino acid sequence <SEQ ID 534>. Analysis of this protein sequence reveals the following:

```
Possible site: 28
>>> Seems to have no N-terminal signal sequence
    INTEGRAL    Likelihood = -0.64    Transmembrane    444-460 (444-460)

----- Final Results -----
            bacterial membrane --- Certainty = 0.1256(Affirmative) < succ>
            bacterial outside  --- Certainty = 0.0000(Not Clear)   < succ>
            bacterial cytoplasm --- Certainty = 0.0000(Not Clear)  < succ>
```

An alignment of the GAS and GBS proteins is shown below:

```
Identities = 631/708 (89%), Positives = 664/708 (93%), Gaps = 2/708 (0%)

Query:   5 MSKQVFEMIFAGKKLVVETGQVAKQANGSVVVRYGDSTVLTAAVMSKKMSTGDFFPLQVN    64
           MSKQ F   FAGK LVVE GQVAKQANG+ VVVRYGDSTVLTAAVMSKKM+TGDFFPLQVN
Sbjct:   1 MSKQTFTTTFAGKPLVVEVGQVAKQANGATVVRYGDSTVLTAAVMSKKMATGDFFPLQVN    60

Query:  65 YEEKMYAAGKFPGGFNKREGRPSTDATLTARLIDRPIRPMFAEGFRNEVQVINTVLSFDE   124
           YEEKMYAAGKFPGGF KREGRPSTDATLTARLIDRPIRPMFAEGFRNEVQVINTVLS+DE
Sbjct:  61 YEEKMYAAGKFPGGFMKREGRPSTDATLTARLIDRPIRPMFAEGFRNEVQVINTVLSYDE   120

Query: 125 NASAPMAAMFGSSLALSISDIPFNGPIAGVQVAYVDGNFIINPTAQEQEASALELTVAGT   184
           NASAPMAAMFGSSLALSISDIPFNGPIAGVQV Y+DG FIINP  ++ EAS LELTVAG+
Sbjct: 121 NASAPMAAMFGSSLALSISDIPFNGPIAGVQVGYIDGEFIINPDKEQMEASLLELTVAGS   180

Query: 185 KEAINMVESGAKELSEEIMLEALLKGHEAVCELIAFQEEIVTAIGKEKAEVELLQVDPEL   244
           KEAINMVESGAKELSE+IMLEALLKGH+A+ ELIAFQE+IV  +GKEKAEVELLQVD +L
Sbjct: 181 KEAINMVESGAKELSEDIMLEALLKGHQAIQELIAFQEQIVAVVGKEKAEVELLQVDVDL   240

Query: 245 QAEIIATHNIALQAAVQVEEKKAREAATEAVKEVVIGEYEARYAEHEEYDRIMRDVAEIL   304
           QA+I+A +N  LQ AVQVEEKKAREAATEAVKE+V  EYE  RYAE E    IMRDVAEIL
Sbjct: 241 QADIVAKYNAQLQKAVQVEEKKAREAATEAVKEMVKAEYEERYAEDENLATIMRDVAEIL   300

Query: 305 EQMEHAEVRRLITEDKIRPDGRRVDEIRPLDAEIDFLPQVHGSGLFTRGQTQALSVLTLA   364
           EQMEHAEVRRLITEDKIRPDGR++DEIRPLDA +DFLP+VHGSGLFTRGQTQALSVLTLA
Sbjct: 301 EQMEHAEVRRLITEDKIRPDGRKIDEIRPLDAVVDFLPKVHGSGLFTRGQTQALSVLTLA   360

Query: 365 PMGEAQIIDGLTPEYKKRFMHHYNFPQYSVGETGRYGAAGRREIGHGALGERALEQVLPR   424
           PMGE QIIDGL PEYKKRF+HHYNFPQYSVGETGRYGAAGRREIGHGALGERALEQVLP
Sbjct: 361 PMGETQIIDGLAPEYKKRFLHHYNFPQYSVGETGRYGAAGRREIGHGALGERALEQVLPS   420

Query: 425 LEEFPYAIRLVAEVLESNGSSSQASICAGTLALMAGGVPIKAPVAGIAMGLISDGTNYTV   484
           LEEFPYAIRLVAEVLESNGSSSQASICAGTLALMAGGVPIKAPVAGIAMGLISDGTNYTV
Sbjct: 421 LEEFPYAIRLVAEVLESNGSSSQASICAGTLALMAGGVPIKAPVAGIAMGLISDGTNYTV   480

Query: 485 LTDIQGLEDHFGDMDFKVAGTREGITALQMDIKIEGITPQILEEALAQAKKARFEILDVL   544
           LTDIQGLEDHFGDMDFKVAGTREGITALQMDIKI GITPQILEEALAQAKKARFEILDV+
Sbjct: 481 LTDIQGLEDHFGDMDFKVAGTREGITALQMDIKIAGITPQILEEALAQAKKARFEILDVI   540

Query: 545 HGAIAEPRPQLAPTAPKIDMIKIDVDKIKVVIGKGGETIDKIIAETGVKIDIDEEGNVSI   604
              IAEPRP+LAPTAPKID IKIDVDKIKVVIGKGGETIDKIIAETGVKIDID+EGNVSI
Sbjct: 541 EATIAEPRPELAPTAPKIDTIKIDVDKIKVVIGKGGETIDKIIAETGVKIDIDDEGNVSI   600

Query: 605 FSSDQAAIDRTKDIIASLVREAKVGEVYHAKVVRIEKFGAFVNLFDKTDALVHISEIAWT   664
           +SSDQAAIDRTK+IIA LVREAKVGEVYHAKVVRIEKFGAFVNLFDKTDALVHISEIAWT
Sbjct: 601 YSSDQAAIDRTKEIIAGLVREAKVGEVYHAKVVRIEKFGAFVNLFDKTDALVHISEIAWT   660

Query: 665 RTANVADVLEIGEEVDVKVIKIDDKGRVDASMKALLPRPPKADNPKKE              712
           RT NV+DVLE+GE+VDVKVIKID+KGRVDASMKAL+PRPPK +  KKE
Sbjct: 661 RTTNVSDVLEVGEDVDVKVIKIDEKGRVDASMKALIPRPPKPE--KKE              706
```

Based on this analysis, it was predicted that these proteins and their epitopes could be useful antigens for vaccines or diagnostics.

EXAMPLE 161

A DNA sequence (GBSx0167) was identified in *S. agalactiae* <SEQ ID 535> which encodes the amino acid sequence <SEQ ID 536>. Analysis of this protein sequence reveals the following:

```
Possible site: 39
>>> Seems to have no N-terminal signal sequence

----- Final Results -----
             bacterial cytoplasm --- Certainty = 0.1293 (Affirmative) < succ>
              bacterial membrane --- Certainty = 0.0000 (Not Clear)   < succ>
                bacterial outside --- Certainty = 0.0000 (Not Clear)  < succ>
```

The protein has no significant homology with any sequences in the GENPEPT database.

A related DNA sequence was identified in *S. pyogenes* <SEQ ID 537> which encodes the amino acid sequence <SEQ ID 538>. Analysis of this protein sequence reveals the following:

```
Possible site: 38
>>> Seems to have no N-terminal signal sequence
      INTEGRAL      Likelihood = -0.43      Transmembrane          83-99 (83-99)

----- Final Results -----
              bacterial membrane --- Certainty = 0.1171 (Affirmative) < succ>
                bacterial outside --- Certainty = 0.0000 (Not Clear)  < succ>
             bacterial cytoplasm --- Certainty = 0.0000 (Not Clear)   < succ>
```

The protein has no significant homology with any sequences in the GENPEPT database.

An alignment of the GAS and GBS proteins is shown below:

```
Identities = 172/248 (69%), Positives = 211/248 (84%)

Query:    1 MTSTNELDIRLRAFINAPDNFLDSIGLVNALHHSTVWASKEPYAIQVDGQEVVPVFTDIT    60
            MT +NELDIRLRAFINAPDNFLDS+ LVNA H+   VWA+KEPY I+V+G +V PVFTD
Sbjct:    1 MTKSNELDIRLRAFINAPDNFLDSLALVNAFHNFPVWAAKEPYVIEVEGVKVTPVFTDKE   60

Query:   61 DLNHFKEEQESARDMFWESRRSLDVLDEAISHGLAGLVYNLKKEGDFGNSTIFYCEDMVQ   120
            D+  FKEEQ+SA+  +W  R +L VL+E I+ G AGL++NLKK+GDFGNSTIF   DM+Q
Sbjct:   61 DMARFKEEQKSAQSQYWLERSALAVLEEVITSGAAGLIFNLKKKGDFGNSTIFKSSDMIQ  120

Query:  121 FMNNYTTILNQLLNEDNIVADIMDKTYLVPAFVHPREEGSFDRLFPTMSTPEGKSYVPVF   180
            FMN+YTT+LN L+++DN+ AD M+K YLVPAFV+P++    +DRLFPTMSTPEGKSYVP F
Sbjct:  121 FMNHYTTVLNTLMSDDNVAADTMEKVYLVPAFVYPKDNNHYDRLFPTMSTPEGKSYVPAF  180

Query:  181 SNLLSFEKWYNHNDFGGAFRKAQGVILAWTIDDIYKPRNGENEIDDTFGVAINPFDEQQV   240
            SNL SF KWYN +DFGG FRKA+GVIL WTIDDIY+PRNGENE+D+TFGVAINPFD+QQ+
Sbjct:  181 SNLQSFAKWYNQDDFGGLFRKAEGVILTWTIDDIYQPRNGENELDETFGVAINPFDDQQI  240

Query:  241 LVDWSDVE                                                     248
            LVDWS+++
Sbjct:  241 LVDWSELD                                                     248
```

Based on this analysis, it was predicted that these proteins and their epitopes could be useful antigens for vaccines or diagnostics.

EXAMPLE 162

A DNA sequence (GBSx0168) was identified in *S. agalactiae* <SEQ ID 539> which encodes the amino acid sequence <SEQ ID 540>. This protein is predicted to be serine acetyltransferase (cysE). Analysis of this protein sequence reveals the following:

```
Possible site: 39
>>> Seems to have no N-terminal signal sequence
      INTEGRAL      Likelihood = -2.02      Transmembrane          150-166 (147-168)

----- Final Results -----
              bacterial membrane --- Certainty = 0.1808 (Affirmative) < succ>
                bacterial outside --- Certainty = 0.0000 (Not Clear)  < succ>
             bacterial cytoplasm --- Certainty = 0.0000 (Not Clear)   < succ>
```

A related GBS nucleic acid sequence <SEQ ID 9503> which encodes amino acid sequence <SEQ ID 9504> was also identified.

The protein has homology with the following sequences in the GENPEPT database:

```
>GP: CAB71304 GB: AJ130879 serine acetyltransferase [Clostridium
sticklandii]
Identities = 92/169 (54%), Positives = 125/169 (73%)

Query:    9 KESIAIVKEQDPAARSSLEVILTYPGIKALAAHRLSHFLWNHNFKLLARMHSQFWRFWTQ   68
            KE+I + +E+DPAA+ ++ +++  PGI A+  HR++H L+N     +AR+ SQ  RF T
Sbjct:   20 KETIEVAREKDPAAKGAINILVNTPGIHAIMFHRVAHSLYNRKHFFIARLISQISRFLTG   79

Query:   69 IEIHPGATISEGVFIDHGSGLVIGETAIVEKGAMLYHGVTLGGTGKDKGKRHPTIRKGAL  128
            IEIHPGA I    FIDHG G+VIGETA +    ML+H VTLGGTGKDKGKRHPT+   +
Sbjct:   80 IEIHPGAQIGRRFFIDHGMGVVIGETAEIGDDVMLFHQVTLGGTGKDKGKRHPTVENNVI  139

Query:  129 ISAHSQIIGPIEVGENAKVGAAAVVLADVPADVTVVGVPAKVVRVHGQK            177
            ISA  +++GPI +GEN+K+GA AVVL D+P + T VG+PAKVVR++G+K
Sbjct:  140 ISAGVKVLGPIVIGENSKIGANAVVLHDIPKNATAVGIPAKVVRLNGEK            188
```

A related DNA sequence was identified in *S. pyogenes* <SEQ ID 541> which encodes the amino acid sequence <SEQ ID 542>. Analysis of this protein sequence reveals the following:

```
Possible site: 35
>>> Seems to have no N-terminal signal sequence

----- Final Results -----
          bacterial cytoplasm --- Certainty = 0.0141 (Affirmative) < succ>
           bacterial membrane --- Certainty = 0.0000 (Not Clear)   < succ>
            bacterial outside --- Certainty = 0.0000 (Not Clear)   < succ>
```

An alignment of the GAS and GBS proteins is shown below:

```
Identities = 162/193 (83%), Positives = 178/193 (91%)

Query:    5 MGWWKESIAIVKEQDPAARSSLEVILTYPGIKALAAHRLSHFLWNHNFKLLARMHSQFWR   64
            MGWWKESIAIVK DPAAR+SLEVILTYPGIKALAAHRLSHFLW H+FKLLARMHSQFWR
Sbjct:    1 MGWWKESIAIVKALDPAARNSLEVILTYPGIKALAAHRLSHFLWRHHFKLLARMHSQFWR   60

Query:   65 FWTQIEIHPGATISEGVFIDHGSGLVIGETAIVEKGAMLYHGVTLGGTGKDKGKRHPTIR  124
            FWTQIEIHPGA I+ GVFIDHG+GLVIGETAIVEKG MLYHGVTLGGTGKD GKRHPT+R
Sbjct:   61 FWTQIEIHPGAQIAPGVFIDHGAGLVIGETAIVEKGVMLYHGVTLGGTGKDCGKRHPTVR  120

Query:  125 KGALISAHSQIIGPIEVGENAKVGAAAVVLADVPADVTVVGVPAKVVRVHGQKDDLQIRS  184
            +GALISAH+Q+IGPI++G NAKVGAAAVVL+DVP DVTVVGVPAK+VRVHGQKD+ QI+S
Sbjct:  121 QGALISAHAQVIGPIDIGANAKVGAAAVVLSDVPEDVTVVGVPAKIVRVHGQKDNRQIQS  180

Query:  185 IEHDREESYYSSK                                                197
            ++  RE SY  SK
Sbjct:  181 LQKQREVSYQLSK                                                193
```

Based on this analysis, it was predicted that these proteins and their epitopes could be useful antigens for vaccines or diagnostics.

EXAMPLE 163

A DNA sequence (GBSx0169) was identified in *S. agalactiae* <SEQ ID 543> which encodes the amino acid sequence <SEQ ID 544>. Analysis of this protein sequence reveals the following:

```
Possible site: 29
>>> May be a lipoprotein
INTEGRAL Likelihood = -5.89 Transmembrane 32-48 (29-49)
```

```
----- Final Results -----
          bacterial membrane --- Certainty = 0.3357 (Affirmative) < succ>
           bacterial outside --- Certainty = 0.0000 (Not Clear)   < succ>
         bacterial cytoplasm --- Certainty = 0.0000 (Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 164

A DNA sequence (GBSx0170) was identified in *S. agalactiae* <SEQ ID 545> which encodes the amino acid sequence <SEQ ID 546>. This protein is predicted to be cysteinyl-tRNA synthetase (cysS). Analysis of this protein sequence reveals the following:

```
Possible site: 46
>>> Seems to have no N-terminal signal sequence

----- Final Results -----
         bacterial cytoplasm --- Certainty = 0.2227 (Affirmative) < succ>
          bacterial membrane --- Certainty = 0.0000 (Not Clear)   < succ>
           bacterial outside --- Certainty = 0.0000 (Not Clear)   < succ>
```

The protein has homology with the following sequences in the GENPEPT database:

```
>GP: CAB11870 GB: Z99104 cysteinyl-tRNA synthetase [Bacillus subtilis]
Identities = 246/465 (52%), Positives = 322/465 (68%), Gaps = 23/465 (4%)

Query:   2 IKIYDTMTRSLQDFIPLNEGKVNMYVCGPTVYNYIHIGNARSVVAFDTIRRYFEYCGYQV   61
           I +Y+T+TR  + F+PL EGKV MYVCGPTVYNYIHIGNAR  + +DT+R Y EY GY V
Sbjct:   3 ITLYNTLTRQKETFVPLEEGKVKMYVCGPTVYNYIHIGNARPAIVYDTVRNYLEYKGYDV   62

Query:  62 NYISNFTDVDDKIIKGAAEAGMDTKSFSDKFISAFMEDVAALGVKPATKNPRVIDYMDEI  121
           Y+SNFTDVDDK+IK A E G D  + S++FI A+ EDV ALG + A  +PRV++ MD I
Sbjct:  63 QYVSNFTDVDDKLIKAANELGEDVPTISERFIKAYFEDVGALGCRKADLHPRVMENMDAI  122

Query: 122 IDFVKVLVDKEFAYEANGDVYFRVSKSHHYAKLANKTLEDLEIGASGRVDGEGEIKENPL  181
           I+FV  LV K +AYE+ GDVYF+       Y KL+ +++++L  GA   RV   GE KE+ L
Sbjct: 123 IEFVDQLVKKGYAYESEGDVYFKTRAFEGYGKLSQQSIDELRSGARIRV---GEKKEDAL  179

Query: 182 DFALWKSAKSGEVSWESPWGKGRPGWHIECSVMATEILGDTIDIHGGGADLEFPHHTNEI  241
           DFALWK+AK GE+SW+SPWGKGRPGWHIECS M + LGD IDIH GG DL FPHH NEI
Sbjct: 180 DFALWKAAKEGEISWDSPWGKGRPGWHIECSAMVKKYLGDQIDIHAGGQDLTFPHHENEI  239

Query: 242 AQSEAKTGKTFANYWMHNGFVNVDNEKMSKSLGNFITVHDMLKSVDGQVIRFFLATQQYR  301
           AQSEA TGKTFA YW+HNG++N+DNEKMSKSLGNF+ VHD++K  D Q++RFF+ +  YR
Sbjct: 240 AQSEALTGKTFAKYWLHNGYINIDNEKMSKSLGNFVLVHDIIKQHDPQLLRFFMLSVHYR  299

Query: 302 KPVNFTEKAVHDAEVNLKYLKNTF-----------NLPIQENANDEELEQFVKAFQGAMD  350
           +P+N++E+ + +    LK +              NL  ++  E++E+  KAF+  MD
Sbjct: 300 HPINYSEELLENTKSAFSRLKTAYSNLQHRLNSSTNLTEDDDQWLEKVEEHRKAFEEEMD  359

Query: 351 DDFNTANGITVIFEMAKWIN--------SGHYTSRVKETFAELLEIFGI-VFQEEVLDAD  401
           DDFNTAN I+V+F++AK  N        + H +   E F ++ + G  + ++E+LD +
Sbjct: 360 DDFNTANAISVLFDLAKHANYYLQKDHTADHVITAFIEMFDRIVSVLGFSLGEQELLDQE  419

Query: 402 IESLIEQRQEARANRDFATADRIRDELAKQGIKLLDTKDGVRWTR                446
           IE LIE+R EAR NRDFA +D+IRD+L   I L DT  G RW R
Sbjct: 420 IEDLIEKRNEARRNRDFALSDQIRDQLKSMNIILEDTAQGTRWKR                464
```

A related DNA sequence was identified in *S. pyogenes* <SEQ ID 547> which encodes the amino acid sequence <SEQ ID 548>. Analysis of this protein sequence reveals the following:

```
Possible site: 46
>>> Seems to have no N-terminal signal sequence

----- Final Results -----
            bacterial cytoplasm --- Certainty = 0.1765(Affirmative) < succ>
             bacterial membrane --- Certainty = 0.0000(Not Clear)  < succ>
              bacterial outside --- Certainty = 0.0000(Not Clear)  < succ>
```

An alignment of the GAS and GBS proteins is shown below:

```
Identities = 357/447 (79%), Positives = 401/447 (88%)

Query:    1 MIKIYDTMTRSLQDFIPLNEGKVNMYVCGPTVYNYIHIGNARSVVAFDTIRRYFEYCGYQ   60
            MIKIYDTMTRSL+ F+PL E  VN+YVCGPTVYNYIHIGNARS VAFDTIRRYFEY GYQ
Sbjct:    1 MIKIYDTMTRSLRKFVPLTENTVNIYVCGPTVYNYIHIGNARSAVAFDTIRRYFEYTGYQ   60

Query:   61 VNYISNFTDVDDKIIKGAAEAGMDTKSFSDKFISAFMEDVAALGVKPATKNPRVIDYMDE  120
            VNYISNFTDVDDKIIK A +AG+  K  SD+FI+AF+ED  ALGVKPAT+NPRV+DY+ E
Sbjct:   61 VNYISNFTDVDDKIIKAATQAGVSPKELSDRFIAAFIEDTKALGVKPATQNPRVMDYIAE  120

Query:  121 IIDFVKVLVDKEFAYEANGDVYFRVSKSHHYAKLANKTLEDLEIGASGRVDGEGEIKENP  180
            II FV+ L++K+FAYEA+GDVYFRV KS HYAKLANKTL +LE+GASGR D E  +KENP
Sbjct:  121 IISFVESLIEKDFAYEADGDVYFRVEKSEHYAKLANKTLSELEVGASGRTDAETALKENP  180

Query:  181 LDFALWKSAKSGEVSWESPWGKGRPGWHIECSVMATEILGDTIDIHGGGADLEFPHHTNE  240
            LDFALWKSAK+GEVSW+SPWG GRPGWHIECSVMATEILGDTIDIHGGGADLEFPHHTNE
Sbjct:  181 LDFALWKSAKAGEVSWDSPWGFGRPGWHIECSVMATEILGDTIDIHGGGADLEFPHHTNE  240

Query:  241 IAQSEAKTGKTFANYWMHNGFVNVDNEKMSKSLGNFITVHDMLKSVDGQVIRFFLATQQY  300
            IAQSEAKTGKTFANYWMHNGFV VDNEKMSKSLGNF+TVHDML++VDGQV+RFFLATQQY
Sbjct:  241 IAQSEAKTGKTFANYWMHNGFVTVDNEKMSKSLGNFVTVHDMLQTVDGQVLRFFLATQQY  300

Query:  301 RKPVNFTEKAVHDAEVNLKYLKNTFNLPIQENANDEELEQFVKAFQGAMDDDFNTANGIT  360
            RKP+NFTEK +HDAE+NLKYLKNT    P+ E A+++EL+QFV AFQ AMDDDFNTANGIT
Sbjct:  301 RKPINFTEKTIHDAEINLKYLKNTLQQPLTETADEQELKQFVIAFQDAMDDDFNTANGIT  360

Query:  361 VIFEMAKWINSGHYTSRVKETFAELLEIFGIVFQEEVLDADIESLIEQRQEARANRDFAT  420
            V+F+MAKWINSG YT  VK  F ++L  +FGI+F+EEVL+ DIE+LI +RQEARANRDFAT
Sbjct:  361 VVFDMAKWINSGSYTEPVKSAFEKMLAVFGIIFEEEVLEVDIEALIAKRQEARANRDFAT  420

Query:  421 ADRIRDELAKQGIKLLDTKDGVRWTRD                                  447
            AD IRD+LA QGIKLLDTKDGVRW RD
Sbjct:  421 ADAIRDQLAVQGIKLLDTKDGVRWLRD                                  447
```

Based on this analysis, it was predicted that these proteins and their epitopes could be useful antigens for vaccines or diagnostics.

EXAMPLE 165

A DNA sequence (GBSx0171) was identified in *S. agalactiae* <SEQ ID 549> which encodes the amino acid sequence <SEQ ID 550>. Analysis of this protein sequence reveals the following:

```
Possible site: 53
>>> Seems to have no N-terminal signal sequence

----- Final Results -----
            bacterial cytoplasm --- Certainty = 0.0259(Affirmative) < succ>
             bacterial membrane --- Certainty = 0.0000(Not Clear)  < succ>
              bacterial outside --- Certainty = 0.0000(Not Clear)  < succ>
```

A related GBS nucleic acid sequence <SEQ ID 9505> which encodes amino acid sequence <SEQ ID 9506> was also identified.

The protein has homology with the following sequences in the GENPEPT database:

>GP: CAB11871 GB: Z99104 similar to hypothetical proteins
[*Bacillus subtilis*]
Identities = 58/122 (47%), Positives = 87/122 (70%)

```
Query:    3 DVRLINGIALAFEGDAVYSLYIRRHLIMQGFTKPNQLHRKATQYVSANAQALLINAMLEE    62
            D + +NG+ALA+ GDA++ +Y+R HL+ QGFTKPN LH+K+++ VSA +QA ++  +  +
Sbjct:    9 DSKQLNGLALAYIGDAIFEVYVRHHLLKQGFTKPNDLHKKSSRIVSAKSQAEILFFLQNQ    68

Query:   63 NILTDEEQLIYKRGRNANSHTKAKNADIITYRMSTGFEALMGYLDMTGQIKRLETLIQWC   122
            +   T+EE+ +  KRGRNA S T   KN D+ TYR ST FEAL+GYL +  +  +RL   L+
Sbjct:   69 SFFTEEEEAVLKRGRNAKSGTTPKNTDVQTYRYSTAFEALLGYLFLEKKEERLSQLVAEA   128

Query:  123 IE                                                           124
            I+
Sbjct:  129 IQ                                                           130
```

A related DNA sequence was identified in *S. pyogenes* <SEQ ID 551> which encodes the amino acid sequence <SEQ ID 552>. Analysis of this protein sequence reveals the following:

```
Possible site: 56
>>> Seems to have no N-terminal signal sequence

----- Final Results -----
         bacterial membrane --- Certainty = 0.0000 (Not Clear) < succ>
          bacterial outside --- Certainty = 0.0000 (Not Clear) < succ>
         bacterial cytoplasm --- Certainty = 0.0000 (Not Clear) < succ>
```

An alignment of the GAS and GBS proteins is shown below:

```
Identities = 99/127 (77%), Positives = 111/127 (86%)

Query:    2 IDVRLINGIALAFEGDAVYSLYIRRHLIMQGFTKPNQLHRKATQYVSANAQALLINAMLE    61
            +DV LINGIALAFEGDAVYS Y+RRHLI QG TKP+QLHR AT+YVSA AQA LI AMLE
Sbjct:    5 VDVNLINGIALAFEGDAVYSYYVRRHLIFQGKTKPSQLHRLATRYVSAKAQANLIQAMLE    64

Query:   62 ENILTDEEQLIYKRGRNANSHTKAKNADIITYRMSTGFEALMGYLDMTGQIKRLETLIQW   121
            +LT++E+ IYKRGRN NSHTKAKNADIITYRMSTGFEA+MGYLDM GQ +RLE LI+W
Sbjct:   65 AQLLTEKEEDIYKRGRNTNSHTKAKNADIITYRMSTGFEAIMGYLDMMGQKERLEELIRW   124

Query:  122 CIETIEK                                                      128
            CIE +EK
Sbjct:  125 CIEYVEK                                                      131
```

Based on this analysis, it was predicted that these proteins and their epitopes could be useful antigens for vaccines or diagnostics.

EXAMPLE 166

A DNA sequence (GBSx0172) was identified in *S. agalactiae* <SEQ ID 553> which encodes the amino acid sequence <SEQ ID 554>. This protein is predicted to be spoU rRNA methylase family protein. Analysis of this protein sequence reveals the following:

```
Possible site: 30
>>> Seems to have no N-terminal signal sequence

----- Final Results -----
         bacterial cytoplasm --- Certainty = 0.1478 (Affirmative) < succ>
          bacterial membrane --- Certainty = 0.0000 (Not Clear)   < succ>
           bacterial outside --- Certainty = 0.0000 (Not Clear)   < succ>
```

The protein has homology with the following sequences in the GENPEPT database:

```
>GP: CAB11872 GB: Z99104 similar to hypothetical proteins [Bacillus subtilis]
Identities = 113/244 (46%), Positives = 163/244 (66%), Gaps = 6/244 (2%)

Query:   11 ESSDLVYGLHAVTESLRANTG-NKLYLQDDLRGKNVDKVKALATEKKVSISWTPKKTLSD   69
             +  D V G +AV E+L+++    KL++ ++      +V  LA ++ ++I + P+K L
Sbjct:    3 QQHDYVIGKNAVIETLKSDRKLYKLWMAENTVKGQAQQVIELAKKQGITIQYVPRKKLDQ   62

Query:   70 MTNGGVHQGFVLKVSEFAYADLSEIMTKAENE-ENPLILILDGLTDPHNLGSILRTADAT  128
             M   G   HQG V +V+ + YA+L ++   AE + E P  LILD L DPHNLGSI+RTADA
Sbjct:   63 MVTGQ-HQGVVAQVAAYEYAELDDLYKAAEEKNEQPFFLILDELEDPHNLGSIMRTADAV  121

Query:  129 NVTGIIIPKHRSVGVTPVVSKTSTGAVEHVPIARVTNLSQTLDTLKDKEFWIFGTDMNGT  188
                GI+IPK R+VG+T   V+K STGA+EH+P+ARVTNL++TL+ +K++  W+ GTD +
Sbjct:  122 GAHGIVIPKRRAVGLTTTVAKASTGAIEHIPVARVTNLARTLEEMKERGIWVVGTDASAR  181

Query:  189 PSHKWNTKGK--LALVIGNEGKGISHNIKKQVDEMITIPMNGHVQSLNASVAAAILMYEV  246
             + N G    LALVIG+EGKG+  +K++ D +I +PM G V SLNASVAA +LMYEV
Sbjct:  182 EDFR-NMDGNMPLALVIGSEGKGMGRLVKEKCDFLIKLPMAGKVTSLNASVAAGLLMYEV  240

Query:  247 FRNR                                                         250
             +R R
Sbjct:  241 YRKR                                                         244
```

A related DNA sequence was identified in *S. pyogenes* <SEQ ID 555> which encodes the amino acid sequence <SEQ ID 556>. Analysis of this protein sequence reveals the following:

```
Possible site: 36
>>> Seems to have no N-terminal signal sequence

----- Final Results -----
            bacterial cytoplasm --- Certainty = 0.1037 (Affirmative) < succ>
            bacterial membrane  --- Certainty = 0.0000 (Not Clear)  < succ>
             bacterial outside  --- Certainty = 0.0000 (Not Clear)  < succ>
```

An alignment of the GAS and GBS proteins is shown below:

```
Identities = 206/248 (83%), Positives = 225/248 (90%), Gaps = 1/248 (0%)

Query:    3 MKDKQFKEESSDLVYGLHAVTESLRANTGNKLYLQDDLRGKNVDKVKALATEKKVSISWT   62
            M+DK      E++D+VYG+HAVTESL+ANTGNKLY+Q+DLRGK VD +K+LAT+KKV+ISWT
Sbjct:   10 MEDKD-TIETNDIVYGVHAVTESLQANTGNKLYIQEDLRGKKVDNIKSLATQKKVAISWT   68

Query:   63 PKKTLSDMTNGGVHQGFVLKVSEFAYADLSEIMTKAENEENPLILILDGLTDPHNLGSIL  122
            PKKTLS MT+G VHQGFVL+VS FAY D+ EI+  AE E NPLILILDGLTDPHNLGSIL
Sbjct:   69 PKKTLSQMTDGAVHQGFVLRVSAFAYTDVDEILEIAEQEANPLILILDGLTDPHNLGSIL  128

Query:  123 RTADATNVTGIIIPKHRSVGVTPVVSKTSTGAVEHVPIARVTNLSQTLDTLKDKEFWIFG  182
            RTADATNV G+IIPKHRSVGVTPVVSKTSTGAVEH+PIARVTNLSQTLD LK + FWIFG
Sbjct:  129 RTADATNVCGVIIPKHRSVGVTPVVSKTSTGAVEHIPIARVTNLSQTLDKLKARGFWIFG  188

Query:  183 TDMNGTPSHKWNTKGKLALVIGNEGKGISHNIKKQVDEMITIPMNGHVQSLNASVAAAIL  242
            TDMNGTPS  WNT GKLALVIGNEGKGIS NIKKQVDEMITIPMNGHVQSLNASVAAAIL
Sbjct:  189 TDMNGTPSDCWNTNGKLALVIGNEGKGISTNIKKQVDEMITIPMNGHVQSLNASVAAAIL  248

Query:  243 MYEVFRNR                                                     250
            MYEVFRNR
Sbjct:  249 MYEVFRNR                                                     256
```

Based on this analysis, it was predicted that these proteins and their epitopes could be useful antigens for vaccines or diagnostics.

EXAMPLE 167

A DNA sequence (GBSx0173) was identified in *S. agalactiae* <SEQ ID 557> which encodes the amino acid sequence <SEQ ID 558>. Analysis of this protein sequence reveals the following:

```
Possible site: 18
>>> Seems to have no N-terminal signal sequence

----- Final Results -----
            bacterial cytoplasm --- Certainty = 0.2187 (Affirmative) < succ>
             bacterial membrane --- Certainty = 0.0000 (Not Clear)  < succ>
              bacterial outside --- Certainty = 0.0000 (Not Clear)  < succ>
```

The protein has homology with the following sequences in the GENPEPT database:

```
>GP: CAB11873 GB: Z99104 similar to hypothetical proteins
[Bacillus subtilis]
Identities = 67/147 (45%), Positives = 94/147 (63%), Gaps = 2/147 (1%)

Query:    6 ILLVDGYNMIAFWKDTRQLFKSNRLEEAREVLLRKLNHYAHFEHIDIICVFDAQYVPGVR    65
            ILLVDGYNMI  W   + L K+N  EEAR+VL++K+  Y  +    +I VFDA  V G+
Sbjct:    3 ILLVDGYNMIGAWPQLKDL-KANSFEEARDVLIQKMAEYQSYTGNRVIVVFDAHLVKGLE   61

Query:   66 QRYDQYKISVIFTEEDETADSYIERAAAELNQSVLNLVSVATSDLNEQWTIFSQGALRVS   125
            ++     +++ VIFT+E+ETAD  IE+ A  LN ++   + VATSD   EQW IF QGALR S
Sbjct:   62 KKQTNHRVEVIFTKENETADERIEKLAQALN-NIATQIHVATSDYTEQWAIFGQGALRKS   120

Query:  126 ARELEQRVATVKSDLDKMSSQIDLSTP                                    152
            AREL + V T++  +++   +I   P
Sbjct:  121 ARELLREVETIERRIERRVRKITSEKP                                    147
```

A related DNA sequence was identified in *S. pyogenes* <SEQ ID 559> which encodes the amino acid sequence <SEQ ID 560>. Analysis of this protein sequence reveals the following:

```
Possible site: 46
>>> Seems to have no N-terminal signal sequence

----- Final Results -----
            bacterial cytoplasm --- Certainty = 0.2465(Affirmative) < succ>
             bacterial membrane --- Certainty = 0.0000(Not Clear)  < succ>
              bacterial outside --- Certainty = 0.0000(Not Clear)  < succ>
```

An alignment of the GAS and GBS proteins is shown below:

```
Identities = 130/167 (77%), Positives = 149/167 (88%), Gaps = 1/167 (0%)

Query:    3 KHSILLVDGYNMIAEWKDTRQLFKSNRLEEAREVLLRKLNHYAHFEHIDIICVFDAQYVP    62
            K   ILLVDGYNMIAFW+ TRQLFK+N+L++AR  LL KLNHYAHFE+I+IICVFDAQYVP
Sbjct:    2 KKRILLVDGYNMIAFWQSTRQLFKTNQLDQARNTLLTKLNHYAHFENINIICVFDAQYVP   61

Query:   63 GVRQRYDQYKISVIFTEEDETADSYIERAAAELNQSVLNLVSVATSDLNEQWTIFSQGAL   122
            G+RQRYDQY ISV+FTEEDETADSYIER AAELN + +++V VATSDLNEQWTIFSQGAL
Sbjct:   62 GLRQRYDQYYISVVFTEEDETADSYIERMAAELN-TAIHMVEVATSDLNEQWTIFSQGAL   120

Query:  123 RVSARELEQRVATVKSDLDKMSSQIDLSTPKLRPWNDEQLGKLKDFL                169
            RV+ARELEQRV TVK+DLDKMS  IDL TPKLRP++  QL +LKDF+
Sbjct:  121 RVTARELEQRVHTVKADLDKMSRDIDLKTPKLRPFDQGQLIQLKDFM                167
```

Based on this analysis, it was predicted that these proteins and their epitopes could be useful antigens for vaccines or diagnostics.

EXAMPLE 168

A DNA sequence (GBSx0174) was identified in *S. agalactiae* <SEQ ID 561> which encodes the amino acid sequence <SEQ ID 562>. Analysis of this protein sequence reveals the following:

```
Possible site: 58
>>> Seems to have no N-terminal signal sequence

----- Final Results -----
            bacterial cytoplasm --- Certainty = 0.4889(Affirmative) < succ>
             bacterial membrane --- Certainty = 0.0000(Not Clear)   < succ>
              bacterial outside --- Certainty = 0.0000(Not Clear)   < succ>
```

The protein has homology with the following sequences in the GENPEPT database:

```
>GP: CAB12951 GB: Z99109 yits [Bacillus subtilis]
Identities = 100/284 (35%), Positives = 157/284 (55%), Gaps = 6/284 (2%)

Query:   1 MTFKILTDSTSDLDEKWAQEHNVDIIGLTIELDGKTYETVGDEKITSDFLLERMQEGAKP   60
           MT  ++ DS +DL   + +E  +  I L +L  K +E       I +D + E MQ G  P
Sbjct:   1 MTVHLIADSATDLPRSYFEEKGIGFIPLRVSLGDKEFEDA--VTIHADQIFEAMQNGETP   58

Query:  61 TTSQINVGQFEEVFSTYAENDHALLYLALSSHLSGTYQSATIAREMVLDKYPDAQIEIVD  120
           TSQ +    + VF   YAE    LY+A SS LSGTYQ+A +   V +++PD  + ++D
Sbjct:  59 KTSQASPQTIKNVFLQYAETGDPALYIAFSSGLSGTYQTAVMIANEVKEEFPDFDLRVID  118

Query: 121 TMAASCGEGVLAMLATKERQEGKSLEEVKQKIESLLPKLNTYFLVDDLNHLMRSGRLSKG  180
            + AS G G+    A    G +++E++  +++   +L   F VDDL +L R GR+SK
Sbjct: 119 SKCASLGYGLAVRHAADLCINGNTIQEIETSVKNFCSQLEHIFTVDDLTYLARGGRISKT  178

Query: 181 AAIIGSVAKIKPLLKLDSEGKLVPFAKTRGRKKGIK---EIVTQATKTLSYSTLIIAYSG  237
            +A +G + IKPLL+++ +GKLVP  K RG+KK  K    E++ +    S  T+ I+Y+
Sbjct: 179 SAFVGGLLNIKPLLQME-DGKLVPLEKIRGQKKLFKRIIELMKERGDDWSNQTVGISYAA  237

Query: 238 EKDSAQVMKEQLLADERIEEVIIRPLGPVISAHVGSGALALFSL                281
           K+ A  MK +    + +I+ P+    I +H G G LA+F L
Sbjct: 238 NKEKATDMKHLIEEAFKPKEIIMHPISSAIGSHAGPGTLAIFFL                281
```

A related DNA sequence was identified in *S. pyogenes* <SEQ ID 563> which encodes the amino acid sequence <SEQ ID 564>. Analysis of this protein sequence reveals the following:

```
Possible site: 18
>>> Seems to have no N-terminal signal sequence

----- Final Results -----
            bacterial cytoplasm --- Certainty = 0.3247(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below:

```
Identities = 167/286 (58%), Positives = 227/286 (78%)

Query:   1 MTFKILTDSTSDLDEKWAQEHNVDIIGLTIELDGKTYETVGDEKITSDFLLERMQEGAKP   60
           MTF I+TDST+DL++ WA++H++ +IGLTI  DG+ YETVG  +I+SD+LL++M+ G+ P
Sbjct:   1 MTFTIMTDSTADLNQTWAEDHDIVLIGLTILCDGEVYETVGPNRISSDYLLKKMKAGSHP   60

Query:  61 TTSQINVGQFEEVFSTYAENDHALLYLALSSHLSGTYQSATIAREMVLDKYPDAQIEIVD  120
            TSQINVG+FE+VF   +A N+ ALLYLA SS LSGTYQSA +AR++ + YPDA IEIVD
Sbjct:  61 QTSQINVGEFEKVFREHARNNKALLYLAFSSVLSGTYQSALMARDLVREDYPDAVIEIVD  120

Query: 121 TMAASCGEGVLAMLATKERQEGKSLEEVKQKIESLLPKLNTYFLVDDLNHLMRSGRLSKG  180
           T+AA+ GEG L +LA + R  GK+L E K   +E+++P+L TYFLVDDL HLMR GRLSKG
Sbjct: 121 TLAAAGGEGYLTILAAEARDSGKNLLETKDIVEAVIPRLRTYFLVDDLFHLMRGGRLSKG  180

Query: 181 AAIIGSVAKIKPLLKLDSEGKLVPFAKTRGRKKGIKEIVTQATKTLSYSTLIIAYSGEKD  240
            +A +GS+A IKPLL +D EGKLVP AK RGR K IKE+V Q   K ++ ST+I++Y+ ++
Sbjct: 181 SAFLGSLASIKPLLWIDEEGKLVPIAKIRGRQKAIKEMVAQVEKDIADSTVIVSYTSDQG  240

Query: 241 SAQVMKEQLLADERIEEVIIRPLGPVISAHVGSGALALFSLGEENR                286
           SA+ ++E+LLA E I +V++ PLGPVISAHVG   LA+F +G+ +R
Sbjct: 241 SAEKLREELLAHENISDVLMMPLGPVISAHVGPNTLAVFVIGQNSR                286
```

Based on this analysis, it was predicted that these proteins and their epitopes could be useful antigens for vaccines or diagnostics.

EXAMPLE 169

A DNA sequence (GBSx0175) was identified in *S. agalactiae* <SEQ ID 565> which encodes the amino acid sequence <SEQ ID 566>. Analysis of this protein sequence reveals the following:

```
Possible site: 56
>>> Seems to have no N-terminal signal sequence
     INTEGRAL     Likelihood = -8.76     Transmembrane     43-59 (40-62)

----- Final Results -----
            bacterial membrane --- Certainty = 0.4503(Affirmative) < succ>
             bacterial outside --- Certainty = 0.0000(Not Clear)   < succ>
           bacterial cytoplasm --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 170

A DNA sequence (GBSx0176) was identified in *S. agalactiae* <SEQ ID 567> which encodes the amino acid sequence <SEQ ID 568>. This protein is predicted to be ribosomal protein L13 (rplM). Analysis of this protein sequence reveals the following:

```
Possible site: 55
>>> Seems to have no N-terminal signal sequence

----- Final Results -----
           bacterial cytoplasm --- Certainty = 0.3426(Affirmative) < succ>
            bacterial membrane --- Certainty = 0.0000(Not Clear)   < succ>
             bacterial outside --- Certainty = 0.0000(Not Clear)   < succ>
```

A related GBS nucleic acid sequence <SEQ ID 9507> which encodes amino acid sequence <SEQ ID 9508> was also identified.

The protein has homology with the following sequences in the GENPEPT database:

```
>GP: BAB03887 GB: AP001507 ribosomal protein L13 [Bacillus halodurans]
Identities = 89/144 (61%), Positives = 113/144 (77%)

Query:  36 KTTFMAKPGQVERKWYVVDAADVPLGRLSAVVASVLRGKNKPTFTPHTDTGDFVIVINAE   95
           +TT+MAKP +VERKWYVVDA    LGRL++ VAS+LRGK+KPT+TPH DTGD VI+INAE
Sbjct:   2 RTTYMAKPNEVERKWYVVDAEGQTLGRLASEVASILRGKHKPTYTPHVDTGDHVIIINAE   61

Query:  96 KVKLTGKKASDKIYYTHSMYPGGLKQISAGELRSKNAVRLIEKSVKGMLPHNTLGRAQGM  155
           K+ LTG K DKIYY HS +PGGLK+ A ++R+    +++E ++KGMLP NTLGR QGM
Sbjct:  62 KIHLTGNKLQDKIYYRHSGHPGGLKETRAADMRANKPEKMLELAIKGMLPKNTLGRKQGM  121

Query: 156 KLKVFVGGEHTHAAQQPEVLDISG                                      179
           KL V+ G EH H AQ+PEV ++ G
Sbjct: 122 KLHVYAGSEHKHQAQKPEVYELRG                                      145
```

A related DNA sequence was identified in *S. pyogenes* <SEQ ID 569> which encodes the amino acid sequence <SEQ ID 570>. Analysis of this protein sequence reveals the following:

```
Possible site: 57
>>> Seems to have no N-terminal signal sequence

----- Final Results -----
            bacterial cytoplasm --- Certainty = 0.4249(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below:

```
Identities = 167/184 (90%), Positives = 171/184 (92%), Gaps = 4/184 (2%)

Query:   1 MFTPFVRPRNLSNTLVDRNIHT--CKQ-KRIRIGEIMNKTTFMAKPGQVERKWYVVDAAD   57
           +FTPF RPRNL NT  D   H   CKQ  RIRIGEIMNKTTFMAKPGQVERKWYVVDAAD
Sbjct:   1 LFTPFERPRNLPNTF-DGTEHPSPCKQILRIRIGEIMNKTTFMAKPGQVERKWYVVDAAD   59

Query:  58 VPLGRLSAVVASVLRGKNKPTFTPHTDTGDFVIVINAEKVKLTGKKASDKIYYTHSMYPG  117
           VPLGRLSAVVASVLRGKNKPTFTPHTDTGDFVIVINAEKVKLTGKKA+DK+YYTHSMYPG
Sbjct:  60 VPLGRLSAVVASVLRGKNKPTFTPHTDTGDFVIVINAEKVKLTGKKATDKVYYTHSMYPG  119

Query: 118 GLKQISAGELRSKNAVRLIEKSVKGMLPHNTLGRAQGMKLKVFVGGEHTHAAQQPEVLDI  177
           GLK I+AGELRSKNAVRLIEKSVKGMLPHNTLGRAQGMKLKVFVGGEHTHAAQQPEVLDI
Sbjct: 120 GLKSITAGELRSKNAVRLIEKSVKGMLPHNTLGRAQGMKLKVFVGGEHTHAAQQPEVLDI  179

Query: 178 SGLI                                                          181
           SGLI
Sbjct: 180 SGLI                                                          183
```

Based on this analysis, it was predicted that these proteins and their epitopes could be useful antigens for vaccines or diagnostics.

EXAMPLE 171

A DNA sequence (GBSx0177) was identified in *S. agalactiae* <SEQ ID 571> which encodes the amino acid sequence <SEQ ID 572>. This protein is predicted to be 30S ribosomal protein S9 (rpsI). Analysis of this protein sequence reveals the following:

```
Possible site: 53
>>> Seems to have no N-terminal signal sequence

----- Final Results -----
            bacterial cytoplasm --- Certainty = 0.1761(Affirmative) < succ>
             bacterial membrane --- Certainty = 0.0000(Not Clear)   < succ>
              bacterial outside --- Certainty = 0.0000(Not Clear)   < succ>
```

The protein has homology with the following sequences in the GENPEPT database:

```
>GP: CAB11926 GB: Z99104 ribosomal protein S9 [Bacillus subtilis]
Identities = 88/130 (67%), Positives = 105/130 (80%)

Query:   1 MAQAQYAGTGRRKNAVARVRLVPGTGKITINKKDVEEYIPHADLRLVINQPFAVTSTQGS   60
           MAQ QY GTGRRK++VARVRLVPG G+I +N +++ E+IP A L   I QP  +T T G+
Sbjct:   1 MAQVQYYGTGRRKSSVARVRLVPGEGRIVVNNREISEHIPSAALIEDIKQPLTLTETAGT   60

Query:  61 YDVFVNVVGGGYAGQSGAIRHGISRALLEVDPDFRDSLKRAGLLTRDARMVERKKPGLKK  120
           YDV VNV GGG +GQ+GAIRHGI+RALLE DP++R +LKRAGLLTRDARM ERKK GLK
Sbjct:  61 YDVLVNVHGGGLSGQAGAIRHGIARALLEADPEYRTTLKRAGLLTRDARMKERKKYGLKG  120

Query: 121 ARKASQFSKR                                                    130
           AR+A QFSKR
Sbjct: 121 ARRAPQFSKR                                                    130
```

A related DNA sequence was identified in *S. pyogenes* <SEQ ID 573> which encodes the amino acid sequence <SEQ ID 574>. Analysis of this protein sequence reveals the following:

```
Possible site: 56
>>> Seems to have no N-terminal signal sequence

----- Final Results -----
              bacterial cytoplasm --- Certainty = 0.1865(Affirmative) < succ>
               bacterial membrane --- Certainty = 0.0000(Not Clear)   < succ>
                bacterial outside --- Certainty = 0.0000(Not Clear)   < succ>
```

An alignment of the GAS and GBS proteins is shown below:

```
Identities = 124/130 (95%), Positives = 129/130 (98%)

Query:    1 MAQAQYAGTGRRKNAVARVRLVPGTGKITINKKDVEEYIPHADLRLVINQPFAVTSTQGS    60
            MAQAQYAGTGRRKNAVARVRLVPGTGKIT+NKKDVEEYIPHADLRL+INQPFAVTST+GS
Sbjct:    1 MAQAQYAGTGRRKNAVARVRLVPGTGKITVNKKDVEEYIPHADLRLIINQPFAVTSTEGS    60

Query:   61 YDVFVNVVGGGYAGQSGAIRHGISRALLEVDPDFRDSLKRAGLLTRDARMVERKKPGLKK   120
            YDVFVNVVGGGY GQSGAIRHGI+RALL+VDPDFRDSLKRAGLLTRDARMVERKKPGLKK
Sbjct:   61 YDVFVNVVGGGYGGQSGAIRHGIARALLQVDPDFRDSLKRAGLLTRDARMVERKKPGLKK   120

Query:  121 ARKASQFSKR                                                    130
            ARKASQFSKR
Sbjct:  121 ARKASQFSKR                                                    130
```

Based on this analysis, it was predicted that these proteins and their epitopes could be useful antigens for vaccines or diagnostics.

EXAMPLE 172

A DNA sequence (GBSx0078) was identified in *S. agalactiae* <SEQ ID 575> which encodes the amino acid sequence <SEQ ID 576>. This protein is predicted to be recombinase (b1345). Analysis of this protein sequence reveals the following:

```
Possible site: 43
>>> Seems to have no N-terminal signal sequence

----- Final Results -----
              bacterial cytoplasm --- Certainty = 0.1939(Affirmative) < succ>
               bacterial membrane --- Certainty = 0.0000(Not Clear)   < succ>
                bacterial outside --- Certainty = 0.0000(Not Clear)   < succ>
```

The protein has homology with the following sequences in the GENPEPT database:

```
>GP: AAG29618 GB: AF217235 integrase-like protein [Staphylococcus
aureus]
Identities = 127/386 (32%), Positives = 205/386 (52%), Gaps = 18/386 (4%)

Query:    3 IHKYPSKKAKNGYLYFVKIYMVKD---SQRADHIKRGFRTRKEAKDYEARLIYLKASGKL    59
            I KY K     Y++    Y+ D     ++    +RGF+T +EAK  EA+L     +
Sbjct:    2 IKKYKKKDGSTAYMFVA--YLGTDPITGKQKRTTRRGFKTEREAKIAEAKL---QTEVSQ    56

Query:   60 EEFIKPTHKTYNEIFEKWYQAYQDMVEPTTASRTLDMFRLHILPVMGDLPISKISPLDCQ   119
            F+    T+ E++E W + YQ+ V  +T  R L +F    IL    D+PI KI+   CQ
Sbjct:   57 NGFLNNDITTFKEVYELWLEQYQNTVRESTYQRVLTLFDTAILEHFQDVPIKKITVPYCQ   116

Query:  120 NFITDKAKTFKNIKQIKSYTGKVFDFAIKMKLLKHNPMAEIIMPKRKKTRIE---NYWTV   176
              I    K + +IK I+ YT  VF +A+ +K++  NP A    P++K+ + +      Y++
Sbjct:  117 KVINKWNKKYSDIKAIRIYTSNVFKYAVSLKIIVDNPFAHTKAPRKKEAQQDASTKYYSS   176

Query:  177 QELQEFLAIVLQEEPYKHYALFRLLAYSGLRKGELYALKWADIDFQTETLSVDKSLGR-L   235
             EL++FL  V  E+    +YA+FR LA++G R+GEL AL W DIDF  +T+S++K+  R
Sbjct:  177 DELKQFLTFV--EDDPLYYAIFRTLAFTGFRRGELMALTWNDIDFTKQTISINKTCARGA   234

Query:  236 DGQAIEKGTKNDFSVRKIKLDSETISILQEWKSISQKEKAQLAVAPLSIEQDFLFTYCTR   295
             + + +   K    S RI +D +T S+L+ W++ + E +       S +   +FT
Sbjct:  235 NYKLVIQEPKTKSSHRTISIDDKTASVLKSWRTHQRVESLKYG-HNTSDKHQVFTTVRD   293
```

```
                             -continued
Query: 296 SGSIEPLHADYINNVLSRIIRKHGLKKISPHGFRHTHATLMIEIGVDPVNTAKRLGHASS 355
           +   +PL+ ++ N   L   I  K+    K+I HGFRHTH +L+ E G+         RLGH
Sbjct: 294 N---KPLYPEHCNKALDLICEKNSFKRIKVHGFRHTHCSLLFEAGLSIQEVQDRLGHGDI 350

Query: 356 QMTLDTYSHSTTTGEDRSVKQFADYL                                    381
           + T+D Y+H T    D+   +FA Y+
Sbjct: 351 KTTMDIYAHVTEKQRDQVADKFAKYI                                    376
```

A related DNA sequence was identified in *S. pyogenes* <SEQ ID 577> which encodes the amino acid sequence <SEQ ID 578>. Analysis of this protein sequence reveals the following:

```
Possible site: 39
>>> Seems to have no N-terminal signal sequence

----- Final Results -----
              bacterial cytoplasm --- Certainty = 0.3445(Affirmative) < succ>
              bacterial membrane  --- Certainty = 0.0000(Not Clear)   < succ>
               bacterial outside  --- Certainty = 0.0000(Not Clear)   < succ>
```

An alignment of the GAS and GBS proteins is shown below:

```
Identities = 109/386 (28%), Positives = 185/386 (47%), Gaps = 28/386 (7%)

Query:   3 IHKYPSKKAKNGYL-YFVKIYMVKDSQRADHIKRGF--RTRKEA--KDYEARLIYLKASG   57
           I K    K KNG + Y   IY+  D       +K    RTRKE    K   A+  +L
Sbjct:   6 IMKITEHKKKNGTIVYRASIYLGIDQMTGKRVKTSITGRTRKEVNQKAKHAQFDFLSNGS   65

Query:  58 KLEEFIKPTHKTYNEIFEKWYQAYQDMVEPTTASRTLDMFRLHILPVMGDLPISKISPLD  117
             ++     K   KT+ E+    W + Y+   V+P T    T+      HI+P +G++ + KI+   D
Sbjct:  66 TIKR--KVVIKTFKELSHLWLETYKLTVKPQTYDATVTRLNRHIMPTLGNMKVDKITASD  123

Query: 118 CQNFITDKAKTFKNIKQIKSYTGKVFDFAIKMKLLKHNPMAEIIMPKRK---KTRIENYW  174
             Q  I   +K + N   ++S   KV  + +  L+ +N   +II+P+++    K +++ +
Sbjct: 124 IQMLINRLSKYYVNYTAVRSVIRKVLQQGVLLGLIDYNSARDIILPRKQPNAKKKVK-FI  182

Query: 175 TVQELQEFLAIVLQEEPYKHY------ALFRLLAYSGLRKGELYALKWADIDFQTETLSV  228
              +L+  FL    L+    +K Y            L++LL  +GLR GE   AL+W DID +   T+++
Sbjct: 183 DPSDLKSFLE-HLETSQHKRYNLYFDAVLYQLLLSTGLRIGEACALEWGDIDLENGTIAI  241

Query: 229 DKSLGRLDGQAIEKGTKNDFSVRKIKLDSETISILQEWKSISQKEKAQLAVAPLSIEQDF  288
              +K+   +               K     R I +D +T+  L+    + Q    + QL      +      +
Sbjct: 242 NKTYNK--NLKFLSTAKTQSGNRVISVDKKTLRSLK----LYQMRQRQLFNEVGARVSEV  295

Query: 289 LFTYCTRSGSIEPLHADYINNVLSRIIRKHGLKKISPHGFRHTHATLMIEIGVDPVNTAK  348
             +F    TR       + +A    + L    ++ G+++ + H FRHTHA+L++  G+
Sbjct: 296 VFATPTR----KYFNASVRQSALDTRCKEAGIERFTFHAFRHTHASLLLNAGISYKELQY  351

Query: 349 RLGHASSQMTLDTYSHSTTTGEDRSV                                    374
           RLGHA+  MTLDTY H +    E  +V
Sbjct: 352 RLGHANISMTLDTYGHLSKGKEKEAV                                    377
```

Based on this analysis, it was predicted that these proteins and their epitopes could be useful antigens for vaccines or diagnostics.

EXAMPLE 173

A DNA sequence (GBSx0179) was identified in *S. agalactiae* <SEQ ID 579> which encodes the amino acid sequence <SEQ ID 580>. Analysis of this protein sequence reveals the following:

```
Possible site: 61
>>> Seems to have no N-terminal signal sequence

----- Final Results -----
              bacterial cytoplasm --- Certainty = 0.2477(Affirmative) < succ>
              bacterial membrane  --- Certainty = 0.0000(Not Clear)   < succ>
               bacterial outside  --- Certainty = 0.0000(Not Clear)   < succ>
```

The protein has homology with the following sequences in the GENPEPT database:

```
>GP: AAF63067 GB: AF158600 putative DNA binding protein
[Streptococcus thermophilus bacteriophage Sfill]
Identities = 32/70 (45%), Positives = 46/70 (65%), Gaps = 3/70 (4%)

Query:    3 NRLKELRKDKGLTQADLAKVINTNQSQYGKYENGKTSLSIENSKILADFFGVSIPYLLGL   62
            NRL  LR+ + +T+ +LA+ I  ++     K E+G + +S   +K LADFFGVS+ YLLGL
Sbjct:    2 NRLYLLRESRKITRVELAEKIGVSKLTVLKLEHGTSKISRREAKKLADFFGVSVGYLLGL   61

Query:   63 D---NNSKIA                                                    69
            D   N+S IA
Sbjct:   62 DTTENDSLIA                                                    71
```

A related DNA sequence was identified in *S. pyogenes* <SEQ ID 581> which encodes the amino acid sequence <SEQ ID 582>. Analysis of this protein sequence reveals the following:

```
Possible site: 30
>>> Seems to have no N-terminal signal sequence

----- Final Results -----
            bacterial cytoplasm --- Certainty = 0.0680(Affirmative) < succ>
            bacterial membrane  --- Certainty = 0.0000(Not Clear)   < succ>
            bacterial outside   --- Certainty = 0.0000(Not Clear)   < succ>
```

An alignment of the GAS and GBS proteins is shown below:

```
Identities = 21/61 (34%), Positives = 34/61 (55%)

Query:    1 MYNRLKELRKDKGLTQADLAKVINTNQSQYGKYENGKTSLSIENSKILADFFGVSIPYLL   60
            MY R++ LR+D    TQ  +A +++ + + Y K E G+ +L  +        + +VSI YLL
Sbjct:    1 MYPRIRNLREDNDFTQKFVANLLSFSHANYAKIERGEVALMADVLVQFYKLYNVSIDYLL   60

Query:   61 G                                                             61
            G
Sbjct:   61 G                                                             61
```

Based on this analysis, it was predicted that these proteins and their epitopes could be useful antigens for vaccines or diagnostics.

EXAMPLE 174

A DNA sequence (GBSx0180) was identified in *S. agalactiae* <SEQ ID 583> which encodes the amino acid sequence <SEQ ID 584>. Analysis of this protein sequence reveals the following:

```
Possible site: 29
>>> Seems to have no N-terminal signal sequence

----- Final Results -----
            bacterial cytoplasm --- Certainty = 0.5278(Affirmative) < succ>
            bacterial membrane  --- Certainty = 0.0000(Not Clear)   < succ>
            bacterial outside   --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 175

A DNA sequence (GBSx0181) was identified in *S. agalactiae* <SEQ ID 585> which encodes the amino acid sequence <SEQ ID 586>. Analysis of this protein sequence reveals the following:

```
Possible site: 60
>>> Seems to have no N-terminal signal sequence

----- Final Results -----
            bacterial cytoplasm --- Certainty = 0.3762(Affirmative) < succ>
             bacterial membrane --- Certainty = 0.0000(Not Clear)   < succ>
              bacterial outside --- Certainty = 0.0000(Not Clear)   < succ>
```

The protein has no significant homology with any sequences in the GENPEPT database.

No corresponding DNA sequence was identified in S. pyogenes.

Based on this analysis, it was predicted that this protein and its epitopes, could be useful antigens for vaccines or diagnostics.

EXAMPLE 176

A DNA sequence (GBSx0182) was identified in S. agalactiae <SEQ ID 587> which encodes the amino acid sequence <SEQ ID 588>. Analysis of this protein sequence reveals the following:

```
Possible site: 59
>>> Seems to have no N-terminal signal sequence
    INTEGRAL      Likelihood = -9.66    Transmembrane    40-56 (33-65)
    INTEGRAL      Likelihood = -5.79    Transmembrane    62-78 (59-81)

----- Final Results -----
             bacterial membrane --- Certainty = 0.4864(Affirmative) < succ>
              bacterial outside --- Certainty = 0.0000(Not Clear)   < succ>
            bacterial cytoplasm --- Certainty = 0.0000(Not Clear)   < succ>
```

No corresponding DNA sequence was identified in S. pyogenes.

A related GBS gene <SEQ ID 8505> and protein <SEQ ID 8506> were also identified. Analysis of this protein sequence reveals the following:

```
Lipop: Possible site: -1 Crend: 7
McG: Discrim Score: -16.96
GvH: Signal Score (-7.5): -2.95
     Possible site: 57
>>> Seems to have no N-terminal signal sequence
ALOM program count: 2 value: -9.66 threshold: 0.0
     INTEGRAL      Likelihood = -9.66    Transmembrane    33-49 (26-58)
     INTEGRAL      Likelihood = -5.79    Transmembrane    55-71 (52-74)
     PERIPHERAL    Likelihood = 10.87    14
modified ALOM score: 2.43
*** Reasoning Step: 3

----- Final Results -----
             bacterial membrane --- Certainty = 0.4864(Affirmative) < succ>
              bacterial outside --- Certainty = 0.0000(Not Clear)   < succ>
            bacterial cytoplasm --- Certainty = 0.0000(Not Clear)   < succ>
```

Based on this analysis, it was predicted that these proteins and their epitopes could be useful antigens for vaccines or diagnostics.

EXAMPLE 177

A DNA sequence (GBSx0183) was identified in S. agalactiae <SEQ ID 589> which encodes the amino acid sequence <SEQ ID 590>. Analysis of this protein sequence reveals the following:

```
Possible site: 31
>>> Seems to have no N-terminal signal sequence
```

```
----- Final Results -----
        bacterial cytoplasm --- Certainty = 0.3276 (Affirmative) < succ>
         bacterial membrane --- Certainty = 0.0000 (Not Clear)   < succ>
          bacterial outside --- Certainty = 0.0000 (Not Clear)   < succ>
```

The protein has no significant homology with any sequences in the GENPEPT database.

No corresponding DNA sequence was identified in S. pyogenes.

Based on this analysis, it was predicted that this protein and its epitopes, could be useful antigens for vaccines or diagnostics.

EXAMPLE 178

A DNA sequence (GBSx0184) was identified in S. agalactiae <SEQ ID 591> which encodes the amino acid sequence <SEQ ID 592>. Analysis of this protein sequence reveals the following:

```
Possible site: 44
>>> Seems to have no N-terminal signal sequence

----- Final Results -----
        bacterial cytoplasm --- Certainty = 0.3482 (Affirmative) < succ>
         bacterial membrane --- Certainty = 0.0000 (Not Clear)   < succ>
          bacterial outside --- Certainty = 0.0000 (Not Clear)   < succ>
```

A related GBS nucleic acid sequence <SEQ ID 9509> which encodes amino acid sequence <SEQ ID 9510> was also identified.

The protein has homology with the following sequences in the GENPEPT database:

```
>GP: CAA30291 GB: X07371 RepM protein (AA 1-314) [Staphylococcus
aureus]
Identities = 89/283 (31%), Positives = 145/283 (50%), Gaps = 26/283 (9%)

Query:  67 KVSLDNITMTAYIKSKKYLAMKQLIETHLAITVQTAMTDMFRATTGDGIHVVLHMNYDKQ  126
           K+S D +T+      +    +   I +   + F+A       +++ YDK
Sbjct:  42 KLSFDAMTIVGNLNKNSAKKLSDFMSLDPQIRLWDILQTKFKAKA---LQEKVYIEYDKV   98

Query: 127 KGQDRKARPFRLEFNPNKLRLVDSEII---DTIIPFLEDISISRADLAFDLFEVDCSEF-  182
           K     R  R+EFNPNKL     E++     II ++ED    +R DLAFD FE D S++
Sbjct:  99 KADTWDRRNMRVEFNPNKL--THDEMLWLKHNIIDYMEDDGFTRLDLAFD-FEDDLSDYY  155

Query: 183 -VLEKKGRPTATKEFRSSTGTLETKYLGAPRSEKQVRLYNKKKEQLQNGTDKDKDFASQF  241
            + EK  + T    F  +TG  ETKY G+  S + +R+YNKKKE+ +N      D D +++
Sbjct: 156 ALSEKALKRTV---FFGTTGKAETKYFGSRDSNRFIRIYNKKKERKENA---DVDVSAE-  208

Query: 242 KHWWRLEFQLRSRSIDEIFEVI-DTIIFKP--FNLKGLSIETQIYLTALIHDKNIWKKLH  298
           +H WR+E +L+    +D       D  I KP     L+ L  +  +YL  L+H+++ W +LH
Sbjct: 209 -HLWRVEIELKRDMVDYWNNCFNDLHILKPAWATLESLKEQAMVYL--LLHEESKWGELH  265

Query: 299 RNTRARYKKILETHQTSDTDYLGLLKDLLKHERPRLENQLAYY                  341
           RN+R  +YK+I++   + S   D   L+K L      L+  Q+ ++
Sbjct: 266 RNSRRKYKQIIQ--EISSIDLTDLMKSTLTDNEENLQKQINFW                  306
```

No corresponding DNA sequence was identified in S. pyogenes.

Based on this analysis, it was predicted that these proteins and their epitopes could be useful antigens for vaccines or diagnostics.

EXAMPLE 179

A DNA sequence (GBSx0185) was identified in S. agalactiae <SEQ ID 593> which encodes the amino acid sequence <SEQ ID 594>. Analysis of this protein sequence reveals the following:

```
Possible site: 32
>>> Seems to have no N-terminal signal sequence
INTEGRAL Likelihood = -15.55 Transmembrane 137-153 (133-157)

----- Final Results -----
            bacterial membrane --- Certainty = 0.7220 (Affirmative) < succ>
              bacterial outside --- Certainty = 0.0000 (Not Clear)   < succ>
             bacterial cytoplasm --- Certainty = 0.0000 (Not Clear)  < succ>
```

A related GBS nucleic acid sequence <SEQ ID 9511> which encodes amino acid sequence <SEQ ID 9512> was also identified.

The protein has no significant homology with any sequences in the GENPEPT database.

No corresponding DNA sequence was identified in S. pyogenes.

A related GBS gene <SEQ ID 8507> and protein <SEQ ID 8508> were also identified. Analysis of this protein sequence reveals the following:

```
Lipop: Possible site: -1 Crend: 2
McG: Discrim Score: -16.84
GvH: Signal Score (-7.5): -5.3
   Possible site: 32
>>> Seems to have no N-terminal signal sequence
ALOM program count: 1 value: -15.55 threshold: 0.0
    INTEGRAL   Likelihood = -15.55 Transmembrane  137-153 (133-157)
    PERIPHERAL Likelihood =  10.93       60
modified ALOM score: 3.61

*** Reasoning Step: 3

----- Final Results -----
            bacterial membrane --- Certainty = 0.7220 (Affirmative) < succ>
              bacterial outside --- Certainty = 0.0000 (Not Clear)   < succ>
             bacterial cytoplasm --- Certainty = 0.0000 (Not Clear)  < succ>
```

The protein has homology with the following sequences in the databases:

```
ORF01844(292-702 of 1074)
EGAD|124517|132830(149-295 of 435)apolipoprotein A-IV{Mus musculus}
GP|191889|gb|AAA37216.1||M64250 apolipoprotein A-IV{Mus musculus castaneus}
% Match = 4.6
% Identity = 30.0    % Similarity = 54.6
Matches = 39   Mismatches = 53   Conservative Sub.s = 32
201         231         261         291         321         351         381         411
NSSNIRY*LFRFAERLVEA*KTKTRKSARLLWG*DRQK*LSTLLLKIQYYQGVTRSKMRIKDYADSLGVSSQSIYKRIRS
                                        |   :|:|     :  |  :   ||:   |:|    |     ::
                      LRDRMMPHANKVTQTFGENMQKLQEHLKPYAVDLQDQINTQTQEMKLQLTPYIQRMQTTIKENVDNLHTSMMPLATNLKD
                              120         130         140         150         160         170         180

435         462         492         522         552         570
P--KYKERLKGHLK-RDNQKVENLDLIGIKILEDYHFENDVIELEKTLGD----IQEEFEQEKKGMQY------------
 :  | |||||  | |:   :|          :|  |  :: ::| ::|           :||:: ::  :|: :
KFNRNMEELKGHLTPRANELKATID-------------QNLEDLRRSLAPLTVGVQEKLNHQMEGLAFQMKKNAEELQTK
           200         210                            220         230         240         250

615         645  672  702  732  762  792  822
---RIDRLADKLTPLLEDNQNLVQKNYE-LLNYVRSLERQKLLLIIALAVMVITLLVAIWLAIF*WQLSDNAKRPTKGTA
   :||:|    | ||:||  |   |   ::   |  ||
VSAKIDQLQKNLAPLVEDVQSKVKGNTEGLQKSLKDLNRQLEQQVEEFRRTVEPMGEMFNKALVQQLEQFRQQLGPNSGE
             270         280         290         300         310         320         330
```

Figure 76:
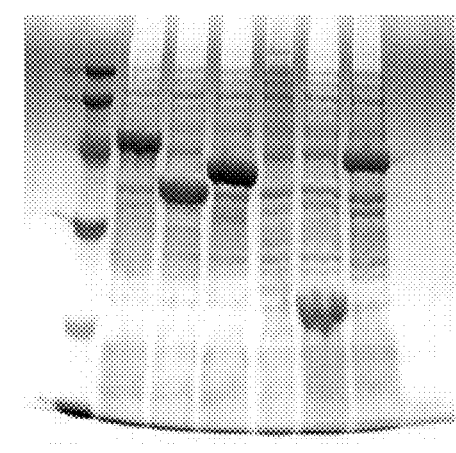

SEQ ID 8508 (GBS405) was expressed in E. coli as a GST-fusion product. SDS-PAGE analysis of total cell extract is shown in FIG. 171 (lane 4; MW 46 kDa-2 bands) and in FIG. 177 (lane 7; MW 46 kDa). It was also expressed in E. coli as a His-fusion product. SDS-PAGE analysis of total cell extract is shown in FIG. 76 (lane 5; MW 21 kDa).

GBS405-GST was purified as shown in FIG. 218, lane 8.

Based on this analysis, it was predicted that these proteins and their epitopes could be useful antigens for vaccines or diagnostics.

EXAMPLE 180

A DNA sequence (GBSx0186) was identified in S. agalactiae <SEQ ID 595> which encodes the amino acid sequence <SEQ ID 596>. Analysis of this protein sequence reveals the following:

```
Possible site: 18
>>> Seems to have no N-terminal signal sequence

----- Final Results -----
              bacterial cytoplasm --- Certainty = 0.3406 (Affirmative) < succ>
               bacterial membrane --- Certainty = 0.0000 (Not Clear)  < succ>
                bacterial outside --- Certainty = 0.0000 (Not Clear)  < succ>
```

The protein has homology with the following sequences in the GENPEPT database:

```
>GP:CAA33713 GB:X15669 pre protein (AA 1-494)
[Streptococcus agalactiae]
Identities = 171/402 (42%), Positives = 250/402 (61%),
Gaps = 46/402 (11%)

Query:    1 MSYVVARMAKYKSGQLTAIYNHNERIFKNHSNKEIDVEKSHLNYELTNRDQAQNYHKQIK   60
            MSY+VARM K+G L   + HNER+F+ HSNK+I+   +SHLNYELT+RD++ +Y KQIK
Sbjct:    1 MSYMVARMQKMKAGNLGGAFKHNERVFETHSNKDINPSRSHLNYELTDRDRSVSYEKQIK  60

Query:   61 EHINENRLSTRGVRKDAILCNEWIITSDKTFFDSLDEKQTREFFETAKDYFAEKYGDANI  120
            +++NEN++S R +RKDA+LC+EWIITSDK FF+  LDE+QTR FFETAK+YFAE YG++NI
Sbjct:   61 DYVNENKVSNRAIRKDAVLCDEWIITSDKDFFEKLDEEQTRTFFETAKNYFAENYGESNI  120

Query:  121 AYARVHLDESTPHMHLGIVPMKNGKLSSKALFGNKEKLVAIQDELPKYLNEHGFNLQRGE  180
            AYA VHLDESTPHMH+G+VP +NGKLSSKA+F  ++E+L   IQ++LP+Y+++HGF L+RG+
Sbjct:  121 AYASVHLDESTPHMHMGVVPFENGKLSSKAMF-DREELKHIQEDLPRYMSDHGFELERGK  179

Query:  181 IGSKKKHLETAEFKEKQRLLDNADRKLADKHEELKALDDKISNV-NDTIA----------  229
            + S+ KH   AEFK    ++  +L +K+    +D++   + NDT A
Sbjct:  180 LNSEAKHKTVAEFKRAMADME-LKEELLEKYHAPPFVDERTGELNNDTEAFWHEKEFADM  238

Query:  230 -DKESRLKEL---EAKEWDAVGDLKQYELEKQSLAESIEDIKDIELLQLDRIQKEDLVKQ  285
             + +S ++E     E   +W        KQY+ E + L  S   ++D     D   E+L+ +
Sbjct:  239 FEVQSPIRETTNQEKMDWLR----KQYQEELKKLESSKKPLED------DLSHLEELLDK  288

Query:  286 SFDGKLKMDKETYNRLFQTASKHASSNAELKRDLVKAQSQNNHLSRELLNHRKTAEKNIK  345
                +K+D E           AS+ AS        +L KA+     N L    NH K+ E  I+
Sbjct:  289 KTKEYIKIDSE--------ASERAS-------ELSKAEGYINTLE----NHSKSLEAKIE  329

Query:  346 LSQENRKLKDKVKMLDEQVKILNKSLSVWKEKAKEFMPKQVY                   387
            + +    +K K      + K LN+S    + K F+ K+ Y
Sbjct:  330 CLESDNLQLEKQKATKLEAKALNESELRELKPKKNFLGKEHY                   371
```

A related DNA sequence was identified in S. *pyogenes* <SEQ ID 597> which encodes the amino acid sequence <SEQ ID 598>. Analysis of this protein sequence reveals the following:

```
LPXTG motif: 2025-2030

Possible site: 52

>>> Seems to have no N-terminal signal sequence
     INTEGRAL       Likelihood = -10.08   Transmembrane    2034-2050 (2030-
                                                           2053)
     INTEGRAL       Likelihood =  -6.05   Transmembrane       21-37  (20-
                                                           39)

----- Final Results -----
              bacterial membrane  --- Certainty = 0.5034 (Affirmative) < succ>
              bacterial outside   --- Certainty = 0.0000 (Not Clear)  < succ>
              bacterial cytoplasm --- Certainty = 0.0000 (Not Clear)  < succ>
```

The protein has homology with the following sequences in the databases:

```
>GP: AA003320 GB: AF067776 extracellular matrix binding protein
[Abiotrophia defectiva]
Identities = 362/1396 (25%), Positives = 591/1396 (41%), Gaps = 87/1396 (6%)

Query:  636 KAEVKLREAHEATKQAIEKDPWLSPEQKKAQKEKAKARLDEGLKALKAADSLEILKVTEE  695
            +A+  + A +A   AI+ +  L+ E+K A+K K +A + L  + A     K T
Sbjct:  636 EAKNAVNNAAKAKNTAIDNNNNLTAEEKAAEKAKVEAAKNATLAGIDQA------KTTAA  689
```

```
-continued

Query:   696 AFVDKEKNPDSIPNQHKAGTADQARKQALDSLDKEVQKELESIDNDNTLTTDEKAAAKKK  755
             + K   I    +   A   AL+  +  ++ I     LT +EK A   +
Sbjct:   690 RNAAQNKGTTDINAVNPVPVAKPAANAALE---QAAVNKINEISQRPDLTREEKQAFMDQ  746

Query:   756 VNDAYDVARQTAMEANSYEDLTTIKDEFLS---NLPHKQGTPLKDQQSDAIAELEKKQQE  812
             V  A D A      A + + +T+ +D+ L+   NLP    TP   + +A+ + +
Sbjct:   747 VRTARDAAMAKVASAANNQAVTSARDQGLNAVNNLP----TPAA-KYPEALGHVRQAADA  801

Query:   813 IEKAIEGDKTLPRDEKEKQIADSKERLKSDTQKVKDAKNADAIKKAFEEGKVNIPQAHIP  872
              +AI + L +E+   +          +       +     + KA +G I
Sbjct:   802 KRQAIRDNANLTAEEQADALRQVDAAQTAAEAAINQNHTNATLAKADSGVKAI------  855

Query:   873 GDLN---KDKEKLLAELKQKADDTEKAIDVDKTLTEDEKKEQKVKTKAELEKAKTDVKNT  929
             D+N   + K     L+Q A  +AI+ +  LT++EK +  +    L AKT V+
Sbjct:   856 NDINPQPRSKPAANQALEQVAAAKRQAINNNNQLTDEEKAQAIQQVDQALANAKTQVQAA  915

Query:   930 QTREELDKKVPELKKAIEDTHVKGNLEGVKNKAIEDLKKAHTETVAKINGDDTLDKATKE  989
              +++          AI + + +G     K +AI ++ A     ++ G + L     +
Sbjct:   916 NDNNGVNQAKTAGTTAINNINPQGTQ---KAQAIAAIEAAEQAKRLELQGRNDLTTEERN  972

Query:   990 AQVKEADKALAAGKDAITKADDADKVSTAVTEHTPKIKAAHKTGDLKKAQVDANTALDKA 1049
              + +      A KDA+ +A + V+ A     +I+  + T +K     DA  A+D+A
Sbjct:   973 NALADLTAKAQAAKDAVNQARNNTGVAGAKDNGVAQIQGINPTAVVKP---DARNAIDQA 1029

Query:  1050 AEKERGEINKDATLTTEDKAKQLKEVETALTKAKDNVKAAKTADAINDARDKGVATIDAV 1109
             A   + E    + LT E+KA +K+V+  A   AK  + A+    +N+A ++G A I A+
Sbjct:  1030 ARDKEAEFQANTKLTDEEKAAAIKKVQDAARDAKAAIDRAGSNGDVNNAVNQGKAAIQAI 1089

Query:  1110 HKAGQDLGARKSGQVAKLEEAAKATKDKISADPTLTSKEKEEQSKAVDAELKKAIEAVNA 1169
              + K    A ++ AA A K  I+A+  LT +EK    K V+ E  KA  AV+A
Sbjct:  1090 KALDDSQPSAKDTAKAAIQNAADAKKAAITANNALTQEEKAAAIKQVEDEAAKAQAAVDA 1149

Query:  1170 ADTADKVDDALGEGVTDIKNQHKSGDSIDARREAHGKELDRVAQETKGAIEKDPTLTTEE 1229
              + +     VD A  +G+  I +       ++         +D+  A + I  D TLT EE
Sbjct:  1150 SRSKADVDRAKDQGLQKISDV----PAVQPPKLNAIAAVDQAATDKKAVINNDTTLTQEE 1205

Query:  1230 KAKQVKDVDAAKERGMAKLNEAKDADALDKAYGEGVTDIKNQHKSGDPVDARRGLHNKSI 1289
             K    ++ VD     +   +N+A    +      +G   IN +       A+   +
Sbjct:  1206 KEAAIRKVDEEAAKARQAINDATSNADVAAKQAQGTQAINNVPQT----PAAKNAAKAAV 1261

Query:  1290 DEVAQATKDAITADTTLTEAEKETQRGNVDKEATKAKEELAKAKDADALDKAYGDGVTSI 1349
              ++  A A KAI  D  LT  EK+      VD+E  KA++ + A        +G  +I
Sbjct:  1262 EQAADAKKQAIENDPNLTRQEKDAAIAKVDQETNKARQAIDAATTNADVTAKQNEGTQAI 1321

Query:  1350 KNQHKSGKGLDVRKDEHKKALEAVAKRVTAEIEADPTLTPEVREQQKAEVQKELELATDK 1409
              ++ K     K + K A+    A+   + IE DP LT E  +    KA+V E  A +
Sbjct:  1322 NAVPQTPKA----KTDAKNAVTQAAEDKKSAIENDPNLTREEKDAAKAKVDAEATKAKNA 1377

Query:  1410 IAEAKDADEADKAYGDGVTAIENAHVIGKGIEARKDLAKKDLAEAAAKTKALIIEDKTLT 1469
              I  A   D+         +G AI    + +   +A+ D AK  ++AA + K I D   LT
Sbjct:  1378 IDAATSNDDETAKQNEGTQAI---NAVPQTPKAKTD-AKNAVTQAADRKKDAIENDPNLT 1433

Query:  1470 DDQRKEQLLGVDTEYAKGIENIDAAKDAAGVDKAYSDGVRDILAQYKEGQNLNDRRNAAK 1529
              +++       VD E  K + IDAA  A V   ++G + I    +       + AK
Sbjct:  1434 REEKVAAKAKVDAEAKKAKDAIDAATSNADVTAKQNEGTKAI----NDVPQTPTAKTDAK 1489

Query:  1530 EFLLKEADKVTKLINDDPTLTHDQKVDQINKVEQAKLDAIKSVDDAQTADAINDALGKGI 1589
              + + AD    I DP LT ++K    KV+  A  ++D A +       +G
Sbjct:  1490 NAVTQAADAKKDAIEKDPNLTREEKDAAKAKVDAEAKKAKDAIDAATSNADVTAKQNEGT 1549

Query:  1590 ENINNQYQHGDGVDVRKATAKGDLEKEAAKVKALIAKDPTLTQADKDKQTAAVDAAKNTA 1649
              + IN+  Q          K AK + +A  K I KDP LT+ +KD  A VDA     A
Sbjct:  1550 KAINDVPQ----TPTAKTDAKNAVTQAADAKKDAIEKDPNLTREEKDAAKAKVDAEAKKA 1605

Query:  1650 IAAVDKATTTEGINQELGKGITAINKAYRPGEGVKARKEAAKADLEKEAAKVKALITNDP 1709
              A+D AT+ + +  G  AIN    +         K  AK + +A  K  I ND
Sbjct:  1606 KDAIDAATSNADVTAQKDAGKNAINAVPQ----TPTAKTDAKNAVTQAADKKDAIENDA 1661

Query:  1710 TLTKADK-AKQTEAVAKALKAAIAAVDKATTAEGINQELGKGITAINKAYRPGEGVKARK 1768
               LT+ +K A + +  A + +   A+A KA    A+D AT+ + +  +G AIN +          K
Sbjct:  1662 NLTREEKDAAKAKVDAEATKAK-NAIDAATSNADVTAKQNEGTKAINDVPQ----TPTAK 1716

Query:  1769 EAAKADLEREAAKVREAIANDPTLTKADK-AKQTEAVAKALKAAIAAVDKATTAEGINQE 1827
                AK ++   A    + AI NDP LT+ +K A + +  A + +   A+A KA  A+D AT+ + +  +
Sbjct:  1717 TDAKNAVDQAATDKKSAIENDPALTREEKDAAKAKVDAEATKAK-NAIDAATSNADVTAQ 1775

Query:  1828 LGKGITAINKAYRPGEGVEAHKEAAKANLEKVAKETKALISGDRYLSKTEKAVQKQAVEQ 1887
              G AIN +              K  AK +++ A  + KAI  D  L+  EK    K V+
Sbjct:  1776 KDAGKNAINAVPQ----TPTAKTDAKNAVDQAATDKKAAIENDPALTREEKDAAKAKVDA 1831
```

```
Query:  1888 ALAKALGQVEAAKTVEAVKLAENLGTVAIRSAYVAGLAKDTDQATAALNEAKQAAIEALK   1947
             KA  ++AA +   V  ++ G              KD  A       AK  A  A+
Sbjct:  1832 EAKKAKDAIDAATSNADVTAQKDAG-------------KDAINAVPQTPTAKTDAKNAVD   1878

Query:  1948 QAAAETLAKITTDAKLTEAQKAEQSENVSLALKTAIATVRSAQSIASVKEAKDKGITAIR   2007
             QAA  +  + I    D  LT  +K     V    K A   + +A S A V   + +G  AI
Sbjct:  1879 QAATDKKSAIENDPALTREEKDAVKAKVDAEAKKAKDAIDAATSNADVTAKQTEGTQAIN   1938

Query:  2008 AAYVPNKAVAKSSSAN                                            2023
             A   VP    AK+ + N
Sbjct:  1939 A--VPQTPTAKTDAKN                                            1952
```

An alignment of the GAS and GBS proteins is shown below:

```
Identities = 77/396 (19%), Positives = 157/396 (39%), Gaps = 48/396 (12%)

Query:   42 LNYELTNRDQAQNYHKQIKEHINENRLSTRGVRKDAILCNEWIITSDKTFFDSLDEKQTR   101
            L++E+ +  ++QN  K+I + +              D     E +I    K  +++  EK T
Sbjct:  338 LDFEILH-PRSQNVSKKISKQVEAKPF-------DPASYKEKVIAKLKPVYEATSEKITN   389

Query:  102 EFF--ETAKDYFAEKYGDANIAYARVHLDESTPHMHLGIVPMKNGKLSSKALFG--NKEK   157
             + +  E AKD  +K + I+              G V +    +A+   NK
Sbjct:  390 DAWLDENAKDLQKQKLEEQYIS---------------GKVAISEAGTKQEAIDAAYNKYS   434

Query:  158 LVAIQDELPKYLNEHGFNLQRGEIGSKKKHLETAEFKEKQRLLDN---ADRKLADKHEEL   214
               D LP   +   N + +  ++  ++T + K  D         K    K E L
Sbjct:  435 SQTDPDSLPSQYKQG--NKENEQEKGRQDLIQTRDLTLKAIQEDKWLTEQEKTIQKEEAL   492

Query:  215 KALDDKISNVNDTIADKESRLKELEAKEWDAVGDLKQYE----------LEKQSLAESIE   264
            KA +  I +VN T++ ++ + + +  K  +   + K+Y             EK+ A   E
Sbjct:  493 KAFETGIESVNQTVSLEQLKQRLIVYKASEKDSEKKEYPESIPNQHIPGKEKEVKAAKQE   552

Query:  265 DIKDIELLQLDRIQKEDLVKQSFDGKLKMDKETYNRLFQTASKHASSNAELKRDLVKAQS   324
              ++K +     L++I ++  +        +      +E   + Q A K A  +L+ DL     S
Sbjct:  553 ELKKLHDTTLEKINQDKWLTPDQQAEQLKQAEVTFKKGQEAIKSAQTLTQLETDLADYVS   612

Query:  325 QNNHLSRELLNHRKTAEKNIKLSQENRKLKDKVKMLDEQVK----ILNKSLSVWKEKAKE   380
             +N   +  +  K+  K+  +++    KLK+  +  + ++    +   +     KEKAK
Sbjct:  613 ENEGKGNSIPDKYKSGNKDDLVNKAEVKLKEAHEATKQAIEKDPWLSPEQKKAQKEKAKA   672

Query:  381 FMPKQVYRETLSIINTLNPIGLAKTAIRQVKKMVDS                         416
             + + +   + L    ++L  + + A     +K  DS
Sbjct:  673 RLDEGL--KALKAADSLEILKVTEEAFVDKEKNPDS                         706
```

Based on this analysis, it was predicted that these proteins and their epitopes could be useful antigens for vaccines or diagnostics.

EXAMPLE 181

A DNA sequence (GBSx0187) was identified in *S. agalactiae* <SEQ ID 599> which encodes the amino acid sequence <SEQ ID 600>. Analysis of this protein sequence reveals the following:

```
Possible site: 42
>>> Seems to have no N-terminal signal sequence

----- Final Results -----
          bacterial cytoplasm --- Certainty = 0.2544 (Affirmative) < succ>
          bacterial membrane  --- Certainty = 0.0000 (Not Clear)   < succ>
           bacterial outside  --- Certainty = 0.0000 (Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 182

A DNA sequence (GBSx0188) was identified in *S. agalactiae* <SEQ ID 601> which encodes the amino acid sequence <SEQ ID 602>. Analysis of this protein sequence reveals the following:

```
Possible site: 57
>>> Seems to have no N-terminal signal sequence

----- Final Results -----
            bacterial cytoplasm --- Certainty = 0.2045 (Affirmative) < succ>
             bacterial membrane --- Certainty = 0.0000 (Not Clear)   < succ>
              bacterial outside --- Certainty = 0.0000 (Not Clear)   < succ>
```

The protein has no significant homology with any sequences in the GENPEPT database.

A related DNA sequence was identified in *S. pyogenes* <SEQ ID 603> which encodes the amino acid sequence <SEQ ID 604>. Analysis of this protein sequence reveals the following:

```
Possible site: 57
>>> Seems to have no N-terminal signal sequence

----- Final Results -----
            bacterial cytoplasm --- Certainty = 0.2045 (Affirmative) < succ>
             bacterial membrane --- Certainty = 0.0000 (Not Clear)   < succ>
              bacterial outside --- Certainty = 0.0000 (Not Clear)   < succ>
```

An alignment of the GAS and GBS proteins is shown below:

```
Identities = 102/111 (91%), Positives = 107/111 (95%)

Query:   1 MDYKKYQIIYAPDVLEKLKEIRDYISQNYSSTSGQHKMEQIISDIEKLEVFPEVGFDADE    60
           +DYKKYQIIYAPDVLEKLKEIRDYISQNYSSTSGQ KMEQIISDIEKLEVFPEVGFDADE
Sbjct:   1 LDYKKYQIIYAPDVLEKLKEIRDYISQNYSSTSGQRKMEQIISDIEKLEVFPEVGFDADE    60

Query:  61 KYGSKISKYHSTRGYTLSKDYIVLYHIEEEENRVVIDYLLPTRSDYMKLFK             111
           KYGSKI YHST+GYTLSKDYIVLYHIE EENR+VIDYLLPT+SDY+KLFK
Sbjct:  61 KYGSKIIHYHSTKGYTLSKDYIVLYHIEGEENRIVIDYLLPTQSDYIKLFK             111
```

Based on this analysis, it was predicted that these proteins and their epitopes could be useful antigens for vaccines or diagnostics.

EXAMPLE 183

A DNA sequence (GBSx0189) was identified in *S. agalactiae* <SEQ ID 605> which encodes the amino acid sequence <SEQ ID 606>. Analysis of this protein sequence reveals the following:

```
Possible site: 13
>>> Seems to have no N-terminal signal sequence

----- Final Results -----
            bacterial cytoplasm --- Certainty = 0.1621(Affirmative) < succ>
             bacterial membrane --- Certainty = 0.0000(Not Clear)   < succ>
              bacterial outside --- Certainty = 0.0000(Not Clear)   < succ>
```

The protein has no significant homology with any sequences in the GENPEPT database.

A related DNA sequence was identified in *S. pyogenes* <SEQ ID 607> which encodes the amino acid sequence <SEQ ID 608>. Analysis of this protein sequence reveals the following:

```
Possible site: 22
>>> Seems to have no N-terminal signal sequence

----- Final Results -----
            bacterial cytoplasm --- Certainty = 0.1596(Affirmative) < succ>
```

```
                         -continued
            bacterial membrane --- Certainty = 0.0000(Not Clear) < succ>
            bacterial outside --- Certainty = 0.0000(Not Clear) < succ>
```

An alignment of the GAS and GBS proteins is shown below:

```
Identities = 91/95 (95%), Positives = 93/95 (97%)
Query:   1 MVTAEKNRAVTFQANKELVSEAMTVLNKKNLTLSSALRLFLQNVVVTNEVDLLTEEELEK   60
           M T +KNRAVTFQANKELVSEAMTVLNKKNLTLSSALRLFLQNVVVTNEVDLLTEEELEK
Sbjct:   1 MTTVKKNRAVTFQANKELVSEAMTVLNKKNLTLSSALRLFLQNVVVTNEVDLLTEEELEK   60

Query:  61 EKLFKQFQAEINKNIEDVRQGKFYTSEEVRSELGL                            95
           EKLFKQFQAEINKNIEDVRQGKFYTSEEVR+ELGL
Sbjct:  61 EKLFKQFQAEINKNIEDVRQGKFYTSEEVRAELGL                            95
```

Based on this analysis, it was predicted that these proteins and their epitopes could be useful antigens for vaccines or diagnostics.

EXAMPLE 184

A DNA sequence (GBSx0190) was identified in *S. agalactiae* <SEQ ID 609> which encodes the amino acid sequence <SEQ ID 610>. Analysis of this protein sequence reveals the following:

```
Possible site: 56
>>> Seems to have no N-terminal signal sequence

----- Final Results -----
            bacterial cytoplasm --- Certainty = 0.4568(Affirmative) < succ>
            bacterial membrane  --- Certainty = 0.0000(Not Clear)   < succ>
            bacterial outside   --- Certainty = 0.0000(Not Clear)   < succ>
```

A related GBS nucleic acid sequence <SEQ ID 9513> which encodes amino acid sequence <SEQ ID 9514> was also identified.

The protein has homology with the following sequences in the GENPEPT database:

```
>GP:CAA46375 GB:X65276 ORFA1 [Clostridium acetobutylicum]
Identities = 36/91 (39%), Positives = 51/91 (55%)
Query:   2 MSQIKLTPEELRISAQKYTTGSQSITDVLTVLTQEQAVIDENWDGTAFDSFEAQFNELSP   61
           M+QI +TPEEL+ AQ Y   + I  +  +   + I E W G AF ++  Q+N+L
Sbjct:   1 MAQISVTPEELKSQAQVYIQSKEEIDQAIQKVNSMNSTIAEEWKGQAFQAYLEQYNQLHQ   60

Query:  62 KITQFAQLLEDINQQLLKVADVVEQTDSDIA                                92
           + QF  LLE +NQQL K AD V + D+  A
Sbjct:  61 TVVQFENLLESVNQQLNKYADTVAERDAQDA                                91
```

No corresponding DNA sequence was identified in *S. pyogenes*.

Based on this analysis, it was predicted that these proteins and their epitopes could be useful antigens for vaccines or diagnostics.

EXAMPLE 185

A DNA sequence (GBSx0191) was identified in *S. agalactiae* <SEQ ID 611> which encodes the amino acid sequence <SEQ ID 612>. Analysis of this protein sequence reveals the following:

```
Possible site: 21
>>> Seems to have no N-terminal signal sequence

----- Final Results -----
            bacterial cytoplasm --- Certainty = 0.4523(Affirmative) < succ>
            bacterial membrane  --- Certainty = 0.0000(Not Clear)   < succ>
            bacterial outside   --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 186

A DNA sequence (GBSx0192) was identified in *S. agalactiae* <SEQ ID 613> which encodes the amino acid sequence <SEQ ID 614>. Analysis of this protein sequence reveals the following:

```
Possible site: 44
>>> Seems to have no N-terminal signal sequence

----- Final Results -----
            bacterial cytoplasm --- Certainty = 0.5339(Affirmative) < succ>
            bacterial membrane  --- Certainty = 0.0000(Not Clear)   < succ>
             bacterial outside  --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 187

A DNA sequence (GBSx0193) was identified in *S. agalactiae* <SEQ ID 615> which encodes the amino acid sequence <SEQ ID 616>. This protein is predicted to be chromosome assembly protein. Analysis of this protein sequence reveals the following:

```
Possible site: 61
>>> Seems to have no N-terminal signal sequence

----- Final Results -----
            bacterial cytoplasm --- Certainty = 0.4620(Affirmative) < succ>
            bacterial membrane  --- Certainty = 0.0000(Not Clear)   < succ>
             bacterial outside  --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 188

A DNA sequence (GBSx0194) was identified in *S. agalactiae* <SEQ ID 617> which encodes the amino acid sequence <SEQ ID 618>. Analysis of this protein sequence reveals the following:

```
Possible site: 46
>>> Seems to have no N-terminal signal sequence

----- Final Results -----
            bacterial cytoplasm --- Certainty = 0.4511(Affirmative) < succ>
```

```
                         -continued
          bacterial membrane --- Certainty = 0.0000(Not Clear) < succ>
          bacterial outside  --- Certainty = 0.0000(Not Clear) < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 189

A DNA sequence (GBSx0195) was identified in *S. agalactiae* <SEQ ID 619> which encodes the amino acid sequence <SEQ ID 620>. Analysis of this protein sequence reveals the following:

```
Possible site: 20
>>> Seems to have no N-terminal signal sequence

----- Final Results -----
          bacterial cytoplasm --- Certainty = 0.5249(Affirmative) < succ>
          bacterial membrane  --- Certainty = 0.0000(Not Clear)   < succ>
          bacterial outside   --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 190

A DNA sequence (GBSx0196) was identified in *S. agalactiae* <SEQ ID 621> which encodes the amino acid sequence <SEQ ID 622>. Analysis of this protein sequence reveals the following:

```
Possible site: 14
>>> Seems to have no N-terminal signal sequence

----- Final Results -----
          bacterial cytoplasm --- Certainty = 0.3542(Affirmative) < succ>
          bacterial membrane  --- Certainty = 0.0000(Not Clear)   < succ>
          bacterial outside   --- Certainty = 0.0000(Not Clear)   < succ>
```

A related GBS nucleic acid sequence <SEQ ID 9515> which encodes amino acid sequence <SEQ ID 9516> was also identified.

The protein has no significant homology with any sequences in the GENPEPT database.

No corresponding DNA sequence was identified in *S. pyogenes*.

Based on this analysis, it was predicted that these proteins and their epitopes could be useful antigens for vaccines or diagnostics.

EXAMPLE 191

A DNA sequence (GBSx0197) was identified in *S. agalactiae* <SEQ ID 623> which encodes the amino acid sequence <SEQ ID 624>. Analysis of this protein sequence reveals the following:

```
Possible site: 15
>>> Seems to have no N-terminal signal sequence

----- Final Results -----
          bacterial cytoplasm --- Certainty = 0.3098 (Affirmative) < succ>
           bacterial membrane --- Certainty = 0.0000 (Not Clear)   < succ>
            bacterial outside --- Certainty = 0.0000 (Not Clear)   < succ>
```

The protein has no significant homology with any sequences in the GENPEPT database.

No corresponding DNA sequence was identified in S. pyogenes.

Based on this analysis, it was predicted that this protein and its epitopes, could be useful antigens for vaccines or diagnostics.

EXAMPLE 192

A DNA sequence (GBSx0198) was identified in S. agalactiae <SEQ ID 625> which encodes the amino acid sequence <SEQ ID 626>. This protein is predicted to be rgg protein. Analysis of this protein sequence reveals the following:

```
Possible site: 59
>>> Seems to have no N-terminal signal sequence

----- Final Results -----
          bacterial cytoplasm --- Certainty = 0.3177 (Affirmative) < succ>
           bacterial membrane --- Certainty = 0.0000 (Not Clear)   < succ>
            bacterial outside --- Certainty = 0.0000 (Not Clear)   < succ>
```

The protein has homology with the following sequences in the GENPEPT database:

```
>GP: AAA26968 GB: M89776 rgg [Streptococcus gordonii]
Identities = 74/277 (26%), Positives = 142/277 (50%)

Query:    7 IFREFRLNRQFSLKQVASNELSVSQLSRFERGESDLSLTKFLGALEAIDLSISEFMDRVN   66
            I +  R ++   SLK+VA+ ++SV+QLSR+ERG S L++  F    L  + +S++EF       +
Sbjct:   10 ILKIIRESKNMSLKEVAAGDISVAQLSRYERGISSLTVDSFYSCLRNMSVSLAEFQYVYH    69

Query:   67 KYQKSDQISLMSQMAQYHYQRDVAGLEKMISVEEGKLKKDSSDIRCRLNIVLFRGMICEC  126
            Y+++D + L   ++++   + ++  LE +++   E     ++         +LN ++ R   +    C
Sbjct:   70 NYREADDVVLSQKLSEAQRENNIVKLESILAGSEAMAQEFPEKKNYKLNTIVIRATLTSC   129

Query:  127 DSSRKMSEEDLCFLSDYLFQKDSWEISDYILIGNLYRYYNTRHICQLVKEVINQKEYYRD  186
            +     ++S+ D+ FL+DYLF    + W    + L  N          +       E+IN+ ++Y +
Sbjct:  130 NPDYQVSKGDIEFLTDYLFSVEEWGRYELWLFTNSVNLLTLETLETFASEMINRTQFYNN   189

Query:  187 IYTNRNVVEATLLNVVETLIERRALEEATFFLEKVEALLNNERNAYHRIILLYEKGFLAY  246
            +   NR  +   LLNVV   IE    L+ A  FL  ++      E + Y R+++ Y K   +Y
Sbjct:  190 LPENRRRIIKMLLNVVSACIENNHLQVAMKFLNYIDNTKIPETDLYDRVLIKYHKALYSY   249

Query:  247 AKGDSRGIQSMKQAIFCFQAIGSKHHVENFQEHFNRV                         283
               G+     ++Q +  F+ + S        +E F R+
Sbjct:  250 KVGNPHARHDIEQCLSTFEYLDSFGVARKLKEQFERI                         286
```

A related DNA sequence was identified in S. pyogenes <SEQ ID 627> which encodes the amino acid sequence <SEQ ID 628>. Analysis of this protein sequence reveals the following:

```
Possible site: 29
>>> Seems to have no N-terminal signal sequence

----- Final Results -----
          bacterial cytoplasm --- Certainty = 0.3792 (Affirmative) < succ>
           bacterial membrane --- Certainty = 0.0000 (Not Clear)   < succ>
            bacterial outside --- Certainty = 0.0000 (Not Clear)   < succ>
```

An alignment of the GAS and GBS proteins is shown below:

```
Identities = 79/275 (28%), Positives = 146/275 (52%), Gaps = 11/275 (4%)

Query:    9 REFRLNRQFSLKQVASNELSVSQLSRFERGESDLSLTKFLGALEAIDLSISEFMDRVNKY  68
            R R +Q S+ +A   LS SQ+SRFERGES+++ ++ L  L+ ++++I EF+   +K
Sbjct:   15 RRLRKGKQVSISFLADEYLSKSQISRFERGESEITCSRLLNLLDKLNITIDEFVSAHSKT  74

Query:   69 QKSDQISLMSQMAQYHYQRDVAGLEKMISVEEGKLKKDSSDIRCRLNIVLFRGMICECDS  128
              +  +L+SQ + + +++V L K++   +    KD    R +  +LF        DS
Sbjct:   75 H-THFFTLLSQARKCYAEKNVVKLTKLL---KDYAHKDYE--RTMIKAILF-----SIDS  123

Query:  129 SRKMSEEDLCFLSDYLFQKDSWEISDYILIGNLYRYYNTRHICQLVKEVINQKEYYRDIY  188
              S   S+E+L  L+DYLF+ + W   + IL+GN R+ N    +  L KE++     Y
Sbjct:  124 SIAPSQEELTRLTDYLFKVEQWGYYEIILLGNCSRFMNYNTLFLLTKEMVASFAYSEQNK  183

Query:  189 TNRNVVEATLLNVVETLIERRALEEATFFLEKVEALLNNERNAYHRIILLYEKGFLAYAK  248
              TN+ +V   +N +   I+    E + + K++ LL +E N Y + + LY  G+    +
Sbjct:  184 TNKMLVTQLSINCLIISIDHSCFEHSRYLINKIDLLLRDELNFYEKTVFLYVHGYYKLKQ  243

Query:  249 GDSRGIQSMKQAIFCFQAIGSKHHVENFQEHFNRV                          283
              +  G + M+QA+  F+ +G           +++EH+ ++
Sbjct:  244 EEMSGEEDMRQALQIFKYLGEDSLYYSYKEHYRQI                          278
```

Based on this analysis, it was predicted that these proteins and their epitopes could be useful antigens for vaccines or diagnostics.

EXAMPLE 193

A DNA sequence (GBSx0199) was identified in *S. agalactiae* <SEQ ID 629> which encodes the amino acid sequence <SEQ ID 630>. This protein is predicted to be permease. Analysis of this protein sequence reveals the following:

```
Possible site: 15
>>> Seems to have no N-terminal signal sequence
      INTEGRAL    Likelihood = -8.07    Transmembrane    217-233 (215-238)
      INTEGRAL    Likelihood = -7.96    Transmembrane    163-179 (158-185)
      INTEGRAL    Likelihood = -7.75    Transmembrane     71-87  (69-91)
      INTEGRAL    Likelihood = -7.22    Transmembrane    369-385 (356-389)
      INTEGRAL    Likelihood = -5.15    Transmembrane    279-295 (275-299)
      INTEGRAL    Likelihood = -4.88    Transmembrane    252-268 (250-270)
      INTEGRAL    Likelihood = -4.78    Transmembrane    140-156 (139-157)
      INTEGRAL    Likelihood = -3.56    Transmembrane    343-359 (340-367)
      INTEGRAL    Likelihood = -3.13    Transmembrane     40-56  (39-56)
      INTEGRAL    Likelihood = -2.28    Transmembrane     94-110 (92-112)

----- Final Results -----
           bacterial membrane --- Certainty = 0.4227(Affirmative) < succ>
            bacterial outside --- Certainty = 0.0000(Not Clear)   < succ>
          bacterial cytoplasm --- Certainty = 0.0000(Not Clear)   < succ>
```

The protein has homology with the following sequences in the GENPEPT database:

```
>GP: AAD36408 GB: AE001788 permease,
putative [Thermotoga maritima]
Identities = 97/396 (24%), Positives = 194/396 (48%),
Gaps = 15/396 (3%)

Query:    1 MNINGIKLLSSRAVSKLGDVFYDYGNSTWIASMGGLGQKILGIYQIVELLVSIVLNPFGG  60
            MN N +   S   VS +G   Y   + W+ S  G  + G++  I    L +I+++PF G
Sbjct:    1 MNRNLLLFASGSFVSLIGTRIYQVALAWWLYSKTGSSEYV-GLFMISSFLPAIIVSPFAG  59

Query:   61 ALADRFQRRKILLITDAICAIM---CFLLSFIGDDKVMVYGLIVANAILAVSNAFSSPAY  117
             + DR  RR ++++ D + +      FL+ +  + + +   L++    +++V ++F +PA
Sbjct:   60 TVVDRHSRRNMMVVMDILRGVLFMYLFLMEYFSELTMAL--LLIVTVLVSVFDSFFNPAV  117

Query:  118 KSYIPEIVDKADIITYNANLETIVQIISVSSPVLGFLIFNNFGIRITLIVDAITFLISFL  177
              S +P++V K +++ N+     +   +   P LG L+      G+     +++++FLIS +
Sbjct:  118 DSLLPDLVRKENLVRANSLYRLLKNLSKILGPALGSLLLKVVGLAGVILINSLSFLISGI  177
```

-continued

```
Query:  178 FLYAIKVERVQLSKQEKVAIKNILADIADGFTYIKKEKEIMFFLIIAALLNTFLAMFNYL  237
            F   IKVE   L K K   +N+  DI      YI+  + I+   +++ A++N F     + L
Sbjct:  178 FEMFIKVEEKHLKKVSKE--RNMWQDIKSALLYIRSVRFILVTILVIAIMNFFTGSMHVL  235

Query:  238 LP-FTNSLLKTSGAYATILSISAIGSIIGALIARKI--KSSINSMLSMLVFSSLGVIVMG  294
            LP  + L K+    Y T++S+ + G +I    +   I   ++S+ ++    LV   L V V
Sbjct:  236 LPEHVSKLGKSEWVYGTLMSMLSFGGLIVTFLMATIRTRASVKTLGLNLVGYGLAVFVFA  295

Query:  295 FPSLFELPIWIPYSGSFLFNSLLTMFNIHFFSQVQIRVDEAYMGRVMSTIFTIAIMFMPI  354
                     W+ ++   FL     T+FNI+  + +Q+ + E    G++ S I  ++    +P+
Sbjct:  296 MTGNH----WLMFAMYFLIGIFQTLFNINVITLLQLAIPEEMRGKIFSLISAVSFSLLPV  351

Query:  355 GTLFMTIFSFALSNVSFIVIGCAIAILGGLGFSYSK                         390
                 F    S ++       +       I GG+  S   +
Sbjct:  352 SYGFFGFLSSYVATAHIFITTSMALIAGGVLISLQR                         387
```

15

A related DNA sequence was identified in *S. pyogenes* <SEQ ID 631> which encodes the amino acid sequence <SEQ ID 632>. Analysis of this protein sequence reveals the following:

```
Possible site: 45
>>> Seems to have no N-terminal signal sequence
    INTEGRAL    Likelihood = -8.17    Transmembrane   172-188  (161-194)
    INTEGRAL    Likelihood = -8.07    Transmembrane   220-236  (218-242)
    INTEGRAL    Likelihood = -7.22    Transmembrane   311-327  (303-329)
    INTEGRAL    Likelihood = -5.26    Transmembrane    98-114   (96-118)
    INTEGRAL    Likelihood = -4.99    Transmembrane   347-363  (342-370)
    INTEGRAL    Likelihood = -4.62    Transmembrane   154-170  (151-171)
    INTEGRAL    Likelihood = -4.25    Transmembrane   284-300  (281-306)
    INTEGRAL    Likelihood = -3.66    Transmembrane   378-394  (378-396)
    INTEGRAL    Likelihood = -3.56    Transmembrane    74-90    (73-92)
    INTEGRAL    Likelihood = -2.39    Transmembrane    50-66    (49-66)

----- Final Results -----
            bacterial membrane  --- Certainty = 0.4270(Affirmative) < succ>
            bacterial outside   --- Certainty = 0.0000(Not Clear)   < succ>
            bacterial cytoplasm --- Certainty = 0.0000(Not Clear)   < succ>
```

The protein has homology with the following sequences in the databases:

```
>GP: AAD36408 GB: AE001788 permease, putative [Thermotoga maritima]
Identities = 85/345 (24%), Positives = 171/345 (48%), Gaps = 8/345 (2%)

Query:   40 SLSLVAVYQSLESVIGVLFNLFGGVIADSFKRKKIIITTNILCGTACLVLSFLTKEQWLV   99
            S  V ++    + ++ + F G + D    R+ +++  +IL G     + L +       L
Sbjct:   36 SSEYVGLFMISSFLPAIIVSPFAGTVVDRHSRRNMMVVMDILRGVLFMYLFLMEYFSELT   95

Query:  100 YAIVL-TNVILAFMSAFSSPSYKAFTKEIVKKDSISQLNSLLETTSTVIKVTVPMVAIFL  158
            A++L   V+++    +F +P+  +     ++V+K+++ + NSL         + K+  P +    L
Sbjct:   96 MALLLIVTVLVSVFDSFFNPAVDSLLPDLVRKENLVRANSLYRLLKNLSKILGPALGSLL  155

Query:  159 YKLLGIHGVLLLDGLSFLIAALLISFILPVNDEVVIKEKVTIREIFNDLKIGFKYVYSHK  218
              K++G+ GV+L++ LSFLI+ +   FI      +E  +K+    R ++ D+K    Y+  S +
Sbjct:  156 LKVVGLAGVILINSLSFLISGIFEMFIKV--EEKHLKKVSKERNMWQDIKSALLYIRSVR  213

Query:  219 SIFIITVLSALVNFFLAAYNLLLPYSNQMFGEISTGLYGTFLTAEAIGGFIGAILSGFVN  278
                I +  ++ A++NFF + ++LLP      G+  S +YGT ++   + GG I     L       +
Sbjct:  214 FILVTILVIAIMNFFTGSMHVLLPEHVSKLGK-SEWVYGTLMSMLSFGGLIVTFLMATIR  272

Query:  279 KELSSMRLILFLSLSGLMLMLAPPFYIMFHNAIILALSPALFSLFLSIFNIQFFSLVQKD  338
                       S    L L L   GL + +         + M N ++         L  +F ++FNI    +L+Q
Sbjct:  273 TRASVKTLGLNLVGYGLAVFV----FAMTGNHWLMFAMYFLIGIFQTLFNINVITLLQLA  328

Query:  339 VDNDFLGRVFGIIFTITILFMPIGTGFFSVALNPNNSFNLFIIGS                383
             +  +    G++F +I   ++     +P+    GFF            +   + ++FI   S
Sbjct:  329 IPEEMRGKIFSLISAVSFSLLPVSYGFFGFLSSYVATAHIFITTS                373
```

65

An alignment of the GAS and GBS proteins is shown below:

```
Identities = 136/379 (35%), Positives = 229/379 (59%), Gaps = 6/379 (1%)

Query:     8 LLSSRAVSKLGDVFYDYGNSTWIASMGGLGQKILGIYQIVELLVSIVLNPFGGALADRFQ    67
             L+ S+ + ++GDV +D+ N+T++A +      ++ +YQ +E ++ ++ N FGG +AD F+
Sbjct:    11 LVYSKVIYRIGDVMFDFANNTFLAGLNPASLSLVAVYQSLESVIGVLFNLFGGVIADSFK    70

Query:    68 RRKILLITDAICAIMCFLLSFIGDDKVMVYGLIVANAILAVSNAFSSPAYKSYIPEIVDK   127
             R+KI++ T+ +C   C +LSF+ ++ +VY +++ N ILA  +AFSSP+YK++  EIV K
Sbjct:    71 RKKIIITTNILCGTACLVLSFLTKEQWLVYAIVLTNVILAFMSAFSSPSYKAFTKEIVKK   130

Query:   128 ADIITYNANLETIVQIISVSSPVLGFLIFNNFGIRITLIVDAITFLISFLFLYAIKVERV   187
                I   N+ LET  +I V+ P++   ++    GI    L++D ++FLI+ L +  I
Sbjct:   131 DSISQLNSLLETTSTVIKVTVPMVAIFLYKLLGIHGVLLLDGLSFLIAALLISFILPVND   190

Query:   188 QLSKQEKVAIKNILADIADGFTYIKKEKEIMFFLIIAALLNTFLAMFNYLLPFTNSLLK-   246
                ++ +EKV I+ I  D+ GF Y+   K I   +++AL+N FLA +N LLP++N +
Sbjct:   191 EVVIKEKVTIREIFNDLKIGFKYVYSHKSIFIITVLSALVNFFLAAYNLLLPYSNQMFGE   250

Query:   247 -TSGAYATILSISAIGSIIGALIARKIKSSINSMLSMLVFSSLGVIVMGFPS---LFELP   302
              ++G Y T L+  AIG  IGA+++  +   ++SM  +L  S  G+++M  P     +F
Sbjct:   251 ISTGLYGTFLTAEAIGGFIGAILSGFVNKELSSMRLILFLSLSGLMLMLAPPFYIMFHNA   310

Query:   303 IWIPYSGSFLFNSLLTMFNIHFFSQVQIRVDEAYMGRVMSTIFTIAIMFMPIGTLFMTIF   362
             I +  S + LF+  L++FNI FFS VQ  VD  ++GRV   IFTI I+FMPIGT F ++
Sbjct:   311 IILALSPA-LFSLFLSIFNIQFFSLVQKDVDNDFLGRVFGIIFTITILFMPIGTGFFSVA   369

Query:   363 SFALSNVSFIVIGCAIAIL                                           381
             ++ +  +IG  I  L
Sbjct:   370 LNPNNSFNLFIIGSCITTL                                          388
```

Based on this analysis, it was predicted that these proteins and their epitopes could be useful antigens for vaccines or diagnostics.

EXAMPLE 194

A DNA sequence (GBSx0200) was identified in *S. agalactiae* <SEQ ID 633> which encodes the amino acid sequence <SEQ ID 634>. This protein is predicted to be membrane permease OpuCD. Analysis of this protein sequence reveals the following:

```
Possible site: 46
>>> Seems to have an uncleavable N-term signal seq
    INTEGRAL    Likelihood = -5.68    Transmembrane     91-107  (88-110)
    INTEGRAL    Likelihood = -4.30    Transmembrane     15-31   (9-37)
    INTEGRAL    Likelihood = -3.72    Transmembrane     72-88   (72-88)
    INTEGRAL    Likelihood = -3.19    Transmembrane    124-140  (123-142)

----- Final Results -----
            bacterial membrane --- Certainty = 0.3272(Affirmative) < succ>
             bacterial outside --- Certainty = 0.0000(Not Clear) < succ>
           bacterial cytoplasm --- Certainty = 0.0000(Not Clear) < succ>
```

A related GBS nucleic acid sequence <SEQ ID 8509> which encodes amino acid sequence <SEQ ID 8510> was also identified. Analysis of this protein sequence reveals the following:

```
Lipop: Possible site: -1 Crend: 1
McG: Discrim Score: -10.69
GvH: Signal Score (-7.5): -3.79
    Possible site: 39
>>> Seems to have no N-terminal signal sequence
ALOM program count: 5 value: -9.02 threshold: 0.0
    INTEGRAL     Likelihood = -9.02    Transmembrane     35-51   (25-53)
    INTEGRAL     Likelihood = -5.68    Transmembrane    151-167  (148-170)
    INTEGRAL     Likelihood = -4.30    Transmembrane     75-91   (69-97)
    INTEGRAL     Likelihood = -3.72    Transmembrane    132-148  (132-148)
    INTEGRAL     Likelihood = -3.19    Transmembrane    184-200  (183-202)
    PERIPHERAL   Likelihood =  2.17         58
modified ALOM score: 2.30
*** Reasoning Step: 3

----- Final Results -----
            bacterial membrane --- Certainty = 0.4609(Affirmative) < succ>
```

```
                bacterial outside --- Certainty = 0.0000(Not Clear) < succ>
              bacterial cytoplasm --- Certainty = 0.0000(Not Clear) < succ>
```

The protein has homology with the following sequences in the GENPEPT database:

```
>GP: AAF91342 GB: AF249729 membrane permease OpuCD
[Listeria monocytogenes]
Identities = 104/154 (67%), Positives = 133/154 (85%)

Query:   3 IANVIQTIPSLAMISIIMLGLGLGIKTVVATVFLYSLLPIITNTYTGIRNVDSDLLDAAK    62
           IAN+IQTIP+LAM++++ML +GLG  TVV ++FLYSLLPI+ NTYTGIRNVD  LL++ K
Sbjct:  60 IANIIQTIPALAMLAVLMLIMGLGTNTVVLSLFLYSLLPILKNTYTGIRNVDGALLESGK   119

Query:  63 GMGMTKRQRLFMVELPLSISVIMAGLRNALVVAIGITAIGAFVGGGGLGDIIIRGTNATN   122
           MGMTK Q L ++E+PL++SVIMAG+RNALV+AIG+ AIG FVG GGLGDII+RGTNATN
Sbjct: 120 AMGMTKWQVLRLIEMPLALSVIMAGIRNALVIAIGVAAIGTFVGAGGLGDIIVRGTNATN   179

Query: 123 GGAIILAGSLPTALMAIFSDLILGGIQRMLEPRK                            156
           G AIILAG++PTA+MAI +D++LG ++R L P K
Sbjct: 180 GTAIILAGAIPTAVMAILADVLLGWVERTLNPVK                            213
```

A related DNA sequence was identified in *S. pyogenes* <SEQ ID 635> which encodes the amino acid sequence <SEQ ID 636>. Analysis of this protein sequence reveals the following:

```
Possible site: 49
>>> Seems to have no N-terminal signal sequence
    INTEGRAL     Likelihood = -9.24    Transmembrane     39-55 (31-59)
    INTEGRAL     Likelihood = -7.17    Transmembrane   190-206 (188-211)
    INTEGRAL     Likelihood = -4.62    Transmembrane    93-109 (75-110)
    INTEGRAL     Likelihood = -3.66    Transmembrane     76-92 (75-92)
    INTEGRAL     Likelihood = -2.87    Transmembrane   221-237 (220-237)
    INTEGRAL     Likelihood = -2.44    Transmembrane   168-184 (165-184)

----- Final Results -----
              bacterial membrane --- Certainty = 0.4694(Affirmative) < succ>
               bacterial outside --- Certainty = 0.0000(Not Clear)   < succ>
             bacterial cytoplasm --- Certainty = 0.0000(Not Clear)   < succ>
```

The protein has homology with the following sequences in the databases:

```
>GP: AAD45530 GB: AF162656 choline transporter [Streptococcus pneumoniae]
Identities = 344/508 (67%), Positives = 425/508 (82%), Gaps = 2/508 (0%)

Query:  13 MPSLFVTFQNRFNEWLAALGEHLQISLLSLMIALLIGVPLAALLSRKRWSDIMLQVTGV    72
           M +L   TFQ+RF++WL AL +HLQ+SLL+L++A+L+ +PLA  L   ++ +D +LQ+ G+
Sbjct:   1 MTNLIATFQDRFSDWLTALSQHLQLSLLTLLLAILLAIPLAVFLRYHEKLADWVLQIAGI    60

Query:  73 FQTIPSLALLGLFIPLMGIGTLPAVTALVIYAIFPILQNTITGLNGIDPSLVEAGIAFGM   132
           FQTIPSLALLGLFIPLMGIGTLPA+TALVIYAIFPILQNTITGL GIDP+L EAGIAFGM
Sbjct:  61 FQTIPSLALLGLFIPLMGIGTLPALTALVIYAIFPILQNTITGLKGIDPNLQEAGIAFGM   120

Query: 133 TKWERLKTFEIPIAMPVIMSGVRTSAVMIIGTATLASLIGAGGLGSFILLGIDRNNANLI   192
           T+WERLK FEIP+AMPVIMSG+RT+AV+ IIGTATLA+LIGAGGLGSFILLGIDRNNA+LI
Sbjct: 121 TRWERLKKFEIPLAMPVIMSGIRTAAVLIIGTATLAALIGAGGLGSFILLGIDRNNASLI   180

Query: 193 LIGAISSSALLAIIFNSLLQYLEKASLRRIMISFGITLLALLASYTPMALSQFSKGKDTVV   252
           LIGA+SSA+LAI FN LL+ +EKA LR I   F + L L  SY+P  L Q  K K+ +V
Sbjct: 181 LIGALSSAVLAIAFNFLLKVMEKAKLRTIFSGFALVALLLGLSYSPALLVQ--KEKENLV   238

Query: 253 IAGKLGAEPDILINLYKELIEDQSDISVELKSNFGKTSFLYEALKSGDIDMYPEFTGTIT   312
           IAGK+G EP+IL N+YK LIE+ + +   +K NFGKTSFLYEALK GDID+YPEFTGT+T
Sbjct: 239 IAGKIGPEPEILANMYKLLIEENTSMTATVKPNFGKTSFLYEALKKGDIDIYPEFTGTVT   298

Query: 313 SSLLRDKPPLSNDPKQVYEDAKKGIAKQDKLTLLKPFAYQNTYAVAMPEKLAKEYQIETI   372
           SLL+  P +S++P+QVY+ A+ GIAKQD L LKP +YQNTYAVA+P+K+A+EY ++TI
Sbjct: 299 ESLLQPSPKVSHEPEQVYQVARDGIAKQDHLAYLKPMSYQNTYAVAVPKKIAQEYGLKTI   358
```

-continued

```
Query:  373 SDLKAHADTLKAGFTLEFKDRADGYKGMQSQYGLQLSVATMEPALRYQAIQSGDIQVTDA  432
            SDLK     LKAGFTLEF DR DG KG+QS YGL L+VAT+EPALRYQAIQSGDIQ+TDA
Sbjct:  359 SDLKKVEGQLKAGFTLEFNDREDGNKGLQSMYGLNLNVATIEPALRYQAIQSGDIQITDA  418

Query:  433 YSTDAEITKYHLKVLKDDKQLFPPYQGAPLMKTSLLTKHPELKGILNQLAGKITEKEMQD  492
            YSTDAE+ +Y L+VL+DDKQLFPPYQGAPLMK +LL KHPEL+ +LN LAGKITE +M
Sbjct:  419 YSTDAELERYDLQVLEDDKQLFPPYQGAPLMKEALLKKHPELERVLNTLAGKITESQMSQ  478

Query:  493 MNYEVSVKGADANKVARDYLLKTGLIQK                                 520
            +NY+V V+G  A +VA+++L + GL++K
Sbjct:  479 LNYQVGVEGKSAKQVAKEFLQEQGLLKK                                 506
```

An alignment of the GAS and GBS proteins is shown below:

```
Identities = 53/148 (35%), Positives = 93/148 (62%), Gaps = 1/148 (0%)

Query:    3 IANVIQTIPSLAMISIIMLGLGLGIKTVVATVFLYSLLPIITNTYTGIRNVDSDLLDAAK   62
            +  V QTIPSLA++ + +  +G+G    V  + +Y++ PI+ NT TG+  +D  L++A
Sbjct:   69 VTGVFQTIPSLALLGLFIPLMGIGTLPAVTALVIYAIFPILQNTITGLNGIDPSLVEAGI  128

Query:   63 GMGMTKRQRLFMVELPLSISVIMAGLRNALVVAIGITAIGAFVGGGGLGDIIIRGTNATN  122
              GMTK +RL    E+P+++ VIM+G+R + V+ IG   + +G GGLG  I+ G +  N
Sbjct:  129 AFGMTKWERLKTFEIPIAMPVIMSGVRTSAVMIIGTATLASLIGAGGLGSFILLGIDRNN  188

Query:  123 GGAIILAGSLPTALMAIFSDLILGGIQR                                 150
             +IL G++ +AL+AI  + +L  +++
Sbjct:  189 AN-LILIGAISSALLAIIFNSLLQYLEK                                 215
```

Based on this analysis, it was predicted that these proteins and their epitopes could be useful antigens for vaccines or diagnostics.

EXAMPLE 195

A DNA sequence (GBSx0201) was identified in *S. agalactiae* <SEQ ID 637> which encodes the amino acid sequence <SEQ ID 638>. This protein is predicted to be choline transporter-related. Analysis of this protein sequence reveals the following:

```
Possible site: 44
>>> May be a lipoprotein
    INTEGRAL    Likelihood = -3.03    Transmembrane   306-322 (306-327)

----- Final Results -----
            bacterial membrane --- Certainty = 0.2211(Affirmative) < succ>
            bacterial outside  --- Certainty = 0.0000(Not Clear)   < succ>
            bacterial cytoplasm --- Certainty = 0.0000(Not Clear)   < succ>
```

A related GBS nucleic acid sequence <SEQ ID 9517> which encodes amino acid sequence <SEQ ID 9518> was also identified.

The protein has homology with the following sequences in the GENPEPT database:

```
>GP: CAB15386 GB: Z99121 glycine betaine/carnitine/choline ABC
transporter (osmoprotectant-binding protein) [Bacillus subtilis]
Identities = 168/303 (55%), Positives = 224/303 (73%), Gaps = 1/303 (0%)

Query:    2 LKKSHFLQIFTLCLALLTISGCQLTDTKKSGHTTIKVAAQSSTESSIMANIITELIHHEL   61
            + K +L  F L  +L + GC L    +   TIK+ AQS TES I+AN+I +LI H+
Sbjct:    1 MTKIKWLGAFALVFVML-LGGCSLPGLGGASDDTIKIGAQSMTESEIVANMIAQLIEHDT   59

Query:   62 GYNTTLISNLGSSTVTHQALLRGDADIAATRYTGTDITGTLGLKAVKDPKEASKIVKTEF  121
              NT L+ NLGS+ V HQA+L GD DI+ATRY+GTD+T TLG +A KDPK+A  IV+ EF
Sbjct:   60 DLNTALVKNLGSNYVQHQAMLGGDIDISATRYSGTDLTSTLGKEAEKDPKKALNIVQNEF  119

Query:  122 QKRYNQTWYPTYGFSDTYAFMVTKEFARQNKITKISDLKKLSTTMKAGVDSSWMNREGDG  181
            QKR++  W+ +YGF +TYAF VTK+FA +  I  +SDLKK ++  K GVD++W+ R+GDG
Sbjct:  120 QKRFSYKWFDSYGFDNTYAFTVTKKFAEKEHINTVSDLKKNASQYKLGVDNAWLKRKGDG  179
```

-continued

```
Query: 182 YTDFAKTYGFEFSHIYPMQIGLVYDAVESNKMQSVLGYSTDGRISSYDLEILRDDKKFFP 241
            Y  F  TYGFEF   YPMQIGLVYDAV++ KM +VL YSTDGRI +YDL+IL+DDK+FFP
Sbjct: 180 YKGFVSTYGFEFGTTYPMQIGLVYDAVKNGKMDAVLAYSTDGRIKAYDLKILKDDKRFFP 239

Query: 242 PYEASMVVNNSIIKKDPKLKKLLHRLDGKINLKTMQNLNYMVDDKLLEPSVVAKQFLEKN 301
            PY+ S V+   ++K+ P+L+ ++++L G+I+ +TMQ LNY VD KL EPSVVAK+FLEK+
Sbjct: 240 PYDCSPVIPEKVLKEHPELEGVINKLIGQIDTETMQELNYEVDGKLKEPSVVAKEFLEKH 299

Query: 302 HYF                                                          304
            HYF
Sbjct: 300 HYF                                                          302
```

Based on this analysis, it was predicted that these proteins and their epitopes could be useful antigens for vaccines or diagnostics.

A related GBS gene <SEQ ID 8511> and protein <SEQ ID 8512> were also identified. Analysis of this protein sequence reveals the following:

```
Lipop: Possible site: 22 Crend: 5
McG: Discrim Score: 10.26
GvH: Signal Score (-7.5): -4.19
Possible site: 44
>>> May be a lipoprotein
ALOM program count: 0 value: 8.65 threshold: 0.0
   PERIPHERAL Likelihood = 8.65 66
modified ALOM score: -2.23

----- Final Results -----
            bacterial membrane --- Certainty = 0.0000 (Not Clear) < succ>
            bacterial outside  --- Certainty = 0.0000 (Not Clear) < succ>
            bacterial cytoplasm --- Certainty = 0.0000 (Not Clear) < succ>
```

The protein has homology with the following sequences in the databases:

```
56.3/75.4% over 287aa
Bacillus subtillus
EGAD|109208|glycine betaine/carnitine/choline ABC Insert characterized
SP|O32243|OPCC_BACSU GLYCINE BETAINE/CARNITINE/CHOLINE-BINDINGE PROTEIN PRECURSOR
(OSMOPROTECTANT-BINDING PROTEIN). Insert characterized
GP|2635894|emb|CAB15386.1||Z99121 glycine betaine/carnitine/choline ABC trasporter
(osmoprotectant-binding protein) Insert characterized
PIR|E69670|E69670 glycine betaine/carnitine/choline ABC transporter (osmoprotec)
opuCC-Insert characterized
```

```
ORF01181(349-1212 of 1524)
EGAD|109208|BS33776(15-302 of 303)glycine betaine/carnitine/choline ABC
{Bacillus subtilus}SP|O32243|OPCC_BACSU GLYCINE BETAINE/CANITINE/CHOLINE-BINDING
PROTEIN PRECURSOR(OSMOPROTECTANT-BINDING PROTEIN). GP|2635894|emb|CAB15386.1||Z99121
glycine betaine/carnitine/choline ABC transporter (osmoprotectant-binding protein)
{Bacillus subtilis}PIR|E69670|E69670 glycine betaine/carnitine/choline ABC
transporter (osmoprotec)opuCC-Bacillus subtilis
% Match = 33.5
% Identity = 56.2  % Similarity = 75.3
Matches = 162  Mismatches = 71  Conservative Sub.s = 55
```

-continued

```
   162       192       222       252       282       312       342       372
VVVFFLIVF*QCLIFIFSVRYKSGSMKRIWGVXXN*LXXITGNSSNAQNNKKGGLDMLKKSHFLQIFTLCLALLTISGCQ
                                                                   : ::  :  ||
                                                                MTKIKWLGAFALVFVMLLGGCS
                                                                   10        20

402       432       462       492       522       552       582       612
LTDTKKSGHTTIKVAAQSSTESSIMANIITELIHHELGYNTTLISNLGSSTVTHQALLRGDADIAATRYTGTDITGTLGL
|    :    |||: ||| ||| |:||:| :||  |:   || |: ||||:  | |||:| || ||:||||:|||:| |||
LPGLGGASDDTIKIGAQSMTESEIVANMIAQLIEHDTDLNTALVKNLGSNYVQHQAMLGGDIDISATRYSGTDLTSTLGK
     40        50        60        70        80        90        100

642       672       702       732       762       792       822       852
KAVKDPKEASKIVKTEXQKRYNQTWYPTYGFSDTYAFMVTKEFARQNKITKISDLKKLSTTMKAGVDSSWMNREGDGYTD
:| ||||:| ||: | |||::  |: :||| :|||| |||:|| :     |  :||||| ::  | |||::|: |:||||
EAEKDPKKALNIVQNEFQKRFSYKWFDSYGFDNTYAFTVTKKFAEKEHINTVSDLKKNASQYKLGVDNAWLKRKGDGYKG
    120       130       140       150       160       170       180

882       912       942       972      1002      1032      1062      1092
FAKTYGFEFSHIYPMQIGLVYDAVESNKMQSVLGYSTDGRISSYDLEILRDDKKFFPPYEASMVVNNSIIKKDPKLKKLL
|  ||||| |||||||||||||::  ||  :|| |||||||  :|||:||:|||:||||||:  |:    ::| :|:: ::
FVSTYGFEFGTTYPMQIGLVYDAVKNGKMDAVLAYSTDGRIKAYDLKILKDDKRFFPPYDCSPVIPEKVLKEHPELEGVI
       200       210       220       230       240       250       260

1122      1152      1182      1212      1242      1272      1302      1332
HRLDGKINLKTMQNLNYMVDDKLLEPSVVAKQFLEKNHYFRGDK*MKQMNTFQQFIYYFQHNGSYILEQFIHHFLISVYG
::|  |:|:  :|||   ||| || ||  ||||||||:||||:|||
NKLIGQIDTETMQELNYEVDGKLKEPSVVAKEFLEKHHYFD
       280       290       300
```

Figure 14:
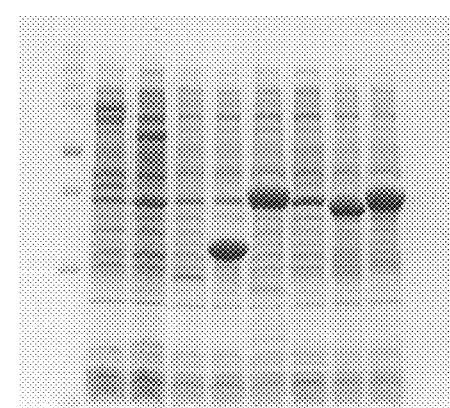

SEQ ID 8512 (GBS23) was expressed in *E. coli* as a His-fusion product. SDS-PAGE analysis of total cell extract is shown in FIG. 14 (lane 8; MW 35 kDa).

The GBS23-His fusion product was purified (FIG. 194, lane 9) and used to immunise mice. The resulting antiserum was used for Western blot (FIG. 251). These tests confirm that the protein is immunoaccessible on GBS bacteria.

EXAMPLE 196

A DNA sequence (GBSx0202) was identified in *S. agalactiae* <SEQ ID 639> which encodes the amino acid sequence <SEQ ID 640>. This protein is predicted to be membrane permease OpuCB (opuBB). Analysis of this protein sequence reveals the following:

```
Possible site: 34
>>> Seems to have no N-terminal signal sequence
INTEGRAL Likelihood = -9.66 Transmembrane   25-41  (18-45)
INTEGRAL Likelihood = -7.96 Transmembrane  182-198 (174-202)
INTEGRAL Likelihood = -4.83 Transmembrane   61-77  (57-95)
INTEGRAL Likelihood = -4.09 Transmembrane   78-94  (78-95)
INTEGRAL Likelihood = -1.22 Transmembrane  134-150 (134-150)

----- Final Results -----
           bacterial membrane --- Certainty = 0.4864 (Affirmative) < succ>
            bacterial outside --- Certainty = 0.0000 (Not Clear)   < succ>
          bacterial cytoplasm --- Certainty = 0.0000 (Not Clear)   < succ>
```

The protein has homology with the following sequences in the GENPEPT database:

```
>GP: AAF91340 GB: AF249729 membrane permease OpuCB [Listeria
monocytogenes]
Identities = 121/208 (58%), Positives = 160/208 (76%)

Query:   1 MVNFLSQYGMQILVKTWEQVYISFFAIALGIAIAVPLGVVLTRFPKVAKIIIAIASMLQT    60
           +V F  + G  +LV+TW+ ++IS  A+ LGIA+AVP G++LTR PKVA  +I + S+LQT
Sbjct:   4 IVTFFQENGHNLLVQTWQHLFISLSAVILGIAVAPTGILLTRSPKVANFVIGVVSVLQT    63

Query:  61 IPSLALLALMIPLFGIGKIPAIVALFIYSLLPILRNTYIGMNNVNPTLKDCAKGMGMKPI   120
           +PSLA+LA +IP  G+G +PAI+ALFIY+LLPILRNT+IG+   V+    L +  +GMGM
Sbjct:  64 VPSLAILAFIIPFLGVGTLPAIIALFIYALLPILRNTFIGVRGVDKNLIESGRGMGMTNW   123
```

-continued

```
Query: 121 QSIFQVELPLATPIIMAGIRLSTIYVIAWATLASYIGAGGLGDLIFSGLNLFQSKLILGG 180
            Q I  VE+P +  +IMAGIRLS +YVIAWATLASYIGAGGLGD IF+GLNL++  LILGG
Sbjct: 124 QLIVNVEIPNSISVIMAGIRLSAVYVIAWATLASYIGAGGLGDFIFNGLNLYRPDLILGG 183

Query: 181 TIPVIILSLIIDYLLGLLETALTPRTTR                                 208
            IPV IL+L++++ LG LE  LTP+  R
Sbjct: 184 AIPVTILALVVEFALGKLEYRLTPKAIR                                 211
```

A related GBS gene <SEQ ID 8513> and protein <SEQ ID 8514> were also identified. Analysis of this protein sequence reveals the following:

```
Lipop: Possible site: -1 Crend: 0
McG: Discrim Score: -9.08
GvH: Signal Score (-7.5): -1.86
Possible site: 37
>>> Seems to have no N-terminal signal sequence
ALOM program count: 5 value: -8.60 threshold: 0.0
INTEGRAL Likelihood =  -8.60 Transmembrane  25-41  (18-45)
INTEGRAL Likelihood =  -7.96 Transmembrane 182-198 (174-202)
INTEGRAL Likelihood =  -4.83 Transmembrane  61-77  (57-95)
INTEGRAL Likelihood =  -4.09 Transmembrane  78-94  (78-95)
INTEGRAL Likelihood =  -1.22 Transmembrane 134-150 (134-150)
PERIPHERAL Likelihood =  2.70  156
modified ALOM score: 2.22

*** Reasoning Step: 3

----- Final Results -----
           bacterial membrane --- Certainty = 0.4439 (Affirmative) < succ>
            bacterial outside --- Certainty = 0.0000 (Not Clear)   < succ>
          bacterial cytoplasm --- Certainty = 0.0000 (Not Clear)   < succ>
```

The protein has homology with the following sequences in the databases:

```
ORF01825(301-927 of 1233)
GP|9651976|gb|AAf91340.1|AF249729_2|AF249729(4-212 of 218)membrane permease
OpuCB {Listeria monocytogenes}
% Match = 30.2
% Identity = 57.9    % Similarity = 79.9
Matches = 121   Mismatches = 42   Conservative Sub.s = 46
117       147       177       207       237       267       297       327
STCF*YLKTY*FLCYGRRLT*KYC*AYFKTWFKIRSSC*P*E*LKGHCYSCIPS*YVIRYYLGRY*NGGSIMVNFLSQYG
                                                                 :|  |: :  |
                                                                 MDAIVTFFQENG
                                                                 10

357       387       417       447       477       507       537       567
MQILVKTWEQVYISFFAIALGIAIAVPXGVVLTRFPKVAKIIIAIASMLQTIPSLALLALMIPLFGIGKIPAIVALFIYS
 :|:||:::||:  |:  ||||:|||  |::|||  ||||    :|  :  |:|||:||||:||::|::|:  :||:||||||:
HNLLVQTWQHLFISLSAVILGIAVAVPTGILLTRSPKVANFVIGVVSVLQTVPSLAILAFIIPFLGVGTLPAIIALFIYA
              30        40        50        60        70        80        90

597       627       657       687       717       747       777       807
LLPILRNTYIGMNNVNPTLKDCAKGMGMKPIQSIFQVELPLATPIIMAGIRLSTIYVIAWATLASYIGAGGLGDLIFSGL
||||||||:||:  |:   |:   :||||   |  ||:|   :||||||||  :||||||||||||||||||||||:|:||
LLPILRNTFIGVRGVDKNLIESGRGMGMTNWQLIVNVEIPNSISVIMAGIRLSAVYVIAWATLASYIGAGGLGDFIFNGL
              110       120       130       140       150       160       170

837       867       897       927       957       987      1017      1047
NLFQSKLILGGTIPVIILSLIIDYLLGLLETALTPRTTRREA*ICLKNRTFYRYLHFA*PS*RFLVVN*PILKSLVIPQL
||::  |||||  |||  ||:|::::   || ||   |||:  |
NLYRPDLILGGAIPVTILALVVEFALGKLEYRLTPKAIREAREGGE
              190       200       210
```

Based on this analysis, it was predicted that these proteins and their epitopes could be useful antigens for vaccines or diagnostics.

EXAMPLE 197

A DNA sequence (GBSx0203) was identified in *S. agalactiae* <SEQ ID 641> which encodes the amino acid sequence <SEQ ID 642>. Analysis of this protein sequence reveals the following:

```
Possible site: 46
>>> Seems to have no N-terminal signal sequence

----- Final Results -----
            bacterial cytoplasm --- Certainty = 0.3531 (Affirmative) < succ>
             bacterial membrane --- Certainty = 0.0000 (Not Clear)  < succ>
              bacterial outside --- Certainty = 0.0000 (Not Clear)  < succ>
```

The protein has homology with the following sequences in the GENPEPT database:

```
>GP: AAF91339 GB: AF249729 ATPase OpuCA [Listeria monocytogenes]
Identities = 230/380 (60%), Positives = 298/380 (77%), Gaps = 4/380 (1%)

Query:    6 IIEYQNINKVY-GENVAVEDINLKIYPGDFVCFIGTSGSGKTTLMRMVNHMLKPTNGTLL    64
            +++++++ K Y G   AV D+ L I  G+FVCFIG SG GKTT M+M+N +++PT G +
Sbjct:    1 MLKFEHVTKTYKGGKKAVNDLTLNIDKGEFVCFIGPSGCGKTTTMKMINRLIEPTEGKIF   60

Query:   65 FKGKDISTINPIELRRIGYVIQNIGLMPHMTIYENIVLVPKLLKWSEEAKRAKARELIK   124
             KDI   +P++LRR IGYVIQ IGLMPHMTI ENIVLVPKLLKWSEE K+ +A+ELIK
Sbjct:   61 INDKDIMAEDPVKLRRSIGYVIQQIGLMPHMTIRENIVLVPKLLKWSEEKKQERAKELIK  120

Query:  125 LVELPEEYLDRYPSELSGGQQQRIGVIRALAADQDIILMDEPFGALDPITREGIQDLVKS  184
            LV+LPEE+LDRYP ELSGGQQQRIGV+RALAA+Q++ILMDEPFGALDPITR+ +Q+  K+
Sbjct:  121 LVDLPEEFLDRYPYELSGGQQQRIGVLRALAAEQNLILMDEPFGALDPITRDSLQEEFKN  180

Query:  185 LQEEMGKTIILVTHDMDEALKLATKIIVMDNGKMVQEGTPNDLLHHPATSFVEQMIGEER  244
            LQ+E+GKTII VTHDMDEA+KLA +I++M +G++VQ  TP+++L +PA SFVE  IG++R
Sbjct:  181 LQKELGKTIIFVTHDMDEAIKLADRIVIMKDGEIVQFDTPDEILRNPANSFVEDFIGKDR  240

Query:  245 LLHAQADITPVKQIMLNNPVSITAEKTLTEAITLMRQKRVDSLLVTDNGKLI-GFIDLES  303
            L+ A+ D+T V QIM  NPVSITA+K+L  AIT+M++KRVD LLV D G ++ GFID+E
Sbjct:  241 LIEAKPDVTQVAQIMNTNPVSITADKSLQAAITVMKEKRVDTLLVVDEGNVLKGFIDVEQ  300

Query:  304 LSSKYKKDRLVSDILKHTDFYVMEDDLLRNTAERILKLGLKYAPVVDHENNLKGIVTRAS  363
             +   +     V DI++   FYV ED LLR+T +RILK G KY PVVD +  L GIVTRAS
Sbjct:  301 IDLNRRTATSVMDIIEKNVFYVYEDTLLRDTVQRILKRGYKYIPVVDKDKRLVGIVTRAS  360

Query:  364 LVDMLYDIIWGDTE--TEDQ                                          381
            LVD++YD IWG  E   TE+Q
Sbjct:  361 LVDIVYDSIWGTLEDATENQ                                          380
```

A related DNA sequence was identified in *S. pyogenes* <SEQ ID 643> which encodes the amino acid sequence <SEQ ID 644>. Analysis of this protein sequence reveals the following:

```
Possible site: 39
>>> Seems to have no N-terminal signal sequence

----- Final Results -----
            bacterial cytoplasm --- Certainty = 0.3619(Affirmative) < succ>
             bacterial membrane --- Certainty = 0.0000(Not Clear)  < succ>
              bacterial outside --- Certainty = 0.0000(Not Clear)  < succ>
```

An alignment of the GAS and GBS proteins is shown below:

```
Identities = 102/237 (43%), Positives = 165/237 (69%), Gaps = 1/237 (0%)

Query:    6 IIEYQNINKVYGENVAVEDINLKIYPGDFVCFIGTSGSGKTTLMRMVNHMLKPTNGTLLF   65
            +I + N++K +G+   +++  +I   +F  +G SGSGKTTL++M+N +++P++G +L
Sbjct:    1 MIRFNNVSKTFGQTKVLQEQTFQINDREFFVLVGPSGSGKTTLLKMINCLIEPSSGDILL   60

Query:   66 KGKDISTINPIELRRIGYVIQNIGLMPHMTIYENIVLVPKLLKWSEEAKRAKARELIKL  125
             + ++  E+R  IGYV+Q I L P++T+ ENI ++P++ +WS E  R K  EL+
Sbjct:   61 NNVPQTELDLREMRLSIGYVLQQIALFPNLTVAENIAIIPEMKQWSAEEIRQKTEELLDK  120

Query:  126 VELP-EEYLDRYPSELSGGQQQRIGVIRALAADQDIILMDEPFGALDPITREGIQDLVKS  184
            V LP ++YLDRYPS+LSGG+QQRIG++RA+    I+LMDEPF ALDPI+R+ +Q+L+ S
Sbjct:  121 VGLPAKDYLDRYPSDLSGGEQQRIGIVRAIISHPKILLMDEPFSALDPISRKQLQELMLS  180
```

```
-continued
Query: 185 LQEEMGKTIILVTHDMDEALKLATKIIVMDNGKMVQEGTPNDLLHHPATSFVEQMIG   241
            L +E    TI+ VTHD+DEA+KL  ++ +++ G++VQ    P  +  HPA +FV  + G
Sbjct: 181 LHKEFDMTIVFVTHDIDEAIKLGDRVAILNEGEIVQLDRPEMIKTHPANAFVVNLFG   237
```

Based on this analysis, it was predicted that these proteins and their epitopes could be useful antigens for vaccines or diagnostics.

EXAMPLE 198

A repeated DNA sequence (GBSx0212) was identified in *S. agalactiae* <SEQ ID 645> which encodes the amino acid sequence <SEQ ID 646>. Analysis of this protein sequence reveals the following:

```
Possible site: 24
>>> Seems to have no N-terminal signal sequence

----- Final Results -----
              bacterial cytoplasm --- Certainty = 0.4736(Affirmative) < succ>
              bacterial membrane  --- Certainty = 0.0000(Not Clear)   < succ>
              bacterial outside   --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 199

A DNA sequence (GBSx0213) was identified in *S. agalactiae* <SEQ ID 647> which encodes the amino acid sequence <SEQ ID 648>. Analysis of this protein sequence reveals the following:

```
Possible site: 38
>>> Seems to have no N-terminal signal sequence
      INTEGRAL    Likelihood = -1.06      Transmembrane     18-34 (18-34)

----- Final Results -----
              bacterial membrane  --- Certainty = 0.1426(Affirmative) < succ>
              bacterial outside   --- Certainty = 0.0000(Not Clear)   < succ>
              bacterial cytoplasm --- Certainty= 0.0000(Not Clear)    < succ>
```

No corresponding DNA sequence was identified in *S. pyogenes*.

A related GBS gene <SEQ ID 8515> and protein <SEQ ID 8516> were also identified. Analysis of this protein sequence reveals the following:

```
Lipop: Possible site: 20 Crend: 5
       Sequence Pattern: CQMN
SRCFLG: 0
McG: Length of UR: 19
     Peak Value of UR: 2.60
     Net Charge of CR: 3
McG: Discrim Score: 7.77
GvH: Signal Score (-7.5): -4.89
     Possible site: 25
>>> May be a lipoprotein
Amino Acid Composition: calculated from 21
ALOM program count: 0 value: 13.21 threshold: 0.0
PERIPHERAL Likelihood = 13.21 115
modified ALOM score: -3.14
*** Reasoning Step: 3
```

```
----- Final Results -----
            bacterial membrane --- Certainty = 0.0000(Not Clear) < succ>
            bacterial outside  --- Certainty = 0.0000(Not Clear) < succ>
          bacterial cytoplasm --- Certainty = 0.0000(Not Clear) < succ>
```

The protein has homology with the following sequences in the databases:

```
ORF01527(346-465 of 1095)
EGAD|7398|7198(2-41 of 47)lysis protein for colicin e9 precursor{Escherichia
coli}EGAD|41475|43808 lysis proetin{ }SP|P13344|LYS5_ECOLI LYSIS PROTEIN FOR
COLICIN E5 PRECURSOR. GP|40543|emb|CAA33861.1||X15857 lysis protein(AA 1-47)
{Enterobacteriaceae}GP|144373|gb|AAA98053.1||M30445 colicin release protein
{Plasmid ColE5-099} PIR|JQ0330|JQ0330 colicin E5 lysis protein precursor-
Escherichia coli plasmid ColE5-099
% Match = 3.7
% Identity = 35.0    % Similarity = 52.5
Matches = 14    Mismatches = 19    Conservative Sub.s = 7
   135       165       195       225       255       285       315       345
YIYFFHCRRIYIIININY*FN*GI*NIQMIFCLHVKTKTIKIRENFVILKLIL*CW*IIVNFIIYLIYKIYILRKENMMR
                                                                              M
   375       405       435       465       495       525       555       585
KYIKWLIPISIFGMILGGCQMNSEHKIQSNEVKNSKQSEVKKDKKMTKKEQLAYLKEHEQEIIDYVKLHNNQIESVQFDQ
  |  |:  : :  :||   ||  |   | :|      |    |    :|:
KKITWIILLLLAAIILAACQANYIHDVQGGTVSPSSSAELTGLATQ
             20        30        40
```

Figure 74:
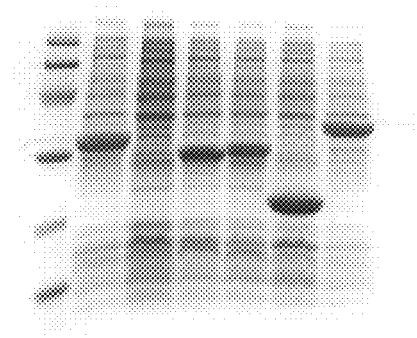

SEQ ID 8516 (GBS389) was expressed in *E. coli* as a His-fusion product. SDS-PAGE analysis of total cell extract is shown in FIG. 74 (lane 6; MW 18 kDa).

Figure 313:
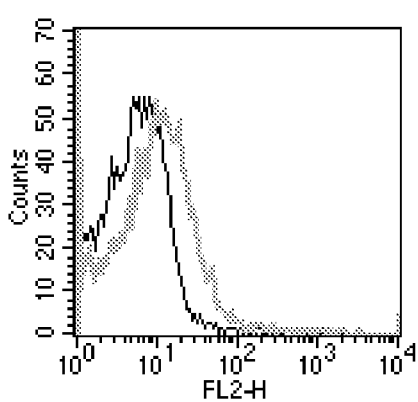

The GBS389-His fusion product was purified (FIG. 214, lane 4) and used to immunise mice. The resulting antiserum was used for FACS (FIG. 313), which confirmed that the protein is immunoaccessible on GBS bacteria.

Based on this analysis, it was predicted that these proteins and their epitopes could be useful antigens for vaccines or diagnostics.

EXAMPLE 200

A DNA sequence (GBSx0214) was identified in *S. agalactiae* <SEQ ID 649> which encodes the amino acid sequence <SEQ ID 650>. Analysis of this protein sequence reveals the following:

```
Possible site: 19
>>> Seems to have no N-terminal signal sequence

----- Final Results -----
          bacterial cytoplasm --- Certainty = 0.3766 (Affirmative) < succ>
            bacterial membrane --- Certainty = 0.0000 (Not Clear)  < succ>
            bacterial outside  --- Certainty = 0.0000 (Not Clear)  < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 201

A DNA sequence (GBSx0215) was identified in *S. agalactiae* <SEQ ID 651> which encodes the amino acid sequence <SEQ ID 652>. Analysis of this protein sequence reveals the following:

```
Possible site: 46
>>> Seems to have no N-terminal signal sequence

----- Final Results -----
            bacterial cytoplasm --- Certainty = 0.3882 (Affirmative) < succ>
             bacterial membrane --- Certainty = 0.0000 (Not Clear)   < succ>
              bacterial outside --- Certainty = 0.0000 (Not Clear)   < succ>
```

The protein has no significant homology with any sequences in the GENPEPT database.

No corresponding DNA sequence was identified in S. pyogenes.

Based on this analysis, it was predicted that this protein and its epitopes, could be useful antigens for vaccines or diagnostics.

EXAMPLE 202

A DNA sequence (GBSx0216) was identified in S. agalactiae <SEQ ID 653> which encodes the amino acid sequence <SEQ ID 654>. This protein is predicted to be lectin, alpha subunit precursor. Analysis of this protein sequence reveals the following:

```
Possible site: 47
>>> Seems to have no N-terminal signal sequence

----- Final Results -----
            bacterial cytoplasm --- Certainty = 0.0653 (Affirmative) < succ>
             bacterial membrane --- Certainty = 0.0000 (Not Clear)   < succ>
              bacterial outside --- Certainty = 0.0000 (Not Clear)   < succ>
```

The protein has no significant homology with any sequences in the GENPEPT database.

No corresponding DNA sequence was identified in S. pyogenes.

Based on this analysis, it was predicted that this protein and its epitopes, could be useful antigens for vaccines or diagnostics.

EXAMPLE 203

DNA sequence (GBSx0217) was identified in S. agalactiae <SEQ ID 655> which encodes the amino acid sequence <SEQ ID 656>. Analysis of this protein sequence reveals the following:

```
Possible site: 41
>>> Seems to have no N-terminal signal sequence

----- Final Results -----
            bacterial cytoplasm --- Certainty = 0.6569(Affirmative) < succ>
             bacterial membrane --- Certainty = 0.0000(Not Clear)   < succ>
              bacterial outside --- Certainty = 0.0000(Not Clear)   < succ>
```

The protein has no significant homology with any sequences in the GENPEPT database.

No corresponding DNA sequence was identified in S. pyogenes.

Based on this analysis, it was predicted that this protein and its epitopes, could be useful antigens for vaccines or diagnostics.

EXAMPLE 204

A DNA sequence (GBSx0218) was identified in S. agalactiae <SEQ ID 657> which encodes the amino acid sequence <SEQ ID 658>. Analysis of this protein sequence reveals the following:

```
Possible site: 27
>>> Seems to have no N-terminal signal sequence

----- Final Results -----
            bacterial cytoplasm --- Certainty = 0.5736(Affirmative) < succ>
             bacterial membrane --- Certainty = 0.0000(Not Clear)  < succ>
              bacterial outside --- Certainty = 0.0000(Not Clear)  < succ>
```

The protein has no significant homology with any sequences in the GENPEPT database.

No corresponding DNA sequence was identified in S. pyogenes.

Based on this analysis, it was predicted that this protein and its epitopes, could be useful antigens for vaccines or diagnostics.

EXAMPLE 205

A DNA sequence (GBSx0219) was identified in S. agalactiae <SEQ ID 659> which encodes the amino acid sequence <SEQ ID 660>. Analysis of this protein sequence reveals the following:

```
Possible site: 52
>>> Seems to have an uncleavable N-term signal seq
    INTEGRAL    Likelihood = -13.11    Transmembrane    146-162 (138-170)
    INTEGRAL    Likelihood = -12.90    Transmembrane     13-29  (9-32)
    INTEGRAL    Likelihood =  -9.50    Transmembrane    108-124 (104-129)
    INTEGRAL    Likelihood =  -7.75    Transmembrane     40-56  (33-61)
    INTEGRAL    Likelihood =  -6.64    Transmembrane    177-193 (170-195)
    INTEGRAL    Likelihood =  -3.35    Transmembrane     77-93  (77-97)

----- Final Results -----
             bacterial membrane --- Certainty = 0.6243(Affirmative) < succ>
              bacterial outside --- Certainty = 0.0000(Not Clear)  < succ>
            bacterial cytoplasm --- Certainty = 0.0000(Not Clear)  < succ>
```

A related GBS nucleic acid sequence <SEQ ID 8517> which encodes amino acid sequence <SEQ ID 8518> was also identified.

The protein has no significant homology with any sequences in the GENPEPT database.

No corresponding DNA sequence was identified in S. pyogenes.

Based on this analysis, it was predicted that these proteins and their epitopes could be useful antigens for vaccines or diagnostics.

EXAMPLE 206

A DNA sequence (GBSx0220) was identified in S. agalactiae <SEQ ID 661> which encodes the amino acid sequence <SEQ ID 662>. Analysis of this protein sequence reveals the following:

```
Possible site: 37
>>> Seems to have no N-terminal signal sequence

----- Final Results -----
            bacterial cytoplasm --- Certainty = 0.2374(Affirmative) < succ>
             bacterial membrane --- Certainty = 0.0000(Not Clear)  < succ>
              bacterial outside --- Certainty = 0.0000(Not Clear)  < succ>
```

The protein has homology with the following sequences in the GENPEPT database:

```
>GP: AAB89623 GB: AE000990 repressor protein [Archaeoglobus
fulgidus]
Identities = 34/62 (54%), Positives = 46/62 (73%)

Query:  11 LKQVREDIGMTQQELAIRIGVRRETIGHLENNRYNPSLEMALKIVKIFDMKIEDIFQLRK  70
            +K+ R    MTQ+ELA R+GVRRETI  LE  +YNPSL++A KI ++F+ KIEDIF   +
Sbjct:   5 IKEFRAKFNMTQEELAKRVGVRRETIVFLEKGKYNPSLKLAYKIARVFNAKIEDIFIFDE  64

Query:  71 ED  72
            E+
Sbjct:  65 EE  66
```

There is also homology to SEQ ID 412.

Based on this analysis, it was predicted that this protein and its epitopes, could be useful antigens for vaccines or diagnostics.

EXAMPLE 207

A DNA sequence (GBSx0221) was identified in *S. agalactiae* <SEQ ID 663> which encodes the amino acid sequence <SEQ ID 664>. Analysis of this protein sequence reveals the following:

```
Possible site: 36
>>> Seems to have no N-terminal signal sequence

----- Final Results -----
             bacterial cytoplasm --- Certainty = 0.3794 (Affirmative) < succ>
             bacterial membrane  --- Certainty = 0.0000 (Not Clear)   < succ>
             bacterial outside   --- Certainty = 0.0000 (Not Clear)   < succ>
```

The protein has homology with the following sequences in the GENPEPT database:

```
>GP: CAB61817 GB: AL133236 putative acetyl transferase [Streptomyces
coelicolor A3(2)]
Identities = 30/97 (30%), Positives = 52/97 (52%), Gaps = 1/97 (1%)

Query:  82 VGMLNIVTLARADMQWGELGYVFHNQFWSNGYAFESILALLNSTYEKLGFHHIEAQITPG  141
            VGM ++  +    Q GE+ Y+ H + W  G   E   +LL+ +++ G H I A   P
Sbjct:  72 VGMGDLHVRSHTQRQ-GEISYIVHPRVWGQGIGTEIGRSLLSLGFDRWGLHRIRATCDPR  130

Query: 142 NERSEKLVRRLGLTYETTRKDFSFENGKWTDKLIYSI  178
            N+ S +++ +LG+TYE   +  ++    W D L++SI
Sbjct: 131 NQASSRVLTKLGMTYEGRHRHTAWIRDGWRDSLVFSI  167
```

No corresponding DNA sequence was identified in *S. pyogenes*.

Based on this analysis, it was predicted that this protein and its epitopes, could be useful antigens for vaccines or diagnostics.

EXAMPLE 208

A DNA sequence (GBSx0222) was identified in *S. agalactiae* <SEQ ID 665> which encodes the amino acid sequence <SEQ ID 666>. This protein is predicted to be p20 protein. Analysis of this protein sequence reveals the following:

```
Possible site: 44
>>> Seems to have no N-terminal signal sequence

----- Final Results -----
             bacterial cytoplasm --- Certainty = 0.1044 (Affirmative) < succ>
             bacterial membrane  --- Certainty = 0.0000 (Not Clear)   < succ>
             bacterial outside   --- Certainty = 0.0000 (Not Clear)   < succ>
```

The protein has homology with the following sequences in the GENPEPT database:

```
>GP: CAA30415 GB: X07542 P20 (AA 1-178) [Bacillus licheniformis]
Identities = 56/175 (32%), Positives = 94/175 (53%), Gaps = 6/175 (3%)

Query:   16 TVLTERLRLQPVELTNVNDFLEFSSDSETVFYMQRYKANTVEEAQVVLA---NVCMKSPL    72
            T+ TERL L+ +EL + +   ++ SD E    YM       V +A+ ++     ++ ++
Sbjct:    3 TLYTERLTLRKMELEDADVLCQYWSDPEVTKYMNITPFTDVSQARDMIQMINDLSLEGQA   62

Query:   73 GIYAMIEKESQKMIGIIELEIRDEFS--AEFGYILNKNYNGKGYMTEACSKLMSIGFEHL   130
            +++I KE+ ++IG       + D+ +   AE GY L +N+ GKG+ +EA   KL+  GF  L
Sbjct:   63 NRFSIIVKETDEVIGTCGFNMIDQENGRAEIGYDLGRNHWGKGFASEAVQKLIDYGFTSL   122

Query:  131 DLERIYARFDINNKKSGNVMERIGMKKEGELRHLAKNPKGEWKTRAYYSILKEEY        185
            +L RI A+ +  N  S  ++  +  +KEG LR   K  KG        +S+LK EY
Sbjct:  123 NLNRIEAKVEPENTPSIKLLNSLSFQKEGLLRDYEK-AKGRLIDVYMFSLLKREY        176
```

Based on this analysis, it was predicted that this protein and its epitopes, could be useful antigens for vaccines or diagnostics.

EXAMPLE 209

A DNA sequence (GBSx0223) was identified in *S. agalactiae* <SEQ ID 669> which encodes the amino acid sequence <SEQ ID 670>. Analysis of this protein sequence reveals the following:

```
Possible site: 51
>>> Seems to have no N-terminal signal sequence

----- Final Results -----
            bacterial cytoplasm --- Certainty = 0.5180 (Affirmative) < succ>
            bacterial membrane  --- Certainty = 0.0000 (Not Clear)   < succ>
             bacterial outside  --- Certainty = 0.0000 (Not Clear)   < succ>
```

The protein has homology with the following sequences in the GENPEPT database:

```
>GP: CAA87001 GB: Z46902 unknown [Saccharomyces cerevisiae]
Identities = 105/224 (46%), Positives = 148/224 (65%), Gaps = 3/224 (1%)

Query:    1 MGDVVENFTEGKNPKIDTLNGKTVRIEKINPD-HFEDLFQVYGELSTEDSLTYISFSKFN    59
            +G  VE +T     P+    L G T R+E ++ + H  +LF  Y E  +   TY+    F
Sbjct:   11 VGADVEGWTTRAFPEKVVLKGNTCRLEPLDRERHGSELFSAYSEAG-QKLWTYLPAGPFT   69

Query:   60 SKNEFDVFFQTLLKSEDPYYLAIVDNNTGKVLGTFSLMRIDTKNRVVEMGWVVYSSKLKQ   119
            +   E+   F + L +++D    AI++  T + +GT  L+RID  N   +E+G+VV+S  +L++
Sbjct:   70 NLEEYLEFIKELNETKDTVPFAIINKETERAVGTLCLIRIDEANGSLEVGYVVFSPELQK   129

Query:  120 TRIATEAQYLVMKYVFEELCYRRYEWKCDSLNAPSNNSAKRLGFTFEGTFRQAVVYKGRN   179
            T IATEAQ+L+MKYVF++L YRRYEWKCDSLN PS  +A RLGF +EGTFRQ VVYKGR
Sbjct:  130 TIIATEAQFLLMKYVFDDLQYRRYEWKCDSLNGPSRRAAMRLGFKYEGTFRQVVVYKGRT   189

Query:  180 RDTNWYSILDKEWPEKKTRFEKWLDDSNFAVNGYQIRSLSSIEQ                   223
            RDT W+SI+DKEW  +    FE+WLD +NF  NG Q R +++I +
Sbjct:  190 RDTQWFSIIDKEWLRIRKTFEEWLDKTNFE-NGKQKRGIAAIRE                   232
```

No corresponding DNA sequence was identified in *S. pyogenes*.

Based on this analysis, it was predicted that this protein and its epitopes, could be useful antigens for vaccines or diagnostics.

EXAMPLE 210

A DNA sequence (GBSx0224) was identified in *S. agalactiae* <SEQ ID 671> which encodes the amino acid sequence <SEQ ID 672>. Analysis of this protein sequence reveals the following:

```
Possible site: 39
>>> Seems to have no N-terminal signal sequence
INTEGRAL Likelihood = -12.15 Transmembrane 25-41 (20-49)
```

```
----- Final Results -----
          bacterial membrane --- Certainty = 0.5861 (Affirmative) < succ>
          bacterial outside  --- Certainty = 0.0000 (Not Clear)   < succ>
          bacterial cytoplasm --- Certainty = 0.0000 (Not Clear)  < succ>
```

The protein has no significant homology with any sequences in the GENPEPT database.

No corresponding DNA sequence was identified in S. pyogenes.

A related GBS gene <SEQ ID 8519> and protein <SEQ ID 8520> were also identified. Analysis of this protein sequence reveals the following:

```
Lipop: Possible site: -1 Crend: 10
McG: Discrim Score: -3.31
GvH: Signal Score (-7.5): -4.44
Possible site: 39
>>> Seems to have no N-terminal signal sequence
ALOM program count: 1 value: -12.15 threshold: 0.0
INTEGRAL Likelihood = -12.15 Transmembrane 25-41 (20-49)
PERIPHERAL Likelihood = 11.94 59
modified ALOM score: 2.93

*** Reasoning Step: 3

----- Final Results -----
          bacterial membrane --- Certainty = 0.5861 (Affirmative) < succ>
          bacterial outside  --- Certainty = 0.0000 (Not Clear)   < succ>
          bacterial cytoplasm --- Certainty = 0.0000 (Not Clear)  < succ>
```

SEQ ID 672 (GBS43) was expressed in E. coli as a His-fusion product. SDS-PAGE analysis of total cell extract is shown in FIG. 5 (lane 4; MW 34 kDa). It was also expressed in E. coli as a GST-fusion product. SDS-PAGE analysis of total cell extract is shown in FIG. 13 (lane 9; MW 58 kDa) and in FIG. 15 (lane 4; MW 59 kDa).

Based on this analysis, it was predicted that these proteins and their epitopes could be useful antigens for vaccines or diagnostics.

EXAMPLE 211

A DNA sequence (GBSx0225) was identified in S. agalactiae <SEQ ID 673> which encodes the amino acid sequence <SEQ ID 674>. Analysis of this protein sequence reveals the following:

```
Possible site: 32
>>> May be a lipoprotein

----- Final Results -----
          bacterial membrane --- Certainty = 0.0000 (Not Clear) < succ>
          bacterial outside  --- Certainty = 0.0000 (Not Clear) < succ>
          bacterial cytoplasm --- Certainty = 0.0000 (Not Clear) < succ>
```

A related GBS nucleic acid sequence <SEQ ID 9519> which encodes amino acid sequence <SEQ ID 9520> was also identified.

The protein has no significant homology with any sequences in the GENPEPT database.

No corresponding DNA sequence was identified in S. pyogenes.

Based on this analysis, it was predicted that these proteins and their epitopes could be useful antigens for vaccines or diagnostics.

EXAMPLE 212

A DNA sequence (GBSx0226) was identified in *S. agalactiae* <SEQ ID 675> which encodes the amino acid sequence <SEQ ID 676>. Analysis of this protein sequence reveals the following:

```
Possible site: 44
>>> Seems to have no N-terminal signal sequence
INTEGRAL Likelihood = -1.54 Transmembrane 165-181 (164-181)
INTEGRAL Likelihood = -0.85 Transmembrane  67-83 (67-84)

----- Final Results -----
            bacterial membrane --- Certainty = 0.1617 (Affirmative) < succ>
             bacterial outside --- Certainty = 0.0000 (Not Clear)  < succ>
           bacterial cytoplasm --- Certainty = 0.0000 (Not Clear)  < succ>
```

The protein has homology with the following sequences in the GENPEPT database:

```
>GP: CAA82211 GB: Z28353 similar to a B. subtilis gene (GB:
BACHEMEHY_5) [Clostridium pasteurianum]
Identities = 40/185 (21%), Positives = 87/185 (46%), Gaps = 6/185 (3%)

Query:  18 MPKGKQKVILSAIELFASQGFHGTSTAQLAKNAEVSQATIYKYFETKDKLLVFILELIVQ   77
              M K K  +  SAI++F++ G++G +   ++A NA V++ T+Y +F++K+++   +I+E  V
Sbjct:   1 MNKTKDNIFYSAIKVFSNNGYNGATMDEIASNAGVAKGTLYYHFKSKEEIFKYIIEEGVN   60

Query:  78 TIGRPFFTELSTFSTKEELIHFFVQDRFKFIEKNNDLIKILMQELLINSETSTIFTKLIN  137
               +         T  E +    + +  I KN D  K++  +L                 ++
Sbjct:  61 LMKNEIDEATDKEKTALEKLKAVCRVQLNLIYKNRDFFKVIASQLWGKELRQLELRDIMR  120

Query: 138 STDPNITKIFNCLSEGNSL---NKMEILRAVIGQFITFFIQLY-ILNIKPENLEEELKQI  193
               +  +I +      E  S+   N + +  A +G    +  + LY ++N + +N+   ++ +
Sbjct: 121 NYVVHIEEFVKDAMEAGSIKKGNSLFVAYAFLGTLCS--VSLYEVINAENDNINNTIENL  178

Query: 194 EKQIL                                                         198
           IL
Sbjct: 179 MNYIL                                                         183
```

No corresponding DNA sequence was identified in *S. pyogenes*.

Based on this analysis, it was predicted that this protein and its epitopes, could be useful antigens for vaccines or diagnostics.

EXAMPLE 213

A DNA sequence (GBSx0227) was identified in *S. agalactiae* <SEQ ID 677> which encodes the amino acid sequence <SEQ ID 678>. Analysis of this protein sequence reveals the following:

```
Possible site: 24
>>> Seems to have no N-terminal signal sequence

----- Final Results -----
           bacterial cytoplasm --- Certainty = 0.2389(Affirmative) < succ>
            bacterial membrane --- Certainty = 0.0000(Not Clear)  < succ>
             bacterial outside --- Certainty = 0.0000(Not Clear)  < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 214

A DNA sequence (GBSx0228) was identified in *S. agalactiae* <SEQ ID 679> which encodes the amino acid sequence <SEQ ID 680>. Analysis of this protein sequence reveals the following:

```
Possible site: 43
>>> Seems to have no N-terminal signal sequence
    INTEGRAL    Likelihood = -13.32     Transmembrane    341-357 (333-361)
    INTEGRAL    Likelihood = -10.93     Transmembrane    253-269 (238-277)
    INTEGRAL    Likelihood = -10.77     Transmembrane    172-188 (166-196)
    INTEGRAL    Likelihood =  -8.01     Transmembrane    225-241 (215-251)
    INTEGRAL    Likelihood =  -7.01     Transmembrane     21-37  (18-42)
    INTEGRAL    Likelihood =  -2.66     Transmembrane    285-301 (283-301)

----- Final Results -----
              bacterial membrane  --- Certainty = 0.6328(Affirmative) < succ>
              bacterial outside   --- Certainty = 0.0000(Not Clear)   < succ>
              bacterial cytoplasm --- Certainty = 0.0000(Not Clear)   < succ>
```

The protein has homology with the following sequences in the GENPEPT database:

```
>GP: CAB42664 GB: AL049819 putative integral membrane protein
[Streptomyces coelicolor A3(2)]
Identities = 60/156 (38%), Positives = 101/156 (64%), Gaps = 1/156 (0%)

Query:  176 LMGFMVFFFVFLISGMALLKERTSGTLDRLLATPVKRSDIVFGYMLSYGILAIIQTIVIV  235
            L+G    +FL++ +A L+ERTSGTL+RLLA P+ + D++ GY L++G LAI+Q+ +
Sbjct:   77 LLGIFPLITMFLVTSIATLRERTSGTLERLLAMPLGKGDLIAGYALAFGALAIVQSALAT 136

Query:  236 LSTIWLLDIQVVGSIFSVIIVNFILALVALSLGILMSTLAKSEFQMMQFIPLIIMPQLFF  295
              +W L + V GS + +++V  + AL+  +LG+ +S  A SEFQ +QF+P +I PQL
Sbjct:  137 GLAVWFLGLDVTGSPWLLLLVALLDALLGTALGLFVSAFAASEFQAVQFMPAVIFPQLLL 196

Query:  296 SGII-PLENMASWAQTVGKILPLSYSGDALTKIIMY                         330
             G+  P +NM    + V  +LP+SY+ D + +++ +
Sbjct:  197 CGLFTPRDNMHPALEAVSDVLPMSYAVDGMNEVLRH                         232
```

There is also homology to a DNA sequence which was identified in *S. pyogenes* <SEQ ID 681> which encodes the amino acid sequence <SEQ ID 682>. Analysis of this protein sequence reveals the following:

```
Possible site: 39
>>> Seems to have no N-terminal signal sequence
    INTEGRAL    Likelihood = -11.41     Transmembrane    263-279 (246-284)
    INTEGRAL    Likelihood =  -7.70     Transmembrane    231-247 (224-258)
    INTEGRAL    Likelihood =  -4.99     Transmembrane     20-36  (18-39)
    INTEGRAL    Likelihood =  -3.72     Transmembrane    349-365 (345-368)
    INTEGRAL    Likelihood =  -3.45     Transmembrane    187-203 (182-204)

----- Final Results -----
              bacterial membrane  --- Certainty = 0.5564(Affirmative) < succ>
              bacterial outside   --- Certainty = 0.0000(Not Clear)   < succ>
              bacterial cytoplasm --- Certainty = 0.0000(Not Clear)   < succ>
```

The protein has homology with the following sequences in the databases:

```
>GP: CAB12662 GB: Z99108 similar to ABC transporter (ATP-binding
protein) [Bacillus subtilis]
Identities = 92/369 (24%), Positives = 180/369 (47%),
Gaps = 25/369 (6%)

Query:   12 IKRKKTSYVTFFFLMPILTTLLALSLSFSNNNQAKIGILDKDNSQISKQFIAQLKQNKKYD  71
            I +K  +Y+   F  P+L T +   S+   N+++ ++ I+D+D++ +S+ +I QLK +
Sbjct:   15 IFKKPQNYLIMFAAPLLLTFVFGSMLSGNDDKVRLAIVDQDDTILSQHYIRQLKAHDDMY  74

Query:   72 IFTKIKKEHIDHYLQDKSLEAVLTIDKGFSDKVLQGKSQKLNIRSIANSEITEWVKAQTN 131
            +F + +        L+ K +  ++ I + F  ++ +GK +L  R            VK
Sbjct:   75 VFENMSESKASEKLKQKKIAGIIVISRSFQTQLEKGKHPELIFRHGPELSEAPMVKQYAE 134
```

```
Query:  132 YLLENYNIIGDVALGNEDTFNR---------ILQKNQQLNYDVKQVTLTDRSRSKAVSST  182
             L  NI      A     T          +K++ +   V + TL+D+     S T
Sbjct:  135 SALATLNIQVTAAKTASQTAGENWKAAYKTVFAKKHEDIVPAVTRQTLSDKKEGAEASDT  194

Query:  183 TT---GFLLILMLGSTSVIYSGILADKSSQLYHRLMLSNLSRFR----YMLSYVCVGFVA  235
             +    GF ++ ++ +       IL  + + ++ RL+ +++SR        Y+LS+  +G++
Sbjct:  195 ASRAAGFSILFVMLTMMGAAGTILEARKNGVWSRLLTASVSRAEIGAGYVLSFFVIGWIQ  254

Query:  236 FTIQIVIMLSLLKVFNISFFVPTSLLLIIFFLFSLLAIGFGLLIGAITQNSQQSSQLANL  295
             F I   ++LS  +F I++  P ++++++  LF L  +G GL+I A  +  +Q     NL
Sbjct:  255 FGI---LLLSTHWLFGINWGNPAAVIVLVS-LFLLTVVGIGLMIAANVRTPEQQLAFGNL  310

Query:  296 IVMPTSMLAGCLWPLSITPSYMQAIGKLLPQNWVLSAIA-IFQSGGTLSQAWPYLLALMG  354
             V+ T M++G   WP+ I P +MQ+I + LPQ W +S +  I  +G  ++      +L + G
Sbjct:  311 FVIATCMVSGMYWPIDIEPKFMQSIAEFLPQKWAMSGLTEIIANGARVTD----ILGICG  366

Query:  355 TALALISFS                                                     363
             LA  + +
Sbjct:  367 ILLAFAAIT                                                    375
```

An alignment of the GAS and GBS proteins is shown below:

```
Identities = 92/375 (24%), Positives = 164/375 (43%),
Gaps = 66/375 (17%)

Query:   11 IKELF----RDKRTLAMMFLAPILIMFLMNVMFSANSNTKVKIGTINVNTKVVSNLDNIK  66
             IK LF    R K +    FL PIL   L+ + S ++N + KIG ++ +     +S
Sbjct:    5 IKTLFVKIKRKKTSYVTFFLMPILTT-LLALSLSFSNNNQAKIGILDKDNSQISK-----  58

Query:   67 HIQVRSFKFNSSAKKALKSNKIDALISEDNKSYTVFYANTDSSKTTLT-RQAFKTAVNTM  125
                    +F +     LK NK   + ++   K +    Y   S +  LT  + F    V
Sbjct:   59 -------QFIAQ----LKQNKKYDIFTKIKKEHIDHYLQDKSLEAVLTIDKGFSDKVLQG  107

Query:  126 NSKELISQVKILANKNPKLAQSLQTRSKYIKEKYNY------GNKNT-----------GF  168
              S++L    I + N ++ + ++ ++ Y+ E YN           GN++T             +
Sbjct:  108 KSQKL----NIRSIANSEITEWVKAQTNYLLENYNIIGDVALGNEDTFNRILQKNQQLNY  163

Query:  169 FAKMIPIL------------MGFMVFFFVFLISGM--ALLKERTSGTLDRLLATPVKRSD  214
              K + +             GF++  +    S +  +L +++S     RL+ + + R
Sbjct:  164 DVKQVTLTDRSRSKAVSSTTTGFLLILMLGSTSVIYSGILADKSSQLYHRLMLSNLSR--  221

Query:  215 IVFGYMLSY---GILAIIQTIVIVLSTIWLLDIQVVGSIFSVIIVNFILALVALSLGILM  271
                F  YMLSY    G +A     IVI+LS + + +I         ++I+  F+  +L+A+   G+L+
Sbjct:  222 --FRYMLSYVCVGFVAFTIQIVIMLSLLKVFNISFFVPTSLLLIIFFLFSLLAIGFGLLI  279

Query:  272 STLAKSEFQMMQFIPLIIMPQLFFSGII-PLENMASWAQTVGKILPLSYSGDALTKIIMY  330
              + ++  Q Q    LI+MP    +G +  PL       S+  Q +GK+LP ++    A+   I
Sbjct:  280 GAITQNSQQSSQLANLIVMPTSMLAGCLWPLSITPSYMQAIGKLLPQNWVLSAIA-IFQS  338

Query:  331 GQGLPNVSSNLLVLL                                              345
              G  L      LL L+
Sbjct:  339 GGTLSQAWPYLLALM                                              353
```

A further related DNA sequence was identified in *S. pyogenes* <SEQ ID 9081> which encodes the amino acid sequence <SEQ ID 9082>. Analysis of this protein sequence reveals the following:

```
Possible site: 38
>>> Seems to have an uncleavable N-term signal seq
    INTEGRAL    Likelihood = -12.52    Transmembrane    21-37   (17-43)
    INTEGRAL    Likelihood = -10.30    Transmembrane    351-367 (346-371)
    INTEGRAL    Likelihood =  -5.36    Transmembrane    262-278 (260-285)
    INTEGRAL    Likelihood =  -2.60    Transmembrane    288-304 (288-305)
    INTEGRAL    Likelihood =  -1.81    Transmembrane    229-245 (229-246)

----- Final Results -----
           bacterial membrane  --- Certainty = 0.6010(Affirmative) < succ>
           bacterial outside   --- Certainty = 0.0000(Not Clear)   < succ>
           bacterial cytoplasm --- Certainty = 0.0000(Not Clear)   < succ>
```

An alignment of the GAS and GBS sequences follows:

```
Score = 62.5 bits (149), Expect = 9e-12
Identities = 72/382 (18%), Positives = 166/382 (42%), Gaps = 32/382 (8%)

Query:    1 MVLFHLIKKESLQIFRNRTALLMMVIFPILMIVILSFAFKSSFNTATTVPKLTIRYQLEG   60
            M +  + +K    ++FR++  L MM + PIL++ +++   F ++ NT    +   + +  ++
Sbjct:    1 MRIIAITEKVIKELFRDKRTLAMMFLAPILIMFLMNVMFSANSNTKVKIGTINVNTKVVS   60

Query:   61 EKTDYQKNFLAFLKVLNQKLHLETKPSNSLEKDRQRVSEGALTAVLEVKKNQTIKVITNN  120
                          L+    H++ +           ++ +      + A++   + N++  V     N
Sbjct:   61 N-------------LDNIKHIQVRSFKFNSSAKKALKSNKIDALIS-EDNKSYTVFYAN  105

Query:  121 INQQNADLINMLVKNYVDNAKTYDSIAALY------PQQLNHIRKRSVDYVKVSSIQTSK  174
              +      L     K V+   + + I++ +        P+       ++ RS    Y+K    + +
Sbjct:  106 TDSSKTTLTRQAFKTAVNTMNSKELISQVKILANKNPKLAQSLQTRS-KYIKE---KYNY  161

Query:  175 GMTSADYYA----ISMFTMITFYSMMSAMNLVLSDRQQRITNRIHLTGVSPSFLVFGKLI  230
              G  +  ++A     I M  M+ F+  + +    +L +R       +R+   T V   S  +VFG ++
Sbjct:  162 GNKNTGFFAKMIPILMGFMVFFFVFLISGMALLKERTSGTLDRLLATPVKRSDIVFGYML  221

Query:  231 GAMLATTVQLSLLYIFTRFVLRVNWGTNEWMLIGITASLVYLSVAIGIGLGISIKNEAFL  290
                   +Q  ++ + T  ++L +      + + +I +    L    +++++GI  +         K+E    +
Sbjct:  222 SYGILAIIQTIVIVLSTIWLLDIQVVGSIFSVIIVNFILALVALSLGILMSTLAKSEFQM  281

Query:  291 TVASNTIIPIFAFLGGSYVPLTTLHSSIINQLSNISPIKWVNDSLFYLIFGGQYNP-IPV  349
                       II        F  G  +PL   +S    +  I P++ +   D+L   +I   GQ   P +
Sbjct:  282 MQFIPLIIMPQLFFSG-IIPLENM-ASWAQTVGKILPLSYSGDALTKIIMYGQGLPNVSS  339

Query:  350 TLIVNISIGTIFIILALIGMRK                                       371
              L+V +    I  I  + G+++
Sbjct:  340 NLLVLLLFLIILTIANIFGLKR                                       361
```

Based on this analysis, it was predicted that these proteins and their epitopes could be useful antigens for vaccines or diagnostics.

EXAMPLE 215

A DNA sequence (GBSx0229) was identified in *S. agalactiae* <SEQ ID 683> which encodes the amino acid sequence <SEQ ID 684>. This protein is predicted to be CG1718 gene product (b0794). Analysis of this protein sequence reveals the following:

```
Possible site: 61
>>> Seems to have no N-terminal signal sequence
    INTEGRAL      Likelihood = -1.17     Transmembrane    118-134 (117-134)

----- Final Results -----
              bacterial membrane --- Certainty = 0.1468(Affirmative) < succ>
               bacterial outside --- Certainty = 0.0000(Not Clear)   < succ>
             bacterial cytoplasm --- Certainty = 0.0000(Not Clear)   < succ>
```

A related GBS nucleic acid sequence <SEQ ID 8521> which encodes amino acid sequence <SEQ ID 8522> was also identified. Analysis of this protein sequence reveals the following:

```
Lipop: Possible site: -1 Crend: 8
McG: Discrim Score: -10.96
GvH: Signal Score (-7.5): -4.84
    Possible site: 15
>>> Seems to have no N-terminal signal sequence
ALOM program count: 1 value: -1.17 threshold: 0.0
    INTEGRAL      Likelihood = -1.17     Transmembrane    142-158 (141-158)
    PERIPHERAL    Likelihood =  4.98     197
modified ALOM score: 0.73
*** Reasoning Step: 3

----- Final Results -----
              bacterial membrane --- Certainty = 0.1468(Affirmative) < succ>
               bacterial outside --- Certainty = 0.0000(Not Clear)   < succ>
             bacterial cytoplasm --- Certainty = 0.0000(Not Clear)   < succ>
```

The protein has homology with the following sequences in the GENPEPT database:

```
>GP:AAF50837 GB:AE003568 CG1718 gene product [Drosophila melanogaster]
Identities = 80/204 (39%), Positives = 123/204 (60%), Gaps = 3/204 (1%)

Query:     7 EIIGLIGPSGAGKSTLIKTMLGMEKADKGTALV--LDTQMPDRNILNQIGYMAQSDALYE    64
             E  GL+G +GAGK+T  K M G E+     GAV L  +   +I  IGY Q DAL +
Sbjct:  1394 ECFGLLGVNGAGKTTTFKMMTGDERISSGAAYVQGLSLESNMNSIYKMIGYCPQFDALLD  1453

Query:    65 SLTGLENLLFFGKMKGIQKTELKQQITHISKVVDLENQLDKFVSGYSGGMKRRLSLAIAL   124
                LTG E L  F  ++G+Q++  ++Q     ++K       +DK    YSGG KR+LS AIA+
Sbjct:  1454 DLTGREVLRIFCMLRGVQESRIRQLSEDLAKSFGFMKHIDKQTHAYSGGNKRKLSTAIAV  1513

Query:   125 LGNPTVLILDEPTVGIDPSLRRKIWQELINIKDEGHSIFITTHVMDEAE-LTSKVALLLR   183
             +G+P+V+ LDEPT G+DP+ RR++W  +   I+D G SI +T+H M+E E L +++A+++
Sbjct:  1514 IGSPSVIYLDEPTTGMDPAARRQLWNMVCRIRDSGKSIVLTSHSMEECEALCTRLAIMVN  1573

Query:   184 GNIIAFDTPLHLKKQFNVSTIEEV                                      207
             G    +  HLK +F+   I ++
Sbjct:  1574 GEFKCIGSTQHLKNKFSKGLILKI                                     1597

Identities = 73/216 (33%), Positives = 128/216 (58%), Gaps = 9/216 (4%)

Query:     1 MEVFKGEIIGLIGPSGAGKSTLIKTMLGMEKADKGTALV--LDTQMPDRNILNQIGYMAQ    58
             M +F+ EI  L+G +GAGK+T I  + GM       GTA++   D +          +G  Q
Sbjct:   536 MNMFEDEITVLLGHNGAGKTTTISMLTGMFPPTSGTAIINGSDIRTNIEGARMSLGICPQ   595

Query:    59 SDALYESLTGLENLLFFGKMKGIQKTELKQQITHISKVVDLENQLDKFVSGYSGGMKRRL   118
              + L++ ++    ++ FF +MKG++     ++Q++      K+++LE++ +    S SGGMKR+L
Sbjct:   596 HNVLFDEMSVSNHIRFFSRMKGLRGKAVEQEVAKYLKMIELEDKANVASSKLSGGMKRKL   655

Query:   119 SLAIALLGNPTVLILDEPTVGIDPSLRRKIWQELINIKDEGHSIFITTHVMDEAE-LTSK   177
             S+   AL G+  V++ DEP+ G+DPS RR++ +L+  +    G ++  +TTH MDEA+ L  +
Sbjct:   656 SVCCALCGDTKVVLCDEPSSGMDPSARRQLW-DLLQQEKVGRTLLLTTHFMDEADVLGDR   714

Query:   178 VALLLRGNIIAFDTPLHLKKQFN-----VSTIEEVF                         208
             +A++  G +    T   LKKQ+     VS ++ +F
Sbjct:   715 IAIMCDGELKCQGTSFFLKKQYGSGYRLVSGVQNLF                         750
```

A related DNA sequence was identified in *S. pyogenes* 35 <SEQ ID 685> which encodes the amino acid sequence <SEQ ID 686>. Analysis of this protein sequence reveals the following:

```
Possible site: 59
>>> Seems to have no N-terminal signal sequence
    INTEGRAL     Likelihood = -0.43    Transmembrane  49-65 (49-65)

----- Final Results -----
              bacterial membrane --- Certainty = 0.1171(Affirmative) < succ>
               bacterial outside --- Certainty = 0.0000(Not Clear)   < succ>
             bacterial cytoplasm --- Certainty = 0.0000(Not Clear)   < succ>
```

The protein has homology with the following sequences in the databases:

```
>GP:CAB12660 GB:Z99108 similar to ABC transporter (ATP-binding protein)
[Bacillus subtilis]
Identities = 151/316 (47%), Positives = 202/316 (63%), Gaps = 18/316 (5%)

Query:     4 VQLTNVVKSYKNGKKA-VNDVSLSIEAGNIYGLLGPNGAGKSTLINLILGLIPLSSGKIT    62
             +Q  N+ K+Y  GKK   V  +S S++  G  +GLLGPNGAGKST I++I GL+P  SG IT
Sbjct:     2 LQAENIKKAY--GKKTIVKGISFSLKKGESFGLLGPNGAGKSTTISMISGLVPHDSGNIT    59

Query:    63 VLGQS-QKTIRKISSQIGYVPQDIAVYPDLTAYENVELFGSLYGLKGAQLKKQVLKSLEF   121
             V G    K     +IG VPQ+IA+YP LTA+EN +G +YGL  + KK+  + LE+
Sbjct:    60 VGGYVIGKETAKAKQKIGIVPQEIALYPTLTAHENLMFWGKMYGLTHDEAKKRAAEVLEY   119

Query:   122 VGLHSQAKQFPSQFSGGMKRRLNIACALVHSPKLIIFDEPTVGIDPQSRNHILESIRLLN   181
             VGL  +AK     FSGGMKRR+NI  AL+H P+L+I DEPTVGIDPQSRNHILE+++ LN
Sbjct:   120 VGLTERAKDKIETFSGGMKRRINIGAALMHKPELLIMDEPTVGIDPQSRNHILETVKQLN   179

Query:   182 KEGATVIYTTHYMEEVEALCDYIFIMDHGQVIEEGPKFELEKRYVANLANQIIVTLTDSR   241
             + G TVIYT+HYMEEVE LCD I I+D G++I  G K +L +    +  Q+ V+  +
Sbjct:   180 ETGMTVIYTSHYMEEVEFLCDRIGIIDQGEMIAIGTKTDLCSRLGGDTIIQLTVSGINEA   239
```

```
-continued
Query:   242 HL----ELADKPDWSLIEDGEKLMLKIDNSD------MTSVVHQLTQANITFSEIRHNHL  291
             L     LA   D ++ E    L LKID S         +TS++ + T   +I       ++
Sbjct:   240 FLVAIRSLAHVNDVTVHE----LELKIDISAAHHEKVVTSLLAEATAHHINLLSLQVQEP  295

Query:   292 NLEEIFLHLTGKKLRD                                             307
             NLE +FL+LTG+ LRD
Sbjct:   296 NLERLFLNLTGRTLRD                                             311
```

An alignment of the GAS and GBS proteins is shown below:

```
Identities = 81/211 (38%), Positives = 125/211 (58%), Gaps = 2/211 (0%)

Query:     1 MEVFKGEIIGLIGPSGAGKSTLIKTMLGMEKADKGTALVL-DTQMPDRNILNQIGYMAQS   59
             + +   G I GL+GP+GAGKSTLI  +LG+      G    VL +Q   R I +QIGY+ Q
Sbjct:    25 LSIEAGNIYGLLGPNGAGKSTLINLILGLIPLSSGKITVLGQSQKTIRKISSQIGYVPQD   84

Query:    60 DALYESLTGLENLLFFGKMKGIQKTELKQQITHISKVVDLENQLDKFVSGYSGGMKRRLS  119
              A+Y  LT  EN+  FG + G++   +LK+Q+     + V L +Q   +F S +SGGMKRRL+
Sbjct:    85 IAVYPDLTAYENVELFGSLYGLKGAQLKKQVLKSLEFVGLHSQAKQFPSQFSGGMKRRLN  144

Query:   120 LAIALLGNPTVLILDEPTVGIDPSLRRKIWQELINIKDEGHSIFITTHVMDEAE-LTSKV  178
             +A AL+ +P ++I DEPTVGIDP   R  I + +    + EG ++  TTH M+E E L    +
Sbjct:   145 IACALVHSPKLIIFDEPTVGIDPQSRNHILESIRLLNKEGATVIYTTHYMEEVEALCDYI  204

Query:   179 ALLLRGNIIAFDTPLHLKKQFNVSTIEEVFL                              209
             ++   G +I       L+K++   +   ++ +
Sbjct:   205 FIMDHGQVIEEGPKFELEKRYVANLANQIIV                              235
```

SEQ ID 8522 (GBS391) was expressed in *E. coli* as a His-fusion product. SDS-PAGE analysis of total cell extract is shown in FIG. 74 (lane 7; MW 30 kDa). It was also expressed in *E. coli* as a GST-fusion product. SDS-PAGE analysis of total cell extract is shown in FIG. 83 (lane 4; MW 55 kDa).

Figure 217:
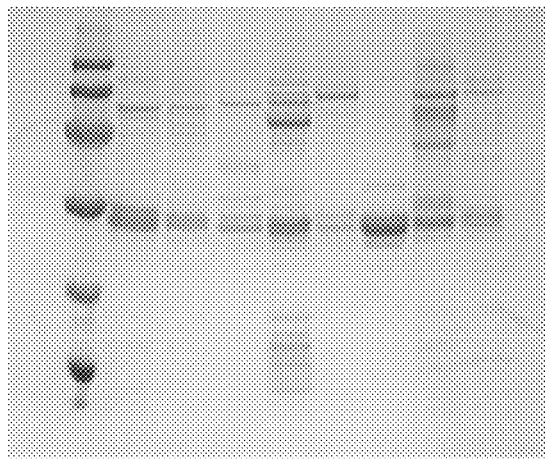

GBS391-GST was purified as shown in FIG. 217, lane 3.

Based on this analysis, it was predicted that these proteins and their epitopes could be useful antigens for vaccines or diagnostics.

EXAMPLE 216

A DNA sequence (GBSx0230) was identified in *S. agalactiae* <SEQ ID 687> which encodes the amino acid sequence <SEQ ID 688>. Analysis of this protein sequence reveals the following:

```
Possible site: 13
>>> Seems to have no N-terminal signal sequence

----- Final Results -----
         bacterial cytoplasm --- Certainty = 0.6732(Affirmative) < succ>
         bacterial membrane  --- Certainty = 0.0000(Not Clear)   < succ>
         bacterial outside   --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 217

A repeated DNA sequence (GBSx0231) was identified in *S. agalactiae* <SEQ ID 689> which encodes the amino acid sequence <SEQ ID 690>. This protein is predicted to be ISL2 protein. Analysis of this protein sequence reveals the following:

```
Possible site: 58
>>> Seems to have an uncleavable N-term signal seq

----- Final Results -----
              bacterial membrane --- Certainty = 0.0000(Not Clear) < succ>
              bacterial outside  --- Certainty = 0.0000(Not Clear) < succ>
              bacterial cytoplasm --- Certainty = 0.0000(Not Clear) < succ>
```

The protein has homology with the following sequences in the GENPEPT database:

```
>GP:CAC18596 GB:AJ278419 IS1381 transposase [Streptococcus pneumoniae]
Identities = 111/129 (86%), Positives = 117/129 (90%)

Query:   1 MKAQAIVTSQGRIVSLDIAVNYCHDMKLFKMSRRNIGQAAKILADSGYQGIMKMYSQAQT  60
           MK QAIVTSQGRIVSLDI VNYCHDMKLFKMSRRNIGQA KILADSGYQG+MK+Y QAQT
Sbjct:   1 MKTQAIVTSQGRIVSLDITVNYCHDMKLFKMSRRNIGQAGKILADSGYQGLMKIYPQAQT  60

Query:  61 PRKSSKLKPLTLEDKTYNHTLSKERIKVENIFAKVKTFKIFSTTYRNRRKRFGLRMNLIA  120
            RKSSKLKPLT+EDK  NH LSKER KVENIFAKVKTFK+FSTTYR+ RKRFGLRMNL A
Sbjct:  61 SRKSSKLKPLTVEDKACNHALSKERSKVENIFAKVKTFKMFSTTYRSHRKRFGLRMNLSA  120

Query: 121 GMINRELGF  129
           G+IN ELGF
Sbjct: 121 GIINHELGF  129
```

No corresponding DNA sequence was identified in *S. pyogenes*.

Based on this analysis, it was predicted that this protein and its epitopes, could be useful antigens for vaccines or diagnostics.

EXAMPLE 218

A repeated DNA sequence (GBSx0232) was identified in *S. agalactiae* <SEQ ID 691> which encodes the amino acid sequence <SEQ ID 692>. This protein is predicted to be ISL2 protein. Analysis of this protein sequence reveals the following:

```
Possible site: 41
>>> Seems to have no N-terminal signal sequence

----- Final Results -----
              bacterial cytoplasm --- Certainty = 0.3996(Affirmative) < succ>
              bacterial membrane  --- Certainty = 0.0000(Not Clear)   < succ>
              bacterial outside   --- Certainty = 0.0000(Not Clear)   < succ>
```

The protein has homology with the following sequences in the GENPEPT database:

```
>GP:CAC18595 GB:AJ278419 IS1381 transposase [Streptococcus pneumoniae]
Identities = 110/125 (88%), Positives = 119/125 (95%)

Query:   1 MNYEASKQLTDVRFKRLVGVQRTTFEEMLAVLKTAYQRKHAKGGRTPKLSLEDLLMATLQ  60
           MNYEASKQLTD RFKRLVGVQRTTFEEMLAVLKTAYQ KHAKGGR PKLSLEDLLMATLQ
Sbjct:   1 MNYEASKQLTDARFKRLVGVQRTTFEEMLAVLKTAYQLKHAKGGRKPKLSLEDLLMATLQ  60

Query:  61 YMREYRTYEQIAADFGIHESNLIRRSQWVESTLIQSGFTISKTHLSAEDTVIVDATEVKI  120
           Y+REYRTYE+IAADFG+HESNL+RRSQWVE TL+QSG TIS+T LS+EDTV++DATEVKI
Sbjct:  61 YVREYRTYEEIAADFGVHESNLLRRSQWVEVTLVQSGVTISRTPLSSEDTVMIDATEVKI  120

Query: 121 NRPKK  125
           NRPKK
Sbjct: 121 NRPKK  125
```

No corresponding DNA sequence was identified in *S. pyogenes*.

Based on this analysis, it was predicted that this protein and its epitopes, could be useful antigens for vaccines or diagnostics.

EXAMPLE 219

A DNA sequence (GBSx0233) was identified in *S. agalactiae* <SEQ ID 693> which encodes the amino acid sequence <SEQ ID 694>. Analysis of this protein sequence reveals the following:

```
Possible site: 57
>>> Seems to have no N-terminal signal sequence
    INTEGRAL    Likelihood = -10.40    Transmembrane    130-146 (123-156)
    INTEGRAL    Likelihood = -7.86     Transmembrane    169-185 (167-191)
    INTEGRAL    Likelihood = -6.90     Transmembrane    100-116 (95-118)
    INTEGRAL    Likelihood = -5.52     Transmembrane    199-215 (189-216)

----- Final Results -----
              bacterial membrane --- Certainty = 0.5161(Affirmative) < succ>
               bacterial outside --- Certainty = 0.0000(Not Clear)   < succ>
             bacterial cytoplasm --- Certainty = 0.0000(Not Clear)   < succ>
```

The protein has homology with the following sequences in the GENPEPT database:

```
>GP:BAB04126 GB:AP001508 unknown conserved protein in others
[Bacillus halodurans]
Identities = 47/207 (22%), Positives = 95/207 (45%), Gaps = 14/207 (6%)

Query:    7 LQKENTLLEGRIDNSNNQTYTDMIVYLRGA-SISPYHQELIRNDIVNMLLEAQERQASLV   65
            L K+N     +    N + Y D+++Y+R A S S     E +  ++++ LLEAQ +  S
Sbjct:    6 LIKDNNEKRKLLTEENLKVYEDLLLYIRLAHSKSEQETEELLTELLDHLLEAQAKGKSAK   65

Query:   66 SVFGEDRHDFINQVIKSTPKISKKEE-TLQRWDLAILLLTIQMIIFLGGYLITEALQQSV  124
            +VFG++   + +++I   PK+  KE   L  + L++    T+  ++F G Y +         V
Sbjct:   66 AVFGDNPKQYADEIIGEIPKMVTKERFGLFAYGLSMFFATV--LVFSGIYRMLRYYVFQV  123

Query:  125 PDLIPITLLDVLFAIFISIIAVKIADTIIYATYNFDK----SKEKKYFFRYIFLILSLII  180
             +  +    +    A+  +I ++ IA    ++  + + +        K F  +I  +  +I
Sbjct:  124 GEAVSEVYVGT--ALITTIASIVIAWMFVFVVFQYFRWSCFRTINKVFEFFILWLGGMIP  181

Query:  181 AYILIGKYYHLP----FINIPLWIYLI                                   203
             +       Y  P      I  IP+++Y +
Sbjct:  182 FALFFALLYFTPNVGRMIEIPVYLYFV                                   208
```

No corresponding DNA sequence was identified in *S. pyogenes*.

Based on this analysis, it was predicted that this protein and its epitopes, could be useful antigens for vaccines or diagnostics.

EXAMPLE 220

A DNA sequence (GBSx0234) was identified in *S. agalactiae* <SEQ ID 695> which encodes the amino acid sequence <SEQ ID 696>. This protein is predicted to be minor extracellular protease epr precursor (epr). Analysis of this protein sequence reveals the following:

```
Possible site: 31
>>> Seems to have an uncleavable N-term signal seq
    INTEGRAL    Likelihood = -10.72    Transmembrane    10-26 (5-33)

----- Final Results -----
              bacterial membrane --- Certainty = 0.5288(Affirmative) < succ>
               bacterial outside --- Certainty = 0.0000(Not Clear)   < succ>
             bacterial cytoplasm --- Certainty = 0.0000(Not Clear)   < succ>
```

A related GBS nucleic acid sequence <SEQ ID 8523> which encodes amino acid sequence <SEQ ID 8524> was also identified. Analysis of this protein sequence reveals the following:

```
Lipop Possible site: -1 Crend: 8
McG: Discrim Score: 12.11
```

-continued

```
GvH: Signal Score (-7.5): -4.02
    Possible site: 29
>>> Seems to have an uncleavable N-term signal seq
ALOM program count: 1 value: -10.72 threshold: 0.0
    INTEGRAL   Likelihood = -10.72   Transmembrane   8-24 (5-33)
    PERIPHERAL Likelihood =  13.74                   219
modified ALOM score: 2.64
*** Reasoning Step: 3

----- Final Results -----
              bacterial membrane  --- Certainty = 0.5288(Affirmative) < succ>
              bacterial outside   --- Certainty = 0.0000(Not Clear)   < succ>
              bacterial cytoplasm --- Certainty = 0.0000(Not Clear)   < succ>
```

The protein has homology with the following sequences in the GENPEPT database:

```
!GB:Z99123 extracellular serine protease [Bacillus s . . .
>GP:CAB15866 GB:Z99123 extracellular serine protease [Bacillus subtilis]
Identities = 44/150 (29%), Positives = 80/150 (53%), Gaps = 14/150 (9%)

Query:  37 QMDTVESSVNHVSDSQLTEAQDMLKDFEKKPSEKLLKDVELALNKLSNSSKKEALQKRFK   96
           ++D V+S  N        + +A+D + K EK  +++ +   + A+NKL N + K+ LQKR
Sbjct: 428 RLDKVQSYRN------VKDAKDKVAKAEKYKTQQTVDTAQTAINKLPNGTDKKNLQKRLD  481

Query:  97 KAKDKYLKDEADKKATKDATDLVEILEQAPSEENVLKAEAAVNKLTVKESKEALQKRIDT  156
           + K +Y+        A+K A D V   E++  + +V  A++A+ KL     K +LQKR++
Sbjct: 482 QVK-RYI-------ASKQAKDKVAKAEKSKKKTDVDSAQSAIGKLPASSEKTSLQKRLNK  533

Query: 157 VKTQYGLIGNQTPSSSVAETTEQGTANPAS                               186
           VK+        Q+ S++  ++T+   A   S
Sbjct: 534 VKSTNLKTAQQSVSAAEKKSTDANAAKAQS                               563

Identities = 39/124 (31%), Positives = 64/124 (51%), Gaps = 2/124 (1%)

Query:  35 TTQMDTVESSVNHVSDSQLTEAQDMLKDFEKKPSEKLLKDVELALNKLSNSSKKEALQKR   94
           +++  +++ +N V  + L  AQ  +   EKK ++         + A+N+L    K ALQKR
Sbjct: 521 SSEKTSLQKRLNKVKSTNLKTAQQSVSAAEKKSTDANAAKAQSAVNQLQAGKDKTALQKR  580

Query:  95 FKKAKDKYLKDEADKKATKDATDLVEILEQAPSEENVLKAEAAVNKLTVKESKEALQKRI  154
               K K K     EA K  T  A   V+  E+   ++++   A++AVN+L    K  LQKR+
Sbjct: 581 LDKVKKKVAAAEAKKVETAKAK--VKKAEKDKTKKSKTSAQSAVNQLKASNEKTKLQKRL  638

Query: 155 DTVK                                                         158
           +  VK
Sbjct: 639 NAVK                                                         642
```

A related DNA sequence was identified in *S. pyogenes* <SEQ ID 697> which encodes the amino acid sequence <SEQ ID 698>. Analysis of this protein sequence reveals the following:

```
Possible site: 41
>>> Seems to have no N-terminal signal sequence
    INTEGRAL   Likelihood = -4.99    Transmembrane   24-40 (23-43)

----- Final Results -----
              bacterial membrane  --- Certainty = 0.2996(Affirmative) < succ>
              bacterial outside   --- Certainty = 0.0000(Not Clear)   < succ>
              bacterial cytoplasm --- Certainty = 0.0000(Not Clear)   < succ>
```

The protein has homology with the following sequences in the databases:

```
>CAB15866 GB:Z99123 extracellular serine protease [Bacillus subtilis]
Identities = 43/130 (33%), Positives = 71/130 (54%), Gaps = 8/130 (6%)

Query:  41 GSHPQTQDKVA---KHSKSAASLLKKAVKAVNDADRLATAAAIQEAQKAVDKLAESSKKK   97
           G   P + +K +    + +K ++ LK A ++V+ A++  +T A   +AQ AV++L      K
Sbjct: 516 GKLPASSEKTSLQKRLNKVKSTNLKTAQQSVSAAEKKSTDANAAKAQSAVNQLQAGKDKT  575
```

```
Query:   98 TLQEQLN-----VAKAKQEQEDAATQAVKAAEETLNQNLKDIAQKAVNDLSNKGKKAALQ   152
            LQ++L+      VA A+ ++ + A   VK AE+   + K  AQ AVN L     +K  LQ
Sbjct:  576 ALQKRLDKVKKKVAAAEAKKVETAKAKVKKAEKDKTKKSKTSAQSAVNQLKASNEKTKLQ   635

Query:  153 SRLDAILPAK                                                    162
            RL+A+ P K
Sbjct:  636 KRLNAVKPKK                                                    645

Identities = 31/105 (29%), Positives = 53/105 (49%), Gaps = 1/105 (0%)

Query:   54 SKSAASLLKKAVKAVNDADRLATAAAIQEAQKAVDKLAESSKKKTLQEQLNVAKAKQEQE   113
            +++ S     A +AV A++       I +A++ + +L   S   K   L  ++L+ ++ + +
Sbjct:  380 AQATDSAYAAAEQAVKKAEQTKAQIDINKARELISQLPNSDAKTALHKRLDKVQSYRNVK   439

Query:  114 DAATQAVKAAEETLNQNLKDIAQKAVNDLSNKGKKAALQSRLDAI                 158
            DA  +  KA E+    Q     D AQ A+N L N      K   LQ RLD +
Sbjct:  440 DAKDKVAKA-EKYKTQQTVDTAQTAINKLPNGTDKKNLQKRLDQV                 483
```

An alignment of the GAS and GBS proteins is shown below:

```
Identities = 61/233 (26%), Positives = 115/233 (49%), Gaps = 13/233 (5%)

Query:    2 SMKIDKKELLALIASIILLIFASVTFFLFKDHGTTQMDTVESSVNHVSDSQLTEAQDMLD    61
            SM   +KE L  + S++ +       + +F  H  TQ     + S +  + S L +A   ++
Sbjct:   12 SMTKSQKEALYWMLSVLTITLIGGSCLIFGSHPQTQDKVAKHSKS--AASLLKKAVKAVN    69

Query:   62 KFEKKPSEKLLKDVELALNKLSNSSKKEALQKRFKKAKDKYLKDEADKKATKDATDLVEI   121
            ++  +  +++ +  A++KL+  SSKK+ LQ++    AK K  +++A       AT  V+
Sbjct:   70 DADRLATAAAIQEAQKAVDKLAESSKKKTLQEQLNVAKAKQEQEDA-------ATQAVKA   122

Query:  122 LEQAPSEENVLKAEAAVNKLTVKESKEALQKRIDTVKTQYGLIGNQTPSSSVAETTEQGT   181
            E+  ++    A+  AVN L+ K   K  ALQ  R+D +        +I ++ P   S   E T+
Sbjct:  123 AEETLNQNLKDIAQKAVNDLSNKGKKAALQSRLDAILPAKPII-DEFPRQS-GEITDNSY   180

Query:  182 ANPASQDTSSYVNQNVAPTYE-QPQANNTPVTPGVNNTVP-TPGTGTVPATNG          232
               P    D  S   + + +PT +    +++ + VTP   ++  P   P T + P+ +G
Sbjct:  181 WTPFPGDVSDTYDNSQSPTLDPSSESSASDVTPQPSHPDPIPPQTSSEPSDSG          233
```

Figure 52:
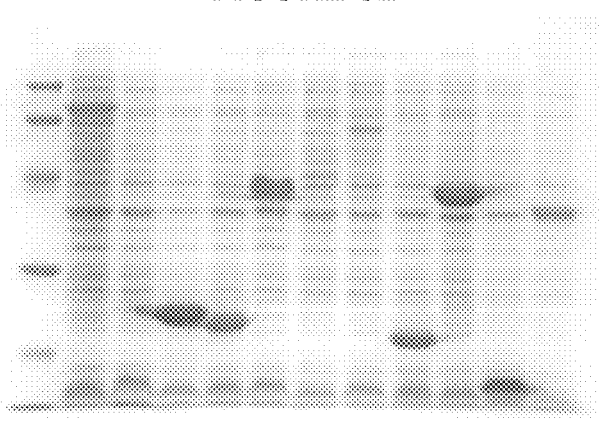

SEQ ID 8524 (GBS278) was expressed in *E. coli* as a His-fusion product. SDS-PAGE analysis of total cell extract is shown in FIG. 52 (lane 6; MW 40 kDa).

Figure 305:
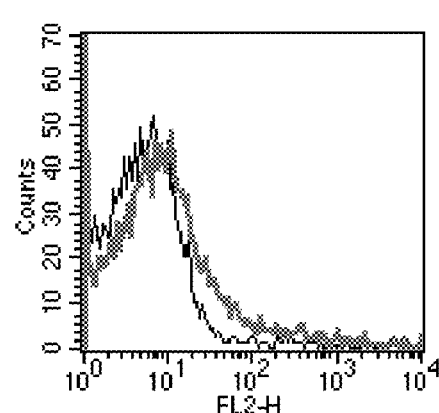

The GBS278-His fusion product was purified (FIG. 206, lane 10) and used to immunise mice. The resulting antiserum was used for FACS (FIG. 305), which confirmed that the protein is immunoaccessible on GBS bacteria.

Based on this analysis, it was predicted that these proteins and their epitopes could be useful antigens for vaccines or diagnostics.

EXAMPLE 221

A DNA sequence (GBSx0235) was identified in *S. agalactiae* <SEQ ID 699> which encodes the amino acid sequence <SEQ ID 700>. Analysis of this protein sequence reveals the following:

```
Possible site: 53
>>> Seems to have no N-terminal signal sequence

----- Final Results -----
          bacterial cytoplasm --- Certainty = 0.1466 (Affirmative) < succ>
          bacterial membrane  --- Certainty = 0.0000 (Not Clear)   < succ>
          bacterial outside   --- Certainty = 0.0000 (Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 222

A DNA sequence (GBSx0236) was identified in *S. agalactiae* <SEQ ID 701> which encodes the amino acid sequence <SEQ ID 702>. This protein is predicted to be N-acetylglucosamine-6-phosphate deacetylase (nagA). Analysis of this protein sequence reveals the following:

```
Possible site: 15
>>> Seems to have no N-terminal signal sequence

----- Final Results -----
            bacterial cytoplasm --- Certainty = 0.4607 (Affirmative) < succ>
            bacterial membrane  --- Certainty = 0.0000 (Not Clear)   < succ>
             bacterial outside  --- Certainty = 0.0000 (Not Clear)   < succ>
```

A related GBS nucleic acid sequence <SEQ ID 9297> which encodes amino acid sequence <SEQ ID 9298> was also identified.

The protein has homology with the following sequences in the GENPEPT database:

```
>GP:AAG21688 GB:AY007718 N-acetylglucosamine-6-phosphate deacetylase
[Lactococcus lactis subsp. cremoris]
Identities = 113/178 (63%), Positives = 135/178 (75%)

Query:  131 GIYFEGPYFTEEYKGAQNPIYMRNPNLEEFAQWQKAAKGLITKIALAPEREGVEEFVSAI  190
            GI+FEGP+FTEE KGAQNP YMR+ + E   WQ+AA G++ KI LAPEREG E+F+
Sbjct:    1 GIFFEGPFFTEEKKGAQNPKYMRDAKMWELEDWQEAAHGMLKKIGLAPEREGSEDFIRKA   60

Query:  191 TKQGVTVALGHSNGTYKEAKKAVKAGASVWVHAYNGMRGLTHREPGMVGAVYNLPNTYAE  250
            T+ GV +ALGHSN TYK+A   V+AGASVWVH +NGM G+TH+EPGMVGA+ N PNTYAE
Sbjct:   61 TESGVVIALGHSNATYKQAVAGVQAGASVWVHTFNGMSGMTHQEPGMVGAILNTPNTYAE  120

Query:  251 LICDGHHVDPVACDILMTQKGHNHVALITDCMAAGGAPDGDYMLGELPVVVSNGTARL   308
            LICDGHHV P A +I++  KG +HV LITD M A G PDG YMLGE  V V +G A L
Sbjct:  121 LICDGHHVRPEAAEIVVKMKGADHVVLITDSMRAAGLPDGPYMLGEYEVEVRDGAAWL   178
```

A related DNA sequence was identified in *S. pyogenes* <SEQ ID 703> which encodes the amino acid sequence <SEQ ID 704>. Analysis of this protein sequence reveals the following:

```
Possible site: 40
>>> Seems to have no N-terminal signal sequence

----- Final Results -----
            bacterial cytoplasm --- Certainty = 0.3114 (Affirmative) < succ>
            bacterial membrane  --- Certainty = 0.0000 (Not Clear)   < succ>
             bacterial outside  --- Certainty = 0.0000 (Not Clear)   < succ>
```

An alignment of the GAS and GBS proteins is shown below:

```
Identities = 227/300 (75%), Positives = 262/300 (86%)

Query:    9 MTKYIKADRFFYADHVKENGYLEIKDNHFGKWIENISGQEEILDYSGYQIAPGLVDTHIH   68
            MT Y+KAD F+Y    V+  GYL + D  FG+W E +    +I+DY+GYQIAPGLVDTHIH
Sbjct:    1 MTCYLKADCFYYPTEVRPAGYLSLHDGVFGEWTEIVPADAQIIDYTGYQIAPGLVDTHIH   60

Query:   69 GFAGADVMDCDSEGILRMSAGLLSTGVTSFLPTTLTSDTKRLEEASKSVAAVAGKEQGAK  128
            G+AGADVMD  ++GI +MS GLL+TGVTSFLPTTLTS  ++LE+ S ++A+VA + +GAK
Sbjct:   61 GYAGADVMDNSAQGIHQMSEGLLATGVTSFLPTTLTSTFEQLEKVSGTIASVADQVKGAK  120

Query:  129 IQGIYFEGPYFTEEYKGAQNPIYMRNPNLEEFAQWQKAAKGLITKIALAPEREGVEEFVS  188
            IQGIYFEGPYFTEEYKGAQNP YM+ P LEEF  WQKAAKGLI KIALAPER+GV EFVS
Sbjct:  121 IQGIYFEGPYFTEEYKGAQNPSYMKTPRLEEFDAWQKAAKGLIKKIALAPERDGVKEFVS  180

Query:  189 AITKQGVTVALGHSNGTYKEAKKAVKAGASVWVHAYNGMRGLTHREPGMVGAVYNLPNTY  248
            A+TKQGVTVALGHSNGTY+EAK AV+AGASVWVHAYNGMRGLTHREPGMVGAVYNLPNTY
Sbjct:  181 AVTKQGVTVALGHSNGTYQEAKEAVQAGASVWVHAYNGMRGLTHREPGMVGAVYNLPNTY  240
```

```
Query:  249 AELICDGHHVDPVACDILMTQKGHNHVALITDCMAAGGAPDGDYMLGELPVVVSNGTARL  308
            AELICDGHHV P+ACDILM QKGH+HVA+ITDCM AGG+PDGDY+LGE   VVV+NGTARL
Sbjct:  241 AELICDGHHVSPIACDILMQQKGHDHVAMITDCMRAGGSPDGDYLLGEFSVVVANGTARL  300
```

Based on this analysis, it was predicted that these proteins and their epitopes could be useful antigens for vaccines or diagnostics.

EXAMPLE 223

A DNA sequence (GBSx0237) was identified in *S. agalactiae* <SEQ ID 705> which encodes the amino acid sequence <SEQ ID 706>. Analysis of this protein sequence reveals the following:

```
Possible site: 25
>>> Seems to have no N-terminal signal sequence

----- Final Results -----
            bacterial cytoplasm --- Certainty = 0.3709(Affirmative) < succ>
             bacterial membrane --- Certainty = 0.0000(Not Clear)   < succ>
              bacterial outside --- Certainty = 0.0000(Not Clear)   < succ>
```

A related GBS nucleic acid sequence <SEQ ID 9307> which encodes amino acid sequence <SEQ ID 9308> was also identified.

The protein has homology with the following sequences in the GENPEPT database:

```
>GP:CAB16112 GB:Z99124 yyaQ [Bacillus subtilis]
Identities = 40/110 (36%), Positives = 62/110 (56%), Gaps = 12/110 (10%)

Query:  121 IAKTFEDSVDYPFAKHPQYASYRVSG--KWYALLFPLKMGKLENVPAQLSED---EVEVL  175
            + + +  S DYP+ K+P YAS R +   KWY L+ +        +P +L  D   E+++L
Sbjct:   11 VKEKYGTSPDYPWEKYPNYASLRHTSNKKWYGLIMNV-------LPEKLGLDGHGEIDIL   63

Query:  176 NIKVNPQDMEILLQKEGIYPSYHMSKKTWVSIVLDNTLSDIEIFKLVSDS            225
            N+K  P+  + L   E I P YHM K+ W+SIVL+ T  + EI+ L+  S
Sbjct:   64 NLKCPPEISDRLRNGENILPGYHMDKEHWISIVLERTDPEGEIYNLIEQS            113
```

A related DNA sequence was identified in *S. pyogenes* <SEQ ID 707> which encodes the amino acid sequence <SEQ ID 708>. Analysis of this protein sequence reveals the following:

```
Possible site: 22
>>> Seems to have no N-terminal signal sequence

----- Final Results -----
            bacterial cytoplasm --- Certainty = 0.2541(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below:

```
Identities = 114/247 (46%), Positives = 169/247 (68%), Gaps = 1/247 (0%)

Query:    7 MSIESDFFRKKRFIFSSLEEFGFIKSDQEYIYCQTFMDNDFKAIITISLDGKIAGKVIDS   66
            MS+ +D+F ++   I   L +GF K D  Y Y +FM+ +F+A + I   G I  +VID
Sbjct:    1 MSLATDYFSRQTPIVEKLMAYGFEKRDNGYFYNERFMEGEFEAQLRIDEAGNIWDRVIDC   60

Query:   67 ALEEEYLPLRAANYNGSFVGEVRSAYMAILGDISDSCCKDLLFTKDQSNRLAEKIAKTFE  126
            LEE+YLPL+ A + G++ G+VR+AY+ +L  +S +C +    F    Q+NRLA+ I K +
Sbjct:   61 DLEEDYLPLQQAAWQGTYTGQVRAAYLELLERLSVACFEATPFQSMQANRLAKHITKEWS  120

Query:  127 DSVDYPFAKHPQYASYRVSGKWYALLFPLKMGKLENVPAQLSEDEVEVLNIKVNPQDMEI  186
            D +DYPF KHP  A+YRV GKWYA++F L   KL+ +  P +L      EV+  +KVNP+
Sbjct:  121 DPMDYPFEKHPDLATYRVGGKWYAMIFSLLADKLDQIPERLVGQTCEVMTVKVNPKAFPQ  180
```

```
Query:  187 LLQKEGIYPSYHMSKKTWVSIVLDNTLSDIEIFKLVSDSRKLVSHNKKSN-SEPEFWIIP  245
            LLQ+EGIYP+YHMSKK W+SI+LD+ ++D +++ LV+ SR+LV+ N  SN + P++W+IP
Sbjct:  181 LLQQEGIYPAYHMSKKNWISIILDDKVTDDKLWTLVTQSRQLVNPNGLSNPNGPDYWVIP  240

Query:  246 ANPKFYD                                                      252
            AN K+YD
Sbjct:  241 ANLKYYD                                                      247
```

Based on this analysis, it was predicted that these proteins and their epitopes could be useful antigens for vaccines or diagnostics.

EXAMPLE 224

A DNA sequence (GBSx0238) was identified in *S. agalactiae* <SEQ ID 709> which encodes the amino acid sequence <SEQ ID 710>. This protein is predicted to be transposase for insertion sequence element is 905. Analysis of this protein sequence reveals the following:

```
Possible site: 61
>>> Seems to have no N-terminal signal sequence

----- Final Results -----
            bacterial cytoplasm --- Certainty = 0.1824(Affirmative) < succ>
            bacterial membrane  --- Certainty = 0.0000(Not Clear)   < succ>
             bacterial outside  --- Certainty = 0.0000(Not Clear)   < succ>
```

A related GBS nucleic acid sequence <SEQ ID 9601> which encodes amino acid sequence <SEQ ID 9602> was also identified.

A related GBS nucleic acid sequence <SEQ ID 9595> which encodes amino acid sequence <SEQ ID 9596> was also identified.

The protein has homology with the following sequences in the GENPEPT database:

```
>GP:AAA25167 GB:L20851 transposase [Lactococcus lactis]
Identities = 325/391 (83%), Positives = 365/391 (93%)

Query:   12 MTQFTTELLNFLAQKQDIDEFFRSSLETAMNDLLQVELSAFLGYEPYDKAGYNTGNSRNG   71
            MTQFTTELLNFLAQKQDIDEFFR+SLETAMNDLLQ ELSAFLGYEPYDK GYN+GNSRNG
Sbjct:    1 MTQFTTELLNFLAQKQDIDEFFRTSLETAMNDLLQAELSAFLGYEPYDKVGYNSGNSRNG   60

Query:   72 AYTRRFETKYGVVNLLIPRDRNGEFSPALIPSYGRRDNHLEEMVIKLYRTGVTTREISDI  131
            +Y+R+FETKYG V L IPRDRNG FSPAL+P+YGRRD+HLEEMVIKLY+TGVTTREISDI
Sbjct:   61 SYSRQFETKYGTVQLSIPRDRNGNFSPALLPAYGRRDDHLEEMVIKLYQTGVTTREISDI  120

Query:  132 IERMYGHHYSPATVSNISKATQENVASFHERSLEANYTVLYLDGTYLPLRRGTVSKECIH  191
            IERMYGHHYSPAT+SNISKATQENVA+FHERSLEANY+VL+LDGTYLPLRRGTVSKECIH
Sbjct:  121 IERMYGHHYSPATISNISKATQENVATFHERSLEANYSVLFLDGTYLPLRRGTVSKECIH  180

Query:  192 IALGVTSYGHKAILGYDIAPNENNASWSDLLERFKGQGVQQVSLVVSDGFNGLDQLIQQA  251
            IALG+T  G KA+LGY+IAPNENNASWS LL++ + QG+QQVSLVV+DGF GL+Q+I QA
Sbjct:  181 IALGITPEGQKAVLGYEIAPNENNASWSTLLDKLQNQGIQQVSLVVTDGFKGLEQIISQA  240

Query:  252 FPMAKQQRCLVHIGRNIASKVKRADRALILEQFKTIYRAINVEEAKQALDSFINEWKPHY  311
            +P+AKQQRCL+HI RN+ASKVKRADRA+ILEQFKTIYRA N+E A QAL++FI EWKP Y
Sbjct:  241 YPLAKQQRCLIHISRNLASKVKRADRAVILEQFKTIYRAENLEMAVQALENFIAEWKPKY  300

Query:  312 KKVIETLESIENLLIFYEFPHQIWGSIYSTNLIESLNKEIKRQTKKKVVFPNEESLERYL  371
            +KV+E+LE+ +NLL FY+FP+QIW SIYSTNLIESLNKEIKRQTKKKV+FPNEE+LERYL
Sbjct:  301 RKVMESLENTDNLLTFYQFPYQIWHSIYSTNLIESLNKEIKRQTKKKVLFPNEEALERYL  360

Query:  372 VTLFSDYNFKQGQRIHKGFGQCTDTLESLFD                              402
            VTLF DYNFKQ QRIHKGFGQC DTLESLFD
Sbjct:  361 VTLFEDYNFKQSQRIHKGFGQCADTLESLFD                              391
```

A related DNA sequence was identified in *S. pyogenes* <SEQ ID 711> which encodes the amino acid sequence <SEQ ID 712>. Analysis of this protein sequence reveals the following:

```
Possible site: 15
>>> Seems to have no N-terminal signal sequence

----- Final Results -----
              bacterial cytoplasm --- Certainty = 0.3054 (Atfirmative) < succ>
               bacterial membrane --- Certainty = 0.0000 (Not Clear) < succ>
                bacterial outside --- Certainty = 0.0000 (Not Clear) < succ>
```

An alignment of the GAS and GBS proteins is shown below:

```
Identities = 111/128 (86%), Positives = 122/128 (94%)

Query:    12 MTQFTTELLNFLAQKQDIDEFFRSSLETAMNDLLQVELSAFLGYEPYDKAGYNTGNSRNG     71
             MTQFTTELLNFLAQKQDIDEFFRSSLE AMNDLLQVELSAFLGYEPY+K GYNTGNSRNG
Sbjct:     1 MTQFTTELLNFLAQKQDIDEFFRSSLEIAMNDLLQVELSAFLGYEPYEKEGYNTGNSRNG     60

Query:    72 AYTRRFETKYGVVNLLIPRDRNGEFSPALIPSYGRRDNHLEEMVIKLYRTGVTTREISDI    131
             Y+R+FETKYG+VNL+IPRDRNGEFSP L+PSY RR++HLEE+VIKLY+TGVTTREISDI
Sbjct:    61 TYSRQFETKYGLVNLIIPRDRNGEFSPVLLPSYARREDHLEEIVIKLYQTGVTTREISDI    120

Query:   132 IERMYGHH                                                        139
             I+RMYG H
Sbjct:   121 IKRMYGDH                                                        128
```

Based on this analysis, it was predicted that these proteins and their epitopes could be useful antigens for vaccines or diagnostics.

EXAMPLE 225

A DNA sequence (GBSx0239) was identified in *S. agalactiae* <SEQ ID 713> which encodes the amino acid sequence <SEQ ID 714>. Analysis of this protein sequence reveals the following:

```
Possible site: 32
>>> Seems to have no N-terminal signal sequence
    INTEGRAL    Likelihood = -12.42    Transmembrane      268-284 (260-286)
    INTEGRAL    Likelihood =  -6.32    Transmembrane      232-248 (231-254)

----- Final Results -----
              bacterial membrane --- Certainty = 0.5967 (Affir-
mative) < succ>
               bacterial outside --- Certainty = 0.0000 (Not
Clear) < succ>
             bacterial cytoplasm --- Certainty = 0.0000 (Not
Clear) < succ>
```

The protein has homology with the following sequences in the GENPEPT database:

```
>GP:AAD40365 GB:AF036485 hypothetical protein [Piasmid pNZ4000]
Identities = 69/283 (24%), Positives = 133/283 (46%), Gaps = 9/283 (3%)

Query:    11 INVDDLSLQEERF-LPSELLAYARDENESS-FVRDIEGHLALVYQLLDTQGHVDDVRHVP     68
             IN ++ + E+++ +  +++ Y  D +ES+ +V DI       L       L       D +R++
Sbjct:    19 INAEERATLEDQYGIDEDIIEYVTDNDESTNYVYDINEDDQLFIFLAPYALDKDALRYIT     78

Query:    69 RVIPVTLFLKEDGLFVLANHKNINLVKKALNRV---EKVDSPKHLLLSLVTAFSKQYFDV    125
             +  P  +L+  LF   N   I V  AL     +V S     +L +       +   +
Sbjct:    79 Q--PFGMLLHKGVLFTF-NQSGIPEVNTALYSALDNPEVKSVDAFILETLFTVVVSFIPI    135

Query:   126 LDTISEERDKLINDLRKRPNKSNLARLANLQSGTVHLMMGTKQNFEMLTDLQNIEQDKEN    185
             I+++R+  L    L ++      S+L   L+ LQ       L    +  N    L   L
Sbjct:   136 SRAITKKRNYLDKMLNRKTKNSDLVSLSYLQQTLTFLSSAVQTNLSELDRLPKTHFGVGA    195

Query:   186 TRNEKMQLQDAIIEARQLSNMCSLNSQVFQELS-SYNNVLSNNLNDNVTTLTIISIGISI    244
             +++    +D  IE  Q+  M   +QV   +  + N++  +NNLND +  LTI S+ +++
Sbjct:   196 DQDKIDLFEDVQIEGEQVQRMFEIETQVVDRIDHTLNSLANNNLNDTMKFLTIWSLTMAV    255
```

```
-continued
Query:  245 IAMVTSFYGMNVKLPFDSVDAVWVLIILITTIITIMLSIVMYI                287
            +++ FYGMNVKLP    +   W+L + I+ ++ + + I++ +
Sbjct:  256 PTIISGFYGMNVKLPLAGMQYAWMLTLGISVVLIVAMLIMLKV                298
```

Figure 172:
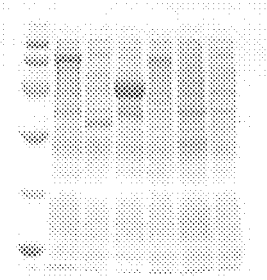

SEQ ID 714 (GBS422) was expressed in *E. coli* as a GST-fusion product. SDS-PAGE analysis of total cell extract is shown in FIG. 172 (lane 7; MW 60 kDa).

Figure 219:
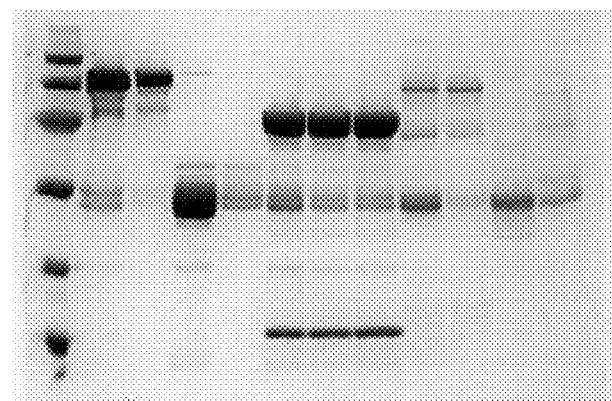

GBS422-GST was purified as shown in FIG. 219, lane 12.

Based on this analysis, it was predicted that these proteins and their epitopes could be useful antigens for vaccines or diagnostics.

EXAMPLE 226

A DNA sequence (GBSx0240) was identified in *S. agalactiae* <SEQ ID 717> which encodes the amino acid sequence <SEQ ID 718>. Analysis of this protein sequence reveals the following:

```
Possible site: 45
>>> Seems to have no N-terminal signal sequence

----- Final Results -----
            bacterial cytoplasm --- Certainty = 0.0783(Affirmative) < succ>
            bacterial membrane  --- Certainty = 0.0000(Not Clear)   < succ>
            bacterial outside   --- Certainty = 0.0000(Not Clear)   < succ>
```

The protein has homology with the following sequences in the GENPEPT database:

```
>GP: CAB61731 GB: AL133220 putative oxidoreductase. [Streptomyces
coelicolor A3(2)]
Identities = 100/306 (32%), Positives = 152/306 (48%), Gaps = 3/306 (0%)

Query:    3 KVRYGVVSTAKVAPRFIEGVRLAGNGEVVAVSSRTLESAQAFANKYHLPKAYDKLEDMLA   62
            KVR+G+++T  +A RF     +   + EVVAV+SRT   SA+ FA ++ +P+AY  E +
Sbjct:    8 KVRWGILATGGMAARFTADLVDLPDAEVVAVASRTEASAKTFAERFGIPRAYGGWETLAR   67

Query:   63 DESIDVIYVATINQDHYKVAKAALLAGKHVLEKPFTLTYDQANELFALAESCNLFLMEA  122
            DE +DV+YVAT + H  A   L AG++VL EKPFTL   +A EL ALA     +FLMEA
Sbjct:   68 DEDVDVVYVATPHSAHRTAAGLCLEAGRNVLCEKPFTLNAREAAELVALARENGVFLMEA  127

Query:  123 QKSVFIPMTQVIKKLLASGEIGEVISISSTTAYPN-IDHVTWFRELELGGGTVHFMAPYA  181
                 P+ + +K+L+A G IGEV S+ +           R+    GGG +  + Y
Sbjct:  128 MWMYCNPLVRRLKELVADGAIGEVRSLQADFGLAGPFPAAHRLRDPAQGGGALLDLGVYP  187

Query:  182 LSYLQYLFDATITHASGTATFPKGQSDSQSKLLLQLSNGVLVDIFLTTRLNLPHEMIIYG  241
            +S+ Q L     T + A +  D Q+ LL    N  L I +     P+    I G
Sbjct:  188 VSFAQLLLGEP-TDVAARAVLSEEGVDLQTGALLSYGNDALASIHCSITGGTPNSASITG  246

Query:  242 TEGRLIIPH-FWKTTHAKLVRNDTSARTIQVDMVSDFEKEAYHVSQMILEGQRVSHIMTP  300
            +EGR+ +P+ F+   H  L R    + +D      +  H ++ ++   R     +P
Sbjct:  247 SEGRIDVPNGFFFPDHFVLHRTGRDPQEFRADPADGPRESLRHEAEEVMRALRAGETESP  306

Query:  301 QLTLSG                                                       306
             + L G
Sbjct:  307 LVPLDG                                                       312
```

Based on this analysis, it was predicted that this protein and its epitopes, could be useful antigens for vaccines or diagnostics.

EXAMPLE 227

A DNA sequence (GBSx0241) was identified in *S. agalactiae* <SEQ ID 721> which encodes the amino acid sequence <SEQ ID 722>. This protein is predicted to be valyl-tRNA synthetase (valS). Analysis of this protein sequence reveals the following:

```
Possible site: 36
>>> Seems to have no N-terminal signal sequence
    INTEGRAL    Likelihood = -0.00    Transmembrane  794-810 (794-810)

----- Final Results -----
              bacterial membrane --- Certainty = 0.1001(Affirmative) < succ>
              bacterial outside  --- Certainty = 0.0000(Not Clear)   < succ>
              bacterial cytoplasm --- Certainty = 0.0000(Not Clear)  < succ>
```

The protein has homology with the following sequences in the GENPEPT database:

```
>GP: AAA57558 GB: L08854 valyl-tRNA synthetase [Lactobacillus casei]
Identities = 543/881 (61%), Positives = 679/881 (76%), Gaps 12/881 (1%)

Query:   5 LSPKYNPAEVEEGRYQTWLDQDVFKPSGDTEAKPYSIVIPPPNVTGKLHLGHAWDTTLQD    64
           L+PKY+    VEEGRYQ WLD+DVFKPSGD +AKPYSIVIPPPNVTGKLH+GHAWDTTLQD
Sbjct:  27 LAPKYDHKAVEEGRYQEWLDEDVFKPSGDKKAKPYSIVIPPPNVTGKLHMGHAWDTTLQD    86

Query:  65 IIIRQKRMQGFDTLWLPGMDHAGIATQAKVEERLREQGISRYDLGREKFLDKVWEWKDEY   124
           I+IRQKR++GFDTLWLPGMDHAGIATQAKVE +LR++GISRYDLGREKF+ KVWEWKDE+
Sbjct:  87 IVIRQKRIEGFDTLWLPGMDHAGIATQAKVEAKLRKEGISRYDLGREKFVQKVWEWKDEF   146

Query: 125 AATIKSQWGKMGLSVDYSRERFTLDEGLSKAVRKVFVDLYNKGWIYRGEFIINWDPAART   184
           A TI  QW KMGLS+DYSRERFTLD+GL++AVR+VFVDLYN+G IYRGE+I+NWDP ART
Sbjct: 147 AKTIHGQWAKMGLSLDYSRERFTLDKGLNQAVRRVFVDLYNQGLIYRGEYIVNWDPQART   206

Query: 185 ALSDIEVIHKDVEGAFYHMNYMLEDGSRALEVATTRPETMFGDVAVAVNPEDARYKDLIG   244
           ALSDIEVIHKD +GAFYH+ Y  DGS +E+ATTRPETM GD AVAV+P D RYKD++G
Sbjct: 207 ALSDIEVIHKDDKGAFYHVKYPFADGSGYIEIATTRPETMMGDTAVAVHPGDERYKDMVG   266

Query: 245 QNVILPIINKPIPIVADEHADPEFGTGVVKITPAHDPNDFAVGQRHNLPQVNVMNDDGTM   304
            +ILP+ N+ IPI+ D + DPEFGTG VKITPAHDPNDF VG RH+L ++N MNDDGTM
Sbjct: 267 TELILPLANRKIPIIEDAYVDPEFGTGAVKITPAHDPNDFQVGNRHDLKRINTMNDDGTM   326

Query: 305 NELADEFNGMDRFEARKAVVAKLESLGNLVKIKKTTHSVGHSERTGVVVEPRLSTQWFVK   364
           NE A ++ GMDRFEARKA+VA L+  G L+K++   HSVGHSERTGV VE RLSTQWFVK
Sbjct: 327 NENAGKYQGMDRFEARKAMVADLDKAGLLLKVEPIVHSVGHSERTGVQVEARLSTQWFVK   386

Query: 365 MDQLAKNAI-ANQDTEDKVEFYPPRFNDTFMSWMENVHDWVISRQLWWGHQIPAWYN-VN   422
           M  LA+ AI A Q+ + KV F P RF  T++ WMEN+HDWVISRQLWWGHQIPAWYN
Sbjct: 387 MKPLAEAAIKAQQEPDKKVTFVPERFEHTYLQWMENIHDWVISRQLWWGHQIPAWYNKQT   446

Query: 423 GEMYVGEDAPEG-DGWTQDEDVLDTWFSSALWPFSTMGWPDTEAADFKRYFPTSTLVTGY   481
           GE YVG +AP+ + W QD DVLDTWFSSALWPFSTMGWP+T+A D+KRY PT TLVTGY
Sbjct: 447 GETYVGMEAPKDIENWKQDPDVLDTWFSSALWPFSTMGWPNTDAPDYKRYYPTDTLVTGY   506

Query: 482 DIIFFWVSRMIFQSLEFTGRQPFSNVLIHGLIRDEEGRKMSKSLGNGIDPMDVIEKYGAD   541
           DII FWV+RMIFQ L FT ++PF   LIHGL+RDE+GRKMSKSLGNGIDPMDVIEKYGAD
Sbjct: 507 DIIPFWVARMIFQGLHFTHQRPFQYTLIHGLMRDEQGRKMSKSLGNGIDPMDVIEKYGAD   566

Query: 542 ALRWFLSNGSAPGQDVRFSYEKMDASWNFINKIWNISRYILMNNEGLTLDQARENVEKVV   601
           ALRWFL G+ PGQD RFSY++++A+WNFINKIWNISR+++MN   L  Q  +
Sbjct: 567 ALRWFLITGNKPGQDTRFSYKQVEAAWNFINKIWNISRFVMMNLGDLDTPQQPD------   620

Query: 602 NSQVGNVTDRWILHNLNETVGKVTENFDKFEFGVAGHILYNFIWEEFANWYVELTKEVLY   661
           +++D+W+   LNET+ +V + +FEFG G  LYNF W   A+WYVE++KEVLY
Sbjct: 621 -PSTFDLSDKWLFAQLNETIKQVMDLSARFEFGEMGRTLYNFTWNVLADWYVEMSKEVLY   679

Query: 662 SDNEDEKVITRSVLLYTLDQILRLLHPINPFVTEEIF--GQYAEGSIVLASYPQVNATFE   719
           D+E K   R  L Y LDQILRLLHP+NPFV +++    +   SIV ASYP N  FE
Sbjct: 680 GDDEQAKAAKRVNLAYALDQILRLLHPVMPFVHGKLWLALPHTGKSIVTASYPVANTAFE   739

Query: 720 NQTAHKGVESLKDLIRSVRNSRAEVNVAPSKPITILVKTSDSELESFFKDNSNYIKRFTN   779
           N  A    ++++ LIR VR  R E       + ILVK +D L+ F+ N ++I RF N
Sbjct: 740 NADATSAMDAIIALIRGVRGIRKEAGAPLKTKVDILVKLTDPALKPIFEQNFDFIDRFVN   799

Query: 780 PETLEISSAIATPELAMSSVITGAEIFLPLADLLNVEEELARLEKELAKWQKELDNVGKK   839
            +  + + +A P++A S+VITGA IF+PL +L++++EE A+L K+  K ++E+  + KK
Sbjct: 800 SKAFTVGTDVAEPKMAGSAVITGATIFVPLNELIDLDEEKAKLTKDAKKLEQEIARIDKK   859

Query: 840 LSNERFVANAKPEVVQKEKDKQTDYQTKYDATIARIEEMKK                     880
           L+N+ F++ A  VV +++ K+D++  +T R+E++++
Sbjct: 860 LNNQGFLSKAPEAVVAEQRTKRSDFEDQLTSTKQRLEQLQR                     900
```

A related DNA sequence was identified in *S. pyogenes* <SEQ ID 723> which encodes the amino acid sequence <SEQ ID 724>. Analysis of this protein sequence reveals the following:

```
Possible site: 61
>>> Seems to have no N-terminal signal sequence

----- Final Results -----
            bacterial cytoplasm --- Certainty = 0.5062 (Affirmative) < succ>
             bacterial membrane --- Certainty = 0.0000 (Not Clear)  < succ>
              bacterial outside --- Certainty = 0.0000 (Not Clear)  < succ>
```

An alignment of the GAS and GBS proteins is shown below:

```
Identities = 782/878 (89%), Positives = 818/878 (93%)

Query:    4 ELSPKYNPAEVEEGRYQTWLDQDVFKPSGDTEAKPYSIVIPPPNVTGKLHLGHAWDTTLQ   63
            ELSPKYNPAEVE GRYQ WLD DVFKPSGD +AKPYSIVIPPPNVTGKLHLGHAWDTTLQ
Sbjct:    3 ELSPKYNPAEVEAGRYQKWLDADVFKPSGDQKAKPYSIVIPPPNVTGKLHLGHAWDTTLQ   62

Query:   64 DIIIRQKRMQGFDTLWLPGMDHAGIATQAKVEERLREQGISRYDLGREKFLDKVWEWKDE  123
            DIIIRQKRMQGFDTLWLPGMDHAGIATQAKVEERLREQGISRYDLGR+KFLDKVWEWKDE
Sbjct:   63 DIIIRQKRMQGFDTLWLPGMDHAGIATQAKVEERLREQGISRYDLGRDKFLDKVWEWKDE  122

Query:  124 YAATIKSQWGKMGLSVDYSRERFTLDEGLSKAVRKVFVDLYNKGWIYRGEFIINWDPAAR  183
            YA TIK QWGKMGLSVDYSRERFTLDEGLSKAVRKVFVDLY KGWIYRGEFIINWDPAAR
Sbjct:  123 YATTIKEQWGKMGLSVDYSRERFTLDEGLSKAVRKVFVDLYKKGWIYRGEFIINWDPAAR  182

Query:  184 TALSDIEVIHKDVEGAFYHMNYMLEDGSRALEVATTRPETMFGDVAVAVNPEDARYKDLI  243
            TALSDIEVIHKDVEGAFYHMNYMLEDGSRAL+VATTRPETMFGDVAVAVNPED RYKDLI
Sbjct:  183 TALSDIEVIHKDVEGAFYHMNYMLEDGSRALQVATTRPETMFGDVAVAVNPEDPRYKDLI  242

Query:  244 GQNVILPIINKPIPIVADEHADPEFGTGVVKITPAHDPNDFAVGQRHNLPQVNVMNDDGT  303
            G+NVILPI+NK IPIV DEHADPEFGTGVVKITPAHDPNDF VGQRHNLPQVNVMNDDGT
Sbjct:  243 GKNVILPIVNKLIPIVGDEHADPEFGTGVVKITPAHDPNDFEVGQRHNLPQVNVMNDDGT  302

Query:  304 MNELADEFNGMDRFEARKAVVAKLESLGNLVKIKKTTHSVGHSERTGVVVEPRLSTQWFV  363
            MNELA +F GMDRFEAR+A VAKLE LG LV I+K  HSVGHSER+G VVEPRLSTQWFV
Sbjct:  303 MNELAGDFAGMDRFEARQATVAKLEELGALVNIEKRVHSVGHSERSGAVVEPRLSTQWFV  362

Query:  364 KMDQLAKNAIANQDTEDKVEFYPPRFNDTFMSWMENVHDWVISRQLWWGHQIPAWYNVNG  423
            KMD+LAK A+ NQ+T+D+V+FYPPRFNDTF+ WMENVHDWVISRQLWWGHQIPAWYN  G
Sbjct:  363 KMDELAKQAMDNQETDDRVDFYPPRFNDTFLQWMENVHDWVISRQLWWGHQIPAWYNAEG  422

Query:  424 EMYVGEDAPEGDGWTQDEDVLDTWFSSALWPFSTMGWPDTEAADFKRYFPTSTLVTGYDI  483
            E+YVGE+APEGD WTQDEDVLDTWFSSALWPFSTMGWPDT+  DFKRYFPTSTLVTGYDI
Sbjct:  423 EIYVGEEAPEGDDWTQDEDVLDTWFSSALWPFSTMGWPDTDVEDFKRYFPTSTLVTGYDI  482

Query:  484 IFFWVSRMIFQSLEFTGRQPFSNVLIHGLIRDEEGRKMSKSLGNGIDPMDVIEKYGADAL  543
            IFFWVSRMIFQSLEFTGRQPF NVLIHGLIRDEEGRKMSKSLGNGIDPMDVIEKYGAD+L
Sbjct:  483 IFFWVSRMIFQSLEFTGRQPFQNVLIHGLIRDEEGRKMSKSLGNGIDPMDVIEKYGADSL  542

Query:  544 RWFLSNGSAPGQDVRFSYEKMDASWNFINKIWNISRYILMNNEGLTLDQARENVEKVVNS  603
            RWFLSNGSAPGQDVRFSYEKMDASWNFINKIWNISRYILMNNEGLTL+ A   NV KV  S
Sbjct:  543 RWFLSNGSAPGQDVRFSYEKMDASWNFINKIWNISRYILMNNEGLTLEDAESNVAKVAAS  602

Query:  604 QVGNVTDRWILHNLNETVGKVTENFDKFEFGVAGHILYNFIWEEFANWYVELTKEVLYSD  663
            + GNVTD+WILHNLNET+ KVTENFDKFEFGVAGHILYNFIWEEFANWYVELTKEVLYSD
Sbjct:  603 EAGNVTDQWILHNLNETIAKVTENFDKFEFGVAGHILYNFIWEEFANWYVELTKEVLYSD  662

Query:  664 NEDEKVITRSVLLYTLDQILRLLHPIMPFVTEEIFGQYAEGSIVLASYPQVNATFENQTA  723
            NE EKVITRSVLLYTLD+ILRLLHPIMPFVTEEI+ QYA+GSIV   YP V   FEN+ A
Sbjct:  663 NEAEKVITRSVLLYTLDKILRLLHPIMPFVTEEIYAQYAQGSIVTVDYPVVRPAFENEAA  722

Query:  724 HKGVESLKDLIRSVRNSRAEVNVAPSKPITILVKTSDSELESFFKDNSNYIKRFTNPETL  783
            HKGVESLKDLIR+VRN+RAEVNVAPSKPITILVKT+DSELE FF  N NYIK FTNPE L
Sbjct:  723 HKGVESLKDLIRAVRNARAEVNVAPSKPITILVKTADSELEDFFNSNINYIKCFTNPEKL  782

Query:  784 EISSAIATPELAMSSVITGAEIFLPLADLLNVEEELARLEKELAKWQKELDMVGKKLSNE  843
            EISSAIA PELAM+S+ITGAEI+LPLADLLNVEEELARL+KELAKWQKELDMVGKKL NE
Sbjct:  783 EISSAIAAPELAMTSIITGAEIYLPLADLLNVEEELARLDKELAKWQKELDMVGKKLGNE  842

Query:  844 RFVANAKPEVVQKEKDKQTDYQTKYDATIARIEMKKL                         881
            RFVANAKPEVVQKEKDKQ DYQ KYDAT  RI EMKK+
Sbjct:  843 RFVANAKPEVVQKEKDKQADYQAKYDATQERIAEMKKI                         880
```

Based on this analysis, it was predicted that these proteins and their epitopes could be useful antigens for vaccines or diagnostics.

EXAMPLE 228

A DNA sequence (GBSx0242) was identified in *S. agalactiae* <SEQ ID 725> which encodes the amino acid sequence <SEQ ID 726>. Analysis of this protein sequence reveals the following:

```
Possible site: 30
>>> Seems to have no N-terminal signal sequence

----- Final Results -----
            bacterial cytoplasm --- Certainty = 0.0669 (Affirmative) < succ>
             bacterial membrane --- Certainty = 0.0000 (Not Clear)   < succ>
              bacterial outside --- Certainty = 0.0000 (Not Clear)   < succ>
```

The protein has no significant homology with any sequences in the GENPEPT database.

A related DNA sequence was identified in *S. pyogenes* <SEQ ID 727> which encodes the amino acid sequence <SEQ ID 728>. Analysis of this protein sequence reveals the following:

```
Possible site: 57
>>> Seems to have a cleavable N-term signal seq.

----- Final Results -----
              bacterial outside --- Certainty = 0.3000(Affirmative) < succ>
             bacterial membrane --- Certainty = 0.0000(Not Clear)   < succ>
            bacterial cytoplasm --- Certainty = 0.0000(Not Clear)   < succ>
```

The protein has no significant homology with any sequences in the GENPEPT database.

An alignment of the GAS and GBS proteins is shown below:

```
Identities = 148/191 (77%), Positives = 165/191 (85%)

Query:  14 GEKKKMNIIIIGAQASGKMTIGQEIAKQTGMTLFHNHDSIDFVLRFMPWSPDSIALTESI    73
           G + KMN+IIIGAQASGKMTIGQE+A+QTGMTLFHNHDSIDFVLRFMPWS +S AL E I
Sbjct:   3 GAETKMNLIIIGAQASGKMTIGQEVARQTGMTLFHNHDSIDFVLRFMPWSQESTALIERI    62

Query:  74 RFKFFETFAKTGQEMIFTIVIDFNDSRDVVFLEKIQIVFQSHNQEVLFVELETELSERLK   133
           RF FFETFAKTGQ+MIFTIVIDFND  DV  LEKIQ VFQS++QEVLFVEL+T++ ERLK
Sbjct:  63 RFAFFETFAKTGQDMIFTIVIDFNDPNDVAMLEKIQAVFQSYDQEVLFVELKTDIEERLK   122

Query: 134 RNRTENRLKHKPSKRDIKWSESDICSTMDYAIFNPEVAPEALTYYHKINNTCLTATETAY   193
           RNRTENRLKHKP KR+I+WSE DI STM YA+FNPE  P+ LT+Y KINNT LTA ETA
Sbjct: 123 RNRTENRLKHKPLKRNIEWSEQDIQSTMAYAVFNPEEPPKTLTHYQKINNTQLTAAETAQ   182

Query: 194 LIIQKINQIKE                                                   204
           LIIQK+  IKE
Sbjct: 183 LIIQKMTHIKE                                                   193
```

Based on this analysis, it was predicted that these proteins and their epitopes could be useful antigens for vaccines or diagnostics.

EXAMPLE 229

A DNA sequence (GBSx0243) was identified in *S. agalactiae* <SEQ ID 729> which encodes the amino acid sequence <SEQ ID 730>. Analysis of this protein sequence reveals the following:

```
Possible site: 49
>>> Seems to have no N-terminal signal sequence

----- Final Results -----
            bacterial cytoplasm --- Certainty = 0.3614(Affirmative) < succ>
```

```
                  bacterial membrane --- Certainty = 0.0000(Not Clear) < succ>
                  bacterial outside  --- Certainty = 0.0000(Not Clear) < succ>
```

The protein has homology with the following sequences in the GENPEPT database:

```
>GP: BAB04556 GB: AP001510 unknown conserved protein
[Bacillus halodurans]
Identities = 60/189 (31%), Positives = 102/189 (53%), Gaps = 3/189 (1%)

Query:    7 EIVDNQLPVVETNRLLLRQRKLEDAKEIFEFVKLDEVSYPAGFPAVKSLEEEITYIQEIY    66
            E +    LP +ET RL LR+    +DA  I+++    ++V+     +   +S+++   ++      +
Sbjct:    4 EDIYGDLPTLETERLRLRKFYKDDAAAIYDYASNEQVTKYVLWETHQSIKDSEAFLA--F    61

Query:   67 PTNLEKEKLPSGYAITLKGDDKVIGSVDFNH-RHEDDIFEIGYLLHPDYWGQGIVPEAAS   125
            N     EK   S +AI LK ++++IG+VDF    + +D     E+GY+L    YWGQGI+ EA +
Sbjct:   62 ALNKYDEKDVSPWAIELKRNERMIGTVDFVWWKPKDKTAELGYVLSEPYWGQGIMTEAVN   121

Query:  126 ALVEIGFTLLGLHKIELGCYDYNKQSQAVARKLGFTLEANIRDRRDAQGKRCGDMRFGLL   185
            ALVE GF  + L +I+  C+  N   S  V KG     E    R       +G          + ++
Sbjct:  122 ALVEFGFNNMELERIQAKCFAENISSARVMEKAGLIYEGTHRRAIYVKGAHRDFKVYAII   181

Query:  186 RSEWEKKRR                                                    194
            R ++E+K +
Sbjct:  182 REDYEQKHQ                                                    190
```

A related DNA sequence was identified in *S. pyogenes* <SEQ ID 731> which encodes the amino acid sequence <SEQ ID 732>. Analysis of this protein sequence reveals the following:

```
Possible site: 30
>>> Seems to have no N-terminal signal sequence

----- Final Results -----
                  bacterial cytoplasm --- Certainty = 0.1864(Affirmative) < succ>
                  bacterial membrane  --- Certainty = 0.0000(Not Clear)   < succ>
                  bacterial outside   --- Certainty = 0.0000(Not Clear)   < succ>
```

An alignment of the GAS and GBS proteins is shown below:

```
Identities = 50/58 (86%), Positives = 56/58 (96%)

Query:  137 LHKIELGCYDYNKQSQAVARKLGFTLEANIRDRRDAQGKRCGDMRFGLLRSEWEKKRR   194
            LHKIELGCYDYNKQSQAVARKLGFTLEAN RDR+D QG+RCGDMRFGLLRSEWE++++
Sbjct:    1 LHKIELGCYDYNKQSQAVARKLGFTLEANARDRKDVQGRRCGDMRFGLLRSEWEEQKQ    58
```

Based on this analysis, it was predicted that these proteins and their epitopes could be useful antigens for vaccines or diagnostics.

EXAMPLE 230

A DNA sequence (GBSx0244) was identified in *S. agalactiae* <SEQ ID 733> which encodes the amino acid sequence <SEQ ID 734>. This protein is predicted to be ribosomal-protein-alanine N-acetyltransferase. Analysis of this protein sequence reveals the following:

```
Possible site: 54
>>> Seems to have no N-terminal signal sequence

----- Final Results -----
                  bacterial cytoplasm --- Certainty = 0.4066(Affirmative) < succ>
                  bacterial membrane  --- Certainty = 0.0000(Not Clear)   < succ>
                  bacterial outside   --- Certainty = 0.0000(Not Clear)   < succ>
```

A related GBS nucleic acid sequence <SEQ ID 9599> which encodes amino acid sequence <SEQ ID 9600> was also identified.

The protein has homology with the following sequences in the GENPEPT database:

```
>GP: BAB04418 GB: AP001509 ribosomal-protein-alanine
N-acetyltransferase [Bacillus halodurans]
Identities = 63/185 (34%), Positives = 95/185 (51%), Gaps = 11/185 (5%)

Query:   53 KALPKLETDRLILRQRTVGDVPAMFDYVCLEEVAYPAGLSPIASLEDEYDYFENRYYQNL   112
             K  P LET RLILR+ T  D  ++  Y+  +EV     GL P  +LED     E  +Y+++
Sbjct:    6 KRFPILETKRLILRKITTDDARSILSYLSDKEVMKYFGLEPFQTLEDALG--EIAWYESI    63

Query:  113 EKAKLPSGYGITVKGSDRIIGSCAFN-----HRHEDDVFEICYLLHPDYWGHGYMTEAVA   167
              +        +GIT+KG D +IGSC F+      H    + FE+   L    YWG G  +EA+
Sbjct:   64 LHEQTGIRWGITLKGQDEVIGSCGFHQWVPKHHRAEIGFELSKL----YWGQGIASEAIR   119

Query:  168 ALIEVGFTLLNLHKIEIRCYDYNKQSRRVAEKLGFTLEATIRDRKDNQDNRCVNLIYGLL   227
              A+I+ GF  L L +I+       N  S+R+ EK GF  E  +R  +             +Y LL
Sbjct:  120 AVIQYGFEHLELQRIQALIEPPNIPSQRLVEKQGFISEGLLRSYEYTCGKFDDLYMYSLL   179

Query:  228 RSEWE                                                          232
              +  +++
Sbjct:  180 KRDFD                                                          184
```

There is also homology to SEQ ID 732:

```
Identities = 39/54 (72%), Positives = 44/54 (81%)

Query:  179 LHKIEIRCYDYNKQSRRVAEKLGFTLEATIRDRKDNQDNRCVNLIYGLLRSEWE   232
             LHKIE+ CYDYNKQS+ VA KLGFTLEA  RDRKD Q  RC ++ +GLLRSEWE
Sbjct:    1 LHKIELGCYDYNKQSQAVARKLGFTLEANARDRKDVQGRRCGDMRFGLLRSEWE    54
```

Based on this analysis, it was predicted that these proteins and their epitopes could be useful antigens for vaccines or diagnostics.

EXAMPLE 231

A DNA sequence (GBSx0245) was identified in *S. agalactiae* <SEQ ID 735> which encodes the amino acid sequence <SEQ ID 736>. Analysis of this protein sequence reveals the following:

```
Possible site: 51
>>> Seems to have no N-terminal signal sequence

----- Final Results -----
            bacterial cytoplasm --- Certainty = 0.2719(Affirmative) < succ>
            bacterial membrane  --- Certainty = 0.0000(Not Clear)  < succ>
             bacterial outside  --- Certainty = 0.0000(Not Clear)  < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 232

A DNA sequence (GBSx0246) was identified in *S. agalactiae* <SEQ ID 737> which encodes the amino acid sequence <SEQ ID 738>. Analysis of this protein sequence reveals the following:

```
Possible site: 53
>>> Seems to have no N-terminal signal sequence
```

```
----- Final Results -----
            bacterial cytoplasm --- Certainty = 0.3250(Affirmative) < succ>
            bacterial membrane  --- Certainty = 0.0000(Not Clear)   < succ>
            bacterial outside   --- Certainty = 0.0000(Not Clear)   < succ>
```

A related GBS nucleic acid sequence <SEQ ID 9597> which encodes amino acid sequence <SEQ ID 9598> was also identified.

The protein has no significant homology with any sequences in the GENPEPT database.

A related DNA sequence was identified in *S. pyogenes* <SEQ ID 739> which encodes the amino acid sequence <SEQ ID 740>. Analysis of this protein sequence reveals the following:

```
Possible site: 38
>>> Seems to have no N-terminal signal sequence

----- Final Results -----
            bacterial cytoplasm --- Certainty = 0.3293(Affirmative) < succ>
            bacterial membrane  --- Certainty = 0.0000(Not Clear)   < succ>
            bacterial outside   --- Certainty = 0.0000(Not Clear)   < succ>
```

An alignment of the GAS and GBS proteins is shown below:

```
Identities = 24/55 (43%), Positives = 38/55 (68%)

Query:  56 LLEGLTANKQDVLKEAGLVSLEAFAKVSEADVLALKGIGPAAIKQLVDNGVVFAK  110
           ++ G+ ++  + L   G+ S +AF + +E D+LALKGIGPA +K+LV+NG  F K
Sbjct:  77 VVAGIRSDLVETLYAEGIHSAQAFKEWTEKDLLALKGIGPATVKKLVENGASFKK  131
```

Based on this analysis, it was predicted that these proteins and their epitopes could be useful antigens for vaccines or diagnostics.

EXAMPLE 233

A DNA sequence (GBSx0247) was identified in *S. agalactiae* <SEQ ID 741> which encodes the amino acid sequence <SEQ ID 742>. Analysis of this protein sequence reveals the following:

```
Possible site: 25
>>> Seems to have no N-terminal signal sequence

----- Final Results -----
            bacterial cytoplasm --- Certainty = 0.2901(Affirmative) < succ>
            bacterial membrane  --- Certainty = 0.0000(Not Clear)   < succ>
            bacterial outside   --- Certainty = 0.0000(Not Clear)   < succ>
```

The protein has no significant homology with any sequences in the GENPEPT database.

A related DNA sequence was identified in *S. pyogenes* <SEQ ID 743> which encodes the amino acid sequence <SEQ ID 744>. Analysis of this protein sequence reveals the following:

```
Possible site: 27
>>> Seems to have no N-terminal signal sequence

----- Final Results -----
            bacterial cytoplasm --- Certainty = 0.2536(Affirmative) < succ>
            bacterial membrane  --- Certainty = 0.0000(Not Clear)   < succ>
            bacterial outside   --- Certainty = 0.0000(Not Clear)   < succ>
```

An alignment of the GAS and GBS proteins is shown below:

```
Identities = 57/84 (67%), Positives = 73/84 (86%)

Query:   1 MSYEQEFLKDFEEWLQSQISINQMAMDSAKKVLEEDKDERAADAYIRYESKLDAYRFLQG   60
           MSYE+EFLKDFE+W+++QI +NQ+AM ++++V +ED DERA DA+IRYESKLDAY FL G
Sbjct:   1 MSYEKEFLKDFEDWVKTQIQVNQLAMATSQEVAQEDGDERAKDAFIRYESKLDAYEFLLG   60

Query:  61 KFNNYHNQKSFHDLPDGLFGQRHY                                      84
           KF+NY N K+FHD+PD LFG RHY
Sbjct:  61 KFDNYKNGKAFHDIPDELFGARHY                                      84
```

Based on this analysis, it was predicted that these proteins and their epitopes could be useful antigens for vaccines or diagnostics.

EXAMPLE 234

A DNA sequence (GBSx0248) was identified in *S. agalactiae* <SEQ ID 745> which encodes the amino acid sequence <SEQ ID 746>. This protein is predicted to be methyltransferase. Analysis of this protein sequence reveals the following:

```
Possible site: 61
>>> Seems to have no N-terminal signal sequence

----- Final Results -----
         bacterial cytoplasm --- Certainty = 0.2469(Affirmative) < succ>
         bacterial membrane  --- Certainty = 0.0000(Not Clear)   < succ>
         bacterial outside   --- Certainty = 0.0000(Not Clear)   < succ>
```

A related DNA sequence was identified in *S. pyogenes* <SEQ ID 747> which encodes the amino acid sequence <SEQ ID 748>. Analysis of this protein sequence reveals the following:

```
Possible site: 35
>>> Seems to have no N-terminal signal sequence

----- Final Results -----
         bacterial cytoplasm --- Certainty = 0.3352(Affirmative) < succ>
         bacterial membrane  --- Certainty = 0.0000(Not Clear)   < succ>
         bacterial outside   --- Certainty = 0.0000(Not Clear)   < succ>
```

An alignment of the GAS and GBS proteins is shown below:

```
Identities = 26/60 (43%), Positives = 37/60 (61%)

Query:  23 LKNERCPHPKLINVLERKLEIILGDQKHILEKDSLISLSPQETHHLRAIENSKFLQIELD    82
           +  E  P  K+I VLE +L   L DQK +L ++SLI++  Q+ HHL A  + K LQ+ LD
Sbjct:  42 ISQETSPRDKVILVLEGQLIFDLEDQKQVLTQESLIAIPAQKVHHLEAKTDCKLLQVLLD   101
```

Based on this analysis, it was predicted that these proteins and their epitopes could be useful antigens for vaccines or diagnostics.

EXAMPLE 235

A DNA sequence (GBSx0249) was identified in *S. agalactiae* <SEQ ID 749> which encodes the amino acid sequence <SEQ ID 750>. This protein is predicted to be integrase (codV). Analysis of this protein sequence reveals the following:

```
Possible site: 59
>>> Seems to have no N-terminal signal sequence
```

```
----- Final Results -----
        bacterial cytoplasm --- Certainty = 0.3842(Affirmative) < succ>
          bacterial membrane --- Certainty = 0.0000(Not Clear)  < succ>
           bacterial outside --- Certainty = 0.0000(Not Clear)  < succ>
```

No corresponding DNA sequence was identified in *S. pyogenes*.

Based on this analysis, it was predicted that this protein and its epitopes, could be useful antigens for vaccines or diagnostics.

EXAMPLE 236

A DNA sequence (GBSx0250) was identified in *S. agalactiae* <SEQ ID 751> which encodes the amino acid sequence <SEQ ID 752>. Analysis of this protein sequence reveals the following:

```
Possible site: 22
>>> May be a lipoprotein

----- Final Results -----
       bacterial membrane --- Certainty = 0.0000 (Not Clear)   <succ>
        bacterial outside --- Certainty = 0.0000 (Not Clear)   <succ>
      bacterial cytoplasm --- Certainty = 0.0000 (Not Clear)   <succ>
```

The protein has no significant homology with any sequences in the GENPEPT database.

No corresponding DNA sequence was identified in *S. pyogenes*.

Figure 23:
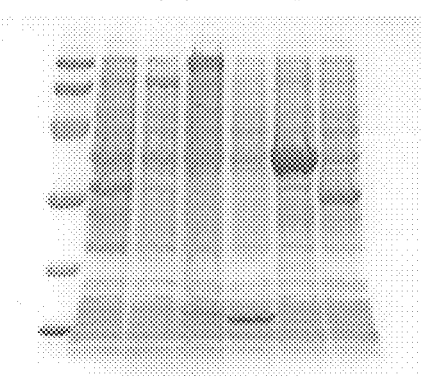
Figure 32:
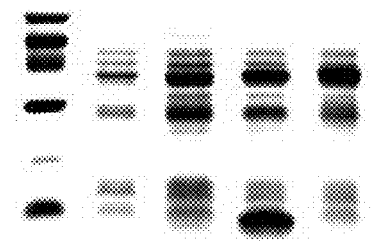

SEQ ID 752 (GBS128) was expressed in *E. coli* as a His-fusion product. SDS-PAGE analysis of total cell extract is shown in FIG. 23 (lane 5; MW 15 kDa). It was also expressed in *E. coli* as a GST-fusion product. SDS-PAGE analysis of total cell extract is shown in FIG. 32 (lane 4; 2 bands).

Figure 288:
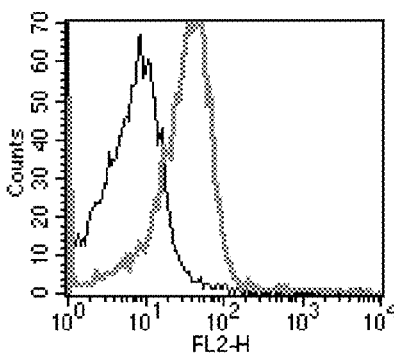

The GBS128-GST fusion product was purified (FIG. 198, lane 2) and used to immunise mice. The resulting antiserum was used for FACS (FIG. 288), which confirmed that the protein is immunoaccessible on GBS bacteria.

Based on this analysis, it was predicted that this protein and its epitopes, could be useful antigens for vaccines or diagnostics.

EXAMPLE 237

A DNA sequence (GBSx0251) was identified in *S. agalactiae* <SEQ ID 753> which encodes the amino acid sequence <SEQ ID 754>. Analysis of this protein sequence reveals the following:

```
Possible site: 30
>>> Seems to have no N-terminal signal sequence

----- Final Results -----
      bacterial cytoplasm --- Certainty = 0.2940 (Affirmative) <succ>
       bacterial membrane --- Certainty = 0.0000 (Not Clear)   <succ>
        bacterial outside --- Certainty = 0.0000 (Not Clear)   <succ>
```

The protein has no significant homology with any sequences in the GENPEPT database.

A related DNA sequence was identified in *S. pyogenes* <SEQ ID 755> which encodes the amino acid sequence <SEQ ID 756>. Analysis of this protein sequence reveals the following:

```
Possible site: 42
>>> Seems to have no N-terminal signal sequence
```

```
----- Final Results -----
      bacterial cytoplasm --- Certainty = 0.2518 (Affirmative) <succ>
       bacterial membrane --- Certainty = 0.0000 (Not Clear)   <succ>
        bacterial outside --- Certainty = 0.0000 (Not Clear)   <succ>
```

An alignment of the GAS and GBS proteins is shown below:

```
Identities = 30/90 (33%), Positives = 49/90 (54%), Gaps = 10/90 (11%)

Query:   3 TVAVRVDDQLKDDATELFQSLGLDMSTAVKMFLIQSVKTQSIPFEIK--------NKSSV    54
           T+ +RVDD +K  A ++ + LG+ MSTA+ MFL Q + T  IPF++        N   +
Sbjct:  15 TLNLRVDDSVKSAADDILKRLGIPMSTAIDMFLNQIILTGGIPFDVSLPEAPQRVNVDYM    74

Query:  55 SDEEFQNLVETKLKGIRVKASDPESVNAFF                                  84
           S E+F + + T  +    K  +P+ V  F+
Sbjct:  75 SQEKFYDKLITSFED--AKTCNPQDVGKFY                                 102
```

Based on this analysis, it was predicted that these proteins and their epitopes could be useful antigens for vaccines or diagnostics.

EXAMPLE 238

A DNA sequence (GBSx0252) was identified in *S. agalactiae* <SEQ ID 757> which encodes the amino acid sequence <SEQ ID 758>. This protein is predicted to be surface protein Rib. Analysis of this protein sequence reveals the following:

```
Possible site: 24
>>> Seems to have no N-terminal signal sequence
INTEGRAL    Likelihood = -2.81   Transmembrane 370-386 (368-388)

----- Final Results -----
       bacterial membrane --- Certainty = 0.2126 (Affirmative) <succ>
        bacterial outside --- Certainty = 0.0000 (Not Clear)   <succ>
            bacterial cytoplasm --- Certainty = 0.0000 (Not Clear)   <succ>
```

A related GBS nucleic acid sequence <SEQ ID 9593> which encodes amino acid sequence <SEQ ID 9594> was also identified. A related GBS nucleic acid sequence <SEQ ID 10773> which encodes amino acid sequence <SEQ ID 10774> was also identified.

A related DNA sequence was identified in *S. pyogenes* <SEQ ID 759> which encodes the amino acid sequence <SEQ ID 760>. Analysis of this protein sequence reveals the following:

```
Possible site: 37
>>> Seems to have a cleavable N-term signal seq.
INTEGRAL    Likelihood = -4.57   Transmembrane 354-370 (353-371)

----- Final Results -----
       bacterial membrane --- Certainty = 0.2826 (Affirmative) <succ>
        bacterial outside --- Certainty = 0.0000 (Not Clear)   <succ>
      bacterial cytoplasm --- Certainty = 0.0000 (Not Clear)   <succ>

LPXTG motif: 344-348
```

An alignment of the GAS and GBS proteins is shown below:

```
Identities = 64/277 (23%), Positives = 99/277 (35%), Gaps = 31/277 (11%)

Query: 126 SIGNLPDLPKGTTVAFETPVDTATPGDKPAKVVVTYPDGSKDTVDVTKVVDPRTDADKN   185
           ++ +LP   + TT   E PV         + V       + D+ + T    P    A
Sbjct: 121 AVKDLPASTESTTQPVEAPVQETQASASDSMVTGDSTVTTDSPEETPSSESPVAPALSE   180

Query: 186 DPAGKDQQVNVGETPKAEDSIGNLPDLPKGTTVAFETPVDTATPGDKPAKVVVTYPDGSK   245
```

```
                PA     Q    E P    S    P      T    A ETP + A P    P    +    S+
Sbjct: 181 APA----QPAESEEPSVAASSEETPS--PSTPAAPETPEEPAAPSPSPESEEPSVAAPSE  234

Query: 246 DTVDVTVKVVDPRTDADKNDPAGKDQQVNVGETPKAEDSIGNLPDLPKGTTVAFETPVDT  305
           +T            P    A   + PA  ++       T    +         P    P    +    +TP
Sbjct: 235 ETPSPET----PEEPAAPSQPAESEESSVAATTSPS-------PSTPAESET--QTPPAV  281

Query: 306 ATPGDKPAKVVVTYPDGSKDTVDVTVKVVDPRTDADK---------NDPAGKDQQVNGK  355
              DKP+             P    S    + TV+    +    +DK              N    +    + +
Sbjct: 282 TKDSDKPSSAAEK-PAASSLVSEQTVQQPTSKRSSDKKEEQEQSYSPNRSLSRQVRAHES  340

Query: 356 GNKLPATGENATPFFNVVALTIMSSVGLLSVSKKKED                         392
           G   LP+TGE A P F +    +T+MS   G L V+K++++
Sbjct: 341 GKYLPSTGEKAQPLF-IATMTLMSLFGSLLVTKRQKE                         376
```

Based on this analysis, it was predicted that these proteins and their epitopes could be useful antigens for vaccines or diagnostics.

EXAMPLE 239

A DNA sequence (GBSx0253) was identified in *S. agalactiae* <SEQ ID 761> which encodes the amino acid sequence <SEQ ID 762>. This protein is predicted to be surface protein Rib. Analysis of this protein sequence reveals the following:

```
Possible site: 49
>>> Seems to have no N-terminal signal sequence

----- Final Results -----
      bacterial cytoplasm --- Certainty = 0.5289 (Affirmative) <succ>
       bacterial membrane --- Certainty = 0.0000 (Not Clear)   <succ>
        bacterial outside --- Certainty = 0.0000 (Not Clear)   <succ>
```

Based on this analysis, it was predicted that this protein and its epitopes, could be useful antigens for vaccines or diagnostics.

EXAMPLE 240

A DNA sequence (GBSx0254) was identified in *S. agalactiae* <SEQ ID 763> which encodes the amino acid sequence <SEQ ID 764>. This protein is predicted to be surface protein Rib. Analysis of this protein sequence reveals the following:

```
Possible site: 53
>>> Seems to have no N-terminal signal sequence
INTEGRAL    Likelihood = -1.06    Transmembrane 39-55 (39-55)

----- Final Results -----
       bacterial membrane --- Certainty = 0.1426 (Affirmative) <succ>
        bacterial outside --- Certainty = 0.0000 (Not Clear)   <succ>
      bacterial cytoplasm --- Certainty = 0.0000 (Not Clear)   <succ>
```

A related GBS nucleic acid sequence <SEQ ID 9591> which encodes amino acid sequence <SEQ ID 9592> was also identified.

The protein differs significantly from U58333 in several places:

```
Query: 157 TKPDGQVDIVNVSLTIYNSSALRDKIDEVKK----------KAED-----PKWDEGSRDK  201
           T PDG  D V+V++ + +      DK D    K               KAED      P    +G+
Sbjct: 683 TYPDGSKDTVDVTVKVVDPRTDADKNDPAGKDQQVNVGETPKAEDSIGNLPDLPKGTTVA  742

Query: 202 VLISLDDIKTDIDNNPK---TQSDIANKITEVTNLEKILVPRIPDADKNDPAGKDQQVNV  258
                +D    T    D    K         T    D +      +VT    K++ PR   DADKNDPAGKDQQVNV
Sbjct: 743 FETPVDTA-TPGDKPAKVVVTYPDGSKDTVDVT--VKVVDPRT-DADKNDPAGKDQQVNV  798

Query: 157 TKPDGQVDIVNVSLTIYNSSALRDKIDEVKK----------KAED-----PKWDEGSRDK  201
           T PDG  D V+V++ + +      DK D    K               KAED      P    +G+
Sbjct: 841 TYPDGSKDTVDVTVKVVDPRTDADKNDPAGKDQQVNVGETPKAEDSIGNLPDLPKGTTVA  900
```

```
-continued

Query:  202 VLISLDDIKTDIDNNPK---TQSDIANKITEVTNLEKILVPRIPDADKNDPAGKDQQVNV  258
            +D   T  D  K    T  D +     +VT   K++ PR DADKNDPAGKDQQVNV
Sbjct:  901 FETPVDTA-TPGDKPAKVVVTYPDGSKDTVDVT--VKVVDPRT-DADKNDPAGKDQQVNV  956

Query:  157 TKPDGQVDIVNVSLTIYNSSALRDKIDEVKK---------KAED-----PKWDEGSRDK  201
            T PDG  D V+V++ + +      DK D   K            KAED      P   +G+
Sbjct:  288 TYPDGSKDTVDVTVKVVDPRTDADKNDPAGKDQQVNVGETPKAEDSIGNLPDLPKGTTVA  347

Query:  202 VLISLDDIKTDIDNNPK---TQSDIANKITEVTNLEKILVPRIPDADKNDPAGKDQQVNV  258
            +D   T  D  K    T  D +     +VT   K++ PR DADKNDPAGKDQQVNV
Sbjct:  348 FETPVDTA-TPGDKPAKVVVTYPDGSKDTVDVT--VKVVDPRT-DADKNDPAGKDQQVNV  403

Query:  157 TKPDGQVDIVNVSLTIYNSSALRDKIDEVKK---------KAED-----PKWDEGSRDK  201
            T PDG  D V+V++ + +      DK D   K            KAED      P   +G+
Sbjct:  604 TYPDGSKDTVDVTVKVVDPRTDADKNDPAGKDQQVNVGETPKAEDSIGNLPDLPKGTTVA  663

Query:  202 VLISLDDIKTDIDNNPK---TQSDIANKITEVTNLEKILVPRIPDADKNDPAGKDQQVNV  258
            +D   T  D  K    T  D +     +VT   K++ PR DADKNDPAGKDQQVNV
Sbjct:  664 FETPVDTA-TPGDKPAKVVVTYPDGSKDTVDVT--VKVVDPRT-DADKNDPAGKDQQVNV  719

Query:  157 TKPDGQVDIVNVSLTIYNSSALRDKIDEVKK---------KAED-----PKWDEGSRDK  201
            T PDG  D V+V++ + +      DK D   K            KAED      P   +G+
Sbjct:  446 TYPDGSKDTVDVTVKVVDPRTDADKNDPAGKDQQVNVGETPKAEDSIGNLPDLPKGTTVA  505

Query:  202 VLISLDDIKTDIDNNPK---TQSDIANKITEVTNLEKILVPRIPDADKNDPAGKDQQVNV  258
            +D   T  D  K    T  D +     +VT   K++ PR DADKNDPAGKDQQVNV
Sbjct:  506 FETPVDTA-TPGDKPAKVVVTYPDGSKDTVDVT--VKVVDPRT-DADKNDPAGKDQQVNV  561

Query:  157 TKPDGQVDIVNVSLTIYNSSALRDKIDEVKK---------KAED-----PKWDEGSRDK  201
            T PDG  D V+V++ + +      DK D   K            KAED      P   +G+
Sbjct:  920 TYPDGSKDTVDVTVKVVDPRTDADKNDPAGKDQQVNVGETPKAEDSIGNLPDLPKGTTVA  979

Query:  202 VLISLDDIKTDIDNNPK---TQSDIANKITEVTNLEKILVPRIPDADKNDPAGKDQQVNV  258
            +D   T  D  K    T  D +     +VT   K++ PR DADKNDPAGKDQQVNV
Sbjct:  980 FETPVDTA-TPGDKPAKVVVTYPDGSKDTVDVT--VKVVDPRT-DADKNDPAGKDQQVNV  1035
```

No corresponding DNA sequence was identified in S. pyogenes.

Based on this analysis, it was predicted that these proteins and their epitopes could be useful antigens for vaccines or diagnostics.

EXAMPLE 241

A DNA sequence (GBSx0255) was identified in S. agalactiae <SEQ ID 765> which encodes the amino acid sequence <SEQ ID 766>. This protein is predicted to be ara-C-like activator. Analysis of this protein sequence reveals the following:

```
Possible site: 30
>>> Seems to have no N-terminal signal sequence
    INTEGRAL      Likelihood = -0.37      Transmembrane      8-24 (8-25)

----- Final Results -----
            bacterial membrane --- Certainty = 0.1150(Affirmative) < succ>
             bacterial outside --- Certainty = 0.0000(Not Clear)   < succ>
            bacterial cytoplasm --- Certainty = 0.0000(Not Clear)   < succ>
```

A related GBS nucleic acid sequence <SEQ ID 9589> which encodes amino acid sequence <SEQ ID 9590> was also identified.

There is homology to SEQ ID 460.

Based on this analysis, it was predicted that these proteins and their epitopes could be useful antigens for vaccines or diagnostics.

EXAMPLE 242

A DNA sequence (GBSx0256) was identified in S. agalactiae <SEQ ID 767> which encodes the amino acid sequence <SEQ ID 768>. Analysis of this protein sequence reveals the following:

```
Possible site: 53
>>> Seems to have no N-terminal signal sequence

----- Final Results -----
            bacterial cytoplasm --- Certainty = 0.1200(Affirmative) < succ>
             bacterial membrane --- Certainty = 0.0000(Not Clear)   < succ>
              bacterial outside --- Certainty = 0.0000(Not Clear)   < succ>
```

A related GBS nucleic acid sequence <SEQ ID 9587> which encodes amino acid sequence <SEQ ID 9588> was also identified.

A related DNA sequence was identified in *S. pyogenes* <SEQ ID 769> which encodes the amino acid sequence <SEQ ID 770>. Analysis of this protein sequence reveals the following:

```
Possible site: 50
>>> Seems to have no N-terminal signal sequence

----- Final Results -----
      bacterial cytoplasm --- Certainty = 0.0679 (Affirmative) < succ>
      bacterial membrane --- Certainty = 0.0000 (Not Clear)    < succ>
      bacterial outside  --- Certainty = 0.0000 (Not Clear)    < succ>
```

An alignment of the GAS and GBS proteins is shown below:

```
Identities = 135/176 (76%), Positives = 161/176 (90%)

Query:   1 MSYMVKDRQIQKTKVAIYNAFISLLQENDYSKITVQDVIGLANVGRSTFYSHYESKEVLL    60
           +S M KDRQI+KTK AIY+AFI+LLQ+ +YSKITV+D+I LANVGRSTFY+HYESKE+LL
Sbjct:   1 VSDMTKDRQIKKTKTAIYSAFIALLQKKEYSKITVRDMITLANVGRSTFYAHYESKEMLL    60

Query:  61 KELCEDLFHHLFKQGRDVTFEEYLVHILKHFEQNQDSIATLLLSDDPYFLLRFRSELEHD   120
           KELCE+LFHHLF+Q R+VTFE+YLVHILKHFEQN+DSIATLLLS+DPYFLLRF++ELEHD
Sbjct:  61 KELCEELFHHLFRQKRNVTFEDYLVHILKHFEQNKDSIATLLLSNDPYFLLRFKNELEHD   120

Query: 121 VYPRLREEYITKVDIPEDFLKQFLLSSFIETLKWWLHQRQKMTVEDLLKYYLTMVE      176
           VYP LR +YI K  IPE FLKQF+LSSFIETLKWWLHQRQ+M+  +LLKYYL +++
Sbjct: 121 VYPNLRCKYIDKTTIPEVFLKQFVLSSFIETLKWWLHQRQRMSANELLKYYLELIK      176
```

Based on this analysis, it was predicted that these proteins and their epitopes could be useful antigens for vaccines or diagnostics.

EXAMPLE 243

A DNA sequence (GBSx0257) was identified in *S. agalactiae* <SEQ ID 771> which encodes the amino acid sequence <SEQ ID 772>. Analysis of this protein sequence reveals the following:

```
Possible site: 29
>>> Seems to have no N-terminal signal sequence

----- Final Results -----
         bacterial cytoplasm --- Certainty = 0.3573 (Affirmative) < succ>
          bacterial membrane --- Certainty = 0.0000 (Not Clear)   < succ>
          bacterial outside  --- Certainty = 0.0000 (Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 244

A DNA sequence (GBSx0258) was identified in *S. agalactiae* <SEQ ID 773> which encodes the amino acid sequence <SEQ ID 774>. Analysis of this protein sequence reveals the following:

```
Possible site: 35
>>> Seems to have a cleavable N-term signal seq.
INTEGRAL Likelihood = -10.19  Transmembrane 112-128 (107-131)
INTEGRAL Likelihood =  -8.07  Transmembrane  77-93  (71-97)
INTEGRAL Likelihood =  -6.10  Transmembrane 144-160 (138-165)
INTEGRAL Likelihood =  -3.03  Transmembrane 165-181 (164-182)

----- Final Results -----
      bacterial membrane --- Certainty = 0.5076 (Affirmative) < succ>
       bacterial outside --- Certainty = 0.0000 (Not Clear)  < succ>
      bacterial cytoplasm --- Certainty = 0.0000 (Not Clear)  < succ>
```

A related DNA sequence was identified in *S. pyogenes* <SEQ ID 775> which encodes the amino acid sequence <SEQ ID 776>. Analysis of this protein sequence reveals the following:

```
Possible site: 35
>>> Seems to have an uncleavable N-term signal seq
INTEGRAL Likelihood = -9.13 Transmembrane 112-128 (107-130)
INTEGRAL Likelihood = -5.89 Transmembrane 144-160 (138-163)
INTEGRAL Likelihood = -5.47 Transmembrane   7-23  (6-29)
INTEGRAL Likelihood = -3.50 Transmembrane  77-93  (74-94)
INTEGRAL Likelihood = -2.07 Transmembrane 166-182 (165-183)

----- Final Results -----
      bacterial membrane --- Certainty = 0.4652 (Affirmative) < succ>
       bacterial outside --- Certainty = 0.0000 (Not Clear)  < succ>
      bacterial cytoplasm --- Certainty = 0.0000 (Not Clear)  < succ>
```

An alignment of the GAS and GBS proteins is shown below:

```
Identities = 212/287 (73%), Positives = 245/287 (84%)

Query:   1 MTSNKKVAIAFILNISFSVLEFIFGSLFFSGAILADAVHDFGDAIAIGISATLEKKSKKD   60
           M ++KKV I FILN+SFS++EFIFG+LFFSGAILADAVHDFGDAIAIGISA LE+K+ K
Sbjct:   1 MPASKKVTIIFILNLSFSLIEFIFGTLFFSGAILADAVHDFGDAIAIGISAILERKAVKK   60

Query:  61 EDTIFSLGYKRFSLLGALITSLILISGSILVMIENIPKLWHPTPVNYHGMFILAVIAIII  120
           E   FSLGYKRFSLLGAL T+LILISGS+LVMIE IPKLWHPT VNY GMF+LA+ AIII
Sbjct:  61 ESPNFSLGYKRFSLLGALTTNLILISGSLLVMIETIPKLWHPTIVNYDGMFVLAIFAIII  120

Query: 121 NGLASFILHSGQSKHEEILSLHFLEDILGWLAIIVISLILNWKPLYILDPLLSVAISTFI  180
           NG ASFI+HS Q+K+EEILSLHFLEDILGWLAII++SLIL WKP YILDPLLS+AI++FI
Sbjct: 121 NGFASFIIHSNQTKNEEILSLHFLEDILGWLAIIILSLILKWKPWYILDPLLSIAIASFI  180

Query: 181 LSKALPKLLSTLKLFLDGVPDSIDYAALHDELKGLSQVRSINQLNIWSMDGIDNRAIIHC  240
           LSKALPKL++T +FLDGVPDSIDY  LH EL  L + S+NQLN+WSMDGID+RA IHC
Sbjct: 181 LSKALPKLVATANIFLDGVPDSIDYCTLHHELSQLPHIVSVNQLNVWSMDGIDHRATIHC  240

Query: 241 CLNQLISEKDCKRAIRTICQHYKINDVTVEIDYSLREHQNHCKPLKN              287
           CL +  +EK CK++IR ICQ Y IN VTVEID SL EHQ+HC    L +
Sbjct: 241 CLRESTTEKHCKKSIRLICQRYNINSVTVEIDTSLNENQHHCSSLSS              287
```

Based on this analysis, it was predicted that these proteins and their epitopes could be useful antigens for vaccines or diagnostics.

EXAMPLE 245

A DNA sequence (GBSx0259) was identified in *S. agalactiae* <SEQ ID 777> which encodes the amino acid sequence <SEQ ID 778>. Analysis of this protein sequence reveals the following:

```
Possible site: 48
>>> Seems to have no N-terminal signal sequence
INTEGRAL Likelihood = -1.22 Transmembrane 221-237 (221-237)

----- Final Results -----
      bacterial membrane --- Certainty = 0.1489 (Affirmative) < succ>
```

```
              bacterial outside --- Certainty = 0.0000 (Not Clear) < succ>
              bacterial cytoplasm --- Certainty = 0.0000 (Not Clear) < succ>
```

There is also homology to SEQ ID 780.

Based on this analysis, it was predicted that this protein and its epitopes, could be useful antigens for vaccines or diagnostics.

EXAMPLE 246

A DNA sequence (GBSx0260) was identified in *S. agalactiae* <SEQ ID 781> which encodes the amino acid sequence <SEQ ID 782>. Analysis of this protein sequence reveals the following:

```
Possible site: 13
>>> Seems to have no N-terminal signal sequence
   INTEGRAL   Likelihood = -2.50    Transmembrane   2-18 (1-18)

----- Final Results -----
              bacterial membrane --- Certainty = 0.1999(Affirmative) < succ>
              bacterial outside --- Certainty = 0.0000(Not Clear) < succ>
              bacterial cytoplasm --- Certainty = 0.0000(Not Clear) < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 247

A DNA sequence (GBSx0261) was identified in *S. agalactiae* <SEQ ID 783> which encodes the amino acid sequence <SEQ ID 784>. This protein is predicted to be dehydrogenase (Zn-dependent). Analysis of this protein sequence reveals the following:

```
Possible site: 15
>>> Seems to have no N-terminal signal sequence
   INTEGRAL   Likelihood = -3.77    Transmembrane   171-187 (170-187)

----- Final Results -----
              bacterial membrane --- Certainty = 0.2508(Affirmative) < succ>
              bacterial outside --- Certainty = 0.0000(Not Clear) < succ>
              bacterial cytoplasm --- Certainty = 0.0000(Not Clear) < succ>
```

The protein has homology with the following sequences in the GENPEPT database:

```
>GP:AAG20655 GB:AE005134 alcohol dehydrogenase; Adh2 [Halobacterium sp. NRC-1]
Identities = 169/348 (48%), Positives = 232/348 (66%), Gaps = 9/348 (2%)

Query:    1 MKVATFIEPGKMVITDTPKPVIEQETDAVIKIVRACVCGSDLWWYRGISKRESGSFAGHE    60
            M+ A +  PG++ + + PKP IE   DAVI++    VCGSDLW+YRG S RE+GS  GHE
Sbjct:    1 MRAAVYQGPGEIAVEEVPKPDIESPEDAVIRVTHTAVCGSDLWFYRGDSDREAGSRVGHE    60

Query:   61 AIGIVEEVGTKVTDVSKGDFVIVPFTHGCGQCPSCKAGFDGNCTNHQA---AKNVGYQGQ   117
            +GIVEEVG  VT V+ GD VI PF   CG+C  C+ G  +C   ++    N G QG+
Sbjct:   61 PMGIVEEVGDDVTSVAPGDRVIAPFAISCGECEFCRQGLYTSCVEDESWGSEANGGGQGE   120

Query:  118 YLRYTNANWALVKIPGQPSDYDNETLNSLLTLSDVMATGYHAAATAEVKEGDTVVVMGDG   177
            Y++     A+  LV++P +  +D + L  SLL L+DVM  TG+HAA +A V EGDT VV+GDG
Sbjct:  121 YVKCPFADGTLVRVPDRYAD-DEDVLESLLPLTDVMGTGHHAAVSAGVGEGDTAVVVGDG   179

Query:  178 AVGLCGVIAAKMLGANRIIAMSRHKDRQELALTFGATDIVEERGDEAVKRVLDLTNQAGA   237
            AVGLCGV+AA+  LGA RIIAM  H+DR ELA   FGATD +   RGD+A++R   DLT+   GA
```

```
-continued
Sbjct:  180  AVGLCGVLAAQRLGAERIIAMGHHEDRLELAAEFGATDTISARGDDAIERARDLTH-GGA  238

Query:  238  DAVLECVGTEQSVDTATQIARPGAVIGRVGIP---QNPDMNTNNLFWKNIGLRGGIASVT  294
             + V+ECVG  ++D+A  IARPG  +G VG+P    ++  ++    +F  NI +RGG+A V
Sbjct:  239  NHVMECVGAASAMDSAIAIARPGGTVGYVGVPYGVEDGGLDVFTMFSDNITIRGGVAPVR  298

Query:  295  TFDKSVLLDAVLTHKINPGLVFTKSFVLDDIQKAYEAMDKRDAIKSLV              342
             + + ++ D VL    ++P  +FTK+  LD + +  Y AMD  R+AIK  LV
Sbjct:  299  AYAEELMAD-VLQGTLDPSPIFTKTVDLDGVPEGYAAMDDREAIKVLV              345
```

There is also homology to SEQ ID 786.

A related sequence was also identified in GAS <SEQ ID 9145> which encodes the amino acid sequence <SEQ ID 9146>. Analysis of this protein sequence reveals the following:

```
Possible site: 23
>>> Seems to have no N-terminal signal sequence
    INTEGRAL    Likelihood = -5.41      Transmembrane    170-186

----- Final Results -----
              bacterial membrane --- Certainty = 0.3166(Affirmative) < succ>
               bacterial outside --- Certainty = 0.0000(Not Clear)   < succ>
             bacterial cytoplasm --- Certainty = 0.0000(Not Clear)   < succ>
```

An alignment of the GAS and GBS proteins is shown below:

```
Identities = 121/353 (34%), Positives = 182/353 (51%), Gaps = 16/353 (4%)

Query:    1  MKVATFIEPGKMVITDTPKPVIEQETDAVIKIVRACVCGSDLWWYRG-ISKRESGSFAGH   59
             MK AT++  G + + D PKPVI + TDA++++V+  + CG+DL     G +    + G+  GH
Sbjct:   15  MKAATYLSTGNLQLIDKPKPVIIKPTDAIVQLVKTTICGTDLHILGGDVPACKEGTILGH   74

Query:   60  EAIGIVEEVGTKVTDVSKGDFVIVPFTHGCQCPSCKAGFDGNCTNHQAAKN---VGYQG  116
             E IGIV+EVG  VT+   GD VI+      C  C  CK G  +C +           G Q
Sbjct:   75  EGIGIVKEVGDAVTNFKIGDKVIISCVTSCHTCYYCKRGLSSHCQDGGWILGHLINGTQA  134

Query:  117  QYLRYTNANWALVKIPGQPSDYDNETLNSLLTLSDVMATGYH-AAATAEVKEGDTVVVMG  175
             +Y+   +A+  +L     P  D        +L+ LSD++  T Y         + VK  GD V ++G
Sbjct:  135  EYVHIPHADGSLYHAPDTIDD------EALVMLSDILPTSYEIGVLPSHVKPGDNVCIVG  188

Query:  176  DGAVGLCGVIAAKMLGANRIIAMSRHKDRQELALTFGATDIVEERGDEAVKRVL-DLTNQ  234
               G VGL  ++ +       II +   ++R E A TFGAT  +        E VK ++ D+TN
Sbjct:  189  AGPVGLAALLTVQFFSPANIIMVDLSQNRLEAAKTFGATHTICSGSSEEVKAIIDDITNG  248

Query:  235  AGADAVLECVGTEQSVDTATQIARPGAVIGRVGIPQNP-DMNTNNLFWKNIGLRGGIASV  293
                G D   +ECVG    + D   +I    G  I  VG+    P  D N  + L+ KNI L   G+  +
Sbjct:  249  RGVDISMECVGYPATFDICQKIISVGGHIANVGVHGKPVDFNLDELWIKNITLNTGLVNA  308

Query:  294  TTFDKSVLLDAVLTHKINPGLVFTKSFVLDDIQKAYEAMDKRDAIKSL-VIVD        345
              T +    +LL+ +  T KI+    + T     F L +++KAYE        A    +L VI+D
Sbjct:  309  NTTE--MLLNVLKTGKIDATRLITHHFKLSEVEKAYETFKHAGANNALKVIID        359
```

Based on this analysis, it was predicted that these proteins and their epitopes could be useful antigens for vaccines or diagnostics.

EXAMPLE 248

A DNA sequence (GBSx0262) was identified in *S. agalactiae* <SEQ ID 787> which encodes the amino acid sequence <SEQ ID 788>. Analysis of this protein sequence reveals the following:

```
Possible site: 31
>>> Seems to have no N-terminal signal sequence

----- Final Results -----
         bacterial cytoplasm --- Certainty = 0.2169 (Affirmative) <succ>
          bacterial membrane --- Certainty = 0.0000 (Not Clear)   <succ>
           bacterial outside --- Certainty = 0.0000 (Not Clear)   <succ>
```

The protein has homology with the following sequences in the GENPEPT database:

```
>GP:AAD36075 GB:AE001762 hypothetical protein [Thermotoga maritima]
Identities = 55/128 (42%), Positives = 72/128 (55%), Gaps = 8/128 (6%)

Query:   8  IFPKGEKNPYGEFFIGQSYLAALAKSPDG--NVSVGNVTFEAGCRNNWHVHLDGYQILLV    65
            IF +G K    +FF G  ++  L    +G  N  V +V FE G R +WH H  G  QIL+V
Sbjct:   5  IFERGSKGS-SDFFTGNVWVKMLVTDENGVFNTQVYDVVFEPGARTHWHSHPGG-QILIV   62

Query:  66  TEGSGWYQEEGKEAVSLKPGDVIVTDKGVRHWHGAKKDSEFAHIAITA----GKSEFYEA  121
            T G G+YQE GK A   LK GDV+     V HWHGA  D E   HI I+      G +E+  +
Sbjct: 63  TRGKGFYQERGKPARILKKGDVVEIPPNVVHWHGAAPDEELVHIGISTQVHLGPAEWLGS  122

Query: 122  VSDEEYSR                                                     129
            V++EEY +
Sbjct: 123  VTEEEYRK                                                     130
```

No corresponding DNA sequence was identified in *S. pyogenes*.

Based on this analysis, it was predicted that this protein and its epitopes, could be useful antigens for vaccines or diagnostics.

EXAMPLE 249

A DNA sequence (GBSx0263) was identified in *S. agalactiae* <SEQ ID 789> which encodes the amino acid sequence <SEQ ID 790>. This protein is predicted to be gamma-carboxymuconolactone decarboxylase. Analysis of this protein sequence reveals the following:

```
Possible site: 49
>>> Seems to have no N-terminal signal sequence

----- Final Results -----
      bacterial cytoplasm --- Certainty = 0.4089 (Affirmative) <succ>
      bacterial membrane  --- Certainty = 0.0000 (Not Clear)   <succ>
       bacterial outside  --- Certainty = 0.0000 (Not Clear)   <succ>
```

The protein has homology with the following sequences in the GENPEPT database:

```
>GP:CAA20070 GB:AL031155 3-oxoadipate enol-lactone hydrolase/
4-carboxymuconolactone decarboxylase [Streptomyces coelicolor A3(2)]
Identities = 33/93 (35%), Positives = 59/93 (62%), Gaps = 1/93 (1%)

Query:  11  QLEEFAPEFARYNDDILFGEVWAKEDHLTDKTRSIITISALISGGNLEQLEHHLQFAKQN    70
            Q +EF+ +F +       +GE+W +    L  ++RS  +T++AL+GG+L++L   HL+ A  +N
Sbjct: 349  QADEFSGDFQEFLTRYAWGEIWDRPG-LDRRSRSCVTLTALVAGGHLDELAPHLRAALRN   407

Query:  71  GVTKEEIADIITHLAFYVGWPKAWSAFNKAKEI                            103
            G+T  EI+++   A Y G P A  AF  A+++
Sbjct: 408  GLTPGEIKEVLLQAAVYCGVPAANGAFRVAQQV                            440
```

No corresponding DNA sequence was identified in *S. pyogenes*.

Based on this analysis, it was predicted that this protein and its epitopes, could be useful antigens for vaccines or diagnostics.

EXAMPLE 250

A DNA sequence (GBSx0265) was identified in *S. agalactiae* <SEQ ID 791> which encodes the amino acid sequence <SEQ ID 792>. Analysis of this protein sequence reveals the following:

```
Possible site: 44
>>> Seems to have no N-terminal signal sequence
```

```
----- Final Results -----
        bacterial cytoplasm --- Certainty = 0.5529 (Affirmative) <succ>
         bacterial membrane --- Certainty = 0.0000 (Not Clear)   <succ>
          bacterial outside --- Certainty = 0.0000 (Not Clear)   <succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 251

A DNA sequence (GBSx0266) was identified in *S. agalactiae* <SEQ ID 793> which encodes the amino acid sequence <SEQ ID 794>. This protein is predicted to be probable transcriptional regulator. Analysis of this protein sequence reveals the following:

```
Possible site: 58
>>> Seems to have an uncleavable N-term signal seq

----- Final Results -----
         bacterial membrane --- Certainty = 0.0000(Not Clear) < succ>
          bacterial outside --- Certainty = 0.0000(Not Clear) < succ>
        bacterial cytoplasm --- Certainty = 0.0000(Not Clear) < succ>
```

A related GBS nucleic acid sequence <SEQ ID 9585> which encodes amino acid sequence <SEQ ID 9586> was also identified.

The protein has homology with the following sequences in the GENPEPT database:

```
>GP: AAG08263 GB: AE004901 probable transcriptional regulator
[Pseudomonas aeruginosa]
Identities = 36/148 (24%), Positives = 68/148 (45%), Gaps = 22/148 (14%)

Query:   5 QIVEKPAMILAG------------------VTLENVKSNQEGIQQAIGICKTQPDFRFD   45
           +IVE+PA  + G                   + E+  + +  + + GIC  QP+  F
Sbjct: 123 RIVERPAFSVVGMEYFGSAPGDTIGQLWERFIPREHEIAGKHDPEVSYGICAQQPNGEFH 182

Query:  46 YSATYQVETSVQAPKGLEIIRIPSATYAVISVKGPMPSSLQETWRKIIQGFFQENNLKPA 105
           Y A ++V+     P+G+   ++P+  YAV + KG P  + E+++ I      E  L+P
Sbjct: 183 YVAGFEVQEGWPVPEGMVRFQVPAQKYAVFTHKGTAP-QIAESFQAIYSHLLAERGLEPK 241

Query: 106 NSPNLEIYSSQH--PQDTDYQMEIWLAI                                 131
           + E Y  +    P D + Q+++++ I
Sbjct: 242 AGVDFEYYDQRFRGPLDPNSQVDLYIPI                                 269
```

No corresponding DNA sequence was identified in *S. pyogenes*.

Based on this analysis, it was predicted that these proteins and their epitopes could be useful antigens for vaccines or diagnostics.

EXAMPLE 252

A DNA sequence (GBSx0267) was identified in *S. agalactiae* <SEQ ID 795> which encodes the amino acid sequence <SEQ ID 796>. Analysis of this protein sequence reveals the following:

```
Possible site: 24
>>> Seems to have no N-terminal signal sequence

----- Final Results -----
        bacterial cytoplasm --- Certainty = 0.0887(Affirmative) < succ>
```

```
                    -continued
        bacterial membrane --- Certainty = 0.0000(Not Clear) < succ>
        bacterial outside --- Certainty = 0.0000(Not Clear) < succ>
```

The protein has homology with the following sequences in the GENPEPT database:

```
>GP: AAB84919 GB: AE000825 conserved protein [Methanothermobacter
thermoautotrophicus]
Identities = 42/130 (32%), Positives = 71/130 (54%), Gaps = 3/130 (2%)

Query:   1 MITQEMKEIINSQLAMVATVDAKGQPNIGPKRSMRLWDDKTFIYNENTDGQTRINIEDNG    60
           M+T EM + I  +L  VAT D +G PN+ P    R  D++T +   +N   +T  N+ +N
Sbjct:   1 MMTPEMMDAIEKELVFVATADEEGTPNVVPIGFARPLDERTILIADNYMKKTIRNLHENP    60

Query:  61 KIEIAFVDRERLLGYRFVGTAEIQTEGTYYEAAKKWAEGRMG--VPKAVGIIHVERIFNL  118
           +I +       R   Y+F GT EI   G Y++   +WA+  M     PK+  ++ VE I+++
Sbjct:  61 RIAL-IPQNARECPYQFKGTVEIFKSGKYFDMVVEWAQNVMTELEPKSAILMTVEEIYSV  119

Query: 119 QSGANAGKEI                                                   128
            + G  AG+++
Sbjct: 120 KPGPEAGEKV                                                   129
```

A related DNA sequence was identified in *S. pyogenes* <SEQ ID 797> which encodes the amino acid sequence <SEQ ID 798>. Analysis of this protein sequence reveals the following:

```
Possible site: 24
>>> Seems to have no N-terminal signal sequence

----- Final Results -----
            bacterial cytoplasm --- Certainty = 0.0789(Affirmative) < succ>
            bacterial membrane  --- Certainty = 0.0000(Not Clear)   < succ>
            bacterial outside   --- Certainty = 0.0000(Not Clear)   < succ>
```

An alignment of the GAS and GBS proteins is shown below:

```
Identities = 123/128 (96%), Positives = 127/128 (99%)

Query:   1 MITQEMKEIINSQLAMVATVDAKGQPNIGPKRSMRLWDDKTFIYNENTDGQTRINIEDNG    60
           MITQEMK++IN+QLAMVATVDAKGQPNIGPKRSMRLWDDKTFIYNENTDGQTRINIEDNG
Sbjct:   1 MITQEMKDLINNQLAMVATVDAKGQPNIGPKRSMRLWDDKTFIYNENTDGQTRINIEDNG    60

Query:  61 KIEIAFVDRERLLGYRFVGTAEIQTEGTYYEAAKKWAEGRMGVPKAVGIIHVERIFNLQS  120
           KIEIAFVDRERLLGYRFVGTAEIQTEG YYEAAKKWA+GRMGVPKAVGIIHVERIFNLQS
Sbjct:  61 KIEIAFVDRERLLGYRFVGTAEIQTEGAYYEAAKKWAQGRMGVPKAVGIIHVERIFNLQS  120

Query: 121 GANAGKEI                                                     128
           GANAGKEI
Sbjct: 121 GANAGKEI                                                     128
```

Based on this analysis, it was predicted that these proteins and their epitopes could be useful antigens for vaccines or diagnostics.

EXAMPLE 253

A DNA sequence (GBSx0268) was identified in *S. agalactiae* <SEQ ID 799> which encodes the amino acid sequence <SEQ ID 800>. Analysis of this protein sequence reveals the following:

```
Possible site: 22
>>> Seems to have a cleavable N-term signal seq.
    INTEGRAL    Likelihood = -5.47    Transmembrane   1028-1044 (1027-1048)

----- Final Results -----
            bacterial membrane --- Certainty = 0.3187(Affirmative) < succ>
```

-continued
```
          bacterial outside --- Certainty = 0.0000(Not Clear) < succ>
          bacterial cytoplasm --- Certainty = 0.0000(Not Clear) < succ>
```

The protein has homology with the following sequences in the GENPEPT database:

```
!GB: AF054892 surface antigen BspA [Bacteroides forsy . . .
!GB: AF054892 surface antigen BspA [Bacteroides forsy . . .
!GB: AF054892 surface antigen BspA [Bacteroides forsy . . .
!GB: AF054892 surface antigen BspA [Bacteroides forsy . . .
!GB: AF054892 surface antigen BspA [Bacteroides forsy . . .
>GP: AAC82625 GB: AF054892 surface antigen BspA [Bacteroides
forsythus]
Identities = 143/566 (25%), Positives = 243/566 (42%), Gaps = 52/566 (9%)

Query:  95 VPKAKPEVTQEASNSSNDASKVEVPKQDTASKKETLETSTWEAKDFVTRGDTLVG----F 150
           +P +    + +A   +    + +P   TA + L   T     +   T +G     F
Sbjct: 120 IPNSVTTIGEWAFKGCSGLKSITLPNSLTAIGQSALSGCTGLTSITIPNSVTTIGEWAFF 179

Query: 151 SKSGINKLSQTSHLVLPSHAA--DGTQLTQVASFAFTPDKKTAIAEYTSRLGENGKPSRL 208
           SG+  ++   + L    +A    LT +         PD    T I E   + G +G  S
Sbjct: 180 GCSGLTSITFPNSLTAIGESAFYGCGALTSIT----LPDALTTIGESAFK-GCSGLKSIT 234

Query: 209 DIDQKEIIDEGEIFNAYQLTKLTIPNGYKSIGQDAFVDNKNIAEVNLPESLETISDYAFA 268
            +       I E    ++     LT +T+P+    +IG+ AF       +   P SL TI + AF
Sbjct: 235 FPNSLTTIGESAFYDCGALTSITLPDALTTIGRSAFYGCSGLKSITFPNSLTTIGESAFY 294

Query: 269 HM-SLKQVKLPDNLKVIGELAFFDNQIGGKLYLPRHLIKLAERAFKSNRIQTVEFLGSKL 327
           +    SL   + +P+++   IG  AF+         + LP  L  + ERAF +  +  T    +  + +
Sbjct: 295 NCGSLTSITIPNSVTTIGRSAFYGCSGLKSITLPDGLTTIEERAFYNCGVLTSITIPNSV 354

Query: 328 KVIGEASFQD-NNLRNVMLPDGLEKIESEAFTGNPGDEHYNNQVVLRTRTGQNPHQLATE 386
           IGE++F  +  L+++  LPDGL   IE    AF          N    L + T  N            E
Sbjct: 355 ATIGESAFYGCSGLKSITLPDGLTTIEWGAFY---------NCGALTSITIPNSVSTIGE 405

Query: 387 NTYVNPDKSLWRATPDMDYTKWLEEDFTYQKNSVTGFS---NKGLQKVRRNKNLEIPKQH 443
            + +   +L  T  D    ++ D    +++   +++G       G +  V    K   ++ K+
Sbjct: 406 SAFYGCG-ALKDVTVAWDTPIDIQRD-VFRELTLSGIRLHVPAGKKTVYEAK--DVWKEF 461

Query: 444 NGITITEIGDNAFRNVDFQSKTLRKYDLEEIKLPSTIRKIGAFAFQSNNLKSFEASEDLE 503
           N +    + G    + N D +KTL    +    P T ++        FA ++    L
Sbjct: 462 NIVEDDDFGGLQW-NYDAATKTLTITN----PTPDTPKPMPNFATPNDQLW--------- 507

Query: 504 EIKEGAFMNNRIGTLDLKDKLIKIGDAAFH-INHIYAIVLPESVQEIGRSAFRQNGALHL 562
               GAF   I  + +D +  +GD AF   +   +I LP+SV  IG+SAF     L
Sbjct: 508 ----GAFQKE-IQKITIGDVTSVGDFAFSGCDALKSITLPKSVTTIGQSAFSGCWDLRS 562

Query: 563 MFIGNKVKTIGEMAFLSNKLESVNLSEQKQLKTIEVQAFS-DNALSEVVLPPNLQTIREE 621
           + + +   V TIGE AF + LE +++  K +  I + F     +L+  +   LP   L    I ++
Sbjct: 563 LTLPDGVNTIGEKAFY-DCLELTSITIPKSVTAIGQETFHYCVSLTSLTLPDALTAIGKK 621

Query: 622 AF-KRNHLKEVKGSSTLSQITFNAFD                                   646
           AF    N L V     +++ I  NAFD
Sbjct: 622 AFYSCNALTSVTFPKSITTIGENAFD                                   647

Identities = 109/407 (26%), Positives = 175/407 (42%),
Gaps = 48/407 (11%)

Query: 222 FNAYQLTKLTIPNGYKSIGQDAFVDNKNIAEVNLPESLETISDYAFAHMS-LKQVKLPDN 280
           F+    LT +T+PN   +IG  AF      + + +P S+ TI ++AF    S  LK + LP++
Sbjct:  87 FSDCALTSVTLPNSLTAIGDHAFKGCSGLTSITIPNSVTTIGEWAFKGCSGLKSITLPNS 146

Query: 281 LKVIGELAFFDNQIGGKLYLPRHLIKLAERAFKSNRIQTVEFLGSKLKVIGEASFQD-NN 339
           L  IG+ A       + +P +   + E AF    T      + L   IGE++F   NN
Sbjct: 147 LTAIGQSALSGCTGLTSITIPNSVTTIGEWAFFGCSGLTSITFPNSLTAIGESAFYGCGA 206

Query: 340 LRNVMLPDGLEKIESEAFTGNPGDEHYNNQVVLRTRTGQNPHQLATENTYVNPDKSLWRA 399
           L  ++ LPD L  I    AF  G          G   L++   T N      E+  +  +
Sbjct: 207 LTSITLPDALTTIGESAFKGCSG---------LKSITFPNSLTTIGESAFYDCGALTSIT 257

Query: 400 TPDMDYTKWLEEDFTYQKNSVTGFSNKGLQKVRRNKNLEIPKQHNGITITEIGDNAFRNV 459
            PD                 ++T       K++   P      ++T IG++AF N
Sbjct: 258 LPD---------------ALTTIGRSAFYGCSGLKSITFPN-----SLTTIGESAFYNC 296

Query: 460 DFQSKTLRKYDLEEIKLPSTIRKIGAFAFQS-NNLKSFEASEDLEEIKEGAFMNNRIGT- 517
                    L  I  +P+++  IG  AF    +  LKS    +   L  I+E AF N  + T
Sbjct: 297 G---------SLTSITIPNSVTTIGRSAFYGCSGLKSITLPDGLTTIEERAFYNCGVLTS 347
```

```
-continued
Query:  518 LDLKDKLIKIGDAAFH-INHIYAIVLPESVQEIGRSAFRQNGALHLMFIGNKVKTIGEMA  576
             + + + +  IG++AF+  + + +I LP+ +  I   AF   GAL  + I N V TIGE A
Sbjct:  348 ITIPNSVATIGESAFYGCSGLKSITLPDGLTTIEWGAFYNCGALTSITIPNSVSTIGESA  407

Query:  577 FLS-NKLESVNLSEQKQLKTIEVQAFSDNALSEVVL--PPNLQTIRE              620
             F      L+ V ++   +  I+   F + LS + L P    +T+ E
Sbjct:  408 FYGCGALKDVTVAWDTPI-DIQRDVFRELTLSGIRLHVPAGKKTVYE              453

Identities = 111/465 (23%), Positives = 185/465 (38%),
Gaps = 56/465 (12%)

Query:  141 VTRGDTLVGFSKSGINKLSQTSHLVLPSHAADGTQLTQVASFAF----------TPDKKT  190
             +T  D L  +S   S  + P+     LT + AF            PD  T
Sbjct:  210 ITLPDALTTIGESAFKGCSGLKSITFPN------SLTTIGESAFYDCGALTSITLPDALT  263

Query:  191 AIAEYTSRLGENGKPSRLDIDQKEIIDEGEIFNAYQLTKLTIPNGYKSIGQDAFVDNKNI  250
              I   ++  G +G S  +   I E  +N  LT +TIPN  +IG+ AF         +
Sbjct:  264 TIGR-SAFYGCSGLKSITFPNSLTTIGESAFYNCGSLTSITIPNSVTTIGRSAFYGCSGL  322

Query:  251 AEVNLPESLETISDYAFAHMS-LKQVKLPDNLKVIGELAFFDNQIGGKLYLPRHLIKLAE  309
                + LP+ L TI + AF +   L + +P+++  IGE AF+        + LP  L +
Sbjct:  323 KSITLPDGLTTIEERAFYNCGVLTSITIPNSVATIGESAFYGCSGLKSITLPDGLTTIEW  382

Query:  310 RAFKSNRIQTVEFLGSKLKVIGEASFQD-NNLRNVMLP-DGLEKIESEAF-----TGNPG  362
             AF +   T   + +  IGE++F     L++V  D    I+ + F      +G
Sbjct:  383 GAFYNCGALTSITIPNSVSTIGESAFYGCGALKDVTVAWDTPIDIQRDVFRELTLSGIRL  442

Query:  363 DEHYNNQVVLRTRTGQNPHQLATEN-------TYVNPDKSLWRATPDMDYTKWLEEDFTY  415
              +  V +    + ++        Y    K+L     P D  K+  +F
Sbjct:  443 HVPAGKKTVYEAKDVWKEFNIVEDDDFGGLQWNYDAATKTLTITNPTPDTPKPM-PNFAT  501

Query:  416 QKNSVTGFSNKGLQKVRRNKNLEIPKQHNGITITEIGDNAFRNVDFQSKTLRKYDLEEIK  475
              + +  G   K +QK+               G  +T +GD AF    D         L+ + I
Sbjct:  502 PNDQLWGAFQKEIQKIT-----------IGDGVTSVGDFAFSGCD---------ALKSIT  541

Query:  476 LPSTIRKIGAFAFQSN-NLKSFEASEDLEEIKEGAFMN-NRIGTDLDKLIKIGDAAFH   533
             LP ++  IG AF     +L+S    + +  I E AF +  + ++ +    + IG  FH
Sbjct:  542 LPKSVTTIGQSAFSGCWDLRSLTLPDGVNTIGEKAFYDCLELTSITIPKSVTAIGQETFH  601

Query:  534 -INHIYAIVLPESVQEIGRSAFRQNGALHLMFIGNKVKTIGEMAF                577
              + ++  LP+++. IG+ AF      AL  +   +   TIGE AF
Sbjct:  602 YCVSLTSLTLPDALTAIGKKAFYSCNALTSVTFPKSITTIGENAF                646

Identities = 98/351 (27%), Positives = 152/351 (42%), Gaps = 53/351 (15%)

Query:  315 NRIQTVEFLGSKLKVIGEASFQDNNLRNVMLPDGLEKIESEAFTGNPGDEHYNNQVVLRT  374
              ++IQTV  +G + +G +F D  L +V LP+ L    +   AF G  G               L+
Sbjct:   68 SKIQTVT-IGDGVTSVGNNAFSDCALTSVTLPNSLTAIGDHAFKGCSG---------LTS  117

Query:  375 RTGQNPHQLATENTYVNPDKSLWRATPDMDYTKWLEEDFTYQKNSVTGFSNKGLQKVRRN  434
               T    P+ + T +     S  ++                  NS+T         L
Sbjct:  118 IT--IPNSVTTIGEWAFKGCSGLKSIT--------------LPNSLTAIGQSALSGCTGL  161

Query:  435 KNLEIPKQHNGITITEIGDNAF------RNVDFQSKTLRKYD--------LEEIKLPSTI  480
             ++ IP    ++T IG+ AF         ++ F +  +          L   I LP ++
Sbjct:  162 TSITIPN-----SVTTIGEWAFFGCSGLTSITFPNSLTAIGESAFYGCGALTSITLPDAL  216

Query:  481 RKIGAFAFQS-NNLKSFEASEDLEEIKEGAFMN-NRIGTDLDKLIKIGDAAFH-INHI    537
              + IG AF+ +  LKS       L  I E AF +  + + +L D L    IG +AF+   + +
Sbjct:  217 TTIGESAFKGCSGLKSITFPNSLTTIGESAFYDCGALTSITLPDALTTIGRSAFYGCSGL  276

Query:  538 YAIVLPESVQEIGRSAFRQNGALHLMFIGNKVKTIGEMAFLS-NKLESVNLSEQKQLKTI  596
              +I  P S+  IG SAF    G+L  + I N V TIG  AF    + L+S+ L   +   L TI
Sbjct:  277 KSITFPNSLTTIGESAFYNCGSLTSITIPNSVTTIGRSAFYGCSGLKSITLPD--GLTTI  334

Query:  597 EVQAFSD-NALSEVVLPPNLQTIREEAFKR-NHLKEVKGSSTLSQITFNAF          645
              E +AF + +  L+ + +P ++ TI E AF +     + LK +     L+ + + AF
Sbjct:  335 EERAFYNCGVLTSITIPNSVATIGESAFYGCSGLKSITLPDGLTTIEWGAF          385

Identities = 78/282 (27%), Positives = 123/282 (42%), Gaps = 46/282 (16%)

Query:  111 NDASKVEVPKQDTASKKETLETSTWEAKDFVTRGDTLVGFSKSGINKLSQTSHLVLPS--  168
              N+AS  E+P     SK +T            VT GD    +     +   +   TS + LP+
Sbjct:   56 NNAS--EIPWHSLQSKIQT-----------VTIGDGVTSVGNNAFSDCALTS-VTLPNSL  101

Query:  169 -----HAADG----------TQLTQVASFAFT----------PDKKTAIAEYTSRLGENG  203
                  HA  G            +T + +AF            P+  TAI + ++   G  G
Sbjct:  102 TAIGDHAFKGCSGLTSITIPNSVTTIGEWAFKGCSGLKSITLPNSLTAIGQ-SALSGCTG  160

Query:  204 KPSRLDIDQKEIIDEGEIFNAYQLTKLTIPNGYKSIGQDAFVDNKNIAEVNLPESLETIS  263
                S    + I E  F   LT +T PN   +IG+ AF        + + LP++L TI
```

-continued

```
Sbjct: 161 LTSITIPNSVTTIGEWAFFGCSGLTSITFPNSLTAIGESAFYGCGALTSITLPDALTTIG 220

Query: 264 DYAFAHMS-LKQVKLPDNLKVIGELAFFDNQIGGKLYLPRHLIKLAERAFKS-NRIQTVE 321
            + AF   S LK + P++L  IGE AF+D     + LP  L  +  AF    + ++++
Sbjct: 221 ESAFKGCSGLKSITFPNSLTTIGESAFYDCGALTSITLPDALTTIGRSAFYGCSGLKSIT 280

Query: 322 FLGSKLKVIGEASFQD-NNLRNVMLPDGLEKIESEAFTGNPG         362
            F  S L  IGE++F + +L ++ +P+ +  I   AF G  G
Sbjct: 281 FPNS-LTTIGESAFYNCGSLTSITIPNSVTTIGRSAFYGCSG         321

Identities = 43/144 (29%), Positives = 70/144 (47%), Gaps = 4/144 (2%)

Query: 220 EIFNAYQ--LTKLTIPNGYKSIGQDAFVDNKNIAEVNLPESLETISDYAFAHM-SLKQVK  76
            +++  A+Q   + K+TI +G  S+G  AF       +  + LP+S+ TI   AF+   L+ +
Sbjct: 505 QLWGAFQKEIQKITIGDGVTSVGDFAFSGCDALKSITLPKSVTTIGQSAFSGCWDLRSLT 564

Query: 277 LPDNLKVIGELAFFDNQIGGKLYLPRHLIKLAERAFKSNRIQTVEFLGSKLKVIGEASFQ 336
            LPD +  IGE AF+D     + +P+ + + + +  F     T     L    L  IG+ +F
Sbjct: 565 LPDGVNTIGEKAFYDCLELTSITIPKSVTAIGQETFHYCVSLTSLTLPDALTAIGKKAFY 624

Query: 337 D-NNLRNVMLPDGLEKIESEAFTG         359
            N L +V  P  +  I    AF G
Sbjct: 625 SCNALTSVTFPKSITTIGENAFDG         648

Identities = 43/134 (32%), Positives = 66/134 (49%), Gaps = 12/134 (8%)

Query: 511 MNNRIGTLDLKDKLIKIGDAAFHINHIYAIVLPESVQEIGRSAFRQNGALHLMFIGNKVK 570
            + ++I T+ + D + +G+ AF      + ++ LP S+  IG  AF+     L   + I N V
Sbjct:  66 LQSKIQTVTIGDGVTSVGNNAFSDCALTSVTLPNSLTAIGDHAFKGCSGLTSITIPNSVT 125

Query: 571 TIGEMAFLS-NKLESVNLSEQKQLKTIEVQAFSD-NALSEVVLPPNLQTIREEAFKRNHL 628
            TIGE AF +  + L+S+ L      L  I  A S     L+ + +P ++ TI E AF
Sbjct: 126 TIGEWAFKGCSGLKSITL--PNSLTAIGQSALSGCTGLTSITIPNSVTTIGEWAF----- 178

Query: 629 KEVKGSSTLSQITF         642
            G  S  L+ ITF
Sbjct: 179 ---FGCSGLTSITF         189
```

A related DNA sequence was identified in *S. pyogenes* <SEQ ID 801> which encodes the amino acid sequence <SEQ ID 802>. Analysis of this protein sequence reveals the following:

```
Possible site: 21

>>> Seems to have a cleavable N-term signal seq.

INTEGRAL    Likelihood = -2.44    Transmembrane 984-1000 (984-1001)

----- Final Results -----
              bacterial membrane --- Certainty = 0.1977 (Affirmative) < succ> bacterial outside --- Certainty = 0.0000 (Not Clear) < succ> bacterial cytoplasm --- Certainty = 0.0000 (Not Clear) < succ>

LPXTG motif: 975-979
```

An alignment of the GAS and GBS proteins is shown below:

```
Identities = 751/1050 (71%), Positives 861/1050 (81%), Gaps = 45/1050 (4%)

Query:   3 KKHLKTLALALTTVSVVTYSQEVYGLEREESVKQEQTQSA-SEDDWFEEDNERKTNVSKE  61
           KKHLKT+AL LTTVSVVT++QEV+ L  +E +K Q Q S+  S  D+ E  +  K +++
Sbjct:   2 KKHLKTVALTLTTVSVVTHNQEVFSLVKEPILKQTQASSSISGADYAESSGKSKLKINET  61

Query:  62 NSTVDETVSDLFSDGNSWNSSSKTESVVSDPKQVPKAKPEVTQEASWSSNDASKVEVPKQ 121
           +  VD+TV+DLFSD +      K     +Q KA  E T E+        S++E  K+
Sbjct:  62 SGPVDDTVTDLFSDKRTTPEKIKDNLAKGPREQELKAVTENT-ESEKQITSGSQLEQSKE 120

Query: 122 DTASKKETLETSTWEAKDFVTRGDTLVGFSKSGIWKLSQTSHLVLPSHAADGTQLTQVAS 181
              + K   TS WE  DF+T+G+TLVG SKSG+ KLSQT NLVLPS AADGTQL QVAS
Sbjct: 121 SLSLNKTVPSTSNWEICDFITKGWTLVGLSKSGVEKLSQTDHLVLPSQAADGTQLIQVAS 180

Query: 182 FAFTPDKKTAIAEYTSRLGENGKPSRLDIDQKEIIDEGEIFWAYQLTKLTIPNGYKSIGQ 241
```

```
                    FAFTPDKKTAIAEYTSR GENG+  S+LD+D KEII+EGE+FN+Y L K+TIP GYK IGQ
Sbjct:   181    FAFTPDKKTAIAEYTSRAGENGEISQLDVDGKEIINEGEVFWSYLLKKVTIPTGYKHIGQ     240

Query:   242    DAFVDNKNIAEVNLPESLETISDYAFAHMSLKQVKLPDWLKVIGELAFFDNQIGGKLYLP     301
                DAFVDNKNIAEVNLPESLETISDYAFAH++LKQ+ LPDWLK IGELAFFDNQI GKL LP
Sbjct:   241    DAFVDNKNIAEVNLPESLETISDYAFAHLALKQIDLPDWLKAIGELAFFDWQITGKLSLP     300

Query:   302    RHLIKLAERAFKSNRIQTVEFLGSKLKVIGEASFQDWNLRNVMLPDGLEKIESEAFTGNF     361
                R L++LAERAFKSN I+T+EF G+ LKVIGEASFQDN+L  +MLPDGLEKIESEAFTGNP
Sbjct:   301    RQLMRLAERAFKSNHIKTIEFRGNSLKVIGEASFQDWDLSQLMLPDGLEKIESEAFTGNP     360

Query:   362    GDEHYNNQVVLRTRTGQNPHQLATENTYVNPDKSLWRATPDMDYTKWLEEDFTYQKWSVT     421
                GD+HYNN+VVL T++G+NP   LATENTYVNPDKSLW+ +P++DYTKWLEEDFTYQK+SVT
Sbjct:   361    GDDHYWNRVVLWTKSGKNPSGLATENTYVNPDKSLWQESPEIDYTKWLEEDFTYQKWSVT     420

Query:   422    GFSNKGLQKVRRNKNLEIPKQHNGITITEIGDNAFRNVDFQSKTLRKYDLEEIKLPSTIR     481
                GFSNKGLQKV+RNKNLEIPKQHNG+TITEIGDNAFRNVDFQ+KTLRKYDLEE+KLPSTIR
Sbjct:   421    GFSNKGLQKVKRNKNLEIPKQHNGVTITEIGDNAFRNVDFQNKTLRKYDLEEVKLPSTIR     480

Query:   482    KIGAFAFQSNNLKSFEASEDLEEIKEGAFMNNRIGTLDLKDKLIKIGDAAFHINHIYAIV     541
                KIGAFAFQSNNLKSFEAS+DLEEIKEGAFMNNR  TL+LKDKL+ IGDAAFHINHIYAIV
Sbjct:   481    KIGAFAFQSNNLKSFEASDDLEEIKEGAFMNNRIETLELKDKLVTIGDAAFHINHIYAIV     540

Query:   542    LPESVQEIGRSAFRQNGALHLMFIGNKVKTIGSMAFLSNKLSSVNLSEQKQLKTIEVQAF     601
                LPESVQEIGRSAFRQNGA +L+F+G+KVKT+GEMAFLSN+LE ++LSEQKQL  I VQAF
Sbjct:   541    LPESVQEIGRSAFRQNGANNLIFNGSKVKTLGEMAFLSNRLEHLDLSEQKQLTSIPVQAF     600

Query:   602    SDNALSEVVLPPNLQTIREEAFKRNHLKEVKGSSTLSQITFNAFDQNDGDKRFGKKVVVR     661
                SDNAL EV+LP +L+TIREEAFK+NHLK+++ +S LS I FNA D NDGD++F   KVVV+
Sbjct:   601    SDNALKEVLLFASLKTIREEAFKKNHLKQLEVASALSHIAFNALDDNDGDEQFDNKVVVK     660

Query:   662    THNNSHMLADGERFIIDPDKLSSTMVDLEKVLKIIEGLDYSTLRQTTQTQFREMTTAGKA     721
                TH+NS+ LADGE FI+DPDKLSST+VDLEK+LK+IEGLDYSTLRQTTQTQFR+MTTAGKA
Sbjct:   661    THHNSYALADGEHFIVDPDKLSSTIVDLEKILKLIEGLDYSTLRQTTQTQFRDMTTAGKA     720

Query:   722    LLSKSNLRQGEKQKFLQEAQFFLGRVDLDKAIAKAEKALVTKKATKNGHLLERSINKAVL     781
                LLSKSNLRQGEKQKFLQEAQFFLGRVDLDKAIAKAEKALVTKKATKNG LLERSINKAVL
Sbjct:   721    LLSKSNLRQGEKQKFLQEAQFFLGRVDLDKAIAKAEKALVTKKATKNGQLLERSINKAVL     780

Query:   782    AYNNSAIKKANVKRLEKELDLLTDLVEGKGPLAQATMVQGVYLLKTPLPLFEYYIGLNVY     841
                AYNNSAIKKANVKRLEKELDLLT LVEGKGPLAQATMVQGVYLLKTPLPLPEYYIGLNVY
Sbjct:   781    AYNNSAIKKANVKRLEKELDLLTGLVEGKGPLAQATMVQGVYLLKTPLPLPEYYIGLNVY     840

Query:   842    FDKSGKLIYALDMSDTIGEGQKDAYGNPILNVDEDNEGYHTLAVATLADYEGLYIKDILN     901
                FDKSGKLIYALDMSDTIGEGQKDAYGNPILNVDEDNEGYH LAVATLADYEGL IK ILN
Sbjct:   841    FDKSGKLIYALDMSDTIGEGQKDAYGNPILNVDEDNEGYHALAVATLADYEGLDIKTILN     900

Query:   902    SSLDKIKAIRQIPLAKYHRLGIFQAIRNAAAEADRLLPKTPKGYLNEVPNYRKKQVEKNL     961
                S L ++ +IRQ+P A YHR GIFQAI+NAAAEA++LLPK
Sbjct:   901    SKLSQLTSIRQVPTAAYHRAGIFQAIQNAAAEAEQLLPK---------------------     939

Query:   962    KPVDYKTPIFNKALPNEKVDGDRAAKGHNINAETNNSVAVTPIRSEQQLHKSQSDVNLPQ    1021
                                ++++    + N++            ++S  + ++ +    LP+
Sbjct:   940    ----------------PGTHSEKSSSSESANSKDRG------LQSNPKTNRGRHSAILPR     977

Query:  1022    TSSKNNFIYEILGYVSLCLLFLVTAGKKGK                                 1051
                T SK +F+Y ILGY S+ LL L+TA KK K
Sbjct:   978    TGSKGSFVYGILGYTSVALLSLITAIKKKK                                1007
```

SEQ ID 800 (GBS97) was expressed in *E. coli* as a His-fusion product. SDS-PAGE analysis of total cell extract is shown in FIG. 17 (lane 12; MW 113.4 kDa).

Figure 193:
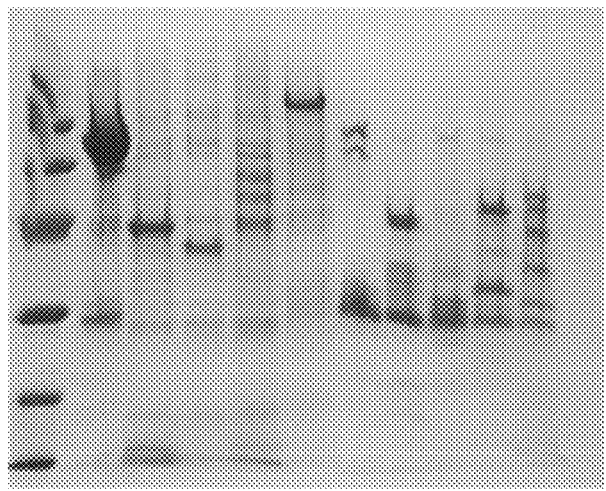

GBS97-His was purified as shown in FIG. 193, lane 6.

Based on this analysis, it was predicted that these proteins and their epitopes could be useful antigens for vaccines or diagnostics.

EXAMPLE 254

A DNA sequence (GBSx0269) was identified in *S. agalactiae* <SEQ ID 803> which encodes the amino acid sequence <SEQ ID 804>. This protein is predicted to be ribonucleoside-diphosphate reductase alpha chain (nrdE). Analysis of this protein sequence reveals the following:

```
          Possible site: 48

>>> Seems to have no N-terminal signal sequence

----- Final Results -----
                    bacterial cytoplasm --- Certainty = 0.4274 (Affirmative) < succ> bacterial membrane --- Certainty = 0.0000 (Not Clear) < succ> bacterial outside --- Certainty = 0.0000 (Not Clear) < succ>
```

The protein has homology with the following sequences in the GENPEPT database:

```
>GP:AAB96160 GB:AE000050 ribonucleoside-diphosphate reductase
alpha
           chain~MPN324 (new), 513 (Himmelreich et al., 1996)
           [Mycoplasma pneumoniae]

Identities = 476/725 (65%), Positives = 586/725 (80%),
Gaps = 20/725 (2%)

Query:    2 TQSD--AYLSLNAKTRFRDRTGNYHFTSDKEAVEQYMIEHVEPNTHVFTSLIEKLDYLVS   59
            TQ D   +Y+SLNA T+         F  D  AVE Y+ EHV+P T VF S  E+LD+LV
Sbjct:   12 TQEDLESYISLNAYTKVYG-----DFKMDLHAVEAYIQEHVKPKTKVFHSTKERLDFLVK   66

Query:   60 NNYYESDLLKQYNLEFICQIFEHAYAKKFAFLNFHGALKFYNAYALKTEDNRYYLEHYED  119
            N+YY+ +++  Y+ E   +I    AYA +F + NFMGA KFYNAYALKT D ++ YLE+YED
Sbjct:   67 NDYYDENIINMYSFEQFEEITRRAYAYRFRYANFHGAFKFYNAYALKTFDGKWYLENYED  126

Query:  120 RVVMNALFLAAGDEKAAYDLVDDMLANRFQPATPTFLNAGKKRRGEYISCYLLRIEDNME  179
            RVVMN LFLA G+    A  L+  ++ NRFQPATPTFLNAG+K+RGE++SCYLLRIEDNME
Sbjct:  127 RVVMNVLFLANGNYNKALKLLKQIITNRFQPATPTFLNAGRKKRGEFVSCYLLRIEDNME  186

Query:  180 SISRAISTSLQLSRRGGGVALCLTNLREFGAFIRGIKNQATGIVPVNKLLEDSFSYANQL  239
            SI  RAI+T+LQLSKR GGVAL LTN+RE GAPIK I+NQ++GI+P+MKLLEDSFSYANQL
Sbjct:  187 SIGRAITTTLQLSRRDGGVALLLTNIRESGAPIRRIENQSSGIIPIMRLLEDSFSYANQL  246

Query:  240 GQRQGAGAVYLHAHHPEVLTFLDTRRENADEKIRIKSLSLGLVIPDITFELAKANKDMAL  299
            GQRQGAGAVYLHAHHP+V+ FLDTKRENADEEIRIRSLSLGLVIPDITF LAK N++MAL
Sbjct:  247 GQRQGAGAVYLHAHHPDVMQFLDTKRENADEKIRIKSLSLGLVIPDITFTLAKNNEEMAL  306

Query:  300 FSPYDIERVYGKPMSDISITEEYETLLANADIRKTFISARKLFQTIAELHFESGYPYILF  359
            FSPYD+   YGKP+SDIS+TE Y LLAN  I+KTFI+ARK FQT+AELHFESGYPYILF
Sbjct:  307 FSPYDVYEEYGKPLSDISVTEMYYELLANQRIKKTFINARKFFQTVAELHFESGYPYILF  366

Query:  360 EDTVNAKNPHKKEGRIVMSNLCSEIAQVNTASQFSEDLTFTKVGHDVCCNLGSINIARAM  419
            +DTVN +N H       RIVMSNLCSEI Q +T S+F  DL F KVG+D+ CNLGS+NIA+AM
Sbjct:  367 DDTVNRRNAH--PNRIVMSNLCSEIVQPSTPSEFHHDLAFKKVGNDISCNLGSLNIARAM  424

Query:  420 DQAADFEKLIANSIRALDRVSRTSDLDSAPSIKKGNAANHAVGLGANNLHGFLATNHIYY  479
               +    +F +L+  +I +LD VSR S+L++APSI+KGN+  NHA+GLGAMNLHGFLATH IYY
Sbjct:  425 ESGPEFSELVKLAIESLDLVSRVSNLETAPSIQKGNSENHALGLGANNLHGFLATNQIYY  484

Query:  480 DSQEAIDFTDCFFYANAYYAFKASNHLAKEKGTFEGFSESSYADGSYFYQY--TEQNF-E  536
            +S EAIDFT+ FFY +AY+AFKAS+ LA ERG F+ F  + +ADGSYF +Y    E +F
Sbjct:  485 NSFEAIDFTNIFFYTVAYHAFKASSELALEKGKFKNFENTKFADGSYFDKYIKVEPDFWT  544

Query:  537 PKTQRVKNLLAEYGLTLPSQEDWRKLVQSIKEIGLANAHLLAVAPTGSISYLSSCTPSLQ  596
            PKT+RVK L  +Y +  +P++E+W++L   +I++  GLAN+HLLA+APTGSISYLSSCTPSLQ
Sbjct:  545 PKTERVKALFQKYQVEIPTRENWKELALNIQKNGLANSHLLAIAPTGSISYLSSCTPSLQ  604

Query:  597 PVVSPVEVRKEGALGRVYVPAYKIDADNYVYYKKGAYEVGSEAIINIAAAAQKHIDQAIS  656
            PVVSPVEVRKEG LGR+YVPAY+++ D+Y +YK GAYE+G E IINIAAAAQ+H+DQAIS
Sbjct:  605 PVVSPVEVRKEGRLGRIYVPAYQLNEDSYPFYKDGAYELGPEPIINIAAAAQQHVDQAIS  664

Query:  657 LTLFMTDQATTRDLNKAYIQAFKQKCASIYYVRVRQDILEGSESYDDMLDDFTSSDLEDC  716
            LTLFMTD+ATTRDLNKAYI AFK+ C+SIYYVRVRQ++LE SE +       +  ++ C
Sbjct:  665 LTLFMTDKATTRDLNKAYIYAFKKGCSSIYYVRVRQEVLEDSEDH--------TIQMQQC  716

Query:  717 QSCMI                                                         721
            ++C+I
Sbjct:  717 EACVI                                                         721
```

A related DNA sequence was identified in *S. pyogenes* <SEQ ID 805> which encodes the amino acid sequence <SEQ ID 806>. Analysis of this protein sequence reveals the following:

```
Possible site: 47

>>> Seems to have no N-terminal signal sequence

----- Final Results -----
          bacterial cytoplasm --- Certainty = 0.1843 (Affirmative) < succ>
``` bacterial membrane --- Certainty = 0.0000 (Not Clear) < succ> bacterial outside --- Certainty = 0.0000 (Not Clear) < succ>

The protein has homology with the following sequences in the databases:

```
>GP:AAC82625 GB:AF054892 surface antigen BspA [Bacteroides forsythus]

Identities = 124/451 (27%), Positives = 202/451 (44%),
Gaps = 65/451 (14%)

Query: 221 FNSYLLKKVTIPTGYKHIGQDAFVDNKNIAEVNLPSSLETISDYAFAHLA-LKQIDLPDN  279
            F+    L  VT+P   IG AF    + + +P S+ TI ++AF   + LK I LP++
Sbjct:  87 FSDCALTSVTLPNSLTAIGDHAFKGCSGLTSITIPNSVTTIGEWAFKGCSGLKSITLPNS  146

Query: 280 LKAIGELAFFDNQITGKLSLPRQLMRLAERA-FKSNHIKTISFRGNSLKVIGEASFQD-N  337
            L AIG+A           +++P  +  E A F  + +I F  NSL  IGE++F
Sbjct: 147 LTAIGQSALSGCTGLTSITIPNSVTTIGEWAFFGCSGLTSITF-PNSLTAIGESAFYGCG  205

Query: 338 DLSQLMLPDGLEKIESEAFTGNPGDDHYNNRVVLWTKSGKNPSGLATENTYVNPDKSLWQ  397
               L+ + LPD L  I   AF G  G              KS   P+ L T      +S +
Sbjct: 206 ALTSITLPDALTTIGESAFKGCSG-----------LKSITFPNSLTTIG------ESAFY  248

Query: 398 SSPEIDYTKWLEEDFTYQKNSVTGFSNKGLQKVKRNKNLSIPKQHNGVTITEIGDNAFRN  457
             +   +    +   T  +++ G S   GL     K++  P       ++T IG++AF N
Sbjct: 249 DCGALTSITLPDALTTIGRSAFYGCS--GL------KSITFPN-----SLTTIGESAFYN  295

Query: 458 VDFQNKTLRKYDLEEVKLPSTIRKIGAFAFQS-NNLKSFEASDDLEEIKEGAFMNNRIET  516
                        L  +P+++  IG  AF   + LKS    D L  I+E AF N  + T
Sbjct: 296 CG---------SLTSITIPNSVTTIGRSAFYGCSGLKSITLPDGLTTIEERAFYNCGVLT  346

Query: 517 -LELKDKLVTIGDAAFH-INHIYAIVLPESVQEIGRSAFRQNGANNLIFNGSKVKTLGEM  574
             +  +  +  TIG++AF+  + + +I  LP+  +  I    AF     GA     I  + + V T+GE
Sbjct: 347 SITIPNSVATIGESAFYGCSGLKSITLPDGLTTIEWGAFYNCGALTSITIPNSVSTIGES  406

Query: 575 AFLS-NRLEHLDLSEQKQLTEIPVQAFSDNALKEVLL--PASLKTIREEAFKKNHLKQLE  631
            AF    L+ + ++    + +I     F +  L  +L  PA  KT+ E      K+    K+
Sbjct: 407 AFYGCGALKDVTVAWDTPI-DIQRDVFRELTLSGIRLHVPAGKKTVYE---AKDVWKE--  460

Query: 632 VASALSHIAFNALDDND-GDEQFDNKVVVRT                              661
                          FN ++D+D  G  Q++                                KT
Sbjct: 461 ---------FNIVEDDDFGGLQWNYDAATKT                              482
```

An alignment of the GAS and GBS proteins is shown below:

```
Identities = 534/726 (73%), Positives = 614/726 (84%),

Gaps = 5/726 (0%)

Query:   1 HTQSDA-YLSLNAKTRFRDRTGNYHFTSDKSAVEQYHIEHVEPNTMVFTSLIEKLDYLVS   59
           M+Q++A YLSLNA TRF+   G+YHF SDKEAV +Y+ EHV PN M F SL +KL YL++
Sbjct:   1 MSQTNASYLSLNALTRFKKPDGSYHFDSDKEAVRRYLEEHVSPNQMAFNSLEDKLAYLIN   60

Query:  60 NNYYESDLLKQYNLEFICQIFEHAYAKKFAFLNFMGALKFYNAYALKTEDNRYYLEHYED  119
              YYE +   Y + F +AY + +  FLN MGA+KFY +YALKT D +  YLE +ED
Sbjct:  61 EGYYEQAIFDAYPNDLIKEAFHYAYQQGYRFLNLNGAMKFYQSYALKTLDGKQYLETFED  120

Query: 120 RVVMNALFLAAGDEKAAYDLVDDMLANRFQPATPTFLNAGKERRGEYISCYLLRIEDNME  179
           R VMNALFLA GD+    +D++D +L  RFQPATPTFLNAGK+RRGEYISCYLLR+EDNME
Sbjct: 121 PAVMNALFLADGDQTFVFDVIDAILHRRFQPATPTFLNAGKKRRGEYISCYLLRVEDNME  180

Query: 180 SISRAISTSLQLSKRGGGVALCLTNLREFGAPIKGIKNQATGIVPVMKLLEDSFSYANQL  239
           SISRAISTSLQLSKRGGGVALCLTNLRE GAPIKGI+NQATGIVPVMKLLEDSFSYANQL
Sbjct: 181 SISRAISTSLQLSKRGGGVALCLTNLREIGAPIKGIENQATGIVPVMKLLEDSFSYANQL  240

Query: 240 GQRQGAGAVYLHAHHPEVLTFLDTKRENADEKIRIKSLSLGLVIPDITFELAKANKDMAL  299
           GQRQGAGAVYLHAHHPEVLTFLDTKRENADEKIRIKSL+LGLVIPDITF+LAK NKDMAL
Sbjct: 241 GQRQGAGAVYLHAHHPEVLTFLDTKRENADEKIRIKSLALGLVIPDITFQLAKENKDMAL  300

Query: 300 FSPYDIERVYGKPMSDISITEEYETLLANADIRKTFISARKLFQTIAELHFESGYPYILF  359
           FSPYDI+R Y K MSDISITEEY+ LLAN  I+KT+ISARK FQ IAELHFESGYPY+LF
Sbjct: 301 FSPYDIKRAYGKDMSDISITEEYDKLLANPAIKKTYISARKFFQLIAELHFSSGYPYLLF  360
```

-continued

```
Query: 360 EDTVNAKNPHKKEGRIVIASNLCSEIAQVNTASQFSEDLTFTKVGHDVCCNLGSINIARM 419
           +DTVN +NPH K+GRIVMSNLCSEIAQV+T S F EDL+F +G D+CCNLGSINIA+AN
Sbjct: 361 DDTVNKRNPHAKKGRIVMSNLCSEIAQVSTPSTFKEDLSFETIGEDICCNLGSINIAQAN 420

Query: 420 DQAADFEKLIANSIRALDRVSRTS0LDSAPSIKKGNAANHAVGLGAMNLHGFLATNNIYY 479
              A  FE+LI  SIRALDRVSR SDL+ APS++ GNAANHAVGLGAMNLHGFLATNHIYY
Sbjct: 421 ADAPHFEQLITTSIRALDRVSRVSDLNCAPSVETGNAANHAVGLGAMNLHGFLATNNIYY 480

Query: 480 DSQEAIDFTDCFFYAMAYYAFKASNHLAKEKGTFEGFSESSYADGSYFYQYTEQNFEPKT 539
           D++EA+DFTD FF+AMAYYAFKAS  LAKEKG F GFS S+Y+DG+YF +Y +++  +P+T
Sbjct: 481 DTKEAVDFTDLFFHAMAYYAFKASCQLAKEKGAFAGFSLSTYSDGTYFAKYLQEDAKPQT 540

Query: 540 QRVKNLLAEYGLTLPSQEDWRKLVQSIKEIGLANAHLLAVAPTGSISYLSSCTPSLQPVV 599
            +V  LL +YG TLP+  DW+ LV   IK+ GLANAHLLAVAPTGSISYLSSCTPSLQPVV
Sbjct: 541 AKVATLLQDYGFTLPTVADWQALVADIKQFGLANAHLLAVAPTGSISYLSSCTPSLQPVV 600

Query: 600 SPVEVRKEGALGRVYVPAYKIDADNYVYYKRGAYEVGSEAIINIAAAAQKHIDQAISLTL 659
           +PVEVRKEG+LGR+YVPAY+ID  NY YY++GAYEVG +AII++ AAAQKH+DQAISLTL
Sbjct: 601 APVEVRKEGSLGRIYVPAYQIDQANYAYYERGAYEVGPKAIIDVVAAAQKHVDQAISLTL 660

Query: 660 FMTDQATTRDLNKAYIQAFKQKCASIYYVRVRQDILEGSESYDD----MLDDFTSSDLED 715
           FMTDQATTRDLN++YIQAFKQ CASIYYVRVRQD+L GSE YD+            +    +
Sbjct: 661 FMTDQATTRDLNRSYIQAFKQNCASIYYVRVRQDVLAGSEQYDEDSLVTAPGASDETTTE 720

Query: 716 CQSCMI 721
           CQSCMI
Sbjct: 721 CQSCMI 726
```

Based on this analysis, it was predicted that these proteins and their epitopes could be useful antigens for vaccines or diagnostics.

EXAMPLE 255

A DNA sequence (GBSx0270) was identified in *S. agalactiae* <SEQ ID 807> which encodes the amino acid sequence <SEQ ID 808>. This protein is predicted to be nrdI protein (nrdI). Analysis of this protein sequence reveals the following:

```
Possible site: 54
>>> Seems to have no N-terminal signal sequence

----- Final Results ----
         bacterial cytoplasm --- Certainty = 0.2952 (Affirmative) < succ>
          bacterial membrane --- Certainty = 0.0000 (Not Clear) < succ>
          bacterial outside --- Certainty = 0.0000 (Not Clear) < succ>
```

The protein has homology with the following sequences in the GENPEPT database:

```
>GP:AAC71451 GB:U39702 nrdI protein (nrdI) [Mycoplasma genitalium]
Identities = 77/127 (60%), Positives = 104/127 (81%), Gaps = 1/127 (0%)

Query:   7 VVYFSSKSNNTHRFVQKLACSNQRIPSD-GSSILVTEDYILIVPTYAGGGDDTKGAVPKQ 65
            +VYFSS SNNTHRF++KL   ++RIP D   SI V+ +Y+LI PTY+GGG+  +GAVPKQ
Sbjct:  22 IVYFSSISNNTHRFIEKLGFQHKRIPVDITQSITVSNEYVLICPTYSGGGNQVEGAVPKQ 81

Query:  66 VVQFLNVRQNREHCQGVISSGNTNFGDTYAIAGPIIARKLNVPLLHQFELLGTQEDVTRV 125
           V+QFLN + NRE C+GVI+SGNTNFGDT+ +AG +I++KLNVPLL+QFELLGT+ DV +
Sbjct:  82 VIQFLNNKHNRELCRGVIASGNTNFGDTFCLAGTVISKKLNVPLLYQFELLGTKNDVEQT 141

Query: 126 KELLCQF 132
           ++++  F
Sbjct: 142 QKIIANF 148
```

A related DNA sequence was identified in *S. pyogenes* <SEQ ID 809> which encodes the amino acid sequence <SEQ ID 810>. Analysis of this protein sequence reveals the following:

A related DNA sequence was identified in *S. pyogenes* <SEQ ID 809> which encodes the amino acid sequence <SEQ ID 810>. Analysis of this protein sequence reveals the following:

```
Possible site: 54
>>> Seems to have no N-terminal signal sequence

----- Final Results -----
        bacterial cytoplasm --- Certainty = 0.0089 (Affirmative) < succ>
         bacterial membrane --- Certainty = 0.0000 (Not Clear)   < succ>
          bacterial outside --- Certainty = 0.0000 (Not Clear)   < succ>
```

An alignment of the GAS and GBS proteins is shown below:

```
Identities = 84/125 (67%), Positives = 100/125 (79%)

Query:  7 VVYFSSKSNNTHRFVQKLACSNQRIPSDGSSILVTEDYILIVPTYAGGGDDTKGAVPKQV    66
          +VYFSSKS NTHRFVQKL   QRIP D  + V+ Y+LIVPTYA GG D KGAV KQV
Sbjct:  6 IVYFSSKSNNTHRFVQKLGLPAQRIPVDNRPLEVSTHYLLIVPTYAAGGSDAKGAVSKQV    65

Query: 67 VQFLNVRQNREHCQGVISSGNTNFGDTYAIAGPIIARKLNVPLLHQFELLGTQEDVTRVK   126
          ++FLN   NR+HC+GVISSGNTNFGDT+A+AGPII++KL VPLLHQFELLGT  DV +V+
Sbjct: 66 IRFLNNPNNRKHCKGVISSGNTNFGDTFALAGPIISQKLQVPLLHQFELLGTATDVKKVQ   125

Query: 127 ELLCQ                                                        131
            ++
Sbjct: 126 AIFAR                                                        130
```

Based on this analysis, it was predicted that these proteins and their epitopes could be useful antigens for vaccines or diagnostics.

EXAMPLE 256

A DNA sequence (GBSx0271) was identified in *S. agalactiae* <SEQ ID 811> which encodes the amino acid sequence <SEQ ID 812>. This protein is predicted to be ribonucleoside-diphosphate reductase beta chain (nrdF). Analysis of this protein sequence reveals the following:

```
Possible site: 27

>>> Seems to have no N-terminal signal sequence

----- Final Results -----
            bacterial cytoplasm --- Certainty = 0.3889 (Affirmative) < succ> bacterial membrane --- Certainty = 0.0000 (Not Clear)   < succ> bacterial outside --- Certainty = 0.0000 (Not Clear)   < succ>
```

The protein has homology with the following sequences in the GENPEPT database:

```
>GP:AAB96162 GB:AE000050 ribonucleoside-diphosphate reductase beta
chain [Mycoplasma pneumoniae]

Identities = 261/335 (77%), Positives = 301/335 (88%)

Query:   2 QSYYDRSQSPLDYALSEKAFPMRSVNWNKLNDDKDLEVWNRVTQNFWLPSKIPVSNDLNS    61
           + Y+  S SPL+YA +    +RSVNWN ++D+KDLEVWNR+TQNFWLPEKIPVSND+ S
Sbjct:   5 KKYFLESVSPLEYAQKKPQGNLRSVNWNLVDDEKDLEVWNRITQNFWLPEKIPVSNDIPS    64

Query:  62 WRTLDADWQQLITRTFTGLTLLDSVQATVGDIAQIKHSQTDHSQVIYANFAFMVAIHARS   121
           W+ L  +WQ LIT+TFTGLTLLD++QAT+GDI QI ++ TDHSQVIYANFAFMV +HARS
Sbjct:  65 WKQLSKEWQDLITKTFTGLTLLDTIQATIGDIKQIDYALTDHEQVIYANFAFMVGVHARS   124

Query: 122 YGTIFSTLCTSQQIEEAHEWVVDTESLQARSRILIPFYTGDDPLKSKVAAAMMPGFLLYG   181
           YGTIFSTLCTS+QI EAHEWVV TESLQ R++ LIP+YTG DPLKSKVAA+MPGFLLYG
```

```
                          -continued
Sbjct: 125 YGTIFSTLCTSEQITEAHEWVVKTESLQKRAKALIPYYTGKDPLKSKVAAALMPGFLLYG  184

Query: 182 GFYLPFYLSARGKLPNTSDIIRLILRDKVIHNYYSGYKYQQKVAKLSVEKQAEMKTFVFD  241
           GFYLPFYLS+R +LPNTSDIIRLILRDKVIHNYYSGYK+Q+KV K+S EKQAEMK FVFD
Sbjct: 185 GFYLPFYLSSRKQLPNTSDIIRLILRDKVIHNYYSGYKFQRKVEKMSKEKQAEMKRFVFD  244

Query: 242 LLYQLIDLEKAYLYELYDGEDLAEDAIRFSIYNAGKFLQNLGYDSPFTEEETRISPEVFA  301
           L+Y+LI+LEKAYL ELY+GF + EDAI+FSIYNAGKFLQNLGYDSPFTSEESTRI PE+FA
Sbjct: 245 LMYELIELEKAYLKELYEGEGIVEDAIKFSIYNAGKFLQNLGYDSPFTSEETRIKPEIFA  304

Query: 302 QLSARADENHDFFSGMGSSYIMGITEETLDEDWEF                           336
           QLSARADENHDFFSGNGSSY+MGI+EET D+DW+F
Sbjct: 305 QLSARADENHDFFSGNGSSYVMGISEETEDKDWDF                           339
```

A related DNA sequence was identified in *S. pyogenes* <SEQ ID 813> which encodes the amino acid sequence <SEQ ID 814>. Analysis of this protein sequence reveals the following:

```
Possible site: 18

>>> Seems to have no N-terminal signal sequence

----- Final Results -----
            bacterial cytoplasm --- Certainty = 0.3779 (Affirmative) < succ> bacterial membrane --- Certainty = 0.0000 (Not Clear)   < succ> bacterial outside --- Certainty = 0.0000 (Not Clear)   < succ>
```

An alignment of the GAS and GBS proteins is shown below:

```
Identities = 292/335 (87%), Positives = 318/335 (94%)

Query:   2 QSYYDRSQSPLDYALSEKAFPMRSVNWNKLNDDKDLEVWNRVTQNFWLPEKIPVSNDLNS   61
           Q YY+RSQSP++YALSE    +RS+NWN LNDDKDLEVWNRVTQNFWLPEK+PVSNDLNS
Sbjct:   3 QHYYERSQSPIEYALSETQKQLRSINWNYLNDDKDLEVWNRVTQNFWLPEKVPVSNDLNS   62

Query:  62 WRTLDADWQQLITRTFTGLTLLDSVQATVGDIAQIKHSQTDHEQVIYANFAFMVAIHARS  121
           WR+L  DWQQLITRT+TGLTLLD+VQATVGD+AQI+HSQTDHEQVIY NFAFMV IHARS
Sbjct:  63 WRSLGEDWQQLITRTYTGLTLLDTVQATVGDVAQIQHSQTDHEQVIYTNFAFMVGIHARS  122

Query: 122 YGTIFSTLCTSQQIEEAHEWVVDTESLQARSRILIPFYTGDDPLKSKVAAAMMPGFLLYG  181
           YGTIFSTLC+S+QIEEAHEWVV T+SLQ R+R+LIP+YTGDDPLKSKVAAAMMPGFLLYG
Sbjct: 123 YGTIFSTLCSSEQIEEAHEWVVSTQSLQDRARVLIPYYTGDDPLKSKVAAAMMPGFLLYG  182

Query: 182 GFYLPFYLSARGKLPNTSDIIRLILRDKVIHNYYSGYKYQQKVAKLSVEKQAEMKTFVFD  241
           GFYLPFYLSARGK+PNTSDIIRLILRDKVIHNYYSGYKYQQKVA+LS EKQAEMK FVFD
Sbjct: 183 GFYLPFYLSARGKMPNTSDIIRLILRDKVIHNYYSGYKYQQKVARLSPEEQAEMKAFVFD  242

Query: 242 LLYQLIDLEKAYLYELYDGFDLAEDAIRWSIYNAGKFLQNLGYDSPFTEEETRISPEVFA  301
           LLY+LIDLEKAYL ELY GFDLAEDAIRFS+YNAGKFLQNLGY+SPFT+EETR+SPEVFA
Sbjct: 243 LLYELIDLEKAYLRELYAGFDLAEDAIRFSLYNAGKFLQNLGYESPFTDEETRVSPEVFA  302

Query: 302 QLSARADENHDFFSGNGSSYIMGITEETLDEDWEF                           336
           QLSARADENHDFFSGNGSSY+MGITEET D+DWEF
Sbjct: 303 QLSARADENHDFFSGNGSSYVHGITEETTDDDWEF                           337
```

Based on this analysis, it was predicted that these proteins and their epitopes could be useful antigens for vaccines or diagnostics.

EXAMPLE 257

A DNA sequence (GBSx0272) was identified in *S. agalactiae* <SEQ ID 815> which encodes the amino acid sequence <SEQ ID 816>. This protein is predicted to be rhamnosyltransferase. Analysis of this protein sequence reveals the following:

```
Possible site: 55

>>> Seems to have no N-terminal signal sequence

----- Final Results -----
            bacterial cytoplasm --- Certainty = 0.1741 (Affirmative) < succ> bacterial membrane  --- Certainty = 0.0000 (Not Clear)   < succ> bacterial outside   --- Certainty = 0.0000 (Not Clear)   < succ>
```

A related GBS nucleic acid sequence <SEQ ID 9583> which encodes amino acid sequence <SEQ ID 9584> was also identified.

The protein has homology with the following sequences in the GENPEPT database:

```
>GP:BAA32090 GB:AB010970 rhamnosyltransferase [Streptococcus mutans]

Identities = 104/309 (33%), Positives = 173/309 (55%), Gaps = 21/309 (6%)

Query:  11 QINICLATYNGQKYLRQQLDSIIQQGYTDWICLIRDDGSTDDTVAIIKEYVNRDSRFIFI    70
           ++NI  ++TYNGQ+++ QQ+ SI +Q + +W LIRDDGS+D T  II ++   D+R  FI
Sbjct:   2 KVNILMSTYNGQEFIAQQIQSIQKQTFENWNLLIRDDGSSDGTPKIIADFAKSDARIRFI    61

Query:  71 NSNDDRKLGSHRSFYELVNYKKADFYVFSDQDDVWKENRLERYLEEAEKFNQELPLLVYS   130
           N++      G  ++FY L+ Y+KAD+Y FSDQDDVW   +LE  L    EK N ++PL+VY+
Sbjct:  62 NADKRENFGVIKNFYTLLKYEKADYYFFSDQDDVWLPQKLELTLASVEKENNQIPLNVYT   121

Query: 131 NWTSVDEKLTVL-------KEHNPATVIQEQIAFNQINGMVINMNNELAKLWE--YRQIG   181
           + T VD  L VL       + H+  T + E++  N + G  +M+NH LAK QW+ Y  +
Sbjct: 122 DLTVVDRDLQVLHDSMIKTQSHHANTSLLEELTENTVTGGTMMVNHCLAKQWKQCYDDLI   181

Query: 182 AHDSYVGTLAYAVGNVAYISDSTVLWRRQ----VGAES----LNNYGRQYG-VATFWQMI   232
           HD Y+  LA ++G + Y+ ++T L+R+     +GA +     L N+ R  + V  +W ++
Sbjct: 182 MHDWYLALLAASLGKLIYLDETTELYRQHESNVLGARTWSKRLKNWLRPHRLVKKYWWLV   241

Query: 233 NTSFDRASLIFAQVSDKNSLERKLFFSRFIELKNANLMRRIYLLSKLKLRRKSLKETVAN   292
           +S  +AS +  +    +   K     ++ L + + RI  L +       +      T
Sbjct: 242 TSSQQQASHL---LELDLPAANKAIIRAYVTLLDQSFLNRIKWLKQYGFAKNRAFHTFVF   298

Query: 293 TILLLTGYG                                                     301
           L++T +G
Sbjct: 299 KTLIITKFG                                                     307
```

Based on this analysis, it was predicted that these proteins and their epitopes could be useful antigens for vaccines or diagnostics.

EXAMPLE 258

A DNA sequence (GBSx0273) was identified in *S. agalactiae* <SEQ ID 819> which encodes the amino acid sequence <SEQ ID 820>. Analysis of this protein sequence reveals the following:

```
Possible site: 36

>>> Seems to have no N-terminal signal sequence

INTEGRAL    Likelihood = -4.19   Transmembrane 1213-1229 (1211-1230)

----- Final Results -----
            bacterial membrane  --- Certainty = 0.2678 (Affirmative) < succ> bacterial outside   --- Certainty = 0.0000 (Not Clear)   < succ> bacterial cytoplasm --- Certainty = 0.0000 (Not Clear)   < succ>
```

A related GBS nucleic acid sequence <SEQ ID 9581> which encodes amino acid sequence <SEQ ID 9582> was also identified.

There is also homology to SEQ ID 822.

A related GBS gene <SEQ ID 8525> and protein <SEQ ID 8526> were also identified. Analysis of this protein sequence reveals the following:

```
Lipop: Possible site: -1   Crend: 7

SRCFLG: 0

McG: Length of UR: 3

Peak Value of UR: 2.28

Net Charge of CR: 4

McG: Discrim Score: 1.29

GvH: Signal Score (-7.5): 2.84

Possible site: 30

>>> Seems to have a cleavable N-term signal seq.

Amino Acid Composition: calculated from 31

ALOM program count: 0 value:   1.16 threshold: 0.0

PERIPHERAL Likelihood = 1.16      344 modified ALOM score: -0.73

*** Reasoning Step: 3

----- Final Results -----
              bacterial outside --- Certainty = 0.3000 (Affirmative) < succ> bacterial membrane --- Certainty = 0.0000 (Not Clear) < succ> bacterial cytoplasm --- Certainty = 0.0000 (Not Clear) < succ>

LPXTG motif: 1197-1201
```

Figure 29:
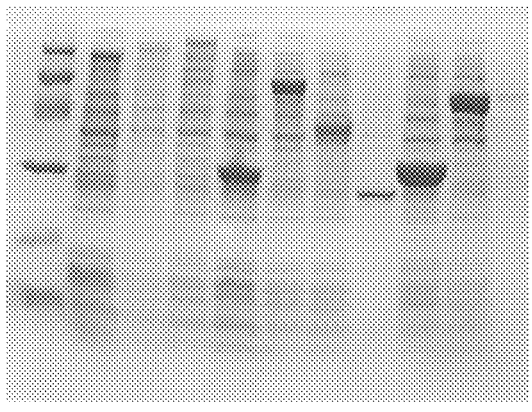

SEQ ID 8526 (GBS147) was expressed in *E. coli* as a His-fusion product. SDS-PAGE analysis of total cell extract is shown in FIG. 29 (lane 4; MW 132 kDa).

Figure 286:
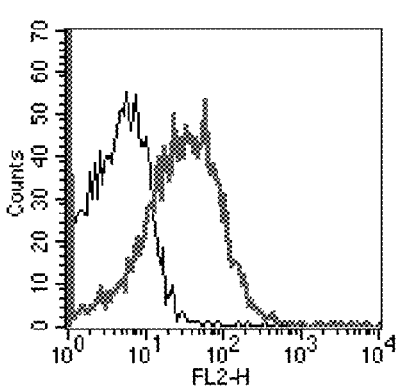

The GBS147-His fusion product was purified (FIG. 200, lane 5) and used to immunise mice. The resulting antiserum was used for FACS (FIG. 286), which confirmed that the protein is immunoaccessible on GBS bacteria.

Based on this analysis, it was predicted that these proteins and their epitopes could be useful antigens for vaccines or diagnostics.

EXAMPLE 259

A DNA sequence (GBSx0274) was identified in *S. agalactiae* <SEQ ID 823> which encodes the amino acid sequence <SEQ ID 824>. This protein is predicted to be Acetyltransferase (GNAT) family. Analysis of this protein sequence reveals the following:

```
Possible site: 57

>>> Seems to have no N-terminal signal sequence

----- Final Results -----
              bacterial cytoplasm --- Certainty = 0.2781 (Affirmative) < succ> bacterial membrane --- Certainty = 0.0000 (Not Clear) < succ> bacterial outside --- Certainty = 0.0000 (Not Clear) < succ>
```

The protein has homology with the following sequences in the GENPEPT database:

```
>GP: AAG03505 GB: AE004449 conserved hypothetical protein [Pseudomonas
aeruginosa]
Identities = 66/143 (46%), Positives = 94/143 (65%), Gaps = 5/143 (3%)

Query:    2 WNVKTFDNLTTHELFQIYKLRVSVFVVEQDCPYQEVDDEDLI--CLHGMNWVDGQLAAYY   59
            W  K    +LT  EL+ + +LR  VFVVEQ CPYQEVD  DL+    H M W DGQL AY
Sbjct:    5 WTCKHHADLTLKELYALLQLRTEVFVVEQKCPYQEVDGLDLVGDTHHLMAWRDGQLLAYL   64

Query:   60 RLIP---EDDKVHLGRVIVNPDFRKKGLGNQLVEYAIKFSEANYPNKPIYAQAQAYLQDF  116
            RL+       + +V +GRV+ +    R +GLG+QL+E A++ +E  + + P+Y  AQA+LQ +
Sbjct:   65 RLLDPVRHEGQVVIGRVVSSSAARGQGLGHQLMERALQAAERLWLDTPVYLSAQAHLQAY  124

Query:  117 YQSFGFQPVSDIYLEDNIPHLDM                                      139
            Y  +GF   V+++YLED+IPH+ M
Sbjct:  125 YGRYGFVAVTEVYLEDDIPHIGM                                      147
```

No corresponding DNA sequence was identified in *S. pyogenes*.

Based on this analysis, it was predicted that this protein and its epitopes, could be useful antigens for vaccines or diagnostics.

EXAMPLE 260

A DNA sequence (GBSx0275) was identified in *S. agalactiae* <SEQ ID 825> which encodes the amino acid sequence <SEQ ID 826>. Analysis of this protein sequence reveals the following:

```
Possible site: 37
>>> Seems to have no N-terminal signal sequence

----- Final Results -----
          bacterial cytoplasm --- Certainty = 0.2010(Affirmative) < succ>
           bacterial membrane --- Certainty = 0.0000(Not Clear)   < succ>
            bacterial outside --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 261

A DNA sequence (GBSx0276) was identified in *S. agalactiae* <SEQ ID 827> which encodes the amino acid sequence <SEQ ID 828>. Analysis of this protein sequence reveals the following:

```
Possible site: 39
>>> Seems to have no N-terminal signal sequence

----- Final Results -----
          bacterial cytoplasm --- Certainty = 0.2935(Affirmative) < succ>
           bacterial membrane --- Certainty = 0.0000(Not Clear)   < succ>
            bacterial outside --- Certainty = 0.0000(Not Clear)   < succ>
```

The protein has homology with the following sequences in the GENPEPT database:

```
>GP: CAB12631 GB: Z99108 similar to RNA methyltransferase [Bacillus
subtilis]
Identities = 217/448 (48%), Positives = 298/448 (66%), Gaps = 4/448 (0%)
```

```
Query:    7 QRIPLKIKRMGINGEGIGFYKKTLIFVPGALKGEEVFCQISSVRRNFAEAKLLKINKKSK   66
            Q  PL IKR+GINGEG+G++KK ++FVPGAL GEEV Q + V+  F+E ++ KI K S+
Sbjct:   16 QTFPLTIKRLGINGEGVGYFKKKVVFVPGALPGEEVVVQATKVQPKFSEGRIKKIRKASE   75

Query:   67 NRVEPPCSIYKECGGCQIMHLQYDKQLEFKTDVIRQALMKFKPEGYENYEIRKTIGMSEP  126
            +RV PPC +Y++CGGCQ+ HL Y +QL   K D++ Q+L +      EN EI++TIGM  P
Sbjct:   76 HRVAPPCPVYEQCGGCQLQHLAYSQQLREKRDIVIQSLERHTKFKVENMEIKETIGMDNP  135

Query:  127 EHYRAKLQFQV-RSFGGNVKAGLYAQGTHRLIDIKDCLVQDSLTQEMINRVAELLGKYKL  185
             +YR K QFQ+ RS  G++ AGLY   +H ++ IKDC+VQ   T +    V  +L + +
Sbjct:  136 WNYRNKSQFQIGRSQSGSIIAGLYGLDSHDIVPIKDCIVQHPATNKTTGIVRRILEDFNV  195

Query:  186 PIYNERKIAG-VRTVMIRRAQASGEVQLIFITSKRL--DFDDVVIELVREFPELKTVAVN  242
            +YNERK  G VRT++ R     +GEVQ++ +T+K       +++V + +  PE+K++  N
Sbjct:  196 SVYNERKRKGDVRTIVTRVGFETGEVQVVLVTAKETLPHKEEIVKAIQKRLPEVKSIIQN  255

Query:  243 INASKTSDIYGQITEVIWGQESINEEVLDYGFSLSPRAFYQLNPKQTQILYSEAVKALDV  302
            +N +KTS I+G+ T+ + G+   I E + D  F LS RAF+QLNP+QT  LY E  KA  +
Sbjct:  256 VNGAKTSVIFGEKTKQLAGKTVIQEVLGDVSFELSARAFFQLNPEQTVKLYDEVKKAAQL  315

Query:  303 KEDDDLIDAYCGVGTIGLAFAGKVKSVRGMDIIPEAIQDAKENALYMGFTNTHYEAGKAE  362
              + ++DAYCGVGTIG+  A    K VRGMD+I E+I DAK+NA    G  N Y  G AE
Sbjct:  316 TGKEKVVDAYCGVGTIGMWVADGAKEVRGMDVIKESIDDAKKNAKKHGMANATYVTGTAE  375

Query:  363 DIIPRWYSEGFRANALIVDPPRTGLDDKLLNTILKMPPEKMVYVSCNTSTLARDLVTLTK  422
             +P+W  EGFR + +IVDPPRTG D    L+TI K+ P++ VYVSCN STLA+DL TL+K
Sbjct:  376 HWLPKWTKEGFRPDVVIVDPPRTGCDSTFLDTIKKVKPKRFVYVSCNPSTLAKDLQTLSK  435

Query:  423 VYHVHYIQSVDMFPHTARTEAVVKLQRK                                 450
             Y V YIQ VDMFP TA  EAV +L  K
Sbjct:  436 DYRVDYIQPVDMFPQTAHVEAVARLVLK                                 463
```

A related DNA sequence was identified in *S. pyogenes* <SEQ ID 829> which encodes the amino acid sequence <SEQ ID 830>. Analysis of this protein sequence reveals the following:

```
Possible site: 56
>>> Seems to have no N-terminal signal sequence

----- Final Results -----
         bacterial cytoplasm --- Certainty = 0.2980(Affirmative) < succ>
          bacterial membrane --- Certainty = 0.0000(Not Clear)   < succ>
           bacterial outside --- Certainty = 0.0000(Not Clear)   < succ>
```

An alignment of the GAS and GBS proteins is shown below:

```
Identities = 327/450 (72%), Positives = 397/450 (87%)

Query:    1 MNVVLKQRIPLKIKRMGINGEGIGFYKKTLIFVPGALKGEEVFCQISSVRRNFAEAKLLK   60
            M V +KQ+IPLKIKRMGINGEGIGFY+KTL+FVPGALKGE++FCQI++V+RNFAEAKLL
Sbjct:    1 MVVKVKQKIPLKIKRMGINGEGIGFYQKTLVFVPGALKGEDIFCQITAVKRNFAEAKLLT   60

Query:   61 INKKSKNRVEPPCSIYKECGGCQIMHLQYDKQLEFKTDVIRQALMKFKPEGYENYEIRKT  120
            +NK SKNRV+P CS+Y+ CGGCQIMHL Y KQL+FK DVIRQAL KFKP GYE +EIR T
Sbjct:   61 VNKASKNRVKPACSVYETCGGCQIMHLAYPKQLDFKDDVIRQALKKFKPTGYEQFEIRPT  120

Query:  121 IGMSEPEHYRAKLQFQVRSFGGNVKAGLYAQGTHRLIDIKDCLVQDSLTQEMINRVAELL  180
            +GM +P+HYRAKLQFQ+RSFGG VKAGL++QG+HRL+ I +CLVQD LTQ++IN++ +L+
Sbjct:  121 LGMKKPDHYRAKLQFQLRSFGGTVKAGLFSQGSHRLVPIDNCLVQDQLTQDIINKITQLV  180

Query:  181 GKYKLPIYNERKIAGVRTVMIRRAQASGEVQLIFITSKRLDFDDVVIELVREFPELKTVA  240
             KYKLPIYNERKIAG+RT+M+R+AQAS +VQ+I ++SK +   + EL + FP++KTVA
Sbjct:  181 DKYKLPIYNERKIAGIRTIMVRKAQASDQVQIIVVSSKEVRLANFIGELTKAFPQVKTVA  240

Query:  241 VNINASKTSDIYGQITEVIWGQESINEEVLDYGFSLSPRAFYQLNPKQTQILYSEAVKAL  300
            +N N SK+S+IYG TE++WGQE+I+EEVLDYGF+LSPRAFYQLNP+QT++LY E VKAL
Sbjct:  241 LNSNRSKSSEIYGDETEILWGQEAIHEEVLDYGFALSPRAFYQLNPQQTEVLYGEVVKAL  300

Query:  301 DVKEDDDLIDAYCGVGTIGLAFAGKVKSVRGMDIIPEAIQDAKENALYMGFTNTHYEAGK  360
            DV    D +IDAYCGVG+IG AFAGKVKSVRGMDIIPEAI+DA++NA  MGF N +YEAGK
Sbjct:  301 DVGSKDHIIDAYCGVGSIGFAFAGKVKSVRGMDIIPEAIEDAQKNKAMGFDNAYYEAGK  360
```

```
-continued
Query:  361 AEDIIPRWYSEGFRANALIVDPPRTGLDDKLLNTILKMPPEKMVYVSCNTSTLARDLVTL  420
            AEDII +WY +G+RA+A+IVDPPRTGLDDKLL TIL   P++MVYVSCNTSTLARDLV L
Sbjct:  361 AEDIISKWYKQGYRADAVIVDPPRTGLDDKLLKTILHYQPKQMVYVSCNTSTLARDLVQL  420

Query:  421 TKVYHVHYIQSVDMFPHTARTEAVVKLQRK                               450
            TKVY VHYIQSVDMFPHTARTEAVVKLQ++
Sbjct:  421 TKVYDVHYIQSVDMFPHTARTEAVVKLQKR                               450
```

Based on this analysis, it was predicted that these proteins and their epitopes could be useful antigens for vaccines or diagnostics.

EXAMPLE 262

A DNA sequence (GBSx0277) was identified in *S. agalactiae* <SEQ ID 831> which encodes the amino acid sequence <SEQ ID 832>. Analysis of this protein sequence reveals the following:

```
Possible site: 45
>>> Seems to have no N-terminal signal sequence

----- Final Results -----
            bacterial cytoplasm --- Certainty = 0.3505(Affirmative) < succ>
            bacterial membrane  --- Certainty = 0.0000(Not Clear)   < succ>
             bacterial outside  --- Certainty = 0.0000(Not Clear)   < succ>
```

The protein has homology with the following sequences in the GENPEPT database:

```
>GP: BAB04643 GB: AP001510 unknown conserved protein in B. subtilis
[Bacillus halodurans]
Identities = 74/263 (28%), Positives = 141/263 (53%),
Gaps = 9/263 (3%)

Query:   3 ITKIEKKKR---LYTLEL-DNTENLY---ITEDTIVHFMLSKGMIINAEKLENIKKFAQL   55
           IT+IE +KR   Y + + N +++Y   + E ++   L KG+ I+AE+++ I      ++
Sbjct:   4 ITRIEVQKRNNERYNIFIHQNGQDVYAFSVDEQVLIKQGLRKGLDIDAEQMKQILYEDEV   63

Query:  56 SYGKNLGLYYISFKQRTEKEVIKYLQQHDIDSKIIPQIIDNLKSENWINDKNYVQSFIQQ  115
              NL L+Y+S++ R+   EV  YL++ D +  II  ++   L  +  ++D  + ++FIQ
Sbjct:  64 QKTFNLALHYLSYRMRSVHEVRTYLKKKDREEPIIEHVLHRLTEQRLLDDHAFAEAFIQT  123

Query: 116 NLNTGDKGPYVIKQKLLQKGIKSKIIESELQAINFQDLASKISQKLYKKYQNKLPLKAL-  174
             T KGP +KQ+L +KG+  K IE  L    ++++   ++    L K+          +L
Sbjct: 124 KRATTSKGPLKLKQELAEKGVSEKTIEGALTTFSYEEQVEQVKAWLEKQKGRTFKGSSLA  183

Query: 175 -KDKLMQSLTTKGFDYQIVHTVIQNLEIEKDQELEEDLIYKELDKQYQKLSKKHDQYELK  233
            K KL + L  KG+   ++     ++ I++++E E + +    +K +K + K   +EL+
Sbjct: 184 WKQKLSRQLLAKGYTSPVIEEAFADVPIKQEEEEEWEALKAFGEKAMRKYAGKKTGWELQ  243

Query: 234 QRIINALMRKGYQYEDIKSALRE                                      256
           Q++  AL RKG+  E I+  L +
Sbjct: 244 QKVKQALYRKGFSLEMIERYLND                                      266
```

A related DNA sequence was identified in *S. pyogenes* <SEQ ID 833> which encodes the amino acid sequence <SEQ ID 834>. Analysis of this protein sequence reveals the following:

```
Possible site: 58
>>> Seems to have no N-terminal signal sequence

----- Final Results -----
            bacterial cytoplasm --- Certainty = 0.2388(Affirmative) < succ>
            bacterial membrane  --- Certainty = 0.0000(Not Clear)   < succ>
             bacterial outside  --- Certainty = 0.0000(Not Clear)   < succ>
```

An alignment of the GAS and GBS proteins is shown below:

```
Identities = 146/258 (56%), Positives = 190/258 (73%)

Query:    1 MKITKIEKKKRLYTLELDNTENLYITEDTIVHFMLSKGMIINAEKLENIKKFAQLSYGKN    60
            MKITKIEKKKRLY +ELDN E+LY+TEDTIV FMLSK   +++ ++LE++K FAQLSYGKN
Sbjct:    1 MKITKIEKKKRLYLIELDNDESLYVTEDTIVRFMLSKDKVLDNDQLEDMKHFAQLSYGKN    60

Query:   61 LGLYYISFKQRTEKEVIKYLQQHDIDSKIIPQIIDNLKSENWINDKNYVQSFIQQNLNTG   120
            L LY++SF+QR+ K+V  YL++H+I+  II   II  L+ E WI+D     ++I+QN   G
Sbjct:   61 LALYFLSFQQRSNKQVADYLRKHEIEEHIIADIITQLQEEQWIDDTKLADTYIRQNQLNG   120

Query:  121 DKGPYVIKQKLLQKGIKSKIIESELQAINFQDLASKISQKLYKKYQNKLPLKALKDKLMQ   180
            DKGP V+KQKLLQKGI S  I+  L   +F  LA K+SQKL+ KYQ KLP KALKDK+ Q
Sbjct:  121 DKGPQVLKQKLLQKGIASHDIDPILSQTDFSQLAQKVSQKLFDKYQEKLPPKALKDKITQ   180

Query:  181 SLTTKGFDYQIVHTVIQNLEIEKDQELEEDLIYKELDKQYQKLSKKHDQYELKQRIINAL   240
            +L TKGF Y +    + +L   ++D +  EDL+ KELDKQY+KLS+K+D Y LKQ++  AL
Sbjct:  181 ALLTKGFSYDLAKHSLNHLNFDQDNQEIEDLLDKELDKQYRKLSRKYDGYTLKQKLYQAL   240

Query:  241 MRKGYQYEDIKSALREYL                                            258
            +RKGY +DI   LR YL
Sbjct:  241 YRKGYNSDDINCKLRNYL                                            258
```

Based on this analysis, it was predicted that these proteins and their epitopes could be useful antigens for vaccines or diagnostics.

EXAMPLE 263

A DNA sequence (GBSx0278) was identified in *S. agalactiae* <SEQ ID 835> which encodes the amino acid sequence <SEQ ID 836>. Analysis of this protein sequence reveals the following:

```
Possible site: 33
>>> Seems to have no N-terminal signal sequence

----- Final Results -----
          bacterial cytoplasm --- Certainty = 0.3912(Affirmative) < succ>
           bacterial membrane --- Certainty = 0.0000(Not Clear)   < succ>
            bacterial outside --- Certainty = 0.0000(Not Clear)   < succ>
```

The protein has homology with the following sequences in the GENPEPT database:

```
>GP: BAB04659 GB: AP001510 unknown conserved protein in B. subtilis
[Bacillus halodurans]
Identities = 96/175 (54%), Positives = 122/175 (68%)

Query:    1 MRLPKEGDFITIQSYKHDGSLHRTWRDTMVLKTTENALIGVNDHTLVTENDGRRWVTREP    60
            M  PK G   I IQSYKH+GS+HR W +T+VLK T   +IG ND  LV E+DGR W TREP
Sbjct:    1 MNFPKVGSKIQIQSYKHNGSIHRIWEETIVLKGTSKVVIGGNDRILVKESDGRHWRTREP    60

Query:   61 AIVYFHKKYWFNIIAMIRETGVSYYCNLASPYILDPEALKYIDYDLDVKVFADGEKRLLD   120
            AI YF  + WFN I MIR  G+ +YCNL +P+  D EALKYIDYDLD+KVF D    +LLD
Sbjct:   61 AICYFDSEQWFNTIGMIRADGIYFYCNLGTPFTWDEEALKYIDYDLDIKVFPDMTFKLLD   120

Query:  121 VDEYEQHKAQMNYPTDIDYILKENVKILVEWINENKGPFSSSYINIWYKRYLELK       175
             DEY  H+  M YP +ID IL+ +V  LV WI++ KGPF+    ++ WY+R+L+ +
Sbjct:  121 EDEYAMHRKMMKYPPEIDRILQRSVDELVSWIHQRKGPFAPQFVESWYERFLQYR       175
```

A related DNA sequence was identified in *S. pyogenes* <SEQ ID 837> which encodes the amino acid sequence <SEQ ID 838>. Analysis of this protein sequence reveals the following:

```
Possible site: 33
>>> Seems to have no N-terminal signal sequence

----- Final Results -----
          bacterial cytoplasm --- Certainty = 0.3912(Affirmative) < succ>
           bacterial membrane --- Certainty = 0.0000(Not Clear)   < succ>
            bacterial outside --- Certainty = 0.0000(Not Clear)   < succ>
```

An alignment of the GAS and GBS proteins is shown below:

```
Identities = 155/177 (87%), Positives = 165/177 (92%)

Query:   1 MRLPKEGDFITIQSYKHDGSLHRTWRDTMVLKTTENALIGVNDHTLVTENDGRRWVTREP    60
           M+LPKEGDFITIQSYKHDGSLHRTWRDTMVLKTTENALIGVNDHTLVTE+DGRRWVTREP
Sbjct:   1 MKLPKEGDFITIQSYKHDGSLHRTWRDTMVLKTTENALIGVNDHTLVTESDGRRWVTREP    60

Query:  61 AIVYFHKKYWFNIIAMIRETGVSYYCNLASPYILDPEALKYIDYDLDVKVFADGEKRLLD   120
           AIVYFHKKYWFNIIAMIR+ GVSYYCNLASPY++D EALKYIDYDLDVKVFADGEKRLLD
Sbjct:  61 AIVYFHKKYWFNIIAMIRDNGVSYYCNLASPYMMDTEALKYIDYDLDVKVFADGEKRLLD   120

Query: 121 VDEYEQHKAQMNYPTDIDYILKENVKILVEWINENKGPFSSSYINIWYKRYLELKKR      177
           VDEYE HK +M Y  D+D+ILKENVKILV+WIN  KGPFS +YI IWYKRYLELK R
Sbjct: 121 VDEYEIHKKEMQYSADMDFILKENVKILVDWINHEKGPFSKAYITIWYKRYLELKNR      177
```

Based on this analysis, it was predicted that these proteins and their epitopes could be useful antigens for vaccines or diagnostics.

EXAMPLE 264

A DNA sequence (GBSx0288) was identified in *S. agalactiae* <SEQ ID 839> which encodes the amino acid sequence <SEQ ID 840>. This protein is predicted to be jag protein. Analysis of this protein sequence reveals the following:

```
Possible site: 49
>>> Seems to have no N-terminal signal sequence

----- Final Results -----
            bacterial cytoplasm --- Certainty = 0.1666(Affirmative) < succ>
            bacterial membrane  --- Certainty = 0.0000(Not Clear)   < succ>
             bacterial outside  --- Certainty = 0.0000(Not Clear)   < succ>
```

The protein has homology with the following sequences in the GENPEPT database:

```
>GP: BAB07782 GB: AP001520 spoIIIJ-associated protein
[Bacillus halodurans]
Identities = 54/198 (27%), Positives = 98/198 (49%), Gaps = 6/198 (3%)

Query: 100 DVVEEYIEEVDETLEKEDVSQPELPKIDDKNVVTTSEAIEKIDLLPNIEVAAAQVTKYVE   159
           +   VE+ I E+   T E+   + E PK    ++ + A+ ++ + P+       + ++E
Sbjct:  13 EAVEQAIIELGTTRERITYTVVEEPKSGLFGILGSKPAVIEVVVKPD---PVDRAKAFLE    69

Query: 160 NIIYEMDLDA--TIETTTSKRQINLQIETPEAGRIIGYHGKVLKSLQLLAQNYLHDRFSK   217
           ++ EMD++    TIE  +   N+ E  + G +IG  G+ L SLQ L     +    +
Sbjct:  70 ELLQEMDMEVEVTIEKDPATVLFNISGEQ-DLGTLIGKRGQTLDSLQYLVNLVANKEEGE   128

Query: 218 SFSVSINVHDYVEHRTETLIDFSKKIARRVLETNEPYHMDPMSNSERKTVHKTIATIEGV   277
           + ++  +Y  R E L+ ++++A + L T P  ++PMS  ERK +H  +  +    V
Sbjct: 129 FIRIKLDAENYRARRKEALVQLAERLASKALRTKRPVSLEPMSAHERKIIHTALQELGDV   188

Query: 278 ESYSEGNDPNRFVVVTKK                                             295
           E+YSEG    R VV+ K
Sbjct: 189 ETYSEGQGIGRHVVIAPK                                             206
```

A related DNA sequence was identified in *S. pyogenes* <SEQ ID 841> which encodes the amino acid sequence <SEQ ID 842>. Analysis of this protein sequence reveals the following:

```
Possible site: 27
>>> Seems to have no N-terminal signal sequence

----- Final Results -----
            bacterial cytoplasm --- Certainty = 0.3721(Affirmative) < succ>
            bacterial membrane  --- Certainty = 0.0000(Not Clear)   < succ>
             bacterial outside  --- Certainty = 0.0000(Not Clear)   < succ>
```

An alignment of the GAS and GBS proteins is shown below:

```
Identities = 176/302 (58%), Positives = 223/302 (73%), Gaps = 32/302 (10%)

Query:   23 MVLFTGATVEEAIEKGLQELNISRLRAHIKVVSREKKGFLGFGKKPAKVEIEGITDEVTD     82
            MVLFTG TVEEAIE GLQEL +SRL+AHIKV+S+EKKGFLGFGKKPA+V+IEGI+D+
Sbjct:    1 MVLFTGKTVEEAIETGLQELGLSRLKAHIKVISKEKKGFLGFGKKPAQVDIEGISDKTVY    60

Query:   83 INESVALKNI------KNVPS--SVDVVEEYIEEVDETLEKEDVSQPELPKIDDK-----   129
             + A + +       +N P+  S DV  E I+   + LE ED        L    D
Sbjct:   61 KADKKATRGVPEDINRQNTPAVNSADVEPEEIKAT-QRLEAEDTKVVPLMSEDSPAQTPS   119

Query:  130 ---NVVTTSEA------IEKIDL---------LPNIEVAAAQVTKYVENIIYEMDLDATI   171
               VT ++A       +E+ ++           +IE AA +V+ YV   IIYEMD++AT+
Sbjct:  120 NLAETVTETKAQQPSIPVEESEVPQDAGNDGFSKDIEKAAQEVSDYVTKIIYEMDIEATV   179

Query:  172 ETTTSKRQINLQIETPEAGRIIGYHGKVLKSLQLLAQNYLHDRFSKSFSVSINVHDYVEH   231
            ET+ ++RQINLQIETPEAGR+IGYHGKVLKSLQLLAQN+LHDR+SK+FSVS+NVHDYVEH
Sbjct:  180 ETSNNRRQINLQIETPEAGRVIGYHGKVLKSLQLLAQNFLHDRYSKNFSVSLNVHDYVEH   239

Query:  232 RTETLIDFSKKIARRVLETNEPYHMDPMSNSERKTVHKTIATIEGVESYSEGNDPNRFVV   291
            RTETLIDF++K+A+RVLE+ + Y MDPMSNSERK VHKT+++IEGV+SYSEGNDPNR+VV
Sbjct:  240 RTETLIDFTQKVAKRVLESGQDYTMDPMSNSERKIVHKTVSSIEGVDSYSEGNDPNRYVV   299

Query:  292 VT                                                            293
            V+
Sbjct:  300 VS                                                            301
```

Based on this analysis, it was predicted that these proteins and their epitopes could be useful antigens for vaccines or diagnostics.

EXAMPLE 265

A DNA sequence (GBSx0290) was identified in *S. agalactiae* <SEQ ID 843> which encodes the amino acid sequence <SEQ ID 844>. This protein is predicted to be 60 kd inner-membrane protein (yidC). Analysis of this protein sequence reveals the following:

```
Possible site: 42
>>> May be a lipoprotein
    INTEGRAL    Likelihood = -7.38    Transmembrane    54-70   (52-75)
    INTEGRAL    Likelihood = -5.20    Transmembrane    193-209 (192-211)
    INTEGRAL    Likelihood = -3.61    Transmembrane    125-141 (124-144)
    INTEGRAL    Likelihood = -2.44    Transmembrane    168-184 (167-184)

----- Final Results -----
            bacterial membrane  --- Certainty = 0.3951(Affirmative) < succ>
            bacterial outside   --- Certainty = 0.0000(Not Clear)  < succ>
            bacterial cytoplasm --- Certainty = 0.0000(Not Clear)  < succ>
```

The protein has homology with the following sequences in the GENPEPT database:

```
>GP: CAA78595 GB: Z14225 SpoIIIJ [Bacillus subtilis]
Identities = 79/243 (32%), Positives = 142/243 (57%), Gaps = 5/243 (2%)

Query:    1 MKKKLKTFSLILLTGSLLVACG--RGEVSSHSATLWEQ-IVYAFAKSIQWLS--FNHSIG    55
            MK+++      S    ++  LL C  +   +++ S     W++ +VY  ++ I +++     + G
Sbjct:    1 MKRRIGLLLSMVGVFMLLAGCSSVKEPITADSPHFWDKYVVYPLSELITYVAKLTGDNYG    60

Query:   56 LGIILFTLIIRAIMMPLYNMQMKSSQKMQEIQPRLKELQKKYPGKDPDNRLKLNDEMQSM   115
            L  IIL T++IR +++PL   Q++SS+ MQ +QP +++L++KY  KD   + KL  E ++
Sbjct:   61 LSIILVTILIRLLILPLMIKQLRSSKAMQALQPEMQKLKEKYSSKDQKTQQKLQQETMAL   120

Query:  116 YKAEGVNPYASVLPLLIQLPVLWALFQALTRVSFLKVGTFLSLELSQPDPYYILPVLAAL   175
             ++ GVNP A   P+LIQ+P+L   A+ R    +FL  +L + DPYYILP++A +
Sbjct:  121 FQKHGVNPLAGCFPILIQMPILIGFYHAIMRTQAISEHSFLWFDLGEKDPYYILPIVAGV   180

Query:  176 FTFPLSTWLTNKAAVEKNIALTLMTYVMPFIILVTSFNFASGVVLYWTVSNAFQVFQILLL   235
             TF+  L         ++N  +M  ++MP +I+V  NF + +  LYW V N F + Q  L+
Sbjct:  181 ATFVQQKLMMAGNAQQNPQMAMMLWIMPIMIIVFAINFPAALSLYWVVGNLFMIAQTFLI   240
```

-continued

```
Query: 236 NNP                                                           238
           P
Sbjct: 241 KGP                                                           243
```

A related GBS sequence was identified <SEQ ID 10783> which encodes amino acid sequence <SEQ ID 10784>.

A related DNA sequence was identified in *S. pyogenes* <SEQ ID 845> which encodes the amino acid sequence <SEQ ID 846>. Analysis of this protein sequence reveals the following:

```
Possible site: 49
>>> May be a lipoprotein
INTEGRAL    Likelihood = -6.32      Transmembrane       198-214 (197-220)
INTEGRAL    Likelihood = -5.52      Transmembrane        59-75  (57-80)
INTEGRAL    Likelihood = -4.25      Transmembrane       130-146 (129-150)
INTEGRAL    Likelihood = -2.28      Transmembrane       173-189 (170-189)

----- Final Results -----
              bacterial membrane --- Certainty = 0.3527 (Affirmative) < succ>
               bacterial outside --- Certainty = 0.0000 (Not Clear)   < succ>
             bacterial cytoplasm --- Certainty = 0.0000 (Not Clear)   < succ>
```

The protein has homology with the following sequences in the databases:

```
>GP: BAA05234 GB: D26185 stage III sporulation [Bacillus subtilis]
Identities = 90/249 (36%), Positives = 150/249 (60%), Gaps = 6/249 (2%)

Query:  16 IVPLVLLLVACG--RGEVTAQSSSGWDQ-LVYLFARAIQWLS--FDGSIGVGIILFTLTI   70
           +V + +LL  C    +TA S    WD+ +VY  +  I +++     + G+ IIL T+ I
Sbjct:  13 MVGVFMLLAGCSSVKEPITADSPHFWDKYVVYPLSELITYVAKLTGDNYGLSIILVTILI   72

Query:  71 RLMLMPLFNMQIKSSQKMQDIQPELRELQRKYAGKDTQTRMKLAEESQALYKKYGVNPYA  130
           RL+++PL   Q++SS+ MQ  +QPE+++L+  KY+  KD +T+  KL  +E+  AL++K+GVNP A
Sbjct:  73 RLLILPLMIKQLRSSKAMQALQPEMQKLKEKYSSKDQKTQQKLQQETMALFQKHGVNPLA  132

Query: 131 SLLPLLIQMPVMIALFQALTRVSFLKTGTFLWVELAQHDHLYLLPVLAAVFTFLSTWLTN  190
             P+LIQMP++I  + A+ R     +FLW +L + D   Y+LP++A V TF+    L
Sbjct: 133 GCFPILIQMPILIGFYHAIMRTQAISEHSFLWFDLGEKDPYYILPIVAGVATFVQQKLMM  192

Query: 191 LAAKEKNVMMTVMIYVMPLMIFFMGFNLASGVVLYWTVSNAFQVVQLLLLNNP-FKIIAE  249
               ++N  M +M+++MP+MI     N + + LYW V N F + Q  L+   P  K    E
Sbjct: 193 AGNAQQNPQMAMMLWIMPIMIIVFAINFPAALSLYWVVGNLFMIAQTFLIKGPDIKKNPE  252

Query: 250 RQRLANEEK                                                    258
           Q+    ++K
Sbjct: 253 PQKAGGKKK                                                    261
```

An alignment of the GAS and GBS proteins is shown below:

```
Identities = 172/270 (63%), Positives = 217/270 (79%), Gaps = 1/270 (0%)

Query:   1 MKKKLKTFSLILLTGSLLVACGRGEVSSHSATLWEQIVYAFAKSIQWLSFNHSIGLGIIL   60
           +KK +K  ++ L    LLVACGRGEV++ S++ W+Q+VY FA++IQWLSF+ SIG+GIIL
Sbjct:   7 VKKNIKIARIVPLV-LLLVACGRGEVTAQSSSGWDQLVYLFARAIQWLSFDGSIGVGIIL   65

Query:  61 FTLIIRAIMMPLYNMQMKSSQKMQEIQPRLKELQKKYPGKDPDNRLKLNDEMQSMYKAEG  120
           FTL IR ++MPL+NMQ +KSSQKMQ+IQP L+ELQ +KY GKD    R+KL +E Q++YK  G
Sbjct:  66 FTLTIRLMLMPLFNMQIKSSQKMQDIQPELRELQRKYAGKDTQTRMKLAEESQALYKKYG  125

Query: 121 VNPYASVLPLLIQLPVLWALFQALTRVSFLKVGTFLSLELSQPDPYYILPVLAALFTFLS  180
           VNPYAS+LPLLIQ+PV+ ALFQALTRVSFLK GTFL +EL+Q D  Y+LPVLAA+FTFLS
Sbjct: 126 VNPYASLLPLLIQMPVMIALFQALTRVSFLKTGTFLWVELAQHDHLYLLPVLAAVFTFLS  185

Query: 181 TWLTNKAAVEKNIALTLMTYVMPFIILVTSFNFASGVVLYWTVSNAFQVFQILLLNNPYK  240
           TWLTN AA EKN+ +T+M YVMP +I    FN ASGVVLYWTVSNAFQV QLLLLNNP+K
Sbjct: 186 TWLTNLAAKEKNVMMTVMIYVMPLMIFFMGFNLASGVVLYWTVSNAFQVVQLLLLNNPFK  245

Query: 241 IIKVREEAVRVAHEKEQRVKRAKRKASKKR                               270
           II  R+      E+  R +RA++KA K++
Sbjct: 246 IIAERQRLANEEKERRLRERRARKKAMKRK                               275
```

Based on this analysis, it was predicted that this protein and its epitopes, could be useful antigens for vaccines or diagnostics.

A related GBS gene <SEQ ID 8527> and protein <SEQ ID 8528> were also identified. Analysis of this protein sequence reveals the following:

```
Lipop: Possible site: 20 Crend: 5
McG: Discrim Score: 4.90
GvH: Signal Score (-7.5): -0.39
Possible site: 42
>>> May be a lipoprotein
ALOM program count: 4    value: -7.38                         threshold: 0.0
INTEGRAL                 Likelihood = -7.38  Transmembrane    54-70 (52-75)
INTEGRAL                 Likelihood = -5.20  Transmembrane    193-209 (192-211)
INTEGRAL                 Likelihood = -3.61  Transmembrane    125-141 (124-144)
INTEGRAL                 Likelihood = -2.44  Transmembrane    168-184 (167-184)
PERIPHERAL               Likelihood = 2.54                    217
modified ALOM score: 1.98

*** Reasoning Step: 3

----- Final Results -----
           bacterial membrane --- Certainty = 0.3951 (Affirmative) < succ>
            bacterial outside --- Certainty = 0.0000 (Not Clear)  < succ>
          bacterial cytoplasm --- Certainty = 0.0000 (Not Clear)  < succ>
```

The protein has homology with the following sequences in the databases:

```
32.8/62.3% over 242aa
Bacillus subtilis
EGAD|17722|stage III sporulation protein j precursor Insert characterized
OMNI|NT01BS4782-identity Insert characterized
SP|Q01625|SP3J_BACSU STAGE III SPORULATION PROTEIN J PRECURSOR. Edit characterized
GP|40023|emb|CAA44401.1||X62539 unnamed protein product Insert characterized
GP|467388|dbj|BAA05234.1||D26185 stage III sporulation Insert characterized
GP|2636651|emb|CAB16141.1||Z99124 alternate gene name: spo0J87 Insert characterized
PIR|I40437|I40437 stage III sporulation protein spoIIIJ-Insert characterized ORF02221(301-1014 of 1413)
EGAD|17722|S4098(3-245 of 261)stage III sporulation protein j precursor {acillus
subtilis} OMNI|NT01 S4782-indentitySP|Q01625|SP3J_ACSU STAGE III SPORULATION PROTEIN
J PRECURSOR.GP|40023|EMB|CAA44401.1||X62539 unnamed protein product {acillus
subtilis}GP|467388|dbj|AA05234.1||D26185 stage III sporulation {acillus
subtilis}GP|2636651|emb|CA 16141.1||Z99124 alternate gene name: spo0J87 {acillus
subtilis}PIR|I40437|I40437 stage III sporulatioon protein spoIIIJ-acillus subtilis
% Match = 17.0
% Identity = 32.8   % Similarity = 62.2
Matches = 79   Mismatches = 88   Conservative Sub.s = 71
         219         249         279         309         339                 393         420
DFVVIARKGVEELDYQALEKNLIHVLKIAGLI*KGIKLKKKLKTFSLILLTGSLLVACG--RGEVSSHSATLWEQ-IVYA
                : ||:::   :   ::     ||    |       :    :::  |    :|:: :||
                                MLLKRRIGLLLSMVGVFMLLAGCSSVKEPITADSPHEWDKYVVYP
                                         10        20        30        40

474         504         534         564         594         624         654
FAKSIQWLS--FNHSIGLGIILFTLIIRAIMMPLYNMQMKSSQKMQEIQPRLKELQKKYPGKDPDNRLKLNDEMQSMYKA
::: |  :::   :  |  |||  |::|| :::|:::|     |::||  ::  :|::||    ||    |     ::
LSELITYVAKLTGDNYGLSIILVTILIRLLILPLMIKQLRSSKAMQALQPEMQKLKEKYSSKDQKTQQKLQQETMALFQK
          60         70        80         90        100       110       120

684         714         744         774         804         834         864         894
EGVNPYASVLPLLIQLPVLWALFQALTRVSFLKVGTFLSLELSQPDPYYILPVLAALFTFLSTWLTNKAAVEKNIALTLM
  ||||
HGVNPLAGCFPILIQMPILIGFYHAIMRTQAISEHSFLWFDLGEKDPYYILPIVAGVATFVQQKLMMAGNAQQNPQMAMM
         140       150       160       170       180       190       200

924         954         984        1014        1044        1074        1104        1134
TYVMPFIILVTSFNFASGVVLYWTVSNAFQVFQILLLNNPYKIIKVREEAVRVAHEKEQRVKRAKRKASKKRK*ENHGII
::||  :|:|  :  ||  :   |||   |  |   |   :|:     |
LWIMPIMIIVFAINFPAALSLYWVVGNLFMIAQTFLIKGPDIKKNPEPQKAGGKKK
          220       230       240       250       260
```

60

EXAMPLE 266

A DNA sequence (GBSx0291) was identified in *S. agalactiae* <SEQ ID 847> which encodes the amino acid sequence <SEQ ID 848>. Analysis of this protein sequence reveals the following:

Possible site: 46
>>> Seems to have no N-terminal signal sequence

----- Final Results -----
            bacterial cytoplasm --- Certainty = 0.3778 (Affirmative) < succ>
             bacterial membrane --- Certainty = 0.0000 (Not Clear)  < succ>
              bacterial outside --- Certainty = 0.0000 (Not Clear)  < succ>

A related GBS nucleic acid sequence <SEQ ID 9579> which encodes amino acid sequence <SEQ ID 9580> was also identified.

The protein has homology with the following sequences in the GENPEPT database:

```
>GP: CAA44400 GB: X62539 homologous to E. coli rnpA [Bacillus subtilis]
Identities = 52/109 (47%), Positives = 77/109 (69%), Gaps = 1/109 (0%)

Query:  21 LKKTYRVKSDKDFQMIFSRGKNVANRKFVIYYLEK-EQKHFRVGISVSKKLGNAVVRNAI   79
           LKK  R+K ++DFQ +F   G +VANR+FV+Y L++ E     RVG+SVSKK+GNAV+RN I
Sbjct:   4 LKKRNRLKKNEDFQKVFKHGTSVANRQFVLYTLDQPENDELRVGLSVSKKIGNAVMRNRI   63

Query:  80 KRKIRHVLLSQKTALQDYDFVVIARKGVEELDYQALEKNLIHVLKIAGL            128
           KR IR   L +K  L++ D+++IARK   +L Y+  +K+L H+ + + L
Sbjct:  64 KRLIRQAFLEEKERLKEKDYIIIARKPASQLTYEETKKSLQHLFRKSSL            112
```

A related DNA sequence was identified in S. pyogenes <SEQ ID 849> which encodes the amino acid sequence <SEQ ID 850>. Analysis of this protein sequence reveals the following:

Possible site: 24
>>> Seems to have no N-terminal signal sequence

----- Final Results -----
            bacterial cytoplasm --- Certainty = 0.3820 (Affirmative) < succ>
             bacterial membrane --- Certainty = 0.0000 (Not Clear)  < succ>
              bacterial outside --- Certainty = 0.0000 (Not Clear)  < succ>

An alignment of the GAS and GBS proteins is shown below:

```
Identities = 73/109 (66%), Positives = 88/109 (79%)

Query:  21 LKKTYRVKSDKDFQMIFSRGKNVANRKFVIYYLEKEQKHFRVGISVSKKLGNAVVRNAIK   80
           LKKTYRVK +KDFQ IF  GK+ ANRKFVIY+L + Q HFRVGISV KK+GNAV RNA+K
Sbjct:   1 LKKTYRVKREKDFQAIFKDGKSTANRKFVIYHLNRGQDHFRVGISVGKKIGNAVTRNAVK   60

Query:  81 RKIRHVLLSQKTALQDYDFVVIARKGVEELDYQALEKNLIHVLKIAGLI            129
           RKIRHV+++    L+  DFVVIARKGV  L+YQ L++NL HVLK+A L+
Sbjct:  61 RKIRHVIMALGHQLKSEDFVVIARKGVHSLEYQELQQNLHHVLKLAQLL            109
```

Based on this analysis, it was predicted that these proteins and their epitopes could be useful antigens for vaccines or diagnostics.

EXAMPLE 267

A DNA sequence (GBSx0292) was identified in S. agalactiae <SEQ ID 851> which encodes the amino acid sequence <SEQ ID 852>. This protein is predicted to be glycerol-3-phosphate dehydrogenase, NAD-dependent (gpsA). Analysis of this protein sequence reveals the following:

Possible site: 33
>>> Seems to have no N-terminal signal sequence

----- Final Results -----
            bacterial cytoplasm --- Certainty = 0.1429 (Affirmative) < succ>

-continued
```
                 bacterial membrane --- Certainty = 0.0000 (Not Clear) < succ>
                 bacterial outside  --- Certainty = 0.0000 (Not Clear) < succ>
```

A related GBS nucleic acid sequence <SEQ ID 8529> which encodes amino acid sequence <SEQ ID 8530> was also identified. There is a signal peptide at residues 1-19. The protein has homology with the following sequences in the GENPEPT database:

```
>GP: AAA86746 GB: U32164 NAD(P)H-dependent dihydroxyacetone-phosphate
reductase [Bacillus subtilis]
Identities = 177/333 (53%), Positives = 241/333 (72%)

Query:  18 QKIAVLGPSWGTALAQVLNDNGHEVRLWGNVVEQIEEINTNHTNQRYFKDITLDSKIKA   77
             +K+ +LG GSWGTALA  VL DHG+EV +W +   + I +IN  H N+ Y  ++ L + IK
Sbjct:   2 KKVTMLGAGSWGTALALVLTDNGNEVCVWAHRADLIHQINELHENKDYLPNVKLSTSIKG   61

Query:  78 YTNLEEAINNVDSILFVVPTKVTRLVAKQVANLLKHKVVLMHASKGLEPGTHERLSTILE  137
             T+++EA+++ D I+  VPTK  R V +Q      + K V +H SKG+EP +   R+S I+E
Sbjct:  62 TTDMKEAVSDADVIIVAVPTKAIREVLRQAVPFITKKAVFVHVSKGIEPDSLLRISEIME  121

Query: 138 EEISEQYRSDIVVVSGPSHAEEAIVRDITLITAASKDIEAAKYVQKLFSNHYFRLYTNTD  197
              E+    R DIVV+SGPSHAEE  +R  T +TA+SK + AA+ VQ LF NH FR+YTN D
Sbjct: 122 IELPSDVRRDIVVLSGPSHAEEVGLRHATTVTASSKSMRAAEEVQDLFINHNFRVYTNPD  181

Query: 198 VVGVETAGALKNIIAVGAGALHGLGYGDNAKAAIITRGLAEITRLGVQLGADPLTFSGLS  257
             ++GVE  GALKNIIA+ AG   GLGYGDNAKAA+ITRGLAEI RLG ++G +PLTFSGL+
Sbjct: 182 IIGVEIGGALKNIIALAAGITDGLGYGDNAKAALITRGLAEIARLGTKMGGNPLTFSGLT  241

Query: 258 GVGDLIVTGTSVHSRNWRAGDALGRGEKLEDIEKNMGMVIEGISTTKVAYEIAQNLNVYM  317
             GVGDLIVT TSVHSRNWRAG+ LG+G KLED+ + MGMV+EG+ TTK AY++++   +V M
Sbjct: 242 GVGDLIVTCTSVHSRNWRAGNLLGKGYKLEDVLEEMGMVVEGVRTTKAAYQLSKKYDVKM  301

Query: 318 PITEAIYKSIYEGANIKDSILDMMSNEFRSENE                            350
             PITEA+++ ++ G  ++ ++  +M+     E E
Sbjct: 302 PITEALHQVLFNGQKVETAVESLMARGKTHEME                            334
```

A related DNA sequence was identified in *S. pyogenes* <SEQ ID 853> which encodes the amino acid sequence <SEQ ID 854>. Analysis of this protein sequence reveals the following:

```
Possible site: 19
>>> Seems to have no N-terminal signal sequence

----- Final Results -----
                 bacterial cytoplasm --- Certainty = 0.0882(Affirmative) < succ>
                 bacterial membrane  --- Certainty = 0.0000(Not Clear) < succ>
                 bacterial outside   --- Certainty = 0.0000(Not Clear) < succ>
```

An alignment of the GAS and GBS proteins is shown below:

```
Identities = 287/338 (84%), Positives = 316/338 (92%)

Query:  15 MTKQKIAVLGPSWGTALAQVLNDNGHEVRLWGNVVEQIEEINTNHTNQRYFKDITLDSK   74
             MTKQK+A+LGPSWGTAL+QVLNDNGH+VRLWGN+ +QIEEINT HTN+ YFKDI LD
Sbjct:   1 MTKQKVAILGPSWGTALSQVLNDNGHDVRLWGNIPDQIEEINTKHTNRHYFKDIVLDKN   60

Query:  75 IKAYTNLEEAINNVDSILFVVPTKVTRLVAKQVANLLKHKVVLMHASKGLEPGTHERLST  134
              I A   +L +A+++VD++LFVVPTKVTRLVA+QVA +L HKVV+MHASKGLEP THERLST
Sbjct:  61 ITATLDLGQALSDVDAVLFVVPTKVTRLVARQVAAILDHKVVVMHASKGLEPETHERLST  120

Query: 135 ILEEEISEQYRSDIVVVSGPSHAEEAIVRDITLITAASKDIEAAKYVQKLFSNHYFRLYT  194
             ILEEEI    +RS++VVVSGPSHAEE IVRDITLITAASKDIEAAKYVQ LFSNHYFRLYT
Sbjct: 121 ILEEEIPAHFRSEVVVVSGPSHAEETIVRDITLITAASKDIEAAKYVQSLFSNHYFRLYT  180

Query: 195 NTDVVGVETAGALKNIIAVGAGALHGLGYGDNAKAAIITRGLAEITRLGVQLGADPLTFS  254
             NTDV+GVETAGALKNIIAVGAGALHGLGYGDNAKAA+ITRGLAEITRLGV+LGADPLT+S
Sbjct: 181 NTDVIGVETAGALKNIIAVGAGALHGLGYGDNAKAAVITRGLAEITRLGVKLGADPLTYS  240

Query: 255 GLSGVGDLIVTGTSVHSRNWRAGDALGRGEKLEDIEKNMGMVIEGISTTKVAYEIAQNLN  314
             GLSGVGDLIVTGTSVHSRNWRAG ALGRGEKLEDIE+NMGMVIEGI+TTKVAYEIAQ+L
```

```
                         -continued
Sbjct: 241 GLSGVGDLIVTGTSVHSRNWRAGAALGRGEKLEDIERNMGMVIEGIATTKVAYEIAQDLG 300

Query: 315 VYMPITEAIYKSIYEGANIKDSILDMMSNEFRSENEWH                      352
           VYMPIT AIYKSIYEGA+IK+SIL MMSNEFRSENEWH
Sbjct: 301 VYMPITTAIYKSIYEGADIKESILGMMSNEFRSENEWH                      338
```

Figure 59:
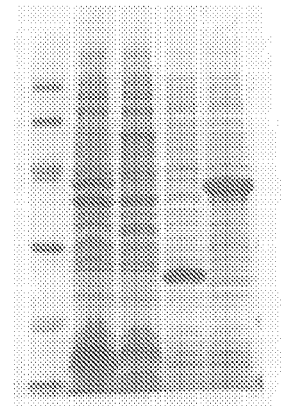
Figure 77:
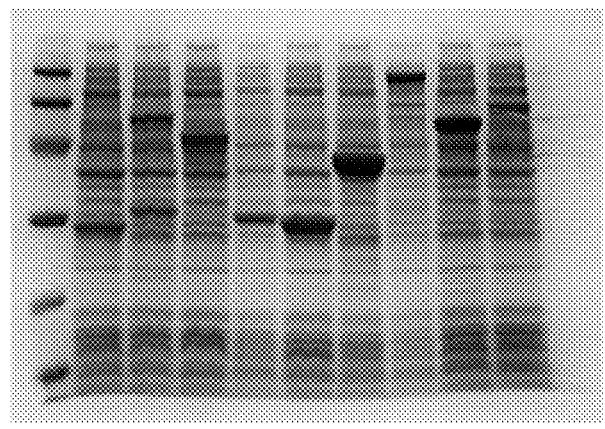

SEQ ID 8530 (GBS291) was expressed in *E. coli* as a His-fusion product. SDS-PAGE analysis of total cell extract is shown in FIG. 59 (lane 5; MW 38.9 kDa). It was also expressed in *E. coli* as a GST-fusion product. SDS-PAGE analysis of total cell extract is shown in FIG. 77 (lane 2; MW 64 kDa).

Figure 226:
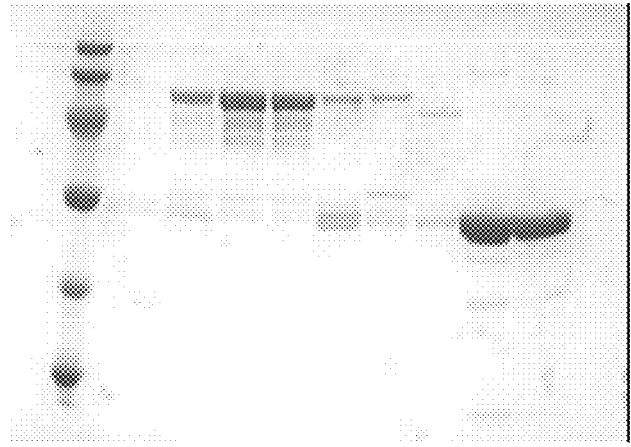

GBS291-GST was purified as shown in FIG. 226, lane 10-11.

Based on this analysis, it was predicted that these proteins and their epitopes could be useful antigens for vaccines or diagnostics.

EXAMPLE 268

A DNA sequence (GBSx0293) was identified in *S. agalactiae* <SEQ ID 855> which encodes the amino acid sequence <SEQ ID 856>. This protein is predicted to be glucose-1-phosphate uridylyltransferase (gtaB). Analysis of this protein sequence reveals the following:

```
Possible site: 25
>>> Seems to have a cleavable N-term signal seq.

----- Final Results -----
             bacterial outside  --- Certainty = 0.3000(Affirmative) < succ>
             bacterial membrane --- Certainty = 0.0000(Not Clear)   < succ>
             bacterial cytoplasm --- Certainty = 0.0000(Not Clear)   < succ>
```

The protein has homology with the following sequences in the GENPEPT database:

```
>GP:BAA28714 GB:AB001562 glucose-1-phosphate uridylyltransferase
[Streptococcus mutans]

Identities = 263/296 (88%), Positives = 285/296 (95%)

Query:   2 KVRKAVIPAAGLGTRFLPATKALAKEMLPIVDKPTIQFIVEEALKSGIEDILVVTGKSKR   61
           KVRKAVIPAAGLGTRFLPATKALAKEMLPIVDKPTIQFIVEEALKSGIEDILVVTGKSKR
Sbjct:   5 KVRKAVIPAAGLGTRFLPATKALAKEMLPIVDKPTIQFIVEEALKSGIEDILVVTGKSKR   64

Query:  62 SIEDEFDSNFELEYNLKEKGKNELLKLVDETTGIRLHFIRQSHPRGLGDAVLQAKAFVGN  121
           SIED FDSNFELEYNL++KGK +LLKLV++TT I LHFIRQSHPRGLGDAVLQAKAFVGN
Sbjct:  65 SIEDHFDSNFELEYNLEQKGKTDLLKLVNDTTAINLHFIRQSHPRGLGDAVLQAKAFVGN  124

Query: 122 EPFVVNLGDDLMDITNNKVIPLTKQLINDFEATHASTIAVMEVPHEDVSAYGVIAPQGEG  181
           EPFVVMLGDDLMDIT++K IPLT+QL+ND+E THASTIAVMEVPHEDVSAYGVIAPQGEG
Sbjct: 125 EPFVVMLGDDLMDITDDKAIPLTRQLMNDYEETHASTIAVMEVPHEDVSAYGVIAPQGEG  184

Query: 182 VNGLYSVNTFVEKPSPEEAPSNLAIIGRYLLTPEIFNILETQKPGAGNEIQLTDAIDTLN  241
           V+GLYSV+T+VEKP+P+EAPSNLAIIGRYLLTPEIF ILETQ+PGAGNE+QLTDAIDTLN
Sbjct: 185 VSGLYSVDTWVEKPAPKEAPSNLAIIGRYLLTPEIFTILETQEPGAGNEVQLTDAIDTLN  244

Query: 242 KTQRVFARKFTGDRYDVGDKFGFMKTSIDYALQHPQVKDDLKKYIIDLGKSLEKTS      297
           KTQRVFAR+F G RYDVGDKFGFMKTSIDYAL+HPQVK+DLK YII+LGK L++ S
Sbjct: 245 KTQRVFAREFRGKRYDVGDKFGFMKTSIDYALKHPQVKEDLEAYIIELGKKLDQKS      300
```

A related DNA sequence was identified in *S. pyogenes* <SEQ ID 857> which encodes the amino acid sequence <SEQ ID 858>. Analysis of this protein sequence reveals the following:

```
Possible site: 26

>>> Seems to have a cleavable N-term signal seq.
```

-continued

```
----- Final Results -----
           bacterial outside --- Certainty = 0.3000 (Affirmative) < succ>
          bacterial membrane --- Certainty = 0.0000 (Not Clear)   < succ>
         bacterial cytoplasm --- Certainty = 0.0000 (Not Clear)   < succ>
```

An alignment of the GAS and GBS proteins is shown below:

```
Identities = 257/295 (87%), Positives = 277/295 (93%)

Query:    2 KVRKAVIPAAGLGTRFLPATKALAKEMLPIVDKPTIQFIVEEALKSGIEDILVVTGKSKR   61
            KVRKA+IPAAGLGTRFLPATKALAKEMLPIVDKPTIQFIVEEALKSGIE+ILVVTGK+KR
Sbjct:    3 KVRKAIIPAAGLGTRFLPATKALAKEMLPIVDKPTIQFIVEEALKSGIEEILVVTGKAKR   62

Query:   62 SIEDHFDSNFELEYNLKEKGKNELLKLVDETTGIRLHFIRQSHPRGLGDAVLQAKAFVGN  121
            SIEDHFDSNFELEYNL+ KGKNSLLKLVDETT I LHFIRQSHPRGLGDAVLQAKAFVGN
Sbjct:   63 SIEDHFDSNFELEYNLQAKGKNELLKLVDETTAINLHFIRQSHPRGLGDAVLQAKAFVGN  122

Query:  122 EPFVVNLGDDLMDITNNKVIPLTKQLINDFEATHASTIAVMEVPHEDVSAYGVIAPQGEG  181
            EPFVVMLGDDLMDITN    PLTKQL+ D++ THASTIAVM+VPHEDVS+YGVIAPQG+
Sbjct:  123 EPFVVMLGDDLMDITNASAKPLTKQLMEDYDKTHASTIAVMKVPHEDVSSYGVIAPQGKA  182

Query:  182 VNGLYSVNTFVEKPSPEEAPSNLAIIGRYLLTPEIFNILETQKPGAGNEIQLTDAIDTLN  241
             V GLYSV+TFVEKP PE+APS+LAIIGRYLLTPEIF ILE Q PGAGNE+QLTDAIDTLN
Sbjct:  183 VKGLYSVDTFVEKPQPEDAPSDLAIIGRYLLTPEIFGILERQTPGAGNEVQLTDAIDTLN  242

Query:  242 KTQRVFARKFTGDRYDVGDKFGFMKTSIDYALQHPQVKDDLKKYIIDLGKSLSKT       296
            KTQRVFAR+F G+RYDVGDKFGFMKTSIDYAL+HPQVK+DLK YII LGK+LEK+
Sbjct:  243 KTQRVFAREFKGNRYDVGDKFGFMKTSIDYALEHPQVKEDLKNYIIKLGKALEKS       297
```

Based on this analysis, it was predicted that these proteins and their epitopes could be useful antigens for vaccines or diagnostics.

EXAMPLE 269

A DNA sequence (GBSx0294) was identified in *S. agalactiae* <SEQ ID 859> which encodes the amino acid sequence <SEQ ID 860>. Analysis of this protein sequence reveals the following:

```
Possible Site: 42

>>> Seems to have no N-terminal signal sequence

INTEGRAL   Likelihood = -4.94 Transmembrane 28-44 (27-45)

----- Final Results -----
          bacterial membrane --- Certainty = 0.2975 (Affirmative) < succ>
           bacterial outside --- Certainty = 0.0000 (Not Clear)   < succ>
         bacterial cytoplasm --- Certainty = 0.0000 (Not Clear)   < succ>
```

The protein has homology with the following sequences in the GENPEPT database:

```
>GP:CAB15143 GB:Z99120 similar to ABC transporter (lipoprotein)
[Bacillus subtilis]

Identities = 148/346 (42%), Positives = 222/346 (63%), Gaps = 16/346 (4%)

Query:   31 LTLLSLSVLTLTACGNRSDKSAN---KSDIKVAMVTNQGGVDDKSFNQSAWEGLQKWGKK    87
            ++L+ +   L ACGN   S +   K+    VAMVT+ GGVDDKSFNQSAWEG+Q +GK+
Sbjct:    1 MSLVIAAGTILGACGNSEKSSGSGEGKNKESVAMVTDVGGVDDKSFNQSAWEGIQAFGKE   60

Query:   88 KGLTKG-NGFDYFQSSNESDHANNLDTAASSGYNLIFGIGFGLHDTIEKVSENNKDVKYV  146
             GL KG NG+DY QS +++D+  NL+  A    ++LI+G+G+ + D+I ++++   K+  +
Sbjct:   61 NGLKKGKNGYDYLQSKSDADYTTNLNKLARENFDLIYGVGYLMEDSISEIADQRKNTNFA  120

Query:  147 IVDDIIKGKENVASVTFADNEAAYLAGVAAAKTTKTKTVGFIGGMEGVVVKRFEAGFKAG  206
            I+D ++  K+NVAS+TF + E ++L GVAAA ++K+  +GF+GGNE  ++K+FE GF+AG
Sbjct:  121 IIDAVVD-KDNVASITFKEQEGSFLVGVAAALSSKSGKIGFVGGMESELIKKFEVGFRAG  179
```

-continued

```
Query: 207 VKSIDPAIKVAVSYAGSFTDAAKGKTIAATQYATGVDVIYQAAGGTGAGIFSEAKTENET 266
           V++++P    V V YAG F  A  GK  A + Y +GVDVIY +AG TG G+F+EAK
Sbjct: 180 VQAVNPKAVVEVKYAGGFDKADVGKATAESMYKSGVDVIYHSAGATGTGVFTEAK---NL 236

Query: 267 RKESNK--VWVIGVDRDQSQEGNYVSKDGKKANFVLASTIKEVGKSLQSVAELTEKKQYP 324
           +KE K   VWVIGVD+DQ  EG      +G  N L S +K+V   ++ V +      ++P
Sbjct: 237 KKEDPKRDVWVIGVDKDQYAEGQV---EGTDDNVTLTSMVKKVDTVVEDVTKKASDGKFP 293

Query: 325 GGKVTVFGLKDSGVDI--KEHQLSSEGSVAVKKAKEDIVSGKIQVP                368
           GG+   +GL  GV I  +  LS +    AV K K+ I+ G +++P
Sbjct: 294 GGETLTYGLDQDGVGISPSKQNLSDDVIKAVDKWKKKIIDG-LEIP                338
```

There is also homology to SEQ ID 862.

A related GBS gene <SEQ ID 8531> and protein <SEQ ID 8532D> were also identified. Analysis of this protein sequence reveals the following:

```
Lipop: Possible site: 20    Crend: 3
       Sequence Pattern: CGNR
SRCFLG: 0
McG: Length of UR: 19
     Peak Value of UR: 2.31
     Net Charge of CR: 2
McG: Discrim Score:    5.09
GvH: Signal Score (-7.5): -3.29
     Possible site: 19
>>> May be a lipoprotein
Amino Acid Composition: calculated from 21
ALOM program count:  0 value:  5.20 threshold:  0.0
     PERIPHERAL Likelihood =  5.20    90
modified ALOM score: -1.54
Reasoning Step: 3
----- Final Results -----
             bacterial membrane --- Certainty = 0.0000 (Not Clear) < succ>
              bacterial outside --- Certainty = 0.0000 (Not Clear) < succ>
            bacterial cytoplasm --- Certainty = 0.0000 (Not Clear) < succ>
```

The protein has homology with the following sequences in the databases:

```
52.8/73.9% over 239aa
Listeria monocytogenes
SP|Q48754|CD4+ T CELL-STIMULATIONF ANTIGEN PRECURSOE. Insert characterized
GP|7240601|gb|AAB35725.2||S80336 CD4+ T cell-stimulatiing antigen Insert
characterized ORF02225(385-1086 of 1710)
SP|Q48754|TCSA_LISMO(8-247 of 268)CD4+ T CELL-STIMULATING ANTIGEN
PRECURSOR.GP|7240601||gb|AAB35725.2||S80336 CD4+ T cell-stimulating antigen
{Listeria monocytogenes}
% Match = 21.7
% Identity = 52.7    % Similarity = 73.8
Matches = 125    Mismatches = 59   Conservative Sub.s = 50

294       324       354       384       414       444       465       489
NFLWEK*NKVC*MIFLCYDRNLFLCDYNLLGGSFSVNRKIIGLTLLSLSVLTLTACGNRSD---KSANKS--DIKVAMVT
                                        : |:::   | : ||||: ||      | :||   |  |||||
                                   MKKRTFALALSMIIASGVILGACGSSSDDKKSSDDKSSKDFTVAMVT
                                             10        20        30        40

519       549       579       606       636       666       696       726
NQGGVDDKSFNQSAWEGLQKWGKKKGLTKG-NGFDYFQSSNESDHANNLDTAASSGYNLIFGIGFGLHDTIEKVSENNKD
:  |||||:|||||||||||:||    :  ||  :|::|:||::|:   ||:||    |  |:|:|||   ||  ||:||:
DTGGVDDRSFNQSAWEGLQKFGKANDMEKGTDGYNYLQSASEADYKTNLNTAVRSDYDLIYGIGYKLKDAIEEVSKQKPK
       60        70        80        90       100       110       120

756       786       816       846       876       906       936       966
VKYVIVDDIIKGKENVASVTFADNEAAYLAGVAAAKTTKTKTVGFIGGMEGVVVKRFEAGFKAGVKSIDPAIKVAVSYAG
 ::  ||||  |   ::||  |: |  ||  :|  ||| |  ||||    |||::| |:   ||||||  ||::|  :: | ||
NQFAIVDDTIDDRDNVVSIGFKDNDGSYLVGVVAGLTTKTNKVGFVGGVKGTVIDRFEAGFTAGVKAVNPNAQIDVQYAN
       140       150       160       170       180       190       200

996      1026      1056      1086      1116      1146      1176      1206
SFTDAAKGKTIAATQYATGVDVIYQAAGGTGAGIFSEAKTENETRKESNKVWVIGVDRDQSQEGNYVSKDGKKANFVLAS
 |  | |||: ||::  |::||||||::||||||  |:|:|||     :       :
DFAKADKGQQIASSMYSSGVDVIFHAAGGTGNGVFAEAKNLKKKDLQMVPYGNSKLGCFGG
       220       230       240       250       260
```

A related GBS nucleic acid sequence <SEQ ID 10947> which encodes amino acid sequence <SEQ ID 10948> was also identified.

Figure 38:
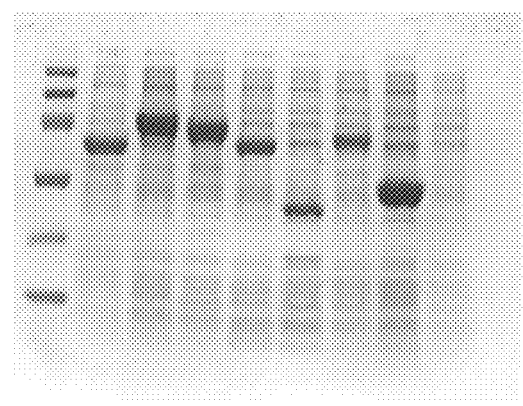

SEQ ID 8532 (GBS108) was expressed in *E. coli* as a His-fusion product. SDS-PAGE analysis of total cell extract is shown in FIG. 38 (lane 7; MW 39.6 kDa). It was also expressed in *E. coli* as a GST-fusion product. SDS-PAGE analysis of total cell extract is shown in FIG. 41 (lane 9; MW 64.6 kDa).

Figure 273:
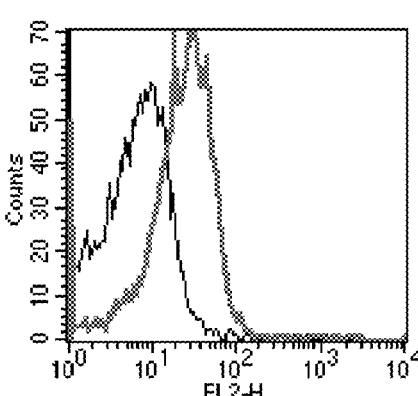

The GBS108-GST fusion product was purified (FIG. 202, lane 9) and used to immunise mice. The resulting antiserum was used for FACS (FIG. 273), which confirmed that the protein is immunoaccessible on GBS bacteria.

Based on this analysis, it was predicted that these proteins and their epitopes could be useful antigens for vaccines or diagnostics.

EXAMPLE 270

A DNA sequence (GBSx0295) was identified in *S. agalactiae* <SEQ ID 863> which encodes the amino acid sequence <SEQ ID 864>. Analysis of this protein sequence reveals the following:

```
Possible site: 35
>>> Seems to have a cleavable N-term signal seq.
INTEGRAL    Likelihood = -12.74    Transmembrane    206-222 (197-224)
INTEGRAL    Likelihood =  -3.72    Transmembrane    174-190 (171-194)
INTEGRAL    Likelihood =  -3.19    Transmembrane     98-114  (98-116)
INTEGRAL    Likelihood =  -1.54    Transmembrane    120-136 (120-139)
INTEGRAL    Likelihood =  -0.90    Transmembrane    157-173 (157-173)

----- Final Results -----
            bacterial membrane --- Certainty = 0.6095 (Affirmative) < succ>
             bacterial outside --- Certainty = 0.0000 (Not Clear)   < succ>
           bacterial cytoplasm --- Certainty = 0.0000 (Not Clear)   < succ>
```

The protein has homology with the following sequences in the GENPEPT database:

```
>GP: CAB90755 GB: AJ400707 hypothetical protein [Streptococcus uberis]
Identities = 126/218 (57%), Positives = 166/218 (75%)

Query:    8 KEYPTTVLLVSLTTLVFLLMQLTYGSQAESSQVIFQFGGIQGDYLKAYPTNLWRLISPIF   67
            KE P T   +S+T L+F++MQ+ YGS A+S QV+FQFGG+ G  +K+ P+ LWRL++PIF
Sbjct:    5 KEKPVTFFFLSVTILLFIVMQVFYGSWAKSPQVVFQFGGMFGLVVKSMPSQLWRLVTPIF   64

Query:   68 VHIGWEHFLLNGLALYFVGQMGESIWGSLRFLILYILSGLMGNIFTLFFTPHVVAAGAST  127
            +HIGWEHFL+N L LYFVGQ+ ESIWGS  FL+LY+LSG+MGN+ TLFFTPHVVAAGAST
Sbjct:   65 IHIGWEHFLINSLTLYFVGQLAESIWGSRFFLLLYVLSGIMGNVLTLFFTPHVVAAGAST  124

Query:  128 SLFGVFSAIAIAGYFGKNPYLKQVGKSYQVMILLNLFFNIFTPGVSLAGHVGGLVGGVLV  187
            SLFG+F+AI + GYFG N LK +GKSYQ +I+LNL  N+F P V + GH+GG +GG L
Sbjct:  125 SLFGLFAAIVVVGYFGHNQLLKSIGKSYQTLIILNLVMNLFMPNVGIVGHLGGALGGALA  184

Query:  188 AIFLTKQNGSLLFKTWQSILALMIFIIVSISLIGLSLV                       225
            A+FL      + LF   Q   AL+ ++ +++ LI LSL+
Sbjct:  185 AVFLPTLLDAELFTKKQKTSALLSYLTLALVLITSLM                        222
```

A related DNA sequence was identified in *S. pyogenes* <SEQ ID 865> which encodes the amino acid sequence <SEQ ID 866>. Analysis of this protein sequence reveals the following:

```
Possible site: 43
>>> Seems to have no N-terminal signal sequence
    INTEGRAL    Likelihood = -9.92    Transmembrane    214-230 (212-232)
    INTEGRAL    Likelihood = -5.36    Transmembrane    135-151 (128-153)
    INTEGRAL    Likelihood = -1.81    Transmembrane    101-117 (100-117)
    INTEGRAL    Likelihood = -1.44    Transmembrane    183-199 (182-199)
    INTEGRAL    Likelihood = -0.53    Transmembrane    166-182 (166-182)
```

-continued

```
----- Final Results -----
           bacterial membrane --- Certainty = 0.4970(Affirmative) < succ>
           bacterial outside  --- Certainty = 0.0000(Not Clear)   < succ>
          bacterial cytoplasm --- Certainty = 0.0000(Not Clear)   < succ>
```

The protein has homology with the following sequences in the databases:

```
>GP: CAB90755 GB: AJ400707 hypothetical protein [Streptococcus uberis]
Identities = 72/128 (56%), Positives = 94/128 (73%)

Query: 106 FLLLYVLSGVMGNAFTFWLTPETVAAGASTSLFGLFAAIVVLSFLGKNQALKDLGKSYQT 165
           FLLLYVLSG+MGN  T + TP  VAAGASTSLFGLFAAIVV+ + G NQ LK +GKSYQT
Sbjct:  95 FLLLYVLSGIMGNVLTLFFTPHVVAAGASTSLFGLFAAIVVVGYFGHNQLLKSIGKSYQT 154

Query: 166 LIVVNLLMNLFMPNVSMAGHIGGVVGGALLSIVFPTKMRVITVKKTKRMLALVSYGIILV 225
           LI++NL+MNLFMPNV + GH+GG +GGAL ++  PT +      K ++  AL+SY + +
Sbjct: 155 LIILNLVMNLFMPNVGIVGHLGGALGGALAAVFLPTLLDAELFTKKQKTSALLSYLTLAL 214

Query: 226 GVLVLGFL                                                    233
           ++ L +
Sbjct: 215 VLITLSLM                                                    222
```

An alignment of the GAS and GBS proteins is shown below:

```
Identities = 63/132 (47%), Positives = 92/132 (68%)

Query:  94 GSLRFLILYILSGLMGNIFTLFFTPHVVAAGASTSLFGVFSAIAIAGYFGKNPYLKQVGK 153
           G    FL+LY+LSG+MGN FT + TP  VAAGASTSLFG+F+AI +  + GKN  LK +GK
Sbjct: 102 GLTPFLLLYVLSGVMGNAFTFWLTPETVAAGASTSLFGLFAAIVVLSFLGKNQALKDLGK 161

Query: 154 SYQVMILLNLFFNIFTPGVSLAGHVGGLVGGVLVAIFLTKQNGSLLFKTWQSILALMIFI 213
           SYQ +I++NL  N+F P VS+AGH+GG+VGG L++I   +   K + +LAL+ +
Sbjct: 162 SYQTLIVVNLLMNLFMPNVSMAGHIGGVVGGALLSIVFPTKMRVITVKKTKRMLALVSYG 221

Query: 214 IVSISLIGLSLV                                                225
           I+ + ++ L  +
Sbjct: 222 IILVGVLVLGFL                                                233
```

A further corresponding DNA sequence was identified in S. pyogenes <SEQ ID 9083> which encodes the amino acid sequence <SEQ ID 9084>. Analysis of this protein sequence reveals the following:

```
Possible site: 52
>>> Seems to have an uncleavable N-term signal seq
      INTEGRAL    Likelihood = -7.70    Transmembrane    12-28 (7-30)

----- Final Results -----
           bacterial membrane --- Certainty = 0.4079(Affirmative) < succ>
           bacterial outside  --- Certainty = 0.0000(Not Clear)   < succ>
          bacterial cytoplasm --- Certainty = 0.0000(Not Clear)   < succ>
```

An alignment of the GAS and GBS sequences follows:

```
Score = 74.5 bits (180), Expect = 5e-16
Identities = 37/96 (38%), Positives = 48/96 (49%)

Query:  1 MTQLLKRYPXXXXXXXXXXXXXXXXAMQVVYGHLATGAQAIYQVGGMFGLLVKAMPDQLWRL 60
          M + K YP                MQ+ YG  A  +Q I+Q GG+ G  +KA P  LWRL
Sbjct:  3 MKKFAKEYPTTVLLVSLTTLVFLLMQLTYGSQAESSQVIFQFGGIQGDYLKAYPTNLWRL 62

Query: 61 VTPXXXXXXXXXXXXXVNGLTLYFVGQIVEDLWGSRLF                        96
          ++P             +NGL LYFVGQ+ E +WGS  F
Sbjct: 63 ISPIFVHIGWEHFLLNGLALYFVGQMGESIWGSLRF                          98
```

Based on this analysis, it was predicted that these proteins and their epitopes could be useful antigens for vaccines or diagnostics.

EXAMPLE 271

A DNA sequence (GBSx0296) was identified in *S. agalactiae* <SEQ ID 867> which encodes the amino acid sequence <SEQ ID 868>. Analysis of this protein sequence reveals the following:

```
Possible site: 22
>>> Seems to have no N-terminal signal sequence

----- Final Results -----
            bacterial cytoplasm --- Certainty = 0.2055(Affirmative) < succ>
            bacterial membrane  --- Certainty = 0.0000(Not Clear)   < succ>
             bacterial outside  --- Certainty = 0.0000(Not Clear)   < succ>
```

The protein has homology with the following sequences in the GENPEPT database:

```
>GP: BAA28715 GB: AB001562 hypothetical protein [Streptococcus mutans]
Identities = 96/173 (55%), Positives = 129/173 (74%)

Query:   1 MEKKLLRKEVLITLKSQPQAYKSEVDCKLLEAFIKTKAYQNSCVIATYLSFDYEYNTQLL   60
           M KK  R +V+  LK Q +A K    D +LLE  I+ +AYQ + VIATYL+F +E++T LL
Sbjct:   1 MMKKDYRTQVIEDLKKQDKAKKVLRDEQLLEELIQLEAYQKAHVIATYLAFPFEFDTSLL   60

Query:  61 IKQALCDGKRVLVPKTYPKGKMIFVDYQKDNLRTTPFGLLEPVNDRAVEKASIDLIHVPG  120
           I+QA  D K ++VPKTYP+ KMIFV Y + +L+ T FGL EP ++ A+EK++IDLIHVPG
Sbjct:  61 IEQAQRDNKSIVVPKTYPQRKMIFVVYDEADLQITKFGLKEPRSEEALEKSAIDLIHVPG  120

Query: 121 LIFNNKGFRIGYGAGYFDRYLSDFEGDTISTIYRCQRQDFVEEKHDVAVKEVL         173
           L FNN+G+RIG+GAGY+D+YL+DF+GDT+STIY   Q+    F       D+ VKEVL
Sbjct: 121 LAFNNEGYRIGFGAGYYDQYLADFQGDTVSTIYSFQQFTFEPSFFDIPVKEVL         173
```

A related GBS nucleic acid sequence <SEQ ID 10925> which encodes amino acid sequence <SEQ ID 10926> was also identified.

No corresponding DNA sequence was identified in *S. pyogenes*.

Based on this analysis, it was predicted that these proteins and their epitopes could be useful antigens for vaccines or diagnostics.

EXAMPLE 272

A DNA sequence (GBSx0297) was identified in *S. agalactiae* <SEQ ID 869> which encodes the amino acid sequence <SEQ ID 870>. Analysis of this protein sequence reveals the following:

```
Possible site: 43
>>> Seems to have no N-terminal signal sequence
    INTEGRAL    Likelihood = -1.44    Transmembrane   161-177 (161-177)
    INTEGRAL    Likelihood = -0.22    Transmembrane    29-45  (28-45)

----- Final Results -----
             bacterial membrane  --- Certainty = 0.1574(Affirmative) < succ>
              bacterial outside  --- Certainty = 0.0000(Not Clear)   < succ>
            bacterial cytoplasm  --- Certainty = 0.0000(Not Clear)   < succ>
```

A related GBS nucleic acid sequence <SEQ ID 9305> which encodes amino acid sequence <SEQ ID 9306> was also identified.

The protein has homology with the following sequences in the GENPEPT database:

```
>GP: AAD33517 GB: AF132127 glucose-6-phosphate isomerase
[Streptococcus mutans]
Identities = 344/401 (85%), Positives = 374/401 (92%)
```

```
                                 -continued
Query:    1 MDLPENYDKEEFSRIQKAAEKIKSDSEVLVVIGIGGSYLGAKAAIDFLNNHFANLQTAEE    60
            ++LP+NYDKEEF+RI+KAAEKIKSDSEVLVVIGIGGSYLGA+AAIDFLN+ F NL+   EE
Sbjct:   49 LNLPQNYDKEEFARIKKAAEKIKSDSEVLVVIGIGGSYLGARAAIDFLNSSFVNLENKEE   108

Query:   61 RKAPQILYAGNSISSTYLADLVEYVQDKEFSVNVISKSGTTTEPAIAFRVFKELLVKKYG   120
            RKAPQILYAGNSISS YLADLV+YV DK+FSVNVISKSGTTTEPAIAFRVFK+LLVKKYG
Sbjct:  109 RKAPQILYAGNSISSNYLADLVDYVADKDFSVNVISKSGTTTEPAIAFRVFKDLLVKKYG   168

Query:  121 QEEANKRIYATTDKVKGAVKVEADANNWETFVVPDNVGGRFSVLTAVGLLPIAASGADIT   180
            QEEAN+RIYATTD+VKGAVKVEADAN WETFVVPD+VGGRF+VLTAVGLLPIAASGAD+
Sbjct:  169 QEEANQRIYATTDRVKGAVKVEADANGWETFVVPDSVGGRFTVLTAVGLLPIAASGADLD   228

Query:  181 ALMEGANAARKDLSSDKISENIAYQYAAVRNVLYRKGYITEILANYEPSLQYFGEWWKQL   240
              LM GA AAR+D SS ++SEN AYQYAA+RN+LYRKGY+TE+LANYEPSLQYF EWWKQL
Sbjct:  229 QLMAGAEAARQDYSSAELSENEAYQYAAIRNILYRKGYVTEVLANYEPSLQYFSEWWKQL   288

Query:  241 AGESEGKDQKGIYPTSANFSTDLHSLGQFIQEGYRNLFETVVRVEKPRKNVTIPELTEDL   300
            AGESEGKDQKGIYPTSANFSTDLHSLGQFIQEG RNLFETV+RVEK RKN+ +PE EDL
Sbjct:  289 AGESEGKDQKGIYPTSANFSTDLHSLGQFIQEGNRNLFETVIRVEKARKNILVPEAAEDL   348

Query:  301 DGLGYLQGKDVDFVNKKATDGVLLAHTDGGVPNMFVTLPTQDAYTLGYTIYFFELAIGLS   360
            DGL YLQGKDVDFVNKKATDGVLLAHTDGGVPN F+T+P QD +TLGY IYFFELAIGLS
Sbjct:  349 DGLAYLQGKDVDFVNKKATDGVLLAHTDGGVPNTFLTIPEQDEFTLGYVIYFFELAIGLS   408

Query:  361 GYLNSVNPFDQPGVEAYKRNMFALLGKPGFEELSAELNARL                     401
            GYLN VNPFDQPGVEAYK+NMFALLGKPGFEEL AELNARL
Sbjct:  409 GYLNGVNPFDQPGVEAYKKNMFALLGKPGFEELGAELNARL                     449
```

A related DNA sequence was identified in *S. pyogenes* <SEQ ID 871> which encodes the amino acid sequence <SEQ ID 872>. Analysis of this protein sequence reveals the following:

```
Possible site: 31
>>> Seems to have no N-terminal signal sequence
    INTEGRAL      Likelihood = -1.44    Transmembrane      209-225  (209-225)
    INTEGRAL      Likelihood = -0.22    Transmembrane       77-93   (76-93)

----- Final Results -----
              bacterial membrane --- Certainty = 0.1574(Affirmative) < succ>
              bacterial outside  --- Certainty = 0.0000(Not Clear)   < succ>
              bacterial cytoplasm --- Certainty = 0.0000(Not Clear)  < succ>
```

The protein has homology with the following sequences in the databases:

```
>GP: AAD33517 GB: AF132127 glucose-6-phosphate isomerase
[Streptococcus mutans]
Identities = 369/449 (82%), Positives = 408/449 (90%)

Query:    1 MSHITFDYSKVLESFAGQHEIDFLQGQVTEADKLLREGTGPGSDFLGWLDLPENYDKEF    60
            M+HI FDYSKVL  F   HE+D++Q QVT AD+ LR+GTGPG++  GWL+LP+NYDK+EF
Sbjct:    1 MTHIKFDYSKVLGKFLASHELDYIQMQVTAADEALRKGTGPGAEMTGWLNLPQNYDKEEF    60

Query:   61 ARILTAAEKIKADSEVLVVIGIGGSYLGAKAAIDFLNHHFANLQTAKERKAPQILYAGNS   120
            ARI  AAEKIK+DSEVLVVIGIGGSYLGA+AAIDFLN  F NL+  +ERKAPQILYAGNS
Sbjct:   61 ARIKKAAEKIKSDSEVLVVIGIGGSYLGARAAIDFLNSSFVNLENKEERKAPQILYAGNS   120

Query:  121 ISSTYLADLVEYVQDKEFSVNVISKSGTTTEPAIAFRVFKELLVKKYGQEEANKRIYATT   180
            ISS YLADLV+YV DK+FSVNVISKSGTTTEPAIAFRVFK+LLVKKYGQEEAN+RIYATT
Sbjct:  121 ISSNYLADLVDYVADKDFSVNVISKSGTTTEPAIAFRVFKDLLVKKYGQEEANQRIYATT   180

Query:  181 DKVKGAVKVEADANNWETFVVPDNVGGRFSVLTAVGLLPIAASGADITALMEGANAARKD   240
            D+VKGAVKVEADAN WETFVVPD+VGGRF+VLTAVGLLPIAASGAD+  LM GA AAR+D
Sbjct:  181 DRVKGAVKVEADANGWETFVVPDSVGGRFTVLTAVGLLPIAASGADLDQLMAGAEAARQD   240

Query:  241 LSSDKISENIAYQYAAVRNVLYRKGYITEILANYEPSLQYFGEWWKQLAGESEGKDQKGI   300
             SS ++SEN AYQYAA+RN+LYRKGY+TE+LANYEPSLQYF EWWKQLAGESEGKDQKGI
Sbjct:  241 YSSAELSENEAYQYAAIRNILYRKGYVTEVLANYEPSLQYFSEWWKQLAGESEGKDQKGI   300

Query:  301 YPTSANFSTDLHSLGQFIQEGYRNLFETVIRVDNPRKNVIIPELAEDLDGLGYLQGKDVD   360
            YPTSANFSTDLHSLGQFIQEG RNLFETVIRV+  RKN+++PE AEDLDGL YLQGKDVD
Sbjct:  301 YPTSANFSTDLHSLGQFIQEGNRNLFETVIRVEKARKNILVPEAAEDLDGLAYLQGKDVD   360

Query:  361 FVNKKATDGVLLAHTDGGVPNMFVTLPAQDEFTLGYTIYFFELAIAVSGYMNAVNPFDQP   420
            FVNKKATDGVLLAHTDGGVPN F+T+P QDEFTLGY IYFFELAI +SGY+N VNPFDQP
```

-continued
```
Sbjct: 361 FVNKKATDGVLLAHTDGGVPNTFLTIPEQDEFTLGYVIYFFELAIGLSGYLNGVNPFDQP 420

Query: 421 GVEAYKRNMFALLGKPGFEALSAELNARL                                449
            GVEAYK+NMFALLGKPGFE L AELNARL
Sbjct: 421 GVEAYKKNMFALLGKPGFEELGAELNARL                                449
```

The protein has homology with the following sequences in the databases:

```
>GP: CAB90755 GB: AJ400707 hypothetical protein [Streptococcus
uberis]
Identities = 58/91 (63%), Positives = 69/91 (75%)

Query:  6 KRYPITIFLLGLTGLIFIAMQVVYGHLATGAQAIYQVGGMFGLLVKAMPDQLWRLVTPIF  65
          K  P+T F L +T L+FI MQV YG  A   Q ++Q GGMFGL+VK+MP QLWRLVTPIF
Sbjct:  5 KEKPVTFFFLSVTILLFIVMQVFYGSWAKSPQVVFQFGGMFGLVVKSMPSQLWRLVTPIF  64

Query: 66 IHIGFGHFFVNGLTLYFVGQIVEDLWGSRLF                               96
          IHIG+ HF +N LTLYFVGQ+ E +WGSR F
Sbjct: 65 IHIGWEHFLINSLTLYFVGQLAESIWGSRFF                               95
```

An alignment of the GAS and GBS proteins is shown below:

```
Identities = 380/401 (94%), Positives = 392/401 (96%)

Query:   1 MDLPENYDKEEFSRIQKAAEKIKSDSEVLVVIGIGGSYLGAKAAIDFLNNHFANLQTAEE   60
           +DLPENYDK+EF+RI   AAERIK+DSEVLVVIGIGGSYLGAKAAIDFLN+HFANLQTA+E
Sbjct:  49 LDLPENYDKDEFARILTAAEKIKADSEVLVVIGIGGSYLGAKAAIDFLNHHFANLQTAKE  108

Query:  61 RKAPQILYAGNSISSTYLADLVEYVQDKEFSVNVISKSGTTTEPAIAFRVFKELLVKKYG  120
           RKAPQILYAGNSISSTYLADLVEYVQDKEFSVNVISKSGTTTEPAIAFRVFKELLVKKYG
Sbjct: 109 RKAPQILYAGNSISSTYLADLVEYVQDKEFSVNVISKSGTTTEPAIAFRVFKELLVKKYG  168

Query: 121 QEEANKRIYATTDKVKGAVKVEADANNWETFVVPDNVGGRFSVLTAVGLLPIAASGADIT  180
           QEEANKRIYATTDKVKGAVKVEADANNWETFVVPDNVGGRFSVLTAVGLLPIAASGADIT
Sbjct: 169 QEEANKRIYATTDKVKGAVKVEADANNWETFVVPDNVGGRFSVLTAVGLLPIAASGADIT  228

Query: 181 ALMEGANAARKDLSSDKISENIAYQYAAVRNVLYRKGYITEILANYEPSLQYFGEWWKQL  240
           ALMEGANAARKDLSSDKISENIAYQYAAVRNVLYRKGYITEILANYEPSLQYFGEWWKQL
Sbjct: 229 ALMEGANAARKDLSSDKISENIAYQYAAVRNVLYRKGYITEILANYEPSLQYFGEWWKQL  288

Query: 241 AGESEGKDQKGIYPTSANFSTDLHSLGQFIQEGYRNLFETVVRVEKPRKNVTIPELTEDL  300
           AGESEGKDQKGIYPTSANFSTDLHSLGQFIQEGYRNLFETV+RV+ PRKNV IPEL EDL
Sbjct: 289 AGESEGKDQKGIYPTSANFSTDLHSLGQFIQEGYRNLFETVIRVDNPRKNVIIPELAEDL  348

Query: 301 DGLGYLQGKDVDFVNKKATDGVLLAHTDGGVPNMFVTLPTQDAYTLGYTIYFFELAIGLS  360
           DGLGYLQGKDVDFVNKKATDGVLLAHTDGGVPNMFVTLP QD +TLGYTIYFFELAI +S
Sbjct: 349 DGLGYLQGKDVDFVNKKATDGVLLAHTDGGVPNMFVTLPAQDEFTLGYTIYFFELAIAVS  408

Query: 361 GYLNSVNPFDQPGVEAYKRNMFALLGKPGFEELSAELNARL                    401
           GY+N+VNPFDQPGVEAYKRNMFALLGKPGFE LSAELNARL
Sbjct: 409 GYMNAVNPFDQPGVEAYKRNMFALLGKPGFEALSAELNARL                    449
```

Based on this analysis, it was predicted that these proteins and their epitopes could be useful antigens for vaccines or diagnostics.

EXAMPLE 273

A DNA sequence (GBSx0298) was identified in *S. agalactiae* <SEQ ID 873> which encodes the amino acid sequence <SEQ ID 874>. Analysis of this protein sequence reveals the following:

```
Possible site: 38
>>> Seems to have no N-terminal signal sequence
INTEGRAL    Likelihood = -2.66      Transmembrane    654-670 (653-671)
INTEGRAL    Likelihood = -1.65      Transmembrane    113-129 (113-129)

----- Final Results -----
             bacterial membrane --- Certainty = 0.2062 (Affirmative) < succ>
```

-continued
```
            bacterial outside --- Certainty = 0.0000 (Not Clear) < succ>
            bacterial cytoplasm --- Certainty = 0.0000 (Not Clear) < succ>
```

A related GBS nucleic acid sequence <SEQ ID 9463> which encodes amino acid sequence <SEQ ID 9464> was also identified.

The protein has homology with the following sequences in the GENPEPT database:

```
>GP: AAA81906 GB: U04863 alcohol dehydrogenase 2 [Entamoeba
histolytica]
Identities = 536/864 (62%), Positives = 663/864 (76%), Gaps = 3/864 (0%)

Query:  20 ETTDVALAIDTLVQNGLKALDEMR--QLNQEQVDYIVAKASVAALDAHGELALHAVEETG   77
           +T  V   I+ LV+    AL E    + QE++DYIV KASVAALD H  LA  AVEETG
Sbjct:   5 QTMTVDEHINQLVRKAQVALKEYLKPEYTQEKIDYIVKKASVAALDQHCALAAAAVEETG   64

Query:  78 RGVFEDKATKNLFACEHVVNNMRHTKTVGVIEEDDVTGLTLIAEPVGVVCGITPTTNPTS  137
           RG+FEDKATKN+FACEHV + MRH KTVG+I  D + G+T IAEPVGVVCG+TP TNPTS
Sbjct:  65 RGIFEDKATKNIFACEHVTHEMRHAKTVGIINVDPLYGITEIAEPVGVVCGVTPVTNPTS  124

Query: 138 TAIFKSLISLKTRNPIIFAFHPSAQESSAHAARIVRDAAIAAGAPENCVQWIEQPSIDAT  197
           TAIFKSLIS+KTRNPI+F+FHPSA + S  AA+IVRDAAIAAGAPENC+QWIE   I+A+
Sbjct: 125 TAIFKSLISIKTRNPIVFSFHPSALKCSIMAAKIVRDAAIAAGAPENCIQWIEFGGIEAS  184

Query: 198 NALMNHDGIATILATGGNAMVKAAYSCGKPALGVGAGNVPAYVEKSANIRQAAHDIVMSK  257
           N LMNH G+ATILATGGNAMVKAAYS GKPALGVGAGNVP Y+EK+ NI+QAA+D+VMSK
Sbjct: 185 NKLMNHPGVATILATGGNAMVKAAYSSGKPALGVGAGNVPTYIEKTCNIKQAANDVVMSK  244

Query: 258 SFDNGMVCASEQAVIIDKEIYKEFVEEFKSYHTYFVNKKEKALLEEFCFGAKANSKNCAG  317
           SFDNGM+CASEQA IIDKEIY + VEE K+    YF+N++EKA LE+F FG   A S +
Sbjct: 245 SFDNGMICASEQAAIIDKEIYDQVVEEMKTLGAYFINEEEKAKLEKFMFGVNAYSADVNN  304

Query: 318 AKLNPNIVGKSAVWIAEQAGFTVPEGTNILAAECTEVSEKEPLTREKLSPVIAVLKAEST  377
           A+LNP   G S  W AEQ G  VPE NI+ A C EV   EPLTREKLSPV+A+LKAE+T
Sbjct: 305 ARLNPKCPGMSPQWFAEQVGIKVPEDCNIICAVCKEVGPNEPLTREKLSPVLAILKAENT  364

Query: 378 EDGVEKARQMVEFNGLGHSAAIHTKDADLAREFGTRIRAIRVIWNSPSTFGGIGDVYNAF  437
           +DG++KA  MVEFNG GHSAAIH+ D  +   ++A R++ N+PS+ GGIG +YN
Sbjct: 365 QDGIDKAEAMVEFNGRGHSAAIHSNDKAVVEKYALTMKACRILHNTPSSQGGIGSIYNYI  424

Query: 438 LPSLTLGCGSYGRNSVGDNVSAINLLNIKKVGRRRNNMQWFKVPSKTYFERDSIQYLQKC  497
              PS TLGCGSYG NSV  NV+  NLLNIK++ RRNN+QWF+VP K +FE  SI+YL +
Sbjct: 425 WPSFTLGCGSYGGNSVSANVTYHNLLNIKRLADRRNNLQWFRVPPKIFFEPHSIRYLAEL  484

Query: 498 RDVERVMIVTDHAMVELGFLDRIIEQLDLRRNKVVYQIFAEVEPDPDITTVMKGTDLMRT  557
           +++ ++ IV+D M +LG++DR+++  L  R N+V  +IF +VEPDP I TV  KG  +M T
Sbjct: 485 KELSKIFIVSDRMMYKLGYVDRVMDVLKRRSNEVEIEIFIDVEPDPSIQTVQKGLAVMNT  544

Query: 558 FKPDTIIALGGGSPMDAAKVMWLFYEQPEVDFHDLVQKFMDIRKRAFKFPELGKKTKFVA  617
           F PD IIA+GGGS MDAAK+MWL YE PE DF  + QKF+D+RKRAFKFP +GKK + +
Sbjct: 545 FGPDNIIAIGGGSAMDAAKIMWLLYEHPEADFFAMKQKFIDLRKRAFKFPTMGKKARLIC  604

Query: 618 IPTTSGTGSEVTPFAVISDKANNRKYPIADYSLTPTVAIVDPALVMTVPGFIAADTGMDV  677
           IPTTSGTGSEVTPFAVISD   +KYP+ADYSLTP+VAIVDP   M++P    ADTG+DV
Sbjct: 605 IPTTSGTGSEVTPFAVISDHETGKKYPLADYSLTPSVAIVDPMFTMSLPKRAIADTGLDV  664

Query: 678 LTHATEAYVSQMANDYTDGLALQAIKIVFDYLERSVKDADFEAREKMHNASTMAGMAFAN  737
           L HATEAYVS MAN+YTDGLA +A+K+VF+ L +S  + D EAREKMHNA+T+AGMAFA+
Sbjct: 665 LVHATEAYVSVMANEYTDGLAREAVKLVFENLLKSY-NGDLEAREKMHNAATIAGMAFAS  723

Query: 738 AFLGISHSMAHKIGAQFHTVHGRTNAILLPYVIRYNGTRPAKTATWPKYNYYRADEKYQD  797
           AFLG+ HSMAHK+GA FH  HGR  A+LLP+VIRYNG +P K A WPKYN+Y+AD++Y +
Sbjct: 724 AFLGMDHSMAHKVGAAFHLPHGRCVAVLLPHVIRYNGQKPRKLAMWPKYNFYKADQRYME  783

Query: 798 IAKLLGLPAATPEEAVESYAKAVYDLGTRLGIKMNFRDQGIDEKEWKEKSRELAFLAYED  857
           +A+++GL   TP E VE++AKA  +L         F+    IDE W  K  E+A LA+ED
Sbjct: 784 LAQMVGLKCNTPAEGVEAFAKACEELMKATETITGFKKANIDEAAWMSKVPEMALLAFED  843

Query: 858 QCSPANPRLPMVDHMQEIIEDAYY                                     881
           QCSPANPR+PMV  M++I++  AYY
Sbjct: 844 QCSPANPRVPMVKDMEKILKAAYY                                     867
```

A related DNA sequence was identified in *S. pyogenes* <SEQ ID 875> which encodes the amino acid sequence <SEQ ID 876>. Analysis of this protein sequence reveals the following:

```
Possible site: 55
>>> Seems to have no N-terminal signal sequence
      INTEGRAL      Likelihood = -3.66    Transmembrane   643-659 (642-660)
      INTEGRAL      Likelihood = -1.81    Transmembrane   102-118 (102-118)

----- Final Results -----
             bacterial membrane --- Certainty = 0.2466(Affirmative) < succ>
              bacterial outside --- Certainty = 0.0000(Not Clear)   < succ>
            bacterial cytoplasm --- Certainty = 0.0000(Not Clear)   < succ>
```

The protein has homology with the following sequences in the databases:

```
>GP: AAA81906 GB: U04863 alcohol dehydrogenase 2
[Entamoeba histolytica]
Identities = 535/870 (61%), Positives = 669/870 (76%),
Gaps = 3/870 (0%)

Query:   6 NTVETTSVSVTIDALVQKGLAALEEMRKLD--QEQVDYIVAKASVAALDAHGELAKHAYE    63
           +T +T +V  I+ LV+K  AL+E  K +  QE++DYIV KASVAALD H  LA   A E
Sbjct:   2 STQQTMTVDEHINQLVRKAQVALKEYLKPEYTQEKIDYIVKKASVAALDQHCALAAAAVE   61

Query:  64 ETGRGVFEDKATKHLFACEHVVNNMRHQKTVGIIEEDDVTGLTLIAEPVGVICGITPTTN  123
           ETGRG+FEDKATK++FACEHV + MRH KTVGII  D + G+T IAEPVGV+CG+TP TN
Sbjct:  62 ETGRGIFEDKATKNIFACEHVTHEMRHAKTVGIINVDPLYGITEIAEPVGVVCGVTPVTN  121

Query: 124 PTSTAIFKSLISLKTRNPIIFAFHPSAQESSAHAARIVRDAAIAAGAPENCVQWVETPSL  183
           PTSTAIFKSLIS+KTRNPI+F FHPSA + S   AA+IVRDAAIAAGAPENC+QW+E   +
Sbjct: 122 PTSTAIFKSLISIKTRNPIVFSFHPSALKCSIMAAKIVRDAAIAAGAPENCIQWIEFGGI  181

Query: 184 EATNALMNHDGIATILATGGNAMVKAAYSCGKPALGVGAGNVPAYVEKSANIRQAAHDIV  243
           EA+N LMNH G+ATILATGGNAMVKAAYS GKPALGVGAGNVP Y+EK+  NI+QAA+D+V
Sbjct: 182 EASNKLMNHPGVATILATGGNAMVKAAYSSGKPALGVGAGNVPTYIEKTCNIKQAANDVV  241

Query: 244 MSKSFDNGMVCASEQAVIIDKEIYDDFVAEFKSYHTYFVNKKEKALLEEFCFGAKANSKN  303
           MSKSFDNGM+CASEQA IIDKEIYD  V E K+    YF+N++EKA LE+F FG  A S +
Sbjct: 242 MSKSFDNGMICASEQAAIIDKEIYDQVVEEMKTLGAYFINEEEKAKLEKFMFGVNAYSAD  301

Query: 304 CAGAKLNPNIVGKPATWIAEQAGFTVPEGTNILAAECKEVSENEPLTREKLSPVIAVLKS  363
            A+LNP   G    W AEQ G  VPE NI+ A CKEV NEPLTREKLSPV+A+LK+
Sbjct: 302 VNNARLNPKCPGMSPQWFAEQVGIKVPEDCNIICAVCKEVGPNEPLTREKLSPVLAILKA  361

Query: 364 ESREDGVEKARQMVEFNGLGHSAAIHTADAELAKEFGTRIRAIRVIWNSPSTFGGIGDVY  423
           E+ +DG++KA MVEFNG GHSAAIH+ D  +++   ++A R++ N+PS+ GGIG +Y
Sbjct: 362 ENTQDGIDKAEAMVEFNGRGHSAAIHSNDKAVVEKYALTMKACRILHNTPSSQGGIGSIY  421

Query: 424 NAFLPSLTLGCGSYGRNAVGDNVSAINLLNIKKVGRRRNNMQWFKVPSKTYFERDSIQYL  483
           N    PS TLGCGSYG N+V  NV+  NLLNIK++  RRNN+QWF+VP K +FE  SI+YL
Sbjct: 422 NYIWPSFTLGCGSYGGNSVSANVTYHNLLNIKRLADRRNNLQWFRVPPKIFFEPHSIRYL  481

Query: 484 QKCRDVERVMIVTDHAMVELGFLDRIIEQLDLRRNKVVYQIFAEVEPDPDITTVMKGTEL  543
            + +++ ++ IV+D M +LG++DR+++  L  R N+V  +IF +VEPDP I TV KG  +
Sbjct: 482 AELKELSKIFIVSDRMMYKLGYVDRVMDVLKRRSNEVEIEIFIDVEPDPSIQTVQKGLAV  541

Query: 544 MRTFKPDTIIALGGGSPMDAAKVMWLFYEQPEVDFHDLVQKFMDIRKRAFKFPELGKKTK  603
           M TF PD IIA+GGGS MDAAK+MWL YE PE DF  + QKF+D+RKRAFKFP  GKK +
Sbjct: 542 MNTFGPDNIIAIGGGSAMDAAKIMWLLYEHPEADFFAMKQKFIDLRKRAFKFPTMGKKAR  601

Query: 604 FVAIPTTSGTGSEVTPFAVISDKANNRKYPIADYSLTPTVAIVDPALVLTVPGFIAADTG  663
            + IPTTSGTGSEVTPFAVISD   +KYP+ADYSLTP+VAIVDP   +++P    ADTG
Sbjct: 602 LICIPTTSGTGSEVTPFAVISDHETGKKYPLADYSLTPSVAIVDPMFTMSLPKRAIADTG  661

Query: 664 MDVLTHATEAYVSQMANDFTDGLALQAIKIVFDNLEKSVKTADFEAREKMHNASTMAGMA  723
           +DVL HATEAYVS MAN++TDGLA +A+K+VF+NL KS     D EAREKMHNA+T+AGMA
Sbjct: 662 LDVLVHATEAYVSVMANEYTDGLAREAVKLVFENLLKSY-NGDLEAREKMHNAATIAGMA  720

Query: 724 FANAFLGISHSMAHKIGAQFHTVHGRTNAILLPYVIRYNGTRPAKTATWPKYNYYRADEK  783
           FA+AFLG+ HSMAHK+GA FH  HGR A+LLP+VIRYNG +P K A WPKYN+Y+AD++
Sbjct: 721 FASAFLGMDHSMAHKVGAAFHLPHGRCVAVLLPHVIRYNGQKPRKLAMWPKYNFYKADQR  780

Query: 784 YQDIAKLLGLPASTPEEAVESYAKAVYDLGCRVGIQMNFKAQGIDENEWKEHSRELAYLA  843
           Y ++A+++GL +TP E VE++AKA +L       FK  IDE W    E+A LA
Sbjct: 781 YMELAQMVGLKCNTPAEGVEAFAKACEELMKATETITGFKKANIDEAAWMSKVPEMALLA  840

Query: 844 YEDQCSPANPRLPMVDHMQEIIEDAYYGA                               873
           +EDQCSPANPR+PMV M++I++ AYY  A
Sbjct: 841 FEDQCSPANPRVPMVKDMEKILKAAYYPIA                              870
```

An alignment of the GAS and GBS proteins is shown below:

```
Identities = 827/880 (93%), Positives = 852/880 (95%)
Query:   12 MTEKTKAVETTDVALAIDTLVQNGLKALDEMRQLNQEQVDYIVAKASVAALDAHGELALH   71
            MTE     VETT V++ ID LVQ GL AL+EMR+L+QEQVDYIVAKASVAALDAHGELA H
Sbjct:    1 MTEGHNTVETTSVSVTIDALVQKGLAALEEMRKLDQEQVDYIVAKASVAALDAHGELAKH   60

Query:   72 AVEETGRGVFEDKATKNLFACEHVVNNMRHTKTVGVIEEDDVTGLTLIAEPVGVVCGITP  131
            A EETGRGVFEDKATK+LFACEHVVNNMRH KTVG+IEEDDVTGLTLIAEPVGV+CGITP
Sbjct:   61 AYEETGRGVFEDKATKHLFACEHVVNNMRHQKTVGIIEEDDVTGLTLIAEPVGVICGITP  120

Query:  132 TTNPTSTAIFKSLISLKTRNPIIFAFHPSAQESSAHAARIVRDAAIAAGAPENCVQWIEQ  191
            TTNPTSTAIFKSLISLKTRNPIIFAFHPSAQESSAHAARIVRDAAIAAGAPENCVQW+E
Sbjct:  121 TTNPTSTAIFKSLISLKTRNPIIFAFHPSAQESSAHAARIVRDAAIAAGAPENCVQWVET  180

Query:  192 PSIDATNALMNHDGIATILATGGNAMVKAAYSCGKPALGVGAGNVPAYVEKSANIRQAAH  251
            PS++ATNALMNHDGIATILATGGNAMVKAAYSCGKPALGVGAGNVPAYVEKSANIRQAAH
Sbjct:  181 PSLEATNALMNHDGIATILATGGNAMVKAAYSCGKPALGVGAGNVPAYVEKSANIRQAAH  240

Query:  252 DIVMSKSFDNGMVCASEQAVIIDKEIYKEFVEEFKSYHTYFVNKKEKALLEEFCFGAKAN  311
            DIVMSKSFDNGMVCASEQAVIIDKEIY +FV EFKSYHTYFVNKKEKALLEEFCFGAKAN
Sbjct:  241 DIVMSKSFDNGMVCASEQAVIIDKEIYDDFVAEFKSYHTYFVNKKEKALLEEFCFGAKAN  300

Query:  312 SKNCAGAKLNPNIVGKSAVWIAEQAGFTVPEGTNILAAECTEVSEKEPLTREKLSPVIAV  371
            SKNCAGAKLNPNIVGK A WIAEQAGFTVPEGTNILAAEC EVSE EPLTREKLSPVIAV
Sbjct:  301 SKNCAGAKLNPNIVGKPATWIAEQAGFTVPEGTNILAAECKEVSENEPLTREKLSPVIAV  360

Query:  372 LKAESTEDGVEKARQMVEFNGLGHSAAIHTKDADLAREFGTRIRAIRVIWNSPSTFGGIG  431
            LK+ES  EDGVEKARQMVEFNGLGHSAAIHT DA+LA+EFGTRIRAIRVIWNSPSTFGGIG
Sbjct:  361 LKSESREDGVEKARQMVEFNGLGHSAAIHTADAELAKEFGTRIRAIRVIWNSPSTFGGIG  420

Query:  432 DVYNAFLPSLTLGCGSYGRNSVGDNVSAINLLNIKKVGRRRNNMQWFKVPSKTYFERDSI  491
            DVYNAFLPSLTLGCGSYGRN+VGDNVSAINLLNIKKVGRRRNNQWFKVPSKTYFERDSI
Sbjct:  421 DVYNAFLPSLTLGCGSYGRNAVGDNVSAINLLNIKKVGRRRNNMQWFKVPSKTYFERDSI  480

Query:  492 QYLQKCRDVERVMIVTDHAMVELGFLDRIIEQLDLRRNKVVYQIFAEVEPDPDITTVMKG  551
            QYLQKCRDVERVMIVTDHAMVELGFLDRIIEQLDLRRNKVVYQIFAEVEPDPDITTVMKG
Sbjct:  481 QYLQKCRDVERVMIVTDHAMVELGFLDRIIEQLDLRRNKVVYQIFAEVEPDPDITTVMKG  540

Query:  552 TDLMRTFKPDTIIALGGGSPMDAAKVMWLFYEQPEVDFHDLVQKFMDIRKRAFKFPELGK  611
            T+LMRTFKPDTIIALGGGSPMDAAKVMWLFYEQPEVDEHDLVQKFNDIRKRAFKFPELGK
Sbjct:  541 TELMRTFKPDTIIALGGGSPMDAAKVMWLFYEQPEVDEHDLVQKFNDIRKRAFKFPELGK  600

Query:  612 KTKFVAIPTTSGTGSEVTPFAVISDKANNRKYPIADYSLTPTVAIVDPALVMTVPGFIAA  671
            KTKFVAIPTTSGTGSEVTPFAVISDKANNRKYPIADYSLTPTVAIVDPALV+TVPGFIAA
Sbjct:  601 KTKFVAIPTTSGTGSEVTPFAVISDKANNRKYPIADYSLTPTVAIVDPALVLTVPGFIAA  660

Query:  672 DTGMDVLTHATEAYVSQMANDYTDGLALQAIKIVFDYLERSVKDADFEAREKMHNASTMA  731
            DTGMDVLTHATEAYVSQMAND+TDGLALQAIKIVFD LE+SVK ADFEAREKMHNASTMA
Sbjct:  661 DTGMDVLTHATEAYVSQMANDFTDGLALQAIKIVFDNLEKSVKTADFEAREKMHNASTMA  720

Query:  732 GMAFANAFLGISHSMAHKIGAQFHTVHGRTNAILLPYVIRYNGTRPAKTATWPKYNYYRA  791
            GMAFANAFLGISHSMAHKIGAQFHTVHGRTNAILLPYVIRYNGTRPAKTATWPKYNYYRA
Sbjct:  721 GMAFANAFLGISHSMAHKIGAQFHTVHGRTNAILLPYVIRYNGTRPAKTATWPKYNYYRA  780

Query:  792 DEKYQDIAKLLGLPAATPEEAVESYAKAVYDLGTRLGIKMNFRDQGIDEKEWKEKSRELA  851
            DEKYQDIAKLLGLPA+TPEEAVESYAKAVYDLG R+GI+MNF+ QGIDE EWKE SRELA
Sbjct:  781 DEKYQDIAKLLGLPASTPEEAVESYAKAVYDLGCRVGIQMNFKAQGIDENEWKEHSRELA  840

Query:  852 FLAYEDQCSPANPRLPMVDHMQEIIEDAYYGYEERPGRRK                      891
            +LAYEDQCSPANPRLPMVDHMQEIIEDAYYGY ERPGRRK
Sbjct:  841 YLAYEDQCSPANPRLPMVDHMQEIIEDAYYGYAERPGRRK                      880
```

A related GBS gene <SEQ ID 8533> and protein <SEQ ID 8534> were also identified. Analysis of this protein sequence reveals the following:

```
Lipop:     Possible site: -1           Crend: 10
McG:       Discrim Score: -4.68
GvH:       Signal Score (-7.5): -2.48
           Possible site: 21
>>> Seems to have no N-terminal signal sequence
ALOM program count: 1 value: -2.66 threshold: 0.0
INTEGRAL    Likelihood = -2.66           Transmembrane 100-116 (99-117)
PERIPHERAL  Likelihood = 3.61            173
modified ALOM score: 1.03
```

-continued

```
*** Reasoning Step: 3
----- Final Results -----
              bacterial membrane --- Certainty = 0.2062 (Affirmative) <
succ>
              bacterial outside  --- Certainty = 0.0000 (Not Clear)   < succ>
              bacterial cytoplasm --- Certainty = 0.0000 (Not Clear)  < succ>
```

SEQ ID 8534 (GBS432) was expressed in *E. coli* as a GST-fusion product. SDS-PAGE analysis of total cell extract is shown in FIG. 173 (lane 5; MW 66 kDa). It was also expressed in *E. coli* as a His-fusion product. SDS-PAGE analysis of total cell extract is shown in FIG. 77 (lane 7; MW 41 kDa).

Figure 223:
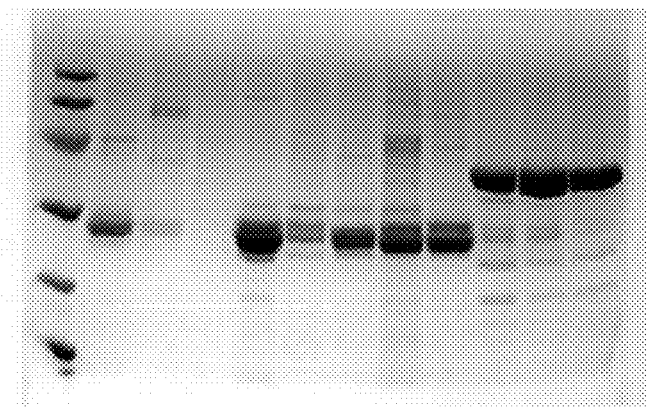

GBS432-GST was purified as shown in FIG. 223, lane 9.

Based on this analysis, it was predicted that these proteins and their epitopes could be useful antigens for vaccines or diagnostics.

EXAMPLE 274

A DNA sequence (GBSx0299) was identified in *S. agalactiae* <SEQ ID 877> which encodes the amino acid sequence <SEQ ID 878>. Analysis of this protein sequence reveals the following:

```
Possible site: 21
>>> Seems to have no N-terminal signal sequence

----- Final Results -----
              bacterial cytoplasm --- Certainty = 0.3444 (Affirmative) <
succ>
              bacterial membrane  --- Certainty = 0.0000 (Not Clear)   < succ>
              bacterial outside   --- Certainty = 0.0000 (Not Clear)   < succ>
```

The protein has no significant homology with any sequences in the GENPEPT database, but there is homology to SEQ ID 880.

Based on this analysis, it was predicted that this protein and its epitopes, could be useful antigens for vaccines or diagnostics.

EXAMPLE 275

A DNA sequence (GBSx0300) was identified in *S. agalactiae* <SEQ ID 881> which encodes the amino acid sequence <SEQ ID 882>. Analysis of this protein sequence reveals the following:

```
Possible site: 26
>>> Seems to have a cleavable N-term signal seq.
INTEGRAL    Likelihood = -8.39     Transmembrane  74-90   (69-94)
INTEGRAL    Likelihood = -5.31     Transmembrane 168-184  (163-186)
INTEGRAL    Likelihood = -4.83     Transmembrane  34-50   (29-52)
INTEGRAL    Likelihood = -0.75     Transmembrane 202-218  (202-219)

----- Final Results -----
              bacterial membrane  --- Certainty = 0.4354 (Affirmative) < succ>
              bacterial outside   --- Certainty = 0.0000 (Not Clear)   < succ>
              bacterial cytoplasm --- Certainty = 0.0000 (Not Clear)   < succ>
```

The protein has homology with the following sequences in the GENPEPT database:

```
>GP:CAA17305 GB:AL021926 hypothetical protein Rv0111
[Mycobacterium tuberculosis]
Identities = 70/218 (32%), Positives = 104/218 (47%), Gaps = 12/218 (5%)
Query:    9 VRITGLLLVLLYHFFKNSFPGGFVGVDIFFTFSGFLITALLIDEFSKTKKIDFVSFCRRR   68
            +R   + LVL H       GGF+GVD FF  SGFLIT+LL+DE  +T +ID   F  RR
Sbjct:   39 LRAIAVALVLASHGGIPGMGGGFIGVDAFFVLSGFLITSLLLDELGRTGRIDLSGFWIRR   98
```

-continued

```
Query:   69  FYRIFPPLVLMVLVTIPFVFLVKSDFRASIGSQIMTALGFTSNFYEILTGGNYESQFI-P  127
             R+ P LVLMVL        L       + S  + A +T+N+  +      +Y +Q   P
Sbjct:   99  ARRLLPALVLMVLTVSAARALFPDQALTGLRSDAIAAFLWTANWRFVAQNTDYFTQGAPP  158

Query:  128  HLFVHTWSLSIEVHFYVLWGL----TVWLLSKRSKDQKQLRGTLFLISMGIFGVSFLTMF  183
             HTWSL +E  +YV+W L        LL+ R++ ++    R T+  +     F ++ L
Sbjct:  159  SPLQHTWSLGVEEQYYVVWPLLLIGATLLLAARAR-RRCRRATVGGVRFAAFLIASLGTM  217

Query:  184  VRAFFVDNFST------IYFSTLSHIFPPFLGAMVATI                       215
               A    F++       IYF T +    +G+  A +
Sbjct:  218  ASATAAVAFTSAATRDRIYFGTDTRAQALLIGSAAAAL                       255
```

A related DNA sequence was identified in *S. pyogenes* <SEQ ID 879> which encodes the amino acid sequence <SEQ ID 880>. Analysis of this protein sequence reveals the following:

```
Possible site: 46
>>>Seems to have an uncleavable N-term signal seq
INTEGRAL    Likelihood = -10.83    Transmembrane 325-341 (313-346)
INTEGRAL    Likelihood =  -9.29    Transmembrane 237-253 (234-258)
INTEGRAL    Likelihood =  -7.91    Transmembrane 166-182 (162-188)
INTEGRAL    Likelihood =  -6.10    Transmembrane  72-88   (68-92)
INTEGRAL    Likelihood =  -4.09    Transmembrane 264-280 (260-281)
INTEGRAL    Likelihood =  -2.87    Transmembrane 371-387 (370-390)
INTEGRAL    Likelihood =  -2.66    Transmembrane  34-50   (32-50)
INTEGRAL    Likelihood =  -1.91    Transmembrane   3-19    (3-19)
INTEGRAL    Likelihood =  -0.85    Transmembrane 136-152 (136-154)

----- Final Results -----
            bacterial membrane   --- Certainty = 0.5331 (Affirmative) < succ>
            bacterial outside    --- Certainty = 0.0000 (Not Clear)  < succ>
            bacterial cytoplasm  --- Certainty = 0.0000 (Not Clear)  < succ>
```

An alignment of the GAS and GBS proteins is shown below:

```
Identities = 167/226 (73%), Positives = 195/226 (85%)
Query:    1  MRIKWFSLVRITGLLLVLLYHFFKNSFPGGFVGVDIFFTFSGFLITALLIDEFSKTKKID   60
             MRIKWFS VR+TGLLLVLLYHFFKN FPGGF+GVDIFFTFSG+LITALLIDE++K  +ID
Sbjct:    1  MRIKWFSFVRVTGLLLVLLYHFFKNVFPGGFIGVDIFFTFSGYLITALLIDEYTKKESID   60

Query:   61  FVSFCRRRFYRIFPPLVLMVLVTIPFVFLVKSDFRASIGSQIMTALGFTSNFYEILTGGN  120
             + F +RRFYRI PPLVLM+L+TIPF FL+K DF A+IGSQI   LGFT+N YEILTG +
Sbjct:   61  IIGFLKRRFYRIVPPLVLMILLTIPFTFLIKKDFIANIGSQITAVLGFTTNIYEILTGSS  120

Query:  121  YESQFIPHLFVHTWSLSIEVHFYVLWGLTVWLLSKRSKDQKQLRGTLFLISMGIFGVSFL  180
             YESQFIPHLFVHTWSL+IEVHFY+ WG+ VWLL++R +  QKQLRG LFLIS+GIF +SFL
Sbjct:  121  YESQFIPHLFVHTWSLAIEVHFYLFWGVFVWLLARRKETQKQLRGLLFLISLGIFAISFL  180

Query:  181  TMFVRAFFVDNFSTIYFSTLSHIFPPFLGAMVATISGIREITGRFK               226
             +MF+R+F   NFS IYFS+LSH FPFFLGAM ATI+GI E T  RF+
Sbjct:  181  SMFIRSFMTSNFSLIYFSSLSHSFPFFLGAMFATITGINETTVRFQ               226
```

Based on this analysis, it was predicted that these proteins and their epitopes could be useful antigens for vaccines or diagnostics.

EXAMPLE 276

A DNA sequence (GBSx0302) was identified in *S. agalactiae* <SEQ ID 883> which encodes the amino acid sequence <SEQ ID 884>. Analysis of this protein sequence reveals the following:

```
Possible site: 38
>>> Seems to have a cleavable N-term signal seq.

----- Final Results -----
            bacterial outside --- Certainty = 0.3000 (Affirmative) < succ>
```

-continued
```
    bacterial membrane --- Certainty = 0.0000 (Not Clear) < succ>
    bacterial cytoplasm --- Certainty = 0.0000 (Not Clear) < succ>
```

The protein has homology with the following sequences in the GENPEPT database:

```
!GB:AE004818 hypothetical protein [Pseudomonas aerug . . .
!GB:AE004818 hypothetical protein [Pseudomonas aerug . . .
!GB:AE004818 hypothetical protein [Pseudomonas aerug . . .
!GB:AE004818 hypothetical protein [Pseudomonas aerug . . .
!GB:AE004818 hypothetical protein [Pseudomonas aerug . . .

>GP:AAG07403 GB:AE004818 hypothetical protein [Pseudomonas aeruginosa]
Identities = 33/80 (41%), Positives = 50/80 (62%)
Query:  45 KYVGSIVNHHMTGKGKLTYENGDYYKGDFVNGVFEGKGTFVSVHGWSYTGDFKKGQPDGQ 104
           +Y G +V+ + G+G+L Y+NG +Y G F +G+   G GT+    G Y+G F  G  DGQ
Sbjct:  39 RYRGELVDGRLEGQGRLDYDNGAWYAGRFEHGLLHGHGTWQGADGSRYSGGFAAGLFDGQ  98

Query: 105 GRLNAKNKKVYKGTFKQGIY 124
           GRL    + VY+G F+QG+
Sbjct:  99 GRLAMADGSVYQGGFRQGLF 118

Identities = 31/91 (34%), Positives = 46/91 (50%), Gaps = 2/91 (2%)
Query:  34 QGVFSYDGGKIKYVGSIVNHHMTGKGKLTYENGDYYKGDFVNGVFEGKGTFVSVHGWSYT  93
           QG   YD G  Y G +  G G       +G Y G F  G+F+G+G       G  Y
Sbjct:  52 QGRLDYDNGAW-YAGRFEHGLLHGHGTWQGADGSRYSGGFAAGLFDGQGRLAMADGSVYQ 110

Query:  94 GDFKKGQPDGQGRLNAKNKKVYKGTFKQGIY 124
           G F++G  DG+G L  +  + Y+G F++G+Y
Sbjct: 111 GGFRQGLFDGEGSLEQQGTR-YRGGFRKGLY 140

Identities = 31/91 (34%), Positives = 42/91 (46%), Gaps = 1/91 (1%)
Query:  32 SSQGVFSYDGGKIKYVGSIVNHHMTGKGKLTYENGDYYKGDFVNGVFEGKGTFVSVHGWS  91
           S QG       G +Y GS    + G+G +   G+ Y G F +G   GKG +     G
Sbjct: 141 SGQGTLDGSDGS-RYQGSFRQGRLEGEGSFSDSQGNQYAGTFRDGQLNGKGRWSGPDGDR 199

Query:  92 YTGDFKKGQPDGQGRLNAKNKKVYKGTFKQG 122
           Y G FK  Q   GQGR  + +   V+  G F +G
Sbjct: 200 YVGQFKDNQFHGQGRYESASGDVWIGRFSEG 230

Identities = 31/91 (34%), Positives = 45/91 (49%), Gaps = 4/91 (4%)
Query:  34 QGVFSYDGGK----IKYVGSIVNHHMTGKGKLTYENGDYYKGDFVNGVFEGKGTFVSVHG  89
           QG+F +G       +Y G    +G+G L    +G Y+G F  G  EG+G+F      G
Sbjct: 115 QGLFDGEGSLEQQGTRYRGGFRKGLYSGQGTLDGSDGSRYQGSFRQGRLEGEGSFSDSQG 174

Query:  90 WSYTGDFKKGQPDGQGRLNAKNKKVYKGTFK 120
              Y G F +GQ  +G+GR +  +    Y G FK
Sbjct: 175 NQYAGTFRDGQLNGKGRWSGPDGDRYVGQFK 205

Identities = 28/87 (32%), Positives = 45/87 (51%), Gaps = 1/87 (1%)
Query:  34 QGVFSYDGGKIKYVGSIVNHHMTGKGKLTYENGDYYKGDFVNGVFEGKGTFVSVHGWSYT  93
           +G FS  G +Y G+ + + GKG+ + +GD Y G F+ F G+G + S G +
Sbjct: 166 EGSFSDSQGN-QYAGTFRDGQLNGKGRWSGPDGDRYVGQFKDNQFHGQGRYESASGDVWI 224

Query:  94 GDFKKGQPDGQGRLNAKNKKVYKGTFK 120
           G F +G +G G L  +  Y+G F+
Sbjct: 225 GRFSEGALNGPGELLGADGSRYRGGFQ 251

Identities = 28/89 (31%), Positives = 43/89 (47%), Gaps = 2/89 (2%)
Query:  34 QGVFSYDGGKIKYVGSIVNHHMTGKGKLTYENGDYYKGDFVNGVFEGKGTFVSVHGWSYT  93
           QG + G + Y G G+G L + G Y+G F G++ G+GT   G Y
Sbjct:  98 QGRLAMADGSV-YQGGFRQGLFDGEGSLE-QQGTRYRGGFRKGLYSGQGTLDGSDGSRYQ 155

Query:  94 GDFKKGQPDGQGRLNAKNKKVYKGTFKQG 122
           G F++G+ +G+G +        Y GTF+ G
Sbjct: 156 GSFRQGRLEGEGSFSDSQGNQYAGTFRDG 184

Identities = 25/80 (31%), Positives = 37/80 (46%)
Query:  45 KYVGSIVNHHMTGKGKLTYENGDYYKGDFVNGVFEGKGTFVSVHGWSYTGDFKKGQPDGQ 104
           +YVG   ++  G+G+     +GD  G F   GG    G  Y G F+ +      GQ
Sbjct: 199 RYVGQFKDNQFHGQGRYESASGDVWIGRFSEGALNGPGELLGADGSRYRGGFQFWRFHGQ 258

Query: 105 GRLNAKNKKVYKGTFKQGIY 124
           G L  +    Y+G F  G Y
Sbjct: 259 GLLEQLDGTRYEGGFAAGAY 278
```

A related DNA sequence was identified in *S. pyogenes* <SEQ ID 885> which encodes the amino acid sequence <SEQ ID 886>. Analysis of this protein sequence reveals the following:

```
Possible site: 35
>>> Seems to have an uncleavable N-term signal seq
INTEGRAL    Likelihood = -13.16         Transmembrane 20-36 (12-41)

----- Final Results -----
              bacterial membrane --- Certainty = 0.6265 (Affirmative) <
succ>
              bacterial outside --- Certainty = 0.0000 (Not Clear) < succ>
              bacterial cytoplasm --- Certainty = 0.0000 (Not Clear) < succ>
```

The protein has homology with the following sequences in the databases:

```
>GP:BAA16606 GB:D90899 hypothetical protein [Synechocystis sp.]
Identities = 37/89 (41%), Positives = 49/89 (54%), Gaps = 6/89 (6%)
Query:  48  KGRMHYT------GYVINHKMNGEGKLVYPNGDIYEGTFKDGLFEGKGTFTAKTGWLYNG  101
            KG    YT        G V+  ++NG GK  Y NGD YEGT K+G  +G+G F     G  Y G
Sbjct: 141  KGTFIYTNGDRCSGTVVQGELNGSGKCEYNNGDQYEGTLKNGQPDGEGIFRFAAGGEYEG  200

Query: 102  EFHKGQANGKGVLKAKNNKVYKGIFKQGI                                130
            EF  G+ +G+G     N    ++G FKQG+
Sbjct: 201  EFQSGEFSGQGTRIFANGNRFQGQFKQGL                                229
```

An alignment of the GAS and GBS proteins is shown below:

```
Identities = 68/126 (53%), Positives = 93/126 (72%)
Query:   1  MKNFKITRTHLEILSLIIIVVFGLSVFTLTTSSQGVFSYDGGKIKYVGSIVNHHMTGKGK   60
            +K + ITR  LEI+S+I+I+V +SVF++  S++      +YD G++ Y G ++NH M G+GK
Sbjct:   8  VKKWSITRAKLEIVSVIVILVCAISVFSVRISNKTSLTYDKGRMHYTGYVINHKMNGEGK   67

Query:  61  LTYENGDYYKGDFVNGVFEGKGTFVSVHGWSYTGDFKKGQPDGQGRLNAKNKKVYKGTFK  120
            L Y NGD Y+G F +G+FEGKGTF +   GW Y G+F KGQ +G+G L AKN KVYKG FK
Sbjct:  68  LVYPNGDIYEGTFKDGLFEGKGTFTAKTGWLYNGEFHKGQANGKGVLKAKNNKVYKGIFK  127

Query: 121  QGIYQK                                                        126
            QGI+QK
Sbjct: 128  QGIFQK                                                        133
```

Figure 19:
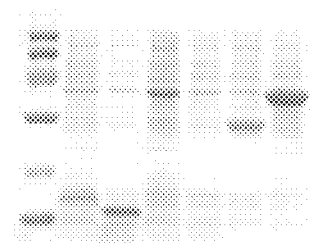
Figure 22:
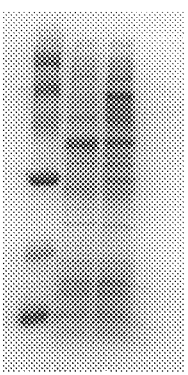

SEQ ID 884 (GBS139) was expressed in *E. coli* as a His-fusion product. SDS-PAGE analysis of total cell extract is shown in FIG. 19 (lane 3; MW 13 kDa). It was also expressed in *E. coli* as a GST-fusion product. SDS-PAGE analysis of total cell extract is shown in FIG. 22 (lane 2; MW 38.2 kDa), in FIG. 24 (lane 7; MW 38 kDa) and in FIG. 33 (lane 7; MW 38.2 kDa).

Figure 287:
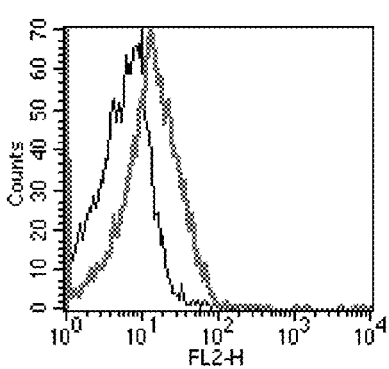

The GBS139-GST fusion product was purified (FIG. 200, lane 2) and used to immunise mice. The resulting antiserum was used for FACS (FIG. 287), which confirmed that the protein is immunoaccessible on GBS bacteria.

Based on this analysis, it was predicted that these proteins and their epitopes could be useful antigens for vaccines or diagnostics.

EXAMPLE 277

A DNA sequence (GBSx0303) was identified in *S. agalactiae* <SEQ ID 887> which encodes the amino acid sequence <SEQ ID 888>. This protein is predicted to be holliday junction dna helicase ruvb (ruvB). Analysis of this protein sequence reveals the following:

```
Possible site: 59
>>> Seems to have no N-terminal signal sequence

----- Final Results -----
              bacterial cytoplasm --- Certainty = 0.4386 (Affirmative) < succ>
```

```
             bacterial membrane --- Certainty = 0.0000 (Not Clear)   < succ>
              bacterial outside --- Certainty = 0.0000 (Not Clear)   < succ>
```

The protein has homology with the following sequences in the GENPEPT database:

```
>GP:CAB75331 GB:Y15896 RuvB protein [Bacillus subtilis]
Identities = 196/322 (60%), Positives = 254/322 (78%)
Query:   3 RFLDSDAMGDEELVERTLRPQYLREYIGQDKVKDQLKIFIEAAKLRDESLDHVLLFGPPG    62
           R + S+A    E ++E++LRPQ L +YIGQ KVK+ L++FI+AAK+R E+LDHVLL+GPPG
Sbjct:   4 RLVSSEADNHESVIEQSLRPQNLAQYIGQHKVKENLRVFIDAAKMRQETLDHVLLYGPPG    63

Query:  63 LGKTTMAFVIANELGVNLKQTSGPAIEKSGDLVAILNDLEPGDVLFIDEIHRMPMAVEEV   122
           LGKTT+A ++ANE+GV L+ TSGPAIE+ GDL AIL  LEPGDVLFIDEIHR+   ++EEV
Sbjct:  64 LGKTTLASIVANEMGVELRTTSGPAIERPGDLAAILTALEPGDVLFIDEIHRLHRSIEEV   123

Query: 123 LYSAMEDFYIDIMIGAGETSRSVHLDLPPFTLIGATTRAGMLSNPLRARFGITGHMEYYE   182
           LY AMEDF +DI+IG G ++RSV LDLPPFTL+GATTR G+L+ PLR  RFG+   +EYY
Sbjct: 124 LYPAMEDFCLDIVIGKGPSARSVRLDLPPFTLVGATTRVGLLTAPLRDRFGVMSRLEYYT   183

Query: 183 ENDLTEIIERTADIFEMKITYEAASELARRSRGTPRIANRLLKRVRDYAQIMGDGLIDDN   242
           + +L +I+ RTAD+FE++I   +A  E+ARRSRGTPR+ANRLL+RVRD+AQ++GD   I ++
Sbjct: 184 QEELADIVTRTADVFEVEIDKPSALEIARRSRGTPRVANRLLRRVRDFAQVLGDSRITED   243

Query: 243 ITDKALTMLDVDHEGLDYVDQKILRTMIEMYNGGPVGLGTLSVNIAEERDTVEDMYEPYL   302
           I+   AL  L VD  GLD++D K+L  MIE +NGGPVGL T+S  I EE  T+ED +YEPYL
Sbjct: 244 ISQNALERLQVDRLGLDHIDHKLLMGMIEKFNGGPVGLDTISATIGEESHTIEDVYEPYL   303

Query: 303 IQKGFIMRTRTGRVATVKAYEH                                          324
           +Q GFI RT  GR+ T    Y H
Sbjct: 304 LQIGFIQRTPRGRIVTPAVYHH                                          325
```

A related GBS nucleic acid sequence <SEQ ID 10943> which encodes amino acid sequence <SEQ ID 10944> was also identified.

A related DNA sequence was identified in *S. pyogenes* <SEQ ID 889> which encodes the amino acid sequence <SEQ ID 890>. Analysis of this protein sequence reveals the following:

```
Possible site: 26
>>> Seems to have no N-terminal signal sequence

----- Final Results -----
                 bacterial cytoplasm --- Certainty = 0.0686 (Affirmative) < succ>
                  bacterial membrane --- Certainty = 0.0000 (Not Clear)   < succ>
                   bacterial outside --- Certainty = 0.0000 (Not Clear)   < succ>
```

An alignment of the GAS and GBS proteins is shown below:

```
Identities = 282/327 (86%), Positives = 306/327 (93%)
Query:   1 MTRFLDSDAMGDEELVERTLRPQYLREYIGQDKVKDQLKIFIEAAKLRDESLDHVLLFGP    60
           M R LD++ MG+EE  +RTLRPQYL EYIGQDKVK+Q  IFIEAAK RDESLDHVLLFGP
Sbjct:  25 MARILDNNVMGNEEFSDRTLRPQYLHEYIGQDKVKEQFAIFIEAAKRRDESLDHVLLFGP    84

Query:  61 PGLGKTTMAFVIANELGVNLKQTSGPAIEKSGDLVAILNDLEPGDVLFIDEIHRMPMAVE   120
           PGLGKTTMAFVIANELGVNLKQTSGPA+EK+GDLVAILN+LEPGD+LFIDEIHRMPM+VE
Sbjct:  85 PGLGKTTMAFVIANELGVNLKQTSGPAVEKAGDLVAILNELEPGDILFIDEIHRMPMSVE   144

Query: 121 EVLYSAMEDFYIDIMIGAGETSRSVHLDLPPFTLIGATTRAGMLSNPLRARFGITGHMEY   180
           EVLYSAMEDFYIDIMIGAG+TSRS+HLDLPPFTLIGATTRAGMLSNPLRARFGITGHMEY
Sbjct: 145 EVLYSAMEDFYIDIMIGAGDTSRSIHLDLPPFTLIGATTRAGMLSNPLRARFGITGHMEY   204

Query: 181 YEENDLTEIIERTADIFEMKITYEAASELARRSRGTPRIANRLLKRVRDYAQIMGDGLID   240
```

-continued

```
                Y+E DLTEI+ERTA IFE+KI +EAA +LA RSRGTPRIANRLLKRVRDYAQI+GDG+I
Sbjct:  205     YQEKDLTEIVERTATIFEIKIDHEAARKLACRSRGTPRIANRLLKRVRDYAQIIGDGIIT    264

Query:  241     DNITDKALTMLDVDHEGLDYVDQKILRTMIEMYNGGPVGLGTLSVNIAEERDTVEDMYEP    300
                 ITD+ALTMLDVD EGLDY+DQKILRTMIEMY GGPVGLGTLSVNIAEER+TVE+MYEP
Sbjct:  265     AQITDRALTMLDVDREGLDYIDQKILRTMIEMYQGGPVGLGTLSVNIAEERNTVEEMYEP    324

Query:  301     YLIQKGFIMRTRTGRVATVKAYEHLGY                                    327
                YLIQKGF+MRTRTGRVAT KAY HLGY
Sbjct:  325     YLIQKGFLMRTRTGRVATQKAYRHLGY                                    351
```

Based on this analysis, it was predicted that these proteins and their epitopes could be useful antigens for vaccines or diagnostics.

EXAMPLE 278

A DNA sequence (GBSx0304) was identified in *S. agalactiae* <SEQ ID 891> which encodes the amino acid sequence <SEQ ID 892>. Analysis of this protein sequence reveals the following:

```
Possible site: 43
>>> Seems to have no N-terminal signal sequence
INTEGRAL     Likelihood = -2.87        Transmembrane 157-173 (157-174)
INTEGRAL     Likelihood = -1.49        Transmembrane 205-221 (205-222)

----- Final Results -----
            bacterial membrane  --- Certainty = 0.2147 (Affirmative) < succ>
             bacterial outside  --- Certainty = 0.0000 (Not Clear)   < succ>
            bacterial cytoplasm --- Certainty = 0.0000 (Not Clear)   < succ>
```

The protein has no significant homology with any sequences in the GENPEPT database.

A related DNA sequence was identified in *S. pyogenes* <SEQ ID 893> which encodes the amino acid sequence <SEQ ID 894>. Analysis of this protein sequence reveals the following:

```
Possible site: 56
>>> Seems to have no N-terminal signal sequence

----- Final Results -----
            bacterial cytoplasm --- Certainty = 0.3097 (Affirmative) < succ>
             bacterial membrane --- Certainty = 0.0000 (Not Clear)   < succ>
             bacterial outside  --- Certainty = 0.0000 (Not Clear)   < succ>
```

An alignment of the GAS and GBS proteins is shown below:

```
Identities = 130/303 (42%), Positives = 202/303 (65%)
Query:    1     MLKHFGSKVRNLRVTRNITREDFCGDETELSVRQLARIESGQSIPNLTKAHYIAKQLNVK    60
                ML+HFG KV+ LR+ + I+RED CGDE+ELSVRQLARIE GQSIP+L+K  +IAK LNV
Sbjct:    1     MLEHFGGKVKVLRLEKRISREDLCGDESELSVRQLARIELGQSIPSLSKVIFIAKALNVS    60

Query:   61     LDILTGGESLELPKRYKELKYLILRIPTYADAERLKLRECQFDHIFEEFYDNLPEDECLA    120
                +  LT G  LELPKRYKELKYLILR PTY D  +L++RE QFD  IFE++YD LPE+E  +
Sbjct:   61     VGYLTDGADLELPKRYKELKYLILRTPTYMDDGKLQVREEQFDEIFEDYYDKLPEEEKII    120

Query:  121     IDSLQAKFEVYQTGDINFGVEVLCECFDKVKYKEKYTLNDLIIIDLFLTCAVVSKFNNRA    180
                ID LQA +   + + NFG+++L E F+++K K ++   NDLI+++L+L    +    + +
Sbjct:  121     IDCLQATLDTLLSENTNFGIDLLQEYFNQIKTKVRFRQNDLILLELYLAYLDIEGMDGQY    180

Query:  181     FTKEVFQTICKTLISQNHKLTAEDLFWFNHVLLNCVFVGLCLNSEECLAEMLEVSRQTMV    240
                 K  + ++   L  Q +    ++ ++LF N ++++    + L N  + L +  +E+S++'M
Sbjct:  181     SDKIFYDSLLDNLSEQFEQFELDELFIVNKIIIDISSLSLKNNRLDNLEKAIEMSQKIMA    240

Query:  241     STHDFHKMPLYFMYQWKYFITIDNDIKSAENAYQQSIMFSKMIDDKHLIKKLELEWQEDI    300
                   D+++MP+   + +WKYF+     DI  AE   ++ +F++M  D++L   KL EW++D+
Sbjct:  241     KIQDWNRMPILKLIEWKYFLIKQKDIIKAEQSFMKACLFAQMTADQYLENKLIQEWEKDV    300
```

```
Query: 301 TGH                                                           303
            +
Sbjct: 301 KSY                                                           303
```

SEQ ID 892 (GBS319) was expressed in *E. coli* as a His-fusion product. SDS-PAGE analysis of total cell extract is shown in FIG. 40 (lane 4; MW 37 kDa). It was also expressed in *E. coli* as a GST-fusion product. SDS-PAGE analysis of total cell extract is shown in FIG. 46 (lane 7; MW 62 kDa).

Based on this analysis, it was predicted that these proteins and their epitopes could be useful antigens for vaccines or diagnostics.

EXAMPLE 279

A DNA sequence (GBSx0305) was identified in *S. agalactiae* <SEQ ID 895> which encodes the amino acid sequence <SEQ ID 896>. This protein is predicted to be adenylosuccinate lyase (purB). Analysis of this protein sequence reveals the following:

```
Possible site: 35
>>> Seems to have no N-terminal signal sequence

----- Final Results -----
            bacterial cytoplasm --- Certainty = 0.3358 (Affirmative) < succ>
             bacterial membrane --- Certainty = 0.0000 (Not Clear)   < succ>
              bacterial outside --- Certainty = 0.0000 (Not Clear)   < succ>
```

The protein has homology with the following sequences in the GENPEPT database:

```
>GP:BAB04344 GB:AP001509 adenylosuccinate lyase [Bacillus halodurans]
Identities = 326/430 (75%), Positives = 366/430 (84%)
Query:   1  MIERYSRPEMAAIWTEENKYRAWLEVEILADEAWAELGEIPKEDVAKIREKADFDIDRIL   60
            MIERY+RPEM AIWTEEN+Y+AWLEVEI+A EAWAELGEIPKEDV KIRE A FD++RIL
Sbjct:   1  MIERYTRPEMGAIWTEENRYQAWLEVEIVACEAWAELGEIPKEDVKKIREHASFDVERIL   60

Query:  61  EIEQDTRHDVVAFTRAVSETLGEERKWVHYGLTSTDVVDTAYGYLYKQANDIIRRDLENF  120
            EIEQ+TRHDVVAFTRAVSETLGEERKWVHYGLTSTDVVDTA  YL KQAN+II  DL  F
Sbjct:  61  EIEQETRHDVVAFTRAVSETLGEERKWVHYGLTSTDVVDTALSYLLKQANEIIEADLVRF  120

Query: 121  TNIVADKAKEHKFTIMMGRTHGVHAEPTTFGLKLATWYSEMKRNIERFEHAAAGVEAGKI  180
             +I+ +KA EHK+T+MMGRTHGVHAEPTTFGLKLA WY EMKRN+ERF  AA GV  GK+
Sbjct: 121  LDILKEKALEHKYTVMMGRTHGVHAEPTTFGLKLALWYEEMKRNLERFRLAAEGVRVGKL  180

Query: 181  SGAVGNFANIPPFVEQYVCDKLGIRPQEISTQVLPRDLHAEYFAVLASIATSIERMATEI  240
            SGAVG +ANI PFVEQYVC+KLG+     ISTQ L RD HAEY A LA IATSIE+  A EI
Sbjct: 181  SGAVGTYANIDPFVEQYVCEKLGLERAPISTQTLQRDRHAEYMATLALIATSIEKFAVEI  240

Query: 241  RGLQKSEQREVEEFFAKGQKGSSAMPHKRNPIGSENMTGLARVIRGHMVTAYENVALWHE  300
            RGLQKSE  REVEE+FAKGQKGSSAMPHKRNPIGSENMTG+ARV+RGHM+ AYENV LWHE
Sbjct: 241  RGLQKSETREVEEYFAKGQKGSSAMPHKRNPIGSENMTGIARVVRGHMLAAYENVPLWHE  300

Query: 301  RDISHSSAERIITPDTTILIDYMLNRFGNIVKNLTVFPENMMRNMESTFGLIYSQRVMLK  360
            RDISHSSAERII PD TI I+YMLNRFGNIVKNLTVFPENM  RNM   T+GLIYSQRV+L
Sbjct: 301  RDISHSSAERIILPDATIAINYMLNRFGNIVKNLTVFPENMKRNMTRTYGLIYSQRVLLS  360

Query: 361  LIEKGMTREEAYDLVQPKTAYSWDNQVDFKPLLEEDTKVTSCLTQEEIDELFNPIYYTKR  420
            LI+KGM REEAYDLVQPK  +W+  V F+ L+E++ ++TS L+ EEI+  F+  ++  K
Sbjct: 361  LIDKGMVREEAYDLVQPKAMEAWEKGVQFRELVEQEERITSVLSPEEIEACFDYNHHLKH  420

Query: 421  VDDIFERLGL                                                   430
            VD IFERLGL
Sbjct: 421  VDTIFERLGL                                                   430
```

A related DNA sequence was identified in *S. pyogenes* <SEQ ID 897> which encodes the amino acid sequence <SEQ ID 898>. Analysis of this protein sequence reveals the following:

```
Possible site: 35
>>> Seems to have no N-terminal signal sequence

----- Final Results -----
            bacterial cytoplasm --- Certainty = 0.3358(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below:

```
Identities = 422/430 (98%), Positives = 428/430 (99%)

Query:   1 MIERYSRPEMAAIWTEENKYRAWLEVEILADEAWAELGEIPKEDVAKIREKADFDIDRIL    60
           M+ERYSRPEMAAIWTEENKY AWLEVEILADEAWAELGEIPKEDVAKIREKADFDIDRIL
Sbjct:   1 MLERYSRPEMAAIWTEENKYHAWLEVEILADEAWAELGEIPKEDVAKIREKADFDIDRIL    60

Query:  61 EIEQDTRHDVVAFTRAVSETLGEERKWVHYGLTSTDVVDTAYGYLYKQANDIIRRDLENF   120
           EIEQDTRHDVVAFTRAVSETLGEERKWVHYGLTSTDVVDTAYGYLYKQANDIIRRDLENF
Sbjct:  61 EIEQDTRHDVVAFTRAVSETLGEERKWVHYGLTSTDVVDTAYGYLYKQANDIIRRDLENF   120

Query: 121 TNIVADKAKEHKFTIMMGRTHGVHAEPTTFGLKLATWYSEMKRNIERFEHAAAGVEAGKI   180
           TNIVADKA+EHK TIMMGRTHGVHAEPTTFGLKLATWYSEMKRNIERFEHAAAGVEAGKI
Sbjct: 121 TNIVADKAREHKMTIMMGRTHGVHAEPTTFGLKLATWYSEMKRNIERFEHAAAGVEAGKI   180

Query: 181 SGAVGNFANIPPPFVEQYVCDKLGIRPQEISTQVLPRDLHAEYFAVLASIATSIERMATEI   240
           SGAVGNFANIPPPFVE+YVCDKLGIRPQEISTQVLPRDLHAEYFAVLASIATSIERMATEI
Sbjct: 181 SGAVGNFANIPPPFVEEYVCDKLGIRPQEISTQVLPRDLHAEYFAVLASIATSIERMATEI   240

Query: 241 RGLQKSEQREVEEFFAKGQKGSSAMPHKRNPIGSENMTGLARVIRGHMVTAYENVALWHE   300
           RGLQKSEQREVEEFFAKGQKGSSAMPHKRNPIGSENMTGLARVIRGHMVTAYENV+LWHE
Sbjct: 241 RGLQKSEQREVEEFFAKGQKGSSAMPHKRNPIGSENMTGLARVIRGHMVTAYENVSLWHE   300

Query: 301 RDISHSSAERIITPDTTILIDYMLNRFGNIVKNLTVFPENMMRNMESTFGLIYSQRVMLK   360
           RDISHSS AERIITPDTTILIDYMLNRFGNIVKNLTVFPENMMRNMESTFGLIYSQRVMLK
Sbjct: 301 RDISHSSAERIITPDTTILIDYMLNRFGNIVKNLTVFPENMMRNMESTFGLIYSQRVMLK   360

Query: 361 LIEKGMTREEAYDLVQPKTAYSWDNQVDFKPLLEEDTKVTSCLTQEEIDELFNPIYYTKR   420
           LIEKGMTREEAYDLVQPKTAYSWDNQVDFKPLLEEDTKVTSCLTQEEIDELFNPIYYTKR
Sbjct: 361 LIEKGMTREEAYDLVQPKTAYSWDNQVDFKPLLEEDTKVTSCLTQEEIDELFNPIYYTKR   420

Query: 421 VDDIFERLGL                                                    430
           VDDIF+RLG+
Sbjct: 421 VDDIFKRLGI                                                    430
```

Based on this analysis, it was predicted that these proteins and their epitopes could be useful antigens for vaccines or diagnostics.

EXAMPLE 280

A DNA sequence (GBSx0306) was identified in *S. agalactiae* <SEQ ID 899> which encodes the amino acid sequence <SEQ ID 900>. Analysis of this protein sequence reveals the following:

```
Possible site: 45
>>> Seems to have no N-terminal signal sequence
    INTEGRAL    Likelihood = -16.24    Transmembrane   145-161 (119-167)
    INTEGRAL    Likelihood =  -9.98    Transmembrane   125-141 (119-144)
    INTEGRAL    Likelihood =  -9.29    Transmembrane    28-44  (23-51)
    INTEGRAL    Likelihood =  -7.01    Transmembrane   196-212 (193-220)
    INTEGRAL    Likelihood =  -6.21    Transmembrane    96-112 (88-116)
    INTEGRAL    Likelihood =  -5.79    Transmembrane   249-265 (246-266)
    INTEGRAL    Likelihood =  -2.87    Transmembrane   222-238 (222-238)
    INTEGRAL    Likelihood =  -2.28    Transmembrane   279-295 (278-295)

----- Final Results -----
             bacterial membrane --- Certainty = 0.7456(Affirmative) < succ>
              bacterial outside --- Certainty = 0.0000(Not Clear)   < succ>
            bacterial cytoplasm --- Certainty= 0.0000(Not Clear)    < succ>
```

The protein has homology with the following sequences in the GENPEPT database:

```
>GP:BAB13498 GB:AB028634 RNA polymerase [Flammulina velutipes]
Identities = 83/336 (24%), Positives = 150/336 (43%), Gaps = 40/336 (11%)
Query: 152 ILLLIAFVSIGKNR-VYNFVQNLNYFEEVIWNYFEENPVKIKEKSLIIK-----FLLTIS  205
            IL L    SI  NR + ++ N      ++  N+F+ + +K   K L+I      F++ +S
Sbjct: 133 ILFLYLIYSILINRFILKWLDNSGIIYKININWFKNHMIKHINKMLVINIKFFNFIIKLS  192

Query: 206 FVFVIDFAMVRL-----LNFNIKFSTILACSAILLAWLYQN-----------KSVTEPFL  249
            + +I +++ L      +NF+I+    I    I     ++           S+    F
Sbjct: 193 IITIIGISIMELFGIFGINFDIRIIIINYLKTINSGKIHLTIINMDQYSVLENSIHTIFY  252

Query: 250 LKKLVIYFIFFIATLIGNLKN-ELSILETPLLFISIFFTMDRIIALSKEMRDLI--ISKS  306
            +   L+I+ IF      L  N+KN + +I     +L+I IF        I         ++DL+  ++K
Sbjct: 253 INLLIIFLIFISLILYRNVKNIDTNIKRWIILYILIFLINIIFIFNHIYIKDLMDNLNKY  312

Query: 307 ILFYYDHENIKPSILLSEIKEIKYLENVDIGE---LELVRQMVIRLRLELEEEFLILSDI  363
            IL Y D   I  S+ L     ++K L+ ++I +      V+ +  I+ ++E     L +   I
Sbjct: 313 ILDYMDLHIIVNSLFLFNKFDVK-LKRINIYKSYSTVTVKDLEIKSKIEERSNELDIKLI  371

Query: 364 YMKNG-YEKYIQFVQGNVYFINLE--LDKIPNYTNLKLILESIFD----HNNQKIFIPKL  416
              K G YE YI  ++ N+  ++ E  L    P Y N   +E + +        +   F+ K+
Sbjct: 372 IAKGSYENYINSIE-NINIVDEEFILKNYPEYINDSKFIEFLMELEPLFRDHTEFVKKI  430

Query: 417 YEEYIYILISLGEVEKAKEIL---KEVSDYLTEESL                          449
            YE       L  +     K+IL    KE+ DY+  + +L
Sbjct: 431 YENLNSTNEKLEFLLANKDILSENKEIFDYVLQLNL                          466
```

Based on this analysis, it was predicted that this protein and its epitopes, could be useful antigens for vaccines or diagnostics.

EXAMPLE 281

A DNA sequence (GBSx0308) was identified in *S. agalactiae* <SEQ ID 901> which encodes the amino acid sequence <SEQ ID 902>. Analysis of this protein sequence reveals the following:

```
Possible site: 37
>>> Seems to have no N-terminal signal sequence

----- Final Results -----
            bacterial cytoplasm --- Certainty = 0.3307 (Affirmative) < succ>
            bacterial membrane  --- Certainty = 0.0000 (Not Clear)   < succ>
            bacterial outside   --- Certainty = 0.0000 (Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 282

A DNA sequence (GBSx0309) was identified in *S. agalactiae* <SEQ ID 903> which encodes the amino acid sequence <SEQ ID 904>. This protein is predicted to be purK (purK). Analysis of this protein sequence reveals the following:

```
Possible site: 34
>>> Seems to have no N-terminal signal sequence

----- Final Results -----
            bacterial cytoplasm --- Certainty = 0.0334 (Affirmative) < succ>
            bacterial membrane  --- Certainty = 0.0000 (Not Clear)   < succ>
            bacterial outside   --- Certainty = 0.0000 (Not Clear)   < succ>
```

A related GBS nucleic acid sequence <SEQ ID 9461> which encodes amino acid sequence <SEQ ID 9462> was also identified.

The protein has homology with the following sequences in the GENPEPT database:

```
>GP:CAA04376 GB:AJ000883 purk [Lactococcus lactis]
Identities = 208/347 (59%), Positives = 258/347 (73%), Gaps = 3/347 (0%)
Query:   14 NSFKTIGIIGGGQLGQMMAIAAIYMGHKVITLDPASDCPASRVS-EVIVAPYDDVEALGT    72
            N+ +TIGIIGGGQLGQMMAIAA YMGHKVITLDP +C A++VS E+IVAPYDDVE L
Sbjct:    4 NTKQTIGIIGGGQLGQMMAIAAQYMGHKVITLDPNPNCSAAKVSDELIVAPYDDVENLLR   63

Query:   73 LAARCDVLTYEFENVDADGLDAVVSAGQLPQGTDLLRISQNRIFEKDFLANKAGVTVAPY   132
            LA CDV+TYEFENV A L +    ++PQG LL I+QNR FEK+FL N+A V VAP+
Sbjct:   64 LAYACDVITYEFENVSAKALHEIEGCVRIPQGIRLLEITQNRRFEKEFLTNEAKVNVAPW  123

Query:  133 KVVTSSLDLEGLDLTKTYVLKTATGGYDGHGQKVIRSAEDLPEAQQLANSAQCVLEEFVN   192
            ++V S+ L  +T+ VLKT TGGYDGHGQ V+ + E L A+ L   ++CVLE+F++
Sbjct:  124 QLVDSAEKLPET-VTRKQVLKTTTGGYDGHGQVVLNTDEKLSAAKSLTELSECVLEDFIS  182

Query:  193 FDLEISVIVSGNGQDVTVFPVQENIHRNNILSKTIVPARISDQLADKAKEMAVQIAKKLQ   252
            F+ EISVI+SGNG + VFP+ EN HR NIL +TI PARIS ++ + A ++A IA+KL+
Sbjct:  183 FEREISVIISGNGHEYVVFPLAENEHRENILHQTISPARISAEITENAYKIATSIAEKLE  242

Query:  253 LSGTLCVEMFATAD-DIIVNEIAPRPHNSGHYSIEACDFSQFDTHILGVLGAPLPPIKLH   311
            LSG LCVEMF TAD  I VNE+APRPHNSGH++IEACDF+QFD HI G+LG  LP  KL
Sbjct:  243 LSGVLCVEMFLTADGQIYVNELAPRPHNSGHFTIEACDFNQFDLHIKGILGEDLPEPKLL  302

Query:  312 APAVMFNVLGQHVQQAIDHVAQNPSAHLHMYGKLEAKHNRKMGHVTV               358
            PA+M NVLGQHV+        ++  H H YGK +AKHNRKMGHVT+
Sbjct:  303 KPAIMLNVLGQHVEAVKKLNHEHADWHQHDYGKADAKHNRKMGHVTI               349
```

A related DNA sequence was identified in *S. pyogenes* <SEQ ID 905> which encodes the amino acid sequence <SEQ ID 906>. Analysis of this protein sequence reveals the following:

```
Possible site: 34
>>> Seems to have no N-terminal signal sequence

----- Final Results -----
            bacterial cytoplasm --- Certainty = 0.0334 (Affirmative) < succ>
            bacterial membrane --- Certainty = 0.0000 (Not Clear)   < succ>
             bacterial outside --- Certainty = 0.0000 (Not Clear)   < succ>
```

An alignment of the GAS and GBS proteins is shown below:

```
Identities = 344/369 (93%), Positives = 353/369 (95%)
Query:    1 MRNKEKSQRSQAMNSFKTIGIIGGGQLGQMMAIAAIYMGHKVITLDPASDCPASRVSEVI    60
            MRNKEKSQRSQ +NSFKTIGIIGGGQLGQMMAIAAIYMGHKVITLDPASD PASRVSEVI
Sbjct:    1 MRNKEKSQRSQVVNSFKTIGIIGGGQLGQMMAIAAIYMGHKVITLDPASDSPASRVSEVI    60

Query:   61 VAPYDDVEALGTLAARCDVLTYEFENVDADGLDAVVSAGQLPQGTDLLRISQNRIFEKDF   120
            VAPYDDVEALG LAARCDVLTYEFENVDADGLDAVVSA QLPQGTDLLRISQNRI EKDF
Sbjct:   61 VAPYDDVEALGQLAARCDVLTYEFENVDADGLDAVVSACQLPQGTDLLRISQNRIVEKDF  120

Query:  121 LANKAGVTVAPYKVVTSSLDLEGLDLTKTYVLRTATGGYDGHGQKVIRSAEDLPEAQQLA   180
            LANKAGVTVAPYKVVTSSLDL GLDLTKTYVLKT TGGYDGHGQK+IRSAEDLPEAQQLA
Sbjct:  121 LANKAGVTVAPYKVVTSSLDLGGLDLTKTYVLKTETGGYDGHGQKIIRSAEDLPEAQQLA  180

Query:  181 NSAQCVLEEFVNFDLEISVIVSGNGQDVTVFPVQENIHRNNILSKTIVPARISDQLADKA   240
            NSAQCVLEEFVNFDLEISVIVSGNG+DVTVFPVQENIHRNNILSKTIVPARISDQLADKA
Sbjct:  181 NSAQCVLEEFVNFDLEISVIVSGNGKDVTVFPVQENIHRNNILSKTIVPARISDQLADKA  240

Query:  241 KEMAVQIAKKLQLSGTLCVEMFATADDIIVNEIAPRPHNSGHYSIEACDFSQFDTHILGV   300
            K+ AVQIAKKLQLSGTLCVEMF TADDIIVNEIAPRPHNSG YSIEACDFSQFDTHILGV
Sbjct:  241 KKTAVQIAKKLQLSGTLCVEMFTTADDIIVNEIAPRPHNSGRYSIEACDFSQFDTHILGV  300

Query:  301 LGAPLPPIKLHAPAVMFNVLGQHVQQAIDHVAQNPSAHLHMYGKLEAKHNRKMGHVTVFS   360
            LGAPLP I+LHAPAVM NVLGQHVQQA D+VA+NPSAHLHMYGKLEAKHNRKMGHVTVF+
Sbjct:  301 LGAPLPQIQLHAPAVMLNVLGQHVQQATDYVAKNPSAHLHMYGKLEAKHNRKMGHVTVFA  360
```

```
Query:  361 DVPDEVEEF                                                369
            DEV+EF
Sbjct:  361 KDADEVKEF                                                369
```

Based on this analysis, it was predicted that these proteins and their epitopes could be useful antigens for vaccines or diagnostics.

EXAMPLE 283

A DNA sequence (GBSx0310) was identified in *S. agalactiae* <SEQ ID 907> which encodes the amino acid sequence <SEQ ID 908>. This protein is predicted to be phosphoribosylaminoimidazole carboxylase catalytic subunit (purE). Analysis of this protein sequence reveals the following:

```
Possible site: 45
>>> Seems to have no N-terminal signal sequence

----- Final Results -----
            bacterial cytoplasm --- Certainty = 0.3572(Affirmative) < succ>
             bacterial membrane --- Certainty = 0.0000(Not Clear)   < succ>
              bacterial outside --- Certainty = 0.0000(Not Clear)   < succ>
```

The protein has homology with the following sequences in the GENPEPT database:

```
>GP:CAB12462 GB:Z99107 phosphoribosylaminoimidazole carboxylase I
[Bacillus subtilis]
Identities = 106/162 (65%), Positives = 128/162 (78%)
Query:   33 MQPIISIIMGSKSDWTTMQKTAEVLDNFGIAYEKKVVSAHRTPDLMFKHAEEARGRGIKI   92
            MQP++ IIMGS SDW TM+   ++LD   + YEKKVVSAHRTPD MF++AE AR RGIK+
Sbjct:    1 MQPLVGIIMGSTSDWETMKHACDILDELNVPYEKKVVSAHRTPDFMFEYAETARERGIKV   60

Query:   93 IIAGAGGAAHLPGMVAAKTTLPVIGVPVKSRALSGLDSLYSIVQMPGGVPVATMAIGEAG  152
            IIAGAGGAAHLPGM AAKTTLPVIGVPV+S+AL+G+DSL SIVQMPGGVPVAT +IG+AG
Sbjct:   61 IIAGAGGAAHLPGMTAAKTTLPVIGVPVQSKALNGMDSLLSIVQMPGGVPVATTSIGKAG  120

Query:  153 ATNAALTALRILSIEDQNLADALAHFHEEQGKIAEESSNELI                   194
             A NA L A +ILS D++LA L   E  + ESS++L+
Sbjct:  121 AVNAGLLAAQILSAFDEDLARKLDERRENTKQTVLESSDQLV                   162
```

A related DNA sequence was identified in *S. pyogenes* <SEQ ID 909> which encodes the amino acid sequence <SEQ ID 910>. Analysis of this protein sequence reveals the following:

```
Possible site: 57
>>> Seems to have no N-terminal signal sequence
     INTEGRAL     Likelihood = -3.08      Transmembrane    36-52 (34-52)

----- Final Results -----
             bacterial membrane --- Certainty = 0.2232(Affirmative) < succ>
              bacterial outside --- Certainty = 0.0000(Not Clear)   < succ>
            bacterial cytoplasm --- Certainty = 0.0000(Not Clear)   < succ>
```

The protein has homology with the following sequences in the databases:

```
>GP:CAA04375 GB:AJ000883 purE [Lactococcus lactis]
Identities = 105/158 (66%), Positives = 131/158 (82%)
Query:   46 ISIIMGSKSDWATMQKTAEVLDNFGIAYEKKVVSAHRTPDLMFKHAEEARGRGIKIIIAG  105
            ++IIMG SDWATM++TA++LD+FG+AYEKKVVSAHRTP LM +  + +AR RG K+IIAG
Sbjct:    4 VAIIMGCSSDWATMKETAKILDDFGLAYEKKVVSAHRTPALMAEFSSQARERGYKVIIAG   63

Query:  106 AGGAAHLPGMVAAKTTLPVIGVPVKSRALSGLDSLYSIVQMPGGVPVATMAIGEAGATNA  165
            AGGAAHLPGMV+A+T +PVIGVP+KSRALSGLDSLYSIVQMP GVPVATMAIGEAGA NA
Sbjct:   64 AGGAAHLPGMVSAQTLVPVIGVPIKSRALSGLDSLYSIVQMPAGVPVATMAIGEAGAKNA  123
```

-continued
```
Query:  166 ALTALRILSIEDQNLADALAHFHEEQGKIAEESSGELI                      203
            AL  AL++L+    ++NL      L    +          ++ EES+   L+
Sbjct:  124 ALFALQLLANTNENLIQKLLVYRAAAQEMVEESNKALL                      161
```

An alignment of the GAS and GBS proteins is shown below:

```
Identities = 162/169 (95%), Positives = 164/169 (96%), Gaps = 1/169 (0%)
Query:   27 PLYLNIMQ-PIISIIMGSKSDWTTMQKTAEVLDNFGIAYEKKVVSAHRTPDLMFKHAEEA   85
            PL + IM+ PIISIIMGSKSDW TMQKTAEVLDNFGIAYEKKVVSAHRTPDLMFKHAEEA
Sbjct:   35 PLCILIMKTPIISIIMGSKSDWATMQKTAEVLDNFGIAYEKKVVSAHRTPDLMFKHAEEA   94

Query:   86 RGRGIKIIAGAGGAAHLPGMVAAKTTLPVIGVPVKSRALSGLDSLYSIVQMPGGVPVAT   145
            RGRGIKIIAGAGGAAHLPGMVAAKTTLPVIGVPVKSRALSGLDSLYSIVQMPGGVPVAT
Sbjct:   95 RGRGIKIIAGAGGAAHLPGMVAAKTTLPVIGVPVKSRALSGLDSLYSIVQMPGGVPVAT   154

Query:  146 MAIGEAGATNAALTALRILSIEDQNLADALAHFHEEQGKIAEESSNELI             194
            MAIGEAGATNAALTALRILSIEDQNLADALAHFHEEQGKIAEESS ELI
Sbjct:  155 MAIGEAGATNAALTALRILSIEDQNLADALAHFHEEQGKIAEESSGELI             203
```

Based on this analysis, it was predicted that these proteins and their epitopes could be useful antigens for vaccines or diagnostics.

EXAMPLE 284

A DNA sequence (GBSx0311) was identified in *S. agalactiae* <SEQ ID 911> which encodes the amino acid sequence <SEQ ID 912>. This protein is predicted to be phosphoribosylglycinamide synthetase (purD). Analysis of this protein sequence reveals the following:

```
Possible site: 16
>>> Seems to have no N-terminal signal sequence

----- Final Results -----
            bacterial cytoplasm --- Certainty = 0.1966(Affirmative) < succ>
            bacterial membrane  --- Certainty = 0.0000(Not Clear)   < succ>
             bacterial outside  --- Certainty = 0.0000(Not Clear)   < succ>
```

The protein has homology with the following sequences in the GENPEPT database:

```
>GP:CAA04374 GB:AJ000883 purD [Lactococcus lactis]
Identities = 236/419 (56%), Positives = 298/419 (70%), Gaps = 7/419 (1%)
Query:    1 MKLLVVGSGGREHAIAKKLLASKDVDQVFVAPGNDGMTLDGLDLVNIGISEHSRLIDFVK   60
            MK+LV+GSGGREHA+AKK + S  V++VFVAPGN GM  DG+ +V+I   + +L+ F +
Sbjct:    1 MKILVIGSGGREHALAKKFMESPQVEEVFVAPGNSGMEKDGIQIVHISELSNDKLVKFAQ   60

Query:   61 ENEIAWTLIGPDDALAAGIVDGFNSAGLRAFGPTKAAAELEWSKDFAKEIMVKYNVPTAA  120
                I  T +GP+  AL  G+VD F   A L  FGP K AAELE SKDFAK IM KY VPTA
Sbjct:   61 NQNIGLTFVGPETALMNGVVDAFIKAELPIFGPNKMAAELEGSKDFAKSIMKKYGVPTAD  120

Query:  121 YGTFSDFEKAKAYIEEQGAPIVVKADGLALGKGVVVAETVEQAVEAAQEMLLDNKFGDSG  180
            Y TF     E A AY++E+G P+V+KADGLA GKGV VA +E A  A  ++      F  S
Sbjct:  121 YATFDSLEPALAYLDEKGVPLVIKADGLAAGKGVTVAFDIETAKSALADI-----FSGSQ  175

Query:  181 ARVVIEEFLDGEEFSLFAFANGDKFYIMPTAQDHKRAYDGDKGLNTGGMGAYAPVPHLPQ  240
             +VVIEEFLDGEEFSLF+F +   K Y MP AQDHKRA+D DKG NTGGMGAY+PV H+ +
Sbjct:  176 GKVVIEEFLDGEEFSLFSFIHDGKIYPMPIAQDHKRAFDEDKGPNTGGMGAYSPVLHISK  235

Query:  241 SVVDTAVETIVKPVLEGMIAEGRPYLGVLYAGLILTADGPKVIEFNSRFGDPETQIILPR  300
              VV+ A+E +VKP + GMI EG+ +  GVLYAGLILT DG K IEFN+RFGDPETQ++LPR
Sbjct:  236 EVVNEALEKVVKPTVAGMIEEGKSFTGVLYAGLILTEDGVKTIEFNARFGDPETQVVLPR  295

Query:  301 LTSDFAQNIDDIMMGIEPYITWQKDGVTLGVVVASEGYPLDYEKGVPLPEKTDGDIITYY  360
            L SD AQ I DI+  G EP + W + GVTLGVVVA+EGYP    +  G+ LPE  +G   YY
Sbjct:  296 LKSDLAQAIIDILAGNEPTLEWLESGVTLGVVVAAEGYPSQAKLGLILPEIPEG-LNVYY  354

Query:  361 AGAKFAENSKALLSNGGRVYMLVTTEDSVKAGQDKIYTQLAQQDTTGLFYRNDIGSKAI  419
            AG      EN++ L+S+GGRVY++    T + VK+  Q  +Y +L +  +    G FYR+DIGS+AI
Sbjct:  355 AGVSKNENNQ-LISSGGRVYLVSETGEDVKSTQKLLYEKLDKLENDGFFYRHDIGSRAI  412
```

A related DNA sequence was identified in *S. pyogenes* <SEQ ID 913> which encodes the amino acid sequence <SEQ ID 914>. Analysis of this protein sequence reveals the following:

```
Possible site: 35
>>> Seems to have no N-terminal signal sequence
      INTEGRAL    Likelihood = -0.80    Transmembrane    5-21 (5-21)

----- Final Results -----
            bacterial membrane --- Certainty = 0.1319(Affirmative) < succ>
            bacterial outside  --- Certainty = 0.0000(Not Clear)   < succ>
          bacterial cytoplasm  --- Certainty = 0.0000(Not Clear)   < succ>
```

The protein has homology with the following sequences in the databases:

```
>GP:CAA04374 GB:AJ000883 purD [Lactococcus lactis]
Identities = 236/419 (56%), Positives = 301/419 (71%), Gaps = 7/419 (1%)
Query:  50 LKLLVVGSGGREHAIAKKLLASKGVDQVFVAPGNDGMTLDGLDLVNIVVSEHSRLIAFAK 109
           +K+LV+GSGGREHA+AKK + S  V++VFVAPGN GM  DG+ +V+I   + +L+ FA+
Sbjct:   1 MKILVIGSGGREHALAKKFMESPQVEEVFVAPGNSGMEKDGIQIVHISELSNDKLVKFAQ  60

Query: 110 ENEISWAFIGPDDALAAGIVDDFNSAGLRAFGPTKAAAELEWSKDFAKEIMVKYNVPTAA 169
             I   F+GP+ AL  G+VD F  A L  FGP K AAELE SKDFAK IM KY VPTA
Sbjct:  61 NQNIGLTFVGPETALMNGVVDAFIKAELPIFGPNKMAAELEGSKDFAKSIMKKYGVPTAD 120

Query: 170 YGTFSDFEKAKAYIEEQGAPIVVKADGLALGKGVVVAETVEQAVEAAQEMLLDNKFGDSG 229
           Y TF   E A AY++E+G P+V+KADGLA GKGV VA +E A  A  ++    F  S
Sbjct: 121 YATFDSLEPALAYLDEKGVPLVIKADGLAAGKGVTVAFDIETAKSALADI-----FSGSQ 175

Query: 230 ARVVIEEFLDGEEFSLFAFANGDKFYIMPTAQDHKRAFDGDKGPNTGGMGAYAPVPHLPQ 289
            +VVIEEFLDGEEFSLF+F +  K Y MP AQDHKRAFD DKGPNTGGMGAY+PV H+ +
Sbjct: 176 GKVVIEEFLDGEEFSLFSFIHDGKIYPMPIAQDHKRAFDEDKGPNTGGMGAYSPVLHISK 235

Query: 290 SVVDTAVEMIVRPVLEGMVAEGRPYLGVLYVGLILTADGPKVIEFNSRFGDPETQIILPR 349
            VV+ A+E +V+P + GM+ EG+ + GVLY GLILT DG K IEFN+RFGDPETQ++LPR
Sbjct: 236 EVVNEALEKVVKPTVAGMIEEGKSFTGVLYAGLILTEDGVKTIEFNARFGDPETQVVLPR 295

Query: 350 LTSDFAQNIDDIMMGIEPYITWQKDGVTLGVVVASEGYPFDYEKGVPLPEKTDGDIITYY 409
           L SD AQ I DI+ G EP + W + GVTLGVVVA+EGYP   G+ LPE +G + YY
Sbjct: 296 LKSDLAQAIIDILAGNEPTLEWLESGVTLGVVVAAEGYPSQAKLGLILPEIPEG-LNVYY 354

Query: 410 AGVKFSENSELLLSNGGRVYMLVTTEDSVKAGQDKIYTQLAQQDTTGLFYRNDIGSKAI 468
           AGV  +EN++ L+S+GGRVY++    T + VK+ Q  +Y +L + +   G FYR+DIGS+AI
Sbjct: 355 AGVSKNENNQ-LISSGGRVYLVSETGEDVKSTQKLLYEKLDKLENDGFFYRHDIGSRAI 412
```

An alignment of the GAS and GBS proteins is shown below:

```
Identities = 399/421 (94%), Positives = 408/421 (96%)
Query:   1 MKLLVVGSGGREHAIAKKLLASKDVDQVFVAPGNDGMTLDGLDLVNIGISEHSRLIDFVK  60
           +KLLVVGSGGREHAIAKKLLASK VDQVFVAPGNDGMTLDGLDLVNI +SEHSRLI F K
Sbjct:  50 LKLLVVGSGGREHAIAKKLLASKGVDQVFVAPGNDGMTLDGLDLVNIVVSEHSRLIAFAK 109

Query:  61 ENEIAWTLIGPDDALAAGIVDGFNSAGLRAFGPTKAAAELEWSKDFAKEIMVKYNVPTAA 120
           ENEI+W  IGPDDALAAGIVD FNSAGLRAFGPTKAAAELEWSKDFAKEIMVKYNVPTAA
Sbjct: 110 ENEISWAFIGPDDALAAGIVDDFNSAGLRAFGPTKAAAELEWSKDFAKEIMVKYNVPTAA 169

Query: 121 YGTFSDFEKAKAYIEEQGAPIVVKADGLALGKGVVVAETVEQAVEAAQEMLLDNKFGDSG 180
           YGTFSDFEKAKAYIEEQGAPIVVKADGLALGKGVVVAETVEQAVEAAQEMLLDNKFGDSG
Sbjct: 170 YGTFSDFEKAKAYIEEQGAPIVVKADGLALGKGVVVAETVEQAVEAAQEMLLDNKFGDSG 229

Query: 181 ARVVIEEFLDGEEFSLFAFANGDKFYIMPTAQDHKRAYDGDKGLNTGGMGAYAPVPHLPQ 240
           ARVVIEEFLDGEEFSLFAFANGDKFYIMPTAQDHKRA+DGDKG NTGGMGAYAPVPHLPQ
Sbjct: 230 ARVVIEEFLDGEEFSLFAFANGDKFYIMPTAQDHKRAFDGDKGPNTGGMGAYAPVPHLPQ 289

Query: 241 SVVDTAVETIVKPVLEGMIAEGRPYLGVLYAGLILTADGPKVIEFNSRFGDPETQIILPR 300
           SVVDTAVE IV+PVLEGM+AEGRPYLGVLY GLILTADGPKVIEFNSRFGDPETQIILPR
Sbjct: 290 SVVDTAVEMIVRPVLEGMVAEGRPYLGVLYVGLILTADGPKVIEFNSRFGDPETQIILPR 349

Query: 301 LTSDFAQNIDDIMMGIEPYITWQKDGVTLGVVVASEGYPLDYEKGVPLPEKTDGDIITYY 360
           LTSDFAQNIDDIMMGIEPYITWQKDGVTLGVVVASEGYP DYEKGVPLPEKTDGDIITYY
Sbjct: 350 LTSDFAQNIDDIMMGIEPYITWQKDGVTLGVVVASEGYPFDYEKGVPLPEKTDGDIITYY 409

Query: 361 AGAKFAENSKALLSNGGRVYMLVTTEDSVKAGQDKIYTQLAQQDTTGLFYRNDIGSKAIKE 421
```

-continued

```
                   AG KF+ENS+ LLSNGGRVYMLVTTEDSVKAGQDKIYTQLAQQDTTGLFYRNDIGSKAI+E
Sbjct:   410 AGVKFSENSELLLSNGGRVYMLVTTEDSVKAGQDKIYTQLAQQDTTGLFYRNDIGSKAIRE   470
```

Based on this analysis, it was predicted that these proteins and their epitopes could be useful antigens for vaccines or diagnostics.

EXAMPLE 285

A DNA sequence (GBSx0312) was identified in *S. agalactiae* <SEQ ID 915> which encodes the amino acid sequence <SEQ ID 916>. Analysis of this protein sequence reveals the following:

```
Possible site: 36
>>> Seems to have no N-terminal signal sequence
    INTEGRAL    Likelihood = -1.28    Transmembrane    235-251 (235-251)

----- Final Results -----
              bacterial membrane --- Certainty = 0.1510(Affirmative) < succ>
              bacterial outside  --- Certainty = 0.0000(Not Clear)   < succ>
              bacterial cytoplasm --- Certainty = 0.0000(Not Clear)   < succ>
```

The protein has homology with the following sequences in the GENPEPT database:

```
>GP: AAA23257 GB: M81878 unknown [Clostridium perfringens]
Identities = 66/258 (25%), Positives = 119/258 (45%), Gaps = 9/258 (3%)

Query:    1 MTIYDQIESALDLMTDLEREIACYFMGQPISKDALASTIVTKQLHISQAALTRFAKKCGF    60
            M I +Q+E+     T  E+ +  Y      +   + +I+ K+  + +A +TRF KK GF
Sbjct:    1 MGILEQLENPKFKATKSEKTLIEYIKSDLDNIIYKSISIIAKESGVGEATITRFTKKLGF    60

Query:   61 KGYREFVFEYLKS-HETISQQLYGLQNDTKKVFMNYQEMISKSADI-------IDEEQL   112
            G+++F      K   + +  L    + V    +M+  S +I         ID + +
Sbjct:   61 NGFQDFKVTLAKEISNKKNTSIINLHVHRDESVTETANKMLKSSINILEQTVKQIDLDLM   120

Query:  113 LEVSHMIEQADRVYFYGKGSSSLVAKEFKIRLMRLGVICEALDDTDSFSWTNSIVNDRCL   172
             +   +I  A RVYF G G S + A +   + MR+G      + D+ +    +SI ND  +
Sbjct:  121 CKCRDLIMNAKRVYFIGIGYSGIAATDINYKFMRIGFTTVPVTDSHTMVIMSSITNDDDV   180

Query:  173 VIAFSLSGNTNSVIGALKIASCHGAKTVLFTK-QPHTIDYAFDKIIQVASARHLDYGNRI   231
            ++A S SG T  VI  +K A  +G K +  T+    +   D  +   SA  +      I
Sbjct:  181 IVAISNSGTTKEVIKTVKQAKENGTKIITLTEDSDNPLRKLSDYELTYTSAETIFETGSI   240

Query:  232 SPQIPMLIMVDIIYAQFL                                             249
            S +IP + ++D++Y + +
Sbjct:  241 SSKIPQIFLLDLLYTEVI                                             258
```

A related DNA sequence was identified in *S. pyogenes* <SEQ ID 917> which encodes the amino acid sequence <SEQ ID 918>. Analysis of this protein sequence reveals the following:

```
Possible site: 60
>>> Seems to have no N-terminal signal sequence
    INTEGRAL    Likelihood = -4.88    Transmembrane    243-259 (242-261)

----- Final Results -----
              bacterial membrane --- Certainty = 0.2954(Affirmative) < succ>
              bacterial outside  --- Certainty = 0.0000(Not Clear)   < succ>
              bacterial cytoplasm --- Certainty = 0.0000(Not Clear)   < succ>
```

A related sequence was also identified <SEQ ID 9093> which encodes the amino acid sequence <SEQ ID 9094>. Analysis of this protein sequence reveals the following:

```
Possible cleavage site: 56
>>> Seems to have no N-terminal signal sequence
```

```
                          -continued
   INTEGRAL   Likelihood = -4.88   Transmembrane    239-255 (238-257)

----- Final Results -----
             bacterial membrane --- Certainty = 0.295(Affirmative) < succ>
              bacterial outside --- Certainty = 0.000(Not Clear)   < succ>
            bacterial cytoplasm --- Certainty = 0.000(Not Clear)   < succ>
```

An alignment of the GAS and GBS proteins is shown below:

```
Identities = 138/263 (52%), Positives = 189/263 (71%), Gaps = 2/263 (0%)
Query:   6 QIESALDLMTDLEREIACYFMGQPISKDALASTIVTKQLHISQAALTRFAKKCGFKGYRE    65
           +IE++L+ MT LE+ IA +F+   ++    L ++ + K+LHISQAALTRFAKKCGF GYR
Sbjct:  14 KIEASLEHMTSLEKGIAHFFITTDLTPQELTASEIVKRLHISQAALTRFAKKCGFTGYRA   73

Query:  66 FVFEYLKSHETISQQLYGLQNDNTKKVFMNYQEMISKSADIIDEEQLLEVSHMIEQADRV  125
           F F+YL S +   +   + + TK+V M+Y  +I+K+ ++++EE+LL ++ +I+ ++RV
Sbjct:  74 FAFDYLHSLQESQETFQSIHLELTKRVLMDYDALINKTYELVNEEKLLNLAKLIDSSERV  133

Query: 126 YFYGKGSSSLVAKEFKIRLMRLGVICEALDDTDSFSWTNSIVNDRCLVIAFSLSGNTNSV  185
           YF+GKGSS LVA+E K+R MRLG+IC+A  DTD F+W NS+VN+ CLV  FSLSG TNSV
Sbjct: 134 YFFGKGSSGLVAREMKLRFMRLGLICDAYSDTDGFTWANSLVNENCLVFGFSLSGRTNSV  193

Query: 186 IGALKIASCHGAKTVLFTKQPHT-IDYAFDKIIQVASARHLDYGNRISPQIPMLIMVDII  244
           I AL  AS GAKTVL T    T  D + D II V+S   L YGNR+SPQ P+LIM+DII
Sbjct: 194 ITALHQASQRGAKTVLLTTDNQTEFDDSLD-IIPVSSTHQLHYGNRVSPQFPLLIMMDII  252

Query: 245 YAQFLDINKIEKERIFRETIIQR                                      267
           YA  L I+K  KE+IF+ TII +
Sbjct: 253 YAYVLAIDKPHKEKIFKNTIIDK                                      275
```

Figure 85:
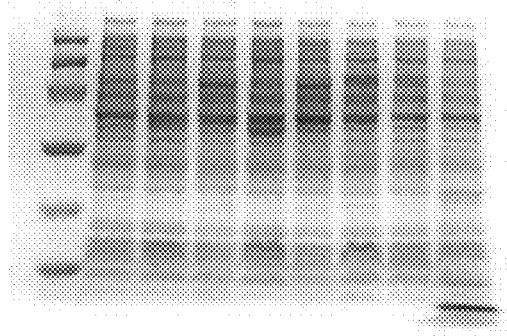
Figure 160:
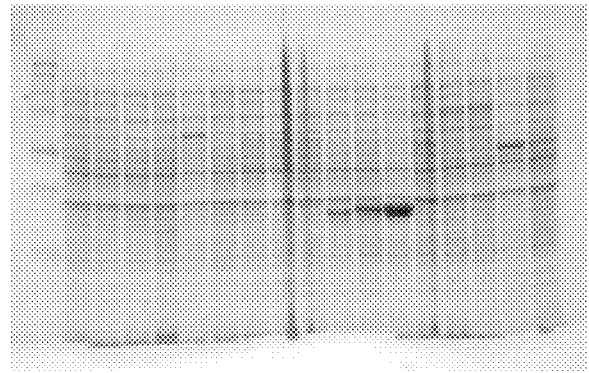

SEQ ID 916 (GBS320) was expressed in *E. coli* as a His-fusion product. SDS-PAGE analysis of total cell extract is shown in FIG. 40 (lane 5; MW 33 kDa). It was also expressed in *E. coli* as a GST-fusion product. SDS-PAGE analysis of total cell extract is shown in FIG. 85 (lane 7; MW 58 kDa) and in FIG. 160 (lane 7 & 8; MW 58 kDa).

Figure 224:
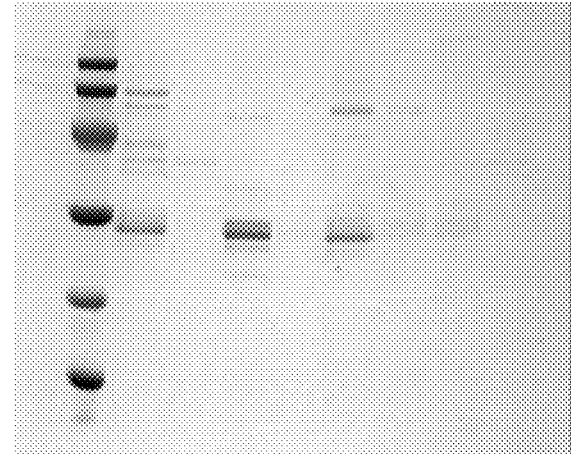

GBS320-GST was purified as shown in FIG. 224, lane 3-4.

Based on this analysis, it was predicted that these proteins and their epitopes could be useful antigens for vaccines or diagnostics.

EXAMPLE 286

A DNA sequence (GBSx0313) was identified in *S. agalactiae* <SEQ ID 919> which encodes the amino acid sequence <SEQ ID 920>. This protein is predicted to be xylan esterase 1 (cephalosporin-C). Analysis of this protein sequence reveals the following:

```
Possible site: 54
>>> Seems to have no N-terminal signal sequence

----- Final Results -----
            bacterial cytoplasm --- Certainty = 0.4981(Affirmative) < succ>
             bacterial membrane --- Certainty = 0.0000(Not Clear)   < succ>
              bacterial outside --- Certainty = 0.0000(Not Clear)   < succ>
```

The protein has homology with the following sequences in the GENPEPT database:

```
>GP:AAB68821 GB:AF001926 xylan esterase 1 [Thermoanaerobacterium sp.
'JW/SL YS485']
Identities = 133/299 (44%), Positives = 188/299 (62%), Gaps = 1/299 (0%)
Query:   5 MSLDDMREYLGQDQIPEDFDDFWKKQTMKYQG-NIEYRLDKKDFNITFAQAYDLHFKGSN   63
           M L  +REY G +  PEDFD++W +    + +     L +   F ++FA+ YDL+F  G
Sbjct:   6 MPLQKLREYTGTNPCPEDFDEYWNRALDEMRSVDPKIELKESSFQVSFAECYDLYFTGVR   65

Query:  64 NSIVYAKCLFPKTNKPYPVVFYFHGYQNQSPDWSDQLNYVAAGYGVVSMDVRGQAGQSQD  123
           + ++AK + PKT  +P +  FHGY + S DW+D+LNYVAAG+ VV+MDVRGQ GQSQD
```

-continued

```
Sbjct:  66 GARIHAKYIKPKTEGKHPALIRFHGYSSNSGDWNDKLNYVAAGFTVVAMDVRGQGGQSQD 125

Query: 124 KGHFDGITVKGQIVRGMISGPNHLFYKDIYLDVFQLIDIIATLESVDSNQLYSYGWSQGG 183
           G   G T+ G I+RG+     +++ ++ I+LD   QL   I+  +  VD +++   G SQGG
Sbjct: 126 VGGVTGNTLNGHIIRGLDDDADNMLFRHIFLDTAQLAGIVMNMPEVDEDRVGVMGPSQGG 185

Query: 184 ALALIAAALNPKIVKTVAVYPFLSDFRRVLDLGGVSEPYDELFRYFKYSDPFHKTENNVL 243
           L+L   AAL P++ K V+   YPFLSD++RV DL        Y E+   YF+  DP H+ EN V
Sbjct: 186 GLSLACAALEPRVRKVVSEYPFLSDYKRVWDLDLAKNAYQEITDYFRLFDPRHERENEVF 245

Query: 244 KTLAYIDVKNFAHRISCPVVLLTALKDDICPPSTQFAIFNRLTSTKKHLLLPDYGHDPM 302
           L YIDVKN A RI    V++     L D +CPPST FA +N + S K    + PDYGH+PM
Sbjct: 246 TKLGYIDVKNLAKRIKGDVLMCVGLMDQVCPPSTVFAAYNNIQSKKDIKVYPDYGHEPM 304
```

No corresponding DNA sequence was identified in *S. pyogenes*.

Based on this analysis, it was predicted that this protein and its epitopes, could be useful antigens for vaccines or diagnostics.

EXAMPLE 287

A DNA sequence (GBSx0314) was identified in *S. agalactiae* <SEQ ID 921> which encodes the amino acid sequence <SEQ ID 922>. Analysis of this protein sequence reveals the following:

```
Possible site: 35
>>> Seems to have no N-terminal signal sequence
    INTEGRAL    Likelihood = -5.73    Transmembrane    128-144 (126-145)

----- Final Results -----
              bacterial membrane --- Certainty = 0.3293(Affirmative) < succ>
              bacterial outside  --- Certainty = 0.0000(Not Clear)   < succ>
              bacterial cytoplasm --- Certainty = 0.0000(Not Clear)  < succ>
```

The protein has homology with the following sequences in the GENPEPT database:

```
>GP:AAA23256 GB:M81878 unknown [Clostridium perfringens]
Identities = 78/160 (48%), Positives = 110/160 (68%)
Query: 131 CLTIGTGIGGCLIIDKTVFHGFSNSACEVGYMHLSDGDFQDLASTTALIADVAKAHGDEI 190
           CLTIGTGIGG LIID V HGFSNSA E+GYM ++  + QD+AS +AL+  +VA    G E
Sbjct:  18 CLTIGTGIGGALIIDGKVLHGFSNSAGEIGYMMVNGENIQDIASASALVKNVALRKGVEP  77

Query: 191 SRWDGRRIFQEAKKGNEKCIASIDRMINYLGQGIANMVYVVNPEKVVLGGGIMAQKDYLQ 250
           S  DGR +    + G+   C    ++++ + L   GI+N+VY++NPE VVLGGGIMA+++  +
Sbjct:  78 SSIDGRYVLDNYENGDLICKEEVEKLADNLALGISNIVYLINPEVVVLGGGIMAREEVFR 137

Query: 251 DKLSESLKRNLVTSLAEKTAIVFAQHENQAGMLGAYYHFK 290
             +   SL++ L+ S+     T I FA+ +N AGM GAYY+FK
Sbjct: 138 PLIENSLRKYLIESVYNNTKIAFAKLKNTAGMKGAYYNFK 177
```

A related DNA sequence was identified in *S. pyogenes* <SEQ ID 923> which encodes the amino acid sequence <SEQ ID 924>. Analysis of this protein sequence reveals the following:

```
Possible site: 22
>>> Seems to have no N-terminal signal sequence
    INTEGRAL    Likelihood = -4.30    Transmembrane    128-144 (127-145)
    INTEGRAL    Likelihood = -0.11    Transmembrane    227-243 (227-243)

----- Final Results -----
              bacterial membrane --- Certainty = 0.2720(Affirmative) < succ>
              bacterial outside  --- Certainty = 0.0000(Not Clear)   < succ>
              bacterial cytoplasm --- Certainty = 0.0000(Not Clear)  < succ>
```

The protein has homology with the following sequences in the databases:

```
>GP:BAB04516 GB:AP001509 glucose kinase [Bacillus halodurans]
Identities = 97/291 (33%), Positives = 155/291 (52%), Gaps = 14/291 (4%)
Query:   5 LAIDIGGTAIKYGLISETGDLLEKEEMATEAYKGGPSILEKVKGLVKTYQDQMDLAGVAI    64
           + ID+GGT IK  L+S+ G+++  +E  TEA +G  ++ K+  L +   D    AG+  I
Sbjct:   3 VGIDLGGTKIKAALVSDAGEIISVQECPTEAAQGPEEVMNKMMSLTEKVTDHQPFAGIGI    62

Query:  65 SSAGMVNPDEGEIFYAGPQIPNYAGTQFKKEIEETFGLPCEVENDVNCAGLAEAISGSAK   124
           + G ++   EG I  + P +P +           +E F  P +++ND N A LAEA+ GS +
Sbjct:  63 GAPGPLSSTEGTIL-SPPNLPGWDHIHLVDRFQEQFQCPVKLDNDANVAALAEALLGSGQ   121

Query: 125 DYPVALCLTIGTGIGGCLLFNSQVFHGSSHSACEVG----------YLHLSDGQFQDLAS   174
            +      LTI TGIGG  + +   +HG+S  A E+G            + +L+  G  + LAS
Sbjct: 122 GFTSVFYLTISTGIGGGYVLDGSIVHGASDYAGEIGNMIVQPNGYQHANLNPGSLEGLAS   181

Query: 175 TTALVQEVVLAYGDDISQWDGRRIFEQAKAGDAICIAAISKQVDYLGQGIANICYVVNPN   234
              TA+ +      +G   +    R  +F+Q + GD       + + +DYL  GIANI + +NP+
Sbjct: 182 GTAIGRMARERFG---VEGGTREVFDQIRRGDHDMQRLVEEAMDYLAIGIANIAHTINPD   238

Query: 235 VVVLGGGIMAQKDYLADKLKTALDSYLVSSLAKKTQLKFASHGNNAGILGA           285
            V VLGGG+M   D +   +K +  YL    LA+ T +   A  G ++G+LGA
Sbjct: 239 VFVLGGGVMNADDLILPIVKEKVSRYLYPGLAQSTTIVKAKLGGDSGVLGA          289
```

An alignment of the GAS and GBS proteins is shown below:

```
Identities = 192/292 (65%), Positives = 237/292 (80%)
Query:   1 MTRTVAIDIGGTMIKHGIVDNLGCIVEASELATEAYKGGPGILQKVCQIIDNYLAEGSID    60
           M   +AIDIGGT IK+G++     G ++E  E+ATEAYKGGP IL+KV  ++   Y  +   +
Sbjct:   1 MKHYLAIDIGGTAIKYGLISETGDLLEKEEMATEAYKGGPSILEKVKGLVKTYQDQNDLA    60

Query:  61 GIAISSAGMVDPDEGCIFYSGPQIPNYAGTQFKKVLEDTYQVRTEIENDVNCAGLAEAVS   120
            G+AISSAGMV+PDEG IFY+GPQIPNYAGTQFKK +E+T+  +  E+ENDVNCAGLAEA+S
Sbjct:  61 GVAISSAGMVNPDEGEIFYAGPQIPNYAGTQFKKEIEETFGLPCEVENDVNCAGLAEAIS   120

Query: 121 GSAKDSSIALCLTIGTGIGGCLIIDKTVFHGFSNSACEVGYMHLSDGDFQDLASTTALIA   180
           GSAKD   +ALCLTIGTGIGGCL+ +    VFHG S+SACEVGY+HLSDG FQDLASTTAL+
Sbjct: 121 GSAKDYPVALCLTIGTGIGGCLLFNSQVFHGSSHSACEVGYLHLSDGQFQDLASTTALVQ   180

Query: 181 DVAKAHGDEISRWDGRRIFQEAKKGNEKCIASIDRMINYLGQGIANMVYVVNPEKVVLGG   240
            +V  A+GD+IS+WDGRRIF++AK G+    CIA+I + ++YLGQGIAN+ YVVNP  VVLGG
Sbjct: 181 EVVLAYGDDISQWDGRRIFEQAKAGDAICIAAISKQVDYLGQGIANICYVVNPNVVVLGG   240

Query: 241 GIMAQKDYLQDKLSESLKRNLVTSLAEKTAIVFAQHENQAGMLGAYYHFKNR          292
           GIMAQKDYL DKL  +L   LV+SLA+KT + FA H N AG+LGAYYHFK +
Sbjct: 241 GIMAQKDYLADKLKTALDSYLVSSLAKKTQLKFASHGNNAGILGAYYHFKQK          292
```

Figure 60:
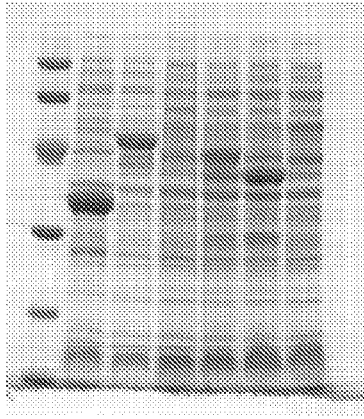
Figure 67:
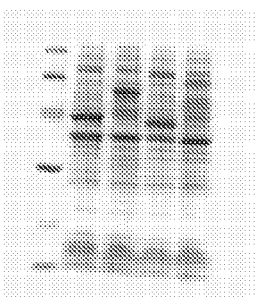

SEQ ID 922 (GBS331) was expressed in E. coli as a His-fusion product. SDS-PAGE analysis of total cell extract is shown in FIG. 60 (lane 2; MW 35.9 kDa). It was also expressed in E. coli as a GST-fusion product. SDS-PAGE analysis of total cell extract is shown in FIG. 67 (lane 3; MW 61 kDa).

Figure 309:
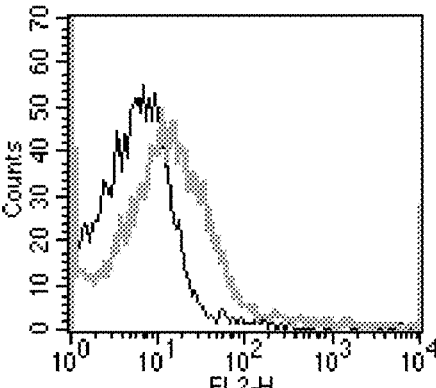

The GBS331-GST fusion product was purified (FIG. 209, lane 3) and used to immunise mice. The resulting antiserum was used for FACS (FIG. 309), which confirmed that the protein is immunoaccessible on GBS bacteria.

Based on this analysis, it was predicted that these proteins and their epitopes could be useful antigens for vaccines or diagnostics.

EXAMPLE 288

A DNA sequence (GBSx0315) was identified in S. agalactiae <SEQ ID 925> which encodes the amino acid sequence <SEQ ID 926>. This protein is predicted to be a acylneuraminate lyase (nanA). Analysis of this protein sequence reveals the following:

```
Possible site: 18
>>> Seems to have no N-terminal signal sequence

----- Final Results -----
            bacterial cytoplasm --- Certainty = 0.0894(Affirmative) < succ>
            bacterial membrane  --- Certainty = 0.0000(Not Clear)   < succ>
            bacterial outside   --- Certainty = 0.0000(Not Clear)   < succ>
```

The protein has homology with the following sequences in the GENPEPT database:

```
>GP: CAA69950 GB: Y08695 putative acylneuraminate lyase [Clostridium
tertium]
Identities = 162/225 (72%), Positives = 191/225 (84%)
```

-continued

```
Query:  1   MKDLQKYQGIIPAFYACYDDKGDICPERVKALTNYFIDKGVQGLYVNGSSGECIYQSVAD   60
            M++L+KY+GIIPAFYACYDD+G I PER +  T Y IDKGV+GLYV GSSGECIYQS  +
Sbjct:  1   MRNLEKYKGIIPAFYACYDDEGKISPERTQMFTQYLIDKGVKGLYVCGSSGECIYQSKEE  60

Query:  61  RKLVLENVMSVAKGKLTVIAHVACNNTKDSVELAMHAEAIGVDAIAAIPPIYPRLPEYAI  120
            RK+ LENVM VAKGK+T+IAHV CNNT+DS ELA HAE+IGVDAIA+IPPIYF LP+Y+I
Sbjct:  61  RKITLENVMKVARGKITIIAHVGCNNTRDSEELAEHAESIGVDAIASIFPIYFHLPDYSI  120

Query:  121 ADYWNTISQAAPQTDFIIYNIPQLAGVALTSDLYRKMLQNPQVIGVKNSSMPVQDIQNFV  180
            A+YWN IS AAP TDFIIYNIPQLAGV L  +LY++ML+NP+VIGVKNSSMPVQDIQ F
Sbjct:  121 AEYWNDISNAAPNTDFIIYNIPQLAGVGLGINLYKQMLKNPRVIGVKNSSMPVQDIQMFK  180

Query:  181 AIGGENHIVFNGPDEQFLGGRLMGAAAGIGGTYGVMPELYLTLNQ                225
                I G+   +VFNGPDEQF+ GR+MGA   GIGGTY VMPEL+L  ++
Sbjct:  181 DISGDESVVFNGPDEQFVAGRIMGADGGIGGTYAVMPELFLAADK                225
```

A related DNA sequence was identified in *S. pyogenes* <SEQ ID 927> which encodes the amino acid sequence <SEQ ID 928>. Analysis of this protein sequence reveals the following:

```
Possible site: 15
>>> Seems to have no N-terminal signal sequence

----- Final Results -----
            bacterial cytoplasm --- Certainty = 0.0981(Affirmative) < succ>
            bacterial membrane  --- Certainty = 0.0000(Not Clear)   < succ>
             bacterial outside  --- Certainty = 0.0000(Not Clear)   < succ>
```

An alignment of the GAS and GBS proteins is shown below:

```
Identities = 238/304 (78%), Positives = 263/304 (86%)

Query:  1   MKDLQKYQGIIPAFYACYDDKGDICPERVKALTNYFIDKGVQGLYVNGSSGECIYQSVAD   60
            M DL KYQGIIPAFYACYDD+G+I PERV+ALT Y+IDKGVQGLY+NGSSGECIYQSV D
Sbjct:  1   MTDLTKYQGIIPAFYACYDDQGNISPERVRALTQYYIDKGVQGLYINGSSGECIYQSVFD  60

Query:  61  RKLVLENVMSVAKGKLTVIAHVACNNTKDSVELANHAEAIGVDAIAAIPPIYFRLPEYAI  120
            R+LVLENVM+VAKGKLT+I HVACNNTKDS+ELA H+E +GVDAIAAIPPIYFRLPEYA+
Sbjct:  61  RQLVLENVMAVAKGKLTIINHVACNNTKDSIELAAHSERLGVDAIAAIPPIYFRLPEYAV  120

Query:  121 ADYWNTISQAAPQTDFIIYNIPQLAGVALTSDLYRKMLQNPQVIGVKNSSMPVQDIQNFV  180
            ADYWN IS AAP TDFIIYNIPQLAGVALT  LY+ ML N +VIGVKNSSMFVQDIQ F
Sbjct:  121 ADYWNAISSAAPHTDFIIYNIPQLAGVALTPSLYKTMLANKRVIGVKNSSMPVQDIQTFC  180

Query:  181 AIGGENHIVFNGPDEQFLGGRLMGAAAGIGGTYGVMPELYLTLNQLIVDKDLEKARELQF  240
            AIGG++HIVFNGPDEQFLGGRLMGAAAGIGGTYG MPEL+L LNQLI DKDLEKA+ LQ+
Sbjct:  181 AIGGDDHIVFNGPDEQFLGGRLMGAAAGIGGTYGAMPELFLRLNQLIADKDLEKAKALQY  240

Query:  241 TINDIITKLCSGHGNMYAVIKAVLEINEQLTIGSVRLPLASVTEEDKPIIKEAAEMIRHA  300
            TIN+II   L S HGNMY VIK VL INE L IGSVR PLA +  EED+ I + AA +I  A
Sbjct:  241 TINEIIGVLVSAHGNMYGVIKEVLRINEGLDIGSVRSPLAELVEEDRVICQRAAALINQA  300

Query:  301 KKQF                                                          304
            K+ F
Sbjct:  301 KETF                                                          304
```

Based on this analysis, it was predicted that these proteins and their epitopes could be useful antigens for vaccines or diagnostics.

EXAMPLE 289

A DNA sequence (GBSx0317) was identified in *S. agalactiae* <SEQ ID 929> which encodes the amino acid sequence <SEQ ID 930>. Analysis of this protein sequence reveals the following:

```
Possible site: 46
>>> Seems to have an uncleavable N-term signal seq
```

```
        INTEGRAL    Likelihood = -9.45      Transmembrane     82-98   (79-111)
        INTEGRAL    Likelihood = -6.85      Transmembrane     24-40   (21-52)
        INTEGRAL    Likelihood = -5.26      Transmembrane    180-196 (172-200)
        INTEGRAL    Likelihood = -5.10      Transmembrane    160-176 (158-179)
        INTEGRAL    Likelihood = -4.35      Transmembrane    110-126 (106-130)

----- Final Results -----
              bacterial membrane --- Certainty = 0.4779(Affirmative) < succ>
              bacterial outside  --- Certainty = 0.0000(Not Clear)   < succ>
              bacterial cytoplasm --- Certainty = 0.0000(Not Clear)  < succ>
```

The protein has homology with the following sequences in the GENPEPT database:

```
>GP: BAB05827 GB: AP001514 unknown conserved protein in B. subtilis
[Bacillus halodurans]
Identities = 40/148 (27%), Positives = 74/148 (49%), Gaps = 4/148 (2%)

Query:   14 VNNPFMQGCNVVFDLALLNLLFMI-TCLPLVTIG--AAKISLYRTLWQKLEGD-QTNLLI   69
               +++ F Q C+ ++ LA +NLL++  T L LV +G    A   +++  L  +   G+    +
Sbjct:    6 MSSRFYQTCDWIWKLAYINLLWLSGTLLGLVVLGFLPATTAMFTVLRKWFTGNPDVAITR   65

Query:   70 LYIKHLKKEWFQGMLLGLVELSILVVIIFDLTILHYQIGFIVSFLKITCYAFLLLTVMTS  129
               + +   K E+ +  LLG V L    ++ F+    L    G +    L +   YAFL+L ++T
Sbjct:   66 TFFQAYKNEFLKINLLGAVLLLGAYILYFNYMYLGTVEGTVHMVSLGWYAFLILYIITL  125

Query:  130 IYLFPMAARYEMSLLDTVKKSFIMACLN                                  157
                Y+ P       Y + L     +K +  I+    +N
Sbjct:  126 FYIIPAYVHYNLKLFQYIKTALIIGFVN                                  153
```

A related DNA sequence was identified in *S. pyogenes* <SEQ ID 931> which encodes the amino acid sequence <SEQ ID 932>. Analysis of this protein sequence reveals the following:

```
Possible site: 24
>>> Seems to have no N-terminal signal sequence
        INTEGRAL    Likelihood = -14.86     Transmembrane    117-133 (108-139)
        INTEGRAL    Likelihood = -7.48      Transmembrane     30-46   (21-54)
        INTEGRAL    Likelihood = -6.90      Transmembrane     88-104  (83-105)
        INTEGRAL    Likelihood = -6.26      Transmembrane    165-181 (151-187)
        INTEGRAL    Likelihood = -5.89      Transmembrane    189-205 (182-207)

----- Final Results -----
              bacterial membrane --- Certainty = 0.6944(Affirmative) < succ>
              bacterial outside  --- Certainty = 0.0000(Not Clear)   < succ>
              bacterial cytoplasm --- Certainty = 0.0000(Not Clear)  < succ>
```

The protein has homology with the following sequences in the databases:

```
>GP: BAB05582 GB: AP001513 unknown conserved protein in bacilli
[Bacillus halodurans]
Identities = 59/194 (30%), Positives = 93/194 (47%), Gaps = 11/194 (5%)

Query:   17 SKWMRASAALFDLLVFNLLFVL-SCLPLLTIGV--AKMALYASLLDWREGQVS-QLVTTY   72
               +K M+      +  L+   NLL++L S +    + +GV    A   +L+A    W + +      L   TY
Sbjct:    8 TKIMKLFEWIMRLVYLNLLWLLFSFIGGIILGVMPATASLFAVFRKWYQKEDDFPLFQTY   67

Query:   73 SSHFKYYFKSGLRLGLIELGIMTICLLDLFLIRNQSGLVFQGFKVLCVAVLFLVVILFY  132
               +  FK    FK   +GL +   I    I   LD+ L+    S   + Q      A+ F+ ++  LY
Sbjct:   68 LNEFKRSFKIANLVGLTLVLIGGILYLDVLLLLGTSHWIGQLLLMGVGALSFIYLVTLLY  127

Query:  133 AYPQAVKRDLSLSTLFKRSFLLAGLFFPWSFAFLAFICLTIFSLQL----SLLTLFGGVS  188
               +P  V   DLS     FK  SFLL G+    P+    L   I L++  +L          LL LF    S
Sbjct:  128 IFPTLVHFDLSYKQYFKHSFLL-GVLQPFR-TLLLMITLSLSALLFLTFPILLPLF-AAS  184

Query:  189 LLAIIGISSLTYLY                                                202
                +A + +  S  + Y
Sbjct:  185 FMAALTMWSFLFGY                                                198
```

An alignment of the GAS and GBS proteins is shown below:

```
Identities = 68/210 (32%), Positives = 117/210 (55%)

Query:    3  KANQLIAAIFDVNNPFMQGCNVVFDLALLNLLFMITCLPLVTIGAAKISLYRTLWQKLEG   62
             K   L+ ++F +++ +M+    +FDL + NLLF+++CLPL+TIG AK++LY +L    EG
Sbjct:    4  KKQGLLHSLFKLDSKWMRASAALFDLLVFNLLFVLSCLPLLTIGVAKMALYASLLDWREG   63

Query:   63  DQTNLLILYIKHLKKEWFQGMLLGLVELSILVVIIFDLTILHYQIGFIVSFLKITCYAFL  122
             + L+  Y  H K  + G+ LGL+EL I+ + + DL ++   Q G +     K+ C A L
Sbjct:   64  QVSQLVTTYSSHFKYYFKSGLRLGLIELGIMTICLLDLFLIRNQSGLVFQGFKVLCVAVL  123

Query:  123  LLTVMTSIYLFPMAARYEMSLLDTVKKSFIMACLNLKWTGVLMFLLIMTWFIMVQSSLLF  182
             L V+  +Y +P A + ++SL      K+SF++A L    W+   +  ++T F  + S L
Sbjct:  124  FLVVILFLYAYPQAVKRDLSLSTLFKRSFLLAGLFFPWSFAFLAFICLTIFSLQLSLLTL  183

Query:  183  MLTVSAIFIFAYTAFAYFKIIILQKQFAYF                               212
                  VS + I    ++  Y  +II++        F
Sbjct:  184  FGGVSLLAIIGISSLTYLYLIIMESLLRRF                               213
```

A related GBS gene <SEQ ID 8535> and protein <SEQ ID 8536> were also identified. Analysis of this protein sequence reveals the following:

```
Lipop:         Possible site: -1              Crend: 2
McG:           Discrim Score: 3.27
GvH:           Signal Score (-7.5): -4.23
Possible site: 46
>>> Seems to have an uncleavable N-term signal seq
ALOM program count: 5 value: -9.45 threshold: 0.0
INTEGRAL       Likelihood = -9.45   Transmembrane  82-98    (79-111)
INTEGRAL       Likelihood = -6.85   Transmembrane  24-40    (21-52)
INTEGRAL       Likelihood = -5.26   Transmembrane 180-196  (172-200)
INTEGRAL       Likelihood = -5.10   Transmembrane 160-176  (158-179)
INTEGRAL       Likelihood = -4.35   Transmembrane 110-126  (106-130)
PERIPHERAL     Likelihood =  5.89   142
modified ALOM score: 2.39

*** Reasoning Step: 3

----- Final Results -----
        bacterial membrane --- Certainty = 0.4779 (Affirmative)  <succ>
         bacterial outside --- Certainty = 0.0000 (Not Clear)    <succ>
       bacterial cytoplasm --- Certainty = 0.0000 (Not Clear)    <succ>
```

The protein has homology with the following sequences in the databases:

```
ORF00072(364-828 of 1260)
EGAD|105353|BS3003(14-171 of 222)hypothetical protein{Bacillus subtilis}
OMNI|NT01BS3507 conserved hypothetical protein GP|2635493|emb|CAB14987.1||Z99119
similar to hypothetical protein yteU-Bacillus subtilis
% Match = 5.9
% Identity = 26.6    % Similarity = 50.6
Matches = 42   Mismatches = 74    Conservative Sub.s = 38

270       300       330       360       390       417       441       471
IMSKKGY*KC*WRKKYREYIVKKANQLIAAIFDVNNPFMQGCNVVFDLALLNLLFMI-TCLPLVTIG--AAKISLYRTLW
                                 |   :  :|   |||::   |||     |    |   :|:    :
                              MEHDGSLGRMLRFCEWIMRFAYTNLLWLFFTLLGLGVFGIMPATAALFAVMR
                                         10        20        30        40        50

498       528       558       588       618       648       678       708
QKLEG-DQTNLLILYIKHLKKEWFQGMLLGLVELSILVVIIFDLTILHYQIGFIVSFLKITCYAFLLLTVMTSIYLFPMA
: ::|  |    :|   : :    |  |:|:  |||     |  |:|   ||  ::  |    |:|  |     |:||:
KWIQGQDNVPVLKTFWQEYKGEFFRSNLLGAVLALIGVIIYIDLALI-YPSHFLLHILRFAIMIFGFLFVSMLFYVFPLL
         70        80        90       100       110       120       130

738       768       798       828       858       888       918       948
ARYEMSLLDTVKKSFIMACLNLKWTGVLMFLLIMTWFIMVQSSLLFMLTVSAIFIFAYTAFAYFKIIILQKQFAYFSKQQ
  ::      ||  |::::   |::| :: |  :  ::|::
VHFDWKKRLYVKFSLLLSVAYLQYTLTMLALTVALFFLLAYLPGIVPFFSVSLISYCHMRIVYAVLLKVEQHGGEPQRKS
             150       160       170       180       190       200       210
```

Based on this analysis, it was predicted that these proteins and their epitopes could be useful antigens for vaccines or diagnostics.

EXAMPLE 290

A DNA sequence (GBSx0318) was identified in *S. agalactiae* <SEQ ID 933> which encodes the amino acid sequence <SEQ ID 934>. Analysis of this protein sequence reveals the following:

```
Possible site: 51
>>> Seems to have no N-terminal signal sequence

----- Final Results -----
         bacterial cytoplasm --- Certainty = 0.1827 (Affirmative) <succ>
         bacterial membrane  --- Certainty = 0.0000 (Not Clear)   <succ>
         bacterial outside   --- Certainty = 0.0000 (Not Clear)   <succ>
```

The protein has homology with the following sequences in the GENPEPT database:

```
>GP: AAC44392 GB: U43526 ORF-1 [Streptococcus pneumoniae]
Identities = 48/151 (31%), Positives = 66/151 (42%), Gaps = 5/151 (3%)

Query:   1 MIYDHLLNLTHYKDINPNLDLAIDYLLSHDLRNLDIGTYHISPEVILMVQSNQLSES-FD   59
           MI   + L  Y  +NP+    ID+L    L NL  G+  I   +        L++
Sbjct:   1 MIITKISRLGTYVGVNPHFATLIDFLEKTGLENLTEGSIAIDGNRLFGNCFTYLADGQAG  60

Query:  60 HIFEYHKKYLDIHYVIEGHEVIKLGKGDKVEV-EEY--LGDIGFIKCSEETSFDLRDNYI  116
           FE H+KYLDIH V+E  E + +    + V V +EY     DI        E    LR
Sbjct:  61 AFFETHQKYLDIHLVLENEEAMAVTSPENVSVTQEYDEEKDIELYTGKVEQLVHLRAGEC  120

Query: 117 AFFFPEEAHQPNGMGSLGNYVKKGVLKVLMA                              147
            FPE+ HQP +      VKK V KV ++
Sbjct: 121 LITFPEDLHQPK-VRINDEPVKKVVFKVAIS                              150
```

No corresponding DNA sequence was identified in *S. pyogenes*.

Based on this analysis, it was predicted that this protein and its epitopes, could be useful antigens for vaccines or diagnostics.

EXAMPLE 291

A DNA sequence (GBSx0319) was identified in *S. agalactiae* <SEQ ID 935> which encodes the amino acid sequence <SEQ ID 936>. This protein is predicted to be sugar ABC transporter, permease protein (araQ). Analysis of this protein sequence reveals the following:

```
Possible site: 35
>>> Seems to have a cleavable N-term signal seq.
    INTEGRAL    Likelihood = -7.38    Transmembrane  245-261 (239-265)
    INTEGRAL    Likelihood = -3.72    Transmembrane  140-156 (139-158)
    INTEGRAL    Likelihood = -3.61    Transmembrane   76-92  (71-94)
    INTEGRAL    Likelihood = -2.81    Transmembrane  112-128 (107-128)
    INTEGRAL    Likelihood = -1.59    Transmembrane  188-204 (186-204)

----- Final Results -----
         bacterial membrane  --- Certainty = 0.3951(Affirmative) < succ>
         bacterial outside   --- Certainty = 0.0000(Not Clear)   < succ>
         bacterial cytoplasm --- Certainty = 0.0000(Not Clear)   < succ>
```

The protein has homology with the following sequences in the GENPEPT database:

```
>GP: AAD35515 GB: AE001721 sugar ABC transporter, permease protein
[Thermotoga maritima]
Identities = 94/262 (35%), Positives = 158/262 (59%), Gaps = 1/262 (0%)

Query: 15 LILCLLTVLFIFPPFYWIMTGAFKSQPDTIIIPPQWWPKAPTLENFKALTVQNPALRWLWN  74
          + +   + V+F+ P ++ +    +FK        PP   +PK P+LE +  +   L +L N
Sbjct:  9 IFIVFMLVVFMLPVFYAVVSSFKPMSEIYSYPPTIFPKKPSLEGYINVIKEYDLLTYLRN  68
```

-continued
```
Query:  75 SVFISIMTMFLVCCTSSMAGYVLAKKRFYGQKILFSLFIAAMALPKQVVLVPLVRIINFM 134
           ++F++ +  +    S M GY LAK +F+G + + S+F   M +  QV++VPL +I +
Sbjct:  69 TLFVATVATVITVLVSVMTGYGLAKGKFWGIRPVNSMFTMTMFVSAQVIMVPLFVVIRSL 128

Query: 135 GIHDTLWAVILPLVGWPFGVFLMKQFSENIPTELLESAKIDGCGEIRTFINVAFPIVKPG 194
           G+ ++LW +I+P V  P G+F+  Q+ ++IP ELLESAKIDG  E + F  + FP+ KP
Sbjct: 129 GLINSLWGLIIPAVYTPTGMFMAVQYMKDIPDELLESAKIDGANEWQIFWRIVFPLSKPL 188

Query: 195 FAALAIFTFINTWNDYFMQLVMLTSRNNLTISLGVATMQAEM-ATNYGLIMAGAALAAVP 253
             AALAIF+F  WND+ + L+++  RN  T+ L +AT+Q E  +   I+A + L  +P
Sbjct: 189 VAALAIFSFTWRWNDFVLPLLVVNRRNLYTLQLALATIQEEYGGAEWNTILAFSTLTIIP 248

Query: 254 IVTVFLVFQKSFTQGITMGAVK                                      275
           +  +FL+FQ+ F +GI  G +K
Sbjct: 249 TLIIFLLFQRLFMKGIMAGGLK                                      270
```

A related DNA sequence was identified in *S. pyogenes* <SEQ ID 937> which encodes the amino acid sequence <SEQ ID 938>. Analysis of this protein sequence reveals the following:

```
Possible site: 40
>>> Seems to have a cleavable N-term signal seq.
    INTEGRAL    Likelihood = -6.37    Transmembrane   245-261 (240-265)
    INTEGRAL    Likelihood = -5.15    Transmembrane   140-156 (139-158)
    INTEGRAL    Likelihood = -2.97    Transmembrane   111-127 (107-128)
    INTEGRAL    Likelihood = -2.87    Transmembrane    76-92  (75-93)
    INTEGRAL    Likelihood = -1.59    Transmembrane   188-204 (186-204)

----- Final Results -----
              bacterial membrane --- Certainty = 0.3548(Affirmative) < succ>
               bacterial outside --- Certainty = 0.0000(Not Clear)  < succ>
             bacterial cytoplasm --- Certainty = 0.0000(Not Clear)  < succ>
```

The protein has homology with the following sequences in the databases:

```
>GP: CAB59597 GB: AL132662 probable sugar transport inner membrane
protein [Streptomyces coelicolor A3(2)]
Identities = 88/262 (33%), Positives = 147/262 (55%)

Query:  15 VMLCVLTILFIFPFYWIMTGAFKAQADTIMIPPQWWPKAPTIENFKALVVQNPALKWLWN  74
           ++L  L ++F P W++ +  + A+   PP WP +  ++ ++     +W  N
Sbjct:  38 LLLAPLALVFAVPLVWLVLSSVMSNAEINRFPPALWPSGIDLGGYRYVLGNAMFPRWFVN  97

Query:  75 SVFISVATMFLVCGTSSLAGYALAKKRFYGQRLLFSIFIAAMALPKQVVLVPLVRIVNFM 134
           S+  +S  T+       SLAGYA A+ RF G R+L + +A MA+P Q+ ++P  ++ +
Sbjct:  98 SLIVSAVTVAANLVFGSLAGYAFARMRFAGSRVLMGLMLATMAVPFQLTMIPTFLVMKKL 157

Query: 135 GIHDTLAAVILPLVGWPFGVFLMKQFSENIPTELLESAKIDGCGEIRTFFNVAFPIVKPG 194
           G+ DTL A+I+P +  PF VFL++QF   ++P EL E+A IDGC  +R + +  P+ +P
Sbjct: 158 GLIDTLGALIVPSLVTPFAVFLLRQFFLSLPRELEEAAWIDGCSRLRVLWRIVLPLSRPA 217

Query: 195 FAALAIFTFINTWNDYFMQLVMLTSRENLTISLGVATMQAEMATNYGLIMAGAAMAAVPI 254
            A +A+ TF+ TWND     L+ +      T+ LG+ T Q +    T  +  +MAG +  +P+
Sbjct: 218 LATVAVLTFLTTWNDLTWPLIAINHDTQYTLQLGLTTFQGQHHTQWAAVMAGNVITVLPV 277

Query: 255 VTVFLVFQKSFTQGITMGAVKG                                      276
           +  FL  QK+F Q IT    +KG
Sbjct: 278 LLAFLGAQKTFIQSITSSGLKG                                      299
```

An alignment of the GAS and GBS proteins is shown below:

```
Identities = 245/276 (88%), Positives = 262/276 (94%)

Query:   1 MKKKTFSAYNFLTALILCLLTVLFIFPFYWIMTGAFKSQPDTIIIPPQWWPKAPTLENFK   60
           M KK  +A + LT ++LC+LT+LFIFPFYWIMTGAFK+Q DTI+IPPQWWPKAPT+ENFK
Sbjct:   1 MTKKKLTASDILTTVMLCVLTILFIFPFYWIMTGAFKAQADTIMIPPQWWPKAPTIENFK   60

Query:  61 ALTVQNPALRWLWNSVFISIMTMFLVCCTSSMAGYVLAKKRFYGQKILFSLFIAAMALPK  120
           AL VQNPAL+WLWNSVFIS+ TMFLVC TSS+AGY LAKKRFYGQ++LFS+FIAAMALPK
Sbjct:  61 ALVVQNPALKWLWNSVFISVATMFLVCGTSSLAGYALAKKRFYGQRLLFSIFIAAMALPK  120
```

-continued

```
Query:  121 QVVLVPLVRIINFMGIHDTLWAVILPLVGWPFGVFLMKQFSENIPTELLESAKIDGCGEI  180
            QVVLVPLVRI+NFMGIHDTL AVILPLVGWPFGVFLMKQFSENIPTELLESAKIDGCGEI
Sbjct:  121 QVVLVPLVRIVNFMGIHDTLAAVILPLVGWPFGVFLMKQFSENIPTELLESAKIDGCGEI  180

Query:  181 RTFINVAFPIVKPGFAALAIFTFINTWNDYFMQLVMLTSRNNLTISLGVATMQAEMATNY  240
            RTF NVAFPIVKPGFAALAIFTFINTWNDYFMQLVMLTSR NLTISLGVATMQAEMATNY
Sbjct:  181 RTFFNVAFPIVKPGFAALAIFTFINTWNDYFMQLVMLTSRENLTISLGVATMQAEMATNY  240

Query:  241 GLIMAGAALAAVPIVTVFLVFQKSFTQGITMGAVKG                         276
            GLIMAGAA+AAVPIVTVFLVFQKSFTQGITMGAVKG
Sbjct:  241 GLIMAGAAMAAVPIVTVFLVFQKSFTQGITMGAVKG                         276
```

Based on this analysis, it was predicted that these proteins and their epitopes could be useful antigens for vaccines or diagnostics.

EXAMPLE 292

A DNA sequence (GBSx0320) was identified in *S. agalactiae* <SEQ ID 939> which encodes the amino acid sequence <SEQ ID 940>. Analysis of this protein sequence reveals the following:

```
Possible site: 31
>>> Seems to have a cleavable N-term signal seq.
    INTEGRAL    Likelihood = -10.83    Transmembrane    74-90   (64-96)
    INTEGRAL    Likelihood =  -6.37    Transmembrane   108-124  (107-126)
    INTEGRAL    Likelihood =  -5.84    Transmembrane   270-286  (265-290)
    INTEGRAL    Likelihood =  -5.20    Transmembrane   161-177  (156-182)
    INTEGRAL    Likelihood =  -0.16    Transmembrane   219-235  (219-235)

----- Final Results -----
              bacterial membrane --- Certainty = 0.5331(Affirmative) < succ>
               bacterial outside --- Certainty = 0.0000(Not Clear)   < succ>
             bacterial cytoplasm --- Certainty = 0.0000(Not Clear)   < succ>
```

The protein has homology with the following sequences in the GENPEPT database:

```
>GP: BAB05584 GB: AP001513 sugar transport system (permease) (binding
protein dependent transporter) [Bacillus halodurans]
Identities = 106/289 (36%), Positives = 168/289 (57%), Gaps = 6/289 (2%)

Query:    9 RETMIAYAFLAPILLFFLIFVFAPMVMGFVTSFFNYSM-TQFTFIGLANYNRMF-HDSIF   66
            +E      Y F+AP ++ F IF   PM+      SF ++ +  +  G  NY R+F  D +F
Sbjct:   25 KEYFWGYLFIAPPIIGFAIFALGPMLYSIYVSFTDFDLYNEPVWTGADNYYRLFVTDDLF   84

Query:   67 MKSLINTVIIVIGSVPVVVFFSLFVAANTYEKNVFSRSFYRCVFFLPVVTGSVAVTVVWK  126
            K++  NT     +G +P+ +   SL +A    +K V    +R  FFLP V+    VA+T++W+
Sbjct:   85 RKTVFNTFYAALG-IPIGMAVSLGIAVALNQK-VKGIALFRTAFFLPAVSSVVAITLLWR  142

Query:  127 WIYDPMSGILNYILKSGHVIEQNISWLGDKHWALLAIIIILLTTSVGQPIILYIAAMGNI  186
            WI++    G+LN +L  +V        WL D+ WA+ A+II +   +G   +ILY+AA+  +
Sbjct:  143 WIFNADFGLLNIMLN--YVGIHGPGWLSDEKWAMPAMIIQGVWGGLGINMILYLAALQGV  200

Query:  187 DNSLCEAARVDGANEMQVFWQIKWPSLLPTTLYIAVITTINSFQCFALIQLLTSGGPNYS  246
            + +L EAA +DG N  Q F I   PS+ PTT +I + +TI + Q F     ++T GGPNYS
Sbjct:  201 NPALYEAADIDGGNAWQKFIHITVPSISPTTFFILITSTIGALQDFQRFMIMTEGGPNYS  260

Query:  247 TSTLMYYLYEKAFKLSEYGYANTMGVFLAVMIALISFAQFKILGNDVEY             295
            T+T++ YYL+  AF+    E GYA+ M    L ++I +I+    FK+       V Y
Sbjct:  261 TTTVVYYLFLNAFRYMEMGYASAMAWVLGIIILIITIINFKLAKKWVHY             309
```

A related DNA sequence was identified in *S. pyogenes* <SEQ ID 941> which encodes the amino acid sequence <SEQ ID 942>. Analysis of this protein sequence reveals the following:

```
Possible site: 13
>>> Seems to have no N-terminal signal sequence
    INTEGRAL    Likelihood = -12.74    Transmembrane    55-71   (44-78)
```

```
                          -continued
INTEGRAL    Likelihood = -10.83    Transmembrane    109-125 (98-130)
INTEGRAL    Likelihood =  -6.21    Transmembrane    304-320 (299-324)
INTEGRAL    Likelihood =  -6.00    Transmembrane    142-158 (141-160)
INTEGRAL    Likelihood =  -5.04    Transmembrane    196-212 (190-216)
INTEGRAL    Likelihood =  -0.16    Transmembrane    253-269 (253-269)

----- Final Results -----
            bacterial membrane  --- Certainty = 0.6095(Affirmative) < succ>
            bacterial outside   --- Certainty = 0.0000(Not Clear)   < succ>
            bacterial cytoplasm --- Certainty = 0.0000(Not Clear)   < succ>
```

The protein has homology with the following sequences in the databases:

```
>GP: BAB05584 GB: AP001513 sugar transport system (permease) (binding
protein dependent transporter) [Bacillus halodurans]
Identities = 113/310 (36%), Positives = 176/310 (56%), Gaps = 9/310 (2%)

Query:   25 KVEQKKEVFQVNVNKLKMR---ETLISYAFLAPVLVFFVIFVLPMIMGFVTSFFNYSM-   80
            +VE  +E      K K R    E    Y F+AP ++ F IF L PM+      SF ++ +
Sbjct:    4 EVETPRETKTTKARKQKRRLNKEYFWGYLFIAPPIIGFAIFALGPMLYSIYVSFTDFDLY   63

Query:   81 TEFTFVGFANYARMF-QDPIFMKSLINTLIIVIGSVPVVVFFSLFVAAKTYDKNVVARSF  139
               E  + G  NY R+F  D +F K++ NT    +G +P+ +  SL +A    K V   +
Sbjct:   64 NEPVWTGADNYYRLFVTDDLFRKTVFNTFYAALG-IPIGMAVSLGIAVALNQK-VKGIAL  121

Query:  140 YRAVFFLPVVTGSVAVTVVWKWIYDPMSGILNYVLKYAHVIEQNISWLGDKHWALLAIIV  199
            +R  FFLP V+  VA+T++W+WI++   G+LN +L Y +      WL D+ WA+ A+I+
Sbjct:  122 FRTAFFLPAVSSVVAITLLWRWIFNADFGLLNIMLNYVGI--HGPGWLSDEKWAMPAMII  179

Query:  200 ILLTTSVGQPIILYIAAMGNIDNSLVEAARVDGATEFQVFWNIKWPSLLPTTLYIAVITT  259
              +   +G  +ILY+AA+ ++ +L EAA +DG    +Q F +I  PS+ PTT +I + +T
Sbjct:  180 QGVWGGLGINMILYLAALQGVNPALYEAADIDGGNAWQKFIHITVPSISPTTFFILITST  239

Query:  260 INSFQCFALIQLLTSGGPNYSTSTLMYYLYEKAFKLSEYGYANTMGVFLAVMIAIISFAQ  319
            I + Q F      ++T GGPNYST+T++YYL+  AF+   E GYA+ M    L ++I II+
Sbjct:  240 IGALQDFQRFMIMTEGGPNYSTTTVVYYLFLNAFRYMEMGYASAMAWVLGIIILIITIIN  299

Query:  320 FKILGNDVEY   329
            FK+      V Y
Sbjct:  300 FKLAKKWVHY   309
```

An alignment of the GAS and GBS proteins is shown below:

```
Identities = 263/295 (89%), Positives = 278/295 (94%)

Query:    1 MRTNKLKMRETMIAYAFLAPILLFFLIFVFAPMVMGFVTSFFNYSMTQFTFIGLANYNRM   60
            +  NKLKMRET+I+YAFLAP+L+FF+IFV  PM+MGFVTSFFNYSMT+FTF+G ANY RM
Sbjct:   35 VNVNKLRMRETLISYAFLAPVLVFFVIFVLPMIMGFVTSFFNYSMTEFTFVGFANYARM   94

Query:   61 FHDSIFMKSLINTVIIVIGSVPVVVFFSLFVAANTYEKNVFSRSFYRCVFFLPVVTGSVA  120
            F D IFMKSLINT+IIVIGSVPVVVFFSLFVAA TY+KNV +RSFYR  VFFLPVVTGSVA
Sbjct:   95 FQDPIFMKSLINTLIIVIGSVPVVVFFSLFVAAKTYDKNVVARSFYRAVFFLPVVTGSVA  154

Query:  121 VTVVWKWIYDPMSGILNYILKSGHVIEQNISWLGDKHWALLAIIIILLTTSVGQPIILYI  180
            VTVVWKWIYDPMSGILNY+LK  HVIEQNISWLGDKHWALLAII+ILLTTSVGQPIILYI
Sbjct:  155 VTVVWKWIYDPMSGILNYVLKYAHVIEQNISWLGDKHWALLAIIVILLTTSVGQPIILYI  214

Query:  181 AAMGNIDNSLCEAARVDGANEMQVFWQIKWPSLLPTTLYIAVITTINSFQCFALIQLLTS  240
            AAMGNIDNSL EAARVDGA E QVFW IKWPSLLPTTLYIAVITTINSFQCFALIQLLTS
Sbjct:  215 AAMGNIDNSLVEAARVDGATEFQVFWNIKWPSLLPTTLYIAVITTINSFQCFALIQLLTS  274

Query:  241 GGPNYSTSTLMYYLYEKAFKLSEYGYANTMGVFLAVMIALISFAQKILGNDVEY        295
            GGPNYSTSTLMYYLYEKAFKLSEYGYANTMGVFLAVMIA+ISFAQKILGNDVEY
Sbjct:  275 GGPNYSTSTLMYYLYEKAFKLSEYGYANTMGVFLAVMIAIISFAQKILGNDVEY        329
```

Based on this analysis, it was predicted that these proteins and their epitopes could be useful antigens for vaccines or diagnostics.

EXAMPLE 293

A DNA sequence (GBSx0321) was identified in *S. agalactiae* <SEQ ID 943> which encodes the amino acid sequence <SEQ ID 944>. Analysis of this protein sequence reveals the following:

Based on this analysis, it was predicted that these proteins and their epitopes could be useful antigens for vaccines or diagnostics.

EXAMPLE 293

A DNA sequence (GBSx0321) was identified in *S. agalactiae* <SEQ ID 943> which encodes the amino acid sequence <SEQ ID 944>. Analysis of this protein sequence reveals the following:

```
Possible site: 31
>>> Seems to have a cleavable N-term signal seq.

----- Final Results -----
          bacterial outside --- Certainty = 0.3000 (Affirmative) <succ>
         bacterial membrane --- Certainty = 0.0000 (Not Clear)   <succ>
        bacterial cytoplasm --- Certainty = 0.0000 (Not Clear)   <succ>
```

The protein has homology with the following sequences in the GENPEPT database:

```
>GP:CAB12516 GB:Z99107 similar to sugar-binding protein [Bacillus subtilis]
Identities = 54/187 (28%), Positives = 90/187 (47%), Gaps = 14/187 (7%)

Query:  19 MFACVDSSQSVMAAEKD-KVEITWWAFPTFTQEKAKDGVGTYEKKVIKAFEKKNPNIKVK    77
           MF+   +  +   ++D  + I WW      +  D    Y  KVI+  +EKKNP++ ++
Sbjct:   1 MFSGCSAGEEASGKKEDVTLRIAWWG-----GQPRHD----YTTKVIELYEKKNPHVHIE   51

Query:  78 LETIDFTSGPEKITTAIEAGTAPDVLFDAPGRIIQYGKNGKLADLNDLFTDQFIKDVN--  135
             E  ++    +K+        AG PDV+     + QYGK +L DL   D   I DV+
Sbjct:  52 AEFANWDDYWKKLAPMSAAGQLPDVIQMDTAYLAQYGKKNQLEDLTPYTKDGTI-DVSSI  110

Query: 136 NKNIIQASKSGDKAYMYPISSAPFYMAFNKKMLKDAGVLKLVKEGWTTSDFEKVLKALKN  195
           ++N++   K  +K Y + +       + N+ +LK AGV + +E WT   D+EK+   L+
Sbjct: 111 DENMLSGGKIDNKLYGFTLGVNVLSVIANEDLLKKAGV-SINQENWTWEDYEKLAYDLQE  169

Query: 196 KGYTPGS                                                      202
           K    GS
Sbjct: 170 KAGVYGS                                                      176
```

A related DNA sequence was identified in *S. pyogenes* <SEQ ID 945> which encodes the amino acid sequence <SEQ ID 946>. Analysis of this protein sequence reveals the following:

```
Possible site: 20
>>> May be a lipoprotein

----- Final Results -----
         bacterial membrane --- Certainty = 0.0000 (Not Clear) <succ>
          bacterial outside --- Certainty = 0.0000 (Not Clear) <succ>
        bacterial cytoplasm --- Certainty = 0.0000 (Not Clear) <succ>
```

The protein has homology with the following sequences in the databases:

```
!GB:Z99107 similar to sugarbinding protein [Bacillu. . . 82 2e-14
>GP:CAB12516 GB:Z99107 similar to sugar-binding protein [Bacillus subtilis]
Identities = 105/446 (23%), Positives = 176/446 (38%), Gaps = 71/446 (15%)

Query:  24 GKSQKEAGASKSDTAKTEITWWAFPVFTQEKAEDGVGTYEKKLIAAFEKANPEIKVKLET   83
           G S  E  + K+       I WW      +  D    Y  K+I  +EK NP + ++ E
Sbjct:   4 GCSAGEEASGKKEDVTLRIAWWG-----GQPRHD----YTTKVIELYEKKNPHVHIEAEF   54

Query:  84 IDFTSGPEKITTAIEAGTAPDVLFDAPGRIIQYGKNGKLADLNDLFTEEFTKDVN--NDK  141
           ++     +K+        AG PDV+     + QYGK +L DL  +T++ T  DV+  ++
Sbjct:  55 ANWDDYWKKLAPMSAAGQLPDVIQMDTAYLAQYGKKNQLEDLTP-YTKDGTIDVSSIDEN  113

Query: 142 LIQASKAGDTAYMYPISSAPFYMALNKKMLKDAGVLDLVKEGWTTDDFEKVLKALKDK--  199
           ++    K  + Y + +       + N+ +LK AGV + +E WT +D+EK+    L++K
Sbjct: 114 MLSGGKIDNKLYGFTLGVNVLSVIANEDLLKKAGV-SINQENWTWEDYEKLAYDLQEKAG  172
```

```
-continued

Query: 200 -----GYNPGSFFANGQGGDQGPRAFFANLYSSHITDDKV---------------TKYTT 239
             G +P   F      +G R+   +       DD++                  T T
Sbjct: 173 VYGSNGMHPPDIFFPYYLRTKGERFYKEDGTGLAYQDDQLFVDYFERQLRLVKAKTSPTP 232

Query: 240 DDANSIKAMTKISNWIKDGLMMNGSQYDGSADIQNFANGQTSFTILWAPAQPGIQAKLLE 299
             D++  IK M       +D  ++ G     SA   N++N  F              A+L+
Sbjct: 233 DESAQIKGM-------EDDFIVKGK----SAITWNYSNQYLGF------------ARLTD 269

Query: 300 ASKVDYLEIPFPSDDGKPELEYLVNGFAVFNNKDEQKVAASKTFIQFIADDKEWGPKNVV 359
             +    YL  P  + L  +        E K  A+K FI F  +++E    + +
Sbjct: 270 SPLSLYLP---PEQMQEKALTLKPSMLFSIPKSSEHKKEAAK-FINFFVNNEE-ANQLIK 324

Query: 360 RTGAFPVRTSYGDLYKDKRMEK---IAEWTKFYSPYYNTID-----GFAEMRTLWFPMVQ 411
                 PV     D  K K  E+    I E+ +   S   + D          G AE+  L
Sbjct: 325 GERGVPVSDKVADAIKPKLNEEETNIVEYVETASKNISKADPPEPVGSAEVIKLLKDTSD 384

Query: 412 AVSNGDEKPEDALKAFTEKANKTIKK                                  437
             +         PE A K  F +KAN+ +++
Sbjct: 385 QILYQKVSPEKAAKTFRKKANEILER                                  410
```

An alignment of the GAS and GBS proteins is shown below:

```
Identities = 352/438 (80%), Positives = 384/438 (87%), Gaps = 4/438 (0%)

Query:   1 MSIKKSVIGFCLGAAALSMFACVDSSQSVMAAEKD---KVEITWWAFPTFTQEKAKDGVG  57
             M++KK     LGA+ L + AC   SQ     A K    K EITWWAFP FTQEKA+DGVG
Sbjct:   1 MNMKKLASLAMLGASVLGLAACGGKSQKEAGASKSDTAKTEITWWAFPVFTQEKAEDGVG  60

Query:  58 TYEKKVIKAFEKKNPNIKVKLETIDFTSGPEKITTAIEAGTAPDVLFDAPGRIIQYGKNG 117
             TYEKK+I AFEK NP IKVKLETIDFTSGPEKITTAIEAGTAPDVLFDAPGRIIQYGKNG
Sbjct:  61 TYEKKLIAAFEKANPEIKVKLETIDFTSGPEKITTAIEAGTAPDVLFDAPGRIIQYGKNG 120

Query: 118 KLADLNDLFTDQFIKDVNNKNIIQASKSGDKAYMYPISSAPFYMAFNKKMLKDAGVLKLV 177
             KLADLNDLFT++F KDVUN +IQASK+GD AYMYPISSAPFYMA NKKMLKDAGVL LV
Sbjct: 121 KLADLNDLFTEEFTKDVNNDKLIQASKAGDTAYMYPISSAPFYMALNKKMLKDAGVLDLV 180

Query: 178 KEGWTTSDFEKVLKALKNKGYTPGSFFANGQGGDQGPRAFFANLYSAPITDKEVTKYTTD 237
             KEGWTT DFEKVLKALK+KGY PGSFFANGQGGDQGPRAFFANLYS+ ITD +VTKYTTD
Sbjct: 181 KEGWTTDDFEKVLKALKDKGYNPGSFFANGQGGDQGPRAFFANLYSSHITDDKVTKYTTD 240

Query: 238 TKNSVKSMKKIVEWIKKGYLMNGSQYDGSADIQNFANGQTAFTILWAPAQPKTQAKLLES 297
                NS+K+M KI   WIK G +MNGSQYDGSADIQNFANGQT+FTILWAPAQP  QAKLLE+
Sbjct: 241 DANSIKANTKISNWIKDGLMNNGSQYDGSADIQNFANGQTSFTILWAPAQPGIQAKLLEA 300

Query: 298 SKVDYLEVPFPSEDGKPDLEYLVNGFAVFNNKDENKVASKKFITFIADDKKWGPKDVIR 357
             SKVDYLE+PFPS+DGKP+LEYLVNGFAVFNNKDE KV ASK FI FIADDK+WGPK+V+R
Sbjct: 301 SKVDYLEIPFPSDDGKPELEYLVNGFAVFNNKDEQKVAASKTFIQFIADDKEWGPKNVVR 360

Query: 358 TGAFPVRTSFGDLYKGDKRNNKISKWTQYYSPYYNTIDGFSEMRTLWFPNVQSVSNGDEK 417
             TGAFPVRTS+GDLYK DKRN KI++WT++YSPYYNTIDGF+EMRTLWFPNVQ+VSNGDEK
Sbjct: 361 TGAFPVRTSYGDLYK-DKRNEKIAEWTKFYSPYYNTIDGFAEMRTLWFPMVQAVSNGDEK 419

Query: 418 PADALKDFTQKANDTIKK                                           435
             P DALK FT+KAN TIKK
Sbjct: 420 PEDALKAFTEKANKTIKK                                           437
```

A related GBS gene <SEQ ID 8537> and protein <SEQ ID 8538> were also identified. Analysis of this protein sequence reveals the following:

```
Lipop: Possible site: -1 Crend: 4
McG: Discrim Score: 5.05
GvH: Signal Score (-7.5): 4.69
      Possible site: 31
>>> Seems to have a cleavable N-term signal seq.
ALOM program   count: 0   value: 7.69  threshold: 0.0
    PERIPHERAL Likelihood = 7.69   90
 modified ALOM score: -2.04
```

```
*** Reasoning Step: 3

----- Final Results -----
               bacterial outside --- Certainty = 0.3000(Affirmative) < succ>
              bacterial membrane --- Certainty = 0.0000(Not Clear) < succ>
             bacterial cytoplasm --- Certainty = 0.0000(Not Clear) < succ>
```

The protein has homology with the following sequences in the databases:

```
28.8/48.4% over 409aa
Bacillus subtilis
EGAD|107689| hypothetical protein Insert characterized
GP|2633010|emb|CAB12516.1||Z99107 similar to sugar-binding protein Insert
characterized
PIR|F69796|F69796 sugar-binidng protein homolog yesO-Insert characterized ORF01146(355-1605 of 1914)
EGAD|107689|BS0697(1-410 of 412)hypothetical protein {Bacillus
subtilis}GP|2633010|emb|CAB12516.1||Z99107 similar to sugar binding
protein{Bacillus subtilis}PIR|F69796|F69796 sugar-binding protein homolog yesO-
Bacillus subtilis
% Match = 5.4
% Identity = 28.8    % Similarity = 48.3
Matches = 69    Mismatches = 116    Conservative Sub.s = 47
318       348       378            435       465       495       525
RGIVMSIKKSVIGFCLGAAALSMFACVDSSQSVMAAEKD-KVEITWWAFPTFTQEKAKDGVGTYEKKVIKAFEKKNPNIK
            ||:    :  :       ::|  :  |  ||           |   |||: :|||||::
                  MFSGCSAGEEASGKKEDVTLRIAWW---------GGQPRHDYTTKVIELYEKKNPHVH
                  10        20                 30        40

555       585       615       645       675       705       732       762
VKLETIDFTSGPEKITTAIEAGTAPDVLFDAPGRIIQYGKNGKLADLNDLFTDQFIKDVN-NKNIIQASKSGDKAYMYPI
::  |   ::    :|:      ||   |||:       : ||||   :| ||        |      | ::  |:: :     |    :|  |  : :
IEAEFANWDDYWKKLAPMSAAGQLPDVIQMDTAYLAQYGKKNQLEDLTPYTKDGTIDVSSIDENMLSGGKIDNKLYGFTL
      60        70        80        90        100       110       120

792       822       852       882       912       942       972
SSAPFYMAFNKKMLKDAGVLKLVKEGWTTSDFEKVLKALKNKGYTPGSFFANGQGGDQGPRAFFANLYSA----------
 :  :   |: :||  |||   :  :|   ||  |:||:     |:|         |   :||       :  |   ||
GVNVLSVIANEDLLKKAGV-SINQENWTWEDYEKLAYDLQEK---AGVYGSNGM---HPPDIFFPYYLRTKGERFYKEDG
       140       150       160       170           180       190       200

990       1020      1050      1080
-------------------------------------PITDKEVTKYTTDTKNSVKSMKKIVEWIKKGYLMNGSQYDGSA~~~
                                        |:   || |    || : :   |
TGLAYQDDQL~~~~NIVEYVETASKNISKADPPEPVGSAEVIKLLKDTSDQILYQKV--------------------~~~
         350           360       370       380       390

1515      1545      1575      1605      1635      1665      1695      1725
FSEMRTLWFPMVQSVSNGDEKPADALKDFTQKANDTIKKAAK*LRRLLFYGQSHIGIEEEFLVKLRCKGEYRMRTNKLK
                                         |   |  |  |  :||||:  :::
-------------------SPEKAAKTFRKKANEILERNN
```

SEQ ID 944 (GBS16) was expressed in *E. coli* as a His-fusion product. SDS-PAGE analysis of total cell extract is shown in FIG. 3 (lane 9; MW 49 kDa).

The GBS16-His fusion product was purified (FIG. 92A; see also FIG. 189, lane 9) and used to immunise mice (lane 1+2 product; 20 µg/mouse). The resulting antiserum was used for Western blot (FIG. 92B), FACS (FIG. 92C), and in the in vivo passive protection assay (Table III). These tests confirm that the protein is immunoaccessible on GBS bacteria and that it is an effective protective immunogen.

Based on this analysis, it was predicted that these proteins and their epitopes could be useful antigens for vaccines or diagnostics.

EXAMPLE 294

A DNA sequence (GBSx0322) was identified in *S. agalactiae* <SEQ ID 947> which encodes the amino acid sequence <SEQ ID 948>. Analysis of this protein sequence reveals the following:

```
Possible site: 49
>>> Seems to have no N-terminal signal sequence

----- Final Results -----
              bacterial membrane --- Certainty = 0.0000 (Not Clear) < succ>
               bacterial outside --- Certainty = 0.0000 (Not Clear) < succ>
             bacterial cytoplasm --- Certainty = 0.0000 (Not Clear) < succ>
```

A related GBS nucleic acid sequence <SEQ ID 9459> which encodes amino acid sequence <SEQ ID 9460> was also identified.

The protein has homology with the following sequences in the GENPEPT database:

```
>GP:AAC66999 GB:AE001166 conserved hypothetical protein
[Borrelia burgdorferi]
Identities = 107/225 (47%), Positives = 147/225 (64%), Gaps = 6/225 (2%)

Query:   12 QIKNGIIVSCQALPGEPLYTESGGVMPLLALAAQEAGAVGIRANSVRDIKEIQEVTNLPI   71
            +IK G+IVSCQAL  EPL+  S  +M  +ALAA+  GA+GIRAN V DI +I+   +LPI
Sbjct:    6 KIKRGLIVSCQALENEPLH--SSFIMSKMALAAKIGGAIGIRANGVNDISQIKLEVDLPI   63

Query:   72 IGIIKREYPPQEPFITATMTEVDQLASLDIAVIALDCTLRERHDGLSVVEFIQKIKRKYP  131
            IGIIK+ Y    + FIT TM E+D+L +    +IALD T R R DG+ +F   IK+KYP
Sbjct:   64 IGIIKKNYNNCDVFITPTMKEIDELCNEGVDIIALDATFRNRPDGVLLDDFFENIKKKYP  123

Query:  132 EQLLMADISTFEEGKNAFEAGVDFVGTTLSGYTDYSR--QEEGPDIELLNKLCQAGI--D  187
            +Q LMADIS+ +E  NA + G DF+GTTL GYT +        D  L L ++
Sbjct:  124 KQCLMADISSLDEAINADKLGFDFIGTTLYGYTKNTNGLNIADNDFNFLRTLLNSNLKST  183

Query:  188 VIAEGKIHTPKQANEINHIGVAGIVVGGAITRPKEIAERFISGLS                 232
            +I EGKI TP +A +    +GV  +VVGGAITRP EI ++F+   ++
Sbjct:  184 LIVEGKIDTPLKAQKCFEMGVDLVVVGGAITRPAEITKKFVEKIN                 228
```

A related DNA sequence was identified in *S. pyogenes* <SEQ ID 949> which encodes the amino acid sequence <SEQ ID 950>. Analysis of this protein sequence reveals the following:

```
Possible site: 44
>>> Seems to have no N-terminal signal sequence
INTEGRAL   Likelihood = -1.49  Transmembrane 175-191   (175-192)

----- Final Results -----
            bacterial membrane --- Certainty = 0.1595 (Affirmative) < succ>
            bacterial outside  --- Certainty = 0.0000 (Not Clear)  < succ>
            bacterial cytoplasm --- Certainty = 0.0000 (Not Clear)  < succ>
```

The protein has homology with the following sequences in the databases:

```
>GP:AAD28762 GB:AF130859 putative N-acetylmannosamine-6-P epimerase
[Clostridium perfringens]
Identities = 113/225 (50%), Positives = 148/225 (65%), Gaps = 5/225 (2%)

Query:   10 LMEQLKGGIIVSCQALPGEPLYSETGGIMPLMAKAAQEAGAVGIRANSVRDIKEIQAITD   69
            +++ +KG +IVSCQAL  EPL+S    IM  MA AA++ GA  IRA  + DI EI+ +T
Sbjct:    1 MLDVVKGNLIVSCQALSDEPLHSSF--IMGRMAIAAKQGGAAAIRAQGIDDINEIKEVTK   58

Query:   70 LPIIGIIKKDYPPQEPFITATMTEVDQLAALNIAVIAMDCTKRDRHDGLDIASFIRQVKE  129
            LPIIGIIK++Y    E +IT TM EVD+L   +I +D TKR R +G +I    +  +
Sbjct:   59 LPIIGIIKRNYDDSEIYITPTMKEVDELLKTDCEMIGLDATKRKRPNGENIKDLVDAIHA  118

Query:  130 KYPNQLLMADISTFDEGLVAHQAGIDFVGTTLSGYTPYSRQEAGPDVALIEALCK-AGIA  188
            K  +L MADIST +EG+ A + G D V TTLSGYTPYS+Q     D  L+E L K   I
Sbjct:  119 K--GRLAMADISTLEEGIEAEKLGFDCVSTTLSGYTPYSKQSNSVDFELLEELVKTVKIP  176

Query:  189 VIAEGKIHSPEEAKKINDLGVAGIVVGGAITRPKEIAERFIEALK                233
            VI EG+I++PEE KK  DLG   VVGGAITRP++I +RF + LK
Sbjct:  177 VICEGRINTPEELKKALDLGAYSAVVGGAITRPQQITKRFTDILK                221
```

An alignment of the GAS and GBS proteins is shown below:

```
Identities = 172/227 (75%), Positives = 202/227 (88%)

Query:    5 SKEAFKKQIKNGIIVSCQALPGEPLYTESGGVMPLLALAAQEAGAVGIRANSVRDIKEIQ   64
            +KE    +Q+K  GIIVSCQALPGEPLY+E+GG+MPL A  AAQEAGAVGIRANSVRDIKEIQ
Sbjct:    6 TKEKLMEQLKGGIIVSCQALPGEPLYSETGGIMPLMAKAAQEAGAVGIRANSVRDIKEIQ   65

Query:   65 EVTNLPIIGIIKREYPPQEPFITATMTEVDQLASLDIAVIALDCTLRERHDGLSVVEFIQ  124
```

```
                +T+LPIIGIIK++YPPQEPFITATMTEVDQLA+L+IAVIA+DCT R+RHDGL +  FI+
Sbjct:   66 AITDLPIIGIIKKDYPPQEPFITATMTEVDQLAALNIAVIAMDCTKRDRHDGLDIASFIR 125

Query:  125 KIKRKYPEQLLMADISTFEEGKNAFEAGVDFVGTTLSGYTDYSRQEEGPDIELLNKLCQA 184
            ++K KYP QLLMADISTF+EG  A +AG+DFVGTTLSGYT YSRQE GPD+ L+   LC+A
Sbjct:  126 QVKEKYPNQLLMADISTFDEGLVAHQAGIDFVGTTLSGYTPYSRQEAGPDVALIEALCKA 185

Query:  185 GIDVIAEGKIHTPKQANEINHIGVAGIVVGGAITRPKEIAERFISGL             231
            GI VIAEGKIH+P++A +IN +GVAGIVVGGAITRPKEIAERFI  L
Sbjct:  186 GIAVIAEGKIHSPEEAKKINDLGVAGIVVGGAITRPKEIAERFIEAL             232
```

Based on this analysis, it was predicted that these proteins and their epitopes could be useful antigens for vaccines or diagnostics.

EXAMPLE 295

A DNA sequence (GBSx0323) was identified in *S. agalactiae* <SEQ ID 951> which encodes the amino acid sequence <SEQ ID 952>. This protein is predicted to be group B streptococcal surface immunogenic protein. Analysis of this protein sequence reveals the following:

```
Possible site: 25
>>> Seems to have a cleavable N-term signal seq.

----- Final Results -----
         bacterial outside --- Certainty = 0.3000 (Affirmative) < succ>
          bacterial membrane --- Certainty = 0.0000 (Not Clear) < succ>
          bacterial cytoplasm --- Certainty = 0.0000 (Not Clear) < succ>
```

A related DNA sequence was identified in *S. pyogenes* <SEQ ID 953> which encodes the amino acid sequence <SEQ ID 954>. Analysis of this protein sequence reveals the following:

```
Possible site: 25
>>> Seems to have a cleavable N-term signal seq.

----- Final Results -----
         bacterial outside --- Certainty = 0.3000 (Affirmative) < succ>
          bacterial membrane --- Certainty = 0.0000 (Not Clear) < succ>
          bacterial cytoplasm --- Certainty = 0.0000 (Not Clear) < succ>
```

An alignment of the GAS and GBS proteins is shown below:

```
Identities = 182/437 (41%), Positives = 240/437 (54%),
Gaps = 53/437 (12%)

Query:    1 MKMNKKVLLTSTMAASLLSVASVQAQETDTTWTARTVSEVKADLVKQDNKSSYTVKYGDT  60
            M + KK L   +++A SL+ +A+ QAQE    WT R+V+E+K++LV  DN  +YTVKYGDT
Sbjct:    1 MIITKKSLFVTSVALSLVPLATAQAQE----WTPRSVTEIKSELVLVDNVFTYTVKYGDT  56

Query:   61 LSVISEAMSIDMNVLAKINNIADINLIYPETTLTVTYDQKSHTATSMKIETPATNAAGQT 120
            LS I+EAM ID++VL  IN+IA+I+LI+P+T LT   Y+Q    AT++ ++ PA++ A  +
Sbjct:   57 LSTIAEAMGIDVHVLGDINHIANIDLIFPDTILTANYNQHGQ-ATNLTVQAPASSPASVS 115

Query:  121 TATVDLKTNQVSVADQKVSLNTISEGMTP-EAATTIVSPMKTYSSAPALKSKEVLAQEQA 179
                      Q S  Q      ++  TP +  TT  +   K SS A  S E+ +
Sbjct:  116 HVPSSEPLPQASATSQPTV--PMAPPATPSDVPTTPFASAKPDSSVTA--SSELTSSTND 171

Query:  180 VSQAAANEQVSPAPVKSITSEVPAAKEEVKPTQTSVSQSTTVSPASVAAETPAPVAKVAP 239
            VS   ++E     V      PA E    T V   T +S A  +A  P       P   +
Sbjct:  172 VSTELSSESQKQPEVPQEAVPTPKAAE-----TTEVEPKTDISEAPTSANRPVPNESASE 226

Query:  240 VRTVAAPRVASVKVVTPKVETGASPEHVSAPAVP---VTTTSPATDSKLQATEVKSVPVA 296
            +  AAP             + A  E  SAPA     TTS AT + L
Sbjct:  227 EVSSAAP-----------AQAPAEKEETSAPAAQKAVADTTSVATSNGL----------- 264

Query:  297 QKAPTATPVAQPASTTNAVAAHPENAGLQPHVAAYKEKVASTYGVNEFSTYRAGDPGDHG 356
                 AP              A +P NAGLQP  AA+KE+VAS +G+   FS YR GDPGDHG
```

```
                            -continued
Sbjct:  265  SYAPNH-------------AYNPMNAGLQPQTAAFKEEVASAFGITSFSGYRPGDPGDHG  311

Query:  357  KGLAVDFIVGTNQALGNKVAQYSTQNMAANNISYVIWQQKFYSNTNSIYGPANTWNAMPD  416
             KGLA+DF+V  N ALG++VAQY+  +MA    ISYVIW+Q+FY+   SIYGPA TWN MPD
Sbjct:  312  KGLAIDFMVPENSALGDQVAQYAIDHMAERGISYVIWKQRFYAPFASIYGPAYTWNPMPD  371

Query:  417  RGGVTANHYDHVHVSFN                                              433
             RG +T NHYDHVHVSFN
Sbjct:  372  RGSITENHYDHVHVSFN                                              388
```

A related GBS gene <SEQ ID 8539> and protein <SEQ ID 8540> were also identified. Analysis of this protein sequence reveals the following:

```
Lipop: Possible site: -1  Crend: 3
SRCFLG: 0
McG: Length of UR: 20
     Peak Value of UR: 1.96
     Net Charge of CR: 2
McG: Discrim Score: 2.95
GvH: Signal Score (-7.5): 3.84
     Possible site: 23
>>> Seems to have a cleavable N-term signal seq.
Amino Acid Composition: calculated from 24
ALOM program count: 0 value: 4.29 threshold: 0.0
PERIPHERAL    Likelihood = 4.29  58
modified ALOM score: -1.36

*** Reasoning Step: 3

Rule gpo1

----- Final Results -----
         bacterial outside --- Certainty = 0.3000 (Affirmative) < succ>
          bacterial membrane --- Certainty = 0.0000 (Not Clear) < succ>
           bacterial cytoplasm --- Certainty = 0.0000 (Not Clear) < succ>
```

Figure 267:
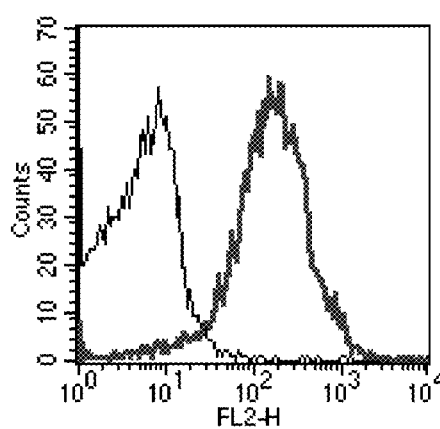

SEQ ID 8540 (GBS322) was expressed in *E. coli* as a His-fusion product. SDS-PAGE analysis of total cell extract is shown in FIG. 77 (lane 9; MW 52 kDa). The GBS322-His fusion product was purified (FIG. 214, lane 10) and used to immunise mice. The resulting antiserum was used for FACS (FIG. 267), which confirmed that the protein is immunoaccessible on GBS bacteria.

Based on this analysis, it was predicted that these proteins and their epitopes could be useful antigens for vaccines or diagnostics.

EXAMPLE 296

A DNA sequence (GBSx0324) was identified in *S. agalactiae* <SEQ ID 955> which encodes the amino acid sequence <SEQ ID 956>. Analysis of this protein sequence reveals the following:

```
Possible site: 23
>>> Seems to have an uncleavable N-term signal seq
INTEGRAL    Likelihood = -1.86     Transmembrane 5-21 (4-21)

----- Final Results -----
         bacterial membrane --- Certainty = 0.1744 (Affirmative) <succ>
          bacterial outside --- Certainty = 0.0000 (Not Clear)   <succ>
         bacterial cytoplasm --- Certainty = 0.0000 (Not Clear)   <succ>
```

The protein has homology with the following sequences in the GENPEPT database:

```
>GP:AAC46072 GB:U50357 zoocin A endopeptidase [Streptococcus
zooepidemicus]
Identities = 163/274 (59%), Positives = 196/274 (71%), Gaps = 11/274 (4%)
```

-continued

```
Query:   25 VLADTYVRPIDNGRITTGFNGYPGHCGVDYAVPTGTIIRAVADGTVKFAGAGANFSWMTD   84
            V A TY RP+D G ITTGFNGYPGH GVDYAVP GT +RAVA+GTVKFAG GAN  WM
Sbjct:   21 VSAATYTRPLDTGNITTGFNGYPGHVGVDYAVPVGTPVRAVANGTVKFAGNGANHPWMLW   80

Query:   85 LAGNCVMIQHADGMHSGYAHMSRVVARTGEKVKQGDIIGYVGATGMATGPHLHFEFLPAN  144
            +AGNCV+IQHADGMH+GYAH+S++    T   VKQG IIGY GATG  TGPHLHFE LPAN
Sbjct:   81 MAGNCVLIQHADGMHTGYAHLSKISVSTDSTVKQGQIIGYTGATGQVTGPHLHFEMLPAN  140

Query:  145 PNFQNGFHGRINPTSLIANVATFSGKTQASAPSIKPLQSAPVQNQSSKLKVYRVDELQKV  204
            PN+QNGF GRI+PT IAN  F+G T         + P N    LK+Y+VD+LQK+
Sbjct:  141 PNWQNGFSGRIDPTGYIANAPVFNGTTPTE-------PTTPTTN----LKIYKVDDLQKI  189

Query:  205 NGVWLVKNNTLTPTGFDWNDNGIPASEIDEVDANGNLTADQVLQKGGYFIFNPKTLKTVE  264
            NG+W V+NN L PT F W DNGI A ++ EV +NG  T+DQVLQKGGYF+ NP  +K+V
Sbjct:  190 NGIWQVRNNILVPTDFTWVDNGIAADDVIEVTSNGTRTSDQVLQKGGYFVINPNNVKSVG  249

Query:  265 KPIQGTAGLTWAKTRFANGSSVWLRVDNSQELLY                          298
            P++G+ GL+WA+  F  G +VWL  +   LLY
Sbjct:  250 TPMKGSGGLSWAQVNFTTGGNVWLNTTSKDNLLY                          283
```

No corresponding DNA sequence was identified in *S. pyogenes*.

A related GBS gene <SEQ ID 8541> and protein <SEQ ID 8542> were also identified. Analysis of this protein sequence reveals the following:

```
Lipop:       Possible site: -1              Crend: 6
McG:         Discrim Score: 6.63
GvH:         Signal Score (-7.5): -2.97
Possible site: 23
>>> Seems to have an uncleavable N-term signal seq
ALOM program count: 1 value: -1.86 threshold: 0.0
INTEGRAL     Likelihood = -1.86   Transmembrane 5-21 (4-21)
PERIPHERAL   Likelihood =  5.57   50
modified ALOM score: 0.87

*** Reasoning Step: 3

----- Final Results -----
            bacterial membrane --- Certainty = 0.1744 (Affirmative) <succ>
            bacterial outside  --- Certainty = 0.0000 (Not Clear)   <succ>
            bacterial cytoplasm --- Certainty = 0.0000 (Not Clear)  <succ>
```

The protein has homology with the following sequences in the databases:

```
GP|2804351|gb|AAC46072.1||U50357(21-283 of 285)zoocin A endopeptidase
{Streptococcus zooepidemicus}
% Match = 34.2
% Identity = 61.3    % Similarity = 74.4
Matches = 163   Mismatches = 65   Conservative Sub.s = 35
144       174       204       234       264       294       324       354
VV*VFLS*LRYTTYILKTFLFIKPPKYSSR*VLFLIF*FKFSNKLIASV*ALHYINSIWRFFLNKWLVKASSLVVLGGMV MKRIFFAFLSLCLF
                                                                       10
384       414       444       474       504       534       564       594
LSAGSRVLADTYVRPODNGRITTGFNGYPGHCGVDYAVPTGTIIRAVADGTVKFAGAGANFSWMTDLAGNCVMIQHADGM
:    |  | || ||:|   |||||||||||| |||||||| ||: ||||||||||| ||  :||||||||
IFGTQTVSAATYTRPLDTGNITTGFNGYPGHVGVDYAVPVGTPVRAVANGTVKFAGNGANHPWMLWMAGNCVLIQHADGM
             30        40        50        60        70        80        90

624       654       684       714       744       774       804       834
HSGYAHMSRVVARTGEKVKQGDIIGYVGATGMATGPHLHFEFLPANPNFQNGFHGRINPTSLIANVATFSGKTQASAPSI
|:||||:|::    |   |||| |||| |||| ||||||||| ||||  |||  ||| ||| |||    ||  |  |
HTGYAHLSKISVSTDSTVKQGQIIGYTGATGQVTGPHLHFEMLPANPNWQNGFSGRIDPTGYIANAPVFNGTT-------
         110       120       130       140       150       160

864       894       924       954       984       1014      1044      1074
KPLQSAPVQNQSSKLKVYRVDELQKVNGVWLVKNNTLTPTGFDWNDNGIPASEIDEVDANGNLTADQVLQKGGYFIFNPK
|  :|    ::  ||:|||:||:||| |:|  | | ::| ::|:|||| |::  ||| :||  |:||||||||| :|||
-P--TEP-TTPTTNLKIYKVDDLQKINGIWQVRNNILVPTDFTWVDNGIAADDVIEVTSNGTRTSDQVLQKGGYFVINPN
        180       190       200       210       220       230       230

1104      1134      1164      1194      1224      1254      1284      1314
TLKTVEKPIQGTAGLTWAKTRFANGSSVWLRVDNSQELLYK*FEVLIHCFK*QLCY*LSTISLNRLKIIL*SSKV*YYSL
:|:|    |::|:   ||:|||     ||  :     :|||
NVKSVGTPMKGSGGLSWAQVNFTTGGNVWLNTTSKDNLLYGK
         260       270       280
```

SEQ ID 8542 (GBS36) was expressed in *E. coli* as a His-fusion product. SDS-PAGE analysis of total cell extract is shown in FIG. 11 (lane 4; MW 34.1 kDa).

Figure 192:
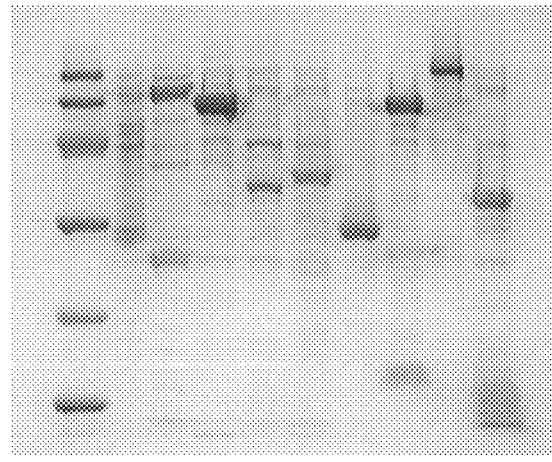

GBS36-His was purified as shown in FIG. 192, lane 7.

Based on this analysis, it was predicted that these proteins and their epitopes could be useful antigens for vaccines or diagnostics.

EXAMPLE 297

A DNA sequence (GBSx0325) was identified in *S. agalactiae* <SEQ ID 957> which encodes the amino acid sequence <SEQ ID 958>. This protein is predicted to be phosphoribosylaminoimidazolecarboxamide formyltransferase/IMP cyclohyd. Analysis of this protein sequence reveals the following:

```
Possible site: 48
>>> Seems to have no N-terminal signal sequence

----- Final Results -----
             bacterial cytoplasm --- Certainty = 0.2815(Affirmative) < succ>
             bacterial membrane  --- Certainty = 0.0000(Not Clear)   < succ>
              bacterial outside  --- Certainty = 0.0000(Not Clear)   < succ>
```

The protein has homology with the following sequences in the GENPEPT database:

```
>GP:BAB04352 GB:AP001509 phosphoribosylaminoimidazolecarboxamide
             formyltransferase/IMP cyclohydrolase [Bacillus halodurans]
 Identities = 310/515 (60%), Positives = 390/515 (75%), Gaps = 4/515 (0%)

Query:   1  MTKRALISVSDKSGIIDFAKELKNLGWDIISTGGTKVALDDAGVETIAIDDVTGFPEMMD   60
            M +RAL+SVS+K GI+ FAK L    +I+STGGTK AL +AG+    I DVTGFPE++D
Sbjct:   1  MKRRALVSVSNREGIVPFAKALVEHEVEIVSTGGTKRALQEAGIPVTGISDVTGFPEILD   60

Query:  61  GRVKTLHPNIHGGLLARRDADSHLQAAKDNNIELIDLVVVNLYPFKETILRPDVTYDLAV  120
            GRVKTLHPNIHGGLLA R+ D HL    +++I  ID VVVNLYPF++TI +P+ T+  A+
Sbjct:  61  GRVKTLHPNIHGGLLAMRERDEHLAQLNEHHIRPIDFVVVNLYPFQQTIAKPEATFADAI  120

Query: 121  ENIDIGGPSMLRSAAKNHASVTVVVDSADYATVLGELADASQTTFKTRQRLAAKAFRHTA  180
            ENIDIGGPSMLR+AAKNH  VTVVVD  DY TVL ELAD      +T++RLAAK FRHTA
Sbjct: 121  ENIDIGGPSMLRAAAKNHQHVTVVVDPVDYETVLKELADQGMVATETKRRLAAKVFRHTA  180

Query: 181  AYDALIAEYFTAQVGEAKPEKLTITYDLKQAMRYGENPQQDADFYQKALPTDYSIASAKQ  240
            AYDA+IAEY T  VGE  PE LT+T++ KQ +RYGENP Q A FYQE L    SIA AKQ
Sbjct: 181  AYDAMIAEYLTDAVGEESPESLTVTFE-KQDLRYGENPHQKATFYQKPLGAKASIAHAKQ  240

Query: 241  LNGKELSFNNIRDADAAIRIIRDFKDSPTVVALKHMNPCGIGQADDIETAWDYAYEADPV  300
            L+GKELS+NNI DADAA+I+++FK+ P  VA+KHMNPCG+G  + I+ A+D AYEADPV
Sbjct: 241  LHGKELSYNNINDADAALSIVKEFKE-PAAVAVKHMNPCGVGTGETIKEAFDRAYEADPV  299

Query: 301  SIFGGIVVLNREVDAATAEKMHPIFLEIIIAPSYSEEALAILTNKKKNLRILELPFDAQA  360
            SIFGGI+LNREVD  TA+   + IFLEIIIAPS+SEEAL +LT+ KKNLR+L LP + +
Sbjct: 300  SIFGGIIALNREVDVETAKTLKEIFLEIIIAPSFSEEALDVLTS-KKNLRLLTLPLNEE-  357

Query: 361  ASEVEAEYTGVVGGLLVQNQDVVAENPSDWQVVTDRQPTEQEATALEFAWKAIKYVKSNG  420
            ++ E    T + GG LVQ +D    ++ ++ T R+PTE E   AL+ AW+ +K+VKSN
Sbjct: 358  -NQAEKRITSIHGGALVQEEDTYGFEEAEIKIPTKREPTEAEWEALKLAWRVVKHVRSNA  416

Query: 421  IIITNDHMTLGLGAGQTMRVGSVKIAIEQAKDHLDGAVLASDAFFPFADNIEEIAAAGIK  480
            I++ +   MT+G+GAGQ NRVG+ KIAIEQA +   G+V+ SDAFFP   D +E   AGI
Sbjct: 417  IVLADGQMTVGVGAGQMNRVGAAKIAIEQAGEKAAGSVMGSDAFFPMGDTVELAAKAGIT  476

Query: 481  AIIQPGGSVRDQESIDAANKHGLTMIFTGVRHFRH                          515
            AIIQPGGS+RD+ESI+ A+KHG+ M+FTGVRHF+H
Sbjct: 477  AIIQPGGSIRDEESIENADKHGIAMVFTGVRHFKH                          511
```

A related DNA sequence was identified in *S. pyogenes* <SEQ ID 959> which encodes the amino acid sequence <SEQ ID 960>. Analysis of this protein sequence reveals the following:

```
Possible site: 48
>>> Seems to have no N-terminal signal sequence

----- Final Results -----
              bacterial cytoplasm --- Certainty = 0.2932(Affirmative) < succ>
               bacterial membrane --- Certainty = 0.0000(Not Clear)   < succ>
                 bacterial outside --- Certainty = 0.0000(Not Clear)   < succ>
```

An alignment of the GAS and GBS proteins is shown below:

```
 Identities = 500/515 (97%), Positives = 507/515 (98%)

Query:   1  MTKRALISVSDKSGIIDFAKELKNLGWDIISTGGTKVALDDAGVETIAIDDVTGFPEMMD   60
             MTKRALISVSDKSGI+DFAKELKNLGWDIISTGGTKV LDDAGVETIAIDDVT FPEMMD
 Sbjct:   1  MTKRALISVSDKSGIVDFAKELKNLGWDIISTGGTKVTLDDAGVETIAIDDVTRFPEMMD   60

Query:  61  GRVKTLHPNIHGGLLARRDADSHLQAAKDNNIELIDLVVVNLYPFKETILRPDVTYDLAV  120
             GRVKTLHPNIHGGLLARRDADSHLQAAKDNNIELIDLVVVNLYPFKETILRPD+TYDLAV
 Sbjct:  61  GRVKTLHPNIHGGLLARRDADSHLQAAKDNNIELIDLVVVNLYPFKETILRPDITYDLAV  120

Query: 121  ENIDIGGPSMLRSAAKNHASVTVVVDSADYATVLGELADASQTTFKTRQRLAAKAFRHTA  180
             ENIDIGGPS+LRSAAKNHASVTVVVD ADYATVLGELADA QTTF+TRQRLAAK FRHTA
 Sbjct: 121  ENIDIGGPSMLRSAAKNHASVTVVVDPADYATVLGELADAGQTTFETRQRLAAKVFRHTA  180

Query: 181  AYDALIAEYFTAQVGEAKPEKLTITYDLKQAMRYGENPQQDADFYQKALPTDYSIASAKQ  240
             AYDALIAEYFT QVGEAKPEKLTITYDLKQAMRYGENPQQDADFYQKALPTDYSIASAKQ
 Sbjct: 181  AYDALIAEYFTTQVGEAKPEKLTITYDLKQAMRYGENPQQOADFYQKALPTDYSIASAKQ  240

Query: 241  LNGKELSFNNIRDADAAIRIIRDFKDSPTVVALKHMNPCGIGQADDIETAWDYAYEADPV  300
             LNGKELSFNNIRDADAAIRIIRDFKD PTVVALKHMNPCGIGQADDIETAWDY Y+ADPV
 Sbjct: 241  LNGKELSFNNIRDADAAIRIIRDFKDRPTVVALKHMNPCGIGQADDIETAWDYTYKADPV  300

Query: 301  SIFGGIVVLNREVDAATAEKMHPIFLEIIIAPSYSEEALAILTNKKKNLRILELPFDAQA  360
             SIFGGI+VLNREVDAATA+KMHPIFLEIIIAPSYSEEALAILTNKKKNLRILELPFDAQA
 Sbjct: 301  SIFGGIIVLNREVDAATAKKMHPIFLEIIIAPSYSEEALAILTNKKKNLRILELPFDAQA  360

Query: 361  ASEVEAEYTGVVGGLLVQNQDVVAENPSDWQVVTDRQPTEQEATALEFAWKAIKYVKSNG  420
             ASEVEAEYTGVVGGLLVQNQDVVAENPSDWQVVTDRQPTEQEATALEFAWKAIKYVKSNG
 Sbjct: 361  ASEVEAEYTGVVGGLLVQNQDVVAENPSDWQVVTDRQPTEQEATALEFAWKAIKYVKSNG  420

Query: 421  IIITNDHMTLGLGAGQTNRVGSVKIAIEQAKDHLDGAVLASDAFFPFADNIEEIAAAGIK  480
             IIITNDHMTLGLGAGQTNRVGSVKIAIEQAKDHLDGAVLASDAFFPFADNIEEIAAAGIK
 Sbjct: 421  IIITNDHMTLGLGAGQTNRVGSVKIAIEQAKDHLDGAVLASDAFFPFADNIEEIAAAGIK  480

Query: 481  AIIQPGGSVRDQESIDAANKHGLTMIFTGVRHFRH                          515
             AIIQPGGSVRDQ+SIDAANKHGLTMIFTGVRHFRH
 Sbjct: 481  AIIQPGGSVRDQDSIDAANKHGLTMIFTGVRHFRH                          515
```

Based on this analysis, it was predicted that these proteins and their epitopes could be useful antigens for vaccines or diagnostics.

EXAMPLE 298

A DNA sequence (GBSx0326) was identified in *S. agalactiae* <SEQ ID 961> which encodes the amino acid sequence <SEQ ID 962>. This protein is predicted to be similar to antibiotic resistance protein. Analysis of this protein sequence reveals the following:

```
Possible site: 46
>>> Seems to have no N-terminal signal sequence

----- Final Results -----
              bacterial cytoplasm --- Certainty = 0.1842(Affirmative) < succ>
               bacterial membrane --- Certainty = 0.0000(Not Clear)   < succ>
                 bacterial outside --- Certainty = 0.0000(Not Clear)   < succ>
```

The protein has homology with the following sequences in the GENPEPT database:

```
>GP: CAB12342 GB: Z99106 similar to antibiotic resistance protein
[Bacillus subtilis]
Identities = 65/263 (24%), Positives = 117/263 (43%), Gaps = 34/263 (12%)

Query:    5 KNLEIVESIFGD-WDETIIWSCV-QGIMGEVFVDSLDQPKSSLAKLGRKSSFGFLAGQPT   62
            K    ++++F D +   T ++S + Q I G V+ D    PKS    +G +S    F+AG
Sbjct:   10 KKYSSLKTMFDDKYCPTFVYSILDQTIPGAVYADDQTFPKSFF--IGTESGIYFIAGDQG   67

Query:   63 ----------LFLLEVCSGEDIILVPQHKGWSDLIESTYGQNAHSFKRYATKKDTLFERS  112
                       +  +V S +   L       W  +++    + +   +R A         +
Sbjct:   68 NRDFHDFIAGYYEEQVKSSKRFTLFSSSDTWDSVLKPILKDDLNQMRRAAFSY-----QP  122

Query:  113 RLEKFVTQLPNGFELRAIDEKV------YNSCLEKEWSQDLVANYATYQYYKKQGIGYVV  166
              +  K    QLP G  L+ IDE +         +NS     +E+      + +    +G G+ V
Sbjct:  123 KSFKKTLQLPKGLVLKRIDEDIISHSTAFNSAYYEEY-------WNSVSQFASKGFGFAV  175

Query:  167 YYQGNIIAGASSYSTYKNGIEIEVDTHPDFRRRGLATIVAAQLILTCLDKGIYPSWDAH-  225
              +  ++++  +S        N    E+++ T  ++R   GLA   VA + I   C++ GI PSWD
Sbjct:  176 LHGNHVVSECTSIFLGHNRAEMDIYTLEEYRGLGLAYCVANRFIAFCMENGIVPSWDCDI  235

Query:  226 -TRTSLNLSEKLGYEFSHEYIAY                                      247
              +S+ L+  KLG++     EY  Y
Sbjct:  236 CNNSSIALAAKLGFKTVTEYTIY                                      258
```

No corresponding DNA sequence was identified in *S. pyogenes*.

Based on this analysis, it was predicted that this protein and its epitopes, could be useful antigens for vaccines or diagnostics.

EXAMPLE 299

A DNA sequence (GBSx0328) was identified in *S. agalactiae* <SEQ ID 963> which encodes the amino acid sequence <SEQ ID 964>. This protein is predicted to be phosphoribosylglycinamide formyltransferase homolog (purN). Analysis of this protein sequence reveals the following:

```
Possible site: 48
>>> Seems to have no N-terminal signal sequence

----- Final Results -----
           bacterial cytoplasm --- Certainty = 0.0736(Affirmative) < succ>
           bacterial membrane  --- Certainty = 0.0000(Not Clear)   < succ>
            bacterial outside  --- Certainty = 0.0000(Not Clear)   < succ>
```

A related DNA sequence was identified in *S. pyogenes* <SEQ ID 965> which encodes the amino acid sequence <SEQ ID 966>. Analysis of this protein sequence reveals the following:

```
Possible site: 48
>>> Seems to have no N-terminal signal sequence
     INTEGRAL    Likelihood = -0.53      Transmembrane     75-91 (75-91)

----- Final Results -----
           bacterial membrane  --- Certainty = 0.1213(Affirmative) < succ>
            bacterial outside  --- Certainty = 0.0000(Not Clear)   < succ>
           bacterial cytoplasm --- Certainty = 0.0000(Not Clear)   < succ>
```

The protein has homology with the following sequences in the databases:

```
>GP: CAA04374 GB: AJ000883 purD [Lactococcus lactis]
Identities = 236/419 (56%), Positives = 301/419 (71%), Gaps = 7/419 (1%)

Query:   50 LKLLVVGSGGREHAIAKKLLASKGVDQVFVAPGNDGMTLDGLDLVNIVVSEHSRLIAFAK  109
            +K+LV+GSGGREHA+AKK + S  V++VFVAPGN GM  DG+ +V+I     + +L+ FA+
Sbjct:    1 MKILVIGSGGREHALAKKFMESPQVEEVFVAPGNSGMEKDGIQIVHISELSNDKLVKFAQ   60

Query:  110 ENEISWAFIGPDDALAAGIVDDFNSAGLRAFGPTKAAAELEWSKDFAKEIMVKYNVPTAA  169
              I    F+GP+  AL    G+VD F   A L   FGP K AAELE SKDFAK IM KY VPTA
```

-continued
```
Sbjct:   61 NQNIGLTFVGPETALMNGVVDAFIKAELPIFGPNKMAAELEGSKDFAKSIMKKYGVPTAD  120

Query:  170 YGTFSDFEKAKAYIEEQGAPIVVKADGLALGKGVVVAETVEQAVEAAQEMLLDNKFGDSG  229
            Y TF   E A AY++E+G P+V+KADGLA GKGV VA  +E A  A  ++      F  S
Sbjct:  121 YATFDSLEPALAYLDEKGVPLVIKADGLAAGKGVTVAFDIETAKSALADI-----FSGSQ  175

Query:  230 ARVVIEEFLDGEEFSLFAFANGDKFYIMPTAQDHKRAFDGDKGPNTGGMGAYAPVPHLPQ  289
              +VVIEEFLDGEEFSLF+F  +   K Y MP AQDHKRAFD DKGPNTGGMGAY+PV H+ +
Sbjct:  176 GKVVIEEFLDGEEFSLFSFIHDGKIYPMPIAQDHKRAFDEDKGPNTGGMGAYSPVLHISK  235

Query:  290 SVVDTAVEMIVRPVLEGMVAEGRPYLGVLYVGLILTADGPKVIEFNSRFGDPETQIILPR  349
             VV+ A+E +V+P + GM+ EG+ + GVLY GLILT DG K IEFN+RFGDPETQ++LPR
Sbjct:  236 EVVNEALEKVVKPTVAGMIEEGKSFTGVLYAGLILTEDGVKTIEFNARFGDPETQVVLPR  295

Query:  350 LTSDFAQNIDDIMMGIEPYITWQKDGVTLGVVVASEGYPFDYEKGVPLPEKTDGDIITYY  409
            L SD AQ I DI+ G EP + W + GVTLGVVVA+EGYP    + G+ LPE  +G +  YY
Sbjct:  296 LKSDLAQAIIDILAGNEPTLEWLESGVTLGVVVAAEGYPSQAKLGLILPEIPEG-LNVYY  354

Query:  410 AGVKFSENSELLLSNGGRVYMLVTTEDSVKAGQDKIYTQLAQQDTTGLFYRNDIGSKAI  468
            AGV   +EN++ L+S+GGRVY++    T + VK+ Q  +Y +L + +   G FYR+DIGS+AI
Sbjct:  355 AGVSKNENNQ-LISSGGRVYLVSETGEDVKSTQKLLYEKLDKLENDGFFYRHDIGSRAI  412
```

An alignment of the GAS and GBS proteins is shown below:

Identities = 172/182 (94%), Positives = 176/182 (96%)

```
Query:    1 MKIAVFASGNGSNFQVIAEQFQVSFVFSDHRDAYVLERAQNLAIPSFAFELKEFENKAAY   60
            MKIAVFASGNGSNFQVIAEQF VSFVFSDHRDAYVLERAQNLAIPSFAFELKEFENK AY
Sbjct:    1 MKIAVFASGNGSNFQVIAEQFPVSFVFSDHRDAYVLERAQNLAIPSFAFELKEFENKVAY   60

Query:   61 EQAVVDLLDKHEIDLVCLAGYMKIVGETLLSAYEGRIINIHPTYLPEFPGAHGIKDAWEA  120
            EQA+VDLLDKHEIDLVCLAGYMKIVGETLL AYE RIINIHP YLPEFPGAHGI+DAWEA
Sbjct:   61 EQAIVDLLDKHEIDLVCLAGYMKIVGETLLLAYERRIINIHPAYLPEFPGAHGIEDAWEA  120

Query:  121 GVDQSGVTIHWVDSGVDTGQVIQQVHVPRLADDSLESFETRIHETEYQLYPAVLDSLGIK  180
            GVDQSGVTIHWVDSGVDTGQVIQQV VPRLADDSLESFETRIHETEYQLYPAVLDSLG++
Sbjct:  121 GVDQSGVTIHWVDSGVDTGQVIQQVRVPRLADDSLESFETRIHETEYQLYPAVLDSLGVE  180

Query:  181 RK                                                          182
            RK
Sbjct:  181 RK                                                          182
```

Based on this analysis, it was predicted that these proteins and their epitopes could be useful antigens for vaccines or diagnostics.

EXAMPLE 300

A DNA sequence (GBSx0329) was identified in *S. agalactiae* <SEQ ID 967> which encodes the amino acid sequence <SEQ ID 968>. Analysis of this protein sequence reveals the following:

```
Possible site: 52
>>> Seems to have no N-terminal signal sequence
    INTEGRAL    Likelihood = -0.59    Transmembrane    121-137 (121-137)

----- Final Results -----
           bacterial membrane --- Certainty = 0.1235(Affirmative) < succ>
            bacterial outside --- Certainty = 0.0000(Not Clear) < succ>
          bacterial cytoplasm --- Certainty = 0.0000(Not Clear) < succ>
```

The protein has homology with the following sequences in the GENPEPT database:

```
>GP: AAC16901 GB: AF016634 phosphoribosylformylglycinamide
cyclo-ligase [Lactococcus lactis subsp. cremoris]
Identities = 253/338 (74%), Positives = 288/338 (84%), Gaps = 4/338 (1%)

Query:    4 KNAYAQSGVDVEAGYEVVERIKKHVARTERAGVMGALGGFGGMFDLSQTGVKEPVLISGT   63
            +NAYA+SGVDVEAGYEVV RIKKHVA+TER GV+GALGGFGG FDLS   VKEPVLISGT
```

```
                            -continued
Sbjct:    5 ENAYAKSGVDVEAGYEVVSRIKKHVAKTERLGVLGALGGFGGSFDLSVLDVKEPVLISGT    64

Query:   64 DGVGTKLMLAIKYDKHDTIGQDCVAMCVNDIIAAGAEPLYFLDYVATGKNEPAKLEQVVA   123
            DGVGTKLMLAI+ DKHDTIG DCVAMCVNDIIAAGAEPLYFLDY+ATGKN P KLEQVVA
Sbjct:   65 DGVGTKLMLAIRADKHDTIGIDCVAMCVNDIIAAGAEPLYFLDYIATGKNIPEKLEQVVA   124

Query:  124 GVAEGCVQASAALIGGETAEMPGMYGEDDYDLAGFAVGVAEKSQIIDGSK-VKEGDILLG   182
            GVAEGC+QA AALIGGETAEMPGMY EDDYDLAGFAVGVAEKSQ+IDG K V+ GD+LLG
Sbjct:  125 GVAEGCLQAGAALIGGETAEMPGMYDEDDYDLAGFAVGVAEKSQLIDGEKDVEAGDVLLG   184

Query:  183 LASSGIHSNGYSLVRRVFADYTGDEVLPELEGKQLKDVLLEPTRIYVKAALPLIKEELVN   242
            LASSGIHSNGYSLVR+VFAD+  +E LPEL+ + L D LL PT+IYVK  LPLIK+  +
Sbjct:  185 LASSGIHSNGYSLVRKVFADFDLNESLPELD-QSLIDTLLTPTKIYVKELLPLIKQNKIK   243

Query:  243 GIAHITGGGFIENVPRMFADDLAAEIDEDKVPVLPIFKALEKYGDIKHEEMFEIFNMGVG   302
            GIAHITGGGF EN+PRMF + L+AEI E    VLPIFKALEKYG IKHEEM+EIFNMG+G
Sbjct:  244 GIAHITGGGFHENLPRMFGNSLSAEIVEGSWDVLPIFKALEKYGSIKHEEMYEIFNMGIG   303

Query:  303 LMLDVNPENVDRVKELLDEPVYEIGRIIKKADDSVVIK                        340
            +++ V PEN   +K+ L+   +EIG+++ + +  VVIK
Sbjct:  304 MVIAVAPENAAALKKELN--AFEIGQMVNRQEAPVVIK                        339
```

A related DNA sequence was identified in S. *pyogenes* <SEQ ID 969> which encodes the amino acid sequence <SEQ ID 970>. Analysis of this protein sequence reveals the following:

```
Possible site: 38
>>> Seems to have no N-terminal signal sequence

----- Final Results -----
         bacterial cytoplasm --- Certainty = 0.3236(Affirmative) < succ>
         bacterial membrane  --- Certainty = 0.0000(Not Clear)   < succ>
          bacterial outside  --- Certainty = 0.0000(Not Clear)   < succ>
```

An alignment of the GAS and GBS proteins is shown below:

```
Identities = 321/340 (94%), Positives = 332/340 (97%)

Query:    1 MSEKNAYAQSGVDVEAGYEVVERIKKHVARTERAGVMGALGGFGGMFDLSQTGVKEPVLI    60
            MSEKNAYA+SGVDVEAGYEVVERIKKHVARTERAGVMGALGGFGGMFDLS+TGVKEPVL+
Sbjct:    1 MSEKNAYAKSGVDVEAGYEVVERIKKHVARTERAGVMGALGGFGGMFDLSKTGVKEPVLV    60

Query:   61 SGTDGVGTKLMLAIKYDKHDTIGQDCVAMCVNDIIAAGAEPLYFLDYVATGKNEPAKLEQ   120
            SGTDGVGTKLMLAIKYDKHDTIGQDCVAMCVNDIIAAGAEPLYFLDY+ATGKN P KLE+
Sbjct:   61 SGTDGVGTKLMLAIKYDKHDTIGQDCVAMCVNDIIAAGAEPLYFLDYIATGKNNPVKLEE   120

Query:  121 VVAGVAEGCVQASAALIGGETAEMPGMYGEDDYDLAGFAVGVAEKSQIIDGSKVKEGDIL   180
            VV+GVAEGCVQA AALIGGETAEMPGMYG+DDYDLAGFAVGVAEKSQIIDGSKVKEGDIL
Sbjct:  121 VVSGVAEGCVQAGAALIGGETAEMPGMYGQDDYDLAGFAVGVAEKSQIIDGSKVKEGDIL   180

Query:  181 LGLASSGIHSNGYSLVRRVFADYTGDEVLPELEGKQLKDVLLEPTRIYVKAALPLIKEEL   240
            LGLASSGIHSNGYSLVRRVFADYTG E+LPELEGKQLKDVLLEPTRIYVKAALPLIKEEL
Sbjct:  181 LGLASSGIHSNGYSLVRRVFADYTGKELLPELEGKQLKDVLLEPTRIYVKAALPLIKEEL   240

Query:  241 VNGIAHITGGGFIENVPRMFADDLAAEIDEDKVPVLPIFKALEKYGDIKHEEMFEIFNMG   300
            V GI HITGGGFIEN+PRMFADDLAAEIDEDKVPVLPIFKALEKYGDIKHEEMFEIFNMG
Sbjct:  241 VKGIGHITGGGFIENIPRMFADDLAAEIDEDKVPVLPIFKALEKYGDIKHEEMFEIFNMG   300

Query:  301 VGLMLDVNPENVDRVKELLDEPVYEIGRIIKKADDSVVIK                      340
            VGLML V+PENV+RVKELLDEPVYEIGRIIKKAD SVVIK
Sbjct:  301 VGLMLAVSPENVNRVKELLDEPVYEIGRIIKKADASVVIK                      340
```

Based on this analysis, it was predicted that these proteins and their epitopes could be useful antigens for vaccines or diagnostics.

EXAMPLE 301

A DNA sequence (GBSx0330) was identified in S. *agalactiae* <SEQ ID 971> which encodes the amino acid sequence <SEQ ID 972>. This protein is predicted to be phosphoribosylpyrophosphate amidotransferase (purF). Analysis of this protein sequence reveals the following:

```
Possible site: 25
>>> Seems to have no N-terminal signal sequence

----- Final Results -----
            bacterial cytoplasm --- Certainty = 0.1112(Affirmative) < succ>
             bacterial membrane --- Certainty = 0.0000(Not Clear)   < succ>
              bacterial outside --- Certainty = 0.0000(Not Clear)   < succ>
```

The protein has homology with the following sequences in the GENPEPT database:

```
>GP: AAD12627 GB: U64311 phosphoribosylpyrophosphate amidotransferase
[Lactococcus lactis]
Identities = 340/470 (72%), Positives = 404/470 (85%), Gaps = 6/470 (1%)

Query:   3 YEVKSLNEECGVFGIWGYPQAAQVTYFGLHSLQHRGQEGAGIISNDNGKLYGYRNVGLLS   62
           +E K+LNEECG+FG+WG+P AA++TYFGLH+LQHRGQEGAGIL N+NGKL  +R +GL++
Sbjct:  37 FEAKTLNEECGLFGVWGHPDAARLTYFGLHALQHRGQEGAGILVNNNGKLNRHRGLGLVT   96

Query:  63 EVFKNQSELDNLTGNAAIGHVRYATAGSADIRNIQPFLYKFHDGQFALCHNGNLTNAISS  122
           EVF+++ +L+ LTG++AIGHVRYATAGSA+I NIQPF ++FHDG   L HNGNLTNA S
Sbjct:  97 EVFRHEKDLEELTGSSAIGHVRYATAGSANINNIQPFQFEFHDGSLGLAHNGNLTNAQSL 156

Query: 123 RKELEKQGAIFNASSDTEILMHLIRRSHNPSFMGKVKEALSTVKGGFAYLLMTEDKLIAA  182
           R ELEK GAIF+++SDTEILMHLIRRSH+P FMG+VKEAL TVKGGFAYL+MTE+ ++AA
Sbjct: 157 RCELEKSGAIFSSNSDTEILMHLIRRSHHPEFMGRVKEALNTVKGGFAYLIMTENSIVAA 216

Query: 183 LDPNAFRPLSIGQMQNGAWVISSETCAFEVVGAKWVRDVEPGEVILIDDSGIQCDRYTDE  242
           LDPN FRPLSIG+M NGA V++SETCAF+VVGA W++DV+PGE+I I+D GI   D++TD
Sbjct: 217 LDPNGFRPLSIGKMSNGALVVASETCAFDVVGATWIQDVQPGEIIEINDDGIHVDQFTDS 276

Query: 243 TQLAICSMEYVYFARPDSTIHGVNVHTARKNMGKRLAQEFKQDADIVIGVPNSSLSAAMG  302
           T + ICSMEY+YFARPDS I GVNVHTARK  GK LAQE K DADIVIGVPNSSLSAA G
Sbjct: 277 TNMTICSMEYIYFARPDSNIAGVNVHTARKRSGKILAQEAKIDADIVIGVPNSSLSAASG 336

Query: 303 FAEESGLPNEMGLVKNQYTQRTFIQPTQELREQGVRMKLSAVSGVVKGKRVVMIDDSIVR  362
           +AEESGLP EMGL+KNQY  RTFIQPTQELREQGVRMKLSAV GVV+GKRV+M+DDSIVR
Sbjct: 337 YAEESGLPYEMGLIKNQYVARTFIQPTQELREQGVRMKLSAVRGVVEGKRVIMVDDSIVR 396

Query: 363 GTTSRRIVGLLREAGATEVHVAIASPELKYPCFYGIDIQTRRELISANHAVDEVCDIIGA  422
           GTTSRRIV LL++AGA EVHVAIASP LKYPCFYGIDIQ R ELI+A H  DE+ + IGA
Sbjct: 397 GTTSRRIVKLLKDAGAAEVHVAIASPALKYPCFYGIDIQDRDELIAATHTTDEIREAIGA 456

Query: 423 DSLTYLSIDGLIKSIGLETKAPNGGLCVAYFDGHYPTPLYDYEEEYLRSL            472
           DSLTYLS  GL+++IG       +  LC++YFDG YPTPLYDYE +YL SL
Sbjct: 457 DSLTYLSQSGLVEAIG------HDKLCLSYFDGEYPTPLYDYEADYLESL            500
```

A related DNA sequence was identified in *S. pyogenes* <SEQ ID 973> which encodes the amino acid sequence <SEQ ID 974>. Analysis of this protein sequence reveals the following:

```
Possible site: 21
>>> Seems to have no N-terminal signal sequence

----- Final Results -----
            bacterial cytoplasm --- Certainty = 0.0610(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below:

```
 Identities = 473/484 (97%), Positives = 481/484 (98%)

Query:   1 MTYEVKSLNEECGVFGIWGYPQAAQVTYFGLHSLQHRGQEGAGIISNDNGKLYGYRNVGL   60
           MTYEVKSLNEECGVFGIWG+PQAAQVTYFGLHSLQHRGQEGAGI+SNDNGKLYGYRNVGL
Sbjct:  20 MTYEVKSLNEECGVFGIWGHPQAAQVTYFGLHSLQHRGQEGAGIVSNDNGKLYGYRNVGL   79

Query:  61 LSEVFKNQSELDNLTGNAAIGHVRYATAGSADIRNIQPFLYKFHDGQFALCHNGNLTNAI  120
           LSEVFKNQSELDNLTGNAAIGHVRYATAGSADIRNIQPFLYKFHDGQFALCHNGNLTNAI
Sbjct:  80 LSEVFKNQSELDNLTGNAAIGHVRYATAGSADIRNIQPFLYKFHDGQFALCHNGNLTNAI  139
```

```
-continued
Query: 121  SSRKELEKQGAIFNASSDTEILMHLIRRSHNPSFMGKVKEALSTVKGGFAYLLMTEDKLI  180
            S RKELEKQGAIFNASSDTEILMHLIRRSHN SFMGKVKEAL+TVKGGFAYLLMTE+KLI
Sbjct: 140  SLRKELEKQGAIFNASSDTEILMHLIRRSHNSSFMGKVKEALNTVKGGFAYLLMTEWKLI  199

Query: 181  AALDPNAFRPLSIGQMQNGAWVISSETCAFEVVGAKWVRDVEPGEVILIDDSGIQCDRYT  240
            AALDPNAFRPLSIGQMQNGAWVISSETCAFEVVGA WVRDVEPGEVILIDD GIQCDRYT
Sbjct: 200  AALDPNAFRPLSIGQMQNGAWVISSETCAFEVVGAKWVROVEPGEVILIDDRGIQCDRYT  259

Query: 241  DETQLAICSMEYVYFARPDSTIHGVNVHTARKNMGKRLAQEFKQDADIVIGVFNSSLSAA  300
            DETQLAICSMEYVYFARPDSTIHGVNVHTARKNMGKRLAQEFKQDADIVIGV NSSLSAA
Sbjct: 260  DETQLAICSMEYVYFARPDSTIHGVNVHTARKNMGKRLAQEFKQDADIVIGVPNSSLSAA  319

Query: 301  MGFAEESGLPNEMGLVKNQYTQRTFIQPTQSLREQGVRMKLSAVSGVVKGKRVVMIDDSI  360
            MGFAEESGLPNEMGLVKNQYTQRTFIQPTQ LREQGV MKLSAVSGVVKGKRVVMIDDSI
Sbjct: 320  MGFAEESGLPNEMGLVKNQYTQRTFIQPTQELREQGVPMKLSAVSGVVKGKRVVMIDDSI  379

Query: 361  VRGTTSRRIVGLLREAGATEVHVAIASPELKYPCFYGIDIQTRRELISANHAVDEVCDII  420
            VRGTTSRRIVGLLREAGA+EVHVAIASPELKYPCFYGIDIQTRRELISANH+VDEVCDII
Sbjct: 380  VRGTTSRRIVGLLREAGASEVHVAIASPELKYPCFYGIDIQTRRELISANHSVDEVCDII  439

Query: 421  GADSLTYLSIDGLIKSIGLETKAPNGGLCVAYFDGHYPTPLYDYEEEYLRSLEEKTSFYI  480
            GADSLTYLS+DGLI+SIGLETKAPNGGLCVAYFDGHYPTPLYDYEEEYLRSLEEKTSFYI
Sbjct: 440  GADSLTYLSLDGLIESIGLSTKAPNGGLCVAYFDGHYPTPLYDYEEEYLRSLEEKTSFYI  499

Query: 481  QKVK                                                         484
            QKVK
Sbjct: 500  QKVK                                                         503
```

Based on this analysis, it was predicted that these proteins and their epitopes could be useful antigens for vaccines or diagnostics.

EXAMPLE 302

A DNA sequence (GBSx0331) was identified in *S. agalactiae* <SEQ ID 975> which encodes the amino acid sequence <SEQ ID 976>. Analysis of this protein sequence reveals the following:

```
Possible site: 28
>>> Seems to have no N-terminal signal sequence

----- Final Results -----
          bacterial cytoplasm --- Certainty = 0.4797(Affirmative) < succ>
          bacterial membrane  --- Certainty = 0.0000(Not Clear)   < succ>
          bacterial outside   --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 303

A DNA sequence (GBSx0332) was identified in *S. agalactiae* <SEQ ID 977> which encodes the amino acid sequence <SEQ ID 978>. Analysis of this protein sequence reveals the following:

```
Possible site: 13
>>> Seems to have no N-terminal signal sequence

----- Final Results -----
          bacterial cytoplasm --- Certainty = 0.3489(Affirmative) < succ>
          bacterial membrane  --- Certainty = 0.0000(Not Clear)   < succ>
          bacterial outside   --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 304

A DNA sequence (GBSx0333) was identified in *S. agalactiae* <SEQ ID 979> which encodes the amino acid sequence <SEQ ID 980>. Analysis of this protein sequence reveals the following:

```
Possible site: 14
>>> Seems to have no N-terminal signal sequence

----- Final Results -----
              bacterial cytoplasm --- Certainty = 0.1690(Affirmative) < succ>
               bacterial membrane --- Certainty = 0.0000(Not Clear) < succ>
                bacterial outside --- Certainty = 0.0000(Not Clear) < succ>
```

The protein has homology with the following sequences in the GENPEPT database:

```
>GP:CAC12194 GB:AL445066 phosphoribosylformylglycinamidine synthase
           related protein [Thermoplasma acidophilum]
 Identities = 199/746 (26%), Positives = 329/746 (43%), Gaps = 103/746 (13%)

Query: 202 ADD--FAAYKAEQGLAMEVDDLLFIQDYFKSIGRVPTETELKVLDTYWSDHCRHTTFETE 259
           ADD   A     GLA+ +D++  ++ YF+ +GR P + E+  +   WS+HC + + +
Sbjct:  11 ADDARLKAISKRLGLALSLDEMKAVRSYFERLGRDPIDAEIHAVAQSWSEHCSYKSSKYY  70

Query: 260 LKNIDFSASKFQKQLQATYDKYIAMRDELGRSEKPQTLMDMATIFGRYERANGRLDDMEV 319
           LK       K+    L+   Y   +AM D+ G
Sbjct:  71 LK-------KYLGSLKTDYT-ILAMEDDAG------------------------------  92

Query: 320 SDEINACSVEIEVDVDGVKEPWLLMFKNETHNHPTEIEPFGGAATCIGGAIRDPLSGRSY 379
                      VD DG   +  + K E+HNHP+ +EP+GGAAT IGG +RD L   +
Sbjct:  93 -----------VVDFDG---EYAYVLKMESHNHPSAVEPYGGAATGIGGIVRDVLCMGAQ 138

Query: 380 VYQAMRISGAGDITTPIAETRAGKLPQQVISKTAAHGYSSYGNQIGLATTYVREYFHPGF 439
                 +     GD+++   E   G L  + I     G   YGN+IG+      YF  +
Sbjct: 139 PVALIDSLFLGDVSSDRYE---GLLSPRYIFGGVVGGIRDYGNRIGIPNVAGSLYFDKLY 195

Query: 440 VAKRMELGAVVGAAPKENVVREKP-EAGDVVVLLGGKTGRDGVGGATGSSKVQTVESVET 498
            + +       VG    ++ +VR K  + GDV+VL+GGKTGRDG+ G      +S  + ++
Sbjct: 196 NSNPLVNAGCVGIVRRDRIVRSKSYKPGDVLVLMGGKTGRDGIHGVNFASTTLG-KVTKS 254

Query: 499 AGAEVQKGNAIEERKIQRLFRDGNVTRLIKKSNDFGAGGVCVAIGELAD----GLEIDLD 554
            +  +Q GN I E+ + +   + N    LI+   D G GG+  A  E+       G EI LD
Sbjct: 255 SRLAIQLGNPIVEQPMIKAVLEANDAGLIRAMKDLGGGGLSSAATEMVYAGGFGAEITLD 314

Query: 555 KVPLKYQGLNGTEIAISESQERMSVVVGPSDVDAFIAACNKENIDAVVVATVTEKPNLVM 614
           + LK  ++G EI ISESQERM +    P DV+         K N+D  V+   VT    + +
Sbjct: 315 DIKLKESNMSGWEIWISESQERMLMECYPEDVEKIRQIAEKWNLDFSVIGQVTADRRIRV 374

Query: 615 TWNGETIVDLERCFLDTNGV-RVVVDAKVVDKDLTVPEARTTSAETLEADMLKVLSDLNH 673
            +     I+D++  FLD + V +    K V+K +TVP+         E L + +   ++ LN
Sbjct: 375 YYKKRKIIDMDIEFLDDSPVYQRPYRIKEVEKSVTPQ----EPEDLNSFVRDFMARLNT 430

Query: 674 ASQKGLQTIFDSSVGRSTVNHPIGGR-YQITPTESSVQKLPVQYGVTTTASVMAQGYNPY 732
             ++  +   +D +V   ST+   P  GR + T   +++V K P++  +     V+   G  P
Sbjct: 431 CARFNVVRQYDHTVRGSTIVTPFVGRPNKETHADATVIK-PLENSM--RGLVLTSGSRPN 487

Query: 733 IAEWSPYHGAAYAVIEATARLVATGADWSRARFSYQEYFERMDKQAERFGQPVSALLGSI 792
           +      PY G   + +  EA   +++TG   R                ++ E  GQ V ++
Sbjct: 488 MVSVDPYAGTLLTLAEAYKNILSTG---GRPHSVVDALNFGNPEREEIMGQFVESVRAIG 544

Query: 793 EAQIQFGLPSIGGKDSMSGTFEELTVPPTLVAFGVTTADS-RKVLSPEFKAAGENIY--- 848
            +    + GLP + G S      + +  + PT   V  D R+   +     K +G  IY
Sbjct: 545 DFCRKMGLPVVAGNVSFYNEYRKTDIMPTPTIMMVGLIDDVRRSRTTYMKGSGNAIYLIG 604

Query: 849 ----------------YIPGQAISEDIDFDLIKANF--SQFEAIQAQHKITAASAVKYGG 890
                            Y G      + D+D        +F  S+ +    + I + H +++   GG
```

-continued
```
Sbjct: 605  EPCDNLTGSEYSRMHGYTDGFLPAPDLDELTRIRDFLSSKADMILSSHDVSS------GG  658

Query: 891  VLESLALMTFGNRIGASVEIAELDSS                                   916
            +  +L+ M+FG+ IG  V+I+ + ++
Sbjct: 659  LFAALSEMSFGSGIGFHVDISNVSAA                                   684
```

A related DNA sequence was identified in *S. pyogenes* <SEQ ID 981> which encodes the amino acid sequence <SEQ ID 982>. Analysis of this protein sequence reveals the following:

```
Possible site: 51
>>> Seems to have no N-terminal signal sequence

----- Final Results -----
            bacterial cytoplasm --- Certainty = 0.1415(Affirmative) < succ>
            bacterial membrane  --- Certainty = 0.0000(Not Clear)   < succ>
             bacterial outside  --- Certainty = 0.0000(Not Clear)   < succ>
```

An alignment of the GAS and GBS proteins is shown below:

```
Identities = 1219/1256 (97%), Positives = 1226/1256 (97%)

Query:   11  SSYFRVAPLSDLVSYMNKRIFVEKKADFGIKSASLVKELTHNLQLASLKDLRIVQVYDVF   70
             SSYF VAPLSDLVSYMNKRIFVEKKADFGIKSASLVKELTHNLQL SLK LRIVQVYDVF
Sbjct:    2  SSYFPVAPLSDLVSYMNKRIFVEKKADFGIKSASLVKELTHNLQLTSLKALRIVQVYDVF   61

Query:   71  NLAEDLLARAEKHIFSEQVTDRLLTEAEITAELDKVAFFAIEALPGQFDQRAASSQEALL  130
             NLAEDLLARAEKHIFSEQVTD LLTE EITAELDKVAFFAIEALPGQFDQRAASSQEALL
Sbjct:   62  NLAEDLLARAEKHIFSEQVTDCLLTETEITAELDKVAFFAIEALPGQFDQRAASSQEALL  121

Query:  131  LLGSDSQVKVNTAQLYLVNKDIAEAELEAVKNYLLNPVDSRFKDITLPLEVQAFSVSDKT  190
             L GSDSQVKVNTAQLYLVNKDI EAELEAVKNYLLNPVDSRFKDITLPLE QAFSVSDKT
Sbjct:  122  LFGSDSQVKVNTAQLYLVNKDITEAELEAVKNYLLNPVDSRFKDITLPLEEQAFSVSDKT  181

Query:  191  ISNLDFFETYQADDFAAYKAEQGLAMEVDDLLFIQDYFKSIGRVPTETELKVLDTYWSDH  250
             I NLDFFETYQADDFA YKAEQGLAMEVDDLLFIQ+YFKSIG VPTETELKVLDTYWSDH
Sbjct:  182  IPNLDFFETYQADDFATYKAEQGLAMEVDDLLFIQNYFKSIGCVPTETELKVLDTYWSDH  241

Query:  251  CRHTTFETELKNIDFSASKFQKQLQATYDKYIAMRDELGRSEKPQTLMDMATIFGRYERA  310
             CRHTTFETELKNIDFSASKFQKQLQ TYDKYIAMRDELGRSEKPQTLMDMATIFGRYERA
Sbjct:  242  CRHTTFETELKNIDFSASKFQKQLQTTYDKYIAMRDELGRSEKPQTLMDMATIFGRYERA  301

Query:  311  NGRLDDMEVSDEINACSVEIEVDVDGVKEPWLLMFKNETHNHPTEIEPFGGAATCIGGAI  370
             NGRLDDMEVSDEINACSVEIEVDVDGVKEPWLLMFKNETHNHPTEIEPFGGAATCIGGAI
Sbjct:  302  NGRLDDMEVSDEINACSVEIEVDVDGVKEPWLLMFKNETHNHPTEIEPFGGAATCIGGAI  361

Query:  371  RDPLSGRSYVYQAMRISGAGDITTPIAETRAGKLPQQVISKTAAHGYSSYGNQIGLATTY  430
             RDPLSGRSYVYQAMRISGAGDITTPIAETRAGKLPQQVISKTAAHGYSSYGNQIGLATTY
Sbjct:  362  RDPLSGRSYVYQAMRISGAGDITTPIAETRAGKLPQQVISKTAAHGYSSYGNQIGLATTY  421

Query:  431  VREYFHPGFVAKRMELGAVVGAAPKENVVREKPEAGDVVVLLGGKTGRDGVGGATGSSKV  490
             VREYFHPGFVAKRMELGAVVGAAPKENVVREKPEAGDVV+LLGGKTGRDGVGGATGSSKV
Sbjct:  422  VREYFHPGFVAKRMELGAVVGAAPKENVVREKPEAGDVVILLGGKTGRDGVGGATGSSKV  481

Query:  491  QTVESVETAGAEVQKGNAIEERKIQRLFRDGNVTRLIKKSNDFGAGGVCVAIGELADGLE  550
             QTVESVETAGAEVQKGNAIEERKIQRLFRDGNVTRLIKKSNDFGAGGVCVAIGELADGLE
Sbjct:  482  QTVESVETAGAEVQKGNAIEERKIQRLFRDGNVTRLIKKSNDFGAGGVCVAIGELADGLE  541

Query:  551  IDLDKVPLKYQGLNGTEIAISESQERMSVVVGPSDVDAFIAACNKENIDAVVVATVTEKP  610
             IDLDKVPLKYQGLNGTEIAISESQERMSVVV P+DVDAFIAACNKENIDAVVVATVTEKP
Sbjct:  542  IDLDKVPLKYQGLNGTEIAISESQERMSVVVRPNDVDAFIAACNKENIDAVVVATVTEKP  601

Query:  611  NLVMTWNGETIVDLERCFLDTNGVRVVVDAKVVDKDLTVPEARTTSAETLEADMLKVLSD  670
             NLVMTWNGE IVDLER FLDTNGVRVVVDAKVVDKDLTVPEARTTSAETLEAD LKVLSD
Sbjct:  602  NLVMTWNGEIIVDLERRFLDTNGVRVVVDAKVVDKDLTVPEARTTSAETLEADTLKVLSD  661

Query:  671  LNHASQKGLQTIFDSSVGRSTVNHPIGGRYQITPTESSVQKLPVQYGVTTTASVMAQGYN  730
             LNHASQKGLQTIFDSSVGRSTVNHPIGGRYQITPTESSVQKLPVQ+GVTTTASVMAQGYN
Sbjct:  662  LNHASQKGLQTIFDSSVGRSTVNHPIGGRYQITPTESSVQKLPVQHGVTTTASVMAQGYN  721

Query:  731  PYIAEWSPYHGAAYAVIEATARLVATGADWSRARFSYQEYFERMDKQAERFGQPVSALLG  790
             PYIAEWSPYHGAAYAVIEATARLVATGADWSRARFSYQEYFERMDKQAERFGQPVSALLG
Sbjct:  722  PYIAEWSPYHGAAYAVIEATARLVATGADWSRARFSYQEYFERMDKQAERFGQPVSALLG  781
```

-continued

```
Query:   791 SIEAQIQFGLPSIGGKDSMSGTFEELTVPPTLVAFGVTTADSRKVLSPEFKAAGENIYYI  850
             SIEAQIQ GLPSIGGKDSMSGTFE+LTVPPTLVAFGVTTADSRKVLSPEFKAAGENIYYI
Sbjct:   782 SIEAQIQLGLPSIGGKDSMSGTFEDLTVPPTLVAFGVTTADSRKVLSPEFKAAGENIYYI  841

Query:   851 PGQAISEDIDFDLIKANFSQFEAIQAQHKITAASAVKYGGVLESLALMTFGNRIGASVEI  910
             PGQAISEDIDFDLIK NFSQFEAIQAQHKITAASA KYGGVLESLALMTFGNRIGASVEI
Sbjct:   842 PGQAISEDIDFDLIKDNFSQFEAIQAQHKITAASAAKYGGVLESLALMTFGNRIGASVEI  901

Query:   911 AELDSSLTAQLGGFVFTSVEEIADVVKIGQTQADFTVTVNGNDLAGASLLSAFEGKLEEV  970
             AELDSSLTAQLGGFVFTS EEIAD VKIGQTQADFTVTVNGNDLAGASLL+AFEGKLEEV
Sbjct:   902 AELDSSLTAQLGGFVFTSAEEIADVVKIGQTQADFTVTVNGNDLAGASLLAAFEGKLEEV  961

Query:   971 YPTEFEQVDAIEEVPAVVSDVVIKAKEIIEKPVVYIPVFPGTNSEYDSAKAFEQVGASVN 1030
             YPTEFEQ D +EEVPAVVSD VIKAKE IEKPVVYIPVFPGTNSEYDSAKAFEQVGASVN
Sbjct:   962 YPTEFEQTDVIEEVPAVVSDTVIKAKETIEKPVVYIPVFPGTNSEYDSAKAFEQVGASVN 1081

Query:  1031 LVPFVTLNEAAIAESVDTMVANIAKANIIFFAGGFSAADEPDGSAKFIVNILLNEKVRAA 1150
             LVPFVTLNE AIAESVDTMVANIAKANIIFFAGGFSAADEPDGSAKFIVNILLNEKVRAA
Sbjct:  1022 LVPFVTLNEVAIAESVDTMVANIAKANIIFFAGGFSAADEPDGSAKFIVNILLNEKVRAA 1081

Query:  1091 IDSFIEKGGLIIGICNGFQALVKSGLLPYGNFEEAGETSPTLFYNDANQHVAKMVETRIA 1150
             IDSFIEKGGLIIGICNGFQALVKSGLLPYGNFEEAGETSPTLFYNDANQHVAKMVETRIA
Sbjct:  1082 IDSFIEKGGLIIGICNGFQALVKSGLLPYGNFEEAGETSPTLFYNDANQHVAKMVETRIA 1141

Query:  1151 NTNSPWLAGVEVGDIHVIPVSHGEGKFVVSASEFAELRDNGQIWSQYVDFDGQPSMDSKY 1210
             NTNSPWLAGVEVGDIH IPVSHGEGK VVSASEFAELRDNGQIWSQYVDFDGQPSMDSKY
Sbjct:  1142 NTNSPWLAGVEVGDIHAIPVSHGEGKLVVSASEFAELRDNGQIWSQYVDFDGQPSMDSKY 1201

Query:  1211 NPNGSVNAIEGITSKNGQIIGKMGHSERWEDGLFQNIPGNKDQKLFESAVKYFTGK     1266
             NPNGSVNAIEGITSKNGQIIGKMGHSERWEDGLFQNIPGNKDQ LF SAVKYFTGK
Sbjct:  1202 NPNGSVNAIEGITSKNGQIIGKMGHSERWEDGLFQNIPGNKDQILFASAVKYFTGK     1257
```

Based on this analysis, it was predicted that these proteins and their epitopes could be useful antigens for vaccines or diagnostics.

EXAMPLE 305

A DNA sequence (GBSx0334) was identified in *S. agalactiae* <SEQ ID 983> which encodes the amino acid sequence <SEQ ID 984>. This protein is predicted to be phosphoribosylaminoimidazole-succinocarboxamide synthase (purC). Analysis of this protein sequence reveals the following:

```
Possible site: 41
>>> Seems to have no N-terminal signal sequence

----- Final Results -----
            bacterial cytoplasm --- Certainty = 0.4783(Affirmative) < succ>
            bacterial membrane  --- Certainty = 0.0000(Not Clear)   < succ>
            bacterial outside   --- Certainty = 0.0000(Not Clear)   < succ>
```

The protein has homology with the following sequences in the GENPEPT database:

```
>GP:AAA03540 GB:L15190 SAICAR synthetase [Streptococcus pneumoniae]
 Identities = 183/231 (79%), Positives = 203/231 (87%)

Query:     1 MTNQLIYTGKAKDIYSTKDENVIRTVYKDQATMLNGARKETIDGKGALNNQISSLIFEKL   60
             M+ QLIY GKAKDIY T+DEN+I + YRDQAT  NG +KE I GKG LNNQISS IFEKL
Sbjct:     1 MSKQLIYSGKAKDIYTTEDENLIISTYKDQATAFNGVKKEQIAGKGVLNNQISSFIFEKL   60

Query:    61 NMAGVVTHYIEQISKNEQLNKKVDIIPLEVVLRNVTAGSFSKRFGVEEGHVLETPIVEFY  120
             N AGV TH++E++S  EQLNKKV IIPLEVVLRN TAGSFSKRFGV+EG  LETFIVEFY
Sbjct:    61 NAAGVATHFVEKLSDTEQLNKKVKIIPLEVVLRNYTAGSFSKRFGVDEGIALETPIVEFY  120

Query:   121 YKNDNLNDPFINDENVKFLGIVNDEEIAYLKGETRHINELLKDWFAQIGLNLIDFKLEFG  180
             YKND+L+DPFINDENVKFL I +D++IAYLK E R INELLK WFA+IGL LIDFKLEFG
Sbjct:   121 YKNDDLDDPFINDEHVKFLQIADDQQIAYLKEEARRINELLKVWFAEIGLKLIDFKLEFG  180

Query:   181 FDKDGKIILADEFSPDNCRLWDADGNHMDKDVFRRDLGSLTDVYQVVLEKL          231
             FDKDGKIILADEFSPDNCRLWDADGNHMDKDVFRR LG LTDVY++V EKL
Sbjct:   181 FDKDGKIILADEFSPDNCRLWDADGNHMDKDVFRRGLGELTDVYEIVWEKL          231
```

A related DNA sequence was identified in *S. pyogenes* <SEQ ID 985> which encodes the amino acid sequence <SEQ ID 986>. Analysis of this protein sequence reveals the following:

```
Possible site: 51
>>> Seems to have no N-terminal signal sequence

----- Final Results -----
            bacterial cytoplasm --- Certainty = 0.3935(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below:

```
 Identities = 221/234 (94%), Positives = 228/234 (96%)

Query:   1  MTNQLIYTGKAKDIYSTKDENVIRTVYKDQATMLNGARKETIDGKGALNNQISSLIFEKL   60
            +TNQLIY GKAKDIYSTKDENVIRTVYKDQATMLNGARKETIDGKGALNNQISSLIFEKL
Sbjct:  11  VTNQLIYKGRAKDIYSTKDENVIRTVYRDQATMLNGARKETIDGKGALNNQISSLIFEKL   70

Query:  61  NMAGVVTHYIEQISKNEQLNKKVDIIPLEVVLRNVTAGSFSKRFGVEEGHVLETPIVEFY  120
            N AGVVTHYIEQISKNEQLNKKVDIIPLEVVLRNVTAGSFSKRFGVEEGHVLETPIVEFY
Sbjct:  71  NKAGVVTHYIEQISKNEQLNKKVDIIPLEVVLRNVTAGSFSKRFGVEEGHVLETPIVEFY  130

Query: 121  YKNDNLNDPFINDEHVKFLGIVNDEEIAYLKGETRHINELLKDWFAQIGLNLIDFKLEFG  180
            YKND+L+DPFINDEHVKFLGIVNDEEIAYLKGETR INELLK WFAQIGLNLIDFKLEFG
Sbjct: 131  YKNDDLDDPFINDEHVKFLGIVNDEEIAYLKGETRRINELLKGWFAQIGLNLIDFKLEFG  190

Query: 181  FDKDGKIILADEFSPDNCRLWDADGNHMDKDVFRRDLGSLTDVYQVVLEKLIAL        234
            FD++G IILADEFSPDNCRLWD +GNHMDKDVFRRDLG+LTDVYQVVLEKLIAL
Sbjct: 191  FDQEGTIILADEFSPDNCRLWDKNGNHMDKDVFRRDLGNLTDVYQVVLEKLIAL        244
```

Based on this analysis, it was predicted that these proteins and their epitopes could be useful antigens for vaccines or diagnostics.

EXAMPLE 306

A DNA sequence (GBSx0335) was identified in *S. agalactiae* <SEQ ID 987> which encodes the amino acid sequence <SEQ ID 988>. Analysis of this protein sequence reveals the following:

```
Possible site: 13
>>> Seems to have no N-terminal signal sequence

----- Final Results -----
            bacterial cytoplasm --- Certainty = 0.2779(Affirmative) < succ>
             bacterial membrane --- Certainty = 0.0000(Not Clear)   < succ>
              bacterial outside --- Certainty = 0.0000(Not Clear)   < succ>
```

A related GBS nucleic acid sequence <SEQ ID 9457> which encodes amino acid sequence <SEQ ID 9458> was also identified.

The protein has homology with the following sequences in the GENPEPT database:

```
>GP:AAC35700 GB:AF041468 acyl carrier protein [Guillardia theta]
 Identities = 27/75 (36%), Positives = 52/75 (69%)

Query:  12  MSRDEVFEKMLELLRQQLGDPQLDITPESSLHDDLAIDSIALTEFIINLEDVFHLEIPDE   71
            M+  E+FEK+  ++ +QLG  +  +T +++  +DL   DS+    E ++ +E+ F++EIPD
Sbjct:   1  MNEQEIFEKVQTIISEQLGVDKSQVTKDANFANDLGADSLDTVELVMAIEEAFNIEIPDD   60

Query:  72  AVEHMSSVQQLLDYI    86
            A E +S++QQ +D+I
Sbjct:  61  AAEQISNLQQAVDFI    75
```

A related DNA sequence was identified in *S. pyogenes* <SEQ ID 989> which encodes the amino acid sequence <SEQ ID 990>. Analysis of this protein sequence reveals the following:

```
Possible site: 24
>>> Seems to have no N-terminal signal sequence

----- Final Results -----
              bacterial cytoplasm --- Certainty = 0.1917(Affirmative) < succ>
               bacterial membrane --- Certainty = 0.0000(Not Clear)   < succ>
                bacterial outside --- Certainty = 0.0000(Not Clear)   < succ>
```

An alignment of the GAS and GBS proteins is shown below:

```
 Identities = 36/77 (46%), Positives = 57/77 (73%)

Query:  12 MSRDEVFSKMLELLRQQLGDPQLDITPESSLHDDLAIDSIALTEFIINLEDVFHLEIPDE  71
           M+R E+FE+++ L+++Q     + IT ++ L +DLA+DSI L EFIIN+ED FH+ IPDE
Sbjct:   1 MTRQEIFERLINLIQKQRSYLSVAITEQTHLRNDLAVDSIELVEFIINVEDEFHIAIPDE  60

Query:  72 AVEHMSSVQQLLDYIIE                                             88
           VE M  ++ +LDY+++
Sbjct:  61 DVEDMVFMRDILDYLVQ                                             77
```

Based on this analysis, it was predicted that these proteins and their epitopes could be useful antigens for vaccines or diagnostics.

EXAMPLE 307

A DNA sequence (GBSx0336) was identified in *S. agalactiae* <SEQ ID 991> which encodes the amino acid sequence <SEQ ID 992>. This protein is predicted to be fatty acid/phospholipid synthesis protein (plsX). Analysis of this protein sequence reveals the following:

```
Possible site: 21
>>> Seems to have no N-terminal signal sequence
        INTEGRAL    Likelihood = -0.64    Transmembrane    101-117    (101-117)

----- Final Results -----
               bacterial membrane --- Certainty = 0.1256(Affirmative) < succ>
                bacterial outside --- Certainty = 0.0000(Not Clear)   < succ>
              bacterial cytoplasm --- Certainty = 0.0000(Not Clear)   < succ>
```

A related GBS nucleic acid sequence <SEQ ID 9455> which encodes amino acid sequence <SEQ ID 9456> was also identified.

The protein has homology with the following sequences in the GENPEPT database:

```
>GP:CAB13462 GB:Z99112 alternate gene name: ylpD [Bacillus subtilis]
 Identities = 174/329 (52%), Positives = 238/329 (71%), Gaps = 2/329 (0%)

Query:   8 KIAIDAMGGDYAPKAIVEGVNQAISDFSDIEVQLYGDQKKIEKYLTVT-ERVSIIHTEEK   66
           +IA+DAMGGD+APKA+++GV + I  F D+ + L GD+  IE +LT T +R++++H +E
Sbjct:   2 RIAVDAMGGDHAPKAVIDGVIKGIEAFDDLHITLVGDKTTIESHLTTTSDRITVLHADEV  61

Query:  67 INSDDEPAKAVRRKKQSSMVLGAKAVKDGVAQAFISAGNTGALLAAGLFVVGRIKGVDRP  126
           I   DEP +AVRRKK SSMVL A+ V +  A A ISAGNTGAL+ AGLF+VGRIKG+DRP
Sbjct:  62 IEPTDEPVRAVRRKKNSSMVLMAQEVAENRADACISAGNTGALMTAGLFIVGRIRGIDRP  121

Query: 127 GLMSTMPTLDGVGFDMLDLGANAENTASHLHQYAILGSFYAKNVRGIEVPRVGLLNNGTE  186
             L  T+PT+ G GF +LD+GAN +    HL QYAI+GS Y++ VRG+  PRVGLLN GTE
Sbjct: 122 ALAPTLPTVSGDGFLLLDVGANVDAKPEHLVQYAIMGSVYSQQVRGVTSPRVGLLNVGTE  181

Query: 187 ETKGDSLHKEAYELLAAEPSINFIGNIEARDLMSSVADVVVTDGFTGNAVLRTMEGTAMS  246
           + KG+ L K+ +++L    +INFIGN+EARDL  VADVVVTDGFTGN  LKT+EG+A+S
Sbjct: 182 DKKGNELTRQTFQILKETANINFIGNVEARDLLDDVADVVVTDGETGNVTLKTLEGSALS  241
```

-continued
```
Query:  247 IMGSLKSSIKSGGVKAKLGALLLKDSLYQLKDSMDYSSAGGAVLFGLKAPIVKCHGSSDS  306
            I   ++  + +  + +KL A +LK  L ++K  M+YS+ GGA LFGLKAP++K HGSSDS
Sbjct:  242 IFKMMR-DVMTSTLTSKLAAAVLKPKLKEMKMKMEYSNYGGASLFGLKAPVIKAHGSSDS  300

Query:  307 KAVYSTLKQVRTMLETQVVDQLVDAFTDE                                335
            AV+  ++Q R M+   V   + +   +E
Sbjct:  301 NAVFHAIRQAREMVSQNVAALIQEEVKEE                                329
```

A related DNA sequence was identified in *S. pyogenes* <SEQ ID 993> which encodes the amino acid sequence <SEQ ID 994>. Analysis of this protein sequence reveals the following:

```
Possible site: 36
>>> Seems to have no N-terminal signal sequence
        INTEGRAL    Likelihood = -2.07    Transmembrane    121-137    (120-138)

----- Final Results -----
              bacterial membrane --- Certainty = 0.1829(Affirmative) < succ>
                bacterial outside --- Certainty = 0.0000(Not Clear)  < succ>
              bacterial cytoplasm --- Certainty = 0.0000(Not Clear)  < succ>
```

A related sequence was also identified in GAS <SEQ ID 9127> which encodes the amino acid sequence <SEQ ID 9128>. Analysis of this protein sequence reveals the following:

```
    Possible cleavage site: 16
>>> Seems to have no N-terminal signal sequence
        INTEGRAL    Likelihood = -2.07    Transmembrane    95-111    (94-112)

------ Final Results -----
              bacterial membrane --- Certainty = 0.183(Affirmative) < succ>
                bacterial outside --- Certainty = 0.000(Not Clear)  < succ>
              bacterial cytoplasm --- Certainty = 0.000(Not Clear)  < succ>
```

An alignment of the GAS and GBS proteins is shown below:

```
Identities = 254/330 (76%), Positives = 290/330 (86%)

Query:    6 MKKIAIDAMGGDYAPKAIVEGVNQAISDFSDIEVQLYGDQKKIEKYLTVTERVSIIHTEE   65
            MK+IAIDAMGGD APKAIVEGVNQAI  FSDIE+QLYGDQ KI  YL  ++RV+IIHT+E
Sbjct:   27 MKRIAIDAMGGDNAPKAIVEGVNQAIEAFSDIEIQLYGDQTKINSYLIQSDRVAIIHTDE   86

Query:   66 KINSDDEPAKAVRRKKQSSMVLGAKAVKDGVAQAFISAGNTGALLAAGLFVVGRIKGVDR  125
            KI SDDEPAKAVRRKK++SMVL AKAVK+G A A ISAGNTGALLA GLFVVGRIKGVDR
Sbjct:   87 KIMSDDEPAKAVRRKKKASMVLAAKAVKEGKADAIISAGNTGALLAVGLFVVGRIKGVDR  146

Query:  126 PGLMSTMPTLDGVGFDMLDLGANAENTASHLHQYAILGSFYAKNVRGIEVPRVGLLNNGT  185
            PGL+ST+PT+ G+GFDMLDLGANAENTA HLHQYAILGSFYAKNVRGI  PRVGLLNNGT
Sbjct:  147 PGLLSTIPTVTGLGFDMLDLGANAENTAKHLHQYAILGSFYAKNVRGIANPRVGLLNNGT  206

Query:  186 EETKGDSLHKEAYELLAAEPSINFIGNIEARDLMSSVADVVVTDGFTGNAVLKTMEGTAM  245
            EETKGD L K  YELL A+ +I+F+GN+EAR+LMS VADV+V+DGFTGNAVLK+ EGTA+
Sbjct:  207 EETKGDPLRKATYELLTADNTISFVGNVEARELMSGVADVIVSDGFTGNAVLKSIEGTAI  266

Query:  246 SIMGSLKSSIKSGGVKAKLGALLLKDSLYQLKDSMDYSSAGGAVLFGLKAPIVKCHGSSD  305
            SIMG LK  I SGG+K K+GA LLK SLY++K ++DYSSAGGAVLFGLKAP+VK HGSSD
Sbjct:  267 SIMGQLKQIINSGGIKTKIGASLLKSSLYEMKKTLDYSSAGGAVLFGLKAPVVKSHGSSD  326

Query:  306 SKAVYSTLKQVRTMLETQVVDQLVDAFTDE                               335
             KA++ST+KQVRTML+T VV QLV+ F  E
Sbjct:  327 VKAIFSTIKQVRTMLDTNVVGQLVEEFAKE                               356
```

Based on this analysis, it was predicted that these proteins and their epitopes could be useful antigens for vaccines or diagnostics.

EXAMPLE 308

A DNA sequence (GBSx0337) was identified in *S. agalactiae* <SEQ ID 995> which encodes the amino acid sequence <SEQ ID 996>. Analysis of this protein sequence reveals the following:

```
Possible site: 27
>>> Seems to have no N-terminal signal sequence

----- Final Results -----
            bacterial cytoplasm --- Certainty = 0.4668(Affirmative) < succ>
            bacterial membrane  --- Certainty = 0.0000(Not Clear)   < succ>
            bacterial outside   --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 309

A DNA sequence (GBSx0338) was identified in *S. agalactiae* <SEQ ID 997> which encodes the amino acid sequence <SEQ ID 998>. Analysis of this protein sequence reveals the following:

```
Possible site: 32
>>> Seems to have no N-terminal signal sequence
    INTEGRAL    Likelihood = -12.84    Transmembrane     61-77   (55-82)
    INTEGRAL    Likelihood = -10.14    Transmembrane     26-42   (19-51)
    INTEGRAL    Likelihood =  -9.77    Transmembrane    192-208 (186-211)
    INTEGRAL    Likelihood =  -5.79    Transmembrane    267-283 (262-286)
    INTEGRAL    Likelihood =  -3.77    Transmembrane    100-116  (99-116)

----- Final Results -----
            bacterial membrane  --- Certainty = 0.6137(Affirmative) < succ>
            bacterial outside   --- Certainty = 0.0000(Not Clear)   < succ>
            bacterial cytoplasm --- Certainty = 0.0000(Not Clear)   < succ>
```

A related GBS nucleic acid sequence <SEQ ID 9453> which encodes amino acid sequence <SEQ ID 9454> was also identified.

The protein has homology with the following sequences in the GENPEPT database:

```
>GP: CAA22372 GB: AL034446 putative transmembrane protein
[Streptomyces coelicolor A3(2)]
Identities = 47/154 (30%), Positives = 69/154 (44%),
Gaps = 12/154 (7%)

Query: 120 SGFVEISSSNSFSFGPFFFLFLAYFIQSLTEEILFRGYVMTTVTKFKGSFAGVLCNSMLF  179
           SG+ E+    S          F+A   + TEE++FRG +    + G++  +    ++F
Sbjct: 118 SGYYEVDGLGSVQGAIGLVGFMA--AAAATEEVVFRGVLFRIIEEHIGTYLALGLTGLVF  175

Query: 180 SFIHFRN-----YGITAIALFNLFLLGIIFSILFNMTKNILFVTGVHTTWNFTMGCVLGN  234
           +H  N     +G  AIA+  F+L  ++    T+N+   GVH  WNF  G V
Sbjct: 176 GLMHLLNEDATLWGALAIAIEAGFMLAAAYAA----TRNLWLTIGVHFGWNFAAGGVFST  231

Query: 235 KVSGGDSPVSLFRITENSSFALWNGGDFGFEGGV                           268
            VSG      L  T  S   L  GGDFG EG V
Sbjct: 232 VVSGNGDSEGLLDAT-MSGPKLLTGGDFGPEGSV                           264
```

No corresponding DNA sequence was identified in *S. pyogenes*.

Based on this analysis, it was predicted that these proteins and their epitopes could be useful antigens for vaccines or diagnostics.

EXAMPLE 310

A DNA sequence (GBSx0339) was identified in *S. agalactiae* <SEQ ID 999> which encodes the amino acid sequence <SEQ ID 1000>. Analysis of this protein sequence reveals the following:

```
Possible site: 55
>>> Seems to have no N-terminal signal sequence

----- Final Results -----
              bacterial cytoplasm --- Certainty = 0.2665(Affirmative) < succ>
               bacterial membrane --- Certainty = 0.0000(Not Clear)   < succ>
                bacterial outside --- Certainty = 0.0000(Not Clear)   < succ>
```

A related GBS nucleic acid sequence <SEQ ID 9451> which encodes amino acid sequence <SEQ ID 9452> was also identified.

The protein has homology with the following sequences in the GENPEPT database:

```
>GP:BAB05088 GB:AP001511 unknown conserved protein [Bacillus halodurans]
Identities = 81/242 (33%), Positives = 124/242 (50%), Gaps = 3/242 (1%)

Query:   8 GLVLYNRNYREDDKLVKIFTETEGKRMFFVKHAS--KSKFNAVLQPLTIAHFILKINDNG   65
             G+V+   +Y E +K+V +FT   GK     + A    KS+  AV Q  T    + + N  G
Sbjct:   7 GIVIRTVDYGESNKIVTVFTREYGKIALMARGAKRPKSRLTAVTQLFTYGMMMFQKNA-G   65

Query:  66 LSYIDDYKEVLAFQETNSDLFKLSYASYITSLADVAISDNVADAQLFIFLKKTLELIEDG  125
           L +    + + +F+E  +DLF+ SY SY+T L +      D    + LF   L +T+  + +G
Sbjct:  66 LGTLTQGEIIQSFREVRNDLFRASYVSYVTDLTNKLTEDEKRNPYLFELLYQTIHYMNEG  125

Query: 126 LDYEILTNIFEVQLLERFGVALNFHDCVFCHRVGLPFDFSHKYSGLLCPNHYYKDERRNH  185
           +D ++LT IFEV++       G+         CV C     +P  FS K +G LC      KD
Sbjct: 126 MDPDVLTRIFEVKMFTVAGIKPELDQCVSCRSTDVPVGFSIKEAGFLCKRCIEKDPHAYK  185

Query: 186 LDPNMLYLINRFQSIQFDDLQTISVKPEMKLKIRQFLDMIYDEYVGIHLKSKKFIDDLSSWG  247
           +    + L+  F       L TIS+KPE K  ++  +    YDEY G+HLKS++F+D L S G
Sbjct: 186 ITAQVAKLLRLFYHFDLQRLGTISLKPETKATLKTIIHQYYDEYSGLHLKSRRFLDQLESMG  247
```

A related DNA sequence was identified in *S. pyogenes* <SEQ ID 1001> which encodes the amino acid sequence <SEQ ID 1002>. Analysis of this protein sequence reveals the following:

```
Possible site: 46
>>> Seems to have no N-terminal signal sequence

----- Final Results -----
              bacterial cytoplasm --- Certainty = 0.1566 (Affirmative) <succ>
               bacterial membrane --- Certainty = 0.0000 (Not Clear)   <succ>
                bacterial outside --- Certainty = 0.0000 (Not Clear)   <succ>
```

An alignment of the GAS and GBS proteins is shown below:

```
Identities = 159/251 (63%), Positives = 210/251 (83%)

Query:   1 MRVSQTYGLVLYNRNYREDDKLVKIFTETEGKRMFFVKHASKSKFNAVLQPLTIAHFILK   60
           M+++++  G+VL+NRNYREDDKLVKIFTE   GK+MFFVKH S+SK  ++++QPLTIA FI K
Sbjct:   1 MQLTESLGIVLFNRNYREDDKLVKIFTEVAGKQMFFVKHISRSKMSSIIQPLTIADFIFK   60

Query:  61 INDNGLSYIDDYKEVLAFQETNSDLFKLSYASYITSLADVAISDNVADAQLFIFLKKTLE  120
           +ND GLSY+ DY  V   ++   N+D+F+L+YASY+ +LAD AI+DN +D+ LF  FLKKTL+
Sbjct:  61 LNDTGLSYVVDYSNVNTYRYINNDIFRLAYASYVLALADAAIADNESDSHLFTFLKKTLD  120

Query: 121 LIEDGLDYEILTNIFEVQLLERFGVALNFHDCVFCHRVGLPFDFSHKYSGLLCPNHYYKD  180
```

```
                  L+E+GLDYEILTNIFE+Q+L+RFG++LNFH+C   CHR   LP DFSH++S +LC   HYYKD
Sbjct: 121   LMEEGLDYEILTNIFEIQILDRFGISLNFHECAICHRTDLPLDFSHRFSAVLCSEHYYKD   180

Query: 181   ERRNHLDPNMLYLINRFQSIQFDDLQTISVKPEMKLKIRQFLDMIYDEYVGIHLKSKKFI   240
                RRNHLDPN++YL++RFQ I FDDL+TIS+   ++K K+RQF+D +Y +YVGI LKSK FI
Sbjct: 181   NRRNHLDPNVIYLLSRFQKITFDDLRTISLNKDIKKKLRQFIDELYHDYVGIKLKSKTFI   240

Query: 241   DDLSSWGSIMK                                                   251
                D+L  WG IMK
Sbjct: 241   DNLVKWGDIMK                                                   251
```

Based on this analysis, it was predicted that these proteins and their epitopes could be useful antigens for vaccines or diagnostics.

EXAMPLE 311

A DNA sequence (GBSx0340) was identified in *S. agalactiae* <SEQ ID 1003> which encodes the amino acid sequence <SEQ ID 1004>. This protein is predicted to be aromatic amino acid aminotransferase (patA). Analysis of this protein sequence reveals the following:

```
Possible site: 14
>>> Seems to have no N-terminal signal sequence
INTEGRAL    Likelihood = -3.13   Transmembrane 141-157 (140-159)

----- Final Results -----
                     bacterial membrane --- Certainty = 0.2253
(Affirmative)   <succ>
                     bacterial outside --- Certainty = 0.0000
(Not Clear)     <succ>
                     bacterial cytoplasm --- Certainty = 0.0000
(Not Clear)     <succ>
```

A related GBS nucleic acid sequence <SEQ ID 9449> which encodes amino acid sequence <SEQ ID 9450> was also identified.

The protein has homology with the following sequences in the GENPEPT database:

```
>GP:AAF06954 GB:AF146529  aromatic amino acid aminotransferase
[Lactococcus lactis subsp. cremoris]
Identities = 261/391 (66%), Positives = 323/391 (81%)

Query:  38   MTLEKRFNKYLDRIEVSLIRQFDQSISDIPGMVKLTLGEPDFTTPDHVKEAAKSAIDANQ    97
              M L K+FN  LD+IE+SLIRQFDQ +S IP ++KLTLGEPDF TP+HVK+A  +AI+ NQ
Sbjct:   1   MDLLKKFNPNLDKIEISLIRQFDQQVSSIPDIIKLTLGEPDFYTPEHVKQAGIAAIENNQ    60

Query:  98   SYYTGMSGLLALRQAAADFAKDKYNLTYNPDCEILVTIGATEALSASLIAILEAGDVVLL   157
              S+YTGM+GLL LRQAA++F   KY L+Y  +  EILVT+G TEA+S+ L++IL AGD VL+
Sbjct:  61   SHYTGMAGLLELRQAASEFLLKKYGLSYAAEDEILVTVGVTEAISSVLLSILVAGDEVLI   120

Query: 158   PAPAYPGYEPIVNLVGADIVEIDTRENDFRLTPEMLETAIIQQGEKLKAVLLNYPTNPTG   217
              PAPAYPGYEP++  L G   +VEIDTR NDF LTPEML+ AII++   K+KAV+LNYP NPTG
Sbjct: 121   PAPAYPGYEPLITLAGGSLVEIDTRANDFVLTPEMLDQAIIEREGKVKAVILNYPANPTG   180

Query: 218   ITYSRQEIAALAEVLKKYDIFVISDEVYSELTYTGQQHVSIAEYLPNQTILINGLSKSHA   277
              +TY+R++I   LAEVLKK+++FVI+DEVYSEL YT Q HVSIAEY P  QTI++NGLSKSHA
Sbjct: 181   VTYNREQIKDLAEVLKKHEVFVIADEVYSELNYTDQPHVSIAEYAPEQTIVLNGLSKSHA   240

Query: 278   MTGWRVGLVYAPEAFIAQIIKSHQYMVTAASTISQFAGVEALSVGKNDTLPMRQGYIKRR   337
              MTGWR+GL++A     +AQIIK+HQY+VT+AST SQFA  +EAL  G +D LPM++ Y+KRR
Sbjct: 241   MTGWRIGLIFAARELVAQIIKTHQYLVTSASTQSQFAAIEALKNGADDALPMKKEYLKRR   300

Query: 338   DYIIDKMSKLGFKIIKPSGAFYIFAKIPDSYPQDSFKFCQDFAYQQAVAIIPGVAFGKYG   397
              DYII+KMS LGFKII+P GAFYIFAKIP   QDSFKF  DFA +  AVAIIPG+AFG+YG
Sbjct: 301   DYIIEKMSALGFKIIEPDGAFYIFAKIPADLEQDSFKFAVDFAKENAVAIIPGIAFGQYG   360

Query: 398   EGYIRLSYAASMEVIETAMARLKVFMESYEG                              428
              EG++RLSYAASM+VIE  AMARL   ++     G
Sbjct: 361   EGFVRLSYAASMDVIEQAMARLTDYVTKKRG                              391
```

There is also homology to SEQ ID 1006.

SEQ ID 1004 (GBS332) was expressed in *E. coli* as a His-fusion product. SDS-PAGE analysis of total cell extract is shown in FIG. 60 (lane 3; MW 50.7 kDa). It was also expressed in *E. coli* as a GST-fusion product. SDS-PAGE analysis of total cell extract is shown in FIG. 67 (lane 4; MW 76 kDa).

Based on this analysis, it was predicted that these proteins and their epitopes could be useful antigens for vaccines or diagnostics.

EXAMPLE 312

A DNA sequence (GBSx0341) was identified in *S. agalactiae* <SEQ ID 1007> which encodes the amino acid sequence <SEQ ID 1008>. This protein is predicted to be ribose-phosphate pyrophosphokinase (prsA). Analysis of this protein sequence reveals the following:

```
Possible site: 22
>>> Seems to have no N-terminal signal sequence

----- Final Results -----
            bacterial cytoplasm --- Certainty = 0.3118(Affirmative) < succ>
            bacterial membrane  --- Certainty = 0.0000(Not Clear)   < succ>
             bacterial outside  --- Certainty = 0.0000(Not Clear)   < succ>
```

A related GBS nucleic acid sequence <SEQ ID 9447> which encodes amino acid sequence <SEQ ID 9448> was also identified.

The protein has homology with the following sequences in the GENPEPT database:

```
>GP: AAA62181 GB: N92842 prs [Listeria monocytogenes]
Identities = 209/312 (66%), Positives = 266/312 (84%), Gaps = 3/312 (0%)

Query:   10 LKLFALSSNKELARKVSQTIGIPLGQSTVRQFSDGEIQVNIEESIRGHHVFILQSTSSPV   69
            LK+F+L+SN+ELA+++++ +GI LG+S+V  FSDGEIQ+NIEESIRG HV+++QSTS+PV
Sbjct:   10 LKIFSLNSNRELAEEIAKEVGIELGKSSVTHFSDGEIQINIEESIRGCHVYVIQSTSNPV   69

Query:   70 NDNLMEILIMVDALKRASAESVSVVMPYYGYARQDRKARSREPITSKLVANNLEVAGVDR  129
            N NLME+LIM+DALKRASA ++++VMPYYGYARQDRKARSREPIT+KLVAN++E AG  R
Sbjct:   70 NQNLNELLIMIDALRRASAATINIVMPYYGYARQDRKARSREPITAKLVANLIETAGATR  129

Query:  130 LLTVDLHAAQIQGFFDIPVDHLMGAPLIADYFDRQGLVGDDVVVVSPDHGGVTRARKLAQ  189
            ++T+D+HA QIQGFFDIP+DHL    L++DYF  + L GDD+VVVSPDHGGVTRARK+A
Sbjct:  130 MITLDMHAPQIQGFFDIPIDHLNAVRLLSDYFSERHL-GDDLVVVSPDHGGVTRARKMAD  188

Query:  190 CLKTPIAIIDKRRSVTKMNTSEVMNIIGNIKGKKCILIDDMIDTAGTICHAADALAEAGA  249
              LK PIAIIDKRR  + N +EVMNI+GN++GK CI+DD+IDTAGTI  AA AL EAGA
Sbjct:  189 RLKAPIAIIDKRR--PRPNVAEVMNIVGNVEGKVCIIIDDIIDTAGTITLAAKALREAGA  246

Query:  250 TAVYASCTHPVLSGPALDNIQNSAIEKLIVLDTIYLPEERLIDKIEQISIAELIGEAIIR  309
            T VYA C+HPVLSGPA+  I+ S IEKL+V ++I LPEE+ IDK+EQ+S+A L+GEAI+R
Sbjct:  247 TKVYACCSHPVLSGPAMKRIEESPIEKLVVTNSIALPEEKWIDKMEQLSVAALLGEAIVR  306

Query:  310 IHEKRPLSPLFE                                                 321
            +HE   +S LFE
Sbjct:  307 VHENASVSSLFE                                                 318
```

A related DNA sequence was identified in *S. pyogenes* <SEQ ID 1009> which encodes the amino acid sequence <SEQ ID 1010>. Analysis of this protein sequence reveals the following:

```
Possible site: 22
>>> Seems to have no N-terminal signal sequence

----- Final Results -----
            bacterial cytoplasm --- Certainty = 0.2685(Affirmative) < succ>
```

```
                           -continued
              bacterial membrane --- Certainty = 0.0000(Not Clear) < succ>
               bacterial outside --- Certainty = 0.0000(Not Clear) < succ>
```

An alignment of the GAS and GBS proteins is shown below:

```
Identities = 298/322 (92%), Positives = 311/322 (96%)

Query:    1 MEEIMSYSNLKLFALSSNKELAKKVSQTIGIPLGQSTVRQFSDGEIQVNIEESIRGHHVF   60
            +EE MSYS+LKLFALSSNKELA+KV+  +GI LG+STVRQFSDGEIQVNIEESIRGHHVF
Sbjct:    1 LEEKMSYSDLKLFALSSNKELAEKVASAMGIQLGKSTVRQFSDGEIQVNIEESIRGHHVF   60

Query:   61 ILQSTSSPVNDNLMEILIMVDALKRASAESVSVVMPYYGYARQDRKARSREPITSKLVAN  120
            ILQSTSSPVNDNLMEILIMVDALKRASAE +SVVMPYYGYARQDRKARSREPITSKLVAN
Sbjct:   61 ILQSTSSPVNDNLMEILIMVDALKRASAEKISVVMPYYGYARQDRKARSREPITSKLVAN  120

Query:  121 MLEVAGVDRLLTVDLHAAQIQGFFDIPVDHLMGAPLIADYFDRQGLVGDDVVVVSPDHGG  180
            MLEVAGVDRLLTVDLHAAQIQGFFDIPVDHLMGAPLIADYFDR GLVG+DVVVVSPDHGG
Sbjct:  121 MLEVAGVDRLLTVDLHAAQIQGFFDIPVDHLMGAPLIADYFDRHGLVGEDVVVVSPDHGG  180

Query:  181 VTRARKLAQCLKTPIAIIDKRRSVTKMNTSEVMNIIGNIKGKKCILIDDMIDTAGTICHA  240
            VTRARKLAQ L+TPIAIIDKRRSV KMNTSEVMNIIGN+ GKKCILIDDMIDTAGTICHA
Sbjct:  181 VTRARKLAQFLQTPIAIIDKRRSVDKMNTSEVMNIIGNVSGKKCILIDDMIDTAGTICHA  240

Query:  241 ADALAEAGATAVYASCTHPVLSGPALDNIQNSAIEKLIVLDTIYLPEERLIDKIEQISIA  300
            ADALAEAGATAVYASCTHPVLSGPALDNIQ SAIEKLIVLDTIYLP+ERLIDKIEQISIA
Sbjct:  241 ADALAEAGATAVYASCTHPVLSGPALDNIQRSAIEKLIVLDTIYLPKERLIDKIEQISIA  300

Query:  301 ELIGEAIIRIHEKRPLSPLFEM                                       322
            +L+ EAIIRIHEKRPLSPLFEM
Sbjct:  301 DLVAEAIIRIHEKRPLSPLFEM                                       322
```

Based on this analysis, it was predicted that these proteins and their epitopes could be useful antigens for vaccines or diagnostics.

EXAMPLE 313

A DNA sequence (GBSx0342) was identified in *S. agalactiae* <SEQ ID 1011> which encodes the amino acid sequence <SEQ ID 1012>. This protein is predicted to be a secreted protein. Analysis of this protein sequence reveals the following:

```
Possible site: 20
>>> Seems to have no N-terminal signal sequence

----- Final Results -----
              bacterial cytoplasm --- Certainty = 0.3751(Affirmative) < succ>
               bacterial membrane --- Certainty = 0.0000(Not Clear)   < succ>
                bacterial outside --- Certainty = 0.0000(Not Clear)   < succ>
```

A related GBS nucleic acid sequence <SEQ ID 9277> which encodes amino acid sequence <SEQ ID 9278> was also identified.

The protein has homology with the following sequences in the GENPEPT database:

```
>GP: AAD00288 GB: U78607 putative secreted protein [Streptococcus mutans]
Identities = 111/157 (70%), Positives = 130/157 (82%), Gaps = 1/157 (0%)

Query:    1 MTAIKGQVGALESQQSELEAQNAQLEAVSQQLGQEIQTLSNKIVARNESLKKQVRSAQKG   60
            +  I+GQV AL++QQ+EL+A+N +LEA S  LGQ+IQTLS+KIVARNESLK+Q RSAQK
Sbjct:   55 LITIQGQVSALQTQQAELQAENQRLEAQSATLGQQIQTLSSKIVARNESLKQQARSAQKS  114

Query:   61 NL-TNYINTILNSKSVSDAVNRVVAIREVVSANEKMLAQQEADKAALEAKQIENQNAINT  119
            N   T+YIN I+NSKSVSDA+NRV AIREVVSANEKML QQE DKAA+E KQ ENQ AINT
Sbjct:  115 NAATSYINAIINSKSVSDAINRVSAIREVVSANEKMLQQQEQDKAAVEQKQQENQAAINT  174

Query:  120 VAANKQAIENNKAALATQRAQLEAAQLELSAQLTTVQ                        156
            VAAN++ I  N  AL TQ+AQLEAAQL L A+LTT Q
Sbjct:  175 VAANQETIAQNTNALNTQQAQLEAAQLNLQAELTTAQ                        211
```

A related GBS gene <SEQ ID 8543> and protein <SEQ ID 8544> were also identified. Analysis of this protein sequence reveals the following:

```
Lipop: Possible site: -1 Crend: 3
McG: Discrim Score: 8.29
GvH: Signal Score (-7.5): 0.8
     Possible site: 49
>>> Seems to have a cleavable N-term signal seq.
ALOM program count: 0 value: 6.74 threshold: 0.0
 PERIPHERAL Likelihood = 6.74    400
modified ALOM score: -1.85

*** Reasoning Step: 3

----- Final Results -----
              bacterial outside --- Certainty = 0.3000 (Affirmative) < succ>
              bacterial membrane --- Certainty = 0.0000 (Not Clear) < succ>
              bacterial cytoplasm --- Certainty = 0.0000 (Not Clear)
```

The protein has homology with the following sequences in the databases:

```
32.8/56.3% OVER 439aa
Lactococcus lactis
GP|512521| usp 45 Insert characterized
PIR|JN0097|JN0097 secreted 45K protein-Insert characterized ORF00094(301-1563 of 1941)
GP|512521|emb|CAA01320.1||A17083)1-440 of 461)usp 45{Lactococcus
lactis}PIR|JN0097|JN0097 secreted
45K preotein precursor-Lactococcus lactis
% Match = 16.5
% Identity = 32.8    % Similarity = 56.3
Matches = 141    Mismatches = 178    Conservative Sub.s = 101
93          123         153         183         213         243         273         303
RKYYNFKSNYTLFLFLF*FHYGVIILIE*IEEGYRFLDLIMVHLEIVDFKYKCNNDVI*FREFFGKIFNVLS*RSSLIKM
                                                                                |
                                                                                M
333         387         417         447         477         507         537
KKRILSAVLVSGVTLGTAA--VTVNADDFDSKIAATDSVINTLSGQQAAAQNQVTAIHGQVGALESQQSELEAQNAQLEA
||:||:||:|  |  ||    |||  :|  ||   |:|::       :|  ||  ||  ::  :| :|: :|:  :||  ||::|:
KKKIISAILMSTVILSAAAPLSGVYAD-TNSDIAKQDATISSAQSAKAQAQAQVDSLQSKVDSLQQKQTSTKAQIAKIES
               20          30         40         50         60         70         80
567         597         627         654         684         714         744         774
VSQQLGQEIQTLSNKIVARNESLKKQVRSAQ-KGNLTNYINTILNSKSVSDAVNRVVAIREVVSANEKMLAQQEADKAAL
::  |    :|  ||:    |    |  ::|:   |     |||::  ::|||||::|    :|  ||     |||::||   |||    ::     |
EAKALNAQIATLNESIKERTKTLEAQARSAQVNSSATNYMDAVVNSKSLTDVIQKVTAIATVSSANKQMLEQQEKEQKEL
           90         100        110        120        130        140        150        160
804         834         864         894         924         954         984         1014
EAKQIENQNAINTVAANKQAIENNKAALATQRAQLEAAQLELSAQLTTVQNEKASLIQAKAQAEEEAARKAAEAQAAAEAK
 |   :      :     |::::      |  |:|:|:|  ||      |  :  |::|  :|:   || ||:|::|:  ||| ||:
SQKSETVKKNYNQFVSLSQSLDSQAQELTSQQAELKVATLNYQATIATAQDKKQALLDEKAAAEKAAQEAAKKQAAYEAQ
           170        180        190        200        210        220        230        240
1044        1065        1095        1125        1155        1185        1215
AQAEAKAQAESVA---KAQAAAQVESATAPTETVQTQPRTEIKPSNLTATSSATTVATTTATATNEPKVTQPSVVTKA--
:  |:||| |  ||   ::  : ::     |    |     |:  |:|: : ::::::::       |     |    |
QKEAAQAQAASTAATAKAVEAATSSASASSSQAPQVSTSTDNTTSNASASNSSNSSSNSSSSSSSSSSSSSSSNSNAGG
           250        260        270        280        290        300        310        320
1266        1296        1326        1347        1374        1401        1455
-VEAPKAVVSSTPRAVSKPVVRSYDSSNTYPMGQCT---WGA-KSMASWVGNYW-GNANQWGASARAAG--YSVGTTPRV
 :  :     |  |     ||  || ||     ||  ||::        :|   |||  ||  || ::   ||  || ||
NTNSGTSTGNTGGTTTGGSGINSSPIGNPYAGGGCTDYVWQYFAAQGIYIRNIMPGNGGQWASNGPAQGVLHVVGAAPGV
           330        340        350        360        370        380        390        400
1503        1533        1563        1593        1623        1653        1683
GAVAVWP----YDGGGYGHVAVVTSVANNSSIQVMESNYAGNMSIGNYRGSFNPSASGSVYYIYPN**ILRRSFVVSFLF
 |    :            |||||:| ||  :: :|  :  |    |:
IASSFSADFVGYANSPYGHVAIVKSVNSDGTITIKEGGYGTTWWGHERTVSASGVTFLMPN
           410        420        430        440        450        460
```

SEQ ID 8544 (GBS65) was expressed in *E. coli* as a His-fusion product. SDS-PAGE analysis of total cell extract is shown in FIG. 5 (lane 6; MW 47.5 kDa). It was also expressed in *E. coli* as a GST-fusion product. SDS-PAGE analysis of total cell extract is shown in FIG. 13 (lane 3; MW 72 kDa) and in FIG. 175 (lane 2 & 3; MW 72 kDa).

The GBS65-GST fusion product was purified (FIG. 102A; see also FIG. 191, lane 4) and used to immunise mice (lane 1 product; 20 kg/mouse). The resulting antiserum was used for Western blot (FIG. 102B), FACS, and in the in vivo passive protection assay (Table III). These tests confirm that the protein is immunoaccessible on GBS bacteria and that it is an effective protective immunogen.

EXAMPLE 314

A DNA sequence (GBSx0343) was identified in *S. agalactiae* <SEQ ID 1015> which encodes the amino acid sequence <SEQ ID 1016>. Analysis of this protein sequence reveals the following:

```
Possible site: 18
>>> Seems to have no N-terminal signal sequence

----- Final Results -----
            bacterial cytoplasm --- Certainty = 0.1184 (Affirmative) < succ>
            bacterial membrane  --- Certainty = 0.0000 (Not Clear)   < succ>
             bacterial outside  --- Certainty = 0.0000 (Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 315

A DNA sequence (GBSx0344) was identified in *S. agalactiae* <SEQ ID 1017> which encodes the amino acid sequence <SEQ ID 1018>. Analysis of this protein sequence reveals the following:

```
Possible site: 23
>>> Seems to have no N-terminal signal sequence

----- Final Results -----
            bacterial cytoplasm --- Certainty = 0.4736 (Affirmative) < succ>
            bacterial membrane  --- Certainty = 0.0000 (Not Clear)   < succ>
             bacterial outside  --- Certainty = 0.0000 (Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 316

A DNA sequence (GBSx0345) was identified in *S. agalactiae* <SEQ ID 1019> which encodes the amino acid sequence <SEQ ID 1020>. This protein is predicted to be elongation factor Tu (tufA). Analysis of this protein sequence reveals the following:

```
Possible site: 43
>>> Seems to have no N-terminal signal sequence

----- Final Results -----
            bacterial cytoplasm --- Certainty = 0.3012 (Affirmative) < succ>
            bacterial membrane  --- Certainty = 0.0000 (Not Clear)   < succ>
             bacterial outside  --- Certainty = 0.0000 (Not Clear)   < succ>
```

A related GBS nucleic acid sequence <SEQ ID 9737> which encodes amino acid sequence <SEQ ID 9738> was also identified.

The protein has homology with the following sequences in the GENPEPT database:

```
>GP: BAB03851 GB: AP001507 translation elongation factor Tu (EF-Tu)
[Bacillus halodurans]
Identities = 302/397 (76%), Positives = 350/397 (88%), Gaps = 2/397 (0%)

Query:    7 MAKEKYDRSKPHVNIGTIGHVDHGKTTLTAAITTVLARRLPTSVNQPKDYASIDAAPEER    66
            MAKEK+DRSK H NIGTIGHVDHGKTTLTAAITTVLA+R      V      Y +ID APEER
Sbjct:    1 MAKEKFDRSKTHANIGTIGHVDHGKTTLTAAITTVLAKRSGKGVAMA--YDAIDGAPEER   58

Query:   67 ERGITINTAHVEYETEKRHYAHIDAPGHADYVKNMITGAAQMDGAILVVASTDGPMPQTR  126
            ERGITI+TAHVEYET+ RHYAH+D PGHADYVKNMITGAAQMDG ILVV++ DGPMPQTR
Sbjct:   59 ERGITISTAHVEYETDNRHYAHVDCPGHADYVKNMITGAAQMDGGILVVSAADGPMPQTR  118

Query:  127 EHILLSRQVGVKHLIVFMNKVDLVDDEELLELVEMEIRDLLSEYDFPGDDLPVIQGSALK  186
            EHILLSRQVGV +L+VF+NK D+VDDEELLELVEME+RDLLSEYDFPGDD+PVI GSALK
Sbjct:  119 EHILLSRQVGVPYLVVFLNKCDMVDDEELLELVEMEVRDLLSEYDFPGDDVPVIRGSALK  178

Query:  187 ALEGDEKYEDIIMELMSTVDEYIPEPERDTDKPLLLPVEDVFSITGRGTVASGRIDRGTV  246
            ALEGD ++E+ I+ELM+ VD+YIP PERDT++KP ++PVEDVFSITGRGTVA+GR++RG +
Sbjct:  179 ALEGDAEWEEKIIELMAAVDDYIPTPERDTEKPFMMPVEDVFSITGRGTVATGRVERGQL  238

Query:  247 RVNDEVEIVGIKEDIQKAVVTGVEMFRKQLDEGLAGDNVGVLLRGVQRDEIERGQVLAKP  306
            V DEVEI+G++E+ +K VTGVEMFRK LD   AGDN+G G LLRGV R+E++RGQVLAKP
Sbjct:  239 NVGDEVEIIGLEEEAKKTTVTGVEMFRKLLDYAEAGDNIGALLRGVSREEVQRGQVLAKP  298

Query:  307 GSINPHTRFKGEVYILSKEEGGRHTPFFNNYRPQFYFRTTDVTGSIELPAGTEMVMPGDN  366
            G+I PHT FK EVY+LSKEEGGRHTPFF+NYRPQFYFRTTDVTG I+LP G EMVMPGDN
Sbjct:  299 GTITPHTNFKAEVYVLSKEEGGRHTPFFSNYRPQFYFRTTDVTGIIQLPDGVEMVMPGDN  358

Query:  367 VTIEVELIHPIAVEQGTTFSIREGGRTVGSGIVSEIE                         403
            V + VELI PIA+E+GT FSIREGGRTVG+G+V+ I+
Sbjct:  359 VEMTVELIAPIAIEEGTKFSIREGGRTVGAGVVASIQ                         395
```

A related DNA sequence was identified in *S. pyogenes* <SEQ ID 1021> which encodes the amino acid sequence <SEQ ID 1022>. Analysis of this protein sequence reveals the following:

```
Possible site: 19
>>> Seems to have no N-terminal signal sequence

----- Final Results -----
          bacterial cytoplasm --- Certainty = 0.1367(Affirmative) < succ>
          bacterial membrane  --- Certainty = 0.0000(Not Clear)   < succ>
          bacterial outside   --- Certainty = 0.0000(Not Clear)   < succ>
```

An alignment of the GAS and GBS proteins is shown below:

```
Identities = 386/404 (95%), Positives = 396/404 (97%)

Query:    1 MEAFPKMAKEKYDRSKPHVNIGTIGHVDHGKTTLTAAITTVLARRLPTSVNQPKDYASID    60
            +EAFPKMAKEKYDRSKPHVNIGTIGHVDHGKTTLTAAITTVLARRLP+SVNQPKDYASID
Sbjct:   12 LEAFPKMAKEKYDRSKPHVNIGTIGHVDHGKTTLTAAITTVLARRLPSSVNQPKDYASID   71

Query:   61 AAPEERERGITINTAHVEYETEKRHYAHIDAPGHADYVKNMITGAAQMDGAILVVASTDG  120
            AAPEERERGITINTAHVEYET  RHYAHIDAPGHADYVKNMITGAAQMDGAILVVASTDG
Sbjct:   72 AAPEERERGITINTAHVEYETATRHYAHIDAPGHADYVKNMITGAAQMDGAILVVASTDG  131

Query:  121 PMPQTREHILLSRQVGVKHLIVFMNKVDLVDDEELLELVEMEIRDLLSEYDFPGDDLPVI  180
            PMPQTREHILLSRQVGVKHLIVFMNKVDLVDDEELLELVEMEIRDLLSEYDFPGDDLPVI
Sbjct:  132 PMPQTREHILLSRQVGVKHLIVFMNKVDLVDDEELLELVEMEIRDLLSEYDFPGDDLPVI  191

Query:  181 QGSALKALEGDEKYEDIIMELMSTVDEYIPEPERDTDKPLLLPVEDVFSITGRGTVASGR  240
            QGSALKALEGD K+EDIIMELM TVD YIPEPERDTDKPLLLPVEDVFSITGRGTVASGR
Sbjct:  192 QGSALKALEGDTKFEDIIMELMDTVDSYIPEPERDTDKPLLLPVEDVFSITGRGTVASGR  251

Query:  241 IDRGTVRVNDEVEIVGIKEDIQKAVVTGVEMFRKQLDEGLAGDNVGVLLRGVQRDEIERG  300
            IDRGTVRVNDE+EIVGIKE+ +KAVVTGVEMFRKQLDEGLAGDNVG LLRGVQRDEIERG
Sbjct:  252 IDRGTVRVNDEIEIVGIKEETKKAVVTGVEMFRKQLDEGLAGDNVGILLRGVQRDEIERG  311
```

```
Query: 301 QVLAKPGSINPHTRFKGEVYILSKEEGGRHTPFFNNYRPQFYFRTTDVTGSIELPAGTEM 360
            QV+AKP SINPHT+FKGEVYILSK+EGGRHTPFFNNYRPQFYFRTTDVTGSIELPAGTEM
Sbjct: 312 QVIAKPSSINPHTKFKGEVYILSKDEGGRHTPFFNNYRPQFYFRTTDVTGSIELPAGTEM 371

Query: 361 VMPGDNVTIEVELIHPIAVEQGTTFSIREGGRTVGSGIVSEIEA                 404
            VMPGDNVTI VELIHPIAVEQGTTFSIREGGRTVGSGIVSEIEA
Sbjct: 372 VMPGDNVTINVELIHPIAVEQGTTFSIREGGRTVGSGIVSEIEA                 415
```

Based on this analysis, it was predicted that these proteins and their epitopes could be useful antigens for vaccines or diagnostics.

EXAMPLE 317

A DNA sequence (GBSx0346) was identified in *S. agalactiae* <SEQ ID 1023> which encodes the amino acid sequence <SEQ ID 1024>. Analysis of this protein sequence reveals the following:

```
Possible site: 36
>>> Seems to have a cleavable N-term signal seq.
    INTEGRAL      Likelihood = -0.64      Transmembrane    90-106 (90-106)

----- Final Results -----
            bacterial membrane --- Certainty = 0.1256(Affirmative) < succ>
            bacterial outside  --- Certainty = 0.0000(Not Clear)   < succ>
            bacterial cytoplasm --- Certainty = 0.0000(Not Clear)  < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 318

A DNA sequence (GBSx0347) was identified in *S. agalactiae* <SEQ ID 1025> which encodes the amino acid sequence <SEQ ID 1026>. This protein is predicted to be ftsW. Analysis of this protein sequence reveals the following:

```
Possible site: 38
>>> Seems to have no N-terminal signal sequence
INTEGRAL Likelihood = -11.15 Transmembrane    44-60 (35-70)
INTEGRAL Likelihood =  -4.73 Transmembrane    76-92 (74-98)
INTEGRAL Likelihood =  -3.86 Transmembrane  117-133 (113-134)

----- Final Results -----
            bacterial membrane --- Certainty = 0.5458 (Affirmative) <succ>
            bacterial outside  --- Certainty = 0.0000 (Not Clear)   <succ>
            bacterial cytoplasm --- Certainty = 0.0000 (Not Clear)  <succ>
```

The protein has homology with the following sequences in the GENPEPT database:

```
>GP: AAB39929 GB: U58049 putative cell division protein ftsW
[Enterococcus hirae]
Identities = 78/159 (49%), Positives = 107/159 (67%), Gaps = 4/159 (2%)

Query:   1 MANSXYAMSNGGWFGRGLGNSIEKLGYLPEATTDFVFSIVIEELGVIGAGFILALVFFLI   60
           M+NS YA+ NGG FGRG+GNSI K GYLPE+ TDF+FS++ EE G+IGA  +L L+F L
Sbjct: 240 MSNSYYALYNGGLFGRGMGNSITKKGYLPESETDFIFSVIAEEFGLIGALLVLFLLFLLC  299

Query:  61 LRIMHVGIKAKDPFNSMIALGIGAMLLMQVFVNIGGISGLIPSTGVTFPFLSQGGNSLLV  120
           +RI      K K+   ++I +G+G  +L+Q  +NIG I GLIP TGV  PF+S GG S L+
Sbjct: 300 MRIFQKSTKQKNQQANLILIGVGTWILVQTSINIGSILGLIPMTGVPLPFVSYGGTSYLI  359
```

```
Query:  121 LSVAIGFVLNIDANEKKELIMKEAEEQYKPQEKNEKIIN                    159
            LS AIG  LNI + + KE     + ++  + Q K  K++N
Sbjct:  360 LSFAIGLALNISSRQVKE----KNKQVERLQLKKPKLLN                    394
```

A related DNA sequence was identified in *S. pyogenes* <SEQ ID 1027> which encodes the amino acid sequence <SEQ ID 1028>. Analysis of this protein sequence reveals the following:

```
Possible site: 51
>>> Seems to have no N-terminal signal sequence
INTEGRAL Likelihood = -10.93  Transmembrane   312-328 (303-338)
INTEGRAL Likelihood =  -8.23  Transmembrane    22- 38  (17- 47)
INTEGRAL Likelihood =  -6.85  Transmembrane   192-208 (187-211)
INTEGRAL Likelihood =  -5.10  Transmembrane   218-234 (212-236)
INTEGRAL Likelihood =  -4.83  Transmembrane    86-102  (85-107)
INTEGRAL Likelihood =  -3.72  Transmembrane   385-401 (383-402)
INTEGRAL Likelihood =  -3.45  Transmembrane    61- 77  (61- 79)
INTEGRAL Likelihood =  -2.39  Transmembrane   344-360 (344-360)

----- Final Results -----
          bacterial membrane --- Certainty = 0.5373 (Affirmative) <succ>
            bacterial outside --- Certainty = 0.0000 (Not Clear) <succ>
          bacterial cytoplasm --- Certainty = 0.0000 (Not Clear) <succ>
```

The protein has homology with the following sequences in the databases:

```
>GP: CAB59721 GB: AJ250603 FtsW protein [Enterococcus faecium]
Identities = 131/397 (32%), Positives = 223/397 (55%), Gaps = 23/397 (5%)

Query:   15 KRHLLNYSILLPYLILSVIGLIMVYSTTSVSLIQAHANPFKSVINQGVFWIISLVAITFI   74
            KR  +++ IL PYL LS+IGL+ VYS +S  L+QA N    ++ Q +F  +S    I
Sbjct:    3 KRKKIDWWILGPYLTLSMIGLLEVYSASSYRLLQADENTKSLLLRQLIFIFLSWGVIFLA   62

Query:   75 YKLKLNFLTNTRVLTVVMLGEAFLLIIAR--FFTTAIKGAHGWIVIGPVSFQPAEYLKII  132
            +KL++L + ++     +     F LI+ R      F  + GA WI +  + FQP+E   +
Sbjct:   63 RSIKLHYLLHPKIAGYGLALSIFFLILVRVGIFGVTVNGAQRWISLFGIQFQPSELANLF  122

Query:  133 MVWYLALTFAKIQKNISLYDYQALTRRKWWPTQWNDLRDWRVYSLLMVLLVAAQPDLGNA  192
            +++YL+  F                 P +  +L+  +  ++ LL+  QP +  A
Sbjct:  123 LIFYLSWFFRDGNN---------------PPK--NLKKPFLITVSITLLILFQPKIAGA  164

Query:  193 SIIVLTAIIMFSISGIGIYRWFSAILVMITGLSTVFLGTIAVIGVERVAKIP-VFGYVAKR  251
            +I+  A  +F + + ++    ++V + L    G +  +G +      +P +F +   +R
Sbjct:  165 LMILSIAWVIFWAAAVPFKKGIYLIVTFSALLIGAAGGVLYLGNK--GWLPQMFNHAYER  222

Query:  252 FSAFFNPFHDLTDSGHQLANSYYAMSNGGWFGQGLGNSIEKRGYLPEAQTDFVFSVVIEE  311
            +    +PF D    +G+Q+  +S+YA+ NGG +G+GLGNSI K+GYLPE +TDF+FS++ EE
Sbjct:  223 IATLRDPFIDSHGAGYQMTHSFYALYNGGIWGRGLGNSITKKGYLPETETDFIFSIITEE  282

Query:  312 LGLIGAGFILALVFFLILRIMNVGIKAKNPFNAMMALGVGGMMLQVFVNIGGISGLIPS  371
            LGLIGA  +L L+F L +RI  + + KN    + LG G ++Q  +N+G I+GL+P
Sbjct:  283 LGLIGALCVLFLLFSLCMRIFCLSSRCKNQQAGLFLLGFGTLLFVQTIMNVGSIAGLMPM  342

Query:  372 TGVTFPFLSQGGNSLLVLSVAVGFVLNIDASEKRDDI                        408
            TGV  PF+S GG S L+LS+ +G  LNI +  +  +++
Sbjct:  343 TGVPLPFVSYGGTSYLILSLGIGITLNISSKIQAEEL                        379
```

An alignment of the GAS and GBS proteins is shown below:

```
Identities = 130/166 (78%), Positives = 152/166 (91%), Gaps = 2/166 (1%)

Query:    1 MANSXYAMSNGGWFGRGLGNSIEKLGYLPEATTDFVFSIVIEELGVIGAGFILALVFFLI   60
            +ANS YAMSNGGWFG+GLGNSIEK GYLPEA TDFVFS+VIEELG+IGAGFILALVFFLI
Sbjct:  269 LANSYYAMSNGGWFGQGLGNSIEKRGYLPEAQTDFVFSVVIEELGLIGAGFILALVFFLI  328

Query:   61 LRIMHVGIKAKDPFNSMIALGIGAMLLMQVFVNIGGISGLIPSTGVTFPPFLSQGGNSLLV  120
            LRIM+VGIKAK+PFN+M+ALG+G M+LMQVFVNIGGISGLIPSTGVTFPPFLSQGGNSLLV
Sbjct:  329 LRIMNVGIKAKNPFNAMMALGVGGMMLQVFVNIGGISGLIPSTGVTFPPFLSQGGNSLLV  388
```

```
                               -continued
Query:  121 LSVAIGFVLNIDANEKKELIMKEAEEQYK--PQEKNEKIINLDAFK           164
            LSVA+GFVLNIDA+EK++ I KEAE  Y+   +++N K++N+  F+
Sbjct:  389 LSVAVGFVLNIDASEKRDDIFKEAELSYRKDTRKENSKVVNIKQFQ           434
```

Based on this analysis, it was predicted that these proteins and their epitopes could be useful antigens for vaccines or diagnostics.

EXAMPLE 319

A DNA sequence (GBSx0348) was identified in *S. agalactiae* <SEQ ID 1029> which encodes the amino acid sequence <SEQ ID 1030>. This protein is predicted to be probable cell division protein ftsw (ftsW). Analysis of this protein sequence reveals the following:

```
Possible site: 34
>>> Seems to have an uncleavable N-term signal seq
INTEGRAL Likelihood = -9.77 Transmembrane   12-28 (7-37)
INTEGRAL Likelihood = -7.22 Transmembrane   76-92 (74-97)
INTEGRAL Likelihood = -6.53 Transmembrane  182-198 (178-201)
INTEGRAL Likelihood = -4.62 Transmembrane   51-67 (46-69)
INTEGRAL Likelihood = -2.87 Transmembrane  202-218 (202-218)

----- Final Results -----
           bacterial membrane --- Certainty = 0.4906 (Affirmative) < succ>
            bacterial outside --- Certainty = 0.0000 (Not Clear)   < succ>
             bacterial cytoplasm --- Certainty = 0.0000 (Not Clear)  < succ>
```

A related GBS nucleic acid sequence <SEQ ID 9327> which encodes amino acid sequence <SEQ ID 9328> was also identified.

The protein has homology with the following sequences in the GENPEPT database:

```
>GP: CAA44490 GB: X62621 ORF2 N-terminal [Lactococcus lactis]
Identities = 82/199 (41%), Positives = 122/199 (61%), Gaps = 9/199 (4%)

Query:    1 MKIDKRHLLNYSILIPYLILSILGLIVIYSTTSATLIQLGANPFRSVINQGVFWAVSLVA    60
            M ++K + LNYSILIPYLIL+ +G+++I+STT     +Q G NP++ VINQ  F   +S++
Sbjct:    1 MNLNKNNFLNYSILIPYLILAGIGIVMIFSTTVPDQLQKGLNPYKLVINQTAFVLLSIIM    60

Query:   61 IIFIYKLKLNFLKNSKVLTMAVLVEVFLLLIARF------FTQEVNGAHGWIVIGPI-SF   113
            I  IY+LKL  LKN K++ + +++ + L+ R         T  VNGA GWI I  I +
Sbjct:   61 IAVIYRLKLRALKNRKMIGIIMVLILSLIFCRIMPSSFALTAPVNGARGWIHIPGIGTV   120

Query:  114 QPAEYLKVIIVWYLAFTFARRQKKIEIYDYQALTKGRWLPRSLSDLKDWRFYSLFMIGLV   173
            QPAE+ KV I+WYLA  F+ +Q++IE  D   + KG+ L + L      WR   + ++ +
Sbjct:  121 QPAEFAKVFIIWYLASVFSTKQEEIEKNDINEIFKGKTLTQKL--FGGWRLPVVAILLVD   178

Query:  174 IAQPDLGNGSIIVLTVIIM                                          192
            +  PDLGN  II   +IM
Sbjct:  179 LIMPDLGNTMIIGAVALIM                                          197
```

There is also homology to SEQ ID 1028.

A related GBS gene <SEQ ID 8545> and protein <SEQ ID 8546> were also identified. Analysis of this protein sequence reveals the following:

```
Lipop: Possible site: -1 Crend: 6
McG: Discrim Score: 15.18
GvH: Signal Score (-7.5): -3.58
Possible site: 34
>>> Seems to have an uncleavable N-term signal seq
ALOM program    count: 5     value: -9.77              threshold: 0.0
INTEGRAL        Likelihood = -9.77   Transmembrane    12-28 (7-37)
INTEGRAL        Likelihood =  7.22   Transmembrane    76-92 (74-97)
INTEGRAL        Likelihood =  6.69   Transmembrane   210-226 (201-227)
INTEGRAL        Likelihood =  6.53   Transmembrane   182-198 (178-201)
INTEGRAL        Likelihood =  4.62   Transmembrane    51-67 (46-69)
PERIPHERAL      Likelihood =  1.32                    116
modified ALOM score: 2.45
```

-continued

```
*** Reasoning Step: 3

----- Final Results -----
         bacterial membrane --- Certainty = 0.4906 (Affirmative) <succ>
          bacterial outside --- Certainty = 0.0000 (Not Clear)   <succ>
        bacterial cytoplasm --- Certainty = 0.0000 (Not Clear)   <succ>
```

The protein has homology with the following sequences in the databases:

```
ORF02700(301-876 of 1377)
EGAD|8615|8419(1-197 of 198) hypothetical protein in rpmg 3'region, fragment
{Lactococcus lactis} SP|P27174|YRG2_LACLA HYPOTHETICAL PROTEIN IN RPMG 3'REGION
(ORF2) (FRAGMENT). GP|44069|emb|CAA44490.1||X6261 ORF2 N-terminal {Lactococcus
lactis} PIR|PC1134|PC1134 hypothetical protein 198 (rmpG 3' region) -
Lactococcus lactis (fragment)
% Match = 15.1
% Identity = 42.3  % Similarity = 64.9
Matches = 82  Mismatches = 64  Conservative Sub.s = 44

87           117          147          177          207          237          267          297
KA*I*Y*I**L*LVILFLLPFFINFL*IYLTGLND*NVPSNISN*SFIFVISIVGGYXX*LIXXXIMHNGNFLKY*RK*Y 327          357          387          417          447          477          507          537
NMKIDKRHLLNYSILIPYLILSILGLIVIYSTTSATLIQLGANPFRSVINQGVFWAVSLVAIIFIYKLKLNFLKNSKVLT
    |  ::|  ::||||||||||||: :|:::|:|||    :| |  ||::  ||||   |  :|:: |  ||:||| ||| |::
 MNLNKNNFLNYSILIPYLILAGIGIVMIFSTTVPDQLQKGLNPYKLVINQTAFVLLSIIMIAVIYRLKLRALKNRKMIG
        10           20           30           40           50           60           70

567          585          609          636          666          696          726          756
MAVLVEVFLLLIARF----FT--QEVNGAHGWIVIGPI-SFQPAEYLKVIIVWYLAFTFARRQKKIEIYDYQALTKGRWL
  : :::  :: |:   |      |       |||| |||  |  |: ||||: || |:|||| |: :|::|  |   :  ||: |
 IIMVILILSLIFCRIMPSSFALTAPVNGARGWIHIPGIGTVQPAEFAKVFIIWYLASVFSTKQEEIEKNDINEIFKGKTL
        90          100          110          120          130          140          150

786          816          846          876          906          936          966          996
PRSLSDLKDWRFYSLFMIGLVIAQPDLGNGSIIVLTVIIMYCISGIGYRWFSALLGLIVVGSTLFIGTIAVVGVETMAKV
  :  |   :  ||:   :  ::  :  :      |||||   ||    :||
 TQKL--FGGWRLPVVAILLVDLIMPDLGNTMIIGAVALIMI
        170          180          190
```

Based on this analysis, it was predicted that these proteins and their epitopes could be useful antigens for vaccines or diagnostics.

EXAMPLE 320

A DNA sequence (GBSx0349) was identified in *S. agalactiae* <SEQ ID 1031> which encodes the amino acid sequence <SEQ ID 1032>. Analysis of this protein sequence reveals the following:

```
Possible site: 22
>>> Seems to have no N-terminal signal sequence

----- Final Results -----
        bacterial cytoplasm --- Certainty = 0.3665(Affirmative) < succ>
         bacterial membrane --- Certainty = 0.0000(Not Clear)   < succ>
          bacterial outside --- Certainty = 0.0000(Not Clear)   < succ>
```

The protein has no significant homology with any sequences in the GENPEPT database.

A related DNA sequence was identified in *S. pyogenes* <SEQ ID 1033> which encodes the amino acid sequence <SEQ ID 1034>. Analysis of this protein sequence reveals the following:

```
Possible site: 54
>>> Seems to have no N-terminal signal sequence

----- Final Results -----
        bacterial cytoplasm --- Certainty = 0.2373(Affirmative) < succ>
```

An alignment of the GAS and GBS proteins is shown below:

```
Identities = 35/41 (85%), Positives = 37/41 (89%)

Query:    1  MEKEAKQIIDLKRNLFKIDVRAQKDEEKVFMRTACCYSPFY   41
             +EKEAKQ+IDLKRNLFKIDVRAQKDEEKVFMRTAC  S Y
Sbjct:    1  LEKEAKQMIDLKRNLFKIDVRAQKDEEKVFMRTACRQSRVY   41
```

Based on this analysis, it was predicted that these proteins and their epitopes could be useful antigens for vaccines or diagnostics.

EXAMPLE 321

A DNA sequence (GBSx0351) was identified in *S. agalactiae* <SEQ ID 1037> which encodes the amino acid sequence <SEQ ID 1038>. Analysis of this protein sequence reveals the following:

```
Possible site: 49
>>> Seems to have no N-terminal signal sequence
    INTEGRAL    Likelihood = -1.65    Transmembrane      78-94 (78-95)
    INTEGRAL    Likelihood = -1.33    Transmembrane     421-437 (420-437)

----- Final Results -----
                bacterial membrane --- Certainty = 0.1659(Affirmative) < succ>
                 bacterial outside --- Certainty = 0.0000(Not Clear)   < succ>
               bacterial cytoplasm --- Certainty = 0.0000(Not Clear)   < succ>
```

The protein has homology with the following sequences in the GENPEPT database:

```
>GP: CAA00827 GB: A09073 phosphoenol pyruvate carboxylase
[Corynebacterium glutamicum]
Identities = 335/958 (34%), Positives = 539/958 (55%), Gaps = 80/958 (8%)

Query:   22 EIITEEVGLLKQLLDEATQKLIGSESFDKIE--KIVSLSLTD---DYTGLKETISALSNE    76
            + + +++  L Q+L E   +  G E ++ +E  ++ S  +      L +       ++
Sbjct:    3 DFLRDDIRFLGQILGEVIAEQEGQEVYELVEQARLTSFDIAKGNAEMDSLVQVFDGITPA    62

Query:   77 EMVIVSRYFSILPLLINISEDVDLAYEINYKNNLNQDYLGKLST----TIDVV-------   125
            +   ++R FS   LL N++ED+       Y  L +  L    T    T+D
Sbjct:   63 KATPIARAFSHFALLANLAEDL-------YDEELREQALDAGDTPPDSTLDATWLKLNEG   115

Query:  126 -AGHENAKDILEHVNVVPVLTAHPTQVQRKTVLELTSKIHDLLRKYRDVKAGIVNQ----   180
                 G E    D+L +   V PVLTAHPT+ +R+TV +      I   +R+   +++
Sbjct:  116 NVGAEAVADVLRNAEVAPVLTAHPTETRRRTVFDAQKWITTHMRERHALQSAEPTARTQS   175

Query:  181 --EKWYADLRRYIGIIMQTDTIREKKLKVKNEITNVMEYYNRSLIKAVTKLTAEYKALAA   238
              ++   ++RR I I+  QT   IR  + ++++EI   + YY    SL++ + ++   +
Sbjct:  176 KLDEIEKNIRRRITILWQTALIRVARPRIEDEIEVGLRYYKLSLLEEIPRINRDVAVELR   235

Query:  239 KK---GIHLENPKPLTM-GMWIGGDRDGNPFVTAETLRLSAMVQSEVIINHYIEQLNELY   294
            ++   G+  L    KP+    G WIGGD DGNP+VTAET+   S     +E ++ +Y  QL+ L
Sbjct:  236 ERFGEGVPL---KPVVKPGSWIGGDHDGNPYVTAETVEYSTHRAAETVLKYYARQLHSLE   292

Query:  295 RNMSLSINLTEVSPELVTLANQSQDNSVYRENEPYRKAFNFIQDKLVQTLLNLKVGSSPK   354
            +SLS  + +V+P+L+  LA+      ++    R  +EPYR+A  + ++  +++      T
Sbjct:  293 HELSLSDRMNKVTPQLLALADAGHNDVPSRVDEPYRRAVHGVRGRILAT-----------   341

Query:  355 EKFVSRQESSDIVGRYIKSHIAQVASDIQTEELPAYATAEEFKQDLLLVKQSLVQYGQDS   414
                  +++++G                +  +    YA+ EEF  D L +   SL +
Sbjct:  342 --------TAELIGE-------DAVEGVWFKVFTPYASPEEFLNDALTIDHSLRESKDVL   386

Query:  415 LVDGELACLIQAVDIFGFYLATIDMRQDSSINEACVAELLKSANIVDDYSSLSEEEKCQL   474
            + D  L+ LI A++  FGF L  +D+RQ+S     E +EL + A +   +Y  LSE EK ++
Sbjct:  387 IADDRLSVLISAIESFGFNLYALDLRQNSESYEDVLTELFERAQVTANYRELSEAEKLEV   446
```

-continued
```
Query:  475 LLKELTEDPRTLSSTHAPKSELLQKELAIFQTARELKDQLGEDIINQHIISHTESVSDMF  534
            LLKEL    +        SE+ +EL IF+TA E   + G  ++   IIS    SV+D+
Sbjct:  447 LLKELRSPRPLIPHGSDEYSEVTDRELGIFRTASEAVKKFGPRMVPHCIISMASSVTDVL  506

Query:  535 ELAIMLKEVGLIDAN----QARIQIVPLFETIEDLDNSRDIMTQYLHYELVKKWIATNNN  590
            E  ++LKE GLI AN    +  + ++PLFETIEDL      I+ +    +L + ++   +N
Sbjct:  507 EPMVLLKEFGLIAANGDNPRGTVDVIPLFETIEDLQAGAGILDELWKIDLYRNYLLQRDN  566

Query:  591 YQEIMLGYSDSNKDGGYLSSGWTLYKAQNELTKIGEENGIKITFFHGRGGTVGRGGGPSY  650
              QE+MLGYSDSNKDGGY S+ W LY A+ +L ++      G+K+  FHGRGGTVGRGGGPSY
Sbjct:  567 VQEVMLGYSDSNKDGGYFSANWALYDAELQLVELCRSAGVKLRLFHGRGGTVGRGGGPSY  626

Query:  651 EAITSQPFGSIKDRIRLTEQGEIIENKYGNQDAAYYNLEMLISASIDRMVTRMITNPNEI  710
              +AI +QP G+++   +R+TEQGEII   KYGN + A  NLE L+SA+++        + + +E+
Sbjct:  627 DAILAQPRGAVQGSVRITEQGEIISAKYGNPETARRNLEALVSATLE----ASLLDVSEL  682

Query:  711 DNFRETMDGIVSESNAV----YRNLVFDNPYFYDYFFEASPIKEVSSLNIGSRPAARKTI  766
             + +     D I+SE + +      Y +LV ++   F  DYF +++P++E+  SLNIGSRP++RK
Sbjct:  683 TDHQRAYD-IMSEISELSLKKYASLVHEDQGFIDYFTQSTPLQEIGSLNIGSRPSSRKQT  741

Query:  767 TEISGLRAIFWVFSWSQNRIMFPGWYGVGSAFKHFI---EQDEANLAKLQTMYQKWPFFN  823
             + +     LRAIPWV  SWSQ+R+M PGW+GVG+A + +I    EQ      +A+LQT+ + WPFF
Sbjct:  742 SSVEDLRAIPWVLSWSQSRVMLPGWFGVGTALSQWIGEGEQATQRIAELQTLNESWPFFT  801

Query:  824 SLLSNVDMVLSKSNMNIALQYAQLAGSKEVRD-VFNIILNEWQLTKDMILAIEQHDNLLE  882
              S+L N+   V+SK+ + +A  YA L     EV + V+++I  E+ LTK M    I    D+LL+
Sbjct:  802 SVLDNMAQVMSKAELRLAKLYADLIPDTEVAERVYSVIREEYFLTKKMFCVITGSDDLLD  861

Query:  883 ENPMLHASLDYRLPYFNVLNYVQIELIKRLRSNQLDEDYEKLIHITINGIATGLRNSG   940
             +NP+L  S+  R PY  LN +Q+E+++R R      E    + I +T+NG++T LRNSG
Sbjct:  862 DNPLLARSVQRRYPYLLPLNVIQVEMMRRYRKGDQSEQVSRNIQLTMNGLSTALRNSG    919
```

A related GBS nucleic acid sequence <SEQ ID 10961> which encodes amino acid sequence <SEQ ID 10962> was also identified.

A related DNA sequence was identified in *S. pyogenes* <SEQ ID 1039> which encodes the amino acid sequence <SEQ ID 1040>. Analysis of this protein sequence reveals the following:

```
Possible site: 40
>>> Seems to have no N-terminal signal sequence

----- Final Results -----
            bacterial cytoplasm --- Certainty = 0.1613(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below:

```
Identities = 659/927 (71%), Positives = 779/927 (83%), Gaps = 11/927 (1%)

Query:   14 KLESSSNKEIITEEVGLLKQLLDEATQKLIGSESFDKIEKIVSLSLTDDYTGLKETISAL   73
            KLESS+N++II EEV LLK++L+  T+++IG ++F  IE I+ LS    DY  L++ ++ +
Sbjct:    5 KLESSNNQDIIAEEVALLKEMLENITRRMIGDDAFTVIESIMVLSEKQDYIELEKVVANI   64

Query:   74 SNEEMVIVSRYFSILPLLINISEDVDLAYEINYKNNLNQDYLGKLSTTIDVVAGHENAKD  133
            SN+EM ++SRYFSILPLLINISEDVDLAYEINY+NN + DYLGKL+ TI  +AG +N KD
Sbjct:   65 SNQEMEVISRYFSILPLLINISEDVDLAYEINYQNNTDTDYLGKLALTIKDLAGKDNGKD  124

Query:  134 ILEHVNVVPVLTAHPTQVQRKTVLELTSKIHDLLRKYRDVKAGIVNQEKWYADLRRYIGI  193
            ILE VNVVPVLTAHPTQVQRKT+LELT+ IH LLRKYRD KAG++N EKW  +L RYI +
Sbjct:  125 ILEQVNVVPVLTAHPTQVQRKTILELTTHIHKLLRKYRDAKAGVINLEKWRQELYRYIEM  184

Query:  194 IMQTDTIREKKLKVKNEITNVMEYYNRSLIKAVTKLTAEYKALAAKKGIHLENPKPLTMG  253
            IMQTD  IREKKL+VKNEI NVM+YY+ SLI+AVTKLT EYK LA K G+ L+NPKP+TMG
Sbjct:  185 IMQTDIIREKKLQVKNEIKNVMQYYDGSLIQAVTKLTTEYKNLAQKHGLELDNPKPITMG  244

Query:  254 MWIGGDRDGNPFVTAETLRLSAMVQSEVIINHYIEQLNELYRNMSLSINLTEVSPELVTL  313
            MWIGGDRDGNPFVTAETL LSA VQSEVI+N+YI++L  LYR   SLS  L + + E+  L
Sbjct:  245 MWIGGDRDGNPFVTAETLCLSATVQSEVILNYYIDELAALYRTFSLSSTLVQPNSEVERL  304

Query:  314 ANQSQDNSVYRENEPYRKAFNFIQDKLVQTLLNLKVGSSPKEKFVSRQESSDIVGRYIKS  373
            A+ SQD S+YR NEPYR+AF++IQ +L QT + L           +  +  SS +        S
```

```
                                             -continued
Sbjct:  305 ASLSQDQSIYRGNEPYRRAFHYIQSRLKQTQIQLT------NQPAASMSSSVGLNTSAWS  358

Query:  374 HIAQVASDIQTEELPAYATAEEFKQDLLLVKQSLVQYGQDSLVDGELACLIQAVDIFGFY  433
              A + + I       AY +  +FK DL  ++QSL+   G   +L++G+L   ++QAVDIFGF+
Sbjct:  359 SPASLENPIL-----AYDSPVDFKADLKAIEQSLLDNGNSALIEGDLREVMQAVDIFGFF  413

Query:  434 LATIDMRQDSSINEACVAELLKSANIVDDYSSLSEEEKCQLLLKELTEDPRTLSSTHAPK  493
              LA+IDMRQDSS+ EACVAELLK ANIVDDYSSLSE EKC +LL++L E+PRTLSS   K
Sbjct:  414 LASIDMRQDSSVQEACVAELLKGANIVDDYSSLSETEKCDVLLQQLMEEPRTLSSAAVAK  473

Query:  494 SELLQKELAIFQTARELKDQLGEDIINQHIISHTESVSDMFELAIMLKEVGLIDANQARI  553
              S+LL+KELAI+ TARELKD+LGE++I QHIISHTESVSDMFELAIMLKEVGL+D  +AR+
Sbjct:  474 SDLLEKELAIYTTARELKDKLGEEVIKQHIISHTESVSDMFELAIMLKEVGLVDQQRARV  533

Query:  554 QIVPLFETIEDLDNSRDIMTQYLHYELVKKWIATNNNYQEIMLGYSDSNKDGGYLSSGWT  613
              QIVPLFETIEDLDN+RDIM   YL +++VK WIATN NYQEIMLGYSDSNKDGGYL+SGWT
Sbjct:  534 QIVPLFETIEDLDNARDIMAAYLSHDIVKSWIATNRNYQEIMLGYSDSNKDGGYLASGWT  593

Query:  614 LYKAQNELTKIGEENGIKITFFHGRGGTVGRGGGPSYEAITSQPFGSIKDRIRLTEQGEI  673
              LYKAQNELT IGEE+G+KITFFHGRGGTVGRGGGPSY+AITSQPFGSIKDRIRLTEQGEI
Sbjct:  594 LYKAQNELTAIGEEHGVKITFFHGRGGTVGRGGGPSYDAITSQPFGSIKDRIRLTEQGEI  653

Query:  674 IENKYGNQDAAYYNLEMLISASIDRMVTRMITNPNEIDNFRETMDGIVSESNAVYRNLVF  733
              IENKYGN+D AYY+LEMLISASI+RMVT+MIT+PNEID+FRE MD IV++SN +YR LVF
Sbjct:  654 IENKYGNKDVAYYHLEMLISASINRMVTQMITDPNEIDSFREIMDSIVADSNIIYRKLVF  713

Query:  734 DNPYFYDYFFEASPIKEVSSLNIGSRPAARKTITEISGLRAIPWVFSWSQNRIMFPGWYG  793
              DNP+FYDYFFEASPIKEVSSLNIGSRPAARKTITEI+GLRAIPWVFSWSQNRIMFPGWYG
Sbjct:  714 DNPHFYDYFFEASPIKEVSSLNIGSRPAARKTITEITGLRAIPWVFSWSQNRIMFPGWYG  773

Query:  794 VGSAFKHFIEQDEANLAKLQTMYQKWPFFNSLLSNVDMVLSKSNMNIALQYAQLAGSKEV  853
              VGSAFK +I++ +  NL +LQ MYQ WPFF+SLLSNVDMVLSKSNMNIA QYAQLA  ++V
Sbjct:  774 VGSAFKRYIDRAQGNLERLQHMYQTWPFFHSLLSNVDMVLSKSNMNIAFQYAQLAERQDV  833

Query:  854 RDVFNIILNEWQLTKDMILAIEQHDNLLEENPMLHASLDYRLPYFNVLNYVQIELIKRLR  913
              RDVF   IL+EWQLTK++ILAI+ HD+LLE+NP L  SL  RLPYFNVLNY+QIELIKR R
Sbjct:  834 RDVFYEILDEWQLTKNVILAIQDHDDLLEDNPSLKHSLKSRLPYFNVLNYIQIELIKRWR  893

Query:  914 SNQLDEDYEKLIHITINGIATGLRNSG                                  940
              +NQLDE+ EKLIH TINGIATGLRNSG
Sbjct:  894 NNQLDENDEKLIHTTINGIATGLRNSG                                  920
```

Based on this analysis, it was predicted that these proteins and their epitopes could be useful antigens for vaccines or diagnostics.

EXAMPLE 322

A DNA sequence (GBSx0352) was identified in *S. agalactiae* <SEQ ID 1041> which encodes the amino acid sequence <SEQ ID 1042>. This protein is predicted to be *Bacillus licheniformis* Pz-peptidase homologue (pepF). Analysis of this protein sequence reveals the following:

```
Possible site: 61
>>> Seems to have no N-terminal signal sequence

----- Final Results -----
         bacterial cytoplasm --- Certainty = 0.3012 (Affirmative) < succ>
          bacterial membrane --- Certainty = 0.0000 (Not Clear)   < succ>
           bacterial outside --- Certainty = 0.0000 (Not Clear)   < succ>
```

A related DNA sequence was identified in *S. pyogenes* <SEQ ID 1043> which encodes the amino acid sequence <SEQ ID 1044>. Analysis of this protein sequence reveals the following:

```
Possible site: 55
>>> Seems to have no N-terminal signal sequence

----- Final Results -----
         bacterial cytoplasm --- Certainty = 0.3137 (Affirmative) < succ>
          bacterial membrane --- Certainty = 0.0000 (Not Clear)   < succ>
           bacterial outside --- Certainty = 0.0000 (Not Clear)   < succ>
```

An alignment of the GAS and GBS proteins is shown below:

```
Identities = 512/593 (86%), Positives = 564/593 (94%)

Query:    1 MKLKKRSEFPENELWDLTALYKDRQDFLLAIEKALEDIKVFKKNYEGKLNCVEDFTSALM   60
            M+LKKRSEFPENELWDLTALYKDRQDFLLAIEKAL+DI +FK+NYEG+L  V+DFT AL+
Sbjct:   26 MELKKRSEFPENELWDLTALYKDRQDFLLAIEKALQDIDLFKRNYEGRLTSVDDFTQALI   85

Query:   61 EIEHIYIQMSHIDTYAFMPQTTDFSNEEFAQISQAGSDFATKANVLLSFFNTALANADIK  120
            EIEHIYIQMSHI TYAFMPQTTDFS+E FAQI+QAG DF TKA+V LSFF+TALANAD+
Sbjct:   86 EIEHIYIQMSHIGTYAFMPQTTDFSDESFAQIAQAGDDFMTKASVALSFFDTALANADLD  145

Query:  121 ILDSLENNPHFKATIRQAKIQKQHLLSPEVEKALTNLNEVLNTPYDIYTKMRAGDFDMED  180
            +LD+LE NP+F A IR AKIQK+HLLSP+VEKAL NL EV+N PYDIYTKMRAGDFDM+D
Sbjct:  146 VLDTLEKNPYFSAAIRMAKIQKEHLLSPDVEKALANLREVINAPYDIYTKMRAGDFDMDD  205

Query:  181 FEVDGKTYKNSFVTYENYFQNHENAEIREKSFRSFSKGLRKHQNAAAAAYLAKVKSEKLI  240
            FEVDGKTYKNSFV+YEN++QNHENAEIREK+FRSFSKGLRKHQN AAAAYLAKVKSEKL+
Sbjct:  206 FEVDGKTYKNSFVSYENFYQNHENAEIREKAFRSFSKGLRKHQNTAAAAYLAKVKSEKLL  265

Query:  241 ADMRGYDSVFDYLLSEQEVDRSMFDRQIDLIMDEFGPVAQRFLKHIADVNGIEKMTFADW  300
            ADM+GY SVFDYLL+EQEVDRS+FDRQIDLIM EFGPVAQ+FLKH+A VNG+EKMTFADW
Sbjct:  266 ADMKGYASVFDYLLAEQEVDRSLFDRQIDLIMTEFGPVAQKFLKHVAQVNGLEKMTFADW  325

Query:  301 KLDIDNELNPEVSINDAYDLVMKSVAPLGKEYSQEVERYQKERWVDFAANANKDSGGYAA  360
            KLDIDN+LNPEVSI+ AYDLVMKS+APLG+EY++E+ERYQ ERWVDFAANANKDSGGYAA
Sbjct:  326 KLDIDNDLNPEVSIDGAYDLVMKSLAPLGQEYTKEIERYQTERWVDFAANANKDSGGYAA  385

Query:  361 DPYKVHPYVLMSWTGRMSDVYTLIHEIGHSGQFIFSDNHQSFFNTHMSTYYVEAPSTFNE  420
            DPYKVHPYVLMSWTGRMSDVYTLIHEIGHSGQFIFSDNHQS+FNTHMSTYYVEAPSTFNE
Sbjct:  386 DPYKVHPYVLMSWTGRMSDVYTLIHEIGHSGQFIFSDNHQSYFNTHMSTYYVEAPSTFNE  445

Query:  421 LLLSDYLENQFDTARQKRFALAHRLTDTYFHNFITHLLEAAFQRKVYTLIEEGGTFGAEQ  480
            L+LSDYLE+QFD  RQKRFALAHRLTDTYFHNFITHLLEAAFQRKVYTLIEEGGTFGA+Q
Sbjct:  446 LMLSDYLEHQFDDPRQKRFALAHRLTDTYFHNFITHLLEAAFQRKVYTLIEEGGTFGADQ  505

Query:  481 LNAIMKEVLTQFWGDAIEIDDDAALTWMRQAHYYMGLYSYTYSAGLVISTAGYLNLKNNP  540
            LNA+MKEVLT FWGDA++IDDDAALTWMRQAHYYMGLYSYTYSAGLVISTAGYLNLK+NP
Sbjct:  506 LNAMMKEVLTDFWGDAVDIDDDAALTWMRQAHYYMGLYSYTYSAGLVISTAGYLNLKHNP  565

Query:  541 NGAKEWLAFLKSGGSRTPLETALLISADISTDKPLRDTINFLSNTVDQIINYS         593
            NGAKEWL FLKSGGSRTPL+TA+LI ADI+T+KPLRDTI FLS+TVDQII+Y+
Sbjct:  566 NGAKEWLDFLKSGGSRTPLDTAMLIGADIATEKPLRDTIQFLSDTVDQIISYT         618
```

Based on this analysis, it was predicted that these proteins and their epitopes could be useful antigens for vaccines or diagnostics.

EXAMPLE 323

A DNA sequence (GBSx0353) was identified in *S. agalactiae* <SEQ ID 1045> which encodes the amino acid sequence <SEQ ID 1046>. Analysis of this protein sequence reveals the following:

```
Possible site: 19
>>> May be a lipoprotein

----- Final Results -----
     bacterial membrane --- Certainty = 0.0000 (Not Clear) < succ>
     bacterial outside  --- Certainty = 0.0000 (Not Clear) < succ>
       bacterial cytoplasm --- Certainty = 0.0000 (Not Clear) < succ>
```

The protein has no significant homology with any sequences in the GENPEPT database.

A related DNA sequence was identified in *S. pyogenes* <SEQ ID 1047> which encodes the amino acid sequence <SEQ ID 1048>. Analysis of this protein sequence reveals the following:

```
Possible site: 19
>>> May be a lipoprotein
```

```
----- Final Results -----
        bacterial membrane --- Certainty = 0.0000 (Not Clear) < succ>
         bacterial outside --- Certainty = 0.0000 (Not Clear) < succ>
        bacterial cytoplasm --- Certainty = 0.0000 (Not Clear) < succ>
```

The protein has no significant homology with any sequences in the GENPEPT database.

An alignment of the GAS and GBS proteins is shown below:

```
Identities = 72/127 (56%), Positives = 85/127 (66%)

Query:    1 MKKYIKLFLLTVFATTLVACGQPSTSNKTTTSSTLEVGKVELVVKEDTNVLSEKVVYHKG    60
            + K   K   L + A  LVAC Q +   +TT S       V LVVKEDTN + EKV + KG
Sbjct:    1 VNKRFKTGFLALVAMLLVACSQGTKQIQTTPSVPKADHHVRLVVKEDTNTVDEKVSFGKG    60

Query:   61 DTVLDVLKANYKVKEKDGFITSIDGISQDETKGLYWMFKVNNKLAPKAANQIKVKKNDKI   120
            DTVL+VLK NY+VKEKDGFIT+IDGI QD      YW+FKVN K+A K A+QI VK  D I
Sbjct:   61 DTVLEVLKDNYEVKEKDGFITAIDGIEQDTKANKYWLFKVNGKMADKGADQITVKDGDSI   120

Query:  121 EFYQEVY                                                       127
            EFYQEV+
Sbjct:  121 EFYQEVF                                                       127
```

SEQ ID 1046 (GBS185) was expressed in *E. coli* as a His-fusion product. SDS-PAGE analysis of total cell extract is shown in FIG. 28 (lane 6; MW 15.7 kDa).

Figure 199:
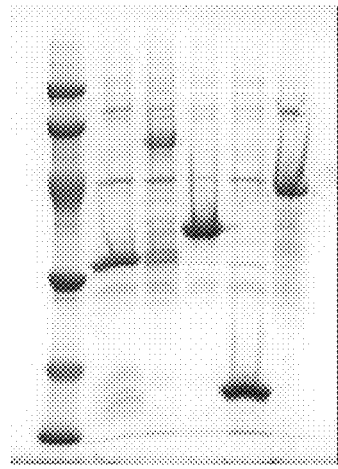

GBS185-His was purified as shown in FIG. 199, lane 8.

Based on this analysis, it was predicted that these proteins and their epitopes could be useful antigens for vaccines or diagnostics.

EXAMPLE 324

A DNA sequence (GBSx0354) was identified in *S. agalactiae* <SEQ ID 1049> which encodes the amino acid sequence <SEQ ID 1050>. Analysis of this protein sequence reveals the following:

```
Possible site: 28
>>> Seems to have a cleavable N-term signal seq.
INTEGRAL Likelihood =  -4.46 Transmembrane   75-91  (67-94)
INTEGRAL Likelihood =  -4.41 Transmembrane   33-49  (30-49)
INTEGRAL Likelihood =  -2.60 Transmembrane   53-69  (52-70)
INTEGRAL Likelihood =  -1.38 Transmembrane  108-124 (106-124)
INTEGRAL Likelihood =  -0.06 Transmembrane  149-165 (149-165)

----- Final Results -----
        bacterial membrane --- Certainty = 0.2784 (Affirmative) < succ>
         bacterial outside --- Certainty = 0.0000 (Not Clear)   < succ>
        bacterial cytoplasm --- Certainty = 0.0000 (Not Clear)   < succ>
```

A related GBS nucleic acid sequence <SEQ ID 9731> which encodes amino acid sequence <SEQ ID 9732> was also identified. A further related GBS nucleic acid sequence <SEQ ID 10929> which encodes amino acid sequence <SEQ ID 10930> was also identified.

The protein has no significant homology with any sequences in the GENPEPT database.

A related DNA sequence was identified in *S. pyogenes* <SEQ ID 1051> which encodes the amino acid sequence <SEQ ID 1052>. Analysis of this protein sequence reveals the following:

```
Possible site: 48
>>> Seems to have a cleavable N-term signal seq.
INTEGRAL Likelihood =  -7.96 Transmembrane   50-66  (49-71)
INTEGRAL Likelihood =  -5.73 Transmembrane  101-117 (99-124)
INTEGRAL Likelihood =  -4.41 Transmembrane  141-157 (139-159)
INTEGRAL Likelihood =  -4.25 Transmembrane   73-89  (67-92)
```

-continued

```
----- Final Results -----
          bacterial membrane --- Certainty = 0.4185 (Affirmative) < succ>
           bacterial outside --- Certainty = 0.0000 (Not Clear) < succ>
         bacterial cytoplasm --- Certainty = 0.0000 (Not Clear) < succ>
```

The protein has no significant homology with any sequences in the GENPEPT database.

An alignment of the GAS and GBS proteins is shown below:

```
Identities = 82/163 (50%), Positives = 120/163 (73%), Gaps = 3/163 (1%)

Query:   10 LTRVAILSALCVVLRYAFAPLPNIQPITAIFLITVVLFDLKEGVATVTITMLVSSFLMGF  69
            ++R+AI+SALCVVLR  F+ LPN+QP+TA  L  ++ F L E V  + + + +S+FL+GF
Sbjct:    6 MSRIAIMSALCVVLRMVFSSLPNVQPVTAFLLSYLLYFGLAEAVLVMMLCLFLSAFLLGF  65

Query:   70 GPWVFLQIISFTLILCLWKFLIYPLTKAVCFGKITEVVLQTFFAGGLGVVYGVIIDTCFA 129
            GPWVF Q+  F L+L LW+F++YPL++    F K  ++  Q F     G++YGV+IDTCFA
Sbjct:   66 GPWVFWQVTCFVLVLLLWRFVLYPLSQQ--FPKY-QLGCQAFLVALCGLLYGVLIDTCFA 122

Query:  130 WLYHMPWWTYVLAGLSFNMAHALSTCLFYPLLLPILRRFRNEK                 172
            +LY MPWW+YVLAG+ FN+AHALST +F+P+++ + RR    E+
Sbjct:  123 YLYSMPWWSYVLAGMPFNIAHALSTLVFFPVVMMLFRRLIGEQ                 165
                                                                     25
```

A related GBS gene <SEQ ID 8549> and protein <SEQ ID 8550> were also identified. Analysis of this protein sequence reveals the following:

```
Lipop: Possible site: -1 Crend: 10
McG: Discrim Score: 6.79
GvH: Signal Score (-7.5): -0.91
Possible site: 28
>>> Seems to have a cleavable N-term signal seq.
ALOM program count: 3 value: -4.46 threshold: 0.0
INTEGRAL Likelihood = -4.46 Transmembrane   35-51 (29-54)
INTEGRAL Likelihood = -1.38 Transmembrane   68-84 (66-84)
INTEGRAL Likelihood = -0.06 Transmembrane 109-125 (109-125)
PERIPHERAL  Likelihood =  7.53  88
modified ALOM score: 1.39

*** Reasoning Step: 3

----- Final Results -----
          bacterial membrane --- Certainty = 0.2784 (Affirmative) < succ>
           bacterial outside --- Certainty = 0.0000 (Not Clear) < succ>
         bacterial cytoplasm --- Certainty = 0.0000 (Not Clear) < succ>
```

The protein has homology with the following sequences in the databases:

```
ORF01220(421-552 of 1002)
GP|9950155|gb|AAG07353.1|AE004814_8|AE004814(16-56 of 69) hypothetical protein
{Pseudomonas aeruginosa}
% Match = 3.2
% Identity = 39.5  % Similarity = 60.5
Matches = 17  Mismatches = 15  Conservative Sub.s = 9

222        252        282        312        342        372        402        432
STLTKLTRVAILSALCVVLRYAFAPLPNIQPITAIFLITVVLFDLKEGVATVTITMLVSSFLMGFGPWVFLQIISFTLIL
                                                                          |:::
                                                                MDPELFEEWMMTGLVTVLI
                                                                         10

462        492        522        552        582        612        642        672
CLWKFLIYPLTKAVCFGKITEVVLQTFFAGGLGVVYGVIIDTCFAWLYHMPWWTYVLAGLSFNMAHALSTCLFYPLLLPI
:   |:::   |       ||       ::|   |||  ||||   |  ||
LFMAFIVWDLAKKSKAGKFGTLIL--FFALGLGV-LGFIIKGLVIGSLEGAGM
       30         40         50         60
```

Based on this analysis, it was predicted that these proteins and their epitopes could be useful antigens for vaccines or diagnostics.

EXAMPLE 325

A DNA sequence (GBSx0355) was identified in *S. agalactiae* <SEQ ID 1053> which encodes the amino acid sequence <SEQ ID 1054>. This protein is predicted to be endolysin. Analysis of this protein sequence reveals the following:

```
Possible site: 28
>>> Seems to have a cleavable N-term signal seq.

----- Final Results -----
              bacterial outside --- Certainty = 0.3000(Affirmative) < succ>
             bacterial membrane --- Certainty = 0.0000(Not Clear)   < succ>
             bacterial cytoplasm --- Certainty = 0.0000(Not Clear)  < succ>
```

The protein has homology with the following sequences in the GENPEPT database:

```
>GP: CAA72266 GB: Y11477 endolysin [Bacteriophage Bastille]
 Identities = 64/210 (30%), Positives = 95/210 (44%), Gaps = 15/210 (7%)

Query:  66 KPIIDVSGWQLPKEIDYDTLSKNISGVVIRVFGGSKISKTNNAAYTTGIDKSFKTHIKEF 125
           K I+D+S     +ID+DT  +S + R  G + +N       +D+ +KT +
Sbjct:  12 KTIVDISHHNA--DIDFDTAKNYVSMFIARTGDGHRYN--SNGELQGVVDRKYKTFVANM  67

Query: 126 QKRNIPVAVYSYALGSSVKEMKEEAQIFYKNAAPYKPTFYWIDVEEETMSNMNKGVQAFR 185
           + R IP   Y +    S V   K+EA+ F+ N     T +  D E   T  NM + +Q F
Sbjct:  68 KARGIPFGNYMFNRFSGVASAKQEAEFFW-NYGDKDATVWVCDAEVSTAPNMKECIQVFI 126

Query: 186 KELKRLGAKNVGIYIGTYFMTEQGISVKGFDAVWIPTYGSDSGYYEAAPQTELKYDLHQY 245
           LK LGAK VG+YIG +   E G      D  WIP YG+  +             DL Q+
Sbjct: 127 DRLKELGAKKVGLYIGHHKYQEFGGKDVNCDFTWIPRYGNKPAF---------ACDLWQW 177

Query: 246 TSQGYLPGFNQPLDLNQIAVNKDKKKTYEK 275
           T  G + G + D+N + +K    EK
Sbjct: 178 TEYGNIAGIGK-CDINVLYGDKPMSFFTEK 206
```

A related DNA sequence was identified in *S. pyogenes* <SEQ ID 1055> which encodes the amino acid sequence <SEQ ID 1056>. Analysis of this protein sequence reveals the following:

```
Possible site: 31
>>> Seems to have an uncleavable N-term signal seq
    INTEGRAL Likelihood = -16.98 Transmembrane 8-24 ( 3-28)

----- Final Results -----
              bacterial membrane --- Certainty = 0.7793(Affirmative) < succ>
              bacterial outside  --- Certainty = 0.0000(Not Clear)   < succ>
              bacterial cytoplasm --- Certainty = 0.0000(Not Clear)  < succ>
```

An alignment of the GAS and GBS proteins is shown below:

```
 Identities = 198/278 (71%), Positives = 225/278 (84%)

Query:    1 MRRRIKPIVVAVFFSLFGLLLIIGHLHSTNTLKKELVEAKKTIPSVKASKVPQKSTSSKD  60
            MRR+IKPIVV VFF L  ++LIIG   + +  +KE+ +AK  IP    ++  K+++S+
Sbjct:    1 MRRKIKPIVVLVFFILLAMVLIIGKRQANHAKQKEVEDAKSHIPIATSNPGKAKTSTSET  60

Query:   61 KEFVLKPIIDVSGWQLPKEIDYDTLSKNISGVVIRVFGGSKISKTNNAAYTTGIDKSFKT 120
            ++F+L PI+DVSGWQLP+EIDYDTLS++ISG ++RV+GGS+I+   NNAA+TTGIDKSFKT
Sbjct:   61 EDFILNPIVDVSGWQLPEEIDYDTLSRHISGAIVRVYGGSQITAHNNAAFTTGIDKSFKT 120
```

```
-continued
Query:  121 HIKEFQKRNIPVAVYSYALGSSVKEMKEEAQIFYKNAAPYKPTFYWIDVEEETMSNMNKG  180
            HIKEFQKRN+PVAVYSYALG S KEMKEEA+ FYKNAAPY PT+YWIDVEE TM +MNKG
Sbjct:  121 HIKEFQKRNVPVAVYSYALGRSTKEMKEEARAFYKNAAPYNPTYYWIDVEEATMKDMNKG  180

Query:  181 VQAFRKELKRLGAKNVGIYIGTYFMTEQGISVKGFDAVWIPTYGSDSGYYEAAPQTELKY  240
            V AFR+ELK+LGA+NVG+YIGTYFM EW IS KGFD+VWIPTYGSDSGYYEAAP T L Y
Sbjct:  181 VTAFREELKKLGAENVGLYIGTYFMAEQDISTKGFDSVWIPTYGSDSGYYEAAPNTTLDY  240

Query:  241 DLHQYTSQGYLPGFNQPLDLNQIAVNKDKKKTYELKFG                        278
            DLHQYTSQGYL GFN  LDLNQIAV KD KKT+EKLFG
Sbjct:  241 DLHQYTSQGYLSGFNNALDLNQIAVTKDTKKTFEKLFG                        278
```

A related GBS gene <SEQ ID 8551> and protein <SEQ ID 8552> were also identified. Analysis of this protein sequence reveals the following:

```
Lipop Possible site: -1 Crend: 5
McG: Discrim Score: 13.20

GvH: Signal Score (-7.5): -0.72
     Possible site: 28

>>> Seems to have a cleavable N-term signal seq.
ALOM program count: 0 value: 7.05 threshold: 0.0
   PERIPHERAL Likelihood = 7.05 196 modified ALOM score: -1.91
*** Reasoning Step: 3

----- Final Results -----
              bacterial outside --- Certainty = 0.3000(Affirmative) < succ>
              bacterial membrane --- Certainty = 0.0000(Not Clear) < succ>
              bacterial cytoplasm --- Certainty = 0.0000(Not Clear) < succ>
```

The protein has homology with the following sequences in the databases:

```
32.4/47.3% over 194aa
Bacteriophage Bastille
GP|1865711| endolysin Insert characterized ORF01218(496 - 1125 of 1446)
GP|1865711|emb|CAA72266.1||Y11477(12 - 206 of 364) endolysin {Bacteriophage Bastille}
% Match = 7.9
% Identity = 32.3  % Similarity = 47.3
Matches = 65  Mismatches = 100  Conservative Sub.s = 30

315       345       375       405       435       465       495       525
VTISIMRRRIKPIVVAVFFSLFGLLLIIGHLHSTNTLKKELVEAKKTIPSVKASKVPQKSTSSKDKEFVLKPIIDVSGWQ
                                                              :|   | |:|:|   :
                                                              MALEANKYPKEKTIVDIS--H
                                                                         10

555       585       615       645       675       705       735       765
LPKEIDYDTLSKNISGVVIRVFGGSKISKTNNAAYTTGIDKSFKTHIKEFQKRNIPVAVYSYALGSSVKEMKEEAQIFYK
  :||:||  :||    |      |        :|:  || :  :  |||   |    |:||:||  :     |:
HNADIDFDT-AKNYVSMFIARTGDGHRYNSN-GELQGVVDRKYKTFVANMKARGIPFGNYMFNRFSGVASAKQEAEFFW-
         30         40        50         60        70        80        90

795       825       855       885       915       945       975      1005
NAAPYKPTFYWIDVEEETMSNMNKGVQAFRKELKRLGAKNVGIYIGTYFMTEQGISVKGFDAVWIPTYGSDSGYYEAAPQ
|       |:   |  :|    ||  ||| ||:|||    |    | | |     |    | ||||   |:
NYGDKDATVWVCDAEVSTAPNMKECIQVFIDRLKELGAKKVGLYIGHHKYQEFGGKDVNCDFTWIPRYG---------NK
         110       120       130       140       150       160

1035      1065      1095      1125      1155      1185      1215      1245
TELKYDLHQYTSQGYLPGXNQPLDLNQIAVNKDKKKTYEKLFGKVKE*KLLLTVAFLINYLLFNSSIERIFWVGFFLSVV
 :    || |:|  | : |  : |:|  :|     || |  |  |      |:   |    : |:  :      ::
PAFACDLWQWTEYGNIAGIGK-CDINVLYGDKPMSFFTEKEGAKETLVPALNKVVTYEVGTNLIPEIQDKLAFLGYEARI
         180       190       200       210       220       230       240
```

SEQ ID 8552 (GBS206) was expressed in *E. coli* as a His-fusion product. SDS-PAGE analysis of total cell extract is shown in FIG. 51 (lane 6; MW 31.7 kDa).

GBS206-His was purified as shown in FIG. 206, lane 6.

Based on this analysis, it was predicted that these proteins and their epitopes could be useful antigens for vaccines or diagnostics.

EXAMPLE 326

A DNA sequence (GBSx0356) was identified in *S. agalactiae* <SEQ ID 1057> which encodes the amino acid sequence <SEQ ID 1058>. Analysis of this protein sequence reveals the following:

```
Possible site: 41
>>> Seems to have no N-terminal signal sequence
     INTEGRAL    Likelihood = -1.44    Transmembrane    183-199 (183-200)

----- Final Results -----
              bacterial membrane --- Certainty = 0.1574(Affirmative) < succ>
              bacterial outside  --- Certainty = 0.0000(Not Clear)   < succ>
            bacterial cytoplasm  --- Certainty = 0.0000(Not Clear)   < succ>
```

A related GBS nucleic acid sequence <SEQ ID 9729> which encodes amino acid sequence <SEQ ID 9730> was also identified.

The protein has homology with the following sequences in the GENPEPT database:

```
>GP: AAG20117 GB: AE005090 NADH dehydrogenase/oxidoreductase-like
protein; NolA [Halobacterium sp. NRC-1]
Identities = 38/156 (24%), Positives = 83/156 (52%), Gaps = 13/156 (8%)

Query:   19 TMEILIAGGSGFLGKQIIKAALTKGHKVAYLSRHEGKGDIFKDPRLTYIRGDITEADKIH   78
            +M++L+ GG+GF+G  + +    +GH V  +R       + D  +T I GD+T  + +
Sbjct:    8 SMDVLVTGGTGFIGTHLCRELDDRGHDVTAFAREPADAALPAD--VTRIVGDVTVKETVA   65

Query:   79 LEDRTFDILIDCIGA---IKPNQLD----ELNVKATQKAVALCHKNQIPKLVYISA----  127
               D +++ +       KP+ D     ++++ T+ VA   +   ++ +SA
Sbjct:   66 NAIDGHDAVVNLVALSPLFKPSGGDSRHLDVHLGGTENVVAAASEAGVEYILQLSALDAD  125

Query:  128 NSGYSAYIKSKRKAEQIIKASGLDYLFVRPGLMYGE                         163
            +G +AY+++K +AE+ +++S L +  VRP +++G+
Sbjct:  126 PTGPTAYLRAKGRAEEAVRSSDLHHTIVRPSVVFGD                         161
```

No corresponding DNA sequence was identified in *S. pyogenes*.

A related GBS gene <SEQ ID 8553> and protein <SEQ ID 8554> were also identified. Analysis of this protein sequence reveals the following:

```
Lipop Possible site: -1 Crend: 5
McG: Discrim Score: -7.99
GvH: Signal Score (-7.5): -6.34
     Possible site: 41
>>> Seems to have no N-terminal signal sequence
ALOM program count: 1 value: -1.44 threshold: 0.0
     INTEGRAL      Likelihood = -1.44    Transmembrane    183-199 (183-200)
     PERIPHERAL    Likelihood =  4.29        20
modified ALOM score: 0.79
*** Reasoning Step: 3

----- Final Results -----
              bacterial membrane --- Certainty = 0.1574(Affirmative) < succ>
              bacterial outside  --- Certainty = 0.0000(Not Clear)   < succ>
            bacterial cytoplasm  --- Certainty = 0.0000(Not Clear)   < succ>
RGD motif 68-70
```

The protein has homology with the following sequences in the databases:

```
32.5/54.4% over 274aa
Schizosaccharomyces pombe
GP|3395590| hypothetical protein Insert characterized
PIR|T41177|T41177 hypothetical protein SPCC1840.09 - fission yeast Insert
characterized ORF01216(358-990 of 1272)
GP|3395590|emb|CAA20132.1||AL031179(1-275 of 276) hypothetical protein
{Schizosaccharomyces pombe} PIR|T41177|T41177 hypothetical protein SPCC1840.09 -
fission yeast (Schizosaccharomyces pombe)
% Match = 7.3
% Identity = 32.4   % Similarity = 54.3
Matches = 71   Mismatches = 88   Conservative Sub.s. = 48

144          174          204          234          264          294          324          354
        *L**ISTDS*K*A*IPFQGIMIINIATVLFGMLN*KFYK*LNMKCPDVMT*NHTVVRY*TITLTRHIKISILNLQNEGEG 384          414          444          474          504          534          564
        TMEILIAGGSGPLGKQIIKAALTKGHKVAYLSRHEGKGDIFKDPRLTYIRGDITEADKIHLEDRTFDILIDCIGAI----
        |:|:: ||||||   |  |: ||::|   :||     |    |:|   :   : :|   |      :     ::|  |      :
        MKIVVLGGSGPLGHNICKLAIAKGYEVVSVSRRGAGGLHNKEPWMDDVEWETLDAQK--DPNSLLPVLRDASAVVNSVG
                 10           20           30           40           50           60           70

585          615                       648          678
        ---------------------------------------KPNQLDELNVKATQKAV---------ALCHKNQIPKLVYIS
                                                ||   :    |  | :|:            :    |  :|   |:|
        ILMENNYKKILQNPRGPVSHLINSLSSNMFKTGQNPLAPKPEEAKQSKNKVTFEAINRDLAIETAKIAAKANVPVYCYVS
                  90          100          110          120          130          140          150

699          726          753          783          810          840          846          876
        ANS---GYSA-YIKSKRKAE-QIIKASGLDYLFVRPGLMYG-EERPLSIFQAKCIKLFSHL--------PFLGIVVQKVF
        |::   |   |||::||:||   :|  |      |  :|:|||:||  ::||::     |           |||
        AHAAAPGLDPRYIKTKREAEREISKISNLRSIFLRPGFMYNFNDRPFTGALASLFTVSSSINRATSGALNFLGTASAEPL
                 170          180          190          200          210          220          230

930          960          990         1020         1050         1080         1110
        PTK-VVIVA-EAIVTTLRKKPTQKILSIEELNNK*FIKKATVNSSFYSFTFPKSFS*VFFLSLLTAI*FKSSG*LXPGR*
        |:: | :  |||        |  |    | ::  ::| | | :|:
        PSEEVALAALEAISDPSVKGPVE-ISELKSMAHK-FKQKSL
                 250          260          270
```

Figure 55:
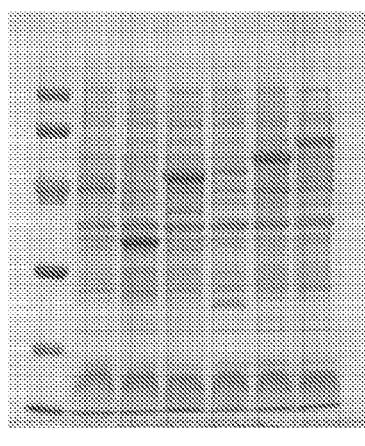

SEQ ID 8554 (GBS303) was expressed in *E. coli* as a His-fusion product. SDS-PAGE analysis of total cell extract is shown in FIG. 51 (lane 5; MW 28.3 kDa). It was also expressed in *E. coli* as a GST-fusion product. SDS-PAGE analysis of total cell extract is shown in FIG. 55 (lane 5; MW 53.2 kDa).

Figure 275:
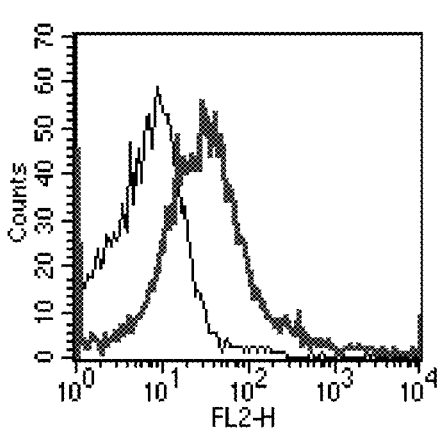

The GBS303-GST fusion product was purified (FIG. 207, lane 6) and used to immunise mice. The resulting antiserum was used for FACS (FIG. 275), which confirmed that the protein is immunoaccessible on GBS bacteria.

Based on this analysis, it was predicted that these proteins and their epitopes could be useful antigens for vaccines or diagnostics.

EXAMPLE 327

A DNA sequence (GBSx0357) was identified in *S. agalactiae* <SEQ ID 1059> which encodes the amino acid sequence <SEQ ID 1060>. Analysis of this protein sequence reveals the following:

```
Possible site: 4
>>> Seems to have no N-terminal signal sequence

----- Final Results -----
            bacterial cytoplasm --- Certainty = 0.2850(Affirmative) < succ>
            bacterial membrane  --- Certainty = 0.0000(Not Clear)   < succ>
            bacterial outside   --- Certainty = 0.0000(Not Clear)   < succ>
```

The protein has homology with the following sequences in the GENPEPT database:

```
>GP: AAC36853 GB: L23802 regulatory protein [Enterococcus faecalis]
   Identities = 61/164 (37%), Positives = 96/164 (58%), Gaps = 13/164 (7%)

Query:   1 MSKKNKIKKTLVDQILDKAKIEH---------DSLQLDALQGDLPNGIQKQDIFKTLALI   51
           M+KK   +KT  +++++ K+ +           D L  +++   L  GI+K  IFKTL +
Sbjct:   1 MAKKKTQQKTNAMRMVEQHKVPYKEYEFAWSEDHLSAESVAESL--GIEKGRIFKTLVTV   58

Query:  52 GDKTGPIIGILPLTEHLSEKKLAKISGNKKVQMIPQKDLQKITGYIHGANNPIGIRQKHN   111
           G+KTGP++  ++P  + L   KKLAK SGNKKV+M+   KDL+   TGIY G   +P G+   K
Sbjct:  59 GNKTGPVVAVIPGNQELDLKKLAKSAGNKKVEMLHLKDLEATTGYIRGGCSPTGM--KKQ   116

Query: 112 YPIFIDTIALEKQELIVSAGEIGRSIRINSEVLADFVNAKFADI                  155
           +P  ++   A +   +IVSAG+ G   I +  E +    N +FA+I
Sbjct: 117 FPTYLAEEAQQYSAIIVSAGKRGMQIELAPEAILSLTNGQFAEI                  160
```

A related DNA sequence was identified in *S. pyogenes* <SEQ ID 1061> which encodes the amino acid sequence <SEQ ID 1062>. Analysis of this protein sequence reveals the following:

```
Possible site: 30
>>> Seems to have no N-terminal signal sequence

----- Final Results -----
            bacterial cytoplasm --- Certainty = 0.2651(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below:

```
 Identities = 114/157 (72%), Positives = 139/157 (87%)

Query:   1 MSKKNKIKKTLVDQILDKAKIEHDSLQLDALQGDLPNGIQKQDIFKTLALIGDKTGPIIG   60
           M+KK K+VVTLV+QILDKA I H  L+L+AL+GD P+ +Q  DI+KTLAL GD+TGP+IG
Sbjct:   1 MAKKTKLKKTLVEQILDKANIAHQGLKLNALEGDFPDDLQPSDIYKTLALTGDQTGPLIG   60

Query:  61 ILPLTEHLSEKKLAKISGNKKVQMIPQKDLQKITGYIHGANNPIGIRQKHNYPIFIDTIA  120
           I+PLTEHLSEK+LAK+SGNKKV M+PQKDLQK TGYIHGANNP+GIRQKH+YPIFID A
Sbjct:  61 IIPLTEHLSEKQLAKVSGNKKVSMVPQKDLQKTTGYIHGANNPVGIRQKHSYPIFIDQTA  120

Query: 121 LEKQELIVSAGEIGRSIRINSEVLADFVNAKFADIKE                        157
           LEK ++IVSAGE+GRSI+I+S+ LADFV A FAD+K+
Sbjct: 121 LEKGQIIVSAGEVGRSIKISSQALADFVGASFADLKK                        157
```

Based on this analysis, it was predicted that these proteins and their epitopes could be useful antigens for vaccines or diagnostics.

EXAMPLE 328

A DNA sequence (GBSx0358) was identified in *S. agalactiae* <SEQ ID 1063> which encodes the amino acid sequence <SEQ ID 1064>. Analysis of this protein sequence reveals the following:

```
Possible site: 28
>>> Seems to have no N-terminal signal sequence

----- Final Results -----
            bacterial cytoplasm --- Certainty = 0.4719(Affirmative) < succ>
             bacterial membrane --- Certainty = 0.0000(Not Clear)   < succ>
              bacterial outside --- Certainty = 0.0000(Not Clear)   >c succ>
```

A related GBS nucleic acid sequence <SEQ ID 8555> which encodes amino acid sequence <SEQ ID 8556> was also identified. This protein belongs to the glycolysis/gluconeogenesis pathway, and such proteins have been experimentally detected as surface-exposed in Streptococci. The protein has homology with the following sequences in the GENPEPT database:

```
>GP: AAD36444 GB: AE001791 phosphoglycerate mutase [Thermotoga maritima]
 Identities = 65/191 (34%), Positives = 93/191 (48%), Gaps = 13/191 (6%)

Query:   5 MKFYLVRHGKTQWNLEGRFQGANGDSPLLEEAIEELEELGQYLSSIHFDAVYSSDLGRAR   64
           MK YL+RHG+T WN +G +QG     D PL E   E+ +L  + DA+YSS R+
Sbjct:   1 MKLYLIRHGETIWNEKGLWQGVT-DVPLNERGREQARKLANSLKRV--DAIYSSPLKRSL   57

Query:  65 DTVNILNDANSCPKEIHYTPQLREWALGTLEGCKIATMQAIYPRQMTAFYQNPLQFKHDM  124
           +T   + A     KEI     LRE    G +        YP +   +  +P       M
Sbjct:  58 ETAEEI--ARRFEKEIIVEEDLRECEISLWNGLTVEEAIREYPVEFKKWSSDP---NFGM  112

Query: 125 FGAESLYQTTHRVESFLRSLASK----NYDKVLIVGHGANLTASIRSLLGYQYGSLHYKD  180
           G ES+    +RV   + S+        + V+IV H +L A I   +LG         LH
Sbjct: 113 EGLESMRNVQNRVVKAIMKIVSQEKLNGSENVVISHSLSLRAFICWILGLPL-YLHRNF  171
```

```
-continued
Query: 181 KLDNASLTIIE                                                     191
            KLDNASL+++E
Sbjct: 172 KLDNASLSVVE                                                     182
```

A related DNA sequence was identified in *S. pyogenes* <SEQ ID 1065> which encodes the amino acid sequence <SEQ ID 1066>. Analysis of this protein sequence reveals the following:

```
Possible site: 24
>>> Seems to have no N-terminal signal sequence

----- Final Results -----
            bacterial cytoplasm --- Certainty = 0.3628(Affirmative) < succ>
            bacterial membrane  --- Certainty = 0.0000(Not Clear)   < succ>
             bacterial outside  --- Certainty = 0.0000(Not Clear)   < succ>
```

An alignment of the GAS and GBS proteins is shown below:

```
Identities = 127/205 (61%), Positives = 152/205 (73%)

Query:   5 MKFYLVRHGKTQWNLEGRFQGANGDSPLLEEAIEELEELGQYLSSIHFDAVYSSDLGRAR    64
           MK Y VRHGKT WNLEGRFQGA GDSPLLEEA +E+  LG+ L+ + FDAVY+SDL RA
Sbjct:   1 MKLYFVRHGKTLWNLEGRFQGAGGDSPLLEEAKDEIHLLGKELAKVAFDAVYTSDLQRAM   60

Query:  65 DTVNILNDANSCPKEIHYTPQLREWALGTLEGCKIATMQAIYPRQMTAFYQNPLQFKHDM   124
           T  I+ DA      ++++T QLREW LG LEG KIATM AIYP+QM AF +N   QFK D
Sbjct:  61 ATAAIILDAFDQQPKLYHTDQLREWRLGKLEGAKIATMAAIYPQQMLAFRENLAQFKPDQ  120

Query: 125 FGAESLYQTTHRVESFLRSLASKNYDKVLIVGHGANLTASIRSLLGYQYGSLHYKDKLDN   184
           F AES+YQTT RV   ++S   K+Y VLIVGHGANLTA+IRSLLG++    L  K  LDN
Sbjct: 121 FEAESIYQTTQRVCHLIQSFKDKHYQNVLIVGHGANLTATIRSLLGFEPALLLAKGGLDN  180

Query: 185 ASLTIIETHDFKDFNCLTWNDKSYL                                    209
           ASLTI+ET D+  ++CL WNDKS+L
Sbjct: 181 ASLTILETKDYLTYDCLIWNDKSFL                                    205
```

SEQ ID 8556 (GBS314) was expressed in *E. coli* as a His-fusion product. SDS-PAGE analysis of total cell extract is shown in FIG. 51 (lane 4; MW 27.2 kDa) and in FIG. 169 (lane 15-17; MW 41.6 kDa) and in FIG. 239 (lane 4; MW 41.6 kDa). It was also expressed in *E. coli* as a GST-fusion product. SDS-PAGE analysis of total cell extract is shown in FIG. 55 (lane 4; MW 52.1 kDa).

Based on this analysis, it was predicted that these proteins and their epitopes could be useful antigens for vaccines or diagnostics.

EXAMPLE 329

A DNA sequence (GBSx0359) was identified in *S. agalactiae* <SEQ ID 1067> which encodes the amino acid sequence <SEQ ID 1068>. Analysis of this protein sequence reveals the following:

```
Possible site: 56
>>> Seems to have no N-terminal signal sequence

----- Final Results -----
            bacterial cytoplasm --- Certainty = 0.3014(Affirmative) < succ>
            bacterial membrane  --- Certainty = 0.0000(Not Clear)   < succ>
             bacterial outside  --- Certainty = 0.0000(Not Clear)   < succ>
```

The protein has homology with the following sequences in the GENPEPT database:

```
>GP: CAB12562 GB: Z99108 similar to hypothetical proteins
[Bacillus subtilis]
Identities = 69/232 (29%), Positives = 108/232 (45%), Gaps = 9/232 (3%)

Query:    4 SIVFDVDDTIYDQQAPYRIAVEKCFPDFDMSAINQAYIRFRHYSDIGFPRVMAGEWTTEY   63
            +++FDVDDTI D QA   +A+   F D ++   N    +++ +   +     G+ T +
Sbjct:    6 TLLFDVDDTILDFQAAEALALRLLFEDQNIPLTNDMKAQYKTINQGLWRAFEEGKMTRDE   65

Query:   64 FRFWRCKETLLEFGYREIDEATGIYFQEIYEHELENITMLDEMRMTLDFLKSKNVPMGII  123
             R   L E+GY     EA G  ++ Y   LE    L+      L    +    + I+
Sbjct:   66 VVNTRFSALLKEYGY----EADGALLEQKYRRFLEEGHQLIDGAFDLISNLQQQFDLYIV  121

Query:  124 TNGPTEHQLKKVKKLGLYDYVDPKRVIVSQATGFQKPEKEIFNLAAEQF-DMNPSTTLYV  182
            TNG +  Q K+++  GL+ +    K + VS+ TGFQKP KE FN    E+    +  TL +
Sbjct:  122 TNGVSHTQYKRLRDSGLFPFF--KDIFVSEDTGFQKPMKEYFNYVFERIPQFSAEHTLII  179

Query:  183 GDSYDNDIMGAFNGGWHSMWFNHRGRSLKPGIKPVYDVAIDNFEQLFGAVKV          234
            GDS   DI G    G +W N  +     P I P Y+   I    E+L+  + +
Sbjct:  180 GDSLTADIKGGQLAGLDTCWMNPDMKPNVPEIIPTYE--IRKLEELYHILNI          229
```

A related DNA sequence was identified in *S. pyogenes* <SEQ ID 1069> which encodes the amino acid sequence <SEQ ID 1070>. Analysis of this protein sequence reveals the following:

```
Possible site: 56
>>> Seems to have no N-terminal signal sequence

----- Final Results -----
           bacterial cytoplasm --- Certainty = 0.3216(Affirmative) < succ>
            bacterial membrane --- Certainty = 0.0000(Not Clear)   < succ>
             bacterial outside --- Certainty = 0.0000(Not Clear)   < succ>
```

An alignment of the GAS and GBS proteins is shown below:

```
Identities = 276/300 (92%), Positives = 292/300 (97%)

Query:    1 MITSIVFDVDDTIYDQQAPYRIAVEKCFPDFDMSAINQAYIRFRHYSDIGFPRVMAGEWT   60
            MIT+IVFDVDDTIYDQQAPYRIA+EKCFPDFDMS +NQAYIRFRHYSD+GFPRVMAGEWT
Sbjct:    1 MITAIVFDVDDTIYDQQAPYRIAMEKCFPDFDMSVMNQAYIRFRHYSDVGFPRVMAGEWT   60

Query:   61 TEYFRFWRCKETLLEFGYREIDEATGIYFQEIYEHELENITMLDEMRMTLDFLKSKNVPM  120
            TEYFRFWRCKETLLEFGYREIDEA G++FQE+YEHELENITMLDEMRMTLDFLKSKNVPM
Sbjct:   61 TEYFRFWRCKETLLEFGYREIDEAAGVHFQEVYEHELENITMLDEMRMTLDFLKSKNVPM  120

Query:  121 GIITNGPTEHQLKKVKKLGLYDYVDPKRVIVSQATGFQKPEKEIFNLAAEQFDMNPSTTL  180
            GIITNGPTEHQLKKV+KLGLYDY+D KRVIVSQATGFQKPEKEIFNLAAEQFDMNP TTL
Sbjct:  121 GIITNGPTEHQLKKVRKLGLYDYIDAKRVIVSQATGFQKPEKEIFNLAAEQFDMNPQTTL  180

Query:  181 YVGDSYDNDIMGAFNGGWHSMWFNHRGRSLKPGIKPVYDVAIDNFEQLFGAVKVLFDLPD  240
            YVGDSYDNDIMGAFNGGWHSMWFNHRGR LKPG KPVYDVAIDNFEQLFGAVKVLFDLPD
Sbjct:  181 YVGDSYDNDIMGAFNGGWHSMWFNHRGRQLKPGTKPVYDVAIDNFEQLFGAVKVLFDLPD  240

Query:  241 NKFIFDINDKSNPVLEMGLNNGLMMAAERLLESNMSVDKVVILLRLTAKQEKVLRMKYAR  300
            NKFIFD+NDK NP+L+MG+NNGLMMAAERLLESNMS+DKVVILLRLT +QEKVLR+KYAR
Sbjct:  241 NKFIFDVNDKKNPILQMGINNGLMMAAERLLESNMSIDKVVILLRLTKQQEKVLRLKYAR  300
```

Based on this analysis, it was predicted that these proteins and their epitopes could be useful antigens for vaccines or diagnostics.

EXAMPLE 330

A DNA sequence (GBSx0360) was identified in *S. agalactiae* <SEQ ID 1071> which encodes the amino acid sequence <SEQ ID 1072>. Analysis of this protein sequence reveals the following:

```
Possible site: 34
>>> Seems to have no N-terminal signal sequence
```

```
                           -continued
----- Final Results -----
          bacterial cytoplasm --- Certainty = 0.2451(Affirmative) < succ>
           bacterial membrane --- Certainty = 0.0000(Not Clear)   < succ>
            bacterial outside --- Certainty = 0.0000(Not Clear)   < succ>
```

A related GBS nucleic acid sequence <SEQ ID 9727> which encodes amino acid sequence <SEQ ID 9728> was also identified.

The protein has homology with the following sequences in the GENPEPT database:

```
>GP: CAB11858 GB: Z99104 lysyl-tRNA synthetase [Bacillus subtilis]
Identities = 318/490 (64%), Positives = 390/490 (78%), Gaps = 1/490 (0%)

Query:  44 EELNDQQIVRREKMAALTEQGIDPFGKRFERTATSGQLNEKYADKSKEDLHDIEETATIA 103
           EELNDQ  VRR+KM L + GIDPFG RFERT   S ++    Y D +KE+L +     TIA
Sbjct:   9 EELNDQLQVRRDKMNQLRDNGIDPFGARFERTHQSQEVISAYQDLTKEELEEKAIEVTIA  68

Query: 104 GRLMTKRGKGKVGFAHIQDREGQIQIYVRKDSVGEENYEIFKKADLGDFLGVEGQVMRTD 163
           GR+MTKRGKGK GFAH+QD EGQIQIYVRKDSVG++ YEIFK +DLGD +GV G+V +T+
Sbjct:  69 GRMMTKRGKGKAGFAHLQDLEGQIQIYVRKDSVGDDQYEIFKSSDLGDLIGVTGKVFKTN 128

Query: 164 MGELSIKATHITHLSKALRPLPEKFHGLTDIETIYRKRHLDLISNRDSFDRFVTRSKIIS 223
           +GELS+KAT    L+KALRPLP+K+HGL D+E  YR+R+LDLI N DS    F+TRSKII
Sbjct: 129 VGELSVKATSFELLTKALRPLPDKYHGLKDVEQRYRQRYLDLIVNPDSKHTFITRSKIIQ 188

Query: 224 EIRRFMDSNGFLEVETPVLHNEAGGASARPFITHHNAQDIDMVLRIATELHLKRLIVGGM 283
            +RR++D +G+LEVETP +H+   GGASARPFITHHNA DI + +RIA ELHLKRLIVGG+
Sbjct: 189 AMRRYLDDHGYLEVETPTMHSIPGGASARPFITHHNALDIPLYMRIAIELHLKRLIVGGL 248

Query: 284 ERVYEIGRIFRNEGMDATHNPEFTSIEAYQAYADYQDIMDLTEGIIQHVTKTVKGDGPIN 343
           E+VYEIGR+FRNEG+    HNPEFT  IE Y+AYADY+DIM LTE ++ H+ + V G   I
Sbjct: 249 EKVYEIGRVFRNEGVSTRHNPEFTMIELYEAYADYKDIMSLTENLVAHIAQEVLGTTTIQ 308

Query: 344 YQGTEIKINEPFKRVHMVDAVKEITGIDFWKEMTLEEAQALAQEKNVPLEKHFTTVGHII 403
           Y   +I +     +KR+HMVDAVKE TG+DFW+E+T+E+A+  A+E  V + K    TVGHII
Sbjct: 309 YGEEQIDLKPEWKRIHMVDAVKEATGVDFWEEVTVEQAREYAKEHEVEI-KDSMTVGHII 367

Query: 404 NAFFEEFVEDTLIQPTFVFGHPVEVSPLAKKNDTDPRFTDRFELFIMTKEYANAFTELND 463
           N  FFE+ +E+TLIQPTF++GHPVE+SPLAKKN  DPRFTDRFELFI+ +E+ANAFTELND
Sbjct: 368 NEFFEQKIEETLIQPTFIYGHPVEISPLAKKNPEDPRFTDRFELFIVGREHANAFTELND 427

Query: 464 PIDQLSRFEAQASAKELGDDEATGVDYDYVEALEYGMPPTGGLGIGIDRLCMLLTDTTTI 523
           PIDQ  RFEAQ    +E G+DEA  +D D+VEALEYGMPPTGGLGIGIDRL MLLT+  +I
Sbjct: 428 PIDQRERFEAQLKEREAGNDEAHLMDEDFVEALEYGMPPTGGLGIGIDRLVMLLTNAPSI 487

Query: 524 RDVLLFPTMK                                                   533
           RDVLLFP M+
Sbjct: 488 RDVLLFPQMR                                                   497
```

A related DNA sequence was identified in *S. pyogenes* <SEQ ID 1073> which encodes the amino acid sequence <SEQ ID 1074>. Analysis of this protein sequence reveals the following:

```
Possible site: 45
>>> Seems to have no N-terminal signal sequence

----- Final Results -----
          bacterial cytoplasm --- Certainty = 0.4694(Affirmative) < succ>
           bacterial membrane --- Certainty = 0.0000(Not Clear)   < succ>
            bacterial outside --- Certainty = 0.0000(Not Clear)   < succ>
```

An alignment of the GAS and GBS proteins is shown below:

```
 Identities = 439/500 (87%), Positives = 474/500 (94%)

Query:  34 LEEIMSNQHIEELNDQQIVRREKMAALTEQGIDPFGKRFERTATSGQLNEKYADKSKEDL  93
           LEE MSNQHIEELNDQQIVRREKM AL EQGIDPFGKRF+RTA S +L EKYADK+KE+L
Sbjct:   1 LEENMSNQHIEELNDQQIVRREKMTALAEQGIDPFGKRFDRTANSAELKEKYADKTKEEL  60

Query:  94 HDIEETATIAGRLMTKRGKGKVGFAHIQDREGQIAIYVRKDSVGEENYEIFKKADLGDFL 153
```

```
                H++  ETA +AGRLMTKRGKGVGFAH+QDREGQIQ+YVRKDSVGE+NYEIFKKADLGDF+
Sbjct:   61 HELNETAIVAGRLMTKRGKGKVGFAHLQDREGQIQLYVRKDSVGEDNYEIFKKADLGDFI   120

Query:  154 GVEGQVMRTDMGELSIKATHITHLSKALRPLPEKFHGLTDIETIYRKRHLDLISNRDSFD   213
            GVEG+VMRTDMGELSIKAT +THLSK+LRPLPEKFHGLTDIETIYRKRHLDLISNR+SFD
Sbjct:  121 GVEGEVMRTDMGELSIKATKLTHLSKSLRPLPEKFHGLTDIETIYRKRHLDLISNRESFD   180

Query:  214 RFVTRSKIISEIRRFMDSNGFLEVETPVLHNEAGGASARPFITHHNAQDIDMVLRIATEL   273
            RFVTRSK+ISEIRR++D     FLEVETPVLHNEAGGA+ARPF+THHNAQ+IDMVLRIATEL
Sbjct:  181 RFVTRSKMISEIRRYLDGLDFLEVETPVLHNEAGGAAARPFVTHHNAQNIDMFLRIATEL   240

Query:  274 HLKRLIVGGMERVYEIGRIFRNEGMDATHNPEFTSIEAYQAYADYQDIMDLTEGIIQHVT   333
            HLKRLIVGGMERVYEIGRIFRNEGMDATHNPEFTSIE YQAYADY DIM+LTEGIIQH
Sbjct:  241 HLKRLIVGGMERVYEIGRIFRNEGMDATHNPEFTSIEVYQAYADYLDIMNLTEGIIQHAA   300

Query:  334 KTVKGDGPINYQGTEIKINEPFKRVHMVDAVKEITGIDFWKEMTLEEAQALAQEKNVPLE   393
            K V+GDGPI+YQGTEI+INEPFKRVHMVDA+KE+TG DFW EMT+EEA ALA+EK VPLE
Sbjct:  301 KAVRGDGPIDYQGTEIRINEPFKRVHMVDAIKEVTGADFWPEMTVEEAIALAKEKQVPLE   360

Query:  394 KHFTTVGHIINAFFEEFVEDTLIQPTFVFGHPVEVSPLAKKNDTDPRFTDRFELFIMTKE   453
            KHF +VGHIINAFFEEFVE+TL+QPTFVFGHPVEVSPLAKKN D RFTDRFELFIMTKE
Sbjct:  361 KHFISVGHIINAFFEEFVEETLVQPTFVFGHPVEVSPLAKKNPEDTRFTDRFELFIMTKE   420

Query:  454 YANAFTELNDPIDQLSRFEAQASAKELGDDEATGVDYDYVEALEYGMPPTGGLGIGIDRL   513
            YANAFTELNDPIDQLSRFEAQA AKELGDDEATG+DYD+VEALEYGMPPTGGLGIGIDRL
Sbjct:  421 YANAFTELNDPIDQLSRFEAQAQAKELGDDEATGIDYFDVEALEYGMPPTGGLGIGIDRL   480

Query:  514 CMLLTDTTTIRDVLLRPTMK                                           533
            CMLLT+TTTIRDVLL PTMK
Sbjct:  481 CMLLTNTTTIRDVLLFPTMK                                           500
```

Based on this analysis, it was predicted that these proteins and their epitopes could be useful antigens for vaccines or diagnostics.

EXAMPLE 331

A DNA sequence (GBSx0361) was identified in *S. agalactiae* <SEQ ID 1075> which encodes the amino acid sequence <SEQ ID 1076>. This protein is predicted to be 6,7-dimethyl-8-ribityllumazine synthase (ribH). Analysis of this protein sequence reveals the following:

```
Possible site: 34
>>> Seems to have no N-terminal signal sequence

----- Final Results -----
         bacterial cytoplasm --- Certainty = 0.1042(Affirmative) < succ>
         bacterial membrane  --- Certainty = 0.0000(Not Clear)   < succ>
          bacterial outside  --- Certainty = 0.0000(Not Clear)   < succ>
```

The protein has homology with the following sequences in the GENPEPT database:

```
>GP: CAB14257 GB: Z99116 riboflavin synthase (beta subunit)
[Bacillus subtilis]
 Identities = 103/151 (68%), Positives = 120/151 (79%)

Query:    1 MTIIEGQLVANEMKIGIVVSRFNELITSKLLSGAVDGLLRHGVSEEDIDIVWVPGAFEIP    60
            M II+G LV  +KIGIVV RFN+ ITSKLLSGA D LLRHGV   DID+ WVPGAFEIP
Sbjct:    1 MNIIQGNLVGTGLKIGIVVGRFNDFITSKLLSGAEDALLRHGVDTNDIDVAWVPGAFEIP    60

Query:   61 YMARKMALYKDYDAIICLGVVIKGSTDHYDYVCNEVTKGIGHLNSQSDIPHIFGVLTTDN   120
            + A+KMA  K YDAII LG VI+G+T HYDYVCNE   KGI   + + +P IFG++TT+N
Sbjct:   61 FAAKKMAETKKYDAIITLGTVIRGATTHYDYVCNEAAKGIAQAANTTGVPVIFGIVTTEN   120

Query:  121 IEQAIERAGTKAGNKGYDCALSAIEMVNLDK                               151
            IEQAIERAGTKAGNKG DCA+SAIEM NL++
Sbjct:  121 IEQAIERAGTKAGNKGVDCAVSAIEMANLNR                               151
```

No corresponding DNA sequence was identified in *S. pyogenes*.

Based on this analysis, it was predicted that this protein and its epitopes, could be useful antigens for vaccines or diagnostics.

EXAMPLE 332

A DNA sequence (GBSx0362) was identified in *S. agalactiae* <SEQ ID 1077> which encodes the amino acid sequence <SEQ ID 1078>. This protein is predicted to be GTP cyclohydrolase ii (ribA/B). Analysis of this protein sequence reveals the following:

```
Possible site: 20
>>> Seems to have no N-terminal signal sequence

----- Final Results -----
          bacterial cytoplasm --- Certainty = 0.1918(Affirmative) < succ>
          bacterial membrane  --- Certainty = 0.0000(Not Clear)   < succ>
          bacterial outside   --- Certainty = 0.0000(Not Clear)   < succ>
```

A related GBS nucleic acid sequence <SEQ ID 9725> which encodes amino acid sequence <SEQ ID 9726> was also identified.

The protein has homology with the following sequences in the GENPEPT database:

```
>GP: AAA86524 GB: U27202 GTP cyclohydrase II/
          3,4-dihydroxy-2-butanone-4-phosphate synthase
          [Actinobacillus pleuropneumoniae]
 Identities = 230/395 (58%), Positives = 307/395 (77%)

Query:  19 FSPIKKLLQDIKSGKMVVLMDDENRENEGDLICAAEMVTKESINFMAKFGKGLICLPLSN   78
           FS ++  ++ I+ GK++++ DDE+RENEGD ICAAE  T E+INFMA +GKGLIC P+S
Sbjct:   6 FSKVEDAIEAIRQGKIILVTDDEDRENEGDFICAAEFATPENINFMATYGKGLICTPIST   65

Query:  79 YYAEKLELAQMASHNTDNHETAFTISIDHLSTSTGISAEDRALTAKMVANDSSKAKFDRR  138
              A+KL    M + N DNHETAFT+S+DH+ T TGISA +R++TA   + +D++KA DFRR
Sbjct:  66 EIAKKLNFHPMVAVNQDNHETAFTVSVDHIDTGTGISAFERSITAMKIVDDNAKATDFRR  125

Query: 139 PGHLFPLLAKEGGVLARNGHTEATVDLCRLAGLKECGLCCEIMAEDGSMMRKDELLAFAQ  198
           PGH+FPL+AKEGGVL RNGHTEATVDL RLAGLK   GLCCEIMA+DG+MM   +L  FA
Sbjct: 126 PGHMFPLIAKEGGVLVRNGHTEATVDLARLAGLKHAGLCCEIMADDGTMMTMPDLQKFAV  185

Query: 199 KHDLAIATIKQLQDYRRQEEGGVVREIEIQLPTQFGHFTAYGYSEVVANKEHVALVKGDI  258
            +H++    TI+QLQ+YRR+ + V +    +++PT++G F A+ + EV++ KEHVALVKGD+
Sbjct: 186 EHNMPFITIQQLQEYRRKHDSLVKQISVVKMPTKYGEFMAHSFVEVISGKEHVALVKGDL  245

Query: 259 SSGEDVLCRLHSECLTGDVFHSLRCDCGEQLANALQQIEAEGRGVLLYMRQEGRGIGLIN  318
           +  GE VL R+HSECLTGD F S RCDCG+Q A A+ QIE EGRGV+LY+RQEGRGIGLIN
Sbjct: 246 TDGEQVLARIHSECLTGDAFGSQRCDCGQQFAAAMTQIEQEGRGVILYLRQEGRGIGLIN  305

Query: 319 KLKAYHLQEEGLDTLEANLALGFEGDERDYGVSAQLLKDLGINSINLLTNNPDKIQQLEA  378
           KL+AY LQ++G+DT+EAN+ALGF+ DER+Y + AQ+  + LG+ SI LLTNNP KI+ L+
Sbjct: 306 KLRAYELQDKGMDTVEANVALGFKEDEREYYIGAQMFQQLGVKSIRLLTNNPAKIEGLKE  365

Query: 379 EGICVKNRVPLQVAVTAYDLNYLKTKKEKMGHLLD                           413
            +G+ +  R P+ V    D++YLK K+ KMGH+ +
Sbjct: 366 QGLNIVAREPIIVEPNKNDIDYLKVKQIKMGHMFN                           400
```

No corresponding DNA sequence was identified in *S. pyogenes*.

Based on this analysis, it was predicted that these proteins and their epitopes could be useful antigens for vaccines or diagnostics.

EXAMPLE 333

A DNA sequence (GBSx0363) was identified in *S. agalactiae* <SEQ ID 1079> which encodes the amino acid sequence <SEQ ID 1080>. This protein is predicted to be riboflavin synthase alpha chain (ribE). Analysis of this protein sequence reveals the following:

```
Possible site: 59
>>> Seems to have no N-terminal signal sequence

----- Final Results -----
          bacterial cytoplasm --- Certainty = 0.3517(Affirmative) < succ>
          bacterial membrane  --- Certainty = 0.0000(Not Clear)   < succ>
          bacterial outside   --- Certainty = 0.0000(Not Clear)   < succ>
```

A related GBS nucleic acid sequence <SEQ ID 9723> which encodes amino acid sequence <SEQ ID 9724> was also identified.

The protein has homology with the following sequences in the GENPEPT database:

```
>GP: BAB05274 GB: AP001512 riboflavin synthase alpha subunit
[Bacillus halodurans]
 Identities = 98/216 (45%), Positives = 147/216 (67%), Gaps = 2/216 (0%)

Query:   1 MFTGIIEEMGQVSRIRNGIKSQQLSIDAPKLVPLLRKGDSVAVNGVCLTVLDKSETAFIA   60
           MFTGIIE++G + I+   ++ ++I + K+V ++ GDS+AVNGVCLTV   ++T F
Sbjct:   1 MFTGIIEDVGTIDAIQQTGEAIVMTITSKKIVSDVQLGDSIAVNGVCLTVTSFTDTQFTV   60

Query:  61 DVMPESMMRTSLAALRLHSKVNLELALRSDSRLGGHFVLGHVDGVGKIEKIQKDDIAVRF  120
           D+MPE++  TSL L    S+VNLE A+ ++ R GGH V GHVDG+G I K ++ D AV +
Sbjct:  61 DLMPETVRATSLRLLSKGSRVNLERAMVANGRFGGHIVSGHVDGIGTIRKKERKDNAVYY  120

Query: 121 SIDAPPSIMSYIIEKGSVALDGISLTVVSFTEHSFEVSVIPHTMAQTNLSLKKVGDLLNI  180
           +I+   S+   Y+I KGSVA+DG SLT+    ++ +F +S+IPHTM +T + LKK GD++NI
Sbjct: 121 TIEVSSSLRRYMIHKGSVAVDGTSLTIFDVSDKTFTISIIPHTMEETIIGLKKAGDIVNI  180

Query: 181 EVDLVGKYAEKFLAPTNRTNHTSSVMDWSFLSENGY                         216
           E D++GKY E+F+    N    +  +FL+E+GY
Sbjct: 181 ECDLIGKYIEQFVQQGKPVNEGG--LTKAFLTEHGY                         214
```

No corresponding DNA sequence was identified in S. pyogenes.

Based on this analysis, it was predicted that these proteins and their epitopes could be useful antigens for vaccines or diagnostics.

EXAMPLE 334

A DNA sequence (GBSx0364) was identified in S. agalactiae <SEQ ID 1081> which encodes the amino acid sequence <SEQ ID 1082>. This protein is predicted to be riboflavin-specific deaminase (ribD). Analysis of this protein sequence reveals the following:

```
Possible site: 30
>>> Seems to have no N-terminal signal sequence
    INTEGRAL Likelihood = -1.01 Transmembrane 307-323 ( 307-323)

----- Final Results -----
            bacterial membrane --- Certainty = 0.1404(Affirmative) < succ>
            bacterial outside  --- Certainty = 0.0000(Not Clear)   < succ>
            bacterial cytoplasm --- Certainty = 0.0000(Not Clear)  < succ>
```

The protein has homology with the following sequences in the GENPEPT database:

```
>GP: AAA86522 GB: U27202 riboflavin-specific deaminase
[Actinobacillus pleuropneumoniae]
 Identities = 182/353 (51%), Positives = 259/353 (72%)

Query:   6 DYMALALKEAEKGMGFVAPNPLVGAVIVKDDRIISKGYHKRFGDLHAERQAIKNADEDIS   65
           DYM A+ A++G+G+  PVPLVG VIVK+ I+++GYH++ G  HAER A+ +  ED+S
Sbjct:  51 DYMRRAIALAKQGLGWTNPNPLVGCVIVKNGEIVAEGYHEKIGGWHAERNAVLHCKEDLS  110

Query:  66 GSTLYVTLEPCCHVGKQPPCTEALIKSGIKKVVVGSLDPNPLVSGKIALLRKEGLNVEV  125
           G+T YVTLEPCCH G+ PPC++ LI+ GIKKV +GS DPNPLV+G+G    LR+ G+ V
Sbjct: 111 GATAYVTLEPCCHHGRTPPCSDLLIERGIKKVFIGSSDPNPLVAGRGANQLRQAGVEVVE  170

Query: 126 GILREECDALNERFIFHMTYKQPFVYLKYAMTLDGKIATKTGDSKWISNEHSRQSVQKLR  185
           G+L+EECDALN  F   ++ K+P+V+ +KYAMT DGKIAT +G+SKWI+ E +R  VQ+ R
Sbjct: 171 GLLKEECDALNPIFFHYIQTKRPYVLMKYAMTADGKIATGSGESKWITGESARARVQQTR  230

Query: 186 QKCSAIMVGINTVLADNPRLTCRIPKGEALVRIVCDSQLKIPLDSYLVKSAKTIPTWIAT  245
           +  SAIMVG++TVLADNP L  R+P +   VRIVCDSQL+ PLD  LV++AK   T IAT
Sbjct: 231 HQYSAIMVGVDTVLADNPMLNSRMPNAKQPVRIVCDSQLRTPLDCQLVQTAKEYRTVIAT  290

Query: 246 CSDNLAQQQTLKEMGCRLIKVPRKDGKLDLKVLMTILGQEGIDSLLIEGGSSLHFSALKA  305
           SD+L + + + +G ++    ++ ++DL+ L+  LG+  IDSLL+EGGSSL+FSAL++
```

```
                                 -continued
Sbjct: 291 VSDDLQKIEQFRPLGVDVLVCKARNKRVDLQDLLQKLGEMQIDSLLLEGGSSLNFSALES   350

Query: 306 GIVNRLIVFIAPKIIGGLKAKTAISGEGLDWLNQARFVKDIELSRMDSDVVIE             358
           GIVNR+   +IAPK++GG +AKT I GEG+  ++QA ++K       +  D++++
Sbjct: 351 GIVNRVHCYIAPKLVGGKQAKTPIGGEGIQQIDQAVKLKLKSTELIGEDILLD             403
```

A related DNA sequence was identified in *S. pyogenes* <SEQ ID 1083> which encodes the amino acid sequence <SEQ ID 1084>. Analysis of this protein sequence reveals the following:

```
Possible site: 25
>>> Seems to have no N-terminal signal sequence
    INTEGRAL Likelihood = -1.17 Transmembrane 88-104 ( 88-105)

----- Final Results -----
              bacterial membrane --- Certainty = 0.1468(Affirmative) < succ>
                bacterial outside --- Certainty = 0.0000(Not Clear)  < succ>
              bacterial cytoplasm --- Certainty = 0.C000(Not Clear)  < succ>
```

The protein has homology with the following sequences in the databases:

```
>GP: CAB11794 GB: Z99104 similar to hypothetical proteins
[Bacillus subtilis]
Identities = 71/161 (44%), Positives = 109/161 (67%)

Query:  13 LEEQTYFMQEALKEAEKSLQKAEIPIGCVIVKDGEIIGRGHNAREESNQAIMHAEMMAIN    72
           + +   +M+EA+KEA+K+ +K E+PIG V+V +GEII R HN RE    ++I AHEM+ I+
Sbjct:   1 MTQDELYMKEAIKEAKKAEEKGEVPIGAVLVINGEIIARAHNLRETEQRSIAHAEMLVID    60

Query:  73 EANAHEGNWRLLDTTLFVTEIPCVMCSGAIGLARIPHVIYGASNQKFGGVDSLYQILTDE   132
           EA    G WRL   TL+VT+EPC MC+GA+ L+R+ V++GA + K G    +L  +L +E
Sbjct:  61 EACKALGTWRLEGATLYVTLEPCPMCAGAVVLSRVEKVVFGAFDPKGGCSGTLMNLLQEE   120

Query: 133 RLNHRVQVERGLLAADCANIMQTFFRQGRERKKIAKHLIKE                     173
           R NH+ +V  G+L  +C  ++ FFR+ R++KK A+   + E
Sbjct: 121 RFNHQAEVVSGVLEEECGGMLSAFFRELRKKKKAARKNLSE                     161
```

An alignment of the GAS and GBS proteins is shown below:

```
 Identities = 48/146 (32%), Positives = 71/146 (47%), Gaps = 21/146 (14%)

Query:   7 YMALALKEAEKGMGFVAPNPLVGAVIVKDDRIISKGYHKRFGD----LHAERQAIKNADE    62
           +M  ALKEAEK +   A  P +G VIVKD  II +G++ R        +HAE  AI  A+
Sbjct:  19 FMQEALKEAEKSLQ-KAEIP-IGCVIVKDGEIIGRGHNAREESNQAIMHAEMMAINEANA    76

Query:  63 D------ISGSTLYVTLEPCCHVGKQPPCTEALIKSGIKKVVVGSLDPNPLVSGKGIALLR   117
           +       +TL+VT+EPC         C+ A+  + I  V+ G+ +              +L
Sbjct:  77 HEGNWRLLDTTLFVTIEPCV------MCSGAIGLARIPHVIYGASNQKFGGVDSLYQILT   130

Query: 118 KEGLN----VEVGILREECDALNERF                                    139
           +E LN----VE G+L  +C  + + F
Sjbct: 131 DERLNHRVQVERGLLAADCANIMQTF                                    156
```

Based on this analysis, it was predicted that these proteins and their epitopes could be useful antigens for vaccines or diagnostics.

EXAMPLE 335

A DNA sequence (GBSx0365) was identified in *S. agalactiae* <SEQ ID 1085> which encodes the amino acid sequence <SEQ ID 1086>. This protein is predicted to be Nramp metal ion transporter. Analysis of this protein sequence reveals the following:

```
Possible site: 43
>>> Seems to have no N-terminal signal sequence
    INTEGRAL Likelihood = -11.89 Transmembrane 169-185 ( 160-191)
```

```
                               -continued
    INTEGRAL Likelihood = -11.09 Transmembrane 140-156 ( 128-165)
    INTEGRAL Likelihood =  -6.85 Tranamembrane  359-375 ( 354-379)
    INTEGRAL Likelihood =  -6.48 Transmernbrane 269-285 ( 263-287)
    INTEGRAL Likelihood =  -6.16 Transmembrane 426-442 ( 423-445)
    INTEGRAL Likelihood =  -5.57 Transmembrane  62-78 ( 58-80)
    INTEGRAL Likelihood =  -4.94 Transmembrane 107-123 ( 103-127)
    INTEGRAL Likelihood =  -4.46 Transmembrane 391-407 ( 389-408)
    INTEGRAL Likelihood =  -4.35 Transmembrane 310-326 ( 307-328)

----- Final Results -----
            bacterial membrane  --- Certainty = 0.5755(Affirmative) < succ>
             bacterial outside  --- Certainty = 0.0000(Not Clear)   < succ>
           bacterial cytoplasm  --- Certainty = 0.0000(Not Clear)   < succ>
```

The protein has homology with the following sequences in the GENPEPT database:

```
>GP: AAF83825 GB: AE003939 manganese transport protein
[Xylella fastidiosa]
Identities = 192/436 (44%), Positives = 274/436 (62%),
Gaps = 14/436 (3%)

Query:   10 SLSEVNQSVEVPHNSSFWNTLRAFLGPGALVAVGYMDPGNWITSVIGGATYRYLLLFVVL   69
            SL E++ SV V      +  L AFLGPG +V+VGYMDPGNW T + GG+ + Y+LL V+L
Sbjct:   39 SLGEMHASVAVSRRGHWGFRLLAFLGPGYMVSVGYMDPGNWATGLAGGSRFGYMLLSVIL   98

Query:   70 VSSLMAMQLQQMAGKLGIVTRQDLAQATASRLPKPLRYLLFIIIELALIATDLAEVIGSA  129
            +S++MA+ LQ +A +LGI +  DLAQA  +R  +      L+++ ELA+IA DLAEVIG+A
Sbjct:   99 LSNVMAIVLQALAARLGIASDMDLAQACRARYSRGTTLALWVVCELAIIACDLAEVIGTA  158

Query:  130 IALHLLFGWPLLLSIMITILDVFLLLLLMKLGVQKIEAFVSVLILTILIIFTYLVVLSQP  189
            IAL+LL G P++  ++IT +DV L+LLLM   G +  EAFV  L+L  I     F   +VL+ P
Sbjct:  159 IALNLLLGVPIIWGVVITAVDVVLVLLLMHRGFRALEAFVIALLLVIFGCFVVQIVLAAP  218

Query:  190 DLDAMFKGFLPHHELFNISHEGKNSPLTLALGIIGATVMPHNLYLHSSLSQTRRVDYHNK  249
               L  +  GF+P  ++             L  LA+GI+GATVMPHNLYLHSS+ QTR   +
Sbjct:  219 PLQEVLGGFVPRWQVV-----ADPQALYLAIGIVGATVMPHNLYLHSSIVQTRAYP-RTP  272

Query:  250 SSIKKAVRFMTLDSNIQLSLAFVVNSLLLVLGASLFYG-HANDISAFSQMYLALSDKTIT  308
               + A+R+   DS + LA +N+ +L+L A++F+  H  D+    Q Y  L+
Sbjct:  273 VGRRSALRWAVADSTLALMLALFINASILILAAAVFHAQHHFDVEEIEQAYQLLAPVLGV  332

Query:  309 GAVASSFLSTLFAVALLASGQNSTITGTLTGQIVMEGFLHFKLPQWLIRLCTRLLTLLPI  368
            G  A    TLFA ALLASG  NST+T TL GQIVMEGFL +L WL R+ TR L ++P+
Sbjct:  333 GVAA-----TLFATALLASGINSTVTATLAGQIVMEGFLRLRLRPWLRRVLTRGLAIVPV  387

Query:  369 FVIALLVGGEENTLDQLIVYSQVFLSLALPFSIFPLIYFTSQKSIMGEHANAKWNTYLAY  428
                  V+  L G E   +L++  SQV LS+ LPF++ PL+   + + +MG      +W    +A+
Sbjct:  388 IVVVALYG--EQGTGRLLLLSQVILSMQLPFAVIPLLRCVADRKVMGALVAPRWLMVVAW  445

Query:  429 LVAIILTLLNLKLIMD                                              444
            L+A ++ +LN+KL+ D
Sbjct:  446 LIAGVIVVLNVKLLGD                                              461
```

Based on this analysis, it was predicted that this protein and its epitopes, could be useful antigens for vaccines or diagnostics.

EXAMPLE 336

A DNA sequence (GBSx0366) was identified in *S. agalactiae* <SEQ ID 1087> which encodes the amino acid sequence <SEQ ID 1088>. Analysis of this protein sequence reveals the following:

```
Possible site: 54
>>> Seems to have a cleavable N-term signal seq.
    INTEGRAL      Likelihood = -14.12      Transmembrane   113-129 (98-132)
    INTEGRAL      Likelihood = -12.15      Transmembrane   228-244 (220-249)
    INTEGRAL      Likelihood = -10.83      Transmembrane   175-191 (167-195)
    INTEGRAL      Likelihood =  -5.04      Transmembrane    57-73  (55-75)
    INTEGRAL      Likelihood =  -3.93      Transmembrane   146-162 (142-166)
    INTEGRAL      Likelihood =  -1.38      Transmembrane   199-215 (199-215)
```

```
                              -continued
  INTEGRAL    Likelihood = -0.32    Transmembrane    82-98 (82-98)

----- Final Results -----
             bacterial membrane --- Certainty = 0.6647(Affirmative) < succ>
             bacterial outside  --- Certainty = 0.0000(Not Clear)   < succ>
             bacterial cytoplasm --- Certainty = 0.0000(Not Clear)   < succ>
```

The protein has homology with the following sequences in the GENPEPT database:

```
>GP: AAF11325 GB: AE002018 hypothetical protein
[Deinococcus radiodurans]
Identities = 63/215 (29%), Positives = 108/215 (49%),
Gaps = 13/215 (6%)

Query:  11 LLLVFILTIIVNYLSATGFLTGNSQKSLSDRYQTLLTPAPLAFSIWSVIYL-LTFLVILR   69
           LL   +LT++VNYLS   L GNS    +SDR    TPA L F++W  I+L L    + +
Sbjct:  10 LLAATVLTLVVNYLSNALPLFGNSNAEVSDRLPNAFTPAGLTFTVWGPIFLGLLVFAVYQ   69

Query:  70 AIFSKSQSYQDNFASIFPYFLGLLLVNNIWTVFFTSNLIGLSTIIIFAYCILLV-IIIKI  128
           A+ ++  + D      +P+ LG LL N   W + F S   IGLS +I+ A   +LV + +
Sbjct:  70 ALPAQRGARLDRL--FWPFLLGNLL-NVAWLLAFQSLNIGLSVVIMLALLAVLVRLYLSV  126

Query: 129 LS---KNKSKLLLRITFGIHAGWLLVASLVNLAVYLVKI----DFNYPLPKVYIAIIALI  181
           S   +   + L++  ++  W+ VA++ N+   +LV        F      V+ A++ ++
Sbjct: 127 RSLPPQGAERWTLQLPVSLYLAWISVATIANITAFLVSAGVTQSFLGIAGPVWSALLLVV  186

Query: 182 FITVLSLYLARVLQNAYLILSVFWAWLMVFKAHLE                          216
              +L R    A+ + + WA+ V+ A E
Sbjct: 187 AAAIGVFFLWRFRDYAFAAV-LLWAFYGVYVARPE                          220
```

No corresponding DNA sequence was identified in *S. pyogenes*.

Based on this analysis, it was predicted that this protein and its epitopes, could be useful antigens for vaccines or diagnostics.

EXAMPLE 337

A DNA sequence (GBSx0367) was identified in *S. agalactiae* <SEQ ID 1089> which encodes the amino acid sequence <SEQ ID 1090>. Analysis of this protein sequence reveals the following:

```
Possible site: 36
>>> Seems to have no N-terminal signal sequence

----- Final Results -----
             bacterial cytoplasm --- Certainty = 0.3401(Affirmative) < succ>
             bacterial membrane  --- Certainty = 0.0000(Not Clear)   < succ>
             bacterial outside   --- Certainty = 0.0000(Not Clear)   < succ>
```

The protein has homology with the following sequences in the GENPEPT database:

```
>GP: AAC65352 GB: AE001215 T. pallidum predicted coding region
TP0352 [Treponema pallidum]
Identities = 28/64 (43%), Positives = 41/64 (63%)

Query:   3 EFTFEIVEKLLVLSENEKGWTKELNRVSFNGAPAKFDLRTWSPDHTKMGKGITLSNEEFK   62
           +F +E+       LS +  GW+ EL  +S+NG P K+D+R WSPD +KMGKG+TL+  E
Sbjct:  12 DFHYEVTRNWGTLSTSGNGWSLELKSISWNGRPEKYDIRAWSPDKSKMGKGVTLTRAEIV   71

Query:  63 VILD                                                         66
           + D
Sbjct:  72 ALRD                                                         75
```

A related DNA sequence was identified in *S. pyogenes* <SEQ ID 1091> which encodes the amino acid sequence <SEQ ID 1092>. Analysis of this protein sequence reveals the following:

```
Possible site: 36
>>> Seems to have no N-terminal signal sequence

----- Final Results -----
            bacterial cytoplasm --- Certainty = 0.4021(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below:

```
Identities = 59/70 (84%), Positives = 64/70 (91%)

Query:   1 MSEFTFEIVEKLLVLSENEKGWTKELNRVSFNGAPAKFDLRTWSPDHTKMGKGITLSNEE   60
           M+EFTF I E LL LSEN+KGWTKELNRVSFNGA AK+D+RTWSPDHTKMGKGITL+NEE
Sbjct:   1 MAEFTFNIEEHLLTLSENDKGWTKELNRVSFNGAEAKWDIRTWSPDHTKNGKGITLTNEE   60

Query:  61 FKVILDAFRK                                                    70
           FK ILDAFRK
Sbjct:  61 FKTILDAFRK                                                    70
```

Based on this analysis, it was predicted that these proteins and their epitopes could be useful antigens for vaccines or diagnostics.

EXAMPLE 338

A DNA sequence (GBSx0368) was identified in *S. agalactiae* <SEQ ID 1093> which encodes the amino acid sequence <SEQ ID 1094>. Analysis of this protein sequence reveals the following:

```
Possible site: 61
>>> Seems to have no N-terminal signal sequence
     INTEGRAL      Likelihood = -2.66     Transmembrane    92-108 (92-110)

----- Final Results -----
             bacterial membrane --- Certainty = 0.2062(Affirmative) < succ>
              bacterial outside --- Certainty = 0.0000(Not Clear)   < succ>
            bacterial cytoplasm --- Certainty = 0.0000(Not Clear)   < succ>
```

The protein has homology with the following sequences in the GENPEPT database:

```
>GP: CAB14676 GB: Z99117 similar to protease [Bacillus subtilis]
Identities = 201/407 (49%), Positives = 277/407 (67%), Gaps = 2/407 (0%)

Query:    4 VKKRPEVLSPAGTLEKLKVAIDYGADAVFVGGQAYGLRSRAGNFSMEELQEGINYAHARD    63
            + K+PE+L+PAG LEKLK+A+ YGADAVF+GGQ YGLRS A NF++EE+ EG+ +A
Sbjct:   18 ITKKPELLAPAGNLEKLKIAVHYGADAVFIGGQEYGLRSNADNFTIEEIAEGVEFAKKYG    77

Query:   64 AKVYVAANMVTHEGNELGAGPWFRELRDMGLDAVIVSDPALIVICATEAPGLEIHLSTQA   123
            AK+YV  N+  H N G    + + L D  +  +IV+DP +I  C   AP +E+HLSTQ
Sbjct:   78 AKIYVTTNIFAHNENMDGLEDYLKALGDANVAGIIVADPLIIETCRRVAPNVEVHLSTQQ   137

Query:  124 SSTNYETFEFWKEMGLTRVVLAREVTMAELAEIRKRTDVEIEAFVHGAMCISYSGRCVLS   183
            S +N++   +FWKE GL RVVLARE +   E+ E++++ D+EIE+F+HGAMCI+YSGRCVLS
Sbjct:  138 SLSNWKAVQFWKEEGLDRVVLARETSALEIREMKEKVDIEIESFIHGAMCIAYSGRCVLS   197

Query:  184 NHMSHRDANRGGCSQSCRWKYDLYDMPFGQERQSLKGEIPEPFSMSAVDMCMIEHIPDMI   243
            NHM+ RD+NRGGC QSCRW YDLY   G    +L GE   PF+MS  D+ +IE IP MI
Sbjct:  198 NHMTARDSNRGGCCQSCRWDYDLYQTD-GANAVALYGEEDAPFAMSPKDLKLIESIPKMI   256

Query:  244 ENGVDSLKIEGRMKSIHYVSTVTNCYKAAVDAYMESPEAFEAIKEDLIDELWKVAQRELA   303
            E G+DSLKIEGRMKSIHYV+TV + Y+  +DAY    PE F  I+++ ++EL K A R+ A
Sbjct:  257 EMGIDSLKIEGRMKSIHYVATVVSVYRKVIDAYCADPENF-VIQKEWLEELDKCANRDTA   315

Query:  304 TGFYYHTPTENEQLFGARRKIPQYKFVGEVVSFDNAKMEATIRQRNVIMEGDRVEFYGPG   363
            T F+   TP   EQ+FG  K   Y FVG V+++D    T++QRN  +GD VEF+GP
Sbjct:  316 TAFFEGTPGYEEQMFGEHAKKTTYDFVGLVLNYDEDTQMVTLQQRNFFKKGDEVEFFGPE   375
```

-continued

```
Query:  364 FRHFECFIDGLRDAEGNKIDRAPNPMELLTITLPNPVKKGDMIRACK              410
            +F    I+  +  D  +GN++D A  +P++++     L    +   +M+R   K
Sbjct:  376 IENFTHTIETIWDEDGNELDAARHPLQIVKFKLDKKIYPSNMMRKGK              422
```

A related DNA sequence was identified in *S. pyogenes* <SEQ ID 1095> which encodes the amino acid sequence <SEQ ID 1096>. Analysis of this protein sequence reveals the following:

```
Possible site: 61
>>> Seems to have no N-terminal signal sequence
      INTEGRAL       Likelihood = -2.66       Transmembrane    92-108 (92-110)

----- Final Results -----
                bacterial membrane  --- Certainty = 0.2062(Affirmative) < succ>
                 bacterial outside  --- Certainty = 0.0000(Not Clear)   < succ>
                bacterial cytoplasm --- Certainty = 0.0000(Not Clear)   < succ>
```

The protein has homology with the following sequences in the databases:

```
>GP: BAB04993 GB: AP001511 protease [Bacillus halodurans]
Identities = 201/403 (49%), Positives = 280/403 (68%), Gaps = 4/403 (0%)

Query:    6 KRPEVLSPAGTLEKLKVAIDYGADAVFVGGQAYGLRSRAGNFSMEELQEGIDYAHARGAK   65
            K+PE+L+PAG+LEKLKVAI YGADAV++GGQ +GLRS A NFS+EE++EG+++A+  GAK
Sbjct:   17 KKPELLAPAGSLEKLKVAIHYGADAVYIGGQEFGLRSNADNFSIEEMREGVEFANKYGAK   76

Query:   66 VYVAANMVTHEGNEIGAGEWFRQLRDMGLDAVIVSDPALIVICSTEAPGLEIHLSTQASS  125
            VYV  N+   H  N  G   E+    L+++G+    +IV+DP +I  C    AP +E+HLSTQ S
Sbjct:   77 VYVTTNIYAHNENMDGLEEYLSALQEVGVTGIIVADPLIIETCKRVAPKVEVHLSTQQSL  136

Query:  126 TNYETFEFWKAMGLTRVVLAREVNMAELAEIRKRTDVEIEAFVHGAMCISYSGRCVLSNH  185
             +N+    +FWK  GL RVVLAREV + E+ E++K   D+EIE FVHGAMCISYSGRCVLSNH
Sbjct:  137 SNWLAVKFWKEEGLHRVVLAREVGLEEMLEMKKHVDIEIETFVHGAMCISYSGRCVLSNH  196

Query:  186 MSHRDANRGGCSQSCRWKYDLYDMPFGGE-RRSLKGEIPEDYSMSSVDMCMIDHIPDLIE  244
            M+   RD+NRGGC QSCRW YDLY+        E    +G++P  Y+MS  D+  +I   IP LIE
Sbjct:  197 MTARDSNRGGCCQSCRWDYDLYEQQDSAEIPLFAEGDVP--YTMSPKDLNLIQAIPQLIE  254

Query:  245 NGVDSLKIEGRMKSIHYVSTVTNCYKAAVGAYMESPEAFYAIKEELIDELWKVAQRELAT  304
              G+DSLK+EGRMKSIHYV+TVT+ Y+  + AY     P+  F    IK E  ++EL  K A  R+ A
Sbjct:  255 AGIDSLKVEGRMKSIHYVATVTSVYRKVIDAYCSDPDNF-KIKREWLEELEKCANRDFAP  313

Query:  305 GFYYGIPTENEQLFGARRKIPQYKFVGEVVAFDSASMTATIRQRNVIMEGDRIECYGPGF  364
              F+  G PT  EQ++G     K   +Y FVG V+  ++     +   T++QRN    +GD +E +GP
Sbjct:  314 QFFEGTPTYKEQMYGIHPKRTKYDFVGLVLDYNEKTGIVTLQQRNHFKQGDEVEFFGPEI  373

Query:  365 RHFETVVKDLHDADGQKIDRAPNPMELLTISLPREVKPGDMIR                  407
                F     V+ +  + D  DG   ++A  +P++++     +  ++V P  +M+R
Sbjct:  374 NRFTQTVEKIWDEDGNELDAARHPLQIVKFKVDQKVYPQNMMR                  416
```

An alignment of the GAS and GBS proteins is shown below:

```
Identities = 386/427 (90%), Positives = 404/427 (94%)

Query:    1 MSNVKKRPEVLSPAGTLEKLKVAIDYGADAVFVGGQAYGLRSRAGNFSMEELQEGINYAH   60
            MS++KKRPEVLSPAGTLEKLKVAIDYGADAVFVGGQAYGLRSRAGNFSMEELQEGI+YAH
Sbjct:    1 MSHMKKRPEVLSPAGTLEKLKVAIDYGADAVFVGGQAYGLRSRAGNFSMEELQEGIDYAH   60

Query:   61 ARDAKVYVAANMVTHEGNELGAGPWFRELRDMGLDAVIVSDPALIVICATEAPGLEIHLS  120
            AR AKVYVAANMVTHEGNE+GAG WFR+LRDMGLDAVIVSDPALIVIC TEAPGLEIHLS
Sbjct:   61 ARGAKVYVAANMVTHEGNEIGAGEWFRQLRDMGLDAVIVSDPALIVICSTEAPGLEIHLS  120

Query:  121 TQASSTNYETFEFWKEMGLTRVVLAREVTMAELAEIRKRTDVEIEAFVHGAMCISYSGRC  180
            TQASSTNYETFEFWK MGLTRVVLAREV MAELAEIRKRTDVEIEAFVHGAMCISYSGRC
Sbjct:  121 TQASSTNYETFEFWKAMGLTRVVLAREVNMAELAEIRKRTDVEIEAFVHGAMCISYSGRC  180

Query:  181 VLSNHMSHRDANRGGCSQSCRWKYDLYDMPFGQERQSLRGEIPEPFSMSAVDMCMIEHIP  240
            VLSNHMSHRDANRGGCSQSCRWKYDLYDMPFG ER+SLKGEIPE +SMS+VDMCMI+HIP
Sbjct:  181 VLSNHMSHRDANRGGCSQSCRWKYDLYDMPFGGERRSLKGEIPEDYSMSSVDMCMIDHIP  240
```

```
Query: 241 DMIENGVDSLKIEGRMKSIHYVSTVTNCYKAAVDAYMESPEAFEAIKEDLIDELWKVAQR 300
            D+IENGVDSLKIEGRNKSIHYVSTVTNCYKAAV AYMESPEAF AIKE+LIDELWKVAQR
Sbjct: 241 DLIENGVDSLKIEGRMKSIHYVSTVTNCYKAAVGAYMESPEAFYAIKEELIDELWKVAQR 300

Query: 301 ELATGFYYHTPTENEQLFGARRKIPQYKFVGEVVSFDNAKMEATIRQRNVIMEGDRVEFY 360
            ELATGFYY  PTENEQLFGARRKIPQYKFVGEVV+FD+A M ATIRQRNVIMEGDR+E Y
Sbjct: 301 ELATGFYYGIPTENEQLFGARRKIPQYKFVGEVVAFDSASMTATIRQRNVIMEGDRIECY 360

Query: 361 GPGFRHFECFIDGLRDAEGNKIDPAPNPMELLTITLPNPVKKGDMIRACKEGLVNLYQND 420
            GPGFRHFE  +  L DA+G KIDRAPNPMELLTI+LP  VK GDMIRACKEGLVNLYQ D
Sbjct: 361 GPGFRHFETVVRDLHDADGQKIDRAPNPMELLTISLPREVKPGDMIRACKEGLVNLYQKD 420

Query: 421 GTSKTVR 427
            GTSKTVR
Sbjct: 421 GTSKTVR 427
```

Figure 69:
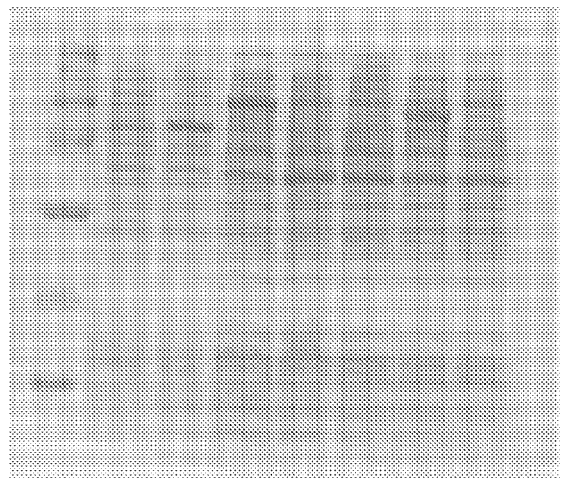
Figure 72:
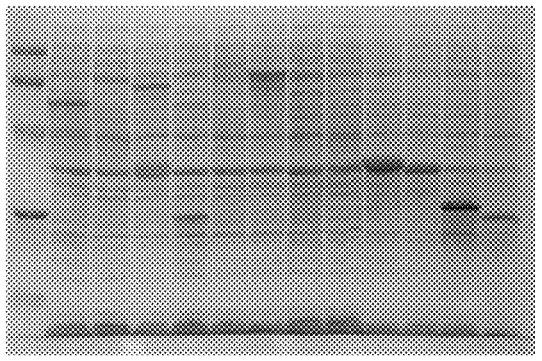

SEQ ID 1094 (GBS385) was expressed in *E. coli* as a His-fusion product. SDS-PAGE analysis of total cell extract is shown in FIG. 69 (lane 3; MW 50 kDa). It was also expressed in *E. coli* as a GST-fusion product. SDS-PAGE analysis of total cell extract is shown in FIG. 72 (lane 7; MW 75.7 kDa).

Figure 312:
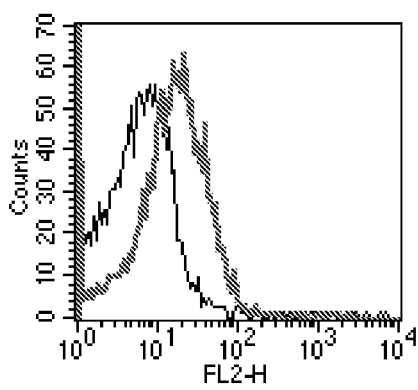

The GBS385-GST fusion product was purified (FIG. 213, lane 7) and used to immunise mice. The resulting antiserum was used for FACS (FIG. 312), which confirmed that the protein is immunoaccessible on GBS bacteria.

Based on this analysis, it was predicted that these proteins and their epitopes could be useful antigens for vaccines or diagnostics.

EXAMPLE 339

A DNA sequence (GBSx0369) was identified in *S. agalactiae* <SEQ ID 1097> which encodes the amino acid sequence <SEQ ID 1098>. This protein is predicted to be collagenase. Analysis of this protein sequence reveals the following:

```
Possible site: 43
>>> Seems to have no N-terminal signal sequence

----- Final Results -----
         bacterial cytoplasm --- Certainty = 0.2208(Affirmative) < succ>
         bacterial membrane  --- Certainty = 0.0000(Not Clear)   < succ>
         bacterial outside   --- Certainty = 0.0000(Not Clear)   < succ>
```

The protein has homology with the following sequences in the GENPEPT database:

```
>GP: CAB14677 GB: Z99117 similar to protease [Bacillus subtilis]
Identities = 92/304 (30%), Positives = 161/304 (52%), Gaps = 5/304 (1%)

Query:   1 MEKIILTATAESIEQVKQLLAIGIDRIYVGEENYGLRLPHSFSDDELREIAKLVHDAGKE  60
           M+K  L T S   + L+ G    VGE+ YGLRL  FS +++ +  ++ H  G +
Sbjct:   1 MKKPELLVTPTSTADILPLIQAGATAFLVGEQRYGLRLAGEFSREDVTKAVEIAHKEGAK 60

Query:  61 LTVACNALMHQEMMDNIKPFLELMKEINVDYLVVGDAGVFYINKRDGYNFKLIYDTSVFV 120
           + VA NA+ H + +   +L  + E VD  V GD  V  +     +  + KL  + T
Sbjct:  61 VYVAVNAIFHNDKVGELGEYLAFLAEAGVDAAVFGDPAVLMAARESAPDLKLHWSTETTG 120

Query: 121 TSSRQVNFWGQHGAVETVLAREIPSEELFKMSENLEFPAEILVYGASVIHHSKRPLLQNY 180
           T+    N+WG+ GA  +VLARE+ + +  ++ EN E   EI V+G + +  SKR L+ NY
Sbjct: 121 TNYYTCNYWGRKGAARSVLARELNMDSIVEIKENAEVEIEIQVHGMTCMFQSKRSLIGNY 180

Query: 181 YNF---THITDEKTRERGLFLAEPGQFESHYSIYEDKHGTHIFINNDINMMTKVTELVEH 237
           + +        + K +E G+FL +  +  ++  Y I+ED++GTHI   ND+ ++ ++EL++
Sbjct: 181 FEYQGKVMDIERKKKESGMFLHDK-ERDNKYPIFEDENGTHIMSPNDVCIIDELEELIDA 239

Query: 238 HFTHWKLDGIYCPGDNFVAIAEIFVETARL-IENGTFTQDQAFLFDERIRKLHPKGRGLD 296
            +K+DG+   + +   + +++ E  L +EN  + +  + ERI  + P R +D
Sbjct: 240 GIDSFKIDGVLKMPEYLIEVTKMYREAIDLCVENRDEYEAKKEDWIERIESIQPVNRKID 299

Query: 297 TGFY 300
           TGF+
Sbjct: 300 TGFF 303
```

A related GBS nucleic acid sequence <SEQ ID 10949> which encodes amino acid sequence <SEQ ID 10950> was also identified.

A related DNA sequence was identified in *S. pyogenes* <SEQ ID 1099> which encodes the amino acid sequence <SEQ ID 1100>. Analysis of this protein sequence reveals the following:

```
Possible site: 31
>>> Seems to have no N-terminal signal sequence

----- Final Results -----
            bacterial cytoplasm --- Certainty = 0.1716(Affirmative) < succ>
            bacterial membrane  --- Certainty = 0.0000(Not Clear)   < succ>
             bacterial outside  --- Certainty = 0.0000(Not Clear)   < succ>
```

An alignment of the GAS and GBS proteins is shown below:

```
Identities = 245/308 (79%), Positives = 273/308 (88%)

Query:    1 MEKIILTATAESIEQVKQLLAIGIDRIYVGEENYGLRLPHSFSDDELREIAKLVHDAGKE    60
            MEKII+TATAESIEQVK LLA G+DRIYVGE NYGLRLPH+FS DELR+IAKLVHDAGKE
Sbjct:    1 MEKIIITATAESIEQVKALLAAGVDRIYVGEANYGLRLPHNFSYDELRQIAKLVHDAGKE    60

Query:   61 LTVACNALMHQEMMDNIKPFLELMKEINVDYLVVGDAGVFYINKRDGYNFKLIYDTSVFV   120
            LTVACNALMHQ+MMD IKPFL+LM EI VDYLVVGDAGVFY+NKRDGYNFKLIYDTSVFV
Sbjct:   61 LTVACNALMHQDMMDQIKPFLDLMIEIAVDYLVVGDAGVFYVNKRDGYNFKLIYDTSVFV   120

Query:  121 TSSRQVNFWGQHGAVETVLAREIPSEELFKMSENLEFPAEILVYGASVIHHSKRPLLQNY   180
            TSSRQVNFWGQHGAVE+VLAREIPS ELF ++ENLEFPAE+LVYGASVIHHSKRPLL+NY
Sbjct:  121 TSSRQVNFWGQHGAVESVLAREIPSAELFTLAENLEFPAEVLVYGASVIHHSKRPLLENY   180

Query:  181 YNFTHITDEKTRERGLFLAEPGDPESHYSIYEDKHGTHIFINNDINMMTKVTELVEHHFT   240
            Y+FT I DE +RERGLFLAEPGD  SHYSIYED HGTHIFINNDI+MM+K+ EL   H T
Sbjct:  181 YHFTKIDDEVSRERGLFLAEPGDASSHYSIYEDNHGTHIFINNDIDMMSKLGELYAHGLT   240

Query:  241 HWKLDGIYCPGDNFVAIAEIFVETARLIENGTFTQDQAFLFDERIRKLHPKGRGLDTGFY   300
            HWKLDGIYCPGD+FVAI ++F++   L+E G FTQ++A    D+ +   HP GRGLDTGFY
Sbjct:  241 HWKLDGIYCPGDDFVAITKLFIQAKTLLEAGQFTQEEAEKLDQAVHAHHPAGRGLDTGFY   300

Query:  301 DFDPSTVK                                                     308
            +FDP TVK
Sbjct:  301 EFDPKTVK                                                     308
```

Based on this analysis, it was predicted that these proteins and their epitopes could be useful antigens for vaccines or diagnostics.

EXAMPLE 340

A DNA sequence (GBSx0371) was identified in *S. agalactiae* <SEQ ID 1101> which encodes the amino acid sequence <SEQ ID 1102>. This protein is predicted to be cDNA EST yk542c12.5 comes from this gene. Analysis of this protein sequence reveals the following:

```
Possible site: 16
>>> Seems to have a cleavable N-term signal seq.

----- Final Results -----
              bacterial outside  --- Certainty = 0.3000(Affirmative) < succ>
              bacterial membrane --- Certainty = 0.0000(Not Clear)   < succ>
              bacterial cytoplasm --- Certainty = 0.0000(Not Clear)   < succ>
```

The protein has homology with the following sequences in the GENPEPT database:

```
>GP:AAD15622 GB:U75480 unknown [Streptococcus mutans]
Identities = 69/152 (45%), Positives = 101/152 (66%), Gaps = 12/152 (7%)
```

```
                                -continued
Query:    1 MSKLFKTLVISAASGAAAAYFLTTKKGKELRKNAEKFYGEYKENPEEYHQIAKDKASEYS  60
            MSK  KT +I A +GAAAAYFL+T KGK+ +K   + + +YKENP+EYHQ A DK +EY
Sbjct:    1 MSKFLKTAIIGAGTGAAAAYFLSTDKGKQFKKKIHQTFTDYKENPKEYHQYAADKVNEYK  60

Query:   61 NLAVDTFKDYKGKFESGELTTEDIVSAVKEKSGEVVDFANDFVNQAKSKFSDEDTAKKED 120
            ++AV +FKDYK KFE+GELT ++I+S+VKEK+ +    FAN ++Q K     T +K +
Sbjct:   61 DVAVHSFKDYKDKFETGELTKDNIISSVKEKASQAGKFANSKLSQVKDHLA--QTVEKAE 118

Query:  121 KAP----------ETKVEDIVIDYKENTEDKE                             142
              +             + +V+DIVIDY+   + K+
Sbjct:  119 ASTNDAGIPLGEMKAQVDDIVIDYQAEEKTKK                             150
```

A related DNA sequence was identified in *S. pyogenes* <SEQ ID 1103> which encodes the amino acid sequence <SEQ ID 1104>. Analysis of this protein sequence reveals the following:

```
Possible site: 26
>>> Seems to have no N-terminal signal sequence
     INTEGRAL    Likelihood = -1.81    Transmembrane    15-31 (14-31)

----- Final Results -----
              bacterial membrane  --- Certainty = 0.1723(Affirmative) < succ>
              bacterial outside   --- Certainty = 0.0000(Not Clear)   < succ>
              bacterial cytoplasm --- Certainty = 0.0000(Not Clear)   < succ>
```

A related sequence was also identified in GAS <SEQ ID 9117> which encodes the amino acid sequence <SEQ ID 9118>. Analysis of this protein sequence reveals the following:

```
Possible cleavage site: 19
>>> Seems to have a cleavable N-term signal seq.

----- Final Results -----
              bacterial outside   --- Certainty = 0.300(Affirmative) < succ>
              bacterial membrane  --- Certainty = 0.000(Not Clear)   < succ>
              bacterial cytoplasm --- Certainty = 0.000(Not Clear)   < succ>
```

An alignment of the GAS and GBS proteins is shown below:

```
Identities = 69/140 (49%), Positives = 91/140 (64%), Gaps = 8/140 (5%)

Query:    1 MSKLFKTLVISAASGAAAAYFLTTKKGKELRKNAEKFYGEYKENPEEYHQIAKDKASEYS  60
            M+K FK LVI A SG AAAYFL+T+KGK L+  AEK Y  YKE+P++YHQ AK+K SEYS
Sbjct:    8 MNKSFKNLVIGAVSGVAAAYFLSTEKGKALKNPAEKAYQAYKESPDDYHQFAKEKGSEYS  67

Query:   61 NLAVDTFKDYKGKFESGELTTEDIVSAVKEKSGEVVDFANDFVNQAKSKFSD-EDTAKKE 119
            +LA DTF D K K SG+LT ED++  +K+K+            FV + K   ++ E  K++
Sbjct:   68 HLARDTFYDVKDKLASGDLTKEDMLDLLKDKT-------TAFVQKTKETLAEVEAKEKQD 120

Query:  120 DKAPETKVEDIVIDYKENTE                                         139
            D  +    EDI+IDY E  E
Sbjct:  121 DVIIDLNEEDIIIDYTEQDE                                         140
```

SEQ ID 1102 (GBS164) was expressed in *E. coli* as a His-fusion product. SDS-PAGE analysis of total cell extract is shown in FIG. 30 (lane 4; MW 17.4 kDa).

The GBS164-His fusion product was purified (FIG. 115A; see also FIG. 200, lane 4) and used to immunise mice (lane 1+2+3 product; 20 μg/mouse). The resulting antiserum was used for Western blot, FACS (FIG. 115B), and in the in vivo passive protection assay (Table III). These tests confirm that the protein is immunoaccessible on GBS bacteria and that it is an effective protective immunogen.

Based on this analysis, it was predicted that these proteins and their epitopes could be useful antigens for vaccines or diagnostics.

EXAMPLE 341

A DNA sequence (GBSx0372) was identified in *S. agalactiae* <SEQ ID 1105> which encodes the amino acid sequence <SEQ ID 1106>. Analysis of this protein sequence reveals the following:

```
Possible site: 19
>>> Seems to have an uncleavable N-term signal seq
     INTEGRAL     Likelihood = -16.93     Transmembrane     6-22 (1-31)

----- Final Results -----
              bacterial membrane --- Certainty = 0.7771(Affirmative) < succ>
               bacterial outside --- Certainty = 0.0000(Not Clear)   < succ>
             bacterial cytoplasm --- Certainty = 0.0000(Not Clear)   < succ>
```

The protein has homology with the following sequences in the GENPEPT database:

```
>GP:AAD15621 GB:U75480 unknown [Streptococcus mutans]
Identities = 88/129 (68%), Positives = 112/129 (86%)

Query:     1 MIEIAVLIIAIAFVVLVLGILFVLKKVSETIEETKQTIKVLTSDVNVTLYQTNEILAKAN   60
             M EIA+LI+AIAF VLV+ ++ +L+K+S+T++E++QT+K+LTSDVNVTLYQTNE+LAKAN
Sbjct:     1 MWEIALLIVAIAFAVLVIYLILLLRKISDTVDESRQTLKILTSDVNVTLYQTNELLAKAN   60

Query:    61 VLVDDVNGKVSTIDPLFVAIADLSESVSDLNLQARHIGQKASSATSSVTKAGSALAIGKA  120
             VLV+DVNGKV TIDPLF AIADLS SVSDLN QAR+ G+K    +T++V KAG+A   GK
Sbjct:    61 VLVEDVNGKVETIDPLFTAIADLSVSVSDLNRQARYFGKKTRKSTANVGKAGAAYTFGKV  120

Query:   121 ASKIFRKKG                                                    129
             ASK+FRKKG
Sbjct:   121 ASKLFRKKG                                                    129
```

A related DNA sequence was identified in *S. pyogenes* <SEQ ID 1107> which encodes the amino acid sequence <SEQ ID 1108>. Analysis of this protein sequence reveals the following:

```
Possible Site: 16
>>> Seems to have a cleavable N-term signal seq.
     INTEGRAL     Likelihood = -0.85     Transmembrane     18-34 (17-34)

----- Final Results -----
              bacterial membrane --- Certainty = 0.1341(Affirmative) < succ>
               bacterial outside --- Certainty = 0.0000(Not Clear)   < succ>
             bacterial cytoplasm --- Certainty = 0.0000(Not Clear)   < succ>
```

The protein has homology with the following sequences in the databases:

```
>GP:AAD15621 GB:U75480 unknown [Streptococcus mutans]
Identities = 83/128 (64%), Positives = 110/128 (85%)

Query:     6 ISLMIIALAFVALVIFLIIVLKKVSETIDEAKKTISVLTSDVNVTLHQTNDILAKANILV   65
             I+L+I+A+AF   LVI+LI++L+K+S+T+DE+++T+ +LTSDVNVTL+QTN++LAKAN+LV
Sbjct:     4 IALLIVAIAFAVLVIYLILLLRKISDTVDESRQTLKILTSDVNVTLYQTNELLAKANVLV   63

Query:    66 EDVNGKVATIDPLFVAIADLSESLSDLNSQARHFGQKATNATGNVSKAGKLALVGKVASK  125
             EDVNGKV TIDPLF AIADLS +SDLN QAR+FG+K   +T NV KAG    GKVASK
Sbjct:    64 EDVNGKVETIDPLFTAIADLSVSVSDLNRQARYFGKKTRKSTANVGKAGAAYTFGKVASK  123

Query:   126 VFGKKGEK                                                     133
             +F KKG++
Sbjct:   124 LFRKKGKQ                                                     131
```

An alignment of the GAS and GBS proteins is shown below:

```
Identities = 92/131 (70%), Positives = 116/131 (88%)

Query:     1 MIEIAVLIIAIAFVVLVLGILFVLKKVSETIEETKQTIKVLTSDVNVTLYQTNEILAKAN   60
             ++ I+++IIA+AFV LV+ ++ VLKKVSETI+E K+TI VLTSDVNVTL+QTN+ILAKAN
Sbjct:     3 LVGISLMIIALAFVALVIFLIIVLKKVSETIDEAKKTISVLTSDVNVTLHQTNDILAKAN   62
```

```
-continued

Query:    61 VLVDDVNGKVSTIDPLFVAIADLSESVSDLNLQARHIGQKASSATSSVTKAGSALAIGKA 120
             +LV+DVNGKV+TIDPLFVAIADLSES+SDLN QARH GQKA++AT +V+KAG    +GK
Sbjct:    63 ILVEDVNGKVATIDPLFVAIADLSESLSDLNSQARHFGQKATNATGNVSKAGKLALVGKV 122

Query:   121 ASKIFRKKGDK                                                   131
             ASK+F KKG+K
Sbjct:   123 ASKVFGKKGEK                                                   133
```

Based on this analysis, it was predicted that these proteins and their epitopes could be useful antigens for vaccines or diagnostics.

EXAMPLE 342

A DNA sequence (GBSx0373) was identified in *S. agalactiae* <SEQ ID 1109> which encodes the amino acid sequence <SEQ ID 1110>. Analysis of this protein sequence reveals the following:

```
Possible site: 13
>>> Seems to have no N-terminal signal sequence

----- Final Results -----
         bacterial cytoplasm --- Certainty = 0.0462(Affirmative) < succ>
         bacterial membrane  --- Certainty = 0.0000 (Not Clear)  < succ>
          bacterial outside  --- Certainty = 0.0000 (Not Clear)  < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 343

A DNA sequence (GBSx0374) was identified in *S. agalactiae* <SEQ ID 1111> which encodes the amino acid sequence <SEQ ID 1112>. This protein is predicted to be prolipoprotein diacylglyceryl transferase (Igt). Analysis of this protein sequence reveals the following:

```
Possible site: 29
>>> Seems to have an uncleavable N-term signal seq
     INTEGRAL   Likelihood = -8.39    Transmembrane    231-247 (225-251)
     INTEGRAL   Likelihood = -7.64    Transmembrane     89-105  (87-107)
     INTEGRAL   Likelihood = -5.20    Transmembrane     18-34   (13-36)
     INTEGRAL   Likelihood = -1.86    Transmembrane     46-62   (46-64)

----- Final Results -----
           bacterial membrane  --- Certainty = 0.4354(Affirmative) < succ>
            bacterial outside  --- Certainty = 0.0000(Not Clear)   < succ>
          bacterial cytoplasm  --- Certainty = 0.0000(Not Clear)   < succ>
```

A related GBS nucleic acid sequence <SEQ ID 9721> which encodes amino acid sequence <SEQ ID 9722> was also identified.

The protein has homology with the following sequences in the GENPEPT database:

```
>GP:AAC80171 GB:U75480 putative prolipoprotein diacylglycerol
transferase [Streptococcus mutans] (ver 3)
Identities = 184/257 (71%), Positives = 226/257 (87%)

Query:    2 MINPVAIRLGPFSIRWYAICIVSGMLLAVYLAMKEAPRKNIKSDDILDFILMAFPLSIVG   61
            MINP+AI+LGP +IRWY+ICIV+G++LAVYL ++EAP+KNIKSDD+LDFIL+AFPL+IVG
Sbjct:    1 MINPIAIKLGPLTIRWYSICIVTGLILAVYLTIREAPKKNIKSDDVLDFILIAFPLAIVG   60

Query:   62 ARIYYVIFEWAYYSKHPVEIIAIWNGGIAIYGGLITGAILLVIFSYRRLINPIDFLDIAA  121
            AR+YYVIF+W YY K+P EI  IW+GGIAIYGGL+TGA++L IFSY R+I PIDFLD AA
Sbjct:   61 ARLYYVIFDWDYYLKNPSEIPVIWHGGIAIYGGLLTGALVLFIFSYYRMIKPIDFLDVAA  120

Query:  122 PGVMIAQAIGRWGNFINQEAYGRAVKNLNYVPNFIKNQMYIDGAYRVPTFLYESLWNFLG  181
            PGVM+AQ+IGRWGNF+NQEAYG+ V   LNY+P+FI+ QMYIDG YR PTFLYESLWN LG
Sbjct:  121 PGVMLAQSIGRWGNFVNQEAYGKTVTQLNYLPDFIRKQMYIDGHYRTPTFLYESLWNLLG  180

Query:  182 FVIIMSIRHRPRTLKQGEVACFYLVWYGCGRFIIEGMRTDSLYLAGLRVSQWLSVILVII  241
            F+IIM +R RP  LK+GEVA FYL+WYG GRF+IEGMRTDSL  A LRVSQWLSV+LV++
Sbjct:  181 FIIIMILRRRPNLLKEGEVAFFYLIWYGSGRFVIEGMRTDSLMFASLRVSQWLSVLLVVV  240

Query:  242 GIVMIIYRRREQHISYY                                            258
            G+++++ RRR   I YY
Sbjct:  241 GVILMVIRRRNHAIPYY                                            257
```

A related DNA sequence was identified in *S. pyogenes* <SEQ ID 1113> which encodes the amino acid sequence <SEQ ID 1114>. Analysis of this protein sequence reveals the following:

```
Possible site: 28
>>> Seems to have an uncleavable N-term signal seq
      INTEGRAL    Likelihood = -7.01    Transmembrane   229-245 (222-249)
      INTEGRAL    Likelihood = -6.90    Transmembrane    45-61  (40-68)
      INTEGRAL    Likelihood = -4.41    Transmembrane    17-33  (11-35)
      INTEGRAL    Likelihood = -4.14    Transmembrane    87-103 (86-106)
      INTEGRAL    Likelihood = -0.27    Transmembrane   170-186 (170-186)

----- Final Results -----
            bacterial membrane --- Certainty = 0.3803(Affirmative) < succ>
             bacterial outside --- Certainty = 0.0000(Not Clear)  < succ>
           bacterial cytoplasm --- Certainty = 0.0000(Not Clear)  < succ>
```

The protein has homology with the following sequences in the databases:

```
>GP:AAC80171 GB:U75480 putative prolipoprotein diacylglycerol
transferase [Streptococcus mutans] (ver 3)
Identities = 176/258 (68%), Positives = 217/258 (83%)

Query:    1 MINPIALKCGPLAIHWYALCILSGLVLAVYLASKEAPKKGISSDAIFDFILIAFPLAIVG   60
            MINPIA+K GPL I WY++CI++GL+LAVYL  +EAPKK I SD + DFILIAFPLAIVG
Sbjct:    1 MINPIAIKLGPLTIRWYSICIVTGLILAVYLTIREAPKKNIKSDDVLDFILIAFPLAIVG   60

Query:   61 ARIYYVIFEWSYYVKHLDEIIAIWNGGIAIYGGLITGALVLLAYCNKVLNPIHFLDIAA  120
            AR+YYVIF+W YY+K+  EI  IW+GGIAIYGGL+TGALVL  + Y +++ PI FLD AA
Sbjct:   61 ARLYYVIFDWDYYLKNPSEIPVIWHGGIAIYGGLLTGALVLFIFSYYRMIKPIDFLDVAA  120

Query:  121 PSVMVAQAIGRWGNFINQEAYGKAVSQLNYLPSFIQKQMFIEGSYRIPTFLYESLWNLLG  180
            P VM+AQ+IGRWGNF+NQEAYGK V+QLNYLP FI+KQM+I+G YR PTFLYESLWNLLG
Sbjct:  121 PGVMLAQSIGRWGNFVNQEAYGKTVTQLNYLPDFIRKQMYIDGHYRTPTFLYESLWNLLG  180

Query:  181 FVIIMMWRRKPKSLLDGEIFAFYLIWYGSGRLVIEGMRTDSLMFLGIRISQYVSALLIII  240
            F+IIM+ RR+P  L +GE+  FYLIWYGSGR VIEGMRTDSLMF  +R+SQ++S LL+++
Sbjct:  181 FIIIMILRRRPNLLKEGEVAFFYLIWYGSGRFVIEGMRTDSLMFASLRVSQWLSVLLVVV  240

Query:  241 GLIFVIKRRRQKGISYYQ                                           258
            G+I ++ RRR   I YYQ
Sbjct:  241 GVILMVIRRRNHAIPYYQ                                           258
```

An alignment of the GAS and GBS proteins is shown below:

```
Identities = 176/257 (68%), Positives = 221/257 (85%)

Query:     2 MINPVAIRLGPFSIRWYAICIVSGMLLAVYLAMKEAPRKNIKSDDILDFILMAFPLSIVG   61
             MINP+A++ GP +I WYA+CI+SG++LAVYLA KEAP+K I SD I DFIL+AFPL+IVG
Sbjct:     1 MINPIALKCGPLAIHWYALCILSGLVLAVYLASKEAPKKGISSDAIFDFILIAFPLAIVG   60

Query:    62 ARIYYVIFEWAYYSKHPVEIIAIWNGGIAIYGGLITGAILLVIFSYRRLINPIDFLDIAA  121
             ARIYYVIFEW+YY KH  EIIAIWNGGIAIYGGLITGA++L+ + Y +++NPI FLDIAA
Sbjct:    61 ARIYYVIFEWSYYVKHLDEIIAIWNGGIAIYGGLITGALVLLAYCYNKVLNPIHFLDIAA  120

Query:   122 PGVMIAQAIGRWGNFINQEAYGRAVKNLNYVFNFIKHQMYIDGAYRVPTFLYESLWNFLG  181
             P VM+AQAIGRWGNFINQEAYG+AV  LNY+P+FI+ QM+I+G+YR+PTFLYESLWN LG
Sbjct:   121 PSVMVAQAIGRWGNFINQEAYGKAVSQLNYLPSFIQKQMFIEGSYRIPTFLYESLWNLLG  180

Query:   182 FVIIMSIRHRPRTLKQGEVACFYLVWYGCGRFIIEGMRTDSLYLAGLRVSQWLSVILVII  241
             FVIIM  R +P++L  GE+  FYL+WYG GR +IEGMRTDSL  G+R+SQ++S +L+II
Sbjct:   181 FVIIMMWRRKPKSLLDGEIFAFYLIWYGSGRLVIEGMRTDSLMFLGIRISQYVSALLIII  240

Query:   242 GIVMIIYRRREQHISYY                                            258
             G++ +I RRR++ ISYY
Sbjct:   241 GLIFVIKRRRQKGISYY                                            257
```

A related GBS gene <SEQ ID 8557> and protein <SEQ ID 8558> were also identified. Analysis of this protein sequence reveals the following:

```
Lipop: Possible site: -1 Crend: 0
McG: Discrim Score: 2.45
GvH: Signal Score (-7.5): -2.9
     Possible site: 39
>>> Seems to have an uncleavable N-term signal seq
ALOM program count: 3 value: -8.39 threshold: 0.0
     INTEGRAL        Likelihood = -8.39      Transmembrane    209-225 (203-229)
     INTEGRAL        Likelihood = -7.64      Transmembrane    67-83 (65-85)
     INTEGRAL        Likelihood = -1.86      Transmembrane    24-40 (24-42)
     PERIPHERAL      Likelihood = 0.79 92
modified ALOM score: 2.18

*** Reasoning Step: 3

----- Final Results -----
            bacterial membrane --- Certainty = 0.4354(Affirmative) < succ>
             bacterial outside --- Certainty = 0.0000(Not Clear) < succ>
           bacterial cytoplasm --- Certainty = 0.0000(Not Clear) < succ>
```

The protein has homology with the following sequences in the databases:

```
ORF01400(238-1008 of 1308)
SP|P72482|LGT_STRMU(1-257 of 259) PROLIPOPROTEIN DIACYLGLYCERYL TRANSFERASE (EC
2.4.99.-). GP|4583534|gb|AAC80171.3||U75480 putative prolipoprotein diacylglycerol
transferase {Streptococcus mutans} PIR|T11569|T11569 prolipoprotein diacylglyceryl
transferase (EC 2.4.99.-) - Streptococcus mutans
% Match = 46.9
% Identity = 71.6   % Similarity = 89.5
Matches = 184  Mismatches = 27   Conservative Sub.s = 46

198       228       258       288       318       348       378       408
WGLMLPRLLRIV*HI*LVRTRSMMINPVAIRLGPFSIRWYAICIVSGMLLAVYLAMKEAPRKNIKSDDILDFILMAFPLS
                 ||||:||:|||::|||||:||||:|::|||||  ::|||:||||||||:|||||:||||:
                 MINPIAIKLGPLTIRWYSICIVTGLILAVYLTIREAPKKNIKSDDVLDFILIAFPLA
                        10        20        30        40        50

438       468       498       528       558       588       618       648
IVGARIYYVIFEWAYYSKHPVEIIAIWNGGIAIYGGLITGAILLVIFSYRRLINPIDFLDIAAPGVMIAQAIGRWGNFIN
|||||:||||||:|  ||  |:|  ||  |:|||||||||:|||::|  ||||  |:| |||||:|||||||||:||:||||:|
IVGARLYYVIFDWDYYLKNPSEIPVIWHGGIAIYGGLLTGALVLFIFSYYRMIKPIDFLDVAAPGVMLAQSIGRWGNFVN
        70        80        90       100       110       120       130

678       708       738       768       798       828       858       888
QEAYGRAVKNLNYVPNFIKNQMYIDGAYRVPTFLYESLWNFLGFVIIMSIRHRPRTLKQGEVACFYLVWYGCGRFIIEGM
|||||:  |   |||:|:||: ||||||  ||  ||||||||||:|||||:|  ||  |:||||  |||:|||   |||:||||
QEAYGKTVTQLNYLPDFIRKQMYIDGHYRTPTFLYESLWNLLGFIIIMILRRRPNLLKEGEVAFFYLIWYGSGRFVIEGM
       150       160       170       180       190       200       210

918       948       978      1008      1038      1068      1098      1128
RTDSLYLAGLRVSQWLSVILVIIGIVMIIYRRREQHISYY*TEEVL**KLLY*LLPLRLLF*F*EYFSF*KKYQKRLRKP
|||||  :|  |||||||||||:||::|:::::   |||   :  |  ||
RTDSLMFASLRVSQWLSVLLVVVGVILMVIRRRNHAIPYYQC
       230       240       250
```

Based on this analysis, it was predicted that these proteins and their epitopes could be useful antigens for vaccines or diagnostics.

EXAMPLE 344

A DNA sequence (GBSx0375) was identified in *S. agalactiae* <SEQ ID 1115> which encodes the amino acid sequence <SEQ ID 1116>. Analysis of this protein sequence reveals the following:

```
Possible site: 31
>>> Seems to have no N-terminal signal sequence

----- Final Results -----
          bacterial cytoplasm --- Certainty = 0.2817(Affirmative) < succ>
           bacterial membrane --- Certainty = 0.0000(Not Clear)   < succ>
            bacterial outside --- Certainty = 0.0000(Not Clear)   < succ>
```

The protein has homology with the following sequences in the GENPEPT database:

```
>GP:BAA77782 GB:AB027460 Hpr kinase [Streptococcus bovis]
Identities = 264/309 (85%), Positives = 292/309 (94%)

Query:    1 MAVTVQMLVDRLRLNVIYGDEHLLSKRITTADISRPGLEMTGYFDYYAPERLQLVGMKEW    60
            M+VTV+MLVD++KL+VIYGD+ LLSK ITT+DISRPGLEMTGYFDYY+PERLQL+GMKEW
Sbjct:    1 MSVTVKMLVDKVKLDVIYGDDDLLSKEITTSDISRPGLEMTGYFDYYSPERLQLLGMKEW    60

Query:   61 SYLMAMTGHNRYQVLREMFQKETPAIVVARDLEIPEEMYEAAKDTGIAILQSKAPTSRLS   120
            SYL MT HNR  VLREM + ETPAI+VAR+L IPEEM  AAK+ GIAILQS  PTSRLS
Sbjct:   61 SYLTRMTSHNRRHVLREMIKPETPAIIVARNLAIPEEMISAAKEKGIAILQSHVPTSRLS   120

Query:  121 GEVSWYLDSCLAERTSVHGVLMDIYGMGVLIQGDSGIGKSETGLELVKRGHRLVADDRVD   180
            GE+SWYLDSCLAERTSVHGVLMDIYGMGVLIQGDSGIGKSETGLELVKRGHRLVADDRVD
Sbjct:  121 GEMSWYLDSCLAERTSVHGVLMDIYGMGVLIQGDSGIGKSETGLELVKRGHRLVADDRVD   180

Query:  181 VYAKDEETLWGEPAEILRHLLEIRGVGIIDIMSLYGASAVKDSSQVQLAIYLENFETGKV   240
            V+AKDEETLWGEPAEILRHLLEIRGVGIID+MSLYGASAVKDSSQVQLAIYLEN+E+GKV
Sbjct:  181 VFAKDEETLWGEPAEILRHLLEIRGVGIIDVMSLYGASAVKDSSQVQLAIYLENYESGKV   240

Query:  241 FDRLGNGNEEIELSGVKVPRIRIPVRTGRNVSVVIEAAAMNHRAKQMGFDATQTFEDRLT   300
            FDRLGNGNEE+ELSGVK+PR+RIPV TGRN+SVVIEAAAMN+RAKQMGFDAT+TFE+RLT
Sbjct:  241 FDRLGNGNEELELSGVKIPRLRIPVQTGRNMSVVIEAAAMNYRAKQMGFDATKTFEERLT   300
```

```
Query:  301 HLISQNEVN                                                 309
            LI++NE N
Sbjct:  301 QLITKNEGN                                                 309
```

A related DNA sequence was identified in *S. pyogenes* <SEQ ID 1117> which encodes the amino acid sequence <SEQ ID 1118>. Analysis of this protein sequence reveals the following:

```
Possible site: 13
>>> Seems to have no N-terminal signal sequence

----- Final Results -----
            bacterial cytoplasm --- Certainty = 0.2391(Affirmative) < succ>
            bacterial membrane  --- Certainty = 0.0000(Not Clear)   < succ>
            bacterial outside   --- Certainty = 0.0000(Not Clear)   < succ>
```

An alignment of the GAS and GBS proteins is shown below:

```
Identities = 255/309 (82%), Positives = 288/309 (92%)

Query:    1 MAVTVQMLVDRLKLNVIYGDEHLLSKRITTADISRPGLEMTGYFDYYAPERLQLVGMKEW  60
            M VTV+MLV ++KL+V+Y   ++LLSK ITT+DISRPGLEMTGYFDYYAPERLQL GMKEW
Sbjct:   32 MTVTVKMLVQKVKLDVVYATDNLLSKEITTSDISRPGLEMTGYFDYYAPERLQLFGMKEW  91

Query:   61 SYLMAMTGHNRYQVLREMFQKETPAIVVARDLEIPEEMYEAAKDTGIAILQSKAPTSRLS 120
            SYL  MT HNRY VL+EMF+K+TPA+VV+R+L IP+EM +AAK+ GI++L S+  TSRL+
Sbjct:   92 SYLTQMTSHNRYSVLKEMFKKDTPAVVVSRNLAIPKEMVQAAKEEGISLLSSRVSTSRLA 151

Query:  121 GEVSWYLDSCLAERTSVHGVLMDIYGMGVLIQGDSGIGKSETGLELVKRGHRLVADDRVD 180
            GE+S++LD+ LAERTSVHGVLMDIYGMGVLIQGDSGIGKSETGLELVKRGHRLVADDRVD
Sbjct:  152 GEMSYFLDASLAERTSVHGVLMDIYGMGVLIQGDSGIGKSETGLELVKRGHRLVADDRVD 211

Query:  181 VYAKDEETLWGEPAEILRHLLEIRGVGIIDIMSLYGASAVKDSSQVQLAIYLENFETGKV 240
            VYAKDEETLWGEPAEILRHLLEIRGVGIID+MSLYGASAVKDSSQVQLAIYLENFE GKV
Sbjct:  212 VYAKDEETLWGEPAEILRHLLEIRGVGIIDVMSLYGASAVKDSSQVQLAIYLENFEAGKV 271

Query:  241 FDRLGNGNEEIELSGVKVPRIRIPVKTGRNVSVVIEAAAMNHRAKQMGFDATQTFEDRLT 300
            FDRLGNGNEEI   SGV++PRIRIPVKTGRNVSVVIEAAAMNHRAK+MGFDAT+TFEDRLT
Sbjct:  272 FDRLGNGNEEITFSGVRIPRIRIPVKTGRNVSVVIEAAAMNHRAKEMGFDATKTFEDRLT 331

Query:  301 HLISQNEVN                                                   309
            LI++NEV+
Sbjct:  332 QLITKNEVS                                                   340
```

Based on this analysis, it was predicted that these proteins and their epitopes could be useful antigens for vaccines or diagnostics.

EXAMPLE 345

A DNA sequence (GBSx0376) was identified in *S. agalactiae* <SEQ ID 1119> which encodes the amino acid sequence <SEQ ID 1120>. Analysis of this protein sequence reveals the following:

```
Possible site: 28
>>> Seems to have no N-terminal signal sequence

----- Final Results -----
            bacterial cytoplasm --- Certainty = 0.1836(Affirmative) < succ>
            bacterial membrane  --- Certainty = 0.0000(Not Clear)   < succ>
            bacterial outside   --- Certainty = 0.0000(Not Clear)   < succ>
```

A related GBS nucleic acid sequence <SEQ ID 9719> which encodes amino acid sequence <SEQ ID 9720> was also identified.

The protein has no significant homology with any sequences in the GENPEPT database.

No corresponding DNA sequence was identified in *S. pyogenes*.

Based on this analysis, it was predicted that these proteins and their epitopes could be useful antigens for vaccines or diagnostics.

EXAMPLE 346

A DNA sequence (GBSx0377) was identified in *S. agalactiae* <SEQ ID 1121> which encodes the amino acid sequence <SEQ ID 1122>. Analysis of this protein sequence reveals the following:

```
Possible site: 37
>>> Seems to have an uncleavable N-term signal seq
     INTEGRAL     Likelihood = -4.88     Transmembrane     35-51 (31-59)

----- Final Results -----
                bacterial membrane  --- Certainty = 0.2954(Affirmative) < succ>
                bacterial outside   --- Certainty = 0.0000(Not Clear)   < succ>
                bacterial cytoplasm --- Certainty = 0.0000(Not Clear)   < succ>
```

The protein has homology with the following sequences in the GENPEPT database:

```
>GP:AAC67275 GB:AF017113 YvlC [Bacillus subtilis]
Identities = 21/63 (33%), Positives = 36/63 (56%), Gaps = 2/63 (3%)

Query:    3 SSFYKQRKGKLVCGVVAGLADKYNWDLALSRVLIALILYFTKF--GLLLYILLAVFLPYK  60
            +  Y+  K K + GV+ GLA+ +NWD +L RV+  ++      T       LL+YI+     +P +
Sbjct:    2 NKLYRSEKNKKIAGVIGGLAEYFNWDASLLRVITVILAIMTSVLPVLLIYIIWIFIVPSE  61

Query:   61 EDI                                                          63
            D+
Sbjct:   62 RDM                                                          64
```

A related DNA sequence was identified in *S. pyogenes* <SEQ ID 1123> which encodes the amino acid sequence <SEQ ID 1124>. Analysis of this protein sequence reveals the following:

```
Possible site: 32
>>> Seems to have an uncleavable N-term signal seq
     INTEGRAL     Likelihood = -5.26     Transmem-  39-55 (31-61)
                                         brane ----- Final Results -----
                bacterial membrane  --- Certainty = 0.3102(Affirmative) < succ>
                bacterial outside   --- Certainty = 0.0000(Not Clear)   < succ>
                bacterial cytoplasm --- Certainty = 0.0000(Not Clear)   < succ>
```

An alignment of the GAS and GBS proteins is shown below:

```
Identities = 60/90 (66%), Positives = 77/90 (84%), Gaps = 3/90 (3%)

Query:    1 MKSSFYKQRKGKLVCGVVAGLADKYNWDLALSRVLIALILYFTKFGLLLYILLAVFLPYK  60
            +++ FYKQRK +LV GV+AGLADKY WDLAL+RVL AL++Y T FG+LLYILLA+FLPYK
Sbjct:    1 VETKFYKQRKNRLVAGVIAGLADKYGWDLALARVLAALLIYGTGFGVLLYILLAIFLPYK  60

Query:   61 EDIIETR-RQGPRRRKDAEPV--DDDGWFW                               87
            ED++E R   +GPRRRKDA+ +   ++DGWFW
Sbjct:   61 EDLLEERYGRGPRRRKDADVLNEEEDGWFW                               90
```

Based on this analysis, it was predicted that these proteins and their epitopes could be useful antigens for vaccines or diagnostics.

EXAMPLE 347

A DNA sequence (GBSx0378) was identified in *S. agalactiae* <SEQ ID 1125> which encodes the amino acid sequence <SEQ ID 1126>. Analysis of this protein sequence reveals the following:

```
Possible site: 19
>>> Seems to have no N-terminal signal sequence

----- Final Results -----
             bacterial cytoplasm --- Certainty = 0.3577(Affirmative) < succ>
              bacterial membrane --- Certainty = 0.0000(Not Clear)  < succ>
               bacterial outside --- Certainty = 0.0000(Not Clear)  < succ>
```

A related GBS nucleic acid sequence <SEQ ID 9717> which encodes amino acid sequence <SEQ ID 9718> was also identified.

The protein has homology with the following sequences in the GENPEPT database:

```
>GP:BAB04250 GB:AP001508 unknown conserved protein
[Bacillus halodurans]
Identities = 379/729 (51%), Positives = 515/729 (69%), Gaps = 25/729 (3%)

Query:  29  ENLNITQIAIDLGIKASQIEKVLELTDEGNTIPFIARYRKEMTGNLDEVQIKSIIDLDKS  88
            E    I   +A +L +K + I++V++L  EGNT+PFIARYRKE+TG +DEV+I+ + +
Sbjct:   8  EEHTIKTLAKELSLKPNYIKQVIQLLHEGNTVPFIARYRKELTGGMDEVKIREVSEKWTY  67

Query:  89  MTALSDRKTTVLAKIEEQGKLTQELKKAIEEATKLADVEELYLPYKEKRRTKATIAREAG  148
                  L +RK V+   +EEQGKLT E KK +E+A KL +VE+LY PYK+KRRT+AT+A+E G
Sbjct:  68  ANQLHERKEEVIRLVEEQGKLTDEWKKTVEQAQKLQEVEDLYRPYKQKRRTRATVAKEKG  127

Query: 149  LFPLARLI--LQNKDNLEEEAQNYLTDGFETTT--KALSGAVDILIEAFSEDNKLRSWTY  204
            L PLA  + L   + +EA+ YL+    E T     L GA DI+  E  ++D   LR
Sbjct: 128  LEPLAEWLFSLPRDGDPLQEAEVYLSVEHELTKVEDVLQGAQDIIAEWIADDADLRKRIR  187

Query: 205  NEIWNYSSITAVVKDESLDEKQVFKIYYDFSEKISKLHGYQVLALNRGEKMGVLKVNFEH  264
             +  +    S+ A VK E LDEK V+++YYD+ E  + L   ++  LALNRGEK   VL+V
Sbjct: 188  SLGFKEGSVIAKVKKEELDEKGVYEMYYDYEEPVRTLVPHRTLALNRGEKEDVLRVTIRF  247

Query: 265  NLEKMFRF----FAVRFKETS-QYIDDLIVQTVKKKIVPAMERRIRTELSEGAEDGAISL  319
                ++++        F  RF +   Y+    I    K+ I  P++ER IR EL+E AE+ AI +
Sbjct: 248  PVDRIIEMSEKTFIRRFGSPAVPYVKAAIEDGYKRLIEPSIEREIRHELTEKAEEQAIHI  307

Query: 320  FSENLRNLLLVSPLKGKMVLGFDPAFRTGAKLAVVDQTGKLMTTQVIYPVPPANQAKIEQ  379
            F+ENLR+LLL  P+KGK+VLG DPA+RTG KLA+VD+TGK++   QVIYP PP N+   +
Sbjct: 308  FAENLRSLLLQPPIKGKVVLGLDPAYRTGCKLAIVDETGKVLDIQVIYPTPPKNE--VAA  365

Query: 380  SKIELAKLIKEFNIEIIAIGNGTASRESEAFVAEVLQDFPD-VSYVIVNESGASVYSASE  438
            +K + KLI ++ +E+IAIGNGTASRESE F+A++++D P +  Y+IVNE+GASVYSASE
Sbjct: 366  AKKIVKKLIADYGVEMIAIGNGTASRESEQFIADLIKDLPQTIYYLIVNEAGASVYSASE  425

Query: 439  LARHEFPDLTVEKRSAISIARRLQDPLAELVKIDPKSIGVGQYQHDVSQKKLAENLDFVV  498
              + R EFPDL VE+RSA+SIARRLQDPLAELVKIDPKS+GVGQYQHDVSQK+L E+L FVV
Sbjct: 426  IGREEFPDLQVEERSAVSIARRLQDPLAELVKIDPKSVGVGQYQHDVSQKRLNESLTFVV  485

Query: 499  ETVVNQVGVNVNTASPALLAHVSGLNKTISENIVKYREENGQIKSRAEIKKVPRLGAKAF  558
            ETVVNQVGVNVNTASP+LL +V+GL+KT+++NIVK REE G+   +RA++K +PRLGAK +
Sbjct: 486  ETVVNQVGVNVNTASPSLLQYVAGLSKTVAKNIVKKREEAGRFTARAQLKDIPRLGAKTY  545

Query: 559  EQAAGFLRIPNAKNFLDNTGVHPESYEAVKKLLDQLTIKELD---DLAKEKLQNLDLIAT  615
            EQ  GFLRI + N LD T +HPESY+    KLL ++      D     +  K+KLQ LD+ A
Sbjct: 546  EQCIGFLRIMDGDNLLDATAIHPESYKVTDKLLSEVGATAADVGIEDLKKKLQALDVSAM  605

Query: 616  AESIGVGQETLKDIIEDLLKPGRDLRDDFEAPVLRHDVLDVSDLKVGQELQGTVRNVVDF  675
            A  ++ VG   TLKD+I+ L++P RD RD+    P+L+  DVL + DL  G ELQGTVRNVVDF
Sbjct: 606  AATLDVGVPTLKDMIDALIRPTRDPRDEVAKPLLKQDVLQLEDLLPGMELQGTVRNVVDF  665

Query: 676  GAFVDIGVHEDGLIHQSRLIKRKRDKKTRKMPPLQHPSKYLSVGDIVTVWVVEVDAERSR  735
            G FVDIGV +DGL+H  S+L  R                 ++HP + ++VG+IVTVWV +VD ++ R
Sbjct: 666  GVFVDIGVKQDGLVHISKLANRY----------IKHPLEVVTVGEIVTVWVEDVDIKKGR  715

Query: 736  IGLSLIKPD  744
            I L++++P+
Sbjct: 716  IALTMLRPE  724
```

A related DNA sequence was identified in *S. pyogenes* <SEQ ID 1127> which encodes the amino acid sequence <SEQ ID 1128>. Analysis of this protein sequence reveals the following:

```
Possible site: 25
>>> Seems to have no N-terminal signal sequence

----- Final Results -----
              bacterial cytoplasm --- Certainty = 0.2207(Affirmative) < succ>
               bacterial membrane --- Certainty = 0.0000(Not Clear) < succ>
                 bacterial outside --- Certainty = 0.0000(Not Clear) < succ>
```

An alignment of the GAS and GBS proteins is shown below:

```
Identities = 532/716 (74%), Positives = 619/716 (86%), Gaps = 10/716 (1%)

Query:   28 MENLNITQIAIDLGIKASQIEKVLELTDEGNTIPFIARYRKEMTGNLDEVQIKSIIDLDK   87
            MEN N   IA L +   QIE+VL LT +GNTIPFIARYRKE+TGNLDEV IKSIID+DK
Sbjct:    1 MENNNNHNIAEALSVSLHQIEQVLALTAQGNTIPFIARYRKEVTGNLDEVVIKSIIDMDK   60

Query:   88 SMTALSDRKTTVLAKIEEQGKLTQELKKAIEEATKLADVEELYLPYKEKRRTKATIAREA  147
            S+T L++RK T+LAKIEEQGKLT +L+ +IE    KLAD+EELYLPYKEKRRTKATIAREA
Sbjct:   61 SLTTLNERKATILAKIEEQGKLTDQLRTSIEATEKLADLEELYLPYKEKRRTKATIAREA  120

Query:  148 GLFPLARLILQNKDNLEEEAQNYLTDGFETTTKALSGAVDILIEAFSEDNKLRSWTYNEI  207
            GLFPLARLILQN  NLE A+ ++T+GF +  +AL+GAVDIL+EA SED KLRSWTYNEI
Sbjct:  121 GLFPLARLILQNAQNLETAAEPFVTEGFASPQEALAGAVDILVEAMSEDAKLRSWTYNEI  180

Query:  208 WNYSSITAVVKDESLDEKQVFKIYYDFSEKISKLHGYQVLALNRGEKMGVLKVNFEHNLE  267
            W YS + + +KDE LDEK+VF+IYYDFS+++S + GY+ LALNRGEK+G+LKV+FEHNLE
Sbjct:  181 WQYSRLVSTLKDEQLDEKKVFQIYYDFSDQVSNMQGYRTLALNRGEKLGILKVSFEHNLE  240

Query:  268 KMFRFFAVRFKETSQYIDDLIVQTVKKKIVPAMERRIRTELSEGAEDGAISLFSENLRNL  327
            KM RFF+VRFKET+ YI+++I QT+KKKIVPAMERR+R+ELS+ AEDGAI LFSENLR+L
Sbjct:  241 KMQRFFSVRFKETNPYIEEVINQTIKKKIVPAMERRVRSELSDAAEDGAIHLFSENLRHL  300

Query:  328 LLVSPLKGKMVLGFDPAFRTGAKLAVVDQTGKLMTTQVIYPVPPANQAKIEQSKIELAKL  387
            LLVSPLKGKMVLGFDPAFRTGAKLA+VDQTGKL+TTQVIYPV PA+Q KI+ +K  L +L
Sbjct:  301 LLVSPLKGKMVLGFDPAFRTGAKLAIVDQTGKLLTTQVIYPVAPASQTKIQAAKETLTQL  360

Query:  388 IKEFNIEIIAIGNGTASRESEAFVAEVLQDFPDVSYVIVNESGASVYSASELARHEFPDL  447
            I+ + I+IIAIGNGTASRESEAFVA+VL+DFP+ SYVIVNESGASVYSASELARHEFPDL
Sbjct:  361 IETYQIDIIAIGNGTASRESEAFVADVLKDFPNTSYVIVNESGASVYSASELARHEFPDL  420

Query:  448 TVEKRSAISIARRLQDPLAELVKIDPKSIGVGQYQHDVSQKKLAENLDFVVETVVNQVGV  507
            TVEKRSAISIARRLQDPLAELVKIDPKSIGVGQYQHDVSQKKL+ENL FVV+TVVNQVGV
Sbjct:  421 TVEKRSAISIARRLQDPLAELVKIDPKSIGVGQYQHDVSQKKLSENLGFVVDTVVNQVGV  480

Query:  508 NVNTASPALLAHVSGLNKTISENIVKYREENGQIKSRAEIKKVPRLGAKAFEQAAGFLRI  567
            NVNTASP+LLAHVSGLNKTISENIVKYREENG + SRA+IKKVPRLGAKAFEQAAGFLRI
Sbjct:  481 NVNTASPSLLAHVSGLNKTISENIVKYREENGALTSRADIKKVPRLGAKAFEQAAGFLRI  540

Query:  568 PNAKNFLDNTGVHPESYEAVKKLLDQLTIKELDDLAKEKLQNLDLIATAESIGVGQETLK  627
            P AKN LDNTGVHPESY AVK+L  L I++LDD AK  L + +   AE++ +GQETLK
Sbjct:  541 PGAKNILDNTGVHPESYPAVKELFKVLGIQDLDDAAKATLAAVQVPQMAETLAIGQETLK  600

Query:  628 DIIEDLLKPGRDLRDDFEAPVLRHDVLDVSDLKVGQELQGTVRNVVDFGAFVDIGVHEDG  687
            DII DLLKPGRDLRDDFEAP+LR D+LD+ DL++GQ+L+GTVRNVVDFGAFVDIGVHEDG
Sbjct:  601 DIIADLLKPGRDLRDDFEAPILRQDILDLKDLEIGQKLEGTVRNVVDFGAFVDIGVHEDG  660

Query:  688 LIHQSRLIKRKRDKKTRKMPPLQHPSKYLSVGDIVTVWVVEVDAERSRIGLSLIKP      743
            LIH S + K              + HPS+ +SVGD+VTVWV ++D +R ++ LSL+ P
Sbjct:  661 LIHISEMSKTF----------VNHPSQVVSVGDLVTVWVSKIDLDRHKVNLSLLPP      706
```

Based on this analysis, it was predicted that these proteins and their epitopes could be useful antigens for vaccines or diagnostics.

EXAMPLE 348

A DNA sequence (GBSx0379) was identified in *S. agalactiae* <SEQ ID 1129> which encodes the amino acid sequence <SEQ ID 1130>. This protein is predicted to be N5,N10-methylenetetrahydromethanopterin reductase homolog. Analysis of this protein sequence reveals the following:

```
Possible site: 60
>>> Seems to have no N-terminal signal sequence

----- Final Results -----
             bacterial cytoplasm --- Certainty = 0.4864(Affirmative) < succ>
              bacterial membrane --- Certainty = 0.0000(Not Clear)   < succ>
                bacterial outside --- Certainty = 0.0000(Not Clear)   < succ>
```

The protein has homology with the following sequences in the GENPEPT database:

```
>GP:AAB94650 GB:U96107 N5,N10-methylenetetrahydromethanopterin
reductase homolog [Staphylococcus carnosus]
Identities = 164/300 (54%), Positives = 217/300 (71%), Gaps = 1/300 (0%)

Query:   45  VYGIGEHHREDFAVSAPEIVLAAGAVRTNNIRLSSAVTILSSNDPIRVYQQFSTIDALSN  104
             +YG+GEHHR D+AVS P  VLAA A  T  I+LSSAVT+LSS+DP+ VY++F+T+DA+SN
Sbjct:    1  MYGLGEHHRSDYAVSDPVTVLAAAASLTQRIKLSSAVTVLSSDDPVCVYERFATLDAVSN   60

Query:  105  GRAEIMAGRGSFIESFPLFGYDLADYDDLFNEKMDMLLAINSATNLDWKGHLTQTVNERP  164
             GRAEIM GRGSFIESFPLFGYDL DYD LF EK+++L  IN    + W+G +   +
Sbjct:   61  GRAEIMVGRGSFIESFPLFGYDLDDYDRLFVEKLELLKEINQHEVVTWEGTMRPAIKGLG  120

Query:  165  IYPRALQRQLPIWVATGGNVDSTIRIAEQGLPIVYATIGGNPKAFRQLVHIYKEVGSRNG  224
             +YPRA+Q ++PIW+ATGG  +S+IR AE GLPI YA IGGNPK F++ + IY+ V    G
Sbjct:  121  VYPRAVQDEIPIWLATGGTPESSIRAAEFGLPITYAIIGGNPKRFKRNIAIYRAVAESRG  180

Query:  225  HKPEQLKVAAHSWGWIEEDNQTAIDRYFFPTKQTVDNIAKGRPHWSEMTKEQYLRSVGPE  284
             +      + VA HSWG+I + ++ A   ++ PTK    + IAK R +W    T+   + R +   E
Sbjct:  181  YDLADMPVAVHSWGYIADTDEQAQREFYEPTKVHHEIIAKER-NWPPYTEAHFQREISDE  239

Query:  285  GAIFVGSPEVVAHKIIGLVEALELDRFMLHLPVGSMPHKDVLNAIKLYGKEVAPIVRKYF  344
             GA+FVGSPE VA K+I ++E L L+RFMLH+PVGSMPH+ ++ AIKLYGK V PI+  YF
Sbjct:  240  GAMFVGSPETVARKMIKVIEELGLNRFMLHIPVGSMPHERIMKAIKLYGKRVKPIIEDYF  299
```

No corresponding DNA-sequence was identified in *S. pyogenes*.

Based on this analysis, it was predicted that this protein and its epitopes, could be useful antigens for vaccines or diagnostics.

EXAMPLE 349

A DNA sequence (GBSx0380) was identified in *S. agalactiae* <SEQ ID 1131> which encodes the amino acid sequence <SEQ ID 1132>. Analysis of this protein sequence reveals the following:

```
Possible site: 22
>>> Seems to have no N-terminal signal sequence

----- Final Results -----
             bacterial cytoplasm --- Certainty = 0.1310(Affirmative) < succ>
              bacterial membrane --- Certainty = 0.0000(Not Clear)   < succ>
                bacterial outside --- Certainty = 0.0000(Not Clear)   < succ>
```

A related GBS nucleic acid sequence <SEQ ID 9715> which encodes amino acid sequence <SEQ ID 9716> was also identified.

The protein has no significant homology with any sequences in the GENPEPT database.

A related DNA sequence was identified in *S. pyogenes* <SEQ ID 1133> which encodes the amino acid sequence <SEQ ID 1134>. Analysis of this protein sequence reveals the following:

```
Possible site: 25
>>> Seems to have no N-terminal signal sequence

----- Final Results -----
             bacterial cytoplasm --- Certainty = 0.0915(Affirmative) < succ>
``` bacterial membrane --- Certainty = 0.0000(Not Clear) < succ>
bacterial outside  --- Certainty = 0.0000(Not Clear) < succ>
```

An alignment of the GAS and GBS proteins is shown below:

```
Identities = 20/40 (50%), Positives = 27/40 (67%), Gaps = 3/40 (7%)

Query:  4 MAITHKRQDDLESMFASFAKVP---KPKKVDSDSKPEQKD    40
          MAITHK+ D+LE M A FA +P   KP +V++D K   K+
Sbjct:  1 MAITHKKNDELEKMLAGFASIPSFDKPLEVNTDGKLATKE    40
```

Based on this analysis, it was predicted that these proteins and their epitopes could be useful antigens for vaccines or diagnostics.

EXAMPLE 350

A DNA sequence (GBSx0381) was identified in *S. agalactiae* <SEQ ID 1135> which encodes the amino acid sequence <SEQ ID 1136>. Analysis of this protein sequence reveals the following:

```
Possible site: 56
>>> Seems to have no N-terminal signal sequence

----- Final Results -----
          bacterial cytoplasm --- Certainty = 0.1453(Affirmative) < succ>
          bacterial membrane  --- Certainty = 0.0000(Not Clear)   < succ>
          bacterial outside   --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 351

A DNA sequence (GBSx0382) was identified in *S. agalactiae* <SEQ ID 1137> which encodes the amino acid sequence <SEQ ID 1138>. Analysis of this protein sequence reveals the following:

```
Possible site: 37
>>> Seems to have an uncleavable N-term signal seq
    INTEGRAL    Likelihood = -11.15    Transmembrane   216-232 (210-240)
    INTEGRAL    Likelihood =  -9.18    Transmembrane    15-31  (10-39)
    INTEGRAL    Likelihood =  -9.02    Transmembrane   283-299 (276-299)
    INTEGRAL    Likelihood =  -8.76    Transmembrane   128-144 (119-150)
    INTEGRAL    Likelihood =  -4.62    Transmembrane   243-259 (237-265)
    INTEGRAL    Likelihood =  -2.44    Transmembrane    65-81  (65-81)
    INTEGRAL    Likelihood =  -2.44    Transmembrane    94-110 (93-111)

----- Final Results -----
          bacterial membrane  --- Certainty = 0.5458(Affirmative) < succ>
          bacterial outside   --- Certainty = 0.0000(Not Clear)   < succ>
          bacterial cytoplasm --- Certainty = 0.0000(Not Clear)   < succ>
```

The protein has homology with the following sequences in the GENPEPT database:

```
>GP:CAB12119 GB:Z99105 ycgR [Bacillus subtilis]
Identities = 141/283 (49%), Positives = 198/283 (69%), Gaps = 3/283 (1%)

Query:  10 SVLQWFAIFISIIIEALPFVLLGTILSGIIEVFITPDIVNKFLPKNKFLRVLFGTFVGFV    69
           S LQ +IFISI+IEA+PF+L+G ILSGII++F++ +++ +PKN+FL VLFG    G +
Sbjct:   6 SFLQLNSIFISILIEAIPFILIGVILSGIIQMFVSEEMIARIMPKNRFLAVLFGALAGVL    65
```

```
-continued
Query:   70 FPSCECGIIPIINRFLEKKVPSYTAVPFLATAPIINPIVLFATYSAFGNSIRFLILRFVG  129
            FP+CECGIIPI  R L K VP +  V F+ TAPIINPIVLF+TY AFGN    + R
Sbjct:   66 FPACECGIIPITRRLLLKGVPLHAGVAFMLTAPIINPIVLFSTYIAFGNRWSVVFYRGGL  125

Query:  130 ATIVAIALGVMLAFLVDDNILKEDAKPTHFHDYSDKKWYQKIFLALAHAIDEFFDTGRYL  189
            A V++ +GV+L++    DN L +  +P H H +        QK+   L HAIDEFF  G+YL
Sbjct:  126 ALAVSLIIGVILSYQFKDNQLLKPDEPGHHHHHHGTL-LQKLGGTLRHAIDEFFSVGKYL  184

Query:  190 VFGTLIASAMQIYLPTRVLTTIGHSPITAILVMMLLAFILSLCSEADAFIGASLLSTFGI  249
            + G  IA+AMQ Y+ T L  IG + +++ LVMM LAF+LSLCSE DAFI +S  STF +
Sbjct:  185 IIGAFIAAAMQTYVKTSTLLAIGQNDVSSLVMMGLAFVLSLCSEVDAFIASSFSSTFSL  244

Query:  250 APVMAFLLIGPMIDIKNLMMMVNSFKTRFIVQFISVSSLIIII                  292
             ++AFL+ G M+DIKNL+MM+ +FK RF+   F+ ++ +++I+
Sbjct:  245 GSLIAFLVFGAMVDIKNLLMMLAAFKKRFV--FLLITYIVVIV                  285
```

A related DNA sequence was identified in *S. pyogenes* <SEQ ID 1139> which encodes the amino acid sequence <SEQ ID 1140>. Analysis of this protein sequence reveals the following:

```
Possible site: 25
>>> Seems to have an uncleavable N-term signal seq
     INTEGRAL    Likelihood = -9.92    Transmembrane    216-232 (211-237)
     INTEGRAL    Likelihood = -9.45    Transmembrane    283-299 (276-299)
     INTEGRAL    Likelihood = -8.76    Transmembrane    128-144 (119-150)
     INTEGRAL    Likelihood = -7.80    Transmembrane     15-31  (10-39)
     INTEGRAL    Likelihood = -5.47    Transmembrane    243-259 (237-265)
     INTEGRAL    Likelihood = -2.44    Transmembrane     65-81  (65-81)
     INTEGRAL    Likelihood = -2.44    Transmembrane     94-110 (93-111)

----- Final Results -----
            bacterial membrane --- Certainty = 0.4970(Affirmative) < succ>
             bacterial outside --- Certainty = 0.0000(Not Clear)   < succ>
            bacterial cytoplasm --- Certainty = 0.0000(Not Clear)   < succ>
```

The protein has homology with the following sequences in the databases:

```
>GP:CAB12119 GB:Z99105 ycgR [Bacillus subtilis]
Identities = 143/288 (49%), Positives = 196/288 (67%), Gaps = 1/288 (0%)

Query:   10 SVLQWFAIFMSIIIEALPFVLLGTILSGCIEVFVTPELVQKYLPKQKCLRILFGTFVGFV   69
            S LQ  +IF+SI+IEA+PF+L+G ILSG I++FV+ E++  +PK + L +LFG   G +
Sbjct:    6 SFLQLNSIFISILIEAIPFILIGVILSGIIQMFVSEEMIARIMPKNRFLAVLFGALAGVL   65

Query:   70 FPSCECGIIPIINRFLEKKVPSYTAVPFLATAPIINPIVLFATYSAFGNSLRFLILRLVG  129
            FP+CECGIIPI  R L K VP +  V F+ TAPIINPIVLF+TY AFGN    + R
Sbjct:   66 FPACECGIIPITRRLLLKGVPLHAGVAFMLTAPIINPIVLFSTYIAFGNRWSVVFYRGGL  125

Query:  130 AALVAITLGVMLAFIVDDNILKDNAQPVHFHDYSHESLPKRIYLALVHAIDEFFDTGRYL  189
            A V++ +GV+L++    DN L   +P H H + H +L +++   L HAIDEFF  G+YL
Sbjct:  126 ALAVSLIIGVILSYQFKDNQLLKPDEPGH-HHHHHGTLLQKLGGTLRHAIDEFFSVGKYL  184

Query:  190 VFGTLIASAMQIYVPTRVLTTIGHNPLTAILIMMLMAFILSLCSEADAFIGASLLSTFGV  249
            + G  IA+AMQ YV T L  IG N +++ L+MM +AF+LSLCSE DAFI +S  STF +
Sbjct:  185 IIGAFIAAAMQTYVKTSTLLAIGQNDVSSLVMMGLAFVLSLCSEVDAFIASSFSSTFSL  244

Query:  250 APVLAFLLIGPMVDIKNLMMMVKAFKGRFIVQFIGVSVLMIAVYCLLV              297
            ++AFL+ G MVDIKNL+MM+ AFK RF+   I  V+++   LLV
Sbjct:  245 GSLIAFLVFGAMVDIKNLLMMLAAFKKRFVFLLITYIVVIVLAGSLLV              292
```

An alignment of the GAS and GBS proteins is shown below:

```
Identities = 248/300 (82%), Positives = 278/300 (92%)

Query:    1 MDIFNQLPDSVLQWFAIFISIIIEALPFVLLGTILSGIIEVFITPDIVNKFLPKNKFLRV   60
            M +F+ LP SVLQWFAIF+SIIIEALPFVLLGTILSG IEVF+TP++V K LPK K LR+
```

```
                                -continued
Sbjct:     1  MSLFSNLPPSVLQWFAIFMSIIIEALPFVLLGTILSGCIEVFVTPELVQKYLPKQKCLRI   60

Query:    61  LFGTFVGFVFPSCECGIIPIINRFLEKKVPSYTAVPFLATAPIINPIVLFATYSAFGNSI  120
              LFGTFVGFVFPSCECGIIPIINRFLEKKVPSYTAVPFLATAPIINPIVLFATYSAFGNS+
Sbjct:    61  LFGTFVGFVFPSCECGIIPIINRFLEKKVPSYTAVPFLATAPIINPIVLFATYSAFGNSL  120

Query:   121  RFLILRFVGATIVAIALGVMLAFLVDDNILKEDAKPTHFHDYSDKKWYQKIFLALAHAID  180
              RFLILR VGA +VAI LGVMLAF+VDDNILK++A+P HFHDYS +    ++I+LAL HAID
Sbjct:   121  RFLILRLVGAALVAITLGVMLAFIVDDNILKDNAQPVHFHDYSHESLPKRIYLALVHAID  180

Query:   181  EFFDTGRYLVFGTLIASAMQIYLPTRVLTTIGHSPITAILVMMLLAFILSLCSEADAFIG  240
              EFFDTGRYLVFGTLIASAMQIY+PTRVLTTIGH+P+TAIL+MML+AFILSLCSEADAFIG
Sbjct:   181  EFFDTGRYLVFGTLIASAMQIYVPTRVLTTIGHNPLTAILIMMLMAFILSLCSEADAFIG  240

Query:   241  ASLLSTFGIAPVMAFLLIGPMIDIKNLMMMVNSFKTRFIVQFISVSSLIIIIYCLFVGVI  300
              ASLLSTFG+APV+AFLLIGPM+DIKNLMMMV +FK RFIVQFI VS L+I +YCL VGV+
Sbjct:   241  ASLLSTFGVAPVLAFLLIGPMVDIKNLMMMVKAFKGRFIVQFIGVSVLMIAVYCLLVGVL  300
```

Based on this analysis, it was predicted that these proteins and their epitopes could be useful antigens for vaccines or diagnostics.

EXAMPLE 352

A DNA sequence (GBSx0383) was identified in *S. agalactiae* <SEQ ID 1141> which encodes the amino acid sequence <SEQ ID 1142>. Analysis of this protein sequence reveals the following:

```
Possible site: 13
>>> Seems to have no N-terminal signal sequence

----- Final Results -----
            bacterial cytoplasm --- Certainty = 0.4703(Affirmative) < succ>
            bacterial membrane  --- Certainty = 0.0000(Not Clear)   < succ>
             bacterial outside  --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 353

A DNA sequence (GBSx0384) was identified in *S. agalactiae* <SEQ ID 1143> which encodes the amino acid sequence <SEQ ID 1144>. Analysis of this protein sequence reveals the following:

```
Possible site: 50
>>> Seems to have an uncleavable N-term signal seq
     INTEGRAL    Likelihood = -8.44    Transmembrane    45-61 (39-65)
     INTEGRAL    Likelihood = -8.12    Transmembrane    83-99 (77-101)
     INTEGRAL    Likelihood = -0.00    Transmembrane    2-18 (1-19)

----- Final Results -----
              bacterial membrane  --- Certainty = 0.4376(Affirmative) < succ>
               bacterial outside  --- Certainty = 0.0000(Not Clear)   < succ>
             bacterial cytoplasm  --- Certainty = 0.0000(Not Clear)   < succ>
```

A related GBS nucleic acid sequence <SEQ ID 8559> which encodes amino acid sequence <SEQ ID 8560> was also identified. Analysis of this protein sequence reveals the following:

```
Lipop Possible site: -1 Crend: 2
SRCFLG: 0
McG: Length of UR: 8
     Peak Value of UR: 2.23
     Net Charge of CR: 1
McG: Discrim Score: 0.46
GvH: Signal Score (-7.5): -3.54
     Possible site: 42
>>> Seems to have an uncleavable N-term signal seq
Amino Acid Composition: calculated from 1
ALOM program count: 2 value: -8.44 threshold: 0.0
      INTEGRAL       Likelihood = -8.44      Transmembrane   37-53 (31-57)
      INTEGRAL       Likelihood = -8.12      Transmembrane   75-91 (69-93)
      PERIPHERAL     Likelihood =  2.76      200
modified ALOM score: 2.19
icm1 HYPID: 7 CFP: 0.438
*** Reasoning Step: 3

----- Final Results -----
              bacterial membrane --- Certainty = 0.4376(Affirmative) < succ>
               bacterial outside --- Certainty = 0.0000(Not Clear)   < succ>
             bacterial cytoplasm --- Certainty = 0.0000(Not Clear)   < succ>
```

The protein has homology with the following sequences in the GENPEPT database:

```
>GP:CAB12118 GB:Z99105 ycgQ [Bacillus subtilis]
Identities = 100/290 (34%), Positives = 159/290 (54%), Gaps = 25/290 (8%)

Query:    9 MIRFLILAGYFELSMYLKLSGKLNQYINTHYTYLAYISMVLSFILAIVQLIIWVKNMKMH    68
            M R L+L G+     +L  SG L +YIN  Y YL++I++ L  IL  VQ  +++K+ +
Sbjct:    1 MFRLLVLMGFTFFFYHLHASGNLTKYINMKYAYLSFIAIFLLAILTAVQAYLFIKSPEKS    60

Query:   69 SHLHGKIA----------KSTSP--------MILVFPVLVGLLVPTVSLDSTTVSAKGYN   110
            H H             +  P         ++ +FP++ G+  P  +LDS+ V  KG++
Sbjct:   61 GHHHDHDCGCGHDHEHDHEQNKPFYQRYLIYVVFLFPLVSGIFFPIATLDSSIVKTKGFS   120

Query:  111 FPLAAGSTGTVSQDGTRVQYLKPDTSTYFTSSAYEKEMQKELKKYKGSGTLTITTENYME   170
            F  A  S    SQ     QYL+PD S Y+   +Y+K+M++  KY    +++T +++++
Sbjct:  121 FK-AMESGDHYSQ----TQYLRPDASLYYAQDSYDKQMKQLFNKYSSKKEISLTDDDFLK   175

Query:  171 VMELIYLYPEQFMDRQIQYTGFVY-NEPKHEGYQFIFRFGIIHCIADSGVYGLLTT-GNQ   228
              ME IY YP +F+ R I++ GF Y     ++   F+ RFGIIHCIADSGVYG+L
Sbjct:  176 GMETIYNYPGEFLGRTIEFHGFAYKGNAINKNQLFVLRFGIIHCIADSGVYGMLVEFPKD   235

Query:  229 KSYPDNTWVTVRGTIKSEYNQLLQQNLPVLHIEESRQVSKANNPYVYRVF             278
               D+ W+ ++GT+ SEY Q  +  LPV + +    + K ++PYVYR F
Sbjct:  236 MDIKDDEWIHIKGTLASEYYQPFKSTLPVVKVTDWNTIKKPDDPYVYRGF             285
```

A related DNA sequence was identified in *S. pyogenes* <SEQ ID 1145> which encodes the amino acid sequence <SEQ ID 1146>. Analysis of this protein sequence reveals the following:

```
Possible site: 60
>>> Seems to have an uncleavable N-term signal seq
      INTEGRAL       Likelihood = -8.33      Transmembrane   83-99 (74-101)
      INTEGRAL       Likelihood = -6.21      Transmembrane   42-58 (39-62)

----- Final Results -----
              bacterial membrane --- Certainty = 0.4333(Affirmative) < succ>
               bacterial outside --- Certainty = 0.0000(Not Clear)   < succ>
             bacterial cytoplasm --- Certainty = 0.0000(Not Clear)   < succ>
```

A related sequence was also identified in GAS <SEQ ID 9115> which encodes the amino acid sequence <SEQ ID 9116>. Analysis of this protein sequence reveals the following:

```
Possible cleavage site: 54
>>> Seems to have an uncleavable N-term signal seq
      INTEGRAL       Likelihood = -8.33      Transmembrane   75-91 (66-93)
      INTEGRAL       Likelihood = -6.21      Transmembrane   34-50 (31-54)
```

```
                         -continued
   PERIPHERAL      Likelihood = 2.76

----- Final Results -----
              bacterial membrane --- Certainty = 0.433(Affirmative) < succ>
              bacterial outside  --- Certainty = 0.000(Not Clear)  < succ>
              bacterial cytoplasm --- Certainty = 0.000(Not Clear)  < succ>
```

An alignment of the GAS and GBS proteins is shown below:

```
Identities = 208/279 (74%), Positives = 244/279 (86%), Gaps = 1/279 (0%)

Query:    1 MFICGGNIMIRFLILAGYFELSMYLKLSGKLNQYINTHYTYLAYISMVLSFILAIVQLII    60
            +F CGG +MIRFLILAGYFEL+MYL+LSGKL+QYIN   Y+YLAYISM+LSFILA+VQL
Sbjct:    1 LFTCGGALMIRFLILAGYFELTMYLQLSGKLDQYINVRYSYLAYISMILSFILALVQLYT   60

Query:   61 WVKNMKMHSHLHGKIAKSTSPMILVFPVLVGLLVPTVSLDSTTVSAKGYNFPLAAGSTGT   120
            W+KN+K+HSHL GKIA+ TSP ILVFPVL+GLLVPTV+LDSTTVSAKGY FPLAAG++ T
Sbjct:   61 WMKNIKVHSHLTGKIARLTSPFILVFPVLIGLLVPTVTLDSTTVSAKGYTFPLAAGASKT  120

Query:  121 -VSQDGTRVQYLKPDTSTYFTSSAYEKEMQKELKKYKGSGTLTITTENYMEVMELIYLYP  179
              VS DGT +QYLKPDTS YFT SAY+KEM++EL KYKG   +TITTENYMEVMELIYLYP
Sbjct:  121 GVSDDGTTIQYLKPDTSLYFTKSAYQKEMRQELHKYKGKKPVTITTENYMEVMELIYLYP  180

Query:  180 EQFMDRQIQYTGFVYNEPKHEGYQFIFRGIIHCIADSGVYGLLTTGNQKSYPDNTWVTV   239
            ++F+DR IQYTGFVYNEP H+ YQF+FRFGIIHCIADSGVYGLLTTGNQ SYP+NTW+TV
Sbjct:  181 DEFLDRDIQYTGFVYNEPGHDNYQFLFRFGIIHCIADSGVYGLLTTGNQTSYPNNTWLTV  240

Query:  240 RGTIKSEYNQLLQQNLPVLHIEESRQVSKANNPYVYRVF                      278
            +G +  EY++ L+Q+LPVL + E  Q  + NNPYVYRVF
Sbjct:  241 KGRLHMEYDKNLEQHLPVLQLAEVHQTKEPNNPYVYRVF                      279
```

Figure 146:
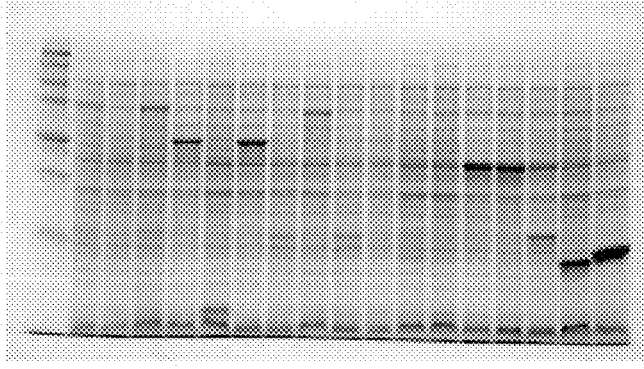

SEQ ID 8560 (GBS235d) was expressed in *E. coli* as a GST-fusion product. SDS-PAGE analysis of total cell extract is shown in FIG. 146 (lane 14 & 15; MW 48.5 kDa). It was also expressed in *E. coli* as a His-fusion product. SDS-PAGE analysis of total cell extract is shown in FIG. 146 (lane 17 & 18; MW 23.4 kDa), in FIG. 150 (lane 15; MW 23 kDa) and in FIG. 182 (lane 5; MW 23 kDa).

Figure 235:
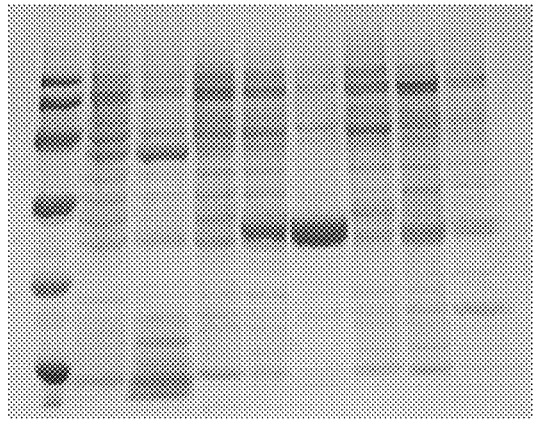

GBS235d-His was purified as shown in FIG. 235, lane 6-7.

Based on this analysis, it was predicted that these proteins and their epitopes could be useful antigens for vaccines or diagnostics.

EXAMPLE 354

A DNA sequence (GBSx0385) was identified in *S. agalactiae* <SEQ ID 1147> which encodes the amino acid sequence <SEQ ID 1148>. This protein is predicted to be signal recognition particle (ftsY). Analysis of this protein sequence reveals the following:

```
Possible site: 57
>>> Seems to have no N-terminal signal sequence

----- Final Results -----
              bacterial cytoplasm --- Certainty = 0.3301(Affirmative) < succ>
              bacterial membrane  --- Certainty = 0.0000(Not Clear)  < succ>
              bacterial outside   --- Certainty = 0.0000(Not Clear)  < succ>
```

The protein has homology with the following sequences in the GENPEPT database:

```
>GP: BAB06205 GB: AP001515 signal recognition particle (docking
protein) [Bacillus halodurans]
Identities = 175/304 (57%), Positives = 227/304 (74%)

Query: 233 EKYNRSLKKTRTGFSARLNAFLSNFRRVDEEFFEELEEMLILSDVGVNVATQLTEDLRYE  292
           EK+   L+KTR F+ ++N +  +R VDE+FFEELEE+LI +DVGV    L E+L+ E
Sbjct:  20 EKFKAGLEKTRDSFAGKMNDLVYKRSVDEDFFEELEEILIGADVGVTTVMDLVEELKDE   79
```

-continued

```
Query: 293 AKLENAKKSEDLKRVIVEKLVEIYEKDGIYNEAINFQEGLTVMLFVGVNGVGKTTSIGKL 352
            + +N K S+D++ +I EKL E+ EK+G  E       GL+V+L VGVNGVGKTTSIGKL
Sbjct:  80 VRRQNIKDSKDIQPIISEKLAELLEKEGGETEVNLQPAGLSVILVVGVNGVGKTTSIGKL 139

Query: 353 AHQYKSQGKKVMLVAADTFRAGAVAQLVEWGRRVDVPVVTGEEKADPASVVFDGMEKAVA 412
            AH YK QGKKV+L A DTFRAGA+ QL  WG R  V V+   E +DPA+V+FD ++ A +
Sbjct: 140 AHMYKQQGKKVILAAGDTFRAGAIEQLEVWGERAGVDVIKQSEGSDPAAVMFDAIQAAKS 199

Query: 413 QGVDVLLIDTAGRLQNKENLMAELEKIGRIIKRVVPDAPHETLLALDASTGQNALSQAKE 472
              + D+L+ DTAGRLQNK NLM ELEK+ R+I R +P APHE L+ALDA+TGQNA SQAK
Sbjct: 200 READILICDTAGRLQNKVNLMKELEKVKRVISREIPGAPHEVLIALDATTGQNAMSQAKT 259

Query: 473 FSKITPLTGLILTKIDGTAKGGVVLAIRQELDIPVKFIGFGEKIDDIGEFNSEDFMRGLL 532
            F + T +TG+ILTK+DGTAKGG+VLAIR ELDIPVKF+G GEKIDD+  F+SE F+ GL
Sbjct: 260 FKETTDVTGIILTKLDGTAKGGIVLAIRHELDIPVKFVGLGEKIDDLQPFDSEQFVYGLF 319

Query: 533 EGIL 536
            + ++
Sbjct: 320 KDMV 323
```

A related DNA sequence was identified in *S. pyogenes* <SEQ ID 1149> which encodes the amino acid sequence <SEQ ID 1150>. Analysis of this protein sequence reveals the following:

```
Possible site: 60
>>> Seems to have no N-terminal signal sequence

----- Final Results -----
         bacterial cytoplasm --- Certainty = 0.4384(Affirmative) < succ>
         bacterial membrane  --- Certainty = 0.0000(Not Clear)  < succ>
          bacterial outside  --- Certainty = 0.0000(Not Clear)  < succ>
```

An alignment of the GAS and GBS proteins is shown below:

```
Identities = 339/549 (61%), Positives = 404/549 (72%), Gaps = 46/549 (8%)

Query:   1 MGLFDRLFGHKKKDKEPEIEASESVVLEDEDSVIDKEEGSNFSKESTLNRTSEVPVAEDD  60
           MGLFDRLFG K+  K  E +  E+++ E       KEE S + E        ++   + +
Sbjct:   1 MGLFDRLFGKKETPKVAEEKLEENLLTE----TTQKEELSEKANEQ-----DKIEAVQQE  51

Query:  61 SFLELERDTALSESHQPVTSEIHPLESEDTDEIPVKEDDSFLELEDRAKTKVADTSEVEN 120
              ++  + A S  + P + ++ L  E+T              D +      DT+E
Sbjct:  52 ---DVSSEGAGSVENGPEAASVNALVEEETG--------------DNSNHPSEDTNEF--  92

Query: 121 VVPDSTTLSDNVSAKSEASFSDKEQLSDSQASDQFSETPLQEEMS--SGKTEVQTESEDT 178
             D T L   VS  S+++ S+ + L D    +QF   Q + S  E    S++
Sbjct:  93 -AADKTDLK--VSELSQSTASEPKDLVDQPVVEQFPTKQAQADASNDSANEEAVDTSKEQ 149

Query: 179 SAADAFLADYYAKRKAIEKEISSNSLST---------DESEFSEAQEVLSQSQA--DTIK 227
           S++    + DYY ++ A+EK +   +T         E++ S + E  SQ++A   DTI
Sbjct: 150 SSSQQVMEDYYRRKAALEKSLQEKAAATVPVMPEEVPQENQASTSAEA-SQNKATHDTIP 208

Query: 228 AESQEEKYNRSLKKTRTGFSARLNAFLSNFRRVDEEFFEELEEMLILSDVGVNVATQLTE 287
            E+ +EKY RSLKKTRTGFSARLN+F +NFRRVDEEFFE+LEEMLILSDVGV+VAT LTE
Sbjct: 209 -ETDQEKYKRSLKKTRTGFSARLNSFFANFRRVDEEFFEDLEEMLILSDVGVHVATTLTE 267

Query: 288 DLRYEAKLENAKKSEDLKRVIVEKLVEIYEKDGIYNEAINFQEGLTVMLFVGVNGVGKTT 347
           +LRYEAKLENAKK + LKRVIVEKLV+IYEKDG YNEAIN+Q+GLTVMLFVGVNGVGKTT
Sbjct: 268 ELRYEAKLENAKKPDALKRVIVEKLVDIYEKDGRYNEAINYQDGLTVMLFVGVNGVGKTT 327

Query: 348 SIGKLAHQYKSQGKKVMLVAADTFRAGAVAQLVEWGRRVDVPVVTGEEKADPASVVFDGM 407
           SIGKLA++YK +GKKVMLVAADTFRAGAVAQLVEWGRRVDVPV+TG EKADPASVVFDGM
Sbjct: 328 SIGKLAYRYKQEGKKVMLVAADTFRAGAVAQLVEWGRRVDVPVITGPEKADPASVVFDGM 387

Query: 408 EKAVAQGVDVLLIDTAGRLQNKENLMAELEKIGRIIKRVVPDAPHETLLALDASTGQNAL 467
           EKAVA+GVD+LLIDTAGRLQNKENLMAELEK+GRIIKRV+PDAPHETLLALDASTGQNAL
Sbjct: 388 EKAVAKGVDILLIDTAGRLQNKENLMAELEKMGRIIKRVLPDAPHETLLALDASTGQNAL 447

Query: 468 SQAKEFSKITPLTGLILTKIDGTAKGGVVLAIRQELDIPVKFIGFGEKIDDIGEFNSEDF 527
           SQAKEFSKITPLTGLILTKIDGTAKGGVVLAIRQELDIPVKFIGFGEK+DDIGEF+SEDF
Sbjct: 448 SQAKEFSKITPLTGLILTKIDGTAKGGVVLAIRQELDIPVKFIGFGEKVDDIGEFHSEDF 507
```

```
Query:  528 MRGLLEGIL  536
            M+GLLEGIL
Sbjct:  508 MKGLLEGIL  516
```

Based on this analysis, it was predicted that these proteins and their epitopes could be useful antigens for vaccines or diagnostics.

EXAMPLE 355

A DNA sequence (GBSx0386) was identified in *S. agalactiae* <SEQ ID 1151> which encodes the amino acid sequence <SEQ ID 1152>. Analysis of this protein sequence reveals the following:

```
Possible site: 52
>>> Seems to have no N-terminal signal sequence

----- Final Results -----
           bacterial cytoplasm --- Certainty = 0.3592(Affirmative) < succ>
           bacterial membrane  --- Certainty = 0.0000(Not Clear)   < succ>
           bacterial outside   --- Certainty = 0.0000(Not Clear)   < succ>
```

The protein has homology with the following sequences in the GENPEPT database:

```
>GP: AAA62048 GB: L10328 f270 [Escherichia coli]
Identities = 101/273 (36%), Positives = 160/273 (57%), Gaps = 10/273 (3%)

Query:    4 IKILALDLDGTLFTTDKKVSEENKVALKAAREKGIKVVITTGRPLKAIGNLLEDLELVSD   63
            IK++A+D+DGTL    D +S   K A+ AAR +G+ VV+TTGRP   + N L++L +
Sbjct:    3 IKLIAIDMDGTLLLPDHTISPAVKNAIAAARARGVNVVLTTGRPYAGVHNYLKELHMEQP   62

Query:   64 EDYSITFNGGLVQQNT-GKILAKTAMTRQEVEDIHEELYQVGLPTDILSEGTVYS----I  118
             DY IT+NG LVQ+   G  +A+TA++  +   + +VG    L   T+Y+    I
Sbjct:   63 GDYCITYNGALVQKAADGSTVAQTALSYDDYRXLEKLSREVGSHFHALDRTTLYTANRDI  122

Query:  119 ANKGHHSQYHLANPLLEFIEVDDLEQVPKDVVYNKIVSVIDATYLDQQIAKLPDRLKVDY  178
            +     H +   PL+ F E    E++ +   + K++ + +    LDQ IA++P  +K  Y
Sbjct:  123 SYYTVHESFVATIPLV-FCEA---EKMDPNTQFLKVMMIDEPAILDQAIARIPQXVKEKY  178

Query:  179 EMFKSRDIILELMPKGVHKAVGLELLTKHLGLDSSQVMAMGDEANDLSMLEWAGLGVAMA  238
             + KS    LE++ K V+K  G++ L   LG+   ++MA+GD+ ND++M+E+AG+GVAM
Sbjct:  179 TVLKSAPYFLEILDKRVNKGTGVKSLADVLGIKPEEIMAIGDQENDIAMIEYAGVGVAMD  238

Query:  239 NGIPEAKAIAKATTICNNDESGVAEAIGKYILS                            271
            N IP  K +A   T  +N E GVA AI KY+L+
Sbjct:  239 NAIPSVKEVANFVT-KSNLEDGVAFAIEKYVLN                            270
```

A related DNA sequence was identified in *S. pyogenes* <SEQ ID 1153> which encodes the amino acid sequence <SEQ ID 1154>. Analysis of this protein sequence reveals the following:

```
Possible site: 32
>>> Seems to have no N-terminal signal sequence

----- Final Results -----
           bacterial cytoplasm --- Certainty = 0.3502(Affirmative) < succ>
           bacterial membrane  --- Certainty = 0.0000(Not Clear)   < succ>
           bacterial outside   --- Certainty = 0.0000(Not Clear)   < succ>
```

An alignment of the GAS and GBS proteins is shown below:

```
Identities = 180/273 (65%), Positives = 218/273 (78%), Gaps = 1/273 (0%)

Query:    3 DIKILALDLDGTLFTTDKKVSEENKVALKAAREKGIKVVITTGRPLKAIGNLLEDLELVS   62
            +I+ILALDLDGTL+ T+K V++ NK AL AAREKG+KVVITTGRPLKAIGNLLE+L+L+
Sbjct:    2 NIRILALDLDGTLYNTEKIVTDANKKALAAAREKGVKVVITTGRPLKAIGNLLEELDLLD   61

Query:   63 DEDYSITFNGGLVQQNTGKILAKTAMTRQEVEDIHEELYQVGLPTDILSEGTVYSIANK-  121
            +DYSITFNGGLVQ+NTG++L K++++  +V  I + L  VGLPTDI+S G VYSI +K
Sbjct:   62 HDDYSITFNGGLVQRNTGEVLDKSSLSFDQVCQIQQALEAVGLPTDIISGGDVYSIPSKD  121

Query:  122 GHHSQYHLANPLLEFIEVDDLEQVPKDVVYNKIVSVIDATYLDQQIAKLPDRLKVDYEMF  181
            G HSQYHLANPLL FIEV + ++PKD+ YNKIV+V D  +LDQQI KL    L  D+E F
Sbjct:  122 GRHSQYHLANPLLTFIEVTSVAELPKDITYNKIVTVTDPDFLDQQIIKLSPSLFEDFEAF  181

Query:  182 KSRDIILELMPKGVHKAVGLELLTKHLGLDSSQVMAMGDEANDLSMLEWAGLGVAMANGI  241
            KSRDII E+MPKG+ KA GL LL +HLGLD+  VMAMGDEAND +MLEWAGLGVAMANG+
Sbjct:  182 KSRDIIFEIMPKGIDKAFGLNLLCQHLGLDARHVMAMGDEANDFAMLEWAGLGVAMANGV  241

Query:  242 PEAKAIAKATTICNNDESGVAEAIGKYILSEEN                            274
               AKA A A T   NDESGVAEA+ +IL EE+
Sbjct:  242 SGAKADADAVTTLTNDESGVAEAVKTFILEEES                            274
```

Based on this analysis, it was predicted that these proteins and their epitopes could be useful antigens for vaccines or diagnostics.

EXAMPLE 356

A DNA sequence (GBSx0387) was identified in *S. agalactiae* <SEQ ID 1155> which encodes the amino acid sequence <SEQ ID 1156>. Analysis of this protein sequence reveals the following:

```
Possible site: 49
>>> Seems to have no N-terminal signal sequence

----- Final Results -----
            bacterial cytoplasm --- Certainty = 0.4648(Affirmative) < succ>
             bacterial membrane --- Certainty = 0.0000(Not Clear)   < succ>
              bacterial outside --- Certainty = 0.0000 (Not Clear)  < succ>
```

The protein has homology with the following sequences in the GENPEPT database:

```
>GP: BAA35556 GB: D90723 Hypothetical 30.2 kd protein in idh-deoR
intergenic region. [Escherichia coli]
Identities = 91/264 (34%), Positives = 146/264 (54%), Gaps = 4/264 (1%)

Query:    2 IKLVATDMDGTFLDENGTYDKKRLANVLKKFKEQGIVFTAASGRSLLSLEQLFADFRDQM   61
            IKL+A DMDGTFL +  TY+++R     ++ K QGI F  ASG     L   F +  +++
Sbjct:    4 IKLIAVDMDGTFLSDQKTYNRERFMAQYQQMKAQGIRFVVASGNQYYQLISFFPEIANEI   63

Query:   62 AFIAENGSAAVLFNRLAYEQHLSREQYLDIIDHLSKSPYMENNEYVLSGKDGAYILSDAN  121
            AF+AENG  V  +    LS++ +    +++HL    P +    E +   GK+ AY L   +
Sbjct:   64 AFVAENGGWVVSEGKDVFNGELSKDAFATVVEHLLTRPEV---EIIACGKNSAYTLKKYD  120

Query:  122 PDYIEFITHYYDNLQKVSHFEDVDDIIFKVTANFTEETVRQAEEWVNQAI-PYATAVTTG  180
                 YY  L+ V +F++++DI FK   N ++E + Q ++  +++AI     +V TG
Sbjct:  121 DAMKTVAEMYYHRLEYVDNFDNLEDIFFKFGLNLSDELIPQVQKALHEAIGDIMVSVHTG  180

Query:  181 FKSIDIILSSVNKRNGLEHLCEQYGIRAEEVLSFGDNINDLEMLEWSGKAIATENARPEV  240
              SID+I+  V+K NGL  L+ +GI   EV+ FGD  ND+EML  +G + A ENA     V
Sbjct:  181 NGSIDLIIPGVHKANGLRQLQKLWGIDDSEVVVFGDGGNDIEMLRQAGFSFAMENAGSAV  240

Query:  241 KEIADCIIGHHNNQAVMAYLESMV                                     264
                  A    G +N + V+  ++ ++
Sbjct:  241 VAAAKYRAGSNNREGVLDVIDKVL                                     264
```

A related DNA sequence was identified in *S. pyogenes* <SEQ ID 1157> which encodes the amino acid sequence <SEQ ID 1158>. Analysis of this protein sequence reveals the following:

```
Possible site: 49
>>> Seems to have no N-terminal signal sequence

----- Final Results -----
          bacterial cytoplasm --- Certainty = 0.3401(Affirmative) < succ>
           bacterial membrane --- Certainty = 0.0000(Not Clear)   < succ>
            bacterial outside --- Certainty = 0.0000(Not Clear)   < succ>
```

An alignment of the GAS and GBS proteins is shown below:

```
Identities = 138/265 (52%), Positives = 193/265 (72%), Gaps = 1/265 (0%)

Query:    1 MIKLVATDMDGTFLDENGTYDKKRLANVLKKFKEQGIVFTAASGRSLLSLEQLFADFRDQ   60
            MIKL+ATDMDGTFL E+GTY++++LA +L K   E+GI+F  +SGRSLL+++QLF  F DQ
Sbjct:    1 MIKLIATDMDGTFLAEDGTYNQEQLAALLPKLAEKGILFAVSSGRSLLAIDQLFEPFLDQ   60

Query:   61 MAFIAENGSAAVLFNRLAYEQHLSREQYLDIIDHLSKSPYMENNEYVLSGKDGAYILSDA  120
            +A IAENGS     + +   +++EQY ++    +P+     V SG+  AYIL  A
Sbjct:   61 IAVIAENGSVVQYRGEILFADMMTKEQYTEVAKKILANPHYVETGMVFSGQKAAYILKGA  120

Query:  121 NPDYIEFITHYYDNLQKVSHFEDVD-DIIFKVTANFTEETVRQAEEWVNQAIPYATAVTT  179
             + +YI+   HYY N++ ++ FED++ D IFKV+ NFT   TV +   +W+NQA+PYATAVTT
Sbjct:  121 SEEYIQKTKHYYANVKVINGFEDMENDAIFKVSTNFTGHTVLEGSDWLNQALPYATAVTT  180

Query:  180 GFKSIDIILSSVNKRNGLEHLCEQYGIRAEEVLSFGDNINDLEMLEWSGKAIATENARPE  239
            GF SIDIIL  VNK  G+EHLC+  GI+  E ++FGDN ND +MLE++G+AIATENARPE
Sbjct:  181 GFDSIDIILKEVNKGFGMEHLCQALGIKKAETIAFGDNFNDYQMLEFAGRAIATENARPE  240

Query:  240 VKEIADCIIGHHNNQAVMAYLESMV                                   264
            +K I+D +IGH N+ AV+ YL+ +V
Sbjct:  241 IKVISDQVIGHCNDGAVLTYLKGLV                                   265
```

Based on this analysis, it was predicted that these proteins and their epitopes could be useful antigens for vaccines or diagnostics.

EXAMPLE 357

A DNA sequence (GBSx0388) was identified in *S. agalactiae* <SEQ ID 1159> which encodes the amino acid sequence <SEQ ID 1160>. Analysis of this protein sequence reveals the following:

```
Possible site: 18
>>> Seems to have no N-terminal signal sequence

----- Final Results -----
          bacterial cytoplasm --- Certainty = 0.2428(Affirmative) < succ>
           bacterial membrane --- Certainty = 0.0000(Not Clear)   < succ>
            bacterial outside --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 358

A DNA sequence (GBSx0389) was identified in *S. agalactiae* <SEQ ID 1161> which encodes the amino acid sequence <SEQ ID 1162>. This protein is predicted to be p115 protein (smc). Analysis of this protein sequence reveals the following:

```
Possible site: 55
>>> Seems to have no N-terminal signal sequence
    INTEGRAL    Likelihood = -4.99    Transmembrane    1092-1108 (1088-1110)

----- Final Results -----
           bacterial membrane --- Certainty = 0.2996(Affirmative) < succ>
```

-continued

```
            bacterial outside --- Certainty = 0.0000(Not Clear) < succ>
            bacterial cytoplasm --- Certainty = 0.0000(Not Clear) < succ>
```

A related GBS nucleic acid sequence <SEQ ID 9713> which encodes amino acid sequence <SEQ ID 9714> was also identified.

The protein has homology with the following sequences in the GENPEPT database:

```
>GP: CAB13467 GB: Z99112 chromosome segregation SMC protein homolg
[Bacillus subtilis]
Identities = 458/1193 (38%), Positives = 728/1193 (60%), Gaps = 27/1193 (2%)

Query:   1 MFLKEIEMQGFKSFADKTKVEFDQGVTAVVGPNGSGKSNITESLRWALGESSAKSLRGGK   60
           MFLK +++ GFKSFA++  V+F +GVTAVVGPNGSGKSNIT+++RW LGE SA+SLRGGK
Sbjct:   1 MFLKRLDVIGFKSFAERISVDFVKGVTAVVGPNGSGKSNITDAIRWVLGEQSARSLRGGK   60

Query:  61 MPDVIFAGTENRKPLNYAQVSVTLDNSDHFIENIADEVRVERRIFRNGDSEYLIDGRKVR  120
           M D+IFAG+++RK LN A+V++TLDN DHF+      EV V RR++R+G+SE+LI+ + R
Sbjct:  61 MEDIIFAGSDSRKRLNLAEVTLTLDNDDHFLPIDFHEVSVTRRVYRSGESEFLINNQPCR  120

Query: 121 LRDIHDLFMDTGLGRDSFSIISQGRVEAIFNSKPEERRAIFEEAAGVLKYKTRKKETQSK  180
           L+DI DLFMD+GLG+++FSIISQG+VE I +SK E+RR+IFEEAAGVLKYKTRKK+ ++K
Sbjct: 121 LKDIIDLFMDSGLGKEAFSIISQGKVEEILSSKAEDRRSIFEEAAGVLKYKTRKKKAENK  180

Query: 181 LEQTQGNLDRLEDIIYELDMQVQPLEKQASIAKRFLVLDEERQGLHLSILIEDILQHQSD  240
           L +TQ NL+R+EDI++EL+ QV+PL+ QASIAK +L  +E + + +++   DI +
Sbjct: 181 LFETQDNLNRVEDILHELEGQVEPLKIQASIAKDYLEKKKELEHVEIALTAYDIEKLHGK  240

Query: 241 LTTVEEKLLTVRKELATYYQQRQSLEDENQSLKQKRHHLSEEIEAKQLALLDVTKLKSDL  300
             +T++EK+  ++E          + E++  + K   L E +   Q LL ++     L
Sbjct: 241 WSTLKEKVQMAKEEELAESSAISAKEAKIEDTRDKIQALDESVNELQQVLLVTSEELEKL  300

Query: 301 ERQIDLIRLESNQKAEKKEEAGQRLAELEIKAKDCSDQITQKNIELTTLSEKIAQIRSEI  360
           E + ++++         + +E+ + + +  K       ++++++      TL  ++ Q+R+++
Sbjct: 301 EGRKEVLKERKKNAVQNQEQLEEAIVQFQQKETVLKEELSKQEAVFETLQAEVKQLRAQV  360

Query: 361 VSTESSLERFSTNPDQIIEKLREDFVTLMQEEADTSNALTALLADIENQKQASQAKSQEI  420
             + +L    + N ++ IE+L+ D+  L+ +   +A   N L  LL D   +Q  +  +  +
Sbjct: 361 KEKQQALSLHNENVEEKIEQLKSDYFELLWSQASIRNEL-QLLDDQMSQSAVTLQRLADN  419

Query: 421 QEVSKNLEVLKSNAKVALE-RFEAAKKNVRQLLSHYQDLGQTLQNLEGEYKWQQSILFDH  479
            E          S  K A E F     ++ +   +   Y+D+     + + +Y+ +S L+
Sbjct: 420 NEKHLQERHDISARKAACETEFARIEQEIHSQVGAYRDMQTKYEQKKRQYEKNESALYQA  479

Query: 480 LDEIKSKQARISSLESILKNHSNFYAGVKSVLQAKDQLGGIIGAVSEHLSFDKHYQTALE  539
                ++   +++ LE++   + S FY GVK VL+AK++LGGI GAV E +S ++ Y+TA+E
Sbjct: 480 YQYVQQARSKKDMLETMQGDFSGFYQGVKEVLKAKERLGGIRGAVLELISTEQKYETAIE  539

Query: 540 IALGGSSQHIIVEDESAAKRSIAFLKKNRQGRATFLPLTTIKPRELAQHYLSKLQSSQGF  599
           IALG S+QH++ +DE +A+++I +LK+N  GRATFLPL+ I+ R+L                 F
Sbjct: 540 IALGASAQHVVTDDEQSARKAIQYLKQNSFGRATFLPLSVIRDRQLQSRDAETAARHSSF  599

Query: 600 LGIASELVTYDQRLSNIFKNNLGLTAIFDTVDNANVAARQLNYQVRLVTLDGTELRPGGS  659
           LG+ASELVT+D    ++ +N LG  I + +  AN  A+ L ++ R+VTL+G  PGGS
Sbjct: 600 LGVASELVTFDPAYRSVIQNLLGTVLITEDLKGANELAKLLGHRYRIVTLEGDVVNPGGS  659

Query: 660 YSGGANRQNNTVFI--KPELDNLKKELKQAQSKQLIQEKEVATLLEQLKEKQETLAQLKN  717
            +GGA ++ N +      EL+++ K L + +    + E+EV TL      +++ ++ LA L+
Sbjct: 660 MTGGAVKKKNNSLLGRSRELEDVTKRLAEMEEKTALLEQEVKTLKHSIQDMEKKLADLRE  719

Query: 718 DGEQARLEEQRADIEYQQLSEKLADLNKLYNGLQLSSGALEQTTSENE--KNRLEKELEQ  775
               GE   RL++Q    +  +L   ++N           AL ++  E +  K +LE+EL
Sbjct: 720 TGEGLRLKQQDVKGQLYELQVAEKNINTHLELYDQEKSALSESDEERKVRKRKLEEELSA  779

Query: 776 FAIKKEELTTSIAQIKEDKDSIQEKVNNLTTLLSEAQLEERDLLNEQKFERANCCTRL---  832
            + K ++L   I ++ + K +   +L+ L+E ++         K E N  RL
Sbjct: 780 VSEKMKQLEEDIDRLTKQKQTQSSTKESLSNELTELKIAAAKKEQACKGEEDNLARLKKE  839

Query: 833 ----EITLSEIKRDISNLQTLLSHQDSQLDKEELPRIEKQLLQVNNRRENDEEKLVSLRF  888
               E+ L E K D+S L  ++S   S            E++L +     +  ND+ K + L
Sbjct: 840 LTETELALKEAKEDLSFLTSEMSSSTSG---------EEKLEEAAKHKLNDKTKTIELIA  890

Query: 889 ELEDCEAALDDLAASLAKEGQKNESLIRQQAQL----ESQCEQLSQQLMIFSRQLSEDYQ  944
              D        L  +E ++ + L +Q+   L       E + ++ +L    + L E+Y
Sbjct: 891 LRRDQRIKLQHGLDTYERELKEMKRLYKQKTTLLKDEEVKLGRMEVELDNLLQYLREEYS  950
```

```
Query:    945 MTLDEAKVKANVLEDILMAREQLKSLQAKIKALGPVNIDAIAQFEEVHERLTFLNTQRDD 1004
              ++ + AK K  +  D   AR+++K ++   I+ LG VN+ +I +FE V+ER  FL+ Q++D
Sbjct:    951 LSFEGAKEKYQLETDPEEARKRVKLIKLAIEELGTVNLGSIDEFERVNERYKFLSEQKED 1010

Query:   1005 LVHAKNLLLETITDMDDEVKTRFKSTFEAIRHSFKETFVQMFGGGSADLILTE-GDLLSA 1063
              L  AKN L + I +MD+E+  RF  TF   IR  F + F  +FGGG A+L LT+  DLL +
Sbjct:   1011 LTEAKNTLFQVIEEMDEEMTKRFNDTFVQIRSHFDQVFRSLFGGGRAELRLTDPNDLLHS 1070

Query:   1064 GVDISVQPPGKKIQSLNLMSGGEKALSALALLFAIIRVKTIPFVILDEVEAALDEANVKR 1123
              GV+I    QPPGKK+Q+LNL+SGGE+AL+A+ALLF+I++V+  +PF  +LDEVEAALDEANV R
Sbjct:   1071 GVEIIAQPPGKKLQNLLLSGGERALTAIALLFSILKVRPVPFCVLDEVEAALDEANVFR 1130

Query:   1124 FGDYLNRFDKSSQFIVVTHRKGTMSAADSIYGVTMQESGVSKIVSVKLKEAQE 1176
                F   YL ++     +QFIV+THRKGTM   AD +YGVTMQESGVSK++SVKL+E +E
Sbjct:   1131 FAQYLKKYSSDTQFIVITHRKGTMEEADVLYGVTMQESGVSKVISVKLEETKE 1183
```

A related DNA sequence was identified in *S. pyogenes* <SEQ ID 1163> which encodes the amino acid sequence <SEQ ID 1164>. Analysis of this protein sequence reveals the following:

```
Possible site: 15
>>> Seems to have no N-terminal signal sequence
     INTEGRAL      Likelihood = -4.99     Transmembrane    1092-1108 (1088-1110)

----- Final Results -----
              bacterial membrane --- Certainty = 0.2996(Affirmative) < succ>
               bacterial outside --- Certainty = 0.0000(Not Clear)  < succ>
             bacterial cytoplasm --- Certainty = 0.0000(Not Clear)  < succ>
```

The protein has homology with the following sequences in the databases:

```
>GP: CAB13467 GB: Z99112 chromosome segregation SMC protein homolg
[Bacillus subtilis]
Identities = 441/1192 (36%), Positives = 729/1192 (60%), Gaps = 25/1192 (2%)

Query:     1 MFLKEIEMEGFKSFADKTKIEFDKGVTAVVGPNGSGKSNITESLRWALGESSAKNLRGGK   60
             MFLK +++  GFKSFA++   ++F KGVTAVVGPNGSGKSNIT+++RW LGE SA++LRGGK
Sbjct:     1 MFLKRLDVIGFKSFAERISVDFVKGVTAVVGPNGSGKSNITDAIRWVLGEQSARSLRGGK   60

Query:    61 MPDVIFAGTQNRNPLNYAKVAVVLDNSDHFIKTAKKEIRVERHIYRNGDSDYLIDGRKVR  120
             M D+IFAG+ +R  LN A+V + LDN DHF+     E+ V R +YR+G+S++LI+ +  R
Sbjct:    61 MEDIIFAGSDSRKRLNLAEVTLTLDNDDHFLPIDFHEVSVTRRVYRSGESEFLINNQPCR  120

Query:   121 LRDIHDLFMDTGLGRDSFSIISQGRVEEIFNSKPEERRAIFEEAAGVLKYKTRKKETQIK  180
             L+DI  DLFMD+GLG++++FSIISQG+VEEI +SK  E+RR+IFEEAAGVLKYKTRKK+ + K
Sbjct:   121 LKDIIDLFMDSGLGKEAFSIISQGKVEEILSSKAEDRRSIFEEAAGVLKYKTRKKKAENK  180

Query:   181 LNQTQDNLDRLEDIIYELDTQLAPLEKQAKVAKQFLELDANRKQLQLDILVKDIDIAQER  240
             L +TQDNL+R+EDI++EL+ Q+  PL+ QA +AK +LE         + +++ +  DI+   +
Sbjct:   181 LFETQDNLNRVEDILHELEGQVEPLKIQASIAKDYLEKKKELEHVEIALTAYDIEKLHGK  240

Query:   241 QTKDTEALAALQQDLASYYAKRQSMEEDYQKFKQKKQVLSQESDQTQTTLLELTKLIADL  300
                   +  E +   +++ +   +  E   + +KQ L +  ++ Q  LL  ++ +  L
Sbjct:   241 WSTLKEKVQMAKEEELAESSAISAKEAKIEDTRDKIQALDESVNELQQVLLVTSEELEKL  300

Query:   301 EKQIELVKLESGQSAEKKAEAKKHLEQLQEQLDGFQAEEKQCTEQLLH-------IDQQL  353
             E +  E+++K        E+K  A ++ EQL+E +   FQ +E       +       ++
Sbjct:   301 EGRKEVLK-------ERKKNAVQNQEQLEEAIVQFQQKETVLKEELSKQEAVFETLQAEV  353

Query:   354 CDVKQQLNELSNALERFSSDPDQLMETLREEFVLLMQKEAALSNQLTALKAHLDKEKQAR  413
              ++ Q+  E   AL   + + ++ +E L+  ++    L+  +A++ N+L       +  +
Sbjct:   354 KQLRAQVKEKQQALSLHNENVEEKIEQLKSDYFELLNSQASIRNELQLLDDQMSQSAVTL  413

Query:   414 QHKAQEYQLLVTKLDQLNDESQKAQAHYKAQKEQVEMLLQNYQEGDKRVQELERDYQLNQ  473
             Q  A  + ++  +  ++           +  +  ++++++   + Y++      + ++ R Y+ N+
Sbjct:   414 QRLADNNEKHLQERHDISARKAACETEFARIEQEIHSQVGAYRDMQTKYEQKKRQYEKNE  473

Query:   474 ERLFDLLDQKKGKEARKASLESIQKSHSQFYAGVRAVLQSQKKLGGIIGAVSEHLSFDSD  533
               L+       +  ++K  LE++Q   S FY GV+ VL+++++LGGI  GAV E +S +
Sbjct:   474 SALYQAYQYVQQARSKKDMLETMQGDFSGFYQGVKEVLKAKERLGGIRGAVLELISTEQK  533

Query:   534 YQTALEVALGANSQHIIVTDEAAAKRAIAYLKKNRQGRATFLPLTTIKARSLSEHYHRQL  593
             Y+TA+E+ALGA++QH++  DE +A+ AI YLK+N  GRATFLPL+ I+ R L
Sbjct:   534 YETAIEIALGASAQHVVTDDEQSARKAIQYLKQNSFGRATFLPLSVIRDRQLQSRDAETA  593
```

```
-continued

Query:   594 ATCEGYLGTAESLIRYDDSLSAIIQNLLSSTAIFETIDQANIAARLLGYKVRIVTLDGTE  653
             A    +LG A  L+ +D +  ++IQNLL +  I E +  AN A+LLG++ RIVTL+G
Sbjct:   594 ARHSSFLGVASELVTFDPAYRSVIQNLLGTVLITEDLKGANELAKLLGHRYRIVTLEGDV  653

Query:   654 LRPGGSFSGGANRQSNTTFI--KPELEQISEELTRLVEQLKITEKEVAALQSDLIAKKEE  711
             + PGGS +GGA ++ N + +    ELE +++ L  + E+  + E+EV L+ +    +++
Sbjct:   654 VNPGGSMTGGAVKRKNNSLLGRSRELEDVTKRLAEMEEKTALLEQEVKTLKHSIQDMEKK  713

Query:   712 LTQLKLAGDQARLAEQ--RAQMAYQQLQEKQEDSKALLAALDQSQTTHSDESLLAEQARI  769
             L  L+  G+  RL +Q    + Q+   Q+ EK  ++    L  ++S  + SDE    + ++
Sbjct:   714 LADLRETGEGLRLRQQDVKGQLYELQVAEKNINTHLELYDQEKSALSESDEERKVRKRKL  773

Query:   770 EEALTAIAKKKNALTCDIDDIKENKDLIRQKTQNIHQALSQARLQERDLLNEKKFEQANQ  829
             EE L+A+++K   L  DID + + K       +++   L++ ++         K E+ N
Sbjct:   774 EEELSAVSEKMKQLEEDIDRLTKQKQTQSSTKESLSNELTELKIAAAKKEQACKGEEDNL  833

Query:   830 SRLRTQLKQCQQNILKLESILNNNVSQDSIQRLPQWQKQLQDATEHKSGAQKRLVQLRFE  889
             +RL+ +L + +    + + L+   S+ S            +++L++A +HK  +   ++L
Sbjct:   834 ARLKKELTETELALKEAKEDLSFLTSEMSSS--TSGEEKLEEAAKHKLNDKTKTIELIAL  891

Query:   890 IEDYEARLEETAEKITKESEKNDTFIRRQTKL----ETHLEQVANRLRAYAKSLSEDFQM  945
              D  +L+ +   +E ++     +++T L   E L  ++   L    + L E++ +
Sbjct:   892 RRDQRIKLQHGLDTYERELKEMKRLYKQKTTLLKDEEVKLGRMEVELDNLLQYLREEYSL  951

Query:   946 TLADAKEVTNSIDHLESAKEKLHHLQKTIRALGPINSDAINQYEEVHERLTFLTSQKTDL 1005
             +    AKE      E A++++ ++  I  LG +N  +I+++E V+ER  FL+ QK DL
Sbjct:   952 SFEGAKEKYQLETDPEEARKRVKLIKLAIEELGTVNLGSIDEFERVNERYKFLSEQKEDL 1011

Query:  1006 TKAKNLLLETINSMDSEVKARFKVTFEAIQKSFKETFTQMFGGGSADLVLTE-TDLLSAG 1064
             T+AKN L + I  MD E+   RF  TF  I+  F  F +FGGG A+L LT+  DLL +G
Sbjct:  1012 TEAKNTLFQVIEEMDEEMTKRFNDTFVQIRSHFDQVFRSLFGGGRAELRLTDPNDLLHSG 1071

Query:  1065 IEISVQPPGKKIQSLNLMSGGEKALSALALLFAIIRVKTIPFVILDEVEAALDEANVKRF 1124
             +EI  QPPGKK+Q+LNL+SGGE+AL+A ALLF+I+ V+  PF +LDEVEAALD+ANV RF
Sbjct:  1072 VEIIAQPPGKKLQNLNLLSGGERALTAIAIALLFSILKVRPVPFCVLDEVEAALDEANVFRF 1131

Query:  1125 GDFLNRFDKDSQFIVVTHRKGTMAAADSIYGITMQESGVSKIVSVKLKEAQE         1176
             +L ++  D+QFIV+THRKGTM  AD +YG+TMQESGVSK++SVKL+E +E
Sbjct:  1132 AQYLKKYSSDTQFIVITHRKGTMEEADVLYGVTMQESGVSKVISVKLEETKE         1183
```

An alignment of the GAS and GBS proteins is shown below:

```
Identities = 732/1179 (62%), Positives = 911/1179 (77%)

Query:    1 MFLKEIEMQGFKSFADKTKVEFDQGVTAVVGPNGSGKSNITESLRWALGESSAKSLRGGK   60
            MFLKEIE++GFKSFADKTK+EFD+GVTAVVGPNGSGKSNITESLRWALGESSAK+LRGGK
Sbjct:    1 MFLKEIELEGFKSFADKTKIEFDKGVTAVVGPNGSGKSNITESLRWALGESSAKNLRGGK   60

Query:   61 MPDVIFAGTENRKPLNYAQVSVTLDNSDHFIENIADEVRVERRIFRNGDSEYLIDGRKVR  120
            MPDVIFAGT+NR PLNYA+V+V LDNSDHFI+    E+RVER I+RNGDS+YLIDGRKVR
Sbjct:   61 MPDVIFAGTQNRPLNYAKVAVVLDNSDHFIKTAKKEIRVERHIYRNGDSDYLIDGRKVR  120

Query:  121 LRDIHDLFMDTGLGRDSFSIISQGRVEAIFNSKPEERRAIFEEAAGVLKYKTRKKETQSK  180
            LRDIHDLFMDTGLGRDSFSIISQGRVE IFNSKPEERRAIFEEAAGVLKYKTRKKETQ K
Sbjct:  121 LRDIHDLFMDTGLGRDSFSIISQGRVEEIFNSKPEERRAIFEEAAGVLKYKTRKKETQIK  180

Query:  181 LEQTQGNLDRLEDIIYELDMQVQPLEKQASIAKRFLVLDEERQGLHLSILIEDILQHSD  240
            L QTQ NLDRLEDIIYELD Q+ PLEKQA +AK+FL LD  R+ L L IL++DI   Q
Sbjct:  181 LNQTQDNLDRLEDIIYELDTQLAPLEKQAKVAKQFLELDANRKQLQLDILVKDIDIAQER  240

Query:  241 LTTVEEKLLTVRKELATYYQQRQSLEDENQSLKQKRHHLSEEIEAKQLALLDVTKLKSDL  300
              T  E L ++++LA+YY +RQS+E++  Q KQK+ LS+E + Q LL++TKL +DL
Sbjct:  241 QTKDTEALAALQQDLASYYAKRQSMEEDYQKFKQKKQVLSQESDQTQTTLLELTKLIADL  300

Query:  301 ERQIDLIRLESNQKAEKKEEAGQRLAELEIKAKDCSDQITQKNIELTTLSEKIAQIRSEI  360
            E+QI+L++LES Q+AEKK EA L +L+ +        Q +L + +++   ++ ++
Sbjct:  301 EKQIELVKLESGQEAEKKAEAKKHLEQLQEQLDGFQAEEKQCTEQLLHIDQQLCDVKQQL  360

Query:  361 VSTESSLERFSTNPDQIIEKLREDFVTLMQEEADTSNALTALLADIENQKQASQAKSQEI  420
              ++LERFS++PDQ++E LRE+FV LMQ+EA  SN LTAL A ++ +KQA Q K+QE
Sbjct:  361 NELSNALERFSSDPDQLMETLREEFVLLMQKEAALSNQLTALKAHLDKEKQARQHKAQEY  420

Query:  421 QEVSKNLEVLKSNAKVALERFEAAKKNVRQLLSHYQDLGQTLQNLEGEYKNQQSILFDHL  480
            Q +    L+  L  ++  A   ++A K+ V  LL  +YQ+    +Q LE +Y+   Q  LFD L
Sbjct:  421 QLLVTKLDQLNDESQKAQAHYKAQKEQVEMLLQNYQEGDKRVQELERDYQLNQERLFDLL  480
```

```
-continued
Query:   481 DEIKSKQARISSLESILKNHSNFYAGVKSVLQAKDQLGGIIGAVSEHLSFDKHYQTALEI   540
             D+ K K+AR +SLESI K+HS FYAGV++VLQ++ +LGGIIGAVSEHLSFD  YQTALE+
Sbjct:   481 DQKKGKEARKASLESIQKSHSQFYAGVRAVLQSQKKLGGIIGAVSEHLSFDSDYQTALEV   540

Query:   541 ALGGSSQHIIVEDESAAKRSIAFLKKNRQGRATFLPLTTIKPRELAQHYLSKLQSSQGFL   600
             ALG +SQHIIV DE+AAKR+IA+LKKNRQGRATFLPLTTIK R L++HY  +L + +G+L
Sbjct:   541 ALGANSQHIIVTDEAAAKRAIAYLKKNRQGRATFLPLTTIKARSLSEHYHRQLATCEGYL   600

Query:   601 GIASELVTYDQRLSNIFKNNLGLTAIFDTVDNANVAARQLNYQVRLVTLDGTELRPGGSY   660
             G A  L+ YD  LS I +N L  TAIF+T+D AN+AAR L Y+VR+VTLDGTELRPGGS+
Sbjct:   601 GTAESLIRYDDSLSAIIQNLLSSTAIFETIDQANIAARLLGYKVRIVTLDGTELRPGGSF   660

Query:   661 SGGANRQNNTVFIKPELDNLKKELKQAQSKQLIQEKEVATLLEQLKEKQETLAQLKNDGE   720
             SGGANRQ+NT FIKPEL+  +EL +   +  I EKEVA L    L  K+E L QLK  G+
Sbjct:   661 SGGANRQSNTTFIKPELEQISEELTRLVEQLKITEKEVAALQSDLIAKKEELTQLKLAGD   720

Query:   721 QARLEEQRADIEYQQLSEKLADLNKLYNGLQLSSGALEQTTSENEKNRLEKELEQFAIKK   780
             QARL EQRA + YQQL EK D   L   L S     +   E+ R+E+ L    A KK
Sbjct:   721 QARLAEQRAQMAYQQLQEKQEDSKALLAALDQSQTTHSDESLLAEQARIEEALTAIAKKK   780

Query:   781 EELTTSIAQIKEDKDSIQEKVNNLTTLLSEAQLEERDLLNEQKFERANCTRLEITLSEIK   840
                LT   I   IKE+KD I++K  N+   LS+A+L+ERDLLNE+KFE AN +RL    L + +
Sbjct:   781 NALTCDIDDIKENKDLIRQKTQNIHQALSQARLQERDLLNEKKFEQANQSRLRTQLKQCQ   840

Query:   841 RDISNLQTLLSHQDSQLDKEELPRIEKQLLQVNNRRENDEEKLVSLRFELEDCEAALDDL   900
             ++I  L+++L++   SQ   + LP+ +KQL      +   +++LV LRFE+ED EA L++
Sbjct:   841 QNILKLESILNNNVSQDSIQRLPQWQKQLQDATEHKSGAQKRLVQLRFEIEDYEARLEET   900

Query:   901 AASLAKEGQKNESLIRQQAQLESQCEQLSQQLMIFSRQLSEDYQMTLDEAKVKANVLEDI   960
             A   + KE +KN++ IR+Q +LE+  EQ++  L  +++ LSED+QMTL +AK    N ++ +
Sbjct:   901 AEKITKESEKNDTFIRRQTKLETHLEQVANRLRAYAKSLSEDFQMTLADAKEVTNSIDHL   960

Query:   961 LMAREQLKSLQAKIKALGPVNIDAIAQFEEVHERLTFLNTQRDDLVHAKNLLLETITDMD   1020
                A+E+L   LQ  I+ALGP+N DAI Q+EEVHERLTFL +Q+ DL  AKNLLLETI  MD
Sbjct:   961 ESAKEKLHHLQKTIRALGPINSDAINQYEEVHERLTFLTSQKTDLTKAKNLLLETINSMD   1020

Query:  1021 DEVKTRFKSTFEAIRHSFKETFVQMFGGGSADLILTEGDLLSAGVDISVQPPGKKIQSLN   1080
              EVK RFK TFEAI+ SFKETF QMFGGGSADL+LTE DLLSAG++ISVQPPGKKIQSLN
Sbjct:  1021 SEVKARFKVTFEAIQKSFKETFTQMFGGGSADLVLTETDLLSAGIEISVQPPGKKIQSLN   1080

Query:  1081 LMSGGEKALSALALLFAIIRVKTIPFVILDEVEAALDEANVKRFGDYLNRFDKSSQFIVV   1140
             LMSGGEKALSALALLFAIIRVKTIPFVILDEVEAALDEANVKRFGD+LNRFDK SQFIVV
Sbjct:  1081 LMSGGEKALSALALLFAIIRVKTIPFVILDEVEAALDEANVKRFGDFLNRFDKDSQFIVV   1140

Query:  1141 THRKGTMSAADSIYGVTMQESGVSKIVSVKLKEAQEMTN                       1179
             THRKGTM+AADSIYG+TMQESGVSKIVSVKLKEAQEMTN
Sbjct:  1141 THRKGTMAAADSIYGITMQESGVSKIVSVKLKEAQEMTN                       1179
```

SEQ ID 1162 (GBS199) was expressed in *E. coli* as a GST-fusion product. SDS-PAGE analysis of total cell extract is shown in FIG. 52 (lane 2; MW 75 kDa).

Figure 208:
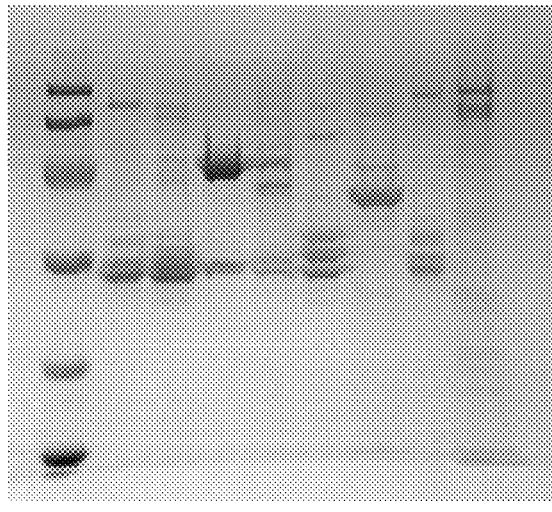

GBS199-GST was purified as shown in FIG. 208, lane 3.

Based on this analysis, it was predicted that these proteins and their epitopes could be useful antigens for vaccines or diagnostics.

EXAMPLE 359

A DNA sequence (GBSx0390) was identified in *S. agalactiae* <SEQ ID 1165> which encodes the amino acid sequence <SEQ ID 1166>. This protein is predicted to be ribonuclease III (rnc). Analysis of this protein sequence reveals the following:

```
Possible site: 46
>>> Seems to have no N-terminal signal sequence

----- Final Results -----
            bacterial cytoplasm --- Certainty = 0.3372(Affirmative) < succ>
            bacterial membrane  --- Certainty = 0.0000(Not Clear)   < succ>
            bacterial outside   --- Certainty = 0.0000(Not Clear)   < succ>
```

A related GBS nucleic acid sequence <SEQ ID 9711> which encodes amino acid sequence <SEQ ID 9712> was also identified.

The protein has homology with the following sequences in the GENPEPT database:

```
>GP: CAB13466 GB: Z99112 ribonuclease III [Bacillus subtilis]
Identities = 115/230 (50%), Positives = 154/230 (66%), Gaps = 1/230 (0%)

Query:   13 KKMKELRSKLEKDYGIVFANQELLDTAFTHTSYANEHRLLNISHNERLEFLGDAVLQLLI    72
            KK+++ +    E+    + F N++LL  AFTH+SY NEHR      NERLEFLGDAVL+L I
Sbjct:   15 KKVEQFKEFQER-ISVHFQNEKLLYQAFTHSSYVNEHRKKPYEDNERLEFLGDAVLELTI   73

Query:   73 SQYLFTKYPQKAEGDLSKLRSMIVREESLAGFSRLCGFDHYIKLGKGEEKSGGRNRDTIL  132
            S++LF KYP +EGDL+KLR+ IV E SL    +    F  + LGKGEE +GGR R  +L
Sbjct:   74 SRFLFAKYPAMSEGDLTKLRAAIVCEPSLVSLAHELSFGDLVLLGKGEEMTGGRKRPALL  133

Query:  133 GDLFEAFLGALLLDKGVEVVHAFVNKVMIPHVEKGTYERVKDYKTSLQELLQSHGDVKID  192
            D+FEAF+GAL LD+G+E V +F+   + P +  G + V D+K+ LQE +Q  G    ++
Sbjct:  134 ADVFEAFIGALYLDQGLEPVESFLKVYVFPKINDGAFSHVMDFKSQLQEYVQRDGKGSLE  193

Query:  193 YQVTNESGPAHAKEFEVTVSVNQENLSQGIGRSKKAAEQDAAKNALATLQ           242
            Y+++NE GPAH +EFE  VS+  E L  G GRSKK AEQ AA+ ALA LQ
Sbjct:  194 YKISNEKGPAHNREFEAIVSLKGEPLGVGNGRSKKEAEQHAAQEALAKLQ           243
```

A related DNA sequence was identified in *S. pyogenes* <SEQ ID 1167> which encodes the amino acid sequence <SEQ ID 1168>. Analysis of this protein sequence reveals the following:

```
Possible site: 32
>>> Seems to have no N-terminal signal sequence

----- Final Results -----
           bacterial cytoplasm --- Certainty = 0.1414(Affirmative) < succ>
           bacterial membrane  --- Certainty = 0.0000(Not Clear)   < succ>
           bacterial outside   --- Certainty = 0.0000(Not Clear)   < succ>
```

An alignment of the GAS and GBS proteins is shown below:

```
Identities = 170/227 (74%), Positives = 192/227 (83%)

Query:   15 MKELRSKLEKDYGIVFANQELLDTAFTHTSYANEHRLLNISHNERLEFLGDAVLQLLISQ   74
            MK+L   L   + I F +  LL+TAFTHTSYANEHRLLN+SHNERLEFLGDAVLQL+IS+
Sbjct:    1 MKQLEELLSTSFDIQFNDLTLLETAFTHTSYANEHRLLNVSHNERLEFLGDAVLQLIISE   60

Query:   75 YLFTKYPQKAEGDLSKLRSMIVREESLAGFSRLCGFDHYIKLGKGEEKSGGRNRDTILGD  134
            YLF KYP+K EGD+SKLRSMIVREESLAGFSR C FD YIKLGKGEEKSGGR RDTILGD
Sbjct:   61 YLFAKYPKKTEGDMSKLRSMIVREESLAGFSRFCSFDAYIKLGKGEEKSGGRRRDTILGD  120

Query:  135 LFEAFLGALLLDKGVEVVHAFVNKVMIPHVEKGTYERVKDYKTSLQELLQSHGDVKIDYQ  194
            LFEAFLGALLLDKG++ V  F+ +VMIP VEKG +ERVKDYKT LQE LQ+ GDV IDYQ
Sbjct:  121 LFEAFLGALLLDKGIDAVRRFLKQVMIPQVEKGNFERVKDYKTCLQEFLQTKGDVAIDYQ  180

Query:  195 VTNESGPAHAKEFEVTVSVNQENLSQGIGRSKKAAEQDAAKNALATL              241
            V +E GPAHAK+FEV++ VN   LS+G+G+SKK AEQDAAKNALA L
Sbjct:  181 VISEKGPAHAKQFEVSIVVNGAVLSKGLGKSKKLAEQDAAKNALAQL              227
```

Based on this analysis, it was predicted that these proteins and their epitopes could be useful antigens for vaccines or diagnostics.

EXAMPLE 360

A DNA sequence (GBSx0391) was identified in *S. agalactiae* <SEQ ID 1169> which encodes the amino acid sequence <SEQ ID 1170>. Analysis of this protein sequence reveals the following:

```
Possible site: 43
>>> Seems to have a cleavable N-term signal seq.
     INTEGRAL    Likelihood = -4.19    Transmembrane    100-116 (99-117)
     INTEGRAL    Likelihood = -2.44    Transmembrane    81-97 (81-97)

----- Final Results -----
            bacterial membrane --- Certainty = 0.2678(Affirmative) < succ>
            bacterial outside  --- Certainty = 0.0000(Not Clear)   < succ>
            bacterial cytoplasm --- Certainty = 0.0000(Not Clear)  < succ>
```

The protein has homology with the following sequences in the GENPEPT database:

```
>GP: CAC12789 GB: AJ279090 hypothetical protein [Staphylococcus
carnosus]
Identities = 50/114 (43%), Positives = 72/114 (62%)

Query:  3 KIFYISLGFISLGIGIAGIVLPVVPTTPLVLLSAFCFSRSSEKFDIWLRQTKVYKYYAAD   62
          K  ++LG I  GIG  GIV+P++PTTP +LL+A CFSRSS+KF+ WL   TK++  Y
Sbjct:  2 KYVLMTLGLIFAGIGFVGIVVPLLPTTPFLLLAAICFSRSSKKFNRWLVNTKIHDEYVES   61

Query: 63 FVESRSIAPARKKSMIWQIYILMGISIYFAPLMWLKLGLLIGTIVGTYVLFYVV         116
          F  +    +K ++ +YILMGISI+     +++++ LLI   V T VLF V
Sbjct: 62 FKRDKGFTLKKKFKLLTSLYILMGISIFIIDNLYIRITLLIMLFVQTVVLFTFV         115
```

No corresponding DNA sequence was identified in *S. pyogenes*.

Based on this analysis, it was predicted that this protein and its epitopes, could be useful antigens for vaccines or diagnostics.

EXAMPLE 361

A DNA sequence (GBSx0392) was identified in *S. agalactiae* <SEQ ID 1171> which encodes the amino acid sequence <SEQ ID 1172>. Analysis of this protein sequence reveals the following:

```
Possible site: 45
>>> Seems to have no N-terminal signal sequence

----- Final Results -----
            bacterial cytoplasm --- Certainty = 0.1908(Affirmative) < succ>
            bacterial membrane  --- Certainty = 0.0000(Not Clear)   < succ>
            bacterial outside   --- Certainty = 0.0000(Not Clear)   < succ>
```

A related DNA sequence was identified in *S. pyogenes* <SEQ ID 1173> which encodes the amino acid sequence <SEQ ID 1174>. Analysis of this protein sequence reveals the following:

```
Possible site: 45
>>> Seems to have no N-terminal signal sequence

----- Final Results -----
            bacterial cytoplasm --- Certainty = 0.1610(Affirmative) < succ>
            bacterial membrane  --- Certainty = 0.0000(Not Clear)   < succ>
            bacterial outside   --- Certainty = 0.0000(Not Clear)   < succ>
```

An alignment of the GAS and GBS proteins is shown below:

```
Identities = 225/269 (83%), Positives = 248/269 (91%)

Query:  1 MSEIGFKYSILASGSTGNCFYIETPQKRLLIDAGLTGKKVTSLLAEINRKPEDLDAILVT   60
          M+E GFKYSILASGSTGNCFY+ETP+KRLLIDAGLTGKK+TSLLAEI+RKPEDLDAIL+T
Sbjct:  1 MNESGFKYSILASGSTGNCFYLETPKKRLLIDAGLTGKKITSLLAEIDRKPEDLDAILIT   60

Query: 61 HEHSDHIKGVGVLARKYHLDIYANEQTWKVMDERNMLGKVDVSQKHVFGRGKTLTFGDLD  120
          HEHSDHIKGVGV+ARKYHLDIYANE+TW++MDE NMLGK+D SQKH+F R K LTFGD+D
```

-continued

```
Sbjct:  61 HEHSDHIKGVGVMARKYHLDIYANEKTWQLMDECNMLGKLDASQKHIFQRDKVLTFGDVD 120

Query: 121 IESFGVSHDAVDPQFYRMMKDDKSFVMLTDTGYVSDRMAGLIENADGYLIESNHDIEILR 180
           IESFGVSHDA+DPQFYR+MKD+KSFVMLTDTGYVSDRM G+IENADGYLIESNHDIEILR
Sbjct: 121 IESFGVSHDAIDPQFYRIMKDNKSFVMLTDTGYVSDRMTGIIENADGYLIESNHDIEILR 180

Query: 181 SGSYPWTLKQRILSDKGHLSNEDGSETMIRTIGNRTKHIYLGHLSKENNIKELAHMTMEN 240
           SGSYPW+LKQRILSD GHLSNEDG+  MIR++G  TK IYLGHLSKENNIKELAHMTM N
Sbjct: 181 SGSYPWSLKQRILSDLGHLSNEDGAGAMIRSLGYNTKKIYLGHLSKENNIKELAHMTMVN 240

Query: 241 NLMRADFGVGTDFSVHDTSPDSATPLTRI                                269
           L  AD  VGTDF+VHDTSPD+A PLT I
Sbjct: 241 QLAMADLAVGTDFTVHDTSPDTACPLTDI                                269
```

Based on this analysis, it was predicted that these proteins and their epitopes could be useful antigens for vaccines or diagnostics.

EXAMPLE 362

A DNA sequence (GBSx0393) was identified in *S. agalactiae* <SEQ ID 1175> which encodes the amino acid sequence <SEQ ID 1176>. Analysis of this protein sequence reveals the following:

```
Possible site: 26
>>> Seems to have an uncleavable N-term signal seq
     INTEGRAL     Likelihood = -11.94     Transmembrane     15-31 (5-34)

----- Final Results -----
             bacterial membrane --- Certainty = 0.5776(Affirmative) < succ>
              bacterial outside --- Certainty = 0.0000(Not Clear)   < succ>
            bacterial cytoplasm --- Certainty = 0.0000(Not Clear)   < succ>
```

A related DNA sequence was identified in *S. pyogenes* <SEQ ID 1177> which encodes the amino acid sequence <SEQ ID 1178>. Analysis of this protein sequence reveals the following:

```
Possible site: 26
>>> Seems to have a cleavable N-term signal seq.

----- Final Results -----
              bacterial outside --- Certainty = 0.3000(Affirmative) < succ>
             bacterial membrane --- Certainty = 0.0000(Not Clear)   < succ>
            bacterial cytoplasm --- Certainty = 0.0000(Not Clear)   < succ>
```

An alignment of the GAS and GBS proteins is shown below:

```
Identities = 335/443 (75%), Positives = 392/443 (87%)

Query:   7 NIRSFELALLFLLVFVAVYFVYLAVRDFKMSKNIRLLNWKVRDLIAGNYSDSILIQGDAD  66
           N+ +FELA+L LLVFVA YF++LAVRD++ ++ IR+++ K+RDLI G Y+D I  + D +
Sbjct:   8 NLSTFELAILILLVFVAFYFIHLAVRDYRNARIIRMMSHKIRDLINGRYTDIIDEKADIE  67

Query:  67 LVELGESLNDLSDVFRMAHDNLEQEKNRLASILTYMTDGVLATDRSGKIVMINETAQQQF 126
           L+EL + LNDLSDVFR+ H+NL QEKNRLASIL YM+DGVLATDRSGKI+MINETA++Q
Sbjct:  68 LMELSDQLNDLSDVFRLTHENLAQEKNRLASILAYMSDGVLATDRSGKIIMINETARKQL 127
```

```
Query:  127 NLAYDEALSMNIVDMLGSGSPYSFQDLVSKTPEVVLNRRDENGEFVTLRIRFALNRRESG  186
            NL+ +EAL  NI D+L    + Y+++DLVSKTP V +N R++ GEFV+LR+RFALNRRESG
Sbjct:  128 NLSKEEALKKNITDLLEGDTSYTYRDLVSKTPVVTVNSRNDMGEFVSLRLRFALNRRESG  187

Query:  187 FISGLVAVSHDATEQEKEERERRLFVSNVSHELRTPLTSVKSYLEALDEGALNEEVAPSF  246
            FISGLV V HD TEQEKEERERRLFVSNVSHELRTPLTSVKSYLEALDEGAL E++APSF
Sbjct:  188 FISGLVVVLHDTTEQEKEERERRLFVSNVSHELRTPLTSVKSYLEALDEGALKEDIAPSF  247

Query:  247 IKVSLDETNRMMRMISDLLSLSRIDNEVTHLDVEMTNFTAFMTSILNRFDQIRNQKTVTG  306
            IKVSLDETNRMMRMISDLL+LSRIDN+VT L VEMTNFTAF+TSILNRFD ++NQ T TG
Sbjct:  248 IKVSLDETNRMMRMISDLLNLSRIDNQVTQLAVEMTNFTAFITSILNRFDLVKNQHTGTG  307

Query:  307 KVYEIVRDYPLKSIWVEIDTDKMTQVIDNILNNAVKYSPDGGKITVNLRTTKTQMILSIS  366
            KVYEIVRDYP+ S+W+EID DKMTQVI+NILNNA+KYSPDGGKITV ++TT TQ+I+SIS
Sbjct:  308 KVYEIVRDYPITSVWIEIDNDKMTQVIENILNNAIKYSPDGGKITVRMKTTDTQLIISIS  367

Query:  367 DQGLGIPKKDLPLIFDRFYRVDKARSRKQGGTGLGLSIAKEIVKQHKGFIWAKSEYGKGS  426
            DQGLGIPK DLPLIFDRFYRVDKARSR QGGTGLGL+IAKEI+KQH GFIWAKS+YGKGS
Sbjct:  368 DQGLGIPKTDLPLIFDRFYRVDKARSRAQGGTGLGLAIAKEIIKQHHGFIWAKSDYGKGS  427

Query:  427 TFTIVLPYDKDAVTYEEWEDVED                                      449
            TFTIVLPY+KDA  YEEWE+  D
Sbjct:  428 TFTIVLPYEKDAAIYEEWEEDVD                                      450
```

A related GBS gene <SEQ ID 8561> and protein <SEQ ID 8562> were also identified. Analysis of this protein sequence reveals the following:

```
Lipop: Possible site: -1 Crend: 8
McG: Discrim Score: 8.59
GvH: Signal Score (-7.5): -3.38
      Possible site: 26
>>> Seems to have an uncleavable N-term signal seq
ALOM program count: 1 value: -11.94 threshold: 0.0
    INTEGRAL      Likelihood = -11.94     Transmembrane      15-31 (5-34)
    PERIPHERAL    Likelihood =  8.27      178
modified ALOM score: 2.89
*** Reasoning Step: 3

----- Final Results -----
              bacterial membrane --- Certainty = 0.5776(Affirmative) < succ>
              bacterial outside  --- Certainty = 0.0000(Not Clear)   < succ>
              bacterial cytoplasm --- Certainty = 0.0000(Not Clear)  < succ>
```

The protein has homology with the following sequences in the databases:

```
67.5/83.5% over 439aa
Streptococcus pneumoniae
GP|5830524| histidine kinase Insert characterized ORF01458(331-1647 of 1947)
GP|5830524|emb|CAB54569.1||AJ006392(10-449 of 449) histidine kinase
{Streptococcus pneumoniae}
% Match    = 45.6
% Identity = 67.5  % Similarity = 83.4
Matches = 297  Mismatches = 70  Conservative Sub.s = 70
```

```
126         156         186         216         246         276         306         336
ITSPFSDTYRTSHDTRTFIGNSLGI*LFWRCPYS*CDGETFT*KD*RYSWSSRIYFDSTWCRXIT*SLMNNSAANIRSFE
                                                                               |
                                                                               MLDLLKQTIFT
                                                                                       10

366         396         426         450         480         510         540         570
LALLFLLVFVAVYFVYLAVRDFKMSKNIRL--LNWKVRDLIAGNYSDSILIQGDADLVELGESLNDLSDVFRMAHDNLEQ
 ::|:|:::      :|    :       ||:|  :| ||:|||||:||   : :||  :::   :  :|||||:|  |: ::||||
RDFIFILILLGPILVVTLLLLENRRDNIQLKQVNQKVKDLIAGDYSKVLDMQGGSEITNITNNLNDLSEVIRLTQENLEQ
                30          40          50          60          70          80          90

600         630         660         690         720         750         780         810
EKNRLASILTYMTDGVLATDRSGKIVMINETAQQQFNLAYDEALSMNIVDMLGSGSPYSFQDLVSKTPEVVLNRRDENGE
|  ||  ||| ||||||||||||:| |:|:|||:|::|: |   ::  |: :|:::|       |  :||::::||::|:  :| |||
ESKRLNSILFYMTDGVLATNRRGQIIMINDTAKKQLGLVKEDVLNRSILELLKIEENYELRDLITQSPELLLDSQDINGE
              110         120         130         140         150         160         170

840         870         900         930         960         990         1020        1050
FVTLRIRFALNRRESGFISGLVAVSHDATEQEKEERERRLFVSNVSHELRTPLTSVKSYLEALDEGALNEEVAPSFIKVS
::  ||:||||  |||||||||||| ||  ||||||||||||||||||||||||||||||||||||||| | ||| |||||
YLNLRVRFALIRRESGFISGLVAVLHDTTEQEKEERERRLFVSNVSHELRTPLTSVKSYLEALDEGALCETVAPDFIKVS
              190         200         210         220         230         240         250

1080        1110        1140        1170        1200        1230        1260        1290
LDETNRMMRMISDLLSLSRIDNEVTHLDVEMTNFTAFMTSILNRFDQIRNQKTVTGKVYEIVRDYPLKSIWVEIDTDKMT
|||||||||||::|||  ||||||   :|||||: ||||||:| |||||||:::  |       | ||:|||||: ||: ||||||||
LDETNRMMRMVTDLLHLSRIDNATSHLDVELINFTAFITFILNRFDKMKGQ--EKEKKYELVRDYPINSIWMEIDTDKMT
              270         280         290         300         310         320

1320        1350        1380        1410        1440        1470        1500        1530
QVIDNILNNAVKYSPDGGKITVNLRTTKTQMILSISDQGLGIPKKDLPLIFDRFYRVDKARSRKQGGTGLGLSIAKEIVK
||:|||||||:|||||||||  ::|:  |||||||:|||||||:||| ||||||||||||:|||| ||||||||||||:|
QVVDNILNNAIKYSPDGGKITVRMKTTEDQMILSISDHGLGIPKQDLPRIFDRFYRVDRARSRAQGGTGLGLSIAKEIIK
         340         350         360         370         380         390         400

1560        1590        1620        1647        1677        1707        1737        1767
QHKGFIWAKSEYGKGSTFTIVLPYDKDAVTYEEWED-VED*NMSEIGFKYSILASGSTGNCFYIETPQKRLLIDAGLTGK
||||||||||||||||||||||||||||  |||  |||
QHKGFIWAKSEYGKGSTFTIVLPYDKDAVKEEVWEDEVED
         420         430         440
```

SEQ ID 1176 (GBS41) was expressed in *E. coli* as a His-fusion product. SDS-PAGE analysis of total cell extract is shown in FIG. 4 (lane 7; MW 50 kDa), in FIG. 168 (lane 24; MW 65 kDa—thioredoxin fusion) and in FIG. 238 (lane 4; MW 65 kDa). It was also expressed in *E. coli* as a GST-fusion product. SDS-PAGE analysis of total cell extract is shown in FIG. 13 (lane 7; MW 75 kDa).

Purified Thio-GBS41-His is shown in FIG. 244, lane 10.

Based on this analysis, it was predicted that these proteins and their epitopes could be useful antigens for vaccines or diagnostics.

EXAMPLE 363

A DNA sequence (GBSx0394) was identified in *S. agalactiae* <SEQ ID 1179> which encodes the amino acid sequence <SEQ ID 1180>. This protein is predicted to be VicR protein (regX3). Analysis of this protein sequence reveals the following:

```
Possible site: 60
>>> Seems to have no N-terminal signal sequence

----- Final Results -----
        bacterial cytoplasm --- Certainty = 0.2754(Affirmative) < succ>
        bacterial membrane  --- Certainty = 0.0000(Not Clear)   < succ>
        bacterial outside   --- Certainty = 0.0000(Not Clear)   < succ>
```

A related DNA sequence was identified in *S. pyogenes* <SEQ ID 1181> which encodes the amino acid sequence <SEQ ID 1182>. Analysis of this protein sequence reveals the following:

```
Possible site: 60
>>> Seems to have no N-terminal signal sequence

----- Final Results -----
            bacterial cytoplasm --- Certainty = 0.2754(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below:

```
Identities = 205/236 (86%), Positives = 221/236 (92%)

Query:    1 MKKILIVDDEKPISDIIKFNLTKEGYETATAFDGREALVQYAEFQPDLIILDLMLPELDG   60
            MKKILIVDDEKPISDIIKFNLTKEGY+  TAFDGREA+  + E +PDLIILDLMLPELDG
Sbjct:    1 MKKILIVDDEKPISDIIKFNLTKEGYDIVTAFDGREAVTIFEEEKPDLIILDLMLPELDG   60

Query:   61 LEVAKEVRKTSHIPIIMLSAKDSEFDKVIGLEIGADDYVTKPFSNRELLARVKAHLRRTE  120
            LEVAKE+RKTSH+PIIMLSAKDSEFDKVIGLEIGADDYVTKPFSNRELLARVKAHLRRTE
Sbjct:   61 LEVAKEIRKTSHVPIIMLSAKDSEFDKVIGLEIGADDYVTKPWSNRELLARVKAHLRRTE  120

Query:  121 NIETAVAEESAQNASSDITIGELQILPDAFIAKKRGEEIELTHREFELLHHLATHIGQVM  180
             IETAVAEE+A + + ++TIG LQILPDAF+AKK G+E+ELTHREFELLHHLA H+GQVM
Sbjct:  121 TIETAVAEENASSGTQELTIGNLQILPDAFVAKKHGQEVELTHREFELLHHLANHMGQVM  180

Query:  181 TREHLLETVWGYDYFGDVRTVDVTVRRLREKIEDTPGRPEYILTRRGVGYYMKSYE      236
            TREHLLE VWGYDYFGDVRTVDVTVRRLREKIEDTP RPEYILTRRGVGYYMKSY+
Sbjct:  181 TREHLLEIVWGYDYFGDVRTVDVTVRRLREKIEDTPSRFEYILTRRGVGYYMKSYD      236
```

Based on this analysis, it was predicted that these proteins and their epitopes could be useful antigens for vaccines or diagnostics.

EXAMPLE 364

A DNA sequence (GBSx0395) was identified in *S. agalactiae* <SEQ ID 1183> which encodes the amino acid sequence <SEQ ID 1184>. This protein is predicted to be amino acid ABC transporter, ATP-binding protein. Analysis of this protein sequence reveals the following:

```
Possible site: 43
>>> Seems to have no N-terminal signal sequence

----- Final Results -----
            bacterial cytoplasm --- Certainty = 0.3791(Affirmative) < succ>
             bacterial membrane --- Certainty = 0.0000(Not Clear)   < succ>
              bacterial outside --- Certainty = 0.0000(Not Clear)   < succ>
```

The protein has homology with the following sequences in the GENPEPT database:

```
>GP: CAB14701 GB: Z99118 glutamine ABC transporter (ATP-binding
protein) [Bacillus subtilis]
Identities = 149/244 (61%), Positives = 200/244 (81%), Gaps = 2/244 (0%)

Query:    3 LISYKNVNKYYGDYHALRQINLEIEPGQVVVLLGPSGSGKSTLIRTMNALESIDDGSLVV   62
            +I+++NVNK+YGD+H L+QINL+IE G+VVV++GPSGSGKSTL+R +N LESI++G L V
Sbjct:    1 MITFQNVNKHYGDFHVLRQINLQIEKGEVVVIIGPSGSGKSTLLRCINRLESINEGVLTV   60

Query:   63 NGHELANISSKELVNLRKEVGMVFQHFNLYPHKTVLENITLAPIKVLKQSKKEAMEIASK  122
            NG  + N    ++  +R+  +GMVFQHF+LYPHKTVL+NI LAP+KVL+QS ++A E A
Sbjct:   61 NGTAI-NDRKTDINQVRQNIGMVFQHFHLYPHKTVLQNIMLAPVKVLRQSPEQAKETARY  119

Query:  123 YLKFVNMWERKDSYPSMLSGGQKQRIAIARGLAMHPKLLLFDEPTSALDPETIGDVLSVM  182
            YL+ V + ++ D+YPS LSGGQ+QR+AIARGLAM P+++LFDEPTSALDPE IG+VL VM
Sbjct:  120 YLEKVGIPDKADAYPSQLSGGQQQRVAIARGLAMKPEVMLFDEPTSALDPEMIGEVLDVM  179
```

```
Query: 183 QKLANDGMNMVVVTHEMGFAREVADRIIFMADGEILVDTTDVQDFFDNPREPRAKQFLSN 242
           + LA +GM MVVVTHEMGFA+EVADRI+F+ +G+IL +      +F+ NP+E RA+ FLS
Sbjct: 180 KTLAKEGMTMVVVTHEMGFAKEVADRIVFIDEGKILEEAVPA-EFYANPKEERARLFLSR 238

Query: 243 IINH                                                      246
           I+NH
Sbjct: 239 ILNH                                                      242
```

A related DNA sequence was identified in *S. pyogenes* <SEQ ID 1185> which encodes the amino acid sequence <SEQ ID 1186>. Analysis of this protein sequence reveals the following:

```
Possible site: 51
>>> Seems to have no N-terminal signal sequence

----- Final Results -----
              bacterial cytoplasm --- Certainty = 0.3763(Affirmative) < succ>
              bacterial membrane  --- Certainty = 0.0000(Not Clear)   < succ>
              bacterial outside   --- Certainty = 0.0000(Not Clear)   < succ>
```

An alignment of the GAS and GBS proteins is shown below:

```
Identities = 131/243 (53%), Positives = 179/243 (72%), Gaps = 2/243 (0%)

Query:   2 SLISYKNVNKYYGDYHALRQINLEIEPGQVVVLLGPSGSGKSTLIRTMNALESIDDGSLV  61
           ++IS K+++KYYG    L+ I+L+I PG+VVV++GPSGSGKSTL+RTMN LE     G +
Sbjct:   5 AIISIKDLHKYYGHNEVLKGIDLDIMPGEVVVIIGPSGSGKSTLLRTMNLLEVPTKGQIR  64

Query:  62 VNGHELANISSKELVNLRKEVGMVFQHFNLYPHKTVLENITLAPIKVLKQSKKEAMEIAE 121
              G ++ +     ++ ++R+++GMVFQ FNL+P+ T+LENITL+PIK   +K EA + A
Sbjct:  65 FEGIDITD-KKNDIFSMREKMGMVFQQFNLFPNMTILENITLSPIKTKGMAKAEADKTAL 123

Query: 122 KYLKFVNMWERKDSYPSMLSGGQKQRIAIARGLAMHPKLLLFDEPTSALDPETIGDVLSV 181
           L    V + E+   +YP+ LSGGQ+QRIAIARGLAM P +LLFDEPTSALDPE +G+VL+V
Sbjct: 124 SLLDKVGLSEKAKAYPASLSGGQQQRIAIARGLAMDPDVLLFDEPTSALDPEMVGEVLAV 183

Query: 182 MQKLANDGMNMVVVTHEMGFAREVADRIIFMADGEILVDTTDVQDFFDNPREPRAKQFLS 241
           MQ LA   GM MV+VTHEMGFA+EVADR++FM DG ++V+        FD  +E R K FLS
Sbjct: 184 MQDLAKSGMTMVIVTHEMGFAKEVADRVMFM-DGGVIVEEGSPNQLFDLTKEERTKDFLS 242

Query: 242 NII                                                        244
           ++
Sbjct: 243 RVL                                                        245
```

Based on this analysis, it was predicted that these proteins and their epitopes could be useful antigens for vaccines or diagnostics.

EXAMPLE 365

A DNA sequence (GBSx0396) was identified in *S. agalactiae* <SEQ ID 1187> which encodes the amino acid sequence <SEQ ID 1188>. This protein is predicted to be glutamine-binding. Analysis of this protein sequence reveals the following:

```
Possible site: 27
>>> Seems to have a cleavable N-term signal seq.

----- Final Results -----
              bacterial outside   --- Certainty = 0.3000(Affirmative) < succ>
              bacterial membrane  --- Certainty = 0.0000(Not Clear)   < succ>
              bacterial cytoplasm --- Certainty = 0.0000(Not Clear)   < succ>
```

The protein has homology with the following sequences in the GENPEPT database:

```
>GP: CAB73178 GB: AL139076 probable ABC-type aminoacid transporter
periplasmic solute-binding protein [Campylobacter jejuni]
Identities = 99/240 (41%), Positives = 141/240 (58%), Gaps = 3/240 (1%)

Query:    1 MLRRKRLTFYLLSCIFIFLLFYPNSTSANQLSEIKKSGVLKVGVKQDVPNFGYYNAETNQ   60
            M+ RK L    +  +  + F  + + +L   IK  G L VGVK DVP++    +  T +
Sbjct:    1 MVFRKSLLKLAVFALGACVAFSNANAAEGKLESIKSKGQLIVGVKNDVPHYALLDQATGE   60

Query:   61 YEGMEIDIAKKIAKSL---GVKPVFVPTTAQTREPLMDNGQIDILIATYTITPERKANYN  117
            +G E+D+AK +AKS+      K  V   A+TR PL+DNG +D +IAT+TITPERK  YN
Sbjct:   61 IKGFEVDVAKLLAKSILGDDKKIKLVAVNAKTRGPLLDNGSVDAVIATFTITPERKRIYN  120

Query:  118 ISKAYYHDEIGFLVRKNSHIKTIKELDGKHIGVAQGATTKVNLEKYAKEHKLKFSYAQLG  177
            S+  YY D IG LV K    K++ ++ G +IGVAQ ATTK  +  AK+   +     +++
Sbjct:  121 FSEPYYQDAIGLLVLKEKKYKSLADMKGANIGVAQAATTKKAIGEAAKKIGIDVKFSEFP  180

Query:  178 SFPELAISLYANRIDAFSVDKSILSGYLSPHTTILKEGFNTQEYGIATSKQDKVLIPYVN  237
            +P +  +L A R+DAFSVDKSIL GY+     + IL + F  Q YGI  T  K D       YV+
Sbjct:  181 DYPSIKAALDAKRVDAFSVDKSILLGYVDDKSEILPDSFEPQSYGIVTKKDDPAFAKYVD  240
```

A related DNA sequence was identified in *S. pyogenes* <SEQ ID 1189> which encodes the amino acid sequence <SEQ ID 1190>. Analysis of this protein sequence reveals the following:

```
Possible site: 30
>>> Seems to have no N-terminal signal sequence
      INTEGRAL     Likelihood = 6.16 Transmembrane 17-33 (15-35)

----- Final Results -----
              bacterial membrane  --- Certainty = 0.3463(Affirmative) < succ>
               bacterial outside  --- Certainty = 0.0000(Not Clear)   < succ>
             bacterial cytoplasm  --- Certainty = 0.0000(Not Clear)   < succ>
```

A related sequence was also identified in GAS <SEQ ID 9097> which encodes the amino acid sequence <SEQ ID 9098>. Analysis of this protein sequence reveals the following:

```
>>> May be a lipoprotein

----- Final Results -----
              bacterial membrane  --- Certainty = 0.000(Not Clear) < succ>
               bacterial outside  --- Certainty = 0.000(Not Clear) < succ>
             bacterial cytoplasm  --- Certainty = 0.000(Not Clear) < succ>
```

An alignment of the GAS and GBS proteins is shown below:

```
Identities = 66/251 (26%), Positives = 111/251 (43%),
Gaps = 27/251 (10%)

Query:   23 PNSTSANQLSEIKKSGVLKVGVKQDVPNFGYYNAETNQYEGMEIDIAKKIAKSLGVKPVF   82
            P+ +  +    IK+ GVLKV            +YN + N+  G E+D+ K+I K L +K  F
Sbjct:   34 PHQSQKSSWDTIKEKGVLKVATPGTYQPTSFYN-DNNELVGYEVDMVKEIGKRLNIKVKF   92

Query:   83 VPTTAQTREPLMDNGQIDILIATYTITPERKANYNISKAYYHDEIGFLVR----KNSHIK  138
            V T         +D+G++DI +  + ITP+R+    YNIS    Y +     G +VR         N    K
Sbjct:   93 VETGFDQAFTSVDSGRVDISLNNFDITPKRQKKYNISTPYKYGVGGMIVRADGSSNIAKK  152

Query:  139 TIKELDGKHIGVAQGATTKVNLEKYAKEHKLKFSYAQLGSFPELAISLYANRI-------  191
            + +   GK    A G        +K           A+L ++  +   +Y N +
Sbjct:  153 DLSDWKGKKAAGASGTEYMKVAQKQG---------AELVTYDNVTGDVYLNDVANGRTDF  203

Query:  192 --DAFSVDKSILSGYLSPHTTILKE----GFNTQEYGIATSKQDKVLIPYVNKLLVSWEK  245
              +  +  K  +   LS +  +      +N  E GI  +K+D  L    ++ ++        K
Sbjct:  204 IPNDYPAQKLFVDYMLSQNPNLNVKMSDVQYNPTEQGIVMNKKDDSLKKKIDAVIKDMIK  263
```

```
Query:  246 DGSLKHIYQKF                                              256
            DGSLK I + +
Sbjct:  264 DGSLKKISETY                                              274
```

SEQ ID 1188 (GBS136) was expressed in *E. coli* as a His-fusion product. SDS-PAGE analysis of total cell extract is shown in FIG. 29 (lane 5; MW 29.9 kDa).

Figure 284:
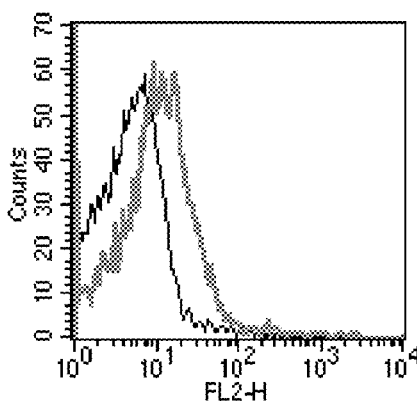

The GBS136-His fusion product was purified (FIG. 200, lane 6) and used to immunise mice. The resulting antiserum was used for FACS (FIG. 284), which confirmed that the protein is immunoaccessible on GBS bacteria.

Based on this analysis, it was predicted that these proteins and their epitopes could be useful antigens for vaccines or diagnostics.

EXAMPLE 366

A DNA sequence (GBSx0397) was identified in *S. agalactiae* <SEQ ID 1191> which encodes the amino acid sequence <SEQ ID 1192>. This protein is predicted to be integral membrane. Analysis of this protein sequence reveals the following:

```
Possible site: 55
>>> Seems to have no N-terminal signal sequence
     INTEGRAL      Likelihood = -9.34    Transmembrane    32-48   (27-55)
     INTEGRAL      Likelihood = -5.04    Transmembrane   200-216  (196-219)
     INTEGRAL      Likelihood = -3.13    Transmembrane    93-109  (93-113)
     INTEGRAL      Likelihood = -2.02    Transmembrane    74-90   (74-92)

----- Final Results -----
            bacterial membrane  --- Certainty = 0.4736(Affirmative) < succ>
            bacterial outside   --- Certainty = 0.0000(Not Clear)   < succ>
            bacterial cytoplasm --- Certainty = 0.0000(Not Clear)   < succ>
```

The protein has homology with the following sequences in the GENPEPT database:

```
>GP: CAB73177 GB: AL139076 putative ABC-type amino-acid transporter
permease protein [Campylobacter jejuni]
Identities = 112/226 (49%), Positives = 160/226 (70%), Gaps = 3/226 (1%)

Query:    5 NISPFAISRWGAFFNHFDLFFKGFLYTLGISFGALLLALILGILSGGLSTSKSKVGKLIS   64
            +ISPFA+ ++      ++ D F   GF+YTL +S   ALL+A I G + G ++TS+ K+ +   +
Sbjct:   25 SISPFAVWKFLDALDNKDAFINGFIYTLEVSILALLIATIFGTIGGVMATSRFKIIRAYT   84

Query:   65 RIYVEVFQNTPLLVQMVFVYYGLAIISNGHVMISAFFTAVLCVGLYHGAYISEVIRSGIE  124
            RIYVE+FQN PL++Q+ F++Y L ++    + +  F    VL VG YHGAY+SEV+RSGI
Sbjct:   85 RIYVELFQNVPLVIQIFFLFYALPVLG---IRLDIFTIGVLGVGAYHGAYVSEVVRSGIL  141

Query:  125 AVPKGQTEAALAQGFTANQTMQLIILPQAVRTILPPMTNQVVNLIKNTSTVAIISGADIM  184
            AVP+GQ EA+ +QGFT  Q M+ II+PQ +R ILPPMTNQ+VNLIKNTS + I+ GA++M
Sbjct:  142 AVPRGQFEASASQGFTYIQQMRYIIVPQTIRIILPPMTNQMVNLIKNTSVLLIVGGAELM  201

Query:  185 FVAKAWAYDTTNYIPAFAGAAIFYFVICFPLASWARKQEELNKKTY                230
              A ++A D  NY PA+  AA+ YF+IC+PLA +A+  E    KK +
Sbjct:  202 HSADSYAADYGNYAPAYIFAAVLYFIICYPLAYFAKAYENKLKKAH                247
```

A related DNA sequence was identified in *S. pyogenes* <SEQ ID 1193> which encodes the amino acid sequence <SEQ ID 1194>. Analysis of this protein sequence reveals the following:

```
Possible site: 28
>>> Seems to have a cleavable N-term signal seq.
INTEGRAL Likelihood = -6.26 Transmembrane 307-323 ( 303-327)
INTEGRAL Likelihood = -5.89 Transmembrane 485-501 ( 479-502)
INTEGRAL Likelihood = -1.12 Transmembrane 375-391 ( 375-391)
```

-continued

```
----- Final Results -----
           bacterial membrane --- Certainty = 0.3506(Affirmative) < succ>
            bacterial outside --- Certainty = 0.0000(Not Clear) < succ>
          bacterial cytoplasm --- Certainty = 0.0000(Not Clear) < succ>
```

The protein has homology with the following sequences in the databases:

```
>GP:BAA17584 GB:D90907 glutamine binding periplasmic protein [Synechocystis sp.]
Identities = 146/532 (27%), Positives = 244/532 (45%), Gaps = 59/532 (11%)

Query:    6 YMKKLILSCLVALALLFGGMSRAQANQYLRVGMEAAYAPFNWTQDDASNGAVPIEGTSQY      65
            Y   L  L  L+A+A+       + Q + V  E  + PF  T             E T Q
Sbjct:   16 YYLLLALGVLLAIAIPLLPAFSQVSRQTIIVATEPTFPPFEMTD----------EATGQL      65

Query:   66 ANGYDVQVAKKVAKAMNKELLVVKTSWTGLIPALTSGKIDMIAAGMSPTKERRNEISFSN     125
             G+DV + + + +A     + +    + G+IPAL S  +    + ++ T ER   +SFS+
Sbjct:   66 T-GFDVDLIQAIGEAAQVTVDIQGYPFDGIIPALQSNTVGAAISAITITPERAQSVSFSS     124

Query:  126 SSYTSQPVLVVTANGRYADATSLKDFSGAKVTAQQGVWHVNLLTQLKGAKLQTPMGDFSQ     185
             + S   VL +         +LKD  G ++         G    + T + GAK+ T    +
Sbjct:  125 PYFKS--VLAIAVQDGNDTIKNLKDLEGKRLAVAIGTTGAMVATNVPGAKV-TNFDSITS     181

Query:  186 MRQALTSGVIDAYISERPEAMTAEAADSRLKMITLKKGFAVAESDAAIAVGMKKNDDRMA     245
              Q L +G  DA I++RP  + A    D+L+ + +        +E    IA+ +     +
Sbjct:  182 ALQELVNGNADAVINDRPVLLYA-IKDAGLRNVKISADVG-SEDYYGIAMPLAPPGE---     236

Query:  246 TVNQVLEGFSQTDRMALMDDMVTKQPVEKKAEDAKASFLGQMWAIFKGN-----------     294
             +NQ  E  +Q    ++++      EK    +   FL  +      G
Sbjct:  237 -INQTREVLNQ--GLFQIIENGTYNAIYEKWFGEKNPPFLPLVAPSLVGKVGTAQSLTERS     294

Query:  295 ------------WKQFLRGTGMTLLISMVGTITGLFIGLLIGIFRTAPKAHHKVAALGQK     342
                         ++   +G+ +T+L++      GL  G + I  +              K
Sbjct:  295 QANPNDNFLITLFRNLFKGSILTVLLTAFSVFFGLIGGTGVAIALISDI-----------K     344

Query:  343 LFGWLLTIYIEIFRGTPMIVQSMVIYYGTAQAF-----GISIDRTLAAIFIVSINTGAYM     397
             +     + IY+E FRGTPM+VQ  +IY+G     F       GI+IDR  AAI  +S+N  AY+
Sbjct:  345 PLQLIFRIYVEFFRGTPMLVQLFIIYFGLPALFKEIGLGITIDRFPAAIIALSLNVAAYL     404

Query:  398 SEIVRGGIFAVDKGQFKAATALGFTHGQTMRKIVLPQVVRNILPATGNEFVINIKDTSVL     457
              +EI+RGGI  ++D+GQ++A   +LG +    QTM++++  PQ  R  ILP   GNEF+  IKDTS+
Sbjct:  405 AEIIRGGIQSIDQGQWEACESLGMSPWQTMKEVIFPQAFRRILPPLGNEFITLIKDTSLT     464

Query:  458 NVISVVELYFSGNTVATQTYQYFQTFTIIAIIYFVLTFTVTRILRYIERRFD             509
                 VI   EL+  G  +  TY+ F+ +   +A++Y +LT  + + +++E   D
Sbjct:  465 AVIGFQELFREGQLIVATTYRAFEVYIAVALVYLLLTTISSFVFKWLENYMD             516
```

An alignment of the GAS and GBS proteins is shown below:

```
Identities = 82/210 (39%), Positives = 113/210 (53%), Gaps = 12/210 (5%)

Query:   14 WGAFFNHFDLFFKGFLYTLGISFGALLLALILGILSGGLSTS---KSKVGKL-------I      63
            W  F  ++   F  +G  TL IS    +  L  +G+L G    T+    K KV   L               +
Sbjct:  288 WAIFKGNWKQFLRGTGMTLLISMVGTITGLFIGLLIGIFRTAPKAHHKVAALGQKLFGWL    347

Query:   64 SRIYVEVFQNTPLLVQMFVYYGLAIISNGHVMISAFFTAVLCVGLYHGAYISEVIRSGI     123
              IY+E+F+  TP++VQ +  +YYG A         + I       A+  V  +  GAY+SE+++R GI
Sbjct:  348 LTIYIEIFRGTPMIVQSMVIYYGTAQAFG--ISIDRTLAAIFIVSINTGAYMSEIVRGGI     405

Query:  124 EAVPKGQTEAALAQGFTANQTMQLIILPQAVRTILPPMTNQVVNLIKNTSTVAIISGADI     183
               AV KGQ +AA A GFT  QTM+  I+LPQ VR  ILP    N+  V  IK+TS + +IS  ++
Sbjct:  406 FAVDKGQFKAATALGFTHGQTMRKIVLPQVVRNILPATGNEFVINIKDTSVLNVISVVEL     465

Query:  184 MFVAKAWAYDTTNYIPAFAGAAIFYFVICF                                213
             F       A  T Y   F    AI  YFV+ F
Sbjct:  466 YFSGNTVATQTYQYFQTFTIIAIIYFVLTF                                495
```

Based on this analysis, it was predicted that these proteins and their epitopes could be useful antigens for vaccines or diagnostics.

EXAMPLE 367

A DNA sequence (GBSx0398) was identified in *S. agalactiae* <SEQ ID 1195> which encodes the amino acid sequence <SEQ ID 1196>. This protein is predicted to be amino acid ABC transporter, permease protein. Analysis of this protein sequence reveals the following:

```
Possible site: 39
>>> Seems to have an uncleavable N-term signal seq
INTEGRAL Likelihood = -6.95 Transmembrane  25-41  ( 16-42)
INTEGRAL Likelihood = -3.61 Transmembrane  66-82  ( 65-86)
INTEGRAL Likelihood = -2.44 Transmembrane 184-200 (182-201)
INTEGRAL Likelihood = -0.59 Transmembrane 119-135 (119-135)
----- Final Results -----
            bacterial membrane  --- Certainty = 0.3781(Affirmative) < succ>
             bacterial outside  --- Certainty = 0.0000(Not Clear)   < succ>
           bacterial cytoplasm  --- Certainty = 0.0000(Not Clear)   < succ>
```

The protein has homology with the following sequences in the GENPEPT database:

```
>GP: CAB14704 GB: Z99118 glutamine ABC transporter (integral membrane
protein) [Bacillus subtilis]
Identities = 84/206 (40%), Positives = 129/206 (61%), Gaps = 6/206 (2%)

Query:  10 ILFLLQGFGLTLYISFISILLSMFFGTLLAIMRNSKNPIWKLIASIYIEFVRNVPNLLWI  69
           + FL  GF +TLY++FISI+LS FFG + +R +K P+  + ++ +E +RN+P LL I
Sbjct:  12 LAFLWDGFLVTLYVAFISIILSFFFGLIAGTLRYAKVPVLSQLIAVLVETIRNLPLLLII  71

Query:  70 FIIFLVF-----QMKSVSAGITSFTIFTSAALAEIIRGGLNGVDKGQTEAGLSQGFTYLQ 124
           F  F        +++  +A IT+ TIF SA L+EIIR GL +DKGQ EA  S G +Y Q
Sbjct:  72 FFTFFALPEIGIKLEITAAAITALTIFESAMLSEIIRSGLKSIDKGQIEAARSSGLSYTQ 131

Query: 125 VFIIIIFPQAFRKMLPAIISQFVTVIKDTSLLYSVIAIQEIFGKSQILMGRYFEAGQVFT 184
           I+ PQA R+M+P I+SQF++++KDTSL   VIA+ E+   +QI+ G+ +    F
Sbjct: 132 TLFFIVMPQALRRMVPPIVSQFISLLKDTSLAV-VIALPELIHNAQIINGQSADGSYFFP 190

Query: 185 LYAIITAVYFITNFIISSFSRKLSKR                                  210
           ++ +   +YF N+ +S  +R+L R
Sbjct: 191 IFLLAALMYFAVNYSLSLAARRLEVR                                  216
```

A related DNA sequence was identified in *S. pyogenes* <SEQ ID 1197> which encodes the amino acid sequence <SEQ ID 1198>. Analysis of this protein sequence reveals the following:

```
Possible site: 20
>>> Seems to have a cleavable N-term signal seq.
    INTEGRAL     Likelihood = -10.51      Transmembrane    529-545 (517-551)
    INTEGRAL     Likelihood = -10.30      Transmembrane    697-713 (693-719)
    INTEGRAL     Likelihood =  -4.41      Transmembrane    560-576 (555-585)
    INTEGRAL     Likelihood =  -0.32      Transmembrane    662-678 (662-678)

----- Final Results -----
            bacterial membrane  --- Certainty = 0.5203(Affirmative) < succ>
             bacterial outside  --- Certainty = 0.0000(Not Clear)   < succ>
           bacterial cytoplasm  --- Certainty = 0.0000(Not Clear)   < succ>
```

The protein has homology with the following sequences in the databases:

```
>GP: BAA17584 GB: D90907 glutamine binding periplasmic protein
[Synechocystis sp.]
Identities = 153/475 (32%), Positives = 251/475 (52%), Gaps = 27/475 (5%)

Query: 273 IVSDSSFAPFEFQN-GKGKYVGIDIELIKAIAKQQGFKIEIANPGFDAALNAVQSSQADG 331
           + ++ +F PFE +   G+   G D++LI+AI +    ++I    FD   A+QS+
Sbjct:  46 VATEPTFPPFEMTDEATGQLTGFDVDLIQAIGEAAQVTVDIQGYPFDGIIPALQSNTVGA 105

Query: 332 VIAGATITDARKAIFDFSDPYYTSNIILAVKAGKN-IKNYEDLDRKTVGAKNGTSSYSWL 390
           +I+ TIT R    FS PY+ S + +AV+ G + IKN +DL+ K +    GT+ + +
```

```
Sbjct: 106 AISAITITPERAQSVSFSSPYFKSVLAIAVQDGNDTIKNLKDLEGKRLAVAIGTTG-AMV 164

Query: 391 KENAPKYGYNVKAFDDGSSMYDSLNSGSVDAIMDDEAVLKYAISQG--RRFETPLEGIST 448
            N P  G  V  FD +S    L +G+ DA+++D  VL YAI    R +   + S
Sbjct: 165 ATNVP--GAKVTNFDSITSALQELVNGNADAVINDRPVLLYAIKDAGLRNVKISADVGSE 222

Query: 449 GEVGFAVKKGTNPELI---EMFNNGLAALKKSGQYDDIIDKYLDSKKA-----ATPSEKG 500
             G A+       E+      E+ N GL + ++G Y+ I +K+    K       PS  G
Sbjct: 223 DYYGIAMPLAPPGEINQTREVLNQGLFQIIENGTYNAIYEKWFGEKNPPFLPLVAPSLVG 282

Query: 501 -----------ADESTISGLLSNNYKQLLAGLGTTLSLTLISFAIAIIIGIIFGMMAVSP 549
                       + +     L   ++ L  G  T+ LT S  +I G   +  +S
Sbjct: 283 KVGTAQSLTERSQANPNDNFLITLFRNLFKGSILTVLLTAFSVFFGLIGGTGVAIALISD 342

Query: 550 TKSLRLISTVFVDVVRGIPLMIVAAFIFWGVPNLIESMTGHQSPINDFLAATIALSLNGG 609
             K L+LI  ++V+  RG P+++    I++G+P L + + G    I+ F AA IALSLN
Sbjct: 343 IKPLQLIFRIYVEFFRGTPMLVQLFIIYFGLPALFKEI-GLGITIDRFPAAIIALSLNVA 401

Query: 610 AYIAEIVRGGIEAVPAGQMEASRSLGLSYGTTMRKVILPQAVKLMLPNFINQFVISLKDT 669
            AY+AEI+RGGI+++   GQ EA  SLG+S  TM++VI PQA  +LP   N+F+   +KDT
Sbjct: 402 AYLAEIIRGGIQSIDQGQWEACESLGMSPWQTMKEVIFPQAFRRILPPLGNEFITLIKDT 461

Query: 670 TIVSAIGLVELFQTGKIIARNYQSFRMYAILAIIYLIMIILLTRLAKRLEKRLN       724
            ++ +  IG  ELF+ G++I+A  Y++F +Y  +A++YL++  +  + K LE ++
Sbjct: 462 SLTAVIGFQELFREGQLIVATTYRAFEVYIAVALVYLLLTTISSFVFKWLENYMD      516
Identities = 68/247 (27%), Positives = 106/247 (42%), Gaps = 11/247 (4%)

Query:   7 VLLLAIMSIFLTCNIASAETIAIVSDTAYAPFEFKD--SDQIYKGIDVDIINEVAKRQSW  64
            VLL   + +       + S +TI + ++  + PFE D  + Q+   G DVD+I  + +
Sbjct:  24 VLLAIAIPLLPAFSQVSRQTIIVATEPTFPPFEMTDEATGQL-TGFDVDLIQAIGEAAQV  82

Query:  65 DFSMSFPGFDAAVNAVQSGQASALMAGTTITNARKKVFHFSEPYYDTKIVIATRKAN-AI 123
                 +    FD + A+QS    A ++  TIT  R +    FS PY+ + + IA +  N  I
Sbjct:  83 TVDIQGYPFDGIIPALQSNTVGAAISAITITPERAQSVSFSSPYFKSVLAIAVQDGNDTI 142

Query: 124 KKYSDLKGKTVGVKNGTAAQAFLNNYKKKYDYTVKTFDTGDLMYNSLSAGSIAAVMDDEA 183
            K   DL+GK + V  GT      N        V  FD+      L G+  AV++D
Sbjct: 143 KNLKDLEGKRLAVAIGTTGAMVATNVP---GAKVTNFDSITSALQELVNGNADAVINDRP 199

Query: 184 VIQYAIS----QNQDIAINMKGEPIGSFGFAVKKGSGYDYLVNDFNTALKAMKADGTYQA 239
            V+ YAI     +N  I+ ++  E    +       +       N  L +  +GTY A
Sbjct: 200 VLLYAIKDAGLRNVKISADVGSEDYYGIAMPLAPPGEINQTREVLNQGLFQIIENGTYNA 259

Query: 240 IMTKWLG                                                      246
            I   KW G
Sbjct: 260 IYEKWFG                                                      266
```

An alignment of the GAS and GBS proteins is shown below:

```
Identities = 68/210 (32%), Positives = 113/210 (53%), Gaps = 16/210 (7%)

Query:  13 LLQGFGLTLYISFISILLSMFFGTLLAIMRNSKNPIWKLIASIYIEFVRNVPNLLWIFII  72
            LL G G TL ++ IS  +++  G +   +M  S   +LI++++++ VR +P ++     I
Sbjct: 517 LLAGLGTTLSLTLISFAIAIIIGIIFGMMAVSPTKSLRLISTVFVDVVRGIPLMIVAAFI 576

Query:  73 F-----LVFQMKSVSAGITSFTIFT-------SAALAEIIRGGLNGVDKGQTEAGLSQGF 120
            F     L+  M  + F  T         A +AEI+RGG+   V  GQ EA  S G
Sbjct: 577 FWGVPNLIESMTGHQSPINDFLAATIALSLNGGAYIAEIVRGGIEAVPAGQMEASRSLGL 636

Query: 121 TYLQVFIIIIFPQAFRKMLPAIISQFVTVIKDTSLLYSVIAIQEIFGKSQILMGRYFEAG 180
            +Y      +I PQA + MLP I+QFV  +KDT++  S I + E+F   +I++ R +
Sbjct: 637 SYGTTMRKVILPQAVKLMLPNFINQFVISLKDTTIV-SAIGLVELFQTGKIIARNY--- 692

Query: 181 QVFTLYAIITAVYFITNFIISSFSRKLSKR                               210
            Q F  YAI+  +Y I    +++  +++L KR
Sbjct: 693 QSFRMYAILAIIYLIMIILLTRLAKRLEKR                               722
```

Based on this analysis, it was predicted that these proteins and their epitopes could be useful antigens for vaccines or diagnostics.

EXAMPLE 368

A DNA sequence (GBSx0399) was identified in *S. agalactiae* <SEQ ID 1199> which encodes the amino acid sequence <SEQ ID 1200>. Analysis of this protein sequence reveals the following:

```
Possible site: 39
>>> Seems to have an uncleavable N-term signal seq
     INTEGRAL     Likelihood = -12.21     Transmembrane     7-23 (1-30)

----- Final Results -----
              bacterial membrane --- Certainty = 0.5883(Affirmative) < succ>
               bacterial outside --- Certainty = 0.0000(Not Clear)  < succ>
             bacterial cytoplasm --- Certainty = 0.0000(Not Clear)  < succ>
```

The protein has homology with the following sequences in the GENPEPT database:

```
>GP:BAB04094 GB:AP001508 unknown conserved protein in B. subtilis
[Bacillus halodurans]
Identities = 43/157 (27%), Positives = 83/157 (52%), Gaps = 9/157 (5%)

Query:  26 YQSQFQKTTNQALAIAYKDAKVAKK--DVIHQKIDKEFENFRGSYEIEFNTKSAEYSYHV   83
            +Q++     N+L+A          ++ + +  + +K+ +N R   YEIE      EY++
Sbjct:  38 HQAESVSADNEGLTLAEASDIALERAGNGVVTEAEKDRDNGRVVYEIEVKNDDDEYDFKI   97

Query:  84 DVKTGQILERDMDNNGFSKSTSQSSSSSSQKSHKISQEEAKKIAFKDANIEESEVSNLKI  143
            D +TG+IL+  +     SK      SSS    ++  IS +EAK+IA K+ +     ++ ++++
Sbjct:  98 DQQTGEILKEKQEQRKGSKPREGHSSSKGSEAVISMDEAKEIALKEVS----GKIDDIEL  153

Query: 144 KEEIENGKSVYDIDF-VDLKNKNEVDYQIDAETGKII                         179
             E ENG  VY+++   D + ++V    +DA TG ++
Sbjct: 154 --ERENGSLVYEVEIESDHYDODDVTVYVDANTGNVL                         188
```

A related DNA sequence was identified in *S. pyogenes* <SEQ ID 1201> which encodes the amino acid sequence <SEQ ID 1202>. Analysis of this protein sequence reveals the following:

```
Possible site: 57
>>> Seems to have no N-terminal signal sequence
INTEGRAL Likelihood = -5.15 Transmembrane 42-58 ( 41-60)

----- Final Results -----
              bacterial membrane --- Certainty = 0.3060(Affirmative) < succ>
               bacterial outside --- Certainty = 0.0000(Not Clear)  < succ>
             bacterial cytoplasm --- Certainty = 0.0000(Not Clear)  < succ>
```

The protein has no significant homology with any sequences in the GENPEPT database.

An alignment of the GAS and GBS proteins is shown below:

```
Identities = 37/96 (38%), Positives = 63/96 (65%), Gaps = 5/96 (5%)
Query:  94 DMDNNGFSKSTSQSSSSSSQKSHKISQEEAKKIAFKDANIEESEVSNLKIKEEIENGKSV  153
            DMD+       +Q  +S + K  K+S+++AK IA KDA++E++    L + ++ E+GK+V
Sbjct:  59 DMDDKD-DHMDNQPKTSQTSKKVKLSEDKAKSIALKDASVTEADAQMLSVTQDNEDGKAV  117

Query: 154 YDIDWVDLKNKN-EVDYQIDAETGKIIERSRDHMND                         188
            Y+I+F   +NK+ E  Y IDA +G I+E+S + +ND
Sbjct: 118 YEIEF---QNKDQEYSYTIDANSGDIVEKSSEPIND                         150
```

-continued

```
Identities = 23/62 (37%), Positives = 37/62 (59%)
Query:   35 NQALAIAYKDAKVAKKDVIHQKIDKEFENFRGSYEIEFNTKSAEYSYHVDVKTGQILERD   94
            ++A +IA KDA V + D    + ++ E+ +  YEIEF  K  EYSY +D  +G I+E+
Sbjct:   85 DKAKSIALKDASVTEADAQMLSVTQDNEDGKAVYEISFQNKDQEYSYTIDANSGDIVEKS  144

Query:   95 MD   96
            +
Sbjct:  145 SE  146
```

A related GBS gene <SEQ ID 8563> and protein <SEQ ID 8564> were also identified. Analysis of this protein sequence reveals the following:

```
Lipop: possible site: = -1 Crend: 9
McG: Discrim Score: 14.45
GyM: Signal Score (-7.5): -5.92
Possible site: 39
>>> Seems to have an uncleavable N-term signal seq
ALOM program count: 1 value: -8.92 threshold: 0.0
INTEGRAL    Likelihood = -8.92 Transmembrane 7-23 ( 2-28)
PERIPHERAL Likelihood = 10.93 37
modified ALOM score: 2.28

*** Reasoning Step: 3

----- Final Results -----
              bacterial membrane --- Certainty = 0.4567(Affirmative) < succ>
                bacterial outside --- Certainty = 0.0000(Not Clear) < succ>
             bacterial cytoplasm --- Certainty = 0.0000(Not Clear) < succ>
```

The protein has homology with the following sequences in the databases:

```
26.1/59.2% over 140aa
Bacillus subtilis
EGAD|107494| hypothetical protein Insert characterized
GP|2632048|emb|CAA05607.1||AJ002571 YkoJ Insert characterized
GP|2633682|emb|CAB13185.1||Z99110 similar to hypothetical proteins from B. subtilis
Insert characterized
PIR|F69859|F69859 conserved hypothetical protein ykoJ - Insert characterized ORF00925(379 - 852 of 1164)
EGAD|107494|BS1329(29 - 169 of 170) hypothetical protein {Bacillus subtilis}
GP|2632048|emb|CAA05607.1||AJ002571 YkoJ {Bacillus subtilis}
GP|2633682|emb|CAB13185.1||Z99110 similar to hypothetical proteins from B. subtilis
{Bacillus subtilis} PIR|F69859|F69859 conserved hypothetical protein ykoJ -
Bacillus subtilis
% Match = 6.2
% Identity = 26.1   % Similarity = 59.2
Matches = 37   Mismatches = 52   Convservative Sub.s = 47
   297       327       357       387       417       447       468       498
NIIE**KEGCCMIKKNKVFLEVLLVLVVILEGGVLFYQSQFQKTTNQALAIAYKDAKVAKKDVIH---QKIDKEFENFRG
                 |  :|     |                  :: :: ::: |:   ::|:    ||:     :  ||::: | :
          MLKKWMVGLLAGCLAAGGFSYNAFATENNENRQASSKTDALTEQEAEAIAKTVVDGTVEDIDRDLYNGKE
                 10        20        30        40        50        60        70

528       558       588       618       648       672       702       732
SYEIEFNTKSAEYSYHVDVKTGQILERDMDNNGFSKSTSQSSSSSSQKSHK--ISQEEAKKIAFKDANIEESEVSNLKIK
 ||:|   :   :|   :|| |  |      :          :|: :  |::|||::||:|      |:   |:
VYEVEIEKEGEDYDVYVDIHTKQALNDPL---------------KEKAEQVAITKEEAEEIALKQTG---GTVTESKLD
       90        100                         110       120          130

762       792       822       852       882       912       942       972
EEIENGKSVYDIDFVDLKNKNEVDYQIDAETGKIIERSRDHMND*FK*DIKKRRSKRPSF*LLSSLLPTF*KFT*KT*DD
|:   :|   :|::   :     |     |:::|  |: |:||:    |
ED--DGAYIYEME-IQTKQGTETEFEISAKDGRIIKQEIDD
       140       150       160       170
```

Figure 16:
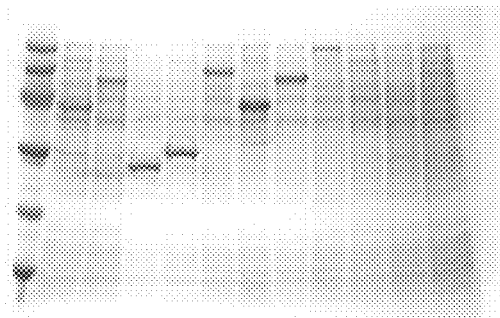

SEQ ID 8564 (GBS37) was expressed in *E. coli* as a His-fusion product. SDS-PAGE analysis of total cell extract is shown in FIG. 14 (lane 4; MW 22 kDa). It was also expressed in *E. coli* as a GST-fusion product. SDS-PAGE analysis of total cell extract is shown in FIG. 16 (lane 10; MW 47 kDa).

Based on this analysis, it was predicted that these proteins and their epitopes could be useful antigens for vaccines or diagnostics.

EXAMPLE 369

A DNA sequence (GBSx0400) was identified in *S. agalactiae* <SEQ ID 1203> which encodes the amino acid sequence <SEQ ID 1204>. Analysis of this protein sequence reveals the following:

```
Possible site: 53
>>> Seems to have no N-terminal signal sequence

----- Final Results -----
            bacterial cytoplasm --- Certainty = 0.1499(Affirmative) < succ>
             bacterial membrane --- Certainty = 0.0000(Not Clear)   < succ>
              bacterial outside --- Certainty = 0.0000(Not Clear)   < succ>
```

A related GBS nucleic acid sequence <SEQ ID 9709> which encodes amino acid sequence <SEQ ID 9710> was also identified.

The protein has no significant homology with any sequences in the GENPEPT database.

A related DNA sequence was identified in *S. pyogenes* <SEQ ID 1205> which encodes the amino acid sequence <SEQ ID 1206>. Analysis of this protein sequence reveals the following:

```
Possible site: 42
>>> Seems to have no N-terminal signal sequence

----- Final Results -----
            bacterial cytoplasm --- Certainty = 0.2808(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below:

```
Identities = 128/297 (43%), Positives = 180/297 (60%), Gaps = 9/297 (3%)

Query:  54 IDDIKVGSPIFKYFWT-SLSLQAPLKALEFVLEQAKMPTELSGELSETQYLVAQFSDELA 112
           I D ++GSP F  W    Q+  + L F+L+  +MP ELSG+L ETQ L+ +F    L
Sbjct:  46 IIDNRLGSPTFWVIWPIEKENQSAKQLLTFLLDLVEMPFELSGQLHETQTLLTRFHPSLL 105

Query: 113 PHDDFWIALSQVIYDSFPGNSLAEDTVLNRKLHQFRYLISSQQAQYVRRYFKDVGMTDRD 172
           P   FW  L+ ++  +FPG +L++   L ++LHQFRY+ISSQQAQ +R ++K + MTD
Sbjct: 106 PDHMFWKELASLVDQAFPGKTLSQAGELEKRLHQFRYVISSQQAQSIRNHYKMIEMTDAQ 165

Query: 173 ALVNYL------SCL-REPDSIAYYESARLHNKRRRNGEIFGFPDDEPVINSKLLISFHTE 226
           AL   +L        CL R+       +SARLHNK R          FP  E   N K+L+ FHTE
Sbjct: 166 ALALFLRSKKGPCLWRQAPDYTLMDSARLHNKLRFEDNKVIFPSQEVSYNIKVLLWFHTE 225

Query: 227 FIIDDKGNFLNEIDAEVITRNGIINGASFNYAFKNNTRHKELDVDPVK-LDPKFRNDMTR 285
           F +D  G FLNE+DAEV+T GI+NGASFNY      + RH +LDVDP+    DP+FR D  +
Sbjct: 226 FTLDSTGFFLNEVDAEVVTEKGIVNGASFNYG-TDGPRHWDLDVDPISHHDPQFRRDTLK 284

Query: 286 GYRSPNLSRRKWFFFKEEDYDCSYFNKKGYYAFGRRSAKQSVDKQVKYLKKAVQKMR    342
           G+RSP     R+WF  +++D+  SYFN KG +A+  +S+    V K  K+ +   ++
Sbjct: 285 GFRSPKRVFRQWFRAQKDDFMFSYFNAKGLFAYHNKSSFARVKKSAKQFKRQIHPIK    341
```

Based on this analysis, it was predicted that these proteins and their epitopes could be useful antigens for vaccines or diagnostics.

EXAMPLE 370

A DNA sequence (GBSx0401) was identified in *S. agalactiae* <SEQ ID 1207> which encodes the amino acid sequence <SEQ ID 1208>. This protein is predicted to be similar to two-component response regulator [YcbM] (ompr-likeprotei). Analysis of this protein sequence reveals the following:

```
Possible site: 31
>>> Seems to have no N-terminal signal sequence

----- Final Results -----
            bacterial cytoplasm --- Certainty = 0.3129(Affirmative) < succ>
             bacterial membrane --- Certainty = 0.0000(Not Clear) < succ>
              bacterial outside --- Certainty = 0.0000(Not Clear) < succ>
```

The protein has homology with the following sequences in the GENPEPT database:

```
>GP: CAA55264 GB: X78502 gtcR [Brevibacillus brevis]
Identities = 99/228 (43%), Positives = 149/228 (64%), Gaps = 3/228 (1%)

Query:   2 RTVLVVQGDDETIELLRSYLEGALYKVVMASDGEEAFSLFQQHQIDLAIIDITLPKIDGY   61
           +T+L+   + E IELL+ +LE    Y+++ A DGE+A++   +QH +DLAIIDI +P +DG+
Sbjct:   3 KTILIADDEPEIIELLKLFLERESYRIIEAYDGEQAWNYIRQHPVDLAIIDIMMPALDGF   62

Query:  62 ELTRLIRQDSQIPIIMLAAKTTDMDRILGLNIGADDFITKPFNSLEVLARINSQLRRYYE  121
           +L + +   + ++P+I+L+AK   D  D+ILGL +GADDFI+KPFN LE +ARI +QLRR +E
Sbjct:  63 QLIKRLTNEYKLPVIILSAKNRDSDKILGLGLGADDFISKPFNPLEAVARIQAQLRRAFE  122

Query: 122 FNSLAKP--KNQFIKIGELELDEEHVELTKNGKHIKLTATEFKILHLMS-SPGRIYTKT  178
           FN     +   Q   +G L L     + +   +T  E+++L+   M   S    I+TK
Sbjct: 123 FNEPEEKAISTQSTTVGRLTLLHTACVVYRGDETYSVTPLEYRLLNTFMQCSRTSIFTKQ  182

Query: 179 QLYEKINGRYLEGDETTIMVHISNIRDKIEDDSKYPKYIKTLRGVGYK            226
           QL+E+            D+ TIMV IS +RDKIED   P YIKT+RG+GYK
Sbjct: 183 QLFEQAWSETYWEDDNTIMVQISRLRDKIEDQPRQPVYIKTVRGLGYK            230
```

There is also homology to SEQ ID 1182:

```
Identities = 87/230 (37%), Positives = 144/230 (61%), Gaps = 5/230 (2%)

Query:   1 MRTVLVVQGDDETIELLRSYLEGALYKVVMASDGEEAFSLFQQHQIDLAIIDITLPKIDG   60
           M+ +L+V  +        ++++  L    Y +V A DG EA  ++F++ + DL I+D+ LP++DG
Sbjct:   1 MKKILIVDDEKPISDIIKFNLTKEGYDIVTAFDGREAVTIFEEEKPDLIILDLMLPELDG   60

Query:  61 YELTRLIRQDSQIPIIMLAAKTTDMDRILGLNIGADDFITKPFNSLEVLARINSQLRRYY  120
           E+ + + IR+  S +PIIML+AK ++ D+++GL IGADD++TKPF++ E+LAR+ + LRR
Sbjct:  61 LEVAKEIRKTSHVPIIMLSAKDSEFDKVIGLEIGADDYVTKPFSNRELLARVKAHLRRTE  120

Query: 121 EFNSLAKPKN-----QFIKIGELELDEEHVELTKNGKHIKLTATEFKILHILMSSPGRIY  175
            +    +N    Q + IG L++ +        K+G+ ++LT  EF++LH L +   G++
Sbjct: 121 TIETAVAEENASSGTQELTIGNLQILPDAFVAKKHGQEVELTHREFELLHHLANHMGQVM  180

Query: 176 TKTQLYEKINGRYLEGDETTIMVHISNIRDKIEDDSKYPKYIKTLRGVGY           225
           T+  L E + G    GD T+ V +  +R+KIED    P+YI T RGVGY
Sbjct: 181 TREHLLEIVWGYDYFGDVRTVDVTVRRLREKIEDTPSRPEYILTRRGVGY           230
```

Based on this analysis, it was predicted that this protein and its epitopes, could be useful antigens for vaccines or diagnostics.

EXAMPLE 371

A DNA sequence (GBSx0402) was identified in *S. agalactiae* <SEQ ID 1209> which encodes the amino acid sequence <SEQ ID 1210>. This protein is predicted to be threonyl-tRNA synthetase 1 (thrS). Analysis of this protein sequence reveals the following:

Possible site: 32
>>> Seems to have no N-terminal signal sequence

----- Final Results -----
              bacterial cytoplasm --- Certainty = 0.2353(Affirmative) < succ>
               bacterial membrane --- Certainty = 0.0000(Not Clear)   < succ>
                 bacterial outside --- Certainty = 0.0000(Not Clear)   < succ>

The protein has homology with the following sequences in the GENPEPT database:

```
>GP: BAB06860 GB: AP001517 threonyl-tRNA synthetase 1
[Bacillus halodurans]
Identities = 413/638 (64%), Positives = 506/638 (78%), Gaps = 7/638 (1%)

Query:   1 MIKITFPDGAIREFESGITTFEIAQSISNSLAKKALAGKFNGQLIDTTRAIEEDGSIEIV   60
           MI ITFPDGA++EF  G TT EIA SIS  L KKALAG  +G L+D    IE+DG+I IV
Sbjct:   4 MINITFPDGAVKEFPKGTTTAEIAGSISPGLKKKALAGMLDGTLLDLNTPIEQDGTITIV   63

Query:  61 TPDHEDALGVLRHSAAHLFAQAAKRLFPD--LCLGVGPAIQDGFYYDTDNKSGQISNDDL  118
           TP+ ++AL VLRHS AH+ AQA KRLF D   + LGVGP I+ GFYYD D     ++DL
Sbjct:  64 TPESDEALEVLRHSTAHVMAQALKRLFKDRNVKLGVGPVIEGGFYYDVDMDES-LTPEDL  122

Query: 119 PRIEEEMKKIVKENHPCIREEISKEEALELFKD--DPYKVELISEHAEDG-LTVYRQGEF  175
           P+IE+EMKKI+ EN P  R  +S+EEAL  +++   DPYK+ELI++   ED  +T+Y QGEF
Sbjct: 123 PKIEKEMKKIIGENLPIERVVVSREEALARYEEVGDPYKIELINDLPEDETITIYEQGEF  182

Query: 176 VDLCRGPHVPSTGRIQVFHLLNVAGAYWRGNSDNAMMQRVYGTAWFDKKDLKAYLKRREE  235
            DLCRG HVPSTG+++ F LLN+AGAYWRG+S N M+QR+YGTA+F K DL  +L+  EE
Sbjct: 183 FDLCRGVHVPSTGKLKEFKLLNLAGAYWRGDSSNKMLQRIYGTAFFKKADLDEHLRLLEE  242

Query: 236 AKERDHRKLGKELDLFMVNPEVGQGLPFWLPNGATIRRELERYIVDKEIASGYQHVYTPP  295
           AKERDHRKLGKEL +F ++  VGQGLP WLP GATIRR +ERYIVDKE   GYQHVYTP
Sbjct: 243 AKERDHRKLGKELGIFALSQKVGQGLPLWLPKGATIRRIIERYIVDKEEKLGYQHVYTPV  302

Query: 296 MASVEFYKTSGHWDHYREDMFPTMDMGDGEEFVLRPMNCPHHIEVYKHHVHSYRELPIRI  355
            +AS E YKTSGHWDHY++DMFPTM+M  +EE VLRPMNCPHH+ VYK   SYR LP+RI
Sbjct: 303 LASSELYKTSGHWDHYKDDMFPTMEM-ENEELVLRPMNCPHHMMVYKTEMRSYRQLPLRI  361

Query: 356 AELGMMHRYEKSGALTGLQRVREMTLNDAHIFVTPEQIKDEFLKALNLIAEIYEDFNLTD  415
           AELG+MHRYE SGA++GLQRVR MTLNDAHIF  P+QIKDEF++ + LI +YEDF L +
Sbjct: 362 AELGLMHRYEMSGAVSGLQRVRGMTLNDAHIFCRPDQIKDEFVRVVRLIQAVYEDFGLKN  421

Query: 416 YRFRLSYRDPEDKHKYYDNDEMWENAQAMLKEAMDDFGLDYFEAEGEAAFYGPKLDIQVK  475
           Y FRLSYRDPEDK KY+D+D MW  AQ MLKEAMD+ L+YFEAEGEAAFYGPKL+QV+
Sbjct: 422 YSFRLSYRDPEDKEKYFDDDNMWNKAQGMLKEAMDELELEYFEAEGEAAFYGPKLDVQVR  481

Query: 476 TALGNEETLSTIQLDFLLPERFDLKYIGADGEEHRPIMIHRGGISTMERFTAILIETYKG  535
           TALG +ETLST+QLDFLLPERFDL Y+G DG+ HRP+++HRG +STMERF A L+E YKG
Sbjct: 482 TALGKDETLSTVQLDFLLPERFDLTYVGEDGQPHRPVVVHRGVVSTMERFVAFLLEEYKG  541

Query: 536 AFPTWLAPQQVSVIPISNEAHIDYAWEVARVLKDRGIRAEVDDRNEKMQYKIRAAQTQKI  595
           AFPTWLAP QV VIP+S EAH++YA  V   L+  GIR E+D+R+EK+ YKIR AQ QKI
Sbjct: 542 AFPTWLAPVQVQVIPVSPEAHLEYAKNVQETLQQAGIRVEIDERDEKIGYKIREAQMQKI  601

Query: 596 PYQLIVGDKEMEEKAVNVRRYGSKATETKSIEEFVESI                        633
           PY L++GDKE+E   VNVR+YG K + +  ++EFV +
Sbjct: 602 PYMLVLGDKEVEANGVNVRKYGEKDSSSMGLDEFVRHV                        639
```

A related DNA sequence was identified in *S. pyogenes* <SEQ ID 1211> which encodes the amino acid sequence <SEQ ID 1212>. Analysis of this protein sequence reveals the following:

Possible site: 32
>>> Seems to have no N-terminal signal sequence

----- Final Results -----
              bacterial cytoplasm --- Certainty = 0.2566(Affirmative) < succ>
               bacterial membrane --- Certainty = 0.0000(Not Clear)   < succ>
                 bacterial outside --- Certainty = 0.0000(Not Clear)   < succ>

An alignment of the GAS and GBS proteins is shown below:

```
Identities = 564/644 (87%), Positives = 608/644 (93%)

Query:     1 MIKITFPDGAIREFESGITTFEIAQSISNSLAKKALAGKFNGQLIDTTRAIEEDGSIEIV   60
             MIKITFPDGA+REFESG+TTF+IA+SIS SLAKKALAGKFN QLIDTTRAIEEDGSIEIV
Sbjct:     1 MIKITFPDGAVREFESGVTTFDIAESISKSLAKKALAGKFNDQLIDTTRAIEEDGSIEIV   60

Query:    61 TPDHEDALGVLRHSAAHLFAQAAKRLFPDLCLGVGPAIQDGFYYDTDNKSGQISNDDLPR  120
             TPDH+DA  VLRHSAAHLFAQAAKRLFP+L LGVGPAI +GFYYDTDN  GQISN+DLPR
Sbjct:    61 TPDHKDAYEVLRHSAAHLFAQAAKRLFPNLHLGVGPAIAEGFYYDTDNAEGQISNEDLPR  120

Query:   121 IEEEMKKIVKENHPCIREEISKEEALELFKDDPYKVELISEHAEDGLTVYRQGEFVDLCR  180
             IE EM+KIV EN+PCIREE++KEEALELFKDDPYKVELI+EHA  GLTVYRQGEFVDLCR
Sbjct:   121 IEAEMQKIVTENYPCIREEVTKEEALELFKDDPYKVELINEHAGAGLTVYRQGEFVDLCR  180

Query:   181 GPHVPSTGRIQVFHLLNVAGAYWRGNSDNAMMQRVYGTAWFDKKDLKAYLKRREEAKERD  240
             GPHVPSTGRIQVFHLLNVAGAYWRGNSDN MMQR+YGTAWFDKKDLKAYL R EEAKERD
Sbjct:   181 GPHVPSTGRIQVFHLLNVAGAYWRGNSDNNMMQRIYGTAWFDKKDLKAYLTRLEEAKERD  240

Query:   241 HRKLGKELDLFMVNPEVGQGLPFWLPNGATIRRELERYIVDKEIASGYQHVYTPPMASVE  300
             HRKLGKELDLFM++  EVGQGLPFWLP+GATIRR LERYI DKE+ASGYQHVYTPP+ASVE
Sbjct:   241 HRKLGKELDLFMISQEVGQGLPFWLPDGATIRRTLERYITDKELASGYQHVYTPPLASVE  300

Query:   301 FYKTSGHWDHYREDMFPTMDMGDGEEFVLRPMNCPHHIEVYKHHVHSYRELPIRIAELGM  360
              YKTSGHWDHY+EDMFP MDMGDGEEFVLRPMNCPHHI+VYK+HV SYRELPIRIAELGM
Sbjct:   301 LYKTSGHWDHYQEDMFPVMDMGDGEEFVLRPMNCPHHIQVYKNHVRSYRELPIRIAELGM  360

Query:   361 MHRYEKSGALTGLQRVREMTLNDAHIFVTPEQIKDEFLKALNLIAEIYEDFNLTDYRFRL  420
             MHRYEKSGAL+GLQRVREMTLND HIFVTPEQI++EF +AL LI ++Y DFNLTDYRFRL
Sbjct:   361 MHRYEKSGALSGLQRVREMTLNDGHIFVTPEQIQEEFQRALQLIIDVYADFNLTDYRFRL  420

Query:   421 SYRDPEDKHKYYDNDEMWENAQAMLKEAMDDFGLDYFEAEGEAAFYGPKLDIQVKTALGN  480
             SYRDP D HKYYDNDEMWENAQ+MLK A+D+ G+DYFEAEGEAAFYGPKLDIQVKTALGN
Sbjct:   421 SYRDPNDTHKYYDNDEMWENAQSMLKAALDEMGVDYFEAEGEAAFYGPKLDIQVKTALGN  480

Query:   481 EETLSTIQLDFLLPERFDLKYIGADGEEHRPIMIHRGGISTMERFTAILIETYKGAFPTW  540
             EETLSTIQLDFLLPERFDLKYIGADGEEHRP+MIHRG ISTMERFTAILIETYKGAFPTW
Sbjct:   481 EETLSTIQLDFLLPERFDLKYIGADGEEHRPVMIHRGVISTMERFTAILIETYKGAFPTW  540

Query:   541 LAPQQVSVIPISNEAHIDYAWEVARVLKDRGIRAEVDDRNEKMQYKIRAAQTQKIPYQLI  600
             LAP QV+VIPISNEAHIDYAWEVA+ L+DRG+RA+VDDRNEKMQYKIRA+QT KIPYQLI
Sbjct:   541 LAPHQVTVIPISNEAHIDYAWEVAKTLRDRGVRADVDDRNEKMQYKIRASQTSKIPYQLI  600

Query:   601 VGDKEMEEKAVNVRRYGSKATETKSIEEFVESILADIARKSRPD                 644
             VGDKEME+K+VNVRRYGSK T T+S+EEFVE+ILADIARKSRPD
Sbjct:   601 VGDKEMEDKSVNVRRYGSKTTHTESVEEFVENILADIARKSRPD                 644
```

Based on this analysis, it was predicted that these proteins and their epitopes could be useful antigens for vaccines or diagnostics.

EXAMPLE 372

A DNA sequence (GBSx0403) was identified in *S. agalactiae* <SEQ ID 1213> which encodes the amino acid sequence <SEQ ID 1214>. Analysis of this protein sequence reveals the following:

```
Possible site: 16
>>> Seems to have no N-terminal signal sequence

----- Final Results -----
          bacterial cytoplasm --- Certainty = 0.1985(Affirmative) < succ>
          bacterial membrane  --- Certainty = 0.0000(Not Clear)   < succ>
           bacterial outside  --- Certainty = 0.0000(Not Clear)   < succ>
```

The protein has homology with the following sequences in the GENPEPT database:

```
>GP:CAA72250 GB:Y11463 ORF5 [Streptococcus pneuinoniae]
Identities = 189/290 (65%), Fesitives = 234/290 (80%)
```

```
-continued
Query:   1 MRIGLFTDTYFFQVSGVSTSIRTLKEGLEKEGHEVYIFTTTDRNVKRFEDPTIIRLPSVP  60
           MRIGLFTDTYFPQVSGV+TSIRTLK  LEK+GH V+IFTTTD++V R+ED  IIR+PSVP
Sbjct:   1 MRIGLFTDTYFPQVSGVATSIRTLKTELEKQGHAVFIFTTTDKDVNRYEDWQIIRIPSVP  60

Query:  61 FISFTDRRVVYRGLISAYRIAKDYELDIIHTQTEFSLGLLGRLVAKALRIPVVHTYHTQY 120
           F +F DRR  YRG    IAK Y+LDIIHTQTEFSLGLLG  +A+  L+IPV+HTYHTQY
Sbjct:  61 FFAFKDRRFAYRGFSKALEIAKQYQLDIIHTQTEFSLGLLGIWIARELKIPVIHTYHTQY 120

Query: 121 EDYVGYIAKGKLIKPSDVKYIMRTYLSDLDGVICPSRIVLNLLDGYGVKIPKQVIPTGIP 180
           EDYV YIAKG LI+PSMVKY++R +L D+DGVICPS IV +LL  Y VK+ K+VIPTGI
Sbjct: 121 EDYVHYIAKGMLIRPSMVKYLVRGFLHDVDGVICPSEIVRDLLSDYKVKVEKRVIPTGIE 180

Query: 181 VENYRREDISEETIKNLRTELGLADNDTMLLSLSRVSFERNIQAILMHLSAVVDENPHVK 240
             + + R +I +E +K LR++LG+ D +  LLSLSR+S+EKNIQA+L+   + V+ E      VK
Sbjct: 181 LAKFERPEIKQENLKELRSKLGIQDGEKTLLSLSRISYEKNIQAVLVAFADVLKEEDKVK 240

Query: 241 LVIVGDGPYLSDLKELVHSLELENSVIFTGMVEHSQVAIYYKACDFFISA           290
           LV+ GDGPYL+DLKE   +LE+++SVIFTGM+  S+ A+YYKA DFFISA
Sbjct: 241 LVVAGDGPYLNDLKEQAQNLEIQDSVIFTGMIAPSETALYYKAADFFISA           290
```

A related DNA sequence was identified in *S. pyogenes* <SEQ ID 1215> which encodes the amino acid sequence <SEQ ID 1216>. Analysis of this protein sequence reveals the following:

```
Possible site: 17
>>> Seems to have no N-terminal signal sequence

----- Final Results -----
            bacterial cytoplasm --- Certainty = 0.1074(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below:

```
Identities = 309/444 (69%), Positives = 370/444 (82%)

Query:   1 MRIGLFTDTYFPQVSGVSTSIRTLKEGLEKEGHEVYIFTTTDRNVKRFEDPTIIRLPSVP  60
           MRIGLFTDTYWPQVSGV+TSIRTLKE LEKEGHEVYIFTTTDR+VKRFSDPTIIRLPSVP
Sbjct:   1 MRIGLFTDTYFPQVSGVATSIRTLKEELEKEGHEVYIFTTTDRDVKRFSDPTIIRLPSVP  60

Query:  61 FISFTDRRVVYRGLISAYRIAKDYELDIIHTQTEFSLGLLGKLVAKALRIPVVHTYHTQY 120
           F+SFTDRRVVYRGLIS+Y+IAK Y LDIIHTQTEFSLGLLGK++ KALRIPVVHTYHTQY
Sbjct:  61 FVSFTDRRVVYRGLISSYKIAKHYNLDIIHTQTEFSLGLLGKMIGKALRIPVVHTYHTQY 120

Query: 121 EDYVGYIAKGKLTKPSMVRYIMRTYLSDLDGVICPSRIVLNLLDGYGVKIPKQVIPTGIP 180
           EDYV YIA GK+I+PSMVK ++R YL DLDGVICPSRIVLNLL+GY V IPK+VIPTGIP
Sbjct: 121 EDYVSYIANGKIIRPSMVKFLLRGYLKOLDGVICPSRIVLNLLEGYEVTIPKRVIPTGIP 180

Query: 181 VENYRREDISEETIKNLRTELGLADNDTMLLSLSRVSFEKNIQAILMHLSAVVDENPHVK 240
           +E Y R+DI+ E + NL+ ELG+A ++TMLLSLSR+S+EKNIQAI+  + A++ EN +K
Sbjct: 181 LEKYIRDDITAEEVTNLKAELGIAGDETMLLSLSRISYEKNIQAIINQMPAILAENAKIK 240

Query: 241 LVIVGDGPYLSDLKELVHSLELENSVIFTGMVEHSQVAIYYKACDFFISASTSETQGLTY 300
           L+IVG+GPYL DLK L   LE++  V FTGMV H +VA+YYKACDFFISASTSETQGLTY
Sbjct: 241 LIIVGNGPYLQDLKHLAMQLEVDKHVTFTGMVPHDKVALYYKACDFFISASTSETQGLTY 300

Query: 301 IESLASGRPIIAQSNPYLDDVISDKMFGTLYKKESDLADAILDAIAETPKMTQEAYEQKL 360
           IESLASG PIIA  NPYLDDV++DKMFGTLY  E+DL DAI+DAI +TP M +    +K
Sbjct: 301 IESLASGTPIIAHGNPYLDDVVTDKMFGTLYYAETDLTDAIIDAILKTPVMDKRLLAKKR 360

Query: 361 YEISAENFSKSVYAFYLDFLISQKASVKEKVSLTIGNKDSHSTLRFVRKAVYLPKKVFTF 420
           YEISA++F KS+Y FYLD LI++ +    +K+SL + +     S+L+ V+ A++LPK+
Sbjct: 361 YEISAQHFGKSIYTFYLDTLIARNSKEAQKLSLYLNHSGKSSSLKLVQGAIHLPKRAAKV 420

Query: 421 TGPASKKVVKAPKRRISSIRDFLD                                     444
           T   S KVVKAP + +  +I+DFLD
Sbjct: 421 TAITSVKVVKAPIRLVHAIKDFLD                                     444
```

Based on this analysis, it was predicted that these proteins and their epitopes could be useful antigens for vaccines or diagnostics.

EXAMPLE 373

A DNA sequence (GBSx0404) was identified in *S. agalactiae* <SEQ ID 1217> which encodes the amino acid sequence <SEQ ID 1218>. This protein is predicted to be lipopolysaccharide biosynthesis protein-related protein. Analysis of this protein sequence reveals the following:

```
Possible site: 61
>>> Seems to have no N-terminal signal sequence

----- Final Results -----
            bacterial cytoplasm --- Certainty = 0.4076(Affirmative) < succ>
             bacterial membrane --- Certainty = 0.0000(Not Clear) < succ>
              bacterial outside --- Certainty = 0.0000(Not Clear) < succ>
```

The protein has homology with the following sequences in the GENPEPT database:

```
>GP: AAG19110 GB: AE005009 Vng0600c [Halobacterium sp. NRC-1]
Identities = 117/350 (33%), Positives = 178/350 (50%),
Gaps = 29/350 (8%)

Query:   1 MKVLLYLEAEEYLKKSGIGRAIKHQEKALQIAGIDYTTNPT-------------------  41
           M+ L YLEA E L+  G+  A   Q   AL+    ++         P
Sbjct:   2 MRALNYLEAAEALR-GGMVTATNQQRAALETTDVEVVETPWRAGDPVRSIGSLAAGGSCF  60

Query:  42 DDFDLVHMNTYGIRSWLLMSKAKKTGKKVIMHGHSTEEDFRNSFIGSNLVSPLFKWYLCR 101
           FD+ H N  G  S  +   A++T    +++H H T EDF   SF GS+ ++P  + YL
Sbjct:  61 TAFDVAHCNLVGPGSVAVARHARRTDTPLVLHAHLTREDFAQSFRGSSTIAPALEPYLRW 120

Query: 102 FYQKADAIITPTDYSKQLIKAYGIKKPIFVLSNGIDLSRYQRSEKKESAFRHYFHLSKDD 161
           FY +AD ++ P++Y+K +++AY +  PI   LSNG+DL   Q  E  + R  F L D
Sbjct: 121 FYSQADLVLCPSEYTKDVLRAYPVDAPIRQLSNGVDLESMQGYESFRADTRARFDL--DG 178

Query: 162 KVVMGAGLYFMRKGIDQFVEVAAKMPDIRFIWFGETNKWVIPRKVRQIVTKQHPSNVTFA 221
              VV   G F RKG+  F E+ AK   D   F WFG ++              P+NVTF
Sbjct: 179 TVVYAVGEVFERKGLTMFCEL-AKATDHEFAWFGPYDEGPQAGAATRKWVADPPANVTFT 237

Query: 222 GYIKGDVYEGAMSASDAFFFPSREETEGIVVLEALASHQHVVLRDIPVYHGWVTE-DSVE 280
           GY++       A   A D + FP++ E +GI VLEA+A  + VVLRDIPV+  + T+ +
Sbjct: 238 GYMEDK--RAAFGAGDIYLFPAKVENQGIAVLEAMACGKPVVLRDIPVFREFFTDGEDCL 295

Query: 281 LATDVDGFVEKLDKVLSGKSDKIKEGYH---VAESRSIERIAHELASVYQ           327
           + +  + F + +D++       + + G +     AES S++RI  ELAS+Y+
Sbjct: 296 MCSTFEAFRDAIDRLADDPELRTRLGENARETAESHSLDRIGEELASIYE          345
```

A related-DNA sequence was identified in *S. pyogenes* <SEQ ID 1219> which encodes the amino acid sequence <SEQ ID 1220>. Analysis of this protein sequence reveals the following:

```
Possible site: 61
>>> Seems to have no N-terminal signal sequence

----- Final Results -----
            bacterial cytoplasm --- Certainty = 0.4088(Affirmative) < succ>
             bacterial membrane --- Certainty = 0.0000(Not Clear) < succ>
              bacterial outside --- Certainty = 0.0000(Not Clear) < succ>
```

An alignment of the GAS and GBS proteins is shown below:

```
Identities = 236/332 (71%), Positives = 276/332 (83%)

Query:  1 MKVLLYLEAEEYLKKSGIGRAIKHQEKALQIAGIDYTTNPTDDFDLVHMNTYGIRSWLLM  60
          MKVLLYLEAE YL+KSGIGRAIKHQ KAL + G  +TTNP + +DLVH+NTYG++SWLLM
Sbjct:  1 MKVLLYLEAENYLRKSGIGRAIKHQAKALSLVGQHFTTNPRETYDLVHLNTYGLKSWLLM  60
```

-continued

```
Query:   61 SKAKKTGKKVIMHGHSTEEDFRNSFIGSNLVSPLFKWYLCRFYQKADAIITPTDYSKQLI  120
            KA+K GKKVIMHGHSTEEDFRNSFI SNL+SP FK YLC FY KADAIITPT YSK LI
Sbjct:   61 IKAQKAGKKVIMHGHSTEEDFRNSFIFSNLLSPWFKKYLCHFYNKADAIITPTLYSKSLI  120

Query:  121 KAYGIKKPIFVLSNGIDLSRYQRSEKKESAFRHYFHLSKDDKVVMGAGLYFMRKGIDQFV  180
            ++YG+K PIF +SNGIDL +Y    KKE+AFR YF + +  +KVVMGAGL+F+RKGID FV
Sbjct:  121 ESYGVKSPIFAVSNGIDLEQYGADPKKEAAFRRYFDIKEGEKVVMGAGLFFLRKGIDDFV  180

Query:  181 EVAAKMPDIRFIWFGETNKWVIPRKVRQIVTKQHPSNVTFAGYIKGDVYEGAMSASDAFF  240
            +VA  MPD+RFIWFGETNKWVIP +VRQ+V   HP N+ F GYIKGDVYEGAM+ +DAFF
Sbjct:  181 KVAQAMPDVRFIWFGETNKWVIPAQVRQMVNGNHPKNLIFPGYIKGDVYEGAMTGADAFF  240

Query:  241 FPSREETEGIVVLEALASHQHVVLRDIPVYHGWVTEDSVELATDVDGFVEKLDKVLSGKS  300
            FPSREETEGIVVLEALAS QH+VLRDIPVY+GWV + S ELATD+ GF+E L KV SG S
Sbjct:  241 FPSREETEGIVVLEALASRQHLVLRDIPVYYGWVDQSSAELATDIPGFIEALKKVFSGAS  300

Query:  301 DKIKEGYHVAESRSIERIAHELASVYQKVMEL                             332
            +K++ GY VA+SR +E + H L  VY+KVMEL
Sbjct:  301 NKVEAGYKVAQSRRLETVGHALVDVYKKVMEL                             332
```

Based on this analysis, it was predicted that these proteins and their epitopes could be useful antigens for vaccines or diagnostics.

EXAMPLE 374

A DNA sequence (GBSx0405) was identified in *S. agalactiae* <SEQ ID 1221> which encodes the amino acid sequence <SEQ ID 1222>. Analysis of this protein sequence reveals the following:

```
Possible site: 16
>>> Seems to have no N-terminal signal sequence

----- Final Results -----
              bacterial cytoplasm --- Certainty = 0.5487(Affirmative) < succ>
              bacterial membrane  --- Certainty = 0.0000(Not Clear)   < succ>
              bacterial outside   --- Certainty = 0.0000(Not Clear)   < succ>
```

The protein has homology with the following sequences in the GENPEPT database:

```
>GP: AAC35010 GB: AF055987 intracellular a-amylase
[Streptococcus mutans]
Identities = 308/483 (63%), Positives = 378/483 (77%)

Query:    1 MTNELIMQAFEWYLPSDGNHWKKLEESISDLKKLGISKIWLPPAFKGTSSDDVGYGVYDL   60
            MTNE +MQ FEWYLP+DG HW+L E   S LK +GISK+W+PPAFKGT S+DVGYGVYDL
Sbjct:    1 MTNETMMQYFEWYLPNDGKHWQHLAEDASHLKNIGISKVWMPPAFKGTGSNDVGYGVYDL   60

Query:   61 FDLGEFDQNGTIRTKYGRKEEYLKLIKSLKANGIKPFADIVLNHKANGDHKEKFQVIKVN  120
            +DLGEF+QNGT+RTKYG +E+YL  +  +LK    I P +DIVLNHKANGD KE+FQV KVN
Sbjct:   61 YDLGEFNQNGTVRTKYGSREDYLNAVNALKEQEIMPISDIVLNHKANGDAKERFQVVKVN  120

Query:  121 PENRQEALSEPYEIEGWTGFDFPGRQGEYNDFKWHWYHFTGLDYDAKNNETDIFMIVGDN  180
            P NRQE +SEPYEIEGWT F+FPGRQ  Y+DFKWHWYHFTG DYDA +NE  I+MI+GDN
Sbjct:  121 PSNRQEKISEPYEIEGWTQFNFPGRQDNYSDFKWHWYHFTGVDYDALHNENGIYMILGDN  180

Query:  181 KGWADDDLIDDENGNFDYLMYNDIDFKHPEVIKNLQDWAKWFIETTGIEGFRLDAVKHID  240
            KGWA  + ID ENGN+DYLMY+DIDFKHPEV ++L+DW  WF ET+G+ GFRLDA+KHID
Sbjct:  181 KGWASQENIDQENGNYDYLMYDDIDFKHPEVQEHLRDWVAWFLETSGVGGFRLDAIKHID  240

Query:  241 SYFIQTFINDIRTKIKPDLEVFGEYWKSDQTSMKDYLEATQFQFSLVDVTLHMNFFDASH  300
              F+  FI   IR  +K DL VFGEYWK     + DYL +   QF L+DV LHM+ F+A
Sbjct:  241 KTFMAQFIRYIREHLKADLYVFGEYWKDSHFDITDYLHSVDLQFDLIDVMLHMSLFEAGQ  300

Query:  301 QNRDFDMRTIFDDSLVIDNPEYAVTFVENHDTQSGQALESRVEDWFKPLAYGLILLRQQG  360
            +  DFD+  TI DDSL+   +P++ AVTFV+NHD+Q GQALES V +WFKPLAYGLILLRQ+G
Sbjct:  301 KGSDFDLSTILDDSLMKSHPDEAVTFVDNHDSQRGQALESTVAEWFKPLAYGLILLRQEG  360

Query:  361 TPCLFYGDYYGIQGEFGQPSFKEVIDKMAELRQNYVFGKQVDYFTHSNCIGWTCLGDEEH  420
             PC+FYGDYYGI  GEF Q SF+ V+DK+  +RQ +V+G +      T NCIGWTCLGDEEH
Sbjct:  361 IPCVFYGDYYGISGEFAQESFQTVLDKLLYIRQYHVGSKKIILTMPNCIGWTCLGDEEH  420
```

```
Query:  421 NSCLAVVLTNGDQGWKHMEVGEIYAGKTFVDYLGNCEQEVVIGDDGWGDFLVESASISAW  480
            +AV+++NG+   K M +GE    K FVDYL NC +EV++ D GWGDF V+ AS+SAW
Sbjct:  421 PDGVAVIISNGEANCKRMNMGEFNRNKVFVDYLNNCTEEVILDDQGWGDFPVQEASLSAW  480

Query:  481 VPK                                                          483
            V K
Sbjct:  481 VNK                                                          483
```

A related DNA sequence was identified in *S. pyogenes* 10 <SEQ ID 1223> which encodes the amino acid sequence <SEQ ID 1224>. Analysis of this protein sequence reveals the following:

```
Possible site: 30
>>> Seems to have a cleavable N-term signal seq.

----- Final Results -----
            bacterial outside  --- Certainty = 0.3000(Affirmative) < succ>
            bacterial membrane --- Certainty = 0.0000(Not Clear)   < succ>
            bacterial cytoplasm --- Certainty = 0.0000(Not Clear)  < succ>
```

The protein has homology with the following sequences in the databases:

```
>GP: AAB00845 GB: M57692 alpha-cyclodextrin glycosyltransferase
[Thermoanaerobacterium thermosulfurigenes]
Identities = 356/710 (50%), Positives = 468/710 (65%), Gaps = 16/710 (2%)

Query:    7 KTYKLLTKSAVLLGLISFPLT--VSAADNASVTNKADFSTDTIYQIVTDRFNDGNTSNNG   64
            KT+KL+   + L L+ F LT   + AA + +V+N  ++STD IYQIVTDRF DGNTSNN
Sbjct:    3 KTFKLILVLMLSLTLV-FGLTAPIQAASDTAVSNVVNYSTDVIYQIVTDRFVDGNTSNNP   61

Query:   65 KTDVFDKN--DLKKYHGGDWQGIIAKIKDGYLTDMGISAIWISSPVENIDSIDPSN---G  119
            +D++D    LKKY GGDWQGII KI DGYLT MG++AIWIS PVENI ++ P +   G
Sbjct:   62 TGDLYDPTHTSLKKYFGGDWQGIINKINDGYLTGMGVTAIWISQPVENIYAVLPDSTFGG  121

Query:  120 SAAYHGYWAKDFFKTNQHFGTEADFQQLVKVAHQHHIKVVIDFAPNHTSTAEKEGTTFKE  179
            S +YHGYWA+DF +TN +FG+  DFQ L+   AH H+IKV+IDFAPNHTS A +   T+ E
Sbjct:  122 STSYHGYWARDFKRTNPYFGSFTDFQNLINTAHAHNIKVIIDFAPNHTSPASETDPTYAE  181

Query:  180 DGALYKNGKLVGKFSDDKDKIFNHESWTDFSTYENSIYHSMYGLADLNNINPKVDQYMKE  239
            +G LY NG L+G +++D +  F+H   TDFS+YE+ IY +++ LADLN   N  +D Y+K
Sbjct:  182 NGRLYDNGTLLGGYTNDTNGYFHHYGGTDFSSYEDGIYRNLFDLADLNQQNSTIDSYLKS  241

Query:  240 AIDKWLDLGVDGIRVDAVKHMSQGWQKNWLSHIYEKHNVFVFGEWFSGHTDDDYDMTTFA  299
            AI  WLD+G+DGIR+DAVKHM  GWQKN++  I    VF FGEWF G  + D + T FA
Sbjct:  242 AIKVWLDMGIDGIRLDAVKHMPFGWQKNFMDSILSYRPVFTFGEWFLGTNEIDVNNTYFA  301

Query:  300 NNSGMGLLDFRFANAIRQLYTGFSTFTMRDFYKVLENRDQVTNEVTDQVTFIDNHDMERF  359
            N SGM LLDFRF+  +RQ++   +T TM    ++++   N + D VTFIDNHDM+RF
Sbjct:  302 NESGMSLLDFRFSQKVRQVFRD-NTDTMYGLDSMIQSTASDYNFINDMVTFIDNHDMDRF  360

Query:  360 ATKVANNQTAVNQAYALLLTSRGVPNIYYGTEQYATGDKDPNNRGDMPSFNKESQAYKVI  419
                +   V QA A  LTSRGVP IYYGTEQY TG+ DP NR  M SFN  + AY VI
Sbjct:  361 YN--GGSTRPVEQALAFTLTSRGVPAIYYGTEQYMTGNGDPYNRAMMTSFNTSTTAYNVI  418

Query:  420 SKLAPLRKQNQALAYGTTEQRWISDHVLVFERKFGNHVALVAINRDQTNGYTITNAKTAL  479
             KLAPLRK N A+AYGTT+QRWI++  V ++ERKFGN+VALVAINR+  +  Y IT  TAL
Sbjct:  419 KKLAPLRKSNPAIAYGTTQQRWINNDVYIYERKFGNNVALVAINRNLSTSYNITGLYTAL  478

Query:  480 PQNSYKDKLEGLLGGQELIVGADGTISSFELGAGQVAVWTYEGEDKTPQLGDVDASVGIA  539
            P  +Y D L GLL G  + V +DG+++  F L AG+VAVW Y    +P +G V  + A
Sbjct:  479 PAGTYTDVLGGLLNGNSISVASDGSVTPFTLSAGEVAVWQYVSSSNSPLIGHVGPTMTKA  538

Query:  540 GNKITISGQGFGNSKGQVTFGEISAEILSWSDTLITLKVPTVPANYYNISVTTADKQTSN  599
            G  ITI G+GFG + GQV FG +  I+SW DT + +KVP+V   YNIS+ T+    TSN
Sbjct:  539 GQTITIDGRGFGTTSGQVLFGSTAGTIVSWDDTEVKVKVPSVTPGKYNISLKTSSGATSN  598

Query:  600 SYQAFEVLTDKQIPVRLLINDFKTVPGEQLYLMGDVFEMGANDAKNAVGPLFNNTQTIAK  659
            +Y    +LT  QI VR ++N+  TV GE +YL G+V E+G  D    A+GP+FN  Q + +
Sbjct:  599 TYNNINILTGNQICVRFVVNNASTVYGENVYLTGNVAELGNWDTSKAIGPMFN--QVVYQ  656

Query:  660 YPNWFFDTHLPINKEIAVKLVKKDSIGNVLWT--SPETYSIKTGHEAQTI            707
            YP W++D +P  I K +KK+   + W   S  TY++ +     I
Sbjct:  657 YPTWYYDVSVPAGTTIQFKFIKKNG-NTITWEGGSNHTYTVPSSSTGTVI            705
```

An alignment of the GAS and GBS proteins is shown below:

```
Identities = 112/509 (22%), Positives = 193/509 (37%),
Gaps = 103/509 (20%)

Query:  18 GNHWKKLEESISD--LKKLGISKIWLPPAFKGTSSDDV--------GYGVYDLFDLGEFD   67
            G W+ +   I D L +GIS IW+   +   S D          GY    D F   +
Sbjct:  79 GGDWQGIIAKIKDGYLTDMGISAIWISSPVENIDSIDPSNGSAAYHGYWAKDFFKTNQH-  137

Query:  68 QNGTIRTKYGRKEEYLKLIKSLKANGIKPFADIVLNHKANGDHKEKFQVIKVNPENRQEA  127
                       +G + ++ +L+K    + IK    D   NH +   + +
Sbjct: 138 --------FGTEADFQQLVKVAHQHHIKVVIDFAPNHTSTAEKE----------------  173

Query: 128 LSEPYEIEGWTGFDFPGRQGEYNDFKWHWYHFTGLDYDAKNNETDIPMIVGDNKGWADDD  187
                        G  F     Y + K      G  D K+      + +++ W D
Sbjct: 174 -----------GTTFKEDGALYKNGK-----LVGKFSDDKDK-------IFNHESWTDFS  210

Query: 188 LIDDE--NGNFDYLMYNDIDFKHPEVIKNLQDWAKWFIETTGIEGFRLDAVKHIDSYFIQ  245
            ++   +   +     N+I+ K  + +K   D  KW       G++G R+DAVKH+    + +
Sbjct: 211 TYENSIYHSMYGLADLNNINPKVDQYMKEAID--KWL--DLGVGDIRVDAVKHMSQGWQK  266

Query: 246 TFINDIRTKIKPDLEVFGEYWKSDQTSMKDYLEATQFQFSLVDVTLHMNFFDASHQ-NRD  304
                +++  I      K ++ VFGE W S    T   D   + T F   +       L     F +A    Q
Sbjct: 267 NWLSHIYE--KHNVFVFGE-WFSGHTD--DDYDMTTFANNSGMGLLDFRFANAIRQLYTG  321

Query: 305 FDMRTIFDDSLVIDNPEYA-------VTFVENHDTQSGQALESRVEDWFKPLAYGLILLR  357
              F    T+ D   V++N +               VTF++NHD +       +  +       AY L LL
Sbjct: 322 FSTFTMRDFYKVLENRDQVTNEVTDQVTFIDNHDMERFATKVANNQTAVNQ-AYAL-LLT  379

Query: 358 QQGTPCLFYGDYYGIQGE------FGQPSFK------EVIDKMAELR---QNYVFGKQVD  402
             +G P ++YG      G+           PSF         +VI K+A LR    Q    +G
Sbjct: 380 SRGVPNIYYGTEQYATGDKDPNNRGDMPSFNKESQAYKVISKLAPLRKQNQALAYGTTEQ  439

Query: 403 YFTHSNCIGWTCLGDEEHNSCLAVVLTWGDQ--GWKHMEVGEIYAGKTFVDYLGNC--EQ  458
                +    + +    + + +    + +A+V  N DQ    G+                    ++ D L       Q
Sbjct: 440 RWISDHVL----VFERKFGNHVALVAINRDQTNGYTITNAKTALPQNSYKDKLEGLLGGQ  495

Query: 459 EVVIGDDGW-GDFLVESASISAWVPKIEE                                486
            E+++G DG       F + +  ++ W   + E+
Sbjct: 496 ELIVGADGTISSFELGAGQVAVWTYEGED                                524
```

Based on this analysis, it was predicted that these proteins and their epitopes could be useful antigens for vaccines or diagnostics.

EXAMPLE 375

A DNA sequence (GBSx0406) was identified in *S. agalactiae* <SEQ ID 1225> which encodes the amino acid sequence <SEQ ID 1226>. This protein is predicted to be catabolite control protein A. Analysis of this protein sequence reveals the following:

```
Possible site: 29
>>> Seems to have no N-terminal signal sequence

----- Final Results -----
           bacterial cytoplasm --- Certainty = 0.2154(Affirmative) < succ>
           bacterial membrane  --- Certainty = 0.0000(Not Clear)   < succ>
             bacterial outside --- Certainty = 0.0000(Not Clear)   < succ>
```

A related GBS nucleic acid sequence <SEQ ID 9707> which encodes amino acid sequence <SEQ ID 9708> was also identified.

The protein has homology with the following sequences in the GENPEPT database:

```
>GP: BAA88121 GB: AB028599 catabolite control protein A [Streptococcus
bovis] (ver 3)
Identities = 304/332 (91%), Positives = 320/332 (95%)

Query:  1 MNTDDTITIYDVAREAGVSMATVSRVVNGNKNVKENTRKKVLEVIDRLDYRPNAVARGLA  60
          MNTDDTITIYDVAREAGVSMATVSRVVNGNKNVKENTRKKVLEVIDRLDYRPNAVARGLA
```

```
                               -continued
Sbjct:    1 MNTDDTITIYDVAREAGVSMATVSRVVNGNKNVKENTRKKVLEVIDRLDYRPNAVARGLA    60

Query:   61 SKKTTTVGVVIPNIANSYFSILARGIDDIAAMYKYNIVLASSDEDDDKEVNVVNTLFAKQ   120
            SKKTTTVGVVIPNIANSYFSILA+GIDDIAAMYKYNIVLASSDEDDDKEVNVVNTLFAKQ
Sbjct:   61 SKKTTTVGVVIPNIANSYFSILAKGIDDIAAMYKYNIVLASSDEDDDKEVNVVNTLFAKQ   120

Query:  121 VDGIIFMGHHLTEKIRAEFSRSRTPIVLAGTVDLEHQLPSVNIDYKAAAVDVIDILAGNH   180
            VDGIIFMGHHLTEKIRAEFSRSRTP+VLAGTVDLEHQLPSVNIDYKAA  DV+DILA N+
Sbjct:  121 VDGIIFMGHHLTEKIRAEFSRSRTPVVLAGTVDLEHQLPSVNIDYKAAVADVVDILAKNN   180

Query:  181 KDIAFVSGPLIDDINGKVRLAGYKEGLKKNGLNFKEGLVFEANYRYAEGFALAQRVINAG   240
            KDIAFVSGPLIDDINGKVRLAGYKEGL+KN L+FKEGLVFEANY Y +G+ LAQRV+N+G
Sbjct:  181 KDIAFVSGPLIDDINGKVRLAGYKEGLEKNNLSFKEGLVFEANYNYKDGYELAQRVMNSG   240

Query:  241 ATAAYVAEDELAAGLLNGLFEAGKRVPEDFEIITSNDSPIAQYTRPNLTSISQPVYDLGA   300
            ATAAYVAEDELAAGLLNGLF AGK+VPEDFEI+TSNDSPI  YTRPNL+SISQPVYDLGA
Sbjct:  241 ATAAYVAEDELAAGLLNGLFAAGKKVPEDFEILTSNDSPITSYTRPNLSSISQPVYDLGA   300

Query:  301 VSMRMLTKIMHKEELEEKEIVLNHGIVKRGTT                              332
            VSMRMLTKIM+KEELEEKEI+LNHG+  RGTT
Sbjct:  301 VSMRMLTKIMNKEELEEKEIILNHGLKLRGTT                              332
```

A related DNA sequence was identified in *S. pyogenes* <SEQ ID 1227> which encodes the amino acid sequence <SEQ ID 1228>. Analysis of this protein sequence reveals the following:

```
Possible site: 29
>>> Seems to have no N-terminal signal sequence

----- Final Results -----
            bacterial cytoplasm --- Certainty = 0.2154(Affirmative) < succ>
            bacterial membrane  --- Certainty = 0.0000(Not Clear)   < succ>
             bacterial outside  --- Certainty = 0.0000(Not Clear)   < succ>
```

An alignment of the GAS and GBS proteins is shown below:

```
Identities = 307/332 (92%), Positives = 320/332 (95%)
Query:    1 MNTDDTITIYDVAREAGVSMATVSRVVNGNKNVKENTRKKVLEVIDRLDYRPNAVARGLA    60
            MNTDD +TIYDVAREAGVSMATVSRVVNGNKNVKENTRKKVLEVIDRLDYRPNAVARGLA
Sbjct:    1 MNTDDPLTIYDVAREAGVSMATVSRVVNGNKNVKENTRKKVLEVIDRLDYRPNAVARGLA    60

Query:   61 SKKTTTVGVVIPNIANSYFSILARGIDDIAAMYKYNIVLASSDEDDDKEVNVVNTLFAKQ   120
            SKKTTTVGVVIPNIANSYFSILA+GIDDIAAMYKYNIVLASSDEDDDKEVNVVNTLFAKQ
Sbjct:   61 SKKTTTVGVVIPNIANSYFSILAKGIDDIAAMYKYNIVLASSDEDDDKEVNVVNTLFAKQ   120

Query:  121 VDGIIFMGHHLTEKIRAEFSRSRTPIVLAGTVDLEHQLPSVNIDYKAAAVDVIDILAGNH   180
            VDGIIFMGHHLTEKIRAEFSRSRTP+VLAGTVDL+HQLPSVNIDY+AA  +V+DILA NH
Sbjct:  121 VDGIIFMGHHLTEKIRAEFSRSRTPVVLAGTVDLDHQLPSVNIDYRAAVSNVVDILAENH   180

Query:  181 KDIAFVSGPLIDDINGKVRLAGYKEGLKKNGLNFKEGLVFEANYRYAEGFALAQRVINAG   240
            K IAFVSGPLIDDINGKVRLAGYKEGLK N L+FKEGLVFEANY Y EGF LAQRVIN+G
Sbjct:  181 KCIAFVSGPLIDDINGKVRLAGYKEGLKHNKLDFKEGLVFEANYSYKEGFELAQRVINSG   240

Query:  241 ATAAYVAEDELAAGLLNGLFEAGKRVPEDFEIITSNDSPIAQYTRPNLTSISQPVYDLGA   300
            ATAAYVAEDELAAGLLNGLFEAGKRVPEDFEIITSNDSP+ QYTRPNL+SISQPVYDLGA
Sbjct:  241 ATAAYVAEDELAAGLLNGLFEAGKRVPEDFEIITSNDSPVVQYTRPNLSSISQPVYDLGA   300

Query:  301 VSMRMLTKIMHKEELEEKEIVLNHGIVKRGTT                              332
            VSMRMLTKIM+KEELEEKEI+LNHGI KRGTT
Sbjct:  301 VSMRMLTKIMNKEELEEKEILLNHGIKKRGTT                              332
```

Based on this analysis, it was predicted that these proteins and their epitopes could be useful antigens for vaccines or diagnostics.

EXAMPLE 376

A DNA sequence (GBSx0407) was identified in *S. agalactiae* <SEQ ID 1229> which encodes the amino acid sequence <SEQ ID 1230>. This protein is predicted to be PepQ (pepQ-2). Analysis of this protein sequence reveals the following:

```
Possible site: 22
>>> Seems to have no N-terminal signal sequence

----- Final Results -----
             bacterial cytoplasm --- Certainty = 0.1118(Affirmative) < succ>
              bacterial membrane --- Certainty = 0.0000(Not Clear)   < succ>
               bacterial outside --- Certainty = 0.0000(Not Clear)   < succ>
```

The protein has homology with the following sequences in the GENPEPT database:

```
>GP:AAC46293 GB:AF014460 PepQ [Streptococcus mutans]
Identities = 257/359 (71%), Positives = 304/359 (84%)
Query:   1 MSKLNRIRHHLHSVQAELAVFSDPVTVNYLTGFFCDPHERQMFLFVYEDRDPILFVPALE    60
           MSKL +I    L    E AV SDPV++NYLTGF+ DPHER MFLF++ D++ +LF+P L+
Sbjct:   1 MSKLAQIVQKLKKQGIEAAVLSDPVSINYLTGFYSDPHERLMFLFLFADQETLLFLPELD    60

Query:  61 VSRAKQSVPFPVFGYIDSENPWQKIASNLPSFSVSKVLAEFDNLNVTKFQGLQTVFDGHF   120
            RAK +  V GY+D ENP +KI + LP +  SK+  EFDNLNVTKF GL+T+F G F
Sbjct:  61 ALRAKSILDISVTGYLDFENPLEKIKTLLPKTNYSKIALEFDNLNVTKFKGLETIFSGQF   120

Query: 121 ENLTPYIQNMRLIKSRDEIEKNLVAGEFADKAVQVGFDNISLNNTETDIIAQIEFEMKKQ   180
            NLTP I  MRLIKS DEI+K+L+AGE ADKAVQ+GFD+ISLN TETDIIAQIEFEMKK
Sbjct: 121 TNLTPLINRNRLIKSADEIQKLLIAGELADKAVQIGFDSISLNATETDIIAQIEFEMKKL   180

Query: 181 GINKNSFDTMVLTGNNAANPHGIPGTNKIENNALLLFDLGVETLGYTSDMTRTVAVGKPD   240
           G++KMSF+TMVLTG+NAANPHG+P ++KIENN LLLFDLGVE+ GY SDMTRTVAVG+PD
Sbjct: 181 GVDKMSFETNVLTGSNAANPHGLPASHKIENNHLLLFDLGVESTGYVSDMTRTVAVGQPD   240

Query: 241 QFKKDIYHLCLEANQAAIDFIKPGVLASEVDAAARNVIEKAGYGQYFNHRLGHGLGMDVH   300
           QFKKDIY++CLEA   A+DFIKPGV A++VDAAAR+VIEKAGYG YFNHRLGHG+GM +H
Sbjct: 241 QFKKDIYNICLEAQLTALDFIKPGVSAAQVDAAARSVIEKAGYGDYFNHRLGHGIGMGLH   300

Query: 301 EFPSIMAGNDMEIQEGMCFSVEPGIYIPDKVGVRIEDCGYVTKTGFEVFTKTPKELLYF   359
           EFPSIMAGNDM ++EGMCFSVEPGIYIP+KVGVRIEDCG+VTK GFEVFT+TPKELLYF
Sbjct: 301 SFPSIMAGNDMLLEEGMCFSVEPGIYIPSKVGVRIEDCGHVTKNGFEVFTQTPKELLYF   359
```

A related DNA sequence was identified in *S. pyogenes* <SEQ ID 1231> which encodes the amino acid sequence <SEQ ID 1232>. Analysis of this protein sequence reveals the following:

```
Possible site: 58
>>> Seems to have no N-terminal signal sequence
INTEGRAL Likelihood = -0.90 Transmembrane 42-58 (42-59)

----- Final Results -----
              bacterial membrane --- Certainty = 0.1362(Atfirmative) < succ>
               bacterial outside --- Certainty = 0.0000(Not Clear)   < succ>
             bacterial cytoplasm --- Certainty = 0.0000(Not Clear)   < succ>
```

The protein has homology with the following sequences in the databases:

```
>GP:AAC46293 GB:AF014460 PepQ [Streptococcus mutans]
Identities = 264/359 (73%) , Positives = 304/359 (84%)
Query:   1 MTKLDQIRLYLDQKGAELAIFSDPVTI-                                  60
           NYLTGFFCDPHERQLFLFVYHDLAPVLFVPALE
           M+KL QI   L ++G S A+ SDPV+INYLTGF+ DPHER +FLF++ D    +LF+
           P L+
Sbjct:   1 MSKLAQIVQKLKKQGIEAAVLSDPVSI-                                  60
           NYLTGFYSDPHERLMFLFLFADQETLLFLPELD Query:  61 VARASQAISFPVFGYVDSENPWEKIKAV-                                120
           LPNTAAKTIYAEFDHLNVNKFHGLQTIFSGQF
             RA +   V GY+D ENP EKIK +LP T+   I  EFD+LNV KF GL+TIFS-
           GQF
Sbjct:  61 ALRAKSILDISVTGYLDFENPLEKIK-                                  120
           TLLPSTNYSKIALEFDNLNVTKFKGLETIFSGQF Query: 121 NNLTPYVQGMRLVKSADEINKMMIAGQ-                                180
           FADKAVQVGFDNISLDATETDVIAQIEFEMKKQ
            NLTP +  MRL+KSADEI K++IAG+ ADKAVQ+GFD+ISL+ATETD+IAQIEFEMKK
Sbjct: 121 TNLTPLINRMRLIKSADEIQKLLIAGE-                                180
           LADKAVQIGFDSISLHATETDIIAQIEFEMKKL
```

-continued

```
Query:  181 GIHKMSFDTMVLTGNNAANPHGIPGT-                          240
            NNIENNALLLFDLGVETLGYTSDMTRTVAVGQPD
            G+ KMSF+TMVLTG+NAANPHG+P ++ IENN LLLFDLGVE+GY SD-
            MTRTVAVGQPD
Sbjct:  181 GVDKMSFETMVLTGSNAANPHGLPASHK-                        240
            IENNHLLLFDLGVESTGYVSDMTRTVAVGQPD Query:  241 QFKIDIYNLCLSAQLAAIDFIK-                              300
            PGVTAAQVDAAARQVIEKAGYGEYFNHRLGHGIGMDVH
            QFK DIYN+CLEAQL A+DFIKPGV+AAQVDAAAR VIEKAGYG+YFNHRLGH-
            GIGM +H
Sbjct:  241 QFKKDIYNICLEAQLTALDFIK-                              300
            PGVSAAQVDAAARSVIEKAGYGDYFNHRLGHGIGMGLH Query:  301 EFPSIMAGNDLVLEEGMCFSVEPGIY-                          359
            IPGKVGVRIEDCGHVTKNGFEVFTHTPKELLYF
            EFPSIMAGND++LEEGMCFSVEPGIYIP KVGVRIEDCGH-
            VTKNGFEVFT TPKELLYF
Sbjct:  301 EFPSIMAGNDMLLEEGMCFSVEPGIYI-                         359
            PEKVGVRIEDCGHVTKNGFEVFTQTPKELLYF
```

An alignment of the GAS and GBS proteins is shown below:

```
Identities = 288/361 (79%), Positives = 325/361 (89%)
Query:    1 MSKLNRIRHHLHSVQAELAVFSDPVTVNYLTGFFCDPHERQMFLFVYEDRDPILFVPALE    60
            M+KL++IR +L    AELA+FSDPVT+NYLTGFFCDPHERQ+FLFVY D  P+LFVPALE
Sbjct:    1 MTKLDQIRLYLDQKGAELAIFSDPVTINYLTGFFCDPHERQLFLFVYHDLAPVLFVPALE    60

Query:   61 VSRAKQSVPFPVFGYIDSENPWQKIASNLPSFSVSKVLAEFDNLNVTKFQGLQTVFDGHF   120
            V+RA Q++ FPVFGY+DSENPW+KI + LP+ +    + AEFD+LNV KF GLQT+F G F
Sbjct:   61 VARASQAISFPVFGYVDSENPWEKIKAVLPNTAAKTIYAEFDHLNVNKFHGLQTIFSGQF   120

Query:  121 ENLTPYIQNMRLIKSRDEIEKMLVAGEFADKAVQVGFDNISLNNTETDIIAQIEFEMKKQ   180
            +NLTPY+Q MRL+KS DEI KM++AG+FADKAVQVGFDNISL+ TETD+IAQIEFEMKKQ
Sbjct:  121 NNLTPYVQGMRLVKSADEINKMMIAGQFADKAVQVGFDNISLDATETDVIAQIEFEMKKQ   180

Query:  181 GINKMSFDTMVLTGNNAANPHGIPGTNKIENNALLLFDLGVETLGYTSDMTRTVAVGKPD   240
            GI+KMSFDTMVLTGNNAANPHGIPGTN IENNALLLFDLGVETLGYTSDMTRTVAVG+PD
Sbjct:  181 GIHKMSFDTMVLTGNNAANPHGIPGTNNIENNALLLFDLGVETLGYTSDMTRTVAVGQPD   240

Query:  241 QFKKDIYHLCLEAHQAAIDFIKPGVLASEVDAAARNVIEKAGYGQYFNHRLGHGLGMDVH   300
            QFK DIY+LCLEA  AAIDFIKPGV A++VDAAAR VIEKAGYG+YFNHRLGHG+GMDVH
Sbjct:  241 QFKIDIYNLCLEAQLAAIDFIKPGVTAAQVDAAARQVIEKAGYGEYFNHRLGHGIGMDVH   300

Query:  301 EFPSIMAGNDMEIQEGMCFSVEPGIYIPDKVGVRIEDCGYVTKTGFEVFTKTPKELLYFEG 361
            EFPSIMAGND+ ++EGMCFSVEPGIYIP KVGVRIEDCG+VTK GFEVFT TPKELLYFEG
Sbjct:  301 EFPSIMAGNDLVLEEGMCFSVEPGIYIPGKVGVRIEDCGHVTKNGFEVFTHTPKELLYFEG 361
```

Based on this analysis, it was predicted that these proteins and their epitopes could be useful antigens for vaccines or diagnostics.

EXAMPLE 377

A DNA sequence (GBSx0408) was identified in *S. agalactiae* <SEQ ID 1233> which encodes the amino acid sequence <SEQ ID 1234>. Analysis of this protein sequence reveals the following:

```
Possible site: 14
>>> Seems to have no N-terminal signal sequence

----- Final Results -----
            bacterial cytoplasm --- Certainty = 0.3629(Affirmative) < succ>
            bacterial membrane  --- Certainty = 0.0000(Not Clear)  < succ>
             bacterial outside  --- Certainty = 0.0000(Not Clear)  < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 378

A DNA sequence (GBSx0409) was identified in *S. agalactiae* <SEQ ID 1235> which encodes the amino acid sequence <SEQ ID 1236>. This protein is predicted to be beta-hexosamidase A precursor. Analysis of this protein sequence reveals the following:

```
Possible site: 47
>>> Seems to have no N-terminal signal sequence

----- Final Results -----
            bacterial cytoplasm --- Certainty = 0.3279(Affirmative) < succ>
            bacterial membrane  --- Certainty = 0.0000(Not Clear)   < succ>
             bacterial outside  --- Certainty = 0.0000(Not Clear)   < succ>
```

The protein has homology with the following sequences in the GENPEPT database:

```
>GP:CAB11942 GB:Z99104 alternate gene name: yzbA~similar to
beta-hexosaminidase [Bacillus subtilis]
Identities = 151/602 (25%), Positives = 268/602 (44%),
Gaps = 69/602 (11%)
Query:  26 INEMTLDEKIGQLF------FNMGASRSEEYLTDVLDRYHIAAVRYNRGSSSEIYDQNL-   78
           +N M+LDEK+GQ+        S + LT + D        +Y G   ++ +N+
Sbjct:  39 VNRMSLDEKLGQMLMPDFRNWQKEGESSPQALTKMNDEVASLVKKYQFGGII-LFAENVK   97

Query:  79 -----------ILQTKSKLPMLIAANTEAGGDGAVTDGTKVGDEIKVAATNDPKYAYEMG  127
                       +    K+P++++ + E G    + +GT    + + A     AY+  G
Sbjct:  98 TTKQTVQLTDDYQKASPKIPLMLSIDQEGGIVTRLGEGTNFPGNMALGAARSINAYQTG  157

Query: 128 RIAGMEASAVGCNASFSPIVDLTRNWRNPIIASRNWGANVDQIISLSKEYMKGIMQYNIV  187
              I G E SA+G N  FSP+VD+  N   NP+I R++ +N +    L    MKG+ + +I
Sbjct: 158 SIIGKELSALGINTDFSPVVDINNNPDNPVIGVRSFSSNRELTSRLGLYTMKGLQRQDIA  217

Query: 188 PFAKHFPGDGIDERDHHLSFASNPMSKEEWMSTFGRIYGELADAGLPGVMAGHIHLPNVE  247
              KHFPG G  + D H      +E        + +   DAG     VM  H+   P  +
Sbjct: 218 SALKHFPGHGDTDVDSHYGLPLVSHGQERLREVELYPFQKAIDAGADMVMTAHVQFPAFD  277

Query: 248 KEMHPER--DLDDMLPASLNKTLLDELLRGELGYNGAIVTDASHMVGMTASMARRDLLPT  305
            + +    D ++PA+L+K ++   LLR E+G+NG IVTDA +M +     + + +
Sbjct: 278 DTTYKSKLDGSDILVPATLSKKVMTGLLRQEMGFNGVIVTDALNMKAIADHFGQEEAVVM  337

Query: 306 AIEAGCDLFLF---FNDPDED------IQWMKEGYEKGILTEERLHDALRRTLGLKAKLG  356
           A++AG D+ L         E+        IQ+ KE    + G+ E+++++++ R + LK K G
Sbjct: 338 AVKAGVDIALMPASVTSLKEEQKFARVIQALKEAVKNGDIPEQQINNSVERIISLKIKRG  397

Query: 357 LHNYEGRRQELFMPK-DKAMALINTLESQKIADEVADKAVTLVKDKQKDIFPVNPERYRH  415
             + Y R +    K KA ++ + + K   ++A+KAVT++K++Q + P  P++
Sbjct: 398 M--YPARNSDSTKEKIAKAKKIVGSKQHLKAEKKLAEKAVTVLKNEQHTL-PFKPKKGSR  454

Query: 416 ILLVNVSGYKGGFGAMIAGNKQRASDYMKE------LLEARGHEVTVWESTEERIMKLPQ  469
           IL+V       A +Q  D +K    L     V+++ E+ +K
Sbjct: 455 ILIV------APYEEQTASIEQTIHDLIKRKKIKPVSLSKMNFASQVFKTEHEKQVK---  505

Query: 470 EERAAAIANVYAQK-QPIANLTEHYDLIINLVDVNAGGTTQRIIWPAAKGTPDQPFYVHE  528
             E   I  Y K P+ N    D +I+ D + ++P A    H
Sbjct: 506 -EADYIITGSYVVKNDPVVN-----DGVID--DTISDSSKWATVFPRA---VMKAALQHN  554

Query: 529 IPSIVISVQHAFALADMPQVGTYINAYD--------GLPSTISAVVAKLAGESEFTGVSP  580
            P +++S+++ + A+ +     I Y           L   I A V  + G+++   G  P
Sbjct: 555 KPFVLMSLRNPYDAANFEEAKALIAVYGFKGYANGRYLQPNIPAGVMAIFGQAKPKGTLP  614

Query: 581 VD                                                            582
           VD
Sbjct: 615 VD                                                            616
```

No corresponding DNA sequence was identified in *S. pyogenes*.

A related GBS gene <SEQ ID 8565> and protein <SEQ ID 8566> were also identified. Analysis of this protein sequence reveals the following homology to a lipoprotein, with homology with the following sequences in the databases:

```
29.5/52.3% over 422aa
Bacillus subtilis
EGAD|20114| hypothetical 70.6 kd protein in feua 5'region precursor Insert
characterized
SP|P40406|YBBD_BACSU HYPOTHETICAL 70.6 KDA LIPOPROTEIN IN FEUA-SIGW INTERGENIC
REGION PRECURSOR (ORF1). Insert characterized
GP|1944006|dbj|BAA19499.1||AB002150 YbbD Insert characterized
GP|438455|gb|AAA64351.1||L19954 possible N-terminal signal sequence; mature
protein may be membrane-anchored and start at Cys-17. 17.5% identity
over 354-aa overlap with Candida pelliculosa beta-glucosidase.; putative Insert
characterized
GP|2632433|emb Insert characterized ORF00431(361-1557 of 2388)
EGAD|20114|BS0166(36-458 of 642) hypothetical 70.6 kd protein in feua 5'region
precursor {Bacillus subtilis} SP|P40406|YBBD_BACSU HYPOTHETICAL 70.6 KDA LIPOPROTEIN
IN FEUA-SIGW INTERGENIC REGION PRECURSOR (ORF1). GP|1944006|dbj|BAA19499.1||AB002150
YbbD {Bacillus subtilis} GP|438455|gb|AAA64351.1||L19954 possible N-terminal signal
sequence; mature protein may be membrane-anchored and start at Cys-17. 17.5%
identity over 354-aa overlap with Candida pelliculosa beta-glocosidase.; putative
{Bacillus subtilis} GP|2632433|emb
% Match = 9.6
% Identity = 29.5   % Similarity = 52.2
Matches = 119   Mismatches = 183   Conservative Sub.s = 92
          114          144          174          204          234          264          294          324
          LMVGDSLGDLAAAEQNGIAFYPVLVGKEVKSWEILREDIGEAFAKGQFEQQRQKESINTFWANLDN**KG*AMTHLVDLT MRPVFPLILSAVLFLSCFFGA
                                                                                10          20

354          384          414          426          456          486          528
          KKPFNLNQEAIEWIEKTINEMTLDEKIGQLFF------NMGASRSEEYLTDVLDRYHIAAVRYNRGS------SSEIYDQ
          :            :            : :|  |:|||:||::            |: || :            :|  |           :  :        |
          RQTEASASKRAIDANQIVNRMSLDEKLGQMLMPDFRNWQKEGESSPQALTKMNDEVASLVKKYQFGGIILFAENVKTTKQ
                       40           50           60           70           80           90          100

543          573          603          633          663          693          723          753
          NLIL-----QTKSKLPMLIAANTEAGGDGAVTDGTKVGDEIKVAATNDPKYAYEMGRIAGMEASAVGCNASFSPIVDLTR
          :  |        :     |:|::::  :  | |        :  ||        :  :  |         ||:  | | | |   ||:|  |    |||:||:
          TVQLTDDYQKASPKIPLMLSIDQEGGIVTRLGEGTNFPGNMALGAARSRINAYQTGSIIGKELSALGINTDFSPVVDINN
                     120          130          140          150          160          170          180

783          813          843          873          903          933          963          993
          NWRNPIIASRNWGANVDQIISLSKEYMKGIMQYNIVPPFAKHFPGDGIDERDHHLSFASNPMSKEEWMSTFGRIYGELADA
          |    ||:|    |:: :|  :          |    |||:  : :|    |||||    :  |  :                :|                :  :  ||
          NPDNPVIGVRSFSSNRELTSRLGLYTMKGLQRQDIASALKHFPGHGDTDVDSHYGLPLVSHGQERLREVELYPFQKAIDA
                     200          210          220          230          240          250          260

1023         1053         1080         1107         1137         1167         1197         1227
          GLPGVMAGHIHLPNVEKEMHPER-DLDDML-PASLNKTLLDELLRGELGYNGAIVTDASHMVGMTASMARRDLLPTAIEA
          |    ||   |:::|     :           :      |     |:|  ||:|:  ::      |||  |:|||  ||||||   :|               :      :  :  |::|
          GADMVMTAHVQFPAFDDTTYKSKLDGSDILVPATLSKKVMTGLLRQEMGFNGVIVTDALNMKAIADHFGQEEAVVMAVKA
                       280          290          300          310          320          330          340

1290         1320         1350         1380         1410         1437
          GCDLFLF------FNDPDE---DIQWMKEGYEKGILTEERLHDALRRTLGLKAKLGLHNYEGRRQELFMPK-DKAMALIN
          |  |:  |                :  :       ||  :||      :  |    :  |:::::::  |   :  ||  ||    |              :           ||      ::
          GVDIALMPASVTSLKEEQKFARVIQALKEAVKNGDIPEQQINNSVERIISLKIKRGM--YPARNSDSTKEKIAKAKKIVG
                       360          370          380          390          400          410

1467         1497         1527         1557         1587         1617         1647         1677
          TLESQKIADEVADKAVTLVKDKQKDIFPVNPERYRHILLVNVEGYKGGFGAMIAGNKQRASDYMKELLEARGHEVTVEWS
          :   :           |    ::|:|||||::|::|               :|              ||:                         |                              |                          |::|
          SKQHLKAEKKLAEKAVTVLKNEQ-HTLPFKPKKGSRILIVAPYEEQTASIEQTIHDLIKRKKIKPVSLSKMNFASQVFKT
                    430          440          450          460          470          480          490
```

SEQ ID 1236 (GBS50) was expressed in *E. coli* as a His-fusion product. SDS-PAGE analysis of total cell extract is shown in FIG. 11 (lane 8; MW 69.2 kDa).

GBS50-His was purified as shown in FIG. 192, lane 5.

Figure 264:
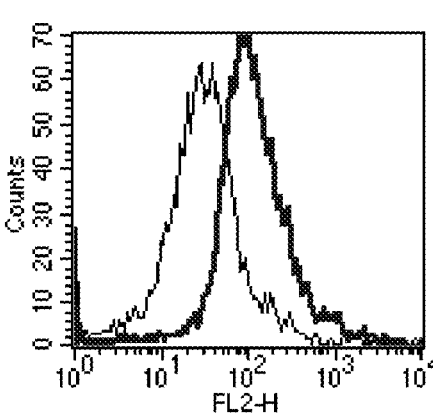

The GBS50-His fusion product was purified (FIG. 192, lane 5) and used to immunise mice. The resulting antiserum was used for FACS (FIG. 264), which confirmed that the protein is immunoaccessible on GBS bacteria.

Based on this analysis, it was predicted that these proteins and their epitopes could be useful antigens for vaccines or diagnostics.

EXAMPLE 379

A DNA sequence (GBSx0410) was identified in *S. agalactiae* <SEQ ID 1237> which encodes the amino acid sequence <SEQ ID 1238>. Analysis of this protein sequence reveals the following:

```
Possible site: 20
>>> Seems to have no N-terminal signal sequence

----- Final Results -----
          bacterial cytoplasm --- Certainty = 0.2266(Affirmative) < succ>
           bacterial membrane --- Certainty = 0.0000(Not Clear)   < succ>
            bacterial outside --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 380

A DNA sequence (GBSx0411) was identified in *S. agalactiae* <SEQ ID 1239> which encodes the amino acid sequence <SEQ ID 1240>. Analysis of this protein sequence reveals the following:

```
Possible site: 49
>>> Seems to have no N-terminal signal sequence

----- Final Results -----
          bacterial cytoplasm --- Certainty = 0.2279(Affirmative) < succ>
           bacterial membrane --- Certainty = 0.0000(Not Clear)   < succ>
            bacterial outside --- Certainty = 0.0000(Not Clear)   < succ>
```

A related GBS nucleic acid sequence <SEQ ID 9705> which encodes amino acid sequence <SEQ ID 9706> was also identified.

The protein has homology with the following sequences in the GENPEPT database:

```
>GP:AAC21726 GB:U32690 oxidoreductase [Haemophilus influenzae Rd]
Identities = 197/271 (72%), Positives = 229/271 (83%)
Query:  26 NKVVVITGAGGVLCGYMAKEFAKAGAKVALLDLNQEAAQTFADEIVEEGGIAKAYKANVL    85
            NK+++ITGAGGVLC ++AK+ A A +ALLDLN EAA A EI + GG AKAYK NVL
Sbjct:  15 NKLIIITGAGGVLCSFLAKQLAYTKANIALLDLNFEAADKVAKEINQSGGKAKAYKTNVL    74

Query:  86 SKENLEEVHQAVLEDLGPTDILVNGAGGNNPKATTDNEFHELDLPSETKTFFELDEAGIS   145
            EN++EV + D G DIL+NGAGGNNPKATTDNEFH+ DL T+TFF+LD++GI
Sbjct:  75 ELENIKEVRNQIETDFGTCDILINGAGGNNPKATTDNEFHQFDLNETTRTFFDLDKSGIE   134

Query: 146 FVFNLNYLGTLLPTQVFAQDMVGREGANIINISSMNAFTPLTKIPAYSGAKAAISNFTQW   205
            FVFNLNYLG+LLPTQVFA+DM+G++GANI INISSMNAFTPLTKIPAYSGAKAAISNFTQW
Sbjct: 135 FVFNLNYLGSLLPTQVFAKDMLGKQGANIINISSMNAFTPLTKIPAYSGAKAAISNFTQW   194

Query: 206 LAVHFSKVGIRCNAIAFGFLVTNQRSLLFTEDGQPTARAEKILNNTPMGRFGEASELIG    265
            LAV+FSKVGIRCNAIAPGFLV+NQN +LLF +G+PT RA KIL NTPMGRFGE+ EL+G
Sbjct: 195 LAVYFSKVGIRCNAIAPGFLVSNQNLALLFDTEGKPTDRANKILTNTPMGRFGESEELLG   254

Query: 266 GLFFLADEKSSSFVNGVVLPIDGGFAAYSGV                              296
            L FL DE S+FVNGVVLP+DGGF+AYSGV
Sbjct: 255 ALLFLIDENYSAFVNGVVLPVDGGFSAYSGV                              285
```

A related DNA sequence was identified in *S. pyogenes* <SEQ ID 1241> which encodes the amino acid sequence <SEQ ID 1242>. Analysis of this protein sequence reveals the following:

```
Possible site: 32
>>> Seems to have no N-terminal signal sequence

----- Final Results -----
          bacterial cytoplasm --- Certainty = 0.0358(Affirmative) < succ>
```

-continued

```
       bacterial membrane --- Certainty = 0.0000(Not Clear) < succ>
       bacterial outside  --- Certainty = 0.0000(Not Clear) < succ>
```

An alignment of the GAS and GBS proteins is shown below:

```
Identities = 77/279 (27%), Positives = 125/279 (44%), Gaps = 19/279 (6%)
Query:   18 MSKTITFTNKVVVITGAGGVLCGYMAKEFAKAGARVALLDLNQEAAQTFADEIVEEGGIA    77
            M    +   K+ +ITGA   +    +AK +A+AGA  +    D+ QE         E G  A
Sbjct:    1 MENMFSLQGKIALITGASYGIGFEIAKAYAQAGATIVFNDIKQELVDKGLAAYRELGIEA    60

Query:   78 KAYKANVLSKENLEEVHQAVLEDLGPTDILVNGAGGNNPKATTDNEFHELDLPSETKTFF   137
            Y  +V  +   ++++    + +++G  DILVN AG
Sbjct:   61 HGYVCDVTDEAGIQQMVSQIEDEVGAIDILVNNAG----------------IIRRTPML   103

Query:  138 ELDEAGISFVFNLNYLGTLLPTQVFAQDMVGREGANIINISSMNAFTPLTKIPAYSGAKA   197
            E+          V +++    + ++      M+ +     IINI SM +      + AY+ AK
Sbjct:  104 EMAAEDFRQVIDIDLMAPFIVSKAVLPSMIAKGHGKIINICSMMSELGRETVSAYAAAKG   163

Query:  198 AISNFTQWLAVHFSKVGIRCNAIAPGFLVTNQNRSLLFTE-DGQPTARAEKILNNTPMGR   256
               +   T+ +A  F +    I+CN I PG++ T Q    L    + DG       + I+  TP  R
Sbjct:  164 GLKNLTKNIASEFGEANIQCNGIGPGYIATPQTAPLRERQADGSRHPFDQFIIAKTPAAR   223

Query:  257 FGEASELIGGLFFLADEKSSSFVNGVVLPIDGGFAAYSG                        295
            +G    +L G    FLA + +S+FVNG +L +DGG   AY G
Sbjct:  224 WGTTEDLAGPAVFLASD-ASNFVNGHILYVDGGILAYIG                       261
```

Based on this analysis, it was predicted that these proteins and their epitopes could be useful antigens for vaccines or diagnostics.

EXAMPLE 381

A DNA sequence (GBSx0412) was identified in *S. agalactiae* <SEQ ID 1243> which encodes the amino acid sequence <SEQ ID 1244>. This protein is predicted to be D-mannonate dehydrolase (uxuA). Analysis of this protein sequence reveals the following:

```
Possible site: 42
>>> Seems to have no N-terminal signal sequence

----- Final Results -----
         bacterial cytoplasm --- Certainty = 0.3188(Affirmative) < succ>
         bacterial membrane  --- Certainty = 0.0000(Not Clear)   < succ>
         bacterial outside   --- Certainty = 0.0000(Not Clear)   < succ>
```

The protein has homology with the following sequences in the GENPEPT database:

```
>GP:BAB04425 GB:AP001509 D-mannonate dehydrolase [Bacillus halodurans]
 Identities = 202/343 (58%), Positives = 261/343 (75%)
Query:    1 MEMSFRWYGEDDPVTLENIGQIPTMKGIVTAIYDVPVGEVWSRERIQQLKEKVEAAGLKI    60
            M ++ RW+G  D V LE I QIP MKGIV+AIYDV VG VW +E+I   LK   +E  GL +
Sbjct:    1 MRLTMRWFGPSDKVKLEYIKQIPGMKGIVSAIYDVAVGGVWPKEKILALKNNIERHGLTL    60

Query:   61 SVIESVPVHEDIKLGRPTRDLLIDNYIQTVKNLAAEGIDTICYNFMPVFDWTRTDLAYQY   120
            +VIESVPVHEDIKLG+PTRD  I+NY QT+++LA   GIDT+CYNFMPVFDWTR+ L ++
Sbjct:   61 DVIESVPVHEDIKLGKPTRDRYIENYKQTLRHLAECGIDTVCYNFMPVFDWTRSQLDFKL   120

Query:  121 PDGSTALIFDETVSKKMDPVNGELSLPGWDASYSKEEMKAIMDAYAEIDEEKLWENLTYF   180
            +DGS ALI++E V  + +P++GEL LPGWD SY  E +K ++ AY +I EE LW++LTYF
Sbjct:  121 EDGSEALIYEEDVISRTNPLSGELELPGWDTSYENESLKGVLQAYKKISEEDLWDHLTYF   180

Query:  181 IKRIIPEAEAVGVKMAIHPDDPPYSIFGLPRIITGLEAIERFVKLYDSKSNGITLCVGSY   240
            ++  I+P A+  VG+KMAIHPDDPP+SIFGLPRI+T    +ER +   LYDS ++GIT+C  GS
Sbjct:  181 VQAIMPVADEVGIKMAIHPDDPPWSIEGLPRIVTNKANLERLLSLYDSPNHGITMCSGSL   240

Query:  241 ASDPQNDVLEISRRAFELDRVNFVHARNIKLGDGKSFKESAHPSEYGSIDMYEVIKLCHE   300
               ++    ND+ E+ R       R++F HARNIK      +SF+ESAH SE GS++M  ++K  H+
Sbjct:  241 GANEANDLPEMIRHFGGQGRIHFAHARNIKRTGPRSFQESAHLSEAGSVNMVAMLKAYHD   300

Query:  301 FGFEGAIRPDHGRMIWGETGRPGYGLYDRALGATYVSGLYEAV                   343
```

```
                 GF G +RPDHGRMIWGE GRPGYGLYDRALGATY++G++EAV
Sbjct:  301 IGFTGPLRPDHGRMIWGEKGRPGYGLYDRALGATYLNGIWEAV                  343
```

No corresponding DNA sequence was identified in *S. pyogenes*.

Based on this analysis, it was predicted that this protein and its epitopes, could be useful antigens for vaccines or diagnostics.

EXAMPLE 382

A DNA sequence (GBSx0413) was identified in *S. agalactiae* <SEQ ID 1245> which encodes the amino acid sequence <SEQ ID 1246>. Analysis of this protein sequence reveals the following:

```
Possible site: 14
>>> Seems to have no N-terminal signal sequence

----- Final Results -----
           bacterial cytoplasm --- Certainty = 0.2447(Affirmative) < succ>
           bacterial membrane  --- Certainty = 0.0000(Not Clear)   < succ>
            bacterial outside  --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 383

A DNA sequence (GBSx0414) was identified in *S. agalactiae* <SEQ ID 1247> which encodes the amino acid sequence <SEQ ID 1248>. This protein is predicted to be uronate isomerase. Analysis of this protein sequence reveals the following:

```
Possible site: 14
>>> Seems to have no N-terminal signal sequence

----- Final Results -----
           bacterial cytoplasm --- Certainty = 0.3066(Affirmative) < succ>
           bacterial membrane  --- Certainty = 0.0000(Not Clear)   < succ>
            bacterial outside  --- Certainty = 0.0000(Not Clear)   < succ>
```

The protein has homology with the following sequences in the GENPEPT database:

```
>GP:BAB04424 GB:AP001509 uronate isomerase [Bacillus halodurans]
 Identities = 215/465 (46%), Positives = 294/465 (62%), Gaps = 7/465 (1%)
Query:    3 FNTETFMLKNQAAIQLYEE-VKRQPIFDYHCHLDPKDIFEDHIFDNIVDLWLGGDHYKWR    61
            F +E F+L N+    +LY    K  PI DYHCHL P++I+E+  F+N+    WLGGDHYKWR
Sbjct:    4 FLSEDFLLMNEYDRELYYTFAKNMPICDYHCHLSPQEIWENKPFENMTKAWLGGDHYKWR    63

Query:   62 LMRANGISEAEITGPASNLEKFKAFARTLERAYGNPVYHWSAMELKNVFGVNEILTESNA   121
               MR NG+ E  ITG A +  KF A+A+T+ +    GNP+YHW+ MELK   F ++  L E+N
Sbjct:   64 AMRLNGVREEFITGGAPDKEKFLAWAKTVPKTIGNPLYHWTHMELKTYFHFHQPLDETNG   123

Query:  122 EEIYHRLNHFLKEHKISPRRLIADSKVMFIGTTDHPLDTLEWHKKLAADESFKTVVAPTF   181
            E ++    N L++   +PR LI  S V   IGTTD P D+L +H+KL AD++F    V PTF
Sbjct:  124 ENVWDACNRLLQQEAFTPRALIERSNVRAIGTTDDPTDSLLYHQKLQADDTFHVKVIPTF   183

Query:  182 RPDEAF-IEHRHFVDFITKLGDITQKEITDFSTFIAAMEERIAYFAQNGCRASDISFTEI   240
            RPD A  IE   F D++ KL D+T + +    F+ A++ER+ +F ++GCR+SD   TE+
Sbjct:  184 RPDGALKIEQDSFADWVAKLSDVTGESLDTLDAFLHALKERLTFFDEHGCRSSDHDMTEV   243
```

```
                            -continued
Query:  241 VFEQTDELELNDLFNKVCEGYIPNQSEISKWQTAVFMELCRLYKKYGFVTQVHFGALRNN  300
             F + +E E   +F K     + E  K++T +    L + Y    G+V Q H G +RNN
Sbjct:  244 PFVEVNEQEAQHIFRKRLANEGLTKVENEKYKTFLMTWLGKEYAARGWVMQWHIGVMRNN  303

Query:  301 HSTIFEKLGADVGVDSLGD-QVALTVNMNRLLDSLVKKDSLPKMIWYNLNPAYNIAVANT  359
            +S +   KLG D  DS+GD Q+A      +LLD L K+ +LPK I Y +NP  N  A+
Sbjct:  304 NSRMLHKLGPDTGFDSIGDGQIAHAT--AKLLDLLDKQGALPKTILYCVNPNANYILASM  361

Query:  360 LANFQANELGVRSYLQFGAGWWFADTKLGMISQMNALAEQGMLANFIGMLTDSRSFLSYQ  419
             + NF   E GVR +QFG+ WWF D   GM Q+   LA  G+L+NFIGMLTDSRSFLSY
Sbjct:  362 IGNF-TESGVRGKVQFGSAWWFNDHIDGMRRQLTDLASVGLLSNFIGMLTDSRSFLSYP  419

Query:  420 RHDYFRRILCTYLGEWIEEGEVPEDYQALGSMAKDIAYQNAVNYF                464
            RHDYFRRILC  +G  WI+EG++P D +   G + +DI Y N V+YF
Sbjct:  420 RHDYFRRILCQLIGSWIKEGQLPPDMERWGQIVQDICYNNVVDYF                464
```

No corresponding DNA sequence was identified in *S. pyogenes*.

Based on this analysis, it was predicted that this protein and its epitopes, could be useful antigens for vaccines or diagnostics.

EXAMPLE 384

A DNA sequence (GBSx0415) was identified in *S. agalactiae* <SEQ ID 1249> which encodes the amino acid sequence <SEQ ID 1250>. This protein is predicted to be 2-dehydro-3-deoxyphosphogluconate aldolase/4-hydroxy-2-oxoglutarate al. Analysis of this protein sequence reveals the following:

```
Possible site: 43
>>> Seems to have no N-terminal signal sequence

----- Final Results -----
            bacterial cytoplasm --- Certainty = 0.3883(Affirmative) < succ>
            bacterial membrane  --- Certainty = 0.0000(Not Clear)   < succ>
            bacterial outside   --- Certainty = 0.0000(Not Clear)   < succ>
```

A related GBS nucleic acid sequence <SEQ ID 9703> which encodes amino acid sequence <SEQ ID 9704> was also identified.

The protein has homology with the following sequences in the GENPEPT database:

```
>GP:AAD35160 GB:AE001693 2-dehydro-3-deoxyphosphogluconate
aldolase/4-hydroxy-2-oxoglutarate aldolase [Thermotoga maritima]
Identities = 93/199 (46%), Positives = 125/199 (62%), Gaps = 6/199 (3%)
Query:   37 KNNYFFAVIRGKSSEDALEIAKHAILGGIRNIEVTFSTPEASKVIKQLSDDFKNNKEIIV   96
            K +    AV+R  S E+A E A    GG+  IE+TF+ P+A  VIK+LS  F   K I+
Sbjct:    8 KKHKIVAVLRANSVEEAKEKALAVFEGGVHLIEITFTVPDADTVIKELS--FLKEKGAII   65

Query:   97 GAGTVMTTELAKEAIDAGAKFLVSPHFDSDIANLANENKVYYFPGCATATEIVVARKYKC  156
            GAGTV + E   ++A+++GA+F+VSPH D +I+    E  V+Y PG  T  TE+V A K
Sbjct:   66 GAGTVTSVEQCRKAVESGAEFIVSPHLDEEISQFCKEKGVFYMPGVMTPTELVKAMKLGH  125

Query:  157 QIIKLFPGGVVGPGFIKDIHGPIPDVDLMPSGGVSVSNVVEWRKAGAVAVGVGSALSSKV  216
             I+KLFPG VVGP +K + GP P+V  +P+GGV++  NV EW KAG +AVGVGSAL
Sbjct:  126 TILKLFPGEVVGPQFVKAMKGPFPNVKFVPTGGVNLDNVCEWFKAGVLAVGVGSALVKGT  185

Query:  217 ATEGYDSVTKIAKQFVSAL                                           235
              D V + AK FV +
Sbjct:  186 P----DEVREKAKAFVEKI                                           200
```

A related DNA sequence was identified in *S. pyogenes* <SEQ ID 1251> which encodes the amino acid sequence <SEQ ID 1252>. Analysis of this protein sequence reveals the following:

Possible site: 29
>>> Seems to have no N-terminal signal sequence

----- Final Results -----
                bacterial cytoplasm --- Certainty = 0.1039(Affirmative) < succ>
                 bacterial membrane --- Certainty = 0.0000(Not Clear)   < succ>
                   bacterial outside --- Certainty = 0.0000(Not Clear)   < succ>

An alignment of the GAS and GBS proteins is shown below:

```
Identities = 82/204 (40%), Positives = 132/204 (64%)
Query:   32 MLNQLKNNYFFAVIRGKSSEDALEIAKHAILGGIRNIEVTFSTPEASKVIKQLSDDFKNN   91
            +L +LK N    V+RG+SSE+AL  +  +I GGI+ IEVT++ P AS+VI QL++ FK +
Sbjct:    6 ILTKLKANRLVLVVRGESSEEALACSLASIEGGIKTIEVTYTNPFASEVIGQLAERFKED   65

Query:   92 KEIIVGAGTVMTTELAKEAIDAGAKFLVSPHFDSDIANLANENKVYYFPGCATATEIVVA   151
              E+++GAGTV+    A++AI AGA+F+V P+F+  +A + +    + Y PGC T  E+V A
Sbjct:   66 PEVLIGAGTVLDDVTARQAILAGAQFIVGPNFNRAVALICHRYSIPYLPGCMTVNEVVTA   125

Query:  152 RKYKCQIIKLFPGGVVGPGFIKDIHGPIPDVDLMPSGGVSVSNVVEWRKAGAVAVGVGSA   211
              +    ++K+FPG  VG  FI+ I  P+P V++M +GGVS  N+ +W   AG    +G+G
Sbjct:  126 LESGVDMVKIFPGSTVGISFIRAIKSPLPQVEVMVTGGVSSDNLKDWLAAGVDVLGIGGE   185

Query:  212 LSSKVATEGYDSVTKIAKQFVSAL                                     235
              +    + + Y+ +TK A  ++ +L
Sbjct:  186 FNQLASQKQYNLITKKAAHYIKSL                                     209
```

Based on this analysis, it was predicted that these proteins and their epitopes could be useful antigens for vaccines or diagnostics.

EXAMPLE 385

A DNA sequence (GBSx0416) was identified in *S. agalactiae* <SEQ ID 1253> which encodes the amino acid sequence <SEQ ID 1254>. This protein is predicted to be pyruvate dehydrogenase complex repressor. Analysis of this protein sequence reveals the following:

Possible site: 26
>>> Seems to have no N-terminal signal sequence

----- Final Results -----
                bacterial cytoplasm --- Certainty = 0.2827(Affirmative) < succ>
                 bacterial membrane --- Certainty = 0.0000(Not Clear)   < succ>
                   bacterial outside --- Certainty = 0.0000(Not Clear)   < succ>

The protein has homology with the following sequences in the GENPEPT database:

```
>GP:CAB12044 GB:Z99105 similar to transcriptional regulator (GntR
          family) [Bacillus subtilis]
 Identities = 67/225 (29%), Positives = 119/225 (52%), Gaps = 17/225 (7%)
Query:    3 RPLVEQTADRLLHLILEREYPVGAKLPNEYELAEDLDVGRSTIREAVRSLATRNILEVRQ    62
            + L +Q  +R++HL+  +   G KLP E EL + L V R  +REA+ SL T  ++   +
Sbjct:   16 KTLAKQVIERIVHLLSSGQLRAGDKLPTEMELMDILHVSRPVLREALSSLETLGVITRKT    75

Query:   63 GSGTYISSKKGVSEDPLGFSLIKDTDRLTSDLFELRLLLEPRIAELVAYRITDDQLQLLE   122
               GTY + K G+    P    L  TD L + + ER+ LE  +  + A +I +++LQ L+
Sbjct:   76 RGGTYFNDKIGM--QPFSVMLALATDNLPA-IIEARMALELGLVTIAAEKINEEELQRLQ   132

Query:  123 KLVGDIEDAV--HAGDPKHLLLDVEFHSMLAKYSGNIAMDSLLPVINQSIHLINANYTNR   180
              K + DI ++    H G+      D EFH ++A  + N  ++ ++     QS+ + +A   ++
Sbjct:  133 KTIDDIANSTDNHYGE-----ADKEFHRIIALSANNPVVEGMI----QSLLITHAKIDSQ   183

Query:  181 ---QMKSDSLEAHREIIKAIREKNPVAAHDAMLMHIMSVRRSALK                222
               +  +  ++E H++I  A+ +++P  AH M  H+  VR    LK
Sbjct:  184 IPYRERDVTVEYHKKIYDALAQRDPYKAHYHMYEHLKFVRDKILK                228
```

A related DNA sequence was identified in *S. pyogenes* <SEQ ID 1255> which encodes the amino acid sequence <SEQ ID 1256>. Analysis of this protein sequence reveals the following:

```
Possible site: 54
>>> Seems to have no N-terminal signal sequence

----- Final Results -----
            bacterial cytoplasm --- Certainty = 0.2161(Affirmative) < succ>
            bacterial membrane  --- Certainty = 0.0000(Not Clear)   < succ>
            bacterial outside   --- Certainty = 0.0000(Not Clear)   < succ>
```

An alignment of the GAS and GBS proteins is shown below:

```
Identities = 24/51 (47%), Positives = 35/51 (68%)
Query:  22 YPVGAKLPNEYELAEDLDVGRSTIREAVRSLATRNILEVRQGSGTYISSKK  72
           +P+G++LP+E  LAE   V R T+R+A+  L     ILE R GSGTY++S +
Sbjct:  30 WPIGSRLPSERHLAEHFTVSRMTLRQAITLLVEEGILERRIGSGTYVASHR  80
```

Based on this analysis, it was predicted that these proteins and their epitopes could be useful antigens for vaccines or diagnostics.

EXAMPLE 386

A DNA sequence (GBSx0417) was identified in *S. agalactiae* <SEQ ID 1257> which encodes the amino acid sequence <SEQ ID 1258>. Analysis of this protein sequence reveals the following:

```
Possible site: 31
>>> Seems to have no N-terminal signal sequence

----- Final Results -----
            bacterial cytoplasm --- Certainty = 0.2178(Affirmative) < succ>
            bacterial membrane  --- Certainty = 0.0000(Not Clear)   < succ>
            bacterial outside   --- Certainty = 0.0000(Not Clear)   < succ>
```

A related GBS nucleic acid sequence <SEQ ID 9701> which encodes amino acid sequence <SEQ ID 9702> was also identified.

The protein has homology with the following sequences in the GENPEPT database:

```
>GP:CAA58911 GB:X84105 gluceronidase [synthetic construct]
 Identities = 258/602 (42%), Positives = 357/602 (58%), Gaps = 31/602 (5%)
Query:   23 MLYPLLTKTRNTYDLGGIWNFKLGEHNPN------ELLPSDEVMVIPTSFNDLMVSKEK    75
            ML P+ T TR   L G+W F L  N            L    + +P SFND     +
Sbjct:    1 MLRPVETPTREIKKLDGLWAFSLDRENCGIDQRWWESALQESRAIAVPGSFNDQFADADI   60

Query:   76 RDYIGDFWYEKVIEVPKVSEDEEMVLRFGSVTHQAKIYVDGVLVGEHKGGFTPFEVLVPE  135
            R+Y G+ WY++ +  +PK     + +VLRF +VTH  K++V+    V EH+GG+TPFE  V
Sbjct:   61 RNYAGNVWYQREVFIPKGWAGQRIVLRFDAVTHYGKVWVNNQEVMEHQGGYTPFEADVTP  120

Query:  136 CKYNNEKIKVSICANNVLDYTTLPVGNYSEIIQEDGSIKKKVRENFDFFNYAGVHRPLKL  195
              + +++++C NN L++ T+P G    I  E+G  KKK        DFFNYAG+HR + L
Sbjct:  121 YVIAGKSVRITVCVNNELNWQTIPPGMV--ITDENG--KKKQSYFHDFFNYAGIHRSVML  176

Query:  196 MIRPKNHIFDITITSRLSDDLQSADLHFLVETNQKVDEVRISVFDEDNKLV--GETKDSR  253
                P    + DIT+ +  ++ D    A + V  N    +V   + D D++V   G+
Sbjct:  177 YTTPNTWVDDITVVTHVAQDCNHASVDWQVVAN---GDVSVELRDADQQVVATGQGTSGT  233

Query:  254 LFLSDVHLWEVLNAYLYTARVEIFVDNQLQDVYEENFGLREIEVTNGQFLLNRKPIYFKG  313
            L + + HLW+     YLY  V     + D+Y    G+R + V  QFL+N  KP YF G
Sbjct:  234 LQVVNPHLWQPGEGYLYELCVTAKSQTEC-DIYPLRVGIRSVAVKGEQFLINHKPFYFTG  292

Query:  314 FGKHEDTFINGRGLNEAANLMDLNLLKDMGANSFRTSHYPYSEEMMRLADRMGVLVIDEV  373
            FG+HED  + G+G +    + D L+   +GANS+RTSHYPY+EEM+  AD  G++VIDE
Sbjct:  293 FGRHEDADLRGKGFDNVLMVHDHALMDWIGANSYRTSHYFYAEEMLDWADEHGIVVIDET  352
```

-continued

```
Query:   374 PAVGLFQNFNASLDLS------PKDNGTWNLM--QTKAAHEQAIQELVKRDKNHPSVVMW   425
             AVG    FN SL +       PK+  +   +T+ AH QAI+EL+ RDKNHPSVVMW
Sbjct:   353 AAVG----FNLSLGIGFEAGNKPKELYSEEAVNGETQQAHLQAIKELIARDKNHPSVVMW   408

Query:   426 VVANEPASHEAGAHDYFEPLVKLYKDLDPQKRPVTLVNILMATPDRDQVMDLVDVVCLNR   485
             +ANEP +   GA +YF PL +  + LDP  RP+T VN++     D + DL DV+CLNR
Sbjct:   409 SIANEPDTRPQGAREYFAPLAEATRKLDPT-RPITCVNVMFCDAHTDTISDLFDVLCLNR   467

Query:   486 YYGWYVDHGDLTNAEVGIRKELLEWQDKFPDKPIIITEYGADTLPGLHSTWNIPYTEEFQ   545
             YYGWYV  GDL  AE + + KELL WQ+K  +PIIITEYG DTL GLHS +   ++EE+Q
Sbjct:   468 YYGWYVQSGDLETAEKVLEKELLAWQEKL-HQPIIITEYGVDTLAGLHSMYTDMWSEEYQ   526

Query:   546 CDFYEMSHRVFDGIPNLVGEQVWNFADFETNLMILRVQGNHKGLFSRNRQPKQVVKEFKK   605
             C + +M HRVFD +  +VGEQVWNFADF T+   ILRV GN  KG+F+R+R+PK    +K
Sbjct:   527 CAWLDMYHRVFDRVSAVVGEQVWNFADFATSQGILRVGGNKKGIFTRDRKPKSAAFLLQK   586

Query:   606 RW                                                            607
             RW
Sbjct:   587 RW                                                            588
```

A related DNA sequence was identified in *S. pyogenes* <SEQ ID 1259> which encodes the amino acid sequence <SEQ ID 1260>. Analysis of this protein sequence reveals the following:

```
Possible site: 23

>>> Seems to have no N-terminal signal sequence
    INTEGRAL    Likelihood = -4.04    Transmembrane 1131-1147    (1130-1147)

----- Final Results -----
              bacterial membrane --- Certainty = 0.2614(Affirmative) < succ>
                bacterial outside --- Certainty = 0.0000(Not Clear) < succ>
              bacterial cytoplasm --- Certainty = 0.0000(Not Clear) < succ>
```

The protein has homology with the following sequences in the databases:

```
>GP:AAF97242 GB:AF282987 beta-galactosidase precursor [Streptococcus pneumoniae]
 Identities = 303/921 (32%), Positives = 463/921 (49%), Gaps = 86/921 (9%)
Query:     5 QKSSEIVT----RTITKPSRATSNVKQEIDMTPDSKEQTVTGYQYHYIDQ--EGRKQPFN   58
             +K  E VT     + KP    ++ +       ++       ++Q  E RK   FN
Sbjct:    96 KKEDEAVTPKEEKVSAKPEEKAPRIESQASNQEKPLKEDAKAVTNEEVNQMIEDRKVDFN   155

Query:    59 QGWRF-LMADVACAQDPSFDDSNWQVIHLPHDFSLTQPYTRNGEA--ESAYKLGGVGWYR   115
             Q W F L A+   A  P  D SW+  + LP+D+S+   +    A E    GG  WYR
Sbjct:   156 QNWYFKLNANSKEAIKPDADVSTWKKLDLPYDWSIFNDFDHESPAQNEGGQLNGGEAWYR   215

Query:   116 HYLVLDEVLAGCHVAITFEGSYMETEIYVNGQFIGKHLNGYQEFTYDISDVVTF-GAENL   174
                     LDE     +V +TF+G YM++++YVNGQ +G + NGY +F+YDI+ +    G EN+
Sbjct:   216 KTFKLDEKDLKKNVRLTFDGVYMDSQVYVNGQLVGHYPNGYNQFSYDITKYLQKDGRENV   275

Query:   175 LAVRVENKVPSSRWYSGSGLYREVSLSVLPQLHFVADQVAMTLADTAVQEKGQQKVDLRF   234
             +AV   NK PSSRWYSGSG+YR+V+L V  ++H    +        Q+ G+ +  +
Sbjct:   276 IAVHAVNKQPSSRWYSGSGIYRDVTLQVTDKVHVEKNGTTILTPKLEEQQHGEVETHVTS   335

Query:   235 ALNQSIQTCHYQLSLCLWEQSHCSKDKKLLYQETEVPLADLAFQRQYGLT--LSLEELQL   292
             + +   +    H  ++     E  +           +       L     L  L +E  +L
Sbjct:   336 KIVNTDDKDHELVA----EYQIVERGGHAVTGLVRTASRTLKAHESTSLDAILSVERPKL   391

Query:   293 WSP--DNPHLYDLELTLYYQGQVIDCFCLETGFRQLTFMANQGLFVNGRAVKLKGVCLHH   350
             W+    D P LY+L   +Y GQ++D         G+R+    N+G  +NG  +K  GV LHH
Sbjct:   392 WTVLNDKPALYELITRVYRDGQLVDAKKDLFGYRYYHWTPNEGFSLNGERIKFHGVSLHH   451

Query:   351 DQGGLGACAYEDALARQLVLLKDMGANTIRSTHNPSSPKLRQLANRLGFFVIEEAFDTWT   410
             D G LGA     A   R+L  +K+MG N+IR+THNP+S  + +A   LG  V EEAFDTW
Sbjct:   452 DHGALGAEENYKAEYRRLKQMKEMGVNSIRTTHNPASEQTLQIAAELGLLVQEEAFDTWY   511

Query:   411 YAKNGNVNDFSNYFHQTIGTENANYLQRVRSPETSWAQYSIEAMVWSAKNDPSVLMWSIG   470
                    K    D+  +F +     A    ++          W+ + + MV   KN+P++ MWSIG
Sbjct:   512 GGK--KPYDYGRFFEKDATHPEARKGEK-------WSDFDLRTMVERGKNNPAIFMWSIG   562

Query:   471 NELMEGFSADVSHYPELTRQMCQWITAIDTSRPITFGDNKLKEADFC-WHEEVSQMATLL   529
             NE+  G  +  +H      +++ + I  +D+R +T G +K  +      HE+++
Sbjct:   563 NEI--GEANGDAHSLATVKRLVKVIKDVDKTRYVTMGADKFRFGNGSGGHEKIA------   614
```

-continued

```
Query:  530  SQLDHPQGLIGLNYADGKDYDRLHEEHSDWLLYGSETVSAITSR-AYYKETKKVLDS---  585
              +LD     +G NY++  +Y   L +H  WL+YGSET SA  +R +YY+   +++   S
Sbjct:  615  DELD----AVGFNYSE-DNYKALRAKHPKWLIYGSETSSATRTRGSYYRPERELKHSNGP  669

Query:  586  --GYHLTSYDHAKVDWGAFASQAWYDTITRDFV--AGECVWTGFDYLGEPTPWNKTDSGV  641
                Y  + Y + +V WG  A+ +W  T   RD      AG+ +WTG DY+GEPTPW+   +
Sbjct:  670  ERNYEQSDYGNDRVGWGKTATASW--TFDRDNAGYAGQFIWTGTDYIGEPTPWHNQNQTP  727

Query:  642  VGLWPSPKNAYFGILDTAGFPKDSYYFYQSQW--AQGQTTLHLLPVWQKD-----QLCFD  694
              V      K++YFGI+DTAG PK  +Y YQSQW   + +  +HLLP W +          D
Sbjct:  728  V------KSSYFGIVDTAGIPKHDFYLYQSQWVSVKKKPMVHLLPHWNWENKELASKVAD  781

Query:  695  EQGLVEVVVYSNAASVQLMFEDEQGNLTDYGRKAFHTYSTPTGHTYQLYQGADAAKNPHE  754
              +G + V  YSNA+SV+L       N    G K F+   T  G TYQ   +GA+A
Sbjct:  782  SEGKIPVRAYSNASSVELFL-----NGKSLGLKTFNKKQTSDGRTYQ--EGANA-----N  829

Query:  755  NLYLTWRVPYQKGLLRAVAYDISGKSIPKTSGRSQVRTYGSVAKLSWKAFEAPIDAPW-E  813
              LYL W+V YQ G L A+A D SGK I      R ++ T G  A+      + I A +
Sbjct:  830  ELYLEWKVAYQPGTLEAIARDESGKEI----ARDKITTAGKPAAVRLIKEDHAIAADGKD  885

Query:  814  LLYLDLSLLDSRGELVSHAQDWLQVQVEGPARLLALDNGNPTDHTPYQEP-----LRQAY  868
              L Y+    ++DS+G +V  A + ++ Q+ G  +L+ +DNG      Y+         +R+A+
Sbjct:  886  LTYIYYEIVDSQGNVVPTANNLVRFQLHGQGQLVGVDNGEQASRERYEAQADGSWIRKAF  945

Query:  869  GGKLLAILALTGEAGHIKVTA                                        889
              GK +AI+   T +AG    +TA
Sbjct:  946  NGKGVAIVKSTEQAGKFTLTA                                        966
```

An alignment of the GAS and GBS proteins is shown below:

```
Identities = 98/414 (23%), Positives = 175/414 (41%), Gaps = 64/414 (15%)
Query:   54  LPSDEVMVIPTSFNDLMVSKEKRDYIGDFWYEKVIEVPKVSEDEEMVLRFGSVTHQAKIY  113
              LP D + P+N    S K   +G  WY  + + +V    + + F     + +IY
Sbjct:   86  LPHDFSLTQPYTRNGEAESAYKLGGVG-WYRHYLVLDEVLAGCHVAITFEGSYMETEIY  143

Query:  114  VDGVLVGEHKGGFTPFEVLVPECKYNNEKIKVSICANNVLDYTTLPVGNYSEIIQEDGSI  173
              V+G  +G+H  G+ F   + +       V+  A N+L                  +
Sbjct:  144  VNGQFIGKHLNGYQEFTYDISDV--------VTFGAENLLAVR---------------V  179

Query:  174  KKKVRENFDFFNYAGVHRPLKLMIRPKNHIFDITITSRLSDDL------QSADLHFLVET  227
              + KV +  +++ +G++R + L + P+ H   +   L+D       Q   DL F +
Sbjct:  180  ENKVPSS-RWYSGSGLYREVSLSVLPQLHFVADQVAMTLADTAVQEKGQQKVDLRFALNQ  238

Query:  228  NQKVDEVRISVF-------DEDNKLVGETKDS-------------RLFLSDVNLWEVLNA  267
              + +   ++S+       +D KL+ + +                L L ++ LW    N
Sbjct:  239  SIQTCHYQLSLCLWEQSHCSKDKKLLYQETEVPLADLAFQRQYGLTLSLEELQLWSPDNP  298

Query:  268  YLYTARVEIFVDNQLQDVYEENFGLREIE-VTNGQFLLNRKPIYFKGFGKHEDTFINGRG  326
              +LY  + +++   Q+ D + +    G R++  + N    +N + + KG     H D     G
Sbjct:  299  HLYDLELTLYYQGQVIDCFCLETGFRQLTFMANQGLFVNGRAVKLKGVCLHHDQGGLGAC  358

Query:  327  LNEAANLMDLNLLKDMGANSFRTSHYPYSEEMMRLADRMGVLVIDEVPAVGLFQ---NFN  383
                E A    L  LLKDMGAN+ R++H P S ++  +LA+R+G  VI+E         N N
Sbjct:  359  AYEDALARQLVLLKDMGANTIRSTHNPSSPKLRQLANRLGFFVIEEAFDTWTYAKNGNVN  418

Query:  384  ASLDLSPKDNGTWN---LMQTKAAH----EQAIQELVKRDKNHPSVVMWVVANE         430
                +  + GT N  L + ++       + +I+ +V   KN PSV+MW + NE
Sbjct:  419  DFSNYFHQTIGTENANYLQRVRSPETSWAQYSIEAMVWSAKNDPSVLMWSIGNE         472
```

Based on this analysis, it was predicted that these proteins and their epitopes could be useful antigens for vaccines or diagnostics.

EXAMPLE 387

A DNA sequence (GBSx0418) was identified in *S. agalactiae* <SEQ ID 1261> which encodes the amino acid sequence <SEQ ID 1262>. This protein is predicted to be 2-keto-3-deoxygluconate kinase. Analysis of this protein sequence reveals the following:

```
Possible site: 13
>>> Seems to have no N-terminal signal sequence
   INTEGRAL    Likelihood = -0.53   Transmembrane 197-213 (197-213)
```

-continued

```
----- Final Results -----
           bacterial membrane --- Certainty = 0.1213(Affirmative) < succ>
            bacterial outside --- Certainty = 0.0000(Not Clear) < succ>
          bacterial cytoplasm --- Certainty = 0.0000(Not Clear) < succ>
```

A related GBS nucleic acid sequence <SEQ ID 9699> which encodes amino acid sequence <SEQ ID 9700> was also identified.

The protein has homology with the following sequences in the GENPEPT database:

```
>GP:AAD35161 GB:AE001693 2-keto-3-deoxygluconate kinase [Thermotoga maritima]
 Identities = 115/342 (33%), Positives = 180/342 (52%), Gaps = 16/342 (4%)
Query:    14 KIISLGEVLLRLSPPQYHTLMQANHLKCQFGGSELNVLASLAQLGYHVGLVSALPDNDLG    73
             K+++ GE++LRLSPP +  + Q +       +GG+E NV A LAQ+G     V+ LP+N LG
Sbjct:     2 KVVTFGEIMLRLSPPDHKRIFQTDSFDVTYGGAEANVAAFLAQMGLDAYFVTKLPNNPLG    61

Query:    74 KMASQFILSQQISPAAIIKKEGRLGIYYYEQGFSVRTNKVIYDRNYSSFWESTLSDYDFT   133
              A+  +  +    I +   R+GIY+ E G S R +KV+YDR +S+   E+    D+D+
Sbjct:    62 DAAAGHLRKFGVKTDYIARGGNRIGIYFLEIGASQRPSKVVYDRAHSAISEAKREDFDWE   121

Query:   134 SIFKGVDWFHVSGITPALTKDLYEVTRFLMTKAKEGGVKVSIDLNFRESLWSSFQEAREQ   193
              I G  WFH SGITP L K+L +     +  A E GV VS DLN+R   LW+   +EA++
Sbjct:   122 KILDGARWFHFSGITPPLGKELPLILEDALKVANEKGVTVSCDLNYRARLWTK-EEAQKV   180

Query:   194 LSPLLGLLDVCFGLEPIYLAGESEDLKDELGLSRPYLDI-------ELLEKITQKIVQEY   246
             + P +  +DV          L    ED++  LG+S   LD+           E   KI +++ ++Y
Sbjct:   181 MIPFMEYVDV--------LIANEEDIEKVLGISVEGLDLKTGKLNREAYAKIAEEVTRKY   232

Query:   247 GLDYIAFTQREMEYTNQYMLKSYLYHNNMLYQTDKTGVEVLDRVGTGDAFAAGLIHALLE   306
              +  T RE             ++ N   + +++     + ++DRVG GD+FA  LI+  L
Sbjct:   233 NFKTVGITLRESISATVNYWSVMVFENGQPHFSNRYEIHIVDRVGAGDSFAGALIYGSLM   292

Query:   307 KETPQRALEIAMATFKYKHTIQGDINIMTRDDIAYLIEKETN                    348
              Q+   E A A      KHTI GD +++ ++I   L       T+
Sbjct:   293 GFDSQKKAEFAAAASCLKHTIPGDFVVLSIEEIEKLASGATS                    334
```

A related DNA sequence was identified in *S. pyogenes* <SEQ ID 1263> which encodes the amino acid sequence <SEQ ID 1264>. Analysis of this protein sequence reveals the following:

```
Possible site: 38
>>> Seems to have no N-terminal signal sequence

----- Final Results -----
          bacterial cytoplasm --- Certainty = 0.0708(Affirmative) < succ>
           bacterial membrane --- Certainty = 0.0000(Not Clear) < succ>
            bacterial outside --- Certainty = 0.0000(Not Clear) < succ>
```

An alignment of the GAS and GBS proteins is shown below:

```
 Identities = 111/319 (34%), Positives = 168/319 (51%), Gaps = 7/319 (2%)
Query:    12 MAKIISLGEVLLRLSPPQYHTLMQANHLKCQFGGSELNVLASLAQLGYHVGLVSALPDND    71
             M+K++ +GE L+R+SP Q+   L  A   +  FGGSE+N+  +L    G      L +ALPDN
Sbjct:    14 MSKLLLVGEPLIRVSPNQFQPLTNACEAQLFFGGSEVNIARTLGGFGLEARLFTALPDNP    73

Query:    72 LGKMASQFILSQQISPAAIIKKEGRLGIYYYEQGFSVRTNKVIYDRNYSSFWESTLSDYD   131
             +G     QF+   +  +      + R+G+YY E GF  R ++V YDR   SSF          D
Sbjct:    74 VGHAFHQFLKQSGVDMSLTAWQGHRVGLYYLENGFGCRASQVYYDRCGSSFSALDKDSLD   133

Query:   132 FTSIFKGVDWFHVSGITPALTKDLYEVTRFLMTKAKEGGVKVSIDLNFRESLWSSFQEAR   191
              +IF+G+   FH SGI+ AL K     ++    L+ +AK+  +  +S DLNFR S+  +  +A+
Sbjct:   134 LAAIFEGISHFHFSGISLALGKKTQDLIEVLVREAKKRDICISFDLNFRSSM-IAVADAK   192

Query:   192 EQLSPLLGLLDVCFGLEPIYLAGESEDLKDELGLSRPYLDIELLEKITQKIVQEYGLDYI   251
                    S       D+  FG+EP+   L   + D+  D   R       D   + +  + Q Y L     I
Sbjct:   193 RLFSHFAQYADIIFGMEPLLLDSDDFDMFD-----RKKADTTTIRERLAGLYQRYQLQAI   247

Query:   252 AFTQREMEYTNQYMLKSYLYHNNMLYQTDKTGVEVLDRVGTGDAFAAGLIHALLEKETPQ   311
```

```
                T+R   +         K+Y Y  +    Y++  +       VL  RVG+GDAF AGL++ LLE      Q
Sbjct:  248  YHTERSNDAQGSNHFKAYAY-DRQFYESCEVTTPVLQRVGSGDAFVAGLLYQLLEGNEKQ      306

Query:  312  RALEIAMATFKYKHTIQGD                                                330
             R  L+  A+AT K  T+     D
Sbjct:  307  RNLDFAVATASLKCTVAED                                                325
```

Based on this analysis, it was predicted that these proteins and their epitopes could be useful antigens for vaccines or diagnostics.

EXAMPLE 388

A DNA sequence (GBSx0419) was identified in *S. agalactiae* <SEQ ID 1265> which encodes the amino acid sequence <SEQ ID 1266>. Analysis of this protein sequence reveals the following:

```
Possible Site: 15
>>> Seems to have an uncleavable N-term signal seq
    INTEGRAL    Likelihood = -1.17    Transmembrane   5-21   (5-21)

----- Final Results -----
             bacterial membrane --- Certainty = 0.1468(Affirmative) < succ>
              bacterial outside --- Certainty = 0.0000(Not Clear)   < succ>
            bacterial cytoplasm --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 389

A DNA sequence (GBSx0420) was identified in *S. agalactiae* <SEQ ID 1267> which encodes the amino acid sequence <SEQ ID 1268>. Analysis of this protein sequence reveals the following:

```
Possible site: 53
>>> Seems to have no N-terminal signal sequence
    INTEGRAL   Likelihood = -12.05     Transmembrane    198-214    (191-220)
    INTEGRAL   Likelihood = -11.68     Transmembrane    446-462    (437-467)
    INTEGRAL   Likelihood =  -9.55     Transmembrane     94-110     (91-116)
    INTEGRAL   Likelihood =  -7.43     Transmembrane    291-307    (283-309)
    INTEGRAL   Likelihood =  -4.88     Transmembrane    265-281    (257-282)
    INTEGRAL   Likelihood =  -4.62     Transmembrane    321-337    (318-339)
    INTEGRAL   Likelihood =  -3.93     Transmembrane    406-422    (405-426)
    INTEGRAL   Likelihood =  -1.59     Transmembrane    121-137    (121-137)
    INTEGRAL   Likelihood =  -1.12     Transmembrane    345-361    (345-362)
    INTEGRAL   Likelihood =  -0.48     Transmembrane     43-59      (43-59)

----- Final Results -----
             bacterial membrane --- Certainty = 0.5819(Affirmative) < succ>
              bacterial outside --- Certainty = 0.0000(Not Clear)   < succ>
            bacterial cytoplasm --- Certainty = 0.0000(Not Clear)   < succ>
```

The protein has homology with the following sequences in the GENPEPT database:

```
>GP:CAB13641 GB:Z99113 similar to H+-symporter [Bacillus subtilis]
 Identities = 105/452 (23%), Positives = 182/452 (40%), Gaps = 37/452 (8%)
Query:   36  IYLFTFMFVTYFSTGVLGSAAIFVSQIMGYIRIFDGFIDPAIGIMIDKTDTKFGKYRPIL    95
             IY     ++ +F T V G +A      +   +RI  D    DP IG ++D+T+++F ++RP L
Sbjct:   27  IYATVSTYLLFFYTDVFGLSAAAAGTMFLVVRIIDALADPFIGTIVDRTNSRFARFRPYL    86
```

-continued

```
Query:  96 IIGNVITALSLIFLLALRGVDENIRFPLFILVLIIHKIGYSHQQTITKAGQTALTNDPKQ  155
           + G    A   + L  L      +      ++   I  +G S+  T        ALT+
Sbjct:  87 LFG----AFPFVILAILCFTTPDFSDMGKLIYAYITYVGLSLTYTTINVPYGALTS-AMT  141

Query: 156 RPIFNIVDAVMTTSLMTGGQFVVSVFLVPKFGNFTPQFFNVLIFGTILISAILAIV--AI  213
           R    +V         L       +V  F VP     +          G  L    IL ++    +
Sbjct: 142 RNNQEVVSITSVRMLFANLGGLVVAFFVPLLAAYLSDTSGNESLGWQLTMGILGMIGGCL  201

Query: 214 IGIWAKDRKEFFGLGENTQKTALKDYWKVLKGNKPLQILSIAAALVKFAIQFFGDSV-VM  272
           +    K  KE    L ++ +K     D ++  + N+PL +LSI    ++ F +     +SV +
Sbjct: 202 LIFCFKSTKERVTLQKSEEKIKFTDIFEQFRVNRPLVVLSIFFIII-FGVNSISNSVGIY  260

Query: 273 VLLFGI----LFGNYALSGQFSLLFIVPGVIINILFSTIARKKGLRFSYVRAIQIGMIGL  328
            + + +     L   Y L G    L I+P   I  L    + +KK L +    A+ + +IGL
Sbjct: 261 YVTYNLEREDLVKWYGLIGSLPALVILP--FIPRLHQFLGKKKLLNY----ALLLNIIGL  314

Query: 329 LAFGAVLYVGKPGDLSLTSLNLYTILFIVTNIIARYASQAPASLVLTMGADISDYETSES  388
           LA              L +   N+Y IL   V   +IA    S          +   +   +   +Y     +
Sbjct: 315 LAL-----------LFVPPSNVYLIL--VCRLIAAAGSLTAGGYMWALIPETIEYGEYRT  361

Query: 389 GRYVSGMIGTIFSLTDSIASSFAPMVVGFVLAGIGFSKSFPTIETPLPPDLKMAAISILV  448
           G+ + G+I   I           +    +V G VL    G+               P    M   +
Sbjct: 362 GKRMGGLIYAIIGFFFKFGMALGGVVPGLVLDKFGY-----VANQAQTPAALMGILITTT  416

Query: 449 AIPFIALSIALLLMKFYKLDKEEMVRIQEKIQ                              480
            IP    L +AL+ + FY LD+++     +   +++
Sbjct: 417 IIPVFLLVLALIDINFYNLDEKKYKNMVRELE                              448
```

No corresponding DNA sequence was identified in *S. pyogenes*.

Based on this analysis, it was predicted that this protein and its epitopes, could be useful antigens for vaccines or diagnostics.

EXAMPLE 390

A DNA sequence (GBSx0422) was identified in *S. agalactiae* <SEQ ID 1269> which encodes the amino acid sequence <SEQ ID 1270>. Analysis of this protein sequence reveals the following:

```
Possible site: 52
>>> Seems to have no N-terminal signal sequence

----- Final Results -----
              bacterial cytoplasm --- Certainty = 0.3375(Affirmative) < succ>
               bacterial membrane --- Certainty = 0.0000(Not Clear) < succ>
                bacterial outside --- Certainty = 0.0000(Not Clear) < succ>
```

The protein has homology with the following sequences in the GENPEPT database:

```
>GP:AAB17663 GB:U31175 D-specific D-2-hydroxyacid dehydrogenase [S. aureus]
 Identities = 165/331 (49%), Positives = 231/331 (68%), Gaps = 1/331 (0%)

Query:   1 MMKLKVFNVREEEATLAQDWANRNHVELSMSEGPLTLETVNEVEGFDGIANAQIEPLDDA   60
           M K+  F  R+ E  +A +W  +N+VE++ S+  L+  TV++++ +DG+   Q   L++
Sbjct:   1 MTKIMFFGTRDYEKEMALNWGKKNNVEVTTSKELLSSATVDQLKDYDGVTTMQFGKLEND   60

Query:  61 IYPLLKEMGIKQIAQRSAGVDMYNLELAKQHGIIISNVPSYSPESIAEFTVTIALNLIRK  120
           +YP L+  GIKQIAQR+AG DMY+L+LAK+H I+ISNVPSYSPE+IAE++V+IAL L+R+
Sbjct:  61 VYPKLESYGIKQIAQRTAGFDMYDLDLAKKHNIVISNVPSYSPETIAEYSVSIALQLVRR  120

Query: 121 VELIRANVREQNFSWTLPIRGRVLGNMTVAIIGTGRIGLATAKIFKGFGCRVIGYDIYHN  180
              I   V+  +F+W   I  + + NMTVAIIGTGRIG ATAKI+ GFG  +  YD Y N
Sbjct: 121 FPDIERRVQAHDFTWQAEIMSKPVKNMTVAIIGTGRIGAATAKIYAGFGATITAYDAYPN  180

Query: 181 PMADGILEYVNSVEEAVEEADLVSLHMPPTAENTHLFNLDMFKQFKKGAILMNMARGALV  240
              D  L Y +SV+EA+++AD++SLH+P   E+ HLF+  MF   KKGAIL+N ARGA++
Sbjct: 181 KDLD-FLTYKDSVKEAIKDADIISLHVPANKESYHLFDKAMFDHVKKGAILVNAARGAVI  239

Query: 241 ETKDLLEALDQGLLEGAGIDTYEFEGPYIPKNCQGQDISDKDFLRLINHPKVIYTPHAAY  300
            T DL+ A++ G L GA IDTYE E  Y   +   +DI DK  L LI H +++ TPH A+
Sbjct: 240 NTPDLIAAVNDGTLLGAAIDTYENEAAYFTNDWTNKDIDDKTLLELIEHERILVTPHIAF  299
```

```
                             -continued
Query:  301 YTDEAVKNLVEGALNACVEVIETGTTTTKVN                         331
            ++DEAV+NLVEG LNA + VI TGT  T++N
Sbjct:  300 FSDEAVQNLVEGGLNAALSVINTGTCETRLN                         330
```

There is also homology to SEQ ID 124.

Based on this analysis, it was predicted that this protein and its epitopes, could be useful antigens for vaccines or diagnostics.

EXAMPLE 391

A DNA sequence (GBSx0423) was identified in *S. agalactiae* <SEQ ID 1271> which encodes the amino acid sequence <SEQ ID 1272>. Analysis of this protein sequence reveals the following:

```
Possible site: 40
>>> Seems to have no N-terminal signal sequence

----- Final Results -----
            bacterial cytoplasm --- Certainty = 0.2364(Affirmative) < succ>
             bacterial membrane --- Certainty = 0.0000(Not Clear)   < succ>
              bacterial outside --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 392

A DNA sequence (GBSx0424) was identified in *S. agalactiae* <SEQ ID 1273> which encodes the amino acid sequence <SEQ ID 1274>. This protein is predicted to be regulatory protein (pfoS/R). Analysis of this protein sequence reveals the following:

```
Possible site: 37
>>> Seems to have a cleavable N-term signal seq.
    INTEGRAL    Likelihood = -12.90   Transmembrane 64 - 80 (53 - 89)

----- Final Results -----
             bacterial membrane --- Certainty = 0.6158(Affirmative) < succ>
              bacterial outside --- Certainty = 0.0000(Not Clear)   < succ>
            bacterial cytoplasm --- Certainty = 0.0000(Not Clear)   < succ>
```

A related GBS nucleic acid sequence <SEQ ID 9325> which encodes amino acid sequence <SEQ ID 9326> was also identified.

The protein has homology with the following sequences in the GENPEPT database:

```
>GP:AAC65034 GB:AE001189 regulatory protein (pfoS/R) [Treponema pallidum]
 Identities = 33/91 (36%), Positives = 55/91 (60%), Gaps = 1/91 (1%)

Query:    1 MANVLAKPKIMLPMISSAAILGILGALFNIQGTPASAGFGISGLIGPINALNLAKGGWSV   60
            M N +  P + +P++ +  + G+L  LFN+QGTPASAGFG  GL+GPINA  L       V
Sbjct:  250 MPNWIRYPILNIPLLLNGLVCGVLAWLFNLQGTPASAGFGFIGLVGPINAYRLMAYTPMV  309

Query:   61 MNMLLIIIIFVAAPIILNFIFNYLFIKVLKI                              91
            +L ++ FV +  +   ++ +++ +   LK+
Sbjct:  310 RAGILFLVYFVLS-FLAAYLIDFILVDRLKL                             339
```

A related DNA sequence was identified in *S. pyogenes* <SEQ ID 1275> which encodes the amino acid sequence <SEQ ID 1276>. Analysis of this protein sequence reveals the following:

```
Possible site: 51
>>> Seems to have a cleavable N-term signal seq.
    INTEGRAL    Likelihood = -12.31    Transmembrane    141-157 (133-166)
    INTEGRAL    Likelihood =  -6.00    Transmembrane     92-108  (88-112)

----- Final Results -----
              bacterial membrane --- Certainty = 0.5925(Affirmative) < succ>
               bacterial outside --- Certainty = 0.0000(Not Clear)   < succ>
             bacterial cytoplasm --- Certainty = 0.0000(Not Clear)   < succ>
```

The protein has homology with the following sequences in the databases:

```
>GP: AAC65034 GB: AE001189 regulatory protein (pfoS/R) [Treponema
pallidum]
Identities = 63/178 (35%), Positives = 107/178 (59%), Gaps = 10/178 (5%)

Query:   2 IGQGIASLLGLQPILMSLLIAMIFCFLIVSPITTVGIALAINLSGIGSGAASFG------   55
           +G+ IA+ + LQP+LMS+L++M F  +I+SP+++V + +A+ L+G+ SGAA+ G
Sbjct: 164 VGRVIATFIALQPLLMSILLSMSFSLIIISPVSSVAVGIAVGLTGLASGAANIGVSSCAM 223

Query:  56 -LCLAGWAVNSKGTSLAHVLRSPKISMANVLSKPKIMLPMLCSAAVLGVIGAIFNIQGTP 114
            L +    VN  G  LA    + K+ M N +  P + +P+L +   V GV+   +FN+QGTP
Sbjct: 224 TLIVGTMRVNKIGVPLAMFAGAMKMLMPNWIRYPILNIPLLLNGLVCGVLAWLFNLQGTP 283

Query: 115 ASAGFGISGLIGPINALNLAKGGWCP-VNILLIIIIFVGAPIVLNMIFNYLFIKVLKV    171
           ASAGFG  GL+GPINA  L    + P V   ++ +++    +   + +++ +  LK+
Sbjct: 284 ASAGFGFIGLVGPINAYRLM--AYTPMVRAGILFLVYFVLSFLAAYLIDFILVDRLKL    339
```

An alignment of the GAS and GBS proteins is shown below:

```
Identities = 86/101 (85%), Positives = 96/101 (94%)

Query:   1 MANVLAKPKIMLPMISSAAILGILGALFNIQGTPASAGFGISGLIGPINALNLAKGGWSV  60
           MANVL+KPKIMLPM+ SAA+LG++GA+FNIQGTPASAGFGISGLIGPINALNLAKGGW
Sbjct:  81 MANVLSKPKIMLPMLCSAAVLGVIGAIFNIQGTPASAGFGISGLIGPINALNLAKGGWCP 140

Query:  61 MNMLLIIIIFVAAPIILNFIFNYLFIKVLKIIDPMDYKLDI                   101
           +N+LLIIIFV API+LN IFNYLFIKVLK+IDPMDYKLDI
Sbjct: 141 VNILLIIIIFVGAPIVLNMIFNYLFIKVLKVIDPMDYKLDI                   181
```

Based on this analysis, it was predicted that these proteins and their epitopes could be useful antigens for vaccines or diagnostics.

EXAMPLE 393

A DNA sequence (GBSx0426) was identified in *S. agalactiae* <SEQ ID 1277> which encodes the amino acid sequence <SEQ ID 1278>. This protein is predicted to be regulatory protein (pfoS/R). Analysis of this protein sequence reveals the following:

```
Possible site: 48
>>> Seems to have no N-terminal signal sequence
    INTEGRAL    Likelihood = -6.58    Transmembrane    148-164 (145-169)
    INTEGRAL    Likelihood = -5.26    Transmembrane     33-49   (25-52)
    INTEGRAL    Likelihood = -4.73    Transmembrane     70-86   (62-88)
    INTEGRAL    Likelihood = -3.45    Transmembrane    124-140 (122-143)
    INTEGRAL    Likelihood = -1.33    Transmembrane     96-112  (96-112)

----- Final Results -----
              bacterial membrane --- Certainty = 0.3633(Affirmative) < succ>
               bacterial outside --- Certainty = 0.0000(Not Clear)   < succ>
             bacterial cytoplasm --- Certainty = 0.0000(Not Clear)   < succ>
```

A related GBS nucleic acid sequence <SEQ ID 9735> which encodes amino acid sequence <SEQ ID 9736> was also identified.

A related GBS nucleic acid sequence <SEQ ID 9697> which encodes amino acid sequence <SEQ ID 9698> was also identified.

The protein has homology with the following sequences in the GENPEPT database:

```
>GP: AAC65034 GB: AE001189 regulatory protein (pfoS/R) [Treponema
pallidum]
Identities = 61/158 (38%), Positives = 92/158 (57%)

Query:   24 KSFIMNVLNGLALGTVIVLIPGAILGELMKALLPMWSGFATLIAATAVATSMMGLVIGIM   83
            + F+M +LNG + G VI L+P AI GEL +AL P+    FA L          +  +IG +
Sbjct:    9 RQFMMKILNGSSAGIVIGLVPPAIAGELFRALAPLSPLFAALYHVVLPIQFSVPALIGTL   68

Query:   84 VGLNFKFNPIQSASLGLAVMFAGGAATFLKGAIMLKGTGDIINMGITAALGVLLIQFLSD  143
            VGL F  +  + A+L    + A G  T      GA ++ G GD+IN+ +  +AL ++L++   L
Sbjct:   69 VGLQFHCSAPEVATLAFVSVIASGNVTLQNGAWLITGIGDVINVMLISALAIILVRALRG  128

Query:  144 KTKSFTLIVIPTVTLLLVGGVGHVLLPYVKMITTIGQ                        181
            K  S T+I +P +   ++ GGVG    LPYVKMIT  +G+
Sbjct:  129 KLGSLTIIALPVIVAVVAGGVGSFSLPYVKMITLFVGR                       166
```

A related DNA sequence was identified in *S. pyogenes* <SEQ ID 1279> which encodes the amino acid sequence <SEQ ID 1280>. Analysis of this protein sequence reveals the following:

```
Possible site: 48
>>> Seems to have no N-terminal signal sequence
      INTEGRAL    Likelihood = -13.06     Transmembrane   314-330 (301-335)
      INTEGRAL    Likelihood = -11.30     Transmembrane   185-201 (178-215)
      INTEGRAL    Likelihood =  -8.01     Transmembrane    22-38  (11-42)
      INTEGRAL    Likelihood =  -3.29     Transmembrane   266-282 (265-285)
      INTEGRAL    Likelihood =  -2.66     Transmembrane   141-157 (141-159)
      INTEGRAL    Likelihood =  -2.13     Transmembrane    53-69  (53-69)
      INTEGRAL    Likelihood =  -1.33     Transmembrane   114-130 (113-131)
      INTEGRAL    Likelihood =  -0.80     Transmembrane   206-222 (206-222)

----- Final Results -----
            bacterial membrane --- Certainty = 0.6222(Affirmative) < succ>
            bacterial outside  --- Certainty = 0.0000(Not Clear)  < succ>
            bacterial cytoplasm --- Certainty = 0.0000(Not Clear) < succ>
```

The protein has homology with the following sequences in the databases:

```
>GP: AAC65034 GB: AE00189 regulatory protein (pfoS/R) [Treponema
pallidum]
Identities = 137/346 (39%), Positives = 217/346 (62%), Gaps = 14/346 (4%)

Query:   12 FMNKVLAGTAIAIVVALIPNAILATFLKPLLP-NMAAAEFLHIVQVFQFFTPIMAGFLIG   70
            FM K+L G++  IV+ L+P AI    + L P +   A    H+V  QF   P + G L+G
Sbjct:   11 FMMKILNGSSAGIVIGLVPPAIAGELFRALAPLSPLFAALYHVVLPIQFSVPALIGTLVG   70

Query:   71 QQFKFNPMQQLAVGGAAYIGSGAWAYTEVIQKGVATGTFQLRGIGDLINMMITASLAVLA  130
            Q F  +  +     +     + I SG          +   G + + GIGD+IN+M+ ++LA++
Sbjct:   71 LQFHCSAPEVATLAFVSVIASG--------NVTLQNGAWLITGIGDVINVMLISALAIIL  122

Query:  131 VKYFGNKFGSLTIILLPITIGTGVGYIGWKFLPYVSYVTTLIGQGINSFTTLQPILMSIL  190
            V+    K GSLTII LP+ +    G +G   LPYV  +T  +G+ I +F  LQP +LMSIL
Sbjct:  123 VRALRGKLGSLTIIALPVIVAVVAGGVGSFSLPYVKMITLFVGRVIATFIALQPLLMSIL  182

Query:  191 IAVAFSLIIVSPISTVAIGLAIGLNGMAAGAASMGIASTAAVLVWATLKVNKSGVPIAIA  250
            ++++FSLII+SP+S+VA+G+A+GL G+A+GAA++G++S A   L+   T++VNK GVP+A+
Sbjct:  183 LSMSFSLIIISPVSSVAVGIAVGLTGLASGAANIGVSSCAMTLIVGTMRVNKIGVPLAMF  242

Query:  251 LGAMKMMMPNFLKHPIMAIPMVFTAAISSLTVPLFNLVGTPASSGFGLVGAVGPIAS--L  308
            GAMKM+MPN++++PI+ IP++    +   +   LFNL GTPAS+GFG +G VGPI + L
Sbjct:  243 AGAMKMLMPNWIRYPILNIPLLLNGLVCGVLAWLFNLQGTPASAGFGFIGLVGPINAYRL  302
```

```
Query: 309 AGGSSIL---IIILAWIIVPFAVAFAAHKVSKDILKLYKEDIFVFE         351
            + ++    I+ L + ++ F  A+     + D LKLY+ ++F+ E
Sbjct: 303 MAYTPMVRAGILFLVYFVLSFLAAYLIDFILVDRLKLYRRELFIPE         348
```

An alignment of the GAS and GBS proteins is shown below:

```
Identities = 65/172 (37%), Positives = 95/172 (54%), Gaps = 9/172 (5%)

Query:  19 EKQTTKSFIMNVLNGLALGTVIVLIPGAILGELMKALLPMWSGFATLIAATAVATSMMGL  78
           +K+T   SF+   VL G A+  V+ LIP AIL    +K LLP   +  A  +   V   +
Sbjct:   5 DKETFSSFMNKVLAGTAIAIVVALIPNAILATFLKPLLPNMAA-AEFLHIVQVFQFFTPI  63

Query:  79 VIGIMVGLNFKFNPIQSASLGLAVMFAGGAATFLK--------GAIMLKGTGDIINMGIT 130
           + G ++G FKFNP+Q  ++G A      GA  +          G   L+G GD+INM IT
Sbjct:  64 MAGFLIGQQFKFNPMQQLAVGGAAYIGSGAWAYTEVIQKGVATGTFQLRGIGDLINMMIT 123

Query: 131 AALGVLLIQFLSDKTKSFTLIVIPTVTLLLVGGVGHVLLPYVKMITTMIGQG         182
           A+L VL +++  +K  S T+I++P    VG +G  LPYV +TT+IGQG
Sbjct: 124 ASLAVLAVKYFGNKFGSLTIILLPITIGTGVGYIGWKFLPYVSYVTTLIGQG         175
```

A related GBS gene <SEQ ID 8567> and protein <SEQ ID 8568> were also identified. Analysis of this protein sequence reveals the following:

```
Lipop: Possible site: -1 Crend: 10
McG: Discrim Score: -13.49
GvH: Signal Score (-7.5): -5.82
     Possible site: 48
>>> Seems to have no N-terminal signal sequence
ALOM program count: 5 value: -6.58 threshold: 0.0
     INTEGRAL      Likelihood = -6.58    Transmembrane    148-164 (145-169)
     INTEGRAL      Likelihood = -5.26    Transmembrane     33-49  (25-52)
     INTEGRAL      Likelihood = -4.73    Transmembrane     70-86  (62-88)
     INTEGRAL      Likelihood = -3.45    Transmembrane    124-140 (122-143)
     INTEGRAL      Likelihood = -1.33    Transmembrane     96-112 (96-112)
     PERIPHERAL    Likelihood = 1.85     51
modified ALOM score: 1.82
*** Reasoning Step: 3

----- Final Results -----
             bacterial membrane  --- Certainty = 0.3633(Affirmative) < succ>
             bacterial outside   --- Certainty = 0.0000(Not Clear)   < succ>
             bacterial cytoplasm --- Certainty = 0.0000(Not Clear)   < succ>
```

The protein has homology with the following sequences in the databases:

```
ORF01226(352-843 of 1218)
EGAD|138195|TP0038(3-166 of 350) regulatory protein {Trepsonema pallidum}
OMNI|TP0038 regulatory protein (pfoS/R) GP|3322295|gb|AAC65034.1||AE001189 regulatory
protein (pfoS/R) {Treponema pallidum} PIR|E71373|E71373 probable regulatory protein
(pfoS/R) - syphilis spirochete
% Match = 13.6
% Identity = 37.2   % Similarity = 59.1
Matches = 61   Mismatches = 67   Conservative Sub.s = 36

273       303       333       363       393       423       453       483
I*FFPIFLLQIAMI*LI*LVKSQTIIISRRHLMSDVVEKQTTKSFIMNVLNGLALGTVIVLIPGAILGELMKALLPMWSG
                                    : : :|:| :||| : | || |:| || ||| :|| |:
                                   MHTQSLSPRQFMMKILNGSSAGIVIGLVPPAIAGELFRALAPLSPL
                                             10        20        30        40

513       543       573       603       633       663       693       723
FATLIAATAVATSMMGLVIGIMVGLNFKFNPIQSASLGLAVMFAGGAATFLKGAIMLKGTGDIINMGITAALGVLLIQFL
|| |         :  :|| :||| |    |  : : |: :  |   | |: || :: ||:||: : :|| ::|:: |
FAALYHVVLPIQFSVPALIGTLVGLQFHCSAPEVATLAFVSVIASGNVTLQNGAWLITGIGDVINVMLISALAIILVRAL
  50        60        70        80        90       100       110       120

753       783       813       843       873       903       933       963
SDKTKSFTLIVIPTVTLLLVGGVGHVLLPYVKMITTMIGQGTRRTHENFLFILLCPDINFEKIPF*INDLLSLFLQIIGL
  | |:|:| :| :   :: |||| ||||||||  :|:
RGKLGSLTIIALPVIVAVVAGGVGSFSLPYVKMITLFVGRVIATFIALQPLLMSILLSMSFSLIIISPVSSVAVGIAVGL
    130       140       150       160       170       180       190       200
```

Based on this analysis, it was predicted that these proteins and their epitopes could be useful antigens for vaccines or diagnostics.

EXAMPLE 394

A DNA sequence (GBSx0428) was identified in *S. agalactiae* <SEQ ID 1281> which encodes the amino acid sequence <SEQ ID 1282>. This protein is predicted to be cyn operon transcriptional activator. Analysis of this protein sequence reveals the following:

```
Possible site: 15
>>> Seems to have no N-terminal signal sequence

----- Final Results -----
              bacterial membrane --- Certainty = 0.0000(Not Clear) < succ>
                bacterial outside --- Certainty = 0.0000(Not Clear) < succ>
              bacterial cytoplasm --- Certainty = 0.0000(Not Clear) < succ>
```

The protein has homology with the following sequences in the GENPEPT database:

```
>GP: CAB15857 GB: Z99123 alternate gene name: ipa-24d~similar to
transcriptional regulator (LysR family) [Bacillus subtilis]
Identities = 87/282 (30%), Positives = 152/282 (53%), Gaps = 5/282 (1%)

Query:    1 MDIRQLTYFIAVAEAKNYSRAAKSLFVTQPTLSQSIKKLEAELNTILFLQNGRQLALTEA   60
            MDIR LTYF+ VA   K++++A++SL+V+QPT+S+ IK LE EL    LF +NGRQ+ LT+A
Sbjct:    1 MDIRHLTYFLEVARLKSFTKASQSLYVSQPTISKMIKNLEEELGIELFYRNGRQVELTDA   60

Query:   61 GEILYEKGQLLMTNVNQMVTEIQQLNQEKKEGIRVGLTSLFAIQFMKQI-STFMATHSNV  119
            G  +Y + Q ++ +    + +E+  + + KK  +R+GL  +    F   ++     F    + NV
Sbjct:   61 GHSMYVQAQEIIKSFQNLTSELNDIMEVKKGHVRIGLPPMIGSGFFPRVLGDFRENYPNV  120

Query:  120 EVSLIQDGSRKLQELLAKGKIDIGLLSFPSTRNDITIEPLQTSTKGYKVSIVMPKSHPLA  179
              L++DGS K+QE +  G +DIG++  P+  +       + T    + +V+  SH LA
Sbjct:  121 TFQLVEDGSIKVQEGVGDGSLDIGVVVLPANEDIFHSFTIVKET----LMLVVHPSHRLA  176

Query:  180 TLPEIELNDLRDYKVASLNEHYMLGEMLPRKCRALGFDPHIVFKHNDWEVLIHSLQDLNA  239
              E +L +L+D          E ++L   +  +C   GF PHI+++ + W+ +   +
Sbjct:  177 DEKECQLRELKDEPFIFFREDFVLHNRIMTECIKAGFRPHIIYETSQWDFISEMVSANLG  236

Query:  240 VTILPSEFESISQVQDLCWVPLKDKNNFYPIGIAYRNDTSFS                  281
            + +LP          + +  +PL D       + + I +R D   S
Sbjct:  237 IGLLPERICRGLDPEKVKVIPLVDPVIPWHLAIIWRKDRYLS                  278
```

A related DNA sequence was identified in *S. pyogenes* <SEQ ID 1283> which encodes the amino acid sequence <SEQ ID 1284>. Analysis of this protein sequence reveals the following:

```
Possible site: 21
>>> Seems to have no N-terminal signal sequence

----- Final Results -----
              bacterial cytoplasm --- Certainty = 0.1101(Affirmative) < succ>
                bacterial membrane --- Certainty = 0.0000(Not Clear) < succ>
                bacterial outside --- Certainty = 0.0000(Not Clear) < succ>
```

An alignment of the GAS and GBS proteins is shown below:

```
Identities = 125/160 (78%), Positives = 144/160 (89%)

Query:  135 LAKGKIDIGLLSFPSTRNDITIEPLQTSTKGYKVSIVMPKSHPLATLPEIELNDLRDYKV  194
            L++GKIDIGLLSF S R DITIE LQTSTKGYKVSIV+ K HPLA  P+++L DL+ YK+
Sbjct:    1 LSQGKIDIGLLSFLSIRKDITIELLQTSTKGYKVSIVLLKQHPLAQHPQLKLKDLKGYKI   60

Query:  195 ASLNEHYMLGEMLPRKCRALGFDPHIVFKHNDWEVLIHSLQDLNAVTILPSEFESISQVQ  254
            ASLN+HYMLGEMLPRKCRALGF+P IVFKHNDWEVLIHSL DLN +TILPS+FES++QV
Sbjct:   61 ASLNDHYMLGEMLPRKCRALGFEPDIVFKHNDWEVLIHSLHDLNTLTILPSDFESLNQVD  120
```

```
Query: 255 DLCWVPLKDKNNFYPIGIAYRNDTSFSPMIEEFLSLLKTN            294
           +L W+PL+DKNNFYPIGIAYR+D SFSP+IEEFLSLLKTN
Sbjct: 121 NLVWIPLQDKNNFYPIGIAYRDDASFSPVIEEFLSLLKTN            160
```

Based on this analysis, it was predicted that these proteins and their epitopes could be useful antigens for vaccines or diagnostics.

EXAMPLE 395

A DNA sequence (GBSx0429) was identified in *S. agalactiae* <SEQ ID 1285> which encodes the amino acid sequence <SEQ ID 1286>. Analysis of this protein sequence reveals the following:

```
Possible site: 47
>>> Seems to have no N-terminal signal sequence

----- Final Results -----
         bacterial cytoplasm --- Certainty = 0.1833(Affirmative) < succ>
         bacterial membrane  --- Certainty = 0.0000(Not Clear)   < succ>
          bacterial outside  --- Certainty = 0.0000(Not Clear)   < succ>
Signal peptide: 1-21
```

A related GBS nucleic acid sequence <SEQ ID 8569> which encodes amino acid sequence <SEQ ID 8570> was also identified.

The protein has no significant homology with any sequences in the GENPEPT database.

No corresponding DNA sequence was identified in *S. pyogenes*.

SEQ ID 8570 (GBS271) was expressed in *E. coli* as a His-fusion product. SDS-PAGE analysis of total cell extract is shown in FIG. 51 (lane 8; MW 31.3 kDa). It was also expressed in *E. coli* as a GST-fusion product. SDS-PAGE analysis of total cell extract is shown in FIG. 55 (lane 6; MW 56.3 kDa) and in FIG. 62 (lane 10; MW 56.3 kDa).

GBS271-GST was purified as shown in FIG. 210, lane 8.

Based on this analysis, it was predicted that these proteins and their epitopes could be useful antigens for vaccines or diagnostics.

EXAMPLE 396

A DNA sequence (GBSx0430) was identified in *S. agalactiae* <SEQ ID 1287> which encodes the amino acid sequence <SEQ ID 1288>. Analysis of this protein sequence reveals the following:

```
Possible site: 22
>>> Seems to have an uncleavable N-term signal seq
      INTEGRAL    Likelihood = -6.74    Transmembrane     9-25   (5-28)
      INTEGRAL    Likelihood = -5.84    Transmembrane    97-113  (92-122)
      INTEGRAL    Likelihood = -5.47    Transmembrane    37-53   (35-61)
      INTEGRAL    Likelihood = -2.55    Transmembrane   220-236  (220-238)
      INTEGRAL    Likelihood = -1.65    Transmembrane    64-80   (63-81)
      INTEGRAL    Likelihood = -1.28    Transmembrane   193-209  (192-209)
      INTEGRAL    Likelihood = -0.53    Transmembrane   125-141  (125-141)

----- Final Results -----
          bacterial membrane  --- Certainty = 0.3697(Affirmative) < succ>
          bacterial outside   --- Certainty = 0.0000(Not Clear)   < succ>
          bacterial cytoplasm --- Certainty = 0.0000(Not Clear)   < succ>
```

The protein has homology with the following sequences in the GENPEPT database:

```
>GP: AAC73593 GB: AE000155 putative metal resistance protein
[Escherichia coli K12]
Identities = 128/252 (50%), Positives = 186/252 (73%)

Query:    5 NSISLMSLLMASSLVLITLFFSYWQKLNLEKEVIISAIRAVIQLLAVGFLLDYIFGYQNP   64
            ++I+   SL +A  LV++ +   S+ +KL LEK+++ S  RA+IQL+ VG++L YIF   +
Sbjct:   13 HNITNESLALALMLVVVAILISHKEKLALEKDILWSVGRAIIQLIIVGYVLKYIFSVDDA   72

Query:   65 IFTALLMLFMIINASYNAAKRGKGINKGFVISFIAIGSGTIITLSVLIFSGILKFVPNQM  124
             T  L++LF+   NA++NA KR K I K F+ SFIAI  G   ITL+VLI SG ++F+P Q+
Sbjct:   73 SLTLLMVLFICFNAAWNAQKRSKYIAKAFISSFIAITVGAGITLAVLILSGSIEFIPMQV  132

Query:  125 IPVGGMIISNSMVAIGLCYKQLLSEFRSKQEEVETKLALGADILPASIDIIRDVIKTGMV  184
            IP+ GMI  N+MVA+GLCY  L    S+Q++++ KL+LGA    AS  +IRD I+   ++
Sbjct:  133 IPIAGMIAGNAMVAVGLCYNNLGQRVISEQQQIQEKLSLGATPKQASAILIRDSIRAALI  192

Query:  185 PTIDSAKTLGIVSLPGMMTGLILAGTSPIQAVKYQMMVTFMLLATTSIASFVATYLAYKI  244
            PT+DSAKT+G+VSLPGMM+GLI AG  P++A+KYQ+MVTFMLL+T S+++ +A YL Y+
Sbjct:  193 PTVDSAKTVGLVSLPGMMSGLIFAGIDPVKAIKYQIMVTFMLLSTASLSTIIACYLTYRK  252

Query:  245 FFNNRKQLVVTK                                                  256
            F+N+R QLVVT+
Sbjct:  253 FYNSRHQLVVTQ                                                  264
```

No corresponding DNA sequence was identified in *S. pyogenes*.

Based on this analysis, it was predicted that this protein and its epitopes, could be useful antigens for vaccines or diagnostics.

EXAMPLE 397

A DNA sequence (GBSx0431) was identified in *S. agalactiae* <SEQ ID 1289> which encodes the amino acid sequence <SEQ ID 1290>. This protein is predicted to be SUGAR TRANSPORT ATP-BINDING PROTEIN. (b0490). Analysis of this protein sequence reveals the following:

```
Possible site: 56
>>> Seems to have no N-terminal signal sequence

----- Final Results -----
           bacterial cytoplasm --- Certainty = 0.1903(Affirmative) < succ>
            bacterial membrane --- Certainty = 0.0000(Not Clear)   < succ>
              bacterial outside --- Certainty = 0.0000(Not Clear)   < succ>
```

The protein has homology with the following sequences in the GENPEPT database:

```
>GP: AAC73592 GB: AE000155 putative ATP-binding component of a
transport system [Escherichia coli K12]
Identities = 95/202 (47%), Positives = 142/202 (70%), Gaps = 2/202 (0%)

Query:    4 LTFKHVDFKTDDKLVLNDINFAIDEGDFVSIVGPSGSGKSTVLKLASGLMSPTAGHIFFD   63
            L  ++V +   D  +LN+INF++  G+F  I GPSG GKST+LK+ +  L+SPT+G + F+
Sbjct:    8 LQLQNVGYLAGDAKILNNINFSLRAGEFKLITGPSGCGKSTLLKIVASLISPTSGTLLFE   67

Query:   64 GKDLNQLEPIESRKMISYCFQTPHLFGNTVEDNISFPYHIRHEKVDYRRVDDLFQRFEMD  123
            G+D++ L+P   R+  +SYC QTP LFG+TV DN+ FP+ IR+ + D      D  +RF +
Sbjct:   68 GEDVSTLKPEIYRQQVSYCAQTPTLFGDTVYDNLIFPWQIRNRQPDPAIFLDFLERFALP  127

Query:  124 QSYLKQDVKKLSGGEKQRIALIRQLLFEPKVLLLDEVTSALDNHNKAIVEKVI-KSLHDK  182
              S L +++ +LSGGEKQRI+LIR L F PKVLLLDE+TSALD  NK V ++I + + ++
Sbjct:  128 DSILTKNIAELSGGEKQRISLIRNLQFMPKVLLLDEITSALDESNKHNVNEMIHRYVREQ  187

Query:  183 GITILWITHDEEQSRRFANKVL                                         204
             I +LW+THD+++   A+KV+
Sbjct:  188 NIAVLWVTHDKDEINH-ADKVI                                         208
```

A related DNA sequence was identified in *S. pyogenes* <SEQ ID 1291> which encodes the amino acid sequence <SEQ ID 1292>. Analysis of this protein sequence reveals the following:

```
Possible site: 61
>>> Seems to have no N-terminal signal sequence

----- Final Results -----
            bacterial cytoplasm --- Certainty = 0.2053(Affirmative) < succ>
            bacterial membrane  --- Certainty = 0.0000(Not Clear)   < succ>
            bacterial outside   --- Certainty = 0.0000(Not Clear)   < succ>
```

An alignment of the GAS and GBS proteins is shown below:

```
Identities = 73/214 (34%), Positives = 133/214 (62%), Gaps = 9/214 (4%)

Query:     4 LTFKHVD--FKTDDKLVLNDINFAIDEGDFVSIVGPSGSGKSTVLKLASGLMSPTAGHIF   61
             +TF +V    F+     VL +INF ++EG F +++G SGSGKST+L + +GL+   ++G I+
Sbjct:     6 ITFNNVSKTFEDSGTQVLKNINFDLEEGKFYTLLGASGSGKSTILNIMAGLLDASSGDIY   65

Query:    62 FDGKDLNQLEPIESRKMISYCFQTPHLFGN-TVEDNISFPYHIR--HEKVDYRRVDDLFQ  118
             DG+ +N L PI   R   I    FQ    LF + TV +N++F       +K    +RV +   +
Sbjct:    66 LDGERINDL-PINKRD-IHTVFQNYALFPHMTVFENVAFALKLKKVDKKEIAKRVKETLK  123

Query:   119 RFEMDQSYLKQDVKKLSGGEKQRIALIRQLLFEPKVLLLDEVTSALDNHNKAIVEKVIKS  178
                ++ + +   + ++KLSGG++QR+A+ R ++ +P+V+LLDE   SALD    +  ++  ++
Sbjct:   124 MVQL-EGFENRSIQKLSGGQRQRVAIARAIINQPRVVLLDEPLSALDLKLRTEMQYELRE  182

Query:   179 LHDK-GITILWITHDEEQSRRFANKVLKVVNGSI                           211
             L   + GIT +++THD+E++     ++ +   + G I
Sbjct:   183 LQQRLGITFVFVTHDQEEALAMSDWIFVMNEGEI                           216
```

Based on this analysis, it was predicted that these proteins and their epitopes could be useful antigens for vaccines or diagnostics.

EXAMPLE 398

A DNA sequence (GBSx0432) was identified in *S. agalactiae* <SEQ ID 1293> which encodes the amino acid sequence <SEQ ID 1294>. Analysis of this protein sequence reveals the following:

```
Possible site: 32
>>> Seems to have no N-terminal signal sequence

----- Final Results -----
            bacterial cytoplasm --- Certainty = 0.0658(Affirmative) < succ>
            bacterial membrane  --- Certainty = 0.0000(Not Clear)   < succ>
            bacterial outside   --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 399

A DNA sequence (GBSx0434) was identified in *S. agalactiae* <SEQ ID 1295> which encodes the amino acid sequence <SEQ ID 1296>. This protein is predicted to be deda protein (dedA). Analysis of this protein sequence reveals the following:

```
Possible site: 58
>>> Seems to have no N-terminal signal sequence
    INTEGRAL    Likelihood = -12.05    Transmembrane    186-202 (178-208)
    INTEGRAL    Likelihood = -8.81     Transmembrane    65-81 (61-89)
    INTEGRAL    Likelihood = -7.54     Transmembrane    26-42 (24-47)
    INTEGRAL    Likelihood = -0.37     Transmembrane    152-168 (152-168)

----- Final Results -----
            bacterial membrane --- Certainty = 0.5819(Affirmative) < succ>
            bacterial outside  --- Certainty = 0.0000(Not Clear)   < succ>
          bacterial cytoplasm  --- Certainty = 0.0000(Not Clear)   < succ>
```

The protein has homology with the following sequences in the GENPEPT database:

```
>GP: AAC75377 GB: AE000320 orf, hypothetical protein
[Escherichia coli K12]
Identities = 91/211 (43%), Positives = 131/211 (61%), Gaps = 7/211 (3%)

Query:    2 FLIDFILHIDTHIYAMANTVGNWTYLLLFLVIFVETGAVIFPFLPGDSLLFAAGALAANP    61
            FLIDFILHID H+ +     G W Y +LFL++F ETG V+ PFLPGDSLLF AGALA+
Sbjct:    6 FLIDFILHIDVHLAELVAEYGVWVYAILFLILFCETGLVVTPFLPGDSLLFVAGALASLE   65

Query:   62 KMSFNIVTFLIIFFIAAFIGDSCNFLIGRTFGYRFIKHP---FFRRFIKEKNIRDAELYF   118
            +N+    +++ IAA +GD+ N+ IGR FG +   +P     FRR   +K        ++
Sbjct:   66 TNDLNVHMMVVLMLIAAIVGDAVNYTIGRLFGEKLFSNPNSKIFRRSYLDK----THQFY   121

Query:  119 EKKGTAAIILGRYIPIIRTFVPFVAGISQLPPKVFIKRAFIAALSWSVIATGSGFLFGNI   178
            EK G    IIL R++PI+RTF PFVAG+    +  F      I AL W ++ T+G+ FG I
Sbjct:  122 EKHGGKTIILARFVPIVRTFAPFVAGMGHMSYRHFAAYNVIGALLWVLLFTYAGYFFGTI   181

Query:  179 PFVKQHFSLIILGIVFVTLIPVLISGVKSYR                              209
            P V+ +  L+I+GI+ V+++P +I   ++ R
Sbjct:  182 PMVQDNLKLLIVGIIVVSILPGVIEIIRHKR                              212
```

No corresponding DNA sequence was identified in *S. pyogenes*.

Based on this analysis, it was predicted that this protein and its epitopes, could be useful antigens for vaccines or diagnostics.

EXAMPLE 400

A DNA sequence (GBSx0435) was identified in *S. agalactiae* <SEQ ID 1297> which encodes the amino acid sequence <SEQ ID 1298>. Analysis of this protein sequence reveals the following:

```
Possible Site: 18
>>> Seems to have no N-terminal signal sequence

----- Final Results -----
          bacterial cytoplasm --- Certainty = 0.3100(Affirmative) < succ>
           bacterial membrane --- Certainty = 0.0000(Not Clear)   < succ>
            bacterial outside --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 401

A DNA sequence (GBSx0436) was identified in *S. agalactiae* <SEQ ID 1299> which encodes the amino acid sequence <SEQ ID 1300>. This protein is predicted to be DNA-entry nuclease. Analysis of this protein sequence reveals the following:

```
Possible site: 51
>>> Seems to have no N-terminal signal sequence

----- Final Results -----
            bacterial cytoplasm --- Certainty = 0.3990(Affirmative) < succ>
             bacterial membrane --- Certainty = 0.0000(Not Clear)   < succ>
              bacterial outside --- Certainty = 0.0000(Not Clear)   < succ>
```

A related GBS nucleic acid sequence <SEQ ID 9323> which encodes amino acid sequence <SEQ ID 9324> was also identified.

The protein has homology with the following sequences in the GENPEPT database:

```
>GP: CAA38134 GB: X54225 membrane nuclease [Streptococcus pneumoniae]
Identities = 87/157 (55%), Positives = 110/157 (69%), Gaps = 1/157 (0%)

Query:   1 MLDRTIRQYQNRRDTTLPDANWKPLGWHQVAT-NDHYGHAVDKGHLIAYALAGNFKGWDA   59
           +L +  RQY+NR++T     +W P GWHQV     Y HAVD+GHL+ YAL G   G+DA
Sbjct: 116 LLSKATRQYKNRKETGNGSTSWTPPGWHQVKNLKGSYTHAVDRGHLLGYALIGGLDGFDA 175

Query:  60 SVSNPQNVVTQTAHSNQSNQKINRGQNYYESLVRKAVDQNKRVRYRVTPLYRNDTDLVPF  119
           S SNP+N+  QTA +NQ+ + + GQNYYES VRKA+DQNKRVRYRVT  Y ++ DLVP
Sbjct: 176 STSNPKNIAVQTAWANQAQAEYSTGQNYYESKVRKALDQNKRVRYRVTLYYASNEDLVPS 235

Query: 120 AMHLEAKSQDGTLEFNVAIPNTQASYTMDYATGEITL                         156
           A  +EAKS DG LEFNV +PN Q    +DY TGE+T+
Sbjct: 236 ASQIEAKSSDGELEFNVLVPNVQKGLQLDYRTGEVTV                         272
```

A related DNA sequence was identified in *S. pyogenes* <SEQ ID 1301> which encodes the amino acid sequence <SEQ ID 1302>. Analysis of this protein sequence reveals the following:

```
Possible site: 42
>>> Seems to have a cleavable N-term signal seq.

----- Final Results -----
              bacterial outside --- Certainty = 0.3000(Affirmative) < succ>
             bacterial membrane --- Certainty = 0.0000(Not Clear)   < succ>
            bacterial cytoplasm --- Certainty = 0.0000(Not Clear)   < succ>
```

The protein has homology with the following sequences in the databases:

```
>GP: CAA38134 GB: X54225 membrane nuclease [Streptococcus pneumoniae]
Identities = 89/135 (65%), Positives = 104/135 (76%), Gaps = 1/135 (0%)

Query:  25 SPAGWHRLHHLKGSYDHAVDRGHLLGYALVGGLKGFDASTGNPDNIATQLSWANQANKPY   84
           +P GWH++ +LKGSY HAVDRGHLLGYAL+GGL GFDAST NP NIA Q +WANQA   Y
Sbjct: 138 TPPGWHQVKNLKGSYTHAVDRGHLLGYALIGGLDGFDASTSNPKNIAVQTAWANQAQAEY 197

Query:  85 LTGQNYYEGLVRRALDKGHRVRYRVTLLY-DGDNLLASGSHLEAKSSDDSLTFNVFVPNV  143
           TGQNYYE VR+ALD+ RVRYRVTL Y   ++L+ S S +EAKSSD  L FNV VPNV
Sbjct: 198 STGQNYYESKVRKALDQNKRVRYRVTLYYASNEDLVPSASQIEAKSSDGELEFNVLVPNV 257

Query: 144 QAGLTADYRTGQIAI                                               158
           Q GL  DYRTG++ +
Sbjct: 258 QKGLQLDYRTGEVTV                                               272
```

An alignment of the GAS and GBS proteins is shown below:

```
Identities = 73/135 (54%), Positives = 92/135 (68%), Gaps = 2/135 (1%)

Query:  24 PLGWHQVA-TNDHYGHAVDKGHLIAYALAGNFKGWDASVSNPQNVVTQTAHSNQSNQKIN   82
           P GWH++         Y HAVD+GHL+ YAL G   KG+DAS  NP N+  TQ + +NQ+N+
Sbjct:  26 PAGWHRLHHLKGSYDHAVDRGHLLGYALVGGLKGFDASTGNPDNIATQLSWANQANKPYL   85
```

```
-continued
Query:    83 RGQNYYESLVRKAVDQNKRVRYRVTPLYRNDTDLVPFAMHLEAKSQDGTLEFNVAIPNTQ  142
             GQNYYE LVR+A+D+   RVRYRVT LY  D +L+     HLEAKS D +L FNV +PN Q
Sbjct:    86 TGQNYYEGLVRRALDKGHRVRYRVTLLYDGD-NLLASGSHLEAKSSDDSLTFNVFVPNVQ  144

Query:   143 ASYTMDYATGEITLN                                              157
             A  T DY TG+I +N
Sbjct:   145 AGLTADYRTGQIAIN                                              159
```

Figure 186:
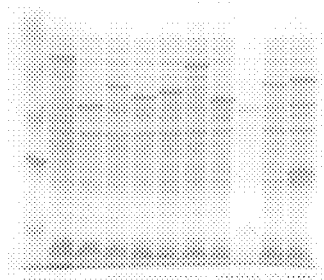

SEQ ID 9324 (GBS656) was expressed in *E. coli* as a GST-fusion product. SDS-PAGE analysis of total cell extract is shown in FIG. 186 (lane 10; MW 57 kDa).

Figure 236:
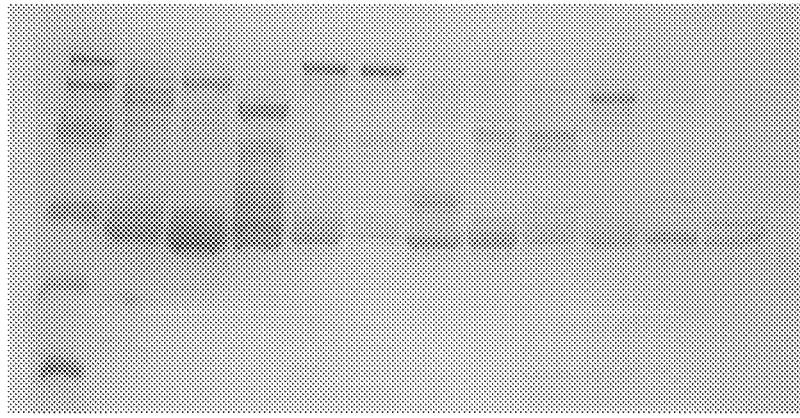

GBS656-GST was purified as shown in FIG. 236, lane 4.

Based on this analysis, it was predicted that these proteins and their epitopes could be useful antigens for vaccines or diagnostics.

EXAMPLE 402

A DNA sequence (GBSx0437) was identified in *S. agalactiae* <SEQ ID 1303> which encodes the amino acid sequence <SEQ ID 1304>. Analysis of this protein sequence reveals the following:

```
Possible site: 13
>>> Seems to have a cleavable N-term signal seq.

----- Final Results -----
              bacterial outside  --- Certainty = 0.3000(Affirmative) < succ>
              bacterial membrane --- Certainty = 0.0000(Not Clear)   < succ>
              bacterial cytoplasm --- Certainty = 0.0000(Not Clear)  < succ>
```

A related GBS nucleic acid sequence <SEQ ID 9321> which encodes amino acid sequence <SEQ ID 9322> was also identified.

The protein has no significant homology with any sequences in the GENPEPT database.

A related DNA sequence was identified in *S. pyogenes* <SEQ ID 1305> which encodes the amino acid sequence <SEQ ID 1306>. Analysis of this protein sequence reveals the following:

```
Possible site: 47
>>> Seems to have no N-terminal signal sequence

----- Final Results -----
              bacterial cytoplasm --- Certainty = 0.5350(Affirmative) < succ>
              bacterial membrane  --- Certainty = 0.0000(Not Clear)   < succ>
              bacterial outside   --- Certainty = 0.0000(Not Clear)   < succ>
```

An alignment of the GAS and GBS proteins is shown below:

```
Identities = 24/73 (32%), Positives = 37/73 (49%),
Gaps = 2/73 (2%)

Query:     1 MFYMKLANRLSLAATIVNEANANSPFGIIHSDKAENVEWNDFETQFPDLFNSPKKEESP   60
             + YMKLA    L  TI+ E +  SPF I+H+D A N++     E      N    +++P
Sbjct:    80 ILYMKLAKENHLPVTIITETHMTSPFAFILHTDHAINLKETRLEVILKQTKNDQLSKQTP  139

Query:    61 K--KSLWQHFFSQ                                                71
             +   KS W+ F +
Sbjct:   140 EKTKSFWKRFLKK                                                152
```

Based on this analysis, it was predicted that these proteins and their epitopes could be useful antigens for vaccines or diagnostics.

EXAMPLE 403

A DNA sequence (GBSx0438) was identified in *S. agalactiae* <SEQ ID 1307> which encodes the amino acid sequence <SEQ ID 1308>. This protein is predicted to be Isopentenyl-diphosphate delta-isomerase. Analysis of this protein sequence reveals the following:

```
Possible site: 39
>>> Seems to have no N-terminal signal sequence

----- Final Results -----
            bacterial cytoplasm --- Certainty = 0.1649(Affirmative) < succ>
             bacterial membrane --- Certainty = 0.0000(Not Clear)  < succ>
              bacterial outside --- Certainty = 0.0000(Not Clear)  < succ>
```

The protein has homology with the following sequences in the GENPEPT database:

```
>GP: AAG20030 GB: AE005083 isopentenyl pyrophosphate isomerase; Idi
[Halobacterium sp. NRC-1]
Identities = 24/77 (31%), Positives = 40/77 (51%)

Query:  14 TGLTLNRDQNIPQGLFHLVVDVILFHEDGDVLMMKRHPKKKAFPAYFEATAGGSALKGEN   73
           TGL    D +   G+ H    +LF EDG VL+ +R  +K+ +  +++ T      ++G++
Sbjct:  42 TGLANRLDAHTGDGVRHRAFTCLLFDEDGRVLLAQRADRKRLWDTHWDGTVASHPIEGQS  101

Query:  74 AKQAILRELKEETGIVP                                            90
           A   + L EE GI P
Sbjct: 102 QVDATRQRLAEELGIEP                                           118
```

No corresponding DNA sequence was identified in *S. pyogenes*.

Based on this analysis, it was predicted that this protein and its epitopes, could be useful antigens for vaccines or diagnostics.

EXAMPLE 404

A DNA sequence (GBSx0439) was identified in *S. agalactiae* <SEQ ID 1309> which encodes the amino acid sequence <SEQ ID 1310>. This protein is predicted to be phosphoserine phosphatase (serB). Analysis of this protein sequence reveals the following:

```
Possible site: 35
>>> Seems to have no N-terminal signal sequence

----- Final Results -----
            bacterial cytoplasm --- Certainty = 0.0613(Affirmative) < succ>
             bacterial membrane --- Certainty = 0.0000(Not Clear)  < succ>
              bacterial outside --- Certainty = 0.0000(Not Clear)  < succ>
```

The protein has homology with the following sequences in the GENPEPT database:

```
>GP: CAB50876 GB: AL096844 putative phosphoserine phosphatase
[Streptomyces coelicolor A3(2)]
Identities = 96/193 (49%), Positives = 132/193 (67%)

Query:   5 LLVMDVDSTLIMEEAIDLLAIEAGVGKQVAALTDAAMRGELDFEEALKKRVALLKGLPVT   64
           L+VMDVDSTLI +E I+L A   AG   +VA +T AAMRGELDFE++L  RVALL GL  +
Sbjct: 183 LVVMDVDSTLIQDEVIELFAAHAGCEDEVAEVTAAAMRGELDFEQSLHARVALLAGLDAS  242

Query:  65 ILTDILSSIHFTPGAYELIKECHKRQMKVGLVSGGFHETIDILAKQLQVDYVKANRLGVK  124
           ++  + + +    TPGA  LI+   +   +VG+VSGGF + D  +QL +D+ +AN L  +
Sbjct: 243 VVDKVRAEVRLTPGARTLIRTLKRLGYQVGVVSGGFTQVTDALQEQLGLDFAQANTLEIV  302
```

```
Query: 125 GGFLTGEVEGEIVTKEVKKIKLKEWASENHLDLSQTIAMGDGANDLPMIKSAGVGIAFCA 184
           G LTG V GEIV + K   L+ +A+   + LSQT+A+GDGANDL M+ +AG+G+AF A
Sbjct: 303 DGRLTGRVTGEIVDRAGKARLLRRFAAAAGVPLSQTVAIGDGANDLDMLNAAGLGVAFNA 362

Query: 185 KPIVREEAAYQIN                                                197
           KP+VRE A   +N
Sbjct: 363 KPVVREAAHTAVN                                                375
```

No corresponding DNA sequence was identified in *S. pyogenes*.

Based on this analysis, it was predicted that this protein and its epitopes, could be useful antigens for vaccines or diagnostics.

EXAMPLE 405

A DNA sequence (GBSx0440) was identified in *S. agalactiae* <SEQ ID 1311> which encodes the amino acid sequence <SEQ ID 1312>. Analysis of this protein sequence reveals the following:

```
Possible site: 23
>>> Seems to have an uncleavable N-term signal seq
    INTEGRAL    Likelihood = -17.88    Transmembrane   5-21 (1-29)

----- Final Results -----
            bacterial membrane --- Certainty = 0.8153(Affirmative) < succ>
            bacterial outside  --- Certainty = 0.0000(Not Clear)   < succ>
            bacterial cytoplasm --- Certainty = 0.0000(Not Clear)   < succ>
```

The protein has homology with the following sequences in the GENPEPT database:

```
>GP: BAB06924 GB: AP001518 unknown conserved
protein [Bacillus halodurans]
Identities = 122/553 (22%), Positives = 265/553 (47%),
Gaps = 12/553 (2%)

Query:   7 LLLVAIVLLVIIAYVVGVVIRKRNDTLIANLETRKQELVDLPVQEEIEQVKLLHLIGQSQ  66
           +++ ++++L +  +V G + RK      + LE  K +++  P+ +EI +VK L + G+++
Sbjct:   3 IVVFSLLVLTVTFFVYGALRRKAFYKRVDKLEDWKNDILQRPIPDEIGKVKGLTMSGETE  62

Query:  67 STFREWNQKWTDLSTNSFKDIDFHLVEAENLNDSFNFVRAKHEIDNVDSQLTIIEEDIVS 126
             F   W   W D+     +++  L + E+  + + F +AK  +D ++ +L  IEE +
Sbjct:  63 EKFEVWRSDWDDIVGVILPNVEEQLFDVEDFANKYRFQKAKALLDTIEQRLHSIEEQLKI 122

Query: 127 IREALEVLKEQEEKNSARVTHALDLYETLQKSISEKEDNYGTTMPEIEKQLKNIEAEFSH 186
           + + ++VL + EE+N +       +L + L K    +  +       +++++L+
Sbjct: 123 MVDDIQVLVQSEEQNRTEIGSVRELQQKLIKEAITRRGSLSSSAKVFDEKLEKANELLQA 182

Query: 187 FVTLNSTGDPIEASEVLNKAEEHTIALGQITEQIPAIVAKLEDDFPDQLDDLETGYRRLL 246
           F       G+  I+ASEVL +A+E     + +  +P + +L+ +  P +L +L   G R +
Sbjct: 183 FDERTEKGNYIQASEVLEEAKELLGQIEHLLKIVPGLFVELQTNIPAELTNLKNGLRDME 242

Query: 247 EENYHFPEKDIEQRFQEVREAIRSNSDGLVSLDLDRARDENEHIQEKIDKLYDIFEREIA 306
           E    +      I+ + + +  E      + L  L+ +    +E    I+E +++++++  E+E+
Sbjct: 243 EAGFFLETFAIDSQMERLEEKRVELLEQLTVLECNGMEEEINFIEESMEQMFELLEKEVE 302

Query: 307 AYKVAHKDSKIIPQFLAHAKSNNEQLGH---EIKRLSAKYILNENESLSLRSFTNDLEEI 363
           A     ++ + ++P           E+L H     E ++   Y L E E  +     +L+E+
Sbjct: 303 A---KNEITILLPNLREDLTKTEEKLTHLKEETESVQLSYRLAEEELVFQQKLGKELKEL 359

Query: 364 ETKVLPSVENFGQEASPYTHLQILFERTLKTLTTVEENQMEVFEAVKTIESVETRARQNM 423
                  ++   E   ++  ++ ++ + E    + LT  +    + E++  ++  E +A++ +
Sbjct: 360 RQQLQVIDEVTEEQKQTFSSVRSMLEEWREGLTACQNKIEQAQESLNSLRKDELKAKEEL 419

Query: 424 DKYVNKLHMIKRFMEKRNLPGIPQDFLSTFFTTSSQIEALINELSRGRIDIEAVSRLNDV 483
             +   KL    KR ++K  N+PG+P+  L        ++    I +LS   +++ V+ L D
Sbjct: 420 KQLKEKLLEDKRLVQKSNIPGLPETLLHRLEDGEQKLAQAIAKLSDVPLEMGRVTALVDE 479

Query: 484 TTNAIANLEQATYLVVQDATLTEQLLQYSNRYRSFEQNVQKSFEQALYLFEVEHNYKASF 543
                  I   +   ++ A L E  ++QY NRYRS      V+K    A  LF           +
Sbjct: 480 AQGLIHENSSILHETIEKARLAEHVIQYGNRYRSRSAEVKKRLSNAEELFRA-----FEY 534
```

```
Query: 544 DE-ISYALETVEP                                              555
            DE I  A++ +EP
Sbjct: 535 DEAIEMAVQAIEP                                              547
```

5

A related DNA sequence was identified in *S. pyogenes* <SEQ ID 1313> which encodes the amino acid sequence <SEQ ID 1314>. Analysis of this protein sequence reveals the following:

```
Possible site: 23
>>> Seems to have an uncleavable N-term signal seq
     INTEGRAL    Likelihood = -18.04    Transmembrane    5-21 (1-29)

----- Final Results -----
             bacterial membrane --- Certainty = 0.8217(Affirmative) < succ>
             bacterial outside  --- Certainty = 0.0000(Not Clear)   < succ>
             bacterial cytoplasm --- Certainty = 0.0000(Not Clear)  < succ>
```

The protein has homology with the following sequences in the databases:

```
>GP: BAB06924 GB: AP001518 unknown conserved
protein [Bacillus halodurans]
Identities = 131/555 (23%), Positives = 269/555 (47%),
Gaps = 16/555 (2%)

Query:   7 LLIVAIVLLVIIAYLVGVIIRKRNDSLITSLEERKQALFALPVNDEIEEVKSLHLIGQSQ   66
           +++ ++++L +  ++ G + RK      LE+ K  +   P+ DEI +VK L + G+++
Sbjct:   3 IVVFSLLVLTVTFFVYGALRRKAFYKRVDKLEDWKNDILQRPIPDEIGKVKGLTMSGETE   62

Query:  67 TSFREWNQKWVDLTVNSFADIENHIFEAENLNDTFNFIRAKHEINSVESQLNLVEEDIAS  126
             F   W D+      ++E  +F+ E+  + + F +AK ++++E +L+ +EE +
Sbjct:  63 EKFEVWRSDWDDIVGVILPNVEEQLFDVEDFANKYRFQKAKALLDTIEQRLHSIEEQLKI  122

Query: 127 IREALNILKEQEEKNSARVTHALDLYEKLQASISENEDNFGSTMPEIDKQMKNIETEFSQ  186
           + + + +L + EE+N  +      +L +KL           + S+    D++++
Sbjct: 123 MVDDIQVLVQSEEQNRTEIGSVRELQQKLIKEAITRRGSLSSSAKVFDEKLEKANELLQA  182

Query: 187 FVALNSSGDPVEASEVLDRAEEHTIALGQITEQIPAIVAKLEDDFPDQLDDLETGYRRLL  246
           F     G+ ++ASEVL+ A+E   +  + +P +  +L+ + P +L +L+ G R +
Sbjct: 183 FDERTEKGNYIQASEVLEEAKELLGQIEHLLKIVPGLFVELQTNIPAELTNLKNGLRDME  242

Query: 247 EENYHFPEKNIEARFQEIRESIRANSSELVTLDLDRAREENTHIQERIDSLYEVFEREIA  306
           E +      I+++ + + E      +L  L+ +    EE   I+E ++ ++E+ E+E
Sbjct: 243 EAGFFLETFAIDSQMERLEEKRVELLEQLTVLECNGMEEEINFIEESMEQMFELLEKE--  300

Query: 307 AYKVAAKN--SKMLPRYLEHVKRNNEQ---LKDEIARLSRKYILSETESLTVKAFEKDIK  361
             V AKN +  +LP   E + + E+    LK+E  +  Y L+E E +  + K++K
Sbjct: 301 ---VEAKNEITILLPNLREDLTKTEEKLTHLKEETESVQLSYRLAEEELVFQQKLGKELK  357

Query: 362 EIEDSTLAVAEQFGLQEKPFSELQVTFERSIKTLTNVESGQMDVFAAVKDIEKIESQARH  421
           E+    + E   Q++ FS ++     E   + LT ++          ++  + K E +A+
Sbjct: 358 ELRQQLQVIDEVTEEQKQTFSSVRSMLEEWREGLTACQNKIEQAQESLNSLRKDELKAKE  417

Query: 422 NLDVYVTQLHMIKRYMEKRHLPGIPQDFLSAFFTTSSQLEALMDELSRGRINIEAVSRLS  481
               L     +L  KR ++K ++PG+P+  L          +L  + +LS + +  V+ L
Sbjct: 418 ELKQLKEKLLEDKRLVQKSNIPGLPETLLHRLEDGEQKLAQAIAKLSDVPLEMGRVTALV  477

Query: 482 EVATVAIANLEDLTYQVVQNATLTEQLLQYSNRYRSFEAGVQSSFEHALRLFEVENDYQA  541
            + A  I     + ++ ++ A L E ++QY NRYRS  A V+     +A  LF
Sbjct: 478 DEAQGLIHENSSILHETIEKARLAEHVIQYGNRYRSRSAEVKKRLSNAEELFRA-----F  532

Query: 542 SFDE-ISYALETVEP                                              555
           +DE I  A++ +EP
Sbjct: 533 EYDEAIEMAVQAIEP                                              547
```

An alignment of the GAS and GBS proteins is shown below:

```
Identities = 429/574 (74%), Positives = 503/574 (86%)

Query:   1 MSSGIILLLVAIVLLVIIAYVVGVVIRKRNDTLIANLETRKQELVDLPVQEEIEQVKLLH   60
           MSSGIILL+VAIVLLVIIAY+VGV+IRKRND+LI +LE RKQ L  LPV +EIE+VK LH
```

```
                        -continued
Sbjct:    1 MSSGIILLIVAIVLLVIIAYLVGVIIRKRNDSLITSLEERKQALFALPVNDEIEEVKSLH   60

Query:   61 LIGQSQSTFREWNQKWTDLSTNSFKDIDFHLVEAENLNDSFNFVRAKHEIDNVDSQLTII  120
            LIGQSQ++FREWNQKW DL+ NSF DI+ H+ EAENLND+FNF+RAKHEI++V+SQL ++
Sbjct:   61 LIGQSQTSFREWNQKWVDLTVNSFADIENHIFEAENLNDTFNFIRAKHEINSVESQLNLV  120

Query:  121 EEDIVSIREALEVLKEQEEKNSARVTHALDLYETLQKSISEKEDNYGTTMPEIEKQLKNI  180
            EEDI SIREAL +LKEQEEKNSARVTHALDLYE LQ SISE EDN+G+TMPEI+KQ+KNI
Sbjct:  121 EEDIASIREALNILKEQEEKNSARVTHALDLYEKLQASISENEDNFGSTMPEIDKQMKNI  180

Query:  181 EAEFSHFVTLNSTGDPIEASEVLNKAEEHTIALGQITEQIPAIVAKLEDDFPDQLDDLET  240
            E EFS FV LNS+GDP+EASEVL++AEEHTIALGQITEQIPAIVAKLEDDFPDQLDDLET
Sbjct:  181 ETEFSQFVALNSSGDPVEASEVLDRAEEHTIALGQITEQIPAIVAKLEDDFPDQLDDLET  240

Query:  241 GYRRLLEENYHFPEKDIEQRFQEVREAIRSNSDGLVSLDLDRARDENEHIQEKIDKLYDI  300
            GYRRLLEENYHFPEK+IE RFQE+RE+IR+NS  LV+LDLDRAR+EN HIQE+ID LY++
Sbjct:  241 GYRRLLEENYHFPEKNIEARFQEIRESIRANSSELVTLDLDRAREENTHIQERIDSLYEV  300

Query:  301 FEREIAAYKVAHKDSKIIPQFLAHAKSNNEQLGHEIKRLSAKYILNENESLSLRSFTNDL  360
            FEREIAAYKVA K+SK++P++L H K NNEQL  EI RLS KYIL+E ESL++++F  D+
Sbjct:  301 FEREIAAYKVAAKNSKMLPRYLEHVKRNNEQLKDEIARLSRKYILSETESLTVKAFEKDI  360

Query:  361 EEIETKVLPSVENFGQEASPYTHLQILFERTLKTLTTVEENQMEVFEAVKTIESVETRAR  420
             +EIE   L   E FG +  P++ LQ+ FER++KTLT VE  QM+VF AVK IE +E++AR
Sbjct:  361 KEIEDSTLAVAEQFGLQEKPFSELQVTFERSIKTLTNVESGQMDVFAAVKDIEKIESQAR  420

Query:  421 QNMDKYVNKLHMIKRFMEKRNLPGIPQDFLSTFFTTSSQIEALINELSRGRIDIEAVSRL  480
             N+D YV +LHMIKR+MEKR+LPGIPQDFLS FFTTSSQ+EAL++ELSRGRI+IEAVSRL
Sbjct:  421 HNLDVYVTQLHMIKRYMEKRHLPGIPQDFLSAFFTTSSQLEALMDELSRGRINIEAVSRL  480

Query:  481 NDVTTNAIANLEQATYLVVQDATLTEQLLQYSNRYRSFEQNVQKSFEQALYLFEVEHNYK  540
            ++V T AIANLE  TY VVQ+ATLTEQLLQYSNRYRSFE  VQ SFE AL LFEVE++Y+
Sbjct:  481 SEVATVAIANLEDLTYQVVQNATLTEQLLQYSNRYRSFEAGVQSSFEHALRLFEVENDYQ  540

Query:  541 ASFDEISYALETVEPGVTDRFVTSYEKTQERIRF                           574
            ASFDEISYALETVEPGVTDRFV SYEKT+E IRF
Sbjct:  541 ASFDEISYALETVEPGVTDRFVNSYEKTREHIRF                           574
```

Figure 142:
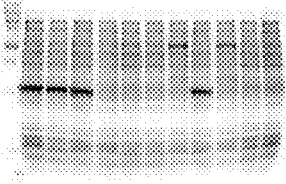

SEQ ID 1312 (GBS642) was expressed in *E. coli* as a GST-fusion product. SDS-PAGE analysis of total cell extract is shown in FIG. 142 (lane 24; MW 27 kDa).

Based on this analysis, it was predicted that these proteins and their epitopes could be useful antigens for vaccines or diagnostics.

EXAMPLE 406

A DNA sequence (GBSx0441) was identified in *S. agalactiae* <SEQ ID 1315> which encodes the amino acid sequence <SEQ ID 1316>. Analysis of this protein sequence reveals the following:

```
Possible site: 41
>>> Seems to have no N-terminal signal sequence

----- Final Results -----
         bacterial cytoplasm --- Certainty = 0.2471(Affirmative) < succ>
         bacterial membrane  --- Certainty = 0.0000(Not Clear)   < succ>
          bacterial outside  --- Certainty = 0.0000(Not Clear)   < succ>
```

A related GBS nucleic acid sequence <SEQ ID 9671> which encodes amino acid sequence <SEQ ID 9672> was also identified.

The protein has homology with the following sequences in the GENPEPT database:

```
>GP: CAA91553 GB: Z67740 DNA gyrase [Streptococcus pneumoniae]
Identities = 574/650 (88%), Positives = 618/650 (94%), Gaps = 2/650 (0%)

Query:    1 MTEETKNMEQRAQEYDASQIQVLEGLEAVRMRPGMYIGSTSKEGLHHLVWEIVDNSIDEA   60
            MTEE KN++   AQ+YDASQIQVLEGLEAVRMRPGMYIGSTSKEGLHHLVWEIVDNSIDEA
Sbjct:    1 MTEEIKNLQ--AQDYDASQIQVLEGLEAVRMRPGMYIGSTSKEGLHHLVWEIVDNSIDEA   58
```

-continued

```
Query:  61 LAGFAGHIKVYIEPDNSITVVDDGRGIPVDIQEKTGRPAVETVFTVLHAGGKFGGGGYKV 120
           LAGFA HI+V+IEPD+SITVVDDGRGIPVDIQEKTGRPAVETVFTVLHAGGKFGGGGYKV
Sbjct:  59 LAGFASHIQVFIEPDDSITVVDDGRGIPVDIQEKTGRPAVETVFTVLHAGGKFGGGGYKV 118

Query: 121 SGGLHGVGSSVVNALSTQLDVKVYKNGKVHYQEYQRGVVVNDLEIIGDTDLSGTTVHFTP 180
           SGGLHGVGSSVVNALSTQLDV +KNGK+HYQEY+RG VV DLE++GDTD +GTTVHFTP
Sbjct: 119 SGGLHGVGSSVVNALSTQLDVHVHKNGKIHYQEYRRGHVVADLEVVGDTDRTGTTVHFTP 178

Query: 181 DPEIFTETTVFDFDKLAKRIQELAFLNRGLRISISDKREGQEVEKEYHYEGGIGSYVEFI 240
           DPEIFTETT+FDFDKL KRIQELAFLNRGL+ISI+DKR+G E  K YHYEGGI SYVE+I
Sbjct: 179 DPEIFTETTIFDFDKLNKRIQELAFLNRGLQISITDKRQGLEQTKHYHYEGGIASYVEYI 238

Query: 241 NENKEVIFENPIYTDGELDGISVEVAMQYTTGYQETVMSFANNIHTHEGGTHEQGFRTAL 300
           NENK+VIF+ PIYTDGE+D I+VEVAMQYTTGY E VMSFANNIHTHEGGTHEQGFRTAL
Sbjct: 239 NENKDVIFDTPIYTDGEMDDITVEVAMQYTTGYHENVMSFANNIHTHEGGTHEQGFRTAL 298

Query: 301 TRVINDYAKKNKILKENEDNLTGEDVREGLTAVISVKHPNPQFEGQTKTKLGNSEVVKIT 360
           TRVINDYA+KNK+LK+NEDNLTGEDVREGLTAVISVKHPNPQFEGQTKTKLGNSEVVKIT
Sbjct: 299 TRVINDYARKNKLLKDNEDNLTGEDVREGLTAVISVKHPNPQFEGQTKTKLGNSEVVKIT 358

Query: 361 NRLFSEAFNRFLLENPQVAKKIVEKGILASKARIAAKRAREVTRKKSGLEISNLPGKLAD 420
           NRLFSEAF+ FL+ENPQ+AK+IVEKGILA+KAR+AAKRAREVTRKKSGLEISNLPGKLAD
Sbjct: 359 NRLFSEAFSDFLMENPQIAKRIVEKGILAAKARVAAKRAREVTRKKSGLEISNLPGKLAD 418

Query: 421 CSSNNAEMNELFIVEGDSAGGSAKSGRNREFQAILPIRGKILNVEKATMDKILANEEIRS 480
           CSSNN    ELFIVEGDSAGGSAKSGRNREFQAILPIRGKILNVEKA+MDKILANEEIRS
Sbjct: 419 CSSNNPAETELFIVEGDSAGGSAKSGRNREFQAILPIRGKILNVEKASMDKILANEEIRS 478

Query: 481 LFTAMGTGFGADFDVSKVRYQKLVIMTDADVDGAHIRTLLLTLIYRFMRPVLEAGYVYIA 540
           LFTAMGTGFGA+FDVSK RYQKLV+MTDADVDGAHIRTLLLTLIYR+M+P+LEAGYVYIA
Sbjct: 479 LFTAMGTGFGAEFDVSKARYQKLVLMTDADVDGAHIRTLLLTLIYRYMKPILEAGYVYIA 538

Query: 541 QPPIYGVKVGSEIKAYIQPGVNQEEELRQALDTYSSGRSKPTVQRYKGLGEMDDHQLWET 600
           QPPIYGVKVGSEIK YIQPG +QE +L++AL  YS GR+KPT+QRYKGLGEMDDHQLWET
Sbjct: 539 QPPIYGVKVGSEIKEYIQPGADQEIKLQEALARYSEGRTKPTIQRYKGLGEMDDHQLWET 598

Query: 601 TMDPENRLMARVSVDDAAEADKIFDMLMGDRVEPRREFIEANAVYSNLDI 650
           TMDPE+RLMARVSVDDAAEADKIFDMLMGDRVEPRREFIE NAVYS LD+
Sbjct: 599 TMDPEHRLMARVSVDDAAEADKIFDMLMGDRVEPRREFIEENAVYSTLDV 648
```

A related DNA sequence was identified in *S. pyogenes* <SEQ ID 1317> which encodes the amino acid sequence <SEQ ID 1318>. Analysis of this protein sequence reveals the following:

```
Possible site: 41
>>> Seems to have no N-terminal signal sequence

----- Final Results -----
         bacterial cytoplasm --- Certainty = 0.1698(Affirmative) < succ>
          bacterial membrane --- Certainty = 0.0000(Not Clear)   < succ>
           bacterial outside --- Certainty = 0.0000(Not Clear)   < succ>
```

An alignment of the GAS and GBS proteins is shown below:

```
Identities = 584/650 (89%), Positives = 618/650 (94%)
Query:   1 MTEETKNMEQRAQEYDASQIQVLEGLEAVRMRPGMYIGSTSKEGLHHLVWEIVDNSIDEA 60
           M EE K+ E++ QEYDASQIQVLEGLEAVRMRPGMYIGST+KEGLHHLVWEIVDNSIDEA
Sbjct:   1 MIEENKHFEKKMQEYDASQIQVLEGLEAVRMRPGMYIGSTAKEGLHHLVWEIVDNSIDEA 60

Query:  61 LAGFAGHIKVYIEPDNSITVVDDGRGIPVDIQEKTGRPAVETVFTVLHAGGKFGGGGYKV 120
           LAGFA  HIKV+IE DNSITVVDDGRGIPVDIQ KTGRPAVETVFTVLHAGGKFGGGGYKV
Sbjct:  61 LAGFASHIKVFIEADNSITVVDDGRGIPVDIQAKTGRPAVETVFTVLHAGGKFGGGGYKV 120

Query: 121 SGGLHGVGSSVVNALSTQLDVKVYKNGKVHYQEYQRGVVVNDLEIIGDTDLSGTTVHFTP 180
           SGGLHGVGSSVVNALSTQLDV+VYKNG++HYQE++RG VV DLE+IG TD++GTTVHFTP
Sbjct: 121 SGGLHGVGSSVVNALSTQLDVRVYKNGQIHYQEFKRGAVVADLEVIGTTDVTGTTVHFTP 180

Query: 181 DPEIFTETTVFDFDKLAKRIQELAFLNRGLRISISDKREGQEVEKEYHYEGGIGSYVEFI 240
           DPEIFTETT FD+   LAKRIQELAFLNRGL+ISI+DKR G E+ + YEGGIGSYVEF+
Sbjct: 181 DPEIFTETTQFDYSVLAKRIQELAFLNRGLKISITDKRSGMEQEEHFLYEGGIGSYVEFL 240

Query: 241 NENKEVIFENPIYTDGELDGISVEVAMQYTTGYQETVMSFANNIHTHEGGTHEQGFRTAL 300
           N+ K+VIFE PIYTDGEL+GI+VEVAMQYTT YQETVMSFANNIHTHEGGTHEQGFR AL
```

```
-continued
Sbjct: 241 NDKKDVIFETPIYTDGELEGIAVEVAMQYTTSYQETVMSFANNIHTHEGGTHEQGFRAAL 300

Query: 301 TRVINDYAKKNKILKENEDNLTGEDVREGLTAVISVKHPNPQFEGQTKTKLGNSEVVKIT 360
           TRVINDYAKKNKILKENEDNLTGEDVREGLTAVISVKHPNPQFEGQTKTKLGNSEVVKIT
Sbjct: 301 TRVINDYAKKNKILKENEDNLTGEDVREGLTAVISVKHPNPQFEGQTKTKLGNSEVVKIT 360

Query: 361 NRLFSEAFNRFLLENPQVAKKIVEKGILASKARIAAKRAREVTRKKSGLEISNLPGKLAD 420
           NRLFSEAF RFLLENPQVA+KIVEKGILASKARIAAKRAREVTRKKSGLEISNLPGKLAD
Sbjct: 361 NRLFSEAFQRFLLENPQVARKIVEKGILASKARIAAKRAREVTRKKSGLEISNLPGKLAD 420

Query: 421 CSSNNAEMNELFIVEGDSAGGSAKSGRNREFQAILPIRGKILNVEKATMDKILANEEIRS 480
           CSSN+A  NELFIVEGDSAGGSAKSGRNREFQAILPIRGKILNVEKATMDKILANEEIRS
Sbjct: 421 CSSNDANQNELFIVEGDSAGGSAKSGRNREFQAILPIRGKILNVEKATMDKILANEEIRS 480

Query: 481 LFTAMGTGFGADFDVSKVRYQKLVIMTDADVDGAHIRTLLLTLIYRFMRPVLEAGYVYIA 540
           LFTAMGTGFGADFDVSK RYQKLVIMTDADVDGAHIRTLLLTLIYRFMRPVLEAGYVYIA
Sbjct: 481 LFTAMGTGFGADFDVSKARYQKLVIMTDADVDGAHIRTLLLTLIYRFMRPVLEAGYVYIA 540

Query: 541 QPPIYGVKVGSEIKAYIQPGVNQEEELRQALDTYSSGRSKPTVQRYKGLGEMDDHQLWET 600
           QPPIYGVKVGSEIK YIQPG++QE++L+ AL+ YS GRSKPTVQRYKGLGEMDDHQLWET
Sbjct: 541 QPPIYGVKVGSEIKEYIQPGIDQEDQLKTALEKYSIGRSKPTVQRYKGLGEMDDHQLWET 600

Query: 601 TMDPENRLMARVSVDDAAEADKIFDMLGDRVEPRREFIEANAVYSNLDI            650
           TMDPENRLMARV+VDDAAEADK+FDMLGDRVEPRR+FIE NAVYS LDI
Sbjct: 601 TMDPENRLMARVTVDDAAEADKVFDMLGDRVEPRRDFIEENAVYSTLDI            650
```

Based on this analysis, it was predicted that these proteins and their epitopes could be useful antigens for vaccines or diagnostics.

EXAMPLE 407

A DNA sequence (GBSx0442) was identified in *S. agalactiae* <SEQ ID 1319> which encodes the amino acid sequence <SEQ ID 1320>. Analysis of this protein sequence reveals the following:

```
Possible site: 26
>>> Seems to have no N-terminal signal sequence

----- Final Results -----
           bacterial cytoplasm --- Certainty = 0.3186(Affirmative) < succ>
            bacterial membrane --- Certainty = 0.0000(Not Clear)   < succ>
              bacterial outside --- Certainty = 0.0000(Not Clear)   < succ>
```

The protein has homology with the following sequences in the GENPEPT database:

```
>GP: CAA91552 GB: Z67740 unidentified [Streptococcus pneumoniae]
Identities = 82/142 (57%), Positives = 105/142 (73%)
Query:  45 LKESTADAIAYFIPEEADFLKEYKANEAKVLETPILFQGAKELLAKIQRQGSRNFLVSHR 104
           LK ST  AI   F P    +FL++YK NEA+ LE PILF+G  +LL  I  QG R+FLVSHR
Sbjct:   2 LKVSTPFAIETFAPNLENFLEKYKENEARELEHPILFEGVSDLLEDILNQGGRHFLVSHR  61

Query: 105 DNQVIVILEKTEIIDYFTEVVTADNGFSRKPSPESMLYLKEKYQIDNCLVIGDRDIDKQA 164
           ++QV+ ILEKT I  YFTEVVT+ +GF RKP+PESMLYL+EKYQI + LVIGDR ID +A
Sbjct:  62 NDQVLEILEKTSIAAYFTEVVTSSSGFKRKPNPESMLYLREKYQISSGLVIGDRPIDIEA 121

Query: 165 GESAGFDTLLVDGSKSLMEIIE                                      186
           G++AG DT L    +L ++++
Sbjct: 122 GQAAGLDTHLFTSIVNLRQVLD                                      143
```

A related DNA sequence was identified in *S. pyogenes* <SEQ ID 1321> which encodes the amino acid sequence <SEQ ID 1322>. Analysis of this protein sequence reveals the following:

```
Possible site: 59
>>> Seems to have no N-terminal signal sequence

----- Final Results -----
           bacterial cytoplasm --- Certainty = 0.2472(Affirmative) < succ>
```

```
              -continued
    bacterial membrane --- Certainty = 0.0000(Not Clear) < succ>
    bacterial outside  --- Certainty = 0.0000(Not Clear) < succ>
```

An alignment of the GAS and GBS proteins is shown below:

```
Identities = 122/185 (65%), Positives = 145/185 (77%)
Query:   1 MNYHDYIWDLGGTLLDNYESSTRAFVETLKEFGYQADHDSVYQKLKESTADAIAYFIPEE   60
           MNY DYIWDLGGTLLDNYE ST+AFV+TL  F     DHD+VYQKLKESTA A+A F P E
Sbjct:   4 MNYQDYIWDLGGTLLDNYELSTQAFVQTLAFFSLPGDHDAVYQKLKESTAIAVAMFAPNE   63

Query:  61 ADFLKEYKANEAKVLETPILFQGAKELLAKIQRQGSRNFLVSHRDNQVIVILEKTEIIDY  120
            +FL  Y+   EA L  PI    GAKE+L KI    GSRNFL+SHRD QV  +LE+  ++ Y
Sbjct:  64 PEFLHVYRLREADKLAQPIWCLGAKEILGKIATSGSRNFLISHRDCQVNQLLEQAGLLIY  123

Query: 121 FTEVVTADNGFSRKPSPESMLYLKEKYQIDNCLVIGDRDIDKQAGESAGFDTLLVDGSKS  180
           FTEVVTA NGF+RKP+PES+ YLKEKY I++ LVIGDR IDKQAG++AGF+TLLVDG K+
Sbjct: 124 FTEVVTASNGFARKPNPESLFYLKEKYDINSGLVIGDRLIDKQAGQAAGFNTLLVDGRKN  183

Query: 181 LMEII                                                         185
           L+EI+
Sbjct: 184 LLEIV                                                         188
```

Based on this analysis, it was predicted that these proteins and their epitopes could be useful antigens for vaccines or diagnostics.

EXAMPLE 408

A DNA sequence (GBSx0443) was identified in *S. agalactiae* <SEQ ID 1323> which encodes the amino acid sequence <SEQ ID 1324>. This protein is predicted to be stage V sporulation protein E (rodA). Analysis of this protein sequence reveals the following:

```
Possible site: 42
>>> Seems to have a cleavable N-term signal seq.
     INTEGRAL    Likelihood = -11.15    Transmembrane   206-222 (177-226)
     INTEGRAL    Likelihood = -10.14    Transmembrane    58-74  (50-82)
     INTEGRAL    Likelihood =  -9.34    Transmembrane   182-198 (177-205)
     INTEGRAL    Likelihood =  -8.55    Transmembrane   158-174 (156-177)
     INTEGRAL    Likelihood =  -8.12    Transmembrane   300-316 (299-324)
     INTEGRAL    Likelihood =  -2.66    Transmembrane    86-102 (83-102)
     INTEGRAL    Likelihood =  -2.34    Transmembrane   338-354 (338-357)

----- Final Results -----
          bacterial membrane  --- Certainty = 0.5458(Affirmative) < succ>
          bacterial outside   --- Certainty = 0.0000(Not Clear)   < succ>
          bacterial cytoplasm --- Certainty = 0.0000(Not Clear)   < succ>
```

A related GBS nucleic acid sequence <SEQ ID 9669> which encodes amino acid sequence <SEQ ID 9670> was also identified.

The protein has homology with the following sequences in the GENPEPT database:

```
>GP: CAB15838 GB: Z99123 alternate gene name: ipa-42d~similar to
cell-division protein [Bacillus subtilis]
Identities = 142/392 (36%), Positives = 237/392 (60%), Gaps = 23/392 (5%)
Query:  10 QKSNYFKGQIDYAVVIPVFFLLMIGLASIYVA-TMNDYPSNIYIAMFQQVSWIIMGCIIA   68
            Q+S +++G  D   +  VFF+  I + SIY A      Y +  +I    QQ+  + ++G +
Sbjct:   7 QQSPFYQG--DLIFIFGVFFI--ISVVSIYAAGQFGQYGNTDWI---QQIVFYLLGAVAI   59

Query:  69 FVVMLFSTEFLWKATPYLYALGLTLMVLPLIFYSPQLFAAT--GAKNWVTIGSVTLFQPS  126
            V++ F   E L K + Y++ +G+  +++ I    SP+  A    GAK+W  IG +T+ QPS
Sbjct:  60 TVLLYFDLEQLEKLSLYIFIIGILSLIILKI--SPESIAPVIKGAKSWFRIGRITI-QPS  116

Query: 127 EFMKISYILMLSRITVSFHQKNRKTFQDDWKLL-GLFGLVTLPVMILLMLQKDLGTALVF  185
            EFMK+  I+ML+ +     +  + K +T +DD  LL   G+  +PV ++LM  +D GTA +
Sbjct: 117 EFMKVGLIMMLASVIGKANPKGVRTLRDDIHLLLKIAGVAVIPVGLILM--QDAGTAGIC  174
```

```
-continued
Query: 186 LAILSGLILLSGISWWIILPILSTIVLFIASFLMIFISPNGKEWFYNLGMDTYQINRLSA 245
          + I+  ++ +SGI+W +I   I  + +L I+  L++ I  N +    ++G+   YQI R+++
Sbjct: 175 MFIVLVMVFMSGINWKLIAIIAGSGILLISLILLVMI--NFPDVAKSVGIQDYQIKRVTS 232

Query: 246 WIDPFSFAD---SIAYQQTQGMVSIGSGGVTGKGFNILELSVPVRESDMIFTVIAENFGF 302
           W+   +       + ++Q  Q +++IGSGG+ G G + L++ VP    +D IF++I E+FGF
Sbjct: 233 WVSASNETQEDSNDSWQVDQAIMAIGSGGILGNGISNLKVYVPESTTDFIFSIIGESFGF 292

Query: 303 IGSAIVLGLYLIIIYRMLRIT--IESNNQFYTFISTGFIMMIVFHVFENIGAAVGILPLT 360
           IG AIV+ ++  +IYR++ +    I    N+F +F    G+  +IV H F+NIG  +GI+P+T
Sbjct: 293 IGCAIVVIMFFFLIYRLVVLIDKIHPFNRFASFFCVGYTALIVIHTFQNIGMNIGIMPVT 352

Query: 361 GIPLPFISQGGSSLLSNLIGIGLVLSMSYQNT                            392
           GIPL F+S GGSS LS LIG G+V + S Q T
Sbjct: 353 GIPLLFVSYGGSSTLSTLIGFGIVYNASVQLT                            384
```

There is also homology to SEQ ID 1028.

Based on this analysis, it was predicted that these proteins and their epitopes could be useful antigens for vaccines or diagnostics.

EXAMPLE 409

A DNA sequence (GBSx0444) was identified in *S. agalactiae* <SEQ ID 1325> which encodes the amino acid sequence <SEQ ID 1326>. Analysis of this protein sequence reveals the following:

```
Possible site: 25
>>> Seems to have no N-terminal signal sequence

----- Final Results -----
         bacterial cytoplasm --- Certainty = 0.3195(Affirmative) < succ>
         bacterial membrane  --- Certainty = 0.0000(Not Clear)   < succ>
         bacterial outside   --- Certainty = 0.0000(Not Clear)   < succ>
```

The protein has no significant homology with any sequences in the GENPEPT database.

A related DNA sequence was identified in *S. pyogenes* <SEQ ID 1327> which encodes the amino acid sequence <SEQ ID 1328>. Analysis of this protein sequence reveals the following:

```
Possible site: 22
>>> Seems to have no N-terminal signal sequence

----- Final Results -----
         bacterial cytoplasm --- Certainty = 0.2735(Affirmative) < succ>
         bacterial membrane  --- Certainty = 0.0000(Not Clear)   < succ>
         bacterial outside   --- Certainty = 0.0000(Not Clear)   < succ>
```

An alignment of the GAS and GBS proteins is shown below:

```
Identities = 38/55 (69%), Positives = 48/55 (87%)
Query: 8   DEFKEAIDKGYISGNTVAIVRKNGKIFDYVLLHEEVREEEVVTVERVLDVLRKLS 62
           DEFK+AID GYI+G+TVAIVRK+G+IFDYVL HE+V+  EVVT E+V +VL +LS
Sbjct: 5   DEFKQAIDNGYIAGDTVAIVRKDGQIFDYVLPHEKVKNGEVVTKEKVEEVLVELS 59
```

Based on this analysis, it was predicted that these proteins and their epitopes could be useful antigens for vaccines or diagnostics.

EXAMPLE 410

A DNA sequence (GBSx0445) was identified in *S. agalactiae* <SEQ ID 1329> which encodes the amino acid sequence <SEQ ID 1330>. Analysis of this protein sequence reveals the following:

```
Possible site: 41
>>> Seems to have no N-terminal signal sequence

----- Final Results -----
            bacterial cytoplasm --- Certainty = 0.4241(Affirmative) < succ>
             bacterial membrane --- Certainty = 0.0000(Not Clear)   < succ>
              bacterial outside --- Certainty = 0.0000(Not Clear)   < succ>
```

The protein has no significant homology with any sequences in the GENPEPT database.

A related DNA sequence was identified in *S. pyogenes* <SEQ ID 1331> which encodes the amino acid sequence <SEQ ID 1332>. Analysis of this protein sequence reveals the following:

```
Possible site: 41
>>> Seems to have no N-terminal signal sequence

----- Final Results -----
            bacterial cytoplasm --- Certainty = 0.4551(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below:

```
Identities = 57/66 (86%), Positives = 63/66 (95%)
Query:  1 MSQEKLKSKLDQAKGGAKEGFGKITGDKELEAKGFIEKTIAKGKELADDAKDAVEGAVDA  60
          MS+EKLKSK++QA GG KEG GK+TGDKELEAKGF+EKTIAKGKELADDAK+AVEGAVDA
Sbjct:  1 MSEEKLKSKIEQASGGLKEGAGKLTGDKELEAKGFVEKTIAKGKELADDAKEAVEGAVDA  60

Query: 61 VKEKLK                                                       66
          VKEKLK
Sbjct: 61 VKEKLK                                                       66
```

Based on this analysis, it was predicted that these proteins and their epitopes could be useful antigens for vaccines or diagnostics.

EXAMPLE 411

A DNA sequence (GBSx0447) was identified in *S. agalactiae* <SEQ ID 1333> which encodes the amino acid sequence <SEQ ID 1334>. This protein is predicted to be TnpA (orfB). Analysis of this protein sequence reveals the following:

```
Possible site: 16
>>> Seems to have no N-terminal signal sequence

----- Final Results -----
            bacterial cytoplasm --- Certainty = 0.3961(Affirmative) < succ>
             bacterial membrane --- Certainty = 0.0000(Not Clear)   < succ>
              bacterial outside --- Certainty = 0.0000(Not Clear)   < succ>
```

A related GBS nucleic acid sequence <SEQ ID 9667> which encodes amino acid sequence <SEQ ID 9668> was also identified.

A related DNA sequence was identified in *S. pyogenes* <SEQ ID 1335> which encodes the amino acid sequence <SEQ ID 1336>. Analysis of this protein sequence reveals the following:

```
Possible site: 55
>>> Seems to have no N-terminal signal sequence

----- Final Results -----
            bacterial cytoplasm --- Certainty = 0.3365(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below:

```
Identities = 152/160 (95%), Positives = 154/160 (96%)
Query:    1 MKNMALPKMATVKTKTALKKTQKTYPQNLLNQKFNPDKPNQVWSTDFTYISIGYKKYVYL    60
            MKNMALPKMATVK KTALK+TQKTYPQNLLNQKFNPDKPNQVWSTDFTYISIGYKKYVYL
Sbjct:  194 MKNMALPKMATVKPKTALKRTQKTYPQNLLNQKFNPDKPNQVWSTDFTYISIGYKKYVYL   253

Query:   61 CAIIDLYSRKYIAWKLSHRMDAKLACDTLELALNKRKIEGTLLFHSDQGSQFKAREFRKI   120
            CAI+DLYSRK IAWKLSHRMDAKLACDTLELALNKRKIEGTLLFHSDQGSQFKARE RKI
Sbjct:  254 CAILDLYSRKCIAWKLSHRMDAKLACDTLELALNKRKIEGTLLFHSDQGSQFKARELRKI   313

Query:  121 IDDNNIMHSFSKPRYPYDNAVTEAFFKYLKHRQINQKNYQ                      160
            IDDN IMHSFSKP YPYDNAVTEAFFKYLKHRQINQK YQ
Sbjct:  314 IDDNTIMHSFSKPGYPYDNAVTEAFFKYLKHRQINQKKYQ                      353
```

Based on this analysis, it was predicted that these proteins and their epitopes could be useful antigens for vaccines or diagnostics.

EXAMPLE 412

A DNA sequence (GBSx0448) was identified in *S. agalactiae* <SEQ ID 1337> which encodes the amino acid sequence <SEQ ID 1338>. Analysis of this protein sequence reveals the following:

```
Possible site: 27
>>> Seems to have no N-terminal signal sequence

----- Final Results -----
          bacterial cytoplasm --- Certainty = 0.1090(Affirmative) < succ>
          bacterial membrane  --- Certainty = 0.0000(Not Clear)   < succ>
           bacterial outside  --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 413

A DNA sequence (GBSx0449) was identified in *S. agalactiae* <SEQ ID 1339> which encodes the amino acid sequence <SEQ ID 1340>. This protein is predicted to be histidine kinase (resE). Analysis of this protein sequence reveals the following:

```
Possible site: 40
>>> Seems to have an uncleavable N-term signal seq
    INTEGRAL    Likelihood = -11.57    Transmembrane    17-33     (6-38)
    INTEGRAL    Likelihood =  -4.67    Transmembrane   147-163  (142-166)

----- Final Results -----
          bacterial membrane  --- Certainty = 0.5628(Affirmative) < succ>
           bacterial outside  --- Certainty = 0.0000(Not Clear)   < succ>
          bacterial cytoplasm --- Certainty = 0.0000(Not Clear)   < succ>
```

The protein has homology with the following sequences in the GENPEPT database:

```
>GP: AAD25109 GB: AF140356 VncS [Streptococcus pneumoniae]
Identities = 178/435 (40%), Positives = 281/435 (63%), Gaps = 1/435 (0%)
Query:    1 MKKLKIFPKMFIQIFSILGILIILVHSLFFFIFPKTYLETRKVKIHIMADEISKNMNGKE    60
            MK+   +F K+FI   FSI  +L+I +H   +F+FP TYL  R+   I   A   I++++ GK+
Sbjct:    1 MKRTGLFAKIFIYTFSIFSVLVICLHLAIYFLFPSTYLSHRQETIGQKATAIAQSLEGKD    60
```

-continued

```
Query:   61 LKYLDQTLELYSKSSDIKVFIKKNNNKNELQINDNINVNVKSDSNSLIIEEREIKLHDGK  120
            + ++Q L+LYS++SDIK  +K     +++L++ D++ ++    + SL IEERE+K  DG
Sbjct:   61 RQSIEQVLDLYSQTSDIKGTVKGEMTEDKLEVKDSLPLDTDRQTTSLFIEEREVKTQDGG  120

Query:  121 KIHLQFVSTADMQKDAKDLSLKFLPYSLSISFLFSIVISLIYAKSIKNNIQEITMVTDKM  180
            + LQF+++ D+QK+A+ +SL+FLPY+L  SFL S++++ IYA++I   I EI  VT +M
Sbjct:  121 TMILQFLASMDLQKEAEQISLQFLPYTLLASFLISLLVAYIYARTIVAPILEIKRVTRRM  180

Query:  181 IKLDKETRLKISSNDEIGQLKQQINDLYCALLNTINDLEFKNKEILKLEKLKYDFFKGAS  240
            + LD + RL++ S DEIG LK+QIN LY  LL  I DL   KN+ IL+LEK+K +F +GAS
Sbjct:  181 MDLDSQVRLRVDSKDEIGNLKEQINSLYQHLLTVIADLHEKNEAILQLEKMKVEFLRGAS  240

Query:  241 HELKTPLSSLKILLENMKYNIGKYKDRDFYISECINIVDNLTKNVSQILSFYSIKDLNND  300
            HELKTPL+SLKIL+ENM+ NIG+YKDRD Y+    + IVD L +V QILS  S+++L +D
Sbjct:  241 HELKTPLASLKILIENMRENIGRYKDRDQYLGVALGIVDELNHHVLQILSLSSVQELRDD  300

Query:  301 EEYLNVGDTLDEVLEKYSILVNQKKININKELLDYNIYIGKTALNIVFSNLISNAVKYTN  360
            E +++       +++ Y++L ++++ I+  L     Y+  + + ++ SNLISNA+K++
Sbjct:  301 RETIDLLQMTQNLVKDYALLAKERELQIDNSLTHQQAYLNPSVMKLILSNLISNAIKHSV  360

Query:  361 RNGIINIKIANDWLLIENSYDKNKISKINKILDASFDLKLDNSNGLGLNIVKNILNKYNI  420
            G++ I      L IENS  + K+ +     + K+ S G+GL +VK++L    +
Sbjct:  361 PGGLVRIGEREGELFIENSCSSEEQEKLAQSFSDNASRKVKGS-GMGLFVVKSLLEHEKL  419

Query:  421 KYEILHGENYFIFKI                                              435
            Y      EN   F I
Sbjct:  420 AYRFEMEENSLTFFI                                              434
```

A related DNA sequence was identified in *S. pyogenes* <SEQ ID 1341> which encodes the amino acid sequence <SEQ ID 1342>. Analysis of this protein sequence reveals the following:

```
Possible site: 37
>>> Seems to have an uncleavable N-term signal seq
    INTEGRAL   Likelihood = -11.83   Transmembrane   14-30   (6-35)
    INTEGRAL   Likelihood =  -2.44   Transmembrane  157-173  (156-174)

----- Final Results -----
              bacterial membrane  --- Certainty = 0.5734(Affirmative) < succ>
              bacterial outside   --- Certainty = 0.0000(Not Clear)   < succ>
              bacterial cytoplasm --- Certainty = 0.0000(Not Clear)   < succ>
```

The protein has homology with the following sequences in the databases:

```
>GP: AAD25109 GB: AF140356 VncS [Streptococcus pneumoniae]
Identities = 123/455 (27%), Positives = 223/455 (48%), Gaps = 23/455 (5%)
Query:    3 LIKKTFLVINGLIIVVVTSILLVLYFAMPIYYTKVKDKEVKCEFDQTSKQIKGKTVTEIR   62
            L  K F+      + V+V  +  L  +YF  P Y   +  +      ++ ++GK     I
Sbjct:    6 LFAKIFIYTFSIFSVLVICLHLAIYFLFPSTYLSHRQETIGQKATAIAQSLEGKDRQSIE   65

Query:   63 DILTKKINKDNIWYSLVDSDNQLLYPSLQLLDGVSESKDSQNVIVTTFDNSYSNVKVMS  122
            +L       +I ++      L++ D +     D Q ++                  +
Sbjct:   66 QVLDLYSQTSDIKGTV---KGEMTEDKLEVKDSLPLDTDRQTTSLF-----------IEE  111

Query:  123 QKVTLRDGKKMTLLGQSSLQPVTDASKVLLDLYPSLLIFSVTVGSIVAYLYSRTSSRRIL  182
            ++V  +DG M L    +S+    +A ++ L  P L+ S  +   +VAY+Y+RT     IL
Sbjct:  112 REVKTQDGGTMILQFLASMDLQKEAEQISLQFLPYTLLASFLISLLVAYIYARTIVAPIL  171

Query:  183 SMSQTAKKMVNLEPNLTCTIHGKDEIAMLASDINRLYASLSTSIKSLQKEYEKASDSERE  242
            + + ++M++L+ +  +     KDEI  L    IN LY L T I  L ++ E      E+
Sbjct:  172 EIKRVTRRMMDLDSQVRLRVDSKDEIGNLKEQINSLYQHLLTVIADLHEKNEAILQLEKM  231

Query:  243 KSEFLRMTSHELKTPITSVIGMIDGMLYNVGDFADRDKYLRKCRDVLEGQAQLVQSILSL  302
            K EFLR  SHELKTP+  S+ +I+ M  N+G + DRD+YL       +++      V ILSL
Sbjct:  232 KVEFLRGASHELKTPLASLKILIENMRENIGRYKDRDQYLGVALGIVDELNHHVLQILSL  291

Query:  303 SKIETLASQNQELFSLKSSLEEEMEVFLVLSELKHLKVTINLEEQFVKANKVYLLKAIKN  362
            S ++   L  ++E    L   + ++  +L++  + L++       + L  Q   N  + N
Sbjct:  292 SSVQEL-RDDRETIDLLQMTQNLVKDYALLAKERELQIDNSLTHQQAYLNPSVMKLILSN  350

Query:  363 IIDNAFHYTKSGGQVMIQLKDNQLVIKNEAETLLTQQQMKQLFQPFYRPDYSRNRKDGGT  422
            +I  NA  ++   GG V I  ++L I+N       + ++ ++L  Q  F      + +RK G+
Sbjct:  351 LISNAIKHSVPGGLVRIGEREGELFIENSC----SSEEQEKLAQSF---SDNASRKVKGS  403
```

-continued

```
Query: 423 GLGLFITHQILDQHHLAYRFVVLDQRWMVFTIDFP       457
           G+GLF+   +L+    LAYRF +++  + F IDFP
Sbjct: 404 GMGLFVVKSLLEHEKLAYRF-EMEENSLTFFIDFP       437
```

An alignment of the GAS and GBS proteins is shown below:

```
Identities = 108/454 (23%), Positives = 220/454 (47%), Gaps = 22/454 (4%)
Query:   4 LKIFPKMFIQIFSILGILIILVHSLFFFIFPKTYLETRKVKIHIMADEISKNMNGKELKY   63
           +++  K F+ I  ++ +++  +  + +F  P  Y + +    D+ SK + GK +
Sbjct:   1 VRLIKKTFLVINGLIIVVVTSILLVLYFAMPIYYTKVKDKEVKCEFDQTSKQIKGKTVTE   60

Query:  64 LDQTLELYSKSSDIKVFIKKNNNK------------NELQINDNINVNVKSDSN--SLII  109
           +    L      +I   +  ++N+             +E +  + N+N+    D++  ++ +
Sbjct:  61 IRDILTKKINKDNIWYSLVDSDNQLLYPSLQLLDGVSESKDSQNVNIVTTFDNSYSNVKV  120

Query: 110 EEREIKLHDGKKIHLQFVSTADMQKDAKDLSLKFLPYSLSISFLFSIVISLIYAKSIKNN  169
              +++ L DGKK+ L    S+     DA  + L   P   L  S     +++ +Y+++
Sbjct: 121 MSQKVTLRDGKKMTLLGQSSLQPVTDASKVLLDLYPSLLIFSVTVGSIVAYLYSRTSSRR  180

Query: 170 IQEITMVTDKMIKLDKETRLKISSNDEIGQLKQQINDLYCALLNTINDLEFKNKEILKLE  229
               I  ++    KM+ L+          I    DEI  L    IN LY +L  +I  L+ + ++     E
Sbjct: 181 ILSMSQTAKKMVNLEPNLTCTIHGKDEIAMLASDINRLYASLSTSIKSLQKEYEKASDSE  240

Query: 230 KLKYDFFKGASHELKTPLSSLKILLENMKYNIGKYKDRDFYISECINIVDNLTKNVSQIL  289
            + K +F +   SHELKTP++S+   +++ M YN+G + DRD Y+ +C ++++   + V  IL
Sbjct: 241 REKSEFLRMTSHELKTPITSVIGMIDGMLYNVGDFADRDKYLRKCRDVLEGQAQLVQSIL  300

Query: 290 SFYSIKDL-NNDEEYLNVGDTLDEVLEKYSILVNQKKININKELLDYNIYIGKTALNIVF  348
           S     I+ L + ++E ++  +L+E +E + +L   K + +    L+   +     K  L
Sbjct: 301 SLSKIETLASQNQELFSLKSSLEEEMEVFLVLSELKHLKVTINLEEQFVKANKVYLLKAI  360

Query: 349 SNLISNAVKYTNRNGIINIKIANDWLLIENSYDKNKISKINKILDASF------DLKLDN  402
              N+I  NA   YT      G + I++ ++ L+I+N +       + KL   F          + D
Sbjct: 361 KNIIDNAFHYTKSGGQVMIQLKDNQLVIKNEAETLLTQQQMKQLFQPFYRPDYSRNRKDG  420

Query: 403 SNGLGLNIVKNILNKYNIKYE-ILHGENYFIFKI                           435
             GLGL I    IL+++++ Y ++  + + +F I
Sbjct: 421 GTGLGLFITHQILDQHHLAYRFVVLDQRWMVFTI                           454
```

Based on this analysis, it was predicted that these proteins and their epitopes could be useful antigens for vaccines or diagnostics.

EXAMPLE 414

A DNA sequence (GBSx0450) was identified in *S. agalactiae* <SEQ ID 1343> which encodes the amino acid sequence <SEQ ID 1344>. This protein is predicted to be response regulator (regX3). Analysis of this protein sequence reveals the following:

```
Possible site: 34
>>> Seems to have no N-terminal signal sequence
    INTEGRAL    Likelihood = -0.80    Transmembrane    50-66 (50-66)

----- Final Results -----
            bacterial membrane --- Certainty = 0.1319(Affirmative) < succ>
             bacterial outside --- Certainty = 0.0000(Not Clear)   < succ>
            bacterial cytoplasm --- Certainty = 0.0000(Not Clear)   < succ>
```

A related GBS nucleic acid sequence <SEQ ID 9665> which encodes amino acid sequence <SEQ ID 9666> was also identified.

The protein has homology with the following sequences in the GENPEPT database:

```
>GP: AAD25108 GB: AF140356 VncR [Streptococcus pneumoniae]
Identities = 131/218 (60%), Positives = 176/218 (80%), Gaps = 1/218 (0%)
Query:   5 MKILTVEDDKLIREGISEYLSEFGYTVIQAKDGREALSKFNS-DINLVILDIQIPFINGL   63
           MKIL VED+++IREG+S+YL++ GY  I+A DG+EAL +F+S ++ LV+LDIQ+P +NGL
```

-continued

```
Sbjct:    1 MKILIVEDEEMIREGVSDYLTDCGYETIEAADGQEALEQFSSYEVALVLLDIQMPKLNGL   60

Query:   64 EVLKEIRKKSNLPILILTAFSDEEYKIDAFTNLVDGYVEKPFSLPVLKARIDSLIKKNFG  123
             EVL EIRK S +P+L+LTAF DEEYK+ AF +L DGY+EKPFSL +LK R+D++ K+ +
Sbjct:   61 EVLAEIRKTSQVPVLMLTAFQDEEYKMSAFASLADGYLEKPFSLSLLKVRVDAIFKRYYD  120

Query:  124 HLEKFEYKNLSVNFNSYTAKINDEKIDVNAKELEILKCLLDNDGQVLTRMQIIDYVWKDS  183
                F YK+  V+F SY+A +  +++ +NAKELEIL  L+ N+G+ LTR QIID VWK +
Sbjct:  121 TGRIFSYKDTKVDFESYSASLAGQEVPINAKELEILDYLVKNEGRALTRSQIIDAVWKAT  180

Query:  184 EEIPYDRVVDVYIKELRKKLQLDCITTIRNVGYKLERK                       221
             +E+P+DRV+DVYIKELRKKL LDCI T+RNVGYKLERK
Sbjct:  181 DEVPFDRVIDVYIKELRKKLDLDCILTVRNVGYKLERK                       218
```

A related DNA sequence was identified in *S. pyogenes* <SEQ ID 1345> which encodes the amino acid sequence <SEQ ID 1346>. Analysis of this protein sequence reveals the following:

```
Possible site: 60
>>> Seems to have no N-terminal signal sequence
     INTEGRAL    Likelihood = -2.60    Transmembrane    48-64 (48-64)

----- Final Results -----
              bacterial membrane --- Certainty = 0.2041(Affirmative) < succ>
               bacterial outside --- Certainty = 0.0000(Not Clear)   < succ>
             bacterial cytoplasm --- Certainty = 0.0000(Not Clear)   < succ>
```

The protein has homology with the following sequences in the databases:

```
>GP: AAF72358 GB: AF192329 VanRB [Enterococcus faecalis]
Identities = 88/215 (40%), Positives = 128/215 (58%), Gaps = 2/215 (0%)
Query:    3 KILVVEDDDTISQVICEFLKANNYDPDCVFDGQAALDKWQTTSYDLIILDIMLPSLSGLE   62
            +IL+VEDDD I  +  FL   Y D  DG A K+   +Y L+ILDIMLP ++G E
Sbjct:    4 RILLVEDDDHICNTVRGFLAEAGYQVDACTDGNEAYTKFYENTYQLVILDIMLPGMNGHE   63

Query:   63 VLKTIRKTSDVPIIMLTALDDEYTQLVSFNHLISDYVTKPFSPLILIKRIENVLRVSTPD  122
             +L+  R +D PI+M+TAL D+  Q+ +F+    DYVTKPF  IL+KR+E +LR S
Sbjct:   64 LLREFRAKNDTPILMMTALSDDENQIRAFDAEADDYVTKPFKMQILLKRVEALLRRSGAL  123

Query:  123 EKR-QIGDLLVDETEHSVYWQGTLVKLTKKEYDIIDYLAKRHQKIVTRDQLMDDIWGYS-  180
            +     K  ++G L +    + +V   GT + LT+KE++I+  L +    +T + ++  IWGY
Sbjct:  124 AKEIRVGRLTLLPEDFTVLCDGTELPLTRKEFEILLLLVQNKGRTLTHEIILSRIWGYDF  183

Query:  181 ELDTRVLDNHIKNLRKKMTGIPLKTITGMGYLLGE                          215
             E D  +  HIKNLR K+     +KTI G+GY L E
Sbjct:  184 EGDGSTVHTHIKNLRAKLPENIIKTIRGVGYRLEE                          218
```

An alignment of the GAS and GBS proteins is shown below:

```
Identities = 80/214 (37%), Positives = 126/214 (58%), Gaps = 4/214 (1%)
Query:    6 KILTVEDDKLIREGISEYLSEFGYTVIQAKDGREALSKFNS-DINLVILDIQIPFINGLE   64
            KIL VEDD  I +  I E+L    Y    DG+ AL K+ +    +L+ILDI +P ++GLE
Sbjct:    3 KILVVEDDDTISQVICEFLKANNYDPDCVFDGQAALDKWQTTSYDLIILDIMLPSLSGLE   62

Query:   65 VLKEIRKKSNLPILILTAFSDEEYKIDAFTNLVDGYVEKPFSLPVLKARIDSLIKKNFGH  124
             VLK IRK S++PI++LTA  DE  ++ +F +L+   YV KPFS  +L  RI++++++ +
Sbjct:   63 VLKTIRKTSDVPIIMLTALDDEYTQLVSFNHLISDYVTKPFSPLILIKRIENVLRVSTPD  122

Query:  125 LEKFEYKNLSVNFNSYTAKINDEKIDVNAKELEILKCLLDNDGQVLTRMQIIDYVWKDSE  184
              EK +  +L V+    ++    + + KE +I+  L     +++TR Q++D +W  SE
Sbjct:  123 -EKRQIGDLLVDETEHSVYWQGTLVKLTKKEYDIIDYLAKRHQKIVTRDQLMDDIWGYSE  181

Query:  185 EIPYDRVVDVYIKELRKKLQLDCITTIRNVGYKL                           218
                   RV+D +IK LRKK+     +  TI  +GY L
Sbjct:  182 --LDTRVLDNHIKNLRKKMTGIPLKTITGMGYLL                           213
```

Based on this analysis, it was predicted that these proteins and their epitopes could be useful antigens for vaccines or diagnostics.

EXAMPLE 415

A DNA sequence (GBSx0451) was identified in *S. agalactiae* <SEQ ID 1347> which encodes the amino acid sequence <SEQ ID 1348>. This protein is predicted to be Vexp3. Analysis of this protein sequence reveals the following:

```
Possible site: 49
>>> Seems to have an uncleavable N-term signal seq
     INTEGRAL    Likelihood = -12.68    Transmembrane    423-439  (413-447)
     INTEGRAL    Likelihood = -10.67    Transmembrane     16-32   (12-37)
     INTEGRAL    Likelihood =  -9.77    Transmembrane    303-319  (301-326)
     INTEGRAL    Likelihood =  -3.13    Transmembrane    343-359  (343-367)

----- Final Results -----
              bacterial membrane  --- Certainty = 0.6074(Affirmative) < succ>
               bacterial outside  --- Certainty = 0.0000(Not Clear)   < succ>
             bacterial cytoplasm  --- Certainty = 0.0000(Not Clear)   < succ>
```

The protein has homology with the following sequences in the GENPEPT database:

```
>GP: AAD47594 GB: AF140784 Vexp3 [Streptococcus pneumoniae]
Identities = 280/458 (61%), Positives = 363/458 (79%), Gaps = 3/458 (0%)
Query:   1 MIKNAFAYVTRKSLKSLIIILVILSMATLSIISLSIKDATDRASKETFANITNSFSMEIN    60
           M+ NAFAYVTRK  KS++I L+IL MA+LS++ LSIK AT +AS+ETF NITNSFSM+IN
Sbjct:   1 MLHNAFAYVTRKFFKSIVIFLIILLMASLSLVGLSIKGATAKASQETFKNITNSFSMQIN    60

Query:  61 RQVNPGTPRGGGNVKGEDIKKISQTNSIDSYVKRINSVADLVDHDIIETQDTLANQSPER   120
           R+VN GTPRG GN+KGEDIKKI++  +I+SYVKRIN++ DL  +D+IET +T  N + +R
Sbjct:  61 RRVNQGTPRGAGNIKGEDIKKITENKAIESYVKRINAIGDLTGYDLIETPETKKNLTADR   120

Query: 121 AKNFKRTVMLTGVNDSAKETKFVSEAYKLVEGKHLENKDKNKILMHKDLAKKNNLKVGDK   180
           AK F  ++M+TGVNDS+KE KFVS +YKLVEG+HL N DK+KIL+HKDLA K+  KVGDK
Sbjct: 121 AKRFGSSLMITGVNDSSKEDKFVSGSYKLVEGEHLTNDDKDKILLHKDLAAKHGWKVGDK   180

Query: 181 IKIKSNLFDADNEKVANETVEVEIKGLFDGHNSGGVSAAQELYENTLITDVHSAAKVYGN   240
           +K+ SN++DADNEK A ETVEV IKGLFDGHN   V+ +QELYENT ITD+H+AAK+YG
Sbjct: 181 VKLDSNIYDADNEKGAKETVEVTIKGLFDGHNKSAVTYSQELYENTAITDIHTAAKLYGY   240

Query: 241 TEDTAVYQDATFFVKGDKNLDSVIKDL-GKLDINWREYNLIKSSSNYPALQQSISGIYSI   299
           TEDTA+Y DATFFV  DKNLD V+K+L G   INW+ Y L+KSSSNYPAL+QSISG+Y +
Sbjct: 241 TEDTAIYGDATFFVTADKNLDDVMKELNGISGINWKSYTLVKSSSNYPALEQSISGMYKM   300

Query: 300 SNKLFVGSLIFAGVVVSLLLFLWMNARKKEIAVLLSLGISKLEIFGQFIIEMVFISIPAL   359
           +N LF GSL F+ ++++LLL LW+NAR+KE+ +LLS+G+ +  I GQFI E + I+IPAL
Sbjct: 301 ANLLFWGSLSFSVLLLALLLSLWINARRKEVGILLSIGLKQASILGQFITESILIAIPAL   360

Query: 360 LGSYFLAQYTADKLGNNILNKVTGDIAKQIARQSASSQLGGGAEAEGFNKTLSGLDINV-   418
           + +YFLA YTA +GN +L  VT  +AKQ ++  +S LGGGAE +GF+KTLS LDI++
Sbjct: 361 VSAYFLANYTARAIGNTVLANVTSGVAKQASKAAQASNLGGGAEVDGFSKTLSSLDISIQ   420

Query: 419 LPKFIIYVVIFMSFVLLVSLILSSIYTLRKNPKELLID                        456
              FII V+ + V+LV + L+S  LRK PKELL+D
Sbjct: 421 TSDFIIIFVLALVLVVLV-MALASSNLLRKQPKELLLD                        457
```

A related DNA sequence was identified in *S. pyogenes* <SEQ ID 1349> which encodes the amino acid sequence <SEQ ID 1350>. Analysis of this protein sequence reveals the following:

```
Possible site: 31
>>> Seems to have no N-terminal signal sequence
     INTEGRAL    Likelihood = -12.90    Transmembrane     19-35   (16-43)
     INTEGRAL    Likelihood =  -7.27    Transmembrane    371-387  (359-392)
     INTEGRAL    Likelihood =  -7.01    Transmembrane    335-351  (326-357)
     INTEGRAL    Likelihood =  -6.21    Transmembrane    282-298  (276-308)
```

```
----- Final Results -----
           bacterial membrane --- Certainty = 0.6158(Affirmative) < succ>
           bacterial outside  --- Certainty = 0.0000(Not Clear)   < succ>
           bacterial cytoplasm --- Certainty = 0.0000(Not Clear)  < succ>
```

The protein has homology with the following sequences in the databases:

```
>GP: AAC24912 GB: AF012285 YknZ [Bacillus subtilis]
Identities = 176/408 (43%), Positives = 250/408 (61%),
Gaps = 16/408 (3%)
Query:   1 MENWKFALSSIWGHKMRSILTMLGIIIGVAAVVIIMGLGNAMKNSVTSTFSSKQKDIQLY   60
           +EN + ALSS+  HKMRSILTMLGIIIGV +V++++ +G    + + + S     ++LY
Sbjct:   4 LENIRMALSSVLAHKMRSILTMLGIIIGVGSVIVVVAVGQGGEQMLKQSISGPGNTVELY   63

Query:  61 FQEKGEE--EDLYAGLHTHENNHEVKPEWLEQIVKDIDGIDSYYFTNSATSTISYEKKKV  118
           +     EE + A  +    +++K        +K I+GI     + S +    Y +++
Sbjct:  64 YMPSDEELASNPNAAAESTFTENDIKG------LKGIEGIKQVVASTSESMKARYHEEET  117

Query: 119 DNASIIGVSKDYFNIKNYDIVAGRTLTDNDYSNFSRIILLDTVLADDLFGKGNYKSALNK  178
           D A++ G++  Y N+ +  I +GRT TDND+    +R+ ++   +A +LF K   S L +
Sbjct: 118 D-ATVNGINDGYMNVNSLKIESGRTFTDNDFLAGNRVGIISQKMAKELFDK---TSPLGE  173

Query: 179 VVSLSDKDYLVIGVYKTDQTPVSFDGLSGGAVMANTQVASEFGTKEIGSIYIHVNDIQNS  238
           VV ++ +   +IGV K    +SFD LS   V  N  + S FGT + ++ + V       +
Sbjct: 174 VVWINGQPVEIIGVLKKVTGLLSFD-LSEMYVPFN-MMKSSFGTSDFSNVSLQVESADDI  231

Query: 239 MNLGNQAADMLTNISHIKDGQYAVPDNSKIVEEINSQFSIMTTVIGSIAAISLLVGGIGV  298
            + G  +AA  L N +H +  Y V +  +I   I     +IMTT+IGSIA ISLLVGGIGV
Sbjct: 232 KSAGKEAAQ-LVNDNHGTEDSYQVMNMEEIAAGIGKVTAIMTTIIGSIAGISLLVGGIGV  290

Query: 299 MNIMLVSVTERTREIGLRKALGATRLKILSQFLIESVVLTVLGGLIGLLLAQLSVGALGN  358
           MNIMLVSVTERTREIG+RK+LGATR +IL+QFLIESVVLT++GGL+G+ +       AL +
Sbjct: 291 MNIMLVSVTERTREIGIRKSLGATRGQILTQFLIESVVLTLIGGLVGIGIG-YGGAALVS  349

Query: 359 AMTLKGACISLDVALIAVLFSASIGVFFGMLPANKASKLDPIEALRYE              406
           A+    +  IS V     VLFS   IGV FGMLPANKA+KLDPIEALRYE
Sbjct: 350 AIAGWPSLISWQVVCGGVLFSMLIGVIFGMLPANKAAKLDPIEALRYE              397
```

An alignment of the GAS and GBS proteins is shown below:

```
Identities = 56/247 (22%), Positives = 101/247 (40%),
Gaps = 42/247 (17%)
Query: 147 YKLVEGKHLENKDKNKI--------LMHKDLAKKNNLK--------VGDKIKIKSNLFDA  190
           Y +V G+  L + D +          ++  DL  K N K         + DK +  ++
Sbjct: 136 YDIVAGRTLTDNDYSNFSRIILLDTVLADDLFGKGNYKSALNKVVSLSDKDYLVIGVYKT  195

Query: 191 DNEKVANETVEVEIKGLFDGHNSGGVSAAQELYENTLITDVHSAAKVYGNTEDTAVYQDA  250
           D    V+        FDG + G V A      NT +        A +G  E   ++Y
Sbjct: 196 DQTPVS-----------FDGLSGGAVMA------NTQV------ASEFGTKEIGSIYIHV  232

Query: 251 TFFVKGDKNLDSVIKDL--GKLDINWREYNLIKSSSNYPALQQSISGIYSISNKLFVGSL  308
             ++   NL +  D+    I  +Y + +S         + S + ++    +     SL
Sbjct: 233 ND-IQNSMNLGNQAADMLTNISHIKDGQYAVPDNSKIVEEINSQFSIMTTVIGSIAAISL  291

Query: 309 IFAGVVVSLLLFLWMNARKKEIAVLLSLGISKLEIFGQFIIEMVFISIPALLGSYFLAQY  368
           + G+ V  ++ + +   R +EI + +LG ++L+I  QF+IE V +++   L     LAQ
Sbjct: 292 LVGGIGVMNIMLVSVTERTREIGLRKALGATRLKILSQFLIESVVLTVLGGLIGLLLAQL  351

Query: 369 TADKLGN                                                       375
             +  LGN
Sbjct: 352 SVGALGN                                                       358
```

Based on this analysis, it was predicted that these proteins and their epitopes could be useful antigens for vaccines or diagnostics.

EXAMPLE 416

A DNA sequence (GBSx0452) was identified in *S. agalactiae* <SEQ ID 1351> which encodes the amino acid sequence <SEQ ID 1352>. This protein is predicted to be Vexp2 (b0879). Analysis of this protein sequence reveals the following:

```
Possible site: 16
>>> Seems to have no N-terminal signal sequence

----- Final Results -----
              bacterial cytoplasm --- Certainty = 0.3194(Affirmative) < succ>
              bacterial membrane  --- Certainty = 0.0000(Not Clear)   < succ>
              bacterial outside   --- Certainty = 0.0000(Not Clear)   < succ>
```

The protein has homology with the following sequences in the GENPEPT database:

```
>GP: AAD47593 GB: AF140784 Vexp2 [Streptococcus pneumoniae]
Identities 142/207 (68%), Positives = 169/207 (81%)
Query:   1 MDILEIKNVNYSYANSKEKVLSGVNQKFELGKFYAIVGKSGTGKSTLLSLLAGLDKVQTG   60
           M +L++++V Y Y N+ E VL  +N  FE GKFY+I+G+SG GKSTLLSLLAGLD      G
Sbjct:   1 MTLLQLQDVTYRYKNTAEAVLYQINYNFEPGKFYSIIGESGAGKSTLLSLLAGLDSPVEG   60

Query:  61 KILFKNEDIEKKGYSNHRKNNISLVFQNYNLIDYLSPIENIRLVNKSVDESILFELGLDK  120
             ILF+ EDI KKGYS HR ++ISLVFQNYNLIDYLSP+ENIRLVNK   ++ L ELGLD+
Sbjct:  61 SILFQGEDIRKKGYSYHRMHHISLVFQNYNLIDYLSPLENIRLVNKKASKNTLLELGLDE  120

Query: 121 KQIKRNVMKLSGGQQQRVAIARALVSDAPIILADEPTGNLDSVTAGEIINILKELAQDRN  180
            QIKRNV++LSGGQQQRVAIAR+LVS+AP+ILADEPTGNLD  TAG+I+  +LK LAQ
Sbjct: 121 SQIKRNVLQLSGGQQQRVAIARSLVSEAPVILADEPTGNLDPKTAGDIVELLKSLAQKTG  180

Query: 181 KCVIVVTHSKEVADSADIILELSGKKL                                  207
           KCVIVVTHSKEVA ++DI LEL  KKL
Sbjct: 181 KCVIVVTHSKEVAQASDITLELKDKKL                                  207
```

A related DNA sequence was identified in *S. pyogenes* <SEQ ID 1353> which encodes the amino acid sequence <SEQ ID 1354>. Analysis of this protein sequence reveals the following:

```
Possible site: 47
>>> Seems to have no N-terminal signal sequence

----- Final Results -----
              bacterial cytoplasm --- Certainty = 0.2717(Affirmative) < succ>
              bacterial membrane  --- Certainty = 0.0000(Not Clear)   < succ>
              bacterial outside   --- Certainty = 0.0000(Not Clear)   < succ>
```

An alignment of the GAS and GBS proteins is shown below:

```
Identities = 83/230 (36%), Positives = 135/230 (58%), Gaps = 13/230 (5%)
Query:   1 MDILEIKNVNYSYANSKEKVLSGVNQKFEL--GKFYAIVGKSGTGKSTLLSLLAGLDKVQ   58
           M +E+K V+ SY   + V +    FE+ G+   I+G SG GKST+L++L G+D V
Sbjct:   5 MAFIELKQVSKSYQIGETTVFANHEVSFEINKGELVVILGASGAGKSTVLNILGGMDTVD   64

Query:  59 TGKILFKNEDIE---KKGYSNHRKNNISLVFQNYNLIDYLSPIENIRLVNKSVDES----  111
             G+++    +DI    K  + +R+N I  VFQ YNL+  L+  EN+ L  +  V ++
Sbjct:  65 AGQVIIDGKDIAHYTSKALTQYRRNAIGFVFQFYNLVPNLTAKENVELAVEIVADALDPV  124

Query: 112 -ILFELGLDKKQIKRNVMKLSGGQQQRVAIARALVSDAPIILADEPTGNLDSVTAGEIIN  170
            IL E+GL + +       +LSGG+QQRV+IARAL   ++L DEPTG LD  T   +I+
Sbjct: 125 TILKEVGLSHR-LDHFPAQLSGGEQQRVSIARALAKNPKLLLCDEPTGALDYQTGKQILT  183

Query: 171 ILKELAQDRNKCVIVVTHSKEVADSADIILELSGKKLKK--VNKMNLEVE           218
            +L+++AQ +   V++VTH+  +A  AD ++ +    ++ K  +NK      +E
Sbjct: 184 LLQDMAQTKGTTVVIVTHNAAIAPIADRVIFMHDAQVTKTVINKEPASIE             233
```

Based on this analysis, it was predicted that these proteins and their epitopes could be useful antigens for vaccines or diagnostics.

EXAMPLE 417

A DNA sequence (GBSx0453) was identified in *S. agalactiae* <SEQ ID 1355> which encodes the amino acid sequence <SEQ ID 1356>. Analysis of this protein sequence reveals the following:

```
Possible site: 25
>>> Seems to have an uncleavable N-term signal seq
     INTEGRAL    Likelihood = -3.35      Transmembrane      17-33  (17-34)

----- Final Results -----
              bacterial membrane --- Certainty = 0.2338(Affirmative) < succ>
               bacterial outside --- Certainty = 0.0000(Not Clear)   < succ>
             bacterial cytoplasm --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 418

A DNA sequence (GBSx0454) was identified in *S. agalactiae* <SEQ ID 1357> which encodes the amino acid sequence <SEQ ID 1358>. This protein is predicted to be Vexp1. Analysis of this protein sequence reveals the following:

```
Possible site: 56
>>> Seems to have an uncleavable N-term signal seq
     INTEGRAL    Likelihood = -11.52     Transmembrane     294-310  (285-312)
     INTEGRAL    Likelihood = -10.67     Transmembrane     396-412  (385-417)
     INTEGRAL    Likelihood =  -8.76     Transmembrane      17-33   (14-38)
     INTEGRAL    Likelihood =  -4.14     Transmembrane     335-351  (333-357)

----- Final Results -----
              bacterial membrane --- Certainty = 0.5607(Affirmative) < succ>
               bacterial outside --- Certainty = 0.0000(Not Clear)   < succ>
             bacterial cytoplasm --- Certainty = 0.0000(Not Clear)   < succ>
```

The protein has homology with the following sequences in the GENPEPT database:

```
>GP:AAD47592 GB:AF140784 Vexpl [Streptococcus pneumoniae]
Identities = 165/425 (38%), Positives = 271/425 (62%), Gaps = 4/425 (0%)
Query:   2 IKNAIAYITRKKNRTLIIFAILTIVLSCLYSCLTIMKSSNEIEKALYESSNSSISITK-K    60
           I+ + AY++RK+ R+ I+F IL ++L+ + +CLT+MKS+   +E   LY+S N+S SI K +
Sbjct:   4 IQRSWAYVSRKRLRSFILFLILLVLLAGISACLTLMKSNKTVESNLYKSLNTSFSIKKIE   63

Query:  61 DGKYFNINQFKNIEKIKEVEEKIFQYDGLAKLKDLKVVSGEQSINREDLSDEFKNVVSLE  120
           +G+ F ++    ++ KIK +E   + + +AKLKD + V+GEQS+ R+DLS     N+VSL
Sbjct:  64 NGQTFKLSDLASVSKIKGLENVSPELETVAKLKDKEAVTGEQSVERDDLSAADNNLVSLT  123

Query: 121 ATSNTKRNLLFSSGVFSFKEGKNIEENDKNSILVHEEFAKQNKLKLGDEIDLELLDTEKS  180
           A  ++ +++ F+S  F+ KEG+++++ D    IL+HEE AK+N L L D+I L+    +E S
Sbjct: 124 ALEDSSKDVTFTSSAFNLKEGRHLQKGDSKKILIHEELAKKNGLSLHDKIGLDAGQSE-S  182

Query: 181 GKIKSHKFKIIGIFSGKKQETYTGLSSDFSENMVFVDYSTSQEILNKSENNRIANKILMY  240
              GK ++ +F+IIGIFSGKKQE +TGLSSDFSEN VF DY +SQ +L  SE    A +   Y
Sbjct: 183 GKGQTVEFEIIGIFSGKKQEKFTGLSSDFSENQVFTDYESSQTLLGNSEAQVSAARF--Y  240

Query: 241 SGSLESTELALNKLKDFKIDKSKYSIKKDNKAFEESLESVSGIKHIIKIMTYSIMLGGIV  300
            +  + + + ++++ ++     Y ++K+NKAFE+   +SV+  +  + I  Y +++ G
Sbjct: 241 VENPKEMDGLMKQVENLALENQGYQVEKENKAFEQIKDSVATFQTFLTIFLYGMLIAGAG  300
```

-continued

```
Query: 301 VLSLILILWLRERIYEIGIFLSIGTTKIQIIRQFIFELIFISIPSIISSLFLGNLLLKVI 360
            L L+L LWLRER+YE+GI L++G   K  I  QF  E++ +S+ +++ +   GN +   +
Sbjct: 301 ALILVLSLWLRERVYEVGILLALGKGKSSIFLQFCLEVVLVSLGALLPAFVAGNAITTYL 360

Query: 361 VEGFINSENSMIFGGSLINKSSFMLNITTLAESYLILISIIVLSVVMASSLILFKKPKEI 420
           ++  + S +         +L   SS   +I + AESY+ L+ +   LSV +     + K PKEI
Sbjct: 361 LQTLLASGDQASLQDTLAKASSLSTSILSFAESYVFLVLLSCLSVALCFLFLRKSPKEI 420

Query: 421 LSKIS 425
           LS IS
Sbjct: 421 LSSIS 425
```

A related DNA sequence was identified in S. pyogenes <SEQ ID 1359> which encodes the amino acid sequence <SEQ ID 1360>. Analysis of this protein sequence reveals the following:

```
Possible site: 15
>>> Seems to have an uncleavable N-term signal seq
     INTEGRAL    Likelihood = -11.57    Transmembrane   23-39  (16-43)
     INTEGRAL    Likelihood = -11.36    Transmembrane  371-387 (362-396)
     INTEGRAL    Likelihood =  -8.12    Transmembrane  331-347 (324-360)
     INTEGRAL    Likelihood =  -7.70    Transmembrane  280-296 (277-308)

----- Final Results -----
              bacterial membrane --- Certainty = 0.5628(Affirmative) < succ>
              bacterial outside  --- Certainty = 0.0000(Not Clear)   < succ>
             bacterial cytoplasm --- Certainty = 0.0000(Not Clear)   < succ>
```

The protein has homology with the following sequences in the databases:

```
>GP:AAB97962 GB:U96166 ATP-binding cassette transporter-like protein
[Streptococcus cristatus]
Identities = 222/311 (71%), Positives = 278/311 (89%)
Query:  16 MRSILTMLGIIIGIGAIIAIFSIIEGNTENTKRQLIGGSNNTINIVFNKKSSIDPKFPDK  75
           MRS+LTMLGIIIGIGAIIAIFSIIEGNTENTKRQLIGGSNNTI +V++KKS+IDP  P+K
Sbjct:   1 MRSMLTMLGIIIGIGAIIAIFSIIEGNTENTKRQLIGGSNNTIKVVYDKKSAIDPSIPEK  60

Query:  76 SNAKKPDYLPFMAEEELSKIQQVKGVKNALISYGIDDKVYHLGQKSSAKISAITKNVAEV 135
            S A+KP Y+PFM E+ LSKI+++ GVKNAL++YG D+K+Y+L QKSS+K+ A++++VA++
Sbjct:  61 SQAQKPSYIPFMGEDVLSKIKEIPGVKNALMTYGADEKIYYLSQKSSSKVQAVSQSVADI 120

Query: 136 RRMTFIKGSDFSDKDFIDQKQVIYLEKSLYESLFPKDDGLGKFVEVMGNPFRVIGVFESK 195
           ++     ++G  F  + F +Q+QV  YLEKSLY++LFPK DG+GK+VEV GNPF+VIGVFES
Sbjct: 121 KQQRLLEGEGFDSEAFKNQEQVAYLEKSLYDTLFPKGDGIGKYVEVKGNPFKVIGVFEST 180

Query: 196 EQSGLTSGTEKIAYIPLHQWYNINGVVDATPEITIQTYRADDLKPVAKRVSDMLNQTIPK 255
           EQSGLTSG+EK+AYIPL QW+ I    ++ +PE+T+QT++ADDLK VAK+VSD LNQ +P+
Sbjct: 181 EQSGLTSGSEKVAYIPLQQWHRIFDTINVSPEVTVQTHKADDLKKVAKKVSDYLNQQMPQ 240

Query: 256 SDYMFGVMNLKEFERQLDNLNKSNFVLLAGIASISLIVGGIGVMNIMLVSVTERTREIGI 315
           SDYMFGV+NL+ EFERQLDNLN+SNFVLLAGIASISL+VGGIGVMNIMLVSVTERTREIGI
Sbjct: 241 SDYMFGVLNLQEFERQLDNLNQSNFVLLAGIASISLLVGGIGVMNIMLVSVTERTREIGI 300

Query: 316 KKALGARRKLI 326
           KKALGARRK++
Sbjct: 301 KKALGARRKIL 311
```

An alignment of the GAS and GBS proteins is shown below:

```
Identities = 79/386 (20%), Positives = 170/386 (43%), Gaps = 38/386 (9%)
Query:   5 AIAYITRKKNRTLIIFAILTIVLSCLYSCLTIMKSSNE-IEKALYESSNSSISITKKDGK  63
           A++ I   K R+++    + I +  + +I++ + E     ++ L   SN++I+I
Sbjct:   7 ALSSILSHKMRSILTMLGIIIGIGAIIAIFSIIEGNTENTKRQLIGGSNNTINIV-----  61
```

```
Query:   64 YFNINQFKNIEKIKEVEEKIFQYDGLAKLKDLKVVSGEQSINREDLSDEFKNVVSLEATS 123
            FN        K   ++ K F    AK D         E+ +++          KN +
Sbjct:   62 -FN--------KKSSIDPK-FPDKSNAKKPDYLPFMAEEELSKIQQVKGVKNALISYGID 111

Query:  124 NTKRNLLFSSGVFSFKEGKNIEENDKNSILVHEEFAKQNKLKLGDEIDLELLDTE----- 178
               +L  S       KN+ E + + +  +F+ ++ +    I LE    E
Sbjct:  112 DKVYHLGQKSSAKISAITKNVAEVRRMTFIKGSDFSDKDFIDQKQVIYLEKSLYESLFPK 171

Query:  179 -----KSGKIKSHKFKIIGIFSGKKQETYTGLSSDFSENMVFVDYSTSQEILNKSENNRI 233
                 K  ++  + F++IG+F  K+Q    +GL+S  +E + ++     I    +
Sbjct:  172 DDGLGKFVEVMGNPFRVIGVFESKEQ---SGLTSG-TEKIAYIPLHQWYNINGVVDATPE 227

Query:  234 ANKILMYSGSLESTELALNKLKDFKIDKSKYSIKKDN-KAFEESLESVSGIKHIIK--IM 290
                + L+    ++ + +   I KS Y    N K FE   L++++      ++     I
Sbjct:  228 ITIQTYRADDLKPVAKRVSDMLNQTIPKSDYMFGVMNLKEFERQLDNLNKSNFVLLAGIA 287

Query:  291 TYSIMLGGIVVLSLILILWLRERIYEIGIFLSIGTTKIQIIRQFIFELIFIS----IPSI 346
              + S+++GGI V++++L+  + ER  EIGI  ++G +   I++QF+ E + ++    + +
Sbjct:  288 SISLIVGGIGVMNIMLVS-VTERTREIGIKKALGARRKLILKQFLIEAVILTLLGGVIGV 346

Query:  347 ISSLFLGNLLLKVIVEGFINSENSMI                                   372
            IS +  G ++ + +    +I S  S++
Sbjct:  347 ISGMVSGLIITRSLEYPYILSLFSVV                                   372
```

A related GBS gene <SEQ ID 8571> and protein <SEQ ID 8572> were also identified. Analysis of this protein sequence reveals the following:

```
Lipop Possible site: -1 Crend: 10
McG: Discrim Score: 5.59
GvH: Signal Score (-7.5): -5.97
     Possible site: 56
>>> Seems to have an uncleavable N-term signal seq
ALOM program count: 4 value: -11.52 threshold: 0.0
     INTEGRAL       Likelihood = -11.52    Transmembrane    294-310   (285-312)
     INTEGRAL       Likelihood = -10.67    Transmembrane    396-412   (385-417)
     INTEGRAL       Likelihood =  -8.76    Transmembrane     17-33    (14-38)
     INTEGRAL       Likelihood =  -4.14    Transmembrane    335-351   (333-357)
     PERIPHERAL     Likelihood =  -4.51                     315
modified ALOM score: 2.80

*** Reasoning Step: 3

----- Final Results -----
              bacterial membrane --- Certainty = 0.5607(Affirmative) < succ>
              bacterial outside  --- Certainty = 0.0000(Not Clear)   < succ>
              bacterial cytoplasm --- Certainty = 0.0000(Not Clear)  < succ>
```

The protein has homology with the following sequences in the databases:

```
38.7/67.3% over 421aa
Streptococcus pneumoniae
GP|5712667| Vexp1 Insert characterized ORF00815(304-1575 of 1875)
GP|5712667|gb|AAD47592.1|AF140784_1|AF140784(4-425 of 425) Vexp1
{Streptococcus pneumoniae}
% Match = 25.0
% Identity = 38.7    % Similarity = 67.2
Matches = 164    Mismatches = 136    Conservative Sub.s = 121
```

-continued

```
48        78        108       138       168       198       228       258
SIEH*VVFDNKTI*T*ELDFVSHSS**VI*DFPLNK*IRNSVTSYINGSIIEIVCQMKKF*WK*F*KH*L*AM*KY*SSG 288       318       348       378       408       438       468       495
CNSCGVKIERSN*EVIKNAIAYITRKKNRTLIIFAILTIVLSCLYSCLTIMKSSNEIEKALYESSNSSISITK-KDGKYF
                     |: : ||::||: |::|:| ||  ::|:  : :|||:|||:  :|  ||:| |:| || ::|: |
                    MNPIQRSWAYVSRKRLRSFILFLILLVLLAGISACLTLMKSNKTVESNLYKSLNTSFSIKKIENGQTF
                    10        20        30        40        50        60

525       555       585       615       645       675       705       735
NINQFKNIEKIKEVEEKIFQYDGLAKLKDLKVVSGEQSINREDLSDEFKNVVSLEATSNTKRNLLFSSGVFSFKEGKNIE
 ::  : :: ||| :|    : : :|||||   : |:|||| : |:|||   |:|||  |  :: ::: |:|  |::|||::::
KLSDLASVSKIKGLENVSPELETVAKLKDKEAVTGEQSVERDDLSAADNNLVSLTALEDSSKDVTFTSSAFNLKEGRHLQ
80        90        100       110       120       130       140

765       795       825       855       885       915       945       975
ENDKNSILVHEEFAKQNKLKLGDEIDLELLDTEKSGKIKSHKFKIIGIFSGKKQETYTGLSSDFSENMVFVDYSTSQEIL
:  |    ||:|||:||: |    |  |:|  |:      :|  ||| :: :|:||||||||||  :|||||||||| ||  || :|  :|
KGDSKKILIHEELAKKNGLSLHDKIGLDAGQSE-SGKGQTVEFEIIGIFSGKKQEKFTGLSSDFSENQVFTDYESSQTLL
160       170       180       190       200       210       220

1005      1035      1065      1095      1125      1155      1185      1215
NKSENNRIANKILMYSGSLESTELALNKLKDFKIDKSKYSIKKDNKAFEESLESVSGIKHIIKIMTYSIMLGGIVVLSLI
||   :    |  :: :  : :::::  ::    |::|:||||: :||: :  :  | |:: |    | |:
GNSEA--QVSAARFYVENPKEMDGLMKQVENLALENQGYQVEKENKAFEQIKDSVATFQTFLTIFLYGMLIAGAGALILV
       240       250       260       270       280       290       300

1245      1275      1305      1335      1365      1395      1425      1455
LILWLRERIYEIGIFLSIGTTKIQIIRQFIFELIFISIPSIISSLFLGNLLLKVIVEGFINSENSMIFGGSLINKSSFML
| ||||||:||:||:|::|   |     |    ||  :|::::|:  ::: ::   ||  :    :::  ::  |:      :|    ||:
LSLWLRERVYEVGILLALGKGKSSIFLQFCLEVVLVSLGALLPAFVAGNAITTYLLQTLLASGDQASLQDTLAKASSLST
       320       330       340       350       360       370       380

1485      1515      1545      1575      1605      1635      1665      1695
NITTLAESYLILISIIVLSVVMASSLILFKKPKEILSKIS*EQIMDILEIKNVNYSYANSKEKVLSGVNQKFELGKFYAI
:|  ::||||:  |: :    |||  :       ::: |  ||||||| |   |
SILSFAESYVFLVLLSCLSVALCFLFLFRKSPKEILSSIS
       400       410       420
```

Based on this analysis, it was predicted that these proteins and their epitopes could be useful antigens for vaccines or diagnostics.

EXAMPLE 419

A DNA sequence (GBSx0455) was identified in *S. agalactiae* <SEQ ID 1361> which encodes the amino acid sequence <SEQ ID 1362>. Analysis of this protein sequence reveals the following:

```
Possible site: 42
>>> Seems to have an uncleavable N-term signal seq
    INTEGRAL    Likelihood = -5.04    Transmembrane    19-35 (14-42)

----- Final Results -----
              bacterial membrane --- Certainty = 0.3011(Affirmative) < succ>
               bacterial outside --- Certainty = 0.0000(Not Clear)   < succ>
             bacterial cytoplasm --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 420

A DNA sequence (GBSx0456) was identified in *S. agalactiae* <SEQ ID 1363> which encodes the amino acid sequence <SEQ ID 1364>. Analysis of this protein sequence reveals the following:

```
Possible site: 26
>>> Seems to have an uncleavable N-term signal seq

----- Final Results -----
            bacterial membrane  --- Certainty = 0.0000(Not Clear) < succ>
            bacterial outside   --- Certainty = 0.0000(Not Clear) < succ>
            bacterial cytoplasm --- Certainty = 0.0000(Not Clear) < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 421

A DNA sequence (GBSx0457) was identified in *S. agalactiae* <SEQ ID 1365> which encodes the amino acid sequence <SEQ ID 1366>. Analysis of this protein sequence reveals the following:

```
Possible site: 17
>>> Seems to have a cleavable N-term signal seq.

----- Final Results -----
            bacterial outside   --- Certainty = 0.3000(Affirmative) < succ>
            bacterial membrane  --- Certainty = 0.0000(Not Clear)   < succ>
            bacterial cytoplasm --- Certainty = 0.0000(Not Clear)   < succ>
```

The protein has homology with the following sequences in the GENPEPT database:

```
>GP: AAA74029 GB: U30715 ORFB [Bacillus anthracis]
Identities = 33/76 (43%), Positives = 44/76 (57%), Gaps = 1/76 (1%)

Query:  11 IRRVSHACTKAGDRFYEENILNREFTATAHNQKWCTDVTYLQYGLGAKAYLSAIKDLYNG    70
            ++R          R    EN+LNR F A   N+KW TD+TYL +G     YL +I DLYN
Sbjct:  86 VKRKRRTWINGESRIVVENLLNRNFQANKPNEKWVTDITYLPFGT-EMLYLLSIMDLYNN   144

Query:  71 SIIAYEISHNNEIHLL                                               86
            IIAYEIS+  ++ L+
Sbjct: 145 EIIAYEISNRQDVTLV                                              160
```

Based on this analysis, it was predicted that this protein and its epitopes, could be useful antigens for vaccines or diagnostics.

EXAMPLE 422

A DNA sequence (GBSx0458) was identified in *S. agalactiae* <SEQ ID 1367> which encodes the amino acid sequence <SEQ ID 1368>. Analysis of this protein sequence reveals the following:

```
Possible site: 27
>>> Seems to have no N-terminal signal sequence
     INTEGRAL      Likelihood = -0.69     Transmembrane    10-26 (10-26)

----- Final Results -----
            bacterial membrane  --- Certainty = 0.1277(Affirmative) < succ>
            bacterial outside   --- Certainty = 0.0000(Not Clear)   < succ>
            bacterial cytoplasm --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 423

A DNA sequence (GBSx0459) was identified in *S. agalactiae* <SEQ ID 1369> which encodes the amino acid sequence <SEQ ID 1370>. Analysis of this protein sequence reveals the following:

```
Possible site: 47
>>> Seems to have no N-terminal signal sequence

----- Final Results -----
            bacterial cytoplasm --- Certainty = 0.4170(Affirmative) < succ>
            bacterial membrane  --- Certainty = 0.0000(Not Clear)   < succ>
             bacterial outside  --- Certainty = 0.0000(Not Clear)   < succ>
```

The protein has homology with the following sequences in the GENPEPT database:

```
>GP: AAA56999 GB: U09558 ORFA, putative Helix-Turn-Helix motif from
amino acid 21 through 42 and from amino acid 78 through
99 [Lactobacillus johnsonii]
Identities = 28/116 (24%), Positives = 59/116 (50%), Gaps = 6/116 (5%)

Query:   3 YSTLAKEQGVQGYLDGKGSLRDICKWYDISSRSVLQKWIKRYTSGEDLKATSRGYSRMKQ    62
           YST  K + V  YL+ + S++ + K Y+I    +++++W+ +    + L A S  +++
Sbjct:   4 YSTELKIEIVSKYLNHEDSIKGLAKQYNIHW-TLIRRWVDK-AKCQGLAALSVKHTKTTY   61

Query:  63 GRQATFEERVEIVNYTIAHGKDYQAAIEKFGVSYQQIYSWVRKLEKNGSQGLVDRR       118
            + ++ +V Y + H         KF +S Q+Y+W +K    + G   GL+ ++
Sbjct:  62 SS----DFKLNVVRYYLTHSIGVSKVAAKFNISDSQVYNWAKKFNEEGYAGLLPKQ      113
```

No corresponding DNA sequence was identified in *S. pyogenes*.

Based on this analysis, it was predicted that this protein and its epitopes, could be useful antigens for vaccines or diagnostics.

EXAMPLE 424

A DNA sequence (GBSx0460) was identified in *S. agalactiae* <SEQ ID 1371> which encodes the amino acid sequence <SEQ ID 1372>. Analysis of this protein sequence reveals the following:

```
Possible site: 23
>>> Seems to have an uncleavable N-term signal seq
       INTEGRAL      Likelihood = -0.69     Transmembrane    2-18 (2-19)

----- Final Results -----
            bacterial membrane  --- Certainty = 0.1277(Affirmative) < succ>
             bacterial outside  --- Certainty = 0.0000(Not Clear)   < succ>
            bacterial cytoplasm --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 425

A DNA sequence (GBSx0461) was identified in *S. agalactiae* <SEQ ID 1373> which encodes the amino acid sequence <SEQ ID 1374>. This protein is predicted to be integrase (phage-relatedpr). Analysis of this protein sequence reveals the following:

```
Possible site: 28
>>> Seems to have no N-terminal signal sequence

----- Final Results -----
            bacterial membrane --- Certainty = 0.0000(Not Clear) < succ>
            bacterial outside  --- Certainty = 0.0000(Not Clear) < succ>
           bacterial cytoplasm --- Certainty = 0.0000(Not Clear) < succ>
```

The protein has homology with the following sequences in the GENPEPT database:

```
>GP: AAC79517 GB: U88974 ORF1 [Streptococcus thermophilus temperate
bacteriophage 01205]
Identities = 104/172 (60%), Positives = 127/172 (73%), Gaps = 11/172 (6%)

Query:   10 QHQSYAALYLIAKTGMRFAECLGLTVNDIDYTNKYLSINKTWDYHFNQRYLPTKNKSSIR   69
            ++ SYAALY+I+KTG+RFAECLGLTV+DI     LS+NKTWDY N  ++PTK KSSIR
Sbjct:  186 EYASYAALYIISKTGIRFAECLGLTVDDIKRDTGMLSVNKTWDYKNNTGFMPTKTKSSIR  245

Query:   70 NIPIDNDTLFFLHEFTKNKNDRLFDKLSNNAVNKTIRKITGREVRVHSLRHTFASY----  125
            IP+D++ + F+ +    + RL  LSNNAVNKT+RKI GREVRVHSLRHT+ASY
Sbjct:  246 EIPLDDEFINFIDQLPPTDDGRLLPSLSNNAVNKTLRKIVGREVRVHSLRHTYASYLIAH  305

Query:  126 ---LISISQVLDHENLNITLEVYAHQLQEQKDRNDKLNQRNLGRIWGKIALN          174
               LIS+SQVL HENLNITLEVYAHQLQEQK RND+    + ++W K   N
Sbjct:  306 DIDLISVSQVLGHENLNITLEVYAHQLQEQKSRNDE----KIKQMWTKCGQN          353
```

There is also homology to SEQ ID 578 Based on this analysis, it was predicted that this protein and its epitopes, could be useful antigens for vaccines or diagnostics.

EXAMPLE 426

A DNA sequence (GBSx0462) was identified in *S. agalactiae* <SEQ ID 1375> which encodes the amino acid sequence <SEQ ID 1376>. Analysis of this protein sequence reveals the following:

```
Possible site: 22
>>> Seems to have no N-terminal signal sequence

----- Final Results -----
           bacterial cytoplasm --- Certainty = 0.3206(Affirmative) < succ>
            bacterial membrane --- Certainty = 0.0000(Not Clear)   < succ>
            bacterial outside  --- Certainty = 0.0000(Not Clear)   < succ>
```

The protein has no significant homology with any sequences in the GENPEPT database, but there is homology to SEQ ID 1328.

Based on this analysis, it was predicted that this protein and its epitopes, could be useful antigens for vaccines or diagnostics.

EXAMPLE 427

A DNA sequence (GBSx0463) was identified in *S. agalactiae* <SEQ ID 1377> which encodes the amino acid sequence <SEQ ID 1378>. Analysis of this protein sequence reveals the following:

```
Possible site: 45
>>> Seems to have no N-terminal signal sequence

----- Final Results -----
            bacterial cytoplasm --- Certainty = 0.6542(Affirmative) < succ>
            bacterial membrane  --- Certainty = 0.0000(Not Clear)   < succ>
              bacterial outside --- Certainty = 0.0000(Not Clear)   < succ>
```

The protein has homology with the following sequences in the GENPEPT database:

```
>GP: CAB52541 GB: AJ131519 hypothetical protein [Lactobacillus
bacteriophage phi adh]
Identities = 24/55 (43%), Positives = 36/55 (64%)

Query:  12 MDKELTPQEKANKKWAENNREHRTYLSKRSTARSFINKNATKEDLLELKQLIESK  66
           M K    + KANKKW E N+  + Y++KRSTA+SFI    AT+EDL  +++ +  +
Sbjct:   1 MAKITEARAKANKKWDEKNKARKLYINKRSTAKSFILNLATEEDLANIEEYVAER  55
```

No corresponding DNA sequence was identified in *S. pyogenes*.

Based on this analysis, it was predicted that this protein and its epitopes, could be useful antigens for vaccines or diagnostics.

EXAMPLE 428

A DNA sequence (GBSx0464) was identified in *S. agalactiae* <SEQ ID 1379> which encodes the amino acid sequence <SEQ ID 1380>. Analysis of this protein sequence reveals the following:

```
Possible site: 41
>>> Seems to have no N-terminal signal sequence

----- Final Results -----
            bacterial cytoplasm --- Certainty = 0.4417(Affirmative) < succ>
            bacterial membrane  --- Certainty = 0.0000(Not Clear)   < succ>
              bacterial outside --- Certainty = 0.0000(Not Clear)   < succ>
```

The protein has no significant homology with any sequences in the GENPEPT database, but there is homology to SEQ ID 1332.

Based on this analysis, it was predicted that this protein and its epitopes, could be useful antigens for vaccines or diagnostics.

EXAMPLE 429

A DNA sequence (GBSx0465) was identified in *S. agalactiae* <SEQ ID 1381> which encodes the amino acid sequence <SEQ ID 1382>. Analysis of this protein sequence reveals the following:

```
Possible site: 28
>>> Seems to have a cleavable N-term signal seq.

----- Final Results -----
            bacterial outside  --- Certainty = 0.3000(Affirmative) < succ>
            bacterial membrane --- Certainty = 0.0000(Not Clear)   < succ>
            bacterial cytoplasm --- Certainty = 0.0000(Not Clear)  < succ>
```

The protein has no significant homology with any sequences in the GENPEPT database.

No corresponding DNA sequence was identified in S. pyogenes.

Based on this analysis, it was predicted that this protein and its epitopes, could be useful antigens for vaccines or diagnostics.

EXAMPLE 430

A DNA sequence (GBSx0466) was identified in S. agalactiae <SEQ ID 1383> which encodes the amino acid sequence <SEQ ID 1384>. Analysis of this protein sequence reveals the following:

```
Possible site: 47
>>> Seems to have no N-terminal signal sequence
    INTEGRAL    Likelihood = -4.30    Transmembrane    205-221 (202-223)
    INTEGRAL    Likelihood = -3.56    Transmembrane    296-312 (294-312)

----- Final Results -----
            bacterial membrane  --- Certainty = 0.2720(Affirmative) < succ>
            bacterial outside   --- Certainty = 0.0000(Not Clear)   < succ>
            bacterial cytoplasm --- Certainty = 0.0000(Not Clear)   < succ>
```

A related GBS nucleic acid sequence <SEQ ID 9663> which encodes amino acid sequence <SEQ ID 9664> was also identified.

The protein has no significant homology with any sequences in the GENPEPT database.

No corresponding DNA sequence was identified in S. pyogenes.

A related GBS gene <SEQ ID 8573> and protein <SEQ ID 8574> were also identified. Analysis of this protein sequence reveals the following:

```
Lipop: Possible site: -1 Crend: 8
McG: Discrim Score: -8.80
GvH: Signal Score (-7.5): -4.03
    Possible site: 47
>>> Seems to have no N-terminal signal sequence
ALOM program count: 2 value: -4.30 threshold: 0.0
    INTEGRAL     Likelihood = -4.30    Transmembrane    205-221 (202-223)
    INTEGRAL     Likelihood = -3.56    Transmembrane    296-312 (294-312)
    PERIPHERAL   Likelihood = 2.97     20
modified ALOM score: 1.36
*** Reasoning Step: 3

----- Final Results -----
            bacterial membrane  --- Certainty = 0.2720(Affirmative) < succ>
            bacterial outside   --- Certainty = 0.0000(Not Clear)   < succ>
            bacterial cytoplasm --- Certainty = 0.0000(Not Clear)   < succ>
```

Figure 281:
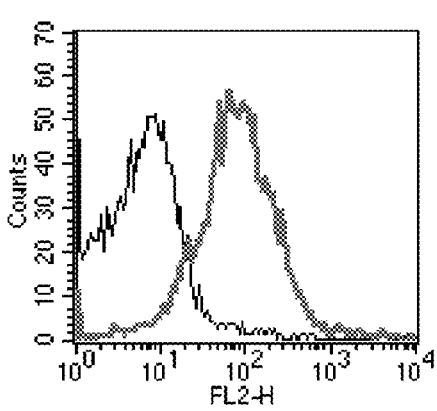

SEQ ID 8574 (GBS366) was expressed in E. coli as a GST-fusion product. The purified fusion protein (FIG. 215, lane 5) was used to immunise mice. The resulting antiserum was used for FACS (FIG. 281), which confirmed that the protein is immunoaccessible on GBS bacteria.

Based on this analysis, it was predicted that these proteins and their epitopes could be useful antigens for vaccines or diagnostics.

EXAMPLE 431

A DNA sequence (GBSx0467) was identified in *S. agalactiae* <SEQ ID 1385> which encodes the amino acid sequence <SEQ ID 1386>. This protein is predicted to be N-acetylmuramoyl-L-alanine amidase. Analysis of this protein sequence reveals the following:

```
Possible site: 31
>>> Seems to have no N-terminal signal sequence

----- Final Results -----
            bacterial cytoplasm --- Certainty = 0.1471(Affirmative) < succ>
            bacterial membrane  --- Certainty = 0.0000(Not Clear)   < succ>
             bacterial outside  --- Certainty = 0.0000(Not Clear)   < succ>
```

A related GBS nucleic acid sequence <SEQ ID 8575> which encodes amino acid sequence <SEQ ID 8576> was also identified. This has an RGD motif at residues 81-83.

The protein has homology with the following sequences in the GENPEPT database:

```
>GP: CAB07986 GB: Z93946 N-acetylmuramoyl-L-alanine amidase
[bacteriophage Dp-1]
Identities = 99/140 (70%), Positives = 120/140 (85%)

Query:   10 MVINIEQAIAWMASRKGKVTYSMDYRNGPSSYDCSSSVYFALRSAGASDNGWAVNTEYEH   69
            M ++IE+ +AWM +RKG+V+YSMD+R+GP SYDCSSS+Y+ALRSAGAS  GWAVNTEY H
Sbjct:    1 MGVDIEKGVAWMQARKGRVSYSMDFRDGPDSYDCSSSMYYALRSAGASSAGWAVNTEYMH   60

Query:   70 DWLIKNGYVLIAENTNWNAQRGDIFIWGKRGASAGAFGHTGMFVDPDNIIHCNYGYNSIT  129
            WLI+NGY LI+EN  W+A+RGDIFIWG++GASAGA GHTGMF+D DNIIHCNY Y+ I+
Sbjct:   61 AWLIENGYELISENAPWDAKRGDIFIWGRKGASAGAGGHTGMFIDSDNIIHCNYAYDGIS  120

Query:  130 VNNHDEIWGYNGQPYVYAYR                                         149
            VN+HDE W Y GQPY Y YR
Sbjct:  121 VNDHDERWYYAGQPYYYVYR                                         140
```

A related DNA sequence was identified in *S. pyogenes* <SEQ ID 1387> which encodes the amino acid sequence <SEQ ID 1388>. Analysis of this protein sequence reveals the following:

```
Possible site: 26
>>> Seems to have no N-terminal signal sequence
     INTEGRAL    Likelihood = -1.06       Transmembrane    79-95 (77-95)

----- Final Results -----
            bacterial membrane  --- Certainty = 0.1426(Affirmative) < succ>
             bacterial outside  --- Certainty = 0.0000(Not Clear)   < succ>
            bacterial cytoplasm --- Certainty = 0.0000(Not Clear)   < succ>
```

An alignment of the GAS and GBS proteins is shown below:

```
Identities = 56/91 (61%), Positives = 68/91 (74%)

Query: 158 KVDNQSVVSKFEKELDVNTPLSNSNMPYYEATISEDYYVESKPDVNSTDKELLVAGTRVR  217
           K+D       F ++LD NT L NSN+PYYEAT+  DYYVESKP+ +S DKE + AGTRVR
Sbjct: 354 KIDKPQSQLTFNQKLDTNTKLDNSNVPYYEATLRTDYYVESKPNASSADKEFIKAGTRVR  413

Query: 218 VYEKVKGWARIGAPQSNQWVEDAYLIDATDM                              248
           VYEKV GW+RI A QS+QWVED YL +AT +
Sbjct: 414 VYEKVNGWSRINASQSDQWVEDKYLSNATQV                              444
```

Figure 44:
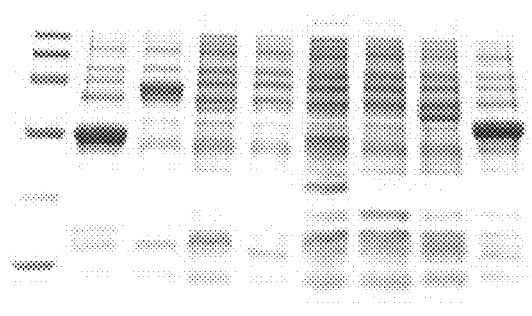
Figure 49:
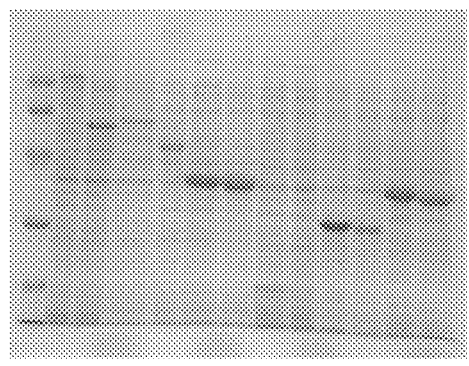

SEQ ID 8576 (GBS301) was expressed in *E. coli* as a His-fusion product. SDS-PAGE analysis of total cell extract is shown in FIG. 44 (lane 9; MW 30 kDa). It was also expressed in *E. coli* as a GST-fusion product. SDS-PAGE analysis of total cell extract is shown in FIG. 49 (lane 3; MW 55 kDa).

Figure 300:
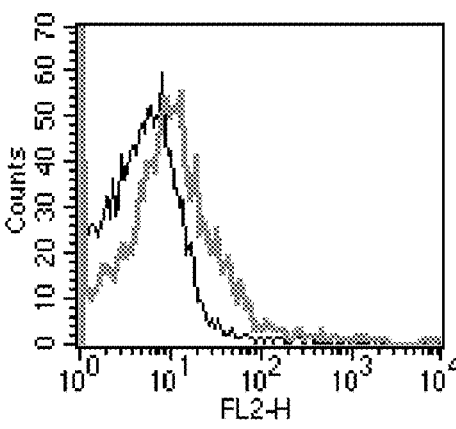

The GBS301-GST fusion product was purified (FIG. 205, lane 4) and used to immunise mice. The resulting antiserum was used for FACS (FIG. 300), which confirmed that the protein is immunoaccessible on GBS bacteria.

Based on this analysis, it was predicted that these proteins and their epitopes could be useful antigens for vaccines or diagnostics.

EXAMPLE 432

A DNA sequence (GBSx0468) was identified in *S. agalactiae* <SEQ ID 1389> which encodes the amino acid sequence <SEQ ID 1390>. Analysis of this protein sequence reveals the following:

```
Possible site: 53
>>> Seems to have an uncleavable N-term signal seq
     INTEGRAL    Likelihood = -6.53    Transmembrane    8-24 (3-25)

----- Final Results -----
            bacterial membrane --- Certainty = 0.3612(Affirmative) < succ>
             bacterial outside --- Certainty = 0.0000(Not Clear)   < succ>
           bacterial cytoplasm --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 433

A DNA sequence (GBSx0469) was identified in *S. agalactiae* <SEQ ID 1391> which encodes the amino acid sequence <SEQ ID 1392>. Analysis of this protein sequence reveals the following:

```
Possible site: 34
>>> Seems to have a cleavable N-term signal seq.

----- Final Results -----
             bacterial outside --- Certainty = 0.3000(Affirmative) < succ>
            bacterial membrane --- Certainty = 0.0000(Not Clear)   < succ>
           bacterial cytoplasm --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 434

A DNA sequence (GBSx0470) was identified in *S. agalactiae* <SEQ ID 1393> which encodes the amino acid sequence <SEQ ID 1394>. Analysis of this protein sequence reveals the following:

```
Possible site: 36
>>> Seems to have no N-terminal signal sequence

----- Final Results -----
           bacterial cytoplasm --- Certainty = 0.0120(Affirmative) < succ>
```

```
                    -continued
        bacterial membrane --- Certainty = 0.0000(Not Clear) < succ>
        bacterial outside  --- Certainty = 0.0000(Not Clear) < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 435

A DNA sequence (GBSx0471) was identified in *S. agalactiae* <SEQ ID 1395> which encodes the amino acid sequence <SEQ ID 1396>. Analysis of this protein sequence reveals the following:

```
Possible site: 38
>>> Seems to have no N-terminal signal sequence

----- Final Results -----
        bacterial cytoplasm --- Certainty = 0.4757(Affirmative) < succ>
        bacterial membrane  --- Certainty = 0.0000(Not Clear)   < succ>
        bacterial outside   --- Certainty = 0.0000(Not Clear)   < succ>
```

A related GBS nucleic acid sequence <SEQ ID 9661> which encodes amino acid sequence <SEQ ID 9662> was also identified.

The protein has no significant homology with any sequences in the GENPEPT database.

No corresponding DNA sequence was identified in *S. pyogenes*.

Based on this analysis, it was predicted that these proteins and their epitopes could be useful antigens for vaccines or diagnostics.

EXAMPLE 436

A DNA sequence (GBSx0472) was identified in *S. agalactiae* <SEQ ID 1397> which encodes the amino acid sequence <SEQ ID 1398>. This protein is predicted to be a minor structural protein. Analysis of this protein sequence reveals the following:

```
Possible site: 23
>>> Seems to have no N-terminal signal sequence
    INTEGRAL    Likelihood = -2.39    Transmembrane    349-365 (347-366)

----- Final Results -----
        bacterial membrane  --- Certainty = 0.1956(Affirmative) < succ>
        bacterial outside   --- Certainty = 0.0000(Not Clear)   < succ>
        bacterial cytoplasm --- Certainty = 0.0000(Not Clear)   < succ>
```

The protein has homology with the following sequences in the GENPEPT database:

```
>GP: AAF43531 GB: AF145054 ORF39 [Streptococcus thermophilus
bacteriophage 7201]
Identities = 212/666 (31%), Positives = 323/666 (47%), Gaps = 52/666 (7%)

Query:  10 WGNNLTLEILSAWNKP---NIASNTSTVNVQVFL-----KMSSYGYISIGETRPLKITVD    61
           W NN     + W      +I +NTS V +++ L       + Y    + E      ++
Sbjct:   5 WSNNDRGYRIRLWVDQVGQDIQNNTSQVRLRLSLLNTTTTFAQYSCSAFVEFNGQRLNWS   64

Query:  62 GRAETINVNPSINYGQRKLLFAKDYIVNHNSDGNKPLFNISAYYPIN--FSNYGEATANQ   119
           G    + N +I       L +   V H DG+  +F + A++  +  +S        NQ
```

```
              -continued
Sbjct:   65 GSPSVLGWNQTIQ------LIDQTITVRHADDGSG-VFGVHAHFNGSGGWSPGNLDIGNQ  117

Query:  120 SISLPKINRLSVSSAISGVLGNAVTITINRYSTSFTHNLKYDFKGSTGTIATGVGTSYLW  179
               I+L  I R S      G +GN V I+I+R     TH L+Y ++   G IA  VGTSY W
Sbjct:  118 QITLTTIPRGSSVRVSDGFIGNQVDISIDRKIGGATHTLRYAWENKQGKIADNVGTSYKW  177

Query:  180 TIPPTFANLLPNELTGTGNLIVETMDGSAKIGETKYTLSITIPNTATYKPKLSSITLSDT  239
              TIP   FAN +PN  +G G + V+T       I     TL+ ++   T  KP  +   TL+DT
Sbjct:  178 TIPEDFANDIPNSTSGRGTIYVDTYINGNFIQTQSTTLTASV-ITNNLKPSFTGFTLTDT  236

Query:  240 NTLTSSIVSG-NNFVRIISKVKVDFGSAIGNNGSTITSYNAEIVGKSNSIIGNGSVFDKL  298
              N  +  IV G  +FV I+S VKV F   A    +G+TI  Y AEIVG +NSI   NG V  ++
Sbjct:  237 NPTSQRIVPGQTHFVSIMSLVKVVFNGAQAKSGATIVGYYAEIVGANNSISSNGGVLREV  296

Query:  299 DFFGSA--TIRATVTDSRGLTSEPVDTKINVIDYFLPIVTSAKVVRSQQNPDILQVLPFV  356
                     T+R  V DSRG+ S+ V+TK+  + YF P +    +V RS +  DIL +   F
Sbjct:  297 SVNQDTEMTLRGRVQDSRGIWSDWVETKLTFLFYFSPAL-RFEVKRSDKKLDILTIKRFA  355

Query:  357 KIAPIIVGGIQKNQLKMSVSVAPYNTGIYAVDSGAATNTWSTISQMSGAPLNLGGTYDKS  416
              KIAP+ V GIQ+N +K++ S A       + VD+G A    WS+IS+ + +    LG +Y
Sbjct:  356 KIAPLSVNGIQRNVMKLTFSTAKVGWDNFVVDNGQAGGVWSSISEFNASDAKLGNSYPAD  415

Query:  417 KSWLVKISVSDNLMSATPIIQPVASEFVLVTKAPSGVAFGKIWEHGIIDAKGDVYVDGTI  476
                  S++V   + D   S T      V ++ V++T     GV  GK  E G +D  GD          I
Sbjct:  416 TSYVVIGKLEDEFTS-TSFQATVPTDEVIMTYDRQGVGIGKYRERGALDVNGD------I  468

Query:  477 YCGDKAIQQKPLALNNGGSFRHDDTDLNSLQDTGFYCVFRGANRPAGAGPGYVTVVRHET  536
               Y  +  IQQ  L  NNG       ++    N+++D G Y +F  A    P   + + H +
Sbjct:  469 YANNSPIQQYQLTNNNGSPKMTNNA--NTIEDPGQYYLFSAA--PGNPSGQWGHLFHHSS  524

Query:  537 ------ANYAYQQFYDRTNKTI-----FTRLLENGVWSGWSEYVKKD--SLQTTGWITIG  583
                          A Q F+    +         ++R++++  W  WE+ + D  +L  TGW    G
Sbjct:  525 YGKGSMYKEAIQIFWSNDGRLFSRHHRWSRIIDD--WEPWKEFARNDNTNLINTGWQPAG  582

Query:  584 -NGFKYKRKGDDIDLMYNFASNGLQRWSVGNMPSGLI--PQELMFAITGWTLAPDKSIHL  640
                +G  YKR GD + + +NF   G   + + ++P   +     PQ  MF +TGW++   +K  ++
Sbjct:  583 VDGSFYKRVGDVLTIKFNFTGTG-GDFLLASVPPEIFKAPQSYMFVVTGWSVWANKQYNV  641

Query:  641 QINASG                                                      646
              Q+N  G
Sbjct:  642 QVNEGG                                                      647
```

No corresponding DNA sequence was identified in *S. pyogenes*.

Figure 82:
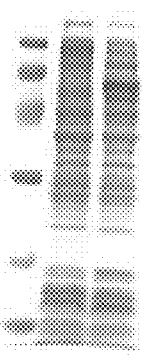

SEQ ID 1398 (GBS365) was expressed in *E. coli* as a GST-fusion product. SDS-PAGE analysis of total cell extract is shown in FIG. 82 (lane 2; MW 102 kDa).

Figure 216:
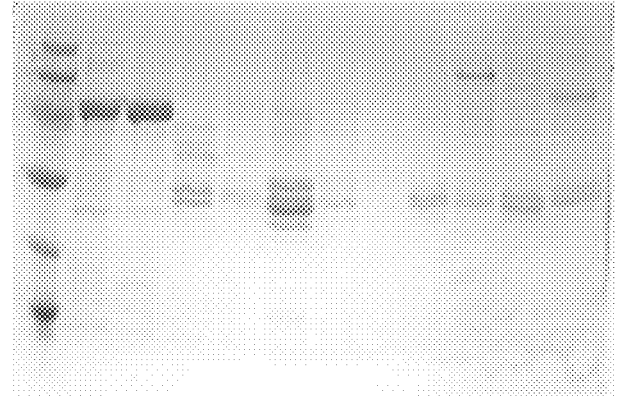

GBS365-GST was purified as shown in FIG. 216, lane 11.

Based on this analysis, it was predicted that this protein and its epitopes, could be useful antigens for vaccines or diagnostics.

EXAMPLE 437

A DNA sequence (GBSx0473) was identified in *S. agalactiae* <SEQ ID 1399> which encodes the amino acid sequence <SEQ ID 1400>. This protein is predicted to be a minor structural protein. Analysis of this protein sequence reveals the following:

```
Possible site: 59
>>> Seems to have no N-terminal signal sequence

----- Final Results -----
         bacterial cytoplasm --- Certainty = 0.3481(Affirmative) < succ>
         bacterial membrane  --- Certainty = 0.0000(Not Clear)   < succ>
          bacterial outside  --- Certainty = 0.0000(Not Clear)   < succ>
```

The protein has homology with the following sequences in the GENPEPT database:

```
>GP: AAC34413 GB: AF158600 putative minor structural protein
[Streptococcus thermophilus bacteriophage Sfi11]
```

-continued

```
Identities = 504/998 (50%), Positives = 675/998 (67%), Gaps = 56/998 (5%)

Query:    1 MLTIHGPDLKPVLFLDNDKQGALNYFNHKWYRKQKTGSSVLEFSVYKKDLLGDSPLSHKY   60
            +LTIH  +L+ V ++DN+KQ LN+FN KW R  ++G+SV EFSV+KK + DS +    Y
Sbjct:    2 LLTIHDNNLQKVAYIDNEKQSTLNFFNDKWTRSLESGTSVFEFSVFKKSIKSDSKVEISY   61

Query:   61 HVLNDQAFVSFVHKGKVQLLNIMKIDEDEKQIDCYCENLNLELLNEYCNAYKATKAMSFE  120
            ++LN++AFVSF HKGK L N+MKI+EDE+ I CYCENL+LELL EY AYKA+K M+F+
Sbjct:   62 KYLNERAFVSFKHKGKSYLFNVMKIEEDEQIIRCYCENLSLELLLEYRGAYKASKPMTFK  121

Query:  121 EYLVQFDILSWGALTVGTNEVKDKKLTLEWTSQETKLARLLSIANNFDAEIEFETKLNFN  180
            EY   + +   LT+G NEV D+K TLEW  QET LARL+S+A NFDAEIEF+T+L  N
Sbjct:  122 EYFDDWGMGQFAKLTLGVNEVSDQKRTLEWEGQETTLARLISLARNFDAEIEFDTRLKPN  181

Query:  181 HTFKQLIINIYKEYEEGKSYGVDRDKTDVILRYQKNISGIRKTVDKRQIYNAIRPYGKK-  239
               + ++N+YK Y+ GK+ GV R ++DVIL+Y KNI+GI+++VDK QIYN I  PYG+K
Sbjct:  182 SQLDEFVLNVYKAYD-GKNQGVGRRRSDVILKYGKNINGIKRSVDKTQIYNMITPYGRKS  240

Query:  240 -TVRGERVISNPVTRKVTKTVGSNRT---YLGGDLKYYGHTIKKANVQAIINYAVQYNIL  295
              T +  + IS+PVT +      V S R    Y GGDL Y GHT+   + VQ I N   VQ N+L
Sbjct:  241 DTKKETKRISDPVTIQNPVVVPSARVEKRYAGGDLTYAGHTLSASLVQTIFNLCVQRNLL  300

Query:  296 PSGIITQLYLESFWGDSTVGKRDNNWAGMSGGAQTRPSGVKVTTGMARPANEGGTYMHYA  355
            PSG+I+QLYLESFWG S V +RDNNW+GM+GGAQTRPSGV VTTG  RPA+EGGTYMHYA
Sbjct:  301 PSGVISQLYLESFWGSSNVARRDNNWSGMTGGAQTRPSGVVVTTGSPRPASEGGTYMHYA  360

Query:  356 SVDDFLKDYTYLLAKQG-----IYNVVGKKNIADYTKGLFRAGGAKYDYAAAGYQSYTNL  410
            SVDDF+KDYTYLLA Q       +Y V GK+NI +YTKGLFR GGA YDYAAAGY   Y   L
Sbjct:  361 SVDDFMKDYTYLLADQTSGGRKMYGVKGKQNIEEYTKGLFRIGGALYDYAAAGYNHYIYL  420

Query:  411 MTNIRNGINKVTGNILNTIDKLWQTPVKPITAVNVARRATKTIQA------INEATKLKG  464
            M +IRNGIN+ GNIL+ +D LW+ P  IT  N ++ T+T++A        +NE  LKG
Sbjct:  421 MRDIRNGINRSNGNILDKLDDLWRQPDNQITQPN--KQVTRTVKADRVIAVLNEMQGLKG  478

Query:  465 RRIGSGQCYALSGWYAKKLDGAWIDSSIGGIRGRIGGGMAAALIGTDYNWGAYGWKVDKS  524
            RR+G+GQCYAL+ WY+ KL G + + + G  IG GMAAA IGTDY W  +GW V +
Sbjct:  479 RRVGNGQCYALAAWYSMKLGGPGLGAGVTGKSGVIGAGMAAAKIGTDYAWDRFGWSVVRP  538

Query:  525 PNAGNLKAGGIYNVRANRGAPFYTTGWGHTGIIKSVSKTRVTVLEQNFVGRMYVVENSYD  584
                +   LK G I N++A         T+ WGH  II S +  + VTVLEQN+ GR YVV+NSY
Sbjct:  539 TSVDQLKPGAIANIKAYNSY-LGTSVWGHVSIIISNNGSTVTVLEQNYAGRQYVVQNSYP  597

Query:  585 INSFASGLQTVCYPREIAQGMSVNGATTQQVSGGTQISYEEVVQEAQTESYEEEQIIYID  644
             +++    ++T+CYP E+ +G +V G T    +  ++    E+     + E    + ID
Sbjct:  598 ASAYLGAVETLCYPPELKEGKTVEGRTETVSTPNVEVQKVEIPPIDVEVTTESTAALTID  657

Query:  645 NSIYKEWKDENGKVEYYLKNGFLYAPLSRDRYPSVLTGNETRDNWIRKDMEVETDSQEVL  704
             +   +EW++ENG+VE+YL NG LYAP+S++   YPS+LTG E  DNWIRKDME++TDS++VL
Sbjct:  658 SKRKQEWRNENGQVEFYLENGSLYAPISKELYPSILTGKENGDNWIRKDMEIDTDSEDVL  717

Query:  705 MSTGLKDLKAHAYPAITYEVDGYVDLELGDVVRIQDDGYEPPLILTARVVEQEISITNPS  764
            +ST L+++L+   YPAITYEVDG++DL++GD V+IQD G+ P L+L ARV EQ+IS TNP
Sbjct:  718 ISTALRNLRKFCYPAITYEVDGFLDLDIGDTVKIQDTGFSPMLMLEARVSEQQISFTNPV  777

Query:  765 SNKTKFSNFVEKESQLASDLISDMLRLYDESIPYEIKLATSNGVAFKNGTGESVLTPSLQ  824
                NKT F+NF   +++++  L+S M +L +E+IPYE+KL+T NG  FKN TG SVL  +L+
Sbjct:  778 ENKTVFANFQTLQNKVSDSLLSRMTKLAEEAIPYELKLSTDNGTTFKNSTGQSVLKATLE  837

Query:  825 KNGKDYEAVYFYKNGDSLIDIGPSLIVKASDFNHVLNITVEAYLNEELVASTQISFTDTE  884
            KNG+ Y+ ++F+KNGDS+I  G  L+VK +DF + L +TVEAYL++ELVAS +I+FTD
Sbjct:  838 KNGEVYQPIFFFKNGDSIIGTGNQLVVKPTDFENTLQVTVEAYLDDELVASAEITFTDVS  897

Query:  885 DGADGKDGAPGPQGPPGVNGLQGPKGDQGIQGPAGADGKATYTHIAYALDENGSTGFSVS  944
            DG                QGPKGD G+                  L     S G+
Sbjct:  898 DGK----------------QGPKGDDGVS--------------PINLIIESSNGYQFK  925

Query:  945 DNVGKTYI--GMYVDDNIIDSNDPK-KYKWNLIKGADG                         979
            +N+ T     +Y D+ ID + + Y W+ + ADG
Sbjct:  926 NNIINTTFTAKLYQDNKEIDKDGTRYAYLWSKV-NADG                         962
```

A related DNA sequence was identified in *S. pyogenes* <SEQ ID 1401> which encodes the amino acid sequence <SEQ ID 1402>. Analysis of this protein sequence reveals the following:

```
Possible site: 37
>>> Seems to have a cleavable N-term signal seq.
    INTEGRAL    Likelihood = -3.56    Transmembrane    325-341 (323-343)
```

```
----- Final Results -----
            bacterial membrane --- Certainty = 0.2423(Affirmative) < succ>
            bacterial outside  --- Certainty = 0.0000(Not Clear)   < succ>
            bacterial Cytoplasm --- Certainty = 0.0000(Not Clear)  < succ>
```

An alignment of the GAS and GBS proteins is shown below:

```
Identities = 23/55 (41%), Positives = 27/55 (48%)

Query: 886 GADGKDGAPGPQGPPGVNGLQGPKGDQGIQGPAGADGKATYTHIAYALDENGSTG       940
           G  GKDGAPG   G PG   G +G +G+ G QGP G  G+       T          G  G
Sbjct: 181 GEAGKDGAPGKDGAPGEKGEKGDRGETGAQGPVGPQGEKGETGAQGPAGPQGEAG       235

Identities = 48/151 (31%), Positives = 58/151 (37%),
Gaps = 19/151 (12%)

Query: 852 KASDFNHVLNITVEAYLNE--ELVASTQISFTDTEDGADGKDGAPGPQGPPGVNGLQGPK   909
           K  DF   L    E  L E  +L+  + I      + G  G   GPQG   G  GQGPK
Sbjct:  82 KEEDFQKELKDFTEKRLKEILDLIGKSGIK---GDRGETGPAGPAGPQGKTGERGAQGPK   138

Query: 910 GD---QGIQGPAGADGKATYTHIAYALDENGSTGFS----VSDNVGKTYIGMYVDDNIID   962
           GD    QGIQG AG  G+             E  G   G +           GK      D
sbjct: 139 GDRGEQGIQGKAGEKGERGEKGDKGETGERGEKGEAGIQGPQGEAGK-------DGAPGK   191

Query: 963 SNDPKKYKWNLIKGADGARGIQGPAGADGKT                                993
              P  +       +G  GA+G  GP G  G+T
Sbjct: 192 DGAPGEKGEKGDRGETGAQGPVGPQGEKGET                                222

Identities = 25/50 (50%), Positives = 29/50 (58%),
Gaps = 9/50 (18%)

Query: 884 EDGADGKDGAPGPQGPPGVNGL---------QGPKGDQGIQGPAGADGKA             924
           +DGA  GRDGAPG +G  G                QG KG+ G QGPAG G+A
Sbjct: 185 KDGAPGKDGAPGEKGEKGDRGETGAQGPVGPQGEKGETGAQGPAGPQGEA             234
```

Figure 122:
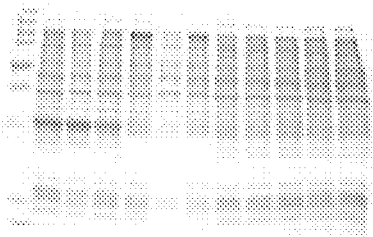
Figure 232:
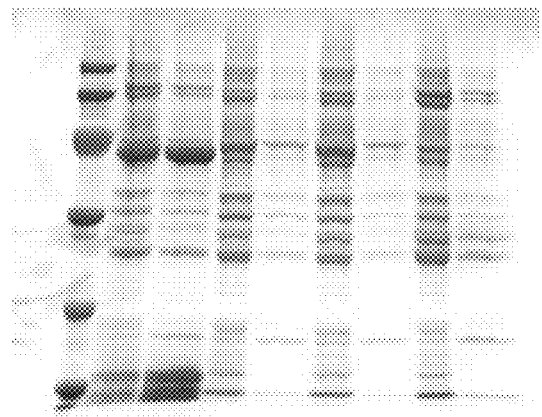
Figure 233:
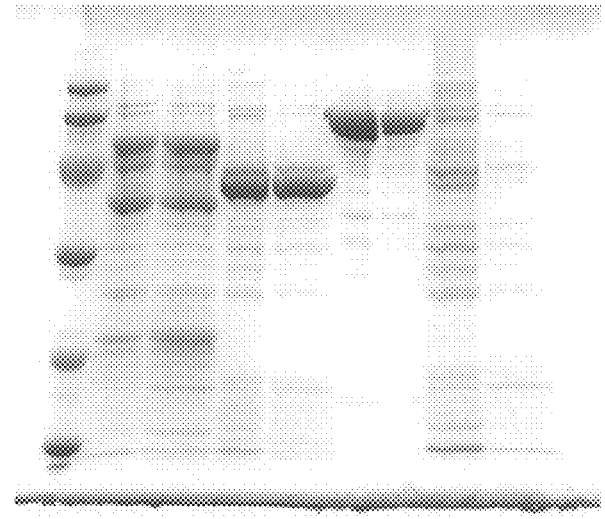

SEQ ID 1400 was expressed in four different forms. SDS-PAGE analysis of total cell extract is shown in FIG. 122 (GBS105dN—lane 5 & 7; MW 102 kDa), FIG. 122 (GBS105dC—lane 8-10; MW 81 kDa), FIG. 179 (GBS105d—lane 8; MW 102 kDa) and in FIG. 181 (GBS105C—lane 2; MW 56 kDa). GBS105dN-His was purified as shown in FIG. 232 (lanes 9 & 10). GBS105dC-His was purified as shown in FIG. 233 (lanes 3 & 4).

Based on this analysis, it was predicted that these proteins and their epitopes could be useful antigens for vaccines or diagnostics.

EXAMPLE 438

A DNA sequence (GBSx0474) was identified in *S. agalactiae* <SEQ ID 1403> which encodes the amino acid sequence <SEQ ID 1404>. This protein is predicted to be a minor structural protein. Analysis of this protein sequence reveals the following:

```
Possible site: 32
>>> Seems to have no N-terminal signal sequence

----- Final Results -----
            bacterial cytoplasm --- Certainty = 0.2502(Affirmative) < succ>
            bacterial membrane  --- Certainty = 0.0000(Not Clear)   < succ>
            bacterial outside   --- Certainty = 0.0000(Not Clear)   < succ>
```

The protein has homology with the following sequences in the GENPEPT database:

```
>GP: AAC34412 GB: AF158600 putative minor structural protein
[Streptococcus thermophilus bacteriophage Sfi11]
```

```
-continued
Identities = 163/433 (37%), Positives = 244/433 (55%), Gaps = 21/433 (4%)

Query:  80 LSSKKPKMLMFSHIPGRYYLAVQVGDLNFKEIKMNGFGEIT--FIVADAYAHSTSYRRIK 137
           L +KK   L    P RYYLA+  G+++ K I  + + E T   F+V D  AHST+Y+R+
Sbjct:  93 LHTKKAVKLFLPTEPERYYLALVKGEVSLKGIS-DWYDEATIEFLVPDGVAHSTTYKRVT 151

Query: 138 DYTQDGNKMTFKIKNNGTAPAFPIFRIKHLGENGYIGITNETGAFAVGSPEEEDGTIVHR 197
           DY +   KM F I N G+  A+PI  +K   ENGY G+ ++   AF   G+ EE DG I+ +
Sbjct: 152 DYQEKDGKMIFSIDNEGSTDAYPIITLKANAENGYYGLVSDKFAFEAGNIEEADGKIISK 211

Query: 198 NETLFDY-SKAIAQAL-EGAPNVAKLNYMPPTFDSELKRMRLDNILGSGKGGEYVAIGAR 255
              E L+D+     I QA  +GA NV    N      +    + + N+ G        IG +
Sbjct: 212 AEVLYDFRDDRIPQAFAKGAKNVGITNVTGDLHGT----LEIQNVWGRPH------IGLK 261

Query: 256 GTTPGYGE-HVGTRTFIINPDSNGEY-TLNEHLWWKQIFIATAQDQKGFLKLCVTGENDE 313
             +     + T  I PDS+G   LNE++WW+QIF A +  Q GFLKL V+   +
Sbjct: 262 NPNANINQLQTASLTLDIPPDSSGNVGALNEYIWWRQIFWAGSISQYGFLKLTVSDADGN 321

Query: 314 FLYGIETYKRKNGFETEYNFFALDDDGVGWRFYKQFEFQA-DRNYHNPFSMNRSRAVEIF 372
           FLYG+ET+KR  G E+EYN  A D   G G+RF KQ+ F A +    HNPF+  R   +I
Sbjct: 322 FLYGVETFKRSLGLESEYNALASDGYG-GFRFLKQWSFLATEYEDHNPFNEPRGWS-DIK 379

Query: 373 REEDKFRIYFNGAHHHVTVPSLKGKKSRKIHLAMGTCSDSSKYINYNLFEKVNFEKMGVS 432
           RE+DK   Y+ G ++    T+P +KGKKS KIHL +      S  ++ +  F+++ + K    +
Sbjct: 380 REDDKVTFYWWGTYNTFTIPEIKGKKSAKIHLTISNI-PSKSFVTHAYFDQLLYIKTNNA 438

Query: 433 HYNNIVNKYQPGDEVIINFENDTVSTKDIDSIQDVVLGSKMISIPPGESELVVHLSSWVA 492
            + +I N+Y  G  +IIN E+DT++   ++ ++ ++V GS     IPPGES++ V  S W
Sbjct: 439 FFEDIPNRYIQGSNLIINSEDDTLTLNNLLNLDEIVDGSLWPVIPPGESQIEVVQSPWAK 498

Query: 493 ALPDISIDFEERY                                                505
            P ++I+FEER+
Sbjct: 499 KKPSVTIEFEERW                                                511
```

No corresponding DNA sequence was identified in *S. pyogenes*.

Based on this analysis, it was predicted that this protein and its epitopes, could be useful antigens for vaccines or diagnostics.

EXAMPLE 439

A DNA sequence (GBSx0475) was identified in *S. agalactiae* <SEQ ID 1405> which encodes the amino acid sequence <SEQ ID 1406>. This protein is predicted to be PblA. Analysis of this protein sequence reveals the following:

```
Possible site: 57
>>> Seems to have no N-terminal signal sequence
    INTEGRAL    Likelihood = -7.11   Transmembrane   427-443 (424-445)
    INTEGRAL    Likelihood = -4.99   Transmembrane   449-465 (448-469)
    INTEGRAL    Likelihood = -2.71   Transmembrane    41-57  (38-57)
    INTEGRAL    Likelihood = -0.37   Transmembrane   361-377 (361-377)
    INTEGRAL    Likelihood = -0.22   Transmembrane   324-340 (324-340)

----- Final Results -----
         bacterial membrane --- Certainty = 0.3845(Affirmative) < succ>
          bacterial outside --- Certainty = 0.0000(Not Clear)   < succ>
         bacterial cytoplasm --- Certainty = 0.0000(Not Clear)   < succ>
```

The protein has homology with the following sequences in the GENPEPT database:

```
>GP: AAG18638 GB: AY007505 PblA [Streptococcus mitis]
Identities = 233/401 (58%), Positives = 296/401 (73%), Gaps = 17/401 (4%)
Query:   1 MATNLGQAYVQIMPSAKGISGSISKTLDPEASSAGSSAGSLLGGKLIGILGSVIAAAKIG   60
           MAT +  QAYVQ++PSA+GI+G I   L+PEAS+AG SAG  LG  L+G++   VIAAA IG
Sbjct:   1 MATEIAQAYVQLIPSARGITGKIQSILNPEASAAGQSAGQSLGSSLVGVMTKVIAAAGIG   60

Query:  61 EMVTKAISSSISEGAALQQSLGGVETLFKSNANLVKKYADEAYKTTGLSANAYMESVTGF  120
              KA  S++ ISEGAALQQSLGG+ETLFK +A+  VK YA+EAYKTTGLSANAYME+VTGF
Sbjct:  61 ----KAFSAAISEGAALQQSLGGIETLFKGSADKVKGYANEAYKTTGLSANAYMENVTGF  116

Query: 121 SASLLQSLGGDTAKAAKVANMAMIDMADNSNKMGTSMESIQYAYQGFAKQNYTMLDNLKL  180
           SASLLQSLGGDT KAA+ ANMAMIDM+DN+NKMGTSMESIQ AYQGFAKQNYTMLDNLKL
```

```
Sbjct: 117 SASLLQSLGGDTNKAAETANMAMIDMSDNANKMGTSMESIQMAYQGFAKQNYTMLDNLKL   176

Query: 181 GYGGTQEEMKRLLSDAQKLTGKKYDISNLSDVYEAIHAIQGKIGITGTTAKEAATTFTGS   240
           GYGGT++EM+RLL+DA+KLTG KYDI+NLSDVY AIHAIQ  +  ITGTTAKEAA+TF+GS
Sbjct: 177 GYGGTKQEMQRLLADAEKLTGVKYDINNLSDVYSAIHAIQENLDITGTTAKEAASTFSGS   236

Query: 241 FEAMKAASKNLLGKMALGEDIKPSLKALFDTTSNFVLNNFIPMLTNVFKGFGSVISLTFS   300
           FE+MKAA++N+LGK+ALGE+I PSL AL  TTS F+ +NF+PM+ NVF G G V++   S
Sbjct: 237 FESMKAAAQNVLGKLALGENILPSLHALLKTTSTFLFDNFLPMIGNVFSGLGLVLTEGIS   296

Query: 301 ELIPKIVGFMQTSGPSLMQSGISFIISFVNGFLTAYPAFLTVAGKIFTDFVSFVMQSIPG   360
           ++  ++G         S +  +S + G    +  F   + G +        ++ +I G
Sbjct: 297 QIASQLFG-------DAFGSAVFDQLSRITGIFETF--FDMIFGSLSKQDNIDILNTI-G   346

Query: 361 LLQAGATLVLNLIDGILANLPQIATS---AVSVISSFISML                     398
             + AT ++N+ D I    I ++   V ++  F+  L
Sbjct: 347 FSEEAATQIVNIADNIRVTFENIGSAIGDVVGIVGDFVGDL                     387

Identities = 112/386 (29%), Positives = 172/386 (44%), Gaps = 18/386 (4%)
Query: 235 TTFTGSFEAMKAASKNLLGKMA-LGEDIKPSLKA---LFDTTSNFVLNNFIPMLTNVFKG   290
           TT+     E++KA    ++   + L E IK +       L    T    V+   FI    N++
Sbjct: 580 TTWNAYVESLKAMWNAVVTFFSDLWESIKEAASTAWTLITTAVMMVVQPFIDGFMNIWNN   639

Query: 291 FGSVISLTFSELIPKIVGFMQTSGPSLMQSGISFIISFVNGFLTAYPAFLTVAGKIFTDF   350
             ++ +  +         G +      S+   I  II V G      A L++ +     +
Sbjct: 640 ISEGLTQVWEGIKLIFEGAWEFI-KSIFLGAILIIIDLVTGNFGQLGADLSLIWEGIKNG   698

Query: 351 VSFVMQSIPGLLQAGATLVLNLIDGILANLPQIATSAVSVISSFISMLQANYPAILKKGF   410
           +S + + I         +++        G+ N   + ++     I +   SM      + I
Sbjct: 699 ISLIWSGIKTYFSGVVDVIVGYATGVFENFSNVLSTIWEFIKTAASMA---WEWIKSTVS   755

Query: 411 EILSYLVQGIIARLPDIVITVGKL----IAILAGAIASNLPKVLALGVQLLITFVKGILSV   467
           +++ L+QG          +V + L  I   A A   S L K L LG    +  VG +
Sbjct: 756 NLITGLIQGAQNLWNNFVSFLSGLWENIKSTASAAWSGL-KSLVLG--FINGLVSGAQTA   812

Query: 468 IGKINETANNIGEK---LINAIKSIDLLSAGRAIMRGFLRGLEDVWGDIQNFVGDIAGWI   524
           + +   +++      K    + N  IK+I+L    AG+AI+   GFL  GL+  W     +  NFVG IA   WI
Sbjct: 813 WNNMKQAVSDLVTKVTNIFNGIKNINLWEAGKAILNGFLGGLKSAWEGVTNFVGGIANWI   872

Query: 525 KDHKGPISYDRRLLIPAGNAIMQGLHQGLVDKFKPVKNLVNGMAEEIQSSFGNPQLAFDM   584
           +DHKGPI YDR+LLIPAGNAIM  L  GL D FK VK  V GM+ EI       F    L   +
Sbjct: 873 RDHKGPIEYDRKLLIPAGNAIMGSLDNGLKDGFKDVKKTVGGMSGEISDVFSGDNLDLNS   932

Query: 585 DTNVNNGFE-RIGTLNKNLSSQVTST                                   609
           +V    E R+   +  L   Q + T
Sbjct: 933 TASVTKNLEARLAMPSAQLEVQESKT                                   958
```

A related DNA sequence was identified in *S. pyogenes* <SEQ ID 1407> which encodes the amino acid sequence <SEQ ID 1408>. Analysis of this protein sequence reveals the following:

```
Possible site: 55
>>> Seems to have no N-terminal signal sequence
    INTEGRAL    Likelihood = -2.76    Transmembrane    458-474   (458-474)
    INTEGRAL    Likelihood = -2.60    Transmembrane    483-499   (482-499)
    INTEGRAL    Likelihood = -2.02    Transmembrane    429-445   (429-445)
    INTEGRAL    Likelihood = -1.28    Transmembrane    397-413   (397-413)
    INTEGRAL    Likelihood = -0.53    Transmembrane    739-755   (738-755)
    INTEGRAL    Likelihood = -0.27    Transmembrane    356-372   (356-372)

----- Final Results -----
          bacterial membrane  --- Certainty = 0.2105(Affirmative) < succ>
          bacterial outside   --- Certainty = 0.0000(Not Clear)  < succ>
          bacterial cytoplasm --- Certainty = 0.0000(Not Clear)  < succ>
```

The protein has homology with the following sequences in the databases:

```
>GP: AAB18717 GB: U38906 ORF42 [Bacteriophage rlt]
Identities = 261/579 (45%), Positives = 359/579 (61%), Gaps = 63/579 (10%)
Query: 184 MKRLLSDAEKLPAAMGKKFDLSNYADVVEAIHLVQDNMGIAGVAAEEAKTTFSGSLAAMK   243
           M+RLL+DA+KL    G+K+D+SN++D+ +AIH +Q  M  G  A+EA TTFSGS  +MK
Sbjct:   1 MQRLLTDAQKLT--GQKYDISNFSDITQAIHAIQTEMDITGTTAKEASTTFSGSFDSMK    57
```

-continued

```
Query: 244 SSFTNVMAGLSLGDDIRPALRGLAETTSNFLFGNFIPMVANIFKGLPSAIGTFIGAAAPI  303
            ++ +NV+ LSLG D++  L  L  TTS FLF NFIPMV NIFK LP AI TF+ AA
Sbjct:  58 AAMSNVLGNLSLGRDLQGPLNALVSTTSTFLFKNFIPMVGNIFKALPGAISTFVSAAGKE  117

Query: 304 ITSQ------------------------------------FQGLMSSLG-ISIDLSPIT  325
            ++SQ                                    F  L+SS+G IS +  +
Sbjct: 118 LSSQLGNGIGSGFSDFTAKFSSILSPLQGSFQTIVSGLKPVFDSLLSSIGPISTQIMGVF  177

Query: 326 AKFAQIGQNLQ----PVFNGLKTAFSQLPSFFTSIGSAVAPVIDTIISGLARLDFSGFEA  381
            +K Q+ N+       PV + L AF QLPS F +I  AV P+IDTI SG++RLDFSG +A
Sbjct: 178 SKLPQLFSNVISAVIPVISTLSVAFGQLPSLFEAISVAVQPMIDTISSGISRLDFSGIQA  237

Query: 382 LISAILPALQAGFSNFAAIVGPAISGVVDSFVGMWNAAQPLISILSDALMPVFQILGSFL  441
            +ISA++PA+ G +    I+GP+I +V+SFV MWN+ QPL ++++ ALMP FQ+LG+F+
Sbjct: 238 IISALVPAITTGITTMMGIIGPSIDTLVNSFVKMWNSIQPLATVIAGALMPAFQVLGAFI  297

Query: 442 GGVVKGALMGVSFAFDAVKVAIQLVTPIIDDLLVQGLNFVQPVLSVIAEWIGVAIGMFGNL  501
            GGV+KGA++ +S  FD ++V +  +TPII  ++        PVL+ +A+W+G AIG F N
Sbjct: 298 GGVLKGAMLALSATFDTIRVVVGFLTPIIAAVLAKFQEFAPVLATVAQWVGTAIGFFANF  357

Query: 502 GTAGQGLSAFIKSAWTNIQTAISTAGTIISTVIDYIKLAFSGAGSAVGVLKNIFSLAWMA  561
            G AG  L   I SAW  I++ IS+  +I +I+  K  F+G GSA G L+++ S AW
Sbjct: 358 GAAGTSLKGLITSAWNGIKSIISSVVSGIGGIINTAKAIFTGLGSAGGALRSMISGAWSG  417

Query: 562 MGDAINVAKGIISSVINGIKSAFSSFS-------SLVSSVGSAVNGVIDSISSTIRG---  611
            +   I+   G IS   INGIKS FSS         S++S V S  G+I    SSTI G
Sbjct: 418 IRSIISSVGGSISGTINGIKSFFSSLGGSGNGLRSVMSGVWSGITGIISGASSTISGIID  477

Query: 612 --------LANIDISGAGAAIMNGFLNGLKSAWGAVKSFVSGIANWIAEHKGPISYDRVL  663
                    L NID++GAG A+++GF+ GLKS W A K FV GIA+WI +HKGPISYDR +
Sbjct: 478 GIKNIFNSLKNIDLAGAGRAVIDGFVGGLKSTWEAGKKFVGGIADWIKDHKGPISYDRKI  537

Query: 664 LKPAGKAIMGGLNTSLIDGFKEVKSNVSGMADDLASTMT                      702
            L PAG+AIMGG N SL++ FK V+ NVSG+A   + S +T
Sbjct: 538 LIPAGQAIMGGFNDSLMENFKAVQKNVSGIAKQIQSAIT                      576
```

An alignment of the GAS and GBS proteins is shown below:

```
Identities = 272/701 (38%), Positives = 371/701 (52%), Gaps = 91/701 (12%)
Query:   1 MATNLGQAYVQIMPSAKGISGSISKTLDPEASSAGSSAGSLLGGKLIGILGSVIAAAKIG   60
           MAT LGQAYVQIMPSA+GISG+ISK LDPEA SAG SAGSL+GG L+ ++G IAAA IG
Sbjct:   1 MATELGQAYVQIMPSARGISGAISKQLDPEARSAGLSAGSLIGGNLVKMIGGAIAAAGIG   60

Query:  61 EMVTKAISSSISEGAALQQSLGGVETLFKSNANLVKKYADEAYKTTGLSANAYMESVTGF  120
           +M    ISS++S GA LQQS GG++TL+K    VK +A EAYK  G+SAN Y E
Sbjct:  61 KM----ISSALSAGADLQQSFGGIDTLYKGAETAVKGFAKEAYKA-GISANTYASQAVSM  115

Query: 121 SASLLQSLGGDTAKAAKVANMAMIDMADNSNKMGTSMESIQYAYQGFAKQNYTMLDNLKL  180
            ASL QSLGGD  AAK  ANMA++DMADNS KMGT + SIQ AYQGFAKQNYTMLDNL+L
Sbjct: 116 GASLKQSLGGDAVAAAKAANMAIMDMADNSAKMGTDITSIQMAYQGFAKQNYTMLDNLRL  175

Query: 181 GYGGTQEEMKRLLSDAQKL---TGKKYDISNLSDVYEAIHAIQGKIGITGTTAKEAATTF  237
           GYGGT+EEMKRLLSDA+KL    GKK+D+SN +DV EAIH +Q  +GI G  A+EA TTF
Sbjct: 176 GYGGTKEEMKRLLSDAEKLPAAMGKKFDLSNYADVVEAIHLVQDNMGIAGVAAEEAKTTF  235

Query: 238 TGSFEAMKAASKNLLGKMALGEDIKPSLKALFDTTSNFVLNNFIPMLTNVFKGFGSVISL  297
           +GS  AMK++  N++   ++LG+DI+P+L+ L  TTSNF+ NFIPM+ N+FKG  S  I
Sbjct: 236 SGSLAAMKSSFTNVMAGLSLGDDIRPALRGLAETTSNFLFGNFIPMVANIFKGLPSAIGT  295

Query: 298 TFSELIPKIV----GFMQTSGPSLMQSGISFIISFV--------NGFLTAY---PAFLTV  342
             P I     GM +GS+ SI+  +     NG TA+   P+F T
Sbjct: 296 FIGAAAPIITSQFQGLMSSLGISIDLSPITAKFAQIGQNLQPVFNGLKTAFSQLPSFFTS  355

Query: 343 AGKIFTDFVSFVMQSIPGL----LQAGATLVLNLIDGILANLPQIATSAVS-VISSFISM  397
              G         +    + L  +A + +L +     +N  I  A+S V+ SF+ M
Sbjct: 356 IGSAVAPVIDTIISGLARLDFSGFEALISAILPALQAGFSNFAAIVGPAISGVVDSFVGM  415

Query: 398 LQANYPAI------LKKGFEILSYLVQGI----------------------IARLPDIVIT  430
             A   P I     L   F+IL   +   G+                     + + D+++
Sbjct: 416 WNAAQPLISILSDALMPVFQILGSFLGGVVKGALMGVSFAFDAVKVAIQLVTPIIDDLLVQ  475

Query: 431 ----VGKLIAILAGAIASNLPKVLALGV--QLLITFVKGILSVIGKINETANNIGEKLIN  484
                V +++++A I   +  LG  Q L F+K + +I   TA  I  +I+
Sbjct: 476 GLNFVQPVLSVIAEWIGVAIGMFGNLGTAGQGLSAFIKSAWTNIQTAISTAGTIISTVID  535
```

```
-continued
Query:  485 AIKSI----------------------DLLSAGRAIMRGFLRGLEDVWGDIQNFVGDIA   521
            IK                        D ++  + I+   + G++  +     + V +
Sbjct:  536 YIKLAFSGAGSAVGVLKNIFSLAWMAMGDAINVAKGIISSVINGIKSAFSSFSSLVSSVG   595

Query:  522 GWIKDHKGPISYDRRLLI-----PAGNAIMQGLHQGLVDKFKPVKNLVNGMAEEIQSSFG   576
            +     IS   R L        AG AIM G  GL   + VK+ V+G+A I     G
Sbjct:  596 SAVNGVIDSISSTIRGLANIDISGAGAAIMNGFLNGLKSAWGAVKSFVSGIANWIAEHKG   655

Query:  577 NPQLAFDMDTMVNNGFERIGTLNKNLSSQVTSTDNYTSGNA                     617
            +++D        G   +G LN +L         + SG A
Sbjct:  656 --PISYDRVLLKPAGKAIMGGLNTSLIDGFKEVKSNVSGMA                     694
```

Based on this analysis, it was predicted that these proteins and their epitopes could be useful antigens for vaccines or diagnostics.

EXAMPLE 440

A DNA sequence (GBSx0477) was identified in *S. agalactiae* <SEQ ID 1409> which encodes the amino acid sequence <SEQ ID 1410>. Analysis of this protein sequence reveals the following:

```
Possible site: 16
>>> Seems to have no N-terminal signal sequence

----- Final Results -----
            bacterial cytoplasm --- Certainty = 0.2565(Affirmative) < succ>
            bacterial membrane  --- Certainty = 0.0000(Not Clear)   < succ>
             bacterial outside  --- Certainty = 0.0000(Not Clear)   < succ>
```

The protein has homology with the following sequences in the GENPEPT database:

```
>GP: AAG18637 GB: AY007505 unknown [Streptococcus mitis]
Identities = 64/119 (53%), Positives = 87/119 (72%), Gaps = 2/119 (1%)

Query:   1 MLKMDEDALVCDLAETYHIYDYKQLPPLKVAVFSLGLREESRINRVISGNRVSFERRILA    60
           M++ DEDAL+CDLAETY I+DY+QLP +VAVF+ GLR++SRI   ++ ++V FE  +LA
Sbjct:   1 MIQTDEDALICDLAETYGIFDYRQLPADQVAVFAFGLRDDSRIKLAMTNSKVPFETFLLA    60

Query:  61 GMFDRLGMLIWMKTTDGQKGKNRPEMVSTMF--DNQQKDSEVVSFGSGKDFEETRNNIL   117
           G+ DRL  L+W KTTDGQKG N+P MV+         + K+S+ + F SG+DFEE R  IL
Sbjct:  61 GVLDRLSALVWFKTTDGQKGINKPLMVTEELTGKTKAKESKEMIFDSGEDFEEYRQKIL   119
```

A related DNA sequence was identified in *S. pyogenes* <SEQ ID 1411> which encodes the amino acid sequence <SEQ ID 1412>. Analysis of this protein sequence reveals the following:

```
Possible site: 41
>>> Seems to have no N-terminal signal sequence

----- Final Results -----
            bacterial cytoplasm --- Certainty = 0.2905(Affirmative) < succ>
            bacterial membrane  --- Certainty = 0.0000(Not Clear)   < succ>
             bacterial outside  --- Certainty = 0.0000(Not Clear)   < succ>
```

An alignment of the GAS and GBS proteins is shown below:

```
Identities = 60/123 (48%), Positives = 82/123 (65%), Gaps = 2/123 (1%)

Query:   1 MLKMDEDALVCDLAETYHIYDYKQLPPLKVAVFSLGLREESRINRVISGNRVSFERRILA    60
           M+  D+DAL CDLAETY IYDY+QLP +VAVF++GLR  SRI   +SG  + +  +LA
Sbjct:   1 MIAKDDDALTCDLAETYGIYDYRQLPAYQVAVFAVGLRSNSRIKMALSGETEALDTVLLA    60
```

-continued

```
Query:  61 GMFDRLGMLIWMKTTDGQKGKNRPEMV--STMFDNQQKDSEVVSFGSGKDFEETRNNILG  118
           G++D   +L W KT DGQ G+N+P+ V  +     QK ++V+SF SG+DFE  R  +LG
Sbjct:  61 GIYDNTNLLFWSKTKDGQSGQNKPKSVVEAISGSKSQKANDVISFVSGEDFENARKQLLG  120

Query: 119 FGG  121
           G
Sbjct: 121 GDG  123
```

Based on this analysis, it was predicted that these proteins and their epitopes could be useful antigens for vaccines or diagnostics.

EXAMPLE 441

A DNA sequence (GBSx0478) was identified in *S. agalactiae* <SEQ ID 1413> which encodes the amino acid sequence <SEQ ID 1414>. Analysis of this protein sequence reveals the following:

```
Possible site: 36
>>> Seems to have no N-terminal signal sequence

----- Final Results -----
            bacterial cytoplasm --- Certainty = 0.2280(Affirmative) < succ>
             bacterial membrane --- Certainty = 0.0000(Not Clear)   < succ>
              bacterial outside --- Certainty = 0.0000(Not Clear)   < succ>
```

The protein has homology with the following sequences in the GENPEPT database:

```
>GP: AAG18636 GB: AY007505 unknown [Streptococcus mitis]
Identities = 40/80 (50%), Positives = 62/80 (77%), Gaps = 1/80 (1%)

Query:   3 TSSGFEYKIEESRLKNYELVEALADLESNPLSLPKVLRLLLGDQVESLKNHLRASDGTVS  62
           TS+GF ++I + RL+NYEL+EA++++++NP  LPKV++L+LG++ E LKNH+R +DG V
Sbjct:  24 TSTGFPFEITKERLENYELLEAISEVDTNPAVLPKVVKLMLGNKSEDLKNHVRTADGIVP  83

Query:  63 TEALMEEVKEIFES-GQLKK  81
           + +  E+ EIF S  QLKK
Sbjct:  84 LDKMGAEISEIFSSQNQLKK  103
```

A related DNA sequence was identified in *S. pyogenes* <SEQ ID 1415> which encodes the amino acid sequence <SEQ ID 1416>. Analysis of this protein sequence reveals the following:

```
Possible site: 56
>>> Seems to have no N-terminal signal sequence

----- Final Results -----
            bacterial cytoplasm --- Certainty = 0.4365(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below:

```
Identities = 42/75 (56%), Positives = 60/75 (80%)

Query:   2 KTSSGFEYKIEESRLKNYELVEALADLESNPLSLPKVLRLLLGDQVESLKNHLRASDGTV  61
           KT+SGFEY+I + RLKN+ELVEA+A+ E++P ++ K++ LLLGD  +SLK H+R ++G V
Sbjct:   7 KTTSGFEYEIPKKRLKNFELVEAIAEEETDPTAVVKIVNLLLGDAAKSLKEHVRDAEGIV  66

Query:  62 STEALMEEVKEIFES  76
           +   EA+  E+KEIFES
Sbjct:  67 DVEAIGVEIKEIFES  81
```

Based on this analysis, it was predicted that these proteins and their epitopes could be useful antigens for vaccines or diagnostics.

EXAMPLE 442

A DNA sequence (GBSx0479) was identified in *S. agalactiae* <SEQ ID 1417> which encodes the amino acid sequence <SEQ ID 1418>. This protein is predicted to be Structural protein. Analysis of this protein sequence reveals the following:

```
Possible site: 44
>>> Seems to have no N-terminal signal sequence

----- Final Results -----
             bacterial cytoplasm --- Certainty = 0.3461(Affirmative) < succ>
              bacterial membrane --- Certainty = 0.0000(Not Clear)   < succ>
                bacterial outside --- Certainty = 0.0000(Not Clear)   < succ>
```

The protein has homology with the following sequences in the GENPEPT database:

```
>GP: AAG18635 GB: AY007505 unknown [Streptococcus mitis]
Identities = 114/183 (62%), Positives = 142/183 (77%)

Query:   2 VANSSNVTTAKPKIGGAIYTAPLGTELPKDTASELNEAFKSLGYISEDGLSNEDKRESEE   61
           +A +NVTTAKPKIGGA+Y+APLGT LP D  ++L++AF++LGYIS+DG++N +  ESE
Sbjct:   1 MATEANVTTAKPKIGGAVYSAPLGTALPTDATTKLDQAFEALGYISDDGMTNSNSPESEN  60

Query:  62 IQAWGGDVVESAQKSKADKFTYTLIEALNIEVLKEIYGKDNVTGDLKTGITVKSNSKPLE 121
           I+AWGG VV S QK K D F Y LIEALN+ VLKE+YG DNV+GDL +GIT+K+NSK L
Sbjct:  61 IKAWGGVVVSSVQKEKTDTFKYMLIEALNLHVLKEVYGPDNVSGDLSSGITIKANSKELP 120

Query: 122 EHCLVIEMILKNNTVKRIVIPKGKVSEVGEIKYVDNEAAGYETTLQAFPDAEGNTHYEYI 181
             HCLVIE +LK   +KRIVIP GKV+ + EI Y D   GY TT+ AFP+A  +THYEYI
Sbjct: 121 HHCLVIETVLKGGVLKRIVIPSGKVTAIDEITYNDGSVLGYGTTVTAFPNAADDTHYEYI 180

Query: 182 KGA                                                          184
           KGA
Sbjct: 181 KGA                                                          183
```

A related DNA sequence was identified in *S. pyogenes* <SEQ ID 1419> which encodes the amino acid sequence <SEQ ID 1420>. Analysis of this protein sequence reveals the following:

```
Possible site: 13
>>> Seems to have no N-terminal signal sequence

----- Final Results -----
             bacterial cytoplasm --- Certainty = 0.2379(Affirmative) < succ>
              bacterial membrane --- Certainty = 0.0000(Not Clear)   < succ>
                bacterial outside --- Certainty = 0.0000(Not Clear)   < succ>
```

An alignment of the GAS and GBS proteins is shown below:

```
Identities = 119/182 (65%), Positives = 142/182 (77%)

Query:   4 NSSNVTTAKPKIGGAIYTAPLGTELPKDTASELNEAFKSLGYISEDGLSNEDKRESEEIQ  63
           ++ NVT+AKPK GGAIY+APLGTELPKD  SELN  FK+LGY+SEDG+ NED R SE I+
Sbjct:   6 DTKNVTSAKPKTGGAIYSAPLGTELPKDAKSELNTKFKNLGYVSEDGVVNEDTRSSENIK  65

Query:  64 AWGGDVVESAQKSKADKFTYTLIEALNIEVLKEIYGKDNVTGDLKTGITVKSNSKPLEEH 123
           AWGGD+V + Q  K DKFTY LIE+LN+EVLKE+YG  NVTGDL  GI +KSNSK LE H
Sbjct:  66 AWGGDIVGAVQTEKEDKFTYKLIESLNVEVLKEVYGAVNVTGDLSGGIQIKSNSKELEAH 125

Query: 124 CLVIEMILKNNTVKRIVIPKGKVSEVGEIKYVDNEAAGYETTLQAFPDAEGNTHYEYIKG 183
            +V++MI+    +KRIV+P  KV EVGEIKYVD E  GYETTL+ FPD +G+TH EYI
Sbjct: 126 VIVVDMIMNGGILKRIVLPNAKVDEVGEIKYVDGEVVGYETTLKCFPDKGDTHREYIVK  185
```

```
                            -continued
Query: 184 AG                                          185
           G
Sbjct: 186 PG                                          187
```

Based on this analysis, it was predicted that these proteins and their epitopes could be useful antigens for vaccines or diagnostics.

EXAMPLE 443

A DNA sequence (GBSx0480) was identified in *S. agalactiae* <SEQ ID 1421> which encodes the amino acid sequence <SEQ ID 1422>. Analysis of this protein sequence reveals the following:

```
Possible site: 58
>>> Seems to have no N-terminal signal sequence

----- Final Results -----
            bacterial cytoplasm --- Certainty = 0.2214(Affirmative) < succ>
             bacterial membrane --- Certainty = 0.0000(Not Clear)   < succ>
              bacterial outside --- Certainty = 0.0000(Not Clear)   < succ>
```

The protein has homology with the following sequences in the GENPEPT database:

```
>GP: AAB18710 GB: U38906 ORF35 [Bacteriophage rlt]
 Identities = 52/78 (66%), Positives = 66/78 (83%)
Query:  1 MSKFKFKLNKAGVAELMKSSEMQQVLTTKATAIRERCGDGYAQDIHVGKNRANAMVSAKT 60
          M+K  FKLN++GVA +MKS EMQ +L  KA+A+++RCG GY QD+HVGKNRANAMV A+T
Sbjct:  1 MAKNLFKLNRSGVASMMKSPEMQAILKEKASAVKQRCGPGYGQDMHVGKNRANAMVFAET 60

Query: 61 IKAKKDNSKNNTLLKAVR                                         78
          +AK+DN KNNT+LKAVR
Sbjct: 61 YQAKRDNMKNNTILRAVR                                         78
```

A related DNA sequence was identified in *S. pyogenes* <SEQ ID 1423> which encodes the amino acid sequence <SEQ ID 1424>. Analysis of this protein sequence reveals the following:

```
Possible site: 54
>>> Seems to have no N-terminal signal sequence

----- Final Results -----
            bacterial cytoplasm --- Certainty = 0.2446(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below:

```
Identities = 75/78 (96%), Positives = 76/78 (97%)
Query:  1 MSKFKFKLNKAGVASLMKSSEMQQVLTTKATAIRERCGDGYAQDIHVGKNRANAMVSAKT 60
          MSKFKFKLN+AGVAELMKSSEMQQVLTTKATAIRERCGDGY QDIHVGKNRANAMVS KT
Sbjct:  1 MSKFKFKLNRAGVAELMKSSEMQQVLTTKATAIRERCGDGYVQDIHVGKNRANAMVSTKT 60

Query: 61 IKAKKDNSKNNTLLKAVR                                         78
          IKAKKDNSKNNTLLKAVR
Sbjct: 61 IKAKKDNSKNNTLLKAVR                                         78
```

Based on this analysis, it was predicted that these proteins and their epitopes could be useful antigens for vaccines or diagnostics.

EXAMPLE 444

A DNA sequence (GBSx0481) was identified in *S. agalactiae* <SEQ ID 1425> which encodes the amino acid sequence <SEQ ID 1426>. Analysis of this protein sequence reveals the following:

```
Possible site: 38
>>> Seems to have no N-terminal signal sequence

----- Final Results -----
            bacterial cytoplasm --- Certainty = 0.2888(Affirmative) < succ>
            bacterial membrane  --- Certainty = 0.0000(Not Clear)   < succ>
            bacterial outside   --- Certainty = 0.0000(Not Clear)   < succ>
```

The protein has homology with the following sequences in the GENPEPT database:

```
>GP: AAB18709 GB: U38906 ORF34 (Bacteriophage rlt]
 Identities = 41/59 (69%), Positives = 45/59 (75%)
Query: 1  MTGKKVEYILAIPKGDKHDWEDKEVCFFDKKWRTVGLALEGIEELIPLEWNKKVMVERY 59
          +TGKK  Y LAIPK D HDWE+K+V FF K WRT G   LEGIE LIPL+WNKKV VE Y
Sbjct: 56 LTGKKAIYTLAIPKKDTHDWENKKVRFFGKTWRTFGEPLEGIEGLIPLDWNKKVTVEHY 114
```

A related DNA sequence was identified in *S. pyogenes* <SEQ ID 1427> which encodes the amino acid sequence <SEQ ID 1428>. Analysis of this protein sequence reveals the following:

```
Possible site: 39
>>> Seems to have no N-terminal signal sequence

----- Final Results -----
            bacterial cytoplasm --- Certainty = 0.2779(Affirmative) < succ>
            bacterial membrane  --- Certainty = 0.0000(Not Clear)   < succ>
            bacterial outside   --- Certainty = 0.0000(Not Clear)   < succ>
```

An alignment of the GAS and GBS proteins is shown below:

```
Identities = 51/60 (85%), Positives = 57/60 (95%)
Query: 1  MTGKKVEYILAIPKGDKHDWEDKEVCFFDKKWRTVGLALEGIEELIPLEWNKKVMVERYE  60
          +TGKKVEY+LAIPKGD+HDWE+KEV FF KKWRTVG+ LEGIEELIPL+WNKKVMVERYE
Sbjct: 50 LTGKKVEYVLAIPKGDEHDWENKEVRFFGKKWRTVGIPLEGIEELIPLDWNKKVMVERYE 109
```

Based on this analysis, it was predicted that these proteins and their epitopes could be useful antigens for vaccines or diagnostics.

EXAMPLE 445

A DNA sequence (GBSx0482) was identified in *S. agalactiae* <SEQ ID 1429> which encodes the amino acid sequence <SEQ ID 1430>. Analysis of this protein sequence reveals the following:

```
Possible site: 25
>>> Seems to have no N-terminal signal sequence

----- Final Results -----
            bacterial cytoplasm --- Certainty = 0.2770(Affirmative) < succ>
            bacterial membrane  --- Certainty = 0.0000(Not Clear)   < succ>
            bacterial outside   --- Certainty = 0.0000(Not Clear)   < succ>
```

The protein has homology with the following sequences in the GENPEPT database:

```
>GP: AAB18708 GB: U38906 ORF33 [Bacteriophage r1t]
Identities = 89/130 (68%), Positives = 106/130 (81%), Gaps = 1/130 (0%)

Query:    1 MTNFATTDDVILLWRQLSVDEIKRAEALLETVSDTLRLEASKVGKNLDEMILETP-YFAT   59
            M  FAT DD+ +LWR L  DE +RAE LLE VSD+LR EA KVG++L  MI E P YFA+
Sbjct:    1 MNPFATVDDLTMLWRPLKGDEKERAEKLLEIVSDSLREEADKVGRDLYAMIAEKPSYFAS   60

Query:   60 VLKSVTVDIVARTLMTATQGEPMSQESQSALGYTWSGTYLVPGGGLFIKDSELKRLGLKK  119
            V+KSVTVDIVARTLMT+T  EPM+Q ++SALGY+ SG+YLVPGGGLFIK+SEL RLGLKK
Sbjct:   61 VVKSVTVDIVARTLMTSTDQEPMTQTTESALGYSVSGSYLVPGGGLFIKNSELSRLGLKK  120

Query:  120 QRYGGIELYG                                                   129
            QR+G I+ YG
Sbjct:  121 QRFGVIDFYG                                                   130
```

A related DNA sequence was identified in *S. pyogenes* <SEQ ID 1431> which encodes the amino acid sequence <SEQ ID 1432>. Analysis of this protein sequence reveals the following:

```
Possible site: 37
>>> Seems to have no N-terminal signal sequence

----- Final Results -----
            bacterial cytoplasm --- Certainty = 0.2061(Affirmative) < succ>
            bacterial membrane  --- Certainty = 0.0000(Not Clear)   < succ>
             bacterial outside  --- Certainty = 0.0000(Not Clear)   < succ>
```

An alignment of the GAS and GBS proteins is shown below:

```
Identities = 116/138 (84%), Positives = 129/138 (93%)

Query:    3 NFATTDDVILLWRQLSVDEIKRAEALLETVSDTLRLEASKVGKNLDEMILETPYFATVLK   62
            NFATTDDVILLWR LSVDE+KRA ALL+ VSDTLR+EA KVGK+LD+ +++ PYF  V+K
Sbjct:    3 NFATTDDVILLWRPLSVDELKRANALLKVVSDTLRMEADKVGKDLDKTMVDKPYFVNVIK   62

Query:   63 SVTVDIVARTLMTATQGEPMSQESQSALGYTWSGTYLVPGGGLFIKDSELKRLGLKKQRY  122
            SVTVDIVARTLMT+T+GEPM+QESQSALGYTWSGTYLVPGGGLFIKDSELKRLGLKKQRY
Sbjct:   63 SVTVDIVARTLMTSTRGEPMAQESQSALGYTWSGTYLVPGGGLFIKDSELKRLGLKKQRY  122

Query:  123 GGIELYGEIERNNSYFSR                                           140
            GGIELYGEIER+NS FSR
Sbjct:  123 GGIELYGEIERDNSCFSR                                           140
```

Based on this analysis, it was predicted that these proteins and their epitopes could be useful antigens for vaccines or diagnostics.

EXAMPLE 446

A DNA sequence (GBSx0483) was identified in *S. agalactiae* <SEQ ID 1433> which encodes the amino acid sequence <SEQ ID 1434>. This protein is predicted to be Structural protein. Analysis of this protein sequence reveals the following:

```
Possible site: 30
>>> Seems to have no N-terminal signal sequence

----- Final Results -----
            bacterial cytoplasm --- Certainty = 0.3015(Affirmative) < succ>
            bacterial membrane  --- Certainty = 0.0000(Not Clear)   < succ>
             bacterial outside  --- Certainty = 0.0000(Not Clear)   < succ>
```

The protein has homology with the following sequences in the GENPEPT database:

```
>GP: AAB18706 GB: U38906 Structural protein [Bacteriophage r1t]
Identities = 132/296 (44%), Positives = 189/296 (63%), Gaps = 8/296 (2%)

Query:   5 IKAGTLFKPELVTEIMSKVKGHSTLAKLSGQTPIPFNGVEQFVFNLDGNAQIVGEGEQKL   64
           +  GTLF P LVT+++SKV G S++A+LS Q PIPFNG + F F +D    +V E  +K
Sbjct:   3 LNKGTLFDPTLVTDLISKVAGKSSIARLSAQKPIPFNGEKVFTFTMDSEIDVVAESGKKT  62

Query:  65 GNTAKVTSKIIKPLKFVYQARMTDEFKYASEEKRLNFLKHYADGFAKKMAEAFDIAAIHG  124
             +   + + P+K   Y AR++DEF YAS+E+++N L+ +  DGFAKK+A    D+ A HG
Sbjct:  63 HGGVTLAPQTMVPIKVEYGARISDEFMYASDEEKINILQEFNDGFAKKVARGIDLMAFHG 122

Query: 125 LEPRTMTDASFKATNSFDGVVTGNVIKYEADK--IDDN--IDAAVTTIVANGNDVTGIAL  180
             + PR  T ++    TN FD   VT     K EA +    D N  I+ AV   +   DVTGIA+
Sbjct: 123 VNPRLGTASAVIGTNHFDSKVTQ---KVEAPRGIADPNGAIENAVELLTGVDADVTGIAI 179

Query: 181 SPQAGQDMSKRKDKFDNVMYPEFRFGQRPSNFFNMTLDINKTLTMKGGTAKDDHAIVGDF  240
             +P       ++K+KD  DN ++PE ++G  P    +  +D+NKT++      T + D AI+GDF
Sbjct: 180 NPSFRSALAKQKDLQDNALFPELKWGATPDTINGLPVDVNKTVSDMSLTQR-DRAIIGDF 238

Query: 241 QNMFKWGYAENIPMEIIEYGDPDGSGRDLKAYNEILLRTEAFIGWGILDEKAFSRV      296
              N FKWGYA+ +P+E+I+YGDPD SG DLK YN++ +R E F+GWGILD    F+RV
Sbjct: 239 ANGFKWGYAKEVPLEVIQYGDPDNSGLDLKGYNQVYIRAELFLGWGILDATKFARV      294
```

A related DNA sequence was identified in *S. pyogenes* <SEQ ID 1435> which encodes the amino acid sequence <SEQ ID 1436>. Analysis of this protein sequence reveals the following:

```
Possible site: 30
>>> Seems to have no N-terminal signal sequence

----- Final Results -----
          bacterial cytoplasm --- Certainty = 0.2772(Affirmative) < succ>
          bacterial membrane  --- Certainty = 0.0000(Not Clear)   < succ>
           bacterial outside  --- Certainty = 0.0000(Not Clear)   < succ>
```

An alignment of the GAS and GBS proteins is shown below:

```
Identities = 133/298 (44%), Positives = 187/298 (62%), Gaps = 2/298 (0%)

Query:   1 MAESIKAGTLFKPELVTEIMSKVKGHSTLAKLSGQTPIPFNGVEQFVFNLDGNAQIVGEG   60
           M      +LF    LV+++++KVKGHS+LAKLS Q PIPFNG ++F F LD +  +V E
Sbjct:   1 MGTETSKASLFDKHLVSDLINKVKGHSSLAKLSSQKPIPFNGSKEFTFTLDSDIDVVAEN  60

Query:  61 EQKLGNTAKVTSKIIKPLKFVYQARMTDEFKYASEEKRLNFLKHYADGFAKKMAEAFDIA  120
           +K   +    I P+K   Y AR++DEF YA+EE++++ LK +  +GFAKK+A    D+
Sbjct:  61 GKKTHGGLSLEPVTIVPIKVEYGARLSDEFLYATEEEKIDILKAFNEGFAKKLARGIDLM 120

Query: 121 AIHGLEPRTMTDASFKATNSFDGVVTGNVIKYEADKIDDNIDAAVTTIVANGNDVTGIAL  180
           A+HG+ PRT  +   TN FD  VT  V    E++  D NI+AAV   I  +      VTG+A+
Sbjct: 121 AMHGINPRTKKASDVIGTNHFDSKVTQVVKFTESEDADANIEAAVNLIQGSEGVVTGLAM 180

Query: 181 SPQAGQDMSK-RKDKFDNVMYPEFRFGQRPSNFFNMTLDINKTLTMKGGTAKD-DHAIVG  238
            +      ++K  +     MYPE +G P +   +N T+       A+   D  I+G
Sbjct: 181 DTEFSTALAKVTNGEMGPKMYPELAWGANPDSINGLKSSVNTTVGAGADEAESKDLVIIG 240

Query: 239 DFQNMFKWGYAENIPMEIIEYGDPDGSGRDLKAYNEILLRTEAFIGWGILDEKAFSRV    296
           DF++MFKWGYA+ IPMEII+YGDPD SG+DLK YN+I LR EA+IGWGILD K+F+RV
Sbjct: 241 DFESMFKWGYAKQIPMEIIKYGDPDNSGKDLKGYNQIYLRAEAYIGWGILDAKSFARV    298
```

Based on this analysis, it was predicted that these proteins and their epitopes could be useful antigens for vaccines or diagnostics.

EXAMPLE 447

A DNA sequence (GBSx0484) was identified in *S. agalactiae* <SEQ ID 1437> which encodes the amino acid sequence <SEQ ID 1438>. Analysis of this protein sequence reveals the following:

Possible site: 61
>>> Seems to have no N-terminal signal sequence

----- Final Results -----
            bacterial cytoplasm --- Certainty = 0.2224(Affirmative) < succ>
             bacterial membrane --- Certainty = 0.0000(Not Clear)   < succ>
              bacterial outside --- Certainty = 0.0000(Not Clear)   < succ>

A related GBS nucleic acid sequence <SEQ ID 9659> which encodes amino acid sequence <SEQ ID 9660> was also identified.

The protein has homology with the following sequences in the GENPEPT database:

```
>GP: AAB18705 GB: U38906 ORF30 [Bacteriophage rlt]
Identities = 64/158 (40%), Positives = 101/158 (63%), Gaps = 8/158 (5%)

Query:  43 MSEFKVIETQEELDTIVKARIARERE----KYQDYDQLKTRVEELETENSSLQTALNDAK   98
           MSE   + +TQEEL+ I++ R+AR++E     + DYD+LKT++  LE +N++ Q  + ++K
Sbjct:   1 MSENNLPKTQEELNQIIETRLARQKETIEANFADYDELKTKIAALEADNTAYQATIEESK   60

Query:  99 SNTDSYTEKITTLENQIAGYEAANLRTKVALQYGLPIDLANRLQGDDEDGLKVDAERLAS  158
           S    + ++      E QI+GY+    L+  +A++ GLP+DLA+RL GDDE+ LK DAER +
Sbjct:  61 S----WEQEKADYEKQISGYKTTQLKQSIAIKAGLPLDLADRLSGDDEESLKADAERFSG  116

Query: 159 FIKPSQPQPPTKSNEPIITDQKEAGWIEMARNLVNKGE                       196
           FIKP  P  P K EP + D K+  + ++     L  +GE
Sbjct: 117 FIKPTPPAPLKDVEPNLGDGKDGAYRKLVDGLKTEGE                         154
```

A related DNA sequence was identified in *S. pyogenes* <SEQ ID 1439> which encodes the amino acid sequence <SEQ ID 1440>. Analysis of this protein sequence reveals the following:

Possible site: 59
>>> Seems to have no N-terminal signal sequence

----- Final Results -----
            bacterial cytoplasm --- Certainty = 0.3476(Affirmative) < succ>
             bacterial membrane --- Certainty = 0.0000(Not Clear)   < succ>
              bacterial outside --- Certainty = 0.0000(Not Clear)   < succ>

An alignment of the GAS and GBS proteins is shown below:

```
Identities = 128/149 (85%), Positives = 136/149 (90%)

Query:  43 MSEFKVIETQEELDTIVKARIAREREKYQDYDQLKTRVEELETENSSLQTALNDAKSNTD  102
           MSEFKVIETQEELDTIVKARIAREREKYQDYDQLKTRVEELETENSSLQTALNDAKSNTD
Sbjct:   1 MSEFKVIETQEELDTIVKARIAREREKYQDYDQLKTRVEELETENSSLQTALNDAKSNTD   60

Query: 103 SYTEKITTLENQIAGYEAANLRTKVALQYGLPIDLANRLQGDDEDGLKVDAERLASFIKP  162
           SYTE+I+TL+NQIA YE ANLRTKVALQYGLPIDLA+RLQGDDEDGLKVDAERLASFIKP
Sbjct:  61 SYTEEISTLKNQIADYETANLRTKVALQYGLPIDLADRLQGDDEDGLKVDAERLASFIKP  120

Query: 163 SQPQPPTKSNEPIITDQKEAGWIEMARNL                                191
           SQPQPP KSNEP I   +A +  + + L
Sbjct: 121 SQPQPPAKSNEPNIDSNADANYRALVQGL                                149
```

Based on this analysis, it was predicted that these proteins and their epitopes could be useful antigens for vaccines or diagnostics.

EXAMPLE 448

A DNA sequence (GBSx0485) was identified in *S. agalactiae* <SEQ ID 1441> which encodes the amino acid sequence <SEQ ID 1442>. Analysis of this protein sequence reveals the following:

Possible site: 56
>>> Seems to have no N-terminal signal sequence

----- Final Results -----
             bacterial cytoplasm --- Certainty = 0.2888(Affirmative) < succ>
             bacterial membrane  --- Certainty = 0.0000(Not Clear)   < succ>
             bacterial outside   --- Certainty = 0.0000(Not Clear)   < succ>

The protein has homology with the following sequences in the GENPEPT database:

```
>GP: AAB18704 GB: U38906 ORF29 [Bacteriophage rlt]
Identities = 322/461 (69%), Positives = 383/461 (82%)

Query:    8 KLGNQRPTQSVNLHFAKTLAHEAINYYKKTGLSCYLWQENMLIPMMAINEDNLWVHQKYG    67
            + GNQ PTQSV L F +T   EAI  Y+K+   CY WQ+N+L  +MAI+ED LW HQK+G
Sbjct:    6 RFGNQYPTQSVILPFTETKYQEAIEIYEKSKHECYPWQKNLLKEVMAIDEDGLWTHQKFG    65

Query:   68 YAIPRRNGKTEVVYILELWALHKGLKILHTAHRISTSHSSFEKVKKYLEMSGYVDGEDFI   127
            Y+IPRRNGKTE+VYILELW+L +GL ILHTAHRISTSHSS+EK+KKYLE SGYV+GEDF
Sbjct:   66 YSIPRRNGKTEIVYILELWSLVQGLSILHTAHRISTSHSSYEKLKKYLEDSGYVEGEDFK   125

Query:  128 SNKAKGQERIEFKSSGSVIQFRTRTSNGGLGEGFDLLIIDEAQEYTAEQESALKYTVTDS   187
            S KAKGQER+E   SG VIQFRTRTS+GGLGEGFD+L+IDEAQEYT EQESALKYTVTDS
Sbjct:  126 SIKAKGQERLELIESGGVIQFRTRTSSGGLGEGFDILVIDEAQEYTTEQESALKYTVTDS   185

Query:  188 DNPMTIMCGTPPTMVSTGTVFESYRKECLKGDRRYSGWAEWSVDEMQPIHDVKSWYVANP   247
            DNPMTIMCGTPPT VS+GTVF +YR    + G  +YSGWAEWSV++++ IHDV++WY +NP
Sbjct:  186 DNPMTIMCGTPPTPVSSGTVFTNYRDNTIAGKAKYSGWAEWSVEDVKDIHDVEAWYNSNP   245

Query:  248 SMGYHLNERKIEAELGEDEIDHNIQRLGYWPSFNQKSVISEKEWAKLKVEQVPELKSKLF   307
            SMGYHLNERKIEAELGED++DHN+QRLGYWP +NQKSVISE+EW  LKV ++P +K KLF
Sbjct:  246 SMGYHLNERKIEAELGEDKLDHNVQRLGYWPKYNQKSVISEQEWNALKVNRLPVIKGKLF   305

Query:  308 VGIKFGQDGNNVSLSIAARASENKVFVEAIDCLSVRNGTQWIINFLKSADIAKVVVDGAS   367
            VGIK+G DG NV++SIA +    KVFVE IDC S+RNG QWIINFLK AD+ KVV+DG S
Sbjct:  306 VGIKYGNDGANVAMSIAVKTLSGKVFVETIDCQSIRNGNQWIINFLKKADVEKVVIDGQS   365

Query:  368 GQELLAQEMREHGLKKPELPKVAEIITANTMWEQGIMQETICHNDQPSLTAVVTNCEKRQ   427
            GQ +L  EM++  LK+P LP V EII AN++WEQGI Q+  CH+ QPSL+ VVTNC+KR
Sbjct:  366 GQSILTSEMKDFKLKEPILPTVKEIINANSLWEQGIFQKNFCHSGQPSLSTVVTNCDKRN   425

Query:  428 IGSNGGFGYKSLYDDRDISLMDSALLAHWICYTTKPKRKQR                    468
            IG++GGFGYKS +DD DISLMDSALLAHW C    KPK+KQ+
Sbjct:  426 IGTSGGFGYKSQFDDMDISLMDSALLAHWACSNNKPKKKQQ                    466
```
40

A related DNA sequence was identified in *S. pyogenes* <SEQ ID 1443> which encodes the amino acid sequence <SEQ ID 1444>. Analysis of this protein sequence reveals the following:

Possible site: 32
>>> Seems to have no N-terminal signal sequence

----- Final Results -----
             bacterial cytoplasm --- Certainty = 0.3133(Affirmative) < succ>
             bacterial membrane  --- Certainty = 0.0000(Not Clear)   < succ>
             bacterial outside   --- Certainty = 0.0000(Not Clear)   < succ>

An alignment of the GAS and GBS proteins is shown below:

```
Identities = 437/471 (92%), Positives = 459/471 (96%)

Query:    1 MVTKTKAKLGNQRPTQSVNLHFAKTLAHEAINYYKKTGLSCYLWQENMLIPMMAINEDNL    60
            MVTKTK  KLGNQRPTQSVNLHFAK+LAHEAINYYKKTGLSCY WQ NMLIP+MAI+E+ L
Sbjct:    6 MVTKTKTKLGNQRPTQSVNLHFAKSLAHEAINYYKKTGLSCYPWQVNMLIPIMAIDENGL    65

Query:   61 WVHQKYGYAIPRRNGKTEVVYILELWALHKGLKILHTAHRISTSHSSFEKVKKYLEMSGY   120
            WVHQKYGYAIPRRNGKTEVVYI++LWALHKGLKILHTAHRISTSH+SFEKVKKYLEMSGY
Sbjct:   66 WVHQKYGYAIPRRNGKTEVVYIVQLWALHKGLKILHTAHRISTSHASFEKVKKYLEMSGY   125
```

```
-continued

Query: 121 VDGEDFISNKAKGQERIEFKSSGSVIQFRTRTSNGGLGEGFDLLIIDEAQEYTAEQESAL 180
           VDGEDFISNKAKGQERIEFK+SG+VIQFRTRTSNGGLGEGFDLLIIDEAQEYT+EQESAL
Sbjct: 126 VDGEDFISNKAKGQERIEFKASGAVIQFRTRTSNGGLGEGFDLLIIDEAQEYTSEQESAL 185

Query: 181 KYTVTDSDNPMTIMCGTPPTMVSTGTVFESYRKECLKGDRRYSGWAEWSVDEMQPIHDVK 240
           KYTVTDSDNPMTIMCGTPPTMVSTGTVFE+YRK+CLKG++RYSGWAEWSV EM   I+DV
Sbjct: 186 KYTVTDSDNPMTIMCGTPPTMVSTGTVFEAYRKDCLKGNRYSGWAEWSVPEMVKINDVS 245

Query: 241 SWYVANPSMGYHLNERKIEAELGEDEIDHNIQRLGYWPSFNQKSVISEKEWAKLKVEQVP 300
           SWY++NPSMG+HLNERKIEAELGEDEIDHNIQRLGYWPSFNQKSVISEKEWAKLKVEQVP
Sbjct: 246 SWYISNPSMGFHLNERKIEAELGEDEIDHNIQRLGYWPSFNQKSVISEKEWAKLKVEQVP 305

Query: 301 ELKSKLFVGIKFGQDGNNVSLSIAARASENKVFVEAIDCLSVRNGTQWIINFLKSADIAK 360
           ELKSKLFVGIKFGQDGNNVSLSIAAR SENKVFVE IDCLSVRNGTQWIINFLKSADIAK
Sbjct: 306 ELKSKLFVGIKFGQDGNNVSLSIAARTSENKVFVETIDCLSVRNGTQWIINFLKSADIAK 365

Query: 361 VVVDGASGQELLAQEMREHGLKKPELPKVAEIITANTMWEQGIMQETICHNDQPSLTAVV 420
           VV+DGASGQELLAQEM++ GLKKPELPKVAEIITAN MWEQGIMQETICH+DQPSLTAVV
Sbjct: 366 VVIDGASGQELLAQEMKDQGLKKPELPKVAEIITANMMWEQGIMQETICHSDQPSLTAVV 425

Query: 421 TNCEKRQIGSNGGFGYKSLYDDRDISLMDSALLAHWICYTTKPKRKQRTSC          471
           TNCEKRQIGSNGGFGYKSLYDDRDISLMDSALLAHWICYTTKPKRKQRTSC
Sbjct: 426 TNCEKRQIGSNGGFGYKSLYDDRDISLMDSALLAHWICYTTKPKRKQRTSC          476
```

Based on this analysis, it was predicted that these proteins and their epitopes could be useful antigens for vaccines or diagnostics.

EXAMPLE 449

A DNA sequence (GBSx0486) was identified in *S. agalactiae* <SEQ ID 1445> which encodes the amino acid sequence <SEQ ID 1446>. Analysis of this protein sequence reveals the following:

```
Possible site: 32
>>> Seems to have no N-terminal signal sequence

----- Final Results -----
           bacterial cytoplasm --- Certainty = 0.2745(Affirmative) < succ>
           bacterial membrane  --- Certainty = 0.0000(Not Clear)  < succ>
            bacterial outside  --- Certainty = 0.0000(Not Clear)  < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 450

A DNA sequence (GBSx0487) was identified in *S. agalactiae* <SEQ ID 1447> which encodes the amino acid sequence <SEQ ID 1448>. Analysis of this protein sequence reveals the following:

```
Possible site: 32
>>> Seems to have no N-terminal signal sequence

----- Final Results -----
           bacterial cytoplasm --- Certainty = 0.2568(Affirmative) < succ>
           bacterial membrane  --- Certainty = 0.0000(Not Clear)  < succ>
            bacterial outside  --- Certainty = 0.0000(Not Clear)  < succ>
```

The protein has homology with the following sequences in the GENPEPT database:

```
>GP: AAB18703 GB: U38906 ORF28 [Bacteriophage r1t]
Identities = 124/250 (49%), Positives = 164/250 (65%), Gaps = 3/250 (1%)

Query:    2 VDDVLPKLLKSVQQDFEKHFGKSEVVAKAFAELQAKKATYKTVNEFAVEVGRLLSLALAN    61
            ++D+LP LL+ + QDF++     S+ + ++   L+ KKATY   NEF VEVG++LS   L
Sbjct:    1 MEDILPPLLEKINQDFDERAANSKKLKQSMELLKTKKATYIQANEFGVEVGQILSDVLGT   60

Query:   62 SVISDELPDGKMYYNIANRLVNDTLRHNYKLISDYAGDVQQNLNKQAKISLKIQRPPLNQ  121
             V  D LPDGKMY+NIA+RL+N  L+ N+ LIS Y+ DVQ  LN+ A    LK Q P LNQ
Sbjct:   61 HVTVDVLPDGKMYFNIADRLLNSILKKNFDLISGYSTDVQSELNQLAGFKLKSQVPELNQ  120

Query:  122 DKIDGLVNRLASEPVFDDVKWLLDEPIVNFSQSIVDDCIRANADFHFKTGLKPTIERIST  181
            D+IDG+VNR++SE  F+ +  WLL EPIV FSQS+VDD ++ N DF  K GLKP I  R
Sbjct:  121 DRIDGIVNRISSEDDFEKILWLLKEPIVTFSQSVVDDTLKKNIDFQAKAGLKPKIVRKLV  180

Query:  182 GKCCDWCDRLAGRYVYHEEPKDFYKRHQHCQCVIDYHPK--NGKRQNSWSKKWTKETTDI  239
            GK  CDWC   LAG Y Y    P D Y RH+ C+C ++Y P+   + KRQ+ WSK W      D
Sbjct:  181 GKACDWCRNLAGSYDYPNVPSDVYHRHERCRCTVEYDPRDIDKKRQDVWSKNWVDPDKDA  240

Query:  240 -LERRKQMNI                                                   248
             +  RK +N+
Sbjct:  241 KIAERKNLNL                                                   250
```

A related DNA sequence was identified in *S. pyogenes* <SEQ ID 1449> which encodes the amino acid sequence <SEQ ID 1450>. Analysis of this protein sequence reveals the following:

```
Possible site: 32
>>> Seems to have no N-terminal signal sequence

----- Final Results -----
            bacterial cytoplasm --- Certainty = 0.3099(Affirmative) < succ>
            bacterial membrane  --- Certainty = 0.0000(Not Clear)  < succ>
             bacterial outside  --- Certainty = 0.0000(Not Clear)  < succ>
```

An alignment of the GAS and GBS proteins is shown below:

```
Identities = 169/261 (64%), Positives = 207/261 (78%), Gaps = 2/261 (0%)

Query:    1 MVDDVLPKLLKSVQQDFEKHFGKSEVVAKAFAELQAKKATYKTVNEFAVEVGRLLSLALA    60
            MVDDVLPKLLKSV+QDFEK+FG+S+VV KAFAELQAKK TYKTVNEFA+EVGRLLSLAL
Sbjct:    1 MVDDVLPKLLKSVRQDFEKYFGESDVVTKAFAELQAKKVTYKTVNEFAIEVGRLLSLALT   60

Query:   61 NSVISDELPDGKMYYNIANRLVNDTLRHNYKLISDYAGDVQQNLNKQAKISLKIQRPPLN  120
             SV  SD+LPDGKMYYNIA RL+++T+  NYKLIS YAGDVQ+ LN+ A+I LK+QRPPLN
Sbjct:   61 GSVSSDKLPDGKMYYNIAKRLLDETMGRNYKLISGYAGDVQRILNENAQIGLKVQRPPLN  120

Query:  121 QDKIDGLVNRLASEPVFDDVKWLLDEPIVNFSQSIVDDCIRANADFHFKTGLKPTIERIS  180
            +DKI+G+VNRL SE   FDDVKWL  EPIVNFSQSIVDD I+ANAD  +KTG+ P + R
Sbjct:  121 RDKINGMVNRLDSENTFDDVKWLFGEPIVNFSQSIVDDTIKANADLQYKTGMTPQVVRTE  180

Query:  181 TGKCCDWCDRLAGRYVYHEEPKDFYKRHQHCQCVIDYHPKNGKRQNSWSKKWTK--ETTD  238
            +G CC+WC + G Y Y + PKD ++RHQ C+C +DY PKNGK Q++WSK W K   +T +
Sbjct:  181 SGNCCEWCREVVGTYSYPKVPKDVWRRHQRCRCTLDYDPKNGKVQSAWSKIWRKKEKTQE  240

Query:  239 ILERRKQMNIDIRDNNRKSDI                                        259
            +ER ++         + K+DI
Sbjct:  241 SIERVEKFKESALVESIKNDI                                        261
```

Based on this analysis, it was predicted that these proteins and their epitopes could be useful antigens for vaccines or diagnostics.

EXAMPLE 451

A DNA sequence (GBSx0488) was identified in *S. agalactiae* <SEQ ID 1451> which encodes the amino acid sequence <SEQ ID 1452>. This protein is predicted to be Structural protein. Analysis of this protein sequence reveals the following:

```
Possible site: 58
>>> Seems to have no N-terminal signal sequence
    INTEGRAL    Likelihood = -1.38    Transmembrane    93-109 (93-110)

----- Final Results -----
              bacterial membrane --- Certainty = 0.1553(Affirmative) < succ>
              bacterial outside  --- Certainty = 0.0000(Not Clear)   < succ>
              bacterial cytoplasm --- Certainty = 0.0000(Not Clear)  < succ>
```

The protein has homology with the following sequences in the GENPEPT database:

```
>GP: AAC39307 GB: AF022773 ORF5 [Lactococcus bacteriophage phi31]
Identities = 271/410 (66%), Positives = 326/410 (79%), Gaps = 2/410 (0%)

Query:   1 MNYMGMGYLQRKLALFKTGVDKRYRYYAMDDRDNTRSIVMPDNVREMYRSVIEWTAKGVD  60
           M   G+GYL+ KL++ K   + RY  YAM   D + I +P + + YRS++ W AKGVD
Sbjct:   1 MTEKGIGYLRFKLSVHKRRAEMRYEQYAMKHVDRFKGITIPQALSQQYRSILGWCAKGVD  60

Query:  61 SLADRIIFREFANDDFNAWEIFKANNPDIFFDTAIQSALIASCCFVYIMPGKEDSLPKMQ 120
           SLADR+IFREF NDDF   EIF+ NNPDIFFD+A+ SALIASC F+YI  G+ D++ ++Q
Sbjct:  61 SLADRLIFREFENDDFTVNEIFEENNPDIFFDSAVLSALIASCSFIYISKGENDAV-RLQ 119

Query: 121 VIEASKATGILDPTTFLLTEGYAVLESDSNENPTLEAYFTGEKTWYYPKDEKP-YSIDNS 179
           VIEA  ATGI+DP T LLTEGYAVLE D N N  LEA+F  ++T YY +D +   SI N
Sbjct: 120 VIEAVNATGIIDPITGLLTEGYAVLERDENNNVVLEAHFLPDRTDYYYRDSRNNISIANP 179

Query: 180 TGHPLLVPVIHRPDAVRPFGRSRITKAGMYHQKAAKRTLERAEVTAEFYSFPQKYVLGMD 239
           TGHPLLVP+IHRPDAVRPFGRSRIT++GMY Q  AKRTLERA+VTAEFYSFPQKYV G+
Sbjct: 180 TGHPLLVPIIHRPDAVRPFGRSRITRSGMYWQSNAKRTLERADVTAEFYSFPQKYVTGLS 239

Query: 240 PDAEPMEKWRATVSTLLEISKDEDGDKPTVGQFTTASMAPFMDHLKMYASLFAGGSGLTL 299
            DAEPME W+ATVS++L+ +KDEDGDKPT+GQFT  SM+PF + L+  A+ FAG +GLTL
Sbjct: 240 DDAEPMETWKATVSSMLQFTKDEDGDKPTLGQFTQPSMSPFTEQLRTAAAGFAGETGLTL 299

Query: 300 DDLGFPSDNPSSVEAIKAAHENLRAAGRKAQRSFSSGFLNVAYIAVCLRDDFPYLRNQFM 359
           DDLGF SDNPSSVEAIKA+HENLR AGRKAQRS  +G LNVAY+A CLRDD PYLR QF
Sbjct: 300 DDLGFVSDNPSSVEAIKASHENLRLAGRKAQRSLGAGLLNVAYLAACLRDDVPYLREQFS 359

Query: 360 DTEIKWEPLFEADANMLTLVGDGAIKLNQAIPGFMDADVIRDLTGVKGSD           409
           T+ KWEPLFEADA+ML+L+GDGAIKLNQAIP F++ D IRDLTG+KG++
Sbjct: 360 KTKPKWEPLFEADASMLSLIGDGAIKLNQAIPEFINKDTIRDLTGIKGAE           409
```

A related DNA sequence was identified in *S. pyogenes* <SEQ ID 1453> which encodes the amino acid sequence <SEQ ID 1454>. Analysis of this protein sequence reveals the following:

```
Possible site: 58
>>> Seems to have no N-terminal signal sequence
    INTEGRAL    Likelihood = -1.38    Transmembrane    93-109 (93-110)

----- Final Results -----
              bacterial membrane --- Certainty = 0.1553(Affirmative) < succ>
              bacterial outside  --- Certainty = 0.0000(Not Clear)   < succ>
              bacterial cytoplasm --- Certainty = 0.0000(Not Clear)  < succ>
```

An alignment of the GAS and GBS proteins is shown below:

```
Identities = 395/422 (93%), Positives = 407/422 (95%)

Query:    1 MNYMGMGYLQRKLALFKTGVDKRYRYYAMDDRDNTRSIVMPDNVREMYRSVIEWTAKGVD    60
            MNYMGMGYL+RKLALFKTGVDKRYRYYAMDDRD+TRSIVMP+NVREMYRSV+EWTAKGVD
Sbjct:    1 MNYMGMGYLRRKLALFKTGVDKRYRYYAMDDRDDTRSIVMPNNVREMYRSVLEWTAKGVD    60

Query:   61 SLADRIIFREFANDDFNAWEIFKANNPDIFFDTAIQSALIASCCFVYIMPGKEDSLPKMQ   120
            SLADRIIFREF NDDFNAWEIFKANNPDIFFDTAIQSALIASCCFVYIMPG ED LPKMQ
Sbjct:   61 SLADRIIFREFTNDDFNAWEIFKANNPDIFFDTAIQSALIASCCFVYIMPGAEDGLPKMQ   120

Query:  121 VIEASKATGILDPTTFLLTEGYAVLESDSNENPTLEAYFTGEKTWYYPKDEKPYSIDNST   180
            VIEASKATGILDPTTFLLTEGYA+LESDSN NPTLEAYFT +  WYYPK  KPY+I N T
Sbjct:  121 VIEASKATGILDPTTFLLTEGYAILESDSNGNPTLEAYFTDKDIWYYPKKGKPYNIKNPT   180

Query:  181 GHPLLVPVIHRPDAVRPFGRSRITKAGMYHQKAAKRTLERAEVTAEFYSFPQKYVLGMDP   240
            GHPLLVP+IHRPDAVRPFGRSRITKAGMYHQKAAKRTLERAEVTAEFYSFPQKYVLGMDP
Sbjct:  181 GHPLLVPIIHRPDAVRPFGRSRITKAGMYHQKAAKRTLERAEVTAEFYSFPQKYVLGMDP   240

Query:  241 DAEPMEKWRATVSTLLEISKDEDGDKPTVGQFTTASMAPFMDHLKMYASLFAGGSGLTLD   300
            DAEPMEKWRATVSTLLEISKDEDGDKPTVGQFTTASMAPFM+HLKMYASLFAGGSGLTLD
Sbjct:  241 DAEPMEKWRATVSTLLEISKDEDGDKPTVGQFTTASMAPFMEHLKMYASLFAGGSGLTLD   300

Query:  301 DLGFPSDNPSSVEAIKAAHENLRAAGRKAQRSFSSGFLNVAYIAVCLRDDFPYLRNQFMD   360
            DLGFPSDNPSSVE+IKAAHENLRAAGRKAQRSFSSGFLNVAYIAVCLRD+FPYLRNQFMD
Sbjct:  301 DLGFPSDNPSSVESIKAAHENLRAAGRKAQRSFSSGFLNVAYIAVCLRDEFPYLRNQFMD   360

Query:  361 TEIKWEPLFEADANMLTLVGDGAIKLNQAIPGFMDADVIRDLTGVKGSDNPIPKATEVTT   420
            T IKWEPLFEADANMLTLVGDGAIKLNQAIPGFMDADVIRDLTGVKG+D  PIP   TEVTT
Sbjct:  361 TVIKWEPLFEADANMLTLVGDGAIKLNQAIPGFMDADVIRDLTGVKGADKPIPAITEVTT   420

Query:  421 DG                                                            422
            DG
Sbjct:  421 DG                                                            422
```

Figure 73:
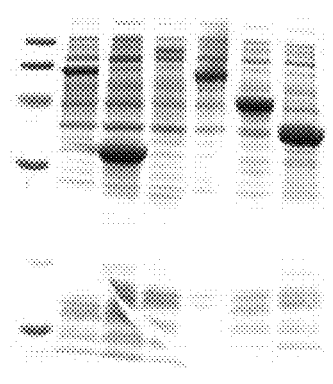
Figure 81:
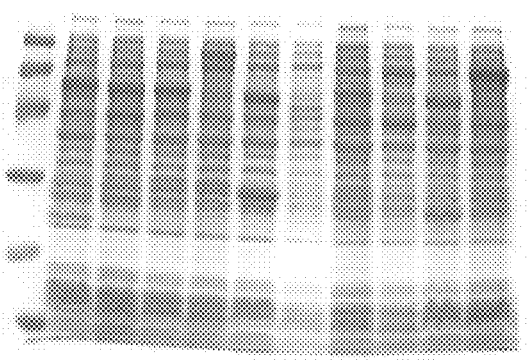

SEQ ID 1452 (GBS364) was expressed in *E. coli* as a His-fusion product. SDS-PAGE analysis of total cell extract is shown in FIG. 73 (lane 6; MW 50 kDa). It was also expressed in *E. coli* as a GST-fusion product. SDS-PAGE analysis of total cell extract is shown in FIG. 81 (lane 11; MW 75 kDa).

GBS364-GST was purified as shown in FIG. 216, lane 10.

Based on this analysis, it was predicted that these proteins and their epitopes could be useful antigens for vaccines or diagnostics.

EXAMPLE 452

A DNA sequence (GBSx0489) was identified in *S. agalactiae* <SEQ ID 1455> which encodes the amino acid sequence <SEQ ID 1456>. Analysis of this protein sequence reveals the following:

```
Possible site: 16
>>> Seems to have no N-terminal signal sequence

----- Final Results -----
            bacterial cytoplasm --- Certainty = 0.4063(Affirmative) < succ>
            bacterial membrane  --- Certainty = 0.0000(Not Clear)   < succ>
             bacterial outside  --- Certainty = 0.0000(Not Clear)   < succ>
```

The protein has no significant homology with any sequences in the GENPEPT database.

A related DNA sequence was identified in *S. pyogenes* <SEQ ID 1457> which encodes the amino acid sequence <SEQ ID 1458>. Analysis of this protein sequence reveals the following:

```
Possible site: 16
>>> Seems to have no N-terminal signal sequence

----- Final Results -----
            bacterial cytoplasm --- Certainty = 0.4120(Affirmative) < succ>
             bacterial membrane --- Certainty = 0.0000(Not Clear)   < succ>
               bacterial outside --- Certainty = 0.0000(Not Clear)   < succ>
```

An alignment of the GAS and GBS proteins is shown below:

```
Identities = 101/118 (85%), Positives = 110/118 (92%)

Query:   1 MKKKCLICKKTFQAKTNRSLYCSEECRKKGIREKQRKLMKQKRADKKKEKIKVLNTNADV   60
           +KKKCLICKK FQAKTNR+LYCSEECRKKG REKQRKLMKQKRA+++KEK KVLN N DV
Sbjct:   1 LKKKCLICKKNFQAKTNRTLYCSEECRKKGNREKQRKLMKQKRAEQRKEKKKVLNPNTDV   60

Query:  61 TEKPKKIRNLVQHYKKLKREILDNESEFGFTGIALVEGIDIHEENFVDLVMQKIKEQQ    118
           TEKPKKIRNL QHYKKLK+EIL NESEFGFTGI L+EGID+HEENFVDLVMQKIKEQ+
Sbjct:  61 TEKPKKIRNLAQHYKKLKKEILANESEFGFTGITLIEGIDVHEENFVDLVMQKIKEQK    118
```

Based on this analysis, it was predicted that these proteins and their epitopes could be useful antigens for vaccines or diagnostics.

EXAMPLE 453

A DNA sequence (GBSx0490) was identified in *S. agalactiae* <SEQ ID 1459> which encodes the amino acid sequence <SEQ ID 1460>. Analysis of this protein sequence reveals the following:

```
Possible site: 19
>>> Seems to have no N-terminal signal sequence

----- Final Results -----
            bacterial cytoplasm --- Certainty = 0.0633(Affirmative) < succ>
             bacterial membrane --- Certainty = 0.0000(Not Clear)   < succ>
               bacterial outside --- Certainty = 0.0000(Not Clear)   < succ>
```

The protein has homology with the following sequences in the GENPEPT database:

```
>GP: AAC39305 GB: AF022773 ORF3 [Lactococcus bacteriophage phi31]
Identities = 75/109 (68%), Positives = 87/109 (79%),
Gaps = 1/109 (0%)

Query:  29 LRADKKGTHRVAFEKNKRRLLKTAHLCGICGRPVDKSLKYPHPLSAAIDHIVPIAKGGHP    88
           LRAD+ G HRVAF+KN++ LLKT + CGICG+P+DK LK P PLS  +DHI+PI KGGHP
Sbjct:   3 LRADRTGAHRVAFDKNRKILLKTQNTCGICGKPIDKRLKAPDPLSPVVDHIIPINKGGHP    62

Query:  89 SSIDNLQLTHWQCNRQKSDKLFINQTAVRATVVGNRNLPQSRDWSSYAS            137
           S++DNLQL HW CNRQKSDKLF N      V+GNRNLPQSRDWSSY S
Sbjct:  63 SAMDNLQLAHWTCNRQKSDKLF-NVKQEEPKVLGNRNLPQSRDWSSYVS            110
```

A related DNA sequence was identified in *S. pyogenes* <SEQ ID 1461> which encodes the amino acid sequence <SEQ ID 1462>. Analysis of this protein sequence reveals the following:

```
Possible site: 49
>>> Seems to have no N-terminal signal sequence

----- Final Results -----
            bacterial cytoplasm --- Certainty = 0.4185(Affirmative) < succ>
             bacterial membrane --- Certainty = 0.0000(Not Clear)   < succ>
               bacterial outside --- Certainty = 0.0000(Not Clear)   < succ>
```

An alignment of the GAS and GBS proteins is shown below:

```
Identities = 88/112 (78%), Positives = 102/112 (90%)

Query:   28 KLRADKKGTHRVAFEKNKRRLLKTAHLCGICGRPVDKSLKYPHPLSAAIDHIVPIAKGGH   87
            +LRADKKGTHRVAF++NK++LLK A +CGICG+PVDKSLKYPHPLSAAIDHIVPIAKGGH
Sbjct:    3 QLRADKKGTHRVAFDRNKKKLLKAATVCGICGKPVDKSLKYPHPLSAAIDHIVPIAKGGH   62

Query:   88 PSSIDNLQLTHWQCNRQKSDKLFINQTAVRATVVGNRNLPQSRDWSSYASKE          139
            PS+++NLQLTHWQCNRQKSDKLF NQ +      +GNRNLPQSRDWSS+A K+
Sbjct:   63 PSALENLQLTHWQCNRQKSDKLFANQASNEPKTIGNRNLPQSRDWSSFAFKK          114
```

Based on this analysis, it was predicted that these proteins and their epitopes could be useful antigens for vaccines or diagnostics.

EXAMPLE 454

A DNA sequence (GBSx0491) was identified in *S. agalactiae* <SEQ ID 1463> which encodes the amino acid sequence <SEQ ID 1464>. Analysis of this protein sequence reveals the following:

```
Possible site: 33
>>> Seems to have no N-terminal signal sequence

----- Final Results -----
          bacterial cytoplasm --- Certainty = 0.4481(Affirmative) < succ>
          bacterial membrane  --- Certainty = 0.0000(Not Clear)   < succ>
          bacterial outside   --- Certainty = 0.0000(Not Clear)   < succ>
```

Based on this analysis, it was predicted that this protein and its epitopes, could be useful antigens for vaccines or diagnostics.

EXAMPLE 455

A DNA sequence (GBSx0492) was identified in *S. agalactiae* <SEQ ID 1465> which encodes the amino acid sequence <SEQ ID 1466>. Analysis of this protein sequence reveals the following:

```
Possible site: 28
>>> Seems to have no N-terminal signal sequence

----- Final Results -----
          bacterial cytoplasm --- Certainty = 0.2907(Affirmative) < succ>
          bacterial membrane  --- Certainty = 0.0000(Not Clear)   < succ>
          bacterial outside   --- Certainty = 0.0000(Not Clear)   < succ>
```

The protein has homology with the following sequences in the GENPEPT database:

```
>GP: AAF43508 GB: AF145054 ORF15
[Streptococcus thermophilus bacteriophage 7201]
Identities = 61/187 (32%), Positives = 90/187 (47%),
Gaps = 31/187 (16%)

Query:    1 MNIEEAKKLIDKQSIGKGGVGDIPVVKTHIVKVLLDQIDQPQPEVPRFVADWYEKHKDSL   60
            MN +EA K I K+             +    + L D I   +P VP++VADWYE+HKD
Sbjct:    1 MNRDEAVKKIAKEGY----------ISIEHAEDLYDSIIT-KPVVPQYVADWYEEHKDEF   49

Query:   61 ECDL------YLYHMSIY--DEEVEKDDFYYWMQTSKNPVYTLINMHQFGYTIQKEKLYT  112
            +L        + H++ Y  +E     DF W    +KN + L+NMHQFGY ++KEK YT
Sbjct:   50 YLNLHRVVRDFFEHLNAYYFNENPIDYDFACWYYNTKNAIQILVNMHQFGYEVKKEKRYT  109

Query:  113 VEIPN--PNERQLSFVLMRQLSGNVSIKVMHRDNLDLLKTDNDLQLTESEIRKDFDWAWQ  170
            V I N   E  L++ R+     +  RDN D +T +    T E+ ++  + W
Sbjct:  110 VRIRNLDDEETYLNYDKFRE-----TWVFYSRDNTDRFRTIH----THKEL-EEGGFGWV  159
```

```
Query:  171 FREEVVE                                                      177
            F   E +E
Sbjct:  160 FDCEGIE                                                      166
```

A related GBS nucleic acid sequence <SEQ ID 10927> which encodes amino acid sequence <SEQ ID 10928> was also identified.

A related DNA sequence was identified in *S. pyogenes* <SEQ ID 1467> which encodes the amino acid sequence <SEQ ID 1468>. Analysis of this protein sequence reveals the following:

```
Possible site: 21
>>> Seems to have no N-terminal signal sequence

----- Final Results -----
         bacterial cytoplasm --- Certainty = 0.3815(Affirmative) < succ>
         bacterial membrane  --- Certainty = 0.0000(Not Clear)   < succ>
          bacterial outside  --- Certainty = 0.0000(Not Clear)   < succ>
```

An alignment of the GAS and GBS proteins is shown below:

```
Identities = 70/180 (38%), Positives = 98/180 (53%), Gaps = 30/180 (16%)

Query:    1 MNIEEAKKLIDKQSI-GKGGVGDIPVVKTHIVKVLLDQIDQPQPEVPRFVADWYEKHKDS  59
            MNIEEAK+L+D      GK         V+K    V+ ++DQ++QP+PEVP+ VADW E+ K+
Sbjct:    1 MNIEEAKELVDNSKFYGKTS----SVIKAE-VRDIIDQLNQPKPEVPQCVADWIEECKEE  55

Query:   60 LECDLYLYHMSIYDEEVEKDDFYYWMQTSKNPVYTLINMHQFGYTIQKEKLYTVEIPN--  117
               DL L    ++        + W+  S       +      GYT++KEKLYTV++PN
Sbjct:   56 ---DLTL--KGLFSNSDMPAKIFDWIFGSDENCRLMAEAWINGYTVEKEKLYTVDLPNGQ  110

Query:  118 PNERQLSFVLMRQLSGNVSIKVMHRDNLDLLKTDNDLQLTESEIRKDFDWAWQFREEVVE  177
            P  R ++ +  Q                      L T+N ++LTESEIRKDF+WAWQF EEV E
Sbjct:  111 PLVRGINTLYFSQN---------------LATEN-VKLTESEIRKDFEWAWQFAEEVTE  153
```

Based on this analysis, it was predicted that these proteins and their epitopes could be useful antigens for vaccines or diagnostics.

EXAMPLE 456

A DNA sequence (GBSx0493) was identified in *S. agalactiae* <SEQ ID 1469> which encodes the amino acid sequence <SEQ ID 1470>. Analysis of this protein sequence reveals the following:

```
Possible site: 46
>>> Seems to have no N-terminal signal sequence

----- Final Results -----
         bacterial cytoplasm --- Certainty = 0.5365(Affirmative) < succ>
         bacterial membrane  --- Certainty = 0.0000(Not Clear)   < succ>
          bacterial outside  --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 457

A DNA sequence (GBSx0494) was identified in *S. agalactiae* <SEQ ID 1471> which encodes the amino acid sequence <SEQ ID 1472>. Analysis of this protein sequence reveals the following:

```
Possible site: 50
>>> Seems to have no N-terminal signal sequence
        INTEGRAL     Likelihood = -8.55     Transmembrane    34-50 (31-54)
```

```
----- Final Results -----
           bacterial membrane --- Certainty = 0.4418(Affirmative) < succ>
           bacterial outside  --- Certainty = 0.0000(Not Clear)   < succ>
           bacterial cytoplasm --- Certainty = 0.0000(Not Clear)  < succ>
```

A related GBS nucleic acid sequence <SEQ ID 9657> which encodes amino acid sequence <SEQ ID 9658> was also identified.

The protein has no significant homology with any sequences in the GENPEPT database.

A related DNA sequence was identified in S. pyogenes <SEQ ID 1473> which encodes the amino acid sequence <SEQ ID 1474>. Analysis of this protein sequence reveals the following:

```
Possible site: 40
>>> Seems to have no N-terminal signal sequence
    INTEGRAL    Likelihood = -11.25    Transmembrane    26-42 (20-49)

----- Final Results -----
           bacterial membrane --- Certainty = 0.5501(Affirmative) < succ>
           bacterial outside  --- Certainty = 0.0000(Not Clear)   < succ>
           bacterial cytoplasm --- Certainty = 0.0000(Not Clear)  < succ>
```

The protein has no significant homology with any sequences in the GENPEPT database.

An alignment of the GAS and GBS proteins is shown below:

```
Identities = 56/89 (62%), Positives = 71/89 (78%)

Query:   8 MTEQQMIDCLLYELAKKDKLNIRRNNIITFLSIVLMAISILNVALQDHYKSQITELRTQL   67
           MTE+QMIDCLLYEL KKDK   +++ II  L+++L+ +S L V+L+ +Y+ QI  LRTQL
Sbjct:   1 MTEEQMIDCLLYELVKKDKAIKKKSIIIAALTVMLIVVSGLCVSLKSYYEPQIYGLRTQL   60

Query:  68 SRTQKQLKRASDDRARQTKRIAELTGNGG   96
           SRTQKQLKRAS+   RQTKRIA+LT NGG
Sbjct:  61 SRTQKQLKRASEQNQRQTKRIADLTNNGG   89
```

Based on this analysis, it was predicted that these proteins and their epitopes could be useful antigens for vaccines or diagnostics.

EXAMPLE 458

A DNA sequence (GBSx0495) was identified in S. agalactiae <SEQ ID 1475> which encodes the amino acid sequence <SEQ ID 1476>. Analysis of this protein sequence reveals the following:

```
Possible site: 32
>>> Seems to have no N-terminal signal sequence

----- Final Results -----
           bacterial cytoplasm --- Certainty = 0.2040(Affirmative) < succ>
           bacterial membrane  --- Certainty = 0.0000(Not Clear)   < succ>
           bacterial outside   --- Certainty = 0.0000(Not Clear)   < succ>
```

The protein has no significant homology with any sequences in the GENPEPT database.

No corresponding DNA sequence was identified in S. pyogenes.

Based on this analysis, it was predicted that this protein and its epitopes, could be useful antigens for vaccines or diagnostics.

EXAMPLE 459

A DNA sequence (GBSx0496) was identified in S. agalactiae <SEQ ID 1477> which encodes the amino acid sequence <SEQ ID 1478>. Analysis of this protein sequence reveals the following:

Possible site: 34
>>> Seems to have no N-terminal signal sequence

----- Final Results -----
            bacterial cytoplasm --- Certainty = 0.3044(Affirmative) < succ>
             bacterial membrane --- Certainty = 0.0000(Not Clear)   < succ>
              bacterial outside --- Certainty = 0.0000(Not Clear)   < succ>

The protein has homology with the following sequences in the GENPEPT database:

```
>GP: AAD37108 GB: AF109874 unknown [Bacteriophage Tuc2009]
Identities = 50/143 (34%), Positives = 67/143 (45%), Gaps = 29/143 (20%)
Query:   1 MIPNFRAFNKETKKM-YG-VDGFELSVRKIYRCSLADDEFRCGRLETFHFVEDNFDDYIL   58
           MIP  RA++K+ ++M YG V+ F+ S+   YR             HF    +D
Sbjct:   1 MIPKLRAWDKQDERMSYGEVEYFDDSIN--YRFD--------------HFCTGADEDVEF 44

Query:  59 MQSTGMFDKNGVEIFDGDIVLTTRL-------IDY-TYKNFKGVVKMLEGRWLIDTGKDA  110
           MQSTG+ DKNGVEI++GDI+    +      I Y Y    G   + EG L    +
Sbjct:  45 MQSTGIKDKNGVEIYEGDILKLHAIFLAPDDKIGYLEYSPKYGYSIICEGNRLY---RQE 101

Query: 111 VGLWTEVDENEAIGNIYQNSELL                                      133
            T    E IGHIY+N ELL
Sbjct: 102 YWASTNKLNYEVIGNIYENPELL                                      124
```

A related DNA sequence was identified in *S. pyogenes* <SEQ ID 1479> which encodes the amino acid sequence <SEQ ID 1480>. Analysis of this protein sequence reveals the following:

Possible site: 34
>>> Seems to have no N-terminal signal sequence

----- Final Results -----
            bacterial cytoplasm --- Certainty = 0.4779(Affirmative) < succ>
             bacterial membrane --- Certainty = 0.0000(Not Clear)   < succ>
              bacterial outside --- Certainty = 0.0000(Not Clear)   < succ>

An alignment of the GAS and GBS proteins is shown below:

```
Identities = 44/52 (84%), Positives = 47/52 (89%)
Query: 1    MIPNFRAFNKETKKMYGVDGFELSVRKIYRCSLADDEFRCGRLETFHFVEDN 52
            MIPNFR FNK+TKKMY +DGF+ S RKIYRCSLADDEFR GRLETFHFVEDN
Sbjct: 1    MIPNFRGFNKKTKKMYSIDGFKSSERKIYRCSLADDEFRSGRLETFHFVEDN 52
```

Based on this analysis, it was predicted that these proteins and their epitopes could be useful antigens for vaccines or diagnostics.

EXAMPLE 460

A DNA sequence (GBSx0497) was identified in *S. agalactiae* <SEQ ID 1481> which encodes the amino acid sequence <SEQ ID 1482>. Analysis of this protein sequence reveals the following:

Possible site: 57
>>> Seems to have no N-terminal signal sequence

----- Final Results -----
            bacterial cytoplasm --- Certainty = 0.3843(Affirmative) < succ>
             bacterial membrane --- Certainty = 0.0000(Not Clear)   < succ>
              bacterial outside --- Certainty = 0.0000(Not Clear)   < succ>

A related GBS nucleic acid sequence <SEQ ID 9655> which encodes amino acid sequence <SEQ ID 9656> was also identified.

The protein has no significant homology with any sequences in the GENPEPT database.

No corresponding DNA sequence was identified in *S. pyogenes*.

Based on this analysis, it was predicted that these proteins and their epitopes could be useful antigens for vaccines or diagnostics.

EXAMPLE 461

A DNA sequence (GBSx0498) was identified in *S. agalactiae* <SEQ ID 1483> which encodes the amino acid sequence <SEQ ID 1484>. Analysis of this protein sequence reveals the following:

```
Possible site: 23
>>> Seems to have no N-terminal signal sequence

----- Final Results -----
            bacterial cytoplasm --- Certainty = 0.5189(Affirmative) < succ>
            bacterial membrane  --- Certainty = 0.0000(Not Clear)   < succ>
             bacterial outside  --- Certainty = 0.0000(Not Clear)   < succ>
```

A related GBS nucleic acid sequence <SEQ ID 9653> which encodes amino acid sequence <SEQ ID 9654> was also identified.

The protein has homology with the following sequences in the GENPEPT database:

```
>GP: AAF43503 GB: AF145054 ORF10 [Streptococcus thermophilus
bacteriophage 7201]
Identities = 92/147 (62%), Positives = 121/147 (81%)

Query:  15 IEPKPQTRPKFSKFGTYEDPKMKRWRKEVSGWIEKNYDGPFFDDCIKVEVTFYMKAPKTL   74
           IEPKPQTRP+FSKFGTYEDPKMK WR+E S  IE+ YDG FF   I V+VTFYMKAP ++
Sbjct:   7 IEPKPQTRPRFSKFGTYEDPKMKAWRRECSRLIEQEYDGQFFYGPISVDVTFYMKAPLSV   66

Query:  75 SKEPTQRSKGKTIQIYQNFVRELIWHAKKPDIDNLIKAVFDSISDAGYDRIQKSGIVWSD  134
           SK+PT +++ KT    ++ F+ E +WH++KPDIDNLIKA+FDSIS AGY+++ K GIVW+D
Sbjct:  67 SKKPTPKARAKTWDAFKKFMAERLWHSRKPDIDNLIKALFDSISTAGYNKVDKKGIVWTD  126

Query: 135 DNIVCDLRAKKKYSQNPRIKVRIEEID                                  161
           D+IVC L A+K+YS+NPRI+  I+E++
Sbjct: 127 DSIVCKLSAQKRYSENPRIEFEIKELE                                  153
```

No corresponding DNA sequence was identified in *S. pyogenes*.

Based on this analysis, it was predicted that these proteins and their epitopes could be useful antigens for vaccines or diagnostics.

EXAMPLE 462

A DNA sequence (GBSx0499) was identified in *S. agalactiae* <SEQ ID 1485> which encodes the amino acid sequence <SEQ ID 1486>. Analysis of this protein sequence reveals the following:

```
Possible site: 30
>>> Seems to have no N-terminal signal sequence

----- Final Results -----
            bacterial cytoplasm --- Certainty = 0.4007(Affirmative) < succ>
            bacterial membrane  --- Certainty = 0.0000(Not Clear)   < succ>
             bacterial outside  --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 463

A DNA sequence (GBSx0500) was identified in *S. agalactiae* <SEQ ID 1487> which encodes the amino acid sequence <SEQ ID 1488>. This protein is predicted to be pXO1-07. Analysis of this protein sequence reveals the following:

```
Possible site: 26
>>> Seems to have no N-terminal signal sequence

----- Final Results -----
            bacterial cytoplasm --- Certainty = 0.3664(Affirmative) < succ>
              bacterial membrane --- Certainty = 0.0000(Not Clear) < succ>
                bacterial outside --- Certainty = 0.0000(Not Clear) < succ>
```

The protein has homology with the following sequences in the GENPEPT database:

```
>GP: AAC38715 GB: AF030367 maturase-related protein [Streptococcus pneumo-
niae]
Identities = 146/373 (39%), Positives = 216/373 (57%), Gaps = 18/373 (4%)

Query:   35 LYDKVYRKDILKVAWFYVKRNKGSAGIDDFTIEEIEAYGVQKFLDEIEDQLRNKKYQPKA    94
             L DK+  ++ +   A+  VK NKGSAGID  TIEE++ Y  Q +     ++ ++ +KY+P+
Sbjct:    4 LLDKILSRENMLEAYNQVKSNKGSAGIDGMTIEEMDNYLRQNWR-LTKELIKQRKYKPQP   62

Query:   95 VKRVYIPKANGKKRPLGIPTVRDRVVQTAVKIVIEPIFEADFQEFSYGFRPKRSANQAIR   154
             V +V IPK +G  R LGIPTV DR++Q A+   V+ PI E   F + SYGFRP RS  +AI
Sbjct:   63 VLKVEIPKPDGGIRQLGIPTVMDRMIQQAIVQVMSPICEPHFSDTSYGFRPNRSCEKAIM  122

Query:  155 EIYKYLNYGCEWVIDADLKGYFDTIPHDKLLLLVKERVTDKSIIKLLSLWLEAGIMEDNQ   214
             ++ +YLN G  EW++D DL+  +FDT+P D+L+ LV    + D     L+  +L +G++ + Q
Sbjct:  123 KLLEYLNDGYEWIVDIDLEKFFDTVPQDRLMSLVHNIIEDGDTESLIRKYLHSGVIINGQ  182

Query:  215 VRSNILGTPQGGVISPLLANIYLNALDRYWKNNRLEGRGHDAHLIRYADDFVI-LCSNNP   273
                ++GTPQGG +SPLL+NI LN LD+        LE RG        +RYADD VI + S
Sbjct:  183 RYKTLVGTPQGGNLSPLLSNIMLNELDK-----ELEKRG--LRFVRYADDCVITVGSEAA  235

Query:  274 KKYYQYAKQRI--DKLGLTLNEEKTRIVHATEGFDFLGYTLRKSKSHKSGKYKTYYYPSR   331
              K   Y+  R   +LGL +N   KT+I    E    +LG+    KS    +       P +
Sbjct:  236 AKRVMYSVSRFIEKRLGLKVNMTKTKITRPRE-LKYLGFGFWKSSDGWKSR------PHQ  288

Query:  332 KSMKSIKGKVKDVIQTGQHLNLPDVMERLNPMLRGWANYFKAGNSKQHFKSIDNYVIYNL   391
             S++  K  K+K + Q      ++L  +E+LN  +RGW NYF   GN K      SID +     L
Sbjct:  289 DSVRRFKLKLKKLTQRKWSIDLTRRIEQLNLSIRGWINYFSLGNMKSIVASIDERLRTRL  348

Query:  392 TIMLRKKHKKSGK                                                 404
             +++ K+ KK +
Sbjct:  349 RMIIWKQWKKKSR                                                361
```

No corresponding DNA sequence was identified in *S. pyogenes*.

Based on this analysis, it was predicted that this protein and its epitopes, could be useful antigens for vaccines or diagnostics.

EXAMPLE 464

A DNA sequence (GBSx0501) was identified in *S. agalactiae* <SEQ ID 1489> which encodes the amino acid sequence <SEQ ID 1490>. Analysis of this protein sequence reveals the following:

```
Possible site: 27
>>> Seems to have no N-terminal signal sequence

----- Final Results -----
            bacterial cytoplasm --- Certainty = 0.3833(Affirmative) < succ>
              bacterial membrane --- Certainty = 0.0000(Not Clear) < succ>
                bacterial outside --- Certainty = 0.0000(Not Clear) < succ>
```

A related GBS nucleic acid sequence <SEQ ID 9651> which encodes amino acid sequence <SEQ ID 9652> was also identified.

A further related DNA sequence (GBSx2517) was identified in *S. agalactiae* <SEQ ID 7217> which encodes the amino acid sequence <SEQ ID 7218>. Analysis of this protein sequence reveals the following:

Possible site: 27
>>> Seems to have no N-terminal signal sequence

----- Final Results -----
            bacterial cytoplasm --- Certainty = 0.3833(Affirmative) < succ>
             bacterial membrane --- Certainty = 0.0000(Not Clear) < succ>
               bacterial outside --- Certainty = 0.0000(Not Clear) < succ>

A related DNA sequence was identified in *S. pyogenes* <SEQ ID 1491> which encodes the amino acid sequence <SEQ ID 1492>. Analysis of this protein sequence reveals the following:

Possible site: 27
>>> Seems to have no N-terminal signal sequence

----- Final Results -----
            bacterial cytoplasm --- Certainty = 0.2299(Affirmative) < succ>
             bacterial membrane --- Certainty = 0.0000(Not Clear) <succ>
               bacterial outside --- Certainty = 0.0000(Not Clear) < succ>

An alignment of the GAS and GBS proteins is shown below:

```
Identities = 113/163 (69%), Positives = 128/163 (78%), Gaps = 25/163 (15%)

Query:    1 MINNIVLVGRMTKDAELRYTPSNQAVATFSLAVNRNFKNQSGEREADFINCVIWRQQAEN    60
            MINN+VLVGRMTKDAELRYTPS  AVATF+LAVNR FK+Q+GEREADFINCVIWRQ AEN
Sbjct:    1 MINNVVLVGRMTKDAELRYTPSQVAVATFTLAVNRTFKSQNGEREADFINCVIWRQPAEN    60

Query:   61 LANWAKKGALVGITGRIQTRNYENQQGQRIYVTEVVAENFQLLESRNSQQ---------Q   111
            LANWAKKGAL+G+TGRIQTRNYENQQGQR+YVTEVVA+NFQ+LESR +++
Sbjct:   61 LANWAKKGALIGVTGRIQTRNYENQQGQRVYVTEVVADNFQMLESRATREGGSTGSFNGG   120

Query:  112 TNQSGNSSNSY----------------FGNANKMDISDDDLPF                   138
            N + +SSNSY                FGN+N MDISDDDLPF
Sbjct:  121 FNNNTSSSNSYSAPAQQTPNFGRDDSPFGNSNPMDISDDDLPF                   163
```

Based on this analysis, it was predicted that these proteins and their epitopes could be useful antigens for vaccines or diagnostics.

EXAMPLE 465

A DNA sequence (GBSx0502) was identified in *S. agalactiae* <SEQ ID 1493> which encodes the amino acid sequence <SEQ ID 1494>. Analysis of this protein sequence reveals the following:

Possible site: 26
>>> Seems to have an uncleavable N-term signal seq
    INTEGRAL Likelihood = -1.33 Transmembrane 17-33 ( 17-33)

----- Final Results -----
             bacterial membrane --- Certainty = 0.1532(Affirmative) < succ>
               bacterial outside --- Certainty = 0.0000(Not Clear) < succ>
            bacterial cytoplasm --- Certainty = 0.0000(Not Clear) < succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 466

A DNA sequence (GBSx0503) was identified in *S. agalactiae* <SEQ ID 1495> which encodes the amino acid sequence <SEQ ID 1496>. This protein is predicted to be p22 erf-like protein. Analysis of this protein sequence reveals the following:

Possible site: 52
>>> Seems to have no N-terminal signal sequence

-continued

```
----- Final Results -----
            bacterial cytoplasm --- Certainty = 0.2469(Affirmative) < succ>
            bacterial membrane  --- Certainty = 0.0000(Not Clear)   < succ>
             bacterial outside  --- Certainty = 0.0000(Not Clear)   < succ>
```

The protein has homology with the following sequences in the GENPEPT database:

```
>GP: BAA97824 GB: AB044554 orf 17 [Staphylococcus aureus prophage
phiPV83]
Identities = 93/183 (50%), Positives = 120/183 (64%), Gaps = 5/183 (2%)

Query:    1 MRKSESITEYAKAFCKAQLEVKQPLKDKDNPFFKSKYVPLENVTEAITTAFANNGISFSQ   60
            M KSE++ E  KA    + EVKQPLKDK+NPFFKSKYVPLENV EAI   A   +G+S++Q
Sbjct:    1 MNKSETVVEINKAMVAFRKEVKQPLKDKNNPFFKSKYVPLENVVEAIDEAATPHGLSYTQ   60

Query:   61 DPTTNTENGYIDVATLVMHTSGEWVEYGPLSVKPTKNDVQGAGSAITYAKRYALSAIFGI  120
              N  +G + VAT++MH SGE++EY P+ +    KN  QGAGS I+Y KRY+LSAIFGI
Sbjct:   61 W-ALNDVDGRVGVATMLMHESGEYIEYDPVFMNAEKNTPQGAGSLISYLKRYSLSAIFGI  119

Query:  121 TSDQDDDGNEDSKPNNSRQSPKATTKKTQKTGYQTPKISNIQIETYKSDLNDIAKATNQN  180
            TSDQDDDGNE S  NN   +PK  T +TQ    +T  I   ++ ++    +    K   QN
Sbjct:  120 TSDQDDDGNEASGKNN---NPKQQT-RTQWASSETIGILRKEVISFTKLIKGTDKEAPQN  175

Query:  181 VEE                                                           183
            + E
Sbjct:  176 IVE                                                           178
```

No corresponding DNA sequence was identified in *S. pyogenes*.

Based on this analysis, it was predicted that this protein and its epitopes, could be useful antigens for vaccines or diagnostics.

EXAMPLE 467

A DNA sequence (GBSx0504) was identified in *S. agalactiae* <SEQ ID 1497> which encodes the amino acid sequence <SEQ ID 1498>. This protein is predicted to be gp157. Analysis of this protein sequence reveals the following:

```
Possible site: 55
>>> Seems to have no N-terminal signal sequence

----- Final Results -----
            bacterial cytoplasm --- Certainty = 0.3148(Affirmative) < succ>
            bacterial membrane  --- Certainty = 0.0000(Not Clear)   < succ>
             bacterial outside  --- Certainty = 0.0000(Not Clear)   < succ>
```

The protein has homology with the following sequences in the GENPEPT database:

```
>GP: AAD44102 GB: AF115103 orf157 gp [Streptococcus thermophilus]
bacteriophage Sfi21]
Identities = 59/160 (36%), Positives = 100/160 (61%), Gaps = 3/160 (1%)

Query:    1 MAYLYELEGIYAQLQSMDLDEETFQDTLDSIDFQSDLENNIEYFVKMLKNVQADAEKYKA   60
            MA LYEL G + ++ +M++D+ET  DTL++ID+ SD EN +E +VK+K+++AD E  K
Sbjct:    1 MATLYELTGQFLEIYNMEIDDETKLDTLEAIDWTSDYENKVEGYVKVIKSLEADIEARKN   60

Query:   61 EKEAFYKKQKQAEAKAEKYKETIRLAMELSQKKKVDAGMFKVSLRRSKKVEILDETKIPL  120
            EK+      K   ++K +K K  + ++M  +  +VD  +FK+    +SK V +++E K+P
Sbjct:   61 EKKRLDGLNKSDQSKIDKLKAALAISMTETGQTRVDTTLFKIGFHKSKAV-VVNEEKLPK  119

Query:  121 DYMQEKIEYKPMKAEISKALKSGIDISGVELIETESLQVK                      160
            +Y  +    YKP K  + LKSG  I G  L E    +L ++
Sbjct:  120 EY--QIATYKPDKKTLKELLKSGKHIEGATLEERRNLNIR                      157
```

No corresponding DNA sequence was identified in *S. pyogenes*.

Based on this analysis, it was predicted that this protein and its epitopes, could be useful antigens for vaccines or diagnostics.

EXAMPLE 468

A DNA sequence (GBSx0505) was identified in *S. agalactiae* <SEQ ID 1499> which encodes the amino acid sequence <SEQ ID 1500>. This protein is predicted to be tropomyosin 2. Analysis of this protein sequence reveals the following:

```
Possible site: 26
>>> Seems to have no N-terminal signal sequence

----- Final Results -----
            bacterial cytoplasm --- Certainty = 0.4474(Affirmative) < succ>
            bacterial membrane  --- Certainty = 0.0000(Not Clear)   < succ>
            bacterial outside   --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 469

A DNA sequence (GBSx0506) was identified in *S. agalactiae* <SEQ ID 1501> which encodes the amino acid sequence <SEQ ID 1502>. Analysis of this protein sequence reveals the following:

```
Possible site: 21
>>> Seems to have no N-terminal signal sequence

----- Final Results -----
            bacterial cytoplasm --- Certainty = 0.4114(Affirmative) < succ>
            bacterial membrane  --- Certainty = 0.0000(Not Clear)   < succ>
            bacterial outside   --- Certainty = 0.0000(Not Clear)   < succ>
```

A related GBS nucleic acid sequence <SEQ ID 9649> which encodes amino acid sequence <SEQ ID 9650> was also identified.

The protein has no significant homology with any sequences in the GENPEPT database.

No corresponding DNA sequence was identified in *S. pyogenes*.

Based on this analysis, it was predicted that these proteins and their epitopes could be useful antigens for vaccines or diagnostics.

EXAMPLE 470

A DNA sequence (GBSx0507) was identified in *S. agalactiae* <SEQ ID 1503> which encodes the amino acid sequence <SEQ ID 1504>. Analysis of this protein sequence reveals the following:

```
Possible site: 17
>>> Seems to have no N-terminal signal sequence

----- Final Results -----
            bacterial cytoplasm --- Certainty = 0.3799(Affirmative) < succ>
            bacterial membrane  --- Certainty = 0.0000(Not Clear)   < succ>
            bacterial outside   --- Certainty = 0.0000(Not Clear)   < succ>
```

The protein has no significant homology with any sequences in the GENPEPT database.

A related DNA sequence was identified in *S. pyogenes* <SEQ ID 1505> which encodes the amino acid sequence <SEQ ID 1506>. Analysis of this protein sequence reveals the following:

```
Possible site: 31
>>> Seems to have no N-terminal signal sequence

----- Final Results -----
            bacterial cytoplasm --- Certainty = 0.3775(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below:

```
Identities = 43/46 (93%), Positives = 46/46 (99%)

Query:  1 MTKQHRETLIWYRASHQEREKLLDFGLVDKSQYVTLLRQLRKKYAI    46
          MTKQHRETLIWYRASHQERE+LLDFGLVDK++YVTLLRQLRKKYAI
Sbjct:  1 MTKQHRETLIWYRASHQERERLLDFGLVDKARYVTLLRQLRKKYAI    46
```

Based on this analysis, it was predicted that these proteins and their epitopes could be useful antigens for vaccines or diagnostics.

EXAMPLE 471

A DNA sequence (GBSx0508) was identified in *S. agalactiae* <SEQ ID 1507> which encodes the amino acid sequence <SEQ ID 1508>. Analysis of this protein sequence reveals the following:

```
Possible site: 61
>>> Seems to have no N-terminal signal sequence

----- Final Results -----
            bacterial cytoplasm --- Certainty = 0.4308(Affirmative) < succ>
             bacterial membrane --- Certainty = 0.0000(Not Clear)   < succ>
              bacterial outside --- Certainty = 0.0000(Not Clear)   < succ>
```

The protein has no significant homology with any sequences in the GENPEPT database.

A related DNA sequence was identified in *S. pyogenes* <SEQ ID 1509> which encodes the amino acid sequence <SEQ ID 1510>. Analysis of this protein sequence reveals the following:

```
Possible site: 61
>>> Seems to have no N-terminal signal sequence

----- Final Results -----
            bacterial cytoplasm --- Certainty = 0.4308(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below:

```
Identities = 76/77 (98%), Positives = 76/77 (98%)
Query:  1  MDQEIFNFFNKQIKKDFGKTASKETFAKFASYCAEGIEKNGVKPIFNWINLYAFGTGMTT    60
           MDQEIFNFFNKQIKKDFGKTASKETFAKFASYCAEGIEKNGVKPIFNWINLYAFGTGMTT
Sbjct:  1  MDQEIFNFFNKQIKKDFGKTASKETFAKFASYCAEGIEKNGVKPIFNWINLYAFGTGMTT    60
```

```
Query:  61 AEADRLRIERYKQENTL                                              77
           AEADRLRIERYKQEN L
Sbjct:  61 AEADRLRIERYKQENAL                                              77
```

Based on this analysis, it was predicted that these proteins and their epitopes could be useful antigens for vaccines or diagnostics.

EXAMPLE 472

A DNA sequence (GBSx0509) was identified in *S. agalactiae* <SEQ ID 1511> which encodes the amino acid sequence <SEQ ID 1512>. Analysis of this protein sequence reveals the following:

```
Possible site: 27
>>> Seems to have no N-terminal signal sequence

----- Final Results -----
              bacterial cytoplasm --- Certainty = 0.2706(Affirmative) < succ>
               bacterial membrane --- Certainty = 0.0000(Not Clear)   < succ>
                bacterial outside --- Certainty = 0.0000(Not Clear)   < succ>
```

A related DNA sequence was identified in *S. pyogenes* <SEQ ID 1513> which encodes the amino acid sequence <SEQ ID 1514>. Analysis of this protein sequence reveals the following:

```
Possible site: 23
>>> Seems to have no N-terminal signal sequence

----- Final Results -----
              bacterial cytoplasm --- Certainty = 0.3316(Affirmative) < succ>
               bacterial membrane --- Certainty = 0.0000(Not Clear)   < succ>
                bacterial outside --- Certainty = 0.0000(Not Clear)   < succ>
```

An alignment of the GAS and GBS proteins is shown below:

```
Identities = 52/127 (40%), Positives = 75/127 (58%), Gaps = 1/127 (0%)
Query: 160 EDRFVDVVEANLGRGLVKFEFDMINDYLIGQNVSKDLFLEAVKVAVANNVRKFNYIARIL  219
           E + +  +   GR +  FE + I  ++    N+ ++    A++ AV NN    + YI +IL
Sbjct:   3 EKKLFENFQLTFGRMISPFEIEDIQKWIHEDNMPIEVVNLALREAVENNKISWKYINKIL   62

Query: 220 DNWINDGIKTPEQAYQAQRDFKAKKANKTMQSQSNVPSWSNPDYKGPDLKEFALGSIDDI  279
           +W   G   T E+     + F   K   +++ + SNVPSWSNPDYK PDL+EFALGS+D I
Sbjct:  63 VDWYKSGDTTVEKVRDRLQRFDDSKKQRSVTT-SNVPSWSNPDYKEPDLEEFALGSMDGI  121

Query: 280 EDGSGDF                                                      286
           EDGSGDF
Sbjct: 122 EDGSGDF                                                      128
```

Based on this analysis, it was predicted that these proteins and their epitopes could be useful antigens for vaccines or diagnostics.

EXAMPLE 473

A DNA sequence (GBSx0510) was identified in *S. agalactiae* <SEQ ID 1515> which encodes the amino acid sequence <SEQ ID 1516>. Analysis of this protein sequence reveals the following:

```
Possible site: 26
>>> Seems to have an uncleavable N-term signal seq
      INTEGRAL    Likelihood = -5.63      Transmembrane      13-29 (11-31)

----- Final Results -----
               bacterial membrane --- Certainty = 0.3251(Affirmative) < succ>
```

```
                bacterial outside --- Certainty = 0.0000(Not Clear) < succ>
                bacterial cytoplasm --- Certainty = 0.0000(Not Clear) < succ>
```

A related GBS nucleic acid sequence <SEQ ID 9647> which encodes amino acid sequence <SEQ ID 9648> was also identified.

The protein has no significant homology with any sequences in the GENPEPT database.

No corresponding DNA sequence was identified in S. pyogenes.

Based on this analysis, it was predicted that these proteins and their epitopes could be useful antigens for vaccines or diagnostics.

EXAMPLE 474

A DNA sequence (GBSx0511) was identified in S. agalactiae <SEQ ID 1517> which encodes the amino acid sequence <SEQ ID 1518>. Analysis of this protein sequence reveals the following:

```
Possible site: 34
>>> Seems to have no N-terminal signal sequence

----- Final Results -----
            bacterial cytoplasm --- Certainty = 0.5822(Affirmative) < succ>
            bacterial membrane --- Certainty = 0.0000(Not Clear) < succ>
             bacterial outside --- Certainty = 0.0000(Not Clear) < succ>
```

The protein has no significant homology with any sequences in the GENPEPT database.

No corresponding DNA sequence was identified in S. pyogenes.

Based on this analysis, it was predicted that this protein and its epitopes, could be useful antigens for vaccines or diagnostics.

EXAMPLE 475

A DNA sequence (GBSx0512) was identified in S. agalactiae <SEQ ID 1519> which encodes the amino acid sequence <SEQ ID 1520>. Analysis of this protein sequence reveals the following:

```
Possible site: 13
>>> Seems to have no N-terminal signal sequence

----- Final Results -----
            bacterial cytoplasm --- Certainty = 0.4175(Affirmative) < succ>
             bacterial membrane --- Certainty = 0.0000(Not Clear) < succ>
              bacterial outside --- Certainty = 0.0000(Not Clear) < succ>
```

The protein has no significant homology with any sequences in the GENPEPT database.

No corresponding DNA sequence was identified in S. pyogenes.

Based on this analysis, it was predicted that this protein and its epitopes, could be useful antigens for vaccines or diagnostics.

EXAMPLE 476

A DNA sequence (GBSx0513) was identified in S. agalactiae <SEQ ID 1521> which encodes the amino acid sequence <SEQ ID 1522>. This protein is predicted to be P1-antirepressor homolog. Analysis of this protein sequence reveals the following:

```
Possible site: 37
>>> Seems to have no N-terminal signal sequence

----- Final Results -----
            bacterial cytoplasm --- Certainty = 0.3411(Affirmative) < succ>
```

-continued
```
          bacterial membrane --- Certainty = 0.0000(Not Clear) < succ>
           bacterial outside --- Certainty = 0.0000(Not Clear) < succ>
```

A related GBS nucleic acid sequence <SEQ ID 9645> which encodes amino acid sequence <SEQ ID 9646> was also identified.

The protein has homology with the following sequences in the GENPEPT database:

```
>GP: AAG31333 GB: AF182207 ORF 169a [Bacteriophage mv4]
Identities = 88/167 (52%), Positives = 122/167 (72%)
Query: 100 MLQRNEKSKQVRKYFIQVEKDFNSPEKIMARALLMADKKITNLTMENNQLQLDLKEAQKQ    159
           M+ +  K K++R+YFIQVEK++NSPE I+ RAL +++ +I   L  +N  L L L+E+ K+
Sbjct:   1 MMSKTAKGKEIRQYFIQVEKNWNSPEMIIQRALEISNARIQELQAQNKSLTLQLEESNKK    60

Query: 160 ARYLDLIIESKGALRVTQIAADYGMSVNKFNKTLLEFGVQHKVNGQWILYKRHMGKGYTD    219
            A  YLD+I+ +   L   TQIAADYG S   FN+ L E G+QHKVNGQWILYK +MGKGY
Sbjct:  61 ASYLDIILGTPDLLATTQIAADYGYSARTFNQLLKEVGIQHKVNGQWILYKAYMGKGYVQ    120

Query: 220 SHTFDYQDKNGHTRANVTTTWTQKGRLFLYELLKDNNILPLIEQEDI                266
             S +F ++D+ GH R+  +T WTQKGR  +Y++LK+N  LPLIE++DI
Sbjct: 121 SKSFAFKDRKGHDRSKPSTYWTQKGRKLIYDVLKENGTLPLIERDDI                167
```

A related DNA sequence was identified in *S. pyogenes* <SEQ ID 1523> which encodes the amino acid sequence <SEQ ID 1524>. Analysis of this protein sequence reveals the following:

```
Possible site: 19
>>> Seems to have no N-terminal signal sequence

----- Final Results -----
              bacterial cytoplasm --- Certainty = 0.4214(Affirmative) < succ>
              bacterial membrane --- Certainty = 0.0000(Not Clear)   < succ>
               bacterial outside --- Certainty = 0.0000(Not Clear)   < succ>
```

An alignment of the GAS and GBS proteins is shown below:

```
Identities = 130/249 (52%), Positives = 163/249 (65%), Gaps = 14/249 (5%)
Query:  19 MNQLINITLNENQEPVVSGRDLHNVLNIKTQYTKWLERMSEYGFEENVDYIAISQKRLTA    78
           MNQLIN+TLNENQEPVVSGRDLH VL IKTQYTKWLERMSEYGF EN D++AISQKRLTA
Sbjct:   1 MNQLINVTLNENQEPVVSGRDLHKVLEIKTQYTKWLERMSEYGFVENEDFMAISQKRLTA    60

Query:  79 QGNRTEYIDHVLKLDMAKEIAMLQRNEKSKQVRKYFIQVEKDFNSPEKIMARALLMADKK    138
           QGN+TEY DHVLKLDMAKEIAMLQRNEKSK+VRKYFIQVEKDFNSPEKIMARALLMADKK
Sbjct:  61 QGNQTEYTDHVLKLDMAKEIAMLQRNEKSKEVRKYFIQVEKDFNSPEKIMARALLMADKK    120

Query: 139 ITNLTMENNQLQLDLKEAQKQARYLDLIIESKGALRVTQIAA-----DYGMSVNKFNKTL    193
             +       ++L+ ++ + + + D + S  ++ V ++A       +  +    L
Sbjct: 121 V-------HKLEAQIEADRPKVLFADAVSASHTSILVGELAKLLKQNGVNIGATRLFTWL    173

Query: 194 LEFGVQHKVNGQ-WIL-YKRHMGKGYTDSHTFDYQDKNGHTRANVTTTWTQKGRLFLYEL    251
            + G   K NG+ W + ++ + G            +GH   + T  T KG+ +
Sbjct: 174 RKHGYLIKRNGRDWNMPTQKSVELGLIRVKETSITHSDGHITVSKTPLVTGKGQQYFINK    233

Query: 252 LKDNNILPL                                                      260
            +     LP+
Sbjct: 234 FLNQEYLPV                                                      242
```

Based on this analysis, it was predicted that these proteins and their epitopes could be useful antigens for vaccines or diagnostics.

EXAMPLE 477

A DNA sequence (GBSx0514) was identified in *S. agalactiae* <SEQ ID 1525> which encodes the amino acid sequence <SEQ ID 1526>. Analysis of this protein sequence reveals the following:

Possible site: 44
>>> Seems to have no N-terminal signal sequence

----- Final Results -----
          bacterial cytoplasm --- Certainty = 0.4205(Affirmative) < succ>
           bacterial membrane --- Certainty = 0.0000(Not Clear)   < succ>
            bacterial outside --- Certainty = 0.0000(Not Clear)   < succ>

The protein has no significant homology with any sequences in the GENPEPT database.

A related DNA sequence was identified in *S. pyogenes* <SEQ ID 1527> which encodes the amino acid sequence <SEQ ID 1528>. Analysis of this protein sequence reveals the following:

Possible site: 32
>>> Seems to have no N-terminal signal sequence

----- Final Results -----
           bacterial membrane --- Certainty = 0.0000(Not Clear) < succ>
            bacterial outside --- Certainty = 0.0000(Not Clear) < succ>
          bacterial Cytoplasm --- Certainty = 0.0000(Not Clear) < succ>

An alignment of the GAS and GBS proteins is shown below:

```
Identities = 21/63 (33%), Positives = 31/63 (48%), Gaps = 1/63 (1%)
Query:  1 MQQFNLKQLREKKGFTQNELADKANVSRSLVVGLETGSYSETSTASLKKLAKALDVKIKD   60
          M+   LK R K +Q LAD   VSR + +E G Y+ T    +  + LD  + D
Sbjct:  1 MKNLKLKAARAGKDLSQQALADLVGVSRQTIAAVEKGDYNPTINLCI-AICRVLDKTLDD   59

Query: 61 LFF                                                           63
          LF+
Sbjct: 60 LFW                                                           62
```

Based on this analysis, it was predicted that these proteins and their epitopes could be useful antigens for vaccines or diagnostics.

EXAMPLE 478

A DNA sequence (GBSx0515) was identified in *S. agalactiae* <SEQ ID 1529> which encodes the amino acid sequence <SEQ ID 1530>. Analysis of this protein sequence reveals the following:

Possible site: 26
>>> Seems to have no N-terminal signal sequence

----- Final Results -----
          bacterial cytoplasm --- Certainty = 0.0396(Affirmative) < succ>
           bacterial membrane --- Certainty = 0.0000(Not Clear)   < succ>
            bacterial outside --- Certainty = 0.0000(Not Clear)   < succ>

The protein has homology with the following sequences in the GENPEPT database:

```
>GP: BAA17582 GB: D90907 hypothetical protein [Synechocystis sp.]
Identities = 45/164 (27%), Positives = 79/164 (47%), Gaps = 33/164 (20%)
Query: 102 EEEELRNLFTKLIASSMDKSKNEFNHPSFIEIIKQFDKIDAQNFKIISDLYFKKGFVATG   161
           ++E L+ L+   L+AS++ +S    + SF+E++KQ D +DA+   ++ L+ +
Sbjct:  97 DDENLQTLWANLLASALTESDRTNSTKSFVEVLKQVDIVDAELLNVLYLLHLRV------   150

Query: 162 TYYTTIIGQDKPLEHIASHVFVDNLEQNDIAIQSSSLTNLERLGLIQINY--KAHVDEKE   219
                     KP E    ++    D+ + N + S +L NLERLGL+ I+        VDE+
Sbjct: 151 --------MAKPDEFTYAN---DSRKYNIVQI-SVALNNLERLGLIIHKYDDTPVDEEA   198
```

```
-continued
Query: 220 YYNILNNSFITKKNSELKEQNKRVLTNLGMITLTLFGVRFSKTC          263
          +I     ++   N    K              ++LTLFG+ F + C
Sbjct: 199 RISIW---YMQDGNRSFKAH----------VSLTLFGIHFMRVC          229
```

A related DNA sequence was identified in *S. pyogenes* <SEQ ID 1531> which encodes the amino acid sequence <SEQ ID 1532>. Analysis of this protein sequence reveals the following:

```
Possible site: 19
>>> Seems to have no N-terminal signal sequence

----- Final Results -----
            bacterial cytoplasm --- Certainty = 0.0151(Affirmative) < succ>
            bacterial membrane  --- Certainty = 0.0000(Not Clear)   < succ>
            bacterial outside   --- Certainty = 0.0000(Not Clear)   < succ>
```

An alignment of the GAS and GBS proteins is shown below:

```
Identities = 64/215 (29%), Positives = 105/215 (48%), Gaps = 23/215 (10%)
Query:  65 QKLAKEIQDVVSKNIE-NLQEPSLSIAGPALEASKFYLEEEELRNLFTKLIASSMDKSKN 123
           +K   EI    SK  + +L+EP   I  PA+   S+ YL  E LRN+F + IAS+ ++ K
Sbjct:  72 EKFKNEIDCEFSKIPQTSLKEPVEYILYPAINESEQYLSNETLRNMFARTIASTFNQDKE 131

Query: 124 EFNHPSFIEIIKQFDKIDAQNFKIISDLYFKKGFVATGTYYTTIIGQDKPLEHI------ 177
           +   H +F+++IIKQ    +DAQN  +I+                 IG      E++
Sbjct: 132 KDLHSAFVQIIKQMTPLDAQNLLLINQ------EGNNLIANLQIGVHYSKENLSGTVNK 184

Query: 178 ASHVFVDNLEQNDIAIQSSSLTNLERLGLIQINYKAHVDEKEYYNILNNSFITKKNSELK 237
           A+++++  L+  +    I +SS+ NL RLGLI+++Y  +   Y +I   +     SE+
Sbjct: 185 ANNIYLSKLDYSPDII-ASSIDNLTRLGLIKVDYLHYPLDSNYESIKQTTIYKSLESEIN 243

Query: 238 EQNKRVLTNL--------GMITLTLFGVRFSKTCL 264
              N    +N         G ++LT FG +F   CL
Sbjct: 244 TLNLFKTSNTKYDIKIEKGKVSLTDFGKKFISVCL 278
```

SEQ ID 1530 (GBS261) was expressed in *E. coli* as a His-fusion product. SDS-PAGE analysis of total cell extract is shown in FIG. 44 (lane 8; MW 31 kDa).

Based on this analysis, it was predicted that these proteins and their epitopes could be useful antigens for vaccines or diagnostics.

EXAMPLE 479

A DNA sequence (GBSx0516) was identified in *S. agalactiae* <SEQ ID 1533> which encodes the amino acid sequence <SEQ ID 1534>. Analysis of this protein sequence reveals the following:

```
Possible site: 16
>>> Seems to have an uncleavable N-term signal seq
    INTEGRAL     Likelihood = -8.55     Transmembrane     3-19 (1-26)

----- Final Results -----
            bacterial membrane  --- Certainty = 0.4418(Affirmative) < succ>
            bacterial outside   --- Certainty = 0.0000(Not Clear)   < succ>
            bacterial cytoplasm --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 480

A DNA sequence (GBSx0517) was identified in *S. agalactiae* <SEQ ID 1535> which encodes the amino acid sequence <SEQ ID 1536>. Analysis of this protein sequence reveals the following:

```
Possible site: 47
>>> Seems to have no N-terminal signal sequence
     INTEGRAL    Likelihood = -4.99    Transmembrane    35-51 (30-51)

----- Final Results -----
          bacterial membrane --- Certainty = 0.2996(Affirmative) < succ>
          bacterial outside  --- Certainty = 0.0000(Not Clear)   < succ>
          bacterial cytoplasm --- Certainty = 0.0000(Not Clear)  < succ>
```

The protein has no significant homology with any sequences in the GENPEPT database.

A related DNA sequence was identified in *S. pyogenes* <SEQ ID 1537> which encodes the amino acid sequence <SEQ ID 1538>. Analysis of this protein sequence reveals the following:

```
Possible site: 47
>>> Seems to have no N-terminal signal sequence
     INTEGRAL    Likelihood = -4.94    Transmembrane    31-47 (30-51)

----- Final Results -----
          bacterial membrane --- Certainty = 0.2975(Affirmative) < succ>
          bacterial outside  --- Certainty = 0.0000(Not Clear)   < succ>
          bacterial cytoplasm --- Certainty = 0.0000(Not Clear)  < succ>
```

An alignment of the GAS and GBS proteins is shown below:

```
Identities = 45/52 (86%), Positives = 48/52 (91%)

Query: 1 MNWKKLMLGDLEHTFTSRDGKEKTSVEFEGGVLPALLVLGGITWLIAWLITK 52
         MNWKKLM GDLEHTFT+ DGKEKTS+EFEGGVLPALLVLGGI W+IAW ITK
Sbjct: 1 MNWKKLMFGDLEHTFTNHDGKEKTSIEFEGGVLPALLVLGGIAWMIAWFITK 52
```

Based on this analysis, it was predicted that these proteins and their epitopes could be useful antigens for vaccines or diagnostics.

EXAMPLE 481

A DNA sequence (GBSx0518) was identified in *S. agalactiae* <SEQ ID 1539> which encodes the amino acid sequence <SEQ ID 1540>. Analysis of this protein sequence reveals the following:

```
Possible site: 35
>>> Seems to have no N-terminal signal sequence

----- Final Results -----
          bacterial cytoplasm --- Certainty = 0.3445(Affirmative) < succ>
          bacterial membrane  --- Certainty = 0.0000(Not Clear)   < succ>
          bacterial outside   --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 482

A DNA sequence (GBSx0519) was identified in *S. agalactiae* <SEQ ID 1541> which encodes the amino acid sequence <SEQ ID 1542>. Analysis of this protein sequence reveals the following:

```
Possible site: 37
>>> Seems to have no N-terminal signal sequence

----- Final Results -----
          bacterial cytoplasm --- Certainty = 0.3934(Affirmative) < succ>
          bacterial membrane  --- Certainty = 0.0000(Not Clear)   < succ>
          bacterial outside   --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 483

A DNA sequence (GBSx0520) was identified in *S. agalactiae* <SEQ ID 1543> which encodes the amino acid sequence <SEQ ID 1544>. This protein is predicted to be repressor protein. Analysis of this protein sequence reveals the following:

```
Possible site: 61
>>> Seems to have no N-terminal signal sequence

----- Final Results -----
            bacterial cytoplasm --- Certainty = 0.0905(Affirmative) < succ>
            bacterial membrane  --- Certainty = 0.0000(Not Clear)   < succ>
             bacterial outside  --- Certainty = 0.0000(Not Clear)   < succ>
```

A related GBS nucleic acid sequence <SEQ ID 9643> which encodes amino acid sequence <SEQ ID 9644> was also identified.

A related DNA sequence was identified in *S. pyogenes* <SEQ ID 1545> which encodes the amino acid sequence <SEQ ID 1546>. Analysis of this protein sequence reveals the following:

```
Possible site: 55
>>> Seems to have no N-terminal signal sequence

----- Final Results -----
            bacterial cytoplasm --- Certainty = 0.3117(Affirmative) < succ>
            bacterial membrane  --- Certainty = 0.0000(Not Clear)   < succ>
             bacterial outside  --- Certainty = 0.0000(Not Clear)   < succ>
```

An alignment of the GAS and GBS proteins is shown below:

```
Identities = 175/264 (66%), Positives = 207/264 (78%), Gaps = 19/264 (7%)
Query:   34 LGKYIKKYRDTNNLSMAEFAKESGISKAY--VSILEKNRDPRNGKEIIPSIPIIKKVSDT    91
            LG  I+K R+  N++   E ++  G+ K Y  VS  EKN +   GK++        KK+++
Sbjct:   24 LGDRIRKLREGRNMTQTELSEILGM-KTYTTVSKWEKNENFPKGKDL-------KKLAEI   75

Query:   92 IGISFDDLLNSLDENQIVALNETKTEKNLTSSTLQKITSTSSQLEQPRQEKVLSFANEQL   151
            ++ D LL         L ++K  K    +I S  +QLEQPRQEKVL+FANEQL
Sbjct:   76 FNVTSDYLLG---------LTDSKLGKITIQNEQPEIVSIYNQLEQPRQEKVLNFANEQL   126

Query:  152 EEQNKVVSMFDRKVEETENYITDYVEGLVAAGLGAYEDNLHMEVKLRADDVPDKYDTIA   211
            EEQNK VS+FD+K EETE+YITDYVEGLVAAGLGAYEDNLHM+VKLR+DDVPD+YDTIA
Sbjct:  127 EEQNKTVSIFDKKSEETEDYITDYVEGLVAAGLGAYEDNLHMKVKLRSDDVPDEYDTIA   186

Query:  212 KVAGNSMEPLIQDNDLLFVKVSSQVDMNDIGIFQVNGKNFVKKLKRDYDGAWYLQSLNKS   271
            KVAG+SMEPLIQDNDLLF+KVSSQVDMNDIGIFQVNGKNFVKKLKRDYDGAWYLQSLNKS
Sbjct:  187 KVAGDSMEPLIQDNDLLFIKVSSQVDMNDIGIFQVNGKNFVKKLKRDYDGAWYLQSLNKS   246

Query:  272 YEEIYLSENDNIRTIGEVVDIYRE                                     295
            YEEIYLS++D+IRTIGEVVDIYRE
Sbjct:  247 YEEIYLSKDDDIRTIGEVVDIYRE                                     270
```

Based on this analysis, it was predicted that these proteins and their epitopes could be useful antigens for vaccines or diagnostics.

EXAMPLE 484

A DNA sequence (GBSx0521) was identified in *S. agalactiae* <SEQ ID 1547> which encodes the amino acid-sequence <SEQ ID 1548>. Analysis of this protein sequence reveals the following:

```
Possible site: 45
>>> Seems to have no N-terminal signal sequence

----- Final Results -----
            bacterial cytoplasm --- Certainty = 0.3760(Affirmative) < succ>
            bacterial membrane  --- Certainty = 0.0000(Not Clear)   < succ>
            bacterial outside   --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 485

A DNA sequence (GBSx0522) was identified in *S. agalactiae* <SEQ ID 1549> which encodes the amino acid sequence <SEQ ID 1550>. This protein is predicted to be integrase (ripX). Analysis of this protein sequence reveals the following:

```
Possible site: 20
>>> Seems to have no N-terminal signal sequence

----- Final Results -----
            bacterial cytoplasm --- Certainty = 0.2719(Affirmative) < succ>
            bacterial membrane  --- Certainty = 0.0000(Not Clear)   < succ>
            bacterial outside   --- Certainty = 0.0000(Not Clear)   < succ>
```

The protein has homology with the following sequences in the GENPEPT database:

```
>GP: CAB96616 GB: AJ400629 integrase [Streptococcus pneumoniae
bacteriophage MM1]
Identities = 36/59 (61%), Positives = 48/59 (81%), Gaps = 1/59 (1%)
Query:   2 KIYGDYHTHLFRHSHISFLAEKGIPLNAIMDRVGHSDPKTTLSIYSHTTVNMKE-IINK  59
           KI  +  +H+FRHSHISFLAE G+P+ +IMDRVGHS+ K TL IYSHTT +M++ ++NK
Sbjct: 312 KIEKNLSSHIFRHSHISFLAESGLPIKSIMDRVGHSNAKMTLEIYSHTTEDMEDKLVNK 370
```

A related DNA sequence was identified in *S. pyogenes* <SEQ ID 1551> which encodes the amino acid sequence <SEQ ID 1552>. Analysis of this protein sequence reveals the following:

```
Possible site: 20
>>> Seems to have no N-terminal signal sequence

----- Final Results -----
            bacterial cytoplasm --- Certainty = 0.2719(Affirmative) < succ>
            bacterial membrane  --- Certainty = 0.0000(Not Clear)   < succ>
            bacterial outside   --- Certainty = 0.0000(Not Clear)   < succ>
```

An alignment of the GAS and GBS proteins is shown below:

```
Identities = 63/71 (88%), Positives = 66/71 (92%)

Query:   1 MKIYGDYHTHLFRHSHISFLAEKGIPLNAIMDRVGHSDPKTTLSIYSHTTVNMKEIINKQ  60
           +KIYGDYHTHLFRHSHISFLAEKGIPLNAIMDRVGHSDPKTTLSIYSHTTVNMKEIINKQ
Sbjct:   1 LKIYGDYHTHLFRHSHISFLAEKGIPLNAIMDRVGHSDPKTTLSIYSHTTVNMKEIINKQ  60

Query:  61 TAPFVPLLKSE  71
           T PF +K   +
Sbjct:  61 TDPFKTGIKQK  71
```

Based on this analysis, it was predicted that these proteins and their epitopes could be useful antigens for vaccines or diagnostics.

EXAMPLE 486

A DNA sequence (GBSx0523) was identified in *S. agalactiae* <SEQ ID 1553> which encodes the amino acid sequence <SEQ ID 1554>. This protein is predicted to be 50S ribosomal protein L19 (rplS). Analysis of this protein sequence reveals the following:

```
Possible site: 54
>>> Seems to have no N-terminal signal sequence

----- Final Results -----
          bacterial cytoplasm --- Certainty = 0.3331(Affirmative) < succ>
          bacterial membrane  --- Certainty = 0.0000(Not Clear)   < succ>
          bacterial outside   --- Certainty = 0.0000(Not Clear)   < succ>
```

A related GBS nucleic acid sequence <SEQ ID 9641> which encodes amino acid sequence <SEQ ID 9642> was also identified.

The protein has homology with the following sequences in the GENPEPT database:

```
>GP: AAC01534 GB: U88973 ribosomal protein L19
[Streptococcus thermophilus]
Identities = 110/115 (95%), Positives = 112/115 (96%)

Query:  25 MNPLIQSLTEGQLRSDIPEFRAGDTVRVHAKVVEGTRERIQIFEGVVISRKGQGISEMYT  84
           MNPLIQSLTEGQLR+DIP FR GDTVRVHAKVVEGTRERIQIFEGVVISRKGQGISEMYT
Sbjct:   1 MNPLIQSLTEGQLRTDIPSFRPGDTVRVHAKVVEGTRERIQIFEGVVISRKGQGISEMYT  60

Query:  85 VRKISGGIGVERTFPIHTPRVDKIEVVRYGKVRRAKLYYLRALQGKAARIKEIRR  139
           VRKIS GIGVERTFPIHTPRVDKIEVVRYGKVRRAKLYYLRALQGKAARIKEIR+
Sbjct:  61 VRKISSGIGVERTFPIHTPRVDKIEVVRYGKVRRAKLYYLRALQGKAARIKEIRK  115
```

A related DNA sequence was identified in *S. pyogenes* <SEQ ID 1555> which encodes the amino acid sequence <SEQ ID 1556>. Analysis of this protein sequence reveals the following:

```
Possible site: 15
>>> Seems to have no N-terminal signal sequence

----- Final Results -----
          bacterial cytoplasm --- Certainty = 0.4849(Affirmative) < succ>
          bacterial membrane  --- Certainty = 0.0000(Not Clear)   < succ>
          bacterial outside   --- Certainty = 0.0000(Not Clear)   < succ>
```

An alignment of the GAS and GBS proteins is shown below:

```
Identities = 111/115 (96%), Positives = 113/115 (97%)

Query:  25 MNPLIQSLTEGQLRSDIPEFRAGDTVRVHAKVVEGTRERIQIFEGVVISRKGQGISEMYT  84
           MNPLIQSLTEGQLRSDIP FR GDTVRVHAKVVEGTRERIQIFEGVVISRKGQGISEMYT
```

```
                              -continued
Sbjct:   1 MNPLIQSLTEGQLRSDIPNFRPGDTVRVHAKVVEGTRERIQIFEGVVISRKGQGISEMYT   60

Query:  85 VRKISGGIGVERTFPIHTPRVDKIEVVRYGKVRRAKLYYLRALQGKAARIKEIRR      139
           VRKISGGIGVERTFPIHTPRVDKIEV+R+GKVRRAKLYYLRALQGKAARIKEIRR
Sbjct:  61 VRKISGGIGVERTFPIHTPRVDKIEVIRHGKVRRAKLYYLRALQGKAARIKEIRR      115
```

Based on this analysis, it was predicted that these proteins and their epitopes could be useful antigens for vaccines or diagnostics.

EXAMPLE 487

A DNA sequence (GBSx0524) was identified in *S. agalactiae* <SEQ ID 1557> which encodes the amino acid sequence <SEQ ID 1558>. This protein is predicted to be ISL2 protein. Analysis of this protein sequence reveals the following:

```
Possible site: 58
>>> Seems to have an uncleavable N-term signal seq

----- Final Results -----
             bacterial membrane --- Certainty = 0.0000(Not Clear) < succ>
              bacterial outside --- Certainty = 0.0000(Not Clear) < succ>
            bacterial cytoplasm --- Certainty = 0.0000(Not Clear) < succ>
```

The protein has homology with the following sequences in the GENPEPT database:

```
>GP: CAC18596 GB: AJ278419 IS1381 transposase [Streptococcus pneumoniae]
Identities = 111/129 (86%), Positives = 117/129 (90%)
Query:   1 MKAQAIVTSQGRIVSLDIAVNYCHDMKLFKMSRRNIGQAAKILADSGYQGIMKNYSQAQT   60
           MK QAIVTSQGRIVSLDI VNYCHDMKLFKMSRRNIGQA KILADSGYQG+MK+Y QAQT
Sbjct:   1 MKTQAIVTSQGRIVSLDITVNYCHDMKLFKMSRRNIGQAGKILADSGYQGLMKIYPQAQT   60

Query:  61 PRKSSKLKPLTLEDKTYNHTLSKERIKVENIFAKVKTFKIFSTTYRNRRKRFGLRMNLIA  120
           RKSSKLKPLT+EDK  NH LSKER KVENIFAKVKTFK+FSTTYR+ RKRFGLRMNL A
Sbjct:  61 SRKSSKLKPLTVEDKACNHALSKERSKVENIFAKVKTFKMFSTTYRSHRKRFGLRMNLSA  120

Query: 121 GMINRELGF                                                    129
           G+IN ELGF
Sbjct: 121 GIINHELGF                                                    129
```

No corresponding DNA sequence was identified in *S. pyogenes*.

Based on this analysis, it was predicted that this protein and its epitopes, could be useful antigens for vaccines or diagnostics.

EXAMPLE 488

A DNA sequence (GBSx0526) was identified in *S. agalactiae* <SEQ ID 1559> which encodes the amino acid sequence <SEQ ID 1560>. Analysis of this protein sequence reveals the following:

```
Possible site: 61
>>> Seems to have an uncleavable N-term signal seq
     INTEGRAL   Likelihood = -10.99   Transmembrane    81-97    (67-107)
     INTEGRAL   Likelihood =  -6.32   Transmembrane     8-24     (6-25)
     INTEGRAL   Likelihood =  -2.76   Transmembrane   120-136  (120-136)

----- Final Results -----
             bacterial membrane --- Certainty = 0.5394(Affirmative) < succ>
              bacterial outside --- Certainty = 0.0000(Not Clear)   < succ>
            bacterial cytoplasm --- Certainty = 0.0000(Not Clear)   < succ>
```

The protein has homology with the following sequences in the GENPEPT database:

```
>GP: BAB04382 GB: AP001509 unknown conserved protein in others
        [Bacillus halodurans]
 Identities = 53/150 (35%), Positives = 82/150 (54%), Gaps = 1/150 (0%)
Query:   1 MLNPYKRIFTLGLLATFLLFIFHFGRYSGLGTNLIEASFTNKNLYDYDWLLKLCLTVITL    60
           M N   R F  GL+    L +I      Y+G G +++E SFT +++   Y +L KL   T +T+
Sbjct: 251 MKNHTVRAFVGGLIIVALTYIIGSYDYNGRGLDMLEDSFT-QDVPPYAFLAKLVFTAVTM   309

Query:  61 AAGYQGGEVTPLFAIGASLGVIIAPILGLPVILVAALGYTSVFGSATNTLLGPILIGGEV   120
              G+ GGE  PLF +GA+LG +   + LP+ +AALG    FG   NT +   L+G E+
Sbjct: 310 GMGFVGGEAIPLFFVGATLGNTLHAFIDLPLSFLAALGMIVTFGGGANTPIAAFLLGVEM   369

Query: 121 FGFANTPYFVIVCLVAYSISHAHTIYGAQS                                150
           F      +F + CL +Y  S  H ++ +Q+
Sbjct: 370 FNGKGIEFFFVACLTSYLFSGHHGLNPSQT                                399
```

A related DNA sequence was identified in *S. pyogenes* <SEQ ID 1561> which encodes the amino acid sequence <SEQ ID 1562>. Analysis of this protein sequence reveals the following:

```
Possible site: 35
>>> Seems to have no N-terminal signal sequence
    INTEGRAL    Likelihood = -11.99    Transmembrane    56-72    (53-76)
    INTEGRAL    Likelihood =  -7.17    Transmembrane   337-353  (327-355)
    INTEGRAL    Likelihood =  -6.74    Transmembrane   264-280  (260-282)
    INTEGRAL    Likelihood =  -6.16    Transmembrane   167-183  (161-187)
    INTEGRAL    Likelihood =  -5.26    Transmembrane   223-239  (217-242)
    INTEGRAL    Likelihood =  -5.10    Transmembrane    20-36    (19-42)
    INTEGRAL    Likelihood =  -0.37    Transmembrane   102-118  (102-119)
    INTEGRAL    Likelihood =  -0.16    Transmembrane   300-316  (300-316)

----- Final Results -----
         bacterial membrane --- Certainty = 0.5798(Affirmative) < succ>
          bacterial outside --- Certainty = 0.0000(Not Clear)  < succ>
        bacterial cytoplasm --- Certainty = 0.0000(Not Clear)  < succ>
```

The protein has homology with the following sequences in the databases:

```
>GP: BAB04382 GB: AP001509 unknown conserved protein in others
        [Bacillus halodurans]
Identities = 129/397 (32%), Positives = 210/397 (52%), Gaps = 14/397 (3%)
Query:  20 VLGLVGLALPIGGAVGVVDVIFGKGLLFLSEYRDHHLFLLLPFLALAGLVIVFLYDKLG-    78
           +L +   + IG  VG   +       L E R++  + +L FL LAGL + +LY K G
Sbjct:   9 LLTWIFFGIMIGAIVGSATALLLTVNDHLGETRENRPWFVL-FLPLAGLALGYLYMKAGT    67

Query:  79 ---KEVRQGMGLVFQVGHGQKNQIPPMLIPLILFSTWVTHLFGASAGREGVAVQIGATIS   135
              E+ +G   LV +    G K ++    L PL+   T++T LFG S GREG A+Q+G +++
Sbjct:  68 SAGNELYKGNNLVIESVQG-KGKMLLRLGPLVYLGTFMTILFGGSTGREGAAIQMGGSVA   126

Query: 136 HYCRR-FVTSQEAARHLLIMGMAAGFAGLFQTPIAAVVFALEVLLVGTLRYSALLPSLVA   194
             + F        R LL+ G++AGF    F TPI A +F +E+   +G L++    AL+P LVA
Sbjct: 127 EAVNKLFKVKLIDTRILLMGGISAGFGAAFGTPITAAIFGMEMASLGRLKFEALVPCLVA   186

Query: 195 AYVASWTSHALG-LEKFTIVLEETLTITPLTLVKLIGLGLIFGLVGNSFAYLL-GWFKPY   252
             ++V +T+     +E         ++ LT  K+I L ++F LV    +  L  G    K
Sbjct: 187 SFVGHYTTEKFWHVEHEKFIIATVPEVSALTFSKVILLAIVFSLVSVLYCQLRHGIHKLS   246

Query: 253 LSQKLPNPYFRIAFIGALLSICL--MIGHVGRYSGLGTNLIAAAFSGQTILTYDWLLKMI   310
             + N   R AF+G L+ + L   +IG     Y+G G +++   +F+ Q   Y +L K++
Sbjct: 247 EKYTMKNHTVR-AFVGGLIIVALTYIIGSYD-YNGRGLDMLEDSFT-QDVPPYAFLAKLV   303

Query: 311 VTVISLSAGFQGGEVTPLFAIGASLGIVLAPYLGLPVLLVAALGYTTVFGSATNTFWAPI   370
            T +++   GF GGE  PLF +GA+LG  L  ++ LP+ +AALG     FG   NT  A
Sbjct: 304 FTAVTMGMGFVGGEAIPLFFVGATLGNTLHAFIDLPLSFLAALGMIVTFGGGANTPIAAF   363

Query: 371 FIGIEVFGPENALAYFVTSAAAYMVSHRHSIYSYQKV                         407
           +G+E+F   +      +FV    +Y+ S  H ++ Q +
Sbjct: 364 LLGVEMFNGKGIEFFFVACLTSYLFSGHHGLWPSQTI                         400
```

65

An alignment of the GAS and GBS proteins is shown below:

```
Identities = 91/147 (61%), Positives = 111/147 (74%)

Query:     3 NPYKRIFTLGLLATFLLFIFHFGRYSGLGTNLIEASFTNKNLYDYDWLLKLCLTVITLAA    62
             NPY RI  +G L +  L I H GRYSGLGTNLI A+F+ + +  YDWLLK+ +TVI+L+A
Sbjct:   259 NPYFRIAFIGALLSICLMIGHVGRYSGLGTNLIAAAFSGQTILTYDWLLKMIVTVISLSA   318

Query:    63 GYQGGEVTPLFAIGASLGVIIAPILGLPVILVAALGYTSVFGSATNTLLGPILIGGEVFG   122
             G+QGGEVTPLFAIGASLG+++AP LGLPV+LVAALGYT+VFGSATNT   PI IG EVFG
Sbjct:   319 GFQGGEVTPLFAIGASLGIVLAPYLGLPVLLVAALGYTTVFGSATNTFWAPIFIGIEVFG   378

Query:   123 FANTPYFVIVCLVAYSISHAHTIYGAQ                                   149
             N  + +     AY +SH H+IY  Q
Sbjct:   379 PENALAYFVTSAAAYMVSHRHSIYSYQ                                   405
```

Based on this analysis, it was predicted that these proteins and their epitopes could be useful antigens for vaccines or diagnostics.

EXAMPLE 489

A DNA sequence (GBSx0527) was identified in *S. agalactiae* <SEQ ID 1563> which encodes the amino acid sequence <SEQ ID 1564>. Analysis of this protein sequence reveals the following:

```
Possible site: 27
>>> Seems to have a cleavable N-term signal seq.
      INTEGRAL      Likelihood = -8.65    Transmembrane     47-63 (45-70)
      INTEGRAL      Likelihood = -5.04    Transmembrane   219-235 (208-237)
      INTEGRAL      Likelihood = -3.35    Transmembrane   168-184 (168-187)
      INTEGRAL      Likelihood = -0.48    Transmembrane   141-157 (141-157)

----- Final Results -----
             bacterial membrane --- Certainty = 0.4461(Affirmative) < succ>
             bacterial outside  --- Certainty = 0.0000(Not Clear)   < succ>
           bacterial cytoplasm  --- Certainty = 0.0000(Not Clear)   < succ>
```

A related GBS nucleic acid sequence <SEQ ID 9317> which encodes amino acid sequence <SEQ ID 9318> was also identified.

The protein has homology with the following sequences in the GENPEPT database:

```
>GP: BAB04382 GB: AP001509 unknown conserved protein in others
[Bacillus halodurans]
Identities = 75/223 (33%), Positives = 119/223 (52%), Gaps = 18/223 (8%)

Query:    17 FSLLIGGVVGAITAVFGRVLLFLTAFRSDYIAYLLPFLSIVGLFIVFVYQKFGGKS----    72
             F ++IG +VG+ TA+  V  L   R +    ++L FL + GL + ++Y K G   +
Sbjct:    15 FGIMIGAIVGSATALLLTVNDHLGETRENRPWFVL-FLPLAGLALGYLYMKAGTSAGNEL   73

Query:    73 VKGMGLVFEVGHGNEETIPKRLVPLVILTTWLTHLFGGSAGREGVAVQIGATVSHYFQKY   132
              KG  LV E   G + +   RL PLV L T++T LFGGS GREG A+Q+G +V+      K
Sbjct:    74 YKGNNLVIESVQGKGKML-LRLGPLVYLGTFMTILFGGSTGREGAAIQMGGSVAEAVNKL   132

Query:   133 CRLQNASQLFLVM-GMAAGFAGLFQTPLAATFFAIEVLVVGRLMVSYVLPSLIAALTANF   191
              +++        L+M G++AGF   F TP+ A  F +E+  +GRL    ++P L+A+    ++
Sbjct:   133 FKVKLIDTRILLMGGISAGFGAAFGTPITAAIFGMEMASLGRLKFEALVPCLVASFVGHY   192

Query:   192 VSHSLGLEKFSH------SIATSMALTPDIILKLLVLGLCFGL                  228
                +    EKF H         IAT   ++      K+++L + F L
Sbjct:   193 TT-----EKFWHVEHEKFIIATVPEVSALTFSKVILLAIVFSL                  230
```

There is also homology to SEQ ID 1562.

A related GBS gene <SEQ ID 8577> and protein <SEQ ID 8578> were also identified. Analysis of this protein sequence reveals the following:

```
Lipop: Possible site: -1 Crend: 5
McG: Discrim Score: 9.66
GvH: Signal Score (-7.5): -1.12
```

```
      Possible site: 27
>>> Seems to have a cleavable N-term signal seq.
ALOM program count: 7 value: -10.99 threshold: 0.0
    INTEGRAL       Likelihood = -10.99     Transmembrane   328-344  (314-354)
    INTEGRAL       Likelihood = -8.65      Transmembrane    47-63   (45-70)
    INTEGRAL       Likelihood = -6.32      Transmembrane   255-271  (253-272)
    INTEGRAL       Likelihood = -4.41      Transmembrane   214-230  (208-238)
    INTEGRAL       Likelihood = -3.35      Transmembrane   168-184  (168-187)
    INTEGRAL       Likelihood = -2.76      Transmembrane   367-383  (367-383)
    INTEGRAL       Likelihood = -0.48      Transmembrane   141-157  (141-157)
    PERIPHERAL     Likelihood = 0.42       94
modified ALOM score: 2.70
*** Reasoning Step: 3

----- Final Results -----
              bacterial membrane --- Certainty = 0.5394(Affirmative) < succ>
                bacterial outside --- Certainty = 0.0000(Not Clear)   < succ>
              bacterial cytoplasm --- Certainty = 0.0000(Not Clear)   < succ>
```

The protein has homology with the following sequences in the databases:

```
ORF01989(349-1491 of 1794)
GP|4512350|dbj|BAA75315.1||AB011836(15-399 of 424) similar to Bordetella
paraperlussis transposase for insertion sequence element(27%-identity) {Bacillus
halodurans} PIR|T44296|T44296 hypothetical protein [imported] - Bacillus halodurans
% Match = 15.4
% Identity = 33.4  % Similarity = 54.7
Matches = 129  Mismatches = 167  Conservative Sub.s = 82
222         252         282         312         342         372         402         432
MY*RKSKTINLTM*YEQLSKTL*QNLVFIKRRIL*TVIKRFDNYAQYVLVLGFSLLIGGVVGAITAVFGRVLLFLTAFRS
                                                       | ::|| :||: ||:: |   |   |
                                       MNKTFWLTLLTWIFFGIMIGAIVGSATALLLTVNDHLGETRE
                                            10         20         30         40

462         492         513         540         570         600         630         660
DYIAYLLPFLSIVGLFIVFVYQKFG---GKSV-KGMGLVFEVGHGNEETIPKRLVPLVILTTWLTHLFGGSAGFEGVAVQ
:   ::| || : ||  : ::|    | ||   | || ||   |  ||  | :: || |||| |||| ||| | ||| |
NRPWFVL-FLPLAGLALGYLYMKAGTSAGNELYKGNNLVIESVQG-KGKMLLRLGPLVYLGTFMTILFGGSTGREGAAIQ
            60         70         80         90         100        110         120

690         720         747         777         807         837         867         894
IGATVSHYFQKYCRLQNASQLFLVMG-MAAGFAGLFQTPLAATFFAIEVLVVGRLMVSYVLPSLIAALTANFVSHSL-GL
:| |:|:     |   | :  :::|   |::|   | :||   | |||   ::|||    ::|   |  | ::  :   :
MGGSVAEAVNKLFKVKLIDTRILLMGGISAGFGAAFGTPITAAIFGMEMASLGRLKFEALVPCLVASFVGHYTTEKFWHV
           130         140         150         160         170        180         190         200

924         954         984         1014        1041        1071        1101        1131
EKFSHSIATSMALTPDIILKLLVLGLCFGLCGNLFAYLLAKA-KLIASSRLLNPYKRIFTLGLLATFLLFIFHFGRYSGL
|     |||       |:::|      |     |       |     | ||    |  ||| ::  || :   |    |:|
EHEKFIIATVPEVSALTFSKVILLAIVFSLVSVLYCQLRHGIHKLSEKYTMKNHTVRAFVGGLIIVALTYIIGSYDYNGR
           210         220         230         240         250        260         270         280

1161        1191        1221        1251        1281        1311        1341        1371
GTNLIEASFTNKNLYDYDWLLKLCLTVITLAAGYQGGEVTPLFAIGASLGVIIAPILGLPVILVAALGYTSVFGSATNTL
|  :::| |||  :::    :  |: |   |: |:|  |  |||  ||||     ::  |  ::: ::|||    || ||
GLDMLEDSFT-QDVPPYAFLAKLVFTAVTMGMGFVGGEAIPLFFVGATLGNTLHAFIDLPLSFLAALGMIVTFGGGANTP
           290         300         310         320         330        340         350

1401        1431        1461        1491        1521        1551        1581        1611
LGPILIGGEVFGFANTPYFVIVCLVAYSISHAHTIYGAQSR*LVMSFKRVYQFVERNIPFSFLFS*SL*KWSLSIL*MQK
:    |:| |:|          :|: || ::| |   :: :        :: :|:
IAAFLLGVEMFNGKGIEFFFVACLTSYLFSGHHGLWPSQTIYEPKSRLYGVRKGETIKRTEEMKE
           370         380         390         400         410        420
```

Based on this analysis, it was predicted that these proteins and their epitopes could be useful antigens for vaccines or diagnostics.

EXAMPLE 490

A DNA sequence (GBSx0528) was identified in *S. agalactiae* <SEQ ID 1565> which encodes the amino acid sequence <SEQ ID 1566>. Analysis of this protein sequence reveals the following:

```
Possible site: 33
>>> Seems to have no N-terminal signal sequence
```

-continued

```
----- Final Results -----
          bacterial cytoplasm --- Certainty = 0.3568(Affirmative) < succ>
           bacterial membrane --- Certainty = 0.0000(Not Clear)   < succ>
            bacterial outside --- Certainty = 0.0000(Not Clear)   < succ>
```

The protein has homology with the following sequences in the GENPEPT database:

```
>GP: AAB98234 GB: U67480 chorismate mutase/prephenate dehydratase
       (pheA) [Methanococcus jannaschii]
 Identities = 26/85 (30%), Positives = 46/85 (53%), Gaps = 1/85 (1%)
Query:  2 ELEEIRQEIDEIDQQLVSLLETRMGLILEVIAFKKKHRLPVLDNNRENEVLNNVLKKVQN 61
          +L EIR++IDEID +++ L+  R  L  +V   K +  +P+ D  RE  + + + K  +
Sbjct:  4 KLAEIRKKIDEIDNKILKLIAERNSLAKDVAEIKNQLGIPINDPEREKYIYDRIRKLCKE 63

Query: 62 HQFDDVIRATFKDIMTE-SRVYQKE                                    85
          H  D+ I      I+ E ++  QK+
Sbjct: 64 HNVDENIGIKIFQILIEHNKALQKQ                                    88
```

A related DNA sequence was identified in *S. pyogenes* <SEQ ID 1567> which encodes the amino acid sequence <SEQ ID 1568>. Analysis of this protein sequence reveals the following:

```
Possible site: 37
>>> Seems to have no N-terminal signal sequence

----- Final Results -----
          bacterial cytoplasm --- Certainty = 0.2356(Affirmative) < succ>
           bacterial membrane --- Certainty = 0.0000(Not Clear)   < succ>
            bacterial outside --- Certainty = 0.0000(Not Clear)   < succ>
```

An alignment of the GAS and GBS proteins is shown below:

```
 Identities = 45/91 (49%), Positives = 62/91 (67%)
Query:  1 MELEEIRQEIDEIDQQLVSLLETRMGLILEVIAFKKKHRLPVLDNNRENEVLNNVLKKVQ 60
          M LE+IRQEI+ ID  LV+LLE RM L+ +V A+K  + LPVLD  REN++L+ V   V+
Sbjct:  1 MRLEKIRQEINGIDHHLVALLEKRMALVEQVTAYKLANHLPVLDQARENQILDRVSYLVK 60

Query: 61 NHQFDDVIRATFKDIMTESRVYQKENIVDGD                              91
          +  F+  I   TFK IM+ SR YQ +++  GD
Sbjct: 61 DQAFEPAIHETFKTIMSLSRQYQTQHLTGGD                              91
```

Based on this analysis, it was predicted that these proteins and their epitopes could be useful antigens for vaccines or diagnostics.

EXAMPLE 491

A DNA sequence (GBSx0529) was identified in *S. agalactiae* <SEQ ID 1569> which encodes the amino acid sequence <SEQ ID 1570>. This protein is predicted to be neuramimidase. Analysis of this protein sequence reveals the following:

```
Possible site: 19
>>> Seems to have no N-terminal signal sequence
     INTEGRAL     Likelihood = -3.35      Transmembrane     28-44 (28-47)

----- Final Results -----
           bacterial membrane --- Certainty = 0.2338(Affirmative) < succ>
            bacterial outside --- Certainty = 0.0000(Not Clear)   < succ>
          bacterial cytoplasm --- Certaimty = 0.0000(Not Clear)   < succ>
```

A related GBS nucleic acid sequence <SEQ ID 10191> which encodes amino acid sequence <SEQ ID 10192> was also identified.

The protein has homology with the following sequences in the GENPEPT database:

```
>GP: CAA51473 GB: X72967 neuraminidase [Streptococcus pneumoniae]
Identities = 294/504 (58%), Positives = 380/504 (75%), Gaps = 10/504 (1%)
Query: 303 EDIKSYFQYYCHLNHQLKLPKGAILSAKTEVYRGGDFGRKNKDNVFGYRIPSLLKTEKGT 362
           E+++   Q +   + + KLP+GA L+ KT+++  G  G+ NKD +  YRIP+LLKT+KGT
Sbjct: 299 EEVQKRSQLFKRSDLEKKLPEGAALTEKTDIFESGRNGKPNKDGIKSYRIPALLKTDKGT 358

Query: 363 LLVGADERIEQACDWGNIGMVIRRSEDDGVTWGKRETIVNLRNNPRVPLVTSGDYSGSPI 422
           L+ GADER   + DWG+IGMVIRRSED+G TWG R TI NLR+NP+      S    GSP+
Sbjct: 359 LIAGADERRLHSSDWGDIGMVIRRSEDNGKTWGDRVTITNLRDNPKA----SDPSIGSPV 414

Query: 423 NMDMALVQDTSSKTKRIFSIYDMFPEGRGVISIANTPEKEYTQIGGQSYLNLYNNGKKSK 482
           N+DM LVQD   +TKRIFSIYDMFPEG+G+  +++   E+ Y +I G++Y  LY  G+K
Sbjct: 415 NIDMVLVQDP--ETKRIFSIYDMFPEGKGIFGMSSQKEEAYKKIDGKTYQILYREGEKG- 471

Query: 483 VFTIRDKGIVYNFKGKKTDYHVITETTKSDHSNLGDIYKGKQLLGNIYFTKHKTSPFRLA 542
            +TIR+ G VY    GK TDY V+ +  K  +S+ GD+YKG QLLGNIYFT +KTSPFR+A
Sbjct: 472 AYTIRENGTVYTPDGKATDYRVVVDPVKPAYSDKGDLYKGNQLLGNIYFTTNKTSPFRIA 531

Query: 543 KSSYVWMSYSDDDGRTWSSPRDITASLRQKGMKFLGIGPGKGIVLKWGPHAGRIIIPAYS 602
           K SY+WMSYSDDDG+TWS+P+DIT  ++    MKFLG+GPG GIVL+ GPH GRI+IP Y+
Sbjct: 532 KDSYLWMSYSDDDGKTWSAPQDITPMVKADWMKFLGVGPGTGIVLRNGPHKGRILIPVYT 591

Query: 603 TNWKSHLRGSQSSRLIYSDDHGKTWHTGKAVNDNRILSNGEKIHSLTMDNKKEQNTESVP 662
           TN   SHL GSQSSR+IYSDDHGKTWH G+AVNDNR +  +G+KIHS TM+N++ QNTES
Sbjct: 592 TNNVSHLNGSQSSRIIYSDDHGKTWHAGEAVNDNRQV-DGQKIHSSTMNNRRAQNTESTV 650

Query: 663 VQLKNGDIKLFMRNLTGNLEVATSKDGGETWQNHVKRYKEVHDAYVQLSAIRFEHDKKEY 722
           VQL NGD+KLFMR LTG+L+VATSKDGG TW+  +KRY +V D YVQ+SAI   H+ KEY
Sbjct: 651 VQLNNGDVKLFMRGLTGDLQVATSKDGGVTWEKDIKRYPQVKDVYVQMSAIHTMHEGKEY 710

Query: 723 ILLVNANGPGKKRQDGYARLAQVNRNGSFKWLYHHHIQDGSFAYNSVQQLNNDKFGVLYE 782
           I+L NA GP   KR++G    LA+V  NG   WL H+ IQ G FAYNS+Q+L N ++G+LYE
Sbjct: 711 IILSNAGGP--KRENGMVHLARVEENGELTWLKHNPIQKGEFAYNSLQELGNGEYGILYE 768

Query: 783 HREKHQNSFTLNYKVFNWSFLSQN                                    806
           H EK QN++TL+++ FNW FLS++
Sbjct: 769 HTEKGQNAYTLSFRKFNWDFLSKD                                    792
```

No corresponding DNA sequence was identified in *S. pyogenes*.

Based on this analysis, it was predicted that these proteins and their epitopes could be useful antigens for vaccines or diagnostics.

EXAMPLE 492

A DNA sequence (GBSx0530) was identified in *S. agalactiae* <SEQ ID 1571> which encodes the amino acid sequence <SEQ ID 1572>. This protein is predicted to be unnamed protein product (gatC). Analysis of this protein sequence reveals the following:

```
Possible site: 34
>>> Seems to have an uncleavable N-term signal seq
    INTEGRAL   Likelihood = -12.63   Transmembrane   154-170   (149-178)
    INTEGRAL   Likelihood = -11.99   Transmembrane   103-119   (98-123)
    INTEGRAL   Likelihood =  -7.91   Transmembrane    21-37    (14-40)
    INTEGRAL   Likelihood =  -6.53   Transmembrane   448-464   (444-467)
    INTEGRAL   Likelihood =  -5.89   Transmembrane    47-63    (45-68)
    INTEGRAL   Likelihood =  -5.10   Transmembrane   356-372   (352-373)
    INTEGRAL   Likelihood =  -4.78   Transmembrane   330-346   (328-350)
    INTEGRAL   Likelihood =  -4.41   Transmembrane   376-392   (375-393)
    INTEGRAL   Likelihood =  -3.72   Transmembrane   243-259   (235-266)
    INTEGRAL   Likelihood =  -2.55   Transmembrane   277-293   (275-293)

----- Final Results -----
          bacterial membrane --- Certainty = 0.6052(Affirmative) < succ>
          bacterial outside  --- Certainty = 0.0000(Not Clear)   < succ>
          bacterial cytoplasm --- Certainty = 0.0000(Not Clear)  < succ>
```

A related DNA sequence was identified in *S. pyogenes* <SEQ ID 1573> which encodes the amino acid sequence <SEQ ID 1574>. Analysis of this protein sequence reveals the following:

```
Possible site: 35
>>> Seems to have an uncleavable N-term signal seq
     INTEGRAL     Likelihood = -12.31    Transmembrane   154-170  (150-179)
     INTEGRAL     Likelihood = -11.68    Transmembrane   104-120  (99-124)
     INTEGRAL     Likelihood =  -9.82    Transmembrane   447-463  (442-469)
     INTEGRAL     Likelihood =  -7.91    Transmembrane    22-38   (11-41)
     INTEGRAL     Likelihood =  -7.11    Transmembrane   377-393  (375-403)
     INTEGRAL     Likelihood =  -5.89    Transmembrane    48-64   (46-69)
     INTEGRAL     Likelihood =  -4.78    Transmembrane   331-347  (329-351)
     INTEGRAL     Likelihood =  -3.88    Transmembrane   357-373  (353-373)
     INTEGRAL     Likelihood =  -2.55    Transmembrane   278-294  (276-294)
     INTEGRAL     Likelihood =  -1.22    Transmembrane   240-256  (240-257)

----- Final Results -----
             bacterial membrane --- Certainty = 0.5925(Affirmative) < succ>
              bacterial outside --- Certainty = 0.0000(Not Clear)   < succ>
            bacterial cytoplasm --- Certainty = 0.0000(Not Clear)   < succ>
```

An alignment of the GAS and GBS proteins is shown below:

```
Identities = 419/482 (86%) , Positives = 447/482 (91%)
Query:   1 MQVFLNIVNKFFDPIIHMGSGVVMLIVMTGLAMIFGVKFSKALEGGIKLAIALTGIGAII   60
           MQ FL+I+NK     I +GSGVVMLIVMTGLAMIFGVKF+KALEGGIKLAIALTGIGAII
Sbjct:   2 MQPFLDIINKILGFPIQLGSGVVMLIVMTGLAMIFGVKFTKALEGGIKLAIALTGIGAII   61

Query:  61 GILTGAFSESLQAFVKNTGINLSIIDVGWAPLATITWGSPYTLYFLLIMLIVNIVMIVMK  120
           GILTGAFSESLQAFVKNTGI+L+IIDVGWAPLATITWGSPYTLYFLL+ML+VNIVMIVMK
Sbjct:  62 GILTGAFSESLQAFVKNTGISLNIIDVGWAPLATITWGSPYTLYFLLVMLVVNIVMIVMK  121

Query: 121 KTDTLDVDIFDIWHLSITGLLIMWYAKKNNLPTLLSVIIATVAIIFVGVLKIINSDLMKP  180
           KTDTLDVDIFDIWHLSITGLLIMWYA +N+LP  +S++IATVA+I VGVLKIINSDLMKP
Sbjct: 122 KTDTLDVDIFDIWHLSITGLLIMWYAARNHLPVFVSLLIATVAVILVGVLKIINSDLMKP  181

Query: 181 TFDDLLGTGPTSPMTSTHMNYMMNPIIMVLDKLFDKVFPGLDKYDFDAAKLNKAIGFWGS  240
           TFDDLLGTGP SPMTSTHMNYMMNPIIMVLDK+FDKVFPGLDKYDFDAAKLNK IGFWGS
Sbjct: 182 TFDDLLGTGPQSPMTSTHMNYMMNPIIMVLDKIFDKVFPGLDKYDFDAAKLNKKIGFWGS  241

Query: 241 KFFIGMILGLVIGIMGNPVFSFAALGGWFSLGFTAGACLELFSLIGSWFIAAVEPLSQGI  300
           KFFIGM LG VIGIMG+P F+  ++  WF LGFTAGACLELFSLIGSWFIAAVEPLSQGI
Sbjct: 242 KFFIGMALGFVIGIMGDPHFTVESIKNWFGLGFTAGACLELFSLIGSWFIAAVEPLSQGI  301

Query: 301 TNFANGKMHGRRFNIGLDWPFIAGRAEIWACANILAPIMLVEAILLSKVGNGILPLAGII  360
           TNFAN +MHGRRFNIGLDWPFIAGRAEIWACANILAPIML+EA+LLSKVGNGILPLAGII
Sbjct: 302 TNFANARMHGRRFNIGLDWPFIAGRAEIWACANILAPIMLIEAVLLSKVGNGILPLAGII  361

Query: 361 AMGVTPALLVVTRGRLIRMITFGTLLLPLFLLSGTMIAPFATELAKKVGAFPAGARAGSL  420
           AMG+TPALLVVTRGRLIRMI FG+LLLPLFLLSGTMIAPFATELAKKVGAFPAG  AGSL
Sbjct: 362 AMGMTPALLVVTRGRLIRMIIFGSLLLPLFLLSGTMIAPFATELAKKVGAFPAGTSAGSL  421

Query: 421 ITHSTLEGPMEKIFGYVIGKATTGQLSAIITLIIFATAYLGLFMWYAKQMKRRNAEYAAN  480
           ITHSTLEGPMEKIFGYVIG+ATTGQ+++IITLIIF   YL LF WYA QMK RNAEYA
Sbjct: 422 ITHSTLEGPMEKIFGYVIGQATTGQIASIITLIIFVAIYLSLFAWYANQMKARNAEYAKT  481

Query: 481 QK                                                            482
           K
Sbjct: 482 MK                                                            483
```

A related GBS gene <SEQ ID 8579> and protein <SEQ ID 8580> were also identified. Analysis of this protein sequence reveals the following:

```
Lipop: Possible site: -1 Crend: 9
McG: Discrim Score: 4.31
GvH: Signal Score (-7.5): -2.64
     Possible site: 34
>>> Seems to have an uncleavable N-term signal seq
ALOM program count: 6 value: -12.63 threshold: 0.0
    INTEGRAL     Likelihood = -12.63    Transmembrane   154-170  (149-178)
    INTEGRAL     Likelihood = -11.99    Transmembrane   103-119  (98-123)
```

```
    INTEGRAL        Likelihood = -7.91      Transmembrane      21-37    (14-40)
    INTEGRAL        Likelihood = -5.89      Transmembrane      47-63    (45-68)
    INTEGRAL        Likelihood = -4.88      Transmembrane     243-259  (235-265)
    INTEGRAL        Likelihood = -1.22      Transmembrane     268-284  (268-284)
    PERIPHERAL      Likelihood =  0.85          127
modified ALOM score: 3.03

*** Reasoning Step: 3

----- Final Results -----
               bacterial membrane  --- Certainty = 0.6052(Affirmative) < succ>
                bacterial outside  --- Certainty = 0.0000(Not Clear)   < succ>
              bacterial cytoplasm  --- Certainty = 0.0000(Not Clear)   < succ>
```

The protein has homology with the following sequences in the databases:

```
ORF00838(343-1122 of 1455)
EGAD|91348|EC2092(9-344 of 451) PTS system, galactitol specific IIC component
{Escherichia coli} OMNI|NT01EC2494 PTS system galactitol-specific enzyme IIC
component SP|P37189|PTKC_ECOLI PTS SYSTEM, GALACTITOL-SPECIFIC IIC COMPONENT
(EIIC-GAT) (GALACTICOL- PERMEASE IIC COMPONENT) (PHOSPHOTRANSFERASE ENZYME II,
C COMPONENT). GP|1736809|dbj|BAA15955.1||D90847 PTS system, Galactitol-specific
IIC component (EIIC-GAT) (Galactitol-permase IIC component) (Phosphotransferase
enzyme II, C component). {Escherichia coli} GP|17884
% Match = 10.9
% Identity = 29.8   % Similarity = 59.2
Matches = 68   Mismatches = 88   Conservative Sub.s = 67
     282       312       342       372       402       432       462       492
LS*HI*NWN*S*RRRNMQVFLNIVNKFFDPIIHMGSGVVMLIVMTGLAMIFGVKFSKALEGGIKLAIALTGIGAIIGILT
                                   |: :|   |::  ||:   ::  |:|:|    ::  :  |  :  ||| :||::
                       MFSEVMRYILDLGPTVMLPIVIIIFSKILGMKAGDCFKAGLHIGIGFVGIGLVIGLML
                           10        20        30        40        50

522       552       582       612       642       672       702
GAFSESLQAFVKNTGINLSIIDVGWAPLATITWGSPYTLYFLLIMLIVNIVMIVMKKTDTLDVDIFDIWHLSITGLLIM-
  :    : :|   :|  ::||||   : :||  |      |  ::||: |::  :    ::|||::|||::  || |:
DSIGPAAKAMAENFDLNLHVVDVGWPGSSPMTWASQIALVAIPIAILVNVAMLLTRMTRVVNVDIWNIWHMTFTGALLHL
    70        80        90       100       110       120       130

747       774       804       834       864       894
-----------------------WYAKKN-NLPTLLSVIIATVAIIFGVLKIINSDLMKPTFDDLLGTGPTSPMTSTH
                       |:|:    |:|    |:   :   |        ::|
ATGSWMIGMAGVVIHAAFVYKLGDWFARDTRNFFELEGIAIPHGTSAYMG-----------------------------
      150       160       170       180

924       954       984      1014      1044
MNYMMNPIIMVLDKLFDKVFPGLDKYDFDAAKLNKAIGFWGSKFFIGMILGLVIXIM----------------------~~~
      ||  :::  :  :|:  ||:::  |      |  : :   |       |  ||::|||:|   |:
------PIAVLVDAIIEKI-PGVNRIKFSADDIQRKFGPFGEPVTVGFVMGLIIGILAGYDVKGVLQLAVKTAAVML~~~
         200       210       220       230       240       250

1092      1122      1152      1182      1212      1242
--------------------GNPVFSFASIRWLVFFFVLQQGACLEVGLF*LVSWVQLLQ*NHFLRKLLILLMVNAXX*
                    ||  |:   |    :   ||  :
~VVSASLIFIPLTILIAVCVPGNQVLPFGDLATIGFFVAMAVAVHRGNLFRTLISGVIIMSITLWIATQTIGLHTQLAAN
         320       330       340       350       360       370       380
```

Based on this analysis, it was predicted that these proteins and their epitopes could be useful antigens for vaccines or diagnostics.

EXAMPLE 493

A DNA sequence (GBSx0531) was identified in *S. agalactiae* <SEQ ID 1575> which encodes the amino acid sequence <SEQ ID 1576>. Analysis of this protein sequence reveals the following:

```
Possible site: 14
>>> Seems to have no N-terminal signal sequence

----- Final Results -----
              bacterial cytoplasm  --- Certainty = 0.0302(Affirmative) < succ>
               bacterial membrane  --- Certainty = 0.0000(Not Clear)   < succ>
                bacterial outside  --- Certainty = 0.0000(Not Clear)   < succ>
```

The protein has no significant homology with any sequences in the GENPEPT database.

A related DNA sequence was identified in *S. pyogenes* <SEQ ID 1577> which encodes the amino acid sequence <SEQ ID 1578>. Analysis of this protein sequence reveals the following:

```
Possible site: 14
>>> Seems to have no N-terminal signal sequence

----- Final Results -----
            bacterial cytoplasm --- Certainty = 0.0302(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below:

```
 Identities = 85/100 (85%), Positives = 96/100 (96%)
Query:  1  MIKILAACGAGVNSSHQIKDAIETQLGDRGYNVHCDAVMVKDITEEMVNKYDIFTPIAKT   60
           MIKILAACGAGVNSSHQIKDAIETQ+ DRGY+VHCDAVMVKDITEE+V++YDIFTPIAKT
Sbjct:  1  MIKILAACGAGVNSSHQIKDAIETQMSDRGYDVHCDAVMVKDITEELVSRYDIFTPIAKT   60

Query: 61  DLGFNVPIPVVEAGPILYRIPVMSEPVFTALEQVIKEHNL                      100
           DLGF +PIP+VEAGPILYRIP+MSEPVF  LE+VIKE++L
Sbjct: 61  DLGFEMPIPIVEAGPILYRIPIMSEPVFAELERVIKENHL                      100
```

Based on this analysis, it was predicted that these proteins and their epitopes could be useful antigens for vaccines or diagnostics.

EXAMPLE 494

A DNA sequence (GBSx0532) was identified in *S. agalactiae* <SEQ ID 1579> which encodes the amino acid sequence <SEQ ID 1580>. This protein is predicted to be GatA. Analysis of this protein sequence reveals the following:

```
Possible site: 15
>>> Seems to have no N-terminal signal sequence

----- Final Results -----
            bacterial cytoplasm --- Certainty = 0.2078(Affirmative) < succ>
             bacterial membrane --- Certainty = 0.0000(Not Clear)   < succ>
              bacterial outside --- Certainty = 0.0000(Not Clear)   < succ>
```

A related GBS nucleic acid sequence <SEQ ID 10193> which encodes amino acid sequence <SEQ ID 10194> was also identified.

The protein has homology with the following sequences in the GENPEPT database:

```
>GP: AAG09977 GB: AF248038 GatA [Streptococcus agalactiae]
 Identities = 39/135 (28%), Positives = 76/135 (55%), Gaps = 9/135 (6%)
Query:  16 QEELFDLVSKALIKQHYVSPNYRQAVKEREREFPTGLKIDLKDGTPIQYVAIPHTETQYC   75
           Q  L +++S+ L+++ YV   + +A+ +RE+++PTGL+++           VAIPHT ++Y
Sbjct:  20 QTNLLEVLSQYLLQKGYVKTEFSKAILQREKDYPTGLQLE------NMAVAIPHTYSEYV   73

Query:  76 LVDRIFYVKNSQPITFKHMINPEEECRVQDFFFIINSRN-SNQSDILSNLITFFITKGNL  134
           L  I+ K +PI+F  M   E+E  +   +   N   +Q+ +L+ L+T F       +
Sbjct:  74 LKPFIYINKLKEPISFIQM-GTEDEIVMARYVIVLGISNPKDQAGLLAELMTLFSNPKIV  132

Query: 135 DRLHELGDNKEKINH                                               149
           +L E    KE + +
Sbjct: 133 QQL-EMAQTKEALKN                                               146
```

A related DNA sequence was identified in *S. pyogenes* <SEQ ID 1581> which encodes the amino acid sequence <SEQ ID 1582>. Analysis of this protein sequence reveals the following:

```
Possible site: 33
>>> Seems to have no N-terminal signal sequence

----- Final Results -----
              bacterial cytoplasm --- Certainty = 0.3130(Affirmative) < succ>
               bacterial membrane --- Certainty = 0.0000(Not Clear)   < succ>
                 bacterial outside --- Certainty = 0.0000(Not Clear)   < succ>
```

An alignment of the GAS and GBS proteins is shown below:

```
 Identities = 102/154 (66%), Positives = 122/154 (78%)
Query:    4 VTQDILFIDAHSQEELFDLVSKALIKQHYVSPNYRQAVKEREREFPTGLKIDLKDGTPIQ   63
            V +ILF +A +Q ELFDLV+  L K  YV+  Y QA+ ERE  FPTGLK+DLKDG+ I
Sbjct:    1 VFPNILFTEARTQPELFDLVASHLEKVGYVTQEYHQALVEREAVFPTGLKVDLKDGSDIL   60

Query:   64 YVAIPHTETQYCLVDRIFYVKNSQPITFKHMINPEEECRVQDFFFIINSRNSNQSDILSN  123
            Y AIPHTET+YCLVD++ YV+NSQ +TFKHMINPEE+C V DFFFIINS+N  Q+ ILSN
Sbjct:   61 YAAIPHTETKYCLVDQVVYVRNSQALTFKHMINPEEDCLVTDFFFIINSQNEGQTTILSN  120

Query:  124 LITFFITKGNLDRLHELGDNKEKINHYLIEKGVF                           157
            LITFFITKGNL   L  L D+K+ I++YLIEKGVF
Sbjct:  121 LITFFITKGNLSYLASLKDDKQAISNYLIEKGVF                           154
```

Based on this analysis, it was predicted that these proteins and their epitopes could be useful antigens for vaccines or diagnostics.

EXAMPLE 495

A DNA sequence (GBSx0533) was identified in *S. agalactiae* <SEQ ID 1583> which encodes the amino acid sequence <SEQ ID 1584>. Analysis of this protein sequence reveals the following:

```
Possible site: 61
>>> Seems to have no N-terminal signal sequence

----- Final Results -----
              bacterial cytoplasm --- Certainty = 0.1429(Affirmative) < succ>
               bacterial membrane --- Certainty = 0.0000(Not Clear)   < succ>
                 bacterial outside --- Certainty = 0.0000(Not Clear)   < succ>
```

The protein has homology with the following sequences in the GENPEPT database:

```
>GP:AAA25176 GB:M60447 repressor protein [Lactococcus lactis]
Identities = 139/255 (54%), Positives = 189/255 (73%), Gaps = 6/255
 (2%)
Query:    1 MLKRERLQKIIEKVNINGIVTVNE-                                    60
            IMEELDVSDMTVRRDLDELDKAGLLIRIHGGAQKVN
            M K+ RL+KI++ + I+G +T+ EI++ELD+SDMT RRDLD L+  GLL R HG-
            GAQ ++
Sbjct:    7 MNKKRRLEKILDMLKIDGTITIREI-                                   66
            IDELDISDMTARRDLDALEADGLLTRTHGGAQLLS Query:   61 ASPTPQNYEKSNTEKYDIQTNEKLEIAQ-                               117
            FAKQFINDGETIFIGPGTTLEKLATQLLD---
            +   + EK++ EK  + T EK++IA+ A    I DG+TIFIGPGTTL +LA +L
Sbjct:   67 SK---KPLEKTHIEKKSLNTKEKIDIAKKACS-                           123
            LIKDGDTIFIGPGTTLVQLALELKGRKG Query:  118 FKIRVVTNSLPVFNILNQSSTLDLIL-                                 177
            VGGEYREITGAFVGSVTINSIKSLNFSKAFVSSN
            +KIRV+TNSLPVF ILN S T+DL+L+GGEYREITGAFVGS+    ++K++
            F+KAFV +N
Sbjct:  124 YKIRVITNSLPVFLILND-                                         183
            SETIDLLLLGGEYREITGAFVGSMASTNLKAMRFAKAFVRAN Query:  178 GVFEKSIATYDEGEGEIQRIALNNSFEK-                               237
            FLLVDSQKFGKYDFYTFYQLDDIDFVLTDHNI
             V   SIATY + EG IQ++ALNN+ EKFLLVDS EF +YDF+ FY LD +D ++TD+
            I
```

-continued
```
Sbjct: 184 AVTHNSIATYSDKEGVIQQLALNNAVEK-                              243
          FLLVDSTKFDRYDFFNFYNLDQLDTIITDNQI Query: 238 DNVVKEQYSSFTKIL 252
              E++S +T IL
Sbjct: 244 SPQHLEEFSQYTTIL 258
```

A related DNA sequence was identified in *S. pyogenes* <SEQ ID 1585> which encodes the amino acid sequence <SEQ ID 1586>. Analysis of this protein sequence reveals the following:

```
Possible site: 60
>>> Seems to have no N-terminal signal sequence

----- Final Results -----
            bacterial cytoplasm --- Certainty = 0.0740(Affirmative) < succ>
            bacterial membrane  --- Certainty = 0.0000(Not Clear)   < succ>
             bacterial outside  --- Certainty = 0.0000(Not Clear)   < succ>
```

An alignment of the GAS and GBS proteins is shown below:

```
Identities = 161/252 (63%), Positives = 195/252 (76%), Gaps = 3/252 (1%)
Query:   1 MLKRERLQKIIEKVNINGIVTVNEIMEELDVSDMTVRRDLDELDKAGLLIRIHGGAQKVN    60
           MLKRERL KI E VN  GIVTVN+I++ L+VSDNTVRRDLDEL+KAG LIRIHGGAQ +
Sbjct:   1 MLKRERLLKITEIVNEQGIVTVNDIIQTLNVSDMTVRRDLDELEKAGRLIRIHGGAQSIT    60

Query:  61 ASPTPQNYEKSNTEKYDIQTNEKLEIAQFAKQFINDGETIFIGPGTTLEKLATQLLDWKI   120
           P    E+SN EK  +QT EK E+A +A Q +NDGETIFIGPGTTLE  A QL ++I
Sbjbt:  61 M---PNKKERSNIEKQTVQTKEKWELASYATQLVNDGETIFIGPGTTLECFAEQLKNRQI   117

Query: 121 RVVTNSLPVFNILNQSSTLDLILVGGEYREITGAFVGSVTINSIRSLNFSKAFVSSNGVF   180
           R+VTNSLPVFNIL  S T+DLIL+GGEYR ITGAFVGS+    +I SL F+KAF+S NG++
Sbjct: 118 RIVTNSLPVFNILQDSETIDLILIGGEYRSITGAFVGSLASQNISSLKFAKAFISCNGIY   177

Query: 181 EKSIATYDEGEGEIQRIALNNSFEKFLLVDSQKFGKYDFYTFYQLDDIDFVLTDHNIDNV   240
            +   IATY E EGEIQ++A NNS EK+LLVD+QKF  YDF+ FY L++ID V+TD   I
Sbjct: 178 KNDIATYSETEGEIQKLAFNNSIEKYLLVDNQKFNAYDFFIFYHLNNIDAVVTDSQITED   237

Query: 241 VKEQYSSFTKIL 252
           V E+YS FT++L
Sbjct: 238 VIERYSQFTQLL 249
```

Based on this analysis, it was predicted that these proteins and their epitopes could be useful antigens for vaccines or diagnostics.

EXAMPLE 496

A DNA sequence (GBSx0534) was identified in *S. agalactiae* <SEQ ID 1587> which encodes the amino acid sequence <SEQ ID 1588>. Analysis of this protein sequence reveals the following:

```
Possible site: 19
>>> Seems to have no N-terminal signal sequence

----- Final Results -----
            bacterial cytoplasm --- Certainty = 0.3436(Affirmative) < succ>
            bacterial membrane  --- Certainty = 0.0000(Not Clear)   < succ>
             bacterial outside  --- Certainty = 0.0000(Not Clear)   < succ>
```

The protein has homology with the following sequences in the GENPEPT database:

```
>GP:AAD13797 GB:AF062533 unknown [Streptococcus agalactiae]
Identities = 86/371 (23%), Positives = 136/371 (36%), Gaps = 79/371 (21%)
Query:  11 DLSESELKAAQEFLSGKSEANQDKPKTGKTAQEIYEAIEPKAIVKPEDLLFGIAQATDYK70
            DL++    + L K    D   TG         IEP+ V  L      AT
```

-continued

```
Sbjct: 526 DLTQIAFAEQELMLKDKKHYRYDIVDTG---------IEPRLAVDVSSLPHHAGHATYDT576

Query:  71 NGTFVIPHKDHYHYVELKWFDEEKDLLADSDKTYSLEDYLATAKYYMMHPSKRPKVEGWG130
            +FVIPH DH H V    W    +            +AT KY M HPE RP V   W
Sbjct: 577 GSSFVIPHIDHIHVVPYSWLTRNQ---------------IATIKYVMQHPEVRPDV--IS619

Query: 131 KDAEIYKEKDSNKADKPSPAPTDNKSTSNSSDKNLSAAEVFKQAKPEKIVPLDKIAAHMA190
            K     + + + P+  P D ++    +    SA EV       +K +   + AA
Sbjct: 620 KPGH-----EESGSVIPNVTPLDKRAGMPHWQIIHSAEEV------QKALAEGRFAA---665

Query: 191 YAVGFEDDQLIVPHHDHYHNVPMAWFDKGGLWKAPEGYTLQQLFST--IKYYMEHPHELP248
                 D  I   D        W D         +G +L+ +   +    +    EL
Sbjct: 666 ------PDGYIFDPRDVLAKETFVWKDGSFSIPRADGSSLRTINKSDLSQAEWQQAQELL719

Query: 249 KEKGWGHDSDHNKGSNKDNKAKNYAPDEEPEDSGKVTHNYGFYDVNKGSDEEEP-EKQED307
            +K   G  +D +K              P+E+ +             +K ++ ++P E  ++
Sbjct: 720 AKKHAGDATDTDK-----------PEEKQQ-------------ADKSNENQQPSEASKE754

Query: 308 ESELDEYELGMAQNAKKYGMDRQSFEKQLIQLSNKYSVSFESFNYIHGSQVQVTKKDGSK367
            E  E D++       +    YG+DR + E + QL+ K ++     +        VQ  K+G
Sbjct: 755 EKESDDF----IDSLPDYGLDRATLEDHIHQLAQKANID-PKYLIFQPEGVQFYNKHGEL809

Query: 368 VLVDIKTLTEV                                                 378
            V  DIKTL ++
Sbjct: 810 VTYDIKTLQQI                                                 820
```

A related DNA sequence was identified in *S. agalactiae* <SEQ ID 6983> which encodes the amino acid sequence <SEQ ID 6984>. Analysis of this protein sequence reveals the following:

```
Possible site: 26
>>> Seems to have an uncleavable N-term signal seq

----- Final Results -----
          bacterial membrane --- Certainty = 0.0000(Not Clear) < succ>
           bacterial outside --- Certainty = 0.0000(Not Clear) < succ>
          bacterial cytoplasm --- Certainty = 0.0000(Not Clear) < succ>
```

A related GBS gene <SEQ ID 8581> and protein <SEQ ID 8582> were also identified. Analysis of this protein sequence reveals the following:

```
Lipop Possible site: -1 Crend: 2
McG: Discrim Score: 6.06
GvH: Signal Score (-7.5): -5.61
     Possible site: 26
>>> Seems to have an uncleavable N-term signal seq
ALOM program count: 0 value: 2.23 threshold: 0.0
PERIPHERAL Likelihood = 2.23 6
modified ALOM score: -0.95
*** Reasoning Step: 3

----- Final Results -----
          bacterial membrane --- Certainty = 0.0000(Not Clear) < succ>
           bacterial outside --- Certainty = 0.0000(Not Clear) < succ>
          bacterial cytoplasm --- Certainty = 0.0000(Not Clear) < succ>
```

A related DNA sequence was identified in *S. pyogenes* <SEQ ID 1589> which encodes the amino acid sequence <SEQ ID 1590>. Analysis of this protein sequence reveals the following:

```
Possible site: 26
>>> Seems to have an uncleavable N-term signal seq

----- Final Results -----
          bacterial membrane --- Certainty = 0.0000(Not Clear) < succ>
           bacterial outside --- Certainty = 0.0000(Not Clear) < succ>
          bacterial cytoplasm --- Certainty = 0.0000(Not Clear) < succ>
```

An alignment of the GAS and GBS proteins is shown below.

```
Identities = 808/825 (97%), Positives = 816/825 (97%),
Gaps = 3/825 (0%)

Query:   2 KKTYGYIGSVAAILLATHIGSYQLGKHHMGLATKDNQIAYIDDSKGKVKAPKTNKTMDQ     60
           KKTYGYIGSVAAILLATHIGSYQLGKHHMG ATKDNQIAYIDDSKGK KAPKTNKTMDQ
Sbjct:   2 KKTYGYIGSVAAILLATHIGSYQLGKHHMGSATKDNQIAYIDDSKGKAKAPKTNKTMDQ     60

Query:  61 ISAEEGISAEQIVVKITDQGYVTSHGDHYHFYNGKVPYDAIISEELLMTDPNYHFKQSDV   120
           ISAEEGISAEQIVVKITDQGYVTSHGDHYHFYNGKVPYDAIISEELLMTDPNY FKQSDV
Sbjct:  61 ISAEEGISAEQIVVKITDQGYVTSHGDHYHFYNGKVPYDAIISEELLMTDPNYRFKQSDV   120

Query: 121 INEILDGYVIKVNGNYYVYLKPGSKRKNIRTKQQIAEQVAKGTKEAKEKGLAQVAHLSKE   180
           INEILDGYVIKVNGNYYVYLKPGSKRKNIRTKQQIAEQVAKGTKEAKEKGLAQVAHLSKE
Sbjct: 121 INEILDGYVIKVNGNYYVYLKPGSKRKNIRTKQQIAEQVAKGTKEAKEKGLAQVAHLSKE   180

Query: 181 EVAAVNEAKRQGRYTTDDGYIFSPTDIIDDLGDAYLVPHGNHYHYIPKKDLSPSELAAAQ   240
           EVAAVNEAKRQGRYTTDDGYIFSPTDIIDDLGDAYLVPHGNHYHYIPKKDLSPSELAAAQ
Sbjct: 181 EVAAVNEAKRQGRYTTDDGYIFSPTDIIDDLGDAYLVPHGNHYHYIPKKDLSPSELAAAQ   240

Query: 241 AYWSQKQGRGARPSDYRPTPAP--GRRKAPIPDVTPNPGQGHQPDNGGYHPAPPRPNDAS   298
           AYWSQKQGRGARPSDYRPTPAP  GRRKAPIPDVTPNPGQGHQPDNGGYHPAPPRPNDAS
Sbjct: 241 AYWSQKQGRGARPSDYRPTPAPAPGRRKAPIPDVTPNPGQGHQPDNGGYHPAPPRPNDAS   300

Query: 299 QNKHQRDEFKGKTFKELLDQLHRLDLKYRHVEEDGLIFEPTQVIKSNAFGYVVPHGDHYH   358
           QNKHQRDEFKGKTFKELLDQLHRLDLKYRHVEEDGLIFEPTQVIKSNAFGYVVPHGDHYH
Sbjct: 301 QNKHQRDEFKGKTFKELLDQLHRLDLKYRHVEEDGLIFEPTQVIKSNAFGYVVPHGDHYH   360

Query: 359 IIPRSQLSPLEMELADRYLAGQTDDNDSGSDHSKPSDKEVTHTFLGHRIKAYGKGLDGKP   418
           IIPRSQLSPLEMELADRYLAGQT+D+DSGSDHSKPSDKEVTHTFLGHRIKAYGKGLDGKP
Sbjct: 361 IIPRSQLSPLEMELADRYLAGQTEDDDSGSDHSKPSDKEVTHTFLGHRIKAYGKGLDGKP   420

Query: 419 YDTSDAYVFSKESIHSVDKSGVTAKHGDHFHYIGFGELEQYELDEVANWVKAKGQADELV   478
           YDTSDAYVFSKESIHSVDKSGVTAKHGDHFHYIGFGELEQYELDEVANWVKAKGQADEL
Sbjct: 421 YDTSDAYVFSKESIHSVDKSGVTAKHGDHFHYIGFGELEQYELDEVANWVKAKGQADELA   480

Query: 479 AALDQEQGKEKPLFDTKKVSRKVTKDGKVGYIMPKDGKDYFYARYQLDLTQIAFAEQELM   538
           AALDQEQGKEKPLFDTKKVSRKVTKDGKVGY+MPKDGKDYFYAR QLDLTQIAFAEQELM
Sbjct: 481 AALDQEQGKEKPLFDTKKVSRKVTKDGKVGYMMPKDGKDYFYARDQLDLTQIAFAEQELM   540

Query: 539 LKDKKHYRYDIVDTGIEPRLAVDLSSLPMHAGNATYDTGSSFVIPHIDHIHVVPYSWLTR   598
           LKDKKHYRYDIVDTGIEPRLAVD+SSLPMHAGNATYDTGSSFVIPHIDHIHVVPYSWLTR
Sbjct: 541 LKDKKHYRYDIVDTGIEPRLAVDVSSLPMHAGNATYDTGSSFVIPHIDHIHVVPYSWLTR   600

Query: 599 NQIATIKYVMQHPEVRPDVWSKPGHEESGSVIPNVTPLDKRAGMPNWQIIHSAEEVQKAL   658
            +QIATIKYVMQHPEVRPD+WSKPGHEESGSVIPNVTPLDKRAGMPNWQIIHSAEEVQKAL
Sbjct: 601 DQIATIKYVMQHPEVRPDIWSKPGHEESGSVIPNVTPLDKRAGMPNWQIIHSAEEVQKAL   660

Query: 659 AEGRFAAPDGYIFDPRDVLAKETFVWKDGSFSIPRADGSSLRTINKSDLSQAEWQQAQEL   718
           AEGRFA PDGYIFDPRDVLAKETFVWKDGSFSIPRADGSSLRTINKSDLSQAEWQQAQEL
Sbjct: 661 AEGRFATPDGYIFDPRDVLAKETFVWKDGSFSIPRADGSSLRTINKSDLSQAEWQQAQEL   720

Query: 719 LAKKNAGDATDTDKPEEKQQADKSNENQQPSEASK-EEKESDDFIDSLPDYGLDRATLED   777
           LAKKNAGDATDTDKP+EKQQADKSNENQQPSEASK EEKESDDFIDSLPDYGLDRATLED
Sbjct: 721 LAKKNAGDATDTDKPKEKQQADKSNENQQPSEASKEEEKESDDFIDSLPDYGLDRATLED   780

Query: 778 HINQLAQKANIDPKYLIFQPEGVQFYNKNGELVTYDIKTLQQINP                822
           HINQLAQKANIDPKYLIFQPEGVQFYNKNGELVTYDIKTLQQINP
Sbjct: 781 HINQLAQKANIDPKYLIFQPEGVQFYNKNGELVTYDIKTLQQINP                825
```

Figure 148:
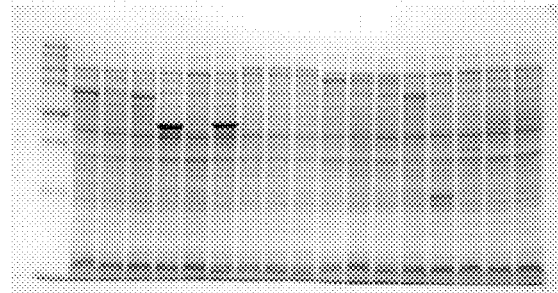
Figure 241:
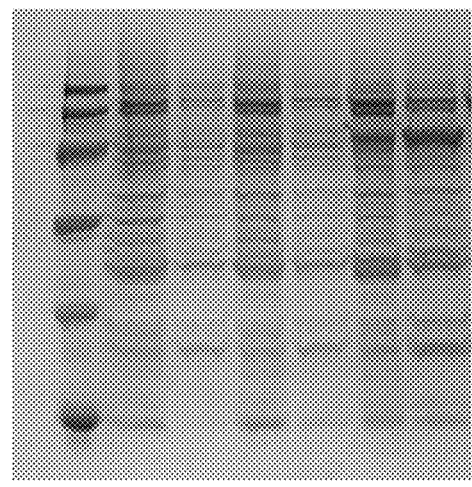

SEQ ID 8582 was expressed in *E. coli* in two different forms. GBS293dNterm was expressed in *E. coli* as a GST-fusion product. SDS-PAGE analysis of total cell extract is shown in FIG. 147 (lane 14; MW 74 kDa+lanes 17 & 18; MW 48.8 kDa). GBS293C was expressed in *E. coli* as a GST-fusion product. SDS-PAGE analysis of total cell extract is shown in FIGS. 148 (lane 24; MW 71 kDa+lanes 5 & 7; MW 46 kDa) and 182 (lane 7; MW 46 kDa). Purified GBS293C-His is shown in FIG. 241, lanes 8 & 9.

Based on this analysis, it was predicted that these proteins and their epitopes could be useful antigens for vaccines or diagnostics.

EXAMPLE 497

A DNA sequence (GBSx0535) was identified in *S. agalactiae* <SEQ ID 1591> which encodes the amino acid sequence <SEQ ID 1592>. Analysis of this protein sequence reveals the following:

```
Possible site: 23
>>> Seems to have a cleavable N-term signal seq.

----- Final Results -----
            bacterial outside --- Certainty = 0.3000(Affirmative) < succ>
            bacterial membrane --- Certainty = 0.0000(Not Clear) < succ>
            bacterial cytoplasm --- Certainty = 0.0000(Not Clear) < succ>
```

The protein has homology with the following sequences in the GENPEPT database:

```
>GP: AAD13797 GB: AF062533 unknown [Streptococcus agalactiae]
Identities = 213/463 (46%), Positives = 277/463 (59%), Gaps = 41/463 (8%)

Query:    4 KKTV-IISALSVALFGTGVGAYQLGSYNA--QKSDNSVSYVKTDKSDSKAQATAVNKTPD   60
            KKT   I +++  L   T +G+YQLG ++      DN ++Y+  D S   K +A    NKT D
Sbjct:    2 KKTYGYIGSVAAILLATHIGSYQLGKHHMGLATKDNQIAYI--DDSKGKVKAPKTNKTMD   59

Query:   61 QISKEEGISAEQIVVKITDDGYVTSHGDHYHYYNGKVPYDAIISEELIMKDPSYVFNKAD  120
            QIS EEGISAEQIVVKITD GYVTSHGDHYH+YNGKVPYDAIISEEL+M DP+Y F ++D
Sbjct:   60 QISAEEGISAEQIVVKITDQGYVTSHGDHYHFYNGKVPYDAIISEELLMTDPNYHFKQSD  119

Query:  121 VINEVKDGYIIKVNGKYYLYLKEGSKRTNVRTKEQIQKQREEWSKGGSKGESGKHSSAKT  180
            VINE+ DGY+IKVNG YY+YLK GSKR N+RTK+QI +Q  + +K     E+ +    A+
Sbjct:  120 VINEILDGYVIKVNGNYYVYLKPGSKRKNIRTKQQIAEQVAKGTK-----EAKEKGLAQV  174

Query:  181 QALS----ASVREAKASGRYTTDDGYVFSPTDVIDDMGDAFLVPHGDHFHYIPKADLSPS  236
               LS     A+V EAK  GRYTTDDGY+FSPTD+IDD+GDA+LVPHG+H+HYIPK DLSPS
Sbjct:  175 AHLSKEEVAAVNEAKRQGRYTTDDGYIFSPTDIIDDLGDAYLVPHGNHYHYIPKKDLSPS  234

Query:  237 ELSAAQAYWNRKTGRSGNSS--KPSNSSSYIHASAPSGNVSTGRHANAPISIPRVTHANH  294
            EL+AAQAYW++K GR    S   +P+ +      A   P    + G+              H
Sbjct:  235 ELAAAQAYWSQKQGRGARPSDYRPTPAPGRRKAPIPDVTPNGQGHQPD------NGGYH  288

Query:  295 WSKPAGNHATAPKHHAPTTKPINKDSALDKMLKRLYAQPLYARHVESDGLVYDPAQVNAF  354
            + P  N A+  KH    +    K        ++L +L+    L RHVE DGL+++P QV
Sbjct:  289 PAPPRPNDASQNKHQ----RDEFKGKTFKELLDQLHRLDLKYRHVEEDGLIFEPTQVIKS  344

Query:  355 TAIGVSIPHGNHFHFIHYKDMSPLELE-ATRMVAEHRGHHIDALGKKDSTEKPKHISHEP  413
               A G  +PHG+H+H I    +SPLE+E A R  +A          G+ D   +         S
Sbjct:  345 NAFGYVVPHGDHYHIIPRSQLSPLEMELADRYLA---------GQTDDNDSGSDHSKPS  394

Query:  414 NKE-PHTEEEHHAVTPKDQRKGKP---NSQIVYSAQEIEEAKK                 452
            +KE  HT   H           GKP    + V+S +  I    K
Sbjct:  395 DKEVTHTFLGHRIKAYGKGLDGKPYDTSDAYVFSKESIHSVDK                 437
```

There is also homology to SEQ ID 1590.

SEQ ID 1592 (GBS94) was expressed in *E. coli* as a His-fusion product. SDS-PAGE analysis of total cell extract is shown in FIG. 17 (lane 3; MW 52.5 kDa).

Figure 194:
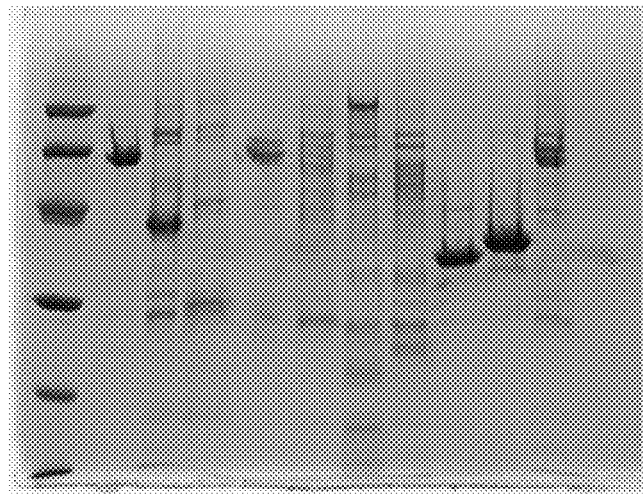

GBS94-His was purified as shown in FIG. 194, lane 8.

Based on this analysis, it was predicted that this protein and its epitopes, could be useful antigens for vaccines or diagnostics.

EXAMPLE 498

A DNA sequence (GBSx0536) was identified in *S. agalactiae* <SEQ ID 1593> which encodes the amino acid sequence <SEQ ID 1594>. This protein is predicted to be Lmb. Analysis of this protein sequence reveals the following:

```
Possible site: 24
>>> May be a lipoprotein

----- Final Results -----
            bacterial membrane --- Certainty = 0.0000(Not Clear) < succ>
            bacterial outside  --- Certainty = 0.0000(Not Clear) < succ>
            bacterial cytoplasm --- Certainty = 0.0000(Not Clear) < succ>
```

There is also homology to SEQ IDs 1596 and 5548.

A related GBS gene <SEQ ID 8583> and protein <SEQ ID 8584> were also identified. Analysis of this protein sequence reveals the following:

```
Lipop: Possible site: 22 Crend: 5
McG: Discrim Score: 13.64
GvH: Signal Score (-7.5): -5.75
     Possible site: 24
>>> May be a lipoprotein
ALOM program count: 0 value: 4.83 threshold: 0.0
    PERIPHERAL Likelihood = 4.83 33
modified ALOM score: -1.47

----- Final Results -----
            bacterial membrane --- Certainty = 0.0000(Not Clear) < succ>
            bacterial outside  --- Certainty = 0.0000(Not Clear) < succ>
            bacterial cytoplasm --- Certainty = 0.0000(Not Clear) < succ>
```

SEQ ID 8584 (GBS22) was expressed in *E. coli* as a His-fusion product. SDS-PAGE analysis of total cell extract is shown in FIG. 14 (lane 6; MW 35 kDa).

The GBS22-His fusion product was purified (FIG. 94A; see also FIG. 193, lane 4) and used to immunise mice (lane 2 product; 20 μg/mouse). The resulting antiserum was used for Western blot (FIG. 94B), FACS (FIG. 94C), and in the in vivo passive protection assay (Table III). These tests confirm that the protein is immunoaccessible on GBS bacteria and that it is an effective protective immunogen.

Figure 183:

SEQ ID 9584 (GBS22) was expressed in *E. coli* as a His-fusion product. SDS-PAGE analysis of total cell extract is shown in FIG. 183 (lane 7 & 8; MW 35 kDa).

Based on this analysis, it was predicted that these proteins and their epitopes could be useful antigens for vaccines or diagnostics.

EXAMPLE 499

A DNA sequence (GBSx0537) was identified in *S. agalactiae* <SEQ ID 1597> which encodes the amino acid sequence <SEQ ID 1598>. Analysis of this protein sequence reveals the following:

```
Possible site: 39
>>> Seems to have no N-terminal signal sequence
        INTEGRAL    Likelihood = -0.59    Transmembrane    19-35 (19-35)

----- Final Results -----
                bacterial membrane --- Certainty = 0.1235(Affirmative) < succ>
                 bacterial outside --- Certainty = 0.0000(Not Clear)   < succ>
               bacterial cytoplasm --- Certainty = 0.0000(Not Clear)   < succ>
```

The protein has homology with the following sequences in the GENPEPT database:

```
>GP: CAA51352 GB: X72832 ORF1 [Streptococcus equisimilis]
Identities = 104/145 (71%), Positives = 126/145 (86%)

Query:    1 MKIIIQRVNQASVSIEDDVVGSIEKGLVLLVGIAPEDTTEDIAYAVRKITSMRIFSDDEG    60
            MK+++QRV +ASVSI+  + G+I +GL+LLVG+ P+D   ED+AYAVRKI +MRIFSD +G
Sbjct:    1 MKLVLQRVKEASVSIDGKIAGAINQGLLLLVGVGPDDAAEDLAYAVRKIVNMRIFSDADG    60

Query:   61 KMNLSIQDIKGSVLSISQFTLFADTKKGNRPAFTGAADPVKANQFYDIFNQELANHVSVE   120
            KMN SIQDIKGS+LS+SQFTL+ADTKKGNRPAFTGAA P   A+QFYD FN++LA+ V VE
Sbjct:   61 KMNQSIQDIKGSILSVSQFTLYADTKKGNRPAFTGAAKPDMASQFYDRFNEQLADFVPVE   120

Query:  121 TGQFGADMQVSLINDGPVTIVLDTK                                     145
            G FGADMQVSLINDGPVTI+LDTK
Sbjct:  121 RGVFGADMQVSLINDGPVTIILDTK                                     145
```

A related DNA sequence was identified in *S. pyogenes* <SEQ ID 1599> which encodes the amino acid sequence <SEQ ID 1600>. Analysis of this protein sequence reveals the following:

```
Possible site: 39
>>> Seems to have no N-terminal signal sequence

----- Final Results -----
               bacterial cytoplasm --- Certainty = 0.1430(Affirmative) < succ>
                bacterial membrane --- Certainty = 0.0000(Not Clear)   < succ>
                 bacterial outside --- Certainty = 0.0000(Not Clear)   < succ>
```

An alignment of the GAS and GBS proteins is shown below:

```
Identities = 103/145 (71%), Positives = 124/145 (85%)

Query:    1 MKIIIQRVNQASVSIEDDVVGSIEKGLVLLVGIAPEDTTEDIAYAVRKITSMRIFSDDEG    60
                MK+++QRV +ASVSI+  + G+I +GL+LLVG+ P+D   ED+AYAVRKI +MRIFSD +G
    Sbjct:    1 MKLVLQRVKEASVSIDGKIAGAINQGLLLLVGVGPDDNAEDLAYAVRKIVNMRIFSDADG    60

Query:   61 KMNLSIQDIKGSVLSISQFTLFADTKKGNRPAFTGAADPVKANQFYDIFNQELANHVSVE   120
                KMN SIQDIKGS+LS+SQFTL+ADTKKGNRPAFTGAA P   A+Q YD FN++LA  V VE
    Sbjct:   61 KMNQSIQDIKGSILSVSQFTLYADTKKGNRPAFTGAAKPDLASQLYDSFNEQLAEFVPVE   120

Query:  121 TGQFGADMQVSLINDGPVTIVLDTK                                     145
                G FGADMQVSLINDGPVTI+LDTK
    Sbjct:  121 RGVFGADMQVSLINDGPVTIILDTK                                     145
```

Figure 70:
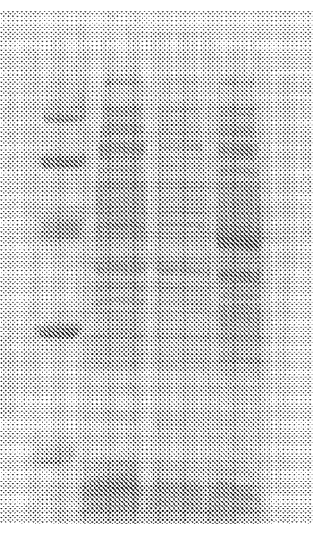

SEQ ID 1598 (GBS368) was expressed in *E. coli* as a His-fusion product. SDS-PAGE analysis of total cell extract is shown in FIG. 64 (lane 4; MW 20 kDa). It was also expressed in *E. coli* as a GST-fusion product. SDS-PAGE analysis of total cell extract is shown in FIG. 70 (lane 4; MW 45 kDa).

GBS368-GST was purified as shown in FIG. 215, lane 6.

Based on this analysis, it was predicted that these proteins and their epitopes could be useful antigens for vaccines or diagnostics.

EXAMPLE 500

A DNA sequence (GBSx0538) was identified in *S. agalactiae* <SEQ ID 1601> which encodes the amino acid sequence <SEQ ID 1602>. This protein is predicted to be stringent response-like protein (rel) (relA). Analysis of this protein sequence reveals the following:

```
Possible site: 37
>>> Seems to have no N-terminal signal sequence
      INTEGRAL      Likelihood = -0.32      Transmembrane      60-76 (60-76)

----- Final Results -----
            bacterial membrane  --- Certainty = 0.1128(Affirmative) < succ>
            bacterial outside   --- Certainty = 0.0000(Not Clear)   < succ>
            bacterial cytoplasm --- Certainty = 0.0000(Not Clear)   < succ>
```

The protein has homology with the following sequences in the GENPEPT database:

```
>GP: CAA51353 GB: X72832 stringent response-like protein
[Streptococcus equisimilis]
Identities = 647/739 (87%), Positives = 696/739 (93%), Gaps = 1/739 (0%)

Query:   1 MVKEINLTGEEVVAITSQYMSETDVAFVKFALNYATAAHYYQARKSGEPYIIHPIQVAGI    60
           M KEINLTGEEVVA+ ++YM+ETD AFVK AL+YATAAH+YQ RKSGEPYI+HPIQVAGI
Sbjct:   1 MAKEINLTGEEVVALAAKYMNETDAAFVKKALDYATAAHFYQVRKSGEPYIVHPIQVAGI    60

Query:  61 LADLHLDAVTVACGFLHDVVEDTEITLDEIETDFGKDVRDIIDGVTKLGKVEYKSHEEQL   120
           LADLHLDAVTVACGFLHDVVEDT+ITLD IE DFGKDVRDI+DGVTKLGKVEYKSHEEQL
Sbjct:  61 LADLHLDAVTVACGFLHDVVEDTDITLDNIEFDFGKDVRDIVDGVTKLGKVEYKSHEEQL   120

Query: 121 AENHRKMLMAMSKDIRVILVKLADRLHNMRTLKHLRKDKQERISRETMEIYAPLAHRLGI   180
           AENHRKMLMAMSKDIRVILVKLADRLHNMRTLKHLRKDKQERISRETMEIYAPLAHRLGI
Sbjct: 121 AENHRKMLMAMSKDIRVILVKLADRLHNMRTLKHLRKDKQERISRETMEIYAPLAHRLGI   180

Query: 181 SRIKWELEDLSFRYLNETEFYKISHMMSEKRREREELVDIIVDKIRSYTEEQGLYGDIYG   240
           SRIKWELEDL+FRYLNETEFYKISHMM+EKRRERE LVD IV KI+SYT EQGL+GD+YG
Sbjct: 181 SRIKWELEDLAFRYLNETEFYKISHMMNEKRREREALVDDIVTKIKSYTTEQGLFGDVYG   240

Query: 241 RPKHIYSIYRKMRDKKKRFDQIYDLIAIRCIMETASDVYAMVGYIHELWRPMPGRFKDYI   300
           RPKHIYSIYRKMRDKKKRFDQI+DLIAIRC+MET SDVYAMVGYIHELWRPMPGRFKDYI
Sbjct: 241 RPKHIYSIYRKMRDKKKRFDQIFDLIAIRCVMETQSDVYAMVGYIHELWRPMPGRFKDYI   300

Query: 301 AAPKANGYQSIHTTVYGPKGPIEIQIRTKEMHQVAEFGVAAHWAYKKGITSKVNQAEQSV   360
           AAPKANGYQSIHTTVYGPKGPIEIQIRTKEMHQVAE+GVAAHWAYKKG+  KVNQAEQ V
Sbjct: 301 AAPKANGYQSIHTTVYGPKGPIEIQIRTKEMHQVAEYGVAAHWAYKKGVRGKVNQAEQKV   360

Query: 361 GMGWIQELVELQDESK-DAKDFVDSVKEDIFTERIYVFTPNGAVQELPRESGPIDFAYAI   419
           GM WI+ELVELQD S  DA DFVDSVKEDIF+ERIYVFTP GAVQELP++SGPIDFAYAI
Sbjct: 361 GMNWIKELVELQDASNGDAVDFVDSVKEDIFSERIYVFTPTGAVQELPKDSGPIDFAYAI   420

Query: 420 HTQVGEKATGAKVNGRMVPLTAKLKTGDVVEIITNPNSFGPSRDWIKIVKTNKARNKIRQ   479
           HTQVGEKA GAKVNGRMVPLTAKLKTGDVVEI+TNPNSFGPSRDWIK+VKTNKARNKIRQ
Sbjct: 421 HTQVGEKAIGAKVNGRMVPLTAKLKTGDVVEIVTNPNSFGPSRDWIKLVKTNKARNKIRQ   480

Query: 480 FFKNQDKETSINKGRELLVDYFQEQGYVPNKYLDKKHIEEILPRVSVKSEEALYAAVGFG   539
           FFKNQDKE S+NKGR++LV YFQEQGYV NKYLDKK IE ILP+VSVKSEE+LYAAVGFG
Sbjct: 481 FFKNQDKELSVNKGRDMLVSYFQEQGYVANKYLDKKRIEAILPKVSVKSEESLYAAVGFG   540

Query: 540 DLSPISIFNKLTEKERREEERAKAKAEADELINGGEIKTDKRDVLKVKSENGVIIQGASG   599
           D+SP+S+FNKLTEKERREEERAKAKAEA+EL+NGGEIK + +DVLKV+SENGVIIQGASG
Sbjct: 541 DISPVSVFNKLTEKERREEERAKAKAEAEELVNGGEIKHENKDVLKVRSENGVIIQGASG   600

Query: 600 LLMRIAKCCNPVPGDLIEGYITKGRGVAIHRSDCQNLKSQENYEQRLIDVEWDDDGSKKE   659
           LLMRIAKCCNPVPGD IEGYITKGRG+AIHR+DC N+KSQ+ Y++RLI+VEWD D S K+
Sbjct: 601 LLMRIAKCCNPVPGDPIEGYITKGRGIAIHRADCNNIKSQDGYQERLIEVEWDLDNSSKD   660

Query: 660 YMAEIDIYGLNRSGLLNDVLQTLSNATKLVSTVNAQPTKDMKFANIHVSFGISNLAQLTT   719
           Y AEIDIYGLNR GLLNDVLQ LSN+TK +STVNAQPTKDMKFANIHVSFGI NL  LTT
Sbjct: 661 YQAEIDIYGLNRRGLLNDVLQILSNSTKSISTVNAQPTKDMKFANIHVSFGIPNLTHLTT   720

Query: 720 VVDKIKIIPDVYSVKRTNG                                            738
```

```
                VV+KIK +PDVYSVKRTNG
Sbjct:  721 VVEKIKAVPDVYSVKRTNG                                     739
```

A related DNA sequence was identified in *S. pyogenes* <SEQ ID 1603> which encodes the amino acid sequence <SEQ ID 1604>. Analysis of this protein sequence reveals the following:

```
Possible site: 41
>>> Seems to have no N-terminal signal sequence
     INTEGRAL       Likelihood = -0.32      Transmembrane       64-80 (64-80)

----- Final Results -----
              bacterial membrane --- Certainty = 0.1128(Affirmative) < succ>
               bacterial outside --- Certainty = 0.0000(Not Clear)  < succ>
             bacterial cytoplasm --- Certainty = 0.0000(Not Clear)  < succ>
```

The protein has homology with the following sequences in the databases:

```
>GP: CAA51353 GB: X72832 stringent response-like protein
[Streptococcus equisimilis]
Identities = 700/739 (94%), Positives = 721/739 (96%)

Query:    5 MAKIMNVTGEEVIALAATYMTKADVAFVAKALAYATAAHFYQVRKSGEPYIVHPIQVAGI   64
            MAK +N+TGEEV+ALAA YM + D AFV KAL YATAAHFYQVRKSGEPYIVHPIQVAGI
Sbjct:    1 MAKEINLTGEEVVALAAKYMNETDAAFVKKALDYATAAHFYQVRKSGEPYIVHPIQVAGI   60

Query:   65 LADLHLDAVTVACGFLHDVVEDTDITLDEIEADFGHDARDIVDGVTKLGEVEYKSHEEQL  124
            LADLHLDAVTVACGFLHDVVEDTDITLD IE DFG D RDIVDGVTKLG+VEYKSHEEQL
Sbjct:   61 LADLHLDAVTVACGFLHDVVEDTDITLDNIEFDFGKDVRDIVDGVTKLGKVEYKSHEEQL  120

Query:  125 AENHRKMLMAMSKDIRVILVKLADRLHNMRTLKHLRKDKQERISRETMEIYAPLAHRLGI  184
            AENHRKMLMAMSKDIRVILVKLADRLHNMRTLKHLRKDKQERISRETMEIYAPLAHRLGI
Sbjct:  121 AENHRKMLMAMSKDIRVILVKLADRLHNMRTLKHLRKDKQERISRETMEIYAPLAHRLGI  180

Query:  185 SRIKWELEDLAFRYLNETEFYKISHMMKEKRREREALVEAIVSKVKTYTTQQGLFGDVYG  244
            SRIKWELEDLAFRYLNETEFYKISHMM EKRREREALV+ IV+K+K+YTT+QGLFGDVYG
Sbjct:  181 SRIKWELEDLAFRYLNETEFYKISHMMNEKRREREALVDDIVTKIKSYTTEQGLFGDVYG  240

Query:  245 RPKHIYSIYRKMRDKKKRFDQIFDLIAIRCVMETQSDVYAMVGYIHELWRPMPGRFKDYI  304
            RPKHIYSIYRKMRDKKKRFDQIFDLIAIRCVMETQSDVYAMVGYIHELWRPMPGRFKDYI
Sbjct:  241 RPKHIYSIYRKMRDKKKRFDQIFDLIAIRCVMETQSDVYAMVGYIHELWRPMPGRFKDYI  300

Query:  305 AAPKANGYQSIHTTVYGPKGPIEIQIRTKDMHQVAEYGVAAHWAYKKGVRGKVNQAEQAV  364
            AAPKANGYQSIHTTVYGPKGPIEIQIRTK+MHQVAEYGVAAHWAYKKGVRGKVNQAEQ V
Sbjct:  301 AAPKANGYQSIHTTVYGPKGPIEIQIRTKEMHQVAEYGVAAHWAYKKGVRGKVNQAEQKV  360

Query:  365 GMNWIKELVELQDASNGDAVDFVDSVKEDIFSERIYVFTPTGAVQELPKESGPIDFAYAI  424
            GMNWIKELVELQDASNGDAVDFVDSVKEDIFSERIYVFTPTGAVQELPK+SGPIDFAYAI
Sbjct:  361 GMNWIKELVELQDASNGDAVDFVDSVKEDIFSERIYVFTPTGAVQELPKDSGPIDFAYAI  420

Query:  425 HTQIGEKATGAKVNGRMVPLTAKLKTGDVVEIITNANSFGPSRDWVKLVKTNKARNKIRQ  484
            HTQ+GEKA GAKVNGRMVPLTAKLKTGDVVEI+TN NSFGPSRDW+KLVKTNKARNKIRQ
Sbjct:  421 HTQVGEKAIGAKVNGRMVPLTAKLKTGDVVEIVTNPNSFGPSRDWIKLVKTNKARNKIRQ  480

Query:  485 FFKNQDKELSVNKGRDLLVSYFQEQGYVANKYLDKKRIEAILPKVSVKSEESLYAAVGFG  544
            FFKNQDKELSVNKGRD+LVSYFQEQGYVANKYLDKKRIEAILPKVSVKSEESLYAAVGFG
Sbjct:  481 FFKNQDKELSVNKGRDMLVSYFQEQGYVANKYLDKKRIEAILPKVSVKSEESLYAAVGFG  540

Query:  545 DISPISVFNKLTEKERREEERAKAKAEAEELVKGGEVKHENKDVLKVRSENGVIIQGASG  604
            DISP+SVFNKLTEKERREEERAKAKAEAEELV GGE+KHENKDVLKVRSENGVIIQGASG
Sbjct:  541 DISPVSVFNKLTEKERREEERAKAKAEAEELVNGGEIKHENKDVLKVRSENGVIIQGASG  600

Query:  605 LLMRIAKCCNPVPGDPIDGYITKGRGIAIHRSDCHNIKSQDGYQERLIEVEWDLDNSSKD  664
            LLMRIAKCCNPVPGDPI+GYITKGRGIAIHR+DC+NIKSQDGYQERLIEVEWDLDNSSKD
Sbjct:  601 LLMRIAKCCNPVPGDPIEGYITKGRGIAIHRADCNNIKSQDGYQERLIEVEWDLDNSSKD  660

Query:  665 YQAEIDIYGLNRSGLLNDVLQILSNSTKSISTVNAQPTKDMKFANIHVSFGIPNLTHLTT  724
            YQAEIDIYGLNR GLLNDVLQILSNSTKSISTVNAQPTKDMKFANIHVSFGIPNLTHLTT
Sbjct:  661 YQAEIDIYGLNRRGLLNDVLQILSNSTKSISTVNAQPTKDMKFANIHVSFGIPNLTHLTT  720

Query:  725 VVEKIKAVPDVYSVKRTNG                                          743
            VVEKIKAVPDVYSVKRTNG
Sbjct:  721 VVEKIKAVPDVYSVKRTNG                                          739
```

An alignment of the GAS and GBS proteins is shown below:

```
Identities = 635/739 (85%), Positives = 691/739 (92%), Gaps = 1/739 (0%)

Query:    1 MVKEINLTGEEVVAITSQYMSETDVAFVKFALNYATAAHYYQARKSGEPYIIHPIQVAGI   60
            M K +N+TGEEV+A+ + YM++ DVAFV  AL YATAAH+YQ RKSGEPYI+HPIQVAGI
Sbjct:    5 MAKIMNVTGEEVIALAATYMTKADVAFVAKALAYATAAHFYQVRKSGEPYIVHPIQVAGI   64

Query:   61 LADLHLDAVTVACGFLHDVVEDTEITLDEIETDFGKDVRDIIDGVTKLGKVEYKSHEEQL  120
            LADLHLDAVTVACGFLHDVVEDT+ITLDEIE DFG D RDI+DGVTKLG+VEYKSHEEQL
Sbjct:   65 LADLHLDAVTVACGFLHDVVEDTDITLDEIEADFGHDARDIVDGVTKLGEVEYKSHEEQL  124

Query:  121 AENHRKMLMAMSKDIRVILVKLADRLHNMRTLKHLRKDKQERISRETMEIYAPLAHRLGI  180
            AENHRKMLMAMSKDIRVILVKLADRLHNMRTLKHLRKDKQERISRETMEIYAPLAHRLGI
Sbjct:  125 AENHRKMLMAMSKDIRVILVKLADRLHNMRTLKHLRKDKQERISRETMEIYAPLAHRLGI  184

Query:  181 SRIKWELEDLSFRYLNETEFYKISHMMSEKRREREELVDIIVDKIRSYTEEQGLYGDIYG  240
            SRIKWELEDL+FRYLNETEFYKISHMM EKRRERE LV+ IV K+++YT +QGL+GD+YG
Sbjct:  185 SRIKWELEDLAFRYLNETEFYKISHMMKEKRREREALVEAIVSKVKTYTTQQGLFGDVYG  244

Query:  241 RPKHIYSIYRKMRDKKKRFDQIYDLIAIRCIMETASDVYAMVGYIHELWRPMPGRFKDYI  300
            RPKHIYSIYRKMRDKKKRFDQI+DLIAIRC+MET SDVYAMVGYIHELWRPMPGRFKDYI
Sbjct:  245 RPKHIYSIYRKMRDKKKRFDQIFDLIAIRCVMETQSDVYAMVGYIHELWRPMPGRFKDYI  304

Query:  301 AAPKANGYQSIHTTVYGPKGPIEIQIRTKEMHQVAEFGVAAHWAYKKGITSKVNQAEQSV  360
            AAPKANGYQSIHTTVYGPKGPIEIQIRTK+MHQVAE+GVAAHWAYKKG+  KVNQAEQ+V
Sbjct:  305 AAPKANGYQSIHTTVYGPKGPIEIQIRTKDMHQVAEYGVAAHWAYKKGVRGKVNQAEQAV  364

Query:  361 GMGWIQELVELQDESK-DAKDFVDSVKEDIFTERIYVFTPNGAVQELPRESGPIDFAYAI  419
            GM WI+ELVELQD S  DA DFVDSVKEDIF+ERIYVFTP GAVQELP+ESGPIDFAYAI
Sbjct:  365 GMNWIKELVELQDASNGDAVDFVDSVKEDIFSERIYVFTPTGAVQELPKESGPIDFAYAI  424

Query:  420 HTQVGEKATGAKVNGRMVPLTAKLKTGDVVEIITNPNSFGPSRDWIKIVKTNKARNKIRQ  479
            HTQ+GEKATGAKVNGRMVPLTAKLKTGDVVEIITN NSFGPSRDW+K+VKTNKARNKIRQ
Sbjct:  425 HTQIGEKATGAKVNGRMVPLTAKLKTGDVVEIITNANSFGPSRDWVKLVKTNKARNKIRQ  484

Query:  480 FFKNQDKETSINKGRELLVDYFQEQGYVPNKYLDKKHIEEILPRVSVKSEEALYAAVGFG  539
            FFKNQDKE S+NKGR LLV YFQEQGYV NKYLDKK IE ILP+VSVKSEE+LYAAVGFG
Sbjct:  485 FFKNQDKELSVNKGRDLLVSYFQEQGYVANKYLDKRIEAILPKVSVKSEESLYAAVGFG  544

Query:  540 DLSPISIFNKLTEKERREEERAKAKAEADELINGGEIKTDKRDVLKVKSENGVIIQGASG  599
            D+SPIS+FNKLTEKERREEERAKAKAEA+EL+ GGE+K + +DVLKV+SENGVIIQGASG
Sbjct:  545 DISPISVFNKLTEKERREEERAKAKAEAEELVKGGEVKHENKDVLKVRSENGVIIQGASG  604

Query:  600 LLMRIAKCCNPVPGDLIEGYITKGRGVAIHRSDCQNLKSQENYEQRLIDVEWDDDGSKKE  659
            LLMRIAKCCNPVPGD I+GYITKGRG+AIHRSDC N+KSQ+ Y++RLI+VEWD D S K+
Sbjct:  605 LLMRIAKCCNPVPGDPIDGYITKGRGIAIHRSDCHNIKSQDGYQERLIEVEWDLDNSSKD  664

Query:  660 YMAEIDIYGLNRSGLLNDVLQTLSNATKLVSTVNAQPTKDMKFANIHVSFGISNLAQLTT  719
            Y AEIDIYGLNRSGLLNDVLQ LSN+TK +STVNAQPTKDMKFANIHVSFGI NL  LTT
Sbjct:  665 YQAEIDIYGLNRSGLLNDVLQILSNSTKSISTVNAQPTKDMKFANIHVSFGIPNLTHLTT  724

Query:  720 VVDKIKIIPDVYSVKRTNG                                           738
            VV+KIK +PDVYSVKRTNG
Sbjct:  725 VVEKIKAVPDVYSVKRTNG                                           743
```

Based on this analysis, it was predicted that these proteins and their epitopes could be useful antigens for vaccines or diagnostics.

EXAMPLE 501

A DNA sequence (GBSx0539) was identified in *S. agalactiae* <SEQ ID 1605> which encodes the amino acid sequence <SEQ ID 1606>. This protein is predicted to be 2',3'-cyclic-nucleotide 2'-phosphodiesterase precursor (cpdB). Analysis of this protein sequence reveals the following:

```
Possible site: 28
>>> Seems to have a cleavable N-term signal seq.
   INTEGRAL    Likelihood = -5.79    Transmembrane     779-795 (778-797)
```

```
----- Final Results -----
        bacterial membrane --- Certainty = 0.3314(Affirmative) < succ>
        bacterial outside  --- Certainty = 0.0000(Not Clear)  < succ>
        bacterial cytoplasm --- Certainty = 0.0000(Not Clear)  < succ>
```

The protein has homology with the following sequences in the GENPEPT database:

```
>GP: CAB12613 GB: Z99108 similar to 2',3'-cyclic-nucleotide
2'-phosphodiesterase [Bacillus subtilis]
Identities = 297/630 (47%), Positives = 419/630 (66%), Gaps = 21/630 (3%)

Query:  102 KVDLRIMSTTDLHTNLVNYDYYQDKESQKIGLAKTAVLIEEAKKENPNTVLVDNGDVIQG    161
            +V L I++TTD+H N+++YDYY DKE+    GLA+TA LI++ +++NPNT+LVDNGD+IQG
Sbjct:   42 QVHLSILATTDIHANMMDYDYYSDKETADFGLARTAQLIQKHREQNPNTLLVDNGDLIQG    101

Query:  162 TPLGTYKAIVKP---VAENEEHPMYQAMNALGYDASTLGNHEFNYGLDYLKKIIATANLP    218
              PLG Y +    ++ + HP+   MNAL YDA TLGNHEFNYGLD+    I A+ P
Sbjct:  102 NPLGEYAVKYQKDDIISGTKTHPIISVMNALKYDAGTLGNHEFNYGLDFLDGTIKGADFP    161

Query:  219 ILNANVLDFKTHQPVFKTYDIITKTFKDSTGRAVALNIGITGIVPPQILNWDKANLEGKV    278
            I+NANV     + +  Y I  KT  D G     + +G  G VPPQI+ WDK NLEG+V
Sbjct:  162 IVNANVKT-TSGENRYTPYVINEKTLIDENGNEQKVKVGYIGFVPPQIMTWDKKNLEGQV    220

Query:  279 IVKDSVKAIEEIVPTMRAKGADVILVLSHSGIGDDRYEEGEENVGYQIAS-IKGVDAVVT    337
             V+D V++  E +P M+A+GADVI+ L+H+GI     G EN + +A+  KG+DA+++
Sbjct:  221 QVQDIVESANETIPKMKAEGADVIIALAHTGIEKQAQSSGAENAVFDLATKTKGIDAIIS    280

Query:  338 GHSAEFPSGNGTGFYEKYTGVDGIN---GKINGTPVTMAGKYGDHLGIIDLGLSYTNGK    394
            GH H  FPS        +Y GV  N   G ING PV M   +G +LG+IDL L   +G
Sbjct:  281 GHQHGLFPSA-------EYAGVAQFNVEKGTINGIPVVMPSSWGKYLGVIDLKLEKADGS    333

Query:  395 WQVSESSAKIRKIDMNSTTADERIIALAKEAHDGTINYVRQQVGTTTAPITSYFALVKDD    454
            W+V++S    I    I  N T+  +E +    ++ H  T+ YVR+ VG T A I  S+FA VKDD
Sbjct:  334 WKVADSKGSIESIAGNVTSRNETVTNTIQQTHQNTLEYVRKPVGKTEADINSFFAQVKDD    393

Query:  455 PSVQIVNNAQRWYVANELKGTPEANLPLLSAAAPFKAGTRGDATAYTDIPAGPVAIKNVA    514
            PS+QIV +AQ+WY   E+K T    NLP+LSA APFKAG R  A   YT+IPAG +AIKNV
Sbjct:  394 PSIQIVTDAQKWYAEKEMKDTEYKNLPILSAGAPFKAGGRNGANYYTNIPAGDLAIKNVG    453

Query:  515 DLYLYDNVTALLKVTGADLREWLEMSAGQFNQIDPNNKAPQNIINTEYRTYNFDVIDGLT    574
            DLYLYDN  ++K+TG+++++WLEMSAGQFNQIDP   Q  ++N  +R+YNFDVIDG+T
Sbjct:  454 DLYLYDNTVQIVKLTGSEVKDWLEMSAGQFNQIDPAKGGDQALLNENFRSYNFDVIDGVT    513

Query:  575 YKFDITQPNKYNKDGKVVNSQASRVRDLMYNGKPVADKQEFMIVTNNYRASGTFPGAKNA    634
            Y+ D+T+P KYN++GKV+N+  +SR+  +L Y GKP++   QEF++VTNNYRASG  G +
Sbjct:  514 YQVDVTKPAKYNENGKVINADSSRIINLSYEGKPISPSQEFLVVTNNYRASGG-GGFPHL    572

Query:  635 TMNRLLN---LENRQTIINYIISEKTINPTADNNWGFTESIKDLDLRFQTADKAKNLVTN    691
            T +++++    +ENRQ +++YII +KT+NP ADNNW     +L F+++ AK
Sbjct:  573 TSDKIVHGSAVENRQVLMDYIIEQKTVNPKADNNWSIA-PVSGTNLTFESSLLAKPFADK    631

Query:  692 SKDIQYIASSTKDEGFGDYRFVYTEQEKVD                               721
             + D+ Y+   S +EG+G Y+ + +   D
Sbjct:  632 ADDVAYVGKSA-NEGYGVYKLQFDDDSNPD                               660

Identities = 133/567 (23%), Positives = 214/567 (37%), Gaps = 147/567 (25%)

Query:  104 DLRIMSTTDLHTNLVNYDYYQDKESQKIGLAKTAVLIEEAKKENPNTVLVDNGDVIQGTP    163
            DL +M T D H +L +              A+     I E + E  +L+D GDV  G
Sbjct:  668 DLTVMHTNDTHAHLDD-------------AARRMTKINEVRSETNHNILLDAGDVFSGD-    713

Query:  164 LGTYKAIVKPVAENEEHPMYQAMNALGYDASTLGNHEFNYG----LDYLKKIIATAN---    216
              Y   +A+        + MN +GYDA T GNHEF+ G     D+L    AT +
Sbjct:  714 --LYFTKWNGLAD------LKMMNMMGYDAMTFGNHEFDKGPTVLSDFLSGNSATVDPAN    765

Query:  217 --------LPILNANVLDFKTHQPVFKTYDIITKTF----KDSTGRAVALNIGITG--IV    262
                     PI++ANV    +++P K++    +TF    K  G       + + G  +
Sbjct:  766 RYHFEAPEFPIVSANV--DVSNEPKLKSFVKKPQTFTAGEKKEAGIHPYILLDVDGEKVA    823

Query:  263 PPQILNWDKANLE--GKVIV--------KDSVKAIEEIVPTMRAKGADVILVLSHSGIGD    312
            +    D A    GK IV         +++VKAI+E        +   I+ L+H G
Sbjct:  824 VFGLTTEDTATTSSPGKSIVFNDAFETAQNTVKAIQE------EEKVNKIIALTHIG---    874

Query:  313 DRYEEGEENVGYQIA-SIKGVDAVVTGHSAEFPSGNGTGFYEKYTGVDGINGKINGTP-    370
                  N   ++A  +KG+D  ++ GH+H                T  VD +     N   P
Sbjct:  875 -------HNRDLELAKKVKGIDLIIGGHTH---------------TLVDKMEVVNNEEPT    912
```

-continued

```
           371 -VTMAGKYGDHLGIIDLGLSYTNGKWQVSESSAKIRKIDMNSTTADERIIALAKEAHDGT   429

Query:
                   V  A +YG  LG +D+       G  Q  +S+  +  ID ++       E     AK+  D
Sbjct:     913 IVAQAKEYGQFLGRVDVAFD-EKGVVQTDKSNLSVLPIDEHTEENPE-----AKQELDQF   966

Query:     430 INYV----RQQVGTTTAPITSYFALVKDDPSVQIVNNAQRWYVANELKGTPEANLPLLSA   485
               N +    ++VG T              +  + QR +V  +              + A
Sbjct:     967 KNELEDVKNEKVGYT----------------DVALDGQREHVRTKETNLGNFIADGMLA  1009

Query:     486 AAPFKAGTRGDAT----AYTDIPAGPVAIKNVADLYLYDNVTALLKVTGADLREWLEMSA   541
                 A    AG R    T          I  G ++  V ++  + N    +TG  ++E LE
Sbjct:    1010 KAKEAAGARIAITNGGGIRAGIDKGDITLGEVLNVMPFGNTLYVADLTGKQIKEALE---  1066

Query:     542 GQFNQIDPNNKAPQNIINTEYRTYNFDVIDGLTYKFDITQPNKYNKDGKVVNSQASRVRD   601
                              Q + N E       F  + G+ Y F +     NK G      + V+
Sbjct:    1067 -------------QGLSNVENGGGAFPQVAGIEYTFTLN-----NKPG----HRVLEVKI  1104

Query:     602 LMYNGKPVADKQE--FMIVTNNYRASG                                   626
                  NG  VA  +  + + TNN+  +G
Sbjct:    1105 ESPNGDKVAINTDDTYRVATNNFVGAG                                  1131
```

There is also homology to SEQ ID 1608. A related sequence was also identified in GAS <SEQ ID 9129> which encodes the amino acid sequence <SEQ ID 9130>. Analysis of this protein sequence reveals the following:

```
Possible cleavage site: 27
>>> Seems to have an uncleavable N-term signal seq
INTEGRAL    Likelihood = -4.67 Transmembrane 649-665  (648-666)
INTEGRAL    Likelihood = -2.02 Transmembrane   6-22   (5-22)
PERIPHERAL  Likelihood =  1.85
```

Based on this analysis, it was predicted that these proteins and their epitopes could be useful antigens for vaccines or diagnostics.

A related GBS gene <SEQ ID 8585> and protein <SEQ ID 8586> were also identified. Analysis of this protein sequence reveals the following:

```
Lipop: Possible site: -1 Crend: 7
McG: Discrim Score: 6.68
GvH: Signal Score (-7.5): 0.87
      Possible site: 28
>>> Seems to have a cleavable N-term signal seq.
ALOM program count: 1 value: -5.79 threshold: 0.0
    INTEGRAL       Likelihood = -5.79    Transmembrane    779-795 (778-797)
    PERIPHERAL     Likelihood =  0.53    251
modified ALOM score: 1.66
*** Reasoning Step: 3

----- Final Results -----
            bacterial membrane --- Certainty = 0.3314(Affirmative) < succ>
            bacterial outside  --- Certainty = 0.0000(Not Clear)   < succ>
            bacterial cytoplasm --- Certainty = 0.0000(Not Clear)  < succ>
LPXTG motif: 769-773
```

The protein has homology with the following sequences in the databases:

```
ORF01378(298-2337 of 3000)
GP|6782402|emb|CAB70615.1||AJ133440(1-680 of 683) cyclo-nucleotide
phosphodiesterase, putative
{Streptococcus dysgalactiae subsp. equisimilis}
% Match = 38.3
% Identity = 59.0  % Similarity = 72.3
Matches = 403  Mismatches = 181  Conservative Sub.s = 91
```

```
          105        135        165        195        225        255        285        315
LFYHFLT*K*KKLEAQKELXTK*MCLTKLSFINKRLFLV*SLKIIRK*D*LNVFNKL**FL *DNIHVMF*WRRFMSKHY
                                                                            |:| |
                                                                            MMTKGY 345        375        405        435        465        495        525        555
FSKSVFALTVLTATATSGLAVQAEDIVTTPSSTSTKVESTTPTSTIAEEKSNVTSTPTAITDASTATSTNTTTNNQNPQP
 |||    |  : |     |    : :    :|| :     |:|     :|| |:    ||     |   : :  :
MSKSAIFLAMLVAAGSAQLT-KAEETTAVEPLTTT-ANTTTSTAVPAETAPLVADTTPATATADTAVPSPVNSTSSE-MA
           20         30         40         50         60         70         80

585        615        645        675        705        735        765        795
VATEATTSDLKPIEGEKVDLRIMSTTDLHTNLVNYDYYQDKESQKIGLAKTAVLIEEAKKENPNTVLVDNGDVIQGTPLG
 |:       :|:||: ||:||:|||||||:|||||||||||||:| :||||||||||: ||||| || ||||::||||
TASADNATVTAPVEGQSVDVRILSTTDLHSNLVNYDYYQDKEAQSLGLAKTAVLIDAAKKENSNVVLVDNGDILQGTPLA
           100        110        120        130        140        150        160

825        855        885        915        945        975       1005       1035
TYKAIVKPVAENEEHPMYQAMNALGYDASTLGNHEFNYGLDYLKKIIATANLXILNANVLDFKTHQPVFKTYDIITKTFK
|||||| ||  :| ||||||:  ||:||||||||||||||||| :::  ||| ||| |||||:  |:|||||||||||
TYKAIVDPVEADEVHPMYAALKALNFDASTLGNHEFNYGLDYLDRVMATAGLPIGNVNVLDAKTGKPKFKPFDIITKTFT
           180        190        200        210        220        230        240

1065       1095       1125       1155       1185       1215       1243       1273
DSTGRAVALNIGITGIVPPQILNWDKANLEGKVIVKDSVKAIEEIVPTMRAKGADVILVS TLALEMIDMKKVKKTLAI
|  |: :| ||||| |||||::||||||| |:||| |:|:::  ||| |||:|||| |||  | | |||   || ||
DKDGKTVSLKIGITGVVPPQIMSWDKANLTGKVTVKDAVEAVKEVIPTIRAAGADLVLVLA!TLVSVMTSMKSVKKMLVT
           260        270        280        290        300        310        320

1303       1357       1387       1416       1446       1476       1500
KLPASREWMPLLRDTHTL--NFHQVTVLASMKNTLELMVSM KINGTPVTMAGKYGDHLGIIDLGLSYTNGKWQVS--ES
||  |:   : |:    |    :|: |  |:|: |:|| |  |||:||||:|||||||| |||||:|| |||::|: :|
KLLALKVLMQWSQAIHMLISQPYQMAVFTITSKVLMVKRAL!-INGVPVTMGGKYGDHLGLIDLNLTYTNGQWKVNKDQS
           340        350        360        370        380        390        400

1530       1560       1590       1620       1650       1680       1710       1740
SAKIRKIDMNSTTADERIIALAKEAHDGTINYVRQQVGTTTAPITSYFALVKDDPSVQIVXNAQRWYVANELKGTPEANL
|: |:||  |   |     ||||||||||||:  |||||||||||:|||||||||:||||||||||:|| :||||||||
RAETRQIDSKSNQVDPTIIALAKEAHDGTVAYVRQQVGTTTAPINSYFALIKDDPSIQIVNNAQRWYAEKELAGTPEANL
           410        420        430        440        450        460        470        480

1770       1800       1830       1860       1887       1917       1947       1977
PLLSAAAPFKAGTRGDATAYTDIPAGPVAIKNVADLYLYDNVTAL-LKVTGADLREWLEMSAGQFNQIDPNNKAPQNIIN
||||||||||||   |  ||  |   ::  :: :   :   :  ||||||||:||||||||||||:||| :::  |:::|
PLLSAAAPFKAGYTKMMRQLILIFLLVQSLSKMSLTFTCTTTSLLFLKVTGADLKEWLEMSAGQFNTIDPSKSEPQDLVN
           490        500        510        520        530        540        550        560

2007       2037       2067       2097       2127       2157       2187       2217
TEYRTYNFDVIDGLTYKFDITQPNKYNKDGKVVNSQASRVRDLMYNGKPVADKQEFMIVTNNYRASGTFPGAKNATMNRL
| ||||||||||||||:||||:|:| |:| :  ||| |||||||| || |:|||||:|:|||||||| ||| ||||:|||
TSYRTYNFDVIDGLTYEFDVTQKNKYDSKGNLVNPDASRVRNLKYMGKDIDPKQEFMVVTNNYRASGNFPGVKNATLNRL
           570        580        590        600        610        620        630        640

2247       2277       2307       2337       2367       2397       2427       2457
LNLENRQTIINYIISEKTINPTADNNWGFTESIKDLDLRFQTADKAKNLVTNSKDIQYIASSTKDEGFGDYRFVYTEQEK
|||||||  |||| :||||||:|||||  |  ||    ||| :|  || :
LNLENRQAIINYIVAEKTINPSADNNWYFADTIKGLNLRFLKR
           650        660        670        680
```

Figure 196:
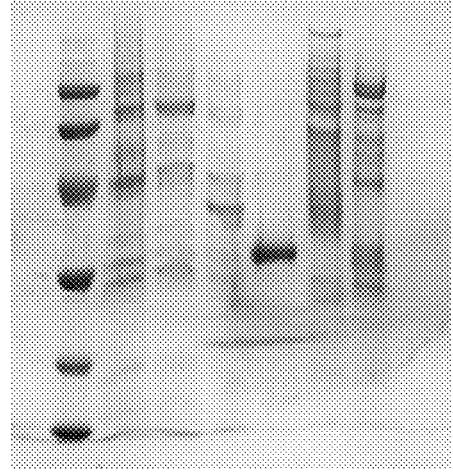

SEQ ID 8586 (GBS53) was expressed in *E. coli* as a His-fusion product. The purified protein is shown in FIG. 196, lane 9.

EXAMPLE 502

A DNA sequence (GBSx0540) was identified in *S. agalactiae* <SEQ ID 1609> which encodes the amino acid sequence <SEQ ID 1610>. Analysis of this protein sequence reveals the following:

```
Possible site: 24
>>> Seems to have no N-terminal signal sequence

----- Final Results -----
            bacterial cytoplasm --- Certainty = 0.0296(Affirmative) < succ>
            bacterial membrane  --- Certainty = 0.0000(Not Clear)   < succ>
            bacterial outside   --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 503

A DNA sequence (GBSx0541) was identified in *S. agalactiae* <SEQ ID 1611> which encodes the amino acid sequence <SEQ ID 1612>. Analysis of this protein sequence reveals the following:

```
Possible site: 18
>>> Seems to have no N-terminal signal sequence

----- Final Results -----
            bacterial cytoplasm --- Certainty = 0.1504(Affirmative) < succ>
            bacterial membrane  --- Certainty = 0.0000(Not Clear)   < succ>
             bacterial outside  --- Certainty = 0.0000(Not Clear)   < succ>
```

A related GBS nucleic acid sequence <SEQ ID 10195> which encodes amino acid sequence <SEQ ID 10196> was also identified.

The protein has homology with the following sequences in the GENPEPT database:

```
>GP: CAB12860 GB: Z99109 similar to glucanase [Bacillus subtilis]
Identities = 212/345 (61%), Positives = 268/345 (77%), Gaps = 1/345 (0%)

Query:   30 SMETTLNYIKTLTSIPSPTGFTQTIMTYIIKELEAFGYSPIRTNKGGVMVSLKGKNDTKH    89
            S+  T+  IK L SIPSPTG T  ++ YI   L+ +     +R +KGG++ +L G++ ++H
Sbjct:    3 SVRKTMELIKELVSIPSPTGNTYEVINYIESLLKEWKVETVRNHKGGLIATLPGRDTSRH    62

Query:   90 RMITAHLDTLGAMVRAIKPDGRLKIDLIGGYTYNAIEGENCTIHLSKNGKEISGTALIHQ   149
            RM+TAH+DTLGAMV+  IK DGRLKIDLIGG+  YN+IEGE C  I  +  +GK  +GT L+HQ
Sbjct:   63 RMLTAHVDTLGAMVKEIKADGRLKIDLIGGFRYNSIEGEYCQIETA-SGKMYTGTILMHQ   121

Query:  150 TSVHVYKDAGTAERNQTNMEIRLDEKVTTADETRALGIQVGDFISFDPRTIITDSGFIKS   209
            TSVHVYKDAG AERNQ NMEIRLDE V   +T  LGI VGDF+SFDPR  IT SGFIKS
Sbjct:  122 TSVHVYKDAGKAERNQENMEIRLDEPVHCRKDTEELGIGVGDFVSFDPRVEITSSGFIKS   181

Query:  210 RYLDDKVSAGILMELLSVYKKEDIQLPYTTHFYFSAFEELGHGANSSIPNETVEYLAVDM   269
            R+LDDK S +L+ L+    + EDI+LPYTTHF   S  EE+G+G NS+IP ETVEYLAVDM
Sbjct:  182 RHLDDKASVALLLRLIHEIQTEDIELPYTTHFLISNNEEIGYGGNSNIPPETVEYLAVDM   241

Query:  270 GAMGDDQETDEYTVSICVKDASGPYHYELRQHLVSLAENNNIPYKLDIYPYYGSDASAAM   329
            GA+GD Q  TDEY+VSICVKDASGPYHY+LR+HLV LAE ++I YKLDIYPYYGSDASAA+
Sbjct:  242 GAIGDGQATDEYSVSICVKDASGPYHYQLRKHLVQLAEKHHIDYKLDIYPYYGSDASAAI   301

Query:  330 RAGAEVKHALLGAGIESSHSYERTHIDSIQATELLVDAYLKSNMV                 374
            ++G ++ H L+G GI++SH++ERTH  S++ T  L+  Y++S MV
Sbjct:  302 KSGHDIVHGLIGPGIDASHAFERTHKSSLRHTAKLLYYVQSPMV                  346
```

There is also homology to SEQ ID 424.

Based on this analysis, it was predicted that these proteins and their epitopes could be useful antigens for vaccines or diagnostics.

EXAMPLE 504

A DNA sequence (GBSx0542) was identified in *S. agalactiae* <SEQ ID 1613> which encodes the amino acid sequence <SEQ ID 1614>. Analysis of this protein sequence reveals the following:

```
Possible site: 20
>>> Seems to have no N-terminal signal sequence
```

```
----- Final Results -----
          bacterial cytoplasm --- Certainty = 0.3157(Affirmative) < succ>
           bacterial membrane --- Certainty = 0.0000(Not Clear)   < succ>
            bacterial outside --- Certainty = 0.0000(Not Clear)   < succ>
```

The protein has homology with the following sequences in the GENPEPT database:

```
>GP: AAF11472 GB: AE002031 conserved hypothetical protein
[Deinococcus radiodurans]
Identities = 55/150 (36%), Positives = 85/150 (56%), Gaps = 2/150 (1%)

Query:    5 LIIIRGNSASGKSTIAKQLQAELGENTLLLSQDYLRREMLGTKDGENTTTIPLLINLLNY   64
            LI++RGNS SGKS++A+ L+    G    + QDYLRR +L    D       I L+   + Y
Sbjct:   23 LIVLRGNSGSGKSSVARALRERFGYGLAWVEQDYLRRVLLREHDVAGGKNIGLIETNVRY   82

Query:   65 GYHNCSYIILEGILRSDWYTPVWKHILKHNPNNTYAYYYDLSFQETVKRHSTRLKSLEFG  124
                 S  +LEGIL S  Y P+ + +  H    + +Y+DL F+ETV+RH+TR ++ +FG
Sbjct:   83 CLSAGSVTVLEGILFSRHYGPMLERL--HADFGGHWFYFDLPFEETVRRHATRPQAADFG  140

Query:  125 EDSLARWWLEKDFLKEIPEKILTKAMSLED                               154
              +    W+  +D L   + E+++  A SL D
Sbjct:  141 VQDMQAWFQARDVLPFVQEQLIGPASSLAD                               170
```

No corresponding DNA sequence was identified in *S. pyogenes*.

Based on this analysis, it was predicted that this protein and its epitopes, could be useful antigens for vaccines or diagnostics.

EXAMPLE 505

A DNA sequence (GBSx0543) was identified in *S. agalactiae* <SEQ ID 1615> which encodes the amino acid sequence <SEQ ID 1616>. This protein is predicted to be periplasmic-iron-binding protein BitC. Analysis of this protein sequence reveals the following:

```
Possible site: 29
>>> Seems to have an uncleavable N-term signal seq
     INTEGRAL      Likelihood = -11.46      Transmembrane    9-25 (5-30)

----- Final Results -----
           bacterial membrane --- Certainty = 0.5585(Affirmative) < succ>
            bacterial outside --- Certainty = 0.0000(Not Clear)   < succ>
          bacterial cytoplasm --- Certainty = 0.0000(Not Clear)   < succ>
```

The protein has homology with the following sequences in the GENPEPT database:

```
>GP: AAD18094 GB: U75349 periplasmic-iron-binding protein BitA
[Brachyspira hyodysenteriae] (ver 2)
Identities = 114/331 (34%), Positives = 184/331 (55%), Gaps = 3/331 (0%)

Query:   11 YILLVVSIIFISVFTYSISQPSKLLPPKELVILSPNSQAILTGTIPAFEEKY-GIKVKLI   69
            +I+ + ++ +++F  S  SK      LVI  +  ++   +   F+ K    I V+++
Sbjct:    4 FIIFCMLMLSMTLFYSCSSGDSK--NANSLVIYCSHPLDLMNTILDDFKAKNPDINVEVV   61

Query:   70 QGGTGQLIDRLSKEGKQLKADIFFGGNYTQFESHKALFESYVSKNVHTVIPDYIHPSDTA  129
            GTG+L+ R+  E     D+ +GG    +S   LFE+Y S N     ++ ++  +
Sbjct:   62 TAGTGELLKRVEAEKMNPLGDVLWGGTLNSVKSKTDLFENYTSTNEANILDEFKNTEGPF  121

Query:  130 TPYTINGSVLIVNNELAKGLTIKSYEDLLQPSLKGKIAFADPNTSSSAFSQLTNILLAKG  189
            T ++     S+L+VN   LA   + I+  YEDLL  P  LKGKIA ADP+ SSSAF  L N+L A G
Sbjct:  122 TRFSAIPSILMVNTNLAGNIKIEGYEDLLNPELKGKIAAADPSASSSAFEHLVNMLYAMG  181

Query:  190 GYTNPKAWNYVKKLQHNINAIKSSSSSEVYQSVAEGKMIVGLTYEDPSVNLQKSGANVSI  249
                 K  W+YV+KL   N++      S SS VY+  VA+G+  VGLTYE+P ++    SG+ V +
Sbjct:  182 KGDPEKGWDYVQKLCANLDGKLLSGSSAVYKGVADGEYTVGLTYEEPGISYMSSGSPVKV  241

Query:  250 VYPTEGTVFVPSSVAIIKNAPSMKEAKLFINFMLSLDVQNAFGQSTSNRPIRKDAQTSNG  309
```

```
                                -continued
          +Y   EG +   P   V IIK      +++ AK FI++ +SLD QN    +  S R IR DA  ++
Sbjct: 242 IYMKEGVISKPDGVYIIKGGKNLENAKKFIDYCVSLDAQNMLVEKLSRRSIRSDAVVTDM  301

Query: 310 MKALKDIATLKEDYRYVTKHKGQILKTYNRI                               340
           +K + +I ++ ++    V + + + L  +  I
Sbjct: 302 VKPMSEIYSITDNADVVEESRQKWLDKFKDI                               332
```

A related DNA sequence was identified in *S. pyogenes* <SEQ ID 1617> which encodes the amino acid sequence <SEQ ID 1618>. Analysis of this protein sequence reveals the following:

```
Possible site: 33
>>> Seems to have an uncleavable N-term signal seq
      INTEGRAL       Likelihood = -13.16         Transmembrane     9-25 (4-33)

----- Final Results -----
               bacterial membrane --- Certainty = 0.6265(Affirmative) < succ>
                bacterial outside --- Certainty = 0.0000(Not Clear)   < succ>
              bacterial cytoplasm --- Certainty = 0.0000(Not Clear)   < succ>
```

The protein has homology with the following sequences in the databases:

```
>GP: AAB95371 GB: U75349 periplasmic-iron-binding protein BitC
[Brachyspira hyodysenteriae]
Identities = 115/324 (35%), Positives = 177/324 (54%),
Gaps = 8/324 (2%)

Query:  15 VIIILAIVNVAMYIF-----SSSKKDSAKELVILTPNSQTILTGTIPAFEEKY-GVKVRL   68
           +++I  + ++++IF      S S     LVI P+   +   + F+ K  G+ V +
Sbjct:   4 IVLIFTSLLLSVFIFYSCSSSESGAQSGNSLVIYCPHPLEFINPLVDDFKAKNPGINVDI   63

Query:  69 IQGGTGQLIDQL-GRKDKPLNADIFFGGNYTQFESHKDLFESYVSPQVSTVISDYQLPSH  127
            I GTG+L+ ++   KD PL  DI +GG  +    DLFESY S      +    Y+
Sbjct:  64 IAAGTGELLKRVESEKDNPLG-DILWGGTISMAKPKIDLFESYTSTNEENIAEIYKNTEG  122

Query: 128 RATPYTINGSVLIVNNELARGLHITSYEDLLQPALKGKIAFADPNSSSSAFSQLTNILLA  187
             T  T    S+L+VN  LA  + I  YEDLL P LKGKIAFADP++SSS+F  L N+L A
Sbjct: 123 ALTRCTAVPSILMVNTNLAGDIKIEGYEDLLNPELKGKIAFADPSASSSSFEHLVNMLYA  182

Query: 188 KGGYTNADAWAYMKRLLVNMNSIRATSSSEVYQSVAEGKMIVGLTYEDPCINLQKSGANV  247
             G     W Y+ +L  N++     + SS VY+ VA+G+  VGLT+E+     N   +G+ V
Sbjct: 183 IGKGDPEKGWDYVSKLCANLDGKLLSGSSAVYKGVADGEYTVGLTFEEGGANYVSAGSPV  242

Query: 248 SIVYPKEGTVFVPSSVAIIKHAPNMTEAKLFINFMLSRDVQNAFGQSTSNRPIRQDAQTS  307
            +VY KEG +  P  + IIK+A N+  AK F+++  S D Q       + R +R D    S
Sbjct: 243 KLVYMKEGVIIKPDGIYIIKNAKNLENAKKFVDYATSYDAQKTITDKLNRRSVRGDLPPS  302

Query: 308 HDMKALETIATLKEDYAYVTKHKK                                     331
            +++++TI  +  +D A V  ++K+
Sbjct: 303 AILQSVDTINVITDDEAVVDQNKQ                                     326
```

An alignment of the GAS and GBS proteins is shown below:

```
Identities = 257/345 (74%), Positives = 295/345 (85%),
Gaps = 1/345 (0%)

Query:   1 MKEKQSKRLIYILLVVSIIFISVFTYSISQPSKLLPPKELVILSPNSQAILTGTIPAFEE   60
           +K K+    L ++L+++  +  ++V  Y  S  SK    KELVIL+PNSQ ILTGTIPAFEE
Sbjct:   2 LKLKRKWLLSFLLVIIILAIVNVAMYIFSS-SKKDSAKELVILTPNSQTILTGTIPAFEE   60

Query:  61 KYGIKVKLIQGGTGQLIDRLSKEGKQLKADIFFGGNYTQFESHKALFESYVSKNVHTVIP  120
           KYG+KV+LIQGGTGQLID+L ++  K L ADIFFGGNYTQFESHK LFESYVS  V TVI
Sbjct:  61 KYGVKVRLIQGGTGQLIDQLGRKDKPLNADIFFGGNYTQFESHKDLFESYVSPQVSTVIS  120

Query: 121 DYIHPSDTATPYTINGSVLIVNNELAKGLTIKSYEDLLQPSLKGKIAFADPNTSSSAFSQ  180
           DY  PS  ATPYTINGSVLIVNNELA+GL I SYEDLLQP+LKGKIAFADPN+SSSAFSQ
Sbjct: 121 DYQLPSHRATPYTINGSVLIVNNELARGLHITSYEDLLQPALKGKIAFADPNSSSSAFSQ  180

Query: 181 LTNILLAKGGYTNPKAWNYVKKLQHNINAIKSSSSEVYQSVAEGKMIVGLTYEDPSVNL   240
           LTNILLAKGGYTN   AW Y+K+L  N+N+I+++SSSEVYQSVAEGKMIVGLTYEDP +NL
```

```
                            -continued
Sbjct: 181 LTNILLAKGGYTNADAWAYMKRLLVNMNSIRATSSSEVYQSVAEGKMIVGLTYEDPCINL  240

Query: 241 QKSGANVSIVYPTEGTVFVPSSVAIIKNAPSMKEAKLFINFMLSLDVQNAFGQSTSNRPI  300
           QKSGANVSIVYP EGTVFVPSSVAIIK+AP+M EAKLFINFMLS DVQNAFGQSTSNRPI
Sbjct: 241 QKSGANVSIVYPKEGTVFVPSSVAIIKHAPNMTEAKLFINFMLSRDVQNAFGQSTSNRPI  300

Query: 301 RKDAQTSNGMKALKDIATLKEDYRYVTKHKGQILKTYNRIRRNAD                 345
           R+DAQTS+ MKAL+ IATLKEDY YVTKHK +I+ TYN++R+  +
Sbjct: 301 RQDAQTSHDMKALETIATLKEDYAYVTKHKKKIVATYNQLRQRLE                 345
```

SEQ ID 1616 (GBS263) was expressed in *E. coli* as a GST-fusion product. SDS-PAGE analysis of total cell extract is shown in FIG. 49 (lane 4; MW 63 kDa).

Figure 301:
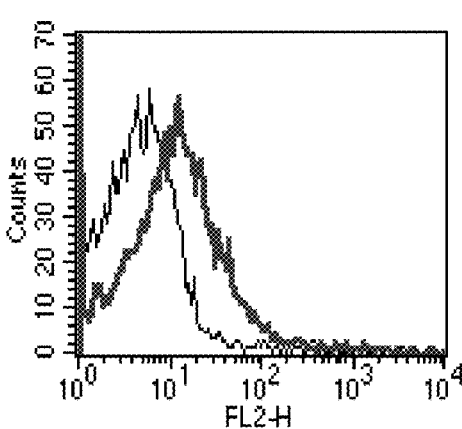

The GBS263-GST fusion product was purified (FIG. 205, lane 5) and used to immunise mice. The resulting antiserum was used for FACS (FIG. 301), which confirmed that the protein is immunoaccessible on GBS bacteria.

Based on this analysis, it was predicted that these proteins and their epitopes could be useful antigens for vaccines or diagnostics.

EXAMPLE 506

A DNA sequence (GBSx0544) was identified in *S. agalactiae* <SEQ ID 1619> which encodes the amino acid sequence <SEQ ID 1620>. This protein is predicted to be response regulator. Analysis of this protein sequence reveals the following:

```
Possible site: 37
>>> Seems to have no N-terminal signal sequence

----- Final Results -----
              bacterial cytoplasm --- Certainty = 0.4733(Affirmative) < succ>
              bacterial membrane  --- Certainty = 0.0000(Not Clear)   < succ>
                bacterial outside --- Certainty = 0.0000(Not Clear)   < succ>
```

The protein has homology with the following sequences in the GENPEPT database:

```
>GP: AAF31452 GB: AF221126 putative response
regulator [Streptococcus pneumoniae]
Identities = 85/252 (33%), Positives = 147/252 (57%),
Gaps = 17/252 (6%)

Query:   2 YRLLIVEDEHLIRKWLRYAIDYQSLNILVVGEAKDGKEGAQLIQEEQPDIVLSDINMPIM   61
           Y +LIVEDE+L+R+ L    ++   + ++ ++G+A++G++   +LIQ++ PDI+L+DINMP +
Sbjct:   3 YTILIVEDEYLVRQGLTKLVNVAAYDMEIIGQAENGRQAWELIQKQVPDIILTDINMPHL   62

Query:  62 TAFDMFEATKGQSYAK---IILSGYADFPNAQSAIHYGVLEFLTKPLEKQALIDCLKTIM  118
             +    + ++Y +    + L+GY DF  A  SA+  GV ++L KP  +Q + + L   I
Sbjct:  63 NGIQLASLVR-ETYPQVHLVFLTGYDDFDYALSAVKLGVDDYLLKPFSRQDIEEMLGKIK  121

Query: 119 ARIE-EHKEKHLQEHTELYLPLPQANDQVPEVIKDMLAWIHSHFHGKIVISQLAHDLGYS  177
           +++  E KE+ LQ+      L    + + I+  LA        +   + LA DLG+S
Sbjct: 122 QKLDKEEKEEQLQD-----LLTNRFEGNMAQKIQSHLA------DSQFSLKSLASDLGFS  170

Query: 178 ESYLYTVTKKHLHITLSDYINQYRINQAIQLMFREPDLMVYQIAEAVGIYDYRYFDRVFK  237
            +YL ++ KK L +    DY+ + R+ QA +L+     DL +Y+IAE VG  D   YF + FK
Sbjct: 171 PTYLSSLIKKELGLPFQDYLVRERVKQA-KLLLLTTDLKIYEIAEKVGFEDMNYFTQRFK  229

Query: 238 KYLGQTVKAFKE                                                 249
           +  G T + FK+
Sbjct: 230 QIAGVTPRQFKK                                                 241
```

A related DNA sequence was identified in *S. pyogenes* <SEQ ID 1621> which encodes the amino acid sequence <SEQ ID 1622>. Analysis of this protein sequence reveals the following:

```
Possible site: 36
>>> Seems to have no N-terminal signal sequence

----- Final Results -----
          bacterial cytoplasm --- Certainty = 0.4239(Affirmative) < succ>
           bacterial membrane --- Certainty = 0.0000(Not Clear)   < succ>
             bacterial outside --- Certainty = 0.0000(Not Clear)   < succ>
```

An alignment of the GAS and GBS proteins is shown below:

```
Identities = 193/257 (75%), Positives = 226/257 (87%)

Query:    1 MYRLLIVEDEHLIRKWLRYAIDYQSLNILVVGEAKDGKEGAQLIQEEQPDIVLSDINMPI    60
            MY+L+I+EDEH+IRKWLRYAIDY++L+ILV+GEAKDGKEGA LI+E QPDIVL+DINMPI
Sbjct:    1 MYKLVIIEDEHIIRKWLRYAIDYKALDILVIGEAKDGKEGAVLIKESQPDIVLTDINMPI    60

Query:   61 MTAFDMFEATKGQSYAKIILSGYADFPNAQSAIHYGVLEFLTKPLEKQALIDCLKTIMAR   120
            MTAFDMFE TK Q+YAKIILSGYADFPNA+SAIHYGVLEFLTKP+EK AL +CL+TI+A+
Sbjct:   61 MTAFDMFEVTKDQTYAKIILSGYADFPNARSAIHYGVLEFLTKPIEKAALWECLQTIIAK   120

Query:  121 IEEHKEKHLQEHTELYLPLPQANDQVPEVIKDMLAWIHSHFHGKIVISQLAHDLGYSESY   180
            IE+ K  + +    +Y+PLPQ  DQ+PEV+KD+L W+H+HF  KI   S+LAHDLGYSESY
Sbjct:  121 IEKQKGSNQKTDACVYIPLPQMTDQIPEVVKDILEWVHAHFQDKISTSRLAHDLGYSESY   180

Query:  181 LYTVTKKHLHITLSDYINQYRINQAIQLMFREPDLMVYQIAEAVGIYDYRYFDRVFKKYL   240
            +Y   KKHL + LSDYINQYRINQAIQLM +EPDLMVY+IA+AVGIYDYRYFDRVFKKYL
Sbjct:  181 IYQNIKKHLQMPLSDYINQYRINQAIQLMQQEPDLMVYEIAQAVGIYDYRYFDRVFKKYL   240

Query:  241 GQTVKAFKEEHIFKQMD                                             257
            GQTVKAFKEEH  K D
Sbjct:  241 GQTVKAFKEEHFMKDTD                                             257
```

Based on this analysis, it was predicted that these proteins and their epitopes could be useful antigens for vaccines or diagnostics.

EXAMPLE 507

A DNA sequence (GBSx0545) was identified in *S. agalactiae* <SEQ ID 1623> which encodes the amino acid sequence <SEQ ID 1624>. Analysis of this protein sequence reveals the following:

```
Possible site: 14
>>> Seems to have no N-terminal signal sequence

----- Final Results -----
          bacterial cytoplasm --- Certainty = 0.2964(Affirmative) < succ>
           bacterial membrane --- Certainty = 0.0000(Not Clear)   < succ>
             bacterial outside --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 508

A DNA sequence (GBSx0546) was identified in *S. agalactiae* <SEQ ID 1625> which encodes the amino acid sequence <SEQ ID 1626>. This protein is predicted to be two-component sensor histidine kinase. Analysis of this protein sequence reveals the following:

```
Possible site: 45
>>> Seems to have no N-terminal signal sequence
    INTEGRAL    Likelihood = -13.80    Transmembrane   266-282 (257-285)
    INTEGRAL    Likelihood = -12.90    Transmembrane    29-45  (24-51)

----- Final Results -----
           bacterial membrane --- Certainty = 0.6519(Affirmative) < succ>
             bacterial outside --- Certainty = 0.0000(Not Clear)   < succ>
          bacterial cytoplasm --- Certainty = 0.0000(Not Clear)   < succ>
```

A related GBS nucleic acid sequence <SEQ ID 10197> which encodes amino acid sequence <SEQ ID 10198> was also identified.

The protein has homology with the following sequences in the GENPEPT database:

```
>GP: BAB05628 GB: AP001513 two-component sensor histidine kinase
[Bacillus halodurans]
Identities = 84/258 (32%), Positives = 138/258 (52%), Gaps = 23/258 (8%)

Query: 298 SSAINQMVLDMDAISRQEKSSIELDSQDEFQYLSVQINQMVSRLKDLHEKTLDLETQKLL  357
              S  INQ+       S    K+ I +D +DE     LSVQ NQMV+ L+ L  +  +    QK L
Sbjct: 327 SERINQVA------SGDLKTKIVVDGKDEIGQLSVQFNQMVANLRSLIHQVHETNRQKRL  380

Query: 358 FEK-------RMLEAQFNPHFLYNTLETILITSHYDSQL-TERIVIQLTKLLRYSLSGST  409
              EK           +ML +Q NPHFL+NTLE+I + SH   +    ++V QL KL+R SL  +
Sbjct: 381 LEKSQNEIKLKMLASQINPHFLFNTLESIRMKSHMKGETEIAKVVKQLGKLMRKSLEVTG  440

Query: 410 EAAVLKDDLAIIESYLLINQVRF-EELTYTISVSPELEHMRVPKLFLLPLIENAIKYGLK  468
                       L+++L ++   YL I   R+ + L Y + + P+ E + +   L + PL+ENA+ +GL+
Sbjct: 441 HHIPLRNELDMVRCYLEIQTFRYGDRLHYELYIDPQSEMVEILPLIIQPLVENAVIHGLE  500

Query: 469 ERHD-VAINIDIWQDSDGIWFTVSNNGSGISLARQQAIRTMLRSTH----SHHGLINSYR  523
                         D   + I     + + +     V+++G G+    + +AI+ ML             +     GL+N ++
Sbjct: 501 RTEDGGTVTISTIVNGNDLTVIVNDDGCGMDEEKLEAIQNMLHHPQEVDGNKIGLLNVHK  560

Query: 524 RLQYQF---STVLLEFTK                                           538
              RLQ +       S +++E  K
Sbjct: 561 RLQLTYGKTSGLIIESAK                                           578
```

A related DNA sequence was identified in *S. pyogenes* <SEQ ID 1627> which encodes the amino acid sequence <SEQ ID 1628>. Analysis of this protein sequence reveals the following:

```
Possible site: 43
>>> Seems to have no N-terminal signal sequence
    INTEGRAL    Likelihood = -10.88    Transmembrane    27-43   (22-49)
    INTEGRAL    Likelihood =  -9.08    Transmembrane   263-279 (258-282)

----- Final Results -----
            bacterial membrane  --- Certainty = 0.5352(Affirmative) < succ>
            bacterial outside   --- Certainty = 0.0000(Not Clear)   < succ>
            bacterial cytoplasm --- Certainty = 0.0000(Not Clear)   < succ>
```

The protein has homology with the following sequences in the databases:

```
>GP: BAB05628 GB: AP001513 two-component sensor histidine kinase
[Bacillus halodurans]
Identities = 85/270 (31%), Positives = 139/270 (51%), Gaps = 20/270 (7%)

Query: 276 IFVILQRKSSGLANRIAAKNSRAINQMVRDMSAISRQEKRRIDLESQDEFQYLSDQINQM  335
              + V+L    S L ++  +  S  INQ+       S    K +I ++ +DE    LS Q NQM
Sbjct: 307 VAVLLIVHFSWLISKRLSHLSERINQVA------SGDLKTKIVVDGKDEIGQLSVQFNQM  360

Query: 336 VERLQQLHDKTLDLETQKLLFEK-------RMLEAQFNPHFLYNTLETILITSHYDSAL-  387
              V   L+ L  +  +    QK L  EK           +ML +Q NPHFL+NTLE+I + SH
Sbjct: 361 VANLRSLIHQVHETNRQKRLLEKSQNEIKLKMLASQINPHFLFNTLESIRMKSHMKGETE  420

Query: 388 TEKIVIQLTKLLRYSLTDSSKPVLLKDDLSVIESYLVINQVRF-EELQYSINLSPDLDSL  446
                  K+V QL KL+R SL   +   + L+++L ++   YL I   R+ + L Y + + P + +
Sbjct: 421 IAKVVKQLGKLMRKSLEVTGHHIPLRNELDMVRCYLEIQTFRYGDRLHYELYIDPQSEMV  480

Query: 447 EVPKLFLLPLIENAIKYGLKERHD-VKINIACYYQDDHIIFSVRDNGSGIDAHHQKVIRE  505
              E+  L + PL+ENA+ +GL+       D   + I+         + +  V D+G G+D      + I+
Sbjct: 481 EILPLIIQPLVENAVIHGLERTEDGGTVTISTIVNGNDLTVIVNDDGCGMDEEKLEAIQN  540

Query: 506 QL----EAGESHHGLINSYRRLKYHFSEVS                              531
                 L    E   + GL+N ++RL+   + + S
Sbjct: 541 MLHHPQEVDGNKIGLLNVHKRLQLTYGKTS                              570
```

An alignment of the GAS and GBS proteins is shown below:

```
Identities = 369/549 (67%), Positives = 449/549 (81%)

Query:    3 MRGYRNEERFKKRLQDDISKHFSRQSLILSLLLIALFVLFSLAPQQIGLYKDVNSVSYSY   62
            MRG ++EE FKK+LQDDIS+HFS QSL+LSLLLI LF++FSLAPQQ+GLY+D+N+ +  Y
Sbjct:    1 MRGEQVEEHFKKQLQDDISRHFSYQSLMLSLLLIGLFIIFSLAPQQLGLYRDINATATRY   60

Query:   63 KQLIQKHDTLLDDLGKNSLKPFVSGHLGSADLSKQYYHLRNHLQSQTELLVFSPNQELLF  122
            +LI K + LLDDLGKNSL PF++ +L +ADLSK Y+HLR+  Q+   ELL+FSP+Q+LLF
Sbjct:   61 HRLISKQEALLDDLGKNSLLPFLNKNLSTADLSKHYFHLRHSSQTSPELLLFSPSQDLLF  120

Query:  123 ASNSHLGNFFSKSIYISEVLDKAKINQRLLKIIVDSEGGHYLALIKPIIVNKKVSGYAFL  182
            ASM HLGN FSKS+YI EVL    + L K  +DSE GHYL +I P+I   ++ GYAFL
Sbjct:  121 ASNPHLGNVFSKSVYIQEVLRATHSPKTLFKDAMDSEDGHYLMIIMPMIDQNQLKGYAFL  180

Query:  183 LMNGKDFLLPTKAINSDLIIADQLNNSFTFTNRDFISSSLDKVDSQFLTRYFSFHDHRAF  242
            +M+GKDFL PTK + S+L+IAD+L+N+FTF+NR+FI+SSLDK++SQ+L  YF F D+RAF
Sbjct:  181 VMSGKDFLHPTKTLTSELVIADKLDNTFTFSNRSFIASSLDKINSQYLHHYFVFQDNRAF  240

Query:  243 VVRKVALQDNILLYMRPLIPVTLVVLFSLVSSVIIFVILRQKSRVLADRIAVKNSSAIN  302
            + RKVALQ +  LYMYRPLIP+  V+LFSL+SS +IFVIL++KS   LA+RIA KNS AIN
Sbjct:  241 ITRKVALQGGLWLYMYRPLIPMVSVMLFSLISSAVIFVILQRKSSGLANRIAAKNSRAIN  300

Query:  303 QMVLDMDAISRQEKSSIELDSQDEFQYLSVQINQMVSRLKDLHEKTLDLETQKLLFEKRM  362
            QMV DM AISRQEK  I+L+SQDEFQYLS QINQMV RL+ LH+KTLDLETQKLLFEKRM
Sbjct:  301 QMVRDMSAISRQEKRRIDLESQDEFQYLSDQINQMVERLQQLHDKTLDLETQKLLFEKRM  360

Query:  363 LEAQFNPHFLYNTLETILITSHYDSQLTERIVIQLTKLLRYSLSGSTEAAVLKDDLAIIE  422
            LEAQFNPHFLYNTLETILITSHYDS LTE+IVIQLTKLLRYSL+ S++   +LKDDL++IE
Sbjct:  361 LEAQFNPHFLYNTLETILITSHYDSALTEKIVIQLTKLLRYSLTDSSKPVLLKDDLSVIE  420

Query:  423 SYLLINQVRFEELTYTISVSPELEHMRVPKLFLLPLIENAIKYGLKERHDVAINIDIWQD  482
            SYL+INQVRFEEL Y+I++SP+L+ +  VPKLFLLPLIENAIKYGLKERHDV INI    +
Sbjct:  421 SYLVINQVRFEELQYSINLSPDLDSLEVPKLFLLPLIENAIKYGLKERHDVKINIACYYQ  480

Query:  483 SDGIWFTVSNNGSGISLARQQAIRTMLRSTHSHHGLINSYRRLQYQFSTVLLEFTKTDDA  542
              D I F+V +NGSGI    Q+ IR  L +   SHHGLINSYRRL+Y FS V L F + D
Sbjct:  481 DDHIIFSVRDNGSGIDAHHQKVIREQLEAGESHHGLINSYRRLKYHFSEVSLVFDQGDKQ  540

Query:  543 FRVSYIVKE                                                   551
            F VSY VKE
Sbjct:  541 FNVSYHVKE                                                   549
```

A related GBS gene <SEQ ID 8587> and protein <SEQ ID 8588> were also identified. Analysis of this protein sequence reveals the following:

```
Lipop: Possible site: -1 Crend: 10
McG: Discrim Score: 6.23
GvH: Signal Score (-7.5): -0.0500002
Possible site: 38
>>> Seems to have a cleavable N-term signal seq.
ALOM program count: 1 value: -13.80 threshold: 0.0
INTEGRAL   Likelihood - -13.80 Transmernbrane 259-275 ( 250-278)
PERIPHERAL Likelihood -   2.70 404
modified ALOM score: 3.26

*** Reasoning Step: 3

----- Final Results -----
           bacterial membrane --- Certainty = 0.6519(Affirmative) < succ>
             bacterial outside --- Certainty = 0.0000(Not Clear) < succ>
           bacterial cytoplasm --- Certainty = 0.0000(Not Clear) < succ>
```

The protein has homology with the following sequences in the databases:

```
33.2/53.9% over 181aa
Streptococcus pneumoniae
GP|5830535| histidine kinase Insert characterized ORF00032(1309-1848 of 2253)
GP|5830535|emb|CAB54576.1||AJ006396(1-182 of 231) histidine kinase
{Streptococcus pneumoniae}
% Match = 5.9
% Identity = 33.2  % Similarity = 53.8
Matches = 61   Mismatches = 78   Conservative Sub.s = 38
```

-continued

```
1053      1083      1113      1143      1173      1203      1233      1263
FVVRKVALQDNILLYMYRPLIPVTLVVLFSLVSSVIIFVILRQKSRVLADRIAVKNSSAINQMVLDMDAISRQEKSSIEL 1293      1323      1350      1380      1410      1440               1494
DSQDEFQYLSVQINQMVSRL-KDLHEKTLDLETQKLLFEKRMLEAQFNPHFLYNTLETILITSHYDSQ--LTERIVIQLT
                    |: || |::|:     || :    | |:|| |||:|||||  : : :   ||  | : |: :::
                    MLDRLEKNIHD-IYQLELSQKDANMRALQAQINPHFMYNTLEFLRMYAVMQSQDELAD-IIYEFS
                               10        20        30        40        50        60

1524      1554      1584      1611      1641      1671      1701      1728
KLLRYSLSGSTEAAVLKDDLAIIESYLLINQVRF-EELTYTISVSPELEHMRVPKLFLLPLIENAIKYGLKERH-DVAIN
||| ::|      :||  :|        |  : ||: : |    : |||||:::||: | ||:||    :|:   |   |:
SLLRNNIS-DERETLLKQELEFCRKYSYLCMVRYPKSIAYGFKIDPELENMKIPKFTLQPLVENYFAHGVDHRRTDNVIS
        80        90       100       110       120       130       140

1758      1788      1818      1848      1878      1908      1938      1968
IDIWQDSDGIWFTVSNNGSGISLARQQAIRTMLRSTHSHHGLINSYRRLQYQFSTVLLEFTKTDDAFRVSYIVKE*VMYR
|  :   :     | :||  |:  :     || |    :    |   |:|          |   |           |
IKALKQDGFVEILVVDNGRGMSAEKLANIREKLSQRYFEHQASYSDQRQSIGIVNVHERFVLYFGDRYAITIESAEQAGV
        160       170       180       190       200       210       220
```

SEQ ID 8588 (GBS47) was expressed in *E. coli* as a GST-fusion product. SDS-PAGE analysis of total cell extract is shown in FIG. 14 (lane 2; MW 84 kDa). It was also expressed in *E. coli* as a His-fusion product. SDS-PAGE analysis of total cell extract is shown in FIG. 85 (lane 4; MW 59.3 kDa).

Figure 221:
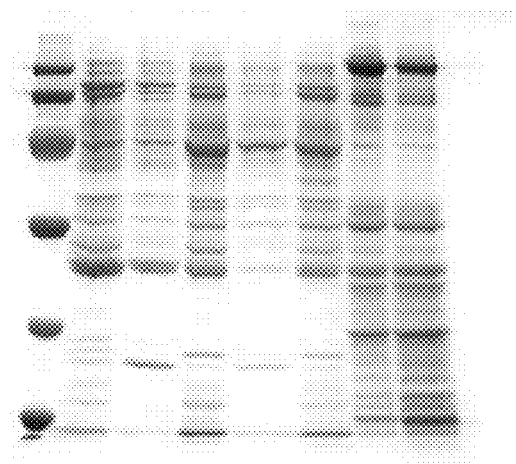

GBS47-His was purified as shown in FIG. 221, lane 4-5.

Based on this analysis, it was predicted that these proteins and their epitopes could be useful antigens for vaccines or diagnostics.

EXAMPLE 509

A DNA sequence (GBSx0547) was identified in *S. agalactiae* <SEQ ID 1629> which encodes the amino acid sequence <SEQ ID 1630>. This protein is predicted to be phosphotransferase enzyme II, D component. Analysis of this protein sequence reveals the following:

```
Possible site: 32
>>> Seems to have no N-terminal signal sequence
INTEGRAL Likelihood = -10.46 Transmembrane 258-274 ( 252-274)
INTEGRAL Likelihood =  -9.13 Transmembrane 232-248 ( 227-251)
INTEGRAL Likelihood =  -5.31 Transmembrane 142-158 ( 140-161)
INTEGRAL Likelihood =  -2.50 Transmembrane 119-135 ( 118-139)

----- Final Results -----
          bacterial membrane --- Certainty = 0.5182(Affirmative) < succ>
           bacterial outside --- Certainty = 0.0000(Not Clear)   < succ>
         bacterial cytoplasm --- Certainty = 0.0000(Not Clear)   < succ>
```

The protein has homology with the following sequences in the GENPEPT database:

```
>GP:AAC74889 GB:AE000276 PTS en yme IID, mannoses--pecific [Escherichia coli
K12] Identities = 94/280 (33%), Positives = 156/280 (55%), Gaps = 13/280 (4%)
Query:   3 SQDNLTKEDRKHLRSVFWRSWTMNASRTGATQYHAVGVIYTLLPVINRFYKTDKD-KAEA    61
           ++  LT+ D   +R VF RS    S     + A+G ++++P I R Y  + + +A
Sbjct:  12 TEKKLTQSD---IRGVFLRSNLFQGS-WNFERMQALGFCFSMVPAIRRLYPENNEARKQA    67

Query:  62 LVRHTTWFNATMHINNFIMGLVASMEKKNSEDPDFDASAITAVKASLMGPISGVGDSFFW   121
           + RH  +FN     +  I+G+ ++E++ +    + D  AI  +K  LMGP++GVGD FW
Sbjct:  68 IRRHLEFFNTQPFVAAPILGVTLALEEQRANGAEIDDGAINGIKVGLMGPLAGVGDPIFW   127
Query: 122 GILRVIAAGIGISLASTGSAMGAVVFLLLYNIPAFLIHYYSLYGGYSVGAGFIKKLYESG   181
            G +R + A  +G   +A +GS +G ++F +L+N+           YY +  GYS G   +K +       G
Sbjct: 128 GTVRPVFAALGAGIAMSGSLLGPLLFFILFNLVRLATRYYGVAYGYSKGIDIVKDM-GGG   186

Query: 182 GIKIVTKTSSMLGLMNVGSM----TASNVKFKTILTVAAKGAKEAASIQSYLDQLFVGVV   237
            ++    +T+  +S+LGL ++G++     T   N+          G +     ++Q+ LDQL G+V
Sbjct: 187 FLQKLTEGASILGLFVMGALVNKWTHVNIPLVVSRITDQTGKEHVTTVQTILDQLMPGLV   246

Query: 238 PLLVTILAFWLLRKRVNINWIMFGIMVLGI---VLGLLGI                      274
           PLL+T    WLLRKKVN  WI+ G  V+GI     GLLG+
Sbjct: 247 PLLLTFACMWLLRKKVNPLWIIVGFFVIGIAGYACGLLGL                      286
```

A related DNA sequence was identified in *S. pyogenes* <SEQ ID 1631> which encodes the amino acid sequence <SEQ ID 1632>. Analysis of this protein sequence reveals the following:

```
Possible site: 32
>>> Seems to have no N-terminal signal sequence
    INTEGRAL      Likelihood = -9.98    Transmembrane    255-271 (251-274)
    INTEGRAL      Likelihood = -7.01    Transmembrane    232-248 (228-250)
    INTEGRAL      Likelihood = -5.68    Transmembrane    142-158 (140-161)
    INTEGRAL      Likelihood = -2.50    Transmembrane    119-135 (118-139)

----- Final Results -----
            bacterial membrane  --- Certainty = 0.4991(Affirmative) < succ>
            bacterial outside   --- Certainty = 0.0000(Not Clear)   < succ>
            bacterial cytoplasm --- Certainty = 0.0000(Not Clear)   < succ>
```

The protein has homology with the following sequences in the databases:

```
>GP: AAC74889 GB: AE000276 PTS enzyme IID, mannose-specific
[Escherichia coli]
Identities = 94/281 (33%), Positives = 157/281 (55%), Gaps = 13/281 (4%)

Query:   2 TSQDNLTKEDRKMLRSVFWRSWTMNASRTGATQYHAVGVIYTLLPVINRFYKTDKD-KAE   60
           T++ LT+ D  +R VF RS     S     + A+G ++++P I R Y + + +
Sbjct:  11 TTEKKLTQSD---IRGVFLRSNLFQGS-WNFERMQALGFCFSMVPAIRRLYPENNEARKQ 66

Query:  61 ALVRHTTWFNATMHINNFIMGLVASMEKKNSEDPDFDASAITAVKASLMGPISGVGDSFF  120
           A+ RH +FN  +   I+G+ ++E++ +  + D  AI +K  LMGP++GVGD  F
Sbjct:  67 AIRRHLEFFNTQPFVAAPILGVTLALEEQRANGAEIDDGAINGIKVGLMGPLAGVGDPIF  126

Query: 121 WGILRVIAAGIGISLASAGSAMGAVVFLLLYNIPAFIIHYYSLYGGYSVGAGFIKKLYES  180
           WG +R + A +G   +A +GS +G ++F +L+N+       YY +  GYS G    +K +
Sbjct: 127 WGTVRPVFAALGAGIAMSGSLLGPLLFFILFNLVRLATRYYGVAYGYSKGIDIVKDM-GG  185

Query: 181 GGIKIVTKTSSMLGLMMVGSM----TASNVKFKTILTVAAKGAKEAASIQDYLDQLFIGI  236
           G ++ +T+ +S+LGL ++G++     T  N+       G +   ++Q  LDQL  G+
Sbjct: 186 GFLQKLTEGASILGLFVMGALVNKWTHVNIPLVVSRITDQTGKEHVTTVQTILDQLMPGL  245

Query: 237 VPLMVTLAAFWLLRKKVNIIWIMFGIMFLGI---ILGLLGI                     274
           VPL++T A  WLLRKKVN +WI+ G  +GI    GLLG+
Sbjct: 246 VPLLLTFACMWLLRKKVNPLWIIVGFFVIGIAGYACGLLGL                     286
```

An alignment of the GAS and GBS proteins is shown below:

```
Identities = 263/275 (95%), Positives = 269/275 (97%)

Query:   1 MKSQDNLTKEDRKMLRSVFWRSWTMNASRTGATQYHAVGVIYTLLPVINRFYKTDKDKAE   60
           M SQDNLTKEDRKMLRSVFWRSWTMNASRTGATQYHAVGVIYTLLPVINRFYKTDKDKAE
Sbjct:   1 MTSQDNLTKEDRKMLRSVFWRSWTMNASRTGATQYHAVGVIYTLLPVINRFYKTDKDKAE   60

Query:  61 ALVRHTTWFNATMHINNFIMGLVASMEKKNSEDPDFDASAITAVKASLMGPISGVGDSFF  120
           ALVRHTTWFNATMHINNFIMGLVASMEKKNSEDPDFDASAITAVKASLMGPISGVGDSFF
Sbjct:  61 ALVRHTTWFNATMHINNFIMGLVASMEKKNSEDPDFDASAITAVKASLMGPISGVGDSFF  120

Query: 121 WGILRVIAAGIGISLASTGSAMGAVVFLLLYNIPAFLIHYYSLYGGYSVGAGFIKKLYES  180
           WGILRVIAAGIGISLAS GSAMGAVVFLLLYNIPAF+IHYYSLYGGYSVGAGFIKKLYES
Sbjct: 121 WGILRVIAAGIGISLASAGSAMGAVVFLLLYNIPAFIIHYYSLYGGYSVGAGFIKKLYES  180

Query: 181 GGIKIVTKTSSMLGLMMVGSMTASNVKFKTILTVAAKGAKEAASIQSYLDQLFVGVVPLL  240
           GGIKIVTKTSSMLGLMMVGSMTASNVKFKTILTVAAKGAKEAASIQ YLDQLF+G+VPL+
Sbjct: 181 GGIKIVTKTSSMLGLMMVGSMTASNVKFKTILTVAAKGAKEAASIQDYLDQLFIGIVPLM  240

Query: 241 VTILAFWLLRKKVNINWIMFGIMVLGIVLGLLGIC                          275
           VT+ AFWLLRKKVNI WIMFGIM LGI+LGLLGIC
Sbjct: 241 VTLAAFWLLRKKVNIIWIMFGIMFLGIILGLLGIC                          275
```

There is also homology to SEQ ID 5236.

A further related DNA sequence was identified in *S. pyogenes* <SEQ ID 9077> which encodes the amino acid sequence <SEQ ID 9078>. An alignment of the GAS and GBS sequences follows:

```
Score = 178 bits (448), Expect = 3e-47
Identities = 83/136 (61%), Positives = 108/136 (79%)

Query:    2 IMEEITIYHNPNCGTSRNVLAMIRHAGIEPTIIEYLQTPPNRETLIELLQSMGISARELL   61
            +ME+I IYHNPNCGTSRNVLA+IRH GIEP II YL+TPP+R  L+ELL  M +SARELL
Sbjct:    1 MMEKIRIYHNPNCGTSRNVLAIIRHCGIEPEIIYYLKTPPSRMELVELLLEMKLSARELL   60

Query:   62 RTNVPEFEAYGLANQAVAEKDIINAMLADPILINRPIVVTRKGVKLCRPSETLLDILPVP  121
            RT+VP +E + L + +V ++++I+AM+ DPILINRPIVVT KG KLCRP E +L ILPV
Sbjct:   61 RTDVPAYEKFNLESSSVTDEEMIDAMIQDPILINRPIVVTSKGAKLCRPCEAILTILPVK  120

Query:  122 LPSPYIKEDGESVNPI                                              137
            +   ++KEDG+ + +
Sbjct:  121 MEKDFVKEDGQIIQSL                                              136
```

Based on this analysis, it was predicted that these proteins and their epitopes could be useful antigens for vaccines or diagnostics.

EXAMPLE 510

A DNA sequence (GBSx0548) was identified in *S. agalactiae* <SEQ ID 1633> which encodes the amino acid sequence <SEQ ID 1634>. This protein is predicted to be PTS permease for mannose subunit IIPMan. Analysis of this protein sequence reveals the following:

```
Possible site: 56
>>> Seems to have an uncleavable N-term signal seq
      INTEGRAL     Likelihood = -8.70    Transmembrane    144-160  (140-165)
      INTEGRAL     Likelihood = -8.07    Transmembrane    220-236  (215-239)
      INTEGRAL     Likelihood = -7.27    Transmembrane     95-111   (91-116)
      INTEGRAL     Likelihood = -3.77    Transmembrane      2-18    (1-18)
      INTEGRAL     Likelihood = -1.44    Transmembrane    180-196  (179-196)
      INTEGRAL     Likelihood = -1.33    Transmembrane     32-48   (30-49)
      INTEGRAL     Likelihood = -0.53    Transmembrane    198-214  (198-214)

----- Final Results -----
             bacterial membrane --- Certainty = 0.4482(Affirmative) < succ>
              bacterial outside --- Certainty = 0.0000(Not Clear)   < succ>
            bacterial cytoplasm --- Certainty = 0.0000(Not Clear)   < succ>
```

The protein has homology with the following sequences in the GENPEPT database:

```
>GP: AAC44680 GB: U65015 PTS permease for mannose subunit IIPMan
[Vibrio furnissii]
Identities = 70/251 (27%), Positives = 132/251 (51%), Gaps = 6/251 (2%)

Query:    2 IMPATMAALAVLICFGGNYLTGQSMMERPLVVGLVTGMLLGDIKVGILMGASLEALFLGN   61
            +   A M L  + G +   G +   RP+V+G + G++LGD+  GIL+G +LE +++G
Sbjct:    5 LFQALMLGLLAFLA-GLDLFNGLTHFHRPVVLGPLVGLILGDLHTGILVGGTLELIWMGL   63

Query:   62 VNIGGVIAAEPVTATAMATTFTIISNIDQKAAMTLAVPIGMLAAFVVMFLKNVFMNIFAP  121
               + G      + T + TTF I +N++   A+ +AVP +     + L +      + +
Sbjct:   64 APLAGAQPPNVIIGTIVGTTFAITTNVEPNVAVGVAVPFAVAVQMGITLLFSAMSAVMSK  123

Query:  122 MVDKAAAANHQGKLVMLHYGTWII--YYLIIASISFIGILVGSGPVNSFVHHIPQNLMNG  179
             + A A+ +G    + ++   ++    +Y + A   F+ I +G+    + V   +P+ L++G
Sbjct:  124 CDEYAKNADTRGIERVNYFALAVLGSFYFLCA---FLPIYLGADHAGAMVAALPKALIDG  180

Query:  180 LSAAGGLLPAVGFAMLMKLLWTNKLAVFYLLGFVLTAYLKLPAVAVAALGAVICVISSQR  239
              L   AGG++PA+GFA+LMK++   N     +++LGFV  A+L+LP +A+     + +I   R
Sbjct:  181 LGVAGGIMPAIGFAVLMKIMMKNAYIPYFILGFVAAAWLQLPILAIRCAATAMAIIDFMR  240

Query:  240 DIELDAITRGA                                                   250
             E  +   A
Sbjct:  241 KSEPTPVNASA                                                   251
```

A related DNA sequence was identified in *S. pyogenes* <SEQ ID 1635> which encodes the amino acid sequence <SEQ ID 1636>. Analysis of this protein sequence reveals the following:

```
Possible site: 56
>>> Seems to have an uncleavable N-term signal seq
     INTEGRAL    Likelihood = -8.70    Transmembrane    144-160  (140-165)
     INTEGRAL    Likelihood = -8.07    Transmembrane    220-236  (215-239)
     INTEGRAL    Likelihood = -7.27    Transmembrane     95-111   (91-116)
     INTEGRAL    Likelihood = -4.62    Transmembrane      2-18     (1-19)
     INTEGRAL    Likelihood = -1.44    Transmembrane    180-196  (179-196)
     INTEGRAL    Likelihood = -0.96    Transmembrane     32-48    (31-49)
     INTEGRAL    Likelihood = -0.53    Transmembrane    198-214  (198-214)

----- Final Results -----
             bacterial membrane --- Certainty = 0.4482(Affirmative) < succ>
              bacterial outside --- Certainty = 0.0000(Not Clear)   < succ>
            bacterial cytoplasm --- Certainty = 0.0000(Not Clear)   < succ>
```

The protein has homology with the following sequences in the databases:

```
>GP: AAC44680 GB: U65015 PTS permease for mannose subunit IIPMan
[Vibrio furnissii]
Identities = 72/251 (28%), Positives = 132/251 (51%), Gaps = 6/251 (2%)

Query:    2 LVPATMAALAVLICFGGNYLTGQSMMERPLVVGLVTGLLLGDMKVGILMGASLEALFLGN   61
            L  A M L    + G +   G +    RP+V+G + GL+LGD+   GIL+G +LE +++G
Sbjct:    5 LFQALMLGLLAFLA-GLDLFNGLTHFHRPVVLGPLVGLILGDLHTGILVGGTLELIWMGL   63

Query:   62 VNIGGVIAAEPVTATAMATTFTIISHIDQKAAMTLAVPIGMLAAFVVMFLKNVFMNIFAP  121
              + G    +    T + TTF I ++++     A+ +AVP +       + L +      + +
Sbjct:   64 APLAGAQPPNVIIGTIVGTTFAITTNVEPNVAVGVAVPFAVAVQMGITLLFSAMSAVMSK  123

Query:  122 MVDKAAAANHQGKLVMLHYGTWII--YYLIIASISFIGILVGSGPVNAFVEHIPQNLMNG  179
              + A  A+ +G  + ++   ++  +Y + A  F+ I +G+     A  V  +P+ L++G
Sbjct:  124 CDEYAKNADTRGIERVNYFALAVLGSFYFLCA---FLPIYLGADHAGAMVAALPKALIDG  180

Query:  180 LSAAGGLLPAVGFAMLMKLLWTNKLAVFYLLGFVLTAYLKLPAVAVAALGAVICVISSQR  239
            L   AGG++PA+GFA+LMK++    N      +++LGFV  A+L+LP  +A+        + +I    R
Sbjct:  181 LGVAGGIMPAIGFAVLMKIMMKNAYIPYFILGFVAAAWLQLPILAIRCAATAMAIIDFMR  240

Query:  240 DLELDAITRGA                                                  250
                E   +    A
Sbjct:  241 KSEPTPVNASA                                                  251
```

An alignment of the GAS and GBS proteins is shown below:

```
Identities = 261/269 (97%), Positives = 268/269 (99%)

Query:    1 MIMPATMAALAVLICFGGNYLTGQSMMERPLVVGLVTGMLLGDIKVGILMGASLEALFLG   60
            M++PATMAALAVLICFGGNYLTGQSMMERPLVVGLVTG+LLGD+KVGILMGASLEALFLG
Sbjct:    1 MLVPATMAALAVLICFGGNYLTGQSMMERPLVVGLVTGLLLGDMKVGILMGASLEALFLG   60

Query:   61 NVNIGGVIAAEPVTATAMATTFTIISNIDQKAAMTLAVPIGMLAAFVVMFLKNVFMNIFA  120
            NVNIGGVIAAEPVTATAMATTFTIIS+IDQKAAMTLAVPIGMLAAFVVMFLKNVFMNIFA
Sbjct:   61 NVNIGGVIAAEPVTATAMATTFTIISHIDQKAAMTLAVPIGMLAAFVVMFLKNVFMNIFA  120

Query:  121 PMVDKAAAANHQGKLVMLHYGTWIIYYLIIASISFIGILVGSGPVNSFVHHIPQNLMNGL  180
            PMVDKAAAANHQGKLVMLHYGTWIIYYLIIASISFIGILVGSGPVN+FV HIPQNLMNGL
Sbjct:  121 PMVDKAAAANHQGKLVMLHYGTWIIYYLIIASISFIGILVGSGPVNAFVEHIPQNLMNGL  180

Query:  181 SAAGGLLPAVGFAMLMKLLWTNKLAVFYLLGFVLTAYLKLPAVAVAALGAVICVISSQRD  240
            SAAGGLLPAVGFAMLMKLLWTNKLAVFYLLGFVLTAYLKLPAVAVAALGAVICVISSQRD
Sbjct:  181 SAAGGLLPAVGFAMLMKLLWTNKLAVFYLLGFVLTAYLKLPAVAVAALGAVICVISSQRD  240

Query:  241 IELDAITRGAISKQTTFDSKESEEEDFFA                                269
            +ELDAITRGAISKQTTFDSKESEEEDFFA
Sbjct:  241 LELDAITRGAISKQTTFDSKESEEEDFFA                                269
```

Based on this analysis, it was predicted that these proteins and their epitopes could be useful antigens for vaccines or diagnostics.

EXAMPLE 511

A DNA sequence (GBSx0549) was identified in *S. agalactiae* <SEQ ID 1637> which encodes the amino acid sequence <SEQ ID 1638>. This protein is predicted to be pts system, sorbose-specific iib component. Analysis of this protein sequence reveals the following:

```
Possible site: 36
>>> Seems to have no N-terminal signal sequence

----- Final Results -----
            bacterial cytoplasm --- Certainty = 0.1874(Affirmative) < succ>
             bacterial membrane --- Certainty = 0.0000(Not Clear)   < succ>
              bacterial outside --- Certainty = 0.0000(Not Clear)   < succ>
```

The protein has homology with the following sequences in the GENPEPT database:

```
>GP: CAA46858 GB: X66059 EIII-B Sor PTS [Klebsiella pneumoniae]
Identities = 49/158 (31%), Positives = 94/158 (59%), Gaps = 8/158 (5%)

Query:    2 ITQIRVDDRLIHGQVAVVWTKELNAPLLVVANDEAAKNEITQMTLKMAVPNGMKLLIRSV   61
            IT  R+DDRLIHGQV  VW+K  NA  +++ ND+   +E+ +  L+ A P GMK+ + S+
Sbjct:    3 ITLARIDDRLIHGQVTTVWSKVANAQRIIICNDDVFNDEVRRTLLRQAAPPGMKVNVVSL   62

Query:   62 EESIALFKDPRATDKRIFVIVNSVKDACTIAKNITDLEAVNVANVGRFDKSDPATKVKLT  121
            E+++A++ +P+  D+ +F + +   D  T+ +    +  +N+  +       K +LT
Sbjct:   63 EKAVAVYHNPQYQDETVFYLFTNPHDVLTMVRQGVQIATLNIGGM-----AWRPGKKQLT  117

Query:  122 SSLLLNTEELEAAKELASL-PDLDVFNQVLPSNTKVNL                       158
            ++ L+ ++++A +EL  L   LD+  +V+ S+  VN+
Sbjct:  118 KAVSLDPQDIQAFRELDKLGVKLDL--RVVASDPSVNI                       153
```

A related DNA sequence was identified in *S. pyogenes* <SEQ ID 1639> which encodes the amino acid sequence <SEQ ID 1640>. Analysis of this protein sequence reveals the following:

```
Possible site: 36
>>> Seems to have no N-terminal signal sequence

----- Final Results -----
            bacterial cytoplasm --- Certainty = 0.1874(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below:

```
Identities = 145/162 (89%), Positives = 152/162 (93%)

Query:    1 MITQIRVDDRLIHGQVAVVWTKELNAPLLVVANDEAAKNEITQMTLKMAVPNGMKLLIRS   60
            MITQIRVDDRLIHGQVAVVWTKELNAPLLVVANDEAAKNEITQMTLKMAVPNGMKLLIRS
Sbjct:    1 MITQIRVDDRLIHGQVAVVWTKELNAPLLVVANDEAAKNEITQMTLKMAVPNGMKLLIRS   60

Query:   61 VEESIALFKDPRATDKRIFVIVNSVKDACTIAKNITDLEAVNVANVGRFDKSDPATKVKL  120
            VE+SI LF DPRA DKRIFVIVNSVKDAC IAK + DLEAVNVANVGRFDKSDPA+KVK+
Sbjct:   61 VEDSIKLFNDPRAKDKRIFVIVNSVKDACAIAKEVPDLEAVNVANVGRFDKSDPASKVKV  120

Query:  121 TSSLLLNTEELEAAKELASLPDLDVFNQVLPSNTKVNLSQLV                   162
            T SLLLN EE+ AAKEL SLP+LDVFNQVLPSNTKV+LSQLV
Sbjct:  121 TPSLLLNPEEMAAAKELVSLPELDVFNQVLPSNTKVHLSQLV                   162
```

Based on this analysis, it was predicted that these proteins and their epitopes could be useful antigens for vaccines or diagnostics.

EXAMPLE 512

A DNA sequence (GBSx0550) was identified in *S. agalactiae* <SEQ ID 1641> which encodes the amino acid sequence <SEQ ID 1642>. Analysis of this protein sequence reveals the following:

```
Possible site: 46
>>> Seems to have no N-terminal signal sequence
    INTEGRAL    Likelihood = -1.22    Transmembrane    87-103 (87-104)

----- Final Results -----
              bacterial membrane --- Certainty = 0.1489(Affirmative) < succ>
               bacterial outside --- Certainty = 0.0000(Not Clear)   < succ>
             bacterial cytoplasm --- Certainty = 0.0000(Not Clear)   < succ>
```

The protein has no significant homology with any sequences in the GENPEPT database.

A related DNA sequence was identified in *S. pyogenes* <SEQ ID 1643> which encodes the amino acid sequence <SEQ ID 1644>. Analysis of this protein sequence reveals the following:

```
Possible site: 33
>>> Seems to have no N-terminal signal sequence
    INTEGRAL    Likelihood = -1.44    Transmembrane    87-103 (87-104)

----- Final Results -----
              bacterial membrane --- Certainty = 0.1574(Affirmative) < succ>
               bacterial outside --- Certainty = 0.0000(Not Clear)   < succ>
             bacterial cytoplasm --- Certainty = 0.0000(Not Clear)   < succ>
```

The protein has no significant homology with any sequences in the GENPEPT database.

An alignment of the GAS and GBS proteins is shown below:

```
Identities = 115/141 (81%), Positives = 125/141 (88%)

Query:    1 MKRKFLIGSHGKLASGLQSSIDILTGKGQEIQTIDAYIDDSDYTKSIVEFIDEIAPDEQG    60
            MKRKFLIGSHG+LASGLQSSIDIL G GQ ++TIDAY+DDSDYT  I +FI  +A DEQG
Sbjct:    1 MKRKFLIGSHGRLASGLQSSIDILAGMGQALETIDAYVDDSDYTSQIDDFIAGVAADEQG    60

Query:   61 LIFTDLLGGSVNQKMATAVMNSGKNNIFLITNSNLATLLSLLFLKPEEELTKEEIVTVIN   120
            LIFTDLLGGSVNQKM TAVMNSGK+NIFLITNSNLATLLSL+FLKP E LTK+EIVTVIN
Sbjct:   61 LIFTDLLGGSVNQKMVTAVMNSGKDNIFLITNSNLATLLSLVFLKPGEALTKDEIVTVIN   120

Query:  121 ESQVQLVDLSFKAGSEDDFFD                                         141
            ESQVQLVDL +  SEDDFFD
Sbjct:  121 ESQVQLVDLVPETNSEDDFFD                                         141
```

Based on this analysis, it was predicted that these proteins and their epitopes could be useful antigens for vaccines or diagnostics.

EXAMPLE 513

A DNA sequence (GBSx0551) was identified in *S. agalactiae* <SEQ ID 1645> which encodes the amino acid sequence <SEQ ID 1646>. Analysis of this protein sequence reveals the following:

```
Possible site: 25
>>> Seems to have no N-terminal signal sequence

----- Final Results -----
             bacterial cytoplasm --- Certainty = 0.2469(Affirmative) < succ>
              bacterial membrane --- Certainty = 0.0000(Not Clear)   < succ>
               bacterial outside --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 514

A DNA sequence (GBSx0552) was identified in *S. agalactiae* <SEQ ID 1647> which encodes the amino acid sequence <SEQ ID 1648>. This protein is predicted to be racemase. Analysis of this protein sequence reveals the following:

```
Possible site: 41
>>> Seems to have no N-terminal signal sequence
    INTEGRAL    Likelihood = -8.65    Transmembrane    319-335 (316-339)
    INTEGRAL    Likelihood = -6.10    Transmembrane     18-34  (17-37)
    INTEGRAL    Likelihood = -5.68    Transmembrane    230-246 (227-248)
    INTEGRAL    Likelihood = -3.98    Transmembrane    254-270 (254-271)
    INTEGRAL    Likelihood = -3.56    Transmembrane    110-126 (110-129)
    INTEGRAL    Likelihood = -3.19    Transmembrane    161-177 (156-177)
    INTEGRAL    Likelihood = -1.97    Transmembrane    132-148 (132-153)
    INTEGRAL    Likelihood = -1.33    Transmembrane    286-302 (286-302)
    INTEGRAL    Likelihood = -0.59    Transmembrane     53-69  (52-69)

----- Final Results -----
           bacterial membrane --- Certainty = 0.4461(Affirmative) < succ>
            bacterial outside --- Certainty = 0.0000(Not Clear)   < succ>
          bacterial cytoplasm --- Certainty = 0.0000(Not Clear)   < succ>
```

The protein has homology with the following sequences in the GENPEPT database:

```
>GP: AAF71283 GB: AF253562 racemase [Enterococcus faecalis]
Identities = 78/262 (29%), Positives = 129/262 (48%), Gaps = 29/262 (11%)

Query:  13 KQHNTSMISLLQYLFSILVILVHSGRLFS-QDVIHFTFKSFLGRMAVPYFLICTAFFLRG   71
           K + S I   +++ ++L++ +H+  LFS   +F F   + +AVP+F + + FFL
Sbjct:   3 KNESYSGIDYFRFIAALLIVAIHTSPLFSFSETGNFIFTRIVAPVAVPFFFMTSGFFL--  60

Query:  72 RIQQGLCNHSYFRKLIKK----YSMWTIIYLPY----GYFFFESLNIAKIYLLPGFIVAF  123
           I +  CN      IKK     Y +   ++Y+P      GYF  ++L      LP  I
Sbjct:  61 -ISRYTCNAEKLGAFIKKTTLIYGVAILLYIPINVYNGYFKMDNL-------LPNIIKDI 112

Query: 124 LYLGMSHTLWYIPAVILGWVIIQGLLKYVGTRGTFITVVVLYCIGAV-ETYSVFIQSTKF  182
           ++ G  + LWY+PA I+G  I    L+K V R   F+    +LY IG   ++Y   ++S
Sbjct: 113 VFDGTLYHLWYLPASIIGAAIAWYLVKKVHYRKAFLIASILYIIGLFGDSYYGIVKSVSC 172

Query: 183 YPLMSTYMSIFQT---TRNGLFYTPVYLLAGYLLYDYFNTDLFTKSRGLK-YILFLLLLA  238
              L   Y  IFQ     TRNG+F+  P++ +  G  +D  + + K     ++ Y LF L+
Sbjct: 173 --LNVFYNLIFQLTDYTRNGIFFAFIFFVLGGYISD--SPNRYRKKNYIRIYSLFCLMFG 228

Query: 239 LENVLIYFN-QGLDKNFFLLAP                                        259
           L +F+ Q  D   + LL P
Sbjct: 229 KTLTLQHFDIQKHDSMYVLLLP                                        250
```

No corresponding DNA sequence was identified in *S. pyogenes*.

A related GBS gene <SEQ ID 8589> and protein <SEQ ID 8590> were also identified. Analysis of this protein sequence reveals the following:

```
Lipop: Possible site: -1 Crend: 7
McG: Discrim Score: 0.23
GvH: Signal Score (-7.5): -5.77
     Possible site: 34
>>> Seems to have an uncleavable N-term signal seq
ALOM program count: 3 value: -5.68 threshold: 0.0
    INTEGRAL      Likelihood = -5.68    Transmembrane    41-57 (38-59)
    INTEGRAL      Likelihood = -3.98    Transmembrane    65-81 (65-82)
    INTEGRAL      Likelihood = -1.33    Transmembrane   97-113 (97-113)
    PERIPHERAL    Likelihood =  5.78    10
modified ALOM score: 1.64
*** Reasoning Step: 3

----- Final Results -----
           bacterial membrane --- Certainty = 0.3272(Affirmative) < succ>
            bacterial outside --- Certainty = 0.0000(Not Clear)   < succ>
          bacterial cytoplasm = Certainty = 0.0000(Not Clear)   < succ>
```

A related GBS gene <SEQ ID 8591> and protein <SEQ ID 8592> were also identified. Analysis of this protein sequence reveals the following:

```
Lipop: Possible site: -1 Crend: 5
McG: Discrim Score: 11.50
GvH: Signal Score (-7.5): -2.69
Possible site: 32
>>> Seems to have an uncleavable N-term signal seq
ALOM program count: 9 value: -8.65 threshold: 0.0
INTEGRAL    Likelihood = -8.65 Transmembrane 310-326  ( 307-330)
INTEGRAL    Likelihood = -6.10 Transmembrane   9-25   ( 8-28)
INTEGRAL    Likelihood = -5.68 Transmembrane 221-237  ( 218-239)
INTEGRAL    Likelihood = -3.98 Transmembrane 245-261  ( 245-262)
INTEGRAL    Likelihood = -3.56 Transmembrane 101-117  ( 101-120)
INTEGRAL    Likelihood = -3.19 Transmembrane 152-168  ( 147-168)
INTEGRAL    Likelihood = -1.97 Transmembrane 123-139  ( 123-144)
INTEGRAL    Likelihood = -1.33 Transmembrane 277-293  ( 277-293)
INTEGRAL    Likelihood = -0.59 Transmembrane  44-60   ( 43-60)
PERIPHERAL Likelihood =   5.78 190
modified ALOM score: 2.23

*** Reasoning Step: 3

----- Final Results -----
               bacterial membrane --- Certainty = 0.4461(Affirmative) < succ>
                bacterial outside --- Certainty = 0.0000(Not Clear)   < succ>
              bacterial cytoplasm --- Certainty = 0.0000(Not Clear)   < succ>
```

The protein has homology with the following sequences in the databases:

```
ORF00153(307-1140 of 1632)
GP|7960293|gb|AAF71283.1|AF253562_7|AF253562(2-284 of 711) racemase
{Enterococcus faecalis}
% Match = 8.5
% Identity = 32.7  % Similarity = 54.0
Matches = 91  Mismatches = 113  Conservative Sub.s = 59
150        180        210        240        270        300        330        360
CEISFFIS*YG**GINNNYQIPFKAFQ*LFGIIEIFF*RDWYHSNDNL*KVMLRMKRSQCVDNKQHNTSMISLLQYLFSI
                                                               |  :  | |    :::: ::
                                                               MTKNESYSGIDYFRFIAAL
                                                                       10
390     417        447        477        507        537       555
LVILVHSGRLFS-QDVIHFTFKSFLGRMAVPYFLICTAFFLRGRIQQGLCNHSYFRKLIKK----YSMWTIIYLP---Y-
|::  :|:  |||    :   :||    :|||:|:: :  |||   |   :  :  :|||       |  :|:|    |
LIVAIHTSPLFSFSETGNFIFTRIVAPVAVPFFFMTSGFFL---ISRYTCNAEKLGAFIKKTTLIYGVAILLYIPINVYN
      30         40         50         60            70         80         90
603        633        663        693        723        753        783        810
GYFFFESLNIAKIYLLPGFIVAFLYLGMSHTLWYIPAVILGWVIIQGLLKYVGTRGTFITVVVLYCIGAV-ETYSVFIQS
|||   ::|       ||  |  :|  |||:||:||  |  |    |:  :||  :|||:  :|   | |
GYFKMDNL-------LPNIIKDIVFDGTLYHLWYLPASIIGAAIAWYLVKKVHYRKAFLIASILYIIGLFGDSYYGIVKS
                110        120        130        140        150        160
840        891        921        951        978        1008       1035
TKFYPLMSTYMSIFQTT---RNGLFYTPVYLLAGYLLYDYFNTDLFTKSRGLK-YILFLLLLALENVLIYFN-QGLDKNF
|  |   |||   :|||    ||:|::  |:::: | :   :    | :  |  |:|| |  | |:    | :|: |
--VSCLNVFYNLIFQLTDYTRNGIFFAPIFFVLGGYISDSPNR--YRKKNYIRIYSLFCLMFGKTLTLQHFDIQKHDSMY
          180        190        200        210        220        230        240
1053       1080       1110       1140       1170       1200       1230       1260
FLLAP----LCAVFL-FNWSIRTSLFKEYRLSPLKQLSVYYFFLPPLFIGIVSYCLKSTSLVAHHQGKVIFVVTLALTHA
||| |    | :: ||     |  |    | |   | :|||
VLLLPSVWCLFNLLLHFRGKRRTGL-RTISLDQLYHSSVYDCCNTIVCAELLHLQSLLVENSLVHYIAVCFASVVLAVVI
          260        270        280        290        300        310        320
```

Based on this analysis, it was predicted that these proteins and their epitopes could be useful antigens for vaccines or diagnostics.

EXAMPLE 515

A DNA sequence (GBSx0553) was identified in *S. agalactiae* <SEQ ID 1649> which encodes the amino acid sequence <SEQ ID 1650>. Analysis of this protein sequence reveals the following:

```
Possible site: 43
>>> Seems to have no N-terminal signal sequence

----- Final Results -----
            bacterial cytoplasm --- Certainty = 0.3088(Affirmative) < succ>
             bacterial membrane --- Certainty = 0.0000(Not Clear)   < succ>
              bacterial outside --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 516

A DNA sequence (GBSx0554) was identified in *S. agalactiae* <SEQ ID 1651> which encodes the amino acid sequence <SEQ ID 1652>. Analysis of this protein sequence reveals the following:

```
Possible site: 35
>>> Seems to have no N-terminal signal sequence

----- Final Results -----
            bacterial cytoplasm --- Certainty = 0.1446(Affirmative) < succ>
             bacterial membrane --- Certainty = 0.0000(Not Clear)   < succ>
              bacterial outside --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 517

A DNA sequence (GBSx0555) was identified in *S. agalactiae* <SEQ ID 1653> which encodes the amino acid sequence <SEQ ID 1654>. Analysis of this protein sequence reveals the following:

```
Lipop: Possible site: -1 Crend: 10
McG: Discrim Score: 8.28
GvH: Signal Score (-7.5): -2.11
     Possible site: 20
>>> Seems to have a cleavable N-term signal seq.
ALOM program count: 6 value: -8.33 threshold: 0.0
    INTEGRAL      Likelihood = -8.33    Transmembrane   358-374 (354-376)
    INTEGRAL      Likelihood = -8.23    Transmembrane   264-280 (257-290)
    INTEGRAL      Likelihood = -6.37    Transmembrane   210-226 (206-232)
    INTEGRAL      Likelihood = -5.95    Transmembrane   163-179 (160-180)
    INTEGRAL      Likelihood = -5.10    Transmembrane    23-39  (21-40)
    INTEGRAL      Likelihood = -1.70    Transmembrane   297-313 (296-314)
    PERIPHERAL    Likelihood =  1.75       322
modified ALOM score: 2.17
*** Reasoning Step: 3

----- Final Results -----
             bacterial membrane --- Certainty = 0.4333(Affirmative) < succ>
              bacterial outside --- Certainty = 0.0000(Not Clear)   < succ>
            bacterial cytoplasm --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 518

A DNA sequence (GBSx0556) was identified in *S. agalactiae* <SEQ ID 1655> which encodes the amino acid sequence <SEQ ID 1656>. This protein is predicted to be ABC transporter (ATP-bindingprot). Analysis of this protein sequence reveals the following:

```
Possible site: 59
>>> Seems to have no N-terminal signal sequence

----- Final Results -----
            bacterial cytoplasm --- Certainty = 0.1510(Affirmative) < succ>
            bacterial membrane  --- Certainty = 0.0000(Not Clear)   < succ>
             bacterial outside  --- Certainty = 0.0000(Not Clear)   < succ>
```

A related GBS nucleic acid sequence <SEQ ID 10199> which encodes amino acid sequence <SEQ ID 10200> was also identified.

The protein has homology with the following sequences in the GENPEPT database:

```
>GP: CAB88481 GB: AL353816 putative ABC transport system ATP-binding
protein [Streptomyces coelicolor A3(2)]
Identities = 104/284 (36%), Positives = 159/284 (55%), Gaps = 18/284 (6%)

Query:    6 TMLLQLDNITKSYGKKIVLNQISYQFTPGLYGLLGANGTGKTTLLNLMSHFTLADSGNIY   65
            T +   ++ YG+   L+ +S + TPG+ GLLG NG GKTTLL +++     AD G
Sbjct:    2 TPTVSASGLSLHYGRTRALDDVSLRLTPGVTGLLGPNGAGKTTLLRVLATAVPADRGAFT   61

Query:   66 WNGQEQS-----EEFYRHIGFLPQHFRYYDQFTGIAFLNYIATLKGV-DKKKAKQEIPRL  119
            G +        +E R +G+LPQ  ++  FT   F++Y+A LK + D+++   +E+ R+
Sbjct:   62 VLGHDPGSSRGRQEVRRRLGYLPQTPGFHPDFTAFEFVDYVAILKELADRRERHREVRRV  121

Query:  120 LELVGLGDVGKKKISSYSGGMKQRLGIAQALINDPEILILDEPTVGLDPKERVKFRHILS  179
            LE V LG+V  ++I   SGGM+QR+ +A AL+ DP L+LDEPTVGLDP++R++FR +++
Sbjct:  122 LEEVDLGEVRGRRIKKLSGGMRQRVALAAALVGDPGFLVLDEPTVGLDPEQRMRFRELIA  181

Query:  180 QLSTNKIIILSTHIVSDVEAVAKEIIVLKNGKFIEHGNTAQLLKTIEGKVWEIT-TEPGL  238
            + ++LSTH   DV  +   +IV+ G    G  A+L     G+VW  T   +PG
Sbjct:  182 GAGEGRTVLLSTHQTEDVAMLCHRVIVMAAGAVRFDGTPAELTARAAGRVWSSTEKDPG-  240

Query:  239 SQIPNIAIVNEKVFSDSRVFRVVSDICPSDSAQLVVPTLEDFYI                 282
                A    +  + S   FR V D  P   A+     PTLED Y+
Sbjct:  241 ------AKAGWRTGTGS--FRNVGD--PPPGAEPAEPTLEDGYL                 274
```

There is also homology to SEQ ID 686.

Based on this analysis, it was predicted that these proteins and their epitopes could be useful antigens for vaccines or diagnostics.

EXAMPLE 519

A DNA sequence (GBSx0557) was identified in *S. agalactiae* <SEQ ID 1657> which encodes the amino acid sequence <SEQ ID 1658>. This protein is predicted to be response regulator. Analysis of this protein sequence reveals the following:

```
Possible site: 38
>>> Seems to have no N-terminal signal sequence

----- Final Results -----
            bacterial cytoplasm --- Certainty = 0.3781(Affirmative) < succ>
            bacterial membrane  --- Certainty = 0.0000(Not Clear)   < succ>
             bacterial outside  --- Certainty = 0.0000(NOt Clear)   < succ>
```

The protein has homology with the following sequences in the GENPEPT database:

```
>GP: CAC10170 GB: AJ278301 response regulator [Streptococcus pneumoniae]
Identities = 136/242 (56%), Positives = 183/242 (75%)

Query:    1 MNIFILEDDFVQQAHFEKIIKEIRVQYNLHFKTVETFAKPVQLLESIYEIGLHNLFFLDI   60
            M IF+LEDDF QQ    E  I+++  ++++    + E F KP QLL  ++E G H LFFLDI
Sbjct:    1 MRIFVLEDDFSQQTRIETTIEKLLKEHHITLSSFEVFGKPDQLLAEVHEKGAHQLFFLDI   60

Query:   61 EIKNDSQMGLSVAKQIRQVDPYAQIVFVTTHSELMPLTFRYQVSALDYIDKGLSQEEFSQ  120
            EI+N+E  GLEVA++IR+ DPYA IVFVTTHSE MPL+FRYQVSALDYIDK LS EEF
Sbjct:   61 EIRNEEMKGLEVARKIREQDPYALIVFVTTHSEFMPLSFRYQVSALDYIDKALSAEEFES  120

Query:  121 RIEEVLLYVDGICNKPLVENSFYFKSRYSQVQLPFNDLLYIETSSRSHRVVLYTEKDRME  180
             RIE  LLY +     +K  L E+ FYFKS+++Q Q PF ++ Y+ETS R HRV+LYT+ DR+E
Sbjct:  121 RIETALLYANSQDSKSLAEDCFYFKSKFAQFQYPFKEVYYLETSPRPHRVILYTKTDRLE  180

Query:  181 FTATLGDILKQEPRLFQCHRSFLVNPLNIFKVDRIDRLVYFQNGTTCLVSRNKVRDIVSI  240
             FTA+L ++ KQEPRL QCHRSFL+NP N+   +D+ ++L++F NG +CL++R KVR++
Sbjct:  181 FTASLEEVFKQEPRLLQCHRSFLINPANVVHLDKKEKLLFFPNGGSCLIARYKVREVSEA  240

Query:  241 VD                                                            242
            ++
Sbjct:  241 IN                                                            242
```

A related DNA sequence was identified in *S. pyogenes* <SEQ ID 1659> which encodes the amino acid sequence <SEQ ID 1660>. Analysis of this protein sequence reveals the following:

```
Possible site: 44
>>> Seems to have no N-terminal signal sequence

----- Final Results -----
         bacterial cytoplasm --- Certainty = 0.2098(Affirmative) < succ>
         bacterial membrane  --- Certainty = 0.0000(Not Clear)   < succ>
         bacterial outside   --- Certainty = 0.0000(Not Clear)   < succ>
```

An alignment of the GAS and GBS proteins is shown below:

```
Identities = 106/235 (45%), Positives = 159/235 (67%)

Query:    1 MNIFILEDDFVQQAHFEKIIKEIRVQYNLHFKTVETFAKPVQLLESIYEIGLHNLFFLDI   60
            MNIFILEDDF+QQ   E I+  I  +  +   +E F+ P +L ESI E G H L+FLDI
Sbjct:    2 MNIFILEDDFIQQTRIESIVVGILKETRIPCNQLEVFSTPQKLFESIQERGDHQLYFLDI   61

Query:   61 EIKNDEQMGLEVAKQIRQVDPYAQIVFVTTHSELMPLTFRYQVSALDYIDKGLSQEEFSQ  120
            EI   + GLE+A  IRQ DP A IVFVTTHSE  P++F+Y+VSALD+IDK   Q++F +
Sbjct:   62 EIGEYTRCGLELAAAIRQKDPNAVIVFVTTHSEFAPISFKYKVSALDFIDKAGGQKQFKE  121

Query:  121 RIEEVLLYVDGICNKPLVENSFYFKSRYSQVQLPFNDLLYIETSSRSHRVVLYTEKDRME  180
            +IEE + Y   + +  ++ F F++  ++++LP+ D+LY  T++  H+V L+T+ +R+E
Sbjct:  122 QIEECIRYTYDMMSSRESKDMFLFETPQTRLKLPYKDILYFATATTPHKVCLWTQTERLE  181

Query:  181 FTATLGDILKQEPRLFQCHRSFLVNPLNIFKVDRIDRLVYFQNGTTCLVSRNKVR       235
            F   L +I    P+LF CHRS+LVN  + ++D+  +L+YF+NG +C+VSR K++
Sbjct:  182 FYGNLSEIQAVAPKLFLCHRSYLVNLDKVVRIDKSKQLLYFENGDSCMVSRLKMK       236
```

Based on this analysis, it was predicted that these proteins and their epitopes could be useful antigens for vaccines or diagnostics.

EXAMPLE 520

A DNA sequence (GBSx0558) was identified in *S. agalactiae* <SEQ ID 1661> which encodes the amino acid sequence <SEQ ID 1662>. Analysis of this protein sequence reveals the following:

```
Possible site: 57
>>> Seems to have no N-terminal signal sequence

----- Final Results -----
          bacterial cytoplasm --- Certainty = 0.2651(Affirmative) < succ>
           bacterial membrane --- Certainty = 0.0000(Not Clear)   < succ>
            bacterial outside --- Certainty = 0.0000(Not Clear)   < succ>
```

The protein has no significant homology with any sequences in the GENPEPT database.

A related DNA sequence was identified in *S. pyogenes* <SEQ ID 1663> which encodes the amino acid sequence <SEQ ID 1664>. Analysis of this protein sequence reveals the following:

```
Possible site: 25
>>> Seems to have no N-terminal signal sequence

----- Final Results -----
          bacterial cytoplasm --- Certainty = 0.0535(Affirmative) < succ>
           bacterial membrane --- Certainty = 0.0000(Not Clear)   < succ>
            bacterial outside --- Certainty = 0.0000(Not Clear)   < succ>
```

An alignment of the GAS and GBS proteins is shown below:

```
Identities = 177/269 (65%), Positives = 219/269 (80%)

Query:   6 MAKCLTLNTHSWMEVNALKKLFDLAEHIFREKYDIICLQEVNQSISSPLAKSSPNYHPIE   65
           M K LTLNTHSWM+ N LKKL  LAEHI EKYDIICLQE+NQ I S LA   P Y +
Sbjct:   1 MTKVLTLNTHSWMQANTLKKLVALAEHILAEKYDIICLQEINQLIESELATDLPRYQALS   60

Query:  66 GTPALHQDNFALQLVHYLNLQGLHYHWTWAYNHIGYSKYHEGVAILSLKPLKPEDILVSA  125
           GTP++H+D+FAL L+HYL  +G HY+W+WAYNHIGY  Y EGVAILS +P+   DILVSA
Sbjct:  61 GTPSIHKDHFALLLIHYLQKRGQHYYWSWAYNHIGYDIYQEGVAILSKQPIHVSDILVSA  120

Query: 126 VDDETDYHTRRALVAETTLNDKVVTVVSLHFSWFEKGFAEEWKRLETTLLEVETPLLLMG  185
           +DDETDYHTRR+L+A+TTL+ K V VV++H SWF+KGF  EW++LE  LL +  PLLLMG
Sbjct: 121 MDDETDYHTRRSLIAKTTLDGKEVAVVNVHLSWFDKGFLGEWEKLEKELLTLNCPLLLMG  180

Query: 186 DFNNPTGNQGYELVLNSPLALKDSHQIANHVFGDHTIMADIDGWEGNKKALKVDHIFTSE  245
           DFNNPT   GY++++ SPL L+DSH+ A+HVFGDH+I+ADIDGW+GNK+ALKVDH FTS+
Sbjct: 181 DFNNPTDQDGYQVMMGSPLDLQDSHKGADHVFGDHSIVADIDGWQGNKEALKVDHVFTSK  240

Query: 246 DLSISSSQVVFEGGEAPVVSDHYGLEITM                                274
           D  I SS++ FEGG+APVVSDHYGLE+T+
Sbjct: 241 DFIIRSSKITFEGGDAPVVSDHYGLEVTL                                269
```

Based on this analysis, it was predicted that these proteins and their epitopes could be useful antigens for vaccines or diagnostics.

EXAMPLE 521

A DNA sequence (GBSx0559) was identified in *S. agalactiae* <SEQ ID 1665> which encodes the amino acid sequence <SEQ ID 1666>. This protein is predicted to be PTS system, glucose-specific enzyme 11, A component (ptsG). Analysis of this protein sequence reveals the following:

```
Possible site: 37
>>> Seems to have no N-terminal signal sequence
    INTEGRAL      Likelihood = -8.07    Transmembrane    193-209   (189-217)
    INTEGRAL      Likelihood = -7.86    Transmembrane     28-44    (24-48)
    INTEGRAL      Likelihood = -6.48    Transmembrane    431-447   (421-449)
    INTEGRAL      Likelihood = -2.92    Transmembrane    153-169   (153-170)
    INTEGRAL      Likelihood = -2.81    Transmembrane     93-109   (93-111)
    INTEGRAL      Likelihood = -2.39    Transmembrane    370-386   (370-388)
    INTEGRAL      Likelihood = -2.28    Transmembrane     68-84    (68-84)
```

-continued
```
----- Final Results -----
            bacterial membrane --- Certainty = 0.4227(Affirmative) < succ>
            bacterial outside --- Certainty = 0.0000(Not Clear) < succ>
           bacterial cytoplasm --- Certainty = 0.0000(Not Clear) < succ>
```

A related GBS nucleic acid sequence <SEQ ID 10201> which encodes amino acid sequence <SEQ ID 10202> was also identified.

The protein has homology with the following sequences in the GENPEPT database:

```
>GP: AAD00281 GB: U78600 putative ptsG protein [Streptococcus mutans] Iden-
tities = 294/409 (71%), Positives = 342/409 (82%), Gaps = 7/409 (1%)
Query: 293 DLINLKGS-NSSQYHHLLTSVTPARFKVGQMIGASGILMGLSYAMYRNVDKDKKLKYKSM 351
           DLI+LKG+ + SQYHHLLTSVTPARFKVGQMIG+SGILMGL+ AMYRNVD DKK KYK M
Sbjct:   3 DLIHLKGAGHMSQYHHLLTSVTPARFKVGQMIGSSGILMGLTLAMYRNVDPDKKEKYKGM  62

Query: 352 FISAAAATFLTGVTEPIEYMFMFAAMPLYLVYAVVQGCAFAMADIVNLRVHSFGNIEFLT 411
           F+SAA A FLTGVTEP+EYMFMFAA+PLYLVYAVVQG AFA AD+++LRVHSFGNIEFLT
Sbjct:  63 FLSAAVAVFLTGVTEPLEYMFMFAALPLYLVYAVVQGLAFASADLIHLRVHSFGNIEFLT 122

Query: 412 RVPMGIKAGLGGDIFNFVWVTLLFAVLMYFIANFMIKKFNLATAGRNGNYDNEEVDNAPS 471
           + PM IKAGL DI NF+ V+++F V MYFI NFMIKKFNLAT+GRNGNYD + D +
Sbjct: 123 KTPMAIKAGLAMDIVNFIVVSVVFGVAMYFITNFMIKKFNLATSGRNGNYDTGD-DASDE 181

Query: 472 TAS----GSADANSQVVQVINLLGGRDNIEDVDACMTRLRVTVKDGNSVGSEAAWKKAGA 527
           TAS    G+A+ANSQ+V++INLLGG++NI DVDACMTRLR+TV D   VG EAAWKKAGA
Sbjct: 182 TASNSNAGTANANSQIVKIINLLGGKENISDVDACMTRLRITVTDVAKVGDEAAWKKAGA 241

Query: 528 MGLVLKGNGVQAIYGPKADVLKSDIQDLLDSGTVIPIVDLETGQPVAAAPVTTYKGITEE 587
           MGL++KGNGVQA+YGPKADVLKSDIQDLLDSG  IP D+  +     A V ++KG+TEE
Sbjct: 242 MGLIVKGNGVQAVYGPKADVLKSDIQDLLDSGVDIPKTDVTAPEEDKTADV-SFKGVTEE 300

Query: 588 IVSVANGQVEALDVVKDPVFSQKMMGDGFAVEPTDGNIYVPVSGTVTSVFPTKHAFGLLT 647
           + +VA+GQV + V DPVFSQKMMGDGFAVEP +GNIY PV+G VTSVFPTKHA GLLT
Sbjct: 301 VATVADGQVLPITQVHDPVFSQKMMGDGFAVEPENGNIYSPVAGLVTSVFPTKHALGLLT 360

Query: 648 ESGLEVLVHIGLDTVALDGQPFEVKISSGQKVVAGDLAVVADLEAIKAA          696
           + GLEVLVH+GLDTVAL+G PF K+ GQ+V GDL +VADLEAIK+A
Sbjct: 361 DDGLEVLVHVGLDTVALNGAPFSAKVKDGQRVALGDLLLVADLEAIKSA          409
```

A related DNA sequence was identified in *S. pyogenes* <SEQ ID 1667> which encodes the amino acid sequence <SEQ ID 1668>. Analysis of this protein sequence reveals the following:

```
Possible site: 33
>>> Seems to have a cleavable N-term signal seq.
    INTEGRAL    Likelihood = -13.43    Transmembrane  186-202 (181-213)
    INTEGRAL    Likelihood =  -6.79    Transmembrane  419-435 (412-442)
    INTEGRAL    Likelihood =  -5.52    Transmembrane   61-77  (57-82)
    INTEGRAL    Likelihood =  -3.56    Transmembrane  363-379 (363-381)
    INTEGRAL    Likelihood =  -1.97    Transmembrane  143-159 (142-160)
    INTEGRAL    Likelihood =  -0.16    Transmembrane  343-359 (343-359)

----- Final Results -----
            bacterial membrane --- Certainty = 0.6371(Affirmative) < succ>
            bacterial outside --- Certainty = 0.0000(Not Clear) < succ>
           bacterial cytoplasm --- Certainty = 0.0000(Not Clear) < succ>
```

The protein has homology with the following sequences in the databases:

```
>GP: AAD00281 GB: U78600 putative ptsG protein [Streptococcus mutans]
Identities = 288/407 (70%), Positives = 331/407 (80%), Gaps = 2/407 (0%)

Query: 286 DLVHLKGSD-ASAYSHLMDSVTPARFKVGQHIGATGTLMGVALAMYRNVDADKKHTYKMM 344
           DL+HLKG+   S Y HL+ SVTPARFKVGQMIG++G LMG+ LAMYRNVD DKK  YK M
Sbjct:   3 DLIHLKGAGHMSQYHHLLTSVTPARFKVGQMIGSSGILMGLTLAMYRNVDPDKKEKYKGM  62

Query: 345 FISAAAAVFLTGVTEPLEYLFMFAAMPLYIVYALVQGASFAMADLVNLRVHSFGNIELLT 404
           F+SAA AVFLTGVTEPLEY+FMFAA+PLY+VYA+VQG +FA ADL++LRVHSFGNIE LT
Sbjct:  63 FLSAAVAVFLTGVTEPLEYMFMFAALPLYLVYAVVQGLAFASADLIHLRVHSFGNIEFLT 122
```

```
Query:  405 RTPMALKAGLGMDVINFVWVSVLFAVIMYFIADMMIKKMHLATAGRLGNYDA-DILGDRN  463
             +TPMA+KAGL MD++NF+ VSV+F V MYFI + MIKK +LAT+GR GNYD  D   D
Sbjct:  123 KTPMAIKAGLAMDIVNFIVVSVVFGVANMFITNFMIKKFNLATSGRNGNYDTGDDASDET 182

Query:  464 TQTRPTQVADSNSQVVQIVNLLGGAGNIDDVDACMTRLRVTVKDPAKVGAEDDWKKAGAI 523
                 A++NSQ+V+I+NLLGG  NI DVDACMTRLR+TV D AKVG E  WKKAGA+
Sbjct:  183 ASNSNAGTANANSQIVKIINLLGGKENISDVDACMTRLRITVTDVAKVGDEAAWKKAGAM 242

Query:  524 GLIQKGNGVQAVYGPKADILKSDIQDLLDSGALIPEVNMSQLTSKPTPAKDFKHVTEDVL 583
             GLI KGNGVQAVYGPKAD+LKSDIQDLLDSG  IP+ +++      T   FK VTE+V
Sbjct:  243 GLIVKGNGVQAVYGPKADVLKSDIQDLLDSGVDIPKTDVTAPEEDKTADVSFKGVTEEVA 302

Query:  584 SVADGMVLPITGVKDQVFAAKMMGDGFAVEPTHGNIYAPVAGLVTSVFPTKHAFGLLTDN 643
             +VADG VLPIT V D VF+ KMMGDGFAVEP +GNIY+PVAGLVTSVFPTKHA GLLTD+
Sbjct:  303 TVADGQVLPITQVHDPVFSQKMMGDGFAVEPENGNIYSPVAGLVTSVFPTKHALGLLTDD 362

Query:  644 GLEVLVHVGLDTVALNGVPFSVKVSEGQRVHAGDLLVVADLAAIKSA              690
             GLEVLVHVGLDTVALNG PFS KV +GQRV GDLL+VADL AIKSA
Sbjct:  363 GLEVLVHVGLDTVALNGAPFSAKVKDGQRVALGDLLLVADLEAIKSA              409
```

An alignment of the GAS and GBS proteins is shown below:

```
Identities = 517/731 (70%), Positives = 606/731 (82%), Gaps = 7/731 (0%)

Query:    8 MKNNVKQLFSFEFWQKFGKALMVVIAVMPAAGLMVSIGNSISLLDPSNVLLGRIANVIAQ  67
            MK + KQLF FEFWQKFGK LMVVIAVNPAAGLM+SIGNSI +++ + L + N+IAQ
Sbjct:    1 MKTSFKQLFRFEFWQKFGKCLMVVIAVMPAAGLMINIGMSIPMINHDSAFLASLGNIIAQ  60

Query:   68 IGWGVIGNLHILFALAIGGSWAKERAGGAFAAGLSFILINLITGNFFGVKTDMLADSKAT 127
            IGW VI NLH+LFALAIGGSWAKERAGGAFA+GL+F+LIN ITG F+GV + MLAD +A
Sbjct:   61 IGWAVIVNLHLLFALAIGGSWAKERAGGAFASGLAFVLINRITGAFYGVSSTMLADPEAK 120

Query:  128 VQTVFGATIRVSDYFVNVLGQPALNMGVFVGIISGFVGATAFNKYYNYRKLPDALTFFNG 187
            + ++ G + V DYF +VL  PALN GVFVGII+GFVGATA+NKYYNYRKLP+ LTFFNG
Sbjct:  121 ITSLLGTQMIVKDYFTSVLESPALNTGVFVGIIAGFVGATAYNKYYNYRKLPEVLTFFNG 180

Query:  188 KRFVPFVVIYRSVIVALILSVFWPVVQSGINGFGKWIASSQDSAPILAPFVYGTLERLLL 247
            KRFVPFVVI RS+ VALIL V WPV+QSGIN FG WIASSQDSAPILAPF+YGTLERLLL
Sbjct:  181 KRFVPFVVILRSIFVALILVVVWPVIQSGINSFGMWIASSQDSAPILAPFLYGTLERLLL 240

Query:  248 PFGLHHMLTIPMNYTQLGGTYTVLTGATKGAQVLGQDPLWLAWVGDLINLKGSNSSQYHH 307
            PFGLHHMLTIPMNYT LGGTY V+TGA   G +V GQDPLWLAWV DL++LKGS++S Y H
Sbjct:  241 PFGLHHMLTIPMNYTALGGTYEVMTGAAAGTKVFGQDPLWLAWVTDLVHLKGSDASAYSH 300

Query:  308 LLTSVTPARFKVGQMIGASGILMGLSYAMYRNVDKDKKLKYKSMFISAAAATFLTGVTEP 367
            L+ SVTPARFKVGQMIGA+G LMG++ AMYRNVD DKK  YK MFISAAAA FLTGVTEP
Sbjct:  301 LMDSVTPARFKVGQMIGATGTLMGVALAMYRNVDADKKHTYKMMFISAAAAVFLTGVTEP 360

Query:  368 IEYMFMFAAMPLYLVYAVVQGCAFAMADIVNLRVHSFGNIEFLTRVPMGIKAGLGGDIFN 427
            +EY+FMFAAMPLY+VYA+VQG +FAMAD+VNLRVHSFGNIE LTR PM +KAGLG D+ N
Sbjct:  361 LEYLFMFAAMPLYIVYALVQGASFAMADLVNLRVHSFGNIELLTRTPMALKAGLGMDVIN 420

Query:  428 FVWVTLLFAVLMYFIANFMIKKFNLATAGRNGNYDNEEVD--NAPSTASGSADANSQVVQ 485
            FVWV++LFAV+MYFIA+ MIKK +LATAGR GNYD + +    N + +  AD+NSQVVQ
Sbjct:  421 FVWVSVLFAVIMYFIADMMIRKMHLATAGRLGNYDADILGDRNTQTRPTQVADSNSQVVQ 480

Query:  486 VINLLGGRDNIEDVDACMTRLRVTVKDGNSVGSEAAWKKAGAMGLVLKGNGVQAIYGPKA 545
            ++NLLGG NI+DVDACMTRLRVTVKD  VG E WKKAGA+GL+ KGNGVQA+YGPKA
Sbjct:  481 IVNLLGGAGNIDDVDACMTRLRVTVKDPAKVGAEDDWKKAGAIGLIQKGNGVQAVYGPKA 540

Query:  546 DVLKSDIQDLLDSGTVIPIVDLE--TGQPVAAAPVTTYKGITEEIVSVANGQVEALDVVK 603
            D+LKSDIQDLLDSG +IP V++   T +P    P   +K +TE+++SVA+G V + VK
Sbjct:  541 DILKSDIQDLLDSGALIPEVNMSQLTSKP---TPAKDFKHVTEDVLSVADGMVLPITGVK 597

Query:  604 DPVFSQKMMGDGFAVEPTDGNIYVPVSGTVTSVFPTKHAFGLLTESGLEVLVHIGLDTVA 663
            D VF+ KMMGDGFAVEPT GNIY PV+G VTSVFPTKHAFGLLT++GLEVLVH+GLDTVA
Sbjct:  598 DQVFAAKMMGDGFAVEPTHGNIYAPVAGLVTSVFPTKHAFGLLTDNGLEVLVHVGLDTVA 657

Query:  664 LDGQPFEVKISSGQKVVAGDLAVVADLEAIKAAGKETSVIIVFTNVSDIKTVKLEKSGPQ 723
            L+G PF VK+S GQ+V AGDL VVADL AIK+A +ET +++ FTN ++I+ V L  G Q
Sbjct:  658 LNGVPFSVKVSEGQRVHAGDLLVVADLAAIKSAERETIIVVAFTNTTEIQDVTLTSLGAQ 717

Query:  724 IAKTVVAKVEL                                                  734
            AKT VA VEL
Sbjct:  718 PAKTKVATVEL                                                  728
```

Based on this analysis, it was predicted that these proteins and their epitopes could be useful antigens for vaccines or diagnostics.

EXAMPLE 522

A DNA sequence (GBSx0560) was identified in *S. agalactiae* <SEQ ID 1669> which encodes the amino acid sequence <SEQ ID 1670>. Analysis of this protein sequence reveals the following:

```
Possible site: 14
>>> Seems to have no N-terminal signal sequence

----- Final Results -----
          bacterial cytoplasm --- Certainty = 0.2266(Affirmative) < succ>
          bacterial membrane  --- Certainty = 0.0000(Not Clear)   < succ>
          bacterial outside   --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 523

A DNA sequence (GBSx0561) was identified in *S. agalactiae* <SEQ ID 1671> which encodes the amino acid sequence <SEQ ID 1672>. This protein is predicted to be alkaline phosphatase synthesis sensor protein phor (hpyA). Analysis of this protein sequence reveals the following:

```
Possible site: 34
>>> Seems to have an uncleavable N-term signal seq
INTEGRAL Likelihood = -13.96 Transmernbrane 160-176 ( 148-183)
INTEGRAL Likelihood =  -8.65 Transmembrane  20-36  ( 13-41)

----- Final Results -----
          bacterial membrane  --- Certainty = 0.6583(Affirmative) < succ>
          bacterial outside   --- Certainty = 0.0000(Not Clear)   < succ>
          bacterial cytoplasm --- Certainty = 0.0000(Not Clear)   < succ>
```

A related GBS nucleic acid sequence <SEQ ID 8595> which encodes amino acid sequence <SEQ ID 8596> was also identified. Analysis of this protein sequence reveals the following:

```
Lipop: Possible site: -1 Crend: 6
SRCFLG: 0
McG: Length of UR: 26
Peak Value of UR: 3.27
Net Charge of CR: 3
McG: Discrim Score: 14.63
GvH: Signal Score (-7.5): -5.64
Possible site: 26
>>> Seems to have an uncleavable N-term signal seq
Amino Acid Composition: calculated from 1
ALOM program count: 2 value: -13.96 threshold: 0.0
INTEGRAL   Likelihood = -13.96 Transmembrane 152-168 ( 140-175)
INTEGRAL   Likelihood =  -8.65 Transmembrane  12-28  ( 5-33)
PERIPHERAL Likelihood =  -1.59 135
modified ALOM score: 3.29
icml HYPID: 7 CFP: 0.658

*** Reasoning Step: 3

----- Final Results -----
          bacterial membrane  --- Certainty = 0.6583(Affirmative) < succ>
          bacterial outside   --- Certainty = 0.0000(Not Clear)   < succ>
          bacterial cytoplasm --- Certainty = 0.0000(Not Clear)   < succ>
```

A related GBS gene <SEQ ID 8593> and protein <SEQ ID 8594> were also identified. Analysis of this protein sequence reveals the following:

```
Lipop: Possible site: -1 Crend: 6
McG: Discrim Score: 14.63
GvH: Signal Score (-7.5): -5.64
Possible site: 26
>>> Seems to have an uncleavable N-term signal seq
ALOM program count: 2 value: -13.96 threshold: 0.0
INTEGRAL    Likelihood = -13.96 Transmembrane 152-168 ( 140-175)
INTEGRAL    Likelihood =  -8.65 Transmembrane  12-28 ( 5-33)
PERIPHERAL Likelihood =  -1.59 135
modified ALOM score: 3.29

*** Reasoning Step: 3

----- Final Results -----
              bacterial membrane --- Certainty = 0.6583(Affirmative) < succ>
               bacterial outside --- Certainty = 0.0000(Not Clear) < succ>
             bacterial cytoplasm --- Certainty = 0.0000(Not Clear) < succ>
```

The protein has homology with the following sequences in the databases:

```
34.9/61.1% over 363aa
Thermotoga maritima
EGAD|131465| sensor histidine kinase HpkA Insert characterized
GP|1575578|gb|AAC44437.1||U67196 histidine protein kinase Insert characterized
GP|4982228|gb|AAD36721.1|AE001807_12|AE001807 sensor histidine kinase HpKA Insert
characterized
PIR|C72228|C72228 sensor histidine kinase HpkA - (strain MSB8) Insert characterized
ORF00680(919-1977 of 2277)
EGAD|131465|TM1654(48-411 of 412) sensor histidine kinase HpkA {Thermotoga
maritima} GP|1575578|gb|AAC44437.1||U67196 histidine protein kinase {Thermotoga
maritima} GP|4982228|gb|AAD36721.1|AE001807_12|AE001807 sensor histidine kinase
HpkA {Thermotoga maritima} PIR|C72228|C72228 sensor histidine kinase HpkA -
Thermotoga maritima (strain MSB8)
% Match = 13.6
% Identity = 34.8  % Similarity = 61.0
Matches = 125  Mismatches = 134  Conservative Sub.s = 94
         720       750       780       810       840       870       900       930
AAQRLNNGTIVRLSVAQQTIFYLLLGMISPLAIIILLAIILSVLIARYIAKKVSEPLNNIDLDHPLSNDSYEEITPLLRR
                                 : ::| |||:      |:::||    |:   :    :    |: |
                              MSVFLFVIVAVLFVLLFLVFKKRLSEYKILIEKLSDMLGEKGVPPLYLFER
                              10        20        30        40        50
         960       990      1020      1050      1080      1110      1140      1170
LDSHQAKIQHQKLLLQKRQKEFDTIISKIKEGMILLDDQARIVSINAEALKLFQINDDWHGRFMMEVSRDLTLKDLIDQG
|  :     :     | | ||: :|  :  :|    :|   |     :|    |  :     |      : :::::
LKKYVDNLKETISRVEVSRDNFLTILNSLSEPIFILDREGKITFLNEIARELVQGRINPEGRPYYEIFEDYYINEMVEET
         70        80        90       100       110       120       130
1197     1215      1245      1275      1305      1335      1365      1395
LKGKK-KEAN----IGIENNHYRVLVRPTTDNNRVTGLVVLLFDVTDQLQMEQLQREFTANVSHELKTPLHVISGYSELL
:|  ::  :|     :|    |:   || |       :    :|:|: |||   |  :::::|||  | |||||:|||      |  ||:| |
IKSEEPQEGTLVTYVGNEKKYFHVKVIPVELKSGDKIFVILFHDVTKERKLDEMRREFIATVSHELRTPLTSIHGYAETL
         150       160       170       180       190       200       210
1452     1482      1512      1539      1569      1599      1629
ANQMVPNEE-VPQFAAKIHKESERLVKLVEDIINLSHLDEQE-KLPQETVNLYDLTQKVLEGLQAKADKKHIQINFNGEE
   : |:|  |  :|     |: | |  |: |:| |:::|  ::|    :    : |:  :: |    :|   |::   :        |:
LEDDLENKELVKRFLKIIEEESARMTRLINDLLDLEKIEESEANFEMKDVDLCEVIEYVYRIIQPIAEENEVDLIVECED
         230       240       250       260       270       280       290
1659      1689     1713                1767      1797      1827      1857
AILRGNPVLLNSLVYNLCDNAITYNH--EKGQVNVTLK--NSPDTITLEVSDTGLGIAEKDKKRIFERFYRVDKSRSKIV
 ::|||  |      |: || | ||:  | |     :|   :: :|    |  ::|| | |      :| |||:|||||:||||||:::
VVVRGNKERLIQMLLNLVDNAVKYTSLKEKGEKKVWVRAYDTPDWVVVEVEDTGPGIPKEAQSRIFEKFYRVDKARSRKM
         310       320       330       340       350       360       370
1887      1917     1947      1977      2007      2037      2067      2097
GGTGLGLSIVKSALDFHNGSIKVDSHLGQGTTMTVLLHKQ*KLTNKSLDDII*TFLVIQKKYISKGLQKTNKCYNKTXX*
|||||||:|||:  :|  |  |:|:|   :   |||   ||| |:
GGTGLGLTIVKTIVDKHGGKIEVESEINQGTLMRVLLPKRR
         390       400       410
```

The protein has homology with the following sequences in the GENPEPT database:

```
>GP: BAB06875 GB: AP001517 two-component sensor histidine kinase
involved in phosphate regulation [Bacillus halodurans]
Identities = 176/589 (29%), Positives = 315/589 (52%), Gaps = 47/589 (7%)

Query:   9 MTKKIFRTTLSASLGIVLVTILMIMG------------FLYNYFNHIQREQLRTQTALAS   56
           MTK +R  L+    ++ VT+L++ G             +L N +  +++E     +  +
Sbjct:   1 MTKFRYRLVLA----VLTVTLLVMAGLGLVIGQFKNVYLENLTDRLKKETYLAASMVEN   56
```

```
Query:   57 QGISF-EGKDYFENLKTS-NVRITWVDNKGQVLYDTQSDAKHMKNHANRQEIKEAIKSGY  114
            + + F E +   E +    + R+T +    G V+ ++ +D   M+NHA+R  E   E ++ G
Sbjct:   57 EAVLFNEVQTLTEEISQKLDARVTIILADGTVVGESAADPAEMENHADRPEFTE-LEEGI  115

Query:  115 GESTRWSATL-TEKSIYAAQRLN--NGTI--VRLSVAQQTIFYLLLGMISPLAIIILLAI  169
            R+S T+ TE      YA     N  N TI   VRL +  + +  +   + +L +    +A
Sbjct:  116 ---VRYSTTVETELLFYAVPIQNEANETIGYVRLGLPIEAVNSVNRTLWAILIVSFTIAF  172

Query:  170 ILSVLIARYIAKKVSEPLNNI----------DLDHPLSNDSYEEITPLLRRLDSHQAKIQ  219
            ++ V +     IA ++  P+ +                 D     S +S +E+  L R ++         ++
Sbjct:  173 LVIVSVTYRIANQMIRPIESATVVANKLAEGDYQARTSEESRDEVGQLNRSINVLAYNLE  232

Query:  220 HQKLLLQKRQKEFDTIISKIKEGMILLDDQARIVSINAEALKLFQINDD-WHGRFMMEVS  278
                    Q +++  +T+I  +   G+IL++ +   I   IN         +FQ + D W    +      +V
Sbjct:  233 QLTKRHQVQKERLETLIENMGSGLILINTRGDISLINKTCHDIFQEDTDLWLHQLYHDVI  292

Query:  279 RDLTLKDLIDQGLKGKKKEAN-----IGIENNHYRVLVRPTT-DNNRVTGLVVLLFDVTD  332
            +   +   ++          +K++          I +E  H+ V    P     +N ++ G+ ++   D+T+
Sbjct:  293 KHKEIIKIVQDIFLTEKRQRRQVKLPIHLEYRHFDVHGAPIVRENGKLKGIALVFHDITE  352

Query:  333 QLQMEQLQREFTANVSHELKTPLHVISGYSELLANQMVPNEEV-PQFAAKIHKESERLVK  391
               ++EQ++++F ANVSHELKTP+    I G++E L  +   + +E++    QF     I KESERL
Sbjct:  353 LKKLEQVRKDFVANVSHELKTPVTSIKGFTETLLDGAMHDEQLRDQFLHIIWKESERLQS  412

Query:  392 LVEDIINLSHLDEQE-KLPQETVNLYDLTQKVLEGLQAKADKKHIQINFNGEEAI-LRGN  449
            L+ D++ LS +++     +L  +   NL+ +    +V+   L+ KA++K  I I+ + E +  L G+
Sbjct:  413 LIHDLLELSKIEQNYFQLNWQQTNLFAVVSEVMTLLKGKAEEKGIDISLSAEGSFDLEGD  472

Query:  450 PVLLNSLVYNLCDNAITYNHEKGQVNVTLKNSPDTITLEVSDTGLGIAEKDKKRIFERFY  509
              P   L  +   NL +NAITY          G++++ LK+   D +    EV+DTG+GI E  +  RIFERFY
Sbjct:  473 PERLKQIAINLVNNAITYTSNGGRIDLALKDHGDVVEFEVNDTGIGIRESEIPRIFERFY  532

Query:  510 RVDKSRSKIVGGTGLGLSIVKSALDFHNGSIKVDSHLGQGTTMTVLLHK             558
            RVD++RS+   GGTGLGL+IVK   ++    H G  I V+S   G+GTT T+   H+
Sbjct:  533 RVDRARSRNSGGTGLGLAIVKHLVEAHQGKILVESEFGKGTTFTIQFHR           581
```

There is also homology to SEQ ID 1178.

SEQ ID 8594 (GBS340) was expressed in *E. coli* as a GST-fusion product. SDS-PAGE analysis of total cell extract is shown in FIG. 173 (lane 10; MW 86 kDa). It was also expressed in *E. coli* as a His-fusion product. SDS-PAGE analysis of total cell extract is shown in FIG. 11 (lane 7; MW 61.5 kDa) and in FIG. 77 (lane 10; MW 62 kDa).

Purified GBS340-GST is shown in FIG. 223, lane 2; purified GBS340-His is shown in FIG. 191, lane 9.

The purified GBS340-GST fusion product was used to immunise mice. The resulting antiserum was used for Western blot (FIG. 254A), FACS (FIG. 254B), and in the in vivo passive protection assay (Table III). These tests confirm that the protein is immunoaccessible on GBS bacteria and that it is an effective protective immunogen.

Based on this analysis, it was predicted that these proteins and their epitopes could be useful antigens for vaccines or diagnostics.

EXAMPLE 524

A DNA sequence (GBSx0562) was identified in *S. agalactiae* <SEQ ID 1673> which encodes the amino acid sequence <SEQ ID 1674>. This protein is predicted to be phosphate regulon transcriptional regulatory protein phob (phoB). Analysis of this protein sequence reveals the following:

```
Possible site: 28
>>> Seems to have no N-terminal signal sequence

----- Final Results -----
            bacterial cytoplasm --- Certainty = 0.2617(Affirmative) < succ>
            bacterial membrane  --- Certainty = 0.0000(Not Clear)   < succ>
             bacterial outside  --- Certainty = 0.0000(Not Clear)   < succ>
```

A related GBS nucleic acid sequence <SEQ ID 10203> which encodes amino acid sequence <SEQ ID 10204> was also identified.

The protein has homology with the following sequences in the GENPEPT database:

```
>GP: AAC73502 GB: AE000146 positive response regulator for pho
regulon, sensor is PhoR (or CreC) [Escherichia coli K12]
Identities = 98/224 (43%), Positives = 138/224 (60%), Gaps = 2/224 (0%)

Query:   2 IYCVEDDADIREMMLYTLQMAGFKAQGFSSSELFWEAIQEKVPDLILLDIMLPGDDGLTI   61
             I   VED+A  IREM+ + L+   GF+        +      + E   PDLILLD MLPG G+
Sbjct:   5 ILVVEDEAPIREMVCFVLEQNGFQPVEAEDYDSAVNQLNEPWPDLILLDWMLPGGSGIQF   64
```

```
Query:  62 LERLRRKHQTEMIPVIMTTAKGSEYDKVKGLDLGADDYLVKPFGMMEMISRIKAVLRRSR 121
           ++ L+R+  T  IPV+M TA+G E D+V+GL+ GADDY+ KPF   E+++RIKAV+RR
Sbjct:  65 IKHLKRESMTRDIPVVMLTARGEEEDRVRGLETGADDYITKPFSPKELVARIKAVMRRIS 124

Query: 122 QVDSKAHIIGNLEIDPTNYWVKRGTEKIHLTLKEFELLVLFFRNPNRVFTRQELLDKVW 181
           +  +  I +  L +DPT++ V  G E + +   EF+LL  F  +P RV++R++LL+ VW
Sbjct: 125 PMAVEEVIEMQGLSLDPTSHRVMAGEEPLEMGPTEFKLLHFFMTHPERVYSREQLLNHVW 184

Query: 182 GEQFLGETRTVDVHIGTLRTKLGEDGY--LIATVRGVGYRLEER 223
           G    E RTVDVHI  LR L   G+ ++ TVRG GYR  R
Sbjct: 185 GTNVYVEDRTVDVHIRRLRKALEPGGHDRMVQTVRGTGYRFSTR 228
```

There is also homology to SEQ ID 1182.

Based on this analysis, it was predicted that these proteins and their epitopes could be useful antigens for vaccines or diagnostics.

EXAMPLE 525

A DNA sequence (GBSx0563) was identified in *S. agalactiae* <SEQ ID 1675> which encodes the amino acid sequence <SEQ ID 1676>. This protein is predicted to be phosphate transport system regulatory protein (phoU). Analysis of this protein sequence reveals the following:

```
Possible site: 33
>>> Seems to have no N-terminal signal sequence

----- Final Results -----
            bacterial cytoplasm --- Certainty = 0.1188(Affirmative) < succ>
            bacterial membrane  --- Certainty = 0.0000(Not Clear)   < succ>
            bacterial outside   --- Certainty = 0.0000(Not Clear)   < succ>
```

The protein has homology with the following sequences in the GENPEPT database:

```
>GP: AAG08750 GB: AE004948 phosphate uptake regulatory protein PhoU
[Pseudomonas aeruginosa]
Identities = 66/213 (30%), Positives = 119/213 (54%), Gaps = 4/213 (1%)

Query:   2 IRSRFASQLNDLNKEIIFMGALCEDIIGKSLGALTNSNDVYLDDISETYHKIEQMERDIE  61
           I  +F ++L D+   ++ MG L E +  ++ AL +++     + E   +I QMER+I+
Sbjct:  11 ISQQFNAELEDVRSHLLAMGGLVEKQVNDAVNALIDADSGLAQQVREIDDQINQMERNID  70

Query:  62 ERCLKLLLRQQPVAKDLRRISSALKMVYDMKRIGAQAYEIAEIVSLGHIIQGSGSERD-- 119
           E C+++L R+QP A DLR I S  K V D++RIG +A ++A       + +   S R
Sbjct:  71 EECVRILARRQPAASDLRLIISISKSVIDLERIGDEASKVARRAI--QLCEEGESPRGYV 128

Query: 120 QLNSMSNNVISMLTKSIDAFIYDNEEQAHQVIEQDRTVNQEFDTIKKQLVLYFSVQDVDG 179
           ++  + + V  M+ +++DAF    + A  V + D+TV++E+ T  ++LV Y
Sbjct: 129 EVRHIGSQVQKMVQEALDAFARFDADLALSVAQYDKTVDREYKTALRELVTYMMEDPRAI 188

Query: 180 EYPIDVLMIAKYLERIGDHTVNIAKWVLFSITG 212
           ++++   + LERIGDH  NIA+ V++ + G
Sbjct: 189 SRVLNIIWALRSLERIGDHARNIAELVIYLVRG 221
```

There is also homology to SEQ ID 1678.

Based on this analysis, it was predicted that this protein and its epitopes, could be useful antigens for vaccines or diagnostics.

EXAMPLE 526

A DNA sequence (GBSx0564) was identified in *S. agalactiae* <SEQ ID 1679> which encodes the amino acid sequence <SEQ ID 1680>. This protein is predicted to be ATP-binding cassette protein PstB (pstB-2). Analysis of this protein sequence reveals the following:

Possible site: 52
>>> Seems to have no N-terminal signal sequence

----- Final Results -----
            bacterial cytoplasm --- Certainty = 0.2432(Affirmative) < succ>
             bacterial membrane --- Certainty = 0.0000(Not Clear)   < succ>
              bacterial outside --- Certainty = 0.0000(Not Clear)   < succ>

A related GBS nucleic acid sequence <SEQ ID 10205> which encodes amino acid sequence <SEQ ID 10206> was also identified.

The protein has homology with the following sequences in the GENPEPT database:

```
>GP: AAD22041 GB: AF118229 ATP-binding cassette protein PstB
[Streptococcus pneumoniae]
Identities = 166/245 (67%), Positives = 211/245 (85%), Gaps = 1/245 (0%)

Query:   10 INNLDLYYGEFHALKDVNLDIEEKEITAFIGPSGCGKSTLLKSINRMNDLVKNCKITGDI   69
            + +LDL+YG+F ALK++++ + E++ITA IGPSGCGKST LK++NRMNDLV +C I G +
Sbjct:    6 VRHLDLFYGDFQALKNISIQLPERQITALIGPSGCGKSTFLKTLNRMNDLVPSCHIEGQV   65

Query:   70 TLEGEDVYR-QLDINQLRKKVGMVFQKPNPFPMSIYDNVAFGPRTHGIHSKAELDDIVER  128
            L+ +D+Y  + ++NQLRK+VGMVFQ+PNPF MSIYDNVA+GPRTHGI  K +LD +VE+
Sbjct:   66 LLDEQDIYSSKFNLNQLRKRVGMVFQQPNPFAMSIYDNVAYGPRTHGIRDKKQLDALVEK  125

Query:  129 SLKQAALWDEVKDRLHKSALGMSGGQQQRLCIARALAIEPDVLLMDEPTSALDPISTAKI  188
            SLK AA+W+EVKD L KSA+ +SGGQQQRLCIARALA+EPD+LLMDEPTSALDPIST KI
Sbjct:  126 SLKGAAIWEEVKDDLKKSAMSLSGGQQQRLCIARALAVEPDILLMDEPTSALDPISTLKI  185

Query:  189 EELVIQLKKNYTIVIVTHNMQQAVRISDKTAFFLMGEVVEYNKTSQLFSLPQDERTENYI  248
            E+L+ QLKK+YTI+IVTHNMQQA RISDKTAFFL GE+ E+  T  +F+ P+D+RTE+YI
Sbjct:  186 EDLIQQLKKDYTIIIVTHNMQQASRISDKTAFFLTGEICEFGDTVDVFTNPKDQRTEDYI  245

Query:  249 TGRFG                                                        253
            +GRFG
Sbjct:  246 SGRFG                                                        250
```

There is also homology to SEQ ID 1682.

Based on this analysis, it was predicted that these proteins and their epitopes could be useful antigens for vaccines or diagnostics.

EXAMPLE 527

A DNA sequence (GBSx0565) was identified in *S. agalactiae* <SEQ ID 1683> which encodes the amino acid sequence <SEQ ID 1684>. This protein is predicted to be transmembrane protein PstA (pstA-2). Analysis of this protein sequence reveals the following:

```
Possible site: 38
>>> Seems to have a cleavable N-term signal seq.
    INTEGRAL    Likelihood = -13.11    Transmembrane    265-281 (255-286)
    INTEGRAL    Likelihood =  -8.81    Transmembrane     79-95  (68-100)
    INTEGRAL    Likelihood =  -4.78    Transmembrane    195-211 (192-213)
    INTEGRAL    Likelihood =  -4.67    Transmembrane    147-163 (143-164)
    INTEGRAL    Likelihood =  -2.92    Transmembrane    122-138 (120-138)
    INTEGRAL    Likelihood =  -0.90    Transmembrane     40-56  (39-56)

----- Final Results -----
             bacterial membrane --- Certainty = 0.6243(Affirmative) < succ>
              bacterial outside --- Certainty = 0.0000(Not Clear)   < succ>
            bacterial cytoplasm --- Certainty = 0.0000(Not Clear)   < succ>
```

The protein has homology with the following sequences in the GENPEPT database:

```
>GP: AAD22040 GB: AF118229 transmembrane protein PstA [Streptococcus pneumoniae]
Identities = 135/263 (51%), Positives = 203/263 (76%)
```

```
Query:  23 FFLFAIVYLGAILSFATIAFVVIYILVKGLPHVNTGLFAWTYNTQNVSLLPAFINTIFII  82
           + L  +VY  + L+F ++   ++ +IL+KGLPH++  LF+WTY ++N+SL+PA I+T+ ++
Sbjct:   4 YLLKLLVYCFSALTFGSLFLIIGFILIKGLPHLSLSLFSWTYTSENISLMPAIISTVILV  63

Query:  83 ALTLLFAVPLGIGGSIYLTEYARRDNPYLKIIRVATETLAGIPSIIYGLFGALFFVKYTH 142
           LL A+P+GI     YL EY ++D+   +KI+R+A++TL+GIPSI++GLFG LFFV +
Sbjct:  64 FGALLLALPIGIFAGFYLVEYTKKDSLCVKIMRLASDTLSGIPSIVFGLFGMLFFVVFLG 123

Query: 143 LGLSLISGSLTLSIMILPLIMRTTEEALLSVPDSYREGAFALGAGKLRTIFKIVLPSAMS 202
           SL+SG LT  IM+LP+I+R+TEEALLSV DS R+ ++ LGAGKLRT+F+IVLP AM
Sbjct: 124 FQYSLLSGILTSVIMVLPVIIRSTEEALLSVSDSMRQASYGLGAGKLRTVFRIVLPVAMP 183

Query: 203 GIFAGIILAVGRIIGESAALIFTAGTVAKVAHSVFSSSRTLAVHMYAISGEGLYVDQTYA 262
           GI AG+ILA+GRI+GE+AAL++T GT     S+ SS R+LA+HMY +S EGL+V++ YA
Sbjct: 184 GILAGVILAIGRIVGETAALMYTLGTSTNTPSSLMSSGRSLALHMYMLSSEGLHVNEAYA 243

Query: 263 TAVILLLLVIIVNFVSGLVAKRL                                     285
           T VIL++ V+++N +S L++++L
Sbjct: 244 TGVILIITVLMINTLSSLLSRKL                                     266
```

There is also homology to SEQ ID 1686.

Based on this analysis, it was predicted that this protein and its epitopes, could be useful antigens for vaccines or diagnostics.

EXAMPLE 528

A DNA sequence (GBSx0566) was identified in *S. agalactiae* <SEQ ID 1687> which encodes the amino acid sequence <SEQ ID 1688>. Analysis of this protein sequence reveals the following:

```
Possible site: 39
>>> Seems to have no N-terminal signal sequence

----- Final Results -----
          bacterial cytoplasm --- Certainty = 0.2687(Affirmative) < succ>
           bacterial membrane --- Certainty = 0.0000(Not Clear) < succ>
            bacterial outside --- Certainty = 0.0000(Not Clear) < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 529

A DNA sequence (GBSx0567) was identified in *S. agalactiae* <SEQ ID 1689> which encodes the amino acid sequence <SEQ ID 1690>. This protein is predicted to be transmembrane protein PstC (pstC-2). Analysis of this protein sequence reveals the following:

```
Possible site: 23
>>> Seems to have a cleavable N-term signal seq.
        INTEGRAL    Likelihood = -10.67    Transmembrane    256-272 (251-279)
        INTEGRAL    Likelihood =  -8.86    Transmembrane    141-157 (133-162)
        INTEGRAL    Likelihood =  -4.99    Transmembrane    111-127 (109-132)
        INTEGRAL    Likelihood =  -4.30    Transmembrane     76-92  (72-95)
        INTEGRAL    Likelihood =  -1.86    Transmembrane     25-41  (24-42)
        INTEGRAL    Likelihood =  -1.33    Transmembrane     59-75  (59-75)
        INTEGRAL    Likelihood =  -0.27    Transmembrane    203-219 (202-219)

--- Final Results -----
           bacterial membrane --- Certainty = 0.5267(Affirmative) < succ>
            bacterial outside --- Certainty = 0.0000(Not Clear) < succ>
          bacterial cytoplasm --- Certainty = 0.0000(Not Clear) < succ>
```

The protein has homology with the following sequences in the GENPEPT database:

```
>GP: AAD22039 GB: AF118229 transmembrane protein PstC
[Streptococcus pneumoniae]
Identities = 162/266 (60%), Positives = 212/266 (78%), Gaps = 3/266 (1%)
```

```
                         -continued
Query:  15 ITACVSVISAILICLFLFSSGLPAITKIGWGNFIFGKVWHPSN--NIFGIFPMIVGSLYV    72
           ++A V+V++ +LIC F+FS+GLP I    G+  F+ G  W P+N    +GI PMIVGSL +
Sbjct:   1 MSATVAVVAILLICFFIFSNGLPFIANYGFARFLLGSDWSPTNIPASYGILPMIVGSLLI    60

Query:  73 TAGALLLGGPIGILTAVFMAYFCPENIYKPLKSAINLMAGIPSVVYGFFGLVVIVPMIRQ   132
           T GA+++G P GILT+VFM Y+CP+ +Y  LKSAINLMA IPS+VYGFFGL ++VP IR
Sbjct:  61 TLGAIVIGVPTGILTSVFMVYYCPKPVYGFLKSAINLMAAIPSIVYGFFGLQLLVPWIRS   120

Query: 133 YIGGFGMGVLAASILLGIMILPTIVSISESSLRAVPESYYEGGIALGASHERSVFFAVLP   192
           ++G  GM VL AS+LLGIMILPTI+S+SES++R VP++YY G +ALGASHERS+F  +LP
Sbjct: 121 FLGN-GMSVLTASLLLGIMILPTIISLSESAIRTVPKTYYSGSLALGASHERSIFSVILP   179

Query: 193 AAKRGILASVVLGIGRAIGETMAVIMVAGNQAVLPQSLTSGVRTLTTNIVMEMGYSSGLH   252
           AA+ GIL++V+LGIGRA+GETMAVI+VAGNQ ++P  L SG RTLTTNIV+EM Y+SG H
Sbjct: 180 AARSGILSAVILGIGRAVGETMAVILVAGNQPIIPSGLFSGTRTLTTNIVLEMAYASGQH   239

Query: 253 RQALIGTAVVLFIFILMINISFSALQ                                    278
           R+ALI T+ VLF  IL+IN  F+ L+
Sbjct: 240 REALIATSAVLFFLILLINAYFAYLK                                    265
```

There is also homology to SEQ ID 1692.

Based on this analysis, it was predicted that this protein and its epitopes, could be useful antigens for vaccines or diagnostics.

EXAMPLE 530

A DNA sequence (GBSx0568) was identified in *S. agalactiae* <SEQ ID 1693> which encodes the amino acid sequence <SEQ ID 1694>. This protein is predicted to be probable hemolysin precursor (pstS). Analysis of this protein sequence reveals the following:

```
Possible site: 34
>>> May be a lipoprotein

----- Final Results -----
           bacterial membrane --- Certainty = 0.0000(Not Clear) < succ>
           bacterial outside  --- Certainty = 0.0000(Not Clear) < succ>
           bacterial cytoplasm --- Certainty = 0.0000(Not Clear) < succ>
```

The protein has homology with the following sequences in the GENPEPT database:

```
>GP: AAD22038 GB: AF118229 phosphate binding protein PstS
[Streptococcus pneuxnoniae]
Identities = 134/295 (45%), Positives = 185/295 (62%), Gaps = 9/295 (3%)

Query:   1 MKKHKMLSLLAVSGLMGIGILAGCSNDSSSSSK---GTINIVSREEGSGTRGAFIELFGI    57
           MK  KML+L A+ GL G G++A C N S++S +   GTI ++SRE GSGTRGAF E+ GI
Sbjct:   1 MKFKKMLTLAAI-GLSGFGLVA-CGNQSAASKQSASGTIEVISRENGSGTRGAFTEITGI    58

Query:  58 ESKNKKGEKVDHTSDAATVTNSTSVMLTTVSKDPSAIGYSSLGSLNSSVKVLKIDGKNAT   117
           +K+   +K+D+T+  A + NST +L+ V   +AIGY SLGSL  SVK L+IDG  A+
Sbjct:  59 LKKDGD-KKIDNTAKTAVIQNSTEGVLSAVQGNANAIGYISLGSLTKSVKALEIDGVKAS   117

Query: 118 VKDIKSGSYKISRPFNIVTKEGKEKEATKDFIDYILSKDGQAVVEKNGYIPL-DNAKAYQ   176
            +   G Y + RPFNIV      K   +DFI +I SK GQ VV  N +I        Y
Sbjct: 118 RDTVLDGEYPLQRPFNIVWSSNLSK-LGQDFISFIHSKQGQQVVTDNKFIEAKTETTEYT   176

Query: 177 AKVSSGKVVIAGSSSVTPVMEKIKEAYHKVNAKVDVEIQQSDSSTGITSAIDGSADIGMA   236
           ++  SGK+  + GS+SV+  +MEK+ EAY K N +V ++I    SS GIT+    +ADIGM
Sbjct: 177 SQHLSGKLSVVGSTSVSSLMEKLAEAYKKENPEVTIDITSNGSSAGITAVKEKTADIGMV   236

Query: 237 SRELDKTESSKGVKATVIATDGIAVVVNKKNKVNDLSTKQVKDIFTGKTTSWSDL       291
           SREL   E  K +    IA DGIAVVVN  NK  +S  ++ D+F GK T+W  +
Sbjct: 237 SREL-TPEEGKSLTHDAIALDGIAVVVNNDNKASQVSMAELADVFSGKLTTWDKI       290
```

There is also homology to SEQ ID 1696.

Based on this analysis, it was predicted that this protein and its epitopes, could be useful antigens for vaccines or diagnostics.

A related GBS gene <SEQ ID 8597> and protein <SEQ ID 8598> were also identified. Analysis of this protein sequence reveals the following:

```
Lipop: Possible site: 23 Crend: 4
McG: Discrim Score: 7.91
GvH: Signal Score (-7.5): -3.72
     Possible site: 34
>>> May be a lipoprotein
ALOM program count: 0 value: 2.44 threshold: 0.0
   PERIPHERAL Likelihood = 2.44 248
modified ALOM score: -0.99
*** Reasoning Step: 3

----- Final Results -----
              bacterial membrane --- Certainty = 0.0000(Not Clear) < succ>
              bacterial outside  --- Certainty = 0.0000(Not Clear) < succ>
              bacterial cytoplasm --- Certainty = 0.0000(Not Clear) < succ>
```

SEQ ID 1694 (GBS24) was expressed in *E. coli* as a His-fusion product. SDS-PAGE analysis of total cell extract is shown in FIG. 14 (lane 9; MW 33 kDa).

GBS24-His was purified as shown in FIG. 194, lane 10.

EXAMPLE 531

A DNA sequence (GBSx0569) was identified in *S. agalactiae* <SEQ ID 1697> which encodes the amino acid sequence <SEQ ID 1698>. Analysis of this protein sequence reveals the following:

```
Possible site: 30
>>> Seems to have no N-terminal signal sequence

----- Final Results -----
              bacterial cytoplasm --- Certainty = 0.1725(Affirmative) < succ>
              bacterial membrane  --- Certainty = 0.0000(Not Clear) < succ>
              bacterial outside   --- Certainty = 0.0000(Not Clear) < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 532

A DNA sequence (GBSx0570) was identified in *S. agalactiae* <SEQ ID 1699> which encodes the amino acid sequence <SEQ ID 1700>. Analysis of this protein sequence reveals the following:

```
Possible site: 58
>>> Seems to have no N-terminal signal sequence

----- Final Results -----
              bacterial cytoplasm --- Certainty = 0.2741(Affirmative) < succ>
              bacterial membrane  --- Certainty = 0.0000(Not Clear) < succ>
              bacterial outside   --- Certainty = 0.0000(Not Clear) < succ>
```

The protein has homology with the following sequences in the GENPEPT database:

```
>GP: BAB05069 GB: AP001511 unknown conserved protein
[Bacillus halodurans]
Identities = 119/250 (47%), Positives = 149/250 (59%), Gaps = 9/250 (3%)

Query:   1 MQQYFVNGE--AGAYVTIEDKDTIKHMFNVMRLTEDDQVVLVFDDAIKRLAKVVDSSAHR    58
            MQ+YFV  E       YVTI  D +KH+  VMR+T  D+  L+  D   R    A+
Sbjct:   1 MQRYFVPKEQMTDTYVTITGDD-VKHIIKVMRMTIGDE--LICSDGHGRTVRCEIEKAND   57

Query:  59 FQIL----EELDNNVEMPVQVTIASGFPKGDKLDFVTQKATELGAAAIWGFPADWSVVKW  114
           ++L     E L  N E+P++VTIA   PKGDKLD++ QK TELGA A W F A  S+VKW
Sbjct:  58 SEVLARVIEPLIPNTELPIRVTIAQALPKGDKLDYIVQKGTELGAQAFWPFSASRSIVKW  117

Query: 115 DGKKLAKKEDKLAKIALGAAEQSKRNRLPQVRLFEKKADFQAELAGFDKIFIAYEESAKE  174
            D KK  KK ++L KIA  AAEQS R R+P +       E++GF K +AYEE AKE
Sbjct: 118 DEKKGRKKTERLMKIAKEAAEQSYRERIPSIETPLAFSKLLQEISGFTKTIVAYEEEAKE  177

Query: 175 GELSALAQNLQTVKAGDKLLFIFGPEGGISPKEIAAFEEVGAIKVGLGPRIMRTETAPLY  234
```

```
                G L    A  L   +   GD LL  I  GPEGG +  +EI  A +  G     GLGPRI+RTETA LY
Sbjct:  178 GRLMTFAACLNELHHGDSLLVIIGPEGGFTTEEIDAIQRAGGAPAGLGPRILRTETASLY  237

Query:  235 ALSVISYSAE                                                   244
            AL+ ISY  E
Sbjct:  238 ALAAISYHFE                                                   247
```

A related DNA sequence was identified in *S. pyogenes* <SEQ ID 1701> which encodes the amino acid sequence <SEQ ID 1702>. Analysis of this protein sequence reveals the following:

```
Possible site: 56
>>> Seems to have no N-terminal signal sequence

----- Final Results -----
              bacterial cytoplasm --- Certainty = 0.2274(Affirmative) < succ>
              bacterial membrane  --- Certainty = 0.0000(Not Clear)   < succ>
              bacterial outside   --- Certainty = 0.0000(Not Clear)   < succ>
```

An alignment of the GAS and GBS proteins is shown below:

```
Identities = 173/245 (70%), Positives = 202/245 (81%)

Query:    1 MQQYFVNGEAGAYVTIEDKDTIKHMFNVMRLTEDDQVVLVFDDAIKRLAKVVDSSAHRFQ   60
            MQQYF+ G+A    VTI DKDTIKHMF VMRL ++ +VVLVFDD +K LAKV +S AN  +
Sbjct:    1 NQQYFIKGKAEKKVTITDKDTIKHMFQVMRLADEAEVVLVFDDGVKYLAKVTNSMAHELE   60

Query:   61 ILEELDNNVEMPVQVTIASGFPKGDKLDFVTQKATELGAAAIWGFPADWSVVKWDGKKLA  120
            I+E L + VE+PV+VTIASGFPKGDKLD + QK TELGA+A+WG+PADWSVVKWDGKKLA
Sbjct:   61 IIEALPDQVELPVKVTIASGFPKGDKLDTIAQKVTELGASALWGYPADWSVVKWDGKKLA  120

Query:  121 KKEDKLAKIALGAAEQSKRNRLPQVRLFEKKADFQAELAGFDKIFIAYEESAKEGELSAL  180
            KKEDKLAKI LGAAEQSKRNR+P+V LFE KA+F    L+ FD IFIAYEE+AK G+L+ L
Sbjct:  121 KKEDKLAKIVLGAAEQSKRNRVPEVHLFEHKAEFLKSLSSFDHIFIAYEETAKAGQLATL  180

Query:  181 AQNLQTVKAGDKLLFIFGPEGGISPKEIAAFEEVGAIKVGLPRIMRTETAPLYALSVIS  240
            A+ ++ VK G K+LFIFGPEGGISP  EI   FE    AIKVGLPRIMR ETAPLYALS +S
Sbjct:  181 AREVKEVKPGAKILFIFGPEGGISPTEITQFEAASAIKVGLPRIMRAETAPLYALSALS  240

Query:  241 YSAEL                                                       245
            Y+ EL
Sbjct:  241 YALEL                                                       245
```

Based on this analysis, it was predicted that these proteins and their epitopes could be useful antigens for vaccines or diagnostics.

EXAMPLE 533

A DNA sequence (GBSx0571) was identified in *S. agalactiae* <SEQ ID 1703> which encodes the amino acid sequence <SEQ ID 1704>. Analysis of this protein sequence reveals the following:

```
Possible site: 34
>>> Seems to have no N-terminal signal sequence
    INTEGRAL   Likelihood = -2.28    Transmembrane    238-254 (237-254)

----- Final Results -----
              bacterial membrane  --- Certainty = 0.1914(Affirmative) < succ>
              bacterial outside   --- Certainty = 0.0000(Not Clear)   < succ>
              bacterial cytoplasm --- Certainty = 0.0000(Not Clear)   < succ>
```

The protein has homology with the following sequences in the GENPEPT database:

```
>GP: BAA82791 GB: AB023064 orf35 [Listeria monocytogenes]
Identities = 138/309 (44%), Positives = 193/309 (61%), Gaps = 5/309 (1%)
```

-continued

```
Query:    4 WNELTVHVNREAEEAVSNLLIETGSQGVAISDSADYLGQ-EDRFGELYP---EVEQSDMI   59
            W+E+ VH   EA E V+N+L E G+ GV+I D AD+L +  ED+FGE+Y    E   D +
Sbjct:    3 WSEVEVHTTNEAVEPVANVLTEFGAAGVSIEDVADFLREREDKFGEIYALRREDYPEDGV  62

Query:   60 AITAYYPDTLDIEAVKADLADRLANFEGFGLATGSVNLDSQELVEEDWADNWKKYYEPAR  119
             I AY+  T +    ++  L N  F + G      ++ +E+WA  WKKYY P +
Sbjct:   63 IIKAYFLKTTEFVEQIPEIEQTLKNLSTFDIPLGKFQFVVNDVDDEEWATAWKKYYHPVQ 122

Query:  120 ITHDLTIVPSWTDYEAKAGEKIIKMDPGMAFGTGTHPTTKMSLFALEQVLRGGETVIDVG 179
             IT +TIVPSW  Y   A E II++DPGMAFGTGTHPTT++ +  AL   L+ G+ VIDVG
Sbjct:  123 ITDRITIVPSWESYTPSANEIIIELDPGMAFGTGTHPTTQLCIRALSNYLQPGDEVIDVG 182

Query:  180 TGSGVLSIASSLLGAKDIYAYDLDDVAVRVAQENIDMNPGTENIHVAAGDLLKGVQQ-EV 238
             TGSGVLSIAS+ LGAK I A DLD++A R A+ENI +N     I V   +LL+ +  + V
Sbjct:  183 TGSGVLSIASAKLGAKSILATDLDEIATRAAEENITLNKTEHIITVKQNNLLQDINKTNV 242

Query:  239 DVIVANILADILIHLTDDAYRLVKDEGYLIMSGIISEKWDMVRESAEKAGFFLETHMVQQ 298
             D++VANILA++++   +D Y+ +K  G  I SGII +K  +V E+ + AG  +E    QG
Sbjct:  243 DIVVANILAEVILLFPEDVYKALKPGGVFIASGIIEDKAKVVEEALKNAGLIIEKMEQQG 302

Query:  299 EWNACVFKK                                                    307
             +W A + K+
Sbjct:  303 DWVAIISKR                                                    311
```

A related DNA sequence was identified in *S. pyogenes* <SEQ ID 1705> which encodes the amino acid sequence <SEQ ID 1706>. Analysis of this protein sequence reveals the following:

```
Possible site: 34
>>> Seems to have no N-terminal signal sequence
   INTEGRAL    Likelihood = -4.57    Transmembrane    238-254 (237-257)

----- Final Results ----- bacterial membrane --- Certainty = 0.2826(Affirmative) < succ>
                bacterial outside --- Certainty = 0.0000(Not Clear)  < succ>
             bacterial cytoplasm --- Certainty = 0.0000(Not Clear)  < succ>
```

The protein has homology with the following sequences in the databases:

```
>GP: BAA82791 GB: AB023064 orf35 [Listeria monocytogenes]
Identities = 139/309 (44%), Positives = 203/309 (64%), Gaps = 5/309 (1%)

Query:    4 WQEVTVHVHRDAQEAVSHVLIETGSQGVAIADSADYIGQK-DRFGELYP---DVEQSDMI   59
            W EV VH   +A E V++VL E G+ GV+I D AD++ ++ D+FGE+Y    +    D +
Sbjct:    3 WSEVEVHTTNEAVEPVANVLTEFGAAGVSISDVADFLREREDKFGEIYALRREDYPEDGV  62

Query:   60 AITAYYPSSTNLADIIATINEQLAELASFGLQVGQVTVDSQELAEEDWADNWKKYYEPAR  119
             I AY+  +T + I   I + L  L++F + +G+        ++ + E+WA  WKKYY P+
Sbjct:   63 IIKAYFLKTTEFVEQIPEIEQTLKNLSTFDIPLGKFQFVVNDVDDEEWATAWKKYYHPVQ 122

Query:  120 ITHDLTIVPSWTDYDASAGEKVIKLDPGMAFGTGTHPTTKMSLFALEQILRGGETVIDVG 179
             IT +TIVPSW  Y   SA E +I+LDPGMAFGTGTHPTT++ +  AL   L+ G+ VIDVG
Sbjct:  123 ITDRITIVPSWESYTPSANEIIIELDPGMAFGTGTHPTTQLCIRALSNYLQPGDEVIDVG 182

Query:  180 TGSGVLSIASSLLGAKTIYAYDLDDVAVRVAQDNIDLNQGTDNIHVAAGDLLKGVSQ-EA 238
             TGSGVLSIAS+ LGAK+I A DLD++A R A++NI LN+      I V   +LL+ +++
Sbjct:  183 TGSGVLSIASAKLGAKSILATDLDEIATRAAEENITLNKTEHIITVKQNNLLQDINKTNV 242

Query:  239 DVIVANILADILVLLTDDAYRLVKKEGYLILSGIISEKLDMVLEAAFSAGFFLETHMVQG 298
             D++VANILA++++L +D Y+ +K  G  I SGII +K  +V EA  +AG  +E    QG
Sbjct:  243 DIVVANILAEVILLFPEDVYKALKPGGVFIASGIIEDKAKVVEEALKNAGLIIEKMEQQG 302

Query:  299 EWNALVFKK                                                    307
             +W A++ K+
Sbjct:  303 DWVAIISKR                                                    311
```

An alignment of the GAS and GBS proteins is shown below:

```
Identities = 259/317 (81%), Positives = 287/317 (89%)

Query:   1 MNTWNELTVHVNREAEEAVSNLLIETGSQGVAISDSADYLGQEDRFGELYPEVEQSDMIA    60
           M TW E+TVHV+R+A+EAVS++LIETGSQGVAI+DSADY+GQ+DRFGELYP+VEQSDMIA
Sbjct:   1 METWQEVTVHVHRDAQEAVSHVLIETGSQGVAIADSADYIGQKDRFGELYPDVEQSDMIA    60

Query:  61 ITAYYPDTLDIEAVKADLADRLANFEGFGLATGSVNLDSQELVEEDWADNWKKYYEPARI   120
           ITAYYP + ++  + A + ++LA    FGL  G V +DSQEL EEDWADNWKKYYEPARI
Sbjct:  61 ITAYYPSSTNLADIIATINEQLAELASFGLQVGQVTVDSQELAEEDWADNWKKYYEPARI   120

Query: 121 THDLTIVPSWTDYEAKAGEKIIKMDPGMAFGTGTHPTTKMSLFALEQVLRGGETVIDVGT   180
           THDLTIVPSWTDY+A AGEK+IK+DPGMAFGTGTHPTTKMSLFALEQ+LRGGETVIDVGT
Sbjct: 121 THDLTIVPSWTDYDASAGEKVIKLDPGMAFGTGTHPTTKMSLFALEQILRGGETVIDVGT   180

Query: 181 GSGVLSIASSLLGAKDIYAYDLDDVAVRVAQENIDMNPGTENIHVAAGDLLKGVQQEVDV   240
           GSGVLSIASSLLGAK IYAYDLDDVAVRVAQ+NID+N GT+NIHVAAGDLLKGV QE DV
Sbjct: 181 GSGVLSIASSLLGAKTIYAYDLDDVAVRVAQDNIDLNQGTDNIHVAAGDLLKGVSQEADV   240

Query: 241 IVANILADILIHLTDDAYRLVKDEGYLIMSGIISEKWDMVRESAEKAGFFLETHMVQGEW   300
           IVANILADIL+ LTDDAYRLVK EGYLI+SGIISEK DMV E+A  AGFFLETHMVQGEW
Sbjct: 241 IVANILADILVLLTDDAYRLVKKEGYLILSGIISEKLDMVLEAAFSAGFFLETHMVQGEW   300

Query: 301 NACVFKKTDDISGVIGG                                             317
           NA VFKKTDDISGVIGG
Sbjct: 301 NALVFKKTDDISGVIGG                                             317
```

Based on this analysis, it was predicted that these proteins and their epitopes could be useful antigens for vaccines or diagnostics.

EXAMPLE 534

A DNA sequence (GBSx0572) was identified in *S. agalactiae* <SEQ ID 1707> which encodes the amino acid sequence <SEQ ID 1708>. Analysis of this protein sequence reveals the following:

```
Possible site: 61
>>> Seems to have no N-terminal signal sequence

----- Final Results -----
            bacterial cytoplasm --- Certainty = 0.4198(Affirmative) < succ>
            bacterial membrane  --- Certainty = 0.0000(Not Clear)   < succ>
             bacterial outside  --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 535

A DNA sequence (GBSx0573) was identified in *S. agalactiae* <SEQ ID 1709> which encodes the amino acid sequence <SEQ ID 1710>. This protein is predicted to be transcriptional activator tipa. Analysis of this protein sequence reveals the following:

```
Possible site: 33
>>> Seems to have no N-terminal signal sequence

----- Final Results -----
            bacterial cytoplasm --- Certainty = 0.0683(Affirmative) < succ>
            bacterial membrane  --- Certainty = 0.0000(Not Clear)   < succ>
             bacterial outside  --- Certainty = 0.0000(Not Clear)   < succ>
```

The protein has homology with the following sequences in the GENPEPT database:

```
>GP: CAB15677 GB: Z99122 transcriptional regulator [Bacillus subtilis]
Identities = 87/246 (35%), Positives = 139/246 (56%), Gaps = 13/246 (5%)

Query:   4 VKEVSILSGVSVRTLHHYDKIGLFPPPTALSEAGYRLYDDEALIRLQEILLFRELEFPLKD    63
           VK+V+ +SGVS+RTLHHYD I L   P+AL++AGYRLY D  L RLQ+IL F+E+ F L +
Sbjct:   5 VKQVAEISGVSIRTLHHYDNIELLNPSALTDAGYRLYSDADLERLQQILFFKEIGFRLDE    64
```

-continued

```
Query:  64 IKYLLEQAKEERQDLLAQQIKLLEWKRSHLEQVITHAKR--LQEKGDDYMN----FDVYN 117
           IK +L+    +R+  L Q ++L K+  ++++I     R   L  G + MN    F   +
Sbjct:  65 IKEMLDHPNFDRKAALQSQKEILMKKKQRMDEMIQTIDRTLLSVDGGETMNKRDLFAGLS 124

Query: 118 KTELEQLQA----EAKEKWGQTAA--YKEFAQKHASDDFAQISQEMAKIMVQFGQLKTQN 171
           ++E+ Q       E ++ +G+ A    ++   +++DD+  I  E   I   +
Sbjct: 125 MKDIEEHQQTYADEVRKLYGKEIAEETEKRTSAYSADDWRTIMAEFDSIYRRIAARMKHG 184

Query: 172 VSDESVQMCVKRLQDYISQNFYTCTNEILAGLGQMYQSDDRFSQSIDKAGGAGTSEFVSQ 231
              D   +Q  V   +D+I Q   Y CT +I    GLG++Y +D+RF+ SI++  G G + F+ +
Sbjct: 185 PDDAEIQAAVGAFRDHICQYHYDCTLDIFRGLGEVYITDERFTDSINQY-GEGLAAFLRE 243

Query: 232 AIAYYC                                                      237
           AI  YC
Sbjct: 244 AIIIYC                                                      249
```

A related DNA sequence was identified in *S. pyogenes* <SEQ ID 1711> which encodes the amino acid sequence <SEQ ID 1712>. Analysis of this protein sequence reveals the following:

```
Possible site: 48
>>> Seems to have no N-terminal signal sequence
    INTEGRAL    Likelihood = -8.28    Transmembrane   146-162 (143-167)
    INTEGRAL    Likelihood = -2.92    Transmembrane   172-188 (171-190)

----- Final Results -----
            bacterial membrane --- Certainty = 0.4312(Affirmative) < succ>
             bacterial outside --- Certainty = 0.0000(Not Clear)   < succ>
           bacterial cytoplasm --- Certainty = 0.0000(Not Clear)   < succ>
```

The protein has homology with the following sequences in the databases:

```
>GP: CAB15677 GB: Z99122 transcriptional regulator [Bacillus subtilis]
Identities = 40/107 (37%), Positives = 69/107 (64%), Gaps = 6/107 (5%)

Query:   7 YSTGELANLAGVSIRTVQYYDQRGILIPTALTAGGRRLYTDSDLEQLRMICFLRDLGFSI  66
           Y    ++A ++GVSIRT+ +YD   +L P+ALT  G RLY+D+DLE+L+  I F +++GF +
Sbjct:   3 YQVKQVAEISGVSIRTLHHYDNIELLNPSALTDAGYRLYSDADLERLQQILFFKEIGFRL  62

Query:  67 EQIRKVLAEENAAQVLELLLVDHIATAKEDLAAKEQQVDIAVKILDR              113
           ++I+++L  N  +  L        + KE L  K+Q++D  ++ +DR
Sbjct:  63 DEIKEMLDHPNFDRKAAL------QSQKEILMKKKQRMDEMIQTIDR              103
```

An alignment of the GAS and GBS proteins is shown below:

```
Identities = 40/133 (30%), Positives = 71/133 (53%),
Gaps = 6/133 (4%)

Query:   6 EVSILSGVSVRTLHHYDKIGLFPPTALSEAGYRLYDDEALIRLQEILLFRELEFPLKDIK  65
           E++ L+GVS+RT+ +YD+ G+   PTAL+  G RLY D  L +L+ I   R+L F ++ I+
Sbjct:  11 ELANLAGVSIRTVQYYDQRGILIPTALTAGGRRLYTDSDLEQLRMICFLRDLGFSIEQIR  70

Query:  66 YLL--EQAKEERQDLLAQQIKL----LEWKRSHLEQVITHAKRLQEKGDDYMNFDVYNKT 119
           +L   E A +  + LL     I         L K    ++  +    RL+++     ++F +
Sbjct:  71 KVLAEENAAQVLELLLVDHIATAKEDLAAKEQQVDIAVKILDRLRKQDPQSLDFLMDISL 130

Query: 120 ELEQLQAEAKEKW                                                132
           ++   +A  K +W
Sbjct: 131 SMKNQKAWKKLQW                                                143
```

Based on this analysis, it was predicted that these proteins and their epitopes could be useful antigens for vaccines or diagnostics.

EXAMPLE 536

A DNA sequence (GBSx0575) was identified in *S. agalactiae* <SEQ ID 1713> which encodes the amino acid sequence <SEQ ID 1714>. Analysis of this protein sequence reveals the following:

```
Possible site: 24
>>> Seems to have no N-terminal signal sequence
     INTEGRAL     Likelihood = -0.06     Transmembrane     57-73 (57-73)

----- Final Results -----
               bacterial membrane --- Certainty = 0.1022(Affirmative) < succ>
                bacterial outside --- Certainty = 0.0000(Not Clear)   < succ>
              bacterial cytoplasm --- Certainty = 0.0000(Not Clear)   < succ>
```

The protein has homology with the following sequences in the GENPEPT database:

```
>GP: CAB14586 GB: Z99117 yrkN [Bacillus subtilis]
Identities = 38/136 (27%), Positives = 60/136 (43%),
Gaps = 3/136 (2%)

Query:    2 ITLQKAEASDLEKIIA-IQRASFKAVYEKYHDQYDPYVEEVEQIRWKLVERPDCFYHFVL   60
            + L+ A+ SDL +    +Q A    AV E + D  D  +    ++ +    P    + +L
Sbjct:    9 VILELAKESDLPEFQKKLQEAFAIAVIETFGDCEDGPIPSDNDVQ-ESFNAPGAVVYHIL   67

Query:   61 VDETIVGFLRLVIKDEEKRAWLGTAAILPQYQGQGYGSAAMALLEKTYPKLTKWDLCTIA  120
              D     VG  + I +      L    + P+Y  QG G +A    +E   YP     W+   T
Sbjct:   68 QDGKNVGGAVVRINSQTNHNSLDLFYVSPEYHSQGIGLSAWKAIEAQYPDTVLWETVTPY  127

Query:  121 QEKLMVSFY-EKCGYH                                             135
            EK    ++FY   KCG+H
Sbjct:  128 FEKRNINFYVNKCGFH                                             143
```

No corresponding DNA sequence was identified in *S. pyogenes*.

Based on this analysis, it was predicted that this protein and its epitopes, could be useful antigens for vaccines or diagnostics.

EXAMPLE 537

A DNA sequence (GBSx0576) was identified in *S. agalactiae* <SEQ ID 1715> which encodes the amino acid sequence <SEQ ID 1716>. This protein is predicted to be Bacterial mutT protein. Analysis of this protein sequence reveals the following:

```
Possible site: 13
>>> Seems to have no N-terminal signal sequence

----- Final Results -----
             bacterial cytoplasm --- Certainty = 0.2417(Affirmative) < succ>
               bacterial membrane --- Certainty = 0.0000(Not Clear)   < succ>
                bacterial outside --- Certainty = 0.0000(Not Clear)   < succ>
```

The protein has homology with the following sequences in the GENPEPT database:

```
>GP: AAG06568 GB: AE004742 hypothetical protein
[Pseudomonas aeruginosa]
Identities = 57/131 (43%), Positives = 82/131 (62%)

Query:   10 FSGAKIALFCEGKILTSLRDDFPDLPYAGFWDLPGGGREDNETPLECLFREVDEELSLTL   69
            FSGAK+ALF     ++    RD+ P +P+  G+WD PGGGRE   ETP EC   RE++EE S+   L
```

```
                              -continued
Sbjct:    7 FSGAKLALFYGDHLVVYKRDEKPGIPFPGYWDFPGGGREGLETPAECALRELEEEFSIRL   66

Query:   70 TRNHIDWVKTYRGMLKPDKLSVFMVGHISQKEYDSIVLGDEGQDYKLMSIDEFLSHKKVI  129
             I+W + Y         + F+V +  +E+++I  GDEGQ ++LM +D +L+H   +
Sbjct:   67 EEPRIEWQRQYPSTSGSAPFAYFLVARLEDREFEAIRFGDEGQYWRLMEVDAYLAHAMAV  126

Query:  130 PQLQERLRDYL                                                  140
             P LQ RL DYL
Sbjct:  127 PYLQSRLGDYL                                                  137
```

No corresponding DNA sequence was identified in *S. pyogenes*.

Based on this analysis, it was predicted that this protein and its epitopes, could be useful antigens for vaccines or diagnostics.

EXAMPLE 538

A DNA sequence (GBSx0577) was identified in *S. agalactiae* <SEQ ID 1717> which encodes the amino acid sequence <SEQ ID 1718>. Analysis of this protein sequence reveals the following:

```
Possible site: 46
>>> Seems to have no N-terminal signal sequence

----- Final Results -----
              bacterial cytoplasm --- Certainty = 0.3299(Affirmative) < succ>
              bacterial membrane  --- Certainty = 0.0000(Not Clear)   < succ>
               bacterial outside  --- Certainty = 0.0000(Not Clear)   < succ>
```

The protein has no significant homology with any sequences in the GENPEPT database.

A related DNA sequence was identified in *S. pyogenes* <SEQ ID 1719> which encodes the amino acid sequence <SEQ ID 1720>. Analysis of this protein sequence reveals the following:

```
Possible site: 41
>>> Seems to have no N-terminal signal sequence

----- Final Results -----
              bacterial cytoplasm --- Certainty = 0.5527(Affirmative) < succ>
              bacterial membrane  --- Certainty = 0.0000(Not Clear)   < succ>
               bacterial outside  --- Certainty = 0.0000(Not Clear)   < succ>
```

An alignment of the GAS and GBS proteins is shown below:

```
Identities = 111/156 (71%), Positives = 128/156 (81%)

Query:    1 MAKFGFLSVLEEELDKHLQYDFAMDWDKKNHTVEVTFILEAQNSSAIETVDDQGETSSED   60
            MA +GFLSVLEEE+DKH QYD+AMDWDKKNH VEVTF+LEAQN  AI+T+DD GE + +D
Sbjct:    1 MATYGFLSVLEEEMDKHFQYDYAMDWDKKNHAVEVTFVLEAQNKEAIKTIDDSGEVTQDD   60

Query:   61 IVFEDYVLFYNPVKSRFDAEDYLVTIPYEPKKGLSREFLAYFAETLNEVATEGLSDLMDF  120
            IVFEDYVLFYNP KS+FDA DYLVTIP++ KKG SREFLAYFA+ LN+VA EG SDLMDF
Sbjct:   61 IVFEDYVLFYNPAKSQFDAADYLVTIPFDAKKGFSREFLAYFAQFLNDVAIEGHSDLMDF  120

Query:  121 LTDDSIEEFGLSWDTDAFENGRAELKETEFYPYRY                          156
            L DDS +F L W+  AFE G+   L+E   YPYRY
Sbjct:  121 LADDSKADFFLEWNAQAFEEGQQGLEEAASYPYRY                          156
```

Based on this analysis, it was predicted that these proteins and their epitopes could be useful antigens for vaccines or diagnostics.

EXAMPLE 539

A DNA sequence (GBSx0578) was identified in *S. agalactiae* <SEQ ID 1721> which encodes the amino acid sequence <SEQ ID 1722>. Analysis of this protein sequence reveals the following:

```
Possible site: 26
>>> Seems to have no N-terminal signal sequence

----- Final Results -----
            bacterial cytoplasm --- Certainty = 0.2846(Affirmative) < succ>
             bacterial membrane --- Certainty = 0.0000(Not Clear)   < succ>
              bacterial outside --- Certainty = 0.0000(Not Clear)   < succ>
```

The protein has homology with the following sequences in the GENPEPT database:

```
>GP: CAB51273 GB: AL096872 putative acetyltransferase [Streptomyces
coelicolor A3(2)]
Identities = 35/109 (32%), Positives = 62/109 (56%), Gaps = 1/109 (0%)

Query:  51 VAEVDDKIAGVLDFGPYYPFPAGKHVATF-GILIAEPYQGQGLGKALLKALLTEAKAQGY  109
           VAE+D  + G +  G    P  +  HV      G+ +A    +G G+G+AL++A + EA+ +G+
Sbjct:  56 VAELDGAVVGYVRLGFPTPLASNTHVRQIRGLAVAGAARGHGVGRALVRAAVEEARHEGF 115

Query: 110 IKIAMHVMGNNSRAISLYQKYGFTEEARITKAFFIENHYVDALIFAKDL            158
           +I + V+G+N+ A  LY+  GF E    + F ++ YVD ++  + L
Sbjct: 116 RRITLRVLGHNTAARGLYESEGFVVEGVQPEEFHLDGRYVDDVLMGQML            164
```

A related DNA sequence was identified in *S. pyogenes* <SEQ ID 1723> which encodes the amino acid sequence <SEQ ID 1724>. Analysis of this protein sequence reveals the following:

```
Possible site: 18
>>> Seems to have no N-terminal signal sequence

----- Final Results -----
            bacterial cytoplasm --- Certainty = 0.0229(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below:

```
Identities = 34/108 (31%), Positives = 59/108 (54%), Gaps = 7/108 (6%)

Query:  35 TESDLEKNLANGMSFFV-----AEVDDKIAGVLDFGPYYPFPAGKHVATFGILIAEPYQG   89
           T  +L   L+   + F+      A +D+K+ G+L+        G+   A   +L+A+ Y+G
Sbjct:  43 TPQELSDFLSRSQTSFIDFCLLARLDEKVVGLLNLSGEV-LSQGQAEADVFMLVAKTYRG  101

Query:  90 QGLGKALLKALLTEAKAQGYIK-IAMHVMGNNSRAISLYQKYGFTEEA             136
             G+G+ LL+  L  A+    YI+ +  + V    N++AI LY+KYGF  E+
Sbjct: 102 YGIGQLLLEIALDWAEENPYIESLKLDVQVRNTKAIYLYKKYGFRIES             149
```

Based on this analysis, it was predicted that these proteins and their epitopes could be useful antigens for vaccines or diagnostics.

EXAMPLE 540

A DNA sequence (GBSx0579) was identified in *S. agalactiae* <SEQ ID 1725> which encodes the amino acid sequence <SEQ ID 1726>. Analysis of this protein sequence reveals the following:

```
Possible site: 46
>>> Seems to have no N-terminal signal sequence

----- Final Results -----
            bacterial cytoplasm --- Certainty = 0.2056(Affirmative) < succ>
             bacterial membrane --- Certainty = 0.0000(Not Clear)   < succ>
              bacterial outside --- Certainty = 0.0000(Not Clear)   < succ>
```

The protein has homology with the following sequences in the GENPEPT database:

```
>GP: CAB14712 GB: Z99118 similar to hypothetical proteins [Bacillus subtilis]
Identities = 248/417 (59%), Positives = 314/417 (74%), Gaps = 4/417 (0%)

Query:   5 LALRMRPRNINEVIGQQHLVGNGKIIDRMVAANMLSSMILYGPPGIGKTSIASAIAGTTK        64
           LA RMRP  I ++IGQQHLV   KII RMV A  LSSMILYGPPGIGKTSIA+AIAG+T
Sbjct:   4 LAYRMRPTKIEDIIGQQHLVAEDKIIGRMVQAKHLSSMILYGPPGIGKTSIATAIAGSTS        63

Query:  65 YAFRTFNATVDSKKRLQEIAEEAKFSGGLVLLLDEIHRLDKTKQDFLLPLLENGNIIMIG       124
            AFR  NA +++KK ++ +A+EAK SG ++L+LDE+HRLDK KQDFLLP LENG II+IG
Sbjct:  64 IAFRKLNAVINNKKDMEIVAQEAKMSGQVILILDEVHRLDKGKQDFLLPYLENGMIILIG       123

Query: 125 ATTENPFFSVTPAIRSRVQIFELEPLSNEDIKKAIQLAISDKERGF-PFLVTIDDEALDF       183
           ATT NP+ ++ PAIRSR QIFELEPL+ E IK+A++ A+ D+ RG    + V+IDD+A++
Sbjct: 124 ATTANPYHAINPAIRSRTQIFELEPLTPELIKQALERALHDEHRGLGTYSVSIDDQAMEH       183

Query: 184 IVTATNGDLRSAYNSLDLAVMSTSPNEDGSRHISLETMENSLQCSYITMDKNGDGHYDIL       243
               GD+RSA N+L+LAV+ST  + DG   HI+LET E   LQ    + DK+GD HYD+L
Sbjct: 184 FAHGCGGDVRSALNALELAVLSTKESADGEIHITLETAEECLQKKSFSHDKDGDAHYDVL       243

Query: 244 SALQKSIRGSDVNASLHYAARLVEAGDLPSLARRLTIIAYEDIGLANPEAQIHTVTALEA       303
           SA QKSIRGSD NA+LHY ARL+EAGDL S+ARRL +IAYEDIGLA+P+A    + A++
Sbjct: 244 SAFQKSIRGSDANAALHYLARLIEAGDLESIARRLLVIAYEDIGLASPQAGPRVLNAIQT       303

Query: 304 AQRIGFPEARILIANIVVDLALSPKSNSAYLAMDAALADLRRSGNLPIPRHLRDGHYSGS       363
           A+R+GFPEART +AN V++L LSPKSNSA LA+D ALAD+R      +P+HL+D HY G+
Sbjct: 304 AERVGFPEARIPLANAVIELCLSPKSNSAILAIDEALADIRAGKIGDVPKHLKDAHYKGA       363

Query: 364 KTLGNARDYKYPHAYPEKWVKQQYLPDKLVGHNYFEANETGKYERALGSNKERIDKL         420
           + LG   DYKYPH Y   WV+QQYLPD L    Y++  +TGK+E AL   K+  DKL
Sbjct: 364 QELGRGIDYKYPHNYDNGWVEQQYLPDPLKNKQYYKPKQTGKFESAL---KQVYDKL         417
```

A related DNA sequence was identified in *S. pyogenes* <SEQ ID 1727> which encodes the amino acid sequence <SEQ ID 1728>. Analysis of this protein sequence reveals the following:

```
Possible site: 60
>>> Seems to have no N-terminal signal sequence

----- Final Results -----
            bacterial cytoplasm --- Certainty = 0.2374(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below:

```
Identities = 394/422 (93%), Positives = 409/422 (96%)

Query:   1 MADNLALRMRPRNINEVIGQQHLVGNGKIIDRMVAANMLSSMILYGPPGIGKTSIASAIA        60
           M D+LALRMRP+ I+EVIGQ+HLVG GKII RMV AN LSSMILYGPPGIGKTSIASAIA
Sbjct:   1 MPDHLALRMRPKTISEVIGQKHLVGEGKIIRRMVEANRLSSMILYGPPGIGKTSIASAIA        60

Query:  61 GTTKYAFRTFNATVDSKKRLQEIAEEAKFSGGLVLLLDEIHRLDKTKQDFLLPLLENGNI       120
           GTT+YAFRTFNAT+DSKKRLQEIAEEAKFSGGLVLLLDEIHRLDKTKQDFLLPLLENG I
Sbjct:  61 GTTRYAFRTFNATIDSKKRLQEIAEEAKFSGGLVLLLDEIHRLDKTKQDFLLPLLENGTI       120

Query: 121 IMIGATTENPFFSVTPAIRSRVQIFELEPLSNEDIKKAIQLAISDKERGFPFLVTIDDEA       180
           IMIGATTENPFFSVTPAIRSRVQIFELEPLSNEDIK AIQLAISDKERGFPFLVTIDDEA
Sbjct: 121 IMIGATTENPFFSVTPAIRSRVQIFELEPLSNEDIKTAIQLAISDKERGFPFLVTIDDEA       180

Query: 181 LDFIVTATNGDLRSAYNSLDLAVMSTSPNEDGSRHISLETMENSLQCSYITMDKNGDGHY       240
```

-continued

```
              LDFIVTATNGDLRSAYNSLDLAVMSTSPNEDGSRHISLETMENSLQ SYITMDKNGDGHY
Sbjct: 181 LDFIVTATNGDLRSAYNSLDLAVMSTSPNEDGSRHISLETMENSLQRSYITMDKNGDGHY 240

Query: 241 DILSALQKSIRGSDVNASLHYAARLVEAGDLPSLARRLTIIAYEDIGLANPEAQIHTVTA 300
              D+LSALQKSIRGSDVNASLHYAARLVEAGDLPSLARRLTIIAYEDIGLANP+AQ+HTVTA
Sbjct: 241 DVLSALQKSIRGSDVNASLHYAARLVEAGDLPSLARRLTIIAYEDIGLANPDAQVHTVTA 300

Query: 301 LEAAQRIGFPEARILIANIVVDLALSPKSNSAYLAMDAALADLRRSGNLPIPRHLRDGHY 360
              L+AAQRIGFPEARI IAN+V+DLALSPKSNSAYLAMDAALADLR SGNLPIPRHLRDGHY
Sbjct: 301 LDAAQRIGFPEARIPIANVVIDLALSPKSNSAYLAMDAALADLRTSGNLPIPRHLRDGHY 360

Query: 361 SGSKTLGNARDYKYPHAYPEKWVKQQYLPDKLVGHNYFEANETGKYERALGSNKERIDKL 420
              +GSK LGNA+DY YPHAYPEKWVKQQYLPDKLVGH+YFEANETGKYERALGSNKERIDKL
Sbjct: 361 AGSKDLGNAKDYLYPHAYPEKWVKQQYLPDKLVGHHYFEANETGKYERALGSNKERIDKL 420

Query: 421 SD                                                           422
              SD
Sbjct: 421 SD                                                           422
```

Based on this analysis, it was predicted that these proteins and their epitopes could be useful antigens for vaccines or diagnostics.

EXAMPLE 541

A DNA sequence (GBSx0580) was identified in *S. agalactiae* <SEQ ID 1729> which encodes the amino acid sequence <SEQ ID 1730>. Analysis of this protein sequence reveals the following:

```
Possible site: 16
>>> Seems to have no N-terminal signal sequence

----- Final Results -----
           bacterial cytoplasm --- Certainty = 0.2991(Affirmative) < succ>
           bacterial membrane  --- Certainty = 0.0000(Not Clear)   < succ>
            bacterial outside  --- Certainty = 0.0000(Not Clear)   < succ>
```

A related GBS nucleic acid sequence <SEQ ID 10207> which encodes amino acid sequence <SEQ ID 10208> was also identified.

The protein has no significant homology with any sequences in the GENPEPT database.

No corresponding DNA sequence was identified in *S. pyogenes*.

Based on this analysis, it was predicted that these proteins and their epitopes could be useful antigens for vaccines or diagnostics.

EXAMPLE 542

A DNA sequence (GBSx0581) was identified in *S. agalactiae* <SEQ ID 1731> which encodes the amino acid sequence <SEQ ID 1732>. Analysis of this protein sequence reveals the following:

```
Possible site: 29
>>> Seems to have no N-terminal signal sequence

----- Final Results -----
           bacterial cytoplasm --- Certainty = 0.2402(Affirmative) < succ>
           bacterial membrane  --- Certainty = 0.0000(Not Clear)   < succ>
            bacterial outside  --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 543

A DNA sequence (GBSx0582) was identified in *S. agalactiae* <SEQ ID 1733> which encodes the amino acid sequence <SEQ ID 1734>. Analysis of this protein sequence reveals the following:

```
Possible site: 49
>>> Seems to have an uncleavable N-term signal seq
    INTEGRAL      Likelihood = -10.40    Transmembrane    231-247 (225-250)
    INTEGRAL      Likelihood =  -9.92    Transmembrane    159-175 (151-179)
    INTEGRAL      Likelihood =  -9.08    Transmembrane     21-37  (18-43)
    INTEGRAL      Likelihood =  -9.08    Transmembrane    181-197 (176-201)
    INTEGRAL      Likelihood =  -3.35    Transmembrane    111-127 (110-130)
    INTEGRAL      Likelihood =  -2.81    Transmembrane     74-90  (74-93)

----- Final Results -----
           bacterial membrane --- Certainty = 0.5161(Affirmative) < succ>
            bacterial outside --- Certainty = 0.0000(Not Clear)   < succ>
          bacterial cytoplasm --- Certainty = 0.0000(Not Clear)   < succ>
```

The protein has homology with the following sequences in the GENPEPT database:

```
>GP: CAB15891 GB: Z99123 yxlG [Bacillus subtilis]
Identities = 54/203 (26%), Positives = 100/203 (48%), Gaps = 7/203 (3%)

Query:    1 MTGLIPMLKKEWLENSRSHKALALLLISIIFGILGPLTALLMPEIMA--GILPKKLQEAI   58
            M  ++ +L+KEWLE  +S K + L + +I G+  PLT   MPEI+A  G LP  ++ +
Sbjct:    1 MKVMMALLQKEWLEGWKSGKLIWLPIAMMIVGLTQPLTIYYMPEIIAHGGNLPDGMKISF   60

Query:   59 PDPTYLDSYSQYFKNINQLGLILLVFLFSGSLTQEFTRGTLINLITKGLSKKAIILAKFI  118
            P+ +       N LG+ L++F   GS+  E  +G    ++++ ++     I++K++
Sbjct:   61 TMPSGSEVMVSTLSQFNTLGMALVIFSVMGSVANERNQGVTALIMSRPVTAAHYIVSKWL  120

Query:  119 MMTLIWSISYILGSLTQYAYTLYYFNNHGQHKLIV-YGTSWIFGLLLLSLILFYSVIFRK  177
            + ++I  +S+  G    Y Y  F +   +    G   ++ +++  L  S    IFR
Sbjct:  121 IQSVIGIMSFAAGYGLAYYYVRLLFEDASFSRFAASLGLYALWVIFIVTAGLAGSTIFR-  179

Query:  178 TAGVLIAC---LMTIVAFFISGF                                      197
            + G   AC   L   V+F + F
Sbjct:  180 SVGAAAACGIGLTAAVSFAVHYF                                      202
```

No corresponding DNA sequence was identified in *S. pyogenes*.

Based on this analysis, it was predicted that this protein and its epitopes, could be useful antigens for vaccines or diagnostics.

EXAMPLE 544

A DNA sequence (GBSx0583) was identified in *S. agalactiae* <SEQ ID 1735> which encodes the amino acid sequence <SEQ ID 1736>. This protein is predicted to be ABC transporter, ATP-binding protein. Analysis of this protein sequence reveals the following:

```
Possible site: 61
>>> Seems to have no N-terminal signal sequence

----- Final Results -----
          bacterial cytoplasm --- Certainty = 0.1344(Affirmative) < succ>
           bacterial membrane --- Certainty = 0.0000(Not Clear)   < succ>
            bacterial outside --- Certainty = 0.0000(Not Clear)   < succ>
```

The protein has homology with the following sequences in the GENPEPT database:

```
>GP: CAB15892 GB: Z99123 similar to ABC transporter (ATP-binding
protein) [Bacillus subtilis]
Identities = 116/303 (38%), Positives = 175/303 (57%), Gaps = 18/303 (5%)

Query:   4 ISLQNLSKSFGDQIILNQVSLELEENKIYGFVGPNGAGKTTTIKMILGLLKVDSGTISVM    63
           +S+++L KS+     +  VS + EN+     +GPNGAGKTTT++M+ GLL   SGTI ++
Sbjct:   2 LSIESLCKSYRHHEAVKNVSFHVNENECVALLGPNGAGKTTTLQMLAGLLSPTSGTIKLL   61

Query:  64 GNPVTFGQTKSNQVIGYLPDVPEFYDYMTAQEYLQLC---AGLAQNKTSLPIADLLEQVG  120
            G        +  ++IGYLP  P FY +MTA E+L      +GL++ K    I ++LE VG
Sbjct:  62 GE-----KKLDRRLIGYLPQYPAFYSWMTANEFLTFAGRLSGLSRKCQEKIGEMLEFVG  116

Query: 121 LADN-QQRISTYSRGMKQRLGLAQALIHNPKILICDEPTSALDPQGRQEILSIISQLRGQ  179
            L +   +RI  YS GMKQRLGLAQAL+H PK LI DEP SALDP GR E+L ++ +L+
Sbjct: 117 LHEAAHKRIGGYSGGMKQRLGLAQALLHKPKFLILDEPVSALDPTGRFEVLDMMRELKKH  176

Query: 180 KTVIFSTHILSDVEKVCDQVLILTKSGIH---NLEDLRDKASASVNQLNLLIKVSDNEAQ  236
            V+FSTH+L D E+VCDQV+I++   I       L++L+ +   +V  L++ K+     +
Sbjct: 177 MAVLFSTHVLHDAEQVCDQVVIMKNGEISWKGELQELKQQQQTNVFTLSVKEKLEGWLEE  236

Query: 237 KLALRFPLNQKDQYYKVHLELSEANNREQALASFYRYLVEQEITPYFIELLEDSLEDFYL  296
            K   + + +     + EL + +     L+        + + +T    E   +SLED YL
Sbjct: 237 KPYVSAIVYKNPS--QAVFELPDIHAGRSLLSD----CIRKGLTVTRFEQKTESLEDVYL  290

Query: 297 EVI                                                          299
           +V+
Sbjct: 291 KVV                                                          293
```

There is also homology to SEQ ID 686.

Based on this analysis, it was predicted that this protein and its epitopes, could be useful antigens for vaccines or diagnostics.

EXAMPLE 545

A DNA sequence (GBSx0584) was identified in *S. agalactiae* <SEQ ID 1737> which encodes the amino acid sequence <SEQ ID 1738>. Analysis of this protein sequence reveals the following:

```
Possible site: 32
>>> Seems to have no N-terminal signal sequence

----- Final Results -----
         bacterial cytoplasm --- Certainty = 0.4383(Affirmative) < succ>
          bacterial membrane --- Certainty = 0.0000(Not Clear)   < succ>
            bacterial outside --- Certainty = 0.0000(Not Clear)   < succ>
```

The protein has homology with the following sequences in the GENPEPT database:

```
>GP: AAB71491 GB: U53767 ORF6 [Bacillus pumilus]
Identities = 25/60 (41%), Positives = 41/60 (67%)

Query:  2 IGDTILFERTRLGMTQEKLSDYLHLTKATISKWENNQAKPDIDYLILMAKLFDMTLDELV   61
          +G  I  +R  L ++QE +++ L +++   ISKWE NQ++P +D LI +A+LFD  + ELV
Sbjct:  4 LGSNISNKRKSLKLSQEYVAEQLGVSRQAISKWETNQSEPSMDNLIRLAELFDSDIKELV   63
```

There is also homology to SEQ ID 1740.

Based on this analysis, it was predicted that this protein and its epitopes, could be useful antigens for vaccines or diagnostics.

EXAMPLE 546

A DNA sequence (GBSx0585) was identified in *S. agalactiae* <SEQ ID 1741> which encodes the amino acid sequence <SEQ ID 1742>. Analysis of this protein sequence reveals the following:

```
Possible site: 41
>>> Seems to have no N-terminal signal sequence

----- Final Results -----
            bacterial cytoplasm --- Certainty = 0.4241(Affirmative) < succ>
            bacterial membrane  --- Certainty = 0.0000(Not Clear)   < succ>
             bacterial outside  --- Certainty = 0.0000(Not Clear)   < succ>
```

The protein has homology with the following sequences in the GENPEPT database:

```
>GP: CAB15470 GB: Z99121 yvdC [Bacillus subtilis]
Identities = 59/104 (56%), Positives = 76/104 (72%)

Query:  1 MDITAYQKWVSEFYKKRNWYQYNSFIRSNFLCEEVGELAQAIRKYEIGRDRPDEIEKSNN   60
          M +   +KW+ EFY+KR W +Y  FIR  FL EE GELA+A+R YEIGRDRPDE E S
Sbjct:  1 MQLADAEKWMKEFYEKRGWTEYGPFIRVGFLMEEAGELARAVRAYEIGRDRPDEKESSRA  60

Query: 61 ENLNDIKEELGDVLDNIFILADQYNISLEEIIEAHKNKLEKRFE                 104
          E   ++ EE+GDV+ NI ILAD Y +SLE++++AH+ KL KRFE
Sbjct: 61 EQKQELIEEMGDVIGNIAILADMYGVSLEDVMKAHQEKLTKRFE                 104
```

No corresponding DNA sequence was identified in *S. pyogenes*.

Based on this analysis, it was predicted that this protein and its epitopes, could be useful antigens for vaccines or diagnostics.

EXAMPLE 547

A DNA sequence (GBSx0586) was identified in *S. agalactiae* <SEQ ID 1743> which encodes the amino acid sequence <SEQ ID 1744>. Analysis of this protein sequence reveals the following:

```
Possible site: 61
>>> Seems to have no N-terminal signal sequence

----- Final Results -----
            bacterial cytoplasm --- Certainty = 0.0453(Affirmative) < succ>
            bacterial membrane  --- Certainty = 0.0000(Not Clear)   < succ>
             bacterial outside  --- Certainty = 0.0000(Not Clear)   < succ>
```

The protein has homology with the following sequences in the GENPEPT database:

```
>GP: BAB06803 GB: AP001517 unknown conserved protein [Bacillus halodurans]
Identities = 87/187 (46%), Positives = 125/187 (66%)

Query:   1 MKITVFCGASNGNNPIYSQKIVELGEWMIKNNHDLVYGGGKVGLMGVIADTVINNGGQAI   60
           MKI VFCG+SNG + +Y +    +LG+ + +    LVYGG  VG+MG +AD+V+  GG+ I
Sbjct:   1 MKIAVFCGSSNGASDVYKEGARQLGKELARRGITLVYGGASVGIMGAVADSVLEAGGEVI  60

Query:  61 GVIPTFLKDREIAHTNLSKLIVVENMPQRKGKMMSLGEAYIALPGGPGTLEEISEVISWS 120
           GV+P FL++ EI+H +L++KLIVVE M +RK KM  L + ++ALPGGPGTLEE   E+ +W+
Sbjct:  61 GVMPRFLEEPEISHPHLTKLIVVETMHERKAKMAELADGFLALPGGPGTLEEFFEIFTWA 120

Query: 121 RIGQNDSPCILYNINGYFNHLESMFDHMVSEGFLSQNDRNNVLFSDDIIEIEKFIKDYQS 180
           +IG +  PC L NIN YF+ L ++   HM +E FL + R+  L    D I +      Y+
Sbjct: 121 QIGLHQKPCGLLNINHYFDPLVTLLHHMSNEQFLHEKYRSMALVHTDPILLLDQFSTYEP 180

Query: 181 PTIRKYS                                                      187
           PT++ YS
Sbjct: 181 PTVKAYS                                                      187
```

No corresponding DNA sequence was identified in *S. pyogenes*.

Based on this analysis, it was predicted that this protein and its epitopes, could be useful antigens for vaccines or diagnostics.

EXAMPLE 548

A DNA sequence (GBSx0587) was identified in *S. agalactiae* <SEQ ID 1745> which encodes the amino acid sequence <SEQ ID 1746>. Analysis of this protein sequence reveals the following:

```
Possible site: 16
>>> Seems to have no N-terminal signal sequence

----- Final Results -----
         bacterial cytoplasm --- Certainty = 0.5288(Affirmative) < succ>
          bacterial membrane --- Certainty = 0.0000(Not Clear)   < succ>
           bacterial outside --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 549

A DNA sequence (GBSx0588) was identified in *S. agalactiae* <SEQ ID 1747> which encodes the amino acid sequence <SEQ ID 1748>. This protein is predicted to be integrase. Analysis of this protein sequence reveals the following:

```
Possible site: 38
>>> Seems to have no N-terminal signal sequence

----- Final Results -----
         bacterial cytoplasm --- Certainty = 0.3685(Affirmative) < succ>
          bacterial membrane --- Certainty = 0.0000(Not Clear)   < succ>
           bacterial outside --- Certainty = 0.0000(Not Clear)   < succ>
```

The protein has homology with the following sequences in the GENPEPT database:

```
>GP: AAF12706 GB: AF066865 integrase [bacteriophage TPW22]
Identities = 106/377 (28%), Positives = 199/377 (52%), Gaps = 31/377 (8%)

Query:   4 ARYRRRGNQNLWAYEIREEGKTVAYNS----GFKTKKLAEAEAEPILQKLRTGSIITKNI   59
           A +R+RG    W + +    Y       G+KTKK AEA A+   ++L   S    +I
Sbjct:   2 ANFRKRGKT--WQFRLSYKDNNGEYKKFEKGGYKTKKEAEAAADEAKKRLNNHSEFDNDI   59

Query:  60 SLPELYQEWLDLKIMPSNRSDVTKKKYLSRKVTLEKLFGDKPISQIRPSEYQRIMNNYGQ  119
           SL + +++W  +   P + ++ T + Y       ++K    DKPI++I P+ YQ ++N
Sbjct:  60 SLYDFFEKWAKVYKKP-HVTEATWRTYKRTLNLIDKYIKDKPIAEITPTFYQAVLNKMSL  118

Query: 120 RVSRNFLGRLNTGVKQSLQMAIADKVMIEDFTQNVELFSTVKSQDADSKYLHSEKAYLDL  179
             + L +    +K ++++A+ +KV+ E+F   + S + ++  + KYLH+++ YL L
Sbjct: 119 LYRQESLDKFYFQIKSAMKIAVHEKVISENFADFTKAKSKLAARPVEEKYLHADE-YLKL  177

Query: 180 INAVKDKFNYKKSVVPYIIYFLLKTGMRYGELIALTWEDIDFDKGIFKTYRRFN-SETSQ  238
            +   ++K  Y     + Y    TGMR+ EL+ LTW +DFDK    R ++ S T+
Sbjct: 178 LAIAEEKMEYTSY---FACYLTAVTGMRFAELLGLTWSHVDFDKKEISIQRTWDYSITNN  234

Query: 239 FVPPKNKTSIRIVPVDNECLEILKNLKIEQNQSNKELGLQNTNNMVFQHFGYPNSVPSTN  298
           F    KN++S R +P+ ++ +++LK   K        KE  +N   + V  +       S N
Sbjct: 235 FAETKNESSKRKIPISSKTIKLLKKYK-------KEYWHENKYDRVIYNL-------SNN  280

Query: 299 GTNKVLRGIVQELNIEPIITTKGARHTYGSFLWHRGYDLGIIAKILGHKDISMLIEVYGH  358
           G NK ++ ++   + P      RH++ S+L ++G DL   ++K+LGH+++++ ++VY H
Sbjct: 281 GLNKTIK-VIAGRKVHP----HSLRHSFASYLIYKGIDLLTVSKLLGHENLNVTLKVYAH  335

Query: 359 TLEEKIQEEYNEIKQLW                                            375
             L+E   QE + I++++
Sbjct: 336 QLKEMEQENNDVIRKIF                                            352
```

There is also homology to SEQ ID 578.

Based on this analysis, it was predicted that this protein and its epitopes, could be useful antigens for vaccines or diagnostics.

EXAMPLE 550

A DNA sequence (GBSx0589) was identified in *S. agalactiae* <SEQ ID 1749> which encodes the amino acid sequence <SEQ ID 1750>. Analysis of this protein sequence reveals the following:

```
Possible site: 54
>>> Seems to have no N-terminal signal sequence

----- Final Results -----
            bacterial cytoplasm --- Certainty = 0.2710(Affirmative) < succ>
            bacterial membrane  --- Certainty = 0.0000(Not Clear)   < succ>
             bacterial outside  --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 551

A DNA sequence (GBSx0590) was identified in *S. agalactiae* <SEQ ID 1751> which encodes the amino acid sequence <SEQ ID 1752>. Analysis of this protein sequence reveals the following:

```
Possible site: 51
>>> Seems to have no N-terminal signal sequence

----- Final Results -----
            bacterial cytoplasm --- Certainty = 0.2534(Affirmative) < succ>
            bacterial membrane  --- Certainty = 0.0000(Not Clear)   < succ>
             bacterial outside  --- Certainty = 0.0000(Not Clear)   < succ>
```

The protein has homology with the following sequences in the GENPEPT database:

```
>GP: BAA06248 GB: D29979 ORF3 [Bacillus stearothermophilus]
Identities = 81/263 (30%), Positives = 135/263 (50%), Gaps = 14/263 (5%)

Query:  65 MGVHVELKGQGCRQYEEFIEGNDNNWTSLVKRLI-DNNSNFTRLDIANDIFDESLNVQRL  123
            MG+HVE+ GQGCR +E       NW  L  RL+ +   N TRLD+A D F     + L
Sbjct:   1 MGIHVEMTGQGCRLFELH---TSINWYELFYRLVYEYEVNITRLDVAVDDFKGYFKINTL   57

Query: 124 YEYSKKGLCITTARHAEYHEKFVIDSGELVGETVVFGARGNQQWCVYNKLMEQNGKLQTD  183
            + K     + +A + E  VI+ GE +G T+ FGA +      + E+N ++  D
Sbjct:  58 VKKLKDDEVTSRFKKARHIENIVIEGGETIGHTLYFGAPSSD---IQVRFYEKNVQMGMD  114

Query: 184 IDINSWVRAELRCWQEKANLIAHQL-NDMRPLASIYFEAINGHYRFVSPKARDKNKRRRE  242
            ID+  W R E++   ++A+++A  + +D+ PL  I    +  +F + KA DKNK+R
Sbjct: 115 IDV--WNRTEIQLRDDRAHVVAQIIADDVLPLGEIVAGLLRNYIQFRTRKATDKNKKRWP  172

Query: 243 SVRWWQNYINTEEKTRLSIVREKPTLRQSEAWTDKQVSKTIAKVYMAKYEAYGIDQAEVF  302
              R+W N++   + R++     K ++ +    W D QVSK+   +Y   E    ++ + F
Sbjct: 173 LARFWLNFLGDVQPLRIAKQMPKTSIEKKYRWIDSQVSKSFFMIYYCLNE----EEKQRF  228

Query: 303 LQDLLRRGVEKFTDNDEKEIEQY                                       325
            + D+L  G  K T  D + Q+
Sbjct: 229 IDDVLAEGASKLTKADLQVINQF                                       251
```

No corresponding DNA sequence was identified in *S. pyogenes*.

Based on this analysis, it was predicted that this protein and its epitopes, could be useful antigens for vaccines or diagnostics.

EXAMPLE 552

A DNA sequence (GBSx0591) was identified in *S. agalactiae* <SEQ ID 1753> which encodes the amino acid sequence <SEQ ID 1754>. Analysis of this protein sequence reveals the following:

```
Possible site: 13
>>> Seems to have no N-terminal signal sequence

----- Final Results -----
            bacterial cytoplasm --- Certainty = 0.2700(Affirmative) < succ>
            bacterial membrane  --- Certainty = 0.0000(Not Clear)   < succ>
             bacterial outside  --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 553

A DNA sequence (GBSx0592) was identified in *S. agalactiae* <SEQ ID 1755> which encodes the amino acid sequence <SEQ ID 1756>. Analysis of this protein sequence reveals the following:

```
Possible site: 50
>>> Seems to have no N-terminal signal sequence

----- Final Results -----
          bacterial cytoplasm --- Certainty = 0.3121(Affirmative) < succ>
          bacterial membrane  --- Certainty = 0.0000(Not Clear)   < succ>
          bacterial outside   --- Certainty = 0.0000(Not Clear)   < succ>
```

The protein has no significant homology with any sequences in the GENPEPT database.

A related DNA sequence was identified in *S. pyogenes* <SEQ ID 1757> which encodes the amino acid sequence <SEQ ID 1758>. Analysis of this protein sequence reveals the following:

```
Possible site: 24
>>> Seems to have no N-terminal signal sequence

----- Final Results -----
          bacterial cytoplasm --- Certainty = 0.2913(Affirmative) < succ>
          bacterial membrane  --- Certainty = 0.0000(Not Clear)   < succ>
          bacterial outside   --- Certainty = 0.0000(Not Clear)   < succ>
```

An alignment of the GAS and GBS proteins is shown below:

```
Identities = 19/52 (36%), Positives = 33/52 (62%)

Query:  8 FGPNLTRLRKERGISQVELSNQLQIGKQSISDYEKQKAFPTFANLDKIAEYF  59
          F  NL  L   ++ I Q+++ N+L I K +I+ Y K ++ PT  N+ K+A++F
Sbjct: 15 FSTNLNMLMAKKNIKQIDIHNKLGIPKSTITGYVKGRSLPTAGNVQKLADFF  66
```

Based on this analysis, it was predicted that these proteins and their epitopes could be useful antigens for vaccines or diagnostics.

EXAMPLE 554

A DNA sequence (GBSx0593) was identified in *S. agalactiae* <SEQ ID 1759> which encodes the amino acid sequence <SEQ ID 1760>. Analysis of this protein sequence reveals the following:

```
Possible site: 54
>>> Seems to have a cleavable N-term signal seq.

----- Final Results -----
          bacterial outside   --- Certainty = 0.3000(Affirmative) < succ>
          bacterial membrane  --- Certainty = 0.0000(Not Clear)   < succ>
          bacterial cytoplasm --- Certainty = 0.0000(Not Clear)   < succ>
```

The protein has homology with the following sequences in the GENPEPT database:

```
>GP:AAA98584 GB:L44593 ORF536; putative [Lactococcus phage BK5-T]
 Identities = 248/532 (46%), Positives = 359/532 (66%), Gaps = 16/532 (3%)

Query:  1 MNFIEQISENNQFPIIFVGSGITQRYFENAPTWEKLLKDIWLELFDEESYYAK--AFELR  58
          MNFIE I +NNQFPIIFVGSG+T+RYF+N   WE+LL ++W  + +E+++Y +    FE
Sbjct:  1 MNFIENIKDNNQFPIIFVGSGVTKRYFKNGLKWEQLLLELWNLVEEEKAFYTQYHVFENL  60
```

-continued

```
Query:  59 ERFEN-----NDFDIYTNLASLLEKEVSKAFINGNIQVDNLDLKTAYELNISPFKQLVAN 113
           + +N       +F+I  +A +LE++++ AF +  + +DNL L  A+  +ISPF+Q +AN
Sbjct:  61 LKSKNLSKSDKEFEINLMMAGILEEKINNAFYSDELNIDNLTLAQAHTENISPFRQCIAN 120

Query: 114 RFSNLKIREEKIEEIKQFSQMLSKARIITTNYDNFIEECLKTINVSVKINVGNKGLFLK 173
           FSNL  ++   EEI  FS+ML KAR I+TTNYDNFIEEC    NVS+K+NVGN GLF+K
Sbjct: 121 TFSNLDRKKGFDEEIISFSKMLVKARFIVTTNYDNFIEECFSKRNVSIKVNVGNSGLFVK 180

Query: 174 SSDYGELYKIHGTVDDASTITITKEDYEKNVTKSALINAKILSNLVESPILFLGYSLTDE 233
           S+DYGELYKIHG+V + +TI IT EDY+N +K AL+NAKILSNL ESPILF+GYSLTD+
Sbjct: 181 SNDYGELYKIHGSVKNPNTICITSEDYKNNESKLALVNAKILSNLTESPILFIGYSLTDK 240

Query: 234 NIRKLLTDFAENSPFDISESAQKIGVVEYLPDSESIETVVSSLPDLSVYYSCLKTDNFTN 293
           NIR+LLT ++EN P++ISE+A +IGVVEY PD   I+ +VS++PDL ++Y+ +TDN+
Sbjct: 241 NIRELLTSYSENLPYEISEAAARIGVVEYTPDKIEIQDIVSNIPDLGIHYTKISTDNYKK 300

Query: 294 IYRLISKINQGFLPSEIAKYENVFRRIIEVKGESKDLKTVLTSYEDLANLTEDEIRSKNI 353
           IY  IS+I QG+LPSEIAK+E   FRKIIEVKG+ K+L TVLTS+ D++ +  +E+++KNI
Sbjct: 301 IYDEISQIEQGYLPSEIAKFEGAFRKIIEVKGKEKELDTVLTSFIDISKINTEELKNKNI 360

Query: 354 VVAFGDERYIYKFPDFKEYVRSYFLDKETIPQEIVIRFIATQPVASHLPIKKYMFAMSEY 413
           VVAFGD +YIYK P +K+Y+R YF +     I + F+  +     +P KK+M  +   +
Sbjct: 361 VVAFGDSKYIYRMPTYKDYIREYFSNSMELDTRIALLFLKKRSANYPVPYKKHMGVIESW 420

Query: 414 --ISKDSNKYTENIKKRLSKEEELSLDDFTSSIGVPLL--HSKTLERQTEIVGILE-ADV 468
             I  D  +  E++K R+S   E  +++   L + L+++ I ++ ++V
Sbjct: 421 GSIPNDLVQEVESLKTRISNFPESIVRTYSIKANKDLAKKYLPYLNKTSTIEDVMSLSNV 480

Query: 469 PDNVRYNFIATHIKNFPKEELFLLVEKIID----EGIFETSRRRFLKAFDLL        516
           P  + FI  I F  EEL   +K ID    +GI  T  R+ +  ++  ++
Sbjct: 481 PLYNKLRFILFKIDKFKVEELKDFIVKNIDMGEGKGISSTLYRKIVMSYSII         532
```

A related GBS gene <SEQ ID 8599> and protein <SEQ ID 8600> were also identified. Analysis of this protein sequence 30 reveals the following:

```
Lipop: Possible site: -1 Crend: 8
McG: Discrim Score: 1.55
GvH: Signal Score (-7.5): 0.27
Possible site: 54
>>> Seems to have a cleavable N-term signal seq.
ALOM program count: 0 value: 2.44 threshold: 0.0
PERIPHERAL Likelihood = 2.44 214
modified ALON score: -0.99

*** Reasoning Step: 3

----- Final Results -----
          bacterial outside --- Certainty = 0.3000(Affirmative) < succ>
          bacterial membrane --- Certainty = 0.0000(Not Clear)  < succ>
          bacterial cytoplasm --- Certainty = 0.0000(Not Clear)  < succ>
```

The protein has homology with the following sequences in the databases:

```
47.3/69.1% over 531aa
Lactococcus lactis
EGAD|36707| hypothetical protein Insert characterized
GP|928833|gb|AAA98584.1||L44593 ORF536; putative {Lactococcus lactis phage BK5-T}
Insert characterized
PIR|T13261|T13261 hypothetical protein 536 - phage BK5-T Insert characterized ORF00184(301-1848 of 2154)
EGAD|36707|38110(1-532 or 536) hypothetical protein {Lactococcus lactis}
GP|928833|gb|AAA98584.1||L44593 ORF536; putative {Lactococcus lactis phage
BK5-T}PIR|T13261|T13261 hypothetical protein 536 - Lactococcus lactis phage BK5-T
% Match = 32.3
% Identity = 47.2   % Similarity = 69.0
Matches = 247  Mismatches = 155  Conservative Sub.s = 114
       126        156        186        216        246        276        306        336
     RMLILKAFYLAKFLKYYC*KK*CGTKRGQLYFRVYGLIIKINKMVSKML**D*QLNKLIINKR*GQELVNFIEQISENNQ
                                                         :||||  |  :|||
                                                         MNFIENIKDNNQ
                                                                  10
```

-continued

```
366        396        426        456        474       495        525        555
FPIIFVGSGITQRYFENAPTWEKLLKDIWLELFDEESYYAK--AFE--LRER---FENNDFDIYTNLASLLEKEVSKAFI
||||||||||:|:|||:|   ||:||  ::|   : :|:::|  :    ||  |::     :|:|    :| :||::::  ||
FPIIFVGSGVTKRYFKNGLKWEQLLLELWNLVEEEKAFYTQYHVFENLLKSKNLSKSDKEFEINLMMAGILEEKINNAFY
           30         40         50        60         70         80         90

585        615        645        675        705       735        765        795
NGNIQVDNLDLKTAYELNISPFKQLVANRFSNLKIREEKIEEIKQFSQMLSKARIIITTNYDNFIEECLKTINVSVKINV
:  :  ||||  |   |: :||||:|:||  ||||  ::   ||||||  :|||||||||:  |||:|||
SDELNIDNLTLAQAHTEHISPPRQCIANTFSNLDRKKGFDEEIISFSKMLVKARFIVTTNYDNFIEECFSKRNVSIKVNV
          110        120        130       140        150        160        170

825        855        885        915        945       975        1005       1035
GNKGLFLKSSDYGELYKIHGTVDDASTITITKEDYEKNVTKSALINAKILSNLVESPILFLGYSLTDENIRKLLTDFAEN
||  |||:||:||||||||||  :||  ||  |||:  |  :|  ||:||||||||||  |||||:|||||||:|||  ::||
GNSGLFVKSNDYGELYKIHGSVKNPNTICITSEDYKNNESKLALVNAKILSNLTESPILFIGYSLTDKNIRELLTSYSEN
          190        200        210       220        230        240        250

1065       1095       1125       1155      1185       1215       1245       1275
SPPDISESAQKIGVVEYLPDSESIETVVSSLPDLSVYYSCLKTDNFTNIYRLISKINQGFLPSEIAKYENVFRKIIEVKG
 |::|||:| :|||||| ||    |::||::|||  ::|:  :  |||:   ||   ||:|  ||:|||||||:|    ||||||||
LPYEISEAAARIGVVEYTPDKIEIQDIVSNIPDLGIHYTKISTDNYKKIYDEISQIEQGYLPSEIAKFEGAFRKIIEVKG
          270        280        290       300        310        320        330

1305       1335       1365       1395      1425       1455       1485       1515
ESKDLKTVLTSYEDLANLTEDEIRSKNIVVAFGDERYIYKFPDFKEYVRSYFLDKETIPQEIVIRFIATQPVASHLPIKK
: |:|   ||||||  |::  :|::||||||||||  ||||   :|||   |||||   |  |:|  |   :| ||
KEKELDTVLTSFIDISKINTEELKNKNIVVAFGDSKYIYKMPTYKDYIREYFSNSMELDTRIALLFLKKRSANYPVPYKK
          350        360        370       380        390        400        410

1569       1599       1629              1683      1710       1740
YMFAMSEY--ISKDSNKYTENIKKRLSKEEELSLDDFTSSIGVPLLHS--KTLERQTEIVGILE-ADVPDNVRYNFIATH
:|   :      |    |   |::|   |:|:|     |  :  ::    |          |::  :|  ::||   :   ||
HMGVIESWGSIPNDLVQEVESLKTRISNFPESIVRTYSIKANKDLAKKYLPYLNKTSTIEDVMSLSNVPLYNKLRFILFK
          430        440        450       460        470        480        490

1770       1818       1848       1878      1908       1938       1968
IKNFPKEELFLLVEKIID----EGIFETSRRRFLKAFDLLHY*IKKSQHCYAMRDFFWTTINKRYENNCFYLTSILQYIF
|   |   |||  ::  | ||      :||  |  |:   ::  ::     |
IDKFKVEELKDFIVKNIDMGEGKGISSTLYRKIVMSYSIITEGI
          510        520        530
```

No corresponding DNA sequence was identified in *S. pyogenes*.

Figure 33:
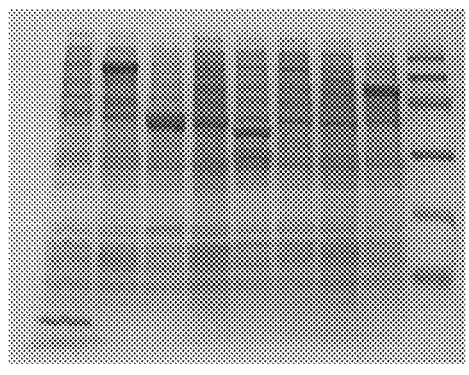

SEQ ID 8600 (GBS142) was expressed in *E. coli* as a His-fusion product. SDS-PAGE analysis of total cell extract is shown in FIG. 18 (lane 5; MW 54 kDa). It was also expressed in *E. coli* as a GST-fusion product. SDS-PAGE analysis of total cell extract is shown in FIG. 33 (lane 6; MW 79.8 kDa).

The GBS142-GST fusion product was purified (FIG. 195, lane 3) and used to immunise mice. The resulting antiserum was used for Western blot (FIG. 249). These tests confirm that the protein is immunoaccessible on GBS bacteria.

Based on this analysis, it was predicted that these proteins and their epitopes could be useful antigens for vaccines or diagnostics.

EXAMPLE 555

A DNA sequence (GBSx0594) was identified in *S. agalactiae* <SEQ ID 1761> which encodes the amino acid sequence <SEQ ID 1762>. This protein is predicted to be integrase. Analysis of this protein sequence reveals the following:

```
Possible site: 37
>>> Seems to have no N-terminal signal sequence

----- Final Results -----
            bacterial cytoplasm --- Certainty = 0.2933(Affirmative) < succ>
            bacterial membrane  --- Certainty = 0.0000(Not Clear)   < succ>
            bacterial outside   --- Certainty = 0.0000(Not Clear)   < succ>
```

The protein has homology with the following sequences in the GENPEPT database:

```
<GP: AAA98585 GB: L44593 integrase [Lactococcus phage BK5-T]
Identities = 124/382 (32%), Positives = 202/382 (52%), Gaps = 21/382 (5%)

Query:   1 MATYRQRGKKKLWDYRIFNEKSELVA-SGSGFKTKREAMNEAMRIE---QQKLLVNSISS   56
           MATY++RGK    W Y I  K  L  + GF TK +A  EAM IE    ++  +V+ I
Sbjct:   1 MATYQKRGKT--WQYSISRTKQGLPRLTKGGFSTKSDAQAEAMDIESKLKKGFIVDPIKQ  58

Query:  57 DITLYDL-WFEWYSLIIKPSNLAETTKNKYFTRGSVIRKLFGNQKVNKIKHSAYQRKLNT  115
            +I+ Y   W E Y     K + + ET  Y        ++     N  +++I  S+YQR LN
Sbjct:  59 EISEYFKDWMELY----KKNAIDEMTYKGYEQTLKYLKTYMPNVLISEITASSYQRALNK 114

Query: 116 YAEKYTKNHVRRLNSDIKKAIQFAKRDGVLLSDFTDGVVIAGRKFVKDADDKYLHSIFD-  174
            +AE + K   + ++ ++ +IQ     +G L  DFT  V+ G    K    DK+++  FD
Sbjct: 115 FAETHAKASTKGFHTRVRASIQPLIEEGRLQKDFTTRAVVKGNGNDKAEQDKFVN--FDE 172
```

-continued

```
Query: 175 YKKVISYLENNLD--YSNSIVYYLLLVLFKTGLRVGEALALTWDDVNFEDLEIKTYR--R  230
            YK+++ Y  N L+   YS+ + +++ +    TG+R  EA  L WDD++F +  IK   R
Sbjct: 173 YKQLVDYFRNRLNPNYSSPTMLFIISI---TGMRASEAFGLVWDDIDFNNNTIKCRRTWN  229

Query: 231 FSGDKGTFSPPKTKTSIRTIPISQSLALILRDLKDDQQVMLKNLKIVNMNNQIFYDYRYG  290
              +   G F  PKT    IR I I       +L+D ++ Q+ + ++L I  +++ + Y
Sbjct: 230 YRNKVGGFKKPKTDAGIRDIVIDDESMQLLKDFREQQKTLFESLGIKPIHDFVCYHPYRK  289

Query: 291 VSTNSAINKSLKNVLKILNINSKMTATGARHTYGSYLLAKGVDIWVVARLMGHKDITQLL  350
             + T SA+  +L + LK LNI++ +T  G RHT+ S LL  GVDI  V++ +GH   +
Sbjct: 290 IITLSALQNTLDHALKKLNISTPLTIHGLRHTHASVLLYHGVDIMTVSKRLGHASVAITQ  349

Query: 351 ETYGHVLTEVINKEYETVRSLV                                       372
           +TY H++ E+ NK+ +  + L+
Sbjct: 350 QTYIHIIKELENKDKDKIIELL                                       371
```

There is also homology to SEQ ID 578.

Based on this analysis, it was predicted that this protein and its epitopes, could be useful antigens for vaccines or diagnostics.

EXAMPLE 556

A DNA sequence (GBSx0595) was identified in *S. agalactiae* <SEQ ID 1763> which encodes the amino acid sequence <SEQ ID 1764>. Analysis of this protein sequence reveals the following:

```
Possible site: 54
>>> Seems to have no N-terminal signal sequence

----- Final Results -----
            bacterial cytoplasm --- Certainty = 0.1603(Affirmative) < succ>
             bacterial membrane --- Certainty = 0.0000(Not Clear)   < succ>
              bacterial outside --- Certainty = 0.0000(Not Clear)   < succ>
```

A related GBS nucleic acid sequence <SEQ ID 10209> which encodes amino acid sequence <SEQ ID 10210> was also identified.

The protein has homology with the following sequences in the GENPEPT database:

```
>GP: BAB07266 GB: AP001519 unknown conserved protein in others
[Bacillus halodurans]
Identities = 26/71 (36%), Positives = 39/71 (54%), Gaps = 6/71 (8%)

Query:  37 WWDIDNLQELLGIGRSKLINDILLNPDIKKEVDLSINPNGFIVYPKGKGSRYKILATK--   94
           WW + +L+E  G       L +ILL+P  K  +D  I    GF+ YP+ KG R+   +A+
Sbjct:   4 WWSMQDLKERTGYSEDWLKENILLHPRYKPMLD--IENGGFVYYPEKKGERWCFIASSME   61

Query:  95 --ARKYFEDNF                                                  103
             +KYF+D F
Sbjct:  62 EFLKKYFKDIF                                                   72
```

No corresponding DNA sequence was identified in *S. pyogenes*.

Based on this analysis, it was predicted that these proteins and their epitopes could be useful antigens for vaccines or diagnostics.

EXAMPLE 557

A DNA sequence (GBSx0596) was identified in *S. agalactiae* <SEQ ID 1765> which encodes the amino acid sequence <SEQ ID 1766>. Analysis of this protein sequence reveals the following:

```
Possible site: 14
>>> Seems to have an uncleavable N-term signal seq
```

```
      INTEGRAL      Likelihood = -3.88      Transmembrane      12-28 (11-29)

----- Final Results -----
                bacterial membrane --- Certainty = 0.2550(Affirmative) < succ>
                 bacterial outside --- Certainty = 0.0000(Not Clear)   < succ>
               bacterial cytoplasm --- Certainty = 0.0000(Not Clear)   < succ>
```

The protein has homology with the following sequences in the GENPEPT database:

```
>GP: AAB99663 GB: U67604 chromosome segretation protein (smc1)
[Methanococcus jannaschii]
Identities = 53/210 (25%), Positives = 95/210 (45%),
Gaps = 33/210 (15%)

Query:  20 IFTNVGVLISNSRDNKAIQRELELLEEGQEKLVDEFSKISTNQYDKYV----------LI   69
           +F  +G+L  N     + + +     + K++DE S I+      K              LI
Sbjct: 133 LFRRLGLLGDNVISQGDLLKIINISPIERRKIIDEISGIAEFDEKKKKAEEELKKARELI  192

Query:  70 Q------SNLSNNIEKNKQELVQKNSYVK--EDTKYIRDEMLIEKKSK-----EEVYNHV  116
           +       S + NN++K K+E          Y+K  E+  K  +  ++++K S     E + N +
Sbjct: 193 EMIDIRISEVENNLKKLKKEKEDAEKYIKLNEELKAAKYALILKKVSYLNVLLENIQNDI  252

Query: 117 KNGDKLIEKMAFANELILKFGEVSRENQMLGLKVNSLEEKIVDLSNQPKNDEISKLRKSI  176
           KN ++L          NE + K  E+  E + L L++N+    I++  N+  N+E+ +L KSI
Sbjct: 253 KNLEEL------KNEFLSKVREIDVEIENLKLRLNN----IINELNEKGNEEVLELHKSI  302

Query: 177 SSFERELSRFEDVGYSEAEEIKSTLRRILN                                206
           E E+   + V  S   E+K      I N
Sbjct: 303 KELEVEIENDKKVLDSSINELKKVEVEIEN                                332
```

No corresponding DNA sequence was identified in *S. pyogenes*.

Figure 42:
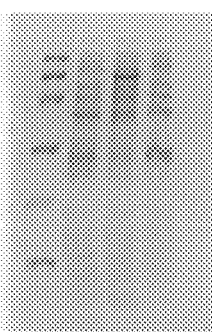
Figure 47:
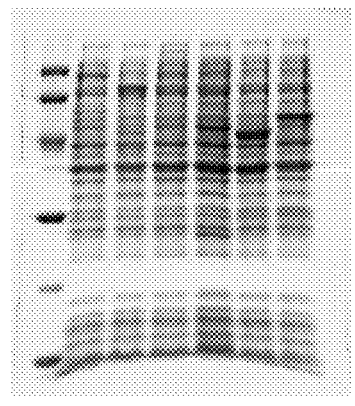

SEQ ID 1766 (GBS315) was expressed in *E. coli* as a His-fusion product. SDS-PAGE analysis of total cell extract is shown in FIG. 42 (lane 4; MW 26.7 kDa) and in FIG. 239 (lane 5; MW 41 kDa). It was also expressed in *E. coli* as a GST-fusion product. SDS-PAGE analysis of total cell extract is shown in FIG. 47 (lane 5; MW 52 kDa).

Based on this analysis, it was predicted that these proteins and their epitopes could be useful antigens for vaccines or diagnostics.

EXAMPLE 558

A DNA sequence (GBSx0597) was identified in *S. agalactiae* <SEQ ID 1767> which encodes the amino acid sequence <SEQ ID 1768>. This protein is predicted to be surface protein. Analysis of this protein sequence reveals the following:

```
Possible site: 26
>>> Seems to have a cleavable N-term signal seq.
    INTEGRAL      Likelihood = -7.70      Transmembrane      229-245 (226-248)

----- Final Results -----
                bacterial membrane --- Certainty = 0.4079(Affirmative) < succ>
                 bacterial outside --- Certainty = 0.0000(Not Clear)   < succ>
               bacterial cytoplasm --- Certainty = 0.0000(Not Clear)   < succ>
```

The protein has homology with the following sequences in the GENPEPT database:

```
>GP: CAA47097 GB: X66468 orf iota [Streptococcus pyogenes]
Identities = 90/262 (34%), Positives = 138/262 (52%),
Gaps = 26/262 (9%)

Query:   4 VKVLSLITV-SGLFLMAGNLSASADVVISGGDTIMLSGVDAGVSDSIMPPPSSINPV---   59
           +K  L+L+T+ S    L++  + + AD   S  D  +L+  D V      P +  ++PV
Sbjct:   1 MKKLALLTLFSTTLLVSAPIVSFADETASSSDINILADDDPVVPVEPTDPTTPVDPVDPV   60
```

-continued

```
Query:   60 -----------TDTTEPSAPTPSTDPI--TDTTEPSAPTPSTDPI--TDTTEPSAPTPST  104
                        T+ TEP+ PT   T+P    T+ TEP+ PT   T+P    T+ TEP+ PT   T
Sbjct:   61 DPVDPVDPVDPTEPTEPTEPTEPTEPTEPTEPTEPTEPTEPTEPTEPTEPTEPTEPTEPT  120

Query:  105 DQTTGTTDSS-TPSSSTTNPVDGITDNGTKPNAGIDKPSTNKPSDHSESSI--KPVTKPT  161
            + T  T  +  T  S   T P +      T+P    +     +PS  +E ++   KPV
Sbjct:  121 EPTEPTEPTEPTEPSKPTEPTE--PSKPTEPTEPTEPSKPTEPSKPTEPTVPNKPVDTNP  178

Query:  162 INQPITTVTGDQVIGTQDGKVLVQTPSGTQLK-DAAEVGGNVQKDGTVAIKKSDGKIEVL  220
              I  P+ T TG  ++  +D K ++Q    GT   K +A E+G +VQKDGTV +K SDGK++VL
Sbjct:  179 IENPVNTDTGVVIVAVEDSKPIIQLADGTTKKVEAKEIGADVQKDGTVTVKGSDGKMKVL  238

Query:  221 PKTGEGKTI-FTIVGLLLIAGA                                      241
            PKTGE   I   +++G L++  G+
Sbjct:  239 PKTGETANIALSVLGSLMVLGS                                      260
```

There is also homology to SEQ ID 760.

Figure 295:
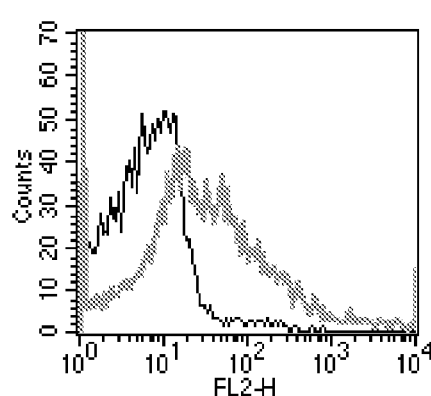

SEQ ID 1768 (GBS141) was expressed in *E. coli* as a His-fusion product. SDS-PAGE analysis of total cell extract is shown in FIG. 19 (lane 4; MW 35 kDa). The GBS141-His fusion product was purified (FIG. 194, lane 3) and used to immunise mice. The resulting antiserum was used for FACS (FIG. 295), which confirmed that the protein is immunoaccessible on GBS bacteria.

Based on this analysis, it was predicted that this protein and its epitopes, could be useful antigens for vaccines or diagnostics.

EXAMPLE 559

A DNA sequence (GBSx0598) was identified in *S. agalactiae* <SEQ ID 1769> which encodes the amino acid sequence <SEQ ID 1770>. Analysis of this protein sequence reveals the following:

```
Possible site: 18
>>> Seems to have a cleavable N-term signal seq.

----- Final Results -----
            bacterial outside  --- Certainty = 0.3000(Affirmative) < succ>
            bacterial membrane --- Certainty = 0.0000(Not Clear)   < succ>
            bacterial cytoplasm --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

A related GBS gene <SEQ ID 8601> and protein <SEQ ID 8602> were also identified. Analysis of this protein sequence reveals the following:

```
Lipop: Possible site: -1 Crend: 4
McG: Discrim Score: 14.39
GvH: Signal Score (-7.5): -1.23
     Possible site: 18
>>> Seems to have a cleavable N-term signal seq.
ALOM program count: 0 value: 8.96 threshold: 0.0
PERIPHERAL Likelihood = 8.96 104
modified ALOM score: -2.29
*** Reasoning Step: 3

----- Final Results -----
            bacterial outside  --- Certainty = 0.3000(Affirmative) < succ>
            bacterial membrane --- Certainty = 0.0000(Not Clear)   < succ>
            bacterial cytoplasm --- Certainty = 0.0000(Not Clear)   < succ>
```

SEQ ID 1770 (GBS17) was expressed in *E. coli* as a His-fusion product. SDS-PAGE analysis of total cell extract is shown in FIG. 4 (lane 2; MW 24 kDa).

Figure 189:
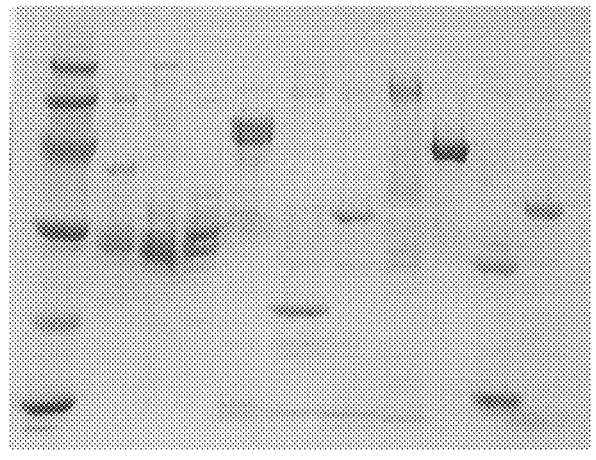
FIGS. 189 to 237 and 240 to 246 show SDS-PAGE analysis of purified GBS proteins of the invention. The left-hand lane contains molecular weight markers. These are 94, 67, 43, 30, 20.1 & 14.4 kDa.

The His-fusion protein was purified as shown in FIG. 189, lane 10.

EXAMPLE 560

A DNA sequence (GBSx0599) was identified in *S. agalactiae* <SEQ ID 1771> which encodes the amino acid sequence <SEQ ID 1772>. Analysis of this protein sequence reveals the following:

```
Possible site: 23
>>> Seems to have a cleavable N-term signal seq.

----- Final Results -----
          bacterial outside --- Certainty = 0.3000(Affirmative) < succ>
          bacterial membrane --- Certainty = 0.0000(Not Clear)  < succ>
          bacterial cytoplasm --- Certainty = 0.0000(Not Clear)  < succ>
```

A related GBS gene <SEQ ID 10779> and protein <SEQ ID 10780> were also identified. A further related GBS nucleic acid sequence <SEQ ID 10957> which encodes amino acid sequence <SEQ ID 10958> was also identified.

The protein has no significant homology with any sequences in the GENPEPT database.

No corresponding DNA sequence was identified in *S. pyogenes*.

Figure 129:
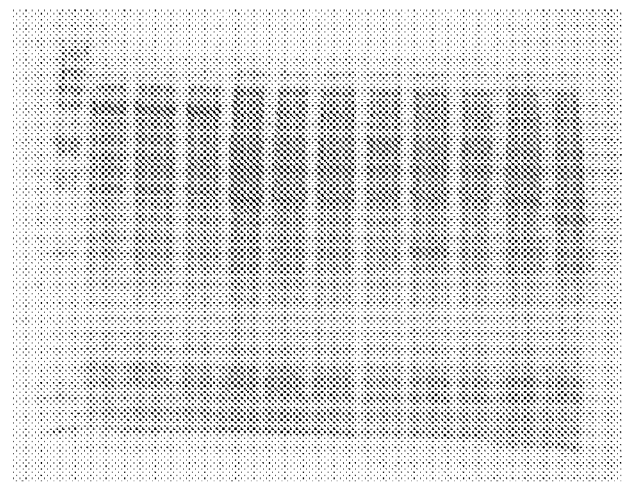

SEQ ID 1772 (GBS643) was expressed in *E. coli* as a GST-fusion product. SDS-PAGE analysis of total cell extract is shown in FIG. 129 (lane 2-4; MW 79 kDa) and in FIG. 186 (lane 2; MW 79 kDa). It was also expressed in *E. coli* as a His-fusion product. SDS-PAGE analysis of total cell extract is shown in FIG. 129 (lane 5-7; MW 54 kDa) and in FIG. 176 (lane 5; MW 54 kDa).

GBS643-GST was purified as shown in FIG. 236, lane 7.

Based on this analysis, it was predicted that these proteins and their epitopes could be useful antigens for vaccines or diagnostics.

EXAMPLE 561

A DNA sequence (GBSx0600) was identified in *S. agalactiae* <SEQ ID 1773> which encodes the amino acid sequence <SEQ ID 1774>. Analysis of this protein sequence reveals the following:

```
Possible site: 27
>>> Seems to have no N-terminal signal sequence

----- Final Results -----
          bacterial cytoplasm --- Certainty = 0.5815(Affirmative) < succ>
          bacterial membrane  --- Certainty = 0.0000(Not Clear)   < succ>
          bacterial outside   --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 562

A DNA sequence (GBSx0601) was identified in *S. agalactiae* <SEQ ID 1775> which encodes the amino acid sequence <SEQ ID 1776>. This protein is predicted to be membrane protein. Analysis of this protein sequence reveals the following:

```
Possible site: 33
>>> Seems to have no N-terminal signal sequence
     INTEGRAL    Likelihood = -13.32    Transmembrane   311-327 (282-332)
     INTEGRAL    Likelihood = -10.46    Transmembrane   293-309 (282-310)
     INTEGRAL    Likelihood =  -8.55    Transmembrane   390-406 (388-410)
     INTEGRAL    Likelihood =  -7.64    Transmembrane    49-65  (40-69)
     INTEGRAL    Likelihood =  -5.68    Transmembrane   100-116 (98-122)
     INTEGRAL    Likelihood =  -4.35    Transmembrane   130-146 (127-148)
     INTEGRAL    Likelihood =  -3.88    Transmembrane   344-360 (342-363)
```

-continued

```
----- Final Results -----
              bacterial membrane --- Certainty = 0.6328(Affirmative) < succ>
              bacterial outside  --- Certainty = 0.0000(Not Clear)   < succ>
              bacterial cytoplasm --- Certainty = 0.0000(Not Clear)   < succ>
```

The protein has homology with the following sequences in the GENPEPT database:

```
>GP: CAB70618 GB: AJ243106 membrane protein
[Streptococcus thermophilus]
Identities = 234/665 (35%), Positives = 379/665 (56%),
Gaps = 59/665 (8%)

Query:  13 FAKVKDVDIFALKAYMEITH-GAETGAQSILLDVFVNFPFFLLNLIVGLFSVILRFFENF   71
           FAK+K VDIF+LK+YME T+ G+  GA  ++ ++FVN  FF+LN +VG FS+++R  E
Sbjct:   5 FAKLKGVDIFSLKSYMEPTNFGSFNGAWVLINELFVNLFFFILNAVVGFFSLLIRILEKI   64

Query:  72 SLYDTYKQTVYHSSQKLWENLSGN--GSYTS-SLLYLLVAISAFSIFISYLFSKGDFSKR  128
           LY TYK V+H + +W   +G+   G+ T+ SL+  L+ + AF +F  Y FSKG FS+
Sbjct:  65 DLYATYKTYVFHGASSIWHGFTGSNTGNITNKSLVGTLLLVLAFYLFYQYFFSKGSFSRT  124

Query: 129 LIHLFVVIILGMGYFGTIQSTSGGIYILDTVHQLAGSFSDAVTNLSLDNPSGGKTKITQK  188
           L+H+ +V++L +GYFGT+  TSGG+Y+LDTV+ ++   +  + +D     KI +
Sbjct: 125 LLHVCLVLLLALGYFGTVAGTSGGLYLLDTVNNVSKDVTKKIAGIKVDYAKDKSIKIGK-  183

Query: 189 SSVADNYVMKTSYTAYLFVNTGQLNGKFHNNQTGKEEKFDNEQVLGKYDKSGKFITPKQK  248
            S++D+Y+ +TSY AY+FVNTGQ NGK+ N+Q GKEE FD+ +VLG  DK+G F    K K
Sbjct: 184 -SMSDSYIAETSYKAYVFVNTGQENGKYKNSQDGKEEAFDDSKVLGTSDKNGNFKAVKAK  242

Query: 249 DILNYTDNLGDKATEGEEKNRWLSAVNDYLWIKSGYVILKIFEAVILAVPLILIQLIAFM  308
           +    Y D+LG+ A +   EKNRW+SA+ D+++ +  YVI KI EA +LAVP+ILIQL+  +
Sbjct: 243 ERSKYLDDLGEGANDDGEKNRWVSAMPDFIFTRVFYVIFKIVEAFVLAVPIILIQLLNVV  302

Query: 309 ADVLVIILMFIFPLALLVSFLPRMQDIIFNVLKVMFGAVSFPALAGFLTLIVFYTQTLIA  368
           A +LV+ ++ +FP+ LL+SF+PRMQ+++F VLKVMFG + FPA+    LTL++FY + +I
Sbjct: 303 AQILVLTMILLFPVVLLMSFVPRMQELVFGVLKVMFGGLIFPAITTLLTLLIFYIEKMIE  362

Query: 369 TFVKKKFTDGSLLSGSNFKGQAILFMLLITVFVQGCVFWGIWKYKETFLRLIIGSRASQV  428
            V   F DG L +  +     ++F LL++V +G +++ IW++K    L+ I+GS+A  V
Sbjct: 363 NIVTNGF-DGVLKTLPSLLLFGLVFKLLVSVVSKGVIYFLIWRFKGQLLQFILGSKARMV  421

Query: 429 -------INQSVDKINEKAENLGITPKSIYERAHDMSSLAMMGAGYGVGTMMNAQ---DN  478
                  + V K EA +  P   A + +  +  GAG+G G MMNA+     N
Sbjct: 422 ATDIGTKVEHGVTKSKEVASQV---PTRSLATAQHLGNFTLAGAGFGTGVMMNAKSHFQN  478

Query: 479 WNAFKERQQANLDDGQSKTNDADKYDEANADDTVISKEAELTNEGEYQSELPKEASKRIE  538
           +F  R++ +  +  +   +   + + +I           ++ P  + K I
Sbjct: 479 AGSFFTRKEPSQPETVMPSGPTEAPITPESPEPIIP-----------PTQTPPDNFKTIG  527

Query: 539 QLGKESSYELSFISEGNSTEEILKNVKSDNHTFQEGDGDTSLTNQDMITNDIENHSNNYT  598
            +          +SEG + E                          ++ +       +
Sbjct: 528 EEKPTPPSDSPIMSEGTPSSE-------------------------DEFQTLKEEWM   559

Query: 599 SPLKQRKLNKLEGELSQFNSDVSMTKNHGKNAFEKGFNASKTKEVRKQHNLERQSKVLEE  658
           SP KQ ++N LE L +    +M K G NAF + + T++ + + N+ER+ ++ +
Sbjct: 560 SPFKQHRINTLERRLDAYKDPQAMYKAQGSNAFTRAYRKTLTRDDKIRANIERRDRLTQR  619

Query: 659 LEKLR                                                         663
           L +LR
Sbjct: 620 LNQLR                                                         624
```

No corresponding DNA sequence was identified in *S. pyogenes*.

Based on this analysis, it was predicted that this protein and its epitopes, could be useful antigens for vaccines or diagnostics.

EXAMPLE 563

A DNA sequence (GBSx0602) was identified in *S. agalactiae* <SEQ ID 1777> which encodes the amino acid sequence <SEQ ID 1778>. This protein is predicted to be conjugative protein. Analysis of this protein sequence reveals the following:

```
Possible site: 28
>>> Seems to have no N-terminal signal sequence

----- Final Results -----
            bacterial cytoplasm --- Certainty = 0.3714(Affirmative) < succ>
             bacterial membrane --- Certainty = 0.0000(Not Clear) < succ>
              bacterial outside --- Certainty = 0.0000(Not Clear) < succ>
```

The protein has homology with the following sequences in the GENPEPT database:

```
>GP: CAB70617 GB: AJ243106 conjugative protein [Streptococcus thermophilus]
Identities = 515/757 (68%), Positives = 612/757 (80%), Gaps = 1/757 (0%)

Query:    1 MSDFEADLADDVKELGLETLDFTVDTLTHEMEIPYQFDWLIGVDLGKGQYNANIKEFIYN     60
            M DF   LADD +ELG E L +TVD LT EMEIPYQFDW+IGV L K  + A +K+  Y
Sbjct:   78 MRDFSEALADDSRELGEELLLYTVDRLTDEMEIPYQFDWVIGVTLRKQNHGATVKDLAYE    137

Query:   61 QFESIASNFASLAGYEVEVDEDWYKEHSEEELLVYSLLSTLKAKRLTDVDLFYYQRMQFL    120
            F    A  GYE +   WY ++  +E  ++    S L+AKRLT+ +LFYYQRMQ+L
Sbjct:  138 SFNEFSEKIAKGLGYEYALSPTWYDDYRSDEFTIFQAFSVLRAKRLTNEELFYYQRMQYL    197

Query:  121 RYVPHTKSEVIANRNMLNVTDTLIKSLEGGFLKLESAYGSSFVSVLPVGRFSTIFNGFHL    180
            RY+PH K EV+ANR+  N+TDTLIK L+GGFL+LES YGSSFV++LPVG+F    FNGFHL
Sbjct:  198 RYIPHYKKEVLANRSQFNITDTLIKVLKGGFLELESPYGSSFVTILPVGKFPVQFNGFHL    257

Query:  181 GELVQRMSFPVELRFKAEFIDKTKLGGTMGRSNTRYDQIMKEAYNTNTVQQDDILMGAYS    240
            GE VQR++FPVELR KAEFID  K+ G MGRSNTRY  IM+EA NT+TVQQD+I+MG+  S
Sbjct:  258 GEFVQRLNFPVELRIKAEFIDTNKIKGRMGRSNTRYRNIMEEAENTDTVQQDEIIMGSIS    317

Query:  241 LKDLMKKVGNKEEIIEYGCYLVVAGSSLNQLKQRRYAILSYFDDMKVNVYEASHDTPYLF    300
            LKDLMKKVGNKE+IIEYG YL+V+ SS+NQL+QRR  IL+YFDDM V + EAS D PYLF
Sbjct:  318 LKDLMKKVGNKEDIIEYGAYLIVSASSVNQLRQRRQVILNYFDDMGVEISEASQDGPYLF    377

Query:  301 QALLYGQDLQKTTRKWNHLVTARGFSELMLFTNTQSGNRIGWYIGRVDNRLTAWDSIDEA    360
            QALLYG++LQK TR W H+VTARGFSELM FTNT SGNRIGWYIGRVDN + WDSI +A
Sbjct:  378 QALLYGENLQKKTRTWTHMVTARGFSELMPFTNTSSGNRIGWYIGRVDNWIGRWDSIAKA    437

Query:  361 IMGSKNLVLFNATVANKEDVAGKVTKNPHVIITGATGQGKSYLAQMIFLHTAQQNVRVLY    420
            I   SKN+VL+NATV NKED+AGK+TKNPH+IITGATGQGKS+LAQ+IFL  A QNV  LY
Sbjct:  438 IDSSKNIVLYNATVGNKEDIAGKITKNPHIIITGATGQGKSFLAQIIFLSVALQNVKTLY    497

Query:  421 VDPKRELRQHYLKVVSDPEYARKFPLRKKQIEETNFVTLDSSVKENHGVLDPIVILDKEG    480
            +DPKRELR HY +V++  PE+AR++P RKKQI+  NFVTLDSS+  NHGVLDPIV+LDKE
Sbjct:  498 IDPKRELRNHYQEVINSPEFARRYPERKKQIDNFNFVTLDSSLPSNHGVLDPIVVLDKEQ    557

Query:  481 ASSTAKNMLLYLLKNATEIKLDQTTALTEAISQVIAKREAGEVVGFNQVIEVLIDSESDE    540
            A   AKNML +LL+    ++ +DQ TA+TEAI+  ++ +R AGE VGF  V+E L ++ S E
Sbjct:  558 AVEVAKNMLEFLLQAVDDVTMDQKTAITEAINTIVERRVAGENVGFKHVLETLRNASSSE    617

Query:  541 VQSVGRYFKAIIQNSILELAFSDGDVAGLSYEERVTVLEVADLSLPKDGSDHISDHESNS    600
            + SVGRY +I+ NSILELAFSDG   GL+YE RVT+LEV +L LPKD S  ISDHE NS
Sbjct:  618 IASVGRYLTSIVTNSILELAFSDGTTPGLNYESRVTILEVNNLKLPKDDSTKISDHERNS    677

Query:  601 IALMFALGAFCKHFGERSDDE-TVEIFDEAWVLMQSSEGKAVIKSMRRVGRSKYNVLMLV    659
            IALMFALGAFC HFGER+++E T+E FDEAW+LM+S+EGKAVIK+MRR+GRSK N L L+
Sbjct:  678 IALMFALGAFCTHFGERNENEDTIEFFDEAWILMKSAEGKAVIKNMRRIGRSKNNTLALI    737

Query:  660 SQSVHDAENDDDTTGFGTIFSFYEKSEREDILSHVGLEVTPKNLEWIDNMISGQCLYYDV    719
            +QSVHDAENDDDTTGFGTIF+FYEKSEREDIL HV LEVT  NLEWIDNMISGQCLYYDV
Sbjct:  738 TQSVHDAENDDDTTGFGTIFAFYEKSEREDILRHVNLEVTESNLEWIDNMISGQCLYYDV    797

Query:  720 YGNLNMISIHNIHPDIDPLLKPMKKTVSSHLENKYAS                         756
            YGNLNMIS+HN+  DID LLKPMK TVSS LENKYAS
Sbjct:  798 YGNLNMISVHNLFEDIDMLLKPMKATVSSSLENKYAS                         834
```

No corresponding DNA sequence was identified in *S. pyogenes*.

Based on this analysis, it was predicted that this protein and its epitopes, could be useful antigens for vaccines or diagnostics.

EXAMPLE 564

A DNA sequence (GBSx0604) was identified in *S. agalactiae* <SEQ ID 1779> which encodes the amino acid sequence <SEQ ID 1780>. This protein is predicted to be ISL2 protein. Analysis of this protein sequence reveals the following:

Possible site: 26
>>> Seems to have no N-terminal signal sequence

----- Final Results -----
            bacterial cytoplasm --- Certainty = 0.3469(Affirmative) < succ>
             bacterial membrane --- Certainty = 0.0000(Not Clear)   < succ>
               bacterial outside --- Certainty = 0.0000(Not Clear)   < succ>

The protein has homology with the following sequences in the GENPEPT database:

```
>GP: CAC18595 GB: AJ278419 IS1381 transposase [Streptococcus pneumoniae]
Identities = 110/125 (88%), Positives = 119/125 (95%)

Query:  81 MNYEASKQLTDVRFKRLVGVQRTTFEEMLAVLKTAYQRKHAKGGRTPKLSLEDLLMATLQ  140
           MNYEASKQLTD RFKRLVGVQRTTFEEMLAVLKTAYQ KHAKGGR PKLSLEDLLMATLQ
Sbjct:   1 MNYEASKQLTDARFKRLVGVQRTTFEEMLAVLKTAYQLKHAKGGRKPKLSLEDLLMATLQ   60

Query: 141 YMREYRTYEQIAADFGIHESNLIRRSQWVESTLIQSGFTISKTHLSAEDTVIVDATEVKI  200
           Y+REYRTYE+IAADFG+HESNL+RRSQWVE TL+QSG TIS+T LS+EDTV++DATEVKI
Sbjct:  61 YVREYRTYEEIAADFGVHESNLLRRSQWVEVTLVQSGVTISRTPLSSEDTVMIDATEVKI  120

Query: 201 NRPKK  205
           NRPKK
Sbjct: 121 NRPKK  125
```

No corresponding DNA sequence was identified in *S. pyogenes*.

Based on this analysis, it was predicted that this protein and its epitopes, could be useful antigens for vaccines or diagnostics.

EXAMPLE 565

A DNA sequence (GBSx0605) was identified in *S. agalactiae* <SEQ ID 1781> which encodes the amino acid sequence <SEQ ID 1782>. Analysis of this protein sequence reveals the following:

```
Possible site: 61
>>> Seems to have no N-terminal signal sequence
    INTEGRAL     Likelihood = -12.58     Transmembrane    39-55 (32-66)

----- Final Results -----
             bacterial membrane --- Certainty = 0.6031(Affirmative) < succ>
               bacterial outside --- Certainty = 0.0000(Not Clear)   < succ>
            bacterial cytoplasm --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 566

A DNA sequence (GBSx0606) was identified in *S. agalactiae* <SEQ ID 1783> which encodes the amino acid sequence <SEQ ID 1784>. This protein is predicted to be Cag-W. Analysis of this protein sequence reveals the following:

```
Possible site: 59
>>> Seems to have no N-terminal signal sequence
        INTEGRAL     Likelihood = -3.82     Transmembrane    50-66 (49-66)
        INTEGRAL     Likelihood = -3.72     Transmembrane    25-41 (23-45)

----- Final Results -----
                    bacterial membrane --- Certainty = 0.2529(Affirmative) < succ>
                      bacterial outside --- Certainty = 0.0000(Not Clear)   < succ>
                   bacterial cytoplasm --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 567

A DNA sequence (GBSx0607) was identified in *S. agalactiae* <SEQ ID 1785> which encodes the amino acid sequence <SEQ ID 1786>. Analysis of this protein sequence reveals the following:

```
Possible site: 55
>>> Seems to have no N-terminal signal sequence
    INTEGRAL     Likelihood = -7.80     Transmembrane     36-52 (32-60)

----- Final Results -----
              bacterial membrane --- Certainty = 0.4121(Affirmative) < succ>
              bacterial outside  --- Certainty = 0.0000(Not Clear)   < succ>
              bacterial cytoplasm --- Certainty = 0.0000(Not Clear)  < succ>
```

The protein has homology with the following sequences in the GENPEPT database:

```
>GP: CAB12298 GB: Z99106 similar to transposon protein
[Bacillus subtilis]
Identities = 68/339 (20%), Positives = 133/339 (39%), Gaps = 49/339 (14%)

Query:  16 KKEEGGKQPKTKEVKQRTANFIV--YGILGLLFIVGFFGSLRAIGLSNQVQHLKETVIAV   73
           K+ E  ++ K K  + R+     V  +  +G L  +     L +I   +Q+   +K+
Sbjct:  24 KRIERPEKDKQKVPRDRSKLIAVTLWSCVGSLLFICLLAVLLSINTRSQLNDMKDETNKP   83

Query:  74 EKKSKHKKTDDSLDISRIQYYMNNFVYYYINYS--QDTADQRKTELENY--------YSF  123
           K K     + ++  + +++ F+  Y+N    Q++ ++R    LE+Y          +
Sbjct:  84 TNDDKQK-----ISVTAAENFLSGFINEYMNVKNDQESIEKRMQSLESYMVKQEDNHFED  138

Query: 124 STASMTDDVRKSRTLQTQRLISVEKEKDYYIALMRIGYEV--------------------  163
              D ++  R L+    L +V++   +   ++ YE
Sbjct: 139 EERFNVDGLKGDRELKGYSLYNVKEGDKNSLFQYKVTYENLYPVEKEVEKEVKDGKKKKK  198

Query: 164 --------DKKSYQMNLAVPFQMQRGLLAIVSQPYTVAEDLYLGKSKAFEKKTLDQVKEL  215
                   +K   QM L +P    +    A+ + PY       +Y  K     K    + E
Sbjct: 199 VKEKVKTNEKYEKQMLLNIPVTNKGDSFAVSAVPYFT--QIYDLKGDIAFKGKEETRDEY  256

Query: 216 SKEQVSSIQKFLPVFFNKYALINKTDLKLLMKTPELMGKGFKVSELDLNNAIYYQEKKHQ  275
              + E+  SI+ FL  FF KYA  K ++  +MK PE +      E  + +   ++ KK
Sbjct: 257 AGEKKESIESFLQNFFEKYASEKKEEMVYMMKKPEALEGNLLFGE--VQSVKIFETKKGF  314

Query: 276 VVQLSVTFEDLVTGGTRSENFTLYLFKADNGWYVEEMYH                      314
             V  +V F++       +E F+L + +    +YV ++ H
Sbjct: 315 EVFCAVRFKEKENDIPVNEKFSLEITENSGQFYVNKLKH                      353
```

No corresponding DNA sequence was identified in *S. pyogenes*.

Figure 145:
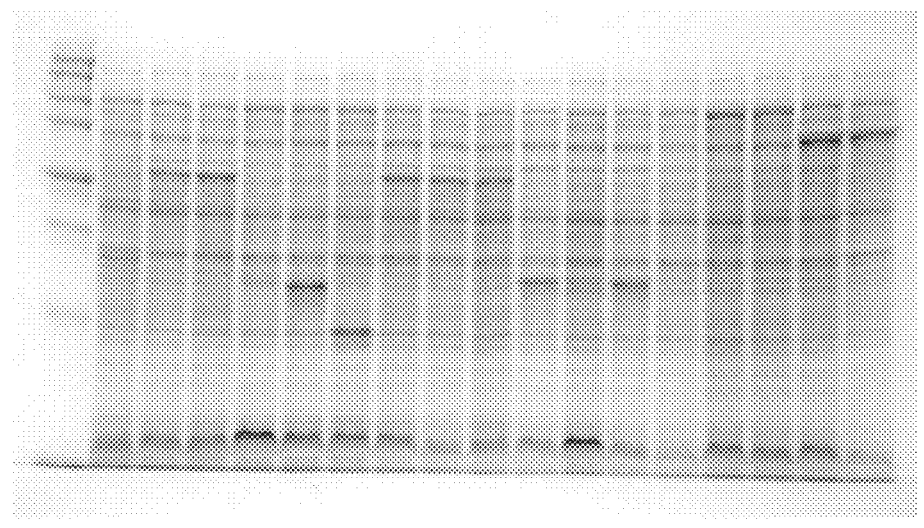

SEQ ID 1786 (GBS333d) was expressed in *E. coli* as a GST-fusion product. SDS-PAGE analysis of total cell extract is shown in FIG. 145 (lane 8-10; MW 58 kDa). It was also expressed in *E. coli* as a His-fusion product. SDS-PAGE analysis of total cell extract is shown in FIG. 145 (lane 11 & 13; MW 33 kDa), in FIG. 182 (lane 2; MW 33 kDa) and in FIG. 185 (lane 3; MW 58 kDa).

GBS333d-GST was purified as shown in FIG. 236, lane 2.

Based on this analysis, it was predicted that this protein and its epitopes, could be useful antigens for vaccines or diagnostics.

EXAMPLE 568

A DNA sequence (GBSx0608) was identified in *S. agalactiae* <SEQ ID 1787> which encodes the amino acid sequence <SEQ ID 1788>. Analysis of this protein sequence reveals the following:

```
Possible site: 54
>>> Seems to have no N-terminal signal sequence

----- Final Results -----
              bacterial cytoplasm --- Certainty = 0.4177(Affirmative) < succ>
```

```
            bacterial membrane --- Certainty = 0.0000(Not Clear) < succ>
            bacterial outside  --- Certainty = 0.0000(Not Clear) < succ>
```

The protein has homology with the following sequences in the GENPEPT database:

```
>GP: CAB38326 GB: Y17736 hypothetical protein [Streptomyces
coelicolor A3(2)]
Identities = 45/80 (56%), Positives = 56/80 (69%)

Query:   4 FTEEAWKDYVSWQQEDKKILKRINRLIEDIKRDPFEGIGKPEPLKYHYSGAWSRRITEEH   63
           FT   W+DYV W + D+K+ KRINRLI DI RDPF+G+GKPEPLK   SG WSRRI + H
Sbjct:   5 FTSHGWEDYVHWAESDRKVTKRINRLIADIARDPFKGVGKPEPLKGDLSGYWSRRIDDTH   64

Query:  64 RLIYMIEDGEIYFLSFRDHY                                          83
           RL+Y   D ++  +  R HY
Sbjct:  65 RLVYKPTDDQLVIVQARYHY                                          84
```

No corresponding DNA sequence was identified in S. pyogenes.

Based on this analysis, it was predicted that this protein and its epitopes, could be useful antigens for vaccines or diagnostics.

EXAMPLE 569

A DNA sequence (GBSx0609) was identified in S. agalactiae <SEQ ID 1789> which encodes the amino acid sequence <SEQ ID 1790>. Analysis of this protein sequence reveals the following:

```
Possible site: 53
>>> Seems to have no N-terminal signal sequence

----- Final Results -----
            bacterial cytoplasm --- Certainty = 0.5669(Affirmative) < succ>
            bacterial membrane  --- Certainty = 0.0000(Not Clear)   < succ>
            bacterial outside   --- Certainty = 0.0000(Not Clear)   < succ>
```

A related GBS nucleic acid sequence <SEQ ID 10211> which encodes amino acid sequence <SEQ ID 10212> was also identified.

The protein has homology with the following sequences in the GENPEPT database:

```
>GP: AAD17306 GB: AF121418 putative Phd protein [Francisella
tularensis subsp. novicida]
Identities = 26/84 (30%), Positives = 45/84 (52%)

Query:   4 MEAIVYSHFRNNLKDYMKKVNDEFEPLIVVNKNPDENIVVLSQDSWESLQETIRLMENDY   63
           M+ + YS FRN L D M +V      P+IV  +  E +V++S + +++ +ET  LM +
Sbjct:   1 MQTVNYSTFRNELSDSMDRVTKNHSPMIVTRGSKKEAVVMMSLEDFKAYEETAYLMRSMN   60

Query:  64 LSHKVINGISQVKEKQVTKHGLIE                                      87
           ++ N I +V+   + LIE
Sbjct:  61 NYKRLQNSIDEVESGLAIQKELIE                                      84
```

No corresponding DNA sequence was identified in S. pyogenes.

Based on this analysis, it was predicted that these proteins and their epitopes could be useful antigens for vaccines or diagnostics.

EXAMPLE 570

A DNA sequence (GBSx0610) was identified in S. agalactiae <SEQ ID 1791> which encodes the amino acid sequence <SEQ ID 1792>. Analysis of this protein sequence reveals the following:

```
Possible site: 55
>>> Seems to have no N-terminal signal sequence

----- Final Results -----
            bacterial cytoplasm --- Certainty = 0.2407(Affirmative) < succ>
             bacterial membrane --- Certainty = 0.0000(Not Clear)   < succ>
              bacterial outside --- Certainty = 0.0000(Not Clear)   < succ>
```

The protein has no significant homology with any sequences in the GENPEPT database.

No corresponding DNA sequence was identified in S. pyogenes.

Based on this analysis, it was predicted that this protein and its epitopes, could be useful antigens for vaccines or diagnostics.

EXAMPLE 571

A DNA sequence (GBSx0611) was identified in S. agalactiae <SEQ ID 1793> which encodes the amino acid sequence <SEQ ID 1794>. Analysis of this protein sequence reveals the following:

```
Possible site: 28
>>> Seems to have no N-terminal signal sequence

----- Final Results -----
            bacterial cytoplasm --- Certainty = 0.1274(Affirmative) < succ>
             bacterial membrane --- Certainty = 0.0000(Not Clear)   < succ>
              bacterial outside --- Certainty = 0.0000(Not Clear)   < succ>
```

A related GBS nucleic acid sequence <SEQ ID 10213> which encodes amino acid sequence <SEQ ID 10214> was also identified.

The protein has homology with the following sequences in the GENPEPT database:

```
>GP: AAB60015 GB: U09422 ORF18 [Enterococcus faecalis]
Identities = 41/140 (29%), Positives = 73/140 (51%), Gaps = 3/140 (2%)

Query:   23 FPVEMSELKLALGLREEDDLEYIIADSDCQL-LKEHDSIEMINQFVELVENVDSELVKAV   81
            FP++   E+K  +GL +E + EY I D +     + E+ SI  +N+   E+V  +  EL    +
Sbjct:   26 FPIDFEEVKEKIGLNDEYE-EYAIHDYELPFTVDEYTSIGELNRLWEMVSELPEELQSEL   84

Query:   82 HQVIGYTASDFVDYDFNFGDCCLLSDVTTRRELGEYYFDELGVQGVGKEALEMYFDHEAY  141
            ++ + +S  +    + D  + SD       ++ YY +E G  G    +L+ Y D++AY
Sbjct:   85 SALLTHFSS-IEELSEHQEDIIIHSDCDDMYDVARYYIEETGALGEVPASLQNYIDYQAY  143

Query:  142 GRDIDLESQGGFSDYGYVEI                                          161
            GRD+DL       +++G  EI
Sbjct:  144 GRDLDLSGTFISTNHGIFEI                                          163
```

No corresponding DNA sequence was identified in S. pyogenes.

Based on this analysis, it was predicted that these proteins and their epitopes could be useful antigens for vaccines or diagnostics.

EXAMPLE 572

A DNA sequence (GBSx0612) was identified in S. agalactiae <SEQ ID 1795> which encodes the amino acid sequence <SEQ ID 1796>. Analysis of this protein sequence reveals the following:

```
Possible site: 31
>>> Seems to have no N-terminal signal sequence

----- Final Results -----
            bacterial cytoplasm --- Certainty = 0.1366(Affirmative) < succ>
```

-continued

```
              bacterial membrane --- Certainty = 0.0000(Not Clear) < succ>
              bacterial outside  --- Certainty = 0.0000(Not Clear) < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 573

A DNA sequence (GBSx0613) was identified in *S. agalactiae* <SEQ ID 1797> which encodes the amino acid sequence <SEQ ID 1798>. Analysis of this protein sequence reveals the following:

```
Possible site: 41
>>> Seems to have no N-terminal signal sequence

----- Final Results -----
              bacterial cytoplasm --- Certainty = 0.1484(Affirmative) < succ>
              bacterial membrane  --- Certainty = 0.0000(Not Clear)   < succ>
              bacterial outside   --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 574

A DNA sequence (GBSx0614) was identified in *S. agalactiae* <SEQ ID 1799> which encodes the amino acid sequence <SEQ ID 1800>. This protein is predicted to be abortive phage resistance protein. Analysis of this protein sequence reveals the following:

```
Possible site: 58
>>> Seems to have no N-terminal signal sequence

----- Final Results -----
              bacterial cytoplasm --- Certainty = 0.2205(Affirmative) < succ>
              bacterial membrane  --- Certainty = 0.0000(Not Clear)   < succ>
              bacterial outside   --- Certainty = 0.0000(Not Clear)   < succ>
```

A related GBS nucleic acid sequence <SEQ ID 10215> which encodes amino acid sequence <SEQ ID 10216> was also identified.

The protein has homology with the following sequences in the GENPEPT database:

```
>GP: AAB53710 GB: U94520 abortive phage resistance protein
[Lactococcus lactis]
Identities = 131/499 (26%), Positives = 210/499 (41%),
Gaps = 97/499 (19%)

Query:   3 MFSKIEFKNFMSFSNLT------------------FDLLNRGKCKDIIAIYGENGSGKTN    44
           M   F+NF+SF L+                    D+ N K   + IYG N SGK++
Sbjct:   1 MLVNFRFENFLSFDKLSTFSMAPGKSRQHMEDLIELDIKNNQKLLKLSTIYGANASGKSS   60

Query:  45 IVEAF---KLLVL-----SLQSMESLNENTRLQSLLKEQTNKE---ENQKTNFGDISEIL   93
```

```
                      V+A     K L++         L     S N+NT    SL + +    E    E++   ++G   S IL
Sbjct:  61 FVDAIGISKSLIIRGFYNGLVLSNSYNKNTVDNSLNETKFEYEIVIEDKVYSYG-FSVIL   119

Query:  94 DKISFFTTFKGIAKNTHRIASEGNTILKYYFNIEKDNGYYLLEYNENNELVKEELVFKIK   153
              F + +      N    ++           Y      KDN         YN N+E     L    +
Sbjct: 120 SLKKFMSEWLYDITNDEKM---------IYTIDRKDN-----SYNINDEF----LNLDEQ   161

Query: 154 SNKGVHFSITNIDGLSQSLNKTIFKNTIFKDLTEQIEKYWGKHTFLSIFN--NYCLEV--   209
              SN  +   I +    S + N  +F N++   D  + IE        F  +FN  N  LEV
Sbjct: 162 SNNRISIYIDD----SANDNTQLFLNSL-NDGKKTIESKDNSTIFKKVFNWFNNTLEVLG   216

Query: 210 ---------------NEEF---INEQVSINFQKVVDEFDKIFIWSGNFRGPFHSTELLLK   251
                             EEF   + + + +N   V+D             N   P      E +L
Sbjct: 217 PGDEARGSIASLTQEEEEFKEDLGKYLELNDTGVIDIQVPVDNLSNV--PAKLQERILD   274

Query: 252 DISKGKIDKSEKEKLSYTEEIIYKYFSALYIDIKDVKYKQDAQGQEIKYELMIRKNIGGD   311
              +I+     I K +KE+      E I    F+ +     +++   Q+    Q    +EL    K+  G
Sbjct: 275 NITT-DIKKKKKER-----EDIEISFNTILNTSQNIYIIQNNDEQFEYFELKF-KHKNGT   327

Query: 312 LLDVPISLESQGTKNLLDLLKV-FNNVLDGKICIVDEIDSGIHDLLMNSILNDLK--GSV   368
              L      +S ES GT  L++L  V  F+N   D K+ ++DEID   +H LL  + +    K    S+
Sbjct: 328 LYS--LSEESDGTVRLIELFSVLFHN--DEKVFVIDEIDRSLHPLLTYNFIESFKKQKSI   383

Query: 369 NGQLIFTTHDTTLL--KELSPSSAYFLNVDIKGNKVIISGNEADKKIGVNNNLEKLYLSG   426
              N  QLI TTH+  +L  + L       +F++ +  +GN   + S  E   ++      + ++    YL+G
Sbjct: 384 N-QLIVTTHEDYILNFELLRRDEVWFVDKNFEGNSSMFSLEEFKERF--DKDINTSYLNG   440

Query: 427 FFGAVPDPLDIDFSDLFLD                                           445
              +G +P+  L      FS+     D
Sbjct: 441 RYGGIPN-LSCLFSEFAKD                                           458
```

No corresponding DNA sequence was identified in *S. pyogenes*.

Based on this analysis, it was predicted that these proteins and their epitopes could be useful antigens for vaccines or diagnostics.

EXAMPLE 575

A DNA sequence (GBSx0615) was identified in *S. agalactiae* <SEQ ID 1801> which encodes the amino acid sequence <SEQ ID 1802>. This protein is predicted to be repressor (rstR-1). Analysis of this protein sequence reveals the following:

```
Possible site: 37
>>> Seems to have no N-terminal signal sequence

----- Final Results -----
           bacterial cytoplasm --- Certainty = 0.3724(Affirmative) < succ>
            bacterial membrane --- Certainty = 0.0000(Not Clear)   < succ>
             bacterial outside --- Certainty = 0.0000(Not Clear)   < succ>
```

The protein has homology with the following sequences in the GENPEPT database:

```
>GP: AAB84427 GB: AF027868 transcription regulator [Bacillus subtilis]
Identities = 31/81 (38%), Positives = 53/81 (65%), Gaps = 2/81 (2%)

Query:  9 QKLKELRKEKKLTQTELASKLNISQKSYSNWESGKAEPTLDNIIKLANILDVTVDYLLGR   68
          Q+L++LRK  KLT +LA K+ I++ SY  +E+   +P LD ++ LA + DV+VDY+LG
Sbjct:  4 QRLRQLRKAHKLTMEQLAEKIGIAKSSYGGYEAESKKPPLDKLVILARLYDVSVDYILGL   63

Query: 69 SDNFSNTIVLSKNNMKSFSKR                                          89
          +D+    +    + N+K F ++
Sbjct: 64 TDDPDKV--ERKNLKEFLEK                                           82
```

There is also homology to SEQ ID 1740.

Based on this analysis, it was predicted that this protein and its epitopes, could be useful antigens for vaccines or diagnostics.

EXAMPLE 576

A DNA sequence (GBSx0616) was identified in *S. agalactiae* <SEQ ID 1803> which encodes the amino acid sequence <SEQ ID 1804>. Analysis of this protein sequence reveals the following:

```
Possible site: 13
>>> Seems to have no N-terminal signal sequence

----- Final Results -----
            bacterial cytoplasm --- Certainty = 0.3607(Affirmative) < succ>
             bacterial membrane --- Certainty = 0.0000(Not Clear)   < succ>
              bacterial outside --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes; could be useful antigens for vaccines or diagnostics.

EXAMPLE 577

A DNA sequence (GBSx0617) was identified in *S. agalactiae* <SEQ ID 1805> which encodes the amino acid sequence <SEQ ID 1806>. Analysis of this protein sequence reveals the following:

```
Possible site: 22
>>> Seems to have no N-terminal signal sequence

----- Final Results -----
            bacterial cytoplasm --- Certainty = 0.0564(Affirmative) < succ>
             bacterial membrane --- Certainty = 0.0000(Not Clear)   < succ>
              bacterial outside --- Certainty = 0.0000(Not Clear)   < succ>
```

A related GBS nucleic acid sequence <SEQ ID 10217> which encodes amino acid sequence <SEQ ID 10218> was also identified.

The protein has homology with the following sequences in the GENPEPT database:

```
>GP:CAB12294 GB:Z99106 similar to transposon protein [Bacillus subtilis]
 Identities = 93/348 (26%), Positives = 164/348 (46%), Gaps = 28/348 (8%)

Query:   81 SRLQVMIDYVRITLKDVRDLEFFCRNFLHCAFKEFQPFESKLMNYNHLWKRGDIWIFDFA   140
            S L  M+DY+R++ K   D++        LH +     +S    Y    ++   I +F  A
Sbjct:   26 SPLVSMVDYIRVSFK-THDVDRIIEEVLHLSKDFMTEKQSGFYGYVGTYELDYIKVFYSA    84

Query:  141 DKHETGNFQITVQLSGRGCRQLELLMETEKFTWHDWLSYLRNSYRDDMNVTRFDIAIDEL   200
                     G   + +++SG+GCRQ E  +E  K TW+D   + ++  +    + TRFD+AID+
Sbjct:   85 PDDNRG---VLIEMSGQGCRQFESFLECRKKTWYD---FFQDCMQQGGSFTRFDLAIDD-   137

Query:  201 YLGKDRENEQFHLSDMISKYYRHELDFESLRTWNYIGGGSLNFSDMEEIEQNRQGISLYF   260
                   +   F + +++ K  + E      R ++   GS + SD         G  ++YF
Sbjct:  138 ------KRTYFSIPELLKKAQKGEC-ISRFRKSDF-NGSFDLSD------GITGGTTIYF   183

Query:  261 GSRQSEMYFNFYEKRYEIAKQEGITVEEALEIFELWNRYEIRLSQSKANAAVDEFISGVP   320
            GS++SE Y  FYEK YE A++  I +EE +    WNRYE+RL   +A  A+D  +
Sbjct:  184 GSKKSEAYLCFYEKNYEQAEKYNIPLEELGD----WNRYELRLKNERAQVAIDALLKTKD   239

Query:  321 IGEISRGLIVSKIDVYDGKNEY--GSFQADRKWQLMFGGVEPLKFVTKPEAYSIERTLRW   378
            + I+ +I ++   D      ++   W    G V L      KP+     +++   W
Sbjct:  240 LTLIAMQIINNYVRFVDADENITREHWKTSLFWSDFIGDVGRLPLYVKPQKDFYQKSRNW   299

Query:  379 LSDSVSPSLAMIREYDMIVDGDYLQTILNSGEVNERGEKILDSIKASL              426
            L +S +P++ M+ E D  +   L ++    E+ ++ +K+LD    A +
Sbjct:  300 LRNSCAPTMKMVLEADEHLGKTDLSDMIAEAELADKHKKMLDVYMADV               347
```

No corresponding DNA sequence was identified in *S. pyogenes*.

A related GBS gene <SEQ ID 8603> and protein <SEQ ID 8604> were also identified. Analysis of this protein sequence reveals a RGD motif at residues 131-133.

The protein has homology with the following sequences in the databases:

```
29.4/54.5% over 342aa
Bacillus subtilis
EGAD|108511| hypothetical protein Insert characterized OMNI|NT01BS0566 conserved
hypothetical protein Insert characterized
GP|1881297|dbj|BAA19324.1||AB001488 SIMILAR TO ORF20 OF ENTEROCOCCUS FAECALIS
TRANSPOSON TN916. Insert characterized
GP|2632787|emb|CAB12294.1||Z99106 similar to transposon protein Insert
characterized
PIR|G69774|G69774 transposon-related protein homolog ydcR - Insert characterized
ORF00101(205-1581 of 1887)
EGAD|108511|BS0487(6-348 of 352) hypothetical protein (Bacillus subtilis)
OMNI|NT01BS0566 conserved hypothetical protein GP|1881297|dbj|BAA19324.1||AB001488
SIMILAR TO ORF20 OF ENTEROCOCCUS FAECALIS TRANSPOSON TN916. {Bacillus subtilis}
GP|2632787|emb|CAB12294.1||Z99106 similar to transposon protein {Bacillus subtilis}
PIR|G69774|G69774 transposon-related protein homolog ydcR - Bacillus subtilis
% Match = 9.7
% Identity = 29.3   % Similarity = 54.4
Matches = 103   Mismatches = 146   Conservative Sub.s = 88
   153       183       213       243       273             489       519
GVV*RSENGHAGHSAHTRALQRDLSILKPPFSNRGVRNEKFRILTPKNLYVSRVFR~~~~EQGKRKLTLEKYQEIKSHFG
                             :  :||  :||||
                             MDELKQPPHANRGV--------------------------------------
                                         10
   567       597       627       657       687       717       747
YLV--ENDS--SRLQVMIDYVRITLKDVRDLEFFCRNFLHCAFKEFQPFESKLMNYNHLWKRGDIWIFDFADKHETGNFQ
  :|    :|::      ||    |:||:||:::|     |:      ||  :    :|   :     :|    |     |
VIVKEKNEAVESPLVSMVDYIRVSFK-THDVDRIIEEVLHLSKDFMTEKQSGFYGYVGTYELDYIKVFYSAPDDNRG---
              30        40        50        60        70        80        90
   777       807       837       867       897       927       957       987
ITVQLSGRGCRQLELLMETEKFTWHDWLSYLRNSYRDDMNVTRFDIAIDELYLGKDRENEQFHLSDMISKYYRHELDFES
 :  :::||:||||:|  ::|    |  ||:|    ::::    :   ||||:|||     |:     |::::|   :  |
VLIEMSGQGCRQFESFLECRKKTWYD---FFQDCMQQGGSFTRFDLAID------DK-KTYFSIPELLKKAQKGEC-ISR
        100       110       120       130          140       150
  1017      1047      1077      1107      1137      1167      1197      1227
LRTWNYIGGGSLNFSDMEEIEQNRQGISLYFGSRQSEMYFNFYEKRYEIAKQEGITVEEALEIFELWNRYEIRLSQSKAN
 :|   ::    ||:::||           |   ::||||::||  |:     ||||   |:        :||     :|
FRKSDF--NGSFDLSD-----GITGGTTIYFGSKKSEAYLCFYEKNYEQAEKYNIPLEE----LGDWNRYELRLKNERAQ
         170         180       190       200       210           220
  1257      1287            1341      1371      1401      1431      1461
AAVDEFISGVPIGEISRGLIVSKIDVYDG-KN-EYGSFQADRKWQLMFGGVEPLKFVTKPEAYSIERTLRWLSDSVSPSL
 |:|  ::         :      |:   :| ::      |:|            ||           :::   || :| :|::
VAIDALLKTKDLTLIAMQIINNYVRFVDADENITREHWKTSLFWSDFIGDVGRLPLYVKPQKDFYQKSRNWLRNSCAPTM
         240       250       260       270       280       290       300
  1491      1521      1551      1581      1611      1641      1671      1701
AMIREYDMIVDGDYLQTILNSGEVNERGEKILDSIKASLGIL*EVSFVLYSNREFAYCVNRRNNLDKMIDLLVFMIPDRE
  |: |  |    :    |  :: |: ::  :|:||    |: :
KMVLEADEHLGKTDLSDMIAEAELADKHKKMLDVYMADVADMVV
         320       330       340       350
```

Figure 167:
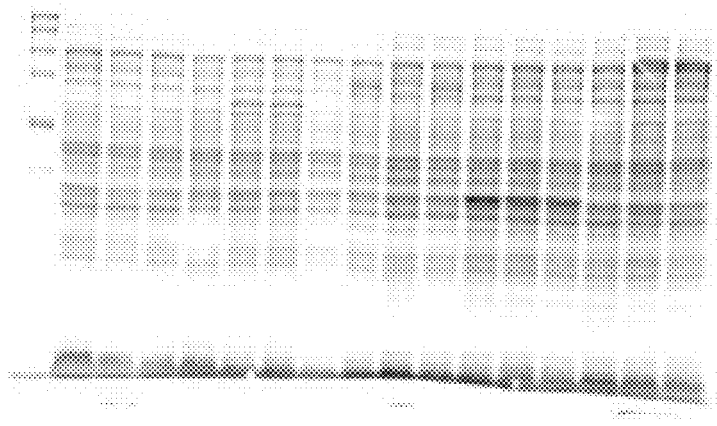

SEQ ID 8604 (GBS294) was expressed in *E. coli* as a His-fusion product. SDS-PAGE analysis of total cell extract is shown in FIG. 167 (lane 6 & 7; MW 65 kDa—thioredoxin fusion), in FIG. 238 (lane 2; MW 65 kDa) and in FIG. 40 (lane 6; MW 37 kDa). It was also expressed in *E. coli* as a GST-fusion product. SDS-PAGE analysis of total cell extract is shown in FIG. 47 (lane 3; MW 76 kDa).

Purified Thio-GBS294-His is shown in FIG. 244, lane 2.

Based on this analysis, it was predicted that these proteins and their epitopes could be useful antigens for vaccines or diagnostics.

EXAMPLE 578

A DNA sequence (GBSx0618) was identified in *S. agalactiae* <SEQ ID 1807> which encodes the amino acid sequence <SEQ ID 1808>. Analysis of this protein sequence reveals the following:

```
Possible site: 40

>>> Seems to have no N-terminal signal sequence
    INTEGRAL    Likelihood = -3.61    Transmembrane    24 - 40    (20 - 41)
    INTEGRAL    Likelihood = -1.97    Transmembrane    53 - 69    (52 - 72)

----- Final Results -----
            bacterial membrane --- Certainty = 0.2444(Affirmative) < succ>
              bacterial outside --- Certainty = 0.0000(Not Clear) < succ>
            bacterial cytoplasm --- Certainty = 0.0000(Not Clear) < succ>
```

The protein has homology with the following sequences in the GENPEPT database:

```
>GP:AAB60012 GB:U09422 ORF21 [Enterococcus faecalis]
 Identities = 136/473 (28%), Positives = 228/473 (47%), Gaps = 40/473 (8%)

Query:    9 RGIKVKPYMRYMSYYL-FSFLFILFLTPVGVYSYYYLDL-------LKMMDKMSM----I     56
            RG +++P  + + ++   + L  +FL VG++      +         L   DK+ +    I
Sbjct:    4 RGKRIRPSGKDLVFHFTIASLLPVFLLVVGLFHVKTIQQINWQDFNLSQADKIDIPYLII    63

Query:   57 SVGTGLFLAFFVSWYLTWFLQEANPLFNKLDRLKMSKFLYENGYVYEKR-------KKS   109
            S    + +  V++     F +     +L    ++++K + EN +   ++         K S
Sbjct:   64 SFSVAILICLLVAFV---FKRVRYDTVKQLYHRQKLAKMILENKWYESEQVKTEGFFKDS   120

Query:  110 NKKTKTKYR-FPKVYVKQGKYDLSVSFEMAGGKFQKKFKDIGGELEDTFFMDFMEKTDDP   168
            +TK K     FPK+Y +      + + E+  GK+Q +     + +LE    + +    +K
Sbjct:  121 AGRTKEKITYFPKMYYRLKNGLIQIRVEITLGRYQDQLLHLEKKLESGLYCELTDKELKD   180

Query:  169 RFKIYKLAYSAFLSRITVKDVIWNKDKGIKLMDGYYWDFINDPHLLVAGGTGGGKTVLLR   228
             + Y L Y    SRI++ D +  KD  ++LM   +W++     PH+L+AGGTGGGKT +
Sbjct:  181 SYVEYTLLYDTIASRISI-DEVEAKDGKLRLMKNVWWEYDKLPHMLIAGGTGGGKTYFIL   239

Query:  229 SILRCLAEI-GVCDICDPKRADFVTMSDLSAFEGRIAFEKADIIEKFENAVTIMFARYDF   287
            +++  L       I DPK AD    ++DL +    + + K D++   E      M R +
Sbjct:  240 TLIEALLHTDSKLYILDPKNAD---LADLGSVMANVYYRKEDLLSCIETFYEEMMKRSE-   295

Query:  288 VRNEMKRLGHKDMKKFYDY-GLEPYFFVCDEYNALMSSLSYQEREIVDNAFTQYILLGRQ   346
                EMK++ +      K Y Y GL  +F + DEY A  M    L  +E     V N     Q  ++LGRQ
Sbjct:  296 ---EMKQMKNYKTGKNYAYLGLPAHFLIFDEYVAFMEMLGTKENTAVMNKLKQIVMLGRQ   352

Query:  347 VGCNAIIAMQKPSADDLPTKIRSNMMHHISVGRLDDGGYVMMFGDENRNKEFRFIKYLAG   406
             G   I+A Q+P A   L     IR        +++GR+ + + GY MMFG + + K+F F+K
Sbjct:  353 AGFFLILACQRPDAKYLGDGIRDQFNFRVALGRMSEMGYGMMFGSDVQ-KDF-FLK----   406

Query:  407 RRVYGRGYSAVFGEVAREFYSPLLPKNFSFYDAFEKINRHENPFDPTENQEVS         459
            R+ GRGY V   V  EFY+PL+PK + F +  +K++          T    EV+
Sbjct:  407 -RIKGRGYVDVGTSVISEFYTPLVFKGYDFLEEIKKLSNSRQSTQATCEAEVA         458
```

No corresponding DNA sequence was identified in *S. pyogenes*.

A related GBS gene <SEQ ID 8605> and protein <SEQ ID 8606> were also identified. Analysis of this protein sequence reveals the following:

```
Lipop Possible site: -1  Crend: 8
McG: Discrim Score: -10.05
GvH: Signal Score (-7.5): -3.42
    Possible site: 40
>>> Seems to have no N-terminal signal sequence
ALOM program count: 2 value: -3.61  threshold: 0.0
    INTEGRAL    Likelihood = -3.61    Transmembrane    24 - 40    (20 - 41)
    INTEGRAL    Likelihood = -1.97    Transmembrane    53 - 69    (52 - 72)
    PERIPHERAL  Likelihood -  1.01                 224
 modified ALOM score: 1.22

*** Reasoning Step: 3

----- Final Results -----
            bacterial membrane --- Certainty = 0.2444(Affirmative) < succ>
              bacterial outside --- Certainty = 0.0000(Not Clear) < succ>
            bacterial cytoplasm --- Certainty = 0.0000(Not Clear) < succ>
```

The protein has homology with the following sequences in the databases:

```
29.9/52.7% over 456aa
Enterococcus faecalis
EGAD|17035| hypothetical protein Insert characterized
GP|532554|gb|AAB60012.1||U09422 ORF21 Insert characterized ORF00100(319-1677 of 2316)
EGAD|17035|17250(2-458 of 461) hypothetical protein {Enterococcus faecalis}
GP|532554|gb|AAB60012.1||U09422 ORF21 {Enterococcus faecalis}
% Match = 11.2
% Identity = 29.9   % Similarity = 52.7
Matches = 135   Mismatches = 199   Conservative Sub.s = 103
      207       237       267       297       327       357       384       414
FQVVCLKFLHHHLRKRMLQIMETHQKMKHLKLINKR*RRGNLARLIPQYRGIKVKPYMRYMSYYL-FSFLFILFLTPVGV
                                      : ||  :::|   :  : ::: :   |:  :|| :|| ||:
                                      MKQRGKRIRPSGKDLVFHFTIASLLPVFLLVVGL
                                          10        20        30

426       453       483       513         570       600
Y------SYYYLDL-LKMMDKMSMISVGTGLFLAFFVSWYLTWFLQEAN-PLFNKLDRLKRMSKFLYENGYVYEKR----
:       : |: |    ||: :      : :|   : :|  :  : ||    :   :::| : ||  :
FHVKTIQQINWQDFNLSQADKIDIPYLIISFSVAILICLLVAFVFKRVRYDTVKQLYHRQKLAKMILENKW-YESEQVKT
              50        60        70        80        90       100       110

636       663       693       723       753       783       813       843
----KKSNKKTKTKYR-FPKVYVKQGKYDLSVSFEMAGGKFQKKFKDIGGELEDTFFMDFMEKTDDPRFKIYKLAYSAFL
    | |  :||| |   |    :|:  :    :   |:   ||:|| :: :: :|    ||  |  |
EGFFKDSAGRTKEKITYFPKDMYYRLKNGLIQIRVEITLGKQDQLLHLEKKLESGLYCELTDKELKDSYVEYTLLYDTIA
              130       140       150       160       170       180       190

873       903       933       963       993      1020      1050      1080
SRITVKDVIWNKDKGIKLMDGYYWDFINDPHLLVAGGTGGGKTVLLRSILRCLAEI-GVCDICDPKRADFVTMSDLSAFE
|||::  |  :  ||   ::||     ||:|||||||||| ::  ::       |      ||||  |   ::||  :
SRISI-DEVEAKDGKLRLMKNVWWEYDKLPHMLIAGGTGGGKTYFILTLIEALLHTDSKLYILDPKNAD---LADLGSVM
              210       220       230       240       250       260

1110      1140      1170      1200      1227      1257      1287      1317
GRIAFEKADIIEKFENAVTIMFARYDFVRNEMKRLGHKDMKKFYDY-GLEPYFFVCDEYNALMSSLSYQEREIVDNAFTQ
 : : |::    |  |   :    |||::  |||        :|:: |||  :| : :|| ||||    ::
ANVYYRKEDLLSCIETFYEEMMKR----SEEMKQMKNYKTGKNYAYLGLPAHFLIFDEYVAFMEMLGTKENTAVMNKLKQ
              280       290       300       310       320       330       340

1347      1377      1407      1437      1467      1497      1527      1557
YILLGRQVGCNAIIAMQKPSADDLPTKIRSNMMHHISVGRLDDGGYVMMFGDENRNKEFRFIKYLAGRRVYGRGYSAVFG
::|||| |     |  |:|  |  :|  ||   :::||:  || ||||   :| |||    |:|  |     ||  ||
IVMLGRQAGFFLILACQRPDAKYLGDGIRDQFNFRVALGRMSEMGYGMMFGSD-VQKDF-FLKRIKGR-----GYVDVGT
              360       370       380       390       400       410

1587      1617      1647      1677      1707      1737      1767      1797
EVAREFYSPLLPKNFSFYDAFEKINRHENPFDPTENQEVSKAILKDESLREFVEKTSENELLKGSVGFDFDDEMEEMENM
 |  |||:||:||  :   :  ::::       |    |  ||:
SVISEFYTPLVPKGYDFLEEIKKLSNSRQSTQATCEAEVAGVD
              430       440       450       460
```

SEQ ID 8606 (GBS216) was expressed in *E. coli* as a His-fusion product. SDS-PAGE analysis of total cell extract is shown in FIG. 42 (lane 3; MW 66.6 kDa). It was also expressed in *E. coli* as a GST-fusion product. SDS-PAGE analysis of total cell extract is shown in FIG. 47 (lane 2; MW 91 kDa).

Based on this analysis, it was predicted that these proteins and their epitopes could be useful antigens for vaccines or diagnostics.

EXAMPLE 579

A DNA sequence (GBSx0619) was identified in *S. agalactiae* <SEQ ID 1809> which encodes the amino acid sequence <SEQ ID 1810>. Analysis of this protein sequence reveals the following:

```
Possible site: 14
>>> Seems to have no N-terminal signal sequence

----- Final Results -----
            bacterial cytoplasm --- Certainty = 0.4095(Affirmative) < succ>
            bacterial membrane  --- Certainty = 0.0000(Not Clear)   < succ>
             bacterial outside  --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 580

A DNA sequence (GBSx0620) was identified in *S. agalactiae* <SEQ ID 1811> which encodes the amino acid sequence <SEQ ID 1812>. Analysis of this protein sequence reveals the following:

```
Possible site: 28
>>> Seems to have no N-terminal signal sequence

----- Final Results -----
            bacterial cytoplasm --- Certainty = 0.0944(Affirmative) < succ>
            bacterial membrane  --- Certainty = 0.0000(Not Clear)   < succ>
             bacterial outside  --- Certainty = 0.0000(Not Clear)   < succ>
```

A related GBS nucleic acid sequence <SEQ ID 10219> which encodes amino acid sequence <SEQ ID 10220> was also identified.

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 581

A DNA sequence (GBSx0621) was identified in *S. agalactiae* <SEQ ID 1813> which encodes the amino acid sequence <SEQ ID 1814>. Analysis of this protein sequence reveals the following:

```
Possible site: 60
>>> Seems to have no N-terminal signal sequence
     INTEGRAL    Likelihood = -4.94    Transmembrane   810-826 (808-830)

----- Final Results -----
             bacterial membrane  --- Certainty = 0.2975(Affirmative) < succ>
              bacterial outside  --- Certainty = 0.0000(Not Clear)   < succ>
            bacterial cytoplasm  --- Certainty = 0.0000(Not Clear)   < succ>
```

The protein has homology with the following sequences in the GENPEPT database:

```
!GB: D90354 surface protein antigen precursor [Strept . . .
>GP: BAA14368 GB: D90354 surface protein antigen precursor
[Streptococcus sobrinus]
Identities = 151/408 (37%), Positives = 219/408 (53%), Gaps = 27/408 (6%)

Query:   451 PSKAVIDEAGQSVNGKTVLPNAELNYVAKQDFSQYKGMTASQGKIAKNFVFIDDYKDDAL    510
             P K  +E G  ++GK+VL       Y     D QYKG  +++  I K F ++DDY ++AL
Sbjct:  1162 PHKVNKNENGVVIDGKSVLAGTTNYYELTWDLDQYKGDKSAKETIQKGFFYVDDYPEEAL   1221

Query:   511 DGKSMKVNSIKASDGTDVSQL-LEMRHVLSTDTLDEKLQTLIKEAGISPVGEFYMWTAKD    569
             D    ++ + IK +D      + + +  S +     +Q ++K+A I+P G F ++TA D
Sbjct:  1222 D---LRTDLIKLTDANGKAVTGVSVADYASLEAAPAAVQDMLKKANITPKGAFQVFTADD   1278

Query:   570 PQAFYKAYVQKGLDVTYNLSFKVKKEFTK--GQIQNGVAQIDFGNGYTGNIVVNDLTTPE    627
             PQAFY  AYV  G D+T     VK E  K  G  +N    QIDFGNGY   NIV+N++
Sbjct:  1279 PQAFYDAYVVTGTDLTIVTPMTVKAEMGKIGGSYENKAYQIDFGNGYESNIVINNVPQIN   1338

Query:   628 IHKDV---LDKEDGKSINNGTVKLGDEVTYKLEGWVVPTGRSYDLFEYKFVDQLQRTPDL    684
               KDV    +D D   +++ T+ L     Y+L G ++P  + +LFEY F D   +T D
Sbjct:  1339 PEKDVTLTMDPADSTNVDGQTIALNQVFNYRLIGGIIPADHAEELFEYSFSDDYDQTGDQ   1398

Query:   685 YLRD-KVVAKVDVTLKDGTVIKKGTNLGEYTETVYNKKTGLYELVFKKDFLEKVARSSEF    743
             Y    K  AKVD+TLKDGT+IK  GT+L    YTE   ++  G     + FK+DFL  V+   S F
Sbjct:  1399 YTGQYKAFAKVDLTLKDGTIIKAGTDLTSYTEAQVDEANGQIVVTFKEDFLRSVSVDSAF   1458

Query:   744 GADDFVVVKRIKAGDVYNTADFFINGNKVKTETVVTHTPE--KPKPVEPQ----------    791
               A+ ++ +KRI  G    NT     +NG   + TV T TPE   +P PV+P+
Sbjct:  1459 QAEVYLQMKRIAVGTFANTYVNTVNGITYSSNTVRTSTPEPKQPSPVDPKTTTTVVFQPR   1518

Query:   792 --KATPKAPAKG--LPQTGEASVAPLTALGAIILSA-IGLAGFKKRKE               834
```

```
                KA    AP  G  LP TG++S  A L   LG +  L+A     L G +++++
Sbjct:  1519 QGKAYQPAPPAGAQLPATGDSSNAYLPLLGLVSLTAGFSLLGLRRKQD              1566

Identities = 75/242 (30%), Positives = 120/242 (48%), Gaps = 33/242 (13%)

Query:    11 SADQVTTQATTQTVTQNQAETVTSTQLDKAVATAKKAAVAVTTTAAVNHATTTDAQADLA    70
             S+   T+QA    T +  V++++LD+A  +A++A V V+   A VN  T    +  D A
Sbjct:    73 SSQAETSQAQAGQKTGAMSVDVSTSELDEAAKSAQEAGVTVSQDATVNKGTVETS--DEA   130

Query:    71 NQTQT-VKDVTAKAQANTQAIKDATAENAKIDAENKAESQRVSQLNAQTKAKID---AEN   126
             NQ +T +KD  +K  A+    I+   T +     A N+AE+ R++Q NA  KA+ +   A N
Sbjct:   131 NQKETEIKDDYSKQAAD---IQKTTEDYKAAVAANQAETDRITQENAAKKAQYEQDLAAN   187

Query:   127 KDAQAKADATNAQLQKDYQAKLAKIKSVEAYNAGVRQRNKDAQA--------------KA   172
             K    +     NAQ + DY+AKLA+ +    A    V+Q N D+QA                +
Sbjct:   188 KAEVERITNENAQAKADYEAKLAQYQKDLA---AVQQANNDSQAAYAAAKEAYDKELARV   244

Query:   173 DATNAQLQKDYQAKLA---LYNQALKAKAEADKQSINNVAFDIKAQ----AKGVDNAEYG   225
               A NA  +K+Y+  LA      N+ +KA+  A +Q       D +A+      K + A+ G
Sbjct:   245 QAANAAAKKEYEEALAANTTKNEQIKAENAAIQQRNAQAKADYEAKLAQYEKDLAAAQSG   304

Query:   226 NS                                                            227
             N+
Sbjct:   305 NA                                                            306

Identities = 63/223 (28%), Positives = 100/223 (44%), Gaps = 31/223 (13%)

Query:     2 ITTLQTSQVSADQVTTQATTQTVTQNQAETVTSTQLDKAVATAK----------KAAVA    50
             +  +Q +  +A +   +A     T+N+       +  + +  A AK            K    A
Sbjct:   241 LARVQAANAAAKKEYEEALAANTTKNEQIKAENAAIQQRNAQAKADYEAKLAQYEKDLAA   300

Query:    51 VTTTAAVNHATTTDAQADLANQTQTVKDVTAKA-QANTQAIKDATAENAKIDAENKAESQ   109
               +   A NA     +A   +   V+    A A QA  QA+    TA+NA+I  AEN+A  Q
Sbjct:   301 AQSGNATNEADYQAKKAAYEQELARVQAANAAAKQAYEQALAANTAKNAQITAENEAIQQ   360

Query:   110 RVSQLNAQTKAKIDAENKDAQAKADATNAQLQKDYQAKLA----KIKSVEAYNAGVRQRN   165
             R +Q  A +AK+    KD  A A + NA  + DYQ KLA       ++ V+A NA   +Q
Sbjct:   361 RNAQAKANYEAKLAQYQKDL-AAAQSGNAANEADYQEKLAAYEKELARVQAANAAAKQEY   419

Query:   166 KDAQAKADATNAQL--------------QKDYQAKLALYNQAL                  194
             +    +A+A NA++                + DY+ KL+ Y + L
Sbjct:   420 EQKVQEANAKNAEITEANRAIRERNAKAKTDYELKLSKYQEEL                   462

Identities = 75/243 (30%), Positives = 101/243 (40%), Gaps = 56/243 (23%)

Query:     8 SQVSAD-QVTTQATTQTVTQNQAETVTSTQLDKAVATAKKAAVAVTTTAAVNHATTTDAQ    66
             S+  +AD Q TT+     V  NQAET   TQ + A   A+        A V  T    +AQ
Sbjct:   142 SKQAADIQKTTEDYKAAVAANQAETDRITQ-ENAAKKAQYEQDLAANKAEVERITNENAQ   200

Query:    67 ADL---ANQTQTVKDVTAKAQANT---------------------------------QAIK    91
              A       A    Q KD+ A  QAN                                        +A+
Sbjct:   201 AKADYEAKLAQYQKDLAAVQQANNDSQAAYAAAKEAYDKELARVQAANAAAKKEYEEALA   260

Query:    92 DATAENAKIDAENKAESQRVSQLNAQTKAKIDAENKDAQAKADATNAQLQKDYQAKLA--   149
                T +N+ I AEN A    QR +Q  A +AK+    KD  A A + NA  + DYQAK A
Sbjct:   261 ANTTKNEQIKAENAAIQQRNAQAKADYEAKLAQYEKDL-AAAQSGNATNEADYQAKKAAY   319

Query:   150 --KIKSVEAYNAGVRQRNKDAQAKADATNAQL--------------QKDYQAKLALYNQA   193
                 ++ V+A NA   +Q  +    +A+A  A NAQ+                + +Y+AKLA Y +
Sbjct:   320 EQELARVQAANAAAKQAYEQALAANTAKNAQITAENEAIQQRNAQAKANYEAKLAQYQKD   379

Query:   194 LKA                                                            196
             L A
Sbjct:   380 LAA                                                            382
```

There is also homology to SEQ ID 598.

Figure 176:
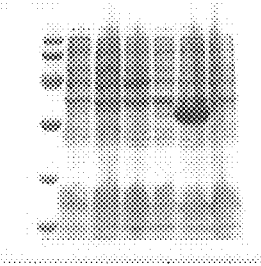

SEQ ID 1814 (GBS191) was expressed in *E. coli* as a His-fusion product. SDS-PAGE analysis of total cell extract is shown in FIG. 176 (lane 2; MW 91 kDa).

Based on this analysis, it was predicted that this protein and its epitopes, could be useful antigens for vaccines or diagnostics.

EXAMPLE 582

A DNA sequence (GBSx0622) was identified in *S. agalactiae* <SEQ ID 1815> which encodes the amino acid sequence <SEQ ID 1816>. This protein is predicted to be TnpA. Analysis of this protein sequence reveals the following:

```
Possible site: 34

>>> Seems to have no N-terminal signal sequence
```

```
----- Final Results -----
            bacterial cytoplasm --- Certainty = 0.2935(Affirmative) < succ>
            bacterial membrane  --- Certainty = 0.0000(Not Clear)   < succ>
             bacterial outside  --- Certainty = 0.0000(Not Clear)   < succ>
```

A related GBS nucleic acid sequence <SEQ ID 10221> which encodes amino acid sequence <SEQ ID 10222> was also identified.

A related GBS nucleic acid sequence <SEQ ID 9921> which encodes amino acid sequence <SEQ ID 9922> was also identified.

The protein has homology with the following sequences in the GENPEPT database:

```
>GP: AAC82523 GB: AF027768 TnpA [Serratia marcescens]
Identities = 168/385 (43%), Positives = 232/385 (59%),
Gaps = 13/385 (3%)

Query:  26 MMFKVEAVGPPERCPECGFD-KLYKHSSRNQLIMDLPIRLKRVGLHLNRRRYKCRECGST    84
            M F+V+ V  P  C ECG    +   +   R+    DLPI  KRV L + RRRY CR C +T
Sbjct:   1 MHFQVD-VPDPIACEECGVQGEFVRFGKRDVPYRDLPIHGKRVTLWVVRRRYTCRACKTT    59

Query:  85 IS------VDEKRSMTKRLLKSIQEQSMSKTFVEVAESVGVDEKTIRNVFKDYVALKERE   138
               VD  R MT RL +  ++++S +  +  VA    G+DEKT+R++F          R
Sbjct:  60 FRPQLPEMVDGFR-MTLRLHEYVEKESFNHPYTFVAAQTGLDEKTVRDIFNARAEFLGRW   118

Query: 139 YQFETPKWLGIDEIHIIRRPRLVLTNIERRTIYDIKPNRNKETVIQRLSEISDRTYIEYV   198
            ++FETP+ LGIDE+++ +R R +LTNIE RT+ D+    R ++ V    L ++ DR   +E V
Sbjct: 119 HRFETPRILGIDELYLNKRYRCILTNIEERTLLDLLATRRQDVVTNYLMKLKDRQKVEIV   178

Query: 199 TMDMWKPYKDAVNTILPQAKVVVDKFHVVRMANQALDNVRKSLKAHMSQKERRTLMRERF   258
            +MDMW PY+ AV  +LPQA++VVDKFHVVRMAN AL+ VRK L+  +    + RTL   +R
Sbjct: 179 SMDMWNPYRAAVKAVLPQARIVVDKFHVVRMANDALERVRKGLRKELKPSQSRTLKGDRK   238

Query: 259 ILLKRKHDLNERESFLLDTWLGNLPALKEAYELKEEFYWIWDTPDPDEGHLRYSQWRHRC   318
            ILLKR H++++RE  +++TW G  P L  AYE KE FY IWD       +        +W
Sbjct: 239 ILLKRAHEVSDRERLIMETWTGAFPQLLAAYEHKERFYGIWDATTRLQAEAALDEWI-AT   297

Query: 319 MSSNSKDAYKDLVRAVDNWHVEIFNYF--DKRLTNAYTESINSIIRQVERMGRGYSFDAL   376
              +    K+ +  DLVRAV NW  E   YF  D  +TNAYTESIN + +   R GRGYSF+ +
Sbjct: 298 IPKGQKEVWSDLVRAVGNWREETMTYFETDMPVTNAYTESINRLAKDKNREGRGYSFEVM   357

Query: 377 RAKILFNEKLHKKRKPRFNSSAFNK                                     401
            RA++L+  K HKK+ P    S F K
Sbjct: 358 RARMLYTTK-HKKKAPTAKVSPFYK                                     381
```

No corresponding DNA sequence was identified in *S. pyogenes*.

Based on this analysis, it was predicted that these proteins and their epitopes could be useful antigens for vaccines or diagnostics.

EXAMPLE 583

A DNA sequence (GBSx0623) was identified in *S. agalactiae* <SEQ ID 1817> which encodes the amino acid sequence <SEQ ID 1818>. This protein is predicted to be mercuric reductase. Analysis of this protein sequence reveals the following:

```
Possible site: 53
>>> Seems to have no N-terminal signal sequence

----- Final Results -----
            bacterial cytoplasm --- Certainty = 0.2115(Affirmative) < succ>
            bacterial membrane  --- Certainty = 0.0000(Not Clear)   < succ>
             bacterial outside  --- Certainty = 0.0000(Not Clear)   < succ>
```

The protein has homology with the following sequences in the GENPEPT database:

```
>GP: CAA70224 GB: Y09024 mercuric reductase
[Bacillus cereus]
Identities = 411/546 (75%), Positives = 483/546 (88%)

Query:    1 MNKFKVNISGMTCTGCEKHVESALEKIGAKNIESSYRRGEAVFELPDDIEVESAIKAIDE   60
            M K++V++ GMTCTGCE+HV ALE +GA  IE  +RRGEAVFELP+ + VE+A KAI +
Sbjct:    1 MKKYRVDVQGMTCTGCEEHVAVALENMGATGIEVDFRRGEAVFELPNALGVETAKKAISD   60

Query:   61 ANYQAGEIEEVSSLENVALINEDNYDLLIIGSGAAAFSSAIKAIEYGAKVGMIERGTVGG  120
            A YQ G+ EEV S E V L NE +YD +IIGSG AAFSSAI+A++YGAKV MIERGT+GG
Sbjct:   61 AKYQPGKAEEVQSQEMVQLGNEGDYDYIIIGSGGAAFSSAIEAVKYGAKVAMIERGTIGG  120

Query:  121 TCVNIGCVPSKTLLRAGEINHLSKDNPFIGLQTSAGEVDLASLITQKDKLVSELRNQKYM  180
            TCVNIGCVPSKTLLRAGEINHL+K+NPF+GL TSAGEVDLA LI QK++LV+ELRN KY+
Sbjct:  121 TCVNIGCVPSKTLLRAGEINHLAKNNPFVGLHTSAGEVDLAPLIKQKNELVTELRNSKYV  180

Query:  181 DLIDEYNFDLIKGEAKFVDASTVEVNGTKLSAKRFLIATGASPSLPQISGLEKMDYLTST  240
            DLID+Y F+LI+GEAKFVD  TVEVNG  +SAKRFLIATGASP+ P I GL ++DYLTST
Sbjct:  181 DLIDDYGFELIEGEAKFVDEKTVEVNGAPISAKRFLIATGASPAKPNIPGLNEVDYLTST  240

Query:  241 TLLELKKIPKRLTVIGSGYIGMELGQLFHHLGSEITLMQRSERLLKEYDPEISESVEKAL  300
            +LLELKK+PKRL VIGSGYIGMELGQLFH+LGSE+TL+QRSERLLKEYDPEISESVEK+L
Sbjct:  241 SLLELKKVPKRLVVIGSGYIGMELGQLFHNLGSEVTLIQRSERLLKEYDPEISESVEKSL  300

Query:  301 IEQGINLVKGATFERVEQSGEIKRVYVTVNGSREVIESDQLLVATGRKPNTDSLNLSAAG  360
            +EQGINLVKGAT+ER+EQ+G+IK+V+V VNG + +IE+DQLLVATGR PNT +LNL AAG
Sbjct:  301 VEQGINLVKGATYERIEQNGDIKKVHVEVNGKKRIIEADQLLVATGRTPNTATLNLRAAG  360

Query:  361 VETGKNNEILINDFGQTSNEKIYAAGDVTLGPQFVYVAAYEGGIITDNAIGGLNKKIDLS  420
            VE G   EI+I+D+ +T+N +IYAAGDVTLGPQFVYVAAY+GG+   NAIGGLNKK++L
Sbjct:  361 VEIGSRGEIIIDDYSRTTNTRIYAAGDVTLGPQFVYVAAYQGGVAAPNAIGGLNKKLNLE  420

Query:  421 VVPAVTFTNPTVATVGLTEEQAKEKGYDVKTSVLPLGAVPRAIVNRETTGVFKLVADAET  480
            VVP VTFT P +ATVGLTE+QAKE GY+VKTSVLPL AVPRA+VNRETTGVFKLVAD++T
Sbjct:  421 VVPGVTFTAPAIATVGLTEQQAKENGYEVKTSVLPLDAVPRALVNRETTGVFKLVADSKT  480

Query:  481 LKVLGVHIVSENAGDVIYAASLAVKFGLTIEDLTETLAPYLTMAEGLKLVALTFDKDISK  540
            +KVLG H+V+ENAGDVIYAA+LAVKFGLT++D+ ETLAPYLTMAEGLKL ALTFDKDISK
Sbjct:  481 MKVLGAHVVAENAGDVIYAATLAVKFGLTVDDIRETLAPYLTMAEGLKLAALTFDKDISK  540

Query:  541 LSCCAG                                                       546
            LSCCAG
Sbjct:  541 LSCCAG                                                       546
```

There is also homology to SEQ ID 1820.

Based on this analysis, it was predicted that this protein and its epitopes, could be useful antigens for vaccines or diagnostics.

EXAMPLE 584

A DNA sequence (GBSx0624) was identified in *S. agalactiae* <SEQ ID 1821> which encodes the amino acid sequence <SEQ ID 1822>. This protein is predicted to be regulatory protein. Analysis of this protein sequence reveals the following:

```
Possible site: 36
>>> Seems to have no N-terminal signal sequence

----- Final Results -----
        bacterial cytoplasm --- Certainty = 0.4529(Affirmative) < succ>
         bacterial membrane --- Certainty = 0.0000(Not Clear) < succ>
          bacterial outside --- Certainty = 0.0000(Not Clear) < succ>
```

The protein has homology with the following sequences in the GENPEPT database:

```
>GP: AAA83973 GB: AF138877 mercury resistance operon negative
regulator MerR1 [Bacillus sp. RC607]
Identities = 84/129 (65%), Positives = 105/129 (81%)

Query:   1 MIYRISEFADKCGVNKETIRYYERKNLLQEPHRTEAGYRIYSYDDVKRVGFIKRIQELGF   60
           M +RI E ADKCGVNKETIRYYER  L+ EP RTE GYR+YS   V R+ FIKR+QELGF
```

```
                              -continued
Sbjct:    1 MKFRIGELADKCGVNKETIRYYERLGLIPEPERTEKGYRMYSQQTVDRLHFIKRMQELGF   60

Query:   61 SLSEIYKLLGVVDKDEVRCQDMFEFVSKKQKEVQKQIEDLKRIETMLDDLKQRCPDEKKL  120
            +L+EI KLLGVVD+DE +C+DM++F    K +++Q++IEDLKRIE ML DLK+RCP+ K +
Sbjct:   61 TLNEIDKLLGVVDRDEAKCRDMYDFTILKIEDIQRKIEDLKRIERMLMDLKERCPENKDI  120

Query:  121 HSCPIIETL                                                    129
            + CPIIETL
Sbjct:  121 YECPIIETL                                                    129
```

There is also homology to SEQ ID 1712.

Based on this analysis, it was predicted that this protein and its epitopes, could be useful antigens for vaccines or diagnostics.

EXAMPLE 585

A DNA sequence (GBSx0625) was identified in *S. agalactiae* <SEQ ID 1823> which encodes the amino acid sequence <SEQ ID 1824>. This protein is predicted to be Nramp metal ion transporter. Analysis of this protein sequence reveals the following:

```
Possible site: 53
>>> Seems to have no N-terminal signal sequence
    INTEGRAL      Likelihood = -13.85    Transmembrane    175-191  (169-201)
    INTEGRAL      Likelihood = -11.94    Transmembrane    150-166  (132-173)
    INTEGRAL      Likelihood =  -9.45    Transmembrane    491-507  (481-509)
    INTEGRAL      Likelihood =  -8.92    Transmembrane    375-391  (374-396)
    INTEGRAL      Likelihood =  -8.39    Transmembrane     72- 88  ( 69- 93)
    INTEGRAL      Likelihood =  -7.96    Transmembrane    280-296  (274-299)
    INTEGRAL      Likelihood =  -7.17    Transmembrane    413-429  (411-431)
    INTEGRAL      Likelihood =  -6.79    Transmembrane    327-343  (322-346)
    INTEGRAL      Likelihood =  -3.40    Transmembrane    444-460  (443-462)
    INTEGRAL      Likelihood =  -3.24    Transmembrane    132-148  (132-149)
    INTEGRAL      Likelihood =  -0.96    Transmembrane    115-131  (114-131)

----- Final Results -----
            bacterial membrane  --- Certainty = 0.6540(Affirmative) < succ>
            bacterial outside   --- Certainty = 0.0000(Not Clear)   < succ>
            bacterial cytoplasm --- Certainty = 0.0000(Not Clear)   < succ>
```

The protein has homology with the following sequences in the GENPEPT database:

```
>GP: AAF83825 GB: AE003939 manganese transport protein [Xylella
fastidiosa]
Identities = 185/450 (41%), Positives = 278/450 (61%),
Gaps = 29/450 (6%)

Query:   16 ANGPSLEEINGTIEVPKDLSFFKTLLAYSGPGALVAVGYMDPGNWSTSITGGQNFQYLLI   75
            ++ PSL E++ ++ V +   +   LLA+ GPG +V+VGYMDPGNW+T + GG   F Y+L+
Sbjct:   35 SDSPSLGEMHASVAVSRRGHWGFRLLAFLGPGYMVSVGYMDPGNWATGLAGGSRFGYMLL   94

Query:   76 SIILMSSLIAMLLQYMSAKLGIVTQMDLAQAIRARTSKQLGIVLWILTELAIMATDIAEV  135
            S+IL+S+++A+++LQ ++A+LGI + MDLAQA RAR S+   + LW++ ELAI+A D+AEV
Sbjct:   95 SVILLSNVMAIVLQALAARLGIASDMDLAQACRARYSRGTTLALWVVCELAIIACDLAEV  154

Query:  136 IGGAIALYLLFHIPLAIAVFITVFDVLLLLLLTKIGFRKIEALVVALILVIFLVFAYQVA  195
            IG AIAL LL +P+   V IT  DV+L+LLL   GFR +EA V+AL+LVIF  F   Q+
Sbjct:  155 IGTAIALNLLLGVPIIWGVVITAVDVVLVLLLMHRGFRALEAFVIALLLVIFGCFVVQIV  214

Query:  196 LSHPIWTDIFKGLVPTSEAFSTSHTVNGQTPLSGALGIIGATVMPHNLYLHSSVVQSRKL  255
            L+ P    ++  G VP +         V      L  A+GI+GATVMPHNLYLHSS+VQ+R
Sbjct:  215 LAAPPLQEVLGGFVPRWQ------VVADPQALYLAIGIGVGATVMPHNLYLHSSIVQTRAY  268

Query:  256 DHNNKKDIAR--AIRFSTFDSNIQLTVAFFVNSLLLIMGVAVFKTGSVTDPSFFGLFKAL  313
             +  + R  A+R++   DS + L +A F+N+ +LI+     AVF         D
Sbjct:  269 P---RTPVGRRSALRWAVADSTLALMLALFINASILILAAAVFHAQHHFD----------  315

Query:  314 SNSTIMSNSILAHIASSGILSLLFAIALLASGQNSTITGTLTGQIIMEGFIHMKVPIWFR  373
             +  +LA +      G+ + LFA ALLASG NST+T TL GQI+MEGF+    +++ W R
Sbjct:  316 VEEIEQAYQLLAPVLGVGVAATLFATALLASGINSTVTATLAGQIVMEGFLRLRLRPWLR  375
```

```
-continued
Query: 374 RIITRLISVIPVMICVLVTSGRSTVEEHIAINNLMNNSQVFLAFALPFSMLPLLIFTNSK 433
           R++TR ++++PV++ V +   + T       L+  SQV L+  LPF+++PLL      +
Sbjct: 376 RVLTRGLAIVPVIVVVALYGEQGT-------GRLLLLSQVILSMQLPFAVIPLLRCVADR 428

Query: 434 VEMDDDFKNTWIIKILGWLSVIGLIYLNMK                               463
           M         W++ ++ WL    ++ LN+K
Sbjct: 429 KVMGALVAPRWLM-VVAWLIAGVIVVLNVK                               457
```

No corresponding DNA sequence was identified in *S. pyogenes*.

Based on this analysis, it was predicted that this protein and its epitopes, could be useful antigens for vaccines or diagnostics.

EXAMPLE 586

A DNA sequence (GBSx0626) was identified in *S. agalactiae* <SEQ ID 1825> which encodes the amino acid sequence <SEQ ID 1826>. Analysis of this protein sequence reveals the following:

```
Possible site: 20
>>> Seems to have no N-terminal signal sequence

----- Final Results -----
          bacterial cytoplasm --- Certainty = 0.2590(Affirmative) < succ>
          bacterial membrane  --- Certainty = 0.0000(Not Clear)   < succ>
           bacterial outside  --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 587

A DNA sequence (GBSx0627) was identified in *S. agalactiae* <SEQ ID 1827> which encodes the amino acid sequence <SEQ ID 1828>. Analysis of this protein sequence reveals the following:

```
Possible site: 53
>>> Seems to have no N-terminal signal sequence
    INTEGRAL      Likelihood = -9.82    Transmembrane    212-228 (204-233)
    INTEGRAL      Likelihood = -8.39    Transmembrane     98-114  (94-125)
    INTEGRAL      Likelihood = -7.22    Transmembrane    132-148 (122-154)
    INTEGRAL      Likelihood = -6.42    Transmembrane    159-175 (155-188)
    INTEGRAL      Likelihood = -4.78    Transmembrane     54-70   (51-72)
    INTEGRAL      Likelihood = -2.97    Transmembrane     18-34   (15-36)

----- Final Results -----
           bacterial membrane  --- Certainty = 0.4927(Affirmative) < succ>
            bacterial outside  --- Certainty = 0.0000(Not Clear)   < succ>
          bacterial cytoplasm  --- Certainty = 0.0000(Not Clear)   < succ>
```

The protein has homology with the following sequences in the GENPEPT database:

```
>GP: CAB16051 GB: Z99124 yydJ [Bacillus subtilis]
Identities = 97/239 (40%), Positives = 154/239 (63%),
Gaps = 3/239 (1%)

Query:   4 LEFRKSIRGRTLFYIISTVALTYVLGYILPVGIDKIRHLTLGEFYFSTYTVFTQFGFLIF  63
           LEF+KSI + +  + +    ++LGY L VGIDK+ ++T    F+FS+YTV TQFG ++F
Sbjct:   3 LEFKKSISNKVIIILGAMFVFLFLLGYFLLVGIDKVSNVTPEMFFFSSYTVATQFGLMLF  62

Query:  64 GFVIVYFFNKDYSDKCILYHYFSGYHLTKYFYTKLLVLFSEFFIAIIVCNILASLLWGYS 123
           + VI +F N++YS+K IL++    G ++  +FY K+ VLF E F   I  ++ SL++ +
Sbjct:  63 SFVIAFFINREYSNKNILFYKLIGENIYTFFYKKIAVLFLECFAFITLGLLIISLMY-HD 121

Query: 124 LFYFLTTTILFSLVVLQYLLVVSTISILFSNMLVSIGVTIFYWITSIILVAIGG-IFKVS 182
           +F      LFS V+LQY+L++ TIS+L  N+L+SIGV+I YW+TS+ILVAI       F
Sbjct: 122 FSHFALLLFLFSAVILQYILIIGTISVLCPNILISIGVSIVYWMTSVILVAISNKTFGFI 181

Query: 183 AIFDASNSLYKIIGK-LFSHPMTIDLTDFFIIVPYMICLSVISFLIVCLSNRRWLLNGM  240
```

```
            A F+A N++Y   I + L S   MT+    D    I+ Y++ + +I+ +++  S  RW+   G+
Sbjct: 182 APFEAGNTMYPRIERVLQSDNMTLGSNDVLFIILYLVSIIIINAIVLRFSKTRWIKMGL  240
```

No corresponding DNA sequence was identified in *S. pyogenes*.

Based on this analysis, it was predicted that this protein and its epitopes, could be useful antigens for vaccines or diagnostics.

EXAMPLE 588

A DNA sequence (GBSx0628) was identified in *S. agalactiae* <SEQ ID 1829> which encodes the amino acid sequence <SEQ ID 1830>. This protein is predicted to be antibiotic epidermin immunity protein F. Analysis of this protein sequence reveals the following:

```
Possible site: 43
>>> Seems to have no N-terminal signal sequence

----- Final Results -----
            bacterial cytoplasm --- Certainty = 0.2901(Affirmative) < succ>
            bacterial membrane  --- Certainty = 0.0000(Not Clear)   < succ>
            bacterial outside   --- Certainty = 0.0000(Not Clear)   < succ>
```

The protein has homology with the following sequences in the GENPEPT database:

```
>GP:CAB16052 GB:Z99124 similar to ABC transporter (ATP-binding
            protein) [Bacillus subtilis]
 Identities = 100/209 (47%), Positives = 150/209 (70%), Gaps = 4/209 (1%)

Query:    1 MFINNYTLKIGNRILLENTNLDFEEGEINHLLGRNGSGKSQLAKDFIINRGNYFSNDIYE    60
            M I NYTLK+   + LL++T+L F   G+INH++G+NG GKSQLAKDF++N       DI +
Sbjct:    1 MNIANYTLKVKGKTLLQDTDLHFSSGKINHVVGKNGVGKSQLAKDFLLNNSERIGRDIRQ    60

Query:   61 DTLIISSYSNLPSDVT----INDLERTIPWKLSKEIYQLLNINQISKTVKLKQLSDGQKQ   116
            +  +ISS SN+P+DV+      ++ L +    K+  +I  LLN++  I    V +K LSDGQKQ
Sbjct:   61 NVSLISSSSSNIPNDVSKDFLLHFLSKKFDAKMIDKIAYLLNLDNIDGKVLIKNLSDGQKQ   120

Query:  117 KVKLLVLLSLDKHIIILDEITNALDKKSVDEINVFLQNYIQYYPEKIIINISHDINNIRS   176
            K+KLL  L  DK+II+LDEITN+LDKK+V EI+  FL   YIQ   PEKIIINI+HD++++++
Sbjct:  121 KLKLLSFLLEDKNIIVLDEITNSLDKKTVIEIHGFLNKYIQENPEKIIINITHDLSDLKA   180

Query:  177 LKGNYFLIDNQKICKVDTLDDAISWYLGE   205
            ++G+Y++   ++Q+I +   ++D  I  Y+ E
Sbjct:  181 IEGDYYIFNHQEIQQYHSVDKLIEVYINE   209
```

A related DNA sequence was identified in *S. pyogenes* <SEQ ID 1831> which encodes the amino acid sequence <SEQ ID 1832>. Analysis of this protein sequence reveals the following:

```
Possible site: 13
>>> Seems to have no N-terminal signal sequence

----- Final Results -----
            bacterial cytoplasm --- Certainty = 0.2760(Affirmative) < succ>
            bacterial membrane  --- Certainty = 0.0000(Not Clear)   < succ>
            bacterial outside   --- Certainty = 0.0000(Not Clear)   < succ>
```

An alignment of the GAS and GBS proteins is shown below:

```
 Identities = 49/174 (28%), Positives = 82/174 (46%), Gaps = 27/174 (15%)

Query:    3 INNYTLKIGNRILLENTNLDFEEGEINHLLGRNGSGKSQLAK----------DFIINRGN    52
            I N     G R +L N N++    +G++     L+G NG+GKS + K                  II  G
```

```
                              -continued
Sbjct:    23 IQNLKKSYGKRTILNNVNMNIPKGKVYALIGPNGAGKSTIMKILTGLVSKTSGSIIFEGR    82

Query:    53 YFS-------NDIYEDTLI---ISSYSNLPSDVTINDL-ERTIPWKLSKEIYQLLNINQI   101
             +S         I E+  +   +S+Y N+      T+ + E TI    L+K     + + I
Sbjct:    83 EWSRRDLRKIGSIIEEPPLYKNLSAYDNMKVVTTMLGVSESTILPLLNK-----VGLGNI   137

Query:   102 SKTVKLKQLSDGQKQKVKLLVLLSLDKHIIILDEITNALDKKSVDEINVFLQNY         155
             K   +KQ S G KQ++ + + L     ++ILDE TN LD   + E+   ++++
Sbjct:   138 DKR-PVKQFSLGMKQRLGIAISLINSPKLLILDEPTNGLDPIGIQELREIIESF        190
```

Based on this analysis, it was predicted that these proteins and their epitopes could be useful antigens for vaccines or diagnostics.

EXAMPLE 589

A DNA sequence (GBSx0629) was identified in *S. agalactiae* <SEQ ID 1833> which encodes the amino acid sequence <SEQ ID 1834>. This protein is predicted to be aminoglycoside 6-adenylyltransferase. Analysis of this protein sequence reveals the following:

```
Possible site: 33
>>> Seems to have no N-terminal signal sequence

----- Final Results -----
              bacterial cytoplasm --- Certainty = 0.1780(Affirmative) < succ>
              bacterial membrane  --- Certainty = 0.0000(Not Clear)   < succ>
              bacterial outside   --- Certainty = 0.0000(Not Clear)   < succ>
```

The protein has homology with the following sequences in the GENPEPT database:

```
>GP:CAA29839 GB:X06627 ORF (str) [Staphylococcus aureus]
 Identities = 91/289 (31%), Positives = 146/289 (50%), Gaps = 14/289 (4%)

Query:     1 MRDEQEIYNLVLNIANQDKRIEAVLLNGSRANPNVPKDDFQDYDIVFVTNFIEDIISDTN    60
             MR E+EI NLV  A Q   ++ + L GSR N N+ KD FQDYD F  + IE    + +
Sbjct:     1 MRTEKEILNLVSEFAYQRSNVKIIALEGSRTNENIKKDKFQDYDFAFFVSDIEYFTHEES    60

Query:    61 YHKKFGDILIMQKPNE---FRNKTEYNCFAYLMQFQDLTRIDLRLIKPEFLEDYLDDA--   115
             +   FG++L +QKP +    F    +Y  ++Y+M F+D  ++D+ LI   + L  Y  D+
Sbjct:    61 WLSLFGELLFIQKPEDMELFPPDLDYG-YSYIMYFKDGIKMDITLINLKDLNRYFSDSDG   119

Query:   116 FSKVLLDKKNKYLDYNFERSSLYETKQLSEDEINKILNEIYWVSTYVVKGIARNDIIYSE   175
             + K+L+DK N      S Y  K+ +E  E        NE + VSTYV  KG+ R +I+++
Sbjct:   120 LVKILVDKDNLVTQEIVPDDSNYWLKKPTEREFYDCCNEFWSVSTYVARGVFRREILFAL   179

Query:   176 FMISNPIKNAFIKLLKQKILIEKELDSLSFGKLDKDILQYITDKD--QLLKIFSNKSLKD   233
                +N ++  ++++     I   +  D  S GK    K I +Y+TDK+    LL F     +
Sbjct:   180 DHFNNILRPELLRMISWYIGFNRGFD-FSLGKNYKFINKYLTDKEFNMLLATFEMNGYRK   238

Query:   234 IEANLRFLLDETNQMAKYISINRKLNLNQGEYQSAMKFMNIFLSNSYQN             282
              + +           ++ KY S N+ L      Y  +  K  +  F+  N+Y+N
Sbjct:   239 TYQSFKLCC----ELFKYYS-NKVSCLGNYNYPNYEKNIENFIRNNYEN             282
```

No corresponding DNA sequence was identified in *S. pyogenes*.

A related GBS gene <SEQ ID 8607> and protein <SEQ ID 8608> were also identified. Analysis of this protein sequence reveals the following:

```
Lipop: Possible site: -1  Crend: 5
McG: Discrim Score: -5.26
GvH: Signal Score (-7.5): -6.14
     Possible site: 33
>>> Seems to have no N-terminal signal sequence
ALOM program   count: 0  value: 6.10  threshold: 0.0
    PERIPHERAL  Likelihood = 6.10    151
modified ALOM score: -1.72

*** Reasoning Step: 3
```

----- Final Results -----
            bacterial cytoplasm --- Certainty = 0.1780(Affirmative) < succ>
            bacterial membrane  --- Certainty = 0.0000(Not Clear)   < succ>
             bacterial outside  --- Certainty = 0.0000(Not Clear)   < succ>

The protein has homology with the following sequences in the databases:

```
31.0/53.4% over 281aa
Staphylococcus aureus
EGAD|9462| streptomycin resistance protein Insert characterized
SP|P12055|STR_STAAU STREPTOMYCIN RESISTANCE PROTEIN. Insert characterized
GP|46644|emb|CAA29839.1||X06627 ORF (str) Insert characterized
PIR|S00938|S00938 str protein-plasmid pS194 Insert characterized
ORF00399(301-1146 of 1452)
EGAD|9462|9267(1-282 of 282) streptomycin resistance protein {Staphylococcus
aureus} SP|P12055|STR_STAAU STREPTOMYCIN RESISTANCE PROTEIN.
GP|46644|emb|CAA29839.1||X06627 ORF (str) {Staphylococcus aureus} PIR|S00938|S00938
str protein - Staphylococcus aureus plasmid pS194
% Match = 12.8
% Identity = 31.0  % Similarity = 53.4
Matches = 87  Mismatches = 125  Conservative Sub.s = 63
117         147         177         207         237         267         297         327
**LMTY*H*TVENIWNHNQLLRKI*N*ILGGRKGMSMLI*VYDYMLREKYKGNIKVLEXTW*YKVK*EVAIMRDEQEIYN
                                                                   || |:|| |
                                                                   MRTEKEILN
357         387         417         447         477         507                 558
LVLNIANQDKRIEAVLLNGSRANPNVPKDDFQDYDIVFVTNFIEDIISDTNYHKKFGDILIMQKPNEFR---NKTEYNCF
||   |     :: :  |||  |:  ||  ||||       |   |::|  |||::|:|||  :            :| :
LVSEFAYQRSNVKIIALEGSRTNENIKKDKFQDYDFAFFVSDIEYFTHEESWLSLFGELLFIQKPEDMELFPPDLDYG-Y
           20          30          40          50          60          70          80
588         618              672         702         732         762         792
AYLMQFQDLTRIDLRLIKPEFLEDYLDDA--FSKVLLDKKNKYLDYNFERSSLYETKQLSEDEINKILNEIYWVSTYVVK
:|:| |:|   ::|: ||   :  |: |:   : |:|:||  |         | |:  :|     || :  ||||| |
SYIMYFKDGIKMDITLINLKDLNRYFSDSDGLVKILVDKDNLVTQEIVPDDSNYWLKKPTEREFYDCCNEFWSVSTYVAK
           100         110         120         130         140         150         160
822         852         882         912         942         966         996         1026
GIARNDIIYSEFMISNPIKNAFIKLLKQKILIEKELDSLSFGKLDKDILQYITDKD--QLLKIFSNKSLKDIEANLRFLL
|:  |  :|:::   |  ::  :::::  |     :|  :|:|||:  |  | ||   |      :      :   ::
GVFRREILFALDHFNNILRPELLRMISWYIGFNRGFD-FSLGKNYKFINKYLTDKEFNMLLATFEMNGYRKTYQSFKLCC
           180         190         200         210         220         230         240
1056        1086        1116        1146        1176        1206        1236        1266
DETNQMAKYISINRKLNLNQGEYQSAMKFMNIFLSNSYQNFN*YYCVKDNRL*LSKLNYHS*RFSRKIINNFGDK*WDKS
:     :|           |   |:  |     |   :|:|
ELFKYYSNKVS-----CLGNYNYPNYEKNIENFIRNNYEN
           260         270         280
```

SEQ ID 1834 (GBS46) was expressed in *E. coli* as a His-fusion product. SDS-PAGE analysis of total cell extract is shown in FIG. 11 (lane 6; MW 34.9 kDa). It was also expressed in *E. coli* as a GST-fusion product. SDS-PAGE analysis of total cell extract is shown in FIG. 16 (lane 3; MW 59.8 kDa).

Based on this analysis, it was predicted that these proteins and their epitopes could be useful antigens for vaccines or diagnostics.

EXAMPLE 590

A DNA sequence (GBSx0630) was identified in *S. agalactiae* <SEQ ID 1835> which encodes the amino acid sequence <SEQ ID 1836>. Analysis of this protein sequence reveals the following:

```
Possible site: 29
>>> Seems to have no N-terminal signal sequence

----- Final Results -----
            bacterial cytoplasm --- Certainty = 0.1179(Affirmative) < succ>
            bacterial membrane  --- Certainty = 0.0000(Not Clear)   < succ>
             bacterial outside  --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 591

A DNA sequence (GBSx0631) was identified in *S. agalactiae* <SEQ ID 1837> which encodes the amino acid sequence <SEQ ID 1838>. Analysis of this protein sequence reveals the following:

```
Possible site: 44
>>> Seems to have no N-terminal signal sequence
    INTEGRAL    Likelihood = -2.81    Transmembrane    177-193 (177-194)
    INTEGRAL    Likelihood = -0.27    Transmembrane    129-145 (129-145)

----- Final Results -----
            bacterial membrane --- Certainty = 0.2126(Affirmative) < succ>
            bacterial outside  --- Certainty = 0.0000(Not Clear)   < succ>
           bacterial cytoplasm --- Certainty = 0.0000(Not Clear)   < succ>
```

A related GBS nucleic acid sequence <SEQ ID 8609> which encodes amino acid sequence <SEQ ID 8610> was also identified. Analysis of this protein sequence reveals the following:

```
Lipop: Possible site: -1 Crend: 9
McG: Discrim Score: -19.59
GvH: Signal Score (-7.5): -4.49
     Possible site: 44
>>> Seems to have no N-terminal signal sequence
ALOM program count: 2 value: -2.81 threshold: 0.0
    INTEGRAL    Likelihood = -2.81    Transmembrane    172-188 (172-189)
    INTEGRAL    Likelihood = -0.27    Transmembrane    124-140 (124 140)
    PERIPHERAL  Likelihood =  8.01    30
modified ALOM score: 1.06
*** Reasoning Step: 3

----- Final Results -----
            bacterial membrane --- Certainty = 0.2126(Affirmative) < succ>
            bacterial outside  --- Certainty = 0.0000(Not Clear)   < succ>
           bacterial cytoplasm --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that these proteins and their epitopes could be useful antigens for vaccines or diagnostics.

EXAMPLE 592

A DNA sequence (GBSx0632) was identified in *S. agalactiae* <SEQ ID 1839> which encodes the amino acid sequence <SEQ ID 1840>. Analysis of this protein sequence reveals the following:

```
Possible site: 27
>>> Seems to have an uncleavable N-term signal seq

----- Final Results -----
            bacterial membrane --- Certainty = 0.0000(Not Clear) < succ>
            bacterial outside  --- Certainty = 0.0000(Not Clear) < succ>
           bacterial cytoplasm --- Certainty = 0.0000(Not Clear) < succ>
```

A related GBS nucleic acid sequence <SEQ ID 10223> which encodes amino acid sequence <SEQ ID 10224> was also identified.

The protein has homology with the following sequences in the GENPEPT database:

```
>GP: CAB49414 GB: AJ248284 hypothetical protein [Pyrococcus abyssi]
Identities = 29/86 (33%), Positives = 52/86 (59%), Gaps = 4/86 (4%)

Query:  14 TYYILLALFE--EAHGYAIMQKVEEMSGGDVRIAAGTMYGAIENLLKQKWIKSIPSD--D    69
            +Y ILL L E   + HGYAI +++EE++ G +   + G +Y   ++ L K K ++    ++
Sbjct:  19 SYLILLILNENEKLHGYAIRKRLEELTDGKLVPSEGALYSILKMLKKYKLVEDYWAEVGG    78

Query:  70 RRRKVYIITETGKEIVELETNRLRKL                                     95
            R R+ Y ITE GKE+++        +R++
Sbjct:  79 RVRRYYQITELGKEVLDEIKEEIREI                                    104
```

No corresponding DNA sequence was identified in *S. pyogenes*.

Based on this analysis, it was predicted that these proteins and their epitopes could be useful antigens for vaccines or diagnostics.

EXAMPLE 593

A DNA sequence (GBSx0633) was identified in *S. agalactiae* <SEQ ID 1841> which encodes the amino acid sequence <SEQ ID 1842>. Analysis of this protein sequence reveals the following:

```
Possible site: 23
>>> Seems to have no N-terminal signal sequence

----- Final Results -----
            bacterial cytoplasm --- Certainty = 0.0510(Affirmative) < succ>
             bacterial membrane --- Certainty = 0.0000(Not Clear)  < succ>
              bacterial outside --- Certainty = 0.0000(Not Clear)  < succ>
```

A related GBS nucleic acid sequence <SEQ ID 10225> which encodes amino acid sequence <SEQ ID 10226> was also identified.

The protein has homology with the following sequences in the GENPEPT database:

```
>GP: AAF22299 GB: AF185571 putative N-acetyltransferase Camello 2
[Homo sapiens]
Identities = 32/110 (29%), Positives = 54/110 (49%), Gaps = 4/110 (3%)

Query:  67 IKMAEQDDIFQIENYYQNRKGQ-FWIALENERVVGSIALLRIDDKTAVLKKFFTYPKYRG   125
            + +A + D+  I    Y +   G  FW+A    EKVVG++  L +DD T    K+    +
Sbjct:  86 VDIALRTDHSDITKSYLSECGSCFWVAESEEKVVGTVGALPVDDFTLREKRLQLFHLSVD   145

Query: 126 NPVR---LGRKLFERFMLFARASKFTRIVLDTPEKEKRSHFFYENQGFKQ            172
            N R   + + L    + FAR   ++ +VLDT   +  +  Y++ GFK+
Sbjct: 146 NEHRGQGIAKALVRTVLQFARDQGYSEVVLDTSNIQLSAMGLYQSLGFKK            195
```

No corresponding DNA sequence was identified in *S. pyogenes*.

Based on this analysis, it was predicted that these proteins and their epitopes could be useful antigens for vaccines or diagnostics.

EXAMPLE 594

A DNA sequence (GBSx0634) was identified in *S. agalactiae* <SEQ ID 1843> which encodes the amino acid sequence <SEQ ID 1844>. Analysis of this protein sequence reveals the following:

```
Possible site: 47
>>> Seems to have a cleavable N-term signal seq.
        INTEGRAL    Likelihood = -11.94    Transmembrane   159-175 (151-180)
        INTEGRAL    Likelihood = -11.62    Transmembrane   231-247 (225-251)
        INTEGRAL    Likelihood =  -9.98    Transmembrane   182-198 (177-203)
        INTEGRAL    Likelihood =  -7.11    Transmembrane   118-134 (106-136)
        INTEGRAL    Likelihood =  -1.49    Transmembrane    74-90  (74-93)
```

-continued

```
----- Final Results -----
              bacterial membrane --- Certainty = 0.5776(Affirmative) < succ>
              bacterial outside  --- Certainty = 0.0000(Not Clear)   < succ>
              bacterial cytoplasm --- Certainty = 0.0000(Not Clear)  < succ>
```

A related GBS nucleic acid sequence <SEQ ID 10227> which encodes amino acid sequence <SEQ ID 10228> was also identified.

The protein has homology with the following sequences in the GENPEPT database:

```
>GP:CAB15891 GB:Z99123 yxlG [Bacillus subtilis]
 Identities = 42/188 (22%), Positives = 94/188 (49%), Gaps = 4/188 (2%)

Query:    1 MKSLAVMLKKEWMENVRTYKVISILITCSIFGILGPLTALMMPDIMA--GILPKKLQGAI    58
            MK +  +L+KEW+E  ++ K+I + I     I G+  PLT    MP+I+A  G LP ++ +
Sbjct:    1 MKVMMALLQKEWLEGWKSGKLIWLPIAMMIVGLTQPLTIYYMPEIIANGGNLPDGMKISF    60

Query:   59 PEPTYIDSYIQYFKNMNQLGLVILVFLFSSTLTQEFSKGTLINLVTKGLAKKVIILAKFI   118
            P+  +  +      N LG+ +++F    ++  E ++G     ++++  +       I++K++
Sbjct:   61 TMPSGSEVMVSTLSQFNTLGMALVIFSVMGSVANERNQGVTALIMSRPVTAAHYIVSKWL   120

Query:  119 VITLLWTVSYLLSVVIHFSYTLYYFSNEGSHKLMVYGATWFIGILFI-SLILFFSVLFRK   177
             + +++  +S+      + + Y   F +    +        + + ++FI +  L   S +FR
Sbjct:  121 IQSVIGIMSFAAGYGLAYYYVRLLFEDASFSRFAASLGLYALWVIFIVTAGLAGSTIFR-   179

Query:  178 TLGGLLGC   185
            ++G    C
Sbjct:  180 SVGAAAAC   187
```

No corresponding DNA sequence was identified in *S. pyogenes*.

Based on this analysis, it was predicted that these proteins and their epitopes could be useful antigens for vaccines or diagnostics.

EXAMPLE 595

A DNA sequence (GBSx0635) was identified in *S. agalactiae* <SEQ ID 1845> which encodes the amino acid sequence <SEQ ID 1846>. This protein is predicted to be ABC transporter, ATP-binding protein. Analysis of this protein sequence reveals the following:

```
Possible site: 14
>>> Seems to have no N-terminal signal sequence

----- Final Results -----
              bacterial cytoplasm --- Certainty = 0.3431(Affirmative) < succ>
              bacterial membrane  --- Certainty = 0.0000(Not Clear)   < succ>
              bacterial outside   --- Certainty = 0.0000(Not Clear)   < succ>
```

A related GBS nucleic acid sequence <SEQ ID 10229> which encodes amino acid sequence <SEQ ID 10230> was also identified.

The protein has homology with the following sequences in the GENPEPT database:

```
>GP:CAB12736 GB:Z99108 similar to ABC transporter (ATP-binding
            protein) [Bacillus subtilis]
 Identities = 105/299 (35%), Positives = 175/299 (58%), Gaps = 11/299 (3%)

Query:    4 ISFQNVTKSFGPKKILNNVSFDLEENMIYGFVGPNGAGKTTTIKMILGLLKFDTGFITIF    63
            +  +NVTK+   + I++++SF + E   ++GF+GPNGAGKTTTI+N++GL+K   G + I
Sbjct:    5 LELKNVTKNIRGRTIIDDLSFTIREGEVFGFLGPNGAGKTTTIRMMVGLMKLSKGDVLIC    64

Query:   64 GKKVNFGRTDTNQLIGYLPDVPEYYDYMTALEYLDLCSGLARSKHKLSNKELLRSVGLDD   123
            G+ +          + IG + + PE Y +++  + L    +      K     E++     VGLD
```

```
                            -continued
Sbjct:   65 GQSITKEYAKAIKHIGAIVENPELYKFLSGYKNLQQFARMVKGVTKEKIDEVVELVGLTD  124

Query:  124 N-HQKIATYSRGMKQRLGLAQALVHDPKIIICDEPTSALDPKGRQDILDIISNLRGEK--  180
               H K+ TYS GM+QRLGLAQ L+HDPK++I DEPT+ LDP G ++I D +  L  E+
Sbjct:  125 RIHDKVKTYSLGMRQRLGLAQCLLHDPKVLILDEPTNGLDPAGIREIRDHLKKLTRERGM  184

Query:  181 TVIFSTHILSDVEKICDHVLVLTKCGIYSLEELKGKKSEENYSVRILIKVTKSEAKVLSH  240
               VI S+H+LS++E +CD + +L K  +   ++ +K +   +EN +      ++   SEA  ++
Sbjct:  185 AVIVSSHLLSEMELMCDRIAILQKGKLIDIQNVKDENIDENDTYFFQVE-QPSEAATVLN  243

Query:  241 NYQIEKKDNEYALTLKGSKMDNKADLLAGFYQDLVSLKISPSAIEVIDNSLEELYLEVT  299
                Y +   K N    + L   ++     +L          LV +I       ++VI   SLE+ +LE+T
Sbjct:  244 QYDLLSKTNGVEIKLAKEEVPAVIEL-------LVMQQIRIYEVKVITKSLEDRFLEMT  295
```

There is also homology to SEQ ID 686.

Based on this analysis, it was predicted that these proteins and their epitopes could be useful antigens for vaccines or diagnostics.

EXAMPLE 596

A DNA sequence (GBSx0636) was identified in *S. agalactiae* <SEQ ID 1847> which encodes the amino acid sequence <SEQ ID 1848>. Analysis of this protein sequence reveals the following:

```
Possible site: 34
>>> Seems to have no N-terminal signal sequence

----- Final Results -----
            bacterial cytoplasm --- Certainty = 0.4040(Affirmative) < succ>
            bacterial membrane --- Certainty = 0.0000(Not Clear)   < succ>
             bacterial outside --- Certainty = 0.0000(Not Clear)   < succ>
```

The protein has homology with the following sequences in the GENPEPT database:

```
>GP:AAB71491 GB:U53767 ORF6 [Bacillus pumilus]
 Identities = 39/134 (29%), Positives = 71/134 (52%), Gaps = 16/134 (11%)

Query:    2 LGENIYLQRTQIGMTQENLSDYLHLTKTTISKWENNQAKPDIDYLILMANLFDISLDDLV   61
            LG NI  +R  +  ++QE +++ L +++  ISKWE NQ++P +D LI +A LFD  +  +LV
Sbjct:    4 LGSNISNKRKSLKLSQEYVAEQLGVSRQAISKWETNQSEPSMDNLIRLAELFDSDIKELV   63

Query:   62 GYQKTLSDDQRNQLIKDLKIKANVLSERDFFQEVKELSKQFPNDFKTLLIMINM--VLSN  119
                    S  +Q  ++  KDL+  +         K++   Q   F +L++I+       +
Sbjct:   64 ------SPEQYSEEQKDLETRIE--------HGQKDIKMQNSAVFGRILMLISFFGYIGA  109

Query:  120 LTNLNDSEMKEWSL                                               133
            L +L+  ++  W L
Sbjct:  110 LFDLSSYQLPIWXL                                               123
```

There is also homology to SEQ ID 1740.

Based on this analysis, it was predicted that this protein and its epitopes, could be useful antigens for vaccines or diagnostics.

EXAMPLE 597

A DNA sequence (GBSx0637) was identified in *S. agalactiae* <SEQ ID 1849> which encodes the amino acid sequence <SEQ ID 1850>. Analysis of this protein sequence reveals the following:

```
Possible site: 20
>>> Seems to have an uncleavable N-term signal seq
    INTEGRAL   Likelihood = -13.59    Transmembrane  152 - 168   (145 - 173)
    INTEGRAL   Likelihood =  -9.71    Transmembrane    7 -  23     (3 -  27)
    INTEGRAL   Likelihood =  -6.95    Transmembrane  125 - 141   (122 - 146)
    INTEGRAL   Likelihood =  -4.51    Transmembrane   85 - 101    (83 - 102)
    INTEGRAL   Likelihood =  -3.35    Transmembrane   55 -  71    (54 -  75)
```

-continued

```
----- Final Results -----
           bacterial membrane --- Certainty = 0.6434(Affirmative) < succ>
            bacterial outside --- Certainty = 0.0000(Not Clear) < succ>
          bacterial cytoplasm --- Certainty = 0.0000(Not Clear) < succ>
```

The protein has homology with the following sequences in the GENPEPT database:

```
>GP:CAA79986 GB:Z21972 ORF2 [Bacillus megaterium]
 Identities = 51/186 (27%), Positives = 106/186 (56%), Gaps = 5/186 (2%)

Query:    5 SFFQCVILLVSFLVLTLAVKSQSDMISYLDNITSAFFQSIRNPDLTNLMTIISTVVSPLT    64
            +F   V+ L+ F  +   + S ++ + + +++ S    Q    +P LT++M   + + S   +
Sbjct:   10 AFIISVLSLIGFSFMAFTI-SANEYLKFDEDVIS-LVQGWESPLLTDIMKFFTYIGSTAS    67

Query:   65 TSLIALVILGYQY-FLNQRIAVWLFM-LFFGTNALALLLKDIIARHRP-MNQLVFDSGYS   121
              +++LVIL + Y  L  R+ + LF   +  G+   L  L++K   R RP +++L+    GYS
Sbjct:   68 LIILSLVILFFLYRILKHRLELVLFTAVMVGSPLLNLMVKLFFQRARPDLHRLIDIGGYS   127

Query:  122 FPSGHTISAFLLMILVLVVARQRLRRVLSQVVFVIFALVILASVIFSRLYLENHFLTDIL   181
            FPSGH  ++AF L  ++  +   +    ++++ ++F+++++ S+    SR+YL  H+   +DI+
Sbjct:  128 FPSGHAMNAFSLYGILTFLLWRHITARWARILLILFSMLMILSIGISRIYLGVHYPSDII   187

Query:  182 GSLLLG                                                        187
                L G
Sbjct:  188 AGYLAG                                                        193
```

There is also homology to SEQ ID 1852.
A related GBS gene <SEQ ID 8611> and protein <SEQ ID 8612> were also identified. Analysis of this

```
Lipop: Possible site: -1    Crend: 3
McG: Discrim Score: 11.91
GvH: Signal Score (-7.5): -4.6
     Possible site: 20
>>> Seems to have an uncleavable N-term signal seq
ALOM program    count: 5 value: -13.59   threshold: 0.0
   INTEGRAL      Likelihood = -13.59    Transmembrane   152 - 168    (145 - 173)
   INTEGRAL      Likelihood =  -9.71    Transmembrane     7 -  23    (  3 -  27)
   INTEGRAL      Likelihood =  -6.95    Transmembrane   125 - 141    (122 - 146)
   INTEGRAL      Likelihood =  -4.51    Transmembrane    85 - 101    ( 83 - 102)
   INTEGRAL      Likelihood =  -3.35    Transmembrane    55 -  71    ( 54 -  75)
   PERIPHERAL    Likelihood =  -1.16    184
modified ALOM score: 3.22

*** Reasoning Step: 3

----- Final Results -----
           bacterial membrane --- Certainty = 0.6434(Affirmative) < succ>
            bacterial outside --- Certainty = 0.0000(Not Clear) < succ>
          bacterial cytoplasm --- Certainty = 0.0000(Not Clear) < succ>
                                              50
```

The protein has homology with the following sequences in the databases:

```
ORF01359(313-864 or 1212)
EGAD|16772|16959(10-194 of 216) hypothetical protein {Bacillus megaterium}
GP|288301|emb|CAA79986.1||Z21972 ORF2 {Bacillus megaterium} PIR|S32217|S32217
hypothetical protein 2-Bacillus megaterium
% Match = 9.5
% Identity = 28.2   % Similarity = 60.1
Matches = 53   Mismatches = 68   Conservative Sub.s = 60

66        96       126       156       186       216       246       276
SFFIEFTHPFLIICNIHYSLRFKYIVAILLY**KFER*LIGKVRIWYFF*FVNSHI*T*KVSAYFKHFLNILNHNV*RFI 306       336       366       396       426       456       486       516
SLLK*GYVVNKKSFFQCVILLVSFLVLTLAVKSQSDMISYLDNITSAFFQSIRNPDLTNLMTIISTVVSPLTTSLIALVI
                 :|   |:  |:  |  :  :  |  :: : :::   ::   |   :| ||:|   :  |  :  ::|||
      MKLKQQLTIAFIISVLSLIGFSFMAFTI-SANEYLKFDEDV-ISLVQGWESPLLTDIMKFFTYIGSTASLIILSLVI
             10        20        30        40        50        60        70
```

```
543       570        600        630         657       687         714        744
LGYQY-FLNQRIAVWLFM-LFFGTNALALLLKDIIARHRP-MNQLVFDSGYSFPSGHTISAFLLM-ILVLVVARQRLRRV
 | :  |   | :|: :|  ||   :  |:   | ||::|     | ||  :::|:    ||||||||  ::|| |  ||  ::: |:  :
LFFLYRILKHRLELVLFTAVMVGSPLLNLMVKLFFQRARPDLHRLIDIGGYSFPSGHAMNAFSLYGILTFLLWRH-ITAR
            90        100        110        120         130        140        150
 774       804        834        864        894         924        954        984
LSQVVFVIFALVILASVIFSRLYLENHFLTDILGSLLLGASSYYGLSAIVSLKELQ*K**LPMNYKRAFLKGSFIIHYFS
 ::::::|::::: |:  ||:||  |: :||:       ||
WARILLILFSMLMILSIGISRIYLGVHYPSDIIAGYLAGGCWIAISIWFFQRYQDRRKNKDR
            174      180        190        200        210
```

Based on this analysis, it was predicted that these proteins and their epitopes could be useful antigens for vaccines or diagnostics.

EXAMPLE 598

A DNA sequence (GBSx0638) was identified in *S. agalactiae* <SEQ ID 1853> which encodes the amino acid sequence <SEQ ID 1854>. Analysis of this protein sequence reveals the following:

```
Possible Site: 41

>>> Seems to have no N-terminal signal sequence

----- Final Results -----
           bacterial cytoplasm --- Certainty = 0.4288(Affirmative) < succ>
           bacterial membrane  --- Certainty = 0.0000(Not Clear)   < succ>
           bacterial outside   --- Certainty = 0.0000(Not Clear)   < succ>
```

The protein has homology with the following sequences in the GENPEPT database:

```
>GP:CAB15470 GB:Z99121 yvdC [Bacillus subtilis]
 Identities = 53/96 (55%), Positives = 70/96 (72%)

Query:   1 MDITDYQKWVSEFYKKRNWYQYNSFIRSNFLSEEVGELAQAIRKYEIGRDRPDETEQTDL   60
           M + D +KW+ EFY+KR W +Y  FIR  FL EE GELA+A+R YEIGRDRPDE E +
Sbjct:   1 MQLADAEKWMKEFYEKRGWTEYGPFIRVGFLMEEAGELARAVRAYEIGRDRPDEKESSRA  60

Query:  61 ENLNDIKEELGDVLDNIFILADQYNISLEEIISAHR                          96
           E    ++ EE+GDV+ NI ILAD Y +SLE+++ AH+
Sbjct:  61 EQKQELIEEMGDVIGNIAILADMYGVSLEDVMKAHQ                          96
```

No corresponding DNA sequence was identified in *S. pyogenes*.

Based on this analysis, it was predicted that this protein and its epitopes, could be useful antigens for vaccines or diagnostics.

EXAMPLE 599

A DNA sequence (GBSx0639) was identified in *S. agalactiae* <SEQ ID 1855> which encodes the amino acid sequence <SEQ ID 1856>. Analysis of this protein sequence reveals the following:

```
Possible Site: 54

>>> Seems to have no N-terminal signal sequence

----- Final Results -----
           bacterial cytoplasm --- Certainty = 0.0635(Affirmative) < succ>
           bacterial membrane  --- Certainty = 0.0000(Not Clear)   < succ>
           bacterial outside   --- Certainty = 0.0000(Not Clear)   < succ>
```

The protein has homology with the following sequences in the GENPEPT database:

```
>GP:BAB06803 GB:AP001517 unknown conserved protein [Bacillus halodurans]
 Identities = 83/186 (44%), Positives = 117/186 (62%)

Query:    1 MRITIFCGASTGENPVYSEKTVALAQWMAQNKHSLVYGGGKVGLMGVMADTVIANGGYTT    60
            M+I +FCG+S G + VY E     L + +A+    +LVYGG  VG+MG +AD+V+  GG
Sbjct:    1 MKIAVFCGSSNGASDVYKEGARQLGKELARRGITLVYGGASVGIMGAVADSVLEAGGEVI   60

Query:   61 GVIPTFLRDREIAHENLSELIIVNNMPERKAKMMLLGDAFIALPGGPGTLEEISEVISWS  120
            GV+P  FL + EI+H +L++LI+V  M ERKAKM   L D F+ALPGGPGTLEE   E+ +W+
Sbjct:   61 GVMPRFLEEPEISHPHLTKLIVVETMHERKAKMAELADGFLALPGGPGTLEEFFEIFTWA  120

Query:  121 RIGQNDNPCILYNVNGYFNDLKNMFDHMVGEGFLSLEDRENVLFSDDITEIEDFITNYKV  180
            +IG +   PC L N+N YF+ L +   HM E FL  + R    L    D  + D  + Y+
Sbjct:  121 QIGLHQKPCGLLNINHYFDPLVTLLHHMSNEQFLHEKYRSMALVHTDPILLLDQFSTYEP  180

Query:  181 PSTRQY                                                       186
            P+ + Y
Sbjct:  181 PTVKAY                                                       186
```

No corresponding DNA sequence was identified in *S. pyogenes*.

Based on this analysis, it was predicted that this protein and its epitopes, could be useful antigens for vaccines or diagnostics.

EXAMPLE 600

A DNA sequence (GBSx0640) was identified in *S. agalactiae* <SEQ ID 1857> which encodes the amino acid sequence <SEQ ID 1858>. Analysis of this protein sequence reveals the following:

```
Possible site: 19
>>> Seems to have a cleavable N-term signal seq.
   INTEGRAL Likelihood = -7.86 Transmembrane 222-238 (214-239)
   INTEGRAL Likelihood = -6.69 Transmembrane 39-55 (36-58)
   INTEGRAL Likelihood = -4.25 Transmembrane 266-282 (266-284)
   INTEGRAL Likelihood = -1.28 Transmembrane 166-182 (166-182)
   INTEGRAL Likelihood = -1.01 Transmembrane 190-206 (190-206)
   INTEGRAL Likelihood = -0.96 Transmembrane 70-86 (70-86)

----- Final Results -----
               bacterial membrane --- Certainty = 0.4142(Affirmative) < succ>
                bacterial outside --- Certainty = 0.0000(Not Clear) < succ>
              bacterial cytoplasm --- Certainty = 0.0000(Not Clear) < succ>
```

The protein has homology with the following sequences in the GENPEPT database:

```
>GP: CAB12420 GB: Z99107 ydiL [Bacillus subtilis]
Identities = 40/132 (30%), Positives = 63/132 (47%), Gaps = 8/132 (6%)
Query: 107 ESQNYDATFNI-----LMISYSVVVGPFFEEVLYRGIVLNLL-SKYGKWFAIITSGILFG  160
           ES+N  A  ++     LMI  S +VGP  EE+++R I+   L  K   +FA + S ++FG
Sbjct: 114 ESENTQAILDVIQAVPLMIIVSSIVGPILEEIIFRKIIFGALYEKTNFFFAGLISSVIFG  173

Query: 161 LMHQDISQLLTTSIAGIIMGFI-AYHYSFKVALLLHICNNFIVEIFTQLSTVNELYGTYF  219
           ++H D+  LL  +  G     F+ A      V +  H+  N  V +  QL  V
Sbjct: 174 IVHADLKHLLLYTAMGFTFAFLYARTKRIWVPIFAHLMMNTFV-VIMQLEPVRNYLEQQS  232

Query: 220 ENILLILAILFI                                                 231
             + LI+  LF
Sbjct: 233 TQMQLIIGGLFL                                                 244
```

No corresponding DNA sequence was identified in *S. pyogenes*.

A related GBS gene <SEQ ID 8613> and protein <SEQ ID 8614> were also identified. Analysis of this protein sequence reveals the following:

```
Lipop: Possible site: -1 Crend: 6
McG: Discrim Score: 12.52
GvH: Signal Score (-7.5): -1.74
```

```
                                  -continued
       Possible site: 19
>>> Seems to have a cleavable N-term signal seq.
ALOM program count: 2 value: -6.69 threshold: 0.0
    INTEGRAL Likelihood = -6.69 Transmembrane 39-55 ( 36-58)
    INTEGRAL Likelihood = -0.96 Transmembrane 70-86 ( 70-86)
    PERIPHERAL Likelihood = 4.56 21
 modified ALOM score: 1.84
***Reasoning Step: 3

----- Final Results -----
              bacterial membrane --- Certainty = 0.3675(Affirmative) < succ>
               bacterial outside --- Certainty = 0.0000(Not Clear) < succ>
             bacterial cytoplasm --- Certainty = 0.0000(Not Clear) < succ>
```

The protein has homology with the following sequences in the databases:

```
Query:   10 LIGLILLAQAIVLSLATTLFAEILQNDVWIGIASTLIALLIPCF   53
            L+ L LL ++++LS++       +L   +W+ +A+ L+A ++ CF
Sbjct:   21 LLCLCLLVRSLLLSVSLYSALILLVLILWVTVATPLLAFVVSCF   64
```

Based on this analysis, it was predicted that these proteins and their epitopes could be useful antigens for vaccines or diagnostics.

EXAMPLE 601

A DNA sequence (GBSx0641) was identified in *S. agalactiae* <SEQ ID 1859> which encodes the amino acid sequence <SEQ ID 1860>. This protein is predicted to be capa protein. Analysis of this protein sequence reveals the following:

```
Possible site: 50
>>> Seems to have no N-terminal signal sequence
   INTEGRAL Likelihood = -13.80 Transmembrane 27-43 ( 22-50)

----- Final Results -----
              bacterial membrane --- Certainty = 0.6519(Affirmative) < succ>
               bacterial outside --- Certainty = 0.0000(Not Clear) < succ>
             bacterial cytoplasm --- Certainty = 0.0000(Not Clear) < succ>
```

A related GBS nucleic acid sequence <SEQ ID 9385> which encodes amino acid sequence <SEQ ID 9386> was also identified.

The protein has homology with the following sequences in the GENPEPT database:

```
>GP: AAF13661 GB: AF188935 pXO2-56 [Bacillus anthracis]
 Identities = 68/224 (30%), Positives = 118/224 (52%), Gaps = 10/224 (4%)

Query:  95 FKEVKSWIESADLAIGDYEGTISSE----YPLAGYPL-FNAPNEIATTMKETGYDVVDLA  149
           F+ V  +++++D  G++E  + E    Y A  + +A  E    +KE G+ V++LA
Sbjct:  87 FRHVSPYLKNSDYVSGNFEHPVLLEDKKNYQKADKNIHLSAKEETVKAVKEAGFTVLNLA  146

Query: 150 HNHILDSQLAGAINTVKTFNRLGLKTIGVYLKDRNKEDILIKHVNGIKIAILGYSYGY-N  208
           +NH+ D   G  +Y+K F   LD +G      ++ ++I+ ++VNG+++A  G++  +
Sbjct: 147 NNHMTDYGAKGTKDTIKAFKEADLDYVGAGENFKDVKNIVYQNVNGVRVATLGFTDAFVA  206

Query: 209 GMEANVSKSDYEKHMSDLDTKKIKQDIKKAEKEADITIVMPQMGIEYQKKPTTEQVMLYH  268
             G  A +       D+ K+I +       + AD+ +V    G EY    KP+   Q  L
Sbjct: 207 GAIATKEQPGSLSMNPDVLLKQISKAKDPKKGNADLVVVNTHWGEEYDNKPSPRQEALAK  266

Query: 269 SMIKWGADIIFGGHPHVVEPSEVIKKDGQKKFIIYSMGNFISNQ                 312
           +M+   GADII G HPHV++  +V  K+      I YS+GNF+ +Q
Sbjct: 267 AMVDAGADIIVGHHPHVLQSFDVYKQG----IIFYSLGNFVGDQ                 306
```

A related DNA sequence was identified in *S. pyogenes* <SEQ ID 1861> which encodes the amino acid sequence <SEQ ID 1862>. Analysis of this protein sequence reveals the following:

```
Possible site: 45
>>> Seems to have no N-terminal signal sequence
    INTEGRAL Likelihood = -12.05 Transmembrane 44-60 ( 40-68)

----- Final Results -----
                bacterial membrane --- Certainty = 0.5819(Affirmative)
< succ>
                 bacterial outside --- Certainty = 0.0000(Not Clear) < succ>
                bacterial cytoplasm --- Certainty = 0.0000(Not Clear) < succ>
```

A related sequence was also identified in GAS <SEQ ID 9119> which encodes the amino acid sequence <SEQ ID 9120>. Analysis of this protein sequence reveals the following:

```
Possible cleavage site: 31
>>> Seems to have no N-terminal signal sequence

----- Final Results -----
                bacterial membrane --- Certainty = 0.582(Affirmative) < succ>
                 bacterial outside --- Certainty = 0.000(Not Clear) < succ>
                bacterial cytoplasm --- Certainty = 0.000(Not Clear) < succ>
```

An alignment of the GAS and GBS proteins is shown below:

```
Identities = 232/334 (69%), Positives = 273/334 (81%), Gaps = 4/334 (1%)
Query:  24 YQKTLIFCVAVIIAIFILGLSKDLAQSKGQKVANNNT----VKTARVVANGDILLHDVLY   79
           Y+KT+   VA+I+A+ + GL  DL   + ++A  +     VKTARVVANGDIL+HD+LY
Sbjct:  40 YKKTMATVVALIVALLLFGLIYDLLGVQKNELAAQKSAQPKVKTARVVANGDILIHDILY   99

Query:  80 ASARQPDGTYNFTPYFKEVKSWIESADLAIGDYEGTISSEYPLAGYPLFNAPNEIATTMK  139
           +SAR+ D TY+FTPYF+ VK WI  ADLAIGDYEGTIS +YPLAGYPLFNAP EIA  +K
Sbjct: 100 MSARKADDTYDFTPYFEYVKDWISGADLAIGDYEGTISPDYPLAGYPLFNAPEEIAGALK  159

Query: 140 ETGYDVVDLAHNHILDSQLAGAINTVKTFNRLGLDTIGVYLKDRNKEDILIKHVNGIKIA  199
            TGYDVVDLAHNHILDSQL GA+NT K F++LG+D+IG+Y KDR+KE  LIK+VNGIKIA
Sbjct: 160 NTGYDVVDLAHNHILDSQLDGALNTKKVFHQLGIDSIGIYDKDRSKEDFLIKNVNGIKIA  219

Query: 200 ILGYSYGYNGMEANVSKSDYEKHMSDLDTKKIKQDIKKAEKEADITIVMPQMGIEYQKKP  259
           ILGYSYGYNGMEA +S+ DYEKHMSDLD  KIK++++  AEK+AD+TIVMPQMG EY  +P
Sbjct: 220 ILGYSYGYNGMEATLSQEDYEKHMSDLDEAKIKKELQLAEKKADVITVMPQMGTEYALEP  279

Query: 260 TTEQVMLYHSMIKWGADIIFGGHPHVVEPSEVIKKDGQKKFIIYSMGNFISNQRLETVDD  319
           T EQ  LYH MI WGAD++ GGHPHV+EPSE + K  QKKFIIYSMGNFISNQRLETVDD
Sbjct: 280 TAEQKELYHKMIDWGADVVLGGHPHVIEPSETVIKGRQKKFIIYSMGNFISNQRLETVDD  339

Query: 320 IWTERGLLMDVTIEKKGQKTVIKKVKAHPTLVEA                           353
           IWTERGLLMD+T EKK  KT IK V+AHPT+V A
Sbjct: 340 IWTERGLLMDLTFEKKDNKTKIKTVEAHPTMVLA                           373
```

A related GBS gene <SEQ ID 8615> and protein <SEQ ID 8616> were also identified. Analysis of this protein sequence reveals the following:

```
Lipop Possible site: -1 Crend: 7
SRCFLG: 0
McG: Length of UR: 18
    Peak Value of UR: 3.83
    Net Charge of CR: 2
McG: Discrim Score: 15.36
GvH: Signal Score (-7.5): -1.52
    Possible site: 32
>>> Seems to have a cleavable N-term signal seq.
Amino Acid Composition: calculated from 33
ALOM program count: 0 value: 4.35 threshold: 0.0
  PERIPHERAL Likelihood = 4.35 170
 modified ALOM score: -1.37
*** Reasoning Step: 3
Rule gpo1

----- Final Results -----
                 bacterial outside --- Certainty = 0.3000(Affirmative) < succ>
```

```
                              -continued
            bacterial membrane --- Certainty = 0.0000(Not Clear) < succ>
            bacterial cytoplasm --- Certainty = 0.0000(Not Clear) < succ>
```

The protein has homology with the following sequences in the databases:

```
30.6/53.3% over 230aa
Bacillus anthracis
EGAD|20151| capa protein Insert characterized
SP|P19579|CAPA_BACAN CAPA PROTEIN. Edit characterized
GP|142633|gb|AAA22288.1||M24150 46 Kd encapsulation protein CapA Insert
characterized
PIR|C30091|C30091 capA protein - Insert characterized
ORF02075(574-1257 of 1734)
EGAD|20151|20674(83-313 of 411) capa protein {Bacillus anthracis}
SP|P19579|CAPA_BACAN CAPA PROTEIN. GP|142633|gb|AAA22288.1||M24150 46 Kd
encapsulation protein CapA {Bacillus anthracis} PIR|C30091|C30091 capA protein -
Bacillus anthracis
% Match = 8.9
% Identity = 30.6  % Similarity = 53.3
Matches = 70  Mismatches = 102  Conservative Sub.s = 52
   468       498       528       558       585       615       645       663
LAQSKGQKVANNNTVKTARVVANGDILLHDVLYASARQPDGTYNFTPY-FKEVKSWIESADLAIGDYEGTI----SSEYP
  :|  : |:    ||         ::  |::       :         |||  |:   :::::|   |::|   :       |
IAATWVQRTEAVAPVKHRENEKLTMTMVGDIMMGRHVKEIVNRYGTDYVFRHVSPYLKNSDYVSGNFEHPVLLEDKKNYQ
           50        60        70        80        90       100       110
   690       720       750       780       810       840       870       900
LAGYPL-FNAPNEIATTMKETGYDVVDLAHNHILDSQLAGAINTVKTFNRLGLDTIGVYLKDRNKEDILIKHVNGIKIAI
  |  : ::|   |     :|| |: |::||:|  |     |  :|::|     |||  :|  :      ::  :|: |||::|
KADKNIHLSAKEETVKAVKEAGFTVLNLANNHMTDYGAKGTKDTIKAFKEADLDYVGAGENFKDVKNIVYQNVNGVRVAT
          130       140       150       160       170       180       190
   927       957       987      1017      1047      1077      1107      1137
LGYSYGY-NGMEANVSKSDYEKHMSDLDTKKIKQDIKKAEKEADITIVMPQMGIEYQKKPTTEQVMLYHSMIKWGADIIF
 ||::   :  | |  |     :      |:|:     :  | ||     ||: ||:  |    :|:  ::|: :|||||
LGFTDAFVAGAIATKEQPGSLSMNPDVLLKQISKAKDPKKGNADLVVVNTHWGEEYDNKPSPRQEALAKAMVDAGADIIV
          210       220       230       240       250       260       270
  1167      1197      1227      1257      1287      1317      1347      1377
GGHPHVVEPSEVIKKDGQKKFIIYSMGNFISNQRLETVDDIWTERGLLMDVTIEKKGQKTVIKKVKAHPTLVEAKPNGRY
| ||||::   :||     :    |  ||:|||: :|      |   :   ||      :     :   :   |       |
GHHPHVLQSFDVYK----QGIIFYSLGNFVFDQGWTRTKDSALVQYHLRDNGTAILDVVPLNIQEGSPKPVASALDKNRV
          290       300       310       320       330       340       350
```

SEQ ID 8616 (GBS289) was expressed in *E. coli* as a His-fusion product. SDS-PAGE analysis of total cell extract is shown in FIG. 57 (lane 5; MW 40 kDa), in FIG. 181 (lane 6; MW 47 kDa), in FIG. 169 (lane 13 & 14; MW 54.5 kDa—thioredoxin fusion) and in FIG. 239 (lane 3; MW 54.5 kDa). It was also expressed in *E. coli* as a GST-fusion product. SDS-PAGE analysis of total cell extract is shown in FIG. 61 (lane 5; MW 65 kDa).

Figure 126:
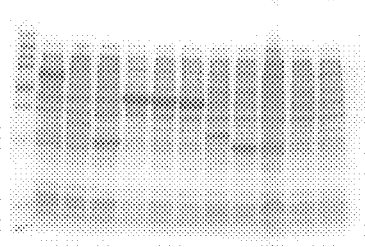

SEQ ID 8616 (GBS289L) was expressed in *E. coli* as a GST-fusion product. SDS-PAGE analysis of total cell extract is shown in FIG. 126 (lane 2; MW 72 kDa) and in FIG. 184 (lane 5; MW 72 kDa). It was also expressed in *E. coli* as a His-fusion product. SDS-PAGE analysis of total cell extract is shown in FIG. 126 (lane 5-7; MW 47 kDa).

GBS289L-His was purified as shown in FIG. 234, lane 9-10. Purified GBS289L-GST is shown in FIG. 245, lane 10.

Based on this analysis, it was predicted that these proteins and their epitopes could be useful antigens for vaccines or diagnostics.

EXAMPLE 602

A DNA sequence (GBSx0642) was identified in *S. agalactiae* <SEQ ID 1863> which encodes the amino acid sequence <SEQ ID 1864>. This protein is predicted to be thiamin biosynthesis protein ThiI (thiI). Analysis of this protein sequence reveals the following:

```
Possible site: 55

>>> Seems to have no N-terminal signal sequence

----- Final Results ----- bacterial cytoplasm --- Certainty = 0.2720(Affirmative) < succ>
            bacterial membrane  --- Certainty = 0.0000(Not Clear)   < succ>
            bacterial outside   --- Certainty = 0.0000(Not Clear)   < succ>
```

A related GBS nucleic acid sequence <SEQ ID 9971> which encodes amino acid sequence <SEQ ID 9972> was also identified.

The protein has homology with the following sequences in the GENPEPT database:

```
>GP: AAC00308 GB: AF008220 YtbJ [Bacillus subtilis] Identities 184/354
(51%), Positives = 249/354 (69%)
Query:  11 MQYSEIMIRYGELSTKKKNRMRFINKLKNNMEHVLSIYPDVSVKTDRDRGHVYLNGTDYH   70
           M Y  I+IR+GE+STK KNR  FI +LK N+  VL  YP++   ++RDR  + LNG D
Sbjct:   1 MNYDHILIRFGEISTKGKNRKSFIERLKQNIRLVLKDYPNLKYFSNRDRMTITLNGEDPE   60

Query:  71 EVAESLKEIFGIQAFSPSFKVEKNVDTLVKAVQEIMTSVYKDGMTFKITAKRSDHSFELD  130
              +   LK++FGIQ+FS + K +  +D +      + +   YK G TFK+  KR+    FELD
Sbjct:  61 ALFPHLKQVFGIQSFSLAIKCDSRLDDIKATALKAIKDQYKPGDTFKVATKRAYKQFELD  120

Query: 131 SRALNHTLGDAVFSVLPNIKAQMKQPDINLKVEIRDEAAYISYEDIRGAGGLPVGTSGKG  190
             + +N  +G +      +   ++ PDI L++EIR+EA +++  D +GAGGLPVG++GK
Sbjct: 121 TNQMNAEIGGHILRNTEGLTVDVRNPDIPLRIEIREEATFLTIRDEKGAGGLPVGSAGKA  180

Query: 191 MLMLSGGIDSPVAGYLALKRGVDIEAVHFASPPYTSPGALKKAHDLTRKLTKFGGNIQFI  250
           MLMLSGG DSPVAG+ A+KRG+ +EAVHF SPPYTS  A +K  DL + L++FGG++
Sbjct: 181 MLMLSGGFDSPVAGFYAMKRGLSVEAVHFFSPPYTSERAKQKVMDLAKCLSRFGGSMTLH  240

Query: 251 EVPFTEIQEEIKAKAPEAYLMTLTRRFMMRITDRIREDRNGLVIINGESLGQVASQTLES  310
               VPFT+ QE I+ +  PE Y MT TRR M++I DRIRE RNGL II GESLGQVASQTLES
Sbjct: 241 IVPFTKTQELIQKQIPENYTMTATRRLMLQIADRIREKRNGLAIITGESLGQVASQTLES  300

Query: 311 MQAINAVTATPIIRPVVTMDKLEIIDIAQKIDTFDISIQPFEDCCTIFAPDRPK        364
           M AINAVT+TPI+RP++ MDK EII+ +++I T++ SIQPFEDCCTIF   +P+
Sbjct: 301 MYAINAVTSTPILRPLIAMDKTEIIEKSREIGTYETSIQPFEDCCTIFTTAKPR        354
```

A related DNA sequence was identified in *S. pyogenes* <SEQ ID 1865> which encodes the amino acid sequence <SEQ ID 1866>. Analysis of this protein sequence reveals the following:

```
Possible site: 42
>>> Seems to have no N-terminal signal sequence

----- Final Results -----
        bacterial cytoplasm --- Certainty = 0.4897(Affirmative) <succ>
         bacterial membrane --- Certainty = 0.0000(Not Clear)  < succ>
          bacterial outside --- Certainty = 0.0000(Not Clear)  < succ>
```

An alignment of the GAS and GBS proteins is shown below:

```
Identities = 316/404 (78%), Positives = 362/404 (89%)
Query:  11 MQYSEIMIRYGELSTKKKNRMRFINKLKNNMEHVLSIYPDVSVKTDRDRGHVYLNGTDYH   70
           M YSEIM+R+GELSTK KNRMRFINKLKNN++ VL+ +P ++V++DRDR HV LNGTDY
Sbjct:   1 MDYSEIMVRHGELSTKGKNRMRFINKLKNNIQDVLAPFPAITVRSDRDRTHVSLNGTDYQ   60

Query:  71 EVAESLKEIFGQQAFSPSFKVEKNVDTLVKAVQEIMTSVYKDGMTFKITAKRSDHSFELD  130
            + E+LK +FG+QA SP +K+EK+V  LV AVQ+IMTS+Y+DG+TFKI  KRSDH+FELD
Sbjct:  61 PIVEALKLVFGVQALSPVYKLEKSVPLLVTAVQDIMTSLYRDGLTFKIATKRSDHAFELD  120

Query: 131 SRALNHTLGDAVFSVLPNIAKQMKQPDINLKVEIRDEAAYISYEDIRGAGGLPVGTSGKG  190
           SR LN  LG AVF VLPNI+AQMK PD+ LKVEIRDEAAYISYE+I+GAGGLPVGTSGKG
Sbjct: 121 SRELNSLLGGAVFEVLPNIQAQMKHPDVTLKVEIRDEAAYISYEEIKGAGGLPVGTSGKG  180

Query: 191 MLMLSGGIDSPVAGYLALKRGVDIEAVHFASPPYTSPGALKKAHDLTRKLTKFGGNIQFI  250
           MLMLSGGIDSPVAGYLALKRG+DIE VHFASPPYTSPGAL KA DLTR+LT+FGGNIQFI
Sbjct: 181 MLMLSGGIDSPVAGYLALKRGDLIEVVHFASPPYTSPGALAKAQDLTRRLTRFGGNIQFI  240

Query: 251 EVPFTEIQEEIKAKAPEAYLMTLTRRFMMRITDRIREDRNGLVIINGESLGQVASQTLES  310
           EVPFTEIQEEIK KAPEAYLMTLTRRFMMRITD IRE R GLVI+NGESLGQVASQTLES
Sbjct: 241 EVPFTEIQEEIKNKAPEAYLMTLTRRFMMRITDAIREQRKGLVIVNGESLGQVASQTLES  300

Query: 311 MQAINAVTATPIIRPVVTMDKLEIIDIAQKIDTFDISIQPFEDCCTIFAPDRPKTNPKIK  370
           MQAINAVT+TPIIRPVVTMDKLEII++AQ IDTFDISIQPFEDCCTIFAPDRPKTNPK+
Sbjct: 301 MQAINAVTSTPIIRPVVTMDKLEIIEMAQAIDTFDISIQPFEDCCTIFAPDRPKTNPKLG  360

Query: 371 NTEQYEKRMDVEGLVERAVAGIMVTTIQPQADSDDVDDLIDDLL                 414
           N E+YE+  D++GLV+RAV+GI+VT I P+  +D+V++LID LL
Sbjct: 361 NAEKYEECFDIDGLVQRAVSGIVVTEITPEIVNDEVENLIDALL                 404
```

Based on this analysis, it was predicted that these proteins and their epitopes could be useful antigens for vaccines or diagnostics.

EXAMPLE 603

A DNA sequence (GBSx0643) was identified in *S. agalactiae* <SEQ ID 1867> which encodes the amino acid sequence <SEQ ID 1868>. This protein is predicted to be nifs protein homolog, fragment. Analysis of this protein sequence reveals the following:

```
Possible site: 47
>>> Seems to have no N-terminal signal sequence
INTEGRAL Likelihood = -0.27 Transmembrane 131-147 (131-147)

----- Final Results -----
      bacterial membrane --- Certainty = 0.1107 (Affirmative) < succ>
       bacterial outside --- Certainty = 0.0000 (Not Clear)   < succ>
      bacterial cytoplasm --- Certainty = 0.0000 (Not Clear)  < succ>
```

The protein has homology with the following sequences in the GENPEPT database:

```
>GP: CAA43493 GB: X61190 nifS-like gene [Lactobacillus delbrueckii]
Identities = 177/353 (50%), Positives = 234/353 (66%), Gaps = 1/353 (0%)

Query:  14 PEVLRTYQEVASKIYGNPSSLHELGTTSSRILEASRKQIASLLELKANEIFFTSGGTEAD   73
           P+ L TY +V +KI+GNPSSLH+LG  +  +LEASRKQ+A LL +  +EI+FTSGGTE++
Sbjct:   3 PKALETYSQVVTKIWGNPSSLHKLGDRAHGLLEASRKQVADLLGVNTDEIYFTSGGTESN   62

Query:  74 NWVIKGLAFEKQHFGNHIIVSDIEHPAVKESAKWLGEYGFEIDYAPVDDKGFVDVEALVK  133
           N   IKG A+ K+ FG HII S +EH +V +    L   GF +    PVD +G V+ E L
Sbjct:  63 NTAIKGTAWAKREFGKHIITSSVEHASVANTFTELENLGFRVTRLPVDKEGRVNPEDLKA  122

Query: 134 LIKPETILISIMAINNEIGSIQPIKAISDLLSDKPTISFHVDAVQAIGKIPTKDYLTERV  193
             +  +T L+SIM +NNEIG+IQPIK IS++L+D P I FHVD VQA+GK       T RV
Sbjct: 123 ALDKDTTLVSIMGVNNEIGTIQPIKEISEILADYPNIHFHVDNVQALGKGIWDQVFTSRV  182

Query: 194 DFASFSSHKFHGVRGVGFLYIKEGKRISPLLTGGGQETDLRSTTENVAGIAATAKALRMV  253
           D   SFSSHKFHG RG+G LY K G+ + PL  GGGQE   LRS TEN+A IAA AKA R++
Sbjct: 183 DMMSFSSHKFHGPRGIGILYKKRGRMLMPLCEGGGQEKGLRSGTENLAAIAAMAKAARLL  242

Query: 254 MDKEVVAIPKISKMKTIIHDELAKYEDITLFSG-KEDFSPNIITFGIKGVRGEVLVHAFE  312
             +  E  +  +K I    LA      I +FS  K DF+P+I+ F ++G+RGE LVH  E
Sbjct: 243 LTDEKEKADREYAIKEKISKYLAGKPGIHIFSPLKADFAPHILCFALEGIRGETLVHTLE  302

Query: 313 GHDIFISTTSACSSKAGKPAGTLIAMGISTKLAQTAVRISLDDDNDMGQVEQF         365
              DI+ISTTSAC+SK     A  TL+AM     +A +AVR+S D+ N +  ++F
Sbjct: 303 DQDIYISTTSACASKKADEASTLVAMKTPDAIATSAVRLSFDESNTLEEADEF         355
```

A related DNA sequence was identified in *S. pyogenes* <SEQ ID 1869> which encodes the amino acid sequence <SEQ ID 1870>. Analysis of this protein sequence reveals the following:

```
Possible site: 41
>>> Seems to have no N-terminal signal sequence

----- Final Results -----
      bacterial cytoplasm --- Certainty = 0.3067 (Affirmative) < succ>
       bacterial membrane --- Certainty = 0.0000 (Not Clear)   < succ>
        bacterial outside --- Certainty = 0.0000 (Not Clear)   < succ>
```

An alignment of the GAS and GBS proteins is shown below:

```
Identities = 268/370 (72%), Positives = 322/370 (86%)

Query:   1 MIYFDNSATTIPYPEVLRTYQEVASKIYGNPSSLHELGTTSSRILEASRKQIASLLELKA   60
           MIYFDN+ATTIPY E L+TYQEVA+KIYGNPSSLH+LGT +SRILEASRKQIA LL +K+
```

```
                            -continued
Sbjct:   1 MIYFDNAATTIPYGEALKTYQEVATKIYGNPSSLHQLGTNASRILEASRKQIAGLLGVKS    60

Query:  61 NEIFFTSGGTEADNWVIKGLAFEKQHFGNHIIVSDIEHPAVKESAKWLGEYGFEIDYAPV   120
           EIFFTSGGTE+ NW IKG+AFEK  FG HII+S IEHPAV ES KWL   GFE+ YAPV
Sbjct:  61 EEIFFTSGGTESANWAIKGIAFEKNAFGKHIIISAIEHPAVSESVKWLLTQGFEVSYAPV   120

Query: 121 DDKGFVDVEALVKLIKPETILISIMAINNEIGSIQPIKAISDLLSDKPTISFHVDAVQAI   180
              +G VDV AL +LI+P+TILISIMA+NNE+G+IQPI+AIS+LL+++PTI+FHVDAVQAI
Sbjct: 121 TTQGVVDVNALAELIRPDTILISIMAVNNEMGAIQPIRAISNLLANQPTITFHVDAVQAI   180

Query: 181 GKIPTKDYLTERVDFASFSSHKFHGVRGVGFLYIKEGKRISPLLTGGGQETDLRSTTENV   240
           GKIP  DY+T RVD ASFS HKFH VRGVGFLY K GKR++PLL+GGGQE +LRSTTENV
Sbjct: 181 GKIPLCDYMTNRVDLASFSGHKFHSVRGVGFLYKKAGKRLNPLLSGGGQEQELRSTTENV   240

Query: 241 AGIAATAKALRMVMDKEVVAIPKISKMKTIIHDELAKYEDITLFSGKEDFSPNIITFGIK   300
           AGIA+ AKALR+V +K+V  +PK++ M+ +I+   L+ Y D+T+FS +E F+PNI+TFGI+
Sbjct: 241 AGIASMAKALRIVTEKQVSVLPKLTAMRDVIYKSLSAYPDVTVFSAQEGFAPNILTFGIR   300

Query: 301 GVRGEVLVHAFEGHDIFISTTSACSSKAGKPAGTLIAMGISTKLAQTAVRISLDDDNDMG   360
           GVRGEV+VHAFE ++I+ISTTSACSSKAG+PAG+L+AMGI   K AQTAVRISLDDDNDMG
Sbjct: 301 GVRGEVIVHAFEKYEIYISTTSACSSKAGEPAGSLVAMGIPVKTAQTAVRISLDDDNDMG   360

Query: 361 QVEQFLTIFK                                                    370
           QVEQFLTIF+
Sbjct: 361 QVEQFLTIFQ                                                    370
```

Based on this analysis, it was predicted that these proteins and their epitopes could be useful antigens for vaccines or diagnostics.

EXAMPLE 604

A DNA sequence (GBSx0644) was identified in *S. agalactiae* <SEQ ID 1871> which encodes the amino acid sequence <SEQ ID 1872>. Analysis of this protein sequence reveals the following:

```
Possible site: 29
>>> Seems to have no N-terminal signal sequence

----- Final Results -----
      bacterial cytoplasm --- Certainty = 0.1539 (Affirmative) < succ>
       bacterial membrane --- Certainty = 0.0000 (Not Clear)   < succ>
        bacterial outside --- Certainty = 0.0000 (Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 605

A DNA sequence (GBSx0645) was identified in *S. agalactiae* <SEQ ID 1873> which encodes the amino acid sequence <SEQ ID 1874>. This protein is predicted to be glutathione reductase (gor). Analysis of this protein sequence reveals the following:

```
Possible site: 23
>>> Seems to have no N-terminal signal sequence
INTEGRAL Likelihood = -4.25 Transmembrane 170-186 (169-187)

----- Final Results -----
         bacterial membrane --- Certainty = 0.2699 (Affirmative) < succ>
          bacterial outside --- Certainty = 0.0000 (Not Clear)   < succ>
        bacterial cytoplasm --- Certainty = 0.0000 (Not Clear)   < succ>
```

The protein has homology with the following sequences in the GENPEPT database:

```
>GP: BAA76640 GB: AB019579 glutathione reductase (GR) [Streptococcus
mutans]
Identities = 274/450 (60%), Positives = 346/450 (76%), Gaps = 1/450 (0%)

Query:   1 MSKQYDYIVIGGGSAGSGTANRAAMYGAKVLLIEGGQVGGTCVNLGCVPKKIMWYGAQVS    60
           M+KQYDYIVIGGGS G  +ANRAAM+GAKV+L EG QVGGTCVN+GCVPKK+MWYGAQV+
```

```
                        -continued
Sbjct:    1 MTKQYDYIVIGGGSGGIASANRAAMHGAKVILFEGKQVGGTCVNVGCVPKKVMWYGAQVA    60

Query:   61 ETLHKYSSGYGFEVNNLNFDFTTLKANRDAYVQRSRQSYAANFERNGVEKIDGFARFIDN   120
            ET++ Y++ YGF+V    F F  LK NR AY+ R  SY   F+ NGVE++  +A F+D
Sbjct:   61 ETINNYAADYGFDVTTQTFHFDALKQNRQAYIDRIQDSYERGFDSNGVERVYSYATFVDA   120

Query:  121 HTIEVNGQQYKAPHITIATGGHPLYPDIIGSELGETSDDFFGWETLPDSILIVGAGYIAA   180
            HT+EV G+ Y APHI IATGGH L PDI GSE G TSD FF  + +P    +VGAGYIA
Sbjct:  121 HTVEVAGEHYTAPHILIATGGHALLPDIPGSEYGITSDGFFELDAIPKRTAVVGAGYIAV   180

Query:  181 ELAGVVNELGVETHLAFRKDHILRGFDDMVTSEVMAEMEKSGISLHANHVPKSLKRDEGG   240
            E++GV++ LG ETHL  R+D  LR FD  +   ++ EM+K G  LH   VPK + ++
Sbjct:  181 EISGVLHALGGETHLFVRRDRPLRKFDKEIVGTLVDEMKKDGPHLHTFSVPKEVIKNTDN   240

Query:  241 KLIFEAENGKTLVVDRVIWAIGRGPNV-DMGLENTDIVLNDKGYIKADEFENTSVDGVYA   299
              L    ENG+   VD +IWAIGR  N    LE T + L+ +G+I  D FENT+V G+YA
Sbjct:  241 SLTLILENGEEYTVDTLIWAIGRAANTKGFNLEVTGVTLDSRGFIATDAFENTNVEGLYA   300

Query:  300 IGDVNGKIALTPVAIAAGRRLSERLFNHKDNEKLDYHNVPSVIFTHPVIGTVGLSEAAAI   359
            +GDVNGK+ LTPVA+ AGR+LSERLFNHK   K+DY +V +VIF+HPVIG++GLSE  A+
Sbjct:  301 LGDVNGKLELTPVAVKAGRQLSERLFNHKPQAKMDYKDVATVIFSHPVIGSIGLSEEVAL   360

Query:  360 EQFGEDNIKVYTSTFTSMYTAVTTNRQAVKMKLITLGKEEKVIGLHGVGYGIDEMIQGFS   419
            +Q+GE+N+ VY STFTSMYTAVT++RQA KMKL+T+G++EK++GLHG+GYG+DEMIQGF+
Sbjct:  361 DQYGEENVTVYRSTFTSMYTAVTSHRQACKMKLVTVGEDEKIVGLHGIGYGVDEMIQGFA   420

Query:  420 VAIKMGATKADFDDTVAIHPTGSEEFVTMR                                 449
            VAIKMGATKADFD+TVAIHPTGSEEFVTMR
Sbjct:  421 VAIKMGATKADFDNTVAIHPTGSEEFVTMR                                 450
```

A related DNA sequence was identified in *S. pyogenes* <SEQ ID 1875> which encodes the amino acid sequence <SEQ ID 1876>. Analysis of this protein sequence reveals the following:

```
Possible site: 23
>>> Seems to have no N-terminal signal sequence
INTEGRAL Likelihood = -1.33 Transmembrane 173-189 (173-191)

----- Final Results -----
         bacterial membrane --- Certainty = 0.1532 (Affirmative) < succ>
         bacterial outside  --- Certainty = 0.0000 (Not Clear)  < succ>
        bacterial cytoplasm --- Certainty = 0.0000 (Not Clear)  < succ>
```

An alignment of the GAS and GBS proteins is shown below:

```
Identities = 268/446 (60%), Positives = 340/446 (76%), Gaps = 1/446 (0%)

Query:    5 YDYIVIGGGSAGSGTANRAAMYGAKVLLIEGGQVGGTCVNLGCVPKKIMWYGAQVSETLH    64
            YDYIVIGGGSAG  +ANRAAM+GAKVLL EG ++GGTCVNLGCVPKK+MWYGAQV++ L
Sbjct:    8 YDYIVIGGGSAGIASANRAAMHGAKVLLAEGKEIGGTCVNLGCVPKKVMWYGAQVADILG    67

Query:   65 KYSSGYGFEVNNLNFDFTTLKANRDAYVQRSRQSYAANFERNGVEKIDGFARFIDNHTIE   124
            Y+  YGF+    FDF  LKANR AY+ R   SY   FE+NGV++I  +A F D HT+E
Sbjct:   68 TYAKDYGFDFKEKAFDFKQLKANRQAYIDRIHASYERGFEQNGVDRIYDYAVFKDAHTVE   127

Query:  125 VNGQQYKAPHITIATGGHPLYPDIIGSELGETSDDFFGWETLPDSILIVGAGYIAAELAG   184
            + GQ Y APHI IATGGHP++PDI G++ G +SD FF   + +P    +VGAGYIA ELAG
Sbjct:  128 IAGQLYTAPHILIATGGHPVFPDIEGAQYGISSDGFFALDEVPKRTAVVGAGYIAVELAG   187

Query:  185 VVNELGVETHLAFRKDHILRGFDDMVTSEVMAEMEKSGISLHANHVPKSLKRDEGGKLIF   244
            V++ LG +T L  R D  LR FD  +   ++ EM  +G  LH   VPK + ++       L
Sbjct:  188 VLHALGSKTDLFIRHDRPLRSFDKTIVDVLVDEMAVNGPRLHTHAEVAKVVKNTDESLTL   247

Query:  245 EAENGKTLVVDRVIWAIGRGPNVD-MGLENTDIVLNDKGYIKADEFENTSVDGVYAIGDV   303
              ++G+ + VD++IWAIGR PN++   L+ T + LNDKGYI+ D +ENTSV G+YA GDV
Sbjct:  248 YLKDGQEVEVDQLIWAIGRKPNLEGFSLDKTGVTLNDKGYIETDAYENTSVKGIYAVGDV   307

Query:  304 NGKIALTPVAIAAGRRLSERLFNHKDNEKLDYHNVPSVIFTHPVIGTVGLSEAAAIEQFG   363
            NGK+ALTPVA+AAGRRLSERLFN K +EKLDY NV +VIF+HPVIG+VGLSE AA++Q+G
Sbjct:  308 NGKLALTPVAVAAGRRLSERLFNGKTDEKLDYQNVATVIFSHPVIGSVGLSEEAAVKQYG   367

Query:  364 EDNIKVYTSTFTSMYTAVTTNRQAVKMKLITLGKEEKVIGLHGVGYGIDEMIQGFSVAIK   423
            ++  +K Y S FTSM TA+T +RQ   MKL+T+G  EK++GLHG+GYG+DEMQGF+VAIK
Sbjct:  368 QEAVKTYQSRFTSMFTAITNHRQPCLMKLVTVGDTEKIVGLHGIGYGVDEMIQGFAVAIK   427
```

```
-continued
Query: 424 MGATKADFDDTVAIHPTGSEEFVTMR                              449
            MGATKADFD+TVAIHPTGSEEFVTMR
Sbjct: 428 MGATKADFDNTVAIHPTGSEEFVTMR                              453
```

SEQ ID 1874 (GBS417) was expressed in *E. coli* as a His-fusion product. SDS-PAGE analysis of total cell extract is shown in FIG. 79 (lane 5; MW 53 kDa).

GBS417-His was purified as shown in FIG. 216, lane 2.

Based on this analysis, it was predicted that these proteins and their epitopes could be useful antigens for vaccines or diagnostics.

EXAMPLE 606

A DNA sequence (GBSx0646) was identified in *S. agalactiae* <SEQ ID 1877> which encodes the amino acid sequence <SEQ ID 1878>. Analysis of this protein sequence reveals the following:

```
Possible site: 35
>>> Seems to have no N-terminal signal sequence

----- Final Results -----
        bacterial cytoplasm --- Certainty = 0.3122 (Affirmative) < succ>
         bacterial membrane --- Certainty = 0.0000 (Not Clear)   < succ>
          bacterial outside --- Certainty = 0.0000 (Not Clear)   < succ>
```

The protein has homology with the following sequences in the GENPEPT database:

```
>GP: AAC62417 GB: AF084104 hypothetical protein [Bacillus firmus]
Identities = 33/110 (30%), Positives = 66/110 (60%)

Query:   1 MANVYDLANELERAVRALPEYQAVLTAKSAIESDADAQVLWQDFLATQSKVQEMMQSGQM    60
           M+NVYD A+EL++A+      E+ A+ +    IE+D  A+ + ++F    Q ++Q+      G
Sbjct:   1 MSNVYDKAHELKKAIAESEEFSALKSMHEEIEADEIAKKMLENFRNLQLELQQKQMQGIQ    60

Query:  61 PSQEEQDEMSKLGEKIESNDLLKVYFDQQQRLSVYMSDIEKIVFAPMQDL              110
           ++EE  +  +  E ++ ++L+      + +QRLSV + DI KI+  P++++
Sbjct:  61 ITEEEAQKAQQQFELVQQHELISKLMEAEQRLSVIIGDINKIITEPLEEI              110
```

A related DNA sequence was identified in *S. pyogenes* <SEQ ID 1879> which encodes the amino acid sequence <SEQ ID 1880>. Analysis of this protein sequence reveals the following:

```
Possible site: 38
>>> Seems to have no N-terminal signal sequence

----- Final Results -----
        bacterial cytoplasm --- Certainty = 0.4058 (Affirmative) < succ>
         bacterial membrane --- Certainty = 0.0000 (Not Clear)   < succ>
          bacterial outside --- Certainty = 0.0000 (Not Clear)   < succ>
```

An alignment of the GAS and GBS proteins is shown below:

```
Identities = 68/108 (62%), Positives = 86/108 (78%)

Query:   4 VYDLANELERAVRALPEYQAVLTAKSAIESDADAQVLWQDFLATQSKVQEMMQSGQMPSQ    63
           +YD AN+LERAVRALPEYQ VL  K AI++D  A   L+ +F+A Q K+Q MMQSGQMP+
Sbjct:   5 IYDYANQLERAVRALPEYQKVLEVKEAIQADVSASELFDEFVAMQEKIQGMMQSGQMPTA    64

Query:  64 EEQDEMSKLGEKIESNDLLKVYFDQQQRLSVYMSDIEKIVFAPMQDLM               111
           EEQ  + +L +KIE+ND LK YF+ QQ LSVYMSDIE+IVFAP++DL+
Sbjct:  65 EEQTSIQELSQKIEANDQLKAYFEAQQALSVYMSDIERIVFAPLKDLV               112
```

Based on this analysis, it was predicted that these proteins and their epitopes could be useful antigens for vaccines or diagnostics.

EXAMPLE 607

A DNA sequence (GBSx0647) was identified in *S. agalactiae* <SEQ ID 1881> which encodes the amino acid sequence <SEQ ID 1882>. This protein is predicted to be chorismate synthase (aroC). Analysis of this protein sequence reveals the following:

```
Possible site: 15
>>> Seems to have no N-terminal signal sequence
INTEGRAL Likelihood = -4.67 Transmembrane 343-359 (341-364)

----- Final Results -----
        bacterial membrane --- Certainty = 0.2869 (Affirmative) < succ>
         bacterial outside --- Certainty = 0.0000 (Not Clear) < succ>
        bacterial cytoplasm --- Certainty = 0.0000 (Not Clear) < succ>
```

The protein has homology with the following sequences in the GENPEPT database:

```
>GP: BAB05375 GB: AP001512 chorismate synthase [Bacillus halodurans]
Identities = 227/381 (59%), Positives = 282/381 (73%), Gaps = 2/381 (0%)

Query:    1 MRYLTAGESHGPSLTAIIEGIPAGLKLSAKDINEDLKRRQGGYGRGNRMKIETDQVIISS    60
            MRYLTAGESHGP LT IIEG PA L+L A DIN DL RRQGG+GRG RM+IE DQV I
Sbjct:    1 MRYLTAGESHGPQLTTIIEGAPAQLELVADDINVDLARRQGHGRGRRMQIEKDQVQIVG    60

Query:   61 GVRHGKTLGSPITLTVTNKDHSKWLDIMSVEDI--EERLKQKRRIKHPRPGHADLVGGIK   118
            G+RHGKT G+PI L V NKD    W   IM  E +  +E   + KR+I  PRPGHADL G  IK
Sbjct:   61 GIRHGKTTGAPIALVVENKDWKHWTKIMGAEPLTGDEEKEIKRKITRPRPGHADLNGAIK   120

Query:  119 YRFDDLRNALERSSARETTMRVAIGAIAKRILKEIGIEIANHIVVFGGKEITVPDKLTVQ   178
            Y    D+RN LERSSARETT+RVA GA+AK+IL+   GIE+ +H++  GG +            +
Sbjct:  121 YGHRDMRNVLERSSARETTVRVAAGAVAKKILRTFGIEVGSHVLEIGGVKAEKTSYDQLS   180

Query:  179 QIKVLSSQSQVAIVNPSFEQEIKDYIDSVKKAGDTIGGVVETIVGGVPVGLGSYVHWDRK   238
              +K L+   S V ++      EQE+    ID   K+ GD+IGGVVE  IV GVP+GLGS+VH+DRK
Sbjct:  181 NLKELAEASPVRCLDKEAEQEMIAAIDQAKENGDSIGGVVEVIVEGVPIGLGSHVHYDRK   240

Query:  239 LDAKIAQAVVSINAFKGVEFGLGFKSGFLKGSQVMDSISWTKDQGYIRQSNNLGGFEGGM   298
            LDAKIA  AV+SINAFKGVEFG+GF++      GS+V  D  I+W +++GY R+SNNLGGFEGGM
Sbjct:  241 LDAKIAAAVMSINAFKGVEFGIGFEAASKPGSEVHDEIAWDEERGYYRKSNNLGGFEGGM   300

Query:  299 TNGEPIIVRGVMKPIPTLYKPLMSVDIDTHEPYRATVERSDPTALPAAGVVMEAVVATVL   358
            TNG PI+VRGVMKPIPTLYKPL SVDI T EP+ A++ERSD  A+PAA VV EAVVA   +
Sbjct:  301 TNGMPIVVRGVMKPIPTLYKPLQSVDIATKEPFAASIERSDSCAVPAAAVVAEAVVAWEV   360

Query:  359 VTEVLEKFSSDNMYELKEAVK                                         379
              +LE+F +D + E+++ ++
Sbjct:  361 ANALLERFGADQVEEIEKNIR                                         381
```

A related DNA sequence was identified in *S. pyogenes* <SEQ ID 1883> which encodes the amino acid sequence <SEQ ID 1884>. Analysis of this protein sequence reveals the following:

```
Possible site: 15
>>> Seems to have no N-terminal signal sequence
INTEGRAL Likelihood = -0.75 Transmembrane 342-358 (342-359)
INTEGRAL Likelihood = -0.16 Transmembrane 155-171 (155-171)

----- Final Results -----
        bacterial membrane --- Certainty = 0.1298 (Affirmative) < succ>
         bacterial outside --- Certainty = 0.0000 (Not Clear) < succ>
        bacterial cytoplasm --- Certainty = 0.0000 (Not Clear) < succ>
```

The protein has homology with the following sequences in the databases:

```
>GP: BAB05375 GB: AP001512 chorismate synthase [Bacillus halodurans]
Identities = 213/390 (54%), Positives = 277/390 (70%), Gaps = 2/390 (0%)

Query:    1 LRYLTAGESHGPSLTAIIEGIPAGLTLHPADIDHELQRRQGGYGRGARMSIETDRVQISS    60
            +RYLTAGESHGP LT IIEG PA L L   DI+ +L RRQGG+GRG RM IE D+VQI
Sbjct:    1 MRYLTAGESHGPQLTTIIEGAPAQLELVADDINVDLARRQGGHGRGRRMQIEKDQVQIVG   60

Query:   61 GVRHGKTTGAPITLTVINKDHQKWLDVMAVGDI--EETLKLRRVKHPRPGHADLVGGIK  118
            G+RHGKTTGAPI L V NKD + W +M    +  +E ++KR++ PRPGHADL G IK
Sbjct:   61 GIRHGKTTGAPIALVVENKDWKHWTKIMGAEPLTGDEEKEIKRKITRPRPGHADLNGAIK  120

Query:  119 YHFNDLRDALERSSARETTMRVAVGAVAKRILAELGIDMLHHILIFGGITITIPSKLSFR  178
            Y   D+R+ LERSSARETT+RVA GAVAK+IL   GI++   H+L  GG+      S
Sbjct:  121 YGHRDMRNVLERSSARETTVRVAAGAVAKKILRTFGIEVGSHVLEIGGVKAEKTSYDQLS  180

Query:  179 ELQERALHSELSIVNPKQEEEIKTYIDKIKKEGDTIGGIIETIVQGVPAGLGSYVQWDKK  238
               L+E A  S +  ++ + E+E+     ID+ K+ GD+IGG++E IV+GVP GLGS+V +D+K
Sbjct:  181 NLKELAEASPVRCLDKEAEQEMIAAIDQAKENGDSIGGVVEVIVEGVPIGLGSHVHYDRK  240

Query:  239 LDAKLAQAVLSINAFKGVEFGAGFDMGFQKGSQVMDEITWTPTQGYGRQTNHLGGFEGGM  298
            LDAK+A AV+SINAFKGVEFG GF+   + GS+V DEI W    +GY R++N LGGFEGGM
Sbjct:  241 LDAKIAAAVMSINAFKGVEFGIGFEAASKPGSEVHDEIAWDEERGYYRKSNNLGGFEGGM  300

Query:  299 TTGQPLVVKGVMKPIPTLYKPLMSVDIDSHEPYKATVERSDPTALPAAGVIMENVVATVL  358
             T G P+VV+GVMKPIPTLYKPL SVDI + EP+ A++ERSD A+PAA V+ E VVA +
Sbjct:  301 TNGMPIVVRGVMKPIPTLYKPLQSVDIATKEPFAASIERSDSCAVPAAAVVAEAVVAWEV  360

Query:  359 AKEILETFSSTTMSELQKAFSDYRAYVKQF                               388
            A +LE F + + E++K    ++    + F
Sbjct:  361 ANALLERFGADQVEEIEKNIREFNEKARLF                               390
```

An alignment of the GAS and GBS proteins is shown below:

```
Identities = 284/388 (73%), Positives = 333/388 (85%)

Query:    1 MRYLTAGESHGPSLTAIIEGIPAGLKLSAKDINEDLKRRQGGYGRGNRMKIETDQVIISS   60
            +RYLTAGESHGPSLTAIIEGIPAGL    DI+ +L+RRQGGYGRG RM IETD V ISS
Sbjct:    1 LRYLTAGESHGPSLTAIIEGIPAGLTLHPADIDHELQRRQGGYGRGARMSIETDRVQISS   60

Query:   61 GVRHGKTLGSPITLTVTNKDHSKWLDIMSVEDIEERLKQKRRIKHPRPGHADLVGGIKYR  120
            GVRHGKT G+PITLTV NKDH KWLD+M+V DIEE LK KRR+KHPRPGHADLVGGIKY
Sbjct:   61 GVRHGKTTGAPITLTVINKDHQKWLDVMAVGDIEETLKLRRVKHPRPGHADLVGGIKYH  120

Query:  121 FDDLRNALERSSARETTMRVAIGAIAKRILKEIGIEIANHIVVFGGKEITVPDKLTVQQI  180
            F+DLR ALERSSARETTMRVA+GA+AKRIL E+GI  +HI++FGG  IT+P KL+ +++
Sbjct:  121 FNDLRDALERSSARETTMRVAVGAVAKRILAELGIDMLHHILIFGGITITIPSKLSFREL  180

Query:  181 KVLSSQSQVAIVNPSFEQEIKDYIDSVKKAGDTIGGVVETIVGGVPVGLGSYVHWDRKLD  240
             +   S+++VNP  E+EIK YID +KK GDTIGG++ETIV GVP GLGSYV WD+KLD
Sbjct:  181 QERALHSELSIVNPKQEEEIKTYIDKIKKEGDTIGGIIETIVQGVPAGLGSYVQWDKKLD  240

Query:  241 AKIAQAVVSINAFKGVEFGLGFKSGFLKGSQVMDSISWTKDQGYIRQSNNLGGFEGGMTN  300
            AK+AQAV+SINAFKGVEFG GF    GF KGSQVMD I+WT  QGY RQ+N LGGFEGGMT
Sbjct:  241 AKLAQAVLSINAFKGVEFGAGFDMGFQKGSQVMDEITWTPTQGYGRQTNHLGGFEGGMTT  300

Query:  301 GEPIIVRGVMKPIPTLYKPLMSVDIDTHEPYRATVERSDPTALPAAGVVMEAVVATVLVT  360
            G P++V+GVMKPIPTLYKPLMSVDID+HEPY ATVERSDPTALPAAGV+ME VVATVL
Sbjct:  301 GQPLVVKGVMKPIPTLYKPLMSVDIDSHEPYKATVERSDPTALPAAGVIMENVVATVLAK  360

Query:  361 EVLEKFSSDNMYELKEAVKLYRNYVDHF                                 388
            E+LE FSS  MEL++A  YR YV  F
Sbjct:  361 EILETFSSTTMSELQKAFSDYRAYVKQF                                 388
```

A related GBS gene <SEQ ID 8617> and protein <SEQ ID 8618> were also identified. Analysis of this protein sequence reveals the following:

```
Lipop: Possible site: -1 Crend: 9
McG: Discrim Score: -2.42
GvH: Signal Score (-7.5): -3.23
Possible site: 15
>>> Seems to have no N-terminal signal sequence
ALOM program count: 1 value: -4.67 threshold: 0.0
INTEGRAL Likelihood = -4.67 Transmembrane 343-359 (341-364)
PERIPHERAL  Likelihood = 0.69 214
```

-continued modified ALOM score: 1.43

*** Reasoning Step: 3

----- Final Results -----
        bacterial membrane --- Certainty = 0.2869 (Affirmative) < succ>
        bacterial outside  --- Certainty = 0.0000 (Not Clear)  < succ>
        bacterial cytoplasm --- Certainty = 0.0000 (Not Clear)  < succ>

The protein has homology with the following sequences in the databases:

```
57.7/73.8% over 354aa
Bacillus subtilis
EGAD|20299| chorismate synthase Insert characterized
SP|P31104|AROC_BACSU CHORISMATE SYNTHASE (EC 4.6.1.4)
(5-ENOLPYRUVYLSHIKIMATE-3-PHOSPHATE PHOSPHOLYASE)
(VEGETATIVE PROTEIN 216) VEG216). Edit characterized
GP|143806|gb|AAA20859.1|M80245 AroF Insert characterized
GP|2634689|emb|CAB14187.1||Z99115 chorismate synthase Insert characterized
PIR|C69590|C69590 chorismate synthase aroF - Insert characterized
ORF00121(301-1359 of 1719)
EGAD|20299|BS2267(1-355 of 368) chorismate synthase {Bacillus
subtilis}SP|P31104|AROC_BACSU CHORISMATE SYNTHASE (EC 4.6.1.4) (5-
ENOLPYRUVYLSHIKIMATE-3-PHOSPHATE PHOSPHOLYASE) (VEGETATIVE PROTEIN 216)
(VEG216).GP|143806|gb|AAA20859.1||M80245 AroF {Bacillus subtilis}
GP|2634689|emb|CAB14187.1||Z99115 chorismate synthase {Bacillus subtilis}
PIR|C69590|C69590 chorismate synthase aroF - Bacillus subtilis
% Match = 35.0
% Identity = 57.6   % Similarity = 73.7
Matches = 204   Mismatches = 92   Conservative Sub.s = 57
      75        105       135       165       195       225       255       285
IQLSRVAERKNLMPRGISQDIYNMCLKFGLPVHYAEWDKDVLFDILSHDKKASGQFIKIVILPQLGSATVHQIPLEEMRD 315       345       375       405       435       465       495       525
YLEK*MRYLTAGESHGPSLTAIIEGIPAGLKLSAKDINEDLKRRQGGYGRGNRMKIETDQVIISSGVRHGKTLGSPITLT
     |||||||||||| || |||:|||| :: :||| :| ||| :||| |:||    |     |:||||| :|||||  |
     MRYLTAGESHGPQLTTIIEGVPAGLYITEEDINFELARRQKGHGRGRRMQIEKDQAKIMSGVRHARTLGSPIALV
          10        20        30        40        50        60        70

555       609       639       669       699       729       759
VTNKDHSKWLDIMSVEDI--EERLKQKRRIKHPRPGHADLVGGIKYRFDDLRNALERSSARETTMRVAIGAIAKRILKEI
|||  |  |   |  : ||:|  ||||||||| ||:|:||  | | ||||| |:|:|| ||::|::| :
VENNDWKHWTKIMGAAPITEDEEKEMKRQISRPRPGHADLNGAIKYNHRDMRNVLERSSARETTVRVAAGAVAKKILSEL
         90        100       110       120       130       140       150

789       819       849       879       909       939       969       999
GIEIANHIVVFGGKEITVPDKLTVQQIKVLSSQSQVAIVNPSFEQEIKDYIDSVKKAGDTIGGVVETIVGGVPVGLGSYV
|| ::|  |::    |     :   :::  ::  ::  :|  |      :   ::   ||   |    ||:|||:||||
GIKVAGHVLQIGAVKAEKTGYTSIEDLQRVTEESPVRCYDEEAGKKMMAAIDEAKANGDSIGGIVEVIVEGMPVGVGSYV
         170       180       190       200       210       220       230

1029      1059      1089      1119      1149      1179      1209      1239
HWDRKLDAKIAQAVVSINAFKGVEFGLGFKSGFLKGSQVMDSISWTKDQGYIRQSNNLGGFEGGMTNGEPIIVRGVMKPI
|:||||:|:| ||::|||||||||||:|||::      ||:|  |:|  || ||  |||| ||||:|  | ||||||||
HYDRKLDSKLAAAVLSINAFKGVEFGIGFEAAGRNGSEVHDEIIWDEEKGYTRATNRLGGLEGGMTTGMPIVVRGVMKPI
         250       260       270       280       290       300       310

1269      1299      1329      1359      1389      1419      1449      1479
PTLYKPLMSVDIDTHEPYRATVERSDPTALPAAGVVMEAVVATVLVTEVLEKFSSDNMYN*KKL*NYIAIMLIIFK*KLV
|||||||  ||||:|  ||:  |||| | |  :|||   ||  |    |  |
PTLYKPLKSVDIETKEPFSASIERSDSCAVPAASVVAEALSLGKLQPSLNNSD
         330       340       350       360
```

SEQ ID 8618 (GBS192) was expressed in *E. coli* as a His-fusion product. SDS-PAGE analysis of total cell extract is shown in FIG. 18 (lane 4; MW 44 kDa).

GBS192-His was purified as shown in FIG. 196, lane 4.

Based on this analysis, it was predicted that these proteins and their epitopes could be useful antigens for vaccines or diagnostics.

EXAMPLE 608

A DNA sequence (GBSx0648) was identified in *S. agalactiae* <SEQ ID 1885> which encodes the amino acid sequence <SEQ ID 1886>. This protein is predicted to be 3-dehydroquinate synthase (aroB). Analysis of this protein sequence reveals the following:

```
        Possible site: 24
        >>> Seems to have no N-terminal signal sequence
        INTEGRAL Likelihood = -3.82 Transmembrane 99-115 (98-116)

----- Final Results -----
                bacterial membrane --- Certainty = 0.2529 (Affirmative) < succ>
                bacterial outside  --- Certainty = 0.0000 (Not Clear)  < succ>
                bacterial cytoplasm --- Certainty = 0.0000 (Not Clear)  < succ>
```

The protein has homology with the following sequences in the GENPEPT database:

```
>GP: BAA18068 GB: D90911 3-dehydroquinate synthase [Synechocystis sp.]
Identities = 138/351 (39%), Positives = 200/351 (56%), Gaps = 4/351 (1%)

Query:    3 VEVDLPNHPYHIKIEEGCFSEAGDWVSHLWQKQMITIITDSNVEILYGESLVNQLKKQGF   62
            + V LP  PY ++I  G  +  D ++ L  + I ++++  +   YGE ++  L++ G+
Sbjct:    5 IPVPLPQSPYQVQIVPGGLAAIADHLAPLGLGKKIMVVSNPEIYDYYGEVVIQALQRAGY   64

Query:   63 TVHVFSFAAGEASKTLEVANRIYAFLAKHHMTRSDGIIALGGGVVGDLAAFVASTYMRGI  122
             V      AGE  KTL  N +Y   + ++ R+   +++LGGGV+GD+  F A+T++RGI
Sbjct:   65 EVFQHLIPAGETHKTLASINELYDVAFQANLERNSTLLSLGGGVIGDMTGFGAATWLRGI  124

Query:  123 HFLQIPTSLTAQVDSSIGGKTGVNTSFAKNMVGTFAQPDGVLIDPVTLKTLGNRELVEGM  182
             +F+Q+PTSL A VD+SIGGKTGVN    KN++G F QP V IDPV LKTL  RE   GM
Sbjct:  125 NFVQVPTSLLAMVDASIGGKTGVNHPQGKNLIGAFYQPRLVYIDPVVLKTLPEREFRAGM  184

Query:  183 GEVIKYGLIDDIKLWHILEEMD--GTIDSILDNALA-IIYHSCQVKRKHVLADQYDKGLR  239
              EVIKYG+I D +L+  LEE +   +ID + D  L   II   SCQ K    V D+ + GLR
Sbjct:  185 AEVIKYGVIWDSELFTALEEAEDLSSIDRLPDELLTKIIQRSCQAKVDVVSQDEKEAGLR  244

Query:  240 MHLNFGHTIGHAIEVHAGYGEIMHGEAVAIGMIQLSRVAERKNLMPRGISQDIYNMCLKF  299
              LN+GHT+GH +E   GYG I HGEAVAIGM   +++A   L  + +      + LK
Sbjct:  245 AILNYGHTVGHGVESLTGYGVINHGEAVAIGMEAAAKIAHYLGLCDQSLGDRQRQLLLKT  304

Query:  300 GLPVHY-AEWDKDVLFDILSHDKKASGQFIKIVILPQLGSATVHQIPLEEM          349
             LP        + L    L  HDKK     ++ ++   +G  T+        +E+
Sbjct:  305 KLPTEMPPTLAVENLLASLLHDKKVKAGKVRFILPTAIGQVTISDAVTDEV          355
```

A related DNA sequence was identified in *S. pyogenes* <SEQ ID 1887> which encodes the amino acid sequence <SEQ ID 1888>. Analysis of this protein sequence reveals the following:

```
Possible site: 60
>>> Seems to have no N-terminal signal sequence
INTEGRAL Likelihood = -0.43 Transmembrane 97-113 (97-114)

----- Final Results -----
         bacterial membrane --- Certainty = 0.1171 (Affirmative) < succ>
          bacterial outside --- Certainty = 0.0000 (Not Clear)   < succ>
            bacterial cytoplasm --- Certainty = 0.0000 (Not Clear)   < succ>
```

The protein has homology with the following sequences in the databases:

```
>GP: BAA18068 GB: D90911 3-dehydroquinate synthase [Synechocystis sp.]
Identities = 123/349 (35%), Positives = 190/349 (54%), Gaps = 9/349 (2%)

Query:    1 MPQTLHVHSRVKDYDILFTDHVLKTLADCLGERKQ-RKLLFITDQTVYHLYQTLFEEFAQ   59
            M  T+ V        Y +       L +AD L     +K++ +++   +Y  Y  +  + Q
Sbjct:    1 MATTIPVPLPQSPYQVQIVPGGLAAIADHLAPLGLGKKIMVVSNPEIYDYYGEVVIQALQ   60

Query:   60 Q--YNAFVHVCPPGGQSKSLERVSAIYDQLIAENFSKKDMIVTIGGGVVGDLGGFVAATY  117
             +    Y  F H+ P G    K+L  ++  +YD      N  +     ++++GGGV+GD+  GF AAT+
Sbjct:   61 RAGYEVFQHLIPAGETHKTLASINELYDVAFQANLERNSTLLSLGGGVIGDMTGFGAATW  120

Query:  118 YRGIPYIQIPTTLLSQVDSSIGGKVGVHFKGLTNMIGSIYPPEAIIISTTFLETLPQREF  177
              RGI  ++Q+PT+LL+ VD+SIGGK GV+     N+IG+ Y P  +  I     L+TLP +REF
Sbjct:  121 LRGINFVQVPTSLLAMVDASIGGKTGVNHPQGKNLIGAFYQPRLVYIDPVVLKTLPEREF  180

Query:  178 SCGISEMLKIGFIHDRPLFQQLRDFQ-----KETDKQGLERLIYQSISNKKRIVEQDEFE  232
               G++E++K  G  I D    LF  L + +             + L  ++I  +S   K  +V QDE  E
Sbjct:  181 RAGMAEVIKYGVIWDSELFTALEEAEDLSSIDRLPDELLTKIIQRSCQAKVDVVSQDEKE  240

Query:  233 NGLRMSLNFGHTLGHAIESLCHHDFYHHGEAIAIGMVVDAKLAVSKGLLPKEDLDSLLQV  292
               GLR  LN+GHT+GH +ESL +     +HGEA+AIGM    AK+A  GL +   D   Q+
Sbjct:  241 AGLRAILNYGHTVGHGVESLTGYGVINHGEAVAIGMEAAAKIAHYLGLCDQSLGDRQRQL  300

Query:  293 FERYQLPTTLERADVSATSLFDVFKTDKKNSEQHIIFILPTETGFTTLA            341
              +  +LPT +       ++ +L     DKK     +  FILPT  G  T++
Sbjct:  301 LLKTKLPTEMP-PTLAVENLLASLLHDKKVKAGKVRFILPTAIGQVTIS             348
```

An alignment of the GAS and GBS proteins is shown below:

```
Identities = 121/332 (36%), Positives = 182/332 (54%), Gaps = 7/332 (2%)

Query:   12 YHIKIEEGCFSEAGDWVSHLWQKQMITIITDSNVEILYGESLVNQLKKQGFTVHVFSFAA    71
             Y I      +       D +    Q++++  ITD  V  LY ++L  +  +Q +     V
Sbjct:   14 YDILFTDHVLKTLADCLGERKQRKLL-FITDQTVYHLY-QTLFEEFAQQ-YNAFVHVCPP    70

Query:   72 GEASKTLEVANRIYAFLAKHHMTRSDGIIALGGGVVGDLAAFVASTYMRGIHFLQIPTSL   131
             G   SK+LE  + IY L    + ++ D I+ +GGGVVGDL  FVA+TY RGI ++QIPT+L
Sbjct:   71 GGQSKSLERVSAIYDQLIAENFSKKDMIVTIGGGVVGDLGGFVAATYYRGIPYIQIPTTL   130

Query:  132 TAQVDSSIGGKTGVNTSFAKNMVGTFAQPDGVLIDPVTLKTLGNRELVEGMGEVIKYGLI   191
             +QVDSSIGGK GV+       NM+G+    P+ ++I     L+TL RE   G+ E++K G I
Sbjct:  131 LSQVDSSIGGKVGVHFKGLTNMIGSIYPPEAIIISTTFLETLPQREFSCGISEMLKIGFI   190

Query:  192 DDIKLWHILEEMDGTIDSILDNALAIIYHSCQVKRKHVLADQYDKGLRMHLNFGHTIGHA   251
               D  L+   L +      D      +IY S   K++ V D+++ GLRM LNFGHT+GHA
Sbjct:  191 HDRPLFQQLRDFQKETDK--QGLERLIYQSISNKKRIVEQDEFENGLRMSLNFGHTLGHA   248

Query:  252 IEVHAGYGEIMHGEAVAIGMIQLSRVAERKNLMPRGISQDIYNMCLKFGLP--VHYAEWD   309
             IE      HGEA+AIGM+   +++A K L+P+     +    +  ++ LP   + A+
Sbjct:  249 IESLCHHDFYHHGEAIAIGMVVDAKLAVSKGLLPKEDLSLLQVFERYQLPTTLERADVS    308

Query:  310 KDVLFDILSHDKKASGQFIKIVILPQLGSATV                             341
              LFD+    DKK S Q I ++   + G  T+
Sbjct:  309 ATSLFDVFKTDKKNSEQHIIFILPTETGFTTL                             340
```

Figure 62:
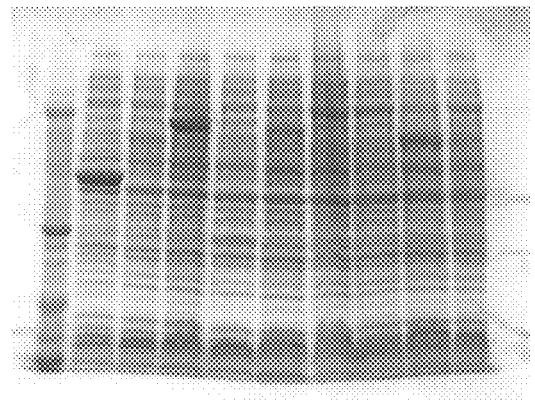

SEQ ID 1886 (GBS336) was expressed in *E. coli* as a His-fusion product. SDS-PAGE analysis of total cell extract is shown in FIG. 62 (lane 2; MW 42.7 kDa). It was also expressed in *E. coli* as a GST-fusion product. SDS-PAGE analysis of total cell extract is shown in FIG. 67 (lane 5; MW 68 kDa).

Figure 310:
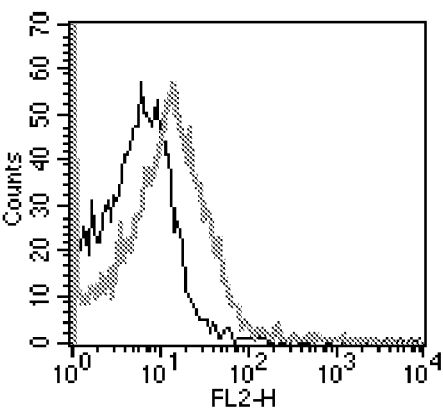

The GBS336-GST fusion product was purified (FIG. 209, lane 4) and used to immunise mice. The resulting antiserum was used for FACS (FIG. 310), which confirmed that the protein is immunoaccessible on GBS bacteria.

Based on this analysis, it was predicted that these proteins and their epitopes could be useful antigens for vaccines or diagnostics.

EXAMPLE 609

A DNA sequence (GBSx0649) was identified in *S. agalactiae* <SEQ ID 1889> which encodes the amino acid sequence <SEQ ID 1890>. Analysis of this protein sequence reveals the following:

```
Possible site: 47
>>> Seems to have no N-terminal signal sequence

----- Final Results -----
        bacterial cytoplasm --- Certainty = 0.3884 (Affirmative) < succ>
         bacterial membrane --- Certainty = 0.0000 (Not Clear)   < succ>
          bacterial outside --- Certainty = 0.0000 (Not Clear)   < succ>
```

A related GBS nucleic acid sequence <SEQ ID 9973> which encodes amino acid sequence <SEQ ID 9974> was also identified.

The protein has homology with the following sequences in the GENPEPT database:

```
>GP: CAB14240 GB: Z99116 3-dehydroquinate dehydratase [Bacillus subtilis]
Identities = 70/233 (30%), Positives = 127/233 (54%), Gaps = 12/233 (5%)

Query:    2 KIVVPVMPRSLEEA-QEIDLSKFDSVDIIEWRADALPK----DDIINVAPAIFEKFAGHE    56
            KI++P+M ++ ++   E +  K  + DI+EWR D   K      + + +    + + +
Sbjct:   17 KIIIPLMGKTEKQILNEAEAVKLLNPDIVEWRVDVFEKANDREAVTKLISKLRKSLEDKL    76

Query:   57 IIFTLRTTREGGNIVLSDAEYVELIQKINSIYNPDYIDFEYFSHKEVFQEMLEFPN----   112
            +FT  RT +EGG++  +  ++ Y+ L++       + D  ID E FS     + ++
Sbjct:   77 FLFTFRTHKEGGSMEMDESSYLALLESAIQTKDIDLIDIELFSGDANVKALVSLAEENNV   136

Query:  113 -LVLSYHNFQETP--ENIMEIFSELTALAPRVVKIAVMPKNEQDVLDVMNYTRGFKTINP   169
             +V+S H+F++TP   + I+      ++   L   + K+AVMP   D+L +++  T    KTI
Sbjct:  137 YVVMSNHDFEKTPVKDEIISRLRKMQDLGAHIPKMAVMPNDTGDLLTLLDATYTMKTIYA   196

Query:  170 DQVYATVSMSKIGRISRFAGDVTGSSWTFAYLDSSIAPGQITISEMKRVKALL          222
            D+     T+SM+  G ISR +G+V GS+ TF   +  APGQI +SE++   V +L
Sbjct:  197 DRPIITMSMAATGLISRLSGEVFGSACTFGAGEEASAPGQIPVSELRSVLDIL         249
```

A related DNA sequence was identified in *S. pyogenes* <SEQ ID 1891> which encodes the amino acid sequence <SEQ ID 1892>. Analysis of this protein sequence reveals the following:

```
Possible site: 17
>>> Seems to have no N-terminal signal sequence

----- Final Results -----
        bacterial cytoplasm --- Certainty = 0.3248 (Affirmative) < succ>
         bacterial membrane --- Certainty = 0.0000 (Not Clear) < succ>
          bacterial outside --- Certainty = 0.0000 (Not Clear) < succ>
```

An alignment of the GAS and GBS proteins is shown below:

```
Identities = 160/225 (71%), Positives = 198/225 (87%)

Query:    1 MKIVVPVMPRSLEEAQEIDLSKFDSVDIIEWRADALPKDDIINVAPAIFEKFAGHEIIFT   60
            M+IV PVMPR  +EAQ ID+SK++ V++IEWRAD LPKD+I+ VAPAIFEKFAG EIIFT
Sbjct:    1 MRIVAPVMPRHFDEAQAIDISKYEDVNLIEWRADFLPKDEIVAVAPAIFEKFAGKEIIFT   60

Query:   61 LRTTREGGNIVLSDAEYVELIQKINSIYNPDYIDFEYFSHKEVFQEMLEFPNLVLSYHNF  120
            LRT +EGGNI LS  EYV++I++IN+IYNPDYIDFEYF+HK VFQEML+FPNL+LSYHNF
Sbjct:   61 LRTVQEGGNITLSSQEYVDIIKEINAIYNPDYIDFEYFTHKSVFQEMLDFPNLILSYHNF  120

Query:  121 QETPENIMEIFSELTALAPRVVKIAVMPKNEQDVLDVMNYTRGFKTINPDQVYATVSMSK  180
            +ETPEN+ME FSE+T LAPRVVKIAVMP++EQDVLD+MNYTRGFKT+NP+Q  +AT+SM K
Sbjct:  121 EETPENLMEAFSEMTKLAPRVVKIAVMPQSEQDVLDLMNYTRGFKTLNPEQEFATISMGK  180

Query:  181 IGRISRFAGDVTGSSWTFAYLDSSIAPGQITISEMKRVKALLDAD                225
            +GR+SRFAGDV GSSWT+  LD    PGQ+T+++MKR+  +L+ D
Sbjct:  181 LGRLSRFAGDVIGSSWTYVSLDHVSGPGQVTLNDMKRIIEVLEMD                225
```

Based on this analysis, it was predicted that these proteins and their epitopes could be useful antigens for vaccines or diagnostics.

EXAMPLE 610

A DNA sequence (GBSx0650) was identified in *S. agalactiae* <SEQ ID 1893> which encodes the amino acid sequence <SEQ ID 1894>. Analysis of this protein sequence reveals the following:

```
Possible site: 17
>>> Seems to have no N-terminal signal sequence

----- Final Results -----
        bacterial cytoplasm --- Certainty = 0.1195 (Affirmative) < succ>
         bacterial membrane --- Certainty = 0.0000 (Not Clear) < succ>
          bacterial outside --- Certainty = 0.0000 (Not Clear) < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 611

A DNA sequence (GBSx0651) was identified in *S. agalactiae* <SEQ ID 1895> which encodes the amino acid sequence <SEQ ID 1896>. Analysis of this protein sequence reveals the following:

```
Possible site: 41
>>> Seems to have no N-terminal signal sequence

----- Final Results -----
        bacterial cytoplasm --- Certainty = 0.3431 (Affirmative) < succ>
         bacterial membrane --- Certainty = 0.0000 (Not Clear) < succ>
          bacterial outside --- Certainty = 0.0000 (Not Clear) < succ>
```

The protein has homology with the following sequences in the GENPEPT database:

```
>GP: CAB15862 GB: Z99123 alternate gene name: ipa-19d~similar to
hypothetical proteins [Bacillus subtilis]
Identities = 161/396 (40%), Positives = 235/396 (58%), Gaps = 11/396 (2%)

Query:    1 MNKLKVNSVVERKIKSGAQLLEKKDFDTSLVNQ----LVQLFSQSN-QFLGMAYLSPQNK   55
            M  L +     KIK G L+EK+   S +      LV + S+S +FL  Y   QNK
Sbjct:    1 MKLLTLKKAHAAKIKKGYPLIEKEALAGSAGHMKEGDLVDIVSESGGEFLARGYYGLQNK   60

Query:   56 GIGWLLSRQVFD-FNHDYFVSLFEKSREKRQKFEKSSQTTAYRLFNQDGDNFGGLTIDFY  114
            G+GW L+R    +  +F+S  K+ + R K  ++  TTA+RLFN +GD  GG+TID+Y
Sbjct:   61 GVGWTLTRNKHEQIDQAFFLSKLTKAAQARAKLFEAQDTTAFRLFNGEGDGVGGVTIDYY  120

Query:  115 SDYALFSWYNEFVYTNRQMIVAAFKQVYPNIKGAYEKIRFKGLDF---ESAHLYGQEAPE  171
              Y L  WY++ +YT + M+++A  ++  + K  YEK RF        +   + G+
Sbjct:  121 DGYLLIQWYSKGIYTFKDMLISALDEMDLDYKAIYEKKRFDTAGQYVEDDDFVKGRRGEF  180

Query:  172 SFLILENNIKYSVFLNDGLMTGIFLDQHDVRKALATNLSEGKKVLNMFSYTAAFSVAAAV  231
             +I EN I+Y+V LN+G MTGIFLDQ  VRKA+    ++GK VLN FSYT AFSVAAA+
Sbjct:  181 PIIIQENGIQYAVDLNEGAMTGIFLDQRHVRKAIRDRYAKGKTVLNTFSYTGAFSVAAAL  240

Query:  232 GGALETTSVDLAKRSRELSKAHFDANQIVTDNHRFIVMDVFEYYKYAKRKHLSYDVIVID  291
            GGA +TTSVD+A RS +    F N++  + H   VMDVF Y+ YA +K L +D+I++D
Sbjct:  241 GGAEKTTSVDVANRSLAKTIEQFSVNKLDYEAHDIKVMDVFNYFSYAAKKDLRFDLIILD  300

Query:  292 PPSFARNKKQTFSVTKDYYKLIEQALDILTPGGTIIASTNAANLTVSQFKKQLEKGFGKA  351
            PPSFAR KK+TFS  KDY L+++ + I   G I+ASTN++  + +FK ++  F +
Sbjct:  301 PPSFARTKKRTFSAAKDYKNLLKETIAITADKGVIVASTNSSAFGMKKFKGFIDAAFKET  360

Query:  352 SHNYISLQQ-LPEDFTINDKDQQSNYLKVFTIKVK                          385
            +  Y  +++  LPEDF        + NYLKV ++ K
Sbjct:  361 NERYTIIEEFTLPEDFKTISAFPEGNYLKVVLLQKK                         396
```

30
A related DNA sequence was identified in *S. pyogenes* <SEQ ID 1897> which encodes the amino acid sequence <SEQ ID 1898>. Analysis of this protein sequence reveals the following:

```
Possible site: 29
>>> Seems to have no N-terminal signal sequence

----- Final Results -----
         bacterial cytoplasm --- Certainty = 0.2699 (Affirmative) < succ>
          bacterial membrane --- Certainty = 0.0000 (Not Clear)   < succ>
           bacterial outside --- Certainty = 0.0000 (Not Clear)   < succ>
```

An alignment of the GAS and GBS proteins is shown below:

```
Identities = 259/386 (67%), Positives = 315/386 (81%), Gaps = 1/386 (0%)

Query:    1 MNKLKVNSVVERKIKSGAQLLEKKDFDT-SLVNQLVQLFSQSNQFLGMAYLSPQNKGIGW   59
            MNKL ++S VE+K+ +G QLL++KDF    NQLVQL ++SN+ +G AY+S QNKGIGW
Sbjct:    1 MNKLYIDSFVEKKLTAGVQLLDEKDFSNIKEKNQLVQLVTKSNRPIGTAYISKQNKGIGW   60

Query:   60 LLSRQVFDFNHDYFVSLFEKSREKRQKFEKSSQTTAYRLFNQDGDNFGGLTIDFYSDYAL  119
            L  + D + YFVSLF  ++ KRQ F +S +T AYRLFNQ+GD FGG+TID Y D+A+
Sbjct:   61 YLGPEKIDLSISYFVSLFSVAKAKRQDFAQSDETNAYRLFNQEGDGFGGVTIDLYKDFAV  120

Query:  120 FSWYNEFVYTNRQMIVAAFKQVYPNIKGAYEKIRFKGLDFESAHLYGQEAPESFLILENN  179
            FSWYN FVY  ++MI+ AF+QV+P +KGAYEK RFKG D E+AHLYG+ A E+F ILEN
Sbjct:  121 FSWYNAFVYDKKEMIMEAFQQVFPEVKGAYEKCRFKGPDTETAHLYGELAQETFSILENG  180

Query:  180 IKYSVFLNDGLMTGIFLDQHDVRKALATNLSEGKKVLNMFSYTAAFSVAAAVGGALETTS  239
            I Y  VFLN+GLMTGIFLDQHDV+AL    L+  GK +LN+FSYTAAFSVAAA+GGA+ETTS
Sbjct:  181 IAYQVFLNEGLMTGIFLDQHDVRRALVDGLAMGKSLLNLFSYTAAFSVAAAMGGAIETTS  240

Query:  240 VDLAKRSRELSKAHFDANQIVTDNHRFIVMDVFEYYKYAKRKHLSYDVIVIDPPSFARNK  299
            VDLAKRSRELS AHF+ NQ+   +H F+VMDVFEY+KYAKRK L +DVIVIDPPSFARNK
Sbjct:  241 VDLAKRSRELSLAHFEHNQLNLASHHFVVMDVFEYFKYAKRKKLIFDVIVIDPPSFARNK  300

Query:  300 KQTFSVTKDYYKLIEQALDILTPGGTIIASTNAANLTVSQFKKQLEKGFGKASHNYISLQ  359
            KQTFSV++DY+KLI +ALDIL+P GTIIASTNAAN+TVSQFKKQ  KGFG      ++LQ
Sbjct:  301 KQTFSVSRDYHKLITEALDILSPKGTIIASTNAANMTVSQFKKQIIKGFGSRRPESMTLQ  360
```

```
Query:  360 QLPEDFTINDKDQQSNYLKVFTIKVK                                385
            QLP DFTIN  D++SNYLKVFTIKV+
Sbjct:  361 QLPSDFTINKADERSNYLKVFTIKVR                                386
```

Based on this analysis, it was predicted that these proteins and their epitopes could be useful antigens for vaccines or diagnostics.

EXAMPLE 612

A DNA sequence (GBSx0652) was identified in *S. agalactiae* <SEQ ID 1899> which encodes the amino acid sequence <SEQ ID 1900>. This protein is predicted to be minimal change nephritis transmembrane glycoprotein. Analysis of this protein sequence reveals the following:

```
Possible site: 30
>>> Seems to have an uncleavable N-term signal seq
INTEGRAL Likelihood = -6.85 Transmembrane 129-145 (126-152)
INTEGRAL Likelihood = -4.88 Transmembrane  48-64 (46-69)
INTEGRAL Likelihood = -4.83 Transmembrane  75-91 (74-97)
INTEGRAL Likelihood = -4.62 Transmembrane  16-32 (15-34)
INTEGRAL Likelihood = -2.28 Transmembrane 163-179 (163-182)

----- Final Results -----
        bacterial membrane --- Certainty = 0.3739 (Affirmative) < succ>
         bacterial outside --- Certainty = 0.0000 (Not Clear)   < succ>
        bacterial cytoplasm --- Certainty = 0.0000 (Not Clear)  < succ>
```

The protein has homology with the following sequences in the GENPEPT database:

```
>GP: CAB12545 GB: Z99107 alternate gene name: yetP~similar to
hypothetical proteins [Bacillus subtilis]
Identities = 299/676 (44%), Positives = 415/676 (61%), Gaps = 33/676 (4%)

Query:    2 KKIKDFASRAINTRLGFILLLVVIYWLKTIWAYHTDFNLGLENSYQLFLTIINPIPLGLL    61
            KK++    +   +L F +L V+++W KT  +Y T+FNLG++ + Q  L I NP    +
Sbjct:    9 KKVEVAMKKLFSYKLSFFVLAVILFWAKTYLSYKTEFNLGVKGTTQEILLIFNPFSSAVF    68

Query:   62 IIGLALYVKRTKAFYITAFITYAIVNILLIANAIYYREFSDFITVSAVLASSKTSAGLGD   121
            +GLAL  K  K+ I    I + ++  +L AN ++YR F DF+T  +  S      +GD
Sbjct:   69 FLGLALLAKGRKSAIIMLIIDF-LMTFVLYANILFYRFFDDFLTFPNIKQSGNVG-NMGD   126

Query:  122 SALNLLRIWDLVYVFDFIILIFLFATKKIHLDDRPFNKRASFSITALSGL-LFSINLFLA   180
                 +++   D+ Y  D IILI +    + L +     KR + S+  LSG+ LF INL  A
Sbjct:  127 GIFSIMAGHDIFYFLDIIILIAVLIWRP-ELKEYKMKKRFA-SLVILSGIALFFINLHYA   184

Query:  181 EIDRPELLSRGFSNTYIVKALGLPSFSIYSGNQTYQAQKERNGATAQELATAKKYVAEHY   240
            E DRP+LL+R F   YIVK LGL +++IY G QT Q + +R  A++ +L + + Y   HY
Sbjct:  185 EKDRPQLLTRTFDRHYIVKYLGLYNYTIYDGVQTAQTETQRAYASSDDLTSVENYTTSHY   244

Query:  241 AKPNPEYYGIGKGRNVIMIHLESFQQFLIDYRLNIDGKEHVVTPFINSLYHSKETVS-FS   299
            AKPN EY+G   KG+N+I IHLESFQ FLIDYKLN   G+E    VTPF+N L H   E V+F
Sbjct:  245 AKPNAEYFGSARGKNIIKIHLESFQSFLIDYKLN--GEE--VTPFLNKLAHGGEDVTYFD   300

Query:  300 NFFHQVKAGKTSDAETLMENSLFGLSSGSFMVNYGGENTQFAAPHILAQNGGYSSAVFHG   359
            NFFHQ   GKTSDAE M+NS+FGL GS V   GENT  + P IL Q  GY+SAV HG
Sbjct:  301 NFFHQTGQGKTSDAELTMDNSIFGLPEGSAFVT-KGENTYQSLPAILDQKEGYTSAVLHG   359

Query:  360 NVGTFWNRNNAYKQWGYDYFFDSSYFSKQTKDNSFQYGLNDKYMFADSIKYLEHMQQPFY   419
            +  +FWNR+   YK  GYD FFD+S +    +N   GL DK  F +SI  LE ++QPFY
Sbjct:  360 DYKSFWNRDQIYKHIGYDKFFDASTYD-MSDENVINMGLKDKPFFTESIPKLESLKQPFY   418

Query:  420 TKFITVSNHYPYTSLKGESDEEGFPLAKTNDETINGYFATANYLDTALKSFFEYLKAAGV   479
               IT++NHYP+        +     A T D T++ YF TA YLD AL+ FF+ LK AG+
Sbjct:  419 AHLITLTNHYPFNL---DEKDASLKKATTGDNTVDSYFQTARYLDEALEQFFKELKEAGL   475

Query:  480 YDNSIIVMYGDHYGISNTRNPSLAELLGKDPETWSEYDNAMLQRVPYMIHIPGYSKGFIS   539
            YDNS+I++YGDH GIS  N ++ E+LGK+   ++Y NA QRVP MI +PG  KG ++
Sbjct:  476 YDNSVIMIYGDHNGISENHNRAMKEILGKE---ITDYQNAQNQRVPLMIRVPG-KKGGVN   531

Query:  540 NTYGGEVDNLPTLLHILGIDTSKYTQLGQDLLSKDNKQMVAMRTTGQYITPKYTNYSGHL   599
```

```
               +TYGGE+D +PTLLH+ GID+ KY    G DL SKD+    VA R  G ++TPKYT+    +
Sbjct: 532 HTYGGEIDVMPTLLHLEGIDSQKYINFGTDLFSKDHDDTVAFR-NGDFVTPKYTSVDNII    590

Query: 600 YYTDSGQEITNPDETTKAEIKAIRDATNKQLSTSDSIQTGDLLRFDENNGLKTVEVEKFN    659
             Y T +G+++   +ET       K ++    N+QLS SDS+    DLLRF + N  K V+    ++
Sbjct: 591 YDTKTGEKLKANEET-----KNLKTRVNQQLSLSDSVLYKDLLRFHKLNDFKAVDPSDYH    645

Query: 660 YTHSLKALKAKERKLK                                                675
             Y          KE+++K
Sbjct: 646 Y--------GKEKEIK                                                653
```

A related DNA sequence was identified in *S. pyogenes* <SEQ ID 1901> which encodes the amino acid sequence <SEQ ID 1902>. Analysis of this protein sequence reveals the following:

```
Possible site: 48
>>> Seems to have no N-terminal signal sequence
INTEGRAL Likelihood = -6.85 Transmembrane  90-106 (88-112)
INTEGRAL Likelihood = -5.68 Transmembrane 146-162 (139-165)
INTEGRAL Likelihood = -4.99 Transmembrane  63-79  (60-84)
INTEGRAL Likelihood = -3.98 Transmembrane 178-194 (176-197)
INTEGRAL Likelihood = -0.59 Transmembrane  31-47  (31-47)

----- Final Results -----
         bacterial membrane --- Certainty = 0.3739 (Affirmative) < succ>
          bacterial outside --- Certainty = 0.0000 (Not Clear)  < succ>
         bacterial cytoplasm --- Certainty = 0.0000 (Not Clear)  < succ>
```

An alignment of the GAS and GBS proteins is shown below:

```
Identities = 533/713 (74%), Positives = 603/713 (83%)

Query:   1 MKKIKDFASRAINTRLGFILLLVVIYWLKTIWAYHTDFNLGLENSYQLFLTIINPIPLGL    60
           +KK K   +    INTRLGFI+ L+   YW+KT+WAYHTDF+L L N  YQ+FLTIINPIPL
Sbjct:  16 VKKFKTLITGFINTRLGFIITLLFCYWIKTLWAYHTDFSLDLGNIYQVFLTIINPIPLAF    75

Query:  61 LIIGLALYVKRTKAFYITAFITYAIVNILLIANAIYYREFSDFITVSAVLASSKTSAGLG    120
           L++G+ALYVK T+AFYI +++ Y  I+NILLI+N+IYYREFSDFITVSA+LASSK SAGLG
Sbjct:  76 LLLGVALYVKNTRAFYICSWVVYIILNILLISNSIYYREFSDFITVSAMLASSKVSAGLG    135

Query: 121 DSALNLLRIWDLVYVFDFIILIFLFATKKIHLDDRPFNKRASFSITALSGLLFSINLFLA    180
           DSALNLLRIWD++Y+ DFIILI L   KKI D RPFNKRA+F+ITALS LL SINLFLA
Sbjct: 136 DSALNLLRIWDIIYILDFIILISLSIAKKIKNDQRPFNKRAAFAITALSSLLLSINLFLA    195

Query: 181 EIDRPELLSRGFSNTYIVKALGLPSFSIYSGNQTYQAQKERNGATAQELATAKKYVAEHY    240
           EIDRPELL+RGFSNTYIV+ALGLP F++YSGNQTYQAQKERNGATA+EL    K YV   HY
Sbjct: 196 EIDRPELLTRGFSNTYIVRALGLPAFTLYSGNQTYQAQKERNGATAEELIDVKTYVKGHY    255

Query: 241 AKPNPEYYGIGKGRNVIMIHLESFQQFLIDYKLNIDGKEHVVTPFINSLYHSKETVSFSN    300
            A P+P+Y+GIGKG+N+I++HLESFQQFLIDYKL   KE+ VTPFINSLYHS  T++F N
Sbjct: 256 AAPDPQYFGIGKGKNIIVLHLESFQQFLIDYKLKEGDKEYEVTPFINSLYHSNATLAFPN    315

Query: 301 FFHQVKAGKTSDAETLMENSLFGLSSGSFMVNYGGENTQFAAPHILAQNGGYSSAVFHGN    360
           FFHQVKAGKTSDAET+MENSLFGL+SGSFMVNYGGENTQFA P ILAQ GGY+SAVFHGN
Sbjct: 316 FFHQVKAGKTSDAETMMENSLFGLNSGSFMVNYGGENTQFATPSILAQKGGYTSAVFHGN    375

Query: 361 VGTFWNRNNAYKQWGYDYFFDSSYFSKQTKDNSFQYGLNDKYMFADSIKYLEHMQQPFYT    420
           VGTFWNRNNAYKQWGY+YFFDSSYFSKQ   NSFQYGLNDKYMF DSIKYLE MQQPFYT
Sbjct: 376 VGTFWNRNNAYKQWGYNYFFDSSYFSKQNSKNSFQYGLNDKYMFKDSIKYLEQMQQPFYT    435

Query: 421 KFITVSNHYPYTSLKGESDEEGFPLAKTNDETINGYFATANYLDTALKSFFEYLKAAGVY    480
           KFITVSNHYPYTSLKGES EEGFPLAKT+DETINGYFATANYLD ALKSFF+YLKA G+Y
Sbjct: 436 KFITVSNHYPYTSLKGESSEEGFPLAKTDDETINGYFATANYLDAALKSFFDYLKATGLY    495

Query: 481 DNSIIVMYGDHYGISNTRNPSLAELLGKDPETWSEYDNAMLQRVPYMIHIPGYSKGFISN    540
           DNSI V+YGDHYGISN+RN SLA LLGKD ETWSEYDNAMLQRVPYMIHIPGY+ G I
Sbjct: 496 DNSIFVLYGDHYGISNSRNSSLAPLLGKDSETWSEYDNAMLQRVPYMIHIPGYTNGSIKE    555

Query: 541 TYGGEVDNLPTLLHILGIDTSKYTQLGQDLLSKDNKQMVAMRTTGQYITPKYTNYSGHLY    600
           T+GGE+D LPTLLHILGIDTS++ QLGQDLLS  N Q+VA RT+G Y+TP+YTNYSG LY
Sbjct: 556 TFGGEIDALPTLLHILGIDTSQFVQLGQDLLSPQNSQIVAQRTSGTYMTPEYTNYSGRLY    615

Query: 601 YTDSGQEITNPDETTKAEIKAIRDATNKQLSTSDSIQTGDLLRFDENNGLKTVEVEKFNY    660
             T +G  EITNPDE T A+ K IR A +QL+ SD+IQTGDLLRFD  NGLK ++   +F Y
```

```
                            -continued
Sbjct: 616 NTQTGLEITNPDEMTIAKTKEIRSAVAQQLAASDAIQTGDLLRFDTQNGLKAIDPNQFIY 675

Query: 661 THSLKALKAKERKLKDRSTSIYSKHNNKSTVDLFHAPSYLELQDPNKTHKTSK       713
           T  LK LK      KL   STS+YSK+ +KST  LF APSYLEL        TS+
Sbjct: 676 TKQLKQLKDISAKLGSESTSLYSKNGHKSTQKLFKAPSYLELNPVEADAATSE       728
```

A related GBS gene <SEQ ID 8619> and protein <SEQ ID 8620> were also identified. Analysis of this protein sequence reveals the following:

```
Lipop Possible site: -1 Crend: 9
McG: Discrim Score: 12.63
GvH: Signal Score (-7.5): -2.99
Possible site: 30
>>> Seems to have an uncleavable N-term signal seq
ALOM program count: 5 value: -6.85 threshold: 0.0
INTEGRAL Likelihood = -6.85 Transmembrane 129-145 (126-152)
INTEGRAL Likelihood = -4.88 Transmembrane  48-64  (46-69)
INTEGRAL Likelihood = -4.83 Transmembrane  75-91  (74-97)
INTEGRAL Likelihood = -4.62 Transmembrane  16-32  (15-34)
INTEGRAL Likelihood = -2.28 Transmembrane 163-179 (163-182)
PERIPHERAL  Likelihood = 3.76  103
modified ALOM score: 1.87

*** Reasoning Step: 3

----- Final Results -----
            bacterial membrane  --- Certainty = 0.3739 (Affirmative) < succ>
             bacterial outside  --- Certainty = 0.0000 (Not Clear)   < succ>
              bacterial cytoplasm --- Certainty = 0.0000 (Not Clear) < succ>
```

The protein has homology with the following sequences in the databases:

```
45.2/63.1% over 643aa
Bacillus subtilis
EGAD|107893| hypothetical protein Insert characterized
GP|2116767|dbj|BAA20118.1||D86418 YfnI Insert characterized
GP|2633039|emb|CAB12545.1||Z99107 alternate gene name: yetP~similar to hypothetical
proteins Insert characterized
PIR|D69815|D69815 conserved hypothetical protein yfnI - Insert characterized ORF00125 (286-2280 of 2742)
EGAD|1078|||  S0726(3-646 of 653) hypothetical protein {acillus subtilis}
GP|2116767|dbj| AA20118.1||D86418 YfnI {acillus subtilis} GP|2633039|emb|CA
12545.1||Z99107 alternate gene name: yetP~similar to hypothetical proteins {acillus
subtilis} PIR|D69815|D69815 conserved hypothetical protein yfnI - acillus subtilis
% Match = 28.5
% Identity = 45.1  % Similarity = 63.1
Matches = 297  Mismatches = 227  Conservative Sub.s = 118

36         66         96        126        156        186        216        246
FVVKDRPSLRIDLTVKKVEPTG*LNWYQNLFFPVTEHLI*FFFQRQNSL*VYS*TVL*QIFIFFHTEFDLSLPYVTKFYV 276        306        336        366        396        426        456        486
II*SEILSLGKKLKEVPTVKKIKDFASRAINTRLGFILLLVVIYWLKTIWAYHTDFNLGLENSYQLFLTIINPIPLGLLI
                :|:    ||::    :  :|   |:|  | :::|   ||  :||||||:: :  |  |  ||     ::
              MNEELKVFKKVEVAMKKLFSYKLSFFVLAVILFWAKTYLSYKTEFNLGVKGTTQEILLIFNPFSSAVFF
                 10         20        30          40         50        60

516        546        576        606        636        666        696        726
IGLALYVKRTKAFYITAFITYAIVNILLIANAIYYREFSDFITVSAVLASSKTSAGLGDSALNLLRIWDLVYVFDFIILI
:||||  |   |:     |    | :  ::  ||  ::||  ||:: :     :||  ::::  |:  | :| ||||
LGLALLAKGRKSAIIMLIIDF-LMTFVLYANILFYRFFDDFLTFPNI-KQSGNVGNMGDGIFSIMAGHDIFYFLDIIILI
                 80         90        100       110        120       130       140

756        786        843        873        903        933        963
FLFATKKIHLDDRPFNKRASFSITALSGL-LFSINLFLAEIDRPELLSRGFSNTYIVKALGPSFSIYSGNQTYQAQKER
      :  |  :      ||   |:  |||:  || |||  || |||:|:|:   |||  ||  :::  |  |  :  :|
-AVLIWRPELKEYKMKKR-FASLVILSGIALFFINLHYAEKDRPQLLTRTFDRNYIVKYLGLYNYTIYDGVQTAQTETQR
                   160        170        180        190       200        210       220

993       1023       1053       1083       1113       1143       1173       1200
NGATAQELATAKKYVAEHYAKPNPEYYGIGKGRNVIMIHLESFQQFLIDYKLNIDGKEHVVTPFINSLYHSKETVS-FSN
|:: :|  : :  |    |||||| |:|  || ::|:| |||||||||||  ||||:| |:||    || | | |: | |
AYASSDDLTSVENYTTSHYAKPNAEYFGSAKGKNIIKIHLESFQSFLIDYKLN----GEEVTPFLNKLAHGGEDVTYPDN
            240        250        260        270         280        290       300

1230       1260       1290       1320       1350       1380       1410       1440
FFHQVKAGKTSDAETLMENSLFGLSSGSFMVNYGGENTQFAAPHILAQNGGYSSAVFHGNVGTFWNRNNAYKQWGYDYFF
||||  ||||||||||| ::|:|||     ||     :|||  :  | | ||:||| ||| :||: ::||:  |||| ||
FFHQTGQGKTSDAELTMDNSIFGLPEGSAFVT-KGENTYQSLPAILDQKEGYTSAVLHGDYKSFWNRDQIYKHIGYDKFF
           320        330        340        350        360        370       380
```

-continued

```
1470       1500       1530       1560       1590       1620       1650       1680
DSSYFSKQTKDNSFQYGLNDKYMFADSIKYLEHMQQPFYTKFITVSNHYPYTSLKGESDEEGFPLAKTNDETINGYFATA
|:|        : :|       || ||    |:||   ||  ::||||    :||::||||:  :|    |  |     :    |    |  |::   || ||
DAS-TYDMSDENVINMGLKDKPFFTESIPKLESLKQPFYAHLITLTNHYPF-NLD-EKDAS-LKKATTGDNTVDSYFQTA
           390        400       410       420       430           440          450

1710       1740       1770       1800       1830       1860       1890       1920
NYLDTALKSFFEYLKAAGVYDNSIIVMYGDHYGISNTRNPSLAELLGKDPETWSEYDNAMLQRVPYMIHIPGYSKGFISN
 ||| ||:   ||:  || ||:|||||:|::||||  |||       | :: |:|||         ::|  ||    |||| || :||  | :::
RYLDEALEQFFKELKEAGLYDNSVIMIYGDHNGISENHNRAMKEILGK---EITDYQNAQNQRVPLMIRVPG-KKGGVNH
           470        480       490       500       510        520           530

1950       1980       2010       2040       2070       2100       2130       2160
TYGGEVDNLPTLLHILGIDTSKYTQLGQDLLSKDNKQMVAMRTTGQYITPKYTNYSGHLYYTDSGQEITNPDETTKAEIK
|||||:| :||||| |||: ||    :| ||:|||:       ||| |  |::||||:      :|  :| :|:::       || |
TYGGEIDVMPTLLHLEGIDSQKYINFGTDLFSKDHDDTVAFR-NGDFVTPKYTSVDNIIYDTKTGEKL-----KANEETK
           550       560        570        580        590            600

2190       2220       2250       2280       2310       2340       2370       2400
AIRDATNKQLSTSDSIQTGDLLRFDENNGLKTVEVEKFNYTHSLKALKAKERKLKDRSTSIYSKHNNKSTVDLFHAPSYL
  ::       |:|||  |||:    |||||  :    |  :|   |:         ::|
NLKTRVNQQLSLSDSVLYKDLLRFHKLNDFKAVDPSDYHYGKEKEIK
           620       630        640       650
```

Based on this analysis, it was predicted that these proteins and their epitopes could be useful antigens for vaccines or diagnostics.

EXAMPLE 613

A DNA sequence (GBSx0653) was identified in *S. agalactiae* <SEQ ID 1903> which encodes the amino acid sequence <SEQ ID 1904>. This protein is predicted to be 50S ribosomal protein L20 (rplT). Analysis of this protein sequence reveals the following:

```
Possible site: 37
>>> Seems to have no N-terminal signal sequence

----- Final Results -----
            bacterial cytoplasm --- Certainty = 0.3392 (Affirmative) < succ>
            bacterial membrane  --- Certainty = 0.0000 (Not Clear)   < succ>
             bacterial outside  --- Certainty = 0.0000 (Not Clear)   < succ>
```

A related GBS nucleic acid sequence <SEQ ID 9387> which encodes amino acid sequence <SEQ ID 9388> was also identified.

The protein has homology with the following sequences in the GENPEPT database:

```
>GP: CAB14845 GB: Z99118 ribosomal protein L20 [Bacillus subtilis]
Identities = 70/89 (78%), Positives = 78/89 (86%)

Query:   1 MFRTAKEQVMNSYYYAYRDRRQKKRDFRKLWITRINAAARMNGLSYSQLMHGLKLAEIEV    60
           +++ A +QVM S   YA+RDRRQKKRDFRKLWITRINAAARMNGLSYS+LMHGLKL+ IEV
Sbjct:  31 LYKVANQQVMKSGNYAFRDRRQKKRDFRKLWITRINAAARMNGLSYSRLMHGLKLSGIEV    90

Query:  61 NRKMLADLAVNDAAAFTALADAAKAKLGK                                 89
           NRKMLADLAVND  AF  LADAAKA+L K
Sbjct:  91 NRKMLADLAVNDLTAFNQLADAAKAQLNK                                119
```

A related DNA sequence was identified in *S. pyogenes* <SEQ ID 1905> which encodes the amino acid sequence <SEQ ID 1906>. Analysis of this protein sequence reveals the following:

```
Possible site: 27
>>> Seems to have no N-terminal signal sequence
INTEGRAL Likelihood = -0.06 Transmembrane 94-110 (94-110)

----- Final Results -----
             bacterial membrane --- Certainty = 0.1022 (Affirmative) < succ>
              bacterial outside --- Certainty = 0.0000 (Not Clear)   < succ>
            bacterial cytoplasm --- Certainty = 0.0000 (Not Clear)   < succ>
```

An alignment of the GAS and GBS proteins is shown below:

```
Identities = 87/89 (97%), Positives = 88/89 (98%)

Query:   1 MFRTAKEQVMNSYYYAYRDRRQKKRDFRKLWITRINAAARMNGLSYSQLMHGLKLAEIEV   60
           +FRTAKEQVMNSYYYAYRDRRQKKRDFRKLWITRINAAARMNGLSYSQLMHGLKLAEIEV
Sbjct:  31 LFRTAKEQVMNSYYYAYRDRRQKKRDFRKLWITRINAAARMNGLSYSQLMHGLKLAEIEV   90

Query:  61 NRKMLADLAVNDAAAFTALADAAKAKLGK                                 89
           NRKMLADLAV DAAAFTALADAAKAKLGK
Sbjct:  91 NRKMLADLAVADAAAFTALADAAKAKLGK                                119
```

Based on this analysis, it was predicted that these proteins and their epitopes could be useful antigens for vaccines or diagnostics.

EXAMPLE 614

A DNA sequence (GBSx0654) was identified in *S. agalactiae* <SEQ ID 1907> which encodes the amino acid sequence <SEQ ID 1908>. Analysis of this protein sequence reveals the following:

```
Possible site: 21
>>> Seems to have an uncleavable N-term signal seq
INTEGRAL Likelihood = -0.64 Transmembrane 32-48 (32-48)
INTEGRAL Likelihood = -0.32 Transmembrane  3-19 (3-19)

----- Final Results -----
         bacterial membrane --- Certainty = 0.1256 (Affirmative) < succ>
          bacterial outside --- Certainty = 0.0000 (Not Clear)   < succ>
        bacterial cytoplasm --- Certainty = 0.0000 (Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 615

A DNA sequence (GBSx0655) was identified in *S. agalactiae* <SEQ ID 1909> which encodes the amino acid sequence <SEQ ID 1910>. Analysis of this protein sequence reveals the following:

```
Possible site: 33
>>> Seems to have a cleavable N-term signal seq.
INTEGRAL Likelihood = -12.63  Transmembrane 747-763 (743-772)
INTEGRAL Likelihood = -12.52  Transmembrane 840-856 (835-856)
INTEGRAL Likelihood = -11.20  Transmembrane 447-463 (440-466)
INTEGRAL Likelihood =  -5.79  Transmembrane 351-367 (346-372)
INTEGRAL Likelihood =  -4.25  Transmembrane 517-533 (516-537)
INTEGRAL Likelihood =  -1.49  Transmembrane 397-413 (396-413)
INTEGRAL Likelihood =  -0.96  Transmembrane 799-815 (799-817)

----- Final Results -----
         bacterial membrane --- Certainty = 0.6052 (Affirmative) < succ>
          bacterial outside --- Certainty = 0.0000 (Not Clear)   < succ>
        bacterial cytoplasm --- Certainty = 0.0000 (Not Clear)   < succ>
```

A related GBS nucleic acid sequence <SEQ ID 9349> which encodes amino acid sequence <SEQ ID 9350> was also identified.

The protein has homology with the following sequences in the GENPEPT database:

```
>GP: AAB89436 GB: AE000977 A. fulgidus predicted coding region AF1820
[Archaeoglobus fulgidus]
Identities = 100/483 (20%), Positives = 210/483 (42%),
Gaps = 61/483 (12%)

Query: 351 LFPIILYLVAALVTLTTMTRFVEEERTNAGILKALGYSDRQVIFKFIIYGFIAGTLGTTL   410
           LFP      LV+   +T    ++R    + N  +++ALG++  +++  ++  Y  +  G   +T
```

-continued

```
Sbjct: 276 LFPAFFILVSIFMTYALLSRIFRLQLGNIAVMRALGFTRNEIMLHYLQYPLLMGFFASTA 335

Query: 411 GIIGGHYLLPRIISDIISKDLTIPNTQYHLFLNYSLLAFVFSLLSIVLPVFVI------- 463
           G++ G +   + S I+ L +P      L    L+ +   L+ +   F++
Sbjct: 336 GLVAGFFASQLLTSQYIT-FLNLPYYVSKPHLEVYSLSLMAGTLTPTISGFLVAYQASRV 394

Query: 464 ----TRRELKEKAAFLLLPKPPAKGSKIALEYINWIWKKLSFTQKVTARNIFRYKQRMIM 519
               R    E AA  + +  A  S+I      W    ++    ++  RNIFR K+R  +
Sbjct: 395 DIVKALRGYAEVAAVSFIARIDALFSRI------W---RMRLIFRLALRNIFRSKRRTAI 445

Query: 520 TIFGVAGSVALLFSGLGIQSSLKQTVNEHFGRIMPYDILLTYNTNASPPKILELLSKDSK 579
           +IF +    +L+ + +   S   +    FG++ YDI ++              E+L K  K
Sbjct: 446 SIFSIVACTSLILNSMVFVDSFDYVMQLQFGKVYAYDIKVSLEGYDK----EVLEKVRK 501

Query: 580 IDKY--------QPIHLENLDESIPGQINKQSISLFITDKKQLLPFIYLQEATTNKSLHL 631
           +D           PI++E   E++P       +L I   Q L  +Y E          +
Sbjct: 502 MDGVLFAEPAVEMPIYVEKGGEAVP--------TLLIASNFQTLYNVYNAEG----EKLI 549

Query: 632 NNKGIIISKKLAQFYHVNTGDFIHL------SHSQTLPSRKLKITGVVNANVGHYIFMTK 685
           ++GII SK  +     + G+ + +           ++      +  + V   A++
Sbjct: 550 PSEGIIFSKTAMKNLSLVEGEKVSVYTEFGKLEAEVEDVEMIPLLSVATASL-------- 601

Query: 686 QYYRTIFKKEAKDNAFLVKLTKHKIANNLAEKLLEINGVESLTQNALQLASVEAVVRSLD 745
           Y+  I   +   N  +V    + +IA  +AEK+  +++GV+  ++         S+E  ++
Sbjct: 602 DYFSRISGVDG-FNRIVVDADEGRIA-EIAEKIRQMDGVKKVSTVIEAQESIEELMGFFY 659

Query: 746 GSMTILVVVSLLLAIVILYNLTNINLAERKRELSTIKVLGFYNEEVTLYIYRETIILSTI 805
            +        + L       ++N T+I++ ER REL+T+++LG+ + E+  +  E + ++  +
Sbjct: 660 AFIAFSLFFGVSLGFAAVFNTTSISVIERSRELATLRMLGYTSREIIISLILENLFVAIL 719

Query: 806 GVI                                                        808
           G++
Sbjct: 720 GLV                                                        722
```

A related DNA sequence was identified in *S. pyogenes* 30 <SEQ ID 1911> which encodes the amino acid sequence <SEQ ID 1912>. Analysis of this protein sequence reveals the following:

```
Possible site: 34
>>> Seems to have no N-terminal signal sequence
      INTEGRAL    Likelihood = -14.33    Transmembrane    749-765 (739-775)
      INTEGRAL    Likelihood = -10.88    Transmembrane    845-861 (834-865)
      INTEGRAL    Likelihood =  -6.64    Transmembrane    350-366 (344-369)
      INTEGRAL    Likelihood =  -6.53    Transmembrane     22-38  (19-42)
      INTEGRAL    Likelihood =  -6.32    Transmembrane    520-536 (515-537)
      INTEGRAL    Likelihood =  -4.99    Transmembrane    446-462 (445-465)
      INTEGRAL    Likelihood =  -2.92    Transmembrane    396-412 (395-413)
      INTEGRAL    Likelihood =  -0.80    Transmembrane    800-816 (800-819)

----- Final Results -----
            bacterial membrane  --- Certainty = 0.6731(Affirmative) < succ>
            bacterial outside   --- Certainty = 0.0000(Not Clear)   < succ>
            bacterial cytoplasm --- Certainty = 0.0000(Not Clear)   < succ>
```

The protein has homology with the following sequences in the databases:

```
>GP: AAB89436 GB: AE000977 A. fulgidus predicted coding region AF1820
[Archaeoglobus fulgidus]
Identities = 101/542 (18%), Positives = 237/542 (43%),
Gaps = 42/542 (7%)

Query: 350 IFPVVLYLVAALVAFTTMTRYVDEERTSSGLLKAIGYSNKDISLKFLIYGLLASFLGTTL 409
           +FP      LV+ + +  ++R  + +  +++A+G++  +I L +L Y LL   F  +T
Sbjct: 276 LFPAFFILVSIFMTYALLSRIFRLQLGNIAVMRALGFTRNEIMLHYLQYPLLMGFFASTA 335

Query: 410 GIIGGTYLLSTLISEILTGA---LTIGKTHLYSYWFYNGIAYLLAMLSAVLPAYLIVKKE 466
           G++ G +    L S+ +T      + K HL  Y         L  +S   L AY  + +
Sbjct: 336 GLVAGFFASQLLTSQYITFLNLPYYVSKPHLEVYSLSLMAGTLTPTISGFLVAYQASRVD 395

Query: 467 LFLN--------AAQLLLPKPPSKGAKIWLEHLTFVWKALSFTHKVTIRNIFRYKQRMLT 519
           +            AA  + +  + ++IW   L F      ++  +RNIFR K+R  ++
Sbjct: 396 IVKALRGYAEVAAVSFIARIDALFSRIWRMRLIF--------RLALRNIFRSKRRTAIS 446
```

-continued

```
Query: 520 IVGVAGSVALLFAGLGIQSSLAKVVEHQFGDLTTYDILAVGSAKATATEQTDLASYLKQE 579
            I +   +L+  +    S  V++ QFG + YDI            + L  Y  +E
Sbjct: 447 IFSIVACTSLILNSMVFVDSFDYVMQLQFGKVYAYDI------------KVSLEGYDGKE 494

Query: 580 PITGYQKVSYASLTLPVKGLP---DKQSISILSSS-ATSLSPYFNLLDSQEKKVPIPTS 635
             + +K+       P  +P +K  ++ +    A++      +N+ +++ +K   IP+
Sbjct: 495 VLEKVRKMDGVLFAEPAVEMPIYVEKGGEAVPTLLIASNFQTLYNVYNAEGEKL--IPSE 552

Query: 636 GVLISEKLASYYKVKPGDQLVLTDRKGQSYKVTIKQVIDMTVGHYLIMSDTYFKNHFKGL 695
            G++ S+     +    G+++ +    G+    ++ ++      L+   T  ++F   +
Sbjct: 553 GIIFSKTAMKNLSLVEGEKVSVYTEFGK-----LEAEVEDVEMIPLLSVATASLDYFSRI 607

Query: 696 EAAPAYLIKVKDKSKHIKETASDLLTLKAIRAVSQNVNHIKSVQLVVTSLNQVMTLLVF 755
                    +  V D D    I E A + +  ++ VS +   +S++ ++      +   +F
Sbjct: 608 SGVDGFNRIVVDADEGRIAEIAEKIRQMDGVKKVSTVIEAQESIEELMGFFYAFIAFSLF 667

Query: 756 LSILLAIVILYNLTTINIAERIRELSTIKVLGFYDQEVTLYIYRETISLSLVGILLGIYL 815
             + L     ++N T+I++  ER REL+T+++LG+  +E+ + +  E + ++++G++   + +
Sbjct: 668 FGVSLGFAAVFNTTSISVIERSRELATLRMLGYTSREIIISLILENLFVAILGLVFALPI 727

Query: 816 GKGLHTYIMTMISTGDIQFGVKVDAYVYLVPILVILSLLAVLGIWVNRHLKKVDMLEALK 875
              + +    +        + +       +     +L +   +++ + +  R + ++D+ +    K
Sbjct: 728 AYSTAYFFFSSFESELYYMPMVIYPRTFAATVLAVFAIILLALLPSARRVSEMDIAKVTK 787

Query: 876 SI                                                            877
            I
Sbjct: 788 EI                                                            789
```

An alignment of the GAS and GBS proteins is shown below:

```
Identities = 377/857 (43%), Positives = 543/857 (62%), Gaps = 7/857 (0%)

Query:   3 KTFWKDIYRSITTSKGRFSSILLLMMLGSFAFIGLKVSAPNMQRTAQNYLAHHHVMDITV  62
           KT WKDI R+I  SKGRF S+  LM LGSFA +GLKV+ P+M+RTA  YL H  VMD+TV
Sbjct:   4 KTLWKDILRAIKNSKGRFISLFFLMALGSFALVGLKVTGPDMERTASRYLERHQVMDLTV  63

Query:  63 FNSWGLDKHDQTVLESLKGSQVEFSYFVDTTPQQNSKSYRLYSNTKTISTFDLVKGRLPL 122
           S    + D+   L++LKG+ +E+   +D + N KS RLYS  K +S    LVKG  P
Sbjct:  64 LASHQFSQADKQELDTLKGAHLEYGHLLDVSLTSNQKSLRLYSVPKKVSKPVLVKGSWPK 123

Query: 123 NKSEIALSFQERKKYAIGDKINFKQDKNKLFSNTGPLTIVGFVNSTEIWSKTNLGSSQTG 182
           ++++ LS   K Y IGD++        L + T   +VGF NS+E+WSK+NLGSS TG
Sbjct: 124 RETDLVLSSSLAKNYQIGDELAVTSPMEGLLTTTH-FQVVGFANSSEVWSKSNLGSSSTG 182

Query: 183 DGDLDSYGVLDKTAFHSPVYTMARVTFKDLRLINPFSISYKEKVAKYQEKVSRKLNIHNK 242
           DG L +Y ++    F S  + R+ F  LRL N FS  Y+++V + Q   +    L  + +
Sbjct: 183 DGSLYAYAFVNPNVFKS-AFNLLRIRFSHLRLTNAFSKDYQKRVTQNQAHLDNLLKDNGQ 241

Query: 243 IRYTKTKKESLRKIDEEEKSLLKAQKQINRLDNDSLAMPLSQRQAIQMKIKQDRLSLLKR 302
            RY  + +    +L K  ++ +  +     +  S Q  + +I+Q + +L  K
Sbjct: 242 KRYDDLQNQYDLALKNGRAALAKETVKLAASEENLTFLEGSALQEAKHQIEQGKQALAKE 301

Query: 303 TKELLKLRHNTQIMESPQIIVYNRTTFPGGQGYNTFDSSTNSTSKISNLFPIILYLVAAL 362
           K+L +++    +E P  + YNR+T PGG+GY+T+ +ST S S + N+FP++LYLVAAL
Sbjct: 302 EKQLEQVQATKDKLEKPSYLTYNRSTLPGGEGYHTYATSTTSISNVGNIFPVVLYLVAAL 361

Query: 363 VTLTTMTRFVEEERTNAGILKALGYSDRQVIFKFIIYGFIAGTLGTTLGIIGGHYLLPRI 422
           V   TTMTR+V+EERT++G+LKA+GYS++  + KF+IYG +A  LGTTLGIIGG YLL  +
Sbjct: 362 VAFTTMTRYVDEERTSSGLLKAIGYSNKDISLKFLIYGLLASFLGTTLGIIGGTYLLSTL 421

Query: 423 ISDIISKDLTIPNTQYHLFLNYSLLAFVFSLLSIVLPVFVITRRELKEKAAFLLLPKPPA 482
            IS+I++  LTI  T  + Y+  +A++  ++LS VLP ++I ++EL    AA LLLPKPP+
Sbjct: 422 ISEILTGALTIGKTHLYSYWFYNGIAYLLAMLSAVLPAYLIVKKELFLNAAQLLLPKPPS 481

Query: 483 KGSKIALEYINWIWKKLSFTQKVTARNIFRYKQRMIMTIFGVAGSVALLFSGLGIQSSLK 542
           KG+KI LE++  +WK LSFT KVT RNIFRYKQRM MTI GVAGSVALLF+GLGIQSSL
Sbjct: 482 KGAKIWLEHLTFVWKALSFTHKVTIRNIFRYKQRMLMTIVGVAGSVALLFAGLGIQSSLA 541

Query: 543 QTVNEHFGRIMPYDILLTYNTASPPKILELLS--KDSKIDKYQPIHLENLDESIPGQIN 600
             + V   FG + YDIL   A+ + +LS K   I YQ +  +L  + G +
Sbjct: 542 KVVEHQFGDLTTYDILAVGSAKATATEQTDLASYLKQEPITGYQKVSYASLTLPVKGLPD 601

Query: 601 KQSISLFITDKKQLLPFIYLQEATTNKSLHLNNKGIIISKKLAQFYHVNTGDFIHLSHSQ 660
           KQSIS+ +    L P+  L ++       K  +      G++IS+KLA +Y V  GD + L+ +
Sbjct: 602 KQSISILSSSATSLSPYFNLLDSQEQKKVPIPTSGVLISEKLASYYKVKPGDQLVLTDRK 661
```

-continued

```
Query:  661 TLPSRKLKITGVVNANVGHYIFMTKQYYRTIFKKEAKDNAFLVKL--TKHKIANNLAEKL  718
              S K+  I  V++  VGHY+ M+   Y++   FK       A+L+K+        K    A  L
Sbjct:  662 G-QSYKVTIKQVIDMTVGHYLIMSDTYFKNHFKGLEAAPAYLIKVKDKSKHIKETASDL  720

Query:  719 LEINGVESLTQNALQLASVEAVVRSLDGSMTILVVVSLLLAIVILYNLTNINLAERKREL  778
              L +  + +++QN   + SV+ VV SL+   MT+LV +S+LLAIVILYNLT IN+AER REL
Sbjct:  721 LTLKAIRAVSQNVNHIKSVQLVVTSLNQVMTLLVFLSILLAIVILYNLTTINIAERIREL  780

Query:  779 STIKVLGFYNEEVTLYIYRETIILSTIGVILGTISGTYLHRQMMLLIGSDQILFGEKVSP  838
              STIKVLGFY++EVTLYIYRETI LS +G++LG    G   LH  +M +I +  I FG KV
Sbjct:  781 STIKVLGFYDQEVTLYIYRETISLSLVGILLGIYLGKGLHTYIMTMISTGDIQFGVKVDA  840

Query:  839 TTFIIPISVVVIILXXL                                            855
              +++PI V++ +L   L
Sbjct:  841 YVYLVPILVILSLLAVL                                            857
```

Based on this analysis, it was predicted that these proteins and their epitopes could be useful antigens for vaccines or diagnostics.

EXAMPLE 616

A DNA sequence (GBSx0656) was identified in *S. agalactiae* <SEQ ID 1913> which encodes the amino acid sequence <SEQ ID 1914>. This protein is predicted to be ABC transporter, ATP-binding protein. Analysis of this protein sequence reveals the following:

```
Possible site: 60
>>> Seems to have no N-terminal signal sequence

----- Final Results -----
            bacterial cytoplasm --- Certainty = 0.2757 (Affirmative) < succ>
             bacterial membrane --- Certainty = 0.0000 (Not Clear)   < succ>
              bacterial outside --- Certainty = 0.0000 (Not Clear)   < succ>
```

The protein has homology with the following sequences in the GENPEPT database:

```
>GP: AAB89431 GB: AE000977 ABC transporter, ATP-binding protein
[Archaeoglobus fulgidus]
Identities = 112/230 (48%), Positives = 167/230 (71%)

Query:    4 IEMKHSYKRYQTGETEIVANNDISFSIERGELVVILGASGAGKSTVLNILGGMDSNSEGE   63
             + ++  +K YQ G+ E+ A   I+   IERGE +V+LG SG GK+T+LNI+GG+D   + G
Sbjct:    2 LRLEDVWKVYQMGKVEVSALRGINLEIERGEFMVVLGPSGCGKTTMLNIIGGIDRPTRGR   61

Query:   64 VLIDGKNIANYTIRELTRYRRYDVGFVFQFYNLVPNLTALENVELASEIVPKALDAQQAL  123
             V+ DGK+I NY    LT +RR +VGF +FQF+NL+P LTA ENVE+A+++V     D  + L
Sbjct:   62 VIFDGKDITNYNEDRLTMHRRNNVGFIFQFFNLIPTLTARENVEIAADLVESPRDVDEVL  121

Query:  124 ENVGLGHRINHFPAQLSGGEQQRVAIARAIAKKPKLLLCDEPTGALDYQTGKQVLAILQK  183
              + VGL  R  HFPA+LSGGEQQRVAIARA+  K P  ++L DEPTG+LD++TGK VL ++++
Sbjct:  122 KMVGLADRAEHFPAELSGGEQQRVAIARALVKNPPIILADEPTGSLDFETGKAVLKVMRE  181

Query:  184 MAQSKETTVIIVTHNTALAPIANRVIHMHDSKISDIVINENPSDIQNIEY           233
              + + +  T ++VTHN+A+A IA+RV+++ D K+    +   N +P+D    I++
Sbjct:  182 INRKEGITFVLVTHNSAIAAIADRVVYLRDGKVERVERNLHPADPDEIQW           231
```

There is also homology to SEQ ID 1354.

Based on this analysis, it was predicted that this protein and its epitopes, could be useful antigens for vaccines or diagnostics.

EXAMPLE 617

A DNA sequence (GBSx0657) was identified in *S. agalactiae* <SEQ ID 1915> which encodes the amino acid sequence <SEQ ID 1916>. This protein is predicted to be DNA topoisomerase I (topA). Analysis of this protein sequence reveals the following:

```
Possible site: 34
>>> Seems to have no N-terminal signal sequence

----- Final Results -----
            bacterial cytoplasm --- Certainty = 0.4716 (Affirmative) < succ>
            bacterial membrane  --- Certainty = 0.0000 (Not Clear)   < succ>
             bacterial outside  --- Certainty = 0.0000 (Not Clear)   < succ>
```

A related GBS nucleic acid sequence <SEQ ID 9821> which encodes amino acid sequence <SEQ ID 9822> was also identified.

The protein has homology with the following sequences in the GENPEPT database:

```
>GP: CAB13485 GB: Z99112 DNA topoisomerase I [Bacillus subtilis]
Identities = 442/690 (64%), Positives = 535/690 (77%), Gaps = 10/690 (1%)

Query:  27 LVIVESPAKAKTIEKYLGRNYKVVASVGHIRDLKKSSMSIDFENNYEPQYINIRGKGPLI   86
           LVIVESPAKAKTIE+YLG+ YKV AS+GH+RDL KS M +D E N+EP+YI IRGKGP++
Sbjct:   5 LVIVESPAKAKTIERYLGKKYKVKASMGHVRDLPKSQMGVDIEQNFEPKYITIRGKGPVL   64

Query:  87 NDLKKEAKKAKKVYLASDPDREGEAISWHLAHILDLDKEDRNRVVFNEITKDAVKNAFVE  146
           +LK  AKKAKKVYLA+DPDREGEAI+WHLAH LDLD     RVVFNEITKDA+K +F
Sbjct:  65 KELKTAAKKAKKVYLAADPDREGEAIAWHLAHSLDLDLNSDCRVVFNEITKDAIKESFKH  124

Query: 147 PRQINMDLVDAQQARRVLDRIVGYSISPILWKKVKKGLSAGRVQSVALKLIIDRENEIKA  206
           PR INMDLVDAQQARR+LDR+VGY ISPILWKKVKKGLSAGRVQSVAL+LIIDRE EI
Sbjct: 125 PRMINMDLVDAQQARRILDRLVGYKISPILWKKVKKGLSAGRVQSVALRLIIDREKEIND  184

Query: 207 FQPEEYWTIDGSFKKGTRKFNATFYGLDGKKFKLSNNEDVKTVLKRIKTDEFLVEKVEKK  266
           F+PEEYWTIDG+F KG   F A+F+G +GKK L++  DVK +L ++K +++ VEKV KK
Sbjct: 185 FKPEEYWTIDGTFLKGQETFEASFFGKNGKKLPLNSEADVKEILSQLKGNQYTVEKVTKK  244

Query: 267 ERRRNAPLPYTTSSLQQDAANKINFRTRKTMMIAQQLYEGLSLGTAGHQGLITYMRTDST  326
           ER+RN  LP+TTS+LQQ+AA K+NFR +KTMMIAQQLYEG+ LG  G  GLITYMRTDST
Sbjct: 245 ERKRNPALPFTTSTLQQEAARKLNFRAKKTMMIAQQLYEGIDLGREGTVGLITYMRTDST  304

Query: 327 RISPLAQNEATEFITNRFGANYSKHGNK-VKNASGAQDAHEAIRPSSVNHTPESIAKYLD  385
           RIS  A +EA  FI   +G +      K   K     AQDAHEAIRP+SV   P   L
Sbjct: 305 RISNTAVDEAAAFIDQTYGKEFLGGKRKPAKKNENAQDAHEAIRPTSVLRKPSELKAVLG  364

Query: 386 KDQLKLYTLIWNRFIASQMTAAVFDTMKVNLTQNGVTFIANGSQVKFDGYMAVYND----  441
           +DQ++LY LIW RF+ASQM  AV DTM V+LT NG+TF ANGS+VKF G+M VY +
Sbjct: 365 RDQMRLYKLIWERFVASQMAPAVLDTMSVDLTNNGLTFRANGSKVKFSGFMKVYVEGKDD  424

Query: 442 --TDKNKMLPDMEEGESVKKVNTNPEQHFTQPPARFSEASLIKTLEENGVGRPSTYAPTL  499
             +K++MLPD++EG+V    +   PEQHFTQPP R++EA L+KTLEE G+GRPSTYAPTL
Sbjct: 425 QMEEKDRMLPDLQEGDTVLSKDIEPEQHFTQPPPRYTEARLVKTLEERGIGRPSTYAPTL  484

Query: 500 ETIQKRYYVKLAAKRFEPTELGEIVNSLIVEFFPDIVDVTFTAEMEGKLDEVEIGKEQWQ  559
           +TIQ+R YV L  KRF PTELG+IV  LI+EFFP+I++V FTA+ME  LD VE G  +W
Sbjct: 485 DTIQRRGYVALDNKRFVPTELGQIVLDLIMEFFPEIINVEFTAKMERDLDHVEEGNTEWV  544

Query: 560 KIIDEFYKPFEKELAKAETEMEKIQIKDEPAGFDCELCGSPMVIKLGRYGKFYACSNFPE  619
           KIID FY   FEK + KAE+EM++++I+ E AG DCELC SPMV K+GRYGKF ACSNFP+
Sbjct: 545 KIIDNFYTDFEKRVKKAESEMKEVEIEPEYAGEDCELCSSPMVYKMGRYGKFLACSNFPD  604

Query: 620 CHNTKAITKEIGVICPICQKGQVIERKTKRNRIFYGCDRYPECEFTSWDKPIGRTCPKSN  679
           C NTK I K+IGV CP C +G ++ERK+K+ R+FYGCDRYP+CEF SWDKPI R CPK
Sbjct: 605 CRNTKPIVKQIGVKCPSCGEGNIVERKSKKKRVFYGCDRYPDCEFVSWDKPIERKCPKCG  664
```

```
                              -continued
Query:  680 DFLVEKKVRGGGKQVVCSNEKCDYQEEKIK                          709
            LVEKK++  G QV C  +CDY+EE  K
Sbjct:  665 KMLVEKKLK-KGIQVQC--VECDYKEEPQK                          691
```

A related DNA sequence was identified in *S. pyogenes* <SEQ ID 1917> which encodes the amino acid sequence <SEQ ID 1918>. Analysis of this protein sequence reveals the following:

```
Possible site: 35
>>> Seems to have no N-terminal signal sequence

----- Final Results -----
           bacterial cytoplasm --- Certainty = 0.5445 (Affirmative) < succ>
            bacterial membrane --- Certainty = 0.0000 (Not Clear)   < succ>
             bacterial outside --- Certainty = 0.0000 (Not Clear)   < succ>
```

An alignment of the GAS and GBS proteins is shown below:

```
Identities = 595/704 (84%), Positives = 656/704 (92%), Gaps = 1/704 (0%)

Query:    6 TTTKTSTKKTSKKKSATAKKNLVIVESPAKAKTIEKYLGRNYKVVASVGHIRDLKKSSMS    65
            T  KT TKK++ KK +TAKKNLVIVESPAKAKTIEKYLGR+YKVVASVGHIRDLKKSSMS
Sbjct:    7 TKPKTGTKKSTTKKKSTAKKNLVIVESPAKAKTIEKYLGRSYKVVASVGHIRDLKKSSMS    66

Query:   66 IDFENNYEPQYINIRGKGPLINDLKKEAKKAKKVYLASDPDREGEAISWHLAHILDLDKE   125
            IDF+NNYEPQYINIRGKGPLIN LKKEAK AKKVYLASDPDREGEAISWHL+HIL LD +
Sbjct:   67 IDFDNNYEPQYINIRGKGPLINSLKKEAKAAKKVYLASDPDREGEAISWHLSHILGLDPQ   126

Query:  126 DRNRVVFNEITKDAVKNAFVEPRQINMDLVDAQQARRVLDRIVGYSISPILWKKVKKGLS   185
            D NRVVFNEITKDAVK+AFVEPRQI+MDLVD+QQARRVLDRIVGYSISPILWKKVKKGLS
Sbjct:  127 DNNRVVFNEITKDAVKHAFVEPRQIDMDLVDSQQARRVLDRIVGYSISPILWKKVKKGLS   186

Query:  186 AGRVQSVALKLIIDRENEIKAFQPEEYWTIDGSFKKGTRKFNATFYGLDGKKFKLSNNED   245
            AGRVQSVALKLIIDREN+IKAF P+EYW+IDG FKKGT+KF ATFYG++GKK KL NN D
Sbjct:  187 AGRVQSVALKLIIDRENDIKAFVPKEYWSIDGLFKKGTKKFQATFYGINGKKTKLDNNND   246

Query:  246 VKTVLKRIKTDEFLVEKVEKKERRRNAPLPYTTSSLQQDAANKINFRTRKTMMIAQQLYE   305
            VK VL ++   ++FLV KV+KKERRRNAPLPYTTSSLQQDAANKINFRTRKTMM+AQQLYE
Sbjct:  247 VKEVLAKLTNEDFLVSKVDKKERRRNAPLPYTTSSLQQDAANKINFRTRKTMMVAQQLYE   306

Query:  306 GLSLGTAGHQGLITYMRTDSTRISPLAQNEATEFITNRFGANYSKHGNKVKNASGAQDAH   365
            G+ LG  G QGLITYMRTDSTRISP+AQN+A +FI NRFGANYSKHGN+VKN SG QDAH
Sbjct:  307 GIHLGENGTQGLITYMRTDSTRISPVAQNDAAQFIINRFGANYSKHGNRVKNTSGVQDAH   366

Query:  366 EAIRPSSVNHTPESIAKYLDKDQLKLYTLIWNRFIASQMTAAVFDTMKVNLTQNGVTFIA   425
            EAIRPSSVNHTP+SIAKYL+KDQLKLYTLIWNRF+ASQMTAAVFDT+KVNL QNGV F+A
Sbjct:  367 EAIRPSSVNHTPDSIAKYLNKDQLKLYTLIWNRFVASQMTAAVFDTVKVNLEQNGVIFVA   426

Query:  426 NGSQVKFDGYMAVYNDTDKNKMLPDMEEGESVKKVNTNPEQHFTQPPARFSEASLIKTLE   485
            NGSQ+KFDGYMAVYND+DKNKMLP+M EGE+VKK++T+PEQHFTQPPAR SEA+LIKTLS
Sbjct:  427 NGSQMKFDGYMAVYNDSDKNKMLPEMAEGETVKKISTSPEQHFTQPPARYSEATLIKTLE   486

Query:  486 ENGVGRPSTYAPTLETIQKRYYVKLAAKRFEPTELGEIVNSLIVEFFPDIVDVTFTAEME   545
            ENGVGRPSTYAPTLE IQ+RYYVKL+AKRFEPTELGEIVN LIVEFFPDIVDV FTAEME
Sbjct:  487 ENGVGRPSTYAPTLEVIQRRYYVKLSAKRFEPTELGEIVNKLIVEFFPDIVDVAFTAEME   546

Query:  546 GKLDEVEIGKEQWQKIIDEFYKPFEKELAKAETEMEKIQIKDEPAGFDCELCGSPMVIKL   605
            GKLD+VEIG+EQWQ +ID+FY+PF KEL KAE+E+EKIQIKDEPAGFDC++CG PMVIKL
Sbjct:  547 GKLDQVEIGEEQWQHVIDQFYQPFVKELNKAESEIEKIQIKDEPAGFDCDVCGHPMVIKL   606

Query:  606 GRYGKFYACSNFPECHNTKAITKEIGVICPICQKGQVIERKTKRNRIFYGCDRYPECEFT   665
            GR+GKFYACSNFPEC NTKAITKEIGV CP+C KGQVIERKTK+NRIFYGCD+YP+CEF
Sbjct:  607 GRFGKFYACSNFPECRNTKAITKEIGVTCPVCHKGQVIERKTKKNRIFYGCDQYPDCEFI   666

Query:  666 SWDKPIGRTCPKSNDFLVEKKVRGGGKQVVCSNEKCDYQEEKIK                 709
            SWD PIGR CPKS D+L+EKKVR GGKQV+CSNE CDY+EEKIK
Sbjct:  667 SWDLPIGRACPKSGDYLIEKKVR-GGKQVMCSNETCDYKEEKIK                 709
```

Based on this analysis, it was predicted that these proteins and their epitopes could be useful antigens for vaccines or diagnostics.

EXAMPLE 618

A DNA sequence (GBSx0658) was identified in *S. agalactiae* <SEQ ID 1919> which encodes the amino acid sequence <SEQ ID 1920>. Analysis of this protein sequence reveals the following:

```
Possible site: 43
>>> Seems to have no N-terminal signal sequence

----- Final Results -----
            bacterial cytoplasm --- Certainty = 0.2578 (Affirmative) < succ>
            bacterial membrane  --- Certainty = 0.0000 (Not Clear)   < succ>
             bacterial outside  --- Certainty = 0.0000 (Not Clear)   < succ>
```

The protein has homology with the following sequences in the GENPEPT database:

```
>GP: AAD35341 GB: AE001708 DNA processing chain A [Thermotoga maritima]
Identities = 97/231 (41%), Positives = 149/231 (63%), Gaps = 2/231 (0%)

Query:  51 FIENYKQLDLKKLRQEFKKFPV--LSILDSNYPLELKEIYNPPVLLFYQGNIELLSKPKL 108
           F+E   + +L++ ++   +K  V   +S  + +YP  L+EI  PP +LF +G+ ELL +   +
Sbjct:  41 FLEKCGKEELERQKELIRKHNVKLVSFWEDDYPQHLREIRYPPAVLFVRGDAELLKEKCV 100

Query: 109 AVVGARQASQIGCQSVKKIIKETNNQFVIVSGLARGIDTAAHVSALKNGGSSIAVIGSGL 168
             VVG R+ +  G    K+ +K  +   FVIVSG+A GID+ AH  AL +GG ++AV+G+G+
Sbjct: 101 GVVGTRRPTSYGVNVTKRFVKLLSEYFVIVSGMAFGIDSVAHKEALSSGGKTVAVLGTGV 160

Query: 169 DVYYPTENKKLQEYMSYNHLVLSEYFTGEQPLKFHFPERNRIIAGLCQGIVVAEAKMRSG 228
           DV YP N++L  +  N V+SEY G +  K HFP RNRIIAGL   I+V EA ++SG
Sbjct: 161 DVVYPRSNERLFHEIVKNGCVVSEYPMGTRARKHHFPARNRIIAGLSDAIIVTEAPIKSG 220

Query: 229 SLITCERALEEGREVFAIPGNIIDGKSDGCHHLIQEGAKCIISGKDILSEY           279
           +LIT + ALE GR+VFA+PG+I    S+G ++LI+ GA +   +D+ + +
Sbjct: 221 ALITVKFALESGRDVFAVPGDIDRKTSEGTNYLIKSGAYPLTDEEDLETHF           271
```

A related DNA sequence was identified in *S. pyogenes* <SEQ ID 1921> which encodes the amino acid sequence <SEQ ID 1922>. Analysis of this protein sequence reveals the following:

```
Possible site: 50
>>> Seems to have no N-terminal signal sequence

----- Final Results -----
            bacterial cytoplasm --- Certainty = 0.2856 (Affirmative) < succ>
            bacterial membrane  --- Certainty = 0.0000 (Not Clear)   < succ>
             bacterial outside  --- Certainty = 0.0000 (Not Clear)   < succ>
```

An alignment of the GAS and GBS proteins is shown below:

```
Identities = 185/279 (66%), Positives = 238/279 (84%), Gaps = 1/279 (0%)

Query:   1 MNHFELFKLKKAGLTNLNIHNIINYLKKNSLTSLSVRNMAVVSKCKNPTFFIENYKQLDL  60
           +NHFEL+KLKKAGLTN NI NI++Y +K+   SLS+R+MAVVS CK+P+ FIE YKQLD+
Sbjct:   1 VNHFELYKLKKAGLTNKNILNILDY-QKHQEKSLSLRDMAVVSGCKHPSHFIEAYKQLDI  59

Query:  61 KKLRQEFKKFPVLSILDSNYPLELKEIYNPPVLLFYQGNIELLSKPKLAVVGARQASQIG 120
           + L+ EFK+FP +SILD +YP+ LKEIYNPPVLLF+QGN++LL KPKLA+VG+R++S  G
Sbjct:  60 QNLKMEFKQFPSISILDKHYPMALKEIYNPPVLLFFQGNLDLLEKPKLAIVGSRRSSDTG 119

Query: 121 CQSVKKIIKETNNQFVIVSGLARGIDTAAHVSALKNGGSSIAVIGSGLDVYYPTENKKLQ 180
            +SV+KI KE  N+FVIVSGLARGIDT+AH++ LKNGG +IA+IG+GLD +YP EN++LQ
Sbjct: 120 VKSVRKILKELGNRFVIVSGLARGIDTSAHLACLKNGGQTIAIIGTGLDRFYPKENRELQ 179

Query: 181 EYMSYNHLVLSEYFTGEQPLKFHFPERNRIIAGLCQGIVVAEAKMRSGSLITCERALEEG 240
               ++   NHLVL+EY  GE+ L  +HFPERNRIIAGL +GI+V EAK RSGSLITC+   +EEG
Sbjct: 180 TFLGKNHLVLTEYGPGEEALSYHFPERNRIIAGLSRGILVVEAKNRSGSLITCQIGIEEG 239
```

```
                                  -continued
Query: 241 REVFAIPGNIIDGKSDGCHHLIQEGAKCIISGKDILSEY                279
           R++FA+PGNI+DGKS+GC  LI+EGA C+ SG DILSEY
Sbjct: 240 RDIFAVPGNILDGKSEGCLQLIKEGATCVTSGMDILSEY                278
```

Based on this analysis, it was predicted that these proteins and their epitopes could be useful antigens for vaccines or diagnostics.

EXAMPLE 619

A DNA sequence (GBSx0659) was identified in *S. agalactiae* <SEQ ID 1923> which encodes the amino acid sequence <SEQ ID 1924>. This protein is predicted to be lipoprotein (ceuE). Analysis of this protein sequence reveals the following:

```
Possible site: 24
>>> Seems to have a cleavable N-term signal seq.

----- Final Results ----- bacterial outside --- Certainty = 0.3000 (Affirmative) < succ>
          bacterial membrane --- Certainty = 0.0000 (Not Clear)  < succ>
          bacterial cytoplasm --- Certainty = 0.0000 (Not Clear) < succ>
```

The protein has homology with the following sequences in the GENPEPT database:

```
>GP: CAA06500 GB: AJ005352 lipoprotein [Staphylococcus aureus]
Identities = 122/348 (35%), Positives = 201/348 (57%), Gaps = 16/348 (4%)

Query:   1 MTKKLIIAILALCTILTTSQAVLAKEKSQ--------TVTIKNNYSVYIKKEKRDKPDNK   52
           M K ++  +LA+  +L       KE+S+        TV I+NNY +  + EK+D  D K
Sbjct:   1 MKKTVLYLVLAVMFLLAACGNNSDKEQSKSETKGSKDTVKIENNYKM--RGEKKDGSDAK   58

Query:  53 KQISETLKVPLKPKKVVVFDMGALDTITALGAEKSVIGIPKAKNALSLLPNNVKSVYKAK  112
           K + ET++VP  P+  VV D GALD +  +G     V +PK +   SL PN ++S +K
Sbjct:  59 K-VKETVEVPKNPENAVVLDYGALDVMKEMGLSDKVKALPKGEGGKSL-PNFLES-FKDD  115

Query: 113 RYQDVGSLFEPNFEAIARMQPDVVFLGARMASVDNIEKLKEAAPKAALVYAGVDSKKVFD  172
           +Y +VG+L E NF+ IA  +P+V+F+  R A+   N+++ K+AAPKA +VY G D K +
Sbjct: 116 KYTNVGNLKEVNFDKIAATKPEVIFISGRTANQKNLDEFKKAAPKAKIVYVGADEKNLIG  175

Query: 173 KGVAERVTMLGKIFDQNKKAKTFNKDIAQAVLKLQKTIEKKGKPTALFVMANSGELLTQS  232
           + +     +GKI+D+  KAK  NKD+  +  ++    K T ++++ N GEL T
Sbjct: 176 S-MKQNTENIGKIYDKEVKAKELNKDLDNKIASMKDKTKNFNK-TVMYLLVNEGELSTFG  233

Query: 233 PSGRFGW-IFSVGGFKAVNENEKLSSHGTPVSYEYIAEKNPNYLFVLDRGATIGQGASSK  291
           P GRFG  ++   GF AV++    S+HG  VS EY+ ++NP+ +  +DRG  +   +++K
Sbjct: 234 PKGRFGGLVYDTLGFNAVDKKVSNSNHGQNVSNEYVNKENPDVILAMDRGQAVSGKSTAK  293

Query: 292 ELFNNDVIKATDAVKNKRVHEVDGKDWYINSGGSRVTLRMIKDVQNFV              339
           +  NN V+K    A+K  +V+  +D K WY  +G +   T++ I+++   V
Sbjct: 294 QALNNPVLKNVKAIKEDKVYNLDPKLWYFAAGSTTTTIKQIEELDKVV              341
```

A related DNA sequence was identified in *S. pyogenes* <SEQ ID 1925> which encodes the amino acid sequence <SEQ ID 1926>. Analysis of this protein sequence reveals the following:

```
Possible site: 32
>>> May be a lipoprotein

----- Final Results -----
          bacterial membrane --- Certainty = 0.0000(Not Clear) < succ>
          bacterial outside  --- Certainty = 0.0000(Not Clear) < succ>
          bacterial cytoplasm --- Certainty = 0.0000(Not Clear) < succ>
```

An alignment of the GAS and GBS proteins is shown below:

```
Identities = 57/255 (22%), Positives = 104/255 (40%), Gaps = 30/255 (11%)

Query:   66 KKVVVFDMGALDTITALGAEKSVIGIPKAKNALSLLPNNVKSVYKAKRYQDVGSLFEPNF 125
             +++V   + +D    L +  ++G+ +K  L LP    +V +       VG   P+
Sbjct:   45 QRIVATSVAVVDICDRLNLD--LVGVCDSK--LYTLPKRYDAVKR------VGLPMNPDI  94

Query:  126 EAIARMQPDVVFLGARMASVDNIEKLKEAAPKAALVYAGVDSKKVFDKGVAERVTMLGKI 185
             E IA ++P  +       +    E L+    K    Y  ++ + V  +G+ + +  LG +
Sbjct:   95 ELIASLKPTWILSPNSLQ-----EDLEPKYQKLDTEYGFLNLRSV--EGMYQSIDDLGNL 147

Query:  186 FDQNKKAKTFNKDIAQAVLKLQKTIEKKGKPTALFVMANSGELLTQSPSGRFGWIFSVGG 245
             F + ++AK    +        Q   + K KP  L +M  G L +     G +   + G
Sbjct:  148 FQRQQEAKELRQQYQDYYRAFQAKRKGKKKPKVLILMGLPGSYLVATNQSYVGNLLDLAG 207

Query:  246 FKAV---NENEKLSSHGTPVSYEYIAEKNPNYLFVLDRGATIGQGAS---SKELFNNDVI 299
              + V    +E E LS++        E +  K P+   +L    I          KE    ND+
Sbjct:  208 GENVYQSDEKEFLSANP-----EDMLAKEPD--LILRTAHAIPDKVKVMFDKEFAENDIW 260

Query:  300 KATDAVKNKRVHEVD                                              314
             K    AVK  +V+++D
Sbjct:  261 KHFTAVKEGKVYDLD                                              275
```

Figure 39:
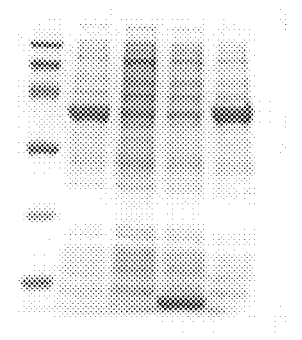

SEQ ID 1924 (GBS181) was expressed in *E. coli* as a His-fusion product. SDS-PAGE analysis of total cell extract is shown in FIG. 39 (lane 5; MW 38.7 kDa). It was also expressed in *E. coli* as a GST-fusion product. SDS-PAGE analysis of total cell extract is shown in FIG. 46 (lane 3; MW 64 kDa).

Figure 299:
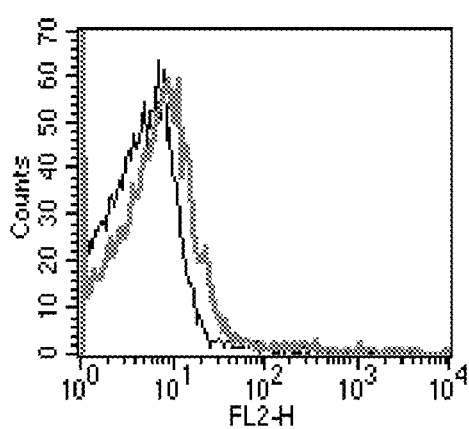

The GBS181-GST fusion product was purified (FIG. 204, lane 9) and used to immunise mice. The resulting antiserum was used for FACS (FIG. 299), which confirmed that the protein is immunoaccessible on GBS bacteria.

Based on this analysis, it was predicted that these proteins and their epitopes could be useful antigens for vaccines or diagnostics.

EXAMPLE 620

A DNA sequence (GBSx0660) was identified in *S. agalactiae* <SEQ ID 1927> which encodes the amino acid sequence <SEQ ID 1928>. This protein is predicted to be iron(III) ABC transporter, ATP-binding protein. Analysis of this protein sequence reveals the following:

```
Possible site: 40
>>> Seems to have no N-terminal signal sequence

----- Final Results -----
            bacterial cytoplasm --- Certainty = 0.3231(Affirmative) < succ>
            bacterial membrane  --- Certainty = 0.0000(Not Clear)   < succ>
            bacterial outside   --- Certainty = 0.0000(Not Clear)   < succ>
```

The protein has homology with the following sequences in the GENPEPT database:

```
>GP: CAB12190 GB: Z99106 similar to ferrichrome ABC transporter
(ATP-binding protein) [Bacillus subtilis]
Identities = 125/247 (50%), Positives = 187/247 (75%)

Query:    1 MIQINNLHKFYGQKEILKDINISIPKGKVTAILGPNGSGKSTLLSCISRLEPYDNGEIFL  60
            M+++ N+ K YG K +L++ +++I KG+T+  +GPNG+GKSTLLS +SRL     D+GEI++
Sbjct:    1 MVEVRNVSKQYGGKVVLEETSVTIQKGKITSFIGPNGAGKSTLLSIMSRLIKKDSGEIYI  60

Query:   61 DKVPLAHYSSNDLAKTLAILRQSNHLTLKIKVRDLIGFGRFPYSKGRLSQKDKAVIESVI 120
            D      S +LAK ++IL+Q+N + +++  ++DL+ FGRFPYS+GRL+++D       I  +
Sbjct:   61 DGQEIGACDSKELAKKMSILKQANQINIRLTIKDLVSFGRFPYSQGRLTEEDWVHINQAL 120

Query:  121 SYMDLNDIADEFINNLSGGQIQRAFIAMTMAQDTQYICLDEPLNNLDMKYAVQMMDLIKR 180
            SYM L DI D++++ LSGGQ QRAFIAM +AQDT YI LDEPLNNLDMK++V++M L+KR
Sbjct:  121 SYMKLEDIQDKYLDQLSGGQCQRAFIAMVIAQDTDYIFLDEPLNNLDMKHSVEIMKLLKR 180

Query:  181 YAYEFNKTIVIIIHDINFATHYADNVVALKEGQVVTCGTVEDVMQEKILSHLFDMPIRIE 240
                 E   KTIVI+IHDINFA+  Y+D +VALK G++V  G  E++++     +L  ++DM I I+
Sbjct:  181 LVEELGKTIVIVIHDINFASVYSDYIVALKNGRIVKEGPPEEMIETSVLEEIYDMTIPIQ 240

Query:  241 TVDGKPI                                                      247
            T+D + I
Sbjct:  241 TIDNQRI                                                      247
```

There is also homology to SEQ ID 1930.

Based on this analysis, it was predicted that this protein and its epitopes, could be useful antigens for vaccines or diagnostics.

EXAMPLE 621

A DNA sequence (GBSx0661) was identified in *S. agalactiae* <SEQ ID 1931> which encodes the amino acid sequence <SEQ ID 1932>. Analysis of this protein sequence reveals the following:

```
Possible site: 33
>>> Seems to have a cleavable N-term signal seq.
    INTEGRAL      Likelihood = -12.74    Transmembrane   271-287 (266-295)
    INTEGRAL      Likelihood =  -8.55    Transmembrane    49-65  (47-69)
    INTEGRAL      Likelihood =  -8.07    Transmembrane   185-201 (178-207)
    INTEGRAL      Likelihood =  -7.70    Transmembrane   112-128 (105-132)
    INTEGRAL      Likelihood =  -7.38    Transmembrane   231-247 (227-261)
    INTEGRAL      Likelihood =  -2.50    Transmembrane   139-155 (135-156)
    INTEGRAL      Likelihood =  -1.97    Transmembrane   302-318 (301-319)

----- Final Results -----
           bacterial membrane --- Certainty = 0.6095(Affirmative) < succ>
           bacterial outside  --- Certainty = 0.0000(Not Clear)   < succ>
         bacterial cytoplasm  --- Certainty = 0.0000(Not Clear)   < succ>
```

The protein has homology with the following sequences in the GENPEPT database:

```
>GP: CAB12189 GB: Z99106 similar to ferrichrome ABC transporter
(permease) [Bacillus subtilis]
Identities = 138/315 (43%), Positives = 222/315 (69%), Gaps = 6/315 (1%)

Query:   9 KLLILLILLIAAIILFLIYGIPTDANEFLIIYILKTRYQKLIALILVGICIGSSSLIFQT   68
           K+ +L+ L I   I LFL Y +         Y L  R +K+ A++L G   I   S++IFQT
Sbjct:   6 KIALLVGLAIVCIGLFLFYDLGNWD------YTLPRRIKKVAAIVLTGGAIAFSTMIFQT   59

Query:  69 LTNNRLLTPSIIGLDSLYILIQTGLMYLIGAQRVIKFSSFSSFLLSLLLMVGFAYLLFTI  128
           +TNNR+LTPSI+GLDSLY+LIQTG+++L G+  ++    +F++S+LLM+ F+ +L+ I
Sbjct:  60 ITNNRILTPSILGLDSLYMLIQTGIIFLFGSANMVIMNKNINFIISVLLMILFSLVLYQI  119

Query: 129 LFRNKKQSLYFVLLAGLIFNTLFSSISSFIQAIMDPNDFMILQNQLFASFNAINTKILWI  188
           +F+ + ++++F+LL G++F TLFSS+SSF+Q ++DPN+F ++Q+++FASFN INT +LW+
Sbjct: 120 MFKGEGRNIFFLLLIGIVFGTLFSSLSSFMQMLIDPNEFQVVQDKMFASFNNINTDLLWL  179

Query: 189 SFIIIVVSFVINWPFIKELDVLLLGKENAISLGISYQKLTTRFFLWLALMVAIATALVGP  248
           +FII +++ V  W F K  DVL LG+E+A++LGI Y K+ +  + +A++V+++TALVGP
Sbjct: 180 AFIIFLLTGVYVWRFTKFFDVLSLGREHAVNLGIDYDKVVKQMLIVVAILVSVSTALVGP  239

Query: 249 ITFLGLLVAHITYHSFHTFRHQILVPIAIVICIFTLVLGQHLVQNLLHLTVQLSVLLNLI  308
             I FLGLLV ++         T++H  L+  ++ I I  LV GQ +V+ +     LSV++N
Sbjct: 240 IMFLGLLVVNLAREFLKTYKHSYLIAGSVFISIIALVGGQFVVEKVFTFSTTLSVIINFA  299

Query: 309 GGSYFIFTLIKGRKN                                              323
           GG YFI+ L+K  K+
Sbjct: 300 GGIYFIYLLLKENKS                                              314
```

A related DNA sequence was identified in *S. pyogenes* <SEQ ID 1933> which encodes the amino acid sequence <SEQ ID 1934>. Analysis of this protein sequence reveals the following:

```
Possible site: 58
>>> Seems to have no N-terminal signal sequence
    INTEGRAL      Likelihood = -13.64    Transmembrane    33-49  (26-61)
    INTEGRAL      Likelihood =  -8.97    Transmembrane   259-275 (246-286)
    INTEGRAL      Likelihood =  -8.65    Transmembrane   296-312 (294-316)
    INTEGRAL      Likelihood =  -8.39    Transmembrane    83-99  (78-104)
    INTEGRAL      Likelihood =  -6.26    Transmembrane   212-228 (210-231)
    INTEGRAL      Likelihood =  -4.04    Transmembrane   113-129 (110-132)
    INTEGRAL      Likelihood =  -3.61    Transmembrane   140-156 (134-157)
    INTEGRAL      Likelihood =  -2.71    Transmembrane   165-181 (165-181)
    INTEGRAL      Likelihood =  -1.06    Transmembrane   327-343 (327-343)
    INTEGRAL      Likelihood =  -0.22    Transmembrane    50-66  (50-66)

----- Final Results -----
           bacterial membrane --- Certainty = 0.6456(Affirmative) < succ>
           bacterial outside  --- Certainty = 0.0000(Not Clear)   < succ>
         bacterial cytoplasm  --- Certainty = 0.0000(Not Clear)   < succ>
```

A related sequence was also identified in GAS <SEQ ID 9175> which encodes the amino acid sequence <SEQ ID 9176>. Analysis of this protein sequence reveals the following:

```
Possible site: 49
>>> Seems to have no N-terminal signal sequence
    INTEGRAL      Likelihood = -13.64      Transmembrane      24-40    (17-52)
    INTEGRAL      Likelihood =  -8.97      Transmembrane     250-266  (237-277)
    INTEGRAL      Likelihood =  -8.65      Transmembrane     287-303  (285-307)
    INTEGRAL      Likelihood =  -8.39      Transmembrane      74-90    (69-95)
    INTEGRAL      Likelihood =  -6.26      Transmembrane     203-219  (201-222)
    INTEGRAL      Likelihood =  -4.04      Transmembrane     104-120  (101-123)
    INTEGRAL      Likelihood =  -3.61      Transmembrane     131-147  (125-148)
    INTEGRAL      Likelihood =  -2.71      Transmembrane     156-172  (156-172)
    INTEGRAL      Likelihood =  -1.06      Transmembrane     318-334  (318-334)
    INTEGRAL      Likelihood =  -0.22      Transmembrane      41-57    (41-57)

----- Final Results -----
             bacterial membrane --- Certainty = 0.646(Affirmative) < succ>
              bacterial outside --- Certainty = 0.0000(Not Clear)  < succ>
            bacterial cytoplasm --- Certainty = 0.0000(Not Clear)  < succ>
```

An alignment of the GAS and GBS proteins is shown below:

```
Identities = 80/326 (24%), Positives = 157/326 (47%), Gaps = 34/326 (10%)

Query:  10 LLILLILLIAAIILFLIYGIPTDANEFL----------IIYILKTRYQKLIALILVGICI   59
           +L++L LL  A+I   + G+         +           + I   R+ +++  +L G  I
Sbjct:  34 VLLILSLLFLAVIALSLGGLAVSYGAIVKGLFVAYDPQVALIYDLRFPRIVIALLAGAGI   93

Query:  60 GSSSLIFQTLTNNRLLTPSIIGL---DSLYILIQTGLMYLIGAQRVIKFSSFSSFL---L  113
              S ++FQ +  N +  P+IIG+     S  +L+ + L+        +++ +    SFL   +
Sbjct:  94 AVSGVLFQAVLKNPISDPAIIGICSGASFMVLVSSLLL-----PQLLLYGPIVSFLGGGV  148

Query: 114 SLLLMVGFAYLLFTILFRNKKQSLYFVLLAGLIFNTLFSSISSFIQAIMDPNDFMILQNQ  173
            S LL+  G A+          K  +  ++L G+  N LF  +S+ + +         M+    N
Sbjct: 149 SFLLIYGLAW--------KKGLNPIRLILTGIAINALFMGLSTALTSFFTSASPMV--NA  198

Query: 174 LFASFNAINTKI-LWISFIIIVVSFVINWPFIKELDVLLLGKENAISLGISYQKLTTRFF  232
              L A    +  T    + +F    + ++        K  ++LLL  +       LGI      L
Sbjct: 199 LLAGHISQKTWADVGVLFPYTFIGLLLALLLSKTCNLLLLLDDQVIRHLGIDATALRLGIS  258

Query: 233 LWLALMVAIATALVGPITFLGLLVAHITYHSFHTFRHQILVPIAIVICIFTLVLGQHLVQ  292
           L     L+ ++AT++VG ++FLGL+V H++        +  +HQIL+P + ++   F   +L   L +
Sbjct: 259 LVAVLLASVATSIVGVVSFLGLIVPHMSRLLVGS-KHQILIPFSALLGAFVFLLADTLGR  317

Query: 293 NLLH-LTVQLSVLLNLIGGSYFIFTL                                    317
           +L + L +  ++++++++GG YFI+ L
Sbjct: 318 SLAYPLEISPAIIMSIVGGPYFIYLL                                    343
```

A related DNA sequence was identified in *S. pyogenes* <SEQ ID 2491> which encodes amino acid sequence <SEQ ID 2492>. An alignment of the GAS and GBS sequences follows:

```
Score = 51.9 bits (122), Expect = 5e-08
Identities = 73/327 (22%), Positives = 137/327 (41%), Gaps = 38/327 (11%)

Query: 494 IISSLGTAISTVAQGIGTGLAIAFRGLGAAIAMVPPTTWLALGTAILMVGAAFALAGTQA  553
           +I  L T  +  + G   L IA   +GA + +V        A+    L++ A
Sbjct: 573 VILGLVTTAVMMLLGAIAPLVIAIGAIGAPVGIVVAAIVGAIAVITLIIQAIMNWGA---  629

Query: 554 DGISQILRTIGDXXXXXXXXXXTDSLATLLTIIANAIGSMLPIVAGAISQIVG-------A  606
             I++ L++  D              ++ T  T   A +    ++G S +V            +
Sbjct: 630 --ITEWLQSTWDSCAAWXSELWTNIVTTAT---TAWSNFTAWLSGLWSSVVSTGQSLWSS  684

Query: 607 VAGGLSQLIIAVSTGVSLVIGAFTGLLGGI-SGVINSISAVIQSLTGVITAVFNGIATVI  665
               LS +  ++ TG   +FT   L  + SG++++ S +  +L+   I+ +FNGI
Sbjct: 685 FTSSLSNIFSSLITGAQSLWSSFTSTLSNLWSGLVSTGSNLFNNLSSTISGIFNGILSTA  744

Query: 666 SSVGSTIKDVLTGLGTAFEGFGNGVKSALEGVGAVIESFGSAVR--------NVLDGVAN  717
           S++  ++K ++   A +G   N V +    GV A+     F    ++                + G AN
Sbjct: 745 SNIWNSIKSTIS---NAIDGAKNAVSN---GVNAIKNLFNFQIKWPHIPLPHFRVSGSAN  798
```

-continued

```
Query: 718 ILDSM--GTAALNAGRGVKEMAKGIKMLVDLSLGDLVATLAAVASGLGKMASSAGEMTTL 775
            LD + G  ++     G+    AKG  ++  +L +     A V     G A     +TL
Sbjct: 799 PLDWLKGGLPSI----GIDWYAKG-GIMTKPTLFGMNGNRAMVGGEAGAEAILPLNKSTL 853

Query: 776 GSAMSKVANGMTRLATSATIAITGLTV                                 802
            G+    +AN M   + +  +  +G+T+
Sbjct: 854 GAIGQSIANTM-NTSNNINVNFSGVTI                                 879

Score = 33.2 bits (74), Expect = 0.019
Identities = 83/477 (17%), Positives = 175/477 (36%),
Gaps = 103/477 (21%)

Query: 420 GSFLDKISTKFGLFGKKAKEGTD--------------QAANGSRKSGGIISQIFNGLGNI 465
            G + +++T+FGL G+K K  ++              +A ++++              LG +
Sbjct: 313 GDAVGELNTQFGLTGEKLKSASELLIKYAEINETDISSSAISAKQAIEAYGLTAEDLGMV 372

Query: 466 VKSAGTAISTAAKGIGTGIKTALSGAPPIISSLGTAISTVA--------QGIGTGLAIA- 516
            + +    A    + + T ++ A+ GAP  I  LG +     A         G+ +  A++
Sbjct: 373 LDNVTKAAQDTGQSVDTIVQKAIDGAPQ-IKGLGLSFEEGAALIGKFEKSGVDSSAALSS 431

Query: 517 ----------------FRGLGAAIAMVPPTT--WLALGTAILMVGAAFALAGTQA----- 553
                            GL   ++ +   +T    AL A + G+   A     A
Sbjct: 432 LSKAAVIYAKDGKTLTDGLNETVSAIQNSTSETEALSIASEIFGSKAAPRMVDAIQRGAF 491

Query: 554 --DGISQILRTIGDXXXXXXXXXTDSLATLLTI-------IANAIGSMLPIVAGAISQIV 604
              D +++  ++        D + L         +A   G +L   V   A+  ++
Sbjct: 492 SFDDLAEAAKSSSGTVSTTFDETLDPIDKLTQYSNQAKEGMAELGGKLLETVIPALEPLM 551

Query: 605 GAVAGGLS----------QLII---AVSTGVSLVIGAFTGL---LGGISGVINSISAVIQ 648
            G +   ++           Q I+     V+T V +++GA    L      +G I   + A I
Sbjct: 552 GMLESSVNWFTSLNETDQQTIVILGLVTTAVMMLLGAIAPLVIAIGAIGAPVGIVVAAIV 611

Query: 649 SLTGVITAVFNGI-----------------ATVISSVGSTIKDVLTGLGTAFEGFGNGVK 691
                VIT +    I                  A    S + + I    T    + F + +G+
Sbjct: 612 GAIAVITLIIQAIMNWGAITEWLQSTWDSCAAWXSELWTNIVTTATTAWSNFTAWLSGLW 671

Query: 692 SALEGVG-AVIESFGSAVRNV----LDGVANILDSMGTAALNAGRGVKEMAKGIKMLVDL 746
            S++      G  ++ SF S++ N+       + G  ++    S  +  N G+         +
Sbjct: 672 SSVVSTGQSLWSSFTSSLSNIFSSLITGAQSLWSSFTSTLSNLWSGLVSTGSNL------ 725

Query: 747 SLGDLVATLAAVASGLGKMASSAGEMTTLGSAMSKVANGMTRLATSATIAITGLTVF     803
               +L +T++ + +G+  +++++       ++ S +S    +G     ++  AI  L  F
Sbjct: 726 -FNNLSSTISGIFNGI--LSTASNIWNSIKSTISNAIDGAKNAVSNGVNAIKNLFNF    779
```

Based on this analysis, it was predicted that these proteins and their epitopes could be useful antigens for vaccines or diagnostics.

EXAMPLE 622

A DNA sequence (GBSx0662) was identified in *S. agalactiae* <SEQ ID 1935> which encodes the amino acid sequence <SEQ ID 1936>. Analysis of this protein sequence reveals the following:

```
Possible site: 13
>>> Seems to have no N-terminal signal sequence

----- Final Results -----
         bacterial cytoplasm --- Certainty = 0.2277 (Affirmative) < succ>
         bacterial membrane  --- Certainty = 0.0000 (Not Clear)   < succ>
          bacterial outside  --- Certainty = 0.0000 (Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 623

A DNA sequence (GBSx0663) was identified in *S. agalactiae* <SEQ ID 1937> which encodes the amino acid sequence <SEQ ID 1938>. This protein is predicted to be membrane protein (ceuB). Analysis of this protein sequence reveals the following:

```
Possible site: 41
>>> Seems to have no N-terminal signal sequence
INTEGRAL    Likelihood = -11.30      Transmembrane    241-257 (237-274)
INTEGRAL    Likelihood = -6.42       Transmembrane    127-143 (118-149)
INTEGRAL    Likelihood = -5.79       Transmembrane    152-168 (150-174)
INTEGRAL    Likelihood = -5.47       Transmembrane    312-328 (309-330)
INTEGRAL    Likelihood = -4.83       Transmembrane    289-305 (287-308)
INTEGRAL    Likelihood = -4.67       Transmembrane     24-40  (22-46)
INTEGRAL    Likelihood = -4.35       Transmembrane     69-85  (68-86)
INTEGRAL    Likelihood = -4.19       Transmembrane    200-216 (198-216)
INTEGRAL    Likelihood = -2.76       Transmembrane    107-123 (107-123)
INTEGRAL    Likelihood = -0.85       Transmembrane    258-274 (258-274)

----- Final Results -----
             bacterial membrane --- Certainty = 0.5522 (Affirmative) < succ>
             bacterial outside  --- Certainty = 0.0000 (Not Clear)   < succ>
             bacterial cytoplasm --- Certainty = 0.0000 (Not Clear)  < succ>
```

A related GBS nucleic acid sequence <SEQ ID 8621> which encodes amino acid sequence <SEQ ID 8622> was also identified. Analysis of this protein sequence reveals the following:

```
Lipop: Possible site: -1 Crend: 2
SRCFLG: 0
NcG: Length of UR: 23
Peak Value of UR: 2.64
Net Charge of CR: 2
McG: Discrim Score: 8.59
GvH: Signal Score (-7.5): -4.6
Possible site: 26
>>> Seems to have an uncleavable N-term signal seq
Amino Acid Composition: calculated from 1
ALOM program        count: 9       value: -11.30           threshold: 0.0
INTEGRAL     Likelihood = -11.30      Transmembrane    226-242 (222-259)
INTEGRAL     Likelihood = -6.42       Transmembrane    112-128 (103-134)
INTEGRAL     Likelihood = -5.79       Transmembrane    137-153 (135-159)
INTEGRAL     Likelihood = -4.67       Transmembrane      9-25  (7-31)
INTEGRAL     Likelihood = -4.35       Transmembrane     54-70  (53-71)
INTEGRAL     Likelihood = -4.19       Transmembrane    185-201 (183-201)
INTEGRAL     Likelihood = -3.08       Transmembrane    268-284 (265-284)
INTEGRAL     Likelihood = -2.76       Transmembrane     92-108 (92-108)
INTEGRAL     Likelihood = -0.85       Transmembrane    243-259 (243-259)
PERIPHERAL   Likelihood = 5.73                         203
modified ALOM score: 2.76
icml HYPID: 7 CFP: 0.552

*** Reasoning Step: 3

----- Final Results -----
             bacterial membrane --- Certainty = 0.5522 (Affirmative) < succ>
             bacterial outside  --- Certainty = 0.0000 (Not Clear)   < succ>
             bacterial cytoplasm --- Certainty = 0.0000 (Not Clear)  < succ>
```

The protein has homology with the following sequences in the GENPEPT database:

```
>GP: CAB12188 GB: Z99106 similar to ferrichrome ABC transporter
(permease) [Bacillus subtilis]
Identities = 149/304 (49%), Positives = 234/304 (76%)

Query:  29 LVILSLTSLFVGVKSIPLEQITHLDQSQVOIFLTSRLPRTISILISGASLSVCGLLMQQL   88
           L+IL++TS+F+GV+  +   + L + +     SRLPR ISI+I+G S+S+CGL+MQQ+
Sbjct:  10 LIILAVTSVFIGVEDLSPLDLFDLSKQEASTLFASRLPRLISIVIAGLSMSICGLIMQQI   69

Query:  89 TQNKFVSPTTSGTMDWAKLGVVVTLIFFKNTSIFIQLCIASGFAILGSLLFVTILKMITF  148
           ++NKFVSPTT+GTMDWA+LG++++L+ F + S   I++ +A   FA+ G+ LF+ IL+ I F
Sbjct:  70 SRNKFVSPTTAGTMDWARLGILISLLLFTSASPLIKMLVAFVFALAGNFLFMKILERIKF  129

Query: 149 KDNIFIPLIGLMLGQIVAAATVFLGTHFQVLQSVNSWLQGNFSIMTSHRYEILYLALPCL  208
            D  IFIPL+GLMLG IV++     F+    + ++Q+V+SWLQG+FS++    RYE+LYL++P +
Sbjct: 130 NDTIFIPLVGLMLGNIVSSIATFIAYKYDLIQNVSSWLQGDFSLVVKGRYELLYLSIPLV  189

Query: 209 FLVYFFAHQFTIVGLGESFAKNLGVAYEKMIYFGLVLVSIMTSLVIIIVGALPFLGLIVP  268
            + Y +A +FT+ G+GESF+ NLG+ Y++++      GL++VS++TSLVI+ VG LPFLGLI+P
Sbjct: 190 IIAYVYADKFTLAGMGESFSVNLGLKYKRVVNIGLIIVSLITSLVILTVGMLPFLGLIIP  249
```

```
-continued
Query: 269 NLISITKGDHMSSTILETSLLGACIVMICDLFGRLVIFPYEVSIGVTLGVLGSAFFLISI 328
            N++SI +GD++ S++   T LLGA  V+ CD+ GR++IFPYE+SIG+ +G++GS  FL  +
Sbjct: 250 NIVSIYRGDNLKSSLPHTVLLGAVFVLFCDILGRIIIFPYEISIGLMVGIIGSGIFLFML 309

Query: 329 IRNE 332
            +R +
Sbjct: 310 LRRK 313
```

There is also homology to SEQ ID 1940.

Based on this analysis, it was predicted that these proteins and their epitopes could be useful antigens for vaccines or diagnostics.

EXAMPLE 624

A DNA sequence (GBSx0664) was identified in *S. agalactiae* <SEQ ID 1941> which encodes the amino acid sequence <SEQ ID 1942>. Analysis of this protein sequence reveals the following:

```
Possible site: 35
>>> Seems to have no N-terminal signal sequence
INTEGRAL    Likelihood = -0.90       Transmembrane     140-156 (140-156)

----- Final Results -----
              bacterial membrane --- Certainty = 0.1362 (Affirmative) < succ>
                bacterial outside --- Certainty = 0.0000 (Not Clear)  < succ>
              bacterial cytoplasm --- Certainty = 0.0000 (Not Clear)  < succ>
```

The protein has homology with the following sequences in the GENPEPT database:

```
>GP: BAB06720 GB: AP001517 maltose transacetylase (maltose
O-acetyltransferase) [Bacillus halodurans]
Identities = 93/182 (51%), Positives = 125/182 (68%), Gaps = 2/182 (1%)

Query:   2 TEKEKMLAGQYYRPSAPELRKDREVALKNMQAFNN--EDNSSKRNVILQKWFGATGKSIH    59
            TEKEKMLAG+ Y+    PEL KDRE A +  + FN    E    +R  ++++ FG+ G+S++
Sbjct:   3 TEKEKMLAGERYKAWDPELVKDRERARRLTRLFNQTTETEEKQRTELIKELFGSMGESVN    62

Query:  60 MEQRFVCDYGCNIYVGENFYANFNQTFLDVCEIRIGDNCMFGPNCQLLTPLHPLDPIERN   119
            +E  F CDYG NI+VG NF+ANF+   LDVCE+RIG NCM P   + T  HP+ P+ER
Sbjct:  63 IEPTFRCDYGYNIHVGNNFFANFDCVILDVCEVRIGANCMLAPGVHIYTATHPIHPLERV   122

Query: 120 SGLEYGAPIQIGNNVWLGGGVTILPGVVLGDNVVVGAGSVVTKSFENNVVIAGNPAKIIKKL   182
            G EYG P+ I NNVW+GG    + PGV +G+N V+ +GSVVTK    NVV+AGNPAK+I+ +
Sbjct: 123 EGPEYGKPVTIRNNVWIGGRAIVNPGVTIGNNAVIASGSVVTKDVPENVVVAGNPAKVIQTI   184
```

A related DNA sequence was identified in *S. pyogenes* <SEQ ID 1943> which encodes the amino acid sequence <SEQ ID 1944>. Analysis of this protein sequence reveals the following:

```
Possible site: 61
>>> Seems to have no N-terminal signal sequence

----- Final Results -----
              bacterial cytoplasm --- Certainty = 0.4052 (Affirmative) < succ>
                bacterial membrane --- Certainty = 0.0000 (Not Clear)  < succ>
                bacterial outside --- Certainty = 0.0000 (Not Clear)  < succ>
```

An alignment of the GAS and GBS proteins is shown below:

```
Identities = 68/188 (36%), Positives = 101/188 (53%), Gaps = 13/188 (6%)

Query:   2 TEKEKMLAGQYYRPSAPELRKDREVALKNMQAFN--------NEDNSSKRNVILQKWFGA    53
            TE +KM  G++Y     +  D E+  K M A +          +R+ +L + FG
```

```
-continued
Sbjct:   3 TEFDKMTRGEWY-----DANFDSELIQKRMMAQDLCFDLNQLKPSREEERSAVLNQLFGQ   57

Query:  54 TGKSIHMEQRFVCDYGCNIYVGENFYANFNQTFLDVCEIRIGDNCMFGPNCQLLTPLHPL  113
            + + + +    F+CDYG NI  G+N + N N  F+D  +I +GDN    GP+    T HPL
Sbjct:  58 SFEGLVLLSPFICDYGKNITFGKNCFINSNCYFMDGAKIALGDNVFVGPSTGFYTANHPL  117

Query: 114 DPIERNSGLEYGAPIQIGNNVWLGGGVTILPGVVLGDNVVVGAGSVVTKSFENNVVIAGN  173
            D   RN GLE    PI IG+NVW G  V ++PGV +G    V+ +GSVVT     N + AG
Sbjct: 118 DYKRRNEGLEKALPITIGDNVWFGANVNVMPGVTIGSGCVIASGSVVTHDIPVNSLAAGV  177

Query: 174 PAKIIKKL                                                     181
            P ++++K+
Sbjct: 178 PCQVVRKI                                                     185
```

Based on this analysis, it was predicted that these proteins and their epitopes could be useful antigens for vaccines or diagnostics.

EXAMPLE 625

A DNA sequence (GBSx0665) was identified in *S. agalactiae* <SEQ ID 1945> which encodes the amino acid sequence <SEQ ID 1946>. This protein is predicted to be ribonuclease H (rnhB-2). Analysis of this protein sequence reveals the following:

```
Possible site: 32
>>> Seems to have no N-terminal signal sequence
INTEGRAL    Likelihood = -0.16         Transmembrane       79-95 (79-95)

----- Final Results -----
               bacterial membrane --- Certainty = 0.1065 (Affirmative) < succ>
                bacterial outside --- Certainty = 0.0000 (Not Clear)  < succ>
              bacterial cytoplasm --- Certainty = 0.0000 (Not Clear)  < succ>
```

A related GBS nucleic acid sequence <SEQ ID 9823> which encodes amino acid sequence <SEQ ID 9824> was also identified.

The protein has homology with the following sequences in the GENPEPT database:

```
>GP: CAB13479 GB: Z99112 ribonuclease H [Bacillus subtilis]
Identities = 128/249 (51%), Positives = 168/249 (67%)

Query:   4 TIKEIKAILETIVDLKDKRWQEYQTDSRAGVQKAILQRKKNIQSDLDEEARLEQMLVYEK   63
            T+K+IK  L+ + D +D     + + D R  VQ  +Q K    +  + +  M  YE+
Sbjct:   5 TVKDIKDRLQEVKDAQDPFIAQCENDPRKSVQTLVEQWLKKQAKEKALKEQWVNMTSYER   64

Query:  64 KLYIEHINLIAGIDEVGRGPLAGPVVAAAVILPPNCKIKHLNDSKKIPKKKHQEIYQNIL  123
            +         LIAG+DEVGRGPLAGPVVA+AVILP  C+I   L  DSKK+  +KK  +E Y+ I+
Sbjct:  65 LARNKGFRLIAGVDEVGRGPLAGPVVASAVILPEECEILGLTDSKKLSEKKREEYYELIM  124

Query: 124 DQALAVGIGIQDSQCIDDINIYEATKHAMIDAVSHLSVAPEHLLIDAMVLDLSIPQTKII  183
             +ALAVGIGI ++  ID+INIYEA+K AM+  A+    LS  P++LL+DAM L L   Q  II
Sbjct: 125 KEALAVGIGIVEATVIDEINIYEASKMAMVKAIQDLSDTPDYLLVDAMTLPLDTAQASII  184

Query: 184 KGDANSLSIAAASIVAKVTRDKIMSDYDSTYPGYAFSKNAGYGTKEHLEGLQKYGITPIH  243
            KGDA S+SIAA +  +AKVTRD ++MS Y   TYP Y F KN GYGTKEHLE   L  YG T +H
Sbjct: 185 KGDAKSVSIAAGACIAKVTRDRMMSAYAETYPMYGFEKNKGYGTKEHLEALAAYGPTELH  244

Query: 244 RKSFEPIKS                                                    252
            RK+F  P++S
Sbjct: 245 RKTFAPVQS                                                    253
```

A related DNA sequence was identified in *S. pyogenes* <SEQ ID 1947> which encodes the amino acid sequence <SEQ ID 1948>. Analysis of this protein sequence reveals the following:

```
Possible site: 50
>>> Seems to have no N-terminal signal sequence
    INTEGRAL      Likelihood = -0.53     Transmembrane      79-95 (79-95)

----- Final Results -----
              bacterial membrane --- Certainty = 0.1213(Affirmative) < succ>
               bacterial outside --- Certainty = 0.0000(Not Clear)   < succ>
             bacterial cytoplasm --- Certainty = 0.0000(Not Clear)   < succ>
```

The protein has homology with the following sequences in the databases:

```
>GP: CAB13479 GB: Z99112 ribonuclease H [Bacillus subtilis]
Identities = 130/252 (51%), Positives = 176/252 (69%), Gaps = 3/252 (1%)

Query:    4 SIKAIKESLEAVTSLLDPLFQELATDTRSGVQKALKSRQKVIQAELAEEERLEAMLSYEK   63
            ++K IK+ L+ V    DP  +   D R  VQ  ++    K    E A +E+   M SYE+
Sbjct:    5 TVKDIKDRLQEVKDAQDPFIAQCENDPRKSVQTLVEQWLKKQAKEKALKEQWVNMTSYER   64

Query:   64 ALYKKGYKAIAGIDEVGRGPLAGPVVAACVILPKYCKIKGLNDSKKIPKAKHETIYQAVK   123
              KG++  IAG+DEVGRGPLAGPVVA+ VILP+ C+I GL DSKK+ + K E   Y+ +
Sbjct:   65 LARNKGFRLIAGVDEVGRGPLAGPVVASAVILPEECEILGLTDSKKLSEKKREEYYELIM   124

Query:  124 EKALAIGIGIIDNQLIDEVNIYEATKLAMLEAIKQLEGQLTQPDYLLIDAMTLDIAISQQ   183
             ++ALA+GIGI++   +IDE+NIYEA+K+AM++AI+ L         PDYLL+DAMTL +   +Q
Sbjct:  125 KEALAVGIGIVEATVIDEINIYEASKMAMVKAIQDLS---DTPDYLLVDAMTLPLDTAQA   181

Query:  184 SILKGDANSLSIAAASIVAKVTRDQMMANYDRIFPGYDFAKNAGYGTKEHLQGLKAYGIT   243
              SI+KGDA S+SIAA + +AKVTRD+MM+ Y    +P  Y F KN GYGTKEHL+ L AYG T
Sbjct:  182 SIIKGDAKSVSIAAGACIAKVTRDRMMSAYAETYPMYGFEKNKGYGTKEHLEALAAYGPT   241

Query:  244 PIHRKSFEPVKS                                                255
            +HRK+F  PV+S
Sbjct:  242 ELHRKTFAPVQS                                                253
```

An alignment of the GAS and GBS proteins is shown below:

```
Identities = 168/256 (65%), Positives = 203/256 (78%),
Gaps = 3/256 (1%)

Query:    1 MMATIKEIKAILETIVDLKDKRWQEYQTDSRAGVQKAILQRKKNIQSDLDEEARLEQMLV   60
            M  +IK IK  LE +  L D  +QE  TD+R+GVQKA+  R+K IQ++L EE RLE ML
Sbjct:    1 MPTSIKAIKESLEAVTSLLDPLFQELATDTRSGVQKALKSRQKVIQAELAEEERLEAMLS   60

Query:   61 YEKKLYIEHINLIAGIDEVGRGPLAGPVVAAAVILPPNCKIKHLNDSKKIPKKKHQEIYQ   120
            YEK LY +     IAGIDEVGRGPLAGPVVAA VILP  CKIK LNDSKKIPK KH+ IYQ
Sbjct:   61 YEKALYKKGYKAIAGIDEVGRGPLAGPVVAACVILPKYCKIKGLNDSKKIPKAKHETIYQ   120

Query:  121 NILDQALAVGIGIQDSQCIDDINIYEATKHAMIDAVSHLS---VAPEHLLIDAMVLDLSI   177
              + ++ALA+GIGI D+Q ID++NIYEATK AM++A+  L        P++LLIDAM LD++I
Sbjct:  121 AVKEKALAIGIGIIDNQLIDEVNIYEATKLAMLEAIKQLEGQLTQPDYLLIDAMTLDIAI   180

Query:  178 PQTKIIKGDANSLSIAAASIVAKVTRDKIMSDYDSTYPGYAFSKNAGYGTKEHLEGLQKY   237
             Q   I+KGDANSLSIAAASIVAKVTRD++M++YD   +PGY F+KNAGYGTKEHL+GL+ Y
Sbjct:  181 SQQSILKGDANSLSIAAASIVAKVTRDQMMANYDRIFPGYDFAKNAGYGTKEHLQGLKAY   240

Query:  238 GITPIHRKSFEPIKSM                                             253
            GITPIHRKSFEP+KSM
Sbjct:  241 GITPIHRKSFEPVKSM                                             256
```

Based on this analysis, it was predicted that these proteins and their epitopes could be useful antigens for vaccines or diagnostics.

EXAMPLE 626

A DNA sequence (GBSx0666) was identified in *S. agalactiae* <SEQ ID 1949> which encodes the amino acid sequence <SEQ ID 1950>. Analysis of this protein sequence reveals the following:

```
Possible site: 16
>>> Seems to have no N-terminal signal sequence

----- Final Results -----
            bacterial cytoplasm --- Certainty = 0.1865(Affirmative) < succ>
             bacterial membrane --- Certainty = 0.0000(Not Clear)   < succ>
              bacterial outside --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 627

A DNA sequence (GBSx0667) was identified in *S. agalactiae* <SEQ ID 1951> which encodes the amino acid sequence <SEQ ID 1952>. Analysis of this protein sequence reveals the following:

```
Possible site: 14
>>> Seems to have no N-terminal signal sequence

----- Final Results -----
            bacterial cytoplasm --- Certainty = 0.3034(Affirmative) < succ>
             bacterial membrane --- Certainty = 0.0000(Not Clear)   < succ>
              bacterial outside --- Certainty = 0.0000(Not Clear)   < succ>
```

The protein has homology with the following sequences in the GENPEPT database:

```
>GP: BAB06195 GB: AP001515 unknown conserved protein [Bacillus halodurans]
Identities = 140/281 (49%), Positives = 195/281 (68%), Gaps = 5/281 (1%)

Query:   3 TIQWFPGHMSKARRQVQENIKHVDFVTILVDARLPLSSQNPMLTKIVGDKPKLMILNKAD   62
           TIQWFPGHM+KARR+V E +K +D V  L+DAR+PLSS+NPM+ +IV   KP+L++LNK D
Sbjct:   2 TIQWFPGHMAKARREVTEKLKLIDVVIELLDARVPLSSRNPMMDEIVAHKPRLVLLNKDD   61

Query:  63 LADPIRTKEWRDFYESQGLKTLAINSKEQSTVKKVTDIAKILMSDKIANLRGRGIQKETL  122
           LADP +TKEW  F+E  G    L IN++     V +++   + L    I    R +G++    +
Sbjct:  62 LADPSKTKEWTRFFEEGGATVLPINAQTGQGVSRISPACQTLAQALIEKQRAKGMKPRAI  121

Query: 123 RTMIIGIPNAGKSTLMNRLAGKKIAVVGNKPGVTKGQQWLKSNKELEILDTPGILWPKFE  182
           R MI+GIPN GKSTL+NRLA K+IA VG++PG+TK QQW+K  KELE+LDTPGILWPKF+
Sbjct: 122 RAMILGIPNVGKSTLINRLASKRIAKVGDRPGITKQQQWIKVGKELELLDTPGILWPKFD  181

Query: 183 DELVGLKLALTGAIKDQLLPMDEVTIFGLNYFKTYYPDRLKERFKSINLEDEAPEIIMAL  242
           D+  G +LA TGAIKD+LL   +V +F L Y +  YPDRL +R+K   L ++    + A+
Sbjct: 182 DQATGFRLAATGAIKDELLDFQDVALFVLRYMREMYPDRLMDRYKLNELPEDGVTLFDAI  241

Query: 243 TQKLGY-----RDDYDRFYNLFVKEVRDGKLGRYTLDIVGE                    278
           +K G+           DYD+    + ++E+R G LGR TL++ G+
Sbjct: 242 GKKRGHLLSGGYIDYDKTAEMILRELRAGTLGRITLEVPGK                    282
```

A related DNA sequence was identified in *S. pyogenes* <SEQ ID 1953> which encodes the amino acid sequence <SEQ ID 1954>. Analysis of this protein sequence reveals the following:

```
Possible site: 14
>>> Seems to have no N-terminal signal sequence

----- Final Results -----
            bacterial cytoplasm --- Certainty = 0.2688(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below:

```
Identities = 247/282 (87%), Positives = 265/282 (93%)

Query:   1 MATIQWFPGHMSKARRQVQENIKHVDFVTILVDARLPLSSQNPMLTKIVGDKPKLMILNK   60
           MA IQWFPGHMSKARRQVQEN+KHVDFVTILVDARLPLSSQNPMLTKIVGDKPKLMILNK
```

```
                              -continued
Sbjct:    1 MAMIQWFPGHMSKARRQVQENVKHVDFVTILVDARLPLSSQNPMLTKIVGDKPKLMILNK    60

Query:   61 ADLADPIRTKEWRDFYESQGLKTLAINSKEQSTVKKVTDIAKILMSDKIANLRGRGIQKE   120
            ADLAD  RTKEW+  +YESQG+KTLAINSKEQSTVKKVT+ AK LM+DKI   LR RGIQKE
Sbjct:   61 ADLADATRTKEWKAYYESQGIKTLAINSKEQSTVKKVTEAAKELMADKIQRLRERGIQKE   120

Query:  121 TLRTMIIGIPNAGKSTLMNRLAGKKIAVVGNKPGVTKGQQWLKSNKELEILDTPGILWPK   180
            TLRTMIIGIPNAGKSTLMNRLAGKKIAVVGNKPGVTKGQQWLKSNKELEILDTPGILWPK
Sbjct:  121 TLRTMIIGIPNAGKSTLMNRLAGKKIAVVGNKPGVTKGQQWLKSNKELEILDTPGILWPK   180

Query:  181 FEDELVGLKLALTGAIKDQLLPMDEVTIFGLNYFKTYYPDRLKERFKSINLEDEAPEIIM   240
            FEDELVGLKLALTGAIKDQLLPMDEVTIFGLNYF+ YYP+RL +RFK+I LE+EAPEIIM
Sbjct:  181 FEDELVGLKLALTGAIKDQLLPMDEVTIFGLNYFREYYPNRLTKRFKNIPLEEEAPEIIM   240

Query:  241 ALTQKLGYRDDYDRFYNLFVKEVRDGKLGRYTLDIVGEHDGN                    282
             LT++LG++DDYDRFY LFVKEVRDGKLG+YTLD VG+ D +
Sbjct:  241 TLTRQLGFKDDYDRFYTLFVKEVRDGKLGQYTLDQVGDMDAD                    282
```

Based on this analysis, it was predicted that these proteins and their epitopes could be useful antigens for vaccines or diagnostics.

EXAMPLE 628

A DNA sequence (GBSx0668) was identified in *S. agalactiae* <SEQ ID 1955> which encodes the amino acid sequence <SEQ ID 1956>. Analysis of this protein sequence reveals the following:

```
Possible site: 24
>>> Seems to have a cleavable N-term signal seq.

----- Final Results -----
            bacterial outside  --- Certainty = 0.3000(Affirmative) < succ>
           bacterial membrane  --- Certainty = 0.0000(Not Clear)   < succ>
           bacterial cytoplasm --- Certainty = 0.0000(Not Clear)   < succ>
```

A related GBS nucleic acid sequence <SEQ ID 9825> which encodes amino acid sequence <SEQ ID 9826> was also identified.

The protein has homology with the following sequences in the GENPEPT database:

```
>GP: CAB12129 GB: Z99105 similar to hypothetical proteins [Bacillus
subtilis]
Identities = 69/173 (39%), Positives = 102/173 (58%), Gaps = 13/173 (7%)

Query:   29 DKAKEKASV-----IKQASQTSQTSKKEVLQKKT----YPNLNKYSNLEIHVSSTRQTMT    79
            D A+E AS+       ++  +T+K  +   K    YP++ K  ++ I V+    Q
Sbjct:   22 DHAEEHASINTKKTVENITDVRKTAKTSIDWTKPSGGEYPDI-KQKHVWIDVNVKEQKAY    80

Query:   80 ITSNDKVIFKTIVSTG---AKESPTPKGTFVIEPERGDFFYNASSKEGAYYWVSFKEHGI   136
            I        I+   ++S+G    K+   TPKGTF +EPERG++F++     +EGA YWVS+K HG
Sbjct:   81 IKEGSNTIYTMMISSGLDQTKDDATPKGTFYVEPERGEWFFSEGYQEGAEYWVSWKNHGE   140

Query:  137 YLFHSVPTDQQGNEIPEEAKQLGKAASHGCVRMSRADAKWFYENIPQGTTVTI         189
            +LFHSVP +    I  EA++LG   SHGC+R++  DAKW YENIP+ T V I
Sbjct:  141 FLFHSVPMTKDQKVIKTEAEKLGTKVSHGCIRLTIPDAKWVYENIPEHTKVVI         193
```

No corresponding DNA sequence was identified in *S. pyogenes*.

Figure 130:
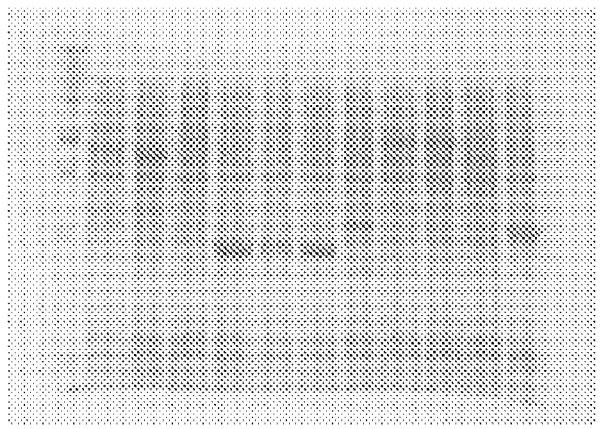

SEQ ID 1956 (GBS644) was expressed in *E. coli* as a GST-fusion product. SDS-PAGE analysis of total cell extract is shown in FIG. 130 (lane 2 & 3; MW 49.6 kDa) and in FIG. 186 (lane 3; MW 50 kDa). It was also expressed in *E. coli* as a His-fusion product. SDS-PAGE analysis of total cell extract is shown in FIG. 130 (lane 5-7; MW 24.6 kDa) and in FIG. 177 (lane 3; MW 25 kDa).

GBS644-GST was purified as shown in FIG. 236, lane 9.

Based on this analysis, it was predicted that these proteins and their epitopes could be useful antigens for vaccines or diagnostics.

EXAMPLE 629

A DNA sequence (GBSx0669) was identified in *S. agalactiae* <SEQ ID 1957> which encodes the amino acid sequence <SEQ ID 1958>. This protein is predicted to be carbon starvation protein A. Analysis of this protein sequence reveals the following:

```
Possible site: 19
>>> Seems to have an uncleavable N-term signal seq
INTEGRAL Likelihood = -11.25  Transmembrane 129-145 (122-151)
INTEGRAL Likelihood =  -9.92  Transmembrane 316-332 (305-342)
INTEGRAL Likelihood =  -6.42  Transmembrane 164-180 (157-181)
INTEGRAL Likelihood =  -5.73  Transmembrane 443-459 (441-466)
INTEGRAL Likelihood =  -5.57  Transmembrane 416-432 (414-435)
INTEGRAL Likelihood =  -4.88  Transmembrane 190-206 (183-209)
INTEGRAL Likelihood =  -4.83  Transmembrane  78-94  (70-95)
INTEGRAL Likelihood =  -3.13  Transmembrane 362-378 (359-379)
INTEGRAL Likelihood =  -2.34  Transmembrane 228-244 (227-245)
INTEGRAL Likelihood =  -2.02  Transmembrane   2-18  (1-18)
INTEGRAL Likelihood =  -1.28  Transmembrane 393-409 (393-410)

----- Final Results -----
          bacterial membrane --- Certainty = 0.5501 (Affirmative) < succ>
           bacterial outside --- Certainty = 0.0000 (Not Clear)   < succ>
         bacterial cytoplasm --- Certainty = 0.0000 (Not Clear)   < succ>
```

The protein has homology with the following sequences in the GENPEPT database:

```
>GP: AAF93852 GB: AE004154 carbon starvation protein A, putative
[Vibrio cholerae]
Identities = 220/470 (46%), Positives = 311/470 (65%), Gaps = 16/470 (3%)

Query:   1 MVTFLGGVALLIVGYFTYGRYIEKNFQIDENRQTPAEALRDGYDFVPMPKWKNGMIELLN   60
           M+ FL  VA L+ GYF YG ++EK F I+E RQTPA   DG D+VPM  K   +++LLN
Sbjct:   1 MLWFLTCVAALVGGYFIYGAFVEKVFGINEKRQTPAHTKTDGVDYVPMSTPKVYLVQLLN   60

Query:  61 IAGTGPIFGPILGALYGPVAYIWIVLGCIFAGAVHDYMIGMISLRNNGAYLPELASRYLG  120
           IAG GPIFGPI+GALYGP A +WIV+GCIFAGAVHDY  GM+S+RN GA +P +  RYLG
Sbjct:  61 IAGVGPIFGPIMGALYGPAAMLWIVVGCIFAGAVHDYFSGMLSIRNGGASVPSITGRYLG  120

Query: 121 KSMKHVINIFSMLLLILVATVFVVTPANLILSILPAG---TLSLPWIIGLIFVYYLISTV  177
           KH +NIF+++LL+LV  VFV  PA +I +++      T+S+  ++ +IF YY+++T+
Sbjct: 121 NGAKHFMNIFAIVLLLLVGVVFVSAPAGMITNLINQQTDFTVSMTTMVVIIFAYYILATI  180

Query: 178 LPIDKALGKVYPVF-------CVILMVSTAAVGFRLLTGGFDMPNLTFETFKNMHPAGLG  230
           +P+DK +G+ YP+F        V LM + A     + GGF++ ++      KN++P   +
Sbjct: 181 VPVDKIIGRFYPLFGALLIFMSVGLMTAIAFSSEHQVLGGFEISDMV----KNLNPNDMP  236

Query: 231 IFPALFFTISCGAISGFHATQAPMVSRTTVNEREGRFTFYGMMIAEGVIAMIWAGASMSL  290
           ++PALF TI+CGAISGFHATQ+P+++R    NE+ GRF FYG MI EG+IA+IW   ++S
Sbjct: 237 LWPALFITIACGAISGFHATQSPLMARCMENEKNGRFVFYGAMIGEGIIALIWCTVALSF  296

Query: 291 FKG-QNLYEMIAAGTPSAVVNQVMLMLLGSVIGTIAIIGVIVLPVSSGLSAFRSLRTIVA  349
           F   +  L E +  G P VV       LLG  G IA +GV++LP++SG +AFRS R I+A
Sbjct: 297 FGSLEALSEAVKNGGPGNVVYGASFGLLGVFGGVIAFLGVVILPITSGDTAFRSSRLILA  356

Query: 350 DYIHVKQDTLPKIFAVTIPLYVISFVLTHVDFNLLWRYFNWANQVTAVIGLLVATRYLIL  409
           +Y +++Q TL    + +PL+VI  VLT VDF ++WRYF +ANQ TAV+ L   AT YL++
Sbjct: 357 EYFNMEQKTLRNRLLMAVPLFVIGAVLTQVDFGIIWRYFGFANQATAVMMLWTATAYLMR  416

Query: 410 KRRNYWVTFVPAMFMLYAVVVYIL-SQPIGFNMGLGILTYSLALVLTGIL          458
           +  +W+ VPA+FM  + +IL S +GF + +  IT +   L    G L
Sbjct: 417 HNKLHWICTVPALFMTTVCISFILNSSTLGFGLPMQISTIAGVLASLGAL          466
```
                                      50

No corresponding DNA sequence was identified in *S. pyogenes*.

A related GBS gene <SEQ ID 8623> and protein <SEQ ID 8624> were also identified. Analysis of this protein sequence reveals the following:

```
Lipop: Possible site: -1 Crend: 0
McG: Discrim Score: 6.07
GvH: Signal Score (-7.5): -3.54
Possible site: 19
>>> Seems to have an uncleavable N-term signal seq
ALOM program count: 11 value: -11.25 threshold: 0.0
INTEGRAL Likelihood = -11.25  Transmembrane 129-145 (122-157)
INTEGRAL Likelihood =  -9.92  Transmembrane 316-332 (305-342)
INTEGRAL Likelihood =  -6.42  Transmembrane 164-180 (157-181)
INTEGRAL Likelihood =  -5.57  Transmembrane 416-432 (414-435)
INTEGRAL Likelihood =  -4.88  Transmembrane 190-206 (183-209)
```

```
                            -continued
INTEGRAL Likelihood = -4.83   Transmembrane    78-94  (70-95)
INTEGRAL Likelihood = -4.67   Transmembrane   445-461 (441-463)
INTEGRAL Likelihood = -3.13   Transmembrane   362-378 (359-379)
INTEGRAL Likelihood = -2.34   Transmembrane   228-244 (227-245)
INTEGRAL Likelihood = -2.02   Transmembrane     2-18  (1-18)
INTEGRAL Likelihood = -1.28   Transmembrane   393-409 (393-410)
PERIPHERAL Likelihood =  0.21  272
modified ALOM score: 2.75

*** Reasoning Step: 3

----- Final Results -----
            bacterial membrane --- Certainty = 0.5501 (Affirmative) < succ>
             bacterial outside --- Certainty = 0.0000 (Not Clear) < succ>
              bacterial cytoplasm --- Certainty = 0.0000 (Not Clear) < succ>
```

The protein has homology with the following sequences in the databases:

```
ORF01729(301-1668 of 2082)
GP|9655126|gb|AAF93852.1||AE004154(1-464 of 494) carbon starvation protein A,
putative {Vibrio cholerae}
% Match = 29.9
% Identity = 47.6  % Similarity = 68.6
Matches = 218  Mismatches = 138  Conservative Sub.s = 96
174       204       234       264       294       324       354       384
TNEKLFIIKLRLFISKKQPFILKIGNFNFSMLY*SHENA**N*AKKFLGGSDMVTFLGGVALLIVGYFTYGRYIEKNFQI
                                          |: ||   || |: ||| || :: ||  |
                                          MLWFLTCVAALVGGYFIYGAFVEKVFGI
                                          10        20
414       444       474       504       534       564       594       624
DENRQTPAEALRDGYDFVPMPKWKNGMIELLNIAGTPIFGPILGALYGPVAYIWIVLGCIFAGAVHDYMIGMISLRNNG
: | |||||     || :|||    |   :::|||||| |||||||:||||||  : ||| :||||||||||   ||:|:|| |
NEKRQTPAHTKTDGVDYVPMSTPKVYLVQLLNIAGVGPIFGPIMGALYGPAAMLWIVVGCIFAGAVHDYFSGMLSIRNGG
           40        50        60        70        80        90        100
654       684       714       744       774       795       825       855
AYLPELASRYLGKSMKHVINIFSMLLLILVATVFVVTPANLILSILPAGT---LSLPWIIGLIFVYYLISTVLPIDKALG
| :| :   |||| || :|||::|:|| ||| || :| :::    |  :|:  :: :|| |:::|::|::|  :|
ASVPSITGRYLGNGAKHFMNIFAIVLLLLVGVVFVSAPAGMITNLINQQTDFTVSMTTMVVIIFAYYILATIVPVDKIIG
        120       130       140       150       160       170       180
894       924       954       984       1014      1044      1074
KVYP------VFCVI-LMVSTAAVGFRLLTGGFDMPNLTFETFKNMHPAGLGIFPALFFTISCGAISGFHATQAPMVSRT
: ||         :|    : ||  :       : |||:: :::       ||::|   || ||||||||||||||:|:::|
RFYPLFGALLIFMSVGLMTAIAFSSEHQVLGGFEISDM----VKNLNPNDMPLWPALFITIACGAISGFHATQSPLMARC
        200       210       220       230       240       250       260
1104      1134      1164      1191      1221      1251      1281      1311
TVNEREGRFTFYGMMIAEGVIAMIWAGASMSLFKG-QNLYEMIAAGTPSAVVNQVMLMLLGSVIGTIAIIGVIVLPVSSG
   ||: |||  |||   ||   ||::||:||     ::|:|   :  |  |  ||    :  |||      |  || ::||::||
MENEKNGRFVFYGAMIGEGIIALIWCTVALSFFGSLEALSEAVKNGGPGNVVYGASFGLLGVFGGVIAFLGVVILPITSG
        280       290       300       310       320       330       340
1341      1371      1401      1431      1461      1491      1521      1551
LSAFRSLRTIVADYIHVKQDTLPKIFAVTIPLYVISFVLTHVDFNLLWRYFNWANQVTAVIGLLVATRYLILKRRNYWVT
:||||  | |:|:|   :  :  :||:||    |||||     |||: ||||||  |  ||||: :   ||:       : |:
DTAFRSSRLILAEYFNMEQKTLRNRLLMAVPLFVIGAVLTQVDFGIIWRYFGFANQATAVMMLWTATAYLMRHNKLHWIC
        360       370       380       390       400       410       420
1581      1608      1638      1668      1698      1728      1758      1788
FVPAMFMLYAVVVYIL-SQPIGFNMGLGILTYSLALVLTGIXVGLFWKSGQKQLKTVHPEAFLFNDHRPINYYSSLDS*Y
 |||:||    : :||   :|| : :  ||| :    |    |
TVPALFMTTVCISFILNSSTLGFGLPMQISTIAGVLASLGALAYVAKVSKGKGETDLADEEKPQGVTKTA
        440       450       460       470       480       490
```

Based on this analysis, it was predicted that these proteins and their epitopes could be useful antigens for vaccines or diagnostics.

EXAMPLE 630

A DNA sequence (GBSx0670) was identified in *S. agalactiae* <SEQ ID 1959> which encodes the amino acid sequence <SEQ ID 1960>. This protein is predicted to be lytR (lytT). Analysis of this protein sequence reveals the following:

```
Possible site: 30
>>> Seems to have no N-terminal signal sequence
   INTEGRAL      Likelihood = -0.80     Transmembrane    27-43 (27-43)
```

```
----- Final Results -----
            bacterial membrane --- Certainty = 0.1319 (Affirmative) < succ>
            bacterial outside  --- Certainty = 0.0000 (Not Clear)   < succ>
            bacterial cytoplasm --- Certainty = 0.0000 (Not Clear)  < succ>
```

The protein has homology with the following sequences in the GENPEPT database:

```
>GP: AAB48183 GB: L42945 lytR [Staphylococcus aureus]
Identities = 93/245 (37%), Positives = 150/245 (60%), Gaps = 3/245 (1%)

Query:    1 MKVLVVDDEPVARNELIYLLNKYDSNLVIAEAHDMATALAILLRETFDVALLDIHLRDDS    60
            MK L++DDEP+ARNEL YLLN+      I EA ++   L  LL   +D+  LD++L D++
Sbjct:    1 MKALIIDDEPLARNELTYLLNEIGGFEEINEAENVKETLEALLINQYDIIFLDVNLMDEN    60

Query:   61 GLQLAEYINKMPKPPLLIFATAYDQYAIQAFEHDARDYLLKPYDFDRLKQAMDRVKGALS   120
            G++L   I KM +PP +IFATA+DQYA+QAFE +A DY+LKP+    R++QA+++V+   +
Sbjct:   61 GIELGAKIQKMKEPPAIIFATAHDQYAVQAFELNATDYILKPFGQKRIEQAVNKVRATKA   120

Query:  121 TSTIIESVTSGPL---FKQQYPLTVEDRIYLVSADDILLIEAMQGKLIIQTPDKNYEIDG   177
                  S + +   F Q  P+ ++D+I+++   +I+ I     G   I T + YE
Sbjct:  121 KDDNNASAIANDMSANFDQSLPVEIDDKIHMLKQQNIIGIGTHNGITTIHTTNHKYETTE   180

Query:  178 SLQQWQDKLPSSQFVRVHRSYIVNINAIKTIEPWFNQTLQLHLCNKITVPVSRANVKPLK   237
              L +++ +L  + F+R+HRSYI+N    IK ++ WFN T   + L N + + V R+ +K   K
Sbjct:  181 PLNRYEKRLNPTYFIRIHRSYIINTKHIKEVQQWFNYTYMVILTNGVKMQVGRSFMKDFK   240

Query:  238 QMLGI                                                         242
              +G+
Sbjct:  241 ASIGL                                                         245
```

There is also homology to SEQ ID 460.

Figure 75:
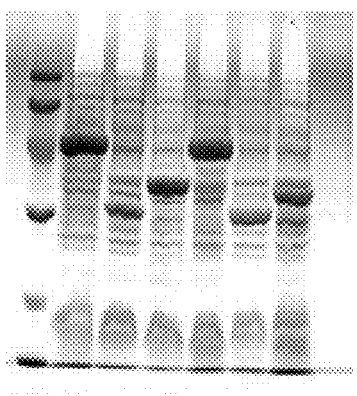
Figure 84:
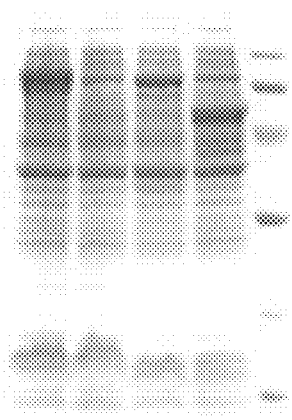

SEQ ID 1960 (GBS399) was expressed in *E. coli* as a His-fusion product. SDS-PAGE analysis of total cell extract is shown in FIG. 75 (lane 7; MW 30.4 kDa). It was also expressed in *E. coli* as a GST-fusion product. SDS-PAGE analysis of total cell extract is shown in FIG. 84 (lane 2; MW 55 kDa). Purified GBS399-GST is shown in FIG. 217, lane 9; purified GBS399d-GST is shown in FIG. 236, lane 3.

Based on this analysis, it was predicted that this protein and its epitopes, could be useful antigens for vaccines or diagnostics.

EXAMPLE 631

A DNA sequence (GBSx0671) was identified in *S. agalactiae* <SEQ ID 1961> which encodes the amino acid sequence <SEQ ID 1962>. Analysis of this protein sequence reveals the following:

```
Possible site: 51
>>> Seems to have a cleavable N-term signal seq.
INTEGRAL Likelihood = -7.59 Transmembrane  95-111 (86-116)
INTEGRAL Likelihood = -5.95 Transmembrane 155-171 (152-176)
INTEGRAL Likelihood = -2.28 Transmembrane 189-205 (187-206)
INTEGRAL Likelihood = -1.49 Transmembrane 122-138 (121-138)

----- Final Results -----
            bacterial membrane --- Certainty = 0.4036 (Affirmative) < succ>
            bacterial outside  --- Certainty = 0.0000 (Not Clear)   < succ>
            bacterial cytoplasm --- Certainty = 0.0000 (Not Clear)  < succ>
```

The protein has homology with the following sequences in the GENPEPT database:

```
>GP: AAB48182 GB: L42945 lytS [Staphylococcus aureus]
Identities = 264/570 (46%), Positives = 389/570 (67%), Gaps = 2/570 (0%)

Query:    1 MTLFLIMMERAGLIILLAYAFVHIPFIKQTLKQPELKKHQYILLILFSLFAIISNFTGVE    60
            ++L ++++ER GLII+LAY  ++IP+ K  +     K ++ L I+FSLFA++SN TG+
Sbjct:    2 LSLTMLLLERVGLIIILAYVLMNIPYFKNLMNRRRTWKARWQLCIIFSLFALMSNLTGIV    61

Query:   61 IQSDLSIIPQTLNHIADQSSVANTRVLTIGVSGLIGGPIVGIIVGLLSVFVRYLQGGLAP   120
              I    S+      + D  S+ANTRVLTIGV+GL+GGP VG+ VG++S    R   GG
Sbjct:   62 IDHQHSLSGSVYFRLDDDVSLANTRVLTIGVAGLVGGPFVGLFVGVISGIFRVYMGGADA   121

Query:  121 HIYVISSLLIGLCSGLSGNYLRKNYNKIRVLDAMVVGFGMEILQMICILIFSVDFNQALR   180
                +Y+ISS+ IG+ +G  G    ++    +   + ++G ME++QM+ IL FS D   A+
Sbjct:  122 QVYLISSIFIGIIAGYFGLQAQRRKRYPSIAKSAMIGIVMEMIQMLSILTFSHDKAYAVD   181
```

-continued

```
Query: 181 LVSFISMPMILSNTLGLGIFISIISSTQKLEEHAKAFQTHQVLELANLTLPYLRKGLTTE  240
            L+S I++PMI+ N++G   IF+SII   T K E+  K  QTH VL+L N T PY ++GL  E
Sbjct: 182 LISLIALPMIIVNSVGPAIFIMSIIIPTLKQEDQMKPVQTHDVLQLMNQTFPYFKEGLNRE  241

Query: 241 SCQPVAEIIHKHMDVSAVSLTSQSAILAYVGDGADHHLPNTQILTKLAKRAIDTGKVSVA   300
            S Q +A II   M VS+V++TS++ IL++VG G+DHH+P  +ILT L+K  + +GK+
Sbjct: 242 SAQQIAMIIKNLMKVSSVAITSKNEILSHVGGGSDHHIPTNEILTSLSKDVLKSGKLKEV   301

Query: 301 TDKSEIECDHKNCPLSSAIVIPLHIHDVIVGTLKLYFSDAQHMTYVDRQLAEGLGNIFST   360
            K EI C H NCPL +AIVIPL +H   IVGTLK+YF++     +T+V+RQLAEGL NIFS+
Sbjct: 302 HTKEEIGCSHPNCPLRAAIVIPLEMHGSIVGTLKMYFTNPNDLTFVERQLAEGLANIFSS   361

Query: 361 QLALGQAEEATRLLQDAEMKSLQAQVNPHFLFNALNTIYGLIRMDSEKARKLVQDFSKVI   420
            Q+ LG+AE  ++LL+DAE+KSLQAQV+PHF FN++N I  L+R++SEKAR+L+ + S
Sbjct: 362 QIELGEAETQSKLLKDAEIKSLQAQVSPHFFFNSINPISALVRINSEKARELLLELSYFF   421

Query: 421 RANLQRAKQNLIPLHDELEQVNAYLALEEARFPNMVAFNLDNQTNSDDNLMIPPFTLQVL   480
            RANLQ +KQ+ I L   EL QV AYL+LE+AR+P    N++ +    D +++PPF +Q+L
Sbjct: 422 RANLQGSKQHTITLDKELSQVRAYLSLEQARYPGRFNININVEDKYRD-VLVPPFLIQIL   480

Query: 481 IENSYKHAFKHVNKNNQLKVTIARNN-DRLHIIVQDNGIGIPKEKLITLGKKTQISKQGS   539
            +EN+ KHAF +  + N + V++ +    + IIVQDNG GI K+K+  LG+ +  S+ G+
Sbjct: 481 VENAIKHAFTNRKQGNDIDVSVIKETATHVRIIVQDNGQGISKDKMHLLGETSVESESGT   540

Query: 540 GTAIENLVRRLNIIYDQASLKFESNDSGT                                569
            G+A+ENL RL ++   A+L+FES  SGT
Sbjct: 541 GSALENLNLRLKGLFGKSAALQFESTSSGT                               570
```

A related DNA sequence was identified in *S. pyogenes* <SEQ ID 1963> which encodes the amino acid sequence <SEQ ID 1964>. Analysis of this protein sequence reveals the following:

```
Possible site: 39
>>> Seems to have no N-terminal signal sequence
INTEGRAL Likelihood = -6.79 Transmembrane 283-299 (276-307)
INTEGRAL Likelihood = -5.57 Transmembrane  27-43 (24-48)

----- Final Results -----
             bacterial membrane --- Certainty = 0.3718 (Affirmative) < succ>
              bacterial outside --- Certainty = 0.0000 (Not Clear) < succ>
             bacterial cytoplasm --- Certainty = 0.0000 (Not Clear) < succ>
```

The protein has homology with the following sequences in the databases:

```
>GP: CAB54576 GB: AJ006396 histidine kinase [Streptococcus pneumoniae]
Identities = 115/231 (49%), Positives = 159/231 (68%), Gaps = 7/231 (3%)

Query: 351 MLASIKAYIDEVYVLEVEQRDAQMRALQSQINPHFLYNTLEYIRMYALSCQQEELADVIY  410
            ML ++  I ++Y LE+ Q+DA MRALQ+QINPHF+YNTLE++RMYA+   Q+ELAD+IY
Sbjct:   1 MLDRLEKNIHDIYQLELSQRDANMRALQAQINPHFMYNTLEFLRMYAVMQSQDELADIIY   60

Query: 411 AFASLLRNNISQDKMTTLKEELAFCEKYIYLYQMRYPDSFAYHVKIDESVADLAIPKFVI  470
            F+SLLRNNIS ++ T LK+EL FC KY YL  +RYP S AY   KID  + ++ IPKF +
Sbjct:  61 EFSSLLRNNISDERETLLKQELEFCRKYSYLCMVRYPKSIAYGFKIDPELENMKIPKFTL  120

Query: 471 QPLVENYFVHGIDYSRHDNALSIKALDETDHLLIQVLDNGRGISQERLADMEKRLQ----  526
            QPLVENYF  HG+D+ R DN +SIKAL+   + I V+DNGRG+S E+LA++ ++L
Sbjct: 121 QPLVENYFAHGVDHRRTDNVISIKALKQDGFVEILVVDNGRGMSAEKLANIREKLSQRYF  180

Query: 527 EHQTT---GNSSIGLQNVYLRLFHHFRDRVSWSMAKEPNGGFIIQIRIRKD           574
            EHQ +      SIG+ NV+ R  +F DR + ++       G  +I I+ +
Sbjct: 181 EHQASYSDQRQSIGIVNVHERFVLYFGDRYAITIESAEQAGVQYRITIQDE           231
```

An alignment of the GAS and GBS proteins is shown below:

```
Identities = 59/180 (32%), Positives = 97/180 (53%), Gaps = 8/180 (4%)

Query: 375 QDAEMKSLQAQVNPHFLFNALNTI--YGLIRMDSEKARKLVQDFSKVIRANLQRAKQNLI  432
            +DA+M++LQ+Q+NPHFL+N L  I  Y L    E A  ++  F+ ++R N+ + K  +
Sbjct: 370 RDAQMRALQSQINPHFLYNTLEYIRMYALSCQQEELA-DVIYAFASLLRNNISQDK--MT  426
```

-continued

```
Query: 433 PLHDELEQVNAYLALEEARFPNMVAFNLDNQTNSDDNLMIPPFTLQVLIENSYKHAFKHV 492
           L +EL      Y+ L + R+P+ A+++    + D L IP F +Q L+EN + H   +
Sbjct: 427 TLKEELAFCEKYIYLYQMRYPDSFAYHVKIDESVAD-LAIPKFVIQPLVENYFVHGIDYS 485

Query: 493 NKNNQLKVTIARNNDRLHIIVQDNGIGIPKEKLITLGKKTQISKQ--GSGTAIENLVRRL 550
           +N L +     D L I V DNG GI +E+L  + K+ Q  +    S   ++N+ RL
Sbjct: 486 RHDNALSIKALDETDHLLIQVLDNGRGISQERLADMEKRLQEHQTTGNSSIGLQNVYLRL 545
```

Based on this analysis, it was predicted that these proteins and their epitopes could be useful antigens for vaccines or diagnostics.

EXAMPLE 632

A DNA sequence (GBSx0672) was identified in *S. agalactiae* <SEQ ID 1965> which encodes the amino acid sequence <SEQ ID 1966>. Analysis of this protein sequence reveals the following:

```
Possible site: 24
>>> May be a lipoprotein

----- Final Results -----
            bacterial membrane  --- Certainty = 0.0000 (Not Clear) < succ>
            bacterial outside   --- Certainty = 0.0000 (Not Clear) < succ>
            bacterial cytoplasm --- Certainty = 0.0000 (Not Clear) < succ>
```

A related GBS nucleic acid sequence <SEQ ID 9827> which encodes amino acid sequence <SEQ ID 9828> was also identified.

The protein has no significant homology with any sequences in the GENPEPT database.

No corresponding DNA sequence was identified in *S. pyogenes*.

Based on this analysis, it was predicted that these proteins and their epitopes could be useful antigens for vaccines or diagnostics.

EXAMPLE 633

A DNA sequence (GBSx0673) was identified in *S. agalactiae* <SEQ ID 1967> which encodes the amino acid sequence <SEQ ID 1968>. Analysis of this protein sequence reveals the following:

```
Possible site: 57
>>> Seems to have no N-terminal signal sequence
INTEGRAL    Likelihood = -9.55    Transmembrane      52-68 (45-74)
INTEGRAL    Likelihood = -9.18    Transmembrane      83-99 (76-106)
INTEGRAL    Likelihood = -8.76    Transmembrane     126-142 (118-146)
INTEGRAL    Likelihood = -7.48    Transmembrane     174-190 (170-191)
INTEGRAL    Likelihood = -3.66    Transifiembrane   195-211 (193-212)
INTEGRAL    Likelihood = -1.28    Transmembrane      24-40 (24-40)

----- Final Results -----
            bacterial membrane  --- Certainty = 0.4821 (Affirmative) < succ>
            bacterial outside   --- Certainty = 0.0000 (Not Clear)   < succ>
            bacterial cytoplasm --- Certainty = 0.0000 (Not Clear)   < succ>
```

The protein has no significant homology with any sequences in the GENPEPT database.

No corresponding DNA sequence was identified in *S. pyogenes*.

A related GBS gene <SEQ ID 8625> and protein <SEQ ID 8626> were also identified. Analysis of this protein sequence reveals the following:

```
Lipop: Possible site: -1 Crend: 8
McG: Discrim Score: -8.54
GvH: Signal Score (-7.5): -5.6
Possible site: 57
>>> Seems to have no N-terminal signal sequence
ALOM program       count: 6       value: -9.55         threshold: 0.0
```

```
                          -continued
INTEGRAL      Likelihood = -9.55     Transmembrane     52-68  (45-74)
INTEGRAL      Likelihood = -9.18     Transmembrane      83-99  (76-106)
INTEGRAL      Likelihood = -8.76     Transmembrane    126-142 (118-146)
INTEGRAL      Likelihood = -7.48     Transmembrane    174-190 (170-191)
INTEGRAL      Likelihood = -3.66     Transmembrane    195-211 (193-212)
INTEGRAL      Likelihood = -1.28     Transmembrane     24-40  (24-40)
PERIPHERAL    Likelihood = 13.05                    100
modified ALOM score: 2.41

*** Reasoning Step: 3

----- Final Results -----
          bacterial membrane --- Certainty = 0.4821 (Affirmative) < succ>
           bacterial outside --- Certainty = 0.0000 (Not Clear)  < succ>
         bacterial cytoplasm --- Certainty = 0.0000 (Not Clear)  < succ>
```

Based on this analysis, it was predicted that these proteins and their epitopes could be useful antigens for vaccines or diagnostics.

EXAMPLE 634

A DNA sequence (GBSx0674) was identified in *S. agalactiae* <SEQ ID 1969> which encodes the amino acid sequence <SEQ ID 1970>. Analysis of this protein sequence reveals the following:

```
Possible site: 51
>>> Seems to have no N-terminal signal sequence
INTEGRAL    Likelihood = -0.53       Transmembrane       83-99 (83-99)

----- Final Results -----
          bacterial membrane --- Certainty = 0.1213 (Affirmative) < succ>
           bacterial outside --- Certainty = 0.0000 (Not Clear)  < succ>
         bacterial cytoplasm --- Certainty = 0.0000 (Not Clear)  < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 635

A DNA sequence (GBSx0675) was identified in *S. agalactiae* <SEQ ID 1971> which encodes the amino acid sequence <SEQ ID 1972>. Analysis of this protein sequence reveals the following:

```
Possible site: 23
>>> Seems to have no N-terminal signal sequence

----- Final Results -----
         bacterial cytoplasm --- Certainty = 0.1902 (Affirmative) < succ>
          bacterial membrane --- Certainty = 0.0000 (Not Clear)  < succ>
           bacterial outside --- Certainty = 0.0000 (Not Clear)  < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 636

A DNA sequence (GBSx0676) was identified in *S. agalactiae* <SEQ ID 1973> which encodes the amino acid sequence <SEQ ID 1974>. Analysis of this protein sequence reveals the following:

```
Possible site: 20
>>> Seems to have no N-terminal signal sequence

----- Final Results -----
           bacterial cytoplasm --- Certainty = 0.4763 (Affirmative) < succ>
            bacterial membrane --- Certainty = 0.0000 (Not Clear)  < succ>
             bacterial outside --- Certainty = 0.0000 (Not Clear)  < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 637

A DNA sequence (GBSx0677) was identified in *S. agalactiae* <SEQ ID 1975> which encodes the amino acid sequence <SEQ ID 1976>. Analysis of this protein sequence reveals the following:

```
Possible site: 20
>>> Seems to have no N-terminal signal sequence

----- Final Results -----
           bacterial cytoplasm --- Certainty = 0.5089 (Affirmative) < succ>
            bacterial membrane --- Certainty = 0.0000 (Not Clear)  < succ>
             bacterial outside --- Certainty = 0.0000 (Not Clear)  < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 638

A DNA sequence (GBSx0678) was identified in *S. agalactiae* <SEQ ID 1977> which encodes the amino acid sequence <SEQ ID 1978>. Analysis of this protein sequence reveals the following:

```
Possible site: 25
>>> May be a lipoprotein

----- Final Results -----
            bacterial membrane --- Certainty = 0.0000 (Not Clear) < succ>
             bacterial outside --- Certainty = 0.0000 (Not Clear) < succ>
           bacterial cytoplasm --- Certainty = 0.0000 (Not Clear) < succ>
```

The protein has no significant homology with any sequences in the GENPEPT database.

No corresponding DNA sequence was identified in *S. pyogenes*.

Figure 26:
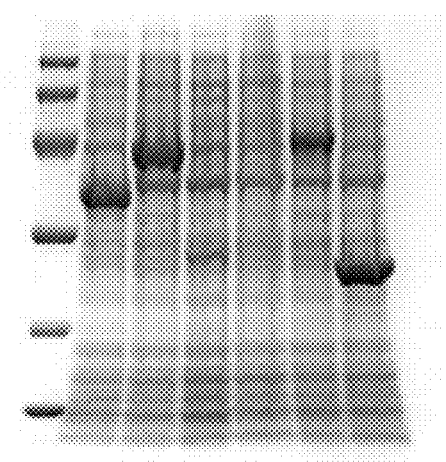
Figure 37:
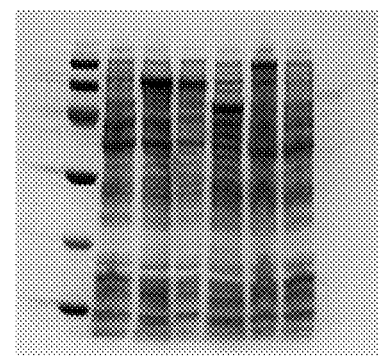

SEQ ID 1978 (GBS184) was expressed in *E. coli* as a His-fusion product. SDS-PAGE analysis of total cell extract is shown in FIG. 26 (lane 7; MW 21 kDa), in FIG. 168 (lane 14-16; MW 36 kDa—thioredoxin fusion) and in FIG. 238 (lane 9; MW 36 kDa). It was also expressed in *E. coli* as a GST-fusion product. SDS-PAGE analysis of total cell extract is shown in FIG. 37 (lane 7; MW 46.4 kDa).

Based on this analysis, it was predicted that this protein and its epitopes, could be useful antigens for vaccines or diagnostics.

EXAMPLE 639

A DNA sequence (GBSx0679) was identified in *S. agalactiae* <SEQ ID 1979> which encodes the amino acid sequence <SEQ ID 1980>. Analysis of this protein sequence reveals the following:

```
Possible site: 52
>>> Seems to have no N-terminal signal sequence

----- Final Results -----
          bacterial cytoplasm --- Certainty = 0.2179(Affirmative) < succ>
           bacterial membrane --- Certainty = 0.0000(Not Clear)   < succ>
            bacterial outside --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 640

A DNA sequence (GBSx0680) was identified in *S. agalactiae* <SEQ ID 1981> which encodes the amino acid sequence <SEQ ID 1982>. This protein is predicted to be immunogenic secreted protein precursor. Analysis of this protein sequence reveals the following:

```
Possible site: 34
>>> Seems to have no N-terminal signal sequence

----- Final Results -----
          bacterial cytoplasm --- Certainty = 0.2166(Affirmative) < succ>
           bacterial membrane --- Certainty = 0.0000(Not Clear)   < succ>
            bacterial outside --- Certainty = 0.0000(Not Clear)   < succ>
```

A related GBS nucleic acid sequence <SEQ ID 9351> which encodes amino acid sequence <SEQ ID 9352> was also identified.

A related DNA sequence was identified in *S. pyogenes* <SEQ ID 1983> which encodes the amino acid sequence <SEQ ID 1984>. Analysis of this protein sequence reveals the following:

```
Possible site: 19
>>> Seems to have an uncleavable N-term signal seq
    INTEGRAL      Likelihood = -3.77     Transmembrane    9-25 (5-27)

----- Final Results -----
           bacterial membrane --- Certainty = 0.2508(Affirmative) < succ>
            bacterial outside --- Certainty = 0.0000(Not Clear)   < succ>
          bacterial cytoplasm --- Certainty = 0.0000(Not Clear)   < succ>
```

An alignment of the GAS and GBS proteins is shown below:

```
Identities = 64/86 (74%), Positives = 76/86 (87%)

Query:   1 MGNGGDWKNKPGYQTTHEAKTGYAISFSPGQAGADRTYGHVAIVEDVKEDGSIPISESNV   60
           MGNGGDW+ KPG+ TTH+ K GY +SF+PGQAGAD TYGHVA+VE +KEDGSI ISESNV
Sbjct: 452 MGNGGDWQRKPGFVTTHKPKVGYVVSFAPGQAGADATYGHVAVVEQIKEDGSILISESNV  511

Query:  61 LGLGTISYRTFSAAEAAQLTYVVGEK                                    86
           +GLGTISYRTF+A +A+ LTYVVG+K
Sbjct: 512 MGLGTISYRTFTAEQASLLTYVVGDK                                   537
```

Based on this analysis, it was predicted that these proteins and their epitopes could be useful antigens for vaccines or diagnostics.

EXAMPLE 641

A DNA sequence (GBSx0681) was identified in *S. agalactiae* <SEQ ID 1985> which encodes the amino acid sequence <SEQ ID 1986>. This protein is predicted to be immunogenic secreted protein precursor. Analysis of this protein sequence reveals the following:

```
Possible site: 40
>>> Seems to have no N-terminal signal sequence

----- Final Results -----
              bacterial cytoplasm --- Certainty = 0.2495(Affirmative) < succ>
                bacterial membrane --- Certainty = 0.0000(Not Clear)  < succ>
                 bacterial outside --- Certainty = 0.0000(Not Clear)  < succ>
```

The protein has homology with the following sequences in the GENPEPT database:

```
AAB52379 GB: U31811 immunogenic secreted protein
precursor [Streptococcus pyogenes]
Identities = 133/259 (51%), Positives = 170/259 (65%), Gaps = 4/259 (1%)

Query:   3 PSQPQVTATPQKSEVVTPAITSGIDLPDVAIPTAMASAAYVKHWIGNDAYTHNLLSHRYG   62
           P QP + A    + V  P   S   DL  +  P++ +SAAYV+HW G+ AYTHNLLS RYG
Sbjct: 174 PIQPPLGAA---APVFAPWRESDKDLSKLK-PSSRSSAAYVRHWTGDSAYTHNLLSRRYG  229

Query:  63 ITAAQLDGFLQSTGITYDSSRIDGQKILDREKSSGLDARAIIAIAIAESSLGTQGVATAP  122
           ITA  QLDGFL S GI YD  R++G+++L+ EK +GLD RAI+AIA+AESSLGTQGVA
Sbjct: 230 ITAEQLDGFLNSLGIHYDKERLNGKRLLEWEKLTGLDVRAIVAIAMAESSLGTQGVAKEK  289

Query: 123 GANMFGFGAVDNNTTNAQNFSDDKAVIKMTQETIIQNQNTSFAIQDQKAQFLSTGNLNVA  182
           G+NMFG+GA D N  NA+ +SD+ A+  M ++TII N+N +F   QD KA+  S G L+
Sbjct: 290 GSNMFGYGAFDFNPNNAKKYSDEVAIRHMVEDTIIANKNQTFERQDLKAKKWSLGQLDTL  349

Query: 183 ARGGVYFTDASGSGKRRAAIMESIDKWIDAHGGISEISKELLNTSSVAMMAVPTSYSVSR  242
              GGVYFTD SGSG+RRA IM  +D+WID HG    +I + L TS       VP Y  S+
Sbjct: 350 IDGGVYFTDTSGSGQRRADIMTKLDQWIDDHGNTPDIPEHLKITSGTQFSEVPVGYKRSQ  409

Query: 243 ANQAGNYVAGTYPWGQRTW                                          261
              Y + TY +GQ TW
Sbjct: 410 PQNVLTYKSETYSFGQCTW                                          428
```

A related DNA sequence was identified in *S. pyogenes* <SEQ ID 1987> which encodes the amino acid sequence <SEQ ID 1988>. Analysis of this protein sequence reveals the following:

```
Possible site: 22
>>> Seems to have a cleavable N-term signal seq.

----- Final Results -----
                 bacterial outside --- Certainty = 0.3000(Affirmative) < succ>
                bacterial membrane --- Certainty = 0.0000(Not Clear)  < succ>
               bacterial cytoplasm --- Certainty = 0.0000(Not Clear)  < succ>
```

An alignment of the GAS and GBS proteins is shown below:

```
Identities = 143/265 (53%), Positives = 184/265 (68%), Gaps = 5/265 (1%)

Query:   2 VPSQPQVTATPQKSEVVTPA-----ITSGIDLPDVAIPTAMASAAYVKHWIGNDAYTHNL   56
           V + P  + +Q  E   TP       S +DL ++ IP+     AAYV+HW G +AYTH+L
Sbjct: 135 VDTAPASSLSKQLPEARTPIQSLSPYVSDLDLSEIDIPSVNTYAAYVEHWSGKNAYTHHL  194

Query:  57 LSHRYGITAAQLDGFLQSTGITYDSSRIDGQKILDREKSSGLDARAIIAIAIAESSLGTQ  116
           LS RYGI A Q+D +L+STGI YDS+RI+G+K+L   EK SGLD RAI+AIA++ESSLGTQ
Sbjct: 195 LSRRYGIKADQIDSYLKSTGIAYDSTRINGEKLLQWEKKSGLDVRAIVAIAMSESSLGTQ  254
```

```
Query: 117 GVATAPGANMFGFGAVDNNTTNAQNFSDDKAVIKMTQETIIQNQNTSFAIQDQKAQFLST 176
           G+AT   GANMFG+ A D + T A  F+DD A++KMTQ+TII+N+N++FA+QD KA    S
Sbjct: 255 GIATLLGANMFGYAAFDLDPTQASKFNDDSAIVKMTQDTIIKNKNSNFALQDLKAAKFSR 314

Query: 177 GNLNVAARGGVYFTDASGSGKRRAAIMESIDKWIDAHGGISEISKELLNTSSVAMMAVPT 236
           G LN A+ GGVYFTD +GSGKRRA IME +DKWID HGG   I  EL   SS +  +VP
Sbjct: 315 GQLNFASDGGVYFTDTTGSGKRRAQIMEDLDKWIDDHGGTPAIPAELKVQSSASFASVPA 374

Query: 237 SYSVSRANQAGNYVAGTYPWGQRTW                                  261
           Y +S++     Y A +Y WGQ TW
Sbjct: 375 GYKLSKSYDVLGYQASSYAWGQCTW                                  399
```

Based on this analysis, it was predicted that these proteins and their epitopes could be useful antigens for vaccines or diagnostics.

EXAMPLE 642

A DNA sequence (GBSx0682) was identified in *S. agalactiae* <SEQ ID 1989> which encodes the amino acid sequence <SEQ ID 1990>. Analysis of this protein sequence reveals the following:

```
Possible site: 27
>>> Seems to have a cleavable N-term signal seq.

----- Final Results -----
            bacterial outside --- Certainty = 0.3000(Affirmative) < succ>
           bacterial membrane --- Certainty = 0.0000(Not Clear)   < succ>
           bacterial cytoplasm --- Certainty = 0.0000(Not Clear)   < succ>
```

The protein has no significant homology with any sequences in the GENPEPT database.

No corresponding DNA sequence was identified in *S. pyogenes*.

A related GBS gene <SEQ ID 8627> and protein <SEQ ID 8628> were also identified. Analysis of this protein sequence reveals the following:

```
Lipop: Possible site: -1 Crend: 4
McG: Discrim Score: 11.56
GvH: Signal Score (-7.5): 0.870001
     Possible site: 27
>>> Seems to have a cleavable N-term signal seq.
ALOM program count: 0 value: 11.88 threshold: 0.0
   PERIPHERAL Likelihood = 11.88 63
modified ALOM score: -2.88
*** Reasoning Step: 3

----- Final Results -----
            bacterial outside --- Certainty = 0.3000(Affirmative) < succ>
           bacterial membrane --- Certainty = 0.0000(Not Clear)   < succ>
           bacterial cytoplasm --- Certainty = 0.0000(Not Clear)   < succ>
```

SEQ ID 8628 (GBS159) was expressed in *E. coli* as a His-fusion product. SDS-PAGE analysis of total cell extract is shown in FIG. 28 (lane 4; MW 26 kDa). It was also expressed in *E. coli* as a GST-fusion product. SDS-PAGE analysis of total cell extract is shown in FIG. 34 (lane 2; MW 41 kDa).

GBS159-GST was purified as shown in FIG. 198, lane 9.

Based on this analysis, it was predicted that these proteins and their epitopes could be useful antigens for vaccines or diagnostics.

EXAMPLE 643

A DNA sequence (GBSx0683) was identified in *S. agalactiae* <SEQ ID 1991> which encodes the amino acid sequence <SEQ ID 1992>. Analysis of this protein sequence reveals the following:

```
Possible site: 32
>>> Seems to have no N-terminal signal sequence

----- Final Results -----
            bacterial cytoplasm --- Certainty = 0.2668(Affirmative) < succ>
             bacterial membrane --- Certainty = 0.0000(Not Clear)   < succ>
              bacterial outside --- Certainty = 0.0000(Not Clear)   < succ>
```

The protein has homology with the following sequences in the GENPEPT database:

```
>GP: BAB04699 GB: AP001510 unknown conserved protein [Bacillus halodurans]
Identities = 32/76 (42%), Positives = 54/76 (70%)

Query:   7 LGSVIELKNDSQKVMITSRFPLYDNEGQLGYFDYSGCIFPISIVGNETYFFNLEDIDKVL   66
           +GS++ LK  + K+MI +R P+ +   G+    FDYSGC +P  +V ++ ++FN E+ID+V+
Sbjct:   4 IGSIVYLKEGTSKLMILNRGPILEANGENKMFDYSGCFYPQGLVPDKVFYFNHENIDEVV   63

Query:  67 FEGYYDENEEEMQKIF                                             82
           FEG+ D+ E+   QK+F
Sbjct:  64 FEGFQDDEEQRFQKLF                                             79
```

No corresponding DNA sequence was identified in *S. pyogenes*.

Based on this analysis, it was predicted that this protein and its epitopes, could be useful antigens for vaccines or diagnostics.

EXAMPLE 644

A DNA sequence (GBSx0684) was identified in *S. agalactiae* <SEQ ID 1993> which encodes the amino acid sequence <SEQ ID 1994>. Analysis of this protein sequence reveals the following:

```
Possible site: 32
>>> Seems to have no N-terminal signal sequence
INTEGRAL Likelihood = -14.81 Transmembrane  75-91  (69-99)
INTEGRAL Likelihood = -14.38 Transmembrane 134-150 (129-179)
INTEGRAL Likelihood =  -8.49 Transmembrane 157-173 (151-179)
INTEGRAL Likelihood =  -1.17 Transmembrane  50-66  (46-67)

----- Final Results -----
             bacterial membrane --- Certainty = 0.6922 (Affirmative) < succ>
              bacterial outside --- Certainty = 0.0000 (Not Clear)   < succ>
            bacterial cytoplasm --- Certainty = 0.0000 (Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 645

A DNA sequence (GBSx0685) was identified in *S. agalactiae* <SEQ ID 1995> which encodes the amino acid sequence <SEQ ID 1996>. Analysis of this protein sequence reveals the following:

```
Possible site: 35
>>> Seems to have no N-terminal signal sequence
INTEGRAL Likelihood = -0.11 Transmembrane 40-56 (40-56)

----- Final Results -----
             bacterial membrane --- Certainty = 0.1044 (Affirmative) < succ>
              bacterial outside --- Certainty = 0.0000 (Not Clear)   < succ>
            bacterial cytoplasm --- Certainty = 0.0000 (Not Clear)   < succ>
```

The protein has no significant homology with any sequences in the GENPEPT database.

No corresponding DNA sequence was identified in *S. pyogenes*.

Figure 53:
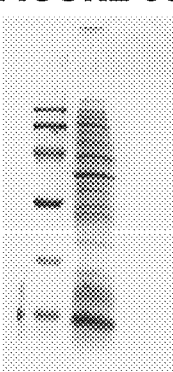
Figure 54:
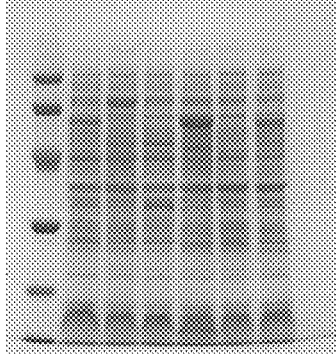

SEQ ID 1996 (GBS204) was expressed in *E. coli* as a His-fusion product. SDS-PAGE analysis of total cell extract is shown in FIG. 49 (lane 13; MW 32 kDa) and FIG. 53 (lane 2; MW 14.7 kDa). It was also expressed in *E. coli* as a GST-fusion product. SDS-PAGE analysis of total cell extract is shown in FIG. 54 (lane 6; MW 39.7 kDa).

Based on this analysis, it was predicted that this protein and its epitopes, could be useful antigens for vaccines or diagnostics.

EXAMPLE 646

A DNA sequence (GBSx0686) was identified in *S. agalactiae* <SEQ ID 1997> which encodes the amino acid sequence <SEQ ID 1998>. Analysis of this protein sequence reveals the following:

```
Possible site: 38
>>> Seems to have no N-terminal signal sequence (or signal = aa 1-26)

----- Final Results -----
              bacterial membrane --- Certainty = 0.0000 (Not Clear) < succ>
              bacterial outside  --- Certainty = 0.0000 (Not Clear) < succ>
              bacterial cytoplasm --- Certainty = 0.0000 (Not Clear) < succ>
```

The protein has homology with the following sequences in the GENPEPT database:

```
>GP: CAC16670 GB: AJ302698 hypothetical protein [Staphylococcus
haemolyticus]
Identities = 60/254 (23%), Positives = 109/254 (42%), Gaps = 14/254 (5%)

Query:    2 VKVSVSSVGTQASTVAISMFSRVSALNDAITKLSSFAEAATLQGTAYSNAKSYATGTLTP   61
            + + V    +Q+S V  ++ S  S  +    + F  A+ LQG AY + K + +   + P
Sbjct:    3 IDMYVGKSKSQSSDVGSTVKSISSGYDSLQKGIMQFVGASELQGQAYDSGKQFFSAVIAP   62

Query:   62 MLQGMILFSETLSEKCTELQTLYVSICGDEDLDSVVLESKLASDRASLKIAEALLEHLND  121
            + + +      E    + C +    Y S    + L      L     +    EA+    L
Sbjct:   63 LTESIKTLGELTEQACNDFVDQYQSEVDSQSLKESELLEDIEELNKQISQLEAMNASLKH  122

Query:  122 DPEPSKSAISSTKSNIKKLKKRIKSNQKKLDNLNEFNAHSATVFADISNAQSTVNQALAA  181
            + S +S      I   L+++ K   ++KL   L +F+A S   +F ++ +   Q TV Q +
Sbjct:  123 KSSKNSSLLSGNHQMISSLEQQKKELEEKLRKLRQFDAKSPNIFKEVESFQKTVQQGINQ  182

Query:  182 VSTGFSGYNSKTGAFGKPTSGQMEWTKTVKKNWKEREDAKAEELKSKKAEESKKASKIEN  241
                 T      ++        F  P    MEW K    ++     E     K +++  ++KA++ KK SK +
Sbjct:  183 AKT---AWDPGKQTFNIPAGKDMEWAKVSQQKALE---VKMDKI-NQKAKDGKKLSKNDI  235

Query:  242 TT-------KKSNV                                                248
             T         KKSN+
Sbjct:  236 FTIIAYQQQKKSNI                                                249
```

No corresponding DNA sequence was identified in *S. pyogenes*.

SEQ ID 1998 (GBS270) was expressed in *E. coli* as a His-fusion product. SDS-PAGE analysis of total cell extract is shown in FIG. 51 (lane 2; MW 34.3 kDa). It was also expressed in *E. coli* as a GST-fusion product. SDS-PAGE analysis of total cell extract is shown in FIG. 54 (lane 7; MW 59.2 kDa).

Figure 265:
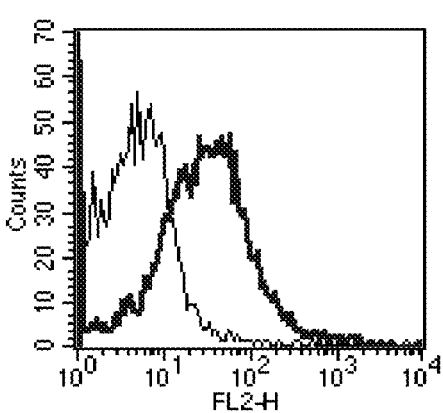

The GBS270-GST fusion product was purified (FIG. 206, lane 3) and used to immunise mice. The resulting antiserun was used for FACS (FIG. 265), which confirmed that the protein is immunoaccessible on GBS bacteria.

Based on this analysis, it was predicted that this protein and its epitopes, could be useful antigens for vaccines or diagnostics.

EXAMPLE 647

A DNA sequence (GBSx0687) was identified in *S. agalactiae* <SEQ ID 1999> which encodes the amino acid sequence <SEQ ID 2000>. This protein is predicted to be outer surface protein F. Analysis of this protein sequence reveals the following:

```
Possible site: 23
>>> Seems to have no N-terminal signal sequence

----- Final Results -----
             bacterial cytoplasm --- Certainty = 0.3323(Affirmative) < succ>
             bacterial membrane  --- Certainty = 0.0000(Not Clear)   < succ>
              bacterial outside  --- Certainty = 0.0000(Not Clear)   < succ>
```

The protein has no significant homology with any sequences in the GENPEPT database.

No corresponding DNA sequence was identified in S. pyogenes.

SEQ ID 2000 (GBS316) was expressed in E. coli as a His-fusion product. SDS-PAGE analysis of total cell extract is shown in FIG. 51 (lane 3; MW 23 kDa). It was also expressed in E. coli as a GST-fusion product. SDS-PAGE analysis of total cell extract is shown in FIG. 55 (lane 2; MW 41.8 kDa).

GBS316-GST was purified as shown in FIG. 206, lane 4.

Based on this analysis, it was predicted that this protein and its epitopes, could be useful antigens for vaccines or diagnostics.

EXAMPLE 648

A DNA sequence (GBSx0688) was identified in S. agalactiae <SEQ ID 2001> which encodes the amino acid sequence <SEQ ID 2002>. This protein is predicted to be actin-like protein arp3 (act4). Analysis of this protein sequence reveals the following:

```
Possible site: 17
>>> Seems to have no N-terminal signal sequence

----- Final Results -----
             bacterial cytoplasm --- Certainty = 0.0217(Affirmative) < succ>
             bacterial membrane  --- Certainty = 0.0000(Not Clear)   < succ>
              bacterial outside  --- Certainty = 0.0000(Not Clear)   < succ>
```

The protein has no significant homology with any sequences in the GENPEPT database.

No corresponding DNA sequence was identified in S. pyogenes.

Based on this analysis, it was predicted that this protein and its epitopes, could be useful antigens for vaccines or diagnostics.

EXAMPLE 649

A DNA sequence (GBSx0689) was identified in S. agalactiae <SEQ ID 2003> which encodes the amino acid sequence <SEQ ID 2004>. This protein is predicted to be diarrheal toxin. Analysis of this protein sequence reveals the following:

```
Possible site: 25
>>> Seems to have no N-terminal signal sequence
       INTEGRAL    Likelihood = -8.65    Transmembrane   65-81  (61-84)
       INTEGRAL    Likelihood = -3.98    Transmembrane   89-105 (85-106)

----- Final Results -----
             bacterial membrane  --- Certainty = 0.4461(Affirmative) < succ>
              bacterial outside  --- Certainty = 0.0000(Not Clear)   < succ>
             bacterial cytoplasm --- Certainty = 0.0000(Not Clear)   < succ>
```

The protein has homology with the following sequences in the GENPEPT database:

```
>GP: CAB15175 GB: Z99120 alternate gene name: yueA~similar to
hypothetical proteins [Bacillus subtilis]
Identities = 452/1058 (42%), Positives = 664/1058 (62%),
Gaps = 39/1058 (3%)

Query:    98 VTMIFSITGYFKNRKQYKQDLQERIDSYHDYLSDKSIELQKLAKEQKRGQHYHYPTIEGL   157
             +T+I S   YF+++ Q  K+   ++R   Y  YL +K  ELQ LA++QK+    +H+P+ E +
Sbjct:     1 MTLITSTVQYFRDKNQRKKREEKRERVYKLYLDNKRKELQALAEKQKQVLEFHFPSFEQM    60

Query:   158 QEMADTYHHRIYEKTPLHFDFLYYRLGLGEVPTSYNIHYSQPERSGKK-DPLENEGYNLY   216
             + +        RI+EK+    D+L  RLG G VP+SY I+ S   + +  D L  +  ++
Sbjct:    61 KYLTSEISDRIWEKSLESKDYLQLRLGTGTVPSSYEINMSGGDLANRDIDDLMEKSQHMQ   120
```

```
Query:  217  FNNRYIKNMPIVANLSHGPVGYIGPRGLVLEQLQLMVNQLAFFHSYHDVQFITIVPEEEM  276
              + I+N P+  +L+ GP+G +G   +V ++  ++ QL+FF+SYHD++F+ I   EEE
Sbjct:  121  RVYKDIRNAPVTVDLAEGPMGLVGKSQIVKNEIHQLIGQLSFFNSYHDLRFVFIFHEEEY  180

Query:  277  DKWSWMRWLPHETLQDVNVRGFVYNQRSRDQVLNSLNQILKLRRTQREDKSAKEGTLFSP  336
              W WM+ +P  +  + +GF+YN+++RDQ+L+SL ++++   +R+ +  KE   F P
Sbjct:  181  KDWEWMKCVPQFQMPHIYAKGFIYNEQTRDQLLSSLYELIR----ERDLEDDKEKLQFKP  236

Query:  337  HYVVIVTDEKLILDHVIMEFFTEDPTELGCSLIFVQDVMSSLSENIKTIINIKDRNTGQL  396
              H+V ++T+++LI +HVI+E+      LG S I  +    SLSENI T++  + + G +
Sbjct:  237  HFVFVITNQQLISEHVILEYLEGQHEHLGISTIVAAETKESLSENITTLVRYINEHEGDI  296

Query:  397  VIEEGELKETDFELDHFLEDYDKENISRRLAPLNHLQNLKSSIPEAVTFMEMYQAEEFED  456
              +I++ +     F LDH   + D E  SR L  LNH   + +SIPE V+F+E++ A+E ++
Sbjct:  297  LIQKKKAVRIPFRLDHHQRE-DNERFSRTLRTLNHQVGITNSIPETVSFLELFHAKEVKE  355

Query:  457  LHVQERWISHAPYKSSAVPLGLRGQDDIVYLNLHEKAHGPHGLVAGTTGSGKSEIIQSYI  516
              + +Q+RW++    KS +VP+G +G+DDIVYLNLHEKAHGPHGL+AGTTGSGKSE +Q+YI
Sbjct:  356  IGIQQRWLTSESSKSLSVPIGYKGKDDIVYLNLHEKAHGPHGLLAGTTGSGKSEFLQTYI  415

Query:  517  LSLAVNFHPHDVAFLLIDYKGGGMANLFKDLPHLLGTITNLDGAQ--SMRALVSINAELK  574
              LSLAV+FHPH+ AFLLIDYKGGGMA  F+++PHLLGTITN++G++  SMRAL SI +ELK
Sbjct:  416  LSLAVHFHPHEAAFLLIDYKGGGMAQPFRNIPHLLGTITNIEGSKNFSMRALASIKSELK  475

Query:  575  RRQRLFAKADVNHINQYQKKYKLGEVSEPMPHLFLISDEFAELKSNQPEFMKELVSTARI  634
              +RQRLF + VNHIN Y K YK G+     MPHLFLISDEFAELKS +P+F++ELVS ARI
Sbjct:  476  KRQRLFDQYQVNHINDYTKLYKQGKAEVAMPHLFLISDEFAELKSEEPDFIRELVSAARI  535

Query:  635  GRSLGIHLILATQKPSGVVDDQIWSNSRFKLALKVADRGDSMEMLHTPDAAEITQAGRAY  694
              GRSLG+HLILATQKP G++DDQIWSNSRFK+ALKV D  DS E+L   DAA IT  GR Y
Sbjct:  536  GRSLGVHLILATQKPGGIIDDQIWSNSRFKVALKVQDATDSKEILKNSDAANITVTGRGY  595

Query:  695  LQVGNNEVYELFQSAWSGADYQPEKDDQGIEDHTIYSINDLGQYEILNDDLSGLDQAENI  754
              LQVGNNEVYELFQSAWSGA Y E     G ED  I + D G     LS +D  +N
Sbjct:  596  LQVGNNEVYELFQSAWSGAPYLEEV--YGTEDE-IAIVTDTGLI-----PLSEVDTEDNA  647

Query:  755  -KEVPTELDAIVENIQALTKEMGISDLPQPWLPPLSNQIAVTDLRKEGSVDLWSKAPSYK  813
              K+V TE++A+V+ I+ +  EMGI  LP PWLPPL+ +I  T       L+
Sbjct:  648  KKDVQTEIEAVVDEIERIQDEMGIEKLPSPWLPPLAERIPRT---------LFPSNEKDH  698

Query:  814  AVLGFMDIPSQQAQEVAYHDFEDDGHLSIFAGPSMGKSTALQTVTMDLARHNSPEFLNLY  873
                     ++D P  Q Q  +   +DG++ IF    GKS A  T M  A    +PE L++Y
Sbjct:  699  FHFAYVDEPDLQRQAPIAYKMMEDGNIGIFGSSGYGKSIAAATFLMSFADVYTPEELHVY  758

Query:  874  LFDFGTNGLLPLRRLPHVADFFTIDDDEKIAKFIARIKVEMSDRKKALSRYNVATAKLYR  933
              +FDFG   LLPL +LPH AD+F +D   KI KF+ RIK E+  RK+        ++ K+Y
Sbjct:  759  IFDFGNGTLLPLAKLPHTADYFLMDQSRKIEKFMIRIKEEIDRRKRLFREKEISHIKMYN  818

Query:  934  QVSGETMPQILIVIDSYEGLREAQTPTNLEACFQNISRDGSSLGISLVISAGRTAALRSS  993
              +S E +P I I ID+++  +++        LE+ F  +SRDG SLGI  +++A R  A+R S
Sbjct:  819  ALSEEELPFIFITIDNFDIVKDEM--HELESEFVQLSRDGQSLGIYFMLTATRVNAVRQS  876

Query:  994  LMANLKERIALKLTDDSESRTLVGRHQHIMEDIPGRGLIKRDDIEVLQVALSTEGTETFD  1053
              L+ NLK +I    L D SE ++ GR +  +E IPGR +I+++++   Q+ L   +   +
Sbjct:  877  LLNNLKTKIVHYLMDQSEGYSIYGRPKFNLEPIPGRVIIQKEELYFAQMFLPVDADDDIG  936

Query:  1054 IINNIQNESDAMNSKWTG-PRPKAIPIVPEELTFDDFMATDSVQADLSANRL--PLGLEM  1110
              + N ++++  +  + ++    +P IP++PE L+ +      S++ L      L P+GL
Sbjct:  937  MFNELKSDVQKLQGRFASMEQPAPIPMLPESLSTREL----SIRFKLERKPLSVPIGLHE  992

Query:  1111 VDVESYSLALNRFKHMLYMSDSDESLEAVGSHIIKVLL                        1148
              V         L + KH L + +          ++++KV+L
Sbjct:  993  ETVSPVYFDLGKHKHCLILGQTQRG----KTNVLKVML                        1026
```

There is also homology to SEQ ID 24.

A related GBS gene <SEQ ID 8629> and protein <SEQ ID 8630> were also identified. Analysis of this protein sequence reveals the following:

Homology to a bacterial toxin

The protein has homology with the following sequences in the databases:

```
>OMNI|NT01BS3725 diarrheal toxin
Score = 203 bits (511), Expect = 4e-51
Identities = 123/377 (32%), Positives = 198/377 (51%),
Gaps = 22/377 (5%)
```

```
Query:     1 MGISDLPQPWLPPLSNQIAVTDLRKEGSVDLWSKAPSYKAVLGFMDIPSQQAQEVAYHDF    60
             MGI  LP PWLPPL+ +I  T           L+            ++D P  Q Q    +
Sbjct:   704 MGIEKLPSPWLPPLAERIPRT---------LFPSNEKDHFHFAYVDEPDLQRQAPIAYEM   754

Query:    61 EDDGHLSIFAGPSMGKSTALQTVTMDLARHNSPEFLNLYLFDFGTNGLLPLRRLPHVADF   120
             +DG++ IF    GKS  A  T  M  A   +PE L++Y+FDFG    LLPL +LPH AD+
Sbjct:   755 MEDGNIGIFGSSGYGKSIAAATFLMSFADVYTPEELHVYIFDFGNGTLLPLAKLPHTADY   814

Query:   121 FTIDDDEKIAKFIARIKVEMSDRKKALSRYNVATAKLYRQVSGETMPQILIVIDSYEGLR   180
             F +D    KI KF+ RIK E+  RK+         ++    K+Y +S E +P I I ID+++ ++
Sbjct:   815 FLMDQSRKIEKFMIRIKEEIDRRKRLFREKEISHIKMYNALSEEELPFIFITIDNFDIVK   874

Query:   181 EAQTPTNLEACFQNISRDGSSLGISLVISAGRTAALRSSLMANLKERIALKLTDDSESRT   240
             +        LE+ F   +SRDG SLGI   +++A R   A+R SL+ NLK +I    L D SE   +
Sbjct:   875 DEM--HELESEFVQLSRDGQSLGIYFMLTATRVNAVRQSLLNNLKTKIVHYLMDQSEGYS   932

Query:   241 LVGRHQHIMEDIPGRGLIKRDDIEVLQVALSTEGTETFDIINNIQNESDAMNSKWTG-PR   299
              + GR +   +E IPGR +I+++++      Q+ L  +  +       + N ++++    +  ++     +
Sbjct:   933 IYGRPKFNLEPIPGRVIIQKEELYFAQMFLPVDADDDIGMFNELKSDVQKLQGRFASMEQ   992

Query:   300 PKAIPIVPEELTFDDFMATDSVQADLSANRL--PLGLEMVDVESYSLALNRFKHMLYMSD   357
             P    IP++PE L+   +      S++  L      L   P+GL    V      L + KH L  +
Sbjct:   993 PAPIPMLPESLSTREL----SIRFKLERKPLSVPIGLHEETVSPVYFDLGKHKHCLILGQ  1048

Query:   358 SDESLEAVGSHIIKVLL                                            374
             +              ++++KV+L
Sbjct:  1049 TQRG----KTNVLKVML                                           1061
```

Figure 65:
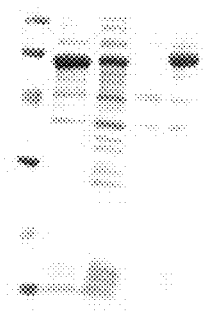

SEQ ID 8630 (GBS326) was expressed in E. coli as a His-fusion product. SDS-PAGE analysis of total cell extract is shown in FIG. 65 (lane 5; MW 66 kDa). It was also expressed in E. coli as a GST-fusion product. SDS-PAGE analysis of total cell extract is shown in FIG. 71 (lane 5; MW 91 kDa).

Figure 212:
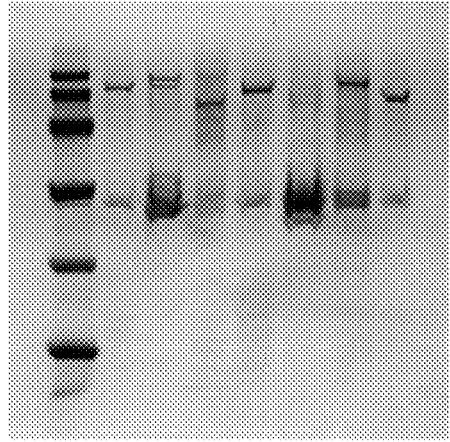

GBS326-GST was purified as shown in FIG. 212, lane 5.

Figure 127:
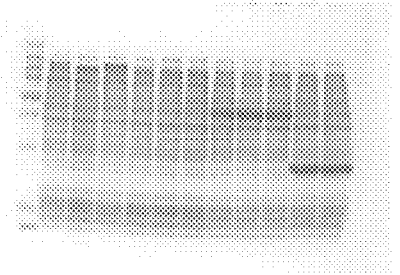
Figure 184:
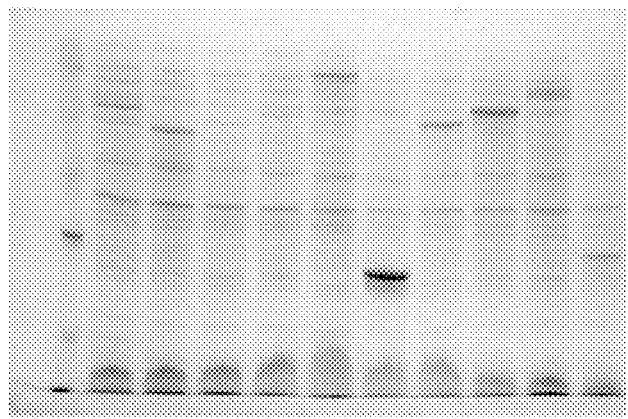

GBS326LN was expressed in E. coli as a GST-fusion product. SDS-PAGE analysis of total cell extract is shown in FIG. 127 (lane 24; MW 114 kDa). It was also expressed in E. coli as a GST-fusion product. SDS-PAGE analysis of total cell extract is shown in FIG. 184 (lane 6; MW 114 kDa). The purified protein is shown in FIG. 236, lane 12.

Based on this analysis, it was predicted that these proteins and their epitopes could be useful antigens for vaccines or diagnostics.

EXAMPLE 650

A DNA sequence (GBSx0690) was identified in S. agalactiae <SEQ ID 2005> which encodes the amino acid sequence <SEQ ID 2006>. Analysis of this protein sequence reveals the following:

```
Possible site: 16
>>> Seems to have no N-terminal signal sequence

----- Final Results -----
            bacterial cytoplasm --- Certainty = 0.2693 (Affirmative) < succ>
            bacterial membrane --- Certainty = 0.0000 (Not Clear)   < succ>
             bacterial outside --- Certainty = 0.0000 (Not Clear)   < succ>
```

The protein has no significant homology with any sequences in the GENPEPT database.

No corresponding DNA sequence was identified in S. pyogenes.

Based on this analysis, it was predicted that this protein and its epitopes, could be useful antigens for vaccines or diagnostics.

EXAMPLE 651

A DNA sequence (GBSx0691) was identified in S. agalactiae <SEQ ID 2007> which encodes the amino acid sequence <SEQ ID 2008>. Analysis of this protein sequence reveals the following:

```
Possible site: 38
>>> Seems to have no N-terminal signal sequence
```

```
----- Final Results -----
        bacterial cytoplasm --- Certainty = 0.3933 (Affirmative) < succ>
        bacterial membrane  --- Certainty = 0.0000 (Not Clear)   < succ>
        bacterial outside   --- Certainty = 0.0000 (Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 652

A DNA sequence (GBSx0692) was identified in *S. agalactiae* <SEQ ID 2009> which encodes the amino acid sequence <SEQ ID 2010>. Analysis of this protein sequence reveals the following:

```
Possible site: 55
>>> Seems to have no N-terminal signal sequence
INTEGRAL Likelihood = -7.32 Transmembrane 225-241 (219-246)

----- Final Results -----
        bacterial membrane  --- Certainty = 0.3930 (Affirmative) < succ>
        bacterial outside   --- Certainty = 0.0000 (Not Clear)   < succ>
        bacterial cytoplasm --- Certainty = 0.0000 (Not Clear)   < succ>
```

The protein has homology with the following sequences in the GENPEPT database:

```
>GP: BAB04693 GB: AP001510 unknown conserved protein
[Bacillus halodurans]
Identities = 83/320 (25%), Positives = 162/320 (49%), Gaps = 1/320 (0%)

Query: 103 VNFILHPSNLFLTKNATAKIAYRSLPGIMRPEKFGPEEFLYQFKCFVFALLTQHDYIELY 162
           ++ I+ P N+ ++      +  +  + P +  PE   + +  LL  +       Y
Sbjct: 106 LHLIVSPENVLVSDGLDVTFIHYGVKDSIPPYETDPERLFLELRATLLVLLDGNHRFHEY 165

Query: 163 NGAISVIEVSDFLKSIYHAETIQAVRDIITIDYEQQVEVETHTLAKVSRAKYKLYKYISV 222
              +++S   KS+    T++ +R++I   + Q+ E +   L KV + K+ + K+   +
Sbjct: 166 MNYHDTLKLSPEAKSLVQQTTLEGLRELIR-HWIQEHEQQEKQLHKVPKTKWTIQKWAGI 224

Query: 223 WLGALSTILLIPLVYLVFIHNPFKEKMLAADTSFIKVDYNQVINRLEHVKVSKLPYTQKY 282
             L A    +I +VY++     P +E    A+ +++  +Y+QVI+ LE     + +P    KY
Sbjct: 225 GLIAALVPAIIYIVYVLAFLQPRQEAFTASHAAYLNENYSQVIDTLEPYSPNSMPRVVKY 284

Query: 283 ELAYSYINGMSFSEEQREVILNNVTLKTDELYLDYWINIGRGLDDDAIDAAKRLDDSDLV 342
           +LA SY+          RE + N + L+  E Y DYWI IGRG ++ AID A+ L D + +
Sbjct: 285 QLAQSYVAIEPLQAYHRENLKNVLVLQAAESYFDYWIAIGRGENEKAIDIARGLQDKEWL 344

Query: 343 IYAIVQKMDQVRKDNSLSGKDREQKLSELQTDYDKYWKDRKTALTDEESKSKNSNNHSTN 402
           +YA V++ ++V+ D +LSGK+RE  + E++ + D Y ++ +     + E+    N+    ++N
Sbjct: 345 VYANVKRREEVKSDENLSGKEREDLIKEIEAEIDDYMRELEELAEEGEAFQPNAEPAASN 404

Query: 403 SNKESSESSSTTASTSSKTK                                         422
           +E       +   S + + K
Sbjct: 405 ELEEDEGDTEEDDSDNQEAK                                         424
```

No corresponding DNA sequence was identified in *S. pyogenes*.

SEQ ID 2010 (GBS337) was expressed in *E. coli* as a His-fusion product. SDS-PAGE analysis of total cell extract is shown in FIG. 62 (lane 3; MW 50.3 kDa).

Based on this analysis, it was predicted that this protein and its epitopes, could be useful antigens for vaccines or diagnostics.

EXAMPLE 653

A DNA sequence (GBSx0693) was identified in *S. agalactiae* <SEQ ID 2011> which encodes the amino acid sequence <SEQ ID 2012>. Analysis of this protein sequence reveals the following:

```
Possible site: 27
>>> Seems to have a cleavable N-term signal seq.
INTEGRAL Likelihood = -14.01 Transmembrane 131-147 (122-153)

----- Final Results -----
            bacterial membrane --- Certainty = 0.6604 (Affirmative) < succ>
            bacterial outside  --- Certainty = 0.0000 (Not Clear)   < succ>
            bacterial cytoplasm --- Certainty = 0.0000 (Not Clear)   < succ>
```

A related GBS nucleic acid sequence <SEQ ID 8631> which encodes amino acid sequence <SEQ ID 8632> was also identified. Analysis of this protein sequence reveals the following:

```
Lipop: Possible site: -1 Crend: 8
McG: Discrim Score: 13.38
GvH: Signal Score (-7.5): -1.25
     Possible site: 23
>>> Seems to have a cleavable N-term signal seq.
ALOM program count: 1 value: -14.01 threshold: 0.0
    INTEGRAL      Likelihood = -14.01    Transmembrane   127-143 (118-149)
    PERIPHERAL    Likelihood = 16.13     113
modified ALOM score: 3.30
*** Reasoning Step: 3

----- Final Results -----
            bacterial membrane --- Certainty = 0.6604(Affirmative) < succ>
            bacterial outside  --- Certainty = 0.0000(Not Clear)   < succ>
            bacterial cytoplasm --- Certainty = 0.0000(Not Clear)   < succ>
```

The protein has no significant homology with any sequences in the GENPEPT database.

No corresponding DNA sequence was identified in *S. pyogenes*.

SEQ ID 8632 (GBS140) was expressed in *E. coli* as a GST-fusion product. SDS-PAGE analysis of total cell extract is shown in FIG. 32 (lane 3; MW 43 kDa). It was also expressed in *E. coli* as a His-fusion product. SDS-PAGE analysis of total cell extract is shown in FIG. 49 (lane 8; MW 18 kDa).

Based on this analysis, it was predicted that these proteins and their epitopes could be useful antigens for vaccines or diagnostics.

EXAMPLE 654

A DNA sequence (GBSx0694) was identified in *S. agalactiae* <SEQ ID 2013> which encodes the amino acid sequence <SEQ ID 2014>. Analysis of this protein sequence reveals the following:

```
Possible site: 15
>>> Seems to have no N-terminal signal sequence

----- Final Results -----
            bacterial cytoplasm --- Certainty = 0.1486(Affirmative) < succ>
            bacterial membrane  --- Certainty = 0.0000(Not Clear)   < succ>
            bacterial outside   --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 655

A DNA sequence (GBSx0695) was identified in *S. agalactiae* <SEQ ID 2015> which encodes the amino acid sequence <SEQ ID 2016>. Analysis of this protein sequence reveals the following:

```
Possible site: 32
>>> Seems to have an uncleavable N-term signal seq
    INTEGRAL    Likelihood = -14.59    Transmembrane    984-1000 (976-1009)
    INTEGRAL    Likelihood =  -9.71    Transmembrane     19-35   (15-42)
    INTEGRAL    Likelihood =  -9.50    Transmembrane    872-888  (865-890)
    INTEGRAL    Likelihood =  -6.37    Transmembrane    927-943  (924-951)
    INTEGRAL    Likelihood =  -4.19    Transmembrane    831-847  (828-847)
    INTEGRAL    Likelihood =  -2.87    Transmembrane    899-915  (899-916)

----- Final Results -----
            bacterial membrane --- Certainty = 0.6838(Affirmative) < succ>
             bacterial outside --- Certainty = 0.0000(Not Clear)   < succ>
           bacterial cytoplasm --- Certainty = 0.0000(Not Clear)   < succ>
```

A related GBS nucleic acid sequence <SEQ ID 8633> which encodes amino acid sequence <SEQ ID 8634> was also identified. Analysis of this protein sequence reveals the following:

```
Lipop Possible site: -1 Crend: 6
SRCFLG: 0
McG: Length of UR: 20
     Peak Value of UR: 3.40
     Net Charge of CR: 3
McG: Discrim Score: 13.67
GvH: Signal Score (-7.5): -3.27
     Possible site: 21
>>> Seems to have an uncleavable N-term signal seq
Amino Acid Composition: calculated from 1
ALOM program count: 6 value: -14.59 threshold: 0.0
    INTEGRAL      Likelihood = -14.59    Transmembrane    973-989 (965-998)
    INTEGRAL      Likelihood =  -9.71    Transmembrane      8-24  (4-31)
    INTEGRAL      Likelihood =  -9.50    Transmembrane    861-877 (854-879)
    INTEGRAL      Likelihood =  -6.37    Transmembrane    916-932 (913-940)
    INTEGRAL      Likelihood =  -4.19    Transmembrane    820-836 (817-836)
    INTEGRAL      Likelihood =  -2.87    Transmembrane    888-904 (888-905)
    PERIPHERAL    Likelihood =   3.82    936
modified ALOM score: 3.42
icm1 HYPID: 7 CFP: 0.684
*** Reasoning Step: 3

----- Final Results -----
            bacterial membrane --- Certainty = 0.6838(Affirmative) < succ>
             bacterial outside --- Certainty = 0.0000(Not Clear)   < succ>
           bacterial cytoplasm --- Certainty = 0.0000(Not Clear)   < succ>
```

The protein has homology with the following sequences in the GENPEPT database:

```
>GP: AAB86324 GB: AE000938 phage infection protein homolog
[Methanothermobacter thermoautotrophicus]
Identities = 96/454 (21%), Positives = 190/454 (41%),
Gaps = 63/454 (13%)

Query:  1  MLKIKYILGRIMKR-NNFRILWYIIAVALFLVAIAGLNLKLQGDHAKENKTTQSATNTKL   59
           M K  I  + MK    N  ++ ++IAV + + A+  +    +Q       ++T+       +
Sbjct:  1  MRKALEIFWKDMKTVKNSPVVLFVIAVIICIPALYAV-FNIQATLDPYSRTSS------I   53
```

```
-continued
Query:  60 NIALVNEDQNVSNGKESYNLGASYIKSIERDNSQNWSVVSRGTAQNGLDKGDYQLMVIIP  119
           +A+VNED         N+GA ++  + ++ + +W  V R  A +GL KG Y  ++IIP
Sbjct:  54 EVAVVNEDMGADFNGTHLNVGAEFVSELRKNRNFDWQFVDRSDAMDGLRKGKYYAVLIIP  113

Query: 120 NNFSQKLLDVNKANAEQTTISYKVNAKGNLALEKKATEKEKDIVSELNSHLVNMYMASIL  179
            NFS  LL +     Q +I Y VN K N     +      + +++NS +V       +
Sbjct: 114 GNFSSDLLSIKNGTPRQASIKYMVNDKLNPVAPRITNAGADALQAKINSEVVKTIDGIVF  173

Query: 180 SNLYTAQENVQA----------MVNVQSGNISNYQKNLLDSATNF---QNIFPAL-----  221
            +   A E  +A          VN  +GN+    + L  + ++    QN++ +L
Sbjct: 174 GKISEAGELARANRDDILRTKRFVNELNGNLGKIDETLSTANSDLEKGQNLWSSLKTDLP  233

Query: 222 -VNQSSSSITANESLKKS-----------LEASDNMFNDLVTTQTNTGKDLSSL-----  263
            +  +++ +     SL +S            +++ ++  ++ +T+       L+SL
Sbjct: 234 EIRDNANFVKEKYSLLESYIGKDPAKALSTVQSMESHLSEAITSMKYLRAVLASLYSATG  293

Query: 264 -------IEQRHQDSISYEAFSTSLLEMNNELLEKQLSDIITQAQKDQETLSSQLNSIMG  316
                   I+Q     +       L  + ++L  K  +D I + +      + + S LN +M
Sbjct: 294 DPKLKTAIDQIDTNIEKASSVLGILQTIESDLKTKGTTDRIVKLKASIDRMDSALNKLMD  353

Query: 317 D-DNNHNHKENSSAYLNVARQKIQELSEALKSQDNIAKDQSEQLDKIVREGLASYFAKNN  375
           D         +++SA L +A  +   + A+       +D S +L+ I   + L S     +
Sbjct: 354 SRDEIDAAMQDASAKLGIANARWPTMRSAI-------QDASRKLNMISDDDLNSLVKLAD  406

Query: 376 KDNITLLELLKSHSTNEK----TLKDFKAKVADF                           405
             D    + E  +S    EK      +K++ + +A F
Sbjct: 407 IDPSAVREYFRSPVRMEKEHIYPVKNYGSALAPF                           440
```

SEQ ID 8634 (GBS250) was expressed in *E. coli* as a GST-fusion product. SDS-PAGE analysis of total cell extract is shown in FIG. 47 (lane 4; MW 136 kDa).

GBS250-GST was purified as shown in FIG. 203, lane 4.

Based on this analysis, it was predicted that these proteins and their epitopes could be useful antigens for vaccines or diagnostics.

EXAMPLE 656

A DNA sequence (GBSx0696) was identified in *S. agalactiae* <SEQ ID 2019> which encodes the amino acid sequence <SEQ ID 2020>. Analysis of this protein sequence reveals the following:

```
Possible site: 39
>>> Seems to have no N-terminal signal sequence

----- Final Results -----
            bacterial cytoplasm --- Certainty = 0.5009(Affirmative) < succ>
             bacterial membrane --- Certainty = 0.0000(Not Clear)   < succ>
              bacterial outside --- Certainty = 0.0000(Not Clear)   < succ>
```

The protein has homology with the following sequences in the GENPEPT database:

```
>GP: CAA46375 GB: X65276 ORFA1 [Clostridium acetobutylicum]
Identities = 35/91 (38%), Positives = 53/91 (57%)

Query:   1 MAQIKLTPEELRSSAQKYTAGSQQVTEVLNLLTQEQAVIDENWDGSTFDSFEAQFNELSP  60
           MAQI +TPEEL+S AQ Y     +++ + +  +   + I E W G  F ++  Q+N+L
Sbjct:   1 MAQISVTPEELKSQAQVYIQSKEEIDQAIQKVNSMNSTIAEEWKGQAFQAYLEQYNQLHQ  60

Query:  61 KITEFAQLLEDINQQLLKVADIIEQTDADIA                              91
            + +F  LLE +NQQL K AD + + DA  A
Sbjct:  61 TVVQFENLLESVNQQLNKYADTVAERDAQDA                              91
```

No corresponding DNA sequence was identified in *S. pyogenes*.

Based on this analysis, it was predicted that this protein and its epitopes, could be useful antigens for vaccines or diagnostics.

EXAMPLE 657

A DNA sequence (GBSx0697) was identified in *S. agalactiae* <SEQ ID 2021> which encodes the amino acid sequence <SEQ ID 2022>. Analysis of this protein sequence reveals the following:

```
Possible site: 22
>>> Seems to have no N-terminal signal sequence

----- Final Results -----
             bacterial cytoplasm --- Certainty = 0.3741(Affirmative) < succ>
             bacterial membrane  --- Certainty = 0.0000(Not Clear)   < succ>
             bacterial outside   --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 658

A repeated DNA sequence (GBSx0698) was identified in *S. agalactiae* <SEQ ID 2023> which encodes the amino acid sequence <SEQ ID 2024>. This protein is predicted to be carbamoylphosphate synthetase (carB). Analysis of this protein sequence reveals the following:

```
Possible site: 23
>>> Seems to have a cleavable N-term signal seq.
    INTEGRAL    Likelihood = -1.33    Transmembrane    807-823 (807-823)

----- Final Results -----
             bacterial membrane  --- Certainty = 0.1532(Affirmative) < succ>
             bacterial outside   --- Certainty = 0.0000(Not Clear)   < succ>
             bacterial cytoplasm --- Certainty = 0.0000(Not Clear)   < succ>
```

The protein has homology with the following sequences in the GENPEPT database:

```
>GP: CAA03928 GB: AJ000109 carbamoylphosphate synthetase [Lactococcus lactis]
Identities = 771/1062 (72%), Positives = 901/1062 (84%), Gaps = 5/1062 (0%)

Query:   1 MPKRTDIRKIMVIGSGPIVIGQAAEFDYSGTQACLSLKEEGYQVVLVNSNPATIMTDKDI    60
           MPKR DI+KIM+IGSGPI+IGQAAEFDY+GT+ACL+LKEEGY+VVLVNSNPATIMTD++I
Sbjct:   1 MPKRNDIKKIMIIGSGPIIGQAAEFDYAGTEACLALKEEGYEVVLVNSNPATIMTDREI    60

Query:  61 ADKVYIEPITLEFVTRILRKERPDALLPTLGGQTGLNMAMALSKNGILEELNVELLGTKL   120
           AD VYIEPITLEFV++ILRKERPDALLPTLGGQTGLNMAM LSK GILEELNVELLGTKL
Sbjct:  61 ADTVYIEPITLEFVSKILRKERPDALLPTLGGQTGLNMAMELSKTGILEELNVELLGTKL   120

Query: 121 SAIDKAEDRDLFKQLMEELNQPIPESEIVNSVEEAIQFAEQIGYPLIVRPAFTLGGTGGG   180
           SAID+AEDR+LFK+L E +N+P+  S+I  +VEEAI A++IGYP+IV PAFT+GGTGGG
Sbjct: 121 SAIDQAEDRELFKELCESINEPLCASDIATTVEEAINIADKIGYPIIVGPAFTMGGTGGG   180

Query: 181 MCDNQEQLVDITTKGLKLSPVTQCLIERSIAGFKEIEYEVMRDAADNALVVCNMENFDPV   240
           +CD +E+L +I   GLKLSPVTQCLIE SIAG+KEIEYEVMRD+ADNA+VVCNMENFDPV
Sbjct: 181 ICDTEEELREIVANGLKLSPVTQCLIEESIAGYKEIEYEVMRDSADNAIVVCNMENFDPV   240

Query: 241 GIHTGDSIVFAPAQTLSDVENQLLRDASLDIIRALKIEGGCNVQLALDPNSFKYYVIEVN   300
           G+HTGDSIVFAP+QTLSD E Q+LRDASL+IIRALKIEGGCNVQLALDPNS++Y VIEVN
Sbjct: 241 GVHTGDSIVFAPSQTLSDNEYQMLRDASLNIIRALKIEGGCNVQLALDPNSYEYRVIEVN   300
```

```
Query:   301 PRVSRSSALASKATGYPIAKLAAKIAVGLTLDEVINPITKTTYAMFEPALDYVVAKMPRF    360
             PRVSRSSALASKATGYPIAK++AKIA+G+TLDE+INP+T  TYAMFEPALDYVVAK+ RF
Sbjct:   301 PRVSRSSALASKATGYPIAKMSAKIAIGMTLDEIINPVTNKTYAMFEPALDYVVAKIARF    360

Query:   361 PFDKFESGDRKLGTQMKATGEVMAIGRNIEESLLKACRSLEIGVDHIKIADLDNVSDDVL    420
             PFDKFE+GDR LGTQMKATGEVMAIGRNIEESLLKA RSLEIGV H ++ +     D+ L
Sbjct:   361 PFDKFENGDRHLGTQMKATGEVMAIGRNIEESLLKAVRSLEIGVFHNEMTEAIEADDEKL    420

Query:   421 LEKIRKAEDDRLFYLAEALRRHYSIEKLASLTSIDSFFLDKLRVIVELEDLLSKNRLDIN    480
             EK+ K +DDRLFY++EA+RR    IE++A LT ID FFLDKL  IVE+E+ L  N  +
Sbjct:   421 YEKMVKTQDDRLFYVSEAIRRGIPIEEIADLTKIDIFFLDKLLYIVEIENQLKVNIFEPE    480

Query:   481 ILKKVKNKGFSDKAIASLWQINEDQVRNMRKEAGILPVYKMVDTCASEFDSATPYFYSTY    540
             +LK  K  GFSD+ IA LW +  ++VR  R+E   I+PVYKMVDTCA+EF+S+TPYFYSTY
Sbjct:   481 LLKTAKKNGFSDREIAKLWNVTPEEVRRRRQENKIIPVYKMVDTCAAEFESSTPYFYSTY    540

Query:   541 AVENESLISDKASILVLGSGPIRIGQGVEFDYATVHSVKAIRESGFEAIIMNSNPETVST    600
               ENES  SDK  I+VLGSGPIRIGQGVEFDYATVH VKAI+  G EAI++NSNPETVST
Sbjct:   541 EWENESKRSDKEKIIVLGSGPIRIGQGVEFDYATVHCVKAIQALGKEAIVINSNPETVST    600

Query:   601 DFSISDKLYFEPLTFEDVMNVIDLEKPEGVILQFGGQTAINLAKDLNKAGVKILGTQLED    660
             DFSISDKLYFEPLTFEDVMNVIDLE+P   VI+QFGGQTAINLA+ L+KAGVKILGTQ+ED
Sbjct:   601 DFSISDKLYFEPLTFEDVMNVIDLEEPLVVIVQFGGQTAINLAEHLSKAGVKILGTQVED    660

Query:   661 LDRAENRKQFEATLQALNIPQPPGFTATTEEEAVNAAQKIGYPVLVRPSYVLGGRAMKIV    720
             LDRAE+R  FE  LQ L+IPQPPG TAT  EEEAV  A KIGYPVL+RPS+VLGGRAM I+
Sbjct:   661 LDRAEDRDLFEKALQDLDIPQPPGATATNEEEAVANANKIGYPVLIRPSFVLGGRAMEII    720

Query:   721 ENEEDLRHYMTTAVKASPDHPVLIDAYLIGKECEVDAISDGQNILIPGIMEHIERSGVHS    780
               NE+DLR YM   AVKASP+HPVL+D+YL G+ECEVDAI DG+ +L+PGIMEHIER+GVHS
Sbjct:   721 NNEKDLRDYMNRAVKASPEHPVLVDSYLQGQECEVDAICDGKEVLLPGIMEHIERAGVHS    780

Query:   781 GDSMAVYPPQTLSETIIETIVDYTKRLAIGLNCIGMMNIQFVIKDQKVYVIEVNPRASRT    840
             GDSMAVYPPQ LS+ II+TIVDYTKRLAIGLNCIGMMNIQFVI +++VYVIEVNPRASRT
Sbjct:   781 GDSMAVYPPQNLSQAIIDTIVDYTKRLAIGLNCIGMMNIQFVIYEEQVYVIEVNPRASRT    840

Query:   841 LPFLSKVTHIPMAQVATKVILGDKLCNFTYGYDLYPASDMVHIKAPVFSFTKLAKVDSLL    900
             +PFLSKVT+IPMAQ+AT++ILG+ L +  Y   L P DMVH+KAPVFSFTKLAKVDSLL
Sbjct:   841 VPFLSKVTNIPMAQLATQMILGENLKDLGYEAGLAPTDMVHVKAPVFSFTKLAKVDSLL    900

Query:   901 GPEMKSTGEVMGSDINLQKALYKAFEAAYLHMPDYGNIVFTVDDTDKEEALELAKVYQSI    960
             GPEMKSTG  MGSD+ L+KALYK+FEAA LHM DYG+++FTV D DKEE L LAK+  I
Sbjct:   901 GPEMKSTGLAMGSDVTLEKALYKSFEAAKLHMADYGSVLFTVADEDKEETLALAKDFAEI    960

Query:   961 GYRIYATQGTAIYFDANGLETVLVGKL--GENDRNHIPDLIKNGKIQAVINTVGQNNID-   1017
             GY + AT GTA +  NGL  V KL  GE++ + + I+ G++QAV+NT+G
Sbjct:   961 GYSLVATAGTAAFLKENGLYVREVEKLAGGEDEEGTLVEDIRQGRVQAVVNTMGNTRASL   1020

Query:  1018 --NHDALIIRRSAIEQGVPLFTSLDTAHAMFKVLESRAFTLK                   1057
                 D   IR+ AI +G+PLFTSLDT  A+ KV++SR+FT K
Sbjct:  1021 TTATDGFRIRQEAISRGIPLFTSLDTVAAILKVMQSRSFTTK                   1062
```

A related DNA sequence was identified in *S. pyogenes* <SEQ ID 2025> which encodes the amino acid sequence <SEQ ID 2026>. Analysis of this protein sequence reveals the following:

```
Possible site: 21
>>> Seems to have no N-terminal signal sequence
    INTEGRAL    Likelihood = -1.17    Transmembrane    773-789 (773-789)

----- Final Results -----
              bacterial membrane --- Certainty = 0.1468(Affirmative) < succ>
               bacterial outside --- Certainty = 0.0000(Not Clear)   < succ>
              bacterial cytoplasm --- Certainty = 0.0000(Not Clear)   < succ>
```

The protein has homology with the following sequences in the databases:

```
>GP: CAA03928 GB: AJ000109 carbamoylphosphate synthetase [Lactococcus
lactis]
Identities = 753/1030 (73%), Positives = 876/1030 (84%), Gaps = 6/1030 (0%)

Query:     1 LALKEEGYKVILVNSNPATIMTDKEIADKVYIEPLTLEFVNRIIRKERPDAILPTLGGQT    60
             LALKEEGY+V+LVNSNPATIMTD+EIAD VYIEP+TLEFV++I+RKERPDA+LPTLGGQT
Sbjct:    35 LALKEEGYEVVLVNSNPATIMTDREIADTVYIEPITLEFVSKILRKERPDALLPTLGGQT    94
```

```
-continued

Query:   61 GLNMAMALSKAGILDDLEIELLGTKLSAIDQAEDRDLFKQLMQELDQPIPESTIVKTVDE   120
            GLNMAM LSK GIL++L +ELLGTKLSAIDQAEDR+LFK+L + +++P+  S I  TV+E
Sbjct:   95 GLNMAMELSKTGILEELNVELLGTKLSAIDQAERELFKELCESINEPLCASDIATTVEE   154

Query:  121 AVTFARDIGYPVIVRPAFTLGGTGGGICSSEEELCEITENGLKLSPVTQCLIERSIAGFK   180
            A+  A  IGYP+IV PAFT+GGTGGGIC +EEEL EI  NGLKLSPVTQCLIE SIAG+K
Sbjct:  155 AINIADKIGYPIIVGPAFTMGGTGGGICDTEEELREIVANGLKLSPVTQCLIEESIAGYK   214

Query:  181 EIEYEVMRDSADNALVVCNMENFDPVGIHTGDSIVFAPTQTLSDIENQMLRDASLKIIRA   240
            EIEYEVMRDSADNA+VVCNMENFDPVG+HTGDSIVFAP+QTLSD E QMLRDASL IIRA
Sbjct:  215 EIEYEVMRDSADNAIVVCNMENFDPVGVHTGDSIVFAPSQTLSDNEYQMLRDASLNIIRA   274

Query:  241 LKIEGGCNVQLALDPYSFKYYVIEVNPRVSRSSALASKATGYPIAKLAAKIAVGLTLDEM   300
            LKIEGGCNVQLALDP S++Y VIEVNPRVSRSSALASKATGYPIAK++AKIA+G+TLDE+
Sbjct:  275 LKIEGGCNVQLALDPNSYEYRVIEVNPRVSRSSALASKATGYPIAKMSAKIAIGMTLDEI   334

Query:  301 INPITGTTYAMFEPALDYVVAKIPRFPFDKFEHGERQLGTQMKATGEVMAIGRNLEESLL   360
            INP+T  TYAMFEPALDYVVAKI RFPFDKFE+G+R LGTQMKATGEVMAIGRN+EESLL
Sbjct:  335 INPVTNKTYAMFEPALDYVVAKIARFPFDKFENGDRHLGTQMKATGEVMAIGRNIEESLL   394

Query:  361 KACRSLEIGVCHNEMTSLSNISDEELVTKVIKAQDDRLFYLSEAIRRGYSIEELESLTKI   420
            KA RSLEIGV HNEMT       DE+L K++K QDDRLFY+SEAIRRG IEE+  LTKI
Sbjct:  395 KAVRSLEIGVFHNEMTEAIEADDEKLYEKMVKTQDDRLFYVSEAIRRGIPIEEIADLTKI   454

Query:  421 DLFFLDKLLHIVEIEQELQMVHDHLESLKKAKRYGFSDQKIAEIWQKDESDIRAMRHSHS   480
            D+FFLDKLL+IVEIE +L++++   E LK AK+ GFSD++IA++W   ++R   R   +
Sbjct:  455 DIFFLDKLLYIVEIENQLKVNIFEPELLKTAKKNGFSDREIAKLWNVTPEEVRRRRQENK   514

Query:  481 LYPVYKMVDTCAAEFDAKTPYFYSTYELENESVQSNKESILVLGSGPIRIGQGVEFDYAT   540
            + PVYKMVDTCAAEF++ TPYFYSTYE ENES +S+KE I+VLGSGPIRIGQGVEFDYAT
Sbjct:  515 IIPVYKMVDTCAAEFESSTPYFYSTYEWENESKRSDKEKIIVLGSGPIRIGQGVEFDYAT   574

Query:  541 VHSVKAIQKAGYEAIIMNSNPETVSTDFSVSDKLYFEPLTFEDVMNVIDLEQPKGVIVQF   600
            VH VKAIQ  G EAI++NSNPETVSTDFS+SDKLYFEPLTFEDVMNVIDLE+P  VIVQF
Sbjct:  575 VHCVKAIQALGKEAIVINSNPETVSTDFSISDKLYFEPLTFEDVMNVIDLEEPLVVIVQF   634

Query:  601 GGQTAINLAQALSEAGVTILGTQVEDLDRAEDRDLFEKALKELGIPQPQGQTATNEEEAL   660
            GGQTAINLA+ LS+AGV ILGTQVEDLDRAEDRDLFEKAL++L IPQP G TATNEEEA+
Sbjct:  635 GGQTAINLAEHLSKAGVKILGTQVEDLDRAEDRDLFEKALQDLDIPQPPGATATNEEEAV   694

Query:  661 EAAKKIGFPVLVRPSYVLGGRAMEIVENKEDLREYIRTAVKASPEHPILVDSYIFGKECE   720
              A  KIG+PVL+RPS+VLGGRAMEI+ N++DLR+Y+  AVKASPEHP+LVDSY+ G+ECE
Sbjct:  695 ANANKIGYPVLIRPSFVLGGRAMEIINNEKDLRDYMNRAVKASPEHPVLVDSYLQGECE   754

Query:  721 VDAISDGKSVLIPGIMEHIERAGVHSGDSMAVYPPQQLSKQIQETIAEYTKRLAIGLNCI   780
            VDAI DGK VL+PGIMEHIERAGVHSGDSMAVYPPQ LS+ I +TI +YTKRLAIGLNCI
Sbjct:  755 VDAICDGKEVLLPGIMEHIERAGVHSGDSMAVYPPQNLSQAIIDTIVDYTKRLAIGLNCI   814

Query:  781 GMMNVQFVIKNEQVYVIEVNPRASRTVPFLSKVTGIPMAQIATKLILGQTLKDLGYEDGL   840
            GMMN+QFVI  EQVYVIEVNPRASRTVPFLSKVT IPMAQ+AT++ILG+ LKDLGYE GL
Sbjct:  815 GMMNIQFVIYEEQVYVIEVNPRASRTVPFLSKVTNIPMAQLATQMILGENLKDLGYEAGL   874

Query:  841 YPQSPLVHIKAPVFSFTKLAQVDSLLGPEMKSTGEVMGSDTSLEKALYKAFEANNSHLSE   900
              P   +VH+KAPVFSFTKLA+VDSLLGPEMKSTG MGSD +LEKALYK FEA  H+++
Sbjct:  875 APTPDMVHVKAPVFSFTKLAKVDSLLGPEMKSTGLAMGSDVTLEKALYKSFEAAKLHMAD   934

Query:  901 FGQIVFTIADDSKAEALSLARRFKAIGYQIMATQGTAAYFAEQGLSACLVGKIGDAANDI   960
            +G ++FT+AD+ K E L+LA+ F  IGY ++AT GTAA+  E GL    V K+    ++
Sbjct:  935 YGSVLFTVADEDKEETLALAKDFAEIGYSLVATAGTAAFLKENGLYVREVEKLAGGEDEE   994

Query:  961 PTLV---RHGHVQAIVNTVGIKR---TADKDGQMIRSSAIEQGVPLFTALDTAKAMLTVL   1014
            TLV   R G VQA+VNT+G  R     T   DG  IR  AI +G+PLFT+LDT A+L V+
Sbjct:  995 GTLVEDIRQGRVQAVVNTMGNTRASLTTATDGFRIRQEAISRGIPLFTSLDTVAAILKVM   1054

Query: 1015 ESRCFNIEAI   1024
            +SR F  + I
Sbjct: 1055 QSRSFTTKNI   1064

Identities = 141/389 (36%), Positives = 222/389 (56%), Gaps = 16/389 (4%)

Query:  518 ESILVLGSGPIRIGQGVEFDYATVHSVKAIQKAGYEAIIMNSNPETVSTDFSVSDKLYFE   577
            + I+++GSGPI IGQ  EFDYA    A+++ GYE +++NSNP T+ TD ++D +Y E
Sbjct:    8 KKIMIIGSGPIIIGQAAEFDYAGTEACLALKEEGYEVVLVNSNPATIMTDREIADTVYIE   67

Query:  578 PLTFEDVMNVIDLEQPKGVIVQFGGQTAINLAQALSEAG------VTILGTQVEDLDRAE   631
            P+T E V ++ E+P ++    GGQT +N+A  LS+ G       V +LGT++  +D+AE
Sbjct:   68 PITLEFVSKILRKERPDALLPTLGGQTGLNMAMELSKTGILEELNVELLGTKLSAIDQAE   127
```

```
                                              -continued

Query:  632 DRDLFEKALKELGIPQPQGQTATNEEEALEAAKKIGFPVLVRPSYVLGGRAMEIVENKED   691
            DR+LF++ + + P      AT EEA+ A KIG+P++V P++ +GG     I + +E+
Sbjct:  128 DRELFKELCESINEPLCASDIATTVEEAINIADKIGYPIIVGPAFTMGGTGGGICDTEEE   187

Query:  692 LREYIRTAVKASPEHPILVDSYIFG-KECEVDAISD-GKSVLIPGIMEHIERAGVHSGDS   749
            LRE +   +K SP    L++  I G KE E + D   + ++    ME+ + GVH+GDS
Sbjct:  188 LREIVANGLKLSPVTQCLIEESIAGYKEIEYEVMRDSADNAIVVCNMENFDPVGVHTGDS   247

Query:  750 MAVYPPQQLSKQIQETIAEYTKRLAIGLNCIGMMNVQFVI--KNEQVYVIEVNPRASRTV   807
            +   P  QLS    + + + + L G NVQ +   + + VIEVNPR SR+
Sbjct:  248 IVFAPSQTLSDNEYQMLRDASLNIIRALKIEGGCNVQLALDPNSYEYRVIEVNPRVSRSS   307

Query:  808 PFLSKVTGIPMAQIATKLILGQTLKDL--GYEDGLY----PQSPLVHIKAPVFSFTKLAQ   861
              SK TG P+A+++ K+ +G TL ++     + Y   P   V K    FFK
Sbjct:  308 ALASKATGYPIAKMSAKIAIGMTLDEIINPVTNKTYAMFEPALDYVVAKIARFPFDKFEN   367

Query:  862 VDSLLGPEMKSTGEVMGSDTSLEKALYKA                                890
             D  LG +MK+TGEVM    ++E++L KA
Sbjct:  368 GDRHLGTQMKATGEVMAIGRNIEESLLKA                                396
```

An alignment of the GAS and GBS proteins is shown below:

```
Identities = 777/1025 (75%), Positives = 896/1025 (86%), Gaps = 1/1025 (0%)

Query:   35 LSLKEEGYQVVLVNSNPATIMTDKDIADKVYIEPITLEFVTRILRKERPDALLPTLGGQT    94
            L+LKEEGY+V+LVNSNPATIMTDK+IADKVYIEP+TLEFV RI+RKERPDA+LPTLGGQT
Sbjct:    1 LALKEEGYKVILVNSNPATIMTDKEIADKVYIEPLTLEFVNRIIRKERPDAILPTLGGQT    60

Query:   95 GLNMAMALSKNGILEELNVELLGTKLSAIDKAEDRDLFKQLMEELNQPIPESEIVNSVEE   154
            GLNMAMALSK GIL++L +ELLGTKLSAID+AEDRDLFKQLM+EL+QPIPES IV +V+E
Sbjct:   61 GLNMAMALSKAGILDDLEIELLGTKLSAIDQAEDRDLFKQLMQELDQPIPESTIVKTVDE   120

Query:  155 AIQFAEQIGYPLIVRPAFTLGGTGGGMCDNQEQLVDITTKGLKLSPVTQCLIERSIAGFK   214
            A+ FA  IGYP+IVRPAFTLGGTGGG+C ++E+L +IT  GLKLSPVTQCLIERSIAGFK
Sbjct:  121 AVTFARDIGYPVIVRPAFTLGGTGGGICSSEEELCEITENGLKLSPVTQCLIERSIAGFK   180

Query:  215 EIEYEVMRDAADNALVVCNMENFDPVGIHTGDSIVFAPAQTLSDVENQLLRDASLDIIRA   274
            EIEYEVMRD+ADNALVVCNMENFDPVGIHTGDSIVFAP QTLSD+ENQ+LRDASL IIRA
Sbjct:  181 EIEYEVMRDSADNALVVCNMENFDPVGIHTGDSIVFAPTQTLSDIENQMLRDASLKIIRA   240

Query:  275 LKIEGGCNVQLALDPNSFKYYVIEVNPRVSRSSALASKATGYPIAKLAAKIAVGLTLDEV   334
            LKIEGGCNVQLALDP SFKYYVIEVNPRVSRSSALASKATGYPIAKLAAKIAVGLTLDE+
Sbjct:  241 LKIEGGCNVQLALDPYSFKYYVIEVNPRVSRSSALASKATGYPIAKLAAKIAVGLTLDEM   300

Query:  335 INPITKTTYAMFEPALDYVVAKMPRFPFDKFESGDRKLGTQMKATGEVMAIGRNIEESLL   394
            INPIT TTYAMFEPALDYVVAK+PRFPFDKFE G+R+LGTQMKATGEVMAIGRN+EESLL
Sbjct:  301 INPITGTTYAMFEPALDYVVAKIPRFPFDKFEHGERQLGTQMKATGEVMAIGRNLEESLL   360

Query:  395 KACRSLEIGVDHIKIADLDNVSDDVLLEKIRKAEDDRLFYLAEALRRHYSIEKLASLTSI   454
            KACRSLEIGV H ++  L N+SD+ L+  K+ KA+DDRLFYL+EA+RR YSIE+L SLT I
Sbjct:  361 KACRSLEIGVCHNEMTSLSNISDEELVTKVIKAQDDRLFYLSEAIRRGYSIEELESLTKI   420

Query:  455 DSFFLDKLRVIVELEDLLSKNRLDINILKKVKNKGFSDKAIASLWQINEDQVRNMRKEAG   514
            D FFLDKL IVE+E  L +  + LKK K GFSD+ IA +WQ +E +R MR
Sbjct:  421 DLFFLDKLLHIVEIEQELQMHVDHLESLKKAKRYGFSDQKIAEIWQKDESDIRAMRHSHS   480

Query:  515 ILPVYKMVDTCASEFDSATPYFYSTYAVENESLISDKASILVLGSGPIRIGQGVEFDYAT   574
             + PVYKMVDTCA+EFD+ TPYFYSTY +ENES+ S+K SILVLGSGPIRIGQGVEFDYAT
Sbjct:  481 LYPVYKMVDTCAAEFDAKTPYFYSTYELENESVQSNKESILVLGSGPIRIGQGVEFDYAT   540

Query:  575 VHSVKAIRESGFEAIIMNSNPETVSTDFSISDKLYFEPLTFEDVMNVIDLEKPEGVILQF   634
            VHSVKAI+++G+EAIIMNSNPETVSTDFS+SDKLYFEPLTFEDVMNVIDLE+P+GVI+QF
Sbjct:  541 VHSVKAIQKAGYEAIIMNSNPETVSTDFSVSDKLYFEPLTFEDVMNVIDLEQPKGVIVQF   600

Query:  635 GGQTAINLAKDLNKAGVKILGTQLEDLDRAENRKQFEATLQALNIPQPPGFTATTEEEAV   694
            GGQTAINLA+ L++AGV ILGTQ+EDLDRAE+R  FE  L+ L IPQP G TAT EEA+
Sbjct:  601 GGQTAINLAQALSEAGVTILGTQVEDLDRAEDRDLFEKALKELGIPQPQGQTATNEEEAL   660

Query:  695 NAAQKIGYPVLVRPSYVLGGRAMKIVENEEDLRHYMTTAVKASPDHPVLIDAYLIGKECE   754
              AA+KIG+PVLVRPSYVLGGRAM+IVEN+EDLR Y+  TAVKASP+HP+L+D+Y+ GKECE
Sbjct:  661 EAAKKIGFPVLVRPSYVLGGRAMEIVENKEDLREYIRTAVKASPEHPILVDSYIFGKECE   720

Query:  755 VDAISDGQNILIPGIMEHIERSGVHSGDSMAVYPPQTLSETIIETIVDYTKRLAIGLNCI   814
            VDAISDG+++LIPGIMEHIER+GVHSGDSMAVYPPQ LS+ I ETI +YTKRLAIGLNCI
Sbjct:  721 VDAISDGKSVLIPGIMEHIERAGVHSGDSMAVYPPQQLSKQIQETIAEYTKRLAIGLNCI   780
```

-continued

```
Query:   815 GMMNIQFVIKDQKVYVIEVNPRASRTLPFLSKVTHIPMAQVATKVILGDKLCNFTYGYDL    874
             GMMN+QFVIK+++VYVIEVNPRASRT+PFLSKVT IPMAQ+ATK+ILG  L + Y   L
Sbjct:   781 GMMNVQFVIKNEQVYVIEVNPRASRTVPFLSKVTGIPMAQIATKLILGQTLKDLGYEDGL    840

Query:   875 YPASDMVHIKAPVFSFTKLAKVDSLLGPEMKSTGEVMGSDINLQKALYKAFEAAYLHMPD    934
             YP S +VHIKAPVFSFTKLA+VDSLLGPEMKSTGEVMGSD +L+KALYKAFEA    H+ +
Sbjct:   841 YPQSPLVHIKAPVFSFTKLAQVDSLLGPEMKSTGEVMGSDTSLEKALYKAFEANNSHLSE    900

Query:   935 YGNIVFTVDDTDKEEALELAKVYQSIGYRIYATQGTAIYFDANGLETVLVGKLGENDRNH    994
             +G IVFT+ D  K EAL LA+ +++IGY+I ATQGTA YF    GL   LVGK+G+    N
Sbjct:   901 FGQIVFTIADDSKAEALSLARRFKAIGYQIMATQGTAAYFAEQGLSACLVGKIGD-AAND    959

Query:   995 IPDLIKNGKIQAVINTVGQNNIDNHDALIIRRSAIEQGVPLFTSLDTAHAMFKVLESRAF   1054
             IP L+++G +QA++NTVG       + D  +IR SAIEQGVPLFT+LDTA AM  VLESR F
Sbjct:   960 IPTLVRHGHVQAIVNTVGIKRTADKDGQMIRSSAIEQGVPLFTALDTAKAMLTVLESRCF   1019

Query:  1055 TLKVL                                                          1059
             ++ +
Sbjct:  1020 NIEAI                                                          1024

Identities = 145/387 (37%), Positives = 229/387 (58%), Gaps = 16/387 (4%)

Query:    10 IMVIGSGPIVIGQAAEFDYSGTQACLSLKEEGYQVVLVNSNPATIMTDKDIADKVYIEPI     69
             I+V+GSGPI IGQ  EFDY+  +  ++++ GY+ +++NSNP T+ TD  ++DK+Y EP+
Sbjct:   520 ILVLGSGPIRIGQGVEFDYATVHSVKAIQKAGYEAIIMNSNPETVSTDFSVSDKLYFEPL    579

Query:    70 TLEFVTRILRKERPDALLPTLGGQTGLNMAMALSKNGILEELNVELLGTKLSAIDKAEDR    129
             T  E V  ++  E+P ++   GGQT +N+A ALS+ G         V +LGT++  +D+AEDR
Sbjct:   580 TFEDVMNVIDLEQPKGVIVQFGGQTAINLAQALSEAG------VTILGTQVEDLDRAEDR    633

Query:   130 DLFKQLMEELNQPIPESEIVNSVEEAIQFAEQIGYPLIVRPAFTLGGTGGGMCDNQEQLV    189
             DLF++ ++EL  P  P+ +   + EEA++ A++IG+P++VRP++ LGG    + +N+E L
Sbjct:   634 DLFEKALKELGIPQPQGQTATNEEEALEAAKKIGFPVLVRPSYVLGGRAMEIVENKEDLR    693

Query:   190 DITTKGLKLSPVTQCLIERSIAGFKEIEYEVMRDAADNALVVCNMENFDPVGIHTGDSIV    249
              +      +K SP     L++  I G KE E + +D     + L+    ME+ +  G+H+GDS+
Sbjct:   694 EYIRTAVKASPEHPILVDSYIFG-KECEVDAISD-GKSVLIPGIMEHIERAGVHSGDSMA    751

Query:   250 FAPAQTLSDVENQLLRDASLDIIRALKIEGGCNVQLALDPNSFKYYVIEVNPRVSRSSAL    309
                P Q LS    + + + + +   L  G  NVQ +    + + YVIEVNPR SR+
Sbjct:   752 VYPPQQLSKQIQETIAEYTKRLAIGLNCIGMMNVQFVI--KNEQVYVIEVNPRASRTVPF    809

Query:   310 ASKATGYPIAKLAAKIAVGLTLDEVINPITKTTYAMFEPALDYVVAKMPRFPFDKFESGD    369
              SK TG P+A++A K+ +G TL ++             Y   P    V KPFF     D
Sbjct:   810 LSKVTGIPMAQIATKLILGQTLKDL--GYEDGLY----PQSPLVHIKAPVFSFTKLAQVD    863

Query:   370 RKLGTQMKATGEVMAIGRNIEESLLKA                                   396
              +LG +MK+TGEVM    ++E++L KA
Sbjct:   864 SLLGPEMKSTGEVMGSDTSLEKALYKA                                   890
```

Based on this analysis, it was predicted that these proteins and their epitopes could be useful antigens for vaccines or diagnostics.

EXAMPLE 659

A DNA sequence (GBSx0699) was identified in *S. agalactiae* <SEQ ID 2027> which encodes the amino acid sequence <SEQ ID 2028>. This protein is predicted to be carbamoyl phosphate synthetase small subunit (carA). Analysis of this protein sequence reveals the following:

```
Possible site: 19
>>> Seems to have no N-terminal signal sequence

----- Final Results -----
            bacterial cytoplasm --- Certainty = 0.2401 (Affirmative) < succ>
            bacterial membrane  --- Certainty = 0.0000 (Not Clear)  < succ>
            bacterial outside   --- Certainty = 0.0000 (Not Clear)  < succ>
```

The protein has homology with the following sequences in the GENPEPT database:

```
>GP: CAB89872 GB: AJ132624 carbamoyl phosphate synthetase small
subunit [Lactococcus lactis]
Identities = 242/355 (68%), Positives = 305/355 (85%)

Query:     2 KRLLLLEDGSVFEGEAFGADVETSGEIVFSTGMTGYQESITDQSYNGQIITFTYPLIGNY    61
             KRLL+LEDG++FEGEA GA+++ +GE+VF+TGMTGYQESITDQSYNGQI+TFTYP++GNY
Sbjct:     3 KRLLILEDGTIFEGEALGANLDVTGELVFNTGMTGYQESITDQSYNGQILTFTYPIVGNY    62

Query:    62 GINRDDYESIRPTCKGVVIYEWAEYPSNWRQQMTLDEFLKLKGIPGISGIDTRALTKIIR   121
             G+NRDDYESI PTCK VV++E A  PSNWR QM+ DEFLK K IPGI+G+DTRA+TKI+R
Sbjct:    63 GVNRDDYESIHPTCKAVVVHEAARRPSNWRMQMSFDEFLKSKNIPGITGVDTRAITKIVR   122

Query:   122 KHGTMKACLINEGNSIHEALENLQKSVLLNDQIEQVSTKLAYASPGVGKNIVLVDFGLKH   181
             +HGTMKA L+   + +    + LQ +VL  +Q+E  ST  AY SP  G+ +V+VDFGLKH
Sbjct:   123 EHGTMKASLVQARDEVDHQMSQLQATVLPTNQVETSSTATAYPSPNTGRKVVVVDFGLKH   182

Query:   182 SILRELSQRQCHITVVPHTTTAQEILNLNPDGVLLSNGPGNPEQLPNALQMIQEIQGKIP   241
             SILRELS+R+C++TVVP+ T+A+EIL + PDGV+L+NGPG+P  +P A++MI+E+QGKIP
Sbjct:   183 SILRELSKRECNLTVVPYNTSAKEILEMEPDGVMLTNGPGDPTDVPEAIEMIKEVQGKIP   242

Query:   242 IFGICMGHQLFAKANGAKTYKMTFGHRGFNHAVRHLQTGQVDFTSQNHGYAVSREDFPEA   301
             IFGIC+GHQLF+ ANGA TYKM FGHRGFNHAVR + TG++DFTSQNHGYAVS E+ PE
Sbjct:   243 IFGICLGHQLFSLANGATTYKMKFGHRGFNHAVREVATGRIDFTSQNHGYAVSSENLPED   302

Query:   302 LFITHEEINDKTVEGVRHKYYPAFSVQFHPDAAPGPHDTSYLFDEFINMIDDFQQ        356
             L ITH EIND +VEGVRHKY+PAFSVQFHPDAAPGPHD SYLFD+F++++D+F++
Sbjct:   303 LMITHVEINDNSVEGVRHKYFPAFSVQFHPDAAPGPHDASYLFDDFMDLMDNFKK        357
```

A related DNA sequence was identified in *S. pyogenes* <SEQ ID 2029> which encodes the amino acid sequence <SEQ ID 2030>. Analysis of this protein sequence reveals the following:

```
Possible site: 43
>>> Seems to have no N-terminal signal sequence

----- Final Results -----
            bacterial cytoplasm --- Certainty = 0.3534 (Affirmative) < succ>
            bacterial membrane  --- Certainty = 0.0000 (Not Clear)   < succ>
             bacterial outside  --- Certainty = 0.0000 (Not Clear)   < succ>
```

An alignment of the GAS and GBS proteins is shown below:

```
Identities = 265/354 (74%), Positives = 309/354 (86%)

Query:     2 KRLLLLEDGSVFEGEAFGADVETSGEIVFSTGMTGYQESITDQSYNGQIITFTYPLIGNY    61
             KRLL+LEDG++FEGE FGAD++ +GEIVF+TGMTGYQESITDQSYNGQI+TFTYPLIGNY
Sbjct:     3 KRLLILEDGTIFEGEPFGADIDVTGEIVFNTGMTGYQESITDQSYNGQILTFTYPLIGNY    62

Query:    62 GINRDDYESIRPTCKGVVIYEWAEYPSNWRQQMTLDEFLKLKGIPGISGIDTRALTKIIR   121
             GINRDDYESI PTCKGVV+ E +   SNWR+QMTLD FLK+KGIPGISGIDTRALTKIIR
Sbjct:    63 GINRDDYESISPTCKGVVVSEVSRLASNWRKQMTLDAFLKIKGIPGISGIDTRALTKIIR   122

Query:   122 KHGTMKACLINEGNSIHEALENLQKSVLLNDQIEQVSTKLAYASPGVGKNIVLVDFGLKH   181
             +HGTMKA + ++G+SI   + L+ +VL +  IEQVSTK AY +PG+GKNIVLVDFGLKH
Sbjct:   123 QHGTMKATMADDGDSIQHLKDQLRATVLPTNTIEQVSTKTAYPAPGIGKNIVLVDFGLKH   182

Query:   182 SILRELSQRQCHITVVPHTTTAQEILNLNPDGVLLSNGPGNPEQLPNALQMIQEIQGKIP   241
             SILRE S+RQC+ITVVP   TA+E+L LNPDG++LSNGPGNPE LP AL MI+ +QGKIP
Sbjct:   183 SILREFSKRQCNITVVPFNITAEEVLQLNPDGLMLSNGPGNPEDLPEALDMIRGVQGKIP   242

Query:   242 IFGICMGHQLFAKANGAKTYKMTFGHRGFNHAVRHLQTGQVDFTSQNHGYAVSREDFPEA   301
             IFGICMGHQLF+ ANGAKT KMTFGHRGFNHAVR + TG++DFTSQNHGYAV R   P+
Sbjct:   243 IFGICMGHQLFSLANGAKTCKMTFGHRGFNHAVREIATGRIDFTSQNHGYAVERSSLPDT   302

Query:   302 LFITHEEINDKTVEGVRHKYYPAFSVQFHPDAAPGPHDTSYLFDEFINMIDDFQ         355
             L +THE+INDKTVEGV+H+ +PAFSVQFHPDAAPGPHD SYLFDEF+ MID ++
Sbjct:   303 LMVTHEDINDKTVEGVKHRDFPAFSVQFHPDAAPGPHDASYLFDEFLEMIDSWR         356
```

Based on this analysis, it was predicted that these proteins and their epitopes could be useful antigens for vaccines or diagnostics.

EXAMPLE 660

A DNA sequence (GBSx0700) was identified in *S. agalactiae* <SEQ ID 2031> which encodes the amino acid sequence <SEQ ID 2032>. This protein is predicted to be aspartate carbamoyltransferase (pyrB). Analysis of this protein sequence reveals the following:

```
Possible site: 26
>>> Seems to have no N-terminal signal sequence

----- Final Results -----
            bacterial cytoplasm --- Certainty = 0.3260 (Affirmative) < succ>
            bacterial membrane  --- Certainty = 0.0000 (Not Clear)   < succ>
            bacterial outside   --- Certainty = 0.0000 (Not Clear)   < succ>
```

The protein has homology with the following sequences in the GENPEPT database:

```
>GP: AAF72727 GB: AF264709 aspartate transcarbamoylase [Enterococcus
faecalis]
Identities = 197/303 (65%), Positives = 250/303 (82%)

Query:   5 TQTLSLEHFVSLEELSNQEVMSLIKRSIEVKENPSNIGFDKDYYVSNLFFENSTRTHKSF  64
           ++ +SL+H ++ E L+++EVM LI+R+ E K+        ++ Y+ +NLFFENSTRTHKSF
Sbjct:   5 SERISLKHLLTAEALTDREVMGLIRRAGEFKQGAKWHPEERQYFATNLFFENSTRTHKSF  64

Query:  65 EMAELKLGLKTIEFNADTSSVNKGETLYDTILTMSALGLDVCVIRHPDIDYYKELIASPN 124
           E+AE KLGL+ IEF A  SSV KGETLYDT+LTMSA+G+DV VIRH   +YY ELI S
Sbjct:  65 EVAEKKLGLEVIEFEASRSSVQKGETLYDTVLTMSAIGVDVAVIRHGKENYYDELIQSKT 124

Query: 125 IHSAIVNGGDGSGQHPSQSLLDLVTIYEEFGYFKGLKIAIVGDLTHSRVAKSNMQVLKRL 184
           I  +I+NGGDGSGQHP+Q LLDL+TIYEEFG F+GLK+AIVGD+THSRVAKSNMQ+L RL
Sbjct: 125 IQCSIINGGDGSGQHPTQCLLDLMTIYEEFGGFEGLKVAIVGDITHSRVAKSNMQLLNRL 184

Query: 185 GAEIFFSGPKEWYSSQFDEYGQYLPIDQLVDQIDVLMLLRVQHERHDGKGVFSKESYHQQ 244
           GAEI+FSGP+EWY  QFD YGQY+P+D++V+++DV+MLLRVQHERHDGK  FSKE YH +
Sbjct: 185 GAEIYFSGPEEWYDHQFDVYGQYVPLDEIVEKVDVMMLLRVQHERHDGKESFSKEGYHLE 244

Query: 245 FGLTKERYKHLRDTAIIMHPAPVNRDVEIASDLVEADKARIVKQMSNGVYARIAILEAVL 304
           +GLT ER   L+  AIIMHPAPVNRDVE+A +LVE+ ++RIV QMSNGV+ R+AILEA+L
Sbjct: 245 YGLTNERATRLQKHAIIMHPAPVNRDVELADELVESLQSRIVAQMSNGVFMRMAILEAIL 304

Query: 305 NSR                                                          307
           + +
Sbjct: 305 HGK                                                          307
```

A related DNA sequence was identified in *S. pyogenes* <SEQ ID 2033> which encodes the amino acid sequence <SEQ ID 2034>. Analysis of this protein sequence reveals the following:

```
Possible site: 38
>>> Seems to have a cleavable N-term signal seq.

----- Final Results -----
            bacterial outside   --- Certainty = 0.3000(Affirmative) < succ>
            bacterial membrane  --- Certainty = 0.0000(Not Clear)   < succ>
            bacterial cytoplasm --- Certainty = 0.0000(Not Clear)   < succ>
```

An alignment of the GAS and GBS proteins is shown below:

```
Identities = 208/300 (69%), Positives = 249/300 (82%)

Query:    8 LSLEHFVSLEELSNQEVMSLIKRSIEVKENPSNIGFDKDYYVSNLFFENSTRTHKSFEMA   67
            ++L + VS+E L+ +EV+ LI R  E K      I  +   V+NLFFENSTRTHKSFE+A
Sbjct:   26 VALTNLVSMEALTTEEVLGLINRGSEYKAGKVVISDHQKDLVANLFFENSTRTHKSFEVA   85

Query:   68 ELKLGLKTIEFNADTSSVNKGETLYDTILTMSALGLDVCVIRHPDIDYYKELIASPNIHS  127
            E KLGL  ++FNAD S+VNKGE+LYDT+LTMSALG D+CVIRHP+ DYYKEL+ SP I +
Sbjct:   86 EKKLGLTVLDFNADASAVNKGESLYDTVLTMSALGTDICVIRHPEDDYYKELVESPTITA  145

Query:  128 AIVNGGDGSGQHPSQSLLDLVTIYEEFGYFKGLKIAIVGDLTHSRVAKSNMQVLKRLGAE  187
            +IVNGGDGSGQHPSQ LLDL+TIYEEFG F+GLKIAI GDLTHSRVAKSNMQ+LKRLGAE
Sbjct:  146 SIVNGGDGSGQHPSQCLLDLLTIYEEFGRFEGLKIAIAGDLTHSRVAKSNMQILKRLGAE  205

Query:  188 IFFSGPKEWYSSQFDEYGQYLPIDQLVDQIDVLMLLRVQHERHDGKGVFSKESYHQQFGL  247
            ++F GP+EWYS  F+ YG Y+ IDQ++ ++DVLMLLRVQHERHDG   FSKE YHQ FGL
Sbjct:  206 LYFYGPEEWYSEAFNAYGTYIAIDQIIKELDVLMLLRVQHERHDGHQSFSKEGYHQAFGL  265

Query:  248 TKERYKHLRDTAIIMHPAPVNRDVEIASDLVEADKARIVKQMSNGVYARIAILEAVLNSR  307
            T+ERY+ L+D+AIIMHPAPVNRDVEIA  LVEA KARIV QM+NGV+ R+AI+EA+LN R
Sbjct:  266 TQERYQQLKDSAIIMHPAPVNRDVEIADSLVEAPKARIVSQMANGVFVRMAIIEAILNGR  325
```

Based on this analysis, it was predicted that these proteins and their epitopes could be useful antigens for vaccines or diagnostics.

EXAMPLE 661

A DNA sequence (GBSx0701) was identified in *S. agalactiae* <SEQ ID 2035> which encodes the amino acid sequence <SEQ ID 2036>. Analysis of this protein sequence reveals the following:

```
Possible site: 30
>>> Seems to have no N-terminal signal sequence

----- Final Results -----
            bacterial cytoplasm --- Certainty = 0.2392(Affirmative) < succ>
             bacterial membrane --- Certainty = 0.0000(Not Clear)   < succ>
              bacterial outside --- Certainty = 0.0000(Not Clear)   < succ>
```

The protein has homology with the following sequences in the GENPEPT database:

```
>GP: AAC06948 GB: AE000708 dihydroorotase [Aquifex aeolicus]
Identities = 176/422 (41%), Positives = 255/422 (59%), Gaps = 8/422 (1%)

Query:   11 IIKNGLIIDPQSGFNQVSDMLIDQGKIKQISKEIDIKGIPIIDASNKIVAPGLVDIHVHF   70
            I+KNG +IDP       D+L++ GKIK+I K I +    IIDA   IV PG +DIHVH
Sbjct:    5 IVKNGYVIDPSQNLEGEFDILVENGKIKKIDKNILVPEAEIIDAKGLIVCPGFIDIHVHL   64

Query:   71 REPGQTHKENIHTGALSAAVGGFTTVLMMANTNPTISSPEIVKQVKESAAKEAI-KIETV  129
            R+PGQT+KE+I +G+  A  GGFTT++ M NTNP I +  +V   + +     + ++
Sbjct:   65 RDPGQTYKEDIESGSRCAVAGGFTTIVCMPNTNPPIDNTTVVNYILQKSKSVGLCRVLPT  124

Query:  130 ATITKSLNGKDLVNFEELLEAGVAGFSDDGIPLTDTKVLQEAMNLARKHDVVLSLHEEDP  189
              TITK  GK++  +F  L  EAG    F+DDG P+ D+ V+++A+ LA +   V +  H ED
Sbjct:  125 GTITKGRKGKEIADFYSLKEAGCVAFTDDGSPVMDSSVMRKALELASQLGVPIMDHCEDD  184

Query:  190 SLN-GVLGINEHIAQKIYHVCGASGLAEYSMIARDAMIAYQTQAKVHIQHLSSSESVEVV  248
             L  GV  INE    +     +   + AE   IARD ++A +T   VHIQH+S+  S+E++
Sbjct:  185 KLAYGV--INEGEVSALLGLSSRAPEAEEIQIARDGILAQRTGGHVHIQHVSTKLSLEII  242

Query:  249 DFAQKLGANLTAEVTPQHFSKTENLLLTKGANAKLNPPLRLEKDRQALIDGLKSGVISII  308
            +F ++  G  +T EV P H    TE  +L  GANA++NPPLR ++DR ALI+G+K  G+I
Sbjct:  243 EFFKEKGVKITCEVNPNHLLFTEREVLNSGANARVNPPLRKKEDRLALIEGVKRGIIDCF  302

Query:  309 ASDHAPHHIMEKAADNISQAPSGMTGLETSLALGITYLVSTKELSMIDFLAKMTCNPAQL  368
            A+DHAPH    EK  +   A  G+ GL+T+L   +  L     +S+     + T NPA++
Sbjct:  303 ATDHAPHQTFEK--ELVEFAMPGIIGLQTALPSALE-LYRKGIISLKKLIEMFTINPARI  359
```

```
                            -continued
Query: 369 YGFDAGYLREGGPADIVIFDQAEERIIKAEF-ASKSSNSPFIGDKLKGVIHYTICNGEIV  427
           G D G L+ G PADI IFD  +E I+  E    SKS N+P  G  LKG + YTI +G++V
Sbjct: 360 IGVDLGTLKLGSPADITIFDPNKEWILNEETNLSKSRNTPLWGKVLKGKVIYTIKDGKMV  419

Query: 428 YQ                                                            429
           Y+
Sbjct: 420 YK                                                            421
```

A related DNA sequence was identified in *S. pyogenes* <SEQ ID 2037> which encodes the amino acid sequence <SEQ ID 2038>. Analysis of this protein sequence reveals the following:

```
Possible site: 35
>>> Seems to have no N-terminal signal sequence
     INTEGRAL     Likelihood = -0.80    Transmembrane    76-92 (76-92)
     INTEGRAL     Likelihood = -0.00    Transmembrane    286-302 (286-302)

----- Final Results -----
               bacterial membrane --- Certainty = 0.132(Affirmative) < succ>
                bacterial outside --- Certainty = 0.000(Not Clear)   < succ>
              bacterial cytoplasm --- Certainty = 0.000(Not Clear)   < succ>
```

The protein has homology with the following sequences in the databases:

```
!GB: AE000708 dihydroorotase [Aquifex aeolicus] 316 3e-85
>GP: AAC06948 GB: AE000708 dihydroorotase [Aquifex aeolicus]
Score = 316 bits (801), Expect = 3e-85
Identities = 177/422 (41%), Positives = 254/422 (59%), Gaps = 8/422 (1%)

Query:   2 ILIKNGRVMDPKSQRDQVADVLIDGKQIVKIASAIECQEAQVIDASGLIVAPGLVDIHVH   61
           +++KNG V+DP   +  D+L++  +I KI    I    EA++IDA GLIV PG +DIHVH
Sbjct:   4 LIVKNGYVIDPSQNLEGEFDILVENGKIKKIDKNILVPEAEIIDAKGLIVCPGFIDIHVH   63

Query:  62 FREPGQTHKEDIHTGALAAAAGGVTTVVMMANTNPVISDVETLQEVLASAAKEKI-HIYT  120
           R+PGQT+KEDI +G+  A  AGG TT+V M NTNP I +   +L +       + +
Sbjct:  64 LRDPGQTYKEDIESGSRCAVAGGFTTIVCMPNTNPPIDNTTVVNYILQKSKSVGLCRVLP  123

Query: 121 NASVTQAFNGKDVTDFKALLEAGAVSFSDDGIPLESSKVLKEAFDLANANQTFISLHEED  180
             +T+   GK++ DF +L EAG V+F+DDG P+  S V+++A +LA+     I  H ED
Sbjct: 124 TGTITKGRKGKEIADFYSLKEAGCVAFTDDGSPVMDSSVMRKALELASQLGVPIMDHCED  183

Query: 181 PQL-NGVLGFNEGIAEEHFHFCGATGVAEYSMIARDVMIAYDRQAHVHIQHLSKAESVQV  239
           +L  GV+  NEG          AE   IARD ++A     HVHIQH+S   S+++
Sbjct: 184 DKLAYGVI--NEGEVSALLGLSSRAPEAEEIQIARDGILAQRTGGHVHIQHVSTKLSLEI  241

Query: 240 VAFAQQLGAKVTAEVSPQHFSTTEDLLLIAGTSAKMNPPLRTQRDRLAVIEGLKSGVITV  299
           + F ++ G K+T EV+P H    TE  +L +G +A++NPPLR + DRLA+IEG+K G+I
Sbjct: 242 IEFFKEKGVKITCEVNPNHLLFTEREVLNSGANARVNPPLRKKEDRLALIEGVKRGIIDC  301

Query: 300 IATDHAPHHKDEKTVDDMTKAPSGMTGLETSLSLGLTHLVEPGHLTMSLLEKMTLNPAL  359
           ATDHAPH    EK + +   A  G+ GL+T+L   L    G ++L  L+E  T+NPA
Sbjct: 302 FATDHAPHQTFEKELVEF--AMPGIIGLQTALPSAL-ELYRKGIISLKKLIEMFTINPAR  358

Query: 360 LYGFDAGYLAENGPADLVIFADKQERLITENF-ASKASNSPFIGNKLKGVVKYTIADGEV  418
           + G D G L     PAD+ IF  +E ++ E    SK+ N+P  G  LKG V YTI DG++
Sbjct: 359 IIGVDLGTLKLGSPADITIFDPNKEWILNEETNLSKSRNTPLWGKVLKGKVIYTIKDGKM  418

Query: 419 VY                                                            420
           VY
Sbjct: 419 VY                                                            420
```

An alignment of the GAS and GBS proteins is shown below:

```
Identities = 269/420 (64%), Positives = 338/420 (80%)

Query:   9 MYIIKNGLIIDPQSGFNQVSDMLIDQGKIKQISKEIDIKGIPIIDASNKIVAPGLVDIHV   68
           M +IKNG ++DP+S  +QV+D+LID  +I +I+  I+ +    +IDAS  IVAPGLVDIHV
Sbjct:   1 MILIKNGRVMDPKSQRDQVADVLIDGKQIVKIASAIECQEAQVIDASGLIVAPGLVDIHV   60
```

-continued

```
Query:  69 HFREPGQTHKENIHTGALSAAVGGFTTVLMMANTNPTISSPEIVKQVKESAAKEAIKIET  128
           HFREPGQTHKE+IHTGAL+AA GG TTV+MMANTNP IS  E +++V  SAAKE I  T
Sbjct:  61 HFREPGQTHKEDIHTGALAAAAGGVTTVVMMANTNPVISDVETLQEVLASAAKEKIHIYT  120

Query: 129 VATITKSLNGKDLVNFEELLEAGVAGFSDDGIPLTDTKVLQEAMNLARKHDVVLSLHEED  188
              A++T++ NGKD+ +F+ LLEAG   FSDDGIPL +KVL+EA +LA +    +SLHEED
Sbjct: 121 NASVTQAFNGKDVTDFKALLEAGAVSFSDDGIPLESSKVLKEAFDLANANQTFISLHEED  180

Query: 189 PSLNGVLGINEHIAQKIYHVCGASGLAEYSMIARDAMIAYQTQAKVHIQHLSSSESVEVV  248
            P LNGVLG NE IA++ +H CGA+G+AEYSMIARD MIAY  QA VHIQHLS +ESV+VV
Sbjct: 181 PQLNGVLGFNEGIAEEHFHFCGATGVAEYSMIARDVMIAYDRQAHVHIQHLSKAESVQVV  240

Query: 249 DFAQKLGANLTAEVTPQHFSKTENLLLTKGANAKLNPPLRLEKDRQALIDGLKSGVISII  308
              FAQ+LGA +TAEV+PQHFS TE+LLL  G +AK+NPPLR ++DR A+I+GLKSGVI++I
Sbjct: 241 AFAQQLGAKVTAEVSPQHFSTTEDLLLIAGTSAKMNPPLRTQRDRLAVIEGLKSGVITVI  300

Query: 309 ASDHAPHHIMEKAADNISQAPSGMTGLETSLALGITYLVSTKELSMIDFLAKMTCNPAQL  368
           A+DHAPHH  EK D++++APSGMTGLETSL+LG+T+LV     L+++  L KMT NPA L
Sbjct: 301 ATDHAPHHKDEKTVDDMTKAPSGMTGLETSLSLGLTHLVEPGHLTLMSLLEKMTLNPALL  360

Query: 369 YGFDAGYLREGGPADIVIFDQAEERIIKAEFASKSSNSPFIGDKLKGVIHYTICNGEIVY  428
           YGFDAGYL E GPAD+VIF   +ER+I   FASK+SNSPFIG+KLKGV+ YTI +GE+VY
Sbjct: 361 YGFDAGYLAENGPADLVIFADKQERLITENFASKASNSPFIGNKLKGVVKYTIADGEVVY  420
```

Based on this analysis, it was predicted that these proteins and their epitopes could be useful antigens for vaccines or diagnostics.

EXAMPLE 662

A DNA sequence (GBSx0702) was identified in *S. agalactiae* <SEQ ID 2039> which encodes the amino acid sequence <SEQ ID 2040>. This protein is predicted to be orotate phosphoribosyltransferase PyrE (pyrE). Analysis of this protein sequence reveals the following:

```
Possible site: 28
>>> Seems to have no N-terminal signal sequence

----- Final Results -----
           bacterial cytoplasm --- Certainty = 0.2214(Affirmative) < succ>
           bacterial membrane  --- Certainty = 0.0000(Not Clear)   < succ>
           bacterial outside   --- Certainty = 0.0000(Not Clear)   < succ>
```

The protein has homology with the following sequences in the GENPEPT database:

```
>GP: AAC95453 GB: AF068902 orotate phosphoribosyltransferase PyrE
[Streptococcus pneumoniae]
Identities = 152/208 (73%), Positives = 180/208 (86%)

Query:   1 MDLARQIAMELLDIQAVYLRPQQPFTWASGVKSPIYTDNRVTLSYPETRTLIENGFVKQI   60
           M LA+ IA  LL IQAVYL+P++PFTWASG+KSPIYTDNRVTL+YPETRTLIENGFV  I
Sbjct:   1 MTLAKDIASHLLKIQAVYLKPEEPFTWASGIKSPIYTDNRVTLAYPETRTLIENGFVDAI   60

Query:  61 QKHFPNVDIIAGTATAGIPHGAIIADKMNLPFAYIRSKAKDHGVGNQIEGRVYSGQKMVI  120
           ++ FP V++IAGTATAGIPHGAIIADKMNLPFAYIRSK KDHG GNQIEGRV  GQKMV+
Sbjct:  61 KEAFPEVEVIAGTATAGIPHGAIIADKMNLPFAYIRSKPKDHGAGNQIEGRVAQGQKMVV  120

Query: 121 IEDLISTGGSVLEAVTAAQSQGIEVLGVVAIFTYQLAKAEQAFREADIPLVTLTDYNQLI  180
            +EDLISTGGSVLEAV AA+ +G +VLGVVAIF+YQL KA++  F +A + LVTL++Y++LI
Sbjct: 121 VEDLISTGGSVLEAVAAAKREGADVLGVVAIFSYQLPKADKNFADAGVKLVTLSNYSELI  180

Query: 181 KVAKVNGYITADQLVLLKKFKEDQMNWQ                                208
            +A+   GYIT + L LLK+FKEDQ NWQ
Sbjct: 181 HLAQEEGYITPEGLDLLKRFKEDQENWQ                                208
```

A related DNA sequence was identified in *S. pyogenes* <SEQ ID 2041> which encodes the amino acid sequence <SEQ ID 2042>. Analysis of this protein sequence reveals the following:

```
Possible site: 28
>>> Seems to have no N-terminal signal sequence

----- Final Results -----
            bacterial cytoplasm --- Certainty = 0.1612(Affirmative) < succ>
             bacterial membrane --- Certainty = 0.0000(Not Clear)  < succ>
              bacterial outside --- Certainty = 0.0000(Not Clear)  < succ>
```

An alignment of the GAS and GBS proteins is shown below:

```
Identities = 158/208 (75%), Positives = 179/208 (85%)

Query:    1 MDLARQIAMELLDIQAVYLRPQQPFTWASGVKSPIYTDNRVTLSYPETRTLIENGFVKQI   60
            M LA QIA +LLDI+AVYL+P+ PFTWASG+KSPIYTDNRVTLSYP+TR LIENGFV+ I
Sbjct:    1 MTLASQIATQLLDIKAVYLKPEDPFTWASGIKSPIYTDNRVTLSYPKTRDLIENGFVETI   60

Query:   61 QKHFPNVDIIAGTATAGIPHGAIIADKMNLPFAYIRSKAKDHGVGNQIEGRVYSGQKMVI  120
            + HFP V++IAGTATAGIPHGAIIADKM LPFAYIRSK KDHG GNQIEGRV  GQKMVI
Sbjct:   61 KAHFPEVEVIAGTATAGIPHGAIIADKMTLPFAYIRSKPKDHGAGNQIEGRVLKGQKMVI  120

Query:  121 IEDLISTGGSVLEAVTAAQSQGIEVLGVVAIFTYQLAKAEQAFREADIPLVTLTDYNQLI  180
            IEDLISTGGSVL+A  AA  +G +VLGVVAIFTY+L KA Q F+EA I L+TL++Y +LI
Sbjct:  121 IEDLISTGGSVLDAAAAASREGADVLGVVAIFTYELPKASQNFKEAGIKLITLSNYTELI  180

Query:  181 KVAKVNGYITADQLVLLKKFKEDQMNWQ                                 208
            VAK+ GYIT D L LLKKFKEDQ+NWQ
Sbjct:  181 AVAKLQGYITNDGLHLLKKFKEDQVNWQ                                 208
```

Based on this analysis, it was predicted that these proteins and their epitopes could be useful antigens for vaccines or diagnostics.

EXAMPLE 663

A DNA sequence (GBSx0703) was identified in *S. agalactiae* <SEQ ID 2043> which encodes the amino acid sequence <SEQ ID 2044>. This protein is predicted to be orotidine 5'-phosphate decarboxylase (pyrF). Analysis of this protein sequence reveals the following:

```
Possible site: 40
>>> Seems to have an uncleavable N-term signal seq

----- Final Results -----
             bacterial membrane --- Certainty = 0.0000(Not Clear)  < succ>
              bacterial outside --- Certainty = 0.0000(Not Clear)  < succ>
            bacterial cytoplasm --- Certainty = 0.0000(Not Clear)  < succ>
```

A related GBS nucleic acid sequence <SEQ ID 9829> which encodes amino acid sequence <SEQ ID 9830> was also identified.

The protein has homology with the following sequences in the GENPEPT database:

```
>GP: AAC95452 GB: AF068902 orotidine-5'-decarboxylase PyrF
[Streptococcus pneumoniae]
Identities = 149/231 (64%), Positives = 176/231 (75%),
Gaps = 1/231 (0%)

Query:   19 MLEKCPIIALDFSDLASVTTFLEHFPKEELLFVKIGMELYYSEGPSIIRYIKSLGHRIFL   78
            M E  PIIALDF  +V  FL  FP EE L++K+GMELYY  GP I+ Y+K LGH +FL
Sbjct:    1 MREHRPIIALDFPSFEAVKEFLALFPAEESLYLKVGMELYYAAGPEIVSYLKGLGHSVFL   60

Query:   79 DLKLHDIPNTVRSSMSVLAKLGIDMTNVHAAGGVEMMKAAREGLGKGPILLAVTQLTSTS  138
            DLKLHDIPNTV+S+M VL++LG+DMTNVHAAGGVEMMKAAREGLG    L+AVTQLTSTS
Sbjct:   61 DLKLHDIPNTVKSAMKVLSQLGVDMTNVHAAGGVEMMKAAREGLGSQAKLIAVTQLTSTS  120

Query:  139 QEQMQVDQHINLSVVDSVCHYAQKAQEAGLDGVVASAQEGMQIKKQTNEHFICLTPGIRP  198
            + QMQ  Q+I  S+ +SV HYA+K  EAGLDGVV SAQE   IK+ TN  FICLTPGIRP
Sbjct:  121 EAQMQEFQNIQTSLQESVIHYAKKTAEAGLDGVVCSAQEVQVIKQATNPDFICLTPGIRP  180
```

```
Query: 199 PQTNQLDDQKRTMTPEQARIVGADYIVVGRPITKAENPYQAYLEIKEEWNR       249
             + DQKR MTP  A  +G+DYIVVGRPIT+AE+P  AY   IK+EW +
Sbjct: 181 AGV-AVGDQKRVMTPADAYQIGSDYIVVGRPITQAEDPVAAYHAIKDEWTQ        230
```

A related DNA sequence was identified in *S. pyogenes* <SEQ ID 2045> which encodes the amino acid sequence <SEQ ID 2046>. Analysis of this protein sequence reveals the following:

```
Possible site: 44
>>> Seems to have no N-terminal signal sequence

----- Final Results -----
             bacterial cytoplasm --- Certainty = 0.1934(Affirmative) < succ>
             bacterial membrane  --- Certainty = 0.0000(Not Clear)   < succ>
              bacterial outside  --- Certainty = 0.0000(Not Clear)   < succ>
```

An alignment of the GAS and GBS proteins is shown below:

```
Identities = 149/229 (65%), Positives = 180/229 (78%), Gaps = 1/229 (0%)

Query:   19 MLEKCPIIALDFSDLASVTTFLEHFPKEELLFVKIGMELYYSEGPSIIRYIKSLGHRIFL   78
            M E+ PIIALDFS      FL+ FP EE L+VKIGMELYY++GP I+RYIKSLGH +FL
Sbjct:    1 MKEERPIIALDFSSFEETKAFLDLFPAEEKLYVKIGMELYYAQGPDIVRYIKSLGHNVFL   60

Query:   79 DLKLHDIPNTVRSSMSVLAKLGIDMTNVHAAGGVEMMKAAREGLGKGPILLAVTQLTSTS  138
            DLKLHDIPNTVR++M+VL +L IDM  VHAAGGVEM+KAAREGLG+GP L+AVTQLTSTS
Sbjct:   61 DLKLHDIPNTVRAAMAVLKELDIDMATVHAAGGVEMLKAAREGLGQGPTLIAVTQLTSTS  120

Query:  139 QEQMQVDQHINLSVVDSVCHYAQKAQEAGLDGVVASAQEGMQIKKQTNEHFICLTPGIRP  198
            ++QM+ DQ+I  S+++SV HY++ A +A LDG V SAQE   IK T   F CLTPGIRP
Sbjct:  121 EDQMRGDQNIQTSLLESVLHYSKGAAKAQLDGAVCSAQEVEAIKAVTPTGFTCLTPGIRP  180

Query:  199 PQTNQLDDQKRTMTPEQARIVGADYIVVGRPITKAENPYQAYLEIKEEW            247
             +N + DQKR MTP QAR +G+DYIVVGRPIT+A++P  AY   IK EW
Sbjct:  181 KGSN-IGDQKRVMTPNQARRIGSDYIVVGRPITQAKDPVAAYQAIKAEW             228
```

Based on this analysis, it was predicted that these proteins and their epitopes could be useful antigens for vaccines or diagnostics.

EXAMPLE 664

A DNA sequence (GBSx0704) was identified in *S. agalactiae* <SEQ ID 2047> which encodes the amino acid sequence <SEQ ID 2048> in others. Analysis of this protein sequence reveals the following:

```
Possible site: 52
>>> Seems to have no N-terminal signal sequence
    INTEGRAL    Likelihood = -8.70    Transmembrane    192-208 (190-211)
    INTEGRAL    Likelihood = -7.64    Transmembrane    226-242 (218-250)
    INTEGRAL    Likelihood = -3.77    Transmembrane    388-404 (378-404)
    INTEGRAL    Likelihood = -3.08    Transmembrane    293-309 (292-311)
    INTEGRAL    Likelihood = -2.87    Transmembrane    165-181 (162-182)
    INTEGRAL    Likelihood = -2.13    Transmembrane    267-283 (267-284)
    INTEGRAL    Likelihood = -0.90    Transmembrane    114-130 (114-130)
    INTEGRAL    Likelihood = -0.75    Transmembrane    318-334 (318-334)
    INTEGRAL    Likelihood = -0.53    Transmembrane    140-156 (140-156)

----- Final Results -----
             bacterial membrane  --- Certainty = 0.4482(Affirmative) < succ>
              bacterial outside  --- Certainty = 0.0000(Not Clear)   < succ>
             bacterial cytoplasm --- Certainty = 0.0000(Not Clear)   < succ>
```

The protein has homology with the following sequences in the GENPEPT database:

```
>GP: BAB03800 GB: AP001507 unknown conserved protein in others
[Bacillus halodurans]
Identities = 63/243 (25%), Positives = 120/243 (48%)

Query:    5 MSVVLRAGKLLIESGAEVYRVEDTMKHFAKALQIENFEAYVVSSSIIASGINRYGKQEAK   64
            M + + AG++++ +GAE YRVE+T++  AKA Q  N  ++V ++ I  S           +
Sbjct:    8 MDICMLAGEIMLINGAETYRVEETLERMAKAGQFRNVHSFVTTTGIFLSFEEEGAGDVMQ   67

Query:   65 VCNTDGVTANLGRLEAVNNLSRQIAKQDLVSPEEIVKQLDLIEHQKDYSLLVTLISYFCG  124
             + D    +L ++  VN +SR+     ++ + E + K  ++ +   +YS L+     +
Sbjct:   68 MIRVDDRMQDLNKVTLVNQVSREFVNGEIDAAEALTKLQNIAKQPMNYSPLLLHTASGVA  127

Query:  125 AGSFSLALGSSLLDSFSAAVTGLILGYFLNLMESRIHTGFLLTILGSSVVALSANLLYFS  184
              G+FS   G +L D+  A + G +     + ++S +   F    + +         A LL
Sbjct:  128 GGAFSYLFGGNLFDTLPAFIAGFVASMAVVHLQSYLKVRFFAEFMAAFTGGAVAILLVLI  187

Query:  185 GLGEHRSIIILGALMVMVPGAAFVNSVREFSQNNFSTGLALIMSALLICISISAGVAITI  244
            GLGE+    +I+G LM +VPG    N+VR+   +   G+       +     +SI+ G+A+ I
Sbjct:  188 GLGENVDQVIIGTLMPLVPGIPLTNAVRDLISGDLLAGVTRGAECFVTSLSIATGIALAI  247

Query:  245 EII                                                          247
            ++
Sbjct:  248 ALL                                                          250
```

No corresponding DNA sequence was identified in *S. pyogenes*.

Based on this analysis, it was predicted that this protein and its epitopes, could be useful antigens for vaccines or diagnostics.

EXAMPLE 665

A DNA sequence (GBSx0705) was identified in *S. agalactiae* <SEQ ID 2049> which encodes the amino acid sequence <SEQ ID 2050>. This protein is predicted to be ABC transporter. Analysis of this protein sequence reveals the following:

```
Possible site: 40
>>> Seems to have no N-terminal signal sequence

----- Final Results -----
            bacterial cytoplasm --- Certainty = 0.5134(Affirmative) < succ>
            bacterial membrane  --- Certainty = 0.0000(Not Clear)   < succ>
             bacterial outside  --- Certainty = 0.0000(Not Clear)   < succ>
```

A related GBS nucleic acid sequence <SEQ ID 9353> which encodes amino acid sequence <SEQ ID 9354> was also identified.

The protein has homology with the following sequences in the GENPEPT database:

```
>GP: CAB12571 GB: Z99108 similar to ABC transporter (ATP-binding
protein) [Bacillus subtilis]
Identities = 193/288 (67%), Positives = 231/288 (80%)

Query:    1 MNDVINIVYHVENQDLVRYSGDYTNFESVYAMKKAQLEAAYERQQKEIADLQDFVNRNKA   60
            +N VIN++YHVENQ+L RY GDY  F  VY +KK QLEAAY++QQ+E+A+L+DFV RNKA
Sbjct:  222 LNSVINLIYHVENQELTRYVGDYHQFMEVYEVKKQQLEAAYKKQQQEVAELKDFVARNKA  281

Query:   61 RVATRNMAMSRQKKLDKMDIIELQAEKPKPSFEFKESRTPGRFIFQAKDLQIGYDRALTK  120
            RV+TRNMAMSRQKKLDKMD+IEL AEKPKP F FK +RT G+ IF+ KDL IGYD  L++
Sbjct:  282 RVSTRNMAMSRQKKLDKMDMIELAAEKPKPEFHFKPARTSGKLIFETKDLVIGYDSPLSR  341

Query:  121 PLNLTFERNQKIAIVGANGIGKTTLLKSLLGIIPPISGNVERGDFIDLGYFEQEVPGGNR  180
            PLNL  ER QKIA+ GANGIGKTTLLKSLLG I P+ G+VERG+ I   GYFEQEV   N
Sbjct:  342 PLNLRMERGQKIALYGANGIGKTTLLKSLLGEIQPLEGSVERGEHIYTGYFEQEVKETNN  401

Query:  181 QTPLEAVWDAFPALNQAEVRAALARCGLTSKHIESQIQVLSGGEQSKVRFCLLMNRENNV  240
             T +E VW  FP+  Q E+RAA A+CGLT+KHIES++ VLSGGE++KVR C L+N E N+
Sbjct:  402 NTCIEEVWSEFPSYTQYEIRAAPAKCGLTTKHIESRVSVLSGGEKAKVRLCKLINSETNL  461
```

-continued

```
Query:   241 LVLDEPTNHLDVDAKDELKRALKAYKGSILMVCHEPDFYEGWMDDVWD          288
             LVLDEPTNHLD DAK+ELKRALK YKGSIL++ HEPDFY     + W+
Sbjct:   462 LVLDEPTNHLDADAKEELKRALKEYKGSILLISHEPDFYMDIATETWN         509

Identities = 56/219 (25%), Positives = 97/219 (43%), Gaps = 44/219 (20%)

Query:   104 IFQAKDLQIGY-DRALTKPLNLTFERNQKIAIVGANGIGKTTLLKSLLGIIPPISGNVER  162
             I    KDL  G+ DRA+     ++    + + + ++GANG GK+T +   + G + P   G VE
Sbjct:     3 ILSVKDLSHGFGDRAIFNNVSFRLLKGEHVGLIGANGEGKSTFMNIITGKLEPDEGKVEW   62

Query:   163 GDFIDLGYFEQEVPGGNRQTPLEAVWDAFPALNQAE------------------------  198
             + +GY +Q         ++  + + DAF  L    E
Sbjct:    63 SKNVRVGYLDQHTVLEKGKSIRDVLKDAFHYLFAMEEEMNEIYNKMGEADPDELEKLLEE  122

Query:   199 ---VRAALAR----------------CGLTSKHIESQIQVLSGGEQSKVRFCLLMNRENN  239
                ++ AL                 GL+    +E +  LSGG+++KV     L+  +
Sbjct:   123 VGVIQDALTNNDFYVIDSKVEEIARGLGLSDIGLERDVTDLSGGQRTKVLLAKLLLEKPE  182

Query:   240 VLVLDEPTNHLDVDAKDELKRALKAYKGSILMVCHEPDF                       278
             +L+LDEPTN+LD    + LKR L+ Y+ + +++ H+   F
Sbjct:   183 ILLLDEPTNYLDEQHIEWLKRYLQEYENAFILISHDIPF                       221
```

20

A related DNA sequence was identified in *S. pyogenes* <SEQ ID 2051> which encodes the amino acid sequence <SEQ ID 2052>. Analysis of this protein sequence reveals the following:

```
Possible site: 14
>>> Seems to have no N-terminal signal sequence

----- Final Results -----
           bacterial cytoplasm --- Certainty = 0.2794 (Affirmative) < succ>
            bacterial membrane --- Certainty = 0.0000 (Not Clear)  < succ>
             bacterial outside --- Certainty = 0.0000 (Not Clear)  < succ>
```

An alignment of the GAS and GBS proteins is shown below:

```
Identities = 246/294 (83%), Positives = 274/294 (92%), Gaps = 1/294 (0%)

Query:     1 MNDVINIVYHVENQDLVRYSGDYTNFESVYAMKKAQLEAAYERQQKEIADLQDFVNRNKA   60
             +NDVINIVYHVENQ LVRY+GDY F++VY MK++QLEAAYERQQKEIA+LQDFVNRNKA
Sbjct:   233 LNDVINIVYHVENQSLVRYTGDYYQFQAVYEMKQSQLEAAYERQQKEIANLQDFVNRNKA  292

Query:    61 RVATRNMAMSRQKKLDKMDIIELQAEKPKPSFEFKESRTPGRFIFQAKDLQIGYDRALTK  120
             RVATRNMAMSRQKKLDKMDIIELQAEKPKP+FEFK++RTP RFIFQ K+L IGYD  LTK
Sbjct:   293 RVATRNMAMSRQKKLDKMDIIELQAEKPKPNFEFKQARTPSRFIFQTKNLVIGYDYPLTK  352

Query:   121 -PLNLTFERNQKIAIVGANGIGKTTLLKSLLGIIPPISGNVERGDFIDLGYFEQEVPGGN  179
              PLN+TFERNQKIAIVGANGIGK+TLLKSLLG+I P G++  GDF+++GYFEQEV G N
Sbjct:   353 EPLNITFERNQKIAIVGANGIGKSTLLKSLLGVIEPLEGHIVTGDFLEVGYFEQEVTGVN  412

Query:   180 RQTPLEAVWDAFPALNQAEVRAALARCGLTSKHIESQIQVLSGGEQSKVRFCLLMNRENN  239
             RQTPLE VWDAFPALNQAEVRAALARCGLTSKHIESQIQVLSGGEQ+KVRFCLLMNRENN
Sbjct:   413 RQTPLEVVWDAFPALNQAEVRAALARCGLTSKHIESQIQVLSGGEQAKVRFCLLMNRENN  472

Query:   240 VLVLDEPTNHLDVDAKDELKRALKAYKGSILMVCHEPDFYEGWMDDVWDFNQLS         293
             VL+LDEPTNHLD+DAK+ELKRALKAYKGSILMVCHEPDFY GW+ D WDF++L+
Sbjct:   473 VLILDEPTNHLDIDAKNELKRALKAYKGSILMVCHEPDFYNGWVTDTWDFSKLT         526

Identities = 60/218 (27%), Positives = 102/218 (46%), Gaps = 43/218 (19%)

Query:   104 IFQAKDLQIGY-DRALTKPLNLTFERNQKIAIVGANGIGKTTLLKSLLGIIPPISGNVER  162
             I  + K L  G+ DRA+ + ++       + + I +VGANG GK+T +    + G + P   G VE
Sbjct:    15 ILEVKQLSHGFGDRAIFENVSFRLLKGEHIGLVGANGEGKSTFMSIVTGHLQPDEGKVEW   74

Query:   163 GDFIDLGYFEQEVPGGNRQTPLEAVWDAFPALNQAEVR-----AALA-------------  204
             ++    GY +Q     + QT + +  AF   L + ER         A++A
Sbjct:    75 SKYVTAGYLDQHTVLESGQTVRDVLRTAFDELFKTENRINEIYASMADDKADIAVLMEEV  134
```

```
                          -continued
Query: 205------------------------RCGLTSKHIESQIQVLSGGEQSKVRFCLLMNRENNV  240
                                  G+    +ES +  LSGG+++KV    L+  + ++
Sbjct: 135 GELQDRLESRDFYTLDAKIDEVARALGVMDFGMESDVTSLSGGQRTKVLLAKLLLEKPDI  194

Query: 241 LVLDEPTNHLDVDAKDELKRALKAYKGSILMVCHEPDF                        278
           L+LDEPTNHLD +  + LKR L+ Y+ + +++ H+  F
Sbjct: 195 LLLDEPTNHLDAEHIEWLKRYLQHYENAFVLISHDISF                        232
```

Based on this analysis, it was predicted that these proteins and their epitopes could be useful antigens for vaccines or diagnostics.

EXAMPLE 666

A DNA sequence (GBSx0706) was identified in *S. agalactiae* <SEQ ID 2053> which encodes the amino acid sequence <SEQ ID 2054>. This protein is predicted to be lipoprotein Nlp1 precursor (pstS). Analysis of this protein sequence reveals the following:

```
Possible site: 32
>>> Seems to have no N-terminal signal sequence

----- Final Results -----
           bacterial cytoplasm --- Certainty = 0.2637 (Affirmative) < succ>
           bacterial membrane  --- Certainty = 0.0000 (Not Clear)   < succ>
           bacterial outside   --- Certainty = 0.0000 (Not Clear)   < succ>
```

The protein has homology with the following sequences in the GENPEPT database:

```
>GP: CAB14429 GB: Z99116 alternate gene name: yzmB~similar to
phosphate ABC transporter (binding protein) [Bacillus subtilis]
Identities = 42/62 (67%), Positives = 49/62 (78%)

Query:  15 SITSVGSTALQPLVEAAADEFGKTNLGKTINVQGGGSGTGLSQVQSGAVQIGNSDLFAEE   74
           S+T  GS+A+QPLV AAA++F + N    I VQ GGSGTGLSQV  GAVQIGNSD+FAEE
Sbjct:  45 SLTISGSSAMQPLVLAAAEKFMEENPDADIQVQAGGSGTGLSQVSEGAVQIGNSDVFAEE  104

Query:  75 KE                                                             76
           KE
Sbjct: 105 KE                                                            106
```

A related DNA sequence was identified in *S. pyogenes* <SEQ ID 1695> which encodes the amino acid sequence <SEQ ID 1696>. Analysis of this protein sequence reveals the following:

```
Possible site: 24
>>> May be a lipoprotein

----- Final Results -----
           bacterial membrane  --- Certainty = 0.0000 (Not Clear)   < succ>
           bacterial outside   --- Certainty = 0.0000 (Not Clear)   < succ>
           bacterial cytoplasm --- Certainty = 0.0000 (Not Clear)   < succ>
```

An alignment of the GAS and GBS proteins is shown below:

```
Identities = 63/74 (85%), Positives = 71/74 (95%)

Query:   3 LSGCANWIDKGQSITSVGSTALQPLVEAAADEFGKTNLGKTINVQGGGSGTGLSQVQSGA   62
           LS C++WIDKG+SIT+VGSTALQPLVEA ADEFG +NLGKT+NVQGGGSGTGLSQVQSGA
Sbjct:  20 LSACSSWIDKGESITAVGSTALQPLVEAVADEFGSSNLGKTVNVQGGGSGTGLSQVQSGA   79
```

```
Query:  63 VQIGNSDLFAEEKE                                              76
           VQIGNSD+FAEEK+
Sbjct:  80 VQIGNSDVFAEEKD                                              93
```

Based on this analysis, it was predicted that these proteins and their epitopes could be useful antigens for vaccines or diagnostics.

EXAMPLE 667

A DNA sequence (GBSx0707) was identified in *S. agalactiae* <SEQ ID 2055> which encodes the amino acid sequence <SEQ ID 2056>. This protein is predicted to be lipoprotein Nlp1 precursor (pstS). Analysis of this protein sequence reveals the following:

```
Possible site: 60
>>> Seems to have an uncleavable N-term signal seq

----- Final Results -----
            bacterial membrane --- Certainty = 0.0000 (Not Clear) < succ>
            bacterial outside  --- Certainty = 0.0000 (Not Clear) < succ>
            bacterial cytoplasm --- Certainty = 0.0000 (Not Clear) < succ>
```

A related GBS nucleic acid sequence <SEQ ID 9343> which encodes amino acid sequence <SEQ ID 9344> was also identified.

The protein has homology with the following sequences in the GENPEPT database:

```
>GP: CAB14429 GB: Z99116 alternate gene name: yzmB~similar to
phosphate ABC transporter (binding protein) [Bacillus subtilis]
Identities = 95/184 (51%), Positives = 126/184 (67%), Gaps = 1/184 (0%)

Query:    3 DHQVAVAGLAVIVNKKVNVKNLTTHQLRDIFAGKIKINWKEVGGQDLDISIINRAASSGSR    62
            DHQVAV G+A VN     VK+++  +L+ IF GKIKNWKE+GG+D I+++NR  SSG+R
Sbjct:  115 DHQVAVVGMAAAVNPDAGVKDISKDELKKIFTGKIKNWKELGGKDQKITLVNRPDSSGTR   174

Query:   63 ATFDNTIMGNVAPIQSQEQDSNGMVKSIVSQTPGAISYLAFAYV-DKSVGTLKLNGFAPT   121
            ATF   +   P +   +DS+  VK I++ TPGAI YLAF+Y+ D V  L ++G  P
Sbjct:  175 ATFVKYALDGAEPAEGITEDSSNTVKKIIADTPGAIGYLAFSYLTDDKVTALSIDGVKPE   234

Query:  122 AKNVTTDNWKLWSYEHMYTKGNETGLTKEFLDYMKSDKVQSSIVQHMGYISINDMKVVKD   181
            AKNV T  + +W+Y+H YTKG  TGL KEFLDY+KS+ +Q SIV   GYI + DMKV +D
Sbjct:  235 AKNVATGEYPIWAYQHSYTKGEATGLAKEFLDYLKSEDIQKSIVTDQGYIPVTDMKVTRD   294

Query:  182 AEGK                                                           185
            A GK
Sbjct:  295 ANGK                                                           298
```

There is also homology to SEQ ID 1696.

Figure 135:
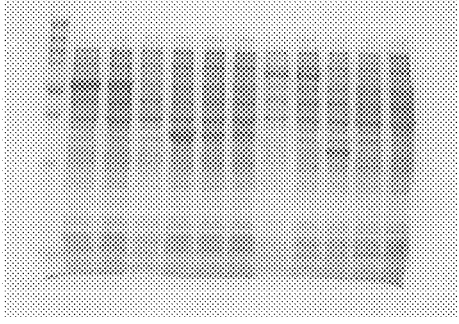

SEQ ID 9344 (GBS659) was expressed in *E. coli* as a GST-fusion product. SDS-PAGE analysis of total cell extract is shown in FIG. 135 (lane 2 & 3; MW 60 kDa). It was also expressed in *E. coli* as a His-fusion product. SDS-PAGE analysis of total cell extract is shown in FIG. 135 (lane 5-7; MW 35 kDa) and in FIG. 178 (lane 11; MW 35 kDa).

Figure 228:
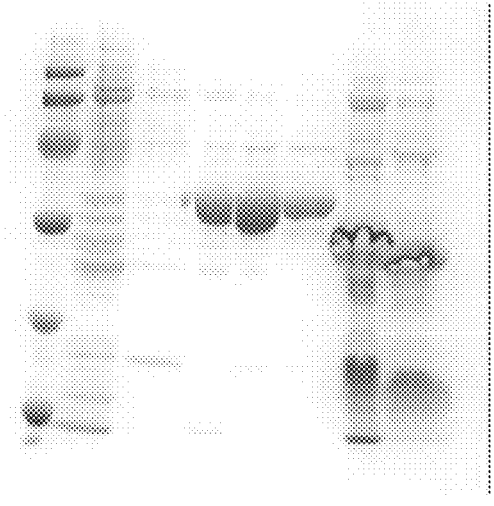

GBS659-His was purified as shown in FIG. 228, lane 6-8.

Based on this analysis, it was predicted that these proteins and their epitopes could be useful antigens for vaccines or diagnostics.

EXAMPLE 668

A DNA sequence (GBSx0708) was identified in *S. agalactiae* <SEQ ID 2057> which encodes the amino acid sequence <SEQ ID 2058>. This protein is predicted to be phosphate transporter permease PstC (pstC-2). Analysis of this protein sequence reveals the following:

```
Possible site: 47
>>> Seems to have no N-terminal signal sequence
INTEGRAL Likelihood = -15.50 Transmembrane  35-51  (27-61)
INTEGRAL Likelihood =  -7.64 Transmembrane 167-183 (154-186)
```

-continued

```
INTEGRAL Likelihood = -6.37   Transmembrane 282-298 (277-302)
INTEGRAL Likelihood = -5.52   Transmembrane  85-101  (81-116)
INTEGRAL Likelihood = -3.24   Transmembrane 133-149 (131-155)

----- Final Results -----
        bacterial membrane  --- Certainty = 0.7198 (Affirmative) < succ>
         bacterial outside  --- Certainty = 0.0000 (Not Clear)   < succ>
        bacterial cytoplasm --- Certainty = 0.0000 (Not Clear)   < succ>
```

A related GBS nucleic acid sequence <SEQ ID 8635> which encodes amino acid sequence <SEQ ID 8636> was also identified. Analysis of this protein sequence reveals the following:

```
Lipop: Possible site: -1 Crend: 8
SRCFLG: 0
McG: Length of UR: 5
     Peak Value of UR: -0.12
     Net Charge of CR: 2
McG: Discrim Score: -16.22
GvH: Signal Score (-7.5): -4.26
     Possible site: 41
>>> Seems to have no N-terminal signal sequence
Amino Acid Composition: calculated from 1
ALOM program       count: 5       value: -15.50        threshold: 0.0
   INTEGRAL        Likelihood = -15.50   Transmembrane    29-45  (21-55)
   INTEGRAL        Likelihood =  -7.64   Transmembrane   161-177 (148-180)
   INTEGRAL        Likelihood =  -6.37   Transmembrane   276-292 (271-296)
   INTEGRAL        Likelihood =  -5.52   Transmembrane    79-95  (75-110)
   INTEGRAL        Likelihood =  -3.24   Transmembrane   127-143 (125-149)
   PERIPHERAL      Likelihood = 0.69                 205
modified ALOM score: 3.60
icm1 HYPID: 7 CFP: 0.720

*** Reasoning Step: 3

----- Final Results -----
           bacterial membrane  --- Certainty = 0.7198 (Affirmative) < succ>
            bacterial outside  --- Certainty = 0.0000 (Not Clear)   < succ>
           bacterial cytoplasm --- Certainty = 0.0000 (Not Clear)   < succ>
```

The protein has homology with the following sequences in the GENPEPT database:

```
>GP: CAB14428 GB: Z99116 alternate gene name: yzmC~similar to
phosphate ABC transporter (permease) [Bacillus subtilis]
Identities = 145/303 (47%), Positives = 209/303 (68%), Gaps = 4/303 (1%)

Query:    8 KNQELAKKLTSPSKNSRLEKFGKGITFLSLALIVFIVAM-ILIFVAQKGLSTFFVDGVKL    66
            +N  ++++L S  +N +L++    +  + ALI+   ++ I IF+  KGL +F V+GV
Sbjct:    6 ENMSVSERLISSRQNRQLDEVRGRMIVTACALIMIAASVAITIFLGVKGLQSFLVNGVSP   65

Query:   67 TDFLFNTKWEP--SAKSFGAFPMIAGSFIVTILSAIIATPFAIGAAVFMTEISPKYGSKI  124
            +FL +  W P   S   +G   P I GSF VTILSA+IA P   I   +FMTEI+P +G K+
Sbjct:   66 IEFLTSLNWNPTDSDPKYGVLPFIFGSFAVTILSALIAAPLGIAGPIFMTEIAPNWGKKV  125

Query:  125 LQPAVELLVGIPSVVYGFIGLQIIVPFVRSI-FGGTGFGILSGVCVLFVMILPTVTFMTV  183
            LQP +ELLVGIPSVVYGFIGL ++VPF+      GTG  +L+G VL VMILPT+T ++
Sbjct:  126 LQPVIELLVGIPSVVYGFIGLTVLVPFIAQFKSSGTGHSLLAGTIVLSVMILPTITSISA  185

Query:  184 DSLRAVPRHYKEASLAMGATRWQTIWRVILNAARPGIFTAIVFGMARAFGEALAIQMVVG  243
            D++ ++P+  +E S A+GATRWQTI +V++  AA P + TA+V GMARAFGEALA+QMV+G
Sbjct:  186 DAMASLPKSLREGSYALGATRWQTIRKVLVPAAFPTLMTAVVLGMARAFGEALAVQMVIG  245

Query:  244 NSAILPTSLTTPAATLTSVLTMGIGNTVMGTVQNNVLWSLALVLLIMSLAFNTVIKLITR  303
            N+  +LP S    A  TLT+++T+ +G+T  G+V NN LWS+ LVLL+MS  F  +I+ ++
Sbjct:  246 NTRVLPESPFDTAGTLTTIITLNMGHTTYGSVENNTLWSMGLVLLVMSFLFILLIRYLSS  305

Query:  304 EGK                                                           306
            K
Sbjct:  306 RRK                                                           308
```

A related DNA sequence was identified in *S. pyogenes* <SEQ ID 1691> which encodes the amino acid sequence <SEQ ID 1692>. Analysis of this protein sequence reveals the following:

```
Possible site: 41
>>> Seems to have no N-terminal signal sequence
    INTEGRAL    Likelihood = -17.25    Transmembrane     29-45  (21-55)
    INTEGRAL    Likelihood =  -7.22    Transmernbrane   162-178 (154-84)
    INTEGRAL    Likelihood =  -5.57    Transmembrane    282-298 (277-302)
    INTEGRAL    Likelihood =  -5.41    Transmembrane     96-112 (81-116)
    INTEGRAL    Likelihood =  -3.08    Transmembrane    133-149 (131-152)

----- Final Results -----
              bacterial membrane --- Certainty = 0.7899 (Affirmative) < succ>
              bacterial outside  --- Certainty = 0.0000 (Not Clear)   < succ>
            bacterial cytoplasm  --- Certainty = 0.0000 (Not Clear)   < succ>
```

An alignment of the GAS and GBS proteins is shown below:

```
Identities = 266/311 (85%), Positives = 290/311 (92%), Gaps 6/311 (1%)

Query:    7 MKNQELAKKLTSPSKNSRLEKFGKGITFLSLALIVFIVAMILIFVAQKGLSTFFVDGVKL   66
            M+NQELAKKL SPSKNSRLE FG+ ITFL LALIVFIVAMILIVAQKGLSTFFVD V L
Sbjct:    1 MENQELAKKLASPSKNSRLETFGRTITFLCLALIVFIVAMILIFVAQKGLSTFFVDKVNL   60

Query:   67 TDFLFNTKWEPSAKS------FGAFPMIAGSFIVTILSAIIATPFAIGAAVFMTEISPKY  120
            DFLF +W+PS K+      GA PMI GSF+VTILSAIIATPFAIGAAVFMTEISPKY
Sbjct:   61 FDFLFGKEWQPSVKNAAGIPYLGALPMITGSFLVTILSAIIATPFAIGAAVFMTEISPKY  120

Query:  121 GSKILQPAVELLVGIPSVVYGFIGLQIIVPFVRSIFGGTGFGILSGVCVLFVMILPTVTF  180
            G+K+LQPAVELLVGIPSVVYGFIGLQ+IVPF+RSIFGGTGFGILSGVCVLFVMILPTVTF
Sbjct:  121 GAKLLQPAVELLVGIPSVVYGFIGLQVIVPFMRSIFGGTGFGILSGVCVLFVMILPTVTF  180

Query:  181 MTVDSLRAVPRHYKEASLAMGATRWQTIWRVILNAARPGIFTAIVFGMARAFGEALAIQM  240
            MT DSLRAVPRHY+EAS+AMGATRWQTIWRV+LNAARPGIFTA++FGMARAFGEALAIQM
Sbjct:  181 MTTDSLRAVPRHYREASMAMGATRWQTIWRVVLNAARPGIFTAVIFGMARAFGEALAIQM  240

Query:  241 VVGNSAILPTSLTTPAATLTSVLTMGIGNTVMGTVQNNVLWSLALVLLIMSLAFNTVIKL  300
            VVGNSA++P+SLTTPAATLTSVLTMGIGNTVMGTVQNNVLWSLALVLL+MSLAFN+++KL
Sbjct:  241 VVGNSAVMPSSLTTPAATLTSVLTMGIGNTVMGTVQNNVLWSLALVLLLMSLAFNSLVKL  300

Query:  301 ITREGKKNYER                                                  311
            IT+E K+NYER
Sbjct:  301 ITKERKRNYER                                                  311
```

Based on this analysis, it was predicted that these proteins and their epitopes could be useful antigens for vaccines or diagnostics.

EXAMPLE 669

A DNA sequence (GBSx0709) was identified in *S. agalactiae* <SEQ ID 2059> which encodes the amino acid sequence <SEQ ID 2060>. Analysis of this protein sequence reveals the following:

```
Possible site: 13
>>> Seems to have no N-terminal signal sequence

----- Final Results -----
            bacterial cytoplasm --- Certainty = 0.2469 (Affirmative) < succ>
              bacterial membrane --- Certainty = 0.0000 (Not Clear)   < succ>
               bacterial outside --- Certainty = 0.0000 (Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 670

A DNA sequence (GBSx0710) was identified in *S. agalactiae* <SEQ ID 2061> which encodes the amino acid sequence <SEQ ID 2062>. This protein is predicted to be probable abc transporter permease protein in soda-comga intergenic reg. Analysis of this protein sequence reveals the following:

```
Possible site: 18
>>> Seems to have a cleavable N-term signal seq.
    INTEGRAL      Likelihood = -9.24 Transmembrane   20-36  (19-41)
    INTEGRAL      Likelihood = -8.28 Transmembrane   66-82  (57-88)
    INTEGRAL      Likelihood = -6.90 Transmembrane  260-276 (258-
                                                    285)
    INTEGRAL      Likelihood = -5.47 Transmembrane  109-125 (106-
                                                    129)
    INTEGRAL      Likelihood = -2.87 Transmembrane  181-197 (178-
                                                    198)

----- Final Results -----
              bacterial membrane --- Certainty = 0.4694 (Affirmative) < succ>
                bacterial outside --- Certainty = 0.0000 (Not Clear)  < succ>
              bacterial cytoplasm --- Certainty = 0.0000 (Not Clear)  < succ>
```

The protein has homology with the following sequences in the GENPEPT database:

```
>GP: CAB14427 GB: Z99116 alternate gene name: yzmD~similar to
phosphate ABC transporter (permease) [Bacillus subtilis]
Identities = 157/294 (53%), Positives = 225/294 (76%)

Query:    1 MNAKKADKLATTILYSIAAIIVTILASLLIFILVRGLPHVSWSFLTGKSSSYEAGGGIGI   60
            MN K  DKLAT +    AAII  IL  L  +I++ G+  +S+ F+T KSS+  AGGGI
Sbjct:    1 MNRKITDKLATGMFGLCAAIIAAILVGLFSYIIINGVSQLSFQFITTKSSAIAAGGGIRD   60

Query:   61 QLYNSFFLLIVTLIISIPLSLGAGIYLSEYAKKGRLTNFVRTCIEILSSLPSVVVGLFGY  120
            QL+NSF++L +T++I+IPL +G G++++EYA   ++T+F+RTCIE+LSSLPS+V+G+FG
Sbjct:   61 QLFNSFYILFITMLITIPLGVGGGVFMAEYAPNNKVTDFIRTCIEVLSSLPSIVIGMFGL  120

Query:  121 LIFVVQFQYGFSIISGALALTVFNLPQMTRSVEDSLQNVHHTQREAGLALGISRWETVIY  180
            L+FV   +G++II GALALTVFNLP M R  ED++++V    +EA LALG+SRW TV
Sbjct:  121 LMFVNLTGWGYTIIGGALALTVFNLPVMVRVTEDAIRSVPKDLKEASLALGVSRWHTVKT  180

Query:  181 VVVPEALPSIVTGVVLASGRIFGEAAALIYTAGQSAPALDWSNWNVLSVTSPISIFRQAE  240
            V++P A+PSI+TG +LASGR+FGEAAAL++TAG + P L+++ WN   S TSP++IFR AE
Sbjct:  181 VLIPSAIPSIITGAILASGRVFGEAAALLFTAGLTTPRLNFTEWNPFSETSPLNIFRPAE  240

Query:  241 TLAVHIWKVNSEGTIPDATQVSAGSAAVLLVVILIFNLSARSIGKKLHSKLTSS        294
            TLAVHIW VN++G IPDA  ++ G + VL++ +L+FNL+AR +G  ++ KLT++
Sbjct:  241 TLAVHIWNVNTQGMIPDAEAIANGGSPVLVISVLVFNLAARWLGTMIYKKLTAN        294
```

A related DNA sequence was identified in *S. pyogenes* <SEQ ID 1685> which encodes the amino acid sequence <SEQ ID 1686>. Analysis of this protein sequence reveals the following:

```
Possible site: 56
>>> Seems to have an uncleavable N-term signal seq
    INTEGRAL      Likelihood              Transmembrane   17-33  (8-40)
                  = -11.89
    INTEGRAL      Likelihood              Transmembrane  260-276 (257-
                  = -10.19                                285)
    INTEGRAL      Likelihood = -5.89 Transmembrane    66-82  (57-87)
```

```
                           -continued
  INTEGRAL      Likelihood = -5.47 Transmembrane 109-125 (106-
                                   129)
  INTEGRAL      Likelihood = -2.02 Transmembrane 181-197 (180-
                                   197)

----- Final Results -----
              bacterial membrane --- Certainty = 0.5755 (Affirmative) < succ>
              bacterial outside  --- Certainty = 0.0000 (Not Clear)  < succ>
              bacterial cytoplasm --- Certainty = 0.0000 (Not Clear) < succ>
```

An alignment of the GAS and GBS proteins is shown below:

```
Identities = 257/294 (87%), Positives = 278/294 (94%)

Query:   1 MNAKKADKLATTILYSIAAIIVTILASLLIFILVRGLPHVSWSFLTGKSSSYEAGGGIGI   60
           MNAKK DK+AT  LY+IA IIV ILASL+++ILVRGLPH+SWSFLTGKSSSYEAGGGIGI
Sbjct:   1 MNAKKVDKVATGTLYTIAGIIVAILASLILYILVRGLPHISWSFLTGKSSSYEAGGGIGI   60

Query:  61 QLYNSFFLLIVTLIISIPLSLGAGIYLSEYAKKGRLTNFVRTCIEILSSLPSVVVGLFGY  120
           QLYNSFFLLIVTLIISIPLS GAGIYL+EYAKKG +TNF+RTCIEILSSLPSVVVGLFGY
Sbjct:  61 QLYNSFFLLIVTLIISIPLSTGAGIYLAEYAKKGPVTNFIRTCIEILSSLPSVVVGLFGY  120

Query: 121 LIFVVQFQYGFSIISGALALTVFNLPQMTRSVEDSLQNVHHTQREAGLALGISRWETVIY  180
           LIFVVQF+YGFSIISGALALTVFNLPQMTR+VEDSL +VHHTQREAGLALG+SRWETV Y
Sbjct: 121 LIFVVQFEYGFSIISGALALTVFNLPQMTRNVEDSLLHVHHTQREAGLALGLSRWETVFY  180

Query: 181 VVVPEALPSIVTGVVLASGRIFGEAAALIYTAGQSAPALDWSNWNVLSVTSPISIFRQAE  240
           VV+PEALP +VTG+VLASGRIFGEAAALIYTAGQSAPALDWSNWN LSVTSPISIFRQ+E
Sbjct: 181 VVIPEALPGMVTGIVLASGRIFGEAAALIYTAGQSAPALDWSNWNPLSVTSPISIFRQSE  240

Query: 241 TLAVHIWKVNSEGTIPDATQVSAGSAAVLLVVILIFNLSARSIGKKLHSKLTSS         294
           TLAVHIWKVNSEGTIPDAT VSAGSAAVLL+ ILIFN SA  IGKKLHSK+T++
Sbjct: 241 TLAVHIWKVNSEGTIPDATLVSAGSAAVLLIFILIFNFSAHFIGKKLHSKMTAA         294
```

Based on this analysis, it was predicted that these proteins and their epitopes could be useful antigens for vaccines or diagnostics.

EXAMPLE 671

A DNA sequence (GBSx0711) was identified in *S. agalactiae* <SEQ ID 2063> which encodes the amino acid sequence <SEQ ID 2064>. This protein is predicted to be phosphate ABC transporter, ATP-binding protein (pstB) (pstB-2). Analysis of this protein sequence reveals the following:

```
Possible site: 60
>>> Seems to have no N-terminal signal sequence

----- Final Results -----
              bacterial cytoplasm --- Certainty = 0.4506 (Affirmative) < succ>
              bacterial membrane  --- Certainty = 0.0000 (Not Clear)   < succ>
              bacterial outside   --- Certainty = 0.0000 (Not Clear)   < succ>
```

The protein has homology with the following sequences in the GENPEPT database:

```
>GP: AAB99016 GB: U67544 phosphate specific transport complex
component (pstB) [Methanococcus jannaschii]
Identities = 154/247 (62%), Positives = 204/247 (82%)

Query:  21 LTTKDLHVYYGEKEAIKGIDMQFEKNKITALIGPSGCGKSTYLRSLNRMNDTIDIARVTG   80
           + TK+L+++YGEK+A+  I++   +NKITALIGPSGCGKST+LR LNR+ND I   R+ G
Sbjct:   6 METKNLNLWYGEKQALFDINLPIYENKITALIGPSGCGKSTFLRCLNRLNDLIPNVRIEG   65

Query:  81 QIMYEGIDVNAQDINVYEMRKHIGMVFQRPNPFAKSIYKNITFAYERAGVKDKKFLDEVV  140
           +++ +G ++  +D++VYE+RK +GMVFQ+PNPFA SIY N+ F     G+KDKK LD++V
Sbjct:  66 EVLLDGKNIYDKDVDVYELRKRVGMVFQKPNPFAMSIYDNVAFGPRIHGIKDKKELDKIV  125
```

```
                            -continued
Query:  141 ETSLKQAALWDQVKDDLHKSAFTLSGGQQQRLCIARAIAVKPEILLMDEPASALDPIATM  200
            E +LK+AALWD+VKD+LHK+A +LSGGQQQRLCIARAIAVKPE+LLMDEP SALDPI+T+
Sbjct:  126 EWALKKAALWDEVKDELHKNALSLSGGQQQRLCIARAIAVKPEVLLMDEPTSALDPISTL  185

Query:  201 QLEETMFELKKNYTIIIVTHNMQQAARASDYTAFFYLGDLIEYDKTNNIFQNAKCQSTSD  260
            ++EE M EL K+YTI++VTHNMQQA+R SDYTAFF +G LIE+ +T  IF N + + T D
Sbjct:  186 KIEELMVELAKDYTIVVVTHNMQQASRVSDYTAFFLMGKLIEFGETEQIFLNPQKKETDD  245

Query:  261 YVSGRFG                                                     267
            Y+SGRFG
Sbjct:  246 YISGRFG                                                     252
```

A related DNA sequence was identified in *S. pyogenes* <SEQ ID 1681> which encodes the amino acid sequence <SEQ ID 1682>. Analysis of this protein sequence reveals the following:

```
Possible site: 20
>>> Seems to have no N-terminal signal sequence

----- Final Results -----
             bacterial cytoplasm --- Certainty = 0.2796 (Affirmative) < succ>
             bacterial membrane  --- Certainty = 0.0000 (Not Clear)   < succ>
             bacterial outside   --- Certainty = 0.0000 (Not Clear)   < succ>
```

An alignment of the GAS and GBS proteins is shown below:

```
Identities = 242/267 (90%), Positives = 258/267 (95%)

Query:    1 MAEYNWDERHIITFPEENSALTTKDLHVYYGEKEAIKGIDMQFEKNKITALIGPSGCGKS   60
            M EYNW+ERHIITFPEE  AL TKDLHVYYG KEAIKGIDMQFEK+KITALIGPSGCGKS
Sbjct:    1 MTEYNWNERHIITFPEETLALATKDLHVYYGAKEAIKGIDMQFEKHKITALIGPSGCGKS   60

Query:   61 TYLRSLNRMNDTIDIARVTGQIMYEGIDVNAQDINVYEMRKHIGMVFQRPNPFAKSIYKN  120
            TYLRSLNRMNDTIDIARVTG+I+Y+GIDVN +D+NVYE+RKH+GMVFQRPNPFAKSIYKN
Sbjct:   61 TYLRSLNRMNDTIDIARVTGEILYQGIDVNRKDMNVYEIRKHLGMVFQRPNPFAKSIYKN  120

Query:  121 ITFAYERAGVKDKKFLDEVVETSLKQAALWDQVKDDLHKSAFTLSGGQQQRLCIARAIAV  180
            ITFA+ERAGVKDKK LDE+VETSLKQAALWDQVKDDLHKSAFTLSGGQQQRLCIARAI+V
Sbjct:  121 ITFAHERAGVKDKKVLDEIVETSLKQAALWDQVKDDLHKSAFTLSGGQQQRLCIARAISV  180

Query:  181 KPEILLMDEPASALDPIATMQLEETMFELKKNYTIIIVTHNMQQAARASDYTAFFYLGDL  240
            KP+ILLMDEPASALDPIATMQLEETMFELKKNYTIIIVTHNMQQAARASDYTAFFYLG+L
Sbjct:  181 KPDILLMDEPASALDPIATMQLEETMFELKKNYTIIIVTHNMQQAARASDYTAFFYLGNL  240

Query:  241 IEYDKTNNIFQNAKCQSTSDYVSGRFG                                 267
            IEYDKT NIFQNA+CQST+DYVSG FG
Sbjct:  241 IEYDKTRNIFQNAQCQSTNDYVSGHFG                                 267
```

Based on this analysis, it was predicted that these proteins and their epitopes could be useful antigens for vaccines or diagnostics.

EXAMPLE 672

A DNA sequence (GBSx0712) was identified in *S. agalactiae* <SEQ ID 2065> which encodes the amino acid sequence <SEQ ID 2066>. This protein is predicted to be phosphate ABC transporter, ATP-binding protein (pstB-1). Analysis of this protein sequence reveals the following:

```
Possible site: 50
>>> Seems to have no N-terminal signal sequence

----- Final Results -----
             bacterial cytoplasm --- Certainty = 0.3806 (Affirmative) < succ>
             bacterial membrane  --- Certainty = 0.0000 (Not Clear)   < succ>
             bacterial outside   --- Certainty = 0.0000 (Not Clear)   < succ>
```

A related GBS nucleic acid sequence <SEQ ID 9815> which encodes amino acid sequence <SEQ ID 9816> was also identified.

The protein has homology with the following sequences in the GENPEPT database:

```
>GP: CAB14426 GB: Z99116 alternate gene name: yzmE~similar to
phosphate ABC transporter (ATP-binding protein)
[Bacillus subtilis]
Identities = 148/248 (59%), Positives = 189/248 (75%)

Query:    5 ILQVSDLSVYYNKKKALKEVSMDFYPNEITALIGPSGSGKSTLLRAINRMGDLNPEVTLT   64
            +L+V DLS+YY  K+A+  V+MD    N +TALIGPSG GKST LR INRM DL  P
Sbjct:   22 VLEVKDLSIYYGNKQAVHHVNMDIEKNAVTALIGPSGCGKSTFLRNINRMNDLIPSARAE   81

Query:   65 GAVMYNGHNVYSPRTDTVELRKEIGMVFQQPNPFPMSVFENVVYGLRLKGIKDKATLDEA  124
            G ++Y G N+       + V LR+EIGMVFQ+PNPFP S++ N+ + L+  G ++KA LDE
Sbjct:   82 GEILYEGLNILGGNINVVSLRREIGMVFQKPNPFPKSIYANITHALKYAGERNKAVLDEI  141

Query:  125 VETSLKGASIWDEVKDRLHDSALGLSGGQQQRVCIARTLATKPKIILLDEPTSALDPISA  184
            VE SL  A++WDEVKDRLH SAL LSGGQQQR+CIARTLA KP ++LLDEP SALDPIS
Sbjct:  142 VEESLTKAALWDEVKDRLHSSALSLSGGQQQRLCIARTLAMKPAVLLLDEPASALDPISN  201

Query:  185 GKIEETLHGLKDQYTMLLVTRSMQQASRISDRTGFFLDGNLIEYGNTKEMFMNPKHKETE  244
            KIEE + GLK +Y++++VT +MQQA R+SDRT FFL+G L+EYG T+++F +PK ++TE
Sbjct:  202 AKIEELITGLKREYSIIIVTHNMQQALRVSDRTAFFLNGELVEYGQTEQIFTSPKKQKTE  261

Query:  245 DYITGKFG  252
            DYI GKFG
Sbjct:  262 DYINGKFG  269
```

A related DNA sequence was identified in *S. pyogenes* <SEQ ID 2067> which encodes the amino acid sequence <SEQ ID 2068>. Analysis of this protein sequence reveals the following:

```
Possible site: 46
>>> Seems to have no N-terminal signal sequence

----- Final Results -----
            bacterial cytoplasm --- Certainty = 0.3590 (Affirmative) < succ>
            bacterial membrane  --- Certainty = 0.0000 (Not Clear)   < succ>
             bacterial outside  --- Certainty = 0.0000 (Not Clear)   < succ>
```

An alignment of the GAS and GBS proteins is shown below:

```
Identities = 208/252 (82%), Positives = 235/252 (92%)

Query:    1 MTQPILQVSDLSVYYNKKKALKEVSMDFYPNEITALIGPSGSGKSTLLRAINRMGDLNPE   60
            MT+PILQ+ DLSVYYN+KK LK+VS+D YPNEITALIGPSGSGKSTLLR+INRN DLNPE
Sbjct:    2 MTEPILQIRDLSVYYNQKKTLKDVSLDLYPNEITALIGPSGSGKSTLLRSINRMNDLNPE   61

Query:   61 VTLTGAVMYNGHNVYSPRTDTVELRKEIGMVFQQPNPFPHSVFENVVYGLRLKGIKDKAT  120
            VT+TG+++YNGHN+YSPRTDTV+LRKEIGMVFQQPNPFPMS++ENVVYGLRLKGI+DK+
Sbjct:   62 VTITGSIVYNGHNIYSPRTDTVDLRKEIGMVFQQPNPFPMSIYENVVYGLRLKGIRDKSI  121

Query:  121 LDEAVETSLKGASIWDEVKDRLHDSALGLSGGQQQRVCIARTLATKPKIILLDEPTSALD  180
            LD AVE+SLKGASIW+EVKDRLHDSA+GLSGGQQQRVCIAR LAT P+IILLDEPTSALD
Sbjct:  122 LDHAVESSLKGASIWNEVKDRLHDSAVGLSGGQQQRVCIARVLATSPRIILLDEPTSALD  181

Query:  181 PISAGKIEETLHGLKDQYTMLLVTRSMQQASRISDRTGFFLDGNLIEYGNTKEMFMNPKH  240
            PISAGKIEETL   LK  YT+  +VTRSMQQASR+SDRTGFFL+G+L+E G TK MFMNPK
Sbjct:  182 PISAGKIEETLLLLKKDYTLAIVTRSMQQASRLSDRTGFFLEGDLLECGPTKAMFMNPKR  241

Query:  241 KETEDYITGKFG  252
            KETEDYI+GKFG
Sbjct:  242 KETEDYISGKFG  253
```

Based on this analysis, it was predicted that these proteins and their epitopes could be useful antigens for, vaccines or diagnostics.

EXAMPLE 673

A DNA sequence (GBSx0713) was identified in *S. agalactiae* <SEQ ID 2069> which encodes the amino acid sequence <SEQ ID 2070>. Analysis of this protein sequence reveals the following:

```
Possible site: 21
>>> Seems to have no N-terminal signal sequence

----- Final Results -----
            bacterial cytoplasm --- Certainty = 0.1937 (Affirmative) < succ>
            bacterial membrane  --- Certainty = 0.0000 (Not Clear)   < succ>
             bacterial outside  --- Certainty = 0.0000 (Not Clear)   < succ>
```

The protein has homology with the following sequences in the GENPEPT database:

```
>GP: AAD22042 GB: AF118229 PhoU [Streptococcus pneumoniae]
Identities = 75/216 (34%), Positives = 126/216 (57%), Gaps = 1/216 (0%)

Query:    2 LRSKFDEELDKLHNQFYAMGIEAIGQIKKTVRAFVSHDRELAKEVIEDDVTLNNFETKLE    61
            +R++FD EL +L   F  +G  +    K + A  S D+E+A+ +I  D  +N  ++ +E
Sbjct:    1 MRNQFDLELHELEQSFLGLGQLVLETASKALLALASKDKEMAELIINKDHAINQGQSAIE    60

Query:   62 KKSLEIIALQQPVSQDLRTVITVLKATSDVERMGDHAAAVAKATIRMKGEERIPAVELEI   121
              ++ALQQP    DLR VI+++ + SD+ERMGDH A +AKA +++K E ++     E ++
Sbjct:   61 LTCARLLALQQPQVSDLRFVISIMSSCSDLERMGDHMAGIAKAVLQLK-ENQLAPDEEQL   119

Query:  122 NNMGKAVKNMLEEALTAYINGDDEKAYEVAAMDEIVDDYFRDIQKMVVETIQKHPDVAFA   181
              + MGK   +ML + L A+         KA  +A  DE +D Y+  + K ++   ++
Sbjct:  120 HQMGKLSLSMLADLLVAFPLHQASKAISIAQKDEQIDQYYYALSKEIIGLMKDQETSIPN   179

Query:  182 AKEYFQVLMHLERIGDYGKNICEWIVYLKTGKIIEL                          217
             +Y  ++ HLER  DY  NICE +VYL+TG++++L
Sbjct:  180 GTQYLYIIGHLERFADYIANICERLVYLETGELVDL                          215
```

A related DNA sequence was identified in *S. pyogenes* <SEQ ID 1677> which encodes the amino acid sequence <SEQ ID 1678>. Analysis of this protein sequence reveals the following:

```
Possible site: 21
>>> Seems to have no N-terminal signal sequence

----- Final Results -----
            bacterial cytoplasm --- Certainty = 0.2229 (Affirmative) < succ>
            bacterial membrane  --- Certainty = 0.0000 (Not Clear)   < succ>
             bacterial outside  --- Certainty = 0.0000 (Not Clear)   < succ>
```

An alignment of the GAS and GBS proteins is shown below:

```
Identities = 174/217 (80%), Positives = 194/217 (89%)

Query:    1 MLRSKFDEELDKLHNQFYAMGIEAIGQIKKTVRAFVSHDRELAKEVIEDDVTLNNFETKL    60
            MLR+KF+EELDKLHNQFY+MG+E + QI KTVRAFVSHDRELAKEVIE+D T+NNFETKL
Sbjct:    1 MLRTKFEEELDKLHNQFYSMGMEVLAQINKTVRAFVSHDRELAKEVIEEDDTINNFETKL    60

Query:   61 EKKSLEIIALQQPVSQDLRTVITVLKATSDVERMGDHAAAVAKATIRMKGEERIPAVELE   120
            EKKSLEIIALQQPVS DLR VITVLKA+SD+ERMGDHAA++AKATIRMKGEERIP VE +
Sbjct:   61 EKKSLEIIALQQPVSNDLRMVITVLKASSDIERMGDHAASIAKATIRMKGEERIPVVEEQ   120

Query:  121 INNMGKAVKNMLEEALTAYINGDDEKAYEVAAMDEIVDDYFRDIQKMVVETIQKHPDVAF   180
            IN MGKAVK M+EEAL AYIN DD KAYE+AA DEI+D YFR+IQ + VE I+K PD  F
Sbjct:  121 INLMGKAVKQMVEEALNAYINADDTKAYEIAASDEIIDQYFRNIQTLAVEEIRKSPDAVF   180
```

-continued

```
Query:  181 AAKEYFQVLMHLERIGDYGKNICEWIVYLKTGKIIEL                           217
             A KEYFQVLM+LERIGDY +NICEWIVYLKTGKIIEL
Sbjct:  181 AGKEYFQVLMYLERIGDYARNICEWIVYLKTGKIIEL                           217
```

Based on this analysis, it was predicted that these proteins and their epitopes could be useful antigens for vaccines or diagnostics.

EXAMPLE 674

A DNA sequence (GBSx0714) was identified in *S. agalactiae* <SEQ ID 2071> which encodes the amino acid sequence <SEQ ID 2072>. This protein is predicted to be aminopeptidase N. Analysis of this protein sequence reveals the following:

```
Possible site: 30
>>> Seems to have no N-terminal signal sequence

----- Final Results -----
             bacterial cytoplasm --- Certainty = 0.2845(Affirmative) < succ>
             bacterial membrane  --- Certainty = 0.0000(Not Clear)   < succ>
             bacterial outside   --- Certainty = 0.0000(Not Clear)   < succ>
```

The protein has homology with the following sequences in the GENPEPT database:

```
>GP:CAB50785 GB:AJ007700 aminopeptidase N [Streptococcus thermophilus]
Identities = 556/847 (65%), Positives = 673/847 (78%), Gaps = 4/847 (0%)

Query:    3 TVEHFVTKFVPENYNLFLDINRQTKTFSGNVAVSGEALDNNISFHQKGLTIKSVLLDNQP    62
            +V  F+  F+PENYNLFLDINR  KTF+GNVA++GEA+DN+IS HQK LTI SVLLDN+
Sbjct:    4 SVARFIESFIPENYNLFLDINRSEKTFTGNVAITGEAIDNHISLHQKDLTINSVLLDNES   63

Query:   63 LDFQLDEDNEAMHIQLHETGSMVLVFEFSGHITDNMTGMYPSYYTVNGIKKEVISTQFES  122
            L+FQ+D+ NEA HI+L ETG + + EFSG ITDNMTG+YPSYYT NG KKE+ISTQFES
Sbjct:   64 LNFQMDDANEAFHIELPETGVLTIFIEFSGRITDNMTGIYPSYYTYNGEKKEIISTQFES  123

Query:  123 HFAREVFPSIDEPEAKATFDLSLKFDQKEGEIALSNMPEINAEQRQETGLWTFDTTPKMS  182
            HFARE FP +DEPEAKATFDLSLKFD +EG+ ALSNMPEIN+  R+ETG+WTF+TTP+MS
Sbjct:  124 HFAREAFPCVDEPEAKATFDLSLKFDAEEGDTALSNMPEINSHLREETGVWTFETTPRMS  183

Query:  183 SYLLAFALGELHGKTTHTKNGTLVGSYATKAHQLNELDFSLDIVVRVIEFYEDYFGVRYP  242
            +YLLAF  G LHGKT  TKNGT VG +AT A   N +DF+LDI VRVIEFYEDYF V+YP
Sbjct:  184 TYLLAFGFGALHGKTAKTKNGTEVGFATVAQAENSVDFALDIAVRVIEFYEDYFQVKYP  243

Query:  243 IPQSLHVALPDFSAGAMENWGLVTYREVYLLVDENSSVSSRQQVALVVAHEIAHQWFGNL  302
            IP S H+ALPD SAGAMENWGLVTYREVYLLVDENSS +SRQQVALVVAHE+AHQWFGNL
Sbjct:  244 IPLSYHLALPDLSAGAMENWGLVTYREVYLLVDENSSAASRQQVALVVAHELAHQWFGNL  303

Query:  303 VTMKWWDDLWLNESFANMMEYVSIDYIEPKLNIFEDFQTG-GLPLALKRDATDGVQSVHV  361
            VTMKWWDDLWLNESFANMMEYVS++ IEP  NIFE F   G+P AL+RDATDGVQSVH+
Sbjct:  304 VTMKWWDDLWLNESFANMMEYVSVNAIEPSWNIFEGFPNKLGVPNALQRDATDGVQSVHM  363

Query:  362 EVNHPDEINTLFDPAIVYAKGSRLMHMLRRWLGDTDFAAGLKIYFEKHQYQNTIGRDLWN  421
            EVNHPDEINTLFD AIVYAKGSRLMHMLRRWLGD  FA GLK YFEKHQY NT+GRDLWN
Sbjct:  364 EVNHPDEINTLFDSAIVYAKGSRLMHMLRRWLGDEAFAKGLKAYFEKHQYNNTVGRDLWN  423

Query:  422 ALSQTSGKDVAAFMDSWLEQPGYPVMAAKIEEDELILTQKQFFIGEHDKSRLWQIPLNS  481
            ALS+ SGKDV++FMD+WLEQPGYPV++A++ +D LIL+QKQFFIGEHEDK RLW+IPLN+
Sbjct:  424 ALSEASGKDVSSFMDTWLEQPGYPVVSAEVVDDTLILSQKQFFIGEHEDKGRLWEIPLNT  483

Query:  482 NWEGIPEILTEETVVIPNFSQLAEKNKENGALRFNTENTAHYITNYQGQLLEHIISDLPL  541
            NW G+P+ L+EE + IPN+SQLA +N  NG LR NT NTAHYIT+YQGQLL+++I+ D
Sbjct:  484 NWNGLPDTLSEERIEIPNYSQLATEN--NGVLRLNTANTAHYITDYQGQLLDNILEDFAN  541

Query:  542 MDNISKLQIVQERHLLAESGMISYSSLIPLVSLLSQETSYLVNSAIKSVIDGLSLFVQED  601
            +D +SKLQI+QER LLAESG ISY+SL+ L+ L+ +E S+L++ A    ++ GL  F+ ED
Sbjct:  542 LDTVSKLQILQERRLLAESGRISYASLVGLLDLVEKEESFLISQAKSQILAGLKRFIDED  601

Query:  602 SQDEFDFKEFVNKLSAFNFNRLGFEKREGEGDDSEMVRHLSLSLALYSDNEHAIEEAHHI  661
            ++  E  +K V++    +F RLGF+  +EGE D+ EMVR  +LS  + +D +   A ++
Sbjct:  602 TEAEVHYKALVSRQFQNDFERLGFDAKEGESDEDEMVRQTALSYLIEADYQPTVLAAANV  661
```

-continued

```
Query:  662 FKAHENNIAAIPAAIRLLVLTNEMKHFESKELSHLLLETYSTTTDGNFKRQLASALSHTT  721
            F+AH+ NI +IPA+IR LVL N+MK   S  L    +  Y  T D NF+RQL  ALS+
Sbjct:  662 FQAHKENIESIPASIRGLVLINQMKQENSLSLVEEYINAYVATNDSNFRRQLTQALSYLK  721

Query:  722 DSKTLKKLLSDWKNKDIVKPQDLAMSWYATFLKNSFTQESVWEWAQENWEWIKATLGGDM  781
            + +  L   +L    K+K++VKPQDL + WY  FL  SF QE+VW+WA+ENWEWIKA LGGDM
Sbjct:  722 NQEGLDYVLGQLKDKNVVKPQDLYL-WYMNFLSKSFAQETVWDWAKENWEWIKAALGGDM  780

Query:  782 SFDKFVIYPSSSFKTEERLEQYKNFFEPQLSDMAISRNISMGIKEISARVLLITKQKEEV  841
            SFD FV  P+  FK +ERL+QY FFEPQ SD A+ RNI MGIK I+ARV LI K+K   V
Sbjct:  781 SFDSFVNIPAGIFKNQERLDQYIAFFEPQTSDKALERNILMGIKTIAARVDLIEKEKAAV  840

Query:  842 INTIKKY                                                       848
            +  +K Y
Sbjct:  841 ESALKDY                                                       847
```

15

A related DNA sequence was identified in *S. pyogenes* <SEQ ID 2073> which encodes the amino acid sequence <SEQ ID 2074>. Analysis of this protein sequence reveals the following:

```
Possible site: 50
>>> Seems to have no N-terminal signal sequence

----- Final Results -----
            bacterial cytoplasm --- Certainty = 0.1098(Affirmative) < succ>
            bacterial membrane  --- Certainty = 0.0000(Not Clear)   < succ>
             bacterial outside  --- Certainty = 0.0000(Not Clear)   < succ>
```

An alignment of the GAS and GBS proteins is shown below:

```
Identities = 576/848 (67%), Positives = 692/848 (80%), Gaps = 3/848 (0%)

Query:    1 MKTVEHFVTKFVPENYNLFLDINRQTKTFSGNVAVSGEALDNNISFHQKGLTIKSVLLDN   60
            MKTVEH +  FVPENYN+FLDINRQTKTF+GNVA++GEALDN+++FHQK L IKS+LLDN
Sbjct:   21 MKTVEHLIETFVPENYNIFLDINRQTKTFTGNVAINGEALDNHVAFHQKDLDIKSILLDN   80

Query:   61 QPLDFQLDEDNEAMHIQLHETGSMVLVFEFSGHITDNMTGMYPSYYTVNGIKKEVISTQF  120
            + + +Q+D DNE + ++L ETG M LV EFSG ITDNMTG+YPSYYT NG KKEVISTQF
Sbjct:   81 EAVIYQVDNDNEVVRVELPETGMMTLVIEFSGSITDNMTGIYPSYYTKNGEKKEVISTQF  140

Query:  121 ESHFAREVFPSIDEPEAKATFDLSLKFDQKEGEIALSNMPEINAEQRQETGLWTFDTTPK  180
            ESHFARE FP IDEP+AKATFDLSL FDQ+ GEIALSNMPE+N ++R+ETGLWTFDTT +
Sbjct:  141 ESHFAREAFPCIDEPQAKATFDLSLTFDQEIGEIALSNMPEVNIDRREETGLWTFDTTLR  200

Query:  181 MSSYLLAFALGELHGKTTHTKNGTLVGSYATKAHQLNELDFSLDIVVRVIEFYEDYFGVR  240
            MSSYLLAFALGELHGKT  +K  GT VG YAT AH L+  LDFSLDI VRVI FYEDYFGV
Sbjct:  201 MSSYLLAFALGELHGKTVESKKGTTVGVYATTAHPLSSLDFSLDIAVRVINFYEDYFGVH  260

Query:  241 YPIPQSLHVALPDFSAGAMENWGLVTYREVYLLVDENSSVSSRQQVALVVAHEIAHQWFG  300
            YPIPQSL++ALPDFS+GAMENWGL+TYRE+YLLVDENS+V SRQQVALV+AHEIAHQWFG
Sbjct:  261 YPIPQSLNIALPDFSSGAMENWGLITYREIYLLVDENSTVQSRQQVALVIAHEIAHQWFG  320

Query:  301 NLVTMKWWDDLWLNESFANMMEYVSIDYIEPKLNIFEDFQTGGLPLALKRDATDGVQSVH  360
            NLVTMKWWDDLWLNESFANMMEYVSI+ IEP    I EDFQTGG+PLALKRDATDGVQSVH
Sbjct:  321 NLVTMKWWDDLWLNESFANMMEYVSIEAIEPSWKIIEDFQTGGIPLALKRDATDGVQSVH  380

Query:  361 VEVNHPDEINTLFDPAIVYAKGSRLMHMLRRWLGDTDFAAGLKIYFEKHQYQNTIGRDLW  420
            VEVNHPDEINTLFDPAIVYAKGSRLMHMLRR++GD DFA GL  YFEK+QY+NT+GRDLW
Sbjct:  381 VEVNHPDEINTLFDPAIVYAKGSRLMHMLRRFIGDRDFAIGLHHYFEKYQYRNTVGRDLW  440

Query:  421 NALSQTSGKDVAAFMDSWLEQPGYPVMAAKIEEDELILTQKQFFIGEHEDKSRLWQIPLN  480
            N LS TSGKDVAAFMD+WLEQPGYPV+ A++E D+LIL+QKQFFIG+ E+K RLW IPLN
Sbjct:  441 NILSDTSGKDVAAFMDAWLEQPGYPVLTARLENDQLILSQKQFFIGKGEEKGRLWPIPLN  500

Query:  481 SNWEGIPEILTEETVVIPNFSQLAEKNKENGALRFNTENTAHYITNYQGQLLEHIISDLP  540
            +NW G+PE LTE +VIPNFSQLA +N+   GALRFN +NTAHYIT+YQG LL+ ++++L
Sbjct:  501 TNWHGLPETLTEAEMVIPNFSQLAAENE--GALRFNIDNTAHYITDYQGSLLDALVTELA  558

Query:  541 LMDNISKLQIVQERHLLAESGMISYSSLIPLVSLLSQETSYLVNSAIKSVIDGLSLFVQE  600
            +DN S LQ++QER LLA+SG+ISY+ L+ L++  SY+V  A++ V GL  F+ E
Sbjct:  559 QLDNTSALQVIQERRLLADSGLISYAELVDLIAQLDDSKSYMVAEAVQQVVSGLKRFIDE  618
```

-continued

```
Query:  601 DSQDEFDFKEFVNKLSAFNFNRLGFEKREGEGDDSEMVRHLSLSLALYSDNEHAIEEAHH  660
            S  E  F   V  +    +FN+ GFEK+  E D+ EMVR ++L      ++N+  I+
Sbjct:  619 GSLAEKSFNRLVTTIYQEDFNQHGFEKKADESDEDEMVRQVALGRLWLAENQTIIDGLRT  678

Query:  661 IFKAHENNIAAIPAAIRLLVLTNEMKHFESKELSHLLLETYSTTTDGNFKRQLASALSHT  720
            IF+A++NNIA+IPAA+R LVL N+MK+FE+  L  +  ETY  TTD N +  L  A S T
Sbjct:  679 IFEAYQNNIASIPAAVRRLVLANQMKYFETDSLVDIYFETYVATTDNNLRSDLTVAFSQT  738

Query:  721 TDSKTLKKLLSDWKNKDIVKPQDLAMSWYATFLKNSFTQESVWEWAQENWEWIKATLGGD  780
            T++++L   K+KDI+KPQDL+  WY    L  SFTQ+ +WEWA+ENW+WIK+ LGGD
Sbjct:  739 KQPTTIRRILVSLKDKDIIKPQDLSY-WYNALLGQSFTQDIIWEWARENWDWIKSALGGD  797

Query:  781 MSFDKFVIYPSSSFKTEERLEQYKNFFEPQLSDMAISRNISMGIKEISARVLLITKQKEE  840
            MSFDKFVIYP+S+FKT + L +YK+FFEP+L DMAISRNI+MGI EI ARV LITK+KE
Sbjct:  798 MSFDKFVIYPASNFKTPKHLAEYKSFFEPKLDDMAISRNITMGINEIEARVALITKEKEA  857

Query:  841 VINTIKKY                                                     848
            VI +  Y
Sbjct:  858 VIAALSHY                                                     865
```

Based on this analysis, it was predicted that these proteins and their epitopes could be useful antigens for vaccines or diagnostics.

EXAMPLE 675

A DNA sequence (GBSx0715) was identified in *S. agalactiae* <SEQ ID 2075> which encodes the amino acid sequence <SEQ ID 2076>. This protein is predicted to be response regulator (trcR). Analysis of this protein sequence reveals the following:

```
Possible site: 59
>>> Seems to have no N-terminal signal sequence

----- Final Results -----
            bacterial cytoplasm --- Certainty = 0.2741(Affirmative) < succ>
            bacterial membrane  --- Certainty = 0.0000(Not Clear)   < succ>
             bacterial outside  --- Certainty = 0.0000(Not Clear)   < succ>
```

The protein has homology with the following sequences in the GENPEPT database:

```
>GP:CAA54465 GB:X77249 response regulator [Streptococcus pneumoniae]
Identities = 198/224 (88%), Positives = 213/224 (94%)

Query:    1 MIKILLIEDDLSLSNSVFDFLDDFADVMQIFDGEEGLYEAESGVYDLILLDLMLPEKNGF    60
            MIKILL+EDDL LSNSVFDFLDDFADVMQ+FDGEEGLYEAESGVYDLILLDLMLPEKNGF
Sbjct:    1 MIKILLVEDDLGLSNSVFDFLDDFADVMQVFDGEEGLYEAESGVYDLILLDLMLPEKNGF    60

Query:   61 QVLKELREKGITTPVLIMTAKESIDDKGQGFDLGADDYLTKPFYLEELKMRIQALLKRSG   120
            QVLKELREKGITTPVLIMTAKES+DDKG  GF+LGADDYLTKPFYLEELKMRIQALLKRSG
Sbjct:   61 QVLKELREKGITTPVLIMTAKESLDDKGHGFELGADDYLTKPFYLEELKMRIQALLKRSG   120

Query:  121 KFNDNSLIYGDIRVDMSTNSTFVNQTEVELLGKEFDLLVYFLQNQNVILPKSQIFDRIWG   180
            KFN+N+L TYG+I V++STN+  V  T VELLGKEFDLLVYFLQNQNVILPK+QIFDR+WG
Sbjct:  121 KFNENTLTYGNIVVNLSTNTVKVEDTPVELLGKEFDLLVYFLQNQNVILPKTQIFDRLWG   180

Query:  181 FDSDTTISVVEVYVSKVRKKLKGTLFSENLQTLRSVGYILKHVE                  224
            FDSDTTISVVEVYVSKVRKKLKGT F+ENLQTLRSVGY+LK V+
Sbjct:  181 FDSDTTISVVEVYVSKVRKKLKGTTFAENLQTLRSVGYLLKDVQ                  224
```

A related DNA sequence was identified in *S. pyogenes* <SEQ ID 2077> which encodes the amino acid sequence <SEQ ID 2078>. Analysis of this protein sequence reveals the following:

```
Possible site: 59
>>> Seems to have no N-terminal signal sequence
```

```
----- Final Results -----
           bacterial cytoplasm --- Certainty = 0.2689(Affirmative) < succ>
            bacterial membrane --- Certainty = 0.0000(Not Clear)   < succ>
             bacterial outside --- Certainty = 0.0000(Not Clear)   < succ>
```

An alignment of the GAS and GBS proteins is shown below:

```
Identities = 180/224 (80%), Positives = 200/224 (88%)

Query:   1 MIKILLIEDDLSLSNSVFDFLDDFADVMQIFDGEEGLYEAESGVYDLILLDLMLPEKNGF    60
           MIKILL+EDDLSLSNS+FDFLDDFADVMQ+FDG+EGLYEAESG+YDLILLDLMLPEKNGF
Sbjct:   1 MIKILLVEDDLSLSNSIFDFLDDFADVMQVFDGDEGLYEAESGIYDLILLDLMLPEKNGF    60

Query:  61 QVLKELREKGITTPVLIMTAKESIDDKGQGFDLGADDYLTKPFYLEELKMRIQALLKRSG   120
           QVLKELREK I  PVLIMTAKE +DDKG GF+LGADDYLTKPFYLEELKMRIQALLKR+G
Sbjct:  61 QVLKELREKDIKIPVLIMTAKEGLDDKGHGFELGADDYLTKPFYLEELKMRIQALLKRTG   120

Query: 121 KFNDNSLIYGDIRVDMSTNSTFVNQTEVELLGKEFDLLVYFLQNQNVILPKSQIFDRIWG   180
           KF D ++ +G++ VD++    V     VELLGKEFDLLVY LQNQNVILPK+QIFDR+WG
Sbjct: 121 KFADKNISFGNLVVDLARKEVKVEGKVVELLGKEFDLLVYLLQNQNVILPKTQIFDRLWG   180

Query: 181 FDSDTTISVVEVYVSKVRKKLKGTLFSENLQTLRSVGYILKHVE                 224
           FDSDTTISVVEVY+SK+RKKLKGT F   LQTLRSVGYILK+ E
Sbjct: 181 FDSDTTISVVEVYISKIRKKLKGTCFVNRLQTLRSVGYILKNNE                 224
```

Based on this analysis, it was predicted that these proteins and their epitopes could be useful antigens for vaccines or diagnostics.

EXAMPLE 676

A DNA sequence (GBSx0716) was identified in *S. agalactiae* <SEQ ID 2079> which encodes the amino acid sequence <SEQ ID 2080>. This protein is predicted to be histidine kinase. Analysis of this protein sequence reveals the following:

```
Possible site: 34
>>> Seems to have no N-terminal signal sequence
   INTEGRAL    Likelihood = -9.18    Transmembrane       22-38  (17-46)
   INTEGRAL    Likelihood = -4.94    Transmembrane      182-198 (178-201)

----- Final Results -----
            bacterial membrane --- Certainty = 0.4673(Affirmative) < succ>
             bacterial outside --- Certainty = 0.0000(Not Clear)   < succ>
           bacterial cytoplasm --- Certainty = 0.0000(Not Clear)   < succ>
```

The protein has homology with the following sequences in the GENPEPT database:

```
>GP:CAA54466 GB:X77249 histidine kinase [Streptococcus pneumoniae]
Identities = 218/420 (51%), Positives = 305/420 (71%), Gaps = 4/420 (0%)

Query:  17 SHFIHFFTVFSGIFLVMTVIILQVMRYGVYSSVDSSLKYISTHPKNYINMVMSRTAAY--    74
           S+FI  F VF+ IF  MT+IILQVM  +Y+SVD  L  +S +P+  I + ++R
Sbjct:  15 SYFIRNFGVFTLIFSTMTLIILQVMHSSLYTSVDDKLHGLSENPQAVIQLAINRATEEIK    74

Query:  75 -LDNSNIASVKLKPGGQTVANTDIILFTSEEEVINYFDAFSNYQFLKPNKKNLGGISELT   133
            L+N+   + K++      +NT++ILF  +    + F    +K  KK LG I ++
Sbjct:  75 DLENARADASKVEIKPNVSSNTEVILFDKDFTQLLSGNRFLGLDKIKLEKKELGHIYQIQ   134

Query: 134 LTNIFGQDETYHAVTVKVN-NPAYPNVTYMTAIVNIDQLVNAKERYEKIIIFVMTTFWII   192
           + N +GQ+E Y + ++ N +    N+ Y   ++N  QL  A +++E++I+ VM +FWI+
Sbjct: 135 VFNSYGQEEIYRVILMETNISSVSTNIKYAAVLINTSQLEQASQKHEQLIVVMASFWIL   194

Query: 193 SIGASIYLAKWAQKPIIENYERQKAFVENASHELRTPLAVLQNRLETLFRKPNATILENS   252
           S+  AS+YLA+   +P++E+  +Q++FVENASHELRTPLAVLQNRLETLFRKP ATI++  S
Sbjct: 195 SLLASLYLARVSVRPLLESMQKQQSFVENASHELRTPLAVLQNRLETLFRKPEATIMDVS   254
```

-continued

```
Query:  253 ENIASSLDEVRNMRILTTNLLNLARRDDGIKPELAVIKPTLFDSIFENYDLITQENGKNF  312
            E+IASSL+EVRNMR LTT+LLNLARRDDGIKPELA +  + F++ F NY++I  EN + F
Sbjct:  255 ESIASSLEEVRNMRFLTTSLLNLARRDDGIKPELAEVPTSFFNTTFTNYEMIASENNRVF  314

Query:  313 TGHNMIQDSFKTDKTLLKQLMTILFDNAIKYTDNDGSIDFTISETDKYLFLEIADNGPGI  372
             N I  +  TD+ LLKQLMTILFDNA+KYT+ DG IDF IS TD+ L+L ++DNG GI
Sbjct:  315 RFENRIHRTIVTDQLLLKQLMTILFDNAVKYTEEDGEIDFLISATDRNLYLLVSDNGIGI  374

Query:  373 SEEDKVRIFDRFYRVDKARTRQQGGFGLGLSLAQQIVNSLRGNITVIDNKPRGSIFKIKL  432
            S EDK +IFDRFYRVDKARTRQ+GGFGLGLSLA+QIV++L+G +TV DNKP+G+IF++K+
Sbjct:  375 STEDKKKIFDRFYRVDKARTRQKGGFGLGLSLAKQIVDALKGTVTVKDNKPKGTIFEVKI  434
```

A related DNA sequence was identified in *S. pyogenes* <SEQ ID 2081> which encodes the amino acid sequence <SEQ ID 2082>. Analysis of this protein sequence reveals the following:

```
Possible site: 57
>>> Seems to have an uncleavable N-term signal seq
     INTEGRAL    Likelihood = -11.09    Transmembrane    19-35 (14-44)
     INTEGRAL    Likelihood = -10.24    Transmembrane   185-201 (182-206)

----- Final Results -----
              bacterial membrane --- Certainty = 0.5437(Affirmative) < succ>
                bacterial outside --- Certainty = 0.0000(Not Clear)   < succ>
             bacterial cytoplasm --- Certainty = 0.0000(Not Clear)   < succ>
```

The protein has homology with the following sequences in the databases:

```
>GP: CAA54466 GB: X77249 histidine kinase [Streptococcus pneumoniae]
Identities = 223/436 (51%), Positives = 313/436 (71%),
Gaps = 5/436 (1%)

Query:    2 NKLKKEILSDNYNHFFHFFAVFTGIFVIMTIIILQIMRFGVYSSVDSSLVSVSNNASSYA   61
            +KLKK  +D++++F   F VFT IF  MT+IILQ+M   +Y+SVD L  +S N  +
Sbjct:    3 SKLKKTWYADDFSYFIRNFGVPTLIFSTMTLIILQVMHSSLYTSVDDKLHGLSENPQAVI   62

Query:   62 NRTMARISSFYFDTENNIIKALPDSDSSKLLGTPAANTDIILFSANGTILNAFDAFSNYQ  121
             + R +     D EN   A D+ ++  ++NT++ILF + T L + + F
Sbjct:   63 QLAINRATEEIKDLEN----ARADASKVEIKPNVSSNTEVILFDKDFTQLLSGNRFLGLD  118

Query:  122 NFHLDKRRLGSIETTSLMNFYGQEEKYHTITVGVHIKNYPA-VAYMMAVVNVEQLDRANE  180
             L+K+ LG I   + N YGQEE Y I+  +I +   + Y  ++N  QL++A++
Sbjct:  119 KIKLEKKELGHIYQIQVFNSYGQEEIYRVILMETNISSVSTNIKYAAVLINTSQLEQASQ  178

Query:  181 RYERIIIIVMSVFWLISILASIYLAKWSRKPILESYEKQKMFVENASHELRTPLAVLQNR  240
            ++E++I++VM+ FW++S+LAS+YLA+ S +P+LES +KQ+ FVENASHELRTPLAVLQNR
Sbjct:  179 KHEQLIVVVMASFWILSLLASLYLARVSVRPLLESMQKQQSFVENASHELRTPLAVLQNR  238

Query:  241 LESLFRKPNETILENSEHLASSLDEVRNMRILTTNLLNLARRDDGINPQWTHLDTDFFNA  300
            LE+LFRKP  TI++ SE +ASSL+EVRNMR LTT+LLNLARRDDGI P+  + T FFN
Sbjct:  239 LETLFRKPEATIMDVSESIASSLEEVRNMRFLTTSLLNLARRDDGIKPELAEVPTSFFNT  298

Query:  301 IFENYELVAKEYGKIFYFQNQVNRSLRMDKALLKQLITILFDNAIKYTDKNGIIEIIVKT  360
             F NYE++A  E   ++F F+N+++R++  D+ LLKQL+TILFDNA+KYT+++G I+ ++
Sbjct:  299 TFTNYEMIASENNRVFRFENRIHRTIVTDQLLLKQLMTILFDNAVKYTEEDGEIDFLISA  358

Query:  361 TDKNLLISVIDNGPGITDEEKKKIFDRFYRVDKARTRQTGGFGLGLALAQQIVMSLKGNI  420
            TD+NL + V DNG GI+ E+KKKIFDRFYRVDKARTRQ GGFGLGL+LA+QIV +LKG +
Sbjct:  359 TDRNLYLLVSDNGIGISTEDKKKIFDRFYRVDKARTRQKGGFGLGLSLAKQIVDALKGTV  418

Query:  421 TVKDNDPKGSIFEVKL                                              436
            TVKDN PKG+IFEVK+
Sbjct:  419 TVKDNKPKGTIFEVKI                                              434
```

An alignment of the GAS and GBS proteins is shown below:

```
Identities = 265/436 (60%), Positives = 334/436 (75%),
Gaps = 10/436 (2%)
```

```
                                -continued
Query:    7 ISKFKKNV-SDS--HFIHFFTVFSGIFLVMTVIILQVMRYGVYSSVDSSLKYISTHPKNY    63
            ++K KK + SD+  HF HFF VF+GIF++MT+IILQ+MR+GVYSSVDSSL +S +  +Y
Sbjct:    1 MNKLKKEILSDNYNHFFHFFAVFTGIFVIMTIIILQIMRFGVYSSVDSSLVSVSNNASSY    60

Query:   64 INMVMSRTAAYLDNSNIASVKLKPG-------GQTVANTDIILFTSEEEVINYFDAFSNY   116
            N  M+R +++ ++    +K P        G   ANTDIILF++    ++N FDAFSNY
Sbjct:   61 ANRTMARISSFYFDTENNIIKALPDSDSSKLLGTPAANTDIILFSANGTILNAFDAFSNY   120

Query:  117 QFLKPNKKNLGGISELTLTNIFGQDETYHAVTVKVNNPAYPNVTYMTAIVNIDQLVNAKE   176
            Q    +K+ LG I    +L N +GQ+E YH +TV V+    YP V YM A+VN++QL  A E
Sbjct:  121 QNFHLDKRRLGSIETTSLMNFYGQEEKYHTITVGVHIKNYPAVAYMMAVVNVEQLDRANE   180

Query:  177 RYERIIIFVMTTFWIISIGASIYLAKWAQKPIIENYERQKAFVENASHELRTPLAVLQNR   236
            RYE+III  VM+  FW+ISI ASIYLAKW++KPI+E+YE+QK FVENASHELRTPLAVLQNR
Sbjct:  181 RYERIIIIVMSVFWLISILASIYLAKWSRKPILESYEKQKMFVENASHELRTPLAVLQNR   240

Query:  237 LETLFRKPNATILENSENIASSLDEVRNMRILTTNLLNLARRDDGIKPELAVIKPTLFDS   296
            LE+LFRKPN TILENSE++ASSLDEVRNMRILTTNLLNLARRDDGI P+   +   F++
Sbjct:  241 LESLFRKPNETILENSEHLASSLDEVRNMRILTTNLLNLARRDDGINPQWTHLDTDFFNA   300

Query:  297 IFENYDLITQENGKNFTGHNMIQDSFKTDKTLLKQLMTILFDNAIKYTDNDGSIDFTISE   356
            IFENY+L+  +E GK F     N +   S + DK LLKQL+TILFDNAIKYTD +G I+ +
Sbjct:  301 IFENYELVAKEYGKIFYFQNQVNRSLRMDKALLKQLITILFDNAIKYTDKNGIIEIIVKT   360

Query:  357 TDKYLFLEIADNGPGISEEDKVRIFDRFYRVDKARTRQQGGFGLGLSLAQQIVNSLRGNI   416
            TDK L + + DNGPGI++E+K +IFDRFYRVDKARTRQ GGFGLGL+LAQQIV SL+GNI
Sbjct:  361 TDKNLLISVIDNGPGITDEEKKKIFDRFYRVDKARTRQTGGFGLGLALAQQIVMSLKGNI   420

Query:  417 TVIDNKPRGSIFKIKL                                              432
            TV DN P+GSIF++KL
Sbjct:  421 TVKDNDPKGSIFEVKL                                              436
```

SEQ ID 2080 (GBS339d) was expressed in *E. coli* as a GST-fusion product. SDS-PAGE analysis of total cell extract is shown in FIG. 146 (lane 9; MW 73 kDa). It was also expressed in *E. coli* as a His-fusion product. SDS-PAGE analysis of total cell extract is shown in FIG. 185 (lane 5; MW 73 kDa).

Based on this analysis, it was predicted that these proteins and their epitopes could be useful antigens for vaccines or diagnostics.

EXAMPLE 677

A DNA sequence (GBSx0717) was identified in *S. agalactiae* <SEQ ID 2083> which encodes the amino acid sequence <SEQ ID 2084>. Analysis of this protein sequence reveals the following:

```
Possible site: 39
>>> Seems to have no N-terminal signal sequence

----- Final Results -----
             bacterial cytoplasm --- Certainty = 0.1783(Affirmative) < succ>
             bacterial membrane  --- Certainty = 0.0000(Not Clear)   < succ>
              bacterial outside  --- Certainty = 0.0000(Not Clear)   < succ>
```

A related GBS nucleic acid sequence <SEQ ID 9813> which encodes amino acid sequence <SEQ ID 9814> was also identified.

The protein has homology with the following sequences in the GENPEPT database:

```
>GP: AAB48049 GB: U88582 YlxM [Streptococcus mutans]

Identities = 95/110 (86%), Positives = 103/110 (93%)

Query:   1 MEIEKTNRMNALFEFYAALLTDKQMNYIELYYADDYSLAEIAEESGVSRQAVYDNIKRTE   60
           MEIEKTNRMNALFEFYAALLTDKQMNYIELYYADDYSLAEIAEE  VSRQAVYDNIKRTE
Sbjct:   1 MEIEKTNRMNALFEFYAALLTDKQMNYIELYYADDYSLAEIAEEFDVSRQAVYDNIKRTE   60
```

```
Query:  61 KILEAYEMKLHMYSDYIVRSQIFDDILEKYTDDAFLQEKISILSSIDNRD           110
           KILE YEMKLHMYSDY+VRS+IFD I++KY +D +LQ KISIL++IDNRD
Sbjct:  61 KILEDYEMKLHMYSDYVVRSEIFDAIMKKYPNDPYLQNKISILTTIDNRD           110
```

A related DNA sequence was identified in *S. pyogenes* <SEQ ID 2085> which encodes the amino acid sequence <SEQ ID 2086>. Analysis of this protein sequence reveals the following:

```
Possible site: 54
>>> Seems to have no N-terminal signal sequence

----- Final Results -----
            bacterial cytoplasm --- Certainty = 0.1767(Affirmative) < succ>
            bacterial membrane  --- Certainty = 0.0000(Not Clear)   < succ>
             bacterial outside  --- Certainty = 0.0000(Not Clear)   < succ>
```

An alignment of the GAS and GBS proteins is shown below:

```
Identities = 95/110 (86%), Positives = 103/110 (93%)

Query:   1 MEIEKTNRMNALFEFYAALLTDKQMNYIELYYADDYSLAEIAEESGVSRQAVYDNIKRTE   60
           MEIEKTNRMNALFEFYAALLTDKQMNYIELYYADDYSLAEIA+E GVSRQAVYDNIKRTE
Sbjct:   4 MEIEKTNRMNALFEFYAALLTDKQMNYIELYYADDYSLAEIADEFGVSRQAVYDNIKRTE   63

Query:  61 KILEAYEMKLHMYSDYIVRSQIFDDILEKYTDDAFLQEKISILSSIDNRD           110
           KILE YEMKLHMYSDY+VRS+IFDD++   Y  D +LQEKISIL+SIDNR+
Sbjct:  64 KILETYEMKLHMYSDYVVRSEIFDDMIAHYPHDEYLQEKISILTSIDNRE           113
```

Based on this analysis, it was predicted that these proteins and their epitopes could be useful antigens for vaccines or diagnostics.

EXAMPLE 678

A DNA sequence (GBSx0719) was identified in *S. agalactiae* <SEQ ID 2087> which encodes the amino acid sequence <SEQ ID 2088>. This protein is predicted to be signal recognition particle protein (ffh). Analysis of this protein sequence reveals the following:

```
Possible site: 51
>>> Seems to have no N-terminal signal sequence
    INTEGRAL    Likelihood = -0.22    Transmembrane    37-53 (37-53)

----- Final Results -----
            bacterial membrane  --- Certainty = 0.1086(Affirmative) < succ>
             bacterial outside  --- Certainty = 0.0000(Not Clear)   < succ>
            bacterial cytoplasm --- Certainty = 0.0000(Not Clear)   < succ>
```

The protein has homology with the following sequences in the GENPEPT database:

```
>GP: AAB48050 GB: U88582 Ffh [Streptococcus mutans]
Identities = 437/522 (83%), Positives = 484/522 (92%), Gaps = 7/522 (1%)

Query:   1 MAFESLTERLQGVFKNIRGKKKLSEKDVQEVTKEIRLALLEADVALPVVKTFIKHVRERA   60
           MAFESLTERLQGVFKN+RGK+KLSEKDVQEVTKEIRLALLEADVALPVVK FIK VR+RA
Sbjct:   1 MAFESLTERLQGVFKNLRGKRKLSEKDVQEVTKEIRLALLEADVALPVVKEFIKRVRKRA   60

Query:  61 VGHEIIDTLDPTQQIVKIVNEELTDLLGAETSEIEKSPKIPTIIMMVGLQGAGKTTFAGK  120
           VGHE+IDTLDP+QQI+KIVNEELT +LG ET+EIEKS KIPTIIMMVGLQGAGKTTFAGK
Sbjct:  61 VGHEVIDTLDPSQQIIKIVNEELTAVLGSETAEIEKSSKIPTIIMMVGLQGAGKTTFAGK  120

Query: 121 LANKLIKEDNARPMMIAADIYRPAAIDQLKTLGSQINVPVFDMGTNHSAVEIVTKGLEQA  180
           LANKL+KE+NARP+MIAADIYRPAAIDQLK LG QINVPVFDMGT HSAVEIV++GL QA
Sbjct: 121 LANKLVKEENARPLMIAADIYRPAAIDQLKILGQQINVPVFDMGTEHSAVEIVSQGLAQA  180
```

-continued

```
Query:  181 RENRNDYVLIDTAGRLQIDATLMQELHDVKAIAQPNEILLVVDSMIGQEAANVAEEFNRQ  240
            +ENRNDYVLIDTAGRLQID  LM EL D+KA+A PNEILLVVDSMIGQEAANVA EFN+Q
Sbjct:  181 KENRNDYVLIDTAGRLQIDEKLMTELRDIKALANPNEILLVVDSMIGQEAANVAREFNQQ  240

Query:  241 LSISGVVLTKIDGDTRGGAALSVREITGKPIKFTGTGEKITDIETFHPDRMASRILGMGD  300
            L ++GV+LTKIDGDTRGGAALSVR+ITGKPIKFTGTGEKITDIETFHPDRM+SRILGMGD
Sbjct:  241 LEVTGVILTKIDGDTRGGAALSVRQITGKPIKFTGTGEKITDIETFHPDRMSSRILGMGD  300

Query:  301 LLTLIERASQEYDEKRSMELAEKMRENTFDFNDFIDQLDQVQNMGPMEDLLKMLPGMANN  360
            LLTLIE+ASQ+YDE++S ELAEKMREN+FDFNDFI+QLDQVQNMG MED+LKM+PGMANN
Sbjct:  301 LLTLIEKASQDYDEQKSAELAEKMRENSFDFNDFIEQLDQVQNMGSMEDILKMIPGMANN  360

Query:  361 PAMKNFKVDENEIARKRAIVSSMTPEERENPDLLNPSRRRRIAAGSGNTFVDVNKFIKDF  420
            PA+ N +VDE EIARKRAIVSSMTPEERENPDLL PSRRRRIA+GSGNTFV+VNKFIKDF
Sbjct:  361 PALANVEVDEGEIARKRAIVSSMTPEERENPDLLTPSRRRRIASGSGNTFVNVNKFIKDF  420

Query:  421 NQAKQMMQGVMSGDMNKMMKKMGIDPNNLPKDMPGMDGMDMSNLEGMMGQNGMPDLSSL-  479
            NQAK+MMQGVMSGDMNK+MK+MGI+PNN+P    + MD S LEGMMGQ GMPD+S L
Sbjct:  421 NQAKKMMQGVMSGDMNKVMKQMGINPNNMP------NNMDSSALEGMMGQGGMPDMSGLS  474

Query:  480 GGDMDFSQMFGGGLKGKVGAFAAKQSMKRMANKMKKAKKKRK                   521
            G +MD SQMFGGGLKGKVG FA KQSMK+MA +MKKAKK++K
Sbjct:  475 GANMDVSQMFGGGLKGKVGEFAMKQSMKKMAKRMKKAKKRKK                   516
```

A related DNA sequence was identified in *S. pyogenes* <SEQ ID 2089> which encodes the amino acid sequence <SEQ ID 2090>. Analysis of this protein sequence reveals the following:

```
Possible site: 53
>>> Seems to have no N-terminal signal sequence
    INTEGRAL     Likelihood = -0.22    Transmembrane    39-55 (39-55)

----- Final Results -----
              bacterial membrane --- Certainty = 0.1086(Affirmative) < succ>
              bacterial outside  --- Certainty = 0.0000(Not Clear)   < succ>
              bacterial cytoplasm --- Certainty = 0.0000(Not Clear)  < succ>
```

An alignment of the GAS and GBS proteins is shown below:

```
Identities = 458/522 (87%), Positives = 489/522 (92%), Gaps = 4/522 (0%)

Query:    1 MAFESLTERLQGVFKNIRGKKKLSEKDVQEVTKEIRLALLEADVALPVVKTFIKHVRERA   60
            MAFESLT+RLQ VFK+IRGKKKLSE DVQEVTKEIRLALLEADVALPVVKTFIK VRERA
Sbjct:    3 MAFESLTQRLQDVFKHIRGKKKLSESDVQEVTKEIRLALLEADVALPVVKTFIKRVRERA   62

Query:   61 VGHEIIDTLDPTQQIVKIVNEELTDLLGAETSEIEKSPKIPTIIMMVGLQGAGKTTFAGK  120
            +GHEIIDTLDPTQQI+KIVNEELT +LG+ET+EI+KSPKIPTIIMMVGLQGAGKTTFAGK
Sbjct:   63 IGHEIIDTLDPTQQILKIVNEELTSILGSETAEIDKSPKIPTIIMMVGLQGAGKTTFAGK  122

Query:  121 LANKLIKEDNARPMMIAADIYRPAAIDQLKTLGSQINVPVFDMGTNHSAVEIVTKGLEQA  180
            LANKLIKE+NARP+MIAADIYRPAAIDQLKTLG QINVPVFDMGT+HSAV+IV KGLEQA
Sbjct:  123 LANKLIKEENARPLMIAADIYRPAAIDQLKTLGQQINVPVFDMGTDHSAVDIVRKGLEQA  182

Query:  181 RENRNDYVLIDTAGRLQIDATLMQELHDVKAIAQPNEILLVVDSMIGQEAANVAEEFNRQ  240
            REN NDYVLIDTAGRLQID  LM EL DVKA+AQPNEILLVVDSMIGQEAANVA EFN Q
Sbjct:  183 RENHNDYVLIDTAGRLQIDEKLMGELRDVKALAQPNEILLVVDSMIGQEAANVAYEFNHQ  242

Query:  241 LSISGVVLTKIDGDTRGGAALSVREITGKPIKFTGTGEKITDIETFHPDRMASRILGMGD  300
            LSI+GVVLTKIDGDTRGGAALSVREITGKPIKFTG GEKITDIETFHPDRM+SRILGMGD
Sbjct:  243 LSITGVVLTKIDGDTRGGAALSVREITGKPIKFTGIGEKITDIETFHPDRMSSRILGMGD  302

Query:  301 LLTLIERASQEYDEKRSMELAEKMRENTFDFNDFIDQLDQVQNMGPMEDLLKMLPGMANN  360
            LLTLIE+ASQEYDEK+S+ELAEKMRENTFDFNDFI+QLDQVQNMGPMEDLLKM+PGMA N
Sbjct:  303 LLTLIEKASQEYDEKKSLELAEKMRENTFDFNDFIEQLDQVQNMGPMEDLLKMIPGMAGN  362

Query:  361 PAMKNFKVDENEIARKRAIVSSMTPEERENPDLLNPSRRRRIAAGSGNTFVDVNKFIKDF  420
            PA+ N KVDEN+IARKRAIVSSMTP ERENPDLLNPSRRRRIAAGSGN+FVD NKFIKDF
Sbjct:  363 PALANIKVDENQIARKRAIVSSMTPAERENPDLLNPSRRRRIAAGSGNSFVD-NKFIKDF  421

Query:  421 NQAKQMMQGVMSGDMNKMMKKMGIDPNNLPKDMPGMDGM-DMSNLEGMMGQNGMPDLSSL  479
            NQAK MMQGVMSGDM+KMMK MGI+PNNLPK+MP   GM DMS+LEGMMGQ GMPDLS L
Sbjct:  422 NQAKSMMQGVMSGDMSKMMKDMGINPNNLPKNMPA--GMPDMSSLEGMMGQGGMPDLSGL  479
```

-continued

```
Query:  480  GGDMDFSQMFGGGLKGKVGAFAAKQSMKRMANKMKKAKKKRK         521
             GGDMD SQ+FG G KGK+G FA KQ+MKR ANK+KKAKKKRK
Sbjct:  480  GGDMDMSQLFGKGFKGKIGQFAMKQAMKRQANKLKKAKKKRK         521
```

Based on this analysis, it was predicted that these proteins and their epitopes could be useful antigens for vaccines or diagnostics.

EXAMPLE 679

A DNA sequence (GBSx0721) was identified in *S. agalactiae* <SEQ ID 2091> which encodes the amino acid sequence <SEQ ID 2092>. This protein is predicted to be SatD. Analysis of this protein sequence reveals the following:

```
Possible site: 49
>>> Seems to have an uncleavable N-term signal seq
     INTEGRAL     Likelihood = -1.28      Transmembrane    3-19 (2-19)

----- Final Results -----
            bacterial membrane  --- Certainty = 0.1510(Affirmative) < succ>
             bacterial outside  --- Certainty = 0.0000(Not Clear)   < succ>
           bacterial cytoplasm  --- Certainty = 0.0000(Not Clear)   < succ>
```

A related GBS nucleic acid sequence <SEQ ID 9811> which encodes amino acid sequence <SEQ ID 9812> was also identified.

The protein has homology with the following sequences in the GENPEPT database:

```
>GP:AAG28336 GB:U88582 SatD [Streptococcus mutans]
Identities = 106/222 (47%), Positives = 162/222 (72%), Gaps = 2/222 (0%)

Query:   13  MYLALIGDIINSKQILERETFQQSFQQLMTELSDVYGEELISPFTITAGDEFQALLKPSK    72
             +Y+A+IGD+I+SK  I  R    Q+  + L+ +++   Y E L S  FTIT GDEFQALL P+
Sbjct:    2  IYIAIIGDLISSKAITNRPKSQKQLKNLLNQINKKYKELLKSAFTITTGDEFQALLVPNP    61

Query:   73  KVFQIIDHIQLALKPVNVRFGLGTGNIITSINSNESIGADGPAYWHARSAINHIHDKNDY   132
             ++FQIID I L  KP  +RFG+G+G+I+T IN  +SIG+DGPAYWHAR+AI++IHDKNDY
Sbjct:   62  QIFQIIDEIALGFKPYQIRFGVGSGSILTEINPEQSIGSDGPAYWHARAAIDYIHDKNDY   121

Query:  133  GTVQVAICLDDEDQNLELTLNSLISAGDFIKSKWTTNHFQMLEHLILQDNYQEQFQHQKL   192
             G+  +A+ L+D + +  +N++++A +FIKSKWT      +++++ L+    Y+E+F H+K+
Sbjct:  122  GSNHLAVDLEDTETSQQ--INAILAACEFIKSKWTVTQYEVIDGLLQAGIYEEKFSHKKM   179

Query:  193  AQLENIEPSALTKRLKASGLKIYLRTRTQAADLLVKSCTQTK                   234
             A+  ++ PS+  KRLK+SGLKIYLR  +  A    LL+ +  + K
Sbjct:  180  AEKLDLSPSSFNKRLKSSGLKIYLRNKKVATTLLLNAIRKEK                   221
```

A related DNA sequence was identified in *S. pyogenes* <SEQ ID 2093> which encodes the amino acid sequence <SEQ ID 2094>. Analysis of this protein sequence reveals the following:

```
Possible site: 38
>>> Seems to have no N-terminal signal sequence

----- Final Results -----
           bacterial cytoplasm  --- Certainty = 0.3744(Affirmative) < succ>
            bacterial membrane  --- Certainty = 0.0000(Not Clear)   < succ>
             bacterial outside  --- Certainty = 0.0000(Not Clear)   < succ>
```

An alignment of the GAS and GBS proteins is shown below:

```
Identities = 94/213 (44%), Positives = 137/213 (64%), Gaps = 3/213 (1%)

Query:   14 YLALIGDIINSKQILERETFQQSFQQLMTELSDVYGEELISPFTITAGDEFQALLKPSKK   73
            Y+ALIGDII SKQ+ +R   Q++    + +L+ +    +IS  ++T GDEFQ L +
Sbjct:    3 YIALIGDIIQSKQLTDRSKVQKTLAAYLDDLNKTFAPYIISKLSLTLGDEFQGLFQVDTP   62

Query:   74 VFQIIDHIQLALKPVNVRFGLGTGNIITSINSNESIGADGPAYWHARSAINHIHDKNDYG  133
            +F +ID I  +  + +RFG+G G+I+T IN + SIGADGPAYWHAR AI +IH KNDYG
Sbjct:   63 IFHLIDLINHHMD-IPIRFGVGVGSILTDINPDISIGADGPAYWHAREAIRYIHQKNDYG  121

Query:  134 TVQVAICLDDEDQNLELTLNSLISAGDFIKSKWTTNHFQMLEHLILQDNYQEQFQHQKLA  193
                +A  L     N +  LNSL++AGD IK+ W  + +++ + L+     Y+E F   Q+L
Sbjct:  122 NTTLA--LRTGHHNQDDVLNSLLAAGDAIKANWRASQWEIFDTLLDLGIYEEYFDQQRLG  179

Query:  194 QLENIEPSALTKRLKASGLKIYLRTRTQAADLL                            226
            +  ++   SAL+KRLK+S +KIYLRTR  A + L
Sbjct:  180 KQLSLSSSALSKRLKSSHVKIYLRTRQSALNCL                            212
```

A related GBS gene <SEQ ID 8637> and protein <SEQ ID 8638> were also identified. Analysis of this protein sequence reveals the following:

```
Lipop: Possible site: -1 Crend: 7
McG: Discrim Score: 4.96
GvH: Signal Score (-7.5): -5.46
     Possible site: 49
>>> Seems to have an uncleavable N-term signal seq
ALOM program count: 1 value: -1.28 threshold: 0.0
     INTEGRAL         Likelihood = -1.28      Transmembrane      3-19 (1-19)
     PERIPHERAL       Likelihood = 5.99       74
modified ALOM score: 0.76
*** Reasoning Step: 3

----- Final Results -----
            bacterial membrane --- Certainty = 0.1510(Affirmative) < succ>
            bacterial outside  --- Certainty = 0.0000(Not Clear)   < succ>
            bacterial cytoplasm --- Certainty = 0.0000(Not Clear)  < succ>
```

Figure 68:
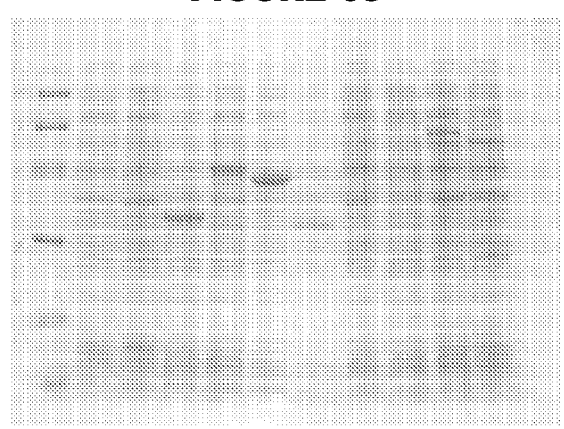

SEQ ID 8638 (GBS338) was expressed in *E. coli* as a His-fusion product. SDS-PAGE analysis of total cell extract is shown in FIG. 62 (lane 5; MW 30 kDa). It was also expressed in *E. coli* as a GST-fusion product. SDS-PAGE analysis of total cell extract is shown in FIG. 68 (lane 11; MW 55 kDa).

GBS338-GST was purified as shown in FIG. 215, lane 3.

Based on this analysis, it was predicted that these proteins and their epitopes could be useful antigens for vaccines or diagnostics.

EXAMPLE 680

A DNA sequence (GBSx0722) was identified in *S. agalactiae* <SEQ ID 2095> which encodes the amino acid sequence <SEQ ID 2096>. Analysis of this protein sequence reveals the following:

```
Possible site: 14
>>> Seems to have no N-terminal signal sequence

----- Final Results -----
            bacterial cytoplasm --- Certainty = 0.6082 (Affirmative) < succ>
            bacterial membrane  --- Certainty = 0.0000 (Not Clear)   < succ>
            bacterial outside   --- Certainty = 0.0000 (Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 681

A DNA sequence (GBSx0723) was identified in *S. agalactiae* <SEQ ID 2097> which encodes the amino acid sequence <SEQ ID 2098>. Analysis of this protein sequence reveals the following:

```
Possible site: 30
>>> Seems to have a cleavable N-term signal seq.
    INTEGRAL    Likelihood = -9.87    Transmembrane   126-142 (124-154)
    INTEGRAL    Likelihood = -8.23    Transmembrane    45-61 (41-66)
    INTEGRAL    Likelihood = -5.10    Transmembrane   241-257 (236-257)
    INTEGRAL    Likelihood = -4.04    Transmembrane   199-215 (198-218)
    INTEGRAL    Likelihood = -0.22    Transmembrane    96-112 (96-112)

----- Final Results -----
              bacterial membrane --- Certainty = 0.4949 (Affirmative) < succ>
               bacterial outside --- Certainty = 0.0000 (Not Clear)  < succ>
             bacterial cytoplasm --- Certainty = 0.0000 (Not Clear)  < succ>
```

The protein has homology with the following sequences in the GENPEPT database:

```
>GP:AAG28337 GB:U88582 SatE [Streptococcus mutans]
Identities = 54/103 (52%), Positives = 70/103 (67%), Gaps = 2/103 (1%)

Query:   1  MISDFLRDNPILTLLFCAHFLADFQWQSQSLADSKSHSWRGLWRHLLIVFLPLAALMILI    60
            +IS FL  NP+LTLL  AHFLADFQWQSQ +AD KS +W  L RHL+IV LPL  L ++I
Sbjct:   6  VISQFLSGNPVLTLLLIAHFLADFQWQSQKMADLKSSNWTYLIRHLIIVALPLILLSVVI   65

Query:  61  PETTLLNLSIWGSHIVIDSIKKLSYPWVEEGHF--QKAAFIID                   101
            P + L+    I+ SH++IDS K L   + ++   F    KA F+ID
Sbjct:  66  PHSFLVLSLIFLSHVLIDSGKLLLNSFYKDRSFIKTKAVFLID                   108
```

A related DNA sequence was identified in *S. pyogenes* <SEQ ID 2099> which encodes the amino acid sequence <SEQ ID 2100>. Analysis of this protein sequence reveals the following:

```
Possible site: 16
>>> Seems to have an uncleavable N-term signal seq
    INTEGRAL    Likelihood = -7.59    Transmembrane   125-141 (120-144)
    INTEGRAL    Likelihood = -6.58    Transmembrane   222-238 (215-238)
    INTEGRAL    Likelihood = -5.04    Transmembrane    47-63 (45-77)
    INTEGRAL    Likelihood = -4.62    Transmembrane   179-195 (178-199)
    INTEGRAL    Likelihood = -0.43    Transmembrane    67-83 (67-83)

----- Final Results -----
              bacterial membrane --- Certainty = 0.4036(Affirmative) < succ>
               bacterial outside --- Certainty = 0.0000(Not Clear)  < succ>
             bacterial cytoplasm --- Certainty = 0.0000(Not Clear)  < succ>
```

The protein has no significant homology with any sequences in the GENPEPT database.

An alignment of the GAS and GBS proteins is shown below:

```
Identities = 109/256 (42%), Positives = 146/256 (56%), Gaps = 28/256 (10%)

Query:   2  ISDFLRDNPILTLLFCAHFLADFQWQSQSLADSKSHSWRGLWRHLLIVFLPLAALMILIP   61
            +S +L  P LTL   H L+D+Q QSQ +AD K     L  HL+  V +PL   L ++IP
Sbjct:   5  VSHYLAQTPTLTLFLICHVLSDYQLQSQQVADLKEKHLTYLGYHLIGVSIPLICLTLIIP   64
```

-continued

```
Query:    62 ETTLLNLSIWGSHIVIDSIKKL---SYPWVEEGHFQKAAFIIDQLAHYTCIIVFYHALPT   118
             + L++L + SH +ID +K    S W E      F++DQ H            L
Sbjct:    65 QAWLMSLLVMISHALIDWLKPKMANSLKWKREW-----IFLLDQCLHIAISSFAGLRLAG   119

Query:   119 YLPPNHWLLPIKHFIVIALVFIIITKPINIVFKIFFNKFQAKELSSLLTQEKTKIMKEKS   178
                PN WL PI   ++  L ++ITKP NIVFK+FF K+Q +       +
Sbjct:   120 VTLPN-WL-PIS-ILMTVLFILLITKPTNIVFKLFFIKYQPDQGEKM-------------   163

Query:   179 EDHEETIEGAGAMIGNLERLIMAILLISGQYAAIGLVFTAKSIARYDKISKSQVFAEYYL   238
                 +TI GAGA IG LER+++ + +I GQ+A+IGLVFTAKSIARY+KIS+S   FAEYYL
Sbjct:   164 ----DTIIGAGATIGILERIVIGVCMIMGQFASIGLVFTAKSIARYNKISESPAFAEYYL   219

Query:   239 IGSLFSIISVLITHWL                                              254
                IGSLFSI+SV I  W+
Sbjct:   220 IGSLFSILSVFIAAWI                                              235
```

Based on this analysis, it was predicted that these proteins and their epitopes could be useful antigens for vaccines or diagnostics.

EXAMPLE 682

A DNA sequence (GBSx0724) was identified in *S. agalactiae* <SEQ ID 2101> which encodes the amino acid sequence <SEQ ID 2102>. Analysis of this protein sequence reveals the following:

```
Possible site: 30
>>> May be a lipoprotein

----- Final Results -----
            bacterial membrane  --- Certainty = 0.0000(Not Clear) < succ>
            bacterial outside   --- Certainty = 0.0000(Not Clear) < succ>
            bacterial cytoplasm --- Certainty = 0.0000(Not Clear) < succ>
```

The protein has homology with the following sequences in the GENPEPT database:

```
>GP:AAD17886 GB:AF100456 hyaluronate-associated protein precursor
[Streptococcus equi]
Identities = 358/521 (68%), Positives = 426/521 (81%), Gaps = 2/521 (0%)

Query:     1 MSSFNRKKLKFLGISLATLTATTVTLVACGNESKNSGDNK-INWYIPTEISTLDISKNT    59
             M+    K K LG++  TL A+    L+ACGN+   S D K  INWY PTEI TLDISKNT
Sbjct:     1 MTVLGTKACKRLGLAAVTL-ASVAALMACGNKQSASTDKKSEINWYTPTEIITLDISKNT   59

Query:    60 DAYSNLAIGNSGSNLLRIDKEGKPKPDLAKKVSVSSDGLTYTATLRDNLKWSDGSKLSAE   119
             D YS LAIGNSGSNLLR D +GK +PDLA+KV VS DGLTYTATLRD LKWSDGS L+AE
Sbjct:    60 DTYSALAIGNSGSNLLRADAKGKLQPDLAEKVDVSEDGLTYTATLRDGLKWSDGSDLTAE   119

Query:   120 DFVYTWRRIVDPKTASEYAYLATESHLLNADKINSGDIKDLNKLGVTAKGNQVTFKLTSP   179
             DFVY+W+R+VDPKTASEYAYLATESHL NA+ INSG   DL+ LGV A GN+V F LT P
Sbjct:   120 DFVYSWQRMVDPKTASEYAYLATESHLKNAEDINSGKNPDLDSLGVKADGNKVIFTLTEP   179

Query:   180 CPQFKYYLAFSNFMPQKQSYVEKVGKDYGTTSKNQIYSGPYLVKDWNGSNGKFKLVKNKY   239
                PQFK   L+FSNF+PQK+S+V+  GKDYGTTS+ QIYSGPY+VKDWNG++G FKLVKNK
Sbjct:   180 APQFKSLLSFSNFVPQKESFVKDAGKDYGTTSEKQIYSGPYIVKDWNGTSGTFKLVKNKN   239

Query:   240 YWDSKHVKTNSVIVQTIKKPDTAVQMYKQGQIDFAEISGTSAIYQANKNNKDVVDASDAR   299
             YWD+K+VKT +V VQT+KKPDTAVQMYKQG++DFA ISGTSAIY ANK +KDVV   +A
Sbjct:   240 YWDAKNVKTETVNVQTVKKPDTAVQMYKQGKLDFANISGTSAIYNANKKHKDVVPVLEAT   299

Query:   300 TTYIIYNQTGSVKALTNQKIRQALNLATDRKGVVKAAVDTGSTPAESLVPKKLAKLPNGE   359
             T YI+YNQTG+++ L + KIRQALNLATDRKG+V AAVDTGS PA +LVP  LAKL +G
Sbjct:   300 TAYIVYNQTGAIEGLNSLKIRQALNLATDRKGIVSAAVDTGSKPATALVPTGLAKLSDGT   359

Query:   360 DLSKYTAPGYTYNTSKAQKLFKEGLAEVGQSSLKLTITADSDSPAAKNAVDYVKSTWESA   419
             DL+++  APGY Y+   +A KLFKEGLAE+G+ +L  +TITAD+D+PAAK +AVDY+K TWE+A
Sbjct:   360 DLTEHVAPGYKYDDKEAAKLFKEGLAELGKDALTITITADADAPAAKSAVDYIKETWETA   419

Query:   420 LPGLTVEEKFVTFKQRLEDAKNENFDVVLFSWGGDYPEGSTFYGLTTNSAYNYGKFSSK   479
             LPGLTVEEKFV FKQRLED KN+NF+V +  WGGDYP+GSTFYGLF + SAYNYGKF++
Sbjct:   420 LPGLTVEEKFVPFKQRLEDTKNQNFEVAVVLWGGDYPKGSTFYGLFKSGSAYNYGKFTNA   479
```

```
Query:  480  EYDNAYQKAITTDALKPGDAANDYKTAEKALFDQSYYNPVY              520
             +YD AY KA+TTDAL    AA+DYK AEKAL+D + YNP+Y
Sbjct:  480  DYDAAYNKALTTDALNTDAAADDYKAAEKALYDNALYNPLY              520
```

There is also homology to SEQ ID 318. An alignment of the GAS and GBS proteins is shown below:

```
Identities = 138/524 (26%), Positives = 222/524 (42%), Gaps = 73/524 (13%)

Query:    7  KKLKFLG-ISLATLTATTVTLVACGNESKNSGDN--KVINWYIPTEISTLDISKNTDAYS   63
             KK K+L  +S+A L+ +     L ACGN++ + G    K    +  +LD          +
Sbjct:    5  KKSKWLAAVSVAILSVSA--LAACGNKNASGGSEATKTYKYVFVNDPKSLDYILTNGGGT   62

Query:   64  NLAIGNSGSNLLRIDKEGKPKPDLAKKVSVSSDGLTYTATLRDNLKW--SDGSK---LSA  118
                I     LL D+ G  P LAK  VS DGLTYT TLRD + W  +DG +    ++A
Sbjct:   63  TDVITQMVDGLLENDEYGNLVPSLAKDWKVSKDGLTYTYTLRDGVSWYTADGEEYAPVTA  122

Query:  119  EDFVYTWRRIVDPKTASEYAYLATESHLLNADKINSGDIKDLNKLGVTAKGNQ-VTFKLT  177
             EDFV   + VD K+ + Y     E + N      +G++ D  ++GV A  ++ V + L
Sbjct:  123  EDFVTGLKHAVDDKSDALY---VVEDSIKNLKAYQNGEV-DFKEVGVKALDDKTVQYTLN  178

Query:  178  SPCPQFKYYLAFSNFMPQKQSYVEKVGKDYGTTSKNQI-YSGPYLVKDWNGSNGKFKLVK  236
                P    +    +S   P     +++   GKD+GTT  + I  +G Y +  + S   + K
Sbjct:  179  KPESYWNSKTTYSVLFPVNAKFLKSKGKDFGTTDPSSILVNGAYFLSAFT-SKSSMEFHK  237

Query:  237  NKYYWDSKHVKTNSV--IVQTIKKPDTAVQMYKQGQIDFAEISGTSAIYQ-ANKNNKDVV  293
             N+ YWD+K+V   SV         P +  + +G+    A +       Y+ A KN   D +
Sbjct:  238  NENYWDAKNVGIESVKLTYSDGSDPGSFYKNFDKGEFSVARLYPNDPTYKSAKKNYADNI  297

Query:  294  D----ASDARTTYIIYN---------------QTGSVKALTNQKIRQALNLATDRKG---  331
                  D R  ++ +N                 Q    KAL N+ RQA+  A DR
Sbjct:  298  TYGMLTGDIR--HLTWNLNRTSFKNTKKDPAQQDAGKKALNNKDFRQAIQFAFDRASFQA  355

Query:  332  ----------------VVKAAVDTGSTPAESLVPKKLAKL-PNGEDLSKYTAPGYTYNTS  374
                             V    V  G +   S V  K++AKL  +D++    A     YN
Sbjct:  356  QTAGQDAKTKALRNMLVPPTFVTIGESDFGSEVEKEMAKLGDEWKDVNLADAQDGFYNPE  415

Query:  375  KAQKLF---KEGLAEVGQS-SLKLTITADSDSPAAKNAVDYVKSTWESALPGLTV-----  425
             KA+ F     KE L  G +  ++L      D  + A        K + E++L     V
Sbjct:  416  KAKAEFAKAKEALTAEGVTFPVQLDYPVDQANAATVQEAQSFKQSVEASLGKENVIVNVL  475

Query:  426  EEKFVTFKQR---LEDAKNENFDVVLFSWGGDYPEGSTFYGLFT                466
             E +   T + +      E  + +++D++   WG DY + T+   + +
Sbjct:  476  ETETSTHEAQGFYAETPEQQDYDIISSWWGPDYQDPRTYLDIMS                519
```
40

SEQ ID 2102 (GBS323) was expressed in *E. coli* as a His-fusion product. SDS-PAGE analysis of total cell extract is shown in FIG. 62 (lane 4; MW 61.3 kDa).

Figure 306:
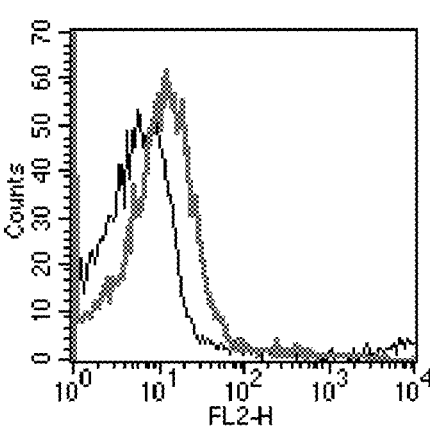

The GBS323-His fusion product was purified (FIG. 209, lane 5) and used to immunise mice. The resulting antiserum was used for FACS (FIG. 306), which confirmed that the protein is immunoaccessible on GBS bacteria.

Based on this analysis, it was predicted that these proteins and their epitopes could be useful antigens for vaccines or diagnostics.

EXAMPLE 683

A DNA sequence (GBSx0725) was identified in *S. agalactiae* <SEQ ID 2103> which encodes the amino acid sequence <SEQ ID 2104>. Analysis of this protein sequence reveals the following:

```
Possible site: 60
>>> Seems to have no N-terminal signal sequence
     INTEGRAL    Likelihood = -1.54    Transmembrane    199-215 (198-215)

----- Final Results -----
             bacterial membrane --- Certainty = 0.1617(Affirmative) < succ>
             bacterial outside  --- Certainty = 0.0000(Not Clear)   < succ>
             bacterial cytoplasm --- Certainty = 0.0000(Not Clear)  < succ>
```

The protein has homology with the following sequences in the GENPEPT database:

```
>GP:AAC17173 GB:AF065141 unknown [Streptococcus mutans]
Identities = 304/356 (85%), Positives = 334/356 (93%)

Query:   1 MKRELLLEKIDELKEIMPWYVLEYYQSKLSVPYSFTTLYEYLKEYRRFLEWLLDSGVANC   60
           M+RELLLEKIDELKE+MPWYVLEYYQSKL+VPYSFTTLYEYLKEYRRF EWL+DSGV+N
Sbjct:   1 MRRELLLEKIDELKELMPWYVLEYYQSKLTVPYSFTTLYEYLKEYRRFFEWLIDSGVSNA  60

Query:  61 HHIAEIELSVLENLTKKDMEAFILYLRERPLLNANTRQNGVSQTTINRTLSALSSLFKYL  120
           + +A+I L  LE+L+KKDME+FILYLRER LLN    ++ GVSQTTINRTLSALSSL+KYL
Sbjct:  61 NKLADIPLETLEHLSKKDMESFILYLRERTLLNTKNKRQGVSQTTINRTLSALSSLYKYL  120

Query: 121 TEEVENADGEPYFYRNVMKKVSTKKKKETLASRAENIKQKLFLGNETIEFLEYIDCEYQN  180
           TEEVENADGEPYFYRNVMKKVSTKKKKETLA+RAENIKQKLFLGNET+EFLEY+DCEY+
Sbjct: 121 TEEVENADGEPYFYRNVMKKVSTKKKKETLAARAENIKQKLFLGNETMEFLEYVDCEYEQ  180

Query: 181 KLSKRALAFFNKNKERDLAIIALLLASGVRLSEAVNLDLKDINLNVMVIDVTRKGGKRDS  240
           KLSKRAL+ F KNKERDLAIIALLLASGVRLSEAVNLDLKD+NLN+M+I+VTRKGGK DS
Sbjct: 181 KLSKRALSSFRKNKERDLAIIALLLASGVRLSEAVNLDLKDVNLNMMIIEVTRKGGKHDS  240

Query: 241 VNVASFAKPYLANYLDIRKNRYKAENQDIALFLSEYRGVPNRIDASSVEKMVAKYSQDFK  300
           VNVA FAKPYL NY+ IR+ RYKA+   D+A FLSEYRGVPNR+DASS+EKMVAKYSQDFK
Sbjct: 241 VNVAGFAKPYLENYITIRRGRYKAKKTDLAFFLSEYRGVPNRMDASSIEKMVAKYSQDFK  300

Query: 301 VRVTPHKLRHTLATRLYDATKSQVLVSHQLGHASTQVTDLYTHIVNDEQKNALDKL      356
           +RVTPHKLRHTLATRLYDATKSQVLVSHQLGHASTQVTDLYTHIVNDEQKNALDKL
Sbjct: 301 IRVTPHKLRHTLATRLYDATKSQVLVSHQLGHASTQVTDLYTHIVNDEQKNALDKL      356
```

A related DNA sequence was identified in *S. pyogenes* <SEQ ID 2105> which encodes the amino acid sequence <SEQ ID 2106>. Analysis of this protein sequence reveals the following:

```
Possible site: 48
>>> Seems to have no N-terminal signal sequence
     INTEGRAL    Likelihood = -1.54    Transmembrane    211-227 (210-227)

----- Final Results -----
             bacterial membrane --- Certainty = 0.1617(Affirmative) < succ>
              bacterial outside --- Certainty = 0.0000(Not Clear)   < succ>
            bacterial cytoplasm --- Certainty = 0.0000(Not Clear)   < succ>
```

A related sequence was also identified in GAS <SEQ ID 9139> which encodes the amino acid sequence <SEQ ID 9140>. Analysis of this protein sequence reveals the following:

```
Possible cleavage site: 60
>>> Seems to have no N-terminal signal sequence
     INTEGRAL    Likelihood = -1.54    Transmembrane    199-215 (198-215)

----- Final Results -----
             bacterial membrane --- Certainty = 0.162(Affirmative) < succ>
              bacterial outside --- Certainty = 0.000(Not Clear)   < succ>
            bacterial cytoplasm --- Certainty = 0.000(Not Clear)   < succ>
```

An alignment of the GAS and GBS proteins is shown below:

```
Identities = 283/356 (79%), Positives = 321/356 (89%)

Query:   1 MKRELLLEKIDELKEIMPWYVLEYYQSKLSVPYSFTTLYEYLKEYRRFLEWLLDSGVANC   60
           M+RELLLEKI+   K IMPWYVL+YYQSKL VPYSFTTLYEYLKEY+RF +WL+D+ +
Sbjct:  13 MRRELLLEKIETYKAIMPWYVLDYYQSKLAVPYSFTTLYEYLKEYKRFFDWLMDADLTQA   72

Query:  61 HHIAEIELSVLENLTKKDMEAFILYLRERPLLNANTRQNGVSQTTINRTLSALSSLFKYL  120
            IA+I+LS LE+LTKKD+EAF+LYLRERP LN  + +  G+SQTTINRTLSALSSL+KYL
Sbjct:  73 PKIADIDLSTLEHLTKKDLEAFVLYLRERPSLNTYSTKEGLSQTTINRTLSALSSLYKYL  132
```

```
                                  -continued
Query:  121 TEEVENADGEPYFYRNVMKKVSTKKKKETLASRAENIKQKLFLGNETIEFLEYIDCEYQN  180
            TEEVEN  GEPYFYRNVMKKVSTKKKKETLASRAENIKQKLFLG+ET+ FL+Y+D EY+
Sbjct:  133 TEEVENDQGEPYFYRNVMKKVSTKKKKETLASRAENIKQKLFLGDETLAFLDYVDKEYEQ  192

Query:  181 KLSKRALAFFNKNKERDLAIIALLLASGVRLSEAVNLDLKDINLNVMVIDVTRKGGKRDS  240
            KLS RA + F KNKERDLAIIALLLASGVRLSEAVNLDLKD+NLN+M+I+V REGGERDS
Sbjct:  193 KLSNRAKSSFRKNKERDLAIIALLLASGVRLSEAVNLDLKDVNLNMMIIEVIRKGGKRDS  252

Query:  241 VNVASFAKPYLANYLDIRKNRYKAENQDIALFLSEYRGVPNRIDASSVEKMVAKYSQDFK  300
            VNVA FAK YL +YL +R+ RYKAE QD+A FL+EYRGVPNR+DASS+EKMV KYS+DFK
Sbjct:  253 VNVAGFAKGYLESYLAVRQRRYKAEKQDLAFFLTEYRGVPNRMDASSIEKMVGKYSEDFK  312

Query:  301 VRVTPHKLRHTLATRLYDATKSQVLVSHQLGHASTQVTDLYTHIVNDEQKNALDKL      356
            +RVTPHKLRHTLATRLYDATKSQVLVSHQLGH+STQVTDLYTHIVNDEQKNALD L
Sbjct:  313 IRVTPHKLRHTLATRLYDATKSQVLVSHQLGHSSTQVTDLYTHIVNDEQKNALDNL      368
```

SEQ ID 2104 (GBS420) was expressed in *E. coli* as a GST-fusion product. SDS-PAGE analysis of total cell extract is shown in FIG. 172 (lane 5; MW 68 kDa).

GBS420-GST was purified as shown in FIG. 219, lane 9-10.

Based on this analysis, it was predicted that these proteins and their epitopes could be useful antigens for vaccines or diagnostics.

EXAMPLE 684

A DNA sequence (GBSx0726) was identified in *S. agalactiae* <SEQ ID 2107> which encodes the amino acid sequence <SEQ ID 2108>. This protein is predicted to be a sensor-like histidine kinase in idh 3'region. Analysis of this protein sequence reveals the following:

```
Possible site: 24
>>> Seems to have an uncleavable N-term signal seq
     INTEGRAL     Likelihood = -7.75     Transmembrane     10-26 (8-34)
     INTEGRAL     Likelihood = -3.93     Transmembrane     37-53 (35-54)

----- Final Results -----
            bacterial membrane  --- Certainty = 0.4100(Affirmative) < succ>
            bacterial outside   --- Certainty = 0.0000(Not Clear)   < succ>
            bacterial cytoplasm --- Certainty = 0.0000(Not Clear)   < succ>
```

The protein has homology with the following sequences in the GENPEPT database:

```
>GP:CAB16001 GB:Z99124 similar to two-component sensor histidine
kinase [YxdJ] [Bacillus subtilis]
Identities = 96/320 (30%), Positives = 172/320 (53%), Gaps = 16/320 (5%)

Query:    2 IRQFLREHLIWYILYIM--MFVLFFISFYLYHLPMPYLFNSLGLNVIVLLGISIWQYSRY   59
            ++ FLR H + +L+++  +FV F+ F  H    +LF  LG+ +++L G   +++ +
Sbjct:    1 MKLFLRSHAVLILLFLLQGLFVFFYYWFAGLH-SFSHLFYILGVQLLILAGYLAYRWYKD   59

Query:   60 RKKMLHLKYFNSSQDPSFELQPSDYAYFNIITQLEA--REAQKVSETIEQTNHVALMIKM  117
            R     L      D  +L  S +         Q+E    + QK+ ET + +        +
Sbjct:   60 RGVYHWLSSGQEGTDIPY-LGSSVFCSELYEKQMELIRLQHQKLHETEAKLDARVTYMNQ  118

Query:  118 WSHQMKVPLAAISLMAQTNHLDP--KEVEQQLLKLQHYLETLLAFLKFRQYRDDFRFEAV  175
            W HQ+K  PL+  I+L+ Q   +P   +P  ++++++ +++  LETLL    +   DF+ EAV
Sbjct:  119 WVHQVKTPLSVINLIIQEED-EPVFEQIKKEVRQIEFGLETLLYSSRLDLFERDFKIEAV  177

Query:  176 SLREVVVEIIKSYKVICLSKSL--SIIIEGDNIWKTDKKWLTFALSQVLDNAIKYSNPES  233
            SL E++  +I+SYK   +   +   + +  D+    TD KWL FA+ QV+ NA+KYS    +S
Sbjct:  178 SLSELLQSVIQSYKRFFIQYRVYPKMNVCDDHQIYTDAKWLKFAIGQVVTNAVKYSAGKS  237

Query:  234 -----KIIISIGEESIRIQDYGIGILEEDIPRLFEDGFTGYNGHEHQKATGMGLYMTKEV  288
                  +        + ++DYG+GI +DI R+F+   +TG NG    Q++TG+GL++ KE+
Sbjct:  238 DRLELNVFCDEDRTVLEVKDYGVGIPSQDIKRVFDPYYTGENGRRFQESTGIGLHLVKEI  297
```

```
Query:   289 LSSLNLSISVDSKINYGTAV                                          308
             LN ++ + S    GT+V
Sbjct:   298 TDKLNHTVDISSSPGEGTSV                                          317
```

SEQ ID 2108 (GBS421) was expressed in *E. coli* as a GST-fusion product. SDS-PAGE analysis of total cell extract is shown in FIG. 172 (lane 6; MW 63 kDa).

GBS421-GST was purified as shown in FIG. 219, lane 11.

Based on this analysis, it was predicted that this protein and its epitopes, could be useful antigens for vaccines or diagnostics.

EXAMPLE 685

A DNA sequence (GBSx0727) was identified in *S. agalactiae* <SEQ ID 2111> which encodes the amino acid sequence <SEQ ID 2112>. Analysis of this protein sequence reveals the following:

```
Possible site: 37
>>> Seems to have no N-terminal signal sequence

----- Final Results -----
              bacterial cytoplasm --- Certainty = 0.1310 (Affirmative) < succ>
              bacterial membrane  --- Certainty = 0.0000 (Not Clear)   < succ>
              bacterial outside   --- Certainty = 0.00000 (Not Clear)  < succ>
```

The protein has homology with the following sequences in the GENPEPT database:

```
>GP:AAD10258 GB:AF036964 putative response regulator [Lactobacillus
sakei]
Identities = 94/222 (42%), Positives = 140/222 (62%), Gaps = 8/222 (3%)

Query:     7 KIYIVEDDMTIVSLLKDHLSASYHVSSV--SNFRDVKQEIIAFQPDLILMDITLPYFNGF   64
             +I IVEDD TI +L+ ++L   + + ++   +F +     +P L+L+DI LP ++GF
Sbjct:     3 EIMIVEDDPTIANLIAENLE-KWQLKAIIPDDFDTIFDRFLTDKPHLVLLDINLPVYDGF   61

Query:    65 YWTAELRKFLTIPIIFISSSNDEMDMVMALNMGGDDFISKPFSLAVLDAKLTAILRRSQQ  124
             YW  ++R+    +PIIFISS +  MDMVM++NMGGDDF++KPFS+ VL AK+ A+LRR+
Sbjct:    62 YWCRKIREVSKVPIIFISSRSTNMDMVMSMNMGGDDFVNKPFSMEVLIAKINALLRRTYN  121

Query:   125 FIQQE---LTFGGFTLT-REGLLSSQDKEVILSPTENRILSILLMHPKQVVSKESLLEKL  180
             ++ Q    +    G +  + G       D V LS  E K+L L+     Q+VS+E LL  L
Sbjct:   122 YVDQNTDVIEHNGLLINLQSGGAQVGDTVVDLSKNEYKLLQFLMRQHGQIVSREKLLRAL  181

Query:   181 WENDSFIDQNTLNVNMTRLRKKIVPIGF-DYIHTVRGVGYLL                   221
             W+++ F+D NTL VN+ RLRKKI   G  DYI T  G GY++
Sbjct:   182 WDDERFVDDNTLTVNINRLRKKIEQAGLEDYIQTKIGQGYII                   223
```

There is also homology to SEQ ID 1182.

Based on this analysis, it was predicted that this protein and its epitopes, could be useful antigens for vaccines or diagnostics.

EXAMPLE 686

A DNA sequence (GBSx0728) was identified in *S. agalactiae* <SEQ ID 2113> which encodes the amino acid sequence <SEQ ID 2114>. This protein is predicted to be permease OrfY. Analysis of this protein sequence reveals the following:

```
Possible site: 37
>>> Seems to have no N-terminal signal sequence
    INTEGRAL    Likelihood = -11.62    Transmembrane     55-71   (49-75)
    INTEGRAL    Likelihood = -10.30    Transmembrane    197-213 (192-218)
    INTEGRAL    Likelihood =  -9.13    Transmembrane    152-168 (141-172)
    INTEGRAL    Likelihood =  -8.70    Transmembrane    624-640 (619-645)
```

```
                           -continued
INTEGRAL   Likelihood = -8.44     Transmembrane   222-238  (219-250)
INTEGRAL   Likelihood = -7.75     Transmembrane   283-299  (280-307)
INTEGRAL   Likelihood = -7.70     Transmembrane   533-549  (526-552)
INTEGRAL   Likelihood = -6.95     Transmembrane   108-124  (99-140)
INTEGRAL   Likelihood = -4.88     Transmembrane   585-601  (581-610)
INTEGRAL   Likelihood = -3.82     Transmembrane    25-41   (21-47)
INTEGRAL   Likelihood = -0.48     Transmembrane   602-618  (602-618)

----- Final Results -----
            bacterial membrane --- Certainty = 0.5649 (Affirmative) < succ>
            bacterial outside  --- Certainty = 0.0000 (Not Clear)  < succ>
         bacterial cytoplasm  --- Certainty = 0.0000 (Not Clear)  < succ>
```

A related GBS nucleic acid sequence <SEQ ID 9809> which encodes amino acid sequence <SEQ ID 9810> was also identified.

The protein has homology with the following sequences in the GENPEPT database:

```
>GP:AAF99695 GB:AF267498 permease OrfY [Streptococcus mutans]
Identities = 154/665 (23%), Positives = 299/665 (44%), Gaps = 40/665 (6%)

Query:    4  MFYLKIAWHNLKHSIDQYIPFLLASLLLYSLTCSTLLILMSAVGRDMGTAAT---VLFLG    60
             MF KI++HNL +  +P+   +      + L +   ++ TA      +L  G
Sbjct:    1  MFLPKISFHNLIVNKSLTLPYFAIMTIFSGFNYVLINFLTNPSFYNIPTARILIDILIFG   60

Query:   61  VIVLSIFAVVMEHYSYMILMKQRSSEFGLYNILGMNKRQVARVASLELFIIYIFLISIGS  120
             +I++S+ ++   Y+  + +R+S G++ +LGM K+Q+ ++   LE  ++        G
Sbjct:   61  FILISLLMLLYGRYANRFISDERNSNMGIFLMLGMGKRQLLKIIYLEKLYLFTGTFFGGL  120

Query:  121  LFSAFFAKFIYLIFVNIINYHALNLSLSLWPFIICIVIFTGIFLTLEVPVIRHVHLSSPL  180
             +F  ++K +L   N+I  +   SL    +++  I+  + +   R+      S
Sbjct:  121  IFGFVYSKIFFLFIRNLIVIGDVREQYSLTAISWLLILTFFIYIYLSEYRLLKRQSIT   180

Query:  181  SLFRKKQQGEKEPKGNLILAILALVAIAIAYTMALTSGKAPALAVIY-RFFFAVLLVIAG  239
              +F K + +   K ++ + + L A+ +  Y  ALTS    P +    + RF +A  LV  G
Sbjct:  181  VIFNSKAKRDNPRKTSVFVGLFGLFALLMGYHFALTS---PNVTTSFSRFIYAACLVTLG  237

Query:  240  TYLFYISFMTWYLKRLRQNKHYYYKSEHFVSTSQMIFRMKQNAVGLASITLLAVMALVTI  299
             +   + S +  L +++ +  YY     FV + +   R++ NA+ LA+I + +    LV++
Sbjct:  238  IFCTFSSGVIMLLTVIKKRRAIYYNQRRFVVIASLFHRIRSNALSLATICIFSTATLVSL  297

Query:  300  ATTVSLYSNTQNVVTGLFPKSVSLSIDNSKGDAKNIFEEKILKKLGKSSKEAITYNQTMI  359
              +   SLY    N+V   P+ V++    S D       E L +      +   +T  Q
Sbjct:  298  SVLASLYLAKDNMVRLSSPRDVTVL---STTDI-----EPNLMDIATKNHVTLTNRQ---  346

Query:  360  SMPVSQSSELNITSKNVKHVDITKTGFNY------LITQNDFRRLGHQLPKLKDNQVAYF  413
             ++ VSQS   NI       H+ +  G M      +I+ + F     +LK++++   +
Sbjct:  347  NLKVSQSVYGNIKGS---HLSVDPNGGMANDYQITVISLDSFNASNNTHYRLKNHEILTY  403

Query:  414  VQKGDSRLKKINLLGNKFDVVKNLKEA-YVPETTNTYNPGLIIFANNKQI-DNIRKAYLP  471
             V  G +      G K   VK +K  ++    + P   I +N++I   I K  L
Sbjct:  404  VSNGAAAPSSYTTNGVKLTNVKQIKRINFIFSPLRSMQPNFFIITDNREIIQTILKEELT  463

Query:  472  YTKNINTFPKTFKAYLDLNSQEINSISKNDIIEVDG--KYVGNISTKQSFLKEGYQMFGG  529
             +      T Y + +++N   D +E    ++ N+ + +         +FGG
Sbjct:  464  WG--------TMAGY-HVKGKKMNQKDFYDELETTNFRQFSANVVSIRQVKSMFNALFGG  514

Query:  530  LLFTGFLLGISFLLGIALIVYYKQYSEGHEDKRSYRILQEVGMSKKLVKRTINSQIMIFF  589
             LLF G + G F + A+ +YY+Q SEG  D+   Y+ +  ++GM+ K ++  +I   QI     F
Sbjct:  515  LLFVGIIFGTIFAILTAITIYYQQLSEGIRDRDDYKAMIKLGMTNKTIQDSIKVQINFVF    574

Query:  590  FQPLVVAVIHFGVAIPMLKQMLLVFGVLNSTIVYVVSGLTVLAISIIYFIIYRITSRTYY  649
              P+ A+++    A+P+L +++     FG ++  +      G  ++     Y+ I  TS+ YY
Sbjct:  575  ILPIAFALLNLIFALPILYKIMTTFGFNDAGLFLRAVGTCLIVYLFFYWFICHCTSKLYY  634

Query:  650  HIIER                                                         654
             +I +
Sbjct:  635  RLISK                                                         639
```

A related DNA sequence was identified in *S. pyogenes* <SEQ ID 2115> which encodes the amino acid sequence <SEQ ID 2116>. Analysis of this protein sequence reveals the following:

```
Possible site: 35
>>> Seems to have a cleavable N-term signal seq.
    INTEGRAL    Likelihood = -13.59    Transmembrane    602-618 (592-630)
    INTEGRAL    Likelihood = -12.26    Transmembrane     59-75  (50-81)
    INTEGRAL    Likelihood = -12.21    Transmembrane    235-251 (224-262)
    INTEGRAL    Likelihood =  -9.82    Transmembrane    159-175 (146-177)
    INTEGRAL    Likelihood =  -9.02    Transmembrane    201-217 (198-223)
    INTEGRAL    Likelihood =  -8.97    Transmembrane    510-526 (507-540)
    INTEGRAL    Likelihood =  -6.42    Transmembrane    569-585 (564-589)
    INTEGRAL    Likelihood =  -5.95    Transmembrane    109-125 (102-138)
    INTEGRAL    Likelihood =  -4.09    Transmembrane    294-310 (290-315)
    INTEGRAL    Likelihood =  -1.86    Transmembrane    126-142 (126-142)

----- Final Results -----
            bacterial membrane  --- Certainty = 0.6434 (Affirmative) < succ>
            bacterial outside   --- Certainty = 0.0000 (Not Clear)   < succ>
            bacterial cytoplasm --- Certainty = 0.0000 (Not Clear)   < succ>
```

The protein has homology with the following sequences in the databases:

```
>GP:BAB03337 GB:AB035452 ABC transporter [Staphylococcus aureus]
Identities = 141/657 (21%), Positives = 289/657 (43%),
Gaps = 66/657 (10%)

Query:   5  ITKSNIKKNFSLYRIYFLATIGLLSIFIAFLNFISDKII--TEKIGDSGQALVIANGSL-   61
            I   N+++N   Y +Y     L S+F + + S   +  T+ + +      +I  G+L
Sbjct:   6  IVFKNLRQNLKHYAMY------LFSLFFSIVLYFSFTTLQFTKGVNNDDSMAIIKKGALV   59

Query:  62  --IFLIVFLVVPLIYFNNFFVKKRSQELGVLAILGFSKRELTKLLTLENLVILVLSYLVS  119
              IFL + +V+FL+Y N+ FVK+R++E   + ++G +++ + K+L LE +++ +++ +V
Sbjct:  60  GSIFLFIIIVIFLMYANHLFVKRRTREFALFQLIGLTRQNILKMLALEQMIVFLITGVVG  119

Query: 120  LLLGPTLYFLAVLAITHLLNLTMEVQWFITVNEIIESLGILVVVFLINVITNGLIISKQS  179
            +L G    L +  ++ L++L++ +         ++ ++  +L++ +++  +  L  + ++S
Sbjct: 120  VLCGIAGAQLLLSIVSKLMSLSINLSIHFEPMALVLTIFMLIIAYVLILFQSALFLKRRS  179

Query: 180  LIEFVNFSRKAE----KKIKIRKVRAIIAITALLLSYILCLATVFSSTRNMLLSIGMVPV  235
            ++  +   S K+      K    +  ++I  +L  Y  +AT   T   L         P
Sbjct: 180  ILSMMKDSIKTDATTAKVTTAEVISGVLGIAMIALGYY--MATEMFGTFKALTMAMTSP-  236

Query: 236  SLLIIVLVVLGTVFTIRYGLAFVVSLLKENKKRLYRPLSNIIYPKFNYRIATKNKLLTVL  295
             +I+ L V+G    R  ++ +    LK++K                   YR+      LT++
Sbjct: 237  -FIILFLTVVGAYLFFRSSVSLIFKTLKKSKNGRVSITDVVFTSSIMYRMKKNAMSLTII  295

Query: 296  GGLLTVTVSVAGMMVMLYAYSLNGIERLTPSAIEYNVESENGQVNVTTILENDQVSL---  352
             +   VTV+V      + +  + +  +  + +   +P+ E+NV +        T L  Q++
Sbjct: 296  AIISAVTVTVLCFAALSKSNTDQTLTSMAPN--EFNVVATQDAKQFETKLSQQQITFSKN  353

Query: 353  ----VDVGLLRLNTIPEVTITDSGQTIPYFDIINYSDYKELMKAQGRTNSIEGSKSLPLL  408
                + V ++    I    +DSG+T     N        K  G      I  +KSLP +
Sbjct: 354  AYETITVDNVKDQVITLENGSDSGRTNSILSANN--------KVTGNNAIITNTKSLPNI  405

Query: 409  INYYPTEISLGKTFNLGNAYDVT--VKQVSTNNVFSFSTSVTTLV--VSDKLYAKLSSRF  464
            IN    I L K  +  + +T V Q          V+  + S  + V VS  Y +L   +
Sbjct: 406  IN-----IHLNKDLVVKGTKNETFRVTQEDKGRVYPLNLSFNSPVVEVSPEKYQQLKT--  458

Query: 465  PEKEMTIRTFNGTSIR------SSEAFYNQFSMVPDVISSYSKEHTVKTANIATYIFIT-  517
             + + TF G I+           ++A   QF   D + Y +         A    IF+T
Sbjct: 459  ---QNNVHTFYGYDIKQTSQKEKAQAIAKQFG---DKVITYDEMKKEVDATNGILIFVTS  512

Query: 518  FLSILFIICTGSILYFTSLIEIMENKEEYGYLSKLGYSKKMIHRILRYETGILFLIPVFI  577
            FL + F++  G I+Y   + E +     + L ++G++  ++ + L +   F +P+ I
Sbjct: 513  FLGLAFLVAAGCIIYIKQMDETEDELSNFRILKRIGFTHTDMLKGLLLKITFNFGLPLLI  572

Query: 578  GIVNGGMLLIYYKYLFMDTLVAGNIIMLSLLLCLLFFLIIYGTFYVLTLRLVTSIIK    634
             I++    I + L       GNI + +++  ++ +IY TF ++       +IK
Sbjct: 573  AILHAVFAAIAFMKLM------GNISFMPVIVVVYTLIYITFALIAFVHSNKLIK     623
```

An alignment of the GAS and GBS proteins is shown below:

```
Identities = 145/678 (21%), Positives = 277/678 (40%), Gaps = 89/678 (13%)

Query:   13 NLKHSIDQYIPFLLASLLLYSLTCSTL-----LILMSAVGRDMGTAATVLFLGVIVLSIF   67
            N+K +    Y + LA++ L S+ +L       I+   +G D G A  +   +I L ++F
Sbjct:    9 NIKKNFSLYRIYFLATIGLLSIFIAFLNFISDKIITEKIG-DSGQALVIANGSLIFLIVF   67

Query:   68 AVVMEHYSYNILMKQRSSEFGLYNILGMNKRQVARVASLELFIIYIFLISIGSLFSAFFA  127
            VV    Y  N  +K+RS E G+    ILG +KR++ ++ +LE  +I +       L  S
Sbjct:   68 LVVFLIYFNNFFVKKRSQELGVLAILGFSKRELTKLLTLENLVILV----LSYLVSLLLG  123

Query:  128 KFIYLIFVNIINYHALNLSLSLWPFIICIVIFTGIFLTLEVPVIRHV------HLSSPLS  181
            +Y + V  I   H LNL++ +  FI    I  + + V +I  +         S  +
Sbjct:  124 PTLYFLAVLAIT-HLLNLTMEVQWFITVNEIIESLGILVVVFLINVITNGLIISKQSLIE  182

Query:  182 LFRKKQQGEKEPKGNLILAILALVAIAIAYTMAL------TSGKAPALAVIYRFFFAVLL  235
             +   EK+ K   + AI+A+ A+ ++Y + L         T       ++ ++     ++L
Sbjct:  183 FVNFSRKAEKKIKIRKVRAIIAITALLLSYILCLATVFSSTRNMLLSIGMVPVSLLIIVL  242

Query:  236 VIAGTYLFYISFMTWYLKRLRQNKHYYYKSEHFVSTSQMIFRMKQNAVGLASITLLAVMA  295
            V+ GT       + + +   L++NK   Y+   +   +R+  A    +T+L  +
Sbjct:  243 VVLGTVFTIRYGLAFVVSLLKENKKRLYRPLSNIIYPKFNYRI---ATKNKLLTVLGGLL  299

Query:  296 LVTIATT---VSLYSNTQNVVTGLFPKSVSLSIDNSKGDAKNIFEEKILKKLGKSSKEAI  352
            VT++      V LY+ + N + L P ++  ++++   G              +     I
Sbjct:  300 TVTVSVAGMMVMLYAYSLNGIERLTPSAIEYNVESENGQV---------------NVTTI  344

Query:  353 TYNQTMISMPVSQSSELNITSKNVKHVDITKTG----FMYLITQNDFRRL------GHQL  402
             N  + V        +    + V IT +G      +I   +D++ L        + +
Sbjct:  345 LENDQVSLVDVGL-----LRLNTIPEVTITDSGQTIPYFDIINYSDYKELMKAQGRTNSI  399

Query:  403 PKLKDNQVAYFVQKGDSRLKKINLLGNKFDVVKNLKEAYVPETTNTYNPGLIIFANNKQI  462
               K +         + L K   LGN +DV  +K+     +          +   ++K
Sbjct:  400 EGSKSLPLLINYYPTEISLGKTFNLGNAYDVT--VKQVSTNNVFSFSTSVTTLVVSDKLY  457

Query:  463 DNIRKAYLPYTKNINTFPKT-------FKAYLDLNSQEINSISKNDIIEVDGKYVGNIST  515
             +    +      I TF  T       F     +  I+S SK   ++        NI+T
Sbjct:  458 AKLSSRFPEKEMTIRTFNGTSIRSSEAFYNQFSMVPDVISSYSKEHTVKT-----ANIAT  512

Query:  516 KQSFLKEGYQMFGGLLFTGFLLGISFLLGIALIVYYKQYSEGHEDKRSYRILQEVGMSKK  575
                           +F  FL   I F++   I+Y+     E E+K  Y  L ++G SKK
Sbjct:  513 --------------YIFITFL-SILFIICTGSILYFTSLIEIMENKEEYGYLSKLGYSKK  557

Query:  576 LVKRTINSQIMIFFFQPLVVAVIHFGVAIPMLKQMLLVFGVLNSTIVYVVSGLTVLAISI  635
            ++ R +  +   I F P+ + +++  G+ +     K  L ++     I+ +     L +L    I
Sbjct:  558 MIHRILRYETGILFLIPVFIGIVNGGMLLIYYK-YLFMDTLVAGNIIMLSLLLCLLFFLI  616

Query:  636 IYFIIYRITSRTYYHIIE                                           653
            IY     Y +T R     II+
Sbjct:  617 IYGTFYVLTLRLVTSIIK                                           634
```

A related GBS gene <SEQ ID 8639> and protein <SEQ ID 8640> were also identified. Analysis of this protein sequence reveals the following:

```
Lipop: Possible site: -1 Crend: 7
McG: Discrim Score: -11.64
GvH: Signal Score (-7.5): -3.52
   Possible site: 37
>>> Seems to have no N-terminal signal sequence
ALOM program count: 11 value: -11.62 threshold: 0.0
    INTEGRAL    Likelihood = -11.62    Transmembrane     55-71  (49-75)
    INTEGRAL    Likelihood = -10.30    Transmembrane    197-213 (192-218)
    INTEGRAL    Likelihood =  -9.13    Transmembrane    152-168 (141-172)
    INTEGRAL    Likelihood =  -8.70    Transmembrane    624-640 (619-645)
    INTEGRAL    Likelihood =  -8.44    Transmembrane    222-238 (219-250)
    INTEGRAL    Likelihood =  -7.75    Transmembrane    283-299 (280-307)
```

```
                   -continued
INTEGRAL    Likelihood = -7.70     Transmembrane   533-549  (526-552)
INTEGRAL    Likelihood = -6.95     Transmembrane   108-124  (99-140)
INTEGRAL    Likelihood = -4.88     Transmembrane   585-601  (581-610)
INTEGRAL    Likelihood = -3.82     Transmembrane    25-41   (21-47)
INTEGRAL    Likelihood = -0.48     Transmembrane   602-618  (602-618)
PERIPHERAL  Likelihood =  1.16  129
modified ALOM score: 2.82

*** Reasoning Step: 3

----- Final Results -----
              bacterial membrane --- Certainty = 0.5649 (Affirmative) < succ>
               bacterial outside --- Certainty = 0.0000 (Not Clear)   < succ>
              bacterial cytoplasm --- Certainty = 0.0000 (Not Clear)   < succ>
```

The protein has homology with the following sequences in the databases:

```
ORF02245(310-2262 of 2562)
GP|9802356|gb|AAF99695.1|AF267498_5|AF267498(1-639 of 640) permease OrfY
{Streptococcus mutans}
% Match = 10.2
% Identity = 24.0  % Similarity = 49.8
Matches = 147  Mismatches = 297  Conservative Sub.s = 158

123       153       183       213       243       273       303       333
QKTC*IYLKLLTWMDKLF*W*PIQQMLLVMPNAFYLSKMDVFFTNFIVVIRIIANSIKIFL*QCLPY*GVNNMFYLKIAW
                                                                     ||  ||::
                                                                     MFLPKISF 363       393       423       453       474       504       534       564
HNLKHSIDQYIPFLLASLLLYSLTCSTLLILMSAVGRDMGTAAT---VLFLGVIVLSIFAVVMEHYSYNILMKQRSSEFG
|||    : :|::    ::    :   |  ::||     :|   :|  ::|::  :      |     :   :|:|  |
HNLIVNKSLTLPYFAIMTIFSGFNYVLINFLTNPSFYNIPTARILIDILIFGPILISLLMLLYGRYANRFISDERNSNMG
          20        30        40        50        60        70        80

594       624       654       684       714       744       774       804
LYNILGMNKRQVARVASLELFIIYIFLISIGSLFSAFFAKFIYLIFVNIINYHALNLSLSLWPFIICIVIFTGIFLTLEV
::  :|||  |:|:  ::  ||  : ::       |  |    ::|   |:|       :       :::  |::  :
IFLMLGMGKKQLLKIIYLEKLYLFTGTFFGGLIFGFVYSKIFFLIRNLIVIGDVREQYSLTAISWLLILTFFIYFIIYL
         100       110       120       130       140       150       160

834       864       894       924       954      1011      1041
PVIRHVHLSSPLSLFRKKQQGEKEPKGNLILAILALVAIAIAYTMALTSGKAPALAVIY-RFFFAVLLVIAGTYLFYISF
      |:   |   :|   | :   |   |::  :: ||:   |:|  :  |||  |:    : |::|  || :   :  |
SEYRLLKRQSITVIFNSKAKRDNPRKTSVFVGLFGLFALLMGYHFALTS---PNVTTSFSRFIYAACLVTLGIFCTFSSG
         180       190       200       210       220       230       240

1071      1101      1131      1161      1191      1221      1251      1281
MTWYLKRLRQNKHYYYKSEHFVSTSQMIFRMKQNAVGLASITLLAVMALVTIATTVSLYSNTQNVVTGLFPKSVSLSIDN
:    |  :::  :   ||       ||   ::    |::   ||:|     :::        ||      :|       |: |
VIMLLTVIKKRRAIYYNQRRFVVIASLFHRIRSNALSLATICIFSTATLVSLSVLASLYLAKDNMVRLSSPRDV------
         260       270       280       290       300       310

1311      1341      1371      1401      1431      1461
SKGDAKNIFEEKILKKLGKSSKEAITYNQTMISMPVSQSSELNITSKNVKHVDITKTGFM--------------------
             |:|      :   ::|   :||     ||:|       :
---------------------------TVLSTTDIEPNLMDIATKN--HVTLTNRQNLKVSQSVYGNIKGSHLSVDPN
                           320       330         340       350       360

1464      1494      1524      1554      1584      1614      1641      1671
---------YLITQNDFRRLGHQLPKLKDNQVAYFVQKGDSRLKKINLLGNKFDVVKNLKEA-YVPETTNTYNPGLIIFA
         :|::  |     :   :||:::    :|   |  :      ||  :|     ::             :  | :
GGMANDYQITVISLDSFNASNNTHYRLKNHEILTYVSNGAAAPSSYTTNGVKLTNVKQIKRINFIFSPLRSMQPNFFIIT
         380       390       400       410       420       430       440

1698      1728      1758      1788      1818      1842      1872      1902
NNKQI-DNIRKAYLPYTKNINTFPKTFKAYLDLNSQEINSISKNDIIEVDG--KYVGNISTKQSFLKEGYQMFGGLLFTG
:|::     ||||   |       |    :    : :::|      |:|      ::     |::         :|||||| |
DNREIIQTILKEELTWG-------TMAGY-HVKGKKMNQKDFYDELETTNFRQFSANVVSIRQVKSMFNALFGGLLFVG
         460             470        480       490       500       510

1932      1962      1992      2022      2052      2082      2112      2142
FLLGISFLLGIALIVYYKQYSEGHEDKRSYRILQEVGMSKKLVKRTINSQIMIFFFQPLVVAVIHFGVAIPMLKQMLLVF
::|   :   |:  :||:| |||  |:    |:    :::||   :::  :|      |  |:   |:|::   |
IIFGTIPAILTAITIYYQQLSEGIRDRDDYKAMIKLGMTNKTIQDSIKVQINPVFILPIAFALLNLIFALPILYKIMTTF
         530       540       550       560       570       580       590

2172      2202      2232      2262      2292      2322      2352      2382
GVLNSTIVYVVSGLTVLAISIIYFIIYRITSRTYYHIIER*KGLVILPILLH**KPID*KICYTK*KKEISYYFRRGYVT
|   ::: :      |    ::   |:  ||  ||  :|  :
GFNDAGLFLRAVGTCLIVYLFFYWFICHCTSKLYYRLISKK
         610       620       630       640
```

Based on this analysis, it was predicted that these proteins and their epitopes could be useful antigens for vaccines or diagnostics.

EXAMPLE 687

A DNA sequence (GBSx0729) was identified in *S. agalactiae* <SEQ ID 2117> which encodes the amino acid sequence <SEQ ID 2118>. This protein is predicted to be ABC transporter OrfX. Analysis of this protein sequence reveals the following:

```
Possible site: 58
>>> Seems to have no N-terminal signal sequence

----- Final Results -----
              bacterial cytoplasm --- Certainty = 0.5121 (Affirmative) < succ>
              bacterial membrane  --- Certainty = 0.0000 (Not Clear)   < succ>
              bacterial outside   --- Certainty = 0.0000 (Not Clear)   < succ>
```

The protein has homology with the following sequences in the GENPEPT database:

```
>GP:AAF99694 GB:AF267498 ABC transporter OrfX [Streptococcus mutans]
Identities = 118/242 (48%), Positives = 175/242 (71%), Gaps = 1/242 (0%)

Query:     5 INHLEKVFRTRFSKEETRALQDVDFKVEQGEFIAIMGESGSGKTTLLNILATLEKPTNGQ   64
             ++HL+KV++T+        AL+D+ F V++GEFIAIMGESGSGK+TLLNILA ++ P++G
Sbjct:     6 VSHLKKVYKTQEGLTN-EALKDITFSVQEGEFIAIMGESGSGKSTLLNILACMDYPSSGH   64

Query:    65 VILNGEDITKIKEAKLASFRLKNLGFVFQDFNLLDTLSVRDNIYLPLVLDRKRYKEMDHR  124
             +I N   + K+K+ + A FR +++GF+FQ+FNLL+  + +DN+ +P+++   +    + R
Sbjct:    65 IIFNNYQLEKVKDEEAAVFRSRHIGFIFQNFNLLNIFNNKDNLLIPVIISGSKVNSYEKR  124

Query:   125 LSELSSHLRIDDLLDKRPFELSGGQKQRVAIARSLITNPQILLADEPTAALDYRNSEDLL  184
             L +L++ + I+ LL K P+ELSGGQ+QR+AIAR+LI NP ++LADEPT  LD + S+ +L
Sbjct:   125 LRDLAAVVGIESLLSKYPYELSGGQQQRLAIARALIMNPDLILADEPTGQLDSKTSQRIL  184

Query:   185 NLFETINLDGQTILMVTHSANAASHAKRVLFIKDGRIFHQLYRGNKNNSEFNKDISLTMS  244
             NL   IN    +TILMVTHS  AAS+A RVLFIKDG IF+QL RG K+    F   I + +
Sbjct:   185 NLLSNINAKRKTILMVTHSPKAASYANRVLFIKDGVIENQLVRGCKSREGFLDQIIMAQA  244

Query:   245 AI                                                            246
             ++
Sbjct:   245 SL                                                            246
```

A related DNA sequence was identified in *S. pyogenes* <SEQ ID 2119> which encodes the amino acid sequence <SEQ ID 2120>. Analysis of this protein sequence reveals the following:

```
Possible Site: 45
>>> Seems to have no N-terminal signal sequence

----- Final Results -----
              bacterial cytoplasm --- Certainty = 0.2131 (Affirmative) < succ>
              bacterial membrane  --- Certainty = 0.0000 (Not Clear)   < succ>
              bacterial outside   --- Certainty = 0.0000 (Not Clear)   < succ>
```

An alignment of the GAS and GBS proteins is shown below:

```
Identities = 91/222 (40%), Positives = 142/222 (62%), Gaps = 2/222 (0%)

Query:     2 LLEINHLEKVFRTRFSKEETRALQDVDFKVEQGEFIAIMGESGSGKTTLLNILATLEKPT   61
             LL +  + K +      EE   L+ +D +V +G+F+AIMG SGSGK+TL+NI+   L+KP
Sbjct:     1 LLNLKDIRKSYH--LGTEEFAILKGIDLEVNEGDFLAIMGPSGSGKSTLMNIIGCLDKPG   58

Query:    62 NGQVILNGEDITKIKEAKLASFRLKNLGFVFQDFNLLDTLSVRDNIYLPLVLDRKRYKEM  121
             +G   + G D++ + + +LA  R + +GFVFQ+FNL+  +   N+ LPL     KE
Sbjct:    59 SGSYAIEGRDVSSLSDNELADLRNQKIGFVFQNFNLMPKLTACQNVELPLTYMNVPKKER  118
```

-continued

```
Query:    122  DHRLSELSSHLRIDDLLDKRPFELSGGQKQRVAIARSLITNPQILLADEPTAALDYRNSE   181
               R   E+    +  +++    +  +P ELSGGQKQRVAIAR+L+TNP  +L DEPT ALD  +  S
Sbjct:    119  RKRALEMLKLVGLEERSEFKPMELSGGQKQRVAIARALVTNPSFILGDEPTGALDTKTSV   178

Query:    182  DLLNLFETINLDGQTILMVTHSANAASHAKRVLFIKDGRIFH                    223
               +++LF+  N +G+TI+++TH     A+   K+  +  ++DG I H
Sbjct:    179  QIMDLFKQFNDNGKTIIIITHEPEVAALCKKTVILRDGNIEH                    220
```

Based on this analysis, it was predicted that these proteins and their epitopes could be useful antigens for vaccines or diagnostics.

EXAMPLE 688

A DNA sequence (GBSx0730) was identified in *S. agalactiae* <SEQ ID 2121> which encodes the amino acid sequence <SEQ ID 2122>. This protein is predicted to be nisin-resistance protein. Analysis of this protein sequence reveals the following:

```
Possible site: 18
>>> Seems to have an uncleavable N-term signal seq
    INTEGRAL    Likelihood = -13.16    Transmembrane    8-24 (1-31)

----- Final Results -----
            bacterial membrane --- Certainty = 0.6265 (Affirmative) < succ>
             bacterial outside --- Certainty = 0.0000 (Not Clear)   < succ>
            bacterial cytoplasm --- Certainty = 0.0000 (Not Clear)  < succ>
```

The protein has homology with the following sequences in the GENPEPT database:

```
>GP:AAB08491 GB:U25181 nisin-resistance protein [Lactococcus lactis]
Identities = 108/318 (33%), Positives = 190/318 (58%), Gaps = 8/318 (2%)

Query:      3  RKIVLLFVVPMLIVLGILGVVVHYYGSALNIYLLPPSSERYGRVILDRVEQRGLYSQGRQ    62
               ++I+L  V    + LGI     ++++G   NIYL+PPS ++Y RV L  +++ GL++  ++
Sbjct:      5  KRILLGLVAVCALFLGI----IYFWGYKFNIYLVPPSPQKYVRVALKNMDELGLFTDSKE    60

Query:     63  WQIIRQRSEKKLKTSKSYQESRNIVQEAVRYGGGKHSQILSKETVRRDTLDSRYPEYRRL   122
               W    ++++  ++   +K+Y E+    +Q+A++   GGKHS  I  +E  +  ++        +
Sbjct:     61  WVETKKKTIEETSNAKNYAETIPFLQKAIKVAGGKHSFIEHEEDISKRSITKYIKPKAEI   120

Query:    123  NEDILLITIPSISKLDKRSISHYSGKLQNILMEKSYKGLILDLSNNTGGNMIPMIGGVAS   182
                +  L++TIP   +  D  ++ S  Y+    L++     +  +Y  G+I+DL    N  GG++  PM+  G++
Sbjct:    121  EGNTLILTIPEFTGNDSQA-SDYANFLESSFHKNNYNGVIVDLRGNRGGDLSPMVLGLSP   179

Query:    183  ILPNDTLFHYTDKYGNKKTITMKNIPLEALKISRKTINTKHV---PIAIITNHKTASSAE   239
               +LP+ TLF Y DK  + K  +  ++N  +  +    S K   + K +    PIA++  ++  T SS E
Sbjct:    180  LLPDGTLFTYVDKSSHSKPVELQNGEINSGGSSTKVSDNKKIKKAPIAVLIDNNTGSSGE   239

Query:    240  MTFLSFKGLPNVKSFGQATAGYTTVNETFMLYDGARLALTTGIVSDRQGYKYENTPILPD   299
               +T L  FKG+PNVK    G  +AGYT+  N+T   LYDG+ L  +T+   V DR     Y+N PI  PD
Sbjct:    240  LTALCFKGIPNVKFLGSDSAGYTSANQTVYLYDGSTLQITSAFVKDRTNNIYKNFPISPD   299

Query:    300  QVTSLPLQESQSWLKSRI                                            317
                 T+    +       W+KS+I
Sbjct:    300  IQTNNAKSSAIEWIKSQI                                            317
```

No corresponding DNA sequence was identified in *S. pyogenes*.

A related GBS gene <SEQ ID 8641> and protein <SEQ ID 8642> were also identified. Analysis of this protein sequence reveals the following:

```
Lipop: Possible site: -1 Crend: 3
McG: Discrim Score: 12.71
GvH: Signal Score (-7.5): -5.64
Possible site: 18
>>> Seems to have an uncleavable N-term signal seq
ALOM program count: 1 value: -13.16 threshold: 0.0
```

```
                              -continued
INTEGRAL     Likelihood = -13.16   Transmembrane   8-24 (1-31)
PERIPHERAL   Likelihood = 4.03     174
modified ALOM score: 3.13

*** Reasoning Step: 3

----- Final Results -----
              bacterial membrane --- Certainty = 0.6265 (Affirmative) < succ>
              bacterial outside  --- Certainty = 0.0000 (Not Clear)  < succ>
              bacterial cytoplasm --- Certainty = 0.0000 (Not Clear)  < succ>
```

The protein has homology with the following sequences in the databases:

```
34.7/62.5% over 311aa
Lactococcus lactis
GP|805128| nisin-resistance protein Insert characterized
ORF01108(343-1254 of 1560)
GP|805128|gb|AAB08491.1||U25181(7-318 of 318) nisin-resistance protein
{Lactococcus lactis}
% Match = 19.4
% Identity = 34.6   % Similarity = 62.4
Matches = 106  Mismatches = 112   Conservative Sub.s = 85
    231       261       291       321       351                393       423
LKLSNL*EIGLKM*GYSKPFCHIIDLKRKGEQEMRRKIVLLFVVPMLIVLGILGV------VVHYYGSALNIYLLPPSSE
                                    : |:||:: |       :::::|   :||||:||| :
                                    MKIGKRILLGLVAVCALFLGIIYFWGYKFNIYLVPPSPQ
                                         10        20        30

453       483       513       543       573       603       633       663
RYGRVILDRVEQRGLYSQGRQWQIIRQRSEKKLKTSKSYQESRNIVQEAVRYGGGKHSQILSKETVRRDTLDSRYPEYRR
:|  ||  |  ::  ::|     :::: ::    :|:|   :|:|:::    ||||| |   :|  : : ::
KYVRVALKNMDELGLFTDSKEWVETKKKTIEETSNAKNYAETIPFLQKAIKVAGGKHSFIEHEEDISKRSITKYIKPKAE
       50        60        70        80        90       100       110

693       723       753       783       813       843       873       903
LNEDILLITIPSISKLDKRSISHYSGKLQNILMEKSYKGLILDLSNNTGGNMIPMIGGVASILPNDTLFHYTDKYGNKKT
: :|::|||   :   | |:   |:: : :| |:||     ||:: ||:    :|:  ||| ||| |   |
IEGNTLILTIPEFTGNDSQA-SDYANFLESSFHKNNYNGVIVDLRGNRGGDLSPMVLGLSPLLPDGTLFTYVDKSSHSKP
       130       140       150       160       170       180       190

933       963       984      1014      1044      1074      1104      1134
ITMKNIPLEALKISRKTINTKHV---PIAIITNHKTASSAEMTFLSFKGLPNVKSFGQATAGYTTVNETFMLYDGARLAL
: ::|   : :    |  |   :   |||:: ::  |  | |||  | :|||: |: |||| |: | ||| : :
VELQNGEINSGGSSTKVSDNKKIKKAPIAVLIDNNTGSSGELTALCFKGIPNVKFLGSDSAGYTSANQTVYLYDGSTLQI
       210       220       230       240       250       260       270

1164      1194      1224      1254      1284      1314      1344      1374
TTGIVSDRQGYKYENTPILPDQVTSLPLQESQSWLKSRINQN*GIINKGELYVIRNQSLRKSFSYTPFKRRDKGSTRRRF
|:   |  ||   |:| ||  |:        :|||:|
TSAFVKDRTNNIYKNFPISPDIQTNNAKSSAIEWIKSQIK
```

SEQ ID 2122 (GBS38) was expressed in *E. coli* as a His-fusion product. SDS-PAGE analysis of total cell extract is shown in FIG. 14 (lane 7; MW 37 kDa). It was also expressed in *E. coli* as a GST-fusion product. SDS-PAGE analysis of total cell extract is shown in FIG. 16 (lane 12; MW 62 kDa).

Based on this analysis, it was predicted that these proteins and their epitopes could be useful antigens for vaccines or diagnostics.

EXAMPLE 689

A DNA sequence (GBSx0731) was identified in *S. agalactiae* <SEQ ID 2123> which encodes the amino acid sequence <SEQ ID 2124>. Analysis of this protein sequence reveals the following:

```
Possible site: 20
>>> Seems to have an uncleavable N-term signal seq

----- Final Results -----
              bacterial membrane --- Certainty = 0.0000 (Not Clear) < succ>
              bacterial outside  --- Certainty = 0.0000 (Not Clear) < succ>
              bacterial cytoplasm --- Certainty = 0.0000 (Not Clear) < succ>
```

The protein has no significant homology with any sequences in the GENPEPT database.

A related DNA sequence was identified in *S. pyogenes* <SEQ ID 2125> which encodes the amino acid sequence <SEQ ID 2126>. Analysis of this protein sequence reveals the following:

```
Possible site: 17
>>> Seems to have no N-terminal signal sequence

----- Final Results -----
            bacterial cytoplasm --- Certainty = 0.1369 (Affirmative) < succ>
            bacterial membrane  --- Certainty = 0.0000 (Not Clear)   < succ>
             bacterial outside  --- Certainty = 0.0000 (Not Clear)   < succ>
```

An alignment of the GAS and GBS proteins is shown below:

```
Identities = 31/49 (63%), Positives = 43/49 (87%)

Query:  6  KKLTKSLGPIGKLISIIPDTTELIGKAIDNSRPIIEKELDRRHEKKTDL  54
           K++ K+LG +GKL+SI+PDTTE+IGK IDNSRPIIEK ++++HEK+  L
Sbjct:  3  KRIRKALGVVGKLMSIVPDTTEIIGKTIDNSRPIIEKRMEQKHEKEMQL  51
```

Based on this analysis, it was predicted that these proteins and their epitopes could be useful antigens for vaccines or diagnostics.

EXAMPLE 690

A DNA sequence (GBSx0732) was identified in *S. agalactiae* <SEQ ID 2127> which encodes the amino acid sequence <SEQ ID 2128>. Analysis of this protein sequence reveals the following:

```
Possible site: 54
>>> Seems to have no N-terminal signal sequence

----- Final Results -----
            bacterial cytoplasm --- Certainty = 0.3644 (Affirmative) < succ>
            bacterial membrane  --- Certainty = 0.0000 (Not Clear)   < succ>
             bacterial outside  --- Certainty = 0.0000 (Not Clear)   < succ>
```

The protein has no significant homology with any sequences in the GENPEPT database, but there is homology to SEQ ID 2126.

Based on this analysis, it was predicted that this protein and its epitopes, could be useful antigens for vaccines or diagnostics.

EXAMPLE 691

A DNA sequence (GBSx0733) was identified in *S. agalactiae* <SEQ ID 2129> which encodes the amino acid sequence <SEQ ID 2130>. This protein is predicted to be 28 kd outer membrane protein precursor (yaeC). Analysis of this protein sequence reveals the following:

```
Possible site: 16
>>> May be a lipoprotein

----- Final Results -----
            bacterial membrane  --- Certainty = 0.0000 (Not Clear)   < succ>
             bacterial outside  --- Certainty = 0.0000 (Not Clear)   < succ>
            bacterial cytoplasm --- Certainty = 0.0000 (Not Clear)   < succ>
```

The protein has homology with the following sequences in the GENPEPT database:

```
>GP:CAB59827 GB:AJ012388 hypothetical protein [Lactococcus lactis]
Identities = 123/290 (42%), Positives = 178/290 (60%), Gaps = 18/290 (6%)

Query:    1 MKIKKLLGLTTTVVISALILGAC------GQSKNEDAKVVRVGTMVKSKTEKARWDKIEE   54
            +K +++L +T +++ +I+G          G     +K+V++G M    K E    W ++++
Sbjct:    3 VKNRRIL-ITIIILVFIIIVGGIFAFSHSGNKSKVSSKIVKIGLMPGGKQEDVIWKQVQK   61

Query:   55 LVKKK-GVKLKFTEFTDYTQPNKALESDEIDINAFQHYNYLNNWNKANKTNLVSVAETYF  113
               K + G+ LKF  FTD  +PNKAL + E+D+NAFQHY YL +WNKAN  N+VS+ +T
Sbjct:   62 NAKDQFGITLKFVNFTDGDEPNKALVNHEVDLNAFQHYAYLKSWNKANNGNIVSIGDTII  121

Query:  114 TSFRLYSGTKNGKGKYQTVSEIPNKATITIPNDAVNESRSLYLLQSAGLLKLKVSGDALA  173
               T    LYS        KY+ V EIP+K+TI IPND   NESR+LY+L++AGL+KL   S      LA
Sbjct:  122 TPIHLYST------KYKKVDEIPDKSTIAIPNDITNESRALYVLKNAGLIKLDTSRGVLA  175

Query:  174 TMSDVVSNPKSLDLKEVDAAQTARSLDSTDAAVINNDFVTEAGINPKSAIFIEPKSKNAK  233
              T+ D+   NPKSL +KE+DA+QT R+LDS    AAVIN +F   A   + K +I+ EP ++++
Sbjct:  176 TVKDIRENPKSLIIKEIDASQTPRALDSVAAAVINYNFAISAKNSDKESIYQEPLNEDSA  235

Query:  234 QWYNLLVAQKGWQDKSKAKAIKEVVKAYHTDAVKKVIEKT-SQGLDQPVW           282
              QW N + A    Q    K  KEVVKAY       +  +I+K    G + P W
Sbjct:  236 QWINFIAAN---QSDKNNKVYKEVVKAYEQKNIADIIKKEYPDGGELPAW          282
```

A related DNA sequence was identified in *S. pyogenes* <SEQ ID 2131> which encodes the amino acid sequence <SEQ ID 2132>. Analysis of this protein sequence reveals the following:

```
Possible site: 24
>>> Seems to have no N-terminal signal sequence

----- Final Results -----
            bacterial cytoplasm --- Certainty = 0.1766 (Affirmative) < succ>
            bacterial membrane  --- Certainty = 0.0000 (Not Clear)   < succ>
             bacterial outside  --- Certainty = 0.0000 (Not Clear)   < succ>
```

An alignment of the GAS and GBS proteins is shown below:

```
Identities = 145/264 (54%), Positives = 203/264 (75%), Gaps = 2/264 (0%)

Query:   20 LGACGQSKNEDAKVVRVGTMVKSKTEKARWDKIEELVKKKGVKLKFTEFTDYTQPNKALE   79
            L AC + K +D   + +G M K+++++ARWDK+EEL+KK   + LK+ EFTDY+QPNKA+
Sbjct:    1 LVACSE-KQDDKNTLTIGVMTKTESDQARWDKVEELLKKDNITLKYKEFTDYSQPNKAVA   59

Query:   80 SDEIDINAFQHYNYLNNWNKANKTNLVSVAETYFTSFRLYSGT-KNGKGKYQTVSEIPNK  138
            + E+DINAFQHYN+LNNWNK NK +LV++A+TY +     L+SGT ++GK KY++V+++PN
Sbjct:   60 NGEVDINAFQHYNFLNNWNKENKEHLVAIADTYISPINLFSGTSQDGKAKYKSVADLPNG  119

Query:  139 ATITIPNDAVNESRSLYLLQSAGLLKLKVSGDALATMSDVVSNPKSLDLKEVDAAQTARS  198
                I +PNDA NESR+LY+LQSAGL+KL VSGD LAT++++  N K LD+KE+DA+QTAR+
Sbjct:  120 TQIAVPNDATNESRALYVLQSAGLIKLNVSGDQLATIANISENKKKLDIKELDASQTARA  179

Query:  199 LDSTDAAVINNDFVTEAGINPKSAIFIEPKSKNAKQWYNLLVAQKGWQDKSKAKAIKEVV  258
            L S DAAV+NN +    A I+ K+++F E    N+KQW N++   QK W+    KA AIK+++
Sbjct:  180 LVSADAAVVNNSYAVPAKIDYKTSLFKEKADDNSKQWINIIAGQKDWEKSEKADAIKKLI  239

Query:  259 KAYHTDAVKKVIEKTSQGLDQPVW                                    282
            KAY TD VKKV+EKTS G+D  VW
Sbjct:  240 KAYQTDEVKKVVEKTSNGIDVSVW                                    263
```

SEQ ID 2130 (GBS96) was expressed in *E. coli* as a His-fusion product. SDS-PAGE analysis of total cell extract is shown in FIG. 19 (lane 7; MW 32 kDa). It was also expressed in *E. coli* as a GST-fusion product. SDS-PAGE analysis of total cell extract is shown in FIG. 22 (lane 3; MW 57.2 kDa).

Figure 290:
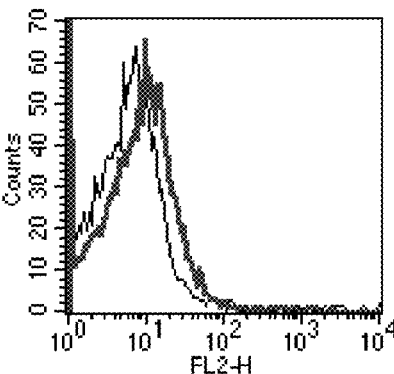

The GBS96-GST fusion product was purified (FIG. 195, lane 10) and used to immunise mice. The resulting antiserum was used for FACS (FIG. 290), which confirmed that the protein is immunoaccessible on GBS bacteria.

Based on this analysis, it was predicted that these proteins and their epitopes could be useful antigens for vaccines or diagnostics.

EXAMPLE 692

A DNA sequence (GBSx0734) was identified in *S. agalactiae* <SEQ ID 2133> which encodes the amino acid sequence <SEQ ID 2134>. Analysis of this protein sequence reveals the following:

```
Possible site: 61
>>> Seems to have no N-terminal signal sequence

----- Final Results -----
            bacterial cytoplasm --- Certainty = 0.5103 (Affirmative) < succ>
            bacterial membrane  --- Certainty = 0.0000 (Not Clear)   < succ>
              bacterial outside --- Certainty = 0.0000 (Not Clear)   < succ>
```

A related GBS nucleic acid sequence <SEQ ID 9807> which encodes amino acid sequence <SEQ ID 9808> was also identified.

The protein has no significant homology with any sequences in the GENPEPT database.

No corresponding DNA sequence was identified in S. pyogenes.

Based on this analysis, it was predicted that these proteins and their epitopes could be useful antigens for vaccines or diagnostics.

EXAMPLE 693

A DNA sequence (GBSx0735) was identified in *S. agalactiae* <SEQ ID 2135> which encodes the amino acid sequence <SEQ ID 2136>. This protein is predicted to be glucose-inhibited division protein (gid). Analysis of this protein sequence reveals the following:

```
Possible site: 18
>>> Seems to have no N-terminal signal sequence

----- Final Results -----
            bacterial cytoplasm --- Certainty = 0.0656 (Affirmative) < succ>
            bacterial membrane  --- Certainty = 0.0000 (Not Clear)   < succ>
              bacterial outside --- Certainty = 0.0000 (Not Clear)   < succ>
```

The protein has homology with the following sequences in the GENPEPT database:

```
>GP:CAB13486 GB:Z99112 glucose-inhibited division protein
[Bacillus subtilis]
Identities = 289/439 (65%), Positives = 352/439 (79%), Gaps = 10/439 (2%)

Query:   1 MSQSYINVIGAGLAGSEAAYQIAKRGIPVKLYEMRGVESTPQHKTDNFAELVCSNSFRGD   60
           M+Q  +NVIGAGLAGSEAA+Q+ARRGI VKLYEMR VR TP H TD FAELVCSNS R +
Sbjct:   1 MNQQTVNVIGAGLAGSEAAWQLAKRGIQVKLYEMRPVKQTPAHHTDKFAELVCSNSLRSN  60

Query:  61 SLTNAVGLLKEEMRRLDSIIMRNGEAHRVPAGGAMAVDREGYSEAVTEEIHKHPLIEVIR 120
           +L NAVG+LKEEMR LDS I+   +   VPAGGA+AVDR ++ +VT  +  HP + VI
Sbjct:  61 TLANAVGVLKEEMRALDSAIIAAADECSVPAGGALAVDRHEFAASVTNRVKNHPNVTVIN 120

Query: 121 DEITDIPGDAITVIATGPLTSDSLAAKIHELNGGDGFYFYDAAAPIVDKNTIDINKVYLK 180
           +E+T+IP +  T+IATGPLTS+SL+A++  EL G D  YFYDAAAPIV+K+++D++KVYLK
Sbjct: 121 EEVTEIP-EGPTIIATGPLTSESLSAQLKELTGEDYLYFYDAAAPIVEKDSLDMDKVYLK 179

Query: 181 SRYDKGEAAYLNCPMTKEEFMAFHEALTTAEEAPLNSFEKEKYFEGCMPIEVMAKRGIKT 240
           SRYDKGEAAYLNCPMT+EEF  FHEALT+AE  PL  FEKE +FEGCMPIEVMAKRG KT
Sbjct: 180 SRYDKGEAAYLNCPMTEEEFDRFHEALTSAETVPLKEFEKEIFFEGCMPIEVMAKRGKKT 239

Query: 241 MLYGPMKPVGLEYPEDYKGPRDGEFKTPYAVVQLRQDNAAGSLYNIVGFQTHLKWGEQKR 300
           ML+GPMKPVGLE+P     K        PYAVVQLRQD+AAG+LYNIVGFQTHLKWG+QK
Sbjct: 240 MLFGPMKPVGLEHPVTGK--------RPYAVVQLRQDDAAGTLYNIVGFQTHLKWGDQKE 291

Query: 301 VFQMIPGLENAEFVRYGVMHRNSYMDSPNLLNQTFATRKNPNLFFAGQMTGVEGYVESAA 360
           V ++IPGLEN E VRYGVMHRN++++SP+LL  T+  +    +LFFAGQMTGVEGYVESAA
Sbjct: 292 VLKLIPGLENVEIVRYGVMHRNTFINSPSLLKPTYQFKNRSDLFFAGQMTGVEGYVESAA 351

Query: 361 SGLVAGINAVRRFNGESEVVFPQTTAIGALPHYITHTDSKHFQPMNVNFGIIKELEGPRI 420
           SGLVAGINA +    GE  V+FPQ TAIG++ HYIT T+K+FQPMN NFG++KEL  +I
Sbjct: 352 SGLVAGINAAKLVLGEELVIFPQETAIGSMAHYITTTNQKNFQPMNANFGLLKELP-VKI 410
```

```
Query:  421 RDKKERYEAIATRALKDLE                                          439
            ++KKER E  A RA++ ++
Sbjct:  411 KNKKERNEQYANRAIETIQ                                          429
```

A related DNA sequence was identified in *S. pyogenes* <SEQ ID 2137> which encodes the amino acid sequence <SEQ ID 2138>. Analysis of this protein sequence reveals the following:

```
Possible site: 30
>>> Seems to have an uncleavable N-term signal seq
    INTEGRAL    Likelihood = -8.44     Transmembrane    12-28 (9-32)

----- Final Results -----
              bacterial membrane --- Certainty = 0.4376 (Affirmative) < succ>
               bacterial outside --- Certainty = 0.0000 (Not Clear)  < succ>
             bacterial cytoplasm --- Certainty = 0.0000 (Not Clear)  < succ>

RGD motif: 111-113
```

The protein has homology with the following sequences in the databases:

```
>GP:CAB13486 GB:Z99112 glucose-inhibited division protein
[Bacillus subtilis]
Identities = 292/435 (67%), Positives = 350/435 (80%), Gaps = 10/435 (2%)

Query:   59 INVIGAGLAGSEAAYQIAKRGIPVKLYEMRGVKATPQHKTTNFAELVCSNSFRGDSLTNA 118
            +NVIGAGLAGSEAA+Q+AKRGI VKLYEMR VK TP H T  FAELVCSNS R ++L NA
Sbjct:    6 VNVIGAGLAGSEAAWQLAKRGIQVKLYEMRPVKQTPAHHTDKFAELVCSNSLRSNTLANA  65

Query:  119 VGLLKEEMRRLDSIIMRNGEANRVPAGGAMAVDREGYAESVTAELENHPLIEVIRGEITE 178
            VG+LKEEMR LDS I+   +   VPAGGA+AVDR  +A  SVT  ++NHP + VI  E+TE
Sbjct:   66 VGVLKEEMRALDSAIIAAADECSVPAGGALAVDRHEFAASVTNRVKNHPNVTVINEEVTE 125

Query:  179 IPDDAITVIATGPLTSDALAEKIHALNGGDGFYFYDAAAPIIDKSTIDMSKVYLKSRYDK 238
            IP+    T+IATGPLTS++L+ ++   L G D  YFYDAAAPI++K  +DM KVYLKSRYDK
Sbjct:  126 IPEGP-TIIATGPLTSESLSAQLKELTGEDYLYFYDAAAPIVEKDSLDMDKVYLKSRYDK 184

Query:  239 GEAAYLNCPMTKEEFMAFHEALTTAEEAPLNAFEKEKYFEGCMPIEVMAKRGIKTMLYGP 298
            GEAAYLNCPMT+EEF  FHEALT+AE   PL  FEKE +FEGCMPIEVMAKRG KTML+GP
Sbjct:  185 GEAAYLNCPMTEEEFDRFHEALTSAETVPLKEFEKEIFFEGCMPIEVMAKRGKKTMLFGP 244

Query:  299 MKPVGLEYPDDYTGPRDGEFKTPYAVVQLRQDNAAGSLYNIVGFQTHLKWGEQKRVFQMI 358
            MKPVGLE+P   TG R        PYAVVQLRQD+AAG+LYNIVGFQTHLKWG+QK V ++I
Sbjct:  245 MKPVGLEHP--VTGKR------PYAVVQLRQDDAAGTLYNIVGFQTHLKWGDQKEVLKLI 296

Query:  359 PGLENAEFVRYGVMHRNSYMDSPNLLTETFQSRSNPNLFFAGQMTGVEGYVESAASGLVA 418
            PGLEN E VRYGVMHRN++++SP+LL   T+Q  ++  +LFFAGQMTGVEGYVESAASGLVA
Sbjct:  297 PGLENVEIVRYGVMHRNTFINSPSLLKPTYQFKNRSDLFFAGQMTGVEGYVESAASGLVA 356

Query:  419 GINAARLFKREEALIFPQTTAIGSLPHYVTHADSKHFQPMNVNFGIIKELEGPRIRDKKE 478
            GINAA+L   EE +IFPQ TAIGS+ HY+T   +  K+FQPMN NFG++KEL    +I++KKE
Sbjct:  357 GINAAKLVLGEELVIFPQETAIGSMAHYITTTNQKNFQPMNANFGLLKELP-VKIKNKKE 415

Query:  479 RYEAIASRALADLDT                                              493
            R E  A+RA+  + T
Sbjct:  416 RNEQYANRAIETIQT                                              430
```

An alignment of the GAS and GBS proteins is shown below:

```
Identities = 395/439 (89%), Positives = 417/439 (94%)

Query:    4 SYINVIGAGLAGSEAAYQIAKRGIPVKLYEMRGVKSTPQHKTDNFAELVCSNSFRGDSLT  63
            +YINVIGAGLAGSEAAYQIAKRGIPVKLYEMRGVK+TPQHKT NFAELVCSNSFRGDSLT
Sbjct:   57 TYINVIGAGLAGSEAAYQIAKRGIPVKLYEMRGVKATPQHKTTNFAELVCSNSFRGDSLT 116

Query:   64 NAVGLLKEEMRRLDSIIMRNGEAHRVPAGGAMAVDREGYSEAVTEEIHKPLIEVIRDEI 123
            NAVGLLKEEMRRLDSIIMRNGEA+RVPAGGAMAVDREGY+E+VT E+  HPLIEVIR EI
Sbjct:  117 NAVGLLKEEMRRLDSIIMRNGEANRVPAGGAMAVDREGYAESVTAELENHPLIEVIRGEI 176
```

-continued

```
Query:   124 TDIPGDAITVIATGPLTSDSLAAKIHELNGGDGFYFYDAAAPIVDKNTIDINKVYLKSRY    183
             T+IP DAITVIATGPLTSD+LA KIH LNGGDGFYFYDAAAPI+DK+TID++KVYLKSRY
Sbjct:   177 TEIPDDAITVIATGPLTSDALAEKIHALNGGDGFYFYDAAAPIIDKSTIDMSKVYLKSRY    236

Query:   184 DKGEAAYLNCPMTKEEFMAFHEALTTAEEAPLNSFEKEKYFEGCMPIEVMAKRGIKTMLY    243
             DKGEAAYLNCPMTKEEFMAFHEALTTAEEAPLN+FEKEKYFEGCMPIEVMAKRGIKTMLY
Sbjct:   237 DKGEAAYLNCPMTKEEFMAFHEALTTAEEAPLNAFEKEKYFEGCMPIEVMAKRGIKTMLY    296

Query:   244 GPMKPVGLEYPEDYKGPRDGEFKTPYAVVQLRQDNAAGSLYNIVGFQTHLKWGEQKRVFQ    303
             GPMKPVGLEYP+DY GPRDGEFKTPYAVVQLRQDNAAGSLYNIVGFQTHLKWGEQKRVFQ
Sbjct:   297 GPMKPVGLEYPDDYTGPRDGEFKTPYAVVQLRQDNAAGSLYNIVGFQTHLKWGEQKRVFQ    356

Query:   304 MIPGLENAEFVRYGVMHRNSYMDSPNLLNQTFATRKNPNLFFAGQMTGVEGYVESAASGL    363
             MIPGLENAEFVRYGVMHRNSYMDSPNLL +TF +R NPNLFFAGQMTGVEGYVESAASGL
Sbjct:   357 MIPGLENAEFVRYGVMHRNSYMDSPNLLTETFQSRSNPNLFFAGQMTGVEGYVESAASGL    416

Query:   364 VAGINAVRRFNGESEVVFPQTTAIGALPHYITHTDSKHFQPMNVNFGIIKELEGPRIRDK    423
             VAGINA R F  E  ++FPQTTAIG+LPHY+TH DSKHFQPMNVNFGIIKELEGPRIRDK
Sbjct:   417 VAGINAARLFKREEALIFPQTTAIGSLPHYVTHADSKHFQPMNVNFGIIKELEGPRIRDK    476

Query:   424 KERYEAIATRALKDLEKFL                                            442
             KERYEAIA+RAL DL+   L
Sbjct:   477 KERYEAIASRALADLDTCL                                            495
```

Based on this analysis, it was predicted that these proteins and their epitopes could be useful antigens for vaccines or diagnostics.

EXAMPLE 694

A DNA sequence (GBSx0736) was identified in *S. agalactiae* <SEQ ID 2139> which encodes the amino acid sequence <SEQ ID 2140>. This protein is predicted to be transcriptional regulator (GntRfamily). Analysis of this protein sequence reveals the following:

```
Possible site: 13
>>> Seems to have no N-terminal signal sequence

----- Final Results -----
              bacterial cytoplasm --- Certainty = 0.5103(Affirmative) < succ>
               bacterial membrane --- Certainty = 0.0000(Not Clear)   < succ>
                bacterial outside --- Certainty = 0.0000(Not Clear)   < succ>
```

The protein has homology with the following sequences in the GENPEPT database:

```
>GP:BAB04138 GB:AP001508 transcriptional regulator (GntR family)
[Bacillus halodurans]
Identities = 83/229 (36%), Positives = 133/229 (57%), Gaps = 1/229 (0%)

Query:     2 LPAYIKIHDAIKKEIDKGTWKIGQRLPSERDLADDYSVSRMTLRQSITLLVEEGILERRV     61
             LP Y +I +  IK++I+  G   K G    L SER+ A+ Y VSRMT+RQ+I   LV +G + ++
Sbjct:     8 LPIYYQIEEQIKQQIESGVLKPGDMLKSEREYAEYYDVSRMTVRQAINNLVNQGYIYKKK    67

Query:    62 GSGTYVASHRVQEKMRGTTSFTEIVNSQGRKPSSKLISFQRKLANETEIQKLNLSQSDYV   121
             GSGTYV ++++ + G TSFTE +  +G +PSS+L+ F+   A       ++LNL ++   V
Sbjct:    68 GSGTYVQEKKIEQALNGLTSFTEDMRKRGMEPSSRLLKFELIPATAKIAKELNLKENTPV   127

Query:   122 VRMERVRYADKVPLVYEVASIPENLIKGFEQSEVTEHFFKTLTEN-GYEIGKSQQTIYAR   180
                ++R+RY D VP+  E     +P NL+KG  + +  ++ ++ + E    I   +Q I A
Sbjct:   128 TEIKRIRYGDGVPIAIERNLLPANLVKGLNEEIINQSLYQYIEEELNLRIADALQVIEAS   187

Query:   181 NASERVASHLEVNAGHAILALTQVSYFTDGKPFEYVHGQYVGDRFEFYL             229
                AS+  A  LE+    G  IL + + ++  DG   E V    Y   DR++F +
Sbjct:   188 TASKTEADLLEIQKGSPILLIERKTFLADGTVLELVKSAYRADRYKFMI             236
```

There is also homology to SEQ ID 1256.

Based on this analysis, it was predicted that this protein and its epitopes, could be useful antigens for vaccines or diagnostics.

EXAMPLE 695

A DNA sequence (GBSx0737) was identified in *S. agalactiae* <SEQ ID 2141> which encodes the amino acid sequence <SEQ ID 2142>. This protein is predicted to be GMP synthase (guaA). Analysis of this protein sequence reveals the following:

```
Possible site: 46
>>> Seems to have no N-terminal signal sequence
     INTEGRAL    Likelihood = -0.96    Transmembrane   228-244 (228-245)

----- Final Results -----
              bacterial membrane --- Certainty = 0.1383(Affirmative) < succ>
               bacterial outside --- Certainty = 0.0000(Not Clear)   < succ>
             bacterial cytoplasm --- Certainty = 0.0000(Not Clear)   < succ>
```

The protein has homology with the following sequences in the GENPEPT database:

```
>GP:AAD15805 GB:AF058326 GMP synthase [Lactococcus lactis]
Identities = 416/511 (81%), Positives = 467/511 (90%), Gaps = 3/511 (0%)

Query:   10 IQKIIVLDYGSQYNQLIARRIREFGVFSELKSHKITADEIRDINPIGIVLSGGPNSVYAD   69
            ++KIIVLDYGSQYNQLIARRIRE GVFSEL SHK+TA EIR+INPIGI+LSGGPNSVY +
Sbjct:    6 LEKIIVLDYGSQYNQLIARRIREIGVFSELMSHKVTAKEIREINPIGIILSGGPNSVYDE   65

Query:   70 GAFGIDEEIFELGIPILGICYGMQLITHKLGGKVLPAGEAGHREYGQSALRLRSESALFA  129
            G+F ID EIFELG+P+LGICYGMQL+++KLGG V  AGE    REYG + L+L  +SALFA
Sbjct:   66 GSFDIDPEIFELGLPVLGICYGMQLMSYKLGGMVEAAGE---REYGVAPLQLTEKSALFA  122

Query:  130 GTPQEQLVLMSHGDAVTEIPEGFHLVGDSVDCPFAAMENTEKQFYGIQFHPEVRHSVYGN  189
            GTP+ Q VLMSHGD VT IPEGFH+VG S + PFAA+ENTE+   YGIQFHPEVRHSV+G
Sbjct:  123 GTPEVQDVLMSHGDRVTAIPEGFHVVGTSPNSPFAAVENTERNLYGIQFHPEVRHSVHGT  182

Query:  190 DILKNFAVNICGARGDWSMDNFIDMEIAKIRETVGDRKVLLGLSGGVDSSVVGVLLQRAI  249
            ++L+NFA+NICGA+G+WSM+NFIDM+I  IRE VGD+KVLLGLSGGVDSSVVGVLLQRAI
Sbjct:  183 EMLRNFALNICGAKGNWSMENFIDMQIKDIREKVGDKKVLLGLSGGVDSSVVGVLLQRAI  242

Query:  250 GDQLTCIFVDHGLLRKNEGDQVMDMLGGKFGLNIIRVDASKRFLDLLSGVEDPERKRKII  309
            GDQLT IFVDHG LRK E DQVM+ LGGKFGLNII+VDA KRF+D L G+ DPE +RKII
Sbjct:  243 GDQLTSIFVDHGFLRKGEADQVMETLGGKFGLNIIKVDAQKRFMDKLVGLSDPETQRKII  302

Query:  310 GNEFVYVFDDEASKLKGVDFLAQGTLYTDIIESGTETAQTIKSHHNVGGLPEDMQFELIE  369
            GNEFVYVFDDEA+KL+GVDFLAQGTLYTD+IESGT+TAQTIKSHHNVGGLPEDMQF+LIE
Sbjct:  303 GNEFVYVFDDEANKLEGVDFLAQGTLYTDVIESGTDTAQTIKSHHNVGGLPEDMQFQLIE  362

Query:  370 PLNTLFKDEVRALGTALGMPDEVVWRQPFPGPGLAIRVMGEITEEKLETVRESDAILREE  429
            PLNTLFKDEVRALGT LGMPDE+VWRQPFPGPGLAIRV+G++TEEKLETVRESDAILREE
Sbjct:  363 PLNTLFKDEVRALGTQLGMPDEIVWRQPFPGPGLAIRVLGDLTEEKLETVRESDAILREE  422

Query:  430 IAKAGLDRDVWQYFTVNTGVRSVGVMGDGRTYDYTIAIRAITSIDGMTADFAQLPWDVLK  489
            IA +GL+RDVWQYFTVNT V+SVGVMGD RTYDYT+AIRAITSIDGMTADFAQLPWD+L+
Sbjct:  423 IAASGLERDVWQYFTVNTDVKSVGVMGDQRTYDYTLAIRAITSIDGMTADFAQLPWDLLQ  482

Query:  490 KISTRIVNEVDHVNRIVYDITSKPPATVEWE                              520
            KIS RIVNEVDHVNRIVYDITSKPPATVEW+
Sbjct:  483 KISKRIVNEVDHVNRIVYDITSKPPATVEWQ                              513
```

A related DNA sequence was identified in *S. pyogenes* <SEQ ID 2143> which encodes the amino acid sequence <SEQ ID 2144>. Analysis of this protein sequence reveals the following:

```
Possible site: 46
>>> Seems to have no N-terminal signal sequence
     INTEGRAL    Likelihood = -0.96    Transmembrane   228-244 (228-245)
```

-continued

```
----- Final Results -----
              bacterial membrane --- Certainty = 0.1383(Affirmative) < succ>
              bacterial outside  --- Certainty = 0.0000(Not Clear)   < succ>
              bacterial cytoplasm --- Certainty = 0.0000(Not Clear)  < succ>
RGD motif: 203-205
```

The protein has homology with the following sequences in the databases:

```
>GP:AAD15805 GB:AF058326 GMP synthase [Lactococcus lactis]
Identities = 411/511 (80%), Positives = 464/511 (90%), Gaps = 3/511 (0%)

Query:   10 VQKIIVLDYGSQYNQLIARRIREFGVFSELKSHKITAQELREINPIGIVLSGGPNSVYAD   69
            ++KIIVLDYGSQYNQLIARRIRE GVFSEL SHK+TA+E+REINPIGI+LSGGPNSVY +
Sbjct:    6 LEKIIVLDYGSQYNQLIARRIREIGVFSELMSHKVTAKEIREINPIGIILSGGPNSVYDE   65

Query:   70 NAFGIDPEIFELGIPILGICYGMQLITHKLGGKVVPAGQAGNREYGQSTLHLRETSKLFS  129
             +F IDPEIFELG+P+LGICYGMQL+++KLGG V  AG+    REYG + L  E S LF+
Sbjct:   66 GSFDIDPEIFELGLPVLGICYGMQLMSYKLGGMVEAAGE---REYGVAPLQLTEKSALFA  122

Query:  130 GTPQEQLVLMSHGDAVTEIPEGFHLVGDSNDCPYAAIENTEKNLYGIQFHPEVRHSVYGN  189
            GTP+ Q VLMSHGD VT IPEGFH+VG S + P+AA+ENTE+NLYGIQFHPEVRHSV+G
Sbjct:  123 GTPEVQDVLMSHGDRVTAIPEGFHVVGTSPNSPFAAVENTERNLYGIQFHPEVRHSVHGT  182

Query:  190 DILKNFAISICGARGDWSMDNFIDMEIAKIRETVGDRKVLLGLSGGVDSSVVGVLLQKAI  249
            ++L+NFA++ICGA+G+WSM+NFIDM+I   IRE VGD+KVLLGLSGGVDSSVVGVLLQ+AI
Sbjct:  183 EMLRNFALNICGAKGNWSMENFIDMQIKDIREKVGDKKVLLGLSGGVDSSVVGVLLQRAI  242

Query:  250 GDQLTCIFVDHGLLRKDEGDQVMGMLGGKFGLNIIRVDASKRFLDLLADVEDPEKKRKII  309
            GDQLT IFVDHG LRK E DQVM  LGGKFGLNII+VDA KRF+D L  + DPE +RKII
Sbjct:  243 GDQLTSIFVDHGFLRKGEADQVMETLGGKFGLNIIKVDAQKRFMDKLVGLSDPETQRKII  302

Query:  310 GNEFVYVFDDEASKLKGVDFLAQGTLYTDIIESGTETAQTIKSHHNVGGLPEDMQFELIE  369
            GNEFVYVFDDEA+KL+GVDFLAQGTLYTD+IESGT+TAQTIKSHHNVGGLPEDMQF+LIE
Sbjct:  303 GNEFVYVFDDEANKLEGVDFLAQGTLYTDVIESGTDTAQTIKSHHNVGGLPEDMQFQLIE  362

Query:  370 PLNTLFKDEVRALGIALGMPEEIVWRQPFPGPGLAIRVMGAITEEKLETVRESDAILREE  429
            PLNTLFKDEVRALG  LGMP+EIVWRQPFPGPGLAIRV+G +TEEKLETVRESDAILREE
Sbjct:  363 PLNTLFKDEVRALGTQLGMPDEIVWRQPFPGPGLAIRVLGDLTEEKLETVRESDAILREE  422

Query:  430 IAKAGLDRDVWQYFTVNTGVRSVGVMGDGRTYDYTIAIRAITSIDGMTADFAQLPWDVLK  489
            IA +GL+RDVWQYFTVNT V+SVGVMGD RTYDYT+AIRAITSIDGMTADFAQLPWD+L+
Sbjct:  423 IAASGLERDVWQYFTVNTDVKSVGVMGDQRTYDYTLAIRAITSIDGMTADFAQLPWDLLQ  482

Query:  490 KISTRIVNEVDHVNRIVYDITSKPPATVEWE                              520
            KIS RIVNEVDHVNRIVYDITSKPPATVEW+
Sbjct:  483 KISKRIVNEVDHVNRIVYDITSKPPATVEWQ                              513
```

An alignment of the GAS and GBS proteins is shown below:

```
Identities = 487/520 (93%), Positives = 505/520 (96%)

Query:    1 MTDISILNDIQKIIVLDYGSQYNQLIARRIREFGVFSELKSHKITADEIRDINPIGIVLS   60
            MT+ISILND+QKIIVLDYGSQYNQLIARRIREFGVFSELKSHKITA E+R+INPIGIVLS
Sbjct:    1 MTEISILNDVQKIIVLDYGSQYNQLIARRIREFGVFSELKSHKITAQELREINPIGIVLS   60

Query:   61 GGPNSVYADGAFGIDEEIFELGIPILGICYGMQLITHKLGGKVLPAGEAGHREYGQSALR  120
            GGPNSVYAD AFGID EIFELGIPILGICYGMQLITHKLGGKV+PAG AG+REYGQS L
Sbjct:   61 GGPNSVYADNAFGIDPEIFELGIPILGICYGMQLITHKLGGKVVPAGQAGNREYGQSTLH  120

Query:  121 LRSESALFAGTPQEQLVLMSHGDAVTEIPEGFHLVGDSVDCPFAAMENTEKQFYGIQFHP  180
            LR  S LF+GTPQEQLVLMSHGDAVTEIPEGFHLVGDS DCP+AA+ENTEK  YGIQFHP
Sbjct:  121 LRETSKLFSGTPQEQLVLMSHGDAVTEIPEGFHLVGDSNDCPYAAIENTEKNLYGIQFHP  180

Query:  181 EVRHSVYGNDILKNFAVNICGARGDWSMDNFIDMEIAKIRETVGDRKVLLGLSGGVDSSV  240
            EVRHSVYGNDILKNFA++ICGARGDWSMDNFIDMEIAKIRETVGDRKVLLGLSGGVDSSV
Sbjct:  181 EVRHSVYGNDILKNFAISICGARGDWSMDNFIDMEIAKIRETVGDRKVLLGLSGGVDSSV  240

Query:  241 VGVLLQRAIGDQLTCIFVDHGLLRKNEGDQVMDMLGGKFGLNIIRVDASKRFLDLLSGVE  300
            VGVLLQ+AIGDQLTCIFVDHGLLRK+EGDQVM MLGGKFGLNIIRVDASKRFLDLL+ VE
Sbjct:  241 VGVLLQKAIGDQLTCIFVDHGLLRKDEGDQVMGMLGGKFGLNIIRVDASKRFLDLLADVE  300
```

```
Query:  301  DPERKRKIIGNEFVYVFDDEASKLKGVDFLAQGTLYTDIIESGTETAQTIKSHHNVGGLP  360
             DPE+KRKIIGNEFVYVFDDEASKLKGVDFLAQGTLYTDIIESGTETAQTIKSHHNVGGLP
Sbjct:  301  DPEKKRKIIGNEFVYVFDDEASKLKGVDFLAQGTLYTDIIESGTETAQTIKSHHNVGGLP  360

Query:  361  EDMQFELIEPLNTLFKDEVRALGTALGMPDEVVWRQPFPGPGLAIRVMGEITEEKLETVR  420
             EDMQFELIEPLNTLFKDEVRALG ALGMP+E+VWRQPFPGPGLAIRVMG ITEEKLETVR
Sbjct:  361  EDMQFELIEPLNTLFKDEVRALGIALGMPEEIVWRQPFPGPGLAIRVMGAITEEKLETVR  420

Query:  421  ESDAILREEIAKAGLDRDVWQYFTVNTGVRSVGVMGDGRTYDYTIAIRAITSIDGMTADF  480
             ESDAILREEIAKAGLDRDVWQYFTVNTGVRSVGVMGDGRTYDYTIAIRAITSIDGMTADF
Sbjct:  421  ESDAILREEIAKAGLDRDVWQYFTVNTGVRSVGVMGDGRTYDYTIAIRAITSIDGMTADF  480

Query:  481  AQLPWDVLKKISTRIVNEVDHVNRIVYDITSKPPATVEWE                     520
             AQLPWDVLKKISTRIVNEVDHVNRIVYDITSKPPATVEWE
Sbjct:  481  AQLPWDVLKKISTRIVNEVDHVNRIVYDITSKPPATVEWE                     520
```

Based on this analysis, it was predicted that these proteins and their epitopes could be useful antigens for vaccines or diagnostics.

EXAMPLE 696

A DNA sequence (GBSx0740) was identified in *S. agalactiae* <SEQ ID 2145> which encodes the amino acid sequence <SEQ ID 2146>. This protein is predicted to be branched chain amino acid ABC transporter, periplasmic amino acid-bind. Analysis of this protein sequence reveals the following:

```
Possible site: 58
>>> Seems to have no N-terminal signal sequence

----- Final Results -----
             bacterial cytoplasm --- Certainty = 0.0957(Affirmative) < succ>
             bacterial membrane  --- Certainty = 0.0000(Not Clear)   < succ>
              bacterial outside  --- Certainty = 0.0000(Not Clear)   < succ>
```

A related GBS nucleic acid sequence <SEQ ID 9409> which encodes amino acid sequence <SEQ ID 9410> was also identified.

The protein has homology with the following sequences in the GENPEPT database:

```
>GP:AAD36211 GB:AE001771 branched chain amino acid ABC transporter,
periplasmic amino acid-binding protein [Thermotoga maritima]
Identities = 31/92 (33%), Positives = 51/92 (54%), Gaps = 4/92 (4%)

Query:   26  AKAFHDHYVKAYGEEPSMFSALSYDAVYMAAKSAKGAKTSID---IKKALAKLKDFKGVT   82
             AK F + Y + YG+EP+ +AL YDA YM     A    SD   I + + K ++F G +
Sbjct:  275  AKKFVEVYKEKYGKEPAALNALGYDA-YMVLLDAIERAGSFDREKIAEEIRKTRNFNGAS  333

Query:   83  GKMSIDKNHNVVKSAYVVKLEDGKTSSVNIIS                             114
             G ++ID+N + +KS V  +++G      +I+
Sbjct:  334  GIINIDENGDAIKSVVVNIVKNGSVDFEAVIN                             365
```

No corresponding DNA sequence was identified in *S. pyogenes*.

Figure 141:
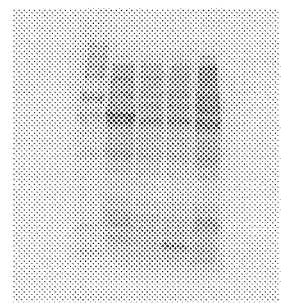

SEQ ID 9410 (GBS660) was expressed in *E. coli* as a GST-fusion product. SDS-PAGE analysis of total cell extract is shown in FIG. 135 (lane 8 & 9; MW 71.5 kDa)+ 10 ; MW 27 kDa). It was also expressed in *E. coli* as a His-fusion product. SDS-PAGE analysis of total cell extract is shown in FIG. 141 (lane 2; MW 46.5 kDa) and in FIG. 181, (lane 3; MW 46 kDa).

GBS660-His was purified as shown in FIG. 233, lane 5-6.

Based on this analysis, it was predicted that these proteins and their epitopes could be useful antigens for vaccines or diagnostics.

EXAMPLE 697

A DNA sequence (GBSx0741) was identified in *S. agalactiae* <SEQ ID 2147> which encodes the amino acid sequence <SEQ ID 2148>. Analysis of this protein sequence reveals the following:

```
Possible site: 27
>>> Seems to have a cleavable N-term signal seq.
       INTEGRAL   Likelihood = -10.61   Transmembrane   140-156 (129-158)
       INTEGRAL   Likelihood =  -9.55   Transmembrane    60-76  (53-80)
```

```
    INTEGRAL     Likelihood = -7.59      Transmembrane     264-280 (257-285)
    INTEGRAL     Likelihood = -5.79      Transmembrane     232-248 (219-251)
    INTEGRAL     Likelihood = -2.23      Transmembrane     190-206 (190-207)
    INTEGRAL     Likelihood = -1.75      Transmembrane      90-106  (90-110)

----- Final Results -----
              bacterial membrane  --- Certainty = 0.5246(Affirmative) < succ>
               bacterial outside  --- Certainty = 0.0000(Not Clear)   < succ>
             bacterial cytoplasm  --- Certainty = 0.0000(Not Clear)   < succ>
```

A related GBS nucleic acid sequence <SEQ ID 10059> which encodes amino acid sequence <SEQ ID 10060> was also identified.

The protein has homology with the following sequences in the GENPEPT database:

```
>GP:AA036212 GB:AE001771 branched chain amino acid ABC transporter,
permease protein [Thermotoga maritima]
Identities = 140/295 (47%), Positives = 200/295 (67%), Gaps = 7/295 (2%)

Query:    2 LQQLVNGLILGSIYALLALGYTMVYGIIKLINFAHGDIYMMGAFMGYYLINHLHLNFFLA   61
            LQ L NG++LG +YAL+A+GYTMVYGI++LINFAHGD+ MMG + +Y    L LN    +
Sbjct:    5 LQNLFNGIMLGGLYALIAIGYTMVYGILRLINFAHGDVMMMGVYFAFYAATLLSLNPLFS   64

Query:   62 LLIAMLGSAFLGVVIEYLAYRPLRKSTRIAALITAIGVSFLLEYGMVYLVGADTRAFPQA  121
            ++A+LG+A LG +I+ +AY+PLR + RI+ALITAIGVSF LE   V + GA  ++F +
Sbjct:   65 AIVAILGAALLGFLIDRVAYKPLRNAPRISALITAIGVSFFLESLAVVVFGAIPKSFLKV  124

Query:  122 IHTVKYNLGPITITNVQL------IILGIALLLMLTLQFIVQKTKMGKAMRALSVDSDAAQ  176
                     +T+     ++       +++ I   ++++ L FIV +TK+G AMRA+S+D
Sbjct:  125 FKDRTILNKVLTVAGARIPLLTFLVIFITAVILIVLFFIVYRTKIGMAMRAISMDIPTTA  184

Query:  177 LMGINVNRTISFTFALGSALAGAGGVLIGLYYNSVQPLMGVTPGLKAFVAAVLGGIGIIP  236
            LMG+NV+  I FTFALGSALA A G++  + + +V P MG  PGLKAF+AAV GGIG IP
Sbjct:  185 LMGVNVDAVIGFTFALGSALAAASGIMWAMRFPNVHPYMGFMPGLKAFIAAVFGGIGSIP  244

Query:  237 GAAIGGFVIGILETLATAL--GVSDFRDGIVYAILILIFLIRPAGILGKNIKEKV       289
            GA +GG ++G+++E    A    V  +RD   + ILI+I L++P+G+LGK I EKV
Sbjct:  245 GAVLGGVLLGLIEIFLAAYFPAVMGYRDAFAFIILIIILLVKPSGLLGKKIVEKV       299
```

There is also homology to SEQ ID 2150. A related sequence was also identified in GAS <SEQ ID 9171> which encodes the amino acid sequence <SEQ ID 9172>. Analysis of this protein sequence reveals the following:

```
Possible site: 30
>>> Seems to have an uncleavable N-term signal seq
    INTEGRAL     Likelihood = -12.74     Transmembrane     196-212 (191-219)
    INTEGRAL     Likelihood = -12.42     Transmembrane      12-28   (5-36)
    INTEGRAL     Likelihood = -7.22      Transmembrane     106-122 (102-126)
    INTEGRAL     Likelihood = -4.78      Transmembrane     242-258 (240-260)
    INTEGRAL     Likelihood = -2.50      Transmembrane      61-77   (60-77)
    INTEGRAL     Likelihood = -2.34      Transmembrane     293-309 (291-309)
    INTEGRAL     Likelihood = -1.44      Transmembrane     139-155 (138-156)
    INTEGRAL     Likelihood = -1.33      Transmembrane     317-333 (317-333)

----- Final Results -----
              bacterial membrane  --- Certainty = 0.609(Affirmative)  < succ>
               bacterial outside  --- Certainty = 0.0000(Not Clear)   < succ>
             bacterial cytoplasm  --- Certainty = 0.0000(Not Clear)   < succ>
```

An alignment of the GAS and GBS proteins is shown below:

```
Identities = 35/147 (23%), Positives = 71/147 (47%), Gaps = 6/147 (4%)

Query:  134 ITNVQLIILGI--ALLLMLTLQFIVQKTKMGKAMRALSVDSDAAQLMGINVNRTISFTFA  191
            +TN   I +GI A++ +   + F++ KT +G  +R++ ++   A++  G++   RTI  +
Sbjct:  197 LTNNSRINIGIFFAIIAIALIWFLLNKTTLGFEIRSVGLNPHASEYAGMSSKRTIILSMI  256

Query:  192 LGSALAGAGGVL--IGLYYNSVQPLMGVTPGLKAFVAAVLGGIGIIPGAAIGGFVIGILE  249
            + ALAG GGV+ +G + N      +  G    ++L    + G    F+ G+L
Sbjct:  257 ISGALAGLGGVVEGLGTFENVFVQGSSLAVGFDGMAVSLLAANSPL-GIFFSSFLFGVLN  315
```

```
                                -continued
Query:  250 TLATALGVSDFRDGIVYAILI-LIFLI                              275
            A  + ++       +V  +   +IF +
Sbjct:  316 IGAPGMNIAGIPPELVKVVTASIIFFV                              342
```

Based on this analysis, it was predicted that these proteins and their epitopes could be useful antigens for vaccines or diagnostics.

EXAMPLE 698

A DNA sequence (GBSx0742) was identified in *S. agalactiae* <SEQ ID 2151> which encodes the amino acid sequence <SEQ ID 2152>. This protein is predicted to be branched chain amino acid ABC transporter, permease protein (livM). Analysis of this protein sequence reveals the following:

```
Possible site: 29
>>> Seems to have an uncleavable N-term signal seq
        INTEGRAL    Likelihood = -8.76    Transmembrane    90-106  (84-113)
        INTEGRAL    Likelihood = -8.23    Transmembrane    12-28   (5-33)
        INTEGRAL    Likelihood = -8.17    Transmembrane    205-221 (200-224)
        INTEGRAL    Likelihood = -7.86    Transmembrane    276-292 (273-300)
        INTEGRAL    Likelihood = -6.32    Transmembrane    159-175 (154-176)
        INTEGRAL    Likelihood = -6.05    Transmembrane    236-252 (232-264)
        INTEGRAL    Likelihood = -5.95    Transmembrane    42-58   (38-60)
        INTEGRAL    Likelihood = -5.84    Transmembrane    120-136 (119-138)
        INTEGRAL    Likelihood = -4.35    Transmembrane    255-271 (253-274)
        INTEGRAL    Likelihood = -1.59    Transmembrane    66-82   (66-85)

----- Final Results -----
            bacterial membrane  --- Certainty = 0.4503(Affirmative) < succ>
             bacterial outside  --- Certainty = 0.0000(Not Clear)   < succ>
           bacterial cytoplasm  --- Certainty = 0.0000(Not Clear)   < succ>
```

The protein has homology with the following sequences in the GENPEPT database:

```
>GP:AAD36213 GB:AE001771 branched chain amino acid ABC transporter,
permease protein [Thermotoga maritima]
Identities = 119/332 (35%), Positives = 191/332 (56%), Gaps = 33/332 (9%)

Query:   12 LAIVVLDYLLISVLISMGIFNLYHIQIIETIGINVILAVGLNLIVGCSGQFSLGHAGFMA   71
            L +V L ++ + + ++     + Y ++++   I I   I+AV LNLI G +G FSLGHAGF+
Sbjct:   16 LTVVFLIFMALLLYLADRYMDSYKLRVVRLIAIYGIMAVSLNLINGITGIFSLGHAGFIL   75

Query:   72 IGAYAVAIIGVKMP----------------TYVGFLIAILVGTLVAGGIALGVGIPTLR  114
            IGAY +++ +                    +  F  A + G ++A   A   +G P LR
Sbjct:   76 IGAYTASLLTLSPEQKAMSFIIEPIVPWLANAHTDFFTATVAGGVLAAVFAFLIGWPVLR  135

Query:  115 LKGDYLAIATLGVAEIIRILLVNGGDITNGAAGIMGIPPFTTWSLVYGVAVVSLILAMNF  174
            L GDYLAIA+LG AE+IRI+ +N    ITNG  G+ GIP ++     YG  V+++    +
Sbjct:  136 LSGDYLAIASLGFAEVIRIIALNAISITNGPLGLKGIPEYSNIWWCYGWLFVTVLFMASL  195

Query:  175 LRSPLGRNTIAIREDEIAAESMGVDTTKVKVIVFVFGAILASIAGSLQAGYVGTVMPKDF  234
            + S   GR   AIRED IAAE+MG++   K +++ FV GA   A ++GSL A ++ T+ P+
Sbjct:  196 VNSSYGRALKAIREDRIAAEAMGINVFKHQLLSFVIGAFFAGVSGSLYAHWLTTIDPRTT  255

Query:  235 SF--MMSVNVLIIVVLGGLGSMTGTVLAAILLGLLNMLLQD--------------YASVR  278
             +   M++  VLI++VLGGLGS++G+++ A L   +L    L+D                +R
Sbjct:  256 TLGPMLTFYVLIMIVLGGLGSISGSLIGAALFAILFEWLRDLEEPFTFFGIHVPGIKGMR  315

Query:  279 MIIYALALILIMIFRPSGLLGTKELTLSHLFR                             310
            +++ +    IL+MIF    G++G +ELT ++L+R
Sbjct:  316 ILVISAIFILVMIFWQRGIMGREELTWNNLYR                             347
```

No corresponding DNA sequence was identified in *S. pyogenes*.

Based on this analysis, it was predicted that this protein and its epitopes, could be useful antigens for vaccines or diagnostics.

EXAMPLE 699

A DNA sequence (GBSx0743) was identified in *S. agalactiae* <SEQ ID 2153> which encodes the amino acid sequence <SEQ ID 2154>. This protein is predicted to be branched chain amino acid ABC transporter, ATP-binding protein (livG). Analysis of this protein sequence reveals the following:

```
Possible site: 58
>>> Seems to have no N-terminal signal sequence

----- Final Results -----
            bacterial cytoplasm --- Certainty = 0.2057(Affirmative) < succ>
             bacterial membrane --- Certainty = 0.0000(Not Clear)   < succ>
              bacterial outside --- Certainty = 0.0000(Not Clear)   < succ>
```

The protein has homology with the following sequences in the GENPEPT database:

```
>GP:AAD36214 GB:AE001771 branched chain amino acid ABC transporter,
ATP-binding protein [Thermotoga maritima]
Identities = 136/271 (50%), Positives = 189/271 (69%), Gaps = 21/271 (7%)

Query:    3 LLEVKNLSKHFGGLTAVGDVSMKLHKGELIGLIGPNGAGKTTLFNLLTGVYLPSKGTISI    62
            LL + +++  FGGL AV D + ++ +GEL+GLIGPNGAGKTT+FN++TG+Y P+KG I
Sbjct:   11 LLLLDHVTMQFGGLVAVDDFTNEIREGELVGLIGPNGAGKTTVFNVITGIYTPTKGRIVF   70

Query:   63 DGKILNGRKPAKIASLGLGRTFQNIRLFKNMTVLDNVLVGLSNHHLSHPIASFLRLPK--  120
            +   + G +P +I   LG+ RTFQNIRLF +MTVL+NVLV    +H LS+P A  + +
Sbjct:   71 NDIDITGLRPYQITHLGIARTFQNIRLFSDMTVLENVLVA-QHHVLSNPDADRILVKHGK  129

Query:  121 ------------------YYHSEKALRKKALELLEIFGLKAYQDALAKNLPYGKQRRLEI  162
                              Y    EK + ++A +L++   GL+       A +LPYG+QR+LEI
Sbjct:  130 PRKGHGRFWFWRAVTRIGYLKKEKEMVERAKDLIKRVGLEKVMYEKASSLPYGEQRKLEI  189

Query:  163 VRALATEPKILFLDEPAAGMNPQETAELTQLISQIKSDFDITIMLIEHDMNLVMQVTERI  222
            RALATEPK++ LDEPAAGMNP+ET +L + I QI+ DF++T++LIEHDM +VM + ERI
Sbjct:  190 ARALATEPKLILLDEPAAGMNPKETEDLMEFIKQIRKDFNLTVLLIEHDMKVVMGICERI  249

Query:  223 YVLEYGRLIAHGTPEEIKNNKRVIEAYLGGE                             253
            V++YGR+IA GTP+EI+N+ RVIEAYLG E
Sbjct:  250 IVMDYGRIIAEGTPKEIQNDPRVIEAYLGRE                             280
```

There is also homology to SEQ ID 644.

Based on this analysis, it was predicted that this protein and its epitopes, could be useful antigens for vaccines or diagnostics.

EXAMPLE 700

A DNA sequence (GBSx0744) was identified in *S. agalactiae* <SEQ ID 2155> which encodes the amino acid sequence <SEQ ID 2156>. Analysis of this protein sequence reveals the following:

```
Possible site: 61
>>> Seems to have no N-terminal signal sequence

----- Final Results -----
            bacterial cytoplasm --- Certainty = 0.2216(Affirmative) < succ>
             bacterial membrane --- Certainty = 0.0000(Not Clear)   < succ>
              bacterial outside --- Certainty = 0.0000(Not Clear)   < succ>
```

The protein has homology with the following sequences in the GENPEPT database:

```
>GP:CAB52068 GB:AL109732 putative branched chain amino acid
transport ATP-binding protein [Streptomyces coelicolor
A3(2)]
Identities = 136/233 (58%), Positives = 181/233 (77%)

Query:     3 MLKVENLSIHYGVIQAVNDVSFEVNQGEVVTLIGANGAGKTSILRTISGLVRPSQGSISF   62
             +L+VE+L + YG I+AV  +SF+V+ GEVVTLIG NGAGKT+ LRT+SGL++P  G I F
Sbjct:     4 LLEVEDLRVAYGKIEAVKGISFKVDAGEVVTLIGTNGAGKTTTLRTLSGLLKPVGGQIRF   63

Query:    63 MGKPIHKLAARKIVGNGLAQVPEGRHVFSSLSVMENLEMGAFLQKDREQNQKMLKKVFDR  122
             GK + K+ A +IV   GLA   PEGRH+F  +++ +NL +GAFL+ DR    +K +++ +D
Sbjct:    64 GGKSLKKVPAHQIVSLGLAHSPEGRHIFPRMTIEDNLRLGAFLRSDRPGIEKDIQRAYDL  123

Query:   123 FPRLEERKNQDAATLSGGEQQMLAMGRALMSRPKLLLLDEPSMGLAPIFIQEIFNIIEDI  182
             FP L ER+ Q A TLSGGEQQMLAMGRALMS+PKLL+LDEPSMGL+PI +Q+I    I ++
Sbjct:   124 FPILGERRKQAAGTLSGGEQQMLAMGRALMSQPKLLMLDEPSMGLSPIMMQKIMATIAEL  183

Query:   183 KKQGTTVLLVEQNANKALTIADKAYVLETGKVVLSGTGKELLVSDQVRKAYLG        235
             K QGTT+LLVEQNA  AL++AD  +V+E G +VLSG+G++LL  +  VRKAYLG
Sbjct:   184 KSQGTTILLVEQNAQAALSLADHGHVMEVGNIVLSGSGQDLLHDESVRKAYLG        236
```

Based on this analysis, it was predicted that this protein and its epitopes, could be useful antigens for vaccines or diagnostics.

EXAMPLE 701

A DNA sequence (GBSx0745) was identified in *S. agalactiae* <SEQ ID 2159> which encodes the amino acid sequence <SEQ ID 2160>. Analysis of this protein sequence reveals the following:

```
Possible site: 23
>>> Seems to have no N-terminal signal sequence

----- Final Results -----
           bacterial cytoplasm --- Certainty = 0.0415(Affirmative) < succ>
           bacterial membrane  --- Certainty = 0.0000(Not Clear)   < succ>
            bacterial outside  --- Certainty = 0.0000(Not Clear)   < succ>
```

The protein has homology with the following sequences in the GENPEPT database:

```
>GP:AAD36216 GB:AE001771 conserved hypothetical protein
[Thermotoga maritima]
Identities = 72/166 (43%), Positives = 116/166 (69%), Gaps = 2/166 (1%)

Query:     1 MPVKDFMTKKLVYVSPDTTVAEAADLLREHHLRRLPVVENDQLVGLVTEGTMAEAQPSKA   60
             M VRDFMT+  + ++P+T+ +EA  L++++ ++RL V++N+++VG+VTE  +   A PSKA
Sbjct:     1 MLVKDFMTRNPITIAPETSFSEALKLMKQNKIKRLIVMKNEKIVGIVTEKDLLYASPSKA   60

Query:    61 TSLSIYEMNYLLNKTKIRDIMIKDIVTVSQYASLEDAIYLMMSRKIGVLPVVDN-GQLYG  119
             T+L+I+E++YLL+K KI +IM KD+VTV++   +EDA  +M  + I  LPVVD+ G+L G
Sbjct:    61 TTLNIWELHYLLSKLKIEEIMTKDVVTVNENTPIEDAARIMEEKDISGLPVVDDAGRLVG  120

Query:   120 IVTDRDVFKAFLEIAGYGQE-SYRLVILADEGIGVLSKVLNRLSSA               164
             I+T  D+FK F+EI G  +E +  R +    + G L +V R+  A
Sbjct:   121 IITQTDIFKVFVEIFGTKREGTIRYTMEMPDKPGELLEVAKRIYEA               166
```

Based on this analysis, it was predicted that this protein and its epitopes, could be useful antigens for vaccines or diagnostics.

EXAMPLE 702

A DNA sequence (GBSx0746) was identified in *S. agalactiae* <SEQ ID 2163> which encodes the amino acid sequence <SEQ ID 2164>. Analysis of this protein sequence reveals the following:

```
Possible site: 41
>>> Seems to have no N-terminal signal sequence

----- Final Results -----
            bacterial cytoplasm --- Certainty = 0.5585(Affirmative) < succ>
             bacterial membrane --- Certainty = 0.0000(Not Clear)   < succ>
              bacterial outside --- Certainty = 0.0000(Not Clear)   < succ>
```

The protein has no significant homology with any sequences in the GENPEPT database.

No corresponding DNA sequence was identified in S. pyogenes.

Based on this analysis, it was predicted that this protein and its epitopes, could be useful antigens for vaccines or diagnostics.

EXAMPLE 703

A DNA sequence (GBSx0747) was identified in S. agalactiae <SEQ ID 2165> which encodes the amino acid sequence <SEQ ID 2166>. This protein is predicted to be a transposase. Analysis of this protein sequence reveals the following:

```
Possible site: 38
>>> Seems to have no N-terminal signal sequence
     INTEGRAL    Likelihood = -1.65    Transmembrane    53-69 (53-70)

----- Final Results -----
             bacterial membrane --- Certainty = 0.1659(Affirmative) < succ>
              bacterial outside --- Certainty = 0.0000(Not Clear)   < succ>
            bacterial cytoplasm --- Certainty = 0.0000(Not Clear)   < succ>
```

The protein has homology with the following sequences in the GENPEPT database:

```
>GP:AAA85003 GB:U28972 SpV1 ORF3; putative transposase
[Spiroplasma citri]
Identities = 49/154 (31%), Positives = 80/154 (51%), Gaps = 11/154 (7%)

Query:    39 WLEMDTVIGRIGGKVLLTFNVAFCNFIFAKLMDSKTAIETAKHIQ--VIKRTLYDNKRDF   96
             WLEMDTV+G+     +L          FA +++ TA E  K  + +IK L     +
Sbjct:   174 WLEMDTVVGKDHKSAILVLVEQLSKKYFAIKLENHTAREVEKKFKDIIIKNNLIGKIKG-  232

Query:    97 FELFPVILTDNGGEFARVDDIEIDVCGQSQLFFCDPNRSDQKARIEKNHTLVRDILPKGT  156
                    I+TD G EF++   ++EI    ++Q++FCD     QK  IE ++ +R   PKGT
Sbjct:   233 ------IITDRGKEFSKWREMEI--FAETQVYFCDAGSPQQKPLIEYMNSELRHWFPKGT  284

Query:   157 SFDNLTQEDINLALSHINSVKRQALNGKTAYELF                           190
             F+ ++Q+ I+  ++ IN   R  LN  ++ E+F
Sbjct:   285 DFNKVSQKQIDWVVNVINDKLRPCLNWISSKEMF                           318
```

No corresponding DNA sequence was identified in S. pyogenes.

Based on this analysis, it was predicted that this protein and its epitopes, could be useful antigens for vaccines or diagnostics.

EXAMPLE 704

A DNA sequence (GBSx0748) was identified in S. agalactiae <SEQ ID 2167> which encodes the amino acid sequence <SEQ ID 2168>. Analysis of this protein sequence reveals the following:

```
Possible site: 45
>>> Seems to have no N-terminal signal sequence

----- Final Results -----
            bacterial cytoplasm --- Certainty = 0.3116(Affirmative) < succ>
             bacterial membrane --- Certainty = 0.0000(Not Clear)   < succ>
              bacterial outside --- Certainty = 0.0000(Not Clear)   < succ>
```

A related GBS nucleic acid sequence <SEQ ID 10055> which encodes amino acid sequence <SEQ ID 10056> was also identified.

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 705

A DNA sequence (GBSx0749) was identified in *S. agalactiae* <SEQ ID 2169> which encodes the amino acid sequence <SEQ ID 2170>. This protein is predicted to be thymidylate kinase (tmk). Analysis of this protein sequence reveals the following:

```
Possible site: 39
>>> Seems to have no N-terminal signal sequence

----- Final Results -----
            bacterial cytoplasm --- Certainty = 0.1876(Affirmative) < succ>
             bacterial membrane --- Certainty = 0.0000(Not Clear)   < succ>
              bacterial outside --- Certainty = 0.0000(Not Clear)   < succ>
```

A related GBS nucleic acid sequence <SEQ ID 10053> which encodes amino acid sequence <SEQ ID 10054> was also identified.

The protein has homology with the following sequences in the GENPEPT database:

```
>GP: BAB03761 GB: AP001507 thymidylate kinase [Bacillus halodurans]
Identities = 112/210 (53%), Positives = 148/210 (70%), Gaps = 1/210 (0%)

Query:  17 MKKGLMISFEGPDGAGKTTVLEAVLPLLREKLSQDILTTREPGGVTISEEIRHIILDVKH   76
            M KG  I+ EG +GAGKT+ L+A+  +LRE     ++ TREPGG+ I+E+IR IILDV H
Sbjct:   1 MTKGCFITVEGGEGAGKTSALDAIEEMLREN-GLSVVRTREPGGIPIAEQIRSIILDVDH   59

Query:  77 TQMDKKTELLLYMAARRQHLVEKVLPALEEGKIVLMDRFIDSSVAYQGSGRGLDKSHIKW  136
           T+MD  +TE LLY AARRQHLVEKVLPALE G +VL DRFIDSS+AYQG  RG+      I
Sbjct:  60 TRMDPRTEALLYAAARRQHLVEKVLPALEAGHVVLCDRFIDSSLAYQGYARGIGFEDILA  119

Query: 137 LNDYATDSHKPDLTLYFDVPSEVGLERIQKSVQREVNRLDLEQLDMHQRVRQGYLELADS  196
            +N++A  +    PDLTL F V  +VGL RI  +   RE NRLD E L  HQ+V++GY  + ++
Sbjct: 120 INEFAIEGRYPDLTLLFRVDPDVGLSRIHRDQSREQNRLDQEALTFHQKVKEGYERIVET  179

Query: 197 EPNRIVTIDASQQLDEVIAETFSIILDRIN                              226
            P R+V IDA+Q  D+V+A+   +I  R++
Sbjct: 180 YPERVVEIDANQSFDQVVADAVRMIKQRLS                              209
```

A related DNA sequence was identified in *S. pyogenes* <SEQ ID 2171> which encodes the amino acid sequence <SEQ ID 2172>. Analysis of this protein sequence reveals the following:

```
Possible site: 56
>>> Seems to have no N-terminal signal sequence
     INTEGRAL    Likelihood = -0.75    Transmembrane   215-231 (215-231)

----- Final Results -----
             bacterial membrane --- Certainty = 0.1298(Affirmative) < succ>
              bacterial outside --- Certainty = 0.0000(Not Clear)   < succ>
            bacterial cytoplasm --- Certainty = 0.0000(Not Clear)   < succ>
```

The protein has homology with the following sequences in the databases:

```
>GP:BAB03761 GB:AP001507 thymidylate kinase [Bacillus halodurans]
Identities = 109/205 (53%), Positives = 148/205 (72%), Gaps = 1/205 (0%)

Query:   22 MITGKLITVEGPDGAGKTTVLEQLIPLLKQKVAQDILTTREPGGVAISEHIRELILDINH    81
            M  G  ITVEG +GAGKT+ L+ +  +L++    ++ TREPGG+ I+E IR +ILD++H
Sbjct:    1 MTKGCFITVEGGEGAGKTSALDAIEEMLREN-GLSVVRTREPGGIPIAEQIRSIILDVDH   59

Query:   82 TAMDPKTELLLYIAARRQHLVEKVLPALEAGQLVFIDRFIDSSVAYQGAGRGLIKADIQW   141
            T MDP+TE LLY AARRQHLVEKVLPALEAG +V  DRFIDSS+AYQG  RG+    DI
Sbjct:   60 TRMDPRTEALLYAAARRQHLVEKVLPALEAGHVVLCDRFIDSSLAYQGYARGIGFEDILA  119

Query:  142 LNEFATDGLEPDLTLYFDVPSEIGLARINANQQREVNRLDLETIEIHQRVRKGYLALAKE   201
            +NEFA +G  PDLTL F V  ++GL+RI+ +Q RE NRLD E +  HQ+V++GY  + +
Sbjct:  120 INEFAIEGRYPDLTLLFRVDPDVGLSRIHRDQSREQNRLDQEALTFHQKVKEGYERIVET  179

Query:  202 HPKRIVTIDATKPLKEVVSVALEHV                                     226
            +P+R+V IDA +   +VV+ A+  +
Sbjct:  180 YPERVVEIDANQSFDQVVADAVRMI                                     204
```

An alignment of the GAS and GBS proteins is shown below:

```
Identities = 145/219 (66%), Positives = 181/219 (82%)

Query:    4 FDRIVVIINKGCTMKKGLMISFEGPDGAGKTTVLEAVLPLLREKLSQDILTTREPGGVTI    63
            FD+I ++ ++G  M  G +I+ EGPDGAGKTTVLE ++PLL++K++QDILTTREPGGV I
Sbjct:    9 FDKIELLKSEGNKMITGKLITVEGPDGAGKTTVLEQLIPLLKQKVAQDILTTREPGGVAI   68

Query:   64 SEEIRHIILDVKHTQMDKKTELLLYMAARRQHLVEKVLPALEEGKIVLMDRFIDSSVAYQ   123
            SE IR +ILD+ HT MD KTELLLY+AARRQHLVEKVLPALE G++V +DRFIDSSVAYQ
Sbjct:   69 SEHIRELILDINHTAMDPKTELLLYIAARRQHLVEKVLPALEAGQLVFIDRFIDSSVAYQ  128

Query:  124 GSGRGLDKSHIKWLNDYATDSHKPDLTLYFDVPSEVGLERIQKSVQREVNRLDLEQLDMH   183
            G+GRGL K+ I+WLN++ATD  +PDLTLYFDVPSE+GL RI + +QREVNRLDLE +++H
Sbjct:  129 GAGRGLIKADIQWLNEFATDGLEPDLTLYFDVPSEIGLARINANQQREVNRLDLETIEIH  188

Query:  184 QRVRQGYLELADSEPNRIVTIDASQQLDEVIAETFSIIL                       222
            QRVR+GYL LA   P RIVTIDA++ L EV++    +L
Sbjct:  189 QRVRKGYLALAKEHPKRIVTIDATKPLKEVVSVALEHVL                       227
```

Based on this analysis, it was predicted that these proteins and their epitopes could be useful antigens for vaccines or diagnostics.

EXAMPLE 706

A DNA sequence (GBSx0750) was identified in *S. agalactiae* <SEQ ID 2173> which encodes the amino acid sequence <SEQ ID 2174>. This protein is predicted to be DNA polymerase III delta' subunit (dnaZX). Analysis of this protein sequence reveals the following:

```
Possible site: 26
>>> Seems to have no N-terminal signal sequence

----- Final Results -----
            bacterial cytoplasm --- Certainty = 0.2603(Affirmative) < succ>
             bacterial membrane --- Certainty = 0.0000(Not Clear)   < succ>
              bacterial outside --- Certainty = 0.0000(Not Clear)   < succ>
```

The protein has homology with the following sequences in the GENPEPT database:

```
>GP:BAB03763 GB:AP001507 DNA polymerase III delta' subunit
[Bacillus halodurans]
Identities = 78/189 (41%), Positives = 113/189 (59%), Gaps = 3/189 (1%)

Query:    2 DLKRTQPKLLEKFNTILQSDRMSHAYLFSGNFAS--LDMALYLAQSQFCEKRQSGLPCQE    59
            +L + QP +      L  R++HAY+F GN +    MAL+LA+S FC +R     PCQ
Sbjct:    5 NLAKNQPFVATMLKNSLAKGRLAHAYIFDGNRGTGKKRMALHLAKSFFCAQRAGVEPCQT   64
```

```
-continued
Query:   60 CRACRLIANGEFSDVKIIEPQGQLIKTETIKELTKDFSRSGFEGKSQVFIIKDCEKMHVN 119
            C+ C+ I +G    DV  IEP GQ IK   ++ L K+FS  G E   +V+I+   +KM  +
Sbjct:   65 CKECKRIEHGNHPDVHFIEPDGQSIKKHQVEHLQKEFSYRGMESAKKVYIVNHADKMTTS 124

Query:  120 AANSLLKFIEEPQSSSYVILLTNDENNVLPTIKSRTQIFRF-PKQLDMLVHQAEQAGLLK 178
            AANSLLKF+EEP + +  ILLT    N+LPTIKSR+Q+  F P ++       E+ G+ +
Sbjct:  125 AANSLLKFLEEPLADTVAILLTEQLQNMLPTIKSRSQVLSFAPLEVQAFAKLLEEEGISE 184

Query:  179 SQASLLAQV 187
            S ++LLA +
Sbjct:  185 SVSNLLASL 193
```

A related DNA sequence was identified in *S. pyogenes* <SEQ ID 2175> which encodes the amino acid sequence <SEQ ID 2176>. Analysis of this protein sequence reveals the following:

```
Possible site: 39
>>> Seems to have no N-terminal signal sequence

----- Final Results -----
            bacterial cytoplasm --- Certainty = 0.2685(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below:

```
Identities = 151/290 (52%), Positives = 213/290 (73%),
Gaps = 3/290 (1%)

Query:    1 MDLKRTQPKLLEKFNTILQSDRMSHAYLFSGNFASLDMALYLAQSQFCEKRQSGLPCQEC  60
            MDL +  P + + F TIL+ DR++HAYLFSG+FA+ +MAL+LA+  FCE+++   PC  C
Sbjct:    1 MDLAQKAPNVYQAFQTILKKDRLNHAYLFSGDFANEEMALFLAKVIFCEQKKDQTPCGHC  60

Query:   61 RACRLIANGEFSDVKIIEPQGQLIKTETIKELTKDFSRSGFEGKSQVFIIKDCEKMHVNA 120
            R+C+LI  G+F+DV ++EP GQ+IKT+  +KE+   +FS++G+E K QVFIIKDC+KMH+NA
Sbjct:   61 RSCQLIEQGDFADVTVLEPTGQVIKTDVVKEMMANFSQTGYENKRQVFIIKDCDKMHINA 120

Query:  121 ANSLLKFIEEPQSSSYVILLTNDENNVLPTIKSRTQIFRFPKQLDMLVHQAEQAGLLKSQ 180
            ANSLLK+IEEPQ  +Y+ LLTND+N VLPTIKSRTQ+F+FPK  L    A++ GLL  Q
Sbjct:  121 ANSLLKYIEEPQGEAYIFLLTNDDNKVLPTIKSRTQVFQFPKNEAYLYQLAQEKGLLNHQ 180

Query:  181 ASLLAQVADDPKHLEILLTNKKLLDYLNLSQQFVTTLAKDRQTAYLEVSRLTSQVVDKND 240
            A L+A++A +  HLE LL    KLL+ +   +++FV+    KD+  AYL ++RL    +K +
Sbjct:  181 AKLVAKLATNTSHLERLLQTSKLLELITQAERFVSIWLKDQLQAYLALNRLVQLATEKEE 240

Query:  241 QAFVFQWLTIMLAKE---GQLYDLENTYRAQQMWKSNVSFQNSLEYMVLS 287
            Q  V    LT++LA+E    L  LE Y+A+ MW+SNV+FQN+LEYMV+S
Sbjct:  241 QDLVLTLLTLLLARERAQTPLTQLEAVYQARLMWQSNVNFQNTLEYMVMS 290
```

Based on this analysis, it was predicted that these proteins and their epitopes could be useful antigens for vaccines or diagnostics.

EXAMPLE 707

A DNA sequence (GBSx0751) was identified in *S. agalactiae* <SEQ ID 2177> which encodes the amino acid sequence <SEQ ID 2178>. Analysis of this protein sequence reveals the following:

```
Possible site: 28
>>> Seems to have no N-terminal signal sequence

----- Final Results -----
            bacterial cytoplasm --- Certainty = 0.2016(Affirmative) < succ>
             bacterial membrane --- Certainty = 0.0000(Not Clear)   < succ>
              bacterial outside --- Certainty = 0.0000(Not Clear)   < succ>
```

The protein has homology with the following sequences in the GENPEPT database:

```
>GP:BAB03765 GB:AP001507 unknown conserved protein in B. subtilis
[Bacillus halodurans]
Identities = 45/116 (38%), Positives = 62/116 (52%), Gaps = 8/116 (6%)

Query:    1  MDKKDLFDAFDDFSQNLLVGLSEIETMKKQIQKLLEENTVLRIENGKLRERLSVIEAET-   59
             M+KK +F         + +      E+  +K+Q+  L+EEN  L IEN  LRERL   E E
Sbjct:    1  MNKKAIFTQVSQLEERIGELHRELGGLKEQLAYLIEENHFLTIENEHLRERLGEPELEET  60

Query:   60  ---ETAVKNSK----QGRELLEGIYNDGFHICNTFYGQRRENDEECAFCIELLYRD      108
                E   K K       +G + L  +Y +GFHICNT YG  R+N E+C FC+  L +D
Sbjct:   61  EEKEQVTKERKPFVGEGYDNLARLYQEGFHICNTHYGSLRKNGEDCLFCLSFLNQD      116
```

A related DNA sequence was identified in *S. pyogenes* <SEQ ID 2179> which encodes the amino acid sequence <SEQ ID 2180>. Analysis of this protein sequence reveals the following:

```
Possible site: 22
>>> Seems to have no N-terminal signal sequence

----- Final Results -----
           bacterial cytoplasm --- Certainty = 0.0700(Affirmative) < succ>
           bacterial membrane  --- Certainty = 0.0000(Not Clear)   < succ>
           bacterial outside   --- Certainty = 0.0000(Not Clear)   < succ>
```

An alignment of the GAS and GBS proteins is shown below:

```
Identities = 75/107 (70%), Positives = 89/107 (83%), Gaps = 1/107 (0%)

Query:    1  MDKKDLFDAFDDFSQNLLVGLSEIETMKKQIQKLLEENTVLRIENGKLRERLSVIEAETE  60
             ++KK+LFDAFD FSQNL+V L+EIE MKKQ+Q L+EENT+LR+EN KLRERLS +E ET
Sbjct:    1  VNKKELFDAFDGFSQNLMVTLAEIEAMKKQVQSLVEENTILRLENTKLRERLSHLEHET-  59

Query:   61  TAVKNSKQGRELLEGIYNDGFHICNTFYGQRRENDEECAFCIELLYR              107
              A    SKQ ++ LEGIY++GFHICN  FYGQRRENDEEC  FC ELL R
Sbjct:   60  VAKNPSKQRKDHLEGIYDEGFHICNFFYGQRRENDEECMFCRELLDR              106
```

Based on this analysis, it was predicted that these proteins and their epitopes could be useful antigens for vaccines or diagnostics.

EXAMPLE 708

A DNA sequence (GBSx0752) was identified in *S. agalactiae* <SEQ ID 2181> which encodes the amino acid sequence <SEQ ID 2182>. Analysis of this protein sequence reveals the following:

```
Possible site: 48
>>> Seems to have no N-terminal signal sequence
    INTEGRAL    Likelihood = -1.28    Transmembrane    119-135 (119-135)

----- Final Results -----
           bacterial membrane  --- Certainty = 0.1510(Affirmative) < succ>
           bacterial outside   --- Certainty = 0.0000(Not Clear)   < succ>
           bacterial cytoplasm --- Certainty = 0.0000(Not Clear)   < succ>
```

A related GBS nucleic acid sequence <SEQ ID 10051> which encodes amino acid sequence <SEQ ID 10052> was also identified.

The protein has homology with the following sequences in the GENPEPT database:

```
>GP:BAB03768 GB:AP001507 unknown conserved protein [Bacillus halodurans]
Identities = 138/287 (48%), Positives = 189/287 (65%), Gaps = 2/287 (0%)
```

-continued

```
Query:     4 MQVQKSFKSNIHYGTLYLVPTPIGNLDDMTFRAIRILREVDFICAEDTRNTGLLLKHFDI    63
             M+ Q+S++    GTLYLV TPIGNL+D+TFRAIR L+E D I AEDTR T  LL HFDI
Sbjct:     1 MKTQQSYQQRDDKGTLYLVATPIGNLEDVTFRAIRTLKEADQIAAEDTRQTKKLLNHFDI    60

Query:    64 TTKQISFHEHNAYDKISGLIDLLKEGKSLAQVSDAGMPSISDPGHDLVKAAIEGDIPVVS   123
              TK +S+HEHN      LID L EG+++A VSDAGMP+ISDPG++LV +AI+  I V+
Sbjct:    61 ATKLVSYHEHNKETMGKRLIDDLIEGRTIALVSDAGMPAISDPGYELVVSAIKEGIAVIP   120

Query:   124 IPGASAGITALIASGLAPQPHIFYGFLPRKKGQQITFFETKQDYPETQIFYESPFRVSDT   183
             IPGA+A +TALIASGL +   F GFLPR+K Q+     E +    T IFYESP R+ DT
Sbjct:   121 IPGANAAVTALIASGLPTESFQFIGFLPRQKKQRQALEETKPTKATLIFYESPHRLKDT   180

Query:   184 LKHMKEIYGDRQVVLVRELTKLYEEYQRGTISQLLEHIEKVPLKGECLIIVDGKRDTERV   243
              L  M  I G+R V + RELTK YEE+ RGT+ + +     + +KGE +IV+G +
Sbjct:   181 LDDMLLILGNRHVSICRELTKTYEEFLRGTLEEAVHWAREATIKGEFCLIVEGNGEKVEP   240

Query:   244 KDS--SQQDPLVLVKEYIANGDKTNQAIKKVAKEFNLNRQELYASFH               288
             ++       P+  V+ YIA G ++ +AIK+VA +  + ++++Y  +H
Sbjct:   241 EEVWWESLSPVQHVEHYIALGFRSKEAIKQVATDRGVPKRDIYNIYH               287
```

A related DNA sequence was identified in *S. pyogenes* <SEQ ID 2183> which encodes the amino acid sequence <SEQ ID 2184>. Analysis of this protein sequence reveals the following:

```
Possible site: 35
>>> Seems to have no N-terminal signal sequence
    INTEGRAL      Likelihood = -4.09    Transmembrane      116-132 (116-134)

----- Final Results -----
              bacterial membrane --- Certainty = 0.2635(Affirmative) < succ>
              bacterial outside  --- Certainty = 0.0000(Not Clear)   < succ>
              bacterial cytoplasm --- Certainty = 0.0000(Not Clear)  < succ>
```

The protein has homology with the following sequences in the databases:

```
>GP:BAB03768 GB:AP001507 unknown conserved protein [Bacillus halodurans]
Identities = 139/287 (48%), Positives = 189/287 (65%), Gaps = 2/287 (0%)

Query:     1 MQVQKSFKDKKTSGTLYLVPTPIGNLQDMTFRAVATLKEVDFICAEDTRNTGLLLKHFDI    60
             M+ Q+S++ +   GTLYLV TPIGNL+D+TFRA+ TLKE D I AEDTR T  LL HFDI
Sbjct:     1 MKTQQSYQQRDDKGTLYLVATPIGNLEDVTFRAIRTLKEADQIAAEDTRQTKKLLNHFDI    60

Query:    61 ATKQISFHEHNAYEKIPDLIDLLISGRSLAQVSDAGMPSISDPGHDLVKAAIDSDIAVVA   120
             ATK +S+HEHN      LID LI GR++A VSDAGMP+ISDPG++LV +AI   IAV+
Sbjct:    61 ATKLVSYHEHNKETMGKRLIDDLIEGRTIALVSDAGMPAISDPGYELVVSAIKEGIAVIP   120

Query:   121 LPGASAGITALIASGLAPQPHVFYGFLPRKAGQQKAFFEDKHHYPETQMFYESPYRIKDT   180
             +PGA+A +TALIASGL +   F GFLPR+  Q++    E+    T +FYESP+R+KDT
Sbjct:   121 IPGANAAVTALIASGLPTESFQFIGFLPRQKKQRQALEETKPTKATLIFYESPHRLKDT   180

Query:   181 LTNMLACYGDRQVVLVRELTKLFEEYQRGSISEILSYLEETPLKGECLLIVA--GAQADS   238
             L +ML   G+R V + RELTK +EE+ RG++ E + +     E +KGE LIV   G + +
Sbjct:   181 LDDMLLILGNRHVSICRELTKTYEEFLRGTLEEAVHWAREATIKGEFCLIVEGNGEKVEP   240

Query:   239 EVELTADVDLVSLVQKEIQAGAKPNQAIKTIAKAYQVNRQELYQQFH               285
             E    + V  V+ I G + +AIK +A    V ++++Y  +H
Sbjct:   241 EEVWWESLSPVQHVEHYIALGFRSKEAIKQVATDRGVPKRDIYNIYH               287
```

An alignment of the GAS and GBS proteins is shown below:

```
Identities = 208/287 (72%), Positives = 238/287 (82%)

Query:     4 MQVQKSFKSNIHYGTLYLVPTPIGNLDDMTFRAIRILREVDFICAEDTRNTGLLLKHFDI    63
             MQVQKSFK     GTLYLVPTPIGNL DMTFRA+  L+EVDFICAEDTRNTGLLLKHFDI
Sbjct:     1 MQVQKSFKDKKTSGTLYLVPTPIGNLQDMTFRAVATLKEVDFICAEDTRNTGLLLKHFDI    60

Query:    64 TTKQISFHEHNAYDKISGLIDLLKEGKSLAQVSDAGMPSISDPGHDLVKAAIEGDIPVVS   123
              TKQISFHEHNAY+KI LIDLL  G+SLAQVSDAGMPSISDPGHDLVKAAI  DI VV+
Sbjct:    61 ATKQISFHEHNAYEKIPDLIDLLISGRSLAQVSDAGMPSISDPGHDLVKAAIDSDIAVVA   120
```

```
Query:  124 IPGASAGITALIASGLAPQPHIFYGFLPRKKGQQITFFETKQDYPETQIFYESPFRVSDT  183
            +PGASAGITALIASGLAPQPH+FYGFLPRK GQQ  FFE K  YPETQ+FYESP+R+ DT
Sbjct:  121 LPGASAGITALIASGLAPQPHVFYGFLPRKAGQQKAFFEDKHHYPETQMFYESPYRIKDT  180

Query:  184 LKHMKEIYGDRQVVLVRELTKLYEEYQRGTISQLLEHIEKVPLKGECLIIVDGKRDTERV  243
            L +M   YGDRQVVLVRELTKL+EEYQRG+IS++L  ++E+ PLKGECL+IV G +     V
Sbjct:  181 LTNMLACYGDRQVVLVRELTKLFEEYQRGSISEILSYLEETPLKGECLLIVAGAQADSEV  240

Query:  244 KDSSQQDPLVLVKEYIANGDKTNQAIKKVAKEFNLNRQELYASFHDL              290
            + ++  D + LV++ I  G K NQAIK +AK + +NRQELY  FHDL
Sbjct:  241 ELTADVDLVSLVQKEIQAGAKPNQAIKTIAKAYQVNRQELYQQFHDL              287
```

A related GBS gene <SEQ ID 8643> and protein <SEQ ID 8644> were also identified. Analysis of this protein sequence reveals the following:

```
Lipop: Possible site: -1 Crend: 10
McG: Discrim Score: -6.92
GvH: Signal Score (-7.5): -9.26
Possible site: 48
>>> Seems to have no N-terminal signal sequence
ALOM program count: 1 value: -1.28 threshold: 0.0
INTEGRAL Likelihood = -1.28 Transmembrane 118-134 (118-134)
PERIPHERAL  Likelihood =  6.89   32
modified ALOM score: 0.76

*** Reasoning Step: 3

----- Final Results -----
               bacterial membrane --- Certainty = 0.1510 (Affirmative) < succ>
                bacterial outside --- Certainty = 0.0000 (Not Clear)   < succ>
              bacterial cytoplasm --- Certainty = 0.0000 (Not Clear)   < succ>
```

The protein has homology with the following sequences in the databases:

```
ORF00263(310-1164 of 1470)
EGAD|17863|BS0036(2-289 of 292) hypothetical 33.0 kd protein in xpac-abrb
intergenic region {Bacillus subtilis} OMNI|NT01BS0044 conserved hypothetical protein
SP|P37544|YABC_BACSU HYPOTHETICAL 33.0 KDA PROTEIN IN XPAC-ABRB INTERGENIC REGION.
GP|467425|dbj|BAA05271.1||D26185 unknown {Bacillus subtilis}
GP|2632303|emb|CAB11812.1||Z99104 similar to hypothetical proteins {Bacillus
subtilis} PIR|S66065|S66065 conserved hypothetical protein yabC - Bacillus subtilis
% Match = 24.5
% Identity = 45.8   % Similarity = 65.7
Matches = 131   Mismatches = 97   Conservative Sub.s = 57

123         153         183         213         243         273         303         333
CSTH*KW*TS*ASERY*SRNRNCS*KF*TRKRITRRHLQ*WLSHL*YFLWSTS*K*RRMCFLY*III*RLMEMQVQKSFK
                                                                      :: |  ||
                                                                      MLRRQMSFN 363         393         423         453         483         513         543         573
SNIHYGTLYLVPTPIGNLDDMTFRAIRILREVDFICAEDTRNTGLLLKHFDITTKQISFHEHNAYDKISGLIDLLKEGKS
  |  ||||||||||||:||||||   |: || | |||| |     | ::|   :|:||||      :|: || ||:
GKSDMGILYLVPTPIGNLEDMTFRAIDTLKSVDAIAAEDTRQTKKLCHVYEIETPLVSYHEHNKESSGHKIIEWLKSGKN
       20          30          40          50          60          70          80

603         633         663         693         723         753         783         813
LAQVSDAGMPSISDPGHDLVKAAIEGDIPVVSIPGASAGITALIASGLAPQPHIFYGFLPRKKGQQITFFETKQDYPETQ
:|  |||| :|:||||  ::||   :  ||   :|||:|||||||||  | |  ||||| |::   :|   :        ||
IALVSDAGLPTISDPGAEIVKDFTDIGGYVVPLPGANAALTALIASGIVPQPFFFYGFLNRQKKEKKKELEALKKRQETI
       100         110         120         130         140         150         160

843         873         903         933         963         993        1023        1053
IFYESPFRVSDTLKHMKEIYGDRQVVLVRELTKLYEEYQRGTISQLLEHIEKVPLKGECLIIVDGKRDTERVKDSSQQDP
||||:| |:  :||  | ||  |||:: :  |||| ||||:::     ::|    ::|: : |   |  ::     :
IFYEAPHRLKETLSAMAEILGDREIAVTRELTKKYEEFIRGTISEVIGWANEDQIRGEFCLVVEGSNNEEVDEEEQWWET
       180         190         200         210         220         230         240

1074        1104        1134        1164        1194        1224        1254        1284
LVL---VKEYIANGDKTNQAIKKVAKEFNLNRQELYASFHDL*VII*KGCQRKIWQPFIISDLAIGIKK*DTSNFLKIFN
|      |: ||: |    : |||| | |: :::|:| ::|
LTAKEHVEHYISKGATSKEAIKKAAVDRNVPKREVYDAYHIKQ
            260         270         280         290
```

SEQ ID 8644 (GBS343) was expressed in *E. coli* as a His-fusion product. SDS-PAGE analysis of total cell extract is shown in FIG. 72 (lane 11; MW 35.4 kDa).

Figure 277:
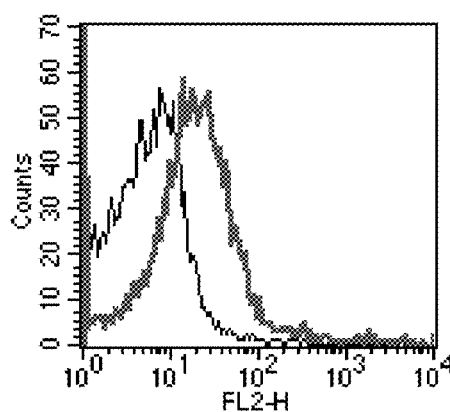

The GBS343-His fusion product was purified (FIG. 215, lane 4) and used to immunise mice. The resulting antiserum was used for FACS (FIG. 277), which confirmed that the protein is immunoaccessible on GBS bacteria.

Based on this analysis, it was predicted that these proteins and their epitopes could be useful antigens for vaccines or diagnostics.

EXAMPLE 709

A DNA sequence (GBSx0753) was identified in *S. agalactiae* <SEQ ID 2185> which encodes the amino acid sequence <SEQ ID 2186>. This protein is predicted to be bA483F11.3 (cutC). Analysis of this protein sequence reveals the following:

```
Possible site: 41
>>> Seems to have no N-terminal signal sequence

----- Final Results -----
            bacterial cytoplasm --- Certainty = 0.2568 (Affirmative) < succ>
            bacterial membrane  --- Certainty = 0.0000 (Not Clear)   < succ>
              bacterial outside --- Certainty = 0.0000 (Not Clear)   < succ>
```

The protein has homology with the following sequences in the GENPEPT database:

```
>GP:CAB88199 GB:AL133353 bA483F11.3 (CGI-32 protein) [Homo sapiens]
Identities = 79/203 (38%), Positives = 116/203 (56%), Gaps = 7/203 (3%)

Query:    3 LREFCAENLTDLTRLDKAIISRVELCDNLAVGGTTPSYGVIKEANQYLHEKGISVAVMIR   62
            L E C +++     ++    R+ELC  L+ GGTTPS GV++   Q +    I V VMIR
Sbjct:   27 LMEVCVDSVESAVNAERGGADRIELCSGLSEGGTTPSMGVLQVVKQSVQ---IPVFVMIR   83

Query:   63 PRGGNFVYNDLELRIMEEDILRAVELESDALVLGILTSNNHIDTEAIEQLLPATQGLPLV  122
            PRGG+F+Y+D E+ +M+ DI  A    +D LV G LT + HID E     L+   + LP+
Sbjct:   84 PRGGDFLYSDREIEVMKADIRLAKLYGADGLVFGALTEDGHIDKELCMSLMAICRPLPVT  143

Query:  123 FHMAFDVIPKSDQKKSIDQLVALGFTRILLHGSSNGEPIIENIKHIKALVEYANNRIEIM  182
            FH AFD++   D   +++ L+ LGF R+L   G  +   +E +  IK L+E A  RI +M
Sbjct:  144 FHRAFDMV--HDPMAALETLLTLGFERVLTSGCDSS--ALEGLPLIKRLIEQAKGRIVVM  199

Query:  183 VGGGVTAENYQYICQETGVKQAH                                       205
            GGG+T  N Q I + +G   + H
Sbjct:  200 PGGGITDRNLQRILEGSGATEFH                                       222
```

A related DNA sequence was identified in *S. pyogenes* <SEQ ID 2187> which encodes the amino acid sequence <SEQ ID 2188>. Analysis of this protein sequence reveals the following:

```
Possible site: 57
>>> Seems to have no N-terminal signal sequence

----- Final Results -----
            bacterial cytoplasm --- Certainty = 0.2372 (Affirmative) < succ>
            bacterial membrane  --- Certainty = 0.0000 (Not Clear)   < succ>
              bacterial outside --- Certainty = 0.0000 (Not Clear)   < succ>
```

An alignment of the GAS and GBS proteins is shown below:

```
Identities = 143/208 (68%), Positives = 168/208 (80%)

Query:    2 ILREFCAENLTDLTRLDKAIISRVELCDNLAVGGTTPSYGVIKEANQYLHEKGISVAVMI   61
            +++EFCAENLT L  LD   ISRVELCDNLAVGGTTPSYGVIKEA Q LH+K ISVA MI
Sbjct:    1 MIKEFCAENLTLLPTLDAGQISRVELCDNLAVGGTTPSYGVIKEACQLLHDKKISVATMI   60
```

```
-continued
Query:    62 RPRGGNFVYNDLELRIMEEDILRAVELESDALVLGILTSNNHIDTEAIEQLLPATQGLPL   121
             RPRGG+FVYNDLEL+ MEEDIL+AVE  SDALVLG+LT+ N +DT+AIEQLLPATQGLPL
Sbjct:    61 RPRGGDFVYNDLELKAMEEDILKAVEAGSDALVLGLLTTENQLDTDAIEQLLPATQGLPL   120

Query:   122 VFHMAFDVIPKSDQKKSIDQLVALGFTRILLHGSSNGEPIIENIKHIKALVEYANNRIEI   181
             VFHMAFD IP   Q +++DQL+  GF R+L HGS      PI +N++ +K+LV YAN RIEI
Sbjct:   121 VFHMAFDRIPTDHQHQALDQLIDYGFVRVLTHGSPEATPITDNVEQLKSLVTYANKRIEI   180

Query:   182 MVGGGVTAENYQYICQETGVKQAHGTRI                                 209
             M+GGG+TAEN Q + Q TG    HGT+I
Sbjct:   181 MIGGGITAENCQSLSQLTGTAIVHGTKI                                 208
```

Based on this analysis, it was predicted that these proteins and their epitopes could be useful antigens for vaccines or diagnostics.

EXAMPLE 710

A DNA sequence (GBSx0754) was identified in *S. agalactiae* <SEQ ID 2189> which encodes the amino acid sequence <SEQ ID 2190>. Analysis of this protein sequence reveals the following:

```
Possible site: 23
>>> Seems to have no N-terminal signal sequence

----- Final Results -----
              bacterial cytoplasm --- Certainty = 0.1216 (Affirmative) < succ>
              bacterial membrane  --- Certainty = 0.0000 (Not Clear)   < succ>
              bacterial outside   --- Certainty = 0.0000 (Not Clear)   < succ>
```

The protein has homology with the following sequences in the GENPEPT database:

```
>GP:BAA12206 GB:D84061 phosphoserine aminotransferase
[Spinacia oleracea]
Identities = 65/109 (59%), Positives = 79/109 (71%), Gaps = 1/109 (0%)

Query:     3 IYNFSAGPAVLPKPVLVKAQSELLNYQGSSMSVLEVSHRSKEFDDIIKGAERYLRDLMGI    62
             ++NF+AGPAVLP+ VL KAQSELLN++GS GMSV+E+SHR KEF  II  AE  LR L+ I
Sbjct:    69 VFNFAAGPAVLPENVLQKAQSELLNWRGSGMSVMEMSHRGKEFTSIIDKAEADLRTLLNI   128

Query:    63 PDNYKVIFLQGGASLQFSMIPLNIARGRKAY-YHVAGSWGEKSLYRGCK            110
             P +Y V+FLQGGAS QFS IPLN+      A Y Y V GSWG+K+       K
Sbjct:   129 PSDYTVLFLQGGASTQFSAIPLNLCTPDSAVDYIVTGSWGDKAAKEAAK            177
```

No corresponding DNA sequence was identified in *S. pyogenes*.

Based on this analysis, it was predicted that this protein and its epitopes, could be useful antigens for vaccines or diagnostics.

EXAMPLE 711

A DNA sequence (GBSx0755) was identified in *S. agalactiae* <SEQ ID 2191> which encodes the amino acid sequence <SEQ ID 2192>. Analysis of this protein sequence reveals the following:

```
Possible site: 24
>>> Seems to have an uncleavable N-term signal seq

----- Final Results -----
              bacterial membrane  --- Certainty = 0.0000 (Not Clear) < succ>
              bacterial outside   --- Certainty = 0.0000 (Not Clear) < succ>
              bacterial cytoplasm --- Certainty = 0.0000 (Not Clear) < succ>
```

The protein has no significant homology with any sequences in the GENPEPT database.

No corresponding DNA sequence was identified in S. pyogenes.

Based on this analysis, it was predicted that this protein and its epitopes, could be useful antigens for vaccines or diagnostics.

EXAMPLE 712

A DNA sequence (GBSx0756) was identified in S. agalactiae <SEQ ID 2193> which encodes the amino acid sequence <SEQ ID 2194>. This protein is predicted to be phosphoserine aminotransferase (serC). Analysis of this protein sequence reveals the following:

```
Possible site: 50
>>> Seems to have no N-terminal signal sequence

----- Final Results -----
             bacterial cytoplasm --- Certainty = 0.3380 (Affirmative) < succ>
             bacterial membrane  --- Certainty = 0.0000 (Not Clear)   < succ>
              bacterial outside  --- Certainty = 0.0000 (Not Clear)   < succ>
```

A related GBS nucleic acid sequence <SEQ ID 10049> which encodes amino acid sequence <SEQ ID 10050> was also identified.

The protein has homology with the following sequences in the GENPEPT database:

```
>GP:AAF94318 GB:AE004196 phosphoserine aminotransferase
[Vibrio cholerae]
Identities = 104/210 (49%), Positives = 152/210 (71%), Gaps 3/210 (1%)

Query:    4 NNTIEGTSLYDIPKTNEVPVIADMSSNILAVKYKVEDFAMIYAGAQKNIGPAGVTVVIIR    63
            N TI+G  + D+P T++ P++ADMSS IL+ +  V  + +IYAGAQKNIGPAG+ + I+R
Sbjct:  170 NETIDGIEINDLPVTDK-PIVADMSSTILSREIDVSKYGVIYAGAQKNIGPAGICIAIVR   228

Query:   64 EDMIN-EEPTLSSMLDYKIQSDAGSLYNTPPAYSIYIAKLVFEWVKSLGGVDAMEKANRE   122
            +D+++      L  +L+YKI ++    S++NTPP ++ Y++ LVF+W+K+ GGV A+E+ NR
Sbjct:  229 DDLLDLASDLLPGVLNYKILAEQESMFNTPPTFAWYLSGLVFQWLKAQGGVKAIEEVNRA   288

Query:  123 KSGLLYDYIDSSEFYSNPVRDKKSRSLCNIPFITINKDLDEKFVKEATERGFKNIKGHRS   182
            K+ LLY YIDSS+FY N +      +RSL N+PF      +LD+ F++ A  RG  ++KGHR
Sbjct:  289 KAALLYGYIDSSDFYRNEIH-PDNRSLMNVPFQLAKPELDDTFLELAEARGLVSLKGHRV   347

Query:  183 VGGMRASLYNAFPKQGVIELIDFMKTFEAE                                212
            VGGMRAS+YNA P +GV  L+DFMK FEA+
Sbjct:  348 VGGMRASIYNAMPLEGVQALVDFMKEFEAQ                                377
```

No corresponding DNA sequence was identified in S. pyogenes.

Based on this analysis, it was predicted that these proteins and their epitopes could be useful antigens for vaccines or diagnostics.

EXAMPLE 713

A DNA sequence (GBSx0757) was identified in S. agalactiae <SEQ ID 2195> which encodes the amino acid sequence <SEQ ID 2196>. Analysis of this protein sequence reveals the following:

```
Possible site: 27
>>> Seems to have no N-terminal signal sequence

----- Final Results -----
             bacterial cytoplasm --- Certainty = 0.0466 (Affirmative) < succ>
             bacterial membrane  --- Certainty = 0.0000 (Not Clear)   < succ>
              bacterial outside  --- Certainty = 0.0000 (Not Clear)   < succ>
```

A related GBS nucleic acid sequence <SEQ ID 10047> which encodes amino acid sequence <SEQ ID 10048> was also identified.

The protein has homology with the following sequences in the GENPEPT database:

```
>GP:CAB73701 GB:AL139079 putative acetyltransferase
[Campylobacter jejuni]
Identities = 46/170 (27%), Positives = 78/170 (45%), Gaps = 13/170 (7%)

Query:    7 IRLAFPNEIDQIMLLIEEARAEIAKTGSDQWQKEDGYPNRNDIIDDILNGYAWVGIEDGM   66
            I+ A   +++ I+ + ++A   +     QW  ++ YPN     +DI     +V  E+
Sbjct:    6 IQKAVNKDLNSILEITKDALNAMKTMNFHQW--DENYPNEIVFQEDIQAQELYVFKENDE  63

Query:   67 LATYAAVIDGHE-EVYDAIYEGKWLHDNHRYLTFHRIAISNQFRGRGLAQTFLQGL----  121
            +  +  + + +E Y  +    K    D    YL   HR+A+      +G+G+AQ    L
Sbjct:   64 ILGFICINEKFKPEFYKQVIFNKNYDDKAFYL--HRLAVKQNAKGKGVAQKLLNFCENFA  121

Query:  122 IEGHKGPDFRCDTHEKNVTMQHILNKLGYQYCGKVPLDGVR---LAYQKI           168
            +E  HK    R DTH KN  M  +  KL + +CG  +   +     LAY+KI
Sbjct:  122 LENHKA-SLRADTHSKNFPMNSLFKKLDFNFCGNFDIPNYQDPFLAYEKI           170
```

No corresponding DNA sequence was identified in *S. pyogenes*.

Based on this analysis, it was predicted that these proteins and their epitopes could be useful antigens for vaccines or diagnostics.

EXAMPLE 714

A DNA sequence (GBSx0758) was identified in *S. agalactiae* <SEQ ID 2197> which encodes the amino acid sequence <SEQ ID 2198>. Analysis of this protein sequence reveals the following:

```
Possible site: 28
>>> Seems to have no N-terminal signal sequence

----- Final Results -----
             bacterial cytoplasm --- Certainty = 0.2968 (Affirmative) < succ>
             bacterial membrane  --- Certainty = 0.0000 (Not Clear)   < succ>
              bacterial outside  --- Certainty = 0.0000 (Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 7151

A DNA sequence (GBSx0759) was identified in *S. agalactiae* <SEQ ID 2199> which encodes the amino acid sequence <SEQ ID 2200>. This protein is predicted to be D-3-phosphoglycerate dehydrogenase (serA). Analysis of this protein sequence reveals the following:

```
Possible site: 54
>>> Seems to have no N-terminal signal sequence

----- Final Results -----
             bacterial cytoplasm --- Certainty = 0.3102 (Affirmative) < succ>
             bacterial membrane  --- Certainty = 0.0000 (Not Clear)   < succ>
              bacterial outside  --- Certainty = 0.0000 (Not Clear)   < succ>
```

A related GBS nucleic acid sequence <SEQ ID 10045> which encodes amino acid sequence <SEQ ID 10046> was also identified.

The protein has homology with the following sequences in the GENPEPT database:

```
>GP:AAB99020 GB:U67544 phosphoglycerate dehydrogenase (serA)
[Methanococcus jannaschii]
Identities = 102/313 (32%), Positives = 168/313 (53%), Gaps = 21/313 (6%)

Query:   31 ENPDAYIIRSQNLHNQDF---PSNLKAIARAGAGTNNIPIEEASAQGIVVFNTPGANANA   87
            ++ D  ++RS      +D          LK I RAG G +NI +E A+ +GI+V N P A++ +
Sbjct:   40 KDADVLVVRSGTKVTRDVIEKAEKLKVIGRAGVGVDNIDVEAATEKGIIVVNAPDASSIS   99

Query:   88 VKEAVIAALLLSARDYLGANRWVNTLTGTDIPKQIEAGKKAFAGNEIAGKKLGVIGLGAI  147
            V E  +  +L +AR         N    T   K+ E   +K F G E+ GK LGVIGLG I
Sbjct:  100 VAELTMGLMLAAAR---------NIPQATASLKRGEWDRKRFKGIELYGKTLGVIGLGRI  150

Query:  148 GARIANDARRLGMTVLGYDPYVSIETAWNISSHVQRVKEIKDIFETCDYITIHVPLTNET  207
            G ++     A+  GM ++GYDPY+   E A ++     V+ V +I ++ +  D+IT+HVPLT +T
Sbjct:  151 GQQVVKRAKAFGMNIIGYDPYIPKEVAESMG--VELVDDINELCKRADFITLHVPLTPKT  208

Query:  208 KHTFDAKAFSIMKKGTTIINFARAELVNNQELFEAIETGVVKRYITDFGDKE------LL  261
            +H    +  ++MKK    I+N AR  L++ + L+EA++  G  +       D   ++E      LL
Sbjct:  209 RHIIGREQIALMKKNAIIVNCARGGLIDEKALYEALKEGKIRAAALDVFEEEPPKDNPLL  268

Query:  262 NQKGITVFPHVGGSTDEAELNCAIMASQTIRCFMETGEITNSVNFPNVHQIQTAPFR-IT  320
                 +     PH G ST+EA+    +  ++ I+   +        N VN PN+ Q +       +
Sbjct:  269 TLDNVIGTPHQGASTEEAQKAAGTIVAEQIKKVLRGELAENVVNMPNIPQEKLGKLKPYM  328

Query:  321 LINKNVPNIVAKI                                                333
            L+ + +  NIV ++
Sbjct:  329 LLAEMLGNIVMQV                                                341
```

There is also homology to SEQ ID 124.

Based on this analysis, it was predicted that these proteins and their epitopes could be useful antigens for vaccines or diagnostics.

EXAMPLE 716

A DNA sequence (GBSx0760) was identified in *S. agalactiae* <SEQ ID 2201> which encodes the amino acid sequence <SEQ ID 2202>. This protein is predicted to be methylated-DNA—protein-cysteine S-methyltransferase (ogt). Analysis of this protein sequence reveals the following:

```
Possible site: 18
>>> Seems to have no N-terminal signal sequence

----- Final Results -----
           bacterial cytoplasm --- Certainty = 0.2460(Affirmative) < succ>
            bacterial membrane --- Certainty = 0.0000(Not Clear) < succ>
             bacterial outside --- Certainty = 0.0000(Not Clear) < succ>
```

The protein has homology with the following sequences in the GENPEPT database:

```
>GP:AAF96913 GB:AE004427 methylated-DNA--protein-cysteine
S-methyltransferase [Vibrio cholerae]
Identities = 73/156 (46%), Positives = 99/156 (62%), Gaps = 9/156 (5%)

Query:    7 YQSPLGEIRLLADNLGLSGLYFVGQKYDMLAVNQEEIVNMSNSYTLLGK--KWLDAYFSQ   64
            Y SPLG + L A + GL G++F  Q          E + +     +L K   + LD YFS
Sbjct:    7 YSSPLGPMTLQASSQGLLGVWFATQ-----TTQPEHLGDYVKECPILNKTIRQLDEYFSG   61

Query:   65 QNLP-SIPLSLRGTAFQTRVWQELQKIPFGDTKTYGELAKEL-NCQSAQAVGGAIGKNSI  122
            Q     +PL+  GTAFQ  VW  L KIP+G+   +Y +LA+ + N ++ +AVG A GKN I
Sbjct:   62 QRTQFELPLAASGTAFQQSVWHALCKIPYGEIWSYQQLAEAIGNPKAVRAVGLANGKNPI  121

Query:  123 SLIIPCHRVLGRYGQLTGYAGGLERKSWLLEYEKEK                         158
            S+I+PCHRV+G+  GQLTGYAGGLERK++LLE EK +
Sbjct:  122 SIIVPCHRVVGKNGQLTGYAGGLERKAFLLELEKRR                         157
```

No corresponding DNA sequence was identified in S. pyogenes.

Based on this analysis, it was predicted that this protein and its epitopes, could be useful antigens for vaccines or diagnostics.

EXAMPLE 717

A DNA sequence (GBSx0761) was identified in S. agalactiae <SEQ ID 2203> which encodes the amino acid sequence <SEQ ID 2204>. Analysis of this protein sequence reveals the following:

```
Possible site: 42
>>> Seems to have no N-terminal signal sequence

----- Final Results -----
            bacterial cytoplasm --- Certainty = 0.3137(Affirmative) < succ>
             bacterial membrane --- Certainty = 0.0000(Not Clear)   < succ>
              bacterial outside --- Certainty = 0.0000(Not Clear)   < succ>
```

The protein has homology with the following sequences in the GENPEPT database:

```
>GP:BAB07204 GB:AP001518 arsenate reductase [Bacillus halodurans]
Identities = 56/107 (52%), Positives = 74/107 (68%), Gaps = 1/107 (0%)

Query:    3  TFYEYPKCTTCRSAKKELTELGLTFEAIDIKSNPPKVSLLKELLENSPYDLKKFFNTSGN   62
             TFY+YPKC TC+ AKK L + G+    ++ I     PP      LK+L E S  +LKKFFNTSG
Sbjct:    4  TFYQYPKCGTCQKAKKWLDQHGIEVNSVHIVEQPPSKEELKQLYEQSGLELKKFFNTSGK   63

Query:   63  SYRELGLKDKFDDLTLDQALDLLASDGMLIKRPLLVKDNKILQIGYR              109
             YRELGLKDK  + + D+ L+ LASDGMLIKRP+L    +K+   +G++
Sbjct:   64  KYRELGLKDKVKEASEDELLETLASDGMLIKRPILTDGDKV-TVGFK              109
```

A related DNA sequence was identified in S. pyogenes <SEQ ID 2205> which encodes the amino acid sequence <SEQ ID 2206>. Analysis of this protein sequence reveals the following:

```
Possible site: 38
>>> Seems to have no N-terminal signal sequence

----- Final Results -----
            bacterial cytoplasm --- Certainty = 0.3969(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below:

```
Identities = 64/99 (64%), Positives = 79/99 (79%)

Query:   19  ELTELGLTFEAIDIKSNPPKVSLLKELLENSPYDLKKFFNTSGNSYRELGLKDKFDDLTL   78
             EL +L    FEAIDIK+NPPK    LK  +E S Y +K FFNTSGNSYRELGLKDK D L+L
Sbjct:    3  ELKQLVSDFEAIDIKANPPKAQDLKHWMETSGYTIKNFFNTSGNSYRELGLKDKIDQLSL   62

Query:   79  DQALDLLASDGMLIKRPLLVKDNKILQIGYRTKYKDLNL                      117
             D+A +LLA+DGMLIKRP+L+KD   +LQ+GYR  Y++L+L
Sbjct:   63  DKAAELLATDGMLIKRPILIKDGNVLQVGYRKPYQELDL                      101
```

Based on this analysis, it was predicted that these proteins and their epitopes could be useful antigens for vaccines or diagnostics.

EXAMPLE 718

A DNA sequence (GBSx0762) was identified in S. agalactiae <SEQ ID 2207> which encodes the amino acid sequence <SEQ ID 2208>. This protein is predicted to be exodeoxyribonuclease (exoA). Analysis of this protein sequence reveals the following:

```
Possible site: 22
>>> Seems to have no N-terminal signal sequence

----- Final Results -----
              bacterial cytoplasm --- Certainty = 0.1859(Affirmative) < succ>
               bacterial membrane --- Certainty = 0.0000(Not Clear)   < succ>
                bacterial outside --- Certainty = 0.0000(Not Clear)   < succ>
```

The protein has homology with the following sequences in the GENPEPT database:

```
>GP:AAA26879 GB:J04234 exodeoxyribonuclease [Streptococcus pneumoniae]
Identities = 217/275 (78%), Positives = 245/275 (88%)

Query:    1  MKLISWNIDSLNAALTSESTRALMSRQVIDTLVAEDADIIAIQETKLSAKGPTKKHLEVL   60
             MKLISWNIDSLNAALTS+S RA +S++V+ TLVAE+ADIIAIQETKLSAKGPTKKH+E+L
Sbjct:    1  MKLISWNIDSLNAALTSDSARAKLSQEVLQTLVAENADIIAIQETKLSAKGPTKKHVEIL   60

Query:   61  ETYFPEYDLVWRSSVEPARKGYAGTMFLYRKGLNPIVSFPEIDAPTTMDNEGRIITLELE  120
              E  FP Y+  WRSS EPARKGYAGTMFLY+K L P +SFPEI AP+TMD EGRIITLE +
Sbjct:   61  EELFPGYENTWRSSQEPARKGYAGTMFLYKKELTPTISFPEIGAPSTMDLEGRIITLEFD  120

Query:  121  NCYITQVYTPNAGDGLKRLADRQIWDIKYAEYLATLDSQKPVLATGDYNVAHKEIDLANP  180
                ++TQVYTPNAGDGLKRL +RQ+WD KYAEYLA LD +KPVLATGDYNVAH EIDLANP
Sbjct:  121  AFFVTQVYTPNAGDGLKRLEERQVWDAKYAEYLAELDKEKPVLATGDYNVAHNEIDLANP  180

Query:  181  SSNRRSAGFTAEERQGFTNLLAKGFTDTFRYLHGDVPNVYSWWAQRSRTSKINNTGWRID  240
             +SNRRS GFT EER GFTNLLA GFTDTFR++HGDVP  Y+WWAQRS+TSKINNTGWRID
Sbjct:  181  ASNRRSPGFTDEERAGFTNLLATGFTDTFRHVHGDVPERYTWWAQRSKTSKINNTGWRID  240

Query:  241  YWLTSNRVADKITKSEMIHSGDRQDHTPIILEIEL                           275
             YWLTSNR+ADK+TKS+MI SG RQDHTPI+LEI+L
Sbjct:  241  YWLTSNRIADKVTKSDMIDSGARQDHTPIVLEIDL                           275
```

A related DNA sequence was identified in *S. pyogenes* <SEQ ID 2209> which encodes the amino acid sequence <SEQ ID 2210>. Analysis of this protein sequence reveals the following:

```
Possible site: 13
>>> Seems to have no N-terminal signal sequence

----- Final Results -----
              bacterial cytoplasm --- Certainty = 0.2181(Affirmative) < succ>
               bacterial membrane --- Certainty = 0.0000(Not Clear)   < succ>
                bacterial outside --- Certainty = 0.0000(Not Clear)   < succ>
```

An alignment of the GAS and GBS proteins is shown below:

```
Identities = 221/275 (80%), Positives = 251/275 (90%)

Query:    1  MKLISWNIDSLNAALTSESTRALMSRQVIDTLVAEDADIIAIQETKLSAKGPTKKHLEVL   60
             MKLISWNIDSLNAALT ES RAL+SR V+DTLVA+DADIIAIQETKLSAKGPTKKH+E L
Sbjct:    1  MKLISWNIDSLNAALTGESPRALLSRAVLDTLVAQDADIIAIQETKLSAKGPTKKHIETL   60

Query:   61  ETYFPEYDLVWRSSVEPARKGYAGTMFLYRKGLNPIVSFPEIDAPTTMDNEGRIITLELE  120
              +YFP Y  VWRSSVEPARKGYAGTMFLY+  LNP+++FPEI APTTMD EGRIITLE E
Sbjct:   61  LSYFPNYLHVWRSSVEPARKGYAGTMFLYKNTLNPVITFPEIGAPTTMDAEGRIITLEFE  120

Query:  121  NCYITQVYTPNAGDGLKRLADRQIWDIKYAEYLATLDSQKPVLATGDYNVAHKEIDLANP  180
             + ++TQVYTPNAGDGL+RL DRQIWD KYA+YL   LD+QKPVLATGDYNVAHKEIDLANP
Sbjct:  121  DFFVTQVYTPNAGDGLRRLDDRQIWDHKYADYLTELDAQKPVLATGDYNVAHKEIDLANP  180

Query:  181  SSNRRSAGFTAEERQGFTNLLAKGFTDTFRYLHGDVPNVYSWWAQRSRTSKINNTGWRID  240
             +SNRRS GFT EERQGFTNLLA GFTDTFR++HGD+P+VY+WWAQRS+TSKINNTGWRID
Sbjct:  181  NSNRRSPGFTDEERQGFTNLLARGFTDTFRHVHGDIPHVYTWWAQRSKTSKINNTGWRID  240

Query:  241  YWLTSNRVADKITKSEMIHSGDRQDHTPIILEIEL                           275
             YWL SNR+ DK+ +SEMI SG+RQDHTPI+L+I+L
Sbjct:  241  YWLASNRLVDKVKRSEMISSGERQDHTPILLDIDL                           275
```

Based on this analysis, it was predicted that these proteins and their epitopes could be useful antigens for vaccines or diagnostics.

EXAMPLE 719

A DNA sequence (GBSx0763) was identified in *S. agalactiae* <SEQ ID 2211> which encodes the amino acid sequence <SEQ ID 2212>. Analysis of this protein sequence reveals the following:

```
Possible site: 39
>>> Seems to have no N-terminal signal sequence
    INTEGRAL    Likelihood = -7.96    Transmembrane    28-44 (22-49)

----- Final Results -----
            bacterial membrane --- Certainty = 0.4185(Affirmative) < succ>
            bacterial outside  --- Certainty = 0.0000(Not Clear)   < succ>
            bacterial cytoplasm --- Certainty = 0.0000(Not Clear)  < succ>
```

A related GBS nucleic acid sequence <SEQ ID 8645> which encodes amino acid sequence <SEQ ID 8646> was also identified. Analysis of this protein sequence reveals the following:

```
Lipop Possible site: -1 Crend: 5
McG: Discrim Score: 17.78
GvH: Signal Score (-7.5): -4.56
    Possible site: 55
>>> Seems to have an uncleavable N-term signal seq
ALOM program count: 1 value: -7.96 threshold: 0.0
    INTEGRAL    Likelihood = -7.96    Transmembrane    8-24 (2-29)
    PERIPHERAL  Likelihood = 9.28     138
modified ALOM score: 2.09
*** Reasoning Step: 3

----- Final Results -----
            bacterial membrane --- Certainty = 0.4185(Affirmative) < succ>
            bacterial outside  --- Certainty = 0.0000(Not Clear)   < succ>
            bacterial cytoplasm --- Certainty = 0.0000(Not Clear)  < succ>
```

The protein has homology with the following sequences in the GENPEPT database:

```
>GP:AAD11512 GB:U60828 unknown [Lactococcus lactis]
Identities = 53/240 (22%), Positives = 102/240 (42%), Gaps = 24/240 (10%)

Query:   65 PTILIPGSSATQERFNSMLAQL----NQMGEKHSVLKLTVKKDNSIIYNGQISGNDHKPY 120
            PTI I GS      + ++ +L     N   +K V+   + K+  +  GQIS ++  P
Sbjct:   64 PTIYIGGSGGNVTSIDWLVERLLPIKNISSQKSLVMTSNITKNYELKVEGQISQDNKYPI 123

Query:  121 IVIGFENNEDGYSNIKKQTKWLQIAMNDLQKKYKFKRFNAIGHSNGGLSWTIFLEDYYDS 180
            I         G ++ +  +K LQ  +  L + Y+     N +G+S+G       ++ D ++
Sbjct:  124 IEFA---TVKGTNSGELFSKGLQKIIVYLTENYQVPWINLVGYSSGATGAVYYMMDTGNN 180

Query:  181 DEFD-MKSLLTMGTPFNFEES-----NTSN--------HTQMLKDLISNKGNIPSSLMVY 226
              F  +   +++   +N E +     + SN         T+M + +  N   + S   +
Sbjct:  181 PNFPPVNKYVSLDGEYNNETNLQLGESLSNVLKEGPIVKTEMYQYIADNYQKVSSKTQML 240

Query:  227 NLAGT--NSYDGDKIVPFASVETGKYIFQETAKHYTQLTVTGNNATHSDLPDNPEVIQYV 284
               L G +   D   +P+A   +   ++F++     T    T+     +HS  P NP V++YV
Sbjct:  241 LLEGNFNSEKQTDSAIPWADSFSIYHLFKKNGNEITT-TLYPTKTSHSQAPKNPTVVKYV 299
```

No corresponding DNA sequence was identified in *S. pyogenes*.

Figure 43:
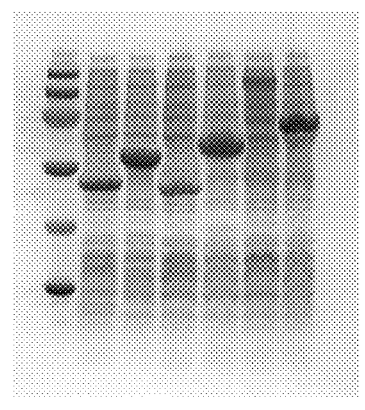

SEQ ID 8646 (GBS219) was expressed in *E. coli* as a His-fusion product. SDS-PAGE analysis of total cell extract is shown in FIG. 43 (lane 3; MW 31.6 kDa). It was also expressed in *E. coli* as a GST-fusion product. SDS-PAGE analysis of total cell extract is shown in FIG. 47 (lane 7; MW 56 kDa).

GBS219-GST was purified as shown in FIG. 203, lane 5.

Based on this analysis, it was predicted that these proteins and their epitopes could be useful antigens for vaccines or diagnostics.

EXAMPLE 720

A DNA sequence (GBSx0764) was identified in *S. agalactiae* <SEQ ID 2213> which encodes the amino acid sequence <SEQ ID 2214>. This protein is predicted to be PTS system, cellobiose-specific IIC component. Analysis of this protein sequence reveals the following:

```
Possible site: 46
>>> Seems to have no N-terminal signal sequence
      INTEGRAL      Likelihood = -7.64    Transmembrane    263-279  (260-282)
      INTEGRAL      Likelihood = -6.26    Transmembrane    200-216  (197-226)
      INTEGRAL      Likelihood = -5.95    Transmembrane    157-173  (156-175)
      INTEGRAL      Likelihood = -5.79    Transmembrane    307-323  (306-332)
      INTEGRAL      Likelihood = -5.68    Transmembrane    131-147  (126-148)
      INTEGRAL      Likelihood = -4.73    Transmembrane    375-391  (370-396)
      INTEGRAL      Likelihood = -3.61    Transmembrane    101-117  (98-119)
      INTEGRAL      Likelihood = -1.75    Transmembrane    326-342  (324-342)
      INTEGRAL      Likelihood = -0.37    Transmembrane     25-41   (25-41)
      INTEGRAL      Likelihood = -0.16    Transmembrane     71-87   (71-88)

----- Final Results -----
             bacterial membrane --- Certainty = 0.4057(Affirmative) < succ>
             bacterial outside  --- Certainty = 0.0000(Not Clear)   < succ>
             bacterial cytoplasm --- Certainty = 0.0000(Not Clear)   < succ>
```

The protein has homology with the following sequences in the GENPEPT database:

```
>GP:AAC74807 GB:AE000268 PEP-dependent phosphotransferase enzyme II
for cellobiose, arbutin, and salicin [Escherichia coli K12]
Identities = 60/197 (30%), Positives = 83/197 (41%), Gaps = 12/197 (6%)

Query:  209 LAIFLTLSGLFVPDIL--FRPYSYFSVVSENLNAALSQHTDKIPYLYTFYTVKNSFAMFG  266
            LA+    +G+ P L     Y + V   L A + H    P L         +SF    G
Sbjct:  253 LALTALDNGIMTPWALENIATYQQYGSVEAALAAGKTFHIWAKPML-------DSFIFLG  305

Query:  267 GIGILLSLFLAVLYESRKLQSKNYYKLTLLTLTPLIFDQNLPFLVGLPVILQPILFIPMV  326
            G G  L L LA+   SR+   +Y ++  L L   IF  N P L GLP+I+ P++FIP V
Sbjct:  306 GSGATLGLILAIFIASRRA---DYRQVAKLALPSGIFQINEPILFGLPIIMNPVMFIPFV  362

Query:  327 LTTIFAEAFGALMLYLKFVDPAVYTVPSGTPSLLFGFLASNGDWRYLPVTAIILVVGFFI  386
            L    A    Y+ + P     P  P+ L F  +NG    L V    L +     I
Sbjct:  363 LVQPILAAITLAAYYMGIIPPVTNIAPWTMPTGLGAFFNTNGSVAALLVALFNLGIATLI  422

Query:  387 YRPFVKIAFAKEEQYEK                                            403
            Y PFV +A   +  +K
Sbjct:  423 YLPFVVVANKAQNAIDK                                            439
```

Based on this analysis, it was predicted that this protein and its epitopes, could be useful antigens for vaccines or diagnostics.

EXAMPLE 721

A DNA sequence (GBSx0765) was identified in *S. agalactiae* <SEQ ID 2217> which encodes the amino acid sequence <SEQ ID 2218>. Analysis of this protein sequence reveals the following:

```
Possible site: 14
>>> Seems to have no N-terminal signal sequence

----- Final Results -----
             bacterial cytoplasm --- Certainty = 0.1991(Affirmative) < succ>
             bacterial membrane  --- Certainty = 0.0000(Not Clear)   < succ>
             bacterial outside   --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 722

A DNA sequence (GBSx0766) was identified in *S. agalactiae* <SEQ ID 2219> which encodes the amino acid sequence <SEQ ID 2220>. Analysis of this protein sequence reveals the following:

```
Possible site: 39
>>> Seems to have no N-terminal signal sequence
    INTEGRAL    Likelihood = -5.79    Transmembrane    188-204 (179-206)
    INTEGRAL    Likelihood = -5.36    Transmembrane    105-121 (104-127)
    INTEGRAL    Likelihood = -4.41    Transmembrane    212-228 (210-229)
    INTEGRAL    Likelihood = -3.45    Transmembrane     72-88  (69-89)
    INTEGRAL    Likelihood = -0.48    Transmembrane    124-140 (124-140)

----- Final Results -----
              bacterial membrane --- Certainty = 0.3314(Affirmative) < succ>
               bacterial outside --- Certainty = 0.0000(Not Clear)   < succ>
             bacterial cytoplasm --- Certainty = 0.0000(Not Clear)   < succ>
```

A related GBS nucleic acid sequence <SEQ ID 8647> which encodes amino acid sequence <SEQ ID 8648> was also identified. Analysis of this protein sequence reveals the following:

```
Lipop Possible site: -1 Crend: 6
SRCFLG: 0
McG: Length of UR: 5
     Peak Value of UR: 2.99
     Net Charge of CR: 4
McG: Discrim Score: 6.88
GvH: Signal Score (-7.5): -2.86
     Possible site: 30
>>> Seems to have an uncleavable N-term signal seq
Amino Acid Composition: calculated from 1
ALOM program count: 5 value: -5.79 threshold: 0.0
    INTEGRAL     Likelihood = -5.79    Transmembrane    179-195 (170-197)
    INTEGRAL     Likelihood = -5.36    Transmembrane     96-112 (95-118)
    INTEGRAL     Likelihood = -4.41    Transmembrane    203-219 (201-220)
    INTEGRAL     Likelihood = -3.45    Transmembrane     63-79  (60-80)
    PERIPHERAL   Likelihood =  0.10        18
modified ALOM score: 1.66
icm1 HYPID: 7 CFP: 0.331
*** Reasoning Step: 3

----- Final Results -----
              bacterial membrane --- Certainty = 0.3314(Affirmative) < succ>
               bacterial outside --- Certainty = 0.0000(Not Clear)   < succ>
             bacterial cytoplasm --- Certainty = 0.0000(Not Clear)   < succ>
```

The protein has no significant homology with any sequences in the GENPEPT database.

A related DNA sequence was identified in S. pyogenes <SEQ ID 2221> which encodes the amino acid sequence <SEQ ID 2222>. Analysis of this protein sequence reveals the following:

```
Possible site: 30
>>> Seems to have a cleavable N-term signal seq.
    INTEGRAL    Likelihood = -11.20    Transmembrane    179-195 (173-201)
    INTEGRAL    Likelihood =  -3.66    Transmembrane     96-112 (95-113)
    INTEGRAL    Likelihood =  -1.44    Transmembrane    203-219 (203-219)
    INTEGRAL    Likelihood =  -0.96    Transmembrane    115-131 (115-131)
    INTEGRAL    Likelihood =  -0.64    Transmembrane     63-79  (63-79)

----- Final Results -----
              bacterial membrane --- Certainty = 0.5479(Affirmative) < succ>
               bacterial outside --- Certainty = 0.0000(Not Clear)   < succ>
             bacterial cytoplasm --- Certainty = 0.0000(Not Clear)   < succ>
```

The protein has no significant homology with any sequences in the GENPEPT database.

An alignment of the GAS and GBS proteins is shown below:

```
Identities = 160/228 (70%), Positives = 185/228 (80%)

Query:   10 MSKKSHRQYQIYEGLRCAVALCFISGYINAFTYVTQGKRFAGVQTGNLLSFAIHLSNKHY  69
            MSKK  + YQ+YEGLRCA+ LCFISGY+NAFTY+TQGKRFAGVQTGNLLSFAI LS +
Sbjct:    1 MSKKKRKHYQVYEGLRCAMTLCFISGYVNAFTYMTQGKRFAGVQTGNLLSFAIRLSEQQL  60
```

-continued
```
Query:    70 SQALAFLLPIMVFMLGQSFTYFMNRWANKHQLHWYLLSSFALTQVAIVTIILTPFLPSSF  129
             +AL FLLP++VFMLGQSFTYFM+RWA K  LHWYLLSS  LT +A  T + TPFLPS+
Sbjct:    61 KEALQFLLPMIVFMLGQSFTYFMHRWATKKGLHWYLLSSVILTGIAFGTALFTPFLPSNV  120

Query:   130 TVAGLAFFASIQVDTFKSLRGAPYANMMMTGNIKNAAYLLTKGLYEKNSDIFLIARNTII  189
             TVA LAFFASIQVDTFK+LRGA YAN+MMTGNIKNAAYLLTKGLYEKN ++  I RNT+I
Sbjct:   121 TVAALAFFASIQVDTFKTLRGASYANVMMTGNIKNAAYLLTKGLYEKNHELTHIGRNTLI  180

Query:   190 IIGGFIFGVVCSTYFSSKLGEWSLSLILIPLLYVNLLLGHEFYNLQVE              237
             +I  F  GVVCST      GE++L  IL+PLLYVN LL  EFY++Q +
Sbjct:   181 VILAFAVGVVCSTLLCIAYGEYALMPILMPLLYVNYLLAQEFYHIQTK              228
```

Based on this analysis, it was predicted that these proteins and their epitopes could be useful antigens for vaccines or diagnostics.

EXAMPLE 723

A DNA sequence (GBSx0767) was identified in *S. agalactiae* <SEQ ID 2223> which encodes the amino acid sequence <SEQ ID 2224>. This protein is predicted to be tellurite resistance protein. Analysis of this protein sequence reveals the following:

```
Possible site: 20
>>> Seems to have no N-terminal signal sequence
    INTEGRAL     Likelihood = -0.00     Transmembrane     190-206 (190-206)

----- Final Results -----
              bacterial membrane --- Certainty = 0.1001(Affirmative) < succ>
              bacterial outside  --- Certainty = 0.0000(Not Clear)   < succ>
              bacterial cytoplasm --- Certainty = 0.0000(Not Clear)   < succ>
```

The protein has homology with the following sequences in the GENPEPT database:

```
>GP:AAC22923 GB:U32807 tellurite resistance protein (tehB)
[Haemophilus influenzae Rd]
Identities = 164/282 (58%), Positives = 205/282 (72%), Gaps = 1/282 (0%)

Query:     7 LLPYKTMPVWTAQSIPKAFLEKHNTKEGTWAKLTILSGSLVFYQLSPDGEEISRHIFDAS   66
             L+ YK MPVWT  ++P+ F EKHNTK GTW KLT+L G L FY+L+ +G+ I+ HIF
Sbjct:     5 LICYKQMPVWTKDNLPQMFQEKHNTKVGTWGKLTVLKGKLKFYELTENGDVIAEHIFTPE   64

Query:    67 SDIPFVDPQVWHKVSPNSPDLSCYLTFYCQKEDYFHKKYGLTRTHSEVIASAPLLSEKSN  126
             S  IPFV+PQ WH+V   S DL C L FYC+KEDYF KKY   T  H +V+ +A ++S
Sbjct:    65 SHIPFVEPQAWHRVEALSDDLECTLGFYCKKEDYFSKKYNTTAIHGDVVDAAKIISP-CK  123

Query:   127 ILDLGCGQGRNSLYLSLLGHQVTSVDSNGQSLVALENMALEEELPYNIKRYDINTAAIEG  186
             +LDLGCGQGRNSLYLSLLG+ VTS D N  S+  L    +E L +    YDIN A I+
Sbjct:   124 VLDLGCGQGRNSLYLSLLGYDVTSWDHNENSIAFLNETKEKENLNISTALYDINAANIQE  183

Query:   187 HYDFILSTVVFMFLNPDCISDIILQMQSHTQIGGYNLIVSAMDTAENPCPLPFPFTFKEG  246
             +YDFI+STVVFMFLN + +  II  M+ HT +GGYNLIV+AM T + PCPLPF FTF E
Sbjct:   184 NYDFIVSTVVFMFLNRERVPSIIKNMKEHTNVGGYNLIVAAMSTDDVPCPLPFSFTFAEN  243

Query:   247 QLKSYYNDWEIIKYNENLGELHRVDENGNRLKLQFATLLARK                   288
             +LK YY DWE ++YNEN+GELH+ DENGNR+K++FAT+LARK
Sbjct:   244 ELKEYYKDWEFLEYNENMGELHKTDENGNRIKMKFATMLARK                   285
```

No corresponding DNA sequence was identified in *S. pyogenes*.

Figure 292:
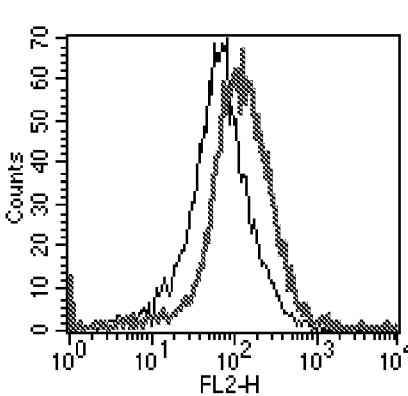

SEQ ID 2224 (GBS95) was expressed in *E. coli* as a His-fusion product. SDS-PAGE analysis of total cell extract is shown in FIG. 5 (lane 3; MW 35.6 kDa) and in FIG. 12 (lane 4; MW 35.6 kDa). The GBS95-His fusion product was purified (FIG. 191, lane 7) and used to immunise mice. The resulting antiserum was used for FACS (FIG. 292), which confirmed that the protein is immunoaccessible on GBS bacteria.

Based on this analysis, it was predicted that this protein and its epitopes, could be useful antigens for vaccines or diagnostics.

EXAMPLE 724

A DNA sequence (GBSx0768) was identified in *S. agalactiae* <SEQ ID 2225> which encodes the amino acid sequence <SEQ ID 2226>. This protein is predicted to be methionyl-tRNA synthetase (metS). Analysis of this protein sequence reveals the following:

```
Possible site: 47
>>> Seems to have no N-terminal signal sequence
    INTEGRAL      Likelihood = -0.32     Transmembrane     473-489 (473-489)

----- Final Results -----
              bacterial membrane --- Certainty = 0.1128(Affirmative) < succ>
              bacterial outside  --- Certainty = 0.0000(Not Clear)   < succ>
              bacterial cytoplasm --- Certainty = 0.0000(Not Clear)  < succ>
```

A related GBS nucleic acid sequence <SEQ ID 10043> which encodes amino acid sequence <SEQ ID 10044> was also identified.

The protein has homology with the following sequences in the GENPEPT database:

```
>GP:CAB11814 GB:Z99104 methionyl-tRNA synthetase [Bacillus subtilis]
Identities = 395/667 (59%), Positives = 501/667 (74%), Gaps = 12/667 (1%)

Query:    20 EKKSFYITTPIYYPSGKLHIGSAYTTIACDVLARYKRMMGFDVQYLTGLDEHGQKIQQKA    79
             E +FYITTPIYYPSGKLHIG AYTT+A D +ARYKR+ GFDV+YLTG DEHGQKIQQKA
Sbjct:     4 ENNTFYITTPIYYPSGKLHIGHAYTTVAGDAMARYKRLKGFDVRYLTGTDEHGQKIQQKA    63

Query:    80 EEAGITPQEYVDGMAESVKTLWELLDISYDKFIRTTDTYHEEAVAKIFEQLLAQGDIYLG   139
             E+  ITPQEYVD A   ++ LW+ L+IS D FIRTT+  H+  + K+F++LL  GDIYL
Sbjct:    64 EQENITPQEYVDRAAADIQKLWKQLEISNDDFIRTTEKRHKVVIEKVFQKLLDNGDIYLD   123

Query:   140 EYTGWYSVSDEEFFTESQLAEVYRDENGNMIGGVAP-SGHEVEKVSEESYFFRMSKYADR   198
             EY GWYS+ DE F+TE+QL ++ R+E G +IGG +P SGH VE + EESYFFRM KYADR
Sbjct:   124 EYEGWYSIPDETFYTETQLVDIERNEKGEVIGGKSPDSGHPVELIKEESYFFRMGKYADR   183

Query:   199 LKAYYAEHPEFIQPDGRMNEMLKNFIEPGLEDLAVSRTTYTWGVQVPSNPKHVIYVWIDA   258
             L  YY E+P FIQP+ R NEM+ NFI+PGLEDLAVSRTT+ WGV+VP NPKHV+YVWIDA
Sbjct:   184 LLKYYEENPTFIQPESRKNEMINNFIKPGLEDLAVSRTTFDWGVKVPENPKHVVYVWIDA   243

Query:   259 LMNYISALGYGWSDDLSQYHKFWPADIHMIGKDILRFHSIYWPIMLMALDLPLPKRLVAH   318
             L NY++ALGY    +D   Y K+WPAD+H++GK+I+RFH+IYWPIMLMALDLPLPK++ AH
Sbjct:   244 LFNYLTALGYDTEND-ELYQKYWPADVHLVGKEIVRFHTIYWPIMLMALDLPLPKQVFAH   302

Query:   319 GWFVMQDGKMSKSKGNVVYPEMLVERFGLDPLRYYLMRSLPVGSDGTFTPEDYVGRINYE   378
             GW +M+DGKMSKSKGNVV P  L+ER+GLD LRYYL+R +P GSDG FTPE +V RINY+
Sbjct:   303 GWLLMKDGKMSKSKGNVVDPVTLIERYGLDELRYYLLREVPFGSDGVFTPEGFVERINYD   362

Query:   379 LANDLGNLLNRTIAMVNKYFDGEVPRF-AVATDFDADLASVATDSIENYHKQMEAVDFPR   437
             LANDLGNLLNRT+AM+NKYFDG++    +   T+FD  L SVA ++++ Y K ME ++F
Sbjct:   363 LANDLGNLLNRTVAMINKYFDGQIGSYKGAVTEFDHTLTSVAEETVKAYEKAMENMEFSV   422

Query:   438 ALEAVWNLISRTNKYIDETAPWVLAKDETDRDKLAAVMSHLVASLRVVAHLIQPFMMETS   497
             AL  +W LISRTNKYIDETAPWVLAKD    ++L +VM HL  SLR+ A L+QPF+ +T
Sbjct:   423 ALSTLWQLISRTNKYIDETAPWVLAKDPAKEEELRSVMYHLAESLRISAVLLQPFLTKTP   482

Query:   498 DAIMEQLGL--GATFDLEKLT-FADLPEGVRVVAKGSPIFPRLDMEDEITYIKEQMNAGK   554
             + + EQLG+  +       + +T F  L +    V KG P+FPRL+ E+EI YIK +M  G
Sbjct:   483 EKMFEQLGITDESLKAWDSITAFGQLKD--TKVQKGEPLFPRLEAEEEIAYIKGKMQ-GS   539

Query:   555 APVEKEWVPEEVELTSSKGQIKFEDFDAVEIRVAEVIEVEKVEGSDKLLRFRLDAGDEGH   614
             AP ++E   EE +      +I + F  VE+RVAEVIE E V+ +D+LL+  +LD G E
Sbjct:   540 APAKEETKEEEPQEVDRLPEITIDQFMDVELRVAEVIEAEPVKKADRLLKLQLDLGFE-K   598

Query:   615 RQILSGIAKFYPNEQELVGKKLQIVANLKPRKMMKKYVSQGMILSAEHDGKLTVLTVDSA   674
             RQ++SGIAK Y E ELVGKKL  V NLKP K ++  +SQGMIL+ E DG L V+++D +
Sbjct:   599 RQVVSGIAKHYTPE-ELVGKKLVCVTNLKPVK-LRGELSQGMILAGEADGVLKVVSIDQS   656

Query:   675 VANGSII                                                       681
             +  G+ I
Sbjct:   657 LPKGTRI                                                       663
```

A related DNA sequence was identified in *S. pyogenes* <SEQ ID 2227> which encodes the amino acid sequence <SEQ ID 2228>. Analysis of this protein sequence reveals the following:

```
Possible site: 29
>>> Seems to have no N-terminal signal sequence

----- Final Results -----
              bacterial cytoplasm --- Certainty = 0.1245(Affirmative) < succ>
                bacterial membrane --- Certainty = 0.0000(Not Clear) < succ>
                 bacterial outside --- Certainty = 0.0000(Not Clear) < succ>
```

An alignment of the GAS and GBS proteins is shown below:

```
Identities = 516/665 (77%), Positives = 573/665 (85%), Gaps = 4/665 (0%)

Query:   21 KKSFYITTPIYYPSGKLHIGSAYTTIACDVLARYKRMMGFDVQYLTGLDEHGQKIQQKAE   80
            KK FYITTPIYYPSGKLHIGSAYTTIACDVLARYKR+MG +V YLTGLDEHGQKIQ KA+
Sbjct:    3 KKPFYITTPIYYPSGKLHIGSAYTTIACDVLARYKRLMGHEVFYLTGLDEHGQKIQTKAK   62

Query:   81 EAGITPQEYVDGMAESVKTLWELLDISYDKFIRTTDTYHEEAVAKIFEQLLAQGDIYLGE  140
            EAGITPQ YVD MA+ VK LW+LLDISYD FIRTTD YHEE VA +FE+LLAQ DIYLGE
Sbjct:   63 EAGITPQTYVDNMAKDVKALWQLLDISYDTFIRTTDDYHEEVVAAVFEKLLAQDDIYLGE  122

Query:  141 YTGWYSVSDEEFFTESQLAEVYRDENGNMIGGVAPSGHEVEKVSEESYFFRMSKYADRLK  200
            Y+GWYSVSDEEFFTESQL EV+RDE+G +IGG+APSGHEVE VSEESYF R+SKY DRL
Sbjct:  123 YSGWYSVSDEEFFTESQLKEVFRDEDGQVIGGIAPSGHEVEWVSEESYFLRLSKYDDRLV  182

Query:  201 AYYAEHPEFIQPDGRMNEMLKNFIEPGLEDLAVSRTTYTWGVQVPSNPKHVIYVWIDALM  260
            A++ E P+FIQPDGRMNEM+KNFIEPGLEDLAVSRTT+TWGV VPS+PKHV+YVWIDAL+
Sbjct:  183 AFFKERPDFIQPDGRMNEMVKNFIEPGLEDLAVSRTTFTWGVPVPSDPKHVVYVWIDALL  242

Query:  261 NYISALGYGWSDDLSQYHKFWPADI-HMIGKDILRFHSIYWPIMLMALDLPLPKRLVAHG  319
            NY +ALGY ++ + + KFW  + HM+GKDILRFHSIYWPI+LM LDLP+P RL+AHG
Sbjct:  243 NYATALGYRQANH-ANFDKFWNGTVFHMVGKDILRFHSIYWPILLMMLDLPMPDRLIAHG  301

Query:  320 WFVMQDGKMSKSKGNVVYPEMLVERFGLDPLRYYLMRSLPVGSDGTFTPEDYVGRINYEL  379
            WFVM+DGKMSKSKGNVVYPEMLVERFGLDPLRYYLMRSLPVGSDGTFTPEDYVGRINYEL
Sbjct:  302 WFVMKDGKMSKSKGNVVYPEMLVERFGLDPLRYYLMRSLPVGSDGTFTPEDYVGRINYEL  361

Query:  380 ANDLGNLLNRTIAMVNKYFDGEVPRFA-VATDFDADLASVATDSIENYHKQMEAVDFPRA  438
            ANDLGNLLNRT+AM+NKYFDG VP +    T FDADL+ +    + +YHK MEAVD+PRA
Sbjct:  362 ANDLGNLLNRTVAMINKYFDGTVPAYVDNGTAFDADLSQLIDAQLADYHKHMEAVDYPRA  421

Query:  439 LEAVWNLISRTNKYIDETAPWVLAKDETDRDKLAAVMSHLVASLRVVAHLIQPFMMETSD  498
            LEAVW +I+RTNKYIDETAPWVLAK++ D+ +LA+VM+HL ASLR+VAH+IQPFMMETS
Sbjct:  422 LEAVWTIIARTNKYIDETAPWVLAKEDGDKAQLASVMAHLAASLRLVAHVIQPFMMETSA  481

Query:  499 AIMEQLGLGATFDLEKLTFADLPEGVRVVAKGSPIFPRLDMEDEITYIKEQMNAGKA-PV  557
            AIM QLGL    DL L  AD P  +VVAKG+PIFPRLDME EI YIK QM    A
Sbjct:  482 AIMAQLGLEPVSDLSTLALADFPANTKVVAKGTPIFPRLDMEAEIDYIKAQMGDSSAISQ  541

Query:  558 EKEWVPEEVELTSSKGQIKFEDFDAVEIRVAEVIEVEKVEGSDKLLRFRLDAGDEGHRQI  617
            EKEWVPEEV L S K  I FE FDAVEIRVAEV EV KVEGS+KLLRFR+DAGD   RQI
Sbjct:  542 EKEWVPEEVALKSEKDVITFETFDAVEIRVAEVKEVSKVEGSEKLLRFRVDAGDGQDRQI  601

Query:  618 LSGIAKFYPNEQELVGKKLQIVANLKPRKMMKKYVSQGMILSAEHDGKLTVLTVDSAVAN  677
            LSGIAKFYPNEQELVGKKLQIVANLKPRKMMKKY+SQGMILSAEH  +LTVLTVDS+V N
Sbjct:  602 LSGIAKFYPNEQELVGKKLQIVANLKPRKMMKKYISQGMILSAEHGDQLTVLTVDSSVPN  661

Query:  678 GSIIG                                                         682
            GSIIG
Sbjct:  662 GSIIG                                                         666
```

Based on this analysis, it was predicted that these proteins and their epitopes could be useful antigens for vaccines or diagnostics.

EXAMPLE 725

A DNA sequence (GBSx0769) was identified in *S. agalactiae* <SEQ ID 2229> which encodes the amino acid sequence <SEQ ID 2230>. Analysis of this protein sequence reveals the following:

```
Possible site: 35
>>> Seems to have no N-terminal signal sequence

----- Final Results -----
            bacterial cytoplasm --- Certainty = 0.2633(Affirmative) < succ>
             bacterial membrane --- Certainty = 0.0000(Not Clear)   < succ>
              bacterial outside --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 726

A DNA sequence (GBSx0770) was identified in *S. agalactiae* <SEQ ID 2231> which encodes the amino acid sequence <SEQ ID 2232>. This protein is predicted to be branched chain amino acid transport system II carrier protein (brnQ). Analysis of this protein sequence reveals the following:

```
Possible site: 26
>>> Seems to have a cleavable N-term signal seq.
    INTEGRAL       Likelihood = -14.91     Transmembrane   279-295   (269-303)
    INTEGRAL       Likelihood =  -9.98     Transmembrane    82-98    (74-102)
    INTEGRAL       Likelihood =  -6.58     Transmembrane   345-361   (340-364)
    INTEGRAL       Likelihood =  -6.00     Transmembrane   157-173   (153-179)
    INTEGRAL       Likelihood =  -4.30     Transmembrane    48-64    (45-66)
    INTEGRAL       Likelihood =  -4.14     Transmembrane   251-267   (250-278)
    INTEGRAL       Likelihood =  -4.09     Transmembrane   308-324   (305-326)
    INTEGRAL       Likelihood =  -2.55     Transmembrane   218-234   (216-237)
    INTEGRAL       Likelihood =  -1.38     Transmembrane   126-142   (126-142)

----- Final Results -----
             bacterial membrane --- Certainty = 0.6965(Affirmative) < succ>
              bacterial outside --- Certainty = 0.0000(Not Clear)   < succ>
            bacterial cytoplasm --- Certainty = 0.0000(Not Clear)   < succ>
```

A related GBS nucleic acid sequence <SEQ ID 9407> which encodes amino acid sequence <SEQ ID 9408> was also identified.

The protein has homology with the following sequences in the GENPEPT database:

```
22 GP:AAC00400 GB:AF008220 branch-chain amino acid transporter
[Bacillus subtilis]
Identities = 130/367 (35%), Positives = 204/367 (55%), Gaps = 12/367 (3%)

Query:    1 MSEKFSPWFSLTFLVILYLTIGPLFAIPRTATVSFEIGVAPIVGHSP--IALLCFTACFF    58
            +++K P F   F V+LYL+IGPLFAIPRT TVS+EIG P +    P  ++LL FT  FF
Sbjct:   73 LADKAHPVFGTIFTVVLYLSIGPLFAIPRTGTVSYEIGAVPFLTGVPERLSLLIFTLIFF   132

Query:   59 AAAYYLAIRPNGILDSVGKILTPVFAFLILSLVVVGAIAYGNLESAKASADYAGKAFGSG   118
               YYLA+ P+ ++D VGKILTP+  F I+  ++V+ AI       +  Y G      G
Sbjct:  133 GVTYYLALNPSKVVDRVGKILTPI-KFTIILIIVLKAIFTPMGGLGAVTEAYKGTPVFKG   191

Query:  119 VLAGYNTLDALAAVAFCLVATETLKKFGFKTKKEYLSTIWIVGIVTSLAFSILYIGLGFL   178
              L GY T+DALA++ F +V    +K  G    K    G++ +L  + +Y+ L +L
Sbjct:  192 FLEGYKTMDALASIVFGVVVVNAVKSKGVTQSKALAAACIKAGVIAALGLTFIYVSLAYL   251

Query:  179 GNKFPVPADILADPNVNKGAYVLSQASYKLFGNFGRYFLSIMVTLTCFTTTVGLIVSVSE   238
            G           A   V +GA +LS +S+ LFG+ G    L    +T+ C TT++GL+ S  +
Sbjct:  252 G-----ATSTNAIGPVGEGAKILSASSHYLFGSLGNIVLGAAITVACLTTSIGLVTSCGQ   306

Query:  239 FFDKNFRFGNYKLFATVFTLIGFLIANLGLNAVITFSVPVLTLLYPIVIVIVLIILINKW   298
            +F K   +YK+ T+ TL   +IAN GL +I FSVP+L+  +YP+ IVI+++   I+K
Sbjct:  307 YFSKLIPALSYKIVVTIVTLFSLIANFGLAQIIAFSVPILSAIYPLAIVIIVLSFIDKI   366
```

```
-continued

Query:  299 LPLSKK---GMSLTIGLVTLVSFVEVLAGQWQEKTLTQLVGFLPFHTISMGWLVPMLIGI  355
             ++        + GL +++ ++ AG         L   LP +++ +GW++P ++G
Sbjct:  367 FKERREVYIACLIGTGLFSILDGIKA-AGFSLGSLDVFLNANLPLYSLGIGWVLPGIVGA  425

Query:  356 VFSLVLS                                                      362
             V    VL+
Sbjct:  426 VIGYVLT                                                      432
```

There is also homology to SEQ ID 2234.

A related GBS gene <SEQ ID 8649> and protein <SEQ ID 8650> were also identified. Analysis of this protein sequence reveals the following:

```
Lipop: Possible site: -1 Crend: 3
SRCFLG: 0
McG: Length of UR: 30
Peak Value of UR: 2.99
Net Charge of CR: 2
McG: Discrim Score: 13.17
GvH: Signal Score (-7.5): -3.3
Possible site: 33
>>> Seems to have an uncleavable N-term signal seq
Amino Acid Composition: calculated from 1
ALOM program count: 11 value: -14.91 threshold: 0.0
INTEGRAL Likelihood = -14.91   Transmembrane 347-363  (337-371)
INTEGRAL Likelihood =  -9.98   Transmembrane 150-166  (142-170)
INTEGRAL Likelihood =  -7.54   Transmembrane  40-56   (36-61)
INTEGRAL Likelihood =  -6.64   Transmembrane  79-95   (76-97)
INTEGRAL Likelihood =  -6.00   Transmembrane 225-241  (221-247)
INTEGRAL Likelihood =  -4.30   Transmembrane 116-132  (113-134)
INTEGRAL Likelihood =  -4.14   Transmembrane 319-335  (318-346)
INTEGRAL Likelihood =  -4.09   Transmembrane 376-392  (373-394)
INTEGRAL Likelihood =  -2.92   Transmembrane   7-23   (6-28)
INTEGRAL Likelihood =  -2.55   Transmembrane 286-302  (284-305)
INTEGRAL Likelihood =  -1.38   Transmembrane 194-210  (194-210)
PERIPHERAL  Likelihood =  2.49   402
modified ALOM score: 3.48
icm1 HYPID: 7 CFP: 0.696

*** Reasoning Step: 3

----- Final Results -----
            bacterial membrane  --- Certainty = 0.6965 (Affirmative) < succ>
            bacterial outside   --- Certainty = 0.0000 (Not Clear)   < succ>
            bacterial cytoplasm --- Certainty = 0.0000 (Not Clear)   < succ>
```

The protein has homology with the following sequences in the databases:

```
ORF00247(304-1596 of 1941)
OMNI|NT01BS3447(19-446 of 459) branched chain amino acid transport system II
carrier protein
% Match = 21.7
% Identity = 38.8  % Similarity = 61.2
Matches = 166  Mismatches = 157  Conservative Sub.s = 96
         93        123       153       183       213       243       273       303
VLTVDSAVANGSIIG*SKRALCSFFVFKKKVTE*LENYENDLEFIFIFDIIKDIDSKHLDRI**GEFMERV*IDYLH*WL
                                                                 LTEYFNIIIRRIFFMKHS
                                                                                10

333       363       393       423       453       483       513       543
LMVKKGFLTGLLLFGIFFGAGNLIFPPALGVASGQDFWPAILGFCLSGVGLAIITLLLGTLTNGGYKTEMSEKFSPWFSL
| ||   : |::||  :||||||:|:||  || | |:|::   | || ||  :|||| :: ::   ||    | :::|  | |
LPVKDTIIIGFMLFALFFGAGNMIYPPELGQAAGHNVWKAIGGFLLTGVGLPLLGIIAIALTGKDAKG-LADKAHPVFGT
             30        40        50        60        70        80        90

573       603       633       657       687       717       747       777
TFLVILYLTIGPLFAIPRTATVSFEIGVAPIVGHSP--IALLCFTACFFAAAYYLAIRPNGILDSVGKILTPVFAFLILS
 | |:|||:|||||||||| |||:|||  |:   |     ::|| ||     ||||: |: ::| |||||||   | |:
IFTVVLYLSIGPLFAIPRTGTVSYEIGAVPFLTGVPERLSLLIFTLIFFGVTYYLALNPSKVVDRVGKILTPI-KFTIIL
             110       120       130       140       150       160       170

801       831       861       891       921       951       981       1011
LVVVGAI--AYGNLESAKASADYAGKAFGSGVLAGYNTLDALAAVAFCLVATETLKKFGFKTKKEYLSTIWIVGIVTSLA
::|:  ||     |  |  :   :  ||    | ||| :||||:: |:       :|       |    |::  :|
IIVLKAIFTPMGGLGA--VTEAYKGTPVFKGFLEGYKTMDALASIVFGVVVVNAVKSKGVTQSKALAAACIKAGVIAALG
             190       200       210       220       230       240       250
```

```
1041      1071      1101      1131      1161      1191      1221      1251
FSILYIGLGFLGNKFPVPADILADPNVNKGAYVLSQASYKLFGNFGRYFLSIMVTLTCFTTTVGLIVSVSEFFDKNFRFG
::  :|:  | :||       |      :||  :||  :|:  |||::|      |     :|:  |:||::||:  |   ::| |
LTFIYVSLAYLG-----ATSTNAIGPVGEGAKILSASSHYLFGSLGNIVLGAAITVACLTTSIGLVTSCGQYFSKLIPAL
              270       280       290       300       310       320

1281      1311      1341      1371      1401      1431      1461      1488
NYKLFATVFTLIGFLIANLGLNAVITFSVPVLTLLYPIVIVIVLIILINKWLPLSKKGMSLTIGLVTLVSFVEVLAG-QW
:||:  |:  ||   ::|||:||   :|  ||||:|:  :||:  |||:::  :|:|       :  |:      :  |:|  |:
SYKIVVTIVTLFSLIIANFGLAQIIAFSVPILSAIYPLAIVIIVLSFIDK---IFKERREVYIACLIGTGLFSILDGIKA
     340       350       360       370       380       390       400

1518      1536      1566      1596      1626      1656      1686      1716
QEKTLTQLVGFL----PFHTISMGWLVPMLIGIVFSLVLSDKQKGQAFDLEKFEG*HYFNFIDMSKRLKLRF*PFLYQIF
  :|   |   ||       |::::  :||::|  ::|    |      ||:
AGFSLGSLDVFLNANLPLYSLGIGWVLPGIVGAVIGYVLTLFIGPSKQLNEIS
           420       430       440       450
```

Based on this analysis, it was predicted that these proteins and their epitopes could be useful antigens for vaccines or diagnostics.

EXAMPLE 727

A DNA sequence (GBSx0771) was identified in *S. agalactiae* <SEQ ID 2235> which encodes the amino acid sequence <SEQ ID 2236>. Analysis of this protein sequence reveals the following:

```
Possible site: 36
>>> Seems to have no N-terminal signal sequence

----- Final Results -----
          bacterial cytoplasm --- Certainty = 0.3291 (Affirmative) < succ>
          bacterial membrane  --- Certainty = 0.0000 (Not Clear)   < succ>
           bacterial outside  --- Certainty = 0.0000 (Not Clear)   < succ>
```

A related GBS nucleic acid sequence <SEQ ID 10041> which encodes amino acid sequence <SEQ ID 10042> was also identified.

The protein has no significant homology with any sequences in the GENPEPT database.

No corresponding DNA sequence was identified in *S. pyogenes*.

Based on this analysis, it was predicted that these proteins and their epitopes could be useful antigens for vaccines or diagnostics.

EXAMPLE 728

A DNA sequence (GBSx0772) was identified in *S. agalactiae* <SEQ ID 2237> which encodes the amino acid sequence <SEQ ID 2238>. Analysis of this protein sequence reveals the following:

```
Possible site: 39
>>> Seems to have a cleavable N-term signal seq.
INTEGRAL Likelihood = -8.33 Transmembrane 117-133 (112-136)
INTEGRAL Likelihood = -3.77 Transmembrane  53-69  (53-70)
INTEGRAL Likelihood = -3.40 Transmembrane  98-114 (97-115)

----- Final Results -----
          bacterial membrane  --- Certainty = 0.4333 (Affirmative) < succ>
           bacterial outside  --- Certainty = 0.0000 (Not Clear)   < succ>
          bacterial cytoplasm --- Certainty = 0.0000 (Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 729

A DNA sequence (GBSx0773) was identified in *S. agalactiae* <SEQ ID 2239> which encodes the amino acid sequence <SEQ ID 2240>. Analysis of this protein sequence reveals the following:

```
Possible site: 15
>>> Seems to have no N-terminal signal sequence
INTEGRAL Likelihood = -4.19 Transmembrane 22-38 (20-44)

----- Final Results -----
            bacterial membrane --- Certainty = 0.2678 (Affirmative) < succ>
              bacterial outside --- Certainty = 0.0000 (Not Clear) < succ>
                bacterial cytoplasm --- Certainty = 0.0000 (Not Clear) < succ>
                                      15
```

A related GBS nucleic acid sequence <SEQ ID 8651> which encodes amino acid sequence <SEQ ID 8652> was also identified. Analysis of this protein sequence reveals the following:

```
Lipop Possible site: -1 Crend: 3
SRCFLG: 0
McG: Length of UR: 21
Peak Value of UR: 3.11
Net Charge of CR: 2
McG: Discrim Score: 11.30
GvH: Signal Score (-7.5): -5.35
Possible site: 28
>>> Seems to have an uncleavable N-term signal seq
Amino Acid Composition: calculated from 1
ALOM program count: value: -4.19 threshold: 0.0
            1
INTEGRAL Likelihood = -4.19 Transmembrane 5-21 (3-27)
PERIPHERAL  Likelihood =  6.74  53
modified ALOM score: 1.34
icm1 HYPID: 7 CFP: 0.268

*** Reasoning Step: 3

----- Final Results -----
            bacterial membrane --- Certainty = 0.2678 (Affirmative) < succ>
              bacterial outside --- Certainty = 0.0000 (Not Clear) < succ>
                bacterial cytoplasm --- Certainty = 0.0000 (Not Clear) < succ>
                                      40
```

The protein has homology with the following sequences in the GENPEPT database:

```
>GP:CAB15623 GB:Z99122 spore coat protein (inner) [Bacillus subtilis]
Identities = 71/359 (19%), Positives = 148/359 (40%), Gaps = 49/359 (13%)

Query:  127 ISYRGNTSRYFDKKSLKVKFVTNKLKEKKHRLAGMPKESEWVLHGPFLDRTLLRNYLSYN  186
            I+YRG+  R F KKS  + F   K       +        L+  + D +L+RN LS +
Sbjct:   47 IAYRGSHIRDFKKKSYHISFYQPKTFRGAREIH---------LNAEYKDPSLMRNKLSLD   97

Query:  187 IAGEIMSYAPNVRYCELFVNGEYQGVYLAVENIEQGEQRVPIEKSDKKLHKTPYIVAWDR  246
               E+ + +P  +  + +NG+ +GVYL +E++++        + +KL      A D
Sbjct:   98 FFSELGTLSPKAEFAFVKMNGKNEGVYLELESVDE------YYLAKRKLADGAIFYAVDD  151

Query:  247 EHKAKQKLDNYVHYTHQSGISALDVKYPGKQRLTSKQLEFINKD----INHIEKVLYSYD  302
            +       D    +  ++L++  Y  +++   +++ +F  +D     IN + K   +
Sbjct:  152 DANFSLMSD-----LERETKTSLELGY--EKKTGTEEDDFYLQDMIFKINTVPKAQFK--  202

Query:  303 FSQYPKYIDRESFANYFVINEFFRNVDAGKFSTYLYKDLRDRA-KLVVWDFNNAFDNQIE  361
            S+ K++D + +  +    F  N D   + LY+        +++ WD++  +    I
Sbjct:  203 -SEVTKHVDVDKYLRWLAGIVFTSNYDGFVHNYALYRSGETGLFEVIPWDYDATWGRDIH  261

Query:  362 GRVDEADFTLTDAPWFNMLIKDKAFIDLVVHRYKELRKGVLATEYLSNYIDETRHFLGPA  421
            G      AD+         FN L             YK L +   L +  +    Y++              P
Sbjct:  262 GERMAADYVRIQG--FNTLTARILDESEFRKSYKRLLEKTLQSLFTIEYME-------PK  312

Query:  422 IDRNYKKWGYVFDLKNTDPRNYLIPTERN-VTSYHKSVEQLKDFIKKRGRWMDRNIETL  479
            I   Y++              P   + P ++N +   +   +  + ++IK R +++    ++  L
Sbjct:  313 IMAMYER---------IRPFVLMDPYKKNDIERFDREPDVICEYIKNRSQYLKDHLSIL  362
```

No corresponding DNA sequence was identified in *S. pyogenes*.

Based on this analysis, it was predicted that these proteins and their epitopes could be useful antigens for vaccines or diagnostics.

EXAMPLE 730

A DNA sequence (GBSx0774) was identified in *S. agalactiae* <SEQ ID 2241> which encodes the amino acid sequence <SEQ ID 2242>. Analysis of this protein sequence reveals the following:

```
Possible site: 17
>>> Seems to have no N-terminal signal sequence

----- Final Results -----
            bacterial membrane --- Certainty = 0.0000 (Not Clear) < succ>
             bacterial outside --- Certainty = 0.0000 (Not Clear) < succ>
            bacterial cytoplasm --- Certainty = 0.0000 (Not Clear) < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 731

A DNA sequence (GBSx0775) was identified in *S. agalactiae* <SEQ ID 2243> which encodes the amino acid sequence <SEQ ID 2244>. Analysis of this protein sequence reveals the following:

```
Possible site: 21
>>> Seems to have an uncleavable N-term signal seq
INTEGRAL Likelihood = -4.62 Transmembrane 5-21 (3-24)

----- Final Results -----
            bacterial membrane --- Certainty = 0.2848 (Affirmative) < succ>
             bacterial outside --- Certainty = 0.0000 (Not Clear) < succ>
            bacterial cytoplasm --- Certainty = 0.0000 (Not Clear) < succ>
```

The protein has homology with the following sequences in the GENPEPT database:

```
>GP:BAB05949 GB:AP001514 unknown [Bacillus halodurans]
Identities = 199/697 (28%), Positives = 322/697 (45%), Gaps = 58/697 (8%)

Query:   57 KPFVVKGVDVESSLAGYHHNDFPITQKTYREWFHLISNMGANTVRVKVPMNVAFYDALYH  116
            K   + GV++      G   +  I +K Y  WF  I  MG N +RV       FY AL
Sbjct:  414 KKLQIHGVNLGMGKPGTFPGEAAIKEKDYYRWFEQIGEMGGNAIRVYTLHPPGFYHALKR  473

Query:  117 HNKASKRPLYLLQGIRIDSYRNNASITAFNDNYRGYLKREAKGVVDILHGRKQVWNTDLG  176
            +N+   + P+YL  G+ ID    ++ AF++      ++E K +VD++HG   V + + G
Sbjct:  474 YNEQHENPIYLFHGVWIDEEPLEDTLDAFDEETNEEFQQEMKRIVDVIHGNAVV-DPNPG  532

Query:  177 SRH--YHYDLSPWVLGYVVGDDWNSGTVAYTNHQEKKT-QYKGRYFKTSVAANPFEVMLA  233
                  H  Y  D+SP+ +G+++G +W     TV     TN       Y G+Y +T    A  PFE  LA
Sbjct:  533 HAHGVYQADVSPYTIGWIIGIEWYPHTVKATNKNNPDIGDYDGKYVETK-DAEPFEYWLA  591

Query:  234 QVMDELTHYETAKYGWQHLISFSNSPTTDPF-HYRKPFEAQAPKYVQLNVENIQANSNVK  292
             D L   YE   +Y W    +SF+N  TTD    H   +P E +     V  NV +++  +   +
Sbjct:  592 NQFDILLSYEIEQYNWIRPVSFTNWVTTDLLTHPAEPNEDEDLVGVDPNVIHLKGPA-TE  650

Query:  293 AGMFAAYKAIDFHPRYKDYLLFDKENISKEDRQKIKELSLSQGYVKLLNAYHKIPVLVTG  352
                  FA+Y       +P Y D+L ++++ I    D +      EL+     GY+K L+    H  +P+L+
Sbjct:  651 TNQFASYHV---YPYYPDFLNYEEDYIHYVDHR--GELNNYAGYLKDLHDAHDLPILIAE  705
```

```
Query:    353 YGYSTARGIA-QKEIDKRPLPINEKEQGQRLLEDYESFISSGSFGATINAWQDDWNARAW   411
              +G   +RG+  +      K     ++E+EQG+ ++E +E  I      G  I  WQD+W  R W
Sbjct:    706 FGVPASRGLTHENPFGKNQGFLSEEEQGKIVVELFEDIIEEKLLGGLIFTWQDEWFKRTW   765

Query:    412 NTSFATNKHSQFLWGDAQVFNQGYGLLGFKNAKHHYQVDGKRGKG-----EWKHPLMTSA   466
              NT   N    +  W +AQ   Q +GLL F  K      D +  +        E  HP  +
Sbjct:    766 NTMDYDNPDRRPFWSNAQTNEQQFGLLSFDRLKVKVNGDDQDWEDASLLYEEDHPYVKR-   824

Query:    467 TGDDLYASSDESYLYLAIKTKPEKLKE-----KRLLPIDITPKSGSRKMNGSK-VTFSKS   520
                 LY   DE YLY  I  K       +         +L +D  P   G+   +    + VTF
Sbjct:    825 ----LYMDHDERYLYFRIDMKSGSTDDFFKDGFPILVLDTLPGQGNEHIKEVEGVTFDHG   880

Query:    521 SDFVLSIDPNGKSELFVQERYNALKANYLRQLNGKDFYAFPPKKNSSNFEQINMVLRNTK   580
                  DF++ +     +S + V    Y+        Y  +      +   + P+ N+  F++I+   L N +
Sbjct:    881 IDFIIELKGYDESRVKVDAYYDFFTYQYSQIYQMIEETSIEPQNNTGVFQKIHYAL-NQE   939

Query:    581 IVEDMEKVKATERFLP--THPTGLLKTGTTDRHQKTFDSQTD--ISFGKDFIEVRIPWQL   636
              I       ++ +T    +P  +  TG L+  G   D      +DS   D   ++  K   IEVRIPW  L
Sbjct:    940 I-----RIPSTNEVIPFSYYETGELRHGNGDPEADDYDSLADFFVNEEKGMIEVRIPWLL   994

Query:    637 LNFSDPSSQKIHDDYFKHYGVKELE-IESI-ALGLGANSKENTLIKMAD----------   683
              L+F DPS +++      ++  G +    E IE + A     L     K++    ++ D
Sbjct:    995 LSFKDPSQREVMSAIYEGEGGETSEIIEGVRAAVLFVEPKDDDSYQVVDALPALDGDRLT   1054

Query:    684 ------YRLKNWERPDTKTFLKDSYYSIKKEWSKERE   714
                     Y   + W+ P   +    LK SY  +K+ ++   +E
Sbjct:    1055 DEVMNMYTWETWDIPLYEERLKQSYDLVKEAFTSIKE   1091
```

No corresponding DNA sequence was identified in *S. pyogenes*.

A related GBS gene <SEQ ID 8653> and protein <SEQ ID 8654> were also identified. Analysis of this protein sequence reveals the following:

```
Lipop: Possible site: -1 Crend: 2
McG: Discrim Score: 12.00
GvH: Signal Score (-7.5): -5.46
Possible site: 21
>>> Seems to have an uncleavable N-term signal seq
ALOM program count: value: -4.62 threshold: 0.0
              1
INTEGRAL Likelihood = -4.62 Transmembrane 5-21 (3-24)
PERIPHERAL Likelihood = 7.32   223
modified ALOM score: 1.42

*** Reasoning Step: 3

----- Final Results -----
          bacterial membrane  --- Certainty = 0.2848 (Affirmative) < succ>
          bacterial outside   --- Certainty = 0.0000 (Not Clear)   < succ>
          bacterial cytoplasm --- Certainty = 0.0000 (Not Clear)   < succ>
```

SEQ ID 2244 (GBS62) was expressed in *E. coli* as a His-fusion product. SDS-PAGE analysis of total cell extract is shown in FIG. 5 (lane 7; MW 80.5 kDa). It was also expressed in *E. coli* as a GST-fusion product. SDS-PAGE analysis of total cell extract is shown in FIG. 13 (lane 4; MW 105 kDa).

The GBS62-GST fusion product was purified (FIG. 100A; see also FIG. 193, lane 7) and used to immunise mice (lane 1 product; 20 μg/mouse). The resulting antiserum was used for Western blot (FIG. 100B), FACS (FIG. 100C), and in the in vivo passive protection assay (Table III). These tests confirm that the protein is immunoaccessible on GBS bacteria and that it is an effective protective immunogen.

Based on this analysis, it was predicted that these proteins and their epitopes could be useful antigens for vaccines or diagnostics.

EXAMPLE 732

A DNA sequence (GBSx0778) was identified in *S. agalactiae* <SEQ ID 2245> which encodes the amino acid sequence <SEQ ID 2246> in others. Analysis of this protein sequence reveals the following:

```
Possible site: 14
>>> Seems to have no N-terminal signal sequence
INTEGRAL Likelihood = -7.48 Transmembrane 310-326 (302-335)
INTEGRAL Likelihood = -7.32 Transmembrane 362-378 (361-380)
INTEGRAL Likelihood = -7.11 Transmembrane 334-350 (329-355)
INTEGRAL Likelihood = -2.28 Transmembrane 381-397 (380-397)
```

-continued
```
----- Final Results -----
             bacterial membrane --- Certainty = 0.3994 (Affirmative) < succ>
               bacterial outside --- Certainty = 0.0000 (Not Clear)   < succ>
              bacterial cytoplasm --- Certainty = 0.0000 (Not Clear)  < succ>
```

A related GBS nucleic acid sequence <SEQ ID 10039> which encodes amino acid sequence <SEQ ID 10040> was also identified.

The protein has homology with the following sequences in the GENPEPT database:

```
>GP:BAB05950 GB:AP001514 unknown conserved protein in others
[Bacillus halodurans]
Identities = 143/405 (35%), Positives = 226/405 (55%), Gaps = 5/405 (1%)

Query:   11 IVPAYNESTTIVSSIDSLLHLDYEAYEIIVVDDGSSDNTSDVLKEEFALMKISNTIDSII   70
            +VPAYNE T I+ ++ SLL L Y    EI+VV+DGS+D T +V+ E F ++K+    I      I
Sbjct:   69 LVPAYNEETGIIETVRSLLSLKYPQTEIVVVNDGSTDQTLEVIIEHFQMVKVGKVIRKQI  128

Query:   71 ATQTCKDVFQRQVGKVKLTLIVKENGGKGDALNMGINAANYDYFLCLDADSMLQVDSLSQ  130
              T+   K V+Q  +     L  L+ K NGGK DALN  G+N + Y  YF  +D DS+L+  D+L +
Sbjct:  129 ETEPIKGVYQSTIFP-HLLLVDKSNGGKADALNAGLNVSKYPYFCSIDGDSILETDALLK  187

Query:  131 ISKSIQV----DPTVIAVGGLVQVAQGVKIEQGKVASYRLPWRIIPCAQALEYDSSFLGA  186
             + K I    +       VIA GG V++A G   I+ G V S +L    +    Q +EY  +FL
Sbjct:  188 VMKPIVTSRDDEDEVIASGGNVRIANGSDIQMGSVLSVQLAKNPLVVMQVIEYLRAFLMG  247

Query:  187 RIFLDYLRANLIISGAFGLFKKDLVKAVGGYDTQTLGEDMELVMKLHFFCRNNNIPYRIC  246
            RI L       LIISGAF +F K  V    GGY +T+GEDMELV++LH     +       + RI
Sbjct:  248 RIGLSRHNMVLIISGAFSVFAKKWVMEAGGYSKKTVGEDMELVVRLHRLVKEKRLKKRIT  307

Query:  247 YETDAVCWSQAPTNLGDLRKQRRRWYLGLYQCLKKYKSIFANYRFGAVGSISYIYYILFE  306
             +  D VCW++AP     L++QR RW+ GL + L ++ +    N ++G VG+ S   Y+ +  E
Sbjct:  308 FVPDPVCWTEAPATFRVLQRQRSRWHRGLMESLWLHRGMTFNPKYGLVGTASIPYFWIVE  367

Query:  307 LLTPFIECFGIVIIFLSLLFNQLNIPFFISLVSLYIFYCVLITLSSFLHRIYSQQLVIGI  366
                P +E   G + I   +  F   L + F ++L  L++ Y  + ++++ +    +S +         +
Sbjct:  368 FFGPVVELMGYLYIVFAFFFGGLYVEFALALFLLFVLYGTVFSMTAVILEGWSLKRYPKV  427

Query:  367 LDIVKVFYIAVFRYLILHPVLTFVKVASVIGYKNKKMVWGHITRE                 411
             D+ ++    ++F  L   P+      +  ++I         +   WG +TR+
Sbjct:  428 SDMSRLMIFSLFEALWYRPLTVLWRFGAIIEALFRSKAWGEMTRK                472
```

A related DNA sequence was identified in *S. pyogenes* <SEQ ID 2247> which encodes the amino acid sequence <SEQ ID 2248>. Analysis of this protein sequence reveals the following:

```
Possible site: 60
>>> Seems to have no N-terminal signal sequence
INTEGRAL Likelihood = -11.04  Transmembrane    33-49  (24-57)
INTEGRAL Likelihood = -10.77  Transmembrane  376-392  (370-399)
INTEGRAL Likelihood =  -7.86  Transmembrane  344-360  (342-372)
INTEGRAL Likelihood =  -4.94  Transmembrane   63-79   (55-81)
INTEGRAL Likelihood =  -2.07  Transmembrane  403-419  (403-419)

----- Final Results -----
             bacterial membrane --- Certainty = 0.5416 (Affirmative) < succ>
               bacterial outside --- Certainty = 0.0000 (Not Clear)   < succ>
              bacterial cytoplasm --- Certainty = 0.0000 (Not Clear)  < succ>
```

An alignment of the GAS and GBS proteins is shown below:

```
Identities = 84/397 (21%), Positives = 173/397 (43%), Gaps = 71/397 (17%)

Query:    6 FRRKSIVPAYNEST-TIVSSIDSLLHLDYEAYEIIVVDDGSSDNTSDVLKEEFALMKISN   64
            ++  +++P+YNE     +++ ++  S+L  Y    EI +VDDGSS+  +   L  EE+      ++
Sbjct:   90 YKVAAVIPSYNEDAESLLETLKSVLAQTYPLSEIYIVDDGSSNTDAIQLIEEY----VNR  145

Query:   65 TIDSIIATQTCKDVFQRQVGKVKLTLIVKENGGKGDALNMGINAANYDYFLCLDADSMLQ  124
             +D       C++V      V  +L+    N GK A       ++ D FL +D+D+ +
Sbjct:  146 EVD------ICRNVI------VHRSLV---NKGKRHAQAWAFERSDADVFLTVDSDTYIY  190
```

```
Query:  125 VDSLSQISKSIQVDPTVIAVGGLVQVAQGVKIEQGKVASYRLPWRIIPCAQALEYDSSFL  184
            ++L ++ KS   D TV A          G + +      ++     + YD++F
Sbjct:  191 PNALEELLKSFN-DETVYAA-------------TGHLNARNRQTNLLTRLTDIRYDNAF-  235

Query:  185 GARIFLDYLRANLII-SGAFGLFKKD-LVKAVGGYDTQT-------LGEDMELVMKLHFF  235
            G       L  N+++ SG  +++++ ++  + Y  QT        +G+D  L
Sbjct:  236 GVERAAQSLTGNILVCSGPLSIYRREVIIPNLERYKNQTFLGLPVSIGDDRCLT------  289

Query:  236 CRNNNIPY-RICYETDAVCWSQAPTNLGDLRKQRRRWYLGLY-QCLKKYKSIFANYRFGA  293
               N  I  R  Y++ A C +  P  L    KQ+ RW     + + +    K I +N
Sbjct:  290 --NYAIDLGRTVYQSTARCDTDVPFQLKSYLKQQNRWNKSFFKESIISVKKILSN----P  343

Query:  294 VGSISYIYYILFELLTPFIECFGIVIIFLSLLFNQLNIPFFISLVSLYIFYCV--LITLS  351
             + ++  I+ ++  ++      +++    +LLFNQ    + L+ L+ F +  ++ L
Sbjct:  344 IVALWTIFEVVMFMM--------LIVAIGNLLFNQ---AIQLDLIKLFAFLSIIFIVALC  392

Query:  352 SFLHRIYSQQLVIGILDIVKVFYIAVFRYLILHPVLT                        388
            +H +         +  +  + ++ V + L+ + T
Sbjct:  393 RNVHYMIKHPASFLLSPLYGILHLFVLQPLKLYSLCT                        429
```

A related GBS gene <SEQ ID 8655> and protein <SEQ ID 8656> were also identified. Analysis of this protein sequence reveals the following:

```
Lipop: Possible site: -1 Crend: 8
McG: Discrim Score: -5.18
GvH: Signal Score (-7.5): -4.91
      Possible site: 14
>>> Seems to have no N-terminal signal sequence
ALOM program count: 4 value: -7.48 threshold: 0.0
    INTEGRAL       Likelihood = -7.48    Transmembrane   310-326 (302-335)
    INTEGRAL       Likelihood = -7.32    Transmembrane   362-378 (361-380)
    INTEGRAL       Likelihood = -7.11    Transmembrane   334-350 (329-355)
    INTEGRAL       Likelihood = -2.28    Transmembrane   381-397 (380-397)
    PERIPHERAL     Likelihood =  1.22    140
modified ALOM score: 2.00
*** Reasoning Step: 3

----- Final Results -----
              bacterial membrane --- Certainty = 0.3994(Affirmative) < succ>
              bacterial outside  --- Certainty = 0.0000(Not Clear)   < succ>
              bacterial cytoplasm --- Certainty = 0.0000(Not Clear)   < succ>
```

The protein has homology with the following sequences in the databases:

```
ORF00238(331-1401 of 1866)
GP|5813901|gb|AAD52055.1|AF086783_3|AF086783(52-367 of 412) IcaA
{Staphylococcus aureus}
% Match = 10.3
% Identity = 34.8   % Similarity = 55.9
Matches = 109  Mismatches = 128  Conservative Sub.s = 66
150       180       210       240       270       300       330       360
VAMRRSSKLNLGVRPPFACLR**AVFNTANISSKVVR*TPTRRLNRTSVNCLLAS*FIELLYHILFRRKSIVPAYNESTT
                                      ::           ||||  |
            MQFFNFLLFYPVFMSIYWIVGSIYFYFTREIRYSLNKKPDINVDELEGITFLLACYNESET
            10        20        30        40        50        60
390       420       450       471       501       531       561       591
IVSSIDSLLHLDYEAYEIIVVDDGSSDNTSDVL---KEEFALMKISNTIDSIIATQTCKDVFQRQVGKVKLTLIVKENGG
| :: ::| | ||    ||::::||||||::::    ||    ::  :                    ::|||  |
IEDTLSNVLALKYEKKEIIINDGSSDNTAELIYKIKENNDFIFVD---------------------------LQENRG
            80        90        100                                      110
621       651       681       711       741       771       801       831
KGDALNMGINAANYDYFLCLDADSMLQVDSLSQISKSIQVDPTVIAVGGLVQVAQGVKIEQGKVASYRLPWRIIPCAQAL
| :||| ||  |:||| :||||:|||:::  |:     :  ::  ||  || ||  ::         |       | :
KANALNQGIKQASYDYVMCLDADTIVDQDAPYYMIENFKHDPKLGAVTGNPRIRNKSSI--------------LGKIQTI
            130       140       150       160       170
```

-continued

```
861         891       918       948         978        1008      1038      1068
EYDSSFLGARIFLDYLRANL-IISGAFGLFKKDLVKAVGGYDTQTLGEDMELVMKLHFFCRNNNIPYRICYETDAVCWSQ
|| :|::|     |    :  |||  ||||    |   ||:||  :  ||: :  |||         |||  ||  |:||
EY-ASLIGCIKRSQTLAGAVNTISGVFTLFKKSAVVDVGYWDTDMITEDIAVSWKLH------LRGYRIKYEPLAMCWML
             190       200       210       220       230             240       250

1098       1128      1155                  1194      1224      1254      1284
APTNLGDLRKQRRWYLGLYQCL-KKYKSIFANYRFG-------AVGSISYIYYILFELLTPFIECFGIVIIFLSLLFNQ
|  ||  |  |||| ||   |  ::  |  : |  ||           : ||  ::|  :|:  |      ||     |
VPETLGGLWKQRVRWAQGGHEVLLRDFFSTMKTKRFPLYILMFEQIISILWVYIVLLYLGYLFI-----TANFLDYTFMT
                270       280       290       300       310       320

1311       1341      1371      1401      1431      1461      1491      1521
LNIP-FFISLVSLYIFYCVLITLSSFLHRIYSQQLVIGILDIVKVFYIAVFRYLILHPVLTFVKVASVIGYKNKKMVWGH
  :   |::|  ::       :   |::  |:    |  |:: :  |::
YSFSIFLLSSFTMTFINVIQFTVALFIDSRYEKKNMAGLIFVSWYPTVYWIINAAVVLVAFPKALKRKRGGYATWSSPDR
          340       350       360       370       380       390       400
```

Based on this analysis, it was predicted that these proteins and their epitopes could be useful antigens for vaccines or diagnostics.

EXAMPLE 733

A DNA sequence (GBSx0779) was identified in *S. agalactiae* <SEQ ID 2249> which encodes the amino acid sequence <SEQ ID 2250>. Analysis of this protein sequence reveals the following:

```
Possible site: 29
>>> Seems to have no N-terminal signal sequence

----- Final Results -----
            bacterial cytoplasm --- Certainty = 0.2014(Affirmative) < succ>
            bacterial membrane  --- Certainty = 0.0000(Not Clear)   < succ>
              bacterial outside --- Certainty = 0.0000(Not Clear)   < succ>
```

The protein has homology with the following sequences in the GENPEPT database:

```
>GP:CAA22725 GB:AL035161 hypothetical protein SC9C7.13c
[Streptomyces coelicolor A3(2)]
Identities = 35/153 (22%), Positives = 64/153 (40%), Gaps = 5/153 (3%)

Query:   5 IRRARLGDEVNLAYIQTESWKAAFGKILPEDIIQKTTEIEPAITMYQQLLHKEVGKGYIL   64
           +R   L D   ++ I+   W++A+  ++P+  +       A            G+  ++
Sbjct:  10 VREMTLADCDRVSLIRVRGWQSAYRGLMPQPYLDAMDPAADAERRRSLFARPPEGRVNLV   69

Query:  65 EVDSNPHCMAWWD----KSREDGMLDYAELICIHSLKEGWGKGYGSQMMNHVLSEIQQAG  120
            D      + W    + E    D AEL ++    +G G +    +     + AG
Sbjct:  70 AEDEGGEVVGWACHGPYRDGEARTAD-AELYALYVDAARFGAGIGRALAGESVRRCRAAG  128

Query: 121 YNKVILWVFTENTRARKFYDRFGFSFKGKSKTY                            153
            + +++LWV   N RAR+FYDR GF    G + +
Sbjct: 129 HARMLLWVLKGNVRARRFYDRAGFRPDGAEEPF                            161
```

No corresponding DNA sequence was identified in *S. pyogenes*.

Based on this analysis, it was predicted that this protein and its epitopes, could be useful antigens for vaccines or diagnostics.

EXAMPLE 734

A DNA sequence (GBSx0780) was identified in *S. agalactiae* <SEQ ID 2251> which encodes the amino acid sequence <SEQ ID 2252>. This protein is predicted to be a DNA-binding protein. Analysis of this protein sequence reveals the following:

```
Possible site: 48
>>> Seems to have no N-terminal signal sequence

----- Final Results -----
            bacterial cytoplasm --- Certainty = 0.1162(Affirmative) < succ>
            bacterial membrane  --- Certainty = 0.0000(Not Clear)   < succ>
              bacterial outside --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 735

A DNA sequence (GBSx0781) was identified in *S. agalactiae* <SEQ ID 2253> which encodes the amino acid sequence <SEQ ID 2254>. Analysis of this protein sequence reveals the following:

```
Possible site: 56
>>> Seems to have no N-terminal signal sequence

----- Final Results -----
            bacterial cytoplasm --- Certainty = 0.2589(Affirmative) < succ>
            bacterial membrane  --- Certainty = 0.0000(Not Clear)   < succ>
            bacterial outside   --- Certainty = 0.0000(Not Clear)   < succ>
```

A related GBS nucleic acid sequence <SEQ ID 10037> which encodes amino acid sequence <SEQ ID 10038> was also identified.

The protein has no significant homology with any sequences in the GENPEPT database.

A related DNA sequence was identified in *S. pyogenes* <SEQ ID 2255> which encodes the amino acid sequence <SEQ ID 2256>. Analysis of this protein sequence reveals the following:

```
Possible site: 53
>>> Seems to have no N-terminal signal sequence

----- Final Results -----
            bacterial cytoplasm --- Certainty = 0.2767(Affirmative) < succ>
            bacterial membrane  --- Certainty = 0.0000(Not Clear)   < succ>
            bacterial outside   --- Certainty = 0.0000(Not Clear)   < succ>
```

An alignment of the GAS and GBS proteins is shown below:

```
Identities = 80/86 (93%), Positives = 84/86 (97%)

Query:   6  LKTIKENNMTFEEILPGLKAKKKYVRTGWGGAENYVQLFDTLEVNGKVLQATPYFLINVT  65
            + +IKENNMTFEEILPGLKAKKKYVRTGWGGAENYVQLFDTLEV+GKVLQATPYFLI+VT
Sbjct:   3  ISSIKENNMTFEEILPGLKAKKKYVRTGWGGAENYVQLFDTLEVDGKVLQATPYFLIHVT  62

Query:  66  GEGEGFSMWAPTPCDVLAEDWIEVND                                    91
            G GEGFSMWAPTPCDVLAEDWIEVND
Sbjct:  63  GAGEGFSMWAPTPCDVLAEDWIEVND                                    88
```

Based on this analysis, it was predicted that these proteins and their epitopes could be useful antigens for vaccines or diagnostics.

EXAMPLE 736

A DNA sequence (GBSx0782) was identified in *S. agalactiae* <SEQ ID 2257> which encodes the amino acid sequence <SEQ ID 2258>. Analysis of this protein sequence reveals the following:

```
Possible site: 19
>>> Seems to have an uncleavable N-term signal seq

----- Final Results -----
            bacterial membrane  --- Certainty = 0.0000(Not Clear) < succ>
            bacterial outside   --- Certainty = 0.0000(Not Clear) < succ>
            bacterial cytoplasm --- Certainty = 0.0000(Not Clear) < succ>
```

The protein has homology with the following sequences in the GENPEPT database:

```
>GP:BAA85256 GB:AB021978 3-oxoacyl-[acyl carrier protein]
reductase homolog [Moritella marina]
Identities = 82/239 (34%), Positives = 125/239 (51%),
Gaps = 15/239 (6%)

Query:     2 TKVVLVTGCASGIGYAQAQYFLKQGYQVYGVDKSDKPNLN-----GNFNF-IKLDLSSDL   55
             +K VLVTG + GIG A A++F K G  V G    S +         G+  F ++L+++S
Sbjct:     5 SKTVLVTGASRGIGRAIAEHFAKLGATVIGTATSAQGAERIGAYLGDAGFGLELNVTSQD   64

Query:    56 S------PLFTMVPTVDILCNTAGILDAYKPLLEVSDEELEHLFDINFFVTVRLTRHYLR  109
             S       + T V  +DIL N AGI  A     L + ++E  ++ D N     RL +  LR
Sbjct:    65 SVDALYAEIKTQVGHIDILVNNAGIT-ADNIFLRMKEDEWCNVIDTNLTSLYRLCKPCLR  123

Query:   110 RMVEKKSGIIINMCSIASFIAGGGGAAYTSSKHALAGFTRQLALDYAKDCIQIFGIAPGA  169
               M++++ G  IIN+ S+         GG A Y ++K  L  GFT+ LA + A    I +   +APG
Sbjct:   124 GMMKQRHGRIINIGSVVGTTGNGGQANYAAAKSGLLGFTKSLASEVASRGITVNAVAPGF  183

Query:   170 VQTAMTASDFEPGGLAEWVASETPIGRWTKPSEVAELTGFLASGKARSMQGEIVKIDGG   228
             ++T MTA    E       + + ++ P   R     +E+AE  GFLAS   A  + GE +  ++GG
Sbjct:   184 IETDMTAELTEE--QKQTILAQVPTSRLGSTTEIAETVGFLASDGASYITGETIHVNGG   240
```

There is also homology to SEQ IDs 2628 and 7170.

A related sequence was also identified in GAS <SEQ ID 9107> which encodes the amino acid sequence <SEQ ID 9108>. Analysis of this protein sequence reveals the following:

```
Possible site: 19
>>> Seems to have an uncleavable N-term signal seq

----- Final Results -----
              bacterial membrane --- Certainty = 0.0000(Not Clear) < succ>
               bacterial outside --- Certainty = 0.0000(Not Clear) < succ>
             bacterial cytoplasm --- Certainty = 0.0000(Not Clear) < succ>
```

An alignment of the GAS and GBS proteins is shown below:

```
Identities = 206/232 (88%), Positives = 224/232 (95%)

Query:     1 MTKVVLVTGCASGIGYAQAQYFLKQGYQVYGVDKSDKPNLNGNFNFIKLDLSSDLSPLFT    60
             MTKVVLVTGCASGIGYAQA+YFLKQG+ VYGVDKSDKP+L+GNF+FIKLDLSS+L+PLF
Sbjct:     4 MTKVVLVTGCASGIGYAQARYFLKQGHHVYGVDKSDKPDLSGNFHFIKLDLSSELAPLFK    63

Query:    61 MVPTVDILCNTAGILDAYKPLLEVSDEELEHLFDINFFVTVRLTRHYLRRMVEKKSGIII   120
             +VP+VDILCNTAGILDAYKPLL+VSDEE+EHLFDINFF TV+LTRHYLRRMVEK+SG+II
Sbjct:    64 VVPSVDILCNTAGILDAYKPLLDVSDEEVEHLFDINFFATVKLTRHYLRRMVEKQSGVII   123

Query:   121 NMCSIASFIAGGGGAAYTSSKHALAGFTRQLALDYAKDCIQIFGIAPGAVQTAMTASDFE   180
             NMCSIASFIAGGGG AYTSSKHALAGFTRQLALDYAKD I IFGIAPGAV+TAMTA+DFE
Sbjct:   124 NMCSIASFIAGGGGVAYTSSKHALAGFTRQLALDYAKDQIHIFGIAPGAVKTAMTANDFE   183

Query:   181 PGGLAEWVASETPIGRWTKPSEVAELTGFLASGKARSMQGEIVKIDGGWSLK   232
             PGGLA+WVA ETPIGRWTKP EVAELTGFLASGKARSMQGEIVKIDGGW+LK
Sbjct:   184 PGGLADWVARETPIGRWTKPDEVAELTGFLASGKARSMQGEIVKIDGGWTLK   235
```

A related DNA sequence was identified in *S. pyogenes* <SEQ ID 9063> which encodes amino acid sequence <SEQ ID 9064>. An alignment of the GAS and GBS sequences follows:

```
Score = 83.1 bits (202), Expect = 4e-18
Identities = 72/258 (27%), Positives = 106/258 (40%),
Gaps = 36/258 (13%)

Query:     6 EVAFITGAASGIGKQIGETLLKEGKTVVFSDINQE-----KLDQVVADYTKEGYDAFSVV    60
             +V  +TG ASGIG    + LK+G V  D +             + + D + +  F++V
Sbjct:     3 KVVLVTGCASGIGYAQAQYFLKQGYQVYGVDKSDKPNLNGNFNFIKLDLSSDLSPLFTMV    62
```

```
-continued
Query:   61 CDVTKEEAINAAIDTVVEKYGRIDILVNNAG-LQHVAMIEDFPTEKFEFMIKIMLTAPFI  119
                            +DIL N AG L     + +    E+ E +  I
Sbjct:   63 -------------------PTVDILCNTAGILDAYKPLLEVSDEELEHLFDINFFVTVR  102

Query:  120 AIKRAFPTMKAQKHGRIINMASINGVIGFAGKSAYNSAKHGLIGLTKVTALEAADSGITV  179
                +    M  +K G IINM SI    I    G +AY S+KH L G T+   AL+ A    I +
Sbjct:  103 LTRHYLRRMVEKKSGIIINMCSIASFIAGGGGAAYTSSKHALAGFTRQLALDYAKDCIQI  162

Query:  180 NAICPGYVDTPLVRGQFEDLSKTRGIPLENVLEEVLYPLVPQKRLIDVQEIADYVSFLAS  239
                    I PG V T +      FE            L E +    P R     E+A+     FLAS
Sbjct:  163 FGIAPGAVQTAMTASDFE----------PGGLAEWVASETPIGRWTKPSEVAELTGFLAS  212

Query:  240 DKAKGVTGQACILDGGYT                                          257
                KA+  +  G+    +DGG++
Sbjct:  213 GKARSMQGEIVKIDGGWS                                          230
```

A further related DNA sequence was identified in *S. pyogenes* <SEQ ID 2259> which encodes the amino acid sequence <SEQ ID 2260>. An alignment of the GAS and GBS sequences follows:

```
Score = 427 bits (1086), Expect = e-122
Identities = 206/232 (88%), Positives = 224/232 (95%)

Query:    4 MTKVVLVTGCASGIGYAQARYFLKQGHHVYGVDKSDKPDLSGNFHFIKLDLSSELAPLFK   63
            MTKVVLVTGCASGIGYAQA+YFLKQG+ VYGVDKSDKP+L+GNF+FIKLDLSS+L+PLF
Sbjct:    1 MTKVVLVTGCASGIGYAQAQYFLKQGYQVYGVDKSDKPNLNGNFNFIKLDLSSDLSPLFT   60

Query:   64 VVPSVDILCNTAGILDAYKPLLDVSDEEVEHLFDINFFATVKLTRHYLRRMVEKQSGVII  123
            +VP+VDILCNTAGILDAYKPLL+VSDEE+EHLFDINFF TV+LTRHYLRRMVEK+SG+II
Sbjct:   61 MVPTVDILCNTAGILDAYKPLLEVSDEELEHLFDINFFVTVRLTRHYLRRMVEKKSGIII  120

Query:  124 NMCSIASFIAGGGGVAYTSSKHALAGFTRQLALDYAKDQIHIFGIAPGAVKTAMTANDFE  183
            NMCSIASFIAGGGG AYTSSKHALAGFTRQLALDYAKD I IFGIAPGAV+TAMTA+DFE
Sbjct:  121 NMCSIASFIAGGGGAAYTSSKHALAGFTRQLALDYAKDCIQIFGIAPGAVQTAMTASDFE  180

Query:  184 PGGLADWVARETPIGRWTKPDEVAELTGFLASGKARSMQGEIVKIDGGWTLK          235
            PGGLA+WVA ETPIGRWTKP EVAELTGFLASGKARSMQGEIVKIDGGW+LK
Sbjct:  181 PGGLAEWVASETPIGRWTKPSEVAELTGFLASGKARSMQGEIVKIDGGWSLK          232
```

SEQ ID 2258 (GBS251) was expressed in *E. coli* as a His-fusion product. SDS-PAGE analysis of total cell extract is shown in FIG. 43 (lane 2; MW 21.7 kDa). It was also expressed in *E. coli* as a GST-fusion product. SDS-PAGE analysis of total cell extract is shown in FIG. 47 (lane 6; MW 52 kDa).

Based on this analysis, it was predicted that these proteins and their epitopes could be useful antigens for vaccines or diagnostics.

EXAMPLE 737

A DNA sequence (GBSx0783) was identified in *S. agalactiae* <SEQ ID 2261> which encodes the amino acid sequence <SEQ ID 2262>. Analysis of this protein sequence reveals the following:

```
Possible site: 48
>>> Seems to have no N-terminal signal sequence
        INTEGRAL    Likelihood = -3.82    Transmembrane    62-78 (62-79)

----- Final Results -----
                bacterial membrane  --- Certainty = 0.2529(Affirmative) < succ>
                 bacterial outside  --- Certainty = 0.0000(Not Clear)   < succ>
               bacterial cytoplasm  --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 738

A DNA sequence (GBSx0784) was identified in *S. agalactiae* <SEQ ID 2263> which encodes the amino acid sequence <SEQ ID 2264>. Analysis of this protein sequence reveals the following:

```
Possible site: 31
>>> Seems to have no N-terminal signal sequence

----- Final Results -----
              bacterial cytoplasm --- Certainty = 0.1495(Affirmative) < succ>
               bacterial membrane --- Certainty = 0.0000(Not Clear)   < succ>
                 bacterial outside --- Certainty = 0.0000(Not Clear)   < succ>
```

The protein has homology with the following sequences in the GENPEPT database:

```
>GP: CAA20397 GB: AL031317 SC6G4.19c, unknown, len: 190 aa; contains
Pro-Ser-rich domain at N-terminus [Streptomyces coelicolor A3(2)]
Identities = 26/80 (32%), Positives = 44/80 (54%), Gaps = 5/80 (6%)

Query:    1 MDSNDEAICIIEITKVDIVPFKDVSADHAFKEGEGDKTLEWWRKAHIDFF-----KPYFE    55
            +DS +  + +IE+T+V +VP  +V   HA  EGEGD ++  WR  H  F+      +
Sbjct:  103 VDSRERPVAVIEVTEVRVVPLAEVDLAHAVDEGEGDTSVAGWRAGHERFWHGAEMRAALG  162

Query:   56 EFGLMFSEDSRIVLEEFQVV                                           75
            + G    + + +VLE F++V
Sbjct:  163 DPGFTVDDATPVVLERFRIV                                          182
```

No corresponding DNA sequence was identified in *S. pyogenes*.

Based on this analysis, it was predicted that this protein and its epitopes, could be useful antigens for vaccines or diagnostics.

EXAMPLE 739

A DNA sequence (GBSx0785) was identified in *S. agalactiae* <SEQ ID 2265> which encodes the amino acid sequence <SEQ ID 2266>. Analysis of this protein sequence reveals the following:

```
Possible site: 40
>>> Seems to have an uncleavable N-term signal seq
     INTEGRAL       Likelihood = -1.49       Transmembrane     3-19 (3-19)

----- Final Results -----
               bacterial membrane --- Certainty = 0.1595(Affirmative) < succ>
                 bacterial outside --- Certainty = 0.0000(Not Clear)   < succ>
              bacterial cytoplasm --- Certainty = 0.0000(Not Clear)   < succ>
```

The protein has homology with the following sequences in the GENPEPT database:

```
>GP: BAB06422 GB: AP001516 unknown conserved protein [Bacillus halodurans]
Identities = 133/315 (42%), Positives = 191/315 (60%), Gaps = 4/315 (1%)

Query:    1 MKLAVLGTGMIVKEVLPVLQKIEGIDLVAILSTVRSLETAKDLAKEYNMSLATSEYKAVL    60
            MK+A +GTG IV+  L  L  I+G   VA+ S  R    TAK LA +YN+    + + +L
Sbjct:    1 MKIATVGTGPIVEAFLSALDDIDGPMCVAMYS--RKETTAKPLADQYNIPTIYTHFDHML   58

Query:   61 DNEEIDTVYIGLPNHLHFDYAKEALLAGKHVICEKPFTLEASQLEELVSIANTRQLILLE  120
            +  ++ VY+  PN LH+ +A +AL    KHVICEKPFT  A +LE L+S+A    +L+L E
Sbjct:   59 ADPNVEVVYVASPNSLHYQHALQALEHRKHVICEKPFTSTARELEHLISVARKNELMLFE  118

Query:  121 AITNQYLPNFDLVKEHLSNLGDIKIVECNYSQYSSRYDAFKRGEIAPAFNPEMGGGALRD  180
            AIT  +LPN+ L+KE++   LG IK+++CNYSQYSSRYD F  GE    FNP  GGAL D
Sbjct:  119 AITTIHLPNYQLIKENIHKLGSIKMIQCNYSQYSSRYDRFLSGETPNVFNPAFSGGALMD  178
```

```
                            -continued
Query: 181 LNIYNLHLVIGLFGEPITAQYLPNIE-RGIDTSGVLVLDYGHFKTVCIGAKDCSAEVKST 239
           +N+YN+H V+ LFG P   A Y+ N    GIDTSGVLVL Y HF + C+G KD   +
Sbjct: 179 INVYNIHFVMNLFGPPEAAHYIANQHANGIDTSGVLVLKYPHFISECVGCKDTQSMNFVL 238

Query: 240 IQGDKGSIAILGPTNTMPKISLTMNGQESHVYQLNGDRHRMHDEFVIFEGIISNLDFKRA 299
           IQG+KG I +       N    + + ++ Q S  +    D    ++     +E  +     +F++
Sbjct: 239 IQGEKGYIHVENGANGCRNVKIYLDDQTSELNAQTNDNLLYYETRTFYE-MYQAKNFEKC 297

Query: 300 AQALEHSRTVMKVLD                                              314
            + L +S +VM+V++
Sbjct: 298 YELLSYSHSVMRVME                                              312
```

A related DNA sequence was identified in *S. pyogenes* <SEQ ID 719> which encodes the amino acid sequence <SEQ ID 720>. Analysis of this protein sequence reveals the following:

```
Possible site: 40
>>> Seems to have a cleavable N-term signal seq.

----- Final Results -----
             bacterial outside --- Certainty = 0.3000(Affirmative) < succ>
            bacterial membrane --- Certainty = 0.0000(Not Clear) < succ>
           bacterial cytoplasm --- Certainty = 0.0000(Not Clear) < succ>
```

An alignment of the GAS and GBS proteins is shown below:

```
Identities = 233/314 (74%), Positives = 269/314 (85%)

Query:   1 MKLAVLGTGMIVKEVLPVLQKIEGIDLVAILSTVRSLETAKDLAKEYNMSLATSEYKAVL  60
           MKLAVLGTGMIVKEVLPVLQKI+GIDLVAILSTVRSL TAKDLAK ++M LATS+Y+A+L
Sbjct:   1 MKLAVLGTGMIVKEVLPVLQKIDGIDLVAILSTVRSLTTAKDLAKAHHMPLATSKYEAIL  60

Query:  61 DNEEIDTVYIGLPNHLHFDYAKEALLAGKHVICEKPFTLEASQLEELVSIANTRQLILLE 120
            NEEIDTVYIGLPNHLHF YAKEALLAGKHVICEKPFT+ A +L+ELV IA  R+LILLE
Sbjct:  61 GNEEIDTVYIGLPNHLHFAYAKEALLAGKHVICEKPFTMTAGELDELVVIARKRKLILLE 120

Query: 121 AITNQYLPNFDLVKEHLSNLGDIKIVECNYSQYSSRYDAFKRGEIAPAFNPEMGGGALRD 180
           AITNQYL N   +KEHL  LGDIKIVECNYSQYSSRYDAFKRG+IAPAFNP+MGGGALRD
Sbjct: 121 AITNQYLSNMTFIKEHLDQLGDIKIVECNYSQYSSRYDAFKRGDIAPAFNPKMGGGALRD 180

Query: 181 LNIYNLHLVIGLFGEPITAQYLPNIERGIDTSGVLVLDYGHFKTVCIGAKDCSAEVKSTI 240
           LNIYN+H V+GLFG P T QYL N+E+GIDTSG+LV+DY  FK VCIGAKDC+AE+KSTI
Sbjct: 181 LNIYNIHFVVGLFGRPKTVQYLANVEKGIDTSGMLVMDYEQFKVVCIGAKDCTAEIKSTI 240

Query: 241 QGDKGSIAILGPTNTMPKISLTMNGQESHVYQLNGDRHRMHDEFVIFEGIISNLDFKRAA 300
           QG+KGS+A+LG TNT+P++ L+++G E  V   N     HRM++EFV F  +I   DF++
Sbjct: 241 QGNKGSLAVLGATNTLPQVQLSLHGHEPQVINHNKHDHRMYEEFVAFRDMIDQRDFEKVN 300

Query: 301 QALEHSRTVMKVLD                                               314
           QALEHSR VM VL+
Sbjct: 301 QALEHSRAVMAVLE                                               314
```

SEQ ID 2266 (GBS342) was expressed in *E. coli* as a His-fusion product. SDS-PAGE analysis of total cell extract is shown in FIG. 72 (lane 10; MW 36.6 kDa). It was also expressed in *E. coli* as a GST-fusion product. SDS-PAGE analysis of total cell extract is shown in FIG. 81 (lane 2; MW 61 kDa).

GBS342-GST was purified as shown in FIG. 226, lane 3.

Based on this analysis, it was predicted that these proteins and their epitopes could be useful antigens for vaccines or diagnostics.

EXAMPLE 740

A DNA sequence (GBSx0786) was identified in *S. agalactiae* <SEQ ID 2267> which encodes the amino acid sequence <SEQ ID 2268>. Analysis of this protein sequence reveals the following:

```
Possible site: 19
>>> Seems to have no N-terminal signal sequence

----- Final Results -----
           bacterial cytoplasm --- Certainty = 0.0499(Affirmative) < succ>
            bacterial membrane --- Certainty = 0.0000(Not Clear) < succ>
             bacterial outside --- Certainty = 0.0000(Not Clear) < succ>
```

The protein has homology with the following sequences in the GENPEPT database:

```
>GP: CAB12535 GB: Z99107 similar to hypothetical proteins [Bacillus subti-
lis]
Identities = 41/127 (32%), Positives = 63/127 (49%), Gaps = 11/127 (8%)

Query:    1 MISSIGQVMLYVSNVEASADFWKNKVGFERVEKQTQGDYVTYI-VAPKLDSEVSFVLHDK   59
            MI  IG V +YV + + + FW  KVGF+         G    +++ VAPK  +E   V++ K
Sbjct:    1 MIKQIGTVAVYVEDQQKAKQFWTEKVGFDIAADHPMGPEASWLEVAPK-GAETRLVIYPK   59

Query:   60 AIIAQMSPELDLATPSILFETTDIDSTYQELTAN--EVMTNP-IVDMGSMRVFNFSDNDN  116
            A     M   +    SI+FE DI  TY+++  N  E +  P  ++ G+      F D D
Sbjct:   60 A----MMKGSEQMKASIVFECEDIFGTYEKMKTNGVEFLGEPNQMEWGTF--VQFKDEDG  113

Query:  117 NYFAIRE                                                       123
            N F ++E
Sbjct:  114 NVFLLKE                                                       120
```

No corresponding DNA sequence was identified in *S. pyogenes*.

Based on this analysis, it was predicted that this protein and its epitopes, could be useful antigens for vaccines or diagnostics.

EXAMPLE 741

A DNA sequence (GBSx0787) was identified in *S. agalactiae* <SEQ ID 2269> which encodes the amino acid sequence <SEQ ID 2270>. Analysis of this protein sequence reveals the following:

```
Possible site: 37
>>> Seems to have no N-terminal signal sequence

----- Final Results -----
         bacterial cytoplasm --- Certainty = 0.3402(Affirmative) < succ>
         bacterial membrane  --- Certainty = 0.0000(Not Clear)   < succ>
         bacterial outside   --- Certainty = 0.0000(Not Clear)   < succ>
```

The protein has homology with the following sequences in the GENPEPT database:

```
>GP: BAB04569 GB: AP001510 unknown conserved protein in others
[Bacillus halodurans]
Identities = 46/144 (31%), Positives = 83/144 (56%), Gaps = 10/144 (6%)

Query:    1 MVKALETYIVTNGNGRQAVDFYKDVFQADLVNMMTWEEM--DPNC--LEDRKDLIINAQL   56
            M+  +  Y++ +G+G+ A++FY+D   A+++ + T+ ++   PN         KDLI++A L
Sbjct:    1 MILTMNPYLMLDGDGQAAIEFYQDALNAEVITIQTYGDLPEQPNSPMASVNKDLILHAHL   60

Query:   57 IFDGIRLQISDENPD-----FVYQAGKNVTAAIIVGSVEEAREIYEKLKKSAQEVQLELQ  111
              + L ISD+  D     F   +G VT A+   +VE  E+++KL     +E+    L+
Sbjct:   61 KLGEMDLMISDQCLDVDPERFPQHSGSPVTIALTTNNVEMTTEVFQKLASGGEEIA-PLE  119

Query:  112 ETFWSPAYANLVDQFGVMWQISTE                                      135
            +TF+SP Y  + D+FG+ W +ST+
Sbjct:  120 KTFFSPLYGQVTDKFGITWHVSTQ                                      143
```

No corresponding DNA sequence was identified in *S. pyogenes*.

Based on this analysis, it was predicted that this protein and its epitopes, could be useful antigens for vaccines or diagnostics.

EXAMPLE 742

A DNA sequence (GBSx0788) was identified in *S. agalactiae* <SEQ ID 2271> which encodes the amino acid sequence <SEQ ID 2272>. Analysis of this protein sequence reveals the following:

```
Possible site: 42
>>> Seems to have no N-terminal signal sequence

----- Final Results -----
              bacterial membrane --- Certainty = 0.0000(Not Clear) < succ>
               bacterial outside --- Certainty = 0.0000(Not Clear) < succ>
             bacterial cytoplasm --- Certainty = 0.0000(Not Clear) < succ>
```

The protein has homology with the following sequences in the GENPEPT database:

```
>GP: BAB03784 GB: AP001507 UDP-N-acetylglucosamine pyrophosphorylase
[Bacillus halodurans]
Identities = 238/453 (52%), Positives = 322/453 (70%), Gaps = 1/453 (0%)

Query:    1 MSN-YAIILAAGKGTRMKSDLPKVMHKVSGITMLEHVFRSVQAIEPSKIVTVIGHKAELV    59
            MSN +A+ILAAG+GTRMKS L KV+H V G  M++HV    V A+    +IVT+IGH A+ V
Sbjct:    1 MSNRFAVILAAGQGTRMKSKLYKVLHSVCGKPMVQHVVDQVSALGFDEIVTIIGHGADAV   60

Query:   60 RDVLGDKSEFVMQTEQLGTGHAVMMAEEELATSKGHTLVIAGDTPLITGESLKNLIDFHV  119
             +  LG++  + +Q EQLGTGHAV+ AE   L    +G T+V+ GDTPL+T E++ +++ +H
Sbjct:   61 KSQLGERVSYALQEEQLGTGHAVLQAESALGGRRGVTIVLCGDTPLLTAETIDHVMSYHE  120

Query:  120 NHKNVATILTADAANPFGYGRIIRNSDDEVTKIVEQKDANDFEQQVKEINTGTYVFDNQS  179
              +   AT+LTA+ A+P GYGRI+RN   V +IVE KDA   E+Q+ E+NTGTY FDN++
Sbjct:  121 EEQAKATVLTAELADPTGYGRIVRNDKGLVERIVEHKDATSEEKQITEVNTGTYCFDNEA  180

Query:  180 LFEALKDINTNNAQGEYYLTDVIGIFKEAGKKVGAYKLRDFDESLGVNDRVALATAEKVM  239
            LF+ALK++  NNAQGEYYL DVI I +  G+KV AYK    +E+LGVNDRVALA AE+VM
Sbjct:  181 LFQALKEVGNNNAQGEYYLPDVIQILQTKGEKVAAYKTAHVEETLGVNDRVALAQAEQVM  240

Query:  240 RHRIARQHMVNGVTVVNPDSAYIDIDVEIGEESVIEPNVTLKGQTKIGKGTLLTNGSYLV  299
             + RI   M GVT ++P+ Y+ D  IG+++VI P  + GQT IG+G +L   + L
Sbjct:  241 KRRINEAWMRKGVTFIDPEQTYVSPDATIGQDTVIYPGTMVLGQTTIGEGCVLGPHTELK  300

Query:  300 DAQVGNDVTITNSMVEESIISDGVTVGPYAHIRPGTSLAKGVHIGNFVEVKGSQIGENTK  359
            D+++GN   + S+V S + + V++GP++HIRP + +   V IGNFVEVK S IG+ +K
Sbjct:  301 DSKIGNKTAVKQSVVHNSEVGERVSIGPFSHIRPASMIHDDVRIGNFVEVKKSTIGKESK  360

Query:  360 AGHLTYIGNAEVGCDVNFGAGTITVNYDGQNKFKTEIGSNVFIGSNSTLIAPLEIGDNAL  419
            A HL+YIG+AEVG  VNF G+ITVNYDG+NKF T+I   FIG NS LIAP+ IG  AL
Sbjct:  361 ASHLSYIGDAEVGERVNFSCGSITVNYDGKNKFLTKIEDDAFIGCNSNLIAPVTIGKGAL  420

Query:  420 TAAGSTITDNVPIDSIAIGRGRQVNKEGYANKK                            452
            +AAGSTIT++VP D+++I R RQ NKE Y  KK
Sbjct:  421 IAAGSTITEDVPSDALSIARARQTNKEHYVTKK                            453
```

A related DNA sequence was identified in *S. pyogenes* <SEQ ID 2273> which encodes the amino acid sequence <SEQ ID 2274>. Analysis of this protein sequence reveals the following:

```
Possible site: 42
>>> Seems to have no N-terminal signal sequence

----- Final Results -----
             bacterial cytoplasm --- Certainty = 0.0461(Affirmative) < succ>
              bacterial membrane --- Certainty = 0.0000(Not Clear)   < succ>
               bacterial outside --- Certainty = 0.0000(Not Clear)   < succ>
```

An alignment of the GAS and GBS proteins is shown below:

```
Identities = 345/458 (75%), Positives = 398/458 (86%)

Query:    1 MSNYAIILAAGKGTRMKSDLPKVMHKVSGITMLEHVFRSVQAIEPSKIVTVIGHKAELVR   60
            M+NYAIILAAGKGTRM SDLPKV+HKVSG+TMLEHVFRSV+AI P K VTVIGHK+E+VR
Sbjct:    1 MTNYAIILAAGKGTRMTSDLPKVLHKVSGLTMLEHVFRSVKAISPEKSVTVIGHKSEMVR   60

Query:   61 DVLGDKSEFVMQTEQLGTGHAVMMAEEELATSKGHTLVIAGDTPLITGESLKNLIDFHVN  120
             VL D+S FV QTEQLGTGHAVMMAE +L   +GHTLVIAGDTPLITGESLK+LIDFHVN
Sbjct:   61 AVLADQSAFVHQTEQLGTGHAVMMAETQLEGLEGHTLVIAGDTPLITGESLKSLIDFHVN  120
```

```
                              -continued
Query:  121 HKNVATILTADAANPFGYGRIIRNSDDEVTKIVEQKDANDFEQQVKEINTGTYVFDNQSL  180
            HKNVATILTA A +PFGYGRI+RN D EV KIVEQKDAN++EQQ+KEINTGTYVFDN+ L
Sbjct:  121 HKNVATILTATAQDPFGYGRIVRNKDGEVIKIVEQKDANEYEQQLKEINTGTYVFDNKRL  180

Query:  181 FEALKDINTNNAQGEYYLTDVIGIFKEAGKKVGAYKLRDFDESLGVNDRVALATAEKVMR  240
            FEALK I TNNAQGEYYLTDV+ IF+   +KVGAY LRDF+ESLGVNDRVALA AE VMR
Sbjct:  181 FEALKCITTNNAQGEYYLTDVVAIFRANKEKVGAYILRDFNESLGVNDRVALAIAETVMR  240

Query:  241 HRIARQHMVNGVTVVNPDSAYIDIDVEIGEESVIEPNVTLKGQTKIGKGTLLTNGSYLVD  300
             RI  ++HMVNGVT  NP++ YI+ DVEI  + +IE NVTLKG+T IG GT+LTNG+Y+VD
Sbjct:  241 QRITQKHMVNGVTFQNPETVYIESDVEIAPDVLIEGNVTLKGRTHIGSGTVLTNGTYIVD  300

Query:  301 AQVGNDVTITNSMVEESIISDGVTVGPYAHIRPGTSLAKGVHIGNFVEVKGSQIGENTKA  360
            +++G++   +TNSM+E S+++ GVTVGPYAH+RPGT+L + VHIGNFVEVKGS IGE TKA
Sbjct:  301 SEIGDNCVVTNSMIESSVLAAGVTVGPYAHLRPGTTLDREVHIGNFVEVKGSHIGEKTKA  360

Query:  361 GHLTYIGNAEVGCDVNFGAGTITVNYDGQNKFKTEIGSNVFIGSNSTLIAPLEIGDNALT  420
            GHLTYIGNA+VG  VN GAGTITVNYDGQNK++T IG + FIGSNSTLIAPLE+GD+ALT
Sbjct:  361 GHLTYIGNAQVGSSVNVGAGTITVNYDGQNKYETVIGDHAFIGSNSTLIAPLEVGDHALT  420

Query:  421 AAGSTITDNVPIDSIAIGRGRQVNKEGYANKKPHHPSQ                       458
            AAGSTI+  VPIDSIAIGR RQV KEGYA +  HHPS+
Sbjct:  421 AAGSTISKTVPIDSIAIGRSRQVTKEGYAKRLAHHPSR                       458
```

Based on this analysis, it was predicted that these proteins and their epitopes could be useful antigens for vaccines or diagnostics.

EXAMPLE 743

A DNA sequence (GBSx0790) was identified in *S. agalactiae* <SEQ ID 2275> which encodes the amino acid sequence <SEQ ID 2276>. Analysis of this protein sequence reveals the following:

```
Possible site: 52
>>> Seems to have no N-terminal signal sequence

----- Final Results -----
            bacterial cytoplasm --- Certainty = 0.1366(Affirmative) < succ>
            bacterial membrane  --- Certainty = 0.0000(Not Clear)   < succ>
             bacterial outside  --- Certainty = 0.0000(Not Clear)   < succ>
```

The protein has homology with the following sequences in the GENPEPT database:

```
>GP: CAB14293 GB: Z99116 similar to hypothetical proteins [Bacillus
subtilis]
Identities = 92/177 (51%), Positives = 124/177 (69%), Gaps = 4/177 (2%)

Query:    4 EEKTINRQTVFDGQIIKVAVDDVELPNGLGQSKRELVFHGGAVATLAVTPEHKIVLVKQY   63
            EEKTI ++ +F G++I + V+DVELPNG   SKRE+V H GAVA LAVT E KI++VKQ+
Sbjct:    5 EEKTIAKEQIFSGKVIDLYVEDVELPNGKA-SKREIVKHPGAVAVLAVTDEGKIIMVKQF   63

Query:   64 RKAIEGISYEIPAGKLETGESGSKEEAALRELEEETGYTG-NLEILYSFYTAIGFCNEKI  122
            RK +E     EIPAGKLE GE   E ALRELEEETGYT   L  + +FYT+ GF +E +
Sbjct:   64 RKPLERTIVEIPAGKLEKGE--EPEYTALRELEEETGYTAKKLTKITAFYTSPGFADEIV  121

Query:  123 VLYLATDLQKVENPRPQDDDEVLELLELSYEDCMQMVEKGMIQDAKTIIALQYYGLK     179
              ++LA +L  +E  R  D+DE +E++E++  ED +++VE  +  DAKT  A+QY  LK
Sbjct:  122 HVFLAEELSVLEEKRELDEDEFVEVMEVTLEDALKLVESREVYDAKTAYAIQYLQLK     178
```

A related DNA sequence was identified in *S. pyogenes* <SEQ ID 2277> which encodes the amino acid sequence <SEQ ID 2278>. Analysis of this protein sequence reveals the following:

```
Possible site: 50
>>> Seems to have no N-terminal signal sequence

----- Final Results -----
            bacterial cytoplasm --- Certainty = 0.1120 (Affirmative) < succ>
            bacterial membrane  --- Certainty = 0.0000 (Not Clear)   < succ>
             bacterial outside  --- Certainty = 0.0000 (Not Clear)   < succ>
```

An alignment of the GAS and GBS proteins is shown below:

```
Identities = 136/182 (74%), Positives = 153/182 (83%)

Query:    1 MDFEEKTINRQTVFDGQIIKVAVDDVELPNGLGQSKRELVFHGGAVATLAVTPEHKIVLV   60
            M FEEKT+ RQTVFDG I KV VDDVELPN LGQSKREL+FH GAVA LA+TPE KIVLV
Sbjct:    1 MKFEEKTLKRQTVFDGHIFKVVVDDVELPNNLGQSKRELIFHRGAVAVLAITPERKIVLV   60

Query:   61 KQYRKAIEGISYEIPAGKLETGESGSKEEAALRELEEETGYTGNLEILYSFYTAIGFCNE  120
            KQYRKAIE +SYEIPAGKLE GE GSK +AA RELEEET YTG L  LY FYTAIGFCNE
Sbjct:   61 KQYRKAIERVSYEIPAGKLEIGEEGSKLKAAARELEEETAYTGTLTFLYEFYTAIGFCNE  120

Query:  121 KIVLYLATDLQKVENPRPQDDDEVLELLELSYEDCMQMVEKGMIQDAKTIIALQYYGLKM  180
            KI L+LATDL +V NP+PQDDDEV+E+LEL+Y++CM +V +G +  DAKT+IALQYY L
Sbjct:  121 KITLFLATDLIQVANPKPQDDDEVIEVLELTYQECMDLVAQGKLADAKTLIALQYYALHF  180

Query:  181 GG                                                          182
            GG
Sbjct:  181 GG                                                          182
```

Based on this analysis, it was predicted that these proteins and their epitopes could be useful antigens for vaccines or diagnostics.

EXAMPLE 744

A DNA sequence (GBSx0791) was identified in *S. agalactiae* <SEQ ID 2279> which encodes the amino acid sequence <SEQ ID 2280>. Analysis of this protein sequence reveals the following:

```
Possible site: 16
>>> Seems to have no N-terminal signal sequence
     INTEGRAL    Likelihood = -15.44   Transmembrane      70-86 (64-88)

----- Final Results -----
            bacterial membrane --- Certainty = 0.7177 (Affirmative) < succ>
             bacterial outside --- Certainty = 0.0000 (Not Clear)  < succ>
           bacterial cytoplasm --- Certainty = 0.0000 (Not Clear)  < succ>
```

The protein has no significant homology with any sequences in the GENPEPT database.

A related DNA sequence was identified in *S. pyogenes* <SEQ ID 2281> which encodes the amino acid sequence <SEQ ID 2282>. Analysis of this protein sequence reveals the following:

```
Possible site: 35
>>> Seems to have no N-terminal signal sequence
     INTEGRAL    Likelihood = -15.60   Transmembrane      65-81 (58-83)

----- Final Results -----
            bacterial membrane --- Certainty = 0.7241 (Affirmative) < succ>
             bacterial outside --- Certainty = 0.0000 (Not Clear)  < succ>
           bacterial cytoplasm --- Certainty = 0.0000 (Not Clear)  < succ>
```

An alignment of the GAS and GBS proteins is shown below:

```
Identities = 39/89 (43%), Positives = 61/89 (67%), Gaps = 6/89 (6%)

Query:    1 MGKPLLTDDMIERSNRGEKVSGQTILDQETKIISTEDGMEQLTDENGKHIYKSRRIENAK   60
            MG+PLLTDD+IE++ R E       ++ +TK+++ +       ++  IYKSRRIENAK
Sbjct:    2 MGRPLLTDDIIEKARRMETFEPDDAVNFDTKVMTLPE------KDDKARIYKSRRIENAK   55

Query:   61 RNEFQRKLNLVLFILLILLALLFYAIFKL                                89
            R++ Q KLN++L   +++L+A+L YAIF L
Sbjct:   56 RSQLQSKLNVILIAVMLLIAILVYAIFYL                                84
```

Based on this analysis, it was predicted that these proteins and their epitopes could be useful antigens for vaccines or diagnostics.

EXAMPLE 745

A DNA sequence (GBSx0792) was identified in *S. agalactiae* <SEQ ID 2283> which encodes the amino acid sequence <SEQ ID 2284>. This protein is predicted to be pfs protein (pfs). Analysis of this protein sequence reveals the following:

```
Possible site: 55
>>> Seems to have no N-terminal signal sequence
     INTEGRAL      Likelihood = -0.32    Transmembrane      56-72 (56-72)

----- Final Results -----
              bacterial membrane --- Certainty = 0.1128 (Affirmative) < succ>
               bacterial outside --- Certainty = 0.0000 (Not Clear)   < succ>
             bacterial cytoplasm --- Certainty = 0.0000 (Not Clear)   < succ>
```

The protein has homology with the following sequences in the GENPEPT database:

```
>GP: AAC22869 GB: U32801 pfs protein (pfs) [Haemophilus influenzae Rd]
Identities = 100/229 (43%), Positives = 144/229 (62%)

Query:    1 MKIGIIAAMEEELKLLVENLEDKSQETVLSNVYYSGRYGEHELVLVQSGVGKVMSAMSVA   60
            MKIGI+ AM +E+++L   + D+++  V S V + G+     ++ L+QSG+GKV +A+
Sbjct:    1 MKIGIVGAMAQEVEILKNLMADRTETRVASAVIFEGKINGKDVALLQSGIGKVAAAIGTT   60

Query:   61 ILVESFKVDAIINTGSAGAVATGLNVGDVVVADTLVYHDVDLTAFGYDYGQMSMQPLYFH  120
            L++    K D +INTGSAG VA GL VGD+V++D    YHD D+TAFGY+ GQ+    P   F
Sbjct:   61 ALLQLAKPDCVINTGSAGGVAKGLKVGDIVISDETRYHDADVTAFGYEKGQLPANPAAFL  120

Query:  121 SDKTFVSTFEAVLSKEEMISKVGLIATGDSFIAGQEKIDVIKGHFPQVLAVEMEGAAIAQ  180
            SDK     + +   K+     K GLI +GDSFI  ++KI  IK    FP V  VEME   AIAQ
Sbjct:  121 SDKKLADLAQEIAEKQGQSVKRGLICSGDSFINSEDKIAQIKADFPNVTGVEMEATAIAQ  180

Query:  181 AAQATGKPFVVVRAMSDTAAHDANITFDEFIIEAGKRSAQVLMAFLKAL             229
              A   PFVVVRA+SD    A+++F+EF+   A K+S+ +++   +   L
Sbjct:  181 VCYAFNVPFVVVRAISDGGDGKASMSFEEFLPLAAKQSSALVLGMIDRL             229
```

A related DNA sequence was identified in *S. pyogenes* <SEQ ID 2285> which encodes the amino acid sequence <SEQ ID 2286>. Analysis of this protein sequence reveals the following:

```
Possible site: 23
>>> Seems to have no N-terminal signal sequence

----- Final Results -----
             bacterial cytoplasm --- Certainty = 0.1245 (Affirmative) < succ>
              bacterial membrane --- Certainty = 0.0000 (Not Clear)   < succ>
               bacterial outside --- Certainty = 0.0000 (Not Clear)   < succ>
```

An alignment of the GAS and GBS proteins is shown below:

```
Identities = 169/229 (73%), Positives = 189/229 (81%)

Query:    1 MKIGIIAAMEEELKLLVENLEDKSQETVLSNVYYSGRYGEHELVLVQSGVGKVMSAMSVA   60
            MKIGIIAAMEEEL LL+ NL D  +   VLS  YY+GR+G+HEL+LVQSGVGKVMSAM+VA
Sbjct:    1 MKIGIIAAMEEELSLLLANLLDAQEHQVLSKTYYTGRFGKHELILVQSGVGKVMSAMTVA   60

Query:   61 ILVESFKVDAIINTGSAGAVATGLNVGDVVVADTLVYHDVDLTAFGYDYGQMSMQPLYFH  120
            ILVE FK   AIINTGSAGAVA+ L +GDVVVAD LVYHDVD TAFGY YGQM+ QPLY+
Sbjct:   61 ILVEHFKAQAIINTGSAGAVASHLAIGDVVVADRLVYHDVDATAFGYAYGQMAGQPLYYD  120

Query:  121 SDKTFVSTFEAVLSKEEMISKVGLIATGDSFIAGQEKIDVIKGHFPQVLAVEMEGAAIAQ  180
              D   FV+ F+ VL  E+    +VGLIATGDSF+AGQ+KID IK  F    VLAVEMEGAAIAQ
Sbjct:  121 CDPQFVAIFKQVLKHEKTNGQVGLIATGDSFVAGQDKIDQIKTAFSDVLAVEMEGAAIAQ  180
```

-continued
```
Query: 181 AAQATGKPFVVVRAMSDTAAHDANITFDEFIIEAGKRSAQVLMAFLKAL       229
            AA   GKPF+VVRAMSDTAAHDANITFD+FIIEAGKRSAQ LM FL+ L
Sbjct: 181 AAHTAGKPFIVVRAMSDTAAHDANITFDQFIIEAGKRSAQTLMTFLENL       229
```

Based on this analysis, it was predicted that these proteins and their epitopes could be useful antigens for vaccines or diagnostics.

EXAMPLE 746

A DNA sequence (GBSx0793) was identified in *S. agalactiae* <SEQ ID 2287> which encodes the amino acid sequence <SEQ ID 2288>. This protein is predicted to be SloR. Analysis of this protein sequence reveals the following:

```
Possible site: 53
>>> Seems to have no N-terminal signal sequence

----- Final Results -----
          bacterial cytoplasm --- Certainty = 0.3777 (Affirmative) < succ>
           bacterial membrane --- Certainty = 0.0000 (Not Clear)   < succ>
            bacterial outside --- Certainty = 0.0000 (Not Clear)   < succ>
```

A related GBS nucleic acid sequence <SEQ ID 9405> which encodes amino acid sequence <SEQ ID 9406> was also identified.

The protein has homology with the following sequences in the GENPEPT database:

```
>GP: AAF81675 GB: AF232688 SloR [Streptococcus mutans]
Identities = 97/175 (55%), Positives = 134/175 (76%)

Query:   1 MSEMIKKMISEQLIVKDKDLGYYLTKQGLLVVSDLYRKHRLVEVFLVNHLHYTADDIHEE    60
           +SEM+KK++ E L++KDK  GY LTK+G ++ S LYRKHRL+EVFL+NHL+YTAD+IHEE
Sbjct:  38 VSEMVKKLLLEDLVLKDKQAGYLLTKKGQILASSLYRKHRLIEVFLMNHLNYTADEIHEE    97

Query:  61 AEVLEHTVSTTFVDQLEKLLDFPQFCPHGGTIPKKGEFLVEINQMTLDQISQLGTYVISR   120
           AEVLEHTVS  FV++L+K L++P+ CPHGGTIP+ G+ LVE  + TL  ++++G Y++ R
Sbjct:  98 AEVLEHTVSDVFVERLDKFLNYPKVCPHGGTIPQHGQPLVERYRTTLKGVTEMGVYLLKR   157

Query: 121 VHDDFQLLKYLEQHRLHINDTIELTQIDPYAKTYHITYNDENLTIPERIASQIYV       175
           V D+FQLLKY+EQH L I D + L + D +A Y I  + E L +    +ASQIY+
Sbjct: 158 VQDNFQLLKYMEQHHLKIGDELRLLEYDAFAGAYTIEKDGEQLQVTSAVASQIYI       212
```

A related DNA sequence was identified in *S. pyogenes* <SEQ ID 2289> which encodes the amino acid sequence <SEQ ID 2290>. Analysis of this protein sequence reveals the following:

```
Possible site: 39
>>> Seems to have no N-terminal signal sequence

----- Final Results -----
          bacterial cytoplasm --- Certainty = 0.2910 (Affirmative) < succ>
           bacterial membrane --- Certainty = 0.0000 (Not Clear)   < succ>
            bacterial outside --- Certainty = 0.0000 (Not Clear)   < succ>
```

An alignment of the GAS and GBS proteins is shown below:

```
Identities = 44/75 (58%), Positives = 59/75 (78%)

Query:   1 MSEMIKKMISEQLIVKDKDLGYYLTKQGLLVVSDLYRKHRLVEVFLVNHLHYTADDIHEE    60
           +SEMIKKMIS+   IVKDK  GY L  +G  +V++LYRK RL+EVFL++  L Y   ++H+E
Sbjct:  38 VSEMIKKMISQGWIVKDKAKGYLLKDKGYALVANLYRKLRLIEVFLIHQLGYNTQEVHQE    97

Query:  61 AEVLEHTVSTTFVDQ                                              75
           AEVLEHTVS +F+D+
Sbjct:  98 AEVLEHTVSDSFIDR                                             112
```

Based on this analysis, it was predicted that these proteins and their epitopes could be useful antigens for vaccines or diagnostics.

EXAMPLE 747

A DNA sequence (GBSx0794) was identified in *S. agalactiae* <SEQ ID 2291> which encodes the amino acid sequence <SEQ ID 2292>. This protein is predicted to be undecaprenyl pyrophosphate synthetase (uppS). Analysis of this protein sequence reveals the following:

```
Possible site: 46
>>> Seems to have no N-terminal signal sequence

----- Final Results -----
            bacterial cytoplasm --- Certainty = 0.3569 (Affirmative) < succ>
             bacterial membrane --- Certainty = 0.0000 (Not Clear)   < succ>
              bacterial outside --- Certainty = 0.0000 (Not Clear)   < succ>
```

A related GBS nucleic acid sequence <SEQ ID 9435> which encodes amino acid sequence <SEQ ID 9436> was also identified.

The protein has homology with the following sequences in the GENPEPT database:

```
>GP: CAB13526 GB: Z99112 similar to hypothetical proteins [Bacillus
subtilis]
Identities = 88/165 (53%), Positives = 118/165 (71%), Gaps = 4/165 (2%)

Query:   1 MNLPVKFFDKYVPELDKNNVRVQVIGDTHKLPKATYDAMQRACLRTKHNSGLVLNFALNY    60
             M LP +F + Y+PEL + NV+V++IGD    LP  T  A+++A    T  N G++LNFALNY
Sbjct: 100 MKLPEEFLNTYLPELVEENVQVRIIGDETALPAHTLRAIEKAVQDTAQNDGMILNFALNY   159

Query:  61 GGRSEITNAIKEIAQDVLEAKLNPDDITEDLVANHLMTNSLPYLYRDPDLIIRTSGELRL   120
             GGR+EI +A K +A+ V E  LN +DI E L + +LMT SL     +DP+L+IRTSGE+RL
Sbjct: 160 GGRTEIVSAAKSLAEKVKEGSLNIEDIDESLFSTYLMTESL----QDPELLIRTSGEIRL   215

Query: 121 SNFLPWQSAYSEFYFTPVLWPDFKKDELHKAIVDYNQRHRRFGSV                 165
             SNF+ WQ AYSEF FT VLWPDFK+D   +A+ ++QR RRFG +
Sbjct: 216 SNFMLWQVAYSEFVFTDVLWPDFKEDHFLQALGEFQQRGRRFGGI                 260
```

A related DNA sequence was identified in *S. pyogenes* <SEQ ID 2293> which encodes the amino acid sequence <SEQ ID 2294>. Analysis of this protein sequence reveals the following:

```
Possible site: 57
>>> Seems to have no N-terminal signal sequence

----- Final Results -----
            bacterial cytoplasm --- Certainty = 0.2073 (Affirmative) < succ>
             bacterial membrane --- Certainty = 0.0000 (Not Clear)   < succ>
              bacterial outside --- Certainty = 0.0000 (Not Clear)   < succ>
```

An alignment of the GAS and GBS proteins is shown below:

```
Identities = 125/165 (75%), Positives = 145/165 (87%)

Query:   1 MNLPVKFFDKYVPELDKNNVRVQVIGDTHKLPKATYDAMQRACLRTKHNSGLVLNFALNY    60
             MNLPV FFDKYVP L +NNV++Q+IG+T +LP+ T  A+   A   +TK N+GL+LNFALNY
Sbjct:  85 MNLPVTFFDKYVPVLHENNVKIQMIGETSRLPEDTLAALNAAIDKTKRNTGLILNFALNY   144

Query:  61 GGRSEITNAIKEIAQDVLEAKLNPDDITEDLVANHLMTNSLPYLYRDPDLIIRTSGELRL   120
             GGR+EIT+A++  IAQDVL+AKLNP DITEDL+AN+LMT+ LPYLYRDPDLIIRTSGELRL
Sbjct: 145 GGRAEITSAVRFIAQDVLDAKLNPGDITEDLIANYLMTDHLPYLYRDPDLIIRTSGELRL   204

Query: 121 SNFLPWQSAYSEFYFTPVLWPDFKKDELHKAIVDYNQRHRRFGSV                 165
             SNFLPWQSAYSEFYFTPVLWPDFKK  EL KAI DYN+R RRFG V
Sbjct: 205 SNFLPWQSAYSEFYFTPVLWPDFKKAELLKAIADYNRRQRRFGKV                 249
```

Based on this analysis, it was predicted that these proteins and their epitopes could be useful antigens for vaccines or diagnostics.

EXAMPLE 748

A DNA sequence (GBSx0795) was identified in *S. agalactiae* <SEQ ID 2295> which encodes the amino acid sequence <SEQ ID 2296>. This protein is predicted to be phosphatidate cytidylyltransferase (cdsA). Analysis of this protein sequence reveals the following:

```
Possible site: 22
>>> Seems to have a cleavable N-term signal seq.
INTEGRAL Likelihood = -8.65 Transmembrane 201-217 (194-222)
INTEGRAL Likelihood = -7.96 Transmembrane 175-191 (170-197)
INTEGRAL Likelihood = -5.89 Transmembrane  81-97  (74-99)
INTEGRAL Likelihood = -3.03 Transmembrane  26-42  (23-42)
INTEGRAL Likelihood = -2.92 Transmembrane 136-152 (135-153)
INTEGRAL Likelihood = -2.02 Transmembrane  49-65  (47-66)
INTEGRAL Likelihood = -0.64 Transmembrane 248-264 (248-264)

----- Final Results -----
           bacterial membrane --- Certainty = 0.4461 (Affirmative) < succ>
            bacterial outside --- Certainty = 0.0000 (Not Clear)   < succ>
          bacterial cytoplasm --- Certainty = 0.0000 (Not Clear)   < succ>
```

The protein has homology with the following sequences in the GENPEPT database:

```
>GP: BAB06141 GB: AP001515 phosphatidate cytidylyltransferase
[Bacillus halodurans]
Identities = 116/266 (43%), Positives = 172/266 (64%), Gaps = 6/266 (2%)

Query:   1 MKERVIWGAVALAIFIPPFLVMGGLPFQFLVGLLAMIGVSELLRMRRLEIFSFEGALAMIG  60
           MK+RV+     +F+ F+V+GGLPF   + +A I +SELL+M+++  FS  GA +++
Sbjct:   1 MKQRVVTAIIFGLVFLTFVVVGGLPFTMFIIVVATIAMSELLKMKKIAPFSPMGAFSLLP  60

Query:  61 AFVLTVPLDSYLSFLPVDASLSAYGIVIFMILAGTVLNSNSYSFEDAAFPIASSFYVGIG 120
           ++L +P D +    +P   +    I  +L  TVL  N+++F++A F I SS Y+G G
Sbjct:  61 MWMLLLPNDWFKVVIPDFTKVEIFIFFILFLLLLTVLTKNTFTFDEAGFVILSSAYIGYG 120

Query: 121 FQNLVSARMA---GIDKVLLALFIVWATDIGAYMIGRQFGQRKLLPSVSPNKTIEGSLGG 177
              F  L+ +R    G+   V   LF++WATD GAY  GR FG+ KL P +SPNKTIEGS+GG
Sbjct: 121 FHFLLLSREIPEIGLPLVFFVLFVIWATDSGAYFAGRAFGKHKLWPHISPNKTIEGSIGG 180

Query: 178 IASAIVVAFFFMLFDKTVYAPHSFLVMLVLVAIFSIFGQFGDLVESSIKRHFGVKDSGKL 237
             I  A+++  F         S+ V L ++ + S+FGQ GDLVES++KRH+ VKDSG +
Sbjct: 181 IILAVIIGSLFYWIMPLF---SSYGVALAVIVVASVFGQLGDLVESALKRHYAVKDSGTV 237

Query: 238 IPGHGGILDRFDSMIFVFPIMHFFGL                                   263
           +PGHGGILDRFDS+I+V PI+H   L
Sbjct: 238 LPGHGGILDRFDSLIYVMPILHLLHL                                   263
```

A related DNA sequence was identified in *S. pyogenes* <SEQ ID 2297> which encodes the amino acid sequence <SEQ ID 2298>. Analysis of this protein sequence reveals the following:

```
    Possible site: 61
>>> Seems to have an uncleavable N-term signal seq
INTEGRAL Likelihood = -9.98 Transmembrane 175-191 (170-197)
INTEGRAL Likelihood = -8.97 Transmembrane   5-21  (4-42)
INTEGRAL Likelihood = -6.85 Transmembrane 201-217 (197-222)
INTEGRAL Likelihood = -6.53 Transmembrane  81-97  (79-99)
INTEGRAL Likelihood = -4.73 Transmembrane  49-65  (47-71)
INTEGRAL Likelihood = -3.40 Transmembrane 136-152 (135-153)
INTEGRAL Likelihood = -3.24 Transmembrane  26-42  (22-42)
INTEGRAL Likelihood = -1.17 Transmembrane 248-264 (248-264)

----- Final Results -----
           bacterial membrane --- Certainty = 0.4991 (Afffirmative) < succ>
            bacterial outside --- Certainty = 0.0000 (Not Clear)    < succ>
          bacterial cytoplasm --- Certainty = 0.0000 (Not Clear)    < succ>
```

The protein has homology with the following sequences in the databases:

```
>GP: BAB06141 GB: AP001515 phosphatidate cytidylyltransferase
[Bacillus halodurans]
Identities = 125/266 (46%), Positives = 177/266 (65%), Gaps = 6/266 (2%)

Query:    1 MKERVVWGGVAVAIFLPFLIIGNLPFQLFVGVLAMIGVSELLKMKRLEVFSFEGVFAMLA   60
            MK+RVV    + +FL F+++G LPF +F+ V+A I +SELLKMK++  FS  G F++L
Sbjct:    1 MKQRVVTAIIFGLVFLTFVVVGGLPFTMFIIVVATIAMSELLKMKKIAPFSPMGAFSLLP   60

Query:   61 AFVLAVPMDHYLTFLPIDANVAFYSLMVFFILAGTVLNSRAYSFDDAAFPIATSFYVGIG  120
            ++L +P D +    +P   V +    + F+L  TVL     ++FD+A F I +S Y+G G
Sbjct:   61 MWMLLLPNDWFKVVIPDFTKVEIFIFFILFLLLLTVLTKNTFTFDEAGFVILSSAYIGYG  120

Query:  121 FQHLINAR---LSGIDKVFLALFIVWATDIGAYLIGRQFGRRKLLPTVSPNKTIEGSLGG  177
            F  L+ +R     G+  VF  LF++WATD GAY  GR FG+ KL P +SPNKTIEGS+GG
Sbjct:  121 FHFLLLSREIPEIGLPLVFFVLFVIWATDSGAYFAGRAFGKHKLWPHISPNKTIEGSIGG  180

Query:  178 IACAVLVSFIFMVIDRSVYAPHHFLTMLVLVALFSIFAQFGDLVESALKRHFGVKDSGKL  237
             I  AV++  +F  I    +++ +     +++VA  S+F Q GDLVESALKRH+ VKDSG +
Sbjct:  181 IILAVIIGSLFYWI-MPLFSSYGVALAVIVVA--SVFGQLGDLVESALKRHYAVKDSGTV  237

Query:  238 IPGHGGILDRFDSMIFVFPIMHLFGL                                    263
            +PGHGGILDRFDS+I+V PI+HL L
Sbjct:  238 LPGHGGILDRFDSLIYVMPILHLLHL                                    263
```

An alignment of the GAS and GBS proteins is shown below:

```
Identities = 204/264 (77%), Positives = 243/264 (91%)

Query:    1 MKERVIWGAVALAIFIPFLVMGGLPFQFLVGLLAMIGVSELLRMRRLEIFSFEGALAMIG   60
            MKERV+WG VA+AIF+PFL++G LPFQ   VG+LAMIGVSELL+M+RLE+FSFEG  AM+
Sbjct:    1 MKERVVWGGVAVAIFLPFLIIGNLPFQLFVGVLAMIGVSELLKMKRLEVFSFEGVFAMLA   60

Query:   61 AFVLTVPLDSYLSFLPVDASLSAYGIVIFMILAGTVLNSNSYSFEDAAFPIASSFYVGIG  120
            AFVL VP+D YL+FLP+DA+++ Y +++F ILAGTVLNS +YSF+DAAFPIA SFYVGIG
Sbjct:   61 AFVLAVPMDHYLTFLPIDANVAFYSLMVFFILAGTVLNSRAYSFDDAAFPIATSFYVGIG  120

Query:  121 FQNLVSARMAGIDKVLLALFIVWATDIGAYMIGRQFGQRKLLPSVSPNKTIEGSLGGIAS  180
            FQ+L++AR++GIDKV LALFIVWATDIGAY+IGRQFG+RKLLP VSPNKTIEGSLGGIA
Sbjct:  121 FQHLINARLSGIDKVFLALFIVWATDIGAYLIGRQFGRRKLLPTVSPNKTIEGSLGGIAC  180

Query:  181 AIVVAFFFMLFDKTVYAPHSFLVMLVLVAIFSIFGQFGDLVESSIKRHFGVKDSGKLIPG  240
            A++V+F FM+ D++VYAPH FL MLVLVA+FSIF QFGDLVES++KRHFGVKDSGKLIPG
Sbjct:  181 AVLVSFIFMVIDRSVYAPHHFLTMLVLVALFSIFAQFGDLVESALKRHFGVRDSGKLIPG  240

Query:  241 HGGILDRFDSMIFVFPIMHFFGLF                                      264
            HGGILDRFDSMIFVFPIMH FGLF
Sbjct:  241 HGGILDRFDSMIFVFPIMHLFGLF                                      264
```

Based on this analysis, it was predicted that these proteins and their epitopes could be useful antigens for vaccines or diagnostics.

EXAMPLE 749

A DNA sequence (GBSx0796) was identified in *S. agalactiae* <SEQ ID 2299> which encodes the amino acid sequence <SEQ ID 2300>. Analysis of this protein sequence reveals the following:

```
Possible site: 46
>>> Seems to have an uncleavable N-term signal seq
INTEGRAL Likelihood = -11.09 Transmembrane    2-18  (1-25)
INTEGRAL Likelihood =  -9.39 Transmembrane 394-410 (390-415)
INTEGRAL Likelihood =  -8.01 Transmembrane 181-197 (173-198)
INTEGRAL Likelihood =  -2.97 Transmembrane 343-359 (342-360)

----- Final Results -----
          bacterial membrane --- Certainty = 0.5437 (Affirmative) < succ>
           bacterial outside --- Certainty = 0.0000 (Not Clear)   < succ>
          bacterial cytoplasm --- Certainty = 0.0000 (Not Clear)   < succ>
```

The protein has homology with the following sequences in the GENPEPT database:

```
>GP: AAD47948 GB: AF152237 Eep [Enterococcus faecalis]
Identities = 229/425 (53%), Positives = 298/425 (69%), Gaps = 9/425 (2%)

Query:     1 MLGILTFIIIFGVIVVVHEFGHFYFAKKSGILVREFAIGMGPKIFSHIDKEGTTYTIRIL   60
             M  I+TFII+FG++V+VHEFGHFYFAK++GILVREFAIGMGPKIF+H  K+GTTYTIR+L
Sbjct:     1 MKTIITFIIVFGILVLVHEFGHFYFAKRAGILVREFAIGMGPKIFAHRGKDGTTYTIRLL   60

Query:    61 PLGGYVRMAGWGDDKTEIKTGTPASLTLNKEGIVTRINLSGKQLDNTSLPINVTAYDLED  120
             P+GGYVRMAG G+D TEI  G P S+ LN  G V +IN S K     S+P+ V  +DLE
Sbjct:    61 PIGGYVRMAGMGEDMTEITPGMPLSVELNAVGNVVKINTSKKVQLPHSIPMEVVDFDLEK  120

Query:   121 KLTITGLV---LSETKTYSVDHDATIIEEDGTEIRIAPLDMQYQNASVWGRLITNFAGPM  177
             +L I G V      E   Y VDHDATIIE DGTE+RIAPLD+Q+Q+A +  R++TNFAGPM
Sbjct:   121 ELFIKGYVNGNEEEETVYKVDHDATIIESDGTEVRIAPLDVQFQSAKLSQRILTNFAGPM  180

Query:   178 NNFILGLVVFIALAFIQGGVQDLSTNQV-RVSENGPAASAGLKNNDRILQIGSHKVSNWE  236
             NNFILG ++F    F+QGGV DL+TNQ+ +V  NGPAA AGLK ND++L I +K+  +E
Sbjct:   181 NNFILGFILFTLAVFLQGGVTDLNTNQIGQVIPNGPAAEAGLKENDKVLSINNQKIKKYE  240

Query:   237 QLTAAVEKSTRHLEKKQKLALKIKSKEVVKTINVKPQKVDKSYI--IGIMPALKTSFKDK  294
                 T  V+K+    EK     ++    KE  T+  + QKV+K  I  +G+ P +KT   K
Sbjct:   241 DFTTIVQKNP---EKPLTFVVERNGKEEQLTVTPEKQKVEKQTIGKVGVYPYMKTDLPSK  297

Query:   295 LLGGLKLAWESFFRILNELKKLIAHFSINKLGGPVALYQASSQAAKNGFVTVLNLMGLIS  354
             L+GG++     S +I   L  L   FS+NKLGGPV +++ S +A+  G  TV+ LM ++S
Sbjct:   298 LMGGIQDTLNSTTQIFKALGSLFTGFSLNKLGGPVMMFKLSEEASNAGVSTVVFLMAMLS  357

Query:   355 INLGIMNLIPIPALDGGKIVMNILEAIRRKPLKQETETYITLAGVAVMLVLMIAVTWNDI  414
             +NLGI+NL+PIPALDGGKIV+NI+E +R KP+  E E   ITL G   ++VLM+ VTWNDI
Sbjct:   358 MNLGIINLLPIPALDGGKIVLNIIEGVRGKPISPEKEGIITLIGFGFVMVLMVLVTWNDI  417

Query:   415 MRAFF                                                       419
              R FF
Sbjct:   418 QRFFF                                                       422
```

A related DNA sequence was identified in *S. pyogenes* <SEQ ID 2301> which encodes the amino acid sequence <SEQ ID 2302>. Analysis of this protein sequence reveals the following:

```
Possible site: 26
>>> Seems to have an uncleavable N-term signal seq
INTEGRAL Likelihood = -11.41 Transmembrane    2-18  (1-25)
INTEGRAL Likelihood =  -9.77 Transmembrane  394-410 (390-415)
INTEGRAL Likelihood =  -9.61 Transmembrane  180-196 (173-201)
INTEGRAL Likelihood =  -2.66 Transmembrane  347-363 (343-363)

----- Final Results -----
           bacterial membrane  --- Certainty = 0.5564 (Affirmative) < succ>
           bacterial outside   --- Certainty = 0.0000 (Not Clear)   < succ>
           bacterial cytoplasm --- Certainty = 0.0000 (Not Clear)   < succ>
```

The protein has homology with the following sequences in the databases:

```
>GP: AAD47948 GB: AF152237 Eep [Enterococcus faecalis]
Identities = 230/427 (53%), Positives = 298/427 (68%), Gaps = 13/427 (3%)

Query:     1 MLGIITFIIIFGILVIVHEFGHFYFAKKSGILVREFAIGMGPKIFSHVDQGGTLYTLRML   60
             M  IITFII+FGILV+VHEFGHFYFAK++GILVREFAIGMGPKIF+H  + GT YT+R+L
Sbjct:     1 MKTIITFIIVFGILVLVHEFGHFYFAKRAGILVREFAIGMGPKIFAHRGKDGTTYTIRLL   60

Query:    61 PLGGYVRMAGWGDDKTEIKTGTPASLTLNEQGFVKRINLSQSKLDPTSLPMHVTGYDLED  120
             P+GGYVRMAG G+D TEI  G P S+ LN  G V +IN S+    P S+PM V  +DLE
Sbjct:    61 PIGGYVRMAGMGEDMTEITPGMPLSVELNAVGNVVKINTSKKVQLPHSIPMEVVDFDLEK  120

Query:   121 QLSITGLV---LEETKTYKVAHDATIVEEDGTEIRIAPLDVQYQNASIGGRLITNFAGPM  177
             +L I G V      EE YKV HDATI E DGTE+RIAPLDVQ+Q+A +  R++TNFAGPM
Sbjct:   121 ELFIKGYVNGNEEEETVYKVDHDATIIESDGTEVRIAPLDVQFQSAKLSQRILTNFAGPM  180

Query:   178 NNFILGIVVFILLVFLQGGMPDFSSNHV-RVQENGAAAKAGLRDNDQIVAINGYKVTSWN  236
             NNFILG ++F L VFLQGG+ D ++N + +V  NG AA+AGL++ND++   IN  K+  +
Sbjct:   181 NNFILGFILFTLAVFLQGGVTDLNTNQIGQVIPNGPAAEAGLKENDKVLSINNQKIKKYE  240
```

-continued

```
Query:  237 DLTEAVDLATRDLGPSQTIKVTYKSHQRLKTVAVKPQKH-AKTYTI---GVKASLKTGFK   292
            D  T  V        P + +     + + + + + V P+K    + TI    GV   +KT
Sbjct:  241 DFTTIV-----QKNPEKPLTFVVERNGKEEQLTVTFPEKQKVEKQTIGKVGVYPYMKTDLP   295

Query:  293 DKLLGGLELAWSRAFTILNALKGLITGFSLNKLGGPVAMYDMSNQAAQNGLESVLSLMAM    352
            KL+GG++   +   I  AL  L TGFSLNKLGGPV M+ +S +A+  G+ +V+ LMAM
Sbjct:  296 SKLMGGIQDTLNSTTQIFKALGSLFTGFSLNKLGGPVMMFKLSEEASNAGVSTVVFLMAM    355

Query:  353 LSINLGIFNLIPIPALDGGKILMNIIEAIRRKPIKQETEAYITLAGVAIMVVLMIAVTWN    412
            LS+NLGI NL+PIPALDGGKI++NIIE +R KPI    E E    ITL G    ++VLM+ VTWN
Sbjct:  356 LSMNLGIINLLPIPALDGGKIVLNIIEGVRGKPISPEKEGIITLIGFGFVMVLMVLVTWN    415

Query:  413 DIMRVFF                                                        419
            DI R FF
Sbjct:  416 DIQRFFF                                                        422
```

An alignment of the GAS and GBS proteins is shown below:

```
Identities = 306/419 (73%), Positives = 359/419 (85%)

Query:    1 MLGILTFIIIFGVIVVVHEFGHFYFAKKSGILVREFAIGMGPKIFSHIDKEGTTYTIRIL    60
            MLGI+TFIIIFG++V+VHEFGHFYFAKKSGILVREFAIGMGPKIFSH+D+ GT YT+R+L
Sbjct:    1 MLGIITFIIIFGILVIVHEFGHFYFAKKSGILVREFAIGMGPKIFSHVDQGGTLYTLRML    60

Query:   61 PLGGYVRMAGWGDDKTEIKTGTPASLTLNKEGIVTRINLSGKQLDNTSLPINVTAYDLED   120
            PLGGYVRMAGWGDDKTEIKTGTPASLTLN++G V RINLS  +LD TSLP++VT YDLED
Sbjct:   61 PLGGYVRMAGWGDDKTEIKTGTPASLTLNEQGFVKRINLSQSKLDPTSLPMHVTGYDLED   120

Query:  121 KLTITGLVLSETKTYSVDHDATIIEEDGTEIRIAPLDMQYQNASVWGRLITNFAGPMNNF   180
            +L+ITGLVL ETKTY V HDATI+EEDGTEIRIAPLD+QYQNAS+ GRLITNFAGPMNNF
Sbjct:  121 QLSITGLVLEETKTYKVAHDATIVEEDGTEIRIAPLDVQYQNASIGGRLITNFAGPMNNF   180

Query:  181 ILGLVVFIALAFIQGGVQDLSTNQVRVSENGPAASAGLKNNDRILQIGSHKVSNWEQLTA   240
            ILG+VVFI L F+QGG+ D S+N VRV ENG AA AGL++ND+I+ I   +KV++W  LT
Sbjct:  181 ILGIVVFILLVFLQGGMPDFSSNHVRVQENGAAAKAGLRDNDQIVAINGYKVTSWNDLTE   240

Query:  241 AVEKSTRHLEKKQKLALKIKSKEVVKTINVKPQKVDKSYIIGIMPALKTSFKDKLLGGLK   300
            AV+ TR L   Q + +  KS + +KT+ VKPQK  K+Y IG+   +LKT FKDKLLGGL+
Sbjct:  241 AVDLATRDLGPSQTIKVTYKSHQRLKTVAVKPQKHAKTYTIGVKASLKTGFKDKLLGGLE   300

Query:  301 LAWESFFRILNELKKLIAHFSINKLGGPVALYQASSQAAKNGFVTVLNLMGLISINLGIM   360
            LAW  F  ILN LK LI   FS+NKLGGPVA+Y  S+QAA+NG  +VL+LM  ++SINLGI
Sbjct:  301 LAWSRAFTILNALKGLITGFSLNKLGGPVAMYDMSNQAAQNGLESVLSLMAMLSINLGIF   360

Query:  361 NLIPIPALDGGKIVMNILEAIRRKPLKQETETYITLAGVAVMLVLMIAVTWNDIMRAFF    419
            NLIPIPALDGGKI+MNI+EAIRRKP+KQETE YITLAGVA+M+VLMIAVTWNDIMR FF
Sbjct:  361 NLIPIPALDGGKILMNIIEAIRRKPIKQETEAYITLAGVAIMVVLMIAVTWWDIMRVFF    419
```

Based on this analysis, it was predicted that these proteins and their epitopes could be useful antigens for vaccines or diagnostics.

EXAMPLE 750

A DNA sequence (GBSx0797) was identified in *S. agalactiae* <SEQ ID 2303> which encodes the amino acid sequence <SEQ ID 2304>. This protein is predicted to be prolyl-tRNA synthetase (proS). Analysis of this protein sequence reveals the following:

```
Possible site: 18
>>> Seems to have no N-terminal signal sequence
INTEGRAL Likelihood = -0.32 Transmembrane 473-489 (473-490)

----- Final Results -----
           bacterial membrane --- Certainty = 0.1128 (Affirmative) < succ>
            bacterial outside --- Certainty = 0.0000 (Not Clear) < succ>
          bacterial cytoplasm --- Certainty = 0.0000 (Not Clear) < succ>
```

A related GBS nucleic acid sequence <SEQ ID 10181> which encodes amino acid sequence <SEQ ID 10182> was also identified.

The protein has homology with the following sequences in the GENPEPT database:

```
>GP: CAB13530 GB: Z99112 prolyl-tRNA synthetase [Bacillus subtilis]
Identities = 301/608 (49%), Positives = 410/608 (66%), Gaps = 52/608 (8%)

Query:    1 MKQSKMLIPTLREMPSDAQVISHALMVRAGYVRQVSAGIYAYLPLANRTIEKFKTIMRQE    60
            M+QS  LIPTLRE+P+DA+  SH L++RAG++RQ ++G+Y+Y+PLA + I+  + I+R+E
Sbjct:    1 MRQSLTLIPTLREVPADAEAKSHQLLLRAGFIRQNTSGVYSYMPLAYKVIQNIQQIVREE    60

Query:   61 FEKIGAVEMLAPALLTADLWRESGRYETYGEDLYKLKNRDQSDFILGPTHEETFTTLVRD   120
            EKI AVEML PAL  A+ W+ESGR+ TYG +L +LK+R   +F LG THEE   T+LVRD
Sbjct:   61 MEKIDAVEMLMPALQQAETWQESGRWYTYGPELMRLKDRHGREFALGATHEEVITSLVRD   120

Query:  121 AVKSYKQLPLNLYQIQSKYRDEKRPRNGLLRTREFIMKDGYSFHKDYEDLDVTYEDYREA   180
            VKSYK+LPL LYQIQSK+RDEKRPR GLLR REFIMED YSFH   E LD TY+   +A
Sbjct:  121 EVKSYKRLPLTLYQIQSKFRDEKRPRFGLLRGREFIMKDAYSFHASAESLDETYQKMYEA   180

Query:  181 YEAIFTRAGLDFKGIIGDGGAMGGKDSQEFMAVTPNRTDLNRWLVLDKTIPSIDDIPEDV   240
            Y  IF R G++ + +I D GAMGGKD+ EFMA++
Sbjct:  181 YSNIFARCGINVRPVIADSGAMGGKDTHEFMALS--------------------------   214

Query:  241 LEEIKVELSAWLVSGEDTIAYSTESSYAANLEMATNEYKPSTKAATFEEVTKVETPNCKS   300
                        GEDTIAYS ES YAAN+EMA   ++       + + KV TPN K+
Sbjct:  215 ------------AIGEDTIAYSDESQYAANIEMAEVLHQEVPSDEEPKALEKVHTPHVKT   262

Query:  301 IDEVAGFLSIDENQTIKTLLFIADEQPVVALLVGNDQVNDVKLKNYLAADFLEPASEEQA   360
            I+E+  FL +    IK++LF AD++ V+ L+ G+ +VND+K+KN L A+ +E A+ E+
Sbjct:  263 IEELTAFLQVSAEACIKSVLFKADDRFVLVLVRGDHEVNDIKVKNLLHAEVVELATHEEV   322

Query:  361 KEIFGAGFGSLGPVNLPDSVKIIADRKVQDLANAVSGANQDGYHFTGVNPERDFTA-EYV   419
            + G  G +GPV +   V++ AD+ V+ + NAV+GAN+  +H+  VN RD    E+
Sbjct:  323 IQQLGTEPGFVGPVGIHQDVEVYADQAVKAMVNAVAGANEGDHHYKNVNVNRDAQIKEFA   382

Query:  420 DIREVKEGEISPDGKGTLKFARGIEIGHIFKLGTRYSDSMGANILDENGRSNPIVMGCYG   479
            D+R +KEG+ SPDGKGT++FA GIE+G +FKLGTRYS++M A   LDENGR+ P++MGCYG
Sbjct:  383 DLRFIKEGDPSPDGKGTIRFAEGIEVGQVFKLGTRYSEAMNATYLDENGRAQPMLMGCYG   442

Query:  480 IGVSRILSAVIEQHARLFVNKTPKGAYRFAWGINFPEELAPFDVHLITVNVKDQESQDLT   539
            IGVSR LSA+ EQH             G+ +P+ +AP+D+H++ +N+K+    ++L
Sbjct:  443 IGVSRTLSAIAEQH-------------HDEKGLIWPKSVAPYDLHILALNMKNDGQRELA   489

Query:  540 EKIEADLMLKGYEVLTDDRNERVGSKFSDSDLIGLPIRVTVGKKASEGIVEVKIKASGDT   599
            EK+ ADL  +GYEVL DDR ER G KF+DSDLIGLPIR+TVGK+A EGIVEVKI+ +G++
Sbjct:  490 EKLYADLKAEGYEVLYDDRAERAGVKFADSDLIGLPIRITVGKRADEGIVEVEIRQTGES   549

Query:  600 IEVHADNL                                                     607
            E+  D L
Sbjct:  550 TEISVDEL                                                     557
```

A related DNA sequence was identified in *S. pyogenes* <SEQ ID 2305> which encodes the amino acid sequence <SEQ ID 2306>. Analysis of this protein sequence reveals the following:

```
Possible site: 18
>>> Seems to have no N-terminal signal sequence
     INTEGRAL     Likelihood = 0.32    Transmembrane       473-489 (473-490)

----- Final Results -----
            bacterial membrane --- Certainty = 0.1128 (Affirmative) < succ>
                bacterial outside --- Certainty = 0.0000 (Not Clear) < succ>
             bacterial cytoplasm --- Certainty = 0.0000 (Not Clear) < succ>
```

An alignment of the GAS and GBS proteins is shown below:

```
Identities = 535/617 (86%), Positives = 584/617 (93%)

Query:    1 MKQSKMLIPTLREMPSDAQVISHALMVRAGYVRQVSAGIYAYLPLANRTIEKFKTIMRQE    60
            MKQSK+LIPTLREMPSDAQVISHALMVRAGYVRQVSAGIYAYLPLANRTIEKFKTIMR+E
Sbjct:    1 MKQSKLLIPTLREMPSDAQVISHALMVRAGYVRQVSAGIYAYLPLANRTIEKFKTIMREE    60
```

-continued

```
Query:   61 FEKIGAVEMLAPALLTADLWRESGRYETYGEDLYKLKNRDQSDFILGPTHEETFTTLVRD  120
            FEKIGAVEMLAPALLTADLWRESGRYETYGEDLYKLKNRD SDFILGPTHEETFTTLVRD
Sbjct:   61 FEKIGAVEMLAPALLTADLWRESGRYETYGEDLYKLKNRDNSDFILGPTHEETFTTLVRD  120

Query:  121 AVKSYKQLPLNLYQIQSKYRDEKRPRNGLLRTREFIMKDGYSFHKDYEDLDVTYEDYRKA  180
            AVKSYKQLPLNLYQIQSKYRDEKRPRNGLLRTREFIMKDGYSFH +YEDLDVTYEDYR+A
Sbjct:  121 AVKSYKQLPLNLYQIQSKYRDEKRPRNGLLRTREFIMKDGYSFHHNYEDLDVTYEDYRQA  180

Query:  181 YEAIFTRAGLDFKGIIGDGGAMGGKDSQEFMAVTPNRTDLNRWLVLDKTIPSIDDIPEDV  240
            YEAIFTRAGLDFKGIIGDGGAMGGKDSQEFMA+TP RTDL+RW+VLDK+I S+DDIP++V
Sbjct:  181 YEAIFTRAGLDFKGIIGDGGAMGGKDSQEFMAITPNRTDLNRWVVLDKSIASMDDIPKEV  240

Query:  241 LEEIKVELSAWLVSGEDTIAYSTESSYAANLEMATNEYKPSTKAATFEEVTKVETPNCKS  300
            LE+IK EL+AW++SGEDTIAYSTESSYAANLEMATNEYKPS+K A  +  + +VETP+CK+
Sbjct:  241 LEDIKAELAAWMISGEDTIAYSTESSYAANLEMATNEYKPSSKVAAEDALAEVETPHCKT  300

Query:  301 IDEVAGFLSIDENQTIKTLLFIADEQPVVALLVGNDQVNDVKLKNYLAADFLEPASEEQA  360
            IDEVA FLS+DE QTIKTLLF+AD +PVVALLVGND +N VKLENYLAADFLEPASEE+A
Sbjct:  301 IDEVAAFLSVDETQTIKTLLFVADNEPVVALLVGNDHINTVKLKNYLAADFLEPASEEEA  360

Query:  361 KEIFGAGFGSLGPVNLPDSVKIIADRKVQDLANAVSGANQDGYHFTGVNPERDFTAEYVD  420
            +  FGAGFGSLGPVNL   +I+ADRKVQ+L NAV+GAN+DG+H TGVNP RDF AEYVD
Sbjct:  361 RAFFGAGFGSLGPVNLAQGSRIVADRKVQNLTNAVAGANKDGFHMTGVNPGRDFQAEYVD  420

Query:  421 IREVKEGEISPDGKGTLKFARGIEIGHIFKLGTRYSDSMGANILDENGRSNPIVMGCYGI  480
            IREVKEGE+SPDG G L+FARGIE+GHIFKLGTRYSDSMGA ILDENGR+ PIVMGCYGI
Sbjct:  421 IREVEEGEMSPDGHGVLQFARGIEVGHIFKLGTRYSDSMGATILDENGRTVPIVMGCYGI  480

Query:  481 GVSRILSAVIEQHARLFVNKTPKGAYRFAWGINFPEELAPFDVHLITVNVKDQESQDLTE  540
            GVSRILSAVIEQHARLFVNKTPKG YR+AWGINFP+ELAPFDVHLITVNVKDQ +QDLT
Sbjct:  481 GVSRILSAVIEQHARLFVNKTPKGDYRYAWGINFPKELAPFDVHLITVNVKDQVAQDLTA  540

Query:  541 KIEADLMLKGYEVLTDDRNERVGSKFSDSDLIGLPIRVTVGKKASEGIVEVKIKASGDTI  600
            K+EADLM KGY+VLTDDRNERVGSKFSDSDLIGLPIRVTVGKKA+EGIVE+KIKA+GD+I
Sbjct:  541 KLEADLMAKGYDVLTDDRNERVGSKFSDSDLIGLPIRVTVGKKAAEGIVEIKIKATGDSI  600

Query:  601 EVHADNLIETLEILTKK                                             617
            EV+A+NLIETLEILTK+
Sbjct:  601 EVNAENLIETLEILTKE                                             617
```

Based on this analysis, it was predicted that these proteins and their epitopes could be useful antigens for vaccines or diagnostics.

EXAMPLE 751

A DNA sequence (GBSx0798) was identified in *S. agalactiae* <SEQ ID 2307> which encodes the amino acid sequence <SEQ ID 2308>. This protein is predicted to be peptidoglycan hydrolase (flgJ). Analysis of this protein sequence reveals the following:

```
Possible site: 21
>>> Seems to have an uncleavable N-term signal seq
     INTEGRAL     Likelihood = -1.86    Transmembrane      9-25 (9-25)

----- Final Results -----
              bacterial membrane --- Certainty = 0.1744 (Affirmative) < succ>
              bacterial outside  --- Certainty = 0.0000 (Not Clear)   < succ>
              bacterial cytoplasm --- Certainty = 0.0000 (Not Clear)  < succ>
```

The protein has homology with the following sequences in the GENPEPT database:

```
>GP: CAB94815 GB: AJ245582 peptidoglycan hydrolase [Streptococcus
thermophilus]
Identities = 101/201 (50%), Positives = 122/201 (60%), Gaps = 9/201 (4%)

Query:    2 KSRKKDKLVLRLTT-----TLLVFGL----GGVWFYNYKNDNVEPTVTSASDQTTTFIQT   52
            KS+KK K VL      +L+  GL    G +    N+     +E  +T    +T  FI
Sbjct:   16 KSKKKKKSVLLFPKFFQKWSLIFIGLFSLLGLLASLNFPRLTMEKNMTPTDETTVAFIAE   75

Query:   53 ISPTAIEISKTYDLYASVLLAQAILESSSGQSDLSKAPNYNLFGIKGEYKGKSVQMPTLE  112
            I   T+  ++    DLYASV++AQAILES SGQS LS+ P YN FGIKGEY G+SV +PT E
Sbjct:   76 IGETSRYLAARNDLYASVMIAQAILESDSGQSQLSQKPLYNFFGIKGEYNGQSVTLPTWE  135
```

-continued

```
Query: 113 DDGKGNMTQIQAPFRAYPNYSASLYDYAELVSSQKYASVWKSNTSSYKDATAALTGLYAT 172
            DDGKGN    I A FR+Y +    SL DY E +    Y  V +S T SYKDATAALTG+YAT
Sbjct: 136 DDGKGNPYHIDAAFRSYGSVENSLQDYVEFLEGSYYVGVHRSKTRSYKDATAALTGVYAT 195

Query: 173 DTAYASKLNQIIETYSLDAYD                                        193
            DT Y   KLN IIE Y L  YD
Sbjct: 196 DTTYGDKLNSIIEQYQLTIYD                                        216
```

A related DNA sequence was identified in *S. pyogenes* <SEQ ID 2309> which encodes the amino acid sequence <SEQ ID 2310>. Analysis of this protein sequence reveals the following:

```
    Possible site: 24
>>> Seems to have a cleavable N-term signal seq.

----- Final Results -----
             bacterial outside  --- Certainty = 0.3000 (Affirmative) < succ>
             bacterial membrane --- Certainty = 0.0000 (Not Clear)   < succ>
             bacterial cytoplasm --- Certainty = 0.0000 (Not Clear)  < succ>
```

The protein has homology with the following sequences in the databases:

```
>GP: CAB94815 GB: AJ245582 peptidoglycan hydrolase [Streptococcus
thermophilus]
Identities = 103/189 (54%), Positives = 126/189 (66%), Gaps = 4/189 (2%)

Query:   4 KKGKLVLISLFVLAACLGAYSAMRQSHKTSNVSAETIASSSTRHFIDEIGPTASTIGQER   63
           +K  L+ I LF L    L + + R+ + +     T   +T FI EIG T+  +
Sbjct:  32 QKWSLIFIGLFSLLGLLASLNFPRLTMEKNM----TPTDETTVAFIAEIGETSRYLAARN   87

Query:  64 DLYASVMIAQAILESSNGKSSLSQAPYYNFFGIKGAYNGSSVTMSTWEDDGNGNTYTIDQ  123
           DLYASVMIAQAILES +G+S LSQ P YNFFGIKG YNG SVT+ TWEDDG GN Y ID
Sbjct:  88 DLYASVMIAQAILESDSGQSQLSQKPLYNFFGIKGEYNGQSVTLPTWEDDGKGNPYHIDA  147

Query: 124 AFRAYPSIADSLNDYADLLSSSTYIGARKSNTLSYQDATAALTGLYATDTSYNLKLNNII  183
               AFR+Y S+ +SL DY + L  S Y+G  +S T SY+DATAALTG+YATDT+Y   KLN+II
Sbjct: 148 AFRSYGSVENSLQDYVEFLEGSYYVGVHRSKTRSYKDATAALTGVYATDTTYGDKLNSII  207

Query: 184 ATYGLTAYD                                                    192
             Y LT YD
Sbjct: 208 EQYQLTIYD                                                    216
```

45
An alignment of the GAS and GBS proteins is shown below:

```
Identities = 108/192 (56%), Positives = 124/192 (64%), Gaps = 2/192 (1%)

Query:   3 SRKKDKLVL-RLTTTLLVFGLGGVWFYNYKNDNVEPTVTSASDQTTTFIQTISPTAIEIS   61
           ++KK KLVL   L       G       ++K NV   T AS T  FI  I PTA I
Sbjct:   2 TKKKGKLVLISLFVLAACLGAYSAMRQSHKTSNVSAE-TIASSSTRHFIDEIGPTASTIG   60

Query:  62 KTYDLYASVLLAQAILESSSGQSDLSKAPNYNLFGIKGEYKGKSVQMPTLEDDGKGNMTQ  121
            +   DLYASV++AQAILESS+G+S LS+AP YN FGIKG Y G SV M T EDDG GN
Sbjct:  61 QERDLYASVMIAQAILESSNGKSSLSQAPYYNFFGIKGAYNGSSVTMSTWEDDGNGNTYT  120

Query: 122 IQAPFRAYPNYSASLYDYAELVSSQKYASVWKSNTSSYKDATAALTGLYATDTAYASKLN  181
            I    FRAYP+ + SL DYA+L+SS Y    KSNT SY+DATAALTGLYATDT+Y  KLN
Sbjct: 121 IDQAFRAYPSIADSLNDYADLLSSSTYIGARKSNTLSYQDATAALTGLYATDTSYNLKLN  180

Query: 182 QIIETYSLDAYD                                                 193
             II  TY L  AYD
Sbjct: 181 NIIATYGLTAYD                                                 192
```

A further related DNA sequence was identified in *S. pyogenes* <SEQ ID 9073> which encodes the amino acid sequence <SEQ ID 9074>. Analysis of this protein sequence reveals the following:

```
      Possible site: 58
>>> Seems to have a cleavable N-term signal seq.

----- Final Results -----
              bacterial outside --- Certainty = 0.3000 (Affirmative) < succ>
              bacterial membrane --- Certainty = 0.0000 (Not Clear)  < succ>
              bacterial cytoplasm --- Certainty=0.0000 (Not Clear)   < succ>
```

An alignment of the GAS and GBS sequences follows:

```
Score = 130 bits (323), Expect = 2e-32
Identities = 68/169 (40%), Positives = 96/169 (56%), Gaps = 3/169 (1%)

Query:   30 MWTLKLGNQRLAPY---ADHETLTFVRKISHAAQSVAQKKQLYSSVMMAQAILESNNGKS    86
            +W      N  + P    A  +T TF++ IS  A   +++   LY+SV++AQAILES++G+S
Sbjct:   25 VWFYNYKNDNVEPTVTSASDQTTTFIQTISPTAIEISKTYDLYASVLLAQAILESSSGQS    84

Query:   87 QLSQKPYYNFFGIKGSYKERSVIFPTLEDDGQGNLYQIDAAFRSYGSLTACFLDYARVLN   146
            LS+ P YN FGIKG YK +SV  PTLEDDG+GN+ QI A FR+Y + +A    DYA +++
Sbjct:   85 DLSKAPNYNLFGIKGEYKGKSVQMPTLEDDGKGNMTQIQAPFRAYPNYSASLYDYAELVS   144

Query:  147 DPLYDKTHKKFWSHYQXXXXXXXXXXXXXXXXXXXXKLNELIEWYQLTNFD            195
             Y    K   S Y+                        KLN++IE Y L  +D
Sbjct:  145 SQKYASVWKSNTSSYKDATAALTGLYATDTAYASKLNQIIETYSLDAYD              193
```

A further related DNA sequence was identified in *S. pyogenes* <SEQ ID 9075> which encodes the amino acid sequence <SEQ ID 9076>. An alignment of the GAS and GBS sequences follows:

```
Score = 69.1 bits (166), Expect = 1e-13
Identities = 52/151 (34%), Positives = 79/151 (51%), Gaps = 10/151 (6%)

Query:    2 TFLDKIKQGCLDGWAKYKILPSLTAAQAILESGWGKH----APHNALFGIKADSSWTGKS    57
            TF+  I   ++   Y +  S+  AQAILES G+     AP+  LFGIK +  + GKS
Sbjct:   48 TFIQTISPTAIEISKTYDLYASVLLAQAILESSSGQSDLSKAPNYNLFGIKGE--YKGKS   105

Query:   58 FDTKTQEEYQAGVVTDIVDRFRAYDSWDESIADHGQFLVDNPRYEAV--IGETDYKKACY   115
              T E+    G +T I    FRAY ++   S+ D+ +LV  +Y +V       + YK A
Sbjct:  106 VQMPTLEDDGKGNMTQIQAPFRAYPNYSASLYDYAE-LVSSQKYASVWKSNTSSYKDATA   164

Query:  116 AIKAAGYATASSYVELLIQLIEENDLQSWDR                              146
            A+     YAT ++Y  L Q+IE   L  ++D+
Sbjct:  165 ALTGL-YATDTAYASKLNQIIETYSLDAYDK                              194
```

Figure 58:
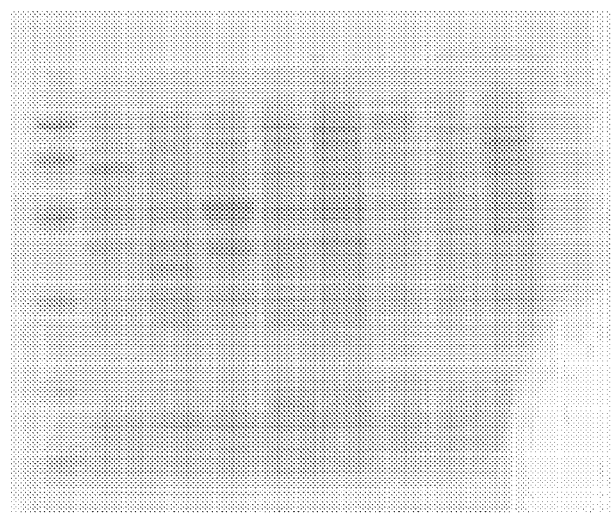

SEQ ID 2308 (GBS275) was expressed in *E. coli* as a His-fusion product. SDS-PAGE analysis of total cell extract is shown in FIG. 52 (lane 4; MW 22.6 kDa). It was also expressed in *E. coli* as a GST-fusion product. SDS-PAGE analysis of total cell extract is shown in FIG. 58 (lane 4; MW 47.5 kDa).

Figure 276:
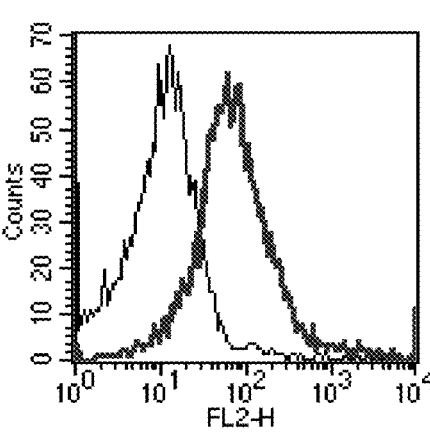

The GBS275-GST fusion product was purified (FIG. 208, lane 5) and used to immunise mice. The resulting antiserum was used for FACS (FIG. 276), which confirmed that the protein is immunoaccessible on GBS bacteria.

Based on this analysis, it was predicted that these proteins and their epitopes could be useful antigens for vaccines or diagnostics.

EXAMPLE 752

A DNA sequence (GBSx0799) was identified in *S. agalactiae* <SEQ ID 2311> which encodes the amino acid sequence <SEQ ID 2312>. Analysis of this protein sequence reveals the following:

```
       Possible site: 27
>>> Seems to have no N-terminal signal sequence
       INTEGRAL    Likelihood = -0.16    Transmembrane    876-892 (876-892)

----- Final Results -----
              bacterial membrane --- Certainty = 0.1065 (Affirmative) < succ>
              bacterial outside  --- Certainty = 0.0000 (Not Clear)   < succ>
              bacterial cytoplasm --- Certainty = 0.0000 (Not Clear)  < succ>
```

A related DNA sequence was identified in *S. pyogenes* <SEQ ID 2313> which encodes the amino acid sequence <SEQ ID 2314>. Analysis of this protein sequence reveals the following:

```
Possible site: 48
>>> Seems to have no N-terminal signal sequence
     INTEGRAL      Likelihood = -0.16    Transmembrane        873-889 (873-889)

----- Final Results -----
               bacterial membrane --- Certainty = 0.1065 (Affirmative) < succ>
                bacterial outside --- Certainty = 0.0000 (Not Clear)   < succ>
              bacterial cytoplasm --- Certainty = 0.0000 (Not Clear)   < succ>
```

The protein has homology with the following sequences in the databases:

```
>GP: CAB94815 GB: AJ245582 peptidoglycan hydrolase [Streptococcus
thermophilus]
Identities = 96/202 (47%), Positives = 127/202 (62%), Gaps = 10/202 (4%)

Query:   4 KKRRRRAKSSV---------NRLVLGLV-LLNLIVSMWTLKLGNQRLAPYADHETLTFVR    53
           KK +++ KS +          + + +GL  LL L+ S+     +L ++      D   T+ F+
Sbjct:  15 KKSKKKKKSVLLFPKFFQKWSLIFIGLFSLLGLLASLNFPRLTMEKNMTPTDETTVAFIA    74

Query:  54 KISHAAQSVAQKKQLYSSVMMAQAILESNNGKSQLSQKPYYNFFGIKGSYKERSVIFPTL   113
           +I    ++ +A +  LY+SVM+AQAILES++G+SQLSQKP YNFFGIKG Y   +SV  PT
Sbjct:  75 EIGETSRYLAARNDLYASVMIAQAILESDSGQSQLSQKPLYNFFGIKGEYNGQSVTLPTW   134

Query: 114 EDDGQGNLYQIDAAFRSYGSLTACFLDYARVLNDPLYDKTHKKFWSHYQDATATLTGTYA   173
           EDDG+GN Y  IDAAFRSYGS+         DY  L    Y  H+        Y+DATA  LTG YA
Sbjct: 135 EDDGKGNPYHIDAAFRSYGSVENSLQDYVEFLEGSYYVGVHRSKTRSYKDATAALTGVYA   194

Query: 174 TDTTYHTKLNELIEWYQLTNFD                                        195
           TDTTY   KLN +IE YQLT +D
Sbjct: 195 TDTTYGDKLNSIIEQYQLTIYD                                        216
```

An alignment of the GAS and GBS proteins is shown below:

```
Identities = 1244/1468 (84%), Positives = 1351/1468 (91%), Gaps = 3/1468 (0%)

Query:   1 MSELFKKLMDQIEMPLEIKNSSVFSSADIIEVKVHSLSRLWEFHFSFPELLPIEVYRELQ    60
           MS+LF  KLMDQIEMPL+++ SS FSSADIIEVKVHS+SRLWEFHF+F  +LPI   YREL
Sbjct:   1 MSDLFAKLMDQIEMPLDMRRSSAFSSADIIEVKVHSVSRLWEFHFAFAAVLPIATYRELH    60

Query:  61 TRLVNSFEKADIKATFDIRAETIDFSDDLLQDYYQQAFCEPLCNSASFKSSFSQLKVHYN   120
           RL+ +FE ADIK TFDI+A  +D+SDDLLQ YYQ+AF      CNSASFKSSFS+LKV Y
Sbjct:  61 DRLIRTFEAADIKVTFDIQAAQVDYSDDLLQAYYQEAFEHAPCNSASFKSSFSKLKVTYE   120

Query: 121 GSQMIISAPQFVNNNHFRQNHLPRLEQQFSLFGFGKLAIDMVSDEQMTQDLKSSFETNRE   180
                ++II+AP FVNN+HFR NHLP L +Q    FGFG L  IDMVSD++MT+  L   +F ++R+
Sbjct: 121 DDKLIIAAPGFVNNDHFRNNHLPNLVKQLEAFGFGILTIDMVSDQEMTEHLTKNFVSSRQ   180

Query: 181 QLLEKANQEAMQALEAQKSLEDSAPPSEEVTPTQNYDFKERIKQRQAGFEKAEITPMIEV   240
             L++KA Q+      LEAQKSLE   PP EE TP    +D+KER +RQAGFEKA ITPMIE+
Sbjct: 181 ALVKKAVQDN---LEAQKSLEAMMPPVEEATPAPKFDYKERAAKRQAGFEKATITPMIEI   237

Query: 241 TTEENRIVFEGMVFSVERKTTRTGRHIINFKMTDYTSSFAMQKWAKDDEELKKYDMISKG   300
            TEENRIVFEGMVF VERKTTRTGRHIINFKMTDYTSSFA+QKWAKDDEEL+K+DMI+KG
Sbjct: 238 ETEENRIVFEGMVFDVERKTTRTGRHIINFKMTDYTSSFALQKWAKDDEELRKFDMIAKG   297

Query: 301 SWLRVRGNIENNNFTKSLTMNVQDIKEIVHHERKDLMPADQKRVEFHAHTNMSTMDALPT   360
           +WLRV+GNIE N FTKSLTMNVQ  +KEIV HERKDLMP  QKRVE HAHTNMSTMDALPT
Sbjct: 298 AWLRVQGNIETNPFTKSLTMNVQQVKEIVRHERKDLMPEGQKRVELHAHTNMSTMDALPT   357

Query: 361 VESLIDTAAKWGHPAIAITDHANVQSFPHGYHRAKKAGIKAIFGLEANIVEDKVPISYNE   420
           VESLIDTAAKWGH  AIAITDHANVQSFPHGYHRA+KAGIKAIFGLEANIVEDKVPISY
Sbjct: 358 VESLIDTAAKWGHKAIAITDHANVQSFPHGYHRARKAGIKAIFGLEANIVEDKVPISYEP   417

Query: 421 VDMNLHEATYVVFDVETTGLSAANNDLIQIAASKMFKGNIIEQFDEFIDPGHPLSAFTTE   480
           VDM+LHEATYVVFDVETTGLSA NNDLIQIAASKMFKGNI+EQFDEFIDPGHPLSAFTTE
Sbjct: 418 VDMDLHEATYVVFDVETTGLSAMNNDLIQIAASKMFKGNIVEQFDEFIDPGHPLSAFTTE   477
```

```
Query:  481 LTGITDNHVRGSKPILQVLQEFQNFCQGTVLVAHNATFDVGFMNANYERHNLPLITQPVI  540
             LTGITD H++G+KP++ VL+ FQ+FC+ ++LVAHNA+FDVGFMNANYERH+LP ITQPVI
Sbjct:  478 LTGITDKHLQGAKPLVTVLKAFQDFCKDSILVAHNASFDVGFMNANYERHDLPKITQPVI  537

Query:  541 DTLEFARNLYPEYKRHGLGPLTKRFQVALEHHHMANYDAEATGRLLFIFLKEARENRDVT  600
             DTLEFARNLYPEYKRHGLGPLTKRFQV+L+HHHMANYDAEATGRLLFIFLK+ARE   +
Sbjct:  538 DTLEFARNLYPEYKRHGLGPLTKRFQVSLDHHHMANYDAEATGRLLFIFLKDAREKHGIK  597

Query:  601 NLMELNTKLVAEDSYKKARIKHATIYVQNQVGLKNIFKLVSLSNVKYFEGVARIPRSVLD  660
             NL++LNT LVAEDSYKKARIKHATIYVQNQVGLKN+FKLVSLSN+KYFEGV RIPR+VLD
Sbjct:  598 NLLQLNTDLVAEDSYKKARIKHATIYVQNQVGLKNMFKLVSLSNIKYFEGVPRIPRTVLD  657

Query:  661 AHREGLLLGTACSDGEVFDALLSNGIDAAVTLAKYYDFIEVMPPAIYRPLVVRDLIKDEV  720
             AHREGLLLGTACSDGEVFDA+L+ GIDAAV LA+YYDFIE+MPPAIY+PLVVR+LIKD+
Sbjct:  658 AHREGLLLGTACSDGEVFDAVLTKGIDAAVDLARYYDFIEIMPPAIYQPLVVRELIKDQA  717

Query:  721 GIQQIIRDLIEVGRRLDKPVLATGNVHYIEPEDEIYREIIVRSLGQGAMINRTIGRGEDA  780
             GI+Q+IRDLIEVG+R  KPVLATGNVHY+EPE+EIYREIIVRSLGQGAMINRTIGRGE A
Sbjct:  718 GIEQVIRDLIEVGKRAKKPVLATGNVHYLEPEEEIYREIIVRSLGQGAMINRTIGRGEGA  777

Query:  781 QPAPLPKAHFRTTNEMLDEFAFLGKDLAYEIVVTNTNTFADRFEDVEVVKGDLYTPFVDR  840
             QPAPLPKAHFRTTNEMLDEFAFLGKDLAY++VV NT  FADR E+VEVVKGDLYTP++D+
Sbjct:  778 QPAPLPKAHFRTTNEMLDEFAFLGKDLAYQVVVQNTQDFADRIEEVEVVKGDLYTPYIDK  837

Query:  841 AEERVAELTYAKAFEIYGNPLPDIIDLRIEKELASILGNGFAVIYLASQMLVQRSNERGY  900
             AEE VAELTY KAFEIYGNPLPDIIDLRIEKEL SILGNGFAVIYLASQMLV RSNERGY
Sbjct:  838 AEETVAELTYQKAFEIYGNPLPDIIDLRIEKELTSILGNGFAVIYLASQMLVNRSNERGY  897

Query:  901 LVGSRGSVGSSFVATMIGITEVNPMPPHYVCPNCQHSEFITDGSCGSGYDLPNKNCPKCG  960
             LVGSRGSVGSSFVATMIGITEVNPMPPHYVCP+CQHSEFITDGS GSGYDLPNK CPKCG
Sbjct:  898 LVGSRGSVGSSFVATMIGITEVNPMPPHYVCPSCQHSEFITDGSVGSGYDLPNKPCPKCG  957

Query:  961 TLYKKDGQDIPFETFLGFDGDKVPDIDLNFSGDDQPSAHLDVRDIFGEEYAFRAGTVGTV  1020
             T Y+KDGQDIPFETFLGFDGDKVPDIDLNFSGDDQPSAHLDVRDIFG+EYAFRAGTVGTV
Sbjct:  958 TPYQKDGQDIPFETFLGFDGDKVPDIDLNFSGDDQPSAHLDVRDIFGDEYAFRAGTVGTV  1017

Query: 1021 AEKTAFGFVKGYERDYNKFYNDAEVERLATGAAGVKRSTGQHPGGIVVIPNYMDVYDFTP  1080
             AEKTA+GFVKGYERDY KFY DAEV+RLA GAAGVKR+TGQHPGGIVVIPNYMDVYDFTP
Sbjct: 1018 AEKTAYGFVKGYERDYGKFYRDAEVDRLAAGAAGVKRTTGQHPGGIVVIPNYMDVYDFTP  1077

Query: 1081 VQYPADDMTAAWQTTHFNFHDIDENVLKLDILGHDDPTMIRKLQDLSGIDPSNILPDDPD  1140
             VQYPADD+TA+WQTTHFNFHDIDENVLKLDILGHDDPTMIRKLQDLSGID   I DDP
Sbjct: 1078 VQYPADDVTASWQTTHFNFHDIDENVLKLDILGHDDPTMIRKLQDLSGIDPITIPADDPG  1137

Query: 1141 VMKLFSGTEVLGVTEEQIGTPTGMLGIPEFGTNFVRGMVNETHPTTFAELLQLSGLSHGT  1200
             VM LFSGTEVLGVT EQIGTPTGMLGIPEFGTNFVRGMVNETHPTTFAELLQLSGLSHGT
Sbjct: 1138 VMALFSGTEVLGVTPEQIGTPTGMLGIPEFGTNFVRGMVNETHPTTFAELLQLSGLSHGT  1197

Query: 1201 DVWLGNAQDLIKEGIATLSTVIGCRDDIMVYLMHAGLQPKMAFTIMERVRKGLWLKISED  1260
             DVWLGNAQDLIKEGIATL TVIGCRDDIMVYLMHAGL+PKMAFTIMERVRKGLWLKISE+
Sbjct: 1198 DVWLGNAQDLIKEGIATLKTVIGCRDDIMVYLMHAGLEPKMAFTIMERVRKGLWLKISEE  1257

Query: 1261 ERNGYIQAMRDNNVPDWYIESCGKIKYMFPKAHAAAYVLMALRVAYFKVHYPIFYYCAYF  1320
             ERNGYI AMR+NNVPDWYIESCGKIKYMFPKAHAAAYVLMALRVAYFKVH+PI YYCAYF
Sbjct: 1258 ERNGYIDAMRENNVPDWYIESCGKIKYMFPKAHAAAYVLMALRVAYFKVHHPIMYYCAYF  1317

Query: 1321 SIRAKAFELRTMSAGLDAVKARMKDITEKRQRNEATNVENDLFTTLELVNEMLERGFKFG  1380
             SIRAKAFEL+TMS GLDAVKARM+DIT KR+ NEATNVENDLFTTLE+VNEMLERGFKFG
Sbjct: 1318 SIRAKAFELKTMSGGLDAVKARMEDITIKRKNNEATNVENDLFTTLEIVNEMLERGFKFG  1377

Query: 1381 KLDLYRSHATDFIIEEDTLIPPFVAMEGLGENVAKQIVRAREDGEFLSKTELRKRGGVSS  1440
             KLDLY+S A +F I+ DTLIPPF+A+EGLGENVAKQIV AR++GEFLSK ELRKRGG SS
Sbjct: 1378 KLDLYKSDAIEFQIKGDTLIPPFIALEGLGENVAKQIVKARQEGEFLSKMELRKRGGASS  1437

Query: 1441 TLVEKFDEMGILGNLPEDNQLSLFDDFF                                 1468
             TLVEK DEMGILGN+PEDNQLSLFDDFF
Sbjct: 1438 TLVEKMDEMGILGNMPEDNQLSLFDDFF                                 1465
```

Based on this analysis, it was predicted that these proteins and their epitopes could be useful antigens for vaccines or diagnostics.

EXAMPLE 753

A DNA sequence (GBSx0800) was identified in *S. agalactiae* <SEQ ID 2315> which encodes the amino acid sequence <SEQ ID 2316>. Analysis of this protein sequence reveals the following:

```
Possible site: 24
>>> Seems to have no N-terminal signal sequence

----- Final Results -----
            bacterial cytoplasm --- Certainty = 0.1505 (Affirmative) < succ>
             bacterial membrane --- Certainty = 0.0000 (Not Clear)   < succ>
              bacterial outside --- Certainty = 0.0000 (Not Clear)   < succ>
```

A related GBS nucleic acid sequence <SEQ ID 10179> which encodes amino acid sequence <SEQ ID 10180> was also identified.

The protein has homology with the following sequences in the GENPEPT database:

```
>GP: CAB13207 GB: Z99111 similar to transcriptional regulator (MarR
family) [Bacillus subtilis]
Identities = 49/124 (39%), Positives = 73/124 (58%)

Query:  18 VMRKAFRTIDGKVSESFKEFELTPTQFAVLDVLYAKGTMKIGELIENMLATSGNMTVVIK   77
            V  +AF+++      KE    PT+FAVL++LY +G  K+ ++    +L  SGN+T VI
Sbjct:  20 VFARAFKSVSEHSIRDSKEHGFNPTEFAVLELLYTRGPQKLQQIGSRLLLVSGNVTYVID   79

Query:  78 NMEKKGWVLRHSCPNDKRAFLVSLTTEGEEVIKKALPEHIKRVEDAFSVLTETEQEDLIN  137
            +E+ G+++R    P DKR+    LT +G E + K  P H  R+  AFS L+  EQ+ LI
Sbjct:  80 KLERNGFLVREQDPKDKRSVYAHLTDKGNEYLDKIYPIHALRIARAFSGLSPDEQDQLIV  139

Query: 138 LLKK                                                         141
           LLKK
Sbjct: 140 LLKK                                                         143
```

A related DNA sequence was identified in *S. pyogenes* <SEQ ID 2317> which encodes the amino acid sequence <SEQ ID 2318>. Analysis of this protein sequence reveals the following:

```
Possible site: 37
>>> Seems to have no N-terminal signal sequence

----- Final Results -----
            bacterial cytoplasm --- Certainty = 0.0537 (Affirmative) < succ>
             bacterial membrane --- Certainty = 0.0000 (Not Clear)   < succ>
              bacterial outside --- Certainty = 0.0000 (Not Clear)   < succ>
```

An alignment of the GAS and GBS proteins is shown below:

```
Identities = 80/145 (55%), Positives = 111/145 (76%), Gaps = 1/145 (0%)

Query:   2 GDEMGNF-KNSAVKSMVVMRKAFRTIDGKVSESFKEFELTPTQFAVLDVLYAKGTMKIGE   60
           G++M +   KN+A+K+MVV RKA RT+D   ++ FK+ +LT TQF+VL+VLY KG M+I
Sbjct:   8 GNQMSHLDKNTALKAMVVFRKAQRTLDAFGADIFKKADLTATQFSVLEVLYTKGCMRINH   67

Query:  61 LIENMLATSGNMTVVIKNMEKKGWVLRHSCPNDKRAFLVSLTTEGEEVIKKALPEHIKRV  120
           LI+++LATSGNMTVV+ NME+ GW+ +     DKRA++V+LT +G  +I+   LP+H+ RV
Sbjct:  68 LIDSLLATSGNMTVVLNNMERNGWISKCKDKTDKRAYVVTLTDKGTRLIEAVLPKHVARV  127

Query: 121 EDAFSVLTETEQEDLINLLKKFKTL                                    145
           E+AF+VLTE EQ  LI LLKKFK L
Sbjct: 128 EEAFAVLTEKEQLCLIELLKKFKQL                                    152
```

Based on this analysis, it was predicted that these proteins and their epitopes could be useful antigens for vaccines or diagnostics.

EXAMPLE 754

A DNA sequence (GBSx0801) was identified in *S. agalactiae* <SEQ ID 2319> which encodes the amino acid sequence <SEQ ID 2320>. Analysis of this protein sequence reveals the following:

```
Possible site: 46
>>> Seems to have no N-terminal signal sequence

----- Final Results -----
            bacterial cytoplasm --- Certainty = 0.3741 (Affirmative) < succ>
            bacterial membrane  --- Certainty = 0.0000 (Not Clear)   < succ>
             bacterial outside  --- Certainty = 0.0000 (Not Clear)   < succ>
```

The protein has homology with the following sequences in the GENPEPT database.

```
>GP: AAG05963 GB: AE004686 hypothetical protein [Pseudomonas aeruginosa]
Identities = 115/203 (56%), Positives = 143/203 (69%), Gaps = 7/203 (3%)

Query:    2 SFLEELKNRRSIYALGRNTEVSDEKIVEIIKEAVRQSPSAFNSQTSRVVILLNDEVTKFW   61
            +FL +KNRR+IYAL +   VS EKIVE++KEAV  SPSAFNSQ+SRVV+L   E  +FW
Sbjct:    4 AFLSSIKNRRTIYALDKQLPVSQEKIVELVKEAVSHSPSAFNSQSSRVVVLFGAEHEQFW   63

Query:   62 DELVANDLVETMKVQGAPETAIAGTKEKLASFGASKGTVLFFEDQDVVKSLQEQFVLYAD  121
            +  +A D  E  K+    P  A  A T+ KL SF A  GTVLFFEDQ VV+ LQEQF LYAD
Sbjct:   64 N--IAKD--ELKKI--VPADAFAATETKLNSFAAGAGTVLFFEDQTVVRQLQEQFALYAD  117

Query:  122 NFPVWSEQSTGIASVNTWTALSAELGLGGNLQHYNPVIDASVQAVYGVPASWKLRGQLNF  181
            NFPVWSEQ++G+A    WTAL AE  +G +LQHYNP++DA     + +P SWKLR Q+ F
Sbjct:  118 NFPVWSEQASGMAQFAVWTAL-AEHKVGASLQHYNPLVDAQTHKTWNLPESWKLRAQMPF  176

Query:  182 GSIEAETGEKEFMNDDDRFKVIG                                      204
            G+I A  GEK F+ +  +RFKV G
Sbjct:  177 GAIAAPAGEKAFIAESERFKVFG                                      199
```

No corresponding DNA sequence was identified in *S. pyogenes*.

Based on this analysis, it was predicted that this protein and its epitopes, could be useful antigens for vaccines or diagnostics.

EXAMPLE 755

A DNA sequence (GBSx0802) was identified in *S. agalactiae* <SEQ ID 2321> which encodes the amino acid sequence <SEQ ID 2322>. Analysis of this protein sequence reveals the following:

```
Possible site: 58
>>> Seems to have no N-terminal signal sequence

----- Final Results -----
            bacterial cytoplasm --- Certainty = 0.2730 (Affirmative) < succ>
            bacterial membrane  --- Certainty = 0.0000 (Not Clear)   < succ>
             bacterial outside  --- Certainty = 0.0000 (Not Clear)   < succ>
```

The protein has homology with the following sequences in the GENPEPT database.

```
>GP: CAB62846 GB: AL035475 hypothetical protein [Plasmodium falciparum]
(ver 2)
Identities = 112/529 (21%), Positives = 217/529 (40%), Gaps = 67/529 (12%)

Query:     3 NKKHKLLKNIEEFKTITQKRLTERGKF-                                 60
             PYDTVHSTFEIKDENFIMERLKSSGLSNGKP--
             N K+ +K +  ++ Q  + E+ KF  D  H    E +E FI E  +   +   K
Sbjct:  1063 NVKYNEMKGAKN-DSLNQNEIIEKEKF--DLQH---ENRSERFIEEEKQICIVD-      1116
             DKKNNI
```

-continued

```
Query:    61 --VDYMGVNGIPIYTKTLSIVNK-                                118
             FAFENNSKDSSYSSNINISEDKIKENDQKILDLIVKS
                VD    + P Y + L +     +N + YS+      DKI +N++   ++  K
Sbjct: 1117 MNVDEKRKSDHPSYERVLKMEG-----SNKNEEGYSNT-----DKILKNEKNEKN-    1166
            VNEKK Query:   119 GANNQNLTDEEKVIAFTKYIGEITNYD-                                178
             NEAYRARNVDTEYYRASDLFSVTERKLAMCVGY
             G N++    +E+K       K + E + ++E      D     + F        +C
Sbjct: 1167 GENDEKNENEKKEENDEKNVNEKK-                                   1226
            DENDEKNENEKKDENDNNNNSYFYNNSDTFELCTNS Query:   179 SVTAARAFNIMGIPSYVVSGK-                                      238
             SPQGISHAAVRAYYNRSWHIIDITASTYWKNGNYKTTYS
                  +    N + IPS     ++ +GI +       N S   I+      KN N ++
             YS
Sbjct: 1227 LIFINNKKNSILIPS-----ENEKGIIGSQKEEEQNISPVKINNKKKDLCKNIN-ES-  1280
            DYS Query:   239 DFIKEYCIDGYD--VYDPAKTNNRFK-VKYMESNEAFENWIHNNGSKSML-------    288
             FIN
             D       ++ + +Y    +N++ + ++   + NE + +   + N S++ L        ++
Sbjct: 1281 DKQYSVLLNSIEKKIYKKCSSNSKIR-                                1340
            GIEKKKINEDYVDLKNINCSRNTLEFFLTKKYLK Query:   289 ESAALKDKKPKDDFVPVTEKEKNELID-                                348
             KYKKLLSQIPENTQNPGEKNIRDYLKNEYEEIL
               S   + ++      +   V EK+K +    K KKL  +I  N    P + I + + +EY +
Sbjct: 1341 SSELIINEHDCQNINNVYEKKKKKEQAK-KKLNRKI--NVNIPNDSIIEENMSSEYN- 1397
            FVK Query:   349 KKDN----LFEHEHAE-------FKESLNLNESFYLQLKKEE-------MKPSDNLK-  390
             KEE
             KK+N       FE + ++         F   N   + L    +E+         ++  +N K+
             E
Sbjct: 1398 KKNNNCMVKFETKRSKSILSSE-                                    1457
            IFAVKKNKKRATNLMRSEEQFISSIGLVEKGENKKRIE Query:   391 KPRENSVKERETPAENNDFVSVTEKNNLIDKYKELLSKIPENTQNPGEKNIRN--     448
             YLEKE
             +  E   +KE+     + N+F       KNNL ++    L   K  EN      G   N   ++++
Sbjct: 1458 EKDEEYIKEK-IKNKKNEF-----KNNLTEQL--LFFKSAENINTSGSFNTEKIRH-  1509
            VKRT Query:   449 YEELLQKDKLFKHEYTEFTKSLNLNETFYSQLKEGEMKLSENPEKGETN           497
                   ++   +    + ++    K L   E      ++ E + ++++N  EKGE  N
Sbjct: 1510 KRKVNLSNNFILNNFSNILKKLQRMEEDKIKMDEQKKEINKNNEKGEFN           1558
```

There is also homology to SEQ ID 598.

Based on this analysis, it was predicted that this protein and its epitopes, could be useful antigens for vaccines or diagnostics.

EXAMPLE 756

A DNA sequence (GBSx0803) was identified in *S. agalactiae* <SEQ ID 2323> which encodes the amino acid sequence <SEQ ID 2324>. Analysis of this protein sequence reveals the following:

```
Possible site: 22
>>> Seems to have no N-terminal signal sequence

----- Final Results -----
            bacterial cytoplasm --- Certainty = 0.1243 (Affirmative) < succ>
            bacterial membrane  --- Certainty = 0.0000 (Not Clear)  < succ>
            bacterial outside   --- Certainty = 0.0000 (Not Clear)  < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 757

A DNA sequence (GBSx0804) was identified in *S. agalactiae* <SEQ ID 2325> which encodes the amino acid sequence <SEQ ID 2326>. This protein is predicted to be 2-dehydro-3-deoxyphosphogluconate aldolase/4-hydroxy-2-oxoglutarate al. Analysis of this protein sequence reveals the following:

```
Possible site: 49
>>> Seems to have no N-terminal signal sequence

----- Final Results -----
            bacterial cytoplasm --- Certainty = 0.1057 (Affirmative) < succ>
             bacterial membrane --- Certainty = 0.0000 (Not Clear)  < succ>
              bacterial outside --- Certainty = 0.0000 (Not Clear)  < succ>
```

The protein has homology with the following sequences in the GENPEPT database.

```
>GP: AAD35160 GB: AE001693 2-dehydro-3-deoxyphosphogluconate
aldolase/4-hydroxy-2-oxoglutarate aldolase [Thermotoga maritima]
Identities = 78/192 (40%), Positives = 118/192 (60%), Gaps = 6/192 (3%)

Query:  14 KIVAVIRGNSQEEAFQAAQACIKGGISAIEIAYTNSKASQVIEQLVTQYTNQEQVVVGAG   73
           KIVAV+R NS EEA + A A  +GG+  IEI +T   A  VI++L   +  ++  ++GAG
Sbjct:  11 KIVAVLRANSVEEAKEKALAVFEGGVHLIEITFTVPDADTVIKEL--SFLKEKGAIIGAG   68

Query:  74 TVLDSETARMAILAGAKFIVSPAFNLQTAKLCNRYAIPYLPGCMTLSEVTTALEAGCEII  133
           TV    E  R A+ +GA+FIVSP + + ++ C    + Y+PG MT +E+  A++ G  I+
Sbjct:  69 TVTSVEQCRKAVESGAEFIVSPHLDEEISQFCKEKGVFYMPGVMTPTELVKAMKLGHTIL  128

Query: 134 KIFPGGTLGTSFISSLKAPLPQVQIMVTGGVNLTNAKDWFLSGVTAIGIGGEFNKLAALG  193
           K+FPG  +G  F+ ++K P P V+ + TGGVNL N  +WF +GV A+G+G    K    G
Sbjct: 129 KLFPGEVVGPQFVKAMGPFPNVKFVPTGGVNLDNVCEWFKAGVLAVGVSALVK----G  184

Query: 194 EFDKITEMAKQY                                                 205
            D++ E AK +
Sbjct: 185 TPDEVREKAKAF                                                 196
```

There is also homology to SEQ ID 1252.

Based on this analysis, it was predicted that this protein and its epitopes, could be useful antigens for vaccines or diagnostics.

EXAMPLE 758

A DNA sequence (GBSx0805) was identified in *S. agalactiae* <SEQ ID 2327> which encodes the amino acid sequence <SEQ ID 2328>. This protein is predicted to be 2-keto-3-deoxygluconate kinase. Analysis of this protein sequence reveals the following:

```
Possible site: 55
>>> Seems to have no N-terminal signal sequence

----- Final Results -----
            bacterial cytoplasm --- Certainty = 0.4113 (Affirmative) < succ>
             bacterial membrane --- Certainty = 0.0000 (Not Clear)  < succ>
              bacterial outside --- Certainty = 0.0000 (Not Clear)  < succ>
```

The protein has homology with the following sequences in the GENPEPT database.

```
>GP: AAD35161 GB: AE001693 2-keto-3-deoxygluconate kinase [Thermotoga
maritima]
Identities = 94/329 (28%), Positives = 169/329 (50%), Gaps = 7/329 (2%)

Query:   3 KILFFGEPLIRITPKENDYFADSISTKLFYGGSEVNTARALQGFGQDTKLLSALPNNPIG   62
           K++ FGE ++R++P ++    + S + YGG+E N A  L  G D  ++ LPNNP+G
Sbjct:   2 KVVTFGEIMLRLSPPDHKRIFQTDSFDVTYGGAEANVAAFLAQMGLDAYFVTKLPNNPLG   61

Query:  63 NSFLQFLKAQGIDTHSIQWVGERVGLYFLEDSFACRKGEVVYDRDHSSLHDFRINQIDFD  122
           ++    L+  G+ T   I    G R+G+YFLE  + R  +VVYDR HS++   +   D++
Sbjct:  62 DAAAGHLRKFGVKTDYIARGGNRIGIYFLEIGASQRPSKVVYDRAHSAISEAKREDFDWE  121

Query: 123 QLFEGVSLFHFSGITLSLDESIQEITLLLLKEAKKREITISLDLNFRSKLISPKNAKILF  182
           ++ +G  FHFSGIT L + +  I     LK A ++ +T+S DLN+R++L + + A+ +
Sbjct: 122 KILDGARWFHFSGITPPLGKELPLILEDALKVANEKGVTVSCDLNYRARLWTKEEAQKVM  181
```

```
-continued
Query: 183 SQFATFADICFG----IEPLMVDSQDTTFFNRDEATIEDVKERMISLINHFDFQVIFHTK 238
            F  + D+       IE ++  S +       +   E  +    +   ++F+  +   T
Sbjct: 182 IPFMEYVDVLIANEEDIEKVLGISVEGLDLKTGKLNREAYAKIAEEVTRKYNFKTVGITL 241

Query: 239 RLQDEWGRNHYQAYI-ANRKQEFVTSKEITTAVNQRIGSGDAFVAGALYQLLQHSDSKTV 297
            R           N++   + N+  F      EI   +  R+G+GD+F    +Y  L   DS+
Sbjct: 242 RESISATVNYWSVMVFENGQPHFSNRYEI--HIVDRVGAGDSFAGALIYGSLMGFDSQKK 299

Query: 298 IDFAVASASLKCALEGDNMFETVTAVNKV                                326
            +FA A++ LK   + GD +   ++   + K+
Sbjct: 300 AEFAAAASCLKHTIPGDFVVLSIEEIEKL                                328
```

There is also homology to SEQ ID 1264.

Based on this analysis, it was predicted that this protein and its epitopes, could be useful antigens for vaccines or diagnostics.

EXAMPLE 759

A DNA sequence (GBSx0806) was identified in *S. agalactiae* <SEQ ID 2329> which encodes the amino acid sequence <SEQ ID 2330>. Analysis of this protein sequence reveals the following:

```
Possible site: 16
>>> Seems to have no N-terminal signal sequence
INTEGRAL    Likelihood = -0.22        Transmembrane          53-69 (53-70)

----- Final Results -----
             bacterial membrane --- Certainty = 0.1086 (Affirmative) < succ>
             bacterial outside  --- Certainty = 0.0000 (Not Clear)   < succ>
             bacterial cytoplasm --- Certainty = 0.0000 (Not Clear)  < succ>
```

The protein has homology with the following sequences in the GENPEPT database.

```
>GP: AAD36157 GB: AE001768 sugar-phosphate isomerase [Thermotoga maritima]
Identities = 41/125 (32%), Positives = 61/125 (48%), Gaps = 10/125 (8%)

Query:   1 MKIALINENSQASKNTIIYKELKAVSDEKGFEVFNYGMYGKEEESQLTYVQNGLLTAILL    60
           MKIA+ ++++          +  +++K     KG EV ++G Y +E        Y  +  ++ +IL
Sbjct:   1 MKIAIASDHAAFE----LKEKVKNYLLGKGIEVEDHGTYSEESVDYPDYAKK-VVQSILS    55

Query:  61 NSGAADFVITGCGTGIGAMLACNSFPGVVCGFAADPVDAYLFSQVNGGNALSLPFAKGFG   120
           N   ADF I  CGTG+G  +A N + G+        P  A L    N  N L LP     G
Sbjct:  56 NE--ADFGILLCGTGLGMSIAANRYRGIRAALCLFPDMARLARSHNNANILVLP---GRL   110

Query: 121 WGAEL                                                         125
           GAEL
Sbjct: 111 IGAEL                                                         115
```

A related DNA sequence was identified in *S. pyogenes* <SEQ ID 2331> which encodes the amino acid sequence <SEQ ID 2332>. Analysis of this protein sequence reveals the following:

```
Possible site: 13
>>> Seems to have no N-terminal signal sequence

----- Final Results -----
             bacterial cytoplasm --- Certainty = 0.2599 (Affirmative) < succ>
             bacterial membrane  --- Certainty = 0.0000 (Not Clear)   < succ>
             bacterial outside   --- Certainty = 0.0000 (Not Clear)   < succ>
```

An alignment of the GAS and GBS proteins is shown below.

```
Identities = 159/212 (75%), Positives = 186/212 (87%)

Query:    1 MKIALINENSQASKNTIIYKELKAVSDEKGFEVFNYGMYGKEEESQLTYVQNGLLTAILL   60
            MKIALINENSQA+KN IIY  L V+D+ G++VFNYGMYG E ESQLTYVQNGLL +ILL
Sbjct:    1 MKIALINENSQAAKNGIIYDALTTVTDKHGYQVFNYGMYGTEGESQLTYVQNGLLASILL  60

Query:   61 NSGAADFVITGCGTGIGAMLACNSFPGVVCGFAADPVDAYLFSQVNGGNALSLPFAKGFG  120
            + AADFV+TGCGTG+GAMLA NSFPGV CGFA++P +AYLFSQ+NGGNALS+PFAKGFG
Sbjct:   61 TTKAADFVVTGCGTGVGAMLALNSFPGVTCGFASEPTEAYLFSQINGGNALSIPFAKGFG  120

Query:  121 WGAELNLRYLFERLFEDEKGGGYPKERAVPEQRNARILSEIKQITYRDLLSVLKEIDQDF  180
            WGAELNL  +FERLF +  GGGYPKERA+PEQRNARILS++K+ITYRDLL+++K+IDQDF
Sbjct:  121 WGAELNLTLIFERLFAEPMGGGYPKERAIPEQRNARILSDLKKITYRDLLAIVKDIDQDF  180

Query:  181 LKETISGEHFQEYFFANCQNQNIADYLKSVLD                             212
            LKETISG HFQEYFFAN +   + YLKSVL+
Sbjct:  181 LKETISGAHFQEYFFANAEPSELVTYLKSVLE                             212
```

Based on this analysis, it was predicted that these proteins and their epitopes could be useful antigens for vaccines or diagnostics.

EXAMPLE 760

A DNA sequence (GBSx0807) was identified in *S. agalactiae* <SEQ ID 2333> which encodes the amino acid sequence <SEQ ID 2334>. Analysis of this protein sequence reveals the following:

```
Possible site: 23
>>> Seems to have no N-terminal signal sequence
INTEGRAL Likelihood = -0.37 Transmembrane 10-26 (8-26)

----- Final Results -----
         bacterial membrane --- Certainty = 0.1150 (Affirmative) < succ>
          bacterial outside --- Certainty = 0.0000 (Not Clear)   < succ>
         bacterial cytoplasm --- Certainty = 0.0000 (Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 761

A DNA sequence (GBSx0808) was identified in *S. agalactiae* <SEQ ID 2335> which encodes the amino acid sequence <SEQ ID 2336>. This protein is predicted to be gluconate 5-dehydrogenase (fabG). Analysis of this protein sequence reveals the following:

```
Possible site: 35
>>> Seems to have no N-terminal signal sequence

----- Final Results -----
         bacterial cytoplasm --- Certainty = 0.1117 (Affirmative) < succ>
          bacterial membrane --- Certainty = 0.000  (Not Clear)   < succ>
          bacterial outside  --- Certainty = 0.000  (Not Clear)   < succ>
```

The protein has homology with the following sequences in the GENPEPT database.

```
>GP: AAC77223 GB: AE000497 5-keto-D-gluconate 5-reductase [Escherichia
coli K12]
Identities = 116/260 (44%), Positives = 165/260 (62%), Gaps = 6/260 (2%)

Query:    6 LKDNFSLEGKVALITGASYGIGFSIATAFARAGATIVFNDIKQELVDKGISAYKKLGIKA   65
            + D FSL GK LITG++ GIGF +AT  + GA I+ NDI  E +  +   + GI+A
Sbjct:    1 MNDLFSLAGKNILITGSAQGIGFLLATGLGKYGAQIIINDITAERAELAVEKLHQEGIQA   60

Query:   66 HGYVCDVTDEDGINEMVDKISQDVGVIDILVNNAGIIKRTPMLEMSAADFRQVIDIDLNA  125
                +VT +   I+  V+ I +D+G ID+LVNNAGI +R  P   E     ++ VI ++  A
Sbjct:   61 VAAPFNVTHKHEIDAAVEHIEKDIGPIDVLVNNAGIQRRHPFTEFPEQEWNDVIAVNQTA  120
```

-continued

```
Query:  126 PFIVSKAVLPGMIQKGHGKIINICSMMSELGRETVAAYAAAKGGLKMLTKNIASEYGSAN  185
            F+VS+AV    M+++  GK+INICSM SELGR+T+  YAA+KG +KMLT+ +  E   N
Sbjct:  121 VFLVSQAVTRHMVERKAGRVINICSMQSELGRDTITPYAASKGAVKMLTRGMCVELARHN  180

Query:  186 IQCNGIGPGYIATPQTAPLRERQDDGSRHPFDQFIIAKTPAARWGEAEDLGAPAIFLASD  245
            IQ NGI PGY  T   T  L E +         F  ++  +TPAARWG+ ++L   A+FL+S
Sbjct:  181 IQVNGIAPGYFKTEMTKALVEDE------AFTAWLCKRTPAARWGDPQELIGAAVFLSSK  234

Query:  246 ASNFINGHILYVDGGILAYI                                          265
            AS+F+NGH+L+VDGG+L  +
Sbjct:  235 ASDFVNGHLLFVDGGMLVAV                                          254
```

There is also homology to SEQ ID 1242:

```
Identities = 225/264 (85%), Positives = 246/264 (92%)

Query:    6 LKDNFSLEGKVALITGASYGIGFSIATAFARAGATIVFNDIKQELVDKGISAYKKLGIKA   65
            +++ FSL+GK+ALITGASYGIGF IA A+A+AGATIVFNDIKQELVDKG++AY++LGI+A
Sbjct:    1 MENMFSLQGKIALITGASYGIGFEIAKAYAQAGATIVFNDIKQELVDKGLAAYRELGIEA   60

Query:   66 HGYVCDVTDEDGINEMVDKISQDVGVIDILVNNAGIIKRTPMLEMSAADFRQVIDIDLNA  125
            HGYVCDVTDE GI +MV +I  +VG IDILVNNAGII+RTPMLEM+A DFRQVIDIDLNA
Sbjct:   61 HGYVCDVTDEAGIQQMVSQIEDEVGAIDILVNNAGIIRRTPMLEMAAEDFRQVIDIDLNA  120

Query:  126 PFIVSKAVLPGMIQRGHGKIINICSMMSELGRETVAAYAAAKGGLKMLTKNIASEYGSAN  185
            PFIVSKAVLP MI KGHGKIINICSMMSELGRETV+AYAAAKGGLKMLTKNIASE+G AN
Sbjct:  121 PFIVSKAVLPSMIAKGHGKIINICSMMSELGRETVSAYAAAKGGLKMLTKNIASEFGEAN  180

Query:  186 IQCNGIGPGYIATPQTAPLRERQDDGSRHPFDQFIIAKTPAARWGEAEDLGAPAIFLASD  245
            IQCNGIGPGYIATPQTAPLRERQ DGSRHPFDQFIIAKTPAARWG  EDL  PA+FLASD
Sbjct:  181 IQCNGIGPGYIATPQTAPLRERQADGSRHPFDQFIIAKTPAARWGTTEDLAGPAVFLASD  240

Query:  246 ASNFINGHILYVDGGILAYIGKQP                                      269
            ASNF+NGHILYVDGGILAYIGKQP
Sbjct:  241 ASNFVNGHILYVDGGILAYIGKQP                                      264
```

Based on this analysis, it was predicted that this protein and its epitopes, could be useful antigens for vaccines or diagnostics.

EXAMPLE 762

A DNA sequence (GBSx0809) was identified in *S. agalactiae* <SEQ ID 2337> which encodes the amino acid sequence <SEQ ID 2338>. This protein is predicted to be mannose-specific phosphotransferase system component IIAB. Analysis of this protein sequence reveals the following:

```
Possible site: 24
>>> Seems to have no N-terminal signal sequence

----- Final Results -----
            bacterial cytoplasm --- Certainty = 0.0886 (Affirmative) < succ>
             bacterial membrane --- Certainty = 0.0000 (Not Clear)   < succ>
              bacterial outside --- Certainty = 0.0000 (Not Clear)   < succ>
```

The protein has homology with the following sequences in the GENPEPT database.

```
>GP: AAD46485 GB: AF130465 mannose-specific phosphotransferase system
component IIAB [Streptococcus salivarius]
Identities = 43/107 (40%), Positives = 61/107 (56%), Gaps = 3/107 (2%)

Query:    2 IKIIIVAHGNFPDGILSSLELIAGHQEYVVGINFIAGMSSNDVRVALQREVIDFK---EI   58
            I  III +HG F  +GI  S  +I G QE V   + F+      +D+       +  F   EI
Sbjct:    3 IGIIIASHGKFAEGIHQSGSMIFGDQEKVQVVTFMPSEGPDDLYAHFNDAIAQFDADDEI   62

Query:   59 LVLTDLLGGTPFNVSSALSVEYTDKKIKVLSGLNLSMLMEAVLSRTM               105
            LVL DL  G+PFN +S+  E  D+KI +++GLNL ML++A    R M
Sbjct:   63 LVLADLWSGSPFNQASRIAGENPDRKIAIITGLNLPMLIQAYTERMM               109
```

A related DNA sequence was identified in *S. pyogenes* <SEQ ID 2339> which encodes the amino acid sequence <SEQ ID 2340>. Analysis of this protein sequence reveals the following:

```
     Possible site: 41
>>> Seems to have an uncleavable N-term signal seq

----- Final Results -----
             bacterial membrane --- Certainty = 0.0000 (Not Clear) < succ>
             bacterial outside --- Certainty = 0.0000 (Not Clear) < succ>
             bacterial cytoplasm --- Certainty = 0.0000 (Not Clear) < succ>
```

The protein has homology with the following sequences in the databases:

```
>GP: AAF81086 GB: AF228498 AgaF [Escherichia coli]
Identities = 48/127 (37%), Positives = 71/127 (55%), Gaps = 6/127 (4%)

Query:   1 MIAIIVMGNGHFASGIVSALELIAGKQEKVTAIDFTTEMTAADVQDQLSRALIP---EEE    57
           M++II+ GHG FASG+  A++ I G+Q +  AID     + A + QL  A+      E+
Sbjct:   1 MLSIILTGHGGFASGMEKAMKQILGEQSQFIAIDVPETSSTALLTSQLEEAIAQLDCEDG   60

Query:  58 TLVLCDLLGGTPFKVAATLMESLPNTTCNVLSGLNLAMLIEASFARQTAASFDDLVSGLI  117
           + L DLLGGTPF+VA+TL    P   C V++G NL +L+E    R+ +  + V  L
Sbjct:  61 IVFLTDLLGGTPFRVASTLAMQKPG--CEVITGTNLQLLLEMVLEREGLSGEEFRVQAL-  117

Query: 118 TCSKEGI                                                      124
           C   G+
Sbjct: 118 ECGHRGL                                                      124
```

An alignment of the GAS and GBS proteins is shown below.

```
Identities = 73/146 (50%), Positives = 94/146 (64%), Gaps = 3/146 (2%)

Query:   1 MIKIIIVAHGNFPDGILSSLELIAGHQEYVVGINFIAGMSSNDVRVALQREVIDFKEILV    60
           MI II++ HG+F  GI+S+LELIAG QE V  I+F  M++ DV+  L R +I  +E LV
Sbjct:   1 MIAIIVMGHGHFASGIVSALELIAGKQEKVTAIDFTTEMTAADVQDQLSRALIPEEETLV   60

Query:  61 LTDLLGGTPFNVSSALSVEYTDKKIKVLSGLNLSMLMEAVLSRTMFEHVDDLVDKVITSS  120
           L DLLGGTPF V++ L     +    VLSGLNL+ML+EA +R     DDLV +IT S
Sbjct:  61 LCDLLGGTPFKVAATLMESLPNTTCNVLSGLNLAMLIEASFARQTAASFDDLVSGLITCS  120

Query: 121 HEGIVDFSTCLATQTAEATFE--GGI                                   144
           EGIVD+ T L+ Q  AT + GGI
Sbjct: 121 KEGIVDWKT-LSQQEDGATDDELGGI                                   145
```

Based on this analysis, it was predicted that these proteins and their epitopes could be useful antigens for vaccines or diagnostics.

EXAMPLE 763

A DNA sequence (GBSx0811) was identified in *S. agalactiae* <SEQ ID 2341> which encodes the amino acid sequence <SEQ ID 2342>. This protein is predicted to be unsaturated glucuronyl hydrolase. Analysis of this protein sequence reveals the following:

```
Possible site: 48
>>> Seems to have no N-terminal signal sequence
INTEGRAL Likelihood = -0.11 Transmembrane 172-188 (172-188)

----- Final Results -----
             bacterial membrane --- Certainty = 0.1044 (Affirmative) < succ>
             bacterial outside --- Certainty = 0.0000 (Not Clear) < succ>
             bacterial cytoplasm --- Certainty = 0.0000 (Not Clear) < succ>
```

The protein has homology with the following sequences in the GENPEPT database.

```
>GP: BAB05773 GB: AP001514 unsaturated glucuronyl hydrolase [Bacillus
halodurans]
Identities = 156/370 (42%), Positives = 219/370 (59%), Gaps = 3/370 (0%)

Query:  30 EEAIEKALKQLYINIDYFGEEYPTPATFNNIYKVMDNTEWTNGFWTGCLWLAYEYNQDKK   89
           ++A+    ++  NI  F   +P  +     Y++ +N EWTNGFW+G LWL YEY  D
Sbjct:   4 KQAMTDVAEKTLTNIKRFNGRFPHVSEDGEHYELNNNNEWTNGFWSGILWLCYEYTNDPA   63

Query:  90 LKNIAHKNVLSFLNRINNRIALDHHDLGFLYTPSCTAEYRINGDVKALEATIKAADKLME  149
            +   A   V SF  R+    + LDHHD+GFLY+ S   A++  I   D +A + TI+AAD LM+
Sbjct:  64 FRQAAASTVRSFQQRMEQNLELDHHDIGFLYSLSSKAQWIIERDERAKQLTIEAADVLMK  123

Query: 150 RYQEKGGFIQAWGELG-YKEHYRLIIDCLLNIQLLFFAYEQTGDEKYRQVAVNHFYASAN  208
           R++EK    QAWG  G      R+I+DCL+N+ LLF+A  E TG+   YR+ A+  H    +
Sbjct: 124 RWREKIELFQAWGPEGDLSNGGRIIVDCLMNLPLLFWASEVTGNPDYREAAIIHADKTRR  183

Query: 209 NVVRDDSSAFHTFYFDPETGEPLKGVTRQGYSDESSWARGQAWGIYGIPLSYRKMKDYQQ  268
            +VR D S +HTFYF+ ETGE L+G T QGY D S+W+RGQAW IYG  ++YR    + +
Sbjct: 184 FIVRGDDSTYHTFYFNQETGEALRGGTHQGYEDGSTWSRGQAWAIYGFAIAYRYTGNERY  243

Query: 269 IILFKGMTNYFLNRLPEDKVSYWDLIFTDGSGQPRDTSATATAVCGIHEMLKYLPEVDPD  328
            +   K    YF+  LP D V+YWD          RD+SA+A A CGI E+L +L E DPD
Sbjct: 244 LETAKRTAKYFIENLPADYVAYWDFNAPITPDTKRDSSASAIASCGILELLSHLQETDPD  303

Query: 329 KETYKYAMHTMLRSLIEQYSNNELIAGRPLLLHGVYSWHSGKGVDEGNIWGDYYYLEALI  388
           K   ++ ++    + SL+E Y++ +    G  L+  G YS    G    D+   IWGDY+Y EAL+
Sbjct: 304 KAFFQQSVQKQMTSLVENYASEKDAQG--LIKRGSYSVRIGHAPDDYVIWGDYFYTEALM  361

Query: 389 RFYKDWELYW                                                    398
           R  K     YW
Sbjct: 362 RLEKLRNGYW                                                    371
```

30

A related DNA sequence was identified in *S. pyogenes* <SEQ ID 2343> which encodes the amino acid sequence <SEQ ID 2344>. Analysis of this protein sequence reveals the following:

```
     Possible site: 33
>>> Seems to have no N-terminal signal sequence
INTEGRAL Likelihood = -0.37 Transmembrane 173-189 (173-189)

----- Final Results -----
             bacterial membrane --- Certainty = 0.1150 (Affirmative) < succ>
              bacterial outside --- Certainty = 0.0000 (Not Clear)   < succ>
            bacterial cytoplasm --- Certainty = 0.0000 (Not Clear)   < succ>
```

An alignment of the GAS and GBS proteins is shown below.

```
Identities = 273/395 (69%), Positives = 336/395 (84%)

Query:   4 IKPVKVESIENPKRFLNSRLLTKIEVEEAIEKALKQLYINIDYFGEEYPTPATFNNIYKV   63
           +K +  +E I+ P+RF     L++ ++ +A++ ALKQ+ +N+DYF E++PTPAT +N Y +
Sbjct:   5 LKTIALEPIKQPERFTKEDFLSQEDITQALDLALKQVRLNMDYFKEDFPTPATKDNQYAI   64

Query:  64 MDNTEWTNGFWTGCLWLAYEYNQDKKLKNIAHKNVLSFLNRINNRIALDHHDLGFLYTPS  123
           MDNTEWTN FWTGCLWLAYEY+ D  +K +A  N LSFL+R+    I LDHHDLGFLYTPS
Sbjct:  65 MDNTEWTNAFWTGCLWLAYEYSGDDAIKALAQANDLSFLDRVTRDIELDHHDLGFLYTPS  124

Query: 124 CTAEYRINGDVKALEATIKAADKLMERYQEKGGFIQAWGELGYKEHYRLIIDCLLNIQLL  183
           C  AE+++      ++ EA  +KAADKL++RYQ+KGGFIQAWGELG KE YRLIIDCLLNIQLL
Sbjct: 125 CMAEWKLLKTPESREAALKAADKLVQRYQDKGGFIQAWGELGKKEDYRLIIDCLLNIQLL  184

Query: 184 FFAYEQTGDEKYRQVAVNHFYASANNVVRDDSSAFHTFYFDPETGEPLKGVTRQGYSDES  243
           FFA ++TGD +YR +A+NHFYASAN+V+RDD SA+HTFYFDPETG+P+KGVTRQGYSD+S
Sbjct: 185 FFASQETGDNRYRDMAINHFYASANHVIRDDASAYHTFYFDPETGDPVKGVTRQGYSDDS  244

Query: 244 SWARGQAWGIYGIPLSYRKMKDYQQIILFKGMTNYFLNRLPEDKVSYWDLIFTDGSGQPR  303
           +WARGQAWGIYGIPL+YR +K+ +  I LFKGMT+YFLNRLP+D+VSYWDLIF DGS Q R
Sbjct: 245 AWARGQAWGIYGIPLTYRFLKEPELIQLFKGMTHYFLNRLPKDQVSYWDLIFGDGSEQSR  304
```

```
                             -continued
Query:  304 DTSATATAVCGIHEMLKYLPEVDPDKETYKYAMHTMLRSLIEQYSNNELIAGRPLLLHGV  363
            D+SATA AVCGIHEMLK LP+ DPDK+TY+ AMH+MLR+LI+ Y+N +L  G PLLLHGV
Sbjct:  305 DSSATAIAVCGIHEMLKTLFDHDPDKKTYEAAMHSMLRALIKDYANKDLKPGAPLLLHGV  364

Query:  364 YSWHSGKGVDEGNIWGDYYYLEALIRFYKDWELYW                           398
            YSWHSGKGVDEGNIWGDYYYLEAL+RFYKDW  YW
Sbjct:  365 YSWHSGKGVDEGNIWGDYYYLEALLRFYKDWNPYW                           399
```

Based on this analysis, it was predicted that these proteins and their epitopes could be useful antigens for vaccines or diagnostics.

EXAMPLE 764

A DNA sequence (GBSx0812) was identified in *S. agalactiae* <SEQ ID 2345> which encodes the amino acid sequence <SEQ ID 2346>. Analysis of this protein sequence reveals the following:

```
Possible site: 36
>>> Seems to have no N-terminal signal sequence

----- Final Results -----
            bacterial cytoplasm --- Certainty = 0.3035 (Atfirmative) < succ>
            bacterial membrane  --- Certainty = 0.0000 (Not Clear)   < succ>
             bacterial outside  --- Certainty = 0.0000 (Not Clear)   < succ>
```

The protein has homology with the following sequences in the GENPEPT database.

```
>GP: AAC44679 GB: U65015 PTS permease for mannose subunit IIIMan C
terminal domain [Vibrio furnissii]
Identities = 63/125 (50%), Positives = 89/125 (70%), Gaps = 1/125 (0%)

Query:    5 PNIVMTRVDERLIHGQ-GQLWVKFLSCNTVIVANDDVSKDHLQQTLMKTVVPESIALRFF   63
            PNIV++R+DERL+HGQ G  WV F   N V+VAND+V+ D +QQ LM+ V+ + IA+RF+
Sbjct:    2 PNIVLSRIDERLVHGQVGVQWVGFADANIVVVANDEVAADTIQQNLMEMVLADGIAIRFW   61

Query:   64 DIQKVIDIIHKANPAQTIFIIVKDLKDVYRLVAGGVPIKEINIGNIHNGEGKEQVSRSIF  123
             +QK ID IHKA+  Q I ++ K   D RLV GGVPI  IN+GN+H  +GK Q+S+++
Sbjct:   62 TVQKTIDTIHKASDRQRILLVCKTPHDFRRLVEGGVPIAAINVGNMHYIDGKTQISKTVS  121

Query:  124 LGMKD                                                         128
            +  +D
Sbjct:  122 VDAED                                                         126
```

A related DNA sequence was identified in *S. pyogenes* <SEQ ID 2347> which encodes the amino acid sequence <SEQ ID 2348>. Analysis of this protein sequence reveals the following:

```
Possible site: 58
>>> Seems to have no N-terminal signal sequence

----- Final Results -----
            bacterial cytoplasm --- Certainty = 0.2511 (Affirmative) < succ>
            bacterial membrane  --- Certainty = 0.0000 (Not Clear)   < succ>
             bacterial outside  --- Certainty = 0.0000 (Not Clear)   < succ>
```

The protein has homology with the following sequences in the databases:

```
>GP: BAA84216 GB: AB019619 unsaturated glucuronyl hydrolase [Bacillus
sp. GL1]
Identities = 161/369 (43%), Positives = 220/369 (58%), Gaps = 1/369 (0%)

Query:   32 QALDLALKQVRLNMDYFKEDFPTPATKDNQYAIMDNTEWTNAFWTGCLWLAYEYSGDDAI   91
            QA+  AL    N+  F + FP +    N+Y + DNT+WT+ FW+G LWL YEY+GD+
Sbjct:    4 QAIGDALGITARNLKKFGDRFPHVSDGSNKYVLNDNTDWTDGFWSGILWLCYEYTGDEQY   63
```

```
Query:  92 KALAQANDLSFLDRVTRDIELDHHDLGFLYTPSCMAEWKLLKTPESREAALKAADKLVQR 151
           +  A     SF +R+ R   LDHHD+GFLY+ S  A+W + K   +R+ AL AAD L++R
Sbjct:  64 REGAVRTVASFRERLDRFENLDHHDIGFLYSLSAKAQWIVEKDESARKLALDAADVLMRR 123

Query: 152 YQDKGGFIQAWGELGKKEDY-RLIIDCLLNIQLLFFASQETGDNRYRDMAINHFYASANH 210
           ++   G IQAWG  G  E+  R+IIDCLLN+ LL +A ++TGD  YR +A  H   S
Sbjct: 124 WRADAGIIQAWGPKGDPENGGRIIIDCLLNLPLLLWAGEQTGDPEYRRVAEAHALKSRRF 183

Query: 211 VIRDDASAYHTFYFDPETGDPVKGVTRQGYSDDSAWARGQAWGIYGIPLTYRFLKEPELI 270
           ++R D S+YHTFYFDPE G+ ++G T QG +D S W RGQAWGIYG  L  R+L   +L+
Sbjct: 184 LVRGDDSSYHTFYFDPENGNAIRGGTHQGNTDGSTWTRGQAWGIYGFALNSRYLGNADLL 243

Query: 271 QLFKGMTHYFLNRLPKDQVSYWDLIFGDGSEQSRDSSATAIAVCGIHEMLKTLPDHDPDK 330
              + K M  +FL R+P+D V YWD         RDSSA+AI  CG+ E+    L + DP++
Sbjct: 244 ETAKRMARHFLARVPEDGVVYWDFEVPQEPSSYRDSSASAITACGLLEIASQLDESDPER 303

Query: 331 KTYEAAMHSMLRALIKDYANKDLKPGAPLLLHGVYSWHSGKGVDEGNIWGDYYYLEALLR 390
           + + A  + + AL   YA +D     + G Y   G   D+  IWGDYYYLEALLR
Sbjct: 304 QRFIDAAKTTVTALRDGYAERDDGEAEGFIRRGSYHVRGGISPDDYTIWGDYYYLEALLR 363

Query: 391 FYKDWNPYW                                                   399
               +   YW
Sbjct: 364 LERGVTGYW                                                   372
```

An alignment of the GAS and GBS proteins is shown below.

```
Identities = 112/160 (70%), Positives = 132/160 (82%), Gaps = 1/160 (0%)

Query:   5 PNIVMTRVDERLIHGQGQLWVKFLSCNTVIVANDDVSKDHLQQTLMKTVVPESIALRFFD 64
           PNI+MTRVDERLIHGQGQLWVKFL+CNTVIVAND VS+D +QQ+LMKTV+P SIA+RFF
Sbjct:   4 PNIIMTRVDERLIHGQGQLWVKFLNCNTVIVANDAVSEDKIQQSLMKTVIPSSIAIRFFS 63

Query:  65 IQKVIDIIHKANPAQTIFIIVKDLKDVYRLVAGGVPIKEINIGNIHNGEGKEQVSRSIFL 124
           IQKVIDIIHKA+PAQ+IFI+VKDL+  D    LV GGVPI EINIGNIH  + K +++ I L
Sbjct:  64 IQKVIDIIHKASPAQSIFIVVKDLQDAKLLVEGGVPITEINIGNIHKTDDKVAITQFISL 123

Query: 125 GMKDKEIIRKLNQEYHIAFNTKTTPTGNDGAVEVNILDYI                    164
           G  DK  IR L  ++H+ FNTKTTP GN  A +V+ILDYI
Sbjct: 124 GETDKSAIRCLAHDHHVVFNTKTTPAGN-SASDVDILDYI                    162
```

Based on this analysis, it was predicted that these proteins and their epitopes could be useful antigens for vaccines or diagnostics.

EXAMPLE 765

A DNA sequence (GBSx0813) was identified in *S. agalactiae* <SEQ ID 2349> which encodes the amino acid sequence <SEQ ID 2350>. This protein is predicted to be AgaW (agaC). Analysis of this protein sequence reveals the following:

```
Possible site: 25
>>> Seems to have a cleavable N-term signal seq.
    INTEGRAL    Likelihood = -6.95    251-267 (244-269)
                Transmembrane
    INTEGRAL    Likelihood = -4.30    213-229 (208-230)
                Transmembrane
    INTEGRAL    Likelihood = -2.71    149-165 (148-165)
                Transmembrane
    INTEGRAL    Likelihood = -1.81     31-47  (31-49)
                Transmembrane
    INTEGRAL    Likelihood = -1.49    173-189 (173-189)
                Transmembrane ----- Final Results -----
            bacterial membrane  --- Certainty = 0.3781 (Affirmative) < succ>
            bacterial outside   --- Certainty = 0.0000 (Not Clear)   < succ>
            bacterial cytoplasm --- Certainty = 0.0000 (Not Clear)   < succ>
```

The protein has homology with the following sequences in the GENPEPT database.

```
>GP: AAF81084 GB: AF228498 AgaW [Escherichia coli]
Identities = 93/295 (31%), Positives = 140/295 (46%), Gaps = 48/295 (16%)

Query:    1 MDISILQAVLIGLWTAFCFSGMLLGL-YTNRCIVLSLGVGVILGDIQTALAVGAISELAY   59
            M+IS+LQA +G+         M  GL + +R +VL  VG++LGD+ T +  G   EL +
Sbjct:    1 MEISLLQAFALGIIAFIAGLDMFNGLTHMHRPVVLGPLVGLVLGDLHTGILTGGTLELVW  60

Query:   60 MGFGVGAGGTVPPNPIGPGIFGTLMAITTAGTKGKITPEAALALSTPIAVGIQFLQTATY  119
            MG     AG   PPN I  I GT AITT       + P+ A+ ++ P AV +Q   T +
Sbjct:   61 MGLAPLAGAQ-PPNVIIGTIVGTAFAITTG-----VKPDVAVGVAVPFAVAVQMGITFLF  114

Query:  120 TAFAGAPETAKK--------ALQAGNFRGFKIAANGT-IWAFAGLGFGLGVLGALSTQTL  170
              + +G   +         AL A N+     N  + AF + FG    A   +T+
Sbjct:  115 SVMSGVMSRCARMPRTPILAALNACNYLALLALGNFYFLCAFLPIYFG-----AEHAKTI  169

Query:  171 TDLFALIPPVLLNGLTLAGKMLPAIGFAMILSVMAKKELIPYILLGYVLAVYFGLPVLTP  230
             D+   +P L++GL +AG ++PAIGFA++L +M K   IPY +LG+V A +  LPVL
Sbjct:  170 IDV---LPQRLIDGLGVAGGIMPAIGFAVLLKIMMKNVYIPYFILGFVAAAWLKLPVL--  224

Query:  231 TANGDGVLTSVATNSVLGVPTIGVAIIATIFALLDIFRKPAAPTKETKTEGDNQD       285
                               +A  A  AL+D+ RK  PT+    + +D
Sbjct:  225 --------------------AIACPALAMALIDLLRKSPEPTQPAAQKEEFED         257
```

A related DNA sequence was identified in *S. pyogenes* <SEQ ID 2351> which encodes the amino acid sequence <SEQ ID 2352>. Analysis of this protein sequence reveals the following:

```
Possible site: 52
>>> Seems to have a cleavable N-term signal seq.
    INTEGRAL    Likelihood = -6.37   Transmembrane   220-236 (214-241)
    INTEGRAL    Likelihood = -5.10   Transmembrane   146-162 (144-165)
    INTEGRAL    Likelihood = -1.59   Transmembrane   184-200 (184-202)

----- Final Results -----
         bacterial membrane --- Certainty = 0.3548 (Affirmative) < succ>
          bacterial outside --- Certainty = 0.0000 (Not Clear)   < succ>
        bacterial cytoplasm --- Certainty = 0.0000 (Not Clear)   < succ>
```

The protein has homology with the following sequences in the databases:

```
>GP: AAC44680 GB: U65015 PTS permease for mannose subunit IIPMan
[Vibrio furnissii]
Identities = 86/255 (33%), Positives = 137/255 (53%), Gaps = 11/255 (4%)

Query:    1 MDINLLQALLIGLWTAFCFSGMLLGI-YTNRCIILSFGVGIILGDLPTALSMGAISELAY   59
            M+I L QAL++GL        +  G+ + G+ + +R ++L  VG+ILGDL T + +G   EL +
Sbjct:    1 MEIGLFQALMLGLLAFLAGLDLFNGLTHFHRPVVLGPLVGLILGDLHTGILVGGTLELIW  60

Query:   60 MGFGVGAGGTVPPNPIGPGIFGTLMAITSAGKVTPEAALALSTPIAVAIQFLQTFAYTAF  119
            MG     AG   PPN I  I GT AIT+  V P  A+ ++ P AVA+Q   T ++A
Sbjct:   61 MGLAPLAGAQ-PPNVIIGTIVGTTFAITT--NVEPNVAVGVAVPFAVAVQMGITLLFSAM  117

Query:  120 AGAPETAKKQLQKGNIRGFK---FAANGTIWAFAFIGLGLGLLGALSMDTLLHLVDYIPP  176
                +   +  + + RG +    +A    +F F+  L +   L D     +V  +P
Sbjct:  118 SAVMSKCDEYAKNADTRGIERVNYFALAVLGSFYFLCAFLPIY--LGADHAGAMVAALPK  175

Query:  177 VLLNGLTVAGKMLPAIGFAMILSVMAKKELIPFVLIGYVCAAYLQIPTIGIAIIGIIFAL  236
            L++GL VAG ++PAIGFA+++ +M K   IP+ +IG+V AA LQ+P + I     A+
Sbjct:  176 ALIDGLGVAGGIMPAIGFAVLMKIMMKNAYIPYFILGFVAAAWLQLPILAIRCAATAMAI  235

Query:  237 NEFYNK--PKQVDAT                                              249
            +F  K   P  V+A+
Sbjct:  236 IDFMRKSEPTPVNAS                                              250
```

An alignment of the GAS and GBS proteins is shown below.

```
Identities = 203/288 (70%), Positives = 225/288 (77%), Gaps 28/288 (9%)

Query:     1 MDISILQAVLIGLWTAFCFSGMLLGLYTNRCIVLSLGVGVILGDIQTALAVGAISELAYM   60
             MDI++LQA+LIGLWTAFCFSGMLLG+YTNRCI+LS GVG+ILGD+ TAL++GAISELAYM
Sbjct:     1 MDINLLQALLIGLWTAFCFSGMLLGIYTNRCIILSFGVGIILGDLPTALSMGAISELAYM   60

Query:    61 GFGVGAGGTVPPNPIGPGIFGTLMAITTAGTKGKITPEAALALSTPIAVGIQFLQTATYT  120
             GFGVGAGGTVPPNPIGPGIFGTLMAIT+AG   K+TPEAALALSTPIAV IQFLQT  YT
Sbjct:    61 GFGVGAGGTVPPNPIGPGIFGTLMAITSAG---KVTPEAALALSTPIAVAIQFLQTFAYT  117

Query:   121 AFAGAPETAKKALQAGNFRGFKIAANGTIWAFAGLGFGLGVLGALSTQTLTDLFALIPPV  180
             AFAGAPETAKI LQ GN RGFK AANGTIWAFA +G GLG+LGALS  TL L   IPPV
Sbjct:   118 AFAGAPETAKKQLQKGNIRGFKFAANGTIWAFAFIGLGLGLLGALSMDTLLHLVDYIPPV  177

Query:   181 LLNGLTLAGKMLPAIGFAMILSVMAKKELIPYILLGYVLAVYFGLPVLTPTANGDGVLTS  240
             LLNGLT+AGKMLPAIGFAMILSVMAKKELIP++L+GYV A Y
Sbjct:   178 LLNGLTVAGKMLPAIGFAMILSVMAKKELIPFVLIGYVCAAY------------------  219

Query:   241 VATNSVLGVPTIGVAIIATIFALLDIFRKPAAPTKETKTEGDNQDDWI              288
                  L +PTIG+AII  IFAL + + KP       T  +G  QDDWI
Sbjct:   220 ------LQIPTIGIAIIGIIFALNEFYNKP-KQVDATTVQGGQQDDWI              260
```

Based on this analysis, it was predicted that these proteins and their epitopes could be useful antigens for vaccines or diagnostics.

EXAMPLE 766

A DNA sequence (GBSx0814) was identified in *S. agalactiae* <SEQ ID 2353> which encodes the amino acid sequence <SEQ ID 2354>. Analysis of this protein sequence reveals the following:

```
Possible site: 31
>>> Seems to have no N-terminal signal sequence

----- Final Results -----
         bacterial cytoplasm --- Certainty = 0.2442 (Affirmative) < succ>
          bacterial membrane --- Certainty = 0.0000 (Not Clear)  < succ>
           bacterial outside --- Certainty = 0.0000 (Not Clear)  < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 767

A DNA sequence (GBSx0815) was identified in *S. agalactiae* <SEQ ID 2355> which encodes the amino acid sequence <SEQ ID 2356>. This protein is predicted to be PTS permease for mannose subunit IIBMan. Analysis of this protein sequence reveals the following:

```
Possible site: 43
>>> Seems to have no N-terminal signal sequence
      INTEGRAL    Likelihood = -8.28    Transmembrane    278-294 (272-294)
      INTEGRAL    Likelihood = -3.45    Transmembrane    155-171 (155-174)
      INTEGRAL    Likelihood = -1.59    Transmembrane    250-266 (250-267)

----- Final Results -----
          bacterial membrane --- Certainty = 0.4312 (Affirmative) < succ>
           bacterial outside --- Certainty = 0.0000 (Not Clear)  < succ>
         bacterial cytoplasm --- Certainty = 0.0000 (Not Clear)  < succ>
```

A related GBS nucleic acid sequence <SEQ ID 8657> which encodes amino acid sequence <SEQ ID 8658> was also identified. Analysis of this protein sequence reveals the following:

```
Lipop: Possible site: -1 Crend: 10
McG: Discrim Score: -9.70
GvH: Signal Score (-7.5): -6.12
    Possible site: 19
>>> Seems to have no N-terminal signal sequence
ALOM program count: 3 value: -8.28 threshold: 0.0
    INTEGRAL    Likelihood = -8.28    Transmembrane    254-270 (248-270)
    INTEGRAL    Likelihood = -3.45    Transmembrane    131-147 (131-150)
    INTEGRAL    Likelihood = -1.59    Transmembrane    226-242 (226-243)
    PERIPHERAL  Likelihood = 0.37               175
modified ALOM score: 2.16

*** Reasoning Step: 3

----- Final Results -----
            bacterial membrane --- Certainty = 0.4312 (Affirmative) < succ>
             bacterial outside --- Certainty = 0.0000 (Not Clear)   < succ>
           bacterial cytoplasm --- Certainty = 0.0000 (Not Clear)   < succ>
```

The protein has homology with the following sequences in the GENPEPT database.

```
>GP: AAA57943 GB: U18997 ORF_o290; Geneplot suggests frameshift
linking to o267, not found [Escherichia coli]
Identities = 101/278 (36%), Positives = 164/278 (58%), Gaps = 6/278 (2%)

Query:  17 LRQKETTKMTGSKKLAKSDYTKTALRAFYLQNGFNYSNYQGLGYANVIYPALKKYYGDDK    76
           ++ K+ T   GS+ ++K D T+   R+ LQ  FNY    Q G+    + P LKK Y DDK
Sbjct:  19 VKMKKRTTAMGSE-ISKKDITRLGFRSSLLQASFNYERMQAGGFTWAMLPILKKIYKDDK    77

Query:  77 KALAGALEENVEFYNTNPHFLPFVTSLHLAMLDNERPEEEIRGIKMALMGPLAGIGDSLS   136
           L+ A+++N+EF NT+P+ + F+  L ++M +     + I+G+K+AL GP+AGIGD++
Sbjct:  78 PGLSAAMKDNLEFINTHPNLVGFLMGLLISMEEKGENRDTIKGLKVALFGPIAGIGDAIF   137

Query: 137 QFCLAPLFSTIAASLATDGLVMGPILFFVAMNTILTGIKLVTGMYGYRLGTSFIDKLSEQ   196
             F L P+ + I +S A+ G ++GPILFF A+   +++      GY +G    IDK+ E
Sbjct: 138 WFTLLPIMAGICSSFASQGNLLGPILFF-AVYLLIFFLRVGWTHVGYSVGVKAIDKVREN   196

Query: 197 MSVISRAANIVGVTVISSLAATQVKLTIPYTFAPEKVTSTTQKIVTVQGMLDKIAPALLP   256
           +I+R+A I+G+TVI  L A+ V + +  +FA        T  +  Q   DK+ P +LP
Sbjct: 197 SQMIARSATILGITVIGGLIASYVHINVVTSFA----IDNTHSVALQQDFFDKVFPNILP   252

Query: 257 ALYTFLMFYLIKNKKWTTYKLVILTVIIGILGSWLGIL                        294
            YT LM+Y ++ KK    L+ +T ++ I+ S   GIL
Sbjct: 253 MAYTLLMYYFLRVKKAHPVLLIGVTFVLSIVCSAFGIL                        290
```

A related DNA sequence was identified in *S. pyogenes* <SEQ ID 2357> which encodes the amino acid sequence <SEQ ID 2358>. Analysis of this protein sequence reveals the following:

```
    Possible site: 45
>>> Seems to have no N-terminal signal sequence
    INTEGRAL    Likelihood = -8.49    Transmembrane    276-292 (270-292)
    INTEGRAL    Likelihood = -7.01    Transmembrane    151-167 (149-176)
    INTEGRAL    Likelihood = -3.03    Transmembrane    202-218 (202-220)
    INTEGRAL    Likelihood = -2.13    Transmembrane    249-265 (248-265)

----- Final Results -----
            bacterial membrane --- Certainty = 0.4397 (Affirmative) < succ>
             bacterial outside --- Certainty = 0.0000 (Not Clear)   < succ>
           bacterial cytoplasm --- Certainty = 0.0000 (Not Clear)   < succ>
```

The protein has homology with the following sequences in the databases:

```
>GP: AAA57943 GB: U18997 ORF_o290; Geneplot suggests frameshift
linking to o267, not found [Escherichia coli]
Identities = 104/285 (36%), Positives = 162/285 (56%), Gaps = 7/285 (2%)

Query:     8 NKSMQQLSKEANKMTGSNKLTKKDYLKTALRAFFLQNGFNYNNYQGIGYANVIYPALKKH    67
             N+S   +  +      ++++KKD  +    R+  LQ  FNY   Q   G+    + P LKK
Sbjct:    13 NRSPLPVKMKKRTTAMGSEISKKDITRLGFRSSLLQASFNYERMQAGGFTWAMLPILKKI    72

Query:    68 FGNDKKGLYQALEDNCEFYNTNPHFLPFITSLHLVMLENNRPEEETRNIKMALMGPLAGI   127
             + +DK GL  A++DN EF NT+P+ + F+   L   + M E          + +K+AL GP+AGI
Sbjct:    73 YKDDKPGLSAAMKDNLEFINTHPNLVGFLMGLLISMEEKGENRDTIKGLKVALFGPIAGI   132

Query:   128 GDSLSQFCLAPLFSTIAASLASDGLVLGPILFFLAMNIILTAIKIGSGLYGYKVGTSFID   187
             GD++   F L P+ + I +S AS G +LGPILFF A+ +++   +++G     GY VG    ID
Sbjct:   133 GDAIFWFTLLPIMAGICSSFASQGNLLGPILFF-AVYLLIFFLRVGWTHVGYSVGVKAID   191

Query:   188 KLSEQMAVVSRMANIVGVTVIAGLAATSVKITVPITFAAGKVDAANTAQKFVTIQGMLDK   247
             K+ E   +++R A I+G+TVI GL A+ V I V  +FA        +    Q F        DK
Sbjct:   192 KVRENSQMIARSATILGITVIGGLIASYVHINVVTSFAIDNTHSVALQQDF------FDK   245

Query:   248 IAPALLPALFTLLMYYLIKNKKWTTYKLVILTVIIGVIGSWLGIL                292
             + P +LP  +TLLMYY ++ KK      L+ +T ++ ++ S   GIL
Sbjct:   246 VFPNILPMAYTLLMYYFLRVKKAHPVLLIGVTFVLSIVCSAFGIL                290
```

An alignment of the GAS and GBS proteins is shown below.

```
Identities = 224/288 (77%), Positives = 255/288 (87%), Gaps = 4/288 (1%)
Query:    12 HLLKKLRQ--KETTKMTGSKKLAKSDYTKTALRAFYLQNGFNYSNYQGLGYANVIYPALK    69
             +L K ++Q   KE   KMTGS KL K DY KTALRAF+LQNGFNY+NYQG+GYANVIYPALK
Sbjct:     6 NLNKSMQQLSKEANKMTGSNKLTKKDYLKTALRAFFLQNGFNYNNYQGIGYANVIYPALK    65

Query:    70 KYYGDDKKALAGALEENVEFYNTNPHFLPFVTSLHLAMLDNERPEEEIRGIKMALMGPLA   129
             K++G+DKK L   ALE+N EFYNTNPHFLPF+TSLHL ML+N RPEEE R IKMALMGPLA
Sbjct:    66 KHFGNDKKGLYQALEDNCEFYNTNPHFLPFITSLHLVMLENNRPEEETRNIKMALMGPLA   125

Query:   130 GIGDSLSQFCLAPLFSTIAASLATDGLVMGPILFFVAMNTILTGIKLVTGMYGYRLGTSF   189
             GIGDSLSQFCLAPLFSTIAASLA+DGLV GPILFF+AMN ILT IK+ +G+YGY++GTSF
Sbjct:   126 GIGDSLSQFCLAPLFSTIAASLASDGLVLGPILFFLAMNIILTAIKIGSGLYGYKVGTSF   185

Query:   190 IDKLSEQMSVISRAANIVGVTVISSLAATQVKLTIPYTFAPEKV--TSTTQKIVTVQGML   247
             IDKLSEQM+V+SR ANIVGVTVI+ LAAT VK+T+P TFA    KV   +T QK VT+QGML
Sbjct:   186 IDKLSEQMAVVSRMANIVGVTVIAGLAATSVKITVPITFAAGKVDAANTAQKFVTIQGML   245

Query:   248 DKIAPALLPALYTFLMFYLIKNKKWTTYKLVILTVIIGILGSWLGILA              295
             DKIAPALLPAL+T LM+YLIKNKKWTTYKLVILTVIIG++GSWLGILA
Sbjct:   246 DKIAPALLPALFTLLMYYLIKNKKWTTYKLVILTVIIGVIGSWLGILA              293
```

Based on this analysis, it was predicted that these proteins and their epitopes could be useful antigens for vaccines or diagnostics.

EXAMPLE 768

A DNA sequence (GBSx0816) was identified in *S. agalactiae* <SEQ ID 2359> which encodes the amino acid sequence <SEQ ID 2360>. Analysis of this protein sequence reveals the following:

```
Possible site: 58
>>> Seems to have no N-terminal signal sequence
INTEGRAL Likelihood = -0.37 Transmembrane 135-151 (135-151)

----- Final Results -----
              bacterial membrane --- Certainty = 0.1150 (Affirmative) < succ>
               bacterial outside --- Certainty = 0.0000 (Not Clear) < succ>
              bacterial cytoplasm --- Certainty = 0.0000 (Not Clear) < succ>
```

The protein has homology with the following sequences in the GENPEPT database.

```
>GP: CAB01924 GB: Z79691 OrfA [Streptococcus pneumoniae]
Identities = 76/206 (36%), Positives = 124/206 (59%), Gaps = 1/206 (0%)

Query:  428 SWTYNSYPKCDYCQLTSKDRYHLVEGQLHVQRASDIYYHKRWLLTLPQAITLVIDKVSCP  487
            SW Y  YP   +C    ++  H +EG          Y HKR +L L + + L++D + C
Sbjct:    2 SWEYEYYPHSLFCHHKEREGMHYIEGAYWSAEPDLPYLHKRKILMLVEDVWLLVDDIRCQ   61

Query:  488 GEHVLTNQYILDDQVIYENGFVNDLKLVSPTTFNLEDCLISKRYNQLTESHKLVKKIKFV  547
            G+H    Q+ILD  V Y++G +N L+L S    F+LED +IS +YN+L   S KL K+  F
Sbjct:   62 GQHEALTQFILDKDVTYQDGKINQLRLWSEVDFDLEDTIISPKYNELERSSKLTKRQFFE  121

Query:  548 DEVMDYTLIVDRNCQVKYVPLVQTNSHKELSNSIAFDIRSQDFHYLIGVLMDDIIFGDKL  607
            ++++DYT+I  + ++    + QT+  +E+ N++AF++++ +    LI +L +DI  G+KL
Sbjct:  122 NQMLDYTIIAHESFEIIRHSVYQTDD-REVENALAFEVKNDETDKLILLLSEDIRVGEKL  180

Query:  608 YLMQGIKCKGKVIVYDKNNGKMSRLK                                   633
            L+  G  K +GK +VYDK N +M  RL+
Sbjct:  181 CLVDGTKMRGKCLVYDKINERMIRLQ                                   206
```

A related DNA sequence was identified in *S. pyogenes* <SEQ ID 2361> which encodes the amino acid sequence <SEQ ID 2362>. Analysis of this protein sequence reveals the following:

```
Possible site: 53
>>> Seems to have no N-terminal signal sequence
INTEGRAL Likelihood = -2.55 Transmembrane 477-493 (477-493)

----- Final Results -----
            bacterial membrane --- Certainty = 0.2020 (Affirmative) < succ>
             bacterial outside --- Certainty = 0.0000 (Not Clear)  < succ>
            bacterial cytoplasm --- Certainty = 0.0000 (Not Clear)  < succ>
```

The protein has homology with the following sequences in the databases:

```
>GP: CAB01924 GB: Z79691 OrfA [Streptococcus pneumoniae]
Identities = 75/207 (36%), Positives = 125/207 (60%), Gaps = 2/207 (0%)

Query:  434 SWAYLSYPKSNYCHLRQNGHVYFIEGSYQTQFSDRNNYQHDRQILILPPGIFLIIDTIQA  493
            SW Y  YP S +CH ++   +++IEG+Y +   D    Y H R+IL+L   ++L++D I+
Sbjct:    2 SWEYEYYPHSLFCHHKEREGMHYIEGAYWSAEPDLP-YLHKRKILMLVEDVWLLVDDIRC   60

Query:  494 QGNHCLVSQFILDNHLDVKTDHLSDLRLISDCPFTIEETILSKKYNQYLTSHKLIKRKPF  553
            QG H  ++QFILD + +  ++ LRL S+  F +E+TI+S KYN+   S KL KR+ F
Sbjct:   61 QGQHEALTQFILDKDVTYQDGKINQLRLWSEVDFDLEDTIISPKYNELERSSKLTKRQFF  120

Query:  554 KDKGCTSTLLVPDDTKVTPLTPLQTGKRNPIETALSWHLKGKQFDYSICVLQEDLIKGEK  613
            +++    T++    + ++     +  QT R  +E AL++ +K  + D  I +L ED+  GEK
Sbjct:  121 ENQMLDYTIIAHESFEIIRHSVYQTDDRE-VENALAFEVKNDETDKLILLLSEDIRVGEK  179

Query:  614 LVLLNSHKIRGKVVVINHITNEIIRLK                                  640
            L L++  K+RGK +V + I    +IRL+
Sbjct:  180 LCLVDGTKMRGKCLVYDKINERMIRLQ                                  206
```

An alignment of the GAS and GBS proteins is shown below.

```
Identities = 282/631 (44%), Positives = 414/631 (64%), Gaps = 2/631 (0%)

Query:    6 YNKFKD-FDREFCQKYIKTYQSNAYQEMKASVNLMMRNTFVFNDNWDMEPCSKAYCLDPL   64
            + +FK+  + +FC+ Y+   YQ+++Y + K     +L++ NTF+F DNWDMEPC   Y LDP+
Sbjct:   11 FARFKETVNPDFCRNYLLDYQTDSYADQKRIADLLLTNTFLFEDNWDMEPCHIPYHLDPI   70

Query:   65 EWDKPVTDDPEWLYMLNRQTYLFKFLVVYIVEGDKSYLRQMKYFMYHWIDCQFTLKPEGA  124
              W + V DDPEW +MLNRQTYL K  ++VY+VE D+ YL   K F+ +WI+     L P+G
Sbjct:   71 TWQEAVIDDPEWNFMLNRQTYLQKLILVYLVERDERYLLTAKGFILNWIESAIPLDPKGL  130
```

```
                                -continued
Query:  125 VSRTIDTGIRCMSWLKVLIFLDYFGLITETKKIKLLTSLREQITYMRDYYREKDSLSNWG  184
            +RT+DTGIRC +W+K LI+L+ F  +T+ ++  +L SL +Q+ ++    Y +K SLSNWG
Sbjct:  131 ATRTLDTGIRCFAWVKCLIYLNLFNALTKQEESLILASLEKQLQFLHANYLDKYSLSNWG  190

Query:  185 ILQTTAILACLYYYEDELNLPEIQSFAEEELLLQIKLQILDDGSQYEQSIMYHVEVLKSL  244
            ILQTTAIL    Y+ +L++     +FA +EL  QI LQIL+DGSQ+EQS MYHVEVLK+L
Sbjct:  191 ILQTTAILLADAYFGSDLDIAAATAFARKELTQQIALQILEDGSQFEQSTMYHVEVLKAL  250

Query:  245 MELVILAPKYYLPLEETIEKMVTYLIAMTGPDYCQLAIGDSDVTDTRDILTLATLVLKSS  304
            +EL   L P Y   L  T+  M  YL+ MTGPD+ Q+ +GDSDVTDTRDILTLA  +L+
Sbjct:  251 LELTALVPDYLPQLRPTLLAMSDYLLKMTGPDHKQIPLGDSDVTDTRDILTLAATILEEP  310

Query:  305 KTKSFSFDNVNLETLLLFGKPSIYLFEEIPRATIGESAYLFPDSGHVCLRDDRRYIFFKN  364
            K+ +F  +++++LLL G+  ++ FE++P  T+    A+ F  SGH+ +  +  Y+FFKN
Sbjct:  311 HLKAAAFPTLDIDSLLLLGEKGVHTFEQLPVQTLPTFAHHFEHSGHITINQENYYLFFKN  370

Query:  365 GPFGSAHTHSDNNSVCLYDKKKPIFIDAGRYTYKEEQLRYDFKRSTSHSTCTLDGQPLEM  424
            GP GS++HTHSD NS+CLY K +P+F DAGRYTYKEE LRY  K ++ HST  L+ Q  E
Sbjct:  371 GPIGSSHTHSDQNSLCLYYKGQPLFCDAGRYTYKEEPLRYALKSASHHSTAFLEEQLPEQ  430

Query:  425 IKDSWTYNSYPKCDYCQLTSKDRYHLVEGQLHVQRAS-DIYYHKRWLLTLPQAITLVIDK  483
            I   SW Y  SYPK +YC L      + +EG   Q +   + Y H R +L LP   I L+ID
Sbjct:  431 IDSSWAYLSYPKSNYCHLRQNGHVYFIEGSYQTQFSDRNNYQHDRQILILPPGIFLIIDT  490

Query:  484 VSCPGEHVLTNQYILDDQVIYENGFVNDLKLVSPTTFNLEDCLISKRYNQLTESHKLVKK  543
            +      G H L +Q+ILD+ +  +    ++DL+L+S    F +E+ ++SK+YNQ   SHKL+K+
Sbjct:  491 IQAQGNHCLVSQFILDNHLDVKTDHLSDLRLISDCPFTIEETILSKKYNQYLTSHKLIKR  550

Query:  544 IKFVDEVMDYTLIVDRNCQVKYVPLVQTNSHKELSNSIAFDIRSQDFHYLIGVLMDDIIF  603
                F  D+    TL+V + +V +  +QT      + ++++ ++ + F Y I VL +D+I
Sbjct:  551 KPFKDKGCTSTLLVPDDTKVTPLTPLQTGKRNPIETALSWHLKGKQFDYSICVLQEDLIK  610

Query:  604 GDKLYLMQGIKCKGKVIVYDKNNGKMSRLKN                              634
            G+KL L+    K +GKV+V +     ++ RLK+
Sbjct:  611 GEKLVLLNSHKIRGKVVVINHITNEIIRLKH                              641
```

Based on this analysis, it was predicted that these proteins and their epitopes could be useful antigens for vaccines or diagnostics.

EXAMPLE 769

A DNA sequence (GBSx0817) was identified in *S. agalactiae* <SEQ ID 2363> which encodes the amino acid sequence <SEQ ID 2364>. This protein is predicted to be RegR (kdgR). Analysis of this protein sequence reveals the following:

```
Possible site: 57
>>> Seems to have no N-terminal signal sequence

----- Final Results -----
            bacterial cytoplasm --- Certainty = 0.2545 (Affirmative) < succ>
            bacterial membrane  --- Certainty = 0.0000 (Not Clear)   < succ>
            bacterial outside   --- Certainty = 0.0000 (Not Clear)   < succ>
```

The protein has homology with the following sequences in the GENPEPT database.

```
>GP: CAB01925 GB: Z79691 RegR [Streptococcus pneumoniae]
Identities = 222/333 (66%), Positives = 279/333 (83%)

Query:    1 MSKKMTINDIAQLSKTSKTTVSFFLNQKFEKMSDETRQRIQEVIDETGYRPSTIARSLNS   60
            M KK+TI DIA++++TSKTTVSF+LN K+EKMS ETR++I++VI ET Y+PS +ARSLNS
Sbjct:    1 MEKKLTIKDIAEMAQTSKTTVSFYLNGKYEKMSQETREKIEKVIHETNYKPSIVARSLNS   60

Query:   61 KKTKLLGVLIGDITNTFSNQIVKGIEHITKQKGYQIIVGNSNYDAKSEEDYIENMLNLGV  120
            K+TKL+GVLIGDITN+FSNQIVKGIE I  Q GYQ+++GNSNY  +SE+ YIE+ML LGV
Sbjct:   61 KRTKLIGVLIGDITNSFSNQIVKGIEDIASQNGYQVMIGNSNYSQESEDRYIESMLLLGV  120

Query:  121 DGFIIQPTSNFRKYSRILKEKKKPMVFFDSQLYEHKTSWVKANNYDAVYDMTQECLNRGY  180
            DGFIIQPTSNFRKYSRI+ EKKK MVFFDSQLYEH+TSWVK NNYDAVYDMTQ C+ +GY
Sbjct:  121 DGFIIQPTSNFRKYSRIIDEKKKKMVFFDSQLYEHRTSWVKTNNYDAVYDMTQSCIEKGY  180

Query:  181 KKFIMITADTSLLSTRIERASGFMDALKDNGFGYDTLVIEDDDHSKSDIEDFLKAVVPDK  240
               + F+++ITADTS LSTRIERASGF+DAL D    + +L IED    I++FL+    +
Sbjct:  181 EYFLLITADTSRLSTRIERASGFVDALTDANMRHASLTIEDKHTNLEQIKEFLQKEIDPD  240
```

```
-continued
Query: 241 EETLVFAPNCWALPMVFTAMKNLNFDMPRVGLVGFDNIEWTDFSSPKVSTIVQPAYEEGE 300
            E+TLVF PNCWALP+VFT +K LN+++P+VGL+GFDN EWT FSSP VST+VQP++EEG+
Sbjct: 241 EKTLVFIPNCWALPLVFTVIKELNYNLPQVGLIGFDNTEWTCFSSPSVSTLVQPSFEEGQ 300

Query: 301 QVAQILINRIEGDDSVDNQQIVDCQMFWKESTF                             333
            Q  +ILI++IEG +  + QQ++DC + WKESTF
Sbjct: 301 QATKILIDQIEGRNQEERQQVLDCSVNWKESTF                             333
```

A related DNA sequence was identified in *S. pyogenes* <SEQ ID 2365> which encodes the amino acid sequence <SEQ ID 2366>. Analysis of this protein sequence reveals the following:

```
Possible site: 45
>>> Seems to have no N-terminal signal sequence

----- Final Results -----
            bacterial cytoplasm --- Certainty = 0.2928 (Affirmative) < succ>
             bacterial membrane --- Certainty = 0.0000 (Not Clear)  < succ>
              bacterial outside --- Certainty = 0.0000 (Not Clear)  < succ>
```

An alignment of the GAS and GBS proteins is shown below.

```
Identities = 214/333 (64%), Positives = 266/333 (79%), Gaps = 2/333 (0%)

Query:   1 MSKKMTINDIAQLSKTSKTTVSFFLNQKFEKMSDETRQRIQEVIDETGYRPSTIARSLNS  60
           M +K+TI DIA+L+KTSKTTVSF+LN +F+KMS+ET+ RI E I   T Y+PS   ARSLN+
Sbjct:  13 MQRKVTIKDIAELAKTSKTTVSFYLNGRFDKMSEETKNRISESIKATNYKPSIAARSLNA  72

Query:  61 KKTKLLGVLIGDITNTFSNQIVKGIEHITKQKGYQIIVGNSNYDAKSEEDYIENMLNLGV 120
           K TKL+GV+IGDITN+FSNQIVKGIE   ++ GYQII+GNSNYD   E++ IE MLNLGV
Sbjct:  73 KSTKLIGVVIGDITNSFSNQIVKGIESKAQEFGYQIIIGNSNYDPSREDELIEKMLNLGV 132

Query: 121 DGFIIQPTSNFRKYSRILKEKKKPMVFFDSQLYEHKTSWVKANNYDAVYDMTQECLNRGY 180
           DGFIIQPTSNFRKYSRI+  KKK +VFFDSQLYEH+T+WVK NNYDAVYD  Q+C+++GY
Sbjct: 133 DGFIIQPTSNFRKYSRIIDIKKKKVVFFDSQLYEHRTNWVKTNNYDAVYDTIQQCIDKGY 192

Query: 181 KKFIMITADTSLLSTRIERASGFMDALKDNGFGYDTLVIEDDDHSKSDIEDFLKAVVPDK 240
           + FIMIT + +LLSTRIERASGF+D L+ N  + ++I+++  S   I  FL+  + K
Sbjct: 193 EHFIMITGNPNLLSTRIERASGFIDVLEANHLTHQEMIIDENQTSSEAIAQFLQGSLTKK 252

Query: 241 EETLVFAPNCWALPMVFTAMKNLNFDMPRVGLVGFDNIEWTDFSSPKVSTIVQPAYEEGE 300
            +LVF PNCWALP VFTAMK+L F++P +GLVGFDNIEWT FSSP ++TI+QPAYEEGE
Sbjct: 253 --SLVFVPNCWALPKVFTAMKSLKFNIPEIGLVGFDNIEWTKFSSPTLTTIIQPAYEEGE 310

Query: 301 QVAQILINRIEGDDSVDNQQIVDCQMFWKESTF                             333
           Q  +ILI+ IEG     QQI DCQ+ W+ESTF
Sbjct: 311 QATKILIDDIEGHSQEAKQQIFDCQVNWQESTF                             343
```

Based on this analysis, it was predicted that these proteins and their epitopes could be useful antigens for vaccines or diagnostics.

EXAMPLE 770

A DNA sequence (GBSx0818) was identified in *S. agalactiae* <SEQ ID 2367> which encodes the amino acid sequence <SEQ ID 2368>. This protein is predicted to be polypeptide defromylase (def-1). Analysis of this protein sequence reveals the following:

```
Possible site: 56
>>> Seems to have no N-terminal signal sequence

----- Final Results -----
            bacterial cytoplasm --- Certainty = 0.2339 (Affirmative) < succ>
             bacterial membrane --- Certainty = 0.0000 (Not Clear)  < succ>
              bacterial outside --- Certainty = 0.0000 (Not Clear)  < succ>
```

The protein has homology with the following sequences in the GENPEPT database.

```
>GP: CAC15392 GB: AJ278785 polypeptide deformylase
[Streptococcus pneumoniae]
Identities = 169/204 (82%), Positives = 192/204 (93%), Gaps = 1/204 (0%)

Query:    1 MSAIDKLVKASHLIDMNDIIREGNPTLRKVAEEVTFPLSEKEEILGEKMMQFLKHSQDPI   60
            MSAI+++ KA+HLIDMNDIIREGNPTLR +AEEVTFPLS++E ILGEKMMQFLKHSQDP+
Sbjct:    1 MSAIERITKAAHLIDMNDIIREGNPTLRAIAEEVTFPLSDQEIILGEKMMQFLKHSQDPV   60

Query:   61 MAEKLGLRGGVGLAAPQLDISKRIIAVLVPNVEDAQGNPPKEAYSLQEVMYNPKVVSHSV  120
            MAEK+GLRGGVGLAAPQLDISKRIIAVLVPN+ + +G   P+EAY L+ +MYNPK+VSHSV
Sbjct:   61 MAEKMGLRGGVGLAAPQLDISKRIIAVLVPNIVE-EGETPQEAYDLEAIMYNPKIVSHSV  119

Query:  121 QDAALSDGEGCLSVDREVPGYVVRHARVTIEYFDKTGEKHRLKLKGYNSIVVQHEIDHID  180
            QDAAL +GEGCLSVDR VPGYVVRHARVT++YFDK GEKHR+KLKGYNSIVVQHEIDHI+
Sbjct:  120 QDAALGEGEGCLSVDRNVPGYVVRHARVTVDYFDKDGEKHRIKLKGYNSIVVQHEIDHIN  179

Query:  181 GIMFYDRINEKNPFAVKEGLLILE                                     204
            GIMFYDRINEK+PFAVK+GLLILE
Sbjct:  180 GIMFYDRINEKDPFAVKDGLLILE                                     203
```

A related DNA sequence was identified in *S. pyogenes* <SEQ ID 2369> which encodes the amino acid sequence <SEQ ID 2370>. Analysis of this protein sequence reveals the following:

```
Possible site: 56
>>> Seems to have no N-terminal signal sequence

----- Final Results -----
        bacterial cytoplasm --- Certainty = 0.1745 (Affirmative) < succ>
         bacterial membrane --- Certainty = 0.0000 (Not Clear)  < succ>
          bacterial outside --- Certainty = 0.0000 (Not Clear)  < succ>
```

An alignment of the GAS and GBS proteins is shown below.

```
Identities = 160/204 (78%), Positives = 186/204 (90%)

Query:    1 MSAIDKLVKASHLIDMNDIIREGNPTLRKVAEEVTFPLSEKEEILGEKMMQFLKHSQDPI   60
            MSA DKL+K SHLI M+DIIREGNPTLR VA+EV+ PL +++ +LGEKMMQFLKHSQDP+
Sbjct:    1 MSAQDKLIKPSHLITMDDIIREGNPTLRAVAKEVSLPLCDEDILLGEKMMQFLKHSQDPV   60

Query:   61 MAEKLGLRGGVGLAAPQLDISKRIIAVLVPNVEDAQGNPPKEAYSLQEVMYNPKVVSHSV  120
            MAEKLGLR GVGLAAPQ+D+SKRIIAVLVPN+ D +GNPPKEAYS QEV+YNPK+VSHSV
Sbjct:   61 MAEKLGLRAGVGLAAPQIDVSKRIIAVLVPNLPDKEGNPPKEAYSWQEVLYNPKIVSHSV  120

Query:  121 QDAALSDGEGCLSVDREVPGYVVRHARVTIEYFDKTGEKHRLKLKGYNSIVVQHEIDHID  180
            QDAALSDGEGCLSVDR V GYVVRHARVT++Y+DK G++HR+KLKGYN+IVVQHEIDHI+
Sbjct:  121 QDAALSDGEGCLSVDRVVEGYVVRHARVTVDYYDKEGQQHRIKLKGYNAIVVQHEIDHIN  180

Query:  181 GIMFYDRINEKNPFAVKEGLLILE                                     204
            G++FYDRIN KNPF  KE LLIL+
Sbjct:  181 GVLFYDRINAKNPFETKEELLILD                                     204
```

Based on this analysis, it was predicted that these proteins and their epitopes could be useful antigens for vaccines or diagnostics.

EXAMPLE 771

A DNA sequence (GBSx0819) was identified in *S. agalactiae* <SEQ ID 2371> which encodes the amino acid sequence <SEQ ID 2372>. Analysis of this protein sequence reveals the following:

```
Possible site: 46
>>> Seems to have no N-terminal signal sequence

----- Final Results -----
        bacterial cytoplasm --- Certainty = 0.3620 (Affirmative) < succ>
         bacterial membrane --- Certainty = 0.0000 (Not Clear)  < succ>
          bacterial outside --- Certainty = 0.0000 (Not Clear)  < succ>
```

A related GBS nucleic acid sequence <SEQ ID 10177> which encodes amino acid sequence <SEQ ID 10178> was also identified.

The protein has homology with the following sequences in the GENPEPT database.

```
>GP: AAC75224 GB: AE000305 putative transcriptional regulator
[Escherichia coli K12]
Identities = 58/191 (30%), Positives = 98/191 (50%)

Query:   37 DLQVITLTAGQSVCKQGEQLEYLHYIVKGRFKIVRRLFNGKEHILDIKTKPTLIGDIELL    96
             D ++    A   + ++G+Q  +L Y+ +GR ++    L NG+   ++D     P  IG+IEL+
Sbjct:   17 DTRLFHFLARDYIVQEGQQPSWLFYLTRGRARLYATLANGRVSLIDFFAAPCFIGEIELI    76

Query:   97 TNRQIVSSVIALEDLTVIQLSLKGRKEKLLTDATFLLKLSQELAQAFHDQNIKASTNLGY   156
                 +V A+E+   + L +K  +  LL D  FL KL    L+  +   +   + N  +
Sbjct:   77 DKDHEPRAVQAIEECWCLALPMKHYRPLLLNDTLFLRKLCVTLSHKNYRNIVSLTQNQSF   136

Query:  157 TVKELLASHILAIEEQGYFQLELSSLADSFGVSYRHLLRVIHDMVKEGLIQKEKPKYFIK   216
                 +    LA+ IL  +E  +  + +  A+   GVSYRHLL  V+     + +GL+ K K   Y IK
Sbjct:  137 PLVNRLAAFILLSQEGDLYHEKHTQAAEYLGVSYRHLLYVLAQFIHDGLLIKSKKGYLIK   196

Query:  217 NRFALESLNIQ                                                   227
             NR    L    L ++
Sbjct:  197 NRKQLSGLALE                                                   207
```

A related DNA sequence was identified in *S. pyogenes* <SEQ ID 2373> which encodes the amino acid sequence <SEQ ID 2374>. Analysis of this protein sequence reveals the following:

```
Possible site: 27
>>> Seems to have no N-terminal signal sequence

----- Final Results -----
            bacterial cytoplasm --- Certainty = 0.3809 (Affirmative) < succ>
             bacterial membrane --- Certainty = 0.0000 (Not Clear)   < succ>
              bacterial outside --- Certainty = 0.0000 (Not Clear)   < succ>
```

An alignment of the GAS and GBS proteins is shown below.

```
Identities = 23/63 (36%), Positives = 35/63 (55%), Gaps = 1/63 (1%)

Query:  146 QNIKASTNLGYTVKELLASHILAIEEQGYFQLELSSLADSFGVSYRHLLRVIHDMVKEGL   205
             QN+    N+  YTVKE   AS+ L  +       L L+ LA+ FG S RHL  V+    + + +
Sbjct:    3 QNV-CQQNITYTVKERFASYTLEAQANQEVHLNLTLLANRFGTSDRHLKHVLKQPIFQRI    61

Query:  206 IQK                                                          208
             I++
Sbjct:   62 IER                                                          64
```

Based on this analysis, it was predicted that these proteins and their epitopes could be useful antigens for vaccines or diagnostics.

EXAMPLE 772

A DNA sequence (GBSx0820) was identified in *S. agalactiae* <SEQ ID 2375> which encodes the amino acid sequence <SEQ ID 2376>. Analysis of this protein sequence reveals the following:

```
Possible site: 54
>>> Seems to have a cleavable N-term signal seq.
        INTEGRAL     Likelihood = -9.24    Transmembrane        163-179 (159-185)
        INTEGRAL     Likelihood = -8.49    Transmembrane        204-220 (201-226)
        INTEGRAL     Likelihood = -7.80    Transmembrane        272-288 (269-296)
        INTEGRAL     Likelihood = -6.00    Transmembrane        333-349 (331-352)
        INTEGRAL     Likelihood = -5.41    Transmembrane         75-91  (73-92)
        INTEGRAL     Likelihood = -4.94    Transmernbrane       245-261 (240-262)
```

```
           -continued
INTEGRAL    Likelihood = -4.41    Transmernbrane        362-378 (359-380)
INTEGRAL    Likelihood = -4.14    Transmembrane          96-112 (95-113)
INTEGRAL    Likelihood = -2.44    Transmembrane         141-157 (141-158)
INTEGRAL    Likelihood = -1.81    Transmembrane         302-318 (301-320)

----- Final Results -----
            bacterial membrane --- Certainty = 0.4694 (Affirmative) < succ>
             bacterial outside --- Certainty = 0.0000 (Not Clear) < succ>
            bacterial cytoplasm --- Certainty = 0.0000 (Not Clear) < succ>
```

A related GBS nucleic acid sequence <SEQ ID 8659> which encodes amino acid sequence <SEQ ID 8660> was also identified. Analysis of this protein sequence reveals the following:

```
Lipop: Possible site: -1 Crend: 7
McG: Discrim Score: -3.52
GvH: Signal Score (-7.5): 0.340001
     Possible site: 25
>>> Seems to have no N-terminal signal sequence
ALOM program count: 11 value: -9.24 threshold: 0.0
       INTEGRAL    Likelihood = -9.24    Transmembrane        134-150 (130-156)
       INTEGRAL    Likelihood = -8.60    Transmembrane         17-33 (13-37)
       INTEGRAL    Likelihood = -8.49    Transmembrane        175-191 (172-197)
       INTEGRAL    Likelihood = -7.80    Transmembrane        243-259 (240-267)
       INTEGRAL    Likelihood = -6.00    Transmembrane        304-320 (302-323)
       INTEGRAL    Likelihood = -5.41    Transmembrane         46-62 (44-63)
       INTEGRAL    Likelihood = -4.94    Transmembrane        216-232 (211-233)
       INTEGRAL    Likelihood = -4.41    Transmembrane        333-349 (330-351)
       INTEGRAL    Likelihood = -4.14    Transmembrane         67-83 (66-84)
       INTEGRAL    Likelihood = -2.44    Transmembrane        112-128 (112-129)
       INTEGRAL    Likelihood = -1.81    Transmembrane        273-289 (272-291)
PERIPHERAL  Likelihood = 3.45 193
modified ALOM score: 2.35

*** Reasoning Step: 3

----- Final Results -----
            bacterial membrane --- Certainty = 0.4694 (Affirmative) < succ>
             bacterial outside --- Certainty = 0.0000 (Not Clear) < succ>
            bacterial cytoplasm --- Certainty = 0.0000 (Not Clear) < succ>
```

The protein has homology with the following sequences in the GENPEPT database.

```
>GP: CAB50057 GB: AJ248286 TRANSPORT PROTEIN, permease [Pyrococcus abyssi]
Identities = 94/382 (24%), Positives = 173/382 (44%), Gaps = 30/382 (7%)

Query:    5 MEKLSLLSL-SLILLSTFSTSPALPQMISYY-RDKGLPSPQVELLFSIPSMAIIFILLIT    62
            MEKL +L L SL  +  +S   A+P +      +D G+ + ++ LL +    +   I +
Sbjct:    1 MEKLIILILISLGWIFNYSHRMAVPSLAPIIMKDLGINNAEIGLLMTSLLLPYSLIQVPA   60

Query:   63 PWLSKKLSEKHMIIFGLLLTALGGGLPVVSQNYLLVFVSRLLLGSGIGFINTRAISVISE  122
            ++  K+ K ++    +L  +L    L  V++++Y   +  R L G   G     A ++ISE
Sbjct:   61 GYIGDKIGRKKLLTISILGYSLSSALIVLTRDYWDLVTVRALYGFFAGLYYAPATALISE  120

Query:  123 YYQGKERRKLLGLRGSFEVLGNA---GLTAL--VGLLLTFGWSKSFMIYFLALPILVLYL  177
            ++ ++     L        F ++G A    G+T L  V + LT  W  +F++  +  I+ + L
Sbjct:  121 LFRERKGSAL-----GFFMVGPAIGSGITPLIVVPVALTLSWRYAFLVLSIMSSIVGILL  175

Query:  178 VFAPKKVVKDTNDKIKTKGQKIPKADLTYIVALAILAGFVITINTGINLRIPLLVVEFGL  237
             + A K       + IK +G K      ++++LA   G       +      +   LV  G+
Sbjct:  176 MVAIK------GEPIKVEGVKFKIPRGVFLLSLANFLGLGAFFAM-LTFLVSYLVSR-GV  227

Query:  238 GTPAQASLVLSAMMLMGIIAGMSFGQLIAMFHKQLIPICLVLFS-LTLLGVGLPSNLNVL  296
            G    +ASL+ S + L+GI+    G L    K  +   + L S LT L + +PS L ++
Sbjct:  228 GME-KASLMFSMLSLVGILGSIIAGFLYDHLGKVSVLLAYALNSLLTFLVIVIPSPLFLI  286
```

```
                              -continued
Query:  297 TISAMASGFLYSL--MVTAVFSLVADRVEYSLVGSATTLVLVF-CNIGGASAAILLSCFD  353
            +  +      LYS+  ++TA  S  A R     +V     +V  F   IG      L+
Sbjct:  287 PLGLV----LYSVGGIMTAYTSEKASRENLGVVMGFVNMVGFFGATIGPYIVGFLIDRLG  342

Query:  354 HLLGQINAVFYVYAILSLAVGM                                        375
            + L   + +V   Y + ++ +G+
Sbjct:  343 YSLALL-SVPLAYLVSAVIIGL                                        363
```

There is also homology to SEQ ID 2378.

Based on this analysis, it was predicted that these proteins and their epitopes could be useful antigens for vaccines or diagnostics.

EXAMPLE 773

A DNA sequence (GBSx0821) was identified in *S. agalactiae* <SEQ ID 2379> which encodes the amino acid sequence <SEQ ID 2380>. Analysis of this protein sequence reveals the following:

```
Possible site: 23
>>> Seems to have no N-terminal signal sequence
      INTEGRAL      Likelihood = -1.38     Transmembrane      171-187 (171-187)

----- Final Results -----
               bacterial membrane --- Certainty = 0.1553 (Affirmative) < succ>
                bacterial outside --- Certainty = 0.0000 (Not Clear)   < succ>
               bacterial cytoplasm --- Certainty = 0.0000 (Not Clear)   < succ>
```

The protein has homology with the following sequences in the GENPEPT database.

```
>GP: CAB61731 GB: AL133220 putative oxidoreductase. [Streptomyces
coelicolor A3(2)]
Identities = 101/327 (30%), Positives = 169/327 (50%), Gaps = 12/327 (3%)

Query:    8 WATLGTGVIANEL-AQALEARGQKLYSVANRTYDKGLEFATKYGIQKVYDHIDQVFEDPE   66
            W  L TG +A      A   ++    ++ +VA+RT      FA ++GI  +  Y    +   +   D +
Sbjct:   11 WGILATGGMAARFTADLVDLPDAEVVAVASRTEASAKTFAERFGIPRAYGGWETLARDED   70

Query:   67 VDIIYISTPHNTHISFLRKALANGKHVLCEKSITLNSTELKEAIDLAETNHVVLAEAMTI  126
            VD++Y++TPH+ H +     L  G++VLCEK  TLN+  E   E  + LA   N V L  EAM +
Sbjct:   71 VDVVYVATPHSAHRTAAGLCLEAGRNVLCEKPFTLNAREAAELVALARENGVFLMEAMWM  130

Query:  127 FHMPIYRQLKTLVDSGKLGPLKMIQMNFGSYKEYDMTNRFFSRDLAGGALLDIGVYALSC  186
              +  P+ R+LK LV  G +G ++  +Q FG        +R        GGALLD+GVY +S
Sbjct:  131 YCNPLVRRLKELVADGAIGEVRSLQADFGLAGPFPAAHRLRDPAQGGGALLDLGVYPVSF  190

Query:  187 IRWFMSEAPHNITSQVTFAPTGVDEQVGILLTNPANEMATVSLSLHAKQPKRATIAYDKG  246
               +  + E P ++ ++     +  GVD Q G LL+    + +A++  S+      P   A+I    +G
Sbjct:  191 AQLLLGE-PTDVAARAVLSEEGVDLQTGALLSYGNDALASIHCSITGGTPNSASITGSEG  249

Query:  247 YIEL---FEYPRGQKAVITYTEDGHQDIL--EAGKTENALQYEVADMEEAV-SGKTNH--  298
            I++      F  +P      V+    T     Q+          A     +L++E  ++  A+  +G+T
Sbjct:  250 RIDVPNGFFFP--DHFVLHRTGRDPQEFRADPADGPRESLRHEAEEVMRALRAGETESPL  307

Query:  299 MYLNYTKDVMDIMTQLRQEWGFTYPEE                                  325
              + L+ T    VM   + +R    G   YP E
Sbjct:  308 VPLDGTLAVMRTLDAIRDRVGVRYPGE                                  334
```

Based on this analysis, it was predicted that this protein and its epitopes, could be useful antigens for vaccines or diagnostics.

EXAMPLE 774

A DNA sequence (GBSx0822) was identified in *S. agalactiae* <SEQ ID 2381> which encodes the amino acid sequence <SEQ ID 2382>. This protein is predicted to be oligopeptidase. Analysis of this protein sequence reveals the following:

```
Possible site: 19
>>> Seems to have no N-terminal signal sequence

----- Final Results -----
            bacterial cytoplasm --- Certainty = 0.2881 (Affirmative) < succ>
             bacterial membrane --- Certainty = 0.0000 (Not Clear)   < succ>
              bacterial outside --- Certainty = 0.0000 (Not Clear)   < succ>
```

The protein has homology with the following sequences in the GENPEPT database.

```
>GP: CAC14579 GB: AJ249396 oligopeptidase [Streptococcus thermophilus]
Identities = 504/631 (79%), Positives = 563/631 (88%)

Query:    1 MIKYQDDFYQAVNGEWAKTAVIPDDKPRTGGFSDLADDIEALMLSTTDKWLADENKPSDT    60
            M + QDDFY A+NGEW KTAVIPDDKP TGGFSDLAD+IE LML TTD+WLA EN P +
Sbjct:    1 MTRLQDDFYHAINGEWEKTAVIPDDKPCTGGFSDLADEIEDLMLETTDQWLAGENVPDNA   60

Query:   61 ILNHFIAFHKMTADYQKREEVGVSPVLPLIEEYKGLQSFSEFASKVAEYELEGKPNEFPF  120
            IL +FI FH+MTADY +RE VG+ PV PLIEEYK L SFSEFASK+AEYE+ GKPNEFPF
Sbjct:   61 ILQNFIKFHRMTADYDRREAVGIEPVKPLIEEYKKLSSFSEFASKIAEYEMSGKPNEFPF  120

Query:  121 GVAPDFMNAQLNVLWAEAPGIILPDTTYYSEDNEKGKELLAFWRKSQEDLLPLFGLSEQE  180
             V+PDFMNAQLNVLWA+APGIILPDTTYY+EDNEKGKELL WR+ QE+LL   +G + +E
Sbjct:  121 SVSPDFMNAQLNVLWADAPGIILPDTTYYTEDNEKGKELLEIWREMQEELLGKYGFTAEE  180

Query:  181 IKDILDKVLALDAKLAQYVLSREESSEYVKLYHPYNWEDFTKLAPELPLDAIFQKILGQK  240
            IKD+LDKV+ LDAKLA+YVLS EESSEYV+LYHPY+W DFTKLAPELPLD+IF +ILGQ
Sbjct:  181 IKDLLDKVIDLDAKLAKYVLSHEESSEYVELYHPYDWADFTKLAPELPLDSIFTEILGQV  240

Query:  241 PDKVIVPEERFWTEFASDYYSESNWELLKADLILSAANAYNAYLTDDIRIKSGVYSRALS  300
            PDKVIV EE FWTEFA++YYSE+NWELLKA L++ A  ++NAYLTD++R+ SG YSRALS
Sbjct:  241 PDKVIVSEESFWTEFAAEYYSEANWELLKAVLLIDATTSWNAYLTDELRVLSGKYSRALS  300

Query:  301 GTPQAMDKKKAAYYLASGPYNQALGLWYAGEKFSPEAKADVEHKIATMIDVYKSRLEKAD  360
            GTPQAMDKKKAA+YLA GPYNQALGLWYAGEKFSPEAKADVE K+ATMIDVYKSRL+ AD
Sbjct:  301 GTPQAMDKKKAAFYLAQGPYNQALGLWYAGEKFSPEAKADVEAKVATMIDVYKSRLQTAD  360

Query:  361 WLAQSTREKAIMKLNVITPHIGYPEKLPETYTKKIIDPKLSLVENATNLDKISIAYGWSK  420
            WLA   TREKAI KLNVITPHIGYPEKLPETY KKIID  LSLVENA  L +ISIA+ WSK
Sbjct:  361 WLAPETREKAITKLNVITPHIGYPEKLPETYDKKIIDENLSLVENAQKLVEISIAHSWSK  420

Query:  421 WNKPVDRSEWHMPAHMVNAYYDPQQNQIVFPAAILQEPFYALEQSSSANYGGIGAVIAHE  480
            WNKPVDRSEWHMPAHMVNAYYDPQQNQIVFPAAILQ PFY + QSSSANYGGIGAVIAHE
Sbjct:  421 WNKPVDRSEWHMPAHMVNAYYDPQQNQIVFPAAILQAPFYDIAQSSSANYGGIGAVIAHE  480

Query:  481 ISHAFDTNGASFDEHGSLNNWWTDEDFEAFKKLTDKVVEQFDGLESYGAKVNGKLTVSEN  540
            ISHAFDTNGASFDE+GSL NWWT++D+ AFK+ TDK+V+QF GL+SYGAKVNGKLTVSEN
Sbjct:  481 ISHAFDTNGASFDENGSLKNWWTEDDYAAFKERTDKIVDQFEGLDSYGAKVNGKLTVSEN  540

Query:  541 VADLGGVACALEAAQRESDFSARDFFINFATIWRMKARDEYMQMLASVDVHAPAQWRTNI  600
            VADLGGVACALEAA+R+ DFS R+FFINFATIWR KAR+EYMQMLASVDVHAPA+WRTN+
Sbjct:  541 VADLGGVACALEAAKRDEDFSVREFFINFATIWRTKAREEYMQMLASVDVHAPAKWRTNV  600

Query:  601 TVTNFEEFHKEFDVKDGDNMWRPVEKRVIIW                              631
             VTNF+EFHKEFDVK+GD MWR  E RVIIW
Sbjct:  601 IVTNFDEFHKEFDVKEGDGMWPAPEDRVIIW                              631
```

Endopeptidases are often exposed antigens.

A related DNA sequence was identified in S. pyogenes <SEQ ID 2383> which encodes the amino acid sequence <SEQ ID 2384>. Analysis of this protein sequence reveals the following:

```
Possible site: 51
>>> Seems to have no N-terminal signal sequence

----- Final Results -----
           bacterial Cytoplasm --- Certainty = 0.2622 (Affirmative) < succ>
           bacterial membrane  --- Certainty = 0.0000 (Not Clear)   < succ>
           bacterial outside   --- Certainty = 0.0000 (Not Clear)   < succ>
```

An alignment of the GAS and GBS proteins is shown below.

```
Identities = 504/631 (79%), Positives = 564/631 (88%)

Query:   1 MIKYQDDFYQAVNGEWAKTAVIPDDKPRTGGFSDLADDIEALMLSTTDKWLADENKPSDT   60
           M  YQDDFYQAVNG+WA+TAVIPDDKPRTGGFSDLAD+IEALML TTD WLA EN P D
Sbjct:   1 MTTYQDDFYQAVNGKWAETAVIPDDKPRTGGFSDLADEIEALMLDTTDAWLAGENIPDDA   60

Query:  61 ILNHFIAFHKMTADYQKREEVGVSPVLPLIEEYKGLQSFSEFASKVAEYELEGKPNEFPF  120
           IL +F+ FH++ ADY KR+EVGVSP+LPLIEEY+ L+SFSEF + +A+YEL G PNEFPF
Sbjct:  61 ILKNFVKFHRLVADYAKRDEVGVSPILPLIEEYQSLKSFSEFVANIAKYELAGLPNEFPF  120

Query: 121 GVAPDFMNAQLNVLWAEAPGIILPDTTYYSEDNEKGKELLAFWRKSQEDLLPLFGLSEQE  180
             VAPDFMNAQLNVLWAEAP I+LPDTTYY E NEK +EL  WR+SQE LLP FG S +E
Sbjct: 121 SVAPDFMNAQLNVLWAEAPSILLPDTTYYEEGNEKAEELRGIWRQSQEKLLPQFGFSTEE  180

Query: 181 IKDILDKVLALDAKLAQYVLSREESSEYVKLYHPYNWEDFTKLAPELPLDAIFQKILGQK  240
           IKD+LDKV+ LD +LA+YVLSREE SEY KLYHPY W DF KLAPELPLD+IF+KILGQ
Sbjct: 181 IKDLLDKVIELDKQLAKYVLSREEGSEYAKLYHPYVWADFKKLAPELPLDSIFEKILGQV  240

Query: 241 PDKVIVPEERFWTEFASDYYSESNWELLKADLILSAANAYNAYLTDDIRIKSGVYSRALS  300
           PDKVIVPEERFWTEFA+ YYSE+NW+LLKA+LI+ AANAYNAYLTDDIR++SG YSRALS
Sbjct: 241 PDKVIVPEERFWTEFAATYYSEANWDLLKANLIVDAANAYNAYLTDDIRVESGAYSRALS  300

Query: 301 GTPQAMDKKKAAYYLASGPYNQALGLWYAGEKFSPEAKADVEHKIATMIDVYKSRLEKAD  360
           GTPQAMDK+KAA+YLA GP++QALGLWYAG+KFSPEAKADVE K+A MI+VYKSRLE AD
Sbjct: 301 GTPQAMDKQKAAFYLAQGPFSQALGLWYAGQKFSPEAKADVESKVARMIEVYKSRLETAD  360

Query: 361 WLAQSTREKAIMKLNVITPHIGYPEKLPETYTKKIIDPKLSLVENATNLDKISIAYGWSK  420
           WLA +TREKAI KLNVITPHIGYPEKLPETY KK+ID  LSLVENA NL KI+IA+ WSK
Sbjct: 361 WLAPATREKAITKLNVITPHIGYPEKLPETYAKKVIDESLSLVENAQNLAKITIAHTWSK  420

Query: 421 WNKPVDRSEWHMPAHMVNAYYDPQQNQIVFPAAILQEPFYALEQSSSANYGGIGAVIAHE  480
           WNKPVDRSEWHMPAH+VNAYYD QQNQIVFPAAILQEPFY+L+QSSSANYGGIGAVIAHE
Sbjct: 421 WNKPVDRSEWHMPAHLVNAYYDLQQNQIVFPAAILQEPFYSLDQSSSANYGGIGAVIAHE  480

Query: 481 ISHAFDTNGASFDEHGSLNNWWTDEDFEAFKKLTDKVVEQFDGLESYGAKVNGKLTVSEN  540
           ISHAFDTNGASFDEHGSLN+WWT ED+ AFK+ TDK+V QFDGLES+GAKVNGKLTVSEN
Sbjct: 481 ISHAFDTNGASFDEHGSLNDWWTQEDYAAFKERTDKIVAQFDGLESHGAKVNGKLTVSEN  540

Query: 541 VADLGGVACALEAAQRESDFSARDFFINFATIWRMKARDEYMQMLASVDVHAPAQWRTNI  600
           VADLGGVACALEAAQ E DFSARDFFINFATIWRMKAR+EYMQMLAS+DVHAP + RTN+
Sbjct: 541 VADLGGVACALEAAQSEEDFSARDFFINFATIWRMKAREEYMQMLASIDVHAPGELRTNV  600

Query: 601 TVTNFEEFHKEFDVKDGDNMWRPVEKRVIIW                              631
           T+TNF+  FH+ FD+K+GD MWR  + RVIIW
Sbjct: 601 TLTNFDAFHETFDIKEGDAMWRAPKDRVIIW                              631
```

SEQ ID 2382 (GBS193) was expressed in E. coli as a His-fusion product. SDS-PAGE analysis of total cell extract is shown in FIG. 23 (lane 3; MW 73 kDa).

The GBS193-His fusion product was purified (FIG. 196, lane 5) and used to immunise mice. The resulting antiserum was used for Western blot (FIG. 253). These tests confirm that the protein is immunoaccessible on GBS bacteria.

Based on this analysis, it was predicted that these proteins and their epitopes could be useful antigens for vaccines or diagnostics.

EXAMPLE 775

A DNA sequence (GBSx0823) was identified in S. agalactiae <SEQ ID 2385> which encodes the amino acid sequence <SEQ ID 2386>. This protein is predicted to be immunity protein (mccF-1). Analysis of this protein sequence reveals the following:

```
Possible site: 36
>>> Seems to have no N-terminal signal sequence

----- Final Results -----
            bacterial cytoplasm --- Certainty = 0.1627 (Affirmative) < succ>
             bacterial membrane --- Certainty = 0.0000 (Not Clear)  < succ>
              bacterial outside --- Certainty = 0.0000 (Not Clear)  < succ>
```

A related GBS nucleic acid sequence <SEQ ID 9433> which encodes amino acid sequence <SEQ ID 9434> was also identified.

The protein has homology with the following sequences in the GENPEPT database.

```
>GP: AAB84435 GB: AF027868 YocD [Bacillus subtilis]
Identities = 114/270 (42%), Positives = 170/270 (62%), Gaps = 4/270 (1%)

Query:    1 MSFSKHYLENDILYSASITSRVEDLHEAFADPSVDAILATIGGFNSNELLPYLDYDLISK   60
            ++ ++H  E +   S+SI SRV DLH AF DP V AIL T+GGFNSN+LL YLDY+ I +
Sbjct:   43 VTIAEHANECNEFDSSSIESRVHDLHAAFFDPGVKAILTTLGGFNSNQLLRYLDYEKIKR  102

Query:   61 NPKIICGYSDSTAFLNAIFAKAKIQTYMGPAYSSFKMKEGQPYQTQAWLT-AMTENHYEL  119
            +PKI+CGYSD TA  NAI+ K  + TY GP +S+F MK+G  Y  +  +L+   +++ +E+
Sbjct:  103 HPKILCGYSDITALCNAIYQKTGLVTYSGPHFSTFAMKKGLDYTEEYFLSCCASDDPFEI  162

Query:  120 WPSEEWSSDPWYDPSKPRQFFPTEWK-IYNHGKASGTIIGGNLSTFGLLRGTPYAPKIER  178
              PS EWS D W+   + R+F+P      +  G A GT+IGGNL T  LL+GT Y P+ E
Sbjct:  163 HPSSEWSDDRWFLDQENRRFYPNNGPVVIQEGYAEGTLIGGNLCTLNLLQGTEYFPETEH  222

Query:  179 YVLLIEEAEESNFYEFDRNLAAI--LQAYPHPQAILMGRFPKECGMTPQVFEYILSKHAI  236
            +LLIE+    S+ + FDR+L ++    L A+ H +AIL+GRF K    ++  + + ++
Sbjct:  223 TILLIEDDYMSDIHMFDRDLQSLIHLPAFSHVKAILIGRFQKASNVSIDLVKAMIETKKE  282

Query:  237 FKEIPVIYDMDFAHTQPLLTVTIGAELSVD                              266
              IP+I +++   HT P+ T  IG    ++
Sbjct:  283 LSGIPIIANINAGHTSPIATFPIGGTCRIE                              312
```

A related DNA sequence was identified in *S. pyogenes* <SEQ ID 2387> which encodes the amino acid sequence <SEQ ID 2388>. Analysis of this protein sequence reveals the following:

```
Possible site: 42
>>> Seems to have no N-terminal signal sequence

----- Final Results -----
            bacterial cytoplasm --- Certainty = 0.1162 (Affirmative) < succ>
             bacterial membrane --- Certainty = 0.0000 (Not Clear)  < succ>
              bacterial outside --- Certainty = 0.0000 (Not Clear)  < succ>
```

An alignment of the GAS and GBS proteins is shown below.

```
Identities = 75/252 (29%), Positives = 125/252 (48%), Gaps = 22/252 (8%)

Query:   34 VDAILATIGGFNSNELLPYLDYDLISKNPKIICGYSDSTAFLNAIFAKAKIQTYMGPAYS   93
            VD I+ +IGG+NSN +L Y+DYDL +   I  GYSD+TA  A++ K    TY+  +
Sbjct:    1 VDVIMTSIGGYNSNSVLKYIDYDLFKQKFPIFIGYSDTTALALALYKKTGCITYLSQSVI   60

Query:   94 SFKMKEGQP----------YQTQAWLTAMTENHYELWPSEEWSSDPWYDPSKPRQFFPTE  143
            S    E +P            Q+  +  ++W ++EW +  W    + ++       E
Sbjct:   61 S-NFGEFEPFNELNYFYFDFMLQSKCETLMVQIPDVW-TDEWIN--WETYERTKKTNKNE  116

Query:  144 WKIYNHGKASGTIIGGNLSTFGLLRGTPYAPKIERYVLLIEEAEESNFYEFDRNLA--AI  201
            W I+N G+ +GT+IGGNL T  + GT Y PKI   +L+ E   ++    RN    A+
Sbjct:  117 WIIFNKGEFNGTLIGGNLDTIVGIIGTEYMPKITEDTILLLEDVYTDLGRLYRNFTTLAL  176

Query:  202 LQAYPHPQAILMGRFPKECGMTPQVFEYILSKHAIFKEIPVIYDMDFAHTQPLLTVTIGA  261
              +     +++ +F + G      V  I+++    ++IP++ + D HT P   + IG
Sbjct:  177 HGIFDKIGGLIISKF-ETIGENSDVINDIINEFVGHRKIPILLNFDCGHTHPSCLMPIGG  235

Query:  262 ELSVDTTTTLSLS                                                273
             ++      TLSLS
Sbjct:  236 KI-----TLSLS                                                 242
```

Based on this analysis, it was predicted that these proteins and their epitopes could be useful antigens for vaccines or diagnostics.

EXAMPLE 776

A DNA sequence (GBSx0824) was identified in *S. agalactiae* <SEQ ID 2389> which encodes the amino acid sequence <SEQ ID 2390>. Analysis of this protein sequence reveals the following:

```
Possible site: 15
>>> Seems to have no N-terminal signal sequence

----- Final Results -----
        bacterial cytoplasm --- Certainty = 0.3112 (Affirmative) < succ>
         bacterial membrane --- Certainty = 0.0000 (Not Clear) < succ>
          bacterial outside --- Certainty = 0.0000 (Not Clear) < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 777

A DNA sequence (GBSx0825) was identified in *S. agalactiae* <SEQ ID 2391> which encodes the amino acid sequence <SEQ ID 2392>. Analysis of this protein sequence reveals the following:

```
Possible site: 21
>>> Seems to have no N-terminal signal sequence

----- Final Results -----
        bacterial cytoplasm --- Certainty = 0.6171 (Affirmative) < succ>
         bacterial membrane --- Certainty = 0.0000 (Not Clear) < succ>
          bacterial outside --- Certainty = 0.0000 (Not Clear) < succ>
```

A related GBS nucleic acid sequence <SEQ ID 10175> which encodes amino acid sequence <SEQ ID 10176> was also identified.

The protein has no significant homology with any sequences in the GENPEPT database.

No corresponding DNA sequence was identified in *S. pyogenes*.

Based on this analysis, it was predicted that these proteins and their epitopes could be useful antigens for vaccines or diagnostics.

EXAMPLE 778

A DNA sequence (GBSx0826) was identified in *S. agalactiae* <SEQ ID 2393> which encodes the amino acid sequence <SEQ ID 2394>. Analysis of this protein sequence reveals the following:

```
Possible site: 19
>>> Seems to have an uncleavable N-term signal seq
INTEGRAL Likelihood = -10.19  Transmembrane  83-99  (80-113)
INTEGRAL Likelihood =  -9.71  Transmembrane   4-20  (1-24)
INTEGRAL Likelihood =  -9.45  Transmembrane 315-331 (307-337)
INTEGRAL Likelihood =  -8.33  Transmembrane 186-202 (180-210)
INTEGRAL Likelihood =  -7.75  Transmembrane 233-249 (227-255)
INTEGRAL Likelihood =  -3.98  Transmembrane 390-406 (382-407)
INTEGRAL Likelihood =  -3.61  Transmembrane  27-43  (27-45)
INTEGRAL Likelihood =  -3.29  Transmembrane 107-123 (105-125)
INTEGRAL Likelihood =  -1.75  Transmembrane 273-289 (273-290)

----- Final Results -----
         bacterial membrane --- Certainty = 0.5076 (Affirmative) < succ>
          bacterial outside --- Certainty = 0.0000 (Not Clear) < succ>
        bacterial cytoplasm --- Certainty = 0.0000 (Not Clear) < succ>
```

The protein has homology with the following sequences in the GENPEPT database.

```
>GP: CAB15347 GB: Z99121 similar to hypothetical proteins [Bacillus
subtilis]
Identities = 174/524 (33%), Positives = 275/524 (52%), Gaps = 13/524 (2%)

Query:    1 MEETILIVSFLLFLILSNVINRIFPKLPLPFIQLVFGILSGLVFHKSQVHIDPELFLAFV   60
            M+  ++++  L  +  +SN++NR  P +P+P IQ+  GIL+          ++ ELF
Sbjct:    1 MDIFLVVLVLLTIIAISNIVNRFIPFIPVPLIQVALGILAASFPQGLHFELNTELFFVLF   60

Query:   61 IAPLNFREGQESDIGSFIKYRAIILYLILPTVFLTAIVVGYVAGHLLPVSLPLAACFALG  120
            IAPL F +G+ +           RA IL L L  VF T IV GY    ++P ++PLAA F  L
Sbjct:   61 IAPLLFNDGKRTPRAELWNLRAPILLLALGLVFATVIVGGYTIHWMIP-AIPLAAAFGLA  119

Query:  121 AALGPTDAVAFISIAKRFQFPKRAENILKLEGLLNDASGLVSFQFALTALVTGYFSLAKA  180
            A L PTD VA +++ R + PK    +L+ EGL+NDASGLV+F+FA+ A VTG FSLA+A
Sbjct:  120 AILSPTDVVAVSALSGRVKMPKGILRLLEGEGLMNDASGLVAFKFAIAAAVTGAFSLAQA  179

Query:  181 SLKLALAIMGGFLIGLLFAFLMRLCLTVLEKFDAADVTGALLLELTLPFVAYFVADLLGF  240
            ++           +GG L G++ +FL+      L +    DVT +L+++  PFV Y  A+ +G
Sbjct:  180 AVSFVFISLGGLLCGVVISFLIIRFRLFLRRLGMQDVTMHMLIQILTPFVIYLAAEEIGV  239

Query:  241 SAIIAVVVAGVMQANRLKKVTLFDAQVDRVTSVIWETLNFILNGLVFLIFGRELTRIIGP  300
            S  I+AVV  G+  A    ++      ++  V+S   W  +  FILNGLVF+I G ++   +I
Sbjct:  240 SGILAVVAGGITHAVEQDRLESTMIKLQIVSSSTWNIILFILNGLVFVILGTQIPDVISV  299

Query:  301 LLTSNAYSNFDLISIVVLVTCTLFLVRFLAVSCFY--AWRSFKYHKSFKKYWREIQLLTF  358
              +    A SN  +I ++++T TL L+RFL V  F+     W     K   +K   R    L++
Sbjct:  300 IFNDTAISNMKVIGYILVITFTLMLLRFLWVLFFWNGKWFFNKDQNIYKPGLRSTLLISI  359

Query:  359 SGVKGSVSIATILLLPKHSVIGE--LGYSLILFTVGAVTLMSFLTGLLVLPKLAPPLQVK  416
            SGV+G+V++A   +P   G      +LILF    V L + +    +VLP L   +
Sbjct:  360 SGVRGAVTLAGSFSIPYFLEDGTPFPERNLILFLAAGVILCTLVIATVVLPILTEKEEED  419

Query:  417 DD-----YLIRLSILTKVLSVLEEDGKSSENQASFYAVIDNYNSRIRHLILEQ--ESSDI  469
            ++           R  ++   L  ++ED   +     AS  AVI  YN ++++L   +Q    S+   I
Sbjct:  420 EERNKKLLTARRKLIKTALQTIKEDMNETNKTASL-AVIAEYNEKMKNLRFQQYTSSNRI  478

Query:  470 KKDLAELQLMMLSIESDGLEAAYRYGNISIKEYRIYQRYLKYLE                 513
            KK   +++    +   E  + L        G+I +   + Q       LE
Sbjct:  479 KKHERKVRAQGVKAEQEALMKMLERGDIPEETANVLQERFNELE                 522
```

No corresponding DNA sequence was identified in *S. pyogenes*.

Based on this analysis, it was predicted that this protein and its epitopes, could be useful antigens for vaccines or diagnostics.

EXAMPLE 779

A DNA sequence (GBSx0827) was identified in *S. agalactiae* <SEQ ID 2395> which encodes the amino acid sequence <SEQ ID 2396>. Analysis of this protein sequence reveals the following:

```
Possible site: 23
>>> Seems to have no N-terminal signal sequence

----- Final Results -----
        bacterial cytoplasm --- Certainty = 0.3494 (Affirmative) < succ>
         bacterial membrane --- Certainty = 0.0000 (Not Clear) < succ>
          bacterial outside --- Certainty = 0.0000 (Not Clear) < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 780

A DNA sequence (GBSx0828) was identified in *S. agalactiae* <SEQ ID 2397> which encodes the amino acid sequence <SEQ ID 2398>. This protein is predicted to be integrase (phage-relatedpr). Analysis of this protein sequence reveals the following:

```
Possible site: 61
>>> Seems to have no N-terminal signal sequence

----- Final Results -----
            bacterial cytoplasm --- Certainty = 0.5094 (Affirmative) < succ>
             bacterial membrane --- Certainty = 0.0000 (Not Clear)   < succ>
              bacterial outside --- Certainty = 0.0000 (Not Clear)   < succ>
```

A related GBS nucleic acid sequence <SEQ ID 10173> which encodes amino acid sequence <SEQ ID 10174> was also identified.

The protein has homology with the following sequences in the GENPEPT database.

```
>GP: AAF12706 GB: AF066865 integrase [bacteriophage TPW22]
Identities = 171/353 (48%), Positives = 253/353 (71%), Gaps = 1/353 (0%)

Query:   21 MASYRKRENGLWEYRISYKTIDGKYKREKGGFKTKKLAQAAAIEIEKKLTQNILTNDEV   80
            MA++RKR    W++R+SYK  +G+YK+ EKGG+KTKK A+AAA E +K+L +   ++++
Sbjct:    1 MANFRKRGK-TWQFRLSYKDNNGEYKKFEKGGYKTKKEAEAAADEAKKRLNNHSEFDNDI  59

Query:   81 TLYDFVKTWSEVYKRPYVKDKTWETYSKNFKHIKNYFQELKVKDITPLYYQKKLNEFGEK  140
            +LYDF + W++VYK+P+V + TW TY +    I  Y ++ + +ITP +YQ  LN+
Sbjct:   60 SLYDFFEKWAKVYKKPHVTEATWRTYKRTLNLIDKYIKDKPIAEITPTFYQAVLNKMSLL 119

Query:  141 YAQETLEKFHYQIKGAMKVAVREQVVTFNFAEGAKVKSQVEPKNEEEDFLEEREYKALLA  200
            Y QE+L+KF++QIK AMK+AV E+V++ NFA+  K KS++  +  EE +L   EY   LLA
Sbjct:  120 YRQESLDKFYFQIKSAMKIAVHEKVISENFADFTKAKSKLAARPVEEKYLHADEYLKLLA 179

Query:  201 LTRENIQYVSYFTLYLLAVTGLRFSEAMGLTWSDIDFKNGILDINKSFDYSNTQDFADLK  260
            +  E ++Y SYF  YL AVTG+RF+E +GLTWS +DF   + I +++DYS T +FA+ K
Sbjct:  180 IAEEKMEYTSYFACYLTAVTGMRFAELLGLTWSHVDFDKKEISIQRTWDYSITNNFAETK 239

Query:  261 NESSKRKVPIDSNTIDILREYKKNHWQANIKNRVCFGVSNSACNKLIKKIVGRKVRNHSL  320
            NESSKRK+PI S TI +L++YKK +W  N  +RV + +SN+  NK IK I GRKV   HSL
Sbjct:  240 NESSKRKIPISSKTIKLLKKYKKEYWHENKYDRVIYNLSNNGLNKTIKVIAGRKVHPHSL 299

Query:  321 RHTYASFLILNGVDIVTISKLLGHESPDITLKVYTHQMEALAERNFEKIKNIF         373
            RH++AS+LI  G+D++T+SKLLGHE+ ++TLKVY HQ++ +  + N + I+ IF
Sbjct:  300 RHSFASYLIYKGIDLLTVSKLLGHENLNVTLKVYAHQLKEMEQENNDVIRKIF         352
```

There is also homology to SEQ ID 578.

Based on this analysis, it was predicted that these proteins and their epitopes could be useful antigens for vaccines or diagnostics.

EXAMPLE 781

A DNA sequence (GBSx0829) was identified in *S. agalactiae* <SEQ ID 2399> which encodes the amino acid sequence <SEQ ID 2400>. Analysis of this protein sequence reveals the following:

```
Possible site: 56
>>> Seems to have no N-terminal signal sequence

----- Final Results -----
            bacterial cytoplasm --- Certainty = 0.3377 (Affirmative) < succ>
             bacterial membrane --- Certainty = 0.0000 (Not Clear)   < succ>
              bacterial outside --- Certainty = 0.0000 (Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 782

A DNA sequence (GBSx0830) was identified in *S. agalactiae* <SEQ ID 2401> which encodes the amino acid sequence <SEQ ID 2402>. This protein is predicted to be homology to cI-like repressor. Analysis of this protein sequence reveals the following:

```
Possible site: 28
>>> Seems to have no N-terminal signal sequence

----- Final Results -----
             bacterial cytoplasm --- Certainty = 0.0827 (Affirmative) < succ>
              bacterial membrane --- Certainty = 0.0000 (Not Clear)   < succ>
               bacterial outside --- Certainty = 0.0000 (Not Clear)   < succ>
```

The protein has homology with the following sequences in the GENPEPT database.

```
>GP: AAD44097 GB: AF115103 orf122 gp [Streptococcus thermophilus
bacteriophage Sfi21]
Identities = 57/125 (45%), Positives = 77/125 (61%), Gaps = 5/125 (4%)

Query:   3 MKLDQLCKEFGVELCLFDASDWHSSGFYNPITKVLGVDVNLSEQEQKQVALHELQHKNHF  62
           M  +L ++FGV LC F +S W   GF +P+ +V+ ++ +L  + + +V LHEL  H   H
Sbjct:   1 MNESELLEQFGVSLCEFSSSQWTRDGFLDPVNRVVYINRDLPTERRLKVLLHELGHLEHD  60

Query:  63 PYQYQLFRERCELDANRNMIHHLLKEELEIAEDHTQFNYLVFMEKYKLKTIADEAMIKEE 122
           P QY+  RE+ E  ANRNMIH LLK      E+    FNY+ FMEKY L  TI DE +K E
Sbjct:  61 PKQYERLREKYEAQANRNMIHELLKN-----ENLDNFNYVHFMEKYNLTTICDETFVKNE 115

Query: 123 YLNLV                                                        127
           YL L+
Sbjct: 116 YLKLI                                                        120
```

No corresponding DNA sequence was identified in *S. pyogenes*.

Based on this analysis, it was predicted that this protein and its epitopes, could be useful antigens for vaccines or diagnostics.

EXAMPLE 783

A DNA sequence (GBSx0831) was identified in *S. agalactiae* <SEQ ID 2403> which encodes the amino acid sequence <SEQ ID 2404>. This protein is predicted to be EpsR protein. Analysis of this protein sequence reveals the following:

```
Possible site: 37
>>> Seems to have no N-terminal signal sequence

----- Final Results -----
             bacterial cytoplasm --- Certainty = 0.4692 (Affirmative) < succ>
              bacterial membrane --- Certainty = 0.0000 (Not Clear)   < succ>
               bacterial outside --- Certainty = 0.0000 (Not Clear)   < succ>
```

The protein has homology with the following sequences in the GENPEPT database.

```
>GP: AAF12710 GB: AF066865 repressor protein [bacteriophage TPW22]
Identities = 36/101 (35%), Positives = 62/101 (60%), Gaps = 7/101 (6%)

Query:   4 LIDRIRELSNKKGMSLNDLEDTLGYSRNSLYSLNE-NSKMGKPKEIAQYFNVSLDYLLGL  62
           L ++I+EL+++K +S+  +E+ LG++  ++    + N  + K K++A+YFNVS+D+LLGL
Sbjct:   3 LYEKIKELASQKNVSIRQVEEKLGFANGTIRQWGKKNPGINKVKDVAKYFNVSVDFLLGL  62

Query:  63 TDNPRIAS--DETAIIDGQVVDLREAAAHTMLFDGKPLDED                    101
            DN R     D    +D V+ E     FDGKPL ++
Sbjct:  63 DDNQRKKEPVDLADFVDDNKVNWDEWVS----FDGKPLSDE                     99
```

Based on this analysis, it was predicted that this protein and its epitopes, could be useful antigens for vaccines or diagnostics.

EXAMPLE 784

A DNA sequence (GBSx0832) was identified in *S. agalactiae* <SEQ ID 2405> which encodes the amino acid sequence <SEQ ID 2406>. Analysis of this protein sequence reveals the following:

```
Possible site: 43
>>> Seems to have no N-terminal signal sequence

----- Final Results -----
        bacterial cytoplasm --- Certainty = 0.4079 (Affirmative) < succ>
        bacterial membrane  --- Certainty = 0.0000 (Not Clear)   < succ>
        bacterial outside   --- Certainty = 0.0000 (Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 785

A DNA sequence (GBSx0833) was identified in *S. agalactiae* <SEQ ID 2407> which encodes the amino acid sequence <SEQ ID 2408>. Analysis of this protein sequence reveals the following:

```
Possible site: 52
>>> Seems to have no N-terminal signal sequence

----- Final Results -----
        bacterial cytoplasm --- Certainty = 0.2942 (Affirmative) < succ>
        bacterial membrane  --- Certainty = 0.0000 (Not Clear)   < succ>
        bacterial outside   --- Certainty = 0.0000 (Not Clear)   < succ>
```

A related GBS nucleic acid sequence <SEQ ID 10171> which encodes amino acid sequence <SEQ ID 10172> was also identified.

The protein has no significant homology with any sequences in the GENPEPT database.

No corresponding DNA sequence was identified in *S. pyogenes*.

Based on this analysis, it was predicted that these proteins and their epitopes could be useful antigens for vaccines or diagnostics.

EXAMPLE 786

A DNA sequence (GBSx0834) was identified in *S. agalactiae* <SEQ ID 2409> which encodes the amino acid sequence <SEQ ID 2410>. This protein is predicted to be a replication initiation protein Rep (RC). Analysis of this protein sequence reveals the following:

```
Possible site: 54
>>> Seems to have no N-terminal signal sequence

----- Final Results -----
        bacterial cytoplasm --- Certainty = 0.3335 (Affirmative) < succ>
        bacterial membrane  --- Certainty = 0.0000 (Not Clear)   < succ>
        bacterial outside   --- Certainty = 0.0000 (Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 787

A DNA sequence (GBSx0835) was identified in *S. agalactiae* <SEQ ID 2411> which encodes the amino acid sequence <SEQ ID 2412>. This protein is predicted to be antirepressor. Analysis of this protein sequence reveals the following:

```
Possible site: 40
>>> Seems to have no N-terminal signal sequence

----- Final Results -----
            bacterial cytoplasm --- Certainty = 0.3380 (Affirmative) < succ>
             bacterial membrane --- Certainty = 0.0000 (Not Clear)   < succ>
              bacterial outside --- Certainty = 0.0000 (Not Clear)   < succ>
```

The protein has homology with the following sequences in the GENPEPT database.

```
>GP: BAA97816 GB: AB044554 antirepressor [Staphylococcus aureus
prophage phiPV83]
Identities = 70/153 (45%), Positives = 93/153 (60%), Gaps = 15/153 (9%)

Query:   3 EIFVFHGQEVRTVTINNEPWFVGKDVADILGYSKSRNAIALHVDEDDALKQGITDNLGRM    62
           + F F    VRTV I NEP+FVGKD+A+ILGY+++ NAI  HVD +D L    + + G+
Sbjct:   5 QTFNFKELPVRTVEIENEPYFVGKDIAEILGYARTDNAIRNHVDSEDKLTHQFSAS-GQN   63

Query:  63 QETIIINESGLYSLIL----SSKLPQVKE----FKRWVTSEVLPQIRQQGAYVPENLSDE  114
           +  IIINESGLYSLI    SK  +++E    FKRWVTS+VLP IR+ G Y  +N+ ++
Sbjct:  64 RNMIIINESGLYSLIFDASKQSKNEKIRETARKFKRWVTSDVLPAIRKHGIYATDNVIEQ  123

Query: 115 A------FIALFTGQKKLKEHQLALAQDVDYLK                             141
              I + T  KK KE  L L Q V+  K
Sbjct: 124 TLKDPDYIITVLTEYKKEKEQNLVLQQQVEVNK                             156
```

A related DNA sequence was identified in *S. pyogenes* <SEQ ID 2413> which encodes the amino acid sequence <SEQ ID 2414>. Analysis of this protein sequence reveals the following:

```
Possible site: 17
>>> Seems to have no N-terminal signal sequence

----- Final Results -----
            bacterial cytoplasm --- Certainty = 0.4609 (Affirmative) < succ>
             bacterial membrane --- Certainty = 0.0000 (Not Clear)   < succ>
              bacterial outside --- Certainty = 0.0000 (Not Clear)   < succ>
```

An alignment of the GAS and GBS proteins is shown below.

```
Identities = 54/142 (38%), Positives = 73/142 (51%), Gaps = 7/142 (4%)

Query:  11 EVRTVTINNEPWFVGKDVADILGYSKSRNAIALHVDEDDALKQGITDNLGRMQETIIINE   70
           EVRT TINN+ +F   D   IL  S R I   +++D     I D+LGR Q+    INE
Sbjct:  13 EVRTATINNQIYFNLNDCCQILELSNPRKTIE-RLNKDGVTTSDIIDSLGRTQQANFINE   71

Query:  71 SGLYSLILSSKLPQVKEFKRWVTSEVLPQIRQQGAYVPENLSDEA------FIALFTGQK  124
            S  Y L+  S+ P+ ++F  WVTSEVLP IR+ GAY+ E    ++A        I L    K
Sbjct:  72 SNFYKLVFQSRKPEAEKFADWVTSEVLPSIRKHGAYMTEQTLEQALTSPDFLIRLANELK  131

Query: 125 KLKEHQLALAQDVDYLKNEQPI                                        146
           + KE    L  + L E   +
Sbjct: 132 EEKERSRQLEAEKSILSVENMV                                        153
```

EXAMPLE 788

A DNA sequence (GBSx0836) was identified in *S. agalactiae* <SEQ ID 2415> which encodes the amino acid sequence <SEQ ID 2416>. This protein is predicted to be e11. Analysis of this protein sequence reveals the following:

```
Possible site: 58
>>> Seems to have no N-terminal signal sequence

----- Final Results -----
           bacterial cytoplasm --- Certainty = 0.3281 (Affirmative) < succ>
           bacterial membrane  --- Certainty = 0.0000 (Not Clear)   < succ>
            bacterial outside  --- Certainty = 0.0000 (Not Clear)   < succ>
```

The protein has homology with the following sequences in the GENPEPT database.

```
>GP: AAC27227 GB: AF009630 e11 [bacteriophage bIL170]
Identities = 66/161 (40%), Positives = 93/161 (56%), Gaps = 13/161 (8%)

Query:  15 YQVSNLGRVRSIGRTVNAKQRTRKTKGRILKQSL-SSGYAIVTLSVNGLRKSIRVHRLVA   73
           Y+VSNLG+VR+I              GRILK  + +GY +  L  N  +K++ +HR++A
Sbjct:  16 YEVSNLGKVRNI-----------KSGRILKPWIVPNGYLMHQLCENNKKKNLFLHRIIA   63

Query:  74 EAFIPNPINKRTINHIDENKLNNRVDNLEWATDKENANHGNRTTKSSLGRCKPVEQFTLE  133
            AFI NP  K  +NHIDENKLNN ++NLEW T KEN  HG R  + +   K V Q   L
Sbjct:  64 TAFIDNPEEKPQVNHIDENKLNNDLNNLEWCTVKENNIHGTRMKRIAEKHFKKVIQLDLN  123

Query: 134 GEFINTFDSIKSASMKTGISSQRITATAMGHQKQTHGYKWR                    174
           +N F+S+  A  +TG+S + I++    G +K       +KWR
Sbjct: 124 DNVLNEFESMVQAEQETGVSRRNISSCCNGKRKSAGRFKWR                    164
```

No corresponding DNA sequence was identified in *S. pyogenes*.

Based on this analysis, it was predicted that this protein and its epitopes, could be useful antigens for vaccines or diagnostics.

EXAMPLE 789

A DNA sequence (GBSx0837) was identified in *S. agalactiae* <SEQ ID 2417> which encodes the amino acid sequence <SEQ ID 2418>. Analysis of this protein sequence reveals the following:

```
Possible site: 21
>>> Seems to have no N-terminal signal sequence

----- Final Results -----
           bacterial cytoplasm --- Certainty = 0.2357 (Affirmative) < succ>
           bacterial membrane  --- Certainty = 0.0000 (Not Clear)   < succ>
            bacterial outside  --- Certainty = 0.0000 (Not Clear)   < succ>
```

A related GBS nucleic acid sequence <SEQ ID 10169> which encodes amino acid sequence <SEQ ID 10170> was also identified.

The protein has no significant homology with any sequences in the GENPEPT database.

No corresponding DNA sequence was identified in *S. pyogenes*.

Based on this analysis, it was predicted that these proteins and their epitopes could be useful antigens for vaccines or diagnostics.

EXAMPLE 790

A DNA sequence (GBSx0838) was identified in *S. agalactiae* <SEQ ID 2419> which encodes the amino acid sequence <SEQ ID 2420>. Analysis of this protein sequence reveals the following:

```
Possible site: 57
>>> Seems to have an uncleavable N-term signal seq
INTEGRAL Likelihood = -5.47 Transmembrane 21-37 (19-38)

----- Final Results -----
            bacterial membrane --- Certainty = 0.3187 (Affirmative) < succ>
              bacterial outside --- Certainty = 0.0000 (Not Clear) < succ>
                bacterial cytoplasm --- Certainty = 0.0000 (Not Clear) < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 791

A DNA sequence (GBSx0839) was identified in *S. agalactiae* <SEQ ID 2421> which encodes the amino acid sequence <SEQ ID 2422>. This protein is predicted to be DNA polymerase III delta prime subunit (dnaB). Analysis of this protein sequence reveals the following:

```
Possible site: 55
>>> Seems to have no N-terminal signal sequence

----- Final Results -----
            bacterial cytoplasm --- Certainty = 0.0544 (Affirmative) < succ>
              bacterial membrane --- Certainty = 0.0000 (Not Clear) < succ>
                bacterial outside --- Certainty = 0.0000 (Not Clear) < succ>
```

The protein has homology with the following sequences in the GENPEPT database.

```
AAF98347 AF280763 DNA polymerase III delta prime subunit
[Streptococcus pyogenes]
Identities = 284/444 (63%), Positives = 357/444 (79%), Gaps = 4/444 (0%)

Query:    3 ELKVLPHDIQAEQSVLGSIFIKPEKMIEVAEYLKPNDFYRPAHKILFKAMVSLADRGEAI   62
            EL+V P D+ AEQSVLGSIFI P+K+I V E++ P+DFY+ AHKI+F+AM++L+DR +AI
Sbjct:    8 ELRVQPQDLLAEQSVLGSIFISPDKLIAVREFISPDDFYKYAHKIIFRAMITLSDRNDAI   67

Query:   63 DIVTIKSTLESTDELGMVGGISYIAEIVNAVPTSSHAEHYAKIVAKKAQLRSIIDNLSDS  122
            D  TI++ L+   D+L  +GG+SYI E+VN+VPTS++AE+YAKIVA+KA LR II   L++S
Sbjct:   68 DATTIRTILDDQDDLQSIGGLSYIVELVNSVPTSANAEYYAKIVAEKAMLRDIIARLTES  127

Query:  123 IGNAYDEDMDIDEIIAKAERSLIEVSQASNKSSFRPIHDVLLENHSKIEERSNNTSQITG  182
            +   AYDE + +E+IA  ER+LIE+++ SN+S FR I DVL  N+  +E RS  TS +TG
Sbjct:  128 VNLAYDEILKPEEVIAGVERALIELNEHSNRSGFRKISDVLKVNYEALEARSKQTSNVTG  187

Query:  183 IETGFYDFDKLITGLHEDQLIVLAARPAMGKTALALNIAQNVATKSNKAVAVFSLEMGAE  242
            + TGF D DK+ TGLH DQL++LAARPA+GKTA  LNIAQNV TK  K VA+FSLEMGAE
Sbjct:  188 LPTGFRDLDKITTGLHPDQLVILAARPAVGKTAFVLNIAQNVGTKQKKTVAIFSLEMGAE  247

Query:  243 SLVERMLSAEGTIINHHIRTGNLTVNEWQRLIYAQGQLAEAPIFIDDTAGVKITDIRARA  302
            SLV+RML+AEG + +H +RTG LT  +W +   AQG LAEAPI+IDDT G+KIT+IRAR+
Sbjct:  248 SLVDRMLAAEGMVDSHSLRTGQLTDQDWNNVTIAQGALAEAPIYIDDTPGIKITEIRARS  307

Query:  303 RRLSQETD-GLGLIVIDYLQLIQGSRSDNRQQEVSEISRQLKIIAKELKVPVIALSQLSR  361
            R+LSQE D GLGLIVIDYLQLI G++ +NRQQEVS+ISRQLKI+AKELKVPVIALSQLSR
Sbjct:  308 RKLSQEVDGGLGLIVIDYLQLITGTKPENRQQEVSDISRQLKILAKELKVPVIALSQLSR  367

Query:  362 GVEQRNDKRPIMSDLRESGSIEQDADIVAFLYRDAYYQ---DKKEGQPENDITELIIRKN  418
            GVEQR DKRP++SD+RESGSIEQDADIVAFLYRD YY+   D  E   E++  E+I+ KN
Sbjct:  368 GVEQRQDKRPVLSDIRESGSIEQDADIVAFLYRDDYYRKECDDAEEAVEDNTIEVILEKN  427

Query:  419 RHGNLGTVKLYFHKEYTKFSSVEE                                     442
            R G  GTVKL F KEY KFSS+ +
Sbjct:  428 RAGARGTVKLMFQKEYNKFSSIAQ                                     451
```

There is also homology to SEQ ID 2424:

```
Identities = 284/444 (63%), Positives = 357/444 (79%), Gaps = 4/444 (0%)

Query:     3 ELKVLPHDIQAEQSVLGSIFIKPEKMIEVAEYLKPNDFYRPAHKILFKAMVSLADRGEAI    62
             EL+V P D+ AEQSVLGSIFI P+K+I V E++ P+DFY+ AHKI+F+AM++L+DR +AI
Sbjct:    11 ELRVQPQDLLAEQSVLGSIFISPDKLIAVREFISPDDFYKYAHKIIFRAMITLSDRNDAI    70

Query:    63 DIVTIKSTLESTDELGMVGGISYIAEIVNAVPTSSHAEHYAKIVAKKAQLRSIIDNLSDS   122
             D  TI++ L+  D+L +GG+SYI E+VN+VPTS++AE+YAKIVA+KA LR II  L++S
Sbjct:    71 DATTIRTILDDQDDLQSIGGLSYIVELVNSVPTSANAEYYAKIVAEKAMLRDIIARLTES   130

Query:   123 IGNAYDEDMDIDEIIAKAERSLIEVSQASNKSSFRPIHDVLLENHSKIEERSNNTSQITG   182
                + AYDE + +E+IA  ER+LIE+++ SN+S FR I DVL  N+  +E RS  TS +TG
Sbjct:   131 VNLAYDEILKPEEVIAGVERALIELNEHSNRSGFRKISDVLKVNYEALEARSKQTSNVTG   190

Query:   183 IETGFYDFDKLITGLHEDQLIVLAARPAMGKTALALNIAQNVATKSNKAVAVFSLEMGAE   242
              + TGF D DK+ TGLH DQL++LAARPA+GKTA  LNIAQNV TK  K VA+FSLEMGAE
Sbjct:   191 LPTGFRDLDKITTGLHPDQLVILAARPAVGKTAFVLNIAQNVGTKQKKTVAIFSLEMGAE   250

Query:   243 SLVERMLSAEGTIINHHIRTGNLTVNEWQRLIYAQGQLAEAPIFIDDTAGVKITDIRARA   302
             SLV+RML+AEG + +H +RTG LT  +W  +  AQG LAEAPI+IDDT G+KIT+IRAR+
Sbjct:   251 SLVDRMLAAEGMVDSHSLRTGQLTDQDWNNVTIAQGALAEAPIYIDDTPGIKITEIRARS   310

Query:   303 RRLSQETD-GLGLIVIDYLQLIQGSRSDNRQQEVSEISRQLKIIAKELKVPVIALSQLSR   361
             R+LSQE D GLGLIVIDYLQLI G++ +NRQQEVS+ISRQLKI+AKELKVPVIALSQLSR
Sbjct:   311 RKLSQEVDGGLGLIVIDYLQLITGTKPENRQQEVSDISRQLKILAKELKVPVIALSQLSR   370

Query:   362 GVEQRNDKRPIMSDLRESGSIEQDADIVAFLYRDAYYQ---DKKEGQPENDITELIIRKN   418
             GVEQR DKRP++SD+RESGSIEQDADIVAFLYRD YY+   D   E   E+I+ KN
Sbjct:   371 GVEQRQDKRPVLSDIRESGSIEQDADIVAFLYRDDYYRKECDDAEEAVEDNTIEVILEKN   430

Query:   419 RHGNLGTVKLYFHKEYTKFSSVEE                                      442
             R G  GTVKL F  KEY KFSS+ +
Sbjct:   431 RAGARGTVKLMFQKEYNKFSSIAQ                                      454
```

Based on this analysis, it was predicted that this protein and its epitopes, could be useful antigens for vaccines or diagnostics.

EXAMPLE 792

A DNA sequence (GBSx0840) was identified in *S. agalactiae* <SEQ ID 2425> which encodes the amino acid sequence <SEQ ID 2426>. Analysis of this protein sequence reveals the following:

```
Possible site: 19
>>> Seems to have no N-terminal signal sequence

----- Final Results -----
         bacterial cytoplasm --- Certainty = 0.2146 (Affirmative) < succ>
         bacterial membrane  --- Certainty = 0.0000 (Not Clear)   < succ>
         bacterial outside   --- Certainty = 0.0000 (Not Clear)   < succ>
```

A related GBS nucleic acid sequence <SEQ ID 10167> which encodes amino acid sequence <SEQ ID 10168> was also identified.

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 793

A DNA sequence (GBSx0841) was identified in *S. agalactiae* <SEQ ID 2427> which encodes the amino acid sequence <SEQ ID 2428>. Analysis of this protein sequence reveals the following:

```
Possible site: 15
>>> Seems to have no N-terminal signal sequence

----- Final Results -----
         bacterial cytoplasm --- Certainty = 0.2774 (Affirmative) < succ>
         bacterial membrane  --- Certainty = 0.0000 (Not Clear)   < succ>
         bacterial outside   --- Certainty = 0.0000 (Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 794

A DNA sequence (GBSx0842) was identified in *S. agalactiae* <SEQ ID 2429> which encodes the amino acid sequence <SEQ ID 2430>. Analysis of this protein sequence reveals the following:

```
Possible site: 28
>>> Seems to have no N-terminal signal sequence
INTEGRAL Likelihood = -1.91 Transmembrane 63-79 (62-79)

----- Final Results -----
            bacterial membrane --- Certainty = 0.1765 (Affirmative) < succ>
              bacterial outside --- Certainty = 0.0000 (Not Clear) < succ>
                bacterial cytoplasm --- Certainty = 0.0000 (Not Clear) < succ>
```

A related GBS nucleic acid sequence <SEQ ID 8661> which encodes amino acid sequence <SEQ ID 8662> was also identified. Analysis of this protein sequence reveals the following:

```
Lipop: Possible site: -1 Crend: 10
McG: Discrim Score: -11.31
GvH: Signal Score (-7.5): -1.86
Possible site: 28
>>> Seems to have no N-terminal signal sequence
ALOM program count: 1 value: -1.91 threshold: 0.0
INTEGRAL Likelihood = -1.91 Transmembrane 61-77 (60-77)
PERIPHERAL  Likelihood =  9.92   19
modified ALOM score: 0.88

*** Reasoning Step: 3

----- Final Results -----
            bacterial membrane --- Certainty = 0.1765 (Affirmative) < succ>
              bacterial outside --- Certainty = 0.0000 (Not Clear) < succ>
                bacterial cytoplasm --- Certainty = 0.0000 (Not Clear) < succ>
```

The protein has homology with the following sequences in the GENPEPT database.

```
>GP: AAB18686 GB: U38906 ORF11 [Bacteriophage r1t]
Identities = 101/249 (40%), Positives = 157/249 (62%), Gaps = 21/249 (8%)

Query:   3 MAQRRMFSRKITETDRFLEMPLSSQALYFHLNMGADDEGFIDKAKTIQRTIGASDDDMKL   62
           MAQRRM  ++  +T +FL +PL +QALYFHL + ADD+G ++ A  + R +GA++D + L
Sbjct:   1 MAQRRMIDKRTIQTQKFLRLPLETQALYFHLMLNADDDGVVE-AFPVVRMVGAAEDSLGL   59

Query:  63 LIAKGFLIPFDSGVV-VIRHWRIHNYIQSDRFQSTLYQSEKAQLEYDKSKTASLKPIGNC  121
           L+ K F+ P +  +V  I   ++ N I+ DR++++ Y    AQL ++      ++P  N
Sbjct:  60 LVVKQFIKPLNEEMVYFIIDFKEQNTIKKDRYKASKY----AQLLTNEEFGTEMEPKRNQ  115

Query: 122 IQNVSKMETQVRLSKGSLDKDSLTTYPTVSDNEEEDIPYKEIISYLNEKANRNYRPNIQK  181
               +   K    RL K  LDK++       +S   ++ IPY EI+ YLN+K  R++R N++
Sbjct: 116 LGTSDKN----RLDKNRLDKNN-----NMSGKPDDVIPYSEILEYLNKKTGRSFR-NVEA  165

Query: 182 NKTLIKARWSEGFRLDDFKHVIDTTVKDWSGTKY-----EKYLRPETLFGSKFEGYLNQA  236
           NK  LIKARW+EG++L+DFK V+D  V +WSG +      E  YL+P+TLF  +KF+ YLNQ
Sbjct: 166 NKKLIKARWNEGYKLEDFKTVVDNMVSNWSGKMFNGVPAENYLQPKTLFSNKFDSYLNQV  225

Query: 237 PRIKTETID                                                   245
           PRI+ + I+
Sbjct: 226 PRIEQKEIN                                                   234
```

No corresponding DNA sequence was identified in *S. pyogenes*.

SEQ ID 8662 (GBS344) was expressed in *E. coli* as a His-fusion product. SDS-PAGE analysis of total cell extract is shown in FIG. 72 (lane 12; MW 30.9 kDa). It was also expressed in *E. coli* as a GST-fusion product. SDS-PAGE analysis of total cell extract is shown in FIG. 81 (lane 3; MW 59 kDa).

Figure 213:
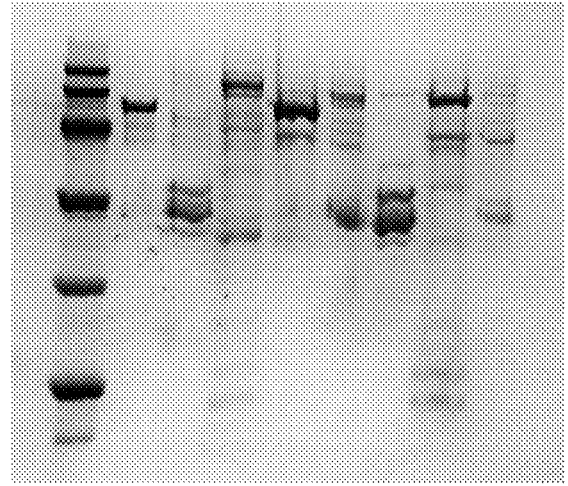
Figure 271:
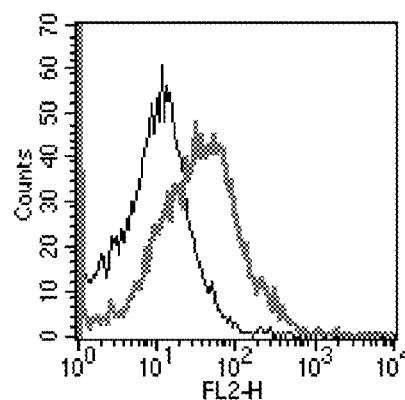

The GBS344-GST fusion product was purified (FIG. 213, (lane 3; FIG. 226, lanes 4-6) and used to immunise mice. The resulting antiserum was used for FACS (FIG. 271), which confirmed that the protein is immunoaccessible on GBS bacteria.

Based on this analysis, it was predicted that these proteins and their epitopes could be useful antigens for vaccines or diagnostics.

EXAMPLE 795

A DNA sequence (GBSx0843) was identified in *S. agalactiae* <SEQ ID 2431> which encodes the amino acid sequence <SEQ ID 2432>. Analysis of this protein sequence reveals the following:

```
Possible site: 47
>>> Seems to have no N-terminal signal sequence

----- Final Results -----
            bacterial cytoplasm --- Certainty = 0.2549 (Affirmative) < succ>
            bacterial membrane  --- Certainty = 0.0000 (Not Clear)   < succ>
            bacterial outside   --- Certainty = 0.0000 (Not Clear)   < succ>
```

The protein has homology with the following sequences in the GENPEPT database:

```
>GP: AAG31329 GB: AF182207 ORF 272 [Bacteriophage mv4]
Identities = 70/241 (29%), Positives = 125/241 (51%), Gaps = 30/241 (12%)

Query:  12 VLEETCEVHGCQLWLTKVPIKGRLEELKQCPECTKAAINIFENKLNSQSKINSKLADTYA    71
           VLE+ C  HG  L +T    +G  E++  CP+C  A+ + + + +++   S +A
Sbjct:  16 VLEQKCSKHGLNL-ITYKNHEG--EQVTCCPQCQAEALEVLQERFDQKAR-QSIIARK--   69

Query:  72 VFERDSLVSDKLRAKSLENYE---------IKDEIDQHAINYAKRMEQFYRQDRTGNAII  122
            F  +SL + K+   + + +E           IK ++   A+ +A +    +     A++
Sbjct:  70 -FRENSLANSKMWKCTFDTFEAQPGSAEELIKGQVRNAAVAFATKPVAHH-------AVL  121

Query: 123 TGPSGVGKSHLTYGLAKFMNEQFKAYESPKSVLFISLVSLFTKIKESFKVDNGY-RQADM  181
           G  G GKSHL      A  M ++    +   K++ FI++  LF+KIK SF    + Y  +
Sbjct: 122 YGQPGAGKSHL----AMAMMQEIHKHRPTKTMAFINISRLFSKIKNSFDDPSEYWTKEKA  177

Query: 182 IELLTRVDYLFLDDLGKESRKGDS--QNNEWTHQILYEILDNRSNTIINTNLSSKEIKALY  240
           +E++   VD L +DDLG ES  G +   +W    ++Y++L+N+    II TNLS +E+K  +Y
Sbjct: 178 LEIMRGVDLLCIDDLGTESSMGRTGQEATKWAQDVIYDVLENQDRIIITTNLSERELKRVY  238
```

No corresponding DNA sequence was identified in *S. pyogenes*.

Based on this analysis, it was predicted that this protein and its epitopes, could be useful antigens for vaccines or diagnostics.

EXAMPLE 796

A DNA sequence (GBSx0844) was identified in *S. agalactiae* <SEQ ID 2433> which encodes the amino acid sequence <SEQ ID 2434>. This protein is predicted to be methyl transferase. Analysis of this protein sequence reveals the following:

```
Possible site: 47
>>> Seems to have no N-terminal signal sequence

----- Final Results -----
            bacterial cytoplasm --- Certainty = 0.1241 (Affirmative) < succ>
            bacterial membrane  --- Certainty = 0.0000 (Not Clear)   < succ>
            bacterial outside   --- Certainty = 0.0000 (Not Clear)   < succ>
```

A related GBS nucleic acid sequence <SEQ ID 10165> which encodes amino acid sequence <SEQ ID 10166> was also identified.

The protein has homology with the following sequences in the GENPEPT database.

```
>GP: AAC98421 GB: L29323 methyl transferase [Streptococcus pneumoniae]
Identities = 262/474 (55%), Positives 313/474 (65%), Gaps = 71/474 (14%)

Query:    2 MKFLDLFAGIGGFRLGMEQAGHECIGFCEINKFARASYKVIHDTEGEIELHDITRVSD-E   60
            M+F+DLF+GIGGFRLGME  GHECIGFCEI+KFAR SYK I  TEGEIE HDI  VSD E
Sbjct:    1 MRFIDLFSGIGGFRLGMESVGHECIGFCEIDKFARESYKSIFQTEGEIEFHDIRDVSDDE   60

Query:   61 FIRGIGSVDVICGGFPCQAFSIAGNRRGFEDTRGTLFFEIARFASILRPKYLFLENVKGL  120
            F +   G VDVICGGFPCQAFSIAG R GFEDTRGTLFFEIAR A   ++P++LFLENVKGL
Sbjct:   61 FKKLRGKVDVICGGFPCQAFSIAGRRLGFEDTRGTLFFEIARAAKQIQPRFLFLENVKGL  120

Query:  121 LNHEGGATFETIIRTLDELGYNVEWQIFNSKNFGVPQNRERVFIIGHLRGEGTRPIFPFE  180
            LNH+ G TF TI+ TLDELG++VEWQ+ NSK+FGVPQNRERVFIIGH R  GTR FPF
Sbjct:  121 LNHDKGRTFTTILTTLDELGFDVEWQMLNSKDFGVPQNRERVFIIGHSRKRGTRLGFPFR  180

Query:  181 SSITENYPIHTRKIGNVNPSGNGMNGEVYDSEGLSPTLTTNKGEGVKIAVN---------  231
                      P   + +GN+NPS +GM+G+VY SEGL+PTL   KGEG KIA+
Sbjct:  181 REGQATNPETLKILGNLNPSKSGMSGKVYYSEGLAPTLVRGKGEGFKIAIPCMTPDRLDK  240

Query:  232 -------------------------VVGRLPGKFEMPNRVYDPDGLAPTIRTMQGGGLE  265
                                     VVG LP  F+   RVY  +GL+PT+  TMQGG
Sbjct:  241 RQNGRRFKDNQEPMFTLNTQDRHGIVVVGDLPTSFKETGRVYGSEGLSPTLTTMQGGDKI  300

Query:  266 PKIIQRGRGYNQGGEYEISPTVTCNSWQENNLLKIKEATKKGYSEAEAGDSVNLSHPNSE  325
            PKI+                   +    LK++EATKKGY++AE GDS+NL  P+S+
Sbjct:  301 PKILIP--------------------EPIQFLKVREATKKGYAQAEIGDSINLERPSSQ  339

Query:  326 TRRGRVGKGIANTLLTGEEQGVVV--YDLYNRRKKDIVGTLTASGHNGNTTTGTFGISNG  383
            RRGRVGKGIANTL T + GVVV   Y+  +++    + G L             G
Sbjct:  340 HRRGRVGKGIANTLTTSGQMGVVVASYEGEDKQVYQVAGVLID-----------GQFYR  387

Query:  384 FRIRKLTPRECWRLQGFPDWAFDKASQVNSNSQLYKQAGNSVTVNVIAAIARRL        437
            RIR++TP+EC+RLQGFPDWAF+ A +V+SNSQLYKQAGNSVTV VIAAIA++L
Sbjct:  388 LRIRRITPKECFRLQGFPDWAFEAARKVSSNSQLYKQAGNSVTVPVIAAIAKKL        441
```

There is also homology to SEQ ID 2436:

```
Identities = 53/75 (70%), Positives = 62/75 (82%), Gaps = 1/75 (1%)

Query:    2 MKFLDLFAGIGGFRLGMEQAGHECIGFCEINKFARASYKVIHDTEGEIELHDITRVSDEF   61
            MKFLDLFAGIGGFRLG+    HECIGFCEI+KFAR SYK I++TEGEIE HDI +V+D+
Sbjct:    4 MKFLDLFAGIGGFRLGLINQCHECIGFCEIDKFARQSYKAIYETEGEIEFHDIRQVTDQD   63

Query:   62 IRGI-GSVDVICGGF                                              75
            R + G VD+ICGGF
Sbjct:   64 FRQLRGQVDIICGGF                                              78
```

Based on this analysis, it was predicted that these proteins and their epitopes could be useful antigens for vaccines or diagnostics.

EXAMPLE 797

A DNA sequence (GBSx0845) was identified in *S. agalactiae* <SEQ ID 2437> which encodes the amino acid sequence <SEQ ID 2438>. Analysis of this protein sequence reveals the following:

```
Possible site: 29
>>> Seems to have no N-terminal signal sequence

----- Final Results -----
            bacterial cytoplasm --- Certainty = 0.2585 (Affirmative) < succ>
            bacterial membrane  --- Certainty = 0.0000 (Not Clear)  < succ>
            bacterial outside   --- Certainty = 0.0000 (Not Clear)  < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 798

A DNA sequence (GBSx0846) was identified in *S. agalactiae* <SEQ ID 2439> which encodes the amino acid sequence <SEQ ID 2440>. This protein is predicted to be arpR protein. Analysis of this protein sequence reveals the following:

```
Possible site: 46
>>> Seems to have no N-terminal signal sequence

----- Final Results -----
           bacterial cytoplasm --- Certainty = 0.5070 (Affirmative) < succ>
           bacterial membrane  --- Certainty = 0.0000 (Not Clear)   < succ>
            bacterial outside  --- Certainty = 0.0000 (Not Clear)   < succ>
```

The protein has homology with the following sequences in the GENPEPT database.

```
>GP: AAB09197 GB: U24159 orf12 [Bacteriophage HP1]
Identities = 34/69 (49%), Positives = 47/69 (67%), Gaps = 1/69 (1%)

Query:  1 MTKTMTLEEKVEQWFIDRNLHE-ANPVKQFQKLIEETGELYSGIAKGKSEIIRDSLGDMQ   59
          M      L + +EQW  DRNL E + P KQF KL+EE GEL SG+AK K ++I+DS+GD
Sbjct:  1 MADLQQLIKNIEQWAEDRNLVEDSTPQKQFIKLMEEFGELCSGVAKNKPDVIKDSIGDCF   60

Query: 60 VVLIGIEQQ                                                     68
          VV++ + +Q
Sbjct: 61 VVMVILAKQ                                                     69
```

No corresponding DNA sequence was identified in *S. pyogenes*.

Based on this analysis, it was predicted that this protein and its epitopes, could be useful antigens for vaccines or diagnostics.

EXAMPLE 799

A DNA sequence (GBSx0847) was identified in *S. agalactiae* <SEQ ID 2441> which encodes the amino acid sequence <SEQ ID 2442>. Analysis of this protein sequence reveals the following:

```
Possible site: 58
>>> Seems to have an uncleavable N-term signal seq
INTEGRAL Likelihood = -5.10 Transmembrane 13-29 (10-36)

----- Final Results -----
           bacterial membrane  --- Certainty = 0.3039 (Affirmative) < succ>
            bacterial outside  --- Certainty= 0.0000 (Not Clear)    < succ>
           bacterial cytoplasm --- Certainty= 0.0000 (Not Clear)    < succ>
```

The protein has homology with the following sequences in the GENPEPT database.

```
>GP: AAD21919 GB: AF085222 unknown [Streptococcus thermophilus
bacteriophage DT1]
Identities = 31/67 (46%), Positives = 49/67 (72%), Gaps = 1/67 (1%)

Query:  42 HQEADRVIIYVADNAGAEMFGKITDKEIIEGRHTVTAGAYGKFLVTEEQYNEITVGDDIP  101
              ++  + ++++ ADN    E+ GK+T K ++    +T+   GAYGKFLV++EQY+ + VGD+IP
Sbjct:  34 NRPVEAIVVHKADNF-VELHGKVTGKSMVGKLYTIDCGAYGKFLVSKEQYDSVQVGDEIP   92

Query: 102 DYLKGRG                                                      108
           YLKGRG
Sbjct:  93 SYLKGRG                                                       99
```

No corresponding DNA sequence was identified in *S. pyogenes*.

Based on this analysis, it was predicted that this protein and its epitopes, could be useful antigens for vaccines or diagnostics.

EXAMPLE 800

A DNA sequence (GBSx0848) was identified in *S. agalactiae* <SEQ ID 2443> which encodes the amino acid sequence <SEQ ID 2444>. This protein is predicted to be gene 17 protein. Analysis of this protein sequence reveals the following:

```
Possible Site: 55
>>> Seems to have no N-terminal signal sequence

----- Final Results -----
            bacterial cytoplasm --- Certainty = 0.5428 (Affirmative) < succ>
            bacterial membrane  --- Certainty = 0.0000 (Not Clear)   < succ>
            bacterial outside   --- Certainty = 0.0000 (Not Clear)   < succ>
```

The protein has homology with the following sequences in the GENPEPT database.

```
> GP: CAA24397 GB: V01146 gene 1.7 [Bacteriophage T7]
Identities = 30/72 (41%), Positives = 40/72 (54%)

Query:  47 DNVNYPSHYQGKYGLESIDVLRNFMTPEMLKGFYLGNALKYQLRYRKKNGLEDLKKARKN 106
           +  V  PSHY    +E+I+V+   MT E  KG+  GN LKY+LR  KK+ L   L+K
Sbjct: 120 EGVTKPSHYMLFDDIEAIEVIARSMTVEQFKGYCFGNILKYRLRAGKKSELAYLEKDLAK 179

Query: 107 LDWLIEEMEKEK                                                 118
           D+  E  EK K
Sbjct: 180 ADFYKELFEKHK                                                 191
```

No corresponding DNA sequence was identified in *S. pyogenes*.

Based on this analysis, it was predicted that this protein and its epitopes, could be useful antigens for vaccines or diagnostics.

EXAMPLE 801

A DNA sequence (GBSx0849) was identified in *S. agalactiae* <SEQ ID 2445> which encodes the amino acid sequence <SEQ ID 2446>. Analysis of this protein sequence reveals the following:

```
Possible site: 28
>>> Seems to have no N-terminal signal sequence

----- Final Results -----
            bacterial cytoplasm --- Certainty = 0.1375 (Affirmative) < succ>
            bacterial membrane  --- Certainty = 0.0000 (Not Clear)   < succ>
            bacterial outside   --- Certainty = 0.0000 (Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 802

A DNA sequence (GBSx0850) was identified in *S. agalactiae* <SEQ ID 2447> which encodes the amino acid sequence <SEQ ID 2448>. Analysis of this protein sequence reveals the following:

```
Possible site: 31
>>> Seems to have no N-terminal signal sequence

----- Final Results -----
             bacterial cytoplasm --- Certainty = 0.0087(Affirmative) < succ>
              bacterial membrane --- Certainty = 0.0000(Not Clear)   < succ>
               bacterial outside --- Certainty = 0.0000(Not Clear)   < succ>
```

A related GBS nucleic acid sequence <SEQ ID 10163> which encodes amino acid sequence <SEQ ID 10164> was also identified.

The protein has homology with the following sequences in the GENPEPT database.

```
>GP: AAF26608 GB: AF145054 ORF9 [Streptococcus thermophilus
bacteriophage 7201]
Identities = 99/148 (66%), Positives = 116/148 (77%), Gaps = 10/148 (6%)

Query:   5 MINNVVLIGRLTRDVELRYTPSNIANATFNLAVNRNFKNAAGDREADFINCVMWRQQAEN    64
           MINN VL+GRLT+D E +YT SNIA A+F+LAVNRNFK+A G+READFINCV+WRQQAEN
Sbjct:   1 MINNTVLVGRLTKDPEFKYTGSNIAVASFSLAVNRNFKDANGEREADFINCVIWRQQAEN    60

Query:  65 LANWTKKGMLIGITGRIQTRSYENQQGQRIYVTEVVADSFQILEKR----DNSTNQASMD   120
           LANW KKG LIGITGRIQTRSYENQQGQR+YVTEVVA++FQ+LE R        + N +
Sbjct:  61 LANWAKKGALIGITGRIQTRSYENQQGQRVYVTEVVAENFQMLESRAAREGGNANNSYSQ   120

Query: 121 DQLP------PSFGNSQPMDISDDDLPF                                  142
           Q+P         + N QP+DIS DDLPF
Sbjct: 121 QQVPNFARKNTEYSNKQPLDISSDDLPF                                  148
```

There is also homology to SEQ ID 1492.

Based on this analysis, it was predicted that these proteins and their epitopes could be useful antigens for vaccines or diagnostics.

EXAMPLE 803

A DNA sequence (GBSx0851) was identified in *S. agalactiae* <SEQ ID 2449> which encodes the amino acid sequence <SEQ ID 2450>. This protein is predicted to be puff C4B protein. Analysis of this protein sequence reveals the following:

```
Possible site: 19
>>> Seems to have no N-terminal signal sequence

----- Final Results -----
             bacterial cytoplasm --- Certainty = 0.1203(Affirmative) < succ>
              bacterial membrane --- Certainty = 0.0000(Not Clear)   < succ>
               bacterial outside --- Certainty = 0.0000(Not Clear)   < succ>
```

A related GBS nucleic acid sequence <SEQ ID 10161> which encodes amino acid sequence <SEQ ID 10162> was also identified.

The protein has no significant homology with any sequences in the GENPEPT database.

No corresponding DNA sequence was identified in *S. pyogenes*.

Based on this analysis, it was predicted that these proteins and their epitopes could be useful antigens for vaccines or diagnostics.

EXAMPLE 804

A DNA sequence (GBSx0852) was identified in *S. agalactiae* <SEQ ID 2451> which encodes the amino acid sequence <SEQ ID 2452>. This protein is predicted to be F5M15.19. Analysis of this protein sequence reveals the following:

```
Possible site: 16
>>> Seems to have an uncleavable N-term signal seq
      INTEGRAL     Likelihood = -2.34     Transmembrane     7-23 (6-23)

----- Final Results -----
              bacterial membrane --- Certainty = 0.1935(Affirmative) < succ>
               bacterial outside --- Certainty = 0.0000(Not Clear)   < succ>
             bacterial cytoplasm --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 805

A DNA sequence (GBSx0853) was identified in *S. agalactiae* <SEQ ID 2453> which encodes the amino acid sequence <SEQ ID 2454>. Analysis of this protein sequence reveals the following:

```
Possible site: 54
>>> Seems to have no N-terminal signal sequence

----- Final Results -----
            bacterial cytoplasm --- Certainty = 0.4398(Affirmative) < succ>
            bacterial membrane  --- Certainty = 0.0000(Not Clear)   < succ>
             bacterial outside  --- Certainty = 0.0000(Not Clear)   < succ>
```

A related GBS nucleic acid sequence <SEQ ID 10159> which encodes amino acid sequence <SEQ ID 10160> was also identified.

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 806

A DNA sequence (GBSx0855) was identified in *S. agalactiae* <SEQ ID 2455> which encodes the amino acid sequence <SEQ ID 2456>. Analysis of this protein sequence reveals the following:

```
Possible site: 58
>>> Seems to have no N-terminal signal sequence

----- Final Results -----
            bacterial cytoplasm --- Certainty = 0.2992(Affirmative) < succ>
            bacterial membrane  --- Certainty = 0.0000(Not Clear)   < succ>
             bacterial outside  --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 807

A DNA sequence (GBSx0856) was identified in *S. agalactiae* <SEQ ID 2457> which encodes the amino acid sequence <SEQ ID 2458>. Analysis of this protein sequence reveals the following:

```
Possible site: 54
>>> Seems to have no N-terminal signal sequence

----- Final Results -----
            bacterial cytoplasm --- Certainty = 0.4639(Affirmative) < succ>
            bacterial membrane  --- Certainty = 0.0000(Not Clear)   < succ>
             bacterial outside  --- Certainty = 0.0000(Not Clear)   < succ>
```

The protein has homology with the following sequences in the GENPEPT database.

```
>GP: BAB07758 GB: AP001520 unknown conserved protein
[Bacillus halodurans]
Identities = 65/184 (35%), Positives = 102/184 (55%), Gaps = 6/184 (3%)

Query:    1 MNIVEPLRDKDDIQAMKDYLSSWNEKYYMLFLLGINTGFRVGDILKLKVKDVQGWHIKVR    60
            M   V P RD D IQA+K  L   + + Y+LF +GINTG R+   +L LK+KDV
Sbjct:    1 MEYVVPFRDVDQIQAIKRSLKKKSPRDYLLFTIGINTGLRISQLLALKIKDVYDGQKPKD   60

Query:   61 EQKTGKYKSIKMTRPLKNELR---EFVKDKELHEYLFQSRVGKNKALSYKTVYWFLKRAA  117
                +   + + +   +K   L+      F++ +E H  LF S    ++ ++ +  Y  +K+AA
Sbjct:   61 YLQLESGEIVYLNDQVKKALQFYAHFIEFQEQH-CLFAS-TNPDQPMTRQHAYRIIKQAA  118

Query:  118 EDLGI-DNVGTHTMRKTFGYHYYKKYKNVADLMSLFNHSSPAVTLIYICVRQDELDTKMS  176
               +G+ D +GTHT+RKTFGYH Y++    ++  L     FNH +PA TL YI +  ++E
Sbjct:  119 LQVGLTDQIGTHTLRKTFGYHAYRQGVALSLLQQRFNHQTPAQTLRYIDIAKNEQTIPRI  178

Query:  177 NFSL                                                         180
            N +L
Sbjct:  179 NVNL                                                         182
```

No corresponding DNA sequence was identified in *S. pyogenes*.

Based on this analysis, it was predicted that this protein and its epitopes, could be useful antigens for vaccines or diagnostics.

EXAMPLE 808

A DNA sequence (GBSx0857) was identified in *S. agalactiae* <SEQ ID 2459> which encodes the amino acid sequence <SEQ ID 2460>. Analysis of this protein sequence reveals the following:

```
Possible site: 33
>>> Seems to have no N-terminal signal sequence

----- Final Results -----
           bacterial cytoplasm --- Certainty = 0.3582(Affirmative) < succ>
           bacterial membrane  --- Certainty = 0.0000(Not Clear)   < succ>
           bacterial outside   --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 809

A DNA sequence (GBSx0858) was identified in *S. agalactiae* <SEQ ID 2461> which encodes the amino acid sequence <SEQ ID 2462>. Analysis of this protein sequence reveals the following:

```
Possible site: 33
>>> Seems to have no N-terminal signal sequence

----- Final Results -----
           bacterial cytoplasm --- Certainty = 0.2732(Affirmative) < succ>
           bacterial membrane  --- Certainty = 0.0000(Not Clear)   < succ>
           bacterial outside   --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 810

A DNA sequence (GBSx0859) was identified in *S. agalactiae* <SEQ ID 2463> which encodes the amino acid sequence <SEQ ID 2464>. Analysis of this protein sequence reveals the following:

```
Possible site: 27
>>> Seems to have no N-terminal signal sequence

----- Final Results -----
          bacterial cytoplasm --- Certainty = 0.1720(Affirmative) < succ>
          bacterial membrane  --- Certainty = 0.0000(Not Clear)   < succ>
          bacterial outside   --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 811

A DNA sequence (GBSx0860) was identified in *S. agalactiae* <SEQ ID 2465> which encodes the amino acid sequence <SEQ ID 2466>. Analysis of this protein sequence reveals the following:

```
Possible site: 26
>>> Seems to have no N-terminal signal sequence

----- Final Results -----
          bacterial cytoplasm --- Certainty = 0.2619(Affirmative) < succ>
          bacterial membrane  --- Certainty = 0.0000(Not Clear)   < succ>
          bacterial outside   --- Certainty = 0.0000(Not Clear)   < succ>
```

A related GBS nucleic acid sequence <SEQ ID 10157> which encodes amino acid sequence <SEQ ID 10158> was also identified.

The protein has no significant homology with any sequences in the GENPEPT database.

No corresponding DNA sequence was identified in *S. pyogenes*.

Based on this analysis, it was predicted that these proteins and their epitopes could be useful antigens for vaccines or diagnostics.

EXAMPLE 812

A DNA sequence (GBSx0861) was identified in *S. agalactiae* <SEQ ID 2467> which encodes the amino acid sequence <SEQ ID 2468>. This protein is predicted to be terminase large subunit. Analysis of this protein sequence reveals the following:

```
Possible site: 13
>>> Seems to have no N-terminal signal sequence

----- Final Results -----
          bacterial cytoplasm --- Certainty = 0.2753(Affirmative) < succ>
          bacterial membrane  --- Certainty = 0.0000(Not Clear)   < succ>
          bacterial outside   --- Certainty = 0.0000(Not Clear)   < succ>
```

The protein has homology with the following sequences in the GENPEPT database.

```
>GP: AAC27181 GB: AF009630 putative terminase subunit [bacteriophage
bIL170]
Identities = 147/531 (27%), Positives = 261/531 (48%), Gaps = 26/531 (4%)

Query:   19 IRICKLTMKSIRRVERYKEQYLFKQEEADKRIEFIEEECSNTKGLAGKLRLALPQKVWLE    78
            I + K   K+I++  R  ++Y+++ +   + IE+IE+     T G   K++L    QK W E
Sbjct:   16 IELNKYMRKTIQKQIRIHKKYIYRYDRVTQAIEWIEDNFYLTTGNLMKIKLHPTQKYWYE    75

Query:   79 TTWGFYHTVEVTKTNPDTLEEYTDYEERRLIHEVPIIVPRGTGKTTLGSAIAEVGQIIDG   138
            G+              D ++E    +  LI+E+ + + RG+GK++L +         I+ G
Sbjct:   76 LMLGY-----------DMVDEKG--VQVNLINEIFLNLGRGSGKSSLMATRVLNWMILGG   122

Query:  139 EWGADIQLLAYSREQAGYLFNASRAMLSNEESLLHYMREADILRSTKQGILYETTNSLMS   198
            ++G +  ++AY    QA ++F+  R       ++L   Y   E   I +STKQG+ +        +
Sbjct:  123 QYGGESLVIAYDNTQARHVFDQVRNQTEASDTLRVY-NENKIFKSTKQGLEFTAFKTTFK   181

Query:  199 IKTSDYESLDGTNAHYNIFDEVHTYDDDFIKVVNDGSSRKRKNWITWYISTNGTKRDKLF   258
            +T+D      G N+   NIFDEVHTY +D  +  VN GS +K+  NW  +  YI++ G   KRD  L+
Sbjct:  182 KQTNDTLRAQGGNSSLNIFDEVHTYGEDITESVNKGSRQKQDNWQSIYITSGGLKRDGLY   241

Query:  259 DKYYNIWVDILDDKIINDSVMPWIYQLDDVSEIHDPDMWQKAMPLLGITTEKETIARDIE   318
            DK     +   +++  ND      +Y L++   ++ D     W   A+PL+G    +    +   + E
Sbjct:  242 DKLVERFKS--EEEFYNDRSFGLLYMLENHEQVKDKKNWTMALPLIGDVPKWSGVIEEYE   299

Query:  319 MSKNDPAQQAELMAKTFNLPVNNYLAYFSNEECKGWSDKFDESLFVGDDERNARCVIGID   378
            +++ DPA Q + +A    LP+ +    YF+ ++ K      +F+ S+F         R   +GID
Sbjct:  300 LAQGDPALQNKFLAFNMGLPMQDTAYYFTPQDTK--LTEFNLSVF-----NKNRTYVGID   352

Query:  379 LSDVNDICSISFMVVRGEERHYLNKKFMPRHTIETLPKELRDKYTEWELSGMLHVHELDY   438
            LS + D+ ++SF+      + +    F   R   E L  E ++ +TE+    G L + + +Y
Sbjct:  353 LSLIGDLTAVSFVCELEGKTYSHTLTFSVRSQYEQLDTEQQELWTEFVDRGELILLDTEY   412

Query:  439 NDQAYIFEELRQFMSDNRILPVAVGYDRYNARELIRLFNDYYGDICHDIPQTVK---SLS   495
            +    +   +   F S        +GYD     L   L   Y+ D   D + ++      S++
Sbjct:  413 INVNDLIPYINDFRSKTGCRLRKIGYDPARYEILKGLIERYFFDKDGDNQRAIRQGFSMN   472

Query:  496 NPLKVYKEKAKMGKIIFDDPVATWNHANVRVKIDANNNIFPNKEKAKEKID            546
            +  +K+ K K    K+I +   V  W   N  VKI + +     K+   K+KID
Sbjct:  473 DYIKLLKSKLVENKLIHNQKVMQWALNNTAVKIGQSGDYMYTKKLEKDKID           523
```

No corresponding DNA sequence was identified in *S. pyogenes*.

Based on this analysis, it was predicted that this protein and its epitopes, could be useful antigens for vaccines or diagnostics.

EXAMPLE 813

A DNA sequence (GBSx0862) was identified in *S. agalactiae* <SEQ ID 2469> which encodes the amino acid sequence <SEQ ID 2470>. Analysis of this protein sequence reveals the following:

```
Possible site: 53
>>> Seems to have no N-terminal signal sequence

----- Final Results -----
          bacterial cytoplasm --- Certainty = 0.3319(Affirmative) < succ>
           bacterial membrane --- Certainty = 0.0000(Not Clear)   < succ>
            bacterial outside --- Certainty = 0.0000(Not Clear)   < succ>
```

The protein has homology with the following sequences in the GENPEPT database.

```
>GP: AAB41469 GB: L35061 orfL4 [Bacteriophage phi-41]
Identities = 86/374 (22%), Positives = 166/374 (43%), Gaps = 38/374 (10%)

Query:   12 FARIFRPNNRKSTRTYLQRSISYWRRNSIYLDNIYNKISTDTAQLRFKHVKITRNPGGVD    71
            F+R      N+ +       +   ++ Y    S ++ NI+NKI+ +   ++ F HVK ++    G D
```

```
                        -continued
Sbjct:   10 FSRGKLNNDTQRVTAWQNEAVEY---TSAFVTNIHNKIANEITKVEFNHVKYKKSDVGSD    66

Query:   72 SMVWYEHSDLAEVLTVSPNPLEVPVVFWSNVTRAMLRDGVAVVVPRW--KNGRLVEIWLA   129
            +++     SDL EVL S       + FW V + +L      + P +  K G LV++ A
Sbjct:   67 TLISMAGSDLDEVLNWSSKGERNSMEFWQKVIKKLLTTRYIDLYPIFDRKTGDLVDLLFA   126

Query:  130 KKTVTWTAESVELMLDDVAVELPLTDVWVFENPKLNVTAQLNQITELIDINLNALTEKLS   189
              + E + ++   +                      N+ T ++D  L  + KL
Sbjct:  127 DNKKEYKPEELVRLISPFYI--------------------NEDTSILDNALAGIQTKLE   165

Query:  190 DGNSSLRGFLKLPT---KAADEHLKQQARDRVDSMLDLAKNGGIAYLEQGEEFQELSKDY   246
               G   ++G LK+         D+  K +A   + +M +++   G+    E    EL KDY
Sbjct:  166 QGK--MKGLLKINAFIDTDNDQEFKDKAMLTIKNMQEMSNYNGLTPTDNKTEIVELKKDY   223

Query:  247 STASKEELEFLKSQLYNAHGINEKLFTCDYTEEQYRAYYSSVMKLYQRVYSEEINRKYFT   306
                S  +K+E++ +KS+L  + +NE +      ++EQ   +Y+S +         +E+  K  +
Sbjct:  224 SVLNKDEIDLIKSELLTGYFMNENILLGTASQEQQIYFYNSTIIPLLIQLEKELTYKLIS   283

Query:  307 KTAR--TQGN----KLLVFFDMADMISFKDLVEGGFKSKYAGLMNSNEFRETYLGLPGYE   360
               R    +GN      +++V   +     + K+L++    ++      +    N+        +G        +
Sbjct:  284 TNRRRVVKGNLYYERIIVDNQLFKFATLKELIDLYHENINGPIFTQNQLL-VKMGEQPIE   342

Query:  361 GGEVFETNLNAVRI                                                374
            GG+V+  NLNAV +
Sbjct:  343 GGDVYIANLNAVAV                                                356
```

No corresponding DNA sequence was identified in *S. pyogenes*.

Based on this analysis, it was predicted that this protein and its epitopes, could be useful antigens for vaccines or diagnostics.

EXAMPLE 814

A DNA sequence (GBSx0863) was identified in *S. agalactiae* <SEQ ID 2471> which encodes the amino acid sequence <SEQ ID 2472>. This protein is predicted to be a prohead protease. Analysis of this protein sequence reveals the following:

```
Possible site: 25
>>> Seems to have no N-terminal signal sequence

----- Final Results -----
            bacterial cytoplasm --- Certainty = 0.3496(Affirmative) < succ>
            bacterial membrane --- Certainty = 0.0000(Not Clear)   < succ>
             bacterial outside --- Certainty = 0.0000(Not Clear)   < succ>
```

The protein has homology with the following sequences in the GENPEPT database.

```
>GP: AAF31089 GB: AF069529 protease [Bacteriophage HK97]
Identities = 52/142 (36%), Positives = 73/142 (50%), Gaps = 11/142 (7%)

Query:   21 FEAYASTYDNTDREGDVMAKGCFDNTLKSKA-VVPMCLNHDR-NCVIGKHE-LSVDEKGL    77
            FE YAS ++NTD +GD++  G F N L ++   V M  NH      +GK + L+ DEKGL
Sbjct:   26 FEGYASVFNNTDSDGDIILPGAFKNALANQTRKVAMFFNHKTWELPVGKWDSLAEDEKGL    85

Query:   78 RTRSTFNLSDPEAKKTYDLMKMGALDSLSIGFFI--KDYEPIDAKQPYGGWIFKEVE-IF   134
               R         A       M+ G ++ +S+GF +    DY  I       G IFK ++  +
Sbjct:   86 YVRGQLTPGHSGAADLKAAMQHGTVEGMSVGFSVAKDDYTIIPT-----GRIFKNIQALR   140

Query:  135 EISVVTVPANPQATVDNIKEFD                                        156
            EISV T PAN QA +  +K  D
Sbjct:  141 EISVCTFPANEQAGIAAMKSVD                                        162
```

No corresponding DNA sequence was identified in S. pyogenes.

Based on this analysis, it was predicted that this protein and its epitopes, could be useful antigens for vaccines or diagnostics.

EXAMPLE 815

A DNA sequence (GBSx0864) was identified in S. agalactiae <SEQ ID 2473> which encodes the amino acid sequence <SEQ ID 2474>. Analysis of this protein sequence reveals the following:

```
Possible site: 47
>>> Seems to have no N-terminal signal sequence

----- Final Results -----
            bacterial cytoplasm --- Certainty = 0.2247(Affirmative) < succ>
             bacterial membrane --- Certainty = 0.0000(Not Clear) < succ>
              bacterial outside --- Certainty = 0.0000(Not Clear) < succ>
```

A related GBS nucleic acid sequence <SEQ ID 10155> which encodes amino acid sequence <SEQ ID 10156> was also identified.

The protein has homology with the following sequences in the GENPEPT database.

```
>GP: AAC27185 GB: AF009630 16 [bacteriophage bIL170]
Identities = 70/249 (28%), Positives = 121/249 (48%), Gaps = 23/249 (9%)

Query:   51 LEQLKTDAESLVSQATA--IKETIAGLDSDIEETEEELSK-AAKIIK---------EKQK   98
            L +LK +   SL SQ    +K  I  L   ++E E+ LS+ + +IIK         EK K
Sbjct:   13 LAELKENNVSLKSQINGFEVKNAIEDLPK-VQELEKTLSENSIEIIKIENELNAQEEKPK   71

Query:   99 GNTPM-DYLKTKAAALDFVRILMDNEGSANSARKAWEANLVEKGV--TNLTKILPEPVLI   155
            G    M  ++++++ A  +F  +L   N G +    + AW  A L E GV   T+ T   LP  ++
Sbjct:   72 GKAKMTNFIESQNAVTEFFDVLKKNSGKSE-IKNAWNAKLAENGVTITDTTFQLPRKLVE   130

Query:  156 AIQDAFTNYNGILN--HVSKDPRYAVRVALQTQVSQAKGHKAGKTKKDEDFTFLDFTINS   213
            +I  A  N N +    HV+     V + +  ++A+ HK G+TK ++   T      T+
Sbjct:  131 SINTALLNTNPVFKVFHVTNVGALLVSRSFDSS-AEAQVHKDGQTKTEQAATLTIDTLEP   189

Query:  214 ATVY-IKYAFEYSDLKKDTTGAYFNYVMKELAQGFI-RTIERAVVIGDGKSN-SAEDKIT   270
             VY ++   E   + +      +N ++ EL Q + + ++ A+V GDG +    + DK
Sbjct:  190 VMVYKLQSLAERVKRLQMSYSELYNLIVAELTQAIVNKIVDLALVEGDGSNGFKSIDKEA   249

Query:  271 EIKSIAEET                                                     279
            ++K I + T
Sbjct:  250 DVKKIKKIT                                                     258
```

No corresponding DNA sequence was identified in *S. pyogenes*.

Based on this analysis, it was predicted that these proteins and their epitopes could be useful antigens for vaccines or diagnostics.

EXAMPLE 816

A DNA sequence (GBSx0865) was identified in *S. agalactiae* <SEQ ID 2475> which encodes the amino acid sequence <SEQ ID 2476>. Analysis of this protein sequence reveals the following:

```
Possible site: 39
>>> Seems to have no N-terminal signal sequence

----- Final Results -----
            bacterial cytoplasm --- Certainty = 0.3068(Affirmative) < succ>
            bacterial membrane  --- Certainty = 0.0000(Not Clear)   < succ>
            bacterial outside   --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 817

A DNA sequence (GBSx0866) was identified in *S. agalactiae* <SEQ ID 2477> which encodes the amino acid sequence <SEQ ID 2478>. Analysis of this protein sequence reveals the following:

```
Possible site: 56
>>> Seems to have no N-terminal signal sequence

----- Final Results -----
            bacterial cytoplasm --- Certainty = 0.0437(Affirmative) < succ>
            bacterial membrane  --- Certainty = 0.0000(Not Clear)   < succ>
            bacterial outside   --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 818

A DNA sequence (GBSx0867) was identified in *S. agalactiae* <SEQ ID 2479> which encodes the amino acid sequence <SEQ ID 2480>. Analysis of this protein sequence reveals the following:

```
Possible site: 14
>>> Seems to have no N-terminal signal sequence

----- Final Results -----
            bacterial cytoplasm --- Certainty = 0.3181(Affirmative) < succ>
            bacterial membrane  --- Certainty = 0.0000(Not Clear)   < succ>
            bacterial outside   --- Certainty = 0.0000(Not Clear)   < succ>
```

A related GBS nucleic acid sequence <SEQ ID 10153> which encodes amino acid sequence <SEQ ID 10154> was also identified.

The protein has no significant homology with any sequences in the GENPEPT database.

No corresponding DNA sequence was identified in *S. pyogenes*.

Based on this analysis, it was predicted that these proteins and their epitopes could be useful antigens for vaccines or diagnostics.

EXAMPLE 819

A DNA sequence (GBSx0869) was identified in *S. agalactiae* <SEQ ID 2481> which encodes the amino acid sequence <SEQ ID 2482>. This protein is predicted to be a major structural protein. Analysis of this protein sequence reveals the following:

```
Possible site: 29
>>> Seems to have no N-terminal signal sequence

----- Final Results -----
             bacterial cytoplasm --- Certainty = 0.3364(Affirmative) < succ>
             bacterial membrane  --- Certainty = 0.0000(Not Clear)   < succ>
             bacterial outside   --- Certainty = 0.0000(Not Clear)   < succ>
```

The protein has homology with the following sequences in the GENPEPT database.

```
>GP: AAA74331 GB: L33769 unidentified ORF28; putative [Bacteriophage bIL67]
Identities = 55/201 (27%), Positives = 84/201 (41%), Gaps = 18/201 (8%)

Query:    9 EVTHGNANGF-YAKIAKTDAGALDLQKPYPFTGLRSTSFETSQESNAYYAD-NVEHVRLQ    66
            E+THG    G  +   +   G           P GLR     ++ QE+  +YA  N  +   +
Sbjct:    8 ELTHGLGYGVVFTDLTGSKTGI-------PIAGLRGIETDSKQENKNFYAGFNAPYRTIA   60

Query:   67 GKKSTEGSITTYQIPKQFMIDHLGKKLTNSTPPALIDTGVNTN-FIWGYAETVTDEFGAE   125
            G K T+  + +Y +P  F       LG    S    L D   N  + + YAE   D+ G
Sbjct:   61 GAKDTQIKVKSYDLPDDFATHALG---FGSVQGFLTDDVANYKPYGFAYAERYRDDDGTG   117

Query:  126 IEEFHIWTNVKASAPKGSTSTDETSATPKEIEIPCTASPNNFIVDSEKKPVSEIVWRDDS   185
            +    +  +V+A+ P  +    DE S T KE E     T +  +F +   +K+  +     D
Sbjct:  118 YKA-TFYPSVQATTPSDTAEADEESPTGKEYEHEATVTTGDFTLGDKKRLFVKFKVSDTE   176

Query:  186 KGT-VRGK---FDKLFADKSP                                          202
              T   GK     F KLF D  P
Sbjct:  177 LATGTSGKALAFKKLFTDLKP                                          197
```

No corresponding DNA sequence was identified in *S. pyogenes*.

Based on this analysis, it was predicted that this protein and its epitopes, could be useful antigens for vaccines or diagnostics.

EXAMPLE 820

A DNA sequence (GBSx0870) was identified in *S. agalactiae* <SEQ ID 2483> which encodes the amino acid sequence <SEQ ID 2484>. Analysis of this protein sequence reveals the following:

```
Possible site: 61
>>> Seems to have no N-terminal signal sequence

----- Final Results -----
            bacterial cytoplasm --- Certainty = 0.2531(Affirmative) < succ>
            bacterial membrane  --- Certainty = 0.0000(Not Clear)   < succ>
            bacterial outside   --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 821

A DNA sequence (GBSx0871) was identified in *S. agalactiae* <SEQ ID 2485> which encodes the amino acid sequence <SEQ ID 2486>. Analysis of this protein sequence reveals the following:

```
Possible site: 22
>>> Seems to have no N-terminal signal sequence

----- Final Results -----
            bacterial cytoplasm --- Certainty = 0.2972(Affirmative) < succ>
            bacterial membrane  --- Certainty = 0.0000(Not Clear)   < succ>
            bacterial outside   --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 822

A DNA sequence (GBSx0872) was identified in *S. agalactiae* <SEQ ID 2487> which encodes the amino acid sequence <SEQ ID 2488>. Analysis of this protein sequence reveals the following:

```
Possible site: 49
>>> Seems to have no N-terminal signal sequence

----- Final Results -----
            bacterial cytoplasm --- Certainty = 0.3860(Affirmative) < succ>
            bacterial membrane  --- Certainty = 0.0000(Not Clear)   < succ>
            bacterial outside   --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 823

A DNA sequence (GBSx0873) was identified in *S. agalactiae* <SEQ ID 2489> which encodes the amino acid sequence <SEQ ID 2490>. Analysis of this protein sequence reveals the following:

```
Possible site: 16
>>> Seems to have no N-terminal signal sequence
    INTEGRAL    Likelihood = -14.22    Transmembrane    605-621 (569-631)
    INTEGRAL    Likelihood =  -8.12    Transmembrane    583-599 (569-604)

----- Final Results -----
            bacterial membrane --- Certainty = 0.6689(Affirmative) < succ>
            bacterial outside  --- Certainty = 0.0000(Not Clear)   < succ>
            bacterial cytoplasm --- Certainty = 0.0000(Not Clear)  < succ>
```

The protein has homology with the following sequences in the GENPEPT database.

```
>GP: AAB70053 GB: AF011378 unknown [Bacteriophage sk1]
Identities = 159/709 (22%), Positives = 285/709 (39%), Gaps = 112/709 (15%)

Query: 128 SILNLNKELDNVAKELDIVNQKLELDPDNVELAEQKMKLLGKQSELAGDKVQELKKKQAA 187
           S+  +N  + + E  +   L+LDP N +   Q  K L  Q  L+ DK  +LK++ ++
Sbjct:  21 SLKGVNTAMSGLRGEAKNLRDALKLDPTNTDKMAQLQKNLQTQLGLSRDKATKLKQELSS  80

Query: 188 LGDEK-IGTEEWRQLQNEIGQAEVEVLKIDRAMDILGESSRSATGDI--KEATSYLRADV 244
           +     G ++W QL  ++G AE +  +++  +  + +  S + DI   K T +  + +
Sbjct:  81 VDKSSPAGQKKWLQLTRDLGTAETQANRLEGEIKQVEGAISSGSWDIDAKMDTKGVNSGI 140

Query: 245 MMDVADKAG----------QIGQKMVDAGKMTVDAWSEIDEALDTVTTKTGLTGD----- 289
                +  +G          QIG    V A   +  W    +A+DT            L
Sbjct: 141 DGMKSRFSGLREIAVGVFRQIGSSAVSAVGNGLKGW--VSDAMDTQKAMISLQNTLKFKG 198

Query: 290 -------ALAELQEIAKDIATG------MPTSFQNAGD----AVGEL------NTQFGLT 326
                  +Q +AKD           + T+F   GD       AVG+         N  FG T
Sbjct: 199 NGQDFDYVSKSMQTLAKDTNANTEDTLKLSTTFIGLGDSAKTAVGKTEALVKANQAFGGT 258

Query: 327 GEKLKSASELL--------IKYAEINE-TD--------ISSSAISAKQAIEAYG--LTAE 367
           GE+LK  +         +      IN+ TD          + S+ +   A++ YG   +A
Sbjct: 259 GEQLKGVVQAYGQMSASGKVSAENINQLTDNNTALGSALKSTVMEMNPALKQYGSFASAS 318

Query: 368 DLGMV----LDNVTKAAQDTGQSVDTIVQKAIDGAPQIKGLGLSFEEGA------ALIGK 417
           + G +    LD +   G   T+ A D  + L L    A       ++I K
Sbjct: 319 EKGAISVEMLDKAMQKLGGAGGGAVTTIGDAWDSFNETLSLALLPTLDALTPIISSIIDK 378

Query: 418 FEKSGVDSSAALSSLSKAAVIYAKD--GKTLTDGLNETVSAIQNSTSET--EALSIASEI 473
                  G + AL S+ K       Y K+ G    +G  ++S I +       T    LSI ++
Sbjct: 379 MAGWGESAGKALDSIVK----YVKELWGALEKNGALSSLSKIWDGLKSTFGSVLSIIGQL 434

Query: 474 FGSKAAPRMVDAIQRGAFSFDDLAEAAKSSSGTVSTTFDETLDPIDKLTQYSNQAKEGMA 533
             S A     +D+     + A + ++ S T++          D I K+ ++ +    E
Sbjct: 435 IESFAG---IDS------KTGESAGSVENVSKTIANLAKGLADVIKKIADFAKKFSESKG 485

Query: 534 ELGGKLLETVIPALEPLMGMLESSVNWFTSLNETDQ-QTIVILGLVTTAVMMLLGAIAPL 592
           +     L+T + AL    +    T+++     + QT +   G         + AI  P
Sbjct: 486 AID--TLKTSLVALTAGFVAFKIGSGIITAISAFKKLQTAIQAGTGVMGAFNAVMAINPF 543

Query: 593 VIAIGAIGAPVGIVAAIV-GAIAVITLIIQAIMNWGAITEWLQSTWDSCAA-------W 644
             V         +GI  +AAIV  G +    T           W +  ++L+S WD  +            W
Sbjct: 544 VA---------LGIAIAAIVAGLVYFFTQTETGKKAWASFVDFLKSAWDGIVSFFSGIGQW 595

Query: 645 LSELWTNIVTTATTAWSNFTAWLSGLWSSVVSTGQSLWSSFTSSLSNIFSSLITGAQSLW 704
           +++W    V  A    W     W    W SG+    V    Q++W+  T+   + +++++++TG Q+  W
```

```
                          -continued
Sbjct: 596 FADIWNGAVDGAKGIWQGLVDWFSGIVQGV----QNIWNGITTFFTTLWTTVVTGIQTAW  651

Query: 705 SSFTSTLSNLWSGLVSTGSNLFNNLSSTISGIFNGILSTASNIWNSIKS            753
           +  T   + LW G+V+  + +F  +SS ++G +N  ++T    + +  KS
Sbjct: 652 AGVTGFFTGLWDGIVNVVTTVFTTISSLVTGAYNWFVTTFQPLISFYKS            700
```

There is also homology to SEQ ID 2492.

A related GBS gene <SEQ ID 8663> and protein <SEQ ID 8664> were also identified. Analysis of this protein sequence reveals the following:

```
Lipop: Possible site: -1 Crend: 10
McG: Discrim Score: -13.98
GvH: Signal Score (-7.5): -2.78
Possible site: 16
>>> Seems to have no N-terminal signal sequence
ALOM program count: 2 value: -14.22 threshold: 0.0
INTEGRAL Likelihood = -14.22   Transmembrane 605-621 (569-631)
INTEGRAL Likelihood =  -8.12   Transmembrane 583-599 (569-604)
PERIPHERAL  Likelihood =  4.45  539
modified ALOM score: 3.34

*** Reasoning Step: 3

----- Final Results -----
             bacterial membrane  --- Certainty = 0.6689 (Affirmative) < succ>
              bacterial outside  --- Certainty = 0.0000 (Not Clear)   < succ>
                bacterial cytoplasm --- Certainty = 0.0000 (Not Clear)
```

The protein has homology with the following sequences in the databases:

```
27.1/51.7% over 981aa
Bacteriophage sk1
GP|2392838|unknown Insert characterized
ORF00471(328-2976 of 3333)
GP|2392838|gb|AAB70053.1||AF011378(9-990 of 999)unknown{Bacteriophage sk1}
% Match = 7.3
% Identity = 27.1   % Similarity = 51.7
Matches = 164  Mismatches = 275  Conservative Sub.s = 149
     243       273       303       333       363       393       423       453
MSINQEEKKTLSNADLLSVMSD*KERRKSMTETFEGLYVKFGANTVEFDRSVKGINTALSSLKKDFNNINRQLKMDPDNV
                       :   :  |:   || :|: |:||:|||:| |: :  |:    ||:|| |
                       MASNATFEVEIYGNTTKFENSLKGVNTAMSGLRGEAKNLRDALKLDPTNT
                                  10        20        30        40        50
     483       513       543       570       600       630       660       690
DLLNRKLVNLQEQARVGAIKIAELKKQQKALGESE-VGSAQWNKLQLEIAKVESQMKIVDKAMESTKKHIEDVGDPKSIL
| : :   |||  :   | : | | :||::  :: :|  | : : |:|     :: :: | |||
DKMAQLQKNLQTQLGLSRDKATKLKQELSSVDKSSPAGQKKWLQLTRDLGTAETQANRLEGEIKQVE-------------
           60        70        80        90       100       110
    1053      1083      1113      1143      1167      1197      1227
NLNKELD~~~~DVMMDVADKAGQIGQKMVDAGKMTVDAWSEIDEALDTVTTKTGLTG--DALAELQEIAKDIATGMPTSF
           |  :: :|| :|| :|   :|: |   |:|   |    :|:|| |  | :   : :|
-----------~~~~--------------------GAISSGSW-DIDAKMDTKGVNSGIDGMKSRFSGLREIAVGVFRQIGSSA
                                      120       130       140       150       160
cag                                                                              g
aac                                                                              g
gtt                                                                              t
                                                                              1239
QNA----------------------------------------------------------------------------G
  :|
VSAVGNGLKGWVSDAMDTQKAMISLQNTLKFKGNGQDFDYVSKSMQTLAKDTNANTEDTLKLSTTFIGLGDSAKTAVGKT
              180       190       200       210       220       230       240
    1269      1299      1329      1359      1389      1416      1446      1476
DAVGELNTQFGLTGEKLKSASELLIKYAEINETDISSSAISAKQAIEAYG-LTAEDLGMVLDNVTKAAQDTGQSVDTIVQ
:|: :  |  || |||:|| ||        :    |  | :  ||::   :    |  |||
EALVKANQAFGGTGEQLKGV------------------VQAYGQMSASGKVSAENINQLTDNNT---------------
              260                      270       280       290
    1506      1536      1566      1596      1626      1656      1686      1716
KAIDGAPQIKGLGLSFEEGAALIGKFEKSGVDSSAALSSLSKAAVIYAKDGKTLTDGLNETVSAIQNSTSETEALSIASE
                                                     |  ||   |:  :    :  :::  |||
-----------------------------------------------------ALGSALKSTVMEMNPALKQYGSFASASE
                                                                        300       310
    1746      1794      1824      1854      1884      1914      1944
IFGSKAAPRMVDAIQR----GAFSFDDLAEAAKSSSGTVSTTFDETLDPIDKLTQYSNQAKEGMAELGGKLLETVIPALE
    |:  :   |:|:    |    :   :|  |   :|   |  :  |||  :       |   |  ||  ::::  ::
-KGAISVEMLDKAMQKLGGAGGGAVTTIGDAWDSFNETLSLALLPTLDALTPIISSIIDKMAGWGESAGKALDSIVKYVK
           330       340       350       360       370       380       390
```

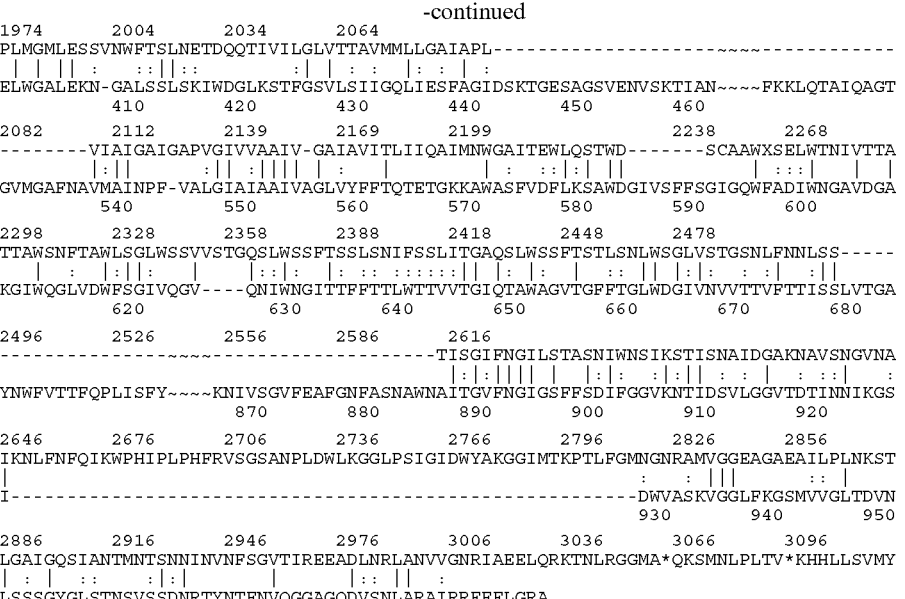

SEQ ID 8664 (GBS58) was expressed in and purified from *E. coli* as a GST fusion. The purified protein is shown in lane 10 of FIG. 193.

Based on this analysis, it was predicted that these proteins and their epitopes could be useful antigens for vaccines or diagnostics.

EXAMPLE 824

A DNA sequence (GBSx0874) was identified in *S. agalactiae* <SEQ ID 2493> which encodes the amino acid sequence <SEQ ID 2494>. Analysis of this protein sequence reveals the following:

```
Possible site: 43
>>> Seems to have no N-terminal signal sequence

----- Final Results -----
        bacterial cytoplasm --- Certainty = 0.2732 (Affirmative) < succ>
        bacterial membrane  --- Certainty = 0.0000 (Not Clear)   < succ>
         bacterial outside  --- Certainty = 0.0000 (Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 825

A DNA sequence (GBSx0875) was identified in *S. agalactiae* <SEQ ID 2495> which encodes the amino acid sequence <SEQ ID 2496>. Analysis of this protein sequence reveals the following:

```
Possible site: 18
>>> Seems to have no N-terminal signal sequence
```

```
----- Final Results -----
          bacterial cytoplasm --- Certainty = 0.2467 (Affirmative) < succ>
          bacterial membrane  --- Certainty = 0.0000 (Not Clear)   < succ>
           bacterial outside  --- Certainty = 0.0000 (Not Clear)   < succ>
```

A related GBS nucleic acid sequence <SEQ ID 10151> which encodes amino acid sequence <SEQ ID 10152> was also identified. A further related GBS nucleic acid sequence <SEQ ID 10935> which encodes amino acid sequence <SEQ ID 10936> was also identified.

The protein has no significant homology with any sequences in the GENPEPT database.

A related DNA sequence was identified in *S. pyogenes* <SEQ ID 2497> which encodes the amino acid sequence <SEQ ID 2498>. Analysis of this protein sequence reveals the following:

```
Possible site: 40
>>> Seems to have no N-terminal signal sequence

----- Final Results -----
          bacterial cytoplasm --- Certainty = 0.2136 (Affirmative) < succ>
          bacterial membrane  --- Certainty = 0.0000 (Not Clear)   < succ>
           bacterial outside  --- Certainty = 0.0000 (Not Clear)   < succ>
```

An alignment of the GAS and GBS proteins is shown below.

```
Identities = 55/240 (22%), Positives = 92/240 (37%), Gaps = 20/240 (8%)

Query:    4 INELTIDGVKTSSFKCDVLVETRPNVIVSSS--KTALLEHDGISGAVVQSNRHRGLIEKP   61
            I ++ ID   TSS    VL        I+S S  +    +G S  +   N + I
Sbjct:    2 IPKVIIDDFDTSSIPNCVLTGYDVGDILSPSFVENEAYGMNGTSRELESYNESKPTIM--  59

Query:   62 YHITLIEPSDEEIYRFSALLNREKFW-LENEQEPTIRLWCYKVDSFEIGKDEFGAWVVDV  120
            +H++ + +    I      L + +FW + N       ++ Y   S +I     +W V +
Sbjct:   60 WHLSTFDDAVNLINHLDGLSKKIEFWHIPNS------IYYYDCLSVKINAVTMSSWRVTL 113

Query:  121 TFICHPTKFFKTTDIQTLTGNGVLRVQGSALAFPKITVVGQSASETSFTIGNQVIKLEKL  180
               +P ++ K    + GNG +   G+  + PKI V G    + + TIG QV++L  L
Sbjct:  114 KLALYPFRYAKGVSDVVIAGNGNINNAGNVFSEPKIVVEG--TGKGTLTIGKQVMEL-NL 170

Query:  181 SESLVMTNDPDNPSFKTASGKL---IKWAGDFITVDTAKGQNVGVVLGAGITSLKFETVW 237
              S  +            A G +  I+  G F  +         G+ +   GIT     W
Sbjct:  171 SGKATIECKHGQQCVYDAEGNVKNSIRIRGSFFEIQPG---TQGIAVSGGITRTIISPRW 227
```

Based on this analysis, it was predicted that these proteins and their epitopes could be useful antigens for vaccines or diagnostics.

EXAMPLE 826

A DNA sequence (GBSx0876) was identified in *S. agalactiae* <SEQ ID 2499> which encodes the amino acid sequence <SEQ ID 2500>. This protein is predicted to be PblB. Analysis of this protein sequence reveals the following:

```
Possible site: 27
>>> Seems to have no N-terminal signal sequence
INTEGRAL Likelihood = -0.00 Transmembrane 952-968 (952-968)

----- Final Results -----
           bacterial membrane  --- Certainty = 0.1001 (Affirmative) < succ>
            bacterial outside  --- Certainty = 0.0000 (Not Clear)   < succ>
          bacterial cytoplasm  --- Certainty = 0.0000 (Not Clear)   < succ>
```

The protein has homology with the following sequences in the GENPEPT database.

```
>GP: AAG18640 GB: AY007505 PblB [Streptococcus mitis]
Identities = 145/542 (26%), Positives = 255/542 (46%), Gaps = 52/542 (9%)

Query:     1 MLFLLDANVRTVKWNGIPLHEASSAIVKEETNGDFYLTVRYPITDSGIYQLIKEDMLIKS    60
             M++L + N         PL+ A + ++E N + LT R+P +D  +++ +KE+  +K+
Sbjct:     1 MIYLTNGNT--------PLNAAYADKISQEANSTYQLTFRFPTSDV-LWEKLKEETFLKA    51

Query:    61 PVPVLGAQLFRIKKPIENDDSMDITAYHVSDDIMKRSITPSVVGQGCAMALSQMVQNAK   120
                        + G Q FI ++  + + A V   +  I P+S+     + ALS+    +
Sbjct:    52 D-DLHGEQDFVIFEVQKKHGYIQVYANQVMTLLNNYVINPISLDRATGSTALSRFAGSI-   109

Query:   121 TGLGDFSFTSDIMDSRTFNTTETETLYSVLMDGKHSIVGTWEGELVRDNFALSIKRSRGA   180
             T     FSF SDI +  TFNT      + +  D KHSI+G W  G+LVR + +  ++ G+
Sbjct:   110 TRYNTFSFFSDIDERHTFNTDSVNAMVAFTKD-KHSILGQWGGDLVRHGYQVRLLKNGGS   168

Query:   181 DRGVVITTHKNLKSYQRTKNSQGVVTRIHARSTFKPDGAE-DEVTLRVSDSPLINSYPY   239
             +    +  KNL SYQ  +++ +  TRI ++T K +G +  +    V VDSPL+N Y
Sbjct:   169 ENESLFMYKKNLSSYQHKTSTKSLKTRITFKATVKGEGEKAPDRKFSVVVDSPLVNKYSQ   228

Query:   240 INEKEYENNNAETVED--LRKWAEAKFTNEGIDKVSDAIEIEAYELDGQVVNLGDTVNLK   297
             I E  E N++ + ++  LRK+ E F    D + D++EI+        V + D V+L
Sbjct:   229 IYEDVIEVNDQDVKDEVGLRKYGEQYFRTTLCDMLEDSLEIQVEGKSDVPVQIFDIVSLF   288

Query:   298 SRKHSADLYKKAIAYEFNALTEEYISITFDDKPGVGGSGVSSGLSN-VADAILVASATAQ   356
                + D+ KK  Y ++ +  ++ +SI F     G   SG+S+ LSN V+DA+   +   Q
Sbjct:   289 HDRFKMDVRKKITKYTYSPMAKKLLSIGF----GQFKSGLSNMLSNAVSDAVKNETQHLQ   344

Query:   357 D---VAVQRAVKNANAAFDAEFGKTKTKINDDIEIAKAKVESFKSELSNRMDNQLLP---   410
                 + + +KNA+ AFD +  +   + D + AKAK E   K  L+ +D +
Sbjct:   345 GQFATQLGKEIKNADLAFDRKKEELVNQFTGLNAAKAKAEEVKKSLTETIDQRFRDFDS   404

Query:   411 ---------------------LATEAKNLASQAQADLTRKEIELRAELNRQVTSTEAVK   448
                                  LA EAK ++ QA+ +   K  E + ++ + TS  +
Sbjct:   405 TGLNEIKQKAEEEALQRVGANTLLAQEAKQISEQARQQMDSKFAEYKQSVDGRFTSLSSQL   464

Query:   449 ISLTNLSHNMDIIKQKALNDLRDAETRLKEADSVQQLATKRVEDKLTGLSTKLESFSVGG   508
                  NL  +D + +  ++L +       E+D  +++A  + ++L  +   S  +VGG
Sbjct:   465 AGKANL---IDFQRVQEKSNLYERIIGSSESDIAEKVARMTLTNQLFQVEVGKYS-AVGG   520

Query:   509 YN                                                           510
              N
Sbjct:   521 PN                                                           522

Identities = 47/183 (25%), Positives = 83/183 (44%), Gaps = 22/183 (12%)

Query:   867 VTTLRVTKGTIPADWSPSPDDLKAYSDTKLEQTANEIKASVTSLDHKTLKQTDITMTSEG   926
             +T L  +GT    W P+P+D    +D  LE T                 QT +T+
Sbjct:   667 MTELDFYEGTTDRRWQPAPEDATLETDKTLEAT----------------QTKLTLLQGS   709

Query:   927 IVLRAGKTSNDVARAIGSYFKVTPDAIALFSSLIKVSGNMLVDGSVTSRKLVTGAVETGH   986
             ++   TS   A +I S    T + I ++   I++ G  L+D  +T+         + G
Sbjct:   710 FAIQ-NLTS---AGSIVSQINATNNQILIEAEKIRLKGKTLLD-ELTAIDGYFKRLFVGE   764

Query:   987 VKAGAITGVLLAAEAVTAEKLKVDQAFFNKLMANDAYLKQLFAKSAFITQVQSVTISASQ  1046
             +    ++ ++ ++ +TA+KL +DQA    +++D +  L AK AFI +++SV +SA+
Sbjct:   765 GTFAKLNAEIIGSKTITADKLIMDQAMARLFVSSDIFTDTLAAKEAFINKLRSVVVSATL   824

Query:  1047 ISG                                                         1049
              G
Sbjct:   825 FEG                                                          827
```

A related DNA sequence was identified in *S. pyogenes* <SEQ ID 2501> which encodes the amino acid sequence <SEQ ID 2502>. Analysis of this protein sequence reveals the following:

```
Possible site: 25
>>> Seems to have no N-terminal signal sequence

----- Final Results -----
            bacterial cytoplasm --- Certainty = 0.2445 (Affirmative) < succ>
            bacterial membrane  --- Certainty = 0.0000 (Not Clear)   < succ>
            bacterial outside   --- Certainty = 0.0000 (Not Clear)   < succ>
```

An alignment of the GAS and GBS proteins is shown below.

```
Identities = 143/552 (25%), Positives = 251/552 (44%), Gaps = 43/552 (7%)
Query:  11 TVKWNGIPLHEASSAIVKEETNGDFYLTVRYPITDSGIYQLIKEDMLIKSPVPVLGAQLF    70
           ++K + PL A    + +E  N D+ L  +YP        LIK+ +++++   + G+QLF
Sbjct:   3 SIKDDNTPLVAAFEDEITQEANSDYKLNFKYPAKHE-YRPLIKKGIILEAD-DLHGSQLF   60

Query:  71 RIKKPIENDDSMDITAYHVSDDIMKRSITPVSVVGQGCAMALSQMVQNAKTGLGDFSFTS  130
           RI + +    +++ A V+DD+   +I  +SV      +S++  + K      FSF S
Sbjct:  61 RIFEITKRHGYINVYANQVADDLNGYAIDTISVDRVQGMTVMSELAGSIKRE-HPFSFFS  119

Query: 131 DIMDSRTFNTTETETLYSVLMDGKHSIVGTWEGELVRDNFALSIKRSRGADRGVVITTHK  190
           DI     TFN ++   +    L +GKHSI+G W GELVR+ + +++ +  G D    +     K
Sbjct: 120 DIDGRHTFNQSDVSVM-DALANGKHSIMGQWGGELVRNKYQINLLKKAGKDTETLFMYKK  178

Query: 191 NLKSYQRTKNSQGVVTRIH----------ARSTFKPDG------AEDEVTLRVSVDSPLI  234
           NLKSY+  T   +G+V+ +H              DG       +   + T+RVSV+S L
Sbjct: 179 NLKSYEETDTIKGLVSILHLVAEVEEEHEVETREASDGNIGHSESPKKKTIRVSVESKLK  238

Query: 235 NSYPYINEK--EYENNNAETVEDLRKWAEAKFTNEGIDKVSDAIEIEAYELDGQVVNLGD  292
           +++P I EK  + ++ + +T EDL  + +  F      D   ++++I+         V L D
Sbjct: 239 DTHPIIVEKTIKVQDQDVKTEEDLLAYGKKYFEKTLCDIPGNSLKIDVTNNYEGAVRLFD  298

Query: 293 TVNLKSRKHSADLYKKAIAYEFNALTEEYISITFDDKPGVGGSGVSSGLSNVADAILVAS  352
           T  +   +  DL  +   YF +      SI F     G       +SN   D  + S
Sbjct: 299 TAIVFHELYDRDLRMQITGYRFAPMANRLKSIIF----GEIKTNLAKQISNQIDNKVAES  354

Query: 353 ATAQDVA----VQRAVKNANAAFDAEFGKTKTKINDDIEIAKAKVESFKSELSNR-MDNQ  407
              D A    +Q+ + NAN  FD +  K + +I D I+ A+A  E   +E++ + ++ +
Sbjct: 355 TAQHDAAFEAKLQKQIDNANRIFDTKEAKLREEIEDGIKKAEANAEVKVAEVNAKVLEAE  414

Query: 408 LLPLATEAK-----NLASQAQADLTRKEIELRAELNRQVTSTEAVKISLTNLSHNMDIIK  462
             L A ++     + A  +D +K ER L       + +L   + D +
Sbjct: 415 ELAKAVDERLKKFLSDADTKEQDFDKKLEEFRTSLKDLEVDEKQIDDALAKAGFSKDSLA  474

Query: 463 QKALNDLRDAETRLKEADSVQQL-ATKRVEDKLTGLSTKLESFSVGGYNYVIDGGEPKEL  521
                 +ET   A+ V    T      ++L G + K+ +F    GY +      GE  E
Sbjct: 475 DIKAKLEDTSETATVTANIVGSTGGTFYNRNRLDGDTDKVITFE-QGYIDIAHNGEGFE-  532

Query: 522 MANFYGKTYDIN                                                 533
                 GKTY I+
Sbjct: 533 ----EGKTYTIS                                                 540
```

A related GBS gene <SEQ ID 8665> and protein <SEQ ID 8666> were also identified. Analysis of this protein sequence reveals the following:

```
Lipop Possible site: -1 Crend: 3
SRCFLG: 0
McG: Length of UR: 11
Peak Value of UR: 1.54
Net Charge of CR: 1
McG: Discrim Score: -3.43
GvH: Signal Score (-7.5): -5.44
Possible site: 58
>>> Seems to have no N-terminal signal sequence
Amino Acid Composition: calculated from 1
ALOM program count: 1 value: -0.00 threshold: 0.0
INTEGRAL Likelihood = -0.00 Transmembrane 897-913 (897-913)
```

```
-continued
PERIPHERAL Likelihood = 1.48  932
modified ALOM score: 0.50
icml HYPID: 7 CFP: 0.100

*** Reasoning Step: 3

----- Final Results -----
              bacterial membrane --- Certainty = 0.1001 (Affirmative) < succ>
               bacterial outside --- Certainty = 0.0000 (Not Clear)   < succ>
              bacterial cytoplasm --- Certainty = 0.0000 (Not Clear)   < succ>
```

The protein has homology with the following sequences in the databases:

```
32.8/53.9% over 503aa
EGAD|33685| hypothetical protein Insert characterized
EGAD|71773|76294 hypothetical protein { } Insert characterized
SP|P15317|YHYA_BPH44 HYPOTHETICAL 65 KDA PROTEIN IN HYALURONIDASE REGION. Insert
characterized
GP|215054|gb|AAA98102.1||M19348 ORF{Streptococcus pyogenes phage H4489A}Insert
characterized
PIR|B30566|B30566 hypothetical protein-phage H4489A Insert characterized ORF00870(1957-3777 of 4272)
EGAD|33685|35003(37-540 of 593) hypothetical protein {Streptococcus pyogenes}
EGAD|71773|76294 hypothetical protein { } SP|P15317|YHYA_BPH44 HYPTHETICAL 65 KDA
PROTEIN IN HYALURONIDASE REGION. GP|215054|gb|AAA98102.1||M19348 ORF{Streptococcus
pyogenes phage H4489A} PIR|B30566|B30566 hypothetical protein-Streptococcus
pyogenes phage H4489A
% Match = 4.4
% Identity = 32.8   % Similarity = 53.8
Matches = 137  Mismatches = 175  Conservative Sub.s = 88

1749      1779      1809      1839      1869      1899      1929      1959
TRLKEADSVQQLATKRVEDKLTGLSTKLESFSVGGYNYVIDGGEPKELMANFYGKTYDINPQLLERTSQATLSFSYEAES
                                                         ::        :   |:|     |          :
                                         MSRDPTYTINEHDLSFADGRFYVTFKADKSSETVRLN
                                            10        20        30

1989      2019      2049      2079      2109      2139
TSRLEVRLYKKMHTGDTSKITIIVMPNFDLSPGKGFISQSFDLGGVMPDPRNQAWLVMRGTNANPLTL------------
:|  |    :||::    |  |        |: |  ||:|KDPKSDLWGKIKFNNKAMLVEYANKEMSSAIAQ
SSCLGNTIIKKLQVEDDNTMHDFVKPKVTTQQAFGLAQQVKELDLQLKDPKSDLWGKIKFNNKAMLVEYANKEMSSAIAQ
        50        60        70        80        90       100       110

2184      2214      2244
---------------------------------SKVKLERGTVATDWNNRDETLKASFAEYKQTVDE-------------
                                  |:|   :|: :::|    |      ::    ||:|
SAEQILLQVKSIDDERYSKFEQTLNGIKQTVKSESVESARTQLASMFDSRISGLDGKYSRLSQTIDSLSSRLDDGVGNYS
       130       140       150       160       170       180       190

2271      2301      2331      2361      2388      2418      2448
-----------------NLANLRTSTETLAGQLTSAESSIRQTSESFSNRLVSLETY-KDSEPNRASRYFEASKSETAK
                  :::  |  : :|   |:|:|      |      |:  :   |:  :|::  :       ||
TLSQKVSGIDLRVSNAANDVSRLSQTAQGLQSQITNA----NQNYSSLSQTVQGLQTTVRDNQSNATSRI----------
       210       220       230           240       250       260

2478  2838      2868      2898      2928      2958            3009
QLSALRTEVN~~~~SFVANNANFRANSLKIRFTDSQLKFRVTTLRVTKGTIPADWSPSPDDLK-AYSDT--KLEQTANEI
                 :||     ::|  :||||   :  ||   : |   :   |    : | :||
-----------------------------NQLSDLIST-KVTKGDVETTIAQSYDKIAFAIRDKLPASKMTGSEI
                             270       280       290       300

3039      3069      3099      3129      3159      3189      3213      3243
KASVTSLDHKTLKQTDITMTSEGIVLRAGKTSNDVARAIGSYFKVTPDAIALFSSLIKVSG-NMLVDG-SVTSRKLVTGA
 :                                              ||  |  |:|::|  : :||  |    :: |
IS-----------------------------------------AINLDRSGVKITGKNITLDGNSYISNAVIKDA
                                                 320       330       340

3261      3291      3321      3351      3381      3411      3441      3471
----VETGHVKAGAITGVLLAAEAVTAEKLKVDQAFFNKLMANDAYLKPQAFKSAFITQVSVTISASQISGGVIKALNN
     ::   |    |:    :||||:|  :|:|    |||||||  ||:  |:::|||:  |   |  ||::||| | |
HIANMDAGKINTGYLNASRIAAEAITGDKIKMDYAFFNKLTANEGYFRTLFAKNIFTTSVQAVTTSASKITGGVLSATNG
       360       370       380       390       400       410       420

3501      3537      3567              3624      3648      3678
AMEIQMNSGQILYYTD--------QAALKRVLSGYPTQFVKFATGTVSG-KGNAGVTVIG--SNRYGTESTNDGGFVGVR
|  :||   |  :   |           ||   ||   ||   |:    |  :|:|     ||  |:    :: |:  | |||
ASRWDLNSANIDFNRDATINFNSKNNALVRK-SGTNTAFVHFSNATPKGYRGSALYASIGITSSGDIDSASSGRFCGVR
       440       450       460       470       480       490       500

3687      3717      3747      3777      3807      3837      3867      3897
-------AWNGSNIDSLDLVGDEIRLASSAFDNSDGWDVRTLDSGLKITPHNRAAERNSRIEVGDVWILKGNGSYSSLRD
        : ::|   :: ||:| :  |:   |:  |    :    :    :                             |
FFRYAEGLQHTAKVDQAEIYGDDI-VFSDDFNIDRGFKMRPSLMPKMVDLNKMYQAILALGRCWLHANNTAWSWNFDTRS
           520       530       540       550       560       570       580
```

A related DNA sequence was identified in *S. pyogenes* <SEQ ID 9059> which encodes amino acid sequence <SEQ ID 9060>. An alignment of the GAS and GBS sequences follows:

```
Score = 87.8 bits (214), Expect = 4e-19
Identities = 88/273 (32%), Positives = 133/273 (48%), Gaps = 47/273 (17%)

Query:    370 AINLNSRGVQIAGKNIALDGNTT----VNGAF-------GAKLGEFI--------KLRAD   410
              AI L S  ++++G N+ +DG+ T    V GA         GA  G +        KL+ D
Sbjct:    897 AIALFSSLIKVSG-NMLVDGSVTSRKLVTGAVETGHVKAGAITGVLLAAEAVTAEKLKVD   955

Query:    411 QIIGGTIDANKINVINLKASSIVGLDANFIKARISYAIT-DLLEGKVIKARNGAMTIDLQ   469
              Q      + AN  + L A S      FI   S  I+    + G VIKA N AM I +
Sbjct:    956 QAFFNKLMANDAYLKQLFAKSA------FITQVQSVTISASQISGGVIKALNNAMEIQMN   1009

Query:    470 SGQINHYTNESAMRRIDSSTASQFIKMTKSGFISEIGNMQAAMTVIGSNSDGSENHENKT   529
              SGQI +YT+++A++R+ S    +QF+K    +G +S  GN  A +TVIGSN  G+E+  +
Sbjct:   1010 SGQILYYTDQAALKRVLSGYPTQFVKFA-TGTVSGKGN--AGVTVIGSNRYGTESTNDGG   1066

Query:    530 FGGIRIWNGKSSYQSTSFVELVGN--RVAIYGNKNRSPWLFDSTTSGYAYLIPQNDRGIK   587
              F G+R WNG    +   ++LVG+  R+A    N    W   + SG   + P N
Sbjct:   1067 FVGVRAWNG----SNIDSLDLVGDEIRLASSAFDNSDGWDVRTLDSGLK-ITPHN-----   1116

Query:    588 HVIGRADRKIDQIHVGDIYV-QGERVAMMLKDL                             619
                 RA  +  +I VGD+++  +G       L+D+
Sbjct:   1117 ----RAAERNSRIEVGDVWILKGNGSYSSLRDI                            1145

Score = 31.3 bits (69), Expect = 0.038
Identities = 34/151 (22%), Positives = 62/151 (40%), Gaps = 13/151 (8%)

Query:    160 QNADKKLSASYQLGIDGLKATMRSDKIGLQAEIQTTAQGLYQRYDNEIRKLSAKITTTSS   219
              Q A K  +A++       K + D    +A++++   L  R DN++ L+ +    +S
Sbjct:    306 QRAVKNANAAFDAEFGKTKTKINDDIEIAKAKVESFKSELSNRMDNQLLPLATEAKNLAS   365

Query:    220 GTTEAYESKLDGLRAEFTH---SNQGMRVELES--------KISGLQSTQQATARQISQE   268
                   K   LRAE     S +  ++ L  +             K  L   + A  R + +
Sbjct:    366 QAQADLTRKEIELRAELNRQVTSTEAVKISLTNLSHNMDIIKQKALNDLRDAETR-LKEA   424

Query:    269 ISNREGAVSRVQQGLDSYQRRLQS-AEGNYN                              298
                S ++ A  RV+  L      +L+S + G YN
Sbjct:    425 DSVQQLATKRVEDKLTGLSTKLESFSVGGYN                              455
```

Figure 50:
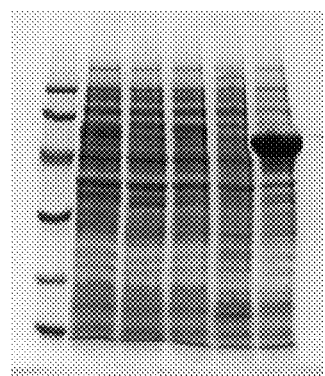

SEQ ID 8666 (GBS202) was expressed in *E. coli* as a His-fusion product. SDS-PAGE analysis of total cell extract is shown in FIG. 50 (lane 5; MW 132 kDa).

Based on this analysis, it was predicted that these proteins and their epitopes could be useful antigens for vaccines or diagnostics.

EXAMPLE 827

A DNA sequence (GBSx0877) was identified in *S. agalactiae* <SEQ ID 2503> which encodes the amino acid sequence <SEQ ID 2504>. This protein is predicted to be nuclear/mitotic apparatus protein. Analysis of this protein sequence reveals the following:

```
Possible site: 22

>>> Seems to have no N-terminal signal sequence

----- Final Results -----
            bacterial cytoplasm --- Certainty = 0.2847 (Affirmative) < succ> bacterial membrane --- Certainty = 0.0000 (Not Clear) < succ> bacterial outside --- Certainty = 0.0000 (Not Clear) < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 828

A DNA sequence (GBSx0879) was identified in *S. agalactiae* <SEQ ID 2505> which encodes the amino acid sequence <SEQ ID 2506>. Analysis of this protein sequence reveals the following:

```
Possible site: 23
>>> Seems to have no N-terminal signal sequence

----- Final Results -----
          bacterial cytoplasm --- Certainty = 0.3420 (Affirmative) < succ>
          bacterial membrane  --- Certainty = 0.0000 (Not Clear)   < succ>
           bacterial outside  --- Certainty = 0.0000 (Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 829

A DNA sequence (GBSx0880) was identified in *S. agalactiae* <SEQ ID 2507> which encodes the amino acid sequence <SEQ ID 2508>. Analysis of this protein sequence reveals the following:

```
Possible site: 13
>>> Seems to have an uncleavable N-term signal seq
INTEGRAL Likelihood = -7.54 Transmembrane 10-26 (2-28)

----- Final Results -----
           bacterial membrane  --- Certainty = 0.4015 (Affirmative) < succ>
            bacterial outside  --- Certainty = 0.0000 (Not Clear)   < succ>
          bacterial cytoplasm  --- Certainty = 0.0000 (Not Clear)   < succ>
```

The protein has homology with the following sequences in the GENPEPT database.

```
>GP: CAB07984 GB: Z93946 hypothetical protein [bacteriophage Dp-1]
Identities = 67/136 (49%), Positives = 91/136 (66%)

Query:   1 MPPWLIDSTVVVAMVTVLGGLFSTIITTSANRKDQLIKHQYEDIKEDLSGLIDKVKTIDH   60
           MP WL D+ V+  ++T  G+ + ++     K    K  EDI  LS L +V  ID
Sbjct:   1 MPMWLNDTAVLTTIITACSGVLTVLLNKLFEWKSNKAKSVLEDISTTLSTLKQQVDGIDQ  60

Query:  61 TTTETKKISEITKDGTLKIQRYRLFHDLTKEISQGYTTIEHFRELSILFESYQLLGGNGE  120
           TT      +++ +DGT KIQRYRL+HDL +E+  GYTT++HFRELSILFESY+ LGGNGE
Sbjct:  61 TTVAINHQNDVIQDGTRKIQRYRLYHDLKREVITGYTTLDHFRELSILFESYKNLGGNGE 120

Query: 121 IEALFEKFKQLPIEED                                             136
           +EAL+EK+K+LPI E+
Sbjct: 121 VEALYEKYKKLPIREE                                             136
```

No corresponding DNA sequence was identified in *S. pyogenes*.

SEQ ID 2508 (GBS118) was expressed in *E. coli* as a GST-fusion product. SDS-PAGE analysis of total cell extract is shown in FIG. 32 (lane 5; MW 42 kDa).

GBS118-GST was purified as shown in FIG. 198, lane 8.

Based on this analysis, it was predicted that this protein and its epitopes, could be useful antigens for vaccines or diagnostics.

EXAMPLE 830

A DNA sequence (GBSx0882) was identified in *S. agalactiae* <SEQ ID 2509> which encodes the amino acid sequence <SEQ ID 2510>. Analysis of this protein sequence reveals the following:

```
Possible site: 53
>>> Seems to have a cleavable N-term signal seq.

----- Final Results -----
            bacterial outside --- Certainty = 0.3000 (Affirmative) < succ>
              bacterial membrane --- Certainty = 0.0000 (Not Clear) < succ>
                bacterial cytoplasm --- Certainty = 0.0000 (Not Clear) < succ>
```

The protein has no significant homology with any sequences in the GENPEPT database.

No corresponding DNA sequence was identified in *S. pyogenes*.

A related GBS gene <SEQ ID 8667> and protein <SEQ ID 8668> were also identified. Analysis of this protein sequence reveals the following:

```
Lipop: Possible site: -1 Crend: 5
McG: Discrim Score: 6.58
GvH: Signal Score (-7.5): -0.49
Possible site: 53
>>> Seems to have a cleavable N-term signal seq.
ALOM program count: 0 value: 12.15 threshold: 0.0
PERIPHERAL  Likelihood = 12.15 84
modified ALOM score: -2.93

*** Reasoning Step: 3

----- Final Results -----
            bacterial outside --- Certainty = 0.3000 (Affirmative) < succ>
              bacterial membrane --- Certainty = 0.0000 (Not Clear) < succ>
                bacterial cytoplasm --- Certainty = 0.0000 (Not Clear)
```

Figure 21:
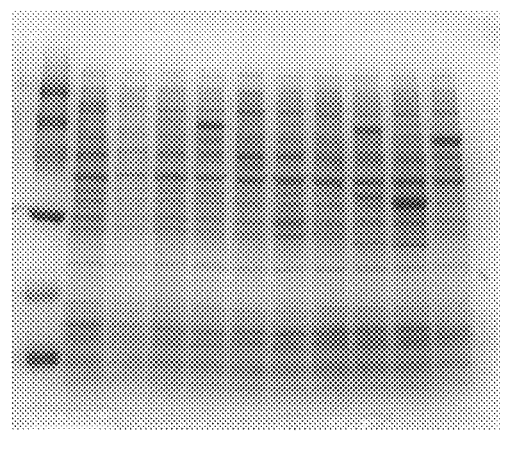

SEQ ID 2510 (GBS56) was expressed in *E. coli* as a His-fusion product. SDS-PAGE analysis of total cell extract is shown in FIG. 17 (lane 8; MW 9.9 kDa). It was also expressed in *E. coli* as a GST-fusion product. SDS-PAGE analysis of total cell extract is shown in FIG. 21 (lane 10; MW 34.9 kDa).

Figure 195:
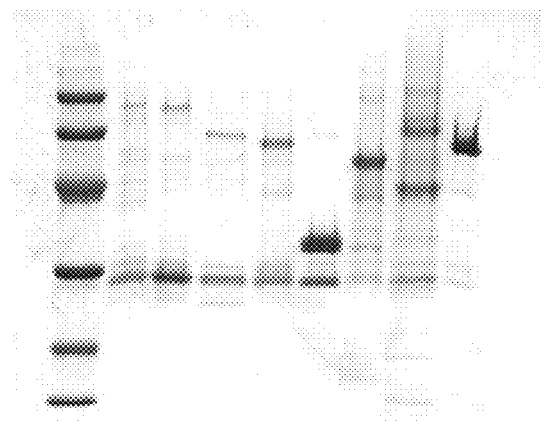

GBS56-GST was purified as shown in FIG. 195, lane 7.

EXAMPLE 831

A DNA sequence (GBSx0883) was identified in *S. agalactiae* <SEQ ID 2511> which encodes the amino acid sequence <SEQ ID 2512>. Analysis of this protein sequence reveals the following:

```
Possible site: 40
>>> Seems to have a cleavable N-term signal seq.

----- Final Results -----
            bacterial outside --- Certainty = 0.3000 (Affirmative) < succ>
              bacterial membrane --- Certainty = 0.0000 (Not Clear) < succ>
                bacterial cytoplasm --- Certainty = 0.0000 (Not Clear) < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

Based on this analysis, it was predicted that these proteins and their epitopes could be useful antigens for vaccines or diagnostics.

EXAMPLE 832

A DNA sequence (GBSx0884) was identified in *S. agalactiae* <SEQ ID 2513> which encodes the amino acid sequence <SEQ ID 2514>. This protein is predicted to be N-acetylmuramoyl-L-alanine amidase. Analysis of this protein sequence reveals the following:

```
Possible site: 53
>>> Seems to have no N-terminal signal sequence

----- Final Results -----
           bacterial cytoplasm --- Certainty = 0.0342 (Affirmative) < succ>
           bacterial membrane  --- Certainty = 0.0000 (Not Clear)   < succ>
           bacterial outside   --- Certainty = 0.0000 (Not Clear)   < succ>
```

The protein has homology with the following sequences in the GENPEPT database.

```
>GP: CAB07986 GB: Z93946 N-acetylmuramoyl-L-alanine amidase
[bacteriophage Dp-1]
Identities = 96/141 (68%), Positives = 118/141 (83%)

Query:    1 MEINTEIAIAWMSARQGKVSYSMDYRDGPNSYDCSSSVYYALRSAGASSAGWAVNTEYMH   60
            M ++ E   +AWM AR+G+VSYSMD+RDGP+SYDCSSS+YYALRSAGASSAGWAVNTEYMH
Sbjct:    1 MGVDIEKGVAWMQARKGRVSYSMDFRDGPDSYDCSSSMYYALRSAGASSAGWAVNTEYMH   60

Query:   61 DWLIKNGYELIAENVDWNAVRGDIAIWGMRGHSSGAGGHVVMFIDPENIIHCNWANNGIT  120
            WLI+NGYELI+EN  W+A RGDI IWG +G S+GAGGH MFID +NIIHCN+A +GI+
Sbjct:   61 AWLIENGYELISENAPWDAKRGDIFIWGRKGASAGAGGHTGMFIDSDNIIHCNYAYDGIS  120

Query:  121 VNNYNQTAAASGWMYCYVYRL                                         141
            VN++++    +G  Y YVYRL
Sbjct:  121 VNDHDERWYYAGQPYYYVYRL                                         141
```

No corresponding DNA sequence was identified in *S. pyogenes*.

A related GBS gene <SEQ ID 8669> and protein <SEQ ID 8670> were also identified. Analysis of this protein sequence reveals the following:

RGD motif 81-83

The protein has homology with the following sequences in the databases:

```
58.2/72.9% over 182aa
GP|3934766| N-acetylmuramoyl-L-alanine amidase {bacteriophage Dp-1} Insert
characterized
ORF00875(301-1044 of 2004)
GP|1934766|emb|CAB07986.1||Z93946(1-183 of 296)N-acetylmuramoyl-L-alanine amidase
{bacteriophage Dp-1}
% Match = 15.5
% Identity = 58.2    % Similarity = 72.8
Matches = 107   Mismatches = 49   Conservative Sub.s = 27
    234         264         294         324         354         384         414         444
LQKYNIHMSDDDLTLFVESAVKQMHDAWKE*PMEINTEIAIAWMSARQGKVSYSMDYRDXPNSYDCSSSVYYALRSAGAS
                               | ::  |    :|||  ||:|:|||||:||  |:|||||||:|||||||||
                               MGVDIEKGVAWMQARKGRVSYSMDFRDGPDSYDCSSSMYYALRSAGAS
                                       10         20         30         40
    474         504         534         564         594         624         654        `684
SAGWAVNTEYMHDWLIKNGYELIAENVDWNAVRGDIAIWGMRGHSSGAGGHVVMFIDPENIIHCNWANNGITVNNYNQTA
|||||||||||||:||  |:|||||:||   |:|  |:|||  |:  |:|||||    |||   |:|||:||   :::
SAGWAVNTEYMHAWLIENGYELISENAPWDAKRGDIFIWGRKGASAGAGGHTGMFIDSDNIIHCNYAYDGISVNDHDERW
        60         70         80         90        100        110        120
    714         744         774         804         834         864         894         924
AASGWMYCYVYRLKSGASTQGKSLDTLVKETLAGNYGNGEARKAVLGNQYEAVMSVINGKTTTNQKTVDQLVQEVIAGKH
 :|   |  |||||  :
YYAGQPYYYVYRLTNA------------------------------------------------------------
         140
    954         984        1014        1044        1074        1104        1134        1164
GNGEARKKSLGSQYDAVQKRVTELLKKQPSEPPFKAQEVNKPTETKTSQTELTGQATATKEEGDLSFNGTILKKAVLDKIL
 |  :||| ||  ||        |  |:   |  |:     |       :|:        |        |       |:
-NAQPAEKKLGWQKDATGFWYARANGTYPKDEFEYIEENKSWFYFDDQGYMLAEKWLKHTDGNWYWFDRDGYMATSWKRT
        160        170        180        190        200        210        220
```

SEQ ID 8670 (GBS302) was expressed in *E. coli* as a His-fusion product. SDS-PAGE analysis of total cell extract is shown in FIG. 50 (lane 6; MW 55 kDa).

Figure 302:
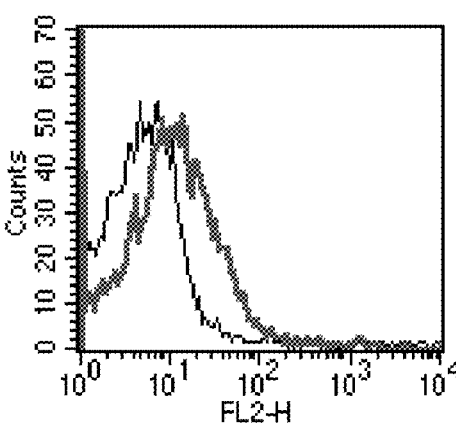

The GBS302-His fusion product was purified (FIG. 205, lane 6) and used to immunise mice. The resulting antiserum was used for FACS (FIG. 302), which confirmed that the protein is immunoaccessible on GBS bacteria.

Based on this analysis, it was predicted that these proteins and their epitopes could be useful antigens for vaccines or diagnostics.

EXAMPLE 833

A DNA sequence (GBSx0885) was identified in *S. agalactiae* <SEQ ID 2515> which encodes the amino acid sequence <SEQ ID 2516>. Analysis of this protein sequence reveals the following:

```
Possible site: 38
>>> Seems to have no N-terminal signal sequence

----- Final Results -----
          bacterial cytoplasm --- Certainty = 0.1509 (Affirmative) < succ>
          bacterial membrane  --- Certainty = 0.0000 (Not Clear)   < succ>
           bacterial outside  --- Certainty = 0.0000 (Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 834

A DNA sequence (GBSx0886) was identified in *S. agalactiae* <SEQ ID 2517> which encodes the amino acid sequence <SEQ ID 2518>. Analysis of this protein sequence reveals the following:

```
Possible site: 19
>>> Seems to have no N-terminal signal sequence

----- Final Results -----
          bacterial cytoplasm --- Certainty = 0.1264 (Affirmative) < succ>
          bacterial membrane  --- Certainty = 0.0000 (Not Clear)   < succ>
           bacterial outside  --- Certainty = 0.0000 (Not Clear)   < succ>
```

The protein has homology with the following sequences in the GENPEPT database.

```
>GP: CAB13473 GB: Z99112 similar to hypothetical proteins [Bacillus
subtilis]
Identities = 25/68 (36%), Positives = 41/68 (59%)

Query:   4 IENLIIAIVKPLISQPDQLTIKIQDGPEFLEYHLDLDTQDIGRVIGKKGRTITAIRSIVY  63
           +E+LI+ IV PL+  PD + +  ++  + +   L +   D G+VIGK+GRT  AIR+ V+
Sbjct:   6 LEDLIVHIVTPLVDHPDDIRVIREETDQKIALRLSVHKSDTGKVIGKQGRTAKAIRTAVF  65

Query:  64 SVPTQGKK                                                     71
              +  Q K
Sbjct:  66 AAGVQSSK                                                     73
```

A related DNA sequence was identified in *S. pyogenes* <SEQ ID 2519> which encodes the amino acid sequence <SEQ ID 2520>. Analysis of this protein sequence reveals the following:

```
Possible site: 19
>>> Seems to have no N-terminal signal sequence

----- Final Results -----
            bacterial cytoplasm --- Certainty = 0.1012 (Affirmative) < succ>
             bacterial membrane --- Certainty = 0.0000 (Not Clear)  < succ>
              bacterial outside --- Certainty = 0.0000 (Not Clear)  < succ>
```

An alignment of the GAS and GBS proteins is shown below.

```
Identities = 72/79 (91%), Positives = 75/79 (94%)

Query:   1 MDTIENLIIAIVKPLISQPDQLTIKIQDGPEFLEYHLDLDTQDIGRVIGKKGRTITAIRS   60
           MDTIENLIIAIVKPLISQPD LTIKI+D P+FLEYHLDLD QDIGRVIGKKGRTITAIRS
Sbjct:   1 MDTIENLIIAIVKPLISQPDNLTIKIEDTPDFLEYHLDLDAQDIGRVIGKKGRTITAIRS   60

Query:  61 IVYSVPTQGKKVRLIIDEK                                            79
           IVYSVPT GKKVRL+IDEK
Sbjct:  61 IVYSVPTLGKKVRLVIDEK                                            79
```

Based on this analysis, it was predicted that these proteins and their epitopes could be useful antigens for vaccines or diagnostics.

EXAMPLE 835

A DNA sequence (GBSx0887) was identified in *S. agalactiae* <SEQ ID 2521> which encodes the amino acid sequence <SEQ ID 2522>. This protein is predicted to be ribosomal protein S116 (rpsP). Analysis of this protein sequence reveals the following:

```
Possible site: 45
>>> Seems to have no N-terminal signal sequence

----- Final Results -----
            bacterial cytoplasm --- Certainty = 0.3654 (Affirmative) < succ>
             bacterial membrane --- Certainty = 0.0000 (Not Clear)  < succ>
              bacterial outside --- Certainty = 0.0000 (Not Clear)  < succ>
```

The protein has homology with the following sequences in the GENPEPT database.

```
>GP: BAB06202 GB: AP001515 ribosomal protein S16 (BS17) [Bacillus halodurans]
Identities = 62/90 (68%), Positives = 73/90 (80%)

Query:   1 MAVKIRLTRMGSKKKPFYRINVADSRAPRDGRFIETVGTYNPLVAENQVTIKEERVLEWL   60
           MAVKIRL RMGSKK PFYR+ VADSR+PRDGRFIE +GTYNPL    +V +KE+R L+W+
Sbjct:   1 MAVKIRLKRMGSKKAPFYRVVVADSRSPRDGRFIEEIGTYNPLTQPAKVELKEDRALDWM   60

Query:  61 SKGAQPSDTVRNLLSKAGVMTKFHDQKFSK                                 90
           KGA+PSDTVRNL SKAG+M K H+ K  K
Sbjct:  61 LKGAKPSDTVRNLFSKAGLMEKLHNAKNEK                                 90
```

A related DNA sequence was identified in *S. pyogenes* <SEQ ID 2523> which encodes the amino acid sequence <SEQ ID 2524>. Analysis of this protein sequence reveals the following:

```
Possible site: 45
>>> Seems to have no N-terminal signal sequence

----- Final Results -----
            bacterial cytoplasm --- Certainty = 0.3654(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below.

```
Identities = 86/90 (95%), Positives = 89/90 (98%)

Query:    1 MAVKIRLTRMGSKKKPFYRINVADSRAPRDGRFIETVGTYNPLVAENQVTIKEERVLEWL   60
            MAVKIRLTRMGSKKKPFYRINVADSRAPRDGRFIETVGTYNPLVAENQ+TIKE+RVLEWL
Sbjct:    1 MAVKIRLTRMGSKKKPFYRINVADSRAPRDGRFIETVGTYNPLVAENQITIKEDRVLEWL   60

Query:   61 SKGAQPSDTVRNLLSKAGVMTKFHDQKFSK                                90
            SKGAQPSDTVRN+LSKAGVM KFHDQKFSK
Sbjct:   61 SKGAQPSDTVRNILSKAGVMAKFHDQKFSK                                90
```

Based on this analysis, it was predicted that these proteins and their epitopes could be useful antigens for vaccines or diagnostics.

EXAMPLE 836

A DNA sequence (GBSx0888) was identified in *S. agalactiae* <SEQ ID 2525> which encodes the amino acid sequence <SEQ ID 2526>. Analysis of this protein sequence reveals the following:

```
Possible site: 35
>>> Seems to have no N-terminal signal sequence
    INTEGRAL     Likelihood = -11.09    Transmembrane     22-38  (16-42)
    INTEGRAL     Likelihood = -7.64     Transmembrane    382-398 (375-402)
    INTEGRAL     Likelihood = -7.59     Transmembrane    291-307 (284-317)
    INTEGRAL     Likelihood = -4.94     Transmembrane    340-356 (335-366)

----- Final Results -----
              bacterial membrane --- Certainty = 0.5437(Affirmative) < succ>
               bacterial outside --- Certainty = 0.0000(Not Clear)   < succ>
              bacterial cytoplasm --- Certainty = 0.0000(Not Clear)  < succ>
```

The protein has homology with the following sequences in the GENPEPT database.

```
>GP: AAC24912 GB: AF012285 YknZ [Bacillus subtilis]
Identities = 161/417 (38%), Positives = 241/417 (57%), Gaps = 25/417 (5%)

Query:    1 MENWKFALSSILGHKMRAFLTMLGIIIGVASVVLIMALGKGMKDSVTNEITKSQKNLQIY    60
            +EN + ALSS+L HKMR+ LTMLGIIIGV SV++++A+G+G  +   I+     +++Y
Sbjct:    4 LENIRMALSSVLAHKMRSILTMLGIIIGVGSVIVVVAVGQGGEQMLKQSISGPGNTVELY    63

Query:   61 YKTKEDQ-KNEDNFGAQGAFMQGSDTNRKEPIIQESWLKKIAKEVDGVSGYYVTNQTNAP   119
            Y   +++  + N  A+  F +              K  K ++G+     +   +
Sbjct:   64 YMPSDEELASNPNAAAESTFTENDI--------------KGLKGIEGIKQVVASTSESMK   109

Query:  120 VAYLEKKAKTVNITGINRTYLGIKKFKIKSGRQFQEEDYNQFSRVILLEEKLAQRLFQTN   179
                Y E++    + GIN    Y+ +   KI+SGR F + D+    +RV ++ +K+A+ LF
Sbjct:  110 ARYHEEETDAT-VNGINDGYMNVNSLKIESGRTFTDNDFLAGNRVGIISQKMAKELFDKT   168

Query:  180 EAALNKVVTVKNKSYLVVGVYSDPEAGSGLYGSNSDGNAILTNTQLASEFGAKEAENIYF   239
              + L +VV +  +    ++GV         +GL  +      + N  + S FG  +  N+
Sbjct:  169 -SPLGEVVWINGQPVEIIGVLKKV---TGLLSFDLSEMYVPFN-MMKSSFGTSDFSNVSL   223

Query:  240 HLNDVSQSNRIGKEIGKRLTDISHAKDGYYDNFDMTSIVKSINTQVGIMTGVIGAIAAIS   299
             +             GKE  + +D +H  +   Y  +M   I   I    IMT +IG+IA IS
Sbjct:  224 QVESADDIKSAGKEAAQLVND-NHGTEDSYQVMNMEEIAAGIGKVTAIMTTIIGSIAGIS   282

Query:  300 LLVGGIGVMNIMLVSVTERTREIGLRKALGATRRKILAQFLIESMVLTILGGLIGLLLAY   359
            LLVGGIGVMNIMLVSVTERTREIG+RK+LGATR +IL QFLIES+VLT++GGL+G+ + Y
Sbjct:  283 LLVGGIGVMNIMLVSVTERTREIGIRKSLGATRGQILTQFLIESVVLTLIGGLVGIGIGY   342

Query:  360 GGTMLIANAQDKITPS-VSLNVAIGSLIFSAFIGIIFGLLPANKASKLNPIDALRYE     415
            GG  L++         PS +S  V  G ++FS  IG+IFG+LPANKA+KL+PI+ALRYE
Sbjct:  343 GGAALVSAIAG--WPSLISWQVVCGGVLFSMLIGVIFGMLPANKAAKLDPIEALRYE     397
```

There is also homology to SEQ ID 1350.

Based on this analysis, it was predicted that this protein and its epitopes, could be useful antigens for vaccines or diagnostics.

EXAMPLE 837

A DNA sequence (GBSx0889) was identified in *S. agalactiae* <SEQ ID 2527> which encodes the amino acid sequence <SEQ ID 2528>. This protein is predicted to be ABC transporter (ATP-bindingprot). Analysis of this protein sequence reveals the following:

```
Possible site: 52
>>> Seems to have no N-terminal signal sequence

----- Final Results -----
            bacterial cytoplasm --- Certainty = 0.4080(Affirmative) < succ>
             bacterial membrane --- Certainty = 0.0000(Not Clear)   < succ>
              bacterial outside --- Certainty = 0.0000(Not Clear)   < succ>
```

The protein has homology with the following sequences in the GENPEPT database.

```
>GP: BAB06841 GB: AP001517 ABC transporter (ATP-binding protein)
[Bacillus halodurans]
Identities = 131/218 (60%), Positives = 169/218 (77%)

Query:   8 LIRLHQIVKSYQNGDQKLQVLKNIDLTVYEGEFLAIMGPSGSGKSTLMNIIGLLDSPTSG  67
           +I+L ++ KS++ G + +++L  IDL +  G+FLAIMGPSGSGKSTLMNIIG LD PTSG
Sbjct:   1 MIKLERVTKSFRVGTEMVEILSAIDLEIASGDFLAIMGPSGSGKSTLMNIIGCLDQPTSG  60

Query:  68 DYSLNGKRVEELSQTKLAQVRNKEIGFVFQQFFLLSKLTALQNVELPLIYAGVPPKKRKN 127
           Y +GK +    S+ ++A++RN+ IGFVFQQF LL +LTALQNVELP++YAG+  K+R
Sbjct:  61 RYMFDGKDLTNYSEQEIAKIRNRHIGFVFQQFHLLPRLTALQNVELPMVYAGMKKKERTE 120

Query: 128 LAKQFLDKVELRERMNHLPTELSGGQKQRVAIARALVNSPSIILADEPTGALDTKTGEQI 187
            A  L++V L ERM +LP  LSGGQKQRVAIAR++VN P+IILADEPTGALDTKT E I
Sbjct: 121 RAAHALERVGLAERMTYLPNSLSGGQKQRVAIARSIVNEPNIILADEPTGALDTKTSETI 180

Query: 188 MQFLTELNQEGKTIIMVTHEPEIADYATRKIVIRDGEI                       225
           M+ L  LN EG TI +VTHEPEIA+Y + + +RDG+I
Sbjct: 181 MELLCSLNNEGTTIALVTHEPEIAEYTQQTVFVRDGQI                       218
```

A related DNA sequence was identified in *S. pyogenes* <SEQ ID 2529> which encodes the amino acid sequence <SEQ ID 2530>. Analysis of this protein sequence reveals the following:

```
Possible site: 52
>>> Seems to have no N-terminal signal sequence

----- Final Results -----
            bacterial cytoplasm --- Certainty = 0.1739(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below.

```
Identities = 182/232 (78%), Positives = 207/232 (88%)

Query:   5 RKELIRLHQIVKSYQNGDQKLQVLKNIDLTVYEGEFLAIMGPSGSGKSTLMNIIGLLDSP  64
           +K+L++L   IVKSYQNGDQ L+VLK I+LTVYEGEFLAIMGPSGSGKSTLMNIIGLLD P
Sbjct:   5 KKQLMQLSNIVKSYQNGDQVLKVLKGINLTVYEGEFLAIMGPSGSGKSTLMNIIGLLDRP  64

Query:  65 TSGDYSLNGKRVEELSQTKLAQVRNKEIGFVFQQFFLLSKLTALQNVELPLIYAGVPPKK 124
           TSGDY+L+ ++E L+ +LA+VRN EIGFVFQQFFL+KLTALQNVELPLIYAGV  K
Sbjct:  65 TSGDYTLHNTKIEILNDRELAKVRNDEIGFVFQQFFLLAKLTALQNVELPLIYAGVNVSK 124

Query: 125 RKNLAKQFLDKVELRERMNHLPTELSGGQKQRVAIARALVNSPSIILADEPTGALDTKTG 184
           R+  AKQFL+KV L  R+ HLP+ELSGGQKQRVAIARALVN PSIILADEPTGALDTKTG
Sbjct: 125 RREQAKQFLEKVGLGRRIKHLPSELSGGQKQRVAIARALVNDPSIILADEPTGALDTKTG 184

Query: 185 EQIMQFLTELNQEGKTIIMVTHEPEIADYATRKIVIRDGEITADTTDSIRID          236
           +QIM+ LTELN+EGKTIIMVTHEPEIAD+ATRKI+IRDG+IT DTT S+ ID
Sbjct: 185 QQIMELLTELNKEGKTIIMVTHEPEIADFATRKIIIRDGDITTDTTASVVID          236
```

Based on this analysis, it was predicted that these proteins and their epitopes could be useful antigens for vaccines or diagnostics.

EXAMPLE 838

A DNA sequence (GBSx0890) was identified in *S. agalactiae* <SEQ ID 2531> which encodes the amino acid sequence <SEQ ID 2532>. This protein is predicted to be ATP-binding cassette transporter-like protein. Analysis of this protein sequence reveals the following:

```
Possible site: 37
>>> Seems to have no N-terminal signal sequence
     INTEGRAL      Likelihood = -8.97     Transmembrane     17-33 (13-39)

----- Final Results -----
              bacterial membrane --- Certainty = 0.4588(Affirmative) < succ>
              bacterial outside  --- Certainty = 0.0000(Not Clear)   < succ>
            bacterial cytoplasm  --- Certainty = 0.0000(Not clear)   < succ>
```

A related GBS nucleic acid sequence <SEQ ID 9965> which encodes amino acid sequence <SEQ ID 9966> was also identified.

The protein has homology with the following sequences in the GENPEPT database.

```
>GP: AAC24909 GB: AF012285 YknX [Bacillus subtilis]
Identities = 104/391 (26%), Positives = 182/391 (45%), Gaps = 21/391 (5%)

Query:   13 KKGAIISGLSVALIVVIGGFLWVQSQPNKSAVKTNYKVFNVREGSVSSSTLLTGKAKANQ    72
            KK  I  G++V + + +G  ++   + P        + +V E  +SS+ ++ G   K +
Sbjct:    2 KKVWIGIGIAVIVALFVGINIYRSAAPTSGSAGKEVQTGSVEENEISSTVMVPGTLKFSN   61

Query:   73 EQYVYFDANKGNRATVTVKVGDKITAGQQLVQYDTTTAQAAYDTANRQLNKVARQINNLK   132
            EQYV+++A+KG   + VK GDK+  G  LV Y  T  Q + +     QL    + ++   +
Sbjct:   62 EQYVFYEADKGTLEDIKVKEGDKVKKGTALVTY--TNEQLSLEKEQNQLTSESNRLQIDQ  119

Query:  133 TTGSLPAMESSDQSSSSSQGQGTQSTSGATNRLQQNYQSQANASYNQQLQDLNDAYADAQ   192
               L A++S ++         G+        + R +   Q +           +L       Q
Sbjct:  120 IQEKLKALDSKERELEKQVGKKEAEKQIESERTELQMQKKTAEI------ELKQTELQRQ  173

Query:  193 AEVNKAQKALNDTVITSDVSGTVVEVNSDIDPASKTSQV---LVHVATEGKLQVQGTMSE   249
              +  N+     ++D + S++ GTV+ VN   + ASK S +    ++H+      L V G +SE
Sbjct:  174 SLANR----VSDLEVKSEIEGTVISVNQ--EAASKKSDIQEPVIHIGNPKDLVVSGKLSE  227

Query:  250 YDLANVKKDQAVKIKSKVYPDKEWEGKISYISNYPEAEANNNDSNNGSSAVNYKYKVDIT   309
            YD    VKK Q V + S V    K W+G +S +   P+ + + +       AV Y  +V I
Sbjct:  228 YDTLKVKKGQKVTLTSDVIQGKTWKGTVSAVGLVPD-QQESAAAQGTEQAVQYPLQVKIK  286

Query:  310 SPLDALKQGFTVSVEV-VNGDKHLIVPTSSVINKDNKHFVWVYNDSNRKISKVEVKIGKA   368
               L   K GF  + +   + K   +P+ +V +D++++V+     D   K  +V+VKIG+
Sbjct:  287 GNLPEGKPGFKFIMNIETDKRKANTLPSKAVKKEDDQYVVYTVKDG--KAKRVDVKIGEV  344

Query:  369 DAKTQEILSGLKAGQIVVTNPSKTFKDGQKI                               399
               EI   GL      V+ NPS    DG ++
Sbjct:  345 TDDLTEIKEGLTQDDQVILNPSDQVTDGMEV                               375
```

A related DNA sequence was identified in *S. pyogenes* <SEQ ID 2533> which encodes the amino acid sequence <SEQ ID 2534>. Analysis of this protein sequence reveals the following:

```
Possible site: 42
>>> Seems to have an uncleavable N-term signal seq
     INTEGRAL      Likelihood = -9.61     Transmembrane     15-31 (11-36)

----- Final Results -----
              bacterial membrane --- Certainty = 0.4843(Affirmative) < succ>
              bacterial outside  --- Certainty = 0.0000(Not Clear)   < succ>
            bacterial cytoplasm  --- Certainty = 0.0000(Not clear)   < succ>
```

The protein has homology with the following sequences in the databases:

```
>GP: AAC24909 GB: AF012285 YknX [Bacillus subtilis]
Identities = 103/380 (27%), Positives = 180/380 (47%), Gaps = 21/380 (5%)

Query:  16 ITASVITLVLIITGIVLWKQQRNTLTADIAKEPYSTVSVTEGSIASSTLLSGTVKALSEE    75
           I  +  +V +  GI +++    T  +  A +   T SV  E  I+S+ ++ GT+K  +E+
Sbjct:   6 IGIGIAVIVALFVGINIYRSAAPT--SGSAGKEVQTGSVEENEISSTVMVPGTLKFSNEQ   63

Query:  76 YIYFDANKGNDATVTKVGDQVTQGQQLVQYNTTTAQSAYDTAVRSLNKIGRQINHLKTY   135
           Y++++A+KG   + VK GD+V +G   LV Y  T  Q + +    + N++   + N L+
Sbjct:  64 YVFYEADKGTLEDIKVKEGDKVKKGTALVTY--TNEQLSLE---KEQNQLTSESNRLQID  118

Query: 136 GVPAVSTETNRDEATGEETTTTVQPSAQ-QNANYKQQLQDLNDAYADAQAEVNKAQIA--  192
              +      +  E    E+      +  Q ++    + Q+Q         Q  E+ +  +A
Sbjct: 119 QIQEKLKALDSKERELEKQVGKKEAEKQIESERTELQMQKKTAEIELKQTELQRQSLANR  178

Query: 193 LNDTVVISSVSGTVVEVNND-IDPSSKNSQTLVHVATEGQLQVKGTLTEYDLANVKVGQS  251
           ++D  V S + GTV+ VN +       S   + ++H+      L  V G L+EYD   VK GQ
Sbjct: 179 VSDLEVKSEIEGTVISVNQEAASKKSDIQEPVIHIGNPKDLVVSGKLSEYDTLKVKKGQK  238

Query: 252 VKIKSKVYSNQEWTGKISYVSNYPTESNAGSTTPAGSTGAGSSTGATYDKIDIISPLNQ   311
           V + S V    + W G +S V     P + +         + G+     Y ++ I   L +
Sbjct: 239 VTLTSDVIQGKTWKGTVSAVGLVPDQQES-------AAAQGTEQAVQYPLQVKIKGNLPE  291

Query: 312 LKQGFTVSVEVVNEAKQA-LVPLTAVIKKDKKHYVWTYDDATGKAKKVEVTLGNADAOQQ  370
              K GF  + +  + ++A  +P  AV K+D ++YV+T   D   GKAK+V+V +G
Sbjct: 292 GKPGFKFIMNIETDKRKANTLPSKAVKKEDDQYVVYTVKD--GKAKRVDVKIGEVTDDLT  349

Query: 371 EIHKGVAVGDIVIANPDKNI                                          390
           EI +G+    D VI NP   +
Sbjct: 350 EIKEGLTQDDQVILNPSDQV                                          369
```

An alignment of the GAS and GBS proteins is shown below.

```
Identities = 234/421 (55%), Positives = 301/421 (70%), Gaps = 19/421 (4%)

Query:   3 MSKRQNLGISKKGAIISGLSVALIVVIGGF-LWVQSQPNKSA--VKTNYKVFNVREGSVS    59
           MSKR  + I+ K  +I+  + L+++I G   LW Q +   +A   K  Y  +V EGS++
Sbjct:   1 MSKRGKIKITTKTKLITASVITLVLIITGIVLWKQQRNTLTADIAKEPYSTVSVTEGSIA   60

Query:  60 SSTLLTGKAKANQEQYVYFDANKGNRATVTKVGDKITAGQQLVQYDTTTAQAAYDTANR  119
           SSTLL+G  KA   E+Y+YFDANKGN  ATVTKVGD++T GQQLVQY+TTTAQ+AYDTA R
Sbjct:  61 SSTLLSGTVKALSEEYIYFDANKGNDATVTKVGDQVTQGQQLVQYNTTTAQSAYDTAVR   120

Query: 120 QLNKVARQINNLKTTGSLPAMESSDQSSSSSQGQGTQSTSGATNRLQQNYQSQANASYNQ  179
           +LNK+ RQIN+LKT G +PA+ S+  +    +    + G+ T +T           +Q NA+Y Q
Sbjct: 121 SLNKIGRQINHLKTYG-VPAV-STETNRDEATGEETTTTVQPS--------AQQNANYKQ  170

Query: 180 QLQDLNDAYADAQAEVNKAQKALNDTVITSDVSGTVVEVNSDIDPASKTSQVLVHVATEG  239
           QLQDLNDAYADAQAEVNKAQ ALNDTV+ S VSGTVVEVN+DIDP+SK SQ LVHVATEG
Sbjct: 171 QLQDLNDAYADAQAEVNKAQIALNDTVVISSVSGTVVEVNNDIDPSSKNSQTLVHVATEG  230

Query: 240 KLQVQGTMSEYDLANVKKDQAVKIKSKVYPDKEWEGKISYISNYP-EAEANN-----NDS  293
           +LQV+GT++EYDLANVK  Q+VKIKSKVY ++EW GKISY+SNYP E+ A +       +
Sbjct: 231 QLQVKGTLTEYDLANVKVGQSVKIKSKVYSNQEWTGKISYVSNYPTESNAGSTTPAGSTG  290

Query: 294 NNGSSAVNYKYKVDITSPLDALKQGFTVSVEVVNGDKHLIVPTSSVINKDNKHFVWVYND  353
              S+     Y YK+DI SPL+ LKQGFTVSVEVVN   K  +VP ++VI KD KH+VW Y+D
Sbjct: 291 AGSSTGATYDYKIDIISPLNQLKQGFTVSVEVVNEAKQALVPLTAVIKKDKKHYVWTYDD  350

Query: 354 SNRKISKVEVKIGKADAKTQEILSGLKAGQIVVTNPSKTFKDGQKIDNIESIDLNSNKKSE  414
           +   K KVEV +G ADA+ QEI  G+   G IV+ NP K  K   +K++ + + SI N+ + +
Sbjct: 351 ATGKAKKVEVTLGNADAQQQEIHKGVAVGDIVIANPDKNIKPDKKLEGVISIGTNTKPEKD  411
```

Based on this analysis, it was predicted that these proteins and their epitopes could be useful antigens for vaccines or diagnostics.

EXAMPLE 839

A DNA sequence (GBSx0891) was identified in *S. agalactiae* <SEQ ID 2535> which encodes the amino acid sequence <SEQ ID 2536>. Analysis of this protein sequence reveals the following:

```
Possible site: 29
>>> Seems to have no N-terminal signal sequence

----- Final Results -----
          bacterial cytoplasm --- Certainty = 0.1832(Affirmative) < succ>
          bacterial membrane  --- Certainty = 0.0000(Not Clear)   < succ>
          bacterial outside   --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 840

A DNA sequence (GBSx0892) was identified in *S. agalactiae* <SEQ ID 2537> which encodes the amino acid sequence <SEQ ID 2538>. This protein is predicted to be carbamoyl-phosphate synthase, pyrimidine-specific, large chain, putati. Analysis of this protein sequence reveals the following:

```
Possible site: 59
>>> Seems to have an uncleavable N-term signal seq
INTEGRAL Likelihood = -1.70 Transmembrane 486-502 (486-502)

----- Final Results -----
          bacterial membrane  --- Certainty = 0.1680 (Affirmative) < succ>
          bacterial outside   --- Certainty = 0.0000 (Not Clear)   < succ>
          bacterial cytoplasm --- Certainty = 0.0000 (Not Clear)   < succ>
```

The protein has homology with the following sequences in the GENPEPT database.

```
>GP: CAA91005 GB: Z54240 carbamoyl-phosphate synthase [Lactobacillus
plantarum]
Identities = 117/417 (28%), Positives = 205/417 (49%), Gaps = 37/417 (8%)

Query: 122 FVQVDCLVMRDSLNNCLYVSDLEYIES-NKTTGKSLAIVPSQTLSDAARQTIRDVAFDVC  180
             + +++  VMRD+ +N + V ++E +    TG S+   P QTL+D   Q +RD A   +
Sbjct: 213 YKEIEFEVMRDAADNAMVVCNMENFDPVGIHTGDSIVYAPVQTLADREVQLLRDAALKII  272

Query: 181 RKANIIGVCYFSFLIDLNSLDYHIISLSSGLSHQSILFETITTYPVLEIATKLTVGYTFS  240
           R    I G C    +D NS +Y+II ++  +S  S L    T YP+ ++A K+ VG
Sbjct: 273 RALKIEGGCNVQLALDPNSFNYYIIEVNPRVSRSSALASKATGYPIAKMAAKIAVGLHLD  332

Query: 241 QLKHSYYPNTSAFLEPQLDYVATV--SFSFEKVDY---------------IFFARNIEQL  283
           ++K+     T A EP LDYV      + F+K +                +  RNIE+
Sbjct: 333 EIKNPVTGTTYAEFEPALDYVVCKIPRWPFDKFTHADRRLGTQMKATGEVMAIGRNIEEA  392

Query: 284 FLNLLEASS----HDHFPFLSDISEEDLMFALIQKKENRLAYLLEAFRRGFDLYDLSSVT  339
            L + +       H    L + ++ L   LI +++RL YL EA RRG+ + +L+ +T
Sbjct: 393 TLKAVRSLEIGVHHVEESTLRSVDDDVLSDKLIHAQDDRLFYLTEAIRRGYQIDELAELT  452

Query: 340 KINPFYLDKCLHIVELYENLNKSQYNVDIYKEAKRYGFSDDYIASSWQISLIDMLEYRKK  399
           KIN F+LDK LHI+E+ + L    +++    AKR GF+D +A  W ++ + ++R
Sbjct: 453 KINVFFLDKLLHIIEIEQALRTHTDDIETLTVAKRNGFADQTVADYWHETIDQVRDFRLA  512

Query: 400 HSVAPVLKQVEQSSGVLTGHQIQYFRSYDWHSDYISSGCQKALIM---------VDKGY  449
           H +APV K V+  +G          Y+ +Y++ ++ I +      L++           V+  Y
Sbjct: 513 HKLAPVYKMVDTCAGEFASETPYYYGTYEFENESIVTKRPSVLVLGSGPIRIGQGVEFDY  572

Query: 450 SLVKLNELIKQIKQTHLELLIVTNQPLLIEQLNDTS--IIFDTIGIETILTIMGIEE   504
             + V      +K I++    E +I+ + P  +       S  + F+  + IE +L ++ +E+
Sbjct: 573 ATV---HSVKAIQKAGYEAIIMNSNPETVSTDFSVSDKLYFEPLTIEDVLNVIELEK   626
```

Based on this analysis, it was predicted that this protein and its epitopes, could be useful antigens for vaccines or diagnostics.

EXAMPLE 841

A DNA sequence (GBSx0893) was identified in *S. agalactiae* <SEQ ID 2539> which encodes the amino acid sequence <SEQ ID 2540>. This protein is predicted to be carbamoyl phosphate synthetase small subunit (carA). Analysis of this protein sequence reveals the following:

```
Possible site: 27
>>> Seems to have no N-terminal signal sequence

----- Final Results -----
            bacterial cytoplasm --- Certainty = 0.2709 (Affirmative) < succ>
            bacterial membrane  --- Certainty = 0.0000 (Not Clear)   < succ>
            bacterial outside   --- Certainty = 0.0000 (Not Clear)   < succ>
```

The protein has homology with the following sequences in the GENPEPT database.

```
>GP: CAB89872 GB: AJ132624 carbamoyl phosphate synthetase small
subunit [Lactococcus lactis]
Identities = 188/352 (53%), Positives = 265/352 (74%)

Query:   1 MAKKLLILEDGTVFEGLSFGSSLDVTGELVFCTGNTGYQEIITNPSHNGKILVFTSPLIG   60
           M+K+LLILEDGT+FEG + G++LDVTGELVF TG TGYQE IT+ S+NG+IL FT P++G
Sbjct:   1 MSKRLLILEDGTIFEGEALGANLDVTGELVFNTGMTGYQESITDQSYNGQILTFTYPIVG   60

Query:  61 NYGIHRSYSEAIIPTCLGVVVAEYSRCVSSDTSKMNLDEFLKMKKVPAMSGVDTRYLMQV  120
           NYG++R    E+I PTC  VVV E +R  S+    +M+ DEFLK K +P ++GVDTR + ++
Sbjct:  61 NYGVNRDDYESIHPTCKAVVVHEAARRPSNWRMQMSFDEFLKSKNIPGITGVDTRAITKI  120

Query: 121 IKEKGFVKATLAEAGDVLSHLQDQLIATVLPTNNVEQVSTKTAYPSPASGRNIVVLDFGL  180
           ++E G +KA+L +A D + H   QL ATVLPTN VE  ST TAYPSP +GR +VV+DFGL
Sbjct: 121 VREHGTMKASLVQARDEVDHQMSQLQATVLPTNQVETSSTATAYPSPNTGRKVVVVDFGL  180

Query: 181 KHSILRELSKRQCDVTVIPYNTSLEGIKNLYPEGIILSNGPGNPEKLQEILNTIKELQKS  240
           KHSILRELSKR+C++TV+PYNTS + I + +P+G++L+NGPG+P + E +  IKE+Q
Sbjct: 181 KHSILRELSKRECNLTVVPYNTSAKEILEMEPDGVMLTNGPGDPTDVPEAIEMIKEVQGK  240

Query: 241 VPMLGIGLGHQLIAMANGAEIMRLPVAKKGPNYPMRDIATGRLETVSQFNHFTVNRLNLP  300
           +P+ GI LGHQL ++ANGA   ++    +G N+ +R++ATGR++  SQ + + V+  NLP
Sbjct: 241 IPIFGICLGHQLFSLANGATTYKMKFGHRGFNHAVREVATGRIDFTSQNHGYAVSSENLP  300

Query: 301 HDLLVTHEGLNDQEIVALRHRSFPVMSVQFYPEAAPGPHDVTYFFDEFLEMI          352
           +DL++TH +ND +  +RH+ FP  SVQF+P+AAPGPHD +Y FD+F++++
Sbjct: 301 EDLMITHVEINDNSVEGVRHKYFPAFSVQFHPDAAPGPHDASYLFDDFMDLM          352
```

There is also homology to SEQ ID 2030.

Based on this analysis, it was predicted that this protein and its epitopes, could be useful antigens for vaccines or diagnostics.

EXAMPLE 842

A DNA sequence (GBSx0894) was identified in *S. agalactiae* <SEQ ID 2541> which encodes the amino acid sequence <SEQ ID 2542>. Analysis of this protein sequence reveals the following:

```
Possible site: 57
>>> Seems to have no N-terminal signal sequence

----- Final Results -----
            bacterial cytoplasm --- Certainty = 0.3646 (Affirmative) < succ>
            bacterial membrane  --- Certainty = 0.0000 (Not Clear)   < succ>
            bacterial outside   --- Certainty = 0.0000 (Not Clear)   < succ>
```

A related GBS nucleic acid sequence <SEQ ID 9967> which encodes amino acid sequence <SEQ ID 9968> was also identified.

The protein has homology with the following sequences in the GENPEPT database.

```
>GP: CAB89869 GB: AJ132624 pyrimidine regulatory protein [Lactococcus
lactis]
Identities = 127/169 (75%), Positives = 147/169 (86%)

Query:   13 MKRKEIIDDVTMKRAITRITYEIIERNKNLDNIVLAGIKTRGVFLAKRIQERLKQLENLD    72
             M RKEIID++TMKRAITRITYEIIERNK LD +VL GIKTRGV+LAKRIQERL+QLE L+
Sbjct:    1 MARKEIIDEITMKRAITRITYEIIERNKELDKLVLIGIKTRGVYLAKRIQERLQQLEGLE    60

Query:   73 IPVGELDTKPFRDDMKVEVDTTTMPVDITDKDIILIDDVLYTGRTIRAAIDNLVSLGRPS   132
             IP GELDT+PFRDD + + DTT + +DIT KD+IL+DDVLYTGRTIRAAID +V LGRP+
Sbjct:   61 IPFGELDTRPFRDDKQAQEDTTEIDIDITGKDVILVDDVLYTGRTIRAAIDGIVKLGRPA   120

Query:  133 RVSLAVLIDRGHRELPIRADYVGKNIPTSQFEEILVEVMEHDGYDRVSI             181
             RV LAVL+DRGHRELPIRADYVGKNIPT   EEI+V++ EHDG D + I
Sbjct:  121 RVQLAVLVDRGHRELPIRADYVGKNIPTGHDEEIIVQMSEHDGNDSILI             169
```

A related DNA sequence was identified in *S. pyogenes* <SEQ ID 2543> which encodes the amino acid sequence <SEQ ID 2544>. Analysis of this protein sequence reveals the following:

```
Possible site: 45
>>> Seems to have no N-terminal signal sequence

----- Final Results -----
          bacterial cytoplasm --- Certainty = 0.3870 (Affirmative) < succ>
           bacterial membrane --- Certainty = 0.0000 (Not Clear)   < succ>
            bacterial outside --- Certainty = 0.0000 (Not Clear)   < succ>
```

An alignment of the GAS and GBS proteins is shown below.

```
Identities = 147/171 (85%), Positives = 158/171 (91%)

Query:   13 MKRKEIIDDVTMKRAITRITYEIIERNKNLDNIVLAGIKTRGVFLAKRIQERLKQLENLD    72
             MK KEI+DDVTMKRAITRITYEIIERNK LDN+VLAGIKTRGVFLA+RIQERL QLE LD
Sbjct:    1 MKTKEIVDDVTMKRAITRITYEIIERNKQLDNVVLAGIKTRGVFLARRIQERLHQLEGLD    60

Query:   73 IPVGELDTKPFRDDMKVEVDTTTMPVDITDKDIILIDDVLYTGRTIRAAIDNLVSLGRPS   132
             +P+GELD KPFRDDM+VE DTT M VDIT KD+ILIDDVLYTGRTIRAAIDNLVSLGRP+
Sbjct:   61 LPIGELDIKPFRDDMRVEEDTTLMSVDITGKDVILIDDVLYTGRTIRAAIDNLVSLGRPA   120

Query:  133 RVSLAVLIDRGHRELPIRADYVGKNIPTSQFEEILVEVMEHDGYDRVSIID           183
             RVSLAVL+DRGHRELPIRADYVGKNIPTS  EEI+VEV E DG DRVSIID
Sbjct:  121 RVSLAVLVDRGHRELPIRADYVGKNIPTSSVEEIVVEVVEVDGRDRVSIID           171
```

Based on this analysis, it was predicted that these proteins and their epitopes could be useful antigens for vaccines or diagnostics.

EXAMPLE 843

A DNA sequence (GBSx0895) was identified in *S. agalactiae* <SEQ ID 2545> which encodes the amino acid sequence <SEQ ID 2546> (rluD). Analysis of this protein sequence reveals the following:

```
Possible site: 35
>>> Seems to have no N-terminal signal sequence

----- Final Results -----
          bacterial cytoplasm --- Certainty = 0.0687 (Affirmative) < succ>
           bacterial membrane --- Certainty = 0.0000 (Not Clear)   < succ>
            bacterial outside --- Certainty = 0.000  (Not Clear)   < succ>
```

A related GBS nucleic acid sequence <SEQ ID 9969> which encodes amino acid sequence <SEQ ID 9970> was also identified.

The protein has homology with the following sequences in the GENPEPT database.

```
>GP: BAB06261 GB: AP001515 unknown conserved protein [Bacillus halodurans]
Identities = 178/290 (61%), Positives = 216/290 (74%), Gaps = 2/290 (0%)

Query:   17 GVRLDKAL-ADNSELSRSQANEEIKKGIVLVNGQVKKAKYTVQEGDRITFDIPKEEVLDY    75
            G R+DK L A   E SR+Q  + IK G VL+NG+  K+ Y V+ GD +   +P+ EVL+
Sbjct:   15 GERIDKFLTAQGEEWSRTQVQQWIKDGHVLINGRTIKSNYKVETGDTLELFVPEPEVLEV   74

Query:   76 QAENIPLDIIYQDDDVAVVNKPQGMVVHPSAGHSSGTLVNALMYHIKDLSSINGVVRPGI  135
               ENIP++IIY+D+DVAVVNKP+GMVVHP+ GH++GTLVNALMYH  DLSSINGVVRPGI
Sbjct:   75 VPENIPIEIIYEDEDVAVVNKPRGMVVHPAPGHTTGTLVNALMYHCNDLSSINGVVRPGI  134

Query:  136 VHRIDKDTSGLLMVAKNDRAHQVLAEELKDKKSLRKYLAIVHGNLPNDRGVIEAPIGRSD  195
            VHRIDKDTSGLLM+AKNDRAH+ L   +LK K + R Y AIVHGN+P+D G I+APIGR
Sbjct:  135 VHRIDKDTSGLLMIAKNDRAHESLVNQLKAKTTERVYQAIVHGNIPHDHGTIDAPIGRDK  194

Query:  196 KDRKKQAVTAK-GKPAITRFHVLERFGDYTLVELSLETGRTHQIRVHMAYIGHPLAGDPV  254
              DR+    VT +  + A+T F VLERFGD+T VE  LETGRTHQIRVH  YIG PLAGDP
Sbjct:  195 VDRQSMTVTEENSRDAVTHFTVLERFGDFTFVECQLETGRTHQIRVHFKYIGFPLAGDPK  254

Query:  255 YGPRKTLGGKGQFLHAQTLGFTHPSNGENLIFSVEVPEIFQTTLEKLRKN            304
            YGP+KTL   GQ LHAQ LGF HP  GE + F VE+PE +  + +L+ N
Sbjct:  255 YGPKKTLSIDGQALHAQKLGFEHPRTGEFMRFKVEMPEEMKKLIRQLQNN            304
```

25

A related DNA sequence was identified in *S. pyogenes* <SEQ ID 2547> which encodes the amino acid sequence <SEQ ID 2548>. Analysis of this protein sequence reveals the following:

```
Possible site: 27
>>> Seems to have no N-terminal signal sequence

----- Final Results -----
           bacterial cytoplasm --- Certainty = 0.2455 (Affirmative) < succ>
           bacterial membrane  --- Certainty = 0.0000 (Not Clear)   < succ>
            bacterial outside  --- Certainty = 0.0000 (Not Clear)   < succ>
```

An alignment of the GAS and GBS proteins is shown below.

```
Identities = 239/295 (81%), Positives = 265/295 (89%)

Query:    9 MEITIKIAGVRLDKALADNSELSRSQANEEIKKGIVLVNGQVKKAKYTVQEGDRITFDIP   68
            MEI +  +G RLDKALAD S LSR QAN++IK+G+VLVNGQ KKAKYTVQ GD I F++P
Sbjct:    1 MEINVITSGQRLDKALADLSPLSRGQANDQIKQGLVLVNGQQKKAKYTVQAGDVICFELP   60

Query:   69 KEEVLDYQAENIPLDIIYQDDDVAVVNKPQGMVVHPSAGHSSGTLVNALMYHIKDLSSIN  128
            KEEVL+YQA+NIPLDIIY+DD +A++NKPQGMVVHPSAGH SGT+VNALMYHIKDLSSIN
Sbjct:   61 KEEVLEYQAQNIPLDIIYEDDALAIINKPQGMVVHPSAGHPSGTMVNALMYHIKDLSSIN  120

Query:  129 GVVRPGIVHRIDKDTSGLLMVAKNDRAHQVLAEELKDKKSLRKYLAIVHGNLPNDRGVIE  188
            GVVRPGIVHRIDKDTSGLLMVAK  AHQ LAEELK KKSLRKYLAIVHGNLPNDRG+IE
Sbjct:  121 GVVRPGIVHRIDKDTSGLLMVAKTDAAHQALAEELKAKKSLRKYLAIVHGNLPNDRGMIE  180

Query:  189 APIGRSDKDRKKQAVTAKGKPAITRFHVLERFGDYTLVELSLETGRTHQIRVHMAYIGHP  248
            APIGRS+KDRKKQAVTAKGK A+TRF VLERFGDY+LVEL LETGRTHQIRVHMAYIGHP
Sbjct:  181 APIGRSEKDRKKQAVTAKGKEAVTRFTVLERFGDYSLVELQLETGRTHQIRVHMAYIGHP  240

Query:  249 LAGDPVYGPRKTLGGKGQFLHAQTLGFTHPSNGENLIFSVEVPEIFQTTLEKLRK       303
            +AGDP+YGPRKTL G GQFLHA+TLG THP  G+ +IF+VE PEIFQ  L+ LRK
Sbjct:  241 VAGDPLYGPRKTLSGHGQFLHAKTLGLTHPMTGKEMIFTVEAPEIFQKVLKLLRK       295
```

Based on this analysis, it was predicted that these proteins and their epitopes could be useful antigens for vaccines or diagnostics.

EXAMPLE 844

A DNA sequence (GBSx0896) was identified in *S. agalactiae* <SEQ ID 2549> which encodes the amino acid sequence <SEQ ID 2550>. Analysis of this protein sequence reveals the following:

```
Possible site: 33
>>> Seems to have no N-terminal signal sequence

----- Final Results -----
             bacterial cytoplasm --- Certainty = 0.0496 (Affirmative) < succ>
              bacterial membrane --- Certainty = 0.0000 (Not Clear)   < succ>
               bacterial outside --- Certainty = 0.0000 (Not Clear)   < succ>
```

The protein has homology with the following sequences in the GENPEPT database.

```
>GP: AAD53064 GB: AF163833 CpsY [Streptococcus agalactiae]
Identities = 105/297 (35%), Positives = 163/297 (54%), Gaps = 4/297 (1%)

Query:    1 MNIQQLRYVVAIANSGTFREAAAKLFVSQPSLSVAVRDLETELGFQIFTRTTTGAVLTNQ    60
            M IQQL+YV+ I  +G+  EAA +L+++QPSLS AVR+LETE+G QIF R    G  LT
Sbjct:    1 MRIQQLQYVIKIVETGSMNEAAKQLYITQPSLSNAVRNLETEMGIQIFIRNPKGITLTKD   60

Query:   61 GMTFYENALEVVKSFDSFEKQFSQSEATEQEFSIASQHYDFLPPLITAFSKCNDNFSY-F  119
            GM F   A ++++     E+++   + + FS++SQHY F+     A    D    Y
Sbjct:   61 GMEFLSYARQILEQTALLEERYKGDNTSRELFSVSSQHYAFVVNAFVALFNGTDMTQYEL  120

Query:  120 RIFESTTIRILDEVAQGNSEIGIIYINSQNKKGLLQRLDKLGLEFVELIPFKTHIYLGKD  179
             + E+ T  I+D+V     SEIG++++NS N+  L + D    L    HI++ K
Sbjct:  121 FLRETRTWEIIDDVKNFRSEIGVLFLNSYNRDVLTKLFDDNSLIATTLFTTTPHIFVSKS  180

Query:  180 HPLASKTSLIMTDLEGLPTVRFTQDRDDYRYYSENFVEVLDSSVTYNVTDRATLNGILER  239
            +PLA++  L M DLE  P + Q    +  Y+SE +  +    V+DRATL  ++
Sbjct:  181 NPLANRKKLSMKDLEDYPYLSYDQGLHNSFYFSEEMMSQIPHPKSIVVSDRATLFNLMIG  240

Query:  240 TQAYATGSGFLDSRSVNG--ITVIPLEDHLDNQMIYIKRKDRNLSQMALKFVAVMEE     294
              Y   +G L+S+ +NG   I  IPL+    ++YI+   NLS+M KF+   + E
Sbjct:  241 LDGYTVATGILNSK-LNGDEIVAIPLDVDDVIDIVYIRHDKANLSKMGQKFIDYLLE    296
```

A related DNA sequence was identified in *S. pyogenes* <SEQ ID 2551> which encodes the amino acid sequence <SEQ ID 2552>. Analysis of this protein sequence reveals the following:

```
Possible site: 13
>>> Seems to have no N-terminal signal sequence

----- Final Results -----
             bacterial cytoplasm --- Certainty = 0.1252 (Affirmative) < succ>
              bacterial membrane --- Certainty = 0.000  (Not Clear)   < succ>
               bacterial outside --- Certainty = 0.0000 (Not Clear)   < succ>
```

An alignment of the GAS and GBS proteins is shown below.

```
Identities = 217/296 (73%), Positives = 253/296 (85%)

Query:    1 MNIQQLRYVVAIANSGTFREAAAKLFVSQPSLSVAVRDLETELGFQIFTRTTTGAVLTNQ   60
            MNIQQLRYVVAIAN+GTFREAA+KLFVSQPSLSV+++DLE ELGFQIF RTT+G VLT+Q
Sbjct:    1 MNIQQLRYVVAIANNGTFREAASKLFVSQPSLSVSIKDLEAELGFQIFNRTTSGTVLTSQ   60

Query:   61 GMTFYENALEVVKSFDSFEKQFSQSEATEQEFSIASQHYDFLPPLITAFSKCNDNFSYFR  120
            G+ FYE ALEVVKSFDSFEK FSQ++  + EFSIASQHYDFLPPLITAFS+  D   FR
```

-continued

```
Sbjct:   61 GLVFYEKALEVVKSFDSFEKTFSQADLDQNEFSIASQHYDFLPPLITAFSQQYDGHRVFR  120

Query:  121 IFESTTIRILDEVAQGNSEIGIIYINSQNKKGLLQRLDKLGLEFVELIPFKTHIYLGKDH  180
            IFESTTI+ILDEVAQGNSEIGIIY+N  N+KGL QR+DKLGLE+V LIPF THIYL K H
Sbjct:  121 IFESTTIQILDEVAQGNSEIGIIYLNVDNQKGLFQRMDKLGLEYVSLIPFTTHIYLSKTH  180

Query:  181 PLASKTSLIMTDLEGLPTVRFTQDRDDYRYYSENFVEVLDSSVTYNVTDRATLNGILERT  240
            PLA++ +L + D++GLP VRFTQ+RD+Y YYSENFV+  +    YNV+DRATLNGILERT
Sbjct:  181 PLANREALYLNDIQGLPAVRFTQERDEYLYYSENFVDTSECPRIYNVSDRATLNGILERT  240

Query:  241 QAYATGSGFLDSRSVNGITVIPLEDHLDNQMIYIKRKDRNLSQMALKFVAVMEEYF      296
            A+ATGSGFLD RSVNGI VIPL DH+DNQMIY+KRKD+NLS    FV ++++YF
Sbjct:  241 NAFATGSGFLDHRSVNGIKVIPLADHIDNQMIYVKRKDKNLSVAGATFVTILKDYF      296
```

Based on this analysis, it was predicted that these proteins and their epitopes could be useful antigens for vaccines or diagnostics.

EXAMPLE 845

A DNA sequence (GBSx0897) was identified in *S. agalactiae* <SEQ ID 2553> which encodes the amino acid sequence <SEQ ID 2554>. This protein is predicted to be 50S ribosomal protein L27 (rpmA). Analysis of this protein sequence reveals the following:

```
Possible site: 36
>>> Seems to have no N-terminal signal sequence

----- Final Results -----
              bacterial cytoplasm --- Certainty = 0.0976 (Affirmative) < succ>
              bacterial membrane  --- Certainty = 0.0000 (Not Clear)   < succ>
              bacterial outside   --- Certainty = 0.0000 (Not Clear)   < succ>
```

The protein has homology with the following sequences in the GENPEPT database.

```
>GP: CAB14754 GB: Z99118 ribosomal protein L27 (BL24) [Bacillus subtilis]
Identities = 70/90 (77%), Positives = 80/90 (88%)

Query:    8 NLQLFAHKKGGGSTSNGRDSQAKRLGAKAADGQTVSGGSILYRQRGTHIYPGANVGRGGD   67
            +LQ FA KKG GST NGRDS+AKRLGAK ADGQ V+GGSILYRQRGT IYPG NVGRGGD
Sbjct:    5 DLQFFASKKGVGSTKNGRDSEAKRLGAKRADGQFVTGGSILYRQRGTKIYPGENVGRGGD   64

Query:   68 DTLFAKVEGVVRFERKGRDKKQVSVYPIAK                                97
            DTLFAK++G V+FER GRD+K+VSVYP+A+
Sbjct:   65 DTLFAKIDGTVKFERFGRDRKKVSVYPVAQ                                94
```

A related DNA sequence was identified in *S. pyogenes* <SEQ ID 2555> which encodes the amino acid sequence <SEQ ID 2556>. Analysis of this protein sequence reveals the following:

```
Possible site: 36
>>> Seems to have no N-terminal signal sequence

----- Final Results -----
              bacterial cytoplasm --- Certainty = 0.0976 (Affirmative) < succ>
              bacterial membrane  --- Certainty = 0.0000 (Not Clear)   < succ>
              bacterial outside   --- Certainty = 0.0000 (Not Clear)   < succ>
```

An alignment of the GAS and GBS proteins is shown below.

```
Identities = 95/97 (97%), Positives = 96/97 (98%)

Query:   1 MLKMNLANLQLFAHKKGGGSTSNGRDSQAKRLGAKAADGQTVSGGSILYRQRGTHIYPGA  60
           MLKMNLANLQLFAHKKGGGSTSNGRDSQAKRLGAKAADGQTVSGGSILYRQRGTHIYPG
Sbjct:   1 MLKMNLANLQLFAHKKGGGSTSNGRDSQAKRLGAKAADGQTVSGGSILYRQRGTHIYPGV  60

Query:  61 NVGRGGDDTLFAKVEGVVRFERKGRDKKQVSVYPIAK                         97
           NVGRGGDDTLFAKVEGVVRFERKGRDKKQVSVYP+AK
Sbjct:  61 NVGRGGDDTLFAKVEGVVRFERKGRDKKQVSVYPVAK                         97
```

Based on this analysis, it was predicted that these proteins and their epitopes could be useful antigens for vaccines or diagnostics.

EXAMPLE 846

A DNA sequence (GBSx0898) was identified in *S. agalactiae* <SEQ ID 2557> which encodes the amino acid sequence <SEQ ID 2558>. Analysis of this protein sequence reveals the following:

```
Possible site: 25
>>> Seems to have no N-terminal signal sequence
INTEGRAL Likelihood = -0.75 Transmembrane 32-48 (32-48)

----- Final Results -----
            bacterial membrane --- Certainty = 0.1298 (Affirmative) < succ>
             bacterial outside --- Certainty = 0.0000 (Not Clear)   < succ>
           bacterial cytoplasm --- Certainty = 0.0000 (Not Clear)   < succ>
```

The protein has homology with the following sequences in the GENPEPT database.

```
>GP: BAB06729 GB: AP001517 unknown conserved protein in B. subtilis
[Bacillus halodurans]
Identities = 33/107 (30%), Positives = 63/107 (58%), Gaps = 4/107 (3%)

Query:   1 MIKATFTRNQSGYLYSAEISGHAGSGEYGFDVICAAVSTLSINFINSLEALTTCQAQLII  60
           MI    F RN+    + S  +SGHA +G YG D++CA   S +++   +N++ AL   CQ +L+
Sbjct:   1 MIDVVFERNKQNDIVSFTMSGHADAGPYGQDLVCAGASAVALGTVNAIIAL--CQVELVT  58

Query:  61 N-DVEGGYMKIDL-SSIPQHKEDKVQLLFESYLLGMTNLSKDSSEFV              105
            10 + EGG+++  + + + +    KVQLL  E  + + ++++    E +
Sbjct:  59 EMENEGGFLRCRVPNDLEETTFEKVQLLLLEGMNISLQSIAESYGEHI              105
                                                            45
```

A related DNA sequence was identified in *S. pyogenes* <SEQ ID 2559> which encodes the amino acid sequence <SEQ ID 2560>. Analysis of this protein sequence reveals the following:

```
Possible site: 52
>>> Seems to have no N-terminal signal sequence
INTEGRAL Likelihood = -0.59 Transmembrane 32-48 (32-48)

----- Final Results -----
            bacterial membrane --- Certainty = 0.1235 (Affirmative) < succ>
             bacterial outside --- Certainty = 0.0000 (Not Clear)   < succ>
           bacterial cytoplasm --- Certainty = 0.0000 (Not Clear)   < succ>
```

The protein has homology with the following sequences in the databases:

```
>GP: BAB06729 GB: AP001517 unknown conserved protein in B. subtilis
[Bacillus halodurans]
Identities = 33/109 (30%), Positives = 60/109 (54%), Gaps = 4/109 (3%)
```

-continued
```
Query:   1  MIKAIFTRQKNGQLSSVTLTGHAGSGKHGFDIVCASVSTLAINFVNSLEVLADCQALVDL   60
            MI  +F R K    + S T++GHA +G +G D+VCA  S +A+  VN++  L   + + ++
Sbjct:   1  MIDVVFERNKQNDIVSFTMSGHADAGPYGQDLVCAGASAVALGTVNAIIALCQVELVTEM   60

Query:  61  NDVEGGYMAITIP---PHDNKEEVQLLFESFLLGMTSLAKDSSKFVNTQ           106
            + EGG++   +P           E+VQLL E  + + S+A+    + +  +
Sbjct:  61  EN-EGGFLRCRVPNDLEETTFEKVQLLLEGMNISLQSIAESYGEHIQIE            108
```

An alignment of the GAS and GBS proteins is shown below.

```
Identities = 67/110 (60%), Positives = 90/110 (80%), Gaps = 2/110 (1%)

Query:   1  MIKATFTRNQSGYLYSAEISGHAGSGEYGFDVICAAVSTLSINFINSLEALTTCQAQLII   60
            MIKA FTR ++G L S   ++GHAGSG++GFD++CA+VSTL+INF+NSLE L   CQA + +
Sbjct:   1  MIKAIFTRQKNGQLSSVTLTGHAGSGKHGFDIVCASVSTLAINFVNSLEVLADCQALVDL   60

Query:  61  NDVEGGYMKIDLSSIPQHKEDKVQLLFESYLLGMTNLSKDSSEFVSTVVM           110
            NDVEGGYM I +   P    +++VQLLFES+LLGMT+L+KDSS+FV+T V+
Sbjct:  61  NDVEGGYMAITIP--PHDNKEEVQLLFESFLLGMTSLAKDSSKFVNTQVI           108
```

Figure 78:
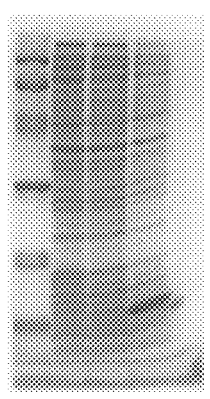

SEQ ID 2558 (GBS433) was expressed in *E. coli* as a His-fusion product. SDS-PAGE analysis of total cell extract is shown in FIG. 78 (lane 4; MW 16 kDa). It was also expressed in *E. coli* as a GST-fusion product. SDS-PAGE analysis of total cell extract is shown in FIG. 173 (lane 8; MW 41 kDa).

GBS433-GST was purified as shown in FIG. 223, lane 10.

Based on this analysis, it was predicted that these proteins and their epitopes could be useful antigens for vaccines or diagnostics.

EXAMPLE 847

A DNA sequence (GBSx0899) was identified in *S. agalactiae* <SEQ ID 2561> which encodes the amino acid sequence <SEQ ID 2562>. This protein is predicted to be ribosomal protein L21 (rplU). Analysis of this protein sequence reveals the following:

```
Possible site: 57
>>> Seems to have no N-terminal signal sequence

----- Final Results -----
              bacterial cytoplasm --- Certainty = 0.2972 (Affirmative) < succ>
              bacterial membrane  --- Certainty = 0.0000 (Not Clear)   < succ>
              bacterial outside   --- Certainty = 0.0000 (Not Clear)   < succ>
```

The protein has homology with the following sequences in the GENPEPT database.

```
>GP: CAB14756 GB: Z99118 ribosomal protein L21 (BL20) [Bacillus subtilis]
    Identities = 67/101 (66%), Positives = 78/101 (76%)

Query:   4  YAIIKTGGKQVKVEVGQAIYVEKLDVEAGAEVTFNEVVLVGGETTKVGTPVVEGATVVGT   63
            YAIIKTGGKQ+KVE GQ +Y+EKL   EAG   VTF +V+ VGG+   KVG P VEGATV
Sbjct:   2  YAIIKTGGKQIKVEEGQTVYIEKLAAEAGETVTFEDVLFVGGDNVKVGNPTVEGATVTAK   61

Query:  64  VEKQGKQKKVVSYKYKPKKGSHRKQGHRQPYTKVVINAINA                    104
            VEKQG+ KK+ ++YKPKK  H+KQGHRQPYTKV I INA
Sbjct:  62  VEKQGRAKKITVFRYKPKKNVHKKQGHRQPYTKVTIEKINA                    102
```

A related DNA sequence was identified in *S. pyogenes* <SEQ ID 2563> which encodes the amino acid sequence <SEQ ID 2564>. Analysis of this protein sequence reveals the following:

```
Possible site: 33
>>> Seems to have no N-terminal signal sequence

----- Final Results -----
              bacterial cytoplasm --- Certainty = 0.3026 (Affirmative) < succ>
              bacterial membrane  --- Certainty = 0.0000 (Not Clear)   < succ>
              bacterial outside   --- Certainty = 0.0000 (Not Clear)   < succ>
```

An alignment of the GAS and GBS proteins is shown below.

```
Identities = 97/104 (93%), Positives = 101/104 (96%)

Query:    1 MSTYAIIKTGGKQVKVEVGQAIYVEKLDVEAGAEVTFNEVVLVGGETTKVGTPVVEGATV    60
            MSTYAIIKTGGKQVKVEVGQAIYVEK+D EAGAEVTFNEVVLVGG+ T VGTPVVEGATV
Sbjct:    1 MSTYAIIKTGGKQVKVEVGQAIYVEKIDAEAGAEVTFNEVVLVGGDKTVVGTPVVEGATV    60

Query:   61 VGTVEKQGKQKKVVSYKYKPKKGSHRKQGHRQPYTKVVINAINA                   104
            VGTVEKQGKQKKVV++KYKPKKGSHRKQGHRQPYTKVVINAINA
Sbjct:   61 VGTVEKQGKQKKVVTFKYKPKKGSHRKQGHRQPYTKVVINAINA                   104
```

Based on this analysis, it was predicted that these proteins and their epitopes could be useful antigens for vaccines or diagnostics.

EXAMPLE 848

A DNA sequence (GBSx0900) was identified in *S. agalactiae* <SEQ ID 2565> which encodes the amino acid sequence <SEQ ID 2566>. Analysis of this protein sequence reveals the following:

```
Possible site: 16
>>> Seems to have no N-terminal signal sequence

----- Final Results -----
           bacterial cytoplasm --- Certainty = 0.1032 (Affirmative) < succ>
           bacterial membrane  --- Certainty = 0.0000 (Not Clear)   < succ>
            bacterial outside  --- Certainty = 0.0000 (Not Clear)   < succ>
```

A related GBS nucleic acid sequence <SEQ ID 9369> which encodes amino acid sequence <SEQ ID 9370> was also identified.

The protein has homology with the following sequences in the GENPEPT database.

```
>GP: CAB14809 GB: Z99118 excinuclease ABC (subunit C) [Bacillus subtilis]
Identities = 221/373 (59%), Positives = 288/373 (76%)

Query:    1 MKSAAMTMEFERAAEYRDLIEAISLLRTKQRVIHQDMKDRDVFGYFVDKGWMCVQVFFVR    60
            M  AA  +EFERA E RD I  I    KQ++   D+ DRDVF Y  DKGWMCVQVFF+R
Sbjct:  206 MHEAAENLEFERAKELRDQIAHIESTMEKQKMTMNDLVDRDVFAYAYDKGWMCVQVFFIR   265

Query:   61 NGKLIQRDVNMFPYYNEPEEDFLTYIGQFYQDTKHFLPKEVFIPQDIDAKSVETIVGCKI   120
            +GKLI+RDV+MFP Y E +E+FLT+IGQFY   HFLPKE+ +P  ID  +E ++    +
Sbjct:  266 QGKLIERDVSMFPLYQEADEEFLTFIGQFYSKNNHFLPKEILVPDSIDQSMIEQLLETNV   325

Query:  121 VKPQRGEKKQLVNLAIKNARVSLQQKFDLLEKDIRKTHGAIENLGNLLNIPKPVRIEAFD   180
            +P++G  KK+L+  LA  KNA+++L++KF  L+E+D   ++ GA++  LG   LNI  P RI AFD
Sbjct:  326 HQPKKGPKKELLMLAHKNAKIALKEKFSLIERDEERSIGAVQKLGEALNIYTPHRIVAFD   385

Query:  181 NSNIQGTSPVAAMVVFVNGKPSKKDYRKFKIKTVIGPDDYASMREVIHRRYSRVLKDGLT   240
            NSNIQGT+PV+AM+VF++GKP  KK+YRK+KIKTV GPDDY SMREV+ RRY+RVL++ L
Sbjct:  386 NSNIQGTNPVSAMIVFIDGKPYKKEYRKYKIKTVTGPDDYGSMREVVRRRYTRVLRENLP   445

Query:  241 PPDLIVIDGGQGQVNIARDVIENQFGLAIPIAGLQKNDKHQTHELLFGDPLEVVELPRNS   300
            PDLI+IDGG+GQ+N ARDVIEN+ GL IPIAGL K++KH+T  LL GDPLEV  L RNS
Sbjct:  446 LPDLIIIDGGKGQINAARDVIENELGLDIPIAGLAKDEKHRTSNLLIGDPLEVAYLERNS   505

Query:  301 EEFFLLHRIQDEVHRFAITFHRQLRSKNSFSSKLDGITGLGPKRKQLLMKHFKSLPNIQK   360
            +EF+LL RIQDEVHRFAI+FHRQ+R   K++F S  LD I G+G  KRK++L+KHF S+   +++
Sbjct:  506 QEFYLLQRIQDEVHRFAISFHRQIRGKSAFQSVLDDIPGIGEKRKKMLLKHFGSVKKMKE   565

Query:  361 AEIEDIIMCGIPR                                                 373
            A +EDI   G+P+
Sbjct:  566 ASLEDIKKAGVPQ                                                 578
```

A related DNA sequence was identified in *S. pyogenes* <SEQ ID 2567> which encodes the amino acid sequence <SEQ ID 2568>. Analysis of this protein sequence reveals the following:

```
Possible site: 53
>>> Seems to have no N-terminal signal sequence

----- Final Results -----
            bacterial cytoplasm --- Certainty = 0.4332 (Affirmative) < succ>
            bacterial membrane  --- Certainty = 0.0000 (Not Clear)   < succ>
            bacterial outside   --- Certainty = 0.0000 (Not Clear)   < succ>
```

An alignment of the GAS and GBS proteins is shown below.

```
Identities = 289/385 (75%), Positives = 334/385 (86%)

Query:    1 MKSAAMTMEFERAAEYRDLIEAISLLRTKQRVIHQDMKDRDVFGYFVDKGWMCVQVFFVR    60
            M +A+  M FERAAEYRDLI  I+ +RTKQRV+ +D++DRD+FGY+VDKGWMCVQVFFVR
Sbjct:  206 MLAASKEMAFERAAEYRDLISGIATMRTKQRVMSKDLQDRDIFGYYVDKGWMCVQVFFVR   265

Query:   61 NGKLIQRDVNMFPYYNEPEEDFLTYIGQFYQDTKHFLPKEVFIPQDIDAKSVETIVGCKI   120
             GKLIQRDVN+FPYY + EEDFLTY+GQFYQD +HF+PKEVFIP+ ID + V   IV  RI
Sbjct:  266 QGKLIQRDVNLFPYYTDAEEDFLTYMGQFYQDKQHFIPKEVFIPEAIDEELVAAIVPTKI   325

Query:  121 VKPQRGEKKQLVNLAIKNARVSLQQKFDLLEKDIRKTHGAIENLGNLLNIPKPVRIEAFD   180
            +KP+RGEKKQLV LA KNARVSLQQKFDLLEKDI+KT GAIENLG LL I KPVRIEAFD
Sbjct:  326 IKPKRGEKKQLVALATKNARVSLQQKFDLLEKDIKKTSGAIENLGQLLRIDKPVRIEAFD   385

Query:  181 NSNIQGTSPVAAMVVFVNGKPSKKDYRKFKIKTVIGPDDYASMREVIHRRYSRVLKDGLT   240
            NSNIQGTSPVAAMVVFV+GKPSKKDYRKFKIKTV+GPDDYASMREV+ RRYSRV K+GL
Sbjct:  386 NSNIQGTSPVAAMVVFVDGKPSKKDYRKFKIKTVVGPDDYASMREVLFRRYSRVKKEGLQ   445

Query:  241 PPDLIVIDGGQGQVNIARDVIENQFGLAIPIAGLQKNDKHQTHELLFGDPLEVVELPRNS   300
             P+LI++DGG GQVN+A+DVIE Q GL IP+AGLQKNDKHQTH+LLFG+PLEVV LPR S
Sbjct:  446 APNLIIVDGGVGQVNVAKDVIEKQLGLTIPVAGLQKNDKHQTHDLLFGNPLEVVPLPRRS   505

Query:  301 EEFFLLHRIQDEVHRFAITFHRQLRSKNSFSSKLDGITGLGPKRKQLLMKHFKSLPNIQK   360
            EEFFLLHRIQDEVHRFA+TFHRQ+R KNSFSS LD I+GLGPKRKQLL++HFK++  I
Sbjct:  506 EEFFLLHRIQDEVHRFAVTFHRQVRRKNSFSSTLDHISGLGPKRKQLLLRHFKTITAIAS   565

Query:  361 AEIEDIIMCGIPRTVAESLRDSLND                                     385
            A E+I   GIP+TV E+++  + D
Sbjct:  566 ATSEEIQALGIPKTVVEAIQQQITD                                     590
```

Based on this analysis, it was predicted that these proteins and their epitopes could be useful antigens for vaccines or diagnostics.

EXAMPLE 849

A DNA sequence (GBSx0901) was identified in *S. agalactiae* <SEQ ID 2569> which encodes the amino acid sequence <SEQ ID 2570>. Analysis of this protein sequence reveals the following:

```
Possible site: 16
>>> Seems to have no N-terminal signal sequence

----- Final Results -----
            bacterial cytoplasm --- Certainty = 0.2491 (Affirmative) < succ>
            bacterial membrane  --- Certainty = 0.0000 (Not Clear)   < succ>
            bacterial outside   --- Certainty = 0.0000 (Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 850

A DNA sequence (GBSx0902) was identified in *S. agalactiae* <SEQ ID 2571> which encodes the amino acid sequence <SEQ ID 2572>. Analysis of this protein sequence reveals the following:

```
Possible site: 55
>>> Seems to have no N-terminal signal sequence

----- Final Results -----
            bacterial cytoplasm --- Certainty = 0.3349 (Affirmative) < succ>
            bacterial membrane  --- Certainty = 0.0000 (Not Clear)   < succ>
             bacterial outside  --- Certainty = 0.0000 (Not Clear)   < succ>
```

The protein has homology with the following sequences in the GENPEPT database.

```
>GP: BAA86651 GB: AB033763 glycerophosphoryl diester phosphodiesterase
homologue [Staphylococcus aureus]
Identities = 50/202 (24%), Positives = 96/202 (46%), Gaps = 15/202 (7%)

Query:    1 MDVIMTKDHKLVVIHDDNLKRLSGMNKDVSKLTLDQVTKIPIHQ---GRFA-SHIPSFTE    56
            +DV +TKD +L++IHDD L+R + M+ ++++L  D++         +F  H+P+F +
Sbjct:   36 LDVAITKDEQLIIIHDDYLERTTNMSGEITELNYDEIKDASAGSWFGEKFKDEHLPTFDD   95

Query:   57 FMKTAQSLDQKIMIELKPY-NQNLDIYADEFIKEFKE----LRLSTKHKVMSLNLTLIEK  111
            +K A  + + +ELK    N    +K+ +E    L + +   S N+ L++
Sbjct:   96 VVKIANEYNMNLNVELKGITGPNGLALSKSMVKQVEEQLTNLNQNQEVLISSFNVVLVKL  155

Query:  112 VEKKLPQLDTGYLIPL-----HWGTLQNH-NVDFYGIEEFSYNDWIAYLAQEYNKQLYVW  165
            E+ +PQ +  +        W TL ++ N        E+      + +E   +L VW
Sbjct:  156 AEEIMPQYNRAVIFHTTSFREDWRTLLDYCNAKIVNTEDAKLTKAKVKMVKEAGYELNVW  215

Query:  166 TINRDNLMIRYLQSPVNGIITD                                       187
            T+N+ +    V+GI TD
Sbjct:  216 TVNKPARANQLANWGVDGIFTD                                       237
```

A related DNA sequence was identified in *S. pyogenes* <SEQ ID 2573> which encodes the amino acid sequence <SEQ ID 2574>. Analysis of this protein sequence reveals the following:

```
Possible site: 36
>>> Seems to have no N-terminal signal sequence
INTEGRAL Likelihood = -12.26  Transmembrane 239-255 (227-260)
INTEGRAL Likelihood =  -9.45  Transmembrane  80-96  (78-108)
INTEGRAL Likelihood =  -9.13  Transmembrane 137-153 (131-160)
INTEGRAL Likelihood =  -4.94  Transmembrane 278-294 (277-295)
INTEGRAL Likelihood =  -3.56  Transmembrane  36-52  (33-55)
INTEGRAL Likelihood =  -3.56  Transmembrane 188-204 (185-206)
INTEGRAL Likelihood =  -3.35  Transmembrane 314-330 (310-331)

----- Final Results -----
            bacterial membrane  --- Certainty = 0.5904 (Affirmative) < succ>
             bacterial outside  --- Certainty = 0.0000 (Not Clear)   < succ>
            bacterial cytoplasm --- Certainty = 0.0000 (Not Clear)   < succ>
```

The protein has homology with the following sequences in the databases:

```
>GP: CAB12801 GB: Z99109 similar to glycerophosphodiester
phosphodiesterase [Bacillus subtilis]
Identities = 67/244 (27%), Positives = 110/244 (44%), Gaps = 14/244 (5%)

Query:  344 VIAHRGLVSAGVENSLEALEGAKKAGSDYVELDLILTKDNHFVVSHDNRLKRLAGVNKTI  403
            +IAHRG     EN++ A + A K  +D +ELD+ LTKD   VV HD+R+ R    +  +
Sbjct:    3 IIAHRGASGYAPENTIAAFDLAVKMNADMIELDVQLTKDRQIVVIHDDRVDRTTNGSGFV   62

Query:  404 RNLTLKEVEHLTSHQGH---FSGRFVSFDTFYQKAKKLNMPLLIELKPIGTEPGNYVDLF  460
            ++ TL+E++ L +  +    F G +        K    + LLIELK    ++ G    ++
Sbjct:   63 KDFTLEELQKLDAGSWYGPAFQGERIPTLEAVLKRYHKKIGLLIELKGHPSQVGIEEEVG  122

Query:  461 LETYHRLGISKDNKVMSLDLEVIEAIKKKNPSITTGYIIPIQFGFFG-------DEFVDF  513
            +   +    S +N V S      ++ ++ PSI T  I      FG             F ++
Sbjct:  123 -QLLGQFSFSINNIVQSFQFRSVQRFRELYPSIPTAVITRPNFGMLSRNQMKAFRSFANY  181

Query:  514 YVIEDFSYRSYLSSQAFWNNKEIYVWTINDPKRIEHYLLKPIQGIITDQPALTNQLIKDL  573
            ++          I+         +    N   I+ WT+N+ K         + GI+TD P    + +IKD
Sbjct:  182 VNIKHTRLNRLMIGSINKNGLNIFAWTVNNQKTAAKLQAMGVDGIVTDYP---DFIIKDG  238

Query:  574 KQDN                                                          577
            K +N
Sbjct:  239 KHEN                                                          242
```

An alignment of the GAS and GBS proteins is shown below.

```
Identities = 90/215 (41%), Positives = 136/215 (62%)

Query:    1 MDVIMTKDHKLVVIHDDNLKRLSGMNKDVSKLTLDQVTKIPIHQGRFASHIPSFTEFMKT   60
            +D+I+TKD+  VV HD+ LKRL+G+NK +   LTL +V  + HQG F+     SF  F +
Sbjct:  375 LDLILTKDNHFVVSHDNRLKRLAGVNKTIRNLTLKEVEHLTSHQGHFSGRFVSFDTFYQK  434

Query:   61 AQSLDQKIMIELKPYNQNLDIYADEFIKEFKELRLSTKHKVMSLNLTLIEKVEKKLPQLD  120
            A+ L+  ++IELKP      Y D F++ +   L +S  +KVMSL+L +IE ++KK P  +
Sbjct:  435 AKKLNMPLLIELKPIGTEPGNYVDLFLETYHRLGISKDNKVMSLDLEVIEAIKKKNPSIT  494

Query:  121 TGYLIPLHWGTLQNHNVDFYGIEEFSYNDWIAYLAQEYNKQLYVWTINRDNLMIRYLQSP  180
            TGY+IP+ +G  +   VDFY IE+FSY +++  A    NK++YVWTIN    + YL  P
Sbjct:  495 TGYIIPIQFGFFGDEFVDFYVIEDFSYRSYLSSQAFWNNKEIYVWTINDPKRIEHYLLKP  554

Query:  181 VNGIITDELNLFKVINKDIKNSPNYYQRALQLIDS                           215
            + GIITD+ L   +KD+K  +Y+ R +++I S
Sbjct:  555 IQGIITDQPALTNQLIKDLKQDNSYFSRLVRIISS                           589
```

Based on this analysis, it was predicted that these proteins and their epitopes could be useful antigens for vaccines or diagnostics.

EXAMPLE 851

A DNA sequence (GBSx0903) was identified in *S. agalactiae* <SEQ ID 2575> which encodes the amino acid sequence <SEQ ID 2576>. Analysis of this protein sequence reveals the following:

```
Possible site: 53
>>> Seems to have no N-terminal signal sequence
INTEGRAL Likelihood = -15.02 Transmembrane  84-100 (76-112)
INTEGRAL Likelihood =  -3.50 Transmembrane 139-155 (139-157)
INTEGRAL Likelihood =  -2.23 Transmembrane  41-57 (39-59)
INTEGRAL Likelihood =  -0.96 Transmembrane 179-195 (179-195)

----- Final Results -----
              bacterial membrane  --- Certainty = 0.7007 (Affirmative) < succ>
               bacterial outside  --- Certainty = 0.0000 (Not Clear)  < succ>
             bacterial cytoplasm  --- Certainty = 0.0000 (Not Clear)  < succ>
```

A related GBS nucleic acid sequence <SEQ ID 9901> which encodes amino acid sequence <SEQ ID 9902> was also identified.

The protein has no significant homology with any sequences in the GENPEPT database, but there is homology to SEQ ID 2574.

A related GBS gene <SEQ ID 8671> and protein <SEQ ID 8672> were also identified. Analysis of this protein sequence reveals the following:

```
Lipop: Possible site: -1 Crend: 10
McG: Discrim Score: -3.38
GvH: Signal Score (-7.5): -4.08
Possible site: 53
>>> Seems to have no N-terminal signal sequence
ALOM program count: 4 value: -15.02 threshold: 0.0
INTEGRAL Likelihood = -15.02 Transmembrane  84-100 (76-112)
INTEGRAL Likelihood =  -3.50 Transmembrane 139-155 (139-157)
INTEGRAL Likelihood =  -2.23 Transmembrane  41-57  (39-59)
INTEGRAL Likelihood =  -0.96 Transmembrane 179-195 (179-195)
PERIPHERAL Likelihood = 2.01  104
modified ALOM score: 3.50

*** Reasoning Step: 3

----- Final Results -----
         bacterial membrane  --- Certainty = 0.7007 (Affirmative) < succ>
         bacterial outside   --- Certainty = 0.0000 (Not Clear)   < succ>
         bacterial cytoplasm --- Certainty = 0.0000 (Not Clear)   < succ>
```

Based on this analysis, it was predicted that these proteins and their epitopes could be useful antigens for vaccines or diagnostics.

EXAMPLE 852

A DNA sequence (GBSx0904) was identified in *S. agalactiae* <SEQ ID 2577> which encodes the amino acid sequence <SEQ ID 2578>. Analysis of this protein sequence reveals the following:

```
Possible site: 61
>>> Seems to have no N-terminal signal sequence

----- Final Results -----
         bacterial cytoplasm --- Certainty = 0.4150 (Affirmative) < succ>
         bacterial membrane  --- Certainty = 0.0000 (Not Clear)   < succ>
         bacterial outside   --- Certainty = 0.0000 (Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 853

A DNA sequence (GBSx0905) was identified in *S. agalactiae* <SEQ ID 2579> which encodes the amino acid sequence <SEQ ID 2580>. Analysis of this protein sequence reveals the following:

```
Possible site: 13
>>> Seems to have no N-terminal signal sequence
INTEGRAL Likelihood = -0.32 Transmembrane 2-18 (2-18)
```

```
----- Final Results -----
          bacterial membrane --- Certainty = 0.1128 (Affirmative) < succ>
           bacterial outside --- Certainty = 0.0000 (Not Clear)  < succ>
          bacterial cytoplasm --- Certainty = 0.0000 (Not Clear)  < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 854

A DNA sequence (GBSx0906) was identified in *S. agalactiae* <SEQ ID 2581> which encodes the amino acid sequence <SEQ ID 2582>. This protein is predicted to be nad(p)h nitroreductase ydgi. Analysis of this protein sequence reveals the following:

```
Possible site: 38
>>> Seems to have no N-terminal signal sequence
INTEGRAL Likelihood = -1.81 Transmembrane 127-143 (126-143)

----- Final Results -----
          bacterial membrane --- Certainty = 0.1723 (Affirmative) < succ>
           bacterial outside --- Certainty = 0.0000 (Not Clear)  < succ>
          bacterial cytoplasm --- Certainty = 0.0000 (Not Clear)  < succ>
```

The protein has homology with the following sequences in the GENPEPT database.

```
>GP: CAC09964 GB: AX033132 unnamed protein product [Bacillus subtilis]
Identities = 62/204 (30%), Positives = 106/204 (51%), Gaps = 11/204 (5%)

Query:    3 FLELNKKRHAVKHFNDKPVDFKDVRTAI-EIATLAPSANNIQPWKFVVVQ--EKKSALAE    59
            F+E+ K R ++++++    K+  T I E AT APS+ N QPW+F+V+   E K  LA
Sbjct:    7 FMEIMKGRRSIRNYDPAVKISKEEMTEILEEATTAPSSVNAQPWRFLVIDSPEGKEKLAP   66

Query:   60 GLPESNCNQINQAQYVIALFTDTD----LGQRSRKIARIGRRSLPDDLIGYYMETLPPRY  115
            L   N  Q+  +  VIA+F D +     L+    K  +G   +P ++    + L   +
Sbjct:   67 -LASFNQTQVTTSSAVIAVFADMNNADYLEEIYSKAVELG--YMPQEVKDRQIAALTAHF  123

Query:  116 ALYSEKQTGEYLSLNAGIVAMNLVLALTDQGISSNMILGFDKAITNDVLEIDK-RFRPEI  174
              +    E + ++ G+V+M L+L       G  +N I G+DK    +DK R+ P +
Sbjct:  124 EKLPAQVNRETILIDGGLVSMQLMLTARAHGYDTNPIGGYDKENIAETFGLDKERYVPVM  183

Query:  175 LITVGYSDEKVEPSYRLPVDHIIE                                     198
            L+++G + ++     SYRLP+D I E
Sbjct:  184 LLSIGKAADEGYASYRLPIDTIAE                                     207
```

A related DNA sequence was identified in *S. pyogenes* <SEQ ID 2583> which encodes the amino acid sequence <SEQ ID 2584>. Analysis of this protein sequence reveals the following:

```
    Possible site: 38
>>> Seems to have no N-terminal signal sequence
   INTEGRAL    Likelihood = -2.18   Transmembrane  127-143 (126-143)

----- Final Results -----
          bacterial membrane --- Certainty = 0.1871 (Affirmative) < succ>
           bacterial outside --- Certainty = 0.0000 (Not Clear)  < succ>
          bacterial cytoplasm --- Certainty = 0.0000 (Not Clear)  < succ>
```

The protein has homology with the following sequences in the databases:

```
>GP:CAC09964 GB:AX033132 unnamed protein product [Bacillus subtilis]
Identities = 63/204 (30%), Positives = 109/204 (52%), Gaps = 11/204 (5%)

Query:     3 FLELNKKRHAIKTFNDQ-PVDYEDLRTAIEIATLAPSANNIQPWKFVVVQ--EKKAELAK    59
             F+E+ K R +I+ ++    +  E++   +E AT APS+ N QPW+F+V+    E K +LA
Sbjct:     7 FMEIMKGRRSIRNYDPAVKISKEEMTEILEEATTAPSSVNAQPWRFLVIDSPEGKEKLA-   65

Query:    60 GLPLA--NKVQVEQAQYVVALFSDTDLALRSRKIARIGVK--SLPDDLIGYYMETLPPRF  115
                PLA  N+ QV  +  V+A+F+D + A    +I     V+   +P ++    + L    F
Sbjct:    66 --PLASFNQTQVTTSSAVIAVFADMNNADYLEEIYSKAVELGYMPQEVKDRQIAALTAHF  123

Query:   116 AAFNEVQTGEYLAINAGIVAMNLVLSLTDQKIASNIILGFDKSTTNEILDID-PRFRPEL  174
                       E + I+ G+V+M L+L+       +N I G+DK     E    +D  R+ P +
Sbjct:   124 EKLPAQVNRETILIDGGLVSMQLMLTARAHGYDTNPIGGYDKENIAETFGLDKERYVPVM  183

Query:   175 LITVGYSDEKPEPSYRLPVDEVIE                                     198
             L+++G + ++    SYRLP+D + E
Sbjct:   184 LLSIGKAADEGYASYRLPIDTIAE                                     207
```

An alignment of the GAS and GBS proteins is shown below.

```
Identities = 157/200 (78%), Positives = 184/200 (91%)

Query:     1 MKFLELNKKRHAVKHFNDKPVDFKDVRTAIEIATLAPSANNIQPWKFVVVQEKKSALAEG   60
               MKFLELNKKRHA+K FND+PVD++D+RTAIEIATLAPSANNIQPWKFVVVQEKK+ LA+G
Sbjct:     1 MKFLELNKKRHAIKTFNDQPVDYEDLRTAIEIATLAPSANNIQPWKFVVVQEKKAELAKG   60

Query:    61 LPESNCNQINQAQYVIALFTDTDLGQRSRKIARIGRRSLPDDLIGYYMETLPPRYALYSE  120
               LP +N  Q+ QAQYV+ALF+DTDL  RSRKIARIG +SLPDDLIGYYMETLPPR+A ++E
Sbjct:    61 LPLANKVQVEQAQYVVALFSDTDLALRSRKIARIGVKSLPDDLIGYYMETLPPRFAAFNE  120

Query:   121 KQTGEYLSLNAGIVAMNLVLALTDQGISSNMILGFDKAITNDVLEIDKRFRPEILITVGY  180
               QTGEYL++NAGIVAMNLVL+LTDQ I+SN+ILGFDK+ TN++L+ID RFRPE+LITVGY
Sbjct:   121 VQTGEYLAINAGIVAMNLVLSLTDQKIASNIILGFDKSTTNEILDIDPRFRPELLITVGY  180

Query:   181 SDEKVEPSYRLPVDHIIEKR                                         200
               SDEK EPSYRLPVD +IE+R
Sbjct:   181 SDEKPEPSYRLPVDEVIERR                                         200
```

Based on this analysis, it was predicted that these proteins and their epitopes could be useful antigens for vaccines or diagnostics.

EXAMPLE 855

A DNA sequence (GBSx0907) was identified in *S. agalactiae* <SEQ ID 2585> which encodes the amino acid sequence <SEQ ID 2586>. Analysis of this protein sequence reveals the following:

```
Possible site: 37

>>> Seems to have no N-terminal signal sequence

----- Final Results -----
           bacterial cytoplasm --- Certainty = 0.2895 (Affirmative) < succ>
            bacterial membrane --- Certainty = 0.0000 (Not Clear)   < succ> bacterial outside --- Certainty = 0.0000 (Not Clear)   < succ>
```

The protein has homology with the following sequences in the GENPEPT database.

```
>GP:AAC45369 GB:U78036 dipeptidase [Lactococcus lactis]
Identities = 312/474 (65%), Positives = 370/474 (77%), Gaps = 11/474 (2%)

Query:    2 TIDFRAEVDKRKDAIMDDLINLLRINSERDDSQADAEHPFGPGPVKALEFFLEMAERDGY    61
            TIDF+AEV+KRKDALM+DL +LLRI+S  D   ADAE+PFGPGP KAL+ FL++AERDGY
Sbjct:    3 TIDFKAEVEKRKDALMEDLFSLLRIDSAMDMEHADAENPFGPGPRKALDAFLKIAERDGY    62

Query:   62 ETKNVDNYAGHFTFGQGE----EELGIFGHLDVVPAGSGWDTDPYEPVIKDNRLYARGSS   117
            TKN DNY GHF +  G      E LGI GHLDVVPAGSGWD++P+EP I++  LYARG+S
Sbjct:   63 TTKNYDNYVGHFEYENGANADAEVLGIIGHLDVVPAGSGWDSNPFEPEIRNGNLYARGAS   122

Query:  118 DDKGPTMACYYALKIIKELGLPTSKKVRFVVGTDEESGWGDMDYYFEHVGLPKPDFGFSP   177
            DDKGPT+ACYYALKI+KEL LP SKK+RF+VGT+EE+GW DMDYYFEH  LP PDFGFSP
Sbjct:  123 DDKGPTVACYYALKILKELNLPLSKKIRFIVGTNEETGWADMDYYFEHCELPLPDFGFSP   182

Query:  178 DAEFPIINGEKGNITEYLHFSGENKGAVRLHSFSGGLRENMVPESATARFTSHLDQTTLG   237
            DAEFPIINGEKGNITEYLHFSG+N G V LHSF  GL ENMVPESATA  +   D   L
Sbjct:  183 DAEFPIINGEKGNITEYLHFSGKNAGQVVLHSFKAGLAENMVPESATAVISGAKD---LE   239

Query:  238 ASLADFASKH---NLKAELSVEDEQYTATVYGKSAHGSTPQEGVNGATYLALYLSQFDFE   294
            A+L  F ++H   NL+ +L    D + T T+YGKSAHG+ P++G+NGATYL L+L+QFDF
Sbjct:  240 AALEKFVAEHASKNLRFDLEEADGKATITLYGKSAHGAMPEKGINGATYLTLFLNQFDFA   299

Query:  295 GPARAFLDVTANIIHEDFSGEKLGVAYEDDCMGPLSMNAGVFQFDETNDDNTIALNFRYP   354
             A AF+ V A  + ED  GEKLG A+ D+ M   SMNAGV+ FDE N +  IALNFR+P
Sbjct:  300 DGAAAFIKVGAEKLLEDHEGEKLGTAFVDELMENTSMNAGVWSFDE-NGEGKIALNFRFP   358

Query:  355 QGTDAKTIQTKLEKLNGVEKVTLSDHEHTPHYVPMDDELVSTLLAVYEKQTGLKGHEQVI   414
            QG   + +Q  L KL+GV +V LS H HTPHYVPM D LVSTL+ VYEK TGLKG+E +I
Sbjct:  359 QGNSPERMQEILAKLDGVVEVELSKHLHTPHYVPMSDPLVSTLIDVYEKHTGLKGYETII   418

Query:  415 GGGTFGRLLERGVAYGAMFPGDENTMHQANEYMPLENIFRSAAIYAEAIYELIK         468
            GGGTFGRLLERGVAYGAMF G+  ++MHQANE   P+ENI+++A IYAEAIYEL K
Sbjct:  419 GGGTFGRLLERGVAYGAMFEGEPDSMHQANEMKPVENIYKAAVIYAEAIYELAK         472
```

A related DNA sequence was identified in *S. pyogenes* <SEQ ID 2587> which encodes the amino acid sequence <SEQ ID 2588>. Analysis of this protein sequence reveals the following:

```
Possible site: 14
>>> Seems to have no N-terminal signal sequence

----- Final Results -----
            bacterial cytoplasm --- Certainty = 0.3107 (Affirmative) < succ>
            bacterial membrane  --- Certainty = 0.0000 (Not Clear)   < succ>
            bacterial outside   --- Certainty = 0.0000 (Not Clear)   < succ>
```

An alignment of the GAS and GBS proteins is shown below.

```
Identities = 361/467 (77%), Positives = 403/467 (85%)

Query:    2 TIDFRAEVDKRKDALMDDLINLLRINSERDDSQADAEHPFGPGPVKALEFFLEMAERDGY    61
            TIDF+AEVDKRK A++ DL++LLRINSERDD  AD +HPFGPGPVKALE FL MAERDGY
Sbjct:   20 TIDFKAEVDKRKKAMLADLVDLLRINSERDDQLADDKHPFGPGPVKALEHFLAMAERDGY    79

Query:   62 ETKNVDNYAGHFTFGQGEEELGIFGHLDVVPAGSGWDTDPYEPVIKDNRLYARGSSDDKG   121
            +T+N+DNYAG F FGQG+E LGIFGHLDVVPAGSGWDTDPYEPVIKD+R+YARGSSDDKG
Sbjct:   80 KTRNIDNYAGDFEFGQGDEVLGIFGHLDVVPAGSGWDTDPYEPVIKDDRIYARGSSDDKG   139

Query:  122 PTMACYYALKIIKELGLPTSKKVRFVVGTDEESGWGDMDYYFEHVGLPKPDFGFSPDAEF   181
            PTMACYYALKIIKELGLP SKKVRF+VGTDEESGWGDMDYYF H GL  FDFGFSPDAEF
Sbjct:  140 PTMACYYALKIIKELGLPVSKKVRFIVGTDEESGWGDMDYYFAHNGLKNPDFGFSPDAEF   199

Query:  182 PIINGEKGNITEYLHFSGENKGAVRLHSFSGGLRENMVPESATARFTSHLDQTTLGASLA   241
            PIINGEKGNITEYLHF+G+NKGA  LH F GGLRENMVPESATA  T+  D   L A+L
Sbjct:  200 PIINGEKGNITEYLHFAGDNKGAFVLHRFQGGLRENMVPESATAVITAPHDLDVLEAALE   259

Query:  242 DFASKHNLKAELSVEDEQYTATVYGKSAHGSTPQEGVNGATYLALYLSQFDFEGPARAFL   301
            F S+H +K   +  D +  T+ GKSAHGSTP+ GVNGAT LA L+QF FEG A+ +L
```

```
                               -continued
Sbjct: 260 QFLSEHGVKGSMKATDGKIEVTIIGKSAHGSTPEAGVNGATLLAKFLNQFTFEGAAKDYL 319

Query: 302 DVTANIIHEDFSGEKLGVAYEDDCMGPLSMNAGVFQFDETNDDNTIALNFRYPQGTDAKT 361
              V   ++HEDF+ EKLG+AY DD MG LSMNAGVF FD  + DNTIALNFRYP+GTDA T
Sbjct: 320 HVAGEVLHEDFAAEKLGLAYTDDRMGALSMNAGVFTFDSQSADNTIALNFRYPKGTDAAT 379

Query: 362 IQTKLEKLNGVERVTLSDHEHTPHYVPMDDELVSTLLAVYEKQTGLKGHEQVIGGGTFGR 421
              ++  LEKL G+ KV+LS+HEHTPHYVPMDDELV+TLLAVYEKQTGLKG+EQVIGGGTFGR
Sbjct: 380 LKAGLEKLPGLTKVSLSEHEHTPHYVPMDDELVATLLAVYEKQTGLKGYEQVIGGGTFGR 439

Query: 422 LLERGVAYGAMFPGDENTMHQANEYMPLENIFRSAAIYAEAIYELIK              468
              LLERGVA+GAMFPGDENTMHQANEYMPLENI+RSAAIYAEAIYELIK
Sbjct: 440 LLERGVAFGAMFPGDENTMHQANEYMPLENIYRSAAIYAEAIYELIK              486
```

Based on this analysis, it was predicted that these proteins and their epitopes could be useful antigens for vaccines or diagnostics.

EXAMPLE 856

A DNA sequence (GBSx0908) was identified in *S. agalactiae* <SEQ ID 2589> which encodes the amino acid sequence <SEQ ID 2590>. Analysis of this protein sequence reveals the following:

```
Possible site: 30
>>> Seems to have no N-terminal signal sequence

----- Final Results -----
             bacterial cytoplasm --- Certainty = 0.5598 (Affirmative) < succ>
             bacterial membrane  --- Certainty = 0.0000 (Not Clear)   < succ>
              bacterial outside  --- Certainty = 0.0000 (Not Clear)   < succ>
```

The protein has homology with the following sequences in the GENPEPT database.

```
>GP:AAC21888 GB:U32707 H. influenzae predicted coding region
HI0220.2 [Haemophilus influenzae Rd]
Identities = 123/192 (64%), Positives = 160/192 (83%), Gaps = 1/192 (0%)

Query:   1 MTDLEKIIKAIKSDSQNQNYTENGIDPLFAAPKTARINIVGQAPGLKTQEARLYWKDKSG  60
             + +L++I   +I  +D QN+++TE GI PLF+APKTARINIVGQAPGLK +++RLYW DKSG
Sbjct:  21 LKNLDEITSSIIADPQNKDFTERGIFPLFSAPKTARINIVGQAPGLKAEQSRLYWNDKSG  80

Query:  61 DRLRQWLGVDEETFYHSGKFAVLPLDFYYPGKGKSGDLSPRKGFAEKWHPLILKEMPNVQ 120
             DRLR+WLGVD + FY+SG FAVLP+DFYYPG GKSGDL PR+GFAE+WHP+IL  +PN+Q
Sbjct:  81 DRLREWLGVDYDYFYNSGIFAVLPMDFYYPGYGKSGDLPPRQGFAERWHPMILGNLPNIQ 140

Query: 121 LTLLVGQYTQKYYLGSSAHKNLTETVKAYKDYLPDYLPLVHPSPRNQIWLKKNPWFEKDL 180
             LT+L+GQY QKYYL    +  N+T TVK Y+ +LP ++PLVHPSPRNQ+W+ KNPWFE+ +
Sbjct: 141 LTILIGQYAQKYYLPEN-KDNVTNTVKNYRQFLPHFMPLVHPSPRNQLWVTKNPWFEEQV 199

Query: 181 IVDLQKIVADIL                                                 192
             I +LQ +V  I+
Sbjct: 200 IPELQILVKQII                                                 211
```

A related DNA sequence was identified in *S. pyogenes* <SEQ ID 2591> which encodes the amino acid sequence <SEQ ID 2592>. Analysis of this protein sequence reveals the following:

```
Possible site: 47
>>> Seems to have no N-terminal signal sequence

----- Final Results -----
             bacterial cytoplasm --- Certainty = 0.3740 (Affirmative) < succ>
             bacterial membrane  --- Certainty = 0.0000 (Not Clear)   < succ>
              bacterial outside  --- Certainty = 0.0000 (Not Clear)   < succ>
```

An alignment of the GAS and GBS proteins is shown below.

```
Identities = 122/189 (64%), Positives = 150/189 (78%)

Query:    4 LEKIIKAIKSDSQNQNYTENGIDPLFAAPKTARINIVGQAPGLKTQEARLYWKDKSGDRL   63
            ++ + KAI +D  N +YTE GI PL+ AP+TARI IVGQAPG+  Q  +LYW D+SG RL
Sbjct:    1 MDDLTKAIMADEANLSYTERGIFPLYDAPQTARIIIVGQAPGIVAQGTKLYWNDRSGIRL   60

Query:   64 RQWLGVDEETFYHSGKFAVLPLDFYYPGKGKSGDLSPRKGFAEKWHPLILKEMPNVQLTL  123
            R WLGVD +TFYHSG F ++P+DFYYPGKGKSGDL PR+GFA KWHP +   MP V+LT+
Sbjct:   61 RDWLGVDNDTFYHSGLFGIIPMDFYYPGKGKSGDLPPREGFAAKWHPPLRALMPEVELTI  120

Query:  124 LVGQYTQKYYLGSSAHKNLTETVKAYKDYLPDYLPLVHPSPRNQIWLKKNPWFEKDLIVD  183
            LVG+Y Q +YLG+ A+K LTETV+ ++DYLPDY PLVHPSPRNQ+WL KNPWFE+DL+
Sbjct:  121 LVGRYAQDFYLGNKAYKTLTETVRHFEDYLPDYFPLVHPSPRNQLWLAKNPWFEQDLLPI  180

Query:  184 LQKIVADIL                                                     192
            LQK V  IL
Sbjct:  181 LQKRVEAIL                                                     189
```

Based on this analysis, it was predicted that these proteins and their epitopes could be useful antigens for vaccines or diagnostics.

EXAMPLE 857

A DNA sequence (GBSx0909) was identified in *S. agalactiae* <SEQ ID 2593> which encodes the amino acid sequence <SEQ ID 2594>. Analysis of this protein sequence reveals the following:

```
Possible Site: 16
>>> Seems to have no N-terminal signal sequence

----- Final Results -----
            bacterial cytoplasm --- Certainty = 0.4178 (Affirmative) < succ>
             bacterial membrane --- Certainty = 0.0000 (Not Clear)  < succ>
              bacterial outside --- Certainty = 0.0000 (Not Clear)  < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 858

A DNA sequence (GBSx0910) was identified in *S. agalactiae* <SEQ ID 2595> which encodes the amino acid sequence <SEQ ID 2596>. Analysis of this protein sequence reveals the following:

```
Possible site: 45

>>> Seems to have no N-terminal signal sequence

----- Final Results -----
            bacterial cytoplasm --- Certainty = 0.2779 (Affirmative) < succ> bacterial membrane --- Certainty = 0.0000 (Not Clear)  < succ> bacterial outside --- Certainty = 0.0000 (Not Clear)  < succ>
```

A related GBS nucleic acid sequence <SEQ ID 9899> which encodes amino acid sequence <SEQ ID 9900> was also identified.

The protein has homology with the following sequences in the GENPEPT database.

```
>GP:AAD35886 GB:AE001748 conserved hypothetical protein [Thermotoga
maritima]
Identities = 36/124 (29%), Positives = 58/124 (46%), Gaps = 3/124 (2%)

Query:   19 VPTKELLADYFNRMEFAIGRVEAHVLAHFDYGFRKLNLDVEDLKPFETQLKRIFIKMLSK    78
            +P   EL  DY  R  F + RV+ H LAH DY  R       D    K       +++I + ++
Sbjct:   98 LPPDELARDYLERTLFVMERVKFHTLAHLDYPARYAKAD---FKANRDLIEKILVFLVKN   154

Query:   79 GLAFELNTKSLYLYGNEKLYRYALEILKQLGCKQYSIGSDGHIPEHFCYEFDRLQGLLKD   138
               A E+NT  L+ +G       + +E+   LG +  +IGSD H  +H     + +     LK
Sbjct:  155 EKALEINTAGLFKHGKPNPDYWIVEMYYDLGGRVVTIGSDAHESQHIGRGIEEVMRELKK   214

Query:  139 YQID   142
            +  +
Sbjct:  215 FNFE   218
```

No corresponding DNA sequence was identified in *S. pyogenes*.

Based on this analysis, it was predicted that these proteins and their epitopes could be useful antigens for vaccines or diagnostics.

EXAMPLE 859

A DNA sequence (GBSx0911) was identified in *S. agalactiae* <SEQ ID 2597> which encodes the amino acid sequence <SEQ ID 2598>. This protein is predicted to be alkaline amylopullulanase (pulA). Analysis of this protein sequence reveals the following:

```
Possible site: 41
>>> Seems to have no N-terminal signal sequence
    INTEGRAL    Likelihood = -10.08   Transmembrane 1225-1241 (1222-1247)
    INTEGRAL    Likelihood =  -2.44   Transmembrane   19-35   (18-36)
    INTEGRAL    Likelihood =  -0.11   Transmembrane 1146-1162 (1146-1162)

----- Final Results -----
            bacterial membrane  --- Certainty = 0.5034 (Affirmative) < succ>
            bacterial outside   --- Certainty = 0.0000 (Not Clear)   < succ>
            bacterial cytoplasm --- Certainty = 0.0000 (Not Clear)   < succ>
```

The protein has homology with the following sequences in the GENPEPT database.

```
>GP: AAG33958 GB: AF217414 pullulanase [Streptococcus pneumoniae]
Identities = 641/1311 (48%), Positives = 854/1311 (64%), Gaps = 88/1311 (6%)

Query:    1 MKRKDLFGDKQTQYTIRKLSVGVASVATGVCIFLHSPQVFAEEVSASPANTAIAESNINQ    60
            M++       +K+  Y+IR L  G SV  G  + L              A+A    I+
Sbjct:    1 MRKTPSHTEKKMVYSIRSLKNGTGSVLIGASLVL----------------LAMATPTISS    44

Query:   61 VDNQQSTNLKDDINSNSETVVTPSDMPDTKQLVSDETDTQKGVTEPDKATSLLEENKG-P   119
            ++  +TN +   N N+ T+ P  + DT        +     + ++ P   A + LE+ + P
Sbjct:   45 DESTPTTN--EPNNRNTTTLAQP--LTDT---AAGSGKNESDISSPGNANASLEKTEEKP    97

Query:  120 VSDKNTLDLKVAPSTLQNTPDKTSQAIGAPSPTLKVANQAPRIENGYFRLHLKELPQGHP   179
            ++  T   A     Q  D++S+   + SP         IE+  YFR+H+K+LP+  +
Sbjct:   98 ATEPTTPAASPADPAPQTGQDRSSEPTTSTSPVTTETKAEEPIEDNYFRIHVKKLPEENK   157

Query:  180 VESTGLWIWGDVDQPSSNWPNGAIPMTDAKKDDYGYYVDFKLSEKQRKQISFLINNKAGT   239
            ++ GLW W DV++PS NWPNGA+   DAKKDDYGYY+D KL  +Q K+ISFLINN AG
Sbjct:  158 -DAQGLWTWDDVEKPSENWPNGALSFKDAKKDDYGYYLDVKLKGEQAKKISFLINNTAGK   216

Query:  240 NLSGDHHIPLLRPEMNQVWIDEKYGTHTYQPLKEGYVRINYLSSSNYDHLSAWLFKDVA   299
            NL+GD  +  L  P+MN+ W+D+ Y    +Y+P  G VR+NY    NYD  S W + DV
```

```
-continued
Sbjct:  217 NLTGDKSVEKLVPKMNEAWLDQDYKVFSYEPQPAGTVRVNYYRTDGNYDKKSLWYWGDVK  276

Query:  300 TPSTT-WPDGSNFVNQGLYGRYIDVSLKTNAKEIGFLILDESKTGDAVKVQPNDYVFRDL  358
            PS+ WPDG++F   G YGRYID+ L   A+E GFL+LDESK GD VK++  +Y F DL
Sbjct:  277 NPSSAQWPDGTDFTATGKYGRYIDIPLNEAAREFGFLLLDESKQGDDVKIRKENYKFTDL  336

Query:  359 ANHNQIFVKDKDPKVYNNPYYIDVQLKDAQQIDLTSIQASFTTLDGVDKTEILKELKVT  418
            NH+QIF+KD D +Y NPYY+ +++ AQ + +SI++SF+TL G  K +ILK   +T
Sbjct:  337 KNHSQIFLKDDDESIYTNPYYVHDIRMTGAQHVGTSSIESSFSTLVGAKKEDILKHSNIT  396

Query:  419 DKNQNAIQISDITLDTSKSLLIIKGDFNPKQGHFNISYNGNNVMTRQSWEFKDQLYAYSG  478
             + N + I+D+ +D +  +   GDF+ + +  +SYN +   T+ SW KD+ Y+Y G
Sbjct:  397 NHLGNKVTITDVAIDEAGKKVTYSGDFSDTKHPYTVSNSDQFTTKTSWRLKDETYSYDG  456

Query:  479 NLGAVLNQDGSKVEASLWSPSADSVTMIIYDKDNQNRVVATTPLMKNNKGVWQTILDT--  536
            LGA L ++G +V+ +LWSPSAD V++++YDK++ ++VV T  L K +G W+  LD+
Sbjct:  457 KLGADLKEEGKQVDLTLWSPSADKVSVVVYDKNDPDKVVGTVALEKGERGTWKQTLDSTN  516

Query:  537 KLGIKNYTGYYYLYEIKRGKDKVKILDPYAKSLAEWDSNT--VNDDIKTAKAAFVNPSQL  594
            KLGI ++TGYYY Y+I+R   V  LDPYAKSLA W+S+   ++D K AKAAFV+P++L
Sbjct:  517 KLGITDFTGYYYQYQIERQGKTVLALDPYAKSLAAWNSDDAKIDDAHKVAKAAFVDPAKL  576

Query:  595 GPQNLSFAKIANFKGRQDAVIYEAHVRDFTSDRSLDGKLKNQFGTFAAFSEKLDYLQKLG  654
            GPQ+L++ KI NFK R+DAVIYEAHVRDFTSD ++   L   FGTF AF EKLDYL+ LG
Sbjct:  577 GPQDLTYGKIHNFKTREDAVIYEAHVRDFTSDPAIAKDLTKPFGTFEAFIEKLDYLKDLG  636

Query:  655 VTHIQLLPVLSYFYVNEMDKSRSTA-YTSSDNNYNWGYDPQSYFALSGMYSEKPKDPSAR  713
            VTHIQLLPVLSY++VNE+   + Y SS++NYNWGYDPQ+YF+L+GMYS  PK+P  R
Sbjct:  637 VTHIQLLPVLSYYFVNELKNHEHLSDYASSNSNYNWGYDPQNYFSLTGMYSSDPKNPEKR  696

Query:  714 IAELKQLIHDIHKRGMGVILDVVYNHTAKTYLFEDIEPNYYHFMNEDGSPRESFGGGRLG  773
            IAE K LI++IHKRGMG ILDVVYNHTAK +FED+EPNYYHFM+ DG+PR SFGGGRLG
Sbjct:  697 IAEFKNLINEIHKRGMGAILDVVYNHTAKVDIFEDLEPNYYHFMDADGTPRTSFGGGRLG  756

Query:  774 TTHAMSRRVLVDSIKYLTSEFKVDGFRFDMMGDHDAAAIELAYKEAKAINPNMIMIGEGW  833
            TTH M++R+LVDSIKYL   +KVDGFRFDMMGDHDA+IE AYK A+A+NPN+IM+GEGW
Sbjct:  757 TTHHMTKRLLVDSIKYLVDTYKVDGFRFDMMGDHDAASIEEAYKAARALNPNLIMLGEGW  816

Query:  834 RTFQGDQGQPVKPADQDWMKSTDTVGVFSDDIRNSLKSGFPNEGTPAFITGGPQSLQGIF  893
            RT+ GD+  P K ADQDWMK TDTV VFSDDIRN+LKSG+PNEG PAFITGG + + IF
Sbjct:  817 RTYAGDENMPTKAADQDWMKHTDTVAVFSDDIRNNLKSGYPNEGQPAFITGGKRDVNTIF  876

Query:  894 KNIKAQPGNFEADSPGDVVQYIAAHDNLTLHDVIAKSINKDPKVAEE--EIHRRLRLGNV  951
            KN+ AQP NFEADSPGDV+QYIAAHDNLTL D+IA+SI KDP  AE   EIHRRLRLGN+
Sbjct:  877 KNLIAQPTNFEADSPGDVIQYIAAHDNLTLFDIIAQSIKKDPSKAENYAEIHRRLRLGNL  936

Query:  952 MILTSQGTAFIHSGQEYGRTKRLLNPDYMTKVSDDKLPNKATLIEAVK----EYPYFIHD  1007
            M+LT+QGT FIHSGQEYGRTK+ NP Y T V++DK+PNK+ L+       +YPYFIHD
Sbjct:  937 MVLTAQGTPFIHSGQEYGRTKQFRNPAYRTPVAEDKVPNKSHLLRDKDGNPFDYPYFIHD  996

Query: 1008 SYDSSDAINHFDWAAATDNNKHPISTKTQAYTAGLITRRSTDAFRKLSKAEIDREVSLI  1067
            SYDSSDA+N FDW ATD  +P + K++ Y GLI LR+STDAFR S +I   V LI
Sbjct:  997 SYDSSDAVNKFDWTKATDGKAYPENVKSRDYMKGLIALRQSTDAFRLKSLQDIKDRVHLI  1056

Query: 1068 TEVGQGDIKEKDLVIAYQTIDSKGDIYAVFVNADSKARNVLLGEKYKHLLKGQVIVDADQ  1127
            T  GQ ++++D+VI YQ    GDIYAVFVNAD KAR  LG + HL  +V+ D +Q
Sbjct: 1057 TVPGQNGVEKEDVVIGYQITAPNGDIYAVFVNADEKAREFNLGTAFAHLRNAEVLADENQ  1116

Query: 1128 AGIKPISTPRGVHFEKDSLLIDPLTAIVIKVGKVAPS---------------PKEELQAD  1172
            AG  I+ P+G+ + +  L ++ LTA V+V + S              P+ + +A
Sbjct: 1117 AGSVGIANPKGLEWTEKGLKLNALTATVLRVSQNGTSHESTAEEKPDSTPSKPEHQNEAS  1176

Query: 1173 YPKTQ----------SFKESKTVEKVNRIANKT---------------SITPVVSKKADS  1207
            +P Q         + ++K + N+ + T              S+   V K++
Sbjct: 1177 HPAHQDPAPEARPDSTKPDAKVADAENKPSQATADSQAEQPAQEAQASSVKEAVRKESVE  1236

Query: 1208 YLTNE----------ANLPKTGDKSSKILSVVGISILASLLALVGLSLKRNR  1249
             + E          A LP TG K+  L  GIS+LA LL L G LK +
Sbjct: 1237 NSSKENISATPDRQAELPNTGIKNENKLLFAGISLLA-LLGL-GFLLKNKK  1285
```

A related DNA sequence was identified in *S. pyogenes* <SEQ ID 2599> which encodes the amino acid sequence <SEQ ID 2600>. Analysis of this protein sequence reveals the following:

```
Possible site: 35
>>> Seems to have no N-terminal signal sequence
INTEGRAL Likelihood = -10.83 Transmembrane 1153-1169 (1148-1171)
INTEGRAL Likelihood =  -1.97 Transmembrane   29-45   (28-46)

----- Final Results -----
            bacterial membrane --- Certainty = 0.5331 (Affirmative) < succ>
             bacterial outside --- Certainty = 0.0000 (Not Clear)   < succ>
           bacterial cytoplasm --- Certainty = 0.0000 (Not Clear)   < succ>
```

A related sequence was also identified in GAS <SEQ ID 9125> which encodes the amino acid sequence <SEQ ID 9126>. Analysis of this protein sequence reveals the following:

```
Possible cleavage site: 26
>>> Seems to have an uncleavable N-term signal seq ----- Final Results -----
            bacterial membrane --- Certainty = 0.533 (Affirmative) < succ>
             bacterial outside --- Certainty = 0.000 (Not Clear)   < succ>
           bacterial cytoplasm --- Certainty = 0.000 (Not Clear)   < succ>

LPXTG motif: 1133-1137
```

An alignment of the GAS and GBS proteins is shown below.

```
Identities = 715/1097 (65%), Positives = 872/1097 (79%), Gaps = 21/1097 (1%)

Query:  156 ANQAPRIENGYFRLHLKELPQGHPVESTGLWIWGDVDQPSSNWPNGAIPMTDAKKDDYGY  215
            AN A    E+ + R+H K LP G   + S GLW+WGDVDQPS +WPNGAI MT AKKDDYGY
Sbjct:   95 ANPASIAEH-HLRMHFKTLPAGESLGSLGLWVWGDVDQPSKDWPNGAITMTKAKKDDYGY  153

Query:  216 YVDFKLSEKQRKQISFLINNKAGTNLSGDHHIPLLRPEMNQVWIDEKYGTHTYQFLKEGY  275
            Y+D  L+ K R+Q+S+LINNKAG NLS D HI LL P+MN+VWIDE Y  H Y+PLK+GY
Sbjct:  154 YLDVPLAAKHRQQVSYLINNKAGENLSKDQHISLLTPKMNEVWIDENYHAHAYRPLKKGY  213

Query:  276 VRINYLSSSSNYDHLSAWLFKDVATPSTTWPDGSNFVNQGLYGRYIDVSLKTNAKEIGFL  335
            +RINY + S +YD+L+ W FKDV TP+T WP+G +   ++G YG Y+DV LK  A EIGFL
Sbjct:  214 LRINYHNQSGHYDNLAVWTFKDVKTPTTDWPNGLDLSHKGHYGAYVDVPLKEGANEIGFL  273

Query:  336 ILDESKTGDAVKVQPNDYVFRDLANHNQIFVKDKDPKVYNNPYYIDQVLKDAQQIDLTS  395
            ILD+SKTGDA+KVQP DY+F++L NH Q+FVKD DPKVYNNPYYIDQV LK A+Q
Sbjct:  274 ILDKSKTGDAIKVQPKDYLFKELDNHTQVFVKDTDPKVYNNPYYIDQVSLKGAEQTTPNE  333

Query:  396 IQASFTTLDGVDKTEILKELKVTDKNQNAIQISDITLDTSKSLLIIKGDFNPKQGHFNIS  455
            I+A FTTLDG+D+  + + +K+TDK    + I ++TLD  KS++ +KGDF +    + ++
Sbjct:  334 IKAIFTTLDGLDEDAVKQNIKITDKAGKTVAIDELTLDRDKSVMTLKGDFKAQGAVYTVT  393

Query:  456 YNGNNVMTRQSWEFKDQLYAYSGNLGAVLNQDGSKVEASLWSPSADSVTMIIYDKDNQNR  515
            +   + + RQSW+ KD+LYAY G LGA L +DGS V+ +LWSPSAD+V +++YDK +Q R
Sbjct:  394 FGEVSQVARQSWQLKDKLYAYDGELGATLAKDGS-VDLALWSPSADTVKVVVYDKQDQTR  452

Query:  516 VVATTPLMKNNKGVWQTIL--DTKLGIKNYTGYYYLYEIKRGKDKVKILDPYAKSLAEWD  573
            VV     L K++KGVW+   L  D+   GI +YTGYYYLYEI RG++KV +LDPYAKSLA W+
Sbjct:  453 VVGQADLTKSDKGVWRAHLTSDSVKGISDYTGYYYLYEITRGQEKVMVLDPYAKSLAAWN  512

Query:  574 SNTVNDDIKTAKAAFVNPSQLGPQNLSFAKIANFKGRQDAVIYEAHVRDFTSDRSLDGKL  633
                T  DDIKTAKAAF++PS+LGP   L FAKI NFK R+DA+IYEAHVRDFTSD++L+GKL
Sbjct:  513 DATATDDIKTAKAAFIDPSKLGPTGLDFAKINNFKKREDAIIYEAHVRDFTSDKALEGKL  572

Query:  634 KNQFGTFAAFSEKLDYLQKLGVTHIQLLPVLSYFYVNEMDKSRSTAYTSSDNNYNWGYDP  693
             + FGTF+AF E+LDYL+ LGVTH+QLLPVLSYFY NE+DKSRSTAYTSSDNNYNWGYDP
Sbjct:  573 THPFGTFSAFVEQLDYLKDLGVTHVQLLPVLSYFYANELDKSRSTAYTSSDNNYNWGYDP  632

Query:  694 QSYFALSGMYSEKPKDPSARIAELKQLIHDIHKRGMGVILDVVYNHTAKTYLFEDIEPNY  753
            Q YFALSGMYS   P DP+ RIAELK L+++IHKRGMGVI DVVYNHTA+TYLFED+EPNY
Sbjct:  633 QHYFALSGMYSANPNDPALRIAELKNLVNEIHKRGMGVIFDVVYNHTARTYLFEDLEPNY  692
```

```
                          -continued
Query:    754 YHFMNEDGSPRESFGGGRLGTTHAMSRRVLVDSIKYLTSEFKVDGFRFDMMGDHDAAAIE   813
              YHFMN DG+ RESFGGGRLGTTHAMSRR+LVDSI YLT EFKVDGFRFDMMGDHDAAAIE
Sbjct:    693 YHFMNADGTARESFGGGRLGTTHAMSRRILVDSITYLTREFKVDGFRFDMMGDHDAAAIE   752

Query:    814 LAYKEAKAINPNMIMIGEGWRTFQGDQGQPVKPADQDWMKSTDTVGVFSDDIRNSLKSGF   873
              A+K AKAINPN IMIGEGWRT+QGD+G+     ADQDWMK+T+TVGVFSDDIRN+LKSGF
Sbjct:    753 QAFKAAKAINPNTIMIGEGWRTYQGDEGKKEIAADQDWMKATNTVGVFSDDIRNTLKSGF   812

Query:    874 PNEGTPAFITGGPQSLQGIFKNIKAQPGNFEADSPGDVVQYIAAHDNLTLHDVIAKSINK   933
              PNEGT AFITGG ++L+G+FK IKAQPGNFEAD+PGDVVQYIAAHDNLTLHDVIAKSINK
Sbjct:    813 PNEGTAAFITGGAKNLEGLFKTIKAQPGNFEADAPGDVVQYIAAHDNLTLHDVIAKSINK   872

Query:    934 DPKVAEEEIHRRLRLGNVMILTSQGTAFIHSGQEYGRTKRLLNPDYMTKVSDDKLPNKAT   993
              DPKVAEEEIH+R+RLGN MILT+QGTAFIHSGQEYGRTK+LLNPDY TK SDDK+PNKAT
Sbjct:    873 DPKVAEEEIHKRIRLGNTMILTAQGTAFIHSGQEYGRTKQLLNPDYKTKASDDKVPNKAT   932

Query:    994 LIEAVKEYPYFIHDSYDSSDAINHFDWAAATDNNKHPISTKTQAYTAGLITLRRSTDAFR  1053
              LI+AV +YPYFIHDSYDSSDA+NHFDWA ATD+  HPIS +T+AYT GLI LRRSTDAF
Sbjct:    933 LIDAVAQYPYFIHDSYDSSDAVNHFDWAKATDSIAHPISNQTKAYTQGLIALRRSTDAFT   992

Query:   1054 KLSKAEIDREVSLITEVGQGDIKEKDLVIAYQTIDSKGDIYAVFVNADSKARNVLLGEKY  1113
              K +KAE+DR+V+LIT+ GQ   I+++DL++ YQT+ S GD YAVFVNAD+K R V+L + Y
Sbjct:    993 KATKAEVDRDVTLITQAGQDGIQQEDLIMGYQTVASNGDRYAVFVNADNKTRKVVLPQAY  1052

Query:   1114 KHLLKGQVIVDADQAGIKPISTPRGVHFEKDSLLIDPLTAIVIKV-GKVAPSPKEELQAD  1172
              ++LL   QV+VDA+QAG+  I+ P+GV F K+ L I+ LTA+V+KV   K A   +++ Q D
Sbjct:   1053 RYLLGAQVLVDAEQAGVTAIAKPKGVQFTKEGLTIEGLTALVLKVSSKTANPSQQKSQTD  1112

Query:   1173 YPKTQSFKESKTVEKVNRIANKTSITPVVSKKADSYLTNEANLPKTGDKSSKILSVVGIS  1232
                 +T++    SK ++K     K + T                LPKTG+ SSK L   GI+
Sbjct:   1113 NHQTKTPDGSKDLDKSLMTRPKRAKT-------------NQKLPKTGEASSKGLLAAGIA  1159

Query:   1233 ILASLLALVGLSLKRNR                                            1249
              +    LL  + L +KR +
Sbjct:   1160 L---LLLAISLLMKRQK                                            1173
```

A related GBS gene <SEQ ID 8673> and protein <SEQ ID 8674> were also identified. Analysis of this

```
Lipop: Possible site: -1 Crend: 9
McG: Discrim Score: -0.88
GvH: Signal Score (-7.5): 4.13
Possible site: 41
>>> Seems to have no N-terminal signal sequence
ALOM program count: 3 value: -10.08 threshold: 0.0
INTEGRAL Likelihood = -10.08   Transmembrane 1225-1241 (1222-1247)
INTEGRAL Likelihood =  -2.44   Transmembrane   19-35   (18-36)
INTEGRAL Likelihood =  -0.11   Transmembrane 1146-1162 (1146-1162)
PERIPHERAL Likelihood = 2.44   653
modified ALOM score: 2.52

*** Reasoning Step: 3

----- Final Results -----
           bacterial membrane --- Certainty = 0.5034 (Affirmative) < succ>
           bacterial outside  --- Certainty = 0.0000 (Not Clear)   < succ>
           bacterial cytoplasm --- Certainty = 0.0000 (Not Clear)  < succ>

LPXTG motif: 1081-1085
```

The protein has homology with the following sequences in the databases:

```
ORF00953(1111-3768 of 4356)
EGAD|165156|TM1845(18-840 of 843)pullulanase {Thermotoga
maritima}SP|033840|PULA_THEMA PULLULANASE PRECURSOR(EC 3.2.1.41)
(ALPHA-DEXTRIN ENDO-1,6-ALPHA-GLUCOSIDASE) (PULLULAN 6-GLUCANOHYDROLASE).
GP|2815006|emb|CAA04522.1||AJ001087 pullulanase {Thermotoga
maritima}
GP|4982428|gb|AAD36907.1|AE001821_7|AE001821 pullulanase {Thermotoga
maritima}PIR|H72204|H72204 pullulanase-Thermotoga maritima(strain MSB8)
% Match = 8.4
% Identity = 30.6    % Similarity = 52.8
Matches = 210  Mismatches = 298  Conservative Sub.s = 152
```

```
       1032       1062       1092       1122       1152       1182       1212       1242
NKAGTNLSGDHHIPLLRPEMNQVWIDEKYGTHTYQPLKEGYVRINYLSSSSNYDHLSAWLFKDVATPSTTWPDGSNFVNQ
                               |           :    :::   ||  |::   |  :      |    :
                    MKTKLWLLLLVLLLSALIFSETTIVVHYHRYDGKYDGWNLWIWP--VEPVSQEGKAYQFTGE
                         10        20        30        40        50

1272       1302       1329       1359                 1668       1698
GLYGRYIDVSLKTNAKEIGFLI-LDESKTGDAVKVQPNDYVFRDLA~~~~PKQGHFNISYNGNNVMTRQSWEFKDQL---
  :|:    |  |   ::|  ::  |::                                         |:  ||
DDFGKVAVVKLPMDLTKVGIIVRLNE-----------------------~~~~---------------WQAKDVAKDR
         70        80                                                    90

1746       1776       1806       1836
---------------------------------------YAYSGNLGAVLNQDGSKVEASLWSPSADSVTMIIYDKDN
                                        |  |  ||||  : :    |    :|||  :  | ::::
FIEIKDGKAEVWILQGV~~~~ELIIEGYKPARVIMMEILDDYYYDGELGAVYSPE--KTIFRVWSPVSKWVKVLLFKNGE
              110       210       220       230       240       250

1866       1896       1926       1956       1986       2016       2046       2076
QNRVVATTPLMKNNKGVWQTILDTKLGIKNYTGYYYLYEIKRGKDKVKILDPYAKSLAEWDSNTVNDDIKTAKAAFVNPS
  :    |||  ::   |      |:|||::      |||||   |   |:||   ::    |
DTEPYQVVNMEYKGNGVWEAVVEGDL-----DGVFYLYQLENYGKIRTTVDPYSKAVYA----------NSKKSAVVNLA
       270       280       290       300       310       320

2106       2136       2166       2196       2226                 2253       2283
QLGPQNLSFAKIANFKGRQDAVIYEAHVRDFTSDRSLDGKLKNQFGTFAAFSEK-----------LDYLQKLGVTHIQLL
 : |:   :     :|:||:||| |: ||   :  :||| |:   ::|               |:|:|||||:::|
RTNPEGWENDRGPKIEGYEDAIIYEIHIADITG--LENSGVKNK-GLYLGLTEENTKGPGGVTTGLSHLVELGVTHVHIL
       330       340       350       360       370       380       390

2313       2343       2373       2403       2433       2463       2493
PVLSYFYVNEMDKSRSTAYTSSDNNYNWGYDPQSYFALSGMYSEKPKDPSARIAELKQLIHDIHKRGMGVILDVVYNHT-
 |  :  :: :|:||       :  ||||||    : |:|| |   |  |:|:::    |  :||||||  ||:|||:|
PFFDFYTGDELDK-------DFEKYYNWGYDPYLFMVPEGRYSTDPKNPHTRIREVKEMVKALHKHGIGVIMDMVFPHTY
       410       420       430       440       450       460       470

2544       2574       2601       2631       2661       2691       2721       2751
--AKTYLFEDIEPNYYHFMNEDGSP-RESFGGGRLGTTHAMSRRVLVDSIKYLTSEFKVDGFRFDMMGDHDAAAIELAYK
    :|:   |  |::  :::  |:   ||        :    |  |:  :||::   |:  :||||||  ||  :
GIGELSAFDQTVPYYFYRIDKTGAYLNESGCGNVIASERPMMRKFIVDTVTYWVKEYHIDGFRFDQMGLIDKKTMLEVER
       480       490       500       510       520       530       540       550

2781       2811       2841       2871       2901       2931       2979
EAKAINPNMIMIGEGWRTFQGDQGQPVKPADQDWMKSTDTVGVFSDDIRNSLKSGFPNEGTPAFITGG----PQSLQGIF
 |:  :|:  |||    |      |    |:    |      |:|   ||    |:   ||   |       :|:
ALHKIDPTIILYGEPW----GGWGAPIRFGKSD--VAGTHVAAFNDEFRDAIRGSVFNPSVKGFVMGGYGKETKIKRGVV
       560       570       580       590       600       610       620

3030       3060       3084       3114       3144       3174       3204
KNIKAQPG---NFEADSPGDVVQYIAAHDNLTLHD--VIAKSINKDPKVAEEEIHRRLRLGNVMILTSQGTAFIHSGQEY
 :|           |     ::  |  |||  ||     :    |: |   :|   :|   ::|||||  |:   ||::
GSINYDGKLIKSFALD-PEETINYAACHDNHTLWDKNYLAAKADKKKEWTEEELKNAQKLAGAILLTSQGVPFLHGGQDF
       640       650       660       670       680       690       700

3234       3264       3294       3324       3354       3384       3414       3444
GRTKRLLNPDYMTKVSDDKLPNKATLIEAVKEYPYFIHDSYDSSDAINHFDWAAATDNNKHPISTKTQAYTAGLITLRRS
|||           |:||| ||  :  ||   :    :       |
CRTKN---------------------------FNDNSYNAPISINGFDY------ERKLQFIDVFNYHKGLIKLRKE
                                  710       720              730       740

3474       3504       3534       3564       3594       3624       3654
TDAFRKLSKAEI----------DREVSLITEVGQGDIKEKDLVIAYQTIDSKGDIYAVFVNADSKARNVLLGEKYKHLLK
|||   : ||           | |::: :      |   ||:|: |             |   |   |  ||  || :
HPAFRLKNAEEIKKHLEFLPGGRRIVAFMLKDHAGGDPWKDIVVIYN--------------------GNLEKTTYK-LPE
       760       770       780       790                              800

3678       3708       3738       3768       3798       3828       3858       3888
GQ--VIVDADQAGIKPISTPRGVHFEKDSLLIDPLTAIVIKVGKVAPSPKEELQADYPKTQSFKESKTVEKVNRIANKTS
|:  |:|::   :||    |  |              ::  :|||||
GKWNVVVNSQKAGTEVIETVEG------TIELDPLSAYVLRE
       820       830       840
```

SEQ ID 2598 (GBS5) was expressed in *E. coli* as a His-fusion product. SDS-PAGE analysis of total cell extract is shown in FIG. 3 (lane 7; MW 134 kDa).

The His-fusion protein was purified as shown in FIG. 190, lane 7.

Based on this analysis, it was predicted that these proteins and their epitopes could be useful antigens for vaccines or diagnostics.

EXAMPLE 860

A DNA sequence (GBSx0912) was identified in *S. agalactiae* <SEQ ID 2601> which encodes the amino acid sequence <SEQ ID 2602>. Analysis of this protein sequence reveals the following:

```
Possible site: 26
>>> Seems to have no N-terminal signal sequence
INTEGRAL Likelihood = -10.72  Transmembrane 231-247  (228-251)
INTEGRAL Likelihood =  -8.39  Transmembrane  50-66   (44-68)
INTEGRAL Likelihood =  -6.74  Transmembrane  23-39   (20-41)
INTEGRAL Likelihood =  -5.84  Transmembrane 173-189  (168-196)
INTEGRAL Likelihood =  -4.41  Transmembrane 299-315  (297-318)
INTEGRAL Likelihood =  -4.14  Transmembrane 115-131  (114-133)
INTEGRAL Likelihood =  -3.35  Transmembrane  80-96   (79-97)
INTEGRAL Likelihood =  -0.48  Transmembrane  97-113  (97-113)

----- Final Results -----
         bacterial membrane --- Certainty = 0.5288 (Affirmative) < succ>
         bacterial outside  --- Certainty = 0.0000 (Not Clear)  < succ>
         bacterial cytoplasm --- Certainty = 0.0000 (Not Clear) < succ>
```

A related GBS nucleic acid sequence <SEQ ID 8675> which encodes amino acid sequence <SEQ ID 8676> was also identified. Analysis of this protein sequence reveals the following:

```
SRCFLG: 0
McG: Length of UR: 19
Peak Value of UR: 3.08
Net Charge of CR: 1
McG: Discrim Score: 9.76
GvH: Signal Score (-7.5): -4.57
Possible site: 22
>>> Seems to have an uncleavable N-term signal seq
Amino Acid Composition: calculated from 1
ALOM program count: 7 value: -10.72 threshold: 0.0
INTEGRAL Likelihood = -10.72  Transmembrane 217-233  (214-237)
INTEGRAL Likelihood =  -8.39  Transmembrane  36-52   (30-54)
INTEGRAL Likelihood =  -6.74  Transmembrane   9-25   (6-27)
INTEGRAL Likelihood =  -5.84  Transmembrane 159-175  (154-182)
INTEGRAL Likelihood =  -4.14  Transmembrane 101-117  (100-119)
INTEGRAL Likelihood =  -3.35  Transmembrane  66-82   (65-83)
INTEGRAL Likelihood =  -0.48  Transmembrane  83-99   (83-99)
PERIPHERAL  Likelihood = 0.26   136
modified ALOM score: 2.64
icm1 HYPID: 7 CFP: 0.529

*** Reasoning Step: 3

----- Final Results -----
         bacterial membrane --- Certainty = 0.5288 (Affirmative) < succ>
         bacterial outside  --- Certainty = 0.0000 (Not Clear)  < succ>
         bacterial cytoplasm --- Certainty = 0.0000 (Not Clear) < succ>
```

The protein has homology with the following sequences in the GENPEPT database.

```
>GP: BAB08178 GB: AB036768 exfoliative toxin A [Staphylococcus hyicus]
Identities = 134/298 (44%), Positives = 197/298 (65%)

Query:  22 PLVMAGLVLGLLALGNLLEGYGTYVRYCLGLVALVFWIFLIKGILKNKKESRKELSNPLI   81
           PLV +GLVLGLL LGNLL+    +    G++A++ W+ L+  +  N    + +L++PL+
Sbjct:   7 PLVSSGLVLGLLGLGNLLKDVSLSLNALCGILAILVWLHLLYSMFNNVNHVKNQLNSPLV   66

Query:  82 ASVFTTFFMAGMILSTYILLFRSLGIWVAVLSKGVWWLSFIALIIHMAIFSWKYLRHFSM  141
           +SVFTTFFM+G + +TY+  F S   ++   L    +W L   I ++HM IFS KYL+ FS+
Sbjct:  67 SSVFTTFFMSGFLGTTYLNTFFSHISFIHHLITPLWLLCLIGILTHMIIFSHKYLKSFSL  126

Query: 142 ANLFPSWSVLYVGIGVASLTAPISGQFTIGKIVFWYGFIATLVLLPFLFIKAYKIGLPSA  201
           N++PSW+VLY+GI +A LTAP+SG F IGK+    YGF+AT ++LP +F +      L ++
```

-continued

```
Sbjct: 127 ENVYPSWTVLYIGIAIAGLTAPVSGYFFIGKLTVIYGFVATCIVLPLVFKRLKTYPLQTS 186

Query: 202 VKPNITTICAPMSLITAGYVNSFVSPNRGLLLLLIVMAQFLYFFILFQVPKLLIGDFTPG 261
            +KPN +TICAP SL+ A YV +F   +  +++L ++++Q  YF+I+FQ+PKLL    F+P
Sbjct: 187 IKPNTSTICAPFSLVAAAYVLAFPEAHDFVVILFLILSQVFYFYIVFQLPKLLREPFSPV 246

Query: 262 FSAFTFPLVISATSLKLSIQHLSLPVDIQGLVHFEIGTTTLIVMIVMVRYIFFLRRTI   319
            FSAFTFPLVISAT+LK S+  L  P    GL+ FE    T+IV V   YI     + +
Sbjct: 247 FSAFTFPLVISATALKNSMPILIFPEIWNGLLMFETVLATVIVFRVFFGYIHLFLKPV   304
```

A related DNA sequence was identified in *S. pyogenes* <SEQ ID 2603> which encodes the amino acid sequence <SEQ ID 2604>. Analysis of this protein sequence reveals the following:

```
Possible site: 40
>>> Seems to have no N-terminal signal sequence
INTEGRAL Likelihood = -9.82 Transmembrane 169-185 (163-189)
INTEGRAL Likelihood = -8.49 Transmembrane  50-66  (38-69)
INTEGRAL Likelihood = -7.86 Transmembrane 228-244 (224-247)
INTEGRAL Likelihood = -5.15 Transmembrane 288-304 (284-306)
INTEGRAL Likelihood = -3.29 Transmembrane 108-124 (107-126)
INTEGRAL Likelihood = -3.29 Transmembrane 140-156 (140-161)
INTEGRAL Likelihood = -1.33 Transmembrane  84-100 (84-100)

----- Final Results -----
            bacterial membrane --- Certainty = 0.4927 (Affirmative) < succ>
             bacterial outside --- Certainty = 0.0000 (Not Clear) < succ>
           bacterial cytoplasm --- Certainty = 0.0000 (Not Clear) < succ>
```

An alignment of the GAS and GBS proteins is shown below.

```
Identities = 138/305 (45%), Positives = 200/305 (65%), Gaps = 5/305 (1%)

Query:  12 RYMMKNWEKPPLVMAGLVLGLLALGNLLEGYGTYVRYCLGLVALVFWIFLIKGILKNKKE  71
            R +MK+ + PPLVM+GL LG L+ GNLL  Y +    Y    L AL  +  L+ G+++N  +
Sbjct:  12 RTLMKHLKTPPLVMSGLALGTLSFGNLLATYVSIFNYLGILAALFIYGILLVGMVRNLND  71

Query:  72 SRKELSNPLIASVFTTFFMAGMILSTYILLFRSLGIWVAVLSKGVWWLSFIALIIHMAIF 131
            ++ +L   PLIASVF TFFM GM+LS+  L      G W+  L+    WWL F+  ++ +A +
Sbjct:  72 TKMQLRQPLIASVFPTFFMTGMLLSSLFLKVTG-GCWLGFLT---WWLFFLGNLVLIAYY 127

Query: 132 SWKYLRHFSMANLFPSWSVLYVGIGVASLTAPISGQFTIGKIVFWYGFIATLVLLPFLFI 191
            ++++   FS  N+FPSWSVL+VGI +A+LTAP S QF +G+++FW    + T V+LPF+
Sbjct: 128 QYRFVFSFSWDNVFPSWSVLFVGIAMAALTAPASRQFLLGQVIFWVCLLLTAVILPFMAK 187

Query: 192 KAYKIGLPSAVKPNITTICAPMSLITAGYVNSFVSPNRGLLLLLIVMAQFLYFFILFQVP 251
            K Y IGL  AV PNI+T CAP+SL++A Y+ +F  P  G+++ L+V +Q LY F++ Q+P
Sbjct: 188 KTYGIGLGQAVMPNISTFCAPLSLLSASYLATFPRPQVGMVIFLLVSSQLLYAFVVVQLP 247

Query: 252 KLLIGDFTPGFSAFTFPLVISATSLKLSIQHLSLP-VDIQGLVHFEIGTTTLIVMIVMVR 310
            +LL    F PGFSAFTFP VISATSLK+++  L   +   Q L+  E+    T +V V
Sbjct: 248 RLLNRPFNPGFSAFTFPFVISATSLKMTLSFLGWQGLGWQVLLLGEVLLATALVTYVYGA 307

Query: 311 YIFFL 315
            Y+ FL
Sbjct: 308 YLRFL 312
```

Based on this analysis, it was predicted that these proteins and their epitopes could be useful antigens for vaccines or diagnostics.

EXAMPLE 861

A DNA sequence (GBSx0913) was identified in *S. agalactiae* <SEQ ID 2605> which encodes the amino acid sequence <SEQ ID 2606>. Analysis of this protein sequence reveals the following:

```
Possible site: 28
>>> Seems to have a cleavable N-term signal seq.

----- Final Results -----
            bacterial outside --- Certainty = 0.3000 (Affirmative) < succ>
            bacterial membrane --- Certainty = 0.0000 (Not Clear) < succ>
            bacterial cytoplasm --- Certainty = 0.0000 (Not Clear) < succ>
```

The protein has no significant homology with any sequences in the GENPEPT database.

A related DNA sequence was identified in *S. pyogenes* <SEQ ID 2607> which encodes the amino acid sequence <SEQ ID 2608>. Analysis of this protein sequence reveals the following:

```
Possible site: 28
>>> Seems to have a cleavable N-term signal seq.

----- Final Results -----
            bacterial outside --- Certainty = 0.3000 (Affirmative) < succ>
            bacterial membrane --- Certainty = 0.0000 (Not Clear) < succ>
            bacterial cytoplasm --- Certainty = 0.0000 (Not Clear) < succ>
```

An alignment of the GAS and GBS proteins is shown below.

```
Identities = 45/57 (78%), Positives = 53/57 (92%)

Query: 1 MVKKFAFAKGIATGVVATAATLAGAAFAIKKTIIEPEEEKIAFIEENRKKAARKRVS 57
         MVKK+ F KG+ATGV+ATAAT+AGA FA+KKTII+PEEEK AFIEENRKKAAR+RV+
Sbjct: 1 MVKKYQFVKGLATGVLATAATVAGAVFAVKKTIIDPEEEKAAFIEENRKKAARRRVA 57
```

Based on this analysis, it was predicted that these proteins and their epitopes could be useful antigens for vaccines or diagnostics.

EXAMPLE 862

A DNA sequence (GBSx0914) was identified in *S. agalactiae* <SEQ ID 2609> which encodes the amino acid sequence <SEQ ID 2610>. This protein is predicted to be tRNA isopentenylpyrophosphate transferase (miaA). Analysis of this protein sequence reveals the following:

```
Possible site: 20
>>> Seems to have an uncleavable N-term signal seq

----- Final Results -----
            bacterial membrane --- Certainty = 0.0000 (Not Clear) < succ>
            bacterial outside --- Certainty = 0.0000 (Not Clear) < succ>
            bacterial cytoplasm --- Certainty = 0.0000 (Not Clear) < succ>
```

A related GBS nucleic acid sequence <SEQ ID 9897> which encodes amino acid sequence <SEQ ID 9898> was also identified.

The protein has homology with the following sequences in the GENPEPT database.

```
>GP: BAB06085 GB: AP001515 tRNA isopentenylpyrophosphate transferase
[Bacillus halodurans]
Identities = 139/311 (44%), Positives = 200/311 (63%), Gaps = 21/311 (6%)

Query:    7 KIKLIAVVGPTAVGKTALGIELAKTFNGEIISGDSQQVYQKLDIGTAKASKEEQEQAYHH   66
            K KL+A+VGPTAVGKT   + LAK  NGE+ISGDS QVY+ +DIGTAK + EE +   HH
Sbjct:    2 KEKLVAIVGPTAVGKTKTSVMLAKRLNGEVISGDSMQVYRGMDIGTAKITAEEMDGVPHH   61

Query:   67 LIDVREVNENYSVYDFVKEAKVAIDTIISKGKIPIIVGGTGLYLQSLFEGYHLGGEVNQE  126
            LID+++ +E++SV DF    A   I  I  +G++P +VGGTGLY+ ++     ++LG      E
Sbjct:   62 LIDIKDPSESFSVADFQDLATPLITEIHERGRLPFLVGGTGLYVNAVIHQFNLGDIRADE  121

Query:  127 TLMAYREKLE----SLSDEDLFEKLT----EQSIIIPQVNRRRAIRALELAKF-------  171
            YR +LE     S    + L +KL+       + +  I    N RR  IRALE+ K
Sbjct:  122 D---YRHELEAFVNSYGVQALHDKLSKIDPKAAAAIHPNNYRRVIRALEIIKLTGKTVTE  178

Query:  172 -GNDLQNSESPYDVLLIGLNDDRQVLYDRINRRVDLMMDNGLLDEAKWLYD-NYPSVQAS  229
             + +   SPY++++IGL   +R VLYDRINRRVD M++  GL+DEAK  LYD      Q+
Sbjct:  179 QARHEEETPSPYNLVMIGLTMERDVLYDRINRRVDQMVEEGLIDEAKKLYDRGIRDCQSV  238

Query:  230 KGIGYKELFPYFSKQIPLEEAVDKLKQNTRRFAKRQLTWFRNRMNVEFIMVGEENYQQKI  289
            + IGYKE++ Y     + LEEA+D LK+N+RR+AKRQLTWFRN+ NV +  + + ++ +KI
Sbjct:  239 QAIGYKEMYDYLDGNVTLEEAIDTLKRNSRRYAKRQLTWFRNKANVTWFDMTDVDFDKKI  298

Query:  290 KRKVSDFLSSK                                                  300
            ++ +F++ K
Sbjct:  299 -MEIHNFIAGK                                                  308
```

A related DNA sequence was identified in *S. pyogenes* <SEQ ID 2611> which encodes the amino acid sequence <SEQ ID 2612>. Analysis of this protein sequence reveals the following:

```
Possible site: 27
>>> Seems to have a cleavable N-term signal seq.

----- Final Results -----
            bacterial outside --- Certainty = 0.3000 (Affirmative) < succ>
              bacterial membrane --- Certainty = 0.0000 (Not Clear)  < succ>
                bacterial cytoplasm --- Certainty = 0.0000 (Not Clear)  < succ>
```

An alignment of the GAS and GBS proteins is shown below.

```
Identities = 202/296 (68%), Positives = 250/296 (84%)

Query:    5 MRKIKLIAVVGPTAVGKTALGIELAKTFNGEIISGDSQQVYQKLDIGTAKASKEEQEQAY   64
            M KIK++ +VGPTAVGKTALGI LAK FNGEIISGDSQQVY++LDIGTAKA++EEQE A
Sbjct:    1 MTKIKIVVIVGPTAVGKTALGISLAKAFNGEIISGDSQQVYRQLDIGTAKATQEEQEAAV   60

Query:   65 HHLIDVREVNENYSVYDFVKEAKVAIDTIISKGKIPIIVGGTGLYLQSLFEGYHLGGEVN  124
            HHLID+REV E+YS YDFV++A+ +I   I+S+GK+PIIVGGTGLYLQSL EGYHLGG V+
Sbjct:   61 HHLIDIREVTESYSAYDFVQDAQKSISDIVSRGKLPIIVGGTGLYLQSLLEGYHLGGQVD  120

Query:  125 QETLMAYREKLESLSDEDLFEKLTEQSIIIPQVNRRRAIRALELAKFGNDLQNSESPYDV  184
            QE + AYR +LE L D DL+E+L   +I I QVNRRRAIRALELA+F ++L+N+E+ Y+
Sbjct:  121 QEAVKAYRNELEQLDDHDLYERLQVNNITIEQVNRRRAIRALELAQFADELENAETAYEP  180

Query:  185 LLIGLNDDRQVLYDRINRRVDLMMDNGLLDEAKWLYDNYPSVQASKGIGYKELFPYFSKQ  244
            L+IGLNDDRQV+YDRIN+RV+ M++NGLL+EAKWLY++YP+VQAS+GIGYKELFPYF +
Sbjct:  181 LIIGLNDDRQVIYDRINQRVNRMIENGLLEEAKWLYEHYPTVQASRGIGYKELFPYFVGE  240

Query:  245 IPLEEAVDKLKQNTRRFARRQLTWFRNRMNVEFIMVGEENYQQKIKRKVSDFLSSK      300
            + L EA D+LKQNTRRFAKRQLTWFRNRM V F  +   +Y Q +   +V DFL  K
Sbjct:  241 MTLAEASDQLKQNTRRFAKRQLTWFRNRMAVSFTAITAPDYPQVVHDRVRDFLGQK      296
```

Based on this analysis, it was predicted that these proteins and their epitopes could be useful antigens for vaccines or diagnostics.

EXAMPLE 863

A DNA sequence (GBSx0915) was identified in *S. agalactiae* <SEQ ID 2613> which encodes the amino acid sequence <SEQ ID 2614>. This protein is predicted to be hflX (hflX). Analysis of this protein sequence reveals the following:

```
Possible site: 35
>>> Seems to have an uncleavable N-term signal seq

----- Final Results -----
            bacterial membrane --- Certainty = 0.0000 (Not Clear) < succ>
               bacterial outside --- Certainty = 0.0000 (Not Clear) < succ>
                  bacterial cytoplasm --- Certainty = 0.0000 (Not Clear) <
succ>
```

The protein has homology with the following sequences in the GENPEPT database.

```
>GP: BAB06081 GB: AP001515 unknown conserved protein [Bacillus halodurans]
Identities = 182/406 (44%), Positives = 254/406 (61%), Gaps = 12/406 (2%)

Query:    9 ERVILVGVELQDT--ENFEMSMEELASLAKTAGANVVNHYYQKRDKYDSKSFIGSGKLEE    66
            ERV LV +L +   E FE S+EEL +L TA  V++   QKR+ +  ++IG GKL+E
Sbjct:   10 ERVFLVACQLPNMTDEQFEASLEELEALTLTAQGTVIDRLTQKREAIEPATYIGRGKLDE    69

Query:   67 IKAIVEADEIDTVVVNNRLTPRQNSNLEAELGVKVIDRMQLILDIFAMRARSHEGKLQVH   126
              +  +E  E D V+VN  L+  Q  NL   LGV+VIDR QLILDIFA RA+S EGKLQV
Sbjct:   70 LAIKMEEQEADLVIVNGELSGSQVRNLTNRLGVRVIDRTQLILDIFAGRAKSREGKLQVE   129

Query:  127 LAQLKYMLPRLVGQGIMLSRQAGGIGSRGPGESQLELNRRSIRHQISDIERQLKIVEKNR   186
            LAQL Y+LPR+VGQG  LSR  GGIG+RGPGE++LE +RR IR +++DI++QLK    K+R
Sbjct:  130 LAQLNYLLPRIVGQGQGLSRLGGGIGTRGPGETKLETDRRHIRKRMADIDKQLKHTVKHR   189

Query:  187 ETVRERRVDSTTFKIGLIGYTNAGKSTIMNVLTDDRQYEANELFATLDATTKQIYLQNQF   246
              + R RR  + TF+I L+GYTNAGKST++N LT    YE + LFATLD   T+++ L +
Sbjct:  190 DRYRARRERNQTFRIALVGYTNAGKSTLLNRLTASDSYEEDLLFATLDPMTRKMRLPSGM   249

Query:  247 QVTLTDTVGFIQDLPTELVAAFKSTLEESRHVDLLFHVIDASDPNHEEHEKVVMEILKDL   306
            +V L+DTVGFI  LPT LVAAF+STLEE +H DLL HV+D S    + H + V E+L  L
Sbjct:  250 EVILSDTVGFINQLPTTLVAAFRSTLEEVKHADLLLHVVDRSSEQLQAHMETVSELLHQL   309

Query:  307 DMIDIPRLAIYNKMDVTEQLNATTFP-----NVRIAAKKQGSKDLLRRLIVDEIRHIFDE   361
             ++     L +YNK D   + N   P      + ++A K+      LR++I   +  +F
Sbjct:  310 EVDQSQMLVVYNKAD---KPNLPIIPVHQQNGIEMSAHKREDIQRLRQMIERTLVDLFTP   366

Query:  362 FSIRVHQNQAYKLYDLNKIALLDTYTFEEEYE--NITGYISPKQKW                405
             +  +  ++ KL  L +  ++    ++E+ E   + GY+  P    W
Sbjct:  367 YVTELASDEGNKLAKLRRETIMTEMKWDEDRECYQVKGYVHPNHAW                412
```

A related DNA sequence was identified in *S. pyogenes* <SEQ ID 2615> which encodes the amino acid sequence <SEQ ID 2616>. Analysis of this protein sequence reveals the following:

```
Possible site: 48
>>> Seems to have an uncleavable N-term signal seq

----- Final Results -----
            bacterial membrane --- Certainty = 0.0000 (Not Clear) < succ>
               bacterial outside --- Certainty = 0.0000 (Not Clear) < succ>
                  bacterial cytoplasm --- Certainty = 0.0000 (Not Clear) < succ>
```

The protein has homology with the following sequences in the databases:

```
>GP: BAB06081 GB: AP001515 unknown conserved protein [Bacillus halodurans]
Identities = 185/403 (45%), Positives = 246/403 (60%), Gaps = 6/403 (1%)

Query:  13 ERVILLGVEL--QTTEHFDMSMTELANLAKTAGVKVMASFSQKRERYDSKTFIGSGKLDE   70
           ERV L+ +L    T E F+ S+ EL  L  TA   V+   +QKRE +  T+IG GKLDE
Sbjct:  10 ERVFLVACQLPNMTDEQFEASLEELEALTLTAQGTVIDRLTQKREAIEPATYIGRGKLDE   69

Query:  71 IKAIVEADEIDAVIVNNRLTARQNANLEAVLEVKVIDRMQLILDIFAMRARSHEGKLQVH  130
           +    +E  E D VIVN  L+   Q  NL   L V+VIDR QLILDIFA RA+S EGKLQV
Sbjct:  70 LAIKMEEQEADLVIVNGELSGSQVRNLTNRLGVRVIDRTQLILDIFAGRAKSREGKLQVE  129

Query: 131 LAQLKYMLPRLVGQGIMLSRQAGGIGSRGPGESQLELNRRSIRHQIADIERQLTQVEKNR  190
           LAQL Y+LPR+VGQG  LSR  GGIG+RGPGE++LE +RR IR ++ADI++QL    K+R
Sbjct: 130 LAQLNYLLPRIVGQGQGLSRLGGGIGTRGPGETKLETDRRHIRKRMADIDKQLKHTVKHR  189

Query: 191 QTIRDRRVGSDTFKIGLIGYTNAGKSTIMNLLTDDSHYEANELFATLDATTKQLYLENQF  250
              R RR +  TF+I L+GYTNAGKST++N LT    YE + LFATLD  T+++ L +
Sbjct: 190 DRYRARRERNQTFRIALVGYTNAGKSTLLNRLTASDSYEEDLLFATLDPMTRKMRLPSGM  249

Query: 251 QATLTDTVGFIQDLPTELVAAFKSTLEESKYVDLLLHVIDASDPNHSEQEKVVLNLLKEL  310
             + L+DTVGFI  LPT LVAAF+STLEE K+ DLLLHV+D S      + V LL +L
Sbjct: 250 EVILSDTVGFINQLPTTLVAAFRSTLEEVKHADLLLHVVDRSSEQLAHMETVSELLHQL  309

Query: 311 DMLNIPRLAIYNKVDIAEQ--FTATAFPNIRISARSKDSKILLRRLIIDQIRDQFVPFRI  368
           ++    L +YNK D         I +SA ++    LR++I  + D F P+
Sbjct: 310 EVDQSQMLVVYNKADKPNLPIIPVHQQNGIEMSAHKREDIQRLRQMIERTLVDLFTPYVT  369

Query: 369 KVHQDKAYKLYDLNRVALLDHYTFDQEIE--DISGYISPKQQW                 409
           ++  D+  KL  L R  ++    +D++ E  + GY+ P  W
Sbjct: 370 ELASDEGNKLAKLRRETIMTEMKWDEDRECYQVKGYVHPNHAW                 412
```

An alignment of the GAS and GBS proteins is shown below.

```
Identities = 326/412 (79%), Positives = 375/412 (90%)

Query:   1 MIETKEEQERVILVGVELQDTENFEMSMEELASLAKTAGANVVNHYYQKRDKYDSKSFIG   60
           MIETK +QERVIL+GVELQ TE+F+MSM ELA+LAKTAG V+   + QKR++YDSK FIG
Sbjct:   5 MIETKRQQERVILLGVELQTTEHFDMSMTELANLAKTAGVKVMASFSQKRERYDSKTFIG   64

Query:  61 SGKLEEIKAIVEADEIDTVVVNNRLTPRQNSNLEAELGVKVIDRMQLILDIFAMRARSHE  120
           SGKL+EIKAIVEADEID V+VNNRLT RQN+NLEA L VKVIDRMQLILDIFAMRARSHE
Sbjct:  65 SGKLDEIKAIVEADEIDAVIVNNRLTARQNANLEAVLEVKVIDRMQLILDIFAMRARSHE  124

Query: 121 GKLQVHLAQLKYMLPRLVGQGIMLSRQAGGIGSRGPGESQLELNRRSIRHQISDIERQLK  180
           GKLQVHLAQLKYMLPRLVGQGIMLSRQAGGIGSRGPGESQLELNRRSIRHQI+DIERQL
Sbjct: 125 GKLQVHLAQLKYMLPRLVGQGIMLSRQAGGIGSRGPGESQLELNRRSIRHQIADIERQLT  184

Query: 181 IVEKNRETVRERRVDSTTFKIGLIGYTNAGKSTIMNVLTDDKQYEANELFATLDATTKQI  240
            VEKNR+T+R+RRV S TFKIGLIGYTNAGKSTIMN+LTDD  YEANELFATLDATTKQ+
Sbjct: 185 QVEKNRQTIRDRRVGSDTFKIGLIGYTNAGKSTIMNLLTDDSHYEANELFATLDATTKQL  244

Query: 241 YLQNQFQVTLTDTVGFIQDLPTELVAAFKSTLEESRHVDLLFHVIDASDPNHEEHEKVVM  300
           YL+NQFQ TLTDTVGFIQDLPTELVAAFKSTLEES++VDLL HVIDASDPNH E EKVV+
Sbjct: 245 YLENQFQATLTDTVGFIQDLPTELVAAFKSTLEESKYVDLLLHVIDASDPNHSEQEKVVL  304

Query: 301 EILKDLDMIDIPRLAIYNKMDVTEQLNATTFPNVRIAAKKQGSKDLLRRLIVDEIRHIFD  360
           E+LK+LDM++IPRLAIYNK+D+ EQ  AT FPN+RI A+ + SK LLRRLI+D+IR  F
Sbjct: 305 NLLKELDMLNIPRLAIYNKVDIAEQFTATAFPNIRISARSKDSKILLRRLIIDQIRDQFV  364

Query: 361 EFSIRVHQNQAYKLYDLNKIALLDTYTFEEEYENITGYISPKQKWKLEEFYD         412
            F I+VHQ++AYKLYDLN++ALLD YTF++E E+I+GYISPKQ+W+L++FY+
Sbjct: 365 PFRIKVHQDKAYKLYDLNRVALLDHYTFDQEIEDISGYISPKQQWRLDDFYE         416
```

Based on this analysis, it was predicted that these proteins and their epitopes could be useful antigens for vaccines or diagnostics.

EXAMPLE 864

A DNA sequence (GBSx0916) was identified in *S. agalactiae* <SEQ ID 2617> which encodes the amino acid sequence <SEQ ID 2618>. Analysis of this protein sequence reveals the following:

```
Possible site: 46
>>> Seems to have no N-terminal signal sequence

----- Final Results -----
            bacterial cytoplasm --- Certainty = 0.2044 (Affirmative) < succ>
              bacterial membrane --- Certainty = 0.0000 (Not Clear) < succ>
                bacterial outside --- Certainty = 0.0000 (Not Clear) < succ>
```

The protein has no significant homology with any sequences in the GENPEPT database.

A related DNA sequence was identified in *S. pyogenes* <SEQ ID 2619> which encodes the amino acid sequence <SEQ ID 2620>. Analysis of this protein sequence reveals the following:

```
Possible site: 40
>>> Seems to have no N-terminal signal sequence

----- Final Results -----
            bacterial cytoplasm --- Certainty = 0.3436 (Affirmative) < succ>
              bacterial membrane --- Certainty = 0.0000 (Not Clear) < succ>
                bacterial outside --- Certainty = 0.0000 (Not Clear) < succ>
```

An alignment of the GAS and GBS proteins is shown below.

```
Identities = 124/209 (59%), Positives = 150/209 (71%)

Query:    1 MIDYIDLALTYGGFTSLDKVYLEKKLDGLSKQQRLDFITPPPSVINAYFAEIYQKQGPEA   60
            M +YIDLA TYGGFTSLD  YL   L   L+ QQ+L FITPPPSVINAYFAEIYQKQ P+A
Sbjct:    5 MNNYIDLAKTYGGFTSLDTNYLNHLLASLTDQQKLAFITPPPSVINAYFAEIYQKQSPQA   64

Query:   61 ATDYYFDLSKALGLFPKHLSFDEEKPFIRLNLSGKSFGFAYLNDQEEASVFSEVKEVITP  120
            ATDYYF+LSKALGLF    SF+EEKPF+RLNLSGK++GFAY NDQE A VFSE  E   P
Sbjct:   65 ATDYYFNLSKALGLFTDQPSFEEEKPFVRLNLSGKAYGFAYQNDQEVALVFSEKAEPKKP  124

Query:  121 QLLLEIAQIFPQYKVYRDRSGIRMAKIDFDETESQNITPETSLLGNVLQLKKDIIKITSF  180
            +L   E+ QIFPQY VY D+  ++M    F++ E ++ITP+ +LL   +L   I   F
Sbjct:  125 ELFFELTQIFPQYMVYEDKGQLKMQAKQFEQGECEDITPDDTLLSKIYRLANGITMLKGF  184

Query:  181 NQEELLELVKTKSGKYYYSSQGRESVIYI                                209
            N EEL  L +T SG+ YY    RE +IYI
Sbjct:  185 NVEELWALSQTFSGQKYYDFAQREFMIYI                                213
```

Based on this analysis, it was predicted that these proteins and their epitopes could be useful antigens for vaccines or diagnostics.

EXAMPLE 865

A DNA sequence (GBSx0917) was identified in *S. agalactiae* <SEQ ID 2621> which encodes the amino acid sequence <SEQ ID 2622>. Analysis of this protein sequence reveals the following:

```
Possible site: 16
>>> Seems to have no N-terminal signal sequence

----- Final Results -----
            bacterial cytoplasm --- Certainty = 0.1060 (Affirmative) < succ>
            bacterial membrane  --- Certainty = 0.0000 (Not Clear)   < succ>
            bacterial outside   --- Certainty = 0.0000 (Not Clear)   < succ>
```

A related GBS nucleic acid sequence <SEQ ID 9895> which encodes amino acid sequence <SEQ ID 9896> was also identified.

The protein has homology with the following sequences in the GENPEPT database.

```
>GP: CAB14316 GB: Z99116 similar to hypothetical proteins [Bacillus subtilis]
Identities = 156/309 (50%), Positives = 210/309 (67%), Gaps = 5/309 (1%)

Query:    1 MEIQFLGTGAGQPAKARNVSSLVLKLLDEINEVWMFDCGEGTQRQILETTIKPRKVKKIF    60
            ME+ FLGTGAG PAKARNV+S+ LKLL+E   VW+FDCGE TQ QIL TTIKPRK++KIF
Sbjct:    1 MELLFLGTGAGIPAKARNVTSVALKLLEERRSVWLFDCGEATQHQILHTTIKPRKIEKIF    60

Query:   61 ITHMHGDHVFGLPGFLSSRAFQANEEQTDLDIYGPVGIKSFVMTALRTSGSRLPYRIHFH   120
            ITHMHGDHV+GLPG L SR+FQ  E++  L +YGP GIK+F+ T+L  + + L Y +
Sbjct:   61 ITHMHGDHVYGLPGLLGSRSFQGGEDE--LTVYGPKGIKAFIETSLAVTKTHLTYPLAIQ   118

Query:  121 EFDESSLGKIMETDKFTVYAEKLDHTIFCMGYRVVQKDLEGTLDAEALKLAGVPFGPLFG   180
            E +E   G + E D+F V A  + H +  GYRV +KD+ G+L A+ LK   +P GP++
Sbjct:  119 EIEE---GIVFEDDQFIVTAVSVIHGVEAFGYRVQEKDVPGSLKADVLKEMNIPPGPVYQ   175

Query:  181 KVKNGENVTLEDGREIIAKDYISEPKKGKVITILGDTRKTDASIRLALGADVLVHESTYG   240
            K+K GE VTLEDGR I  D++ PKKG+ +    GDTR +D    LA    DVLVHE+T+
Sbjct:  176 KIKKGETVTLEDGRIINGNDFLEPPKKGRSVVFSGDTRVSDKLKELARDCDVLVHEATFA   235

Query:  241 KGDERIAKSHGHSTNMQAADIAKQANAKRLLLNHVSARFMGRDCWQMEEDAKTIFSNTHL   300
            K D  ++A  + HST  QAA   AK+A AK+L+L H+SAR+ G     +++++A  +F N+
Sbjct:  236 KEDRKLAYDYYHSTTEQAAVTAKEARAKQLILTHISARYQGDASLELQKEAVDVFPNSVA   295

Query:  301 VRDLEEVGI                                                     309
            D   EV +
Sbjct:  296 AYDFLEVNV                                                     304
```

A related DNA sequence was identified in *S. pyogenes* <SEQ ID 2623> which encodes the amino acid sequence <SEQ ID 2624>. Analysis of this protein sequence reveals the following:

```
Possible site: 16
>>> Seems to have no N-terminal signal sequence

----- Final Results -----
            bacterial cytoplasm --- Certainty = 0.2352 (Affirmative) < succ>
            bacterial membrane  --- Certainty = 0.0000 (Not Clear)   < succ>
            bacterial outside   --- Certainty = 0.0000 (Not Clear)   < succ>
```

An alignment of the GAS and GBS proteins is shown below.

```
Identities = 253/307 (82%), Positives = 285/307 (92%)

Query:    1 MEIQFLGTGAGQPAKARNVSSLVLKLLDEINEVWMFDCGEGTQRQILETTIKPRKVKKIF    60
            ME+QFLGTGAGQPAK RNVSSL LKLLDEINEVWMFDCGEGTQRQILETTIKPRK++KIF
Sbjct:    1 MELQFLGTGAGQPAKQRNVSSLALKLLDEINEVWMFDCGEGTQRQILETTIKPRKIRKIF    60

Query:   61 ITHMHGDHVFGLPGFLSSRAFQANEEQTDLDIYGPVGIKSFVMTALRTSGSRLPYRIHFH   120
            ITH+HGDH+FGLPGFLSSR+FQA+EEQTDLDIYGP+GIK++V+T+L+ SG+R+PY+IHFH
Sbjct:   61 ITHLHGDHIFGLPGFLSSRSFQASEEQTDLDIYGPIGIKTYVLTSLKVSGARVPYQIHFH   120

Query:  121 EFDESSLGKIMETDKFTVYAEKLDHTIFCMGYRVVQKDLEGTLDAEALKLAGVPFGPLFG   180
            EFD+ SLGKIMETDKF VYAE+L HTIFCMGYRVVQKDLEGTLDAEALK AGVPFGPLFG
Sbjct:  121 EFDDKSLGKIMETDKFEVYAERLAHTIFCMGYRVVQKDLEGTLDAEALKAAGVPFGPLFG   180

Query:  181 KVKNGENVTLEDGREIIAKDYISEPKKGKVITILGDTRKTDASIRLALGADVLVHESTYG   240
            K+KNG++V LEDGR I AKDYIS PKKGK+ITI+GDTRKT AS++LA  ADVLVHESTYG
Sbjct:  181 KIKNGQDVELEDGRLICAKDYISAPKKGKIITIIGDTRKTSASVKLAKDADVLVHESTYG   240

Query:  241 KGDERIAKSHGHSTNMQAADIAKQANAKRLLLNHVSARFMGRDCWQMEEDAKTIFSNTHL   300
            KGDERIA++HGHSTNMQAA IA +A AKRLLLNHVSARF+GRDC QME+DA TIF N  +
Sbjct:  241 KGDERIARNHGHSTNMQAAQIAHEAGAKRLLLNHVSARFLGRDCRQMEKDAATIFENVKM   300

Query:  301 VRDLEEV   307
            V+DLEEV
Sbjct:  301 VQDLEEV   307
```

Based on this analysis, it was predicted that these proteins and their epitopes could be useful antigens for vaccines or diagnostics.

EXAMPLE 866

A DNA sequence (GBSx0918) was identified in *S. agalactiae* <SEQ ID 2625> which encodes the amino acid sequence <SEQ ID 2626>. This protein is predicted to be similar to ketoacyl reductase. Analysis of this protein sequence reveals the following:

```
Possible site: 17
>>> Seems to have no N-terminal signal sequence

----- Final Results -----
              bacterial membrane --- Certainty = 0.0000 (Not Clear) < succ>
               bacterial outside --- Certainty = 0.0000 (Not Clear) < succ>
             bacterial cytoplasm --- Certainty = 0.0000 (Not Clear) < succ>
```

The protein has homology with the following sequences in the GENPEPT database.

```
>GP: CAB14310 GB: Z99116 similar to ketoacyl reductase [Bacillus subtilis]
Identities = 100/253 (39%), Positives = 152/253 (59%), Gaps = 2/253 (0%)

Query:    3 RTILITGASGGLAQAIINQLPQDD-HLIVTGRSREKLEKLYGKRPNTLCLSLDITN-DNA    60
            + I ITGASGGL + I    +  H++++ R ++L ++  K      +I  D
Sbjct:    7 KRIWITGASGGLGERIAYLCAAEGAHVLLSARREDRLIEIKRKITEEWSGQCEIFPLDVG   66

Query:   61 VTNMIEKIYGEFGQIDILINNAGFGSFKEFWDYSDEEVKDMFAVNTFATMSIARQIGHKM   120
              I ++  + G ID+LINNAGFG F+   D + +++K MF VN F  ++  + +  +M
Sbjct:   67 RLEDIARVRDQIGSIDVLINNAGFGIFETVLDSTLDDMKAMFDVNVFGLIACTKAVLPQM   126

Query:  121 SLVKSGHIVNIASMAGLIATSKASVYGASKFAVVGFSNALRLELAEKNVYVTSVNPGPIK   180
            K GHI+NIAS AG IAT K+S+Y A+K AV+G+SNALR+EL+    +YVT+VNPGPI+
Sbjct:  127 LEQKKGHIINIASQAGKIATPKSSLYSATKHAVLGYSNALRMELSGTGIYVTTVNPGPIQ   186

Query:  181 TGFFAQADPSGDYLASIGRFALTPEKVSKKVVSILGKNKRELNLPFILAFAHKYYSLFPK   240
            T FF+ AD   GDY ++GR+ L P+ V+ + +     KRE+NLP ++    K Y LFP
Sbjct:  187 TDFFSIADKGGDYAKNVGRWMLDPDDVAAQITAAIFTKKREINLPRLMNAGTKLYQLFPA   246

Query:  241 TADYFARKVFNYK   253
              + A +   K
Sbjct:  247 LVEKLAGRALMKK   259
```

A related DNA sequence was identified in *S. pyogenes* <SEQ ID 2627> which encodes the amino acid sequence <SEQ ID 2628>. Analysis of this protein sequence reveals the following:

```
Possible site: 18
>>> Seems to have a cleavable N-term signal seq.

----- Final Results -----
              bacterial outside --- Certainty = 0.3000 (Affirmative) < succ>
             bacterial membrane --- Certainty = 0.0000 (Not Clear)   < succ>
            bacterial cytoplasm --- Certainty = 0.0000 (Not Clear)   < succ>
```

The protein has homology with the following sequences in the databases:

```
>GP: BAB05225 GB: AP001512 oxidoreductase [Bacillus halodurans]
Identities = 107/259 (41%), Positives = 156/259 (59%), Gaps = 5/259 (1%)

Query:    1 MAQRIIVITGASGGLAQAIVKQLPKEDSLI-LLGRNKERLEHCYQHI----DNKECLELD    55
            M ++ I ITGAS GL + +      E++++ L  R++ERLE+  + +             +D
Sbjct:    1 MRKKTIFITGASSGLGRQLAIDFSWEETVLCLFARSQERLENVQRIVVENGGEAHIYPVD    60

Query:   56 ITNPVAIEKMVAQIYQRYGRIDVLINNAGYGAFKGFEEFSAQEIADMFQVNTLASIHFAC   115
            + +P +I++  A+      G +DVLINNAGYG F+ F +    E    MF+VN     +
Sbjct:   61 LADPQSIDRSFAEAISAVGVVDVLINNAGYGVFEPFCDSQMDENERMFRVNVFGLMRATA   120

Query:  116 LIGQKMAEQGQGHLINIVSMAGLIASAKSSIYSATKFALIGFSNALRLELADKGVYVTTV   175
             +   M EQG GH+INI  S AG  IA+AKS+IYSATK A++GF+N+LR+EL    G++V+  V
Sbjct:  121 AVLPTMREQGSGHIINIASQAGKIATAKSAIYSATKHAVLGFTNSLRMELKGTGIHVSAV   180

Query:  176 NPGPIATKFFDQADPSGHYLESVGKFTLQPNQVAKRLVSIIGKNKRELNLPFSLAVTHQF   235
            NPGPI T FFDQAD  G Y   V +  L P  V++++V +    K  KRELNLP+ + +
Sbjct:  181 NPGPIQTPFFDQADKEGAYTSKVQRIMLDPEDVSEKIVQLTKKPKRELNLPWWMNIGATA   240

Query:  236 YTLFPKLSDYLARKVFNYK                                           254
            Y + P+L +  LA K F  K
Sbjct:  241 YQVAPRLLELLAGKQFRQK                                           259
```

An alignment of the GAS and GBS proteins is shown below.

```
Identities = 155/251 (61%), Positives = 200/251 (78%)

Query:    3 RTILITGASGGLAQAIINQLPQDDHLIVTGRSREKLEKLYGKRPNTLCLSLDITNDNAVT    62
            R I+ITGASGGLAQAI+ QLP++D LI+ GR++E+LE   Y    N   CL LDITN  A+
Sbjct:    4 RIIVITGASGGLAQAIVKQLPKEDSLILLGRNKERLEHCYQHIDNKECLELDITNPVAIE    63

Query:   63 NMIEKIYGEFGQIDILINNAGFGSFKEFWDYSDEEVKDMFAVNTFATMSIARQIGHKMSL   122
            M+ +IY  +G+ID+LINNAG+G FK F  +S +E+ DMF VNT A++   A   IG KM+
Sbjct:   64 KMVAQIYQRYGRIDVLINNAGYGAFKGFEEFSAQEIADMFQVNTLASIHFACLIGQKMAE   123

Query:  123 VKSGHIVNIASMAGLIATSKASVYGASKFAVVGFSNALRLELAEKNVYVTSVNPGPIKTG   182
              +GH++NI SMAGLIA++K+S+Y A+KFA++GFSNALRLELA+K VYVT+VNPGPI T
Sbjct:  124 QGQGHLINIVSMAGLIASAKSSIYSATKFALIGFSNALRLELADKGVYVTTVNPGPIATK   183

Query:  183 FFAQADPSGDYLASIGRFALTPEKVSKKVVSILGKNKRELNLPFILAFAHKYYSLFPKTA   242
            FF QADPSG YL S+G+F  L P +V+K++VSI+GKNKRELNLPF LA   H++Y+LFPK +
Sbjct:  184 FFDQADPSGHYLESVGKFTLQPNQVAKRLVSIIGKNKRELNLPFSLAVTHQFYTLFPKLS   243

Query:  243 DYFARKVFNYK                                                    253
            DY ARKVFNYK
Sbjct:  244 DYLARKVFNYK                                                    254
```

Based on this analysis, it was predicted that these proteins and their epitopes could be useful antigens for vaccines or diagnostics.

EXAMPLE 867

A DNA sequence (GBSx0919) was identified in *S. agalactiae* <SEQ ID 2629> which encodes the amino acid sequence <SEQ ID 2630>. This protein is predicted to be single-stranded-DNA-specific exonuclease (recJ). Analysis of this protein sequence reveals the following:

```
Possible site: 31
>>> Seems to have no N-terminal signal sequence
INTEGRAL    Likelihood = -0.16       Transmembrane     197-213 (197-213)

----- Final Results -----
              bacterial membrane --- Certainty = 0.1065 (Affirmative) < succ>
               bacterial outside --- Certainty = 0.0000 (Not Clear)  < succ>
             bacterial cytoplasm --- Certainty = 0.0000 (Not Clear)  < succ>
```

The protein has homology with the following sequences in the GENPEPT database.

```
>GP: CAB14721 GB: Z99118 similar to single-strand DNA-specific
exonuclease [Bacillus subtilis]
Identities = 276/772 (35%), Positives = 447/772 (57%), Gaps = 45/772 (5%)

Query:    1 MISAKYSWVLNNQKPDAGFFEASKKE-KISEAVASLIYSRGIKTSAELHHFLQTNLENLH   59
            M+++K  W +  Q+PD     ++  ++  I+  VASL+  RG  T+      FL T  + +
Sbjct:    1 MLASKMRWEI--QRPDQDKVKSLTEQLHITPLVASLLVKRGFDTAESARLFLHTKDADFY   58

Query:   60 DPYLLNDMDKAVNRIRRAIENNETILVYGDYDADGMTSASIMKEALDMMGAEVQVYLPNR  119
            DP+ +   M +A +RI++AI    E I++YGDYDADG+TS S+M   L  + A+V  Y+P+R
Sbjct:   59 DPFEMKGMKEAADRIKQAISQQEKIMIYGDYDADGVTSTSVMLHTLQKLSAQVDFYIPDR  118

Query:  120 FTDGYGPNQSVYKYFIEQQDVSLIITVDNGVAGHEAITYAQNQGVDVVVTDHHSMPADLP  179
            F +GYGPN+    ++   I+++   SLIITVD G+A      A+   G+DV++TDHH    +LP
Sbjct:  119 FKEGYGPNEQAFRS-IKERGFSLIITVDTGIAAVHEAKVAKELGLDVIITDHHEPGPELP  177

Query:  180 CAYAIIHPEHPDANYPFPYLAGCGVAFKVACALLETIPTEMLDLVAIGTIADMVSLTDEN  239
                 AI+HP+ P    YPF  LAG GVAFK+A ALL  +P E+LDL AIGTIAD+V L DEN
Sbjct:  178 DVRAIVHPKQPGCTYPFKELAGVGVAFKLAHALLGELPDELLDLAAIGTIADLVPLHDEN  237

Query:  240 RIMVKAGLEVMKDSERIGLQELISLSNIDLKTLNEETIGFKIAPQLNALGRLDDPNPAIE  299
            R++    GLE ++ + R+GL+ELI LS   D+     NEET+GF++AP+LNA+GR++   +PA+
Sbjct:  238 RLIATLGLERLRRTNRLGLKELIKLSGGDIGEANEETVGFQLAPRLNAVGRIEQADPAVH  297

Query:  300 LLTGFDDEESQAIAQMIDQKNEERKEIVQTIFDQAMQMLDQ---TKPVQVLAKENWHPGV  356
            LL   D  E++ +A  IDQ N+ER+++V + D+A++M++Q      + V+AK  W+PGV
Sbjct:  298 LLMSEDSFEAEELAAEIDQLNKERQKMVSKMTDEAIEMVEQQGLDQTAIVVAKAGWNPGV  357

Query:  357 LGIVAGRILERTGQPVIVLNI--EDGIAKGSARSVEALDIFQAFDQHRELFIAFGGHSGA  414
            +GIVA ++++R +P IVL I  E GIAKGSARS+   ++F++  + R++     FGGH  A
Sbjct:  358 VGIVASKLVDRFYRPAIVLGIDEEKGIAKGSARSIRGFNLFESLSECRDILPHFGGHPMA  417

Query:  415 AGMTLEESKVGDLSQVLCDYISKKQLDMSQKKTLTIDSELRFDELSLDTVRDFEKLAPFG  474
            AGMTL+   V DL  L +        +     +D   ++++++++ +   L+PFG
Sbjct:  418 AGMTLKAEDVPDLRSRLNEIADNTLTEEDFIPVQEVDLVCGVEDITVESIAEMNMLSPFG  477

Query:  475 MDNKKPVFLLKDFKVSQARVMGQNGAHLKLKLEQDGQALDLVAFNMGSQLQEFQQAQHLE  534
            M N KP L+++ +    R +G N H+K+ + +    LD V FN G  +         +
Sbjct:  478 MLNPKPHVLVENAVLEDVRKIGANKTHVKMTIRNESSQLDCVGFNKGELQEGIVPGSRIS  537

Query:  535 LAVTLSVNQWNGATTLQLMLEDARVDGIQLFDIRSK------ASSLPHG----------  577
            +    +S+N+WN     QLM++DA V   QLFD+R K           S+LP
Sbjct:  538 IVGEMSINEWNNRKKPQLMIKDAAVSEWQLFDLRGKRTWEDTVSALPSAKRAIVSFKEDS  597

Query:  578 ------------VPILSQEEQSKE-------VILLTVPDHPQELKQMTQGKQFDAIYFKN  618
                         V ++S ++Q+K         ++LL  P     L ++ +GK + IYF
Sbjct:  598 TTLLQTEDLRREVHVISSKDQAKAFDLDGAYIVLLDPPPSLDMLARLLEGKAPERIYFIF  657
```

-continued

```
Query: 619 EIPKNYFISGYGTRDQFASLYKTIYQFPEFDVRYKLKELSSYLHIPDILLIKMIQIFEEL 678
            +++F+S + RD F   Y + +    FDV+    EL+ +        +  M ++F +L
Sbjct: 658 LNHEDHFLSTFPARDHFKWYYAFLLKRGAFDVKKHGSELAKHKGWSVETINFMTKVFFDL 717

Query: 679 HFVTITEGIMTVNKEAEKRDISESQIYQELKETVKFQELMALGTPKEIYDFM       730
            FV I  G+++V  A+KRD+++SQ YQ  ++ ++  + +   + +E+ +++
Sbjct: 718 GFVKIENGVLSVVSGAKKRDLTDSQTYQAKQQLMELDQKLNYSSAEELKEWL         769
```

A related DNA sequence was identified in *S. pyogenes* <SEQ ID 2631> which encodes the amino acid sequence <SEQ ID 2632>. Analysis of this protein sequence reveals the following:

```
Possible site: 31
>>> Seems to have no N-terminal signal sequence
INTEGRAL    Likelihood = -0.16    Transmembrane    220-236 (220-236)
INTEGRAL    Likelihood = -0.11    Transmembrane    667-683 (667-683)

----- Final Results -----
            bacterial membrane --- Certainty = 0.1065 (Affirmative) < succ>
              bacterial outside --- Certainty = 0.0000 (Not Clear)   < succ>
            bacterial cytoplasm --- Certainty = 0.0000 (Not Clear)   < succ>
```

An alignment of the GAS and GBS proteins is shown below.

```
Identities = 474/731 (64%), Positives = 594/731 (80%)

Query:   1 MISAKYSWVLNNQKPDAGFFEASKKEKISEAVASLIYSRGIKTSAELHHFLQTNLENLHD   60
           MI +KYSW + ++KPD GFF+ +K + +++  A LIY RGI+T    L  FL  +L  LHD
Sbjct:   1 MIKSKYSWKIKDKKPDDGFFKLAKTKGLTQTAAQLIYDRGIRTEEALDEFLTADLSQLHD   60

Query:  61 PYLLNDMDKAVNRIRRAIENNETILVYGDYDADGMTSASIMKEALDMMGAEVQVYLPNRF  120
           PYLL+DM KAV RIR+AIE  E IL+YGDYDADGMTSASI+KE LDMMGAE  VYLPNRF
Sbjct:  61 PYLLHDMAKAVPRIRQAIEEGERILIYGDYDADGMTSASIVKETLDMMGAEPLVYLPNRF  120

Query: 121 TDGYGPNQSVYKYFIEQQDVSLIITVDNGVAGHEAITYAQNQGVDVVVTDHHSMPADLPC  180
           TDGYGPNQSVYKYFIEQ+ VSLIITVDNGVAGHEAI YAQ Q VDV+VTDHHS+P +LP
Sbjct: 121 TDGYGPNQSVYKYFIEQEAVSLIITVDNGVAGHEAIRYAQEQEVDVIVTDHHSLPEELPE  180

Query: 181 AYAIIHPEHPDANYPFPYLAGCGVAFKVACALLETIPTEMLDLVAIGTIADMVSLTDENR  240
           A+AIIHPEHPDA+YPF +LAGCGVAFK+A ALLE++PT+ LDLVAIGTIADMVSLT ENR
Sbjct: 181 AFAIIHPEHPDADYPFKHLAGCGVAFKLATALLESLPTDCLDLVAIGTIADMVSLTGENR  240

Query: 241 IMVKAGLEVMKDSERIGLQELISLSNIDLKTLNEETIGFKIAPQLNALGRLDDPNPAIEL  300
           ++VK GL  ++K +ER+GLQEL+SLS IDL+  NE+ IGF+IAPQLNALGRLDDPNPAIEL
Sbjct: 241 VLVKNGLAMLKHTERVGLQELMSLSPIDLEHFNEDAIGFQIAPQLNALGRLDDPNPAIEL  300

Query: 301 LTGFDDEESQAIAQMIDQKNEERKEIVQTIFDQAMQMLDQTKPVQVLAKENWHPGVLGIV  360
           LTGFDD+E+QAIA MI +KNEERK +VQ IFDQAM M+D  KPVQVLA+  WHPGVLGIV
Sbjct: 301 LTGFDDQEAQAIALMIKKKNEERKALVQDIFDQAMAMVDPQKPVQVLAQAGWHPGVLGIV  360

Query: 361 AGRILERTGQPVIVLNIEDGIAKGSARSVEALDIFQAFDQHRELFIAFGGHSGAAGMTLE  420
           AGRI+E  GQ V+VL I++G AKGSARS+EA++IF+A +   RELF AFGGH+GAAGMTL
Sbjct: 361 AGRIMETIGQTVVVLTIDNGFAKGSARSLEAINIFEALNGKRELFTAFGGHAGAAGMTLP  420

Query: 421 ESKVGDLSQVLCDYISKKQLDMSQKKTLTIDSELRFDELSLDTVRDFEKLAPFGMDNKKP  480
           +   LS  LC ++ ++ LD + K TLTID  L  D+LSLD ++  +KLAP+GMD++KP
Sbjct: 421 VDNLEALSDFLCQFVIERGLDQTAKNTLTIDERLSLDDLSLDILKSLDKLAPYGMDHQKP  480

Query: 481 VFLLKDFKVSQARVMGQNGAHLKLKLEQDGQALDLVAFNMGSQLQEFQQAQHLELAVTLS  540
           VF +KD +VSQAR +GQ+ +HLK K+ Q   + D++AF  GSQLQEF +QA  LELAVTLS
Sbjct: 481 VFYVKDIRVSQARTIGQDQSHLKFKVSQGKASFDVLAFGQGSQLQEFRQATGLELAVTLS  540

Query: 541 VNQWNGATTLQLMLEDARVDGIQLFDIRSKASSLPHGVPILSQEEQSKEVILLTVPDHPQ  600
           VN WNG T+LQ ML DARVDG+QL D+R+K  +P G+P  ++ ++ +++  +P+  +
Sbjct: 541 VNHWNGNTSLQFMLVDARVDGVQLLDLRTKTAKVPEGIPTIEEDPNARVILINDIPEDFK  600

Query: 601 ELKQMTQGKQFDAIYFKNEIPKNYFISGYGTRDQFASLYKTIYQFPEFDVRYKLKELSSY  660
                   K FDAIYFKN++   Y+++G+G+R+QFA LYKTIYQFPEFD+R+KL ELS Y
Sbjct: 601 TWRNQFVHKDFDAIYFKNQMKHPYYLTGFGSREQFAKLYKTIYQFPEFDLRHKLTELSHY  660

Query: 661 LHIPDILLIKMIQIFEELHFVTITEGIMTVNKEAEKRDISESQIYQELKETVKFQELMAL  720
           L+I  +LLIK+IQIFEEL FVTI +G+MTVN +A+KR+ISES IYQ+LKE VKFQE+MAL
Sbjct: 661 LNIEKLLLIKLIQIFEELSFVTIDDGLMTVNPQAQKREISESHIYQDLKELVKFQEIMAL  720
```

```
Query: 721 GTPKEIYDFMM                                              731
           +PKE+YD+++
Sbjct: 721 ASPKEMYDYLV                                              731
```

Based on this analysis, it was predicted that these proteins and their epitopes could be useful antigens for vaccines or diagnostics.

EXAMPLE 868

A DNA sequence (GBSx0920) was identified in *S. agalactiae* <SEQ ID 2633> which encodes the amino acid sequence <SEQ ID 2634>. Analysis of this protein sequence reveals the following:

```
Possible site: 13
>>> Seems to have no N-terminal signal sequence

----- Final Results -----
            bacterial cytoplasm --- Certainty = 0.4114 (Affirmative) < succ>
            bacterial membrane  --- Certainty = 0.0000 (Not Clear)   < succ>
            bacterial outside   --- Certainty = 0.0000 (Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 869

A DNA sequence (GBSx0921) was identified in *S. agalactiae* <SEQ ID 2635> which encodes the amino acid sequence <SEQ ID 2636>. Analysis of this protein sequence reveals the following:

```
Possible Site: 42
>>> Seems to have an uncleavable N-term signal seq
INTEGRAL    Likelihood = -5.10         Transmembrane       15-31 (14-33)

----- Final Results -----
            bacterial membrane  --- Certainty = 0.3039 (Affirmative) < succ>
            bacterial outside   --- Certainty = 0.0000 (Not Clear)   < succ>
            bacterial cytoplasm --- Certainty = 0.0000 (Not Clear)   < succ>
```

The protein has homology with the following sequences in the GENPEPT database.

```
>GP: AAA88584 GB: M18954 fructosyltransferase [Streptococcus mutans]
Identities = 67/219 (30%), Positives = 106/219 (47%), Gaps 31/219 (14%)

Query:   1 MRPIVRKKMYKKGKFWVVAGIVT-ILGGSAILGQDVKAEQAEAVTSTISEKTDSSQTISD    59
           M   VRKKMYKKGKFWVVA I T +L G +    V+A++A + T    SE  + SQ   +
Sbjct:   1 METKVRKKMYKKGKFWVVATITTAMLTGIGL--SSVQADEANS-TQVSSELAERSQVQEN   57

Query:  60 TSKLTLPVNSSEAMKNSAEPLIKTAFATSVSSNPREIAATPVKTFDASSKVVVKASTAEH  119
           T+        SS A +N A    KT   + S+NP   AA  V+ D  ++KV+   +  E
Sbjct:  58 TTA------SSSAAENQA----KTEVQETPSTNP---AAATVENTDQTTKVITDNAAVES  104

Query: 120 SANQTN---SNVNQVANDSEVITQQN------STKQLPTVTYSAHVQDIGW----QKSVD  166
           +A++T   + V + A  +  +Q N      +TK+    T   + G      +K
Sbjct: 105 KASKTKDQAATVTKTAASTPEVGQTNEKDKAKATKEADITTPKNTIDEYGLTEQARKIAT  164

Query: 167 NATVSGTVGQEKQVEAIKLSIKAPEGITG-KLSYKTYVK                       204
           +A ++ +   +KQVEA+        +  TG +++Y+ + K
Sbjct: 165 EAGINLSSLTQKQVEALNKVKLTSDAQTGHQMTYQEFDK                       203
```

No corresponding DNA sequence was identified in *S. pyogenes*.

Based on this analysis, it was predicted that this protein and its epitopes, could be useful antigens for vaccines or diagnostics.

A related GBS gene <SEQ ID 8677> and protein <SEQ ID 8678> were also identified. Analysis of this protein sequence reveals the following:

```
Lipop Possible site: -1 Crend: 5
McG: Discrim Score: 9.08
GvH: Signal Score (-7.5): -3.94
Possible site: 34
>>> Seems to have an uncleavable N-term signal seq
ALOM program      count: 1              value: -5.10        threshold: 0.0
INTEGRAL          Likelihood = -5.10    Transmembrane       7-23 (6-25)
PERIPHERAL        Likelihood = 4.03     694
modified ALOM score: 1.52
*** Reasoning Step: 3

----- Final Results -----
                bacterial membrane --- Certainty = 0.3039 (Affirmative) < succ>
                 bacterial outside --- Certainty = 0.0000 (Not Clear)   < succ>
                bacterial cytoplasm --- Certainty = 0.0000 (Not Clear)   < succ>
```

The protein has homology with the following sequences in the databases:

```
31.1/52.1% over 749aaa
Streptococcus mutans
EGAD|14681|levansucrase precursor Insert characterized
SP|P11701|SACB_STRMU LEVANSUCRASE PRECURSOR(EC 2.4.1.10)(BETA-D-FRUCTOFURANOSYL
TRANSFERASE)(SUCROSE 6-FRUCTOSYL TRANSFERASE). Edit characterized
GP|153636|gb|AAA88584.1||M18954 fructosyltransferase Insert characterized
PIR|B28551|B28551 levansucrase(EC 2.4.1.10)precursor-(strain GS-5)Insert
characterized
ORF02172(295-1731 of 3138)
EGAD|14681|14686(7-756 of 797)levansucrase precursor{Streptococcus mutans}
SP|P11701|SACB_STRMU LEVANSUCRASE PRECURSOR(EC 2.4.1.10)(BETA-D-FRUCTOFURANOSYL
TRANSFERASE)(SUCROSE 6-FRUCTOSYL TRANSFERASE). GP|153636|gb|AAA88584.1||M18954
fructosyltransferase {Streptococcus mutans}PIR|B28551|B28551 levansucrase
(EC 2.4.1.10)precursor-Streptococcus mutans(strain GS-5)
% Match = 2.9
% Identity = 31.1    % Similarity = 52.1
Matches = 83    Mismatches = 115    Conservative Sub.s = 56
132        162        192        222        252        282        312        342
LPEHLENQSYQH*PYQH*YQ*RHNHHQYLVQ*ERVQQLIQRAPCL*FQFYVSYXXXN*LXXYR*KKMYKKGKFWVVAGIV
                                                          :   ||||||||||||||  |
                                                          METKVRKKMYKKGKFWVVATIT
                                                                      10        20

372        402        432        462        492        522        552        582
TILGGSAILGQDVKAEQAEAVTSTISEKTDSSQTISDTSKLTLPVNSSEAMKNSAEPLIKTAFATSVSSNPREIAATPVK
 |  :   : |  : | : ||  ||      |   |: :: :    :: |  :: ||   ||   : |:||    || |:
TAM----LTGIGLSSVQADEANST--------QVSSELAERSQVQENTTASSSAAENQAKTEVQETPSTNP---AAATVE
           30         40              50         60         70         80

612        642        663        693        705        735        783
TFDASSKVVVKASTAEHSANQTNSN---VNQVANDSEVITQQN------STKQLPTVTYSAHVQDIGW----QKSVDNAT
    | ::||:    :    |   |::         |: |   |   :  :||:      |     : :||     |      |
NTDQTTKVITDNAAVESKASKTKDQAATVTKTAASTPEVGQTNEKDKAKATKEADITTPKNTIDEYGLTEQARKIATEAG
        100        110        120        130        140        150        160

813        834                                                              882
VSGTVGQEKQVEA---IKLSIKAPEG-----------------------~~~----------------------ITGKLSYKTY
:: :     :|||||       :||:      | |                                          |
INLSSLTQKQVEALNKVKLTSDAQTGHQMTYQEFDKIAQTLIAQDE~~~~VGTLDTAYLPGENDGYIDWNVIGGYGLKPH
       180        190        200        210                  660        670

912        942        972        1002       1032       1062       1092       1122
VKGQGWQPSVESGQVSGTVGQSRPIEALSINLTDNLQKLYDVYYRVHVQDIGWMAWAKNGAYAGTLGMSKRLEAYEVKFT
 ||  : ||:|
TPGQ-YQPTV--------------------------------------------------------------------

1152       1182       1209       1239       1269       1290       1320       1350
LKGQSVLTPTIPKEERPVLNYQVKV-GQNGWQSNKLEGQMAGTLGESKALDG---VKFTLSTLKYGDILYRTHVQDKGWG
         |:  |      : : : :|     |:    : |:    || : :|          |    | | | :|
--------PSTPIHTDDIISFEVSFDGHLVIKPVKVNNDSAGRIDQSRNSGGSLNVAFNVSA------------------
        690        700        710        720        730        740

1641       1671       1701       1731       1761       1791       1821       1851
EI~~~~SYQTYLQKDGWKPTVLEGQLGGSIGLSKSIKAIKLNLGSTALGNIEYRTFLNGSGWQTVVNSGRESNVPNESQQ
                         ||:    |  |:|           :          ::                  |
~~~~~~~~~~~~~~~~~~~~~~~~GGNISVKPSQKSINNTKETKKAHHVSTEKKQKKGNSFFAALLALFSAFCVSIGF
                             750        760        770        780        790
```

SEQ ID 8678 (GBS243) was expressed in *E. coli* as a His-fusion product. SDS-PAGE analysis of total cell extract is shown in FIG. 57 (lane 7; MW 94 kDa).

GBS243-His was purified as shown in FIG. 208, lane 10.

EXAMPLE 870

A DNA sequence (GBSx0922) was identified in *S. agalactiae* <SEQ ID 2637> which encodes the amino acid sequence <SEQ ID 2638>. This protein is predicted to be adenine phosphoribosyltransferase (apt). Analysis of this protein sequence reveals the following:

```
Possible site: 59
>>> Seems to have no N-terminal signal sequence
INTEGRAL    Likelihood = -1.86      Transmembrane      61-77 (59-77)
INTEGRAL    Likelihood = -0.64      Transmembrane      137-153 (137-153)

----- Final Results -----
              bacterial membrane --- Certainty = 0.1744 (Affirmative) < succ>
               bacterial outside --- Certainty = 0.0000 (Not Clear)   < succ>
             bacterial cytoplasm --- Certainty = 0.0000 (Not Clear)   < succ>
```

The protein has homology with the following sequences in the GENPEPT database.

```
>GP: AAC46040 GB: U86377 adenine phosphoribosyltransferase; Apt
[Bacillus subtilis]
Identities = 110/170 (64%), Positives = 135/170 (78%)

Query:    1 MDLNNYIASIENYPQEGITFRDISPLMADGKAYSYAVREIVQYAADKDIDMIVGPEARGF    60
            MDL  Y+  + +YP+EG+ F+DI+ LM  G  Y YA   +IV+YA +K ID++VGPEARGF
Sbjct:    1 MDLKQYVTIVPDYPKEGVQFKDITTLMDKGDVYRYATDQIVEYAKEKQIDLVVGPEARGF    60

Query:   61 IVGCPVAYALGIGFAPVRKPGKLPREVISADYEKEYGLDTLTMHADAIKPGQRVLIVDDL   120
            I+GCPVAYALG+GFAPVRK GKLPREVI  DY  EYG D LT+H DAIKPGQRVLI DDL
Sbjct:   61 IIGCPVAYALGVGFAPVRKEGKLPREVIKVDYGLEYGKDVLTIHKDAIKPGQRVLITDDL   120

Query:  121 LATGGTVKATIEMIEKLGGVVAGCAFLVELDGLNGRKAIEGYDTKVLMNF             170
            LATGGT++ATI+++E+LGGVVAG AFL+EL  L+GR  +E YD    LM +
Sbjct:  121 LATGGTIEATIKLVEELGGVVAGIAFLIELSYLDGRNKLEDYDILTLMKY             170
```

A related DNA sequence was identified in *S. pyogenes* <SEQ ID 2639> which encodes the amino acid sequence <SEQ ID 2640>. Analysis of this protein sequence reveals the following:

```
Possible site: 40
>>> Seems to have a cleavable N-term signal seq.

----- Final Results -----
               bacterial outside --- Certainty = 0.300 (Affirmative) < succ>
              bacterial membrane --- Certainty = 0.000 (Not Clear)   < succ>
             bacterial cytoplasm --- Certainty = 0.000 (Not Clear)   < succ>
```

The protein has homology with the following sequences in the databases:

```
!GB: Z99120 similar to opine catabolism [Bacillus sub . . .   231 1e-59
>GP: CAB15253 GB: Z99120 similar to opine catabolism [Bacillus subtilis]
Score = 231 bits (583), Expect = 1e-59
Identities = 138/363 (38%), Positives = 212/363 (58%), Gaps = 11/363 (3%)

Query:    5 IIGAGIVGSTAAYYLQQSGQKEVTIFDHGQ-GQATKAAAGIISPWFSKRRNKVWYRMARL    63
            I+GAGI+G++ AY+L  ++G + VT+ D   + GQAT AAAGI+ PW S+RRN+ WY++A+
Sbjct:    6 IVGAGILGASTAYHLAKTGAR-VTVIDRKEPGQATADAAAGIVCPWLSQRRNQDWYQLAKG    64

Query:   64 GADFYQQLINDLKEDGFATDFYQQNGIYVLKKQEEKLRDLYELALARKVESPIIGELAIK   123
            GA +Y+ LI+ L++DG +  Y++ G       KL  + E A  R+ ++P IG++
Sbjct:   65 GARYYKDLIHQLEKDGESDTGYKRVGAISIHTDASKLDKMEERAYKRREDAPEIGDITRL   124
```

```
-continued
Query:  124 NRKELGNDFKGLIGFDNCLYASGAARVEGAALCETLLKAS---GYPVIRQKVTLKQQG--   178
            +  E   F L      ++ SGAARV G ALC +LL A+    G  VI+     +L  +
Sbjct:  125 SASETKKLFPILADGYESVHISGAARVNGRALCRSLLSAAEKRGATVIKGNASLLFENGT   184

Query:  179 -SGYEIAGHYF--DQVILAAGAWLPDLLRPLGYQVDVRPQKGQLLDYDVHHIISDTYPVV   235
             +G +       F   D VI+ AGAW  ++L+PLG    V    QK Q++  +++    + ++PVV
Sbjct:  185 VTGVQTDTKQFAADAVIVTAGAWANEILKPLGIHFQVSFQKAQIMHFEMTDADTGSWPVV   244

Query:  236 MPEGEIDLIPFNQGKISVGTSHENDKGY-DLEPDWQVLKKLEMQALTYLPLLKEATQKTC   294
            MP  +  ++ F+ G+I  G +HEND G   DL          ++  +AL   P L +A
Sbjct:  245 MPPSDQYILSFDNGRIVAGATHENDAGLDDLRVTAGGQHEVLSKALAVAPGLADAAAVET   304

Query:  295 RVGIRAYTSDYSPFYGQVSGLKNLYTASGLGSSGLTVGPLIGYELAQLLLGHEGLLTPSD   354
            RVG R +T   + P    G V  ++ LY A+GLG+SGLT+GP +G ELA+L+LG +   L   S
Sbjct:  305 RVGFRPFTPGFLPVVGAVPNVQGLYAANGLGASGLTMGPFLGAELAKLVLGKQTELDLSP   364

Query:  355 YSP   357
            Y P
Sbjct:  365 YDP   367
```

An alignment of the GAS and GBS proteins is shown below.

```
Identities = 150/172 (87%), Positives = 161/172 (93%)

Query:    1 MDLNNYIASIENYPQEGITFRDISPLMADGKAYSYAVREIVQYAADKDIDMIVGPEARGF    60
            MDL NYIASI++YP+ GITFRDISPLMADGKAYSYA+REI QYA DKDIDM+VGPEARGF
Sbjct:    1 MDLTNYIASIKDYPKAGITFRDISPLMADGKAYSYAIREIAQYACDKDIDMVVGPEARGF    60

Query:   61 IVGCPVAYALGIGFAPVRKPGKLPREVISADYEKEYGLDTLTMHADAIKPGQRVLIVDDL   120
            I+GCPVA   LGIGFAPVRKPGKLPR+V+SADYEKEYGLDTLTMHADAIKPGQRVLIVDDL
Sbjct:   61 IIGCPVAVELGIGFAPVRKPGKLPRDVVSADYEKEYGLDTLTMHADAIKPGQRVLIVDDL   120

Query:  121 LATGGTVKATIEMIEKLGGVVAGCAFLVELDGLNGRKAIEGYDTKVLMNFPG          172
            LATGGTVKATIEMIEKLGG+VAGCAFL+EL+GLNGR AI   YD KVLM FPG
Sbjct:  121 LATGGTVKATIEMIEKLGGIVAGCAFLIELEGLNGRHAIRNYDYKVLMQFPG          172
```

SEQ ID 2638 (GBS419) was expressed in *E. coli* as a His-fusion product. SDS-PAGE analysis of total cell extract is shown in FIG. 79 (lane 6; MW 22.6 kDa). It was also expressed in *E. coli* as a GST-fusion product. SDS-PAGE analysis of total cell extract is shown in FIG. 172 (lane 4; MW 47.5 kDa).

GBS419-GST was purified as shown in FIG. 219, lane 6-8.

Based on this analysis, it was predicted that these proteins and their epitopes could be useful antigens for vaccines or diagnostics.

EXAMPLE 871

A DNA sequence (GBSx0923) was identified in *S. agalactiae* <SEQ ID 2641> which encodes the amino acid sequence <SEQ ID 2642>. Analysis of this protein sequence reveals the following:

```
Possible site: 29
>>> Seems to have no N-terminal signal sequence

----- Final Results -----
              bacterial cytoplasm --- Certainty = 0.0847 (Affirmative) < succ>
              bacterial membrane  --- Certainty = 0.0000 (Not Clear)   < succ>
              bacterial outside   --- Certainty = 0.0000 (Not Clear)   < succ>
```

The protein has homology with the following sequences in the GENPEPT database.

```
>GP: BAA11244 GB: D78182 ORF2 [Streptococcus mutans]
Identities = 140/225 (62%), Positives = 178/225 (78%)

Query:    1 MTYLEQYQSGQLTLPSALFFHFKSIFKTADDFLVWQFFYLQNTTNLSDLTPSRIATSLDK    60
            M++L+ Y+SG L LPSAL FH+K  IF   ADDFLVWQFFY QNTT  + D+   S+IAT++ K
Sbjct:    1 MSFLQHYKSGNLVLPSALLFHYKDIFSNADDFLVWQFFYFQNTTKMEDIATSQIATAIGK    60

Query:   61 TVADINRSISNLTSQGLLDVKTIELNHEIEIIFDTSPVFAKLDKLFEEDNQVIIDNKTSD   120
            TV ++NRS+SNL SQ LLD+KTIEL+ E E++FD +    KLD L    ++  + +
Sbjct:   61 TVPEVNRSVSNLISQELLDMKTIELDGESEVLFDATLALKKLDDLLTAADETTVSSSKGT   120
```

-continued

```
Query: 121 SNRLKDLVGDFERELGRLLSPFELEDLQKTLQEDQTDPDIVRAALREAVFNGKTSWNYIN 180
           SN LKDLV DFERELGR+LSPFELEDLQKT+ +D+TDPD+VR+ALREAVFNGKT+WNYI
Sbjct: 121 SNALKDLVEDFERELGRMLSPFELEDLQKTVSDDKTDPDLVRSALREAVFNGKTNWNYIQ 180

Query: 181 AILRNWRREGLTTLRQIEERKQAREDNQMKDLAISDDFKNAMNLW         225
           AILRNWRREG++TLRQ+EER++ RE       ++ +SDDF +AMNLW
Sbjct: 181 AILRNWRREGISTLRQVEERRKEREQANPANVTVSDDFLSAMNLW         225
```

A related DNA sequence was identified in *S. pyogenes* 10 <SEQ ID 2643> which encodes the amino acid sequence <SEQ ID 2644>. Analysis of this protein sequence reveals the following:

```
Possible site: 57
>>> Seems to have a cleavable N-term signal seq.

----- Final Results -----
               bacterial outside --- Certainty = 0.3000 (Affirmative) < succ>
              bacterial membrane --- Certainty = 0.0000 (Not Clear)   < succ>
             bacterial cytoplasm --- Certainty = 0.0000 (Not Clear)   < succ>
```

The protein has homology with the following sequences in the databases:

```
>GP: BAA11244 GB: D78182 ORF2 [Streptococcus mutans]
Identities = 154/228 (67%), Positives = 188/228 (81%), Gaps = 1/228 (0%)

Query:   1 MSFLEHYKSGNLVIPSALLFHYKDLFKSSDDFLVWQFFYLQNTTKRDDLAPSQIAHALGK  60
           MSFL+HYKSGNLV+PSALLFHYKD+F ++DDFLVWQFFY QNTTK +D+A SQIA A+GK
Sbjct:   1 MSFLQHYKSGNLVLPSALLFHYKDIFSNADDFLVWQFFYFQNTTKMEDIATSQIATAIGK  60

Query:  61 SVADINKIISSLTNQGLLDMRTIELTGEIEIIFDASPVLAKLDQLFVSQTATEIDKQE-T  119
           +V ++N+ +S+L +Q LLDM+TIEL GE E++FDA+  L KLD L  +  T + +   T
Sbjct:  61 TVPEVNRSVSNLISQELLDMKTIELDGESEVLFDATLALKKLDDLLTAADETTVSSSKGT  120

Query: 120 PNHFKRLVDEFERELGRFLSPFELEDLEKTLRDDKTDPDLIREALKEAVFNGKTNWKYIQ  179
               N   K LV++FERELGR LSPFELEDL+KT+ DDKTDPDL+R AL+EAVFNGKTNW YIQ
Sbjct: 121 SNALKDLVEDFERELGRMLSPFELEDLQKTVSDDKTDPDLVRSALREAVFNGKTNWNYIQ  180

Query: 180 AILRNWRKEGIVNLRQVEERRRVREGEDLSQVTISEDFLSAMNLWSDS            227
           AILRNWR+EGI   LRQVEERR+ RE  + + VT+S+DFLSAMNLWSDS
Sbjct: 181 AILRNWRREGISTLRQVEERRKEREQANPANVTVSDDFLSAMNLWSDS            228
```

An alignment of the GAS and GBS proteins is shown below.

```
Identities = 144/225 (64%), Positives = 179/225 (79%), Gaps = 1/225 (0%)

Query:   1 MTYLEQYQSGQLTLPSALFFHFKSIFKTADDFLVWQFFYLQNTTNLSDLTPSRIATSLDK  60
           M++LE Y+SG L +PSAL FH+K +FK++DDFLVWQFFYLQNTT  DL PS+IA +L K
Sbjct:   1 MSFLEHYKSGNLVIPSALLFHYKDLFKSSDDFLVWQFFYLQNTTKRDDLAPSQIAHALGK  60

Query:  61 TVADINRSISNLTSQGLLDVKTIELNHEIEIIFDTSPVFAKLDKLFEEDNQVIIDNKTSD  120
           +VADIN+ IS+LT+QGLLD++TIEL  EIEIIFD SPV AKLD+LF       ID K
Sbjct:  61 SVADINKIISSLTNQGLLDMRTIELTGEIEIIFDASPVLAKLDQLFVSQTATEID-KQET  119

Query: 121 SNRLKDLVGDFERELGRLLSPFELEDLQKTLQEDQTDPDIVRAALREAVFNGKTSWNYIN  180
               N   K LV +FERELGR LSPFELEDL+KTL++D+TDPD++R AL+EAVFNGKT+W YI
Sbjct: 120 PNHFKRLVDEFERELGRFLSPFELEDLEKTLRDDKTDPDLIREALKEAVFNGKTNWKYIQ  179

Query: 181 AILRNWRREGLTTLRQIEERKQAREDNQMKDLAISDDFKNAMNLW                225
           AILRNWR+EG+  LRQ+EER++ RE   + + IS+DF +AMNLW
Sbjct: 180 AILRNWRKEGIVNLRQVEERRRVREGEDLSQVTISEDFLSAMNLW                224
```

Based on this analysis, it was predicted that these proteins and their epitopes could be useful antigens for vaccines or diagnostics.

EXAMPLE 872

A DNA sequence (GBSx0924) was identified in *S. agalactiae* <SEQ ID 2645> which encodes the amino acid sequence <SEQ ID 2646>. Analysis of this protein sequence reveals the following:

```
Possible site: 47
>> Seems to have no N-terminal signal sequence

----- Final Results -----
            bacterial cytoplasm --- Certainty = 0.1617 (Affirmative) < succ>
             bacterial membrane --- Certainty = 0.0000 (Not Clear)  < succ>
              bacterial outside --- Certainty = 0.0000 (Not Clear)  < succ>
```

The protein has homology with the following sequences in the GENPEPT database.

```
>GP: BAA11245 GB: D78182 ORF3 [Streptococcus mutans]
Identities = 134/226 (59%), Positives = 170/226 (74%)

Query:    2 DLQLSKRLQKVANYVPKGARLLDVGSDHAYLPIFLLQMGYCDFAIAGEVVNGPYQSALKN    61
            ++ LS RLQ+VA++VPKGARLLDVGSDHAYLPI+LL+ G   DFA+AGE++ GPY+SA+ N
Sbjct:    7 EVSLSHRLQEVASFVPKGARLLDVGSDHAYLPIYLLEQGLIDFAVAGEIIKGPYESAVAN   66

Query:   62 VSEHGLTSKIDVRLANGLSAFEEADNIDTITICGMGGRLIADILNNDIDKLQHVKTLVLQ  121
            V+E GL+ +I VRLA+GL+A  + D+ID ITICGMGGRLIADIL    DKL  VK L+LQ
Sbjct:   67 VNESGLSGQIAVRLADGLAALNDNDDIDLITICGMGGRLIADILAAGSDKLNSVKQLILQ  126

Query:  122 PNNREDDLRKWLAANDFEIVAEDILTENDKRYEILVVKHGHMNLTAKELRFGPFLLSNNT  181
            PNN EDDLR WL ANDF I AE ++ +   K YEILVV+ G + L+ K+LRFGPFL   +
Sbjct:  127 PNNCEDDLRSWLVANDFMIKAEKMVKDRHKYYEILVVEKGKITLSDKDLRFGPFLRQERS  186

Query:  182 TVFKEKWQNELNKLTFALNSIPNSKMEERAILEDKIQDIKEVLDES               227
            ++FKE+W+ EL KL   AL  +P  K +    L  KI+ I+EVL ES
Sbjct:  187 SIFKERWRKELAKLELALTRVPAKKKADNMFLSTKIEQIREVLYES               232
```

A related DNA sequence was identified in *S. pyogenes* <SEQ ID 2647> which encodes the amino acid sequence <SEQ ID 2648>. Analysis of this protein sequence reveals the following:

```
Possible site: 47
>>> Seems to have no N-terminal signal sequence

----- Final Results -----
            bacterial cytoplasm --- Certainty = 0.0803 (Affirmative) < succ>
             bacterial membrane --- Certainty = 0.0000 (Not Clear)  < succ>
              bacterial outside --- Certainty = 0.0000 (Not Clear)  < succ>
```

An alignment of the GAS and GBS proteins is shown below.

```
Identities = 145/224 (64%), Positives = 173/224 (76%)

Query:    1 MDLQLSKRLQKVANYVPKGARLLDVGSDHAYLPIFLLQMGYCDFAIAGEVVNGPYQSALK   60
            MD QLS RL +VA YVPKG +LLDVGSDHAYLPIFL++         AIAGEVV GPY+SALK
Sbjct:    1 MDSQLSNRLAQVAAYVPKGVKLLDVGSDHAYLPIFLVETNQISAAIAGEVVRGPYESALK   60

Query:   61 NVSEHGLTSKIDVRLANGLSAFEEADNIDTITICGMGGRLIADILNNDIDKLQHVKTLVL  120
            NV++ GL   I VRLANGL+AFEEAD++  ITICGMGGRLIADIL    +KLQ ++ LVL
Sbjct:   61 NVTQSGLAEHIQVRLANGLAAFEEADDVTAITICGMGGRLIADILEAGKEKLQGIERLVL  120
```

```
                                   -continued
Query:  121 QPNNREDDLRKWLAANDFEIVAEDILTENDKRYEILVVKHGHMNLTAKELRFGPFLLSNN   180
            QPNNREDDLR WL+ N F+IVAE I+ ENDK YEI+V +HG    L+A ELRFGP+L
Sbjct:  121 QPNNREDDLRAWLSVNAFKIVAETIMAENDKYYEIIVAEHGEKALSATELRFGPYLSQEK   180

Query:  181 TTVFKEKWQNELNKLTFALNSIPNSKMEERAILEDKIQDIKEVL                  224
            + VFKEKWQ E++KL +AL+ IP  K +ER +L   KIQ IKEV+
Sbjct:  181 SVVFKEKWQREMDKLAYALSCIPEEKTQERQLLLTKIQQIKEVI                  224
```

Based on this analysis, it was predicted that these proteins and their epitopes could be useful antigens for vaccines or diagnostics.

EXAMPLE 873

A DNA sequence (GBSx0925) was identified in *S. agalactiae* <SEQ ID 2649> which encodes the amino acid sequence <SEQ ID 2650>. Analysis of this protein sequence reveals the following:

```
Possible site: 54
>>> Seems to have no N-terminal signal sequence

----- Final Results -----
             bacterial cytoplasm --- Certainty = 0.3245 (Affirmative) < succ>
              bacterial membrane --- Certainty = 0.0000 (Not Clear)   < succ>
                bacterial outside --- Certainty = 0.0000 (Not Clear)   < succ>
```

A related GBS nucleic acid sequence <SEQ ID 9893> which encodes amino acid sequence <SEQ ID 9894> was also identified.

The protein has homology with the following sequences in the GENPEPT database.

```
>GP: BAA11246 GB: D78182 ORF4 [Streptococcus mutans]
Identities = 187/262 (71%), Positives = 224/262 (85%)

Query:    2 MKARELIDVYETYCPQELSMEGDISGLQIGSLDKEIKTVMVALDVRETTVAEAIERQVDL    61
            MKA ++I  YE YCPQ+LS+EGDISGLQIG+LDKEIK +M+ALDVRETTVAEAIE++VDL
Sbjct:    1 MKASQIIKRYEAYCPQDLSLEGDISGLQIGTLDKEIKRLMIALDVRETTVAEAIEKKVDL    60

Query:   62 LIVKHAPIFRPLKDLVATPQNKIYIDLLKSDIAVYVSHTNIDIVPNGLNDWFCELLDIQY   121
            LIVKHAPIFRPLK+LV T QN IY +L+K DIAVYVSHTNIDIVP+GLNDWFC+LLDI+
Sbjct:   61 LIVKHAPIFRPLKNLVETAQNHIYFNLIKHDIAVYVSHTNIDIVPDGLNDWFCDLLDIKN   120

Query:  122 PDILSETSNGYGIGRIGDIRPQSFEFFAWKIKDVFGLDSVRLVSYDKSNPEIQRVAICGG   181
              ILS + + YGIGR+GDI P SFE   A K+K +F LDSVRLVSY ++NP I R+AICGG
Sbjct:  121 RRILSPSKDDYGIGRVGDISPLSFEDLAKKVKKIFNLDSVRLVSYGENNPLISRIAICGG   180

Query:  182 SGQSFYKEAIAKGADVFVTGDIYYHTAQEMITNGLLAIDPGHHIEVLFVSKIATMIEQWK   241
            SGQSFY+EA+ KGA V++TGDIYYHTAQEM+TNGLLA+DPGHHIEVLFV K+A   + W
Sbjct:  181 SGQSFYQEALTKGAQVYITGDIYYHTAQEMLTNGLLALDPGHHIEVLFVRKLAEKFQTWS   240

Query:  242 LEKGWDISVLESKAPTNPFYHM                                        263
            ++ WDI++LES+   TNPFYH+
Sbjct:  241 CQENWDITILESQVNTNPFYHL                                        262
```

A related DNA sequence was identified in *S. pyogenes* <SEQ ID 2651> which encodes the amino acid sequence <SEQ ID 2652>. Analysis of this protein sequence reveals the following:

```
Possible site: 53
>>> Seems to have no N-terminal signal sequence

----- Final Results -----
             bacterial cytoplasm --- Certainty = 0.1804 (Affirmative) < succ>
```

-continued

```
                bacterial membrane --- Certainty = 0.0000 (Not Clear) < succ>
                bacterial outside  --- Certainty = 0.0000 (Not Clear) < succ>
```

An alignment of the GAS and GBS proteins is shown below.

```
Identities = 169/262 (64%), Positives = 214/262 (81%)

Query:    2 MKARELIDVYETYCPQELSMEGDISGLQIGSLDKEIKTVMVALDVRETTVAEAIERQVDL   61
            MKA+ LID YE +CP +LSMEGD+ GLQ+GSLDK+I+ VM+ LD+RE+TVAEAI+ +VDL
Sbjct:    3 MKAKTLIDAYEAFCPLDLSMEGDVKGLQMGSLDKDIRKVMITLDIRESTVAEAIKNEVDL   62

Query:   62 LIVKHAPIFRPLKDLVATPQNKIYIDLLKSDIAVYVSHTNIDIVPNGLNDWFCELLDIQY  121
            +I KHAPIF+PLKDLV++PQ  I +DL+K DI+VYVSHTNIDIVP GLNDWFC+LL+I+
Sbjct:   63 IITKHAPIFKPLKDLVSSPQRDILLDLVKHDISVYVSHTNIDIVPGGLNDWFCDLLEIKE  122

Query:  122 PDILSETSNGYGIGRIGDIRPQSFEFFAWKIKDVFGLDSVRLVSYDKSNPEIQRVAICGG  181
            LSET G+GIGRIG ++ Q+ E  A K+K VF LD+VRL+ YDK NP I ++AICGG
Sbjct:  123 ATYLSETKEGFGIGRIGTVKEQALEELASKVKRVFDLDTVRLIRYDKENPLISKIAICGG  182

Query:  182 SGQSFYKEAIAKGADVFVTGDIYYHTAQEMITNGLLAIDPGHHIEVLFVSKIATMIEQWK  241
            SG  FY++A+ KGADV++TGDIYYHTAQEM+T GL A+DPGHHIEVLF  K+   ++ WK
Sbjct:  183 SGGEFYQDAVQKGADVYITGDIYYHTAQEMLTEGLFAVDPGHHIEVLFTEKLKEKLQGWK  242

Query:  242 LEKGWDISVLESKAPTNPFYHM                                        263
            E GWD+S++ SKA TNPF H+
Sbjct:  243 EENGWDVSIISSKASTNPFSHL                                        264
```

Based on this analysis, it was predicted that these proteins and their epitopes could be useful antigens for vaccines or diagnostics.

EXAMPLE 874

A DNA sequence (GBSx0926) was identified in *S. agalactiae* <SEQ ID 2653> which encodes the amino acid sequence <SEQ ID 2654>. This protein is predicted to be 0. Analysis of this protein sequence reveals the following:

```
Possible site: 41
>>> Seems to have a cleavable N-term signal seq.

----- Final Results -----
                bacterial outside  --- Certainty = 0.3000 (Affirmative) < succ>
                bacterial membrane --- Certainty = 0.0000 (Not Clear)   < succ>
                bacterial cytoplasm --- Certainty = 0.0000 (Not Clear)  < succ>
```

The protein has homology with the following sequences in the GENPEPT database.

```
>GP: CAB15253 GB: Z99120 similar to opine catabolism [Bacillus subtilis]
Identities = 148/368 (40%), Positives = 211/368 (57%), Gaps = 13/368 (3%)

Query:    1 MKKIAIIGAGAVGATLAYYLSKEKDIQVTVFDYGV-GQATKAAAGIISPWFSKRRNKAWY   59
            MK  I+GAG +GA+ AY+L+K  +VTV D   GQAT AAAGI+ PW S+RRN+ WY
Sbjct:    1 MKSYIIVGAGILGASTAYHLAKT-GARVTVIDRKEPGQATADAAAGIVCPWLSQRRNQDWY   59

Query:   60 RMARLGADFYSKLVTDLQKDGFETKFYQQTGVFLLKKDESQLESLFALADKRRLESPLIG  119
            ++A+ GA +Y  L+  L+KDG     Y++ G    + D S+L+ +   A KRR ++P IG
Sbjct:   60 QLAKGGARYYKDLIHQLEKDGESDTGYKRVGAISIHTDASKLDKMEERAYKRREDAPEIG  119

Query:  120 DLQILNKSEANTHFPEL-DGYEQLLYASGGARVEGADLTRILLEAS---GVNVIKDEVHF  175
            D+  L+ SE    FP L DGYE ++ SG ARV G  L R LL A+    G  VIK
Sbjct:  120 DITRLSASETKKLFPILADGYES-VHISGAARVNGRALCRSLLSAAEKRGATVIKGNASL  178

Query:  176 -----TITDNGFRVQGIDFDKLVLASGAWLAKILDEHNYQVDVRPQKGQLRDYYFSNINT  230
                 T+T    +  D +++ +GAW +IL       V QK Q+ +  ++ +T
Sbjct:  179 LFENGTVTGVQTDTKQFAADAVIVTAGAWANEILKPLGIHFQVSFQKAQIMHFEMTDADT  238
```

-continued
```
Query:  231 GKYPVVMPEGELDIIPFDNGKVSVGASHENDMAF-DLNIDFKVLDKFEEQAIGYFPQLKK  289
            G +PVVMP   + I+ FDNG++   GA+HEND    DL +      +  +A+   P L
Sbjct:  239 GSWPVVMPPSDQYILSFDNGRIVAGATHENDAGLDDLRVTAGGQHEVLSKALAVAPGLAD  298

Query:  290 ADTTSERVGIRAYTSDFSPFFGPVPCMEGAYAASGLGSTGLTVGPLIGYELCQLILNKEN  349
            A      RVG R +T  F P  G VP ++G YAA+GLG++GLT+GP  +G  EL +L+L  K+
Sbjct:  299 AAAVETRVGFRPFTPGFLPVVGAVPNVQGLYAANGLGASGLTMGPFLGAELAKLVLGKQT  358

Query:  350 QLNLEDYD                                                     357
            +L+L   YD
Sbjct:  359 ELDLSPYD                                                     366
```

A related DNA sequence was identified in *S. pyogenes* <SEQ ID 2655> which encodes the amino acid sequence <SEQ ID 2656>. Analysis of this protein sequence reveals the following:

```
Possible site: 40
>>> Seems to have a cleavable N-term signal seq.

----- Final Results -----
              bacterial outside  --- Certainty = 0.3000 (Affirmative) < succ>
              bacterial membrane --- Certainty = 0.0000 (Not Clear)   < succ>
           bacterial cytoplasm   --- Certainty = 0.0000 (Not Clear)   < succ>
```

An alignment of the GAS and GBS proteins is shown below.

```
Identities = 211/360 (58%), Positives = 262/360 (72%)

Query:    3 KIAIIGAGAVGATLAYYLSKEKDIQVTVFDYGVGQATKAAAGIISPWFSKRRNKAWYRMA   62
            KIAIIGAG VG+T AYYL +     +VT+FD+G GQATKAAAGIISPWFSKRRNK WYRMA
Sbjct:    2 KIAIIGAGIVGSTAAYYLQQSGQKEVTIFDHGQGQATKAAAGIISPWFSKRRNKVWYRMA   61

Query:   63 RLGADFYSKLVTDLQKDGFETKFYQQTGVFLLKKDESQLESLFALADKRRLESPLIGDLQ  122
            RLGADFY +L+  DL++DGF T  FYQQ G+++LKK E +L   L+ LA   R++ESP+IG+L
Sbjct:   62 RLGADFYQQLINDLKEDGFATDFYQQNGIYVLKKQEEKLRDLYELALARKVESPIIGELA  121

Query:  123 ILNKSEANTHFPELDGYEQLLYASGGARVEGADLTRILLEASGVNVIKDEVHFTITDNGF  182
            I N+ E    F  L G++ LYASG ARVEGA L    LL+ASG VI+ +V       +G+
Sbjct:  122 IKNRKELGNDFKGLIGFDNCLYASGAARVEGAALCETLLKASGYPVIRQKVTLKQQGSGY  181

Query:  183 RVQGIDFDKLVLASGAWLAKILDEHNYQVDVRPQKGQLRDYYFSNINTGKYPVVMPEGEL  242
            + G FD+++LA+GAWL +L   YQVDVRPQKGQL DY  +I +   YPVVMPEGE+
Sbjct:  182 EIAGHYFDQVILAAGAWLPDLLRPLGYQVDVRPQKGQLLDYDVHHIISDTYPVVMPEGEI  241

Query:  243 DIIPFDNGKVSVGASHENDMAFDLNIDFKVLDKFEEQAIGYFPQLKKADTTSERVGIRAY  302
            D+IPF+ GK+SVG SHEND  +DL  D++VL K E QA+ Y P LK+A    + RVGIRAY
Sbjct:  242 DLIPFNQGKISVGTSHENDKGYDLEPDWQVLKKLEMQALTYLPLLKEATQKTCRVGIRAY  301

Query:  303 TSDFSPFFGPVPCMEGAYAASGLGSTGLTVGPLIGYELCQLILNKENQLNLEDYDITKYV  362
            TSD+SPF+G V   ++   Y ASGLGS+GLTVGPLIGYEL QL+L  E   L   DY   Y+
Sbjct:  302 TSDYSPFYGQVSGLKNLYTASGLGSSGLTVGPLIGYELAQLLLGHEGLLTPSDYSPEPYL  361
```

Based on this analysis, it was predicted that these proteins and their epitopes could be useful antigens for vaccines or diagnostics.

A related GBS gene <SEQ ID 8679> and protein <SEQ ID 8680> were also identified. Analysis of this protein sequence reveals the following:

```
Lipop Possible site: -1 Crend: 2
McG: Discrim Score: 4.44
GvH: Signal Score (-7.5): 0.81
Possible site: 41
>>> Seems to have a cleavable N-term signal seq.
ALOM program count: 0           value: 7.32            threshold: 0.0
PERIPHERAL                      Likelihood = 7.32      153
modified ALOM score: -1.96
```

-continued
```
*** Reasoning Step: 3

----- Final Results -----
                    bacterial outside --- Certainty = 0.3000 (Affirmative) < succ>
                   bacterial membrane --- Certainty = 0.0000 (Not Clear)   < succ>
                  bacterial cytoplasm --- Certainty = 0.0000 (Not Clear)   < succ>
```

The protein has homology with the following sequences in
the databases:

```
45.2/62.7% over 163aa
Bacillus subtilis
EGAD|109026|hypothetical protein Insert characterized
SP|032159|YURR_BASCU HYPOTHETICAL 39.4 KDA OXIDOREDUCTASE IN HOM-MRGA INTERGENIC
REGION. Insert characterized.
GP|2635760|emb|CAB15253.1||Z99120 similar to opine catabolism Insert characterized
PIR|A70019|A70019 opine catabolism homolog yurR-Insert characterized
ORF02167(301-792 of 1161)
EGAD|109026|BS3258(1-164 of 372) hypothetical protein {Bacillus subtilis}
SP|032159|YURR_BACSU HYPOTHETICAL 39.4 KDA OXIDOREDUCTASE IN HOM-MRGA INTERGENIC
REGION. GP|2635760|emb|CAB15253.1||Z99120 similar to opine catabolism {Bacillus
subtilis} PIR|A70019|A70019 opine catabolism homolog yurR-Bacillus subtilis
% Match = 16.6
% Identity = 45.2    % Similarity = 62.7
Matches = 75   Mismatches = 58   Conservative Sub.s = 29
       228         258         288         318         348         378                435
       SYYD*AVET*KRLGYFSFRE*SSNKSLLPYVGAIMKKIAIIGAGAVGATLAYYLSKEKDIQVTVFDYGV-GQATKAAAGI
                            ||    |:|||  :||:  ||:|:|       :|||  |     ||||  |||||
                            MKSYIIVGAGILGASTAYHLAKT-GARVTVIDRKEPGQATDAAAGI
                                             10          20          30          40
       465         495         525         555         585         615         645         675
       ISPWFSKRRNKAWYRMARLGADFYSKLVTDLQKDGFETKFYQQTGVFLLKKDESQLESLFALADKRRLESPLIGDLQILN
       :  ||:|:|||   ||::|:   ||    |:   |:|||      |::   |    : :   |   |  ||  ::|  |:
       VCPWLSQRRNQDWYQLAKGGARYYKDLIHQLEKDGESDTGYKRVGAISIHTDASKLDKMEERAYKRREDAPEIGDITRLS
              60          70          80          90         100         110         120
       705         732         762         792         822         852         882         912
       KSEANTHFPEL-DGYEQLLYASGGARVEGADLTRILXEASGVNVIKDESHFTITDKWLSCSRN*F**TCLASGAPAS*IL
       ||      ||| |||||  ::  || |||| | |  |   |:                     |           :
       ASETKKLFPILADGYE-SVHISGAARVNGRALCRSLLSAAEKRGATVIKGNASLLFENGTVTGVQTDTKQFAADAVIVTA
              140         150         160         170         180         190         200
```

SEQ ID 8680 (GBS290) was expressed in *E. coli* as a His-fusion product. SDS-PAGE analysis of total cell extract is shown in FIG. 57 (lane 6; MW 22 kDa). It was also expressed in *E. coli* as a GST-fusion product. SDS-PAGE analysis of total cell extract is shown in FIG. 77 (lane 4; MW 47 kDa).

GBS290-GST was purified as shown in FIG. 226, lane 9.

Based on this analysis, it was predicted that these proteins and their epitopes could be useful antigens for vaccines or diagnostics.

EXAMPLE 875

A DNA sequence (GBSx0927) was identified in *S. agalactiae* <SEQ ID 2657> which encodes the amino acid sequence <SEQ ID 2658>. Analysis of this protein sequence reveals the following:

```
       Possible site: 20
       >>> Seems to have no N-terminal signal sequence
       INTEGRAL    Likelihood = -2.18         Transmembrane        38-54 (36-54)

----- Final Results -----
                       bacterial membrane --- Certainty = 0.1871 (Affirmative) < succ>
                         bacterial outside --- Certainty = 0.0000 (Not Clear)   < succ>
                       bacterial cytoplasm --- Certainty = 0.0000 (Not Clear)   < succ>
```

The protein has homology with the following sequences in the GENPEPT database.

```
       >GP: AAD19913 GB: AF105113 glucose-1-phosphate thymidylyl transferase
       [Streptococcus pneumoniae]
       Identities = 262/289 (90%), Positives = 276/289 (94%)

Query:  1  MKGIILAGGSGTRLYPLTRAASKQLMPIYDKPMIYYPLSVLMLAGIKEILIISTPQDLPR   60
                  MKGIILAGGSGTRLYPLTRAASKQLMP+YDKPMIYYPLS LMLAGIK+ILIISTPQDLPR
       Sbjct:  1  MKGIILAGGSGTRLYPLTRAASKQLMPVYDKPMIYYPLSTLMLAGIKDILIISTPQDLPR   60
```

-continued

```
Query:   61 FEDMLGDGSELGISLSYAEQPSPDGLAQAFIIGEDFIGDDHVALVLGDNIYHGPGLSAML 120
            F+D+L DGSE GI LSYAEQPSPDGLAQAF+IGE+FIGDD VAL+LGDNIYHGPGLS ML
Sbjct:   61 FKDLLLDGSEFGIKLSYAEQPSPDGLAQAFLIGEEFIGDDSVALILGDNIYHGPGLSTML 120

Query:  121 QRAASKESGATVFGYQVKDPERFGVVEFDTDMNAISIEEKPAQPKSNYAVTGLYFYDNDV 180
            Q+AA KE GATVFGYQVKDPERFGVVEFDTDMNAISIEEKP P+SNYAVTGLYFYDNDV
Sbjct:  121 QKAAKKEKGATVFGYQVKDPERFGVVEFDTDMNAISIEEKPEYPRSNYAVTGLYFYDNDV 180

Query:  181 VEIAKNIKPSPRGELEITDVNKAYLDRGDLSVELMGRGFAWLDTGTHESLLEAAQYIETV 240
            VEIAK IKPS RGELEITDVNKAYL+RGDLSVELMGRGFAWLDTGTHESLLEA+QYIETV
Sbjct:  181 VEIAKQIKPSARGELEITDVNKAYLNRGDLSVELMGRGFAWLDTGTHESLLEASQYIETV 240

Query:  241 QRMQNVQVANLEEIAYRMGYITREQVLELAQPLKKNEYGQYLLRLIGEA 289
            QRMQNVQVANLEEI+YRMGYI+RE VLELAQPLKKNEYG+YLLRLIGEA
Sbjct:  241 QRMQNVQVANLEEISYRMGYISREDVLELAQPLKKNEYGRYLLRLIGEA 289
```

A related DNA sequence was identified in *S. pyogenes* <SEQ ID 2659> which encodes the amino acid sequence <SEQ ID 2660>. Analysis of this protein sequence reveals the following:

```
Possible site: 20
>>> Seems to have no N-terminal signal sequence

----- Final Results -----
            bacterial cytoplasm --- Certainty = 0.1585 (Affirmative) < succ>
             bacterial membrane --- Certainty = 0.0000 (Not Clear) < succ>
              bacterial outside --- Certainty = 0.0000 (Not Clear) < succ>

RGD motif: 207-209
```

The protein has homology with the following sequences in the databases:

```
>GP: AAC69538 GB: AF057294 Cps23fO [Streptococcus pneumoniae]
Identities = 263/289 (91%), Positives = 276/289 (95%)

Query:    1 MKGIILAGGSGTRLYPLTRAASKQLMPIYDKPMIYYPLSTLMLAGIKDVLIISTPQDLPR  60
            MKGIILAGGSGTRLYPLTRAASKQLMP+YDKPMIYYPLSTLMLAGI+D+LIISTPQDLPR
Sbjct:    1 MKGIILAGGSGTRLYPLTRAASKQLMPVYDKPMIYYPLSTLMLAGIRDILIISTPQDLPR  60

Query:   61 FEELLGDGSEFGISLSYKEQPSPDGLAQAFIIGEEFIGDDRVALILGDNIYHGNGLTKML 120
            F+ELL DGSEFGI LSY EQPSPDGLAQAFIIGEEFIGDD VALILGDNIYHG GL+ ML
Sbjct:   61 FKELLQDGSEFGIKLSYAEQPSPDGLAQAFIIGEEFIGDDSVALILGDNIYHGPGLSTML 120

Query:  121 QKAAAKEKGATVFGYQVKDPERFGVVEFDENMNAISIEEKPEVPKSHFAVTGLYFYDNDV 180
            QKAA KEKGATVFGY VKDPERFGVVEFDENMNAISIEEKPE P+S++AVTGLYFYDNDV
Sbjct:  121 QKAAKKEKGATVFGYHVKDPERFGVVEFDENMNAISIEEKPEYPRSNYAVTGLYFYDNDV 180

Query:  181 VEIAKNIKPSARGELEITDVNKAYLERGDLSVELMGRGFAWLDTGTHESLLEAAQYIETV 240
            VEIAK+IKPS RGELEITDVNKAYL+RGDLSVELMGRGFAWLDTGTHESLLEA+QYIETV
Sbjct:  181 VEIAKSIKPSPRGELEITDVNKAYLDRGDLSVELMGRGFAWLDTGTHESLLEASQYIETV 240

Query:  241 QRLQNAQVANLEEIAYRMGYISKEDVHKLAQSLKKNEYGQYLLRLIGEA 289
            QR+QN QVANLEEIAYRMGYIS+EDV  LAQSLKKNEYGQYLLRLIGEA
Sbjct:  241 QRMQNVQVANLEEIAYRMGYISREDVLALAQSLKKNEYGQYLLRLIGEA 289
```

An alignment of the GAS and GBS proteins is shown below.

```
Identities = 257/289 (88%), Positives = 274/289 (93%)

Query:    1 MKGIILAGGSGTRLYPLTRAASKQLMPIYDKPMIYYPLSVLMLAGIKEILIISTPQDLPR  60
            MKGIILAGGSGTRLYPLTRAASKQLMPIYDKPMIYYPLS LMLAGIK++LIISTPQDLPR
Sbjct:    1 MKGIILAGGSGTRLYPLTRAASKQLMPIYDKPMIYYPLSTLMLAGIKDVLIISTPQDLPR  60

Query:   61 FEDMLGDGSELGISLSYAEQPSPDGLAQAFIIGEDFIGDDHVALVLGDNIYHGPGLSAML 120
            FE++LGDGSE GISLSY EQPSPDGLAQAFIIGE+FIGDD VAL+LGDNIYHG GL+ ML
Sbjct:   61 FEELLGDGSEFGISLSYKEQPSPDGLAQAFIIGEEFIGDDRVALILGDNIYHGNGLTKML 120
```

```
-continued
Query: 121 QRAASKESGATVFGYQVKDPERFGVVEFDTDMNAISIEEKPAQPKSNYAVTGLYFYDNDV 180
           Q+AA+KE GATVFGYQVKDPERFGVVEFD +MNAISIEEKP  PKS++AVTGLYFYDNDV
Sbjct: 121 QKAAAKEKGATVFGYQVKDPERFGVVEFDENMNAISIEEKPEVPKSHFAVTGLYFYDNDV 180

Query: 181 VEIAKNIKPSPRGELEITDVNKAYLDRGDLSVELMGRGFAWLDTGTHESLLEAAQYIETV 240
           VEIAKNIKPS RGELEITDVNKAYL+RGDLSVELMGRGFAWLDTGTHESLLEAAQYIETV
Sbjct: 181 VEIAKNIKPSARGELEITDVNKAYLERGDLSVELMGRGFAWLDTGTHESLLEAAQYIETV 240

Query: 241 QRMQNVQVANLEEIAYRMGYITREQVLELAQPLKKNEYGQYLLRLIGEA 289
           QR+QN QVANLEEIAYRMGYI++E V +LAQ LKKNEYGQYLLRLIGEA
Sbjct: 241 QRLQNAQVANLEEIAYRMGYISKEDVHKLAQSLKKNEYGQYLLRLIGEA 289
```

There is also homology to SEQ ID 858.

SEQ ID 2658 (GBS296) was expressed in *E. coli* as a His-fusion product. SDS-PAGE analysis of total cell extract is shown in FIG. 43 (lane 5; MW 35.4 kDa).

GBS296-His was purified as shown in FIG. 203, lane 7.

Based on this analysis, it was predicted that these proteins, and their epitopes could be useful antigens for vaccines or diagnostics.

EXAMPLE 876

A DNA sequence (GBSx0929) was identified in *S. agalactiae* <SEQ ID 2661> which encodes the amino acid sequence <SEQ ID 2662>. Analysis of this protein sequence reveals the following:

```
Possible site: 18
>>> Seems to have no N-terminal signal sequence

----- Final Results -----
            bacterial cytoplasm --- Certainty = 0.2635 (Affirmative) < succ>
            bacterial membrane  --- Certainty = 0.0000 (Not Clear)  < succ>
            bacterial outside   --- Certainty = 0.0000 (Not Clear)  < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 877

A DNA sequence (GBSx0930) was identified in *S. agalactiae* <SEQ ID 2663> which encodes the amino acid sequence <SEQ ID 2664>. This protein is predicted to be unnamed protein product. Analysis of this protein sequence reveals the following:

```
Possible site: 56
>>> Seems to have no N-terminal signal sequence

----- Final Results -----
            bacterial cytoplasm --- Certainty = 0.1868 (Affirmative) < succ>
            bacterial membrane  --- Certainty = 0.0000 (Not Clear)  < succ>
            bacterial outside   --- Certainty = 0.0000 (Not Clear)  < succ>
```

A related DNA sequence was identified in *S. pyogenes* <SEQ ID 2665> which encodes the amino acid sequence <SEQ ID 2666>. Analysis of this protein sequence reveals the following:

```
Possible site: 30
>>> Seems to have no N-terminal signal sequence

----- Final Results -----
            bacterial cytoplasm --- Certainty = 0.2818 (Affirmative) < succ>
             bacterial membrane --- Certainty = 0.0000 (Not Clear)  < succ>
              bacterial outside --- Certainty = 0.0000 (Not Clear)  < succ>
RGD motif: 29-31
```

The protein has homology with the following sequences in the databases:

```
>GP: AAC69539 GB: AF057294 Cps23fP [Streptococcus pneumoniae]
Identities = 168/197 (85%), Positives = 183/197 (92%)

Query:    1 MTETFFDKPLACREIKEIPGLLEFDIPVRGDNRGWFKENFQKEKMLPIGFPERFFEEGKL    60
            MT+ FF K LA R+++ IPG+LEFDIPV GDNRGWFKENFQKEKMLP+GFPE FF EGKL
Sbjct:    1 MTDNFFGKTLAARKVEAIPGMLEFDIPVHGDNRGWFKENFQKEKMLPLGFPESFFAEGKL    60

Query:   61 QNNVSFSRQHVLRGLHAEPWDKYISVADDGKVLGAWVDLREGETFGNVYQTVIDASKGMF   120
            QNNVSFSR++VLRGLHAEPWDKYISVAD GKVLG+WVDLREGETFGN YQTVIDASKG+F
Sbjct:   61 QNNVSFSRKNVLRGLHAEPWDKYISVADGGKVLGSWVDLREGETFGNTYQTVIDASKGIF   120

Query:  121 VPRGVANGFQVLSETVSYSYLVNDYWALDLKPKYAFVNYADPSLGITWENLAAAEVSEAD   180
            VPRGVANGFQVLS+TVSYSYLVNDYWAL+LKPKYAFVNYADPSLGI WEN+A AEVSEAD
Sbjct:  121 VPRGVANGFQVLSDTVSYSYLVNDYWALELKPKYAFVNYADPSLGIEWENIAEAEVSEAD   180

Query:  181 KNHPLLSDVKPLKPKDL                                             197
            K+HPLL DVKPLK +DL
Sbjct:  181 KHHPLLKDVKPLKKEDL                                             197
```

An alignment of the GAS and GBS proteins is shown below.

```
Identities = 157/197 (79%), Positives = 180/197 (90%)

Query:    1 MTEQFFDKELTCRPIEAIPGLLEFDIPVRGDNRGWFKENFQKEKMIPLGFPESFFEADKL    60
            MTE FFDK L CR I+ IPGLLEFDIPVRGDNRGWFKENFQKEKM+P+GFPE FFE  KL
Sbjct:    1 MTETFFDKPLACREIKEIPGLLEFDIPVRGDNRGWFKENFQKEKMLPIGFPERFFEEGKL    60

Query:   61 QNNISFNKKNTLRGLHAEPWDKYVSIADEGRVIGTWVDLREGDSFGNVYQTIIDASKGIF   120
            QNN+SF++++ LRGLHAEPWDKY+S+AD+G+V+G WVDLREG++FGNVYQT+IDASKG+F
Sbjct:   61 QNNVSFSRQHVLRGLHAEPWDKYISVADDGKVLGAWVDLREGETFGNVYQTVIDASKGMF   120

Query:  121 VPRGVANGFQVLSDKAAYTYLVNDYWALELKPKYAFVNYADPNLGIQWENLEEAEVSEAD   180
            VPRGVANGFQVLS+   +Y+YLVNDYWAL+LKPKYAFVNYADP+LGI WENL  AEVSEAD
Sbjct:  121 VPRGVANGFQVLSETVSYSYLVNDYWALDLKPKYAFVNYADPSLGITWENLAAAEVSEAD   180

Query:  181 KNHPLLKDVKPLKKEDL                                             197
            KNHPLL DVKPLK +DL
Sbjct:  181 KNHPLLSDVKPLKPKDL                                             197
```

Based on this analysis, it was predicted that these proteins and their epitopes could be useful antigens for vaccines or diagnostics.

EXAMPLE 878

A DNA sequence (GBSx0931) was identified in *S. agalactiae* <SEQ ID 2667> which encodes the amino acid sequence <SEQ ID 2668>. Analysis of this protein sequence reveals the following:

```
Possible site: 14
>>> Seems to have no N-terminal signal sequence

----- Final Results -----
            bacterial cytoplasm --- Certainty = 0.3019 (Affirmative) < succ>
```

```
              bacterial membrane --- Certainty = 0.0000 (Not Clear) < succ>
              bacterial outside  --- Certainty = 0.0000 (Not Clear) < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 879

A DNA sequence (GBSx0932) was identified in *S. agalactiae* <SEQ ID 2669> which encodes the amino acid sequence <SEQ ID 2670>. Analysis of this protein sequence reveals the following:

```
Possible site: 37
>>> Seems to have an uncleavable N-term signal seq

----- Final Results -----
              bacterial membrane  --- Certainty = 0.0000 (Not Clear) < succ>
              bacterial outside   --- Certainty = 0.0000 (Not Clear) < succ>
              bacterial cytoplasm --- Certainty = 0.0000 (Not Clear) < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 880

A DNA sequence (GBSx0933) was identified in *S. agalactiae* <SEQ ID 2671> which encodes the amino acid sequence <SEQ ID 2672>. Analysis of this protein sequence reveals the following:

```
Possible site: 38
>>> Seems to have no N-terminal signal sequence

----- Final Results -----
              bacterial cytoplasm --- Certainty = 0.0957 (Affirmative) < succ>
              bacterial membrane  --- Certainty = 0.0000 (Not Clear)   < succ>
              bacterial outside   --- Certainty = 0.0000 (Not Clear)   < succ>
```

A related GBS nucleic acid sequence <SEQ ID 9367> which encodes amino acid sequence <SEQ ID 9368> was also identified.

The protein is similar to the dTDP-glucose-4,6-dehydratase from *S. mutans*:

```
>GP: BAA11249 GB: D78182 dTDP-glucose-4,6-dehydratase [Streptococcus
mutans]
Identities = 290/310 (93%), Positives = 304/310 (97%)

Query:    1 MTYAGNRANIEAILGDRVELVVGDIADAELVDKLAAKADAIVHYAAESHNDNSLNDPSPF   60
            +TYAGN AN+E ILGDRVELVVGDIAD+ELVDKLAAKADAIVHYAAESHNDNSL DPSPF
Sbjct:   39 LTYAGNHANLEEILGDRVELVVGDIADSELVDKLAAKADAIVHYAAESHNDNSLKDPSPF   98

Query:   61 IHTNFIGTYTLLEAARKYDIRFHHVSTDEVYGDLPLREDLPGNGEGPGEKFTAETKYNPS  120
            I+TNF+GTYTLLEAARKYDIRFHHVSTDEVYGDLPLREDLPG+GEGPGEKFTAETKYNPS
Sbjct:   99 IYTNFVGTYTLLEAARKYDIRFHHVSTDEVYGDLPLREDLPGHGEGPGEKFTAETKYNPS  158

Query:  121 SPYSSTKAASDLIVKAWVRSFGVKATISNCSNNYGPYQHIEKFIPRQITNILAGIKPKLY  180
            SPYSSTKAASDLIVKAWVRSFGVKATISNCSNNYGPYQHIEKFIPRQITNIL+GIKPKLY
Sbjct:  159 SPYSSTKAASDLIVKAWVRSFGVKATISNCSNNYGPYQHIEKFIPRQITNILSGIKPKLY  218
```

-continued

```
Query: 181 GEGKNVRDWIHTNDHSTGVWAILTKGRIGETYLIGADGEKNNKEVLELILEKMGQPKDAY  240
           GEGKNVRDWIHTNDHSTGVWAILTRGRIGETYLIGADGEKNNKEVLELILSKM QPKDAY
Sbjct: 219 GEGKNVRDWIHTNDHSTGVWAILTKGRIGETYLIGADGEKNNKEVLELILEKMSQPKDAY  278

Query: 241 DHVTDRAGHDLRYAIDSTKLREELGWEPQFTNFSEGLEETINWYTENQDWWKAEKEAVEA  300
           DHVTDRAGHDLRYAIDSTKLREELGW+PQFTNF EGLE+TI WYTE++DWWKAEKEAVEA
Sbjct: 279 DHVTDRAGHDLRYAIDSTKLREELGWKPQFTNFEEGLEDTIKWYTEHEDWWKAEKEAVEA  338

Query: 301 NYAKTQEVIN                                                   310
           NYAKTQ+++N
Sbjct: 339 NYAKTQKILN                                                   348
```

A related DNA sequence was identified in *S. pyogenes* <SEQ ID 2673> which encodes the amino acid sequence <SEQ ID 2674>. Analysis of this protein sequence reveals the following:

```
Possible site: 40
>>> Seems to have no N-terminal signal sequence

----- Final Results -----
              bacterial cytoplasm --- Certainty = 0.1150 (Affirmative) < succ>
                bacterial membrane --- Certainty = 0.0000 (Not Clear) < succ>
                  bacterial outside --- Certainty = 0.0000 (Not Clear) < succ>
```

An alignment of the GAS and GBS proteins is shown below.

```
Identities = 300/309 (97%), Positives = 303/309 (97%)

Query:   1 MTYAGNRANIEAILGDRVELVVGDIADAELVDKLAAKADAIVHYAAESHNDNSLNDPSPF   60
           +TYAGNRANIEAILGDRVELVVGDIADAELVDKLAAK DAIVHYAAESHNDNSL DPSPF
Sbjct:  37 LTYAGNRANIEAILGDRVELVVGDIADAELVDKLAAKTDAIVHYAAESHNDNSLEDPSPF   96

Query:  61 IHTNFIGTYTLLEAARKYDIRFHHVSTDEVYGDLPLREDLPGNGEGPGEKFTAETKYNPS  120
           IHTNFIGTYTLLEAARKYDIRFHHVSTDEVYGDLPLREDLPG GEGPGEKFTAETKYNPS
Sbjct:  97 IHTNFIGTYTLLEAARKYDIRFHHVSTDEVYGDLPLREDLPGQGEGPGEKFTAETKYNPS  156

Query: 121 SPYSSTKAASDLIVKAWVRSFGVKATISNCSNNYGPYQHIEKFIPRQITNILAGIKPKLY  180
           SPYSSTKAASDLIVKAWVRSFGVKATISNCSNNYGPYQHIEKFIPRQITNILAGIKPKLY
Sbjct: 157 SPYSSTKAASDLIVKAWVRSFGVKATISNCSNNYGPYQHIEKFIPRQITNILAGIKPKLY  216

Query: 181 GEGKNVRDWIHTNDHSTGVWAILTKGRIGETYLIGADGEKNNKEVLELILEKMGQPKDAY  240
           GEGKNVRDWIHTNDHSTGVWAILTKGRIGETYLIGADGEKNNKEVLELILEKMGQPKDAY
Sbjct: 217 GEGKNVRDWIHTNDHSTGVWAILTKGRIGETYLIGADGEKNNKEVLELILEKMGQPKDAY  276

Query: 241 DHVTDRAGHDLRYAIDSTKLREELGWEPQFTNFSEGLEETINWYTENQDWWKAEKEAVEA  300
           DHVTDRAGHDLRYAIDSTKLREELGWEPQFTNFSEGLEETI WYTEN+ WWKAEK+AVEA
Sbjct: 277 DHVTDRAGHDLRYAIDSTKLREELGWEPQFTNFSEGLEETIKWYTENETWWKAEKDAVEA  336

Query: 301 NYAKTQEVI                                                    309
            YAKTQEVI
Sbjct: 337 KYAKTQEVI                                                    345
```

Based on this analysis, it was predicted that these proteins and their epitopes could be useful antigens for vaccines or diagnostics.

EXAMPLE 881

A DNA sequence (GBSx0935) was identified in *S. agalactiae* <SEQ ID 2675> which encodes the amino acid sequence <SEQ ID 2676>. Analysis of this protein sequence reveals the following:

```
Possible site: 36
>>> Seems to have a cleavable N-term signal seq.
```

```
----- Final Results -----
          bacterial outside --- Certainty = 0.3000 (Affirmative) < succ>
          bacterial membrane --- Certainty = 0.0000 (Not Clear)  < succ>
          bacterial cytoplasm --- Certainty = 0.0000 (Not Clear)  < succ>
```

The protein has no significant homology with any sequences in the GENPEPT database.

No corresponding DNA sequence was identified in S. pyogenes.

Based on this analysis, it was predicted that this protein and its epitopes, could be useful antigens for vaccines or diagnostics.

EXAMPLE 882

A DNA sequence (GBSx0936) was identified in S. agalactiae <SEQ ID 2677> which encodes the amino acid sequence <SEQ ID 2678>. Analysis of this protein sequence reveals the following:

```
Possible site: 35
>>> Seems to have an uncleavable N-term signal seq
INTEGRAL    Likelihood = -15.55         Transmembrane    13-29 (3-40)

----- Final Results -----
          bacterial membrane --- Certainty = 0.7220 (Affirmative) < succ>
          bacterial outside --- Certainty = 0.0000 (Not Clear)  < succ>
          bacterial cytoplasm --- Certainty = 0.0000 (Not Clear)  < succ>
```

The protein has no significant homology with any sequences in the GENPEPT database.

No corresponding DNA sequence was identified in S. pyogenes.

Based on this analysis, it was predicted that this protein and its epitopes, could be useful antigens for vaccines or diagnostics.

EXAMPLE 883

A DNA sequence (GBSx0937) was identified in S. agalactiae <SEQ ID 2679> which encodes the amino acid sequence <SEQ ID 2680>. Analysis of this protein sequence reveals the following:

```
Possible site: 15
>>> Seems to have no N-terminal signal sequence

----- Final Results -----
          bacterial cytoplasm --- Certainty = 0.2882 (Affirmative) < succ>
          bacterial membrane --- Certainty = 0.0000 (Not Clear)  < succ>
          bacterial outside --- Certainty = 0.0000 (Not Clear)  < succ>
```

The protein has no significant homology with any sequences in the GENPEPT database.

No corresponding DNA sequence was identified in S. pyogenes.

Based on this analysis, it was predicted that this protein and its epitopes, could be useful antigens for vaccines or diagnostics.

EXAMPLE 884

A DNA sequence (GBSx0938) was identified in S. agalactiae <SEQ ID 2681> which encodes the amino acid sequence <SEQ ID 2682>. This protein is predicted to be hyaluronate lyase. Analysis of this protein sequence reveals the following:

```
Possible site: 30
>>> Seems to have a cleavable N-term signal seq.
```

-continued

```
----- Final Results -----
             bacterial outside --- Certainty = 0.3000 (Affirmative) < succ>
           bacterial membrane --- Certainty = 0.0000 (Not Clear)   < succ>
          bacterial cytoplasm --- Certainty = 0.0000 (Not Clear)   < succ>
```

A related DNA sequence was identified in *S. pyogenes* <SEQ ID 2683> which encodes the amino acid sequence <SEQ ID 2684>. Analysis of this protein sequence reveals the following:

```
Possible site: 46
>>> Seems to have a cleavable N-term signal seq.

----- Final Results -----
             bacterial outside --- Certainty = 0.3000 (Affirmative) < succ>
           bacterial membrane --- Certainty = 0.0000 (Not Clear)   < succ>
          bacterial cytoplasm --- Certainty = 0.0000 (Not Clear)   < succ>
```

A related sequence was also identified in GAS <SEQ ID 9099> which encodes the amino acid sequence <SEQ ID 9100>. Analysis of this protein sequence reveals the following:

```
Possible cleavage site: 23
>>> Seems to have a cleavable N-term signal seq.

----- Final Results -----
             bacterial outside --- Certainty = 0.300 (Affirmative) < succ>
           bacterial membrane --- Certainty = 0.000 (Not Clear)    < succ>
          bacterial cytoplasm --- Certainty = 0.000 (Not Clear)    < succ>
```

An alignment of the GAS and GBS proteins is shown below.

```
Identities = 359/771 (46%), Positives = 492/771 (63%), Gaps = 50/771 (6%)

Query: 307 PNAT--GSTTVKISDKSGKIIKEVPLSVTASTED-                     364
           NFTKLLDKWNDVTIGNHVYDTNDSNM
           PN  T    + T+  +D    K+++           +D +T+LLD+WN +   GN   YD   +
           +M
Sbjct:  65 PNNTYFQTQTLTTTDSEKKVVQP-------QQKDYYTELLDQWNSIIAGNDAYDKT-   117
           NPDM Query: 365 QKLNQKLDETNAKNIEAIKL-----DSNRTFLWKDLDNLNNSAQLTATYR-         419
           RLEDLAKQIT
               + K   E +A+NI   IK          NRT+LW+   +  +  SA  +T TYR  +E  +AK-
           QIT
Sbjct: 118 VTFHNKA-EKDAQNI--IKSYQGPDHENRTYLWEHAKDYSASANI-              174
           TKTYRNIEKIAKQIT Query: 420 NPHSTIYKNEKAIRTVKESLAWLHQNFYNVNKDI------EGSANWWD-          473
           FEIGVPRSITGT
           NP  S    Y++ KAI    VK+  +A+++++  YN++++       E    NWW  +EIG  PR+
           I  T
Sbjct: 175 NPESCYYQDSKAIAIVKDGMAFMYE-                                 234
           HAYNLDRENHQTTGKENKENWWVYEIGTPRAINNT Query: 474 LALMYNYFTDAEIKTYTDPIEHFVPDAGFFRKTLVN--PFKALGGNLVDMGRVKI-  531
           IEGLL
           L+LMY YFT   EI   YT  PIE  FVPD     FR    N    PF+A   GNL+DMGRVK+
           I  G+L
Sbjct: 235 LSLMYPYFTQEEILKYTAPIEKFVPDP-                              294
           TRFRVRAANFSPFEANSGNLIDMGRVKLISGIL
```

```
                                        -continued
Query: 532 RKDNTIIEKTSHSLKNLFTTATKAEGFYADGSYIDHT----------NVAYT-        580
           GAYGNVL
           RKD+  I   T  +++ +FT  +  GFY DGS IDH              +AYT-
           GAYGNVL
Sbjct: 295 RKDDLEISDTIKAIEKVFTLVDEGNG-                                   354
           FYQDGSLIDHVVTNAQSPLYKKGIAYTGAYGNVL Query: 581 IDGLTQLLPIIQETDYKISNQELDMVYK-                                 640
           WINQSFLPLIVKGELMDMSRGRSISREAASSH
           IDGL+QL+PIIQ+T   I    ++  +Y WIN SF P+IV+GE+MDM+RGRSIS-
           R  A SH
Sbjct: 355 IDGLSQLIPIIQKTKSPIKADKMATIYH-                                 414
           WINHSFFPIIVRGEMMDMTRGRSISRFNAQSH Query: 641 AAAVEVLRGFLRLANMSNEERNLDLKSTIKTIITS-NKFYNVFNNLKSYSDIAN-       699
           MNKLLN
            A +E LR   LR+A+MS E    L LK+ IKT++T  N FYNV++NLK+Y DI   M +
           LL+
Sbjct: 415 VAGIEALRAILRIADMSEEPHRLALK-                                   474
           TRIKTLVTQGNAFYNVYDNLKTYHDIKLMKELLS Query: 700 DSTVATKPLKSNLSTFNSMDRLAYY-                                    759
           NAEKDFGFALSLHSKRTLNYEGMNDENTRGWYTGD
           D++V    + L S  +++FNSMD+LA YN +  DF F LS+  S  RT NYE MN+EN   GW+
           T D
Sbjct: 475 DTSVPVQKLDSYVASFNSMDKLALYNN-                                  534
           KHDFAFGLSMFSNRTQNYEAMNNENLHGWFTSD Query: 760 GMFYLYNSDQSHYSNHFWPTVNPYK-                                    819
           MAGTTEKDAKREDTTKDFMSKHSKDAKEKTGQVTG
           GMFYLYN+D  HYS ++W TVNPY++ GTTE + K  + T +    + K    ++
           G +TG
Sbjct: 535 GMFYLYNNDLGHYSENYWATVNPYRLPGTTETEQKPLEGTPE----NIKTNYQQVG-     589
           MTG Query: 820 ASD--FVGSVKLNDHFALAAMDFTNWDRTL-                               877
           TAQKGWVILNDKIVFLGSNIKNTNGIGNVS
            SD   FV S KLN+  ALAAM FTNW+++LT   KGW IL +KI+F+GSNIKN  +
Sbjct: 590 LSDDAFVASKKLNNTSALAAMTFTNWNKSLTLNKGWPILGNKIIFVGSNIKNQSS-      648
           HKAY Query: 878 TTIDQRKDDSKTPYTTYVNGK-                                        937
           TVDLKQASSQQFTDTKSVFLESKEPGRNIGYIFFKNSTI
           TTI+QRK++ K PY +YVN + VDL         FT+TKS+FLES +P +NIGY FFK +
           T+
Sbjct: 649 TTIEQRKENQKYPYCSYVNNQPVDLNN-QLVDFTNTKSIFLESDDPAQNIGYY-        707
           FFKPTTL Query: 938 DIERKEQTGTWNSINRTSKNTSI---VSNPFITISQKHDNKGDSYDYMMVP-          994
           NIDRTSFDK
             I  +  QTG W +I    K+        VSN FITI Q H   GD Y YMM+PN+
           R  F+
Sbjct: 708 SISKALQTGKWQNIKADDKS-                                         767
           PEAIKEVSNTFITIMQNHTQDGDRYAYMMLPNMTRQEFET Query: 995 LANSKEVELLENSSKQQVIYDKNSQTWAVIKHDNQESLINNQFKMNKAGLY          1045
             +   +++LLEN+ K   +YD +SQ    VI +   + ++ +N    ++   G Y
Sbjct: 768 YISKLDIDLLENNDKLAAVYDHDSQQMHVIHYGKKATMFSNH-NLSHQGFY          817
```

Figure 6:
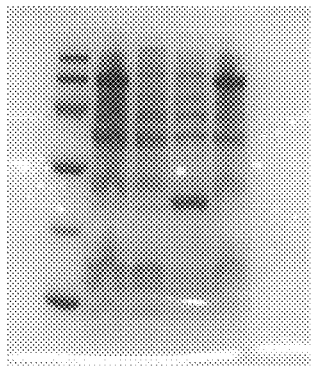

SEQ ID 2682 (GBS89) was expressed in *E. coli* as a His-fusion product. SDS-PAGE analysis of total cell extract is shown in FIG. 6 (lane 3; MW 118 kDa).

The His-fusion protein was purified as shown in FIG. 190, lane 4.

Based on this analysis, it was predicted that these proteins and their epitopes could be useful antigens for vaccines or diagnostics.

EXAMPLE 885

A DNA sequence (GBSx0939) was identified in *S. agalactiae* <SEQ ID 2685> which encodes the amino acid sequence <SEQ ID 2686>. This protein is predicted to be mutator mutt protein. Analysis of this protein sequence reveals the following:

```
              Possible site: 42

>>> Seems to have no N-terminal signal sequence

----- Final Results -----
                        bacterial cytoplasm --- Certainty = 0.3781(Affirmative) < succ>
                        bacterial membrane  --- Certainty = 0.0000(Not Clear)  < succ>
                        bacterial outside   --- Certainty = 0.0000(Not Clear)  < succ>
```

The protein has homology with the following sequences in the GENPEPT database.

```
>GP: BAA11250 GB: D78182 MutX [Streptococcus mutans]
Identities = 132/160 (82%), Positives = 146/160 (90%), Gaps = 1/160 (0%)

Query:   1 MTKLATICYIDNGKELLLLHRNKKENDVHEGKWISVGGKLEAGETPDECAKREILEETHL    60
           M KLATICYIDNG+ELLL+HRNKK NDVHEGKWISVGGKLE GE+PDECA+REI EETHL
Sbjct:   1 MIKLATICYIDNGRELLLMHRNKKPNDVHEGKWISVGGKLEKGESPDECARREIFEETHL    60

Query:  61 TVKKMDFKGVITFPEFTPGHDWYTYVFKVTDYEGELISDDESREGTLEWVPYDQVLSKPT   120
            VK+MDFKG+ITFP+FTPGHDWYTYVFKV D+EG LISD +SREGTLEWVPY+QVL+KPT
Sbjct:  61 IVKQMDFKGIITFPDFTPGHDWYTYVFKVRDFEGRLISDKDSREGTLEWVPYNQVLTKPT   120

Query: 121 WQGDYEIFKWILEDVPFFSAKFVYDEHQNLIEKTVNFYEK                      160
           W+GDYEIFKWILED PFFSAKFVY E Q L++K V FYEK
Sbjct: 121 WEGDYEIFKWILEDAPFFSAKFVYQE-QKLVDKHVIFYEK                      159
```

A related DNA sequence was identified in *S. pyogenes* <SEQ ID 2687> which encodes the amino acid sequence <SEQ ID 2688>. Analysis of this protein sequence reveals the following:

```
Possible site: 42
>>> Seems to have no N-terminal signal sequence

----- Final Results -----
              bacterial cytoplasm --- Certainty = 0.3399 (Affirmative) < succ>
              bacterial membrane  --- Certainty = 0.0000 (Not Clear)   < succ>
              bacterial outside   --- Certainty = 0.0000 (Not Clear)   < succ>
```

An alignment of the GAS and GBS proteins is shown below.

```
Identities = 131/158 (82%), Positives = 146/158 (91%)

Query:   1 MTKLATICYIDNGKELLLLHRNKKENDVHEGKWISVGGKLEAGETPDECAKREILEETHL    60
           MT+LATICYIDNG  LLLLHRNKKENDVH+GKWISVGGKLEAGETPDECA+REILEETHL
Sbjct:   1 MTQLATICYIDNGDSLLLLHRNKKENDVHKGKWISVGGKLEAGETPDECARREILEETHL    60

Query:  61 TVKKMDFKGVITFPEFTPGHDWYTYVFKVTDYEGELISDDESREGTLEWVPYDQVLSKPT   120
           TV +M FKG+ITFPEFTPGHDWYTYVFKVT +EG+LISD+ESREGTLEWVPYDQVL KPT
Sbjct:  61 TVTEMAFKGIITFPEFTPGHDWYTYVFKVTGFEGDLISDEESREGTLEWVPYDQVLEKPT   120

Query: 121 WQGDYEIFKWILEDVPFFSAKFVYDEHQNLIEKTVNFY                        158
           W+GDY+IFKWILED  FFSAKF YD++  L++K+V FY
Sbjct: 121 WEGDYDIFKWILEDRSFFSAKFTYDQNNQLMDKSVTFY                        158
```

Based on this analysis, it was predicted that these proteins and their epitopes could be useful antigens for vaccines or diagnostics.

EXAMPLE 886

A DNA sequence (GBSx0940) was identified in *S. agalactiae* <SEQ ID 2689> which encodes the amino acid sequence <SEQ ID 2690>. This protein is predicted to be MutT/nudix family protein. Analysis of this protein sequence reveals the following:

```
Possible site: 28
>>> Seems to have no N-terminal signal sequence

----- Final Results -----
              bacterial cytoplasm --- Certainty = 0.1901 (Affirmative) < succ>
              bacterial membrane  --- Certainty = 0.0000 (Not Clear)   < succ>
              bacterial outside   --- Certainty = 0.0000 (Not Clear)   < succ>
```

The protein has homology with the following sequences in the GENPEPT database.

```
>GP: AAF11817 GB: AE002059 MutT/nudix family protein [Deinococcus
radiodurans]
Identities = 40/135 (29%), Positives = 62/135 (45%), Gaps = 3/135 (2%)

Query:   22 FGVRVSALIIENQKLLLIYAPHLDKYY-LPGGALQVGEDSNKAVAREVLEEIGLHSQVGD    80
            F  R + + +++ +LL  +        ++ LPGGA+Q GE S  A  RE  EE GL + V
Sbjct:   33 FQTRATLICVQDNRLLTCWDERFPDFFALPGGAVQTGESSAAAAQREWHEETGLRADVTR   92

Query:   81 LAYIIENQFNIKRHHYHSVEFLYFVNLLGQAPESIKEGTHKRHFVWLPIKELTKIDCNPN   140
               A  +E  F+ +    H   F + V L G+ P ++ +   H    F WL +  L        P
Sbjct:   93 CA-TLERFFHWEGRERHEFGFFFRVELTGELPATVLDNPHV-FFRWLAVDALDDHTLYPR  150

Query:  141 FLAQDLIEWPGHVVH                                               155
              + Q L     G + H
Sbjct:  151 CVPQLLRLPAGEIGH                                               165
```

A related DNA sequence was identified in *S. pyogenes* <SEQ ID 2691> which encodes the amino acid sequence <SEQ ID 2692>. Analysis of this protein sequence reveals the following:

```
Possible site: 55
>>> Seems to have no N-terminal signal sequence

----- Final Results -----
             bacterial cytoplasm --- Certainty = 0.3832 (Affirmative) < succ>
               bacterial membrane --- Certainty = 0.0000 (Not Clear) < succ>
                  bacterial outside --- Certainty = 0.0000 (Not Clear) < succ>
```

An alignment of the GAS and GBS proteins is shown below.

```
Identities = 33/80 (41%), Positives = 50/80 (62%), Gaps = 1/80 (1%)

Query:   29 LIIENQKLLLIYAPHLDKYYLPGGALQVGEDSNKAVAREVLEEIGLHSQVGDLAYIIENQ    88
            LI+ N K  L        D+YY  GG    VGE +++ V RE LEE+G+ ++V  LA+++EN
Sbjct:    1 LIVRNGKNFLTRDAD-DQYYTIGGTSLVGEKTHETVLRETLEEVGIRAKVNQLAFMVENH   59

Query:   89 FNIKRHHYHSVEFLYFVNLL                                          108
            F+I    +H++EF Y V+ L
Sbjct:   60 FDIDDVFWHNIEFHYLVSPL                                           79
```

Based on this analysis, it was predicted that these proteins and their epitopes could be useful antigens for vaccines or diagnostics.

EXAMPLE 887

A DNA sequence (GBSx0941) was identified in *S. agalactiae* <SEQ ID 2693> which encodes the amino acid sequence <SEQ ID 2694>. This protein is predicted to be unnamed protein product. Analysis of this protein sequence reveals the following:

```
Possible site: 26
>>> Seems to have no N-terminal signal sequence
INTEGRAL    Likelihood = -12.95      Transmembrane       24-40  (17-48)
INTEGRAL    Likelihood = -11.09      Transmembrane      88-104  (82-112)
INTEGRAL    Likelihood =  -9.39      Transmembrane     294-310  (276-315)
INTEGRAL    Likelihood =  -8.07      Transmembrane     242-258  (236-262)
INTEGRAL    Likelihood =  -7.86      Transmembrane       50-66  (43-74)
INTEGRAL    Likelihood =  -3.13      Transmembrane     337-353  (332-355)
INTEGRAL    Likelihood =  -2.23      Transmembrane     185-201  (182-202)
INTEGRAL    Likelihood =  -1.38      Transmembrane     269-285  (267-285)
```

```
                                -continued
----- Final Results -----
             bacterial membrane --- Certainty = 0.6180 (Affirmative) < succ>
              bacterial outside --- Certainty = 0.0000 (Not Clear) < succ>
            bacterial cytoplasm --- Certainty = 0.0000 (Not Clear) < succ>
```

A related DNA sequence was identified in *S. pyogenes* <SEQ ID 2695> which encodes the amino acid sequence <SEQ ID 2696>. Analysis of this protein sequence reveals the following:

```
Possible site: 26
>>> Seems to have no N-terminal signal sequence
INTEGRAL    Likelihood = -9.71    Transmembrane    88-104 (85-112)
INTEGRAL    Likelihood = -9.29    Transmembrane    24-40  (21-72)
INTEGRAL    Likelihood = -8.92    Transmembrane    47-63  (41-72)
INTEGRAL    Likelihood = -7.59    Transmembrane   243-259 (237-266)
INTEGRAL    Likelihood = -6.10    Transmembrane   181-197 (178-203)
INTEGRAL    Likelihood = -5.47    Transmembrane   278-294 (273-310)
INTEGRAL    Likelihood = -3.88    Transmembrane   338-354 (331-368)
INTEGRAL    Likelihood = -1.59    Transmenbrane   297-313 (297-314)

----- Final Results -----
             bacterial membrane --- Certainty = 0.4885 (Affirmative) < succ>
              bacterial outside --- Certainty = 0.0000 (Not Clear) < succ>
            bacterial cytoplasm --- Certainty = 0.0000 (Not Clear) < succ>
```

The protein has homology with the following sequences in the databases:

```
>GP: AAD00285 GB: U78604 putative membrane protein [Streptococcus mutans]
Identities = 244/382 (63%), Positives = 310/382 (80%), Gaps = 3/382 (0%)

Query:  12 SLFYKWFLNNQATMALVITLLAFLTIFVFTKISFLFMPVISFFAVIMLPLVISTILYYLT   71
           S F+KWFL+N+    L++ LL FL I VFTKIS +F P++SF AVIMLPLVIS +LYYL
Sbjct:  17 SWFFKWFLDNKTVTVLLVLLLVFLDILVFTKISSIFKPLLSFLAVIMLPLVISALLYYLL   76

Query:  72 KPLVDLINHLGPNRTTSIFIVFGLITLLFVWAISGFVPMVQTQLTSFIEDLPKYVGKVNE  131
           KP+VD I   G +R  +I IVF +I   L VW I+ F  PM+  QLTSFI+ LP YV  V+
Sbjct:  77 KPIVDFIEIRGTSRVMAITIVFVIIAGLLVWGIANFFPMLNEQLTSFIKYLPSYVRSVDA  136

Query: 132 EANKLLENEWLVSYKPQLQDMLTHTSQKALDYAQSFSKNAIDWAGNPAGAIARITVAIII  191
           + +KLL N+ L S++PQ+++ +T+ SQKA+DYA+ FSK A+ WAGNFA  IAR+TVAIII
Sbjct: 137 QVSKLLRNDLLASFRPQIENAVTNFSQKAVDYAEPFSKGAVTWAGNFASLIARVTVAIII  196

Query: 192 SPFILFYFLRDSSHMKNGLVNVLPLKLRVPMVRVLGDINKQLSGYVQGQVTVAIVVGFMF  251
           SPFI+FY LRDSS MK   V+ LP K+R P+ R+LGD+N+QL+GYVQ   TVAI+VGFMF
Sbjct: 197 SPFIVFYLLRDSSKMKEAFVSYLPTKMRQPIHRILGDVNRQLAGYVQRSSTVAIIVGFMF  256

Query: 252 SIMFSLVGLKYAITFGIIAGFLNMIPYLGSFLAMIPVVIMAMVQGPFMLVKVLVIFMIEQ  311
           SIMF+++GL YA+TFGIIAGFLNMIPYLGSFLA  IPV  I+A+V+GP   +VKV ++F++EQ
Sbjct: 257 SIMFTIIGLRYAVTFGIIAGFLNMIPYLGSFLATIPVFILALVEGPVKVVKVALVFIVEQ  316

Query: 312 TIEGRFVAPLVLGNKLSIHPITIMFLLLTAGSMFGVWGVFLVIPIYASVKVVIKELFDWY  371
           TIEGRFV+PLVLG+KLSIHPITIMF+LLTAGSMFGVWGVFL IP+YAS+KVV KE+F+WY
Sbjct: 317 TIEGRFVSPLVLGSKLSIHPITIMFILLTAGSMFGVWGVFLGIPVYASIKVVVKEIFEWY  376

Query: 372 KKVSGLYDEEVLVIEEVKDHVK                                        393
           K +SGLY++E    E++K  VK
Sbjct: 377 KPISGLYEKEE---EDIKKDVK                                        395
```

An alignment of the GAS and GBS proteins is shown below.

```
Identities = 243/389 (62%), Positives = 306/389 (78%), Gaps = 2/389 (0%)

Query:   6 EKEFKNSLFFKWILNNQAVIALMITFLVFLTIFIFTKISFMFKPVFDFLAVLILPLVISG   65
           EK   +SLF+KW LNNQA +AL+IT L FLTIF +FTKISF+F PV  F AV++LPLVIS
Sbjct:   6 EKSRTDSLFYKWFLNNQATMALVITLLAFLTIFVFTKISFLFMPVISFFAVIMLPLVIST   65

Query:  66 LLYYLLKPMVTFLEKRGIKRVTAILSVFTIIILLLIWAMSSFIPMMSNQLRHFMEDLPSY  125
           +LYYL KP+V +    G  R T+I  VF +I LL +WA+S F+PM+  QL  F+EDLP Y
Sbjct:  66 ILYYLTKPLVDLINHLGPNRTTSIFIVFGLITLLFVWAISGFVPMVQTQLTSFIEDLPKY  125
```

-continued

```
Query:  126 VNKVQMETSSFIDHNPWLKSYKGEISSMLSNISSQAVSYAEKFSKNILDWAGNLASTVAR  185
            V KV  E +  ++ N WL SYK ++   ML++ S +A+ YA+ FSKN +DWAGN A  +AR
Sbjct:  126 VGKVNEEANKLLE-NEWLVSYKPQLQDMLTHTSQKALDYAQSFSKNAIDWAGNFAGAIAR  184

Query:  186 VTVATIMAPFILFYLLRDSRNMKNGFLMVLPTKLRQPTDRILREMNSQMSGYVQGQIIVA  245
             +TVA I++PFILFY LRDS +MKNG + VLP KLR P  R+L ++N Q+SGYVQGQ+ VA
Sbjct:  185 ITVAIIISPFILFYFLRDSSHMKNGLVNVLPLKLRVPMVRVLGDINKQLSGYVQGQVTVA  244

Query:  246 ITVGVIFSIMYSIIGLRYGVTLGIIAGVLNMVPYLGSFVAQIPVFILALVAGPVMVVKVA  305
              I VG +FSIM+S++GL+Y +T GIIAG LNM+PYLGSF+A  IPV I+A+V GP M+VKV
Sbjct:  245 IVVGFMFSIMFSLVGLKYAITFGIIAGFLNMIPYLGSFLAMIPVVIMAMVQGPFMLVKVL  304

Query:  306 IVFVIEQTLEGRFVSPLVLGNKLSIHPITIMFILLTSGAMFGVWGVFLSIPIYASIKVVV  365
             ++F+IEQT+EGRFV+PLVLGNKLSIHPITIMF+LLT+G+MFGVWGVFL IPIYAS+KVV+
Sbjct:  305 VIFMIEQTIEGRFVAPLVLGNKLSIHPITIMFLLLTAGSMFGVWGVFLVIPIYASVKVVI  364

Query:  366 KELFDWYKAVSGLYTVDV-VTEERSEEVK                                393
            KELFDWYK VSGLY  +V V EE  + VK
Sbjct:  365 KELFDWYKKVSGLYDEEVLVIEEVKDHVK                                393
```

Based on this analysis, it was predicted that these proteins and their epitopes could be useful antigens for vaccines or diagnostics.

EXAMPLE 888

A DNA sequence (GBSx0942) was identified in *S. agalactiae* <SEQ ID 2697> which encodes the amino acid sequence <SEQ ID 2698>. Analysis of this protein sequence reveals the following:

```
Possible site: 58
>>> Seems to have no N-terminal signal sequence

----- Final Results -----
            bacterial cytoplasm --- Certainty = 0.2715 (Affirmative) < succ>
              bacterial membrane --- Certainty = 0.0000 (Not Clear)  < succ>
                bacterial outside --- Certainty = 0.0000 (Not Clear)  < succ>
```

A related GBS nucleic acid sequence <SEQ ID 9891> which encodes amino acid sequence <SEQ ID 9892> was also identified.

The protein has homology with the following sequences in the GENPEPT database.

```
>GP: AAA25160 GB: L16975 ORF1 [Lactococcus lactis]
Identities = 132/345 (38%), Positives = 203/345 (58%), Gaps = 3/345 (0%)

Query:   79 INLAQIVAEDGDIEQAFLYLDYISEDSQEYVSALLVMADLYDMEGLTDVAREKLLLASKL  138
            +NLA+I  ++G++++A  YL I + + Y++AL+ +ADLY  E   + A  KL  A +L
Sbjct:    1 VNLAEIAEDNGNLDEALNYLYQIPVNDENYIAALIKIADLYQFEVDFETAISKLEEAREL   60

Query:  139 SDDPLVTFGLAEMNLSLEHYQEAIEGYASLDNREILETTGVSTYQRIGKSYAIMGKFDAA  198
            SD  PL+TF LAE     Y  AI  YA L  R+IL  T +S YQRIG  SYA +G F+ A
Sbjct:   61 SDSPLITFALAESYFEQGDYSAAITEYAKLSERKILHETKISIYQRIGDSYAQLGNFENA  120

Query:  199 IEFLEKAVDIEYDDLTVFELATILYDQEEYQKANLYFKQLDTINPDFAGYEYIYGLSLRE  258
            I FLEK+++ +     T++++A + +       +A  FK+L+ ++ +F  YE Y  +L
Sbjct:  121 ISFLEKSLEFDEKPETLYKIALLYGETHNETRAIANFKRLEKMDVEFLNYELAYAQTLEA  180

Query:  259 EHKSEEALRLVQQGIRKNSFDGQLLLLASQLSYELHDVHSSESYLKQAEKVSENQDEIVM  318
              + +  AL  ++G++KN       LL AS++ ++L D   +E YL  A + E DE V
Sbjct:  181 NQEFKAALEMAKKGMKKNPNAVPLLHFASKICFKLKDKAAAERYLVDALNLPELHDETVF  240
```

-continued
```
Query: 319 RLSNLYLEEERFEEVLELDN-DNLENILAKWNIAKAHKALEMDDSVD--YYQSLYNDLKD  375
            L+NLY   EE FE V+ L+       E++LAKW  A AHKALE D       Y + +  +L +
Sbjct: 241 LLANLYFNEEDFEAVINLEELLEDEHLLAKWLFAGAHKALENDSEAAALYEELIQTNLSE  300

Query: 376 NPEFLQDYAYILREFGYLDKAQEVGKAYLKLVPDDIEMSEWVNNI               420
           NPEFL+DY    L+E G + K + + + YL+LVPDD  M    + ++
Sbjct: 301 NPEFLEDYIDFLKEIGQISKTEPIIEQYLELVPDDENMRNLLTDL                345
```

A related DNA sequence was identified in *S. pyogenes* <SEQ ID 2699> which encodes the amino acid sequence <SEQ ID 2700>. Analysis of this protein sequence reveals the following:

```
Possible site: 25
>>> Seems to have no N-terminal signal sequence

----- Final Results -----
            bacterial cytoplasm --- Certainty = 0.2991 (Affirmative) < succ>
            bacterial membrane  --- Certainty = 0.0000 (Not Clear)   < succ>
            bacterial outside   --- Certainty = 0.0000 (Not Clear)   < succ>
```

An alignment of the GAS and GBS proteins is shown below.

```
Identities = 267/409 (65%), Positives = 336/409 (81%), Gaps = 1/409 (0%)

Query:   13 MLNSEKMIVSIQNQDLEHANKYFEKALKNDPEEVLLELGAYLESIGFLPQAKRLYDQIRP   72
            MLNSEKMI S+  QDL HA KYF+KALK D  + L+LG YLESIGFLP AKR+Y Q+
Sbjct:    7 MLNSEKMIASLDQQDLAHAEKYFQKALKEDDADSLIALGEYLESIGFLPHAKRIYLQLAD   66

Query:   73 NYPEVAINLAQIVAEDGDIEQAFLYLDYISEDSQEYVSALLVMADLYDMEGLTDVAREKL  132
            +YPE+ INLAQI AED   IE+AFLYLD +S+DS   Y+SALLVMADLYDMEGLT+VAREKL
Sbjct:   67 DYPELNINLAQIAAEDDAIEEAFLYLDKVSKDSPNYLSALLVMADLYDMEGLTEVAREKL  126

Query:  133 LLASKLSDDPLVTFGLAEMNLSLEHYQEAIEGYASLDNREILETTGVSTYQRIGKSYAIM  192
            L A  +S +PLV FGLAE+++SL+H++EAI+ YA LDNR+ILE TG+STYQRIG++YA +
Sbjct:  127 LQAVGISPEPLVIFGLAEIDMSLQHFKEAIDYYAQLDNRQILELTGISTYQRIGRAYASL  186

Query:  193 GKFDAAIEFLEKAVDIEYDDLTVFELATILYDQEEYQKANLYFKQLDTINPDFAGYEYIY  252
            GKF+AAIEFLEKAV IEY+D TVFELAT++YDQE YQKANLYFKQL+TINPD+ GYEY Y
Sbjct:  187 GKFEAAIEFLEKAVAIEYEDETVFELATLMYDQENYQKANLYFKQLETINPDYPGYEYGY  246

Query:  253 GLSLREEHKSEEALRLVQQGIRKNSFDGQLLLLASQLSYELHDVHSSESYLKQAEKVSEN  312
                LSL EEHK+ EALRLVQQG+RKN+FD QLLLLASQLSYELHD  ++E+YL QA++V+ +
Sbjct:  247 ALSLHEEHKTSEALRLVQQGLRKNAFDSQLLLLASQLSYELHDRQNAENYLLQAKEVAVD  306

Query:  313 QDEIVMRLSNLYLEEERFEEVLELDNDNLENILAKWNIAKAHKALEMDD-SVDYYQSLYN  371
            +EI+MRL  LY + ERFEEV+ L+ + ++N+L KW IAKA+ ALE ++ ++    Y   +
Sbjct:  307 DEEILMRLVTLYFDAERFEEVIALNRETIDNVLTKWTIAKAYHALEQEEVALALYNEISA  366

Query:  372 DLKDNPEFLQDYAYILREFGYLDKAQEVGKAYLKLVPDDIEMSEWVNNI            420
            DL +NPEFLQDYAY+LREFG   KA ++  AYL+ VPDD+M +++++I
Sbjct:  367 DLAENPEFLQDYAYLLREFGQFHKAIQMATAYLRQVPDDVNMQDFLDHI            415
```

Based on this analysis, it was predicted that these proteins and their epitopes could be useful antigens for vaccines or diagnostics.

EXAMPLE 889

A DNA sequence (GBSx0943) was identified in *S. agalactiae* <SEQ ID 2701> which encodes the amino acid sequence <SEQ ID 2702>. This protein is predicted to be alpha-acetolactate synthase (ilvK). Analysis of this protein sequence reveals the following:

```
Possible site: 60
>>> Seems to have no N-terminal signal sequence

----- Final Results -----
            bacterial cytoplasm --- Certainty = 0.2105 (Affirmative) < succ>
```

-continued
```
          bacterial membrane --- Certainty = 0.0000 (Not Clear) < succ>
          bacterial outside  --- Certainty = 0.0000 (Not Clear) < succ>
```

The protein has homology with the following sequences in the GENPEPT database.

```
>GP:CAA01700 GB:A23961 alpha-acetolactate synthase [Lactococcus
lactis]
Identities = 396/559 (70%), Positives = 466/559 (82%), Gaps 8/559 (1%)

Query:    4 SHNQYGADLIVDSLINHDVKYVFGIPGAKIDRVFDTLE-DKGPELIVARHEQNATFMAQA    62
            S  Q+GA+L+VDSLINH VKYVFGIPGAKIDRVFD LE ++GP+++V RHEQ A FMAQA
Sbjct:    2 SEKQFGANLVVDSLINHKVKYVFGIPGAKIDRVFDLLENEEGPQMVVTRHEQGAAFMAQA    61

Query:   63 VGRITGEPGVVIATSGPGISNLATGLVTATDEGDAVLAIGGQVKRGDLLKRAHQSMNNVA   122
            VGR+TGEPGVV+ TSGPG+SNLAT L+TAT EGDA+LAIGGQVKR D LKRAHQSM+N
Sbjct:   62 VGRLTGEPGVVVVTSGPGVSNLATPLLTATSEGDAILAIGGQVKRSDRLKRAHQSMDNAG   121

Query:  123 MLEPITKYSAEVHDPNTLSETVANAYRLAKSGKPGASFISIPQDVTDSPVSVKAIKPLSA   182
            M++  TKYSAEV DPNTLSE++ANAYR+AKSG PGA+F+SIPQDVTD+ VS+KAI+PLS
Sbjct:  122 MMQSATKYSAEVLDPNTLSESIANAYRIAKSGHPGATFLSIPQDVTDAEVSIKAIQPLSD   181

Query:  183 PKLGSASVLDINYLAQAINNAVLPVLLLGNGASSEGVTAAVRRLLDAVKLPVVETFQGAG   242
            PK+G+AS+ DINYLAQAI NAVLPV+L+G GAS    V +++R LL   V +PVVETFQGAG
Sbjct:  182 PKMGNASIDDINYLAQAIKNAVLPVILVGAGASDAKVASSLRNLLTHVNIPVVETFQGAG   241

Query:  243 IVSRELEDETFFGRVGLFRNQPGDMLLKRADLVIAIGYDPIEYEARNWNAEISARIIVID   302
            ++S +LE   TF+GR+GLFRNQPGDMLLKR+DLVIA+GYDPIEYEARNWNAEI +RIIVID
Sbjct:  242 VISHDLE-HTFYGRIGLFRNQPGDMLLKRSDLVIAVGYDPIEYEARNWNAEIDSRIIVID   300

Query:  303 VEQAEIDTYFQPERELIGDMAHTLDLLLPAIKGYELPEGSKEYLKGLRNNIENVSDVKFD   362
            +  AEIDTY+QPERELIGD+A TLD LLPA++GY++P+G+K+YL GL   E     +FD
Sbjct:  301 NAIAEIDTYYQPERELIGDIAATLDNLLPAVRGYKIPKGTKDYLDGLH---EVAEQHEFD   357

Query:  363 RDSA-HGLVHPLDLIDVLQENTTDDMTVTVDVGSHYIWMARYFKSYEARHLLFSNGMQTL   421
             ++   G +HPLDL+   QE   DD TVTVDVGS YIWMAR+FKSYE RHLLFSNGMQTL
Sbjct:  358 TENTEEGRMHPLDLVSTFQEIVKDDETVTVDVGSLYIWMARHFKSYEPRHLLFSNGMQTL   417

Query:  422 GVALPWAISAALLRPNTKVISVSGDGGFLFSAQSLETAVRLHLPIVHIIWNDGKYNMVEF   481
            GVALPWAI+AALLRP  KV S SGDGGFLF+ QELETAVRL+LPIV IIWNDG Y+MV+F
Sbjct:  418 GVALPWAITAALLRPGKKVYSHSGDGGFLFTGQELETAVRLNLPIVQIIWNDGHYDMVKF   477

Query:  482 QEEMKYGRSSGVDFGPVDFVKYAESFGAKGYRVDSKDSFEETLKQALIDAENGPVLIDVP   541
            QEEMKYGRS+ VDFG VD+VKYAE+  AKGYR  SK+  E LK  I    GPV+IDVP
Sbjct:  478 QEEMKYGRSAAVDFGYVDYVKYAEAMRAKGYRAHSKEELAEILKS--IPDTTGPVVIDVP   535

Query:  542 IDYKDNVTLGETILPDEFY                                           560
            +DY DN+ L E +LP+EFY
Sbjct:  536 LDYSDNIKLAEKLLPEEFY                                           554
```

No corresponding DNA sequence was identified in *S. pyogenes*.

Based on this analysis, it was predicted that this protein and its epitopes, could be useful antigens for vaccines or diagnostics.

EXAMPLE 890

A DNA sequence (GBSx0944) was identified in *S. agalactiae* <SEQ ID 2703> which encodes the amino acid sequence <SEQ ID 2704>. This protein is predicted to be alpha-acetolactate decarboxylase (aldC). Analysis of this protein sequence reveals the following:

```
Possible site: 43
>>> Seems to have no N-terminal signal sequence

----- Final Results -----
          bacterial cytoplasm --- Certainty = 0.3096 (Affirmative) < succ>
          bacterial membrane  --- Certainty = 0.0000 (Not Clear)   < succ>
          bacterial outside   --- Certainty = 0.0000 (Not Clear)   < succ>
```

A related GBS nucleic acid sequence <SEQ ID 9889> which encodes amino acid sequence <SEQ ID 9890> was also identified.

The protein has homology with the following sequences in the GENPEPT database.

```
>GP:CAA57941 GB:X82620 alpha-acetolactate decarboxylase [Lactococcus
lactis]
Identities = 139/239 (58%), Positives = 187/239 (78%), Gaps 3/239 (1%)

Query:   16 MSETVKLFQYSTLSSLMAGLYKGSLTIGELLTHGDLGIGTVHMIDGELIVLDGKAYQAIG    75
            MSE  +LFQY+TL +LMAGLY+G++TIGELL HGDLGIGT+  IDGELIVLDGKAYQA
Sbjct:    1 MSEITQLFQYNTLGALMAGLYEGTMTIGELLKHGDLGIGTLDSIDGELIVLDGKAYQA--   58

Query:   76 TDGKAEIIQLSDDVTVPYAAVLPHHIQKQFDINAEIDNKDLEEMILKNFEGQNLFKSLKI   135
             G    I++L+DD+ VPYAAV+PH  +  F    + +K+LE+  I    F+GQNLF+S+KI
Sbjct:   59 -KGDKTIVELTDDIKVPYAAVVPHQAEVVFKQKFTVSDKELEDRIESYFDGQNLFRSIKI   117

Query:  136 KGTFSRMHVRMIPKSPQHKRFADIASNQPEFTRENVSGTLVGIWTPELFHGVGVKGFHVH   195
              G F +MHVRMIP++     +F +++ NQPE+T EN+ GT+VGIWTPE+FHGV V G+H+H
Sbjct:  118 TGKFPKMHVRMIPRAKSGTKFVEVSQNQPEYTEENIKGTIVGIWTPEMFHGVSVAGYHLH   177

Query:  196 FISDDLTFGGHVMDYSLTQGKVEIGKVDQLDQCFPTQDQEFLKANFDLQKLREDIDLSE   254
            FIS+D TFGGHV+D+  + G VEIG +DQL+Q FP QD++FL A+ D++ L++DID++E
Sbjct:  178 FISEDFTFGGHVLDFIIDNGTVEIGAIDQLNQSFPVQDRKFLFADLDIEALKKDIDVAE   236
```

No corresponding DNA sequence was identified in *S. pyogenes*.

Based on this analysis, it was predicted that these proteins and their epitopes could be useful antigens for vaccines or diagnostics.

EXAMPLE 891

A DNA sequence (GBSx0945) was identified in *S. agalactiae* <SEQ ID 2705> which encodes the amino acid sequence <SEQ ID 2706>. This protein is predicted to be fibronectin-binding protein-like protein A. Analysis of this protein sequence reveals the following:

```
Possible site: 57
>>> Seems to have no N-terminal signal sequence

----- Final Results -----
            bacterial cytoplasm --- Certainty = 0.5042 (Affirmative) < succ>
            bacterial membrane  --- Certainty = 0.0000 (Not Clear)   < succ>
             bacterial outside  --- Certainty = 0.0000 (Not Clear)   < succ>
```

The protein has homology with the following sequences in the GENPEPT database.

```
>GP:CAA46282 GB:X65164 fibronectin-binding protein-like protein A
[Streptococcus gordonii]
Identities = 392/550 (71%), Positives = 462/550 (83%)

Query:    1 MSFDGFFLHHLTNELQEQIEKGRIQKVNQPFDHELVLTIRNNRRNYKLLLSAHPVFGRIQ    60
            MSFDGFFLHH+T EL+ ++  GRIQK+NQPF+ ELVL IR+NR++ KLLLSAH VFGR+Q
Sbjct:    1 MSFDGFFLHHMTEELRHELVGGRIQKINQPFEQELVLQIRSNRKSLKLLLSAHSVFGRVQ    60

Query:   61 TTEANFQNPQNPNTFTMIMRKYLQGAVIETIQQIENDRILEIVVSNKNEIGDHIKATLVV   120
             T+  F+NP  PNTF M+MRKYLQGAVIE IQQ+ENDRILEI VSNKNEIGD +  TLV+
Sbjct:   61 LTDTTFENPAVPNTFIMVMRKYLQGAVIEAIQQVENDRILEISVSNKNEIGDSVAVTLVI   120

Query:  121 EIMGKHSNIILIDKNEHKIIESIKHVGFSQNSYRTILPGSTYIAPPKTKAINPFDISDQT   180
            EIMGKHSNIIL+DK    KIIE+IKHVGFSQNSYRTILPGSTY+APP+T ++NPF + D+
Sbjct:  121 EIMGKHSNIILLDKASGKIIEAIKHVGFSQNSYRTILPGSTYVAPPQTGSLNPFTVGDEK   180

Query:  181 LFELLQTNDLSPKNLQQLLQGLGRDTALELSHCLKDNKLNDFRQFFSREYYPSLTEKSFS   240
            LFE+LQT ++ PK L Q+ QGLGRDTA ELS  L  ++L  FR FF+     PSLTEKSFS
Sbjct:  181 LFEILQTEEIEPKRLLQIFQGLGRDTATELSGRLTTDRLKTFRAFFASPTQPSLTEKSFS   240
```

-continued

```
Query:  241 AVQFSSSHETFQSLGQLLDYYYQEKAEKDRIAQQASDLIHRVQSELEKNIKKLAKQQDEL  300
            A+ FS S     +L +LLD +Y++KAE+ R+ QQAS+LI RV++ELEKN KKL KQ+DEL
Sbjct:  241 ALVFSDSKTQMSTLSELLDTFYKDKAERYRVNQQASELIRRVENELEKNRKKLGKQEDEL  300

Query:  301 LATENAEEFRQKGELLTTYLSMVPNNQDVVVLDNYYTNQTIEISLDRALTPNQNAQRYFK  360
            LATE AEEFRQKGELLTT+L  VPN+QD V LDNYYT + I I+LD+ALTPNQNAQRYFK
Sbjct:  301 LATEKAEEFRQKGELLTTFLHQVPNDQDQVELDNYYTGEKILITLDKALTPNQNAQRYFK  360

Query:  361 KYQKLKEAVKHLKGIISDTENTITYLESVETSLNHASMEDINDIREELVETGFIKRRAHD  420
            +YQKLKEAVKHL  +I +T   TI YLESVET+L  AS+ +I +IREEL++TGFI+RR  +
Sbjct:  361 RYQKLKEAVKHLTSLIEETRTTILYLESVETALAQASLTEIAEIREELIQTGFIRRRQRE  420

Query:  421 KQHKRKKPEQYLASDGKTIIMVGRNNLQNDELTFKMARKGELWFHAKDIPGSHVLIRDNL  480
            K  KRKKPE+YLASDG+TII+VGRNNLQNDELTFKMA+K ELWFHAKDIPGSHV+I  NL
Sbjct:  421 KIQKRKKPEKYLASDGQTIILVGRNNLQNDELTFKMAKKDELWFHAKDIPGSHVVITGNL  480

Query:  481 NPSDEVKTDAAELAAYYSKARLSNLVQVDMIEAKKLNKPSGTKPGFVTYTGQKTLRVTPT  540
            PSDEVKTDAAELAAY+SKARLSNLVQVDMIE KKLNKP+G KPGFVTYTGQKTLRVTP
Sbjct:  481 QPSDEVKTDAAELAAYFSKARLSNLVQVDMIEIKKLNKPTGGKPGFVTYTGQKTLRVTPD  540

Query:  541 QEKIDSLELK                                                  550
            +KI S+K++
Sbjct:  541 ADKIKSMKIQ                                                  550
```

A related DNA sequence was identified in *S. pyogenes* <SEQ ID 2707> which encodes the amino acid sequence <SEQ ID 2708>. Analysis of this protein sequence reveals the following:

```
    Possible site: 38
>>> Seems to have no N-terminal signal sequence

----- Final Results -----
        bacterial cytoplasm --- Certainty = 0.5434 (Affirmative) < succ>
        bacterial membrane  --- Certainty = 0.0000 (Not Clear)   < succ>
         bacterial outside  --- Certainty = 0.0000 (Not Clear)   < succ>
```

The protein differs significantly from L28919 in its midregion:

```
    Query:   223     QHFQGLGRDTAKELAELLTTD
                     F   L  +T K + ELLTTD
    Sbjct:   121     PAFSRLRGETPKRIGELLTTD
```

An alignment of the GAS and GBS proteins is shown below.

```
Identities = 421/549 (76%), Positives = 487/549 (88%)

Query:    1 MSFDGFFLHHLTNELQEQIEKGRIQKVNQPFDHELVLTIRNNRRNYKLLLSAHPVFGRIQ   60
            MSFDGFFLHHLTNEL+E +  GRIQKVNQPF+ ELVLTIRN+R+NYKLLLSAHPVFGR+Q
Sbjct:   27 MSFDGFFLHHLTNELKENLLYGRIQKVNQPFERELVLTIRNHRKNYKLLLSAHPVFGRVQ   86

Query:   61 TTEANFQNPQNPNTFTMIMRKYLQGAVIETIQQIENDRILEIVVSNKNEIGDHIKATLVV  120
            T+A+FQNFQ PNTFTMIMRKYLQGAVIE ++QI+NDRI EI VSNKNEIGD I+ATL++
Sbjct:   87 ITQADFQNPQVPNTFTMIMRKYLQGAVIEQLEQIDNDRIIEIKVSNKNEIGDAIQATLII  146

Query:  121 EIMGKHSNIILIDKNEHKIIESIKHVGFSQNSYRTILPGSTYIAPPKTKAINPFDISDQT  180
            EIMGKHSNIIL+D+ E+KIIESIKHVGFSQNSYRTILPGSTYI PPKT A+NPF I+D
Sbjct:  147 EIMGKHSNIILVDRAENKIIESIKHVGFSQNSYRTILPGSTYIEPPKTAAVNPFTITDVP  206

Query:  181 LFELLQTNDLSPKNLQQLLQGLGRDTALELSHCLKDNKLNDFRQFFSREYYPSLTEKSFS  240
            LFE+LQT +L+ K+LQQ  QGLGRDTA EL+  L  +KL FR+FF+R     +LT  SF+
Sbjct:  207 LFEILQTQELTVKSLQQHFQGLGRDTAKELAELLTTDKLKRFREFFARPTQANLTTASFA  266

Query:  241 AVQFSSSHETFQSLGQLLDYYYQEKAEKDRIAQQASDLIHRVQSELEKNIKKLAKQQDEL  300
             V  FS SH TF++L  +LD++YQ+KAE+DRI QQASDLIHRVQ+EL+KN  KL+KQ+ EL
Sbjct:  267 PVLFSDSHATFETLSDMLDHFYQDKAERDRINQQASDLIHRVQTELDKNRNKLSKQEAEL  326

Query:  301 LATENAEEFRQKGELLTTYLSMVPNNQDVVVLDNYYTNQTIEISLDRALTPNQNAQRYFK  360
            LATENAE FRQKGELLTTYLS+VPNNQD V+LDNYYT + IEI+LD+ALTPNQNAQRYFK
Sbjct:  327 LATENAELFRQKGELLTTYLSLVPNNQDSVILDNYYTGEKIEIALDKALTPNQNAQRYFK  386
```

-continued

```
Query: 361 KYQKLKEAVKHLKGIISDTENTITYLESVETSLNHASMEDINDIREELVETGFIKRRAHD 420
           KYQKLKEAVKHL G+I+DT+ +ITY ESV+ +L+ AS++DI DIREEL + GF+K R  D
Sbjct: 387 KYQKLKEAVKHLSGLIADTKQSITYFESVDYNLSQASIDDIEDIREELYQAGFLKSRQRD 446

Query: 421 KQHKRKKPEQYLASDGKTIIMVGRNNLQNDELTFKMARKGELWFHAKDIPGSHVLIRDNL 480
           K+HKRKKPEQYLASDG TI+MVGRNNLQN+ELTFKMA+KGELWFHAKDIPGSHV+I+DNL
Sbjct: 447 KRHKRKKPEQYLASDGTTILMVGRNNLQNEELTFKMAKKGELWFHAKDIPGSHVIIKDNL 506

Query: 481 NPSDEVKTDAAELAAYYSKARLSNLVQVDMIEAKKLNKPSGTKPGFVTYTGQKTLRVTPT 540
           +PSDEVKTDAAELAAYYSKARLSNLVQVDMIEAKKL+KPSG KPGFVTYTGQKTLRVTP
Sbjct: 507 DPSDEVKTDAAELAAYYSKARLSNLVQVDMIEAKKLHKPSGAKPGFVTYTGQKTLRVTPD 566

Query: 541 QEKIDSLKL                                                   549
           Q KI S+KL
Sbjct: 567 QAKILSMKL                                                   575
```

Figure 319:
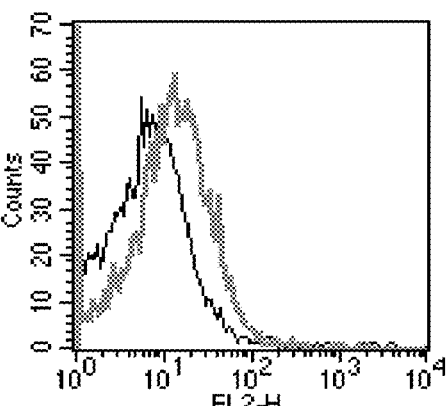

SEQ ID 2706 (GBS81) was expressed in *E. coli* as a His-fusion product. SDS-PAGE analysis of total cell extract is shown in FIG. 6 (lane 2; MW 64 kDa) and in FIG. 6 (lane 5; MW 64 kDa). The GBS81-His fusion product was purified (FIG. 190, lane 3) and used to immunise mice. The resulting antiserum was used for FACS (FIG. 319), which confirmed that the protein is immunoaccessible on GBS bacteria.

Based on this analysis, it was predicted that these proteins and their epitopes could be useful antigens for vaccines or diagnostics.

EXAMPLE 892

A DNA sequence (GBSx0946) was identified in *S. agalactiae* <SEQ ID 2709> which encodes the amino acid sequence <SEQ ID 2710>. Analysis of this protein sequence reveals the following:

```
Possible site: 53
>>> Seems to have an uncleavable N-term signal seq
    INTEGRAL    Likelihood = -9.08   Transmembrane   6-22 (1-24)

----- Final Results -----
                bacterial membrane  --- Certainty = 0.4630 (Affirmative) < succ>
                bacterial outside   --- Certainty = 0.0000 (Not Clear)   < succ>
                bacterial cytoplasm --- Certainty = 0.0000 (Not Clear)   < succ>
```

The protein has homology with the following sequences in the GENPEPT database.

```
>GP:AAF94260 GB:AE004191 conserved hypothetical protein [Vibrio cholerae]
  Identities = 111/295 (37%), Positives = 184/295 (61%), Gaps = 1/295 (0%)

Query:  36 QVVKIGILQYVTHDALDAIEKGVEDGLAQEGYK-GKKVKLTVLNAEADQSKIQAMSKQLV  94
           +  K+ + Q V H ALDA  +G+ DGL  +GY+GK ++       A+ + +    +++Q V
Sbjct:  26 KTAKVAVSQIVEHPALDATRQGLLDGLKAKGYEEGKNLEFDYKTAQGNPAIAVQIARQFV  85

Query:  95 NHHNDILIGIATPSAQGLAASTKDTPIIMGAVSDPLGAKLVTNMKKPTTNVTGLSNVVPT 154
           + D+L+GIATP+AQ L ++TK  PI+  AV+DP+GAKLV   +++P  NVTGLS++ P
Sbjct:  86 GENPDVLVGIATPTAQALVSATKTIPIVFTAVTDPVGAKLVKQLEQPGKNVTGLSDLSPV 145

Query: 155 KQTVQLIKDITPNIKRIGILYASSEDNSVSQVTEFTKYAQKAGLEVLKYSVPSTNEIKTS 214
           +Q V+LIK+I PN+K IG++Y   E N+VS +      A K G+++++ +    +++++
Sbjct: 146 EQHVELIKEILPNVKSIGVVYNPGEANAVSLMELLKLSAAKHGIKLVEATALKSADVQSA 205

Query: 215 MSVMTKKVDAVFVPQDNTIASAFRTVIVAANQANIPVYSSVDTMVEQGSIASVAQSQYGL 274
           +  +K D ++     DNT+ASA    +IVAANQA  PV+ +  + VE+G+IAS+    Y +
Sbjct: 206 TQAIAEKSDVIYALIDNTVASAIEGMIVAANQAKTPVFGAATSYVERGAIASLGFDYYQI 265

Query: 275 GLETAKQAIKVLRGKPVKDVPVKVIDTGKPSLNLKAAKHLGIKIPKKIMKQAEIT      329
           G++TA     +L GK    + V+V         +N  AA+ LGI IP+ ++ +A  T
Sbjct: 266 GVQTADYVAAILEGKEPGSLDVQVAKGSDLVINKTAAEQLGITIPEAVLARATST      320
```

A related DNA sequence was identified in *S. pyogenes* <SEQ ID 2711> which encodes the amino acid sequence <SEQ ID 2712>. Analysis of this protein sequence reveals the following:

```
Possible site: 23
>>> Seems to have an uncleavable N-term signal seq
    INTEGRAL    Likelihood = -11.25   Transmembrane   6-22 (1-27)
```

-continued
```
----- Final Results -----
              bacterial membrane --- Certainty = 0.5501 (Affirmative) < succ>
               bacterial outside --- Certainty = 0.0000 (Not Clear)   < succ>
             bacterial cytoplasm --- Certainty = 0.0000 (Not Clear)   < succ>
```

The protein has homology with the following sequences in the databases:

```
>GP:AAF94260 GB:AE004191 conserved hypothetical protein [Vibrio cholerae]
Identities = 103/304 (33%), Positives = 178/304 (57%), Gaps = 1/304 (0%)

Query:  17 VIGSLLSKGVSKENRDLANQQNITIGILQFVTHEALDDIKRGIEDQLK-KQMPQKQNVVI   75
           VI + + G + +       + + + Q V H ALD  ++G+ D LK K   + +N+
Sbjct:   6 VIATAVLAGAALLSSQSIMAKTAKVAVSQIVEHPALDATRQGLLDGLKAKGYEEGKNLEF   65

Query:  76 KVMNAEGDQSKIQTMSRQLVQSGSDIVIGIATPAAQGLAATSKDIPVVMSAVSDPVGSRL  135
              A+G+ +   ++RQ V    D+++GIATP AQ L + +K IP+V +AV+DPVG++L
Sbjct:  66 DYKTAQGNPAIAVQIARQFVGENPDVLVGIATPTAQALVSATKTIPIVFTAVTDPVGAKL  125

Query: 136 VMQLDQPEANVTGLSNKVPVKQTIDLMKKLTPHVKTVGILYASNEDNSLSQVKEFRRLAR  195
             V QL+QP  NVTGLS+  PV+Q ++L+K++ P+VK++G++Y   E N++S ++  +  A
Sbjct: 126 VKQLEQPGKNVTGLSDLSPVEQHVELIKEILPNVKSIGVVYNPGEANAVSLMELLKLSAA  185

Query: 196 KKGYQVISYAVPSTNEVPATMSVMLGKVDAVFIPDNTIASAFSSVMTTSKAAKIPVYTS  255
              K G +++     + +V +    + K D ++   DNT+ASA   ++  +  AK PV+ +
Sbjct: 186 KHGIKLVEATALKSADVQSATQAIAEKSDVIYALIDNTVASAIEGMIVAANQAKTPVFGA  245

Query: 256 VDRMVEKGGLAAISQNQYDLGVQTANQVLKLIKGKRVVDVPVKVVDIGQPLINKNVAAEL  315
               VE+G +A++ + Y +GVQTA+ V +++GK   + V+V     +INK  A +L
Sbjct: 246 ATSYVERGAIASLGFDYYQIGVQTADYVAAILEGKEPGSLDVQVAKGSDLVINKTAAEQL  305

Query: 316 GIAI  319
           GI I
Sbjct: 306 GITI  309
```

An alignment of the GAS and GBS proteins is shown below.

```
Identities = 181/322 (56%), Positives = 252/322 (78%), Gaps = 1/322 (0%)

Query:   1 MKNKGLIATLILLTILVVGELFYNK-SEKRLNLSEKQVVKIGILQYVTHDALDAIEKGVE   59
           MKNK LIATL++LT++V+G L      S++  +L+ +Q + IGILQ+VTH+ALD I++G+E
Sbjct:   1 MKNKSLIATLLVLTVIVIGSLLSKGVSKENRDLANQQNITIGILQFVTHEALDDIKRGIE   60

Query:  60 DGLAQEGYKGKKVKLTVLNAEADQSKIQAMSKQLVNHHNDILIGIATPSAQGLAASTKDT  119
           D L ++ + + V + V+NAE DQSKIQ MS+QLV   +DI+IGIATP+AQGLAA++KD
Sbjct:  61 DQLKKQMPQKQNVVIKVMNAEGDQSKIQTMSRQLVQSGSDIVIGIATPAAQGLAATSKDI  120

Query: 120 PIIMGAVSDPLGAKLVTNMKKPTTNVTGLSNVVPTKQTVQLIKDITPNIKRIGILYASSE  179
           P++M AVSDP+G++LV  + +P  NVTGLSN VP KQT+ L+K +TP++K +GILYAS+E
Sbjct: 121 PVVMSAVSDPVGSRLVMQLDQPEANVTGLSNKVPVKQTIDLMKKLTPHVKTVGILYASNE  180

Query: 180 DNSVSQVTEFTKYAQKAGLEVLKYSVPSTNEIKTSMSVMTKKVDAVFVPQDNTIASAFRT  239
           DNS+SQV EF + A+K G +V+ Y+VPSTNE+  +MSVM  KVDAVF+P QDNTIASAF +
Sbjct: 181 DNSLSQVKEFRRLARKKGYQVISYAVPSTNEVPATMSVMLGKVDAVFIPDNTIASAFSS  240

Query: 240 VIVAANQANIPVYSSVDTMVEQGSIASVAQSQYGLGLETAKQAIKVLRGKPVKDVPVKVI  299
           V+ +  + A  IPVY+SVD MVE+G +A+++Q+QY LG+ TA Q +K+++GK V DVPVKV+
Sbjct: 241 VMTTSKAAKIPVYTSVDRMVEKGGLAAISQNQYDLGVQTANQVLKLIKGKRVVDVPVKVV  300

Query: 300 DTGKPSLNLKAAKHLGIKIPKK  321
           D G+P +N   A  LGI I K+
Sbjct: 301 DIGQPLINKNVAAELGIAIKKE  322
```

Figure 48:
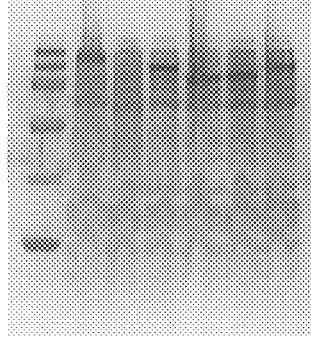

SEQ ID 2710 (GBS254) was expressed in *E. coli* as a His-fusion product. SDS-PAGE analysis of total cell extract is shown in FIG. 43 (lane 4; MW 27 kDa). It was also expressed in *E. coli* as a GST-fusion product. SDS-PAGE analysis of total cell extract is shown in FIG. 48 (lane 3; MW 59.6 kDa).

GBS254-GST was purified as shown in FIG. 203, lane 6.

Based on this analysis, it was predicted that these proteins and their epitopes could be useful antigens for vaccines or diagnostics.

EXAMPLE 893

A DNA sequence (GBSx0947) was identified in *S. agalactiae* <SEQ ID 2713> which encodes the amino acid sequence <SEQ ID 2714>. This protein is predicted to be probable permease of ABC transporter (rbsC). Analysis of this protein sequence reveals the following:

```
Possible site: 24
>>> Seems to have an uncleavable N-term signal seq
INTEGRAL Likelihood = -15.12 Transmembrane 127-143 (119-151)
INTEGRAL Likelihood =  -8.81 Transmembrane 206-222 (200-227)
INTEGRAL Likelihood =  -6.48 Transmembrane 260-276 (258-282)
INTEGRAL Likelihood =  -5.84 Transmembrane 234-250 (231-257)
INTEGRAL Likelihood =  -4.78 Transmembrane  55-71  (54-72)
INTEGRAL Likelihood =  -3.61 Transmembrane 177-193 (176-194)
INTEGRAL Likelihood =  -3.35 Transmembrane  84-100 (83-102)
INTEGRAL Likelihood =  -1.91 Transmembrane  10-26  (10-26)

----- Final Results -----
          bacterial membrane --- Certainty = 0.7050 (Affirmative) < succ>
          bacterial outside  --- Certainty = 0.0000 (Not Clear)   < succ>
          bacterial cytoplasm --- Certainty = 0.0000 (Not Clear)   < succ>
```

The protein has homology with the following sequences in the GENPEPT database.

```
>GP: AAG07224 GB: AE004801 probable permease of ABC transporter
[Pseudomonas aeruginosa]
Identities = 116/288 (40%), Positives = 185/288 (63%), Gaps = 9/288 (3%)

Query:    2 IISSVSQGLLWGILGLGIYLTFRILKFPDMTTEGSFPLGGAVCVTLMNQGVNPILATILG   61
            +  ++  GL++ ++ LG++++FR+L+FPD+T +GSFPLGGAVC TL+  G +P  AT+
Sbjct:    6 LFGALEIGLIFSLVALGVFISFRLLRFPDLTVDGSFPLGGAVCATLIALGWDPYSATLAA  65

Query:   62 MLSGMLAGFVTGLLYTKGKIPTILAGILVMTSCHSIMLMVMKRANLGLNEIQTLKDFLPF  121
            +G LAG   TGLL  K KI  +LA IL+M + +SI L +M + N+ L       TL   L
Sbjct:   66 TAAGALAGLATGLLNVKLKIMDLLASILMMIALYSINLRIMGKPNVPLIAEPTLFTLLQP 125

Query:  122 SNDLNLLVLGLIAILLVISA---LIYFLYTRLGQAYIATGDNPDMAKSFGIDTDKMEMLG  178
            + +   L+ + +VI+A    L +F  T+ G A   ATG NP  MA++ G++T  M +LG
Sbjct:  126 EWLSDYVFRPLLLVFIVIAAKLLLDWFFTTQKGLAIRATGSNPRMARAQGVNTGGMILLG 185

Query:  179 LIVSNGLIALSGALVSQQDGYADVSKGIGVIVIGLASIIIGE-VLYSTGLTLFERLIAIV  237
            + +SN L+AL+GAL +Q  G AD+S GIG IVIGLA++I+GE +L S  L  L    +A++
Sbjct:  186 MAISNALVALAGALFAQTQGGADISMGIGTIVIGLAAVIVGESILPSRRLIL--ATLAVI 243

Query:  238 VGSILYQFLITAVI---ALGFNTNYLKLFSAIVLGICLMVPVLKTKIL             282
            +G+I+Y+F I  +    +G    L L +A+++ + L++P++K ++L
Sbjct:  244 LGAIVYRFFIALALNSDFIGLQAQDLNLVTAVLVTVALVIPMMKKRLL             291
```

A related DNA sequence was identified in *S. pyogenes* <SEQ ID 2715> which encodes the amino acid sequence <SEQ ID 2716>. Analysis of this protein sequence reveals the following:

```
Possible site: 55
>>> Seems to have an uncleavable N-term signal seq
INTEGRAL Likelihood = -10.46 Transmembrane 131-147 (125-156)
INTEGRAL Likelihood =  -8.65 Transmembrane 210-226 (204-230)
INTEGRAL Likelihood =  -8.17 Transmembrane 265-281 (261-283)
INTEGRAL Likelihood =  -7.22 Transmembrane 238-254 (233-261)
INTEGRAL Likelihood =  -3.03 Transmembrane  89-105 (87-107)
INTEGRAL Likelihood =  -2.60 Transmembrane  63-79  (62-79)
INTEGRAL Likelihood =  -2.23 Transmembrane 180-196 (180-198)
INTEGRAL Likelihood =  -2.13 Transmembrane  14-30  (14-30)

----- Final Results -----
          bacterial membrane --- Certainty = 0.5182 (Affirmative) < succ>
          bacterial outside  --- Certainty = 0.0000 (Not Clear)   < succ>
          bacterial cytoplasm --- Certainty = 0.0000 (Not Clear)   < succ>
```

The protein has homology with the following sequences in the databases:

```
>GP: AAG07224 GB: AE004801 probable permease of ABC transporter
[Pseudomonas aeruginosa]
Identities = 118/285 (41%), Positives = 186/285 (64%), Gaps = 7/285 (2%)

Query:    6 IISSVSQGLIWGVLGLGIYLTFRILNFPDMTTEGSFPLGGAVAVTAISLGWNPFLSTLLG   65
            +  ++  GLI+ ++ LG++++FR+L FPD+T +GSFPLGGAV  T I+LGW+P+ +TL
Sbjct:    6 LFGALEIGLIFSLVALGVFISFRLLRFPDLTVDGSFPLGGAVCATLIALGWDPYSATLAA   65

Query:   66 MLSGALAGFLTGLLYTKGKNPTLLAGILVMTSCNSIMLMVMGRANLGLHDHKRIQDCLPF  125
              +GALAG  TGLL  K K+  LLA IL+M +  SI L +MG+ N+ L    +    L
Sbjct:   66 TAAGALAGLATGLLNVKLKIMDLLASILMMIALYSINLRIMGKPNVPLIAEPTLFTLLQP  125

Query:  126 SIDLNSLLTGLITVVIVIS---VLIYFLYTNLGQAYIATGDNKDMAKSFGINTDWMEVMG  182
              + +   L+ V IVI+    +L +F  T  G A  ATG N  MA++ G+NT  M ++G
Sbjct:  126 EWLSDYVFRPLLLVFIVIAAKLLLDWFFTQKGLAIRATGSNPRMARAQGVNTGGMILLG   185

Query:  183 LVVSNSLIALSGALVSQQDGYADVSKGIGVIVIGLASIIVGEVLYSTGLTLLERLIAIVI  242
              + +SN+L+AL+GAL +Q  G AD+S GIG IVIGLA++IVGE +    +L  L A+++
Sbjct:  186 MAISNALVALAGALFAQTQGGADISMGIGTIVIGLAAVIVGESILPSRRLILATL-AVIL  244

Query:  243 GSILYQFLISVVIT---LGFNTSYLKLISALVLALCLMIPVVKER                 284
            G+I+Y+F I++ +    +G   L L++A+++ + L+IP++K+R
Sbjct:  245 GAIVYRFFIALALNSDFIGLQAQDLNLVTAVLVTVALVIPMMKKR                 289
```

An alignment of the GAS and GBS proteins is shown below.

```
Identities = 227/287 (79%), Positives = 259/287 (90%)

Query:    1 MIISSVSQGLLWGILGLGIYLTFRILKFPDMTTEGSFPLGGAVCVTLMNQGVNPILATIL   60
            MIISSVSQGL+WG+LGLGIYLTFRIL FPDMTTEGSFPLGGAV VT ++ G NP L+T+L
Sbjct:    5 MIISSVSQGLIWGVLGLGIYLTFRILNFPDMTTEGSFPLGGAVAVTAISLGWNPFLSTLL   64

Query:   61 GMLSGMLAGFVTGLLYTKGKIPTILAGILVMTSCHSIMLMVMKRANLGLNEIQTLKDFLP  120
            GMLSG LAGF+TGLLYTKGK PT LAGILVMTSC+SIMLMVM RANLGL++ +  +D LP
Sbjct:   65 GMLSGALAGFLTGLLYTKGKMPTLLAGILVMTSCNSIMLMVMGRANLGLHDHKRIQDCLP  124

Query:  121 FSNDLNLLVLGLIAILLVISALIYFLYTRLGQAYIATGDNPDMAKSFGIDTDKMEMLGLI  180
            FS DLN L+ GLI +++VIS LIYFLYT LGQAYIATGDN DMAKSFGI+TD ME++GL+
Sbjct:  125 FSIDLNSLLTGLITVVIVISVLIYFLYTNLGQAYIATGDNKDMAKSFGINTDWMEVMGLV  184

Query:  181 VSNGLIALSGALVSQQDGYADVSKGIGVIVIGLASIIIGEVLYSTGLTLFERLIAIVVGS  240
            VSN LIALSGALVSQQDGYADVSKGIGVIVIGLASII+GEVLYSTGLTL ERLIAIV+GS
Sbjct:  185 VSNSLIALSGALVSQQDGYADVSKGIGVIVIGLASIIVGEVLYSTGLTLLERLIAIVIGS  244

Query:  241 ILYQFLITAVIALGFNTNYLKLFSAIVLGICLMVPVLKTKILKGVRL              287
            ILYQFLI+ VI LGFNT+YLKL SA+VL +CLM+PV+K   KGVRL
Sbjct:  245 ILYQFLISVVITLGFNTSYLKLISALVLALCLMIPVVKERFFKGVRL              291
                                                                          45
```

A related GBS gene <SEQ ID 8681> and protein <SEQ ID 8682> were also identified. Analysis of this protein sequence reveals the following:

```
Lipop: Possible site: -1 Crend: 0
McG: Discrim Score: 4.24
GvH: Signal Score (-7.5): -6.43
Possible site: 24
>>> Seems to have an uncleavable N-term signal seq
ALOM program      count: 8       value: -15.12        threshold: 0.0
INTEGRAL          Likelihood = -15.12   Transmernbrane   127-143 (119-151)
INTEGRAL          Likelihood = -7.54    Transmembrane    206-222 (201-225)
INTEGRAL          Likelihood = -6.48    Tranamembrane    260-276 (258-282)
INTEGRAL          Likelihood = -5.84    Transmembrane    234-250 (231-257)
INTEGRAL          Likelihood = -4.78    Transmembrane     55-71  (54-72)
INTEGRAL          Likelihood = -3.61    Transmembrane    177-193 (176-194)
INTEGRAL          Likelihood = -3.35    Transmembrane     84-100 (83-102)
INTEGRAL          Likelihood = -1.91    Transmembrame     10-26  (10-26)
PERIPHERAL        Likelihood = 4.77                36
modified ALOM score: 3.52
```

-continued

*** Reasoning Step: 3

----- Final Results -----
            bacterial membrane --- Certainty = 0.7050 (Affirmative) < succ>
            bacterial outside  --- Certainty = 0.0000 (Not Clear)   < succ>
            bacterial cytoplasm --- Certainty = 0.0000 (Not Clear)  < succ>

The protein has homology with the following sequences in the databases:

```
ORF00338(298-1146 of 1461)
GP|9950013|gb|AAG07224.1|AE004801_2|AE004801(4-291 of 296)probable permease of
ABC transporter{Pseudomonas aeruginosa}
% Match = 20.2
% Identity = 40.8    % Similarity = 68.3
Matches = 116   Mismatches = 84   Conservative Sub.s = 78
     126       156       186       216       246       276       306       336
YGLGLETAKQAIKVLRGKPVKDVPVKVIDTGKPSLNLKAAKHLGIKIPKKIMKQAEITVKVDD*KEGFMISSVSQGLLW
                                                                |:  ::   ||::
                                                               MSLFSLFGALEIGLIF
                                                                      10

366       396       426       456       486       516       546       576
GILGLGIYLTFRILKFPDMTTEGSFPLGGAVCVTLMNQGVNPILATILGMLSGMLAGFVTGLLYTKGKIPTILAGILVMT
 ::  ||::::||:|:|||:| :||||||||  ||:  |:|  ||:   :| |||: ||||  |  || :|| ||:|
SLVALGVFISFRLLRFPDLTVDGSFPLGGAVCATLIALGWDPYSATLAATAAGALAGLATGLLNVKLKIMDLLASILMMI
        30        40        50        60        70        80        90

606       636              690       720       747       777       807
SCHSIMLMVMKRANLGLNEIQTLKDFL-P-FSNDLNLLVLGLIAILLVISALI-YFLYTRLGQAYIATGDNPDMAKSFGI
: :|   |:|  |:   :       ||   :   |  |  |:::    | :| :   ||  ||  ||   |   |:
ALYSINLRIMGKPNVPLIAEPTLFTLLQPEWLSDYVFRPLLLVFIVIAAKLLLDWFFTTQKGLAIRATGSNPRMARAQGV
        110       120       130       140       150       160       170

837       867       897       927       957       987      1017      1047
DTDKMEMLGLIVSNGLIALSGALVSQQDGYADVSKGIGVIXIGLASIIIGLASIIIGLASI...
(alignment rendering partial)
NTGGMILLGMAISNALVALAGALFAQTQGGADISMGIGTIVIGLAAVIVGESILPSRRLILATL-AVILGAIVYRFFI--
        190       200       210       220       230       240       250

1077     1086      1116      1146      1176      1206      1236      1266
VIALGFNTNY-------LKLFSAIVLGICLMVPVLKTKILKGVRL*W**KS*S*KKQPYKSVMV*QK*KRY*IMLI*VFM
 ||  :|:::        |  | :|:::  :  |::|::|  ::|
--ALALNSDFIGLQAQDLNLVTAVLVTVALVIPMMKKRLLGKKGA
          270       280       290
```

Based on this analysis, it was predicted that these proteins and their epitopes could be useful antigens for vaccines or diagnostics.

EXAMPLE 894

A DNA sequence (GBSx0948) was identified in *S. agalactiae* <SEQ ID 2717> which encodes the amino acid sequence <SEQ ID 2718>. This protein is predicted to be ABC transporter (potA). Analysis of this protein sequence reveals the following:

```
Possible Site: 36
>>> Seems to have an uncleavable N-term signal seq

----- Final Results -----
            bacterial membrane --- Certainty = 0.0000 (Not Clear) < succ>
            bacterial outside  --- Certainty = 0.0000 (Not Clear) < succ>
            bacterial cytoplasm --- Certainty= 0.0000 (Not Clear) < succ>
```

A related GBS nucleic acid sequence <SEQ ID 9887> which encodes amino acid sequence <SEQ ID 9888> was also identified.

The protein has homology with the following sequences in the GENPEPT database.

```
>GP: AAF86640 GB: AF162694 ABC transporter [Enterococcus gallinarum]
Identities = 117/252 (46%), Positives = 167/252 (65%)

Query:   19 MVMKIIELKEATVQVSNGLAEMKTILDHVNLSIYEHDFITILGGNGAGKSTLFNVIAGTL   78
            M   ++ + +       G      +L  ++L++    DFITI+GGNGAGKSTL N IAGT+
Sbjct:    1 MTTPVLTISDLHQTFEKGTINENHVLRGIDLTMNSGDFITIIGGNGAGKSTLLNSIAGTI   60

Query:   79 MLSSGNIYIMGQDVTNLSAEKRAKYLSRVFQDPKMGTAPRMTVAENLLVAKFRGEKRPLV  138
               G I +  +++T  S   +R+K +SRVFQDP+MGTA R+TV ENL +A   RG+ R
Sbjct:   61 PTEQGKIVLGDKEITRHSVTRRSKEISRVFQDPRMGTAVRLTVEENLALAYKRGQVRGFS  120

Query:  139 PRKIINYTEEFQKLIARTGNGLDRHLETPTGLLSGGQRQALSLLMATLKKPNLLLLDEHT  198
                    +    F++ +AR     GL+  L T  GLLSGGQRQA++LLMATL++P L+LLDEHT
Sbjct:  121 SGVKGKHRAFFKEKLARLNLGLENRLTTEIGLLSGGQRQAITLLMATLQQPKLILLDEHT  180

Query:  199 AALDPRTSVSLMGLTDEFIKQDSLTALMITHHMEDALKYGNRVLVMKDGKIVRDLNQAQR  258
               AALDP+TS+++M LTD+ I++   LTA M+TH MEDA++YGNR++++  GKIV D+   +K
Sbjct:  181 AALDPKTSMTVMALTDQLIQEQQLTAFMVTHDMEDAIRYGNRLIMLHQGKIVVDITGEEK  240

Query:  259 NKMAIADYYQLF                                                 270
                + + D   LF
Sbjct:  241 QSLTVPDLMALF                                                 252
```

A related DNA sequence was identified in *S. pyogenes* <SEQ ID 2719> which encodes the amino acid sequence <SEQ ID 2720>. Analysis of this protein sequence reveals the following:

```
Possible site: 58
>>> Seems to have no N-terminal signal sequence

----- Final Results -----
              bacterial cytoplasm --- Certainty = 0.2249 (Affirmative) < succ>
              bacterial membrane  --- Certainty = 0.0000 (Not Clear)   < succ>
              bacterial outside   --- Certainty = 0.0000 (Not Clear)   < succ>
```

An alignment of the GAS and GBS proteins is shown below.

```
Identities = 186/250 (74%), Positives = 210/250 (83%)

Query:   22 KIIELKEATVQVSNGLAEMKTILDHVNLSIYEHDFITILGGNGAGKSTLFNVIAGTLMLS   81
            KIIEL  ATV V NG  + KTILD+V L+IYEHDF+TILGGNGAGKSTLFNVIAGTL L+
Sbjct:    3 KIIELINATVDVDNGFEDAKTILDNVTLTIYEHDFLTILGGNGAGKSTLFNVIAGTLSLT   62

Query:   82 SGNIYIMGQDVTNLSAEKRAKYLSRVFQDPKMGTAPRMTVAENLLVAKFRGEKRPLVPRK  141
             G I I+GQDVT+   AEKRA YLSRVFQD KMGTAPRMTVAENLL+A+ RG KR L  RK
Sbjct:   63 RGQIRILGQDVTHWPAEKRALYLSRVFQDSKMGTAPRMTVAENLLIARQRGGKRSLASRK  122

Query:  142 IINYTEEFQKLIARTGNGLDRHLETPTGLLSGGQRQALSLLMATLKKPNLLLLDEHTAAL  201
            I +   F+ L+ RTGNGL++HLETP GLLSGGQRQALSLLMATLKKP LLLLDEHTAAL
Sbjct:  123 ITEHLASFEDLVKRTGNGLEKHLETPAGLLSGGQRQALSLLMATLKKPALLLLDEHTAAL  182

Query:  202 DPRTSVSLMGLTDEFIKQDSLTALMITHHMEDALKYGNRVLVMKDGKIVRDLNQAQKNKM  261
            DP+TS SLM LTDEF+ +D LTALMITHHMEDAL YGNR++VMKDG I++DLNQ +K ++
Sbjct:  183 DPKTSQSLMQLTDEFVTKDGLTALMITHHMEDALTYGNRLIVMKDGNIIKDLNQMEKEQL  242

Query:  262 AIADYYQLFD                                                   271
              I  DYYQLFD
Sbjct:  243 TITDYYQLFD                                                   252
```

Based on this analysis, it was predicted that these proteins and their epitopes could be useful antigens for vaccines or diagnostics.

EXAMPLE 895

A DNA sequence (GBSx0949) was identified in *S. agalactiae* <SEQ ID 2721> which encodes the amino acid sequence <SEQ ID 2722>. Analysis of this protein sequence reveals the following:

```
Possible site: 33
>>> Seems to have no N-terminal signal sequence

----- Final Results -----
            bacterial cytoplasm --- Certainty = 0.1930 (Affirmative) < succ>
            bacterial membrane  --- Certainty = 0.0000 (Not Clear)   < succ>
            bacterial outside   --- Certainty = 0.0000 (Not Clear)   < succ>
RGD motif: 415-417
```

The protein has homology with the following sequences in the GENPEPT database.

```
>GP: BAB06117 GB: AP001515 unknown conserved protein [Bacillus halodurans]
Identities = 236/549 (42%), Positives = 362/549 (64%), Gaps = 2/549 (0%)

Query:    4 IKIMALGGVRENGKNLYVVEVNDSIFVLDAGLKYPENEQLGVDVVIPNLDYLIENKKRVQ    63
            I++ ALGGV E GKN+YVVEV+D +FV+DAGL +P++E LGVDVVIP++ YL+EN++RV+
Sbjct:    9 IRVFALGGVGEIGKNMYVVEVDDDLFVIDAGLMFPDDEMLGVDVVIPDISYLVENEERVR    68

Query:   64 GIFLTHGHADAIGALPYIIAEVKAPVFGSPLTIELAKLFVKNSTAVKKFNNFHVIDSETE   123
            I LTHGH D IG LPY++ ++  PV+G+ LT+ L + +K +  ++       +IDS +
Sbjct:   69 AILLTHGHEDHIGGLPYVLQKLNVPVYGTKLTLGLVEEKLKEAGLIRSAK-LKLIDSNSR   127

Query:  124 IEFQDAVISFFKTTHSIPESMGIVIGTKEGNIVYTGDFKFDQAARKYYQTDLARLAEIGR   183
            ++      +SFF+T HSIP+S+GI I T +G IV+TGDFKFDQ   Q ++ ++A IG
Sbjct:  128 LKLGSTPVSFFRTNHSIPDSVGICIQTSQGFIVHTGDFKFDQTPVDGKQAEIGKMAAIGH   187

Query:  184 DGVLALLSDSANATSNEQVASEYEVGDEIKSVIEDAEGRVIVAAVASNLIRIQQVFDAAA   243
              GVL LLSDS NA     SE EVG  I   E +GR+IV  ASN+ R+QQV  AA
Sbjct:  188 KGVLCLLSDSTNAERPGMTKSETEVGRGIAEAFEQTKGRIIVTTFASNVHRVQQVIHAAI   247

Query:  244 ENGRRVVLTGFDIENIVRTAIRMKRIHIADENMIIKPKDMTRYEDNELLILETGRMGEPI   303
             R++ + G + +V A R+ +    D+ + I +++++Y+D  + I+ TG  GEP+
Sbjct:  248 ATNRKLAVAGRSMVKVVSIAERLGYLEAPDD-LFIDIEEVSKYDDERVAIITTGSQGEPM   306

Query:  304 NGLQKMAIGRHRYVQIKDGDLVFIVTTPSIAKEAVVARVENLIYKAGGSVKLITQNLRVS   363
             + L +MA G HR + I + D V I  TP    E V+ + +L+++ G  V      + S
Sbjct:  307 SALSRMAKGAHRQITITENDTVIIAATPIPGNERSVSTIVDLLHRIGADVIFGHGKVHAS   366

Query:  364 GHANGRELQLLMNLLKPKYLFPIQGEYRDLSAHAGLAQEVGMSADDIYIVKRGDIMVLEK   423
            GH +  EL+L++NL++PK+  PI GE+R   AH  LA+ VG+  + I++V +G+++
Sbjct:  367 GNGSAEELKLMLNLMRPKFFVPIHGEFRMQHAHKELAKSVGIREEAIFLVDKGEVVEFRN   426

Query:  424 DGFFHSGSVPAGDVMIDGNAIGDVGNIVLRDKVLSEDGIFIVVITVSKKEKKIISKARV   483
             +G VP+G+V+IDG  +GDVGNIVLRDR++LS+DGI +VV T++K+   I+S  +
Sbjct:  427 GQGRKAGKVPSGNVLIDGLGVGDVGNIVLRDRRLLSKDGILVVVVTLNKQSGTILSGPNI   486

Query:  484 NTRGFVYVKKSRDILRESAELVNTTVEDYLSKDTFDWGELKGKVRDEVSKFLFDQTKRRP   543
             +RGFVYV++S  ++ E+ ELV T++   ++++   +W  LK  VR+ +S+FLF++TKRRP
Sbjct:  487 ISRGFVYVRESEKLIEEANELVTETLKKCVTENVNEWSSLKSNVREVLSRFLFEKTKRRP   546

Query:  544 AILPVVMEV   552
            ILP++MEV
Sbjct:  547 MILPIIMEV   555
```

A related DNA sequence was identified in *S. pyogenes* <SEQ ID 2723> which encodes the amino acid sequence <SEQ ID 2724>. Analysis of this protein sequence reveals the following:

```
Possible site: 33
>>> Seems to have no N-terminal signal sequence

----- Final Results -----
            bacterial cytoplasm --- Certainty = 0.2204 (Affirmative) < succ>
             bacterial membrane --- Certainty = 0.0000 (Not Clear)  < succ>
              bacterial outside --- Certainty = 0.0000 (Not Clear)  < succ>
```

The protein has homology with the following sequences in the databases:

```
>GP: BAB06117 GB: AP001515 unknown conserved protein [Bacillus halodurans]
Identities = 232/549 (42%), Positives = 360/549 (65%), Gaps = 2/549 (0%)

Query:   4 IKMIALGGVREYGKNFYLVEINDSMFILDAGLKYPENEQLGVDLVIPNLDYVIENKGKVQ   63
           I++ ALGGV E GKN Y+VE++D +F++DAGL +P++E LGVD+VIP++ Y++EN+ +V+
Sbjct:   9 IRVFALGGVGEIGKNMYVVEVDDDLFVIDAGLMFPDDEMLGVDVVIPDISYLVENEERVR   68

Query:  64 GIFLSHGHADAIGALPYLLAEVSAPVFGSELTIELAKLFVKSNNSTKKFNNFHVVDSDTE  123
             I L+HGH D IG LPY+L +++ PV+G++LT+ L +  +K       +  ++DS++
Sbjct:  69 AILLTHGHEDHIGGLPYVLQKLNVPVYGTKLTLGLVEEKLKEAGLIRSAK-LKLIDSNSR  127

Query: 124 IEFKDGLVSFFRTTHSIPESMGIVIGTDKGNIIYTGDFKFDQAAREGYQTDLLRLAEIGK  183
            ++     VSFFRT HSIP+S+GI I T +G I++TGDFKFDQ    +G Q ++ ++A IG
Sbjct: 128 LKLGSTPVSFFRTNHSIPDSVGICIQTSQGFIVHTGDFKFDQTPVDGKQAEIGKMAAIGH  187

Query: 184 EGVLALLSDSVNATSNDQIASESEVGEEMDSVISDADGRVIVAAVASNLVRIQQVFDSAT  243
           +GVL LLSDS NA        SE+EVG +       GR+IV  ASN+ R+QQV  +A
Sbjct: 188 KGVLCLLSDSTNAERPGMTKSETEVGRGIAEAFEQTKGRIIVTTFASNVHRVQQVIHAAI  247

Query: 244 AHGRRVVLTGTDAENIVRTALRLEKLMITDERLLIKPKDMSKFEDHELIILEAGRMGEPI  303
           A   R++ + G   +V  A RL   L  D+ L I  +++SK++D + I+  G  GEP+
Sbjct: 248 ATNRKLAVAGRSMVKVVSIAERLGYLEAPDD-LFIDIEEVSKYDDERVAIITTGSQGEPM  306

Query: 304 NSLQKMAAGRHRYVQIKEGDLVYIVTTPSTAKEAMVARVENLIYKAGGSVKLITQNLRVS  363
           ++L +MA G HR + I E D V I   TP      E  V+ + +L+++ G  V    + S
Sbjct: 307 SALSRMAKGAHRQITITENDTVIIAATPIPGNERSVSTIVDLLHRIGADVIFGHGKVHAS  366

Query: 364 GHANGRDLQLLMNLLKPQYLFPVQGEYRDLAAHAKLAEEVGIFPENIHILKRGDIMVLND  423
           GH +  +L+L++NL++P++    P+ GE+R   AH +LA+ VGI  E I ++  +G+++     +
Sbjct: 367 GHGSAEELKLMLNLMRPKFFVPIHGEFRMQHAHKELAKSVGIREEAIFLVDKGEVVEFRN  426

Query: 424 EGFLHEGGVPASDVMIDGNAIGDVGNIVLRDRKVLSEDGIFIVAITVSKKEKRIISKAKV  483
              G VP+ +V++IDG  +GDVGNIVLRDR++LS+DGI +V +T++K+  I+S   +
Sbjct: 427 GQGRKAGKVPSGNVLIDGLGVGDVGNIVLRDRRLLSKDGILVVVVTLNKQSGTILSGPNI  486

Query: 484 NTRGFVYVKKSHDILRESAELVNTTVGNYLKKDTFDWGELKGNVRDDLSKFLFEQTKRRP  543
             +RGFVYV++S  ++ E+ ELV T+    + ++W LK NVR+ LS+FLFE+TKRRP
Sbjct: 487 ISRGFVYVRESEKLIEEANELVTETLKKCVTENVNEWSSLKSNVREVLSRFLFEKTKRRP  546

Query: 544 AILPVVMEV                                                    552
            ILP++MEV
Sbjct: 547 MILPIIMEV                                                    555
```

An alignment of the GAS and GBS proteins is shown below.

```
Identities = 446/553 (80%), Positives = 513/553 (92%)

Query:   1 MSDIKIMALGGVRENGKNLYVVEVNDSIFVLDAGLKYPENEQLGVDVVIPNLDYLIENKK   60
           M+DIK++ALGGVRE GKN Y+VE+NDS+F+LDAGLKYPENEQLGVD+VIPNLDY+IENK
Sbjct:   1 MTDIKMIALGGVREYGKNFYLVEINDSMFILDAGLKYPENEQLGVDLVIPNLDYVIENKG   60

Query:  61 RVQGIFLTHGHADAIGALPYIIAEVKAPVFGSPLTIELAKLFVKNSTAVKKFNNFHVIDS  120
           +VQGIFL+HGHADAIGALPY++AEV APVFGS LTIELAKLFVK++ + KKFNNFHV+DS
Sbjct:  61 KVQGIFLSHGHADAIGALPYLLAEVSAPVFGSELTIELAKLFVKSNNSTKKFNNFHVVDS  120
```

-continued
```
Query: 121 ETEIEFQDAVISFFKTTHSIPESMGIVIGTKEGNIVYTGDFKFDQAARKYYQTDLARLAE 180
            +TEIEF+D ++SFF+TTHSIPESMGIVIGT +GNI+YTGDFKFDQAAR+ YQTDL RLAE
Sbjct: 121 DTEIEFKDGLVSFFRTTHSIPESMGIVIGTDKGNIIYTGDFKFDQAAREGYQTDLLRLAE 180

Query: 181 IGRDGVLALLSDSANATSNEQVASEYEVGDEIKSVIEDAEGRVIVAAVASNLIRIQQVFD 240
            IG++GVLALLSDS NATSN+Q+ASE EVG+E+ SVI DA+GRVIVAAVASNL+RIQQVFD
Sbjct: 181 IGKEGVLALLSDSVNATSNDQIASESEVGEEMDSVISDADGRVIVAAVASNLVRIQQVFD 240

Query: 241 AAAENGRRVVLTGFDIENIVRTAIRMKRIHIADENMIIKPKDMTRYEDNELLILETGRMG 300
            +A  +GRRVVLTG D ENIVRTA+R++++ I DE ++IKPKDM+++ED+EL+ILE GRMG
Sbjct: 241 SATAHGRRVVLTGTDAENIVRTALRLEKLMITDERLLIKPKDMSKFEDHELIILEAGRMG 300

Query: 301 EPINGLQKMAIGRHRYVQIKDGDLVFIVTTPSIAKEAVVARVENLIYKAGGSVKLITQNL 360
            EPIN LQKMA GRHRYVQIK+GDLV+IVTTPS AKEA+VARVENLIYKAGGSVKLITQNL
Sbjct: 301 EPINSLQKMAAGRHRYVQIKEGDLVYIVTTPSTAKEAMVARVENLIYKAGGSVKLITQNL 360

Query: 361 RVSGHANGRELQLLMNLLKPKYLFPIQGEYRDLSAHAGLAQEVGMSADDIYIVKRGDIMV 420
            RVSGHANGR+LQLLMNLLKP+YLFP+QGEYRDL+AHA LA+EVG+  ++I+I+KRGDIMV
Sbjct: 361 RVSGHANGRDLQLLMNLLKPQYLFPVQGEYRDLAAHAKLAEEVGIFPENIHILKRGDIMV 420

Query: 421 LEKDGFFHSGSVPAGDVMIDGNAIGDVGNIVLRDRKVLSEDGIFIVVITVSKKEKKIISK 480
            L  +GF H G VPA DVMIDGNAIGDVGNIVLRDRKVLSEDGIFIV ITVSKKEK+IISK
Sbjct: 421 LNDEGFLHEGGVPASDVMIDGNAIGDVGNIVLRDRKVLSEDGIFIVAITVSKKEKRIISK 480

Query: 481 ARVNTRGFVYVKKSRDILRESAELVNTTVEDYLSKDTFDWGELKGKVRDEVSKFLFDQTK 540
            A+VNTRGFVYVKKS DILRESAELVNTTV +YL KDTFDWGELKG VRD++SKFLF+QTK
Sbjct: 481 AKVNTRGFVYVKKSHDILRESAELVNTTVGNYLKKDTFDWGELKGNVRDDLSKFLFEQTK 540

Query: 541 RRPAILPVVMEVR                                                553
            RRPAILPVVMEVR
Sbjct: 541 RRPAILPVVMEVR                                                553
```

There is also homology to SEQ ID 4910.

SEQ ID 2722 (GBS295) was expressed in *E. coli* as a GST-fusion product. SDS-PAGE analysis of total cell extract is shown in FIG. 48 (lane 2; MW 89.4 kDa). It was also expressed in *E. coli* as a His-fusion product. SDS-PAGE analysis of total cell extract is shown in FIG. 167 (lane 9 & 11; MW 79 kDa—thioredoxin fusion) and in FIG. 238 (lane 3; MW 79 kDa—thioredoxin fusion).

Purified Thio-GBS295-His is shown in FIG. 244, lane 3.

Based on this analysis, it was predicted that these proteins and their epitopes could be useful antigens for vaccines or diagnostics.

EXAMPLE 896

A DNA sequence (GBSx0950) was identified in *S. agalactiae* <SEQ ID 2725> which encodes the amino acid sequence <SEQ ID 2726>. This protein is predicted to be tributyrin esterase. Analysis of this protein sequence reveals the following:

```
Possible site: 22
>>> Seems to have a cleavable N-term signal seq.

----- Final Results -----
            bacterial outside --- Certainty = 0.3000 (Affirmative) < succ>
            bacterial membrane --- Certainty = 0.0000 (Not Clear) < succ>
            bacterial cytoplasm --- Certainty = 0.0000 (Not Clear) < succ>
```

A related GBS nucleic acid sequence <SEQ ID 9885> which encodes amino acid sequence <SEQ ID 9886> was also identified.

The protein has homology with the following sequences in the GENPEPT database.

```
>GP: AAF62859 GB: AF157484 tributyrin esterase [Lactococcus lactis
subsp. lactis]
Identities = 154/262 (58%), Positives = 188/262 (70%), Gaps = 4/262 (1%)

Query: 21 MAFFNIEYHSKVLGTERQVNVIYPDAFEMSDDKIDDCDIPVLYLLHGMGGNENSWQKRTN  80
           MA  NIEY+S+VLG R+VNVIYP++ ++ D      DIPVLYLLHGM GNENSW  R+
Sbjct:  1 MAVINIEYYSEVLGMNRKVNVIYPESSKVED--FTQTDIPVLYLLHGMSGNENSWIIRSG  58

Query: 81 IERLLRHTNLIVVMPSTDLAWYTNTKYGLDYFDAIAIELPKVLKRFFPNMSDKREKNFIA 140
           IERL+RHTNL +VMPSTDL+Y NT  YG++YFDAIA ELPKV+  FFPN+S KREKNFIA
Sbjct: 59 IERLIRHTNLAIVMPSTDLGFYVNTTYGMNYFDAIAHELPKVINNFFPNLSTKREKNFIA 118
```

```
                       -continued
Query:  141 GLSMGGYGAYKIALLTNRFSHAASLSGALSFDFDLLFNNGNNNINYWSGIFGDLNNTDNI  200
            GLSMGGYGAY++AL T+ FS+AASLSG L+FD    +   N    N  YW GIFG+
Sbjct:  119 GLSMGGYGAYRLALGTDYFSYAASLSGVLTFDG--MEENFKENPAYWGGIFGNWETFKGS  176

Query:  201 ERHSLRRYVESFDMKTKFYAWCGYEDFLFEANEVAIDELRQLGLTIDYFNDHGKHEWYYW  260
               +  L       + K K YAWCG +DFLF  NE A  EL++LG  I Y +  G HEWYYW
Sbjct:  177 DNEILSLADRKQENKPKLYAWCGKQDFLFPGNEYATAELKKLGFDITYESSDGVHEWYYW  236

Query:  261 NQQLEKVLEWLPVDYVKEERLS                                       282
            Q++E VL+WLP++Y +EERLS
Sbjct:  237 TQKIESVLKWLPINYKQEERLS                                       258
```

A related DNA sequence was identified in *S. pyogenes* <SEQ ID 2727> which encodes the amino acid sequence <SEQ ID 2728>. Analysis of this protein sequence reveals the following:

```
Possible site: 14
>>> Seems to have no N-terminal signal sequence

----- Final Results -----
            bacterial cytoplasm --- Certainty = 0.2183 (Affirmative) < succ>
            bacterial membrane  --- Certainty = 0.0000 (Not Clear)  < succ>
            bacterial outside   --- Certainty = 0.0000 (Not Clear)  < succ>
```

An alignment of the GAS and GBS proteins is shown below.

```
Identities = 172/262 (65%), Positives = 199/262 (75%), Gaps = 1/262 (0%)

Query:   21 MAFFNIEYHSKVLGTERQVNVIYPDAFEMSDDKIDDCDIPVLYLLHGMGGNENSWQKRTN   80
            MA   IEYHS VLG ER+VNVIYPD E+      D DIPVLYLLHGMGGNENSWQKRT
Sbjct:    1 MASIAIEYHSVVLGMERKVNVIYPDQSEIPKKDQGDKDIPVLYLLHGMGGNENSWQKRTA   60

Query:   81 IERLLRHTNLIVVMPSTDLAWYTNTKYGLDYFDAIAIELPKVLKRFFPNMSDKREKNFIA  140
            IERLLRHTNLIVVMPSTDL WYT+T YGL+Y+ A++ ELP+VL  FFPNM+ KREK F+A
Sbjct:   61 IERLLRHTNLIVVMPSTDLGWYTDTAYGLNYYRALSQELPQVLAAFFPNMTQKREKTFVA  120

Query:  141 GLSMGGYGAYKIALLTNRFSHAASLSGALSFDFDLLFNNGNNNINYWSGIFGDLNNTDNI  200
            GLSMGGYGA+K AL +NRFS+AAS SGAL F + L       + YW G+FG  ++ D +
Sbjct:  121 GLSMGGYGAFKWALKSNRFSYAASFSGALDFSPETLLEGKLGELAYWQGVFGQFDDPD-L  179

Query:  201 ERHSLRRYVESFDMKTKFYAWCGYEDFLFEANEVAIDELRQLGLTIDYFNDHGKHEWYYW  260
              ++H L+   V   D KTKFYAWCGYEDFLF  NE AI + +  GL IDY   HGKHEWYYW
Sbjct:  180 DKHYLKNMVAESDGKTKFYAWCGYEDFLFATNEKAIADFQAQGLDIDYHKGHGKHEWYYW  239

Query:  261 NQQLEKVLEWLPVDYVKEERLS                                       282
            NQQLE +LEWLP++Y KEERLS
Sbjct:  240 NQQLEVLLEWLPINYQKEERLS                                       261
```

Figure 229:
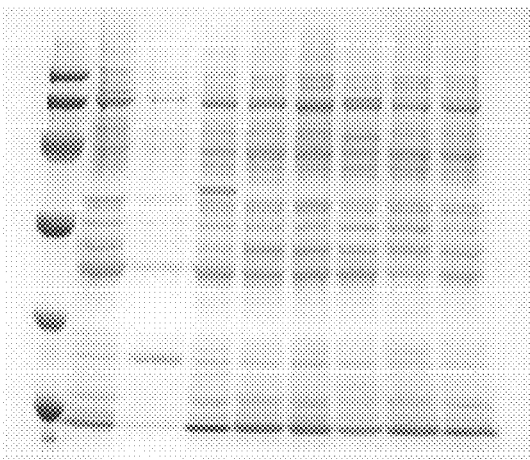

SEQ ID 2726 (GBS645) was expressed in *E. coli* as a GST-fusion product. SDS-PAGE analysis of total cell extract is shown in FIG. 129 (lanes 8 & 10; MW 60 kDa+lane 9; MW 27 kDa) and in FIG. 186 (lane 4; MW 60 kDa). It was also expressed in *E. coli* as a His-fusion product. SDS-PAGE analysis of total cell extract is shown in FIG. 129 (lane 12; MW 34.7 kDa), in FIG. 140 (lane 8; MW 35 kDa) and in FIG. 178 (lane 4; MW 35 kDa). Purified GBS645-GST is shown in FIG. 236, lane 11; purified GBS645-His is shown in FIG. 229, lanes 34.

Based on this analysis, it was predicted that these proteins and their epitopes could be useful antigens for vaccines or diagnostics.

EXAMPLE 897

A DNA sequence (GBSx0951) was identified in *S. agalactiae* <SEQ ID 2729> which encodes the amino acid sequence <SEQ ID 2730>. Analysis of this protein sequence reveals the following:

```
Possible site: 44
>>> Seems to have no N-terminal signal sequence
INTEGRAL    Likelihood = -9.34     Transmembrane      22-38 (18-46)

----- Final Results -----
            bacterial membrane  --- Certainty = 0.4736 (Affirmative) < succ>
            bacterial outside   --- Certainty = 0.0000 (Not Clear)  < succ>
            bacterial cytoplasm --- Certainty = 0.0000 (Not Clear)  < succ>
```

The protein has no-significant homology with any sequences in the GENPEPT database.

A related DNA sequence was identified in *S. pyogenes* <SEQ ID 2731> which encodes the amino acid sequence <SEQ ID 2732>. Analysis of this protein sequence reveals the following:

```
Possible site: 52
>>> Seems to have an uncleavable N-term signal seq
INTEGRAL    Likelihood = -7.43        Transmembrane      25-41 (20-46)
INTEGRAL    Likelihood = -2.71        Transmembrane      4-20 (3-20)

----- Final Results -----
            bacterial membrane --- Certainty = 0.3972 (Affirmative) < succ>
             bacterial outside --- Certainty = 0.0000 (Not Clear)   < succ>
           bacterial cytoplasm --- Certainty = 0.0000 (Not Clear)   < succ>
```

The protein has no significant homology with any sequences in the GENPEPT database.

An alignment of the GAS and GBS proteins is shown below.

```
Identities = 31/87 (35%), positives = 50/87 (56%), Gaps = 2/87 (2%)

Query:   1 MRTLFRMIFAIPKFIFRLIWNIIWGIFKTVLVIAIILFGLYYYANHSQSEFANQLSDIIQ   60
           M+ L  +I  +PK I ++ W++I G  +T+L++ II+ GL YY+NHS S  AN++S  I
Sbjct:   1 MKQLLAIILWLPKLIVKMFWHLIKGFLQTILLVTIIIIGLMYYSNHSDSVLANKIS--IV   58

Query:  61 TGKTFLNFADTNQLKNSFTNLATDNVH                                   87
           T +    F   Q ++ T   + N H
Sbjct:  59 TEQVVQIFDILTQKPSAKTRHGSGNSH                                   85
```

Figure 155:
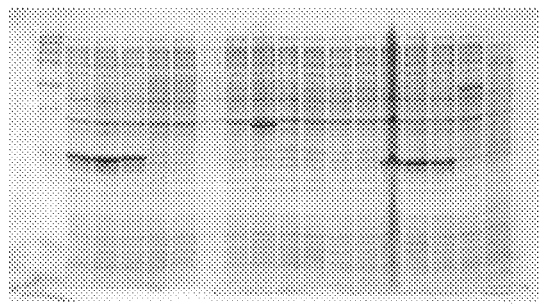
Figure 246:
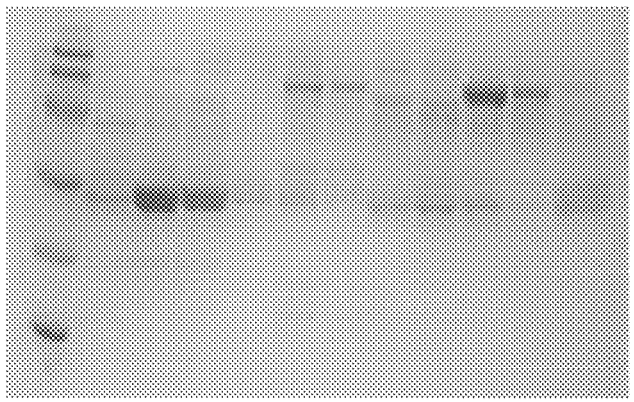

SEQ ID 2730 (GBS220d) was expressed in *E. coli* as a GST-fusion product. SDS-PAGE analysis of total cell extract is shown in FIG. 155 (lane 11-13; MW 50 kDa) and in FIG. 239 (lane 12; MW 50 kDa). It was also expressed in *E. coli* as a His-fusion product. SDS-PAGE analysis of total cell extract is shown in FIG. 155 (lane 14-16; MW 25.2 kDa) and in FIG. 184 (lane 7; MW 25 kDa). Purified GBS220d-GST is shown in FIG. 246, lanes 3 & 4.

Based on this analysis, it was predicted that these proteins and their epitopes could be useful antigens for vaccines or diagnostics.

EXAMPLE 898

A DNA sequence (GBSx0953) was identified in *S. agalactiae* <SEQ ID 2733> which encodes the amino acid sequence <SEQ ID 2734>. This protein is predicted to be unnamed protein product (rpiA). Analysis of this protein sequence reveals the following:

```
Possible site: 33
>>> Seems to have no N-terminal signal sequence

----- Final Results -----
           bacterial cytoplasm --- Certainty = 0.2538 (Affirmative) < succ>
            bacterial membrane --- Certainty = 0.0000 (Not Clear)   < succ>
             bacterial outside --- Certainty = 0.0000 (Not Clear)   < succ>
```

The protein has homology with the following sequences in the GENPEPT database.

```
>GP: CAB69583 GB: A93589 unnamed protein product [Spinacia oleracea]
Identities = 114/232 (49%), Positives = 147/232 (63%), Gaps = 11/232 (4%)

Query:   2 DELKKLAGVTAAKYVKNGMIVGLGTGSTAYFFVEEIGRRVKEEGL-QVVGVTTSNRTTEQ   60
           D+LKKLA  A   VK+GM++GLGTGSTA F V  IG +   L  +VG+ TS RT EQ
Sbjct:  59 DDLKKLAAEKAVDSVKSGMVLGLGTGSTAAFAVSRIGELLSAGKLTNIVGIPTSKRTAEQ  118

Query:  61 ARGLGIPLKSADDIDVIDVTVDGADEVDPDFNGIKGGGGALLMEKIVATPTKEYIWVVDE  120
           A  LGIPL   DD   ID+ +DGADEVDPD N +KG GGALL EK+V   + ++I VVD+
Sbjct: 119 AASLGIPLSVLDDHPRIDLAIDGADEVDPDLNLVKGRGGALLREKMVEAASDKFIVVVDD  178

Query: 121 SKLVETLGAFKL--PVEVV----RYGSERLFRVFKSKGYCPSFRETEGDR--FITDMGNY  172
           +KLV+ LG +L  PVEVV    +Y  +RL  +FK  G C +    EGD   ++TD  NY
Sbjct: 179 TKLVDGLGGSRLAMPVEVVQFCWKYNLKRLQEIFKELG-CEAKLRMEGDSSPYVTDNSNY  237
```

```
                           -continued
Query: 173 IIDLDL-KKIEDPKQLANELDHTVGVVEHGLFNGMVNKVIVAGKNGLDILEK   223
           I+DL    I+D +    E+   GVVEHGLF GM ++VI+AGK G+ +  K
Sbjct: 238 IVDLYFPTSIKDAEAAGREISALEGVVEHGLFLGMASEVIIAGKTGVSVKTK       289
```

A related DNA sequence was identified in *S. pyogenes* <SEQ ID 2735> which encodes the amino acid sequence <SEQ ID 2736>. Analysis of this protein sequence reveals the following:

```
Possible site: 30
>>> Seems to have no N-terminal signal sequence

----- Final Results -----
              bacterial cytoplasm --- Certainty = 0.1646 (Affirmative) < succ>
                bacterial membrane --- Certainty = 0.0000 (Not Clear) < succ>
                  bacterial outside --- Certainty = 0.0000 (Not Clear) < succ>
```

An alignment of the GAS and GBS proteins is shown below.

```
Identities = 166/222 (74%) , Positives = 190/222 (84%)

Query:   1 MDELKKLAGVTAAKYVKNGMIVGLGTGSTAYFFVEEIGRRVKEEGLQVVGVTTSNRTTEQ   60
           M+ LKK+AGVTAA+YV +GM +GLGTGSTAY+FVEEIGRRVK+EGLQVVGVTTS+ T++Q
Sbjct:   1 MEALKKIAGVTAAQYVTDGMTIGLGTGSTAYYFVEEIGRRVKQEGLQVVGVTTSSVTSKQ   60

Query:  61 ARGLGIPLKSADDIDVIDVTVDGADEVDPDFNGIKGGGGALLMEKIVATPTKEYIWVVDE  120
            A  LGIPLKS DDID ID+TVDGADEVD +FNGIKGGG ALLMEKIVATPTKEYIWVVD
Sbjct:  61 AEVLGIPLKSIDDIDSIDLTVDGADEVDKNFNGIKGGGAALLMEKIVATPTKEYIWVVDA  120

Query: 121 SKLVETLGAFKLPVEVVRYGSERLFRVFKSKGYCPSFRETEGDRFITDMGNYIIDLDLKK  180
           SK+VE LGAFKLPVEVV+YG++RLFRVF+  GY PSFR     R +TDM NYIIDLDL
Sbjct: 121 SKMVEHLGAFKLPVEVVQYGADRLFRVFEKAGYKPSFRMKGDSRLVTDMQNYIIDLDLGC  180

Query: 181 IEDPKQLANELDHTVGVVEHGLFNGMVNKVIVAGKNGLDILE                   222
           I+DP     + LD TVGVVEHGLFNGMV+KVIVA K+G+ +LE
Sbjct: 181 IKDPVAFGHLLDGTVGVVEHGLFNGMVDKVIVASKDGVTVLE                   222
```

Based on this analysis, it was predicted that these proteins and their epitopes could be useful antigens for vaccines or diagnostics.

EXAMPLE 899

A DNA sequence (GBSx0954) was identified in *S. agalactiae* <SEQ ID 2737> which encodes the amino acid sequence <SEQ ID 2738>. This protein is predicted to be phosphopentomutase (deoB). Analysis of this protein sequence reveals the following:

```
Possible site: 22
>>> Seems to have no N-terminal signal sequence

----- Final Results -----
              bacterial cytoplasm --- Certainty = 0.0546 (Affirmative) < succ>
                bacterial membrane --- Certainty = 0.0000 (Not Clear) < succ>
                  bacterial outside --- Certainty = 0.0000 (Not Clear) < succ>
```

The protein has homology with the following sequences in the GENPEPT database.

```
>GP: AAC45496 GB: U80410 phosphopentomutase [Lactococcus lactis
subsp. cremoris]
Identities = 275/408 (67%), Positives = 325/408 (79%), Gaps = 7/408 (1%)

Query:    3 QFDRIHLVVLDSVGIGAAPDANDFVNAGVP------DGASDTLGHISKTVGLAVPNMAKI   56
            +F RIHLVV+DSVGIGAAPDA+ F N V      D  SDT+GHIS+  GL VPN+ K+
Sbjct:    4 KFGRIHLVVMDSVGIGAAPDADKFFNHDVETHEAINDVKSDTIGHISEIRGLDVPNLQKL   63

Query:   57 GLGNIPRPQALKTVPAEENPSGYATKLQEVSLGKDTMTGHWEIMGLNITEPFDTFWNGFP  116
            G GNIPR   LKT+PA + P+ Y TKL+E+S GKDTMTGHWEIMGLNI  PF T+  G+P
Sbjct:   64 GWGNIPRESPLKTIPAAQKPAAYVTKLEEISKGKDTMTGHWEIMGLNIQTPFPTYPEGYP  123

Query:  117 EDIITKIEDFSGRKVIREANKPYSGTAVIDDFGPRQMETGELIIYTSADPVLQIAAHEDI  176
            ED++ KIE+FSGRK+IREANKPYSGTAVI+DFGPRQ+ETGELIIYTSADPVLQIAAHED+
Sbjct:  124 EDLLEKIEEFSGRKIIREANKPYSGTAVIEDFGPRQLETGELIIYTSADPVLQIAAHEDV  183

Query:  177 IPLEELYRICEYARSITMERPALL-GRIIARPYVGEPGNFTRTANRHDYAVSPFEDTVLN  235
            I   EELY+ICEY RSIT+E   ++ GRIIARPYVGE GNF RT  R DYA+SPF +TVL
Sbjct:  184 ISREELYKICEYVRSITLEGSGIMIGRIIARPYVGEAGNFERTDGRRDYALSPFAETVLE  243

Query:  236 KLDQAGIDTYAVGKINDIFNGSGINHDMGHNKSNSHGIDTLIKTMGLSEFEKGFSFTNLV  295
            KL +AGIDTY+VGKI+DIFN  G+  +DMGHN ++   G+D L+K M   +EF +GFSFTNLV
Sbjct:  244 KLYKAGIDTYSVGKISDIFNTVGVKYDMGHNHNDMDGVDRLLKAMTKTEFTEGFSFTNLV  303

Query:  296 DFDALYGHRRDPHGYRDCLHEFDERLPEIISAMRDKDLLLITADHGNDPTYAGTDHTREY  355
            DFDA YGHRRD  GY  + +FD RLPEII AM++ DLL+ITADHGNDP+Y GTDHTREY
Sbjct:  304 DFDAKYGHRRDVEGYGKAIEDFDGRLPEIIDAMKEDDLLMITADHGNDPSYVGTDHTREY  363

Query:  356 IPLLAYSPSFTGNGLIPVGHFADISATVADNFGVDTAMIGESFLQDLV              403
            IPL+ +S SF    ++PVGHFADISAT+A+NF V  A  GESFL  LV
Sbjct:  364 IPLVIFSKSFKEPKVLPVGHFADISATIAENFSVKKAQTGESFLDALV              411
```

A related DNA sequence was identified in *S. pyogenes* <SEQ ID 2739> which encodes the amino acid sequence <SEQ ID 2740>. Analysis of this protein sequence reveals the following:

```
Possible site: 22
>>> Seems to have no N-terminal signal sequence

----- Final Results -----
            bacterial cytoplasm --- Certainty = 0.0185(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below.

```
Identities = 348/402 (86%), Positives = 374/402 (92%)

Query:    1 MSQFDRIHLVVLDSVGIGAAPDANDFVNAGVPDGASDTLGHISKTVGLAVPNMAKIGLGN   60
            MS+F+RIHLVVLDSVGIGAAPDA+ F NAGV D  SDTLGHIS+  GL+VPNMAKIGLGN
Sbjct:    1 MSKFNRIHLVVLDSVGIGAAPDADKFFNAGVADTDSDTLGHISEAAGLSVPNMAKIGLGN   60

Query:   61 IPRPQALKTVPAEENPSGYATKLQEVSLGKDTMTGHWEIMGLNITEPFDTFWNGFPEDII  120
            I RP  LKTVP E+NP+GY TKL+EVSLGKDTMTGHWEIMGLNITEPFDTFWNGFPE+I+
Sbjct:   61 ISRPIPLKTVPTEDNPTGYVTKLEEVSLGKDTMTGHWEIMGLNITEPFDTFWNGFPEEIL  120

Query:  121 TKIEDFSGRKVIREANKPYSGTAVIDDFGPRQMETGELIIYTSADPVLQIAAHEDIIPLE  180
            TKIE+FSGRK+IREANKPYSGTAVIDDFGPRQMETGELI+YTSADPVLQIAAHEDIIP+E
Sbjct:  121 TKIEEFSGRKIIREANKPYSGTAVIDDFGPRQMETGELIVYTSADPVLQIAAHEDIIPVE  180

Query:  181 ELYRICEYARSITMERPALLGRIIARPYVGEPGNFTRTANRHDYAVSPFEDTVLNKLDQA  240
            ELY+ICEYARSIT+ERPALLGRIIARPYVG+PGNFTRTANRHDYAVSPF+DTVLNKL  A
Sbjct:  181 ELYKICEYARSITLERPALLGRIIARPYVGDPGNFTRTANRHDYAVSPFQDTVLNKLADA  240

Query:  241 GIDTYAVGKINDIFNGSGINHDMGHNKSNSHGIDTLIKTMGLSEFEKGFSFTNLVDFDAL  300
            G+  TYAVGKINDIFNGSGI +DMGHNKSNSHGIDTLIKT+ L  EF KGFSFTNLVDFDA
Sbjct:  241 GVPTYAVGKINDIFNGSGITNDMGHNKSNSHGIDTLIKTLQLPEFTKGFSFTNLVDFDAN  300

Query:  301 YGHRRDPHGYRDCLHEFDERLPEIISAMRDKDLLLITADHGNDPTYAGTDHTREYIPLLA  360
            +GHRRDP GYRDCLHEFD RLPEII+ M++ DLLLITADHGNDPTYAGTDHTREYIPLLA
Sbjct:  301 FGHRRDPEGYRDCLHEFDNRLPEIIANMKEDDLLLITADHGNDPTYAGTDHTREYIPLLA  360
```

-continued

```
Query: 361 YSPSFTGNGLIPVGHFADISATVADNFGVDTAMIGESFLQDL       402
           YS SFTGNGLIP GHFADISATVA+NFGVDTAMIGESFL  L
Sbjct: 361 YSVSFTGNGLIPQGHFADISATVAENFGVDTAMIGESFLSHL       402
```

Based on this analysis, it was predicted that these proteins and their epitopes could be useful antigens for vaccines or diagnostics.

EXAMPLE 900

A DNA sequence (GBSx0955) was identified in *S. agalactiae* <SEQ ID 2741> which encodes the amino acid sequence <SEQ ID 2742>. This protein is predicted to be unnamed protein product (mtaP). Analysis of this protein sequence reveals the following:

```
Possible site: 36
>>> Seems to have no N-terminal signal sequence
    INTEGRAL    Likelihood = -1.44    Transmembrane    215-231 (215-231)

----- Final Results -----
           bacterial membrane --- Certainty = 0.1574(Affirmative) < succ>
            bacterial outside --- Certainty = 0.0000(Not Clear)   < succ>
          bacterial cytoplasm --- Certainty = 0.0000(Not Clear)   < succ>
```

A related DNA sequence was identified in *S. pyogenes* <SEQ ID 2743> which encodes the amino acid sequence <SEQ ID 2744>. Analysis of this protein sequence reveals the following:

```
Possible site: 36
>>> Seems to have no N-terminal signal sequence
    INTEGRAL    Likelihood = -1.44    Transmembrane    215-231 (215-231)

----- Final Results -----
           bacterial membrane --- Certainty = 0.1574(Affirmative) < succ>
            bacterial outside --- Certainty = 0.0000(Not Clear)   < succ>
          bacterial cytoplasm --- Certainty = 0.0000(Not Clear)   < succ>
```

An alignment of the GAS and GBS proteins is shown below.

```
Identities = 225/269 (83%), Positives = 248/269 (91%)

Query:   1 MTLLEKINETRDFLQAKGVTAPEFGLILGSGLGELAEEIENPIVVDYADIPNWGQSTVVG   60
           M+L+ KINET+DFL  KG+   PEFGLILGSGLGELAEE+EN IV+DYADIPNWG+STVVG
Sbjct:   1 MSLMTKINETKDFLVTKGIETPEFGLILGSGLGELAEEVENAIVIDYADIPNWGKSTVVG   60

Query:  61 HAGKLVYGDLSGRKVLALQGRFHFYEGNTMEVVTFPVRIMRALACHSVLVTNAAGGIGYG  120
           HAGKLVYGDL+GRKVLALQGRFHFYEGN +EVVTFPVR+M+AL C  VLVTNAAGGIGYG
Sbjct:  61 HAGKLVYGDLAGRKVLALQGRFHFYEGNPLEVVTFPVRVMKALGCEGVLVTNAAGGIGYG  120

Query: 121 PGTLMLIKDHINMIGTNPLIGENLEEFGPRFPDMSDAYTATYRQKAHQIAEKQNIKLEEG  180
           PGTLM I DHINM G NPLIGENL+EFGPRFPDMSDAYT  YR KAH++AEK NIKLE+G
Sbjct: 121 PGTLMAITDHINMTGNNPLIGENLDEFGPRFPDMSDAYTKVYRNKAHEVAEKMNIKLEDG  180

Query: 181 VYLGVSGPTYETPAEIRAFQTMGAQAVGMSTVPEVIVAAHSGLKVLGISAITNFAAGFQS  240
           VY+G++GPTYETPAEIRAF+ +GA AVGMSTVPEVIVAAHSGLKVLGISAITNFAAGFQS
Sbjct: 181 VYMGLTGPTYETPAEIRAFKVLGADAVGMSTVPEVIVAAHSGLKVLGISAITNFAAGFQS  240

Query: 241 ELNHEEVVEVTQRIKEDFKGLVKSLVAEL                                269
           ELNHEEVVEVTQ IKEDFKGLVK+++AEL
Sbjct: 241 ELNHEEVVEVTQHIKEDFKGLVKAILAEL                                269
```

Based on this analysis, it was predicted that these proteins and their epitopes could be useful antigens for vaccines or diagnostics.

EXAMPLE 901

A DNA sequence (GBSx0956) was identified in *S. agalactiae* <SEQ ID 2745> which encodes the amino acid sequence <SEQ ID 2746>. Analysis of this protein sequence reveals the following:

```
Possible site: 31
>>> Seems to have a cleavable N-term signal seq.
        INTEGRAL      Likelihood = -9.34    Transmembrane    266-282  (263-289)
        INTEGRAL      Likelihood = -8.97    Transmembrane    231-247  (229-253)
        INTEGRAL      Likelihood = -7.70    Transmembrane    356-372  (352-376)
        INTEGRAL      Likelihood = -7.32    Transmembrane    303-319  (297-326)
        INTEGRAL      Likelihood = -5.57    Transmembrane    337-353  (334-355)
        INTEGRAL      Likelihood = -5.57    Transmembrane    391-407  (387-409)
        INTEGRAL      Likelihood = -2.44    Transmembrane    177-193  (177-193)
        INTEGRAL      Likelihood = -1.01    Transmembrane    159-175  (159-175)
        INTEGRAL      Likelihood = -0.43    Transmembrane    198-214  (196-215)

----- Final Results -----
              bacterial membrane --- Certainty = 0.4736(Affirmative) < succ>
              bacterial outside  --- Certainty = 0.0000(Not Clear)   < succ>
            bacterial cytoplasm --- Certainty = 0.0000(Not Clear)   < succ>
```

A related GBS nucleic acid sequence <SEQ ID 9883> which encodes amino acid sequence <SEQ ID 9884> was also identified.

The protein has homology with the following sequences in the GENPEPT database.

```
>GP: AAD53928 GB: AF179611 chloride channel protein [Zymomonas
mobilis]
Identities = 121/410 (29%), Positives = 213/410 (51%), Gaps = 19/410 (4%)

Query:   14 VKFMIAVLFMTVMAGVGAILMHYVLMFTEWLAFGDSRENTLSLLN------SVTPIKRVL   67
            +++ +A L +   + G+G +L+ ++L    +A+G S ++ +S  +      + +P++R+
Sbjct:    3 IRYGLACLAVGCLTGLGGMLLSWILHAVQHIAYGYSLQHVISEESFLKGSMAASPLRRLE   62

Query:   68 SLTLVSFLASLSWYYLQIKPKQITSIKQQVVFKDFSVKKSPYWLHIGHAFLQLIYVGTGG  127
            L    +    W L+    + SI Q V          P+W   I H  LQ++ VG G
Sbjct:   63 VLVFCGAVVGGGWGLLRHFGSPLVSITQAVAANK---RVMPFWTTIIHVLLQIVTVGLGS  119

Query:  128 PIGKEGAPREFGAINAGKISDLLALKVLDKRLLIISGAAAGLSAVYQVPLASVFFAFETL  187
            P+G+E APRE G++    +    L   +R+L+  GA AG ++VY VPL+    FA E L
Sbjct:  120 PLGREVAPRELGSLIGERFAFWGGLSENQRRILVACGAGAGFASVYNVPLSGALFALEAL  179

Query:  188 ALGISLKNIVTLLASTFGAASIAQLVISTAPLYHISKMSLNSQSLAFMFLIVLCVTPI--  245
             +   +   ++ L ++  +A +A +++ + +YH+      ++++     + L+ L   PI
Sbjct:  180 LMTWASPVVIVALLTSALSARMAWILLGNSMVYHVPAWPVDTR----LMLLALLAGPIFG  235

Query:  246 --AISFRYLNQKVTERRIK-NIKILLSLPVVSLIVSVLSIVYPQILGNGNALVQEVFKGT  302
              A  FR+ +QK+T  RIK N ++ L    +  +LS+ +P+ILGNG    V   F
Sbjct:  236 IAAHYFRFWSQKITASRIKDNRRLALVAILCFAAIGLLSMWFPEILGNGKGPVSLAFNDN  295

Query:  303 TVSLIA-ILVVLKMIATLSTLYAGAYGGILTPSFSIGACLGFLLASISIPLLPHISIVTS  361
              + A  L   K++A    L+AGAYGG+LTP  S GA L  ++    LP + I
Sbjct:  296 LSGMKAGELFCFKILAVFLALWAGAYGGLLTPGISFGALLAVVIGHLWNMWLPPVPIGAF  355

Query:  362 MLVGAAIFLAITMRAPLTAVGLVISFTGQSVITIVPLTIAVLFATAYDYF           411
            ++G A FLA +M+ P+TA+ LVI F      ++P+  AV + A    F
Sbjct:  356 AIIGGAAFLASSMKMPITAMALVIEFARTGHDFLIPIAFAVAGSIAISQF           405
```

A related DNA sequence was identified in *S. pyogenes* <SEQ ID 2747> which encodes the amino acid sequence <SEQ ID 2748>. Analysis of this protein sequence reveals the following:

```
Possible site: 13
>>> Seems to have no N-terminal signal sequence
    INTEGRAL    Likelihood = -5.41    Transmembrane    247-263 (245-267)
    INTEGRAL    Likelihood = -5.15    Transmembrane    326-342 (323-345)
    INTEGRAL    Likelihood = -5.04    Transmembrane    411-427 (407-429)
    INTEGRAL    Likelihood = -4.94    Transmembrane     39-55  (34-59)
    INTEGRAL    Likelihood = -4.46    Transmembrane    284-300 (282-307)
    INTEGRAL    Likelihood = -3.45    Transmembrane    380-396 (376-400)
    INTEGRAL    Likelihood = -2.13    Transmembrane    185-201 (184-201)
    INTEGRAL    Likelihood = -2.02    Transmembrane     88-104 (87-105)
    INTEGRAL    Likelihood = -1.12    Transmembrane    350-366 (350-367)

----- Final Results -----
           bacterial membrane --- Certainty = 0.3166(Affirmative) < succ>
           bacterial outside  --- Certainty = 0.0000(Not Clear)   < succ>
         bacterial cytoplasm  --- Certainty = 0.0000(Not Clear)   < succ>
```

The protein has homology with the following sequences in the databases:

```
>GP: AAF41386 GB: AE002449 chloride channel protein-related protein
[Neisseria meningitidis MC58]
Identities = 137/373 (36%), Positives = 201/373 (53%), Gaps = 23/373 (6%)

Query:  59 IHLIQSLSFGFSQG----SFSTMIASVPPQRRALSLLFAGLLAGLGWHLLAKKGKDIQSI  114
           +H IQ  ++G+       SF  +A   RR  L    G +AG GW LL  + GK    I
Sbjct:   1 MHFIQHTAYGYGADGVYTSFREGVAQASGMRRVAVLTLCGAVAGSGWWLLKRFGKPQIEI  60

Query: 115 QQIIQDDISFSPW-TQFWHGWLQLTTVSMGAPVGREGASREVATLTSLWSQRCNLSKAD  173
             + ++  +     P+ T  +H  LQ+ TV +G+P+GRE A RE+        +R  L + +
Sbjct:  61 KAALKQPLQGLPFLTTVFHVLLQIITVGLGSPLGREVAPREMTAAFAFAGGKRLGLDEGE  120

Query: 174 QKLLLACASGAALGAVYNAPLATILFILEAILNRWSLKNIYAACLTSYVAVETVALLQGR  233
              +LL+ACASGA L AVYN PLA+ LFILEA+L  W+ + +  AA LTS +A     G
Sbjct: 121 MRLLIACASGAGLAAVYNVPLASTLFILEAMLGVWTQQAVAAALLTSVIATAVARI--GL  178

Query: 234 HEIQYLMPQQHWTLGT--LIGSVLAGLILSLFAHAYKHLLKHLPKADAKSQWFIPKVLIA  291
             ++Q    P   + T  T L  S + GIL + A ++    + P    + IP +
Sbjct: 179 GDVQQYHP-ANLTVNTSLLWFSAVIGPILGVAAVFFQRTAQKFPFIKRDNIKIIPLAVCM  237

Query: 292 FSLIAGLSIFFPEILGNGKAG--LLF-FLHEEPH---LSYISWLLVAKAVAISLVFASGA  345
           F+LI  +S++FPEILGNGKAG   L F  L +  H     L++  WL+V  A+A+      GA
Sbjct: 238 FALIGVISVWFPEILGNGKAGNQLTFGGLTDWQHSLGLTAVKWLVVLMALAV------GA  291

Query: 346 KGGKIAPSMMLGGASGLLLAILSQYLIPLSLSNTLAIMVGATIFLGVINKIPLAAPVFLV  405
              GG I PSMMLG  +     A   + P +S+  A +VGA +FLGV  K+PL A  F++
Sbjct: 292 YGGLITPSMMLGSTIAFAAATAWNSVFP-EMSSESAAIVGAAVFLGVSLKMPLTAIAFIL  350

Query: 406 EITGQSLLMIIPL                                                418
           E+T   + +++PL
Sbjct: 351 ELTYAPVALLMPL                                                363
```

An alignment of the GAS and GBS proteins is shown below.

```
Identities = 131/415 (31%), Positives = 215/415 (51%), Gaps = 9/415 (2%)

Query:   2 LNFKMVSRLYYAVKFMIAVLFMT-VMAGVGAILMHYVLMFTEWLAFGDSRENTLSLLNSV   60
           LNF   S +        + LF+T + AG+ A ++       + L+FG S+ +   +++ SV
Sbjct:  22 LNFCYNSLMKRHFLLLTFYLFLTGLTAGLVAFILTKAIHLIQSLSFGFSQGSFSTMIASV   81

Query:  61 TPIKRVLSLTLVSFLASLSWYYLQIKPKQITSIKQQVVFKDFSVKKSPYWLHIGHAFLQL  120
             P +R LSL     LA L W+  L   K KI   SI QQ++   D S      SP W    H +LQL
Sbjct:  82 PPQRRALSLLFAGLLAGLGWHLLAKKGKDIQSI-QQIIQDDISF--SP-WTQFWHGWLQL  137

Query: 121 IYVGTGGPIGKEGAPREFGAINAGKISDLLALKVLDKRLLIISGAAAGLSAVYQVPLASV  180
              V G P+G+EGA RE        S    L  D++LL+      + A L AVY  PLA++
Sbjct: 138 TTVSMGAPVGREGASREVATLTSLWSQRCNLSKADQKLLLACASGAALGAVYNAPLATI  197

Query: 181 FFAFETLALGISLKNIVTLLASTFGAASIAQLVISTAPL-YHISKMSLNSQSLAFMFLIV  239
            F  E +    SLKNI     +++ A     L+      + Y  +       +L      L
Sbjct: 198 LFILEAILNRWSLKNIYAACLTSYVAVETVALLQGRHEIQYLMPQQHWTLGTLIGSVLAG  257

Query: 240 LCVTPIAISFRYLNQKVTERRIKNIKILLSLPVVSLIVSVLSIVYPQILGNGNA-LVQEV  298
           L ++  A ++++L + +    K+   +  +   + LSI +P+ILGNG A L+
Sbjct: 258 LILSLFAHAYKHLLKHLPKADAKSQWFIPKVLIAFSLIAGLSIFFPEILGNGKAGLLFFL  317
```

-continued

```
Query: 299 FKGTTVSLIAILVVLKMIATLSTLYAGAYGGILTPSFSIGACLGFLLASISIPLLP-HIS 357
            +  +S I+ L+V K +A      +GA GG + PS  +G   G LLA +S  L+P  +S
Sbjct: 318 HEEPHLSYISWLLVAKAVAISLVFASGAKGGKIAPSMMLGGASGLLLAILSQYLIPLSLS 377

Query: 358 IVTSMLVGAAIFLAITMRAPLTAVGLVISFTGQSVITIVPLTIA-VLFATAYDYF      411
           +++VGA IFL +  + PL A   ++   TGQS++ I+PL +A ++F  +Y ++
Sbjct: 378 NTLAIMVGATIFLGVINKIPLAAPVFLVEITGQSLLMIIPLALANLIFYFSYQFY      432
```

A related GBS gene <SEQ ID 8683> and protein <SEQ ID 8684> were also identified. Analysis of this protein sequence reveals the following:

```
Lipop: Possible site: -1 Crend: 9
SRCFLG: 0
McG: Length of UR: 19
     Peak Value of UR: 2.96
     Net Charge of CR: 2
McG: Discrim Score: 9.64
GvH: Signal Score (-7.5): 1.15
     Possible site: 26
>>> Seems to have a cleavable N-term signal seq.
Amino Acid Composition: calculated from 27
ALOM program count: 9 value: -9.34 threshold: 0.0
    INTEGRAL       Likelihood = -9.34     Transmembrane    261-277 (258-284)
    INTEGRAL       Likelihood = -8.97     Transmembrane    226-242 (224-248)
    INTEGRAL       Likelihood = -7.70     Transmembrane    351-367 (347-371)
    INTEGRAL       Likelihood = -7.32     Transmembrane    298-314 (292-321)
    INTEGRAL       Likelihood = -5.57     Transmembrane    332-348 (329-350)
    INTEGRAL       Likelihood = -5.57     Transmembrane    386-402 (382-404)
    INTEGRAL       Likelihood = -2.44     Transmembrane    172-188 (172-188)
    INTEGRAL       Likelihood = -1.01     Transmembrane    154-170 (154-170)
    INTEGRAL       Likelihood = -0.43     Transmembrane    193-209 (191-210)
    PERIPHERAL     Likelihood =  1.22     61
modified ALOM score: 2.37
icm1 HYPID: 7 CFP: 0.474
*** Reasoning Step: 3

----- Final Results -----
              bacterial membrane --- Certainty = 0.4736(Affirmative) < succ>
               bacterial outside --- Certainty = 0.0000(Not Clear) < succ>
             bacterial cytoplasm --- Certainty = 0.0000(Not Clear) < succ>
```

The protein has homology with the following sequences in the databases:

```
ORF00327(340-1533 of 1869)
GP|5834362|gb|AAD53928.1|AF179611_12|AF179611(3-405 of 425) chloride channel
protein {Zymomonas mobilis}
% Match = 14.7
% Identity = 30.2    % Similarity = 56.1
Matches = 121   Mismatches = 169   Conservative Sub.s = 104
        270       300       330       360       390       420       450       468
RSLKLLSVLKKISRD*LNH*LLNFKMVSRLYYAVKFMIAVLFMTVMAGVGAILMHYVLMFTEWLAFGDSRENTLS----L
                                 ::: :|  |  :   : |:|  :|: ::|    : :|:|  |  :: :|      |
                               MKIRYGLACLAVGCLTGLGGMLLSWILHAVQHIAYGYSLQHVISEESFL
                                          10        20        30        40
        492       522       552       582       612       642       672       702
LNSV--TPIKRVLSLTLVSFLASLSWYYLQIKPKQITSIKQQVVFKDFSVKKSPYWLHIGHAFLQLIYVGTGGPIGKEGA
 |:  :|::|:    |  |:     |    |:     |||| |    :|   |   | :|:||: || | |:|:| |
KGSMAASPLRRLEVLVFCGAVVGGGWGLLRHFGSPLVSITQAVAANK---RVMPFWTTIIHVLLQIVTVGLGSPLGREVA
           60        70        80        90       100       110       120
        732       762       792       822       852       882       912       942
PREFGAINAGKISDLLALKVLDKRLLIISGAAAGLSAVYQVPLASVFFAFETLALGISLKNIVTLLASTFGAASIAQLVI
|||:|::   :   :    :|:|     || ||:::||   |   :   | |: :   :: :| |   : | |  :|
PRELGSLIGERFAFWGCLSENQRRILVACGAGAGFASVYNVPLSGALFALEALLMTWASPVVIVALLTSALSARMAWILL
          140       150       160       170       180       190       200
        972       1002      1032      1059      1089      1119      1146      1176
STAPLYHISKMSLNSQSLAFMPFLIVLCVTPIAIS-FRYLNQKVTERRIKNIKILLSLPVVSLI-VSVLSIVYPQILGNGN
  :||:    :::: |  :: |:    :  ||    ||:|:   |||: |    | :::   : :||: :|:||||
GNSMVYHVPAWPVDTR-LMLLALLAGPIFGIAAHYFRFWSQKITASRIKDNRRLALVAILCFAAIGLLSMWFPEILGNGK
          220       230       240       250       260       270       280
        1206      1233      1263      1293      1323      1353      1383      1413
ALVQEVFKGTTVSLIA-ILVVLKMIATLSTLYAGAYGGILTPSFSIGACLGFLLASISIPLLPHISIVTSMLVGAAIFLA
 |   |    :  |  |  :|::|  :  |:||||||||  |  |   |||||::  |    ||  |   ::| |  |||
GPVSLAFNDNLSGMKAGELFCFKILAVFLALWAGAYGGLLTPGISPGALLAVVIGHLWNMWLPPVPIGAFAIIGGAAFLA
          300       310       320       330       340       350       360
```

-continued

```
1443       1473       1503       1533       1563       1593       1623       1653
ITMRAPLTAVGLVISFTGQSVITIVPLTIAVLFATAYDYFIRKMRSLYVNPY*SKTR*NCR*NFTSRRSTPCEIYCREFF
  :|:  |:||:  |||  |       ::|:   ||   :  |    |
SSMKMPITAMALVIEFARTGHDFLIPIAFAVAGSIAISQFYDQKKQPKTASKSVISHLGG
           380        390        400        410        420
```

Based on this analysis, it was predicted that these proteins and their epitopes could be useful antigens for vaccines or diagnostics.

EXAMPLE 902

A DNA sequence (GBSx0957) was identified in *S. agalactiae* <SEQ ID 2749> which encodes the amino acid sequence <SEQ ID 2750>. This protein is predicted to be purine nucleoside phosphorylase fragment (deoD-1). Analysis of this protein sequence reveals the following:

```
Possible site: 25
>>> Seems to have no N-terminal signal sequence

----- Final Results -----
             bacterial cytoplasm --- Certainty = 0.2384(Affirmative) < succ>
             bacterial membrane  --- Certainty = 0.0000(Not Clear)   < succ>
             bacterial outside   --- Certainty = 0.0000(Not Clear)   < succ>
```

The protein has homology with the following sequences in the GENPEPT database.

```
>GP: CAC18350 GB: Y17900 putative purine-nucleotide phosphorylase
[Streptococcus salivarius]
Identities = 200/236 (84%), Positives = 219/236 (92%)

Query:    1 MSIHIEAKQGEIADKILLPGDPLRAKFIAENFLEDAVCFNTVRNMFGYTGTYKGHRVSVM    60
            MSIHI AKQGEIADKILLPGDPLRAKFIAENFLEDAVCFN VRNMFGYTGTYKG RVSVM
Sbjct:    1 MSIHIAAKQGEIADKILLPGDPLRAKFIAENFLEDAVCFNEVRNMFGYTGTYKGERVSVM    60

Query:   61 GTGMGMPSISIYARELIVDYGVKTLIRVGTAGAINPDIHVRELVLAQAAATNSNIIRNDW   120
            GTGMGMPSISIYARELIVDYGVK LIRVGTAG++N D+HVRELVLAQAAATNSNIIRNDW
Sbjct:   61 GTGMGMPSISIYARELIVDYGVKKLIRVGTAGSLNEDVHVRELVLAQAAATNSNIIRNDW   120

Query:  121 PEFDFPQIADFKLLDKAYHIAKEMDITTHVGSVLSSDVFYSNQPDRNMALGKLGVHAIEM   180
            P++DFPQIA+F LLDKAYHIAK   +TTHVG+VLSSDVFYSN ++N+ LGK GV A+EM
Sbjct:  121 PQYDFPQIANFNLLDKAYHIAKNFGMTTHVGNVLSSDVFYSNYFEKNIELGKWGVKAVEM   180

Query:  181 EAAALYYLAAQHNVNALAMMTISDNLNNPEEDTSAEERQTTFTDMMKVGLETLISE       236
            EAAALYYLAAQH V+ALA+MTISD+L NP+EDT+AEERQ TFTDMMKVGLETLI++
Sbjct:  181 EAAALYYLAAQHQVDALAIMTISDSLVNPDEDTTAEERQNTFTDMMKVGLETLIAD       236
                                                                50
```

A related DNA sequence was identified in *S. pyogenes* <SEQ ID 2751> which encodes the amino acid sequence <SEQ ID 2752>. Analysis of this protein sequence reveals the following:

```
Possible site: 25
>>> Seems to have no N-terminal signal sequence

----- Final Results -----
             bacterial cytoplasm --- Certainty = 0.2117(Affirmative) < succ>
             bacterial membrane  --- Certainty = 0.0000(Not Clear)   < succ>
             bacterial outside   --- Certainty = 0.0000(Not Clear)   < succ>
```

An alignment of the GAS and GBS proteins is shown below.

```
Identities = 210/235 (89%), Positives = 226/235 (95%)

Query:     1 MSIHIEAKQGEIADKILLPGDPLRAKFIAENFLEDAVCFNTVRNMFGYTGTYKGHRVSVM    60
             MSIHI AK+G+IADKILLPGDPLRAKFIAENFLEDAVCFN VRNMFGYTGTYKGHRVSVM
Sbjct:     1 MSIHISAKKGDIADKILLPGDPLRAKFIAENFLEDAVCFNEVRNMFGYTGTYKGHRVSVM    60

Query:    61 GTGMGMPSISIYARELIVDYGVKTLIRVGTAGAINPDIHVRELVLAQAAATNSNIIRNDW   120
             GTGMGMPSISIYARELIVDYGVKTLIRVGTAGAI+P++HVRELVLAQAAATNSNIIRND+
Sbjct:    61 GTGMGMPSISIYARELIVDYGVRTLIRVGTAGAIDPEVHVRELVLAQAAATNSNIIRNDF   120

Query:   121 PEFDFPQIADFKLLDKAYHIAKEMDITTHVGSVLSSDVFYSNQPDRNMALGKLGVHAIEM   180
             PEFDFPQIADF LLDKAYHIA+EM +TTHVG+VLSSDVFY+N P+RNMALGKLGV AIEM
Sbjct:   121 PEFDFPQIADFGLLDKAYHIAREMGVTTHVGNVLSSDVFYTNMPERNMALGKLGVKAIEM   180

Query:   181 EAAALYYLAAQHNVNALAMMTISDNLNNPEEDTSAEERQTTFTDMMKVGLETLIS        235
             EAAALYYLAAQH+V AL +MTISDNLN+P EDT+AEERQTTFTDMMKVGLETLI+
Sbjct:   181 EAAALYYLAAQHHVKALGIMTISDNLNDPTEDTTAEERQTTFTDMMKVGLETLIA        235
```

Based on this analysis, it was predicted that these proteins and their epitopes could be useful antigens for vaccines or diagnostics.

EXAMPLE 903

A DNA sequence (GBSx0958) was identified in *S. agalactiae* <SEQ ID 2753> which encodes the amino acid sequence <SEQ ID 2754>. Analysis of this protein sequence reveals the following:

```
Possible site: 36
>>> Seems to have no N-terminal signal sequence

----- Final Results -----
        bacterial cytoplasm --- Certainty = 0.1710 (Affirmative) < succ>
         bacterial membrane --- Certainty = 0.0000 (Not Clear)   < succ>
          bacterial outside --- Certainty = 0.0000 (Not Clear)   < succ>
```

A related GBS nucleic acid sequence <SEQ ID 9881> which encodes amino acid sequence <SEQ ID 9882> was also identified.

The protein has no significant homology with any sequences in the GENPEPT database.

A related DNA sequence was identified in *S. pyogenes* <SEQ ID 2755> which encodes the amino acid sequence <SEQ ID 2756>. Analysis of this protein sequence reveals the following:

```
Possible site: 21
>>> Seems to have no N-terminal signal sequence

----- Final Results -----
        bacterial cytoplasm --- Certainty = 0.1386 (Affirmative) < succ>
         bacterial membrane --- Certainty = 0.0000 (Not Clear)   < succ>
          bacterial outside --- Certainty = 0.0000 (Not Clear)   < succ>
```

An alignment of the GAS and GBS proteins is shown below.

```
Identities = 126/253 (49%), Positives = 175/253 (68%), Gaps = 2/253 (0%)

Query:     3 IEMTDFSTALKVLVDQYSYHNAFLLLQKHGPLNSDLLFLLEMMKERRELNIDFLFAHQEQ    62
             + MT+  T L +L+D Y+Y++AF + +    +   L+LLEM+KERRELN+ FL  H  +
Sbjct:     1 LPMTNNQT-LDILLDVYAYNHAFRIAKALPNIPKTALYLLEMLKERRELNLAFLAEHAAE    59

Query:    63 VVILQEKYNIKL-LHNPYDLELLANYIMDLEAKVKNGLIIDFVRSVSPILYRLFMILLAQ   121
             ++++Y+  L L+   + E +ANYI+DLE KVKNG IIDFVRSVSPILYRLF+ L+
Sbjct:    60 NRTIEDQYHCSLWLNQSLEDEQIANYILDLEVKVKNGAIIDFVRSVSPILYRLFLRLITS   119
```

```
                           -continued
Query: 122 EVPHLHDYIHNARDDHYDTWKFKELKESNHPVLLAFSERWHDSRLTSKSLAECLQLTDLD  181
           E+P+    YI + ++D YDTW F+ + ES+H V  A+  +       +T+KSLA+ L LT L
Sbjct: 120 EIPNFKAYIFDTKNDQYDTWHFQAMLESDHEVFKAYLSQKQSRNVTTKSLADMLTLTSLP  179

Query: 182 EEVKSTIIQLRQFEKSVRNPLAHLIKPFDEQELYRTTQFSSQAFLDQIIFLAKVIGVEYD  241
            +E+K  +  LR FEK+VRNPLAHLIKPFDE+EL+RTT FSSQAFL+ II LA    GV Y
Sbjct: 180 QEIKDLVFLLRHFEKAVRNPLAHLIKPFDEEELHRTTHFSSQAFLENIITLATFSGVIYR  239

Query: 242 TVNFHYDTVNKLI                                                254
               F++D +N +I
Sbjct: 240 REPFYFDDMNAII                                                252
```

Based on this analysis, it was predicted that these proteins and their epitopes could be useful antigens for vaccines or diagnostics.

EXAMPLE 904

A DNA sequence (GBSx0959) was identified in *S. agalactiae* <SEQ ID 2757> which encodes the amino acid sequence <SEQ ID 2758>. This protein is predicted to be CpsY protein. Analysis of this protein sequence reveals the following:

```
Possible site: 35
>>> Seems to have no N-terminal signal sequence
INTEGRAL Likelihood = -0.59 Transmembrane 260-276 (260-276)

----- Final Results -----
          bacterial membrane --- Certainty = 0.1235 (Affirmative) < succ>
           bacterial outside --- Certainty = 0.0000 (Not Clear)   < succ>
         bacterial cytoplasm --- Certainty = 0.0000 (Not Clear)   < succ>
```

A related GBS nucleic acid sequence <SEQ ID 9879> which encodes amino acid sequence <SEQ ID 9880> was also identified.

A related DNA sequence was identified in *S. pyogenes* <SEQ ID 2759> which encodes the amino acid sequence <SEQ ID 2760>. Analysis of this protein sequence reveals the following:

```
Possible site: 35
>>> Seems to have no N-terminal signal sequence

----- Final Results -----
         bacterial cytoplasm --- Certainty = 0.1958 (Affirmative) < succ>
          bacterial membrane --- Certainty = 0.0000 (Not Clear)   < succ>
           bacterial outside --- Certainty = 0.0000 (Not Clear)   < succ>
```

An alignment of the GAS and GBS proteins is shown below.

```
Identities = 247/301 (82%), Positives = 274/301 (90%)

Query:   1 MRIQQLQYVIKIVETGSMNEAAKQLYITQPSLSNAVRNLETEMGIQIFIRNPKGITLTKD   60
           MRIQQL Y+IKIVE GSMNEAAKQL+ITQPSLSNAV++LE EMGI IF RNPKGITLTKD
Sbjct:   1 MRIQQLHYIIKIVECGSMNEAAKQLFITQPSLSNAVKDLEMEMGITIFNRNPKGITLTKD   60

Query:  61 GMEFLSYARQILEQTALLEERYKGDNTSRELFSVSSQHYAFVVNAFVALFNGTDMTQYEL  120
           G+EFLSYARQI+EQT+LLE+RYK  NT RELFSVSSQHYAFVVNAFV+L   TDMT+YEL
Sbjct:  61 GVEFLSYARQIIEQTSLLEDRYKNHNTGRELFSVSSQHYAFVVNAFVSLLKRTDMTRYEL  120

Query: 121 FLRETRTWEIIDDVKNFRSEIGVLFLNSYNRDVLTKLFDDNSLIATTLFTTTPHIFVSKS  180
           FLRETRTWEIIDDVKNFRSEIGVLF+N YNRDVLTKLFDDN L A+ LF   PHIFVSKS
Sbjct: 121 FLRETRTWEIIDDVKNFRSEIGVLFINDYNRDVLTKLFDDNHLTASPLFKAQPHIFVSKS  180

Query: 181 NPLANRKKLNMKDLEDYPYLSYDQGLHNSFYFSEEMMSQIPHPKSIVVSDRATLFNLMIG  240
           NPLA +   L+M DL D+PYLSYDQG+HNSFYFSEEMMSQ+PH KSIVVSDRATLFNLMIG
Sbjct: 181 NPLATKSLLSMDDLRDFPYLSYDQGIHNSFYFSEEMMSQMPHNKSIVVSDRATLFNLMIG  240

Query: 241 LDGYTVATGILNSKLNGDEIVAIPLDVDDVIDIVYIRHDKANLSKMGQKFIDYLLEEVSFN  301
           LDGYTVA+GILNS LNGD+IVAIPLDV D IDIV+I+H+KANLSKMG++FI+YLLEEV+F+
Sbjct: 241 LDGYTVASGILNSNLNGDQIVAIPLDVPDEIDIVFIKHEKANLSKMGERFIEYLLEEVTFD  301
```

Based on this analysis, it was predicted that these proteins and their epitopes could be useful antigens for vaccines or diagnostics.

EXAMPLE 905

A DNA sequence (GBSx0960) was identified in *S. agalactiae* <SEQ ID 2761> which encodes the amino acid sequence <SEQ ID 2762>. This protein is predicted to be CpsX protein. Analysis of this protein sequence reveals the following:

```
Possible site: 32
>>> Seems to have an uncleavable N-term signal seq
INTEGRAL Likelihood = -14.91 Transmembrane 22-38 (13-42)
INTEGRAL Likelihood = -14.65 Transmembrane 52-68 (44-77)
INTEGRAL Likelihood =  -6.74 Transmembrane 76-92 (73-97)

----- Final Results -----
            bacterial membrane --- Certainty = 0.6965 (Affirmative) < succ>
              bacterial outside --- Certainty = 0.0000 (Not Clear)   < succ>
            bacterial cytoplasm --- Certainty = 0.0000 (Not Clear)   < succ>
```

The protein has homology with the following sequences in the databases:

```
>GP:AAC44935 GB:U56901 putative transcriptional regulator
[Bacillus subtilis]
Identities = 120/389 (30%), Positives = 196/389 (49%), Gaps = 17/389 (4%)

Query:   2 KIGKKIVLMFTAIVLTTVLALGVYLTSAYTFSTGELSKTFKDFSTSSNKSDAIK-QTRAF   60
           KI K+I+L+F A+ L  V+ LG Y      + E        + S+ +++ +  + + F
Sbjct:  19 KILKRIMLLF-ALALLVVVGLGGYKLYKTINAADESYDALSRGNKSNLRNEVVDMKKKPF   77

Query:  61 SILLMGVDTGSSERASKWEGNSDSMILVTVNPKTKKTTMTSLERDTLTTLSGPKNNEMNG  120
           SIL MG++  +++     +G SDS+I+VT++PK K   M S+ RDT    L+G    + G
Sbjct:  78 SILFMGIEDYATKGQ---KGRSDSLIVVTLDPKNKTMKMLSIPRDTRVQLAG----DTTG  130

Query: 121 VEAKLNAAYAAGGAQMAIMTVQDLLNITIDNYVQINMQGLIDLVNAVGGITVTNEFDFPI  180
            + K+NAAY+ GG    + TV++ L I ID YV ++  G  D++N VGGI V    FDF
Sbjct: 131 SKTKINAAYSKGGKDETVETVENFLQIPIDRYVTVDFDGFKDVINEVGGIDVDVPFDFDE  190

Query: 181 SIAENEPEYQATVAPGTHKINGEQALVYARMRYDDPEGDYGRQKRQREVIQKVLKKILAL  240
             +E + +    G  +NGE+AL YARMR  D  GD+GR  RQ++++ ++ ++ +
Sbjct: 191 KSDVDESK-RIYFKKGEMHLNGEEALAYARMRKQDKRGDFGRNDRQKQILNALIDRMSSA  249

Query: 241 DSISSYRKILSAVSSNMQTNIEISSRTIPSLLGYRDALRTIKTYQLKGEDATLSDGGSYQ  300
             +I+   KI   S N++TNI I+       +  + I T  + G D  L    +Y
Sbjct: 250 SNIAKIDKIAEKASENVETNIRITEGLALQQIYSGFTSKKIDTLSITGSDLYLGPNNTYY  309

Query: 301 IVTSNHLLEIQNRIRTELGLHKVNQLKTNATVYENLYGSTKSQTVNNNYDSSGQAPSYSD  360
              LE   ++R  L H ++      +T     T S + + +    S+G     +
Sbjct: 310 FEPDATNLE---KVRKTLQEH-LDYTPDTSTGTSGTEDGTDSSSSSGSTGSTGTTTDGTT  365

Query: 361 SHSSYANYSSGVDTGQSASTDQDSTASSH                               389
           + SSY+N SS   T  + ST    +T SS+
Sbjct: 366 NGSSYSNDSS---TSSNNSTTNSTTDSSY                               391
```

There is also homology to SEQ ID 2764.

Based on this analysis, it was predicted that these proteins and their epitopes could be useful antigens for vaccines or diagnostics.

EXAMPLE 906

A DNA sequence (GBSx0961) was identified in *S. agalactiae* <SEQ ID 2765> which encodes the amino acid sequence <SEQ ID 2766>. This protein is predicted to be CpsIaB. Analysis of this protein sequence reveals the following:

```
Possible site: 41
>>> Seems to have no N-terminal signal sequence
INTEGRAL Likelihood = -0.75 Transmembrane 121-137 (121-137)
```

-continued

```
----- Final Results -----
            bacterial membrane --- Certainty = 0.1298 (Affirmative) < succ>
            bacterial outside  --- Certainty = 0.0000 (Not Clear)  < succ>
            bacterial cytoplasm --- Certainty = 0.0000 (Not Clear)  < succ>
```

A related GBS nucleic acid sequence <SEQ ID 9877> which encodes amino acid sequence <SEQ ID 9878> was also identified.

No corresponding DNA sequence was identified in *S. pyogenes*.

Based on this analysis, it was predicted that these proteins and their epitopes could be useful antigens for vaccines or diagnostics.

EXAMPLE 907

A DNA sequence (GBSx0962) was identified in *S. agalactiae* <SEQ ID 2767> which encodes the amino acid sequence <SEQ ID 2768>. This protein is predicted to be cpsb protein. Analysis of this protein sequence reveals the following:

```
Possible site: 35
>>> Seems to have no N-terminal signal sequence
INTEGRAL Likelihood = -9.02 Transmembrane 182-198 (179-204)
INTEGRAL Likelihood = -5.57 Transmembrane  30-46  (24-48)

----- Final Results -----
            bacterial membrane --- Certainty = 0.4609(Affirmative) < succ>
            bacterial outside  --- Certainty = 0.0000(Not Clear)  < succ>
            bacterial cytoplasm --- Certainty = 0.0000(Not Clear)  < succ>
```

No corresponding DNA sequence was identified in *S. pyogenes*.

A related GBS gene <SEQ ID 10785> and protein <SEQ ID 10786> were also identified. Analysis of this protein sequence reveals the following:

```
Lipop: Possible site: -1 Crend: 9
McG: Discrim Score: -8.96
GvH: Signal Score (-7.5): 0.11
Possible site: 35
>>> Seems to have no N-terminal signal sequence
ALOM program count: 2 value: -9.02 threshold: 0.0
INTEGRAL    Likelihood = -9.02 Transmembrane 182-198 (179-204)
INTEGRAL    Likelihood = -5.57 Transmembrane  30-46  (24-48)
PERIPHERAL  Likelihood =  6.21 113
modified ALOM score: 2.30
*** Reasoning Step: 3

----- Final Results -----
            bacterial membrane --- Certainty = 0.4609 (Affirmative) < succ>
            bacterial outside  --- Certainty = 0.0000 (Not Clear)  < succ>
            bacterial cytoplasm --- Certainty = 0.0000 (Not Clear)  < succ>
```

Based on this analysis, it was predicted that these proteins and their epitopes could be useful antigens for vaccines or diagnostics.

EXAMPLE 908

A DNA sequence (GBSx0963) was identified in *S. agalactiae* <SEQ ID 2769> which encodes the amino acid sequence <SEQ ID 2770>. This protein is predicted to be CpsIaD. Analysis of this protein sequence reveals the following:

```
Possible site: 61
>>> Seems to have no N-terminal signal sequence
INTEGRAL Likelihood = -2.44 Transmembrane 149-165 (149-166)
```

-continued

```
----- Final Results -----
            bacterial membrane --- Certainty = 0.1977 (Affirmative) < succ>
              bacterial outside --- Certainty = 0.0000 (Not Clear) < succ>
                bacterial cytoplasm --- Certainty = 0.0000 (Not Clear) < succ>
```

No corresponding DNA sequence was identified in *S. pyogenes*.

Based on this analysis, it was predicted that this protein and its epitopes, could be useful antigens for vaccines or diagnostics.

EXAMPLE 909

A DNA sequence (GBSx0964) was identified in *S. agalactiae* <SEQ ID 2771> which encodes the amino acid sequence <SEQ ID 2772>. Analysis of this protein sequence reveals the following:

```
Possible site: 25
>>> Seems to have an uncleavable N-term signal seq
INTEGRAL Likelihood = -12.26  Transmembrane 276-292  (270-297)
INTEGRAL Likelihood =  -4.62  Transmembrane  10-26   (9-28)
INTEGRAL Likelihood =  -4.14  Transmembrane  41-57   (39-58)
INTEGRAL Likelihood =  -3.24  Transmembrane 100-116  (100-116)
INTEGRAL Likelihood =  -3.08  Transmembrane 445-461  (443-461)

----- Final Results -----
            bacterial membrane --- Certainty = 0.5904 (Affirmative) < succ>
              bacterial outside --- Certainty = 0.0000 (Not Clear) < succ>
                bacterial cytoplasm --- Certainty = 0.0000 (Not Clear) < succ>
```

No corresponding DNA sequence was identified in *S. pyogenes*.

A related GBS gene <SEQ ID 8687> and protein <SEQ ID 8688> were also identified. Analysis of this protein sequence reveals the following:

```
Lipop: Possible site: -1 Crend: 8
McG: Discrim Score: 5.69
GvH: Signal Score (-7.5) : -5.63
Possible site: 25
>>> Seems to have an uncleavable N-term signal seq
ALOM program count: 5 value: -12.26 threshold: 0.0
INTEGRAL    Likelihood = -12.26  Transmembrane 276-292  (270-297)
INTEGRAL    Likelihood =  -4.62  Transmembrane  10-26   (9-28)
INTEGRAL    Likelihood =  -4.14  Transmembrane  41-57   (39-58)
INTEGRAL    Likelihood =  -3.24  Transmembrane 100-116  (100-116)
INTEGRAL    Likelihood =  -3.08  Transmembrane 445-461  (443-461)
PERIPHERAL  Likelihood =   2.23     221
modified ALOM score: 2.95

*** Reasoning Step: 3

----- Final Results -----
            bacterial membrane --- Certainty = 0.5904 (Affirmative) < succ>
              bacterial outside --- Certainty = 0.0000 (Not Clear) < succ>
                bacterial cytoplasm --- Certainty = 0.0000 (Not Clear) < succ>
```

Based on this analysis, it was predicted that these proteins and their epitopes could be useful antigens for vaccines or diagnostics.

EXAMPLE 910

A DNA sequence (GBSx0965) was identified in *S. agalactiae* <SEQ ID 2773> which encodes the amino acid sequence <SEQ ID 2774>. This protein is predicted to be CpsF. Analysis of this protein sequence reveals the following:

```
Possible site: 13
>>> Seems to have no N-terminal signal sequence
INTEGRAL Likelihood = -2.60 Transmembrane 79-95 (78-95)

----- Final Results -----
            bacterial membrane --- Certainty = 0.2041 (Affirmative) < succ>
              bacterial outside --- Certainty = 0.0000 (Not Clear) < succ>
               bacterial cytoplasm --- Certainty = 0.0000 (Not Clear) < succ>
```

No corresponding DNA sequence was identified in S. pyogenes.

Based on this analysis, it was predicted that this protein and its epitopes, could be useful antigens for vaccines or diagnostics.

EXAMPLE 911

A DNA sequence (GBSx0966) was identified in S. agalactiae <SEQ ID 2775> which encodes the amino acid sequence <SEQ ID 2776>. This protein is predicted to be galactosyltransferase. Analysis of this protein sequence reveals the following:

```
Possible site: 39
>>> Seems to have no N-terminal signal sequence

----- Final Results -----
            bacterial cytoplasm --- Certainty = 0.4634 (Affirmative) < succ>
              bacterial membrane --- Certainty = 0.0000 (Not Clear) < succ>
               bacterial outside --- Certainty = 0.0000 (Not Clear) < succ>
```

No corresponding DNA sequence was identified in S. pyogenes.

Based on this analysis, it was predicted that this protein and its epitopes, could be useful antigens for vaccines or diagnostics.

EXAMPLE 912

A DNA sequence (GBSx0967) was identified in S. agalactiae <SEQ ID 2777> which encodes the amino acid sequence <SEQ ID 2778>. Analysis of this protein sequence reveals the following:

```
Possible site: 23
>>> Seems to have an uncleavable N-term signal seq
INTEGRAL Likelihood = -12.47  Transmembrane  59-75  (54-82)
INTEGRAL Likelihood = -10.88  Transmembrane 309-325 (307-332)
INTEGRAL Likelihood =  -8.07  Transmembrane  33-49  (28-53)
INTEGRAL Likelihood =  -6.48  Transmembrane 195-211 (187-212)
INTEGRAL Likelihood =  -6.16  Transmembrane 285-301 (283-306)
INTEGRAL Likelihood =  -4.09  Transmembrane 222-238 (221-240)
INTEGRAL Likelihood =  -3.50  Transmembrane  78-94  (77-96)
INTEGRAL Likelihood =  -2.71  Transmembrane 101-117 (99-117)
INTEGRAL Likelihood =  -2.44  Transmembrane   8-24  (7-25)
INTEGRAL Likelihood =  -1.59  Transmembrane 147-163 (147-164)
INTEGRAL Likelihood =  -0.48  Transmembrane 168-184 (168-184)

----- Final Results -----
            bacterial membrane --- Certainty = 0.5989 (Affirmative) < succ>
              bacterial outside --- Certainty = 0.0000 (Not Clear) < succ>
               bacterial cytoplasm --- Certainty = 0.0000 (Not Clear) < succ>
```

The protein has homology with the following sequences in the GENPEPT database.

```
>GP: CAB43614 GB: AJ239004 polysaccharide polymerase [Streptococcus
pneumoniae]
Identities = 74/309 (23%), Positives = 137/309 (43%), Gaps = 36/309 (11%)
```

-continued

```
Query:   53 FERRKLV---IIFLLFIATILNLFFVHKVTFILTLIFFLALKDI--SLKKAFSIIIGSRI  107
            FE+RK     II ++ I T+L    +    ++   +F+ +  I    L++   II
Sbjct:   61 FEKRKYTLQFIISIILITTLLLYTSIQMQNYVYFTSWFMLIGTIHYDLRRVIKIIFIVS-  119

Query:  108 LGVLLNQIFVKLDLIEIKY-----VNFYRDGQFILRSDLGFGHPNFIHNFFALTIFLYIV  162
            L ++   IF+ L +  I Y     +N R+ + +    GF HPN    +    ++I
Sbjct:  120 LSIMFISIFISLLMYIIDYKREILINIRRN-ETVRAFTFGFIHPNKFTIVLSNLCLMFIW  178

Query:  163 LNYKRLKPVVMVLFLTLNYLLYQYTFSRTGYYIVILFIVLIYVTKNSLIKRVFMKLAPYV  222
            L   RLK  +  L +     Y +T +RT   + I+    L+Y+      ++ + ++   Y
Sbjct:  179 LIKDRLKYYHVTFCLFIQLFFYFFTQTRTALLVSIVIFALLYI--YMFVENLELRWIGYS  236

Query:  223 QFFLLVFTFLSSTIFFNSN--FVQKLDVLLTGRLHY-AHLQLVDGLTPFGNSFKE-----  274
            F + F  ++  F+ SN  F    +D +LTGR+   A+ +   G T +G    +
Sbjct:  237 FFCISTFLGVLAFQFYPSNNKFSIFIDNILTGRIKLAAYARTFFGYTFWGQYVDKEIVWD  296

Query:  275 -----TSVLFDNSYSMLLSMYGVVLTMFCMIIY-----YIYSKKIIIIELQLLLFIMSII  324
                 TS  FD+ YS L+S  G++   +   +++     Y+ +K +I+    LL + M  +
Sbjct:  297 PIWGLTSFTFDSFYSFLMSNAGIIWLLILSVLFVKLQKYLDNKSLIL----LLAWSMYAV  352

Query:  325 LFTESFYPS                                                    333
            T+    +PS
Sbjct:  353 TETDLIFPS                                                    361
```

No corresponding DNA sequence was identified in *S. pyogenes*.

Based on this analysis, it was predicted that this protein and its epitopes, could be useful antigens for vaccines or diagnostics.

EXAMPLE 913

A DNA sequence (GBSx0968) was identified in *S. agalactiae* <SEQ ID 2779> which encodes the amino acid sequence <SEQ ID 2780>. This protein is predicted to be cap8J. Analysis of this protein sequence reveals the following:

```
Possible site: 57
>>> Seems to have no N-terminal signal sequence

----- Final Results -----
            bacterial cytoplasm --- Certainty = 0.3424 (Affirmative) < succ>
            bacterial membrane  --- Certainty = 0.0000 (Not Clear)   < succ>
             bacterial outside  --- Certainty = 0.0000 (Not Clear)   < succ>
```

The protein has homology with the following sequences in the GENPEPT database.

```
>GP: CAB43613 GB: AJ239004 cap8J [Streptococcus pneumoniae]
Identities = 94/237 (39%), Positives = 135/237 (56%), Gaps = 10/237 (4%)

Query:    1 MIPKVIHYCWFGGNPLPDNLKKYIKTWREQCPDYEIIEWNEHNYDVSKNVFMREAYTKKN   60
            MIPK IHY WFGG+  PD + K I +W++  PDYEI+EWNE N+D+S + F + AY  +
Sbjct:    1 MIPKKIHYIWFGGSEKPDVVLKCINSWKKYMPDYEIVEWNEDNFDLSDSQFAKSAYESRK   60

Query:   61 FAYVSDYARLDIIYTYGGFYLDTDVELLKSL-DPLRIHECFLAREISCDVNTGLIIGAVK  119
            +A+ SDYAR  I+  YGG Y DTDVELLK++ D +  H  F   E    +VN GL+    +
Sbjct:   61 WAFASDYARFKILSKYGGIYFDTDVELLKTISDDILAHSSFTGFEYIGEVNPGLVYACMP  120

Query:  120 GHHFLKSNMSIYDKS--DLTSLNKTCVEVTTNLLINRGLKNKNIIQKIDDITIYPRNYFN  177
                 K + Y+++  D+  L  T   + T+ L+     + N Q ID + IYP +YF
Sbjct:  121 DDKIAKYMVQYYEQASFDINHL-VTVNTIITDYLLKNNFQKNNQFQIIDGLAIYPDDYFC  179

Query:  178 PKNLLTGKVDCLTSVTYSIHHYEGSWKSSSFISDSLKIRVRLIIDFLFGYGTYRMLL    234
              +   +V LT T SIHHY +WK+      +LK +V++I+  + G   YR LL
Sbjct:  180 GYDQEVKEVR-LTERTISIHHYSATWKTR-----TLKRKVQMIVKTIIGAENYRKLL    230
```

No corresponding DNA sequence was identified in S. pyogenes.

Based on this analysis, it was predicted that this protein and its epitopes, could be useful antigens for vaccines or diagnostics.

EXAMPLE 914

A DNA sequence (GBSx0969) was identified in S. agalactiae <SEQ ID 2781> which encodes the amino acid sequence <SEQ ID 2782>. Analysis of this protein sequence reveals the following:

```
Possible site: 44
>>> Seems to have no N-terminal signal sequence

----- Final Results -----
            bacterial cytoplasm --- Certainty = 0.3897 (Affirmative) < succ>
             bacterial membrane --- Certainty = 0.0000 (Not Clear) < succ>
              bacterial outside --- Certainty = 0.0000 (Not Clear) < succ>
```

The protein has homology with the following sequences in the GENPEPT database.

```
>GP: CAA87700 GB: Z47767 WbcL [Yersinia enterocolitica]
Identities = 60/207 (28%), Positives = 101/207 (47%), Gaps = 22/207 (10%)

Query:    4 IFTPTFNRGYRLSYLYDSLCNQTNKNFIWLIVDDGSEDSTKEIVSNYIKENKVSIVYLYK   63
            +FTPTFNR + L   Y S+  Q   +  WLIVDDGS D+T E+V ++   ENK++I Y+Y+
Sbjct:    6 VFTPTFNRAHVLKRCYLSILEQDRDDIEWLIVDDGSTDNTAEVVDSFKIENKLNIKYIYQ   65

Query:   64 RNGGKHSAYNLAMRYMQPSDYHVCVDSDDWLLEDAV------EIIFKDLESLTLSNRYVG  117
              N GK +A+N A+     +Y + +DSDD   +  ++             +F D E + +
Sbjct:   66 DNSGKQAAWNKAVENAS-GEYFIGLDSDDAFIAGSINKLLSMNAVFDDKEIIGIR----A  120

Query:  118 LVYPRYSLNQGNNWLNPKILEVNIPDLKYKYHLKIETCIVINNAYLVDFEFPCFEGENFL  177
              +    +L  N +L+ +  + +  D ++    ++ E         L   +P   G NF+
Sbjct:  121 ISVSSETLKPNNYYLSNEDKKSSWFD-EFSSGIRGERIDFFKTELLRKYLYPVASGINFI  179

Query:  178 SEEIMYIYLSKKGYFCPQNRKIYCFDY                                  204
              E   Y  ++K+         YCF Y
Sbjct:  180 PEIWFYSTVAKE----------YCFYY                                  196
```

No corresponding DNA sequence was identified in S. pyogenes.

Based on this analysis, it was predicted that this protein and its epitopes, could be useful antigens for vaccines or diagnostics.

EXAMPLE 915

A DNA sequence (GBSx0970) was identified in S. agalactiae <SEQ ID 2783> which encodes the amino acid sequence <SEQ ID 2784>. This protein is predicted to be eps7. Analysis of this protein sequence reveals the following:

```
Possible site: 32
>>> Seems to have an uncleavable N-term signal seq
INTEGRAL Likelihood = -2.18 Transmembrane 190-206 (189-206)

----- Final Results -----
              bacterial membrane --- Certainty = 0.1871 (Affirmative) < succ>
               bacterial outside --- Certainty = 0.0000 (Not Clear) < succ>
             bacterial cytoplasm --- Certainty = 0.0000 (Not Clear) < succ>
```

The protein has homology with the following sequences in the GENPEPT database.

```
>GP: CAB59293 GB: AJ131984 putative galactosyl transferase
[Streptococcus pneumoniae]
Identities = 101/312 (32%), Positives = 172/312 (54%), Gaps = 4/312 (1%)

Query:    3 LISIIVPVYNGEIYIGRCLDSILEQTYQNLEIIIDDGSSDRTGDICEKYFLEDRRIKYF   62
            +IS+IVPVYN   Y+   LDS+LEQTY++  E+I+++DGS+D +G+IC++Y      I  F
Sbjct:    1 MISVIVPVYNVADYLRFALDSLLEQTYKDFEVILVNDGSTDNSGEICDEYGKLYDNIHVF   60

Query:   63 YQENRGQSVARNNGVLRCTGDWIAFLDSDDVYLPYSIEVMYNIQKATNADIVLT--SIGN  120
            +++N G S ARN G+  +  G++I FLDSDD + PY++E++   IQK   + DIV T   I
Sbjct:   61 HKKNGGLSDARNFGLEKSRGEFITFLDSDDYFEPYALELLITIQKKYDVDIVSTKGGITY  120

Query:  121 FNNTYNTSINSQYLKEIKLYTLEVALEEMYYGKTYGVSPLAKLYPRSNLLSNPYPEGKIH  180
              ++ Y+  + ++       +K+ T +  L  +YY      VS   KLY R +L    +P+GKI+
Sbjct:  121 SHDIYSKKLMAEDYLTVKILTNKEFLAAVYYNDEMTVSAWGKLYKR-DLFKTIFPKGKIY  179

Query:  181 EDMDTTFKLISCASKIAVCDIVTAVVYFSDNSTTRTKFNERMLYFFEAIQNNIVFINLNF  240
            ED+  + +      +A  D+        Y  S    + F++R   FF+AI +N     I     +
Sbjct:  180 EDLYVVAERLLNIKTVAHTDLPIYHYYQRQGSIVNSTFSDRQYDFFDAIDHNEAIIKKFY  239

Query:  241 PHNTSLISAVIYNEVFGGIDICGKMIDFKLYDTVDYYRKKYRKYFKTILFNNRISVKEKV  300
                +  L++A+    V G  I     +   + +    +    + Y+  ++ N +I +K KV
Sbjct:  240 CGDKELLAALNAKRVIGSF-ILSNSAFYNSKNDITKIIRIIKPYYWEVIKNKKIPMKRKV  298

Query:  301 KYILFISSIRYF                                                 312
             +  +LF+ S   Y+
Sbjct:  299 QCVLFLLSPNYY                                                 310
```

Based on this analysis, it was predicted that this protein and its epitopes, could be useful antigens for vaccines or diagnostics.

EXAMPLE 916

A DNA sequence (GBSx0971) was identified in *S. agalactiae* <SEQ ID 2785> which encodes the amino acid sequence <SEQ ID 2786>. This protein is predicted to be galactosyltransferase. Analysis of this protein sequence reveals the following:

```
Possible site: 26
>>> Seems to have an uncleavable N-term signal seq

----- Final Results -----
         bacterial membrane --- Certainty = 0.0000 (Not Clear) < succ>
         bacterial outside  --- Certainty = 0.0000 (Not Clear) < succ>
         bacterial cytoplasm --- Certainty = 0.0000 (Not Clear) < succ>
```

A related DNA sequence was identified in *S. pyogenes* <SEQ ID 2787> which encodes the amino acid sequence <SEQ ID 2788>. Analysis of this protein sequence reveals the following:

```
Possible site: 28
>>> Seems to have no N-terminal signal sequence

----- Final Results -----
         bacterial cytoplasm --- Certainty = 0.2065 (Affirmative) < succ>
         bacterial membrane  --- Certainty = 0.0000 (Not Clear) < succ>
         bacterial outside   --- Certainty = 0.0000 (Not Clear) < succ>
```

An alignment of the GAS and GBS proteins is shown below.

```
Identities = 37/111 (33%), Positives = 61/111 (54%), Gaps = 3/111 (2%)

Query:    1 MDKVSIIIPVYNVQSFLNECIESVLAQ-TYSNLEIILVNDGSTDNSGDIC-DYYSEIDGR   58
            M KVSII   YN    ++++ ++S L+Q T   +EII+++D STD+S +I    Y  + G+
Sbjct:    1 MYKVSIICTNYNKAPWISDALDSFLSQVTDFEVEIIVIDDASTDDSREILKSYQKKSSGK   60
```

```
-continued
Query:  59 I-FVFHKNNGGLSDARNYGISRATGDYIYLLDSDDYLYKEDAIERMVEFSE          108
           I +F++ N G++          A G YI   D DDY      +++ V+  E
Sbjct:  61 IKLLFNETNIGITKTWIKACLYAKGKYIARCDGDDYWTDSFKLQKQVDVLE          111
```

Based on this analysis, it was predicted that these proteins and their epitopes could be useful antigens for vaccines or diagnostics.

EXAMPLE 917

A DNA sequence (GBSx0972) was identified in *S. agalactiae* <SEQ ID 2789> which encodes the amino acid sequence <SEQ ID 2790>. This protein is predicted to be CpsK. Analysis of this protein sequence reveals the following:

```
Possible site: 52
>>> Seems to have an uncleavable N-term signal seq

----- Final Results -----
          bacterial membrane --- Certainty = 0.0000 (Not Clear) < succ>
          bacterial outside  --- Certainty = 0.0000 (Not Clear) < succ>
          bacterial cytoplasm --- Certainty = 0.0000 (Not Clear) < succ>
```

No corresponding DNA sequence was identified in *S. pyogenes*.

Based on this analysis, it was predicted that this protein and its epitopes, could be useful antigens for vaccines or diagnostics.

EXAMPLE 918

A DNA sequence (GBSx0973) was identified in *S. agalactiae* <SEQ ID 2791> which encodes the amino acid sequence <SEQ ID 2792>. Analysis of this protein sequence reveals the following:

```
Possible site: 31
>>> Seems to have no N-terminal signal sequence

----- Final Results -----
          bacterial cytoplasm --- Certainty = 0.1956 (Affirmative) < succ>
          bacterial membrane  --- Certainty = 0.0000 (Not Clear)   < succ>
          bacterial outside   --- Certainty = 0.0000 (Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 919

A DNA sequence (GBSx0974) was identified in *S. agalactiae* <SEQ ID 2793> which encodes the amino acid sequence <SEQ ID 2794>. This protein is predicted to be capsular polysaccharide. Analysis of this protein sequence reveals the following:

```
Possible site: 36
>>> Seems to have an uncleavable N-term signal seq
INTEGRAL Likelihood = -8.81 Transmembrane  89-105 (80-112)
INTEGRAL Likelihood = -7.01 Transmembrane 439-455 (428-460)
INTEGRAL Likelihood = -6.74 Transmembrane 322-338 (317-342)
INTEGRAL Likelihood = -4.88 Transmembrane 175-191 (174-195)
INTEGRAL Likelihood = -3.45 Transmembrane 146-162 (145-166)
INTEGRAL Likelihood = -3.08 Transmembrane 381-397 (375-398)
INTEGRAL Likelihood = -2.50 Transmembrane 413-429 (412-430)
INTEGRAL Likelihood = -1.91 Transmembrane 206-222 (205-222)
INTEGRAL Likelihood = -1.59 Transmembrane 354-370 (354-372)
INTEGRAL Likelihood = -1.54 Transmembrane  43-59  (43-61)
INTEGRAL Likelihood = -0.22 Transmembrane 252-268 (252-268)
```

```
                            -continued
----- Final Results -----
            bacterial membrane --- Certainty = 0.4524 (Affirmative) < succ>
            bacterial outside  --- Certainty = 0.0000 (Not Clear)  < succ>
            bacterial cytoplasm --- Certainty = 0.0000 (Not Clear) < succ>
```

No corresponding DNA sequence was identified in *S. pyogenes*.

Based on this analysis, it was predicted that this protein and its epitopes, could be useful antigens for vaccines or diagnostics.

EXAMPLE 920

A DNA sequence (GBSx0975) was identified in *S. agalactiae* <SEQ ID 2795> which encodes the amino acid sequence <SEQ ID 2796>. This protein is predicted to be NeuB. Analysis of this protein sequence reveals the following:

```
Possible site: 30
>>> Seems to have no N-terminal signal sequence

----- Final Results -----
            bacterial cytoplasm --- Certainty = 0.2992 (Affirmative) < succ>
            bacterial membrane  --- Certainty = 0.0000 (Not Clear)   < succ>
            bacterial outside   --- Certainty = 0.0000 (Not Clear)   < succ>
```

No corresponding DNA sequence was identified in *S. pyogenes*.

Based on this analysis, it was predicted that this protein and its epitopes, could be useful antigens for vaccines or diagnostics.

EXAMPLE 921

A DNA sequence (GBSx0976) was identified in *S. agalactiae* <SEQ ID 2797> which encodes the amino acid sequence <SEQ ID 2798>. This protein is predicted to be NeuC. Analysis of this protein sequence reveals the following:

```
Possible site: 41
>>> Seems to have no N-terminal signal sequence

----- Final Results -----
            bacterial cytoplasm --- Certainty = 0.3150 (Affirmative) < succ>
            bacterial membrane  --- Certainty = 0.0000 (Not Clear)   < succ>
            bacterial outside   --- Certainty = 0.0000 (Not Clear)   < succ>
```

No corresponding DNA sequence was identified in *S. pyogenes*.

Based on this analysis, it was predicted that this protein and its epitopes, could be useful antigens for vaccines or diagnostics.

EXAMPLE 922

A DNA sequence (GBSx0977) was identified in *S. agalactiae* <SEQ ID 2799> which encodes the amino acid sequence <SEQ ID 2800>. This protein is predicted to be neuD. Analysis of this protein sequence reveals the following:

```
Possible site: 16
>>> Seems to have no N-terminal signal sequence

----- Final Results -----
            bacterial membrane  --- Certainty = 0.0000 (Not Clear) < succ>
            bacterial outside   --- Certainty = 0.0000 (Not Clear) < succ>
            bacterial cytoplasm --- Certainty = 0.0000 (Not Clear) < succ>
```

There is homology to SEQ ID 542.

Based on this analysis, it was predicted that this protein and its epitopes, could be useful antigens for vaccines or diagnostics.

EXAMPLE 923

A DNA sequence (GBSx0979) was identified in *S. agalactiae* <SEQ ID 2801> which encodes the amino acid sequence <SEQ ID 2802>. Analysis of this protein sequence reveals the following:

```
Possible site: 33
>>> Seems to have no N-terminal signal sequence

----- Final Results -----
            bacterial cytoplasm --- Certainty = 0.2576 (Affirmative) < succ>
            bacterial membrane  --- Certainty = 0.0000 (Not Clear)   < succ>
             bacterial outside  --- Certainty = 0.0000 (Not Clear)   < succ>
```

No corresponding DNA sequence was identified in *S. pyogenes*.

Based on this analysis, it was predicted that this protein and its epitopes, could be useful antigens for vaccines or diagnostics.

EXAMPLE 924

A DNA sequence (GBSx0980) was identified in *S. agalactiae* <SEQ ID 2803> which encodes the amino acid sequence <SEQ ID 2804>. Analysis of this protein sequence reveals the following:

```
Possible site: 49
>>> Seems to have no N-terminal signal sequence

----- Final Results -----
            bacterial cytoplasm --- Certainty = 0.1621 (Affirmative) < succ>
            bacterial membrane  --- Certainty = 0.0000 (Not Clear)   < succ>
             bacterial outside  --- Certainty = 0.0000 (Not Clear)   < succ>
```

A related GBS nucleic acid sequence <SEQ ID 9875> which encodes amino acid sequence <SEQ ID 9876> was also identified.

A related DNA sequence was identified in *S. pyogenes* <SEQ ID 2805> which encodes the amino acid sequence <SEQ ID 2806>. Analysis of this protein sequence reveals the following:

```
Possible site: 51
>>> Seems to have no N-terminal signal sequence

----- Final Results -----
            bacterial cytoplasm --- Certainty = 0.1066 (Affirmative) < succ>
            bacterial membrane  --- Certainty = 0.0000 (Not Clear)   < succ>
             bacterial outside  --- Certainty = 0.0000 (Not Clear)   < succ>
```

An alignment of the GAS and GBS proteins is shown below.

```
Identities = 83/139 (59%), Positives = 111/139 (79%)

Query:   6 TETHDHQALIQKLLVSIHYLTLFRDEIILVEKTPSLLGKHFSIAIVQNELGEILSKIEAL   65
           TE + HQ LIQKLLVSIHYLTLFRDE+ LVE+TPS+LG  F   +VQ+ELG+I++ I+ L
Sbjct:   4 TEQNSHQILIQKLLVSIHYLTLFRDELKLVERTPSILGGEFPAHLVQSELGDIVAAIDTL   63

Query:  66 SKQKKLIRSIYWYDESSFKVMNKALAIVEEWIKGLDNLLEFCQSQTVFQAILGDERAHVF  125
           Q++LI S +WY+ES+FK+MNK L IV+ WIKG+D+L++ CQS+ VFQ I+GD+R  VF
Sbjct:  64 DMQQRLIESTFWYEESAFKLMNKTLDIVDNWIKGVDHLIDLCQSKEVFQIIIGDKRIRVF  123

Query: 126 GILIDVYTSLNIINTSLKE                                          144
           G+L DV++SL +    SLKE
Sbjct: 124 GVLSDVFSSLKVSALSLKE                                          142
```

Based on this analysis, it was predicted that these proteins and their epitopes could be useful antigens for vaccines or diagnostics.

EXAMPLE 925

A DNA sequence (GBSx0981) was identified in *S. agalactiae* <SEQ ID 2807> which encodes the amino acid sequence <SEQ ID 2808>. This protein is predicted to be uracil-DNA glycosylase (ung). Analysis of this protein sequence reveals the following:

```
Possible site: 34
>>> Seems to have no N-terminal signal sequence

----- Final Results -----
            bacterial cytoplasm --- Certainty = 0.3427 (Affirmative) < succ>
             bacterial membrane --- Certainty = 0.0000 (Not Clear)   < succ>
              bacterial outside --- Certainty = 0.0000 (Not Clear)   < succ>
```

A related DNA sequence was identified in *S. pyogenes* <SEQ ID 2809> which encodes the amino acid sequence <SEQ ID 28110>. Analysis of this protein sequence reveals the following:

```
Possible site: 33
>>> Seems to have no N-terminal signal sequence

----- Final Results -----
            bacterial cytoplasm --- Certainty = 0.4200 (Affirmative) < succ>
             bacterial membrane --- Certainty = 0.0000 (Not Clear)   < succ>
              bacterial outside --- Certainty = 0.0000 (Not Clear)   < succ>
```

An alignment of the GAS and GBS proteins is shown below.

```
Identities = 160/216 (74%), Positives = 185/216 (85%)

Query:    1 MKHSSWHDLIKRELPNHYYNKINTFMDAVYESGIVYPPRDKVFNAIQITPLENVKVVIIG   60
            M HS WH+ IK  LP HYY +IN F+D  Y SG+VYPPR+ VF A+Q+TPLE  KV+I+G
Sbjct:    1 MAHSIWHEKIKSFLPEHYYGRINHFLDEAYASGLVYPPRENVFKALQVTPLEETKVLILG   60

Query:   61 QDPYHGPQQAQGLSFSVPDNLPAPPSLQNILKELAEDIGSRSHHDLTSWAQQGVLLLNAC  120
            QDPYHGP+QAQGLSFSVP+ + APPSL NILKELA+DIG R HHDL++WA QGVLLLNAC
Sbjct:   61 QDPYHGPKQAQGLSFSVPEEISAPPSLINILKELADDIGPRDHHDLSTWASQGVLLLNAC  120

Query:  121 LTVPEHQANGHAGLIWEPFTDAVIKVVNQKETPVVFILWGGYARKKKSLIDNPIHHIIES  180
            LTVP  QANGHAGLIWEPFTDAVIKV+N+K++PVVFILWG YARKKK+ I NP HHIIES
Sbjct:  121 LTVPAGQANGHAGLIWEPFTDAVIKVLNEKDSPVVFILWGAYARKKKAFITNPKHHIIES  180

Query:  181 PHPSPLSAYRGFFGSRPFSRTNHFLEEEGINEIDWL                         216
            PHPSPLS+YRGFFGS+PFSRTN  LE+EG+  +DWL
Sbjct:  181 PHPSPLSSYRGFFGSKPFSRTNAILEKEGMTGVDWL                         216
```

Based on this analysis, it was predicted that these proteins and their epitopes could be useful antigens for vaccines or diagnostics.

EXAMPLE 926

A DNA sequence (GBSx0982) was identified in *S. agalactiae* <SEQ ID 2811> which encodes the amino acid sequence <SEQ ID 2812>. Analysis of this protein sequence reveals the following:

```
Possible site: 20
>>> Seems to have an uncleavable N-term signal seq
INTEGRAL Likelihood = -11.15  Transmembrane 147-163 (109-166)
INTEGRAL Likelihood =  -8.92  Transmembrane 124-140 (109-146)
INTEGRAL Likelihood =  -6.16  Transmembrane 167-183 (166-186)
INTEGRAL Likelihood =  -4.67  Transmembrane   3-19  (1-23)
```

-continued

```
INTEGRAL Likelihood = -3.98   Transmembrane    72-88  (64-92)
INTEGRAL Likelihood = -1.06   Transmembrane   106-122 (105-122)
INTEGRAL Likelihood = -0.90   Transmembrane    54-70  (54-70)

----- Final Results -----
              bacterial membrane --- Certainty = 0.5458 (Affirmative) < succ>
                bacterial outside --- Certainty = 0.0000 (Not Clear) < succ>
                  bacterial cytoplasm --- Certainty = 0.0000 (Not Clear) < succ>
```

A related GBS nucleic acid sequence <SEQ ID 9873> which encodes amino acid sequence <SEQ ID 9874> was also identified.

The protein has homology with the following sequences in the GENPEPT database.

```
>GP: CAA91549 GB: Z67739 unidentified [Streptococcus pneumoniae]
Identities = 134/212 (63%), Positives = 168/212 (79%)

Query:    1 MNIIIMIIAYLLGSIQTGLWIGKYFYQVNLRQHGSGNTGTTNTFRILGVKAGIVTLTID    60
            M  I+++I+AYLLGSI +GLWIG+ F+Q+NLR+HGSGNTGTTNTFRILG KAG+ T  ID
Sbjct:    1 MITIVLLILAYLLGSIPSGLWIGQVFFQINLREHGSGNTGTTNTFRILGKKAGMATFVID   60

Query:   61 ILKGTLATLIPIILGITTVSPFFIGFFAIIGHTFPIFAQFKGGKAVATSAGVLLGFAPSF  120
            KGTLATL+PII +   VSP   G A+IGHTFPIFA FKGGKAVATSAGV+ GFAP F
Sbjct:   61 FFKGTLATLLPIIFHLQGVSPLIFGLLAVIGHTFPIFAGFKGGKAVATSAGVIFGFAPIF  120

Query:  121 FLYLLVIFLLTLYLFSMISLSSITVAVVGILSVLIFPLVGFILTDYDWIFTTVVILMALT  180
            LYL +IF    LYL SMISLSS+T ++   ++ VL+FPL GFIL++YD++F   +++ +A
Sbjct:  121 CLYLAIIFFGALYLGSMISLSSVTASIAAVIGVLLFPLFGFILSNYDFLFIAIILALASL  180

Query:  181 IIIRHQDNIKRIRKRQENLVPFGLNLSKQKNK                             212
            IIIRH+DNI RI+ +  ENLVP+GLNL+ Q  K
Sbjct:  181 IIIRHKDNIARIKNKTENLVPWGLNLTHQDPK                             212
```

A related DNA sequence was identified in S. pyogenes <SEQ ID 2813> which encodes the amino acid sequence <SEQ ID 2814>. Analysis of this protein sequence reveals the following:

```
Possible site: 17
>>> Seems to have no N-terminal signal sequence
INTEGRAL Likelihood = -10.83  Transmembrane  194-210 (191-216)
INTEGRAL Likelihood = -9.77   Transmembrane  146-162 (132-191)
INTEGRAL Likelihood = -7.70   Transmembrane  165-181 (163-191)
INTEGRAL Likelihood = -5.89   Transmembrane   23-39  (19-47)
INTEGRAL Likelihood = -4.83   Transmembrane   95-111 (91-118)

----- Final Results -----
              bacterial membrane --- Certainty = 0.5331 (Affirmative) < succ>
                bacterial outside --- Certainty = 0.0000 (Not Clear) < succ>
                  bacterial cytoplasm --- Certainty = 0.0000 (Not Clear) < succ>
```

The protein has homology with the following sequences in the databases:

```
>GP: CAA91549 GB: Z67739 unidentified [Streptococcus pneumoniae]
Identities = 138/213 (64%), Positives = 166/213 (77%)

Query:   28 MKLLLFITIAYLLGSIPTGLWIGQYFYHINLREHGSGNTGTTNTFRILGVKAGTATLAID   87
            M  ++ + +AYLLGSIP+GLWIGQ F+ INLREHGSGNTGTTNTFRILG KAG AT  ID
Sbjct:    1 MITIVLLILAYLLGSIPSGLWIGQVFFQINLREHGSGNTGTTNTFRILGKKAGMATFVID   60

Query:   88 MFKGTLSILLPIIFGMTSISSIAIGFFAVLGHTFPIFANFKGGKAVATSAGVLLGFAPLY  147
            FKGTL+ LLPIIF +  +S + G AV+GHTFPIFA FKGGKAVATSAGV+ GFAP++
Sbjct:   61 FFKGTLATLLPIIFHLQGVSPLIFGLLAVIGHTFPIFAGFKGGKAVATSAGVIFGFAPIF  120

Query:  148 LFFLASIFVLVLYLFSMISLASVVSAIVGVLSVLTFPAIHFLLPNYDYFLTFIVILLAFI  207
            +LA IF    LYL SMISL+SV ++I  V+ VL FP   F+L NYD+     I++ LA +
Sbjct:  121 CLYLAIIFFGALYLGSMISLSSVTASIAAVIGVLLFPLFGFILSNYDFLFIAIILALASL  180

Query:  208 IIIRHKDNISRIKHHTENLIPWGLNLSKQVPPK                            240
            IIIRHKDNI+RIK+ TENL+PWGLNL+ Q PKK
Sbjct:  181 IIIRHKDNIARIKNKTENLVPWGLNLTHQDPKK                            213
```

An alignment of the GAS and GBS proteins is shown below.

```
Identities = 143/212 (67%), Positives = 174/212 (81%)

Query:    1 MNIIIMIIAYLLGSIQTGLWIGKYFYQVNLRQHGSGNTGTTNTFRILGVKAGIVTLTID   60
            M +++ I IAYLLGSI TGLWIG+YFY +NLR+HGSGNTGTTNTFRILGVKAG  TL ID
Sbjct:   28 MKLLLFITIAYLLGSIPTGLWIGQYFYHINLREHGSGNTGTTNTFRILGVKAGTATLAID   87

Query:   61 ILKGTLATLIPIILGITTVSPFFIGFFAIIGHTFPIFAQFKGGKAVATSAGVLLGFAPSF  120
            + KGTL+ L+PII G+T++S   IGFFA++GHTFPIFA FKGGKAVATSAGVLLGFAP +
Sbjct:   88 MFKGTLSILLPIIFGMTSISSIAIGFFAVLGHTFPIFANFKGGKAVATSAGVLLGFAPLY  147

Query:  121 FLYLLVIFLLTLYLFSMISLSSITVAVVGILSVLIFPLVGFILTDYDWIFTTVVILMALT  180
            +L   IF+L LYLFSMISL+S+  A+VG+LSVL FP + F+L +YD+  T +VIL+A
Sbjct:  148 LFFLASIFVLVLYLFSMISLASVVSAIVGVLSVLTFPAIHFLLPNYDYFLTFIVILLAFI  207

Query:  181 IIIRHQDNIKRIRKRQENLVPFGLNLSKQKNK                             212
            IIIRH+DNI RI+    ENL+P+GLNLSKQ  K
Sbjct:  208 IIIRHKDNISRIKHHTENLIPWGLNLSKQVPK                             239
```

Based on this analysis, it was predicted that these proteins and their epitopes could be useful antigens for vaccines or diagnostics.

EXAMPLE 927

A DNA sequence (GBSx0983) was identified in *S. agalactiae* <SEQ ID 2815> which encodes the amino acid sequence <SEQ ID 2816>. Analysis of this protein sequence reveals the following:

```
Possible site: 18
>>> Seems to have an uncleavable N-term signal seq

----- Final Results -----
            bacterial membrane --- Certainty = 0.0000 (Not Clear) < succ>
             bacterial outside --- Certainty = 0.0000 (Not Clear) < succ>
             bacterial cytoplasm --- Certainty = 0.0000 (Not Clear) < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 928

A DNA sequence (GBSx0984) was identified in *S. agalactiae* <SEQ ID 2817> which encodes the amino acid sequence <SEQ ID 2818>. Analysis of this protein sequence reveals the following:

```
Possible site: 56
>>> Seems to have no N-terminal signal sequence

----- Final Results -----
            bacterial cytoplasm --- Certainty = 0.1585 (Affirmative) < succ>
             bacterial membrane --- Certainty = 0.0000 (Not Clear) < succ>
              bacterial outside --- Certainty = 0.0000 (Not Clear) < succ>
```

A related GBS nucleic acid sequence <SEQ ID 9871> which encodes amino acid sequence <SEQ ID 9872> was also identified.

The protein has homology with the following sequences in the GENPEPT database.

```
>GP: CAA91550 GB: Z67739 DNA topoisomerase IV [Streptococcus
pneumoniae] (ver 2)
Identities = 574/649 (88%), Positives = 617/649 (94%), Gaps = 2/649 (0%)

Query:    5 LAKQDITVTNYGDDAIQVLEGLDAVRKRPGMYIGSTDGTGLHHLVWEIVDNAVDEALSGF   64
            ++K++I + NY DDAIQVLEGLDAVRKRPGMYIGSTDG GLHHLVWEIVDNAVDEALSGF
Sbjct:    1 MSKKEININNYNDDAIQVLEGLDAVRKRPGMYIGSTDGAGLHHLVWEIVDNAVDEALSGF   60

Query:   65 GNRIDVIINKDGSITVTDHGRGMPTGMHAMGKPTVEVIFTVLHAGGKFGQGGYKTSGGLH  124
            G+RIDV INKDGS+TV DHGRGMPTGMHAMG PTVEVIFT+LHAGGKFGQGGYKTSGGLH
Sbjct:   61 GDRIDVTINKDGSLTVQDHGRGMPTGMHAMGIPTVEVIFTILHAGGKFGQGGYKTSGGLH  120

Query:  125 GVGSSVVNALSSWLEVEIIRDGAIYRQRFENGGKPVTTLKKIGTAPKSKSGTSVSFMPDQ  184
            GVGSSVVNALSSWLEVEI RDGA+Y+QRFENGGKPVTTLKKIGTAPKSK+GT V+FMPD
Sbjct:  121 GVGSSVVNALSSWLEVEITRDGAVYKQRFENGGKPVTTLKKIGTAPKSKTGTKVTFMPDA  180

Query:  185 SVFSTIDFKFNTIAERLKESAFLLKNVTLTLTDNRSEEAEHLEFHYENGVQDFVEYLNED  244
            ++FST DFK+NTI+ERL ESAFLLKNVTL+LTD R++EA  +EFHYENGVQDFV YLNED
Sbjct:  181 TIFSTTDFKYNTISERLNESAFLLKNVTLSLTDKRTDEA--IEFHYENGVQDFVSYLNED  238

Query:  245 KETLTPIMFFEGEEQEFHIEVALQYNDGFSDNILSFVNNVRTKDGGTHETGLKSAITKSM  304
            KE LTP+++FEGE+   F +EVALQYNDGFSDNILSFVNNVRTKDGGTHETGLKSAITK M
Sbjct:  239 KEILTPVLYFEGEDNGFQVEVALQYNDGFSDNILSFVNNVRTKDGGTHETGLKSAITKVM  298

Query:  305 NDYARKTGLLKEKDKNLEGSDYREGLSAILSILVPEEHLQFEGQTKDKLGSPLARPIVDG  364
            NDYARKTGLLKEKDKNLEGSDYREGL+A+LSILVPEEHLQFEGQTKDKLGSPLARP+VDG
Sbjct:  299 NDYARKTGLLKEKDKNLEGSDYREGLAAVLSILVPEEHLQFEGQTKDKLGSPLARPVVDG  358

Query:  365 IVSEKLTYFLMENGDLASNLIRKAIKARDAREAARKARDESRNGKKSKKDKGLLSGKLTP  424
            IV++KLT+FLMENG+LASNLIRKAIKARDAREAARKARDESRNGKK+KKDKGLLSGKLTP
Sbjct:  359 IVADKLTFFLMENGELASNLIRKAIKARDAREAARKARDESRNGKKNKKDKGLLSGKLTP  418

Query:  425 AQSKNAKKNELYLVEGDSAGGSAKQGRDRKFQAILPLRGKVLNTAKAKMADIIKNEEINT  484
            AQSKN  KNELYLVEGDSAGGSAKQGRDRKFQAILPLRGKV+NTAKAKMADI+KNEEINT
Sbjct:  419 AQSKNPAKNELYLVEGDSAGGSAKQGRDRKFQAILPLRGKVINTAKAKMADILKNEEINT  478

Query:  485 MHTIGAGVGPDFNLDDINYDKIIIMTDADTDGAHIQTLLLTFFYRYMRPLVEEGHVYIA  544
            MI+TIGAGVG DF+++D NYDKIIIMTDADTDGAHIQTLLLTFFYRYMRPLVE GHVYIA
Sbjct:  479 MIYTIGAGVGADFSIEDANYDKIIIMTDADTDGAHIQTLLLTFFYRYMRPLVEAGHVYIA  538

Query:  545 LPPLYKMSKGKGKKEIVEYAWTDIELEELRQKFGKGSLLQRYKGLGEMNADQLWETTMNP  604
            LPPLYKMSKGKGKKE V YAWTD ELEELR++FGKG+ LQRYKGLGEMNADQLWETTMNP
Sbjct:  539 LPPLYKMSKGKGKKEEVAYAWTDGELEELRKQFGKGATLQRYKGLGEMNADQLWETTMNP  598

Query:  605 ETRTLIRVTIEDLARAERRVNVLMGDKVPPRRQWIEDNVKFTLEENTVF            653
            ETRTLIRVTIEDLARAERRVNVLMGDKV PRR+WIEDNVKFTLEE TVF
Sbjct:  599 ETRTLIRVTIEDLARAERRVNVLMGDKVEPRRKWIEDNVKFTLEEATVF            647
```

A related DNA sequence was identified in *S. pyogenes* <SEQ ID 2819> which encodes the amino acid sequence <SEQ ID 2820>. Analysis of this protein sequence reveals the following:

```
Possible site: 53
>>> Seems to have no N-terminal signal sequence

----- Final Results -----
          bacterial cytoplasm --- Certainty = 0.1518 (Affirmative) < succ>
          bacterial membrane  --- Certainty = 0.0000 (Not Clear)   < succ>
           bacterial outside  --- Certainty = 0.0000 (Not Clear)   < succ>
```

An alignment of the GAS and GBS proteins is shown below.

```
Identities = 560/649 (86%), Positives = 615/649 (94%)

Query:    5 LAKQDITVTNYGDDAIQVLEGLDAVRKRPGMYIGSTDGTGLHHLVWEIVDNAVDEALSGF   64
            L K++IT+ NY DDAIQVLEGLDAVRKRPGMYIGSTD TGLHHL+WEIVDNAVDEALSGF
Sbjct:    2 LTKKEITINNYNDDAIQVLEGLDAVRKRPGMYIGSTDATGLHHLIWEIVDNAVDEALSGF   61

Query:   65 GNRIDVIINKDGSITVTDHGRGMPTGMHAMGKPTVEVIFTVLHAGGKFGQGGYKTSGGLH  124
            G+ I V+INKDGS++V D GRGMPTG HAMG PTV+VIFT+LHAGGKFGQGGYKTSGGLH
Sbjct:   62 GDDIKVVINKDGSVSVADSGRGMPTGQHAMGIPTVQVIFTILHAGGKFGQGGYKTSGGLH  121
```

-continued

```
Query: 125 GVGSSVVNALSSWLEVEIIRDGAIYRQRFENGGKPVTTLKKIGTAPKSKSGTSVSFMPDQ 184
            GVGSSVVNALS+WLEVEI RDG++YRQRFENGGKPVTTLKK+GTAPKSKSGT V+FMPD
Sbjct: 122 GVGSSVVNALSAWLEVEITRDGSVYRQRFENGGKPVTTLKKVGTAPKSKSGTVVTFMPDD 181

Query: 185 SVFSTIDFKFNTIAERLKESAFLLKNVTLTLTDNRSEEAEHLEFHYENGVQDFVEYLNED 244
             +FSTIDFKFNTI+ERLKESAFLLKNV ++LTD R ++    EPHYENGVQDFVEYLNED
Sbjct: 182 KIFSTIDFKFNTISERLKESAFLLKNVKMSLTDLRGDDPIIEEFHYENGVQDFVEYLNED 241

Query: 245 KETLTPIMFFEGEEQEFHIEVALQYNDGFSDNILSFVNNVRTKDGGTHETGLKSAITRSM 304
            KETLTP+++ EG++Q+F +EVALQYNDGFSDNILSFVNNVRTKDGG+HETGLKSAITK+M
Sbjct: 242 KETLTPVIYMEGQDQDFQVEVALQYNDGFSDNILSFVNNVRTKDGGSHETGLKSAITKAM 301

Query: 305 NDYARKTGLLKEKDKNLEGSDYREGLSAILSILVPEEHLQFEGQTKDKLGSPLARPIVDG 364
            NDYARKT LLKEKDKNLEGSDYREGLSA+LSILVPE+HLQFEGQTKDKLGSPLARPIV+
Sbjct: 302 NDYARKTNLLKEKDKNLEGSDYREGLSAVLSILVPEQHLQFEGQTKDKLGSPLARPIVES 361

Query: 365 IVSEKLTYFLMENGDLASNLIRKAIKARDAREAARKARDESRNGKKSKKDKGLLSGKLTP 424
            IVSEKLT+FL+ENG++AS+L+RKAIKARDAREAARKARD+SRNGKK+KKDKGLLSGKLTP
Sbjct: 362 IVSEKLTFFLLENGEVASHLVRKAIKARDAREAARKARDDSRNGKKNKKDKGLLSGKLTP 421

Query: 425 AQSKNAKKNELYLVEGDSAGGSAKQGRDRKFQAILPLRGKVLNTAKAKMADIIKNEEINT 484
            AQSKNAKKNELYLVEGDSAGGSAKQGRDRKFQAILPLRGKVLNT KAKMADI+KNEEINT
Sbjct: 422 AQSKNAKKNELYLVEGDSAGGSAKQGRDRKFQAILPLRGKVLNTEKAKNADILKNEEINT 481

Query: 485 MIHTIGAGVGPDFNLDDINYDKIIIMTDADTDGAHIQTLLLTFFYRYMRPLVEEGHVYIA 544
            M++TIGAGVG DFNL+DINYDKIIIMTDADTDGAHIQTLLLTFFYRYMRPLVE GHVYIA
Sbjct: 482 MVYTIGAGVGADFNLEDINYDKIIIMTDADTDGAHIQTLLLTFFYRYMRPLVEAGHVYIA 541

Query: 545 LPPLYKMSKGKGKKEIVEYAWTDIELEELRQKFGKGSLLQRYKGLGEMNADQLWETTMNP 604
            LPPLYKMSKGKGK E + YAWTD ELE+LR++FGKG++LQRYKGLGEMNA+QLWETTM+P
Sbjct: 542 LPPLYKMSKGKGKTEKIAYAWTDGELEDLRREFGKGAILQRYKGLGEMNANQLWETTMDP 601

Query: 605 ETRTLIRVTIEDLARAERRVNVLMGDKVPPRRQWIEDNVKFTLEENTVF            653
            ETRTLIRVTI+DLARAERRV+VLMGDK PRRQWIEDNVKFTLEENTVF
Sbjct: 602 ETRTLIRVTIDDLARAERRVSVLMGDKAAPRRQWIEDNVKFTLEENTVF            650
```

Based on this analysis, it was predicted that these proteins and their epitopes could be useful antigens for vaccines or diagnostics.

EXAMPLE 929

A DNA sequence (GBSx0985) was identified in *S. agalactiae* <SEQ ID 2821> which encodes the amino acid sequence <SEQ ID 2822>. Analysis of this protein sequence reveals the following:

```
Possible site: 49
>>> Seems to have no N-terminal signal sequence
INTEGRAL Likelihood = -0.80 Transmembrane 378-394 (378-394)

----- Final Results -----
            bacterial membrane --- Certainty = 0.1319 (Affirmative) < succ>
              bacterial outside --- Certainty = 0.0000 (Not Clear) < succ>
                bacterial cytoplasm --- Certainty = 0.0000 (Not Clear) < succ>
```

The protein has homology with the following sequences in the GENPEPT database.

```
>GP: AAD34369 GB: AF129764 ParC [Streptococcus mitis]
Identities = 640/820 (78%), Positives = 722/820 (88%), Gaps = 5/820 (0%)

Query:   1 MSNIQNMSLEDIMGERFGRYSKYIIQERALPDIRDGLKPVQRRILYSMNKDGNTFEKGFR  60
            MSNIQNMSLEDIMGERFGRYSKYIIQ+RALPDIRDGLKPVQRRILYSMNKDGNTF+K +R
Sbjct:   1 MSNIQNMSLEDIMGERFGRYSKYIIQDRALPDIRDGLKPVQRRILYSMNKDGNTFDKSYR  60

Query:  61 KSAKSVGNVMGNFHPHGDSSIYDAMVRMSQDWKNRETLIEMHGNNGSMDGDPAAAMRYTE 120
            KSAKSVGN+MGNFHPHGDSSIYDAMVRMSQDWKNRE L+EMHGNNGSMDGDP AAMRYTE
Sbjct:  61 KSAKSVGNIMGNFHPHGDSSIYDAMVRMSQDWKNREILVEMHGNNGSMDGDPPAAMRYTE 120

Query: 121 ARLSEIAGYLLQDIDKNTVPFAWNFDDTEKEPTVLPAAFPNLLVNGATGISAGYATDIPP 180
            ARLSEIAGYLLQDIDK TVPF+WNFDDTEKEPTVLPAAFPNLLVNG+TGISAGYATD+PP
Sbjct: 121 ARLSEIAGYLLQDIDKKTVPFSWNFDDTEKEPTVLPAAFPNLLVNGSTGISAGYATDIPP 180
```

-continued

```
Query: 181 HNLAEVIDAVVYMIDHPKAKLDKLMEFLPGPDFPTGAIIQGKDEIRKAYETGKGRVAVRS 240
            HNLAEVIDA VYMIDHP AK+DKLMEFLPGPDFPTG IIQG+DEI+KAYETGKGRV VRS
Sbjct: 181 HNLAEVIDAAVYMIDHPTAKVDKLMEFLPGPDFPTGGIIQGRDEIKKAYETGKGRVVVRS 240

Query: 241 RTAIETLKGGKKQIIVTEIPYEVNKSVLVKRIDDVRVNNKVPGIAEVRDESDRDGLRIAI 300
            +T IE LKGGK+QI++TEIPYE+NK+ LVK+IDDVRVN+KV GIAEVRDESDRDGLRIAI
Sbjct: 241 KTEIEKLKGGKEQIVITEIPYEINKANLVKKIDDVRVNSKVAGIAEVRDESDRDGLRIAI 300

Query: 301 ELKKEADETIVLNYLFKYTDLQVNYNFNMVAIDDYTPKQVGLSRILTSYIAHRREIIIAR 360
            ELKK+A+   +VLNYLFKYTDLQ+NYNFNMVAID++TP+QVG+  IL+SYIAHRRE+I+AR
Sbjct: 301 ELKKDANTELVLNYLFKYTDLQINYNFNMVAIDNFTPRQVGIVPILSSYIAHRREVILAR 360

Query: 361 SKFDKEKAEKRLHIVEGLIRVLSILDEVIALIRASENKADAKENLKVSYEFSEAQAEAIV 420
            S+FDKEKAEKRLHIVEGLIRV+SILDEVIALIRASENKADAKENLKVSY+F+E QAEAIV
Sbjct: 361 SRFDKEKAEKRLHIVEGLIRVISILDEVIALIRASENKADAKENLKVSYDFTEEQAEAIV 420

Query: 421 TLQLYRLTNTDIVTLREEEEELRQQITMLKAIISDERTMYNVMKRELREVKKKFANTRRS 480
            TLQLYRLTNTD+V L+EEE ELR++I ML AII DERTMYN+MK+ELREVKKKFA  R S
Sbjct: 421 TLQLYRLTNTDVVVLQEEEAELREKIAMLAAIIGDERTMYNLMKKELREVKKKFATPRLS 480

Query: 481 ELQELAETIEIDTASLIIEEDTYVSVTRGGYVKRTSPRSFNASTVDELGKREDDELIFVS 540
            L++ A+ IEIDTASLI EEDTYVSVT+ GY+KRTSPRSF AST++E+GKR+DD LIFV
Sbjct: 481 SLEDTAKAIEIDTASLIAEEDTYVSVTKAGYIKRTSPRSFAASTLEEIGKRDDDRLIFVQ 540

Query: 541 NAKTTQHLLMFTNLGNLAYRPVHELADIRWKDVGEHLSQNLVNFASNEEIIYAELVDDF- 599
            +AKTTQHLLMFT LGN+ YRP+HELADIRWKD+GEHLSQ + NF +NEEI+Y E+VD F
Sbjct: 541 SAKTTQHLLMFTTLGNVIYRPIHELADIRWKDIGEHLSQTITNFETNEEILYVEVVDQFD 600

Query: 600 TKETYFAVTSLGQIKRFERQEISPWRTYKSKTAKYAKLKSVEDYVVTVAPIQLEDVILVT 659
             TYFA T LGQIKR ER+E +PWRTYKSK+ KYAKLK    D +V VAPI+L+DV+L++
Sbjct: 601 DATTYFAATRLGQIKRVERKEFTPWRTYKSKSVKYAKLKDDTDQIVAVAPIKLDDVLLIS 660

Query: 660 YNGYALRFSINDVPVVGSKAAGVKAMNLKDRDHIVSAFIANTTSLYLLTHRGSLKRMAID 719
            NGYALRF+I +VPVVG+KAAGVKAMNLK+ D + SAFI NT+S YLLT RGSLKR++ID
Sbjct: 661 QNGYALRFNIEEVPVVGAKAAGVKAMNLKEDDTLQSAFICNTSSFYLLTQRGSLKRVSID 720

Query: 720 VIPTTSRANRGLQVLRELKSKPHRVFKAGPVYLEDSSFEFDLFSSVSNHEGDTFVLEIMS 779
            IP TSRA RGLQVLRELK+KPHRVF AG V  +  F   DLFS+         T  L + S
Sbjct: 721 EIPATSRAKRGLQVLRELKNKPHRVFLAGSV--AEQGFVGDLFSTEVEENDQT--LLVQS 776

Query: 780 KTGKVYDVDLSQWSFSERTSNGSFVSDKISDEEVFSVKIK                    819
             G +Y+  L    + SERTSNGSF+SD ISDEEVF  +K
Sbjct: 777 NKGTIYESRLQDLNLSERTSNGSFISDTISDEEVFDAYLK                    816
```

A related DNA sequence was identified in *S. pyogenes* <SEQ ID 2823> which encodes the amino acid sequence <SEQ ID 2824>. Analysis of this protein sequence reveals the following:

```
Possible site: 51
>>> Seems to have no N-terminal signal sequence
INTEGRAL Likelihood = -0.53 Transmembrane 376-392 (376-394)

----- Final Results -----
           bacterial membrane --- Certainty = 0.1213 (Affirmative) < succ>
            bacterial outside --- Certainty = 0.0000 (Not Clear) < succ>
              bacterial cytoplasm --- Certainty = 0.0000 (Not Clear) < succ>
```

An alignment of the GAS and GBS proteins is shown below.

```
Identities = 633/819 (77%), Positives = 719/819 (87%)

Query:   1 MSNIQNMSLEDIMGERFGRYSKYIIQERALPDIRDGLKPVQRRILYSMNKDGNTFEKGFR  60
           MSNIQNMSLEDIMGERFGRYSKYIIQERALPDIRDGLKPVQRRILYSMNKDGNTFEKG+R
Sbjct:   3 MSNIQNMSLEDIMGERFGRYSKYIIQERALPDIRDGLKPVQRRILYSMNKDGNTFEKGYR  62

Query:  61 KSAKSVGNVMGNFHPHGDSSIYDAMVRMSQDWKNRETLIEMHGNNGSMDGDPAAAMRYTE 120
           KSAKSVGN+MGNFHPHGDSSIYDAMVRMSQDWKNRE L+EMHGNNGSMDGDP AAMRYTE
Sbjct:  63 KSAKSVGNIMGNFHPHGDSSIYDAMVRMSQDWKNREILVEMHGNNGSMDGDPPAAMRYTE 122

Query: 121 ARLSEIAGYLLQDIDKNTVPFAWNFDDTEKEPTVLPAAFPNLLVNGATGISAGYATDIPP 180
           ARLSEIAGYLLQDI+KNTV FAWNFDDTEKEPTVLPAAFPNLLVNG++GISAGYATDIPP
Sbjct: 123 ARLSEIAGYLLQDIEKNTVSFAWNFDDTEKEPTVLPAAFPNLLVNGSSGISAGYATDIPP 182
```

-continued

```
Query:  181 HNLAEVIDAVVYMIDHPKAKLDKLMEFLPGPDFPTGAIIQGKDEIRKAYETGKGRVAVRS  240
            HNL+EVIDAVVYMIDHPKA L+KLMEFLPGPDFPTG IIQG DEI+KAYETGKGRV VRS
Sbjct:  183 HNLSEVIDAVVYMIDHPKASLEKLMEFLPGPDFPTGGIIQGADEIKKAYETGKGRVVVRS  242

Query:  241 RTAIETLKGGKKQIIVTEIPYEVNKSVLVKRIDDVRVNNKVPGIAEVRDESDRDGLRIAI  300
            RT IE LKGGK+QIIVTEIPYEVNK+VLVK+IDDVRVNNKVPGI EVRDESDR GLRIAI
Sbjct:  243 RTEIEELKGGKQQIIVTEIPYEVNKAVLVKKIDDVRVNNKVPGIVEVRDESDRTGLRIAI  302

Query:  301 ELKKEADETIVLNYLFKYTDLQVNYNFNMVAIDDYTPKQVGLSRILTSYIAHRREIIIAR  360
            ELKKEAD   +LNYL KYTDLQVNYNFNMVAID +TP+QVGL +IL+SYI+HR++III R
Sbjct:  303 ELKKEADSQTILNYLLKYTDLQVNYNFNMVAIDHFTPRQVGLQKILSSYISHRKDIIIER  362

Query:  361 SKFDKEKAEKRLHIVEGLIRVLSILDEVIALIRASENKADAKENLKVSYEFSEAQAEAIV  420
            SKFDK KAEKRLHIVEGLIRVLSILDE+IALIR+S+NKADAKENLKVSY+FSE QAEAIV
Sbjct:  363 SKFDKAKAEKRLHIVEGLIRVLSILDEIIALIRSSDNKADAKENLKVSYDFSEEQAEAIV  422

Query:  421 TLQLYRLTNTDIVTLREEEEELRQQITMLKAIISDERTMYNVMKRELREVKKKFANTRRS  480
            TLQLYRLTNTDIVTL+ EE +LR  IT L AII DE TMYNVMKRELREVKKKFAN R S
Sbjct:  423 TLQLYRLTNTDIVTLQNEENDLRDLITTLSAIIGDEATMYNVMKRELREVKKKFANPRLS  482

Query:  481 ELQELAETIEIDTASLIIEEDTYVSVTRGGYVKRTSPRSFNASTVDELGKREDDELIFVS  540
            ELQ  ++ IEIDTASLI EE+T+VSVTRGGY+KRTSPRSFNAS+++E+GKR+DDELIFV
Sbjct:  483 ELQAESQIIEIDTASLIAEEETFVSVTRGGYLKRTSPRSFNASSLEEVGKRDDDELIFVK  542

Query:  541 NAKTTQHLLMFTNLGNLAYRPVHELADIRWKDVGEHLSQNLVNFASNEEIIYAELVDDFT  600
               AKTT+HLL+FT LGN+ YRP+HEL D+RWKD+GEHLSQ + NFA+ EEI+YA++V  F
Sbjct:  543 QAKTTEHLLLFTTLGNVIYRPIHELTDLRWKDIGEHLSQTISNFATEEEILYADIVTSFD  602

Query:  601 KETYFAVTSLGQIKRFERQEISPWRTYKSKTAKYAKLKSVEDYVVTVAPIQLEDVILVTY  660
            +  Y AVT  G IKRF+R+E+SPWRTYKSK+ KY KLK  +D VVT++P+ +ED++LVT
Sbjct:  603 QGLYVAVTQNGFIKRFDRKELSPWRTYKSKSTKYVKLKDDKDRVVTLSPVIMEDLLLVTK  662

Query:  661 NGYALRFSINDVPVVGSKAAGVKAMNLKDRDHIVSAFIANTTSLYLLTHRGSLKRMAIDV  720
            NGYALRFS +VP+ G K+AGVK +NLK+ D + SAF    + S ++LT RGSLKRMA+D
Sbjct:  663 NGYALRFSSQEVPIQGLKSAGVKGINLKNDDSLASAFAVTSNSFFVLTQRGSLKRMAVDD  722

Query:  721 IPTTSRANRGLQVLRELKSKPHRVFKAGPVYLEDSSFEFDLFSSVSNHEGDTFVLEIMSK  780
            IP TSRANRGL VLRELK+KPHRVF AG V + S+ +FDLF+ +   E + +LE++SK
Sbjct:  723 IPQTSRANRGLLVLRELKTKPHRVFLAGGVQSDTSAEQFDLFTDIPEEETNQQMLEVISK  782

Query:  781 TGKVYDVDLSQWSFSERTSNGSFVSDKISDEEVFSVKIK                       819
            TG+ Y++ L  S SER SNGSF+SD ISD+EV   + +
Sbjct:  783 TGQTYEIALETLSLSERISNGSFISDTISDQEVLVARTR                       821
```

Based on this analysis, it was predicted that these proteins and their epitopes could be useful antigens for vaccines or diagnostics.

EXAMPLE 930

A DNA sequence (GBSx0986) was identified in *S. agalactiae* <SEQ ID 2825> which encodes the amino acid sequence <SEQ ID 2826>. Analysis of this protein sequence reveals the following:

```
Possible site: 49
>>> Seems to have no N-terminal signal sequence

----- Final Results -----
          bacterial cytoplasm --- Certainty = 0.3369 (Affirmative) < succ>
           bacterial membrane --- Certainty = 0.0000 (Not Clear)   < succ>
            bacterial outside --- Certainty = 0.0000 (Not Clear)   < succ>
```

The protein has homology with the following sequences in the GENPEPT database.

```
>GP: AAF64593 GB: AF169649 branched-chain aminotransferase IlvE
[Lactococcus lactis]
Identities = 259/340 (76%), Positives = 294/340 (86%)

Query:  1  MTVNLDWDNLGFAYRKLPFRYISHFKDGKWDDGKLTDDATLHISESSPALHYGQQAFEGL   60
           M +NLDW+NLGF+YR LPFRYI+ FKDGKW  G+LT D  LHISESSPALHYGQQ FEGL
Sbjct:  1  MAINLDWENLGFSYRNLPFRYIARFKDGKWSAGELTGDNQLHISESSPALHYGQQGFEGL   60
```

-continued

```
Query:   61 KAYRTKDGSIQLFRPDQNAERLQRTADRLLMPHVPTDKFIAAVKSVVRANEEFVPPYGTG  120
            KAYRTKDGSIQLFRPDQNA RLQ+TA RL M  V T+ FI AVK VV+AN++FVPPYGTG
Sbjct:   61 KAYRTKDGSIQLFRPDQNAARLQKTARRLCMAEVSTEMFIDAVKQVVKANKDFVPPYGTG  120

Query:  121 ATLYIRPLLIGVGDIIGVKPAEEYIFTVFAMPVGSYFKGGLTPTNFIVSKEYDRAAPNGT  180
            ATLY+RPLLIGVGD+IGVKPA+EYIF VFAMPVGSYFKGGL P+ F++S+EYDRAAP GT
Sbjct:  121 ATLYLRPLLIGVGDVIGVKPADEYIFKVFAMPVGSYFKGGLAPSKFVISREYDRAAPLGT  180

Query:  181 GAAKVGGNYAASLLPGKYAHEKQFSDVIYLDPATHTKIEEVGAANFFGITKDNQFITPLS  240
            G AKVGGNYAASL    A    ++D IYLDP+THTKIEEVGAANFFGIT DN+FITPLS
Sbjct:  181 GGAKVGGNYAASLQAEVGAKASGYADAIYLDPSTHTKIEEVGAANFFGITADNEFITPLS  240

Query:  241 PSILPSITKYSLLYLAKERFGMEAIEGDVFVDELDKFTEAGACGTAAVISPIGGIQNGDD  300
            PSILPSITKYSLLYLA+ R G++AIEG+V+  +L KF EAGACGTAA+ISPIG I +G+D
Sbjct:  241 PSILPSITKYSLLYLAEHRLGLKAIEGEVYAKDLGKFVEAGACGTAAIISPIGRIDDGED  300

Query:  301 FHVFYSETEVGPATRKLYDELVGIQFGDVEAPEGWIYKVD                      340
            ++F+SETEVGP  ++LYDELVGIQFGDVEAPEGWI KVD
Sbjct:  301 SYIFHSETEVGPTVKRLYDELVGIQFGDVEAPEGWIVKVD                      340
```

A related DNA sequence was identified in *S. pyogenes* <SEQ ID 2827> which encodes the amino acid sequence <SEQ ID 2828>. Analysis of this protein sequence reveals the following:

```
Possible site: 61
>>> Seems to have no N-terminal signal sequence

----- Final Results -----
              bacterial cytoplasm --- Certainty = 0.1208 (Affirmative) < succ>
              bacterial membrane  --- Certainty = 0.0000 (Not Clear)  < succ>
              bacterial outside   --- Certainty = 0.0000 (Not Clear)  < succ>
```

An alignment of the GAS and GBS proteins is shown below.

```
Identities = 280/340 (82%), Positives = 308/340 (90%)

Query:    1 MTVNLDWDNLGFAYRKLPFRYISHFKDGKWDDGKLTDDATLHISESSPALHYGQQAFEGL   60
            MT+ +DWDNLGF Y KLPFRYIS++K+G+WD G+LT+DATLHISES+PALHYGQQAFEGL
Sbjct:   16 MTIAIDWDNLGFEYHKLPFRYISYYKNGQWDKGQLTEDATLHISESAPALHYGQQAFEGL   75

Query:   61 KAYRTKDGSIQLFRPDQNAERLQRTADRLLMPHVPTDKFIAAVKSVVRANEEFVPPYGTG  120
            KAYRTKDGSIQLFRPD+NA RLQ TADRLLMP V T++FI A K VV+ANE+FVPPYGTG
Sbjct:   76 KAYRTKDGSIQLFRPDRNAVRLQATADRLLMPQVSTEQFIDAAKQVVKANEDFVPPYGTG  135

Query:  121 ATLYIRPLLIGVGDIIGVKPAEEYIFTVFAMPVGSYFKGGLTPTNFIVSKEYDRAAPNGT  180
            ATLY+RPLLIGVGDIIGVKPAEEYIFT+FAMPVG+YFKGGL PTNFIVS+ +DRAAP GT
Sbjct:  136 ATLYLRPLLIGVGDIIGVKPAEEYIFTIFAMPVGNYFKGGLAPTNFIVSEAFDRAAPYGT  195

Query:  181 GAAKVGGNYAASLLPGKYAHEKQFSDVIYLDPATHTKIEEVGAANFFGITKDNQFITPLS  240
            GAAKVGGNYA SLLPGK A     FSDVIYLDPATHTKIEEVGAANFFGIT +N+F+TPLS
Sbjct:  196 GAAKVGGNYAGSLLPGKAAKSAGFSDVIYLDPATHTKIEEVGAANFFGITANNEFVTPLS  255

Query:  241 PSILPSITKYSLLYLAKERFGMEAIEGDVFVDELDKFTEAGACGTAAVISPIGGIQNGDD  300
            PSILPSITKYSLL LA+ER GM  IEGDV ++ELDKF EAGACGTAAVISPIGGIQ  D+
Sbjct:  256 PSILPSITKYSLLQLAEERLGMTVIEGDVPINELDKFVEAGACGTAAVISPIGGIQYKDN  315

Query:  301 FHVFYSETEVGPATRKLYDELVGIQFGDVEAPEGWIYKVD                      340
             HVFYSETEVGP TR+LYDELVGIQFGD+EAPEGWI KVD
Sbjct:  316 LHVFYSETEVGPVTRRLYDELVGIQFGDIEAPEGWIVKVD                      355
```

Based on this analysis, it was predicted that these proteins and their epitopes could be useful antigens for vaccines or diagnostics.

EXAMPLE 931

A DNA sequence (GBSx0987) was identified in *S. agalactiae* <SEQ ID 2829> which encodes the amino acid sequence <SEQ ID 2830>. Analysis of this protein sequence reveals the following:

```
Possible site: 30
>>> Seems to have no N-terminal signal sequence

----- Final Results -----
           bacterial cytoplasm --- Certainty = 0.3459 (Affirmative) < succ>
           bacterial membrane  --- Certainty = 0.0000 (Not Clear)   < succ>
           bacterial outside   --- Certainty = 0.0000 (Not Clear)   < succ>
```

A related GBS nucleic acid sequence <SEQ ID 9365> which encodes amino acid sequence <SEQ ID 9366> was also identified. A further related GBS nucleic acid sequence <SEQ ID 10915> which encodes amino acid sequence <SEQ ID 10916> was also identified.

The protein has no significant homology with any sequences in the GENPEPT database.

A related DNA sequence was identified in *S. pyogenes* <SEQ ID 2831> which encodes the amino acid sequence <SEQ ID 2832>. Analysis of this protein sequence reveals the following:

```
Possible site: 50
>>> Seems to have no N-terminal signal sequence

----- Final Results -----
           bacterial cytoplasm --- Certainty = 0.3043 (Affirmative) < succ>
           bacterial membrane  --- Certainty = 0.0000 (Not Clear)   < succ>
           bacterial outside   --- Certainty = 0.0000 (Not Clear)   < succ>
```

An alignment of the GAS and GBS proteins is shown below.

```
Identities = 22/36 (61%), Positives = 30/36 (83%)

Query:  4 IVSKKDKKIEIQISDAQVTVNGTKVDGYQLVMEKKL 39
          ++SKKDKKIEIQ+ D +V VN TK+DGYQL + K++
Sbjct:  1 VMSKKDKKIEIQLIDHKVMVNETKIDGYQLQIGKRV 36
```

Based on this analysis, it was predicted that these proteins and their epitopes could be useful antigens for vaccines or diagnostics.

EXAMPLE 932

A DNA sequence (GBSx0988) was identified in *S. agalactiae* <SEQ ID 2833> which encodes the amino acid sequence <SEQ ID 2834>. This protein is predicted to be glycyl-tRNA synthetase beta subunit (glyS). Analysis of this protein sequence reveals the following:

```
Possible site: 14
>>> Seems to have no N-terminal signal sequence

----- Final Results -----
           bacterial cytoplasm --- Certainty = 0.1617 (Affirmative) < succ>
           bacterial membrane  --- Certainty = 0.0000 (Not Clear)   < succ>
           bacterial outside   --- Certainty = 0.0000 (Not Clear)   < succ>
```

The protein has homology with the following sequences in the GENPEPT database.

```
>GP: CAB73488 GB: AL139077 glycyl-tRNA synthetase beta chain
[Campylobacter jejuni]
Identities = 33/90 (36%), Positives = 49/90 (53%), Gaps = 2/90 (2%)

Query:   3 RAFNLAEKVTHSVLVDSSLFENNQEKALYQAILSLELTEDMHDNLDKLFALSPIINDFFD  62
           R  N+A K  H V  D SLF   E  LY+A       + + L+ LFAL P I++FF+
Sbjct: 570 RLANIATKNPHKV--DESLFVQEAESKLYKAFQEKTKANSLQEKLENLFALKPFIDEFFN 627

Query:  63 NTMVMTDDEKMKQNRLAILNSLVAKARTVA 92
           M+  +DEK+K NR A++  + A+   +A
Sbjct: 628 QVMINAEDEKLKNNRQALVYEIYAEFLKIA 657
```

There is also homology to SEQ ID 2836.

Based on this analysis, it was predicted that this protein and its epitopes, could be useful antigens for vaccines or diagnostics.

EXAMPLE 933

A DNA sequence (GBSx0989) was identified in *S. agalactiae* <SEQ ID 2837> which encodes the amino acid sequence <SEQ ID 2838>. Analysis of this protein sequence reveals the following:

```
Possible site: 30
>>> Seems to have no N-terminal signal sequence

----- Final Results -----
            bacterial cytoplasm --- Certainty = 0.4825 (Affirmative) < succ>
            bacterial membrane  --- Certainty = 0.0000 (Not Clear)   < succ>
             bacterial outside  --- Certainty = 0.0000 (Not Clear)   < succ>
```

The protein has homology with the following sequences in the GENPEPT database.

```
>GP: CAB13672 GB: Z99113 ynzC [Bacillus subtilis]
Identities = 41/72 (56%), Positives = 56/72 (76%)

Query:   5 KIARINELSKKKKTVGLTGEEKVEQAKLREEYIEGFRRSVRHHVEGIKLVDDEGNDVTPE  64
           KIARINEL+ K K   +T EEK EQ KLR+EY++GFR S+++ ++ +K++D EGNDVTPE
Sbjct:   6 KIARINELAAKAKAGVITEEEKAEQQKLRQEYLKGFRSSMKNTLKSVKIIDPEGNDVTPE  65

Query:  65 KLRQVQREKGLH                                                 76
           KL++ QR    LH
Sbjct:  66 KLKREQRNNKLH                                                 77
```

A related DNA sequence was identified in *S. pyogenes* <SEQ ID 2839> which encodes the amino acid sequence <SEQ ID 2840>. Analysis of this protein sequence reveals the following:

```
Possible site: 30
>>> Seems to have no N-terminal signal sequence
----- Final Results -----
            bacterial cytoplasm --- Certainty = 0.4303 (Affirmative) < succ>
            bacterial membrane  --- Certainty = 0.0000 (Not Clear)   < succ>
             bacterial outside  --- Certainty = 0.0000 (Not Clear)   < succ>
```

An alignment of the GAS and GBS proteins is shown below.

```
Identities = 79/85 (92%), Positives = 83/85 (96%)

Query:   1 MDPKKIARINELSKKKKTVGLTGEEKVEQAKLREEYIEGFRRSVRHHVEGIKLVDDEGND  60
           MDPKKIARINEL+KKKKTVGLTG EKVEQAKLREEYIEG+RRSVRHH+EGIKLVD+EGND
Sbjct:   1 MDPKKIARINELAKKKKTVGLTGPEKVEQAKLREEYIEGYRRSVRHHIEGIKLVDEEGND  60

Query:  61 VTPEKLRQVQREKGLHGRSLDDPNS                                    85
           VTPEKLRQVQREKGLHGRSLDDP S
Sbjct:  61 VTPEKLRQVQREKGLHGRSLDDPKS                                    85
```

Based on this analysis, it was predicted that these proteins and their epitopes could be useful antigens for vaccines or diagnostics.

EXAMPLE 934

A DNA sequence (GBSx0990) was identified in *S. agalactiae* <SEQ ID 2841> which encodes the amino acid sequence <SEQ ID 2842>. Analysis of this protein sequence reveals the following:

Possible site: 20
>>> Seems to have no N-terminal signal sequence

----- Final Results -----
            bacterial cytoplasm --- Certainty = 0.2343 (Affirmative) < succ>
             bacterial membrane --- Certainty = 0.0000 (Not Clear)  < succ>
               bacterial outside --- Certainty = 0.0000 (Not Clear)  < succ>

The protein has homology with the following sequences in the GENPEPT database.

>GP: AAB69985 GB: U94355 glycerol kinase [*Enterococcus casseliflavus*]
Identities = 381/496 (76%), Positives = 439/496 (87%)

```
Query:   3 SEEKYIMAIDQGTTSSRAIIFNKKGEKIASSQKEFPQIFPQAGWVEHNANQIWNSVQSVI    62
           +E+ Y+MAIDQGTTSSRAIIF++ G+KI SSQKEFPQ FP++GWVEHNAN+IWNSVQSVI
Sbjct:   2 AEKNYVMAIDQGTTSSRAIIFDRNGKKIGSSQKEFPQYFPKSGWVEHNANEIWNSVQSVI    61

Query:  63 AGAFIESSIKPGQIEAIGITNQRETTVVWDKKTGLPIYNAIVWQSRQTAPIADQLKQEGH   122
             AGAFIES I+P   I  IGITNQRETTVVWDK TG PI NAIVWQSRQ++PIADQLK +GH
Sbjct:  62 AGAFIESGIRPEAIAGIGITNQRETTVVWDKTTGQPIANAIVWQSRQSSPIADQLKVDGH   121

Query: 123 TNMIHEKTGLVIDAYFSATKVRWILDHVPGAQERAEKGELLFGTIDTWLVWKLTDGLVHV   182
            T MIHEKTGLVIDAYFSATKVRW+LD++ GAQE+A+ GELLFGTID+WLVWKLTDG VHV
Sbjct: 122 TEMIHEKTGLVIDAYFSATKVRWLLDNIEGAQEKADNGELLFGTIDSWLVWKLTDGQVHV   181

Query: 183 TDYSNAARTMLYNIKELKWDDEILELLNIPKAMLPEVKSNSEVYGKTTPFHFYGGEVPIS   242
            TDYSNA+RTMLYNI +L+WD EIL+LLNIP +MLPEVKSNSEVYG T   +HFYG EVPI+
Sbjct: 182 TDYSNASRTMLYNIHKLEWDQEILDLLNIPSSMLPEVKSNSEVYGHTRSYHFYGSEVPIA   241

Query: 243 GMAGDQQAALFGQLAFEPGMVKNTYGTGSFIIMNTGEEMQLSQNNLLTTIGYGINGKVHY   302
            GMAGDQQAALFGQ+AFE GM+KNTYGTG+FI+MNTGEE QLS N+LLTTIGYGINGKV+Y
Sbjct: 242 GMAGDQQAALFGQMAFEKGMIKNTYGTGAFIVMNTGEEPQLSDNDLLTTIGYGINGKVYY   301

Query: 303 ALEGSIFIAGSAIQWLRDGLRMIETSSESEGLAQSSTSDDEVYVVPAFTGLGAPYWDSNA   362
            ALEGSIF+AGSAIQWLRDGLRMIETS +SE LA  +   D+EVYVVPAFTGLGAPYWDS A
Sbjct: 302 ALEGSIFVAGSAIQWLRDGLRMIETSPQSEELAAKAKGDNEVYVVPAFTGLGAPYWDSEA   361

Query: 363 RGSVFGLTRGTSKEDFVKATLQSIAYQVRDVIDTMQVDSGIDIQQLRVDGGAAMNNLLMQ   422
            RG+VFGLTRGT+KEDFV+ATLQ++AYQ +DVIDTM+ DSGIDI   L+VDGGAA N+LLMQ
Sbjct: 362 RGAVFGLTRGTTKEDFVRATLQAVAYQSKDVIDTMKKDSGIDIPLLKVDGGAAKNDLLMQ   421

Query: 423 FQADILGIDIARAKNLETTALGAAFLAGLSVGYWESMDELKELNATGQLFQATMNESRKE   482
            FQADIL ID+ RA NLETTALGAA+LAGL+VG+W+ +DELK +    GQ+F   M     ++
Sbjct: 422 FQADILDIDVQRAANLETTALGAAYLAGLAVGFWKDLDELKSMAEEGQMFTPEMPAEERD   481

Query: 483 KLYKGWRKAVKATQVF                                              498
            LY+GW++AV ATQ F
Sbjct: 482 NLYEGWKQAVAATQTF                                              497
```

A related DNA sequence was identified in *S. pyogenes* <SEQ ID 2843> which encodes the amino acid sequence <SEQ ID 2844>. Analysis of this protein sequence reveals the following:

Possible site: 19
>>> Seems to have no N-terminal signal sequence

----- Final Results -----
            bacterial cytoplasm --- Certainty = 0.2282 (Affirmative) < succ>
             bacterial membrane --- Certainty = 0.0000 (Not Clear)  < succ>
               bacterial outside --- Certainty = 0.0000 (Not Clear)  < succ>

An alignment of the GAS and GBS proteins is shown below.

Identities = 464/500 (92%), Positives = 484/500 (96%)

```
Query:   3 SEEKYIMAIDQGTTSSRAIIFNKKGEKIASSQKEFPQIFPQAGWVEHNANQIWNSVQSVI    62
           S+EKYIMAIDQGTTSSRAIIFN+KGEK++SSQKEFPQIFP AGWVEHNANQIWNSVQSVI
Sbjct:   2 SQEKYIMAIDQGTTSSRAIIFNQKGEKVSSSQKEFPQIFPHAGWVEHNANQIWNSVQSVI    61

Query:  63 AGAFIESSIKPGQIEAIGITNQRETTVVWDKKTGLPIYNAIVWQSRQTAPIADQLKQEGH   122
```

-continued

```
          AGAFIESSIKP QIEAIGITNQRETTVVWDKKTG+PIYNAIVWQSRQTAPIA+QLKQ+GH
Sbjct:  62 AGAFIESSIKPSQIEAIGITNQRETTVVWDKKTGVPIYNAIVWQSRQTAPIAEQLKQDGH 121

Query: 123 TNMIHEKTGLVIDAYFSATKVRWILDHVPGAQERAEKGELLFGTIDTWLVWKLTDGLVHV 182
           T MIHEKTGLVIDAYFSATK+RWILDHVPGAQERAEKGELLFGTIDTWLVWKLTDG VHV
Sbjct: 122 TKMIHEKTGLVIDAYFSATKIRWILDHVPGAQERAEKGELLFGTIDTWLVWKLTDGAVHV 181

Query: 183 TDYSNAARTMLYNIKELKWDDEILELLNIPKAMLPEVKSNSEVYGKTTPFHFYGGEVPIS 242
           TDYSNAARTMLYNIK+L WDDEILELLNIPK MLPEVKSNSE+YGKT  FHFYGGEVPIS
Sbjct: 182 TDYSNAARTMLYNIKDLTWDDEILELLNIPKDMLPEVKSNSEIYGKTAAFHFYGGEVPIS 241

Query: 243 GMAGQQAALFGQLAFEPGMVKNTYGTGSFIIMNTGEEMQLSQNNLLTTIGYGINGKVHY  302
           GMAGDQQAALFGQLAFEPGMVKNTYGTGSFIIMNTG+EMQLS NNLLTTIGYGINGKVHY
Sbjct: 242 GMAGDQQAALFGQLAFEPGMVKNTYGTGSFIIMNTGDEMQLSSNNLLTTIGYGINGKVHY 301

Query: 303 ALEGSIFIAGSAIQWLRDGLRMIETSSESEGLAQSSTSDDEVYVVPAFTGLGAPYWDSNA 362
           ALEGSIFIAGSAIQWLRDGL+MIETS ESE  A +STSDDEVYVVPAFTGLGAPYWDSNA
Sbjct: 302 ALEGSIFIAGSAIQWLRDGLKMIETSPESEQFALASTSDDEVYVVPAFTGLGAPYWDSNA 361

Query: 363 RGSVFGLTRGTSKEDFVKATLQSIAYQVRDVIDTMQVDSGIDIQQLRVDGGAAMNNLLMQ 422
           RGSVFGLTRGTSKEDFVKATLQSIAYQVRDVIDTMQVDSGIDIQQLRVDGGAAMNN+LMQ
Sbjct: 362 RGSVFGLTRGTSKEDFVKATLQSIAYQVRDVIDTMQVDSGIDIQQLRVDGGAAMNNMLMQ 421

Query: 423 FQADILGIDIARAKNLETTALGAAFLAGLSVGYWESMDELKELNATGQLFQATMNESRKE 482
           FQADILGIDIARAKNLETTALGAAFLAGL+VGYWE MD LKELNATGQLF+A+MNESRKE
Sbjct: 422 FQADILGIDIARAKNLETTALGAAFLAGLAVGYWEDMDALKELNATGQLFKASMNESRKE 481

Query: 483 KLYKGWRKAVKATQVFAQED                                         502
           KLYKGW++AVKATQVF QE+
Sbjct: 482 KLYKGWKRAVKATQVFTQEE                                         501
```

Based on this analysis, it was predicted that these proteins and their epitopes could be useful antigens for vaccines or diagnostics.

EXAMPLE 935

A DNA sequence (GBSx0992) was identified in *S. agalactiae* <SEQ ID 2845> which encodes the amino acid sequence <SEQ ID 2846>. Analysis of this protein sequence reveals the following:

```
Possible site: 14
>>> Seems to have no N-terminal signal sequence

----- Final Results -----
           bacterial cytoplasm --- Certainty = 0.3146 (Affirmative) < succ>
           bacterial membrane  --- Certainty = 0.0000 (Not Clear)   < succ>
            bacterial outside  --- Certainty = 0.0000 (Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 936

A DNA sequence (GBSx0993) was identified in *S. agalactiae* <SEQ ID 2847> which encodes the amino acid sequence <SEQ ID 2848>. This protein is predicted to be alpha-glycerophosphate oxidase (glpD). Analysis of this protein sequence reveals the following:

```
Possible site: 40
>>> Seems to have no N-terminal signal sequence
INTEGRAL Likelihood = -1.81 Transmembrane 20-36 (20-36)
```

-continued
```
----- Final Results -----
            bacterial membrane --- Certainty = 0.1723 (Affirmative) < succ>
            bacterial outside  --- Certainty = 0.0000 (Not Clear)  < succ>
           bacterial cytoplasm --- Certainty = 0.0000 (Not Clear)  < succ>
```

The protein has homology with the following sequences in the GENPEPT database.

```
>GP: AAC34740 GB: U94770 alpha-glycerophosphate oxidase [Streptococcus
pneumoniae]
Identities = 464/608 (76%), Positives = 539/608 (88%)

Query:   1 MEFSRETRRLALQRMQDRTLDLLIIGGGITGAGVALQAAASGLDTGLIEMQDFAEGTSSR   60
           MEFS++TR L++++MQ+RTLDLLIIGGGITGAGVALQAAASGL+TGLIEMQDFAEGTSSR
Sbjct:   1 MEFSKKTRELSIKKMQERTLDLLIIGGGITGAGVALQAAASGLETGLIEMQDFAEGTSSR   60

Query:  61 STKLVHGGLRYLKQFDVEVVSDTVSERAVVQQIAPHIPKPDPMLLPVYDEPGSTFSMFRL  120
           STKLVHGGLRYLKQFDVEVVSDTVSERAVVQQIAPHIPKPDPMLLPVYDE G+TFS+FRL
Sbjct:  61 STKLVHGGLRYLKQFDVEVVSDTVSERAVVQQIAPHIPKPDPMLLPVYDEDGATFSLFRL  120

Query: 121 KVAMDLYDLLAGVTNTPAANKVLSAEDVLKREPDLQKEGLLGGGVYLDFRNNDARLVIEN  180
           KVAMDLYDLLAGV+NTP ANKVLS + VL+R+P+L+KEGL+GGGVYLDFRNNDARLVIEN
Sbjct: 121 KVAMDLYDLLAGVSNTPTANKVLSKDQVLERQPNLKKEGLVGGGVYLDFRNNDARLVIEN  180

Query: 181 IKRANRDGAYIASHVKAEDFLFDDNNQIIGVRARDLLTDQVIDIKARLVINTTGPWSDTV  240
           IKRAN+DGA IA+HVKAE FLFD++ +I GV ARDLLTDQV +IKARLVINTTGPWSD V
Sbjct: 181 IKRANQDGALIANHVKAEGFLFDESGKITGVVARDLLTDQVFEIKARLVINTTGPWSDKV  240

Query: 241 RNFSNEGKQIHQLRPTKGVHLVVDRQKLNISQPVYVDTGLNDGRMIFVLPREDKTYFGTT  300
           RN SN+G Q Q+RPTKGVHLVVD K+ +SQPVY DTGL DGRM+FVLPRE+KTYFGTT
Sbjct: 241 RNLSNKGTQFSQMRPTKGVHLVVDSSKIKVSQPVYFDTGLGDGRMVFVLPRENKTYFGTT  300

Query: 301 DTDYHGDLEHPTVTKEDVDYLLNIVNKRFPEAELTIDDIESSWAGLRPLLSGNSASDYNG  360
           DTDY GDLEHP VT+EDVDYLL IVN RFPE+ +TIDDIESSWAGLRPL++GNSASDYNG
Sbjct: 301 DTDYTGDLEHPKVTQEDVDYLLGIVNNRFPESNITIDDIESSWAGLRPLIAGNSASDYNG  360

Query: 361 GNSGKLSDESFEELIDSVKDYIAHKNHREDVEKAISHVESSTSEKELDPSAVSRGSSFER  420
           GN+G +SDESF+ LI +V+ Y++ +   REDVE A+S +ESSTSEK LDPSAVSRGSS +R
Sbjct: 361 GNNGTISDESFDNLIATVESYLSKEKTREDVESAVSKLESSTSEKHLDPSAVSRGSSLDR  420

Query: 421 DDNGLLTLAGGKITDYRKMAEGAMETIINILDKEYNRKFKLINSKTYPVSGGEINPSNVD  480
           DDNGLLTLAGGKITDYRKMAEGAME +++IL  E++R FKLINSKTYPVSGGE+NP+NVD
Sbjct: 421 DDNGLLTLAGGKITDYRKMAEGAMERVVDILKAEFDRSFKLINSKTYPVSGGELNPANVD  480

Query: 481 SEIEAYAQLGTLSGLSIEDARYIANLYGSNAPKLFALTRQITEAEGLSLVETLSLHYAMD  540
           SEIEA+AQLG   GL ++A Y+ANLYGSNAPK+FAL   + +A GLSL +TLSLHYAM
Sbjct: 481 SEIEAFAQLGVSRGLDSKEAHYLANLYGSNAPKVFALAHSLEQAPGLSLADTLSLHYAMR  540

Query: 541 YEMALSPTDFFLRRTNHMLFMRDNLDSLIQPVIDEMAKHYQWSDQDKTFYEEELHETLKD  600
           E+ALSP DF LRRTNHMLFMRD+LDS+++PV+DEM + Y W++++K  Y  ++   L +
Sbjct: 541 NELALSPVDFLLRRTNHMLFMRDSLDSIVEPVLDEMGRFYDWTEEEKATYRADVEAALAN  600

Query: 601 NDLAALKD                                                      608
           NDLA LK+
Sbjct: 601 NDLAELKN                                                      608
```

There is also homology to SEQ ID 128.

Figure 7:
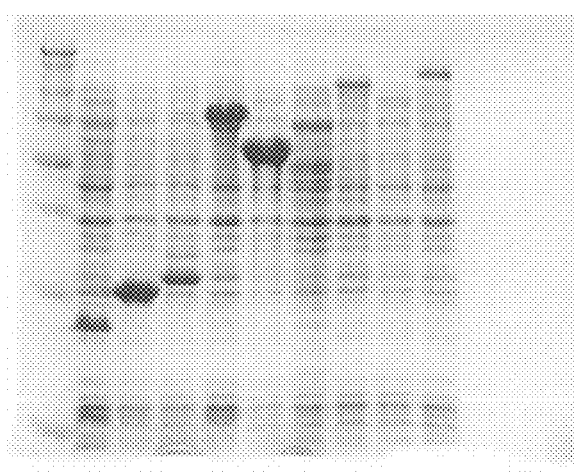

SEQ ID 2848 (GBS93) was expressed in *E. coli* as a His-fusion product. SDS-PAGE analysis of total cell extract is shown in FIG. 7 (lane 7; MW 70.6 kDa).

GBS93-His was purified as shown in FIG. 192, lane 4.

Based on this analysis, it was predicted that this protein and its epitopes, could be useful antigens for vaccines or diagnostics.

EXAMPLE 937

A DNA sequence (GBSx0994) was identified in *S. agalactiae* <SEQ ID 2849> which encodes the amino acid sequence <SEQ ID 2850>. Analysis of this protein sequence reveals the following:

```
         Possible site: 23
         >>> Seems to have no N-terminal signal sequence ----- Final Results -----
                    bacterial cytoplasm --- Certainty = 0.0965 (Affirmative) < succ>
                    bacterial membrane  --- Certainty = 0.0000 (Not Clear)  < succ>
                    bacterial outside   --- Certainty = 0.0000 (Not Clear)  < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 938

A DNA sequence (GBSx0995) was identified in *S. agalactiae* <SEQ ID 2851> which encodes the amino acid sequence <SEQ ID 2852>. This protein is predicted to be glycerol uptake facilitator protein (glpF). Analysis of this protein sequence reveals the following:

```
Possible Site: 55
>>> Seems to have a cleavable N-term signal seq.
INTEGRAL Likelihood =  -7.43 Transmembrane 220-236  (216-236)
INTEGRAL Likelihood =  -6.48 Transmembrane 139-155  (136-158)
INTEGRAL Likelihood =  -3.88 Transmembrane  87-103  (83-107)
INTEGRAL Likelihood =  -3.03 Transmembrane 164-180  (162-183)

----- Final Results -----
            bacterial membrane --- Certainty = 0.3972 (Affirmative) < succ>
             bacterial outside --- Certainty = 0.0000 (Not Clear)   < succ>
           bacterial cytoplasm --- Certainty = 0.0000 (Not Clear)   < succ>
```

A related GBS nucleic acid sequence <SEQ ID 8689> which encodes amino acid sequence <SEQ ID 8690> was also identified. Analysis of this protein sequence reveals the following:

```
Lipop: Possible site: -1 Crend: 5
SRCFLG: 0
McG: Length of UR: 21
Peak Value of UR: 2.51
Net Charge of CR: -2
McG: Discrim Score: 4.43
GvH: Signal Score (-7.5): -0.139999
Possible site: 50
>>> Seems to have a cleavable N-term signal seq.
Amino Acid Composition: calculated from 51
ALOM program count: 4 value: -7.43 threshold: 0.0
INTEGRAL      Likelihood =  -7.43 Transmembrane 215-231  (211-231)
INTEGRAL      Likelihood =  -6.48 Transmembrane 134-150  (131-153)
INTEGRAL      Likelihood =  -3.88 Transmembrane  82-98   (78-102)
INTEGRAL      Likelihood =  -3.03 Transmembrane 159-175  (157-178)
PERIPHERAL    Likelihood =   4.98 65
modified ALOM score: 1.99
icm1 HYPID: 7 CFP: 0.397

*** Reasoning Step: 3

----- Final Results -----
            bacterial membrane --- Certainty = 0.3972 (Affirmative) < succ>
             bacterial outside --- Certainty = 0.0000 (Not Clear)   < succ>
           bacterial cytoplasm --- Certainty = 0.0000 (Not Clear)   < succ>
```

The protein has homology with the following sequences in the GENPEPT database.

```
>GP: AAA91618 GB: U12567 glycerol uptake facilitator
[Streptococcus pneumoniae]
Identities = 150/230 (65%), Positives = 194/230 (84%), Gaps 1/230 (0%)

Query:   7 DIFGEFLGTALLVLLGNGVVAGVVLPKTKNHNSGWIVITFGWGLAVAIAALVSGNISPAH    66
           ++FGEFLGT +L+LLGNGVVAGVVLPKTK+++SGWIVIT   G+AVA+A  VSG +SPAH
Sbjct:   4 ELFGEFLGTLILILLGNGVVAGVVLPKTKSNSSGWIVITMV-GIAVAVAVFVSGKLSPAH    62

Query:  67 LNPAVSLAFAIKGDLAWGTAILYMIAQIIGAMLGSLLVYLQFRPHYEAAENRADILGTFA   126
           LNPAV++   A+KG L W + +  Y++AQ   GAMLG +LV+LQF+PHYEA EN   +IL TF+
```

-continued

```
Sbjct:   63 LNPAVTIGVALKGGLPWASVLPYILAQFAGAMLGQILVWLQFKPHYEAEENAGNILATFS  122

Query:  127 TGPALKDNFSNFLSEVLGTLVLVLTIFAIGKYNMPPGVGTMSVGMLVVGIGLSLGGTTGY  186
            TGPA+KD  SN +SE+LGT VLVLTIFA+G Y+   G+GT +VG L+VGIGLSLGGTTGY
Sbjct:  123 TGPAIKDTVSNLISEILGTFVLVLTIFALGLYDFQAGIGTFAVGTLIVGIGLSLGGTTGY  182

Query:  187 AINPARDFGPRLLHALLPMKNKGDSDWTYSWIPIVGPMVGAILAALIFAM            236
            A+NPARD GPR++H++LP+ NKGD DW+Y+WIP+VGP++GA LA L+F++
Sbjct:  183 ALNPARDLGPRIMHSILPIPNKGDGDWSYAWIPVVGPVIGAALAVLVFSL            232
```

A related DNA sequence was identified in *S. pyogenes* <SEQ ID 2853> which encodes the amino acid sequence <SEQ ID 2854>. Analysis of this protein sequence reveals the following:

```
Possible site: 50
>>> Seems to have a cleavable N-term signal seq.
INTEGRAL Likelihood = -9.13 Transmembrane 213-229 (209-232)
INTEGRAL Likelihood = -5.52 Transmembrane 137-153 (132-157)
INTEGRAL Likelihood = -4.35 Transmembrane 159-175 (155-178)
INTEGRAL Likelihood = -1.17 Transmembrane  85-101  (85-101)

----- Final Results -----
              bacterial membrane --- Certainty = 0.4652 (Affirmative) < succ>
               bacterial outside --- Certainty = 0.0000 (Not Clear)   < succ>
              bacterial cytoplasm --- Certainty = 0.0000 (Not Clear)   < succ>
```

The protein has homology with the following sequences in the databases:

```
>GP: AAA91618 GB: U12567 glycerol uptake facilitator
[Streptococcus pneumoniae]
Identities = 159/230 (69%), Positives = 196/230 (85%), Gaps = 1/230 (0%)

Query:    2 DIFGEFLGTALLVLLGNGVVAGVVLPKTKTHASGWIVIATGWGIAVAVAVFISGKVAPAH   61
            ++FGEFLGT +L+LLGNGVVAGVVLPKTK+++SGWIVI T  GIAVAVAVF+SGK++PAH
Sbjct:    4 ELFGEFLGTLILILLGNGVVAGVVLPKTKSNSSGWIVI-TMVGIAVAVAVFVSGKLSPAH   62

Query:   62 LNPAVSLAFAMSGTIAWSTAIAYSLAQLLGAMVGSTLVFLQFRPHYLAAESQADILGTFA  121
            LNPAV++  A+ G + + W++ + Y LAQ  GAM+G  LV+LQF+PHY A E+  +IL TF+
Sbjct:   63 LNPAVTIGVALKGGLPWASVLPYILAQFAGAMLGQILVWLQFKPHYEAEENAGNILATFS  122

Query:  122 TGPAIRDTSSNLLSEIFGTFVLMLGILAFGLYDMPAGLGTLCVGTLVIGIGLSLGGTTGY  181
            TGPAI+DT SNL+SEI GTFVL+L I A GLYD  AG+GT  VGTL++GIGLSLGGTTGY
Sbjct:  123 TGPAIKDTVSNLISEILGTFVLVLTIFALGLYDFQAGIGTFAVGTLIVGIGLSLGGTTGY  182

Query:  182 AINPARDLGPRLVHAILPLNNKGDSDWSYAWIPVVGPIIGAVLAVLLFQV            231
            A+NPARDLGPR++H+ILP+ NKGD DWSYAWIPVVGP+IGA LAVL+F +
Sbjct:  183 ALNPARDLGPRIMHSILPIPNKGDGDWSYAWIPVVGPVIGAALAVLVFSL            232
```

An alignment of the GAS and GBS proteins is shown below.

```
Identities = 169/232 (72%), Positives = 202/232 (86%)

Query:    6 MDIFGEFLGTALLVLLGNGVVAGVVLPKTKNHNSGWIVITFGWGLAVAIAALVSGNISPA   65
            MDIFGEFLGTALLVLLGNGVVAGVVLPKTK H SGWIVI  GWG+AVA+A  +SG ++PA
Sbjct:    1 MDIFGEFLGTALLVLLGNGVVAGVVLPKTKTHASGWIVIATGWGIAVAVAVFISGKVAPA   60

Query:   66 HLNPAVSLAFAIKGDLAWGTAILYMIAQIIGAMLGSLLVYLQFRPHYEAAENRADILGTF  125
            HLNPAVSLAFA+ G +AW TAI Y +AQ++GAM+GS LV+LQFRPHY AAE++ADILGTF
Sbjct:   61 HLNPAVSLAFAMSGTIAWSTAIAYSLAQLLGAMVGSTLVFLQFRPHYLAAESQADILGTF  120

Query:  126 ATGPALKDNFSNFLSEVLGTLVLVLTIFAIGKYNMPPGVGTMSVGMLVVGIGLSLGGTTG  185
            ATGPA++D  SN LSE+ GT VL+L I A G Y+MP G+GT+ VG LV+GIGLSLGGTTG
Sbjct:  121 ATGPAIRDTSSNLLSEIFGTFVLMLGILAFGLYDMPAGLGTLCVGTLVIGIGLSLGGTTG  180

Query:  186 YAINPARDFGPRLLHALLPMKNKGDSDWTYSWIPIVGPMVGAILAALIFAMM          237
            YAINPARD GPRL+HA+LP+ NKGDSDW+Y+WIP+VGP++GA+LA L+F +M
Sbjct:  181 YAINPARDLGPRLVHAILPLNNKGDSDWSYAWIPVVGPIIGAVLAVLLFQVM          232
```

Based on this analysis, it was predicted that these proteins and their epitopes could be useful antigens for vaccines or diagnostics.

EXAMPLE 939

A DNA sequence (GBSx0996) was identified in S. agalactiae <SEQ ID 2855> which encodes the amino acid sequence <SEQ ID 2856>. This protein is predicted to be NADH oxidase. Analysis of this protein sequence reveals the following:

```
Possible site: 23
>>> Seems to have a cleavable N-term signal seq.
INTEGRAL Likelihood = -2.87 Transmembrane 152-168 (152-168)

----- Final Results -----
            bacterial membrane --- Certainty = 0.2147 (Affirmative) < succ>
             bacterial outside --- Certainty = 0.0000 (Not Clear) < succ>
            bacterial cytoplasm --- Certainty = 0.0000 (Not Clear) < succ>
```

A related GBS nucleic acid sequence <SEQ ID 9523> which encodes amino acid sequence <SEQ ID 9524> was also identified.

The protein has homology with the following sequences in the GENPEPT database.

```
>GP: CAA48728 GB: X68847 NADH oxidase [Enterococcus faecalis]
Identities = 105/423 (24%), Positives = 197/423 (45%), Gaps = 15/423 (3%)

Query:   10 IVILGASFAGMTCAQKLRQLNPNWDIVLIDKEIHPDYVPNGLNWYYRHEISGLNQAMWQT    69
            +V++G + AG +  + +    +P  ++ + ++   +  ++   G+  Y    +        +
Sbjct:    3 VVVVGCTHAGTSAVKSILANHPEAEVTVYERNDNISFLSCGIALYVGGVVKNAADLFYSN    62

Query:   70 EEEQRLQNIRCLFGLKVEKINKEDR-----ELMLSDGSSVYYDQLICAMGSQAESTYIDG   124
            EE              VE+IN +D+        L      +V YD+L+    GS       I G
Sbjct:   63 PEELASLGATVKMEHNVEEINVDDKTVTAKNLQTGATETVSYDKLVMTTGSWPIIPPIPG   122

Query:  125 ADAQGVLTTKTYATSQNAKQVLDKSHKVAVVGAGIIGLDIAYSLHESGKAVTLLEAQERP   184
               DA+ +L   K Y+ +    +    + +V VVG G  IG+++    +   ESGK  VTL++    +R
Sbjct:  123 IDAENILLCKNYSQANVIIEKAKDAKRVVVVGGGYIGIELVEAFVESGKQVTLVDGLDRI   182

Query:  185 DFRHTDPDMSLPLLDAMAESKLHFFQNQKVEKITVTREEKLCLRTLTGDTFTVDAVILAV   244
            ++ D   +  L   + + ++     + V++       + K+            F   D VI+ V
Sbjct:  183 LNKYLDKPFTDVLEKELVDRGVNLALGENVQQFVADEQGKVAKVITPSQEFEADMVIMCV   242

Query:  245 NFRPDSRLLTGLVDLSVDNSVVVNDYFQTSDPNIYAIGDLIWSYFKGLNSAYYMPLINQA   304
               FRP++ LL      VD+  +  ++  VN+Y  QTS+P+I+A  GD        ++      +   Y+PL     A
Sbjct:  243 GFRPNTELLKDKVDMLPNGAIEVNEYMQTSNPDIFAAGDSAVVHYNPSQTKNYIPLATNA   302

Query:  305 IRSAQMLAYHLSGHAVPKLKITRATGSKHFGYYRANIGLT---------ELEAGFYEDTV   355
              +R    ++   +L+     +         +G   FG+       + G+T              ++EA    +ED
Sbjct:  303 VRQGMLVGRNLTEQKLAYRGTQGTSGLYLFGWKIGSTGVTKESAKLNGLDVEATVFEDNY   362

Query:  356 SVTYFPKEQYDLRIKLIANQKTGHLLGAQLISKENCLATANQLVQAISCDMTFDFLAFQD   415
                  + P   +    L  ++L+   + T    ++G QL+SK +      +AN   L A+       MT     DLA    D
Sbjct:  363 RPEFMPTTEKVL-MELVYEKGTQRIVGGQLMSKYDITQSANTLSLAVQNKMTVEDLAISD   421

Query:  416 FIY                                                            418
            F +
Sbjct:  422 FFF                                                            424
```

A related DNA sequence was identified in S. pyogenes <SEQ ID 2857> which encodes the amino acid sequence <SEQ ID 2858>. Analysis of this protein sequence reveals the following:

```
Possible site: 16
>>> Seems to have an uncleavable N-term signal seq
INTEGRAL Likelihood = -3.35 Transmembrane 155-171 (155-173)

----- Final Results -----
            bacterial membrane --- Certainty = 0.2338 (Affirmative) < succ>
             bacterial outside --- Certainty = 0.0000 (Not Clear) < succ>
```

-continued

```
                    bacterial cytoplasm --- Certainty = 0.0000 (Not Clear) < succ>
RGD motif: 54-56
```

The protein has homology with the following sequences in the databases:

```
>GP: CAA44611 GB: X62755 NADH peroxidase [Enterococcus faecalis]
Identities = 111/428 (25%), Positives = 202/428 (46%), Gaps = 24/428 (5%)

Query:    10 VIGASFAGLAFVDKYKDLNPDSQIILIDKESCPNYIPNGINQLFRGDIQDLSDAMWGRAC    69
             V+G+S  G   V++  +L+PD++I   +K    +++ G+       G ++D++      R
Sbjct:     5 VLGSSHGGYEAVEELLNLHPDAEIQWYEKGDFISFLSCGMQLYLEGKVKDVNSV---RYM    61

Query:    70 LAAQIESN--HRFIQAEVLAIEAPSNTLLLKDS-QGRVFEEGYETLVCAMGASPQSHYIE   126
                ++ES  + F   E+ AI+  + + +KD  G     E Y+L+ + GA P    I
Sbjct:    62 TGEKMESRGVNVFSNTEITAIQPKEHQVTVKDLVSGEERVENYDKLIISPGAVPFELDIP   121

Query:   127 TSQTNKVLVTKYYEESQASLKLIEASQE-----VLVIGAGLIGLDLAYSLSLQGKRVKLI   181
                + + + +     Q ++KL + + +      V+VIG+G IG++  A + +  GK+V +I
Sbjct:   122 GKDLDNIYLMR---GRQWAIKLKQKTVDPEVNNVVVIGSGYIGIEAAEAFAKAGKKVTVI   178

Query:   182 EAAERPDFYQTDAELIAPVMAEMSTHHVTFINNKRVTAIHEIEGKVVAHTEQGDTFQGDL   241
                + +RP     D E   + EM +++T   + V   +E +G+V       + + DL
Sbjct:   179 DILDRPLGVYLDKEFTDVLTEEMEANNITIATGETVER-YEGDGRVQKVVTDKNAYDADL   237

Query:   242 AILAINFRPNTHLLQGQVACALDKTILVNENLQTSQANIYAIGDMVSLHFGILGMDYYTP   301
                ++A+  RPNT L+G +    + I  +E ++TS+ +++A+GD  + +     +
Sbjct:   238 VVVAVGVRPNTAWLKGTLELHPNGLIKTDEYMRTSEPDVFAVGDATLIKYNPADTEVNIA   297

Query:   302 LINQAMKTGQALALHLAGYPIPPLQTVK-VLGSSHFDYYRASVGVTE-------EEAELY   353
                L   A K G+    +L    P+ P    V+    G + FDY  AS G+  E        +E +
Sbjct:   298 LATNARKQGRFAVKNLE-EPVKPFPGVQGSSGLAVFDYKFASTGINEVMAQKLGKETKAV   356

Query:   354 MDTCSYLYQNGDSKNLFWLKLIARKTDGILIGAQLLSKTNALVIANQLGQALALKVTDAD   413
                      YL       K   W KL+          ++GAQL+SK +     N +  A+    K+T  D
Sbjct:   357 TVVEDYLMDFNPDKQKAWFKLVYDPETTQILGAQLMSKADLTANINAISLAIQAKMTIED   416

Query:   414 LAFQDFLF                                                      421
                LA+ DF F
Sbjct:   417 LAYADFFF                                                      424
```

An alignment of the GAS and GBS proteins is shown below.

```
Identities = 192/440 (43%), Positives = 276/440 (62%), Gaps = 7/440 (1%)

Query:     8 KVIVILGASFAGMTCAQKLRQLNPNWDIVLIDKEIHPDYVPNGLNWYYRHEISGLNQAMW    67
             K I  ++GASFAG+   K + LNP+  I+LIDKE  P+Y+PNG+N  +R +I  L+ AMW
Sbjct:     6 KTIHVIGASFAGLAFVDKYKDLNPDSQIILIDKESCPNYIPNGINQLFRGDIQDLSDAMW    65

Query:    68 -QTEEEQRLQNIRCLFGLKVEKINKEDRELMLSDGSSVY----YDQLICAMGSQAESTYI   122
               +          ++++        +V I        L+L D          Y+ L+CAMG+  +S YI
Sbjct:    66 GRACLAAQIESNHRFIQAEVLAIEAPSNTLLLKDSQGRVFEEGYETLVCAMGASPQSHYI   125

Query:   123 DGADAQGVLTTKTYATSQNAKQVLDKSHKVAVVGAGIIGLDIAYSLHESGKAVTLLEAQE   182
             + +    VL TK Y  SQ + ++++  S +V V+GAG+IGLD+AYSL   GK V L+EA E
Sbjct:   126 ETSQTNKVLVTKYYEESQASLKLIEASQEVLVIGAGLIGLDLAYSLSLQGKRVKLIEAAE   185

Query:   183 RPDFRHTDPDMSLPLLDAMAESKLHFFQNQKVEKITVTREEKLCLRTLTGDTFTVDAVIL   242
             RPDF  TD ++  P++ M+   + F N++V I   E K+    T  GDTF  D  IL
Sbjct:   186 RPDFYQTDAELIAPVMAEMSTHHVTFINNKRVTAIHEI-EGKVVAHTEQGDTFQGDLAIL   244

Query:   243 AVNFRPDSRLLTGLVDLSVDNSVVVNDYFQTSDPNIYAIGDLIWSYFKGLNSAYYMPLIN   302
             A+NFRP++ LL G V  ++D +++VN+   QTS    NIYAIGD++  +F  L     YY PLIN
Sbjct:   245 AINFRPNTHLLQGQVACALDKTILVNENLQTSQANIYAIGDMVSLHFGILGMDYYTPLIN   304

Query:   303 QAIRSAQMLAYHLSGHAVPKLKITRATGSKHFGYYRANIGLTELEAGFYEDTVSVTYFPK   362
             QA+++  Q  LA HL+G+ +P L+    +   GS HF  YYRA++G+TE EA   Y DT S    Y
Sbjct:   305 QAMKTGQALALHLAGYPIPPLQTVKVLGSSHFDYYRASVGVTEEEAELYMDTCSYLYQNG   364

Query:   363 EQYDL-RIKLIANQKTGHLLGAQLISKENCLATANQLVQAISCDMTFDFDLAFQDFIYTAR   421
             + +L   +KLIA +  G L+GAQL+SK N L  ANQL QA++   +TD  DLAFQDF++
Sbjct:   365 DSKNLFWLKLIARKTDGILIGAQLLSKTNALVIANQLGQALALKVTDADLAFQDFLFLQG   424
```

-continued

```
Query:  422 ESEMAYMLHQAAINLYEKRI                                          441
            S++AY LH+A + L+EKR+
Sbjct:  425 HSDLAYHLHEACLKLFEKRL                                          444
```

There is also homology to SEQ IDs 1820, 1876, 4666.

Based on this analysis, it was predicted that these proteins and their epitopes could be useful antigens for vaccines or diagnostics.

EXAMPLE 940

A DNA sequence (GBSx0998) was identified in *S. agalactiae* <SEQ ID 2859> which encodes the amino acid sequence <SEQ ID 2860>. Analysis of this protein sequence reveals the following:

```
Possible site: 31
>>> Seems to have no N-terminal signal sequence

----- Final Results -----
        bacterial cytoplasm --- Certainty = 0.2980 (Affirmative) < succ>
         bacterial membrane --- Certainty = 0.0000 (Not Clear)   < succ>
          bacterial outside --- Certainty = 0.0000 (Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 941

A DNA sequence (GBSx0999) was identified in *S. agalactiae* <SEQ ID 2861> which encodes the amino acid sequence <SEQ ID 2862>. Analysis of this protein sequence reveals the following:

```
Possible site: 23
>>> Seems to have no N-terminal signal sequence

----- Final Results -----
        bacterial cytoplasm --- Certainty = 0.3548 (Affirmative) < succ>
         bacterial membrane --- Certainty = 0.0000 (Not Clear)   < succ>
          bacterial outside --- Certainty = 0.0000 (Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 942

A DNA sequence (GBSx1000) was identified in *S. agalactiae* <SEQ ID 2863> which encodes the amino acid sequence <SEQ ID 2864>. Analysis of this protein sequence reveals the following:

```
Possible site: 29
>>> Seems to have no N-terminal signal sequence
```

-continued
```
----- Final Results -----
            bacterial cytoplasm --- Certainty = 0.1685 (Affirmative) < succ>
            bacterial membrane  --- Certainty = 0.0000 (Not Clear)   < succ>
             bacterial outside  --- Certainty = 0.0000 (Not Clear)   < succ>
```

A related GBS nucleic acid sequence <SEQ ID 9525> which encodes amino acid sequence <SEQ ID 9526> was also identified.

The protein has no significant homology with any sequences in the GENPEPT database.

A related DNA sequence was identified in *S. pyogenes* <SEQ ID 2865> which encodes the amino acid sequence <SEQ ID 2866>. Analysis of this protein sequence reveals the following:

```
Possible site: 22
>>> Seems to have no N-terminal signal sequence

----- Final Results -----
            bacterial cytoplasm --- Certainty = 0.3125(Affirmative) < succ>
            bacterial membrane  --- Certainty = 0.0000(Not Clear)   < succ>
             bacterial outside  --- Certainty = 0.0000(Not Clear)   < succ>
```

An alignment of the GAS and GBS proteins is shown below.

```
Identities = 179/476 (37%), Positives = 279/476 (58%), Gaps = 5/476 (1%)

Query:    1 MRIEALMEKERRVQYRLLSFLRGSPQAIALKLALLETGLSRATFLKYINNLNSYFEQEKV   60
            M+IE LM+KERR QYRLL L + + + LK  +  + LS+ T LKYI+NLN    ++ +
Sbjct:   21 MKIEDLMDKERRAQYRLLVTLYHAKETLRLKDLMRLSNLSKVTLLKYIDNLNHLCREQGL   80

Query:   61 NCRIVYYKDKLFLEEDYNLSNQEVLKALMKDSIKYTILISLFNQRQFTIVGLSQELMVSE  120
            C+++ KD L L+E+   ++++ L+K+S+ Y IL ++   F I  LS ELMVSE
Sbjct:   81 ACQLLLEKDSLSLKENGQFHWEDLVALLLKESVAYQILTYMYCHEHFNITNLSVELMVSE  140

Query:  121 ATLNRHLAHLNELLAEFDIAISQGKQIGDELQWRYFYYELFKQLWSYDKCQNMIKKLDLD  180
            ATLNR LAHLN+LL+EFD+A+SQG+Q+G ELQWRYFY+ELF+  +    ++ +LD
Sbjct:  141 ATLNRQLAHLNQLLSEFDLALSQGRQLGSELQWRYFYFELFRHTLTRQGIDALVNQLDAS  200

Query:  181 SLILLIERLAQHTLTREAHQNLGLWFSICHHRLLAMEKISDNLKPIVKHYQCNAFYKRLD  240
            L   LIERL   +L+ EA + L +W +I   R+  +  +D+        N F+KRL+
Sbjct:  201 HLATLIERLIGQSLSAEALEQLLIWLAISQARMSFQKSYNDHFLRDSDFMTSNIFFKRLE  260

Query:  241 AALVLYMSRFALEYREGEVLATFAFLHSQNILPINTMEYIMGFGGPIIDCVTETIIYFKK  300
            + L+ Y+ R+ALE+    E  + F FLH+  +LPI +M+Y +GFGGPI D ++E +    KK
Sbjct:  261 SMLLHYLRRYALEFDAFEAKSLFVFLHAYPLLPIASMKYSLGFGFGPIADHISEALWLLKK  320

Query:  301 ESILADETSDQVIYQLGQLYSHYYFFKGHILVEQPDLEQTYRLIDHNMRDKLHHISKKII  360
            ++   +T +++IY LG  +S  YFFKG IL +  + +  Y+L+ + R  L I   ++
Sbjct:  321 AHVIIHQTKEEIIYGLGIFFSKAYFFKGAILSQPTNSQYLYQLVGEDKRALLRVIINHLV  380

Query:  361 ANVNRIRPLTEDGCSLLTLHLLELLIFSKNSQKMPFRIGLDMTGNAVEQSLLEYRIRQHF  420
            +++     D   L+  +L LLIFS      P +GL + N VE ++ E   IR+H
Sbjct:  381 LQMDQ----ETDFSQQLSDDILALLIFSIERHHEPLLVGLALGQNKVEAAIAELAIRRHL  436

Query:  421 SGNNSIQVEPYDEGKGFD-MVIYQSHSRPYKAKLTYCLNKGASERELQEIDSLIYD      475
                  Q+ PYD   K +D ++ YQ+   P +    Y L + +S  EL  +++ + D
Sbjct:  437 GHRRDFQLMPYDHQKVYDCLITYQTVCLPRQDLPYYRLKQYSSPYELTALEAFLKD      492
```

Based on this analysis, it was predicted that these proteins and their epitopes could be useful antigens for vaccines or diagnostics.

EXAMPLE 943

A DNA sequence (GBSx1001) was identified in *S. agalactiae* <SEQ ID 2867> which encodes the amino acid sequence <SEQ ID 2868>. This protein is predicted to be transketolase (tktA-1). Analysis of this protein sequence reveals the following:

```
Possible site: 27
>>> Seems to have no N-terminal signal sequence

----- Final Results -----
            bacterial cytoplasm --- Certainty = 0.2084(Affirmative) < succ>
             bacterial membrane --- Certainty = 0.0000(Not Clear)   < succ>
              bacterial outside --- Certainty = 0.0000(Not Clear)   < succ>
```

A related GBS nucleic acid sequence <SEQ ID 9527> which encodes amino acid sequence <SEQ ID 9528> was also identified.

The protein has homology with the following sequences in the GENPEPT database.

```
>GP: BAB06071 GB: AP001515 transketolase [Bacillus halodurans]
Identities = 403/661 (60%), Positives = 520/661 (77%), Gaps = 8/661 (1%)

Query:   6 IDQLAVNTVRTLSIDAIQAANSGHPGLPMGAAPMAYVLWNKFLNVNPKTSRNWTNRDRFV    65
           ++QLAVNT+RTLSID+++ ANSGHPG+PMGAAPMA+ LW KF+N NP  + +W NRDRFV
Sbjct:   5 VEQLAVNTIRTLSIDSVEKANSGHPGMPMGAAPMAFCLWTKFMNHNP-ANPDWVNRDRFV    63

Query:  66 LSAGHGSALLYSLLHLAGYDLSIDDLKQFRQWGSKTPGHPEVNHTDGVEATTGPLGQGIA   125
           LSAGHGS LLYSLLHL GYDLS+++L+ FRQWGSKTPGHPE  HT GVEATTGPLGQG+A
Sbjct:  64 LSAGHGSMLLYSLLHLTGYDLSLEELQNFRQWGSKTPGHPEYGHTPGVEATTGPLGQGVA   123

Query: 126 NAVGMAMAEAHLAAKFNKPGFDLVDHYTYTLHGDGCLMEGVSQEAASLAGHLKLGKLVLL   185
            AVGMAMAE HLAA +N+ G+++VDHYTYT+ GDG LMEGVS EAASLAGHLKLG+++LL
Sbjct: 124 MAVGMAMAERHLAATYNRDGYNIVDHYTYTICGDGDLMEGVSAEAASLAGHLKLGRMILL   183

Query: 186 YDSNDISLDGPTSQSFTEDVKGRFESYGWQHILVKDGNDLEAIAAAIEAAKAETDKPTII   245
           YDSNDISLDG   SF+E V+ RF++YGW  V+DGN+L+ IA AIE AKA+ ++P++I
Sbjct: 184 YDSNDISLDGDLHHSFSESVEDRFKAYGWHVVRVEDGNNLDEIAKAIEEAKAD-ERPSLI   242

Query: 246 EVKTIIGFGAEKQGTSSV-HGAPLGAEGITFAKKAYVWEYP-DFTVPAEVADRFASDLQA   303
           EVKT IGFG+  +G  SV HGAPLGA+ +   K+AY W Y  +F +P EVA  +    ++
Sbjct: 243 EVKTTIGFGSPNKGGKSVSHGAPLGADEVKLTKEAYEWTYENEFHIPEEVA-AYYEQVKQ   301

Query: 304 RGAKAEEAWNDLFAKYEVEYPELATEYKEAFAG---QAETVELKAHDLGSSVASRVSSQQ   360
           +GA+ EE+WN+LFA+Y+  YPELA++++ A  G   +      ++++G SVA+R SS +
Sbjct: 302 QGAEKEESWNELFAQYKKAYPELASQFELAVHGDLPEGWDAVAPSYEVGKSVATRSSSGE   361

Query: 361 AIQQLSTQLPNLWGGSADLSASNNTMVAAETDFQASNYAGRNIWFGVREFAMAAAMNGIA   420
           A+   + +P L+GGSADL++SN T++  E +F   +Y+GRN+WFGVREFAM AAMNG+A
Sbjct: 362 ALNAFAKTVPQLFGGSADLASSNKTLIKGEANFSRDDYSGRNVWFGVREFAMGAAMNGMA   421

Query: 421 LHGGTRVYGGTFFVFSNYLLPAVRMAALQNLPTVYVMTHDSIAVGEDGPTHEPIEQLASV   480
           LHGG +V+G TFFVFS+YL PA+R+AAL  LP +YV THDSIAVGEDGPTHEP+EQLAS+
Sbjct: 422 LHGGLKVFGATFFVFSDYLRPAIRLAALMQLPVIYVFTHDSIAVGEDGPTHEPVEQLASL   481

Query: 481 RSMPNLNVIRPADGNETNAAWQRAVSETDRPTMLVLTRQNLPVLEGTSELAQEGVNKGAY   540
           R+MP L+VIRPADGNE+ AAW+ A+    D+PT LVL+RQNLP LEG + A +GV+KGAY
Sbjct: 482 RAMPGLSVIRPADGNESVAAWKLALESKDQPTALVLSRQNLPTLEGAVDRAYDGVSKGAY   541

Query: 541 ILSEAKGELDGIIIATGSEVKLALDTQDKLESEGIHVRVVSMPAQNIFDEQEASYQEQVL   600
           +L+ A G  D  +++A+GSEV LA++ ++ LE EGIH  VVSMP+ + F+ Q A Y+E+VL
Sbjct: 542 VLAPANGSADLLLLASGSEVSLAVNAKEALEKEGIHAAVVSMPSWDRFEAQSAEYKEEVL   601

Query: 601 PSAVTKRLAIEAGSSFGWGKYVGLNGLTLTIDTWGASAPGNRIFEEYGFTVENAVSLYKEL   661
           PS VT RLAIE GSS GW KYVG  G  + ID +GASAPG RI EE+GFTV++ V+  K L
Sbjct: 602 PSDVTARLAIEMGSSLGWAKYVGNQGDVVAIDRFGASAPGERIMEEFGFTVQHVVARAKAL   662
```

There is also homology to SEQ ID 520.

Based on this analysis, it was predicted that these proteins and their epitopes could be useful antigens for vaccines or diagnostics.

EXAMPLE 944

A DNA sequence (GBSx1002) was identified in *S. agalactiae* <SEQ ID 2869> which encodes the amino acid sequence <SEQ ID 2870>. Analysis of this protein sequence reveals the following:

```
Possible site: 39
>>> Seems to have no N-terminal signal sequence

----- Final Results -----
            bacterial cytoplasm --- Certainty = 0.4477(Affirmative) < succ>
             bacterial membrane --- Certainty = 0.0000(Not Clear)  < succ>
              bacterial outside --- Certainty = 0.0000(Not Clear)  < succ>
```

A related GBS nucleic acid sequence <SEQ ID 9529> which encodes amino acid sequence <SEQ ID 9530> was also identified.

The protein has no significant homology with any sequences in the GENPEPT database.

A related DNA sequence was identified in *S. pyogenes* <SEQ ID 2871> which encodes the amino acid sequence <SEQ ID 2872>. Analysis of this protein sequence reveals the following:

```
Possible site: 42
>>> Seems to have no N-terminal signal sequence

----- Final Results -----
            bacterial cytoplasm --- Certainty = 0.4581(Affirmative) < succ>
             bacterial membrane --- Certainty = 0.0000(Not Clear)  < succ>
              bacterial outside --- Certainty = 0.0000(Not Clear)  < succ>
```

An alignment of the GAS and GBS proteins is shown below.

```
Identities = 27/79 (34%), Positives = 45/79 (56%)

Query:   3 MKKECRDFYRQIQHTYNDISVREDAVLSSILLSASNGLIKTSDVPRVAYELTQQLENNEI  62
           M+K+ +  Y I+ Y+    RE+  LS +LL+ASN LIK S+   VAY+L Q ++N +
Sbjct:   1 MEKKRQRLYDVIRQAYDYPENRENVALSQLLLAASNRLIKHSNPLLVAYQLNQDVDNYLL  60

Query:  63 EKSFESLATVKELKKSAKK                                           81
            +       ++   K+S +K
Sbjct:  61 DNDILLPKSLCRFKQSLEK                                           79
```

Based on this analysis, it was predicted that these proteins and their epitopes could be useful antigens for vaccines or diagnostics.

EXAMPLE 945

A DNA sequence (GBSx1003) was identified in *S. agalactiae* <SEQ ID 2873> which encodes the amino acid sequence <SEQ ID 2874>. This protein is predicted to be ABC transporter, ATP-binding protein. Analysis of this protein sequence reveals the following:

```
Possible site: 56
>>> Seems to have no N-terminal signal sequence

----- Final Results -----
            bacterial cytoplasm --- Certainty = 0.2610(Affirmative) < succ>
             bacterial membrane --- Certainty = 0.0000(Not Clear)  < succ>
              bacterial outside --- Certainty = 0.0000(Not Clear)  < succ>
```

The protein has homology with the following sequences in the GENPEPT database.

```
>GP: CAB49925 GB: AJ248286 ABC transporter, ATP-binding protein
[Pyrococcus abyssi]
Identities = 96/243 (39%), Positives = 164/243 (66%), Gaps = 2/243 (0%)

Query:   1 MIKFEHVSKVYGEKEALSDLTLSVKDGEIFGLIGHNGAGKTTTISILTSIIDATYGQVYI  60
```

-continued

```
             MI  E++ K +G KE L   ++ +VKDGEI+GL+G NG+GK+TT+ IL+ II    G+V +
Sbjct:   1 MIIVENLRKRFGGKEVLKGISFTVKDGEIYGLLGPNGSGKSTTMRILSGIITDFEGKVIV   60

Query:  61 DDLLLTEHRDQIKKKIGYVPDSPDIFLNLTAEEYWYFLAKIYDVAPEDIEARITKLVDIF  120
            + + +     Q+K+ +GYVP++P ++ +LT  E++ F+  +   +  +E R+ KLV+ F
Sbjct:  61 GGVEVAKDPLQVKRIVGYVPETPALYESLTPAEFFSFVGGVRGIPKDILEERVRKLVEAF  120

Query: 121 ELEEQRYNPIESFSHGMRQKVIVIGALLPNPDIWILDEPLTGLDPQASFDLKEMMKEHAK  180
            E+++      I + S G +QK+ +I +LL +P +  ILDE + GLDP+++   +E++ E  +
Sbjct: 121 EIKKYMNQLIGTLSFGTKQKISLISSLLHDPKVLILDEAMNGLDPKSARIFRELLYEFKE  180

Query: 181 NGKTVIFSTHVLAVAEQLCDRIGILKQGKLIFVGSLGELKMKYPDKDLETIYLELAGRQA  240
             GK+++FSTHVLA+AE +CDR+GI +QG++I   G++ ELK    ++ LE ++L+L   QA
Sbjct: 181 EGKSIVFSTHVLALAELICDRVGIIYQGRIIAEGTVEELKEISKEERLEDVFLKLT--QA  238

Query: 241 SRE                                                          243
             E
Sbjct: 239 KEE                                                          241
```

A related DNA sequence was identified in *S. pyogenes* <SEQ ID 2875> which encodes the amino acid sequence <SEQ ID 2876>. Analysis of this protein sequence reveals the following:

```
Possible site: 56
>>> Seems to have no N-terminal signal sequence

----- Final Results -----
           bacterial cytoplasm --- Certainty = 0.2723(Affirmative) < succ>
            bacterial membrane --- Certainty = 0.0000(Not Clear)  < succ>
             bacterial outside --- Certainty = 0.0000(Not Clear)  < succ>
```

An alignment of the GAS and GBS proteins is shown below.

```
Identities = 182/244 (74%), Positives = 215/244 (87%)

Query:   1 MIKFEHVSKVYGEKEALSDLTLSVKDGEIFGLIGHNGAGKTTTISILTSIIDATYGQVYI   60
           MI+F+HVSK+YG+KEALSDL +++ DGEIFGLIGHNGAGKTTTISILTSII+A+YG+V++
Sbjct:   1 MIEFKHVSKLYGDKEALSDLNVTINDGEIFGLIGHNGAGKTTTISILTSIIEASYGEVFV   60

Query:  61 DDLLLTEHRDQIKKKIGYVPDSPDIFLNLTAEEYWYFLAKIYDVAPEDIEARITKLVDIF  120
           D  LLTE+R+ IKK+I YVPDSPDIFLNLT  EYW FLAKIY V+ ED E R+ +L  +F
Sbjct:  61 DGQLLTENREAIKKQIAYVPDSPDIFLNLTPNEYWQFLAKIYGVSDEDREERLAQLTTLF  120

Query: 121 ELEEQRYNPIESFSHGMRQKVIVIGALLPNPDIWILDEPLTGLDPQASFDLKEMMKEHAK  180
           EL+E+    I+SFSHGMRQKVIVIGAL+ NP+IWILDEPLTGLDPQASFDLKEMMK HA
Sbjct: 121 ELKEEVNQTIDSFSHGMRQKVIVIGALVSNPNIWILDEPLTGLDPQASFDLKEMMKAHAA  180

Query: 181 NGKTVIFSTHVLAVAEQLCDRIGILKQGKLIFVGSLGELKMKYPDKDLETIYLELAGRQA  240
           +G TV+FSTHVL+VAEQLCDRIGILK+GKLIFVG++ ELK  +PDKDLE+IYLELAGR+A
Sbjct: 181 SGHTVLFSTHVLSVAEQLCDRIGILKKGKLIFVGTIDELKEHHPDKDLESIYLELAGRKA  240

Query: 241 SREG                                                         244
            EG
Sbjct: 241 QEEG                                                         244
```

Based on this analysis, it was predicted that these proteins and their epitopes could be useful antigens for vaccines or diagnostics.

EXAMPLE 946

A DNA sequence (GBSx1004) was identified in *S. agalactiae* <SEQ ID 2877> which encodes the amino acid sequence <SEQ ID 2878>. Analysis of this protein sequence reveals the following:

```
Possible site: 55
>>> Seems to have no N-terminal signal sequence
   INTEGRAL     Likelihood = -13.43    Transmembrane   504-520 (495-529)
   INTEGRAL     Likelihood = -12.58    Transmembrane   427-443 (400-449)
```

```
    INTEGRAL     Likelihood = -10.99    Transmembrane    151-167  (144-179)
    INTEGRAL     Likelihood =  -8.44    Transmembrane    194-210  (189-214)
    INTEGRAL     Likelihood =  -7.96    Transmembrane     48- 64  (46-68)
    INTEGRAL     Likelihood =  -7.32    Transmembrane    350-366  (348-378)
    INTEGRAL     Likelihood =  -6.69    Transmembrane    475-491  (474-501)
    INTEGRAL     Likelihood =  -6.00    Transmembrane    319-335  (318-337)
    INTEGRAL     Likelihood =  -5.73    Transmembrane    252-268  (244-271)
    INTEGRAL     Likelihood =  -4.78    Transmembrane    125-141  (121-148)
    INTEGRAL     Likelihood =  -4.51    Transmembrane     76- 92  (71-98)
    INTEGRAL     Likelihood =  -3.56    Transmembrane    406-422  (400-426)

----- Final Results -----
             bacterial membrane --- Certainty = 0.6371(Affirmative) < succ>
             bacterial outside  --- Certainty = 0.0000(Not Clear)  < succ>
           bacterial cytoplasm --- Certainty = 0.0000(Not Clear)  < succ>
```

The protein has no significant homology with any sequences in the GENPEPT database.

A related DNA sequence was identified in *S. pyogenes* <SEQ ID 2879> which encodes the amino acid sequence <SEQ ID 2880>. Analysis of this protein sequence reveals the following:

```
Possible site: 37
>>> Seems to have no N-terminal signal sequence
    INTEGRAL     Likelihood = -14.33    Transmembrane    167-183  (158-193)
    INTEGRAL     Likelihood = -12.52    Transmembrane    524-540  (508-546)
    INTEGRAL     Likelihood = -10.93    Transmembrane     63- 79  (60-84)
    INTEGRAL     Likelihood =  -8.39    Transmembrane    421-437  (414-456)
    INTEGRAL     Likelihood =  -8.23    Transmembrane    208-224  (203-228)
    INTEGRAL     Likelihood =  -8.23    Transmembrane    504-520  (493-521)
    INTEGRAL     Likelihood =  -7.59    Transmembrane    139-155  (134-162)
    INTEGRAL     Likelihood =  -6.64    Transmembrane    261-277  (257-287)
    INTEGRAL     Likelihood =  -4.99    Transmembrane    446-462  (444-464)
    INTEGRAL     Likelihood =  -4.25    Transmembrane    369-385  (367-387)
    INTEGRAL     Likelihood =  -0.80    Transmembrane     87-103  (87-104)
    INTEGRAL     Likelihood =  -0.11    Transmembrane    334-350  (334-350)

----- Final Results -----
             bacterial membrane --- Certainty = 0.6731(Affirmative) < succ>
             bacterial outside  --- Certainty = 0.0000(Not Clear)  < succ>
           bacterial cytoplasm --- Certainty = 0.0000(Not Clear)  < succ>
```

A related sequence was also identified in GAS <SEQ ID 9173> which encodes the amino acid sequence <SEQ ID 9174>. Analysis of this protein sequence reveals the following:

```
Possible site: 51
>>> Seems to have no N-terminal signal sequence
    INTEGRAL     Likelihood = -14.33    Transmembrane    153-169  (144-179)
    INTEGRAL     Likelihood = -12.52    Transmembrane    510-526  (494-532)
    INTEGRAL     Likelihood = -10.93    Transmembrane     49- 65  (46-70)
    INTEGRAL     Likelihood =  -8.39    Transmembrane    407-423  (400-442)
    INTEGRAL     Likelihood =  -8.23    Transmembrane    194-210  (189-214)
    INTEGRAL     Likelihood =  -8.23    Transmembrane    490-506  (479-507)
    INTEGRAL     Likelihood =  -7.59    Transmembrane    125-141  (120-148)
    INTEGRAL     Likelihood =  -6.64    Transmembrane    247-263  (243-273)
    INTEGRAL     Likelihood =  -4.99    Transmembrane    432-448  (430-450)
    INTEGRAL     Likelihood =  -4.25    Transmembrane    355-371  (353-373)
    INTEGRAL     Likelihood =  -0.80    Transmembrane     73- 89  (73-90)
    INTEGRAL     Likelihood =  -0.11    Transmembrane    320-336  (320-336)

----- Final Results -----
             bacterial membrane --- Certainty = 0.673(Affirmative) < succ>
             bacterial outside  --- Certainty = 0.0000(Not Clear)  < succ>
           bacterial cytoplasm --- Certainty = 0.0000(Not Clear)  <succ>
```

An alignment of the GAS and GBS proteins is shown below.

```
Identities = 255/542 (47%), Positives = 378/542 (69%),
Gaps = 12/542 (2%)

Query:    1 MNWSRIWELVKINILYSNPQTLSALRKKQEKHPKKEFSAYKSMFRNQLFQILLFSIIYVF   60
            MNWS IWEL+KINILYSNPQ+L+ L+K+QEKHPK+ F AYKSM R Q   I +F +IY+F
Sbjct:   15 MNWSTIWELIKINILYSNPQSLANLKKRQEKHPKENFKAYKSMMRQQALMIAMFLVIYLF   74

Query:   61 LFVSLDFKEYPGYFTFYIGIFTLVSIIYSFIAMYSVFYESDDVKQYAYLPIKSEELYVAK  120
            +F+ +DF   YPG F+F + +F ++S + +F ++Y++FYES+D+K Y +LP+ SEELY+AK
Sbjct:   75 MFIGVDFSHYPGLFSFDVAMFFIMSTLTAFSSLYTIFYESNDLKYIHLPVTSEELYIAK  134

Query:  121 IFATFGMSVTFLMPILTLMIVAYWRIIGGPLAVLLAIINFAILFLSVTVISLYINSLIGR  180
            I ++ GM    FLMP+++L+++AYW+++G PL++L+AI+ F +L +S  V+++YIN+ +G+
Sbjct:  135 IVSSLGMGAVFLMPLISLLLIAYWQLLGNPLSILVAIVLFLVLLVSSMVLAIYINAWVGK  194

Query:  181 AIIRSANRKLISTILISLATFGAIVPLLFVNMTSQK--MVQGKLQDIAPIPYVRGYYDIV  238
             I+RS  RKLISTI++ ++TFGA V +  +N+++ K  M G    D    IPY +G+YD+V
Sbjct:  195 IIVRSRKRKLISTIMMFVSTFGAFVLIFAINISNNKRTMTDGVFTDYPTIPYFKGFYDVV  254

Query:  239 TAPFSMESLLNYYLPLLIILFLIGAIYKWVMPRYYQELLY----GQVKQRK--VHRQIDF  292
             APFS  +LLN++LPLL+IL ++  I    VMP YY+E  Y       +VKQ  K  V+R
Sbjct:  255 QAPFSTAALLNFWLPLLLILAMVYGIVTKVMPTYYREAFYISNENKVKQTKKPVNRP---  311

Query:  293 SKRESINKTLVKHHLSSLQNATLLTNTFLMPLLYLAMFIVPILNNGKEIGRFFNENYFGI  352
              +S+ + L KHHL +LQNATLLT T+LMPL+Y+ +FI P L+ G    +  +YFG+
Sbjct:  312 HQNQSLAQLLRKHHLLTLQNATLLTQTYLMPLMYVMLFIGPSLSRGTGFFKHISPDYFGV  371

Query:  353 AFLAGILIGSLCVMPASIVGVGISLEKSNFYIKSLPISFSYFLKHKFVTLITLQLAVPT   412
            A L G+ +G +C  P S +GVGISLEK NF FIKSLPI+    FL   KF  L+ LQL VP
Sbjct:  372 ALLFGVSLGVMCATPTSFIGVGISLEKDNFTFIKSLPITLKKFLMDKFCLLVGLQLIVPM  431

Query:  413 FIYFLVGFFLLKLSILVLLSFILGLVFMGLIEGQFIYRRDYKHLFLNWQEVTQLFNRGLG  472
            IY +  G F+L L    L+ ++F LG      +++G+ +YRRDY+ L L WQ++TQLF RG G
Sbjct:  432 VIYLVFGLFVLHLHPLLTIAFCLGYALSLIVQGELMYRRDYRLLDLKWQDMTQLFTRGDG  491

Query:  473 QWLLVGSLFGMMIIGSFL-IGISIFWSMVWNTVAVNIIILIIGLLILSICQYLLLKNFWK  531
            QWL +G +FG +I+    L   G I  +++    + ++I++   + L++L +  Q  +  K FWK
Sbjct:  492 QWLTMGLIFGNLIVAGVLGFGAVIIANIIQQPLLISILLSCLILMVLGLAQLWIQKTFWK  551

Query:  532 KL                                                           533
            L
Sbjct:  552 SL                                                           553
```

Based on this analysis, it was predicted that these proteins and their epitopes could be useful antigens for vaccines or diagnostics.

EXAMPLE 947

A DNA sequence (GBSx1005) was identified in *S. agalactiae* <SEQ ID 2881> which encodes the amino acid sequence <SEQ ID 2882>. Analysis of this protein sequence reveals the following:

```
Possible site: 44
>>> Seems to have no N-terminal signal sequence
      INTEGRAL    Likelihood = -8.12    Transmembrane    242-258 (239-265)
      INTEGRAL    Likelihood = -7.64    Transmembrane    430-446 (421-450)
      INTEGRAL    Likelihood = -5.84    Transmembrane    120-136 (113-139)
      INTEGRAL    Likelihood = -5.52    Transmembrane    212-228 (210-232)
      INTEGRAL    Likelihood = -5.20    Transmembrane    287-303 (283-313)
      INTEGRAL    Likelihood = -3.56    Transmembrane    148-164 (143-166)
      INTEGRAL    Likelihood = -0.48    Transmembrane    382-398 (382-398)

----- Final Results -----
          bacterial membrane --- Certainty = 0.4248(Affirmative) < succ>
          bacterial outside  --- Certainty = 0.0000(Not Clear)   < succ>
          bacterial cytoplasm --- Certainty = 0.0000(Not Clear)  < succ>
```

The protein has homology with the following sequences in the GENPEPT database.

```
>GP: CAB15963 GB: Z99124 phosphotransferase system (PTS)
beta-glucoside-specific enzyme IIABC component [Bacillus subtilis]
```

```
                              -continued
Identities = 175/447 (39%), Positives = 266/447 (59%), Gaps = 10/447 (2%)

Query:     4 EYITLSKNIIKHLGGQNNINNVYHCQTRLRFSLNDPTKVNLEQLKTLKEVKTVVISGGQH   63
             +Y  LSK+I++ +GG+ N+  V HC TRLRF+L+D  K +  QL+ L  V      ISG Q
Sbjct:     2 DYDKLSKDILQLVGGEENVQRVIHCMTRLRFNLHDNAKADRSQLEQLPGVMGTNISGEQF   61

Query:    64 QIVIGTHVAKVFEEI---NSLIETNSTTKIEQTKKAKAVSRIIDFVSGTFQPILPALSGA  120
             QI+IG  V KV++ I    ++L +    S       Q K    +S + D +SG F PILPA++GA
Sbjct:    62 QIIIGNDVPKVYQAIVRHSNLSDEKSAGSSSQKKNV--LSAVFDVISGVFTPILPAIAGA  119

Query:   121 GMIKALLALLLVFKILTPSSQTYILLNLFADGVFYFLPILIAITAAQKLKANPILALGTV  180
             GMIK L+AL + F  +   SQ +++L    DG FYFLP+L+A++AA+K +NP +A
Sbjct:   120 GMIKGLVALAVTFGWMAEKSQVHVILTAVGDGAFYFLPLLLAMSAARKFGSNPYVAAAIA  179

Query:   181 VMLLHPNWANLVASGKPVSLFHTIPFTLTNYASSVIPIILIICVQAYIEKYLKQIIPKSL  240
             +LHP+    L+ +GKP+S F  +P T   Y+S+VIPI+L I +  +Y+EK++ +     SL
Sbjct:   180 AAILHPDLTALLGAGKPIS-FIGLPVTAATYSSTVIPILLSIWIASYVEKWIDRFTHASL  238

Query:   241 RLVLVPMLIFLSMGILSFSILGPMGTIAGQYLAVIFTFLSKYASW-APAFLVGAFAPILI  299
             +L++VP   L +  L+   +GP+G I G+YL+    +L +A   A  FL G F+ ++I
Sbjct:   239 KLIVVPTFTLLIVVPLTLITVGPLGAILGEYLSSGVNYLFDHAGLVAMIFLAGTFS-LII  297

Query:   300 MFGVHSGIAALGITQLAKLGVDSIFGPGMLCSNIAQATAGTVVTLITKEKKLKEIAGPAA  359
             M G+H     + I  +A+ G D +  P M  +N+ QA A   V L ++ KK K +A   +
Sbjct:   298 MTGMHYAFVPIMINNIAQNGHDYLL-PAMFLANMGQAGASFAVFLRSRNKKFKSLALTTS  356

Query:   360 ITAYMGITEPILYGVNLPKRYPLIASLIGGGLGGLYAGIMNAHRFAV-GSSGLPGLFLYI  418
             ITA MGITEP +YGVN+  + P  A+LIGG  GG + G+    + V G++GLP + ++I
Sbjct:   357 ITALMGITEPAMYGVNMRLKKPFAAALIGGAAGGAFYGMTGVASYIVGGNAGLPSIPVFI  416

Query:   419 SHTSTHLFITMLIAVIITVSTTAILTF                                  445
              T + I ++IA     S   +L F
Sbjct:   417 GPTFIYAMIGLVIAFAAGTSAAYLLGF                                  443
```

There is also homology to SEQ ID 2884.

Based on this analysis, it was predicted that this protein and its epitopes, could be useful antigens for vaccines or diagnostics.

EXAMPLE 948

A DNA sequence (GBSx1006) was identified in *S. agalactiae* <SEQ ID 2885> which encodes the amino acid sequence <SEQ ID 2886>. This protein is predicted to be gamma-glutamyl kinase (proB). Analysis of this protein sequence reveals the following:

```
Possible site: 58
>>> Seems to have no N-terminal signal sequence
      INTEGRAL     Likelihood = -0.11     Transmembrane    160-176 (160-176)

----- Final Results -----
               bacterial membrane --- Certainty = 0.1044(Affirmative) < succ>
                bacterial outside --- Certainty = 0.0000(Not Clear)   < succ>
               bacterial cytoplasm --- Certainty = 0.0000(Not Clear)   < succ>
```

The protein has homology with the following sequences in the GENPEPT database.

```
>GP: CAA63147 GB: X92418 gamma-glutamyl kinase [Streptococcus thermophilus]
Identities = 200/265 (75%), Positives = 235/265 (88%)

Query:     1 MKRHFETTRRIVIKVGTSSLVQTSGKINLSKIDHLAFVISSLMNRGMEVILVSSGAMGFG   60
             MKR+F++ +R+VIK+GTSSLV  SGKINL KID LAFVISSL N+G+EV+LVSSGAMGFG
Sbjct:     1 MKRNFDSVKRLVIKIGTSSLVLPSGKINLEKIDQLAFVISSLHNKGIEVVLVSSGAMGFG  60

Query:    61 LDILKMDKRPQEISQQQAVSSVGQVAMMSLYSQIFSHYQTHVSQILLTRDVVVFPESLQN  120
             L++L ++KRP E+ +QQAVSSVGQVAMMSLYSQ+FSHYQT VSQ+LLTRDVV + ESL N
Sbjct:    61 LNVLDLEKRPAEVGKQQAVSSVGQVAMMSLYSQVFSHYQTKVSQLLLTRDVVEYSESLAN  120

Query:   121 VTNSFESLLSMGILPIVNENDAVSVDEMDHKTKFGDNDRLSAVVAKITKADLLIMLSDID  180
              N+FESL   +G++PIVNENDAVSVDEMDH TKFGDNDRLSA+VAK+   ADLLIMLSDID
Sbjct:   121 AINAFESLFELGVVPIVNENDAVSVDEMDHATKFGDNDRLSAIVAKVVGADLLIMLSDID  180
```

```
-continued
Query: 181 GLFDKNPNIYDDAVLRSHVSEITDDIIKSAGGAGSKFGTGGMLSKIKSAQMVFDNNGQMI 240
            GLFDKNPN+Y+DA LRS+V EIT++I+ SAGGAGSKFGTGGM+SKIKSAQMVF+N  QM+
Sbjct: 181 GLFDKNPNVYEDATLRSYVPEITEEILASAGGAGSKFGTGGMMSKIKSAQMVFENQSQMV 240

Query: 241 LMNGANPRDILKVLDGHNIGTYFAQ                                   265
            LMNG NPRDIL+VL+G  IGT F Q
Sbjct: 241 LMNGENPRDILRVLEGAKIGTLFKQ                                   265
```

A related DNA sequence was identified in *S. pyogenes* <SEQ ID 2887> which encodes the amino acid sequence <SEQ ID 2888>. Analysis of this protein sequence reveals the following:

```
Possible site: 61
>>> Seems to have no N-terminal signal sequence
    INTEGRAL    Likelihood = -1.97    Transmembrane    163-179 (163-179)
    INTEGRAL    Likelihood = -0.06    Transmembrane    124-140 (124-140)

----- Final Results -----
            bacterial membrane --- Certainty = 0.1786(Affirmative) < succ>
             bacterial outside --- Certainty = 0.0000(Not Clear)   < succ>
            bacterial cytoplasm --- Certainty = 0.0000(Not Clear)   < succ>
```

The protein has homology with the following sequences in the databases:

```
>GP: CAA63147 GB: X92418 gamma-glutamyl kinase [Streptococcus thermophilus]
Identities = 212/265 (80%), Positives = 237/265 (89%)

Query:   4 MKRQFEDVTRIVIKIGTSSLVLPTGKINLEKIDQLAFVISSLMNKGKEVILVSSGAMGFG  63
           MKR F+ V R+VIKIGTSSLVLP+GKINLEKIDQLAFVISSL NKG EV+LVSSGAMGFG
Sbjct:   1 MKRNFDSVKRLVIKIGTSSLVLPSGKINLEKIDQLAFVISSLHNKGIEVVLVSSGAMGFG  60

Query:  64 LDILKMEKRPTNLAKQQAVSSVGQVAMMSLYSQIFAYYQTNVSQILLTRDVVVFPESLAN 123
           L++L +EKRP  + KQQAVSSVGQVAMMSLYSQ+F++YQT VSQ+LLTRDVV + ESLAN
Sbjct:  61 LNVLDLEKRPAEVGKQQAVSSVGQVAMMSLYSQVFSHYQTKVSQLLLTRDVVEYSESLAN 120

Query: 124 VTNAFESLISLGIVPIVNENDAVSVDEMDHATKFGDNDRLSAVVAGITKADLLIMLSDID 183
              NAFESL  LG+VPIVNENDAVSVDEMDHATKFGDNDRLSA+VA +  ADLLIMLSDID
Sbjct: 121 AINAFESLFELGVVPIVNENDAVSVDEMDHATKFGDNDRLSAIVAKVVGADLLIMLSDID 180

Query: 184 GLFDKNPTIYEDAQLRSHVANITQEIIASAGGAGSKFGTGGMLSKVQSAQMVFENKGQMV 243
           GLFDKNP +YEDA LRS+V  IT+EI+ASAGGAGSKFGTGGM+SK++SAQMVFEN+ QMV
Sbjct: 181 GLFDKNPNVYEDATLRSYVPEITEEILASAGGAGSKFGTGGMMSKIKSAQMVFENQSQMV 240

Query: 244 LMNGANPRDILRVLEGQPLGTWFKQ                                   268
           LMNG NPRDILRVLEG +GT FKQ
Sbjct: 241 LMNGENPRDILRVLEGAKIGTLFKQ                                   265
```

An alignment of the GAS and GBS proteins is shown below.

```
Identities = 217/265 (81%), Positives = 242/265 (90%)

Query:   1 MKRHFETTRRIVIKVGTSSLVQTSGKINLSKIDHLAFVISSLMNRGMEVILVSSGAMGFG  60
           MKR FE    RIVIK+GTSSLV +GKINL KID LAFVISSLMN+G EVILVSSGAMGFG
Sbjct:   4 MKRQFEDVTRIVIKIGTSSLVLPTGKINLEKIDQLAFVISSLMNKGKEVILVSSGAMGFG  63

Query:  61 LDILKMDKRPQEISQQQAVSSVGQVAMMSLYSQIFSHYQTHVSQILLTRDVVVFPESLQN 120
           LDILKM+KRP +++QQAVSSVGQVAMMSLYSQIF++YQT+VSQILLTRDVVVFPESL N
Sbjct:  64 LDILKMEKRPTNLAKQQAVSSVGQVAMMSLYSQIFAYYQTNVSQILLTRDVVVFPESLAN 123

Query: 121 VTNSFESLLSMGILPIVNENDAVSVDEMDHKTKFGDNDRLSAVVAKITKADLLIMLSDID 180
           VTN+FESL+S+GI+PIVNENDAVSVDEMDH TKFGDNDRLSAVVA ITKADLLIMLSDID
Sbjct: 124 VTNAFESLISLGIVPIVNENDAVSVDEMDHATKFGDNDRLSAVVAGITKADLLIMLSDID 183

Query: 181 GLFDKNPNIYDDAVLRSHVSEITDDIIKSAGGAGSKFGTGGMLSKIKSAQMVFDNNGQMI 240
           GLFDKNP IY+DA LRSHV+ IT +II SAGGAGSKFGTGGMLSK++SAQMVF+N GQM+
Sbjct: 184 GLFDKNPTIYEDAQLRSHVANITQEIIASAGGAGSKFGTGGMLSKVQSAQMVFENKGQMV 243

Query: 241 LMNGANPRDILKVLDGHNIGTYFAQ                                   265
           LMNGANPRDIL+VL+G  +GT+F Q
Sbjct: 244 LMNGANPRDILRVLEGQPLGTWFKQ                                   268
```

Based on this analysis, it was predicted that these proteins and their epitopes could be useful antigens for vaccines or diagnostics.

EXAMPLE 949

A DNA sequence (GBSx1007) was identified in *S. agalactiae* <SEQ ID 2889> which encodes the amino acid sequence <SEQ ID 2890>. This protein is predicted to be unnamed protein product (proA). Analysis of this protein sequence reveals the following:

```
Possible site: 55
>>> Seems to have no N-terminal signal sequence

----- Final Results -----
            bacterial cytoplasm --- Certainty = 0.3517(Affirmative) < succ>
            bacterial membrane  --- Certainty = 0.0000(Not Clear)   < succ>
            bacterial outside   --- Certainty = 0.0000(Not Clear)   < succ>
```

A related DNA sequence was identified in *S. pyogenes* <SEQ ID 2891> which encodes the amino acid sequence <SEQ ID 2892>. Analysis of this protein sequence reveals the following:

```
Possible site: 55
>>> Seems to have no N-terminal signal sequence

----- Final Results -----
            bacterial membrane  --- Certainty = 0.0000(Not Clear)   < succ>
            bacterial outside   --- Certainty = 0.0000(Not Clear)   < succ>
            bacterial cytoplasm --- Certainty = 0.0000(Not Clear)   < succ>
```

The protein has homology with the following sequences in the databases:

```
>GP: CAA63148 GB: X92418 gamma-glutamyl phosphate reductase
[Streptococcus thermophilus]
Identities = 309/416 (74%), Positives = 355/416 (85%)

Query:    1 MTDMRRLGQRAKQASLLIAPLSTQIKNRFLSTLAKALVDDTQTLLAANQKDLANAKEHGI   60
            MT + LGQ+AK AS  IA LST  KN L+ +AKALV ++   +  N KD+ANA E+GI
Sbjct:    1 MTYVDTLGQQAKVASRQIAKLSTAAKNDLLNQVAKALVAESDYIFTENAKDMANASENGI   60

Query:   61 SDIMMDRLRLTSERIKAIAQGVQQVADLADPIGQVIKGYTNLDGLKILQKRVPLGVIAMI  120
            S IM DRL LT +RI   IA+GV+QVADL DPIGQV++GYTNLDGLKI+QKRVP+GVIAMI
Sbjct:   61 SKIMQDRLLLTEDRIAGIAEGVRQVADLQDPIGQVVRGYTNLDGLKIVQKRVPMGVIAMI  120

Query:  121 FESRPNVSVDAFSLAFKTNNAIILRGGKDALHSNKALVKLIRQSLEKSGITPDAVQLVED  180
            FESRPNVS+DAFSLAFKTNNAIILRGG+DA++SNKALV + R++L+ +GIT DAVQ VED
Sbjct:  121 FESRPNVSIDAFSLAFKTNNAIILRGGRDAINSNKALVTVARKALKNAGITADAVQFVED  180

Query:  181 PSHAVAEELMQATDYVDVLIPRGGAKLIQTVKEKAKVPVIETGVGNVHIYVDAQADLDIA  240
              SH VAEELM AT YVD+LIPRGGA+LIQTVKEKAKVPVIETGVGN HIYVD  A+LD+A
Sbjct:  181 TSHEVAEELMVATKYVDLLIPRGGARLIQTVKEKAKVPVIETGVGNCHIYVDKYANLDMA  240

Query:  241 TKIVINAKTKRPSVCNAAEGLVIHEAVAARFIPMLEKAINQVQPVEWRADDKALPLFEQA  300
            T+IVINAKT+RPSVCNAAE LV+H +    F+P LEKAI+++Q  VE+RAD++AL  L E+A
Sbjct:  241 TQIVINAKTQRPSVCNAAESLVVHADIVEEFLPNLEKAISKIQSVEFRADERALKLMEKA  300

Query:  301 VPAKAEDFETEFLDYIMSVKVVSSLEEAISWINQYTSHHSEAIITRDIKAAETFQDLVDA  360
            VPA   EDF TEFLDYIMSVKVV SL+EAI+WIN YT+ HSEAI+T+DI   AE FQD VDA
Sbjct:  301 VPASPEDFATEFLDYIMSVKVVDSLDEAINWINTYTTSHSEAIVTQDISRAEQFQDDVDA  360

Query:  361 AAVYVNASTRFTDGFVFGLGAEIGISTQKMHARGPMGLEALTSTKFYINGDGHIRE      416
            AAVYVNASTRFTDGFVFGLGAEIGISTQKMHARGPMGLEALTSTKFYING G IRE
Sbjct:  361 AAVYVNASTRFTDGFVFGLGAEIGISTQKMHARGPMGLEALTSTKFYINGQGQIRE      416
```

An alignment of the GAS and GBS proteins is shown below.

```
Identities = 307/417 (73%), Positives = 353/417 (84%), Gaps = 1/417 (0%)

Query:    1 MTYIEILGQNAKKASQSVARLSTASKNEILRDLARNIVADTETILTENARDVVKAKDNGI   60
            MT +  LGQ AK+AS  +A LST  KN  L  LA+ +V DT+T+L  N +D+  AK++GI
Sbjct:    1 MTDMRRLGQRAKQASLLIAPLSTQIKNRFLSTLAKALVDDTQTLLAANQKDLANAKEHGI   60

Query:   61 SEIMVDRLRLNKDRIQAIANGIYQVADLADPIGQVVSGYTNLDGLKILKKRVPLGVIAMI  120
            S+IM+DRLRL   +RI+AIA G+ QVADLADPIGQV+ GYTNLDGLKIL+KRVPLGVIAMI
Sbjct:   61 SDIMMDRLRLTSERIKAIAQGVQQVADLADPIGQVIKGYTNLDGLKILQKRVPLGVIAMI  120

Query:  121 FESRPNVSVDAFSLAFKTGNAIILRGGKDAIFSNTALVNCMRQTLQDTGHNPDIVQLVED  180
            FESRPNVSVDAFSLAFKT NAIILRGGKDA+ SN ALV  +RQ+L+ +G   PD VQLVED
Sbjct:  121 FESRPNVSVDAFSLAFKTNNAIILRGGKDALHSNKALVKLIRQSLEKSGITPDAVQLVED  180

Query:  181 TSHVVAEELMQATDYVDVLIPRGGAKLIQTVKEKSKIPVIETGVGNVHIYIDEFADLDMA  240
             SH VAEELMQATDYVDVLIPRGGAKLIQTVKEK+K+PVIETGVGNVHIY+D  ADLD+A
Sbjct:  181 PSHAVAEELMQATDYVDVLIPRGGAKLIQTVKEKAKVPVIETGVGNVHIYVDAQADLDIA  240

Query:  241 AKIVINAKTQRPSVCNAAEGLVVHQAIAKGFLSQLEKMLKESNQSVEFRADEEALQLLEN  300
             KIVINAKT+RPSVCNAAEGLV+H+A+A  F+   LEK + +  Q VE+RAD++AL L E
Sbjct:  241 TKIVINAKTKRPSVCNAAEGLVIHEAVAARFIPMLEKAINQV-QPVEWRADDKALPLFEQ  299

Query:  301 AVAASESDYATEFLDYIMSVKVVDSFEQAISWINKYSSHHSEAIITNNISRAEIFQDMVD  360
            AV A   D+ TEFLDYIMSVKVV S E+AISWIN+Y+SHHSEAIIT +I  AE FQD+VD
Sbjct:  300 AVPAKAEDFETEFLDYIMSVKVVSSLEEAISWINQYTSHHSEAIITRDIKAAETFQDLVD  359

Query:  361 AAAVYVNASTRFTDGFVFGLGAEIGISTQKLHARGPMGLEALTSTKYYINGTGQVRE    417
            AAAVYVNASTRFTDGFVFGLGAEIGISTQK+HARGPMGLEALTSTK+YING G +RE
Sbjct:  360 AAAVYVNASTRFTDGFVFGLGAEIGISTQKMHARGPMGLEALTSTKFYINGDGHIRE    416
```

Based on this analysis, it was predicted that these proteins and their epitopes could be useful antigens for vaccines or diagnostics.

EXAMPLE 950

A DNA sequence (GBSx1008) was identified in *S. agalactiae* <SEQ ID 2893> which encodes the amino acid sequence <SEQ ID 2894>. Analysis of this protein sequence reveals the following:

```
Possible site: 53
>>> Seems to have no N-terminal signal sequence

----- Final Results -----
            bacterial cytoplasm --- Certainty = 0.1859(Affirmative) < succ>
              bacterial membrane --- Certainty = 0.0000(Not Clear) < succ>
               bacterial outside --- Certainty = 0.0000(Not Clear) < succ>
```

A related GBS nucleic acid sequence <SEQ ID 9531> which encodes amino acid sequence <SEQ ID 9532> was also identified.

A related DNA sequence was identified in *S. pyogenes* <SEQ ID 2895> which encodes the amino acid sequence <SEQ ID 2896>. Analysis of this protein sequence reveals the following:

```
Possible site: 23
>>> Seems to have no N-terminal signal sequence

----- Final Results -----
            bacterial cytoplasm --- Certainty = 0.0853(Affirmative) < succ>
              bacterial membrane --- Certainty = 0.0000(Not Clear) < succ>
               bacterial outside --- Certainty = 0.0000(Not Clear) < succ>
```

An alignment of the GAS and GBS proteins is shown below.

```
Identities = 259/315 (82%), Positives = 287/315 (90%)

Query:    1 MTNDFHHITVLLHETVDMLDIKPDGIYVDATLGGAGHSEYLLSQLGPDGHLYAFDQDQKA   60
```

-continued

```
                  MT +FHH+TVLLHETVDMLDIKPDGIYVDATLGG+GHS YLLS+LG +GHLY FDQDQKA
Sbjct:   22 MTKEFHHVTVLLHETVDMLDIKPDGIYVDATLGGSGHSAYLLSKLGEEGHLYCFDQDQKA   81

Query:   61 IDNAHIRLKKYVDTGQVTFIKDNFRNLSSNLKALGVSEINGICYDLGVSSPQLDERERGF  120
            IDNA + LK Y+D GQVTFIKDNFR+L + L ALGV EI+GI YDLGVSSPQLDERERGF
Sbjct:   82 IDNAQVTLKSYIDKGQVTFIKDNFRHLKARLTALGVDEIDGILYDLGVSSPQLDERERGF  141

Query:  121 SYKQDAPLDMRMNREQSLTAYDVVNTYSYHDLVRIFFKYGEDKFSKQIARKIEQVRAEKT  180
            SYKQDAPLDMRM+R+   LTAY+VVNTY ++DLV+IFFKYGEDKFSKQIARKIEQ RA K
Sbjct:  142 SYKQDAPLDMRMDRQSLLTAYEVVNTYPFNDLVKIFFKYGEDKFSKQIARKIEQARAIKP  201

Query:  181 ISTTTELAEIIKSSKSAKELKKKGHPAKQIFQAIRIEVNDELGAADESIQQAMDLLAVDG  240
            I TTTELAE+IK++K AKELKKKGHPAKQIFQAIRIEVNDELGAADESIQ AM+LLA+DG
Sbjct:  202 IETTTELAELIKAAKPAKELKKKGHPAKQIFQAIRIEVNDELGAADESIQDAMELLALDG  261

Query:  241 RISVITFHSLEDRLTKQLFKEASTVEVPKGLPFIPDDLQPKMELVNRKPILPSQEELEAN  300
            RISVITFHSLEDRLTKQLFKEASTV+VPKGLP IP+D++PK ELV+RKPILPS  EL AN
Sbjct:  262 RISVITFHSLEDRLTKQLFKEASTVDVPKGLPLIPEDMKPKFELVSRKPILPSHSELTAN  321

Query:  301 NRAHSAKLRVARRIR                                               315
            RAHSAKLRVA++IR
Sbjct:  322 KRAHSAKLRVAKKIR                                               336
```

Based on this analysis, it was predicted that these proteins and their epitopes could be useful antigens for vaccines or diagnostics.

EXAMPLE 951

A DNA sequence (GBSx1009) was identified in *S. agalactiae* <SEQ ID 2897> which encodes the amino acid sequence <SEQ ID 2898>. This protein is predicted to be FtsL. Analysis of this protein sequence reveals the following:

```
Possible site: 42
>>> Seems to have no N-terminal signal sequence
     INTEGRAL      Likelihood = -8.92     Transmembrane    30-46 (24-49)

----- Final Results -----
               bacterial membrane --- Certainty = 0.4567(Affirmative) < succ>
                 bacterial outside --- Certainty = 0.0000(Not Clear)   < succ>
               bacterial cytoplasm --- Certainty = 0.0000(Not Clear)   < succ>
```

The protein has homology with the following sequences in the GENPEPT database.

```
>GP: AAC95455 GB: AF068903 YllD [Streptococcus pneumoniae]
Identities = 44/99 (44%) , Positives = 71/99 (71%)

Query:    5 KRTEAVTQTLQRHIKTFSRIEKAFYGAIVITAIIMAVGIIYLQSNSLQVKQEVNQLNSKI   64
            ++ E   Q LQ  +K FSR+EKAFY +I +T +I+A+ II++Q+  LQV+ ++ ++N++I
Sbjct:    3 EKMEKTGQILQMQLKRFSRVEKAFYFSIAVTTLIVAISIIFMQTKLLQVQNDLTKINAQI   62

Query:   65 NDKQTEFDNAKQEVNELSNRDRITKIAKDAGLTIQNDNI                     103
            +K+TE D+AKQEVNEL    +R+ +IA   L + N+NI
Sbjct:   63 EEKKTELDDAKQEVNELLRAERLKEIANSHDLQLNNENI                     101
```

A related DNA sequence was identified in *S. pyogenes* <SEQ ID 2899> which encodes the amino acid sequence <SEQ ID 2900>. Analysis of this protein sequence reveals the following:

```
Possible site: 50
>>> Seems to have no N-terminal signal sequence
INTEGRAL Likelihood = -5.79 Transmembrane 40-56 (37-58)

----- Final Results -----
               bacterial membrane --- Certainty= 0.3314 (Affirmative) < succ>
                 bacterial outside --- Certainty= 0.0000 (Not Clear)   < succ>
                  bacterial cytoplasm --- Certainty= 0.0000 (Not Clear)   < succ>
```

The protein has homology with the following sequences in the databases:

```
>GP: AAC95455 GB: AF068903 YllD [Streptococcus pneumoniae]
Identities = 45/94 (47%), Positives = 69/94 (72%)

Query:  24 LQKRIKTFSRIEKAFYTAIIVTAITMAVSIIYLQSRKLQLQQEITSLNSHISDQKLELNN   83
           LQ ++K FSR+EKAFY +I VT + +A+SII++Q++ LQ+Q ++T +N+ I ++K EL++
Sbjct:  12 LQMQLKRFSRVEKAFYFSIAVTTLIVAISIIFMQTKLLQVQNDLTKINAQIEEKKTELDD   71

Query:  84 AKQEVNELSRRDRIIDIAGKAGLSNRNNNIKKVE                           117
           AKQEVNEL R +R+ +IA    L   N NI+  E
Sbjct:  72 AKQEVNELLRAERLKEIANSHDLQLNNENIRIAE                           105
```

An alignment of the GAS and GBS proteins is shown below.

```
Identities = 71/108 (65%), Positives = 87/108 (79%), Gaps = 1/108 (0%)

Query:   1 MTNEKRTEAVTQTLQRHIKTFSRIEKAFYGAIVITAIIMAVGIIYLQSNSLQVKQEVNQL    60
           MTNEKRT+ VT  LQ+ IKTFSRIEKAFY AI++TAI MAV IIYLQS  LQ++QE+  L
Sbjct:  11 MTNEKRTQVVTNALQKRIKTFSRIEKAFYTAIIVTAITMAVSIIYLQSRKLQLQQEITSL   70

Query:  61 NSKINDKQTEFDNAKQEVNELSNRDRITKIAKDAGLTIQNDNIYRKVD             108
           NS I+D++ E +NAKQEVNELS RDRI   IA  AGL+ +N+NI +KV+
Sbjct:  71 NSHISDQKLELNNAKQEVNELSRRDRIIDIAGKAGLSNRNNNI-KKVE             117
```

SEQ ID 2898 (GBS82) was expressed in *E. coli* as a GST-fusion product. SDS-PAGE analysis of total cell extract is shown in FIG. 15 (lane 2; 2 bands).

Based on this analysis, it was predicted that these proteins and their epitopes could be useful antigens for vaccines or diagnostics.

EXAMPLE 952

A DNA sequence (GBSx1010) was identified in *S. agalactiae* <SEQ ID 2901> which encodes the amino acid sequence <SEQ ID 2902>. Analysis of this protein sequence reveals the following:

```
Possible site: 21
>>> Seems to have no N-terminal signal sequence

----- Final Results -----
            bacterial cytoplasm --- Certainty = 0.1435 (Affirmative) < succ>
            bacterial membrane  --- Certainty = 0.0000 (Not Clear)  < succ>
              bacterial outside --- Certainty = 0.0000 (Not Clear)  < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 953

A DNA sequence (GBSx1011) was identified in *S. agalactiae* <SEQ ID 2903> which encodes the amino acid sequence <SEQ ID 2904>. This protein is predicted to be unnamed protein product. Analysis of this protein sequence reveals the following:

```
Possible site: 47
>>> Seems to have no N-terminal signal sequence
INTEGRAL Likelihood = -13.90 Transmembrane 37-53 (30-60)

----- Final Results -----
             bacterial membrane  --- Certainty = 0.6562 (Affirmative) < succ>
              bacterial outside  --- Certainty = 0.0000 (Not Clear)  < succ>
            bacterial cytoplasm  --- Certainty = 0.0000 (Not Clear)  < succ>
```

A related DNA sequence was identified in *S. pyogenes* <SEQ ID 2905> which encodes the amino acid sequence <SEQ ID 2906>. Analysis of this protein sequence reveals the following:

```
Possible site: 42
>>> Seems to have no N-terminal signal sequence
INTEGRAL Likelihood = -13.06 Transmembrane 33-49 (24-53)

----- Final Results -----
            bacterial membrane --- Certainty = 0.6222 (Affirmative) < succ>
             bacterial outside --- Certainty = 0.0000 (Not Clear)   < succ>
              bacterial cytoplasm --- Certainty = 0.0000 (Not Clear)   < succ>
```

An alignment of the GAS and GBS proteins is shown below.

```
Identities = 480/753 (63%), Positives = 603/753 (79%), Gaps = 8/753 (1%)

Query:   5 KKLKKIFLDYVIHIRDRRSPQKNRERVGQNLMILTIFLFFIFIINFVIIVGTDSKFGVNL   64
           KK +K  LDYV+  RDRR+P +NR RVGQN+M+LTIF+FFIFIINF+II+GTD KFGV+L
Sbjct:   2 KKWQKYVLDYVV--RDRRTPVENRVRVGQNMMLLTIFIFFIFIINFMIIGTDQKFGVSL   59

Query:  65 SKEAKKVYQQSMTVQAKRGTIYDRNGNPIAEDATTYSLYAIISKNYTTATGQKLYVQPSQ  124
           S+ AKKVYQ+++T+QAKRGTIYDRNG  IA D+TTYS+YAI K++ +A+ +KLYVQPSQ
Sbjct:  60 SEGAKKVYQETVTIQAKRGTIYDRNGTAIAVDSTTYSIYAILDKSFVSASDEKLYVQPSQ  119

Query: 125 YEKVASILENKLGMKKNLVLKQLNQKKLFQVSFGSSGSGLSYTKMADIKKTMEKSDIKGI  184
           YE VA IL+ LGMKK  V+KQL +K LFQVSFG SGSG+SY+ M+ I+K ME + IKGI
Sbjct: 120 YETVADILKKHLGMKKTDVIKQLKRKGLFQVSFGPSGSGISYSTMSTIQKAMEDAKIKGI  179

Query: 185 GFSTSPGRIYPNGIFASQFIGF-TLPQDDGDG-KKLVGNTGLEAALNKVLSGTDGKVTYE  242
            F+TSPGR+YPNG FAS+FIG  +L +D    G K LVG TGLEA+ +K+LSG DG +TY+
Sbjct: 180 AFTTSPGRMYPNGTFASEFIGLASLTEDKKTGVKSLVGKTGLEASFDKILSGQDGVITYQ  239

Query: 243 KDRSGNVLLGTATTERRAVNGKDIYTTLSEPIQTVLETQMDVFAEKTKGKFASATVVNAK  302
           KDR+G  LLGT  T ++A++GKDIYTTLSEPIQT LETQMDVF   K+  G+ ASAT+VNAK
Sbjct: 240 KDRNGTTLLGTGKTVKKAIDGKDIYTTLSEPIQTFLETQMDVFQAKSNGQLASATLVNAK  299

Query: 303 TGEILATSQRPTYNPSTLKGYDKKNLGTYNTLLYDNFFEPGSTMKVMTLASAIDSKHFNS  362
           TGEILAT+QRPTYN  TLKG +  N  Y+ L   N FEPGSTMKVMTLA+AID K FN
Sbjct: 300 TGEILATTQRPTYNADTLKGLENTNYKWYSALHQGN-FEPGSTMKVMTLAAAIDDKVFNP  358

Query: 363 TEVYNSAQ-YKIADAIIRDWDVNEGLSSGSYMTFPQGFAHSSNVGMVTLEQKMGRDKWLN  421
            E +++A    IADA I+DW +NEG+S+G YM + QGFA SSNVGM  LEQKMG  KW+N
Sbjct: 359 NETFSNANGLTIADATIQDWSINEGISTGQYMNYAQGFAFSSNVGMTKLEQKMGNAKWMN  418

Query: 422 YLSKFKFGYPTRFGMLHESGGLFPSDNEVTIAMSSFGQGIGVTQVQMLRAFTSISNDGVM  481
           YL+KF+FG+PTRFG+  E  G+FPSDN VT AMS+FGQGI VTQ+QMLRAFT+ISN+G M
Sbjct: 419 YLTKFRFGFPTRFGLKDEDAGIFPSDNIVTQAMSAFGQGISVTQIQMLRAFTAISNNGEM  478

Query: 482 LQPQFISSIYDPNTGTSRTARKEVVGKPVSKEAASKTRDYMVTVGTDPYYGTLYA-AGAP  540
           L+PQFIS IYDPNT + RTA KE+VGKPVSK+AAS TR YM+ VGTDP +GTLY+    P
Sbjct: 479 LEPQFISQIYDPNTASFRTANKEIVGKPVSKKAASETRQYMIGVGTDPEFGTLYSKTFGP  538

Query: 541 VIQVGNQSVAVKSGTAQIAQEGGGGYLQ-GKNDTINSVVAMVPSENPDFIMYVTIQQPEK  599
            +I+VG+  VAVKSGTAQI  E G GY  G + + SVVAMVP++ PDF+MYVT  +P+
Sbjct: 539 IIKVGDLPVAVKSGTAQIGSEDGSGYQDGGLTNYVYSVVAMVPADKPDFLMYVTMTKPQH  598

Query: 600 FSITFWKDVVNPVLEQATAMKETILKPGLNDSEHQTKYKLSKIVGENPGHVAEELRRNLV  659
           F    FW+DVVNPVLE+A  M++T+ KP  +D+  QT YKL   VG+NPG  + ELRRNLV
Sbjct: 599 FGPLFWQDVVNPVLEEAYLMQDTLTKPVVSDANRQTTYKLPNFVGKNPGETSSELRRNLV  658

Query: 660 QPIILGNGSKVSKVSKRPGANLAENEQLLVLTNKLTELPDMYGWSKANVEQFAKWTGIKV  719
           QP++LG GSK+ KVS +PG  L  EN+Q+L+L+++  E+PDMYGW+K+NV+ FAKWTGI +
Sbjct: 659 QPVVLGTGSKIKKVSHQPGQTLTENQQVLILSDRFVEVPDMYGWTKSNVKTFAKWTGIDI  718

Query: 720 TYKGSTSGKVRKQSIDVGKSINKIKKIKITIGD                             752
           ++KG+ SG+V KQS+DVGKS+ KIKK+ IT+GD
Sbjct: 719 SFKGTDSGRVMKQSVDVGKSLKKIKKMTITLGD                             751
```

A related GBS gene <SEQ ID 8691> and protein <SEQ ID 8692> were also identified. Analysis of this protein sequence reveals the following:

```
Lipop: Possible site: -1 Crend: 8
McG: Discrim Score: -4.31
GvH: Signal Score (-7.5): -7.07
Possible site: 47
>>> Seems to have no N-terminal signal sequence
ALOM program count: 1 value: -13.90 threshold: 0.0
INTEGRAL Likelihood = -13.90 Transmembrane 37-53 (30-60)
PERIPHERAL Likelihood = 5.30  450
modified ALOM score: 3.28

*** Reasoning Step: 3

----- Final Results -----
            bacterial membrane --- Certainty = 0.6562 (Affirmative) < succ>
            bacterial outside  --- Certainty = 0.0000 (Not Clear)  < succ>
            bacterial cytoplasm --- Certainty = 0.0000 (Not Clear)  < succ>
```

The protein has homology with the following sequences in the databases:

```
ORF00411(341-2556 of 2856)
GP|6779111|emb|CAB70457.1||A941911(1-752 of 752)unnamed protein product
{unidentified}, homology to penicillin-binding protein 2x {S. pneumoniae}
% Match = 77.4
% Identity = 99.7  % Similarity = 99.9
Matches = 750  Mismatches = 1  Conservative Sub.s = 1
        66         96        126        156        186        216        246        276
RIEKAFYGAIVITAIIMAVGIIYLQSNSLQVKQEVNQLNSKINDKQTEFDNAKQEVNELSNRDRITKIAKDAGLTIQNDN 306        336        366        396        426        456        486        516
IYRKVD*SVTFFKKLKKIFLDYVIHIRDRRSPQKNRERVGQNLMILTIFLFFIFIINFVIIVGTDSKFGVNLSKEAKKVY
       ||||||||||||||||||||||||||||||||||||||||||||||||||||||||||||||||||||||||
       VTFFKKLKKIFLDYVIHIRDRRSPQKNRERVGQNLMILTIFLFFIFIINFVIIVGTDSKFGVNLSKEAKKVY
              10         20         30         40         50         60         70

546        576        606        636        666        696        726        756
QQSMTVQAKRGTIYDRNGNPIAEDATTYSLYAIISKNYTTATGQKLYVQPSQYEKVASILENKLGMKKNLVLKQLNQKKL
||||||||||||||||||||||||||||||||||||||||||||||||||||||||||||||||||||||||||||||
QQSMTVQAKRGTIYDRNGNPIAEDATTYSLYAIISKNYTTATGQKLYVQPSQYEKVASILENKLGMKKNLVLKQLNQKKL
        90        100        110        120        130        140        150

786        816        846        876        906        936        966        996
FQVSFGSSGSGLSYTKMADIKKTMEKSDIKGIGFSTSPGRIYPNGIFASQFIGFTLPQDDGDGKKLVGNTGLEAALNKVL
||||||||||||||||||||||||||||||||||||||||||||||||||||||||||||||||||||||||||||||
FQVSFGSSGSGLSYTKMADIKKTMEKSDIKGIGFSTSPGRIYPNGIFASQFIGFTLPQDDGDGKKLVGNTGLEAALNKVL
       170        180        190        200        210        220        230

1026       1056       1086       1116       1146       1176       1206       1236
SGTDGKVTYEKDRSGNVLLGTATTERRAVNGKDIYTTLSEPIQTVLETQMDVFAEKTKGKFASATVVNAKTGEILATSQR
||||||||||||||||||||||||||||||||||||||||||||||||||||||||||||||||||||||||||||||
SGTDGKVTYEKDRSGNVLLGTATTERRAVNGKDIYTTLSEPIQTVLETQMDVFAEKTKGKFASATVVNAKTGEILATSQR
       250        260        270        280        290        300        310

1266       1296       1326       1356       1386       1416       1446       1476
PTYNPSTLKGYDKKNLGTYNTLLYDNFFEPGSTMKVMTLASAIDSKHFNSTEVYNSAQYKIADAIIRDWDVNEGLSSGSY
||||||||||||||||||||||||||||||||||||||||||||||||||||||||||||||||||||||||||||||
PTYNPSTLKGYDKKNLGTYNTLLYDNFFEPGSTMKVMTLASAIDSKHFNSTEVYNSAQYKIADAVIRDWDVNEGLSSGSY
       330        340        350        360        370        380        390

1506       1536       1566       1596       1626       1656       1686       1716
MTFPQGFAHSSNVGMVTLEQKMGRDKWLNYLSKFKFGYPTRFGMLHESGGLFPSDNEVTIAMSSFGQGIGVTQVQMLRAF
||||||||||||||||||||||||||||||||||||||||||||||||||||||||||||||||||||||||||||||
MTFPQGFAHSSNVGMVTLEQKMGRDKWLNYLSKFKFGYPTRFGMLHESGGLFPSDNEVTIAMSSFGQGIGVTQVQMLRAF
       410        420        430        440        450        460        470

1746       1776       1806       1836       1866       1896       1926       1956
TSISNDGVMLQPQFISSIYDPNTGTSRTARKEVVGKPVSKEAASKTRDYMVTVGTDPYYGTLYAAGAPVIQVGNQSVAVK
||||||||||||||||||||||||||||||||||||||||||||||||||||||||||||||||||||||||||||||
TSISNDGVMLQPQFISSIYDPNTGTSRTARKEVVGKPVSKEAASKTRDYMVTVGTDPYYGTLYAAGAPVIQVGNQSVAVK
       490        500        510        520        530        540        550

1986       2016       2046       2076       2106       2136       2166       2196
SGTAQIAQEGGGGYLQGKNDTINSVVAMVPSENPDFIMYVTIQQPEKFSITFWKDVVNPVLEQATAMKETILKPGLNDSE
||||||||||||||||||||||||||||||||||||||||||||||||||||||||||||||||||||||||||||||
SGTAQIAQEGGGGYLQGKNDTINSVVAMVPSENPDFIMYVTIQQPEKFSITFWKDVVNPVLEQATAMKETILKPVLNDSE
       570        580        590        600        610        620        630

2226       2256       2286       2316       2346       2376       2406       2436
HQTKYKLSKIVGENPGHVAEELRRNLVQPIILGNGSKVSKVSKRPGANLAENEQLLVLTNKLTELPDMYGWSKANVEQFA
||||||||||||||||||||||||||||||||||||||||||||||||||||||||||||||||||||||||||||||
HQTKYKLSKIVGENPGHVAEELRRNLVQPIILGNGSKVSKVSKRPGANLAENEQLLVLTNKLTELPDMYGWSKANVEQFA
       650        660        670        680        690        700        710

2466       2496       2526       2556       2586       2616       2646       2676
KWTGIKVTYKGSTSGKVRKQSIDVGKSINKIKKKIKITIGD*HVFKYNGRCHSICPDSYCHSALH*VLPIEENWRATNA*R
||||||||||||||||||||||||||||||||||||||||
KWTGIKVTYKGSTSGKVRKQSIDVGKSINKIKKKIKITIGD
       730        740        750
```

SEQ ID 8692 (GBS352d) was expressed in *E. coli* as a GST-fusion product. SDS-PAGE analysis of total cell extract is shown in FIG. 145 (lane 15 & 16; MW 105.5 kDa). It was also expressed in *E. coli* as a His-fusion product. SDS-PAGE analysis of total cell extract is shown in FIG. 145 (lane 17 & 18; MW 80.5 kDa), in FIG. 182 (lane 3; MW 80 kDa) and in FIG. 185 (lane 4; MW 105 kDa). Purified GBS352d-GST is shown in lane 5 of FIG. 236.

Based on this analysis, it was predicted that these proteins and their epitopes could be useful antigens for vaccines or diagnostics.

EXAMPLE 954

A DNA sequence (GBSx1012) was identified in *S. agalactiae* <SEQ ID 2907> which encodes the amino acid sequence <SEQ ID 2908>. Analysis of this protein sequence reveals the following:

```
Possible site: 36
>>>Seems to have no N-terminal signal sequence

----- Final Results -----
        bacterial cytoplasm --- Certainty = 0.1950 (Affirmative) < succ>
        bacterial membrane  --- Certainty = 0.0000 (Not Clear)   < succ>
         bacterial outside  --- Certainty = 0.0000 (Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 955

A DNA sequence (GBSx1013) was identified in *S. agalactiae* <SEQ ID 2909> which encodes the amino acid sequence <SEQ ID 2910>. This protein is predicted to be unnamed protein product (mraY). Analysis of this protein sequence reveals the following:

```
Possible site: 18
>> Seems to have a cleavable N-term signal seq.
   INTEGRAL Likelihood = -15.12  Transmembrane  56-72  (47-76)
   INTEGRAL Likelihood = -14.70  Transmembrane 203-219 (198-223)
   INTEGRAL Likelihood =  -6.69  Transmembrane 318-334 (315-335)
   INTEGRAL Likelihood =  -6.64  Transmembrane  83-99  (79-103)
   INTEGRAL Likelihood =  -5.52  Transmembrane 179-195 (175-197)
   INTEGRAL Likelihood =  -5.31  Transmembrane 232-248 (230-249)
   INTEGRAL Likelihood =  -3.08  Transmembrane 119-135 (119-137)
   INTEGRAL Likelihood =  -2.87  Transmembrane 151-167 (147-167)
   INTEGRAL Likelihood =  -2.34  Transmembrane 254-270 (254-270)

----- Final Results -----
         bacterial membrane  --- Certainty = 0.7050 (Affirmative) < succ>
         bacterial outside   --- Certainty = 0.0000 (Not Clear)   < succ>
         bacterial cytoplasm --- Certainty = 0.0000 (Not Clear)   < succ>
```

A related DNA sequence was identified in *S. pyogenes* <SEQ ID 2911> which encodes the amino acid sequence <SEQ ID 2912>. Analysis of this protein sequence reveals the following:

```
Possible site: 36
>>> Seems to have no N-terminal signal sequence
    INTEGRAL Likelihood = -9.55 Transmembrane  52-68  (48-75)
    INTEGRAL Likelihood = -9.39 Transmembrane 175-191 (171-194)
    INTEGRAL Likelihood = -8.12 Transmembrane  30-46  (23-48)
    INTEGRAL Likelihood = -6.37 Transmembrane 121-137 (119-145)
    INTEGRAL Likelihood = -6.32 Transmembrane 293-309 (287-309)
    INTEGRAL Likelihood = -5.31 Transmembrane 204-220 (202-221)
    INTEGRAL Likelihood = -5.20 Transmembrane 151-167 (150-170)
    INTEGRAL Likelihood = -4.67 Transmembrane 226-242 (224-244)
    INTEGRAL Likelihood = -0.11 Transmembrane  91-107 (91-107)
```

```
           -continued
----- Final Results -----
          bacterial membrane --- Certainty= 0.4821 (Affirmative) < succ>
          bacterial outside  --- Certainty= 0.0000 (Not Clear)   < succ>
          bacterial cytoplasm --- Certainty= 0.0000 (Not Clear)  < succ>
```

The protein has homology with the following sequences in the databases:

```
>GP: CAB70458 GB: A94911 unnamed protein product [unidentified]
Identities = 244/309 (78%), Positives = 273/309 (87%), Gaps = 1/309 (0%)

Query:   1 LKKIGGQQMHEDVKQHLAKAGTPTMGGTVFLLVATAVSLLVSLF-SIKNTQSLALISGIL   59
           LKKIGGQQMHEDVKQHLAKAGTPTMGGTVFL+VA  VSL+S+  S +N+ +L     GIL
Sbjct:  28 LKKIGGQQMHEDVKQHLAKAGTPTMGGTVFLVVALLVSLIFSIILSKENSGNLGATFGIL   87

Query:  60 SIVVIYGIIGFLDDFLKIFKQINEGLTAKQKLALQLVGGLMPYFLHVSPSGISSINVFGY  119
           S+V+IYGIIGFLDDFLKIFKQINEGLT KQK++LQL+ GL+FYF+HV PSG S+IN+FG+
Sbjct:  88 SVVLIYGIIGFLDDFLKIFKQINEGLTPKQKMSLQLIAGLIFYFVHVLPSGTSAINIFGF  147

Query: 120 QLPLGIFYLFFVLFWVVGFSNAVNLTDGIDGLASISVVISLVTYGVIAYVQSQFDVLLLI  179
           L +G  Y FFVLFWVVGFSNAVNLTDGIDGLASISVVISL+TYG+IAY Q+QFD+LL+I
Sbjct: 148 NLEVGYLYAFFVLFWVVGFSNAVNLTDGIDGLASISVVISLITYGIIAYNQTQFDILLII  207

Query: 180 GAMIGALLGFFCFNHKPAKVFMGDVGSLALGAMLAAISIALRQEWTLLIIGIVYVLETSS  239
              MIGALLGFF FNHKPAKVFMGDVGSLALGAMLAAISIALRQEWTLL  IG VYV ETSS
Sbjct: 208 VIMIGALLGFFVFNHKPAKVFMGDVGSLALGAMLAAISIALRQEWTLLFIGFVYVFETSS  267

Query: 240 VMLQVSYFKYTKKKYGEGRRIFRMTPFHHHLELGGLSGKGKKWSEWQVDAFLWGVGSLAS  299
           VMLQV+YFKYTKKK  C G+RIFRMTPFHHHLELGG+SGKG KWSEW+VDAFLW +G  S
Sbjct: 268 VMLQVAYFKYTKKKTGVGKRIFRMTPFHHHLELGGVSGKGNKWSEWKVDAFLWAIGIFMS  327

Query: 300 LLVLAILYV                                                    308
           + LAILY+
Sbjct: 328 AITLAILYL                                                    336
```

An alignment of the GAS and GBS proteins is shown below.

```
Identities = 244/309 (78%), Positives = 273/309 (87%), Gaps = 1/309 (0%)

Query:  28 LKKIGGQQMHEDVKQHLAKAGTPTMGGTVFLVVALLVSLIFSIILSKENSGNLGATFGIL   87
           LKKIGGQQMHEDVKQHLAKAGTPTMGGTVFL+VA  VSL+S+  S +N+ +L     GIL
Sbjct:   1 LKKIGGQQMHEDVKQHLAKAGTPTMGGTVFLLVATAVSLLVSLF-SIKNTQSLALISGIL   59

Query:  88 SVVLIYGIIGFLDDFLKIFKQINEGLTPKQKMSLQLIAGLIFYFVHVLPSGTSAINIFGF  147
           S+V+IYGIIGFLDDFLKIFKQINEGLT KQK++LQL+GL+FYF+HV PSG S+IN+FG+
Sbjct:  60 SIVVIYGIIGFLDDFLKIFKQINEGLTAKQKLALQLVGGLMPYFLHVSPSGISSINVFGY  119

Query: 148 YLEVGYLYAFFVLFWVVGFSNAVNLTDGIDGLASISVVISLITYGIIAYNQTQFDILLII  207
             L +G  Y FFVLFWVVGFSNAVNLTDGIDGLASISVVISL+TYG+IAY Q+QFD+LL+I
Sbjct: 120 QLPLGIFYLFFVLFWVVGFSNAVNLTDGIDGLASISVVISLVTYGVIAYVQSQFDVLLLI  179

Query: 208 VIMIGALLGFFVFNHKPAKVFMGDVGSLALGAMLAAISIALRQEWTLLFIGFVYVFETSS  267
              MIGALLGFF FNHKPAKVFMGDVGSLALGAMLAAISIALRQEWTLL  IG VYV ETSS
Sbjct: 180 GAMIGALLGFFCFNHKPAKVFMGDVGSLALGAMLAAISIALRQEWTLLIIGIVYVLETSS  239

Query: 268 VMLQVAYFKYTKKKTGVGKRIFRMTPFHHHLELGGVSGKGNKWSEWKVDAFLWAIGIFMS  327
           VMLQV+YFKYTKKK  G G+RIFRMTPFHHHLELGG+SGKG KWSEW+VDAFLW +G  S
Sbjct: 240 VMLQVSYFKYTKKKYGEGRRIFRMTPFHHHLELGGLSGKGKKWSEWQVDAFLWGVGSLAS  299

Query: 328 AITLAILYL                                                    336
           + LAILY+
Sbjct: 300 LLVLAILYV                                                    308
```

Based on this analysis, it was predicted that these proteins and their epitopes could be useful antigens for vaccines or diagnostics.

EXAMPLE 956

A DNA sequence (GBSx1014) was identified in *S. agalactiae* <SEQ ID 2913> which encodes the amino acid sequence <SEQ ID 2914>. This protein is predicted to be autoaggregation-mediating protein (deaD). Analysis of this protein sequence reveals the following:

Possible site: 29
>>> Seems to have no N-terminal signal sequence

----- Final Results -----
              bacterial cytoplasm --- Certainty = 0.3018(Affirmative) < succ>
                bacterial membrane --- Certainty = 0.0000(Not Clear) < succ>
                  bacterial outside --- Certainty = 0.0000(Not Clear) < succ>

The protein has homology with the following sequences in the GENPEPT database.

```
>GP:CAB14444 GB:Z99116 similar to ATP-dependent RNA helicase
[Bacillus subtilis]
Identities = 215/436 (49%), Positives = 310/436 (70%), Gaps = 5/436 (1%)
Query:   3 FKDFNFKPYIQRALDELKFVDPTDVQAKLIPVVRSGRDLVGESKTGSGKTHTFLLPIFEK   62
           F+ +  KP+I  A+  L F +PTD+Q  +LIP V     ++G+S+TG+GKTH +LLP+  K
Sbjct:   6 FELYELKPFIIDAVHRLGFYEPTDIQKRLIPAVLKKESVIGQSQTGTGKTHAYLLPLLNK   65

Query:  63 LDESSDDVQVVITAPSRELGTQIYQATKQIAEHSE-QEIRVVNYVGGTDKLRQIEKLKVS  121
           +D + D VQVVITAP+REL  QIYQ   +I +   E  +IR   ++GGTDK  I+KLK+
Sbjct:  66 IDPAKDVVQVVITAPTRELANQIYQEALKITQGEEGSQIRSKCFIGGTDKQKSIDKLKI-  124

Query: 122 QPHIVIGTPGRIYDLVKSGDLAIHKAHTFVVDEADMTLDMGFLDTVDKIAGSLPKDVQIL  181
           QPH+V+GTPGRI DL+K    L++HKA + V+DEAD+ LDMGFL  VD I    +P+D+Q+L
Sbjct: 125 QPHLVVGTPGRIADLIKEQALSVHKAESLVIDEADLMLDMGFLADVDYIGSRMPEDLQML  184

Query: 182 VFSATIPQKLQPFLKKYLTNPVMEKIKTATVIADTIDNWLLSTKGRDKNAQILELSKLMQ  241
           VFSATIP+KL+PFLKKY+ NP      ++   V A  I++ L+ +K RDK+ + ++     +
Sbjct: 185 VFSATIPEKLKPFLKKYMENPKYAHVEPKQVTAAKIEHILIPSKHRDKDKLLFDIMSHLN  244

Query: 242 PYLAMIFVNTKERADELHSYLSSNGLKVAKIHGGIAPRERKRIMNQVKNLEFEYIVATDL  301
           PYL ++F NTK  AD +  YL+  G+K+   +HGG+ PRERK++M Q+ +LEF YI+ATDL
Sbjct: 245 PYLGIVFANTKNTADHIAQYLTGKGMKIGLLHGGLTPRERKKVMKQINDLEFTYIIATDL  304

Query: 302 AARGIDIEGVSHVINDAIPQDLSFFVHRVGRTGRNGLSGTAITLYQPSDDSDIRELEKLG  361
           AARGIDI+GVSHVIN  +P DL F+VHRVGRT R G SG A+T+Y+ +D+  +   LEK+G
Sbjct: 305 AARGIDIKGVSHVINYELPDDLDFYVHRVGRTARAGSSGQAMTIYELTDEDALVRLEKMG  364

Query: 362 INFIPKVIKNGEFQDTYDRDRRNNREKSYQKLDTEMIGLVKKKKKKIKPGYKKKIQWKVD  421
            I F    ++ GE++    DR RR  R+K+  + D E+     + KK KK+KPGYKKK+ ++++
Sbjct: 365 IEFEYLELEKGEWKKGDDRQRRKKRKKTPNEAD-EIAHRLVKKPKKVKPGYKKKMSYEME  423

Query: 422 EKRRKERRASNRAKGR                                             437
           + ++K+RR   N++K R
Sbjct: 424 KIKKKQRR--NQSKKR                                             437
```

40

A related DNA sequence was identified in *S. pyogenes* <SEQ ID 2915> which encodes the amino acid sequence <SEQ ID 2916>. Analysis of this protein sequence reveals the following:

Possible site: 54
>>> Seems to have no N-terminal signal sequence

----- Final Results -----
              bacterial cytoplasm --- Certainty = 0.2315 (Affirmative) < succ>
                bacterial membrane --- Certainty = 0.0000 (Not Clear) < succ>
                  bacterial outside --- Certainty = 0.0000 (Not Clear) < succ>

An alignment of the GAS and GBS proteins is shown below.

```
Identities = 382/447 (85%), Positives = 420/447 (93%)
Query:   1 MSFKDFNFKPYIQRALDELKFVDPTDVQAKLIPVVRSGRDLVGESKTGSGKTHTFLLPIF   60
           MSFKD++FK Y+Q+AL+E+ FV+PT+VQ +LIP+V SGRDLVGESKTGSGKTHTFLLPIF
Sbjct:   1 MSFKDYHFKQYVQQALEEIGFVNPTEVQKRLIPIVNSGRDLVGESKTGSGKTHTFLLPIF   60

Query:  61 EKLDESSDDVQVVITAPSRELGTQIYQATKQIAEHSEQEIRVVNYVGGTDKLRQIEKLKV  120
           EKLDE+  +VQVVITAPSREL TQI+ A KQIA+H ++EIR+ NYVGGTDKLRQIEKLK
Sbjct:  61 EKLDEAKAEVQVVITAPSRELATQIFDACKQIAKHFQEEIRLANYVGGTDKLRQIEKLKD  120

Query: 121 SQPHIVIGTPGRIYDLVKSGDLAIHKAHTFVVDEADMTLDMGFLDTVDKIAGSLPKDVQI  180
```

-continued

```
          SQPHIVIGTPGRIYDLVKSGDLAIHKA TFVVDEADMT+DMGFLDTVDKIA  SLPK VQI
Sbjct: 121 SQPHIVIGTPGRIYDLVKSGDLAIHKATTFVVDEADMTMDMGFLDTVDKIAASLPKSVQI 180

Query: 181 LVFSATIPQKLQPFLKKYLTNPVMEKIKTATVIADTIDNWLLSTKGRDKNAQILELSKLM 240
           LVFSATIPQKLQPFLKKYLTNPV+E+IKT TVIADTIDNWL+STKGRDKN Q+LE+ K M
Sbjct: 181 LVFSATIPQKLQPFLKKYLTNPVIEQIKTKTVIADTIDNWLVSTKGRDKNGQLLEILKTM 240

Query: 241 QPYLAMIFVNTKERADELHSYLSSNGLKVAKIHGGIAPRERKRIMNQVKNLEFEYIVATD 300
           QPY+AM+FVNTKERAD+LH++L++NGLKVAKIHGGI PRERKRIMNQVK L+FEYIVATD
Sbjct: 241 QPYMAMLFVNTKERADDLHAFLTANGLKVAKIHGGIPPRERKRIMNQVKKLDFEYIVATD 300

Query: 301 LAARGIDIEGVSHVINDAIPQDLSFFVHRVGRTGRNGLSGTAITLYQPSDDSDIRELEKL 360
           LAARGIDIEGVSHVINDAIPQDLSFFVHRVGRTGRNG++GTAITLYQPSDDSDI+ELEK+
Sbjct: 301 LAARGIDIEGVSHVINDAIPQDLSFFVHRVGRTGRNGMAGTAITLYQPSDDSDIKELEKM 360

Query: 361 GINFIPKVIKNGEFQDTYDRDRRNNREKSYQKLDTEMIGLVKKKKKKIKPGYKKKIQWKV 420
           GI F PKV+KNGEFQDTYDRDRR NREK+YQKLDTEMIGLVKKKKKK+KPGYKKKIQW V
Sbjct: 361 GIAFTPKVLKNGEFQDTYDRDRRQNREKAYQKLDTEMIGLVKKKKKKVKPGYKKKIQWAV 420

Query: 421 DEKRRKERRASNRAKGRAERKAKKQSF                                 447
           DEKRRKERRA NRAKGRAERKAKKQ F
Sbjct: 421 DEKRRKERRAENRAKGRAERKAKKQHF                                 447
```

Based on this analysis, it was predicted that these proteins and their epitopes could be useful antigens for vaccines or diagnostics.

EXAMPLE 957

A DNA sequence (GBSx1015) was identified in *S. agalactiae* <SEQ ID 2917> which encodes the amino acid sequence <SEQ ID 2918>. This protein is predicted to be unnamed protein product. Analysis of this protein sequence reveals the following:

```
Possible site: 19
>>> Seems to have a cleavable N-term signal seq.

----- Final Results -----
              bacterial outside --- Certainty = 0.3000 (Affirmative) < succ>
             bacterial membrane --- Certainty = 0.0000 (Not Clear) < succ>
            bacterial cytoplasm --- Certainty = 0.0000 (Not Clear) < succ>
```

There is also homology to SEQ ID 2920.

A related GBS gene <SEQ ID 8693> and protein <SEQ ID 8694> were also identified. Analysis of this protein sequence reveals the following:

```
Lipop: Possible site: -1   Crend: 3
McG: Discrim Score: 8.85
GvH: Signal Score (-7.5): -1.77
Possible site: 19
>>> Seems to have a cleavable N-term signal seq.
ALOM program count: 0   value: 8.12             threshold: 0.0
PERIPHERAL           Likelihood = 8.12  182
modified ALOM score: -2.12

*** Reasoning Step: 3

----- Final Results -----
              bacterial outside --- Certainty = 0.3000 (Affirmative) < succ>
             bacterial membrane --- Certainty = 0.0000 (Not Clear) < succ>
```

The protein has homology with the following sequences in the databases:

```
EGAD|126750|collagen binding protein Insert characterized
GP|1617328|emb|CAA68052.1||X99716 collagen binding protein Insert characterized
```

```
ORF00181(331-1089 of 1410)
EGAD|126750|135177(23-260 of 263)collagen binding protein {Lactobacillus
reuteri}GP|1617328|emb|CAA68052.1||X99716 collagen binding protein
{Lactobacillus reuteri}
% Match = 11.2
% Identity = 35.4    % Similarity = 59.0
Matches = 69  Mismatches = 77  Conservative Sub.s = 46
       177       207       237       267       297       327       357       387
   KTKFLKLLKSEISSFQAFLLI*NLYHLIRKYYYTDRF*SVRLVI*YFRRILMFKKIILSIATIAATASLAVSVQASEKVE
                                   : ::    :   |  :        :   |  : ||  ||:  :    ||
                                   MKFWKKALLTIAALTVGTSAGITSVSAASSAVNSELVHKGE
                                   10        20        30        40
      417       447       477       507       537       567       597       627
   LKVATDSDTAPFTYQKDGKFKGYDVDVVKAVFKGSKYKVTFKTVPFDTISTGIDAGKFDLSANDFSYNKERAEKYLFSDP
   |  :   :  :|::|:|:  |:  |::||:  |||  |      |::    |: :||||:  |: :    |||::|  | |
   LTIGLEGTYSPYSYRKNNKLTGFEVDLGKAVAKKMGLKANFVPTKWDSLIAGLGSGKFDVVMNNITQTPERAKQYNFSTP
              60        70        80        90       100       110       120
      657       687       717       747
   XSRSNYAVVGKKGSHYKSLSDLSGKSTEVLSGVNYAQVLENWNKN-HPN-----------------------------
   :|  :|:::     |:  |||  |:  ||        : |   | |:: :   |    ||
   YIKSRFALIVPTDSNIKSLKDIKGKKIIAGTGTNNANVVKKYKGNLTPNGDFASSLDMIKQGRAAGTVNSREAWYAYSKK
              140       150       160       170       180       190       200
      789       819       849       879       909       939       969
   --------------KKPIKIKYVSGTTGVTSRLKNIESGKIDFILYDAISSDYIVKDQSLNLSVSPLKGKIGNNKDGLEY
                 : |  ||  :
   NSTKGLKMIDVSSEQDPAKISALF-----------------------------------------------------
                 220
      999      1029      1059      1089      1119      1149      1179      1209
   LLLPKDKKGKTLQKFINKRIKVLKENGTLARLSKQYFGGDYVSNIDK*ISETISFIFLHVRVLRDRITEIESLEKESRRN
   :||      :|     ||  :|  |:::||:    :||::|||  |
   -----NKKDTAIQSSYNKALKELQQDGTVKKLSEKYFGADITE
          230       240       250       260
```

SEQ ID 8694 (GBS8) was expressed in E. coli as a His-fusion product. SDS-PAGE analysis of total cell extract is shown in FIG. 2 (lane 5; MW 31 kDa), FIG. 63 (lane 2; MW 31.3 kDa), FIG. 66 (lane 2 & 3; MW 31 kDa), in FIG. 178 (lane 2; MW 31 kDa), in FIG. 179 (lane 3 & 4; MW 31 kDa) and in FIG. 180 (lane 3; MW 31 kDa). It was also expressed in E. coli as a GST-fusion product, with SDS-PAGE shown in FIG. 66 (lanes 4 & 5; MW 56 kDa) and in FIG. 180 (lanes 4 & 5; MW 55 kDa).

GBS8-His was purified as shown in FIGS. 189 (lane 7), 211 (lane 3), 228 (lanes 4-5) and 230 (lanes 3-6). Purified GBS8-GST is shown in FIG. 209, lane 6.

The GBS8-His fusion product was purified (FIG. 90A) and used to immunise mice (lane 2 product; 12.9 µg/mouse). The resulting antiserum was used for Western blot (FIG. 90B), FACS (FIG. 90C), and in the in vivo passive protection assay (Table III). These tests confirm that the protein is immunoaccessible on GBS bacteria and that it is an effective protective immunogen.

Based on this analysis, it was predicted that these proteins and their epitopes could be useful antigens for vaccines or diagnostics.

EXAMPLE 958

A DNA sequence (GBSx1016) was identified in S. agalactiae <SEQ ID 2921> which encodes the amino acid sequence <SEQ ID 2922>. Analysis of this protein sequence reveals the following:

```
Possible site: 30
>>> Seems to have no N-terminal signal sequence

----- Final Results -----
            bacterial cytoplasm --- Certainty = 0.3991 (Affirmative) < succ>
            bacterial membrane  --- Certainty = 0.0000 (Not Clear)   < succ>
            bacterial outside   --- Certainty = 0.0000 (Not Clear)   < succ>
```

The protein has no significant homology with any sequences in the GENPEPT database.

No corresponding DNA sequence was identified in S. pyogenes.

Based on this analysis, it was predicted that this protein and its epitopes, could be useful antigens for vaccines or diagnostics.

EXAMPLE 959

A DNA sequence (GBSx1017) was identified in S. agalactiae <SEQ ID 2923> which encodes the amino acid sequence <SEQ ID 2924>. This protein is predicted to be probable amino-acid abc transporter permease protein in idh-deor inter. Analysis of this protein sequence reveals the following:

```
Possible site: 56
>>> Seems to have no N-terminal signal sequence
INTEGRAL    Likelihood = -11.62      Transmembrane    50-66     (41-74)
INTEGRAL    Likelihood =  -0.90      Transmembrane    226-242   (226-242)
INTEGRAL    Likelihood =  -0.53      Transmembrane    80-96     (80-96)

----- Final Results -----
            bacterial membrane  --- Certainty = 0.5649 (Affirmative) < succ>
             bacterial outside  --- Certainty = 0.0000 (Not Clear)   < succ>
           bacterial cytoplasm  --- Certainty = 0.0000 (Not Clear)   < succ>
```

The protein has homology with the following sequences in the GENPEPT database.

```
>GP:CAB15985 GB:Z99124 similar to amino acid ABC transporter
(permease) [Bacillus subtilis]
Identities = 90/224 (40%), Positives = 137/224 (60%), Gaps = 10/224 (4%)
Query:  28 WKAVLDAIPSILERLPITLLLTVAGALFGLILALIFAVVKINRVKILYPIQALFVSFLRG  87
           W+ ++ A P++++ LPITL + +A  +F +I  LI A++  N++ +L+ +  L++SF RG
Sbjct:   6 WEFMISAFPTLIQALPITLFMAIAAMIFAIIGGLILALITKNKIPVLHQLSKLYISFFRG  65

Query:  88 TPILVQLMLSYYGIPLFLKFLNQKYGFDWNINAIPASVFAITAFAFNEAAYTSETIRAAI 147
           P LVQL L YYG+P        +++         + A   AI   +   AAY +E RAA+
Sbjct:  66 VPTLVQLFLIYYGLPQLFPEMSK---------MTALTAAIIGLSLKNAAYLAEIFRAAL 115

Query: 148 LSVDQGEIEAARSLGMTSAQVYRRVIIPNAAVVATPTLINTLIGLTKGTSLAFNAGIVEM 207
           SVD G++EA  S+GMT Q YRR+I+P A   A P    NT IGL K TSLAF  G++EM
Sbjct: 116 NSVDDGQLEACLSVGMTKFQAYRRIILPQAIRNAIPATGNTFIGLLKETSLAFTLGVMEM 175

Query: 208 FAQAQIMGGSDYRYFERYISVALVYWAVSFLIEQLGNAIERKMA                251
           FAQ ++     + +YFE Y++VA+VYW ++ +    L +   ER M+
Sbjct: 176 FAQGKMYASGNLKYFETYLAVAIVYWVLTIIYSILQDLFERAMS                219
```

A related DNA sequence was identified in *S. pyogenes* <SEQ ID 2925> which encodes the amino acid sequence <SEQ ID 2926>. Analysis of this protein sequence reveals the following:

```
Possible site: 43
>>> Seems to have no N-terminal signal sequence
    INTEGRAL    Likelihood = -7.27     Transmembrane    80-96    (74-104)
    INTEGRAL    Likelihood = -1.06     Transmembrane    207-223  (207-223)
    INTEGRAL    Likelihood = -0.90     Transmembrane    110-126  (110-126)

----- Final Results -----
            bacterial membrane  --- Certainty = 0.3909(Affirmative) < succ>
             bacterial outside  --- Certainty = 0.0000(Not Clear)   < succ>
           bacterial cytoplasm  --- Certainty = 0.0000(Not Clear)   < succ>
```

A related sequence was also identified in GAS <SEQ ID 9167> which encodes the amino acid sequence <SEQ ID 9168>. Analysis of this protein sequence reveals the following:

```
Possible site: 60
>>> Seems to have no N-terminal signal sequence
    INTEGRAL    Likelihood = -7.27     Transmembrane    50-66    (44-74)
    INTEGRAL    Likelihood = -1.06     Transmembrane    177-193  (177-193)
    INTEGRAL    Likelihood = -0.90     Transmembrane    80-96    (80-96)

----- Final Results -----
            bacterial membrane  --- Certainty = 0.391(Affirmative) < succ>
             bacterial outside  --- Certainty = 0.0000(Not Clear)  < succ>
           bacterial cytoplasm  --- Certainty = 0.0000(Not Clear)  < succ>
```

An alignment of the GAS and GBS proteins is shown below.

```
Identities = 212/267 (79%), Positives = 238/267 (88%)

Query:   1 MNQFILTGGWSWYNNLVSQVPAGKLFSWKAVLDAIPSILERLPITLLLTVAGALFGLILA  60
```

```
                M     LT GW++Y+ L+S +P GKLFSW AV DAIP+I++RLPITL LT++GA FGL+LA
Sbjct:   31 MTSVFLTSGWAFYDYLISPIPHGKLFSWHAVFDAIPNIIQRLPITLGLTLSGATFGLVLA   90

Query:   61 LIFAVVKINRVKILYPIQALFVSFLRGTPILVQLMLSYYGIPLFLKFLNQKYGFDWNINA  120
            LIFA+VKIN+VK+LYPIQA+FVSFLRGTPILVQLML+YYGIPLFLKFLNQKYGFDWN+NA
Sbjct:   91 LIFALVKINKVKLLYPIQAIFVSFLRGTPILVQLMLTYYGIPLFLKFLNQKYGFDWNVNA  150

Query:  121 IPASVFAITAFAFNEAAYTSETIRAAILSVDQGEIEAARSLGMTSAQVYRRVIIPNAAVV  180
            IPAS+FAITAFAFNEAAY SETIRAAILSVD GEIEAA+SLGMTS QVYRRVIIPNA VV
Sbjct:  151 IPASIFAITAFAFNEAAYASETIRAAILSVDTGEIEAAKSLGMTSVQVYRRVIIPNATVV  210

Query:  181 ATPTLINTLIGLTKGTSLAFNAGIVEMFAQAQIMGGSDYRYFERYISVALVYWAVSFLIE  240
            A PTLIN LIGLTKGTSLAFNAGIVEMFAQAQI+GGSDYRYFERYISVALVYW++S L+E
Sbjct:  211 AIPTLINGLIGLTKGTSLAFNAGIVEMFAQAQILGGSDYRYFERYISVALVYWSISILME  270

Query:  241 QLGNAIERKMAIKAPRHLTDEIPGGVR                                  267
            Q+G  IE KMAIKAP      +E  G  +R
Sbjct:  271 QVGRLIENKMAIKAPEQARNEKLGELR                                  297
```

There is also homology to SEQ ID 4794.

Based on this analysis, it was predicted that these proteins and their epitopes could be useful antigens for vaccines or diagnostics.

EXAMPLE 960

A DNA sequence (GBSx1018) was identified in *S. agalactiae* <SEQ ID 2927> which encodes the amino acid sequence <SEQ ID 2928>. This protein is predicted to be amino acid ABC transporter, ATP-binding protein. Analysis of this protein sequence reveals the following:

```
Possible site: 46
>>> Seems to have no N-terminal signal sequence

----- Final Results -----
            bacterial cytoplasm --- Certainty = 0.3205(Affirmative) < succ>
            bacterial membrane  --- Certainty = 0.0000(Not Clear)   < succ>
             bacterial outside  --- Certainty = 0.0000(Not Clear)   < succ>
```

The protein has homology with the following sequences in the GENPEPT database.

```
>GP: AAC00329 GB: AF008220 putative amino acid
transporter [Bacillus subtilis]
Identities = 121/247 (48%), Positives = 176/247 (70%)

Query:    1 MIKLRQLTKSFSGQKVLDKLDLDIEKGQVVALVGASGAGKSTFLRSMNYLEEPDYGTIEI   60
            MI+++ + K F      VL  ++L + KG+VV ++G SG+GK+TFLR +N LE PD G I I
Sbjct:    1 MIEIKNIHKQFGIHHVLKGINLTVRKGEVVTIIGPSGSGKTTFLRCLNLLERPDEGIISI   60

Query:   61 DDFKVDFKSISKDDILTLRRKLAMVFQQFNLFERRTALDNVKEGLKIVKKMSDQEATRIA  120
            D  ++ +   SK ++   LR++ AMVFQQ++LF  +T ++NV EGL I +KM  Q+A  +A
Sbjct:   61 HDKVINCRFPSKKEVHWLRKQTAMVFQQYHLFAHKTVIENVMEGLTIARKMRKQDAYAVA  120

Query:  121 RDELAKVGLADREKYYPRHLSGGQKQRVALARALAMKPDVLLLDEPTSALDPELVGEVEK  180
            +EL KVGL D+    YP  LSGGQKQRV +ARALA+ PDVLL DEPT+ALDPELVGEV +
Sbjct:  121 ENELRKVGLQDKLNAYPSQLSGGQKQRVGIARALAIHPDVLLFDEPTAALDPELVGEVLE  180

Query:  181 SIADAAKQGQTMVLVSHDMNFVYQVADKVLFLEKGRILESGTPEQLFNHPLEERTKEFFA  240
            + +    K G TM++V+H+M F   +V+D+V+F+++G I+E GTPE++F H   ++RT++F
Sbjct:  181 VMLEIVKTGATMIVVTHEMEFARRVSDQVVFMDEGVIVEQGTPEEVFRHTKKDRTRQFLR  240

Query:  241 SYNKSYL                                                      247
              + YL
Sbjct:  241 RVSPEYL                                                      247
```

A related DNA sequence was identified in *S. pyogenes* <SEQ ID 2929> which encodes the amino acid sequence <SEQ ID 2930>. Analysis of this protein sequence reveals the following:

```
Possible site: 13
>>> Seems to have no N-terminal signal sequence

----- Final Results -----
            bacterial cytoplasm --- Certainty = 0.1840(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below.

```
Identities = 199/247 (80%), Positives = 229/247 (92%)

Query:    1 MIKLRQLTKSFSGQKVLDKLDLDIEKGQVVALVGASGAGKSTFLRSMNYLEEPDYGTIEI   60
            MI +R L+K+FSGQKVLD L LDIEKGQV+ALVGASGAGKSTFLRS+NYLE+PD G+I I
Sbjct:    2 MITIRNLSKTFSGQKVLDSLALDIEKGQVIALVGASGAGKSTFLRSLNYLEKPDSGSISI   61

Query:   61 DDFKVDFKSISKDDILTLRRKLAMVFQQFNLFERRTALDNVKEGLKIVKKMSDQEATRIA   120
            DF VDF++I+ + +L LRRKLAMVFQQFNLFERRTAL+NVKSGLK+VKK+SDQEAT++A
Sbjct:   62 GDFTVDFETITTEQVLILRRKLAMVFQQFNLFERRTALENVKEGLKVVKKLSDQEATKLA   121

Query:  121 RDELAKVGLADREKYYPRHLSGGQKQRVALARALAMKPDVLLLDEPTSALDPELVGEVEK   180
            + ELAKVGLADR+ +YPRHLSGGQKQRVALARALAMKPDVLLLDEPTSALDPELVGEVEK
Sbjct:  122 QAELAKVGLADRKHHYPRHLSGGQKQRVALARALAMKPDVLLLDEPTSALDPELVGEVEK   181

Query:  181 SIADAAKQGQTMVLVSHDMNFVYQVADKVLFLEKGRILESGTPEQLFNHPLEERTKEFFA   240
            SI DAAK GQTMVLVSHDMNFVYQVAD+VLFL++G+ILE GTPE++F HP +ERTKEFFA
Sbjct:  182 SITDAAKSGQTMVLVSHDMNFVYQVADRVLFLDQGKILEQGTPEEVFRHPQKERTKEFFA   241

Query:  241 SYNKSYL                                                       247
            SY+K+Y+
Sbjct:  242 SYSKTYI                                                       248
```

Based on this analysis, it was predicted that these proteins and their epitopes could be useful antigens for vaccines or diagnostics.

EXAMPLE 961

A DNA sequence (GBSx1019) was identified in *S. agalactiae* <SEQ ID 2931> which encodes the amino acid sequence <SEQ ID 2932>. Analysis of this protein sequence reveals the following:

```
Possible site: 17
>>> Seems to have no N-terminal signal sequence

----- Final Results -----
            bacterial cytoplasm --- Certainty = 0.831(Affirmative) < succ>
             bacterial membrane --- Certainty = 0.0000(Not Clear)  < succ>
              bacterial outside --- Certainty = 0.0000(Not Clear)  < succ>
```

The protein has homology with the following sequences in the GENPEPT database.

```
>GP: BAB07290 GB: AP001519 thioredoxin reductase
(NADPH) [Bacillus halodurans]
Identities = 173/302 (57%), Positives = 234/302 (77%)

Query:    1 MYDTLIIGSGPGGMTAALYAARSNLKVGLIEQGAPGGQMNNTAEIENYPGYDHISGPELS   60
            +YD +I G+GP GMTAA+Y +R+NL   ++E+G PGGQM NT ++ENYPG+DHI GPELS
Sbjct:    7 VYDVVIAGAGPAGMTAAVYTSRANLSTVMVERGVPGGQMANTEDVENYPGFDHILGPELS   66

Query:   61 MKMYEPLEKFEVEHIYGIVQRVENDGDVKRVITEDESYEAKTVILATGAKNSLLGVPGEE   120
            KM+E  +KF  E+ YG ++ + + GD+K V   ++ Y+A+ VI+ATGA+    LGVPGE+
Sbjct:   67 TKMFEHAKKFGAEYAYGDIKEIIDQGDLKLVKAGNKEYKARAVIVATGAEYKKLGVPGEK   126

Query:  121 EYTSRGVSYCAVCDGAFFRDQDLLVVGGGDSAVEEAVFLTQFAKSVTIIHRRDQLRAQKV   180
            E + RGVSYCAVCDGAFF+ ++L+VVGGGDSAVEEAV+LT+FA  VTIIHRRDQLRAQK+
Sbjct:  127 ELSGRGVSYCAVCDGAFFKGKELVVVGGGDSAVEEAVYLTRFASKVTIIHRRDQLRAQKI   186

Query:  181 LQDRAFANEKIKFVWDSVVKEIKGNEIKVSGVTVENLKTGEISEMTFGGVFIYVGLKPHS   240
```

-continued

```
              LQ RAF N+KI+F+WD VVK+I G + KVS VT+E+ KTGE   +      GVFIY+G+ P +
Sbjct: 187 LQQRAFDNDKIEFIWDHVVKQINGTDGKVSSVTIEHAKTGEQQDFKTDGVFIYIGMLPLN 246

Query: 241 SMVSELGITDETGWVLTDTNMKTSIPGLYAIGDVRQKDLRQIATAVGEGAIAGQGVYNYI 300
              V  L I ++ G+++T+  M+TS+PG++A GDVR+K LRQI TA G+G++A Q V +YI
Sbjct: 247 EAVKNLNILNDEGYIVTNEEMETSVPGIFAAGDVREKSLRQIVTATGDGSLAAQNVQHYI 306

Query: 301 TE                                                         302
              E
Sbjct: 307 EE                                                         308
```

A related DNA sequence was identified in *S. pyogenes* <SEQ ID 2933> which encodes the amino acid sequence <SEQ ID 2934>. Analysis of this protein sequence reveals the following:

```
Possible site: 28
>>> Seems to have no N-terminal signal sequence

----- Final Results -----
              bacterial cytoplasm --- Certainty = 0.386 (Affirmative) < succ>
               bacterial membrane --- Certainty = 0.0000 (Not Clear)  < succ>
                bacterial outside --- Certainty = 0.0000 (Not Clear)  < succ>
```

An alignment of the GAS and GBS proteins is shown below.

```
Identities = 236/300 (78%), Positives = 273/300 (90%)

Query:   1 MYDTLIIGSGPGGMTAALYAARSNLKVGLIEQGAPGGQMNNTAEIENYPGYDHISGPELS  60
           MYDTLIIGSGP GMTAALYAARSNL V +IEQGAPGGQMNNT +IENYPGYDHISGPEL+
Sbjct:   1 MYDTLIIGSGPAGMTAALYAARSNLSVAIIEQGAPGGQMNNTFDIENYPGYDHISGPELA  60

Query:  61 MKMYEPLEKFEVEHIYGIVQRVENDGDVKRVITEDESYEAKTVILATGAKNSLLGVPGEE 120
           MKMYEPLEKF VE+IYGIVQ++EN GD K V+TED SYEAKTVI+ATGAK  +LGVPGEE
Sbjct:  61 MKMYEPLEKFNVENIYGIVQKIENFGDYKCVLTEDASYEAKTVIIATGAKYRVLGVPGEE 120

Query: 121 EYTSRGVSYCAVCDGAFFRDQDLLVVGGGDSAVEEAVFLTQFAKSVTIIHRRDQLRAQKV 180
           YTSRGVSYCAVCDGAFFRDQDLLVVGGGDSAVEEA++LTQFAK VT++HRRDQLRAQK+
Sbjct: 121 YYTSRGVSYCAVCDGAFFRDQDLLVVGGGDSAVEEAIYLTQFAKKVTVVHRRDQLRAQKI 180

Query: 181 LQDRAFANEKIKFVWDSVVKEIKGNEIKVSGVTVENLKTGEISEMTFGGVFIYVGLKPHS 240
           LQDRAFAN+K+ F+WDSVVKEI+GN+IKVS V +EN+KTG++++  FGGVFIYVG+ P +
Sbjct: 181 LQDRAFANDKVDFIWDSVVKEIQGNDIKVSNVLIENVKTGQVTDHAFGGVFIYVGMNPVT 240

Query: 241 SMVSELGITDETGWVLTDTNMKTSIPGLYAIGDVRQKDLRQIATAVGEGAIAGQGVYNYI 300
            MV +L ITD  GW++TD +M+TSIPG++AIGDVRQKDLRQI TAVG+GAIAGQGVY+Y+
Sbjct: 241 GMVKDLEITDSEGWIITDDHMRTSIPGIFAIGDVRQKDLRQITTAVGDGAIAGQGVYHYL 300
```

Based on this analysis, it was predicted that these proteins and their epitopes could be useful antigens for vaccines or diagnostics.

EXAMPLE 962

A DNA sequence (GBSx1020) was identified in *S. agalactiae* <SEQ ID 2935> which encodes the amino acid sequence <SEQ ID 2936>. Analysis of this protein sequence reveals the following:

```
Possible site: 35
>>> Seems to have no N-terminal signal sequence

----- Final Results -----
              bacterial cytoplasm --- Certainty = 0.3626 (Affirmative) < succ>
               bacterial membrane --- Certainty = 0.0000 (Not Clear)   < succ>
                bacterial outside --- Certainty = 0.0000 (Not Clear)   < succ>
```

The protein has homology with the following sequences in the GENPEPT database.

```
>GP: CAB15163 GB: Z99120 similar to nicotinate
phosphoribosyltransferase [Bacillus subtilis]
Identities = 309/476 (64%), Positives = 384/476 (79%), Gaps = 2/476 (0%)

Query:   2 YKDDSLTLHTDLYQINMMQVYFNKGIHNKRAVFEAYFRKVPFENGYAVFAGLERIVRYLE  61
           +KDDSL+LHTDLYQINM + Y+  GIH K+A+FE +FR++PFENGYAVFAGLE+ + YLE
Sbjct:   6 FKDDSLSLHTDLYQINMAETYWRDGIHEKKAIFELFFRRLPFENGYAVFAGLEKAIEYLE  65

Query:  62 NLSFSDSDLSYLE-ELGYPEEFLDYLKNLKMELTVKSAKEGDLVFANEPLVQIEGPLAQC 120
           N  F+DSDLSYL+ ELGY E+F++YL+ L    ++ S KEG+LVF NEP++++E PL +
Sbjct:  66 NFKFTDSDLSYLQDELGYHEDFIEYLRGLSFTGSLYSMKEGELVFNNEPIMRVEAPLVEA 125

Query: 121 QLVETAILNIINYQTLVATKAARIRSVIEDEPLLEFGTRRAQEMDAAIWGTRAAIIGGAN 180
           QL+ETA+LNI+NYQTL+ATKAARI+ VI DE  LEFGTRRA EMDAA+WG RAA+IGG +
Sbjct: 126 QLIETALLNIVNYQTLIATKAARIKGVIGDEVALEFGTRRAHEMDAAMWGARAALIGGFS 185

Query: 181 ATSNVRAGKIFNIPVSGTHAHALVQTYGDDYQAFKAYAETHKDCVFLVDTYDTLRVGVPN 240
           ATSNVRAGK FNIPVSGTHAHALVQ Y D+Y AFK YAETHKDCVFLVDTYDTLR G+PN
Sbjct: 186 ATSNVRAGKRFNIPVSGTHAHALVQAYRDEYTAFKKYAETHKDCVFLVDTYDTLRSGMPN 245

Query: 241 AIRVAKEMGEKINFLGVRLDSGDLAYLSKKVRQQLDDAGFPNAKIYASNDLDENTILNLK 300
           AIRVAKE G++INF+G+RLDSGDLAYLSKK R+ LD+AGF +AK+ AS+DLDE+TI+NLK
Sbjct: 246 AIRVAKEFGDRINFIGIRLDSGDLAYLSKKARKMLDEAGFTDAKVIASSDLDEHTIMNLK 305

Query: 301 MQKAKIDVWGVGTKLITAYDQPALGAVYKIVSIETDAGSMRDTIKLSNNAEKVSTPGKKQ 360
           Q A+IDVWGVGTKLITAYDQPALGAVYK+V+IE D G M DTIK+S+N EKV+TPG+K+
Sbjct: 306 AQGARIDVWGVGTKLITAYDQPALGAVYKLVAIEED-GKMVDTIKISSNPEKVTTPGRKK 364

Query: 361 VWRITSRAKGKSEGDYITFADTDVTQLDEIEMFHPTYTYINKTVRDFDAVPLLVDIFDKG 420
           V+RI +++   SEGDYI  D V    + MFHP +T+I+K V +F A  L   IF+KG
Sbjct: 365 VYRIINQSNHHSEGDYIALYDEQVNDQKRLRMFHPVHTFISKFVTNFYAKDLHELIFEKG 424

Query: 421 KLVYQLPSLQEIQEYGRKEFDQLWDEYKRVLNPQDYPVDLARDVWQNKMDLIDRIR    476
           L YQ P + +IQ+Y +    LW+EYKR+ P++YPVDL+ D W NKM  I  ++
Sbjct: 425 ILCYQNPEISDIQQYVQDNLSLLWEEYKRISKPEEYPVDLSEDCWSNKMQRIHEVK    480
```

A related DNA sequence was identified in *S. pyogenes* <SEQ ID 2937> which encodes the amino acid sequence <SEQ ID 2938>. Analysis of this protein sequence reveals the following:

```
Possible site: 32
>>> Seems to have no N-terminal signal sequence

----- Final Results -----
           bacterial cytoplasm --- Certainty = 0.3192(Affirmative) < succ>
            bacterial membrane --- Certainty = 0.0000(Not Clear)   < succ>
             bacterial outside --- Certainty = 0.0000(Not Clear)   < succ>
```

An alignment of the GAS and GBS proteins is shown below.

```
Identities = 409/484 (84%), Positives = 446/484 (91%)

Query:   1 MYKDDSLTLHTDLYQINMMQVYFNKGIHNKRAVFEAYFRKVPFENGYAVFAGLERIVRYL  60
           MYKDDSLTLHTDLYQINMMQVYF +GIHN+ AVFE YFRK PF NGYAVFAGL+R+V YL
Sbjct:   1 MYKDDSLTLHTDLYQINMMQVYFEQGIHNRHAVFEVYFRKEPFNNGYAVFAGLQRMVEYL  60

Query:  61 ENLSFSDSDLSYLEELGYPEEFLDYLKNLKMELTVKSAKEGDLVFANEPLVQIEGPLAQC 120
           E    FS++DL+YLEELGYPE FL YLK L++ELT++SAKEGDLVFANEP+VQ+EGPL QC
Sbjct:  61 EQFQFSETDLAYLEELGYPENFLTYLKELRLELTIRSAKEGDLVFANEPIVQVEGPLGQC 120

Query: 121 QLVETAILNIINYQTLVATKAARIRSVIEDEPLLEFGTRRAQEMDAAIWGTRAAIIGGAN 180
           QLVETA+LNI+N+QTL+ATKAARIRSVIEDEPLLEFGTRRAQE+DAAIWGTRAA+IGGA+
Sbjct: 121 QLVETALLNIVNFQTLIATKAARIRSVIEDEPLLEFGTRRAQELDAAIWGTRAAMIGGAD 180

Query: 181 ATSNVRAGKIFNIPVSGTHAHALVQTYGDDYQAFKAYAETHKDCVFLVDTYDTLRVGVPN 240
           ATSNVRAGK F+IPVSGTHAHALVQ YG+DY AF AYA+THKDCVFLVDTYDTL+VGVP
Sbjct: 181 ATSNVRAGKRFDIPVSGTHAHALVQAYGNDYDAFMAYAKTHKDCVFLVDTYDTLKVGVPT 240

Query: 241 AIRVAKEMGEKINFLGVRLDSGDLAYLSKKVRQQLDDAGFPNAKIYASNDLDENTILNLK 300
           AIRVAKEMG+KINFLGVRLDSGDLAYLSK VRQQLDDAGF  AKIYASNDLDENTILNLK
Sbjct: 241 AIRVAKEMGDKINFLGVRLDSGDLAYLSKTVRQQLDDAGFTEAKIYASNDLDENTILNLK 300

Query: 301 MQKAKIDVWGVGTKLITAYDQPALGAVYKIVSIETDAGSMRDTIKLSNNAEKVSTPGKKQ 360
           MQKAKIDVWGVGTKLITAYDQPALGAVYKIVSIE + GSMRDTIKLSNNAEKVSTPGKKQ
```

-continued

```
Sbjct: 301 MQKAKIDVWGVGTKLITAYDQPALGAVYKIVSIEQEDGSMRDTIKLSNNAEKVSTPGKKQ 360

Query: 361 VWRITSRAKGKSEGDYITFADTDVTQLDEIEMFHPTYTYINKTVRDFDAVPLLVDIFDKG 420
           VWRITSR KGKSEGDYITF D +V +L EIEMFHPTYTYI KTV++FDA+PLLVDIF KG
Sbjct: 361 VWRITSREKGKSEGDYITFTDINVNELTEIEMFHPTYTYIKKTVKEFDAIPLLVDIFVKG 420

Query: 421 KLVYQLPSLQEIQEYGRKEFDQLWDEYKRVLNPQDYPVDLARDVWQNKMDLIDRIRKEAL 480
           +LVYQLP+L EI+ Y +KEFD+LWDEYKRVLNPQDYPVDLARDVWQNKM LID IRK+A
Sbjct: 421 ELVYQLPTLAEIKAYAKKEFDKLWDEYKRVLNPQDYPVDLARDVWQNKMALIDNIRKDAY 480

Query: 481 AKGE                                                         484
           K E
Sbjct: 481 GKSE                                                         484
```

Based on this analysis, it was predicted that these proteins and their epitopes could be useful antigens for vaccines or diagnostics.

EXAMPLE 963

A DNA sequence (GBSx1021) was identified in *S. agalactiae* <SEQ ID 2939> which encodes the amino acid sequence <SEQ ID 2940>. Analysis of this protein sequence reveals the following:

```
Possible site: 56
>>> Seems to have no N-terminal signal sequence

----- Final Results -----
            bacterial cytoplasm --- Certainty = 0.2744(Affirmative) < succ>
             bacterial membrane --- Certainty = 0.0000(Not Clear) < succ>
              bacterial outside --- Certainty = 0.0000(Not Clear) < succ>
```

The protein has homology with the following sequences in the GENPEPT database.

```
>GP:AAC74810 GB:AE000269 NAD synthetase, prefers NH3 over glutamine
[Escherichia coli K12]
Identities = 173/274 (63%), Positives = 214/274 (77%), Gaps = 1/274 (0%)

Query:    1 MTLQDQIIKELGVKPVINPSQEIRRSVEFLKDYLLKHSFLKTYVLGISGGQDSTLAGRLA    60
            MTLQ QIIK LG KP IN +EIRRSV+FLK YL  + F+K+ VLGISGGQDSTLAG+L
Sbjct:    1 MTLQQQIIKALGAKPQINAEEEIRRSVDFLKSYLQTYPFIKSLVLGISGGQDSTLAGKLC    60

Query:   61 QLAVEELRADTG-ENYQFIAIRLPYGIQADEEDAQKALDFIKPDIALTINIKEAVDGQVR   119
            Q+A+ ELR +TG E+ QFIA+RLPYG+QADE+D Q A+ FI+PD  LT+NIK AV    +
Sbjct:   61 QMAINELRLETGNESLQFIAVRLPYGVQADEQDCQDAIAFIQPDRVLTVNIKGAVLASEQ   120

Query:  120 ALNAAGVEITDFNKGNIKARQRMISQYAVAGQYAGAVIGTDHAAENITGFFTKFGDGGAD   179
            AL  AG+E++DF +GN KAR+RM +QY++AG  +G V+GTDHAAE ITGFFTK+GDGG D
Sbjct:  121 ALREAGIELSDFVRGNEKARERMKAQYSIAGMTSGVVVGTDHAAEAITGFFTKYGDGGTD   180

Query:  180 LLPLFRLNKSQGKQLLAELGADKALYEKIPTADLEENKPGIADEIALGVTYQEIDAYLEG   239
            + PL+RLNK QGKQLLA L  + LY+K PTADLE+++P + DE+ALGVTY  ID YLEG
Sbjct:  181 INPLYRLNKRQGKQLLAALACPEHLYKKAPTADLEDDRPSLPDEVALGVTYDNIDDYLEG   240

Query:  240 KVVSDKSRGIIENWWYKGQHKRHLPITIFDDFWK                            273
            K V +    IENW+ K +HKR  PIT+FDDFWK
Sbjct:  241 KNVPQQVARTIENWYLKTEHKRRPPITVFDDFWK                            274
```

A related DNA sequence was identified in *S. pyogenes* <SEQ ID 2941> which encodes the amino acid sequence <SEQ ID 2942>. Analysis of this protein sequence reveals the following:

```
Possible site: 18
>>> Seems to have no N-terminal signal sequence

----- Final Results -----
            bacterial cytoplasm --- Certainty = 0.3482(Affirmative) < succ>
             bacterial membrane --- Certainty = 0.0000(Not Clear) < succ>
              bacterial outside --- Certainty = 0.0000(Not Clear) < succ>
```

An alignment of the GAS and GBS proteins is shown below.

```
Identities = 213/274 (77%), Positives = 242/274 (87%), Gaps = 1/274 (0%)

Query:    1 MTLQDQIIKELGVKPVINPSQEIRRSVEFLKDYLLKHSFLKTYVLGISGGQDSTLAGRLA   60
            MTLQ++II++LGVK  I+P +EIR++V+FLK YL KHSFLKTYVLGISGGQDSTLAG+LA
Sbjct:   15 MTLQEEIIRQLGVKASIDPQEEIRKAVDFLKAYLRKHSFLKTYVLGISGGQDSTLAGKLA   74

Query:   61 QLAVEELRADTGEN-YQFIAIRLPYGIQADEEDAQKALDFIKPDIALTINIKEAVDGQVR  119
            Q+A+ ELR + +  YQFIA+RLPYG+QADE DAQKAL FI PD  LTINIK AVDGQV
Sbjct:   75 QMAIAELREEASDQAYQFIAVRLPYGVQADEADAQKALAFIAPDQTLTINIKAAVDGQVE  134

Query:  120 ALNAAGVEITDFNKGNIKARQRMISQYAVAGQYAGAVIGTDHAAENITGFFTKFGDGGAD  179
            AL AAGVEI+DFNKGNIKARQRMISQYA+AGQ AGAVIGTDHAAENITGFFTKFGDGGAD
Sbjct:  135 ALQAAGVEISDFNKGNIKARQRMISQYAIAGQMAGAVIGTDHAAENITGFFTKFGDGGAD  194

Query:  180 LLPLFRLNKSQGKQLLAELGADKALYEKIPTADLEENKPGIADEIALGVTYQEIDAYLEG  239
            +LPLFRLNK QGK LL  LGAD ALYEK+PTADLE+ KPG+ADE+ALGVTYQ+ID YLEG
Sbjct:  195 ILPLFRLNKRQGKALLKVLGADAALYEKVPTADLEDQKPGLADEVALGVTYQDIDDYLEG  254

Query:  240 KVVSDKSRGIIENWWYKGQHKRHLPITIFDDFWK                           273
            K++S ++   IE WW+KGQHKRHLPITIFDDFWK
Sbjct:  255 KLISKVAQATIEKWWHKGQHKRHLPITIFDDFWK                           288
```

Based on this analysis, it was predicted that these proteins and their epitopes could be useful antigens for vaccines or diagnostics.

EXAMPLE 964

A DNA sequence (GBSx1022) was identified in *S. agalactiae* <SEQ ID 2943> which encodes the amino acid sequence <SEQ ID 2944>. Analysis of this protein sequence reveals the following:

```
Possible site: 28
>>> Seems to have no N-terminal signal sequence

----- Final Results -----
              bacterial cytoplasm --- Certainty = 0.2718(Affirmative) < succ>
              bacterial membrane  --- Certainty = 0.0000(Not Clear)   < succ>
              bacterial outside   --- Certainty = 0.0000(Not Clear)   < succ>
```

The protein has homology with the following sequences in the GENPEPT database.

```
>GP:CAA82960 GB:Z30315 aminopeptidase C [Streptococcus thermophilus]
Identities = 363/444 (81%), Positives = 407/444 (90%)

Query:    1 MSKLTQTFTDKLFADYQANTKFSAIENAVTHNGLLKSLETRQSEIENDYVFSIDLTKDEV   60
            M+ L+  FT+KLFADY+AN K+ AIENAVTHNGLLKS+ETRQSE+END+VFSIDLTKDEV
Sbjct:    1 MTSLSTDFTEKLFADYEANAKYGAIENAVTHNGLLKSIETRQSEVENDFVFSIDLTKDEV   60

Query:   61 SNQKQSGRCWMFAALNTFRHKLISDFKLENFELSQAHTFFWDKYEKSNWFMEQIIATANQ  120
            SNQK SGRCWMFAALNTFRHKLISDFKLE+FELSQAHTFFWDKYEKSNWF+EQIIATA+Q
Sbjct:   61 SNQKASGRCWMFAALNTFRHKLISDFKLESFELSQAHTFFWDKYEKSNWFLEQIIATADQ  120

Query:  121 ELSSRKVKFLLDVPQQDGGQWDMVVALFEKYGVVPKTVYPESVSSSASRELNQYLNKLLR  180
            E+  SRKVKFLLD PQQDGGQWDMVV+LFEKYGVVPK+VYPESV SS SRELNQYLNKLLR
Sbjct:  121 EIGSRKVKFLLDTPQQDGGQWDMVVSLFEKYGVVPKSVYPESVASSNSRELNQYLNKLLR  180

Query:  181 QDAQILRELIAQGADGATVQNKKEELLQEIFNFLAMNLGLPPQSFDFAYRDKDNHYQSDK  240
            QDAQILR+LIA GAD A VQ KKEE LQEIFN+LAM LGLPP+ FDFAYRDKD++Y+S+K
Sbjct:  181 QDAQILRDLIASGADQAAVQAKKEEFLQEIFNYLAMTLGLPPRQFDFAYRDKDDNYRSEK  240

Query:  241 NITPKAFYQKYVNLDLSDYVSIINAPTVDKPYGQSYTVEMLGNVGGPAVKYLNLDMKRF  300
            +ITP+AF++KYV L LSDYVS+INAPT DKPYG+SYTVEMLGNVVG P+V+Y+NL M RF
Sbjct:  241 GITPRAFFEKYVGLKLSDYVSVINAPTADKPYGKSYTVEMLGNVVGAPSVRYINLPMDRF  300

Query:  301 KELAIAQMKSGETVWFGSDVGQVSNRQKGILATTTYDFNSSMDIKLSQDKAGRLDYSESL  360
            KELAIAQMK+GE+VWFGSDVGQVS+RQKGILAT   YDF +SMDI  +QDKAGRLDYSESL
Sbjct:  301 KELAIAQMKAGESVWFGSDVGQVSDRQKGILATNVYDFTASMDINWTQDKAGRLDYSESL  360
```

```
                           -continued
Query:  361 MTHAMVLTGVDLDESGQPLKWKVENSWGEKVGKDGYFVASDAWMDEYTYQIVVRKELLTK  420
            MTHAMVLTGVDLD  G+P+KWK+ENSWG+KVG+ GYFVASDAWMDEYTYQIVVRK+ LT
Sbjct:  361 MTHAMVLTGVDLDADGKPIKWKIENSWGDKVGQKGYFVASDAWMDEYTYQIVVRKDFLTA  420

Query:  421 EELEAYNAEPITLAPWDPMGALAN                                     444
            EEL AY A+P  LAPWDPMG+LA+
Sbjct:  421 EELAAYEADPQVLAPWDPMGSLAS                                     444
```

A related DNA sequence was identified in *S. pyogenes* <SEQ ID 2945> which encodes the amino acid sequence <SEQ ID 2946>. Analysis of this protein sequence reveals the following:

```
Possible site: 14
>>> Seems to have no N-terminal signal sequence

----- Final Results -----
           bacterial cytoplasm --- Certainty = 0.3002(Affirmative) < succ>
            bacterial membrane --- Certainty = 0.0000(Not Clear)   < succ>
             bacterial outside --- Certainty = 0.0000(Not Clear)   < succ>
```

An alignment of the GAS and GBS proteins is shown below.

```
Identities = 369/443 (83%), Positives = 407/443 (91%)

Query:    1 MSKLTQTFTDKLFADYQANTKFSAIENAVTHNGLLKSLETRQSEIENDYVFSIDLTKDEV   60
            MS LT+TFT++LFA Y+AN KFSAIENAVTHNGLLKSLETRQSE++ND+VFSIDLTKD+V
Sbjct:    1 MSALTETFTEQLFAHYEANAKFSAIENAVTHNGLLKSLETRQSEVDNDFVFSIDLTKDKV   60

Query:   61 SNQKQSGRCWMFAALNTFRHKLISDFKLENFELSQAHTFFWDKYEKSNWFMEQIIATANQ  120
            SNQK SGRCWMFAALNTFRHKLI++FKLENFELSQAHTFFWDKYEK+NWFMEQ+IATA+Q
Sbjct:   61 SNQKASGRCWMFAALNTFRHKLITEFKLENFELSQAHTFFWDKYEKANWFMEQVIATADQ  120

Query:  121 ELSSRKVKFLLDVPQQDGGQWDMVVALFEKYGVVPKTVYPESVSSSASRELNQYLNKLLR  180
            EL+SRKVKFLLDVPQQDGGQWDMVV+LFEKYGVVPK+VYPES+SSS SRELNQYLNKLLR
Sbjct:  121 ELTSRKVKFLLDVPQQDGGQWDMVVSLFEKYGVVPKSVYPESISSSNSRELNQYLNKLLR  180

Query:  181 QDAQILRELIAQGADGATVQNKKEELLQEIFNFLAMNLGLPPQSFDFAYRDKDNHYQSDK  240
            QDAQILR+LIA GA    V+++K ELLQEIFNFLAM LGLPP+FDFAYRDKD+HY  +K
Sbjct:  181 QDAQILRDLIASGAKADQVEDRKAELLQEIFNFLAMTLGLPPRHFDFAYRDKDDHYVEK   240

Query:  241 NITPKAFYQKYVNLDLSDYVSIINAPTVDKPYGQSYTVEMLGNVVGGPAVKYLNLDMKRF  300
             +TP+AFY K+V L LSDYVS+INAPT DKPYG+SYTVEMLGNVVG   V+YLNLDMKRF
Sbjct:  241 GLTPQAFYDKFVGLKLSDYVSVINAPTADKPYGKSYTVEMLGNVVGSREVRYLNLDMKRF  300

Query:  301 KELAIAQMKSGETVWFGSDVGQVSNRQKGILATTTYDFNSSMDIKLSQDKAGRLDYSESL  360
            KELAI QM++GE+VWFGSDVGQVS+RQKGILAT TYDF +SMDI LSQDKAGRLDYSESL
Sbjct:  301 KELAIKQMQAGESVWFGSDVGQVSDRQKGILATNTYDFEASMDINLSQDKAGRLDYSESL  360

Query:  361 MTHAMVLTGVDLDESGQPLKWKVENSWGEKVGKDGYFVASDAWMDEYTYQIVVRKELLTK  420
            MTHAMVLTGVDLDE+G+PLKWKVENSWGEKVG  GYFVASDAWMDEYTYQIVVRKE LT
Sbjct:  361 MTHAMVLTGVDLDETGKPLKWKVENSWGEKVGDKGYFVASDAWMDEYTYQIVVRKEFLTA  420

Query:  421 EELEAYNAEPITLAPWDPMGALA                                      443
            +EL AY  EP  LAPWDPMGALA
Sbjct:  421 DELAAYEKEPQVLAPWDPMGALA                                      443
```

Based on this analysis, it was predicted that these proteins and their epitopes could be useful antigens for vaccines or diagnostics.

EXAMPLE 965

A DNA sequence (GBSx1024) was identified in *S. agalactiae* <SEQ ID 2947> which encodes the amino acid sequence <SEQ ID 2948>. Analysis of this protein sequence reveals the following:

```
Possible site: 36
>>> Seems to have a cleavable N-term signal seq.
```

-continued

```
----- Final Results -----
           bacterial outside --- Certainty = 0.3000(Affirmative) < succ>
           bacterial membrane --- Certainty = 0.0000(Not Clear) < succ>
           bacterial cytoplasm --- Certainty = 0.0000(Not Clear) < succ>
```

A related GBS nucleic acid sequence <SEQ ID 9533> which encodes amino acid sequence <SEQ ID 9534> was also identified.

The protein has homology with the following sequences in the GENPEPT database.

```
>GP:AAF17262 GB:AF210752 penicillin-binding protein 1A
[Streptococcus pneumoniae]
Identities = 412/725 (56%), Positives = 544/725 (74%), Gaps = 14/725 (1%)

Query:    4 IKKESVIKLLKYAFGIIMGFIILAIVIGGLLFAYYVSRSPKLTDQALKSVNSSLVYDGNN    63
            + K ++++L+KY     +  +I AIV+GG +F YYVS++P L++   L +  SS +YD  N
Sbjct:    1 MNKPTILRLIKYLSISFLSLVIAAIVLGGGVFFYYVSKAPSLSESKLVATTSSKIYDNKN    60

Query:   64 KLIADLGSEKRESVSADSIPLNLVNAITSIEDKRFFKHRGVDIYRILGAAWHNLVSSNTQ   123
            +LIADLGSE+R +  A+ IP +LV AI SIED RFF HRG+D  RILGA   NL S++ Q
Sbjct:   61 QLIADLGSERRVNAQANDIPTDLVKAIVSIEDHRFFDHRGIDTIRILGAFLRNLQSNSLQ   120

Query:  124 GGSTLDQQLIKLAYFSTNKSDQTLKRKSQEVWLALQMERKYTKEEILTFYINKVYMGNGN   183
            GGSTL QQLIKL YFST+ SDQT+ RK+QE WLA+Q+E+K TK+EILT+YINKVYM NGN
Sbjct:  121 GGSTLTQQLIKLTYFSTSTSDQTISRKAQEAWLAIQLEQKATKQEILTYYINKVYMSNGN   180

Query:  184 YGMRTTAKSYFGKDLKELSIAQLALLAGIPQAPTQYDPYKNPESAQTRRNTVLQQMYQDK   243
            YGM+T A++Y+GKDL  LS+ QLALLAG+PQAP QYDPY +PE+AQ RRN VL +M
Sbjct:  181 YGMQTAAQNYYGKDLNNLSLPQLALLAGMPQAPNQYDPYSHPEAAQDRRNLVLSEMKNQG   240

Query:  244 NISKKEYDQAVATPVTDGLKELKQKSTYPKYMDNYLKQVISEVKQKTGKDIFTAGLKVYT   303
             IS ++Y++AV TP+TDGL+ LK  S YP YMDNYLK+VI++V+++TG ++ T G+ VYT
Sbjct:  241 YISAEQYEKAVNTPITDGLQSLKSASNYPAYMDNYLKEVINQVEEETGYNLLTTGMDVYT   300

Query:  304 NINTDAQKQLYDIYNSDTYIAYPNNELQIASTIMDATNGKVIAQLGGRHQNENISFGTNQ   363
            N++ +AQK L+DIYN+D Y+AYP++ELQ+ASTI+D +NGKVIAQLG RHQ+ N+SFG NQ
Sbjct:  301 NVDQEAQKHLWDIYNTDEYVAYPDDELQVASTIVDVSNGKVIAQLGARHQSSNVSFGINQ   360

Query:  364 SVLTDRDWGSTMKPISAYAPAIDSGVYNSTGQSLNDSVYYWPGTSTQLYDWDRQYMGWMS   423
            +V T+RDWGSTMKPI+ YAPA++ GVY+ST    ++D  Y +PGT T +Y+WDR Y G ++
Sbjct:  361 AVETNRDWGSTMKPITDYAPALEYGVYDSTATIVHDEPYNYPGTDTPVYNWDRGYFGNIT   420

Query:  424 MQTAIQQSRNVPAVRALEAAGLDEAKSFLEKLGIYYPEMNYSNAISSNNSSSDAKYGASS   483
            +Q A+QQSRNVPAV  L   GL+ AK+FL  LGI YP ++YSNAISSN + SD KYGASS
Sbjct:  421 LQYALQQSRNVPAVETLNKVGLNRAKTFLNGLGIDYPSLHYSNAISSNTTESDKKYGASS   480

Query:  484 EKMAAAYSAFANGGTYYKPQYVNKIEFSDGTNDTYAASGSRAMKETTAYMMTDMLKTVLT   543
            EKMAAAY+AFANGGTYYKP Y++K+ FSDG+    ++ G+RAMKETTAYMMTDM+KTVL
Sbjct:  481 EKMAAAYAAFANGGTYYKPMYIHKVVFSDGSEKEFSNVGTRAMKETTAYMMTDMMKTVLV   540

Query:  544 FGTGTKAAIPGVAQAGKTGTSNYTEDELAKIEATTGIYNSAVGTMAPDENFVGYTSKYTM   603
            +G G  A +P + QAGKTGTSNYT++E+  K        Y    G +APDE FVGYT KY M
Sbjct:  541 YGIGRGAYLPWLPQAGKTGTSNYTDEEIEK-------YIKNTGYVAPDEMFVGYTRKYAM   593

Query:  604 AIWTGYKNRLTPLYGSQLDIATEVYRAMMSYLTGGYSA-DWTMPEGLYRSGSYLYINGTT   662
            A+WTGY NRLTPL G  L +A +VYR+MM+YL+ G + DW +PEGLYR+G +++NG
Sbjct:  594 AVWTGYSNRLTPLVGDGLTVAAKVYRSMMTYLSEGSNPEDWNIPEGLYRNGEFVFKNGAR   653

Query:  663 TTGTYSSSVYKNIYQNSGQSSQSSSSTSSEKQKEDKNTANDANSSSPQVETPNNGNATTP   722
            +T  +SS  +       S  +SS SSS +S+ +       + N++ +++P    T   +TTP
Sbjct:  654 ST--WSSFAPQQ--PPSTESSSSSDSSTSQSNSTTPSTNNSTTTNPNNNTQQSN--TTP   707

Query:  723 NNSNQ                                                         727
            +  NQ
Sbjct:  708 DQQNQ                                                         712
```

A related DNA sequence was identified in *S. pyogenes* <SEQ ID 2949> which encodes the amino acid sequence <SEQ ID 2950>. Analysis of this protein sequence reveals the following:

```
Possible site: 41
>>> Seems to have an uncleavable N-term signal seq
    INTEGRAL     Likelihood = -13.96     Transmembrane     19-35 (9-43)
```

-continued

```
----- Final Results -----
             bacterial membrane --- Certainty = 0.6583(Affirmative) < succ>
             bacterial outside  --- Certainty = 0.0000(Not Clear)   < succ>
             bacterial cytoplasm --- Certainty = 0.0000(Not Clear)  < succ>
```

The protein has homology with the following sequences in the databases:

```
>GP:CAA88918 GB:Z49095 penicillin-binding protein 1a [Streptococcus
pneumoniae]
Identities = 422/712 (59%), Positives = 536/712 (75%), Gaps = 8/712 (1%)

Query:    4 IKNPKILKWLKYVLSAILSLIILVIIGGLLFTFYISSAPKLSEAQLKSTNSSLVYDGNN    63
            +  P IL+ +KY+   + LSL+I  I++GG +F +Y+S AP LSE++L +T SS +YD  N
Sbjct:    1 MNKPTILRLIKYLSISFLSLVIAAIVLGGGVFFYYVSKAPSLSESKLVATTSSKIYDNKN    60

Query:   64 NLIADLGSEKRENVTADSIPINLVNAITSIEDKRFFNHRGVDLYRIFGAAFHNLTSQTTQ   123
            +LIADLGSE+R N  A+ IP +LV AI SIED RFF+HRG+D  RI GA   NL S + Q
Sbjct:   61 QLIADLGSERRVNAQANDIPTDLVKAIVSIEDHRFFDHRGIDTIRILGAFLRNLQSNSLQ   120

Query:  124 GGSTLDQQLIKLAYFSTNESDQTLKRKAQEVWLALQMERKYTKQEILTFYINKVYMGNGN   183
            GGSTL QQLIKL YFST+ SDQT+ RKAQE WLA+Q+E+K TKQEILT+YINKVYM NGN
Sbjct:  121 GGSTLTQQLIKLTYFSTSTSDQTISRKAQEAWLAIQLEQKATKQEILTYYINKVYMSNGN   180

Query:  184 YGMLTAAKSYYGKDLKDLSYAQLALLAGIPQAPSQYDPYLHPEAAQNRRNVVLQQMYMEK   243
            YGM TAA++YYGKDL +LS  QLALLAG+PQAP+QYDPY HPEAAQ+RRN+VL +M  +
Sbjct:  181 YGMQTAAQNYYGKDLNNLSLPQLALLAGMPQAPNQYDPYSHPEAAQDRRNLVLSEMKNQG   240

Query:  244 HLTKAEYETAIATPVAEGLQSLQQRSTYPKYMDNYLKQVIEEVKKETNKDIFTAGLKVYT   303
            +++  +YE A+ TP+ +GLQSL+  S YP YMDNYLK+VI +V++ET ++ T G+ VYT
Sbjct:  241 YISAEQYEKAVNTPITDGLQSLKSASNYPAYMDNYLKEVINQVEEETGYNLLTTGMDVYT   300

Query:  304 NIIPDAQQTLYNIYHSGDYVYYPDQDFQVASTIVDVTNGHVIAQLGGRNQDENVSFGTNQ   363
            N+  +AQ+ L++IY+S  YV YPD D QVAST+VDV+NG VIAQLG R+Q  NVSFGTNQ
Sbjct:  301 NVDQEAQKHLWDIYNSDQYVSYPDDDLQVASTVVDVSNGKVIAQLGARHQASNVSFGTNQ   360

Query:  364 AVLTDRDWGSTMKPITAYAPAIESGVYTSTAQSTNDSVYYWPGTTTQLFNWDLRYNGWMT   423
            AV T+RDWGS+MKPIT YAPA+E GVY STA   +D Y +PGT T L+NWD  Y G +T
Sbjct:  361 AVETNRDWGSSMKPITDYAPALEYGVYDSTASIVHDVPYNYPGTDTPLYNWDHVYFGNIT   420

Query:  424 IQAAIMLSRNVPAVRALEAAGLDYARSFLSSLGINYPEMHYSNAISSNNSSSDKKYGASS   483
            IQ A+   SRNV AV  L   GLD A++FL+ LGI+YP MHY+NAISSN + S+KKYGASS
Sbjct:  421 IQYALQQSRNVTAVETLNKVGLDRAKTFLNGLGIDYPSMHYANAISSNTTESNKKYGASS   480

Query:  484 EKMAAAYAAFANGGIYHKPRYVNKVEFSDGTSKTFDEKGKRAMKETTAYMMTDMLKTVLT   543
            EKMAAAYAAFANGGIYHKP Y+NK+ FSDG+ K F + G RAMKETTAYMMT+M+KTVLT
Sbjct:  481 EKMAAAYAAFANGGIYHKPMYINKIVFSDGSEKEFSDAGTRAMKETTAYMMTEMMKTVLT   540

Query:  544 YGTGTAAAIPGVAQAGKTGTSNYTDEELAKIGEKYGLYPDYVGTLAPDENFVGFTKRYAM   603
            YGTG  A +P + QAGKTGTSNYTDEE+ K        Y     G +APDE FVG+T++YAM
Sbjct:  541 YGTGRGAYLPWLPQAGKTGTSNYTDEEIEK-------YIKNTGYVAPDEMFVGYTRKYAM   593

Query:  604 AVWTGYKNRLTPVYGSSLEIASDVYRSMMTYLT-NGYSEDWTMPNGLYRSGGFLYLSGTY   662
            AVWTGY NRLTP+ G    +A  VYRSM+TYL+ +    DWTMP+GLYR+G F++ +G
Sbjct:  594 AVWTGYSNRLTPIIGDGFLVAGKVYRSMITYLSEDDQPGDWTMPDGLYRNGEFVFKNGAR   653

Query:  663 ASNTDYTNSVYNNLYSNNTTTASSQTTSDDTSSSNDTSNSTNTDNNGSHPST          714
            ++ +         +  S+++++ SS + S+ T+ S + S  +TN +NN     +T
Sbjct:  654 STWSSPAPQQPPSTESSSSSSDSSTSQSNSTTPSTNNSTTTNPNNNTQQSNT          705
```

An alignment of the GAS and GBS proteins is shown below.

```
Identities = 521/729 (71%), Positives = 621/729 (84%), Gaps = 10/729 (1%)

Query:    1 MITIKKESVIKLLKYAFGIIMGFIILAIVIGGLLFAYYVSRSPKLTDQALKSVNSSLVYD    60
            +ITIK  ++K LKY   I+   IIL I+IGGLLF +Y+S +PKL++  LKS NSSLVYD
Sbjct:    1 VITIKNPKILKWLKYVLSAILSLIILVIIGGLLFTFYISSAPKLSEAQLKSTNSSLVYD    60

Query:   61 GNNKLIADLGSEKRESVSADSIPLNLVNAITSIEDKRFFKHRGVDIYRILGAAWHNLVSS   120
            GNN LIADLGSEKRE+V+ADSIP+NLVNAITSIEDKRFF HRGVD+YRI GAA+HNL S
Sbjct:   61 GNNNLIADLGSEKRENVTADSIPINLVNAITSIEDKRFFNHRGVDLYRIFGAAFHNLTSQ   120

Query:  121 NTQGGSTLDQQLIKLAYFSTNKSDQTLKRKSQEVWLALQMERKYTKEEILTFYINKVYMG   180
            +TQGGSTLDQQLIKLAYFSTN+SDQTLKRK+QEVWLALQMERKYTK+EILTFYINKVYMG
```

```
                     -continued
Sbjct:  121 TTQGGSTLDQQLIKLAYFSTNESDQTLKRKAQEVWLALQMERKYTKQEILTFYINKVYMG  180

Query:  181 NGNYGMRTTAKSYFGKDLKELSIAQLALLAGIPQAPTQYDPYKNPESAQTRRNTVLQQMY  240
            NGNYGM T AKSY+GKDLK+LS AQLALLAGIPQAP+QYDPY +PE+AQ RRN VLQQMY
Sbjct:  181 NGNYGMLTAAKSYYGKDLKDLSYAQLALLAGIPQAPSQYDPYLHPEAAQNRRNVVLQQMY  240

Query:  241 QDKNISKKEYDQAVATPVTDGLKELKQKSTYPKYMDNYLKQVISEVKQKTGKDIFTAGLK  300
              +K+++K EY+ A+ATPV +GL+ L+Q+STYPKYMDNYLKQVI EVK++T KDIFTAGLK
Sbjct:  241 MEKHLTKAEYETAIATPVAEGLQSLQQRSTYPKYMDNYLKQVIEEVKKETNKDIFTAGLK  300

Query:  301 VYTNINTDAQKQLYDIYNSDTYIAYPNNELQIASTIMDATNGKVIAQLGGRHQNENISFG  360
            VYTNI  DAQ+ LY+IY+S  Y+ YP+ + Q+ASTI+D TNG VIAQLGGR+Q+EN+SFG
Sbjct:  301 VYTNIIPDAQQTLYNIYHSGDYVYYPDQDFQVASTIVDVTNGHVIAQLGGRNQDENVSFG  360

Query:  361 TNQSVLTDRDWGSTMKPISAYAPAIDSGVYNSTGQSLNDSVYYWPGTSTQLYDWDRQYMG  420
            TNQ+VLTDRDWGSTMKPI+AYAPAI+SGVY ST QS NDSVYYWPGT+TQL++WD +Y G
Sbjct:  361 TNQAVLTDRDWGSTMKPITAYAPAIESGVYTSTAQSTNDSVYYWPGTTTQLFNWDLRYNG  420

Query:  421 WMSMQTAIQQSRNVPAVRALEAAGLDEAKSFLEKLGIYYPEMNYSNAISSNNSSSDAKYG  480
            WM++Q AI   SRNVPAVRALEAAGLD A+SFL  LGI YPEM+YSNAISSNNSSSD KYG
Sbjct:  421 WMTIQAAIMLSRNVPAVRALEAAGLDYARSFLSSLGINYPEMHYSNAISSNNSSSDKKYG  480

Query:  481 ASSEKMAAAYSAFANGGTYYKPQYVNKIEFSDGTNDTYAASGSRAMKETTAYMMTDMLKT  540
            ASSEKMAAAY+AFANGG Y+KP+YVNK+EFSDGT+ T+   G RAMKETTAYMMTDMLKT
Sbjct:  481 ASSEKMAAAYAAFANGGIYHKPRYVNKVEFSDGTSKTFDEKGKRAMKETTAYMMTDMLKT  540

Query:  541 VLTFGTGTKAAIPGVAQAGKTGTSNYTEDELAKIEATTGIYNSAVGTMAPDENFVGYTSK  600
            VLT+GTGT AAIPGVAQAGKTGTSNYT++ELAKI    G+Y   VGT+APDENFVG+T +
Sbjct:  541 VLTYGTGTAAAIPGVAQAGKTGTSNYTDEELAKIGEKYGLYPDYVGTLAPDENFVGFTKR  600

Query:  601 YTMAIWTGYKNRLTPLYGSQLDIATEVYRAMMSYLTGGYSADWTMPEGLYRSGSYLYING  660
            Y MA+WTGYKNRLTP+YGS L+IA++VYR+MM+YLT GYS DWTMP GLYRSG +LY++G
Sbjct:  601 YAMAVWTGYKNRLTPVYGSSLEIASDVYRSMMTYLTNGYSEDWTMPNGLYRSGGFLYLSG  660

Query:  661 TTTTGT-YSSSVYKNIYQNSGQSSQSSSSTSSEKQKEDKNTANDANSSSPQVETPNNGNA  719
            T  + T Y++SVY N+Y N       ++++ SS+  +D +++ND ++S+    T NNG+
Sbjct:  661 TYASNTDYTNSVYNNLYSN------NTTTASSQTTSDDTSSSNDTSNST---NTDNNGSH  711

Query:  720 TTPNNSNQT                                                     728
            + ++     T
Sbjct:  712 PSTDDKKTT                                                     720
```

A related GBS gene <SEQ ID 8695> and protein <SEQ ID 8696> were also identified. Analysis of this protein sequence reveals the following:

```
Lipop: Possible site: -1 Crend: 10
McG: Discrim Score: 6.55
GvH: Signal Score (-7.5): -1.98
     Possible site: 36
>>> Seems to have a cleavable N-term signal seq.
ALOM program count: 0 value: 4.03 threshold: 0.0
   PERIPHERAL Likelihood = 4.03 201
 modified ALOM score: -1.31
*** Reasoning Step: 3

----- Final Results ----- bacterial outside --- Certainty = 0.3000(Affirmative) < succ>
             bacterial membrane --- Certainty = 0.0000(Not Clear)  < succ>
             bacterial cytoplasm --- Certainty = 0.0000(Not Clear)  < succ>
```

The protein has homology with the following sequences in the databases:

```
57.5/76.2% over 712aa
Streptococcus pneumoniae
GP|6563351|penicillin-binding protein 1A Insert characterized
ORF00399(310-2484 of 2850)
GP|6563351|gb|AAF17262.1|AF210752_1|AF210752(1-713 of 719)penicillin-binding
protein 1A {Streptococcus pneumoniae}
% Match = 43.8
% Identity = 57.5   % Similarity = 76.2
Matches = 412  Mismatches = 166  Conservative Sub.s = 134
```

```
237         267         297         327         357         387         417         447
LIISEKMDFS*RRVPFLKSLT*ILLKKNY*AVITIKKESVIKLLKYAFGIIMGFIILAIVIGGLLFAYYVSRSPKLTDQA
                                 : |::::|:||    : ::| |||:|| :| ||||::| |::
                                MNKPTILRLIKYLSISFLSLVIAAIVLGGGVFFYYVSKAPSLSESK
                                         10         20         30         40
477         507         537         567         597         627         657         687
LKSVNSSLVYDGNNKLIADLGSEKRESVSADSIPLNLVNAITSIEDKRFFKHRGVDIYRILGAAWHNLVSSNTQGGSTLD
| :  || :||    |:|||||||:|  |: :| ||  ||| |||| |||||    || |::  |||||
LVATTSSKIYDNKNQLIADLGSERRVNAQANDIPTDLVKAIVSIEDHRFFDHRGIDTIRILGAFLRNLQSNSLQGGSTLT
           60         70         80         90        100        110        120
717         747         777         807         837         867         897         927
QQLIKLAYFSTNKSDQTLKRKSQEVWLALQMERKYTKEEILTFYINKVYMGNGNYGMRTTAKSYFGKDLKELSIAQLALL
||||||  ||||:  ||||:  ||:| |||:|:|:|  ||:|||| ||||||  |||||:| |:::|||| ||:  |||||
QQLIKLTYFSTSTSDQTISRKAQEAWLAIQLEQKATKQEILTYYINKVYMSNGNYGMQTAAQNYYGKDLNNLSLPQLALL
          140        150        160        170        180        190        200
957         987        1017        1047        1077        1107        1137        1167
AGIPQAPTQYDPYKNPESAQTRRNTVLQQMYQDKNISKKEYDQAVATPVTDGLKELKQKSTYPKYMDNYLKQVISEVKQK
||:||| ||||| :||:||  |||  :|  ||  ::|::|| ||:||||:   ||  ||  | ||||||||||:||::|:::
AGMPQAPNQYDPYSHPEAAQDRRNLVLSEMKNQGYISAEQYEKAVNTPITDGLQSLKSASNYPAYMDNYLKEVINQVEEE
          220        230        240        250        260        270        280
1197        1227        1257        1287        1317        1347        1377        1407
TGKDIFTAGLKVYTNINTDAQKQLYDIYNSDTYIAYPNNELQIASTIMDATNGKVIAQLGGRHQNENISFGTNQSVLTDR
|| ::::| |:  ||||| :|:  |||:|| :|||||:||||||   |||||  :|||||:|||:|:||||||:|||| |:|
TGYNLLTTGMDVYTNVDQEAQKHLWDIYNTDEYVAYPDDELQVASTIVDVSNGKVIAQLGARHQSSNVSFGINQAVETNR
          300        310        320        330        340        350        360
1437        1467        1497        1527        1557        1587        1617        1647
DWGSTMKPISAYAPAIDSGVYNSTGQSLNDSVYYWPGTSTQLYDWDRQYMGWMSMQTAIQQSRNVPAVRALEAAGLDEAK
||||||||:  ||||::  |||:||    ::|   | :||| |:|||| | |:::| |:||||||||||    || ::||
DWGSTMKPITDYAPALEYGVYDSTATIVHDEPYNYPGTDTPVYNWDRGYFGNITLQYALQQSRNVPAVETLNKVGLNRAK
          380        390        400        410        420        430        440
1677        1707        1737        1767        1797        1837        1857        1887
SFLEKLGIYYPEMNYSNAISSNNSSSDAKYGASSEKMAAAYSAFANGGTYYKPQYVNKIEFSDGTNDTYAASGSRAMKET
:||  ||| ||  ::||||||||||  |||||||||||||| ||||||||||| ||:   |::  |:|:||||||||
TFLNGLGIDYPSLHYSNAISSNTTESDKKYGASSEKMAAAYAAFANGGTYYKPMYIHKVVFSDGSEKEFSNVGTRAMKET
          460        470        480        490        500        510        520
1917        1947        1977        2007        2037        2067        2097        2127
TAYMMTDMLKTVLTFGTGTKAAIPGVAQAGKTGTSNYTEDELAKIEATTGIYNSAVGTMAPDENFVGYTSKYTMAIWTGY
||||||||:|||| :|| | |:|  | :|| |||||||||||||:: |      |:|||| |||| | ||:| ||:|||
TAYMMTDMMKTVLVYGIGRGAYLPWLPQAGKTGTSNYTDEEIEK-------YIKNTGYVAPDEMFVGYTRKYAMAVWTGY
          540        550        560        570                580        590
2157        2187        2214        2244        2274        2304        2334        2364
KNRLTPLYGSQLDIATEVYRAMMSYLT-GGYSADWTMPEGLYRSGSYLYINGTTTTGTYSSSVYKNIYQNSGQSSQSSSS
||||||| |  :| :|||:||:|   |  ||:||||||||:| :::  || :|   :||     |:|| |||
SNRLTPLVGDGLTVAAKVYRSMMTYLSEGSNPEDWNIPEGLYRNGEFVFKNGARST--WSSPAPQQ--PPSTESSSSSSD
          610        620        630        640        650        660        670
2394        2424        2454        2484        2514        2544        2574        2604
TSSEKQKEDKNTANDANSSSPQVETPNNGNATTPNNSNQTVPGTGHGNGNGNGNNNTVPNGN*KTGYIIQFFNL*LLLLI
:|: :      : |:: ::|   :       |||  ||
SSTSQSNSTTPSTNNSTTTNPNNNTQQS--NTTPDQNQNPQPAQP
          690        700        710
```

SEQ ID 8696 (GBS146) was expressed in *E. coli* as a His-fusion product. SDS-PAGE analysis of total cell extract is shown in FIG. 23 (lane 4; MW 82 kDa), in FIG. 168 (lane 11-13; MW 96.5 kDa) and in FIG. 238 (lane 8; MW 96.5 kDa). It was also expressed in *E. coli* as a GST-fusion product. SDS-PAGE analysis of total cell extract is shown in FIG. 49 (lane 2; MW 107 kDa).

Purified Thio-GBS146-His is shown in FIG. 244, lane 4.

Based on this analysis, it was predicted that these proteins and their epitopes could be useful antigens for vaccines or diagnostics.

EXAMPLE 966

A DNA sequence (GBSx1025) was identified in *S. agalactiae* <SEQ ID 2951> which encodes the amino acid sequence <SEQ ID 2952>. Analysis of this protein sequence reveals the following:

```
Possible site: 37
>>> Seems to have no N-terminal signal sequence

----- Final Results -----
        bacterial cytoplasm --- Certainty = 0.3647(Affirmative) < succ>
        bacterial membrane  --- Certainty = 0.0000(Not Clear)   < succ>
         bacterial outside  --- Certainty = 0.0000(Not Clear)   < succ>
```

The protein has homology with the following sequences in the GENPEPT database.

```
>GP:AAA26957 GB:M90528 ORF [Streptococcus oralis]
Identities = 143/196 (72%), Positives = 165/196 (83%), Gaps = 1/196 (0%)
Query:  1 MVNYPHQLIRKTTVTKSKKKKIDFANRGMSFEAAINATNDYYLSHELAVIHKKPTPVQIV  60
          MVNYPH++  +       + K +FANRGMSFE  INATNDYYLSH LAVIHKKPTP+QIV
```

```
                    -continued
Sbjct:   1 MVNYPHKISSQKRQAPPSQTK-NFANRGMSFEKMINATNDYYLSHGLAVIHKKPTPIQIV   59

Query:  61 KVDYPKRSRAKIVEAYFRQASTTDYSGVYKGYYIDFEAKETRQKTAMPMKNFHAHQIEHM  120
           +VDYP+RSRAKIVEAYFRQASTTDYSGVY GYYIDFEAKETRQK A+PMKNFH HQI+HM
Sbjct:  60 RVDYPQRSRAKIVEAYFRQASTTDYSGVYDGYYIDFEAKETRQKHAIPMKNFHHHQIQHM  119

Query: 121 ANVLQQKGICFVLLHFSTLKETYLLPANELISFYQIDKGNKSMPIDYIRKNGFFVKESAF  180
           VL Q+GICFVLLHF++ +ETYLLPA +LI FY  DKG KSMP+ YIR+NG+ ++  AF
Sbjct: 120 EQVLAQRGICFVLLHFASQQETYLLPAVDLIRFYHQDKGQKSMPLGYIRENGYRIELGAF  179

Query: 181 PQVPYLDIIEEKLLGG                                             196
           PQ+PYLDII+E LLGG
Sbjct: 180 PQIPYLDIIKEHLLGG                                             195
```

A related DNA sequence was identified in *S. pyogenes* <SEQ ID 2953> which encodes the amino acid sequence <SEQ ID 2954>. Analysis of this protein sequence reveals the following:

```
Possible site: 37
>>> Seems to have no N-terminal signal sequence

----- Final Results -----
            bacterial cytoplasm --- Certainty = 0.5030(Affirmative) < succ>
            bacterial membrane  --- Certainty = 0.0000(Not Clear)   < succ>
             bacterial outside  --- Certainty = 0.0000(Not Clear)   < succ>
```

An alignment of the GAS and GBS proteins is shown below.

```
Identities = 166/199 (83%), Positives = 177/199 (88%)

Query:   1 MVNYPHQLIRKTTVTKSKKKKIDFANRGMSFEAAINATNDYYLSHELAVIHKKPTPVQIV   60
           MVNYPH LIR+   +  K+ K+DFANRGMSFEAAINATNDYYLS ++AVIHKKPTPVQIV
Sbjct:   1 MVNYPHNLIRQKVSSVQKQNKVDFANRGMSFEAAINATNDYYLSRQIAVIHKKPTPVQIV   60

Query:  61 KVDYPKRSRAKIVEAYFRQASTTDYSGVYKGYYIDFEAKETRQKTAMPMKNFHAHQIEHM  120
           KVDYPKRSRAKIVEAYFRQASTTDY GVYKG+Y+DFEAKETRQKTAMPMKNFH HQIEHM
Sbjct:  61 KVDYPKRSRAKIVEAYFRQASTTDYCGVYKGHYVDFEAKETRQKTAMPMKNFHLHQIEHM  120

Query: 121 ANVLQQKGICFVLLHFSTLKETYLLPANELISFYQIDKGNKSMPIDYIRKNGFFVKESAF  180
           A VL QKGICFVLLHFSTLKETY LPA   LISFYQID G+KSMPIDYIRKNGF V   AF
Sbjct: 121 ACVLHQKGICFVLLHFSTLKETYYLPAQALISFYQIDNGSKSMPIDYIRKNGFKVAFGAF  180

Query: 181 PQVPYLDIIEEKLLGGDYN                                          199
           PQVPYL+IIE+ LGGDYN
Sbjct: 181 PQVPYLNIIEQNFLGGDYN                                          199
```

Based on this analysis, it was predicted that these proteins and their epitopes could be useful antigens for vaccines or diagnostics.

EXAMPLE 967

A DNA sequence (GBSx1026) was identified in *S. agalactiae* <SEQ ID 2955> which encodes the amino acid sequence <SEQ ID 2956>. Analysis of this protein sequence reveals the following:

```
Possible site: 61
>>> Seems to have no N-terminal signal sequence

----- Final Results -----
            bacterial cytoplasm --- Certainty = 0.3227(Affirmative) < succ>
            bacterial membrane  --- Certainty = 0.0000(Not Clear)   < succ>
             bacterial outside  --- Certainty = 0.0000(Not Clear)   < succ>
```

The protein has homology with the following sequences in the GENPEPT database.

```
>GP:CAB14136 GB:Z99115 similar to hypothetical proteins from
B. subtilis [Bacillus subtilis]
Identities = 74/174 (42%), Positives = 97/174 (55%), Gaps = 6/174 (3%)
Query:   5 ILVTGYKNFELGIFQDKDPRITIIKKAIDKDFRRFLENGADWFIFMGNLGFEYWALEVAL    64
           + +TGYK FELGIF+  D  +  IKKAI       FL+ G +W +  G LG E WA E A
Sbjct:   4 LAITGYKPFELGIFKQDDKALYYIKKAIKNRLIAFLDEGLEWILISGQLGVELWAAEAAY   63

Query:  65 DLQKEY-DFQIATIFTFENHGQNWNEANKAKL-ALFKQVDF-VKYTFPSYENPGQFKQYN  121
           DLQ+EY D ++A I  F    +NW E NK +  A+   Q D+    T   YE+P QFKQ N
Sbjct:  64 DLQEEYPDLKVAVITPFYEQEKNWKEPNKEQYEAVLAQADYEASLTHRPYESPLQFKQKN  123

Query: 122 HFLINNTQGAYLFYDSENETNLKFLLEMMEKK---EAYDISFLTFDRLNEIYEE        172
              F I+ + G  L YD E E + K++L    EK+   + Y I F+T D L    EE
Sbjct: 124 QFFIDKSDGLLLLYDPEKEGSPKYMLGTAEKRREQDGYPIYFITMDDLRVTVEE        177
```

A related DNA sequence was identified in *S. pyogenes* <SEQ ID 2957> which encodes the amino acid sequence <SEQ ID 2958>. Analysis of this protein sequence reveals the following:

```
Possible site: 60
>>> Seems to have no N-terminal signal sequence

----- Final Results -----
         bacterial cytoplasm --- Certainty = 0.3041(Affirmative) < succ>
          bacterial membrane --- Certainty = 0.0000(Not Clear)   < succ>
           bacterial outside --- Certainty = 0.0000(Not Clear)   < succ>
```

An alignment of the GAS and GBS proteins is shown below.

```
Identities = 102/167 (61%), Positives = 127/167 (75%)
Query:   3 STILVTGYKNFELGIFQDKDPRITIIKKAIDKDFRRFLENGADWFIFMGNLGFEYWALEV   62
           + IL+TGY++FE+GIF  KDPR++IIK+AI KD   +LENG DWFIF GNLGFE WALEV
Sbjct:   2 TAILITGYRSFEIGIFDHKDPRVSIIKQAIRKDLIGYLENGVDWFIFTGNLGFEQWALEV   61

Query:  63 ALDLQKEYDFQIATIFTFENHGQNWNEANKAKLALFKQVDFVKYTFPSYENPGQFKQYNH  122
           A +L++EY   QIATIF  FE HG  WNE NK  L+ F+  VDFVKY  FP+YE P QF QY
Sbjct:  62 ANELKEEYPLQIATIFLFETHGDRWNEKNKEVLSQFRAVDFVKYYFPNYEQPTQFSQYYQ  121

Query: 123 FLINNTQGAYLFYDSENETNLKFLLEMMEKKEAYDISFLTFDRLNEI               169
           FL+   T+GAY+FYD+ENETNLK+ L+ +       Y +  LTFDRLN++
Sbjct: 122 FLLEKTEGAYVFYDTENETNLKYFLKKAKDMPHYQLLLLTFDRLNDM                168
```

Based on this analysis, it was predicted that these proteins and their epitopes could be useful antigens for vaccines or diagnostics.

EXAMPLE 968

A DNA sequence (GBSx1027) was identified in *S. agalactiae* <SEQ ID 2959> which encodes the amino acid sequence <SEQ ID 2960>. Analysis of this protein sequence reveals the following:

```
Possible site: 23
>>> Seems to have no N-terminal signal sequence

----- Final Results -----
         bacterial cytoplasm --- Certainty = 0.5188(Affirmative) < succ>
          bacterial membrane --- Certainty = 0.0000(Not Clear)   < succ>
           bacterial outside --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 969

A DNA sequence (GBSx1028) was identified in *S. agalactiae* <SEQ ID 2961> which encodes the amino acid sequence <SEQ ID 2962>. This protein is predicted to be cell division protein DivIVA. Analysis of this protein sequence reveals the following:

```
Possible site: 16
>>> Seems to have no N-terminal signal sequence

----- Final Results -----
              bacterial cytoplasm --- Certainty = 0.2736(Affirmative) < succ>
                bacterial membrane --- Certainty = 0.0000(Not Clear)  < succ>
                  bacterial outside --- Certainty = 0.0000(Not Clear)  < succ>
```

A related GBS nucleic acid sequence <SEQ ID 9535> which encodes amino acid sequence <SEQ ID 9536> was also identified.

The protein has homology with the following sequences in the GENPEPT database.

```
>GP:CAB14135 GB:Z99115 YPsB [Bacillus subtilis]
Identities = 46/102 (45%), Positives = 69/102 (67%), Gaps = 14/102 (13%)
Query:  14 SPKDIFEQDFKVSMRGYDKKEVDVFLDDVIKDYENYLEQIEKLQMENRRLQQALDKKESE    73
           S K+I E++FK  +RGY +++VD FLD +IKDYE + ++IE+LQ EN +L++ L+     E
Sbjct:   9 SAKEILEKEFKTGVRGYKQEDVDKFLDMIIKDYETFHQEIEELQQENLQLKKQLE----E    64

Query:  74 ASNVRNSGTAMYNQKPIAQSATNFDILKRISRLEKEVFGRQI                    115
           AS             ++P+  + TNFDILKR+S LEK VFG ++
Sbjct:  65 AS----------KKQPVQSNTTNFDILKRLSNLEKHVFGSKL                    96
```

A related DNA sequence was identified in *S. pyogenes* <SEQ ID 2963> which encodes the amino acid sequence <SEQ ID 2964>. Analysis of this protein sequence reveals the following:

```
Possible site: 51
>>> Seems to have no N-terminal signal sequence

----- Final Results -----
              bacterial cytoplasm --- Certainty = 0.4466(Affirmative) < succ>
                bacterial membrane --- Certainty = 0.0000(Not Clear)  < succ>
                  bacterial outside --- Certainty = 0.0000(Not Clear)  < succ>
```

An alignment of the GAS and GBS proteins is shown below.

```
Identities = 71/112 (63%), Positives = 85/112 (75%), Gaps = 6/112 (5%)
Query:   8 MASIIYSPKDIFEQDFKVSMRGYDKKEVDVFLDDVIKDYENYLEQIEKLQMENRRLQQAL    67
           M SIIYSPKDIFEQ+FK SMRG+DKKEVD FLD+VIKDYEN+  QIE L+ EN    +AL
Sbjct:   1 MTSIIYSPKDIFEQEFKTSMRGFDKKEVDEFLDNVIKDYENFNAQIEALKAEN----EAL    56

Query:  68 DKKESEASNVRNSGTAMYNQKP--IAQSATNFDILKRISRLEKEVFGRQIRE          117
           K + +A N  ++       +P  +AQSATNFDILKRIS+LEKEVFG+QI E
Sbjct:  57 KKAKFQARNTVSATVQQPVPQPTRVAQSATNFDILKRISKLEKEVFGKQIIE          108
```

Based on this analysis, it was predicted that these proteins and their epitopes could be useful antigens for vaccines or diagnostics.

EXAMPLE 970

A DNA sequence (GBSx1029) was identified in *S. agalactiae* <SEQ ID 2965> which encodes the amino acid sequence <SEQ ID 2966>. Analysis of this protein sequence reveals the following:

```
Possible site: 55
>>> Seems to have no N-terminal signal sequence (or aa 1-19)

----- Final Results -----
              bacterial cytoplasm --- Certainty = 0.0655(Affirmative) < succ>
                bacterial membrane --- Certainty = 0.0000(Not Clear)  < succ>
                  bacterial outside --- Certainty = 0.0000(Not Clear)  < succ>
```

The protein has homology with the following sequences in the GENPEPT database.

```
>GP:CAB14134 GB:Z99115 similar to hypothetical proteins [Bacillus subtilis]
Identities = 204/382 (53%), Positives = 274/382 (71%), Gaps = 3/382 (0%)
Query:    3 ESFKLIATAAAGLEAIVGREIRNLGIDCQVENGRVRFHGDIKTIIETNLWLRAADRIKII   62
            + + LIATA  G+EA+V +E+R+LG +C+V+NG+V F GD    I   NLWLR ADRIK+
Sbjct:    2 KKYTLIATAPMGIEAVVAKEVRDLGYECKVDNGKVIFEGDALAICRANLWLRTADRIKVQ   61

Query:   63 VGEFPAPTFEELFQGVYGLDWENYLPLGAKFPIAKAKCVKSKLHNEPSVQAISKKAVAKK  122
            V  F A TF+ELF+    ++W +++P   KFP+    K VKS L + P  Q I KKA+ +K
Sbjct:   62 VASFKAKTFDELFEKTKAINWRSFIPENGKFPVI-GKSVKSTLASVPDCQRIVKKAIVEK  120

Query:  123 LQKVFHRPEGVPLQENGAEFKIEVSILKDKATVMIDTTGSSLFKRGYRAEKGGAPIKENM  182
            L K+         ++E GAE+K+E+S+LKD+A + +D++G+ L KRGYR ++GGAPIKE +
Sbjct:  121 L-KLQSGKANDWIEETGAEYKVEISLLKDQALITLDSSGTGLHKRGYRVDQGGAPIKETL  179

Query:  183 AAAIIQLSNWFPDKPLIDPTCGSGTFCIEAAMIGMNIAPGFNRDFAFEAWPWVDQSQVQK  242
            AAA++QL+ NW PD+P +DP CGSGT  IEAA+IG NIAPGFNRDF  E W W+ +    K
Sbjct:  180 AAALVQLTNWTPDRPFVDPFCGSGTIAIEAALIGQNIAPGFNRDFVSEDWEWIGKDLWNK  239

Query:  243 VRDEAESKANYDIDLDISGFDLDGRMVEIARKNAEEAGLGDVIKLKQMRLQDLKTDKING  302
              R E E KANYD  L I   D+D RMV+IA++NAEEAGLGD+I+  KQM+++D  T+   G
Sbjct:  240 ARLEVEEKANYDQPLTIFASDIDHRMVQIAKENAEEAGLGDLIQFKQMQVKDFTTNLEFG  299

Query:  303 VIISNPPYGERLLDDKAVDILYNEMGQTFAPLKTWSKFILTSDEGFEKKYGSQADKKRKL  362
            VI+ NPPYGERL + KAV+ +Y EMGQ F PL TWS ++LTS+E FE+ YG +A KKRKL
Sbjct:  300 VIVGNPPYGERLGEKKAVEQMYKEMGQAFEPLDTWSVYMLTSNENFEEAYGRKATKKRKL  359

Query:  363 YNGTLKVDLYQYYGERVRRQVK                                        384
            +NG +K D YQY+   +VR Q K
Sbjct:  360 FNGFIKTDYYQYW-SKVRPQRK                                        380
```

A related DNA sequence was identified in *S. pyogenes* <SEQ ID 2967> which encodes the amino acid sequence <SEQ ID 2968>. Analysis of this protein sequence reveals the following:

```
Possible site: 14
>>> Seems to have no N-terminal signal sequence

----- Final Results -----
           bacterial cytoplasm --- Certainty = 0.0324(Affirmative) < succ>
            bacterial membrane --- Certainty = 0.0000(Not Clear)  < succ>
             bacterial outside --- Certainty = 0.0000(Not Clear)  < succ>
```

An alignment of the GAS and GBS proteins is shown below.

```
Identities = 317/383 (82%), Positives = 354/383 (91%)

Query:    1 MKESFKLIATAAAGLEAIVGREIRNLGIDCQVENGRVRFHGDIKTIIETNLWLRAADRIK   60
            MKE+F+L+ATAAAGLEA+VG+E+R LG DCQVENG+V F GD++ I++TNLWLRAADRIK
Sbjct:    1 MKETFRLVATAAAGLEAVVGKEVRALGFDCQVENGKVYFEGDVEAIVKTNLWLRAADRIK   60

Query:   61 IIVGEFPAPTFEELFQGVYGLDWENYLPLGAKFPIAKAKCVKSKLHNEPSVQAISKKAVA  120
            IIVG+FPA TFEELFQGV+ LDWENYLPLGAKFPI+KAKCVKSKLHNEPSVQAI+KKAV
Sbjct:   61 IIVGQFPARTFEELFQGVFALDWENYLPLGAKFPISKAKCVKSKLHNEPSVQAITKKAVV  120

Query:  121 KKLQKVFHRPEGVPLQENGAEFKIEVSILKDKATVMIDTTGSSLFKRGYRAEKGGAPIKE  180
            KKLQK FHRPEGVPLQE G+ F IEVSILKD+AT+MIDTTGSSLFKRGYR +KGGAPIKE
Sbjct:  121 KKLQKHFHRPEGVPLQEVGSTFNIEVSILKDQATIMIDTTGSSLFKRGYRVQKGGAPIKE  180

Query:  181 NMAAAIIQLSNWFPDKPLIDPTCGSGTFCIEAAMIGMNIAPGFNRDFAFEAWPWVDQSQV  240
            NMAAAI+ LSNWFPDKPL+DPTCGSGTFCIEAAMIGMNIAPGFNR FAFE W WVD+  V
Sbjct:  181 NMAAAILALSNWFPDKPLVDPTCGSGTFCIEAAMIGMNIAPGFNRSFAFEEWSWVDKDMV  240

Query:  241 QKVRDEAESKANYDIDLDISGFDLDGRMVEIARKNAEEAGLGDVIKLKQMRLQDLKTDKI  300
            Q+VRD+AE +ANY+I+LDISGFD+DGRM+EIA+ NAEEAGL DVI  KQMRLQD +TDK+
Sbjct:  241 QQVRDDAEQEANYEIELDISGFDIDGRMIEIAKSNAEEAGLSDVITFKQMRLQDFRTDKV  300

Query:  301 NGVIISNPPYGERLLDDKAVDILYNEMGQTFAPLKTWSKFILTSDEGFEKKYGSQADKKR  360
            NGV+ISNPPYGERLLDDKAVDILYNEMGQTFAPLKTWSKFILTSDE  FE KYG +ADKKR
Sbjct:  301 NGVVISNPPYGERLLDDKAVDILYNEMGQTFAPLKTWSKFILTSDELFELKYGQKADKKR  360
```

```
Query: 361 KLYNGTLKVDLYQYYGERVRRQV                                    383
           KLYNGTLKVDLYQ+YGERV+R +
Sbjct: 361 KLYNGTLKVDLYQFYGERVKRHL                                    383
```

SEQ ID 2966 (GBS255) was expressed in *E. coli* as a His-fusion product. SDS-PAGE analysis of total cell extract is shown in FIG. 43 (lane 7; MW 44 kDa) It was also expressed in *E. coli* as a GST-fusion product. SDS-PAGE analysis of total cell extract is shown in FIG. 48 (lane 4; MW 69 kDa).

Based on this analysis, it was predicted that these proteins and their epitopes could be useful antigens for vaccines or diagnostics.

EXAMPLE 971

A DNA sequence (GBSx030) was identified in *S. agalactiae* <SEQ ID 2969> which encodes the amino acid sequence <SEQ ID 2970>. Analysis of this protein sequence reveals the following:

```
Possible site: 30
>>> Seems to have no N-terminal signal sequence
    INTEGRAL    Likelihood = -15.02    Transmembrane    171-187 (167-193)

----- Final Results -----
              bacterial membrane --- Certainty = 0.7007(Affirmative) < succ>
              bacterial outside  --- Certainty = 0.0000(Not Clear)   < succ>
              bacterial cytoplasm --- Certainty = 0.0000(Not Clear)   < succ>
```

The protein has homology with the following sequences in the GENPEPT database.

```
>GP:AAD16120 GB:AF094508 dentin phosphoryn [Homo sapiens]
Identities = 71/398 (17%), Positives = 152/398 (37%), Gaps = 16/398 (4%)

Query:  16 TDGLEFKDAK-EMTVEEAVRKDSEIKAGITEEDSILDKYIKQHRDEVASQKFETKSSDFA   74
           +D + D+K + + E+   DS+ K+ ++ +S         D    S       S
Sbjct: 152 SDSSDSSDSKSDSSKSESDSSDSDSKSDSSDSNSSDSSDNSSDSSDSSNSSNSSDSSDSSD 211

Query:  75 NLDTASLDDFIKKQREELSAMLAAEELSKKLDNSVSQEQDTEANAVSPKEESSQEQENSV  134
           + D++S D      + S    +   S+ D+S S + D+ ++ S     SS      ++
Sbjct: 212 SSDSSSSSD--SSNSSDSSDSSDSSNSSESSDSSDSSDSDSSDSDSSNSNSSDSDSSNS  269

Query: 135 TPVPPLNTEAEPTATEPDSTIADSEEYKSSSKKRGGIVGTLIALILLLIVAIFGYNYFKN  194
           +      + ++ + +    S   +DS +    SS           + +      + N  +
Sbjct: 270 SDSSDSSNSSDSSDSSNSSDSSDSSDSSNSSDSSDSSDSS------DSSDSSNSSDS    323

Query: 195 NNSTNSQTATSQSSSSKATTTSSEEDKKASQNLDNFNKSYANFFVDDKKTQLKNSEFDKL  254
           N+S+NS   ++ S SS ++ +S     D    S + D+ N S         D      +S+
Sbjct: 324 NDSSNSSDSSDSSDSSNSSDSSDSSDSSDSDSSNSS-------DSSNSSDSSDSCNS    376

Query: 255 SELEKKVDALKGTKYYGKVKVKFDSLKRQIDAVKAVNDKFKSPAVVDGKKSEKLEVKDGA  314
           S+        D+ G+      +          D+ + N     S +       + S      + D +
Sbjct: 377 SDSSDSSDSSDGSDSDSSNRSDSSNSSDSSDSSDSSNSSDSSDSSDSNESSNSSDSSDSS  436

Query: 315 NFDSLDSKTLNTGNASLDSLLHSIVSTGRNQVKQSEEQASSNKVSDTQITEQPNVTNGQS  374
           N      DS   + +S DS   S  S        N        S       SSN    +  ++  N ++  +
Sbjct: 437 NSSDSDSSDSSNSSDSSDSSNSSDSSESSNSSDNSNSSDSSNSSDSSDSSDSSNSSDSSN  496

Query: 375 SSSAATINNQAAGTASGNLERNRSRVPYNNAAIADTGN                         412
           SS ++  ++ +    +S + + + S         +++   +D+  +
Sbjct: 497 SSDSSNSSDSSDSNSSDSSDSSXSSDSSDSSDSSDSSD                          534

Identities = 64/341 (18%), Positives = 140/341 (40%), Gaps = 35/341 (10%)

Query:  59 DEVASQKFETKSSDFANLDTASLDDFIKKQREELS-AMLAAEELSKKLDNSVSQEQDTEA  117
           D+   S K ++ SSD   + D+++  D         + S +   +++    S      D+S S  +  D+
Sbjct:  76 DKSDSGKGKSDSSDSDSSDSSNSSDSSDSSDSDSSDSNSSDSDSSDSDSSDSSDSDSSD  135

Query: 118 NAVSPKEESSQEQENSVTPVPPLNTEAEPTATEPDSTIADSEEYKSSSKKRGGIVGTLIA  177
           ++ S      S +   +S          +++++ + +E DS+ +DS+    S S
Sbjct: 136 SSNSSDSSDSSDSSDSSDSSDSSDSKSDSSKSESDSSDSDSKSDSSDSN-----------  184
```

```
-continued
Query: 178 LILLLIVAIFGYNYFKNNNSTNSQTATSQSSSSKATTTSSEEDKKASQNLDNFNKSYANF 237
            +++S NS ++ S +SS+ + ++ S +   +S + D+ N S ++
Sbjct: 185 ---------------SSDSSDNSDSSDSSNSSNSSDSSDSSDSSDSSSSSDSSNSSDSS- 228

Query: 238 FVDDKKTQLKNSEFDKLSELEKKVDALKGTKYYGKVKVKFDSLKRQIDAVKAVNDKFKSP 297
            D       +SE    S+      D+  +           DS     D+ +N    S
Sbjct: 229 ---DSSDSSNSSESSDSSD-SSDSDSSDSSDSSNSNSSDSDS-SNSSDSSDSSNSSDSSD 283

Query: 298 AVVDGKKSEKLEVKDGANFDSLDSKTLNTGNASLDSLLHSIVSTGRNQVKQSEEQASSNK 357
              +     S+   + D +N  S DS    + + S DS   S    +  N    S+  SS+
Sbjct: 284 SSDSSNSSDSSDSSDSSN--SSDSSDSSDSSDSSDSSNSSDSNDSSNSSDSSDSSDSSDS 341

Query: 358 VSDTQITEQPNVTNGQSSSSAATINNQAAGTASGNLERNRS                   398
            + +  ++  + ++   SS+S+ + N+  +  +   + +S
Sbjct: 342 SNSSDSSDSSDSDSSDSSNSSDSSNSSDSSDSCNSSDSSDS                   382
```

A related DNA sequence was identified in *S. pyogenes* <SEQ ID 2971> which encodes the amino acid sequence <SEQ ID 2972>. Analysis of this protein sequence reveals the following:

```
Possible site: 28
>>> Seems to have no N-terminal signal sequence
    INTEGRAL    Likelihood = -14.70    Transmembrane    180-196 (175-202)

----- Final Results -----
            bacterial membrane --- Certainty = 0.6880(Affirmative) < succ>
             bacterial outside --- Certainty = 0.0000(Not Clear)  < succ>
           bacterial cytoplasm --- Certainty = 0.0000(Not Clear)  < succ>
```

The protein has homology with the following sequences in the databases:

```
>GP:AAF15293 GB:AF202180 erythrocyte membrane-associated giant
protein antigen 332 [Plasmodium falciparum]
Identities = 41/173 (23%), Positives = 87/173 (49%), Gaps = 10/173 (5%)

Query:   1 VSEESKEVEVTKESQTLGLNEAKSMTIGEAVRKQSE----IKAGVTKDDSILDKYIKQHR  56
           + E  + V + KE +  GL+  + +   ++V +Q+E    I   + K+ S ++    ++
Sbjct:  78 IEEAEENVWIEKEVEEEGLDNEEVIDEEDSVSEQAEEEVYINEEILKESSDVEDVKVENE 137

Query:  57 ---DEVSSQKFDAKYTELDTASLDNFIKKQREALSKAGLVDDEPVSAESAEQDSTLVEEV 113
              +EV+ +          +    LDN++ ++ E++++  +VD+ P S E   E +S ++EE+
Sbjct: 138 LMNEEVNEETQSVAENNEEDKELDNYVVEETESVTEEVVVDEVPNSKEVQEIES-IIEEI 196

Query: 114 AEDLAPMETTAVVTGIPVEATVPVLDLDPSERVIPEPQMTKEEPKRDQFLSED         166
           ED   +       G +E  V  + D SE ++  E  +T+E  K++   ++ED
Sbjct: 197 VEDGLTTDDLVGQQGSVIEEVVEEVGSD-SEGIVEEASITEEVEKKES-VTED         247
```

An alignment of the GAS and GBS proteins is shown below.

```
Identities = 234/506 (46%), Positives = 304/506 (59%), Gaps = 36/506 (7%)

Query:   1 MSEDQKHPFFEPKKETDGLEFKDAKEMTVEEAVRKDSEIKAGITEEDSILDKYIKQHRDE  60
           +SE+ K     E   KE+ L   +AK MT+ EAVRK SEIKAG+T++DSILDKYIKQHRDE
Sbjct:   1 VSEESKE--VEVTKESQTLGLNEAKSMTIGEAVRKQSEIKAGVTKDDSILDKYIKQHRDE  58

Query:  61 VASQKFETKSSDFANLDTASLDDFIKKQREELSAMLAAEELSKKLDNSVSQEQDTEANAV 120
           V+SQKF+ K   +   LDTASLD+FIKKQRE LS    A + +    ++ S EQD+
Sbjct:  59 VSSQKFDAK---YTELDTASLDNFIKKQREALSK---AGLVDDEPVSAESAEQDSTLVEE 112

Query: 121 SPKEESSQEQENSVTPVPPLNT--------------EAEPTATEP--DSTIADSEEYKSS 164
            ++ +  E     VT +P   T                E + T  EP  D  +++   + +
Sbjct: 113 VAEDLAPMETTAVVTGIPVEATVPVLDLDPSERVIPEPQMTKEEPKRDQFLSEDSHHPAK 172

Query: 165 SKKRGGIVGTLIALILLLIVAIFGYNYFKNNNSTNSQTATSQSSSSKATTTSSEEDKKAS 224
              + G +  L     L+L ++   +FG+N+F   +S   +   S+  +   T S+++  +
Sbjct: 173 QNTKKGWLIALFLLLLAILAVVFGWNHFLRQDSGKTTQTASKQTKTSLQTDSAKKATRLK 232

Query: 225 QNLDNFNKSYANFFVDDKKTQLKNSEFDKLSELEKKVDALKGTKYYGKVKVKFDSLKRQI 284
                F K Y  F+ D   K++LKNS F    L  +LE  +   AL+G+ YY K K K  DSLK+ I
Sbjct: 233 AAAKAFEKLYGTFYTDATKSKLKNSAFATLPDLEAALKALEGSAYYDKAKAKVDSLKKAI 292
```

-continued

```
Query:  285 DAVKAVNDKFKSPAVVDGKKSEKLEVKDGANFDSLDSKTLNTGNASLDSLLHSIVSTGRN  344
            A+  AVN KF S  VVDG+K     EVK ANFD L S TL  GNA+LD++L + ++ GR
Sbjct:  293 AAITAVNGKFVSDVVVDGEKVSA-EVKADANFDDLSSATLTIGNANLDAVLQASITEGRQ  351

Query:  345 QVKQSEEQASSNKVSDTQITEQPNVTNGQSSSSAATINNQAAGTAS---GNLERNRSRVP  401
            Q+    E A   K ++ Q   Q      GQS+S A +      G S    +L+R+ SRVP
Sbjct:  352 QLASKAEAA---KAANEQAV-QDQAAQGQSTSVAPS----GYGLTSYDPASLQRHLSRVP  403

Query:  402 YNNAAIADTGNPAWIFNPGVLEKIVATSQARGYFSGNNYILEPVNIINGNGYYNMFKLDG  461
            YN   IAD  NP+W FNPGVLEKIVATSQARGY SGN YILEPVNIINGNGYYNMFK DG
Sbjct:  404 YNQDVIADRANPSWAFNPGVLEKIVATSQARGYISGNQYILEPVNIINGNGYYNMFKPDG  463

Query:  462 TYLFSINAKTGYFVGNAPGRADSLDY                                   487
            TYLFSIN KTGYFVGN  G AD+LDY
Sbjct:  464 TYLFSINCKTGYFVGNGKGYADALDY                                   489
```

SEQ ID 2970 (GBS351) was expressed in *E. coli* as a His-fusion product. SDS-PAGE analysis of total cell extract is shown in FIG. 73 (lane 2; MW 57 kDa). It was also expressed in *E. coli* as a GST-fusion product. SDS-PAGE analysis of total cell extract is shown in FIG. 81 (lane 5; MW 82 kDa).

GBS351-GST was purified as shown in FIG. 216, lane 4.

Based on this analysis, it was predicted that these proteins and their epitopes could be useful antigens for vaccines or diagnostics.

EXAMPLE 972

A DNA sequence (GBSx1031) was identified in *S. agalactiae* <SEQ ID 2973> which encodes the amino acid sequence <SEQ ID 2974>. Analysis of this protein sequence reveals the following:

```
Possible site: 19
>>> Seems to have no N-terminal signal sequence

----- Final Results -----
            bacterial cytoplasm --- Certainty = 0.3169(Affirmative) < succ>
            bacterial membrane  --- Certainty = 0.0000(Not Clear)   < succ>
            bacterial outside   --- Certainty = 0.0000(Not Clear)   < succ>
```

A related DNA sequence was identified in *S. pyogenes* <SEQ ID 2975> which encodes the amino acid sequence <SEQ ID 2976>. Analysis of this protein sequence reveals the following:

```
Possible site: 19
>>> Seems to have no N-terminal signal sequence

----- Final Results -----
            bacterial cytoplasm --- Certainty = 0.3169(Affirmative) < succ>
            bacterial membrane  --- Certainty = 0.0000(Not Clear)   < succ>
            bacterial outside   --- Certainty = 0.0000(Not Clear)   < succ>
```

An alignment of the GAS and GBS proteins is shown below.

```
Identities = 129/160 (80%), Positives = 149/160 (92%)

Query:    1 MTKEVVVESFELDHTIVKAPYVRLISEEVGPVGDIITNFDIRLIQPNENAIDTAGLHTIE   60
            MTKEV+VESFELDHTIVKAPYVRLISEE GP GD ITNFD+RL+QPN+N+I+TAGLHTIE
Sbjct:    1 MTKEVIVESFELDHTIVKAPYVRLISESFGPKGDRITNFDVRLVQPNQNSIETAGLHTIE   60

Query:   61 HLLAKLIRQRINGLIDCSPFGCRTGFHMIMWGKQDATEIAKVIKSSLEAIAGGVTWEDVP  120
            HLLAKLIRQRI+G+IDCSPFGCRTGFH+IMWGK  +T+IAKVIKSSLE IA G+TWEDVP
Sbjct:   61 HLLAKLIRQRIDGMIDCSPFGCRTGFHLIMWGKHSSTDIAKVIKSSLEEIATGITWEDVP  120

Query:  121 GTTIESCGNYKDHSLHSAQEWAKLILSQGISDNAFERHIV                     160
            GTT+ESCGNYKDHSL +A+EWA+LI+ QGISD+ F RH++
Sbjct:  121 GTTLESCGNYKDHSLFAAKEWAQLIIDQGISDDPFSRHVI                     160
```

Based on this analysis, it was predicted that these proteins and their epitopes could be useful antigens for vaccines or diagnostics.

EXAMPLE 973

A DNA sequence (GBSx1032) was identified in *S. agalactiae* <SEQ ID 2977> which encodes the amino acid sequence <SEQ ID 2978>. Analysis of this protein sequence reveals the following:

```
Possible site: 32
>>> Seems to have a cleavable N-term signal seq.

----- Final Results -----
              bacterial outside --- Certainty = 0.3000(Affirmative) < succ>
             bacterial membrane --- Certainty = 0.0000(Not Clear)   < succ>
            bacterial cytoplasm --- Certainty = 0.0000(Not Clear)   < succ>
```

The protein has homology with the following sequences in the GENPEPT database.

```
>GP:AAF34762 GB:AF228345 unknown [Listeria monocytogenes]
Identities = 302/532 (56%), Positives = 400/532 (74%), Gaps = 14/532 (2%)

Query:    4 IILAMVCALIGLIIGYVAISMKMKSSKEAAELTLLNAEQDAVDLRGRAEIEAEHIRKAAE    63
            I + ++ +L+ LI+G V  S+  KSS           E+     RG AE+  E  +K AE
Sbjct:    3 IAITIISSLLFLIVGLVVGSLIFKSS----------TEKKLAAARGTAELIVEDAKKEAE   52

Query:   64 RESKAHQKELLLEAKEEARKYREEIEKEFKSDRQELKQMEARLTDRASSLDRKDENLSNK  123
            +KE LLEAKEE  + R EIE E +   R E ++ E RL  R  +LDRKD  +LS +
Sbjct:   53 TT----KKEALLEAKEENHRLRTEIENELRGRRTETQKAENRLLQREENLDRKDTSLSKR  108

Query:  124 EKMLDSKEQSLTDKSRHINEREQEIATLETKKVEELSRIAELSQEEAKDIILADTEKDLA  183
            E  L+ KE+S++ + + I E+E ++A +    EL RI+ LS+EEAK IIL    E++L
Sbjct:  109 EATLERKEESISKRQQQIEEKESKLAEMIQAEQTELERISALSKEEAKSIILNQVEEELT  168

Query:  184 HDIATRIKEAEREVKDRSIAKNKDLLAQAMQRLAGEYVTEQTITTVHLPDDNMKGRIIGR  243
            HD A  +KE+E    K+ S+K AK++L+ A+QR A ++V E T++ V LP+D MKGRIIGR
Sbjct:  169 HDTAIMVKESENRAKEESDKKAKNILSLAIQRCAADHVAETTVSVVTLPNDEMKGRIIGR  228

Query:  244 EGRNIRTLESLTGIDVIIDDTPEVVVLSGFDPIRREIARMTLESLIQDGRIHPARIEELV  303
            EGRNIRTLE+LTGID+IIDDTPE V+LSGFDPIRREIAR+ LE L+QDGRIHPARIEE+V
Sbjct:  229 EGRNIRTLETLTGIDLIIDDTPEAVILSGFDPIRREIARIALEKLVQDGRIHPARIEEMV  288

Query:  304 EKNRLEMDQRIREYGEAAAYEIGAPNLHPDLIKIMGRLQFRTSYGQNVLRHSVEVGKLAG  363
             K+ R E+D+ IRE GE A +E+G  ++HPDLIKI+GRL++RTSYGQNVL HS+EV KLAG
Sbjct:  289 DKARKEVDEHIREVGEQATFEVGIHSIHPDLIKILGRLRYRTSYGQNVLNHSLEVSKLAG  348

Query:  364 ILAGELGENVDLARRAGFLHDMGKAIDREVEGSHVEIGMEFARKYKEHPIVVNTIASHHG  423
            ILAGELGE+V LA+RAG LHD+GKAID E+EGSHVEIG+E A KYKE+ +V+N+IASHHG
Sbjct:  349 ILAGELGEDVTLAKRAGLLHDIGKAIDHEIEGSHVEIGVELATKYKENDVVINSIASHHG  408

Query:  424 DVEPDSVIAVIVAAADALSSARPGARNESMENYIKRLRDLEEIANGFEGVQNAFALQAGR  483
            D E  SVIAV+VAAADALS+ARPGAR+E++ENYI+RL   LEEI+   ++GV+ ++A+QAGR
Sbjct:  409 DTEATSVIAVLVAAADALSAARPGARSETLENYIRRLEKLEEISESYDGVEKSYAIQAGR  468

Query:  484 EIRIMVQPGKVSDDQVVIMSHKVREKIEQNLDYPGNIKVTVIREMRAVDFAK          535
            E+RI+V+P  + D        ++  +R++IE+ LDYPG+IKVTVIRE RAV++AK
Sbjct:  469 EVRIIVEPDTIDDLSSYRLARDIRKRIEEELDYPGHIKVTVIRETRAVEYAK          520
```

A related DNA sequence was identified in *S. pyogenes* <SEQ ID 2979> which encodes the amino acid sequence <SEQ ID 2980>. Analysis of this protein sequence reveals the following:

```
Possible site: 32
>>> Seems to have a cleavable N-term signal seq.

----- Final Results -----
              bacterial outside --- Certainty = 0.3000(Affirmative) < succ>
             bacterial membrane --- Certainty = 0.0000(Not Clear)   < succ>
            bacterial cytoplasm --- Certainty = 0.0000(Not Clear)   < succ>
```

The protein has homology with the following sequences in the databases:

```
>GP:AAF34762 GB:AF228345 unknown [Listeria monocytogenes]
Identities = 299/534 (55%), Positives = 408/534 (75%), Gaps = 14/534 (2%)

Query:   2 VNIILLIVSALIGLILGYALISIRLKSAKEAAELTLLNAEQEAVDIRGKAEVDAEHIKKT  61
           + I + I+S+L+ LI+G  + S+  KS+           E++   RG AE+    I +
Sbjct:   1 MTIAITIISSLLFLIVGLVVGSLIFKSS----------TEKKLAAARGTAEL----IVED  46

Query:  62 AKRESKANRKELLLEAKEEARKYREEIEQEFKSERQELKQLETRLAERSLTDRKDENLS  121
           AK+E++  +KE LLEAKEE  + R EIE E +  R E ++ E RL +R   LDRKD +LS
Sbjct:  47 AKKEAETTKKEALLEAKEENHRLRTEIENELRGRRTETQKAENRLLQREENLDRKDTSLS  106

Query: 122 SKEKVLDSKEQSLTDKSKHIDERQLQVEKLEEEKKAELEKVAAMTIAEAREVILMETENK  181
            +E   L+ KE+S++ + + I+E++ ++ ++ + ++ ELE+++A++   EA+ +IL + E +
Sbjct: 107 KREATLERKEESISKRQQQIEEKESKLAEMIQAEQTELERISALSKEEAKSIILNQVEEE  166

Query: 182 LTHEIATRIRDAERDIKDRTVKTAKDLLAQAMQRLAGEYVTEQTITSVHLPDDNMKGRII  241
           LTH+ A  ++++E   K+ + K AK++L+ A+QR A ++V E T++ V  LP+D MKGRII
Sbjct: 167 LTHDTAIMVKESENRAKEESDKKAKNILSLAIQRCAADHVAETTVSVVTLPNDEMKGRII  226

Query: 242 GREGRNIRTLESLTGIDVIIDDTPEVVILSGFDPIRREIARMTLESLIADGRIHPARIEE  301
           GREGRNIRTLE+LTGID+IIDDTPE VILSGFDPIRREIAR+ LE L+ DGRIHPARIEE
Sbjct: 227 GREGRNIRTLETLTGIDLIIDDTPEAVILSGFDPIRREIARIALEKLVQDGRIHPARIEE  286

Query: 302 LVEKNRLEMDNRIREYGEAAAYEIGAPNLHPDLIKIMGRLQFRTSFGQNVLRHSVEVGKL  361
           +V+K R E+D   IRE GE A +E+G  ++HPDLIKI+GRL++RTS+GQNVL HS+EV KL
Sbjct: 287 MVDKARKEVDEHIREVGEQATFEVGIHSIHPDLIKILGRLRYRTSYGQNVLNHSLEVSKL  346

Query: 362 AGILAGELGENVALARRAGFLHDMGKAIDREVEGSHVEIGMEFARKYKEHPVVVNTIASH  421
           AGILAGELGE+V LA+RAG LHD+GKAID E+EGSHVEIG+E A KYKE+ VV+N+IASH
Sbjct: 347 AGILAGELGEDVTLAKRAGLLHDIGKAIDHEIEGSHVEIGVELATKYKENDVVINSIASH  406

Query: 422 HGDVEPDSVIAVLVAAADALSSARPGARNESMENYIKRLRDLEEIATSFDGVQNSFALQA  481
           HGD E  SVIAVLVAAADALS+ARPGAR+E++ENYI+RL   LEEI+ S+DGV+ S+A+QA
Sbjct: 407 HGDTEATSVIAVLVAAADALSAARPGARSETLENYIRRLEKLEEISESYDGVEKSYAIQA  466

Query: 482 GREIRIMVQPEKISDDQVVILSHKVREKIENNLDYPGNIKVTVIREMRAVDYAK    535
           GRE+RI+V+P+ I D     L+  +R++IE   LDYPG+IKVTVIRE RAV+YAK
Sbjct: 467 GREVRIIVEPDTIDDLSSYRLARDIRKRIEEELDYPGHIKVTVIRETRAVEYAK    520
```

An alignment of the GAS and GBS proteins is shown below.

```
Identities = 451/535 (84%), Positives = 503/535 (93%)

Query:    1 MFNIILAMVCALIGLIIGYVAISMKMKSSKEAAELTLLNAEQDAVDLRGKAEIEAEHIRK  60
            M NIIL +V ALIGLI+GY   IS+++KS+KEAAELTLLNAEQ+AVD+RGKAE++AEHI+K
Sbjct:    1 MVNIILLIVSALIGLILGYALISIRLKSAKEAAELTLLNAEQEAVDIRGKAEVDAEHIKK  60

Query:   61 AAERESKAHQKELLLEAKEEARKYREEIEKEFKSDRQELKQMEARLTDRASSLDRKDENL  120
            A+RESKA++KELLLEAKEEARKYREEIE+EFKS RQELKQ E RL +R+  LDRKDENL
Sbjct:   61 TAKRESKANRKELLLEAKEEARKYREEIEQEFKSERQELKQLETRLAERSLTDRKDENL  120

Query:  121 SNKEKMLDSKEQSLTDKSRHINEREQEIATLETKKVEELSRIAELSQEEAKDIILADTEK  180
            S+KEK+LDSKEQSLTDKS+HI+ER+ ++  LE +K  EL ++A ++  EA+++IL +TE
Sbjct:  121 SSKEKVLDSKEQSLTDKSKHIDERQLQVEKLEEEKKAELEKVAAMTIAEAREVILMETEN  180

Query:  181 DLAHDIATRIKEAEREVKDRSNKIAKDLLAQAMQRLAGEYVTEQTITTVHLPDDNMKGRI  240
            L H+IATRI++AER++KDR+ K AKDLLAQAMQRLAGEYVTEQTIT+VHLPDDNMKGRI
Sbjct:  181 KLTHEIATRIRDAERDIKDRTVKTAKDLLAQAMQRLAGEYVTEQTITSVHLPDDNMKGRI  240

Query:  241 IGREGRNIRTLESLTGIDVIIDDTPEVVLSGFDPIRREIARMTLESLIQDGRIHPARIE  300
            IGREGRNIRTLESLTGIDVIIDDTPEV+LSGFDPIRREIARMTLESLI DGRIHPARIE
Sbjct:  241 IGREGRNIRTLESLTGIDVIIDDTPEVVILSGFDPIRREIARMTLESLIADGRIHPARIE  300

Query:  301 ELVEKNRLEMDQRIREYGEAAAYEIGAPNLHPDLIKIMGRLQFRTSYGQNVLRHSVEVGK  360
            ELVEKNRLEMD RIREYGEAAAYEIGAPNLHPDLIKIMGRLQFRTS+GQNVLRHSVEVGK
Sbjct:  301 ELVEKNRLEMDNRIREYGEAAAYEIGAPNLHPDLIKIMGRLQFRTSFGQNVLRHSVEVGK  360

Query:  361 LAGILAGELGENVDLARRAGFLHDMGKAIDREVEGSHVEIGMEFARKYKEHPIVVNTIAS  420
            LAGILAGELGENV LARRAGFLHDMGKAIDREVEGSHVEIGMEFARKYKEHP+VVNTIAS
Sbjct:  361 LAGILAGELGENVALARRAGFLHDMGKAIDREVEGSHVEIGMEFARKYKEHPVVVNTIAS  420

Query:  421 HHGDVEPDSVIAVIVAAADALSSARPGARNESMENYIKRLRDLEEIANGFEGVQNAFALQ  480
            HHGDVEPDSVIAV+VAAADALSSARPGARNESMENYIKRLRDLEEIA   F+GVQN+FALQ
Sbjct:  421 HHGDVEPDSVIAVLVAAADALSSARPGARNESMENYIKRLRDLEEIATSFDGVQNSFALQ  480

Query:  481 AGREIRIMVQPGKVSDDQVVIMSHKVREKIEQNLDYPGNIKVTVIREMRAVDFAK    535
```

```
              AGREIRIMVQP K+SDDQVVI+SHKVREKIE NLDYPGNIKVTVIREMRAVD+AK
Sbjct: 481 AGREIRIMVQPEKISDDQVVILSHKVREKIENNLDYPGNIKVTVIREMRAVDYAK       535
```

SEQ ID 2978 (GBS86) was expressed in *E. coli* as a His-fusion product. SDS-PAGE analysis of total cell extract is shown in FIG. 7 (lane 6; MW 59 kDa). It was also expressed in *E. coli* as a GST-fusion product. SDS-PAGE analysis of total cell extract is shown in FIG. 13 (lane 5; MW 84 kDa).

GBS86-GST was purified as shown in FIG. 192, lane 3.

Based on this analysis, it was predicted that these proteins and their epitopes could be useful antigens for vaccines or diagnostics.

EXAMPLE 974

A DNA sequence (GBSx1033) was identified in *S. agalactiae* <SEQ ID 2981> which encodes the amino acid sequence <SEQ ID 2982>. Analysis of this protein sequence reveals the following:

```
Possible site: 28
>>> Seems to have no N-terminal signal sequence

----- Final Results -----
          bacterial cytoplasm --- Certainty = 0.4984(Affirmative) < succ>
          bacterial membrane  --- Certainty = 0.0000(Not Clear)   < succ>
          bacterial outside   --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 975

A DNA sequence (GBSx1034) was identified in *S. agalactiae* <SEQ ID 2983> which encodes the amino acid sequence <SEQ ID 2984>. Analysis of this protein sequence reveals the following:

```
Possible site: 37
>>> Seems to have no N-terminal signal sequence
    INTEGRAL    Likelihood = -2.87    Transmembrane    146-162 (146-162)

----- Final Results -----
          bacterial membrane  --- Certainty = 0.2147(Affirmative) < succ>
          bacterial outside   --- Certainty = 0.0000(Not Clear)   < succ>
          bacterial cytoplasm --- Certainty = 0.0000(Not Clear)   < succ>
```

A related GBS nucleic acid sequence <SEQ ID 8697> which encodes amino acid sequence <SEQ ID 8698> was also identified. Analysis of this protein sequence reveals the following:

```
Lipop: Possible site: -1 Crend: 9
McG: Discrim Score: -10.72
GvH: Signal Score (-7.5): -5.66
    Possible site: 29
>>> Seems to have no N-terminal signal sequence
ALOM program count: 1 value: -2.87 threshold: 0.0
    INTEGRAL     Likelihood = -2.87    Transmembrane    138-154 (138-154)
    PERIPHERAL   Likelihood = 3.76     51
modified ALOM score: 1.07
*** Reasoning Step: 3

----- Final Results -----
          bacterial membrane  --- Certainty = 0.2147(Affirmative) < succ>
          bacterial outside   --- Certainty = 0.0000(Not Clear)   < succ>
          bacterial cytoplasm --- Certainty = 0.0000(Not Clear)   < succ>
```

The protein has homology with the following sequences in the GENPEPT database.

```
>GP:AAG21390 GB:AF302051 ABC transporter ATP binding subunit
[Bacillus licheniformis]
Identities = 84/218 (38%), Positives = 138/218 (62%), Gaps = 1/218 (0%)
Query:   12 DIIKVDHIFKSIGQKTILEDISFSIASNQCVALIGPNGAGKTTLMSTLLGDISISSGSLT    71
            +++ + ++ K+   QKT ++ I FSI    + VA++GPNGAGKTT +S +LG +  ++G++T
Sbjct:    3 NVVSLTNVTKTFRQKTAVDQIDFSIKKGEIVAILGPNGAGKTTTISMILGLLKPTAGNIT    62

Query:   72 IFNLPAHHNRLKYKVAILPQE-NVLPSKFTVRELIDFQRCLFPEVLPMSLILDYLQWSDT   130
            +F+   H   R++ K+  + QE +V+P     E+I+  R  +P+ L   +       +D
Sbjct:   63 LFDSMPHEKRVREKIGTMLQEVSVMPGLRCRVEIIELIRSYYPKPLSFQKLRTLTGLTDK   122

Query:  131 HLQQFTETLSGGQKRLLAFVLTLVGKPQLLFLDEPTSGMDTSTRQRFWELIATLKKEGVT   190
            L+    E LSGGQKR L F L L G P+L+   DEPT GMD ++R RFW+ + +L ++G  T
Sbjct:  123 DLKTQAEKLSGGQKRRLGFALALAGDPELMIFDEPTVGMDITSRNRFWQTVQSLAEQGKT   182

Query:  191 IVYSSHYIEEVEHTADRILVLHKGKLLRDTTPLCHEAR                        228
            I++S+HY++E +  A RIL+   GK++ D TPL  ++R
Sbjct:  183 IIFSTHYLQEADDAAQRILLFKDGKIVADGTPLQIKSR                        220
```

There is also homology to SEQ ID 686.

SEQ ID 8698 (GBS350) was expressed in *E. coli* as a His-fusion product. SDS-PAGE analysis of total cell extract is shown in FIG. 72 (lane 13; MW 28.9 kDa). It was also expressed in *E. coli* as a GST-fusion product. SDS-PAGE analysis of total cell extract is shown in FIG. 81 (lane 4; MW 54 kDa).

GBS350-GST was purified as shown in FIG. 226, lane 7.

Based on this analysis, it was predicted that these proteins and their epitopes could be useful antigens for vaccines or diagnostics.

EXAMPLE 976

A DNA sequence (GBSx1035) was identified in *S. agalactiae* <SEQ ID 2985> which encodes the amino acid sequence <SEQ ID 2986>. Analysis of this protein sequence reveals the following:

```
Possible site: 35
>>> Seems to have no N-terminal signal sequence

----- Final Results -----
         bacterial cytoplasm --- Certainty = 0.2913(Affirmative) < succ>
         bacterial membrane  --- Certainty = 0.0000(Not Clear)   < succ>
         bacterial outside   --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 977

A DNA sequence (GBSx1036) was identified in *S. agalactiae* <SEQ ID 2987> which encodes the amino acid sequence <SEQ ID 2988>. Analysis of this protein sequence reveals the following:

```
Possible site: 31
>>> Seems to have an uncleavable N-term signal seq
        INTEGRAL    Likelihood = -10.51    Transmembrane   222-238  (214-241)
        INTEGRAL    Likelihood =  -6.90    Transmembrane   104-120  (101-125)
        INTEGRAL    Likelihood =  -5.84    Transmembrane   140-156  (138-159)
        INTEGRAL    Likelihood =  -5.20    Transmembrane    19-35    (18-41)
        INTEGRAL    Likelihood =  -1.28    Transmembrane   164-180  (164-180)

----- Final Results -----
            bacterial membrane  --- Certainty = 0.5203(Affirmative) < succ>
            bacterial outside   --- Certainty = 0.0000(Not Clear)   < succ>
            bacterial cytoplasm --- Certainty = 0.0000(Not Clear)   < succ>
```

The protein has homology with the following sequences in the GENPEPT database.

```
>GP:CAB69806 GB:AJ243712 YVFS protein [Bacillus cereus]
Identities = 73/239 (30%), Positives = 127/239 (52%), Gaps = 4/239 (1%)
Query:    9 KMEFLLTKRQLANLIMAIGMPVAFFLFFSGFMGEGLTKAIEAIYVRNYMITMAGFSSLSF   68
            K+E L T R   +  ++ MPV F+  F+  +           +   +Y+I+MA FS  +
Sbjct:    4 KIEILRTFRNKLFIFFSLLMPVMFYYIFTNVVQ---VPQNGDAWKAHYLISMATFSIVGT   60

Query:   69 AFFTFPFSMKDDQLSNRMQLLRHSPVPMWQYYLAKIIRILFYYCLAITVVFLTGHILRQV  128
              A F+F    +  ++      LL+ +P+P   Y  AKII         +I V+F+ G ++  V
Sbjct:   61 ALFSFGVRLSQERGQGWTHLLKITPLPEGAYLTAKIIAQTVVNAFSILVIFIAGILINHV  120

Query:  129 SMPIEQWMQSFLLLLGGATCFIPFGLLVSYFKNTELMSMVANICYMSLAVLGGMWMPITM  188
              +  I  QW+ +  L LL  G T F+   G ++     K  +   + +ANI   MSLA++GG+WMPI +
Sbjct:  121 ELTIGQWIGAGLWLLLGVTPFLALGTVIGSIKKADAAAGLANILNMSLAIVGGLWMPIEV  180

Query:  189 FPKWLQALSKLTPTYHLTQVILSPFANSFAGF-SLIILIGYGIIMLVIAYLLSQKRHSI   246
              FPK L+ +  +  TPTYH         A      G+ ++  +L GY +I  +V++   +  +++  ++
Sbjct:  181 FPKILRTIGEWTPTYHFGSGAWDIVAGKSIGWENIAVLGGYFLIFVVVSIYIRKRQEAV   239
```

There is also homology to SEQ ID 682 and to SEQ ID 1628.

Based on this analysis, it was predicted that this protein and its epitopes, could be useful antigens for vaccines or diagnostics.

EXAMPLE 978

A DNA sequence (GBSx1037) was identified in *S. agalactiae* <SEQ ID 2989> which encodes the amino acid sequence <SEQ ID 2990>. This protein is predicted to be histidine kinase. Analysis of this protein sequence reveals the following:

```
Possible site: 49
>>> Seems to have a cleavable N-term signal seq.
    INTEGRAL    Likelihood = -7.43    Transmembrane    105-121 (102-124)
    INTEGRAL    Likelihood = -6.95    Transmembrane    130-146 (129-149)

----- Final Results -----
            bacterial membrane --- Certainty = 0.3972(Affirmative) < succ>
            bacterial outside  --- Certainty = 0.0000(Not Clear)   < succ>
           bacterial cytoplasm --- Certainty = 0.0000(Not Clear)   < succ>
```

A related GBS nucleic acid sequence <SEQ ID 9537> which encodes amino acid sequence <SEQ ID 9538> was also identified.

The protein has homology with the following sequences in the GENPEPT database.

```
>GP:CAB54584 GB:AJ006400 histidine kinase [Streptococcus pneumoniae]
Identities = 138/350 (39%), Positives = 212/350 (60%), Gaps = 3/350 (0%)
Query:   11 MYFIPLVFLIYPIGGILYYHYPFWTLFFTLAFVGAYLYSVIIRGESKYHMIAWSTMLTYI   70
            M++I L+F+I+PI  ++           W L   + FV AYL  V+   +     + W   MLTY+
Sbjct:   11 MFWISLIFMIFPILSVVTGWLSAWHLLIDILFVVAYL-GVLTTKSQRLSWLYWGLMLTYV   69

Query:   71 FYMTIFINSGFIWYIYFLSNLLVYRFRDK-LKSFRFISFACTLATVVF-LCFFKASDFGD  128
               T F+    +IW+ +FLSNLL Y F   + LKS    +F       VV  L F+    +
Sbjct:   70 VGNTAFVAVNYIWFFFLSNLLSYHFSVRSLKSLHVWTFLLAQVLVVGQLLIFQRIEVEF   129

Query:  129 RIMFLIVPIFCIGYMWIAIENRNSEEQREKIAEQNQYINILSAENERNRIGRDLHDSLGH  188
              L++     F       + + R   E+ +E    +QN   IN+L  AENER+RIG+DLHDSLGH
Sbjct:  130 LFYLLVILTFVDLMTFGLVRIRIVEDLKEAQVKQNAQINLLLAENERSRIGQDLHDSLGH  189

Query:  189 TFAMMTLKTELALKLLEKRNYDKVQKELSELNHISHQSMSEVRQIVSNLKYRTVVEEIDE  248
            TFAM+++KT+LAL+L +   Y +V+KEL E++  IS   SM+EVR  IV NLK RT+   E++
Sbjct:  190 TFAMLSVKTDLALQLFQMEAYPQVEKELKEIHQISKDSMNEVRTIVENLKSRTLTSELET  249

Query:  249 LYRLFQLSNIKLTVVNKLETSQLSPVTQSTITMILKELSNNIVKHAEADSVELSLVRQGA  308
             + ++ +++ I++   V N L+  S L+    +ST +MIL EL   NI+KHA+A   V L L R
Sbjct:  250 VKKMLEIAGIEVQVENHLDKSSLTQELESTASMILLELVTNIIKHAKASKVYLKLERTEK  309

Query:  309 TINIEMIDNGCGFTNLDGDELHSIQERLTIVEGTLTILSRSKPTHIQVVL           358
             + + +  D+GCGF ++ GDELH+++ R+       G ++++S+  PT +QV L
Sbjct:  310 ELILTVRDDGCGFASISGDELHTVRNRVFPFSGEVSVISQKHPTEVQVRL          359
```

There is also homology to SEQ ID 2992.

A related GBS gene <SEQ ID 8699> and protein <SEQ ID 8700> were also identified. Analysis of this protein sequence reveals the following:

```
Lipop: Possible site: -1 Crend: 8
McG: Discrim Score: 10.90
GvH: Signal Score (-7.5): -2.42
     Possible site: 49
>>> Seems to have a cleavable N-term signal seq.
ALOM program count: 2 value: -7.43 threshold: 0.0
    INTEGRAL      Likelihood = -7.43    Transmembrane    105-121 (102-124)
    INTEGRAL      Likelihood = -6.95    Transmembrane    130-146 (129-149)
    PERIPHERAL    Likelihood = 0.16     61
modified ALOM score: 1.99
*** Reasoning Step: 3

----- Final Results -----
            bacterial membrane --- Certainty = 0.3972(Affirmative) < succ>
            bacterial outside  --- Certainty = 0.0000(Not Clear)   < succ>
            bacterial cytoplasm --- Certainty = 0.0000(Not Clear)  < succ>
```

Based on this analysis, it was predicted that these proteins and their epitopes could be useful antigens for vaccines or diagnostics.

EXAMPLE 979

A DNA sequence (GBSx1038) was identified in *S. agalactiae* <SEQ ID 2993> which encodes the amino acid sequence <SEQ ID 2994>. This protein is predicted to be response regulator. Analysis of this protein sequence reveals the following:

```
Possible site: 28
>>> Seems to have no N-terminal signal sequence
    INTEGRAL    Likelihood = -0.16    Transmembrane    49-65 (49-65)

----- Final Results -----
            bacterial membrane --- Certainty = 0.1065(Affirmative) < succ>
            bacterial outside  --- Certainty = 0.0000(Not Clear)   < succ>
            bacterial cytoplasm --- Certainty = 0.0000(Not Clear)  < succ>
```

The protein has homology with the following sequences in the GENPEPT database.

```
>GP:CAB54585 GB:AJ006400 response regulator [Streptococcus pneumoniae]
Identities = 95/153 (62%), Positives = 125/153 (81%), Gaps = 3/153 (1%)
Query:   1 MKLLVAEDQSMLRDAMCQLLLMEESVSTIDQAGNGGEAIAILSNKAIDVAILDVEMPILS    60
           MK+LVAEDQSMLRDAMCQLL+++  V ++ QA NG  EAI +L   +++D+AILDVEMP+ +
Sbjct:   1 MKVLVAEDQSMLRDAMCQLLMLQPDVESVFQAKNGQEAIQLLEKESVDIAILDVEMPVKT    60

Query:  61 GLDVLEWVRKYQ-NVKVIIVTTFKRSGYFQRAIRSNVDAYVLKDRSVADLMKTIQKVLSG   119
           GL+VLEW+R   +   KV++VTTFKR GYF+RA+++  VDAYVLK+R++ADLM+T+   VL G
Sbjct:  61 GLEVLEWIRAEKLETKVVVVTTFKRPGYFERAVKAGVDAYVLKERNIADLMQTLHTVLEG   120

Query: 120 GKEYSPELMENVI--SNPLSEQEIKILSLIAQG                             150
           KEYSPELME V+   NPL+EQEI +L  IAQG
Sbjct: 121 RKEYSPELMEVVMMHPNPLTEQEIAVLKGIAQG                             153
```

There is also homology to SEQ ID 2996.

Based on this analysis, it was predicted that this protein and its epitopes, could be useful antigens for vaccines or diagnostics.

EXAMPLE 980

A DNA sequence (GBSx1039) was identified in *S. agalactiae* <SEQ ID 2997> which encodes the amino acid sequence <SEQ ID 2998>. Analysis of this protein sequence reveals the following:

```
Possible site: 34
>>> Seems to have an uncleavable N-term signal seq
    INTEGRAL    Likelihood = -6.69    Transmembrane    158-174  (145-184)
    INTEGRAL    Likelihood = -4.94    Transmembrane     11-27   (8-31)
    INTEGRAL    Likelihood = -3.93    Transmembrane     74-90   (73-92)
    INTEGRAL    Likelihood = -2.39    Transmembrane    103-119  (102-119)
    INTEGRAL    Likelihood = -1.86    Transmembrane     42-58   (38-59)

----- Final Results -----
              bacterial membrane --- Certainty = 0.3675(Affirmative) < succ>
               bacterial outside --- Certainty = 0.0000(Not Clear)   < succ>
             bacterial cytoplasm --- Certainty = 0.0000(Not Clear)   < succ>
```

The protein has homology with the following sequences in the GENPEPT database.

```
>GP:AAB85965 GB:AE000909 unknown [Methanothermobacter
thermoautotrophicus]
Identities = 46/183 (25%), Positives = 81/183 (44%), Gaps = 11/183 (6%)
Query:   5 KERFDTLSDAILAIAMTILVLEI-------KTPATMGDIGDFTRNIGLFIVSFVVVFNFW   57
           K+R + L DAI AIAMTILVL I       PA     ++  + +SF+++  FW
Sbjct:   6 KKRLEGLVDAIFAIAMTILVLGIDVPTGTMSVPAMDAYIMGLASDLYSYCLSFLLLGVFW   65

Query:  58 YERAQNSLDAQKTNDEIIALDIIEHLGICLIPLFTKFMISFENHNFAVMAYGLLTLLVGL  117
           +    +     +K +   I ++I+  + + L+P TK  ++ +       + + L  L +GL
Sbjct:  66 WVNHMHFEKLEKVDTGFIWINIVWLMVVVLVPFSTKLTGNYDLVTPNILFHLNMLTIGL  125

Query: 118 TSDIIRIRLASYDLVTIPSELKERVIKVMTTFAIRSVVVRFIIIILAYFLPEVGIFAYLV  177
             + I    L+ I    ++K   + ++      + +IL    PE     AY V
Sbjct: 126 LLSMSWIYTQRNGLMDIGENEYRLILKKNLLMPLAAI----LALILTPIAPEYSSTAYAV  181

Query: 178 IPL                                                          180
           + L
Sbjct: 182 LIL                                                          184
```

No corresponding DNA sequence was identified in *S. pyogenes*.

Based on this analysis, it was predicted that this protein and its epitopes, could be useful antigens for vaccines or diagnostics.

EXAMPLE 981

A DNA sequence (GBSx1040) was identified in *S. agalactiae* <SEQ ID 2999> which encodes the amino acid sequence <SEQ ID 3000>. This protein is predicted to be guanylate kinase (gmk). Analysis of this protein sequence reveals the following:

```
Possible site: 16
>>> Seems to have an uncleavable N-term signal seq

----- Final Results -----
              bacterial membrane --- Certainty = 0.0000(Not Clear) < succ>
               bacterial outside --- Certainty = 0.0000(Not Clear) < succ>
             bacterial cytoplasm --- Certainty = 0.0000(Not Clear) < succ>
```

The protein has homology with the following sequences in the GENPEPT database.

```
>GP:CAB13441 GB:Z99112 similar to guanylate kinase [Bacillus subtilis]
Identities = 121/202 (59%), Positives = 155/202 (75%)
Query:   1 MSERGLLIVFSGPSGVGKGTVRQEIFSTPDHKFDYSVSMTTRPQRPGEVDGVDYFFRTRE   60
           M ERGLLIV SGPSGVGKGTVRQ IFS  D KF+YS+S+TTR  R GEV+GVDYFF+TR+
Sbjct:  41 MKERGLLIVLSGPSGVGKGTVRQAIFSQEDTKFEYSISVTTRSPREGEVNGVDYFFKTRD  100

Query:  61 EFEALIKEGQMLEYAEYVGNYYGTPLSYVNETLDKGIDVFLEIEVQGALQVKSKVPDGVF  120
           EFE +I + ++LE+AEYVGNYYGTP+ YV +TL  G DVFLEIEVQGALQV++  P+G+F
Sbjct: 101 EFEQMIADNKLLEWAEYVGNYYGTPVDYVEQTLQDGKDVFLEIEVQGALQVRNAFPEGLF  160

Query: 121 IFLTPPDLEELEERLVGRGTDSPEVIAQRIERAKEEIALMREYDYAVVNDQVSLAAERVK  180
```

```
              IFL PP L EL+ R+V RGT++  +I   R++ AK EI  +M  YDY V ND V   A +++K
Sbjct: 161 IFLAPPSLSELKNRIVTRGTETDALIENRMKAAKAEIEMMDAYDYVVENDNVETACDKIK 220

Query: 181 RVIEAEHYRVDRVIGRYTNMVK                                        202
              ++ AEH + +RV  RY  M++
Sbjct: 221 AIVLAEHLKRERVAPRYKKMLE                                        242
```

A related DNA sequence was identified in *S. pyogenes* <SEQ ID 3001> which encodes the amino acid sequence <SEQ ID 3002>. Analysis of this protein sequence reveals the following:

```
     Possible site: 16
>>> Seems to have an uncleavable N-term signal seq

----- Final Results -----
              bacterial membrane --- Certainty = 0.0000 (Not Clear) < succ>
               bacterial outside --- Certainty = 0.0000 (Not Clear) < succ>
              bacterial cytoplasm --- Certainty = 0.0000 (Not Clear) < succ>
```

The protein has homology with the following sequences in the databases:

```
>GP:CAB13441 GB:Z99112 similar to guanylate kinase [Bacillus subtilis]
 Identities = 123/203 (60%), Positives = 157/203 (76%)

Query:   1 MSERGLLIVFSGPSGVGKGTVRQEIFSTPDHKFEYSVSMTTRPQRFGEVDGVDYFFRTRE   60
           M ERGLLIV SGPSGVGKGTVRQ IFS  D KFEYS+S+TTR  R GEV+GVDYFF+TR+
Sbjct:  41 MKERGLLIVLSGPSGVGKGTVRQAIFSQEDTKFEYSISVTTRSPREGEVNGVDYFFKTRD  100

Query:  61 EFEELIKTGQMLEYAEYVGNYYGTPLTYVNETLDKGIDVFLEIEVQGALQVKSKVPDGVF  120
           EFE++I    ++LE+AEYVGNYYGTP+ YV +TL  G DVFLEIEVQGALQV++  P+G+F
Sbjct: 101 EFEQMIADNKLLEWAEYVGNYYGTPVDYVEQTLQDGKDVFLEIEVQGALQVRNAFPEGLF  160

Query: 121 VFLTPPDLDELEDRLVGRGTDSQEVIAQRIERAKEEIALMREYDYAVVNDEVALAAERVK  180
           +FL PP L EL++R+V RGT++  +I  R++ AK EI +M  YDY V ND V   A +++K
Sbjct: 161 IFLAPPSLSELKNRIVTRGTETDALIENRMKAAKAEIEMMDAYDYVVENDNVETACDKIK  220

Query: 181 RIIETEHFRVERVIGRYDKMIKI                                      203
           I+  EH + ERV  RY KM+++
Sbjct: 221 AIVLAEHLKRERVAPRYKKMLEV                                       243
```

An alignment of the GAS and GBS proteins is shown below.

```
 Identities = 186/204 (91%), Positives = 197/204 (96%)

Query:   1 MSERGLLIVFSGPSGVGKGTVRQEIFSTPDHKFDYSVSMTTRPQRPGEVDGVDYFFRTRE   60
           MSERGLLIVFSGPSGVGKGTVRQEIFSTPDHKF+YSVSMTTRPQRPGEVDGVDYFFRTRE
Sbjct:   1 MSERGLLIVFSGPSGVGKGTVRQEIFSTPDHKFEYSVSMTTRPQRPGEVDGVDYFFRTRE   60

Query:  61 EFEALIKEGQMLEYAEYVGNYYGTPLSYVNETLDKGIDVFLEIEVQGALQVKSKVPDGVF  120
           EFE LIK GQMLEYAEYVGNYYGTPL+YVNETLDKGIDVFLEIEVQGALQVKSKVPDGVF
Sbjct:  61 EFEELIKTGQMLEYAEYVGNYYGTPLTYVNETLDKGIDVFLEIEVQGALQVKSKVPDGVF  120

Query: 121 IFLTPPDLEELEERLVGRGTDSPEVIAQRIERAKEEIALMREYDYAVVNDQVSLAAERVK  180
           +FLTPPDL+ELE+RLVGRGTDS EVIAQRIERAKEEIALMREYDYAVVND+V+LAAERVK
Sbjct: 121 VFLTPPDLDELEDRLVGRGTDSQEVIAQRIERAKEEIALMREYDYAVVNDEVALAAERVK  180

Query: 181 RVIEAEHYRVDRVIGRYTNMVKET                                     204
           R+IE EH+RV+RVIGRY  M+K T
Sbjct: 181 RIIETEHFRVERVIGRYDKMIKIT                                     204
```

Based on this analysis, it was predicted that these proteins and their epitopes could be useful antigens for vaccines or diagnostics.

EXAMPLE 982

A DNA sequence (GBSx1041) was identified in *S. agalactiae* <SEQ ID 3003> which encodes the amino acid sequence <SEQ ID 3004>. Analysis of this protein sequence reveals the following:

```
Possible site: 30
>>>Seems to have no N-terminal signal sequence

----- Final Results -----
           bacterial cytoplasm --- Certainty = 0.1763 (Affirmative) < succ>
           bacterial membrane  --- Certainty = 0.0000 (Not Clear)   < succ>
           bacterial outside   --- Certainty = 0.0000 (Not Clear)   < succ>
```

The protein has no significant homology with any sequences in the GENPEPT database.

A related DNA sequence was identified in *S. pyogenes* <SEQ ID 3005> which encodes the amino acid sequence <SEQ ID 3006>. Analysis of this protein sequence reveals the following:

```
Possible site: 35
>>>Seems to have no N-terminal signal sequence

----- Final Results -----
           bacterial cytoplasm --- Certainty = 0.1551 (Affirmative) < succ>
           bacterial membrane  --- Certainty = 0.0000 (Not Clear)   < succ>
           bacterial outside   --- Certainty = 0.0000 (Not Clear)   < succ>
```

An alignment of the GAS and GBS proteins is shown below.

```
 Identities = 95/105 (90%), Positives = 100/105  (94%), Gaps = 1/105 (0%)

Query:   1 MMLKPSIDTLLDKVPSKYSLVILQAKRAHELEAGEKATQDFKSVKSTLRALEEIESGNVV    60
           MMLKPSIDTLLDKVPSKYSLVILQAKRAHELEAG   TQ+FKSVKSTL+ALEEIESGNVV
Sbjct:   1 MMLKPSIDTLLDKVPSKYSLVILQAKRAHELEAGATPTQEFKSVKSTLQALEEIESGNVV    60

Query:  61 IHPDPSAKRASVRARIEAERLAKEEEERKIKEQIAKEK-EDGEKI                104
           IHPDPSAKR +VRA+IEAERLAKEEEERKIKEQIAKEK E+GEKI
Sbjct:  61 IHPDPSAKREAVRAKIEAERLAKEEEERKIKEQIAKEKEEEGEKI                105
```

Based on this analysis, it was predicted that these proteins and their epitopes could be useful antigens for vaccines or diagnostics.

EXAMPLE 983

A DNA sequence (GBSx1043) was identified in *S. agalactiae* <SEQ ID 3007> which encodes the amino acid sequence <SEQ ID 3008>. Analysis of this protein sequence reveals the following:

```
Possible site: 24
>>> Seems to have no N-terminal signal sequence

----- Final Results -----
           bacterial cytoplasm --- Certainty = 0.3413(Affirmative) < succ>
           bacterial membrane  --- Certainty = 0.0000(Not Clear)   < succ>
           bacterial outside   --- Certainty = 0.0000(Not Clear)   < succ>
```

The protein has homology with the following sequences in the GENPEPT database.

```
>GP:CAB13444 GB:Z99112 primosomal replication factor Y (primosomal
protein N') [Bacillus subtilis]
Identities = 377/807 (46%), Positives = 529/807 (64%), Gaps = 21/807 (2%)

Query:   6 AQVIVDIPLMQTDKPFSYAIPKDLEDLVQVGVRVHVPFGRGNRLLQGFVVGFRDDDELET   65
           A+VIVD+    D+PF Y IP   L+ +++ G+RV VPFG    R +QGFV    ++  +L
Sbjct:   4 AEVIVDVSTKNIDRPFDYKIPDHLKGMIKTGMRVIVPFGP--RKIQGFVTAVKEASDLSG   61
```

-continued

```
Query:   66 KDIAEV---LDFEPVLNQEQLDLADQMRHTVFSYKISILKSMLPSLLNSQYDKLLL---A  119
             K + EV    LD  PVL +E + L+  +      S+KI+ L++MLP+ L ++Y+K L
Sbjct:   62 KSVKEVEDLLDLTPVLTEELMILSSWLSDKTLSFKITALQAMLPAALKAKYEKELKIAHG  121

Query:  120 TDTLPSEDREDLFGHKTEIVFSSLSSQDAKKA-GRLIQKGFIEVQYLAKDKKTIKTEKIY  178
              D  P  +R LF       +++S +   + K   R +QKG I+V Y    K   K +
Sbjct:  122 ADLPPQVER--LFSETKTLLYSDIPDHETLKLIQRHVQKGDIDVTYKVAQKTNKKMVRHI  179

Query:  179 KINRTLLEKSQ----IAARAKKRLELKEFLLENPQPGRLTALN----KQFSSPVVNFFRE  230
             + N +  E ++    ++ +A K+ +   FL+  P+   ++ A      SS   +   +
Sbjct:  180 QANASKEELAKQAEGLSRQAAKQQAILHFLISEPEGVKIPAAELCKKTDTSSATIKTLIQ  239

Query:  231 EGIIEVIEKEASRSDNYFKGILKTDFLDLNQEQAKVVKIVVDQIGKEQNKPFLLEGITGS  290
             +G+++   +E  R     K    KT+ L  L  EQ     + +  + +  +++K FLL G+TGS
Sbjct:  240 KGLLKESYEEVYRDPYQDKMFKKTEPLPLTDEQRAAFEPIRETLDSDEHKVFLLHGVTGS  299

Query:  291 GKTEVYLHIIDNVLKLGKTAIVLVPEISLTPQMTNRFISRFGKQVAIMHSGLSEGEKFDE  350
             GKTE+YL   I+  VL   GK AIVLVPEISLTPQM NRF   RFG QVA+MHSGLS GEK+DE
Sbjct:  300 GKTEIYLQSIEKVLAKGKEAIVLVPEISLTPQMVNRFKGRFGSQVAVMHSGLSTGEKYDE  359

Query:  351 WRKIKSGQAKVVVGARSAIFAPLENIGAIIIDEEHESTYKQESNPRYHARDVALLRAEYY  410
             WRKI    + ++VVGARSAIFAP EN+G  IIIDEEHES+YKQE   PRYHA++VA+ RAE++
Sbjct:  360 WRKIHRKEVRLVVGARSAIFAPFENLGMIIIDEEHESSYKQEEMPRYHAKEVAIKRAEHH  419

Query:  411 KAVLLMGSATPSIESRARASRDVYKFLELKHRANPKARIPQVEIIDFRNFIGQQEVSNFT  470
                   +++GSATP++ES ARA + VY+ L LKHR N +   +P+V ++D R    +    S F+
Sbjct:  420 SCPVVLGSATPTLESYARAQKGVYELLSLKHRVNHRV-MPEVSLVDMREELRNGNRSMFS  478

Query:  471 SYLLDKIRDRLDKKEQVVLMLNRRGYSSFIMCRDCGYVDQCPNCDISLTLHMATKTMNCH  530
                L++K+ +  +  K EQ VL LN+RGYSSF+MCRDCGYV  QCP+CDIS+T H    + +  CH
Sbjct:  479 VELMEKLEETIAKGEQAVLFLNKRGYSSFVMCRDCGYVPQCPHCDISMTYHRYGQRLKCH  538

Query:  531 YCGFEKPIPRTCPNCNSKSISYYGTGTQKAYEELLKVIPDAKILRMDVDTTRQKGGHESI  590
             YCG E+P+P TCP C S+ I ++GTGTQ+   EEL KV+P A+++RMDVDTT +KG HE +
Sbjct:  539 YCGHEEPVPHTCPECASEHIRFFGTGTQRVEEELTKVLPSARVIRMDVDTTSRKGAHEKL  598

Query:  591 LKRFGNHEADILLGTQMIAKGLDFPNVTLVGVLNADTSLNLPDFRSSERTFQLLTQVAGR  650
             L  FG +ADILLGTQMIAKGLDFPNVTLVGVL+ADT L++ PDFRS E+TFQLLTQV GR
Sbjct:  599 LSAFGEGKADILLGTQMIAKGLDFPNVTLVGVLSADTTLHIPDFRSAEKTFQLLTQVSGR  658

Query:  651 AGRAEKEGEVVIQTYNPNHYAIQLAQKQDFEAFYQYEMNIRRQLGYPPYYFTVGLTLSNK  710
             AGR EK G V+IQTY P+HY+IQL +  D+E FYQ+EM  RR+   YPPYY+    +T+SH+
Sbjct:  659 AGRHEKPGHVIIQTYTPSHYSIQLTKTHDYETFYQHEMAHRREQSYPPYYYLALVTVSHE  718

Query:  711 DEEWLIRKSYEVLSLLKQGFSDKVKLLGPTPKPIARTHNLYHYQIIIKYRFEDNLELVLN  770
              +        + ++  LK      K+LGP+  PIAR  + Y YQ +IKY+ E  L  +L
Sbjct:  719 EVAKAAVTAEKIAHFLKANCGADTKILGPSASPIARIKDRYRYQCVIKYKQETQLSALLK  778

Query:  771 RLLD-MTQDKENRDLRLAIDHEPQNMM                                 796
             ++L+   ++ E + +  ++ID  P  MM
Sbjct:  779 KILEHYKREIEQKHVMISIDMNPYMMM                                 805
```

A related DNA sequence was identified in *S. pyogenes* <SEQ ID 3009> which encodes the amino acid sequence <SEQ ID 3010>. Analysis of this protein sequence reveals the following:

```
Possible site: 32
>>> Seems to have no N-terminal signal sequence

----- Final Results -----
         bacterial cytoplasm --- Certainty = 0.1396 (Affirmative) < succ>
          bacterial membrane --- Certainty = 0.0000 (Not Clear)  < succ>
           bacterial outside --- Certainty = 0.0000 (Not Clear)  < succ>
```

An alignment of the GAS and GBS proteins is shown below.

```
Identities = 556/793 (70%), Positives = 659/793 (82%), Gaps = 1/793 (0%)

Query:    4 KLAQVIVDIPLMQTDKPFSYAIPKDLEDLVQVGVRVHVPFGRGNRLLQGFVVGFRDDDEL   63
             K+A  VIVDIPLMQTDKPFSY IPK+L   LVQ+G RVHPFG+GNRLLQGF++GF  +D
Sbjct:   12 KVAHVIVDIPLMQTDKPFSYGIPKELVSLVQLGSRVHVPFGKGNRLLQGFIIGFGQEDSS   71

Query:   64 ETKDIAEVLDFEPVLNQEQLDLADQMRHTVFSYKISILKSMLPSLLNSQYDKLLLATDTL  123
```

```
               K I   VLD EPVLNQEQL LADQ+R TVFSYKI++LK+M+P+LLNS YDK+L      L
Sbjct:   72 SLKLIQTVLDPEPVLNQEQLTLADQLRKTVFSYKITLLKAMIPNLLNSNYDKVLRPESGL  131

Query:  124 PSEDREDLFGHKTEIVFSSLSSQDAKKAGRLIQKGFIEVQYLAKDKKTIKTEKIYKINRT  183
            DR+ LF K   +++S+L  +   K A + IQ G I V YLAKDKK +KTEK Y ++
Sbjct:  132 KKSDRDFLFEGKPSVLYSTLDREKEKIALKGIQAGHITVSYLAKDKKNLKTEKYYHVDLD  191

Query:  184 LLEKSQIAARAKKRLELKEFLLENPQPGRLTALNKQFSSPVVNFFREEGIIEVIEKEASR  243
            L     I++RAKKR LK++LL + +   +L    L + FS   VV +F     +I + E+    R
Sbjct:  192 ALAVHPISSRAKKRQLLKDYLLTHTKEAKLATLYQAFSRDVVAYFVTNHLIRIDERPIDR  251

Query:  244 SDNYFKGILKTDFLDLNQEQAKVVKIVVDQIGKEQNKPFLLEGITGSGKTEVYLHIIDNV  303
            S++YF   I  + FL LN++QA   V  +V+QIGK   +KPFL+EGITGSGKTEVYLHII+ V
Sbjct:  252 SESYFDQIKPSSFLTLNEQQASAVTEIVEQIGKP-SKPFLIEGITGSGKTEVYLHIIEAV  310

Query:  304 LKLGKTAIVLVPEISLTPQMTNRFISRFGKQVAIMHSGLSEGEKFDEWRKIKSGQAKVVV  363
            LK   KTAIVLVPEISLTPQMT+RFISRFGKQVAIMHSGLS+GEKFDEWRKIK+GQAKVVV
Sbjct:  311 LKQDKTAIVLVPEISLTPQMTSRFISRFGKQVAIMHSGLSDGEKFDEWRKIKTGQAKVVV  370

Query:  364 GARSAIFAPLENIGAIIIDEEHESTYKQESNPRYHARDVALLRAEYYKAVLLMGSATPSI  423
            GARSAIF+PLE IGAIIIDEEHESTYKQESNPRYHAR+VALLRA++++AV++MGSATPSI
Sbjct:  371 GARSAIFSPLERIGAIIIDEEHESTYKQESNPRYHAREVALLRAKHHQAVVVMGSATPSI  430

Query:  424 ESRARASRDVYKFLELKHRANPKARIPQVEIIDFRNFIGQQEVSNFTSYLLDKIRDRLDK  483
            ESRARAS+ VY F++L  RANP A+IP+V I+DFR++IGQQ VSNFT YL+DKI++RL K
Sbjct:  431 ESRARASKGVYHFIQLTQRANPLAKIPEVTIVDFRDYIGQQAVSNFTPYLIDKIKERLVK  490

Query:  484 KEQVVLMLNRRGYSSFIMCRDCGYVDQCPNCDISLTLHMATKTMNCHYCGFEKPIPRTCP  543
            KEQVVLMLNRRGYSSF+MCRDCGYVD+CPNCDISLTLHM TKTMNCHYCGF+KPIP TCP
Sbjct:  491 KEQVVLMLNRRGYSSFVMCRDCGYVDKCPNCDISLTLHMDTKTMNCHYCGFQKPIPITCP  550

Query:  544 NCNSKSISYYGTGTQKAYEELLKVIPDAKILRMDVDTTRQKGGHESILKRFGNHEADILL  603
              C+S  SI YYGTGTQKA++EL  VIP+AKILRMDVDTTR+K  H++IL  FG  EADILL
Sbjct:  551 ECHSNSIRYYGTGTQKAFDELQGVIPEAKILRMDVDTTRKKRSHKTILDSFGRQEADILL  610

Query:  604 GTQMIAKGLDFPNVTLVGVLNADTSLNLPDFRSSERTFQLLTQVAGRAGRAEKEGEVVIQ  663
            GTQMIAKGLDFPNVTLVGVLNADTSLNLPDFR+SE+TFQLLTQVAGRAGRA K GEV+IQ
Sbjct:  611 GTQMIAKGLDFPNVTLVGVLNADTSLNLPDFRASEKTFQLLTQVAGRAGRAHKPGEVLIQ  670

Query:  664 TYNPNHYAIQLAQKQDFEAFYQYEMNIRRQLGYPPYYFTVGLTLSHKDEEWLIRKSYEVL  723
            TYNP+HYAIQLA+KQDFEAFY+YEM+IR Q+ YPPYYFTVG+TLSH+ E   +++K+Y+V
Sbjct:  671 TYNPDHYAIQLAKKQDFEAFYRYEMSIRHQMAYPPYYFTVGITLSHRLEASVVKKAYQVT  730

Query:  724 SLLKQGFSDKVKLLGPTPKPIARTHNLYHYQIIIKYRFEDNLELVLNRLLDMTQDKENRD  783
            LLK   SD +K+LGPTPKPIARTHNLYHYQI++KYRFEDNLE  LNR+LD +Q+ +NR
Sbjct:  731 ELLKSHLSDNIKILGPTPKPIARTHNLYHYQILLKYRFEDNLEETLNRILDWSQEADNRH  790

Query:  784 LRLAIDHEPQNMM                                                796
            L+L ID EPQ +
Sbjct:  791 LKLIIDCEPQQFL                                                803
```

Based on this analysis, it was predicted that these proteins and their epitopes could be useful antigens for vaccines or diagnostics.

EXAMPLE 984

A DNA sequence (GBSx1044) was identified in *S. agalactiae* <SEQ ID 3011> which encodes the amino acid sequence <SEQ ID 3012>. This protein is predicted to be methionyl-tRNA formyltransferase (fmt). Analysis of this protein sequence reveals the following:

```
Possible site: 13
>>> Seems to have no N-terminal signal sequence

----- Final Results -----
          bacterial cytoplasm --- Certainty = 0.1329 (Affirmative) < succ>
          bacterial membrane --- Certainty = 0.0000 (Not Clear)  < succ>
           bacterial outside --- Certainty = 0.0000 (Not Clear)  < succ>
```

The protein has homology with the following sequences in the GENPEPT database.

```
>GP: CAB13446 GB: Z99112 methionyl-tRNA formyltransferase
[Bacillus subtilis]
Identities = 155/314 (49%), Positives = 221/314 (70%), Gaps = 7/314 (2%)

Query:    1 MTKLLFMGTPDFSATVLKGILADGKYDVLAVVTQPDRAVGRKKEIKMTPVKEVALENNIP   60
            MT+++FMGTPDFS VL+ ++ DG Y+V+ VVTQPDR  GRKK +    PVKE AL + IP
Sbjct:    1 MTRIVFMGTPDFSVPVLRTLIEDG-YEVVGVVTQPDRPKGRKKVLTPPPVKEEALRHGIP   59

Query:   61 VYQPEKLSGSPELEQLMTLGADGIVTAAFGQFLPTKLLESVGFA-INVHASLLPKYRGGA  119
            V QPEK+  + E+E+++ L D IVTAAFGQ LP +LL+S  +  INVHASLLP+ RGGA
Sbjct:   60 VLQPEKVRLTEEIEKVLALKPDLIVTAAFGQILPKELLDSPKYGCINVHASLLPELRGGA  119

Query:  120 PIHYAIINGEKEAGVTIMEMVAKMDAGDMVSKASVEITDEDNVGTMFDRLAVVGRDLLLD  179
            PIHY+I+ G+K+ G+TIM MV K+DAGDM+SK   V+I + DNVGT+ D+L+V G  LL +
Sbjct:  120 PIHYSILQGKKKTGITIMYMVEKLDAGDMISKVEVDIEETDNVGTLHDKLSVAGAKLLSE  179

Query:  180 TLPGYLSGDIKPIPQNEEEVSFSPNISPDEERIDWNKSSRDIFNHVRGMYPWPVAHTLLE  239
            T+P  ++G I P  Q+EE+ +++PNI  ++E +DW+++  +++N +RG+ PWPVA+T L
Sbjct:  180 TVPNVIAGSISPEKQDEEKATYAPNIKREQELLDWSRTGEELYNQIRGLNPWPVAYTTLN  239

Query:  240 GNRFKLY--EVTMSEGKGSPGQVIAKTKNSLTVATG-DGAIELKSVQPAGKPRMDIKDFL  296
            G    K++ +  +        PG V+A  K  + VATG + A+ L  +QPAGK RM  +DF+
Sbjct:  240 GQNLKIWASKKIAAPTTAEPGTVVAVEKEGIIVATGNETALLLTELQPAGKKRMKGEDFV  299

Query:  297 NGVGRNLEIGDKFG                                               310
            G      ++E GD  G
Sbjct:  300 RGA--HVEAGDVLG                                               311
```

A related DNA sequence was identified in *S. pyogenes* <SEQ ID 3013> which encodes the amino acid sequence <SEQ ID 3014>. Analysis of this protein sequence reveals the following:

```
Possible site: 15
>>> Seems to have no N-terminal signal sequence

----- Final Results -----
          bacterial cytoplasm --- Certainty = 0.0730(Affirmative) < succ>
          bacterial membrane  --- Certainty = 0.0000(Not Clear)  < succ>
          bacterial outside   --- Certainty = 0.0000(Not Clear)  < succ>
```

An alignment of the GAS and GBS proteins is shown below.

```
Identities = 217/310 (70%), Positives = 266/310 (85%)

Query:    1 MTKLLFMGTPDFSATVLKGILADGKYDVLAVVTQPDRAVGRKKEIKMTPVKEVALENNIP   60
            M KLLFMGTP FSATVLKG+L +   Y++L VVTQPDRAVGRKK+IK+TPVK++ALE+ I
Sbjct:    1 MIKLLFMGTPQFSATVLKGLLDNPAYEILGVVTQPDRAVGRKKDIKVTPVKQLALEHGIS   60

Query:   61 VYQPEKLSGSPELEQLMTLGADGIVTAAFGQFLPTKLLESVGFAINVHASLLPKYRGGAP  120
            +YQPEKLSGS EL ++M LGADGI+TAAFGQFLPT LL+SV FAINVHASLLPKYRGGAP
Sbjct:   61 IYQPEKLSGSQELIEIMGLGADGIITAAFGQFLPTILLDSVSFAINVHASLLPKYRGGAP  120

Query:  121 IHYAIINGEKEAGVTIMEMVAKMDAGDMVSKASVEITDEDNVGTMFDRLAVVGRDLLLDT  180
            IHYAI+NG+KEAGVTIMEM+ +MDAGDMV+KAS  I +  DNVGT+F++LA++GRDLLLD+
Sbjct:  121 IHYAIMNGDKEAGVTIMEMIKEMDAGDMVAKASTPILETDNVGTLFEKLAIIGRDLLLDS  180

Query:  181 LPGYLSGDIKPIPQNEEEVSFSPNISPDEERIDWNKSSRDIFNHVRGMYPWPVAHTLLEG  240
            LP YLSG++KPIPQ+   +FSPNISP+ E++DW  S++++FNH+RGM PWPVAHT LEG
Sbjct:  181 LPAYLSGELKPIPQDHSQATFSPNISPEHEKLDWTMSNQEVFNHIRGMNPWPVAHTFLEG  240

Query:  241 NRFKLYEVTMSEGKGSPGQVIAKTKNSLTVATGDGAIELKSVQPAGKPRMDIKDFLNGVG  300
             R K+YE ++EG+G PGQV+ KTK SL +ATG GA+ L  VQPAGKP+M I DFLNG+G
Sbjct:  241 QRLKIYEAQLAEGEGLPGQVVVKTKKSLVIATGQGALSLIVVQPAGKPKMSIIDFLNGIG  300

Query:  301 RNLEIGDKFG                                                   310
            R  LE+GD  G
Sbjct:  301 RKLEVGDIIG                                                   310
```

Based on this analysis, it was predicted that these proteins and their epitopes could be useful antigens for vaccines or diagnostics.

EXAMPLE 985

A DNA sequence (GBSx1045) was identified in *S. agalactiae* <SEQ ID 3015> which encodes the amino acid sequence <SEQ ID 3016>. This protein is predicted to be sunL protein (sun). Analysis of this protein sequence reveals the following:

```
Possible site: 59
>>> Seems to have no N-terminal signal sequence

----- Final Results -----
            bacterial cytoplasm --- Certainty = 0.1677(Affirmative) < succ>
             bacterial membrane --- Certainty = 0.0000(Not Clear)   < succ>
              bacterial outside --- Certainty = 0.0000(Not Clear)   < succ>
```

The protein has homology with the following sequences in the GENPEPT database.

```
>GP: CAA10711 GB: AJ132604 sunL protein [Lactococcus lactis]
Identities = 222/434 (51%), Positives = 305/434 (70%), Gaps = 15/434 (3%)

Query:    7 KSARGLALMTLEEVFDKGAYSNIALNKSLKKSRLSDKDRALVTEIVYGTVARKITLEWYL   66
            K+AR  AL  L ++F   AY+NI+L+++L+ S LS  D+  VT +VYG V++K  LEWY+
Sbjct:    3 KNARQTALDVLNDIFGNDAYANISLDRNLRDSELSTVDKGFVTALVYGVVSKKALLEWYI   62

Query:   67 SHFIVDRDKLELWVYHLLLLSLYQLLYLDNIPDHAIVNDAVTIAKNRGNKKGAEKLINAV  126
            +  +   K   W   LLLL++YQ+L++D +P  A V++AV IAK R + +       INAV
Sbjct:   63 TPLLKKEPKP--WAKMLLLLTIYQVLFMDKVPISAAVDEAVKIAK-RHDGQATANFINAV  119

Query:  127 LRR-VSSETLPEIASIKRQNKRYSVAYSMPVWLVKKLIDQYGETRALAIMESLFERNKAS  185
            LR  + SE  E        + K +   YSMP  L+ K++ Q+G  R    I+ESL + + S
Sbjct:  120 LRNFMRSEHRNE------EPKDWETKYSMPKLLLDKMVRQFGGKRTGEILESLEKPSHVS  173

Query:  186 LRVTDLSQKQTIKETLNVRDSHIAETALVADSGNFASTSFFQDGLITIQDESSQLVAPTL  245
            LR  D +        E    R S + ETAL+ADSGNF+  T  FQ G ITIQDE+SQLVAP L
Sbjct:  174 LRKIDPTV-----EIAGTRPSLLTETALIADSGNFSITEEFQTGRITIQDETSQLVAPQL  228

Query:  246 KVSGNDQVLDACSAPGGKTSHIASYLTTGAVTALDLYDHKLELVMENAKRLGLSDKIKTK  305
            + + G ++VLDAC+APGGK++H+A YLTTG +TALDLY+HKL+L+  +NA+R   ++DKI T+
Sbjct:  229 ELEGTEEVLDACAAPGGKSTHMAQYLTTGHITALDLYEHKLDLINQNAQRQHVADKITTQ  288

Query:  306 KLDASKAHEYFLEDTFDKILVDAPCSGIGLIRRKPDIKYNKANQDFEALQEIQLSILSSV  365
            K DA+  +E F  + FD+ILVDAPCSGIGLIRRKPDI+Y K + DF  LQ+IQL IL+S
Sbjct:  289 KADATMIYENFGPEKFDRILVDAPCSGIGLIRRKPDIRYRKESSDFIDLQKIQLEILNSA  348

Query:  366 CQTLRKGGIITYSTCTIFEEENFQVIEKFLENHPNFEQVELSHTQEDIVKRGCISISPEQ  425
                ++L+K GI+ YSTCTIF+EENF V+ +FLENHPNFEQVE+S+ + +++K GC+ I+PE
Sbjct:  349 SKSLKKSGIMVYSTCTIFDEENFDVVHEFLENHPNFEQVEISNEKPEVIKEGCLFITPEM  408

Query:  426 YHTDGFFIGQVKRI                                               439
            YHTDGFFI + K+I
Sbjct:  409 YHTDGFFIAKFKKI                                               422
```

A related DNA sequence was identified in *S. pyogenes* <SEQ ID 3017> which encodes the amino acid sequence <SEQ ID 3018>. Analysis of this protein sequence reveals the following:

```
Possible site: 42
>>> Seems to have a cleavable N-term signal seq.

----- Final Results -----
              bacterial outside --- Certainty = 0.3000 (Affirmative) < succ>
             bacterial membrane --- Certainty = 0.0000 (Not Clear)   < succ>
            bacterial cytoplasm --- Certainty = 0.0000 (Not Clear)   < succ>
```

The protein has homology with the following sequences in the databases:

```
>GP:CAA10711 GB:AJ132604 sunL protein [Lactococcus lactis]
Identities = 208/433 (48%), Positives = 287/433 (66%), Gaps = 13/433 (3%)
```

-continued

```
Query:     7 KSTRGKALLVIEAIFDQGAYTNIALNQQLSNKALSAKDRALLTEIVYGTVSRKISLEWYL   66
             K+ R  AL V+  IF   AY NI+L++ L +  LS  D+  +T +VYG VS+K  LEWY+
Sbjct:     3 KNARQTALDVLNDIFGNDAYANISLDRNLRDSELSTVDKGFVTALVYGVVSKKALLEWYI   62

Query:    67 AHYVKDRDKLDKWVYYLLMLSLYQLTYLDKLPAHAIVNDAVGIAKNRGNKKGAEKFVNAI  126
             +K   K    W    LL+L++YQ+ ++DK+P  A V++AV IAK R + +    F+NA+
Sbjct:    63 TPLLKKEPK--PWAKMLLLLTIYQVLFMDKVPISAAVDEAVKIAK-RHDGQATANFINAV  119

Query:   127 LRQFTSHPLPDMETIKRRNKYYSVKYSLPVWLVKKLEDQFGSDRSVAIMESLFVRSKASI  186
             LR F        E      K + KYS+P L+ K+  QFG R+  I+ESL   S  S+
Sbjct:   120 LRNFMRS-----EHRNEEPKDWETKYSMPKLLLDKMVRQFGGKRTGEILESLEKPSHVSL  174

Query:   187 RVTDPLKEEVAEALDAERSLLSATGLTKASGHFAASDYFTNGDITIQDESSQLVAPTLN  246
             R  DP        E        SLL+ T L   SG+F+ ++  F  G  ITIQDE+SQLVAP L
Sbjct:   175 RKIDP-----TVEIAGTRPSLLTETALIADSGNFSITEEFQTGRITIQDETSQLVAPQLE  229

Query:   247 IDGDDIILDACSAPGGKTSHIASYLKTGKVIALDLYDHKLELVKENANRLGVADNIETRK  306
             ++G + +LDAC +APGGK++H+A YL TG + ALDLY+HKL+L+ +NA R  VAD I T+K
Sbjct:   230 LEGTEEVLDACAAPGGKSTHMAQYLTTGHITALDLYEHKLDLINQNAQRQHVADKITTQK  289

Query:   307 LDAREVHRHFEKDSFDKILVDAPCSGIGLIRRKPDIKYNKESQGFNALQAIQLEILSSVC  366
                 DA  ++ +F  +  FD+ILVDAPCSGIGLIRRKPDI+Y KES  F  LQ IQLEIL+S
Sbjct:   290 ADATMIYENFGPEKFDRILVDAPCSGIGLIRRKPDIRYRKESSDFIDLQKIQLEILNSAS  349

Query:   367 QTLRKGGIITYSTCTIFDEENRQVIEAFLQSHPNFEQVKLNHTQADIVKDGYLIITPEQY  426
             ++L+K  GI+ YSTCTIFDEEN   V+    FL++HPNFEQV++++ + +++K+G L ITPE Y
Sbjct:   350 KSLKKSGIMVYSTCTIFDEENFDVVHEFLENHPNFEQVEISNEKPEVIKEGCLFITPEMY  409

Query:   427 QTDGFFIGQVRRV                                                439
              TDGFFI + +++
Sbjct:   410 HTDGFFIAKFKKI                                                422
```

An alignment of the GAS and GBS proteins is shown below.

```
Identities = 305/440 (69%), Positives = 370/440 (83%)

Query:     1 MANDWKKSARGLALMTLEEVFDKGAYSNIALNKSLKKSRLSDKDRALVTEIVYGTVARKI   60
             +A++WKKS RG AL+ +E +FD+GAY+NIALN+ L    LS KDRAL+TEIVYGTV+RKI
Sbjct:     1 LADNWKKSTRGKALLVIEAIFDQGAYTNIALNQQLSNKALSAKDRALLTEIVYGTVSRKI   60

Query:    61 TLEWYLSHFIVDRDKLELWVYHLLLLSLYQLLYLDNIPDHAIVNDAVTIAKNRGNKKGAE  120
             +LEWYL+H++ DRDKL+  WVY+LL+LSLYQL YLD +P HAIVNDAV IAKNRGNKKGAE
Sbjct:    61 SLEWYLAHYVKDRDKLDKWVYYLLMLSLYQLTYLDKLPAHAIVNDAVGIAKNRGNKKGAE  120

Query:   121 KLINAVLRRVSSETLPEIASIKRQNKRYSVAYSMPVWLVKKLIDQYGETRALAIMESLFE  180
             K +NA+LR+ +S  LP++ +IKR+NK YSV YS+PVWLVKKL DQ+G  R++AIMESLF
Sbjct:   121 KFVNAILRQFTSHPLPDMETIKRRNKYYSVKYSLPVWLVKKLEDQFGSDRSVAIMESLFV  180

Query:   181 RNKASLRVTDLSQKQTIKETLNVRDSHIAETALVADSGNFASTSFFQDGLITIQDESSQL  240
             R+KAS+RVTD + + + E L+   S ++ T L   SG+FA++ +F +G ITIQDESSQL
Sbjct:   181 RSKASIRVTDPLKEEVAEALDAERSLLSATGLTKASGHFAASDYFTNGDITIQDESSQL  240

Query:   241 VAPTLKVSGNDQVLDACSAPGGKTSHIASYLTTGAVTALDLYDHKLELVMENAKRLGLSD  300
             VAPTL + G+D +LDACSAPGGKTSHIASYL TG V ALDLYDHKLELV ENA RLG++D
Sbjct:   241 VAPTLNIDGDDIILDACSAPGGKTSHIASYLKTGKVIALDLYDHKLELVKENANRLGVAD  300

Query:   301 KIKTKKLDASKAHEYFLEDTFDKILVDAPCSGIGLIRRKPDIKYNKANQDFEALQEIQLS  360
              I+T+KLDA + H +F +D+FDKILVDAPCSGIGLIRRKPDIKYNK +Q F ALQ IQL
Sbjct:   301 NIETRKLDAREVHRHFEKDSFDKILVDAPCSGIGLIRRKPDIKYNKESQGFNALQAIQLE  360

Query:   361 ILSSVCQTLRKGGIITYSTCTIFEEENFQVIEKFLENHPNFEQVELSHTQEDIVKRGCIS  420
             ILSSVCQTLRKGGIITYSTCTIF+EEN QVIE FL++HPNFEQV+L+HTQ DIVK G +
Sbjct:   361 ILSSVCQTLRKGGIITYSTCTIFDEENRQVIEAFLQSHPNFEQVKLNHTQADIVKDGYLI  420

Query:   421 ISPEQYHTDGFFIGQVKRIL                                          440
             I+PEQY TDGFFIGQV+R+L
Sbjct:   421 ITPEQYQTDGFFIGQVRRVL                                          440
```

Based on this analysis, it was predicted that these proteins and their epitopes could be useful antigens for vaccines or diagnostics.

EXAMPLE 986

A DNA sequence (GBSx1046) was identified in *S. agalactiae* <SEQ ID 3019> which encodes the amino acid sequence <SEQ ID 3020>. This protein is predicted to be pppL protein. Analysis of this protein sequence reveals the following:

```
Possible site: 45
>>> Seems to have no N-terminal signal sequence

----- Final Results -----
            bacterial cytoplasm --- Certainty = 0.5796 (Affirmative) < succ>
            bacterial membrane  --- Certainty = 0.0000 (Not Clear)   < succ>
             bacterial outside  --- Certainty = 0.0000 (Not Clear)   < succ>
```

The protein has homology with the following sequences in the GENPEPT database.

```
>GP: CAA10712 GB: AJ132604 pppL protein [Lactococcus lactis]
Identities = 131/245 (53%), Positives = 177/245 (71%), Gaps = 4/245 (1%)

Query:    1 MEISLLTDIGQRRSNNQDFINQFENKAGVPLIILADGMGGHRAGNIASEMTVTDLGSDWA   60
            ME S+L+DIG +RS NQD++   + N+AG  L +LADGMGGH+AGN+AS++TV DLG  W+
Sbjct:    1 MEYSILSDIGSKRSTNQDYVGTYVNRAGYQLFLLADGMGGHKAGNVASKLTVEDLGKLWS   60

Query:   61 ETDF---SELSEIRDWMLVSIETENRKIYELGQSDDYKGMGTTIEAVAIVGDNIIFAHVG  117
            ET F   +  + +  W+   +  EN  I  LG+ D+Y+GMGTT EA+  I G+ I+ AHVG
Sbjct:   61 ETFFDAGTPEATLEIWLRNQVRNENENIASLGKLDEYQGMGTTLEALVIKGNTIVSAHVG  120

Query:  118 DSRIGIVRQGEYHLLTSDHSLVNELVKAGQLTEEEAASHPQKNIITQSIGQANPVEPDLG  177
            DSR ++R GE + +T+DHSLV ELV AGQ+TEEEA  HP KNIIT+S+GQ N V+ D+
Sbjct:  121 DSRTYLMRDGELNKITTDHSLVQELVDAGQITEEEAEVHPNKNIITRSLGQTNEVQADIQ  180

Query:  178 VHLLEEGDYLVVNSDGLTNMLSNADIATVLTQEK-TLDDKNQDLITLANHRGGLDNITVA  236
              L+ GD +++NSDGLTNM+S  +I   VL +E  TLD+K++ LI LAN  GGLDNITV
Sbjct:  181 ALELQAGDIILMNSDGLTNMVSTTEIMEVLEREDLTLDNKSEALIRLANEHGGLDNITVV  240

Query:  237 LVYVE                                                         241
            L+  E
Sbjct:  241 LIKFE                                                         245
```

A related DNA sequence was identified in *S. pyogenes* <SEQ ID 3021> which encodes the amino acid sequence <SEQ ID 3022>. Analysis of this protein sequence reveals the following:

```
Possible site: 43
>>> Seems to have no N-terminal signal sequence

----- Final Results -----
            bacterial cytoplasm --- Certainty = 0.5301(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below.

```
Identities = 180/245 (73%), Positives = 220/245 (89%)

Query:    1 MEISLLTDIGQRRSNNQDFINQFENKAGVPLIILADGMGGHRAGNIASEMTVTDLGSDWA   60
            M+ISL TDIGQ+RSNNQDFIN+F+NK G+ L+ILADGMGGHRAGNIASEMTVTDLG +W
Sbjct:    1 MKISLKTDIGQKRSNNQDFINKFDNKKGITLVILADGMGGHRAGNIASEMTVTDLGREWV   60

Query:   61 ETDFSELSEIRDWMLVSIETENRKIYELGQSDDYKGMGTTIEAVAIVGDNIIFAHVGDSR  120
            +TDF+ELS+IRDW+  +I++EN++IY+LGQS+D+KGMGTT+EAVA+V    + I+AH+GDSR
Sbjct:   61 KTDFTELSQIRDWLFETIQSENQRIYDLGQSEDFKGMGTTVEAVALVESSAIYAHIGDSR  120

Query:  121 IGIVRQGEYHLLTSDHSLVNELVKAGQLTEEEAASHPQKNIITQSIGQANPVEPDLGVHL  180
            IG+V   G Y LLTSDHSLVNELVKAGQ+TEEEAASHPQ+NIITQSIGQA+PVEPDLGV +
Sbjct:  121 IGLVHDGHYTLLTSDHSLVNELVKAGQITEEEAASHPQRNIITQSIGQASPVEPDLGVRV  180
```

```
Query:  181 LEEGDYLVVNSDGLTNMLSNADIATVLTQEKTLDDKNQDLITLANHRGGLDNITVALVYV  240
            LE GDYLV+NSDGLTNM+SN +I T+L   + +LD+KNQ++I LAN RGGLDNIT+ALV+
Sbjct:  181 LEPGDYLVINSDGLTNMISNDEIVTILGSKVSLDEKNQEMIDLANLRGGLDNITIALVHN  240

Query:  241 ESEAV                                                        245
            ESE V
Sbjct:  241 ESEDV                                                        245
```

Based on this analysis, it was predicted that these proteins and their epitopes could be useful antigens for vaccines or diagnostics.

EXAMPLE 987

A DNA sequence (GBSx1047) was identified in *S. agalactiae* <SEQ ID 3023> which encodes the amino acid sequence <SEQ ID 3024>. Analysis of this protein sequence reveals the following:

```
Possible site: 56
>>> Seems to have no N-terminal signal sequence
   INTEGRAL    Likelihood = -10.03      Transmembrane     346-362 (340-372)

----- Final Results -----
              bacterial membrane --- Certainty = 0.5012(Affirmative) < succ>
               bacterial outside --- Certainty = 0.0000(Not Clear)   < succ>
             bacterial cytoplasm --- Certainty = 0.0000(Not Clear)   < succ>
```

A related GBS nucleic acid sequence <SEQ ID 9539> which encodes amino acid sequence <SEQ ID 9540> was also identified.

The protein has homology with the following sequences in the GENPEPT database.

```
>GP: CAA10713 GB: AJ132604 hypothetical protein [Lactococcus lactis]
Identities = 219/380 (57%), Positives = 284/380 (74%), Gaps = 8/380 (2%)

Query:    1 MIQIGKLFAGRYRILKSIGRGGMADVYLARDLILDNEEVAIKVLRTNYQTDQIAVARFQR   60
            MIQIGK+FA RYRI+K IGRGGMA+VY    D  L + +VAIKVLR+N++ D IA+ARFQR
Sbjct:    1 MIQIGKIFADRYRIIKEIGRGGMANVYQGEDTFLGDRKVAIKVLRSNFENDDIAIARFQR   60

Query:   61 EARAMAELTHPNIVAIRDIGEEDGQQFLVMEYVDGFDLKKYIQDNAPLSNNEVVRIMNEV  120
            EA AMAEL+HPNIV I D+GE + QQ++VME+VDG  LK+YI  NAPL+N+E + I+ E+
Sbjct:   61 EAFAMAELSHPNIVGISDVGEFESQQYIVMEFVDGMTLKQYINQNAPLANDEAIEIITEI  120

Query:  121 LSAMSLAHQKGIVHRDLKPQNILLTKKGTVKVTDFGIAVAFAETSLTQTNSMLGSVHYLS  180
            LSAM +AH  GI+HRDLKPQN+L++  GTVKVTDFGIA A +ETSLTQTN+M GSVHYLS
Sbjct:  121 LSAMDMAHSHGIIHRDLKPQNVLSSSGTVKVTDFGIAKALSETSLTQTNTMFGSVHYLS  180

Query:  181 PEQARGSKATVQSDIYAMGIMLFEMLTGHIPYDGDSAVTIALQHFQKPLPSILAENKSVP  240
            PEQARGS ATVQSDIYA+GI+LFE+LTG IP+DGDSAV IAL+HFQ+ +PSI+  N  VP
Sbjct:  181 PEQARGSNATVQSDIYAIGIILFELLTGQIPFDGDSAVAIALKHFQENIPSIINLNPEVP  240

Query:  241 QALENIVIKATAKKLTDRYKTTYEMGRDLSTALSSTRHREPKLVFN-DTESTKTLPKVTS  299
            QALEN+VIKATAK + +RY      EM  D++T+  S  R   E KLVFN D + TK +P    +
Sbjct:  241 QALENVVIKATAKDINNRYADVEEMMTDVATSTSLDRRGEEKLVFNKDHDETKIMP--AN  298

Query:  300 TVSSLTTEQLLRNQKQAKTTEKITPDSASNDKTKSKKKASHRLLGTIMKLFFALCVVGII  359
                ++   T+ L+    K+       EK    +S++ +    K+K K S +   G I+ L     L V+G
Sbjct:  299 LINPYDTKPLI--DKKTDDQEKAQSESSTTENNKNKNKKSKK--GLIISLVVLLLVIGGG  354

Query:  360 VFAYKILVSPTTIRVPDVSN                                         379
            FA+ +  +PT ++VP+V+N
Sbjct:  355 AFAWAV-STPTNVKVPNVTN                                         373
```

A related DNA sequence was identified in *S. pyogenes* <SEQ ID 3025> which encodes the amino acid sequence <SEQ ID 3026>. Analysis of this protein sequence reveals the following:

```
Possible site: 56
>>> Seems to have no N-terminal signal sequence
    INTEGRAL     Likelihood = -8.60    Transmembrane    349-365 (340-370)

----- Final Results -----
             bacterial membrane --- Certainty = 0.4439(Affirmative) < succ>
              bacterial outside --- Certainty = 0.0000(Not Clear)   < succ>
            bacterial cytoplasm --- Certainty = 0.0000(Not Clear)   < succ>
```

The protein has homology with the following sequences in the databases:

```
>GP:CAA10713 GB:AJ132604 hypothetical protein [Lactococcus lactis]
Identities = 209/378 (55%), Positives = 273/378 (71%), Gaps = 8/378 (2%)

Query:    1 MIQIGKLFAGRYRILKSIGRGGMADVYLANDLILDNEDVAIKVLRTNYQTDQVAVARFQR   60
            MIQIGK+FA RYRI+K IGRGGMA+VY    D  L  + VAIKVLR+N++ D +A+ARFQR
Sbjct:    1 MIQIGKIFADRYRIIKEIGRGGMANVYQGEDTFLGDRKVAIKVLRSNFENDDIAIARFQR   60

Query:   61 EARAMAELNHPNIVAIRDIGEEDGQQFLVMEYVDGADLKRYIQNHAPLSNNEVVRIMEEV  120
            EA AMAEL+HPNIV I D+GE + QQ++VME+VDG  LK+YI  +APL+N+E + I+ E+
Sbjct:   61 EAFAMAELSHPNIVGISDVGEFESQQYIVMEFVDGMTLKQYINQNAPLANDEAIEIITEI  120

Query:  121 LSAMTLAHQKGIVHRDLKPQNILLTKEGVVKVTDFGIAVAFAETSLTQTNSMLGSVHYLS  180
            LSAM +AH GI+HRDLKPQN+L++  G VKVTDFGIA A +ETSLTQTN+M GSVHYLS
Sbjct:  121 LSAMDMAHSHGIIHRDLKPQNVLVSSSGTVKVTDFGIAKALSETSLTQTNTMFGSVHYLS  180

Query:  181 PEQARGSKATIQSDIYAMGIMLFEMLTGHIPYDGDSAVTIALQHFQKPLPSIIEENHNVP  240
            PEQARGS AT+QSDIYA+GI+LFE+LTG IP+DGDSAV IAL+HFQ+ +PSII N  VP
Sbjct:  181 PEQARGSNATVQSDIYAIGIILFELLTGQIPFDGDSAVAIALKHFQENIPSIINLNPEVP  240

Query:  241 QALENVVIRATAKKLSDRYGSTFEMSRDLMTALSYNRSRERKIIF-ENVESTKPLPKVAS  299
            QALENVVI+ATAK +++RY    EM  D+ T+ S  +R  E K++F ++ + TK +P
Sbjct:  241 QALENVVIKATAKDINNRYADVEEMMTDVATSTSLDRRGEEKLVFNKDHDETKIMPANLI  300

Query:  300 GPTASVKLSPPTPTVLTQESRLDQTNQTDALQPPTKKKKSGRFLGTLFKILFSFFIVGVA  359
               P   +  L        QE   +++ T+ +   KK K G  +   +L    ++G
Sbjct:  301 NPYDTKPLIDKKTD--DQEKAQSESSTTENNKNKNKKSKKGLIISLVVLLL----VIGGG  354

Query:  360 LFTYLILTKPTSVKVPNV                                           377
            F + + T  PT+VKVPNV
Sbjct:  355 AFAWAVST-PTNVKVPNV                                           371
```

An alignment of the GAS and GBS proteins is shown below.

```
Identities = 390/643 (60%), Positives = 480/643 (73%), Gaps = 29/643 (4%)

Query:    1 MIQIGKLFAGRYRILKSIGRGGMADVYLARDLILDNEEVAIKVLRTNYQTDQIAVARFQR   60
            MIQIGKLFAGRYRILKSIGRGGMADVYLA DLILDNE+VAIKVLRTNYQTDQ+AVARFQR
Sbjct:    1 MIQIGKLFAGRYRILKSIGRGGMADVYLANDLILDNEDVAIKVLRTNYQTDQVAVARFQR   60

Query:   61 EARAMAELTHPNIVAIRDIGEEDGQQFLVMEYVDGFDLKKYIQDNAPLSNNEVVRIMNEV  120
            EARAMAEL HPNIVAIRDIGEEDGQQFLVMEYVDG DLK+YIQ++APLSNNEVVRIM EV
Sbjct:   61 EARAMAELNHPNIVAIRDIGEEDGQQFLVMEYVDGADLKRYIQNHAPLSNNEVVRIMEEV  120

Query:  121 LSAMSLAHQKGIVHRDLKPQNILLTKKGTVKVTDFGIAVAFAETSLTQTNSMLGSVHYLS  180
            LSAM+LAHQKGIVHRDLKPQNILLTK+G VKVTDFGIAVAFAETSLTQTNSMLGSVHYLS
Sbjct:  121 LSAMTLAHQKGIVHRDLKPQNILLTKEGVVKVTDFGIAVAFAETSLTQTNSMLGSVHYLS  180

Query:  181 PEQARGSKATVQSDIYAMGIMLFEMLTGHIPYDGDSAVTIALQHFQKPLPSILAENKSVP  240
            PEQARGSKAT+QSDIYAMGIMLFEMLTGHIPYDGDSAVTIALQHFQKPLPSI+ EN +VP
Sbjct:  181 PEQARGSKATIQSDIYAMGIMLFEMLTGHIPYDGDSAVTIALQHFQKPLPSIIEENHNVP  240

Query:  241 QALENIVIKATAKKLTDRYKTTYEMGRDLSTALSSTRHREPKLVFNDTESTKTLPKVTS-  299
            QALEN+VI+ATAKKL DRY +T+EM RDL TALS  R RE K++F ++ ESTK LPKV S
Sbjct:  241 QALENVVIRATAKKLSDRYGSTFEMSRDLMTALSYNRSRERKIIFENVESTKPLPKVASG  300

Query:  300 ----------TVSSLTTEQLLRNQKQATTEKITPDSASNDKTKSKKKASHRLLGTIMKL  349
                      T + LT E  L   Q  T+ + P +         KKK S R LGT+ K+
Sbjct:  301 PTASVKLSPPTPTVLTQESRL---DQTNQTDALQPPT--------KKKKSGRFLGTLFKI  349

Query:  350 FFALCVVGIIVFAYKILVSPTTIRVPDVSNKTVAQAKMTLENSGLKVGAIRNIESDSVSE  409
            F+  +VG+ +F Y IL  PT+++VP+V+    ++  AK  L +  GLKVG IR  IESD+V+E
Sbjct:  350 LFSFFIVGVALFTYLILTKPTSVKVPNVAGTSLKVAKQELYDVGLKVGKIRQIESDTVAE  409
```

-continued

```
Query:  410 GLVVKTDPAAGRSRREGAKVNLYIATPNKSFTLGNYKEHNYKDILKDL-QGKGVKKSLIK  468
            G VV+TDP AG ++R+G+ + LY++  NK F + NYK  +Y++ +  L +  GV KS IK
Sbjct:  410 GNVVRTDPKAGTAKRQGSSITLYVSIGNKGFDMENYKGLDYQEANNSLIETYGVPKSKIK  469

Query:  469 VKRKINNDYTTGTILAQSLPEGTSFNPDGNKKLTLTVAVNDPMIMPDVTGMTVGEVIETL  528
            ++R + N+Y   T+++QS   G  FNP+G  K+TL+VAV+D + MP VT  +  + + TL
Sbjct:  470 IERIVTNEYPENTVISQSPSAGDKFNPNGKSKITLSVAVSDTITMPMVTEYSYADAVNTL  529

Query:  529 TDLGLDADNLVFYQMQNGV---YQTVVTPPSSSKIASQDPYYGGEVGLRRGDKVKLYLLG  585
            T LG+DA + Y  +        + + P S + ++ Q PYYG  + L      ++ LYL
Sbjct:  530 TALGIDASRIKAYVPSSSSATGFVPIHSPSSKAIVSGQSPYYGTSLSLSDKGEISLYLYP  589

Query:  586 SKTTNNSSSTPIDSSASSSTGTTTSDSVSSSTDASTSDSSSTS                  628
            +T ++SSS+   SS SSS  ++ +DS +  ++    S S +TS
Sbjct:  590 EETHSSSSSS---SSTSSSNSSSINDSTAPGSNTELSPSETTS                  629
```

Figure 27:
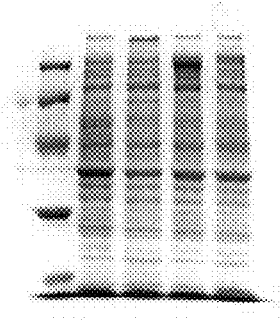
Figure 159:
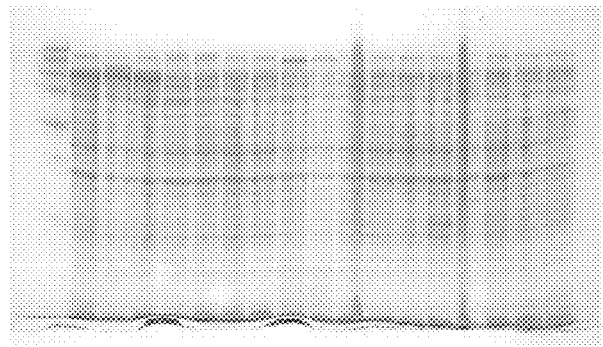

SEQ ID 3024 (GBS297) was expressed in *E. coli* as a His-fusion product. SDS-PAGE analysis of total cell extract is shown in FIG. 43 (lane 6; MW 75 kDa). It was also expressed in *E. coli* as a GST-fusion product. SDS-PAGE analysis of total cell extract is shown in FIG. 27 (lane 4; MW 100.2 kDa) and in FIG. 159 (lane 24; MW 100 kDa). GBS297-GST was purified as shown in FIG. 223, lane 3.

GBS297-His was purified as shown in FIG. 203, lane 8.

Based on this analysis; it was predicted that these proteins and their epitopes could be useful antigens for vaccines or diagnostics.

EXAMPLE 988

A DNA sequence (GBSx1048) was identified in *S. agalactiae* <SEQ ID 3027> which encodes the amino acid sequence <SEQ ID 3028>. Analysis of this protein sequence reveals the following:

```
Possible site: 16
>>> Seems to have an uncleavable N-term signal seq
    INTEGRAL      Likelihood = -7.91      Transmembrane    60-76 (50-90)
    INTEGRAL      Likelihood = -7.43      Transmembrane     7-23 (3-25)
    INTEGRAL      Likelihood = -5.68      Transmembrane    27-43 (24-46)

----- Final Results -----
            bacterial membrane --- Certainty = 0.4163(Affirmative) < succ>
            bacterial outside  --- Certainty = 0.0000(Not Clear)   < succ>
            bacterial cytoplasm --- Certainty = 0.0000(Not Clear)   < succ>
```

The protein has homology with the following sequences in the GENPEPT database.

```
>GP: BAB03323 GB: AB035448 hypothetical protein [Staphylococcus
aureus]
Identities = 53/230 (23%), Positives = 104/230 (45%), Gaps = 14/230 (6%)

Query:    5 QFFLLVEAVVLVMGLMKILSDDWTSFIFILAL--ILLALRF-YNNDSRHNFLLTTSLLLL   61
            Q ++ A++++     I +     F+ +L L  +L+ + + Y +  R            LL+
Sbjct:    9 QMLIIFTALMIIANFYYIFFEK-IGFLLVLLLGCVLVYVGYLYFHKIRGLLAFWIGALLI   67

Query:   62 FLIFMLNPY-IIAAVVFAVLYVLINHFSQVKKKNRYALIQFKNHQLDVKTTRNQWLGTDQ  120
            + N Y II    VF +L ++      + K K  A +     +K     +W G +
Sbjct:   68 AFTLLSNKYTIIILFVFLLLLIVRYLIHKFKPKKVVATDEVMTSPSFIK---QKWFGEQR  124

Query:  121 HESDFYAFEDINIIRISGTDTIDLTNVIVSGQDNVIIIQKVFGDTKVLVPLDVAVKADIS  180
                 Y +ED+ I     G    IDLT       ++N  I+++ + G  +V++P++  +     ++
Sbjct:  125 TPVYVYKWEDVQIQHGIGDLHIDLTKAANIKENNTIVVRHILGKVQVILPVNYNINLHVA  184

Query:  181 SVYGSVQYFDFEEYDLRNESIKLSQ--EEEYYLLKRVKLVVNTIAGKVEV            228
            + YGS  Y + + Y  +N +I + +    + + Y     V + V+T  G VEV
Sbjct:  185 AFYGST-YVNEKSYKVENNNIHIEEMMKPDNY---TVNIYVSTFIGDVEV            230
```

A related DNA sequence was identified in *S. pyogenes* <SEQ ID 3029> which encodes the amino acid sequence <SEQ ID 3030>. Analysis of this protein sequence reveals the following:

```
Possible site: 35
>>> Seems to have no N-terminal signal sequence
    INTEGRAL      Likelihood = -9.92      Transmembrane    44-60 (36-64)
    INTEGRAL      Likelihood = -8.76      Transmembrane    69-85 (66-105)
    INTEGRAL      Likelihood = -8.70      Transmembrane    24-40 (20-42)
    INTEGRAL      Likelihood = -6.64      Transmembrane    88-104 (85-105)
```

-continued

```
----- Final Results -----
            bacterial membrane --- Certainty = 0.4970(Affirmative) < succ>
            bacterial outside  --- Certainty = 0.0000(Not Clear)   < succ>
            bacterial cytoplasm --- Certainty = 0.0000(Not Clear)  < succ>
```

The protein has homology with the following sequences in the databases:

```
>GP: BAB03323 GB: AB035448 hypothetical protein [Staphylococcus
aureus]
Identities = 41/187 (21%), Positives = 85/187 (44%), Gaps = 22/187 (11%)

Query:   47 FILILVL--ILLALRF-YNQDSRNNFLLTVSLLFLFLIFMLNPYIIMAVLLGIVYIFINH 103
            F+L+L+L  +L+ + + Y    R      + L +   + N Y I+ + + ++ + +
Sbjct:   33 FLLVLLLGCVLVYVGYLYFHKIRGLLAFWIGALLIAFTLLSNKYTIIILFVFLLLLIV--  90

Query:  104 FSQVKKKNRFALIRFKEEKIEVNNT--------KHQWIGTANYESDYYCFDDINIIRISG 155
                       R+ + +FK +K+   +        K +W G       Y ++D+ I   G
Sbjct:   91 --------RYLIHKFKPKKVVATDEVMTSPSFIKQKWFGEQRTPVYVYKWEDVQIQHGIG 142

Query:  156 NDTVDLTNVIVTGMDNIIVIRKIFGNTTILVPIDVTVTLDVSSIYGSVDFFRCQQYDLRN 215
            +  +DLT       +N IV+R I G   +++P++  + L V++ YGS   +  + Y + N
Sbjct:  143 DLHIDLTKAANIKENNTIVVRHILGKVQVILPVNYNINLHVAAFYGST-YVNEKSYKVEN 201

Query:  216 ESIKFKE                                                       222
            +I  +E
Sbjct:  202 NNIHIEE                                                       208
```

An alignment of the GAS and GBS proteins is shown below.

```
Identities = 137/211 (64%), Positives = 175/211 (82%)

Query:    1 MKKFQFFLLVEAVVLVMGLMKILSDDWTSFIFILALILLALRFYNNDSRHNFLLTTSLLL  60
            MKKFQFFLL+E ++L MG+M IL +D +SFI  IL LILLALRFYN DSR+NFLLT SLL
Sbjct:   18 MKKFQFFLLIECILLAMGIMTILDNDLSSFILILVLILLALRFYNQDSRNNFLLTVSLLF  77

Query:   61 LFLIFMLNPYIIAAVVFAVLYVLINHFSQVKKKNRYALIQFKNHQLDVKTTRNQWLGTDQ 120
            LFLIFMLNPYII AV+  ++Y+ INHFSQVKKKNR+ALI+FK   +++V  T++QW+GT
Sbjct:   78 LFLIFMLNPYIIMAVLLGIVYIFINHFSQVKKKNRFALIRFKEEKIEVNNTKHQWIGTAN 137

Query:  121 HESDFYAFEDINIIRISGTDTIDLTNVIVSGQDNVIIQKVFGDTKVLVPLDVAVKADIS 180
            +ESD+Y F+DINIIRISG DT+DLTNVIV+G DN+I++K+FG+T +LVP+DV V  D+S
Sbjct:  138 YESDYYCFDDINIIRISGNDTVDLTNVIVTGMDNIIVIRKIFGNTTILVPIDVTVTLDVS 197

Query:  181 SVYGSVQYFDFEEYDLRNESIKLSQEEEYYL                              211
            S+YGSV +F  ++YDLRNESIK  +   L
Sbjct:  198 SIYGSVDFFRCQQYDLRNESIKFKETDNQSL                              228
```

SEQ ID 3028 (GBS66) was expressed in *E. coli* as a His-fusion product. SDS-PAGE analysis of total cell extract is shown in FIG. 6 (lane 4; MW 25 kDa) and in FIG. 7 (lane 2; MW 24.7 kDa).

Based on this analysis, it was predicted that these proteins and their epitopes could be useful antigens for vaccines or diagnostics.

EXAMPLE 989

A DNA sequence (GBSx1049) was identified in *S. agalactiae* <SEQ ID 3031> which encodes the amino acid sequence <SEQ ID 3032>. This protein is predicted to be histidine kinase (narQ). Analysis of this protein sequence reveals the following:

```
Possible site: 19
>>> Seems to have an uncleavable N-term signal seq
    INTEGRAL    Likelihood = -11.41    Transmembrane    47-63 (40-72)
    INTEGRAL    Likelihood =  -9.98    Transmembrane     9-25 (5-36)

----- Final Results -----
            bacterial membrane --- Certainty = 0.5564(Affirmative) < succ>
            bacterial outside  --- Certainty = 0.0000(Not Clear)   < succ>
            bacterial cytoplasm --- Certainty = 0.0000(Not Clear)  < succ>
```

The protein has homology with the following sequences in the GENPEPT database.

```
>GP: CAB54570 GB: AJ006393 histidine kinase [Streptococcus pneumoniae]
Identities = 159/334 (47%), Positives = 239/334 (70%), Gaps = 5/334 (1%)

Query:    1 MKKHHYFLAFFYGSVIIFAICFVIIDSLGVNL-VHLYQTSRLWLIEQLIFSIFFLSLAVT   59
            MKK  Y +     + +F      +++ L +  + L+      +    E+ +F +    S+++T
Sbjct:    1 MKKQAYVIIALTSFLFVFFFSHSLLEILDFDWSIFLHDVEKT---EKFVFLLLVFSMSMT   57

Query:   60 ILLLLTWFLLDDNSKRQINHNLRRILNNQSINVTDDGTEISTNIQRLSKKMNLMTASLQS  119
            LL  L W  +++  S  R++  NL+R+L   Q +       D  ++   +  + LS  K+NL+T +LQ
Sbjct:   58 CLLALFWRGIEELSLRKMQANLKRLLAGQEVVQVAD-PDLDASFKSLSGKLNLLTEALQK  116

Query:  120 KENSRILKSQEIVKQERKRIARDLHDTVSQDLFAASMVLSGIAQNVSQLDVDQVGSQLLA  179
              EN  + +  +EI+++ERKRIARDLHDTVSQ+LFAA  M+LSGI+Q     +LD +++  +QL +
Sbjct:  117 AENQSLAQEEEIIEKERKRIARDLHDTVSQELFAAHMILSGISQQALKLDREKMQTQLQS  176

Query:  180 VEEMLQHAQNDLRILLLHLRPVELENKTLSEGFRMILKELTDKSDIEVVYHESILTLPKK  239
              V   +L+  AQ  DLR+LLLHLRPVELE  K+L  EG  +++LKEL DKSD+  V        +++    LPKK
Sbjct:  177 VTAILETAQKDLRVLLLHLRPVELEQKSLIEGIQILLKELEDKSDLRVSLKQNMTKLPKK  236

Query:  240 IEDNIFRIGQEFISNTLKHSQASRLEVYLNQTENELQLKMIDNGIGFDMDSVYDLSYGLK  299
            IE++IFRI QE ISNTL+H+QAS L+VYL QT+ ELQLK++DNGIGF + S+ DLSYGL+
Sbjct:  237 IEEHIFRILQELISNTLRHAQASCLDVYLYQTDVELQLKVVDNGIGFQLGSLDDLSYGLR  296

Query:  300 NIEDRVEDLAGNLQLLSQPGKGVAMDIRLPLVNQ                           333
            NI++RVED+AG +QLL+  P +G+A+DIR+PL+++
Sbjct:  297 NIKERVEDMAGTVQLLTAPKQGLAVDIRIPLLDK                           330
```

A related DNA sequence was identified in *S. pyogenes* <SEQ ID 2991> which encodes the amino acid sequence <SEQ ID 2992>. Analysis of this protein sequence reveals the following:

```
Possible site: 18
>>> Seems to have an uncleavable N-term signal seq
      INTEGRAL      Likelihood = -14.22      Transmembrane      49-65 (42-70)
      INTEGRAL      Likelihood =  -6.58      Transmembrane       8-24 (5-33)

----- Final Results -----
            bacterial membrane --- Certainty = 0.6689(Affirmative) < succ>
             bacterial outside --- Certainty = 0.0000(Not Clear)  < succ>
           bacterial cytoplasm --- Certainty = 0.0000(Not Clear)  < succ>
```

An alignment of the GAS and GBS proteins is shown below.

```
Identities = 218/337 (64%), Positives = 276/337 (81%), Gaps = 3/337 (0%)

Query:    1 MKKHHYFLAFFYGSVIIFAICFVIIDSLGVNLVHLYQTSRLWLIEQLIFSIFFLSLAVTI   60
            MKK +Y L + Y ++ I +I FV++D+LG+    +L   + LW +E+L FSI  L ++VT+
Sbjct:    1 MKKRYYALVWLYSTITILSIVFVVMDNLGITFNYL--RNHLWQVERLGFSILLLIVSVTL   58

Query:   61 LLLLTWFLLDDNSKRQINHNLRRILNNQSINVTDDGTEISTNIQRLSKKMNLMTASLQSK  120
            LLLL W ++DDNSKR IN NL+ ILNN+ + + D+ +EI+TN+ RLSKKM+ +TA++Q K
Sbjct:   59 LLLLLWIIMDDNSKRNINQNLKYILNNRRLYL-DETSEINTNLSRLSKKMSHLTANMQKK  117

Query:  121 ENSRILKSQEIVKQERKRIARDLHDTVSQDLFAASMVLSGIAQNVSQLDVDQVGSQLLAV  180
            E++ IL SQE+VKQERKRIARDLHDTVSQ+LFA+S++LSGI+  ++ QLD  Q+ +QL   V
Sbjct:  118 ESAYILDSQEVVKQERKRIARDLHDTVSQELFASSLILSGISMSLEQLDKTQLQTQLTTV  177

Query:  181 EEMLQHAQNDLRILLLHLRPVELENKTLSEGFRMILKELTDKSDIEVVYHESILTLPKKI  240
            E MLQ+AQNDLRILLLHLRP EL N+TLSEG  MILKELTDKSDIEV+Y E+I  LPK +
Sbjct:  178 EAMLQNAQNDLRILLLHLRPTELANRTLSEGLHMILKELTDKSDIEVIYKETIAQLPKTM  237

Query:  241 EDNIFRIGQEFISNTLKHSQASRLEVYLNQTENELQLKMIDNGIGFDMDSVYDLSYGLKN  300
            EDN+FRI QEFISNTLKH++ASR+EVYLNQT  ELQLKMID+G+GFDMD V DLSYGLKN
Sbjct:  238 EDNLFRIAQEFISNTLKHAKASRIEVYLNQTSTELQLKMIDDGVGFDMDQVRDLSYGLKN  297

Query:  301 IEDRVEDLAGNLQLLSQPGKGVAMDIRLPLVNQSEDK                        337
            IEDRV DLAGNL L+SQ GKGV+MDIRLP+V    +D+
Sbjct:  298 IEDRVNDLAGNLHLISQKGKGVSMDIRLPIVKGDDDE                        334
```

A related GBS gene <SEQ ID 8701> and protein <SEQ ID 8702> were also identified. Analysis of this protein sequence reveals the following:

```
Lipop: Possible site: -1 Crend: 4
McG: Discrim Score: 14.69
GvH: Signal Score (-7.5): -4.31
Possible site: 19
>>> Seems to have an uncleavable N-term signal seq
ALOM program  count: 2 value: -11.41 threshold: 0.0
     INTEGRAL    Likelihood = -11.41    Transmembrane   47-63 (40-72)
     INTEGRAL    Likelihood = -9.98     Transmembrane   9-25 (5-36)
     PERIPHERAL  Likelihood = 3.61                      146
modified ALOM score: 2.78

*** Reasoning Step: 3

----- Final Results -----
              bacterial membrane  --- Certainty = 0.5564 (Affirmative) < succ>
              bacterial outside   --- Certainty = 0.0000 (Not Clear)   < succ>
              bacterial cytoplasm --- Certainty = 0.0000 (Not Clear)   < succ>
```

The protein has homology with the following sequences in the databases:

```
52.5/77.6% over 288aa
Streptococcus pneumoniae
GP|5830526|histidine kinase Insert characterized
ORF00320(433-1302 of 1617)
GP|5830526|emb|CAB54570.1||AJ006393(43-331 of 331)histidine kinase
{Streptococcus pneumoniae}
% Match = 28.6
% Identity = 52.4    % Similarity = 77.6
Matches = 152  Mismatches = 64   Conservative Sub.s = 73
252         282         312         342         372         402         432         462
QEEEYTF*NVSN*L*TLSLES*G*S*MKKHHYFLAFFYGSVIIFAICFVIIDSLGVNLVHLYQTSRLWLIEQLIFSIFFL
                    :   :|        |          :  :|                  |:::|  :: :
                          MKKQAYVIIALTSFLFVFFFSHSLLEILDFDWSIFLHDVEKTEKFVFLLLVF
                          10         20         30         40         50
492         522         552         582         612         642         672         702
SLAVTILLLLTWFLLDDNSKRQINHNLRRILNNQSINVTDDGTEISTNIQRLSKKMNLMTASLQSKENSRILKSQEIVKQ
|:::|  || |      :::  |  |::  ||:|:|   |  :      :|  :   ::  ||  |:||:|  :|| ||   :   :  :||:::
SMSMTCLLALFWRGIEELSLRKMQANLKRLLAGQEVVQVAD-PDLDASFKSLSGKLNLLTEALQKAENQSLAQEEEIIEK
            70         80         90         100        110        120        130
732         762         792         822         852         882         912         942
ERKRIARDLHDTVSQDLFAASMVLSGIAQNVSQLDVDQVGSQLLAVEEMLQHAQNDLRILLLHLRPVELENKTLSEGFRM
||||||||||||||| |:||||| ||    :||  ::: ||  :|    :|:  :|:  || |||||||||  |:| ::
ERKRIARDLHDTVSQELFAAHMILSGISQQALKLDREKMQTQLQSVTAILETAQKDLRVLLLHLRPVELEQKSLIEGIQI
            150        160        170        180        190        200        210
972         1002        1032        1062        1092        1122        1152        1182
ILKELTDKSDIEVVYHESILTLPKKIEDNIFRIGQEFISNTLKHSQASRLEVVLNQTENELQLKMIDNGIGFDMDSVYDL
:||||  ||||: |    :::   ||||||::|||| |::|||||:|:|| |:|||  |: ||||||::||||||  :|: ||
LLKELEDKSDLRVSLKQNMTKLPKKIEEHIFRILQELISNTLRHAQASCLDVYLYQTDVELQLKVVDNGIGFQLGSLDDL
            230        240        250        260        270        280        290
1212        1242        1272        1302        1332        1362        1392        1422
SYGLKNIXDRVEDLAGNLQLLSQPGKGVAMDIRLPLVNQSEDKNG*NKNCTC**P*DGSSRFKKFFKLTS*C*SNR*GLK
||||:|| :||||:|| :|||: |  :|:|:|||:||::
SYGLRNIKERVEDMAGTVQLLTAPKQGLAVDIRIPLLDKE
            310        320        330
```

Figure 151:
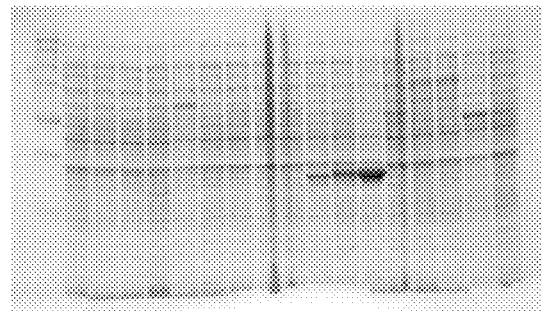

SEQ ID 8702 (GBS31) was expressed in E. coli as a GST-fusion product. SDS-PAGE analysis of total cell extract is shown in FIG. 15 (lane 8; MW 64 kDa). It was also expressed as GBS31d in E. coli as a GST-fusion product. SDS-PAGE analysis of total cell extract is shown in FIG. 151 (lane 8-10; MW 59 kDa) and in FIG. 187 (lane 8; MW 59 kDa). GBS31d was also expressed in E. coli as a His-fusion product. SDS-PAGE analysis of total cell extract is shown in FIG. 151 (lane 11-13; MW 34 kDa) and in FIG. 182 (lane 11; MW 34 kDa). Purified GBS31d-GST is shown in lane 3 of FIG. 237.

EXAMPLE 990

A DNA sequence (GBSx1050) was identified in S. agalactiae <SEQ ID 3033> which encodes the amino acid sequence <SEQ ID 3034>. Analysis of this protein sequence reveals the following:

```
Possible site: 31
>>> Seems to have no N-terminal signal sequence

----- Final Results -----
                bacterial cytoplasm --- Certainty = 0.2706(Affirmative) < succ>
                bacterial membrane  --- Certainty = 0.0000(Not Clear)   < succ>
                bacterial outside   --- Certainty = 0.0000(Not Clear)   < succ>
```

The protein has homology with the following sequences in the GENPEPT database.

```
>GP: CAB54571 GB: AJ006393 response regulator [Streptococcus pneumoniae]
Identities = 154/209 (73%), Positives = 184/209 (87%)

Query:    8 IKIVLVDDHEMVRLGLKSFLNLQADVEVIGEASNGLEGIKKALELRPDVVVMDLVMPEMD   67
            +KI+LVDDHEMVRLGLKS+ +LQ DVEV+GEASNG +GI   ALELRPDV+VMD+VMPEM+
Sbjct:    1 MKILLVDDHEMVRLGLKSYFDLQDDVEVVGEASNGSQGIDLALELRPDVIVMDIVMPEMN   60

Query:   68 GVEATLALLKDWPEAAILVLTSYLDNEKIYPVIEAGAKGYMLKTSSAAEILNAIRKVSRG  127
            G++ATLA+LK+WPEA IL++TSYLDNEKI PV++AGAKGYMLKTSSA E+L+A+ KV+ G
Sbjct:   61 GIDATLAILKEWPEAKILIVTSYLDNEKIMPVLDAGAKGYMLKTSSADELLHAVSKVAAG  120

Query:  128 EQAIENEVDKKIKAHDKCPALHEGLTARERDILNLLAKGYDNQRIADELFISLKTVKTHV  187
            E AIE EV KK++ H    LHE LTARERD+L L+AKGY+NQRIAD+LFISLKTVKTHV
Sbjct:  121 ELAIEQEVSKKVEYHRNHMELHEELTARERDVLQLIAKGYENQRIADDLFISLKTVKTHV  180

Query:  188 SNILGKLNVADRTQAVVYAFQHHLVPQDD                                216
            SNIL KL V+DRTQA VYAFQHHLV Q++
Sbjct:  181 SNILAKLEVSDRTQAAVYAFQHHLVGQEE                                209
```

A related DNA sequence was identified in *S. pyogenes* <SEQ ID 2995> which encodes the amino acid sequence <SEQ ID 2996>. Analysis of this protein sequence reveals the following:

```
Possible site: 29
>>> Seems to have no N-terminal signal sequence

----- Final Results -----
         bacterial cytoplasm --- Certainty = 0.3094(Affirmative) < succ>
         bacterial membrane  --- Certainty = 0.0000(Not Clear)   < succ>
           bacterial outside --- Certainty = 0.0000(Not Clear)   < succ>
```

An alignment of the GAS and GBS proteins is shown below.

```
Identities = 175/212 (82%), Positives = 192/212 (90%)

Query:    5 MDKIKIVLVDDHEMVRLGLKSFLNLQADVEVIGEASNGLEGIKKALELRPDVVVMDLVMP   64
            M KIK++LVDDHEMVR+GLKSFLNLQAD++V+GEASNG EG+   AL L+PDV+VMDLVMP
Sbjct:    3 MSKIKVILVDDHEMVRMGLKSFLNLQADIDVVGEASNGREGVDLALALKPDVLVMDLVMP   62

Query:   65 EMDGVEATLALLKDWPEAAILVLTSYLDNEKIYPVIEAGAKGYMLKTSSAAEILNAIRKV  124
            E+ GVEATL +LK W EA +LVLTSYLDNEKIYPVI+AGAKGYMLKTSSAAEILNAIRKV
Sbjct:   63 ELGGVEATLEVLKKWKEAKVLVLTSYLDNEKIYPVIDAGAKGYMLKTSSAAEILNAIRKV  122

Query:  125 SRGEQAIENEVDKKIKAHDKCPALHEGLTARERDILNLLAKGYDNQRIADELFISLKTVK  184
            S+GE AIE EVDKKIKAHD+ P LHE LTARE DIL+LLAKGYDNQ IADELFISLKTVK
Sbjct:  123 SKGELAIETEVDKKIKAHDQHPDLHEELTAREYDILHLLAKGYDNQTIADELFISLKTVK  182

Query:  185 THVSNILGKLNVADRTQAVVYAFQHHLVPQDD                             216
            THVSNIL KL V DRTQAVVYAF+HHLVPQDD
Sbjct:  183 THVSNILAKLEVGDRTQAVVYAERHHLVPQDD                             214
```

Based on this analysis, it was predicted that these proteins and their epitopes could be useful antigens for vaccines or diagnostics.

EXAMPLE 991

A DNA sequence (GBSx1051) was identified in *S. agalactiae* <SEQ ID 3035> which encodes the amino acid sequence <SEQ ID 3036>. Analysis of this protein sequence reveals the following:

```
Possible site: 59
>>> Seems to have no N-terminal signal sequence

----- Final Results -----
         bacterial cytoplasm --- Certainty = 0.1688(Affirmative) < succ>
```

```
                           -continued
            bacterial membrane --- Certainty = 0.0000(Not Clear) < succ>
              bacterial outside --- Certainty = 0.0000(Not Clear) < succ>
```

The protein has homology with the following sequences in the GENPEPT database.

```
>GP: CAB08166 GB: Z94864 putative peptidyl-prolyl cis-trans isomerase
[Schizosaccharomyces pombe]
Identities = 81/174 (46%), Positives = 109/174 (62%),
Gaps = 30/174 (17%)

Query: 288 IKTNHGDMTVKLFPDHAPKTVANFIGLAKQGYYDGIIFHRIIPDFMIQGGDPTGTMGGE  347
           ++T+ G + ++L+ +HAPKT  NF   LAK+GYYDG+IFHR+IPDF+IQGGDPTGTG GG
Sbjct:   6 LQTSLGKILIELYTEHAPKTCQNFYTLAKEGYYDGVIFHRVIPDFVIQGGDPTGTGRGGT   65

Query: 348 SIYGESFEDEFSEELYNV-RGALSMANAGPNTNGSQFFIVQNTKIPYAKKELERGGWPTP  406
           SIYG+ F+DE   +L++    G LSMANAGPNTN SQFFI    T  P
Sbjct:  66 SIYGDKFDDEIHSDLHHTGAGILSMANAGPNTNSSQFFI---TLAP--------------  108

Query: 407 IAELYAGQGGTPHLDRRHSVFGQLVDQSSFEVLDEIAAVETGSQDKPLEDVVIL        460
                       TP LD +H++FG++V  S     V + + T S D+P+E + I+
Sbjct: 109 ----------TPWLDGKHTIFGRVV--SGLSVCKRMGLIRTDSSDRPIEPLKII        150
```

A related DNA sequence was identified in *S. pyogenes* <SEQ ID 3037> which encodes the amino acid sequence <SEQ ID 3038>. Analysis of this protein sequence reveals the following:

```
Possible site: 59
>>> Seems to have no N-terminal signal sequence

----- Final Results -----
              bacterial cytoplasm --- Certainty = 0.2175(Affirmative) < succ>
              bacterial membrane --- Certainty = 0.0000(Not Clear) < succ>
              bacterial outside --- Certainty = 0.0000(Not Clear) < succ>
```

An alignment of the GAS and GBS proteins is shown below.

```
Identities = 381/464 (82%), Positives = 422/464 (90%)

Query:   1 MDAKTKYKAKKIKAVFFDIDDTLRVKDTGYMPPSILKVFKALKDKGIVVGIASGRARYGV   60
           MDAK KYKAKKIK VFFDIDDTLRVKDTGYMP SI +VFKALI KGI+VGIASGRARYGV
Sbjct:   5 MDAKLKYKAKKIKMVFFDIDDTLRVKDTGYMPESIQRVFKALKAKGILVGIASGRARYGV   64

Query:  61 PKEVQDLNADYCVKLNGAYVKDKDKNIIFHRPIPAEYVEQYKKWADTVGIKYGLAGRHEA  120
           P+EVQDL+ADYCVKLNGAYVKD  K IIF  PIPA+ V  YKKWAD +GI YG+AGRHEA
Sbjct:  65 PQEVQDLHADYCVKLNGAYVKDDAKTIIFQAPIPADVVVAYKKWADDMGIFYGMAGRHEA  124

Query: 121 VLSDRDDLVNDAIDIVYSDLEVNPDFNKEHDIYQMWTFEDKGDSLHLPEPLAEHLRLIRW  180
           VLS R+D++++AID VY+ LEV PD+N+ HD+YQMWTFEDKGD L LP  LAEHLRL+RW
Sbjct: 125 VLSARNDMISNAIDNVYAQLEVCPDYNEYHDVYQMWTFEDKGDGLQLPAELAEHLRLVRW  184

Query: 181 HDHSSDVVLKGTSKALGVSKVVEHLGLKPENILVFGDELNDLELFDYAGLAVAMGVSHPE  240
           HD+SSDVVLKGTSKALGVSKVV+HLGLKPENILVFGDELNDLELFDYAG+++AMGVSHP
Sbjct: 185 HDNSSDVVLKGTSKALGVSKVVDHLGLKPENILVFGDELNDLELFDYAGISIAMGVSHPL  244

Query: 241 AQKKADFITKKVEEDGILYALEELGLIEKELTFPQVDIENTEGPVAVIKTNHGDMTVKLF  300
            Q+KADFITKKVEEDGILYALEELGLI+KEL FPQ+D+ N +GP A IKTNHGDMT+ LF
Sbjct: 245 LQEKADFITKKVEEDGILYALEELGLIDKELQFPQLDLPNHKGPKATIKTNHGDMTLVLF  304

Query: 301 PDHAPKTVANFIGLAKQGYYDGIIFHRIIPDFMIQGGDPTGTMGGESIYGESFEDEFSE   360
           PDHAPKTVANF+GLAK+GYYDGIIFHRIIP+FMIQGGDPTGTGM G+SIYGESFEDEFS+
Sbjct: 305 PDHAPKTVANFLGLAKEGYYDGIIFHRIIPEFMIQGGDPTGTGMCGQSIYGESFEDEFSD  364

Query: 361 ELYNVRGALSMANAGPNTNGSQFFIVQNTKIPYAKKELERGGWPTPIAELYAGQGGTPHL  420
           ELYN+RGALSMANAGPNTNGSQFFIVQN+KIPYAKKELERGGWP PIA  YA  GGTPHL
Sbjct: 365 ELYNLRGALSMANAGPNTNGSQFFIVQNSKIPYAKKELERGGWPAPIAASYAANGGTPHL  424

Query: 421 DRRHSVFGQLVDQSSFEVLDEIAAVETGSQDKPLEDVVILTIEV                 464
           DRRH+VFGQLVD++SF+VLD IA VETG+QDKP EDV+I TIEV
Sbjct: 425 DRRHTVFGQLVDETSFQVLDLIAGVETGAQDKPKEDVIIETIEV                 468
```

Based on this analysis, it was predicted that these proteins and their epitopes could be useful antigens for vaccines or diagnostics.

EXAMPLE 992

A DNA sequence (GBSx1052) was identified in *S. agalactiae* <SEQ ID 3039> which encodes the amino acid sequence <SEQ ID 3040>. This protein is predicted to be ribosomal protein S1 (rpsA). Analysis of this protein sequence reveals the following:

```
Possible site: 36
>>> Seems to have no N-terminal signal sequence

----- Final Results -----
              bacterial cytoplasm --- Certainty = 0.3126(Affirmative) < succ>
               bacterial membrane --- Certainty = 0.0000(Not Clear)   < succ>
                 bacterial outside --- Certainty = 0.0000(Not Clear)   < succ>
```

The protein has homology with the following sequences in the GENPEPT database.

```
>GP:BAB07066 GB:AP001518 polyribonucleotide nucleotidyltransferase
(general stress protein 13) [Bacillus halodurans]
Identities = 46/120 (38%), Positives = 71/120 (58%), Gaps = 11/120 (9%)

Query:   8 KIGDKLKGTVTGIRPYGAFVSLEDGRTGLIHISEIKTGYIDNIYDVLSVGDEVYVQVIDV    67
           ++G  ++G VTGI+P+GAFV+++D + GL+HISE+   G++ +I DVLSVGDEV V+++ V
Sbjct:   5 EVGSIVEGKVTGIKPFGAFVAIDDQKQGLVHISEVAHGFVKDINDVLSVGDEVKVKILSV    64

Query:  68 DEFTQKASLSLRTLEEERHHIQH----------RHRFSNNRLKIGFKPLEENLPSWVEE   116
           DE + K SLS+R  +E                 R          GF  LE+ L  W+++
Sbjct:  65 DEESGKISLSIRATQEAPERPARAPKPRPAGGGGRKPQKGQSQGQGFNTLEDKLKEWLKQ   124
```

A related DNA sequence was identified in *S. pyogenes* <SEQ ID 3041> which encodes the amino acid sequence <SEQ ID 3042>. Analysis of this protein sequence reveals the following:

```
Possible site: 58
>>> Seems to have no N-terminal signal sequence

----- Final Results -----
              bacterial cytoplasm --- Certainty = 0.1832 (Affirmative) < succ>
               bacterial membrane --- Certainty = 0.0000 (Not Clear)   < succ>
                 bacterial outside --- Certainty = 0.0000 (Not Clear)   < succ>
```

An alignment of the GAS and GBS proteins is shown below.

```
Identities = 78/115 (67%), Positives = 100/115 (86%)

Query:   7 MKIGDKLKGTVTGIRPYGAFVSLEDGRTGLIHISEIKTGYIDNIYDVLSVGDEVYVQVID    66
           MKIGDKL GT+TGI+PYGAFV+LE+G TGLIHISEIKTG+ID+I  +L++G++V VQVID
Sbjct:   1 MKIGDKLHGTITGIKPYGAFVALENGTTGLIHISEIKTGFIDDIDQLLAIGNQVLVQVID    60

Query:  67 VDEFTQKASLSLRTLEEERHHIQHRHRFSNNRLKIGFKPLEENLPSWVEEGLAYL       121
           +DE+++K SLS+RTL EE+ H  HRHR+SN+R KIGF+PLEE LP W+EE L +L
Sbjct:  61 IDEYSKKPSLSMRTLAEEKQHFFHRHRYSNSRHKIGFRPLEEQLPQWIEESLQFL       115
```

Based on this analysis, it was predicted that these proteins and their epitopes could be useful antigens for vaccines or diagnostics.

EXAMPLE 993

A DNA sequence (GBSx1053) was identified in *S. agalactiae* <SEQ ID 3043> which encodes the amino acid sequence <SEQ ID 3044>. This protein is predicted to be pyruvate formate-lyase 2 activating enzyme (pflA). Analysis of this protein sequence reveals the following:

```
Possible site: 41
>>> Seems to have no N-terminal signal sequence

----- Final Results -----
            bacterial cytoplasm --- Certainty = 0.2889(Affirmative) < succ>
             bacterial membrane --- Certainty = 0.0000(Not Clear)   < succ>
              bacterial outside --- Certainty = 0.0000(Not Clear)   < succ>
```

The protein has homology with the following sequences in the GENPEPT database.

```
>GP:AAC76934 GB:AE000469 probable pyruvate formate lyase activating
enzyme 2 [Escherichia coli K12]
Identities = 90/251 (35%), Positives = 142/251 (55%), Gaps = 16/251 (6%)

Query:   8 VFNIQHFSIHDGPGIRTTVFLKGCPLRCPWCANPESQKMVPETMR---------------   52
           +FNIQ +S++DG GIRT VF KGCP  CPWCANPES       +T+R
Sbjct:  24 IFNIQRYSLNDGEGIRTVVFFKGCPHLCPWCANPESISGKIQTVRREAKCLHCAKCLRDA   83

Query:  53 -DAITNESVIVGEEKSVDDIIEEVLKDIDFYEESGGGITLSGGEIFAQFEFAKAILKRAK  111
            +   +      +G + S+D +  EV+KD  F+    SGGG+TLSGGE+   Q EFA    L+R +
Sbjct:  84 DECPSGAFERIGRDISLDALEREVMKDDIFFRTSGGGVTLSGGEVLMQAEFATRFLQRLR  143

Query: 112 SLGIHTAIETTAYTRHEQFIDLIQYVDFIYTDLKHYNSLKHQEKTMVKNASIIKNIHYAF  171
              G+  AIET     + + L +  D +  DLK   ++ + ++    +    +++N+
Sbjct: 144 LWGVSCAIETAGDAPASKLLPLAKLCDEVLFDLKIMDATQARDVVKMNLPRVLENLRLLV  203

Query: 172 ANGKTIVLRIPVIPNFNDSLEDAEEFACLFDRLDIRQVQLLPFHQFGQNKYQLLNRQYEM  231
            + G  ++ R+P+IP F  S E+ ++     +    L+IRQ+ LLPFHQ+G+ KY+LL  + + M
Sbjct: 204 SEGVNVIPRLPLIPGFTLSRENMQQALDVLIPLNIRQIHLLPFHQYGEPKYRLLGKTWSM  263

Query: 232 EEIAALHPEDL                                                  242
           +E+ A    D+
Sbjct: 264 KEVPAPSSADV                                                  274
```

A related DNA sequence was identified in *S. pyogenes* <SEQ ID 3045> which encodes the amino acid sequence <SEQ ID 3046>. Analysis of this protein sequence reveals the following:

```
Possible site: 58
>>> Seems to have no N-terminal signal sequence

----- Final Results -----
            bacterial cytoplasm --- Certainty = 0.2209(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below.

```
Identities = 187/255 (73%), Positives = 220/255 (85%)

Query:   4 EKGIVFNIQHFSIHDGPGIRTTVFLKGCPLRCPWCANPESQKMVPETMRDAITNESVIVG   63
           ++GIVFNIQHFSIHDGPGIRTTVFLKGCPLRCPWCANPESQ+  PE M  +    + IVG
Sbjct:   3 DRGIVFNIQHFSIHDGPGIRTTVFLKGCPLRCPWCANPESQQKAPEQMLTSDGLNTKIVG   62

Query:  64 EEKSVDDIIEEVLKDIDFYEESGGGITLSGGEIFAQFEFAKAILKRAKSLGIHTAIETTA  123
           EEK+VD++IEEVLKD+DFYEESGGG+TLSGGEIFAQF+FA A+LK  AK+ G+HTAIETTA
Sbjct:  63 EEKTVDEVIEEVLKDLDFYEESGGGMTLSGGEIFAQFDFALALLKAAKAAGLHTAIETTA  122

Query: 124 YTRHEQFIDLIQYVDFIYTDLKHYNSLKHQEKTMVKNASIIKNIHYAFANGKTIVLRIPV  183
            +  +HEQF+  L+  YVDFIYTDLKHYN L+HQ+  T V+N   IIKNIHYAF  GK IVLRIPV
Sbjct: 123 FAKHEQFVTLVDYVDFIYTDLKHYNQLRHQKVTGVRNDLIIKNIHYAFQAGKEIVLRIPV  182

Query: 184 IPNFNDSLEDAEEFACLFDRLDIRQVQLLPFHQFGQNKYQLLNRQYEMEEIAALHPEDLL  243
           IP FNDSL+DA+ F+ LF++L+I QVQLLPFHQFG+NKY+LL R+YEM E+ A  HPEDL
Sbjct: 183 IPQFNDSLDDAKAFSELFNQLEIDQVQLLPFHQFGENKYKLLGREYEMAEVKAYHPEDLA  242
```

```
Query: 244 DYQAIFSKYNIHCYF                                               258
            DYQA+F  +NIHCYF
Sbjct: 243 DYQAVFLNHNIHCYF                                               257
```

Based on this analysis, it was predicted that these proteins and their epitopes could be useful antigens for vaccines or diagnostics.

EXAMPLE 994

A DNA sequence (GBSx1054) was identified in *S. agalactiae* <SEQ ID 3047> which encodes the amino acid sequence <SEQ ID 3048>. Analysis of this protein sequence reveals the following:

```
Possible site: 57
>>> Seems to have no N-terminal signal sequence

----- Final Results -----
            bacterial cytoplasm --- Certainty = 0.1762 (Affirmative) < succ>
            bacterial membrane  --- Certainty = 0.0000 (Not Clear)   < succ>
            bacterial outside   --- Certainty = 0.0000 (Not Clear)   < succ>
```

A related GBS nucleic acid sequence <SEQ ID 9299> which encodes amino acid sequence <SEQ ID 9300> was also identified.

The protein has homology with the following sequences in the GENPEPT database.

```
>GP:AAC74366 GB:AE000226 putative DEOR-type transcriptional
regulator [Escherichia coli K12]
Identities = 74/177 (41%), Positives = 113/177 (63%), Gaps = 1/177 (0%)

Query:   2 NRLENIISLVSQYQKIDVNTLSELLQVSKVTIRKDLDKLEGKGLLHREHGYAVLNSGDDL   61
           +R + I+ +V    ++ V  L++   VS+VTIR+DL+ LE     L R HG+AV    DD+
Sbjct:   3 SRQQTILQMVIDQGQVSVTDLAKATGVSEVTIRQDLNTLEKLSYLRRAHGFAVSLDSDDV   62

Query:  62 NVRLSFNHKTKKEIAALAANMVSDNDTILIESGSTCALLAENICQTKRNVTILTNSCFIA  121
              R+  N+   K+E+A  AA++V   +TI IE+GS+ ALLA  + + K+NVTI+T S +IA
Sbjct:  63 ETRMMSNYTLKRELAEFAASLVQPGETIFIENGSSNALLARTLGEQKKNVTIITVSSYIA  122

Query: 122 NYLREYDSCQIVLLGGEYQSSSQVTVGPLLKKMISLFHVSLAFVGTDGFDPKTRIYG     178
           + L++   C+++LLGG YQ  S+  VGPL ++ I   H S AF+G DG+ P+T    G
Sbjct: 123 HLLKD-APCEVILLGGVYQKKSESMVGPLTRQCIQQVHFSKAFIGIDGWQPETGFTG    178
```

A related DNA sequence was identified in *S. pyogenes* <SEQ ID 3049> which encodes the amino acid sequence <SEQ ID 3050>. Analysis of this protein sequence reveals the following:

```
Possible site: 58
>>> Seems to have no N-terminal signal sequence

----- Final Results -----
            bacterial cytoplasm --- Certainty = 0.2888 (Affirmative) < succ>
            bacterial membrane  --- Certainty = 0.0000 (Not Clear)   < succ>
            bacterial outside   --- Certainty = 0.0000 (Not Clear)   < succ>
```

An alignment of the GAS and GBS proteins is shown below.

```
Identities = 131/171 (76%), Positives = 150/171 (87%)

Query:   1 MNRLENIISLVSQYQKIDVNTLSELLQVSKVTIRKDLDKLEGKGLLHREHGYAVLNSGDD   60
           MNRLE II LVSQ +KIDVN+LSE L VSKVTIRKDLDKLE KGLL REHGYAVLNSGDD
Sbjct:   2 MNRLERIIQLVSQKKKIDVNSLSEQLDVSKVTIRKDLDKLESKGLLRREHGYAVLNSGDD   61

Query:  61 LNVRLSFNHKTKKEIAALAANMVSDNDTILIESGSTCALLAENICQTKRNVTILTNSCFI  120
           LNVRLS+N+  K+ IA  AA +V DNDTI+IESGSTCALLAE +CQTKRN+ ++TNSCFI
```

```
                              -continued
Sbjct:  62 LNVRLSYNYNIKRRIAEKAAELVQDNDTIMIESGSTCALLAEVLCQTKRNIKVITNSCFI  121

Query: 121 ANYLREYDSCQIVLLGGEYQSSSQVTVGPLLKKMISLFHVSLAFVGTDGFD         171
           ANY+R+Y SCQI+LLGG YQ +S+VTVGPLLK+MISLFHV+  FVGTDGF+
Sbjct: 122 ANYIRQYSSCQIILLGGYYQPNSEVTVGPLLKEMISLFHVNRVFVGTDGFN         172
```

Based on this analysis, it was predicted that these proteins and their epitopes could be useful antigens for vaccines or diagnostics.

EXAMPLE 995

A DNA sequence (GBSx1055) was identified in *S. agalactiae* <SEQ ID 3051> which encodes the amino acid sequence <SEQ ID 3052>. Analysis of this protein sequence reveals the following:

```
Possible site: 24
>>> Seems to have no N-terminal signal sequence

----- Final Results -----
            bacterial cytoplasm --- Certainty = 0.1672 (Affirmative) < succ>
            bacterial membrane  --- Certainty = 0.0000 (Not Clear)   < succ>
            bacterial outside   --- Certainty = 0.0000 (Not Clear)   < succ>
```

The protein has homology with the following sequences in the GENPEPT database.

```
>GP:AAG04879 GB:AE004578 probable transcriptional regulator
[Pseudomonas aeruginosa]
Identities = 20/70 (28%), Positives = 40/70 (56%)

Query:   6 GFMGRDLMRSEVAQEMANAADEVIILTDSSKFNQTALVEQLPLSTVSQVITDKHPNSEIA   65
           G M   +  +E+A+ M   A ++ ++ DSSK   + AL +   PLS +++++ D+ P  E+
Sbjct: 179 GAMDFSIEEAEIARAMIAQARQLTVIADSSKLGRRALFQVFPLSRINRLVVDRKPTGELW  238

Query:  66 NLFQEAEITI                                                   75
           Q+A + +
Sbjct: 239 EALQQARVEV                                                  248
```

There is also homology to SEQ ID 3050.

Based on this analysis, it was predicted that this protein and its epitopes, could be useful antigens for vaccines or diagnostics.

EXAMPLE 996

A DNA sequence (GBSx1056) was identified in *S. agalactiae* <SEQ ID 3053> which encodes the amino acid sequence <SEQ ID 3054>. This protein is predicted to be transcriptional regulator. Analysis of this protein sequence reveals the following:

```
Possible site: 46
>>> Seems to have no N-terminal signal sequence

----- Final Results -----
            bacterial cytoplasm --- Certainty = 0.0904 (Affirmative) < succ>
            bacterial membrane  --- Certainty = 0.0000 (Not Clear)   < succ>
            bacterial outside   --- Certainty = 0.0000 (Not Clear)   < succ>
```

A related GBS nucleic acid sequence <SEQ ID 9541> which encodes amino acid sequence <SEQ ID 9542> was also identified.

The protein has homology with the following sequences in the GENPEPT database.

```
>GP:BAB04499 GB:AP001509 transcriptional regulator [Bacillus halodurans]
Identities = 98/309 (31%), Positives = 178/309 (56%), Gaps = 1/309 (0%)

Query:     6 ERQKLLAKVAYLYYMEGKSQSEIANELGIYRTTISRMLAKAREEGLVRIEISDFNPEIFQ   65
             E ++L+ KVA LYY EG +Q+++A ++G+ R   IS++L KA+E+G+V I I D N    +
Sbjct:     5 EERRLIVKVASLYYFEGWTQAQVAKKIGVSRPVISKLLNKAKEQGIVEIYIKDENIHTVE   64

Query:    66 LESYFKSKYHLKDIEIVSSRKDSDTSEIEKDLAHVAAAMIRKKIKENDKVGIAWGRTLSK  125
             LE    + KYHLK+  +V +         I++ +     +  + K IK  D +GI+WG T+S
Sbjct:    65 LEQRLEKKYHLKEAIVVPT-SGLTQDMIKRAIGKATSYYVSKNIKGMDSIGISWGTTVSS  123

Query:   126 VVEAMRPHPVSQVSFVPLAGGPSHINARYHVNTLVYEMSRRFQGSCTFINATLVQENANL  185
             V+          ++  +PL GG         H N L YE++++    C+++ A  + E     L
Sbjct:   124 FVQEYPYEQHRELKVIPLVGGMGRKFVELHSNLLAYELAKKMNCECSYLYAPAMVEAKEL  183

Query:   186 AKGILTSKYFEGLMDNWEKLDVAIVGVGGKPKSNEQQWLDLLNQDDFQCLDEEAAVGEIT  245
                + ++ S+     +++      +  +A+VG+G    K +    + ++ L ++D   L +   AVG+++
Sbjct:   184 KERLIQSEDIASVLEEGRNVKMAVVGISPFKGSTMKVMNYLKEEDIATLKKIGAVGDMS  243

Query:   246 CRFFNHSGDPVNQHLAKRTIGITLEQLQKVPNRIAVAHGNYKAAALLAVLKKGYINHLVT  305
                RF++   G P++   L +    IGI L++L+++P   I V+ G +K    ++ A LK GY++  LVT
Sbjct:   244 SRFYDALGQPIDHPLNELVIGIDLDELKRIPIVIGVSEGAHKVDSVEAALKGGYLDVLVT  303

Query:   306 DFSTALNIL                                                    314
             D STA +++
Sbjct:   304 DDSTAQSLI                                                    312
```

A related DNA sequence was identified in *S. pyogenes* <SEQ ID 3055> which encodes the amino acid sequence <SEQ ID 3056>. Analysis of this protein sequence reveals the following:

```
Possible site: 44
>>> Seems to have no N-terminal signal sequence

----- Final Results -----
            bacterial cytoplasm --- Certainty = 0.2123 (Affirmative) < succ>
            bacterial membrane  --- Certainty = 0.0000 (Not Clear)   < succ>
             bacterial outside  --- Certainty = 0.0000 (Not Clear)   < succ>
```

An alignment of the GAS and GBS proteins is shown below.

```
Identities = 165/324 (50%), Positives = 238/324 (72%), Gaps = 1/324 (0%)

Query:     3 MKLERQKLLAKVAYLYYMEGKSQSEIANELGIYRTTISRMLAKAREEGLVRIEISDFNPE   62
             MK ER++LLAKVAYL+Y++GKSQ+ I+ E+ IYRTT+ RMLAKA+EEG+VRIEI+D++ +
Sbjct:     1 MKEERRLLAKVAYLHYVQGKSQTLISKEMNIYRTTVCRMLAKAKEEGIVRIEIADYDAD   60

Query:    63 IFQLESYFKSKYHLKDIEIVSSRKDSDTSEIEKDLAHVAAAMIRKKIKENDKVGIAWGRT  122
             +F LE Y + +Y L+ +++V ++ +      ++A  AA + R   +K+ DK+G++WG T
Sbjct:    61 LFALEEYVRQYGLEKLDLVPNQVEDTPMDTLTNVAKTAAEVFRHVVKDGDKIGLSWGAT  120

Query:   123 LSKVVEAMRPHPVSQVSFVPLAGGPSHINARYHVNTLVYEMSRRFQGSCTFINATLVQEN  182
             LS +++ + P +  V   PLAGGPSHINA+YHVNTLVY ++R F G+  F+NA ++QE+
Sbjct:   121 LSCLMDELNPKAMKDVFIYPLAGGPSHINAKYHVNTLVYRLARIFHGNSAFMNAMVIQED  180

Query:   183 ANLAKGILTSKYFEGLMDNWEKLDVAIVGVGGKPKSNEQ-QWLDLLNQDDFQCLDEEAAV  241
              +LAKGIL SKYF ++ +W++LD+A+VG+GG+P S EQ QW DLL   D   L   E AV
Sbjct:   181 KHLAKGILQSKYFNDILTSWDQLDLALVGIGGEPNSLEQSQWRDLLTSSDHDQLKYEKAV  240

Query:   242 GEITCRFFNHSGDPVNQHLAKRTIGITLEQLQKVPNRIAVAHGNYKAAALLAVLKKGYIN  301
             GE+ CRFF+ +G PV    L  RTIGI+LEQL++VP  +AVA G +KA A+LA LK G+IN
Sbjct:   241 GEVCCRFFDQAGQPVYTGLQDRTIGISLEQLRRVPKTMAVATGKHKAKAILAALKAGFIN  300

Query:   302 HLVTDFSTALNILRLDKDTFVDTI                                     325
             +LVTD    T L +L LD+D  ++ +
Sbjct:   301 YLVTDKETMLAVLALDEDIDLNNV                                     324
```

Based on this analysis, it was predicted that these proteins and their epitopes could be useful antigens for vaccines or diagnostics.

EXAMPLE 997

A DNA sequence (GBSx1057) was identified in *S. agalactiae* <SEQ ID 3057> which encodes the amino acid sequence <SEQ ID 3058>. This protein is predicted to be PTS enzyme III cel (celC). Analysis of this protein sequence reveals the following:

```
Possible site: 55
>>> Seems to have a cleavable N-term signal seq.

----- Final Results -----
              bacterial outside  --- Certainty = 0.3000 (Affirmative) < succ>
              bacterial membrane --- Certainty = 0.0000 (Not Clear)   < succ>
              bacterial cytoplasm --- Certainty = 0.0000 (Not Clear)  < succ>
```

A related GBS nucleic acid sequence <SEQ ID 9543> which encodes amino acid sequence <SEQ ID 9544> was also identified.

The protein has homology with the following sequences in the GENPEPT database.

```
>GP:AAA23551 GB:M93570 PTS enzyme III cel [Escherichia coli]
Identities = 42/102 (41%), Positives = 70/102 (68%)

Query:   4 EIIVADQIIMGLILNAGDAKQHIYQALKLAKEGNFAESKIEIELADSALLEAHNLQTQFL   63
           E+   ++++MGLI+N+G A+   Y ALK AK+G+FA +K  ++ +  AL EAH +QT+ +
Sbjct:  13 EVEELEEVVMGLIINSGQARSLAYAALKQAKQGDFAAAKAMMDQSRMALNEAHLVQTKLI  72

Query:  64 AQEAGGTRTDISALFIHSQDHLMTSITEINLIKEIIDLRQEL                   105
              +AG  +  +S + +H+QDHLMTS+    LI E+I+L ++L
Sbjct:  73 EGDAGEGKMKVSLVLVHAQDHLMTSMLARELITELIELHEKL                   114
```

A related DNA sequence was identified in *S. pyogenes* <SEQ ID 3059> which encodes the amino acid sequence <SEQ ID 3060>. Analysis of this protein sequence reveals the following:

```
Possible site: 17
>>> Seems to have an uncleavable N-term signal seq

----- Final Results -----
              bacterial membrane --- Certainty = 0.0000 (Not Clear) < succ>
              bacterial outside  --- Certainty = 0.0000 (Not Clear) < succ>
              bacterial cytoplasm --- Certainty = 0.0000 (Not Clear) < succ>
```

The protein has homology with the following sequences in the databases:

```
>GP:AAC74806 GB:AE000268 PEP-dependent phosphotransferase enzyme III
for cellobiose, arbutin, and salicin [Escherichia coli]
Identities = 39/97 (40%), Positives = 66/97 (67%)

Query:   7 DQIIMGLILNAGDAKQHIYQALKCAKEDDYATSEKEMALADDALLEAHNLQTQFLAQEAS  66
           ++++MGLI+N+G A+   Y ALK AK+ D+A ++  M  +  AL EAH +QT+ +  +A
Sbjct:  18 EEVVMGLIINSGQARSLAYAALKQAKQGDFAAAKAMMDQSRMALNEAHLVQTKLIEGDAG 77

Query:  67 GNKSEITALFVHSQDHLMTTITEINLIKEIIDLRKEL                        103
           K +++ +  VH+QDHLMT++    LI E+I+L ++L
Sbjct:  78 EGKMKVSLVLVHAQDHLMTSMLARELITELIELHEKL                        114
```

An alignment of the GAS and GBS proteins is shown below.

```
Identities = 81/103 (78%), Positives = 94/103 (90%)

Query:   3 MEIIVADQIIMGLILNAGDAKQHIYQALKLAKEGNFAESKIEIELADSALLEAHNLQTQF  62
           M++IV DQIIMGLILNAGDAKQHIYQALK AKE ++A S+ E+ LAD ALLEAHNLQTQF
Sbjct:   1 MQVIVPDQIIMGLILNAGDAKQHIYQALKCAKEDDYATSEKEMALADDALLEAHNLQTQF  60
```

```
Query:  63  LAQEAGGTRTDISALFIHSQDHLMTSITEINLIKEIIDLRQEL                    105
            LAQEA G +++I+ALF+HSQDHLMT+ITEINLIKEIIDLR+EL
Sbjct:  61  LAQEASGNKSEITALFVHSQDHLMTTITEINLIKEIIDLRKEL                    103
```

Based on this analysis, it was predicted that these proteins and their epitopes could be useful antigens for vaccines or diagnostics.

EXAMPLE 998

A DNA sequence (GBSx1058) was identified in *S. agalactiae* <SEQ ID 3061> which encodes the amino acid sequence <SEQ ID 3062>. This protein is predicted to be PTS system, cellobiose-specific IIB component (celA). Analysis of this protein sequence reveals the following:

```
Possible site: 24
>>> Seems to have a cleavable N-term signal seq.

----- Final Results -----
              bacterial outside  --- Certainty = 0.3000(Affirmative) < succ>
              bacterial membrane --- Certainty = 0.0000(Not Clear)   < succ>
              bacterial cytoplasm --- Certainty = 0.0000(Not Clear)  < succ>
```

The protein has homology with the following sequences in the GENPEPT database.

```
>GP: AAF94440 GB: AE004207 PTS system, cellobiose-specific IIB
component [Vibrio cholerae]
Identities = 46/100 (46%), Positives = 62/100 (62%)

Query:   1  MIKIGLFCAAGFSTGMLVNNMKIAADKEGIEAHIEAYSQGKIADYAKDLDVALLGPQVSY    60
            M KI L C+AG ST MLV  M+ AA+ +GIE  I+A S      +  ++ DV LLGPQV +
Sbjct:   1  MKKILLCCSAGMSTSMLVKKMQQAAESKGIECKIDALSVNAFEEAIQEYDVCLLGPQVRF    60

Query:  61  TLDKSKSICDEYGVPIAVIPMADYGMLDGVKVLKLALSLL                       100
             L++ +    DEYG  IA I    YGM+ G +VL+ AL L+
Sbjct:  61  QLEELRKTADEYGKNIAAISPQAYGMMKGDEVLQQALDLI                       100
```

A related DNA sequence was identified in *S. pyogenes* <SEQ ID 3063> which encodes the amino acid sequence <SEQ ID 3064>. Analysis of this protein sequence reveals the following:

```
Possible site: 31
>>> Seems to have a cleavable N-term signal seq.

----- Final Results -----
              bacterial outside  --- Certainty = 0.3000(Affirmative) < succ>
              bacterial membrane --- Certainty = 0.0000(Not Clear)   < succ>
              bacterial cytoplasm --- Certainty = 0.0000(Not Clear)  < succ>
```

The protein has homology with the following sequences in the databases:

```
>GP: AAF94440 GB: AE004207 PTS system, cellobiose-specific IIB
component [Vibrio cholerae]
Identities = 43/100 (43%), Positives = 58/100 (58%)

Query:   8  MIKIGLFCAAGFSTGMLVNNMKVAAEKKGIDCQIEAYAQGKLADYAPLLDVALLGPQVAY    67
            M KI L C+AG ST MLV  M+ AAE KGI+C+I+A +      +    DV LLGPQV +
Sbjct:   1  MKKILLCCSAGMSTSMLVKKMQQAAESKGIECKIDALSVNAFEEAIQEYDVCLLGPQVRF    60

Query:  68  TLDKSEAICKDNDIPIAVIPMADYGMLDGNKVLDLALSLV                       107
             L++       +   IA I    YGM+ G++VL  AL L+
Sbjct:  61  QLEELRKTADEYGKNIAAISPQAYGMMKGDEVLQQALDLI                       100
```

An alignment of the GAS and GBS proteins is shown below.

```
Identities = 79/101 (78%), Positives = 92/101 (90%)

Query:    1 MIKIGLFCAAGFSTGMLVNNMKIAADKEGIEAHIEAYSQGKIADYAKDLDVALLGPQVSY    60
            MIKIGLFCAAGFSTGMLVNNMK+AA+K+GI+  IEAY+QGK+ADYA  LDVALLGPQV+Y
Sbjct:    8 MIKIGLFCAAGFSTGMLVNNMKVAAEKKGIDCQIEAYAQGKLADYAPLLDVALLGPQVAY    67

Query:   61 TLDKSKSICDEYGVPIAVIPMADYGMLDGVKVLKLALSLLE                     101
            TLDKS++IC +   +PIAVIPMADYGMLDG KVL LALSL++
Sbjct:   68 TLDKSEAICKDNDIPIAVIPMADYGMLDGNKVLDLALSLVK                     108
```

SEQ ID 3062 (GBS180) was expressed in *E. coli* as a His-fusion product. SDS-PAGE analysis of total cell extract is shown in FIG. 39 (lane 4; MW 12.6 kDa). It was also expressed in *E. coli* as a GST-fusion product. SDS-PAGE analysis of total cell extract is shown in FIG. 41 (lane 2; MW 37.6 kDa).

Figure 298:
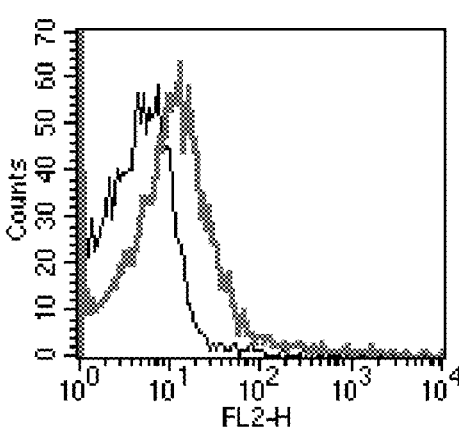

The GBS180-GST fusion product was purified (FIG. 204, lane 8) and used to immunise mice. The resulting antiserum was used for FACS (FIG. 298), which confirmed that the protein is immunoaccessible on GBS bacteria.

Based on this analysis, it was predicted that these proteins and their epitopes could be useful antigens for vaccines or diagnostics.

EXAMPLE 999

A DNA sequence (GBSx1059) was identified in *S. agalactiae* <SEQ ID 3065> which encodes the amino acid sequence <SEQ ID 3066>. This protein is predicted to be pts system, cellobiose-specific iic component (celB). Analysis of this protein sequence reveals the following:

```
Possible site: 40
>>> Seems to have no N-terminal signal sequence
    INTEGRAL    Likelihood = -11.68    Transmembrane   346-362 (334-374)
    INTEGRAL    Likelihood =  -9.77    Transmembrane   182-198 (178-205)
    INTEGRAL    Likelihood =  -8.65    Transmembrane    29-45  (27-50)
    INTEGRAL    Likelihood =  -6.53    Transmembrane   140-156 (134-161)
    INTEGRAL    Likelihood =  -4.78    Transmembrane   292-308 (289-312)
    INTEGRAL    Likelihood =  -4.41    Transmembrane   397-413 (395-416)
    INTEGRAL    Likelihood =  -2.97    Transmembrane    77-93  (72-93)
    INTEGRAL    Likelihood =  -2.97    Transmembrane   228-244 (222-246)

----- Final Results -----
        bacterial membrane  --- Certainty = 0.5670(Affirmative) < succ>
         bacterial outside  --- Certainty = 0.0000(Not Clear)   < succ>
        bacterial cytoplasm --- Certainty = 0.0000(Not Clear)   < succ>
```

The protein has homology with the following sequences in the GENPEPT database.

```
>GP: AAA17390 GB: U07818 cellobiose phosphotransferase enzyme II"
[Bacillus stearothermophilus]
Identities = 160/415 (38%), Positives = 251/415 (59%), Gaps = 13/415 (3%)

Query:   15 KFVNMRGIIALKDGMLAILPLTVVGSLFLILGQLPFKGLNQAIANVFGPEWTEPFMQVYS    74
            K   R + A++DG++  +PL ++GSLFLI+G LP   G N+ +A  FG  W +   +
Sbjct:   18 KIAEQRHLQAIRDGIILSMPLLIIGSLFLIVGFLPIPGYNEWMAKWFGEHWLDKLLYPVG    77

Query:   75 GTFAIMGLISCFAIAYAYAKNSSVEPLPAGVLSLSSFFILMKSSYIPVKGEA------IA   128
             TF IM L+  F +AY  A+    V+ L AG +SL++F +L      +P   E         ++
Sbjct:   78 ATFDIMALVVSFGVAYRLAEKYKVDALSAGAISLAAF-LLATPYQVPFTPEGAKETIMVS   136

Query:  129 DAISKVWFGGQGIIGAIIGLVVGAIYTWFIQHHIVIKMPEQVPQAIAKQFEAMIPAFVI   188
                I   W G +G+  A+I+ +V   IY    IQ +IVIK+P+ VP A+A+ F A+IP   +
Sbjct:  137 GGIPVQWVGSKGLFVAMILAIVSTEIYRKIIQKNIVIKLPDGVPPAVARSFVALIPGAAV   196

Query:  189 FLLSMIVYLIAKVTTGGTFIEMIYDIIQVPLQGLTGSLYGAIGIAFFISFLWWFGVHGQS   248
             ++  +  LI ++T   +F  ++ ++  PL  L GS++GAI     + LW  G+HG +
Sbjct:  197 LVVVWVARLILEMTPFESFHNIVSVLLNKPLSVLGGSVFGAIVAVLLVQLLWSTGLHGAA   256

Query:  249 VVNGIVTALLLSNLDANKSLLAAN-RLTLDNGAHIVTQQFLDSFLILSGSGITFGLVIAM   307
            +V G++  + LS +D N+ +    N     L N     ++TQQF D ++ + GSG T  L + M
Sbjct:  257 IVGGVMGPIWLSLMDENRMVFQQNPNAELPN---VITQQFFDLWIYIGGSGATLALALTM   313

Query:  308 LFAAKSQYKALGKVAAFPAIFNVNEPIVGFPIVMNPVMFLPFILVPVLAALIVYGAIA   367
             +F A+S+Q K+LG++A  P IFN+NEPI  FG  PIVMNP++  +PFILVPV+   ++ Y A+A
Sbjct:  314 MFRARSRQLKSLGRLAIAPGIFNINEPITFGMPIVMNPLLIIPFILVPVVLVVVSYAAMA   373
```

```
-continued
Query: 368 VGFMQPFSGVTLPWSTPAIISGFMVGGWQ--GALVQIVILAISTAVYFPFFKIQD    420
            G +     SGV +PW+TP +ISG++   G +   G+++QIV   I+ A+Y+PFF I D
Sbjct: 374 TGLVAKPSGVAVPWTTPIVISGYLATGGKISGSILQIVNFFIAFAIYYPFFSIWD    428
```

A related DNA sequence was identified in *S. pyogenes* <SEQ ID 2215> which encodes the amino acid sequence <SEQ ID 2216>. Analysis of this protein sequence reveals the following:

```
Possible site: 40
>>> Seems to have no N-terminal signal sequence
       INTEGRAL    Likelihood = -8.92    Transmembrane    347-363 (335-373)
       INTEGRAL    Likelihood = -7.59    Transmembrane     29-45  (27-50)
       INTEGRAL    Likelihood = -7.38    Transmembrane    182-198 (179-204)
       INTEGRAL    Likelihood = -5.68    Transmembrane    398-414 (395-420)
       INTEGRAL    Likelihood = -4.99    Transmembrane    293-309 (291-314)
       INTEGRAL    Likelihood = -3.61    Transmembrane    140-156 (134-160)
       INTEGRAL    Likelihood = -2.60    Transmembrane    229-245 (229-246)
       INTEGRAL    Likelihood = -0.75    Transmembrane     72-88  (72-88)

----- Final Results -----
              bacterial membrane --- Certainty = 0.4567(Affirmative) < succ>
               bacterial outside --- Certainty = 0.0000(Not Clear)   < succ>
             bacterial cytoplasm --- Certainty = 0.0000(Not Clear)   < succ>
```

An alignment of the GAS and GBS proteins is shown below.

```
Identities = 366/428 (85%), Positives = 402/428 (93%), Gaps = 1/428 (0%)

Query:   1 MSKFDSQKIITPIMKFVNMRGIIALKDGMLAILPLTVVGSLFLILGQLPFKGLNQAIANV    60
           M+K + Q II PIM FVNMRGIIALKDGMLAILPLTVVGSLFLI GQ+PF+G+N AIA+V
Sbjct:   1 MAKMNMQNIIKPIMTFVNMRGIIALKDGMLAILPLTVVGSLFLIAGQIPFQGVNDAIASV    60

Query:  61 FGPEWTEPFMQVYSGTFAIMGLISCFAIAYAYAKNSSVEPLPAGVLSLSSFFILMKSSYI   120
           FG +WTEPFMQVY GTFAIMGLISCFAI Y+YAKNS VEPLP+GVLSLS+FFIL++SSY+
Sbjct:  61 FGADWTEPFMQVYHGTFAIMGLISCFAIGYSYAKNSGVEPLPSGVLSLSAFFILLRSSYV   120

Query: 121 PVKGEAIADAISKVWFGGQGIIGAIIIGLVVGAIYTWFIQHHIVIKMPEQVPQAIAKQFE   180
           P +GEAI DAISKVWFGGQGIIGAI+IGL VGA+YT FI+ HIVIKMP+QVPQAIAKQFE
Sbjct: 121 PAEGEAIGDAISKVWFGGQGIIGAIVIGLTVGAVYTTFIRRHIVIKMPDQVPQAIAKQFE   180

Query: 181 AMIPAFVIFLLSMIVYLIAK-VTTGGTFIEMIYDIIQVPLQGLTGSLYGAIGIAFFISFL   239
           AMIPAFVIF LSM+VY+IAK VT GGTFIEMIYD+IQVPLQGLTGSLYGA+GIAFFISFL
Sbjct: 181 AMIPAFVIFTLSMLVYIIAKSVTGGGTFIEMIYDVIQVPLQGLTGSLYGALGIAFFISFL   240

Query: 240 WWFGVHGQSVVNGIVTALLLSNLDANKSLLAANRLTLDNGAHIVTQQFLDSFLILSGSGI   299
           WWFGVHGQSVVNGIVTALLLSNLDANK+L+AA   L+LD GAHIVTQQFLDSFLILSGSGI
Sbjct: 241 WWFGVHGQSVVNGIVTALLLSNLDANKALMAAGELSLDKGAHIVTQQFLDSFLILSGSGI   300

Query: 300 TFGLVIAMLFAAKSKQYKALGKVAAFPAIFNVNEPIVFGFPIVMNPVMFLPFILVPVLAA   359
           TFGLV+AM+FAAKSKQYKALGKVAAFPA+FNVNEP+VFGFPIVMNPVMFLPFILVPVLAA
Sbjct: 301 TFGLVVAMIFAAKSKQYKALGKVAAFPALFNVNEPVVFGFPIVMNPVMFLPFILVPVLAA   360

Query: 360 LIVYGAIAVGFMQPFSGVTLPWSTPAIISGFMVGGWQGALVQIVILAISTAVYFPFFKIQ   419
           L VYGAIA+GFMQPF+GVTLPWSTPAIISGFMVGGWQGA+VQI+IL +ST VYFPFFKIQ
Sbjct: 361 LTVYGAIAIGFMQPFAGVTLPWSTPAIISGFMVGGWQGAIVQILILIMSTLVYFPFFKIQ   420

Query: 420 DNITYKNE   427
           DN+ Y+NE
Sbjct: 421 DNMAYQNE   428
```

Based on this analysis, it was predicted that these proteins and their epitopes could be useful antigens for vaccines or diagnostics.

EXAMPLE 1000

A DNA sequence (GBSx1060) was identified in *S. agalactiae* <SEQ ID 3067> which encodes the amino acid sequence <SEQ, ID 3068>. This protein is predicted to be formate acetyltransferase 2 (pflB). Analysis of this protein sequence reveals the following:

```
Possible site: 54
>>> Seems to have no N-terminal signal sequence

----- Final Results -----
            bacterial cytoplasm --- Certainty = 0.5049(Affirmative) < succ>
             bacterial membrane --- Certainty = 0.0000(Not Clear) < succ>
              bacterial outside --- Certainty = 0.0000(Not Clear) < succ>
```

The protein has homology with the following sequences in the GENPEPT database.

```
>GP: AAC73910 GB: AE000184 putative formate acetyltransferase
[Escherichia coli K12]
Identities = 414/805 (51%), Positives = 555/805 (68%), Gaps = 14/805 (1%)

Query:   25 LTERMYSYRDKVLD-KKPFIDAERAILVTEAYQKHQEKPNVLKRAYMLQNILEKMTIYID   83
            L++R+ ++++ ++    KP +  ERA   TE YQ+H +KP  ++RA  L + L    TI+I
Sbjct:    9 LSDRIKAHKNALVHIVKPPVCTERAQHYTEMYQQHLDKPIPVRRALALAHHLANRTIWIK   68

Query:   84 DETMIVGNQASSDKDAPIFPEYTLEFVVNELDLFEKRDGDVFYITEETKEQIRNIAPFWE  143
            + +I+GNQAS  + APIFPEYT+ ++  E+D     R G  F ++EE K  +  + P+W
Sbjct:   69 HDELIIGNQASEVRAAPIFPEYTVSWIEKEIDDLADRPGAGFAVSEENKRVLHEVCPWWR  128

Query:  144 NNNLRARAGVMLPEEVQVYMETGFFGMEGKMNSGDAHLAVNYQKLLEEGLIGFEKKARKA  203
            ++ R    M +E +  + TG    EG M SGDAHLAVN+   LLE+GL G  ++   +
Sbjct:  129 GQTVQDRCYGMFTDEQKGLLATGIIKAEGNMTSGDAHLAVNFPLLLEKGLDGLREEVAER  188

Query:  204 KADLDLTKPESIDKYHFYDSILITIEAVKTYAERFAILAKKQAKTANAK-RRQELLDIAS  262
            ++  ++LT  E +    F   +I I +  AV + ERFA  LA++ A T   + RR ELL +A
Sbjct:  189 RSRINLTVLEDLHGEQFLKAIDIVLVAVSEHIERFAALAREMAATETRESRRDELLAMAE  248

Query:  263 ICERVPYYPAETFAEAVQSVWFIQCILQIESNGHSLSYGRFDQYMYPYVKSDLEAGRETE  322
            C+ + + P +TF +A+Q  +FIQ ILQIESNGHS+S+GR DQY+YPY + D+E   +   +
Sbjct:  249 NCDLIAHQPPQTFWQALQLCYFIQLILQIESNGHSVSFGRMDQYLYPYYRRDVELNQTLD  308

Query:  323 -DSIVERLTNLWIKTITINKVRSQAHTFSSAGSPLYQNVTIGGQTR---HKEDAVNPLSF  378
             + +E L + W+K + +NK+RS +H+ +SAGSPLYQNVTIGGQ            DAVNPLS+
Sbjct:  309 REHAIEMLHSCWLKLLEVNKIRSGSHSKASAGSPLYQNVTIGGQNLVDGQPMDAVNPLSY  368

Query:  379 LVLKSVAQTHLPQPNLTVRYHANLDKSFMNEAIEVMKLGFGMPAFNNDEIIPSFIKKGV  438
            +L+S +     QPNL+VRYHA +    F++   ++V++  GFGMPAFNNDEI+P FIK G+
Sbjct:  369 AILESCGRLRSTQPNLSVRYHAGMSNDFLDACVQVIRCGFGMPAFNNDEIVIPEFIKLGI  428

Query:  439 SEEDAYDYSAIGCVETAVPGKWGYRCTGMSYINFPKVLLITMNDGIDPASGKRFAP----  494
            +DAYDY+AIGC+ETAV GKWGYRCTGMS+INF +V+L  +    G D   SGK F P
Sbjct:  429 EPQDAYDYAAIGCIETAVGGKWGYRCTGMSFINFARVMLAALEGGHDATSGKVFLPQEKA  488

Query:  495 -SYGHFTQMTSYKELKEAWDKTLRYLTRMSVIVENAIDISLEREVPDILCSALTDDCIGR  553
              S G+F    ++ E+ +AWD  +RY TR S+ +E  +D  LE  V DILCSAL DDCI R
Sbjct:  489 LSAGNFN---NFDEVMDAWDTQIRYYTRKSIEIEYVVDTMLEENVHDILCSALVDDCIER  545

Query:  554 GKHLKEGGAVYDYISGLQVGIANLSDSLAALKKLVFEEKRLTTLEVWQALQSDYAGPRGE  613
             K +K+GGA YD++SGLQVGIANL +SLAA+KKLVFE+         ++ AL  D+ G    E
Sbjct:  546 AKSIKQGGAKYDWVSGLQVGIANLGNSLAAVKKLVFEQGAIGQQQLAAALADDFDGLTHE  605

Query:  614 EIRQMLINEAPKYGNDDDYADSLVRECYDVYVEEIAKYPNTRYGRGPIGGIRYSGTSSIS  673
            ++RQ LIN APKYGNDDD  D+L+   Y  Y++E+ +Y N RYGRGP GG  Y+GTSSIS
Sbjct:  606 QLRQRLINGAPKYGNDDDTVDTLLARAYQTYIDELKQYHNPRYGRGPVGGNYYAGTSSIS  665

Query:  674 ANVGQGRGTLATPDGRHAGTPLAEGCSPSHNMDKKGPTSVLKSVSKLPTDEIVGGVLLNQ  733
            ANV G  T+ATPDGR A TPLAEG SP+    D  GPT+V+ SV KLPT  I+GGVLLNQ
Sbjct:  666 ANVPFGAQTMATPDGRKAHTPLAEGASPASGTDHLGPTAVIGSVGKLPTAAILGGVLLNQ  725

Query:  734 KVNPQTLAKEEDKQKLIALLRTFFNRLHGYHIQYNVVSRETLIDAQKHPEKHRDLIVRVA  793
            K+NP TL  E DKQKL+ LLRTFF      G+HIQYN+VSRETL DA+KHP+++RDL+VRVA
Sbjct:  726 KLNPATLENESDKQKLMILLRTFFEVHKGWHIQYNIVSRETLLDAKKHPDQYRDLVVRVA  785

Query:  794 GYSAFFNVLSKATQDDIIARTEHAL                                    818
            GYSAFF   LS   QDDIIARTEH L
Sbjct:  786 GYSAFFTALSPDAQDDIIARTEHML                                    810
```

A related DNA sequence was identified in *S. pyogenes* <SEQ ID 3069> which encodes the amino acid sequence <SEQ ID 3070>. Analysis of this protein sequence reveals the following:

```
Possible site: 19
>>> Seems to have no N-terminal signal sequence

----- Final Results -----
              bacterial cytoplasm --- Certainty = 0.4763(Affirmative) < succ>
               bacterial membrane --- Certainty = 0.0000(Not Clear)   < succ>
                 bacterial outside --- Certainty = 0.0000(Not Clear)   < succ>
```

An alignment of the GAS and GBS proteins is shown below.

```
Identities = 694/803 (86%), Positives = 747/803 (92%)

Query:   16 QNSQKHFGYLTERMYSYRDKVLDKKPFIDAERAILVTEAYQKHQEKPNVLKRAYMLQNIL    75
            +    +FG+LT+RM  YR+ VLDKKP+IDAERAIL TEAYQKHQ KP  LKRAYMLQ IL
Sbjct:    3 ETKSPYFGHLTDRMTHYREAVLDKKPYIDAERAILATEAYQKHQNKPANLKRAYMLQTIL    62

Query:   76 EKMTIYIDDETMIVGNQASSDKDAPIFPEYTLEFVVNELDLFEKRDGDVFYITEETKEQI   135
            E MTIYI+DE++I GNQASS+KDAPIFPEYTLEFV+NELDLFEKRDGDVFYITEETK+Q+
Sbjct:   63 ENMTIYIEDESLIAGNQASSNKDAPIFPEYTLEFVLNELDLFEKRDGDVFYITEETKQQL   122

Query:  136 RNIAPFWENNNLRARAGVMLPEEVQVYMETGFFGMEGKMNSGDAHLAVNYQKLLEEGLIG   195
            R+IAPFWENNNLRAR GV+LPEEVQVYMETGFFGMEGKMNSGDAHLAVNYQKLLE GL G
Sbjct:  123 RDIAPFWENNNLRARCGVLLPEEVQVYMETGFFGMEGKMNSGDAHLAVNYQKLLEHGLKG   182

Query:  196 FEKKARKAKADLDLTKPESIDKYHFYDSILITIEAVKTYAERFAILAKKQAKTANAKRRQ   255
            FE++AR AKA LDLT PE+IDKYHFYDS+ I  I+AVKTYA+R+A LA++ AKTA  +R+
Sbjct:  183 FEERARAAKAALDLTIPENIDKYHFYDSVFIVIDAVKTYAKRYAKLARELAKTAKPERQA   242

Query:  256 ELLDIASICERVPYYPAETFAEAVQSVWFIQCILQIESNGHSLSYGRFDQYMYPYVKSDL   315
            ELLDIA IC++VPY PA+TFAEAVQSVWFIQCILQIESNGHSLSYGRFDQYMYPYVK+DL
Sbjct:  243 ELLDIARICDKVPYEPAKTFAEAVQSVWFIQCILQIESNGHSLSYGRFDQYMYPYVKADL   302

Query:  316 EAGRETEDSIVERLTNLWIKTITINKVRSQAHTFSSAGSPLYQNVTIGGQTRHKEDAVNP   375
            EAGRETED+IVERLTNLWIKT+TINKVRSQAHTFSSAGSPLYQNVTIGGQTR K+DAVNP
Sbjct:  303 EAGRETEDTIVERLTNLWIKTLTINKVRSQAHTFSSAGSPLYQNVTIGGQTRDKKDAVNP   362

Query:  376 LSFLVLKSVAQTHLPQPNLTVRYHANLDKSFMNEAIEVMKLGFGMPAFNNDEIIIPSFIK   435
            LS+LVL+SVAQT LPQPNLTVRYH  LD +FMNE IEVMKLGFGMPA NNDEIIIPSFIK
Sbjct:  363 LSYLVLRSVAQTKLPQPNLTVRYHKGLDNTFMNECIEVMKLGFGMPAMNNDEIIIPSFIK   422

Query:  436 KGVSEEDAYDYSAIGCVETAVPGKWGYRCTGMSYINFPKVLLITMNDGIDPASGKRFAPS   495
            KGVSEEDAYDYSAIGCVETAVPGKWGYRCTGMSYINFPK+LLITMNDGIDPASGKRFA
Sbjct:  423 KGVSEEDAYDYSAIGCVETAVPGKWGYRCTGMSYINFPKILLITMNDGIDPASGKRFAKG   482

Query:  496 YGHFTQMTSYKELKEAWDKTLRYLTRMSVIVENAIDISLEREVPDILCSALTDDCIGRGK   555
            +GHF  MTSY+ELK AWD TLR +TRMSVIVENAID+ LEREVPDILCSALTDDCIGRGK
Sbjct:  483 HGHFKDMTSYEELKAAWDATLREITRMSVIVENAIDLGLEREVPDILCSALTDDCIGRGK   542

Query:  556 HLKEGGAVYDYISGLQVGIANLSDSLAALKKLVFEEKRLTTLEVWQALQSDYAGPRGEEI   615
              LKEGGAVYDYISGLQVGIANLSDSLAALKKLVFEE RLT  E+W+AL+SD+AG RGE+I
Sbjct:  543 TLKEGGAVYDYISGLQVGIANLSDSLAALKKLVFEEGRLTPEELWKALESDFAGERGEDI   602

Query:  616 RQMLINEAPKYGNDDDYADSLVRECYDVYVEEIAKYPNTRYGRGPIGGIRYSGTSSISAN   675
            RQMLIN+APKYGNDDDYADSLV E YD Y++EIAKYPNTRYGRGPIGGIRYSGTSSISAN
Sbjct:  603 RQMLINDAPKYGNDDDYADSLVVEAYDTYIDEIAKYPNTRYGRGPIGGIRYSGTSSISAN   662

Query:  676 VGQGRGTLATPDGRHAGTPLAEGCSPSHNMDKKGPTSVLKSVSKLPTDEIVGGVLLNQKV   735
            VGQG+GTLATPDGRHAGTPLAEGCSP H+MDKKGPTSVLKSV+KLPTDEIVGGVLLNQKV
Sbjct:  663 VGQGKGTLATPDGRHAGTPLAEGCSPEHSMDKKGPTSVLKSVAKLPTDEIVGGVLLNQKV   722

Query:  736 NPQTLAKEEDKQKLIALLRTFFNRLHGYHIQYNVVSRETLIDAQKHPEKHRDLIVRVAGY   795
            NPQTLAKEEDK KL+ALLRTFFNRLHGYHIQYNVVSRETLIDAQKHPEKHRDLIVRVAGY
Sbjct:  723 NPQTLAKEEDKLKLMALLRTFFNRLHGYHIQYNVVSRETLIDAQKHPEKHRDLIVRVAGY   782

Query:  796 SAFFNVLSKATQDDIIARTEHAL                                        818
            SAFFNVLSKATQDDII RTEH L
Sbjct:  783 SAFFNVLSKATQDDIIERTEHTL                                        805
```

Based on this analysis, it was predicted that these proteins and their epitopes could be useful antigens for vaccines or diagnostics.

EXAMPLE 1001

A DNA sequence (GBSx1061) was identified in *S. agalactiae* <SEQ ID 3071> which encodes the amino acid sequence <SEQ ID 3072>. Analysis of this protein sequence reveals the following:

```
Possible site: 32
>>> Seems to have no N-terminal signal sequence

----- Final Results -----
            bacterial cytoplasm --- Certainty = 0.1024(Affirmative) < succ>
             bacterial membrane --- Certainty = 0.0000(Not Clear)   < succ>
              bacterial outside --- Certainty = 0.0000(Not Clear)   < succ>
```

The protein has homology with the following sequences in the GENPEPT database.

```
>GP: CAA05516 GB: AJ002527 OrfX [Clostridium beijerinckii]
Identities = 90/214 (42%), Positives = 131/214 (61%), Gaps = 1/214 (0%)

Query:    1 MEFLLDTLNLEAIKKWHHILPLAGVTSNPTIAKKEGDIHFFQRIRDVREIIGREASLHVQ   60
            M+ ++D +N+E IK    I  + GVTSNP+I  K G   +  I+ +RE IG  + LHVQ
Sbjct:    1 MKLIIDDVNIEKIKDVFSIFQIDGVTSNPSILHKYGKQPYEILIK-IREFIGENSELHVQ   59

Query:   61 VVAKDYQGILDDAAKIRQETDDDIYIKVPVTPDGLAAIKTLKAEGYNITATAIYTSMQGL  120
            V+++  +G+L +A KI +E   + Y+K+PVT DGL AIK L+ E  N+TATAIYT MQ
Sbjct:   60 VISESSEGMLKEAHKIIKELGKNTYVKIPVTRDGLKAIKILRKEEINVTATAIYTQMQAY  119

Query:  121 LAISAGADYLAPYFNRMENLDIDATQVIKELAQAIERTGSSSKILAASFKNASQVTKALS  180
            LA  AGA Y APY NR++NL +  QV K++      E+     +++LAASFKN+ QV +
Sbjct:  120 LAGKAGAQYAAPYVNRIDNLGANGVQVAKDIHDIFEKNNFKTEVLAASFKNSQQVLELCK  179

Query:  181 QGAQSITAGPDIFESVFAMPSIAKAVNDFADDWK                           214
             G  + T  PD+ E +     + AV +F  D++
Sbjct:  180 YGIGAATISPDVIEGLIKNDCVDVAVENFKKDFE                           213
```

A related DNA sequence was identified in *S. pyogenes* <SEQ ID 3073> which encodes the amino acid sequence <SEQ ID 3074>. Analysis of this protein sequence reveals the following:

```
Possible site: 32
>>> Seems to have no N-terminal signal sequence

----- Final Results -----
            bacterial cytoplasm --- Certainty = 0.1090(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below.

```
Identities = 158/222 (71%), Positives = 194/222 (87%)

Query:    1 MEFLLDTLNLEAIKKWHHILPLAGVTSNPTIAKKEGDIHFFQRIRDVREIIGREASLHVQ   60
            ME++LDTL+LEAIKKWHHILPLAGVTSNP+IAKKEG+I FF+RIR+VR IIG +AS+HVQ
Sbjct:    1 MEYMLDTLDLEAIKKWHHILPLAGVTSNPSIAKKEGEIDFFERIREVRAIIGDKASIHVQ   60

Query:   61 VVAKDYQGILDDAAKIRQETDDDIYIKVPVTPDGLAAIKTLKAEGYNITATAIYTSMQGL  120
            V+A+DY+GIL DAA+IR++  D +Y+KVPVT +GLAAIKTLKAEGY+ITATAIYT+ QGL
Sbjct:   61 VIAQDYEGILKDAAEIRRQCGDSVYVKVPVTTEGLAAIKTLKAEGYHITATAIYTTFQGL  120

Query:  121 LAISAGADYLAPYFNRMENLDIDATQVIKELAQAIERTGSSSKILAASFKNASQVTKALS  180
            LAI AGADYLAPY+NRMENL+ID   VI++LA+AI R  ++SKILAASFKN +QV K+ +
Sbjct:  121 LAIEAGADYLAPYYNRMENLNIDPEAVIEQLAEAINRENANSKILAASFKNVAQVNKSFA  180

Query:  181 QGAQSITAGPDIFESVFAMPSIAKAVNDFADDWKASQHSEHI                   222
             GAQ+ITAGPD+FE+ FAMPSI KAV+DF DW+A  H + I
Sbjct:  181 LGAQAITAGPDVFEAGFAMPSIQKAVDDFGKDWEAIHHRKSI                   222
```

Based on this analysis, it was predicted that these proteins and their epitopes could be useful antigens for vaccines or diagnostics.

EXAMPLE 1002

A DNA sequence (GBSx1062) was identified in *S. agalactiae* <SEQ ID 3075> which encodes the amino acid sequence <SEQ ID 3076>. Analysis of this protein sequence reveals the following:

```
Possible site: 30
>>> Seems to have no N-terminal signal sequence

----- Final Results -----
            bacterial cytoplasm --- Certainty = 0.3086(Affirmative) < succ>
             bacterial membrane --- Certainty = 0.0000(Not Clear)   < succ>
              bacterial outside --- Certainty = 0.0000(Not Clear)   < succ>
```

A related GBS nucleic acid sequence <SEQ ID 9545> which encodes amino acid sequence <SEQ ID 9546> was also identified.

The protein has homology with the following sequences in the GENPEPT database.

```
>GP: AAA22477 GB: M65289 glycerol dehydrogenase [Bacillus
stearothermophilus]
Identities = 199/362 (54%), Positives = 271/362 (73%), Gaps = 2/362 (0%)

Query:   4 KVFASPSRYIQGKDALFQSIEHIKSLGQTPLILCDDVVYNIVGERFLSYLQD-DLLPHRV   62
           +VF SP++Y+QGK+ + +   +++ +G    +++ D++V+ I G    ++ L+ ++    V
Sbjct:   5 RVFISPAKYVQGKNVITKIANYLEGIGNKTVVIADEIVWKIAGHTIVNELKKGNIAAEEV   64

Query:  63 SFNGEASDNEINRVVAVAKEKNSDLIIGLGGGKTIDSAKAIADKVNLPVVIAPTVASTDA  122
             F+GEAS NE+ R+   +A++  + ++IG+GGGKT+D+AKA+AD+++  +VI PT ASTDA
Sbjct:  65 VFSGEASRNEVERIANIARKAEAAIVIGVGGGKTLDTAKAVADELDAYIVIVPTAASTDA  124

Query: 123 PTSALSVIYTDEGAFEKYIFYSKNPDLVLVDTQVIAQAPKRLLASGIADGLATWVEARAV  182
            PTSALSVIY+D+G FE Y FY KNPDLVLVDT++IA AP RLLASGIAD LATWVEAR+V
Sbjct: 125 PTSALSVIYSDDGVFESYRFYKKNPDLVLVDTKIIANAPPRLLASGIADALATWVEARSV  184

Query: 183 LQKNGIAMAGGRQTLAGVAIAQACERTLFNDSLQALAACDAKVVTKALENVIEANTLLSG  242
           ++  G  MAGG  T+A  AIA+ CE+TLF     A  +  AKVVT ALE V+EANTLLSG
Sbjct: 185 IKSGGKTMAGGIPTIAAEAIAEKCEQTLFKYGKLAYESVKAKVVTPALEAVVEANTLLSG  244

Query: 243 LGFESAGLAAAHAIHNGFTALSGDIHHLTHGEKVAYGTLTQLFLENRPKEEIDRYINLYQ  302
           LGFES GLAAAHAIHNGFTAL G+IHHLTHGEKVA+GTL QL LE   ++EI+RYI LY
Sbjct: 245 LGFESGGLAAAHAIHNGFTALEGEIHHLTHGEKVAFGTLVQLALEEHSQQEIERYIELYL  304

Query: 303 AIGMPTTLAELHLGDATYEELLKVGQQATIEGETIHEMPFKISAEDVAAALLTVDRYVSN  362
           ++ +P TL ++ L DA+ E++LKV + AT EGETIH   F ++A+DVA A+    D+Y
Sbjct: 305 SLDLPVTLEDIKLKDASREDILKVAKAATAEGETIHN-AFNVTADDVADAIFAADQYAKA  363

Query: 363 HQ                                                           364
           ++
Sbjct: 364 YK                                                           365
```

A related DNA sequence was identified in *S. pyogenes* <SEQ ID 3077> which encodes the amino acid sequence <SEQ ID 3078>. Analysis of this protein sequence reveals the following:

```
Possible site: 35
>>> Seems to have no N-terminal signal sequence
    INTEGRAL   Likelihood = -4.62   Transmembrane   101-117 (98-119)

----- Final Results -----
             bacterial membrane --- Certainty = 0.2848(Affirmative) < succ>
              bacterial outside --- Certainty = 0.0000(Not Clear)   < succ>
            bacterial cytoplasm --- Certainty = 0.0000(Not Clear)   < succ>
```

The protein has homology with the following sequences in the databases:

```
>GP: AAA22477 GB: M65289 glycerol dehydrogenase [Bacillus
stearothermophilus]
Identities = 202/357 (56%), Positives = 261/357 (72%), Gaps = 1/357 (0%)

Query:    2 KVFASPSRYIQGKNALFTNVKTLKQLGDSPILLCDDVVYGIVGERFESYLIDNGMTPVHV   61
            +VF SP++Y+QGKN +      L+ +G+  +++ D++V+ I G   + L   +    V
Sbjct:    5 RVFISPAKYVQGKNVITKIANYLEGIGNKTVVIADEIVWKIAGHTIVNELKKGNIAAEEV   64

Query:   62 AFNGEASDNEISRVVAIAKENGNDVIIGLGGGKTIDSAKAIADLLAVPVIIAPTIASTDA  121
              F+GEAS NE+ R+  IA++    ++IG+GGGKT+D+AKA+AD L   ++I PT ASTDA
Sbjct:   65 VFSGEASRNEVERIANIARKAEAAIVIGVGGGKTLDTAKAVADELDAYIVIVPTAASTDA  124

Query:  122 PTSALSVIYTDEGAFEKYIFYSKNPDLVLVDTQVICQAPKRLLASGIADGLATWVEARAV  181
            PTSALSVIY+D+G FE Y FY KNPDLVLVDT++I   AP RLLASGIAD LATWVEAR+V
Sbjct:  125 PTSALSVIYSDDGVFESYRFYKKNPDLVLVDTKIIANAPPRLLASGIADALATWVEARSV  184

Query:  182 MQKNGDTMAGGNQTLAGVAIAKACEQTLFADGLKAMASCDRQVVTPALENVIEANTLLSG  241
             ++  G TMAGG  T+A  AIA+ CEQTLF  G  A  S   +VVTPALE V+EANTLLSG
Sbjct:  185 IKSGGKTMAGGIPTIAAEAIAEKCEQTLFKYGKLAYESVKAKVVTPALEAVVEANTLLSG  244

Query:  242 LGFESAGLAAAHAIHNGFTALTGAIHHLTHGEKVAYGTLTQLFLENRSREEIDRYIDFYQ  301
            LGFES  GLAAAHAIHNGFTAL G  IHHLTHGEKVA+GTL QL LE   S++EI+RYI+ Y
Sbjct:  245 LGFESGGLAAAHAIHNGFTALEGEIHHLTHGEKVAFGTLVQLALEEHSQQEIERYIELYL  304

Query:  302 AIGMPTTLKEMHLDTATQEDFLKIGRQATMAGETIHQMPFVISPEDVAAALVAVDAY     358
             ++  +P TL+++  L   A++ED LK+ +  AT   GETIH   F ++  +DVA A+ A D Y
Sbjct:  305 SLDLPVTLEDIKLKDASREDILKVAKAATAEGETIHN-AFNVTADDVADAIFAADQY     360
```

An alignment of the GAS and GBS proteins is shown below.

```
Identities = 287/361 (79%), Positives = 325/361 (89%), Gaps = 1/361 (0%)

Query:    3 MKVFASPSRYIQGKDALFQSIEHIKSLGQTPLILCDDVVYNIVGERFLSYLQDD-LLPHR   61
            MKVFASPSRYIQGK+ALF +++ +K LG +P++LCDDVVY IVGERF SYL D+ + P
Sbjct:    1 MKVFASPSRYIQGKNALFTNVKTLKQLGDSPILLCDDVVYGIVGERFESYLIDNGMTPVH   60

Query:   62 VSFNGEASDNEINRVVAVAKEKNSDLIIGLGGGKTIDSAKAIADKVNLPVVIAPTVASTD  121
            V+FNGEASDNEI+RVVA+AKE  +D+IIGLGGGKTIDSAKAIAD + +PV+IAPT+ASTD
Sbjct:   61 VAFNGEASDNEISRVVAIAKENGNDVIIGLGGGKTIDSAKAIADLLAVPVIIAPTIASTD  120

Query:  122 APTSALSVIYTDEGAFEKYIFYSKNPDLVLVDTQVIAQAPKRLLASGIADGLATWVEARA  181
            APTSALSVIYTDEGAFEKYIFYSKNPDLVLVDTQVI QAPKRLLASGIADGLATWVEARA
Sbjct:  121 APTSALSVIYTDEGAFEKYIFYSKNPDLVLVDTQVICQAPKRLLASGIADGLATWVEARA  180

Query:  182 VLQKNGIAMAGGRQTLAGVAIAQACERTLFNDSLQALAACDAKVVTKALENVIEANTLLS  241
            V+QKNG  MAGG QTLAGVAIA+ACE+ TLF D L+A+A+CD +VVT ALENVIEANTLLS
Sbjct:  181 VMQKNGDTMAGGNQTLAGVAIAKACEQTLFADGLKAMASCDRQVVTPALENVIEANTLLS  240

Query:  242 GLGFESAGLAAAHAIHNGFTALSGDIHHLTHGEKVAYGTLTQLFLENRPKEEIDRYINLY  301
            GLGFESAGLAAAHAIHNGFTAL+G IHHLTHGEKVAYGTLTQLFLENR +EEIDRYI+ Y
Sbjct:  241 GLGFESAGLAAAHAIHNGFTALTGAIHHLTHGEKVAYGTLTQLFLENRSREEIDRYIDFY  300

Query:  302 QAIGMPTTLAELHLGDATYEELLKVGQQATIEGETIHEMPFKISAEDVAAALLTVDRYVSN 362
            QAIGMPTTL E+HL  AT E+ LK+G+QAT+ GETIH+MPF IS EDVAAAL+ VD YV++
Sbjct:  301 QAIGMPTTLKEMHLDTATQEDFLKIGRQATMAGETIHQMPFVISPEDVAAALVAVDAYVTS 361
```

Based on this analysis, it was predicted that these proteins and their epitopes could be useful antigens for vaccines or diagnostics.

EXAMPLE 1003

A DNA sequence (GBSx1063) was identified in *S. agalactiae* <SEQ ID 3079> which encodes the amino acid sequence <SEQ ID 3080>. Analysis of this protein sequence reveals the following:

```
Possible site: 28
>>> Seems to have no N-terminal signal sequence
    INTEGRAL    Likelihood = -0.75    Transmembrane    262-278 (262-279)

----- Final Results -----
            bacterial membrane --- Certainty = 0.1298(Affirmative) < succ>
```

```
            bacterial outside --- Certainty = 0.0000(Not Clear) < succ>
            bacterial cytoplasm --- Certainty = 0.0000(Not Clear) < succ>
```

The protein has homology with the following sequences in the GENPEPT database.

```
>GP:BAA88310 GB:AB028865 O-acetylserine lyase [Streptococcus suis]
Identities = 239/304 (78%), Positives = 273/304 (89%)

Query:    4 IYNSITDLIGNTPIIQLHHIVPEGAAEVYVKLESFNPGSSVKDRIALAMIEDAEQKGILK   63
            IY +IT L+G TP+I+L++IVPEGAAEVYVKLE+FNPGSSVKDRIALAMIEDAE+ G +K
Sbjct:    3 IYQNITQLVGKTPVIKLNNIVPEGAAEVYVKLEAFNPGSSVRDRIALAMIEDAEKAGTIK   62

Query:   64 AGDTIVEPTSGNTGIGLAWVGKAKGYNVIIVMPETMSIERRKIIQAYGAQLVLTPGSEGM  123
              GDTIVEPTSGNTGIGLAWVG AKGYNVIIVMPETMS+ERRKIIQAYGA+LVLTPGSEGM
Sbjct:   63 PGDTIVEPTSGNTGIGLAWVGAAKGYNVIIVMPETMSVERRKIIQAYGAELVLTPGSEGM  122

Query:  124 KGAIAKAKEISAEQNAWLPLQFNNQANPEIHEKTTGREIIETFGEKGLDAFIAGVGTGGT  183
            KGAIAKAKEI+ E+N W+P QF N +NP++HE TTG+EI+E FG  GLDAF++GVGTGGT
Sbjct:  123 KGAIAKAKEIAEEKNGWVPFQFANPSNPKVHEDTTGQEILEDFGTTGLDAFVSGVGTGGT  182

Query:  184 ITGVSRALKKVNPDVAIYAVEADESAILSGEQPGPHKIQGISAGFIPETLATDSYDHIIR  243
            ++GVS  LK  NPD+AIYAVEADESA+LSGE PGPHKIQGISAGFIP+TL T +YD IIR
Sbjct:  183 VSGVSHVLKTANPDIAIYAVEADESAVLSGEAPGPHKIQGISAGFIPDTLDTSAYDGIIR  242

Query:  244 VTSDDAIETGRIIGGLEGFLAGISASAAIYAAIEVAKQLGKGKKVLALLPDNGERYLSTS  303
            V SDDA+ TGR IGG EGFL GIS+ AAI+AAIEVAK+LG GKKVLA+LPDNGERYLST+
Sbjct:  243 VKSDDALATGRAIGGKEGFLVGISSGAAIHAAIEVAKELGTGKKVLAILPDNGERYLSTA  302

Query:  304 LYDF                                                          307
            LY+F
Sbjct:  303 LYEF                                                          306
```

A related DNA sequence was identified in *S. pyogenes* <SEQ ID 3081> which encodes the amino acid sequence <SEQ ID 3082>. Analysis of this protein sequence reveals the following:

```
Possible site: 58
>>> Seems to have no N-terminal signal sequence
    INTEGRAL      Likelihood = -0.48    Transmembrane      262-278 (262-278)

----- Final Results -----
            bacterial membrane --- Certainty = 0.1192(Affirmative) < succ>
            bacterial outside --- Certainty = 0.0000(Not Clear) < succ>
            bacterial cytoplasm --- Certainty = 0.0000(Not Clear) < succ>
```

The protein has homology with the following sequences in the databases:

```
>GP:BAA88310 GB:AB028865 O-acetylserine lyase [Streptococcus suis]
Identities = 235/303 (77%), Positives = 261/303 (85%)

Query:    4 IYKTITELVGQTPIIKLNRLIPNEAADVYVKLEAFNPGSSVKDRIALSMIEAAEAEGLIS   63
            IY+ IT+LVG+TP+IKLN ++P  AA+VYVKLEAFNPGSSVKDRIAL+MIE AE  G I
Sbjct:    3 IYQNITQLVGKTPVIKLNNIVPEGAAEVYVKLEAFNPGSSVKDRIALAMIEDAEKAGTIK   62

Query:   64 PGDVIIEPTSGNTGIGLAWVGAAKGYRVIIVMPETMSLERRQIIQAYGAELVLTPGAEGM  123
            PGD I+EPTSGNTGIGLAWVGAAKGY VIIVMPETMS+ERR+IIQAYGAELVLTPG+EGM
Sbjct:   63 PGDTIVEPTSGNTGIGLAWVGAAKGYNVIIVMPETMSVERRKIIQAYGAELVLTPGSEGM  122

Query:  124 KGAIAKAETLAIELGAWMPMQFNNPANPSIHEKTTAQEILEAFKEISLDAFVSGVGTGGT  183
            KGAIA+A+ +A E   W+P QF NP+NP +HE TT QEILE F   LDAFVSGVGTGGT
Sbjct:  123 KGAIAKAKEIAEEKNGWVPFQFANPSNPKVHEDTTGQEILEDFGTTGLDAFVSGVGTGGT  182

Query:  184 LSGVSHVLKKANPETVIYAVEAEESAVLSGQEPGPHKIQGISAGFIPNTLDTKAYDQIIR  243
            +SGVSHVLK ANP+  IYAVEA+ESAVLSG+ PGPHKIQGISAGFIP+TLDT AYD IIR
Sbjct:  183 VSGVSHVLKTANPDIAIYAVEADESAVLSGEAPGPHKIQGISAGFIPDTLDTSAYDGIIR  242

Query:  244 VKSKDALETARLTGAKEGFLVGISSGAALYAAIEVAKQLGKGKHVLTILPDNGERYLSTE  303
            VKS DAL T R  G KEGFLVGISSGAA++AAIEVAK+LG GK VL ILPDNGERYLST
Sbjct:  243 VKSDDALATGRAIGGKEGFLVGISSGAAIHAAIEVAKELGTGKKVLAILPDNGERYLSTA  302
```

```
Query:  304 LYD                                                         306
            LY+
Sbjct:  303 LYE                                                         305
```

An alignment of the GAS and GBS proteins is shown below.

```
Identities = 222/306 (72%), Positives = 263/306 (85%)

Query:    1 MSKIYNSITDLIGNTPIIQLHHIVPEGAAEVYVKLESFNPGSSVKDRIALAMIEDAEQKG   60
            M+KIY +IT+L+G TPII+L+ ++P  AA+VYVKLE+FNPGSSVKDRIAL+MIE AE +G
Sbjct:    1 MTKIYKTITELVGQTPIIKLNRLIPNEAADVYVKLEAFNPGSSVKDRIALSMIEAAEAEG   60

Query:   61 ILKAGDTIVEPTSGNTGIGLAWVGKAKGYNVIIVMPETMSIERRKIIQAYGAQLVLTPGS  120
            ++  GD I+EPTSGNTGIGLAWVG AKGY VIIVMPETMS+ERR+IIQAYGA+LVLTPG+
Sbjct:   61 LISPGDVIIEPTSGNTGIGLAWVGAAKGYRVIIVMPETMSLERRQIIQAYGAELVLTPGA  120

Query:  121 EGMKGAIAKAKEISAEQNAWLPLQFNNQANPEIHEKTTGREIIETFGEKGLDAFIAGVGT  180
            EGMKGAIAKA+ ++E  AW+P+QFNN ANP IHEKTT +EI+E F E  LDAF++GVGT
Sbjct:  121 EGMKGAIAKAETLAIELGAWMPMQFNNPANPSIHEKTTAQEILEAFKEISLDAFVSGVGT  180

Query:  181 GGTITGVSRALKKVNPDVAIYAVEADESAILSGEQPGPHKIQGISAGFIPETLATDSYDH  240
            GGT++GVS  LKK NP+  IYAVEA+ESA+LSG++PGPHKIQGISAGFIP TL T +YD
Sbjct:  181 GGTLSGVSHVLKKANPETVIYAVEAEESAVLSGQEPGPHKIQGISAGFIPNTLDTKAYDQ  240

Query:  241 IIRVTSDDAIETGRIIGGLEGFLAGISASAAIYAAIEVAKQLGKGKKVLALLPDNGERYL  300
            IIRV S DA+ET R+ G  EGFL GIS+ AA+YAAIEVAKQLGKGK VL +LPDNGERYL
Sbjct:  241 IIRVKSKDALETARLTGAKEGFLVGISSGAALYAAIEVAKQLGKGKHVLTILPDNGERYL  300

Query:  301 STSLYD                                                      306
            ST LYD
Sbjct:  301 STELYD                                                      306
```

Based on this analysis, it was predicted that these proteins and their epitopes could be useful antigens for vaccines or diagnostics.

EXAMPLE 1004

A DNA sequence (GBSx1064) was identified in *S. agalactiae* <SEQ ID 3083> which encodes the amino acid sequence <SEQ ID 3084>. Analysis of this protein sequence reveals the following:

```
Possible site: 56
>>> Seems to have no N-terminal signal sequence

----- Final Results -----
        bacterial cytoplasm --- Certainty = 0.3666(Affirmative) < succ>
         bacterial membrane --- Certainty = 0.0000(Not Clear)   < succ>
          bacterial outside --- Certainty = 0.0000(Not Clear)   < succ>
```

The protein has homology with the following sequences in the GENPEPT database.

```
>GP: BAB07349 GB: AP001519 unknown conserved protein [Bacillus halodurans]
Identities = 96/204 (47%), Positives = 127/204 (62%)

Query:    2 NYKTIKSDGIVEEEIKKSRFICHLKRVESEEEGRNYITQIKKAHYKANHSCSAMVIGEKG   61
            +Y T+K  GI E  I+KSRFI HL R  SEEE   +I QIKK H+ A H+CSA +IGE
Sbjct:    4 SYYTVKESGIHEISIQKSRFIAHLSRATSEEEAIQFIEQIKKEHWNATHNCSAYLIGEND   63

Query:   62 DIKRSSDDGEPSGTAGIPMLTVLEKQGLTNVVAVVTRYFGGIKLGAGGLIRAYSGSVANT  121
            +++++DDGEPSGTAG+PML VL+K+ L + VAVVTRYFGG+KLGAGGLIRAY  +V++
Sbjct:   64 QVQKANDDGEPSGTAGVPMLEVLKKRRLKDTVAVVTRYFGGVKLGAGGLIRAYGSAVSDG  123

Query:  122 IKEIGVVEVKEQIGIRIQLTYPQYQTFDNFLKEHHLQEFETEFLEAVTCKIYVDPKEFEH  181
            +  IGVVE K   I  + Y      +N L++ H   E  +LE V  + YV   E E
Sbjct:  124 LNAIGVVERKRMQVIHTSIDYHWLGKVENELRQSHYLLKEISYLENVDVQTYVLEAEVES  183
```

```
-continued
Query:  182 TITNLTEFYQGKALLTEEGSQIVE                                    205
            +T    G+A  T    + +E
Sbjct:  184 YCEWMTNLTNGQAAFTHGAIEYLE                                    207
```

A related DNA sequence was identified in *S. pyogenes* <SEQ ID 3085> which encodes the amino acid sequence <SEQ ID 3086>. Analysis of this protein sequence reveals the following:

```
Possible site: 36
>>> Seems to have no N-terminal signal sequence
     INTEGRAL    Likelihood = -0.43    Transmembrane    86-102 (86-102)

----- Final Results -----
            bacterial membrane --- Certainty = 0.1171(Affirmative) < succ>
             bacterial outside --- Certainty = 0.0000(Not Clear)   < succ>
           bacterial cytoplasm --- Certainty = 0.0000(Not Clear)   < succ>
```

A related sequence was also identified in GAS <SEQ ID 9153> which encodes the amino acid sequence <SEQ ID 9154>. Analysis of this protein sequence reveals the following:

```
Possible site: 31
>>> Seems to have no N-terminal signal sequence
     INTEGRAL    Likelihood = -0.43    Transmembrane    81-97 (81-97)

----- Final Results -----
            bacterial membrane --- Certainty = 0.1171(Affirmative) < succ>
             bacterial outside --- Certainty = 0.0000(Not Clear)   < succ>
           bacterial cytoplasm --- Certainty = 0.0000(Not Clear)   < succ>
```

An alignment of the GAS and GBS proteins is shown below.

```
Identities = 122/206 (59%), Positives = 153/206 (74%)

Query:    2 NYKTIKSDGIVEEEIKKSRFICHLKRVESEEEGRNYITQIKKAHYKANHSCSAMVIGEKG   61
            ++KTIK+ G  EE IKKSRFICH+KRV +EE+G+N++  IKK HYKANHSC AM+IG
Sbjct:    8 HFKTIKASGFFEESIKKSRFICHIKRVSTEEDGKNFVNAIKKEHYKANHSCFAMIIGNNR   67

Query:   62 DIKRSSDDGEPSGTAGIPMLTVLEKQGLTNVVAVVTRYFGGIKLGAGGLIRAYSGSVANT  121
            IKRSSDDGEPSGTAGIP+L+VLEKQ LTNVV VVTRYFGGIKLG GGLIRAYS    A
Sbjct:   68 QIKRSSDDGEPSGTAGIPILSVLEKQCLTNVVVVVTRYFGGIKLGTGGLIRAYSNMTATA  127

Query:  122 IKEIGVVEVKEQIGIRIQLTYPQYQTFDNFLKEHHLQEFETEFLEAVTCKIYVDPKEFEH  181
            IK  G++EVK+QIG+ I L+YPQYQ + N L +  L E ET+F + +   +Y D +  E+
Sbjct:  128 IKRFGIIEVKQQIGLEITLSYPQYQLYSNLLDQLALTETETKFSDTIKTTLYCDTERVEN  187

Query:  182 TITNLTEFYQGKALLTEEGSQIVEIP                                   207
            I   LT +Y G+     + GS+++E P
Sbjct:  188 LIDTLTNYYHGQISCEKIGSKVIEFP                                   213
```

Based on this analysis, it was predicted that these proteins and their epitopes could be useful antigens for vaccines or diagnostics.

EXAMPLE 1005

A DNA sequence (GBSx1065) was identified in *S. agalactiae* <SEQ ID 3087> which encodes the amino acid sequence <SEQ ID 3088>. Analysis of this protein sequence reveals the following:

```
Possible site: 45
>>> Seems to have no N-terminal signal sequence

----- Final Results -----
           bacterial cytoplasm --- Certainty = 0.1421(Affirmative) < succ>
```

-continued
```
                   bacterial membrane --- Certainty = 0.0000(Not Clear) < succ>
                   bacterial outside  --- Certainty = 0.0000(Not Clear) < succ>
```

The protein has homology with the following sequences in the GENPEPT database.

```
>GP: AAC44940 GB: U56901 involved in transformation [Bacillus subtilis]
Identities = 160/405 (39%), Positives = 228/405 (55%), Gaps = 20/405 (4%)

Query:  35 YICTRCSSSVAKNCQL----PTGNYYCRECIVFGRVTSNENLYYFPQKTFSKTNSLK--W   88
            Y C RC  + +            YCR C++ GRV+   LY + ++   S    S+K   W
Sbjct:  58 YRCNRCGQTDQRYFSFYHSSGKNKLYCRSCVMMGRVSEEVPLYSWKEENESNWKSIKLTW  117

Query:  89 KGELTPYQNEVSEELLKGISSKENLLVHAVTGAGKTEMIYHSVAKVIDTGGSVCIASPRI  148
              G+L+  Q + +  L++ IS KE LL+ AV GAGKTEM++  +   ++ G  VCIA+PR
Sbjct: 118 DGKLSSGQQKAANVLIEAISKKEELLIWAVCGAGKTEMLFPGIESALNQGLRVCIATPRT  177

Query: 149 DVCLELYKRLSNDFRCA-ITLMHGESPSYQR-SPLTIATTHQLLKFYHAFDLLIVDEVDA  206
              DV LEL   RL    F+ A I+   ++G S      R SPL I+TTHQLL++    A D++I+DEVDA
Sbjct: 178 DVVLELAPRLKAAFQGADISALYGGSDDKGRLSPLMISTTHQLLRYKDAIDVMIIDEVDA  237

Query: 207 FPYVDNPILYQGVKQALKENGTSIFLTATSTTELERKVARKELKKLHLARRFHANPLVIP  266
              FPY + L   V++A K+N T ++L+AT    EL+RK   +L + +  R H  PL   P
Sbjct: 238 FPYSADQTLQFAVQKARKKNSTLVYLSATPPKELRKALHGQLHSVRIPARHHRKPLPEP  297

Query: 267 EMVWVSGIQKSLQTQKLPPKLYQLINKQRQTRYPLLLFFPHISEGQVFTEILRQAFPMEK  326
              VW    +K L   K+PP + + I      P+ LF P +S      IL +A     K
Sbjct: 298 RFVWCGNWKKKLNRNKIPPAVKRWIEFHVKEGRPVFLFVPSVS-------ILEKAAACFK  350

Query: 327 -----IGFVSSKSTSRLKLVQDFRDNKLSILVSTTILERGVTFPSVDVFVIQANHHLFTK  381
                   V ++    R + VQ FRD +L  L++TTILERGVT P V    V+ A    +FT+
Sbjct: 351 GVHCRTASVHAEDKHRKEKVQQFRDGQLDLLITTTILERGVTVPKVQTGVLGAESSIFTE  410

Query: 382 SSLVQISGRVGRALERPEGLLYFLHDGKSKSMHQAIKEIKNMNHI                426
              S+LVQI+GR GR  E   +G + +  H  GK+KSM   A K  IK  MN +
Sbjct: 411 SALVQIAGRTGRHKEYADGDVIYFHFGKTKSMLDARKHIKEMNEL                455
```

A related DNA sequence was identified in *S. pyogenes* <SEQ ID 3089> which encodes the amino acid sequence <SEQ ID 3090>. Analysis of this protein sequence reveals the following:

```
Possible site: 21
>>> Seems to have no N-terminal signal sequence.
    INTEGRAL    Likelihood = -4.09    Transmembrane    304-320 (303-322)

----- Final Results -----
                   bacterial membrane  --- Certainty = 0.2635(Affirmative) < succ>
                   bacterial outside   --- Certainty = 0.0000(Not Clear)   < succ>
                   bacterial cytoplasm --- Certainty = 0.0000(Not Clear)   < succ>
```

The protein has homology with the following sequences in the databases:

```
!GB: U56901 involved in transformation [Bacillus subt . . .   258   1e-67
>GP: AAC44940 GB: U56901 involved in transformation [Bacillus subtilis]
Identities = 155/435 (35%), Positives = 249/435 (56%), Gaps = 20/435 (4%)

Query:  10 RLLLESQLPDSAKQLAQPLK--------SVVILRGKMICQRCHYQLDEEA-----RLPSG   56
            R LL ++L  S + +   +K         S+ I + +   C RC   Q D+
Sbjct:  22 RHLLRTELSFSDEMIEWHIKNGYITAENSISINKRRYRCNRCG-QTDQRYFSFYHSSGKN   80

Query:  57 AYYCRFCLVFGRNQSDKLLYAIPPMHFP--KGNYLVWGGQLTAYQEMISQQLLINMQNQK  114
              YCR C++ GR   + LY+  +       K    L W G+L++ Q+    L+  +  ++
Sbjct:  81 KLYCRSCVMMGRVSEEVPLYSWKEENESNWKSIKLTWDGKLSSGQQKAANVLIEAISKKE  140

Query: 115 TTLVHAVTGAGKTEMIYAAIEAVINTGGWVCIASPRVDVCVEVATRLSQAFS-CSICLMH  173
               L+ AV GAGKTEM++   IE+ +N G  VCIA+PR DV +E+A RL  AF    I ++
Sbjct: 141 ELLIWAVCGAGKTEMLFPGIESALNQGLRVCIATPRTDVVLELAPRLKAAFQGADISALY  200

Query: 174 AESLPYQR-APIIVATTHQLLKFHKAFDLLIIDEVDAFPFVNNIQLHYAASQALKEGGAK  232
              S      R  +P++++TTHQLL++    A D++IIDEVDAFP+    +   L +A  +A K+
Sbjct: 201 GGSDDKGRLSPLMISTTHQLLRYKDAIDVMIIDEVDAFPYSADQTLQFAVQKARKKNSTL  260
```

```
-continued

Query: 233 ILLTATSTRTLERKVNKGEVVKLTLARRFHNRPLVIPKFIRSFNLFKMIHRQKLPLKILK  292
            + L+AT  + L+RK    G++  + + R H +PL  P+F+    N  K ++R K+P  + +
Sbjct: 261 VYLSATPPKELKRKALNGQLHSVRIPARHHRKPLPEPRFVWCGNWKKKLNRNKIPPAVKR  320

Query: 293 YLKKQRKTGYPLLIFLPTIIMAESVTAILKELLPAEQIACVSSQSQNRKEDITAFRQGKK  352
            +++     K G P+ +F+P++ + E    A  K +     + A V ++ ++RKE +  FR G+
Sbjct: 321 WIEFHVKEGRPVFLFVPSVSILEKAAACFKGV--HCRTASVHAEDKHRKEKVQQFRDGQL  378

Query: 353 TILITTSILERGVTFPQIDVFVLGSHHRVYSSQSLVQIAGRVGRSIDRPDGTLYFFHEGI  412
            +LITT+ILERGVT P++    VLG+    +++  +LVQIAGR GR  +   DG + +FH G
Sbjct: 379 DLLITTTILERGVTVPKVQTGVLGAESSIFTESALVQIAGRTGRHKEYADGDVIYFHFGK  438

Query: 413 SKAMLLARKEIKEMN                                              427
            +K+ML ARK IKEMN
Sbjct: 439 TKSMLDARKHIKEMN                                              453
```

An alignment of the GAS and GBS proteins is shown below.

```
Identities = 223/427 (52%), Positives = 299/427 (69%)

Query:    1 MENYLGRLWTKAQLSEQLRKIAISLPSFIKKGSDYICTRCSSSVAKNCQLPTGNYYCREC   60
            +EN  GRL  ++QL +  +++A  L S +       IC RC   + +  +LP+G YYCR C
Sbjct:    4 IENSYGRLLLESQLPDSAKQLAQPLKSVVILRGKMICQRCHYQLDEEARLPSGAYYCRFC   63

Query:   61 IVFGRVTSNENLYYFPQKTFSKTNSLKWKGELTPYQNEVSEELLKGISSKENLLVHAVTG  120
            +VFGR  S++ LY  P    F K N L W G+LT YQ  +S++LL  +  +++  LVHAVTG
Sbjct:   64 LVFGRNQSDKLLYAIPPMHFPKGNYLVWGGQLTAYQEMISQQLLINMQNQKTTLVHAVTG  123

Query:  121 AGKTEMIYHSVAKVIDTGGSVCIASPRIDVCLELYKRLSNDFRCAITLMHGESPSYQRSP  180
            AGKTEMIY ++   VI+TGG VCIASPR+DVC+E+   RLS   F C+I LMH ES  YQR+P
Sbjct:  124 AGKTEMIYAAIEAVINTGGWVCIASPRVDVCVEVATRLSQAFSCSICLMHAESLPYQRAP  183

Query:  181 LTIATTHQLLKFYHAFDLLIVDEVDAFPYVDNPILYQGVKQALKENGTSIFLTATSTTEL  240
            + +ATTHQLLKF+ AFDLLI+DEVDAFP+V+N  L+    QALKE G   I LTATST  L
Sbjct:  184 IIVATTHQLLKFHKAFDLLIIDEVDAFPFVNNIQLHYAASQALKEGGAKILLTATSTRTL  243

Query:  241 ERKVARKELKKLHLARRFHANPLVIPEMVWVSGIQKSLQTQKLPPKLYQLINKQRQTRYP  300
            ERKV + E+ KL LARRFH  PLVIP+ +     + K +  QKLP K+ + + KQR+T YP
Sbjct:  244 ERKVNKGEVVKLTLARRFHNRPLVIPKFIRSFNLFKMIHRQKLPLKILKYLKKQRKTGYP  303

Query:  301 LLLFFPHISEGQVFTEILRQAFPMEKIGFVSSKSTSRLKLVQDFRDNKLSILVSTTILER  360
            LL+F P I   +   T IL++   P E+I   VSS+S +R +  +    FR   K  +IL++T+ILER
Sbjct:  304 LLIFLPTIIMAESVTAILKELLPAEQIACVSSQSQNRKEDITAFRQGKKTILITTSILER  363

Query:  361 GVTFPSVDVFVIQANHHLFTKSSLVQISGRVGRALERPEGLLYFLHDGKSKSMHQAIKEI  420
            GVTFP +DVFV+ +++H +++    SLVQI+GRVGR+++RP+G LYF H+G SK+M  A KEI
Sbjct:  364 GVTFPQIDVFVLGSHHRVYSSQSLVQIAGRVGRSIDRPDGTLYFFHEGISKAMLLARKEI  423

Query:  421 KNMNHIG                                                      427
            K MN+ G
Sbjct:  424 KEMNYKG                                                      430
```

Based on this analysis, it was predicted that these proteins and their epitopes could be useful antigens for vaccines or diagnostics.

EXAMPLE 1006

A DNA sequence (GBSx1066) was identified in *S. agalactiae* <SEQ ID 3091> which encodes the amino acid sequence <SEQ ID 3092>. This protein is predicted to be comf operon protein 3 (comFC). Analysis of this protein sequence reveals the following:

```
Possible site: 41
>>> Seems to have no N-terminal signal sequence

----- Final Results -----
            bacterial cytoplasm --- Certainty = 0.0894(Affirmative) < succ>
            bacterial membrane  --- Certainty = 0.0000(Not Clear)   < succ>
             bacterial outside  --- Certainty = 0.0000(Not Clear)   < succ>
```

The protein has homology with the following sequences in the GENPEPT database.

```
>GP: AAC44942 GB: U56901 involved in transformation [Bacillus subtilis]
Identities = 76/230 (33%), Positives = 118/230 (51%), Gaps = 11/230 (4%)

Query:    1 MTCLLCHEIDLSQLTFVEUMLLKPKQNVICQTCKGSFEALSREMGCQTCCK-QIPQKQCQ    59
            M CLLC      +T+   L LLKP +V C +C+   + ++  + C  C + Q      C+
Sbjct:    1 MICLLCDSQFSQDVTWRALFLLKPDEKV-CYSCRSKLKKITGHI-CPLCGRPQSVHAVCR   58

Query:   60 DCIYWGKKGIEV----NHFSLYRYNEAMKKNFSLFKFQGDYLLKDVFTKEIKAALKKY--  113
            DC  W  +  +      + S+Y YN+ MK+   S FKF+GD  + F   +      K
Sbjct:   59 DCEVWRTRIRDSLLLRQNRSVYTYNDMMKETLSRFKFRGDAEIINAFKSDFSSTFSKVYP  118

Query:  114 -KGYTIVPVPLSHEGYQNRQFNQVIAFLQSANIPYKNILSKKDGGKQSANNKEERLKQVQ  172
             K + +VP+PLS  E   +R FNQ      + + P   +L + +   KQS    K ERL
Sbjct:  119 DKHFVLVPIPLSKEREEERGFNQAHLLAECLDRPSHHPLIRLNNEKQSKKKKTERLLSEC  178

Query:  173 QFTLKNEAELGDNLLIVDDIYTTGATIAQIRKLLEEKG-IKNIKSFSLAR           221
              F  KN +   G N++++DD+YTTGAT+    + L EKG    ++ SF+L R
Sbjct:  179 IFDTKNNSAEGMNIILIDDLYTTGATLHFAARCLLEKGKAASVSSFTLIR            228
```

A related DNA sequence was identified in *S. pyogenes* <SEQ ID 3093> which encodes the amino acid sequence <SEQ ID 3094>. Analysis of this protein sequence reveals the following:

```
Possible site: 52
>>> Seems to have no N-terminal signal sequence

----- Final Results -----
            bacterial cytoplasm --- Certainty = 0.0763(Affirmative) < succ>
            bacterial membrane  --- Certainty = 0.0000(Not Clear)   < succ>
              bacterial outside --- Certainty 0.0000(Not Clear)     < succ>
```

An alignment of the GAS and GBS proteins is shown below.

```
Identities = 100/222 (45%), Positives = 139/222 (62%), Gaps = 2/222 (0%)

Query:    1 MTCLLCHEIDLSQLTFVELMLLKPKQNVICQTCKGSFEALSREMGCQTCCKQIPQKQCQD   60
            M CLLC +I  + ++   E++ L+   + ICQ C+ SF+ + + + C TCC       C+D
Sbjct:    1 MICLLCQQISQTPISITEIIFLRRISSPICQQCQKSFQKIGKSV-CATCCANSDIIACRD   59

Query:   61 CIYWGKKGIEVNHFSLYRYNEAMKKNFSLFKFQGDYLLKDVFTKEIKAALKKY-KGYTIV  119
            C+  W  KG  VNH SLY YN AMK   FS +KFQGDYLL+ VF  E+    + KY KGY  V
Sbjct:   60 CLKWENKGYNVNHRSLYCYNAAMKAYFSQYKFQGDYLLRKVFAVELADVITKYYKGYIPV  119

Query:  120 PVPLSHEGYQNRQFNQVIAFLQSANIPYKNILSKKDGGKQSANNKEERLKQVQQFTLKNE  179
            PVP+S    ++ RQFNQV A L++AN+  Y ++   K D     QS+   K+ERL    + +L
Sbjct:  120 PVPVSPGCFREROFNQVSAILEAANVSYLSLFEKLDNTHQSSRTKKERLLVEKSYRLLKV  179

Query:  180 AELGDNLLIVDDIYTTGATIAQIRKLLEEKGIKNIKSFSLAR                    221
             +  + D +LIVDDIYTTG+TI   +RK L +     +IKS  S+AR
Sbjct:  180 SNIPDKILIVDDIYTTGSTIIALRKQLAKVANSDIKSLSIAR                    221
```

Based on this analysis, it was predicted that these proteins and their epitopes could be useful antigens for vaccines or diagnostics.

EXAMPLE 1007

A DNA sequence (GBSx1067) was identified in *S. agalactiae* <SEQ ID 3095> which encodes the amino acid sequence <SEQ ID 3096>. Analysis of this protein sequence reveals the following:

```
Possible site: 16
>>> Seems to have no N-terminal signal sequence

----- Final Results -----
            bacterial cytoplasm --- Certainty = 0.3889(Affirmative) < succ>
```

```
            bacterial membrane --- Certainty = 0.0000(Not Clear) < succ>
             bacterial outside --- Certainty = 0.0000(Not Clear) < succ>
```

The protein has homology with the following sequences in the GENPEPT database.

```
>GP: CAB91549 GB: AJ249134 hypothetical protein [Lactococcus lactis]
Identities = 107/185 (57%), Positives = 140/185 (74%), Gaps = 3/185 (1%)

Query:    1 MIKYSIRGENIEVTEAIREYVETKLSKVEKYFNEAQELDTRVNLKVYREKTAKVEVTILI   60
            MIK++IRGEN+EVT+AIR YVE K+ K++KYFN+  E+    VNLKVY EK AKVEVT+
Sbjct:    1 MIKFNIRGENVEVTDAIRAYVEDKIGKLDKYFNDGHEVTAYVNLKVYTEKRAKVEVTLPA  60

Query:   61 DSITLRAEDVSQDMYGSIDLVVDKIERQIRKNKTKIAKKYREKIPASQVFTTEFEAEPDE  120
              ++TLRAED SQDMY SID V +K+ERQIRK KT++ +K R   +P  QVF  EF
Sbjct:   61 KNVTLRAEDTSQDMYSSIDFVEEKLERQIRKYKTRMNRKPRNAVPTGQVFGDEFAPLDTT  120

Query:  121 EAVSQ---RIVRTKNVNLKPMDVEEALLQMELLGHDFFIYTDAEDNTTNVLYKREDGELG  177
             + V++      IVRTK+V LKPMD EEA+LQM++LGHDF+++TDA+ N T+V+Y+R DG  G
Sbjct:  121 DEVAEDHVDIVRTKHVALKPMDAEEAVLQMDMLGHDFYVFTDADSNGTHVVYRRTDGRYG  180

Query:  178 LIEAK                                                        182
            LIE +
Sbjct:  181 LIETE                                                        185
```

A related DNA sequence was identified in *S. pyogenes* <SEQ ID 3097> which encodes the amino acid sequence <SEQ ID 3098>. Analysis of this protein sequence reveals the following:

```
Possible site: 16
>>> Seems to have no N-terminal signal sequence

----- Final Results -----
            bacterial cytoplasm --- Certainty = 0.3751(Affirmative) < succ>
            bacterial membrane --- Certainty = 0.0000(Not Clear) < succ>
             bacterial outside --- Certainty = 0.0000(Not Clear) < succ>
```

An alignment of the GAS and GBS proteins is shown below.

```
Identities = 145/182 (79%), Positives = 165/182 (89%)

Query:    1 MIKYSIRGENIEVTEAIREYVETKLSKVEKYFNEAQELDTRVNLKVYREKTAKVEVTILI   60
            MIK+SIRGENIEVTEAIR+YVE+KL+K+EKYF + QE+D RVNLKVYRE+++KVEVTI +
Sbjct:    1 MIKFSIRGENIEVTEAIRDYVESKLTKIEKYFAKDQEIDARVNLKVYRERSSKVEVTIPL  60

Query:   61 DSITLRAEDVSQDMYGSIDLVVDKIERQIRKNKTKIAKKYREKIPASQVFTTEFEAEPDE   20
            DS+TLRAEDVSQDMYGSIDLVVDKIERQIRKNKTKIAKK+REK+P  QVFTTEFEAE  +
Sbjct:   61 DSVTLRAEDVSQDMYGSIDLVVDKIERQIRKNKTKIAKKHREKVPTGQVFTTEFEAEEVD  120

Query:  121 EAVSQRIVRTKNVNLKPMDVEEALLQMELLGHDFFIYTDAEDNTTNVLYKREDGELGLIE  180
            E     ++VRTKNV LKPMDVEEA LQMELLGHDFFIYTD+ED   TN+LY+REDG LGLIE
Sbjct:  121 EIPEVQVVRTKNVTLKPMDVEEARLQMELLGHDFFIYTDSEDGATNILYRREDGNLGLIE  180

Query:  181 AK                                                           182
            AK
Sbjct:  181 AK                                                           182
```

Based on this analysis, it was predicted that these proteins and their epitopes could be useful antigens for vaccines or diagnostics.

EXAMPLE 1008

A DNA sequence (GBSx1068) was identified in *S. agalactiae* <SEQ ID 3099> which encodes the amino acid sequence <SEQ ID 3100>. Analysis of this protein sequence reveals the following:

```
Possible site: 16
>>> Seems to have no N-terminal signal sequence

----- Final Results -----
           bacterial cytoplasm --- Certainty = 0.0685(Affirmative) < succ>
            bacterial membrane --- Certainty = 0.0000(Not Clear)   < succ>
             bacterial outside --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1009

A DNA sequence (GBSx1077) was identified in *S. agalactiae* <SEQ ID 3101> which encodes the amino acid sequence <SEQ ID 3102> (sgaT). Analysis of this protein sequence reveals the following:

```
Possible site: 41
>>> Seems to have a cleavable N-term signal seq.
     INTEGRAL     Likelihood = -5.95      Transmembrane    99-115 (87-115)
     INTEGRAL     Likelihood = -3.50      Transmembrane     43-59 (42-60)

----- Final Results -----
               bacterial membrane --- Certainty = 0.3378(Affirmative) < succ>
                bacterial outside --- Certainty = 0.0000(Not Clear) < succ>
              bacterial cytoplasm --- Certainty = 0.0000(Not Clear) < succ>
```

The protein has homology with the following sequences in the GENPEPT database.

```
>GP:BAB03942 GB:AP001507 unknown conserved protein [Bacillus halodurans]
 Identities = 47/111 (42%), Positives = 76/111 (68%), Gaps = 5/111 (4%)

Query:   1 MAIIYLIVAVFAG--EAYIAKEI---SNGVNGLVYALQLAGQFAAGVFVILAGVRLILGE   55
           M I++L+A+     +    A+E+    S    +   +YA+   +FA G+ V+L GV++ +GE
Sbjct: 233 MGILFLVGAIILALKDTQGAQELIAQSGEQSFFIYAIIQSFMFAGGIAVVLLGVKMFIGE  292

Query:  56 IVPAFKGISEKLVPNSKPALDCPIVYPYAPNAVLIGFISKFVGGLVSMIVM          106
           +VPAF GI+ KLVP ++PALD P+V+P APNAV++GF+  FVG L+ ++V+
Sbjct: 293 VVPAFNGIATKLVPGARPALDAPVVFPMAPNAVILGFLGAFVGALIWLVVI          343
```

There is also homology to SEQ ID 516.

Based on this analysis, it was predicted that this protein and its epitopes, could be useful antigens for vaccines or diagnostics.

EXAMPLE 1010

A DNA sequence (GBSx1078) was identified in *S. agalactiae* <SEQ ID 3103> which encodes the amino acid sequence <SEQ ID 3104>. This protein is predicted to be tryptophanyl-tRNA synthetase (trpS). Analysis of this protein sequence reveals the following:

```
Possible site: 50
>>> Seems to have no N-terminal signal sequence

----- Final Results -----
             bacterial cytoplasm --- Certainty = 0.2156 (Affirmative) < succ>
              bacterial membrane --- Certainty = 0.0000 (Not Clear) < succ>
               bacterial outside --- Certainty = 0.0000 (Not Clear) < succ>
```

The protein has homology with the following sequences in the GENPEPT database.

```
>GP:AAC05711 GB:L49336 tryptophanyl-tRNA synthetase [Clostridium longisporum]
 Identities = 225/340 (66%), Positives = 271/340 (79%), Gaps = 3/340 (0%)

Query:  1 MTKPIILTGDRPTGKLHIGHYVGSLKNRVLLQNEGSYTLFVFLADQQALTDHAKDPQTIV  60
```

```
                 M K IILTGDRPTGKLHIGHYVGSLKNRV LQN G Y F+ +ADQQALTD+A++P+ I
Sbjct:      1MAKEIILTGDRPTGKLHIGHYVGSLKNRVQLQNSGDYRSFIMIADQQALTDNARNPEKIR    60

Query:     61ESIGNVALDYLAVGLDPNKSTLFIQSQIPELAELSMYYMNLVSLARLERNPTVKTEIAQK   120
              S+  VALDYLAVG+DP KST+ +QSQIPEL EL+M+Y+NLV+L+RLERNPTVK EI QK
Sbjct:     61NSLIEVALDYLAVGIDPLKSTILVQSQIPELNELTMHYLNLVTLSRLERNPTVKAEIKQK   120

Query:    121GFGESIPAGFLVYPVAQAADITAFKANLVPVGTDQKPMIEQTREIVRSFNHAYNCQVLVE   180
              F  SIPAGFL+YPV+QAADITAFKA  VPVG DQ PMIEQ REIVRSFN  Y  +VLVE
Sbjct:    121NFENSIPAGFLIYPVSQAADITAFKATTVPVGEDQLPMIEQAREIVRSFNTIYGKEVLVE   180

Query:    181PEGIYPENDAAGRLPGLDGNAKMSKSLNNGIFLADDMDTVKKKVMSMYTDPNHIKVEEPG   240
              P+ + P+    GRLPG DG AKMSKS+ N I+LAD+ D +K+VMSMYTDPNHIKV +PG
Sbjct:    181PKAVIPKG-TIGRLPGTDGKAKMSKSIGNAIYLADEADVIKQKVNSMYTDPNHIKVTDPG   239

Query:    241QIEGNMVFHYLDVFGRDEDQKEITAMKEHYQKGGLGDVKTKRYLLDILERELSPIRERRL   300
              Q+EGN VF YLD F +D +  E    MK HY +GGLGDVK K++L +IL+  EL PIR RR
Sbjct:    240QVEGNTVFTYLDTFCKDTETLE--EMKAHYSRGGLGDVKVKKFLNEILQAELEPIRNRRK   297

Query:    301EYAKDMGQVYQMLQKGSEKAQAVAASTLDEVKSAMGLNYF                      340
              E+  KD+  +VY++L++GSEKA+ VAA TL EV+   +G+ YF
Sbjct:    298EFQKDIPEVYRILKEGSEKAREVAAGTLKEVRETIGIEYF                      337
```

A related DNA sequence was identified in *S. pyogenes* <SEQ ID 3105> which encodes the amino acid sequence <SEQ ID 3106>. Analysis of this protein sequence reveals the following:

```
Possible site: 54
>>> Seems to have no N-terminal signal sequence

----- Final Results -----
              bacterial cytoplasm --- Certainty = 0.2737(Affirmative) < succ>
              bacterial membrane  --- Certainty = 0.0000(Not Clear)  < succ>
              bacterial outside   --- Certainty = 0.0000(Not Clear)  < succ>
```

An alignment of the GAS and GBS proteins is shown below.

```
Identities = 290/340 (85%), Positives = 316/340 (92%)

Query:      1 MTKPIILTGDRPTGKLHIGHYVGSLKNRVLLQNEGSYTLFVFLADQQALTDHAKDPQTIV    60
              MTKPIILTGDRPTGKLH+GHYVGSLKNRV LQNE Y +FVFLADQQALTDHAK+ + I
Sbjct:      2 MTKPIILTGDRPTGKLHLGHYVGSLKNRVFLQNENKYKMFVFLADQQALTDHAKESELIQ    61

Query:     61 ESIGNVALDYLAVGLDPNKSTLFIQSQIPELAELSMYYMNLVSLARLERNPTVKTEIAQK   120
              ESIGNVALDYL+VGLDP +ST+FIQSQIPELAELSMYYMNLVSLARLERNPTVKTEIAQK
Sbjct:     62 ESIGNVALDYLSVGLDPKQSTIFIQSQIPELAELSMYYMNLVSLARLERNPTVKTEIAQK   121

Query:    121 GFGESIPAGFLVYPVAQAADITAFKANLVPVGTDQKPMIEQTREIVRSFNHAYNCQVLVE   180
              GFGESIP+GFLVYPV+QAADITAFKANLVPVG DQKPMIEQTREIVRSFNH Y+   LVE
Sbjct:    122 GFGESIPSGFLVYPVSQAADITAFKANLVPVGNDQKPMIEQTREIVRSFNHTYHTDCLVE   181

Query:    181 PEGIYPENDAAGRLPGLDGNAKMSKSLNNGIFLADDMDTVKKKVMSMYTDPNHIKVEEPG   240
              PEGIYPEN+ AGRLPGLDGNAKMSKSL NGI+L+DD DTV+KKVMSMYTDPNHIK+E+PG
Sbjct:    182 PEGIYPENEKAGRLPGLDGNAKMSKSLGNGIYLSDDADTVRKKVMSMYTDPNHIKIEDPG   241

Query:    241 QIEGNMVFHYLDVFGRDEDQKEITAMKEHYQKGGLGDVKTKRYLLDILERELSPIRERRL   300
              QIEGNMVFHYLD+F R EDQ +I AMKEHYQ GGLGDVKTKRYLLDILEREL+PIRERRL
Sbjct:    242 QIEGNMVFHYLDIFARKEDQADIEAMKEHYQIGGLGDVKTKRYLLDILERELAPIRERRL   301

Query:    301 EYAKDMGQVYQMLQKGSEKAQAVAASTLDEVKSAMGLNYF                      340
              EYAKDMG+V++MLQ+GS+KA+ VAA TL EVKSAMG+NYF
Sbjct:    302 EYAKDMGEVFRMLQEGSQKARTVAAKTLSEVKSAMGINYF                      341
```

Based on this analysis, it was predicted that these proteins and their epitopes could be useful antigens for vaccines or diagnostics.

EXAMPLE 1011

A DNA sequence (GBSx1079) was identified in *S. agalactiae* <SEQ ID 3107> which encodes the amino acid sequence <SEQ ID 3108>. This protein is predicted to be carbamate kinase. Analysis of this protein sequence reveals the following:

```
Possible site: 24
>>> Seems to have no N-terminal signal sequence

----- Final Results -----
            bacterial cytoplasm --- Certainty = 0.0013(Affirmative) < succ>
             bacterial membrane --- Certainty = 0.0000(Not Clear)   < succ>
              bacterial outside --- Certainty = 0.0000(Not Clear)   < succ>
```

The protein has homology with the following sequences in the GENPEPT database.

```
>GP:CAA04684 GB:AJ001330 carbamate kinase [Lactobacillus sakei]
Identities = 199/311 (63%), Positives = 254/311 (80%), Gaps = 3/311 (0%)

Query:    6 QKIVVALGGNAILSTDASAKAQQEALINTSKSLVKLIKEGHDVIVTHGNGPQVGNLLLQQ   65
            +KIVVALGGNAILSTDASA AQ +A+  T K LV  +K+G  +I++HGNGPQVGNLL+QQ
Sbjct:    4 RKIVVALGGNAILSTDASANAQIKAVKETVKQLVAFVKQGDQLIISHGNGPQVGNLLIQQ   63

Query:   66 AASDSEKNPAMPLDTCVAMTEGSIGFWLQNALNNELQEQGIDKEVATVVTQVIVDEKDQA  125
            AASDSEK PAMPLDT  AM++G IG+W+QNA N  L E+G+  +VAT+VTQ IVD KD+A
Sbjct:   64 AASDSEKTPAMPLDTVGAMSQGEIGYWMQNAFNEVLAEEGLALDVATIVTQTIVDAKDEA  123

Query:  126 FTNPTKPIGPFLSEEDAKKQAQ-ETGSKFKEDAGRGWRKVVPSPKPVGIKEASVIRRLVD  184
            F NPTKPIGPF SE +AKKQ      + F EDAGRGWR+VVPSP+P+GI+EA VI++LV+
Sbjct:  124 FQNPTKPIGPFYSEAEAKKQQSINPEAHFVEDAGRGWRRVVPSPRPIGIQEAPVIQKLVE  183

Query:  185 SGVVVISAGGGGVPVIEDANTKALKGVEAVIDKDFASQTLSELVDADLFIVLTGVDNVFV  244
             V+ ISAGGGGVPV ++ N  L+GVEAVIDKDFAS+ L+ELV AD+ I+LT VDNV+V
Sbjct:  184 GNVITISAGGGGVPVAKEGN--KLRGVEAVIDKDFASEKLAELVGADMLIILTAVDNVYV  241

Query:  245 NFNKPNQEKLEEVTVSQMKQYITENQFAPGSMLPKVEAAIAFVENKPESRAIITSLENID  304
            NFNKP+Q+KL  V+V++++ YI ++QFA GSMLPK++ AI +V N+P+S+AIITSL+N+
Sbjct:  242 NFNKPDQKKLTNVSVAELEDYIKDDQFAKGSMLPKIQTAIEYVNNRPDSKAIITSLDNVK  301

Query:  305 NVLAQNAGTQI                                                  315
            N+LA +AGT I
Sbjct:  302 NLLAHDAGTII                                                  312
```

A related DNA sequence was identified in *S. pyogenes* <SEQ ID 3109> which encodes the amino acid sequence <SEQ ID 3110>. Analysis of this protein sequence reveals the following:

```
Possible site: 22
>>> Seems to have no N-terminal signal sequence

----- Final Results -----
            bacterial cytoplasm --- Certainty = 0.0013(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below.

```
 Identities = 275/312 (88%), Positives = 295/312 (94%)

Query:    6 QKIVVALGGNAILSTDASAKAQQEALINTSKSLVKLIKEGHDVIVTHGNGPQVGNLLLQQ   65
            QKIVVALGGNAILSTDASAKAQQEALI+TSKSLVKLIKEGH+VIVTHGNGPQVGNLLLQQ
Sbjct:    4 QKIVVALGGNAILSTDASAKAQQEALISTSKSLVKLIKEGHEVIVTHGNGPQVGNLLLQQ   63

Query:   66 AASDSEKNPAMPLDTCVAMTEGSIGFWLQNALNNELQEQGIDKEVATVVTQVIVDEKDQA  125
            AA+DSEKNPAMPLDTCVAMTEGSIGFWL NAL+NELQ QGI KEVA VVTQVIVD +D A
Sbjct:   64 AAADSEKNPAMPLDTCVAMTEGSIGFWLVNALDNELQAQGIQKEVAAVVTQVIVDAKDPA  123

Query:  126 FTNPTKPIGPFLSEEDAKKQAQETGSKFKEDAGRGWRKVVPSPKPVGIKEASVIRRLVDS  185
            F NPTKPIGPFL+EEDAKKQ  E+G+ FKEDAGRGWRKVVPSPKPVGIKEA+VIR LVDS
SbjCt:  124 FENPThPIGPFLTEEDAKKQMAESGASFKEDAGRGWRKVVPSPKPVGIKEANVIRSLVDS  183

Query:  186 GVVVISAGGGGVPVIEDANTKALKGVEAVIDKDFASQTLSELVDADLFIVLTGVDNVFVN  245
```

-continued

```
         GVVV+SAGGGGVPV+EDA +K L GVEAVIDKDFASQTLSELVDADLFIVLTGVDNV+VN
SbjCt: 184 GVVVVSAGGGGVPVVEDATSKTLTGVEAVIDKDFASQTLSELVDADLFIVLTGVDNVYVN  243

Query: 246 FNKPNQEKLEEVTVSQMKQYITENQFAPGSMLPKVEAAIAFVENKPESRAIITSLENIDN  305
           FNKP+Q KLEEVTVSQMK+YIT++QFAPGSMLPKVEAAIAFVENKP ++AIITSLENIDN
Sbjct: 244 FNKPDQAKLEEVTVSQMKEYITQDQFAPGSMLPKVEAAIAFVENKPNAKAIITSLENIDN  303

Query: 306 VLAQNAGTQIVA                                                  317
           VL+ NAGTQI+A
Sbjct: 304 VLSANAGTQIIA                                                  315
```

Based on this analysis, it was predicted that these proteins and their epitopes could be useful antigens for vaccines or diagnostics.

EXAMPLE 1012

A DNA sequence (GBSx1080) was identified in *S. agalactiae* <SEQ ID 3111> which encodes the amino acid sequence <SEQ ID 3112>. This protein is predicted to be permease (potE). Analysis of this protein sequence reveals the following:

```
Possible site: 52
>>> Seems to have an uncleavable N-term signal seq
     INTEGRAL    Likelihood = -12.63     Transmembrane    450-466 (441-478)
     INTEGRAL    Likelihood = -8.97      Transmembrane    236-252 (231-259)
     INTEGRAL    Likelihood = -8.70      Transmembrane    283-299 (277-308)
     INTEGRAL    Likelihood = -8.44      Transmembrane    165-181 (153-186)
     INTEGRAL    Likelihood = -7.96      Transmembrane    129-145 (126-151)
     INTEGRAL    Likelihood = -6.16      Transmembrane    396-412 (394-415)
     INTEGRAL    Likelihood = -5.15      Transmembrane      45-61 (38-63)
     INTEGRAL    Likelihood = -4.94      Transmembrane    335-351 (334-352)
     INTEGRAL    Likelihood = -3.72      Transmembrane      13-29 (10-30)
     INTEGRAL    Likelihood = -2.92      Transmembrane    417-433 (417-435)
     INTEGRAL    Likelihood = -1.54      Transmembrane    360-376 (360-376)
     INTEGRAL    Likelihood = -0.53      Transmembrane    207-223 (207-223)

----- Final Results -----
               bacterial membrane --- Certainty = 0.6052(Affirmative) < succ>
                bacterial outside --- Certainty = 0.0000(Not Clear) < succ>
              bacterial cytoplasm --- Certainty = 0.0000(Not Clear) < succ>
```

A related GBS nucleic acid sequence <SEQ ID 10295> which encodes amino acid sequence <SEQ ID 10296> was also identified.

The protein has homology with the following sequences in the GENPEPT database.

```
>GP:CAA76779 GB:Y17554 permease [Bacillus licheniformis]
 Identities = 265/470 (56%), Positives = 347/470 (73%), Gaps = 3/470 (0%)

Query:   5 MEKEKKLGLLPLTMLVIGSLIGGGIFDLMQNMSSRAGLVPMLIAWVITAIGMGTFVLSFQ   64
           M +EKKLGL  L  LVIGS+IGGG F+L  +M+S AG   +LI W+IT +GM     SFQ
Sbjct:   1 MAEEKKLGLFALIALVIGSMIGGGAFNLASDMASGAGAGAILIGWIITGVGMIALAFSFQ   60

Query:  65 NLSEKRPDLTAGIFSYAKEGFGNFMGFNSAWGYWLSAWLGNVAYAALLFSSLGYFFKFFG  124
           NL+ KRPDL  GIF+YA+EGFG+FMGFNS WGYW +A LGNVAY  LLFS++GYF   FG
Sbjct:  61 NLTTKRPDLDGGIFTYAREGFGHFMGFNSGWGYWFAALLGNVAYGTLLFSAIGYFIPAFG  120

Query: 125 NGNNIISIIGASIVIWVVHFLILRGVNTAAFINTIVTFAKLVPVIIFLISALLAFKFNIF  184
           +G NI SIIGAS+++W VHFLILRGV +AA IN I T +KLVP+  F+I+ +  F  ++F
Sbjct: 121 DGQNIASIIGASVILWCVHFLILRGVQSAAMINLITTISKLVPIFAFIIAIIFVFHLDLF  180

Query: 185 SLDIWGNGLH-QSIFNQVNSTMKTAVWVFIGIEGAVVFSGRAKKIISDIGKASILALFTMI 243
           + D WG GL    SI  QV STM   VWVF GIEGAV+FS RAKK SD+GKA+++ L +++
Sbjct: 181 TNDFWGKGLSLGSIGTQVKSTMLVTVWVFTGIEGAVLFSSRAKKSSDVGKATVIGLISVL  240

G
Sbjct: 417 FG                                                            418
```

An alignment of the GAS and GBS proteins is shown below.

```
Identities = 104/368 (28%), Positives = 162/368 (43%), Gaps = 32/368 (8%)

Query:    1 MRYKMEKEKKLGLLPLTMLVIGSLIGGGIFDLMQNMSSRAGLVPMLIAWVI-TAIGMGTF   59
            M  +  ++ K  L    T+  I  ++IG GIF L + +     GL P    IA +  TAI
Sbjct:    6 MNEQEREQAKFSLSGATLYGINAVIGSGIFLLPRAIYK--GLGPASIAVMFGTAILTIML  63

Query:   60 VLSFQNLSEKRPDLTAGIFSYAKEGFGNFMGFNSA---WGYWLSAWLGNVAYAALLFSSL 116
            + F +S         G F Y+K FG+F+GFN      W    + AW     A A +F
Sbjct:   64 AVCFAEVSGYFGK-NGGAFQYSKRAFGDFIGFNVGFLGWTVTIFAWAAMAAGFARMFIIT 122

Query:  117 GYFFKFFGNGNNIISIIGASIVIWVVHFLILRGVNTAAFINTIVTFAKLVPVIIFLISAL 176
                F+    G +I   IG  I++ +++   + G+ T+ +      T AKL+P++  F    L
Sbjct:  123 FPAFE----GWHIPLSIGLIILLSLMN---IAGLKTSKIVTITATIAKLIPIVAFCACTL 175

Query:  177 LAFK-----FNIFSLDIWGNGLHQSIFNQVNSTMKTAVWVFIGIEGAVVFSGRAKKHSDI 231
            K        F F     G  L +I N         TAV++F G G      S A + D
Sbjct:  176 FFIKNGLPNFTPFVQLEPGTNLLGAISN-------TAVYIFYGFIGFETLSIVAGEMRDP 228

Query:  232 GKASILALFTMISLYVLISVLSLG---IMSRPELANLKTPAM-AYVLEKAVGHWGAILVN 287
            K      AL   IS+  ++ +L +G        M    ++        P   A+V++K  +G    GA  +V+
Sbjct:  229 EKNVPRALLGSISIVSVLYMLIGGTIAMLGSQIMMTNAPVQDAFV--KMIGPAGAWMVS  286

Query:  288 LGVIISVFGAILAWTLFAAELPYQAAKEGAFPKFFAKENKNKAPINSLLVTNLCVQAFLI 347
            +G +IS+ G  +  ++           A EG  P    AK+N+N AP+  ++LV+           L+
Sbjct:  287 IGALISITGLNMGESIMVPRYGAAIADEGLLPAAIAKQNQNGAPLVAILVSGAIAIVLLL 346

Query:  348 TFLFTQSA                                                     355
            T  F   A
Sbjct:  347 TGSFESLA                                                     354
```

A further related DNA sequence was identified in *S. pyogenes* <SEQ ID 9079> which encodes the amino acid sequence <SEQ ID 9080>. Analysis of this protein sequence reveals the following:

```
    Possible site: 60
>>> Seems to have no N-terminal signal sequence
   INTEGRAL Likelihood = -9.92 Transmembrane  77-93   (72-100)
   INTEGRAL Likelihood = -9.29 Transmembrane 279-295  (274-303)
   INTEGRAL Likelihood = -9.08 Transmembrane 203-219  (199-225)
   INTEGRAL Likelihood = -8.55 Transmembrane 174-190  (171-197)
   INTEGRAL Likelihood = -8.33 Tramsmembrane 436-452  (432-455)
   INTEGRAL Likelihood = -7.32 Transmembrene 329-345  (324-350)
   INTEGRAL Likelihood = -5.63 Transmembrane 402-418  (396-421)
   INTEGRAL Likelihood = -4.88 Tramsmembrane 460-476  (456-479)
   INTEGRAL Likelihood = -4.51 Transmembrane 379-395  (377-401)
   INTEGRAL Likelihood = -2.81 Transmembrane  48-64   (48-65)
   INTEGRAL Likelihood = -2.23 Transmembrane 243-259  (243-262)
   INTEGRAL Likelihood = -0.37 Transmembrane 123-139  (123-139)

----- Final Results -----
           bacterial membrane --- Certainty = 0.4970 (Affirmative) < succ>
            bacterial outside --- Certainty = 0.0000 (Not Clear)   < succ>
           bacterial cytoplasm --- Certainty = 0.0000 (Not Clear)   < succ>
```

An alignment of the GAS and GBS sequences follows:

```
Score = 62.1 bits (148), Expect = 2e-11
Identities = 59/250 (23%), Positives = 107/250 (42%), Gaps = 12/250 (4%)

Query:  143 WGSYLKGLLAN--YNIVLPNALNGTFNL--KNGTYIDILPV-LVMFFVTGIVLMNSKLAL 197
            WG +L    L N  Y  +L ++L   F          I I+    +V++ V   ++L       A
Sbjct:   95 WGYWLSAWLGNVAYAALLFSSLGYFFKFFGNGNNIISIIGASIVIWVVHFLILRGVNTAA 154

Query:  198 RFNSFLVILKFSALALFIFVGIFFIDHNNWSHFAPYGVGQITGGKTGIFAGASVMFFAFL 257
            N+ +    K   +F+   +     N +S       +G G         + +     + F+
Sbjct:  155 FINTIVTFAKLVPVIIFLISALLAFKFNIFS-LDIWGNGLHQSIFNQVNSTMKTAVWVFI 213

Query:  258 GFESISMAVDEVKEPQKTIPKGIILSLIIVTALYIVvTTILTGIV---HYTKLNVPDAVA 314
            G E  +       K+    I K  IL+L  + +LY++++ +  GI+         L  P A+A
Sbjct:  214 GIEGAVVFSGRAKK-HSDIGKASILALFTMISLYVLISVLSLGIMSRPELANLKTP-AMA 271

Query:  315 FALRNIRLYWAADYVSIVAILTLITVCISMTYALARTIYSISRDGLLPKSLYTLTKKNKV 374
```

```
                 + L     +W A  V++  I+++       ++ T   A    Y   +++G   PK   +      KNK
Sbjct: 272 YVLEKAVGHWGAILVNLGVIISVFGAILAWTLFAAELPYQAAKEGAFPK-FFAKENKNKA  330

Query: 375 PQNATLVTGL                                                    384
           P N+ LVT L
Sbjct: 331 PINSLLVTNL                                                    340
```

Based on this analysis, it was predicted that these proteins and their epitopes could be useful antigens for vaccines or diagnostics.

EXAMPLE 1013

A DNA sequence (GBSx1081) was identified in *S. agalactiae* <SEQ ID 3115> which encodes the amino acid sequence <SEQ ID 3116>. This protein is predicted to be unnamed protein product (argF). Analysis of this protein sequence reveals the following:

```
Possible site: 31
>>> Seems to have no N-terminal signal sequence

----- Final Results -----
            bacterial cytoplasm --- Certainty = 0.3757(Affirmative) < succ>
            bacterial membrane  --- Certainty = 0.0000(Not Clear)   < succ>
            bacterial outside   --- Certainty = 0.0000(Not Clear)   < succ>
```

A related DNA sequence was identified in *S. pyogenes* <SEQ ID 3117> which encodes the amino acid sequence <SEQ ID 3118>. Analysis of this protein sequence reveals the following:

```
Possible site: 31
>>> Seems to have no N-terminal signal sequence
    INTEGRAL    Likelihood = 0.48    Transmembrane    171-187 (171-188)

----- Final Results -----
            bacterial membrane  --- Certainty = 0.1192(Affirmative) < succ>
            bacterial outside   --- Certainty = 0.0000(Not Clear)   < succ>
            bacterial cytoplasm --- Certainty = 0.0000(Not Clear)   < succ>
```

The protein has homology with the following sequences in the databases:

```
>GP:CAB12563 GB:Z99108 similar to metabolite transporter [Bacillus subtilis]
Identities = 190/467 (40%), Positives = 284/467 (60%), Gaps = 13/467 (2%)

Query:  25 TIFRKK-----KKYSNKTEMQRHFKVIDLVFLGLGSMVGTGIFTVTGIGAAKYAGPALTI   79
           ++FRKK       S   + R       DL  LG+G ++GTGIF +TG  AA  AGPAL I
Sbjct:   3 SLFRKKPLETLSAQSKSKSLARTLSAFDLTLLGIGCVIGTGIFVITGTVAATGAGPALII   62

Query:  80 SIIISAIAIGILALFYAEFASRMPSNGGAYSYVYATLGEFPAWLVGWYIIMEFLTAISSV  139
           S I++ +A  + A  YAEF+S +P +G  YSY Y TLGE  A+L+GW +++E++ A+S+V
Sbjct:  63 SFILAGLACALAAFCYAEFSSSIPISGSVYSYSYVTLGELLAFLIGWDLMLEYVIALSAV  122

Query: 140 AVGWGSYLKGLLANYNIVLPNALNGTFNLKNGTYIDILPVLVMFFVTGIVLMNSKLALRF  199
           A GW SY + LLA +N+ +P AL G         G    ++   +++  +T IV    K + RF
Sbjct: 123 ATGWSSYFQSLLAGFNLHIPAALTGAPGSMAGAVFNLPAAVIILLITAIVSRGVKESTRF  182

Query: 200 NSFLVILKFSALALFIFVGIFFIDHNNWSHFAPYGVGQITGGKTGIFAGASVMFFAFLGF  259
           N+ +V++K + + LFI VGI ++    +NWS F P+G+           G+   A+ +FFA+LGF
Sbjct: 183 NNVIVLMKIAIILLFIIVGIGYVKPDNWSPFMPFGM-------KGVILSAATVFFAYLGF  235

Query: 260 ESISMAVDEVKEPQKTIPKGIILSLIIVTALYIVVTTILTGIVHYTKLNVPDAVAFALRN  319
           +++S A +EVK PQK +P GII +L + T LYI V+ +LTG++  Y KLNV D V+FAL+
Sbjct: 236 DAVSNASEEVKNPQKNMPVGIISALAVCTVLYIAVSLVLTGMMPYAKLNVGDPVSFALKF  295

Query: 320 IRLYWAADYVSIVAILTLITVCISNTYALARTIYSISRDGLLPKSLYTLTKKNKVPQNAT  379
           +       A  +S+ AI+ + TV +++ YA  R  +++SRDGLLP    +     K P    T
Sbjct: 296 VGQDAVAGIISVGAIIGITTVMLALLYAQVRLTFAMSRDGLLPGLFAKVHPSFKTPFRNT  355
```

```
-continued
Query:  380 LVTGLLAMICAGIFPLSSLAEFVNICTLAYLIILSGAIIKLRRIEGEPKANEFKTPLVPF  439
            +TG++A    AG   L +LA  VN+ TLA    ++S A+I LR+   E KA+ F+ P VP
Sbjct:  356 WLTGIVAAGIAGFINLGTLAHLVNMGTLAAFTVISIAVIVLRKKHPEIKAS-FRVPFVPV  414

Query:  440 LPMLAIIICLSFMSQYKAFTWIAFAIATIIGTLIYLAYGYTHSIENK  486
            +P+++  ICL FM      TW++F I   +GTL+Y  Y   HS+ NK
Sbjct:  415 VPIISAGICLWFMYSLPGVTWLSFVIWIAVGTLVYFLYSRKHSLLNK  461
```

An alignment of the GAS and GBS proteins is shown below.

```
Identities = 312/337 (92%), Positives = 324/337 (95%)

Query:    1 MTQVFQGRSFLAEKDFSREEFEYLIDFSAHLKDLKKRGVPHHYLEGKNIALLFEKTSTRT   60
            MTQVFQGRSFLAEKDF+R E EYLIDFSAHLKDLKKRGVPHHYLEGKNIALLFEKTSTRT
Sbjct:    1 MTQVFQGRSFLAEKDFTRAELEYLIDFSAHLKDLKKRGVPHHYLEGKNIALLFEKTSTRT   60

Query:   61 RAAFTTAAIDLGAHPEYLGANDIQLGKKESTEDTAKVLGRMFDGIEFRGFSQRMVEELAE  120
            RAAFTTAAIDLGAHPEYLGANDIQLGKKESTEDTAKVLGRMFDGIEFRGFSQRMVEELAE
Sbjct:   61 RAAFTTAAIDLGAHPEYLGANDIQLGKKESTEDTAKVLGRMFDGIEFRGFSQRMVEELAE  120

Query:  121 FSGVPVWNGLTDEWHPTQMLADYLTIKENFGKLEGITLVYCGDGRNNVANSLLVAGTLMG  180
            FSGVPVWNGLTDEWHPTQMLADY T+KENFGKLEG+TLVYCGDGRNNVANSLLV G ++G
Sbjct:  121 FSGVPVWNGLTDEWHPTQMLADYFTVKENFGKLEGLTLVYCGDGRNNVANSLLVTGAILG  180

Query:  181 VNVHIFSPKELFPAEEIVKLAEEYAKESGAHVLVTDNVDEAVKGADVFYTDVWVSMGEED  240
            VNVHIFSPKELFP EEIV LAE YAKESGA +L+T++ DEAVKGADV YTDVWVSMGEED
Sbjct:  181 VNVHIFSPKELFPEEEIVTLAEGYAKESGARILITEDADEAVKGADVLYTDVWVSMGEED  240

Query:  241 KFKERVELLQPYQVNMELIKKANNDNLIFLHCLPAFHDTNTVYGKDVAEKFGVKEMEVTD  300
            KFKERVELLQPYQVNM+L++KA ND LIFLHCLPAFHDTNTVYGKDVAEKFGVKEMEVTD
Sbjct:  241 KFKERVELLQPYQVNMDLVQKAGNDKLIFLHCLPAFHDTNTVYGKDVAEKFGVKEMEVTD  300

Query:  301 EVFRSKYARHFDQAENRMHTIKAVMAATLGNLFIPKV  337
            EVFRSKYARHFDQAENRMHTIKAVMAATLGNLFIPKV
Sbjct:  301 EVFRSKYARHFDQAENRMHTIKAVMAATLGNLFIPKV  337
```

Based on this analysis, it was predicted that these proteins and their epitopes could be useful antigens for vaccines or diagnostics.

EXAMPLE 1014

A DNA sequence (GBSx1082) was identified in *S. agalactiae* <SEQ ID 3119> which encodes the amino acid sequence <SEQ ID 3120>. Analysis of this protein sequence reveals the following:

```
Possible site: 24
>>> Seems to have no N-terminal signal sequence

----- Final Results -----
           bacterial cytoplasm --- Certainty = 0.0456(Affirmative) < succ>
           bacterial membrane  --- Certainty = 0.0000(Not Clear)  < succ>
            bacterial outside  --- Certainty = 0.0000(Not Clear)  < succ>
```

A related GBS nucleic acid sequence <SEQ ID 10921> which encodes amino acid sequence <SEQ ID 10922> was also identified.

A related DNA sequence was identified in *S. pyogenes* <SEQ ID 3121> which encodes the amino acid sequence <SEQ ID 3122>. Analysis of this protein sequence reveals the following:

```
Possible site: 61
>>> Seems to have no N-terminal signal sequence
    INTEGRAL    Likelihood = -5.41    Transmembrane    121-137 (118-140)
```

```
----- Final Results -----
            bacterial membrane --- Certainty = 0.3166(Affirmative) < succ>
            bacterial outside --- Certainty = 0.0000(Not Clear) < succ>
           bacterial cytoplasm --- Certainty = 0.0000(Not Clear) < succ>
```

An alignment of the GAS and GBS proteins is shown below.

```
 Identities = 65/113 (57%), Positives = 83/113 (72%)

Query:  31 MEEEFDDNDEQDTIYAVLYDGKQPVSTGRFLPETQTEARLTRIATLKGYRGNGYGTKIII   90
           M ++FD NDE  T+YAV+YD  QPVSTG+FL ET+ EARLTRI TL  Y G GYG K+
Sbjct:   1 MADKFDANDETRTVYAVVYDNDQPVSTGQFLAETKIEARLTRIVTLADYCGCGYGAKVTE   60

Query:  91 ALENYAKENGYHYLTIHAELTAKDFYQTLGYQATGNIYMEDGEACQTLEKYLI          143
           ALE Y +  G++ LTIH+ELTA+ FY+ LGYQ+ G    +EDGE CQ+L K ++
Sbjct:  61 ALETYTRREGFYQLTIHSELTAQTFYENLGYQSYGPKCLEDGEYCQSLAKTIL          113
```

Based on this analysis, it was predicted that these proteins and their epitopes could be useful antigens for vaccines or diagnostics.

EXAMPLE 1015

A DNA sequence (GBSx1083) was identified in *S. agalactiae* <SEQ ID 3123> which encodes the amino acid sequence <SEQ ID 3124>. Analysis of this protein sequence reveals the following:

```
Possible site: 58
>>> Seems to have no N-terminal signal sequence

----- Final Results -----
           bacterial cytoplasm --- Certainty = 0.2160 (Affirmative) < succ>
            bacterial membrane --- Certainty = 0.0000 (Not Clear) < succ>
             bacterial outside --- Certainty = 0.0000 (Not Clear) < succ>
```

A related DNA sequence was identified in *S. pyogenes* <SEQ ID 3125> which encodes the amino acid sequence <SEQ ID 3126>. Analysis of this protein sequence reveals the following:

```
Possible site: 58
>>> Seems to have no N-terminal signal sequence

----- Final Results -----
           bacterial cytoplasm --- Certainty = 0.2730 (Affirmative) < succ>
            bacterial membrane --- Certainty = 0.0000 (Not Clear) < succ>
             bacterial outside --- Certainty = 0.0000 (Not Clear) < succ>
```

An alignment of the GAS and GBS proteins is shown below.

```
Identities = 375/411 (91%), Positives = 395/411 (95%), Gaps = 1/411 (0%)

Query:    1 MTQTHPIHVFSEIGKLKKVMLHRPGKEIENLMPDYLERLLFDDIPFLEDAQKEHDAFAQA   60
            MT   PIHV+SEIGKLKKV+LHRPGKEIENLMPDYLERLLFDDIPFLEDAQKEHDAFAQA
Sbjct:    1 MTAQTPIHVYSEIGKLKKVLLHRPGKEIENLMPDYLERLLFDDIPFLEDAQKEHDAFAQA   60

Query:   61 LRNEGVEVLYLENLAAESLTNQEIREQFIDEYIGEANVRGRATKKAIRELLLNIKDNKEL  120
            LR+EG+EVLYLE LAAESL   EIRE FIDEY+ EAN+RGRATKKAIRELL+ I+DN+EL
Sbjct:   61 LRDEGIEVLYLETLAAESLVTPEIREAFIDEYLSEANIRGRATKKAIRELLMAIEDNQEL  120

Query:  121 IEKTMAGIQKSELPEIPSSEKGLTDLVESNYPFAIDPMPNLYFTRDPFATIGNGVSLNHM  180
            IEKTMAG+QKSELPEIP+SEKGLTDLVESNYPFAIDPMPNLYFTRDPFATIG GVSLNHM
Sbjct:  121 IEKTMAGVQKSELPEIPASEKGLTDLVESNYPFAIDPMPNLYFTRDPFATIGTGVSLNHM  180

Query:  181 FSETRNRETLYGKYIFTHHPEYGG-KVPMVYEREETTRIEGGDELVLSKDVLAVGISQRT  239
            FSETRNRETLYGKYIFTHHP YGG KVPMVY+R ETTRIEGGDELVLSKDVLAVGISQRT
```

```
-continued
Sbjct:  181  FSETRNRETLYGKYIFTHHPIYGGGKVPMVYDRNETTRIEGGDELVLSKDVLAVGISQRT  240

Query:  240  DAASIEKLLVNIFKQNLGFKKVLAFEFANNRKFMHLDTVFTMVDYDKFTIHPEIEGDLRV  299
             DAASIEKLLVNIFKQNLGFKKVLAFEFANNRKFMHLDTVFTMVDYDKFTIHPEIEGDLRV
Sbjct:  241  DAASIEKLLVNIFKQNLGFKKVLAFEFANNRKFMHLDTVFTMVDYDKFTIHPEIEGDLRV  300

Query:  300  YSVTYENQDLHIEEEKGDLADLLAKNLGVEKVELIRCGGDNLVAAGREQWNDGSNTLTIA  359
             YSVTY+N++LHI EEKGDLA+LLA NLGVEKV+LIRCGGDNLVAAGREQWNDGSNTLTIA
Sbjct:  301  YSVTYDNEELHIVEEKGDLAELLAANLGVEKVDLIRCGGDNLVAAGREQWNDGSNTLTIA  360

Query:  360  PGVVIVYNRNTITNAILESKGLKLIKINGSELVRGRGGPRCMSMPFEREDL  410
             PGVV+VYNRNTITNAILESKGLKLIKI+GSELVRGRGGPRCMSMPFERED+
Sbjct:  361  PGVVVVYNRNTITNAILESKGLKLIKIHGSELVRGRGGPRCMSMPFEREDI  411
```

Based on this analysis, it was predicted that these proteins and their epitopes could be useful antigens for vaccines or diagnostics.

EXAMPLE 1016

A DNA sequence (GBSx1084) was identified in *S. agalactiae* <SEQ ID 3127> which encodes the amino acid sequence <SEQ ID 3128>. Analysis of this protein sequence reveals the following:

```
Possible site: 20
>>> Seems to have no N-terminal signal sequence

----- Final Results -----
           bacterial cytoplasm --- Certainty = 0.3162(Affirmative) < succ>
           bacterial membrane  --- Certainty = 0.0000(Not Clear)   < succ>
           bacterial outside   --- Certainty = 0.0000(Not Clear)   < succ>
```

A related GBS nucleic acid sequence <SEQ ID 8703> which encodes amino acid sequence <SEQ ID 8704> was also identified. This protein has an RGD motif and has homology with the following sequences in the GENPEPT database.

```
>GP:AAG07568 GB:AE004834 hypothetical protein [Pseudomonas aeruginosa]
Identities = 42/132 (31%), Positives = 74/132 (55%), Gaps = 3/132 (2%)

Query:   35  IQTYRKAYQTFKTK-KGARSSIEALLKRVNSGNEITSINPLVDIYNAASLRFGLPIGAED   93
             +  + +A++ F  K +    S EAL KR       + SI+P+VD+YNA S++F +P+G E+
Sbjct:   63  LAAWAEAFRRFGAKPQRTPCSAEALRKRALRDGGLPSIDPVVDLYNAISVQFAIPVGGEN  122

Query:   94  SDTFRGDLKLTITNGGDEFYLI--GEDFNRPTLSGELAYVDDVGAVCRCFNWRDGKRTMI  151
             + G  +L + +G + F + GE +   GE+ + DD+G  CR +NWR G RT +
Sbjct:  123  LAAYAGPPRLVVADGSETFDTLKNGEALDESPDPGEVVWRDDLGVTCRRWNWRQGVRTRL  182

Query:  152  TDNTQNAFLVIE  163
             + +  + ++E
Sbjct:  183  DASARRMWFILE  194
```

A related DNA sequence was identified in *S. pyogenes* <SEQ ID 3129> which encodes the amino acid sequence <SEQ ID 3130>. Analysis of this protein sequence reveals the following:

```
Possible site: 33
>>> Seems to have no N-terminal signal sequence

----- Final Results -----
           bacterial cytoplasm --- Certainty = 0.0700(Affirmative) < succ>
           bacterial membrane  --- Certainty = 0.0000(Not Clear)   < succ>
           bacterial outside   --- Certainty = 0.0000(Not Clear)   < succ>
```

An alignment of the GAS and GBS proteins is shown below.

```
Identities = 127/199 (63%), Positives = 155/199 (77%)

Query:     8 ELKQLLSDSHSLAKKYLQEKEFSQNRVIQTYRKAYQTFKTKKGARSSIEALLKRVNSGNE    67
             ++KQLL+DSH LAK YL    FS N+V+Q YRKAYQ FKTKKGARSSIEALLKRV++G
Sbjct:    36 DVKQLLADSHELAKAYLTADNFSDNQVVQYRKAYQHFKTKKGARSSIEALLKRVSNGQS    95

Query:    68 ITSINPLVDIYNAASLRFGLPIGAEDSDTFRGDLKLTITNGGDEFYLIGEDFNRPTLSGE   127
             I SINPLVDIYNAASLRFGLP GAEDSD+F GDL+LTIT+GGD+FYLIG+  N PTL  E
Sbjct:    96 IPSINPLVDIYNAASLRFGLPAGAEDSDSFIGDLRLTITDGGDDFYLIGDADNNPTLPNE   155

Query:   128 LAYVDDVGAVCRCFNWRDGKRTMITDNTQNAFLVIELIDNGREIIFKEALDFIATNTNRF   187
             L Y DD+GA CRC NWRDG+RTM+T++T+NAFL+IE +D  +    +EAL FI  +  +
Sbjct:   156 LCYKDDIGAFCRCLNWRDGERTMVTEHTKNAFLIIEALDQEGQNRLQEALKFIEGSAKMY   215

Query:   188 LKAKTQTIILDKEHSEITL                                           206
             L A T   +LDK++ + L
Sbjct:   216 LHAITSVHVLDKDNPHVPL                                           234
```

SEQ ID 8704 (GBS298) was expressed in *E. coli* as a His-fusion product. SDS-PAGE analysis of total cell extract is shown in FIG. 44 (lane 2; MW 29 kDa). It was also expressed in *E. coli* as a GST-fusion product. SDS-PAGE analysis of total cell extract is shown in FIG. 48 (lane 5; MW 54 kDa).

Figure 297:
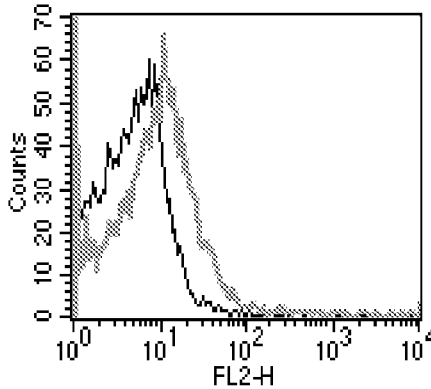

The GBS298-GST fusion product was purified (FIG. 203, lane 9) and used to immunise mice. The resulting antiserum was used for FACS (FIG. 297), which confirmed that the protein is immunoaccessible on GBS bacteria.

Based on this analysis, it was predicted that these proteins and their epitopes could be useful antigens for vaccines or diagnostics.

EXAMPLE 1017

A DNA sequence (GBSx1085) was identified in *S. agalactiae* <SEQ ID 3131> which encodes the amino acid sequence <SEQ ID 3132>. Analysis of this protein sequence reveals the following:

```
Possible site: 26
>>> Seems to have no N-terminal signal sequence

----- Final Results -----
         bacterial cytoplasm --- Certainty = 0.3770(Affirmative) < succ>
          bacterial membrane --- Certainty = 0.0000(Not Clear)   < succ>
           bacterial outside --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1018

A DNA sequence (GBSx1086) was identified in *S. agalactiae* <SEQ ID 3133> which encodes the amino acid sequence <SEQ ID 3134>. Analysis of this protein sequence reveals the following:

```
Possible site: 20
>>> Seems to have no N-terminal signal sequence

----- Final Results -----
         bacterial cytoplasm --- Certainty = 0.4263(Affirmative) < succ>
          bacterial membrane --- Certainty = 0.0000(Not Clear)   < succ>
           bacterial outside --- Certainty = 0.0000(Not Clear)   < succ>
```

The protein has homology with the following sequences in the GENPEPT database.

```
>GP:CAB95946 GB:Y17554 Crp/Fnr family protein [Bacillus licheniformis]
    Identities = 85/214 (39%), Positives = 126/214 (58%), Gaps = 14/214 (6%)

Query:    11 RQLDDFKHFTIEQFDHIVSHIKHRTALKNHTLFFEGDYREKLFLIQSGHVKIEQSDASGS    70
             R L+D K F           I R+ K    LF E D RE+++L+  G +K+E+S+ +GS
Sbjct:    22 RDLEDMKQF----------IYWRSYHKGQILFMEDDPRERMYLLLDGFIKLEKSNEAGS    70
```

-continued

```
Query:  71 FIYTDYVRQGTVFPYGGLFLDDDYHFSAVAITDIEYFSLPMALYEEYSLQNINQMKHLCR  130
           YTDYVR  T+FP+GGLF D+ YH++A A+TDIE + +PM ++E+    N N + +
Sbjct:  71 MFYTDYVRPHTLFPEGGLFRDEHYHYAAEALTDIELYYIPMNIFEDLVRDNKNLLYDILN  130

Query: 131 KYSKLLRVHEIRLRNMVTSSASMRVIQSLATL---LLQVPTERGHLPFPITTIEIANMSG  187
           S +L +HE RL+ +  S A  RV Q++  L    L Q +    +  PIT   EIA +SG
Sbjct: 131 HLSDILALHEERLKRITLSHAHDRVTQAIYYLTESLGQKESNSTVINCPITAAEIAKISG  190

Query: 188 TTRETVSHVLKELRQKDIVEMKGKKLLYNNKNYF                            221
           T+RETVS VLK+LR + ++     K+++ N    YF
Sbjct: 191 TSRETVSAVLKKLRCEGVISQMNKQIMINRPEYF                            224
```

A related DNA sequence was identified in *S. pyogenes* <SEQ ID 3135> which encodes the amino acid sequence <SEQ ID 3136>. Analysis of this protein sequence reveals the following:

```
Possible site: 20
>>> Seems to have no N-terminal signal sequence

----- Final Results -----
            bacterial cytoplasm --- Certainty = 0.4478 (Affirmative) < succ>
            bacterial membrane  --- Certainty = 0.0000 (Not Clear)   < succ>
             bacterial outside  --- Certainty = 0.0000 (Not Clear)   < succ>
```

An alignment of the GAS and GBS proteins is shown below.

```
Identities = 130/224 (58%), Positives = 180/224 (80%)

Query:   1 MITKEQYFYFRQLDDFKHFTIEQFDHIVSHIKHRTALKNHTLFFEGDYREKLFLIQSGHV  60
           +I +E Y Y R+L+DF++F+IEQFD IV  ++ R A K+H LFFEGD R+KLFL+ SG+
Sbjct:   1 VIRREDYQYLRKLNDFRYFSIEQFDKIVGQMEFRKAKKDHILFFEGDKRDKLFLVTSGYF  60

Query:  61 KIEQSDASGSFIYTDYVRQGTVFPYGGLFLDDDYHFSAVAITDIEYFSLPMALYEEYSLQ  120
           K+EQSD SG+F+YTD++R GT+FPYGGLF DD YHFS VA+TD+ YF  P+ L+E+YSL+
Sbjct:  61 KVEQSDQSGTFMYTDFIRHGTIFPYGGLFTDDYYHFSVVAMTDVTYFYFPVDLFEDYSLE  120

Query: 121 NINQMKHLCRKYSKLLRVHEIRLRNMVTSSASMRVIQSLATLLLQVPTERGHLPFPITTI  180
           N  QMKHL  K SKLL +HE+R+RN++TSSAS RVIQSLA LL+++  +    LPF +TT
Sbjct: 121 NRLQMKHLYSKMSKLLELHELRVRNLITSSASSRVIQSLAILLVEMGKDSDTLPFQLTTT  180

Query: 181 EIANMSGTTRETVSHVLKELRQKDIVEMKGKKLLYNNKNYFKKF                  224
           +IA +SGTTRETVSHVL++L++++++  +KGK L Y +K+YF ++
Sbjct: 181 DIAQISGTTRETVSHVLRDLKKQELITIKGKYLTYLDKDYFLQY                  224
```

Based on this analysis, it was predicted that these proteins and their epitopes could be useful antigens for vaccines or diagnostics.

EXAMPLE 1019

A DNA sequence (GBSx1087) was identified in *S. agalactiae* <SEQ ID 3137> which encodes the amino acid sequence <SEQ ID 3138>. Analysis of this protein sequence reveals the following:

```
Possible site: 53
>>> Seems to have no N-terminal signal sequence

----- Final Results -----
            bacterial cytoplasm --- Certainty = 0.1643(Affirmative) < succ>
            bacterial membrane  --- Certainty = 0.0000(Not Clear)   < succ>
             bacterial outside  --- Certainty = 0.0000(Not Clear)   < succ>
```

A related DNA sequence was identified in *S. pyogenes* <SEQ ID 2161> which encodes the amino acid sequence <SEQ ID 2162>. Analysis of this protein sequence reveals the following:

```
Possible site: 59
>>> Seems to have no N-terminal signal sequence

----- Final Results -----
            bacterial cytoplasm --- Certainty = 0.1201(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below.

```
Identities = 461/493 (93%), Positives = 478/493 (96%)

Query:    2 MSNWDTKFLKKGFTFDDVLLIPAESHVLPNEVDMKTKLADNLTLNIPIITAAMDTVTDSK   61
            MSNWDTKFLKKG+TFDDVLLIPAESHVLPNEVD+KTKLADNLTLNIPIITAAMDTVT SK
Sbjct:    1 MSNWDTKFLKKGYTFDDVLLIPAESHVLPNEVDLKTKLADNLTLNIPIITAAMDTVTGSK   60

Query:   62 MAIAIARAGGLGIIHKNMSIVDQAEEVRKVKRSENGVIIDPFFLTPDNTVSEAEELMQNY  121
            MAIAIARAGGLG+IHKNMSI +QAEEVRKVKRSENGVIIDPFFLTP++ VSEAEELMQ Y
Sbjct:   61 MAIAIARAGGLGVIHKNMSITEQAEEVRKVKRSENGVIIDPFFLTPEHKVSEAEELMQRY  120

Query:  122 RISGVPIVETLENRKLVGIITNRDMRFISDYKQLISEHMTSQNLVTAPIGTDLETAERIL  181
            RISGVPIVETL NRKLVGIITNRDMRFISDY   ISEHMTS++LVTA +GTDLETAERIL
Sbjct:  121 RISGVPIVETLANRKLVGIITNRDMRFISDYNAPISEHMTSEHLVTAAVGTDLETAERIL  180

Query:  182 HEHRIEKLPLVDDEGRLSGLITIKDIEKVIEFPKAAKDEFGRLLVAGAVGVTSDTFERAE  241
            HEHRIEKLPLVD+ GRLSGLITIKDIEKVIEFP AAKDEFGRLLVA AVGVTSDTFERAE
Sbjct:  181 HEHRIEKLPLVDNSGRLSGLITIKDIEKVIEFPHAAKDEFGRLLVAAAVGVTSDTFERAE  240

Query:  242 ALFEAGADAIVIDTAHGHSAGVLRKIAEIRAHFPNRTLIAGNIATAEGARALYDAGVDVV  301
            ALFEAGADAIVIDTAHGHSAGVLRKIAEIRAHFPNRTLIAGNIATAEGARALYDAGVDVV
Sbjct:  241 ALFEAGADAIVIDTAHGHSAGVLRKIAEIRAHFPNRTLIAGNIATAEGARALYDAGVDVV  300

Query:  302 KVGIGPGSICTTRVVAGVGVPQITAIYDAAAVAREYGKTIIADGGIKYSGDIVKALAAGG  361
            KVGIGPGSICTTRVVAGVGVPQ+TAIYDAAAVAREYGKTIIADGGIKYSGDIVKALAAGG
Sbjct:  301 KVGIGPGSICTTRVVAGVGVPQVTAIYDAAAVAREYGKTIIADGGIKYSGDIVKALAAGG  360

Query:  362 NAVMLGSMFAGTDEAPGETEIFQGRKFKTYRGMGSIAAMKKGSSDRYFQGSVNEANKLVP  421
            NAVMLGSMFAGTDEAPGETEI+QGRKFKTYRGMGSIAAMKKGSSDRYFQGSVNEANKLVP
Sbjct:  361 NAVMLGSMFAGTDEAPGETEIYQGRKFKTYRGMGSIAAMKKGSSDRYFQGSVNEANKLVP  420

Query:  422 EGIEGRVAYKGSVADIVFQMLGGIRSGMGYVGAANIKELHDNAQFVEMSGAGLKESHPHD  481
            EGIEGRVAYKG+ +DIVFQMLGGIRSGMGYVGA +I+ELH+NAQFVEMSGAGL ESHPHD
Sbjct:  421 EGIEGRVAYKGAASDIVFQMLGGIRSGMGYVGAGDIQELHENAQFVEMSGAGLIESHPHD  480

Query:  482 VQITNEAPNYSVH                                                494
            VQITNEAPNYSVH
Sbjct:  481 VQITNEAPNYSVH                                                493
```

Based on this analysis, it was predicted that these proteins and their epitopes could be useful antigens for vaccines or diagnostics.

EXAMPLE 1020

A DNA sequence (GBSx1089) was identified in *S. agalactiae* <SEQ ID 3139> which encodes the amino acid sequence <SEQ ID 3140>. This protein is predicted to be MutR. Analysis of this protein sequence reveals the following:

```
Possible site: 23
>>> Seems to have no N-terminal signal sequence

----- Final Results -----
            bacterial cytoplasm --- Certainty = 0.1841(Affirmative) < succ>
             bacterial membrane --- Certainty = 0.0000(Not Clear)   < succ>
              bacterial outside --- Certainty = 0.0000(Not Clear)   < succ>
```

The protein has homology with the following sequences in the GENPEPT database.

```
>GP:AAD04237 GB:AF007761 MutR [Streptococcus mutans]
Identities = 51/215 (23%), Positives = 102/215 (46%), Gaps = 9/215 (4%)
```

-continued

```
Query:     5 GKILKELREDKGISLSSLAKSAQLSKSTLSRFENGETQIGIDKFIKALQTLEVGVTINEV   64
             G++ KELR +G+ L +A+   LS S LS+FENG+T +  DK I A+Q +   +T +E
Sbjct:     9 GELYKELRMARGLKLKDIARD-NLSVSQLSKFENGQTMLAADKLILAIQGIH--MTFSEF   65

Query:    65 SILDSKVKAGTSNTDLEQLTLLESYRDNEDIMRIFSFQKQQSCDRIESNVLKILAKLFIS  124
             S   ++ +         ++L  L++ +D + + +I          + + + K++ K  +
Sbjct:    66 SYAFTQYQESDLFKTGKKLVELQTKKDIKGLKKILKDYPDTETYNVYNRLNKLVIKAAVY  125

Query:   125 NLGLNMRLPQDEINLVVTYLNGVTQYNDFYFKVICYFQDILPED--VILNKI----SNMT  178
             +L  +  +E   +YL  + ++ ++    +     IL +D  V L K         +
Sbjct:   126 SLDSSFEITNEEKEFLTSYLYAIEEWTEYELYLFGNTLFILSDDDLVFLGKAFVERDKLY  185

Query:   179 KEQLPYSKSLVNLLIKQVIIALEKDSVDKAIVFAD                           213
             +E   + K    +LI ++I +E  S   A F +
Sbjct:   186 RELSEHKKRAELVLINLILILVEHHSFYHAQYFIE                           220
```

There is also homology to SEQ ID 628.

Based on this analysis, it was predicted that this protein and its epitopes, could be useful antigens for vaccines or diagnostics.

EXAMPLE 1021

A DNA sequence (GBSx1090) was identified in *S. agalactiae* <SEQ ID 3141> which encodes the amino acid sequence <SEQ ID 3142>. Analysis of this protein sequence reveals the following:

```
Possible site: 15
>>> Seems to have a cleavable N-term signal seq.
      INTEGRAL    Likelihood = -10.77    Transmembrane   269-285  (265-287)
      INTEGRAL    Likelihood =  -6.90    Transmembrane    33-49   (31-51)
      INTEGRAL    Likelihood =  -6.79    Transmembrane   182-198  (176-200)
      INTEGRAL    Likelihood =  -6.37    Transmembrane   117-133  (113-135)
      INTEGRAL    Likelihood =  -5.57    Transmembrane   240-256  (232-259)
      INTEGRAL    Likelihood =  -3.40    Transmembrane   223-239  (220-239)
      INTEGRAL    Likelihood =  -0.96    Transmembrane    56-72   (55-72)

----- Final Results -----
             bacterial membrane  --- Certainty = 0.5310(Affirmative) < succ>
              bacterial outside  --- Certainty = 0.0000(Not Clear)   < succ>
            bacterial cytoplasm  --- Certainty = 0.0000(Not Clear)   < succ>
```

A related DNA sequence was identified in *S. pyogenes* <SEQ ID 3143> which encodes the amino acid sequence <SEQ ID 3144>. Analysis of this protein sequence reveals the following:

```
Possible site: 48
>>> Seems to have an uncleavable N-term signal seq
      INTEGRAL    Likelihood = -10.99    Transmembrane   269-285  (264-286)
      INTEGRAL    Likelihood =  -8.76    Transmembrane   117-133  (112-135)
      INTEGRAL    Likelihood =  -7.70    Transmembrane   179-195  (174-200)
      INTEGRAL    Likelihood =  -4.83    Transmembrane    34-50   (32-52)
      INTEGRAL    Likelihood =  -4.46    Transmembrane   213-229  (211-230)
      INTEGRAL    Likelihood =  -4.14    Transmembrane   240-256  (232-259)
      INTEGRAL    Likelihood =  -0.69    Transmembrane    91-107  (91-108)
      INTEGRAL    Likelihood =  -0.32    Transmembrane     4-20   (4-20)

----- Final Results -----
             bacterial membrane  --- Certainty = 0.5394(Affirmative) < succ>
              bacterial outside  --- Certainty = 0.0000(Not Clear)   < succ>
            bacterial cytoplasm  --- Certainty = 0.0000(Not Clear)   < succ>
```

A related sequence was also identified in GAS <SEQ ID 9181> which encodes the amino acid sequence <SEQ ID 9182>. Analysis of this protein sequence reveals the following:

```
    Possible site: 38
>>> Seems to have an uncleavable N-term signal seq
    INTEGRAL Likelihood = -10.99 Transmembrane 259-275 (254-276)
```

-continued

```
INTEGRAL Likelihood =   -8.76 Transmembrane 107-123 (102-125)
INTEGRAL Likelihood =   -7.70 Transmembrane 169-185 (164-190)
INTEGRAL Likelihood =   -4.83 Transmembrane  24-40  ( 22-42)
INTEGRAL Likelihood =   -4.46 Transmembrane 203-219 (201-220)
INTEGRAL Likelihood =   -4.14 Transmembrane 230-246 (222-249)
INTEGRAL Likelihood =   -0.69 Transmembrane  81-97  ( 81-98)

----- Final Results -----
              bacterial membrane  --- Certainty = 0.539 (Affirmative) < succ>
              bacterial outside   --- Certainty = 0.0000 (Not Clear)  < succ>
              bacterial cytoplasm --- Certainty = 0.0000 (Not Clear)  < succ>
```

An alignment of the GAS and GBS proteins is shown below.

```
Identities = 200/287 (69%), Positives = 244/287 (84%)

Query:    1 MEGLLIALIPMFAWGSIGFVSNKIGGRPNQQTFGMTLGALLFAIIVWLFKQPEMTASLWI   60
            +EG+  ALIPMF WGSIGFVSNKIGG+P+QQT GMT GALLF++ VWL  +PEMT  LW+
Sbjct:    1 LEGIFYALIPMFTWGSIGFVSNKIGGKPSQQTLGMTFGALLFSLAVWLIVRPEMTLQLWL   60

Query:   61 FGILGGILWSVGQNGQFQAMKYMGVSVANPLSSGAQLVGGSLVGALVFHEWTKPIQFILG  120
            FGILGG +WS+GQ GQF AM+YMGVSVANPLSSG+QLV GSL+G LVFHEWT+P+QF++G
Sbjct:   61 FGILGGFIWSIGQTGQFHAMQYMGVSVANPLSSGSQLVLGSLIGVLVFHEWTRPMQFVVG  120

Query:  121 LTALTLLVIGFYFSSKRDVSEQALATHQEFSKGFATIAYSTVGYISYAVLFNNIMKFDAM  180
               AL LL++GFYFSSK+D +      FSKGF  + YST+GY+ YAVLFNNIMKF+ +
Sbjct:  121 SLALLLLIVGFYFSSKQDDANAQVNHLHNFSKGFRALTYSTIGYVMYAVLFNNIMKFEVL  180

Query:  181 AVILPMAVGMCLGAICFMKFRVNFEAVVVKNMITGLMWGVGNVFMLLAAAKAGLAIAFSF  240
            +VILPMAVGM LGAI FM F+++ +V+KN +GL+WG GN+FMLLAA+KAGLAIAFSF
Sbjct:  181 SVILPMAVGMVLGAITFMSFKISIDQYVIKNSVVGLLWGIGNIFMLLAASKAGLAIAFSF  240

Query:  241 SQLGVIISIIGGILFLGETKTKKEQKWVVMGILCFVMGAILLGIVKS              287
            SQLG IISI+GGILFLGETKTKKE +WVV GI+CF++GAILLG+VKS
Sbjct:  241 SQLGAIISIVGGILFLGETKTKKEMRWVVTGIICFIVGAILLGVVKS              287
```

Based on this analysis, it was predicted that these proteins and their epitopes could be useful antigens for vaccines or diagnostics.

EXAMPLE 1022

A DNA sequence (GBSx1092) was identified in *S. agalactiae* <SEQ ID 3145> which encodes the amino acid sequence <SEQ ID 3146>. This protein is predicted to be recf protein (recF). Analysis of this protein sequence reveals the following:

```
Possible site: 56
>>> Seems to have no N-terminal signal sequence

----- Final Results -----
              bacterial cytoplasm --- Certainty = 0.2653(Affirmative) < succ>
              bacterial membrane  --- Certainty = 0.0000(Not Clear)   < succ>
              bacterial outside   --- Certainty = 0.0000(Not Clear)   < succ>
```

A related DNA sequence was identified in *S. pyogenes* <SEQ ID 3147> which encodes the amino acid sequence <SEQ ID 3148>. Analysis of this protein sequence reveals the following:

```
Possible site: 56
>>> Seems to have no N-terminal signal sequence

----- Final Results -----
              bacterial cytoplasm --- Certainty = 0.1677(Affirmative) < succ>
              bacterial membrane  --- Certainty = 0.0000(Not Clear)   < succ>
              bacterial outside   --- Certainty = 0.0000(Not Clear)   < succ>
```

An alignment of the GAS and GBS proteins is shown below.

```
Identities = 248/364 (68%), Positives = 300/364 (82%), Gaps = 1/364 (0%)

Query:    1 MWIKNISLKHYRNYEEAQVDFSPNLNIFIGRNAQGKTNFLEAIYFLALTRSHRTRSDKEL   60
            MWIK + LKHYRNY+     FS LN+FIG NAQGKTNFLEAIYFL+LTRSHRTR+DKEL
Sbjct:    1 MWIKELELKHYRNYDHLLASFSSGLNVFIGNNAQGKTNFLEAIYFLSLTRSHRTRADKEL   60

Query:   61 VHFKHHDVQITGEVIRKSGHLNLDIQLSEKGRITKVNHLKQAKLSDYIGAMTVVLFAPED  120
            +HF H  V +TG++ R SG ++L+I LS+KGR+TK+N LKQAKLSDYIG M VVLFAPED
Sbjct:   61 IHFDHSTVSLTGKIQRISGTVDLEINLSDKGRVTKINALKQAKLSDYIGTMMVVLFAPED  120

Query:  121 LQLVKGAPSLRRKFLDIDIGQIKPTYLAELSNYNHVLKQRNTYLKTTNNVDKTFLTVLDE  180
            LQLVKGAPSLRRKF+DID+GQIKP YL+ELS+YNHVLKQRN+YLK+   +D  FL VLDE
Sbjct:  121 LQLVKGAPSLRRKFIDIDLGQIKPVYLSELSHYNHVLKQRNSYLKSAQQIDAAFLAVLDE  180

Query:  181 QLADYGSRVIEHRFDFIQALNDEADKHHYIISTELEHLSIHYKSSIEFTDKSSIREHFLN  240
            QLA  YG+RV+EHR DFI AL  EA+ HH  IS  LE LS+ Y+SS+  F   K++I + FL+
Sbjct:  181 QLASYGARVMEHRIDFINALEKEANTHHQAISNGLESLSLSYQSSVVFDKKTNIYQQFLH  240

Query:  241 QLSKSHSRDIFKKNTSIGPHRDDITFFINDINATFASQGQQRSLILSLKLAEIELIKTVT  300
            QL K+H +D F+KNTS+GPHRD++ F+IN +NA FASQGQ RSLILSLK+AE+ L+K +T
Sbjct:  241 QLEKNHQKDFFRKNTSVGPHRDELAFYINGMNANFASQGQHRSLILSLKMAEVSLMKALT  300

Query:  301 NDYPILLLDDVMSELDNHRQLKLLEG-IKENVQTFITTTSLEHLSALPDQLKIFNVSDGT  359
             D  PILLLDDVMSELDN RQ KLLE  IKENVQTFITTTSL+HLS LP+ ++IF+V+ GT
Sbjct:  301 GDNPILLLDDVMSELDNTRQTKLLETVIKENVQTFITTTSLDHLSQLPEGIRIFHVTKGT  360

Query:  360 ISIN                                                         363
            + I+
Sbjct:  361 VQID                                                         364
```

Based on this analysis, it was predicted that these proteins and their epitopes could be useful antigens for vaccines or diagnostics.

EXAMPLE 1023

A DNA sequence (GBSx1093) was identified in *S. agalactiae* <SEQ ID 3149> which encodes the amino acid sequence <SEQ ID 3150>. Analysis of this protein sequence reveals the following:

```
Possible site: 26
>>> Seems to have no N-terminal signal sequence

----- Final Results -----
         bacterial cytoplasm --- Certainty = 0.1807(Affirmative) < succ>
          bacterial membrane --- Certainty = 0.0000(Not Clear)   < succ>
           bacterial outside --- Certainty = 0.0000(Not Clear)   < succ>
```

The protein has homology with the following sequences in the GENPEPT database.

```
>GP: CAA61548 GB: X89367 orf121 [Lactococcus lactis]
Identities = 56/116 (48%), Positives = 74/116 (63%), Gaps = 3/116 (2%)

Query:    3 YKLFDEYITLQSLLKEIGIIQSGGAIKKFLADNR--VLFNGDLENRRGKKLRLGDIITIP   60
            Y LF+EYITL  LLKE+G+I +GG  K FLA+N    + +NG+ ENRRGKKLR GD++  P
Sbjct:    4 YILFEEYITLGQLLKELGLISTGGQPKIFLAENEGNIFYNGEAENRRGKKLRDGDLLEFP   63

Query:   61 DQNIEIIIRKPSDQEIEERNIEIAEKQRVSAIVKEMNKNTNKGKSKTSKKPVRFPG      116
             ++++    +    I+E  E AE+ RV AIVK+MN   NK      K P RFPG
Sbjct:   64 TFDLKVTFEQADADAIKEHEAEKAEEARVKAIVKKMNAE-NKTTKPAKKAPPRFPG      118
```

A related DNA sequence was identified in *S. pyogenes* <SEQ ID 3151> which encodes the amino acid sequence <SEQ ID 3152>. Analysis of this protein sequence reveals the following:

```
Possible site: 34
>>> Seems to have no N-terminal signal sequence

----- Final Results -----
            bacterial cytoplasm --- Certainty = 0.0483(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below.

```
Identities = 74/136 (54%), Positives = 94/136 (68%), Gaps = 20/136 (14%)

Query:   1 MDYKLFDEYITLQSLLKEIGIIQSGGAIKKFLADNRVLFNGDLENRRGKKLRLGDIITIP    60
           M YKLF E+ITLQ+LLKE+GIIQSGGAIK FLA+   VLFNG+ E RRGKK+R+GD I++P
Sbjct:   9 MIYKLFTEFITLQALLKELGIIQSGGAIKGFLAETTVLFNGEDEKRRGKKIRVGDKISLP    68

Query:  61 DQNIEIIIRKPSDQEIEERNIEIAEKQRVSAIVKEMNKNTNKGKSK------TSKK----   110
           DQ++ I I +PS +E E+    E+AEK RV+A+VK+MN+   K  SK       T+KK
Sbjct:  69 DQDLIITIVEPSQEEKEQFAEEMAEKTRVAALVKQMNQANKKTSSKHNNRQSTTKKSLRA   128

Query: 111 ----------PVRFPG                                              116
                     PVRFPG
Sbjct: 129 TKKTKGKPTAPVRFPG                                              144
```

Based on this analysis, it was predicted that these proteins and their epitopes could be useful antigens for vaccines or diagnostics.

EXAMPLE 1024

A DNA sequence (GBSx1094) was identified in *S. agalactiae* <SEQ ID 3153> which encodes the amino acid sequence <SEQ ID 3154>. Analysis of this protein sequence reveals the following:

```
Possible site: 47
>>> Seems to have no N-terminal signal sequence
     INTEGRAL    Likelihood = -1.86    Transmembrane   269-285 (267-285)

----- Final Results -----
            bacterial membrane  --- Certainty = 0.1744(Affirmative) < succ>
             bacterial outside  --- Certainty = 0.0000(Not Clear)   < succ>
           bacterial cytoplasm  --- Certainty = 0.0000(Not Clear)   < succ>
```

A related DNA sequence was identified in *S. pyogenes* <SEQ ID 3155> which encodes the amino acid sequence <SEQ ID 3156>. Analysis of this protein sequence reveals the following:

```
Possible site: 48
>>> Seems to have no N-terminal signal sequence

----- Final Results -----
            bacterial cytoplasm --- Certainty = 0.3008 (Affirmative) < succ>
             bacterial membrane --- Certainty = 0.0000 (Not Clear)   < succ>
              bacterial outside --- Certainty = 0.0000 (Not Clear)   < succ>
```

An alignment of the GAS and GBS proteins is shown below.

```
 Identities = 227/413 (54%), Positives = 309/413 (73%)

Query:   1 MKIVEGVSLHLIKNQQFKTNHLTFRFSGDFNNKTVARRSLVAQMLVTANAKYPKVQEFRE    60
           MKIV+GV LHLIK +QFKTNN+TFRFSGD N KTVA++ LVAQNL TAN  YP V++FRE
Sbjct:   1 MKIVQGVQLHLIKTKQFKTNHITFRFSGDLNQKTVAKKVLVAQMLATANECYPTVRQFRE    60

Query:  61 KLASLYGASLSTKISTKGLVHIVDIDIVFVKNTFTLEQENIVEQIITFLEDMLFSPLISL   120
           KLA LYGASLST + TKGLVHIVDIDI F+++ +    E I++++I FL+D+LFSPL+S+
```

```
                                    -continued
Sbjct:  61 KLARLYGASLSTNVLTKGLVHIVDIDITFIQDRYACNGEKILDEMIQFLKDILFSPLLSI 120

Query: 121 EQYQTSIFDTEKKNLIQYLEADIEDNFYSSDLALKSLFYNNKTLRLPKYGTASLVESENS 180
              QYQ  +F+TEK NLI Y+E+D ED+FY S L +K LFY NK L++ +YG+  L+   E +
Sbjct: 121 AQYQPKVFETEKNNLINYIESDREDSFYYSSLKVKELFYCNKNLQNSEYGSPELIAKETA 180

Query: 181 FTAYQEFQKMLKEDQLDIFVVGDFDDYRMIQAFNRMAFEPRHKVLAFDYTQTYENITRSQ 240
              +T+YQEF KML EDQ+DIF++GDFDDYR++Q  ++    + R+K L F + Q    NI +
Sbjct: 181 YTSYQEFHKMLNEDQIDIFILGDFDDYRVVQLIHQFPLDNRNKNLNFFHLQNSVNIIKES 240

Query: 241 VEDKDVNQSIMQLAYHLPITYKDEDYFALIVFNGLFGAFAHSLLFTEIREKQGLAYTIGS 300
              +E + V+QSI+QLAYH P  +   DY+AL++ NGL G+FAHS LF +IRE++GLAY+IG
Sbjct: 241 IEKRAVHQSILQLAYHFPSVFGQRDYYALVLLNGLLGSFAHSRLFIKIREEEGLAYSIGC 300

Query: 301 QFDSFTGLFTIYAGIDKENRERFLKLINKQFNNIKMGRFSSTLLKQTKDILKMNYVLASD 360
              +FDS+TGLF IY GID ++R + L+LI ++ N IKMGRFS  L+K+T+ +L  N +L+ D
Sbjct: 301 RFDSYTGLFEIYTGIDSQHRTKTLQLIIQELNAIKMGRFSEQLIKKTRSMLLNNALLSED 360

Query: 361 NPKVIVDHIYHEHYLDQFHTSALFIDKVDDVTKSDIVSVATKLKLQAFYFLEG         413
                K I++IY  Y+D ++    +I  V++V K+DI+ VA  LKLQ  YFLEG
Sbjct: 361 YNKNIIERIYRSSYIDSSYSIKNWIKGVNEVNKADIIKVANLLKLQTVYFLEG         413
```

SEQ ID 3154 (GBS400) was expressed in *E. coli* as a His-fusion product. SDS-PAGE analysis of total cell extract is shown in FIG. 76 (lane 2; MW 49.2 kDa). It was also expressed in *E. coli* as a GST-fusion product. SDS-PAGE analysis of total cell extract is shown in FIG. 84 (lane 3; MW 74 kDa) and in FIG. 177 (lane 6; MW 74 kDa).

GBS400-GST was purified as shown in FIG. 217, lane 10.

Based on this analysis, it was predicted that these proteins and their epitopes could be useful antigens for vaccines or diagnostics.

EXAMPLE 1025

A DNA sequence (GBSx1095) was identified in *S. agalactiae* <SEQ ID 3157> which encodes the amino acid sequence <SEQ ID 3158>. Analysis of this protein sequence reveals the following:

```
Possible site: 50
>>> Seems to have no N-terminal signal sequence

----- Final Results -----
          bacterial cytoplasm --- Certainty = 0.3473 (Affirmative) < succ>
          bacterial membrane  --- Certainty = 0.0000 (Not Clear)   < succ>
            bacterial outside --- Certainty = 0.0000 (Not Clear)   < succ>
```

A related DNA sequence was identified in *S. pyogenes* <SEQ ID 3159> which encodes the amino acid sequence <SEQ ID 3160>. Analysis of this protein sequence reveals the following:

```
Possible site: 45
>>>Seems to have no N-terminal signal sequence

----- Final Results -----
          bacterial cytoplasm --- Certainty = 0.4298 (Affirmative) < succ>
          bacterial membrane  --- Certainty = 0.0000 (Not Clear)   < succ>
            bacterial outside --- Certainty = 0.0000 (Not Clear)   < succ>
```

An alignment of the GAS and GBS proteins is shown below.

```
Identities = 207/424 (48%), Positives = 276/424 (64%), Gaps = 3/424 (0%)

Query:   5 KITYQNLQEEVYKLTLESGLNVYLIPKPSFKETVGVLTANFGSLHTKYTRNGCVEHYPAG  64
             KI Y N+ E++Y + LE+GL VY I K   F E   +LT FGSL  K T     PAG
Sbjct:   6 KINYPNIDEDLYYVKLENGLTVYFIKKIGFLEKTAMLTVGFGSLDNKLTVDDESRDAPAG  65

Query:  65 IAHFLEHKLFELDKGQDAATQFTKYGAESNAFTTFDKTSFYFSTISHITNCLDILLDFVL 124
             IAHFLEHKLFE + G D + +FT+ GAE+NAFTTF++TSF+FST S     L++L  FVL
Sbjct:  66 IAHFLEHKLFEDESGGDISLKFTQLGAETNAFTTFNQTSFFFSTASKFQENLELLQYFVL 125

Query: 125 TTNFTEESITKEKDIIKQEIEMYQDDPEYRLYQGVLSNLYPNSPLAFDIAGDYQSISQIT 184
             +  N T+ES+++EK  II QEI+MYQDD +YR Y G+L NL+P + LA DIAG   SI +IT
Sbjct: 126 SANITDESVSREKKIIGQEIDMYQDDADYRAYSGILQNLFPKTSLANDIAGSKASIQKIT 185
```

```
                       -continued
Query: 185 LTDLQENHKDFYQLSNMNLVLVGQFSPQEIITYLQKNSHFTSY--SQNIDRDSISLEPVI 242
           L+ +H  FYQ +NM+L +VG      E   +Q+       SY  + + D +   PVI
Sbjct: 186 KILLETHHTYFYQPTNMSLFIVGDIDIDETFLAIQRFQTTLSYPDRKRVTVDPLHYYPVI 245

Query: 243 KNNSCHMTVTKPKLAIGYRKSNHMIHGSYLKEKIGLQLFFAMLLGWTSTINQDWYESGQI 302
           K++S  M VT KL +G+R    +  S L  +I L+LF +ML+GWTS I    YE G+I
Sbjct: 246 KSSSVDMDVTTAKLVVGFRGYLTLTQHSLLTYRIALKLFLSMLIGWTSKIYHTLYEDGKI 305

Query: 303 DDSFDIEIEVHPDFECVIISLDTTEPIAFSTQLRLLLKNALQSSDLTESHLKNVKRELYG 362
           DDSFD+++E+H +F+ V+ISLDT EPIA S  +R  L       S + T  HL  +K+E+YG
Sbjct: 306 DDSFDVDVEIHHNFQFVLISLDTPEPIAMSNYIRQKLATIKISKEFTNEHLNLLKKEMYG 365

Query: 363 DFLRSLDSIENLAMQFVTYLYDG-KTMYLDLPSIVEELDLEDVITIGKDFLDNADTSDFV 421
           DF++SLDSIE+L  QF  YL D  K  Y D+P I+E L L+DV+TIGK F + AD SDF
Sbjct: 366 DFIQSLDSIEHLTHQFSLYLSDSDKETYFDIPKIIERLTLKDVVTIGKAFFEKADASDFT 425

Query: 422 IFPK                                                         425
           +FPK
Sbjct: 426 VFPK                                                         429
```

Based on this analysis, it was predicted that these proteins and their epitopes could be useful antigens for vaccines or diagnostics.

EXAMPLE 1026

A DNA sequence (GBSx1096) was identified in *S. agalactiae* <SEQ ID 3161> which encodes the amino acid sequence <SEQ ID 3162>. This protein is predicted to be phosphotidylglycerophosphate synthase (pgsA). Analysis of this protein sequence reveals the following:

```
Possible site: 55
>>> Seems to have no N-terminal signal sequence
      INTEGRAL    Likelihood = -8.17    Transmembrane     17-33 (14-39)
      INTEGRAL    Likelihood = -3.77    Transmembrane     92-108 (88-108)
      INTEGRAL    Likelihood = -2.87    Transmembrane    144-160 (142-162)
      INTEGRAL    Likelihood = -1.65    Transmembrane     42-58 (42-59)

----- Final Results -----
            bacterial membrane --- Certainty = 0.4270(Affirmative) < succ>
             bacterial outside --- Certainty = 0.0000(Not Clear)   < succ>
           bacterial cytoplasm --- Certainty = 0.0000(Not Clear)   < succ>
```

A related GBS nucleic acid sequence <SEQ ID 10293> which encodes amino acid sequence <SEQ ID 10294> was also identified.

A related DNA sequence was identified in *S. pyogenes* <SEQ ID 3163> which encodes the amino acid sequence <SEQ ID 3164>. Analysis of this protein sequence reveals the following:

```
Possible site: 48
>>> Seems to have a cleavable N-term signal seq.
      INTEGRAL    Likelihood = -6.64    Transmembrane     76-92 (72-102)
      INTEGRAL    Likelihood = -5.36    Transmembrane    136-152 (131-164)
      INTEGRAL    Likelihood = -2.34    Transmembrane     98-114 (97-114)

----- Final Results -----
            bacterial membrane --- Certainty = 0.3654(Affirmative) < succ>
             bacterial outside --- Certainty = 0.0000(Not Clear)   < succ>
           bacterial cytoplasm --- Certainty = 0.0000(Not Clear)   < succ>
```

An alignment of the GAS and GBS proteins is shown below.

```
Identities = 145/180 (80%), Positives = 160/180 (88%)

Query:  8 MMKKENIPNLLTVVRILMIPLFIVLTSVTTSTTWHIVAAIVFAIASLTDYLDGYLARKWQ  67
          M+KKENIPNLLT+VRI MIP F+ +TS +    WHI AA++FAIAS TDYLDGYLARKW
```

-continued
```
Sbjct:    1 MIKKSNIPNLLTLVRIAMIPFFLFITSSSNKVGWHIFAAVIFAIASFTDYLDGYLARKWH    60
Query:   68 VVTNFGKFADPLADKMLVMSAFIMLVGLDLAPAWVSAIIICRELAVTGLRLLLVETGGTV   127
            V +NFGKFADPLADKMLVMSAFIMLVGL L PAWVSA+IICRELAVTGLRLLLVETGG V
Sbjct:   61 VASNFGKFADPLADKMLVMSAFIMLVGLGLVPAWVSAVIICRELAVTGLRLLLVETGGKV   120
Query:  128 LAAAMPGKIKTATQMFAVIFLLVHWMTLGNIMLYIALFFTLYSGYDYFKGAGFLFKDTFK   187
            LAAAMPGKIKTATQM ++I LL HW+ LGN++LYIALFFT+YSGYDYFKGA FLFKDTFK
Sbjct:  121 LAAAMPGKIKTATQMLSIILLLCHWIFLGNVLLYIALFFTIYSGYDYFKGASFLFKDTFK   180
```

A related GBS gene <SEQ ID 8705> and protein <SEQ ID 8706> were also identified. Analysis of this protein sequence reveals the following:

```
Lipop Possible site: -1 Crend: 4
SRCFLG: 0
McG: Length of UR: 9
     Peak Value of UR: 3.03
     Net Charge of CR: 1
McG: Discrim Score: 6.36
GvH: Signal Score (-7.5): -0.400001
     Possible site: 48
>>> Seems to have a cleavable N-term signal seq.
Amino Acid Composition: calculated from 49
ALOM program count: 2 value: -3.77 threshold: 0.0
    INTEGRAL      Likelihood = -3.77    Transmembrane    85-101 (81-101)
    INTEGRAL      Likelihood = -2.87    Transmembrane   137-153 (135-155)
    PERIPHERAL    Likelihood = 1.27     109
modified ALOM score: 1.25
icm1 HYPID: 7 CFP: 0.251
*** Reasoning Step: 3

----- Final Results -----
              bacterial membrane --- Certainty = 0.2508(Affirmative) < succ>
              bacterial outside  --- Certainty = 0.0000(Not Clear)   < succ>
            bacterial cytoplasm  --- Certainty = 0.0000(Not Clear)   < succ>
```

Based on this analysis, it was predicted that these proteins and their epitopes could be useful antigens for vaccines or diagnostics.

EXAMPLE 1027

A DNA sequence (GBSx1097) was identified in *S. agalactiae* <SEQ ID 3165> which encodes the amino acid sequence <SEQ ID 3166>. This protein is predicted to be ABC transporter ATP-binding protein (potA): Analysis of this protein sequence reveals the following:

```
Possible site: 32
>>> Seems to have no N-terminal signal sequence

----- Final Results -----
            bacterial cytoplasm --- Certainty = 0.1805(Affirmative) < succ>
              bacterial membrane --- Certainty = 0.0000(Not Clear)   < succ>
                bacterial outside --- Certainty = 0.0000(Not Clear)   < succ>
```

The protein has homology with the following sequences in the GENPEPT database.

```
>GP:AAC61484 GB:AF082738 ABC transporter ATP-binding protein
           [Streptococcus pyogenes]
 Identities = 201/279 (72%), Positives = 231/279 (82%)

Query:    1 MTNIITVNNLFFKYDSNQTHYQLENVSFHVKQGEWLSIIGHNGSGKSTTVRLIDGLLEAE    60
            M+ II +  + F Y  +Q   L+ VSFHVKQGEWLSIIGHNGSGKSTT+RLIDGLLE E
Sbjct:   18 MSAIIELKKVTFNYHKDQEKPTLDGVSFHVKQGEWLSIIGHNGSGKSTTIRLIDGLLEPE    77

Query:   61 SGQIIIDGQELTEDNVWELRHKIGMVFQNPDNQFVGATVEDDVAFGLENKGIPLKDMKER   120
            SG II+DG  LT  NVWE+RHKIGMVFQNPDNQFVGATVEDDVAFGLENKGI +D+KER
Sbjct:   78 SGSIIVDGDLLTITNVWEIRHKIGMVFQNPDNQFVGATVEDDVAFGLENKGIAHEDIKER   137

Query:  121 VDQALDLVGMSEFKMREPARLSGGQKQRVAIAGAVAMRPQVIILDEATSMLDPEGRLELI   180
```

```
                V+ AL+LVGM  FK +EPARLSGGQKQRVAIAGAVAM+P++IILDEATSMLDP+GRLELI
Sbjct: 138 VNHALELVGMQNFKEKEPARLSGGQKQRVAIAGAVAMKPKIIILDEATSMLDPKGRLELI 197

Query: 181 RTIRAIRQKYNLTVISITHDLDEVALSDRVIVMKNGKVESTSTPKALFGRGNRLISLGLD 240
           +TI+ IR  Y LTVISITHDLDEVALSDRV+VMK+G+VESTSTP+ LF RG+ L+ LGLD
Sbjct: 198 KTIKNIRDDYQLTVISITHDLDEVALSDRVLVMKDGQVESTSTPEQLFARGDELLQLGLD 257

Query: 241 VPFTSRLMAELAANGLDIGTEYLTEKELEEQLWELNLKM                     279
           +PFT+ ++ L    G I   YLTEKELE QL +L  KM
Sbjct: 258 IPFTTSVVQMLQEEGYPIDYGYLTEKELENQLCQLISKM                     296
```

A related DNA sequence was identified in *S. pyogenes* <SEQ ID 3167> which encodes the amino acid sequence <SEQ ID 3168>. Analysis of this protein sequence reveals the following:

```
    Possible site: 19
>>> Seems to have no N-terminal signal sequence

----- Final Results -----
            bacterial cytoplasm --- Certainty = 0.2235 (Affirmative) < succ>
            bacterial membrane  --- Certainty = 0.0000 (Not Clear)   < succ>
            bacterial outside   --- Certainty = 0.0000 (Not Clear)   < succ>

RGD motif: 247-249
```

An alignment of the GAS and GBS proteins is shown below.

```
Identities = 200/279 (71%), Positives = 231/279 (82%)

Query:   1 MTNIITVNNLFFKYDSNQTHYQLENVSFHVKQGEWLSIIGHNGSGKSTTVRLIDGLLEAE  60
           M+ II +  + F Y  +Q    L+ VSFHVKQGEWLSIIGHNGSGKSTT+RLIDGLLE E
Sbjct:  18 MSAIIELKKVTFNYHKDQEKPTLDGVSFHVKQGEWLSIIGHNGSGKSTTIRLIDGLLEPE  77

Query:  61 SGQIIIDGQELTEDNVWELRHKIGMVFQNPDNQFVGATVEDDVAFGLENKGIPLKDMKER 120
           SG II+DG  LT  NVWE+RHKIGMVFQNPDNQFVGATVEDDVAFGLENKGI  +D+KER
Sbjct:  78 SGSIIVDGDLLTITNVWEIRHKIGMVFQNPDNQFVGATVEDDVAFGLENKGIAHEDIKER 137

Query: 121 VDQALDLVGMSEFKMREPARLSGGQKQRVAIAGAVAMRPQVIILDEATSMLDPEGRLELI 180
                V+ AL+LVGM  FK +EPARLSGGQKQRVAIAGAVAM+P++IILDEATSMLDP+GRLELI
Sbjct: 138 VNHALELVGMQNFKEKEPARLSGGQKQRVAIAGAVAMKPKIIILDEATSMLDPKGRLELI 197

Query: 181 RTIRAIRQKYNLTVISITHDLDEVALSDRVIVMKNGKVESTSTPKALFGRGNRLISLGLD 240
           +TI+ IR  Y LTVISITHDLDEVALSDRV+VMK+G+VESTSTP+ LF RG+ L+ LGLD
Sbjct: 198 KTIKNIRDDYQLTVISITHDLDEVALSDRVLVMKDGQVESTSTPEQLFARGDELLQLGLD 257

Query: 241 VPFTSRLMAELAANGLDIGTEYLTEKELEEQLWELNLKM                     279
           +PFT+ ++ L    G +   YLTEKELE QL +L  KM
Sbjct: 258 IPFTTSVVQMLQEEGYPIDYGYLTEKELENQLCQLISKM                     296
```

Based on this analysis, it was predicted that these proteins and their epitopes could be useful antigens for vaccines or diagnostics.

EXAMPLE 1028

A DNA sequence (GBSx1098) was identified in *S. agalactiae* <SEQ ID 3169> which encodes the amino acid sequence <SEQ ID 3170>. Analysis of this protein sequence reveals the following:

```
Possible site: 49
>>> Seems to have no N-terminal signal sequence
    INTEGRAL    Likelihood = -0.27    Transmembrane  154-170 (154-170)

----- Final Results -----
            bacterial membrane  --- Certainty = 0.1107 (Affirmative) < succ>
            bacterial outside   --- Certainty = 0.0000 (Not Clear)   < succ>
            bacterial cytoplasm --- Certainty = 0.0000 (Not Clear)   < succ>
```

The protein has homology with the following sequences in the GENPEPT database.

```
>GP: CAB11922 GB: Z99104 similar to ABC transporter (ATP-binding
protein) [Bacillus subtilis]
Identities = 141/242 (58%), Positives = 188/242 (77%), Gaps = 1/242 (0%)

Query:   16 TPFEGRALFDVNLKIEDASYTAFIGHTGSGKSTIMQLLNGLHIPTKGEVIVDDFSIKAGD   75
            TPFE  AL+D+N I++ SY A IGHTGSGKST++Q LNGL  PTKG++ +    I+AG
Sbjct:    3 TPFERLALYDINASIKEGSYVAVIGHTGSGKSTLLQHLNGLLKPTKGQISLGSTVIQAGK   62

Query:   76 KNKEIKFIRQKVGLVFQFPESQLFEETVLKDVAFGPQNFGISQIEAERLAEEKLRLVGIS  135
            KNK++K +R+KVG+VFQFPE QLFEETVLKD++FGP NFG+ + +AE+ A E L+LVG+S
Sbjct:   63 KNKDLKKLRKKVGIVFQFPEHQLFEETVLKDISFGPMNFGVKKEDAEQKAREMLQLVGLS  122

Query:  136 EDLFDKNPFELSGGQMRRVAIAGILAMEPKVLVLDEPTAGLDPKGRKELMTLFKNLHKKG  195
            E+L D++PFELSGGQMRRVAIAG+LAM+P+VLVLDEPTAGLDP+GRKE+M +F  LH++G
Sbjct:  123 EELLDRSPFELSGGQMRRVAIAGVLAMDPEVLVLDEPTAGLDPRGRKEIMDMFYELHQRG  182

Query:  196 -MTIVLVTHLMDDVADYADYVYVLEAGKVTLSGQPKQIFQEVELLESKQLGVPKITKFAQ  254
             +T+LVTH M+D A YAD + V+  G + SG P+ +F + E +    L +P+  KF +
Sbjct:  183 NLTTILVTHSMEDAAAYADEMIVMHKGTIQASGSPRDLFLKGEEMAGWGLDLPETIKFQR  242

Query:  255 RL                                                           256
            L
Sbjct:  243 HL                                                           244
```

A related DNA sequence was identified in *S. pyogenes* <SEQ ID 3171> which encodes the amino acid sequence <SEQ ID 3172>. Analysis of this protein sequence reveals the following:

```
Possible site: 40

>>> Seems to have no N-terminal signal sequence
    INTEGRAL    Likelihood = -0.27    Transmembrane    154-170 (154-170)

----- Final Results -----
              bacterial membrane --- Certainty = 0.1107(Affirmative) < succ>
               bacterial outside --- Certainty = 0.0000(Not Clear)   < succ>
             bacterial cytoplasm --- Certainty = 0.0000(Not Clear)   < succ>
```

The protein has homology with the following sequences in the databases:

```
>GP: CAB11922 GB: Z99104 similar to ABC transporter (ATP-binding
protein) [Bacillus subtilis]
Identities = 146/259 (56%), Positives = 187/259 (71%), Gaps = 2/259 (0%)

Query:   16 TPFEGRALFNINLDILDGSYTAFIGHTGSGKSTIMQLLNGLHVPTTGIVSVDKQDITNHS   75
            TPFE  AL++IN  I +GSY A IGHTGSGKST++Q LNGL  PT G +S+      I
Sbjct:    3 TPFERLALYDINASIKEGSYVAVIGHTGSGKSTLLQHLNGLLKPTKGQISLGSTVIQAGK   62

Query:   76 KNKEIKSIRKHVGLVFQFPESQLFEETVLKDVAFGPQNFGVSPEEAEALAREKLALVGIS  135
            KNK++K +RK VG+VFQFPE QLFEETVLKD++FGP NFGV  E+AE  ARE L LVG+S
Sbjct:   63 KNKDLKKLRKKVGIVFQFPEHQLFEETVLKDISFGPMNFGVKKEDAEQKAREMLQLVGLS  122

Query:  136 ENLFEKNPFELSGGQMRRVAIAGILAMQPKVLVLDEPTAGLDPKGRKELMTIFKKLHQSG  195
            E L +++PFELSGGQMRRVAIAG+LAM P+VLVLDEPTAGLDP+GRKE+M +F  LHQ G
Sbjct:  123 EELLDRSPFELSGGQMRRVAIAGVLAMDPEVLVLDEPTAGLDPRGRKEIMDMFYELHQRG  182

Query:  196 -MTIVLVTHLMDDVANYADFVYVLDKGKIILSGKPKTIFQQVSLLEKKQLGVPKVTKLAQ  254
             +T +LVTH M+D A YAD  V+ KG I  SG P+ +F +  +    L +P+  K  +
Sbjct:  183 NLTTILVTHSMEDAAAYADEMIVMHKGTIQASGSPRDLFLKGEEMAGWGLDLPETIKFQR  242

Query:  255 RL-VDRGIPISSLPITLEE                                          272
            L     G+ +   +T+E+
Sbjct:  243 HLEAALGVRFNEPMLTIED                                          261
```

An alignment of the GAS and GBS proteins is shown below.

```
Identities = 218/280 (77%), Positives = 241/280 (85%)

Query:    1 MGIEFKNVSYTYQAGTPFEGRALFDVNLKIEDASYTAFIGHTGSGKSTIMQLLNGLHIPT    60
            M I  +NVSYTYQAGTPFEGRALF++NL I D SYTAFIGHTGSGKSTIMQLLNGLH+PT
Sbjct:    1 MSINLQNVSYTYQAGTPFEGRALFNINLDILDGSYTAFIGHTGSGKSTIMQLLNGLHVPT    60

Query:   61 KGEVIVDDFSIKAGDKNKEIKFIRQKVGLVFQFPESQLFEETVLKDVAFGPQNFGISQIE   120
               G V VD  I    KNKEIK IR+ VGLVFQFPESQLFEETVLKDVAFGPQNFG+S  E
Sbjct:   61 TGIVSVDKQDITNHSKNKEIKSIRKHVGLVFQFPESQLFEETVLKDVAFGPQNFGVSPEE   120

Query:  121 AERLAEEKLRLVGISEDLFDKNPFELSGGQMRRVAIAGILAMEPKVLVLDEPTAGLDPKG   180
            AE  LA EKL LVGISE+LF+KNPFELSGGQMRRVAIAGILAM+PKVLVLDEPTAGLDPKG
Sbjct:  121 AEALAREKLALVGISENLFEKNPFELSGGQMRRVAIAGILAMQPKVLVLDEPTAGLDPKG   180

Query:  181 RKELMTLFKNLHKKGMTIVLVTHLMDDVADYADYVYVLEAGKVTLSGQPKQIFQEVELLE   240
            RKELMT+FK LH+ GMTIVLVTHLMDDVA+YAD+VYVL+ GK+ LSG+PK IFQ+V LLE
Sbjct:  181 RKELMTIFKKLHQSGMTIVLVTHLMDDVANYADFVYVLDKGRIILSGKPKTIFQQVSLLE   240

Query:  241 SKQLGVPKITKFAQRLSHKGLNLPSLPITINEFVEAIKHG                      280
            +KQLGVPK+TK AQRL  +G+ + SLPIT+ E  E +KHG
Sbjct:  241 KKQLGVPKVTKLAQRLVDRGIPISSLPITLEELREVLKHG                      280
```

SEQ ID 3170 (GBS401) was expressed in *E. coli* as a His-fusion product. SDS-PAGE analysis of total cell extract is shown in FIG. 76 (lane 3; MW 34 kDa). It was also expressed in *E. coli* as a GST-fusion product. SDS-PAGE analysis of total cell extract is shown in FIG. 84 (lane 4; MW 59 kDa).

GBS401-GST was purified as shown in FIG. 218, lane 2.

Based on this analysis, it was predicted that these proteins and their epitopes could be useful antigens for vaccines or diagnostics.

EXAMPLE 1029

A DNA sequence (GBSx1099) was identified in *S. agalactiae* <SEQ ID 3173> which encodes the amino acid sequence <SEQ ID 3174>. Analysis of this protein sequence reveals the following:

```
Possible site: 43
>>> Seems to have no N-terminal signal sequence
    INTEGRAL     Likelihood = -10.46    Transmembrane      47-63  (25-69)
    INTEGRAL     Likelihood =  -8.81    Transmembrane    252-268  (249-269)
    INTEGRAL     Likelihood =  -7.91    Transmembrane    116-132  (110-141)
    INTEGRAL     Likelihood =  -4.25    Transmembrane      29-45  (25-46)
    INTEGRAL     Likelihood =  -2.55    Transmembrane      77-93  (77-95)
    INTEGRAL     Likelihood =  -0.43    Transmembrane    199-215  (199-215)

----- Final Results -----
            bacterial membrane  --- Certainty = 0.5182(Affirmative) < succ>
             bacterial outside  --- Certainty = 0.0000(Not Clear)   < succ>
           bacterial cytoplasm  --- Certainty = 0.0000(Not Clear)   < succ>
```

A related GBS nucleic acid sequence <SEQ ID 8707> which encodes amino acid sequence <SEQ ID 8708> was also identified. Analysis of this protein sequence reveals the following:

```
Lipop: Possible site: -1 Crend: 7
SRCFLG: 0
McG: Length of UR: 8
     Peak Value of UR: 0.65
     Net Charge of CR: 1
McG: Discrim Score: -10.55
GvH: Signal Score (-7.5): 1.45
     Possible site: 37
>>> Seems to have no N-terminal signal sequence
Amino Acid Composition: calculated from 1
ALOM program count: 6 value: -10.46 threshold: 0.0
    INTEGRAL     Likelihood = -10.46    Transmembrane     41-57  (19-63)
    INTEGRAL     Likelihood =  -8.81    Transmembrane   246-262  (243-263)
    INTEGRAL     Likelihood =  -7.91    Transmembrane   110-126  (104-135)
    INTEGRAL     Likelihood =  -4.25    Transmembrane     23-39  (19-40)
    INTEGRAL     Likelihood =  -2.55    Transmembrane     71-87  (71-89)
    INTEGRAL     Likelihood =  -0.43    Transmembrane   193-209  (193-209)
    PERIPHERAL   Likelihood =   0.79                       90
modified ALOM score: 2.59
icm1 HYPID: 7 CFP: 0.518
*** Reasoning Step: 3
```

----- Final Results -----
```
              bacterial membrane  --- Certainty = 0.5182(Affirmative) < succ>
              bacterial outside   --- Certainty = 0.0000(Not Clear)   < succ>
           bacterial cytoplasm    --- Certainty = 0.0000(Not Clear)   < succ>
```

The protein has homology with the following sequences in the GENPEPT database.

```
>GP:CAB11923 GB:Z99104 ybaF [Bacillus subtilis]
 Identities = 133/263 (50%), Positives = 191/263 (72%)

Query:    7 MDKLILGRYIPGNSLIHKLDPRSKLLAMLLFIIIVFWANNVVTNVIVFIFTLVIVGLSQI   66
            MD +I+G+Y+PG SL+H+LDPR+KL+ +  LF+ IVF ANNV T   ++ +FT+ +V L+++
Sbjct:    2 MDSMIIGKYVPGTSLVHRLDPRTKLITIFLFVCIVFLANNVQTYALLGLFTIGVVSLTRV   61

Query:   67 KFSYFFNGIKPMVGIILFTTLFQMLFAQGGQVIFSFWIFSITSLGLQQAALIFMRFVLII  126
            FS+   G+KP++  I+LFT L  +L     G +IF     +  GL Q    I +RFV +I
Sbjct:   62 PFSFLMKGLKPIIWIVLFTFLLHILMTHEGPIIFQIGFSRVYEGGLVQGIFISLRFVYLI  121

Query:  127 FFSTLLTLTTTPLSLADAVESLLKPLEVLRVPAHEIGLMLSLSLRFVPTLMDDTTRIMNA  186
            +TLLTLTTTP+ +  D +E LL PL+ L++P HE+ LM+S+SLRF+PTLM++T +IM A
Sbjct:  122 LITTLLTLTTTPIEITDGMEQLLNPLKKLKLPVHELALMMSISLRFIPTLMEETDKIMKA  181

Query:  187 QRARGVDFGEGNLIHKVKSIIPILIPLFASSFKRADALAIAMEARGYQGGANRSKYRLLK  246
            Q ARGVDF G +  +VK+I+P+L+PLF S+FKRA+ LA+AMEARGYQGG  R+KYR L
Sbjct:  182 QMARGVDFTSGPVKERVKAIVPLLVPLFVSAFKRAEELAVAMEARGYQGGEGRTKYRKLV  241

Query:  247 WTVRDTFSILLMLLLGLSLFLLK                                      269
            WT +DT  I+ +++L   LF L+
Sbjct:  242 WTGKDTSVIVSLIVLAALLFSLR                                      264
```

A related DNA sequence was identified in *S. pyogenes* <SEQ ID 3175> which encodes the amino acid sequence <SEQ ID 3176>. Analysis of this protein sequence reveals the following:

```
    Possible site: 53
>>> Seems to have no N-terminal signal sequence
   INTEGRAL Likelihood = -9.50 Transmembrane 246-262  (243-265)
   INTEGRAL Likelihood = -9.34 Transmembrane 110-126  (103-135)
   INTEGRAL Likelihood = -6.69 Transmembrane  41-57   (40-58)
   INTEGRAL Likelihood = -2.81 Transmembrane  23-39   (21-40)
   INTEGRAL Likelihood = -1.01 Transmembrane  62-78   (62-78)
   INTEGRAL Likelihood = -0.27 Transmembrane 193-209  (193-209)

----- Final Results -----
   bacterial membrane  --- Certainty = 0.4800 (Affirmative) < succ>
    bacterial outside  --- Certainty = 0.0000 (Not Clear)   < succ>
  bacterial cytoplasm  --- Certainty = 0.0000 (Not Clear)   < succ>
```

The protein has homology with the following sequences in the databases:

```
>GP: CAB11923 GB: Z99104 ybaF [Bacillus subtilis]
Identities = 138/263 (52%), Positives = 195/263 (73%)

Query:    1 MDKLILGRYIPGDSLIHRLDPRSKLLAMIIYIVIIFWANNVVTNLLMLTFTLAVVFLSKI   60
            MD +I+G+Y+PG SL+HRLDPR+KL+ +   +++I+F ANNV T  L+  FT+ VV L+++
Sbjct:    2 MDSMIIGKYVPGTSLVHRLDPRTKLITIFLFVCIVFLANNVQTYALLGLFTIGVVSLTRV   61

Query:   61 KLSFFLNGVKPMIGIILFTTLFQMFFSQGGKVIFSWWFISITDLGLSQAILIFMRFVLII  120
            + SF + G+KP+I  I+LFT L  +    G +IF  F    + LGL Q  I +RFV +I
Sbjct:   62 PFSFLMKGLKPIIWIVLFTFLLHILMTHEGPIIFQIGFSRVYEGGLVQGIFISLRFVYLI  121

Query:  121 FFSTLLTLTTTPLSLSDAVESLLKPLTRFKVPAHEIGLMLSLSLRFVPTLMDDTTRIMNA  180
            +TLLTLTTTP+ ++D +E LL PL + +P HE+ LM+S+SLRF+PTLM++T +IM A
Sbjct:  122 LITTLLTLTTTPIEITDGMEQLLNPLKKLKLPVHELALMMSISLRFIPTLMEETDKIMKA  181

Query:  181 QRARGVDFGEGNLIQKVKSIIPILIPLFASSFKRADALAIAMEARGYQGGEGRTKYRQLD  240
            Q ARGVDF G +  ++VK+I+P+L+PLF S+FKRA+ LA+AMEARGYQGGEGRTKYR L
Sbjct:  182 QMARGVDFTSGPVKERVKAIVPLLVPLFVSAFKRAEELAVAMEARGYQGGEGRTKYRKLV  241
```

```
Query: 241 WQLKDSLAIGIVSLLGLLLFFLK                                    263
            W  KD+  I  +  +L  LLF L+
Sbjct: 242 WTGKDTSVIVSLIVLAALLFSLR                                    264
```

An alignment of the GAS and GBS proteins is shown below.

```
Identities = 210/263 (79%), Positives = 237/263 (89%)

Query:   7 MDKLILGRYIPGNSLIHKLDPRSKLLAMLLFIIIVFWANNVVTNVIVFIFTLVIVGLSQI   66
           MDKLILGRYIPG+SLIH+LDPRSKLLAM+++I+I+FWANNVVTN+++  FTL +V LS+I
Sbjct:   1 MDKLILGRYIPGDSLIHRLDPRSKLLAMIIYIVIIFWANNVVTNLLMLTFTLAVVFLSKI   60

Query:  67 KFSYFFNGIKPMVGIILFTTLFQMLFAQGGQVIFSFWIFSITSLGLQQAALIFMRFVLII  126
           K S+F NG+KPM+GIILFTTLFQM F+QGG+VIFS+W  SIT LGL QA LIFMRFVLII
Sbjct:  61 KLSFFLNGVKPMIGIILFTTLFQMFFSQGGKVIFSWWFISITDLGLSQAILIFMRFVLII  120

Query: 127 FFSTLLTLTTTPLSLADAVESLLKPLEVLRVPAHEIGLMLSLSLRFVPTLMDDTTRIMNA  186
           FFSTLLTLTTTPLSL+DAVESLLKPL   +VPAHEIGLMLSLSLRFVPTLMDDTTRIMNA
Sbjct: 121 FFSTLLTLTTTPLSLSDAVESLLKPLTRFKVPAHEIGLMLSLSLRFVPTLMDDTTRIMNA  180

Query: 187 QRARGVDFGEGNLIHKVKSIIPILIPLFASSFKRADALAIAMEARGYQGGANRSKYRLLK  246
           QRARGVDFGEGNLI KVKSIIPILIPLFASSFKRADALAIAMEARGYQGG  R+KYR L
Sbjct: 181 QRARGVDFGEGNLIQKVKSIIPILIPLFASSFKRADALAIAMEARGYQGGEGRTKYRQLD  240

Query: 247 WTVRDTFSILLMLLLGLSLFLLK                                      269
           W ++D+ +I ++ LLGL LF LK
Sbjct: 241 WQLKDSLAIGIVSLLGLLLFFLK                                      263
```

Based on this analysis, it was predicted that these proteins and their epitopes could be useful antigens for vaccines or diagnostics.

EXAMPLE 1030

A DNA sequence (GBSx1101) was identified in *S. agalactiae* <SEQ ID 3179> which encodes the amino acid sequence <SEQ ID 3180>. This protein is predicted to be unnamed protein product. Analysis of this protein sequence reveals the following:

```
Possible site: 45
>>> Seems to have an uncleavable N-term signal seq
    INTEGRAL    Likelihood = -12.05   Transmembrane   22-38 (16-43)

----- Final Results -----
   bacterial membrane --- Certainty = 0.5819 (Affirmative) < succ>
    bacterial outside --- Certainty = 0.0000 (Not Clear) < succ>
  bacterial cytoplasm --- Certainty = 0.0000 (Not Clear) < succ>
```

A related DNA sequence was identified in *S. pyogenes* <SEQ ID 3181> which encodes the amino acid sequence <SEQ ID 3182>. Analysis of this protein sequence reveals the following:

```
Possible site: 31
>>> Seems to have a cleavable N-term signal seq.

----- Final Results -----
            bacterial outside --- Certainty = 0.3000(Affirmative) < succ>
           bacterial membrane --- Certainty = 0.0000(Not Clear) < succ>
          bacterial cytoplasm --- Certainty = 0.0000(Not Clear) < succ>
```

An alignment of the GAS and GBS proteins is shown below.

```
Identities = 116/233 (49%), Positives = 140/233 (59%), Gaps = 39/233 (16%)

Query:   9  KLNVKKHHLAYGAITLVALFSCILAVMVIFKSSQVTTESLSKADKVRVAKKSK-------   61
```

```
                K N+K+ +  +G     LVAL     ILA++  F S        T+S +K  + ++     K
Sbjct:     4    KENLKQRYFNFG---LVALALTILAIIFAFSSKNADTKSYAKKSESKMVTIDKAPKNNHA     60

Query:    62    MTKATSKSKVEDVKQAPKPSQASNEAPKSSSQSTEANSQQQVTASEEAAVEQAVVTENTP    121
                +TK  SK K + +    P P+  ++ AP                T +EE   V Q   VT
Sbjct:    61    ITKEESKEKAKSIASEPIPTVENSVAP---------------TVTEEVPVVQQEVT----    101

Query:   122    ATSQAQQAYAVTETTYRPAQHQTSGQVLSNGNTAGAIGSAAAAQMAAATGVPQSTWEHII    181
                          Q   V+  Y P    +  VLSNGNTAG +GS AAAQMAAATGVPQSTWEHII
Sbjct:   102    -----QTVQQVSSVAYNP-----NNVVLSNGNTAGIVGSQAAAQMAAATGVPQSTWEHII    151

Query:   182    ARESNGNPNVANASGASGLFQTMPGWGSTATVQDQVNSAIKAYRAQGLSAWGY          234
                ARESNGNPN ANASGASGLFQTMPGWGSTATV+DQVN+A+KAY AQGLSAWGY
Sbjct:   152    ARESNGNPNAANASGASGLFQTMPGWGSTATVEDQVNAALKAYSAQGLSAWGY          204
```

A related GBS gene <SEQ ID 8713> and protein <SEQ ID 8714> were also identified. Analysis of this protein sequence reveals the following:

```
Lipop: Possible site: -1 Crend: 8
McG: Discrim Score: 2.48
GvH: Signal Score (-7.5): -3.74
     Possible site: 45
>>> Seems to have an uncleavable N-term signal seq
ALOM program count: 1 value: -12.05 threshold: 0.0
     INTEGRAL       Likelihood = -12.05      Transmembrane   22-38 (16-43)
     PERIPHERAL     Likelihood = 4.29        156
modified ALOM score: 2.91
*** Reasoning Step: 3

----- Final Results -----
             bacterial membrane   --- Certainty = 0.5819(Affirmative) < succ>
             bacterial outside    --- Certainty = 0.0000(Not Clear)   < succ>
             bacterial cytoplasm  --- Certainty = 0.0000(Not Clear)   < succ>
```

The protein has homology with the following sequences in the databases:

```
61.8/68.7% over 114aa
Staphylococcus aureus
GP|7959131|secretory protein SAI-B Insert characterized
ORF01057(664-1002 of 1302)
GP|7959131|dbj|BAA95959.1||AB042839(119-233 of 233)secretory protein SAI-B
{Staphylococcus aureus}
% Match = 15.1
% Identity = 61.7    % Similarity = 68.7
Matches = 71   Mismatches = 34   Conservative Sub.s = 8
       438         468         498         528         558         588         618         648
IFKSSQVTTESLSKADKVRVAKKSKMTKATSKSKVEDVKQAPKPSQASNEAPKSSSQSTEANSQQQVTASEEAAVEQAVV VDQAHLVDLAHNHQDQLNAAPIKDGAYDIHFVKDGFQYNFTSNGTTWSWSYEAANGQTAGFSNVAGADYTTSYNQGSNVQ
         50       60       70      80       90      100     110
       678         708       735       762       792       822       852       882
TENTPATSQAQQAYAVTETTYRP-AQHQTSGQV-LSNGNTAGAIGSAAAAQMAAATGVPQSTWEHI IARESNGNPNVANA
: :   | |      ||:   |         ||  | ||||||||  | |||| |||||||||||  | |||||||||| |
SVSYNAQSSNSNVEAVSAPTYHNYSTSTTSSSVRLSNGNTAGATGSSAAQIMAQRTGVPASTWAAI IARESNGQVNAYNP
         130      140       150       160      170      180      190
       912         942       972       1002      1032      1062      1092      1122
SGASGLFQTMPGWGSTATVQDQVNSAIKAYRAQGLSAWGY**IAIN*LYTVVNNNYRLLKQINKNATVKL*RFYLFSGKE
||||||||||||||| | ||     |:|:|:||||||| |||:
SGASGLFQTMPGWGPTNTVDQQINAAVKAYKAQGLGAWGF
```

SEQ ID 3180 (GBS25) was expressed in *E. coli* as a His-fusion product. SDS-PAGE analysis of total cell extract is shown in FIG. 14 (lane 5; MW 25 kDa). It was also expressed in *E. coli* as a GST-fusion product. SDS-PAGE analysis of total cell extract is shown in FIG. 16 (lane 11; MW 50 kDa), FIG. 63 (lane 6; MW 50.3 kDa), FIG. 66 (lane 6; MW 50 kDa) and in FIG. 175 (lane 8 & 9; MW 50 kDa).

Purified GBS25-GST is shown in FIG. 9A, FIG. 193 (lane 11) and FIG. 210 (lane 5).

The purified GBS25-GST fusion product was used to immunise mice (lane 1+2+3 products; 20 μg/mouse). The resulting antiserum was used for Western blot (FIG. 95B), FACS (FIG. 95C), and in the in vivo passive protection assay (Table III). These tests confirm that the protein is immunoaccessible on GBS bacteria and that it is an effective protective immunogen.

Based on this analysis, it was predicted that these proteins and their epitopes could be useful antigens for vaccines or diagnostics.

EXAMPLE 1031

A DNA sequence (GBSx1103) was identified in *S. agalactiae* <SEQ ID 3183> which encodes the amino acid sequence <SEQ ID 3184>. This protein is predicted to be L-serine dehydratase 1 (sdaA-2). Analysis of this protein sequence reveals the following:

```
Possible site: 61
>>> Seems to have no N-terminal signal sequence
     INTEGRAL    Likelihood = -0.85    Transmembrane   205-221 (205-221)
     INTEGRAL    Likelihood = -0.59    Transmembrane   171-187 (171-187)
     INTEGRAL    Likelihood = -0.53    Transmembrane   226-242 (226-242)

----- Final Results -----
              bacterial membrane --- Certainty = 0.1341(Affirmative) < succ>
               bacterial outside --- Certainty = 0.0000(Not Clear) < succ>
             bacterial cytoplasm --- Certainty = 0.0000(Not Clear) < succ>
```

The protein has homology with the following sequences in the GENPEPT database.

```
>GP:CAB13459 GB:Z99112 similar to L-serine dehydratase [Bacillus subtilis]
 Identities = 176/289 (60%), Positives = 224/289 (76%), Gaps = 1/289 (0%)

Query:    1 MFYTIEELVEQANSQHKGNIAELMIQTEIEMTGRSREEIRYIMSRNLEVMKASVIDGLTP   60
            MF  ++EL+E    + +  I+++MI  E+E+T +++E+I    M   NL VM+A+V  GL
Sbjct:    1 MFRNVKELIE-ITKEKQILISDVMIAQEMEVTEKTKEDIFQQMDHNLSVMEAAVQKGLEG  59

Query:   61 SKSISGLTGGDAVKMDQYLQSGKTISDTTILAAVRNAMAVNELNAKKMGLVCATPTAGSAG 120
            S +GLTGGDAVK+  Y++SGK++S   IL AV  A+A NE+NA MG +CATPTAGSAG
Sbjct:   60 VTSQTGLTGGDAVKLQAYIRSGKSLSGPLILDAVSKAVATNEVNAAMGTICATPTAGSAG 119

Query:  121 CLPAVISTAIEKLNLTEEEQLDFLFTAGAFGLVIGNNASISGAEGGCQAEVGSASAMAAA 180
            +P +     EKLN T E+ + FLFTAGAFG V+ NNASISGA GGCQAEVGSAS MAAA
Sbjct:  120 VVPGTLFAVKEKLNPTREQMIRFLFTAGAFGFVVANNASISGAAGGCQAEVGSASGMAAA 179

Query:  181 ALVMAGGTPFQASQAIAFVIKNMLGLICDPVAGLVEVPCVKRNALGSSFALVAADMALA  240
            A+V  AGGTP Q+++A+A  +KNMLGL+CDPVAGLVEVPCVKRNA+G+S A++ADMALA
Sbjct:  180 AIVEMAGGTPEQSAEAMAITLKNMLGLVCDPVAGLVEVPCVKRNAMGASNAMIAADMALA 239

Query:  241 GIESQIPVDEVIDAMYQVGSSLPTAFRETAEGGLAATPTGRRYSKEIFG            289
            GI S+IP DEVIDAMY++G ++PTA RET +GGLAATPTGR    K+IFG
Sbjct:  240 GITSRIPCDEVIDAMYKIGQTMPTALRETGQGGLAATPTGRELEKKIFG            288
```

A related DNA sequence was identified in *S. pyogenes* <SEQ ID 3185> which encodes the amino acid sequence <SEQ ID 3186>. Analysis of this protein sequence reveals the following:

```
    Possible site: 55
>>> Seems to have no N-terminal signal sequence
   INTEGRAL Likelihood = -1.12 Transmembrane 196-212 (196-213)
   INTEGRAL Likelihood = -0.27 Transmembrane 226-242 (226-242)

----- Final Results -----
   bacterial membrane --- Certainty = 0.1447 (Affirmative) < succ>
    bacterial outside --- Certainty = 0.0000 (Not Clear) < succ>
  bacterial cytoplasm --- Certainty = 0.0000 (Not Clear) < succ>
```

The protein has homology with the following sequences in the databases:

```
>GP:CAB13459 GB:Z99112 similar to L-serine dehydratase [Bacillus subtilis]
 Identities = 173/289 (59%), Positives = 222/289 (75%), Gaps = 1/289 (0%)

Query:    1 MFYTIEELVKQADQQFNGNIAELMIATEVEMSGRNREDIIKIMSRNLQVMKAAVTEGLTS   60
            MF  ++EL++     ++   I+++MIA E+E++ + +EDI + M   NL VM+AAV +GL
Sbjct:    1 MFRNVKELIEITKEK-QILISDVMIAQEMEVTEKTKEDIFQQMDHNLSVMEAAVQKGLEG  59

Query:   61 TKSISGLTGGDAVKMDNYIKKGNSLSDTTILNAVRNAIAVNELNAKHGLVCATPTAGSAG 120
            S +GLTGGDAVK+  YI+G SLS    IL+AV  A+A NE+NA MG +CATPTAGSAG
Sbjct:   60 VTSQTGLTGGDAVKLQAYIRSGKSLSGPLILDAVSKAVATNEVNAAMGTICATPTAGSAG 119

Query:  121 CLPAVLATAIEKLDLSEKEQLEFLFTAGAFGLVIGNNASISGAEGGCQAEVGSAAAMSAA 180
            +P L    EKL+ + ++ + FLFTAGAFG V+ NNASISGA GGCQAEVGSA+ M+AA
Sbjct:  120 VVPGTLFAVKEKLNPTREQMIRFLFTAGAFGFVVANNASISGAAGGCQAEVGSASGMAAA 179
```

-continued

```
Query: 181 ALVKAAGGTSHQASQAIAFVIKNLLGLVCDPVAGLVEVPCVKRNALGASFALVAADMALA  240
            A+V+ AGGT Q+++A+A   +KN+LGLVCDPVAGLVEVPCVKRNA+GAS A++AADMALA
Sbjct: 180 AIVEMAGGTPEQSAEAMAITLKNMLGLVCDPVAGLVEVPCVKRNAMGASNAMIAAOMALA  239

Query: 241 DIDSQIPVDEVIDAMYQVGSAMPTAFRETAEGGLAATPTGRRYSVEIFG            289
            I S+IP DEVIDAMY++G  MPTA RET +GGLAATPTGR    +IFG
Sbjct: 240 GITSRIPCDEVIDAMYKIGQTMPTALRETGQGGLAATPTGRELEKKIFG            288
```

An alignment of the GAS and GBS proteins is shown below.

```
Identities = 244/290 (84%), Positives = 273/290 (94%)

Query:   1 MFYTIEELVEQANSQHKGNIAELMIQTEIEMTGRSREEIRYIMSRNLEVMKASVIDGLTP   60
           MFYTIEELV+QA+ Q  GNIAELMI TE+EM+GR+RE+I   IMSRNL+VMKA+V +GLT
Sbjct:   1 MFYTIEELVKQADQQFNGNIAELMIATEVEMSGRNREDIIKIMSRNLQVMKAAVTEGLTS  60

Query:  61 SKSISGLTGGDAVKMDQYLQSGKTISDTTILAAVRNAMAVNELNAKMGLVCATPTAGSAG  120
           +KSISGLTGGDAVKMD Y++  G ++SDTTIL AVRNA+AVNELNAKMGLVCATPTAGSAG
Sbjct:  61 TKSISGLTGGDAVKMDNYIKKGNSLSDTTILNAVRNAIAVNELNAKMGLVCATPTAGSAG  120

Query: 121 CLPAVISTAIEKLNLTEEEQLDFLFTAGAFGLVIGNNASISGAEGGCQAEVGSASAMAAA  180
           CLPAV++TAIEKL+L+E+EQL+FLFTAGAFGLVIGNNASISGAEGGCQAEVGSA+AM+AA
Sbjct: 121 CLPAVLATAIEKLDLSEKEQLEFLFTAGAFGLVIGNNASISGAEGGCQAEVGSAAAMSAA  180

Query: 181 ALVMAAGGTPFQASQAIAFVIKNMLGLICDPVAGLVEVPCVKRNALGSSFALVAADMALA  240
           ALV  AAGGT  QASQAIAFVIKN+LGL+CDPVAGLVEVPCVKRNALG+SFALVAADMALA
Sbjct: 181 ALVKAAGGTSHQASQAIAFVIKNLLGLVCDPVAGLVEVPCVKRNALGASFALVAADMALA  240

Query: 241 GIESQIPVDEVIDAMYQVGSSLPTAFRETAEGGLAATPTGRRYSKEIFGE           290
            I+SQIPVDEVIDAMYQVGS++PTAFRETAEGGLAATPTGRRYS EIFGE
Sbjct: 241 DIDSQIPVDEVIDAMYQVGSAMPTAFRETAEGGLAATPTGRRYSVEIFGE           290
```

SEQ ID 3184 (GBS358) was expressed in *E. coli* as a His-fusion product. SDS-PAGE analysis of total cell extract is shown in FIG. 176 (lane 6; MW 35 kDa).

Based on this analysis, it was predicted that these proteins and their epitopes could be useful antigens for vaccines or diagnostics.

EXAMPLE 1032

A DNA sequence (GBSx1104) was identified in *S. agalactiae* <SEQ ID 3187> which encodes the amino acid sequence <SEQ ID 3188>. Analysis of this protein sequence reveals the following:

```
Possible site: 28
>>> Seems to have a cleavable N-term signal seq.

----- Final Results -----
            bacterial outside  --- Certainty = 0.3000(Affirmative) < succ>
            bacterial membrane --- Certainty = 0.0000(Not Clear)   < succ>
            bacterial cytoplasm --- Certainty = 0.0000(Not Clear)  < succ>
```

The protein has homology with the following sequences in the GENPEPT database.

```
>GP:BAB06216 GB:AP001515 L-serine dehydratase beta subunit [Bacillus halodurans]
Identities = 101/216 (46%), Positives = 156/216 (71%), Gaps = 2/216 (0%)

Query:   4 LKFQSVFDIIGPVMIGPSSSHTAGAVRIGKVVHSIFGE-PSEVTFHLYNSFAKTYQGHGT   62
           +K+++VFDIIGPVMIGPSSSHTAGA RIG+V ++FG+ P     + Y SFA+TY+GHGT
Sbjct:   1 MKYRTVFDIIGPVMIGPSSSHTAGAARIGRVARTLFGQQPERCDIYFYGSFAETYKGHGT  60

Query:  63 DKALVAGILGMDTDNPDIKNSLEIAHQKGIKIYWDILKDSNSPHPNTAKITVKNGDRSMS  122
           D A+V GIL  DT +P I  SL++A +KG+++Y+    +++ + HPNTAK+ ++ G+  +
Sbjct:  61 DVAIVGGILDFDTFDPRIPRSLQLAKEKGVRVYFHE-EEAITDHPNTAKVVLQKGEDQLE  119

Query: 123 ITGVSIGGGNIQVTELNGFSVSLTMNTPTLIIVHQDIPGMIAKVTDILSDFNINIAQMNV  182
           + GVSIGGG I++ ELNGF + L+ N P +++VH D  G+IA V+++L+    INI  M V
Sbjct: 120 VVGVSIGGGKIEIVELNGFHLKLSGNHPAILVVHTDRFGVIASVSNMLAKHEINIGHMEV  179

Query: 183 TRESAGEKAIMIIEVDSRDCQQAVKKIEAIPHLHNV                         218
           +R+  G++A+M+IEVD     ++++E +P++  V
Sbjct: 180 SRKEKGKEALMVIEVDQNVDDLLLQELERLPNIVTV                         215
```

A related DNA sequence was identified in *S. pyogenes* <SEQ ID 3189> which encodes the amino acid sequence <SEQ ID 3190>. Analysis of this protein sequence reveals the following:

```
Possible site: 30
>>> Seems to have no N-terminal signal sequence

----- Final Results -----
            bacterial membrane --- Certainty = 0.0000(Not Clear) < succ>
            bacterial outside  --- Certainty = 0.0000(Not Clear) < succ>
            bacterial cytoplasm --- Certainty = 0.0000(Not Clear) < succ>
```

A related sequence was also identified in GAS <SEQ ID 9161> which encodes the amino acid sequence <SEQ ID 9162>. Analysis of this protein sequence reveals the following:

```
Possible Site: 28
>>> Seems to have a cleavable N-term signal seq.

----- Final Results -----
            bacterial outside  --- Certainty = 0.300(Affirmative) < succ>
            bacterial membrane --- Certainty = 0.000(Not Clear)   < succ>
            bacterial cytoplasm --- Certainty = 0.000(Not Clear)   < succ>
```

An alignment of the GAS and GBS proteins is shown below.

```
Identities = 187/223 (83%), Positives = 205/223 (91%), Gaps = 1/223 (0%)

Query:   1 MKHLKFQSVFDIIGPVMIGPSSSHTAGAVRIGKVVHSIFGE-PSEVTFHLYNSFAKTYQG  59
           M  KFQSVFDIIGPVMIGPSSSHTAGAVRIGKVVHSIFG+ P EVTFHLYNSFAKTY+G
Sbjct:   3 MNTQKFQSVFDIIGPVMIGPSSSHTAGAVRIGKVVHSIFGDIPDEVTFHLYNSFAKTYRG  62

Query:  60 HGTDKALVAGILGMDTDNPDIKNSLEIAHQKGIKIYWDILKDSNSPHPNTAKITVKNGDR 119
           HGTDKALVAGI+GM TDNPDIKNSLEIAHQKGIKIYWDILKDSN+PHPNT KI+VK  D+
Sbjct:  63 HGTDKALVAGIMGMGTDNPDIKNSLEIAHQKGIKIYWDILKDSNAPHPNTVKISVKKADK 122

Query: 120 SMSITGVSIGGGNIQVTELNGFSVSLTMNTPTLIIVHQDIPGMIAKVTDILSDFNINIAQ 179
           ++S+TGVSIGGGNIQVTELNGFSVSL+MNTPT++ VH+DIPGMIAKVTDILS  NINIA
Sbjct: 123 TLSVTGVSIGGGNIQVTELNGFSVSLSMNTPTIVTVHKDIPGMIAKVTDILSSNNINIAT 182

Query: 180 MNVTRESAGEKAIMIIEVDSRDCQQAVKKIEAIPHLHNVNFFD 222
           MNVTRESAGEKA MIIEVDSR+CQ+A  +I  IPH++NVNFFD
Sbjct: 183 MNVTRESAGEKATMIIEVDSRECQEAANQIAKIPHIYNVNFFD 225
```

Figure 188:
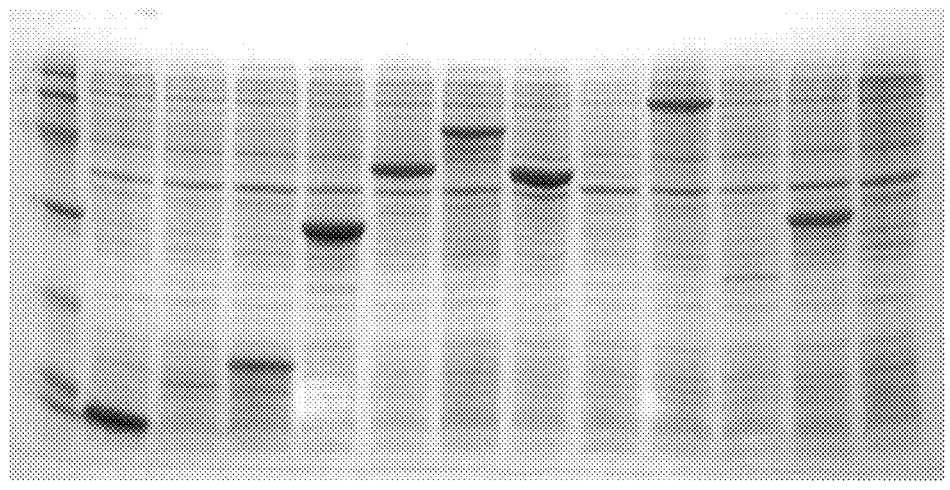

SEQ ID 3188 (GBS151) was expressed in *E. coli* as a GST-fusion product. SDS-PAGE analysis of total cell extract is shown in FIG. 31 (lane 3; MW 50 kDa). It was also expressed in *E. coli* as a His-fusion product. SDS-PAGE analysis of total cell extract is shown in FIG. 188 (lane 11; MW 25 kDa) and in FIG. 165 (lane 14-16; MW 25.3 kDa).

Figure 289:
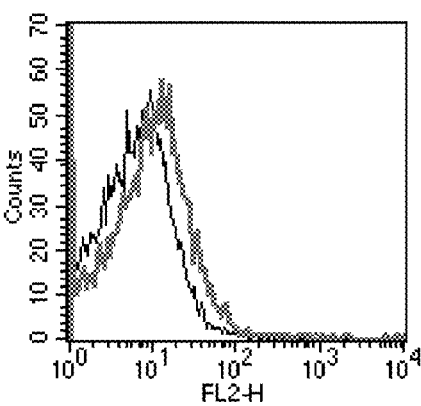

The GBS151-GST fusion product was purified (FIG. 198, lane 3; FIG. 236, lane 8) and used to immunise mice. The resulting antiserum was used for FACS (FIG. 289), which confirmed that the protein is immunoaccessible on GBS bacteria.

Figure 128:
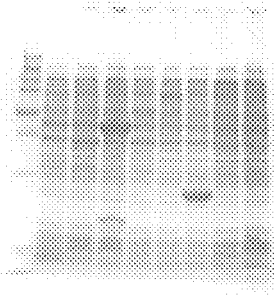

GBS151L was expressed in *E. coli* as a GST-fusion product. SDS-PAGE analysis of total cell extract is shown in FIG. 127 (lane 8-10; MW 50 kDa). GBS151L was also expressed in *E. coli* as a His-fusion product. SDS-PAGE analysis of total cell extract is shown in FIG. 127 (lane 11 & 12; MW 25 kDa), in FIG. 128 (lane 7; MW 25 kDa) and in FIG. 180 (lane 7; MW 25 kDa). Purified GBS151L-His is shown in FIG. 232 (lanes 5 & 6) and in FIG. 240 (lanes 3 & 4).

Based on this analysis, it was predicted that these proteins and their epitopes could be useful antigens for vaccines or diagnostics.

EXAMPLE 1033

A DNA sequence (GBSx1105) was identified in *S. agalactiae* <SEQ ID 3191> which encodes the amino acid sequence <SEQ ID 3192>. This protein is predicted to be tRNA (5-methylaminomethyl-2-thiouridylate)-methyltransferase (trmU). Analysis of this protein sequence reveals the following:

```
Possible site: 47
>>> Seems to have no N-terminal signal sequence

----- Final Results -----
            bacterial cytoplasm --- Certainty = 0.2208(Affirmative) < succ>
            bacterial membrane  --- Certainty = 0.0000(Not Clear)   < succ>
            bacterial outside   --- Certainty = 0.0000(Not Clear)   < succ>
```

A related GBS nucleic acid sequence <SEQ ID 10291> which encodes amino acid sequence <SEQ ID 10292> was also identified.

The protein has homology with the following sequences in the GENPEPT database.

```
>GP:BAB04980 GB:AP001511
         (5-methylaminomethyl-2-thiouridylate)-methyltran sferase
         [Bacillus halodurans]
 Identities = 250/359 (69%), Positives = 292/359 (80%), Gaps = 6/359 (1%)

Query:  32 RVVVGMSGGVDSSVTALLLKEQGYDVIGVFMKNWDDTDEFGVCTATEDYKDVAAVADQIG   91
           RVVVGMSGGVDSSVTALLLKEQGYDVIG+FMKNWDDTDE GVCTATEDY+DV V +Q+G
Sbjct:  10 RVVVGMSGGVDSSVTALLLKEQGYDVIGIFMKNWDDTDENGVCTATEDYQDVVQVCNQLG   69

Query:  92 IPYYSVNFEKEYWDRVFEYFLAEYRAGRTPNPDVMCNKEIKFKAFLDYAMTLGADYVATG  151
           I YY+VNFEKEYWD+VF YFL EY+AGRTPNPDVMCNKEIKFKAFL++A+TLGADYVATG
Sbjct:  70 IAYYAVNFEKEYWDKVFTYFLEEYKAGRTPNPDVMCNKEIKFKAFLNHALTLGADYVATG  129

Query: 152 HYAQVTRDENGIVHMLRGADNNKDQTYFLSQLSQEQLQKTLFPLGHLQKPEVRRIAEEAG  211
           HYAQV ++ +G   ++RG D NKDQTYFL+ LSQ+QL + +FPLGHL+K EVR IAE AG
Sbjct: 130 HYAQV-KNVDGQYQLIRGKDPNKDQTYFLNALSQQQLSRVMFPLGHLSKKEVRAIAERAG  188

Query: 212 LATAKKKDSTGICFIGEKNFKDFLGQYLPAQPGRMMTVDGRDMGEHAGLMYYTIGQRGGL  271
           LATAKKKDSTGICFIG+++FK+FL  YLPAQPG M T+DG   G H GLMYYT+GQR GL
Sbjct: 189 LATAKKKDSTGICFIGKRDFKEFLSSYLPAQPGEMQTLDGEVKGTHDGLMYYTLGQRQGL  248

Query: 272 GIGGQHGGDNKPWFVVGKDLSKNILYVGQGFYHDSLMSTSLTASEIHFTRDMPNEFKLEC  331
           GI    GG  +PWFV+GK+L KNILYVGQGF+H  L S   L A ++++      ++   EC
Sbjct: 249 GI----GGSGEPWFVIGKNLSKNILYVGQGFHHPGLYSEGLRAIKVNWILRRSSDEPFEC  304

Query: 332 TAKFRYRQPDSKVTVYVKGNQA-RVVFDDLQRAITPGQAVVFYNEQECLGGGMIDQAYR  389
           TAKFRYRQPD KVTVY + + A  V+F + QRAITPGQAVVFY+   CLGGG ID  +
Sbjct: 305 TAKFRYRQPDQKVTVYPQSDGAVEVLFAEPQRAITPGQAVVFYDGDVCLGGGTIDHVLK  363
                                                  30
```

A related DNA sequence was identified in *S. pyogenes* <SEQ ID 3193> which encodes the amino acid sequence <SEQ ID 3194>. Analysis of this protein sequence reveals the following:

```
Possible site: 29
>>> Seems to have no N-terminal signal sequence

----- Final Results -----
           bacterial cytoplasm --- Certainty = 0.1691(Affirmative) < succ>
            bacterial membrane --- Certainty = 0.0000(Not Clear) < succ>
              bacterial outside --- Certainty = 0.0000(Not Clear) < succ>
RGD motif: 331-333
```

The protein has homology with the following sequences in the databases:

```
>GP: BAB04980 GB: AP001511
(5-methylaminomethyl-2-thiouridylate)-methyltran sferase
[Bacillus halodurans]
Identities = 255/359 (71%), Positives = 293/359 (81%), Gaps = 6/359 (1%)

Query:  14 RVVVGMSGGVDSSVTALLLKEQGYDVIGVFMKNWDDTDEFGVCTATEDYKDVAAVADKIG   73
           RVVVGMSGGVDSSVTALLLKEQGYDVIG+FMKNWDDTDE GVCTATEDY+DV V +++G
Sbjct:  10 RVVVGMSGGVDSSVTALLLKEQGYDVIGIFMKNWDDTDENGHVCTATEDYQDVVQVCNQLG   69

Query:  74 IPYYSVNFEKEYWDRVFEYFLAEYRAGRTPNPDVMCNKEIKFKAFLDYAMTLGADYVATG  133
           I YY+VNFEKEYWD+VF YFL EY+AGRTPNPDVMCNKEIKFKAFL++A+TLGADYVATG
Sbjct:  70 IAYYAVNFEKEYWDKVFTYFLEEYKAGRTPNDDVMCNKEIKFKAFLNHALTLGADYVATG  129

Query: 134 HYAQVRRDENGTVHMLRGADNGKDQTYFLSQLSQEQLQKTLFPLGHLQKSEVREIAERAG  193
           HYAQVK + +G    ++RG D  KDQTYFL+ LSQ+QL + +FPLGHL+K EVR IAERAG
Sbjct: 130 HYAQVK-NVDGQYQLIRGKDPNKDQTYFLNALSQQQLSRVMFPLGHLEKKEVRAIAERAG  188

Query: 194 LATAKKKDSTGICFIGEKNFKQFLSQYLPAQKGRMMTIDGRDMGEHAGLMYYTIGQRGGL  253
           LATAKKKDSTGICFIG+++FK+FLS YLPAQ G M T+DG   G H GLMYYT+GQR GL
Sbjct: 189 LATAKKKDSTGICFIGKRDFKEFLSSYLPAQPGEMQTLDGEVKGTHDGLMYYTLGQRQGL  248

Query: 254 GIGGQHGGDNQPWFVVGKDLSQNILYVGQGFYHEALMSNSLDASVIHFTREMPEEFTFEC  313
           GI    GG  +PWFV+GK+L +NILYVGQGF+H  L S    L A +++        + FEC
```

```
-continued
Sbjct: 249 GI----GGSGEPWFVIGKNLEKNILYVGQGFHHPGLYSEGLRAIKVNWILRRESDEPFEC  304

Query: 314 TAKFRYRQPDSHVAVHVRGDKA-EVVFAEPQRAITPGQAVVFYDGKECLGGGMIDMAYK  371
           TAKFRYRQPD  V V+ + D A EV+FAEPQRAITPGQAVVFYDG  CLGGG ID   K
Sbjct: 305 TAKFRYRQPDQKVTVYPQSDGAVEVLFAEPQRAITPGQAVVFYDGDVCLGGGTIDHVLK  363
```

An alignment of the GAS and GBS proteins is shown below.

```
Identities = 332/377 (88%), Positives = 349/377 (92%)

Query:  21 GRILMTDNSNIRVVVGMSGGVDSSVTALLLKEQGYDVIGVFMKNWDDTDEFGVCTATEDY  80
           G   MTDNS IRVVVGMSGGVDSSVTALLLKEQGYDVIGVFMKNWDDTDEFGVCTATEDY
Sbjct:   3 GEFFMTDNSKIRVVVGMSGGVDSSVTALLLKEQGYDVIGVFMKNWDDTDEFGVCTATEDY  62

Query:  81 KDVAAVADQIGIPYYSVNFEKEYWDRVFEYFLAEYRAGRTPNPDVMCNKEIKFKAFLDYA  140
           KDVAAVAD+IGIPYYSVNFEKEYWDRVFEYFLAEYRAGRTPNPDVMCNKEIKFKAFLDYA
Sbjct:  63 KDVAAVADKIGIPYYSVNFEKEYWDRVFEYFLAEYRAGRTPNPDVMCNKEIKFKAFLDYA  122

Query: 141 MTLGADYVATGHYAQVTRDENGIVHMLRGADNNKDQTYFLSQLSQEQLQKTLFPLGHLQK  200
           MTLGADYVATGHYAQV RDENG VHMLRGADN KDQTYFLSQLSQEQLQKTLFPLGHLQK
Sbjct: 123 MTLGADYVATGHYAQVKRDENGTVHMLRGADNGKDQTYFLSQLSQEQLQKTLFPLGHLQK  182

Query: 201 PEVRRIAEEAGLATAKKKDSTGICFIGEKNFKDFLGQYLPAQPGRMMTVDGRDMGEHAGL  260
             EVR IAE AGLATAKKKDSTGICFIGEKNFK FL QYLPAQ GRMMT+DGRDMGEHAGL
Sbjct: 183 SEVREIAERAGLATAKKKDSTGICFIGEKNFKQFLSQYLPAQKGRMMTIDGRDMGEHAGL  242

Query: 261 MYYTIGQRGGLGIGGQHGGDNKPWFVVGKDLSKNILYVGQGFYHDSLMSTSLTASEIHFT  320
           MYYTIGQRGGLGIGGQHGGDN+PWFVVGKDLS+NILYVGQGFYH++LMS SL AS IHFT
Sbjct: 243 MYYTIGQRGGLGIGGQHGGDNQPWFVVGKDLSQNILYVGQGFYHEALMSNSLDASVIHFT  302

Query: 321 RDMPNEFKLECTAKFRYRQPDSKVTVYVKGNQARVVFDDLQRAITPGQAVVFYNEQECLG  380
           R+MP EF  ECTAKFRYRQPDS V V+V+G++A VVF + QRAITPGQAVVFY+ +ECLG
Sbjct: 303 REMPEEFTFECTAKFRYRQPDSHVAVHVRGDKAEVVFAEPQRAITPGQAVVFYDGKECLG  362

Query: 381 GGMIDQAYRDDKICQYI  397
           GGMID AY++ + CQYI
Sbjct: 363 GGMIDMAYKNGQPCQYI  379
```

Based on this analysis, it was predicted that these proteins and their epitopes could be useful antigens for vaccines or diagnostics.

EXAMPLE 1034

A DNA sequence (GBSx1106) was identified in *S. agalactiae* <SEQ ID 3195> which encodes the amino acid sequence <SEQ ID 3196>. Analysis of this protein sequence reveals the following:

```
Possible site: 29
>>> Seems to have a cleavable N-term signal seq.
    INTEGRAL    Likelihood = -12.84    Transmembrane    141-157  (134-165)
    INTEGRAL    Likelihood = -11.78    Transmembrane     40-56   (36-73)
    INTEGRAL    Likelihood =  -4.35    Transmembrane     68-84   (65-86)
    INTEGRAL    Likelihood =  -3.50    Transmembrane    180-196  (175-199)

----- Final Results -----
         bacterial membrane --- Certainty = 0.6137(Affirmative) < succ>
         bacterial outside  --- Certainty = 0.0000(Not Clear)   < succ>
         bacterial cytoplasm --- Certainty = 0.0000(Not Clear)  < succ>
```

The protein has homology with the following sequences in the GENPEPT database.

```
>GP: CAB15390 GB: Z99121 similar to hypothetical proteins
[Bacillus subtilis]
Identities = 71/202 (35%), Positives = 120/202 (59%), Gaps = 5/202 (2%)

Query:  1 MISKFILAFMAFFAIMNPISNLPAFMALVADDDQKISRRIAAKGVLLAFVIIVIFVLSGH  60
          M S  + F++FA+ NPI N+P F+ L          + IA K  +L+F I+   F++ GH
Sbjct:  2 MFSFIVHVFISLFAVSNPIGNVPIFLTLTEGYTAAERKAIARKAAILSFFILAAFLVFGH  61
```

-continued

```
Query:   61 LLFNLFGITLAALKISGGILVGIIGYKMINGIHSPTNK-NLEEHKD--DPMNVAVSPLAM  117
            L+F LF I + AL+++GGI +  I Y ++N   S     + +EHK+  +  +++V+PL++
Sbjct:   62 LIFKLFDINIHALRVAGGIFIFGIAYNLLNAKESHVQSLHHDEHKESKEKADISVTPLSI  121

Query:  118 PLLAGPGTIATAMGLSSG--GLSGKLITILAFAILCVIMYVILISANEITKFLGKNANTI  175
            P++AGPGTIAT M LS+G  G+     ++ A + + ++     + I+  LGK M   +
Sbjct:  122 PIIAGPGTIATVMSLSAGHSGIGHYAAVMIGIAAVIALTFLFFHYSAFISSKLGKTEMNV  181

Query:  176 ITKMMGLILMTIGIEMLITGIK                                       197
            IT++MGLIL  + +  M+  G+K
Sbjct:  182 ITRLMGLILAVVAVGMIGAGLK                                       203
```

No corresponding DNA sequence was identified in *S. pyogenes*.

A related GBS gene <SEQ ID 8715> and protein <SEQ ID 8716> were also identified. Analysis of this protein sequence reveals the following:

```
Lipop: Possible site: -1 Crend: 3
McG: Discrim Score: 9.79
GvH: Signal Score (-7.5): -1.53
     Possible site: 29
>>> Seems to have a cleavable N-term signal seq.
ALOM program count: 4 value: -12.84 threshold: 0.0
    INTEGRAL       Likelihood = -12.84    Transmembrane  141-157 (134-165)
    INTEGRAL       Likelihood = -11.78    Transmembrane   40-56  (36-73)
    INTEGRAL       Likelihood =  -4.35    Transmembrane   68-84  (65-86)
    INTEGRAL       Likelihood =  -3.50    Transmembrane  180-196 (175-199)
    PERIPHERAL     Likelihood =   1.27    110
modified ALOM score: 3.07
*** Reasoning Step: 3

----- Final Results ----- bacterial membrane --- Certainty = 0.6137(Affirmative) < succ>
               bacterial outside --- Certainty = 0.0000(Not Clear)   < succ>
             bacterial Cytoplasm --- Certainty = 0.0000(Not Clear)   < succ>
```

The protein has homology with the following sequences in the databases:

```
ORF00620(301-891 of 1209)
OMNI|NT01BS3953(11-212 of 220)conserved hypothetical protein
% Match = 15.8
% Identity = 35.5  % Similarity = 61.5
Matches = 71  Mismatches = 74  Conservative Sub.s = 52

96         125         156         186         216         246         276         306
VQLSSDIVNLTVKLQFT*KVIKQGLCLMIYNEQSHQVKLLFFIMNKNV*AVG*LIRLIVMIKSVNTFN*HLIIK*GNRMI
                                                                                |
                                                                              VQRLSTRRYMMF
                                                                                     10
336         366         396         426         456         486         516         546
SKFILAFMAFFAIMNPISNLPAFMALVADDDQKISRRIAAKGVLLAFVIIVIFVLSGHLLFNLFGITLAALKISGGILVG
 |  :  |:::||:  |||  |:| |: |       : ||  | :|:| |:   |:: |||:| || :  :||:::|||::
SFIVHVFISLFAVSNPIGNVPIFLTLTEGYTAAERKAIARKAAILSFFILAAFLVFGHLIFKLFDINIHALRVAGGIFIF
          30         40         50         60         70         80         90
576         603         627         657         687         711         741         771
IIGYKMINGIHSPTNK-NLEEHKD--DPMNVAVSPLAMPLLAGPGTIATAMGLSSG--GLSGKLITILAFAILCVIMYVI
|| |  ::|   |    :  :|||  :   :::|:||::|:|||||||||| ||:|  |:   ::    |:   :   ::
GIAYNLLNAKESHVQSLHHDEHKESKEKADISVTPLSIPIIAGPGTIATVMSLSAGHSGIGHYAAVMIGIAAVIALTFLF
         110         120         130         140         150         160         170
801         831         861         891         921         921         951         1011
LISANEITKFLGKNAMTIITKMMGLILMTIGIEMLITGIKIGFHXT*PIPSG*LLKDKC*NKFNXNYDGQSSWNL*VFLT
:  :  |:  |||   |  |:||::|||||   :  :  |:  |:|
FHYSAFISSKLGKTEMNVITRLMGLILAVVAVGMIGAGLKGMFPVLTS
           190         200         210         220
```

Based on this analysis, it was predicted that these proteins and their epitopes could be useful antigens for vaccines or diagnostics.

EXAMPLE 1035

A DNA sequence (GBSx1107) was identified in *S. agalactiae* <SEQ ID 3197> which encodes the amino acid sequence <SEQ ID 3198>. Analysis of this protein sequence reveals the following:

```
Possible site: 17
>>> Seems to have no N-terminal signal sequence

----- Final Results -----
           bacterial cytoplasm --- Certainty = 0.1747(Affirmative) < succ>
            bacterial membrane --- Certainty = 0.0000(Not Clear)   < succ>
             bacterial outside --- Certainty = 0.0000(Not Clear)   < succ>
```

A related GBS nucleic acid sequence <SEQ ID 10289> which encodes amino acid sequence <SEQ ID 10290> was also identified.

The protein has homology with the following sequences in the GENPEPT database.

```
>GP: AAC45494 GB: U80409 glucose inhibited division protein homolog
GidA [Lactococcus lactis subsp. cremoris]
Identities = 394/524 (75%), Positives = 458/524 (87%), Gaps = 2/524 (0%)

Query:  13 KTLLATINLEMLAFMPCNPSIGGSAKGIVVREIDALGGEMGKNIDKTYIQMKMLNTGKGP    72
           KTLL  TINL M+AFMPCNPSIGGSAKGIVVREIDALGGEMG+NIDKTYIQMKMLNTGKGP
Sbjct:  12 KTLLMTINLNMVAFMPCNPSIGGSAKGIVVREIDALGGEMGRNIDKTYIQMKMLNTGKGP    71

Query:  73 AVRALRAQADKALYAQTMKQTVEKQENLTLRQAMIDEILVEDGK--VVGVRTATNQKFSA   130
           AVRALRAQADK  YA +MK TV QENLTLRQ M++E++++D K  V+GVRT+T  ++ A
Sbjct:  72 AVRALRAQADKDEYAASMKNTVSDQENLTLRQGMVEELILDDEKQKVIGVRTSTGTQYGA   131

Query: 131 KSVVITTGTALRGEIILGDLKYSSGPNNSLASVTLADNLRDLGLEIGRFKTGTPPRVKAS   190
           K+V+ITTGTALRGEII+G+LKYSSGPNNSL+S+ LADNLR++G EIGRFKTGTPPRV AS
Sbjct: 132 KAVIITTGTALRGEIIIGELKYSSGPNNSLSSIGLADNLREIGFEIGRFKTGTPPRVLAS   191

Query: 191 SINYEKTEIQPGDEQPNHFSFMSRDEDYITDQVPCWLTYTNTLSHDIINQNLHRAPMFSG   250
           SI+Y+KTEIQPGDE PNHFSFMS DEDY+ DQ+PCWLTYT   SH I+ NLHRAP+FSG
Sbjct: 192 SIDYDKTEIQPGDEAPNHFSFMSSDEDYLKDQIPCWLTYTTENSHTILRDNLHRAPLFSG   251

Query: 251 IVKGVGPRYCPSIEDKIVRFADKERHQLFLEPEGRYTEEVYVQGLSTSLPEDVQVDLLRS   310
           IVKGVGPRYCPSIEDKI RFADK RHQLFLEPEGR TEEV+ GLSTS+PEDVQ DL++S
Sbjct: 252 IVKGVGPRYCPSIEDKITRFADKPRHQLFLEPEGRNTEEVYIGGLSTSMPEDVQFDLVKS   311

Query: 311 IKGLENAEMMRTGYAIEYDIVLPHQLRATLETKVIAGLFTAGQTNGTSGYEEAAGQGLVA   370
           I GLENA+MMR GYAIEYD+V+PHQLR TLETK+I+GLFTAGQTNGTSGYEEAAGQGLVA
Sbjct: 312 IPGLENAKMMRPGYAIEYDVVMPHQLRPTLETKLISGLFTAGQTNGTSGYEEAAGQGLVA   371

Query: 371 GINAALKVQGKPELILKRSDAYIGVMIDDLVTKGTLEPYRLLTSRAEYRLILRHDNADMR   430
           GINAALK+QGKPE ILKRS+AYIGVMIDDLVTKGTLEPYRLLTSRAEYRLILRHDNAD R
Sbjct: 372 GINAALKIQGKPEFILKRSEAYIGVMIDDLVTKGTLEPYRLLTSRAEYRLILRHDNADRR   431

Query: 431 LTEIGYEIGLVDEERYAIFKKRQMQFENELERLDSIKLKPVSETNKRIQELGFKPLTDAL   490
           LTEIG ++GLV + ++  ++ +   QF+ E++RL+S KLKP+ +T +++ +LGF P+ DAL
Sbjct: 432 LTEIGRQVGLVSDAQWEHYQAKMAQFDREMKRLNSEKLKPLPDTQEKLGKLGFGPIKDAL   491

Query: 491 TAKEFMRRPQITYAVATDFVGCADEPLDSKVIELLETEIKYEGY                  534
           T  EF++RP++ Y    DF+G A E +D  V EL+ETEI YEGY
Sbjct: 492 TGAEFLKRPEVNYDEVIDFIGQAPEVIDRTVSELIETEITYEGY                  535
```

A related DNA sequence was identified in *S. pyogenes* <SEQ ID 3199> which encodes the amino acid sequence <SEQ ID 3200>. Analysis of this protein sequence reveals the following:

```
Possible site: 28
>>> Seems to have no N-terminal signal sequence

----- Final Results -----
  bacterial cytoplasm --- Certainty = 0.1064 (Affirmative) < succ>
   bacterial membrane --- Certainty = 0.0000 (Not Clear)   < succ>
    bacterial outside --- Certainty = 0.0000 (Not Clear)   < succ>
```

An alignment of the GAS and GBS proteins is shown below.

```
Identities = 530/610 (86%), Positives = 574/610 (93%)

Query:    1 MEASLAASRMGCKTLLATINLEMLAFMPCNPSIGGSAKGIVVREIDALGGEMGKNIDKTY   60
            +EASLA SRMGCKTLLATINL+MLAFMPCNPSIGGSAKGIVVREIDALGGEMGKNIDKTY
Sbjct:   21 VEASLATSRMGCKTLLATINLDMLAFMPCNPSIGGSAKGIVVREIDALGGEMGKNIDKTY   80

Query:   61 IQMKMLNTGKGPAVRALRAQADKALYAQTMKQTVEKQENLTLRQAMIDEILVEDGKVVGV  120
            IQMKMLNTGKGPAVRALRAQADK+LYA+ MK TVEKQ NLTLRQ MID+ILVEDG+VVGV
Sbjct:   81 IQMKMLNTGKGPAVRALRAQADKSLYAREMKHTVEKQANLTLRQTMIDDILVEDGRVVGV  140

Query:  121 RTATNQKFSAKSVVITTGTALRGEIILGDLKYSSGPNNSLASVTLADNLRDLGLEIGRFK  180
               TAT QKF+AK+VV+TTGTALRGEIILG+LKYSSGPNNSLASVTLADNL+ LGLEIGRFK
Sbjct:  141 LTATGQKFAAKAVVVTTGTALRGEIILGELKYSSGPNNSLASVTLADNLKKLGLEIGRFK  200

Query:  181 TGTPPRVKASSINYEKTEIQPGDEQPNHFSFMSRDEDYITDQVPCWLTYTNTLSHDIINQ  240
            TGTPPRVKASSINY++TEIQPGD++PNHFSFMS+D DY+ DQ+PCWLTYTN  SHDIINQ
Sbjct:  201 TGTPPRVKASSINYDQTEIQPGDDKPNHFSFMSKDADYLKDQIPCWLTYTNQTSHDIINQ  260

Query:  241 NLHRAPMFSGIVKGVGPRYCPSIEDKIVRFADKERHQLFLEPEGRYTEEVYVQGLSTSLP  300
            NL+RAPMFSGIVKGVGPRYCPSIEDKIVRFADKERHQLFLEPEGR TEEVYVQGLSTSLP
Sbjct:  261 NLYRAPMFSGIVKGVGPRYCPSIEDKIVRFADKERHQLFLEPEGRDTEEVYVQGLSTSLP  320

Query:  301 EDVQVDLLRSIKGLENAEMMRTGYAIEYDIVLPHQLRATLETKVIAGLFTAGQTNGTSGY  360
            EDVQ DL+ SIKGLE AEMMRTGYAIEYDIVLPHQLRATLETK+I+GLFTAGQTNGTSGY
Sbjct:  321 EDVQKDLIHSIKGLEKAEMMRTGYAIEYDIVLPHQLRATLETKLISGLFTAGQTNGTSGY  380

Query:  361 EEAAGQGLVAGINAALKVQGKPELILKRSDAYIGVMIDDLVTKGTLEPYRLLTSRAEYRL  420
            EEAAGQGL+AGINAALKVQGKPELILKRSDAYIGVMIDDLVTKGTLEPYRLLTSRAEYRL
Sbjct:  381 EEAAGQGLIAGINAALKVQGKPELILKRSDAYIGVMIDDLVTKGTLEPYRLLTSRAEYRL  440

Query:  421 ILRHDNADMRLTEIGYEIGLVDEERYAIFKKRQMQFENELERLDSIKLKPVSETNKRIQE  480
            ILRHDNADMRLTEIG +IGLVD+ER+  F+ ++ QF+NEL+RL+SIKLKP+ ETN R+Q+
Sbjct:  441 ILRHDNADMRLTEIGRDIGLVDDERWKAFEIKKNQFDNELKRLNSIKLKPIKETNDRVQD  500

Query:  481 LGFKPLTDALTAKEFMRRPQITYAVATDFVGCADEPLDSKVIELLETEIKYEGYIKKALD  540
            LGFKPLTDA+TAKEFMRRP+I YA A  FVG A E LD+K+IELLETEIKYEGYI+KALD
Sbjct:  501 LGFKPLTDAMTAKEFMRRPEIDYATAVSFVGPAAEDLDAKIIELLETEIKYEGYIRKALD  560

Query:  541 QVAKMKRMEEKRIPPHIDWDDIDSIATEARQKFKKINPETLGQASRISGVNPADISILMV  600
            QVAKMKRMEEKRIP +IDWD IDSIATEARQKFKKINPET+GQASRISGVNPADISILM+
Sbjct:  561 QVAKMKRMEEKRIPTNIDWDAIDSIATEARQKFKKINPETIGQASRISGVNPADISILMI  620

Query:  601 YLEGRQKGRK                                                   610
            YLEG  K  +
Sbjct:  621 YLEGNGKAHR                                                   630
```

Based on this analysis, it was predicted that these proteins and their epitopes could be useful antigens for vaccines or diagnostics.

EXAMPLE 1036

A DNA sequence (GBSx1108) was identified in *S. agalactiae* <SEQ ID 3201> which encodes the amino acid sequence <SEQ ID 3202>. Analysis of this protein sequence reveals the following:

```
Possible site: 44
>>> Seems to have a cleavable N-term signal seq.

----- Final Results -----
            bacterial outside  --- Certainty = 0.3000(Affirmative) < succ>
            bacterial membrane --- Certainty = 0.0000(Not Clear)   < succ>
            bacterial cytoplasm --- Certainty = 0.0000(Not Clear)  < succ>
```

The protein has homology with the following sequences in the GENPEPT database.

```
>GP:BAB07750 GB:AP001520 unknown conserved protein in B. subtilis
[Bacillus halodurans]
Identities = 205/644 (31%), Positives = 362/644 (55%), Gaps = 28/644 (4%)
```

-continued

```
Query:   35 LLLAIFVALSFVVALLYYQ--------------------KITYELSEVEQIELLNDQTE   73
            ++  + VAL F++AL + YQ                    +I++E   + I  L+ +
Sbjct:   14 VIALLAVALVFLIALSFYQWQLGVIGVLLLLVIAIFSLRARISFERDLEQYISTLSYRVH   73

Query:   74 VSLKSLLEQMPVGVIQFDLETNDIEWFNPYA-ELIFTGDNGHFQSATVKDIITSRRNGTA  132
            + +   + Q+PVG+I ++ +    ++W NPYA E +     +          +++ +    GT
Sbjct:   74 KAGEEAVTQLPVGMILYNDQLR-VQWVNPYAAEHLPKAEIDASLEELSPELVRALEEGTD  132

Query:  133 GQSFEYGDNKYSAYLDTETGVFYFFDNFMGNRRNYDSSMLRPVIGIISIDNYDDIMDTML  192
                Q     +  Y        + YFFD     R +        +PV+  I +DNYD++    M
Sbjct:  133 EQKIVIEEKTYDCTFKPNERLIYFFDITESERMHQQFEESQPVLTFIYLDNYDEVTQGME  192

Query:  193 EADMSKINAFVTSFISDFTQSKNIFYRRVNMDRYYIFTDYSVLNTLIKDKFDILNEFRKR  252
            +    S++ + VTS ++ +    ++F RR    DR+      Y  L   + K KF IL+E R+
Sbjct:  193 DQVRSRLMSQVTSSLNQWANEHDLFLRRTAADRFIAVMSYGSLLAIEKTKFGILDEIRET  252

Query:  253 AQENHLSLTLSMGISYGDGNHNQIGQIALENLNTALVRGGDQIVVRENDSSKKALYFGGG  312
               +  + LTLS+G+ YGD +  ++GQ+A  +L+ AL RGGDQ+ +++        K ++GG
Sbjct:  253 TGKEKIPLTLSIGVGYGDLSLRELGQLAQSSLDLALGRGGDQVAIKQKTG--KVRFYGGK  310

Query:  313 AVSTIKRSRTRTRAMMTAISDRLKVVDSVFIVGHRKLDMDALGASVGMQFFASNIVNASY  372
             + +    KR+R R R + A+ D +      D V ++GH+  DMDA+GA++G+    A           ++
Sbjct:  311 SNAMEKRTRVRARVISHALRDFVLESDRVIVMGHKNPDMDAVGAAIGILKIAEVNDREAF  370

Query:  373 VVYDPNDMNSDIERAIDYLQEDGET--RLVSVERAFELITQNSLLVMVDHSKTALTLSKE  430
            VV DPND+N D+ + ++ ++++ +    + ++ E + EL+T+ +LLV+VD    K  ++ +
Sbjct:  371 VVLDPNDVNPDVSKLMEEVEKNEQLWDKFITPEESLELMTEETLLVIVDTHKPSMVIEPR  430

Query:  431 FFNKFADVIVVDHHRRDEDFPKNAVLSFIESGASSASELVTELIQFQQAKDKLSRSQASI  490
              +       V+V+DHHRR E+F ++ VL ++E  ASS +ELVTEL+++Q  K  K+     +++
Sbjct:  431 LLDYVERVVVLDHHRRGEEFIEDPVLVYMEPYASSTAELVTELLEYQPKKLKMDILESTA  490

Query:  491 LMAGIMLDTRNFASNVTSRTFDVASYLRGLGSNSMAIQKISATDFDEYRLINELILKGER  550
            L+AG+++DT++FA     +RTFD AS+LR  G++++ +QK+     D + Y       +L+    +
Sbjct:  491 LLAGMIVDTKSFAIRTGARTFDAASFLRSHGADTVLVQKLLKEDLNHYVKRAKLVETAKL  550

Query:  551 IYDNIIVATGEEHKVYSHVIASKAADTMLTMAGIEATFVITKNSSN-IGISARSRNNINV  609
              D + +AT  E +    S  ++ ++AADT+LTM  G+ A+FVI++        + ISARS  ++NV
Sbjct:  551 YRDGMAIATAREEEAVSQLLIAQAADTLLTMKGVVASFVISRRHDGVVSISARSLGDVNV  610

Query:  610 QRIMEKLGGGGHFSFAACQIQDKSVKQVRRMLLEIIDEDLRENS                 653
               Q  IME L GGGH + AA  Q +D ++++      L E ID+ L     S
Sbjct:  611 QLIMESLDGGGHLTNAATQFEDATLEEAEAKLKEAIDQYLEGGS                 654
```

A related DNA sequence was identified in *S. pyogenes* <SEQ ID 3203> which encodes the amino acid sequence <SEQ ID 3204>. Analysis of this protein sequence reveals the following:

```
    Possible site: 25
>>> Seems to have an uncleavable N-term signal seq
   INTEGRAL Likelihood = -18.57 Transmembrane 33-49 (6-56)
   INTEGRAL Likelihood = -10.14 Transmembrane 12-28 (6-32)

----- Final Results -----
   bacterial membrane --- Certainty = 0.8429 (Affirmative) < succ>
    bacterial outside --- Certainty = 0.0000 (Not Clear) < succ>
  bacterial cytoplasm --- Certainty = 0.0000 (Not Clear) < succ>
```

The protein has homology with the following sequences in the databases:

```
>GP:BAB07750 GB:AP001520 unknown conserved protein in B. subtilis
[Bacillus halodurans]
Identities = 199/659 (30%), Positives = 367/659 (55%), Gaps = 16/659 (2%)

Query:    1 MKKF---RFETIHLI-MMGLILFGLLALCVSIMQSKILILLAIFLVLLFVV-ALLWYQKE   55
            M KF    R+    H+I ++ + L  L+AL    Q  ++ +L + ++ +F + A +  ++++
Sbjct:    1 MPKFLLKRWHGYHVIALLAVALVFLIALSFYQWQLGVIGVLLLLVIAIFSLRARISFERD   60

Query:   56 AYQLSDLAHIELLNEQTEDNLKTLLDNMPVGVVQFDQETNAVEWYNPYA-ELIFTTEEGF  114
               Q    +I  L+ +    + +  +PVG++ ++ +   V+W NPYA E +     E
Sbjct:   61 LEQ-----YISTLSYRVHKAGEEAVTQLPVGMILYNDQLR-VQWVNPYAAEHLPKAEIDA  114

Query:  115 IQNGLIQQIITEKRREDISQTFEVSGNKYTSYIDVSSGIFYFFDSFVGNRQLADASMLRP  174
```

```
              L   +++             Q    +      Y       +    + YFFD       R            +P
Sbjct: 115 SLEELSPELVRALEEGTDEQKIVIEEKTYDCTFKPNERLIYFFDITESERMHQQFEESQP   174

Query: 175 VVGIISVDNYDDITDDLSDADTSKINSFVANFIDEFMESKRIFYRRVNMDRYYFFTDFKT   234
           V+   I  +DNYD++T + D    S++ S V +  ++++       +F RR    DR+       + +
Sbjct: 175 VLTFIYLDNYDEVTQGMEDQVRSRLMSQVTSSLNQWANEHDLFLRRTAADRFIAVMSYGS   234

Query: 235 LNDLMDNKFSVLSEEFRKEAQDARPLTLSIGISFGEENHSQIGQVALENLNIALVRGGDQ   294
           L    +    KF +L+E R+         + PLTLSIG+ +G+ +   ++GQ+A  +L++AL RGGDQ
Sbjct: 235 LLAIEKTKFGILDEIRETTGKEKIPLTLSIGVGYGDLSLRELGQLAQSSLDLALGRGGDQ   294

Query: 295 IVIRENADHTNPIYFGGGSVSTVKRSRTRTRAMMTAISDRIKMVDNVFIVGHRKLDMDAL   354
            + I++              ++GG S  +  KR+R R R  + A+  D  +     D V  ++GH+   DMDA+
Sbjct: 295 VAIKQKTGKVR--FYGGKSNAMEKRTRVRARVISHALRDFVLESDRVIVMGHKNPDMDAV   352

Query: 355 GSAVGMQFFAGNIIENSFAVYNPDEMSPDIERAIERLQADGKT--RLISVSQAMGLVTPR   412
           G+A+G+       A    +F V +P++++PD+ +  +E ++ +  +       + I+   +++ L+T
Sbjct: 353 GAAIGILKIAEVNDREAFVVLDPNDVNPDVSKLMEEVEKNEQLWDKFITPEESLELMTEE   412

Query: 413 SLLVMVDHSKISLTLSKEFYEQFQNVIVVDHHRRDDDFPDNAILTFIESGASSAAELVTE   472
           +LLV+VD  K S+ +         +  + V+V+DHHRR  ++F ++   +L ++E  ASS AELVTE
Sbjct: 413 TLLVIVDTHKPSMVIEPRLLDYVERVVVLDHHRRGEEFIEDPVLVYMEPYASSTAELVTE   472

Query: 473 LIQFQNAKKCLNKIQASVLMAGIMLDTKNFSTRVTSRTFDVASYLRSKGSDSVEIQNISA   532
           L+++Q  K   ++   ++++  L+AG+++DTK+F+  R    +RTFD AS+LRS G+D+V +Q +
Sbjct: 473 LLEYQPKKLKMDILESTALLAGMIVDTKSFAIRTGARTFDAASFLRSHGADTVLVQKLLK   532

Query: 533 TDFEEYKQINEIILQGERLGDSIIVAAGEKNHLYSNVIASKAADTILSMAHVEASFVLVE   592
            D   Y  +    +++         +   D + +A    +   S ++  ++AADT+L+M V ASFV+
Sbjct: 533 EDLNHYVKRAKLVETAKLYRDGMAIATAREEEAVSQLLIAQAADTLLTMKGVVASFVISR   592

Query: 593 TASHKIAISARSRSKINVQRVMEKLGGGGHFNLAACQLTDISLPQAKYLLLKTINMTMK   651
                   ++ISARS     +NVQ +ME L GGGH    AA Q   D +L +A+    L  + I+  ++
Sbjct: 593 RHDGVVSISARSLGDVNVQLIMESLDGGGHLTNAATQFEDATLEEAEAKLKEAIDQYLE   651
```

An alignment of the GAS and GBS proteins is shown below.

```
Identities = 428/658 (65%), Positives = 547/658 (83%), Gaps = 1/658 (0%)

Query:   1 MKRFRFATVHLVLIGLILFGLLAICVRLFQSYTALLLAIFVALSFVVALLYYQKITYELS   60
           MK+FRF T+HL+++GLILFGLLA+CV + QS  +LLAIF+ L FVVALL+YQK  Y+LS
Sbjct:   1 MKKFRFETIHLIMMGLILFGLLALCVSIMQSKILILLAIFLVLLFVVALLWYQKEAYQLS   60

Query:  61 EVEQIELLNDQTEVSLKSLLEQMPVGVIQFDLETNDIEWFNPYAELIFTGDNGHFQSATV   120
           ++    IELLN+QTE +LK+LL+ MPVGV+QFD  ETN  +EW+NPYAELIFT +  G  Q+  +
Sbjct:  61 DLAHIELLNEQTEDNLKTLLDNMPVGVVQFDQETNAVEWYNPYAELIFTTEEGFIQNGLI   120

Query: 121 KDIITSRRNGTAGQSFEYGDNKYSAYLDTETGVFYFFDNFMGNRRNYDSSMLRPVIGIIS   180
           + IIT +R     Q+FE   NKY++ Y+D   +G+FYFFD+F+GNR+   D+SMLRPV+GIIS
Sbjct: 121 QQIITEKRREDISQTFEVSGNKYTSYIDVSSGIFYFFDSFVGNRQLADASMLRPVVGIIS   180

Query: 181 IDNYDDIMDTMLEADMSKINAFVTSFISDFTQSKNIFYRRVNMDRYYIFTDYSVLNTLIK   240
           +DNYDDI D + +AD SKIN+FV +FI +F +SK IFYRRVNMDRYY FTD+  LN L+
Sbjct: 181 VDNYDDITDDLSDADTSKINSFVANFIDEFMESKRIFYRRVNMDRYYFFTDFKTLNDLMD   240

Query: 241 DKFDILNEFRKAQENHLSLTLSMGISYGDGNHNQIGQIALENLNTALVRGGDQIVVREN   300
           +KF +L EFRK AQ+       LTLS+GIS+G+ NH+QIGQ+ALENLN ALVRGGDQIV+REN
Sbjct: 241 NKFSVLEEFRKEAQDARPLTLSIGISFGEENHSQIGQVALENLNIALVRGGDQIVIREN   300

Query: 301 DSSKKALYFGGGAVSTIKRSRTRTRAMMTAISDRLKVVDSVFIVGHRKLDMDALGASVGM   360
                   +YFGGG+VST KRSRTRTRAMMTAISDR+K+VD+VFIVGHRKLDMDALG++VGM
Sbjct: 301 ADHTNPIYFGGGSVSTVKRSRTRTRAMMTAISDRIKMVDNVFIVGHRKLDMDALGSAVGM   360

Query: 361 QFFASNIVNASYVVYDPNDMNSDIERAIDYLQEDGETRLVSVERAFELITQNSLLVMVDH   420
           QFFA  NI+   S+   VY+P++M+ DIERAI+ LQ DG+TRL SV  +A  L+T   SLLVMVDH
Sbjct: 361 QFFAGNIIENSFAVYNPDEMSPDIERAIERLQADGKTRLISVSQAMGLVTPRSLLVMVDH   420

Query: 421 SKTALTLSKEFFNKFADVIVVDHHRREDEDFPKNAVLSFIESGASSASELVTELIQFQQAK   480
           SK +LTLSKEF+ +F +VIVVDHHRRD+DFP NA+L+FIESGASSA+ELVTELIQFQ AK
Sbjct: 421 SKISLTLSKEFYEQFQNVIVVDHHRRDDDFPDNAILTFIESGASSAAELVTELIQFQNAK   480

Query: 481 DKLSRSQASILMAGIMLDTRNFASNVTSRTFDVASYLRGLGSNSMAIQKISATDFDEYRL   540
            L++ QAS+LMAGIMLDT+NF++  VTSRTFDVASYLR  GS+S+ IQ ISATDF+EY+
Sbjct: 481 KCLNKIQASVLMAGIMLDTKNFSTRVTSRTFDVASYLRSKGSDSVEIQNISATDFEEYKQ   540

Query: 541 INELILKGERIYDNIIVATGEEHKVYSHVIASKAADTMLTMAGIEATFVITKNSSN-IGI   599
           INE+IL GER+ D+ IIVA GE++ +YS+VIASKAADT+L MA  +EA+FV+ + +S+ I I
```

-continued

```
Sbjct: 541 INEIILQGERLGDSIIVAAGEKNHLYSNVIASKAADTILSMAHVEASFVLVETASHKIAI 600

Query: 600 SARSRNNINVQRIMEKLGGGGHFSFAACQIQDKSVKQVRRMLLEIIDEDLRENSTVEN 657
           SARSR+ INVQR+MEKLGGGGHF+ AACQ+ D S+ Q + +LL+ I+  ++E   VE+
Sbjct: 601 SARSRSKINVQRVMEKLGGGGHFNLAACQLTDISLPQAKYLLLKTINMTMKETGEVES 658
```

A related GBS gene <SEQ ID 8717> and protein <SEQ ID 8718> were also identified. Analysis of this protein sequence reveals the following:

```
Lipop: Possible site: -1 Crend: 9
McG: Discrim Score: 13.82
GvH: Signal Score (-7.5): -0.890001
Possible site: 44
>>> Seems to have a cleavable N-term signal seq.
ALOM program count: 0 value: 2.97  threshold: 0.0
PERIPHERAL  Likelihood = 2.97 574
modified ALOM score: -1.09

*** Reasoning Step: 3

----- Final Results -----
           bacterial outside --- Certainty = 0.3000(affirmative) < succ>
            bacterial membrane --- Certainty = 0.0000(Not Clear) < succ>
```

The protein has homology with the following sequences in the databases:

```
31.3/55.8% over 631aa
Bacillus subtilis
EGAD|19304|hypothetical 74.3 kd protein in rpli-cotf intergenic region Insert
characterized
SP|P37484|YYBt_BACSU HYPOTHETICAL 74.3 KDA PROTEIN IN RPLI-COTF INTERGENIC REGION.
Insert characterized
GP|467336|dbj|BAA05182.1||D26185 unknown Insert characterized
GPú|636598|emb|CAB16088.1||z99124 yybT Insert characterized
PIR|S65976|S65976 yybT protein - Insert characterized ORF00251(364-2241 of 2580)
EGAD|19304|BS4045(20-651 of 659) hypothetical 74.3 kd protein in rpli-cotf
intergenic region {Bacillus subtilis} SP|P37484|YYBT_BAC
SU HYPOTHETICAL 74.3 KDA PROTEIN IN RPLI-COTF INTERGENIC
REGION.GP|467336|dbj|BAA05182.1||D26185 unknown {Bacillus subtilis}GP|26365
98|emb|CAB16088.1||Z99124 yybT {Bacillus subtilis}PIR|S65976|S65976 yybT protein-
Bacillus subtilis
% Match = 18.5
% Identity = 31.2   % Similarity = 55.8
Matches = 197 Mismatches = 271 Conservative Sub.s = 155

258       288       318       348       378       408       438       468
N***CSPLFIRGVLCYN*VLRGYLMKRFRFATVHLVLIGLILFGLLAICVRLFQSYTALLLAIFVALSFVVALLYYQKIT
                                 |     | : :  |:|     |     |   :|      |  :  | |:: ::
                              MPSFYEKPLFRYPIYALIALSIITILISFYNWILGTVEVLLLAVILFFIKRAD 522       552       582       612             666       696
YEL-SEVEQ-IELLNDQTEVSLKSLLEQMPVGVIQFDLETNDIEWFNPYAELIFTGDN--GHFQSATVKDIITSRRNGTA
 : |::  |  |:: :  |    |  :||:|:: |:  |||  |     |         |     |   :|::   |
SLIRQEIDAYISTLSYRLKKVGEEALMEMPIGIMLFN-DQYYIEWANPFLSSCFNESTLVGRSLYDTCESVVPLIKQEVE
           70        80        90       100       110       120       130

726       756       786       816       846       876       906       936
GQSFEYGDNKYSAYLDTETGVFYFFDNFMGNRRNYDSSMLRPVIGIISIDNYDDIMDTMLEADMSKINAXVTSFXSDFTQ
 ::     | |:   :  : ::|||          | |:  :|||||:  :   : :|: |||::  |
SETVTLNDRKFRVVIKRDERLLYFFDVTEQIQIEKLYENERTVLAYIFLDNYDDVTQGLDDQTRSTMNSQVTSLLNAWAQ
          150       160       170       180       190       200       210

966       996      1026      1056      1086      1116      1146      1176
SKNIFYRRVNMDRYYIFTDYSVLNTLIKDKFDILNEFRKRAQENHLSLTLSMGISYDGDNHNQIGQIALENLNTALVRGG
   ||  :|  : :|       :  :|    |   || ||:| |:    : ::||||:|:     :  :| :|: || |||
EYGIFLKRTSSERFIAVLNEHILTELENSKFSILDEVREKTSFDGVALTLSVGVGASVSSLKELGDLAQSSLDLALGRGG
          230       240       250       260       270       280       290

1206      1236      1266      1296      1326      1356      1386      1416
DQIVVRENDSSKKALYFGGGAVSTIKRSRTRTRAMMTAISDRLKVVDSVFIVGHRKLDMDALGASVGMQFFASNIVNASY
||: ::    :   |   ::||    ||:| | |   |: :   :|:||: |||::||::|:  |  |       |   :
DQVAIKLPNGKVK--FYGGKTNPMEKRTRVRARVISHALKEIVTESSNVIIMGHKFPDMDSIGAAIGILKVAQANNKDGF
             310       320       330       340       350       360       370
```

```
1446      1476      1500      1530      1560      1590      1620      1650
VVYDPNDMNSDIERAIDYLQEDGE--TRLVSVERAFELITQNSLLVMVDHSKTALTLSKEFFNKFADVIVVDHHRRDEDF
 :|  |||  :  |  ::|   |   :::    |   :|:::  |||  |:    ::|||:||   | :|  :  :   ||    ::|:|||||  |:|
IVIDPNQIGSSVQRLIGEIKKYEELWSRFITPEEAMEISNDDTLLVIVDTHKPSLVMEERLVNKIEHIVVIDHHRRGEEF
            390       400       410       420       430       440       450
1680      1710      1740      1770      1800      1830      1860      1890
PKNAVLSFIESGASSASELVTELIQFQQAKDKLSRSQASILMAGIMLDTRNFASNVTSRTFDVASYLRGLGSNSMAIQKI
 ::   :|  ::|    |||  :|||||||:::|     :  |::    :|:   |:|||:::||::|:      ||||| |||||     |::::  :||
IRDPLLVYMEPYASSTAELVTELLEYQPKRLKINMIEATALLAGIIVDTKSFSLRTGSRTFDAASYLRAKGADTVLVQKF
            470       480       490       500       510       520       530
1920      1950      2004      2034      2064      2091      2121
SATDFDEYRLINELILKGERIYDNIIVAT--GEEHKVYSHVIASKAADTMLTMAGIEATFVITK-NSSNIGISARSRNNI
 |  |       :||         |||  :|:        |  :  :  :|:  ::|||::|:|:  :||:|        :     |||||       :
LKETVDSYIKRAKLIQHTVLYKDNIAIASLPENEEEYFDQVLIAQAADSLLSMSEVEASFAVARRDEQTVCISARSLGEV
            550       560       570       580       590       600       610
2151      2181      2211      2241      2271      2301      2331      2361
NVQRIMEKLGGGGHFSAACQIQDKSVKQVRRMLLEIIDEDLRENSTVENRRD*LR*KLFFYKMLRGKEKKVRLRKYLLV
|||  |||  |   ||||::  ||   |:           |          |||  :
NVQIIMEALEGGGHLTNAATQLSGISVSEALERLKHAIDEYFEGGVQR
            630       640       650
```

SEQ ID 8718 (GBS10) was expressed in *E. coli* as a GST-fusion product. SDS-PAGE analysis of total cell extract is shown in FIG. 1 (lane 6; MW 98 kDa). It was also expressed in *E. coli* as a His-fusion product. SDS-PAGE analysis of total cell extract is shown in FIG. 2 (lane 7; MW 73 kDa).

The GST-fusion protein was purified as shown in FIG. 189, lane 3.

Based on this analysis, it was predicted that these proteins and their epitopes could be useful antigens for vaccines or diagnostics.

EXAMPLE 1037

A DNA sequence (GBSx1109) was identified in *S. agalactiae* <SEQ ID 3205> which encodes the amino acid sequence <SEQ ID 3206>. Analysis of this protein sequence reveals the following:

```
Possible site: 59
>>> Seems to have no N-terminal signal sequence

----- Final Results -----
  bacterial cytoplasm --- Certainty = 0.4643 (Affirmative) < succ>
  bacterial membrane  --- Certainty = 0.0000 (Not Clear)  < succ>
  bacterial outside   --- Certainty = 0.0000 (Not Clear)  < succ>
```

The protein has homology with the following sequences in the GENPEPT database.

```
>GP:CAA43972 GB:X62002 ribosomal protein L9 [Bacillus
           stearothermophilus]
  Identities = 80/149 (53%), Positives = 105/149 (69%), Gaps = 2/149 (1%)

Query:   1 MKVIFLQDVKGKGKKGEVKEVPTGYAQNFLLKKNLAKEATTQAIGELKGKQKSEEKAQAE    60
           MKVIFL+DVKGKGKKGE+K V  GYA NFL K+ LA EAT    +   L+ +++ E++  AE
Sbjct:   1 MKVIFLKDVKGKGKKGEIKNVADGYANNFLFKQGLAIEATPANLKALEAQKQKEQRQAAE   60

Query:  61 ILAQAKELKTQLESETTRVQFIEKVGPDGRTFGSITAKKIAEELQKQYGIKIDKRHIDLD  120
              LA AK+LK QLE  T  +   K G  GR FGSIT+K+IAE LQ Q+G+K+DKR I+L
Sbjct:  61 ELANAKKLKEQLEKLTVTIP--AKAGEGGRLFGSITSKQIAESLQAQHGLKLDKRKIELA  118

Query: 121 HTIRAIGKVEVPVKLHKQVSSQIKLDIKE                                149
             IRA+G   VPVKLH +V++  +K+ + E
Sbjct: 119 DAIRALGYTNVPVKLHPEVTATLKVHVTE                                147
```

A related DNA sequence was identified in *S. pyogenes* <SEQ ID 3207> which encodes the amino acid sequence <SEQ ID 3208>. Analysis of this protein sequence reveals the following:

```
Possible site: 59
>>> Seems to have no N-terminal signal sequence

----- Final Results -----
  bacterial cytoplasm --- Certainty = 0.4630 (Affirmative) < succ>
  bacterial membrane  --- Certainty = 0.0000 (Not Clear)  < succ>
  bacterial outside   --- Certainty = 0.0000 (Not Clear)  < succ>
```

An alignment of the GAS and GBS proteins is shown below.

```
Identities = 119/150 (79%), Positives = 138/150 (91%)
Query:   1 MKVIFLQDVKGKGKKGEVKEVPTGYAQNFLLKKNLAKEATTQAIGELKGKQKSEEKAQAE    60
           MKVIFL DVKGKGKKGE+KEVPTGYAQNFL+KKNLAKEAT+Q+IGELKGKQK+EEKAQAE
Sbjct:   1 MKVIFLADVKGKGKKGEIKEVPTGYAQNFLIKKNLAKEATSQSIGELKGKQKAEEKAQAE    60

Query:  61 ILAQAKELKTQLESETTRVQFIEKVGPDGRTFGSITAKKIAEELQKQYGIKIDKRHIDLD   120
           ILA+A+ +K  L+ + TRVQF EKVGPDGRTFGSITAKKI+EELQKQ+G+K+DKRHI LD
Sbjct:  61 ILAEAQAVKAVLDEDKTRVQFQEKVGPDGRTFGSITAKKISEELQKQFGVKVDKRHIVLD   120

Query: 121 HTIRAIGKVEVPVKLHKQVSSQIKLDIKEA                                150
           H IRAIG +EVPVKLHK+V+++IKL I EA
Sbjct: 121 HPIRAIGLIEVPVKLHKEVTAEIKLAITEA                                150
```

Based on this analysis, it was predicted that these proteins and their epitopes could be useful antigens for vaccines or diagnostics.

EXAMPLE 1038

A DNA sequence (GBSx1110) was identified in *S. agalactiae* <SEQ ID 3209> which encodes the amino acid sequence <SEQ ID 3210>. This protein is predicted to be DNA polymerase III delta prime subunit (dnaB). Analysis of this protein sequence reveals the following:

```
Possible site: 61
>>> Seems to have an uncleavable N-term signal seq
    INTEGRAL    Likelihood = -0.43    Transmembrane  204-220 (204-220)

----- Final Results -----
   bacterial membrane --- Certainty = 0.1171 (Affirmative) < succ>
    bacterial outside --- Certainty = 0.0000 (Not Clear)  < succ>
  bacterial cytoplasm --- Certainty = 0.0000 (Not Clear)  < succ>
```

A related DNA sequence was identified in *S. pyogenes* <SEQ ID 2423> which encodes the amino acid sequence <SEQ ID 2424>. Analysis of this protein sequence reveals the following:

```
Possible site: 21
>>> Seems to have no N-terminal signal sequence
    INTEGRAL    Likelihood = -0.27    Transmembrane  210-226 (210-226)

----- Final Results -----
            bacterial membrane --- Certainty = 0.1107(Affirmative) < succ>
             bacterial outside --- Certainty = 0.0000(Not Clear)   < succ>
           bacterial cytoplasm --- Certainty = 0.0000(Not Clear)   < succ>
```

An alignment of the GAS and GBS proteins is shown below.

```
Identities = 397/450 (88%), Positives = 431/450 (95%), Gaps = 1/450 (0%)

Query:   3 EVSELRVQPQDLLAEQAVLGSIFISPEKLIMVREFISPDDFYKYSHKVIFRAMITLADRN    62
           EV+ELRVQPQDLLAEQ+VLGSIFISP+KLI VREFISPDDFYKY+HK+IFRAMITL+DRN
Sbjct:   8 EVAELRVQPQDLLAEQSVLGSIFISPDKLIAVREFISPDDFYKYAHKIIFRAMITLSDRN    67

Query:  63 DAIDAATVRNILDDQGDLQNIGGLGYIVELVNSVPTSANAEFYAKIVSEKAMLRDIISKL   122
           DAIDA T+R ILDDQ DLQ+IGGL YIVELVNSVPTSANAE+YAKIV+EKAMLRDII++L
Sbjct:  68 DAIDATTIRTILDDQDDLQSIGGLSYIVELVNSVPTSANAEYYAKIVAEKAMLRDIIARL   127

Query: 123 TDTVNMAY-EGNDSDEIIATAEKALVDINEHSNRSGFRKISDVLKVNYENLELRSQQTSD   181
           T++VN+AY E    +E+IA E+AL+++NEHSNRSGFRKISDVLKVNYE LE RS+QTS+
Sbjct: 128 TESVNLAYDEILKPEEVIAGVERALIELNEHSNRSGFRKISDVLKVNYEALEARSKQTSN   187

Query: 182 VTGLPTGFRDLDRITTGLHPDQLIILAARPAVGKTAFVLNIAQNVGTKQNRPVAIFSLEM   241
           VTGLPTGFRDLD+ITTGLHPDQL+ILAARPAVGKTAFVLNIAQNVGTKQ + VAIFSLEM
Sbjct: 188 VTGLPTGFRDLDKITTGLHPDQLVILAARPAVGKTAFVLNIAQNVGTKQKKTVAIFSLEM   247
```

```
                              -continued
Query: 242 GAESLVDRMLAAEGMVDSHSLRTGQLTDQDWNNVTIAQGALADAPIYIDDTPGIKITEIR  301
           GAESLVDRMLAAEGMVDSHSLRTGQLTDQDWNNVTIAQGALA+APIYIDDTPGIKITEIR
Sbjct: 248 GAESLVDRMLAAEGMVDSHSLRTGQLTDQDWNNVTIAQGALAEAPIYIDDTPGIKITEIR  307

Query: 302 ARSRKLSQEVDDGLGLIVIDYLQLISGTRPENRQQEVSEISRQLKILAKELKVPVIALSQ  361
           ARSRKLSQEVD GLGLIVIDYLQLI+GT+PENRQQEVS+ISRQLKILAKELKVPVIALSQ
Sbjct: 308 ARSRKLSQEVDGGLGLIVIDYLQLITGTKPENRQQEVSDISRQLKILAKELKVPVIALSQ  367

Query: 362 LSRGVEQRQDKRPVLSDIRESGSIEQDADIVAFLYRDDYYRREGEEAEEIVEDNTVEVIL  421
           LSRGVEQRQDKRPVLSDIRESGSIEQDADIVAFLYRDDYYR+E ++AEE VEDNT+EVIL
Sbjct: 368 LSRGVEQRQDKRPVLSDIRESGSIEQDADIVAFLYRDDYYRKECDDAEEAVEDNTIEVIL  427

Query: 422 EKNRAGARGTVKLMFQKEYNKFSSIAQFEE                                451
           EKNRAGARGTVKLMFQKEYNKFSSIAQFEE
Sbjct: 428 EKNRAGARGTVKLMFQKEYNKFSSIAQFEE                                457
```

Based on this analysis, it was predicted that these proteins and their epitopes could be useful antigens for vaccines or diagnostics.

EXAMPLE 1039

A DNA sequence (GBSx111) was identified in *S. agalactiae* <SEQ ID 3211> which encodes the amino acid sequence <SEQ ID 3212>. Analysis of this protein sequence reveals the following:

```
Possible Site: 61
>>> Seems to have no N-terminal signal sequence

----- Final Results -----
            bacterial cytoplasm --- Certainty = 0.4909(Affirmative) < succ>
             bacterial membrane --- Certainty = 0.0000(Not Clear)   < succ>
              bacterial outside --- Certainty = 0.0000(Not Clear)   < succ>
```

The protein has no significant homology with any sequences in the GENPEPT database.

A related DNA sequence was identified in *S. pyogenes* <SEQ ID 3213> which encodes the amino acid sequence <SEQ ID 3214>. Analysis of this protein sequence reveals the following:

```
Possible site: 21
>>> Seems to have no N-terminal signal sequence

----- Final Results -----
            bacterial cytoplasm --- Certainty = 0.3467(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below.

```
Identities = 77/90 (85%), Positives = 84/90 (92%)

Query:  1 MSDAFADVAKMKKIKEDIKSHEGQMVELTLENGRKREKNKIGRLIEVYPSLFIVEYKDTA   60
          MSDAF DVAKMKKIKEDI++HEGQ+VELTLENGRKREKNKIGRLIEV SLFI+EY D++
Sbjct: 11 MSDAFTDVAKMKKIKEDIRAHEGQLVELTLENGRKREKNKIGRLIEVYSSLFIIEYSDSS   70

Query: 61 AVPGAIDNTYVESYTYSDILTEKTLIRYFD                                90
             PGAIDN+YVESYTYSDILTEKTLIRY D
Sbjct: 71 DTPGAIDNSYVESYTYSDILTEKTLIRYLD                                100
```

Based on this analysis, it was predicted that these proteins and their epitopes could be useful antigens for vaccines or diagnostics.

EXAMPLE 1040

A DNA sequence (GBSx1112) was identified in *S. agalactiae* <SEQ ID 3215> which encodes the amino acid sequence <SEQ ID 3216>. This protein is predicted to be 30S ribosomal protein S4 (rpsD). Analysis of this protein sequence reveals the following:

```
Possible site: 27
>>> Seems to have no N-terminal signal sequence

----- Final Results -----
            bacterial cytoplasm --- Certainty = 0.2937(Affirmative) < succ>
             bacterial membrane --- Certainty = 0.0000(Not Clear)  < succ>
              bacterial outside --- Certainty = 0.0000(Not Clear)  < succ>
```

The protein has homology with the following sequences in the GENPEPT database.

```
>GP:AAC00397 GB:AF008220 ribosomal protein S4 [Bacillus subtilis]
 Identities = 138/201 (68%), Positives = 158/201 (77%), Gaps = 1/201 (0%)

Query:    1 MSRYTGPSWKQSRRLGLSLTGTGKELARRNYVPGQHGPNNRSKLSEYGLQLAEKQKLRFS      60
            M+RYTGPSWK SRRLG+SL+GTGKEL +R Y PG HGP  R KLSEYGLQL EKQKLR
Sbjct:    1 MARYTGPSWKLSRRLGISLSGTGKELEKRPYAPGPHGPGQRKKLSEYGLQLQEKQKLRHM     60

Query:   61 YGLGEKQFRNLFVQATKAKEGTLGFNFMVLLERRLDNVVYRLGLATTRRQARQFVNHGHI    120
            YG+ E+QFR LF +A K    G  NFM+LL+ RLDNVVY+LGLA TRRQARQ VNHGHI
Sbjct:   61 YGVNERQFRTLFDKAGKLA-GKHGENFMILLDSRLDNVVYKLGLARTRRQARQLVNHGHI    119

Query:  121 LVDGKRVDIPSYRVTPGQVISVREKSMKVPAILEAVEATLGRPAFVSFDAEKLEGSLTRL    180
            LVDG RVDIPSY V PGQ I VREKS  +  I E+VE       P +++FDAEKLEG+ TRL
Sbjct:  120 LVDGSRVDIPSYLVKPGQTIGVREKSRNLSIIKESVEVNNFVPEYLTFDAEKLEGTFTRL    179

Query:  181 PERDEINPEINEALVVEFYNK                                          201
            PER E+ PEINEAL+VEFY++
Sbjct:  180 PERSELAPEINEALIVEFYSR                                          200
```

A related DNA sequence was identified in S. pyogenes <SEQ ID 3217> which encodes the amino acid sequence <SEQ ID 3218>. Analysis of this protein sequence reveals the following:

```
Possible site: 27
>>> Seems to have no N-terminal signal sequence

----- Final Results -----
            bacterial cytoplasm --- Certainty = 0.2937(Affirmative) < succ>
             bacterial membrane --- Certainty = 0.0000(Not Clear)  < succ>
              bacterial outside --- Certainty = 0.0000(Not Clear)  < succ>
```

An alignment of the GAS and GBS proteins is shown below.

```
Identities = 201/203 (99%), Positives = 201/203 (99%)

Query:    1 MSRYTGPSWKQSRRLGLSLTGTGKELARRNYVPGQHGPNNRSKLSEYGLQLAEKQKLRFS      60
            MSRYTGPSWKQSRRLGLSLTGTGKELARRNYVPGQHGPNNRSKLSEYGLQLAEKQKLRFS
Sbjct:    1 MSRYTGPSWKQSRRLGLSLTGTGKELARRNYVPGQHGPNNRSKLSEYGLQLAEKQKLRFS     60

Query:   61 YGLGEKQFRNLFVQATKAKEGTLGFNFMVLLERRLDNVVYRLGLATTRRQARQFVNHGHI    120
            YGLGEKQFRNLFVQATK KEGTLGFNFMVLLERRLDNVVYRLGLATTRRQARQFVNHGHI
Sbjct:   61 YGLGEKQFRNLFVQATKIKEGTLGFNFMVLLERRLDNVVYRLGLATTRRQARQFVNHGHI    120

Query:  121 LVDGKRVDIPSYRVTPGQVISVREKSMKVPAILEAVEATLGRPAFVSFDAEKLEGSLTRL    180
            LVDGKRVDIPSYRV PGQVISVREKSMKVPAILEAVEATLGRPAFVSFDAEKLEGSLTRL
Sbjct:  121 LVDGKRVDIPSYRVDPGQVISVREKSMKVPAILEAVEATLGRPAFVSFDAEKLEGSLTRL    180

Query:  181 PERDEINPEINEALVVEFYNKNL                                        203
            PERDEINPEINEALVVEFYNKML
Sbjct:  181 PERDEINPEINEALVVEFYNKML                                        203
```

Based on this analysis, it was predicted that these proteins and their epitopes could be useful antigens for vaccines or diagnostics.

EXAMPLE 1041

A DNA sequence (GBSx1113) was identified in *S. agalactiae* <SEQ ID 3219> which encodes the amino acid sequence <SEQ ID 3220>. Analysis of this protein sequence reveals the following:

```
Possible site: 29
>>> Seems to have no N-terminal signal sequence

----- Final Results -----
            bacterial cytoplasm --- Certainty = 0.4067(Affirmative) < succ>
            bacterial membrane  --- Certainty = 0.0000(Not Clear)   < succ>
             bacterial outside  --- Certainty = 0.0000(Not Clear)   < succ>
```

The protein has homology with the following sequences in the GENPEPT database.

```
>GP:AAF98302 GB:AF243383 unknown; Orf3 [Lactococcus lactissubsp.
          lactis]
 Identities = 46/97 (47%), Positives = 69/97 (70%)

Query:   1 MNLNDRLKIEEMEEKYDSFKPRINALVEAIDDFQKHYEDYVKLREFYGSEDWFRLSEQTE  60
           M+  D    I++ME KYD+F P +  L+++++ F    Y +Y++LR FYGSE WF   E  +
Sbjct:   1 MDNKDIELIQQMENKYDTFMPVLTNLIDSVEKFNSIYNNYIELRNFYGSEKWFEYMEIEK  60

Query:  61 NNLKCGVLSEDQLFDFIGEHNELVGQFLDNSSQMYRH                        97
              +KCGVL+EDQLFD I +HNEL+G  LD++S+MY++
Sbjct:  61 IPVKCGVLTEDQLFDMISDHNELLGVLLDLTSKMYKN                        97
```

A related DNA sequence was identified in *S. pyogenes* <SEQ ID 3221> which encodes the amino acid sequence <SEQ ID 3222>. Analysis of this protein sequence reveals the following:

```
Possible site: 34
>>> Seems to have no N-terminal signal sequence

----- Final Results -----
            bacterial cytoplasm --- Certainty = 0.3465(Affirmative) < succ>
            bacterial membrane  --- Certainty = 0.0000(Not Clear)   < succ>
             bacterial outside  --- Certainty = 0.0000(Not Clear)   < succ>
```

An alignment of the GAS and GBS proteins is shown below.

```
Identities = 48/98 (48%), Positives = 74/98 (74%)

Query:   1 MNLNDRLKIEEMEEKYDSFKPRINALVEAIDDFQKHYEDYVKLREFYGSEDWFRLSEQTE  60
           M   D+L +E+ME+ Y++F P++  L+EA+D F++HYE+Y   LR FY S++WFRL+ Q
Sbjct:   1 MTKQDQLIVEKMEQTYEAFSPKLANLIEALDAFKEHYEEYATLRNFYSSDEWFRLANQPW  60

Query:  61 NNLKCGVLSEDQLFDFIGEHNELVGQFLDMSSQMYRHL                       98
           +++  CGVLSED LFD IG+HN+L+     LD++  MY+H+
Sbjct:  61 DDIPCGVLSEDLLFDMIGDHNQLLADILDLAPIMYKHN                       98
```

Based on this analysis, it was predicted that these proteins and their epitopes could be useful antigens for vaccines or diagnostics.

EXAMPLE 1042

A DNA sequence (GBSx1114) was identified in *S. agalactiae* <SEQ ID 3223> which encodes the amino acid sequence <SEQ ID 3224>. Analysis of this protein sequence reveals the following:

```
Possible site: 50
>>> Seems to have no N-terminal signal sequence

----- Final Results -----
              bacterial cytoplasm --- Certainty = 0.0965(Affirmative) < succ>
               bacterial membrane --- Certainty = 0.0000(Not Clear)  < succ>
                 bacterial outside --- Certainty = 0.0000(Not Clear)  < succ>
```

The protein has homology with the following sequences in the GENPEPT database.

```
>GP:BAB04438 GB:AP001509 transcriptional regulator (TetR/AcrR
           family) [Bacillus halodurans]
 Identities = 47/181 (25%), Positives = 95/181 (51%), Gaps = 16/181 (8%)

Query:    4 DTRREKTKRAIEAAMITLLKDQSFDEISTINLTKTAGISRSSFYTHYKDKYEMIDQYQQS    63
            D R++ T+  ++ +++ L++++    I+   +   A I+RS+FY+HY D Y+++ Q +
Sbjct:    6 DRRKKYTRMLLKESLMKLMQEKPLSNITIKEICDLADINRSTFYSHYTDLYDLLYQIEDE    65

Query:   64 LFNKV-EYIFDRNQFKKEDAL-----LEIFQFLDRESLFAALLTQNGTKEIQTYILNKLQ    117
              +   + E +   N  K E+AL      L ++   +RES    L ++ G     Q         K
Sbjct:   66 IIKDLSEALSSYNYTKDEEALQMTENLLVYIANNRESC-QTLFSEYGDPSFQ-----KKV    119

Query:  118 LMLSKELPVVNP---DATKSDINRLYYSVYLSHAIFGVYQMWITRGKKESPQQITQVLLSL   175
            +ML+ +  +  P       TK DI+  Y S+Y+ +    + Q W+   G K+SP+++ ++++ L
Sbjct:  120 MMLAHDHVIKTPLVGKHTKPDISE-YVSLYIVNGSIHIVQSWLKNGLKQSPKEMAELIIKL    179
```

A related DNA sequence was identified in S. pyogenes <SEQ ID 3225> which encodes the amino acid sequence <SEQ ID 3226>. Analysis of this protein sequence reveals the following:

```
     Possible site: 48
>>> Seems to have an uncleavable N-term signal seq

----- Final Results -----
              bacterial membrane --- Certainty = 0.0000 (Not Clear) < succ>
                bacterial outside --- Certainty = 0.0000 (Not Clear) < succ>
                 bacterial cytoplasm --- Certainty = 0.0000 (Not Clear) < succ>
```

The protein has homology with the following sequences in the databases:

```
>GP:BAB04438 GB:AP001509 transcriptional regulator (TetR/AcrR
           family) [Bacillus halodurans]
 Identities = 47/180 (26%), Positives = 88/180 (48%), Gaps = 18/180 (10%)

Query:    4 RKENTKQAILKAMVMLLKTESFDDITTVKLSKRAGISRSSFYTHYKDKYEMIDYYQQTFF    63
            RK+ T+  + ++++ L++ +      +IT    ++   A I+RS+FY+HY D Y+++   +
Sbjct:    8 RKKYTRMLLKESLMKLMQEKPLSNITIKEICDLADINRSTFYSHYTDLYDLLYQIEDEII    67

Query:   64 HKLEYIFEKKYQNKEQAFLEVFEFL-----QREQLLSSLLSANGTKEIQAFIINKVRLL-   117
               L          K++  L++ E  L          +L S  G  Q        KV +L
Sbjct:   68 KDLSEALSSYNYTKDEEALQMTENLLVYIANNRESCQTLFSEYGDPSFQ----KKVMMLA    123

Query:  118 ----ITTDLQDKFSTEELSQTEKEYQSIYLAHAFFGVCQSWIAKGKKESPQEMTQFVLKM    173
                I T L   K +    ++S    EY S+Y+ +    + QSW+   G K+SP+EM + ++K+
Sbjct:  124 HDHVIKTPLVGKHTRPDIS----EYVSLYIVNGSIHIVQSWLKNGLKQSPKEMAELIIKL    179
```

An alignment of the GAS and GBS proteins is shown below.

```
 Identities = 100/179 (55%), Positives = 134/179 (73%), Gaps = 2/179 (1%)

Query:    1 MVNDTRREKTKRAIEAAMITLLKDQSWDEISTINLTKTAGISRSSFYTHYKDKYEMIDQY    60
            MVN  R+E TK+AI  AM+ LLK +SFD+I+T+ L+K AGISRSSFYTHYKDKYEMID Y
Sbjct:    1 MVN--RKENTKQAILKAMVMLLKTESFDDITTVKLSKRAGISRSSFYTHYKDKYEMIDYY    58

Query:   61 QQSLFNKVEYIFDRNQFKKEDALLEIFQFLDRESLFAALLTQNGTKEIQTYILNKLQLML    120
            QQ+ F+K+EYIF++   KE A LE+F+FL RE L  ++LL+ NGTKEIQ +I+NK++L++
Sbjct:   59 QQTFFHKLEYIFEKKYQNKEQAFLEVFEFLQREQLLSSLLSANGTKEIQAFIINKVRLLI    118
```

```
Query: 121 SKELPVVNPDATKSDINRLYYSVYLSHAIFGVYQMWITRGKKESPQQITQVLLSLLPQT 179
            + +L         S   + Y S+YL+HA FGV Q WI +GKKESPQ++TQ +L +L   T
Sbjct: 119 TTDLQDKFSTEELSQTEKEYQSIYLAHAFFGVCQSWIAKGKKESPQEMTQFVLKMLTST 177
```

Based on this analysis, it was predicted that these proteins and their epitopes could be useful antigens for vaccines or diagnostics.

EXAMPLE 1043

A DNA sequence (GBSx1115) was identified in *S. agalactiae* <SEQ ID 3227> which encodes the amino acid sequence <SEQ ID 3228>. Analysis of this protein sequence reveals the following:

```
Possible site: 58
>>> Seems to have no N-terminal signal sequence
   INTEGRAL Likelihood = -10.35 Transmembrane 790-806 (787-808)
   INTEGRAL Likelihood =  -7.32 Transmembrane 707-723 (703-725)
   INTEGRAL Likelihood =  -7.11 Transmembrane 637-653 (630-659)
   INTEGRAL Likelihood =  -6.32 Transmembrane 678-694 (672-698)
   INTEGRAL Likelihood =  -1.44 Transmembrane  55-71   (55-73)
   INTEGRAL Likelihood =  -0.22 Transmembrane 732-748 (730-748)

----- Final Results -----
           bacterial membrane --- Certainty = 0.5140 (Affirmative) < succ>
            bacterial outside --- Certainty = 0.0000 (Not Clear)  < succ>
          bacterial cytoplasm --- Certainty = 0.0000 (Not Clear)  < succ>
```

A related GBS nucleic acid sequence <SEQ ID 10287> which encodes amino acid sequence <SEQ ID 10288> was also identified.

The protein has homology with the following sequences in the GENPEPT database.

```
>GP:CAB12856 GB:Z99109 alternate gene name: yixE~similar to phage
           infection protein [Bacillus subtilis]
 Identities = 227/783 (28%), Positives = 387/783 (48%), Gaps = 60/783 (7%)

Query:  45 KAIIKSPKLWITMAGVALIPTLYNVIFLSSMWDPYGNTKNLPVAVVNQDKSAKLNGKTIS 104
           K I+ S KL I +   +  +P +Y+ +FL + WDPYG    LPV VVNQDK A   G+ +
Sbjct:   9 KDIVTSKKLLIPIIAILFVPLIYSGVFLKAYWDPYGTVDQLPVVVVNQDKGATYEGERLQ  68

Query: 105 IGKDMEDNLSKNDSLDFHFTT-AKRAEKELEKGHYYMVITFPKDLSRKATTLMTEKPERL 163
           IG D+    L  N++ D+HF+     ++ K+L    YY+V+  P+D S+ A+T++ + P++L
Sbjct:  69 IGDDLVKELKDNNNFDWHFSNDLDQSLKDLLNQKYYLVVEIPEDFSKNASTVLDKNPKKL 128

Query: 164 NITYKTTKGRSFVASKMSETAANKLKDEVAESITGTYTESVFKNMGSMKTGINKAADGSQ 223
           ++ Y T  G ++V + + E A +KLK V++ +T  YT+ +F N   +  G++ A+ G++
Sbjct: 129 DLKYHTNAGSNYVGATIGEKAIDKLKASVSKEVTEQYTKVIFDNFKDIAKGLSDASSGAK 188

Query: 224 ELLNGSNKLQDGSQTLTSNLDVLASSSQTFSGGANKLNSGINLYTDGVGTLSNGLETLSD 283
           ++ +G+   ++GS L   NL L  S+ T S    +L  G     T G+ +L + L    D
Sbjct: 189 KIDDGTKDAKNGSAQLKENLAKLKESTATISDKTAQLADGAAQVTSGIQSLDSSLGKFQD 248

Query: 284 GVTAYTTGVHKLSEGSQKLDDKSQALV-------EGSEKLTDGLQQLSQATQLKPEQSRT 336
                      +L+ GS +L  K    L+          +G+    LT+GL QL+    Q    E+
Sbjct: 249 SSNQIYDKSSQLAAGSGELTSKMNELLAGLQNVQKGTPNLTNGLDQLNSKVQEGSEKAAK 308

Query: 337 LQNLSDG--LKNLNQIITNLQSTATTDSDTNSKLFNFLSTIESSTKALMNTAAADKQKQM 394
              + +      L    L  + NL+ + T    +L +F +++++ +A  N    +   +
Sbjct: 309 AEKIINALDLTKLETAVNNLEKSETAMKEFKKQLTDFENSLKNRDQAFKN--VINSSDFL 366

Query: 395 TAVQST----SAFKSLTPEQQSQITSAVTGTPTSAE-TIAANISSNIENMKTVLSEASSS 449
           TA Q +      S  K L          ++  PT+ +    A I S++E++K  +++ +
Sbjct: 367 TAEQKSQLINSVEKKLPQVDAPDFDQILSQLPTADQLPDIATIKSSLEDVKAQVAQVKAM 426

Query: 450 APSN----NGSQNLQTLSGTANNLVLKAISDLDKIQKLPTATKQLYQGSQTLTKGITDYT 505
           +       NG++ +Q                 D I +L     ++Y GSQ LT G T  T
Sbjct: 427 PEATSKLYNGAKTIQ----------------DAIDRLTEGADKIYNGSQKLTDGQTKLT 469

Query: 506 NAVGQLRKGAVTLDSKSNQLISGTQKASQGAQTLDSKSDQLRDGAGQLASGSDRIADGSN 565
            +G+   K     + S QL++ G           S Q+  G    +L GS ++   GS+
```

```
                        -continued
Sbjct:  470 AGIGEYNKQFAKAKAGSEQLVTG--------------SSQVSGGLFKLLDGSKQVQSGSS  515

Query:  566 KLAGGGHQLTDGLTELSGGVSQLSSSLGKAGDQLSMVSVNKDNANAVSSPVTIKHEDYDS  625
            KLA G   L  GL +L  G  +LSS L  A DQ    +  +        + PV  K +    S
Sbjct:  516 KLADGSASLDTGLGKLLDGTGELSSKLKDAADQTGDIDADDQTYGMFADPVKTKDDAIHS  575

Query:  626 VDTNGVGMAPYMISVALMVVALSANVIFAKALSGKEPANRFSWAKNK---LLINGFIATL  682
            V    G G+ PY++S+ L V  +    V+F       +   P N F W  +K   +++ G I +L
Sbjct:  576 VPNYGTGLTPYILSMGLYVGGIMLTVVFPLKEASGRPRNGFEWFFSKFNVMMLVGIIQSL  635

Query:  683 -AATILFFAVQFIGLKPDYPGKTYFIILLTAWTLMALVTALVGWDNRYGSFLSLLILLFQ  741
                AT+L        IGL+ +    + Y    ++T+    +A++  L           G F++++IL+  Q
Sbjct:  636 IVATVLLLG---IGLEVESTWRFYVFTIITSLAFLAIIQFLATTMGNPGRFIAVIILVLQ  692

Query:  742 LGSSAGTYPIELSPKFFQTIQPFLPMTYSVSGLRETISLTGDVNHQWRMLVIFLVSSMIL  801
            LG+S  GT+P+EL  P  F+Q  I      LPMTYS++G R    IS   GD    + W+M  +  +   ++++
Sbjct:  693 LGASGGTFPLELLPNFYQVIHGALPMTYSINGFRAVIS-NGDFGYMWQMAGVLIGIALVM  751

Query:  802 ALL                                                             804
            L
Sbjct:  752 IAL                                                             754
```

A related DNA sequence was identified in *S. pyogenes* [20] <SEQ ID 2017> which encodes the amino acid sequence <SEQ ID 2018>. Analysis of this protein sequence reveals the following:

```
Possible site: 26
>>> Seems to have no N-terminal signal sequence
    INTEGRAL Likelihood = -9.29 Transmembrane 735-751  (729-754)
    INTEGRAL Likelihood = -5.79 Transmembrane 582-598  (580-601)
    INTEGRAL Likelihood = -3.66 Transmembrane 652-668  (650-669)
    INTEGRAL Likelihood = -2.97 Transmembrane  14-30   (14-34)
    INTEGRAL Likelihood = -2.66 Transmembrane 623-639  (622-641)

----- Final Results -----
             bacterial membrane  --- Certainty = 0.4715 (Affirmative) < succ>
             bacterial outside   --- Certainty = 0.0000 (Not Clear)   < succ>
             bacterial cytoplasm --- Certainty = 0.0000 (Not Clear)   < succ>
```

An alignment of the GAS and GBS proteins is shown below.

```
 Identities = 360/779 (46%), Positives = 508/779 (64%), Gaps = 32/779 (4%)

Query:   40 MLDELKAIIKSPKLWITMAGVALIPTLYNVIFLSSMWDPYGNTKNLPVAVVNQDKSAKLN   99
            ML+ELK +IK+PKL ITM GVAL+P LYN+ FL SMWDPYG    +LP+AVVN DK AK
Sbjct:    1 MLEELKTLIKNPKLMITMIGVALVPALYNLSFLGSMWDPYGRVNDLPIAVVNHDKPAKRA   60

Query:  100 GKTISIGKDMEDNLSKNDSLDFHFTTAKRAEKELEKGHYYMVITFPKDLSRKATTLMTEK  159
              K+++IG DM D  +SK+   L++HF +AK+A++ L++G YYMVIT  P+DLS++A TL+  +
Sbjct:   61 DKSLTIGNDMVDKMSKSKDLEYHFVSAKQAQEGLKEGDYYMVITLPEDLSQRAATLLNPE  120

Query:  160 PERLNITYKTTKGRSFVASKMSETAANKLKDEVAESITGTYTESVFKNMGSMKTGINKAA  219
            P++L  I  Y+T+KG   VA+KM ETA  KLK+ V+++IT TYT +VF +M   +++G+  +A+
Sbjct:  121 PQKLTIRYQTSKCHGMVAAKMGETAMAKLKESVSQNITKTYTSAVFSSMTDLQSGLKEAS  180

Query:  220 DGSQELLNGSNKLQDCSQTLTSNLDVLASSSQTFSGGANKLNSGINLYTDGVGTLSNGLE  279
              GSQ  L  +G+     Q  GSQTL++NL  L   +SQ F  G   +L  SG+    YTDGV   + NGL
Sbjct:  181 AGSQALASGAKTAQAGSQTLSTNLAALTGASQQFQQGTGRLTSGLTTYTDGVNQVKNGLG  240

Query:  280 TLSDGVTAYTTGVHKLSEGSQKLDDKSQALVEGSEKLTDGLQQLSQATQLKPEQERTLQN  339
            TLS  +   Y   GV +LS+G+  +L+                GL  QL+QAT  L   E+  +Q+
Sbjct:  241 TLSTDIPNYLNGVSRLSQGASQLNQ--------------GLSQLTQATTLSDEKAKGIQS  286

Query:  340 LSDGLKNLNQIITNLQSTATTDSDTN---SKLFNFLSTIESSTKALMNTAAADKQKQNTA  396
            L   GL  LNQ I  L  +  +T   N       +L N L   +  + K ++    A + ++++A
Sbjct:  287 LIVGLPVLNQGIQQLNTELSTLQPPNLNADELGNSLGAIAQAAKQVIAEETAAQNEELSA  346

Query:  397 VQSTSAFKSLTPEQQSQITSAVTGTPTSAETIAAN-ISSNIENMKTVLSEASSSAPSNNG  455
             +Q+TS ++SLT EQQ  ++ +A++  +    S         AA  I S+++ + T L      S          S
Sbjct:  347 LQATSVYQSLTAEQQGELAAALSQSDKSQTVSAAQTILSSVQTLSTSLQSLSQEDQSKQL  406

Query:  456 SQNLQTLSGTANNLVLKAISDLDKIQKLPTATKQLYQGSQTLTKGITDYTNAV----GQL  511
              Q   + ++ AN             Q LP A+  L + S  L K              V              QL
Sbjct:  407 EQLKEAVAQIANQ----------SNQALPGASSALTELSTGLAKVNGSLNQQVLPGSNQL  456
```

-continued

```
Query:  512 RKGAVTLDSKSNQLISGTQKASQGAQTLDSKSDQLRDGAGQLASGSDRIADGSNKLAGGG  571
            G    L+  +   + SG   K S+GA   L SKS +L DG+ QL+ G+ ++ADGS++L+ GG
Sbjct:  457 TTGLAQLNRYNTAIGSGVIKLSEGANALSSKSGELLDGSHQLSEGATKLADGSSQLSQGG  516

Query:  572 HQLTDGLTELSGGVSQLSSSLGKAGDQLSMVSVNKDNANAVSSPVTIKHEDYDSVDTNGV  631
            HQLT GLTELS G+S L+ SL KA   QLS+VSV   NA AV+ P+ +   +D D V TNG+
Sbjct:  517 HQLTSGLTELSTGLSTLNGSLAKASQQLSLVSVTDKNAKAVAKPLVLNEKDKDGVKTNGI  576

Query:  632 GMAPYMISVALMVVALSANVIFAKALSGKEPANRFSWAKNKLLINGFIATLAATILFFAV  691
            GMAPYMI+V+LMVVALS NVIFA +LSG+    +++ WAK K +INGFI+T+ + +L+ A+
Sbjct:  577 GMAPYMIAVSLMVVALSTNVIFANSLSGRPVKDKWDWAKQKFVINGFISTMGSIVLYLAI  636

Query:  692 QFIGLKPDYFGKTYFIILLTAWTLMALVTALVGWDNRYGSFLSLLILLFQLGSSAGTYPI  751
                Q  +G + Y   +T    I+L+ WT MALVTALVGWD+RYGSF  SL++LL Q+GSS G+YPI
Sbjct:  637 QLLGFEARYGMETLGFIMLSGWTFMALVTALVGWDDRYGSFASLVMLLLQVGSSGGSYPI  696

Query:  752 ELSPKFFQTIQPFLPMTYSVSGLRETISLTGDVNHQWRMLVIFLVSSMILALLIYRKQE  810
            ELS  FFQ + PFLPMTY VSGLR+TISL+G +   + ++L   FL++ M+LALLIYR ++
Sbjct:  697 ELSGAFFQKLHPFLPMTYVVSGLRQTISLSGHIGVEVKVLTGFLLAFMVLALLIYRPKK  755
```

Based on this analysis, it was predicted that these proteins and their epitopes could be useful antigens for vaccines or diagnostics.

EXAMPLE 1044

A DNA sequence (GBSx1116) was identified in *S. agalactiae* <SEQ ID 3229> which encodes the amino acid sequence <SEQ ID 3230>. Analysis of this protein sequence reveals the following:

```
Possible site: 35
>>> Seems to have no N-terminal signal sequence

----- Final Results -----
         bacterial cytoplasm --- Certainty = 0.2664 (Affirmative) < succ>
          bacterial membrane --- Certainty = 0.0000 (Not Clear)   < succ>
           bacterial outside --- Certainty = 0.0000 (Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1045

A DNA sequence (GBSx1117) was identified in *S. agalactiae* <SEQ ID 3231> which encodes the amino acid sequence <SEQ ID 3232>. Analysis of this protein sequence reveals the following:

```
Possible site: 60
>>> Seems to have no N-terminal signal sequence
   INTEGRAL Likelihood = -9.45 Transmembrane 48-64 (45-69)
   INTEGRAL Likelihood = -1.49 Transmembrane 71-87 (71-87)

----- Final Results -----
          bacterial membrane --- Certainty = 0.4779 (Affirmative) < succ>
           bacterial outside --- Certainty = 0.0000 (Not Clear)   < succ>
         bacterial cytoplasm --- Certainty = 0.0000 (Not Clear)   < succ>
```

A related GBS nucleic acid sequence <SEQ ID 9441> which encodes amino acid sequence <SEQ ID 9442> was also identified.

The protein has homology with the following sequences in the GENPEPT database.

```
>GP:AAA25222 GB:M87483 ORF 1 [Lactococcus lactis]
 Identities = 50/88 (56%), Positives = 66/88 (74%), Gaps = 1/88 (1%)

Query:   2 TGKIFSMSKEELSYLPVIKLFKNQGVYNGLIGLFLLYGLYISQNQ-EIVAVFLINVLLVA  60
           T ++F+M KEEL     V  LFKNQG+YNGLIGL L+Y ++  S  Q EIV + LI ++LVA
Sbjct:  32 TSRVFNMGKEELERSSVQTLFKNQGIYNGLIGLGLIYAIFFSSAQLEIVRLLLIYIILVA  91
```

```
Query:  61 IYGALTVDKKILLKQGGLPILALLTFLF                          88
           +YG+LT +KKI+L QGGL ILAL++  F
Sbjct:  92 LYGSLTSNKKIILTQGGLAILALISSFF                         119
```

No corresponding DNA sequence was identified in *S. pyogenes*.

A related GBS gene <SEQ ID 8719> and protein <SEQ ID 8720> were also identified. Analysis of this protein sequence reveals the following:

```
Lipop: Possible site: -1   Crend: 8
McG: Discrim Score:       4.19
GvH: Signal Score (-7.5): -3.99
     Possible site: 38
>>> Seems to have an uncleavable N-term signal seq
ALOM program    count: 3 value:  -9.45 threshold:  0.0
   INTSGRAL   Likelihood = -9.45 Transmembrane  87-103   (84-108)
   INTEGRAL   Likelihood = -1.49 Transmembrane 110-126  (110-126)
   INTEGRAL   Likelihood = -0.37 Transmembrane  13-29    (13-29)
   PERIPHERAL Likelihood =  0.47    65
 modified ALOM score:   2.39

*** Reasoning Step: 3

----- Final Results -----
             bacterial membrane --- Certainty = 0.4779 (Affirmative) < succ>
              bacterial outside --- Certainty = 0.0000 (Not Clear)   < succ>
            bacterial cytoplasm --- Certainty = 0.0000 (Not Clear)   < succ>
```

The protein has homology with the following sequences in the databases:

```
ORF00610(328-681 of 981)
SP|Q02009|YTRP_LACLA(1-119 of 119) HYPOTHETICAL 13.3 KDA PROTEIN IN TRPE 5'REGION.
GP|551879|551879|gb|AAA25222.1||M87483 ORF 1 {Lactococcus lactis} PIR|S35123|S35123
hypothetical protein (trpE 5'region) - Lactococcus lactis subsp. lactis
% Match = 19.9
% Identity = 58.8    % Similarity = 77.3
Matches = 70   Mismatches = 26   Conservative Sub.s = 22
     114         144         174         204         234         264         294         324
SPKFFQTIQPFLPMTYSVSGLRETISLTGDVNHQWRMLVIFLVSSMILALLIYRKQED**KVSSDRLTV*YGMSKYLGGE
     354         384         414         444         474         504         534         561
DMSTLTIIIATLTALEHFYIMYLETLATQSNMTGKIFSMSKEELSYLPVIKLFKNQGVYNGLIGLFLLYGLYISQNQ-EI
    |: ||||::  |  |||  ||||||||:||   |    |::|:|  ||||      |   ||||||:||||||  |:|  :: |   | ||
MTILTIILSLLVALEFFYIMYLETFATSSKTTSRVFNMGKEELERSSVQTLFKNQGIYNGLIGLGLIYAIFFSSAQLEI
          10          20          30          40          50          60          70
     591         621         651         681         711         741         771         801
VAVFLINVLLVAIYGALTVDKKILLKQGGLPILALLTFLF*YYLAVRFS*TAFSNHFFLIIQVV*VICL*K*YNITTNSK
    | ::||  ::|||:||:||  :|||:|  ||||  ||||::   :|
VRLLLIYIILVALYGSLTSNKKIILTQGGLAILALISSFF
           90         100         110
```

Based on this analysis, it was predicted that these proteins and their epitopes could be useful antigens for vaccines or diagnostics.

EXAMPLE 1046

A DNA sequence (GBSx1118) was identified in *S. agalactiae* <SEQ ID 3233> which encodes the amino acid sequence <SEQ ID 3234>. Analysis of this protein sequence reveals the following:

```
Possible site: 41
>>> Seems to have no N-terminal signal sequence

----- Final Results -----
            bacterial cytoplasm --- Certainty = 0.3140 (Affirmative) < succ>
             bacterial membrane --- Certainty = 0.0000 (Not Clear)   < succ>
              bacterial outside --- Certainty = 0.0000 (Not Clear)   < succ>
```

A related GBS nucleic acid sequence <SEQ ID 10285> which encodes amino acid sequence <SEQ ID 10286> was also identified.

The protein has homology with the following sequences in the GENPEPT database.

```
>GP:CAB12447 GB:Z99107 similar to arylesterase [Bacillus subtilis]
 Identities = 37/91 (40%), Positives = 56/91 (60%)

Query:  13 KDGSDIYYRVVGQGQPIVFLHGNSLSSRYFDKQIAYFSKYYQVIVMDSRGHGKSHAKLNT   72
           +D + +YY   G G PI+F+HG  +S ++F KQ +  S  YQ I +D RGHG+S    L+
Sbjct:   7 EDQTRLYYETHGSGTPILFIHGVLMSGQFFHKQFSVLSANYQCIRLDLRGHGESDKVLHG   66

Query:  73 ISFRQIAVDLKDILVHLEIDKVILVGHSDGA  103
           +  Q A D+++ L  +E+D V+L G S GA
Sbjct:  67 HTISQYARDIREFLNANELDHVVLAGWSMGA   97
```

No corresponding DNA sequence was identified in *S. pyogenes*.

Based on this analysis, it was predicted that these proteins and their epitopes could be useful antigens for vaccines or diagnostics.

EXAMPLE 1047

A DNA sequence (GBSx1119) was identified in *S. agalactiae* <SEQ ID 3235> which encodes the amino acid sequence <SEQ ID 3236>. This protein is predicted to be an integral membrane protein. Analysis of this protein sequence reveals the following:

```
Possible site: 58
>>> Seems to have an uncleavable N-term signal seq
    INTEGRAL Likelihood = -12.90 Transmembrane  14-30    (9-41)
    INTEGRAL Likelihood =  -9.71 Transmembrane 451-467 (447-472)
    INTEGRAL Likelihood =  -9.18 Transmembrane 234-250 (229-257)
    INTEGRAL Likelihood =  -8.07 Transmembrane  56-72   (46-77)
    INTEGRAL Likelihood =  -8.01 Transmembrane 490-506 (484-512)
    INTEGRAL Likelihood =  -5.84 Transmembrane 414-430 (412-436)
    INTEGRAL Likelihood =  -4.99 Transmembrane 136-152 (135-159)
    INTEGRAL Likelihood =  -4.14 Transmembrane 213-229 (211-232)
    INTEGRAL Likelihood =  -4.14 Transmembrane 365-381 (364-382)
    INTEGRAL Likelihood =  -2.66 Transmembrane 393-409 (391-412)
    INTEGRAL Likelihood =  -1.06 Transmembrane 168-184 (167-184)
    INTEGRAL Likelihood =  -0.64 Transmembrane 275-291 (275-291)
    INTEGRAL Likelihood =  -0.32 Transmembrane 328-344 (328-345)
    INTEGRAL Likelihood =  -0.27 Transmembrane 821-837 (821-837)

----- Final Results -----
            bacterial membrane --- Certainty = 0.6158 (Affirmative) < succ>
             bacterial outside --- Certainty = 0.0000 (Not Clear) < succ>
           bacterial cytoplasm --- Certainty = 0.0000 (Not Clear) < succ>
```

A related GBS nucleic acid sequence <SEQ ID 10283> which encodes amino acid sequence <SEQ ID 10284> was also identified.

The protein has homology with the following sequences in the GENPEPT database.

```
>GP:BAA24464 GB:D85082 YfiX [Bacillus subtilis]
 Identities = 190/596 (31%), Positives = 324/596 (53%), Gaps = 31/596 (5%)

Query: 246 IVSLIPGGLGSFELVLFTGFAAEGLPKETVVAWLLLYRLAYYIIPFFAGIYFFIHYLGSQ  305
           ++SL+PGG GSF+L+    G      G  +E +V  ++LYRLAY  IPF G++F     L
Sbjct:   1 MISLVPGGFGSFDLLFLLGMEQLGYHQEAIVTSIVLYRLAYSFIPFILGLFFAAGDLTEN   60

Query: 306 INQRYENVPK-----ELVSTVLQTMVSHLMRILG---AFLIFSTAFFENITYIMWLQKLG  357
           +R E  P+      E + +L    L+RIL      + +F        +  + + +L
Sbjct:  61 TMKRLETNPRIAPAIETTNVLLVVQRAVLVRILQGSLSLIVFVAGLIVLASVSLPIDRLT  120

Query: 358 LDP-LQEQMLWQFPGLLLGVCFILLARTID--QKVKNAFPIAIIWITLTLFYLNLGHISW  414
           + P +    L FGL L    ILL  I+ ++ K ++ +AI +     + L ++
Sbjct: 121 VIPHIPRPALLLFNGLSLSSALILLILPIELYKRTKRSYTMAITALVGGFVSFLKGLNI  180

Query: 415 RLSFWFILLLLGLLVIKPTLYKKQFIYSWEERIKDGIIIVSLMGVLFY----IAGLLFPI  470
            F    ++++ L+++K   ++Q Y+ + I     V+L V     IAG ++
Sbjct: 181 SAIFVLPMIIVLLVLLKKQFVREQASYTLGQLI----FAVALFTVALFNYNLIAGFIWDR  236

Query: 471 RAHITGGSIERLHYIIAWEPIALATL----ILTLVYLCLVKILQGKSCQIGDVFNVDRYK  526
```

```
                  +      +   +++ +      I   AT+     I+ L +L      +   ++  IG+  + +R
Sbjct: 237 MKKV----LRHEYFVHSTSHITHATIMAIIIVPLFFLIFTVVYHRRTKPIGEKADPERLA 292

Query: 527 KLLQAYGGSSDSGLAFLNDKRLYWYQKNGEDCVAFQFVIVNNKCLIMGEPAGDDTYIREA 586
             L    GG++ S L  FL DKR Y +   +G    + F   +    + +++G+P+G
Sbjct: 293 AFLNEKGGNALSHLGFLGDKRFY-FSSDGNALLLFGKIA--RRLVVLGDPSGQRESFPLV 349

Query: 587 IESFIDDADKLDYDLVFYSIGQKLTLLLHEYGFDFMKVGEDALVNLETFTLKGNKYKPFR 646
           +E F+++A +   + ++FY  I ++    L H++G++F K+GE+A V+L TFTL G K     R
Sbjct: 350 LEEFLNEAHQKGFSVLFYQIEREDMALYHDFGYNFFKLGEEAYVDLNTFTLTGKKKAGLR 409

Query: 647 NALNRVEKDGFYFEVVQSPHSQSLLNSLEEISNTWLEGRPEKGFSLGYFNKDYFQQAPIA 706
                NR E++ + F V    P S     L  L++IS+ WL +  EKGFSLG+F+    Y Q+APIA
Sbjct: 410 AINNRFEREEYTFHVDHPPFSDAFLEELKQISDEWLGSKKEKGFSLGFFDPSYLQKAPIA 469

Query: 707 LVKNAEHEVVAFANIMPNYEKSIISIDLMRHDKQKIPNGVMDFLFLSLFSYYQEKGYHYF 766
             +KNAE E+VAFAN+MP Y++    IS+DLMR+ +     PNG+MD LF+ +F +  +E+G     F
Sbjct: 470 YMKNAEGEIVAFANVMPMYQEGEISVDLMRY-RGDAPNGIMDALFIRMFLWAKEEGCTSF 528

Query: 767 DLGMAPLSGVGRVETSFAKERMAYLVYHFGSHFYSFNGLHKYKKKFTPLWSERYIS     822
           ++GMAPL+ VG    TSF  ER A ++++   + YSF+GL   +K+K+ P W   +Y++
Sbjct: 529 NMGMAPLANVGTAFTSFWSERFAAVIFNNVRYMYSFSGLRAFKEKYKPEWRGKYLA     584
```

20

No corresponding DNA sequence was identified in S. pyogenes.

A related GBS gene <SEQ ID 8721> and protein <SEQ ID 8722> were also identified. Analysis of this protein sequence reveals the following:

```
Lipop: Possible site: -1    Crend: 9
McG: Discrim Score:       9.22
GvH: Signal Score (-7.5): -7.66
     Possible site: 58
>>> Seems to have an uncleavable N-term signal seq
ALOM program count: 14 value: -12.90 threshold: 0.0
    INTEGRAL   Likelihood =  -12.90 Transmembrane  14-30    (9-41)
    INTEGRAL   Likelihood =   -9.71 Transmembrane 451-467  (447-472)
    INTEGRAL   Likelihood =   -9.18 Transmembrane 234-250  (229-257)
    INTEGRAL   Likelihood =   -8.07 Transmembrane  56-72   (46-77)
    INTEGRAL   Likelihood =   -8.01 Transmembrane 490-506  (484-512)
    INTEGRAL   Likelihood =   -5.84 Tranamembrane 414-430  (412-436)
    INTEGRAL   Likelihood =   -4.99 Transmembrane 136-152  (135-159)
    INTEGRAL   Likelihood =   -4.14 Transmembrane 213-229  (211-232)
    INTEGRAL   Likelihood =   -4.14 Transmembrane 365-381  (364-382)
    INTEGRAL   Likelihood =   -2.66 Transmembrane 393-409  (391-412)
    INTEGRAL   Likelihood =   -1.06 Transmembrane 168-184  (167-184)
    INTEGRAL   Likelihood =   -0.64 Transmembrane 275-291  (275-291)
    INTEGRAL   Likelihood =   -0.32 Transmembrane 328-344  (328-345)
    INTEGRAL   Likelihood =   -0.27 Transmembrane 821-837  (821-837)
    PERIPHERAL Likelihood =    1.06     558
  modified ALOM score:   3.08

*** Reasoning Step: 3

----- Final Results -----
           bacterial membrane --- Certainty = 0.6158(Affirmative) < succ>
            bacterial outside --- Certainty = 0.0000(Not Clear)  < succ>
          bacterial cytoplasm --- Certainty = 0.0000(Not Clear)  < succ>
```

The protein has homology with the following sequences in the databases:

```
ORF00608(967-2787 of 3141)
OMNI|NT01BS0989(20-633 of 652) putative integral membrane protein, putative
% Match = 14.6
% Identity = 33.0   % Similarity = 58.0
Matches = 201  Mismatches = 244  Conservative Sub.s = 153

825        855        885        915        945        975       1005       1035
YYLVLIGASMYFPVIYWISGHKGSHYFGDMPSSTRIKLGVVSFFEWGCAAAAFIIIGYLMGIHLPVYKILPLFCIGCAVG
                                        :  ||||   :    ::  :| |         |
                                    LELQLLNGSWPGPVIYFALFAMGIHADIRYVFGVFVIAAIGG
                                        10         20         30         40
```

-continued

```
1065       1095       1125       1155       1185       1215       1245       1260
IVSLIPGGLGSFELVLFTGFAAEGLPKETVVAWLLLYRLAYYIIPFFAGIYFFIHYLGSQINQRYENVPK-----ELVST
::|||:|||:|||:::  |        |    :|   :|    ::||||||   |||    |::|         :|   |   |    |  :
MISLVPGGFGSFDLLFLLGMEQLGYHQEAIVTSIVLYRLAYSFIPFILGLFFAAGDLTENTMKRLETNPRIAPAIETTNV
            60         70         80         90        100        110        120
1290       1311       1341       1371       1398       1428       1458       1482
VLQTMVSHLMRIL-GAF--LIFSTAFFENITYIMWLQKLGLDP-LQEQMLWQPGLLLGVCFILLARTID--QKVKNAFP
:|    :  |:|||  |::  ::|    :       :   :  :  :|  :  |       |   |||   |   :|||    |:   :: | ::
LLVVQRAVLVRILQGSLSLIVFVAGLIVLASVSLPIDRLTVIPHIPRPALLLFNGLSLSSALILLILPIELYKRTKRSYT
          140        150        160        170        180        190        200
1512       1542       1572       1602       1632       1659       1689       1719
IAIIWITLTLFYLNLGHISWRLSFWFILLLLGLLVIKPTLYKKQFIYSWEE-RIKDGIIIVSLMGVLFYIAGLLFPIRAH
:||      :    : :      :|   |:|  ::  :|::           |  | ||||:           |         |      |   |:
MAITALVGGFVFSFLKGLN--ISAIFVLPMIIVLLV---LLKKQFVREQASYTLGQLIFAVALFTVALFJYNLIAGFIWD
          220        230        240        250        260        270
1749       1779       1797       1827       1857       1887       1917       1947
ITGGSIERLHYIIAWEPIALAT----LILTLVYLCLVKILQGKSCQIGDVFNVDRYKKLLQAYGGSSDSGLAFLNDKRLY
:        :::   :      |       ||     :|:|        |:        ||::   ::     ||:|   ||   |||:|
RMKKVLRHEYFVHSTSHITHATIMAIIIVPLFFLIFTVVYHKRTKPIGEKADPERLAAFLNEKGGNALSHLGPLGDKRFY
          290        300        310        320        330        340        350
1977       2007       2037       2067       2097       2127       2157       2187
WYQKNGEDCVAFQFVIVNNKCLIMGEPAGDDTYIREAIESFIDDADKLDYDLVFYSIGQKLTLLLHEYGFDFMKVGEDAL
:    |:    |     :|       |   :  :::|:|:|       :|  |:::   |    :    :||     ::       |   |::|::|   |:|:|:|
-FSSDGNALLLF--GKIARRLVVLGDPSGQRESFPLVLEEFLNEAHQKGFSVLFYQIEREDMALYHDFGYNFFKLGEEAY
             370        380        390        400        410        420        430
2217       2247       2277       2307       2337       2367       2397       2427
VNLETFTLKGNKYKPFRNALNRVEKDGFYFEVVQSPHSQELLNSLEEISNTWLEGRPEKGFSLGYFNKDYFQQAPIALVK
|:|  ||||  |  |     :|    || |::: :  |  |   |    :|    |::||:  ||    :  ||||||:|:|   |:|:|||| :|
VDLNTFTLTGKKKAGLRAINNRFEREEYTFHVDHPPFSDAFLEELKQISDEWLGSKKEKGFSLGFFDPSYLQKAPIAYMK
          450        460        470        480        490        500        510
2457       2487       2517       2547       2577       2607       2637       2667
NAEHEVVAFANIMPNYEKSIISIDLMRHDKQKIPNGVMDFLFLSLFSYYQEKGYHYFDLGMAPLSGVGRVETSFAKERMA
|||  |:|:||||:||  |::      ||:||||:  :         |||:||    ||: :|   :  :|:|    |::||||||: ||        |||  ||  |
NAEGEIVAFANVMPMYQEGEISVDLMRY-RGDAPNGIMDALFIRMFLWAKEEGCTSFNMGMAPLANVGTAFTSFWSERFA
          530        540        550        560        570        580        590
2697       2727       2757       2787       2817       2847       2877       2907
YLVYHFGSHFYSFNGLHKYKKKFTPLWSERYISCSRSSWLICAICALLMEDSKIKIVK*ALFGN*KEHVMRHALFKSFNT
::::    :  |||:||    :|:|:   |   |      :|::    ::     |
AVIFNNVRYMYSFSGLRAFKEKYKPEWRGKYLAYRKNRSLSVTMFLVTRLIGKSKKDSV
          610        620        630        640        650
```

Based on this analysis, it was predicted that these proteins and their epitopes could be useful antigens for vaccines or diagnostics.

EXAMPLE 1048

A DNA sequence (GBSx1120) was identified in *S. agalactiae* <SEQ ID 3237> which encodes the amino acid sequence <SEQ ID 3238>. This protein is predicted to be choline transporter. Analysis of this protein sequence reveals the following:

```
Possible site: 37
>>> Seems to have no N-terminal signal sequence
   INTEGRAL Likelihood = -10.24 Transmembrane 28-44   (22-47)
   INTEGRAL Likelihood =  -8.81 Transmembrane 178-194 (176-204)
   INTEGRAL Likelihood =  -7.22 Transmembrane 81-97   (63-105)
   INTEGRAL Likelihood =  -3.50 Transmembrane 209-225 (206-226)
   INTEGRAL Likelihood =  -3.13 Transmembrane 64-80   (63-80)
   INTEGRAL Likelihood =  -2.44 Transmembrane 156-172 (153-172)
   INTEGRAL Likelihood =  -0.64 Transmembrane 137-153 (137-153)

----- Final Results -----
         bacterial membrane  --- Certainty = 0.5097(Affirmative) < succ>
          bacterial outside  --- Certainty = 0.0000(Not Clear)   < succ>
        bacterial cytoplasm  --- Certainty = 0.0000(Not Clear)   < succ>
```

The protein has homology with the following sequences in the GENPEPT database.

```
>GP:AAD45530 GB:AF162656 choline transporter [Streptococcus pneumoniae]
 Identities = 326/505 (64%), Positives = 409/505 (80%), Gaps = 1/505 (0%)
```

-continued

```
Query:    1 MTTLITTFQERFGDWTQSLIEHLQLSLLTLILATLIAIPLGIIISHYKKISHVVLQITGI   60
            MT LI TFQ+RF DW  +L +HLQLSLLTL+LA L+AIPL + + +++K++  VLQI GI
Sbjct:    1 MTNLIATFQDRFSDWLTALSQHLQLSLLTLLLAILLAIPLAVFLRYHEKLADWVLQIAGI   60

Query:   61 FQTIPSLALLGLFIPFMGIGTVPAVVALIIYALFPILQNTVTVLMQIDANLIEAATAFGM  120
            FQTIPSLALLGLFIP MGIGT+PA+ AL+IYA+FPILQNT+T L   ID NL EA  AFGM
Sbjct:   61 FQTIPSLALLGLFIPLMGIGTLPALTALVIYAIFPILQNTITGLKGIDPNLQEAGIAFGM  120

Query:  121 TRWERLKKFELALSMPVIISGIRTASVMIIGTATLASLIGAGGLGSFILLGIDRNNPSLI  180
            TRWERLKKFE+ L+MPVI+SGIRTA+V+IIGTATLA+LIGAGGLGSFILLGIDRNN SLI
Sbjct:  121 TRWERLKKFEIPLAMPVIMSGIRTAAVLIIGTATLAALIGAGGLGSFILLGIDRNNASLI  180

Query:  181 LIGAISSAVLAIIFSGLIGLLEKARLRTIAVSGILLLAGLGLSYAPKWMPGTNTATITVA  240
            LIGA+SSAVLAI F+ L+ ++EKA+LRTI     L+    LGLSY+P +     + +A
Sbjct:  181 LIGALSSAVLAIAFNFLLKVMEKAKLRTIFSGFALVALLLGLSYSPALLVQKEKENLVIA  240

Query:  241 GKLGTEPDILINMYKELIEDQTDIKVLKPNFGKTTFLYQALKSGDIDLYPEFTGTITSS   300
            GK+G EP+IL NMYK LIE+ T +   +KPNFGKT+FLY+ALK GDID+YPEFTGT+T S
Sbjct:  241 GKIGPEPEILANMYKLLIEENTSMTATVKPNFGKTSFLYEALKKGDIDIYPEFTGTVTES  300

Query:  301 LLKNPPKVSNNPKQVYNLAKNGILKQDKLSLLSPMAYQNTYAVAVKKDYAEANQLKNISD  360
            LL+  PKVS+ P+QVY +A++GI KQD L+ L PM+YQNTYAVAV K  A+    LK ISD
Sbjct:  301 LLQPSPKVSHEPEQVYQVARDGIAKQDHLAYLKPMSYQNTYAVAVPKKIAQEYGLKTISD  360

Query:  361 LKKLD-KLKAGETLEFKDREDGSIGLQKHYGLNLDISTLEPALRYQAINSKDVNIIDAYS  419
            LKK++ +LKAGFTLEF DREDG+ GLQ   YGLNL+++T+EPALRYQAI S D+ I DAYS
Sbjct:  361 LKKVEGQLKAGFTLEFNDREDGNKGLQSMYGLNLNVATIEPALRYQAIQSGDIQITDAYS  420

Query:  420 TDSELIQYQLQILKDDKHLFPPYQGAPLLRQDTIKKYPQVKKALNKLAGHITEKEMQEMN  479
            TD+EL +Y LQ+L+DDK LFPPYQGAPL+++   +KK+P++++ LN LAG ITE +M ++N
Sbjct:  421 TDAELERYDLQVLEDDKQLFPPYQGAPLMKEALLKKHPELERVLNTLAGKITESQMSQLN  480

Query:  480 YQVAVKHKSAATVAKQYLKAHHIIK                                    504
            YQV V+ KSA  VAK++L+    ++K
Sbjct:  481 YQVGVEGKSAKQVAKEFLQEQGLLK                                    505
```

There is also homology to SEQ ID 636.

Based on this analysis, it was predicted that this protein and its epitopes, could be useful antigens for vaccines or diagnostics.

EXAMPLE 1049

A DNA sequence (GBSx1121) was identified in *S. agalactiae* <SEQ ID 3239> which encodes the amino acid sequence <SEQ ID 3240>. This protein is predicted to be choline transporter (opuBA). Analysis of this protein sequence reveals the following:

```
Possible site: 59
>>> Seems to have no N-terminal signal sequence

----- Final Results -----
          bacterial cytoplasm --- Certainty = 0.2345(Affirmative) < succ>
          bacterial membrane  --- Certainty = 0.0000(Not Clear)   < succ>
            bacterial outside --- Certainty = 0.0000(Not Clear)   < succ>
```

The protein has homology with the following sequences in the GENPEPT database.

```
>GP:AAD45529 GB:AF162655 choline transporter [Streptococcus pneumoniae]
 Identities = 139/236 (58%), Positives = 178/236 (74%)

Query:    1 MISFENVSKSYGDHTIIDNISCHIQRGEFFVLVGASGSGKTTILKMINRLIEPSQGAITL   60
            MI ++NV+  Y +  ++ +++  I+ GEF VLVG SGSGKTT+LKMINRL+EP+ G I +
Sbjct:    1 MIEYKNVALRYTEKDVLRDVNLQIEDGEFMVLVGPSGSGKTTMLKMINRLLEPTDGNIYM   60

Query:   61 DGENITSLDLRQLRLETGYVLQQIALFPNLTVGENIELIPEMKGWSKGDQKKAASDLLDK  120
            DG+ I   D R+LRL TGYVLQ IALFPNLTV ENI LIPEMKGWSK +  K    +LL K
Sbjct:   61 DGKRIKDYDERELRLSTGYVLQAIALFPNLTVAENIALIPEMKGWSKEEITKKTEELLAK  120

Query:  121 VGLPAKDYFNRYPHELSGGEQQRIGILRAIVAKPKVLLMDEPFSALDPISRRQLQDITKQ  180
            VGLP  +Y +R P ELSGGEQQR+GI+RA++ PK+ LMDEPFSALD ISR+QLQ +TK+
```

-continued

```
Sbjct: 121 VGLPVAEYGHRLPSELSGGEQQRVGIVRAMIGQPKIFLMDEPFSALDAISRKQLQVLTKE  180

Query: 181 LQSELGITLVFVTHDMKEAMRLADRICVIKEGKIVQLDRPEIIQNNPSDQFVRTLF       236
           L  E G+T +FVTHD  EA++LADRI V+++G+I Q+  PE I   P+  FV  LF
Sbjct: 181 LHKEFGMTTIFVTHDTDEALKLADRIAVLQDGEIRQVANPETILKAPATDFVADLF       236
```

There is also homology to SEQ ID 644.

Based on this analysis, it was predicted that this protein and its epitopes, could be useful antigens for vaccines or diagnostics.

EXAMPLE 1050

A DNA sequence (GBSx1122) was identified in *S. agalactiae* <SEQ ID 3241> which encodes the amino acid sequence <SEQ ID 3242>. This protein is predicted to be two-component response regulator. Analysis of this protein sequence reveals the following:

```
Possible site: 61
>>> Seems to have no N-terminal signal sequence
   INTEGRAL    Likelihood = -5.52   Transmembrane   49-65 (46-66)

----- Final Results -----
              bacterial membrane --- Certainty = 0.3208(Affirmative) < succ>
              bacterial outside  --- Certainty = 0.0000(Not Clear)   < succ>
              bacterial cytoplasm --- Certainty = 0.0000(Not Clear)   < succ>
```

The protein has homology with the following sequences in the GENPEPT database.

```
>GP:BAB06434 GB:AP001516 two-component response regulator [Bacillus halodurans]
 Identities = 101/305 (33%), Positives = 152/305 (49%), Gaps = 31/305 (10%)

Query:   1 MKFYIIDDDPTITMILQDIIE-EDFNNTVVRVNNVSSKAYNELLIADVDIVLIDLLNPIL    59
           M F+I DDD T+  IL   IIE E     V    + S       L I  VDI+LIDLLMP
Sbjct:   1 MNFFITDDDVTVRSILAQIIEDEQLGQVVGEAEDGSELDGKRLNIKQVDILLIDLLMPNC   60

Query:  60 DGVTLVQKIYKQRSDLKFIMISQVKDNDLRQEAYKAGIEFEINKPINIIEVKSVVKRVTD  119
           DG+  +QKI K    K  IMISQ++  +L   EAY  GIE +I KPIN IEV SV+++V +
Sbjct:  61 DGLEAIQKI-KPEFKGKIINISQIESKELISEAYLLGIEHYIMKPINKIEVLSVIRKVIN  119

Query: 120 TIEMQKKLNTIQNLLENTPSYQKPITTSNLT----KIRS----ILSYLGITSETAYTDIL  171
              +++ L  IQ L N   P  ++      +    I+S     +LS LGI  E+    D++
Sbjct: 120 HTRLEQSLYDIQKSLSNVLQGSIPTQVNDQVFHDDSIKSYGQYLLSELGIAGESGSKDLM  179

Query: 172 NICELLLKQELNF-------AQFDFQKELSIDE-----------HQQKIILQRIRRAVKK  213
           NI  L   E +         A D  ++L+ ++                + K   QR+RRAV +
Sbjct: 180 NILNFLYTYEKEYSFEKGFPALKDIFEQLASEKLGDAADERDVRREVKAAKQRVRRAVYQ  239

Query: 214 AMINNAHLYIDDFENELTLQYANALFGFQNIHNEAQLIQGK---SMYGGKISLKHFFDEL  270
           ++ ++A L + DF N   +YA+  F F + ++  ++ +  + S     +I++K F   L
Sbjct: 240 SLEHVASLGLIDFSNPKFEEYASHFFDFSVVRSKMTELKNETSSSYTSARINVKKFTQAL  299

Query: 271 ILQSK                                                        275
           ++K
Sbjct: 300 YYEAK                                                        304
```

There is homology to SEQ ID 460.

A related GBS gene <SEQ ID 8723> and protein <SEQ ID 8724> were also identified. Analysis of this protein sequence reveals the following:

```
Lipop: Possible site: -1   Crend: 8
McG: Discrim Score:      -7.05
GvH: Signal Score (-7.5): -6.58
     Possible site: 61
>>> Seems to have no N-terminal signal sequence
ALOM program count: 1 value: 5.52 threshold: 0.0
    INTEGRAL   Likelihood = -5.52 Transmembrane 49-65 (46-66)
```

```
-continued
    PERIPHERAL Likelihood =   7.37 155
 modified ALOM score:   1.60

*** Reasoning Step: 3

----- Final Results -----
            bacterial membrane --- Certainty = 0.3208(Affirmative) < succ>
            bacterial outside  --- Certainty = 0.0000(Not Clear)   < succ>
            bacterial cytoplasm --- Certainty = 0.0000(Not Clear)  < succ>
                                               10
```

The protein has homology with the following sequences in the databases:

```
ORF00604(307-1125 of 1431)
EGAD|137180|146289(3-304 of 310) hypothetical protein {Bacillus cereus}
GP|1769946|emb|CAA67094.1||X98455 orf1 {Bacillus cereus}
% Match = 12.7
% Identity = 34.1  % Similarity = 53.0
Matches = 95  Mismatches = 123  Conservative Sub.s = 53

168       198       228       258       288       318       348       375
*C*W*YLSRNRAIPRAYFNGRAISRNDNCLS*SAKWNNIYTVIP*KSI*VRR*YVKFYIIDDDPTITMILQDIIEE-DFN
                                                      :||:|||     :|  |||: |:
                                                     MFYYIVDDDEVFRSMLSQIIEDGDLG
                                                            10        20
  405       435       465       495       525       555       585       615
NTVVRVNNVSSKAYNELLIADVDIVLIDLLMPILDGVTLVQKIYKQRSDLKFIMISQVKDNDLRQEAYKAGIEFFINKPI
 :    : :    :|   |||::||||||: ||: |: |      | ||||||:  |  ||| |:|::| ||:
EVIGESEDGAFVEAEQLNYKKVDILFIDLLMPMRDGIETVRHI-ASSFTGKIIMISQVESKQLIGEAYTLGVEYYITKPL
       40        50        60        70        80        90        100
  645       675       705            753       771       801       831
NIIEVKSVVKRVTDTIEMQKKLNTIQNLLENTPSYQKP----ITTSNLTKI----RSILSYLGITSETAYTDILNICELL
| ||| |||:| :  | : :::    || | |   ::||    |    ||    | :|: ||| |       |:|:: : :
NKIEVVSVVRKVIERIRLERSIYDIQKSLNNVFQWEKPQMRSETVQEEKKISDSGRFLLAELGIAGENGSKDLLSMLEYL
       120       130       140       150       160       170       180
  861            894       924       954       984      1014
LKQELNFAQFDFQKELSID------------------EHQQKIILQRIRRAVKKAMINMAHLYIDDFENELTLQYANAL
    ||       |:|        |                  | ::|   ||:|||: ::: ::|  | : ||| ||  :
YGQE-KAQTFEFGFPALKDIFHQITLKKLGEIASDADIEKEKKASEQRVRRAIYQSLNHLASLGLTDFSNPKFESYAPKF
       200       210       220       230       240       250       260
 1071      1095      1125      1155      1185      1215      1245
FGFQNIHNE-AQLIQGKSMYGGKISL--KHFFDELILQSKTF*DLFKHGLIYYNHPKTFLFINLQQTPCLPQGVCFCF*F
|  |    :     ::  :       | | :    |  :    | :::|
FDFTVVRKRMTEMTKDGVATSGHIRINTKKFIQVLYFEAKRLMEIE
        280       290       300       310
```

SEQ ID 8724 (GBS356) was expressed in E. coli as a His-fusion product. SDS-PAGE analysis of total cell extract is shown in FIG. 73 (lane 3; MW 34 kDa). It was also expressed in E. coli as a GST-fusion product. SDS-PAGE analysis of total cell extract is shown in FIG. 81 (lane 8; MW 59 kDa).

GBS356-GST was purified as shown in FIG. 216, lane 7.

Based on this analysis, it was predicted that these proteins and their epitopes could be useful antigens for vaccines or diagnostics.

EXAMPLE 1051

A DNA sequence (GBSx1123) was identified in S. agalactiae <SEQ ID 3243> which encodes the amino acid sequence <SEQ ID 3244>. Analysis of this protein sequence reveals the following:

```
            Possible site: 26
            >>> Seems to have a cleavable N-term signal seq.
                INTEGRAL Likelihood = -6.48 Transmembrane 149-165  (147-172)
                INTEGRAL Likelihood = -5.20 Transmembrane  37-53    (29-55)
                INTEGRAL Likelihood = -2.50 Transmembrane 126-142  (126-142)
                INTEGRAL Likelihood = -2.13 Transmembrane  62-78    (60-78)
                INTEGRAL Likelihood = -0.64 Transmembrane 314-330  (314-330)
                INTEGRAL Likelihood = -0.11 Transmembrane  89-105   (89-105)

----- Final Results -----
                     bacterial membrane  --- Certainty = 0.3590(Affirmative) < succ>
                     bacterial outside   --- Certainty = 0.0000(Not Clear)   < succ>
                     bacterial cytoplasm --- Certainty = 0.0000(Not Clear)   < succ>
```

The protein has homology with the following sequences in the GENPEPT database.

```
>GP:BAB06435 GB:AP001516 two-component sensor histidine kinase
          [Bacillus halodurans]
 Identities = 118/427 (27%), Positives = 199/427 (45%), Gaps = 25/427 (5%)

Query:  10 LERRQRIIISAIAIA-LAAQINISILADGFIMTLSLFILPVFLYFNDDINPILLCLGITF   68
            L +    II+S +  A +A +IN    + + F ++L   I  +FL F  +I+
Sbjct:   7 LSKDYMIILSMLLFAPIAGEINFYPVNETFRVSLGPPIFFLFLLFLRNTAAIVPGFFTAI   66

Query:  69 ASPIFRGIILSIAGEAEIHQIIEFVLTDMAFYICYGITFYTIYWHRSYRNKGTFFFSIII  128
            A  +FR + ++  +       E       FY Y + F    R +      F  II
Sbjct:  67 AVVVFRVFLDTLHADFYWVDSFEIHYPTFFFYFTYSLLFSLAKVQRFHEQPLIIFLFGII  126

Query: 129 CDYFANLVEISFLIKFNNYTITIFA-TLFAIALLRAFISCAVAYTYSYLSLLLQKD---D  184
             +  A+  E  F+ ++   + +    ++F  I  L+      S    V   +S  L     +
Sbjct: 127 IEILADTAE--FIAQYFAFGVMVTKDSIFQILLIAFSHSFIVLGVFSMMKLYETRSRELE  184

Query: 185 HERRYYYFMWSTSAVKSEVYFMQKNIIEIENIMKNAYLLDKELSKY---HLPKEYQHLS-  240
            +R  + +    S + E      ++K  +    E+I       + L +E+ +    H+    HL
Sbjct: 185 IRKRNEHMLLLISNLYEESVHLKKTLQNSEDITSKVFGLYREMKRLQSEHMDQVNPHLEK  244

Query: 241 -----LDISRDVHEVKKDYQNIIKGLGTYFSVKNESTMALKDIFQIVLSYTRS---IIQF  292
                 L+IS +VHE+KKD Q I   GL    S   NES +     +I QI+    R+         Q
Sbjct: 245 ISKRLLEISGEVHEIKKDNQRIFAGLSKLIS--NESYVDYIEIGQIIKMIVRTNEKYAQL  302

Query: 293 RHQDIIILENNKCNLIISNYYYLLTIISNIVLNAVEAIDKQKKGTISVHTESLEDFIKIE  352
             ++I   + +         + Y  L+II+N+V NAVEAID     KG +++   + L    ++
Sbjct: 303 LGKEIDFHYSIQGEHPPYHIYTHLSIINNLVANAVEAIDG--KGNLTIRVKALGQTVEFR  360

Query: 353 ISDNGPGIPDKMKHMIFKPGFSTKFDANGDIYRGIGLSHVRILMEEQYQGTITVCPNQ-P  411
             I D+GPGIPDK +  +IFKPGF++KFD   G    GIGL++V     M ++    GT+           Q
Sbjct: 361 IEDDGPGIPDKHRALIFKPGFTSKFDHTGKPSTGIGLTYVHD-MVDKLGGTVVYERGQGG  419

Query: 412 NGTTFTL                                                      418
            G+  FT+
Sbjct: 420 KGSVFTI                                                      426
```

Based on this analysis, it was predicted that this protein and its epitopes, could be useful antigens for vaccines or diagnostics.

EXAMPLE 1052

A DNA sequence (GBSx1124) was identified in *S. agalactiae* <SEQ ID 3245> which encodes the amino acid sequence <SEQ ID 3246>. This protein is predicted to be ornithine carbamoyltransferase Otc6850 (argF). Analysis of this protein sequence reveals the following:

```
Possible site: 61
>>>Seems to have no N-terminal signal sequence
   INTEGRAL Likelihood = -0.64 Transmembrane 171-187 (171-187)

----- Final Results -----
            bacterial membrane --- Certainty = 0.1256(Affirmative) < succ>
             bacterial outside --- Certainty = 0.0000(Not Clear) < succ>
           bacterial cytoplasm --- Certainty = 0.0000(Not Clear) < succ>
```

The protein has homology with the following sequences in the GENPEPT database.

```
>GP:CAB75986 GB:AJ272085 ornithine carbamoyltransferase
          [Staphylococcus aureus]
 Identities = 264/332 (79%), Positives = 292/332 (87%)

Query:   1 MKNLRNRSFLTLLDFSTAEVEFLLKLSEDLKRAKYAGIEQQKLVGKNIALIFEKDSTRTR   60
           MKNLRNRSFLTLLDFS  EVEFLL LSEDLKRAKY G E+    L  KNIAL+FSKDSTRTR
Sbjct:   1 MKNLRNRSFLTLLDFSRQEVEFLLTLSEDLKRAKYIGTEKPMLKNKNIALLFEKDSTRTR   60

Query:  61 CAFEVAAHDQGAHVTYLGPTGSQMGKKETSKDTARVLGGMYDGIEYRGFSQETVETLAEF  120
           CAFEVAAHDQGA+VTYLGPTGSQMGKKET+KDTARVLGGMYDGIEYRGFSQ TVETLAE+
Sbjct:  61 CAFEVAAHDQGANVTYLGPTGSQMGKKETTKDTARVLGGMYDGIEYRGFSQRTVETLAEY  120

Query: 121 SGVPVWNGLTDADHPTQVLADFLTAKECLHKPYKDIRFTYVGDGRNNVANALMIGASIVG  180
           SGVPVWNGLTD DHPTQVLADFLTAKE L K Y DI FTYVGDGRNNVANALM GA+I+G
```

```
                             -continued
Sbjct: 121 SGVPVWNGLTDEDHPTQVLADFLTAKEVLKKDYADINFTYVGDGRNNVANALMQGAAIMG 180

Query: 181 MTYHLVCPKELEPDPELLSKCQEIAKTTGASIEITADIAEGVRDSDVLYTDVWVSMGSPD 240
            M +HLVCPKEL P  ELL++C+ IA   G +I IT DI +GV+ SDV+YTDVWVSHGEPD
Sbjct: 181 MNFHLVCPKELNPTDELLNRCKNIAAENGGNILITDDIDQGVKGSDVIYTDVWVSMGEPD 240

Query: 241 EVWKERIALLEPYRITQEMLNMTENPNVIFEHCLPSFHNIDTKVGYDIYEKYGLKEMSVS 300
            EVWKER+ LL+PY++ +EM++ T NPNVIFEHCLPSFHN DTK+G  I+EKYG++EMEV+
Sbjct: 241 EVWKERLSLLKPYQVNKEMMDKTGNPNVIFEHCLPSFHNADTKIGQQIFEKYGIREMEVT 300

Query: 301 DSVFEGPHSVVFQEAENRMHTIKAVMVATLGD 332
            DEVFE    SVVFQSAENRMHTIKAVMVATLG+
Sbjct: 301 DEVFESKASVVFQEAENRMHTIKAVMVATLGE 332
```

There is also homology to SEQ ID 3118.

Based on this analysis, it was predicted that this protein and its epitopes, could be useful antigens for vaccines or diagnostics.

EXAMPLE 1053

A DNA sequence (GBSx1126) was identified in *S. agalactiae* <SEQ ID 3247> which encodes the amino acid sequence <SEQ ID 3248>. This protein is predicted to be carbamate kinase (b2874). Analysis of this protein sequence reveals the following:

```
Possible site: 53
>>> Seems to have no N-terminal signal sequence
    INTEGRAL    Likelihood = -0.48    Transmembrane    214-230 (214-230)

----- Final Results -----
            bacterial membrane --- Certainty = 0.1192 (Affirmative) < succ>
            bacterial outside  --- Certainty = 0.0000 (Not Clear)  < succ>
            bacterial cytoplasm --- Certainty = 0.0000 (Not Clear)  < succ>
```

The protein has homology with the following sequences in the GENPEPT database.

```
>GP:CAA66367 GB:X97768 carbamate kinase [Clostridium perfringens]
 Identities = 162/313 (51%), Positives = 207/313 (65%), Gaps = 7/313 (2%)
Query:   3 KIVVALGGNAL-----GNSPEEQLRLVKHTAKSLVALIKKGHEIVVSHGNGPQVGAINLG  57
           KIV+ALG NAL      S E QL   + TA S+  LI+ GHE+ + HGNGPQVG I
Sbjct:   2 KIVLALGENALQKDSKDKSAEGQLETCRQTAISVADLIEDGHEVSIVHGNGPQVGQILAS  61

Query:  58 MNFAAESGQGTN-FPFPECGAMSQGYIGYHLQQSLLNELRQEGINKEVATIITQIEVDES 116
             + A +   G   FPF   GA S+GYIGYHLQ ++  EL + GI K V TI TQ+ VD++
Sbjct:  62 IELAHQVDNGNPLFPFDVVGAFSEGYIGYHLQNTIREELLKRGIEKSVDTITTQVIVDKN 121

Query: 117 DQAFSAPTKPIGTFYDKETSEKIAIEKGYTFVEDAGRGYRRVVASPEPKKIIEINSIKTL 176
           D  F+ PTKPIG+FY KE +EK+  +KGYT  EDAGRGYRRVVASP+P  I+E  +IKT+
Sbjct: 122 DPGFTNPTKPIGSFYTKEEAEKLEKDKGYTMKEDAGRGYRRVVASPKPVDIVEKEAIKTM 181

Query: 177 IENDTLVIAGGGGGIPVINKGG-YEGIAAVIDKDKSSALLAGELAADQLIILTAVDYVYT 235
            +++  +VIA GGGGIPV+   G   EG+ AVIDKD ++  LA   L AD L+ILTAVD V
Sbjct: 182 VDSGFIVIACGGGGIPVVEDGDRLEGVPAVIDKDFAAEKLAEILDADALLILTAVDRVCV 241

Query: 236 QFGKENQKALTEVNENQMIDYVNQGEFAKGSMLPKVIACMSFLDHNPKGTALITSLNGLE 295
             F K +QKAL E+N  ++  Y+ +G+FA GSMLPKV AC  F+   K  A+I SL    +
Sbjct: 242 NFNKPDQKALKEINLEEVDKYIEEGQFAPGSMLPKVEACKKFVLSGDKKVAIIASLTNAK 301

Query: 296 DALDGKLGTRITK 308
            AL G+ GT+I K
Sbjct: 302 AALRGESGTKIVK 314
```

There is also homology to SEQ ID 3110.

Based on this analysis, it was predicted that this protein and its epitopes, could be useful antigens for vaccines or diagnostics.

EXAMPLE 1054

A DNA sequence (GBSx1127) was identified in *S. agalactiae* <SEQ ID 3249> which encodes the amino acid sequence <SEQ ID 3250>. Analysis of this protein sequence reveals the following:

```
Possible site: 34
>>> Seems to have no N-terminal signal sequence

----- Final Results -----
           bacterial cytoplasm --- Certainty = 0.3558 (Affirmative) < succ>
           bacterial membrane  --- Certainty = 0.0000 (Not Clear)   < succ>
            bacterial outside  --- Certainty = 0.0000 (Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1055

A DNA sequence (GBSx1128) was identified in *S. agalactiae* <SEQ ID 3251> which encodes the amino acid sequence <SEQ ID 3252>. This protein is predicted to be a transmembrane protein (b2298). Analysis of this protein sequence reveals the following:

```
Possible site: 35
>>>Seems to have a cleavable N-term signal seq.
     INTEGRAL    Likelihood = -13.11    Transmembrane    413-429  (405-440)
     INTEGRAL    Likelihood =  -9.61    Transmembrane    498-514  (489-516)
     INTEGRAL    Likelihood =  -9.45    Transmembrane    165-181  (161-185)
     INTEGRAL    Likelihood =  -8.07    Transmembrane    127-143  (122-146)
     INTEGRAL    Likelihood =  -7.22    Transmembrane    308-324  (306-326)
     INTEGRAL    Likelihood =  -5.57    Transmembrane    334-350  (330-357)
     INTEGRAL    Likelihood =  -4.51    Transmembrane    194-210  (193-217)
     INTEGRAL    Likelihood =  -3.82    Transmembrane    372-388  (371-390)
     INTEGRAL    Likelihood =  -1.22    Transmembrane    250-266  (250-268)
     INTEGRAL    Likelihood =  -0.80    Transmembrane    468-484  (468-484)
     INTEGRAL    Likelihood =  -0.32    Transmembrane    436-452  (436-452)

----- Final Results -----
             bacterial membrane  --- Certainty = 0.6243 (Affirmative) < succ>
              bacterial outside  --- Certainty = 0.0000 (Not Clear)   < succ>
           bacterial cytoplasm   --- Certainty = 0.0000 (Not Clear)   < succ>
```

The protein has homology with the following sequences in the GENPEPT database.

```
>GP:AAC22251 GB:U32741 conserved hypothetical transmembrane protein
       [Haemophilus influenzae Rd]
  Identities = 303/506 (59%), Positives = 389/506 (75%), Gaps = 6/506 (1%)
   Query:   10 NKRSKGFRMPGAFTILFILTIFSVLATWWIPAGSYSKLQFDTASSKLVVTDPNGKTVHVP    69
              +K+  K F  P AFTILF + I +V  TW IP+GSYSKL +++   +  VV           P
   Sbjct:    4 SKKKKTFNFPSAFTILFAILILAVGLTWVIPSGSYSKLTYNSTDNVFVVKAYGVDDKTYP    63

Query:   70 ATQTQLDKMNVKIKIKEFTSGAISKPVSVPNTYKRLKQNPAGIGSVTTSMVNGTIEAVDI   129
                 AT    LD +N+KIK+   FT G I  KP+++P  TY+R++Q+   GI   +T SMV GTIEAVD+
   Sbjct:   64 ATTDTLDNLNIKIKLSNFTEGVIKKPIAIPGTYQRVEQHHKGIEDITKSMVEGTIEAVDV   123

Query:  130 MVFIMVLGGMIGVVRKSGAFESGLLALTKKTKGREFLLIFLVSLLMVLGGTLCGIEEEAV   189
                  MVFI VLGGMIGV+ ++G+F +GL+AL KKTKG EF  ++F VS+LMVLGGT CGIEEEAV
   Sbjct:  124 MVFIFVLGGMIGVINRTGSFNAGLMALVKKTKGNEFFIVFCVSVLMVLGGTTCGIEEEAV   183

Query:  190 AFYPILVPIFLAMGYDSIICVGAIFLASSVGTSFSTINPFSSVIASNAAGISFTEGLSWR   249
                  AFYPILVP+FLA+GYD+I+CVGAIFLA+S+GT+FSTINPFS VIASNAAGI FTEG+ +R
   Sbjct:  184 AFYPILVPVFLALGYDAIVCVGAIFLAASMGTAFSTINPFSVVIASNAAGIQFTEGIGFR   243

Query:  250 TAGCIAGAIFVVVYLHWYAKKIKANPEFSYSYEDRVEFNAKWGMTTN-HTPSLFTIRQKI   308
                      G + GA  V+ YL+WY KKIKA+P FSY+Y+DR EF  ++      + +T    F+ R+K+
   Sbjct:  244 ALGLVLGATCVIAYLYWYCKKIKADPSFSYTYDDREEFRQRYMKNFDPNTTIPFSARRKL   303

Query:  309 ILSLFVISFPLMVWGVMSQGWWFPTMASSFLAITIIIMFLTATGANGIGERDVVDEFVNG   368
                  IL+LF  ISFP+M+WGVM  GWWFP MA+SFLAITIIIMF+          +G+ E+D+++ F   G
   Sbjct:  304 ILTLFCISFPIMIWGVMGGWWFPQMAASFLAITIIIMFI-----SGLSEKDIMESFTEG   358

Query:  369 ASSLVGVSLIIGLARGINIILSQGYISDTMLYTASKLASHVSGSVFIIVMMFIYFVLGFV   428
                   AS LVGVSLIIGLARG+N++L  QG ISDT+L     S + S +  GSVFI+  +  ++  LG +
   Sbjct:  359 ASELVGVSLIIGLARGVNLVLEQGMISDTILDYMSNVVSGMPGSVFILGQLVVFIFLGLI   418

Query:  429 VPSSSGLAVLSMPILAPLADTVGIPRSVVVMAYQFGQYAMLFLAPTGLVMATLQMLDMKY   488
                  VPSSSGLAVLSMPI+APLAD+VGIPR +VV AY +GQYAMLFLAPTGLV+ TLQML + +
   Sbjct:  419 VPSSSGLAVLSMPIMAPLADSVGIPRDIVVSAYNWGQYAMLFLAPTGLVLVTLQMLQIPF   478

Query:  489 SHWLKFVWPVVLFLLIFGGGLLVLQV                                    514
```

```
                            W+KFV P++   LL+  G   LLV+QV
Sbjct: 479 DRWVKFVMPMIGCLLLIGSILLVVQV                             504
```

A related DNA sequence was identified in *S. pyogenes* <SEQ ID 3253> which encodes the amino acid sequence <SEQ ID 3254>. Analysis of this protein sequence reveals the following:

```
Possible site: 36
>>> Seems to have a cleavable N-term signal seq.
    INTEGRAL    Likelihood = -13.21      Transmembrane   479-495  (472-496)
    INTEGRAL    Likelihood = -10.24      Transmembrane   261-277  (258-280)
    INTEGRAL    Likelihood =  -9.24      Transmembrane   153-169  (142-180)
    INTEGRAL    Likelihood =  -7.17      Transmembrane   393-409  (391-411)
    INTEGRAL    Likelihood =  -6.00      Transmembrane    81-97    (78-99)
    INTEGRAL    Likelihood =  -5.95      Transmembrane   318-334  (314-338)
    INTEGRAL    Likelihood =  -3.77      Transmembrane   352-368  (352-369)
    INTEGRAL    Likelihood =  -2.66      Transmembrane   120-136  (119-138)
    INTEGRAL    Likelihood =  -0.32      Transmembrane   204-220  (204-220)

----- Final Results -----
             bacterial membrane  --- Certainty = 0.6286 (Affirmative) < succ>
             bacterial outside   --- Certainty = 0.0000 (Not Clear)   < succ>
           bacterial cytoplasm   --- Certainty = 0.0000 (Not Clear)   < succ>
```

The protein has homology with the following sequences in the databases:

```
>GP:AAB94000 GB:AF008219 unknown [Borrelia afzelii]
 Identities = 174/496 (35%), Positives = 306/496 (61%), Gaps = 37/496 (7%)
Query:  10 RIPSSYTVLFIIIAIMAVLTWFIPAGAYETAK---GGG-----VISGTYKTVASNPQGFF    61
           ++PSS+T++F +I + +LT+ IPAG ++       G G      +++GTY+T+    P+GF
Sbjct:   3 KMPSSFTIIFSLIVFVTILTYVIPAGKFDKEFRQIGDGPKREIIVAGTYQTIDRGPRGFL    62

Query:  62 DILMAPVRGMLGVEGTDGAIQVSFFILMVGGFLGVVNKTGALDTGIASVVRKNKGREKML   121
           +M + M   +G + A +V  F+L+VGG  G++ KTGA+D GI S+++K    ++K+L
Sbjct:  63 HPIMTILTAMS--KGMEHAAEVIIFVLIVGGAYGIIMKTGAIDAGIYSLIKKLGHKDELL   120

Query: 122 IAILIPLFALGGTTYGMGEETMAFYPLLIPVMIAVGFDSIVAVAIILIGSQIGCLASTIN   181
           I +L+ +F++GGT  GM EET+ FY ++IP+++A+G+D++V VAII +G+ +G +AST+N
Sbjct: 121 IPLLMFIFSIGGTVTGMSEETLPFYFVMIPLIVALGYDNVVGVAIIALGAGVGTMASTVN   180

Query: 182 PFATGVAADAAGVSIADGMIWRVIQWVILVGMSIWFVYNYASKIEEDPSKSLVADKEEEH   241
           PFATG+A+   A +S+ DG  +R++  + I + ++I +V  YAS+I++DPSKSLV  K+ EH
Sbjct: 181 PFATGIASAIASISLQDGFSFRIVLYFISILVAIIYVCVYASRIKKDPSKSLVYSKKNEH   240

Query: 242 KELF-QLQNSGEDLNKRQRNVLTIFTLTFVIMILSLIPWEDFGIKFFTNINTWLTTMPIL   300
           + F + + S ED       NV     TF   ++ L+    FG    I  + ++   L
Sbjct: 241 YQYFVKNEISKED------NVQNTLEFTFARKLVLLL----FGFM----ILFLVFSIVQL   286

Query: 301 GGVIGKTMGAFGTWYFPEITMLFIMMGVLVAIVYRMSEEDFFSSFLTGAGEFLGVAMICA   360
           G              W+  E+TML++  +  ++ A + R+ E + + +F+  G+     A+I
Sbjct: 287 G------------WWMQEMTMLYLGVAIISAFICRLGESEMWDAFVKGSESLITAALIIG   334

Query: 361 IARGIQVIMNGGNITATILHLGETSLSGLSSQVFVILAYIFYLPMSFLIPSTSGLAGATM   420
           +ARG+ ++  + G+ITAT+L+          L   L       F+IL    I  +      F++PS+SG A   TM
Sbjct: 335 LARGVMIVCDDGLITATMLNAATNFLYNLPRPFFIILNEIIQIFIGFIVPSSSGHASLTM   394

Query: 421 GIMAPLGQFSNVPAHLVITAFQSASGILNMISPTSAIVMGALALGRVDLGTWWKFIGKFI   480
              IMAPL  F ++    V+ A Q++SG++N+I+PTS ++M   L + ++    GTW+KF +
Sbjct: 395 PIMAPLADFLSIGRSSVVIAMQTSSGLINLITPTSGVIMAVLGISKLSYGTWFRFVLPLF   454

Query: 481 VMVMLVSVLLLVVATF                                              496
           ++     +S+L+++    +
Sbjct: 455 IIEFFISILVIIANVY                                              470
```

An alignment of the GAS and GBS proteins is shown below.

```
 Identities = 158/542 (29%), Positives = 274/542 (50%), Gaps = 92/542 (16%)
Query:  11 KRSKGFRMPGAFTILFILTIFSVLATWWIPAGSYSKLQFDTASSKLVVTDPNGKTVHVPA    70
           ++ +GFR+P ++T+LFI+     + TW+IPAG+Y     +TA
Sbjct:   4 EKKRGFRIPSSYTVLFIIIAIMAVLTWFIPAGAY-----ETAKG---------------    42
```

```
Query:   71 TQTQLDKMNVKIKIKEFTSGAISKPVSVPNTYKRLKQNPAGIGSVTTSMVNG------TI  124
                              G IS       TYK + NP G    + +V G      T
Sbjct:   43 ------------------GGVIS------GTYKTVASNPQGFFDILMAPVRGMLGVEGTD   78

Query:  125 EAVDIMVFIMVLGGMIGVVRKSGAFESGLLALTKKTKGREFLLIFLVSLLMVLGGTLCGI  184
              A+ +   FI+++GG +GVV K+GA ++G+ ++ +K KGRE +LI ++  L  LGGT  G+
Sbjct:   79 GAIQVSFFILMVGGFLGVVNKTGALDTGIASVVRKNKGREKMLIAILIPLFALGGTTYGM  138

Query:  185 EEEAVAFYPILVPIFLAMGYDSIICVGAIFLASSVGTSFSTINPFSSVIASNAAGISFTE  244
               EE +AFYP+L+P+ +A+G+DSI+ V   I + S +G     STINPF++ +A++AAG+S   +
Sbjct:  139 GEETMAFYPLLIPVMIAVGFDSIVAVAIILIGSQIGCLASTINPFATGVAADAAGVSIAD  198

Query:  245 GLSWRTAGCIAGAIFVVVYLHWYAKKIKANPEFSYSYEDRVEFNAKWGMTTNHTPSLFTI  304
               G+ WR    +       + +++ YA KI+ +P  S    D+ E + +       N    L
Sbjct:  199 GMIWRVIQWVILVGMSIWFVYNYASKIEEDPSKSL-VADKEEEHKELFQLQNSGEDL-NK  256

Query:  305 RQKIILSLFVISFPLMV-----W---------------------GVMSQ------GWWF  331
               RQ+ +L++F ++F +M+     W                      GV+ +        W+F
Sbjct:  257 RQRNVLTIFTLTFVIMILSLIPWEDFGIKFFTNINTWLTTMPILGGVIGKTMGAFGTWYF  316

Query:  332 PTMASSFLAITIIIMFLTATGANGIGERDVVDEFVNGASSLVGVSLIIGLARGINIILSQ  391
                 P +     F+ +  +++  +    + E D    F+ GA    +GV++I  +ARGI +I++
Sbjct:  317 PEITMLFIMMGVLVAIVYR-----MSEEDFFSSFLTGAGEFLGVAMICAIARGIQVIMNG  371

Query:  392 GYISDTMLYTASKLASHVSGSVFIIVMMFIYFVLGFVVPSSSGLAVLSMPILAPLADTVG  451
                      G I+ T+L+         S +S  VF+I+      Y   + F++PS+SGLA  +M I+APL
Sbjct:  372 GMITATILHLGETSLSGLSSQVFVILAYIFYLPMSFLIPSTSGLAGATMGIMAPLGQFSN  431

Query:  452 IPRSVVVMAYQFGQYAMLFLAPT-GLVMATLQMLDMKYSHWLKFVWPVVLFLLIFGGGLLVL  512
              +P  +V+ A+Q    +   ++PT  +VM  L  +        W  KF+   ++ +++    LLV+
Sbjct:  432 VPAHLVITAFQSASGILNMISPTSAIVMGALALGRVDLGTWWKFIGKFIVMVMLVSVLLLVV  493
```

Based on this analysis, it was predicted that these proteins and their epitopes could be useful antigens for vaccines or diagnostics.

EXAMPLE 1056

A DNA sequence (GBSx1129) was identified in *S. agalactiae* <SEQ ID 3255> which encodes the amino acid sequence <SEQ ID 3256>. Analysis of this protein sequence reveals the following:

```
Possible site: 46
>>> Seems to have no N-terminal signal sequence
    INTEGRAL    Likelihood = -10.83    Transmembrane    25-41    (18-47)
    INTEGRAL    Likelihood = -10.46    Transmembrane   153-169  (148-176)

----- Final Results -----
             bacterial membrane  --- Certainty = 0.5331 (Affirmative) < succ>
             bacterial outside   --- Certainty = 0.0000 (Not Clear)  < succ>
             bacterial cytoplasm --- Certainty = 0.0000 (Not Clear)  < succ>
```

The protein has homology with the following sequences in the GENPEPT database.

```
>GP:CAB13183 GB:Z99110 similar to two component sensor histidine
           kinase [YkoG] [Bacillus subtilis]
 Identities = 119/446 (26%), Positives = 212/446 (46%), Gaps = 18/446 (4%)
Query:   17 TQITLWYSSFIFILVIGVLIGSFFISKSIAENKSKKNLEAKAVQMSQALAKGHRYEAFED   76
              T+I L+ S  + IL+I V   + I  S +K      L  +   +++AL
Sbjct:    5 TKIHLYTSISLLILLILVHTAVYLIFSSALTSKDAARLADETDNIAEALRAAETEGVALQ   64

Query:   77 GIFYSVYDQNGKV-IYSGFPKGFKRDLDHQHKHKKKLSLFSMEN--------RTFQYVDI  127
              + +      NG V + +G  K        +            LS  S E        + F     +
Sbjct:   65 DMLQAYLPANGMVRVVNGDQKAVMTIKEKAYKDFPLSFHSGETADVRKPDGKLFAEEAV  124

Query:  128 PISGKNQWLRAIRTVDRLDKQLTELLFSLGIVLPLMLIIITVG----GYLILKRTFRPIQ  183
                 P+   +     + +++ V+RL+      E LF L I+L       + +   G L+ +R    PI+
Sbjct:  125 PVIWTDGQVVSLQLVERLENT-EESLFLLKIILIAASAAVCIASFFAGSLLARRIINPIR  183

Query:  184 EITETAQFITQNEDYTKRIITKNNENELTELAAVINTMLASIESSFVREKQFNNDVSHEL  243
                  + T + I +++++     +     +  +EL ++     N M   ++   +  +++QF   D  SHEL
```

-continued

```
Sbjct: 184 RLMITMKDIQRDKEFKTISLEGQSNDELYQMGLTFNEMAMMLKEHYDKQQQFVQDASHEL 243

Query: 244 RTPVTVILSESEYGKNYAENLSEA-KESFEVIHRQSLSMKKLVEQLLELTKAENPLSIQL 302
           +TP+T+I S S   K +      E +ES E IH +++ MKKL  QLL L K+    L + L
Sbjct: 244 KTPLTIIESYSSLMKRWGAKKPEVLEESIEAIHSEAVHMKKLTNQLLALAKSHQGLEVDL 303

Query: 303 EPLNFSIMMKQLVSDSSRLLDNTPIHLDSQIEDDLWIIGQQTLLKRLFDNLFSNAIKFTN 362
           + ++  I   + V   + +     I L++  ++ L +    + +K+L    L  NAIK++
Sbjct: 304 KTIDL-IKAARAVMQTLQSVYQRDILLETD-KESLLVKADEERIKQLLTILLDNAIKYSE 361

Query: 363 NHISISLRQSDNQIVFSIKDNGLGISVDDQSKIWNRFYQVDSARTKDSQSGIGLGLSLVK 422
               I +S    + +     S++D G+GI  +     ++ RFY+ D AR + +  G GLGLS+ K
Sbjct: 362 KPIEMSAGTRNGRPFLSVRDEGIGIPEEHIPHLFERFYRADEARNRKT-GGTGLGLSIAK 420

Query: 423 QIATIHRAKIWVDSKPDDGSQFTLTF                                  448
           QIA  H  ++ V SKP  G+  T+ F
Sbjct: 421 QIADEHGIELSVKSKPGQGTAVTMQF                                  446
```

There is also homology to SEQ ID 1178.

SEQ ID 3256 (GBS77) was expressed in *E. coli* as a GST-fusion product. SDS-PAGE analysis of total cell extract is shown in FIG. 21 (lane 2; MW 78.5 kDa) and in FIG. 28 (lane 2; MW 78.5 kDa).

GBS77-GST was purified as shown in FIG. 195, lane 4.

Based on this analysis, it was predicted that this protein and its epitopes, could be useful antigens for vaccines or diagnostics.

EXAMPLE 1057

A DNA sequence (GBSx1130) was identified in *S. agalactiae* <SEQ ID 3257> which encodes the amino acid sequence <SEQ ID 3258>. This protein is predicted to be CopR protein (tcrA). Analysis of this protein sequence reveals the following:

```
Possible Site: 33
>>> Seems to have no N-terminal signal sequence

----- Final Results -----
         bacterial cytoplasm --- Certainty = 0.3963 (Affirmative) < succ>
         bacterial membrane  --- Certainty = 0.0000 (Not Clear)   < succ>
          bacterial outside  --- Certainty = 0.0000 (Not Clear)   < succ>
```

The protein has homology with the following sequences in the GENPEPT database.

```
>GP:CAC07978 GB:AJ278983 CopR protein [Ralstonia metallidurans]
 Identities = 102/221 (46%), Positives = 145/221 (65%)
Query:   1 MKILVVEDEFDLNRSIVKLLKKQHYSVDSASNGEEALQFVSVAEYDVIILDVMMPKMDGF   60
           MK+LVVEDE    + +L +  + VD +NG +   F     YD+IILDVM+P +DG+
Sbjct:   1 MKLLVVEDEVKTGEYLRQGLTEAGFVVDLVANGLDGQHFAVNETYDLIILDVMLPDVDGW   60

Query:  61 TFLKLLRNKGSQVSILMLTARDAVEDRIAGLDFGADDYLVKPFEFGELMARIRAMLRRAN  120
             L +R  G+ V +L LTARD+V DR+ GL+ GADDYLVKPF F EL+AR+R +LRR A
Sbjct:  61 HILHAIRASGNAVPVLFLTARDSVADRVRGLELGADDYLVKPFAFSELLARVRTLLRRGA  120

Query: 121 RQVSSDDIQIQDITINLSTKQVWRNDNLIDLTAKEYEVLEYLARHRDQVLSRHQIREHVW  180
            Q++ D IQ+ D+ ++LS ++   R    I LT+KE+ +LE  AR R +VL R I   VW
Sbjct: 121 VQLAMDRIQVADLILDLSRRRASRGGRRITLTSKEFALLELFARRGEVLPRSLIASQVW  180

Query: 181 DYDYYGESNIIDVLIKNLRRKLDNNRDGSLIKTKRGLGYVI                    221
           D ++    +SN+IDV I+ LR K+D+     LI+T RG+GYV+
Sbjct: 181 DMNFDSDSNVIDVAIRRLRAKIDDGFEVKLIQTVRGMGYVL                    221
```

There is also homology to SEQ ID 3260.

Based on this analysis, it was predicted that this protein and its epitopes, could be useful antigens for vaccines or diagnostics.

EXAMPLE 1058

A DNA sequence (GBSx1131) was identified in *S. agalactiae* <SEQ ID 3261> which encodes the amino acid sequence <SEQ ID 3262>. Analysis of this protein sequence reveals the following:

```
Possible site: 40
>>> Seems to have no N-terminal signal sequence
    INTEGRAL     Likelihood = -3.45        Transmembrane      18-34  (16-36)

----- Final Results -----
              bacterial membrane --- Certainty = 0.2381 (Affirmative) < succ>
              bacterial outside  --- Certainty = 0.0000 (Not Clear)  < succ>
              bacterial cytoplasm --- Certainty = 0.0000 (Not Clear)  < succ>
```

A related GBS nucleic acid sequence <SEQ ID 10281> which encodes amino acid sequence <SEQ ID 10282> was also identified.

The protein has no significant homology with any sequences in the GENPEPT database.

No corresponding DNA sequence was identified in *S. pyogenes*.

SEQ ID 3262 (GBS78) was expressed in *E. coli* as a His-fusion product. SDS-PAGE analysis of total cell extract is shown in FIG. 16 (lane 4; MW 23.8 kDa).

Figure 317:
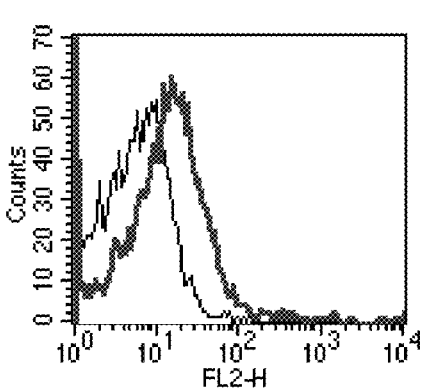

The GBS78-GST fusion product was purified (FIG. 194, lane 4) and used to immunise mice. The resulting antiserum was used for FACS (FIG. 317), which confirmed that the protein is immunoaccessible on GBS bacteria.

Based on this analysis, it was predicted that these proteins and their epitopes could be useful antigens for vaccines or diagnostics.

EXAMPLE 1059

A DNA sequence (GBSx1132) was identified in *S. agalactiae* <SEQ ID 3263> which encodes the amino acid sequence <SEQ ID 3264>. Analysis of this protein sequence reveals the following:

```
Possible site: 36
>>> Seems to have an uncleavable N-term signal seq
    INTEGRAL     Likelihood = -11.04       Transmembrane      15-31  (6-35)
    INTEGRAL     Likelihood =  -1.28       Transmembrane      51-67  (51-67)

----- Final Results -----
              bacterial membrane --- Certainty = 0.5416 (Affirmative) < succ>
              bacterial outside  --- Certainty = 0.0000 (Not Clear)  < succ>
              bacterial cytoplasm --- Certainty = 0.0000 (Not Clear)  < succ>
```

The protein has no significant homology with any sequences in the GENPEPT database.

No corresponding DNA sequence was identified in *S. pyogenes*.

Figure 154:
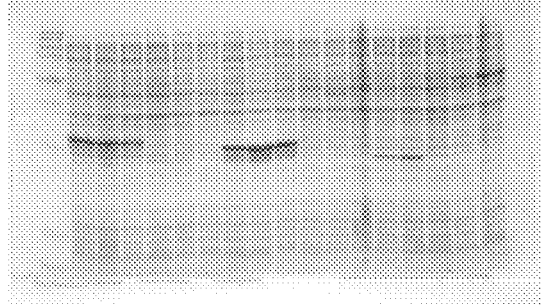

SEQ ID 3264 (GBS79) was expressed in *E. coli* as a GST-fusion product. GBS79d was expressed in *E. coli* as a GST-fusion product. SDS-PAGE analysis of total cell extract is shown in FIG. 154 (lane 17 & 18; MW 51 kDa), in FIG. 155 (lane 17; MW 51 kDa) and in FIG. 187 (lane 13; MW 51 kDa).

Figure 243:
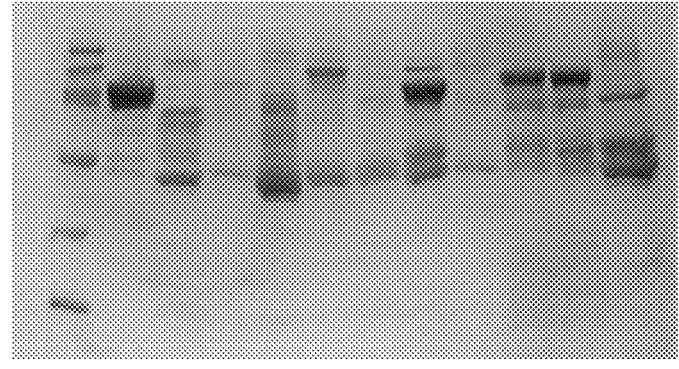

GBS79d was also expressed in *E. coli* as a His-fusion product. SDS-PAGE analysis of total cell extract is shown in FIG. 155 (lane 24; MW 26 kDa) and in FIG. 183 (lane 5; MW 26 kDa). Purified GBS79d-GST is shown in FIG. 243, lane 2.

Based on this analysis, it was predicted that this protein and its epitopes, could be useful antigens for vaccines or diagnostics.

EXAMPLE 1060

A DNA sequence (GBSx1133) was identified in *S. agalactiae* <SEQ ID 3265> which encodes the amino acid sequence <SEQ ID 3266>. Analysis of this protein sequence reveals the following:

```
Possible site: 50
>>> Seems to have no N-terminal signal sequence

----- Final Results -----
              bacterial cytoplasm --- Certainty = 0.5326 (Affirmative) < succ>
```

A related GBS nucleic acid sequence <SEQ ID 10279> which encodes amino acid sequence <SEQ ID 10280> was also identified.

The protein has homology with the following sequences in the GENPEPT database.

```
>GP:AAG20974 GB:AE005164 Vng6349c [Halobacterium sp. NRC-1]
 Identities = 97/358 (27%), Positives = 163/358 (45%), Gaps =20/358 (5%)

Query:   35 DPQIIKLTTRANIAIGTYEGFLESIINPMLLISPLLSQEAVLSSKLEGTHATLKDLLNYE   94
            D   +   A   +G   G    +  P +L +  LL +EA+ S++++EG      L + E
Sbjct:   70 DDDFYETLADATFWLGKLSGVSLELDFPPVLYTSLLRKEAMESAEIEGADVDYDALYSLE  129

Query:   95 AGNKVDIERDELHEII------NYRKALFYALENISTINNIDSKGLPLSNRIIKENHKIL  148
               D  RDE  E          + R+ L Y     I+ +D+ G  L+  ++ ++H+ L
Sbjct:  130 T-RTFDEGRDEPSETTAAAETKDTREVLNYETAVKEGIDALDA-GEELNVELLHDLHETL  187

Query:  149 LDNV---RGSSKNPGNFKRSQNYIGSVSSISYTPVPAEKTPEYMSNLEQYIHYD-DLDLL  204
            L  V   R +    G++K + NY+G      + P     +  M  L Y         L
Sbjct:  188 LTGVPDDRVDTDTIGDYKTNPNYLGD-----FLPPAPGAVEDLMDGLFTYYRTGGSYHPL  242

Query:  205 VQSAIIHAQFEMIHPFEDGNGRIGRLLIPLFLYYQELLSYPTFYMSSYFERDRSLYISHL  264
            V  A+ H QFE IHP+ DGNGR+GRLLI L LY  +LL  P Y+S Y  R+++ Y+  +
Sbjct:  243 VDIALFHYQFETIHPYGDGNGRLGRLLITLQLYDADLLERPNLYLSEYLNRNKTTYVERM  302

Query:  265 SNISKDNNWKDWFEYYLEGVILSAEESTKKAQDILSLYNIMKEQVIPKLNSVSGIQLLDF  324
            +      W+ W  +++EG+   A ES ++ + +  L    + +    K   + +  QL
Sbjct:  303 EGVRFHGEWEAWLSFFIEGIARQAHESVERTRALADLRREYEHEYGGKAYTKN--QLAVT  360

Query:  325 IFSAPIFKAEQVSEHLKISERTTYTLLNKLIDEGYL-STDNAQRNRTYYCPQLLSIVQ    381
            +F  P   ++ V   I + T   +N+L++EG L       RN+ Y   ++  I++
Sbjct:  361 LFEQPYITSKTVQRLFDIEQSTASRAINELVNEGILEEVPRHGRNKEYRAREIFEILE   418
```

No corresponding DNA sequence was identified in *S. pyogenes*.

Based on this analysis, it was predicted that these proteins and their epitopes could be useful antigens for vaccines or diagnostics.

EXAMPLE 1061

A DNA sequence (GBSx1134) was identified in *S. agalactiae* <SEQ ID 3267> which encodes the amino acid sequence <SEQ ID 3268>. Analysis of this protein sequence reveals the following:

```
Possible site: 47
>>> Seems to have no N-terminal signal sequence

----- Final Results -----
         bacterial cytoplasm --- Certainty = 0.4370(Affirmative) < succ>
         bacterial membrane  --- Certainty = 0.0000(Not Clear)   < succ>
         bacterial outside   --- Certainty = 0.0000(Not Clear)   < succ>

RGD motif : 46-48
```

The protein has no significant homology with any sequences in the GENPEPT database.

No corresponding DNA sequence was identified in *S. pyogenes*.

SEQ ID 3268 (GBS299) was expressed in *E. coli* as a GST-fusion product. SDS-PAGE analysis of total cell extract is shown in FIG. 58 (lane 2; MW 62.2 kDa) and in FIG. 60 (lane 4; MW 62.2 kDa).

Figure 225:
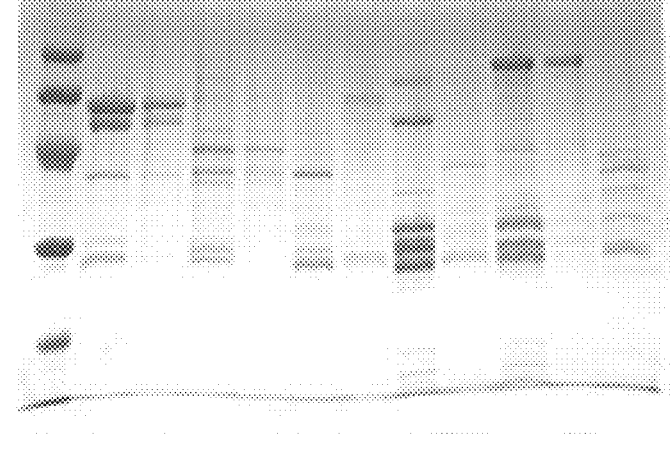

GBS299-GST was purified as shown in FIG. 207 (lane 4) and FIG. 225 (lanes 2-3).

Based on this analysis, it was predicted that this protein and its epitopes, could be useful antigens for vaccines or diagnostics.

EXAMPLE 1062

A DNA sequence (GBSx1135) was identified in *S. agalactiae* <SEQ ID 3269> which encodes the amino acid sequence <SEQ ID 3270>. Analysis of this protein sequence reveals the following:

```
Possible site: 37
>>> Seems to have no N-terminal signal sequence

----- Final Results -----
            bacterial cytoplasm --- Certainty = 0.4176(Affirmative) < succ>
             bacterial membrane --- Certainty = 0.0000(Not Clear)   < succ>
              bacterial outside --- Certainty = 0.0000(Not Clear)   < succ>
```

The protein has no significant homology with any sequences in the GENPEPT database.

No corresponding DNA sequence was identified in S. pyogenes.

Based on this analysis, it was predicted that this protein and its epitopes, could be useful antigens for vaccines or diagnostics.

EXAMPLE 1063

A DNA sequence (GBSx1136) was identified in S. agalactiae <SEQ ID 3271> which encodes the amino acid sequence <SEQ ID 3272>. Analysis of this protein sequence reveals the following:

```
Possible site: 19
>>> Seems to have no N-terminal signal sequence

----- Final Results ------
            bacterial cytoplasm --- Certainty = 0.1789(Affirmative) < succ>
             bacterial membrane --- Certainty = 0.0000(Not Clear)   < succ>
              bacterial outside --- Certainty = 0.0000(Not Clear)   < succ>
```

The protein has no significant homology with any sequences in the GENPEPT database.

No corresponding DNA sequence was identified in S. pyogenes.

Based on this analysis, it was predicted that this protein and its epitopes, could be useful antigens for vaccines or diagnostics.

EXAMPLE 1064

A DNA sequence (GBSx1137) was identified in S. agalactiae <SEQ ID 3273> which encodes the amino acid sequence <SEQ ID 3274>. Analysis of this protein sequence reveals the following:

```
Possible site: 49
>>> Seems to have no N-terminal signal sequence

----- Final Results -----
            bacterial cytoplasm --- Certainty = 0.3748(Affirmative) < succ>
             bacterial membrane --- Certainty = 0.0000(Not Clear)   < succ>
              bacterial outside --- Certainty = 0.0000(Not Clear)   < succ>
```

The protein has no significant homology with any sequences in the GENPEPT database.

No corresponding DNA sequence was identified in S. pyogenes.

Based on this analysis, it was predicted that this protein and its epitopes, could be useful antigens for vaccines or diagnostics.

EXAMPLE 1065

A DNA sequence (GBSx1138) was identified in S. agalactiae <SEQ ID 3275> which encodes the amino acid sequence <SEQ ID 3276>. Analysis of this protein sequence reveals the following:

```
Possible site: 51
>>> Seems to have no N-terminal signal sequence

----- Final Results -----
            bacterial cytoplasm --- Certainty = 0.1638(Affirmative) < succ>
```

-continued
```
            bacterial membrane --- Certainty = 0.0000(Not Clear) < succ>
            bacterial outside  --- Certainty = 0.0000(Not Clear) < succ>
```

The protein has homology with the following sequences in the GENPEPT database.

```
>GP:CAB12294 GB:Z99106 similar to transposon protein [Bacillus subtilis]
 Identities = 84/291 (28%), Positives = 138/291 (46%), Gaps = 6/291 (2%)

Query:   6 MLDYLAVTIKGLAPDDVIEKILILPKDKFVLNEWGINKYQRHYSFSEIKVYFNKDWQSKM    65
           M+DY+ V+ K    D +IE++L L KD      + G   Y     IKV+++    ++
Sbjct:  31 MVDYIRVSFKTHDVDRIIEEVLHLSKDFMTEKQSGFYGYVGTYELDYIKVFYSAPDDNR-    89

Query:  66 GVFIELRGQGCRQYEEYMENNVNNWVTLMKRISECHSNVTRLDIANDIFDDSLSVPLIYS   125
           GV IE+ GQGCRQ+E ++E       W    +     + TR D+A D      S+P +
Sbjct:  90 GVLIEMSGQGCRQFESFLECRKKTWYDFFQDCMQQGGSFTRFDLAIDDKKTYFSIPELLK   149

Query: 126 YCKKQLCISTAKTFDYHEKSLLENGEKVGEMVTIGVRGTQQW-CVYNKLLEQKLDQELPN   184
           +K  CIS  +  D++      L +G    G + G + ++ + C Y K  EQ       +P
Sbjct: 150 KAQKGECISRFRKSDFNGSFDLSDGITGGTTIYFGSKKSEAYLCFYEKNYEQAEKYNIPL   209

Query: 185 TPL-SWTRAELRCWQEKANLLAKQIKEGRPLKEIYFEVINGHYRFVSPRDKDSNRWRRKT   243
           L   W R ELR    E+A +    + + + L  I   ++IN + RFV   D++  R    KT
Sbjct: 210 EELGDWNRYELRLKNERAQVAIDALLKTKDLTLIAMQIINNYVRFVD-ADENITREHWKT   268

Query: 244 VKWWNDYLETQEKTVLSVKRTKPTLKRSEKWTEKQVSRTLGKLYVAKAESH            294
           +W+D++      +  L VK   K     ++S  W       + T+      V +A+ H
Sbjct: 269 SLFWSDFIGDVGRLPLYVKPQKDFYQKSRNWLRNSCAPTM--KMVLEADEH            317
```

No corresponding DNA sequence was identified in S. pyogenes.

Based on this analysis, it was predicted that this protein and its epitopes, could be useful antigens for vaccines or diagnostics.

EXAMPLE 1066

A DNA sequence (GBSx1139) was identified in S. agalactiae <SEQ ID 3277> which encodes the amino acid sequence <SEQ ID 3278>. This protein is predicted to be integrase. Analysis of this protein sequence reveals the following:

```
Possible site: 58
>>> Seems to have no N-terminal signal sequence

----- Final Results -----
            bacterial cytoplasm --- Certainty = 0.1914(Affirmative) < succ>
            bacterial membrane  --- Certainty = 0.0000(Not Clear)   < succ>
            bacterial outside   --- Certainty = 0.0000(Not Clear)   < succ>
```

The protein has homology with the following sequences in the GENPEPT database.

```
>GP:CAB70622 GB:AJ243106 integrase [Streptococcus thermophilus]
 Identities = 135/474 (28%), Positives = 233/474 (48%), Gaps = 68/474 (14%)

Query:  20 KAGNVLVKFAMRFTHPITKKSHKKYLSTGASKGWFTTKATPSKKLPSGKERLLVSDIKNT    79
           K G + VKF   F + +T K  ++ LS         W+T     +KK  +GK +L   S
Sbjct:  19 KTGYIEVKFRTYFNNQLTNK-RREILSD-----WYTIV---NKKDTTGKIKL--SPQIKA    67

Query:  80 QLITQVTQELNKLVDDYIAELMGIKPKKAKKLLTLEEIAKPFDKDGNFYGKAFKAWH---   136
           +  ++ ++ NK+ ++        ++         K   +TL+E+             +  WH
Sbjct:  68 IIHKELQEKANKVYEELTRTIL-----LEKSDITLDEV--------------WNEWHNER   108

Query: 137 -ERVKPANNTLKTRVTIYNRYIEPNFDTRMSITKFAFMTDEIQNLIN-----ASSMHMAR   190
            ER   A  TL      Y +I     + SI K   + I+NL++        +  +A+
Sbjct: 109 VERQLVAPKTLAGEDGRYRNHITKQIP-KNSILK-NIPSSLIKNLLDNLYPIGNHKRLAQ   166

Query: 191 NLHIYLKMIFDWSVENGQITLTQDPIASNKVKRRVLTKSEEQDK-KREDIAEKYLEASEV   249
             +  L I+ +++ +  I+  Q+P+    + R+ L   S+E D+  K+ DI  ++YLE+ E+
Sbjct: 167 GVKSDLTSIYKFAILHDYISPDQNPMPYISIGRKGL--SDELDRLKKSDIEDQYLESWEL   224
```

```
-continued
Query: 250 NHVLRLIESWTNRPDNQLIADVLRMIFLTGMRPSEVLGLNEDMLDFEKKWIKVHWQRASK 309
            VL ++  +    N+ A +      LTGMR  EVLGL E+ +DF K    V    RA+
Sbjct: 225 KEVLSIVRKY-----NEQYARIFEFQALTGMRIGEVLGLKEEAIDFNKNIASVIRTRATH 279

Query: 310 NKSDDMMEALNLDEKERYRADLKTKESVRTIPMSPEVEKILRHYIDRNKFQAQFSPTYQD 369
            + +             + Y ++K  +S R + +S     +IL+  I+ N    +F+P Y+D
Sbjct: 280 GGASE----------DSYEGNVKNLQSYRNVQLSKRAIEILKEEIELNHQHIRFNPDYKD 329

Query: 370 LGYLFTRTYIRAGNRQGSPLYHNELSQFLRGGSSQSAKYNKKAGKPYK---DIDSFLDFG 426
              G++FT    I  +  G+PL+++ L+ FL   SS++K N+  G P +   DID+ L F
Sbjct: 330 NGWIFTSKSIHKPDYNGTPLHYSVLNNFL--NSSENGKLNRN-GNPRRAGIDIDNKLSFK 386

Query: 427 RPIHVIPHMFRHSFISIMASEGIDLPTIREFVGHSEDSKEIERVYLHVIKKQKD      480
            +  H+  H+FRH+ IS +A +G+ L  I++ VGHS  S+ +   +YLH+ KK RD
Sbjct: 387 K--HITTHIFRHTHISFLAEQGVPLEAIQDRVGHSRGSR-VTEIYLHITKKTKD       437
```

A related DNA sequence was identified in *S. pyogenes* <SEQ ID 3279> which encodes the amino acid sequence <SEQ ID 3280>. Analysis of this protein sequence reveals the following:

```
Possible site: 33
>>> Seems to have no N-terminal signal sequence

----- Final Results -----
              bacterial cytoplasm --- Certainty = 0.5203(Affirmative) < succ>
              bacterial membrane  --- Certainty = 0.0000(Not Clear)   < succ>
              bacterial outside   --- Certainty = 0.0000(Not Clear)   < succ>
```

An alignment of the GAS and GBS proteins is shown below.

```
 Identities = 82/357 (22%), Positives = 155/357 (42%), Gaps = 52/357 (14%)

Query: 135 WHERVKPANNTLKTRVTIYNRYIEPNFDTRMSITKFAFMTDEIQNLINA--SSMHMARNL 192
            W    K  +T  +    R +     D  +I K    T +Q++I+     S    +
Sbjct:  73 WEHHQKSLKSTSVRSLDFRIRELRNLIDPEVMIAKIT--TKYLQSIIDKIPGSYDKRKRA 130

Query: 193 HIYLKMIFDWSVENGQITLTQDPIASNKVKRRVLTKSEEQDKKREDIAEKYLEASEVNHV 252
             LK  FD+++   +++  +P+ S +++ V T    K   ED+A+K+LE  E+
Sbjct: 131 RQLLKQTFDYAIALEYVSI--NPVISTQLAKPVKTI-----KDFEDVAQKFLSKDELK-- 181

Query: 253 LRLIESWTNRPDNQLIADVLRMIFLTGMRPSEVLGLNEDMLDFEKKWIKVHWQRASKNKS 312
            RL++     R +   +A  +    + L G R   EL +  + +     I++H
Sbjct: 182 -RLLDEMYRRKGSIKMAYLAEFMSLNGCRIGEALAIQPD--NIKNDIIEIH--------- 229

Query: 313 DDMMEALNLDEKERYRADLKTKESVRTIPMSPEVEKILRHYIDRNKFQAQFSPTYQDLGY 372
             ++ +     +  +    KT  S R    ++   ++I++    +    N    +P Y+D+GY
Sbjct: 230 -GTLDYTSNGYRNAIKTTPKTNSSWRETLITKREKEIIQDILKINALEKNTNPNYKDNGY 288

Query: 373 LFTRTYIRAGNRQGSPLYNNELSQFLRGGSSQSAKYNKKAGKPYKDIDSFLDFGRPIHVI 432
             +F           +R G P+   N L+  +R           NK+   KP +            +
Sbjct: 289 IFI-------SRNGVPIQDNALNTSIRAA-------NKRLEKPIQK-----------ELT 323

Query: 433 PHMFRHSFISIMASEGIDLPTIREFVGHSEDSKEIERVYLHVIKKQKDTMRGAVEKL    489
             H+FRH+ +S +A   + L TI + VGH+ DSK  +++Y HV K  K+ +     + +L
Sbjct: 324 SHIFRHTLVSRLAENKVPLKTIMDRVGHA-DSKTTQQIYTHVTHSMKNEVVDILNRL    379
```

Based on this analysis, it was predicted that these proteins and their epitopes could be useful antigens for vaccines or diagnostics.

EXAMPLE 1067

A DNA sequence (GBSx1140) was identified in *S. agalactiae* <SEQ ID 3281> which encodes the amino acid sequence <SEQ ID 3282>. Analysis of this protein sequence reveals the following:

```
Possible site: 42
>>> Seems to have no N-terminal signal sequence
```

```
----- Final Results -----
            bacterial cytoplasm --- Certainty = 0.3023(Affirmative) < succ>
            bacterial membrane  --- Certainty = 0.0000(Not Clear)   < succ>
             bacterial outside  --- Certainty = 0.0000(Not Clear)   < succ>
```

A related GBS nucleic acid sequence <SEQ ID 10277> which encodes amino acid sequence <SEQ ID 10278> was also identified.

The protein has homology with the following sequences in the GENPEPT database.

```
>GP:AAB64982 GB:U43834 Ydr540cp [Saccharomyces cerevisiae]
 Identities = 88/170 (51%), Positives = 117/170 (68%), Gaps = 3/170 (1%)

Query:   36 MRTYSDKNELKEEVLKSYKKYIAEFNDIPEKLKDLRIDEVDRTPAENLAYQVGWTTLILK   95
            MR Y+ K ELKEE+ K Y+KY AEF  I E  KD +++ VDRTP+ENL+YQ+GW  L+L+
Sbjct:    1 MREYTSKKELKEEIEKKYEKYDAEFETISESQKDEKVETVDRTPSENLSYQLGWVNLLLE   60

Query:   96 WESDEQSGLEVKTPTETFKWNQLGELYQHFTETYASLTIKELTAQLNDNVDAIGNMIDSM  155
            WE+ E +G  V+TP    +KWN LG LYQ F + Y    +IKE  A+L + V+ +   I ++
Sbjct:   61 WEAKEIAGYNVETPAPGYKWNNLGGLYQSFYKKYGIYSIKEQRAKLREAVNEVYKWISTL  120

Query:  156 SDEVLFKPHMRNWADSATKNAVWEVYKFIHINTVAPFGTFRTKIRKWKKV            205
            SD+ LF+   R W   AT    A+W VYK+IHINTVAPF   FR KIRKWK++
Sbjct:  121 SDDELFQAGNRKW---ATTKAMWPVYKWIHINTVAFFTNFRGKIRKWKRL            167
```

No corresponding DNA sequence was identified in *S. pyogenes*.

Based on this analysis, it was predicted that these proteins and their epitopes could be useful antigens for vaccines or diagnostics.

EXAMPLE 1068

A DNA sequence (GBSx1141) was identified in *S. agalactiae* <SEQ ID 3283> which encodes the amino acid sequence <SEQ ID 3284>. This protein is predicted to be 50S ribosomal protein subunit L33-related protein. Analysis of this protein sequence reveals the following:

```
Possible site: 46
>>> Seems to have no N-terminal signal sequence

----- Final Results -----
            bacterial cytoplasm --- Certainty = 0.5420(Affirmative) < succ>
            bacterial membrane  --- Certainty = 0.0000(Not Clear)   < succ>
             bacterial outside  --- Certainty = 0.0000(Not Clear)   < succ>
```

The protein has homology with the following sequences in the GENPEPT database.

```
>GP:AAB66692 GB:U89998 50S ribosomal protein subunit L33
          [Lactococcus lactis subsp. cremoris]
 Identities = 43/49 (87%), Positives = 46/49 (93%)

Query:    1 HRVNITLEHKESGERLYLTSKNKRNTPDRLQLKKYSPKLRKHVVFTEVK   49
            HRVNITLEHKESGERLYLT KNKRNTPD+L+LKKYS KLRKHV+F EVK
Sbjct:    1 MRVNITLEHKESGERLYLTQKNKRNTPDKLELKKYSKKLRKHVIFKEVK   49
```

A related DNA sequence was identified in *S. pyogenes* <SEQ ID 3285> which encodes the amino acid sequence <SEQ ID 3286>. Analysis of this protein sequence reveals the following:

```
Possible site: 46
>>> Seems to have no N-terminal signal sequence

----- Final Results -----
            bacterial cytoplasm --- Certainty = 0.5394(Affirmative) < succ>
```

```
              -continued
    bacterial membrane --- Certainty = 0.0000(Not Clear) < succ>
    bacterial outside  --- Certainty = 0.0000(Not Clear) < succ>
```

An alignment of the GAS and GBS proteins is shown below.

```
Identities = 48/49 (97%), Positives = 48/49 (97%)

Query: 1 MRVNITLEHKESGERLYLTSKNKRNTPDRLQLKKYSPKLRKHVVFTEVK 49
         MRVNITLEHKESGERLYLTSKNKRNTPDRLQLKKYSPKLRKHV FTEVK
Sbjct: 1 MRVNITLEHKESGERLYLTSKNKRNTPDRLQLKKYSPKLRKHVTFTEVK 49
```

Based on this analysis, it was predicted that these proteins and their epitopes could be useful antigens for vaccines or diagnostics.

EXAMPLE 1069

A DNA sequence (GBSx1142) was identified in *S. agalactiae* <SEQ ID 3287> which encodes the amino acid sequence <SEQ ID 3288>. This protein is predicted to be 50S ribosomal protein subunit L32-related protein. Analysis of this protein sequence reveals the following:

```
Possible site: 56
>>> Seems to have no N-terminal signal sequence

----- Final Results -----
    bacterial cytoplasm --- Certainty = 0.3577(Affirmative) < succ>
    bacterial membrane  --- Certainty = 0.0000(Not Clear)   < succ>
    bacterial outside   --- Certainty = 0.0000(Not Clear)   < succ>
```

The protein has homology with the following sequences in the GENPEPT database.

```
>GP: AAB66691 GB: U89998 50S ribosomal protein subunit L32
[Lactococcus lactis subsp. cremoris]
Identities = 44/53 (83%), Positives = 48/53 (90%)

Query: 1 MAKPARHTSKAKRNKRRTHYKLTAPSVQFDETTGDYSRSHRVSLKGYYKGRKI 53
         MA PARHTS AK+N+RRTHYKLTAP+V FDETTGDY  SHRVSLKGYYKGRK+
Sbjct: 1 MAVPARHTSSAKKNRRRTHYKLTAPTVTFDETTGDYRHSHRVSLKGYYKGRKV 53
```

A related DNA sequence was identified in *S. pyogenes* <SEQ ID 3289> which encodes the amino acid sequence <SEQ ID 3290>. Analysis of this protein sequence reveals the following:

```
Possible site: 35
>>> Seems to have no N-terminal signal sequence

----- Final Results -----
    bacterial cytoplasm --- Certainty = 0.5148(Affirmative) < succ>
    bacterial membrane  --- Certainty = 0.0000(Not Clear)   < succ>
    bacterial outside   --- Certainty = 0.0000(Not Clear)   < succ>
```

An alignment of the GAS and GBS proteins is shown below.

```
Identities = 38/39 (97%), Positives = 39/39 (99%)

Query:  22 LTAPSVQFDETTGDYSRSHRVSLKGYYKGRKIAKANEAK 60
           +TAPSVQFDETTGDYSRSHRVSLKGYYKGRKIAKANEAK
Sbjct:   1 MTAPSVQFDETTGDYSRSHRVSLKGYYKGRKIAKANEAK 39
```

Based on this analysis, it was predicted that these proteins and their epitopes could be useful antigens for vaccines or diagnostics.

EXAMPLE 1070

A DNA sequence (GBSx1144) was identified in *S. agalactiae* <SEQ ID 3291> which encodes the amino acid sequence <SEQ ID 3292>. This protein is predicted to be histidyl-tRNA synthetase (hisS). Analysis of this protein sequence reveals the following:

```
Possible site: 32
>>> Seems to have no N-terminal signal sequence

----- Final Results -----
            bacterial cytoplasm --- Certainty = 0.4357(Affirmative) < succ>
            bacterial membrane  --- Certainty = 0.0000(Not Clear)   < succ>
            bacterial outside   --- Certainty = 0.0000(Not Clear)   < succ>
```

A related GBS nucleic acid sequence <SEQ ID 10275> which encodes amino acid sequence <SEQ ID 10276> was also identified.

The protein has homology with the following sequences in the GENPEPT database.

```
>GP: CAA78919 GB: Z17214 histidine--tRNA ligase [Streptococcus
equisimilis]
Identities = 327/404 (80%), Positives = 361/404 (88%)

Query:  32 WQYVENVIRNLFKQYHYDEIRTPMFEHYEVISRSVGDTTDIVTKEMYDFHDKGDRHITLR   91
           WQYVE V R  FKQYHY EIRTPMFEHYEVISRSVGDTTDIVTKEMYDF+DKGDRHITLR
Sbjct:   1 WQYVEGVARETFKQYHYGEIRTPMFEHYEVISRSVGDTTDIVTKEMYDFYDKGDRHITLR   60

Query:  92 PEGTAPVVRSYVENKLFAPEVQKPTKMYYIGSMFRYERPQAGRLREFHQVGVECFGSNNP  151
           PEGTAPVVRSYVENKLFAPEVQKP K+YYIGSMFRYERPQAGRLREFHQ+GVECFGS NP
Sbjct:  61 PEGTAPVVRSYVENKLFAPEVQKPVKLYYIGSMFRYERPQAGRLREFHQIGVECFGSANP  120

Query: 152 ATDVETIAMGHHLFEDLGIKNVKLHLNSLGNPESRQAYRQALIDYLTPIREQLSKDSQRR  211
           ATDVETIAM +HLFE LGIK V LHLNSLGN  SR AYRQALIDYL+P+R+ LSKDSQRR
Sbjct: 121 ATDVETIAMAYHLFERLGIKGVTLHLNSLGNAASRAAYRQALIDYLSPMRDTLSKDSQRR  180

Query: 212 LNENPLRVLDSKEPEDKLAVENAPSILDYLDESSQAHFDAVCHMLDALNIPYIIDTNMVR  271
           L+ENPLRVLDSKE EDK+AV NAPSILDY DE SQAHFDAV  ML+AL IPY+IDTNMVR
Sbjct: 181 LDENPLRVLDSKEKEDKIAVANAPSILDYQDEESQAHFDAVRSMLEALAIPYVIDTNMVR  240

Query: 272 GLDYYNHTIFEFITEIEDNELTICAGGRYDGLVSYFGGPETPAFGFGLGLERLLLILDKQ  331
           GLDYYNHTIFEFITE++ +ELTICAGGRYDGLV YFGGP TP FGFGLGLERLLLILDKQ
Sbjct: 241 GLDYYNHTIFEFITEVDQSELTICAGGRYDGLVEYFGGPATPGFGFGLGLERLLLILDKQ  300

Query: 332 GISLPIENTIDLYIAVLGSEANLAALDLAQSIRHQGFKVERDYLGRKIKAQFKSADTFNA  391
           G+ LP+E  +D+YIAVLG++AN+AAL L Q+IR QGF VERDYLGRKIKAQFKSADTF A
Sbjct: 301 GVELPVEEGLDVYIAVLGADANVAALALTQAIRRQGFTVERDYLGRKIKAQFKSADTFKA  360

Query: 392 KVIMTLGSSEVDSKEVGLKNNQTRQEVKVSFENIKTDFSSVLKQ                 435
           KV++TLG SE+ + +  LK+NQTRQE+ VSF+ I+TDF+S+  +
Sbjct: 361 KVVITLGESEIKAGQAVLKHNQTRQEMTVSFDQIQTDFASIFAE                 404
```

A related DNA sequence was identified in *S. pyogenes* <SEQ ID 3293> which encodes the amino acid sequence <SEQ ID 3294>. Analysis of this protein sequence reveals the following:

```
Possible site: 27
>>> Seems to have no N-terminal signal sequence

----- Final Results -----
            bacterial cytoplasm --- Certainty = 0.3183(Affirmative) < succ>
            bacterial membrane  --- Certainty = 0.0000(Not Clear)   < succ>
            bacterial outside   --- Certainty = 0.0000(Not Clear)   < succ>
```

An alignment of the GAS and GBS proteins is shown below.

```
Identities = 339/424 (79%), Positives = 387/424 (90%)

Query:    13 MKLQKPKGTQDILPGESAKWQYVENVIRNLFKQYHYDEIRTPMFEHYEVISRSVGDTTDI    72
             MKLQKPKGTQDILPG++AKWQYVE+V R+ F QY+Y EIRTPMFEHYEVISRSVGDTTDI
Sbjct:     1 MKLQKPKGTQDILPGDAAKWQYVESVARDTFSQYNYGEIRTPMFEHYEVISRSVGDTTDI    60

Query:    73 VTKEMYDFHDKGDRHITLRPEGTAPVVRSYVENKLFAPEVQKPTKMYYIGSMFRYERPQA   132
             VTKEMYDF+DKGDRHITLRPEGTAPVVRSYVENKLFAPEVQKP K+YYIGSMFRYERPQA
Sbjct:    61 VTKEMYDFYDKGDRHITLRPEGTAPVVRSYVENKLFAPEVQKPVKLYYIGSMFRYERPQA   120

Query:   133 GRLREFHQVGVECFGSNNPATDVETIAMGHHLFEDLGIKNVKLHLNSLGNPESRQAYRQA   192
             GRLREFHQ+GVECFG+ NPATDVETIAM +HLFE LGIK+V LHLNSLG+PESR AYRQA
Sbjct:   121 GRLREFHQIGVECFGAANPATDVETIAMAYHLFEKLGIKDVTLHLNSLGSPESRAAYRQA   180

Query:   193 LIDYLTPIREQLSKDSQRRLNENPLRVLDSKEPEDKLAVENAPSILDYLDESSQAHFDAV   252
             LIDYLTP+R+QLSKDSQRRL+ENPLRVLDSKE EDKLAVE APSILDYLDE SQAHF+AV
Sbjct:   181 LIDYLTPMRDQLSKDSQRRLDENPLRVLDSKEKEDKLAVEKAPSILDYLDEESQAHFEAV   240

Query:   253 CHMLDALNIPYIIDTNMVRGLDYYNHTIFEFITEIEDNELTICAGGRYDGLVSYFGGPET   312
             ML+AL+IPY+IDTNMVRGLDYY+HTIFEFIT +E ++LTICAGGRYD LV YFGGPET
Sbjct:   241 KDMLEALDIPYVIDTNMVRGLDYYSHTIFEFITSVEGSDLTICAGGRYDSLVGYFGGPET   300

Query:   313 PAFGFGLGLERLLLILDKQGISLPIENTIDLYIAVLGSEANLAALDLAQSIRHQGFKVER   372
             P FGFGLGLERLL+I++KQGI+LPIE +D+Y+AVLG AN AL+L Q+IR QGF ER
Sbjct:   301 PGFGFGLGLERLLMIIEKQGITLPIETEMDIYLAVLGDGANSKALELVQAIRRQGFTAER   360

Query:   373 DYLGRKIKAQFKSADTFNAKVIMTLGSSEVDSKEVGLKNNQTRQEVKVSFENIKTDFSSV   432
             DYLGRKIKAQFKSADTF AK++MTLG SEV++ + +KNN++RQEV VSFE++ T+F+++
Sbjct:   361 DYLGRKIKAQFKSADTFKAKLVMTLGESEVEAGKAVIKNNRSRQEVEVSFEDMMTNFANI   420

Query:   433 LKQL   436
             +QL
Sbjct:   421 SEQL   424
```

Based on this analysis, it was predicted that these proteins and their epitopes could be useful antigens for vaccines or diagnostics.

EXAMPLE 1071

A DNA sequence (GBSx1145) was identified in *S. agalactiae* <SEQ ID 3295> which encodes the amino acid sequence <SEQ ID 3296>. This protein is predicted to be aspartyl-tRNA synthetase (aspS). Analysis of this protein sequence reveals the following:

```
Possible site: 29
>>> Seems to have no N-terminal signal sequence

----- Final Results -----
            bacterial cytoplasm --- Certainty = 0.5124(Affirmative) < succ>
            bacterial membrane  --- Certainty = 0.0000(Not Clear)   < succ>
            bacterial outside   --- Certainty = 0.0000(Not Clear)   < succ>
```

A related GBS nucleic acid sequence <SEQ ID 10273> which encodes amino acid sequence <SEQ ID 10274> was also identified.

The protein has homology with the following sequences in the GENPEPT database.

```
>GP: CAB14714 GB: Z99118 aspartyl-tRNA synthetase [Bacillus subtilis]
Identities = 339/585 (57%), Positives = 432/585 (72%), Gaps = 9/585 (1%)

Query:    20 RSMYAGRVRSEHIGTSITLKGWVGRRRDLGGLIFIDLRDREGIMQLVINPEEVSASVMAT    79
             R+ Y G +  + IG S+TLKGWV +RRDLGGLIFIDLRDR GI+Q+V NP+ VS   +A
Sbjct:     4 RTYYCGDITEKAIGESVTLKGWVQKRRDLGGLIFIDLRDRTGIVQVVFNPD-VSKEALAI    62

Query:    80 AESLRSEFVIEVSGVVTAREQA--NDNLPTGEVELKVQELSILNTSKTTPFEIKDGIE-A   136
             AE +R+E+V+++ G V ARE+    N NL TG +E+     +++LN +KT PF I D  E
Sbjct:    63 AEGIRNEYVLDIQGKVVAREEGTVNPNLKTGAIEIHADGVNVLNAAKTPPFAISDQAEEV   122

Query:   137 NDDTRMRYRYLDLRRPEMLENFKLRAKVTHSIRNYLDNLEFIDVETPMLTKSTPEGARDY   196
             ++D R+++RYLDLRRP M + +LR VT ++R++LD  F+D+ETP+LT STPEGARDY
Sbjct:   123 SEDVRLKHRYLDLRRPAMFQTMQLRHNVTKAVRSFLDENGFLDIETPILTGSTPEGARDY   182
```

-continued

```
Query: 197 LVPSRVNQGHFYALPQSPQITKQLLMNAGFDRYYQIVKCFRDEDLRGDRQPEFTQVDLET 256
            LVPSRV++G FYALPQSPQ+ KQLLM +G +RYYQI +CFRDEDLR DRQPEFTQ+D+E
Sbjct: 183 LVPSRVHEGEFYALPQSPQLFKQLLMVSGIERYYQIARCFRDEDLRADRQPEFTQIDIEM 242

Query: 257 SFLSDQEIQDIVEGMIAKVMKDTKGLEVSLPFPRMAYDDAMNNYGSDKPDTRFDMLLQDL 316
            SF+S ++I  + E M+AKVM++TKG E+ LP PRM YD+AMN YGSDKPDTRFDMLL D+
Sbjct: 243 SFMSQEDIMSLAEEMMAKVMRETKGEELQLPLPRMTYDEAMNKYGSDKPDTRFDMLLTDV 302

Query: 317 TEIVKEVDFKVFSEA----SVVKAIVVKDKADKYSRKNIDKLTEIAKQYGAKGLAWLKYA 372
            ++IVK+ +FKVFS A    VVKAI VK A YSRK+ID L   A YGAKGLAW+K
Sbjct: 303 SDIVKDTEFKVFSSAVANGGVVKAINVKGGAGDYSRKDIDALGAFAANYGAKGLAWVKVE 362

Query: 373 DNTISGPVAKFL-TAIEGRLTEALQLENNDLILFVADSLEVANETLGALRTRIAKELELI 431
             + + GP+AKF     + +L EAL    DL+LF AD   EV   +LGALR ++ KE  LI
Sbjct: 363 ADGVKGPIAKFFDEEKQSKLIEALDAAEGDLLLFGADQFEVVAASLGALRLKLGKERGLI 422

Query: 432 DYSKFNFLWVVDWPMFEWSEEEGRYMSAHHPFTLPTAETAHELEGDLAKVRAVAYDIVLN 491
            D   FNFLWV+DWP+ E   EEGR+ +AHHPFT+P  E     +E     ++A AYD+VLN
Sbjct: 423 DEKLFNFLWVIDWPLLEHDPEEGRFYAAHHPFTMPVREDLELIETAPEDMKAQAYDLVLN 482

Query: 492 GYELGGGSLRINQKDTQERMFKALGFSAESAQEQFGFLLEAMDYGFPPHGGLAIGLDRFV 551
            GYELGGGS+RI +KD QE+MF  LGFS E A EQFGFLLEA +YG PPHGG+A+GLDR V
Sbjct: 483 GYELGGGSIRIFEKDIQEKMFALLGFSPEEAAEQFGFLLEAFEYGAPPHGGIALGLDRLV 542

Query: 552 MLLAGKDNIREVIAFPKNNKASDPMTQAPSLVSEQQLEELSLTVE                596
            MLLAG+ N+R+ IAFPK   AS  MT+AP  VS+ QL+EL L+++
Sbjct: 543 MLLAGRTNLRDTIAFPKTASASCLMTEAPGEVSDAQLDELHLSIK                587
```

25

A related DNA sequence was identified in *S. pyogenes* <SEQ ID 3297> which encodes the amino acid sequence <SEQ ID 3298>. Analysis of this protein sequence reveals the following:

```
Possible site: 23
>>> Seems to have an uncleavable N-term signal seq

----- Final Results -----
             bacterial membrane --- Certainty = 0.0000(Not Clear) < succ>
              bacterial outside --- Certainty = 0.0000(Not Clear) < succ>
            bacterial cytoplasm --- Certainty = 0.0000(Not Clear) < succ>
```

An alignment of the GAS and GBS proteins is shown below.

```
Identities = 495/582 (85%), Positives = 538/582 (92%)

Query:  18 MKRSMYAGRVRSEHIGTSITLKGWVGRRRDLGGLIFIDLRDREGIMQLVINPEEVSASVM  77
           MKRSMYAGRVR EHIGT+ITLKGWV RRRDLGGLIFIDLRDREG+MQLVINPEEVS+ VM
Sbjct:  18 MKRSMYAGRVREEHIGTTITLKGWVSRRRDLGGLIFIDLRDREGVMQLVINPEEVSSDVM  77

Query:  78 ATAESLRSEFVIEVSGVVTAREQANDNLPTGEVELKVQELSILNTSKTTPFEIKDGIEAN 137
           ATAE LRSE+VIEV G V AR+QAND L TG VELKV  L+ILNT+KTTPFEIKD +E +
Sbjct:  78 ATAERLRSEYVIEVEGFVEARQQANDKLATGMVELKVSALTILNTAKTTPFEIKDDVEVS 137

Query: 138 DDTRMRYRYLDLRRPEMLENFKLRAKVTHSIRNYLDNLEFIDVETPMLTKSTPEGARDYL 197
           DDTR+RYRYLDLRRPEMLENFKLRAKVTHSIRNYLD+LEFIDVETPMLTKSTPEGARDYL
Sbjct: 138 DDTRLRYRYLDLRRPEMLENFKLRAKVTHSIRNYLDDLEFIDVETPMLTKSTPEGARDYL 197

Query: 198 VPSRVNQGHFYALPQSPQITKQLLMNAGFDRYYQIVKCFRDEDLRGDRQPEFTQVDLETS 257
           VPSRV+QGHFYALPQSPQITKQLLMNAGFDRYYQIVKCFRDEDLRGDRQPEFTQVDLETS
Sbjct: 198 VPSRVSQGHFYALPQSPQITKQLLMNAGFDRYYQIVKCFRDEDLRGDRQPEFTQVDLETS 257

Query: 258 FLSDQEIQDIVEGMIAKVMKDTKGLEVSLPFPRMAYDDAMNNYGSDKPDTRFDMLLQDLT 317
           FLS+QEIQDIVEGMIAKVMK+TK ++V+ LPFPRM YD AMN YGSDKPDTRF+MLLQDLT
Sbjct: 258 FLSEQEIQDIVEGMIAKVMKETKEIDVTLPFPRMSYDVAMNSYGSDKPDTRFEMLLQDLT 317

Query: 318 EIVKEVDFKVFSEASVVKAIVVKDKADKYSRKNIDKLTEIAKQYGAKGLAWLKYADNTIS 377
              VK  DFKVFSEA VKAIVVK  AD+YSRK+IDKLTE AKQ+GAKGLAW+K  D  ++
Sbjct: 318 VTVKGNDFKVFSEAPAVKAIVVKGNADRYSRKDIDKLTEFAKQFGAKGLAWVKVTDGQLA 377

Query: 378 GPVAKFLTAIEGRLTEALQLENNDLILFVADSLEVANETLGALRTRIAKELELIDYSKFN 437
           GPVAKFLTAIE  L+  L+L  NDL+LFVAD+LEVAN TLGALR RIAK+L++ID S+FN
Sbjct: 378 GPVAKFLTAIETELSSQLKLAENDLVLFVADTLEVANNTLGALRNRIAKDLDMIDQSQFN 437
```

```
Query: 438 FLWVVDWPMFEWSEEEGRYMSAHHPFTLPTAETAHELEGDLAKVRAVAYDIVLNGYELGG 497
            FLWVVDWPMFEWSEEEGRYMSAHHPFTLPT E+AHELEGDLAKVRA+AYDIVLNGYELGG
Sbjct: 438 FLWVVDWPMFEWSEEEGRYMSAHHPFTLPTPESAHELEGDLAKVRAIAYDIVLNGYELGG 497

Query: 498 GSLRINQKDTQERMFKALGFSAESAQEQFGFLLEAMDYGFPPHGGLAIGLDRFVMLLAGK 557
            GSLRINQK+ QERMFKALGF+A+ A +QFGFLLEAMDYGFPPHGGLAIGLDRFVMLLAGK
Sbjct: 498 GSLRINQKEMQERMFKALGFTADEANDQFGFLLEAMDYGFPPHGGLAIGLDRFVMLLAGK 557

Query: 558 DNIREVIAFPKNNKASDPMTQAPSLVSEQQLEELSLTVESYE                   599
            DNIREVIAFPKNNKASDPMTQAPSLVSE QLEELSL +ES++
Sbjct: 558 DNIREVIAFPKNNKASDPMTQAPSLVSENQLEELSLQIESHD                   599
```

Based on this analysis, it was predicted that these proteins and their epitopes could be useful antigens for vaccines or diagnostics.

EXAMPLE 1072

A DNA sequence (GBSx1146) was identified in *S. agalactiae* <SEQ ID 3299> which encodes the amino acid sequence <SEQ ID 3300>. Analysis of this protein sequence reveals the following:

```
Possible site: 54
>>> Seems to have no N-terminal signal sequence
    INTEGRAL    Likelihood = -8.44    Transmembrane    186-202 (182-205)
    INTEGRAL    Likelihood = -5.68    Transmembrane     88-104  (86-106)
    INTEGRAL    Likelihood = -3.40    Transmembrane    115-131 (112-132)
    INTEGRAL    Likelihood = -2.13    Transmembrane    141-157 (141-157)
    INTEGRAL    Likelihood = -0.96    Transmembrane     43-59   (43-59)

----- Final Results -----
              bacterial membrane --- Certainty = 0.4376(Affirmative) < succ>
               bacterial outside --- Certainty = 0.0000(Not Clear)   < succ>
             bacterial cytoplasm --- Certainty = 0.0000(Not Clear)   < succ>
```

The protein has homology with the following sequences in the GENPEPT database.

```
>GP:CAB12952 GB:Z99109 alternate gene name: yuxA~similar to
hypothetical proteins [Bacillus subtilis]
Identities = 104/275 (37%), Positives = 181/275 (65%), Gaps = 1/275 (0%)
Query:  39 EKISASLLYGILSSVAVNFFFQPGHVYSSGATGLAQVISAVSKHWFSFEIPVALAFYAIN   98
           +K+   ++  +L++  +N F  P  VY+SG TG+AQ++S+V   + F I      + +N
Sbjct:   7 KKLLIVIIGALLNAAGLNLFLIPADVYASGFTGVAQLLSSVVDQYAPFYISTGTLLFLLN   66

Query:  99 IPLLILSWRKIGHKFTIFTFITVTVSSIFIQLMPQITLTTDPLINAIFGGLIMGAGVGFS  158
           IP+ IL W K+G  FT+++ ++V ++++F+ ++P+ +L+ D L+NA+FGG+I   G+G +
Sbjct:  67 IPVGILGWLKVGKSFTVYSILSVALTTLFMGILPETSLSHDILLNAVFGGVISAVGIGLT  126

Query: 159 FKSRISSGGTDIISLTIRKKTGRDVGSISFIINGIILLFAGLLFGWKYALYSMVTIFVSS  218
              K   S+GG DI+++ + K   + VG+  FI+NGII+L AGLL GW+ ALY++VT++V++
Sbjct: 127 LKYGASTGGLDIVAMVLAKWKDKPVGTYFFILNGIIILTAGLLQGWEKALYTLVTLYVTT  186

Query: 219 RVTDAIFTKQKKMQAMIVTSKPYCVIKRIHRDLHRGVTCINDAEGTYNHEKKAVLITILT  278
           RV DAI T+  K+ AMIVT K   + I+  + RG+T   A+G + +E+K ++I  ++T
Sbjct: 187 RVIDAIHTRHMKLTAMIVTKKADEIKEAIYGKMVRGITTV-PAKGAFTNEQKEMMIIVIT  245

Query: 279 REEFSDFKYLMLKADPKAFVSVAENVHIIGRFVDD                          313
           R E  D + ++ + DPKAF ++ +   I G F D
Sbjct: 246 RYELYDLEKIVKEVDPKAFTNIVQTTGIFGFFRKD                          280
```

A related DNA sequence was identified in *S. pyogenes* <SEQ ID 3301> which encodes the amino acid sequence <SEQ ID 3302>. Analysis of this protein sequence reveals the following:

```
Possible site: 53
>>> Seems to have no N-terminal signal sequence
    INTEGRAL    Likelihood = -5.47    Transmembrane     87-103  (86-106)
    INTEGRAL    Likelihood = -4.94    Transmembrane    185-201 (182-203)
```

```
INTEGRAL    Likelihood = -1.59    Transmembrane    114-130  (113-130)
INTEGRAL    Likelihood = -1.12    Transmembrane     42-58    (42-58)
INTEGRAL    Likelihood = -0.32    Transmembrane    140-156  (140-156)

----- Final Results -----
            bacterial membrane --- Certainty = 0.3187(Affirmative) < succ>
            bacterial outside  --- Certainty = 0.0000(Not Clear)   < succ>
           bacterial cytoplasm --- Certainty = 0.0000(Not Clear)   < succ>
```

The protein has homology with the following sequences in the databases:

```
>GP:CAA66894 GB:X98238 orf2 [Lactobacillus sakei]
Identities = 105/280 (37%), Positives = 180/280 (63%), Gaps = 7/280 (2%)
Query:   37 AEKISASLLYGILSSIAVNFFFQPGHVYSSGATGLAQVFSAL-SHRLLGYDFPIAFAFYL    95
            +++I   +++YG L++++VN F  P   YSSG TG+AQ+ +AL SH   LG    +A   ++
Sbjct:    8 SKRIVIAMVYGFLAAVSVNLFLIPAKTYSSGVTGVAQLLTALVSH--LGGSLSVAALVFI   65

Query:   96 INIPLLILAWYKIGHQFTIFTFITVSMSSFFIQIMPQVT--LTTDPLINAIFGGLVMGMG  153
            +N+PLL+LAW+KI HQ+ IF+ + V  S  F++I+P     + T+     A+FGG ++G+G
Sbjct:   66 LNVPLLVLAWFKINHQYAIFSIVAVFTSVIFLKIIPVPVQPILTERFAGALFGGALIGLG  125

Query:  154 IGTGLKSRISSGGTDIVSLTLRKRTGKDVGSLSLMVNGAILAFAGILFGWQYALYSMVSI  213
            +G   ++  S+GGTD++   + + TGK VG+++ ++NG I+  AGI  FGW  ALYS+V I
Sbjct:  126 VGLCFRAGFSTGGTDVIVTLVGRLTGKRVGAVNNVINGMIILAAGIFFGWGAALYSIVEI  185

Query:  214 FVSSRVTDAIFTKQKKMQATIVTSHPERVIHMIHKRLHRGVTSINDAEGTYKHEQKAVLI  273
            FVSS + D  I+T+Q+K+    TI T  PE +     + + +H G T + D   G Y +++ +V++
Sbjct:  186 FVSSLLMDYIYTQQQKVTVTIFTKQPEALKKRMREFIH-GATEL-DGTGLYTNQETSVIM  243

Query:  274 TILTCEEYPEFKWLMLKTDPQAFVSVAENVRIIGRFVEDD                     313
            T+++  +    K ++  DP AFV++   + +GRF  ++
Sbjct:  244 TVVSKYDLTALKLVVQDADPNAFVNIQSTMNLWGRFESNE                     283
```

An alignment of the GAS and GBS proteins is shown below.

```
Identities = 239/311 (76%), Positives = 274/311 (87%)
Query:    4 RRTPLEKKVKYIISVWAKKFGLLHTLKSISREKYAEKISASLLYGILSSVAVNFFFQPGH    63
            ++T  +KKVKY+IS  AKK GLLH L+SISREKYAEKISASLLYGILSS+AVNFFFQPGH
Sbjct:    3 KKTTYKKKVKYVISRGAKKVGLLHALRSISREKYAEKISASLLYGILSSIAVNFFFQPGH    62

Query:   64 VYSSGATGLAQVISAVSKHWFSFEIPVALAFYAINIPLLILSWRKIGHKFTIFTFITVTV   123
            VYSSGATGLAQV SA+S    ++ P+A AFY INIPLLIL+W KIGH+FTIFTFITV++
Sbjct:   63 VYSSGATGLAQVFSALSHRLLGYDFPIAFAFYLINIPLLILAWYKIGHQFTIFTFITVSM   122

Query:  124 SSIFIQLMPQITLTTDPLINAIFGGLIMGAGVGFSFKSRISSGGTDIISLTIRKKTGRDV   183
            SS FIQ+MPQ+TLTTDPLINAIFGGL+MG G+G   KSRISSGGTDI+SLT+RK+TG+DV
Sbjct:  123 SSFFIQIMPQVTLTTDPLINAIFGGLVMGMGIGTGLKSRISSGGTDIVSLTLRKRTGKDV   182

Query:  184 GSISFIINGIILLFAGLLFGWKYALYSMVTIFVSSRVTDAIFTKQKKMQAMIVTSKPYCV   243
            GS+S  ++NG IL FAG+LFGW YALYSMV+IFVSSRVTDAIFTKQKKMQA IVTS P  V
Sbjct:  183 GSLSLMVNGAILAFAGILFGWQYALYSMVSIFVSSRVTDAIFTKQKKMQATIVTSHPERV   242

Query:  244 IKRIHRDLHRGVTCINDAEGTYNHEKKAVLITILTREEFSDFKYLMLKADPKAFVSVAEN   303
            I   IH+ LHRGVT  INDAEGTY HE+KAVLITILT EE+ +FK+LMLK DP+AFVSVAEN
Sbjct:  243 IHMIHKRLHRGVTSINDAEGTYKHEQKAVLITILTCEEYPEFKWLMLKTDPQAFVSVAEN   302

Query:  304 VHIIGRFVDDD                                                  314
            V IIGRFV+DD
Sbjct:  303 VRIIGRFVEDD                                                  313
```

Based on this analysis, it was predicted that these proteins and their epitopes could be useful antigens for vaccines or diagnostics.

EXAMPLE 1073

A DNA sequence (GBSx1147) was identified in *S. agalactiae* <SEQ ID 3303> which encodes the amino acid sequence <SEQ ID 3304>. Analysis of this protein sequence reveals the following:

```
Possible site: 26
>>> Seems to have a cleavable N-term signal seq.
    INTEGRAL    Likelihood = -3.72    Transmembrane    156-172  (156-174)
    INTEGRAL    Likelihood = -3.03    Transmembrane    112-128  (110-129)
    INTEGRAL    Likelihood = -2.34    Transmembrane     80-96   (79-96)
    INTEGRAL    Likelihood = -1.49    Transmembrane     60-76   (58-76)

----- Final Results -----
            bacterial membrane --- Certainty = 0.2487(Affirmative) < succ>
            bacterial outside  --- Certainty = 0.0000(Not Clear)   < succ>
            bacterial cytoplasm --- Certainty = 0.0000(Not Clear)  < succ>
```

The protein has homology with the following sequences in the GENPEPT database.

```
>GP:BAB05397 GB:AP001512 unknown conserved
protein [Bacillus halodurans]
Identities = 113/278 (40%), Positives = 192/278 (68%), Gaps = 1/278 (0%)
Query:   7 KTKIKETILIAFGVALYTFGFVKFNMANHLAEGGISGVTLIIHALFGVNPALSSLLLNIP   66
           + K K  + I   G A+++FG V FNM N+LAEGG +G+TLI++ +F +NPA+++L+LNIP
Sbjct:   4 RLKWKNIVFILLGSAIFSFGLVYFNMENNLAEGGFTGITLILYFMFQINPAVTNLVLNIP   63

Query:  67 LFILGARILGKKSLLLTIYGTVLMSFFMWFWQQIP-VTVPLKNDMMLVAVAAGILAGTGS   125
           + ++G +ILG+ +L+ TI GTV +S F+  +Q+     +PL +DM L A+ AG+  GTG
Sbjct:  64 ILLIGWKILGRVTLIYTIIGTVSVSVFLEMFQRWKFMDIPLHDDMTLAALFAGVFVGTGL   123

Query: 126 GLVFRYGATTGGADIIGRIVEEKSGIKLGQTLLFIDAIVLTSSLVYINLQQMLYTLVASF   185
           G+VFR+G TTGG DII ++     G  +G+T+   DA+V+ SSL+Y+N ++ +YTL+A F
Sbjct: 124 GIVFRFGGTTGGVDIIAKLGFRYLGWSMGKTMFMFDAVVIASSLIYLNYREAMYTLLAVF   183

Query: 186 VFSQVLTNVENGGYTVRGMIIITKESESAAATILHEINRGVTFLRGQGAYSGREHDVLYV   245
           + ++V+  ++    Y+ +  II++ +E+ A TIL E+ RG T L+G+G+++G  E ++LY
Sbjct: 184 IAAKVIDFIQQTAYSAKAAFIISEHTEAIADTILKEMERGATTLKGKGSFTGTEKEILYC   243

Query: 246 ALNPSEVRDVKEIMADLDPDAFISVINVDEVISSDFKI                        283
           +   +E+  +K ++   +DP AF++V +V +VI    F +
Sbjct: 244 VVGRNELIRLKSLVERIDPHAFVTVNDVQDVIGEGFTL                        281
```

A related DNA sequence was identified in *S. pyogenes* <SEQ ID 3305> which encodes the amino acid sequence <SEQ ID 3306>. Analysis of this protein sequence reveals the following:

```
Possible site: 26
>>> Seems to have a cleavable N-term signal seq.
    INTEGRAL    Likelihood = -5.15    Transmembrane    112-128  (109-130)
    INTEGRAL    Likelihood = -2.34    Transmembrane    156-172  (156-174)
    INTEGRAL    Likelihood = -1.81    Transmembrane    178-194  (177-194)
    INTEGRAL    Likelihood = -1.65    Transmembrane     80-96   (79-96)
    INTEGRAL    Likelihood = -0.37    Transmembrane     60-76   (59-76)

----- Final Results -----
            bacterial membrane --- Certainty = 0.3060(Affirmative) < succ>
            bacterial outside  --- Certainty = 0.0000(Not Clear)   < succ>
            bacterial cytoplasm --- Certainty = 0.0000(Not Clear)  < succ>
```

The protein has homology with the following sequences in the databases:

```
>GP:BAB05397 GB:AP001512 unknown conserved
protein [Bacillus halodurans]
Identities = 116/276 (42%), Positives = 182/276 (65%), Gaps = 1/276 (0%)
Query:   9 KLLKLFLIALGVAIYTFGFVNFNMANALAEGGVAGITLILHAHFGINPAYSSLLFNLPLF   68
           K    +  I  LG AI++FG V FNM N LAEGG  GITLIL+ F INPA ++L+ N+P+
Sbjct:   6 KWKNIVFILLGSAIFSFGLVYFNMENNLAEGGFTGITLILYFMFQINPAVTNLVLNIPIL   65

Query:  69 ILGAKIFGKRSLALTIYGTVLMSAFIWMWQKVP-IELGLENDMMLVAVVAGLFSGIGSGI   127
           ++G KI G+ +L  TI GTV +S F+ M+Q+    +  L +DM L A+ AG+F G G GI
Sbjct:  66 LIGWKILGRVTLIYTIIGTVSVSVFLEMFQRWKFMDIPLHDDMTLAALFAGVFVGTGLGI   125

Query: 128 VFRYGATTGGTDIIGRIAEEKFGAKLGQTLLLVDALVLTASLTYVDLKHMLYTLVASFVF   187
           VFR+G TTGG DII ++        G +G+T+ + DA+V+ +SL Y++ +  +YTL+A F+
Sbjct: 126 VFRFGGTTGGVDIIAKLGFRYLGWSMGKTMFMFDAVVIASSLIYLNYREAMYTLLAVFIA   185
```

```
Query: 188 SQMISVVQNGGYTIRGMIIITKHSEAAAQAILTEINRGVTYLKGQGAYSGNDYNIMYVTL 247
           +++I  +Q    Y+ +   II++H+EA A   IL E+ RG T LKG+G+++G +   I+Y  +
Sbjct: 186 AKVIDFIQQTAYSAKAAFIISEHTEAIADTILKEMERGATTLKGKGSFTGTEKEILYCVV 245

Query: 248 NPTEVREVKRILAGLDPDAFISIIDVDEVISSDFKI                         283
            E+   +K  ++    +DP AF+++ DV +VI    F +
Sbjct: 246 GRNELIRLKSLVERIDPHAFVTVNDVQDVIGEGFTL                         281
```

An alignment of the GAS and GBS proteins is shown below.

```
Identities = 206/286 (72%), Positives = 250/286 (87%)
Query:   5 DLKTKIKETILIAFGVALYTFGFVKFNMANHLAEGGISGVTLIIHALFGVNPALSSLLLN  64
           D  TK+ +  LIA GVA+YTFGFV FNMAN LAEGG++G+TLI+HA  FG+NPA SSLL N
Sbjct:   5 DKLTKLLKLFLIALGVAIYTFGFVNFNMANALAEGGVAGITLILHAHFGINPAYSSLLFN  64

Query:  65 IPLFILGARILGKKSLLLTIYGTVLMSFFMWFWQQIPVTVPLKNDMMLVAVAAGILAGTG 124
           +PLFILGA+I GK+SL LTIYGTVLMS F+W WQ++P+ + L+NDMMLVAV AG+ +G G
Sbjct:  65 LPLFILGAKIFGKRSLALTIYGTVLMSAFIWMWQKVPIELGLENDMMLVAVVAGLFSGIG 124

Query: 125 SGLVFRYGATTGGADIIGRIVEEKSGIKLGQTLLFIDAIVLTSSLVYINLQQMLYTLVAS 184
           SG+VFRYGATTGG DIIGRI EEK G KLGQTLL +DA+VLT+SL Y++L+ MLYTLVAS
Sbjct: 125 SGIVFRYGATTGGTDIIGRIAEEKFGAKLGQTLLLVDALVLTASLTYVDLKHMLYTLVAS 184

Query: 185 FVFSQVLTNVENGGYTVRGMIIITKESESAAATILHEINRGVTFLRGQGAYSGREHDVLY 244
           FVFSQ+++ V+NGGYT+RGMIIITK SE+AA   IL EINRGVT+L+GQGAYSG +++++Y
Sbjct: 185 FVFSQMISVVQNGGYTIRGMIIITKHSEAAAQAILTEINRGVTYLKGQGAYSGNDYNIMY 244

Query: 245 VALNPSEVRDVKEIMADLDPDAFISVINVDEVISSDFKIRRRNYDK 290
           V LNP+EVR+VK I+A LDPDAFIS+I+VDEVISSDFKIRRRNYDK
Sbjct: 245 VTLNPTEVREVKRILAGLDPDAFISIIDVDEVISSDFKIRRRNYDK 290
```

Based on this analysis, it was predicted that these proteins and their epitopes could be useful antigens for vaccines or diagnostics.

EXAMPLE 1074

A DNA sequence (GBSx1148) was identified in *S. agalactiae* <SEQ ID 3307> which encodes the amino acid sequence <SEQ ID 3308>. This protein is predicted to be BacB protein. Analysis of this protein sequence reveals the following:

```
Possible site: 60
>>> Seems to have no N-terminal signal sequence

----- Final Results -----
          bacterial cytoplasm --- Certainty = 0.4355(Affirmative) < succ>
           bacterial membrane --- Certainty = 0.0000(Not Clear)  < succ>
            bacterial outside --- Certainty = 0.0000(Not Clear)  < succ>
```

The protein has homology with the following sequences in the GENPEPT database.

```
>GP:BAA11330 GB:D78257 BacB [Enterococcus faecalis]
Identities = 27/88 (30%), Positives = 48/88 (53%), Gaps = 1/88 (1%)
Query:   1 MPSEKEILDALSKVYSEEVIQADDYFRQAIFELASQLEKEGMN-SLLATKIDSLINQYVL  59
           M  ++E+LD LSK Y++ I  +  +FE A +L    N   +  K+ ++ ++Y+
Sbjct:   1 MDKQQELLDLLSKAYNDPKINEYEGLKDKLFECAKRLTTNETNIGEVCYKLSTINSEYLA  60

Query:  60 THQFDAPKSIFDLSRLVKTKASHYKGTA 87
            H F+ PKSI +L + V  +  Y+G A
Sbjct:  61 RHHFEMPKSIIELQKFVTKEGQKYRGWA 88
```

A related DNA sequence was identified in *S. pyogenes* <SEQ ID 3309> which encodes the amino acid sequence <SEQ ID 3310>. Analysis of this protein sequence reveals the following:

Possible site: 27
>>> Seems to have no N-terminal signal sequence

----- Final Results -----
           bacterial cytoplasm --- Certainty = 0.2712(Affirmative) < succ>
            bacterial membrane --- Certainty = 0.0000(Not Clear)   < succ>
             bacterial outside --- Certainty = 0.0000(Not Clear)   < succ>
```

An alignment of the GAS and GBS proteins is shown below.

```
Identities = 99/102 (97%), Positives = 102/102 (99%)
Query:   1 MPSEKEILDALSKVYSEEVIQADDYFRQAIFELASQLEKEGMNSLLATKIDSLINQYVLT   60
           MPSEKEILDALSKVYSE+VIQADDYFRQAIFELASQLEKEGM+SLLATKIDSLINQY+LT
Sbjct:   7 MPSEKEILDALSKVYSEQVIQADDYFRQAIFELASQLEKEGMSSLLATKIDSLINQYILT   66

Query:  61 HQFDAPKSIFDLSRLVKTKASHYKGTAISAIMLGSFLSGGPK                   102
           HQFDAPKSIFDLSRLVKTKASHYKGTAISAIMLGSFLSGGPK
Sbjct:  67 HQFDAPKSIFDLSRLVKTKASHYKGTAISAIMLGSFLSGGPK                   108
```

Based on this analysis, it was predicted that these proteins and their epitopes could be useful antigens for vaccines or diagnostics.

EXAMPLE 1075

A DNA sequence (GBSx1149) was identified in *S. agalactiae* <SEQ ID 3311> which encodes the amino acid sequence <SEQ ID 3312>. This protein is predicted to be ArgS (argS). Analysis of this protein sequence reveals the following:

```
Possible site: 57
>>> Seems to have no N-terminal signal sequence

----- Final Results -----
           bacterial cytoplasm --- Certainty = 0.2522(Affirmative) < succ>
            bacterial membrane --- Certainty = 0.0000(Not Clear)   < succ>
             bacterial outside --- Certainty = 0.0000(Not Clear)   < succ>
```

A related GBS nucleic acid sequence <SEQ ID 10271> which encodes amino acid sequence <SEQ ID 10272> was also identified.

The protein has homology with the following sequences in the GENPEPT database.

```
>GP:AAF86984 GB:AF282249 ArgS [Lactococcus lactis subsp. lactis]
Identities = 377/566 (66%), Positives = 464/566 (81%), Gaps = 5/566 (0%)
Query:  12 MDTKHLIASEIQKVVPD-MEQSTILSLLETPKNSSMGDLAFPAFSLAKTLRKAPQIIASD   70
           MD K L++  +   +     I +++E PK+S +GDLAFPAF LAKTLRK+PQIIA +
Sbjct:   1 MDEKQLVSQALSAAIDGVLGVEQIAAIIEKPKSSDLGDLAFPAFQLAKTLRKSPQIIAGE   60

Query:  71 IAEQIKSDQFEKVEAVGPYVNFFLDKAAISSQVLKQVLSDGSAYATQNIGEGRNVAIDMS  130
           IAE+I +  FEKV AVGPYVNFFLDK A +S+V+++VL++G  Y    NIGEG NV IDMS
Sbjct:  61 IAEKIDTKGFEKVIAVGPYVNFFLDKNATASEVIREVLAEGEHYGDANIGEGGNVPIDMS  120

Query: 131 SPNIAKPFSIGHLRSTVIGDSLANIFDKIGYHPVKINHLGDWGKQFGMLIVAYKKWGNEE  190
           +PNIAKPFSIGHLRSTVIGDS+A  I++K+GY P+KINHLGDWGKQFG+LI AYKK+G+E
Sbjct: 121 APNIAKPFSIGHLRSTVIGDSIAKIYEKLGYQPIKINHLGDWGKQFGLLITAYKKYGDEA  180

Query: 191 AVRAHPIDELLKLYVRINAEAETDPSVDEEAREWFRKLEANDPEATELWQWFRDESLLEF  250
            + A+PIDELLKLYV+INAEA+ D  VDEE R+WF K+E  D EA  +W+WF D SL+EF
Sbjct: 181 TITANPIDELLKLYVKINAEAKEDSEVDEEGRQWFLKMEQGDEEALRIWKWFSDVSLIEF  240

Query: 251 NRLYDQMNVTFDSYNGEAFYNDKMDEVLELLESKNLLVESKGAQVVNLEKYGIEHPALIK  310
           NR+Y ++  VTFD + GE+FY+DKMD ++E LE+KNLL ESKGA +V+LEKY + +PALIK
Sbjct: 241 NRIYGKLGVTFDHFMGESFYSDKMDAIVEDLENKNLLHESKGALIVDLEKYNL-NPALIK  299

Query: 311 KSDGATLYITRDLAAALYRKRTYDFAKSIYVVGNEQSAHFKQLKAVLKEMDYDWSDDMTH  370
           K+DGATLYITRDLA A YRK+T++F  KS+YVVG EQ+ HFKQLKAVLKE  YDWSDDM H
Sbjct: 300 KTDGATLYITRDLATAAYRKKTFNFVKSLYVVGGEQTNHFKQLKAVLKEAGYDWSDDMVH  359
```

-continued

```
Query: 371 VPFGLVTKGGAKLSTRKGNVILLEPTVAEAINRAASQIEAKNPNLADKDKVAQAVGVGAI  430
            VPFG+VT+GG K STRKG+V+ LE  + EA++RA  QIEAKNPNL +K++VA+ VGVGA+
Sbjct: 360 VPFGMVTQGGKKFSTRKGHVVKLEMALDEAVDRAEKQIEAKNPNLENKEEVAKQVGVGAV  419

Query: 431 KFYDLKTDRTNGYDFDLEAMVSFEGETGPYVQYAHARIQSILRKANFSPSNSDNYSL--N  488
            KFYDLKTDR NGYDFDL+ MVSFEGETGPYVQYAHARIQSILRKAN   N DN SL  +
Sbjct: 420 KFYDLKTDRNNGYDFDLDEMVSFEGETGPYVQYAHARIQSILRKAN-RKVNIDNISLVVS  478

Query: 489 DVESWEIIKLIQDFPRIIVRAADNFEPSIIAKFAINLAQCFNKYYAHTRILDEDAEISSR  548
            D E+WEI+K +++FP I+ RAADN+EPSIIAK+AI+LAQ FNKYYAH RIL++DA++  R
Sbjct: 479 DAEAWEIVKALKEFPNIVKRAADNYEPSIIAKYAISLAQAFNKYYAHVRILEDDAQLDGR  538

Query: 549 LALCYATATVLKESLRLLGVDAPNEM                                   574
            LAL  AT+ VLKE+LRLLGV AP  M
Sbjct: 539 LALISATSIVLKEALRLLGVAAPENM                                   564
```

15

A related DNA sequence was identified in *S. pyogenes* <SEQ ID 3313> which encodes the amino acid sequence <SEQ ID 3314>. Analysis of this protein sequence reveals the following:

```
Possible site: 46
>>> Seems to have no N-terminal signal sequence

----- Final Results -----
            bacterial cytoplasm --- Certainty = 0.1734(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below.

```
Identities = 492/563 (87%), Positives = 526/563 (93%)

Query:  12 MDTKHLIASEIQKVVPDMEQSTILSLLETPKNSSMGDLAFPAFSLAKTLRKAPQIIASDI   71
           MDTK LIASEI KVVP++EQ  I +LLETPKNS MGDLAFPAFSLAK LRKAPQ+IAS++
Sbjct:   1 MDTKTLIASEIAKVVPELEQDAIFNLLETPKNSDMGDLAFPAFSLAKVLRKAPQMIASEL   60

Query:  72 AEQIKSDQFEKVEAVGPYVNFFLDKAAISSQVLKQVLSDGSAYATQNIGEGRNVAIDMSS  131
           AEQI   QFEKV AVGPY+NFFLDKA ISSQVL+QV++ GS YA Q+ G+GRNVAIDMSS
Sbjct:  61 AEQIDESQFEKVVAVGPYINFFLDKAKISSQVLEQVITAGSDYAQQDEGQGRNVAIDMSS  120

Query: 132 PNIAKPFSIGHLRSTVIGDSLANIFDKIGYHPVKINHLGDWGKQFGMLIVAYKKWGNEEA  191
           PNIAKPFSIGHLRSTVIGDSLA+IF K+GY PVKINHLGDWGKQFGMLIVAYKKWG+E A
Sbjct: 121 PNIAKPFSIGHLRSTVIGDSLAHIFAKMGYKPVKINHLGDWGKQFGMLIVAYKKWGDEAA  180

Query: 192 VRAHPIDELLKLYVRINAEAETDPSVDEEAREWFRKLEANDPEATELWQWFRDESLLEFN  251
           V+AHPIDELLELYVERINAEAETDP+VDEEAREWFRKLE  D EATELWQWFRDESLLEFN
Sbjct: 181 VQAHPIDELLKLYVRINAEAETDPTVDEEAREWFRKLEDGDKEATELWQWFRDESLLEFN  240

Query: 252 RLYDQMNVTFDSYNGEAFYNDKMDEVLELLESKNLLVESKGAQVVNLEKYGIEHPALIKK  311
           RLYDQ++VTFDSYNGEAFYNDKMDEVL+LLE+KNLLVESKGAQVVNLEKYGIEHPALIKK
Sbjct: 241 RLYDQLHVTFDSYNGEAFYNDKMDEVLDLLEAKNLLVESKGAQVVNLEKYGIEHPALIKK  300

Query: 312 SDGATLYITRDLAAALYRKRTYDFAKSIYVVGNEQSAHFKQLKAVLKEMDYDWSDDMTHV  371
           SDGATLYITRDLAAALYRKRTYDFAKS+YVVGNEQ+AHFKQLKAVLKEM YDWSDDMTHV
Sbjct: 301 SDGATLYITRDLAAALYRKRTYDFAKSVYVVGNEQAAHFKQLKAVLKEMGYDWSDDMTHV  360

Query: 372 PFGLVTKGGAKLSTRKGNVILLEPTVAEAINRAASQIEAKNPNLADKDKVAQAVGVGAIK  431
            FGLVTKGGAKLSTRKGNVILLEPTVAEAINRAASQIEAKNPNLADK+ VA AVGVGAIK
Sbjct: 361 AFGLVTKGGAKLSTRKGNVILLEPTVAEAINRAASQIEAKNPNLADKEAVAHAVGVGAIK  420

Query: 432 FYDLKTDRTNGYDFDLEAMVSFEGETGPYVQYAHARIQSILRKANFSPSNSDNYSLNDVE  491
           FYDLKTDR NGYDFDLEAMVSFEGETGPYVQYAHARIQSILRKA+F+PS +  YSL D E
Sbjct: 421 FYDLKTDRMNGYDFDLEAMVSFEGETGPYVQYAHARIQSILRKADFTPSATTTYSLADAE  480

Query: 492 SWEIIKLIQDFPRIIVRAADNFEPSIIAKFAINLAQCFNKYYAHTRILDEDAEISSRLAL  551
           SWEIIKLIQDFPRII R +DNFEPSI+AKFAINLAQ FNKYYAHTRILD+++E  +RLAL
Sbjct: 481 SWEIIKLIQDFPRIIKRTSDNFEPSIMAKFAINLAQSFNKYYAHTRILDDNSERDNRLAL  540

Query: 552 CYATATVLKESLRLLGVDAPNEM                                      574
           CYATATVLKE+LRLLGVDAPNEM
Sbjct: 541 CYATATVLKEALRLLGVDAPNEM                                      563
```

Based on this analysis, it was predicted that these proteins and their epitopes could be useful antigens for vaccines or diagnostics.

EXAMPLE 1076

A DNA sequence (GBSx1150) was identified in *S. agalactiae* <SEQ ID 3315> which encodes the amino acid sequence <SEQ ID 3316>. This protein is predicted to be arginine hydroximate resistance protein (argR). Analysis of this protein sequence reveals the following:

```
Possible site: 42
>>> Seems to have no N-terminal signal sequence

----- Final Results -----
             bacterial cytoplasm --- Certainty = 0.3252(Affirmative) < succ>
              bacterial membrane --- Certainty = 0.0000(Not Clear)   < succ>
               bacterial outside --- Certainty = 0.0000(Not Clear)   < succ>
```

A related GBS nucleic acid sequence <SEQ ID 10269> which encodes amino acid sequence <SEQ ID 10270> was also identified.

The protein has homology with the following sequences in the GENPEPT database.

```
>GP: AAA88596 GB: M18729 unknown protein [Streptococcus pneumoniae]
Identities = 63/141 (44%), Positives = 90/141 (63%)

Query:    4 MNKIERQKRIKRLIQSGQIGTQEEIKLHLKNEGIDVTQATLSRDLREIGLLKLRSPEGKL   63
            M K +R + IK++I    ++ TQ+EI+  L+   + VTQ TLSRDLREIGL K++  +
Sbjct:    1 MRKRDRHQLIKKMITEEKLSTQKEIQDRLEAHNVCVTQTTLSRDLREIGLTKVKKNDMVY   60

Query:   64 YYSLSTATSNRFSPALRSYILKVSRASFMLVLNTNLGEASVLANFIDEKGLPEILGTMAG  123
            Y ++            L  ++ V+RA F LVL+T LGEASVLAN +D        ILGT+AG
Sbjct:   61 YVLVNETEKIDLVEFLSHHLEGVARAEFTLVLHTKLGEASVLANIVDVNKDEWILGTVAG  120

Query:  124 ADTLLVICQNEDIAKVFEKEL                                        144
            A+TLLVIC+++ +AK+ E   L
Sbjct:  121 ANTLLVICRDQHVAKLMEDRL                                        141
```

A related DNA sequence was identified in *S. pyogenes* <SEQ ID 3317> which encodes the amino acid sequence <SEQ ID 3318>. Analysis of this protein sequence reveals the following:

```
Possible site: 42
>>> Seems to have no N-terminal signal sequence

----- Final Results -----
             bacterial cytoplasm --- Certainty = 0.3176(Affirmative) < succ>
              bacterial membrane --- Certainty = 0.0000(Not Clear)   < succ>
               bacterial outside --- Certainty = 0.0000(Not Clear)   < succ>
```

An alignment of the GAS and GBS proteins is shown below.

```
Identities = 101/145 (69%), Positives = 121/145 (82%)

Query:    4 MNKIERQKRIKRLIQSGQIGTQEEIKLHLKNEGIDVTQATLSRDLREIGLLKLRSPEGKL   63
            MNK+ERQ++IKR+IQ+  IGTQE+IK HL+ EGI VTQATLSRDLREIGLLKLR +GKL
Sbjct:    1 MNKMERQQQIKRIIQAEHIGTQEDIKNHLQKEGIVVTQATLSRDLREIGLLKLRDEQGKL   60

Query:   64 YYSLSTATSNRFSPALRSYILKVSRASFMLVLNTNLGEASVLANFIDEKGLPEILGTMAG  123
            YYSLS   +   FSP +R Y+LKV RA FMLVL+TNLGEA VLAN ID     + +ILGT+AG
Sbjct:   61 YYSLSEPVATPFSPEVRFYVLKVDRAGFMLVLHTNLGEADVLANLIDNDAIEDILGTIAG  120

Query:  124 ADTLLVICQNEDIAKVFEKELSVGL                                    148
            ADTLLVIC++E+IAK FEK+L+ GL
Sbjct:  121 ADTLLVICRDEEIAKRFEKDLAAGL                                    145
```

Based on this analysis, it was predicted that these proteins and their epitopes could be useful antigens for vaccines or diagnostics.

EXAMPLE 1077

A DNA sequence (GBSx1151) was identified in *S. agalactiae* <SEQ ID 3319> which encodes the amino acid sequence <SEQ ID 3320>. This protein is predicted to be DNA mismatch repair protein hexa (mutS). Analysis of this protein sequence reveals the following:

```
Possible site: 43
>>> Seems to have no N-terminal signal sequence

----- Final Results -----
           bacterial cytoplasm --- Certainty = 0.3570(Affirmative) < succ>
            bacterial membrane --- Certainty = 0.0000(Not Clear)   < succ>
             bacterial outside --- Certainty = 0.0000(Not Clear)   < succ>
```

The protein has homology with the following sequences in the GENPEPT database.

```
>GP: AAA88597 GB: M18729 mismatch repair protein [Streptococcus pneumoniae]
Identities = 593/858 (69%), Positives = 698/858 (81%), Gaps = 14/858 (1%)

Query:   1 MAKPTISPGMQQYLDIKENYPDAFLLFRMGDFYELFYDDAVKAAQILEISLTSRNKNAEK     60
           MA   +SPGMQQY+DIK+ YPDAFLLFRMGDFYELFY+DAV AAQILEISLTSRNKNA+
Sbjct:   1 MAIEKLSPGMQQYVDIKKQYPDAFLLFRMGDFYELFYEDAVNAAQILEISLTSRNKNADN     60

Query:  61 PIPMAGVPYHSAQQYIDVLVELGYKVAIAEQMEDPKKAVGVVKREVVQVVTPGTVVESTK    120
           PIPMAGVPYHSAQQYIDVL+E GYKVAIAEQMEDPK+AVGVVKREVVQV+TPGTVV+S+K
Sbjct:  61 PIPMAGVPYHSAQQYIDVLIEQGYKVAIAEQMEDPKQAVGVVKREVVQVITPGTVVDSSK    120

Query: 121 PDSANNFLVAIDSQDQQTFGLAYMDVSTGEFQATLLTDFESVRSEILNLKAREIVVGYQL    180
           PDS NNFLV+ID +  Q FGLAYMD+ TG+F   T L DF   V  EI NLKARE+V+GY L
Sbjct: 121 PDSQNNFLVSIDREGNQ-FGLAYMDLVTGDFYVTGLLDFTLVCGEIRNLKAREVVLGYDL    179

Query: 181 TDEKNHLLTKQMNLLLSYEDERLNDIHLIDEQLTDLEISAAEKLLQYVHRTQKRELSHLQ    240
             ++E+  +L++QMNL+LSYE E    D+HL+D +L   +E +A+ KLLQYVHRTQ REL+HL+
Sbjct: 180 SEEEEQILSRQMNLVLSYEKESFEDLHLLDLRLATVEQTASSKLLQYVHRTQMRELNHLK    239

Query: 241 KVVHYEIKDYLQMSYATKNSLDLLENARTSKKHGSLYWLLDETKTAMGTRMLRTWIDRPL    300
              V+  YEIKD+LQM YATK  SLDL+ENAR+  KK GSL+WLLDETKTAMG R+LR+WI RPL
Sbjct: 240 PVIRYEIKDFLQMDYATKASLDLVENARSGKKQGSLFWLLDETKTAMGMRLLRSWIHRPL    299

Query: 301 VSMNRIKERQDIIQVFLDYFFERNDLTESLKGVYDIERLASRVSFGKANPKDLLQLGQTL    360
              +   RI +RQ+++QVFLD+FFER+DLT+SLKGVYDIERLASRVSFGK NPKDLLQL   TL
Sbjct: 300 IDKERIVQRQEVVQVFLDHFFERSDLTDSLKGVYDIERLASRVSFGKTNPKDLLQLATTL    359

Query: 361 SQIPRIKMILQSFNQPELDIIVNKIDTMPELESLINTAIAPEAQATITEGNIIKSGFDKQ    420
           S +PRI+ IL+    QP L  ++ ++D +PELESLI+ AIAPEA   IT+G II++GFD+
Sbjct: 360 SSVPRIRAILEGMEQPTLAYLIAQLDAIPELESLISAAIAPEAPHVITDGGIIRTGFDET    419

Query: 421 LDNYRTVMREGTGWIADIEAKERAASGIGTLKIDYNKKDGYYFHVTNSNLSLVPEHFFRK    480
           LD YR V+REGT WIA+IEAKER  SGI TLKIDYNKKDGYYFHVTNS L  VP HFFRK
Sbjct: 420 LDKYRCVLREGTSWIAEIEAKERENSGISTLKIDYNKKDGYYFHVTNSQLGNVPAHFFRK    479

Query: 481 ATLKNSERYGTAELAKIEGEMLEAREQSSNLEYDIFMRVRAQVESYIKRLQELAKTIATV    540
           ATLKNSER+GT ELA+IEG+MLEARE+S+NLEY+IFMR+R +V  YI+RLQ LA+ IATV
Sbjct: 480 ATLKNSERFGTEELARIEGDMLEAREKSANLEYEIFMRIREEVGKYIQRLQALAQGIATV    539

Query: 541 DVLQSLAVVAENYHYVRPKFNDQHQIKIKNGRHATVEKVMGVQEYIPNSIYFDSQTDIQL    600
           DVLQSLAVVAE H +RP+F D  QI I+ GRHA VEKVMG Q YIPN+I     T IQL
Sbjct: 540 DVLQSLAVVAETQHLIRPEFGDDSQIDIRKGRHAVVEKVMGAQTYIPNTIQMAEDTSIQL    599

Query: 601 ITGPNMSGKSTYMRQLALTVIMAQMGGFVSADEVDLPVFDAIFTRIGAADDLISGQSTFM    660
           +TGPNMSGKSTYMRQLA+T +MAQ+G +V A+    LP+FDAIFTRIGAADDL+SGQSTFM
Sbjct: 600 VTGPNMSGKSTYMRQLAMTAVMAQLGSYVPAESAHLPIFDAIFTRIGAADDLVSGQSTFM    659

Query: 661 VEMMEANQAVKRASDKSLILFDELGRGTATYDGMALAQSIIEYIHDRVRAKTMFATHYHE    720
           VEMMEAN A+  A+   SLILFDELGRGTATYDGMALAQSIIEYIH+ + + AKT+FATHYHE
Sbjct: 660 VEMMEANNAISHATKNSLILFDELGRGTATYDGMALAQSIIEYIHEHIGAKTLFATHYHE    719

Query: 721 LTDLSEQLTRLVNVHVATLERDGEVTFLHKIESGPADKSYGIHVAKIAGLPIDLLDRATD    780
           LT L    L  LVNVHVATLE+DG+VTFLHKIE GPADKSYGIHVAKIAGLP DLL RA
Sbjct: 720 LTSLESSLQHLVNVHVATLEQDGQVTFLHKIEPGPADKSYGIHVAKIAGLPADLLARADK    779
```

-continued

```
Query: 781 ILSQLEADAVQLIVSPSQEAVTADLNEELDSEKQQGQLSLFEEPSNAGRVIEELEAIDIM  840
            IL+QLE    +     SP    T+ + E           Q+SLF+  +   ++ EL  +D+
Sbjct: 780 ILTQLENQGTE---SPPPMRQTSAVTE---------QISLFDR-AEEHPILAELAKLDVY  826

Query: 841 NLTPMQAMNAIFDLKKLL                                           858
            N+TPMQ MN + +LK+ L
Sbjct: 827 NMTPMQVMNVLVELKQKL                                           844
```

A related DNA sequence was identified in *S. pyogenes* 10 <SEQ ID 3321> which encodes the amino acid sequence <SEQ ID 3322>. Analysis of this protein sequence reveals the following:

```
Possible site: 58
>>> Seems to have no N-terminal signal sequence
    INTEGRAL    Likelihood = -1.38    Transmembrane      532-548 (532-549)

----- Final Results -----
                bacterial membrane --- Certainty = 0.1553(Affirmative) < succ>
                 bacterial outside --- Certainty = 0.0000(Not Clear)   < succ>
               bacterial cytoplasm --- Certainty = 0.0000(Not Clear)   < succ>
```

An alignment of the GAS and GBS proteins is shown below.

```
Identities = 661/858 (77%), Positives = 746/858 (86%), Gaps = 7/858 (0%)

Query:    1 MAKPTISPGMQQYLDIKENYPDAFLLFRMGDFYELFYDDAVKAAQILEISLTSRNKNAEK   60
            MAK   ISPGMQQYLDIK++YPDAFLLFRMGDFYELFY+DAVKAAQ+LEI LTSRNKNAE
Sbjct:    1 MAKTNISPGMQQYLDIKKDYPDAFLLFRMGDFYELFYEDAVKAAQLLEIGLTSRNKNAEN   60

Query:   61 PIPMAGVPYHSAQQYIDVLVELGYKVAIAEQMEDPKKAVGVVKREVVQVVTPGTVVESTK  120
            PIPMAGVP+HSAQQYIDVL+ELGYKVA+AEQMEDPK+AVGVVKREVVQV+TPGTVV+S K
Sbjct:   61 PIPMAGVPHHSAQQYIDVLIELGYKVAVAEQMEDPKQAVGVVKREVVQVITPGTVVDSAK  120

Query:  121 PDSANNFLVAIDSQDQQTFGLAYMDVSTGEFQATLLTDFESVRSEILNLKAREIVVGYQL  180
            PDSANNFLVA+D    D    +GLAYMDVSTGEF    T L DF SVRSEI NLKA+E+++G+ L
Sbjct:  121 PDSANNFLVAVDF-DGCRYGLAYMDVSTGEFCVTDLADFTSVRSEIQNLKAKEVLLGFDL  179

Query:  181 TDEKNHLLTKQMNLLLSYEDERLNDIHLIDEQLTDLEISAAEKLLQYVHRTQKRELSHLQ  240
              ++E+   +L KQMNLLLSYE+     D  LID QLT +E++AA KLLQYVH+TQ RELSHLQ
Sbjct:  180 SEEEQTILVKQMNLLLSYEETVYEDKSLIDGQLTTVELTAAGKLLQYVHKTQMRELSHLQ  239

Query:  241 KVVHYEIKDYLQMSYATKNSLDLLENARTSKKHGSLYWLLDETKTAMGTRMLRTWIDRPL  300
             +VHYEIKDYLQMSYATK+SLDL+ENART+KKHGSLYWLLDETKTAMG R+LR+WIDRPL
Sbjct:  240 ALVHYEIKDYLQMSYATKSSLDLVENARTNKKHGSLYWLLDETKTAMGMRLLRSWIDRPL  299

Query:  301 VSMNRIKERQDIIQVFLDYFFERNDLTESLKGVYDIERLASRVSFGKANPKDLLQLGQTL  360
            VS    I ERQ+IIQVFL+ F ER DL+ SLKGVYDIERL+SRVSFGKANPKDLLQLG TL
Sbjct:  300 VSKEAILERQEIIQVFLNAFIERTDLSNSLKGVYDIERLSSRVSFGKANPKDLLQLGHTL  359

Query:  361 SQIPRIKMILQSFNQPELDIIVNKIDTMPELESLINTAIAPEAQATITEGNIIKSGFDKQ  420
             +Q+P IK IL+SF+ P +D +VN ID++PELE LI TAI P+A ATI+EG+II++GFD++
Sbjct:  360 AQVPYIKAILESFDSPCVDKLVNDIDSLPELEYLIRTAIDPDAPATISEGSIIRNGFDER  419

Query:  421 LDNYRTVMREGTGWIADIEAKERAASGIGTLKIDYNKKDGYYFHVTNSNLSLVPEHFFRK  480
            LD+YR VMREGTGWIADIEAKER ASGI  LKIDYNKKDGYYFHVTNSNLSLVPEHFFRK
Sbjct:  420 LDHYRKVMREGTGWIADIEAKERQASGINNLKIDYNKKDGYYFHVTNSNLSLVPEHFFRK  479

Query:  481 ATLKNSERYGTAELAKIEGEMLEAREQSSNLEYDIFMRVRAQVESYIKRLQELAKTIATV  540
            ATLKNSERYGTAELAKIEG+MLEARE+SS+LEYDIFM +RAQVE+YI RLQ+LAK +ATV
Sbjct:  480 ATLKNSERYGTAELAKIEGQMLEAREESSSLEYDIFMCIRAQVETYINRLQKLAKILATV  539

Query:  541 DVLQSLAVVAENYHYVRPKFNDQHQIKIKNGRHATVEKVMGVQEYIPNSIYFDSQTDIQL  600
            DVLQSLAVVAE  HY+RP+FND H I I+  GRHA VEKVMGVQEYIPNSI FD QT IQL
Sbjct:  540 DVLQSLAVVAETNHYIRPQFNDNHVITIQEGRHAVVEKVMGVQEYIPNSISFDQQTSIQL  599

Query:  601 ITGPNMSGKSTYMRQLALTVIMAQMGGFVSADEVDLPVFDAIFTRIGAADDLISGQSTFM  660
            ITGPNMSGKSTYMRQLALTVIMAQMG FV+AD VDLP+FDAIFTRIGAADDLISGQSTFM
Sbjct:  600 ITGPNMSGKSTYMRQLALTVIMAQMGSFVAADHVDLPLFDAIFTRIGAADDLISGQSTFM  659

Query:  661 VEMMEANQAVKRASDKSLILFDELGRGTATYDGMALAQSIIEYIHDRVRAKTMFATHYHE  720
            VEMMEANQA+KRASD SLILFDELGRGTATYDGMALAQ+IIEYIHDRV AKT+FATHYHE
Sbjct:  660 VEMMEANQAIKRASDNSLILFDELGRGTATYDGMALAQAIIEYIHDRVGAKTIFATHYHE  719
```

```
                                -continued
Query: 721 LTDLSEQLTRLVNVHVATLERDGEVTFLHKIESGPADKSYGIHVAKIAGLPIDLLDRATD 780
           LTDLS  LT LVNVHVATLE+DG+VTFLHKI  GPADKSYGIHVAKIAGLP  LL RA +
Sbjct: 720 LTDLSTNLTSLVNVHVATLEKDGDVTFLHKIAEGPADKSYGIHVAKIAGLPKSLLKRADE 779

Query: 781 ILSQLEADAVQLIVSPSQEAVTADLNEELDSEKQQGQLSLFEEPSNAGRVIEELEAIDIM 840
           +L++LE       S S E ++       E  S  +QGQLSLF +   A  + + LE ID+M
Sbjct: 780 VLTRLETQ------SRSTEIISVPSQVESSSAVRQGQLSLFGDEEKAHEIRQALEVIDVM 833

Query: 841 NLTPMQAMNAIFDLKKLL                                           858
           N+TP+QAM   +++LKKLL
Sbjct: 834 NMTPLQAMTTLYELKKLL                                           851
```

Based on this analysis, it was predicted that these proteins and their epitopes could be useful antigens for vaccines or diagnostics.

EXAMPLE 1078

A DNA sequence (GBSx1152) was identified in *S. agalactiae* <SEQ ID 3323> which encodes the amino acid sequence <SEQ ID 3324>. This protein is predicted to be cold shock protein-related protein. Analysis of this protein sequence reveals the following:

```
Possible site: 28
>>> Seems to have no N-terminal signal sequence

----- Final Results -----
            bacterial cytoplasm --- Certainty = 0.2095(Affirmative) < succ>
            bacterial membrane  --- Certainty = 0.0000(Not Clear)   < succ>
             bacterial outside  --- Certainty = 0.0000(Not Clear)   < succ>
```

The protein has homology with the following sequences in the GENPEPT database.

```
>GP: CAB69404 GB: A91080 unnamed protein product [unidentified]
Identities = 48/63 (76%), Positives = 56/63 (88%)

Query:   1 MTQGTVKWFNSEKGFGFISSETGTDVFAHFSEIKVDGFKTLEEGQKVTFDIQDGQRGPQA  60
           MT+GTVKWFN +KGFGFI+SE G DVFAHFS+I+  GFKTL+EGQKVTFD++ GQRGPQA
Sbjct:   1 MTKGTVKWFNPDKGFGFITSEDGQDVFAHFSQIQTSGFKTLDEGQKVTFDVEAGQRGPQA  60

Query:  61 TNI                                                           63
           NI
Sbjct:  61 VNI                                                           63
```

A related DNA sequence was identified in *S. pyogenes* <SEQ ID 3325> which encodes the amino acid sequence <SEQ ID 3326>. Analysis of this protein sequence reveals the following:

```
Possible site: 30
>>> Seems to have no N-terminal signal sequence

----- Final Results -----
            bacterial cytoplasm --- Certainty = 0.2350(Affirmative) < succ>
            bacterial membrane  --- Certainty = 0.0000(Not Clear)   < succ>
             bacterial outside  --- Certainty = 0.0000(Not Clear)   < succ>
```

An alignment of the GAS and GBS proteins is shown below.

```
Identities = 49/63 (77%), Positives = 56/63 (88%)

Query:   1 MTQGTVKWFNSEKGFGFISSETGTDVFAHFSEIKVDGFKTLEEGQKVTFDIQDGQRGPQA  60
           M QGTVKWFN+EKGFGFIS+E G DVFAHFS I+  GFKTLEEGQKV FD+++GQRGPQA
Sbjct:   3 MAQGTVKWFNAEKGFGFISTENGQDVFAHFSAIQTNGFKTLEEGQKVAFDVEEGQRGPQA  62

Query:  61 TNI                                                           63
           NI
Sbjct:  63 VNI                                                           65
```

Based on this analysis, it was predicted that these proteins and their epitopes could be useful antigens for vaccines or diagnostics.

EXAMPLE 1079

A DNA sequence (GBSx1153) was identified in *S. agalactiae* <SEQ ID 3327> which encodes the amino acid sequence <SEQ ID 3328>. Analysis of this protein sequence reveals the following:

```
Possible site: 13
>>> Seems to have no N-terminal signal sequence

----- Final Results -----
            bacterial cytoplasm --- Certainty = 0.6378(Affirmative) < succ>
            bacterial membrane  --- Certainty = 0.0000(Not Clear)   < succ>
             bacterial outside  --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1080

A DNA sequence (GBSx1154) was identified in *S. agalactiae* <SEQ ID 3329> which encodes the amino acid sequence <SEQ ID 3330>. This protein is predicted to be DNA mismatch repair protein hexb (mutL). Analysis of this protein sequence reveals the following:

```
Possible site: 37
>>> Seems to have no N-terminal signal sequence

----- Final Results -----
            bacterial cytoplasm --- Certainty = 0.2242(Affirmative) < succ>
            bacterial membrane  --- Certainty = 0.0000(Not Clear)   < succ>
             bacterial outside  --- Certainty = 0.0000(Not Clear)   < succ>
```

A related GBS nucleic acid sequence <SEQ ID 10267> which encodes amino acid sequence <SEQ ID 10268> was also identified.

The protein has homology with the following sequences in the GENPEPT database.

```
>GP:AAA88600 GB:M29686 mismatch repair protein [Streptococcus pneumoniae]
Identities = 452/657 (68%), Positives = 543/657 (81%), Gaps = 8/657 (1%)

Query:   20 LSKIIELPDILANQIAAGEVVERPSSVVKELVENAIDAGSSQITIEVEESGLKKIQITDN   79
            +S IIELP++LANQIAAGEV+ERP+SV KELVENAIDAGSSQI IE+EE+GLKK+QITDN
Sbjct:    1 MSHIIELPEMLANQIAAGEVIERPASVCKELVENAIDAGSSQIIIEIEEAGLKKVQITDN   60

Query:   80 GEGMTSEDAVLSLRRHATSKIKSQSDLFRIRTLGFRGEALPSIASISLMTIKTATEQGKQ  139
             G G+   ++   L+LRRHATSKIK+Q+DLFRIRTLGFRGEALPSIAS+S++T+ TA +
Sbjct:   61 GHGIAHDEVELALRRHATSKIKNQADLFRIRTLGFRGEALPSIASVSVLTLLTAVDGASH  120

Query:  140 GTLLVAKGGNIEKQEVVSSPRGTKILVENLFFNTPARLKYMKSLQSELAHIIDIVNRLSL  199
            GT LVA+GG +E+    +SP GTK+ VE+LFFNTPARLKYMKS Q+EL+HIIDIVNRL L
Sbjct:  121 GTKLVARGGEVEEVIPATSPVGTKVCVEDLFFNTPARLKYMKSQQAELSHIIDIVNRLGL  180

Query:  200 AHPEVAFTLINDGKEMTKTSGTGDLRQAIAGIYGLNTAKKMIEISNADLDFEISGYVSLP  259
            AHPE++F+LI+DGKEMT+T+GTG LRQAIAGIYGL +AKKMIEI N+DLDFEISG+VSLP
Sbjct:  181 AHPEISFSLISDGKEMTRTAGTGQLRQAIAGIYGLVSAKKMIEIENSDLDFEISGFVSLP  240

Query:  260 ELTRANRNYITLLINGRYIKNFLLNRSILDGYGSKLMVGRFPIAVIDIQIDPYLADVNVH  319
            ELTRANRNYI+L INGRYIKNFLLNR+ILDG+GSKLMVGRFP+AVI I IDPYLADVNVH
Sbjct:  241 ELTRANRNYISLFINGRYIKNFLLNRAILDGFGSKLMVGRFPLAVIHIHIDPYLADVNVH  300

Query:  320 PTKQEVRISKERELMSLISTAISESLKQYDLIPDALENLAKTSTRSVDKPIQTSFSLKQP  379
            PTKQEVRISKE+ELM+L+S AI+ SLK+  LIPDALENLAK++ R+ +K  QT   LK+
Sbjct:  301 PTKQEVRISKEKELMTLVSEAIANSLKEQTLIPDALENLAKSTVRNREKVEQTILPLKEN  360

Query:  380 GLYYDRAKNDFFIGADTVSEPIANFTNLDKSDGSVDNDVKNSVNQGATQSPNIKYASRDQ  439
            LYY++ +         + +E     L      K ++++  T+    + +A R
Sbjct:  361 TLYYEKTEP----SRPSQTEVADYQVELTDEGQDLTLFAKETLDR-LTKPAKLHFAERKP  415

Query:  440 ADSENFIHSQDYLSSKQSLNKLVEKLDSEESSTFPELEFFGQMHGTYLFAQGNGGLYIID  499
```

-continued

```
              A+ +    H +  L+     S++K  +KL+ EE+S+FPELEFFGQMHGTYLFAQG  GLYIID
Sbjct: 416 ANYDQLDHPELDLA---SIDKAYDKLEREEASSFPELEFFGQMHGTYLFAQGRDGLYIID 472

Query: 500 QHAAQERVKYEYYREKIGEVDNSLQQLLVPFLFEFSSSDFLQLQEKMSLLQDVGIFLEPY 559
           QHAAQERVKYE YRE IG VD S QQLLVP++FEF + D L+L+E+M LL++VG+FL  Y
Sbjct: 473 QHAAQERVKYEEYRESIGNVDQSQQQLLVPYIFEFPADDALRLKERMPLLEEVGVFLAEY 532

Query: 560 GNNTFILREHPIWMKEEEVESGIYEMCDMLLLTNEVSVKKYRAELAIMMSCKRSIKANHT 619
           G N FILREHPIWM EEE+ESGIYEMCDMLLLT EVS+KKYRAELAIMMSCKRSIKANH
Sbjct: 533 GENQFILREHPIWMAEEEIESGIYEMCDMLLLTKEVSIKKYRAELAIMMSCKRSIKANHR 592

Query: 620 LDDYSARHLLDQLAQCKNPYNCPHGRPVLVNFTKADMEKMFKRIQENHTSLRDLGKY     676
           +DD+SAR LL QL+QC NPYNCPHGRPVLV+FTK+DMEKMF+RIQENHTSLR+LGKY
Sbjct: 593 IDDHSARQLLYQLSQCDNPYNCPHGRPVLVHFTKSDMEKMFRRIQENHTSLRELGKY     649
```

A related DNA sequence was identified in *S. pyogenes* <SEQ ID 3331> which encodes the amino acid sequence <SEQ ID 3332>. Analysis of this protein sequence reveals the following:

```
Possible site: 25
>>> Seems to have no N-terminal signal sequence

----- Final Results -----
            bacterial cytoplasm --- Certainty = 0.1854(Affirmative) < succ>
            bacterial membrane  --- Certainty = 0.0000(Not Clear)   < succ>
             bacterial outside  --- Certainty = 0.0000(Not Clear)   < succ>
```

An alignment of the GAS and GBS proteins is shown below.

```
Identities = 502/663 (75%), Positives = 574/663 (85%), Gaps = 9/663 (1%)

Query:  20 LSKIIELPDILANQIAAGEVVERPSSVVKELVENAIDAGSSQITIEVEESGLKKIQITDN   79
           ++ IIELP++LANQIAAGEVVERP+SVVKELVENAIDA SSQIT+E+EESGLK IQ+TDN
Sbjct:  14 MTNIIELPEVLANQIAAGEVVERPASVVKELVENAIDAKSSQITVEIEESGLKMIQVTDN   73

Query:  80 GEGMTSEDAVLSLRRHATSKIKSQSDLFRIRTLGFRGEALPSIASISLMTIKTATEQGKQ  139
           GEGM+ ED   LSLRRHATSKIKSQSDLFRIRTLGFRGEALPS+ASIS +TIKTAT++
Sbjct:  74 GEGMSHEDLPLSLRRHATSKIKSQSDLFRIRTLGFRGEALPSVASISKITIKTATKEVTH  133

Query: 140 GTLLVAKGGNIEKQEVVSSPRGTKILVENLFFNTPARLKYMKSLQSELAHIIDIVNRLSL  199
           G+LL+A GG IE  E +S+P GTKI VENLF+NTPARLKYMKSLQ+ELAHI+D+VNRLSL
Sbjct: 134 GSLLIATGGEIETLEAISTPTGTKIKVENLFYNTPARLKYMKSLQAELAHIVDVVNRLSL  193

Query: 200 AHPEVAFTLINDGKEMTKTSGTGDLRQAIAGIYGLNTAKKMIEISNADLDFEISGYVSLP  259
           AHPEVAFTLI+DG+++T+TSGTGDLRQAIAGIYGLNT KKM+ ISNADLDFE+SGYVSLP
Sbjct: 194 AHPEVAFTLISDGRQLTQTSGTGDLRQAIAGIYGLNTTKKMLAISNADLDFEVSGYVSLP  253

Query: 260 ELTRANRNYITLLINGRYIKNFLLNRSILDGYGSKLMVGRFPIAVIDIQIDPYLADVNVH  319
           ELTRANRNY+T+L+NGRYIKNFLLNR+ILDGYGSKLMVGRFPI VIDIQIDPYLADVNVH
Sbjct: 254 ELTRANRNYMTILVNGRYIKNFLLNRAILDGYGSKLMVGRFPIVVIDIQIDPYLADVNVH  313

Query: 320 PTKQEVRISKERELMSLISTAISESLKQYDLIPDALENLAKTSTRSVDKPIQTSFSLKQP  379
           PTKQEVRISKERELM+LISTAISESLK+ DLIPDALENLAK+STR   KP QT   L+
Sbjct: 314 PTKQEVRISKERELMALISTAISESLKEQDLIPDALENLAKSSTRHFSKPEQTQLPLQSR  373

Query: 380 GLYYDRAKNDFFIGADTVSEPIANFTNLDKSDGSVDNDVKNSV------NQGATQSPNIK  433
           GLYYD KNDFF+    VSE I    D   G+VDN VK       ++          K
Sbjct: 374 GLYYDPQKNDFFVKESAVSEKI---PETDFYSGAVDNSVKVEKVELLPHSEEVIGPSVK   430

Query: 434 YASRDQADSENFIHSQDYLSSKQSLNKLVEKLDSEESSTFPELEFFGQMHGTYLFAQGNG  493
           +ASR Q       H    L ++Q L++++  +L++E   S FPEL++FGQMHGTYLFAQG
Sbjct: 431 HASRPQNTFTETDHPNLDLKNRQKLSQMLTRLENEGQSVFPELDYFGQMHGTYLFAQGKD  490

Query: 494 GLYIIDQHAAQERVKYEYYREKIGEVDNSLQQLLVPFLFEFSSSDFLQLQEKMSLLQDVG  553
           GL+IIDQHAAQERVKYEYYR+KIGEVD+SLQQLLVP+LFEFS SDF+ LQEKM LL +VG
Sbjct: 491 GLFIIDQHAAQERVKYEYYRDKIGEVDSSLQQLLVPYLFEFSGSDFINLQEKMALLNEVG  550

Query: 554 IFLEPYGNNTFILREHPIWMKEEEVESGIYEMCDMLLLTNEVSVKKYRAELAIMMSCKRS  613
           IFLE YG+NTFILREHPIWMKEEE+ SG+YEMCDMLLLTNEVS+K YRAELAIMMSCKRS
Sbjct: 551 IFLEVYGHNTFILREHPIWMKEEEIASGVYEMCDMLLLTNEVSIKTYRAELAIMMSCKRS  610

Query: 614 IKANHTLDDYSARHLLDQLAQCKNPYNCPHGRPVLVNFTKADMEKMFKRIQENHTSLRDLGKY 676
           IKANH+LDDYSAR+LL QLAQC+NPYNCPHGRPVL+NF+KADMEKMF+RIQENHTSLR+LGKY
Sbjct: 611 IKANHSLDDYSARNLLLQLAQCQNPYNCPHGRPVLINFSKADMEKMFRRIQENHTSLRELGKY 673
```

Based on this analysis, it was predicted that these proteins and their epitopes could be useful antigens for vaccines or diagnostics.

EXAMPLE 1081

A DNA sequence (GBSx1155) was identified in *S. agalactiae* <SEQ ID 3333> which encodes the amino acid sequence <SEQ ID 3334>. Analysis of this protein sequence reveals the following:

```
Possible site: 15
>>> Seems to have no N-terminal signal sequence

----- Final Results -----
            bacterial cytoplasm --- Certainty = 0.3372(Affirmative) < succ>
             bacterial membrane --- Certainty = 0.0000(Not Clear)   < succ>
              bacterial outside --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1082

A DNA sequence (GBSx1156) was identified in *S. agalactiae* <SEQ ID 3335> which encodes the amino acid sequence <SEQ ID 3336>. Analysis of this protein sequence reveals the following:

```
Possible site: 43
>>> Seems to have no N-terminal signal sequence
      INTEGRAL    Likelihood = -14.01   Transmembrane   176-192  (170-197)
      INTEGRAL    Likelihood =  -8.07   Transmembrane   390-406  (387-412)
      INTEGRAL    Likelihood =  -6.10   Transmembrane   271-287  (269-291)
      INTEGRAL    Likelihood =  -6.00   Transmembrane    83-99   (82-101)
      INTEGRAL    Likelihood =  -4.78   Transmembrane    51-67   (50-71)
      INTEGRAL    Likelihood =  -2.92   Transmembrane   303-319  (302-320)
      INTEGRAL    Likelihood =  -2.76   Transmembrane   363-379  (362-381)
      INTEGRAL    Likelihood =  -2.39   Transmembrane   152-168  (151-169)
      INTEGRAL    Likelihood =  -2.02   Transmembrane   325-341  (325-342)
      INTEGRAL    Likelihood =  -1.65   Transmembrane   226-242  (226-242)
      INTEGRAL    Likelihood =  -0.90   Transmembrane    24-40   (24-40)
      INTEGRAL    Likelihood =  -0.27   Transmembrane   111-127  (111-127)

----- Final Results -----
             bacterial membrane --- Certainty = 0.6604(Affirmative) < succ>
              bacterial outside --- Certainty = 0.0000(Not Clear)   < succ>
            bacterial cytoplasm --- Certainty = 0.0000(Not Clear)   < succ>
```

A related GBS nucleic acid sequence <SEQ ID 10265> which encodes amino acid sequence <SEQ ID 10266> was also identified.

The protein has homology with the following sequences in the GENPEPT database.

```
>GP:CAA61918 GB:X89779 LmrP integral membrane protein [Lactococcus
lactis]
Identities = 145/401 (36%), Positives = 236/401 (58%), Gaps = 4/401 (0%)

Query:   9 VKEFFALPKQLQLRELLRFISITVGSAIFPFMAMYYVQYFGNLVTGILIIITQLSGFVAT    68
           +KEF+ L K LQLR  + F+      +F   M +YY QY G+ +TGIL+ ++ ++ FVA
Sbjct:   1 MKEFWNLDKNLQLRLGIVFLGAFSYGTVFSSMTIYYNQYLGSAITGILLALSAVATFVAG   60

Query:  69 LYGGHLSDAMGRKKVVIIGSLLATIGWAITIAANVPNHITPHLTFVGILIIEIAHQFYFP   128
           + G +D  GRK V++ G+++  +G A+  IA+N+P H+ P  TF+  L+I    +F
Sbjct:  61 ILAGFFADRNGRKPVMVFGTIIQLLGAALAIASNLPGHVNPWSTFIAFLLISFGYNFVIT   120
```

-continued

```
Query: 129 AYEAMTIDLTNEQNRRFVYTIGYWLVNIAVMLGSGIAGIFYDHHFFELLIVLLIISAICC  188
            A  AM ID +N +NR+ V+ + YW  N++V+LG+ +     F  LL++LL+   +
Sbjct: 121 AGNAMIIDASNAENRKVVFMLDYWAQNLSVILGAALGAWLFRPAFEALLVILLLTVLVSF  180

Query: 189 FVVYFKFDET-KPQEGTFKHDKGVLGTFKNYSQVLVDKAFVVYTLGAIGSSVVWLQVDNY  247
            F+  F    ET KP    T K D+     F+ Y VL DK ++++    I ++ + +Q DN+
Sbjct: 181 FLTTFVMTETFKP---TVKVDEKAENIFQAYKTVLQDKTYMIFMGANIATTFIIMQFDNF  237

Query: 248 FSVNLKQNFEVVSILGHTITGAKMLSLAVFTNTLLIVLLMTTINKFIENWPLKRQLILGS  307
               V+L  +F+ ++   G   I G +ML++ + +    L+VLLMTT+N+  ++W  ++  I GS
Sbjct: 238 LPVHLSNSFKTITFWGFEIYGQRMLTIYLILACVLVVLLMTTLNRLTKDWSHQKGFIWGS  297

Query: 308 LICGFGMLFNISLNTFGAILIAMTFFTFGEMIYVPASQVLRAEMMVEGKIGSYSGFLAIA  367
               L    GM+F+      TF   I  IA    +T GE++Y P+ Q L A++M   KIGSY+G  AI
Sbjct: 298 LFMAIGMIFSFLTTTFTPIFIAGIVYTLGEIVYTPSVQTLGADLMNPEKIGSYNGVAAIK  357

Query: 368 QPVASVLAGAMVSLSYFTGKIGVQITLTIFMLAGLVLILYA                    408
            P+AS+LAG +VS+S     IGV + L + +   ++L+L A
Sbjct: 358 MPIASILAGLLVSISPMIKAIGVSLVLALTEVLAIILVLVA                    398
```

A related DNA sequence was identified in *S. pyogenes* <SEQ ID 3337> which encodes the amino acid sequence <SEQ ID 3338>. Analysis of this protein sequence reveals the following:

```
Possible site: 56
>>> Seems to have no N-terminal signal sequence
        INTEGRAL    Likelihood = -11.41    Transmembrane   166-182  (161-188)
        INTEGRAL    Likelihood =  -7.75    Transmembrane   384-400  (376-403)
        INTEGRAL    Likelihood =  -7.64    Transmembrane   266-282  (261-285)
        INTEGRAL    Likelihood =  -4.25    Transmembrane   295-311  (291-313)
        INTEGRAL    Likelihood =  -2.71    Transmembrane    98-114   (98-115)
        INTEGRAL    Likelihood =  -2.23    Transmembrane   355-371  (355-374)
        INTEGRAL    Likelihood =  -2.02    Transmembrane   218-234  (218-234)
        INTEGRAL    Likelihood =  -1.91    Transmembrane   315-331  (315-331)
        INTEGRAL    Likelihood =  -1.22    Transmembrane    75-91    (75-92)
        INTEGRAL    Likelihood =  -0.75    Transmembrane    45-61    (45-63)
        INTEGRAL    Likelihood =  -0.75    Transmembrane   144-160  (144-161)

----- Final Results -----
            bacterial membrane  --- Certainty = 0.5564(Affirmative) < succ>
            bacterial outside   --- Certainty = 0.0000(Not Clear)   < succ>
            bacterial cytoplasm --- Certainty = 0.0000(Not Clear)   < succ>
```

The protein has homology with the following sequences in the databases:

```
>GP:CAA61918 GB:X89779 LmrP integral membrane protein [Lactococcus
lactis]
Identities = 138/400 (34%), Positives = 223/400 (55%), Gaps = 2/400 (0%)

Query:   1 MQEFLNLPKQIQLRQLVRFVTITLGSSIFPFMAMYYTTYFGTFWTGLLMMITSLMGFVGT   60
           M+EF NL K +QLR + F+      ++F M +YY  Y G+  TG+L+ ++++  FV
Sbjct:   1 MKEFWNLDKNLQLRLGIVFLGAFSYGTVFSSMTIYYNQYLGSAITGILLALSAVATFVAG   60

Query:  61 LYGGHLSDALGRKKVIMIGSVGTTLGWFLTILANLPNAAIPWLTFAGILLVEIASSFYGP  120
           +  G +D  GRK V++ G++    LG  L I +NLP    PW TF  LL+   +F
Sbjct:  61 ILAGFFADRNGRKPVMVFGTIIQLLGAALAIASNLPGHVNPWSTFIAFLLISFGYNFVIT  120

Query: 121 AYEAMLIDLTDESNRRFVYTINYWFINIAVMFGAGLSGLFYDHHFLALLVALLLVNVLCF  180
           A  AM+ID ++ NR+ V+ ++YW  N++V+  GA L     F  ALLV LLL  ++ F
Sbjct: 121 AGNAMIIDASNAENRKVVFMLDYWAQNLSVILGAALGAWLFRPAFEALLVILLLTVLVSF  180

Query: 181 GVAYYCFDETRPETHAFDHGKGLLASFQNYRQVFHDRAFVLFTLGAIFSGSIWMQMDNYV  240
            +  +   ET   T  D      + FQ Y+ V D+ +++F   I + +   I MQ DN++
Sbjct: 181 FLTTFVMTETFKPTVKVDEKAENI--FQAYKTVLQDKTYMIFMGANIATTFIIMQFDNFL  238

Query: 241 PVHLKLYFQPTAVLGFQVTSSKMLSLMVLTNTLLIVLFMTVVNKLTEKWKLLPQLVVGSL  300
           PVHL    F+        GF++   +ML++ ++  +L+VL MT +N+LT  W      + GSL
Sbjct: 239 PVHLSNSFKTITFWGFEIYGQRMLTIYLILACVLVVLLMTTLNRLTKDWSHQKGFIWGSL  298

Query: 301 LFTLGMLLSFTFTQFYAIWLSVVLLTFGEMINVSASQVLRADMMDHSQIGSYTGFVSMAQ  360
                +GM+ SF T F  I+++ ++   T GE++    + Q L AD+M+   +IGSY G  ++
Sbjct: 299 FMAIGMIFSFLTTTFTPIFIAGIVYTLGEIVYTPSVQTLGADLMNPEKIGSYNGVAAIKM  358
```

```
Query:  361 PLGAILASLLVSVSHFTGPLGVQCLFAVIALLGIYFTVVS              400
            P+ +ILA LLVS+S     +GV + A+  +L I   +V+
Sbjct:  359 PIASILAGLLVSISPMIKAIGVSLVLALTEVLAIILVLVA              398
```

An alignment of the GAS and GBS proteins is shown below.

```
Identities = 228/406 (56%), Positives = 305/406 (74%)

Query:    9 VKEFFALPKQLQLRELLRFISITVGSAIFPFMAMYYVQYFGNLVTGILIIITQLSGFVAT   68
            ++EF  LPKQ+QLR+L+RF++IT+GS+IFPFMAMYY   YFG   TG+L++IT L GFV T
Sbjct:    1 MQEFLNLPKQIQLRQLVRFVTITLGSSIFPFMAMYYTTYFGTFWTGLLMMITSLMGFVGT   60

Query:   69 LYGGHLSDAMGRKKVVIIGSLLATIGWAITIAANVPNHITPHLTFVGILIIEIAHQFYFP  128
            LYGGHLSDA+GRKKV++IGS+  T+GW +TI AN+PN   P LTF GIL++EIA  FY P
Sbjct:   61 LYGGHLSDALGRKKVIMIGSVGTTLGWFLTILANLPNAAIPWLTFAGILLVEIASSFYGP  120

Query:  129 AYEAMTIDLTNEQNRRFVYTIGYWLVNIAVMLGSGIAGIFYDHHFFELLIVLLIISAICC  188
            AYEAM IDLT+E NRRFVYTI YW +NIAVM G+G++G+FYDHHF  LL+ LL+++ +C
Sbjct:  121 AYEAMLIDLTDESNRRFVYTINYWFINIAVMFGAGLSGLFYDHHFLALLVALLLVNVLCF  180

Query:  189 FVVYFKFDETKPQEGTFKHDKGVLGTFKNYSQVLVDKAFVVYTLGAIGSSVVWLQVDNYF  248
              V Y+ FDET+P+    F H KG+L +F+NY QV  D+AFV++TLGAI S  +W+Q+DNY
Sbjct:  181 GVAYYCFDETRPETHAFDHGKGLLASFQNYRQVFHDRAFVLFTLGAIFSGSIWMQMDNYV  240

Query:  249 SVNLKQNFEVVSILGHTITGAKMLSLAVFTNTLLIVLLMTTINKFIENWPLKRQLILGSL  308
             V+LK  F+   ++LG  +T +KMLSL V TNTLLIVL MT +NK  E W L  QL++GSL
Sbjct:  241 PVHLKLYFQPTAVLGFQVTSSKMLSLMVLTNTLLIVLFMTVVNKLTEKWKLLPQLVVGSL  300

Query:  309 ICGFGMLFNISLNTFGAILIAMTFFTFGEMIYVPASQVLRAEMMVEGKIGSYSGFLAIAQ  368
             +   GML + +   F AI +++   TFGEMI V ASQVLRA+MM    +IGSY+GF+++AQ
Sbjct:  301 LFTLGMLLSFTFTQFYAIWLSVVLLTFGEMINVSASQVLRADMMDHSQIGSYTGFVSMAQ  360

Query:  369 PVASVLAGAMVSLSYFTGKIGVQITLTIFMLAGLVLILYATKMKNI                414
            P+ ++LA +VS+S+FTG +GVQ    + L G+   + + KMK +
Sbjct:  361 PLGAILASLLVSVSHFTGPLGVQCLFAVIALLGIYFTVVSAKMKKV                406
```

A related GBS gene <SEQ ID 8725> and protein <SEQ ID 8726> were also identified. Analysis of this protein sequence reveals the following:

```
Lipop: Possible site: -1 Crend: 8
SRCFLG: 0
McG: Length of UR: 4
     Peak Value of UR: 1.73
     Net Charge of CR: 1
McG: Discrim Score: -4.26
GvH: Signal Score (-7.5): -2.48
     Possible site: 35
>>> Seems to have no N-terminal signal sequence
Amino Acid Composition: calculated from 1
ALOM program count: 12 value: -14.01 threshold: 0.0
    INTEGRAL    Likelihood = -14.01    Transmembrane    168-184 (162-189)
    INTEGRAL    Likelihood =  -8.07    Transmembrane    382-398 (379-404)
    INTEGRAL    Likelihood =  -6.10    Transmembrane    263-279 (261-283)
    INTEGRAL    Likelihood =  -6.00    Transmembrane     75-91  (74-93)
    INTEGRAL    Likelihood =  -4.78    Transmembrane     43-59  (42-63)
    INTEGRAL    Likelihood =  -2.92    Transmembrane    295-311 (294-312)
    INTEGRAL    Likelihood =  -2.76    Transmembrane    355-371 (354-373)
    INTEGRAL    Likelihood =  -2.39    Transmembrane    144-160 (143-161)
    INTEGRAL    Likelihood =  -2.02    Transmembrane    317-333 (317-334)
    INTEGRAL    Likelihood =  -1.65    Transmembrane    218-234 (218-234)
    INTEGRAL    Likelihood =  -0.90    Transmembrane     16-32  (16-32)
    INTEGRAL    Likelihood =  -0.27    Transmembrane    103-119 (103-119)
    PERIPHERAL  Likelihood =   9.44                     239
modified ALOM score: 3.30
icm1 HYPID: 7 CFP: 0.660
*** Reasoning Step: 3

----- Final Results -----
            bacterial membrane --- Certainty = 0.6604(Affirmative) < succ>
             bacterial outside --- Certainty = 0.0000(Not Clear)  < succ>
           bacterial cytoplasm --- Certainty = 0.0000(Not Clear)  < succ>
```

The protein has homology with the following sequences in the databases:

```
ORF01675(325-1530 of 1854)
EGAD|40187|42348(1-400 of 408) integral membrane protein (lmrP) {Lactococcus
lactis} GP|1052754|emb|CAA61918.1||X89779 LmrP integral membrane protein {Lactococcus
lactis} PIR|S58131|S58131 integral membrane protein LmrP - Lactococcus lactis
% Match = 21.7
% Identity = 36.2   % Similarity = 60.8
Matches = 145   Mismatches = 155   Conservative Sub.s = 99
   243       273       303       333       363       393       423       453
LQKLIWRKCLNESKKIIQASGI*ENIDNYLLGKKGEKVKEFFALPKQLQLRELLRFISITVGSAIFPFMAMYYVQYFGNL
                                        :|||:  |  ||||  :  |:         :|   |  :||  ||:|:
                                        MKEFWNLDKNLQLRLGIVFLGAFSYGTVFSSMTIYYNQYLGSA
                                              10        20        30        40
   483       513       543       573       603       633       663       693
VTGILIIITQLSGFVATLYGGHLSDAMGRKKVVIIGSLLATIGWAITIAANVPNHITPHLTFVGILIIEIAHQFYFPAYE
:||||: :: :: ||| : |  :|    |||  ||  |:  :|  | ||:||  :|  :|      | |
ITGILLALSAVATFVAGILAGFFADRNGRKPVMVFGTIIQLLGAALAIASNLPGHVNPWSTFIAFLLISFGYNFVITAGN
           60        70        80        90       100       110       120
   723       753       783       813       843       873       900       930
AMTIDLTNEQNRRFVYTIGYWLVNIAVMLGSGIAGIFYDHHFFELLIVLLIISAICCFVVYFKFDET-KPQEGTFKHDKG
||  || :| :|| :  |: || |::|:||: ::    ::   | ||::|||:  :  :  ||||| |||| :   ||| |
AMIIDASNAENRKVVFMLDYWAQNLSVILGAALGAWLFRPAFEALLVILLLTVLVSFFLTTFVMTETFKP---TVKVDEK
          140       150       160       170       180       190       200
   960       990      1020      1050      1080      1110      1140      1170
VLGTFKNYSQVLVDKAFVVYTLGAIGSSVVWLQVDNYFSVNLKQNFEVVSILGHTITGAKMLSLAVFTNTLLIVLLMTTI
    |:  |   ||  ||   ::::         |  ::  :| ||::  |:|     :|:  ::     |    |  |:||::   ::|:|||||:
AENIFQAYKTVLQDKTYMIFMGANIATTFIIMQFDNFLPVHLSNSFKTITFWGFEIYGQRMLTIYLILACVLVVLLMTTL
        210       220       230       240       250       260       270       280
  1200      1230      1260      1290      1320      1350      1380      1410
NKFIENWPLKRQLILGSLICGFGMLFNISLNTFGAILIAMTFFTFGEMIYVPASQVLRAEMMVEGKIGSYSGPFLAIAQPV
|::: ::|    :: :| |||       ||:|:       ||  |:||       :|:||::| |:   |   |::      ||||||:|   || |:
NRLTKDWSHQKGFIWGSLFMAIGMIFSFLTTTFTPIFIAGIVYTLGEIVYTPSVQTLGADLMNPEKIGSYNGVAAIKMPI
          290       300       310       320       330       340       350       360
  1440      1470      1500      1530      1560      1590      1620      1650
ASVLAGAMVSLSYFTGKIGVQITLTIFMLAGLVLILYATKMKNIEIGK*NVRLY*RKIE*NNG*IYCCGNSWIGIHDICG
||:|||  :||:|       |||  |  |:     :    ::|:| |
ASILAGLLVSISPMIKAIGVSLVLALTEVLAIILVLVAVNRHQKTKLN
          370       380       390       400
```

Based on this analysis, it was predicted that these proteins and their epitopes could be useful antigens for vaccines or diagnostics.

EXAMPLE 1083

A DNA sequence (GBSx1157) was identified in *S. agalactiae* <SEQ ID 3339> which encodes the amino acid sequence <SEQ ID 3340>. This protein is predicted to be holliday junction DNA helicase (ruvA). Analysis of this protein sequence reveals the following:

```
Possible site: 37
>>> Seems to have no N-terminal signal sequence
     INTEGRAL     Likelihood = -1.75     Transmembrane     75-91 (74-91)

----- Final Results -----
            bacterial membrane --- Certainty = 0.1702(Affirmative) < succ>
             bacterial outside --- Certainty = 0.0000(Not Clear)   < succ>
            bacterial cytoplasm --- Certainty = 0.0000(Not Clear)   < succ>
```

The protein has homology with the following sequences in the GENPEPT database.

```
>GP:BAB04943 GB:AP001511 holliday junction DNA helicase [Bacillus
halodurans]
Identities = 86/201 (42%), Positives = 122/201 (59%), Gaps = 6/201 (2%)

Query:   1 MYDYIKGKLSKITAKFIVVETAGLGYMIYVANPYSFSGYVNQEVTIYLHQVIRDDAHLLF    60
           M DY++G L+ I   ++ VVE  G+GY +Y  NPY F    +  +TIY  Q +R+D    L+
Sbjct:   1 MIDYLRGTLTDIDHQYAVVEVHGVGYQVYCPNPYEFEKERDSVITIYTFQYVREDVIRLY    60

Query:  61 GFHTENEKEIFLNLISVSGIGPTTALAIIAVDDNEGLVSAIDNSDIKYLTKFPKIGKKTA   120
```

-continued

```
                GF T+ ++ +F  L++VSGIGP  ALAI+A      E ++ AI+  D  +L KFP +GKKTA
Sbjct:   61 GFRTKEKRSLFEKLLNVSGIGPKGALAILATGQPEHVIQAIEEEDEAFLVKFPGVGKKTA   120

Query:  121 QQMILDLSGKFVE------ASGESATSRKVSSEQNSLEEAMEALLALGYKATELKKVKA   174
                +Q+ILDL GK E      + E         ++ N  L+EAMEAL ALGY    ELKKVK
Sbjct:  121 RQIILDLKGKVDELHPGLFSQKEEQPKPHEKNDGNQALDEAMEALKALGYVEKELKKVKP   180

Query:  175 FFEGTNETVEQYIKSSLKMLM                                         195
                E    T + YIK +L++++
Sbjct:  181 KLEQETLTTDAYIKKALQLML                                         201
```

A related DNA sequence was identified in *S. pyogenes* <SEQ ID 3341> which encodes the amino acid sequence <SEQ ID 3342>. Analysis of this protein sequence reveals the following:

```
Possible site: 37
>>> Seems to have no N-terminal signal sequence
    INTEGRAL     Likelihood = -1.59      Transmembrane    75-91 (74-91)

----- Final Results -----
              bacterial membrane --- Certainty = 0.1638(Affirmative) < succ>
               bacterial outside --- Certainty = 0.0000(Not Clear)   < succ>
             bacterial cytoplasm --- Certainty = 0.0000(Not Clear)   < succ>
```

The protein has homology with the following sequences in the databases:

```
>GP:BAB04943 GB:AP001511 holliday junction DNA helicase
[Bacillus halodurans]
Identities = 91/201 (45%), Positives = 128/201 (63%), Gaps = 5/201 (2%)

Query:    1 MYDYIKGQLTKITAKYIVVEANGLGYMINVANPYSFTDSVNQLVTIYLHQVIREDAHLLF    60
              M DY++G LT  I  +Y VVE +G+GY +    NPY F    + ++TIY  Q +RED   L+
Sbjct:    1 MIDYLRGTLTDIDHQYAVVEVHGVGYQVYCPNPYEFEKERDSVITIYTFQYVREDVIRLY    60

Query:   61 GFHTEDEKDVFLKLISVSGIGPTTALAIVAVDDNEGLVNAIDNSDIKYLMKFPKIGKKTA   120
                GF T++++ +F  KL++VSGIGP  ALAI+A      E ++ AI+  D  +L+KFP +GKKTA
Sbjct:   61 GFRTKEKRSLFEKLLNVSGIGPKGALAILATGQPEHVIQAIEEEDEAFLVKFPGVGKKTA   120

Query:  121 QQMVLDLAGKFVEA------PQETGHTKARSNKAGNTQLDEAIEALLALGYKAKELKKIRA   175
                +Q++LDL GK E        Q+     K       GN  LDEA+EAL ALGY   KELKK++
Sbjct:  121 RQIILDLKGKVDELHPGLFSQKEEQPKPHEKNDGNQALDEAMEALKALGYVEKELKKVKP   180

Query:  176 FFEGTSETAEQYIKSALKLLM                                         196
                E  + T + YIK AL+L++
Sbjct:  181 KLEQETLTTDAYIKKALQLML                                         201
```

An alignment of the GAS and GBS proteins is shown below.

```
Identities = 153/197 (77%), Positives = 176/197 (88%), Gaps = 1/197 (0%)

Query:    1 MYDYIKGKLSKITAKFIVVETAGLGYMIYVANPYSFSGYVNQEVTIYLHQVIRDDAHLLF    60
              MYDYIKG+L+KITAK+IVVE  GLGYMI VANPYSF+  VNQ VTIYLHQVIR+DAHLLF
Sbjct:    1 MYDYIKGQLTKITAKYIVVEANGLGYMINVANPYSFTDSVNQLVTIYLHQVIREDAHLLF    60

Query:   61 GFHTENEKEIFLNLISVSGIGPTTALAIIAVDDNEGLVSAIDNSDIKYLTKFPKIGKKTA   120
              GFHTE+EK++FL LISVSGIGPTTALAI+AVDDNEGLV+AIDNSDIKYL KFPKIGKKTA
Sbjct:   61 GFHTEDEKDVFLKLISVSGIGPTTALAIVAVDDNEGLVNAIDNSDIKYLMKFPKIGKKTA   120

Query:  121 QQMILDLSGKFVEASGESA-TSRKVSSEQNSLEEAMEALLALGYKATELKKVKAFFEGT   179
              QQM+LDL+GKFVEA  E+ T  +   N+ L+EA+EALLALGYKA ELKK++AFFEGT
Sbjct:  121 QQMVLDLAGKFVEAPQETGHTKARSNKAGNTQLDEAIEALLALGYKAKELKKIRAFFEGT   180

Query:  180 NETVEQYIKSSLKMLMK                                             196
              +ET EQYIKS+LK LMK
Sbjct:  181 SETAEQYIKSALKLLMK                                             197
```

Based on this analysis, it was predicted that these proteins and their epitopes could be useful antigens for vaccines or diagnostics.

EXAMPLE 1084

A DNA sequence (GBSx1159) was identified in *S. agalactiae* <SEQ ID 3343> which encodes the amino acid sequence <SEQ ID 3344>. This protein is predicted to be DNA-3-methyladenine glycosidase I (tag). Analysis of this protein sequence reveals the following:

```
Possible site: 50
>>> Seems to have no N-terminal signal sequence

----- Final Results -----
            bacterial cytoplasm --- Certainty = 0.2812(Affirmative) < succ>
             bacterial membrane --- Certainty = 0.0000(Not Clear) < succ>
              bacterial outside --- Certainty = 0.0000(Not Clear) < succ>
```

A related GBS nucleic acid sequence <SEQ ID 10263> which encodes amino acid sequence <SEQ ID 10264> was also identified.

The protein has homology with the following sequences in the GENPEPT database.

```
>GP:AAC76573 GB:AE000432 3-methyl-adenine DNA glycosylase I,
constitutive [Escherichia coli K12]
Identities = 87/176 (49%), Positives = 122/176 (68%), Gaps = 1/176 (0%)

Query:   5 MKRCSWVNLDNPLYVAYHDKEWGRAVHDDHVLFELLCLETYQSGLSWETVLNKRQEFRQV   64
           M+RC WV+ D PLY+AYHD EWG    D    LFE++CLE Q+GLSW TVL KR+ +R
Sbjct:   1 MERCGWVSQD-PLYIAYHDNEWGVPETDSKKLFEMICLEGQQAGLSWITVLKKRENYRAC  59

Query:  65 FHHYNIEKVAAMSDADLEIILQNPRVIRHRLKLFSTRQNARSIILIQKEFGSFDRYIWSF  124
           FH ++  KVAAM + D+E ++Q+  +IRHR K+ +    NAR+ + +++    F ++WSF
Sbjct:  60 FHQFDPVKVAAMQEEDVERLVQDAGIIRHRGKIQAIIGNARAYLQMEQNGEPFVDFVWSF  119

Query: 125 VDNKVQVNSVNNYNDVPASTTLSERLSKDLKKRGFKFVGPTCLYSFIQAAGMVNDH     180
           V+++ QV     +++P ST+ S+ LSK LKKRGFKFVG T  YSF+QA G+VNDH
Sbjct: 120 VNHQPQVTQATTLSEIPTSTSASDALSKALKKRGFKFVGTTICYSFMQACGLVNDH     175
```

A related DNA sequence was identified in *S. pyogenes* <SEQ ID 3345> which encodes the amino acid sequence <SEQ ID 3346>. Analysis of this protein sequence reveals the following:

```
Possible site: 48
>>> Seems to have no N-terminal signal sequence

----- Final Results -----
            bacterial cytoplasm --- Certainty = 0.4149(Affirmative) < succ>
             bacterial membrane --- Certainty = 0.0000(Not Clear) < succ>
              bacterial outside --- Certainty = 0.0000(Not Clear) < succ>
```

An alignment of the GAS and GBS proteins is shown below.

```
Identities = 114/184 (61%), Positives = 135/184 (72%)

Query:   3 FHMKRCSWVNLDNPLYVAYHDKEWGRAVHDDHVLFELLCLETYQSGLSWETVLNKRQEFR   62
           FHMKRCSWV  DN LY  YHD EWG+ + DD   FELLCLE+YQSGLSW TVL KRQ FR
Sbjct:   2 FHMKRCSWVPKDNQLYCDYHDLEWGQPLDDDRDFFELLCLESYQSGLSWLTVLKKRQAFR   61

Query:  63 QVFHHYNIEKVAAMSDADLEIILQNPRVIRHRLKLFSTRQNARSIILIQKEFGSFDRYIW  122
              VFHHY+I  VA +  ++   L+NP +IRH+LKL +T  NA ++  IQKEFGSF  Y+W
Sbjct:  62 TVFHHYDIASVATFTSEEMADALENPSIIRHKLKLAATVNNAIAVQKIQKEFGSFSTYLW  121

Query: 123 SFVDNKVQVNSVNNYNDVPASTTLSERLSKDLKKRGFKFVGPTCLYSFIQAAGMVNDHEN  182
           +FV  K   N VN  N VPA T LS RL+KDLKKRGFKF+GPT  +YSF+QA+G+VNDHE
Sbjct: 122 NFVGGKPINNLVNQENLVPAQTELSIRLAKDLKKRGFKFLGPTTVYSFMQASGLVNDHEE  181
```

-continued

```
Query: 183 ICDF                                                      186
           C F
Sbjct: 182 ACVF                                                      185
```

Based on this analysis, it was predicted that these proteins and their epitopes could be useful antigens for vaccines or diagnostics.

EXAMPLE 1085

A DNA sequence (GBSx1160) was identified in *S. agalactiae* <SEQ ID 3347> which encodes the amino acid sequence <SEQ ID 3348>. This protein is predicted to be competence-damage inducible protein (cinA). Analysis of this protein sequence reveals the following:

```
Possible site: 22
>>> Seems to have an uncleavable N-term signal seq

----- Final Results -----
              bacterial membrane --- Certainty = 0.0000(Not Clear) < succ>
              bacterial outside  --- Certainty = 0.0000(Not Clear) < succ>
              bacterial cytoplasm --- Certainty = 0.0000(Not Clear) < succ>
```

A related GBS nucleic acid sequence <SEQ ID 10261> which encodes amino acid sequence <SEQ ID 10262> was also identified.

The protein has homology with the following sequences in the GENPEPT database.

```
>GP:CAA84071 GB:Z34303 CinA protein [Streptococcus pneumoniae]
Identities = 194/297 (65%), Positives = 236/297 (79%), Gaps = 1/297 (0%)

Query:   1 MVEGSIPLQNLTGLAVGGIVTSKGVQYMVLPGPPSELKPMVMEQVVPILSNNGTKLYSRV   60
           +VEG+IPL N TGLAVGG +  GV Y+VLPGPPSELKPMV+ Q++P L    G+KLYSRV
Sbjct: 121 IVEGAIPLPNETGLAVGGKLEVDGVTYVVLPGPPSELKPMVLNQLLPKLMT-GSKLYSRV  179

Query:  61 LRFFGIGESQLVTILEDIIKNQTDPTIAPYAKVGEVTLRLSTKAENQDEADFKLDSLEKE  120
           LRFFGIGESQLVTIL D+I NQ DPT+APYAK GEVTLRLSTKA +Q+EA+  LD LE +
Sbjct: 180 LRFFGIGESQLVTILADLIDNQIDPTLAPYAKTGEVTLRLSTKASSQEEANQALDILENQ  239

Query: 121 ILALKTLDNRKLKDLLYGYGDNNSMARTVLELLKVQNKTITAAESLTAGLFQSQLAEFSG  180
           IL  +T +   L+D  YGYG+  S+A  V+E LK Q KTI AAESLTAGLFQ+ +A FSG
Sbjct: 240 ILDCQTFEGISLRDFCYGYGEETSLASIVVEELKRQGKTIAAAESLTAGLFQATVANFSG  299

Query: 181 ASQVFNGGFTTYSMEAKSQLLGIPKKKLQEYGVVSHFTAEAMAQQARQLLKADFGIGLTG  240
           +S +F GGF TYS+E KS++L IP K L+E+GVVS FTA+ MA+QAR   ++DFGI LTG
Sbjct: 300 VSSIFEGGFVTYSLEEKSRMLDIPAKNLEEHGVVSEFTAQKMAEQARSKTQSDFGISLTG  359

Query: 241 VAGPDELEGYPAGTVFIGIATPEGVSSIKVSIGGKSRSDVRHISTLHAFDLVRRALL     297
           VAGPD LEG+P GTVFIG+A  +G   IKV+IGG+SR+DVRHI+ +HAF+LVR ALL
Sbjct: 360 VAGPDSLEGHPVGTVFIGLAQDQGTEVIKVNIGGRSRADVRHIAVMHAFNLVRKALL     416
```

A related DNA sequence was identified in *S. pyogenes* <SEQ ID 3349> which encodes the amino acid sequence <SEQ ID 3350>. Analysis of this protein sequence reveals the following:

```
Possible site: 22
>>> Seems to have no N-terminal signal sequence
    INTEGRAL    Likelihood = -1.91    Transmembrane    134-150 (134-150)

----- Final Results -----
              bacterial membrane --- Certainty = 0.1765(Affirmative) < succ>
              bacterial outside  --- Certainty = 0.0000(Not Clear)   < succ>
              bacterial cytoplasm --- Certainty = 0.0000(Not Clear)   < succ>
```

The protein has homology with the following sequences in the databases:

```
>GP:CAA84071 GB:Z34303 CinA protein [Streptococcus pneumoniae]
Identities = 286/417 (68%), Positives = 336/417 (79%), Gaps = 1/417 (0%)

Query:   1 MKAELIAVGTEILTGQIVNTNAQFLSEKMAELGIDVYFQTAVGDNEERLLSVITTASQRS    60
           MKAE+IAVGTEILTGQIVNTNAQFLSEK+AE+G+DVYFQTAVGDNE RLLS++  ASQRS
Sbjct:   1 MKAEIIAVGTEILTGQIVNTNAQFLSEKLAEIGVDVYFQTAVGDNEVRLLSLLEIASQRS    60

Query:  61 NLVILCGGLGPTKDDLTKQTLAKYLRKDLVYDEQACQKLDDFFAKRKPSSRTPNNERQAQ   120
           +LVIL GGLG T+DDLTKQTLAK+L K LV+D QA +KLD FFA R    +RTPNNERQAQ
Sbjct:  61 SLVILTGGLGATEDDLTKQTLAKFLGKALVFDPQAQEKLDIFFALRPDYARTPNNERQAQ   120

Query: 121 VIEGSIPLPNKTGLAVGGFITVDGISYVVLPGPPSELKPMVNEELVPLLSKQYSTLYSKV   180
           ++EG+IPLPN+TGLAVGG + VDG++YVVLPGPPSELKPMV  +L+P L    S LYS+V
Sbjct: 121 IVEGAIPLPNETGLAVGGKLEVDGVTYVVLPGPPSELKPMVLNQLLPKLMTG-SKLYSRV   179

Query: 181 LRFFGIGESQLVTVLSDFIENQTDPTIAPYAKTGEVTLRLSTKTENQALADKKLGQLEAQ   240
           LRFFGIGESQLVT+L+D I+NQ DPT+APYAKTGEVTLRLSTK  +Q  A++ L  LE Q
Sbjct: 180 LRFFGIGESQLVTILADLIDNQIDPTLAPYAKTGEVTLRLSTKASSQEEANQALDILENQ   239

Query: 241 LLSRKTLEGQPLADVFYGYGEDNSLARETFELLVKYDKTITAAESLTAGLEQSTLASFPG   300
           +L  +T EG  L D  YGYGE+ SLA    E L +  KTI AAESLTAGLFQ+T+A+F G
Sbjct: 240 ILDCQTFEGISLRDFCYGYGEETSLASIVVEELKRQGKTIAAAESLTAGLFQATVANFSG   299

Query: 301 ASQVFNGGFVTYSMEEKAKMLGLPLEELKSHGVVSAYTAEGMAEQARLLTGADIGVSLTG   360
            S +F GGFVTYS+EEK++ML +P + L+ HGVVS +TA+ MAEQAR  T +D G+SLTG
Sbjct: 300 VSSIFEGGFVTYSLEEKSRMLDIPAKNLEEHGVVSEFTAQKMAEQARSKTQSDFGISLTG   359

Query: 361 VAGPDMLEEQPAGTVFIGLATQNKVESIKVLISGRSRLDVRYIATLHAFNMVRKTLL      417
           VAGPD LE  P GTVFIGLA    E IKV I GRSR DVR+IA +HAFN+VRK LL
Sbjct: 360 VAGPDSLEGHPVGTVFIGLAQDQGTEVIKVNIGGRSRADVRHIAVMHAFNLVRKALL      416
```

An alignment of the GAS and GBS proteins is shown below.

```
Identities = 201/299 (67%), Positives = 242/299 (80%)

Query:   1 MVEGSIPLQNLTGLAVGGIVTSKGVQYMVLPGPPSELKPMVMEQVVPILSNNGTKLYSRV    60
           ++EGSIPL N TGLAVGG +T  G+ Y+VLPGPPSELKPMV E++VP+LS   + LYS+V
Sbjct: 121 VIEGSIPLPNKTGLAVGGFITVDGISYVVLPGPPSELKPMVNEELVPLLSKQYSTLYSKV   180

Query:  61 LRFFGIGESQLVTILEDIIKNQTDPTIAPYAKVGEVTLRLSTKAENQDEADFKLDSLEKE   120
           LRFFGIGESQLVT+L D I+NQTDPTIAPYAK GEVTLRLSTK ENQ  AD KL  LE +
Sbjct: 181 LRFFGIGESQLVTVLSDFIENQTDPTIAPYAKTGEVTLRLSTKTENQALADKKLGQLEAQ   240

Query: 121 ILALKTLDNRKLKDLLYGYGDNNSMARTVLELLKVQNKTITAAESLTAGLFQSQLAEFSG   180
           +L+ KTL+ +  L D+ YGYG++NS+AR    ELL  +KTITAAESLTAGLFQS LA F G
Sbjct: 241 LLSRKTLEGQPLADVFYGYGEDNSLARETFELLVKYDKTITAAESLTAGLFQSTLASFPG   300

Query: 181 ASQVFNGGFTTYSMEAKSQLLGIPKKKLQEYGVVSHFTAEAMAQQARQLLKADFGIGLTG   240
           ASQVFNGGF TYSME K+++LG+P ++L+ +GVVS +TAE MA+QAR L  AD G+ LTG
Sbjct: 301 ASQVFNGGFVTYSMEEKAKMLGLPLEELKSHGVVSAYTAEGMAEQARLLTGADIGVSLTG   360

Query: 241 VAGPDELEGYPAGTVFIGIATPEGVSSIKVSIGGKSRSDVRHISTLHAFDLVRRALLKI    299
           VAGPD LE  PAGTVFIG+AT   V SIKV I G+SR DVR+I+TLHAF++VR+ LLK+
Sbjct: 361 VAGPDMLEEQPAGTVFIGLATQNKVESIKVLISGRSRLDVRYIATLHAFNMVRKTLLKL   419
```

Figure 131:
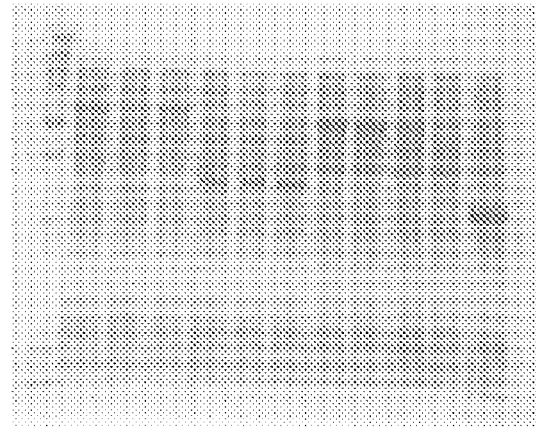

SEQ ID 3348 (GBS646) was expressed in *E. coli* as a GST-fusion product. SDS-PAGE analysis of total cell extract is shown in FIG. 131 (lane 24; MW 61.6 kDa), in FIG. 134 (lane 3; MW 57.5 kDa+lanes 2 & 4; MW 27 kDa). It was also expressed in *E. coli* as a His-fusion product. SDS-PAGE analysis of total cell extract is shown in FIG. 131 (lane 5-7; MW 36.6 kDa) and in FIG. 178 (lane 5; MW 37 kDa).

GBS646-His was purified as shown in FIG. 229, lane 5.

Based on this analysis, it was predicted that these proteins and their epitopes could be useful antigens for vaccines or diagnostics.

EXAMPLE 1086

A DNA sequence (GBSx1161) was identified in *S. agalactiae* <SEQ ID 3351> which encodes the amino acid sequence <SEQ ID 3352>. Analysis of this protein sequence reveals the following:

```
Possible site: 59
>>> Seems to have no N-terminal signal sequence
   INTEGRAL   Likelihood = -0.37   Transmembrane   148-164 (148-164)
```

-continued

```
----- Final Results -----
            bacterial membrane --- Certainty = 0.1150(Affirmative) < succ>
            bacterial outside  --- Certainty = 0.0000(Not Clear)   < succ>
            bacterial cytoplasm --- Certainty = 0.0000(Not Clear)   < succ>
```

A related DNA sequence was identified in *S. pyogenes* <SEQ ID 3353> which encodes the amino acid sequence <SEQ ID 3354>. Analysis of this protein sequence reveals the following:

```
Possible site: 59
>>> Seems to have no N-terminal signal sequence
    INTEGRAL    Likelihood = -0.37    Transmembrane    148-164 (148-164)

----- Final Results -----
            bacterial membrane --- Certainty = 0.1150(Affirmative) < succ>
            bacterial outside  --- Certainty = 0.0000(Not Clear)   < succ>
            bacterial cytoplasm --- Certainty = 0.0000(Not Clear)   < succ>
```

The protein has homology with the following sequences in the databases:

```
>GP:AAD04860 GB:AF069745 RecA protein [Streptococcus parasanguinis]
Identities = 333/381 (87%), Positives = 356/381 (93%), Gaps = 3/381 (0%)

Query:   1 LAKKLKKNEEITKKFGDERRKALDDALKNIEKDFGKGAVMRLGERAEQKVQVMSSGSLAL   60
           +AKK KK ++ITKKFGDER KAL+DALK IEKDFGKG++MRLGERAEQKVQVMSSGSLAL
Sbjct:   1 MAKKQKKLDDITKKFGDEREKALNDALKLIEKDFGKGSIMRLGERAEQKVQVMSSGSLAL   60

Query:  61 DIALGAGGYPKGRIIEIYGPESSGKTTVALHAVAQAQKEGGIAAFIDAEHALDPAYAAAL  120
           DIALGAGGYPKGRIIEIYGPESSGKTTVALHAVAQAQKEGGIAAFIDAEHALDP+YAAAL
Sbjct:  61 DIALGAGGYPKGRIIEIYGPESSGKTTVALHAVAQAQKEGGIAAFIDAEHALDPSYAAAL  120

Query: 121 GVNIDELLLSQPDSGEQGLEIAGKLIDSGAVDLVVVDSVAALVPRAEIDGDIGDSHVGLQ  180
           GVNIDELLLSQPDSGEQGLEIAGKLIDSGAVDLVVVDSVAALVPRAEIDGDIGDSHVGLQ
Sbjct: 121 GVNIDELLLSQPDSGEQGLEIAGKLIDSGAVDLVVVDSVAALVPRAEIDGDIGDSHVGLQ  180

Query: 181 ARMMSQAMRKLSASINKTKTIAIFINQLREKVGVMFGNPETTPGGRALKFYASVRLDVRG  240
           ARMMSQAMRKL ASINKTKTIAIFINQLREKVGVMFGNPETTPGGRALKFYASVRLDVRG
Sbjct: 181 ARMMSQAMRKLGASINKTKTIAIFINQLREKVGVMFGNPETTPGGRALKFYASVRLDVRG  240

Query: 241 TTQIKGTGDQKDSSIGKETKIKVVKNKVAPPFKVAEVEIMYGEGISRTGELVKIASDLDI  300
            TQIKGTGDQKD+++GKETKIKVVKNKVAPPFK A VEIMYGEGISRTGELVKIA+DLDI
Sbjct: 241 NTQIKGTGDQKDTNVGKETKIKVVKNKVAPPFKEAMVEIMYGEGISRTGELVKIATDLDI  300

Query: 301 IQKAGAWFSYNGEKIGQGSENAKRYLADHPELFDEIDLKVRVKFGLLEESEEESAMAVAS  360
           IQKAGAW+SYNGEKIGQGSENAK++LADHPE+FDEID KVRV FGL+E+ E     ++
Sbjct: 301 IQKAGAWYSYNGEKIGQGSENAKKFLADHPEIFDEIDHKVRVHFGLIEKDEAVKSLDKTE  360

Query: 361 EE---TDDLALDLDNGIEIED                                         378
           E     +++ LDLD+ IEIED
Sbjct: 361 EAAPVVEEVTLDLDDAIEIED                                         381
```

An alignment of the GAS and GBS proteins is shown below.

```
Identities = 339/379 (89%), Positives = 356/379 (93%), Gaps = 1/379 (0%)

Query:   1 MAKKTKKAEEITKKFGDERRKALDDALKNIEKDFGKGAVMRLGERAEQKVQVMSSGSLAL   60
           +AKK KK EEITKKFGDERRKALDDALKNIEKDFGKGAVMRLGERAEQKVQVMSSGSLAL
Sbjct:   1 LAKKLKKNEEITKKFGDERRKALDDALKNIEKDFGKGAVMRLGERAEQKVQVMSSGSLAL   60

Query:  61 DIALGAGGYPKGRIVEIYGPESSGKTTVALHAVAQAQKEGGIAAFIDAEHALDPAYAAAL  120
           DIALGAGGYPKGRI+EIYGPESSGKTTVALHAVAQAQKEGGIAAFIDAEHALDPAYAAAL
Sbjct:  61 DIALGAGGYPKGRIIEIYGPESSGKTTVALHAVAQAQKEGGIAAFIDAEHALDPAYAAAL  120

Query: 121 GVNIDELLLSQPDSGEQGLEIAGKLIDSGAVDLVVVDSVAALVPRAEIDGDIGDSHVGLQ  180
           GVNIDELLLSQPDSGEQGLEIAGKLIDSGAVDLVVVDSVAALVPRAEIDGDIGDSHVGLQ
Sbjct: 121 GVNIDELLLSQPDSGEQGLEIAGKLIDSGAVDLVVVDSVAALVPRAEIDGDIGDSHVGLQ  180

Query: 181 ARMMSQAMRKLSASINKTKTIAIFINQLREKVGVMFGNPETTPGGRALKFYSSVRLDVRG  240
           ARMMSQAMRKLSASINKTKTIAIFINQLREKVGVMFGNPETTPGGRALKFY+SVRLDVRG
```

```
-continued
Sbjct: 181 ARMMSQAMRKLSASINKTKTIAIFINQLREKVGVMFGNPETTPGGRALKFYASVRLDVRG 240

Query: 241 NTQIKGTGEHKDHNVGKETKIKVVKNKVAPPFREAFVEIMYGEGISRTGELIKIASDLDI 300
            TQIKGTG+ KD ++GKETKIKVVKNKVAPPF+ A VEIMYGEGISRTGEL+KIASDLDI
Sbjct: 241 TTQIKGTGDQKDSSIGKETKIKVVKNKVAPPFKVAEVEIMYGEGISRTGELVKIASDLDI 300

Query: 301 IQKAGAWYSYNGEKIGQGSENAKKYLADNPAIFDEIDHKVRVHFGMTEDDSPVQSELVEE 360
            IQKAGAW+SYNGEKIGQGSENAK+YLAD+P +FDEID KVRV FG+ E +S   +S +
Sbjct: 301 IQKAGAWFSYNGEKIGQGSENAKRYLADHPELFDEIDLKVRVKFGLLE-ESEEESAMAVA 359

Query: 361 KNEADDLVLDLDNAIEIEE                                         379
              E DDL LDLDN IEIE+
Sbjct: 360 SEETDDLALDLDNGIEIED                                         378
```

Based on this analysis, it was predicted that these proteins and their epitopes could be useful antigens for vaccines or diagnostics.

EXAMPLE 1087

A DNA sequence (GBSx1162) was identified in *S. agalactiae* <SEQ ID 3355> hich encodes the amino acid sequence <SEQ ID 3356>. Analysis of this protein sequence reveals the following:

```
Possible site: 26
>>> Seems to have no N-terminal signal sequence

----- Final Results -----
          bacterial cytoplasm --- Certainty = 0.2344(Affirmative) < succ>
          bacterial membrane  --- Certainty = 0.0000(Not Clear)   < succ>
          bacterial outside   --- Certainty = 0.0000(Not Clear)   < succ>
```

A related GBS nucleic acid sequence <SEQ ID 10259> which encodes amino acid sequence <SEQ ID 10260> was also identified.

The protein has homology with the following sequences in the GENPEPT database.

```
>GP: AAG37358 GB: AF028804 NrpR [Lactococcus lactis subsp. cremoris]
Identities = 69/132 (52%), Positives = 102/132 (77%)

Query:   5 MIKIYTISSCTSCKKAKTWLNAHQLPYKEQNLGKESLTRDEILEILTKTESGIESIVSSK  64
           MI IYT  SCTSCKKAKTWL+ H +P+ E+NL  + L+  EI +IL K + G+E ++SS+
Sbjct:   1 MITIYTAPSCTSCKKAKTWLSYHHIPFNERNLIADPLSTTEISQILQKCDDGVEGLISSR  60

Query:  65 NRYAKALNCNIEELSVNEVIDLIQENPRILKSPILIDDKRLQVGYKEDDIRAFLPRSIRN 124
           NR+ K L  + E++S+++ I +I ENP+I++ PI++D+KRL VGY E++IRAFLPR++R
Sbjct:  61 NRFVKTLGVDFEDISLSQAIKIISENPQIMRRPIIMDEKRLHVGYNEEEIRAFLPRTVRV 120

Query: 125 VENAEARLRAAL                                                136
           +EN   ARLR+A+
Sbjct: 121 LENGGARLRSAI                                                132
```

A related DNA sequence was identified in *S. pyogenes* <SEQ ID 3357> which encodes the amino acid sequence <SEQ ID 3358>. Analysis of this protein sequence reveals the following:

```
Possible site: 28
>>> Seems to have no N-terminal signal sequence

----- Final Results -----
          bacterial cytoplasm --- Certainty = 0.2569(Affirmative) < succ>
          bacterial membrane  --- Certainty = 0.0000(Not Clear)   < succ>
          bacterial outside   --- Certainty = 0.0000(Not Clear)   < succ>
```

An alignment of the GAS and GBS proteins is shown below.

```
Identities = 117/132 (88%), Positives = 128/132 (96%)

Query:   5 MIKIYTISSCTSCKKAKTWLNAHQLPYKEQNLGKESLTRDEILEILTKTESGIESIVSSK    64
           MIKIYTISSCTSCKKAKTWLNAH+L YKEQNLGKE LT++EIL IL+KTE+G+ESIVSSK
Sbjct:   1 MIKIYTISSCTSCKKAKTWLNAHKLAYKEQNLGKEPLTKEEILAILSKTENGVESIVSSK    60

Query:  65 NRYAKALNCNIEELSVNEVIDLIQENPRILKSPILIDDKRLQVGYKEDDIRAFLPRSIRN   124
           NRYAKAL+C+IEELSV+EVIDLIQ+NPRILKSPILIDDKRLQVGYKEDDIRAFLPRSIRN
Sbjct:  61 NRYAKALDCDIEELSVSEVIDLIQDNPRILKSPILIDDKRLQVGYKEDDIRAFLPRSIRN   120

Query: 125 VENAEARLRAAL                                                  136
           +EN EARLRAAL
Sbjct: 121 IENTEARLRAAL                                                  132
```

Based on this analysis, it was predicted that these proteins and their epitopes could be useful antigens for vaccines or diagnostics.

EXAMPLE 1088

A DNA sequence (GBSx1163) was identified in *S. agalactiae* <SEQ ID 3359> which encodes the amino acid sequence <SEQ ID 3360>. Analysis of this protein sequence reveals the following:

```
Possible site: 49
>>> Seems to have no N-terminal signal sequence

----- Final Results -----
           bacterial cytoplasm --- Certainty = 0.3097(Affirmative) < succ>
            bacterial membrane --- Certainty = 0.0000(Not Clear)   < succ>
              bacterial outside --- Certainty = 0.0000(Not Clear)   < succ>
```

The protein has homology with the following sequences in the GENPEPT database.

```
>GP: BAB04987 GB: AP001511 unknown [Bacillus halodurans]
Identities = 49/82 (59%), Positives = 64/82 (77%), Gaps = 1/82 (1%)

Query:   1 MGFTDETVRFRLDDSN-KVEISETLTAVYRSLEEKGYNPINQIVGYVLSGDPAYVPRYND    59
           M    D T++F +++    V++ E L +VY +LEEKGYNPINQIVGY+LSGDPAY+PR+ D
Sbjct:   1 MSSMDNTMKFNVNEEPVSVDVQEVLMSVYEALEEKGYNPINQIVGYLLSGDPAYIPRHKD    60

Query:  60 ARNQIRKYERDEIVEELVRYYL                                         81
           AR   IRK ERDE++EELV+ YL
Sbjct:  61 ARTLIRKLERDELIEELVKSYL                                         82
```

A related DNA sequence was identified in *S. pyogenes* <SEQ ID 3361> which encodes the amino acid sequence <SEQ ID 3362>. Analysis of this protein sequence reveals the following:

```
Possible site: 49
>>> Seems to have no N-terminal signal sequence

----- Final Results -----
           bacterial cytoplasm --- Certainty = 0.3097(Affirmative) < succ>
            bacterial membrane --- Certainty = 0.0000(Not Clear)   < succ>
              bacterial outside --- Certainty = 0.0000(Not Clear)   < succ>
```

An alignment of the GAS and GBS proteins is shown below.

```
Identities = 80/88 (90%), Positives = 85/88 (95%)

Query:   1 MGFTDETVRFRLDDSNKVEISETLTAVYRSLEEKGYNPINQIVGYVLSGDPAYVPRYNDA    60
           MGFTDETVRF+LDD +K +ISETLTAVY SL+EKGYNPINQIVGYVLSGDPAYVPRYNDA
Sbjct:   1 MGFTDETVRFKLDDGDKRQISETLTAVYHSLDEKGYNPINQIVGYVLSGDPAYVPRYNDA    60
```

```
                       -continued
Query:  61 RNQIRKYERDEIVEELVRYYLQGNGIDL                               88
           RNQIRKYERDEIVEELVRYYLQGNGID+
Sbjct:  61 RNQIRKYERDEIVEELVRYYLQGNGIDV                               88
```

Based on this analysis, it was predicted that these proteins and their epitopes could be useful antigens for vaccines or diagnostics.

EXAMPLE 1089

A DNA sequence (GBSx1164) was identified in *S. agalactiae* <SEQ ID 3363> which encodes the amino acid sequence <SEQ ID 3364>. Analysis of this protein sequence reveals the following:

```
Possible Site: 27
>>> Seems to have no N-terminal signal sequence

----- Final Results -----
            bacterial cytoplasm --- Certainty = 0.1575(Affirmative) < succ>
             bacterial membrane --- Certainty = 0.0000(Not Clear)   < succ>
              bacterial outside --- Certainty = 0.0000(Not Clear)   < succ>
```

A related GBS nucleic acid sequence <SEQ ID 10257> which encodes amino acid sequence <SEQ ID 10258> was also identified.

The protein has homology with the following sequences in the GENPEPT database.

```
>GP: CAB14698 GB: Z99118 similar to hypothetical proteins
[Bacillus subtilis]
Identities = 82/138 (59%), Positives = 109/138 (78%), Gaps = 1/138 (0%)

Query:    1 MRIMGLDVGSKTVGVAISDPLGFTAQGLEIIKIDEESGNFGFDRLAELVKEYKVDKFVVG    60
            MRI+GLD+G+KT+GVA+SD +G+TAQG+E IKI+E   G++G  RL+EL+K+Y +DK V+G
Sbjct:    1 MRILGLDLGTKTLGVALSDEMGWTAQGIETIKINEAEGDYGLSRLSELIKDYTIDKIVLG    60

Query:   61 LPKNMNNTSGPRVEASQAYGDKITELFNLPVEYQDERLTTVQAERMLVEQADISRGKRKK   120
             PKNMN T GPR EASQ +    +N+PV   DERLTT+ AE+ML+   AD+SR KRKK
Sbjct:   61 FPKNMNGTVGPRGEASQTFAKVLETTYNVPVVLWDERLTTMAAEKMLI-AADVSRQKRKK   119

Query:  121 VIDKLAAQLILQNYLDRM                                            138
            VIDK+AA +ILQ YLD +
Sbjct:  120 VIDKMAAVMILQGYLDSL                                            137
```

A related DNA sequence was identified in *S. pyogenes* <SEQ ID 3365> which encodes the amino acid sequence <SEQ ID 3366>. Analysis of this protein sequence reveals the following:

```
Possible site: 27
>>> Seems to have no N-terminal signal sequence

----- Final Results -----
            bacterial cytoplasm --- Certainty = 0.1575(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below.

```
Identities = 114/139 (82%), Positives = 126/139 (90%)

Query:    1 MRIMGLDVGSKTVGVAISDPLGFTAQGLEIIKIDEESGNFGFDRLAELVKEYKVDKFVVG    60
            MRIMGLDVGSKTVGVAISDPLGFTAQGLEIIKIDEE   FGF RL ELVK+Y+V++FV+G
Sbjct:    1 MRIMGLDVGSKTVGVAISDPLGFTAQGLEIIKIDEEKAEFGFTRLEELVKQYQVEQFVIG    60

Query:   61 LPKNMNNTSGPRVEASQAYGDKITELFNLPVEYQDERLTTVQAERMLVEQADISRGKRKK   120
            LPKNMNNT+GPRV+AS  YG+ I  LF LPV YQDERLTTV+A+RML+EQADISRGKRKK
```

```
                                     -continued
Sbjct:    61 LPKNMNNTNGPRVDASITYGNHIEHLFGLPVHYQDERLTTVEAKRMLIEQADISRGKRKK  120

Query:   121 VIDKLAAQLILQNYLDRMF                                           139
             VIDKLAAQLILQNYL+R F
Sbjct:   121 VIDKLAAQLILQNYLNRNF                                           139
```

Based on this analysis, it was predicted that these proteins and their epitopes could be useful antigens for vaccines or diagnostics.

EXAMPLE 1090

A DNA sequence (GBSx1165) was identified in *S. agalactiae* <SEQ ID 3367> which encodes the amino acid sequence <SEQ ID 3368>. Analysis of this protein sequence reveals the following:

```
Possible site: 56
>>> Seems to have no N-terminal signal sequence

----- Final Results -----
             bacterial cytoplasm --- Certainty = 0.2631(Affirmative) < succ>
             bacterial membrane  --- Certainty = 0.0000(Not Clear)   < succ>
             bacterial outside   --- Certainty = 0.0000(Not Clear)   < succ>
```

The protein has homology with the following sequences in the GENPEPT database.

```
>GP: CAB14697 GB: Z99118 yrzB [Bacillus subtilis]
Identities = 50/94 (53%), Positives = 65/94 (68%), Gaps = 5/94 (5%)

Query:    12 EHQHEVITLVDENGNETLFEILLTIDGREEFGKNYVLLVPAGAEEDEQGEIEIQAYSFTE    71
             EH  + IT+VD+ GNE L E+L T +  EEFGK+YVL  P +++DE  E+EI A SFT
Sbjct:     2 EHGEKNITIVDDQGNEQLCEVLFTFEN-EEFGKSYVLYYPIESKDDE--EVEILASSFTP   58

Query:    72 NADGTEGDLQPIPEDSDAEWDMIEEVFNSFLDEE                            105
             N DG  G+L PI  ++D EWDMIEE  N+FL +E
Sbjct:    59 NEDGENGELFPI--ETDEEWDMIEETLNTFLADE                             90
```

A related DNA sequence was identified in *S. pyogenes* <SEQ ID 3369> which encodes the amino acid sequence <SEQ ID 3370>. Analysis of this protein sequence reveals the following:

```
Possible site: 52
>>> Seems to have no N-terminal signal sequence

----- Final Results -----
             bacterial cytoplasm --- Certainty = 0.3170(Affirmative) < succ>
             bacterial membrane  --- Certainty = 0.0000(Not Clear)   < succ>
             bacterial outside   --- Certainty = 0.0000(Not Clear)   < succ>
```

An alignment of the GAS and GBS proteins is shown below.

```
Identities = 90/98 (91%), Positives = 94/98 (95%)
Query:     7 HDHNHEHQHEVITLVDENGNETLFEILLTIDGREEFGKNYVLLVPAGAEEDEQGEIEIQA   66
             H+H ++HQHEVITLVDE GNETLFEILLTIDGREEFGKNYVLLVPAG+EEDE GEIEIQA
Sbjct:     3 HNHENDHQHEVITLVDEQGNETLFEILLTIDGREEFGKNYVLLVPAGSEEDESGEIEIQA   62

Query:    67 YSFTENADGTEGDLQPIPEDSDAEWDMIEEVFNSFLDE                        104
             YSFTEN DGTEGDLQPIPEDSDAEWDMIEEVFNSFLDE
Sbjct:    63 YSFTENEDGTEGDLQPIPEDSDAEWDMIEEVFNSFLDE                        100
```

Based on this analysis, it was predicted that these proteins and their epitopes could be useful antigens for vaccines or diagnostics.

EXAMPLE 1091

A DNA sequence (GBSx1166) was identified in *S. agalactiae* <SEQ ID 3371> which encodes the amino acid sequence <SEQ ID 3372>. Analysis of this protein sequence reveals the following:

```
Possible site: 20
>>> Seems to have no N-terminal signal sequence

----- Final Results -----
            bacterial cytoplasm --- Certainty = 0.2059(Affirmative) < succ>
            bacterial membrane  --- Certainty = 0.0000(Not Clear)   < succ>
            bacterial outside   --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1092

A DNA sequence (GBSx1167) was identified in *S. agalactiae* <SEQ ID 3373> which encodes the amino acid sequence <SEQ ID 3374>. This protein is predicted to be unnamed protein product. Analysis of this protein sequence reveals the following:

```
Possible site: 53
>>> Seems to have no N-terminal signal sequence
    INTEGRAL    Likelihood = -9.18    Transmembrane    314-330  (308-334)
    INTEGRAL    Likelihood = -6.21    Transmembrane    279-295  (274-300)
    INTEGRAL    Likelihood = -6.10    Transmembrane    136-152  (135-157)
    INTEGRAL    Likelihood = -5.31    Transmembrane    232-248  (226-253)
    INTEGRAL    Likelihood = -4.73    Transmembrane    163-179  (162-180)
    INTEGRAL    Likelihood = -3.13    Transmembrane     95-111   (94-119)
    INTEGRAL    Likelihood = -3.03    Transmembrane    386-402  (386-405)
    INTEGRAL    Likelihood = -2.18    Transmembrane    204-220  (204-221)
    INTEGRAL    Likelihood = -2.13    Transmembrane     40-56    (40-57)
    INTEGRAL    Likelihood = -1.70    Transmembrane    186-202  (182-202)

----- Final Results -----
            bacterial membrane  --- Certainty = 0.4673(Affirmative) < succ>
            bacterial outside   --- Certainty = 0.0000(Not Clear)   < succ>
            bacterial cytoplasm --- Certainty = 0.0000(Not Clear)   < succ>
```

A related GBS nucleic acid sequence <SEQ ID 10255> which encodes amino acid sequence <SEQ ID 10256> was also identified.

A related DNA sequence was identified in *S. pyogenes* <SEQ ID 3375> which encodes the amino acid sequence <SEQ ID 3376>. Analysis of this protein sequence reveals the following:

```
Possible site: 53
>>> Seems to have no N-terminal signal sequence
    INTEGRAL    Likelihood = -7.38    Transmembrane    315-331  (311-333)
    INTEGRAL    Likelihood = -6.48    Transmembrane     40-56    (37-61)
    INTEGRAL    Likelihood = -6.10    Transmembrane    278-294  (274-298)
    INTEGRAL    Likelihood = -5.57    Transmembrane    392-408  (387-410)
    INTEGRAL    Likelihood = -3.98    Transmembrane    186-202  (184-208)
    INTEGRAL    Likelihood = -3.93    Transmembrane    339-355  (338-356)
    INTEGRAL    Likelihood = -2.97    Transmembrane    235-251  (228-253)
    INTEGRAL    Likelihood = -2.44    Transmembrane    166-182  (166-182)
    INTEGRAL    Likelihood = -2.23    Transmembrane    106-122  (106-125)
    INTEGRAL    Likelihood = -1.81    Transmembrane     83-99    (83-101)

----- Final Results -----
            bacterial membrane  --- Certainty = 0.3951(Affirmative) < succ>
```

```
            bacterial outside --- Certainty = 0.0000(Not Clear) < succ>
          bacterial cytoplasm --- Certainty = 0.0000(Not Clear) < succ>
```

A related sequence was also identified in GAS <SEQ ID 9179> which encodes the amino acid sequence <SEQ ID 9180>. Analysis of this protein sequence reveals the following:

```
Possible cleavage site: 13
>>> Seems to have a cleavable N-term signal seq.
    INTEGRAL    Likelihood = -7.38    Transmembrane    243-259  (239-261)
    INTEGRAL    Likelihood = -6.10    Transmembrane    206-222  (202-226)
    INTEGRAL    Likelihood = -5.57    Transmembrane    320-336  (315-338)
    INTEGRAL    Likelihood = -3.98    Transmembrane    114-130  (112-136)
    INTEGRAL    Likelihood = -3.93    Transmembrane    267-283  (266-284)
    INTEGRAL    Likelihood = -2.97    Transmembrane    163-179  (156-181)
    INTEGRAL    Likelihood = -2.44    Transmembrane     94-110   (94-110)
    INTEGRAL    Likelihood = -2.23    Transmembrane     34-50    (34-53)

----- Final Results -----
              bacterial membrane --- Certainty = 0.395(Affirmative) < succ>
               bacterial outside --- Certainty = 0.0000(Not Clear) < succ>
             bacterial cytoplasm --- Certainty = 0.0000(Not Clear) < succ>
```

An alignment of the GAS and GBS proteins is shown below.

```
Identities = 200/480 (41%), Positives = 310/480 (63%), Gaps = 1/480 (0%)
Query:  40 ILLYSVLSTLLAIANPLLTYFANGLQTQNLYTGLMMTKGQIPYSDVFATGGFLYYVTIAL    99
           +L +S++ + L IA P LT  ANGLQ+QNLY G+M+TKGQ+PYS  F TGG  Y+V IAL
Sbjct:  40 LLFFSIIISSLTIAVPFLTDAANGLQSQNLYIGMMLTKGQLPYSAAFTTGGLFYFVIIAL    99

Query: 100 SYLLGSSIWLLIVQFIAYYVSGIYFYKLVYYVAQSEIVSIGMTLIFYIMNIVLGFGGMYP   159
           SY LGS++WL+ VQ   +Y+SG+Y YKL+ Y+   + V++  ++ +Y++++ LGFGG+YP
Sbjct: 100 SYYLGSTLWLVFVQVFCFYLSGLYLYKLINYMTGFQKVALTFSISYYLLSVSLGFGGLYP   159

Query: 160 IQWALPFMLISLWFLIKFCVDNIVDEAFIFYGILAAFSLFIDPQTLIFWLCSFVLLTATN   219
             Q A+PF+LIS WFL K+    + DEAFI +G + A ++ IDP TLIFW   + V + + N
Sbjct: 160 TQLAMPFILISAWFLTKYFACLVKDEAFILFGFVGALAMLIDPSTLIFWSFACVTVFSYN   219

Query: 220 IKQKQSLRGFYQFLCVVFGMILIAYTVGYFMFNLQIISSYIDKAIFYPFTYFARTNHSFL   279
             I QK   RGFYQ L  +FGMIL+ YT GYF+ NLQ+++ Y+ + +  YPFT+F      N S L
Sbjct: 220 ISQKHLARGFYQLLASIFGMILVFYTAGYFILNLQVLNPYLSQTMIYPFTFFKSGNLSLL   279

Query: 280 LSLAIQIVVLLGSGCLFGLWDFIQNRKKASYQIGLNFIACIFIIYAIMAIFSRDFNLYHF   339
           LAIQ+    LG G L G+ + I+   K  S ++       + +   ++AIFS+D+  YH
Sbjct: 280 FGLAIQLFFALGLGLLTGMENVIRRFKNNSDRVVKWLFVMVILESILVAIFSQDYRPYHL   339

Query: 340 LPALPFGLLLTSNKITILYQKVIDRRSHRRQY-FSGKSLIVDLFVKKTYYLPLLLVSLSI   398
           LP LPFGL+LT+  +   Y + +  SHRR++   +G   ++ +++K+ +YLP+L+V   +
Sbjct: 340 LPLLPFGLILTAIPVGYQYGIGLGQSSHRRRHGKNGVGRVMNIYLKRHFYLPILIVGTIL   399

Query: 399 GLLVYNTYQNVTLSKERRDISHYLTTKIDRDGKIYVWDKVASIYSQTRLKSASQFVLPHI   458
             Y    ++ L++ER  I+  YL  K+++    IYVWD  + IY   ++ KS SQF  P I
Sbjct: 400 ICSTYCFISSIPLNQERDHIASYLEQKLNKTQSIYVWDDTSKIYLDSKAKSVSQFSSPDI   459

Query: 459 NTAQKNNEKILKDELLQHGAKYFILNKNEKLPNELKSDIKKHYQEVPLSNITHFVLYRFK   518
           NT ++++ KIL+DELL++  A Y ++N+ +  LP ++  +  +Y+         F++Y+ K
Sbjct: 460 NTQKESHRKILEDELLENKAAYIVVNRYKNLPKIIQKVLSTNYKVDKQITTKSFIVYQKK   519
```

A related GBS gene <SEQ ID 8727> and protein <SEQ ID 8728> were also identified. Analysis of this protein sequence reveals the following:

```
Lipop: Possible site: -1 Crend: 0
SRCFLG: 0
McG: Length of UR: 34
     Peak Value of UR: 2.23
     Net Charge of CR: 0
McG: Discrim Score: 7.72
GvH: Signal Score (-7.5): -2.21
     Possible site: 60
```

-continued
```
>>> Seems to have a cleavable N-term signal seq.
Amino Acid Composition: calculated from 61
ALOM program count: 5 value: -9.18 threshold: 0.0
    INTEGRAL      Likelihood = -9.18    Transmembrane    174-190  (168-194)
    INTEGRAL      Likelihood = -6.21    Transmembrane    139-155  (134-160)
    INTEGRAL      Likelihood = -5.31    Transmembrane     92-108   (86-113)
    INTEGRAL      Likelihood = -3.03    Transmembrane    246-262  (246-265)
    INTEGRAL      Likelihood = -2.18    Transmembrane     64-80    (64-81)
    PERIPHERAL    Likelihood =  3.29    194
modified ALOM score: 2.34
icm1 HYPID: 7 CFP: 0.467
*** Reasoning Step: 3

----- Final Results -----
            bacterial membrane --- Certainty = 0.4673(Affirmative) < succ>
            bacterial outside  --- Certainty = 0.0000(Not Clear)   < succ>
            bacterial cytoplasm --- Certainty = 0.0000(Not Clear)  < succ>
```

The protein has homology with the following sequences in the databases:

```
ORF02392(331-978 of 1764)
EGAD|43696|MJ1079(2-379 of 397) conserved hypothetical protein {Methanococcus
jannaschii} OMNI|MJ1079 conserved hypothetical protein
GP|1591727|gb|AAB99076.1||U67550 conserved hypothetical protein {Methanococcus
jannaschii} PIR|F64434|F64434 hypothetical protein MJ1079 - Methanococcus jannaschii
% Match = 3.1
% Identity = 25.6    % Similarity = 50.7
Matches = 57   Mismatches = 100   Conservative Sub.s = 56
174       204       234       264       294       324       354
*LLLANI*LSVHPTSFFTXXXN*LXXSSIWLLIVQFIAYYVSGIYFYKLVYYVAQSEIVSIGMTLIFYIMNIVLG-----
                                                             : |:: |: |: |
                                                              MLNLLYLILGIICGTITGL
                                                              10
426       447       477       507       537       567       597
FGGMYPIQW-ALPFMLISLWFL---IKFCVDNIVDEAFIFYGILAAFSLFIDPQTLIFWLCSFVLLTATNIKQKQSLRGF
|  | ::|    ||  |:::  :  | |  |  :    ||  : | :||     |:|  :  |       |   :  | ||
FPGIHPNNIVALSFLILPYFGLDNYIPFLIGLVITHYFINF-IPSAFLGVPDDETAVSALPMHKLTLNGNGYEAIVLAGF
   30        40        50        60        70        80        90
627       657       687       717       747       774
YQFLCVVFGMILIAYTVGYFMFNLQIISSYIDKAIFYPFTYFARTNHSFLLSLAI-QIVVLLGSGC--------------
 :|  |||   :::  : :  :|::    ||   ||||   |   : : :::|::  ||
GSYLGVVFSILISLFLMSILHFDVRAFYCSI--KIFIPFILIAFILYQIFTAKSVWEVLVIFLSGIFGIAVLYCSEAFNI
     110       120       130       140       150       160       170
798       828                                            846       876
--------LFGLWDFIQNRKKASYQ-------------------------------IGLNFIACIFI
         :||: :| |        :                              : :|:: ||
TLTAIFTGMFGIPLLINNLKTYKIKSQMMAFPDFELKFLKSSFFA~~~~TIAIIILLNLSKYILLFIRKVNPKFLSLFFI
         190       200       210       220              320       330
906       948       978       1008      1038      1068      1098
IYAIMAIFSRDFN---LYH---FLPALPFGLLLTSNKITILYQKVIDRRSHRRQYFSGKSLIVDLFVKKTYYLPLLLVSL
|: : :       :|   :||     :| |: |||    :   :
IFCSLVVIIGSYNTYLIYHIIVYLTAIYIGLLAVKSNTNLSNMMNVLIFPTILYFLRG
     350       360       370       380       390
```

Based on this analysis, it was predicted that these proteins and their epitopes could be useful antigens for vaccines or diagnostics.

EXAMPLE 1093

A DNA sequence (GBSx1168) was identified in *S. agalactiae* <SEQ ID 3377> which encodes the amino acid sequence <SEQ ID 3378>. This protein is predicted to be anaerobic ribonucleotide reductase (nrdD). Analysis of this protein sequence reveals the following:

```
Possible site: 52
>>> Seems to have no N-terminal signal sequence

----- Final Results -----
            bacterial cytoplasm --- Certainty = 0.3722(Affirmative) < succ>
            bacterial membrane  --- Certainty = 0.0000(Not Clear)   < succ>
            bacterial outside   --- Certainty = 0.0000(Not Clear)   < succ>
```

A related GBS nucleic acid sequence <SEQ ID 10253> which encodes amino acid sequence <SEQ ID 10254> was also identified.

The protein has homology with the following sequences in the GENPEPT database.

```
>GP:AAD00215 GB:U73336 anaerobic ribonucleotide reductase
[Lactococcus lactis subsp. cremoris]
Identities = 539/725 (74%), Positives = 616/725 (84%), Gaps = 7/725 (0%)
Query:  10 MTESDIKVIKRDGRLVSFDKYIYTALLKASNKVIKMSPLVEAKLEMIADHVIAEIYNRF   69
             +T  +I VIKRDGR V F+   KI+ AL KA+ KV      V    L  + D V++EI++RF
Sbjct:  10 VTLEEINVIKRDGRSVKFNSEKIFDALTKAAKKVELTDKSV---LSELTDRVVSEIFSRF   66

Query:  70 KDNIKIYEIQNIVEHKLLEANEYAIAQEYINYRTQRDFERSQATDINFSIGKLINKDQTV  129
             +N+KIYEIQ+IVE +LLE+  E A+A+EYI+YR  RD  R++ATDINF+I KLIN+DQTV
Sbjct:  67 SENVKIYEIQSIVEQELLESGETALAEEYISYRANRDLARTKATDINFTIEKLINRDQTV  126

Query: 130 VNENANKDSDVFNTQRDLTAGIVGKSIGLKMLPSHVANAHQKGDIHYHDLDYSPYTPMTN  189
             VNENANKDS+VFNTQRDLTAG V K+IGLK+LP HVANAHQKGDIHYHDLDYSP+T M N
Sbjct: 127 VNENANKDSNVFNTQRDLTAGAVSKAIGLKLLPPHVANAHQKGDIHYHDLDYSPFTTMAN  186

Query: 190 CCLIDFKGMLANGFKIGNAEVESPKSIQTATAQISQIIANVASSQYGGCTADRIDEFLAP  249
             CCLIDFK M  NGFK+GNA+V+SPKSIQTATAQ SQIIANVASSQYGGC+ DR DE LAP
Sbjct: 187 CCLIDFKNMFENGFKLGNAQVDSPKSIQTATAQASQIIANVASSQYGGCSFDRADEVLAP  246

Query: 250 YAQLNYQKHLKDAKEWVIED-KQEDYARAKTQKDIYDAMQSLEYEINTLFTSNGQTPFTS  308
             YA+LNYQKHLKDA++W+  D K+E YAR KT KDIYDAMQSLEYEINTLFTSNGQTPF +
Sbjct: 247 YAKLNYQKHLKDAQKWIDGDEKREAYAREKTAKDIYDAMQSLEYEINTLFTSNGQTPFVT  306

Query: 309 LGFGLGTNWFEREIQKAILKIRIQGLGSEHRTAIFPKLIFTLKKGLNLEEDSPNYDIKQL  368
             +GFGLG +W+ REIQKAILK+RI GLGSEHRTAIFPKLIFTLK+GLNLE  +PNYDIK+L
Sbjct: 307 VGFGLGDDWYAREIQKAILKVRIGGLGSEHRTAIFPKLIFTLKRGLNLEVGTPNYDIKEL  366

Query: 369 ALECATKRMYPDVLSYDKIIDLTGSFKAPMGCRSFLQGWRDANGQDVTSGRMNLGVVTVN  428
             ALEC+TKRMYPD+LSYDKI++LTGSFKA MGCRSFLQGW+DANG DVT+GR NLGVVTVN
Sbjct: 367 ALECSTKRMYPDILSYDKIVELTGSFKASMGCRSFLQGWKDANGNDVTAGRNNLGVVTVN  426

Query: 429 LPRVAMESNGDMDKFWEIFNERMSIARDALVYRVERVKEAIPANAPILYQYGAFGERLGK  488
             LPR+A+E+ G+ +KFWEIFNER+ IA DAL +RVER KEA P NAPIL+  GA G RL
Sbjct: 427 LPRIALEAAGNKEKFWEIFNERVEIAHDALAFRVERAKEAQPKNAPILFMNGALG-RLDS  485

Query: 489 YDNVDRLFNHRRATVSLGYIGLYEVASVFYGGDWEDNHQAKAFTVDIVRKMKQLCADWSD  548
             +VD L+N+ RATVSLGYIGLYEVA+ FYG  WE N +AKAFT++IV++M + C DWS
Sbjct: 486 EGSVDDLYNNERATVSLGYIGLYEVATTFYGPTWESNPEAKAFTIEIVKRMHEDCEDWSK  545

Query: 549 EYDYHFSVYSTPSESLTDRFCRLDTEKFGIVTDITDKEYYTNSFHYDVRKNPTPFEKLDF  608
              YH+SVYSTPSESLTDRFCR+D EKFG V DITDK+YYTNSFHYDVRKNPTPFEKL+F
Sbjct: 546 ASGYHYSVYSTPSESLTDRFCRMDKEKFGSVADITDKDYYTNSFHYDVRKNPTPFEKLEF  605

Query: 609 EKIYPETGASGGFIHYCEYPVLQQNPKALEAVWDYAYDRVGYLGTNTPIDKCYQCQFEGD  668
             EK YP   A+GGFIHYCEYPVLQQNPKALEAVWD+AYDR+GYLGTN PID CY C FEGD
Sbjct: 606 EKDYP-VYANGGFIHYCEYPVLQQNPKALEAVWDFAYDRIGYLGTNAPIDHCYACGFEGD  664

Query: 669 FTPTDRGFTCPNCGNSDPKTVDVVKRTCGYLGNPQARPMVNGRHKEISARVKHMNGS-SI  727
             FTPT+RGF CP CGN DPKT DVVKRTCGYLGNPQARPMV+GRHKEIS+RVKHMNGS
Sbjct: 665 FTPTERGFKCPQCGNDDPKTCDVVKRTCGYLGNPQARPMVHGRHKEISSRVKHMNGSVGA  724

Query: 728 KNQGN  732
             N GN
Sbjct: 725 LNDGN  729
```

A related DNA sequence was identified in *S. pyogenes* <SEQ ID 3379> which encodes the amino acid sequence <SEQ ID 3380>. Analysis of this protein sequence reveals the following:

```
Possible site: 52
>>> Seems to have no N-terminal signal sequence

----- Final Results -----
              bacterial cytoplasm --- Certainty = 0.2975(Affirmative) < succ>
               bacterial membrane --- Certainty = 0.0000(Not Clear) < succ>
                bacterial outside --- Certainty = 0.0000(Not Clear) < succ>
```

An alignment of the GAS and GBS proteins is shown below.

```
Identities = 641/731 (87%), Positives = 680/731 (92%)
Query:    1 MMVLERERFMTESDIKVIKRDGRLVSFDKYKIYTALLKASNKVIKMSPLVEAKLEMIADH   60
            M+ LE ++   + DIKVIKRDGRLV+FD  KIY+ALLKAS KV +MSPLVEAKLE I+D
Sbjct:    1 MVSLEEDKVTVQPDIKVIKRDGRLVNFDSTKIYSALLKASMKVTRMSPLVEAKLEAISDR   60

Query:   61 VIAEIYNRFKDNIKIYEIQNIVEHKLLEANEYAIAQEYINYRTQRDFERSQATDINFSIG  120
            +IAEI  RF  NIKIYEIQNIVEHKLL ANEYAIA+EYINYRTQRDF RSQATDINFSI
Sbjct:   61 IIAEIIERFPTNIKIYEIQNIVEHKLLAANEYAIAKEYINYRTQRDFARSQATDINFSID  120

Query:  121 KLINKDQTVVNENANKDSDVFNTQRDLTAGIVGKSIGLKMLPSHVANAHQKGDIHYHDLD  180
            KLINKDQTVVNENANKDSDVFNTQRDLTAGIVGKSIGLKMLPSHVANAHQKGDIHYHDLD
Sbjct:  121 KLINKDQTVVNENANKDSDVFNTQRDLTAGIVGKSIGLKMLPSHVANAHQKGDIHYHDLD  180

Query:  181 YSPYTPMTNCCLIDFKGMLANGFKIGNAEVESPKSIQTATAQISQIIANVASSQYGGCTA  240
            YSPYTPMTNCCLIDFKGMLANGFKIGNAEVESPKSIQTATAQISQIIANVASSQYGGCTA
Sbjct:  181 YSPYTPMTNCCLIDFKGMLANGFKIGNAEVESPKSIQTATAQISQIIANVASSQYGGCTA  240

Query:  241 DRIDEFLAPYAQLNYQKHLKDAKEWVIEDKQEDYARAKTQKDIYDAMQSLEYEINTLFTS  300
            DRIDEFLAPYA+LN++KH+ DAK+W++E K+E YA  KTQKDIYDAMQSLEYEINTLFTS
Sbjct:  241 DRIDEFLAPYAELNFKKHMADAKKWIVETKRESYAFEKTQKDIYDAMQSLEYEINTLFTS  300

Query:  301 NGQTPFTSLGFGLGTNWFEREIQKAILKIRIQGLGSEHRTAIFPKLIFTLKKGLNLEEDS  360
            NGQTPFTSLGFGLGT+WFEREIQKAIL IRI GLGSEHRTAIFPKLIFT+K+GLNLE DS
Sbjct:  301 NGQTPFTSLGFGLGTSWFEREIQKAILTIRINGLGSEHRTAIFPKLIFTVKRGLNLEPDS  360

Query:  361 PNYDIKQLALECATKRMYPDVLSYDKIIDLTGSFKAPMGCRSFLQGWRDANGQDVTSGRM  420
            PNYDIK LALECATKRMYPD+LSYDKIIDLTGSFK+PMGCRSFLQGW+D NGQDVTSGRM
Sbjct:  361 PNYDIKTLALECATKRMYPDMLSYDKIIDLTGSFKSPMGCRSFLQGWKDENGQDVTSGRM  420

Query:  421 NLGVVTVNLPRVAMESNGDMDKFWEIFNERMSIARDALVYRVERVKEAIPANAPILYQYG  480
            NLGVVT+NLPR+AMESNGDMDKFWE+FNERM I++DAL+YRVERV EA PANAPILYQYG
Sbjct:  421 NLGVVTLNLPRIAMESNGDMDKFWELFNERMLISKDALIYRVERVTEAKPANAPILYQYG  480

Query:  481 AFGERLGKYDNVDRLFNHRRATVSLGYIGLYEVASVFYGGDWEDNHQAKAFTVDIVRKMK  540
            AFG+RL K  NV+ LF +RRATVSLGYIGLYEVASVFYGG WE N  AKAFT+ IV+ MK
Sbjct:  481 AFGKRLEKTGNVNDLFKNRRATVSLGYIGLYEVASVFYGGQWEGNPDAKAFTLSIVKAMK  540

Query:  541 QLCADWSDEYDYHFSVYSTPSESLTDRFCRLDTEKFGIVTDITDKEYYTNSFHYDVRKNP  600
            Q C DWSDEY YHFSVYSTPSESLTDRFCRLDTEKFGIVTDITDKEYYTNSFHYDVRK+P
Sbjct:  541 QACEDWSDEYGYHFSVYSTPSESLTDRFCRLDTEKFGIVTDITDKEYYTNSFHYDVRKSP  600

Query:  601 TPFEKLDFEKIYPETGASGGFIHYCEYPVLQQNPKALEAVWDYAYDRVGYLGTNTPIDKC  660
            TPFEKLDFEK YPE GASGGFIHYCEYPVLQQNPKALEAVWDYAYDRVGYLGTNTPIDKC
Sbjct:  601 TPFEKLDFEKDYPEAGASGGFIHYCEYPVLQQNPKALEAVWDYAYDRVGYLGTNTPIDKC  660

Query:  661 YQCQFEGDFTPTDRGFTCPNCGNSDPKTVDVVKRTCGYLGNPQARPMVNGRHKEISARVK  720
            Y CQFEGDFTPT+RGFTCPNCGN+DPKTVDVVKRTCGYLGNPQARPMVNGRHKEISARVK
Sbjct:  661 YNCQFEGDFTPTERGFTCPNCGNNDPKTVDVVKRTCGYLGNPQARPMVNGRHKEISARVK  720

Query:  721 HMNGSSIKNQG                                                  731
            HMNGS+IK  G
Sbjct:  721 HMNGSTIKYPG                                                  731
```

Based on this analysis, it was predicted that these proteins and their epitopes could be useful antigens for vaccines or diagnostics.

EXAMPLE 1094

A DNA sequence (GBSx1169) was identified in *S. agalactiae* <SEQ ID 3381> which encodes the amino acid sequence <SEQ ID 3382>. Analysis of this protein sequence reveals the following:

```
Possible site: 27
>>> Seems to have no N-terminal signal sequence

----- Final Results -----
            bacterial cytoplasm --- Certainty = 0.5372(Affirmative) < succ>
            bacterial membrane  --- Certainty = 0.0000(Not Clear) < succ>
             bacterial outside  --- Certainty = 0.0000(Not Clear) < succ>
```

The protein has no significant homology with any sequences in the GENPEPT database.

A related DNA sequence was identified in *S. pyogenes* <SEQ ID 3383> which encodes the amino acid sequence <SEQ ID 3384>. Analysis of this protein sequence reveals the following:

```
Possible site: 45
>>> Seems to have no N-terminal signal sequence

----- Final Results -----
            bacterial cytoplasm --- Certainty = 0.6084(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below.

```
Identities = 28/47 (59%), Positives = 40/47 (84%), Gaps = 1/47 (2%)
Query:    1 MGKYQLDYKGQAQVQKFHEKHSTGENANQKSRLKDLRKQFLEKAKKK       47
            MGKYQLDYKG QV++FHEKHS  +   ++KSR+++L+ +FLEK+KK+
Sbjct:    1 MGKYQLDYKGMQQVERFHEKHSK-KKTDKKSRVQELKARFLEKSKKQ      46
```

Based on this analysis, it was predicted that these proteins and their epitopes could be useful antigens for vaccines or diagnostics.

EXAMPLE 1095

A DNA sequence (GBSx1170) was identified in *S. agalactiae* <SEQ ID 3385> which encodes the amino acid sequence <SEQ ID 3386>. Analysis of this protein sequence reveals the following:

```
Possible site: 51
>>> Seems to have no N-terminal signal sequence

----- Final Results -----
            bacterial cytoplasm --- Certainty = 0.0436(Affirmative) < succ>
             bacterial membrane --- Certainty = 0.0000(Not Clear)   < succ>
              bacterial outside --- Certainty = 0.0000(Not Clear)   < succ>
```

The protein has homology with the following sequences in the GENPEPT database.

```
>GP: CAB95794 GB: AL359949 putative oxidoreductase [Streptomyces
coelicolor A3(2)]
Identities = 91/299 (30%), Positives = 147/299 (48%), Gaps = 7/299 (2%)

Query:    2 LQLGIVGLGGISQKAYLPYMRQVTGVHWHLFTRQKQILEEV--NMLFGSSTAYDSLDSLA   59
            +++G +GLG I+QK YLP +  + G+  HL TR    L  V  +   +   + LD+L
Sbjct:    1 MKVGCIGLGDIAQKGYLPVLAALPGIELHLQTRTPATLTRVADKLRIPPAQRHADLDALL  60

Query:   60 EHPLDGVFIHVATSAHFDIAKLFLKKGIPVFMDKPLTEDYTSTKALYDLAKDHKTFLMAG  119
              LD  F+H  T+AH +I    L+ G+P ++DKPL  +    ++ L  LA++   T L G
Sbjct:   61 AQGLDAAFVHAPTAAHPEIVTRLLEAGVPTYVDKPLAYELADSERLVTLAEERGTSLAVG  120

Query:  120 FNRRFAPRIMEMKKVEDKNHIRTFKNAVNAPADFQYKLFDMFIHPLDTALFLTNNVVKRG  179
            FNRR AP   +   + I   KN     P D +  D FIH +DT  FL         V
Sbjct:  121 FNRRHAPGYAQCAE-HPRELILMQKNRTGLPEDPRTMILDDFIHVVDTLRFLVPGPVDDV  179

Query:  180 YFVTKRDGNKILQVSVTLETDSEIIEASMNLQSGSRREIIEIESPEVTYSLDDLSNLSVI  239
              +G  +  V + L  D      MN  SGS  EI+E+  +    +L+   VI
Sbjct:  180 TVRARTEGGLLHHVVLQLAGDGFTALGVMNRLSGSAEEILEVSGQDTKRQVVNLA--EVI  237

Query:  240 DGFDRRAI-GFGSWASTLEKRGFEPMIDAFIQAITTGVNPISPKSSLLSHFICDQINKA  297
            D  +  +  G W   +RG E  + AF+ A+ +G  +S + +L +H +C+++  +A
Sbjct:  238 DHKGQPTVRRRGDWVPVARQRGIEQAVLAFLDAVRSG-EVLSARDALATHELCERVVRA  295
```

A related DNA sequence was identified in *S. pyogenes* <SEQ ID 3387> which encodes the amino acid sequence <SEQ ID 3388>. Analysis of this protein sequence reveals the following:

```
Possible site: 57
>>> Seems to have an uncleavable N-term signal seq

----- Final Results -----
              bacterial membrane --- Certainty = 0.0000(Not Clear) < succ>
               bacterial outside --- Certainty = 0.0000(Not Clear) < succ>
             bacterial cytoplasm --- Certainty = 0.0000(Not Clear) < succ>
```

The protein has homology with the following sequences in the databases:

```
>GP: AAF96942 GB: AE004430 oxidoreductase, Gfo/Idh/MocA family
[Vibrio cholerae]
Identities = 103/304 (33%), Positives = 158/304 (51%), Gaps = 11/304 (3%)

Query:    4 LNIGIVGLGAISQKAYLPYMRQLSDITWHLSTRNAAVRQQVGQLFGHAILYSDVKELSKT   63
            + I ++GLG I+QKAYLP + Q  DI   L TRN V   +  +  +D +++ +
Sbjct:    1 MKIAMIGLGDIAQKAYLPVLAQWPDIELVLCTRNPKVLGTLATRYRVSATCTDYRDVLQY   60

Query:   64 NLDGVFIHAATSAHAELASLFLNQGIPVFMDKPIADNYLMTKNLYDLAKENQTFLMAGFN  123
            +D V IHAAT  H+ LA+ FL+ GIP F+DKP+A +    +NLY+LA+++  L  GFN
Sbjct:   61 GVDAVMIHAATDVHSTLAAFFLHLGIPTFVDKPLAASAQECENLYELAEKHHQPLYVGFN  120

Query:  124 RRFTPRVKK-LSSLSTK-----RKVAVEKNDLNRPGDMTFKLFDFFIHPLDTALFLTEGT  177
            RR  P   + LS L+ +       R + EK+    PGD+  +FD FIHPLD+     +
Sbjct:  121 RRHIPLYNQHLSELAQQECGALRSLRWEKHRHALPGDIRTFVFDDFIHPLDSVNLSRQCN  180

Query:  178 LLKGHFQYHLEAGLLSQVMVTLMTESMTTTASMNLQSGSRREVMEVQRAEETYHLENLDE  237
            L   H  YH+ GLL+++ V  T       ASMN Q G   E +        Y ++  +
Sbjct:  181 LDDLHLTYHMSEGLLARLDVQWQTGDTLLHASMNRQFGITTEHVTASYDNVAYLFDSFTQ  240

Query:  238 LSIYKGTEKRVLGFASWDTTLHKRGFETMIDAFLEAISTGVNPVS-PESSLLSHW----I  292
              +++   ++    W   L  +GF+ M+    +L+  + G P    E +L SH      I
Sbjct:  241 GKMWRDNQESRVALKDWTPMLASKGFDAMVQDWLQVAAAGKLPTHIIERNLASHQLAEAI  300

Query:  293 CQQI                                                          296
            CQQI
Sbjct:  301 CQQI                                                          304
```

An alignment of the GAS and GBS proteins is shown below.

```
Identities = 168/308 (54%), Positives = 223/308 (71%)

Query:    1 MLQLGIVGLGGISQKAYLPYMRQVTGVHWHLFTRQKQILEEVNMLFGSSTAYDSLDSLAE   60
            ML +GIVGLG ISQKAYLPYMRQ++ + WHL TR   + ++V LFG + Y   + L++
Sbjct:    3 MLNIGIVGLGAISQKAYLPYMRQLSDITWHLSTRNAAVRQQVGQLFGHAILYSDVKELSK   62

Query:   61 HPLDGVFIHVATSAHFDIAKLFLKKGIPVFMDKPLTEDYTSTKALYDLAKDHKTFLMAGF  120
              LDGVFIH ATSAH ++A LFL +GIPVFMDKP+ ++Y  TK LYDLAK+++TFLMAGF
Sbjct:   63 TNLDGVFIHAATSAHAELASLFLNQGIPVFMDKPIADNYLMTKNLYDLAKENQTFLMAGF  122

Query:  121 NRRFAPRIMEMKKVEDKNHIRTFKNAVNAPADFQYKLFDMFIHPLDTALFLTNNVVKRGY  180
            NRRF PR+ ++  + K  +   KN +N P D +KLFD FIHPLDTALFLT   + +G+
Sbjct:  123 NRRFTPRVKKLSSLSTKRKVAVEKNDLNRPGDMTFKLFDFFIHPLDTALFLTEGTLLKGH  182

Query:  181 FVTKRDGNKILQVSVTLETDSEIIEASMNLQSGSRREIIEIESPEVTYSLDDLSNLSVID  240
            F   +  + + QV VTL T+S    ASMNLQSGSRRE++E++  E TY L++L  LS+
Sbjct:  183 FQYHLEAGLLSQVMVTLMTESMTTTASMNLQSGSRREVMEVQRAEETYHLENLDELSIYK  242

Query:  241 GFDRRAIGFGSWASTLEKRGFEPMIDAFIQAITTGVNPISPKSSLLSHFICDQINKANAP  300
            G ++R +GF SW +TL KRGFE MIDAF++AI+TGVNP+SP+SSLLSH+IC QI   +
Sbjct:  243 GTEKRVLGFASWDTTLHKRGFETMIDAFLEAISTGVNPVSPESSLLSHWICQQIADSQLS  302

Query:  301 FGMLNLKI                                                      308
            +G L +++
Sbjct:  303 YGELTVEL                                                      310
```

SEQ ID 3386 (GBS309) was expressed in *E. coli* as a GST-fusion product. SDS-PAGE analysis of total cell extract is shown in FIG. 68 (lane 10; MW 63 kDa).

GBS309-GST was purified as shown in FIG. 212, lane 10.

Based on this analysis, it was predicted that these proteins and their epitopes could be useful antigens for vaccines or diagnostics.

EXAMPLE 1096

A DNA sequence (GBSx1171) was identified in *S. agalactiae* <SEQ ID 3389> which encodes the amino acid sequence <SEQ ID 3390>. Analysis of this protein sequence reveals the following:

Possible site: 27
>>> Seems to have no N-terminal signal sequence

----- Final Results -----
```
              bacterial cytoplasm --- Certainty = 0.2983(Affirmative) < succ>
               bacterial membrane --- Certainty = 0.0000(Not Clear)   < succ>
                 bacterial outside --- Certainty = 0.0000(Not Clear)   < succ>
```

The protein has homology with the following sequences in the GENPEPT database.

```
>GP: BAB04222 GB: AP001508 unknown conserved protein in others
          [Bacillus halodurans]
Identities = 52/129 (40%), Positives = 70/129 (53%), Gaps = 5/129 (3%)

Query:  39 FEDWLDHNLNMELGVGVPDNFVPYIQFVSFDNDNNAIGFLNLRLRLNDTLLEKGGHIGYS   98
           FE  L   + + GV +P N V     +           IG +N+R  LND L  +GGHIGY
Sbjct:  43 FEHLLKTLKDYQHGVNLPANRVANTTYWLVHEQKRLIGAINIRHTLNDWLHHRGGHIGYG  102

Query:  99 IRPRQRGKGYAKEQLKLGIEQAHLKNINEILVTCHVDNDASKSVILANGGVLEDCLHQ--  156
           IRP +RGKGYA    LKLG+E+A    + ++L+TC +N  S    I  NGGVL+   
Sbjct: 103 IRPSERGKGYATLMLKLGLEKAAALGLEKVLITCDKENLPSARTIQRNGGVLDSEVVDER  162

Query: 157 ---TERYWI                                                    162
              +RYWI
Sbjct: 163 GIAIQRYWI                                                    171
```

A related DNA sequence was identified in *S. pyogenes* <SEQ ID 3391> which encodes the amino acid sequence <SEQ ID 3392>. Analysis of this protein sequence reveals the following:

Possible site: 59
>>> Seems to have no N-terminal signal sequence

----- Final Results -----
```
              bacterial cytoplasm --- Certainty = 0.2195(Affirmative) < succ>
               bacterial membrane --- Certainty = 0.0000(Not Clear)   < succ>
                 bacterial outside --- Certainty = 0.0000(Not Clear)   < succ>
```

An alignment of the GAS and GBS proteins is shown below.

```
Identities = 90/164 (54%), Positives = 115/164 (69%), Gaps = 4/164 (2%)

Query:   1 MKLRRPVLEDKEEILAMYKEFQKESSSVDG--GFYEPTMHFEDWLDHNLNMELGVGVPDN   58
           M++RRP L+DK+ +L+M  EF ++ S+ DG   F     ++E WL+ +L  E+G+
Sbjct:   1 MEIRRPTLKDKDAVLSMINEFLEQKSATDGLWHFNVNDFNYETWLEDSLRQEMGLS--SQ   58

Query:  59 FVPYIQFVSFDNDNNAIGFLNLRLRLNDTLLEKGGHIGYSIRPRQRGKGYAKEQLKLGIE  118
            VP IQ+V+FD + AIGFLNLRLRLN+ LLEKGGHIGYS+RP QRGKGYAKE LK  +
Sbjct:  59 GVPAIQYVAFDERSQAIGFLNLRLRLNERLLEKGGHIGYSVRPSQRGKGYAKEMLKQAVS  118

Query: 119 QAHLKNINEILVTCHVDNDASKSVILANGGVLEDCLHQTERYWI                 162
              A  KNI  ILVTC   N AS++VI+AN G+LED     TERYWI
Sbjct: 119 YAISKNITTILVTCDETNVASRAVIVANVGILEDSRGGTERYWI                 162
```

Based on this analysis, it was predicted that these proteins and their epitopes could be useful antigens for vaccines or diagnostics.

EXAMPLE 1097

A DNA sequence (GBSx1172) was identified in *S. agalactiae* <SEQ ID 3393> which encodes the amino acid sequence <SEQ ID 3394>. This protein is predicted to be anaerobic ribonucleotide reductase activator protein (nrdG). Analysis of this protein sequence reveals the following:

Possible site: 59
>>> Seems to have no N-terminal signal sequence

-continued

```
----- Final Results -----
            bacterial cytoplasm --- Certainty = 0.4239(Affirmative) < succ>
            bacterial membrane  --- Certainty = 0.0000(Not Clear)   < succ>
            bacterial outside   --- Certainty = 0.0000(Not Clear)   < succ>
```

The protein has homology with the following sequences in the GENPEPT database.

```
>GP: AAD00216 GB: U73336 anaerobic ribonucleotide reductase activator
           protein [Lactococcus lactis subsp. cremoris]
Identities = 152/198 (76%), Positives = 176/198 (88%)

Query:     8 NTPKPGEWKSEELSHGHIIDYKAFNFVDGEGVRNSLYVAGCMFHCKGCYNTATWSFRAGI    67
             N PKPGEW+++ELS  +I DYK FNFVDGEGVR SLYV+GCMFHC+GCYN ATWSFR G
Sbjct:     2 NNPKPGEWRADELSQNYIADYKPFNFVDGEGVRCSLYVSGCMFHCEGCYNQATWSFRYGR   61

Query:    68 PYTKELEDQIMTDLEQPYVQGLTLLGGEPFLNTGILLPLLQRIRRELPEKDIWSWTGYTW  127
             PYTKELED+IM DL +PYVQGLTLLGGEPFLNT  L+PLL+RIRRELP+KDIWSWTGYTW
Sbjct:    62 PYTKELEDKIMADLAEPYVQGLTLLGGEPFLNTTFLIPLLKRIRRELPDKDIWSWTGYTW  121

Query:   128 EEMMLETQDKLEMLSLIDILVDGRFDQSKRNLMLQFRGSSNQRIIDVQKSLKEGEVVIWE  187
             EEMMLET DKLEML L+D+LVDGRF+ SK+NLMLQFRGSSNQRIIDV KS  +G+VVIWE
Sbjct:   122 EEMMLETDDKLEMLDLLDVLVDGRFELSKKNLMLQFRGSSNQRIIDVPKSRSKGQVVIWE  181

Query:   188 GLNDGDNSYEQVKRDDLL                                           205
             LNDG+N++EQ+ ++ L+
Sbjct:   182 KLNDGENNFEQIHKEKLI                                           199
```

A related DNA sequence was identified in *S. pyogenes* <SEQ ID 3395> which encodes the amino acid sequence <SEQ ID 3396>. Analysis of this protein sequence reveals the following:

```
Possible site: 59
>>> Seems to have no N-terminal signal sequence

----- Final Results -----
            bacterial cytoplasm --- Certainty = 0.4111(Affirmative) < succ>
            bacterial membrane  --- Certainty = 0.0000(Not Clear)   < succ>
            bacterial outside   --- Certainty = 0.0000(Not Clear)   < succ>
```

An alignment of the GAS and GBS proteins is shown below.

```
Identities = 167/202 (82%), Positives = 186/202 (91%)

Query:     4 EASWNTPKPGEWKSEELSHGHIIDYKAFNFVDGEGVRNSLYVAGCMFHCKGCYNTATWSF    63
             E  WN PKP EW++EELS G IIDYKAFNFVDGEGVRNSLYV+GC+FHCKGCYN ATWSF
Sbjct:     4 EKCWNNPKPKEWQAEELSQGRIIDYKAFNFVDGEGVRNSLYVSGCLFHCKGCYNAATWSF   63

Query:    64 RAGIPYTKELEDQIMTDLEQPYVQGLTLLGGEPFLNTGILLPLLQRIRRELPEKDIWSWT  123
             +AG+PYT+ELE+QIMTDL QPYVQGLTLLGGEPFLNTGIL+PL++RIRRELPEKDIWSWT
Sbjct:    64 KAGMPYTQELEEQIMTDLAQPYVQGLTLLGGEPFLNTGILIPLIKRIRRELPEKDIWSWT  123

Query:   124 GYTWEEMMLETQDKLEMLSLIDILVDGRFDQSKRNLMLQFRGSSNQRIIDVQKSLKEGEV  183
             GYTWEEMMLET DKLEMLSLIDILVDGRFD +K+NLMLQFRGSSNQRIIDVQKSL   EV
Sbjct:   124 GYTWEEMMLETPDKLEMLSLIDILVDGRFDITKKNLMLQFRGSSNQRIIDVQKSLAAKEV  183

Query:   184 VIWEGLNDGDNSYEQVKRDDLL                                       205
             +IW+ LNDGD ++EQ+ R+DLL
Sbjct:   184 IIWDKLNDGDQTFEQISREDLL                                       205
```

Based on this analysis, it was predicted that these proteins and their epitopes could be useful antigens for vaccines or diagnostics.

EXAMPLE 1098

A DNA sequence (GBSx1173) was identified in *S. agalactiae* <SEQ ID 3397> which encodes the amino acid sequence <SEQ ID 3398>. Analysis of this protein sequence reveals the following:

```
Possible site: 27
>>> Seems to have no N-terminal signal sequence
    INTEGRAL    Likelihood = -3.03    Transmembrane    102-118 (101-119)

----- Final Results -----
            bacterial membrane --- Certainty = 0.2211(Affirmative) < succ>
            bacterial outside  --- Certainty = 0.0000(Not Clear)   < succ>
          bacterial cytoplasm  --- Certainty = 0.0000(Not Clear)   < succ>
```

The protein has homology with the following sequences in the GENPEPT database.

```
>GP: AAD24446 GB: AF118389 unknown [Streptococcus suis]
Identities = 97/240 (40%), Positives = 151/240 (62%), Gaps = 1/240 (0%)

Query:   2 IKILIPTAKEMKV-CQNIAWPKLSAQTKIIIDYFSTLTVSDLEDIYRINTSAARCEAQRW    60
           +KI+IP AKE+     +N ++  LS ++K ++D  S    V  +   Y++N + A  EA RW
Sbjct:   1 MKIIIPNAKEVNTNLENASFYLLSDRSKPVLDAISQFDVKKMAAFYKLNEAKAELEADRW   60

Query:  61 QDFKAKQLTLNPAIKLFNGLMYRNIKRHNLSTSEAQFMENSVFITSALYGIIPAMTLISP  120
           +  Q    PA +L++GLMYR + R  + + E  ++ + V + +ALYG+I       ISP
Sbjct:  61 YRIRTGQAKTYPAWQLYDGLMYRYMDRRGIDSKEENYLRDHVRVATALYGLIHPFEFISP  120

Query: 121 HRLDFNTKIKINNNSLKVFWRENYDTFMQSDDIMVSLLSNEFETVFSPKERQKLIHLNFI  180
           HRLDF   +KI N SLK  +WR   YD  +  D++++SL S+EFE VFSP+ +++L+ + F+
Sbjct: 121 HRLDFQGSLKIGNQSLKQYWRPYYDQEVGDDELILSLASSEFEQVFSPQIQKRLVKILFM  180

Query: 181 EDRDGQLKTHSTISKKARGKCLTAMMENNCQTLEHLKQLRFDGFCYDNELSDSKQLTFVK  240
           E++ GQLK HSTISKK RG+ L+ +  +NN Q L    ++  + DGF Y     S + QLTF++
Sbjct: 181 EEKAGQLKVHSTISKKGRGRLLSWLAKNNIQELSDIQDFKVDGFEYCTSESTANQLTFIR  240
```

A related GBS nucleic acid sequence <SEQ ID 10941> which encodes amino acid sequence <SEQ ID 10942> was also identified.

A related DNA sequence was identified in *S. pyogenes* <SEQ ID 3399> which encodes the amino acid sequence <SEQ ID 3400>. Analysis of this protein sequence reveals the following:

```
Possible site: 38
>>> Seems to have no N-terminal signal sequence

----- Final Results -----
          bacterial cytoplasm  --- Certainty = 0.3759(Affirmative) < succ>
            bacterial membrane --- Certainty = 0.0000(Not Clear)   < succ>
             bacterial outside --- Certainty = 0.0000(Not Clear)   < succ>
```

An alignment of the GAS and GBS proteins is shown below.

```
Identities = 114/242 (47%), Positives = 155/242 (63%)

Query:   1 MIKILIPTAKEMKVCQNIAWPKLSAQTKIIIDYFSTLTVSDLEDIYRINTSAARCEAQRW   60
           M+  LIPTAKEM + +       L   ++ I+   + +T DL    YRI  +A+ E QRW
Sbjct:   1 MLTFLIPTAKEMTIPKESHPHLLPQDSQAILKIMAAMTTEDLAKSYRIKEESAKKEQQRW   60

Query:  61 QDFKAKQLTLNPAIKLFNGLMYRNIKRHNLSTSEAQFMENSVFITSALYGIIPAMTLISP  120
           QD ++Q     PA +LFNGLMYR+IKR   L+T E  ++    V+ITS+ YGIIPA   I+
Sbjct:  61 QDMASQQSLAYPAYQLFNGLMYRHIKRDKLTTQEQAYLTQQVYITSSFYGIIPANHPIAE  120

Query: 121 HRLDFNTKIKINNNSLKVFWRENYDTFMQSDDIMVSLLSNEFETVFSPKERQKLIHLNFI  180
```

```
                HR DF+T+IKI    SLK +WR    Y+ F +     ++SLLS+EF+ VFS   +Q  I    F+
Sbjct:  121 HRHDFHTRIKIEGQSLKSYWRPCYNQFAKEHPQVISLLSSEFDDVFSKDCKQLWISPKFM     180

Query:  181 EDRDGQLKTHSTISKKARGKCLTAMMENNCQTLEHLKQLRFDGFCYDNELSDSKQLTFVKKQ   242
                +++GQ KTHSTISKKARG  LTA MENNCQT++ LK L F GF Y  +LS    +  ++KK+
Sbjct:  181 AEKEGQFKTHSTISKKARGAFLTACMENNCQTVDSLKSLVFAGFYYHPDLSTDHEFVYIKKK   242
```

Figure 80:
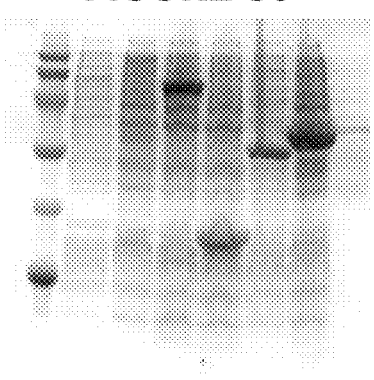

SEQ ID 3398 (GBS428) was expressed in *E. coli* as a His-fusion product. SDS-PAGE analysis of total cell extract is shown in FIG. 80 (lane 6; MW 30.4 kDa). It was also expressed in *E. coli* as a GST-fusion product. SDS-PAGE analysis of total cell extract is shown in FIG. 173 (lane 4; MW 55 kDa).

Figure 220:
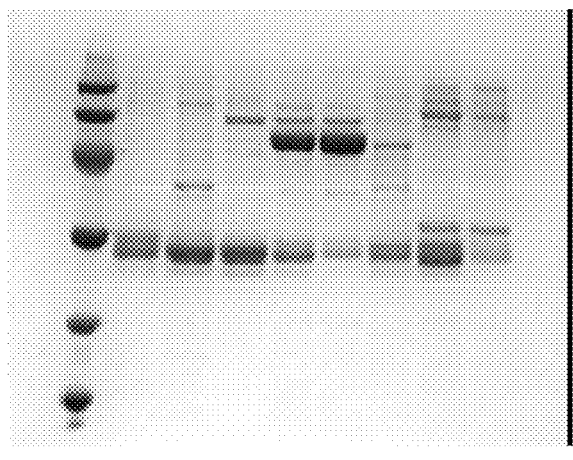

GBS428-GST was purified as shown in FIG. 220, lane 6-7.

Based on this analysis, it was predicted that these proteins and their epitopes could be useful antigens for vaccines or diagnostics.

EXAMPLE 1099

A DNA sequence (GBSx1174) was identified in *S. agalactiae* <SEQ ID 3401> which encodes the amino acid sequence <SEQ ID 3402>. Analysis of this protein sequence reveals the following:

```
Possible site: 23
>>> Seems to have an uncleavable N-term signal seq
        INTEGRAL      Likelihood = -0.59      Transmembrane     3-19  (3-19)

----- Final Results -----
               bacterial membrane --- Certainty = 0.1235(Affirmative) < succ>
                bacterial outside --- Certainty = 0.0000(Not Clear)   < succ>
              bacterial cytoplasm --- Certainty = 0.0000(Not Clear)   < succ>
```

A related GBS nucleic acid sequence <SEQ ID 10251> which encodes amino acid sequence <SEQ ID 10252> was also identified.

The protein has homology with the following sequences in the GENPEPT database.

```
>GP: BAB07024 GB: AP001518 unknown conserved
protein [Bacillus halodurans]
Identities = 86/275 (31%), Positives = 143/275 (51%), Gaps = 6/275 (2%)

Query:   17 MSYPYKANHSIESITLKVNDLENLVNFYSDIIGLTVIDKSSTRALLGVNQKIPLIILEKT    76
            M +   + N  ++ + +KV+DL    + FY +IIG  V+++S    A L  N + PL+++E+
Sbjct:    1 MEFHRQPNTFVDLVNIKVSDLSRALTFYQEIIGFQVLERSERSATLTANGRTPLLVIEQP    60

Query:   77 E---LEKHSTYGLYHTAILVPDEYHLSLALNHLLSQHIPLEGGADHGYSNAIYLSDPEGN   133
                +    ++  T GLYH A+L+P       L    LNHLL    PL+G  +DH  S AIY +DP+GN
Sbjct:   61 DPVIAKQPRTTGLYHFALLLPSRADLGRFLNHLLQSGYPLQGASDHLVSEAIYFADPDGN   120

Query:  134 GIEIYNDKDISMWDIRESGQIIGITERLDIDNLLDSLVNVPNNYKLSEKTSIGHIHLSVK   193
               G+E+Y D+  S WD   +G++     TE +  +NLL        + P    L  +T +GHIHL V
Sbjct:  121 GVEVYADRPSSSWD-WSNGEVKMSTEPIHAENLLAEGKDEPWT-ALPPETILGHIHLHVA   178

Query:  194 DAKISSKLYQNVFGLDEKFAIPT-ASWIASGNYHHHLAFNNWAGPNLSKNQEDRPGISLL   252
                +    +   Y    G +     +  A +I++GNYHHH+  N W G         E    G+
Sbjct:  179 NLFEAETFYIEGLGFNVVARLGNQALFISTGNYHHHIGLNTWNGVGAPTPPENSVGLKWF   238

Query:  253 TIAYNDDNLFRDSLKKAQLYQLTFLEKQDHYYIIE                           287
                ++ Y  + +    ++ + +       K     ++I+
Sbjct:  239 SLTYPSEEVRAKTVNRLETIGFQVERKHGEEWVID                           273
```

A related DNA sequence was identified in *S. pyogenes* <SEQ ID 3403> which encodes the amino acid sequence <SEQ ID 3404>. Analysis of this protein sequence reveals the following:

```
Possible site: 38
>>> Seems to have no N-terminal signal sequence
```

```
----- Final Results -----
           bacterial cytoplasm --- Certainty = 0.0936(Affirmative) < succ>
           bacterial membrane  --- Certainty = 0.0000(Not Clear)   < succ>
           bacterial outside   --- Certainty = 0.0000(Not Clear)   < succ>
```

An alignment of the GAS and GBS proteins is shown below.

```
Identities = 143/282 (50%), Positives = 194/282 (68%)

Query:  17 MSYPYKANHSIESITLKVNDLENLVNFYSDIIGLTVIDKSSTRALLGVNQKIPLIILEKT   76
           M YPY + S+ +++L V DL +  FY+ IIGL V+ + +T   L  + K ++ L +T
Sbjct:   1 MIYPYNSTISLGTVSLNVTDLAKMTTFYTSIIGLQVLSQDTTSRQLTTDGKTVILELRQT   60

Query:  77 ELEKHSTYGLYHTAILVPDEYHLSLALNHLLSQHIPLEGGADHGYSNAIYLSDPEGNGIE  136
           L     YGLYHTA LVPD + L L LNH L++ I LEG ADHG+S AIYLSDPEGNGIE
Sbjct:  61 PLPGDKAYGLYHTAFLVPDRHSLGLVLNHFLTRSISLEGAADHGHSEAIYLSDPEGNGIE  120

Query: 137 IYNDKDISMWDIRESGQIIGITERLDIDNLLDSLVNVPNNYKLSEKTSIGHIHLSVKDAK  196
           IY+DK +  WDIR++GQIIG+TE  D  ++L+ L ++P ++ L++ T I H+HLSVK+A
Sbjct: 121 IYHDKAVEHWDIRDNGQIIGVTEPTDTKSILEQLTDIPKHFLLAQDTRIRHVHLSVKNAL  180

Query: 197 ISSKLYQNVFGLDEKFAIPTASWIASGNYHHHLAFNNWAGPNLSKNQEDRPGISLLTIAY  256
              SS LYQ VF L +K  IP+ASWIASGNY+HHLAFN+W+ P L K+QE  PG++ LTI
Sbjct: 181 ASSLLYQKVFDLGDKMTIPSASWIASGNYYHHLAFNHWSAPYLKKHQEGAPGLAFLTIHI  240

Query: 257 NDDNLFRDSLKKAQLYQLTFLEKQDHYYIIEDFDGIRIKVVL                   298
           LF  +LKKA+L+ L  L++    +  ED +GIR+ V+L
Sbjct: 241 ETPLLFSATLKKARLHGLAILQEDSSSFTTEDEEGIRVNVIL                   282
```

SEQ ID 3402 (GBS429) was expressed in *E. coli* as a His-fusion product. SDS-PAGE analysis of total cell extract is shown in FIG. 80 (lane 7; MW 34.2 kDa).

Figure 214:
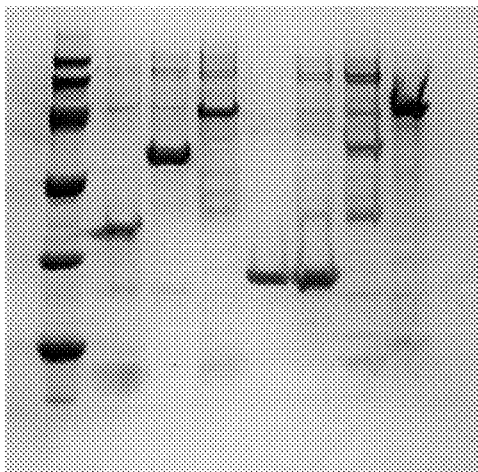

GBS429-His was purified as shown in FIG. 214, lane 9.

Based on this analysis, it was predicted that these proteins and their epitopes could be useful antigens for vaccines or diagnostics.

EXAMPLE 1100

A DNA sequence (GBSx1175) was identified in *S. agalactiae* <SEQ ID 3405> which encodes the amino acid sequence <SEQ ID 3406>. Analysis of this protein sequence reveals the following:

```
Possible site: 59
>>> Seems to have no N-terminal signal sequence

----- Final Results -----
           bacterial cytoplasm --- Certainty = 0.2362(Affirmative) < succ>
           bacterial membrane  --- Certainty = 0.000(Not Clear)    < succ>
           bacterial outside   --- Certainty = 0.0000(Not Clear)   < succ>
```

A related GBS nucleic acid sequence <SEQ ID 10249> which encodes amino acid sequence <SEQ ID 10250> was also identified.

The protein has homology with the following sequences in the GENPEPT database.

```
>GP: AAC21682 GB: U32686 conserved hypothetical
protein [Haemophilus influenzae Rd]
Identities = 89/261 (34%), Positives = 151/261 (57%), Gaps = 4/261 (1%)

Query:  10 MVRLIFSDIDGTLINSNFKVTPKTRQGIKQIVAQGATFVPISARMPEAITPIMEQIGIDS   69
           M + +FSD +GTL+ S    ++P+T   IK++ A G  FVPISAR P  I P +Q+ ++
Sbjct:   2 MYKAVFSDFNGTLLTSQHTISPRTVVVIKRLTANGIPFVPISARSPLGILPYWKQLETNN   61

Query:  70 YIISYNGALIQDMQQKTIASHTMDGQVALQVCSYVSKHYSKIAWNVYRYHEWYSCDKENE  129
           +++++GALI +   + I S ++ +   L++ +  +++H   + N Y ++ ++ D EN+
Sbjct:  62 VLVAFSGALILNQNLEPIYSVQIEPKDILEINTVLAEH-PLLGVNYYTNNDCHARDVENK  120

Query: 130 WVQKEEEIVGLQSKEMSLMELEKQDRIHKLLLMGEPSLMGELENTLKAQYPHLSIAQSAP  189
           WV  E +  ++       +     HK+ ++GE   E+E  LK ++PHLSI +S
Sbjct: 121 WVIYERSVTKIEIHPFDEVATRSP---HKIQIIGEAEEIIEIEVLLKEKFPHLSICRSHA  177

Query: 190 YFIEIMAPGIEKGKSAKTLADYLDISLADSIAFGDNYNDLNLLEIVGKGFVMGNAPKDLQ  249
           F+E+M    KG + + L DY +     IAFGDN+NDL++LE VG G  MGNAP +++
Sbjct: 178 NFLEVMHKSATKGSAVRFLEDYFGVQTNEVIAFGDNFNDLDMLEHVGLGVAMGNAPNEIK  237
```

```
Query: 250 ERIGNVTQDNDNDGIYYALVE                                270
          +    VT  N+ DG+    L E
Sbjct: 238 QAANVVTATNNEDGLALILEE                                258
```

Based on this analysis, it was predicted that these proteins and their epitopes could be useful antigens for vaccines or diagnostics.

EXAMPLE 1101

A DNA sequence (GBSx1176) was identified in *S. agalactiae* <SEQ ID 3409> which encodes the amino acid sequence <SEQ ID 3410>. Analysis of this protein sequence reveals the following:

```
Possible site: 19
>>> May be a lipoprotein

----- Final Results -----
              bacterial membrane --- Certainty = 0.0000(Not Clear) < succ>
              bacterial outside  --- Certainty = 0.0000(Not Clear) < succ>
              bacterial cytoplasm --- Certainty = 0.0000(Not Clear) < succ>
```

The protein has homology with the following sequences in the GENPEPT database.

```
>GP: AAG07223 GB: AE004801 hypothetical protein [Pseudomonas aeruginosa]
Identities = 103/283 (36%), Positives = 165/283 (57%), Gaps = 1/283 (0%)

Query:  33 KHIGILQYVEHPSLTATRKGFIKELAKEGYKDGKNIKIEYKNAQGDQSNIQSISEKLIKD   92
           K + +   VEHP+L A R G  + L + GY+DGKN+K +Y++AQG+       I+ K I D
Sbjct:  31 KSVAVTAIVEHPALDAARDGVKEALQEAGYEDGKNLKWQYQSAQGNTGTAAQIARKFIGD   90

Query:  93 NK-LVLGIATPAAQSLTTVSTETPILFTAVTDPVSAELVKSMKKPEGLATGTSDMSPIKK  151
              +++GIATP+AQ+L  +      PI+F+ VTDPV A L  S +      TG SDM  + K
Sbjct:  91 KPDVIVGIATPSAQALVAATKSIPIVFSTVTDPVGAHLTPSWEASGTNVTGVSDMLALDK  150

Query: 152 QVSLLRKVMPKVKRVGIMYTTSERNSEVQVKQAKKIFQEAGIKTSVKGISSTNDVQDTAK  211
           Q+ L++KV+P  KR+G++Y    E NS V VK+ K++   + G+         + DV   A+
Sbjct: 151 QIELIKKVVPGAKRIGMVYNPGEANSVVVVKELKELLPKMGLSLVEASAPRSVDVSSAAR  210

Query: 212 SLMSKTEVIFVPTDNIIASSVTLLGNLSKELKVPVVGGSADMVPSGLLFSYGADYEALGR  271
           SL+ K + I+  TDN + S+   L +   + K+P++    D V  G + + G +Y+ +G+
Sbjct: 211 SLVGKVDAIYTNTDNNVVSAYEALVKVGNDAKIPLIASDTDSVKRGAIAALGINYKEMGK  270

Query: 272 QTARQAVKILKGKDVAKVPSEYPQNLKVVVNEDMAKELGIDVS                  314
           QT R  V+ILKG+   ++   E    NL++ VN    A++ G+ +S
Sbjct: 271 QTGRMVVRILKGEKPGEIKPETSDNLQLFVNPGAAQKQGVTLS                  313
```

There is also homology to SEQ ID 2712.

SEQ ID 3410 (GBS188) was expressed in *E. coli* as a His-fusion product. SDS-PAGE analysis of total cell extract is shown in FIG. 39 (lane 2; MW 36.6 kDa).

Figure 247:
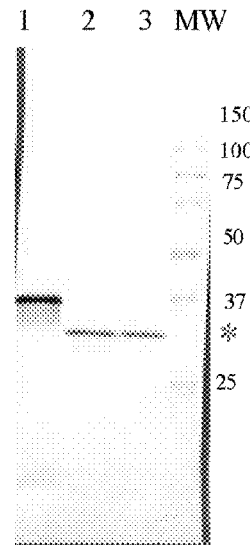

The GBS188-His fusion product was purified (FIG. 204, lane 6) and used to immunise mice. The resulting antiserum was used for Western blot (FIG. 247), FACS, and in the in vivo passive protection assay (Table III). These tests confirm that the protein is immunoaccessible on GBS bacteria and that it is an effective protective immunogen.

Based on this analysis, it was predicted that this protein and its epitopes, could be useful antigens for vaccines or diagnostics.

EXAMPLE 1102

A DNA sequence (GBSx1177) was identified in *S. agalactiae* <SEQ ID 3411> which encodes the amino acid sequence <SEQ ID 3412>. This protein is predicted to be probable permease of ABC transporter (rbsC). Analysis of this protein sequence reveals the following:

```
Possible site: 21
>>> Seems to have a cleavable N-term signal seq.
         INTEGRAL   Likelihood = -16.13    Transmembrane   132-148 (124-160)
         INTEGRAL   Likelihood =  -6.42    Transmembrane   241-257 (238-258)
         INTEGRAL   Likelihood =  -6.32    Transmembrane   264-280 (260-284)
         INTEGRAL   Likelihood =  -6.00    Transmembrane   213-229 (207-235)
         INTEGRAL   Likelihood =  -4.67    Transmembrane    58-74  (57-75)
         INTEGRAL   Likelihood =  -1.38    Transmembrane    36-52  (36-52)
         INTEGRAL   Likelihood =  -0.85    Transmembrane    90-106 (87-106)
```

-continued

```
----- Final Results -----
            bacterial membrane --- Certainty = 0.7453(Affirmative) < succ>
            bacterial outside  --- Certainty = 0.0000(Not Clear)   < succ>
           bacterial cytoplasm --- Certainty = 0.0000(Not Clear)   < succ>
```

The protein has homology with the following sequences in the GENPEPT database.

```
>GP: AAG07224 GB: AE004801 probable permease of ABC transporter
[Pseudomonas aeruginosa]
Identities = 114/285 (40%), Positives = 175/285 (61%), Gaps = 3/285 (1%)

Query:    5 ILSGISQGLLWSIMAIGVFITFRILDIADLSAEGAFPMGAAVCALCIVNDINPIVATIAG   64
            +   +   GL++S++A+GVFI+FR+L   DL+ +G+FP+G AVCA  I    +P  AT+A
Sbjct:    6 LFGALEIGLIFSLVALGVFISFRLLRFPDLTVDGSFPLGGAVCATLIALGWDPYSATLAA   65

Query:   65 MLGGMLAGLVSGFLHTKMKIPALLTGIITLTGLYSINLLVLGRSNVSFALKNTLVTMVTR  124
            G LAGL +G L+ K+KI  LL  I+ +  LYSINL ++G+ NV    + TL T++
Sbjct:   66 TAAGALAGLATGLLNVKLKIMDLLASILMMIALYSINLRIMGKPNVPLIAEPTLFTLLQP  125

Query:  125 LGLNKLSAVLLIGIVCVGLVLILYLFLNTQLGLALRATGDNEAMGQANSIKVDRMKMLG  184
            L+      L+ + V   L+L   F  TQ GLA+RATG N   M +A   +    M +LG
Sbjct:  126 EWLSDYVFRPLLLVFIVIAAKLLLDWFFTTQKGLAIRATGSNPRMARAQGVNTGGMILLG  185

Query:  185 YMIGNGLIALSGALLAQNNGYADLNMGVGTIVIGLASIILAEVMIKYLPLGKRLWSIVLG  244
            +   I N L+AL+GAL AQ  G AD++MG+GTIVIGLA++I+ E ++     L    +++LG
Sbjct:  186 MAISNALVALAGALFAQTQGGADISMGIGTIVIGLAAVIVGESILPSRRLILATLAVILG  245

Query:  245 SVLYRMIIVFILTTD---IDAQMIKLVSAILLALILYVPELRAKL              286
            +++YR  I    L +D    + AQ + LV+A+L+ + L +P ++ +L
Sbjct:  246 AIVYRFFIALALNSDFIGLQAQDLNLVTAVLVTVALVIPMMKKRL              290
```

There is also homology to SEQ ID 2716.

Based on this analysis, it was predicted that this protein and its epitopes, could be useful antigens for vaccines or diagnostics.

EXAMPLE 1103

A DNA sequence (GBSx1178) was identified in *S. agalactiae* <SEQ ID 3413> which encodes the amino acid sequence <SEQ ID 3414>. This protein is predicted to be ABC transporter. Analysis of this protein sequence reveals the following:

```
Possible site: 41
>>> Seems to have no N-terminal signal sequence

----- Final Results -----
           bacterial cytoplasm --- Certainty = 0.3798(Affirmative) < succ>
            bacterial membrane --- Certainty = 0.0000(Not Clear)   < succ>
            bacterial outside  --- Certainty = 0.0000(Not Clear)   < succ>
```

The protein has homology with the following sequences in the GENPEPT database.

```
>GP: AAF86640 GB: AF162694 ABC transporter [Enterococcus gallinarum]
Identities = 171/264 (64%), Positives = 213/264 (79%), Gaps = 1/264 (0%)

Query:    3 LLELVNLHKTFEKGTVNENHVLRGLDLTIEDGDFISVIGGNGAGKSTLLNCIAGLIPIDQ   62
            +L + +LH+TFEKGT+NENHVLRG+DLT   GDFI++IGGNGAGKSTLLN IAG IP +Q
Sbjct:    5 VLTISDLHQTFEKGTINENHVLRGIDLTMNSGDFITIIGGNGAGKSTLLNSIAGTIPTEQ   64

Query:   63 GAITLDNQSITKDSVEKRSKDISRVFQDPRMGTATNLTIEENMAIAHKRGNKRHIFRQSV  122
            G  I L ++  IT+  SV +RSK+ISRVFQDPRMGTA  LT+EEN+A+A+KRG   R F    V
Sbjct:   65 GKIVLGDKEITRHSVTRRSKEISRVFQDPRMGTAVRLTVEENLALAYKRGQVRG-FSSGV  123

Query:  123 TDDDRQLFKKSLSQLGLGLENRMKTDAAFLSGGQRQALTLAMATLVRPKLLLLDEHTAAL  182
                 R   FK+ L++L LGLENR+ T+   LSGGQRQA+TL MATL +PKL+LLDEHTAAL
Sbjct:  124 KGKHRAFFKEKLARLNLGLENRLTTEIGLLSGGQRQAITLLMATLQQPKLILLDEHTAAL  183
```

-continued

```
Query:  183 DPKTSDMVMELTQKVIEEQRLTALMITHNMEHAIAYGNRLVMLYHGKIVVDVKGEAKRNL  242
            DPKTS  VM LT ++I+EQ+LTA M+TH+ME AI YGNRL+ML+ GKIVVD+ GE K++L
Sbjct:  184 DPKTSMTVMALTDQLIQEQQLTAFMVTHDMEDAIRYGNRLIMLHQGKIVVDITGEEKQSL  243

Query:  243 TVAELMELFHKNSGQQLIDDALVL                                     266
            TV +LM LFH+NSG +L DD L+L
Sbjct:  244 TVPDLMALFHQNSGTELKDDQLLL                                     267
```

There is also homology to SEQ ID 2720:

```
Identities = 116/249 (46%), Positives = 166/249 (66%), Gaps = 1/249 (0%)

Query:    3 LLELVNLHKTFEKGTVNENHVLRGLDLTIEDGDFISVIGGNGAGKSTLLNCIAGLIPIDQ   62
            ++EL+N     + G  +   +L   + LTI + DF++++GGNGAGKSTL N IAG + + +
Sbjct:    4 IIELINATVDVDNGFEDAKTILDNVTLTIYEHDFLTILGGNGAGKSTLFNVIAGTLSLTR   63

Query:   63 GAITLDNQSITKDSVEKRSKDISRVFQDPRMGTATNLTIEENMAIAHKRGNKRHIFRQSV  122
              G I +   Q +T    EKR+  +SRVFQD +MGTA  +T+ EN+ IA +RG KR +   + +
Sbjct:   64 GQIRILGQDVTHWPAEKRALYLSRVFQDSKMGTAPRMTVAENLLIARQRGGKRSLASRKI  123

Query:  123 TDDDRQLFKKSLSQLGLGLENRMKTDAAFLSGGQRQALTLAMATLVRPKLLLLDEHTAAL  182
            T+       F+  + + G GLE  ++T A  LSGGQRQAL+L MATL +P LLLLDEHTAAL
Sbjct:  124 TEHLAS-FEDLVKRTGNGLEKHLETPAGLLSGGQRQALSLLMATLKKPALLLLDEHTAAL  182

Query:  183 DPKTSDMVMELTQKVIEEQRLTALMITHNMEHAIAYGNRLVMLYHGKIVVDVKGEAKRNL  242
            DPKTS  +M+LT + + +  LTALMITH+ME A+ YGNRL+++  G I+ D+       K   L
Sbjct:  183 DPKTSQSLMQLTDEFVTKDGLTALMITHHMEDALTYGNRLIVMKDGNIIKDLNQMEKEQL  242

Query:  243 TVAELMELF                                                    251
            T+ +   +LF
Sbjct:  243 TITDYYQLF                                                    251
```

Based on this analysis, it was predicted that this protein and its epitopes, could be useful antigens for vaccines or diagnostics.

EXAMPLE 1104

A DNA sequence (GBSx1179) was identified in *S. agalactiae* <SEQ ID 3415> which encodes the amino acid sequence <SEQ ID 3416>. This protein is predicted to be mannose-specific phosphotransferase system component IIAB. Analysis of this protein sequence reveals the following:

```
Possible site: 54
>>> Seems to have no N-terminal signal sequence

----- Final Results -----
            bacterial cytoplasm --- Certainty = 0.3527(Affirmative) < succ>
             bacterial membrane --- Certainty = 0.0000(Not Clear)   < succ>
              bacterial outside --- Certainty = 0.0000(Not Clear)   < succ>
```

The protein has homology with the following sequences in the GENPEPT database.

```
>GP: AAD46485 GB: AF130465 mannose-specific phosphotransferase system
component IIAB [Streptococcus salivarius]
Identities = 287/336 (85%), Positives = 306/336 (90%), Gaps = 6/336 (1%)

Query:    1 MGIGIIIASHGKFAEGIHQSGSMIFGEQEKVQVVTFMPNEGPDDLYGHFNNAIAQFDADD   60
            MGIGIIIASHGKFAEGIHQSGSMIFG+QEKVQVVTFMP+EGPDDLY HFN+AIAQFDADD
Sbjct:    1 MGIGIIIASHGKFAEGIHQSGSMIFGDQEKVQVVTFMPSEGPDDLYAHFNDAIAQFDADD   60

Query:   61 EVLVLADLWSGSPFNQASRVMGENPERKMAIITGLNLPMLIQAYTERMMDANAGVEQVAA  120
            E+LVLADLWSGSPFNQASR+ GENP+RK+AIITGLNLPMLIQAYTERMMDANA  EQVAA
Sbjct:   61 EILVLADLWSGSPFNQASRIAGENPDRKIAIITGLNLPMLIQAYTERMMDANATAEQVAA  120

Query:  121 NIIKESKEGIKALPEELNPVVEATPVAGVPADVPAEVKQSGSIPEGTVIGDGKLKINLAR  180
            NIIKE+K GIKALPEELNP  E T  A V A P         G+IPEGTVIGDGKLKINLAR
Sbjct:  121 NIIKEAKGGIKALPEELNPAEETT-AAPVEAAAP-----QGAIPEGTVIGDGKLKINLAR  174

Query:  181 IDTRLLHGQVATAWTPASKANRIIVASDEVSKDELRKQLIKQAAPGGVKANVVPISKLIE  240
            +DTRLLHGQVAT WTPASKA+RIIVASD+V+KDELRK+LIKQAAP GVKANVVPI KLI+
```

```
                               -continued
Sbjct:  175 LDTRLLHGQVATNWTPASKADRIIVASDDVAKDELRKELIKQAAPNGVKANVVPIQKLID  234

Query:  241 VAKDPRFGNTRALILFETVQDALRAIEGGVEIPELNVGSMAHSTGKTMVNNVLSMDKDDV  300
            +KDPRFGNT ALILFETVQDALRAIEGGV I ELNVGSMAHSTGKTMVNNVLSMDKDDV
Sbjct:  235 ASKDPRFGNTHALILFETVQDALRAIEGGVPIKELNVGSMAHSTGKTMVNNVLSMDKDDV  294

Query:  301 AAFEKLRDLGVSFDVRKVPNDAKKNLFDLINKANVK                          336
            A FEKLRDLGV FDVRKVPND+KK+LFDLI KANV+
Sbjct:  295 ACFEKLRDLGVEFDVRKVPNDSKKDLFDLIKKANVQ                          330
```

A related DNA sequence was identified in *S. pyogenes* <SEQ ID 3417> which encodes the amino acid sequence <SEQ ID 3418>. Analysis of this protein sequence reveals the following:

```
Possible site: 14
>>> Seems to have no N-terminal signal sequence

----- Final Results -----
            bacterial cytoplasm --- Certainty = 0.3533(Affirmative) < succ>
            bacterial membrane  --- Certainty = 0.0000(Not Clear)   < succ>
            bacterial outside   --- Certainty = 0.0000(Not Clear)   < succ>
```

An alignment of the GAS and GBS proteins is shown below.

```
Identities = 288/336 (85%), Positives = 308/336 (90%), Gaps = 6/336 (1%)

Query:    1 MGIGIIIASHGKFAEGIHQSGSMIFGEQEKVQVVTFMPNEGPDDLYGHFNNAIAQFDADD   60
            MGIGIIIASHGKFAEGIHQSGSMIFGEQEKVQVVTFMPNEGPDDLYGHFNNAI QFDADD
Sbjct:    1 MGIGIIIASHGKFAEGIHQSGSMIFGEQEKVQVVTFMPNEGPDDLYGHFNNAIQQFDADD   60

Query:   61 EVLVLADLWSGSPFNQASRVMGENPERKMAIITGLNLPMLIQAYTERMMDANAGVEQVAA  120
            E+LVLADLWSGSPFNQASRV GENP+RKMAIITGLNLPMLIQAYTER+MDA GVEQVAA
Sbjct:   61 EILVLADLWSGSPFNQASRVAGENPDRKMAIITGLNLPMLIQAYTERLMDAGAGVEQVAA  120

Query:  121 NIIKESKEGIKALPEELNPVVEATPVAGVPADVPAEVKQSGSIPEGTVIGDGKLKINLAR  180
            NIIKESK+GIKALPE+LNPV E        V  +       G+IP GTVIGDGKLKINLAR
Sbjct:  121 NIIKESKDGIKALPEDLNPVEETAATEKVVNAL------QGAIPAGTVIGDGKLKINLAR  174

Query:  181 IDTRLLHGQVATAWTPASKANRIIVASDEVSKDELRKQLIKQAAPGGVKANVVPISKLIE  240
            +DTRLLHGQVATAWTPASKA+RIIVASDEV++D+LRKQLIKQAAPGGVKANVVPISKLIE
Sbjct:  175 VDTRLLHGQVATAWTPASKADRIIVASDEVAQDDLRKQLIKQAAPGGVKANVVPISKLIE  234

Query:  241 VAKDPRFGNTRALILFETVQDALRAIEGGVEIPELNVGSMAHSTGKTMVNNVLSMDKDDV  300
            +KDPRFGNT ALILF+T QDALRA+EGGVEI ELNVGSMAHSTGKTMVNNVLSMDK+DV
Sbjct:  235 ASKDPRFGNTHALILFQTPQDALRAVEGGVEINELNVGSMAHSTGKTMVNNVLSMDKEDV  294

Query:  301 AAFEKLRDLGVSFDVRKVPNDAKKNLFDLINKANVK                          336
            A FEKLRDLGV+FDVRKVPND+KKNLF+LI K N+K
Sbjct:  295 ATFEKLRDLGVTFDVRKVPNDSKKNLFELIQKTNIK                          330
```

Based on this analysis, it was predicted that these proteins and their epitopes could be useful antigens for vaccines or diagnostics.

EXAMPLE 1105

A DNA sequence (GBSx1180) was identified in *S. agalactiae* <SEQ ID 3419> which encodes the amino acid sequence <SEQ ID 3420>. Analysis of this protein sequence reveals the following:

```
Possible site: 52
>>> Seems to have no N-terminal signal sequence

----- Final Results -----
            bacterial cytoplasm --- Certainty = 0.3873(Affirmative) < succ>
            bacterial membrane  --- Certainty = 0.0000(Not Clear)   < succ>
            bacterial outside   --- Certainty = 0.0000(Not Clear)   < succ>
```

The protein has homology with the following sequences in the GENPEPT database.

```
>GP: BAB06625 GB: AP001517 unknown conserved protein [Bacillus halodurans]
Identities = 89/267 (33%), Positives = 139/267 (51%), Gaps = 3/267 (1%)

Query:   3 KKIIAVDLDGTLLHNNNTISDYTADTLRKVQAQGHKVIITTGRPYRMALAHYLRLDLKTP    62
           + +IA+DLDGTLL +N TIS  T  T++K +  GH V+I+TGRPYR ++ +Y  L L T
Sbjct:   4 RHLIALDLDGTLLTDNKTISMKTKQTIQKAREAGHIVVISTGRPYRASIQYYQELQLDTA   63

Query:  63 MINFNGALTHIPEKKWAFERSATIDKKLLLETLNLSDAIQADFIASEYRKNFYITMDNRD  122
           ++NFNGA  H P+         ++     + +    +A     I  E    ++Y+     D
Sbjct:  64 IVNFNGAFVHHPKDSSFGTYHHPLELSTARQVIETCEAFDVSNIMVEVIDDYYLRY--YD  121

Query: 123 KINPQLFGVNEITDKMALDVTKITRNPNALLMQTRHKDKYELAKELRQHFNHELEVDSWG  182
           ++  Q F    +       + K+ +P  +L+ +        EL  L         ++  +WG
Sbjct: 122 ELFIQTFTEGQGPVEHGNLLKKLRDDPTCVLIHPKDDHVSELRSLLDGAHAEVIDQRTWG  181

Query: 183 GPLNILEFSPKGVNKAYALKHLLKSLNLSQENLIAFGDEHNDTEMLAFAHTGYAMKNANP  242
               P N++E     G+NKA  LK +     + +E +IAFGDE ND EM+ +A   G AM NA
Sbjct: 182 APWNVIEIVKAGMNKAVGLKRIADYYQVPKERIIAFGDEDNDFEMIEYAGKGVAMANAID  241

Query: 243 TLLPYADQQIQWTNEEDGVAKTLEKLL                                   269
           L   A+  I  +NE+DG+A  LE+ L
Sbjct: 242 PLKALAN-DITLSNEDDGIAVYLEEAL                                   267
```

A related DNA sequence was identified in *S. pyogenes* <SEQ ID 3421> which encodes the amino acid sequence <SEQ ID 3422>. Analysis of this protein sequence reveals the following:

```
Possible site: 50
>>> Seems to have no N-terminal signal sequence

----- Final Results -----
            bacterial cytoplasm --- Certainty = 0.4380(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below.

```
Identities = 188/270 (69%), Positives = 224/270 (82%)

Query:   1 MTKKIIAVDLDGTLLHNNNTISDYTADTLRKVQAQGHKVIITTGRPYRMALAHYLRLDLK   60
           MTKK+IA+DLDGTLLH++NTIS YT  T++ VQ +GH VII+TGRPYRNAL +YL+L+LK
Sbjct:   1 MTKKLIAIDLDGTLLHHDNTISTYTQKTIKAVQDKGHHVIISTGRPYRMALGYYLQLNLK   60

Query:  61 TPMINFNGALTHIPEKKWAFERSATIDKKLLLETLNLSDAIQADFIASEYRKNFYITMDN  120
           TP+I  FNGALTH+PE+KWA+E +  T+DK  LL   L    D  Q DFIASEYRKN YITM N
Sbjct:  61 TPIITFNGALTHMPEQKWAYEHNVTLDKGYLLRLLKYQDDFQMDFIASEYRKNVYITMTN  120

Query: 121 RDKINPQLFGVNEITDKMALDVTKITRNPNALLMQTRHKDKYELAKELRQHFNHELEVDS  180
              +  I+PQLFGV+EIT   MAL++TKITRNPNALLMQT H+DKY LAK +R   F   E+E+DS
Sbjct: 121 PESIDPQLFGVDEITQDMALEITKITRNPNALLMQTHHEDKYALAKNMRACFKDEIEIDS  180

Query: 181 WGGPLNILEFSPKGVNKAYALKHLLKSLNLSQENLIAFGDEHNDTEMLAFAHTGYAMKNA  240
           WGGPLNILE S K VNKAYAL +LL    N+ +++LIAFGDENNDTEMLAFA TGYAMKNA
Sbjct: 181 WGGPLNILEISSKNVNKAYALNYLLGIYNMDKKDLIAFGDEHNDTEMLAFAGTGYAMKNA  240

Query: 241 NPTLLPYADQQIQWTNEEDGVAKTLEKLLL                                270
           +P LLPYADQQ+ ++NEEDGVAK LE+L L
Sbjct: 241 SPVLLPYADQQLNFSNEEDGVAKKLEELFL                                270
```

Based on this analysis, it was predicted that these proteins and their epitopes could be useful antigens for vaccines or diagnostics.

EXAMPLE 1106

A DNA sequence (GBSx1181) was identified in *S. agalactiae* <SEQ ID 3423> which encodes the amino acid sequence <SEQ ID 3424>. Analysis of this protein sequence reveals the following:

```
Possible site: 39
>>> Seems to have an uncleavable N-term signal seq
     INTEGRAL    Likelihood = -7.38    Transmembrane    96-112 (90-119)
     INTEGRAL    Likelihood = -6.58    Transmembrane    28- 44 (27-47)
     INTEGRAL    Likelihood = -6.26    Transmembrane   176-192 (174-193)
     INTEGRAL    Likelihood = -5.26    Transmembrane   127-143 (126-144)
     INTEGRAL    Likelihood = -1.59    Transmembrane     4- 20 (3-20)
     INTEGRAL    Likelihood = -0.22    Transmembrane    60- 76 (59-78)

----- Final Results -----
          bacterial membrane --- Certainty = 0.3951(Affirmative) < succ>
           bacterial outside --- Certainty = 0.0000(Not Clear) < succ>
         bacterial cytoplasm --- Certainty = 0.0000(Not Clear) < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1107

A DNA sequence (GBSx1182) was identified in *S. agalactiae* <SEQ ID 3425> which encodes the amino acid sequence <SEQ ID 3426>. Analysis of this protein sequence reveals the following:

```
Possible site: 31
>>> Seems to have no N-terminal signal sequence

----- Final Results -----
         bacterial cytoplasm --- Certainty = 0.2025(Affirmative) < succ>
          bacterial membrane --- Certainty = 0.0000(Not Clear) < succ>
           bacterial outside --- Certainty = 0.0000(Not Clear) < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1108

A DNA sequence (GBSx1183) was identified in *S. agalactiae* <SEQ ID 3427> which encodes the amino acid sequence <SEQ ID 3428>. This protein is predicted to be an integral membrane protein. Analysis of this protein sequence reveals the following:

```
Possible site: 22
>>> Seems to have a cleavable N-term signal seq.
     INTEGRAL    Likelihood = -5.41    Transmembrane   180-196 (179-199)
     INTEGRAL    Likelihood = -5.31    Transmembrane    96-112 (94-114)
     INTEGRAL    Likelihood = -2.18    Transmembrane   129-145 (129-145)
     INTEGRAL    Likelihood = -1.33    Transmembrane    37- 53 (37-53)

----- Final Results -----
          bacterial membrane --- Certainty = 0.3166(Affirmative) < succ>
           bacterial outside --- Certainty = 0.0000(Not Clear) < succ>
         bacterial cytoplasm --- Certainty = 0.0000(Not Clear) < succ>
```

A related GBS nucleic acid sequence <SEQ ID 8729> which encodes amino acid sequence <SEQ ID 8730> was also identified. Analysis of this protein sequence reveals the following:

```
Lipop: Possible site: -1 Crend: 7
McG: Discrim Score: 5.85
GvH: Signal Score (-7.5): -2.39
     Possible site: 18
>>> Seems to have a cleavable N-term signal seq.
ALOM program count: 4 value: -5.41 threshold: 0.0
    INTEGRAL     Likelihood = -5.41    Transmembrane    176-192 (175-195)
    INTEGRAL     Likelihood = -5.31    Transmembrane     92-108  (90-110)
    INTEGRAL     Likelihood = -2.18    Transmembrane    129-145 (129-145)
    PERIPHERAL   Likelihood =  0.05        57
modified ALOM score: 1.58
*** Reasoning Step: 3

----- Final Results -----
         bacterial membrane --- Certainty = 0.3166(Affirmative) < succ>
          bacterial outside --- Certainty = 0.0000(Not Clear)   < succ>
        bacterial cytoplasm --- Certainty = 0.0000(Not Clear)   < succ>
```

The protein has homology with the following sequences in the GENPEPT database.

```
>GP: AAC65028 GB: AE001188 conserved hypothetical integral membrane
protein [Treponema pallidum]
Identities = 54/190 (28%), Positives = 93/190 (48%), Gaps = 14/190 (7%)

Query:   14 LFFIVISFGIKYYHLQG--PNLIWNMTLALIALDFAYLTSL--FKKKILIGLFALAWFFF    69
            +F +++SFG +          L+WN+ LA I    + +  F + +      L W  F
Sbjct:    3 VFCLLLSFGRRCVAADNFLSFLVWNLVLAFIPWLISAILHVRRFAVRSVQLFLMLLWLLF    62

Query:   70 YPNTFYMLTDIIHMHFVGDVLYNKTNLILYILYVSSILFGFLSGIESFSVIMRKFRISNI   129
            +PN  Y+LTDIIH+     L    +IL   + + F+S    S++ R F I
Sbjct:   63 FPNAPYILTDIIHLGKGKSFLLYYDLIILLAYSFTGLFYAFVSLHLIESILARDFHIKRP   122

Query:  130 FLRWGIIGIVSL-VSSFGIHIGRYARLNSWDILTKPQVVINELLAVPSR-----DSFHFI   183
            F     II +  L + +FGI++GR+ R NSWDI+   + +++++    R      D++ F+
Sbjct:  123 F----IISVFELYLCAFGIYLGRFLRWNSWDIVLHGRTILSDIGIRVIRPVFYVDTWMFV   178

Query:  184 LGFTFLQVLC                                                    193
            F  + VLC
Sbjct:  179 FFFGTMLVLC                                                    188
```

No corresponding DNA sequence was identified in S. pyogenes.

Based on this analysis, it was predicted that these proteins and their epitopes could be useful antigens for vaccines or diagnostics.

EXAMPLE 1109

A DNA sequence (GBSx1184) was identified in S. agalactiae <SEQ ID 3429> which encodes the amino acid sequence <SEQ ID 3430>. Analysis of this protein sequence reveals the following:

```
Possible site: 17
>>> Seems to have no N-terminal signal sequence
    INTEGRAL     Likelihood = -6.79    Transmembrane    171-187 (166-191)

----- Final Results -----
         bacterial membrane --- Certainty = 0.3718(Affirmative) < succ>
          bacterial outside --- Certainty = 0.0000(Not Clear)   < succ>
        bacterial cytoplasm --- Certainty = 0.0000(Not Clear)   < succ>
```

The protein has no significant homology with any sequences in the GENPEPT database.

No corresponding DNA sequence was identified in S. pyogenes.

Based on this analysis, it was predicted that this protein and its epitopes, could be useful antigens for vaccines or diagnostics.

EXAMPLE 1110

A DNA sequence (GBSx1185) was identified in S. agalactiae <SEQ ID 3431> which encodes the amino acid sequence <SEQ ID 3432>. Analysis of this protein sequence reveals the following:

```
Possible site: 29
>>> Seems to have no N-terminal signal sequence
    INTEGRAL    Likelihood = -10.46    Transmembrane    193-209 (191-214)
    INTEGRAL    Likelihood = -10.30    Transmembrane     99-115 (96-119)
    INTEGRAL    Likelihood =  -8.17    Transmembrane    454-470 (451-472)
    INTEGRAL    Likelihood =  -6.64    Transmembrane    216-232 (212-236)
    INTEGRAL    Likelihood =  -6.37    Transmembrane     49-65  (43-68)
    INTEGRAL    Likelihood =  -4.88    Transmembrane    362-378 (357-383)
    INTEGRAL    Likelihood =  -3.61    Transmembrane    385-401 (385-402)
    INTEGRAL    Likelihood =  -2.76    Transmembrane    275-291 (275-291)
    INTEGRAL    Likelihood =  -1.70    Transmembrane     18-34  (18-34)

----- Final Results -----
            bacterial membrane --- Certainty = 0.5182(Affirmative) < succ>
            bacterial outside  --- Certainty = 0.0000(Not Clear)   < succ>
          bacterial cytoplasm  --- Certainty = 0.0000(Not Clear)   < succ>
```

The protein has homology with the following sequences in the GENPEPT database.

```
>GP: AAF95422 GB: AE004299 conserved hypothetical protein [Vibrio cholerae]
Identities = 193/471 (40%), Positives = 286/471 (59%), Gaps = 42/471 (8%)

Query:   1 MEKFFKLKEHGTTIRTEITAGLTTFFAMSYILFVNPAILSQTGMPAQGVFLATIIGAVVA   60
           +EK FKL E+GT +RTEI AG+TTF M+YI+FVNPAILS  GM    VF+AT + A +
Sbjct:   2 LEKLFKLSEYGTNVRTEILAGVTTFLTMAYIIFVNPAILSDAGMDRGAVFVATCLAAAIG   61

Query:  61 TSVMAFYANLPYAQAPGMGLNAFFTYTVVFALGYTWQEALAMVFICGLISLIITLTKVRK  120
           +M F AN P AQAPGMGLNAFFTY VV  +G+TWQ ALA VF  G++ ++++L K+R+
Sbjct:  62 CFIMGFIANYPIAQAPGMGLNAFFTYGVVLGMGHTWQVALAAVFCSGVLFILLSLFKIRE  121

Query: 121 MIIESIPTTLKSAITAGIGTFLAYVGIKNAGFLKFSIDPGTYDVVGKGAAKGLATITANS  180
           II SIP +L++ I+AGIG FLA++ +KNAG +    +P T  +V GA    L    +
Sbjct: 122 WIINSIPHSLRTGISAGIGLFLAFIALKNAGIV--VDNPAT--LVSLGAITSLHAV----  173

Query: 181 SATPGLVSFDNPAILLSLIGLSITIFFIVKGIRGGIILSILTTTLLGILMGVVKLDAINW  240
                         L+ +G  +TI  + +G++G ++++IL  T LG++G V+    I
Sbjct: 174 ---------------LAAVGFFLTIGLVYRGVKGAVMIAILAVTALGLVFGDVQWGGIMS  218

Query: 241 EATNLSASFRDLKQVFGVALGEKGLISLFSNPSRLPSVLMAILAFSLTDIFDTIGTLIGT  300
              +++ +F   Q+  A+ E G+IS+            + AF   D+FDT GTL+G
Sbjct: 219 TPPSIAPTF---MQLDFSAVFEIGMISV-----------VFAFLFVDLFDTAGTLVGV   262

Query: 301 GEKVGILATTGDNHESKSLDKALYSDLIGTTFGAICGTSNVTTYVESAAGIGAGGRTGLT  360
            +K G++     G   +    L++AL +D    T+ GA+ GTSN T+Y+ES +G+  GGRTGLT
Sbjct: 263 ATKAGLIEKDG---KIPRLNRALLADSTATSVGALLGTSNTTSYIESVSGVAVGGRTGLT  319

Query: 361 ALVVAGLFAISSFFSPLVSIVPSQATAPILVIVGIMNLSNLKDIKWDDMSEAIPAFFTSL  420
            A+VV  LF ++ FFSPL  ++P+ ATA  L V I+M+S L   I W D++EA P     T L
Sbjct: 320 AVVVGILFLLALFFSPLAGMIPAYATAGALFYVAILMMSGLVSIDWRDLTEAAPTVVTCL  379

Query: 421 FMGFTYSITYGIAAGFLTYTLAKVIKGQAKDIHVVLWILDILFILNFISLA           471
            M  T+SI  GI+ GF+ Y    K+   G+ + + +  +W++  +F++   +I    A
Sbjct: 380 MMPLTFSIAEGISLGFIAYAAIKLFSGKGRSVSLSVWVMAAIFVIKYILAA           430
```

A related DNA sequence was identified in *S. pyogenes* <SEQ ID 3433> which encodes the amino acid sequence <SEQ ID 3434>. Analysis of this protein sequence reveals the following:

```
Possible site: 51
>>> Seems to have no N-terminal signal sequence
    INTEGRAL    Likelihood = -11.57    Transmembrane    378-394 (370-419)
    INTEGRAL    Likelihood =  -9.29    Transmembrane    202-218 (195-221)
    INTEGRAL    Likelihood =  -7.64    Transmembrane     48-64  (46-71)
    INTEGRAL    Likelihood =  -7.64    Transmembrane     99-115 (97-118)
    INTEGRAL    Likelihood =  -6.90    Transmembrane    225-241 (221-245)
    INTEGRAL    Likelihood =  -6.05    Transmembrane    468-484 (465-485)
    INTEGRAL    Likelihood =  -4.35    Transmembrane    399-415 (395-419)
    INTEGRAL    Likelihood =  -3.24    Transmembrane    425-441 (425-442)
    INTEGRAL    Likelihood =  -3.08    Transmembrane     18-34  (18-34)
    INTEGRAL    Likelihood =  -2.28    Transmembrane    442-458 (442-460)
    INTEGRAL    Likelihood =  -0.00    Transmembrane    282-298 (282-298)

----- Final Results -----
            bacterial membrane --- Certainty = 0.5628(Affirmative) < succ>
```

-continued
```
        bacterial outside --- Certainty = 0.0000(Not Clear) < succ>
        bacterial cytoplasm --- Certainty = 0.0000(Not Clear) < succ>
```

The protein has homology with the following sequences in the databases:

```
>GP: BAB04327 GB: AP001509 unknown conserved protein [Bacillus halodurans]
Identities = 192/485 (39%), Positives = 276/485 (56%), Gaps = 53/485 (10%)

Query:    1 MEKFFKLSENGTTVSTEIMAGLTTFFAMSYILFVNPSILGAAGMPSNAVFLATIIAAAIS   60
            M+++F  E+GTT  E +AGLTTF +M+YILFVNP ILG AGM   AVF+AT +AAAI
Sbjct:    1 MDRYFGFKEHGTTYGRESIAGLTTFLSMAYILFVNPLILGDAGMDVQAVFMATALAAAIG  60

Query:   61 TLIMGLFANVPYALAPGMGLNAFFTYTVVFALRFSWQEALAMVFICGLFNIFITVTKFRK  120
            TLIMG+ A P ALAPGMGLNAFF Y+VV +   WQ AL VF+ G+  I ITV K R+
Sbjct:   61 TLIMGILAKYPIALAPGMGLNAFFAYSVVIGMGIDWQLALFGVFVSGIIFILITVFKIRE  120

Query:  121 SIIKAIPVSLQHAIGGGIGVFVAYLGFKNANIITFSISAENIVMVNGVEPAKASAKTFAD  180
            II AIP  L++A  GIG+F+A++G KNA I+
Sbjct:  121 VIINAIPAELKNAAAAGIGLFIAFIGLKNAGIVV--------------------------  154

Query:  181 GLLFVDANGGVVPTISSFTDSGVLLAIFGLLLTTALVIRNFRGAILIGIVATTLVGIPLG  240
                     ++    ++    +   LLA FGL++T  ++R +G I  G++ T +VG+  G
Sbjct:  155 ------SDEATAVSLGHILNGPTLLACFGLIVTVLFMVRGIQGGIFYGMILTAIVGLISG  208

Query:  241 IVDVSNLNFGISHIGEAWTELGTTFLAAFD-GLSSLFSDSSRLPLVFMTIFAFSLSDTFD  299
            I+  +    I     L  TF AF+ ++ +FS      + +   F  D FD
Sbjct:  209 IITYTG-----GGIVSTPPSLAPTFGQAFNIQMADVFSVQ-----FLIVVLTFLFVDFFD  258

Query:  300 TIGTFIGTGRRTGIFSQDDENALENSIGFSSKMDRALFADAIGTSIGALVGTSNTTTYVE  359
            T GT  G   + G F +D++          +   +AL AD+  TSIGA++GTS TT Y+E
Sbjct:  259 TAGTLYGVANQAG-FIKDNK---------LPRAGKALLADSSATSIGAILGTSTTTAYIE  308

Query:  360 SAAGIAEGGRTGLTAVSTAVCFLLSILLLPLVGIVPAAATAPALIIVGVMMVSSFLDVNW  419
            S+AG+A GGRTG ++ TA F+L++  PL+ +V   TA ALI+VG++M SS  ++W
Sbjct:  309 SSAGVAAGGRTGFASIVTAGLFVLAMFFSPLLSVVTEQVTAAALIVVGILMASSLRFIDW  368

Query:  420 SKFADALPAFFAAFFMALCYSISYGIAAAFIFYCLVKVVEGKTKDIHPIIWGATFLFIVN  479
            +K  A+P+F     M L YSI+ GIA  F+FY +  +V+G+ K++HPI++   F+F+
Sbjct:  369 TKLEIAIPSFLTVVAMPLTYSIATGIAFGFLFYPITMIVKGRGKEVHPIMYALFFVFLAY  428

Query:  480 FIILT                                                        484
            FI L+
Sbjct:  429 FIFLS                                                        433
```

An alignment of the GAS and GBS proteins is shown below.

```
Identities = 258/488 (52%), Positives = 336/488 (67%), Gaps = 17/488 (3%)

Query:    1 MEKFFKLKEHGTTIRTEITAGLTTFFAMSYILFVNPAILSQTGMPAQGVFLATIIGAVVA   60
            MEKFFKL E+GTT+ TEI AGLTTFFAMSYILFVNP+IL   GMP+  VFLATII A ++
Sbjct:    1 MEKFFKLSENGTTVSTEIMAGLTTFFAMSYILFVNPSILGAAGMPSNAVFLATIIAAAIS   60

Query:   61 TSVMAFYANLPYAQAPGMGLNAFFTYTVVFALGYTWQEALAMVFICGLISLIITLTKVRK  120
            T +M  +AN+PYA APGMGLNAFFTYTVVFAL ++WQEALAMVFICGL ++ IT+TK RK
Sbjct:   61 TLIMGLFANVPYALAPGMGLNAFFTYTVVFALRFSWQEALAMVFICGLFNIFITVTKFRK  120

Query:  121 MIIESIPTTLKSAITAGIGTFLAYVGIKNAGFLKFSIDPGTYDVV---------GRGAAK  171
             II++IP +L++AI GIG F+AY+G KNA + FSI      +V             K A
Sbjct:  121 SIIKAIPVSLQHAIGGGIGVFVAYLGFKNANIITFSISAENIVMVNGVEPAKASAKTFAD  180

Query:  172 GLATITANSSATPGLVSFDNPAILLSLIGLSITIFFIVKGIRGGIILSILTTTLLGILMG  231
            GL  + AN    P + SF +  +LL++ GL +T    +++ RG I++ I+ TTL+GI +G
Sbjct:  181 GLLFVDANGGVVPTISSFTDSGVLLAIFGLLLTTALVIRNFRGAILIGIVATTLVGIPLG  240

Query:  232 VVKLDAINWEATNLSASFRDLKQVFGVALGEKGLISLFSNPSRLPSVLMAILAFSLTDIF  291
            +V +  +N+   +++  ++L   F A    GL SLFS+ SRLP V M I AFSL+D F
Sbjct:  241 IVDVSNLNFGISHIGEAWTELGTTFLAAF--DGLSSLFSDSSRLPLVFMTIFAFSLSDTF  298

Query:  292 DTIGTLIGTGEKVGILATTGDN------HESKSLDKALYSDLIGTTFGAICGTSNVTTYV  345
            DTIGT IGTG + GI +    +N        S +D+AL++D IGT+ GA+ GTSN TTYV
Sbjct:  299 DTIGTFIGTGRRTGIFSQDDENALENSIGFSSKMDRALFADAIGTSIGALVGTSNTTTYV  358

Query:  346 ESAAGIGAGGRTGLTALVVAGLFAISSFFSPLVSIVPSQATAPILVIVGIMMLSNLKDIK  405
            ESAAGI GGRTGLTA+  A F +S   PLV IVP+ ATAP L+IVG+MM+S+  D+
```

```
                            -continued
Sbjct: 359 ESAAGIAEGGRTGLTAVSTAVCFLLSILLLPLVGIVPAAATAPALIIVGVMNVSSFLDVN 418

Query: 406 WDDMSEAIPAFFTSLFMGFTYSITYGIAAGFLTYTLAKVIKGQAKDIHVVLWILDILFIL 465
           W   ++A+PAFF + FM    YSI+YGIAA F+ Y L KV++G+ KDIH ++W    LFI+
Sbjct: 419 WSKFADALPAFFAAFFMALCYSISYGIAAAFIFYCLVKVVEGKTKDIHPIIWGATFLFIV 478

Query: 466 NFISLAIL                                                     473
           NFI L IL
Sbjct: 479 NFIILTIL                                                     486
```

Based on this analysis, it was predicted that these proteins and their epitopes could be useful antigens for vaccines or diagnostics.

EXAMPLE 1111

A DNA sequence (GBSx1186) was identified in *S. agalactiae* <SEQ ID 3435> which encodes the amino acid sequence <SEQ ID 3436>. Analysis of this protein sequence reveals the following:

```
Possible site: 32
>>> Seems to have no N-terminal signal sequence

----- Final Results -----
             bacterial cytoplasm --- Certainty = 0.3221(Affirmative) < succ>
             bacterial membrane  --- Certainty = 0.0000(Not Clear)   < succ>
             bacterial outside   --- Certainty = 0.0000(Not Clear)   < succ>
```

The protein has homology with the following sequences in the GENPEPT database.

```
>GP: BAB04264 GB: AP001508 unknown conserved protein [Bacillus halodurans]
Identities = 68/147 (46%), Positives = 100/147 (67%), Gaps = 1/147 (0%)

Query:  27 MFYTQNEEELIALGQKLGTVLKSGDIVLLTGNLGAGKTTLTKGIAKGLDIKQMIKSPTYT  86
           M  TQ+ E  +A  QKL    L +GD++  L G+LGAGKT+ TKG+A GL IK+++KSPT+T
Sbjct:   5 MMITQSPEATMAFAQKLADKLLAGDVITLEGDLGAGKTSFTKGLALGLGIKRVVKSPTFT  64

Query:  87 IVREYEGRVPLYHLDVYRIGDDPDSIDLDDFLFGQGVTVIEWGELLSDNLINNYLEIVIT 146
           I+REY+GR+PLYH+DVYR+ ++ + +  D++  G GVTV+EW  L+    L    L I IT
Sbjct:  65 IIREYKGRLPLYHMDVYRLNEEEEDLGFDEYFHGDGVTVVEWASLIEGRLPPVRLAITIT 124

Query: 147 RSNQG-RQVQLEAYGHRAREIIEAIQD                                 172
            + +   RQ+    AYG R  E+++ + D
Sbjct: 125 HAGENERQLSFTAYGERWEEVLKELLD                                 151
```

A related DNA sequence was identified in *S. pyogenes* <SEQ ID 3437> which encodes the amino acid sequence <SEQ ID 3438>. Analysis of this protein sequence reveals the following:

```
Possible site: 43
>>> Seems to have no N-terminal signal sequence

----- Final Results -----
             bacterial cytoplasm --- Certainty = 0.1202(Affirmative) < succ>
             bacterial membrane  --- Certainty = 0.0000(Not Clear)   < succ>
             bacterial outside   --- Certainty = 0.0000(Not Clear)   < succ>
```

An alignment of the GAS and GBS proteins is shown below.

```
Identities = 97/142 (68%), Positives = 122/142 (85%)

Query:  27 MFYTQNEEELIALGQKLGTVLKSGDIVLLTGNLGAGKTTLTKGIAKGLDIKQMIKSPTYT  86
           MFY++NE  L A G+ LGT L  GD+++L+G+LGAGKTTL KGIAKG  I QMIKSPTYT
Sbjct:   1 MFYSENEYTLKAYGETLGTYLSIGDVIVLSGDLGAGKTTLAKGIAKGMGISQMIKSPTYT  60
```

```
                        -continued
Query:  87 IVREYEGRVPLYHLDVYRIGDDPDSIDLDDFLFGQGVTVIEWGELLSDNLINNYLEIVIT  146
           IVREYEGR+PLYHLD+YR+GDDPDSIDLDDFLFG GVTVIEWGELL + L+ +YL+I IT
Sbjct:  61 IVREYEGRLPLYHLDIYRVGDDPDSIDLDDFLFGNGVTVIEWGELLGEGLLQDYLQITIT  120

Query: 147 RSNQGRQVQLEAYGHRAREIIE                                        168
           + ++GRQ+ L A+G R+R+++E
Sbjct: 121 KRDKGRQLDLLAHGERSRQLLE                                        142
```

Based on this analysis, it was predicted that these proteins and their epitopes could be useful antigens for vaccines or diagnostics.

EXAMPLE 1112

A DNA sequence (GBSx1187) was identified in *S. agalactiae* <SEQ ID 3439> which encodes the amino acid sequence <SEQ ID 3440>. Analysis of this protein sequence reveals the following:

```
Possible site: 58
>>> Seems to have no N-terminal signal sequence

----- Final Results -----
             bacterial cytoplasm --- Certainty = 0.1782(Affirmative) < succ>
             bacterial membrane  --- Certainty = 0.0000(Not Clear)   < succ>
             bacterial outside   --- Certainty = 0.0000(Not Clear)   < succ>
```

The protein has homology with the following sequences in the GENPEPT database.

```
>GP: AAD35662 GB: AE001732 conserved hypothetical protein
[Thermotoga maritima]
Identities = 56/163 (34%), Positives = 94/163 (57%), Gaps = 1/163 (0%)

Query:  24 EASREEASAILEFLNTVTEETDFILHTVSNQLSLSEMETFIENTLMTKNCICLIAKLKNK   83
           EAS  +A  I+E+L  VT ETDF++        +S   +I        + ++ ++   +
Sbjct:  18 EASIWDARRIVEYLKEVTSETDFLITRPDEVYDVSTERNYIRMYRSNPGKLMIVGEINRE   77

Query:  84 VIGLITIISQSDIEIEHVGDLFIAVQKDYWGYGIGHILMEEAIEWASDNDITRRLELSVQ  143
           ++ L+T         +HVG++ I+V+K YW  GIG  ++   AIEWA  N    R++L V
Sbjct:  78 IVSLLTFTGFGRKRTKHVGEIGISVKKRYWNIGIGTRMITSAIEWARRNGFI-RIQLEVL  136

Query: 144 GRNERAIHLYQKFGFEIDGLQTRGIKRENGEFLDIYRMSKLID                  186
           RNERAI LY+K GFE++G++ +  ++R++G F D+   M+ L+D
Sbjct: 137 KSNERAISLYRKLGFELEGIKRKAVRRDDGSFEDVLVMALLLD                  179
```

There is also homology to SEQ ID 1724.

Based on this analysis, it was predicted that this protein and its epitopes, could be useful antigens for vaccines or diagnostics.

EXAMPLE 1113

A DNA sequence (GBSx1188) was identified in *S. agalactiae* <SEQ ID 3441> which encodes the amino acid sequence <SEQ ID 3442>. Analysis of this protein sequence reveals the following:

```
Possible site: 53
>>> Seems to have a cleavable N-term signal seq.

----- Final Results -----
             bacterial outside   --- Certainty = 0.3000(Affirmative) < succ>
             bacterial membrane  --- Certainty = 0.0000(Not Clear)   < succ>
             bacterial cytoplasm --- Certainty = 0.0000(Not Clear)   < succ>
```

The protein has homology with the following sequences in the GENPEPT database.

```
>GP: CAB15582 GB: Z99122 membrane-bound protein [Bacillus subtilis]
Identities = 108/324 (33%), Positives = 178/324 (54%), Gaps = 33/324 (10%)

Query:   5 KKITLMFSAIILTTVIALGV--YVASAYNFSTNELSKTFKDFKLAKS--KSHAIEETKPF   60
           KK TL+ + + + ++ LG    Y   ++ + + ++   +   +K   K  +I +   PF
Sbjct:   8 KKKTLLLTILTIIGLLVLGTGGYAYYLWHKAASTVASIHESIDKSKKRDKEVSINKKDPF   67

Query:  61 SILLMGVDTGSEHRKSKWSGNSDSMILVTINPKTNKTTMTSLERDVLIKLSGPKNNGQTG  120
           S+L+MGVD  +      G +D++I +T+NPKTN T M S+ RD    K+ G        G
Sbjct:  68 SVLIMGVDERDGDK-----GRADTLIYMTVNPKTNTTDMVSIPRDTYTKIIGK------G  116

Query: 121 VEAKLNAAYASGGAEMALMTVQDLLDINVDYFMQINMQGLVDLVNAVGGITVTNKFDFPI  180
           K+N +YA GG +M + TV++ LD+ VDYF+++NM+    D+V+ +GGITV + F F
Sbjct: 117 TMDKINHSYAFGGTQMTVDTVENFLDVPVDYFVKVNMESFRDVVDTLGGITVNSTFAFSY  176

Query: 181 SIAANEPEYKAVVEPGTHKINGEQALVYSRMRYDDPEGDYGRQKRQREVIQKVLKKILAL  240
             +               G   +NG++AL Y+RMR +DP GD+GRQ RQR+VIQ ++ K   +
Sbjct: 177 DGYS--------FGKGEITLNGKEALAYTRMRKEDPRGDFGRQDRQRQVIQGIINKGANI  228

Query: 241 NSISSYKKILSAVSNNMQTNIEISSKTIPNL----LAYKDSLEHIKSYQLKGEDATLSDG  296
           +SI+ +  +    V NN++TN+      T   N+       YK + +HIK ++LKG   T  +G
Sbjct: 229 SSITKFGDMFKVVENNVKTNL-----TFDNMWDIQSDYKGARKHIKQHELKG-TGTKING  282

Query: 297 GSYQILTKKHLLAVQNRIKKELDK                                     320
           Y     + L +   +K+ L+K
Sbjct: 283 IYYYQADESALSDITKELKESLEK                                     306
```

A related DNA sequence was identified in *S. pyogenes* <SEQ ID 2763> which encodes the amino acid sequence <SEQ ID 2764>. Analysis of this protein sequence reveals the following:

```
Possible site: 33
>>> Seems to have a cleavable N-term signal seq.

----- Final Results -----
         bacterial outside  --- Certainty = 0.3000(Affirmative) < succ>
         bacterial membrane --- Certainty = 0.0000(Not Clear)   < succ>
         bacterial cytoplasm --- Certainty = 0.0000(Not Clear)   < succ>
```

An alignment of the GAS and GBS proteins is shown below.

```
Identities = 288/436 (66%), Positives = 342/436 (78%), Gaps = 22/436 (5%)

Query:   1 MKIWKKITLMFSAIILTTVIALGVYVASAYNFSTNELSKTFKDFKLAKSKSHAIEETKPF   60
           MKI KKI LMF+AI+LTTV+ALGVY+ SAY FST ELSKTFKDF   + +KS AI++T+ F
Sbjct:   1 MKIGKKIVLMFTAIVLTTVLALGVYLTSAYTFSTGELSKTFKDFSTSSNKDSAIKQTRAF   60

Query:  61 SILLMGVDTGSEHRKSKWSGNSDSMILVTINPKTNKTTMTSLERDVLIKLSGPKNNGQTG  120
           SILLMGVDTGS  R  SKW GNSDSMILVT+NPKT KTTMTSLERD L  LSGPKNN   G
Sbjct:  61 SILLMGVDTGSSERASKWEGNSDSMILVTVNPKTKKTTMTSLERDTLTTLSGPKNNEMNG  120

Query: 121 VEAKLNAAYASGGAEMALMTVQDLLDINVDYFMQINMQGLVDLVNAVGGITVTNKFDFPI  180
           VEAKLNAAYA+GGA+MA+MTVQDLL+I +D ++QINMQGL+DLVNAVGGITVTN+FDFPI
Sbjct: 121 VEAKLNAAYAAGGAQMAIMTVQDLLNITIDNYVQINMQGLIDLVNAVGGITVTNEFDFPI  180

Query: 181 SIAANEPEYKAVVEPGTHKINGEQALVYSRMRYDDPEGDYGRQKRQREVIQKVLKKILAL  240
           SIA NEPEY+A V PGTHKINGEQALVY+RMRYDDPEGDYGRQKRQREVIQKVLKKILAL
Sbjct: 181 SIAENEPEYQATVAPGTHKINGEQALVYARMRYDDPEGDYGRQKRQREVIQKVLKKILAL  240

Query: 241 NSISSYKKILSAVSNNMQTNIEISSKTIPNLLAYKDSLEHIKSYQLKGEDATLSDGGSYQ  300
           +SISSY+KILSAVS+NMQTNIEISS+TIP+LL Y+D+L   IK+YQLKGEDATLSDGGSYQ
Sbjct: 241 DSISSYRKILSAVSSNMQTNIEISSRTIPSLLGYRDALRTIKTYQLKGEDATLSDGGSYQ  300

Query: 301 ILTKKHLLAVQNRIKKELDKKRSKTLKTSAILYEDYYGTTASNDSSTYSSTQENNYNTT-  359
           I+T  HLL +QNRI+ EL     LKT+A +YE+ YG      ST S T  NNY+++
Sbjct: 301 IVTSNHLLEIQNRIRTELGLHKVNQLKTNATVYENLYG-------STKSQTVNNNYDSSG  353

Query: 360 ---PYSEAPPSYSG-----NTTYSSETNQTTHQNYYNSSTPASNYSSNTNTGQADSSGSV  411
              + YS++   SY+       +T  S+ T+Q +  + +  +TP+S+  S    ++ SSGS
Sbjct: 354 QAPSYSDSHSSYANYSSGVDTGQSASTDQDSTASSHRPATPSSS-SDALAADESSSSGS-  411

Query: 412 NNHNGAATPNPNTGTQ                                             427
           G+    P N   Q
Sbjct: 412 ----GSLVPPANINPQ                                             423
```

SEQ ID 3442 (GBS54) was expressed in *E. coli* as a His-fusion product. SDS-PAGE analysis of total cell extract is shown in FIG. 16 (lane 8; MW 48.4 kDa).

The GBS54-His fusion product was purified (FIG. 98A; see also FIG. 194, lane 6) and used to immunise mice (lane 1+2 product; 20 μg/mouse). The resulting antiserum was used for Western blot (FIG. 98B), FACS (FIG. 98C), and in the in vivo passive protection assay (Table III). These tests confirm that the protein is immunoaccessible on GBS and that it is an effective protective immunogen.

Based on this analysis, it was predicted that these proteins and their epitopes could be useful antigens for vaccines or diagnostics.

EXAMPLE 1114

A DNA sequence (GBSx1189) was identified in *S. agalactiae* <SEQ ID 3443> which encodes the amino acid sequence <SEQ ID 3444>. This protein is predicted to be Vesl-1L. Analysis of this protein sequence reveals the following:

```
Possible site: 18
>>> Seems to have an uncleavable N-term signal seq
      INTEGRAL    Likelihood = -1.44    Transmembrane    3-19 (3-19)

----- Final Results -----
            bacterial membrane --- Certainty = 0.1574(Affirmative) < succ>
            bacterial outside  --- Certainty = 0.0000(Not Clear)   < succ>
          bacterial cytoplasm  --- Certainty = 0.0000(Not Clear)   < succ>
```

The protein has no significant homology with any sequences in the GENPEPT database.

A related DNA sequence was identified in *S. pyogenes* <SEQ ID 3445> which encodes the amino acid sequence <SEQ ID 3446>. Analysis of this protein sequence reveals the following:

```
Possible site: 15
>>> Seems to have a cleavable N-term signal seq.

----- Final Results -----
            bacterial outside  --- Certainty = 0.3000(Affirmative) < succ>
            bacterial membrane --- Certainty = 0.0000(Not Clear)   < succ>
          bacterial cytoplasm  --- Certainty = 0.0000(Not Clear)   < succ>
```

The protein has no significant homology with any sequences in the GENPEPT database.

An alignment of the GAS and GBS proteins is shown below.

```
Identities = 42/98 (42%), Positives = 64/98 (64%)
Query:   1 MKIGRLIALGLVSLGALELYKNRK-                                    60
           TIKDSYQNTKNETDSAKLKLERIKNDLAIISQEKEK
           MK+  +IA+GL+S  A + Y+ R TIK+      ++    D+A+L L+ IK +L +I  + +
Sbjct:   1 MKVKTVIAVGLLSFTAYKAYQKRC-                                    60
           TIKELLSISRQAKDAAQLDLDNIKANLDLIHSQGKV Query:  61 IRLISQELNHKFQVFNKDIQPRLEEINQRMAKYQEKDE                       98
           I+ ISQ+L HK++ FN++ Q  L EI  RMAKYQE  E
Sbjct:  61 IQNISQDLAHKWRYFNQETQAHLTEIQNRMAKYQEDSE                       98
```

Based on this analysis, it was predicted that these proteins and their epitopes could be useful antigens for vaccines or diagnostics.

EXAMPLE 1115

A DNA sequence (GBSx1190) was identified in *S. agalactiae* <SEQ ID 3447> which encodes the amino acid sequence <SEQ ID 3448>. This protein is predicted to be Hit-like protein involved in cell-cycle regulation (hit). Analysis of this protein sequence reveals the following:

Possible site: 37
>>> Seems to have no N-terminal signal sequence

----- Final Results -----
             bacterial cytoplasm --- Certainty = 0.2694(Affirmative) < succ>
              bacterial membrane --- Certainty = 0.0000(Not Clear) < succ>
                bacterial outside --- Certainty = 0.0000(Not Clear) < succ>
```

The protein has homology with the following sequences in the GENPEPT database.

```
>GP:BAB04908 GB:AP001511 Hit-like protein involved in cell-cycle
regulation [Bacillus halodurans]
Identities = 74/137 (54%), Positives = 95/137 (69%), Gaps = 2/137 (1%)
Query:    3 NCIFCKIISGEIPSSKVYEDDEV-                                 62
            LAFLDITQTTTGHTLLIPKKHVRNVLEMDEKTAQITF
            NCIFCKII+GEIPS+ VYEDD V AFLDI+Q T GHTL+IPK H RNV E+ E+
            A   F
Sbjct:    6 NCIFCKIIAGEIPSATVYEDDHVYAFLD-                            65
            ISQVTKGHTLVIPKVHKRNFELSEEIASSLF Query:   63 ERLPKVARAVQAATKAKGMNIINNNEE-                            122
            IAGQTVFHAHVHLVPRFDESDGIKIHYTTHEPD
            +PK++RA+  A +  GMNI+NNN E AGQTVFH H+HL+PR+ E DG    +  H
Sbjct:   66 AAVPKISRAINDAFQPIGM-                                    125
            NIVNNNGEAAGQTVFHYHLHLLPRYGEGDGYGAVWKDHSSQ Query:  123 F--EALAKLAKEIRKEI                                       137
            +  + L  L+  IR+ +
Sbjct:  126 YSGDDLQVLSSSIREHL                                       142
```

A related DNA sequence was identified in *S. pyogenes* <SEQ ID 3449> which encodes the amino acid sequence <SEQ ID 3450>. Analysis of this protein sequence reveals the following:

```
Possible site: 37
>>> Seems to have no N-terminal signal sequence

----- Final Results -----
             bacterial cytoplasm --- Certainty = 0.0125(Affirmative) < succ>
              bacterial membrane --- Certainty = 0.0000(Not Clear) < succ>
                bacterial outside --- Certainty = 0.0000(Not Clear) < succ>
```

An alignment of the GAS and GBS proteins is shown below.

```
Identities = 97/137 (70%), Positives = 117/137 (84%)
Query:    1 MDNCIFCKIISGEIPSSKVYEDDEV-                               60
            LAFLDITQTTTGHTLLIPKKHVRNVLEMDEKTAQI
            M+NCIFC II G+IPSSKVYED++VLAFLDI+QTT GHTL+IPK+HVRN+LEM  +TA
Sbjct:    1 MENCIFCSIIQGDIPSSKVYEDEQV-                               60
            LAFLDISQTTKGHTLVIPKQHVRNLLEMTAETASH Query:   61 TFERLPKVARAVQAATKAKGMNI-                                120
            INNNEEIAGQTVFHAHVHLVPRFDESDGIKIHYTTHE
             F R+PK+ARA+Q+AT A  MNIINNNE +AGQTVFHAHVHLVPR++E DGI I YT-
            THE
Sbjct:   61 LFARIPKIARAIQSATGATAMNI-                                120
            INNNEALAGQTVFHAHVHLVPRYNEEDGISIQYTTHE Query:  121 PDFEALAKLAKEIRKEI                                       137
            PDF   L  KLA++I +E+
Sbjct:  121 PDFPVLEKLARQINQEV                                       137
```

Based on this analysis, it was predicted that these proteins and their epitopes could be useful antigens for vaccines or diagnostics.

EXAMPLE 1116

A DNA sequence (GBSx1191) was identified in *S. agalactiae* <SEQ ID 3451> which encodes the amino acid sequence <SEQ ID 3452>. Analysis of this protein sequence reveals the following:

```
Possible site: 36
>>> Seems to have a cleavable N-term signal seq.

----- Final Results -----
           bacterial outside --- Certainty = 0.3000(Affirmative) < succ>
          bacterial membrane --- Certainty = 0.0000(Not Clear)   < succ>
         bacterial cytoplasm --- Certainty = 0.0000(Not Clear)   < succ>
```

A related GBS nucleic acid sequence <SEQ ID 10923> which encodes amino acid sequence <SEQ ID 10924> was also identified.

The protein has no significant homology with any sequences in the GENPEPT database.

No corresponding DNA sequence was identified in *S. pyogenes*.

Figure 8:
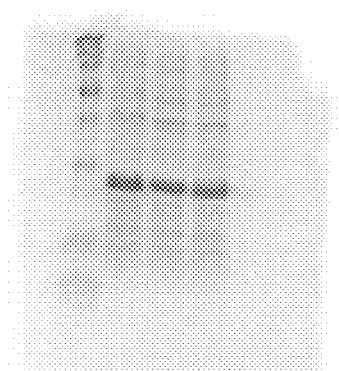

SEQ ID 3452 (GBS87) was expressed in *E. coli* as a His-fusion product. SDS-PAGE analysis of total cell extract is shown in FIG. 8 (lane 3; MW 19.5 kDa). It was also expressed in *E. coli* as a GST-fusion product. SDS-PAGE analysis of total cell extract is shown in FIG. 15 (lane 10; MW 44 kDa).

Based on this analysis, it was predicted that these proteins and their epitopes could be useful antigens for vaccines or diagnostics.

EXAMPLE 1117

A DNA sequence (GBSx1192) was identified in *S. agalactiae* <SEQ ID 3453> which encodes the amino acid sequence <SEQ ID 3454>. This protein is predicted to be ABC transporter, ATP-binding protein. Analysis of this protein sequence reveals the following:

```
Possible site: 45
>>> Seems to have no N-terminal signal sequence
    INTEGRAL    Likelihood = -6.53    Transmembrane    143-159 (141-161)

----- Final Results -----
          bacterial membrane --- Certainty = 0.3612(Affirmative) < succ>
           bacterial outside --- Certainty = 0.0000(Not Clear)   < succ>
         bacterial cytoplasm --- Certainty = 0.0000(Not Clear)   < succ>
```

A related GBS nucleic acid sequence <SEQ ID 9563> which encodes amino acid sequence <SEQ ID 9564> was also identified.

The protein has homology with the following sequences in the GENPEPT database.

```
>GP:CAB12844 GB:Z99109 ABC transporter (ATP-binding protein)
[Bacillus subtilis]
Identities = 137/242 (56%), Positives = 181/242 (74%)
    Query:    1MTMLKIENVTGGYVNIPVLKNISFEVND-                                60
              GELVGLIGLNGAGKSTTINEIIGILRPYQGDI
              M++L ++++TGGY   PVLKN+SF +   ++VGLIGLNGAGKSTTI   IIG++
              P++G I
    Sbjct:    1MSLLSVKDLTGGYTRNPVLKNVSFTLEP-                                60
              NQIVGLIGLNGAGKSTTIRHIIGLMDPHKGSI Query:   61TIDGISLEADQELYRKKIGFIPETPSLY-                               120
              EELTLREHLETVAMAYDIATDEVMARAQKLLE
              ++G +   D E YR +  +IPETP LYEELTL EHLE  AMAY ++ + +
              R    LL+
    Sbjct:   61ELNGKTFAEDPEGYRSQFTYIPETPVLY-                               120
              EELTLMEHLELTAMAYGLSKETMEKRLPPLLK Query:  121MFRLTDKLDWFPMHFSKGMKQKVMII-                                 180
              CAFVVSPSLFIVDEPFLGLDPLAISDLINLLAEE
              FR+  +L WFP HFSKGMKQKVMI+CAF+   P+L+I+DEPFLGLDPLAI+ L+   + E
    Sbjct:  121EFRMEKRLKWFPAHFSKGMKQKVMIM-                                 180
              CAFLAEPALYIIDEPFLGLDPLAINALLERMNEA Query:  181KAKGKSILMSTHVLDSAEKMCDRFVILH-                               240
              KGEIRAVGTLEELRAIFGDSNANLNDIYIALT
              K   G S+LMSTH+L +AE+ CD F+ILH  GE+RA GTL ELR   FG   +A L+D+Y+
              LT
    Sbjct:  181KKGGASVLMSTHILATAERYCDSFIILH-                               240
              NGEVRARGTLSELREQFGMKDAALDDLYLELT Query:  241KE                                                          242
              KE
    Sbjct:  241KE                                                          242
```

A related DNA sequence was identified in *S. pyogenes* <SEQ ID 3455> which encodes the amino acid sequence <SEQ ID 3456>. Analysis of this protein sequence reveals the following:

```
Possible site: 43
>>> Seems to have no N-terminal signal sequence
    INTEGRAL      Likelihood = -5.04    Transmembrane      141-157 (139-158)

----- Final Results -----
               bacterial membrane --- Certainty = 0.3017(Affirmative) < succ>
                bacterial outside --- Certainty = 0.0000(Not Clear)   < succ>
              bacterial cytoplasm --- Certainty = 0.0000(Not Clear)   < succ>
```

The protein has homology with the following sequences in the databases:

```
>GP:CAB12844 GB:Z99109 ABC transporter (ATP-binding protein)
[Bacillus subtilis]
Identities = 139/241 (57%), Positives = 189/241 (77%)
Query:    1 MLNIKNLTGGYHNIPVLNDVSFSVDNGELVGLIGLNGAGKSTTINEIIGFLKPYQGSISI     60
            +L++K+LTGGY   PVL +VSF+++  ++VGLIGLNGAGKSTTI  IIG + P++GSI +
Sbjct:    3 LLSVKDLTGGYTRNPVLKNVSFTLEPNQIVGLIGLNGAGKSTTIRHIIGLMDPHKGSIEL    62

Query:   61 DGLTLAENAVAYRQKIGFIPETPSLYEELTLSEHINTVAMAYDIDLEVAQKRAQPFLEMF   120
            +G T AE+   YR +  +IPETP LYEELTL EH+   AMAY +   E  +KR  P L+ F
Sbjct:   63 NGKTFAEDPEGYRSQFTYIPETPVLYEELTLMEHLELTAMAYGLSKETMEKRLPPLLKEF   122

Query:  121 RLTDKLEWFPVNFSKGMKQKVMIICAFVIDPSLFILDEPFLGLDPLAISDLIQTLEVEKA   180
            R+  +L+WFP +FSKGMKQKVMI+CAF+ +P+L+I+DEPFLGLDPLAI+ L++  +    K
Sbjct:  123 RMEKRLKWFPAHFSKGMKQKVMIMCAFLAEPALYIIDEPFLGLDPLAINALLERMNEAKK   182

Query:  181 KGKSILMSTHVLDSAERMCDRFVILHHGQVRAQGTLADLQEAFGDRSASLNDIYLALTKED   241
              G S+LMSTH+L +AER CD F+ILH+G+VRA+GTL++L+E FG + A+L+D+YL LTKED
Sbjct:  183 GGASVLMSTHILATAERYCDSFIILHNGEVRARGTLSELREQFGMKDAALDDLYLELTKED   243
```

An alignment of the GAS and GBS proteins is shown below.

```
Identities = 181/240 (75%), Positives = 208/240 (86%)
Query:    3 MLKIENVTGGYVNIPVLKNISFE-                                       62
            VNDGELVGLIGLNGAGKSTTINEIIGILRPYQGDITI
            ML I+N+TGGY NIPVL ++SF V++GELVGLIGLNGAGKSTTINEIIG L+
            PYQG I+I
Sbjct:    1 MLNIKNLTGGYHNIPVLNDVSFSVDN-                                    60
            GELVGLIGLNGAGKSTTINEIIGFLKPYQGSISI Query:   63 DGISLEADQELYRKKIGFIPETPSLY-                                   122
            EELTLREHLETVAMAYDIATDEVMARAQKLLEMF
            DG++L  +   YR+KIGFIPETPSLYEELTL EH+ TVAMAYDI   +
              RAQ  LEMF
Sbjct:   61 DGLTLAENAVAYRQKIGFIPETPSLY-                                   120
            EELTLSEHINTVAMAYDIDLEVAQKRAQPFLEMF Query:  123 RLTDKLDWFPMHFSKGMKQKVMIICAFV-                                 182
            VSPSLFIVDEPFLGLDPLAISDLINLLAEEKA
            RLTDKL+WFP++FSKGMKQKVMIICAFV+ PSLFI+DEPFLGLDPLAISD-
            LI  L  EKA
Sbjct:  121 RLTDKLEWFPVNFSKGMKQKVMIICAF-                                  180
            VIDPSLFILDEPFLGLDPLAISDLIQTLEVEKA Query:  183 KGKSILMSTHVLDSAEKMCDRFVILH-                                   242
            KGEIRAVGTLEELRAIFGDSNANLNDIYIALTKE
            KGKSILMSTHVLDSAE+MCDRFVILH G++RA GTL +L+  FGD +A+LNDIY+AL-
            TKE
Sbjct:  181 KGKSILMSTHVLDSAERMCDRFVILHH-                                  240
            GQVRAQGTLADLQEAFGDRSASLNDIYLALTKE
```

SEQ ID 3454 (GBS353) was expressed in *E. coli* as a His-fusion product. SDS-PAGE analysis of total cell extract is shown in FIG. 74 (lane 2; MW 30 kDa). It was also expressed in *E. coli* as a GST-fusion product. SDS-PAGE analysis of total cell extract is shown in FIG. 81 (lane 6; MW 55 kDa).

GBS353-GST was purified as shown in FIG. 216, lane 5.

Based on this analysis, it was predicted that these proteins and their epitopes could be useful antigens for vaccines or diagnostics.

EXAMPLE 1118

A DNA sequence (GBSx1193) was identified in *S. agalactiae* <SEQ ID 3457> which encodes the amino acid sequence <SEQ ID 3458>. Analysis of this protein sequence reveals the following:

```
Possible site: 28
>>> Seems to have no N-terminal signal sequence

----- Final Results -----
            bacterial cytoplasm --- Certainty = 0.1475(Affirmative) < succ>
             bacterial membrane --- Certainty = 0.0000(Not Clear)   < succ>
              bacterial outside --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1119

A DNA sequence (GBSx1194) was identified in *S. agalactiae* <SEQ ID 3459> which encodes the amino acid sequence <SEQ ID 3460>. Analysis of this protein sequence reveals the following:

```
Possible site: 44
>>> Seems to have no N-terminal signal sequence
    INTEGRAL    Likelihood = -12.68    Transmembrane    57-73    (50-80)
    INTEGRAL    Likelihood =  -8.49    Transmembrane   122-138  (103-152)
    INTEGRAL    Likelihood =  -6.58    Transmembrane   319-335  (308-337)
    INTEGRAL    Likelihood =  -4.99    Transmembrane   252-268  (249-273)
    INTEGRAL    Likelihood =  -4.19    Transmembrane   104-120  (103-121)
    INTEGRAL    Likelihood =  -3.50    Transmembrane   231-247  (229-248)
    INTEGRAL    Likelihood =  -1.91    Transmembrane   298-314  (298-314)
    INTEGRAL    Likelihood =  -1.44    Transmembrane    28-44    (27-44)

----- Final Results -----
             bacterial membrane --- Certainty = 0.6074(Affirmative) < succ>
              bacterial outside --- Certainty = 0.0000(Not Clear)   < succ>
            bacterial cytoplasm --- Certainty = 0.0000(Not Clear)   < succ>
```

The protein has homology with the following sequences in the GENPEPT database.

```
>GP:CAB12845 GB:Z99109 ABC transporter (membrane protein)
[Bacillus subtilis]
Identities = 101/409 (24%), Positives = 187/409 (45%),
Gaps = 76/409 (18%)
Query:    1 MKKLFNKRRSLFLTQNSKYLRYVFNDH-                                60
            FVLVLMFLSGFLLYQYSQLLKDFPKTHWPIIVI
            M  ++  R   + +    Y++Y+ NDH V+VL+F          YS+ ++D P   H+
            P      +
Sbjct:    4 MLDIWQSRLQEHIKETRTYMKYMLNDHLVIVLIFFLAGAASWYSKWIRDIP-AHFPS-   62
            FWV Query:   61 VSIIILMLLAMGGIASYLEPADKQFLLI-                              106
            KEEAIKEIINSAKKRTYI--------------
            ++++  ++L      +  + L+ AD  FLL  E   ++   +  A    +Y+
Sbjct:   63 MAVLFSLVLTSSYVRTLLKEADLVFLL-                              122
            PLEAKMEPYLKQAFVYSYVSQLFPLIALSIVAM Query:  107 --FWLVIQTLFLVLISPI-                                        128
            LIKLGL------------------------------
            ++ V       LV  +  +  ++L  L
Sbjct:  123 PLYFAVTP-                                                 182
            GASLVSYAAVFVQLLLLKAWNQVMEWRTTFQNDRSMKRMDVIIRFAANTLVL Query:  129 -----SVFMITLLIFGLGIIKWLVITYKVKV-                           183
            FYNNQNLNWDAAINHEQERKQSILKFFSL
                 SV+M    LL++ +   + +L ++      K       +    W++ I  E   RKQ   +
                 +L
Sbjct:  183 YFVFQSVYMYALLVYVIMAVLYLYMSSAAK----RKTFKWESHIESELRRKQRFYRI-  238
            ANL Query:  184 FTNVKGISTSVKRRSFLDGILKLISK-                                243
            TPSRLWTNLFVRAFLRSSDYLGLTIRLVTLNILS
            FT+V   +      KRR++LD +L+L+         +  +  +F RAFLRSSDYLG+ +RL  +   L
```

```
                                 -continued
Sbjct: 239 FTDVPHLRKQAKRRAYLDFLLR-                                    298
           LVPFEQRKTFAYMFTRAFLRSSDYLGILVRLTIVFALI Query: 244 VIFVNETYLALALAFVFN-YLLLFQLLALGHHFDYQYMNQLYPVRL-           302
           NAKASQLKGFLRVL
           +++V+ + L  A+  VF ++   QLL L  HFD+ + +LYPV+   K ++LK +
           +L
Sbjct: 299 IMYVSASPLIAAVLTVFAIFITGIQLLPLFGHFDHLALQELYPVQ---KETKLKSYF- 355
           SLL Query: 303 SYAVTVIDSI----------LIRELKPVILLIVLMLIVTEYYIPYKIKK          341
            A+++    +         L   L +I   VL+ +V  Y+  ++KK
Sbjct: 356 KTALSIQALLMSVASAYAAGLTGFLYALIGSAVLIFVVLPAYMTTRLKK          404
```

A related DNA sequence was identified in *S. pyogenes* <SEQ ID 3461> which encodes the amino acid sequence <SEQ ID 3462>. Analysis of this protein sequence reveals the following:

```
Possible site: 44
>>> Seems to have no N-terminal signal sequence
    INTEGRAL    Likelihood = -14.91    Transmembrane    126-142 (119-151)
    INTEGRAL    Likelihood =  -9.77    Transmembrane    320-336 (311-339)
    INTEGRAL    Likelihood =  -6.37    Transmembrane     59-75  (53-79)
    INTEGRAL    Likelihood =  -4.94    Transmembrane     28-44  (22-47)
    INTEGRAL    Likelihood =  -4.73    Transmembrane    250-266 (249-273)
    INTEGRAL    Likelihood =  -4.04    Transmembrane    231-247 (229-248)
    INTEGRAL    Likelihood =  -3.19    Transmembrane    298-314 (295-315)
    INTEGRAL    Likelihood =  -2.28    Transmembrane    103-119 (103-119)

----- Final Results -----
                 bacterial membrane --- Certainty = 0.6965(Affirmative) < succ>
                  bacterial outside --- Certainty = 0.0000(Not Clear)  < succ>
                bacterial cytoplasm --- Certainty = 0.0000(Not Clear)  < succ>
```

The protein has homology with the following sequences in the databases:

```
>GP:CAB12845 GB:Z99109 ABC transporter (membrane protein)
[Bacillus subtilis]
Identities = 96/403 (23%), Positives = 173/403 (42%), Gaps = 78/403 (19%)

Query:   1 MKALFLKRRQDFQKQQNKYLRYVLNDHFVLVLMFLLGFAMVQYGQLLN----HEPT----   52
           M  ++ R Q+  K+   Y++Y+LNDH V+VL+F L A   Y + +       HFP+
Sbjct:   4 MLDIWQSRLQEHIKETRTYMKYMLNDHLVIVLIFFLAGAASWYSKWIRDIPAHFPSFWVM   63

Query:  53 -------------NHLPIQVCLGILIPLLLSM---------------------------   71
                        L  +  L  L+PL    M
Sbjct:  64 AVLFSLVLTSSYVRTLLKEADLVFLLPLEAKMEPYLKQAFVYSYVSQLFPLIALSIVAMP  123

Query:  72 --------GSIATYLEEADQHFLLPKEEEVISYI------KQAERLSFLLWGTLQTAVLL  117
                   S+ +Y    Q  LL   +V+ +       +  +R+ ++    T  VL
Sbjct: 124 LYFAVTPGASLVSYAAVFVQLLLLLKAWNQVMEWRTTFQNDRSMKRMDVIIRFAANTLVLY  183

Query: 118 FLYPIFRRLGLSLFIFIILVLILLALKRVVLSRKTRYFLRGNRLDWAKAVAFESNRKQSI  177
           F++         S++++ +LV +++A+ + +S +            W  + E  RKQ
Sbjct: 184 FVFQ-------SVYMYALLVYVIMAVLYLYMSSAAKR----KTFKWESHIESELRRKQRF  232

Query: 178 LKFYSLFTTVKGISTKVKERTYLNPLLKLVKQTPSNLWLSLYARAFLRSSDYLGLFLRLM  237
            + +LFT V + + K R YL+ LL+LV     + ++ RAFLRSSDYLG+ +RL
Sbjct: 233 YRIANLFTDVPHLRKQAKRRAYLDFLLRLVPFEQRKTFAYMFTRAFLRSSDYLGILVRLT  292

Query: 238 LLSSLSVFFIHNLYLSVSLALIFN-YLVVFQLLSLYYHYDYHYMTSLYPENSRSKKKNML  296
           ++ +L + +       L ++ +F ++   QLL L+ H+D+ +  LYP    +K  K+
Sbjct: 293 IVFALIIMYVSASPLIAAVLTVFAIFITGIQLLPLFGHFDHLALQELYPVQKETKLKSYF  352

Query: 297 SFLR-GLSFLMLIVNMLCCSSAPKA--LILIVGMVFIACIYLP                  336
           S L+  LS   L++++    +A    L  ++G   +  + LP
Sbjct: 353 SLLKTALSIQALLMSVASAYAAGLTGFLYALIGSAVLIFVVLP                  395
```

An alignment of the GAS and GBS proteins is shown below.

```
Identities = 170/344 (49%), Positives = 237/344 (68%)

Query:    1 MKKLFNKRRSLFLTQNSKYLRYVFNDHFVLVLHFLSGFLLYQYSQLLKDFPKTHWPIIVI   60
            MK LF KRR  F Q +KYLRYV NDHFVLVLMFL GF + QY QLL  FP  H PI V
Sbjct:    1 MKALFLKRRQDFQKQQNKYLRYVLNDHFVLVLMFLLGFAMVQYGQLLNHFPTNHLPIQVC   60

Query:   61 VSIIILMLLAMGGIASYLEPADKQFLLIKEEAIKEIINSAKKRTYIFWLVIQTLFLVLIS  120
            + I+I +LL+MG IA+YLE AD+ FLL KEE +   I  A++ +++ W  +QT  L+ +
Sbjct:   61 LGILIPLLLSMGSIATYLEEADQHFLLPKEEEVISYIKQAERLSFLLWGTLQTAVLLFLY  120

Query:  121 PILIKLGLSVFMITLLIFGLGIIKWLVITYKVKVFYNNQNLNWDAAINHEQERKQSILKF  180
            PI   +LGLS+F+  +L+  L  +K +V++ K + F      L+W A+  E  RKQSILKF
Sbjct:  121 PIFRRLGLSLFIFIILVLILLALKRVVLSRKTRYFLRGNRLDWAKAVAFESNRKQSILKF  180

Query:  181 FSLFTNVKGISTSVKRRSFLDGILKLISKTPSRLWTNLFVRAFLRSSDYLGLTIRLVTLN  240
            +SLFT VKGIST VK R++L+ +LKL+ +TPS LW +L+ RAFLRSSDYLGL +RL+ L+
Sbjct:  181 YSLFTTVKGISTKVKERTYLNPLLKLVKQTPSNLWLSLYARAFLRSSDYLGLFLRLMLLS  240

Query:  241 ILSVIFVNETYLALALAFVFNYLLLFQLLALGHHFDYQYMNQLYPVRLNAKASQLKGFLR  300
            +LSV F++  YL+++LA +FNYL++FQLL+L +H+DY YM  LYP   +K  +   FLR
Sbjct:  241 SLSVFFIHNLYLSVSLALIFNYLVVFQLLSLYYHYDYHYMTSLYPENSRSKKKNMLSFLR  300

Query:  301 VLSYAVTVIDSILIRELKPVILLIVLMLIVTEYYIPYKIKKMID                 344
            LS+ + +++ +           ++LIV M+ +   Y+PYK+KK+ID
Sbjct:  301 GLSFLMLIVNMLCCSSAPKALILIVGMVFIACIYLPYKLKKIID                 344
```

Based on this analysis, it was predicted that these proteins and their epitopes could be useful antigens for vaccines or diagnostics.

EXAMPLE 1120

A DNA sequence (GBSx1195) was identified in *S. agalactiae* <SEQ ID 3463> which encodes the amino acid sequence <SEQ ID 3464>. Analysis of this protein sequence reveals the following:

```
Possible site: 45
>>> Seems to have no N-terminal signal sequence

----- Final Results -----
        bacterial cytoplasm --- Certainty = 0.2821(Affirmative) < succ>
         bacterial membrane --- Certainty = 0.0000(Not Clear)   < succ>
          bacterial outside --- Certainty = 0.0000(Not Clear)   < succ>
```

The protein has homology with the following sequences in the GENPEPT database.

```
>GP:AAC00284 GB:AF008220 YtmP [Bacillus subtilis]
Identities = 69/214 (32%), Positives = 121/214 (56%), Gaps = 1/214 (0%)

Query:   12 PLRGKSGKAYIGTYPNGERVFVKYNTTPILPALAKEQIAPQLLWARRTSNGDMMSAQEWL   71
            P  G +G AY   + NG+++F+K N++P L  L+ E I P+L+W +R  NGD+++AQ W+
Sbjct:   20 PAGGATGDAYYAKH-NGQQLFLKRNSSPFLAVLSAEGIVPKLVWTKRMENGDVITAQHWM   78

Query:   72 DGRTLTKEDMGSKQIIHILLRLHKSRPLVNQLLQLGYKIENPYDLLMDWEKQTPIQIREN  131
             GR L  +DM + +  +L ++H S+ L++ L +LG +  NP  LL   ++       + +
Sbjct:   79 TGRELKPKDMSGRPVAELLRKIHTSKALLDMLKRLGKEPLNPGALLSQLKQAVFAVQQSS  138

Query:  132 TYLQSIVTELKRSLPEFRTEVATIVHGDIKHSNWVITTSGLIYLVDWDSVRLTDRMYDVA  191
                +Q + L+  L E     + H D+ H+NW+++     +YL+DWD   + D    D+
Sbjct:  139 PLIQEGIKYLEEHLHEVHFGEKVVCHCDVNHNNWLLSEDNQLYLIDWDGAMIADPAMDLG  198

Query:  192 YILSHYIPQKHWKDWLSYYGYKDNEKVWSKIIWY                           225
            +L HY+    W+  WLS YG +  E +  ++ WY
Sbjct:  199 PLLYHYVEKPAWESWLSMYGIELTESLRLRMAWY                           232
```

A related DNA sequence was identified in *S. pyogenes* <SEQ ID 3465> which encodes the amino acid sequence <SEQ ID 3466>. Analysis of this protein sequence reveals the following:

```
Possible site: 45
>>> Seems to have no N-terminal signal sequence

----- Final Results -----
            bacterial cytoplasm --- Certainty = 0.2686(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below.

```
Identities = 214/262 (81%), Positives = 242/262 (91%)

Query:    1 MTISNQELTLTPLRGKSGKAYIGTYPNGERVFVKYNTTPILPALAKEQIAPQLLWARRTS   60
            +T + QELTLTPLRGKSGKAY GTYPNGE VF+K NTTPILPALAKEQIAPQLLWA+R
Sbjct:    1 VTTTEQELTLTPLRGKSGKAYKGTYPNGECVFIKLNTTPILPALAKEQIAPQLLWAKRHG   60

Query:   61 NGDMMSAQEWLDGRTLTKEDMGSKQIIHILLRLHKSRPLVNQLLQLGYKIENPYDLLMDW  120
            NGDMMSAQEWL+GRTLTKEDM SKQIIHILLRLHKS+ LVNQLLQL YKIENPYDLL+D+
Sbjct:   61 NGDMMSAQEWLNGRTLTKEDMNSKQIIHILLRLHKSKKLVNQLLQLNYKIENPYDLLVDF  120

Query:  121 EKQTPIQIRENTYLQSIVTELKRSLPEFRTEVATIVHGDIKHSNWVITTSGLIYLVDWDS  180
            E+  P+QI++N+YLQ+IV ELKRSLPEF++EVATIVHGDIKHSNWVITTSG+I+LVDWDS
Sbjct:  121 EQNAPLQIQQNSYLQAIVKELKRSLPEFKSEVATIVHGDIKHSNWVITTSGMIFLVDWDS  180

Query:  181 VRLTDRMYDVAYILSHYIPQKHWKDWLSYYGYKDNEKVWSKIIWYGQFSYLSQIIKCFDK  240
            VRLTDRMYDVAY+LSHYIP+  W +WLSYYGYK+N+KV  KIIWYGQFS+L+QI+KCFDK
Sbjct:  181 VRLTDRMYDVAYLLSHYIPRSRWSEWLSYYGYKNNDKVMQKIIWYGQFSHLTQILKCFDK  240

Query:  241 RDMEHVNQEIYELRKFRELIKK                                       262
            RDMEHVNQEIY LRKFRE+ +K
Sbjct:  241 RDMEHVNQEIYALRKFREIFRK                                       262
```

Based on this analysis, it was predicted that these proteins and their epitopes could be useful antigens for vaccines or diagnostics.

EXAMPLE 1121

A DNA sequence (GBSx1196) was identified in *S. agalactiae* <SEQ ID 3467> which encodes the amino acid sequence <SEQ ID 3468>. Analysis of this protein sequence reveals the following:

```
Possible site: 51
>>> Seems to have no N-terminal signal sequence

----- Final Results -----
            bacterial cytoplasm --- Certainty = 0.4529(Affirmative) < succ>
             bacterial membrane --- Certainty = 0.0000(Not Clear)   < succ>
              bacterial outside --- Certainty = 0.0000(Not Clear)   < succ>
```

The protein has homology with the following sequences in the GENPEPT database.

```
>GP:AAC00285 GB:AF008220 YtmQ [Bacillus subtilis]
Identities = 126/211 (59%), Positives = 161/211 (75%)

Query:    1 MRVRKRKGAEEHLENNPHYVISNPEEAKGRWHEIFGNNNPIHIEVGSGKGAFITGMAEQN   60
            MR+R + A++ L N    ISNP + KG+W+ +FGN+NPIHIEVG+GKG FI+GMA+QN
Sbjct:    1 MRMRHKPWADDFLAENADIAISNPADYKGKWNTVFGNDNPIHIEVGTGKGQFISGMAKQN   60

Query:   61 PDINYIGIDIQLSVLSYALDKVLDSGAKNIKLLLVDGSSLSNYFDTGEVDLMYLNFSDPW  120
            PDINYIGI++  SV+ A+ KV DS A+N+KLL +D  +L++ F+ GEV  +YLNFSDPW
Sbjct:   61 PDINYIGIELFKSVIVTAVQKVKDSEAQNVKLLNIDADTLTDVFEPGEVKRVYLNFSDPW  120

Query:  121 PKKKHEKRRLTYKTFLDTYKDILPEQGEIHFKTDNRGLFEYSLASFSQYGMTLKQVWLDL  180
            PKK+HEKRRLTY   FL   Y++++ + G IHFKTDNRGLFEYSL SFS+YG+ L  V LDL
Sbjct:  121 PKKRHEKRRLTYSHFLKKYEEVMGKGGSIHFKTDNRGLFEYSLKSFSEYGLLLTYVSLDL  180
```

```
Query: 181 HASDYQQNIMTEYERKFSNKGQVIYRVEARF                                   211
            H S+ + NIMTEYE KFS  GQ IYR E  +
Sbjct: 181 HNSNLEGNIMTEYEEKFSALGQPIYRAEVEW                                   211
```

A related DNA sequence was identified in *S. pyogenes* <SEQ ID 3469> which encodes the amino acid sequence <SEQ ID 3470>. Analysis of this protein sequence reveals the following:

```
Possible site: 29
>>> Seems to have no N-terminal signal sequence

----- Final Results -----
            bacterial cytoplasm --- Certainty = 0.3303(Affirmative) < succ>
            bacterial membrane  --- Certainty = 0.0000(Not Clear)   < succ>
            bacterial outside   --- Certainty = 0.0000(Not Clear)   < succ>
```

An alignment of the GAS and GBS proteins is shown below.

```
Identities = 179/211 (84%), Positives = 193/211 (90%)

Query:   1 MRVRKRKGAEEHLENNPHYVISNPEEAKGRWHEIFGNNNPIHIEVGSGKGAFITGMAEQN    60
           MRVRKRKGAEEHL NNPHYVI NPE+AKGRWH++FGN+ PIHIEVGSGKG FITGMA +N
Sbjct:   1 MRVRKRKGAEEHLANNPHYVILNPEDAKGRWHDVFGNDRPIHIEVGSGKGGFITGMALKN    60

Query:  61 PDINYIGIDIQLSVLSYALDKVLDSGAKNIKLLLVDGSSLSNYFDTGEVDLMYLNFSDPW   120
           PDINYIGIDIQLSVLSYALDKVL S   N+KLL VDGSSL+NYF+ GEVD+MYLNFSDPW
Sbjct:  61 PDINYIGIDIQLSVLSYALDKVLASEVPNVKLLRVDGSSLTNYFEDGEVDMMYLNFSDPW   120

Query: 121 PKKKHEKRRLTYKTFLDTYKDILPEQGEIHFKTDNRGLFEYSLASFSQYGMTLKQVWLDL   180
           PK  HEKRRLTYK FLDTYK ILPE GEIHFKTDNRGLFEYSLASFSQYGMTL+Q+WLDL
Sbjct: 121 PKTKHEKRRLTYKDFLDTYKRILPEHGEIHFKTDNRGLFEYSLASFSQYGMTLRQIWLDL   180

Query: 181 HASDYQQNIMTEYERKFSNKGQVIYRVEARF                                   211
           HAS+Y+ N+MTEYE KFSNKGQVIYRVEA F
Sbjct: 181 HASNYEGNVMTEYEEKFSNKGQVIYRVEANF                                   211
```

Based on this analysis, it was predicted that these proteins and their epitopes could be useful antigens for vaccines or diagnostics.

EXAMPLE 1122

A DNA sequence (GBSx1197) was identified in *S. agalactiae* <SEQ ID 3471> which encodes the amino acid sequence <SEQ ID 3472>. Analysis of this protein sequence reveals the following:

```
Possible site: 35
>>> Seems to have no N-terminal signal sequence

----- Final Results -----
            bacterial cytoplasm --- Certainty = 0.1311(Affirmative) < succ>
            bacterial membrane  --- Certainty = 0.0000(Not Clear)   < succ>
            bacterial outside   --- Certainty = 0.0000(Not Clear)   < succ>
```

The protein has homology with the following sequences in the GENPEPT database.

```
>GP:BAB06136 GB:AP001515 unknown conserved protein
[Bacillus halodurans]
Identities = 61/124 (49%), Positives = 81/124 (65%),
Gaps = 2/124 (1%)

Query:   2 GGDYVLSILIDKPGGITVEDTAQLTDVVSPLLDTIQPDPFPEQYMLEVSSPGLERPLKTA    61
           G D+ L + ID   G+ +ED  ++++ +S  LD + DP  + Y LEVSSPG ERPLK
Sbjct:  33 GKDWFLRVFIDSETGVDLEDCGKVSERLSEKLD--ETDPIEQAYFLEVSSPGAERPLKRE    90
```

```
Query:  62 EALSNAVGSYINVSLYKSIDKVKIFEGDLLSFDGETLTIDYMDKTRHKTVDIPYQTVAKA 121
           + L  ++G  ++V+LY+ ID K   EG+L  FDGETLTI+    KTR KTV IPY  VA A
Sbjct:  91 KDLLRSIGKNVHVTLYEPIDGEKALEGELTEFDGETLTIEIKIKTRKKTVTIPYAKVASA 150

Query: 122 RLAV                                                      125
           RLAV
Sbjct: 151 RLAV                                                      154
```

A related DNA sequence was identified in *S. pyogenes* <SEQ ID 3473> which encodes the amino acid sequence <SEQ ID 3474>. Analysis of this protein sequence reveals the following:

```
Possible site: 33
>>> Seems to have no N-terminal signal sequence

----- Final Results -----
              bacterial cytoplasm --- Certainty = 0.3445(Affirmative) < succ>
              bacterial membrane  --- Certainty = 0.0000(Not Clear)   < succ>
              bacterial outside   --- Certainty = 0.0000(Not Clear)   < succ>
```

An alignment of the GAS and GBS proteins is shown below.

```
Identities = 101/127 (79%), Positives = 117/127 (91%)

Query:   1 MGGDYVLSILIDKPGGITVEDTAQLTDVVSPLLDTIQPDPFPEQYMLEVSSPGLERPLKT   60
           MG DY+LSIL+DK GGITVEDT+ LT+++SPLLDTI PDPFP QYMLEVSSPGLERPLKT
Sbjct:  52 MGSDYILSILVDKEGGITVEDTSDLTNIISPLLDTIDPDPFPNQYMLEVSSPGLERPLKT  111

Query:  61 AEALSNAVGSYINVSLYKSIDKVKIFEGDLLSFDGETLTIDYMDKTRHKTVDIPYQTVAK  120
           A++L   AVGSYINVSLY++IDKVK+F+GDLL+FDGETLTIDY+DKTRHK V+IPYQ VAK
Sbjct: 112 ADSLKAAVGSYINVSLYQAIDKVKVFQGDLLAFDGETLTIDYLDKTRHKIVNIPYQAVAK  171

Query: 121 ARLAVKL                                                     127
           R+AVKL
Sbjct: 172 VRMAVKL                                                     178
```

Based on this analysis, it was predicted that these proteins and their epitopes could be useful antigens for vaccines or diagnostics.

EXAMPLE 1123

A DNA sequence (GBSx1198) was identified in *S. agalactiae* <SEQ ID 3475> which encodes the amino acid sequence <SEQ ID 3476>. This protein is predicted to be n utilization substance protein a homolog (nusA). Analysis of this protein sequence reveals the following:

```
Possible site: 36
>>> Seems to have no N-terminal signal sequence

----- Final Results -----
              bacterial cytoplasm --- Certainty = 0.5069(Affirmative) < succ>
              bacterial membrane  --- Certainty = 0.0000(Not Clear)   < succ>
              bacterial outside   --- Certainty = 0.0000(Not Clear)   < succ>
```

A related GBS nucleic acid sequence <SEQ ID 9565> which encodes amino acid sequence <SEQ ID 9566> was also identified.

The protein has homology with the following sequences in the GENPEPT database.

```
>GP: CAB13533 GB: Z99112 nusA [Bacillus subtilis]
Identities = 164/370 (44%), Positives = 251/370 (67%), Gaps = 15/370 (4%)

Query:   4 MSKEMLEAFRILEEEKHINKEDIIDAVTESLKSAYKRRYGQSESCVIEFNEKKADFTVYT   63
```

```
                MS E+L+A  ILE+EK I+KE II+A+  +L SAYKR + Q+++  ++ N +     V+
Sbjct:    1 MSSELLDALTILEKEKGISKEIIIEAIEAALISAYKRNFNQAQNVRVDLNRETGSIRVFA   60

Query:   64 VREVVDEVFDSRLEISLKDALAISSAYELGDKIRFEESVTEFGRVAAQSAKQTIMEKMRR  123
            ++VVDEV+D RLEIS+++A  I   Y +GD +  E +   +FGR+AAQ+AKQ + +++R
Sbjct:   61 RKDVVDEVYDQRLEISIEEAQGIHPEYMVGDVVEIEVTPKDFGRIAAQTAKQVVTQRVRE  120

Query:  124 QMREVTFNEYKQHEGEIMTGTVERFDQRFIYVNLGSLEAQLSHDQIPGESFKSHDMIDV  183
              R V ++E+   E +IMTG V+R D +FIYV+LG +EA L    +Q+P ES+K HD I V
Sbjct:  121 AERGVIYSEFIDREEDIMTGIVQRLDNKFIYVSLGKIEALLPVNEQMPNESYKPHDRIKV  180

Query:  184 YVYKVENNPKGVNVFVSRSHPEFIKRIMEREIPEVFDGTVEIMSVSREAGDRTKVAVRSH  243
            Y+ KVE    KG ++VSR+HP  +KR+ E E+PE++DGTVE+ SV+REAGDR+K+VR+
Sbjct:  181 YITKVEKTTKGPQIYVSRTHPGLLKRLFEIEVPEIYDGTVELKSVAREAGDRSKISVRTD  240

Query:  244 NSNVDAIGTIVGRGGSNIKKVISNFHPKRVDAKTGLEIPVEENIDVIQWVEDPAEFIYNA  303
            + +VD +G+ VG  G  ++ +++               E ID++ W  DP EF+ NA
Sbjct:  241 DPDVDPVGSCVGPKGQRVQAIVNELK--------------GEKIDIVNWSSDPVEFVANA  286

Query:  304 IAPAEVDMVLFDDEDTKRATVVVPDSKLSLAIGRRGQNVRLAAHLTGYRIDIKSASEYEK  363
            ++P++V  V+  ++E+ K    TV+VPD +LSLAIG+RGQN RLAA LTG++IDIKS ++  +
Sbjct:  287 LSPSKVLDVIVNEEE-KATTVIVPDYQLSLAIGKRGQNARLAAKLTGWKIDIKSETDARE  345

Query:  364 MEAQELQTEE                                                   373
             +      + EE
Sbjct:  346 LGIYPRELEE                                                   355
```

A related DNA sequence was identified in *S. pyogenes* <SEQ ID 3477> which encodes the amino acid sequence <SEQ ID 3478>. Analysis of this protein sequence reveals the following:

```
Possible site: 44
>>> Seems to have no N-terminal signal sequence

----- Final Results -----
            bacterial cytoplasm --- Certainty = 0.2074(Affirmative) < succ>
             bacterial membrane --- Certainty = 0.0000(Not Clear)  < succ>
              bacterial outside --- Certainty = 0.0000(Not Clear)  < succ>
```

An alignment of the GAS and GBS proteins is shown below.

```
Identities = 348/380 (91%), Positives = 361/380 (94%), Gaps = 2/380 (0%)

Query:    4 MSKEMLEAFRILEEEKHINKEDIIDAVTESLKSAYKRRYGQSESCVIEFNEKKADFTVYT   63
            MSKEMLEAFRILEEEKHI+K DIIDAVTESLKSAYKRRYGQSESCVIEFNEK ADF V+T
Sbjct:   12 MSKEMLEAFRILEEEKHIDKADIIDAVTESLKSAYKRRYGQSESCVIEFNEKTADFQVFT   71

Query:   64 VREVVDEVFDSRLEISLKDALAISSAYELGDKIRFEESVTEFGRVAAQSAKQTIMEKMRR  123
            VREVV+EVFDSRLEISLKDALAISSAYELGDKIRFEESV EFGRVAAQSAKQTIMEKMRR
Sbjct:   72 VREVVEEVFDSRLEISLKDALAISSAYELGDKIRFEESVNEFGRVAAQSAKQTIMEKMRR  131

Query:  124 QMREVTFNEYKQHEGEIMTGTVERFDQRFIYVNLGSLEAQLSHDQIPGESFKSHDMIDV  183
            QMREV FNEYK+HEGEIMTGTVERFDQRFIYVNLGSLEAQLSHDQIPGE+FKSHD IDV
Sbjct:  132 QMREVMFNEYKEHEGEIMTGTVERFDQRFIYVNLGSLEAQLSHDQIPGETFKSHDRIDV  191

Query:  184 YVYKVENNPKGVNVFVSRSHPEFIKRIMEREIPEVFDGTVEIMSVSREAGDRTKVAVRSH  243
            YVYKVENNPKGVNVFVSRSHPEFIKRIME+EIPEVFDGTVEIMSVSREAGDRTKVAVRSH
Sbjct:  192 YVYKVENNPKGVNVFVSRSHPEFIKRIMEQEIPEVFDGTVEIMSVSREAGDRTKVAVRSH  251

Query:  244 NSNVDAIGTIVGRGGSNIKKVISNFHPKRVDAKTGLEIPVEENIDVIQWVEDPAEFIYNA  303
            N NVDAIGTIVGRGGSNIKKVIS FHPKRVDAKTGLEIPVEENIDVIQWV+DPAEFIYNA
Sbjct:  252 NPNVDAIGTIVGRGGSNIKKVISKFHPKRVDAKTGLEIPVEENIDVIQWVDDPAEFIYNA  311

Query:  304 IAPAEVDMVLFDDEDTKRATVVVPDSKLSLAIGRRGQNVRLAAHLTGYRIDIKSASEYEK  363
            IAPAEVDMVLFDDED KRATVVVPDSKLSLAIGRRGQNVRLAAHLTGYRIDIKSASEY++
Sbjct:  312 IAPAEVDMVLFDDEDLKRATVVVPDSKLSLAIGRRGQNVRLAAHLTGYRIDIKSASEYDR  371

Query:  364 MEAQELQTEEVAQESEVISD                                         383
            +EA+ +   A E V+ D
Sbjct:  372 LEAE--KEAATAVEEPVVDD                                         389
```

Based on this analysis, it was predicted that these proteins and their epitopes could be useful antigens for vaccines or diagnostics.

EXAMPLE 1124

A DNA sequence (GBSx1199) was identified in *S. agalactiae* <SEQ ID 3479> which encodes the amino acid sequence <SEQ ID 3480>. Analysis of this protein sequence reveals the following:

```
Possible site: 37
>>> Seems to have no N-terminal signal sequence

----- Final Results -----
            bacterial cytoplasm --- Certainty = 0.2012(Affirmative) < succ>
             bacterial membrane --- Certainty = 0.0000(Not Clear)   < succ>
              bacterial outside --- Certainty = 0.0000(Not Clear)   < succ>
```

The protein has homology with the following sequences in the GENPEPT database.

```
>GP: CAB13534 GB: Z99112 alternate gene name: ymxB~similar to
hypothetical proteins [Bacillus subtilis]
Identities = 46/92 (50%), Positives = 67/92 (72%), Gaps = 1/92 (1%)

Query:  1 MAKTKKIPLRKSVVSGEVIDKRDLLRIVKNKEGQVFIDPTGKQNGRGAYIKLDNDEAILA    60
          M K KKIPLRK VV+GE+  K++L+R+V++KEG++ +DPTGK+NGRGAY+ LD +  + A
Sbjct:  1 MNKHKKIPLRKCVVTGEMKPKKELIRVVRSKEGEISVDPTGKKNGRGAYLTLDKECILAA    60

Query: 61 KKKRVFDRSFSMEVSDEFYDELLAYVDHKVKR                              92
          KKK     F  ++ D+ +DELL   + KVK+
Sbjct: 61 KKKNTLQNQFQSQIDDQIFDELLELAE-KVKK                              91
```

A related DNA sequence was identified in *S. pyogenes* <SEQ ID 3481> which encodes the amino acid sequence <SEQ ID 3482>. Analysis of this protein sequence reveals the following:

```
Possible site: 61
>>> Seems to have no N-terminal signal sequence

----- Final Results -----
            bacterial cytoplasm --- Certainty = 0.1008(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below.

```
Identities = 77/98 (78%), Positives = 92/98 (93%)

Query:  1 MAKTKKIPLRKSVVSGEVIDKRDLLRIVKNKEGQVFIDPTGKQNGRGAYIKLDNDEAILA    60
          M+K KKIPLRKS+VSGE+I KRDLLRIVK K+GQVFIDPTGKQNGRGAYIKLDN EA++A
Sbjct:  2 MSKVKKIPLRKSLVSGEIIAKRDLLRIVKTKDGQVFIDPTGKQNGRGAYIKLDNQEALMA    61

Query: 61 KKKRVFDRSFSMEVSDEFYDELLAYVDHKVKRRELGLE                        98
          KKK+VF+RSFSH++ + FYD+L+AYVDHK+KRRELGL+
Sbjct: 62 KKKQVFNRSFSMDIPESFYDDLIAYVDHKIKRRELGLD                        99
```

Based on this analysis, it was predicted that these proteins and their epitopes could be useful antigens for vaccines or diagnostics.

EXAMPLE 1125

A DNA sequence (GBSx1200) was identified in *S. agalactiae* <SEQ ID 3483> which encodes the amino acid sequence <SEQ ID 3484>. This protein is predicted to be probable ribosomal protein in infb 5'region. Analysis of this protein sequence reveals the following:

```
Possible site: 19
>>> Seems to have an uncleavable N-term signal seq

----- Final Results -----
           bacterial membrane --- Certainty = 0.0000(Not Clear) < succ>
            bacterial outside --- Certainty = 0.0000(Not Clear) < succ>
          bacterial cytoplasm --- Certainty = 0.0000(Not Clear) < succ>
```

The protein has homology with the following sequences in the GENPEPT database.

```
>GP: BAB06133 GB: AP001515 unknown conserved protein [Bacillus halodurans]
Identities = 46/95 (48%), Positives = 65/95 (68%), Gaps = 1/95 (1%)

Query:   6 KVLNLIGLAQRAGRLITGEELVIKAIQNQQVSLIFLANDAGPNLTKKVTDKSNYYKTEVS  65
           K L+L+GLA RA +L+TGEE V+KA+QN QV+L+ L++DAG +   KK+ DK   Y+  V
Sbjct:   5 KWLSLLGLAARARQLLTGEEQVVKAVQNGQVTLVILSSDAGIHTKKKLLDKCGSYQIPVK  64

Query:  66 TVFSTLELSDALGK-PRKVVAVADAGFSKKMRTLM                          99
           V +    L  A+GK  R V+ V DAGFS+K+  L+
Sbjct:  65 VVGNRQMLGRAIGKHERVVIGVKDAGFSRKLAALI                          99
```

A related DNA sequence was identified in *S. pyogenes* <SEQ ID 3485> which encodes the amino acid sequence <SEQ ID 3486>. Analysis of this protein sequence reveals the following:

```
Possible site: 45
>>> Seems to have no N-terminal signal sequence

----- Final Results -----
          bacterial cytoplasm --- Certainty = 0.1950(Affirmative) < succ>
           bacterial membrane --- Certainty = 0.0000(Not Clear) < succ>
            bacterial outside --- Certainty = 0.0000(Not Clear) < succ>
```

An alignment of the GAS and GBS proteins is shown below.

```
Identities = 75/99 (75%), Positives = 88/99 (88%)

Query:   1 MNNSEKVLNLIGLAQRAGRLITGEELVIKAIQNQQVSLIFLANDAGPNLTKKVTDKSNYY  60
           + N E++ +LIG AQRAG++I+GEELV+KAIQ+QQV L+FLANDAGPN+TKKVTDKSNYY
Sbjct:   1 LTNLERLSSLIGPAQRAGKVISGEELVVKAIQHQQVILVFLANDAGPNVTKKVTDKSNYY  60

Query:  61 KTEVSTVFSTLELSDALGKPRKVVAVADAGFSKKMRTLM                      99
             EVSTV + LELS ALGKPRKV A+ADAGFSKKMRTLM
Sbjct:  61 NVEVSTVLNALELSAALGKPRKVAAIADAGFSKKMRTLM                      99
```

Based on this analysis, it was predicted that these proteins and their epitopes could be useful antigens for vaccines or diagnostics.

EXAMPLE 1126

A DNA sequence (GBSx1201) was identified in *S. agalactiae* <SEQ ID 3487> which encodes the amino acid sequence <SEQ ID 3488>. Analysis of this protein sequence reveals the following:

```
Possible site: 37
>>> Seems to have no N-terminal signal sequence

----- Final Results -----
          bacterial cytoplasm --- Certainty = 0.2873(Affirmative) < succ>
           bacterial membrane --- Certainty = 0.0000(Not Clear) < succ>
            bacterial outside --- Certainty = 0.0000(Not Clear) < succ>
```

A related GBS nucleic acid sequence <SEQ ID 10959> which encodes amino acid sequence <SEQ ID 10960> was also identified.

A related DNA sequence was identified in *S. pyogenes* <SEQ ID 3489> which encodes the amino acid sequence <SEQ ID 3490>. Analysis of this protein sequence reveals the following:

```
Possible site: 37
>>> Seems to have no N-terminal signal sequence

----- Final Results -----
            bacterial cytoplasm --- Certainty = 0.2985(Affirmative) < succ>
            bacterial membrane  --- Certainty = 0.0000(Not Clear)   < succ>
             bacterial outside  --- Certainty = 0.0000(Not Clear)   < succ>
```

An alignment of the GAS and GBS proteins is shown below.

```
Identities = 735/961 (76%), Positives = 805/961 (83%), Gaps = 42/961 (4%)

Query:    1 MSKKRLHEIAKEIGKTSKEVVEQAQSLGLPVKSHASSVEENDATRIVESFS-SSKTKAPT     59
            +SKKRLHEIAKEIGK+SKEVVE A+ LGL VKSHASSVEE DA +I+ SFS +SK
Sbjct:    1 LSKKRLHEIAKEIGESSKEVVEHAKYLGLDVKSHASSVEEADAKKIISSFSKASKPDVTA    60

Query:   60 NSVQTNQGVKTESKTVETKQGLSDDKPSTQPVAKPKPQSRNFKAEREARAKAEAEKRQHN    119
            +        + V    S TV   + G S+      TQ V+KPK  SRNFKAEREARAK +A ++Q N
Sbjct:   61 SQTVKPKEVAQPSVTVVKETG-SEHVEKTQ-VSKPK--SRNFKAEREARAKEQAARKQAN    116

Query:  120 GD----------HRKNNRHNDTRSDDRR--HQGQKRSNGNR-----------NDNRQ--G    154
            G           +R+ N H     D+R H+ Q  +N R            +DN Q   G
Sbjct:  117 GSSHRSQERRGGYRQPNNHQTNEQGDKRITHRSQGDTNDKRIERKASNVSPRHDNHQLVG    176

Query:  155 QQNN----RNKNDGRYADHKQKPQTRPQQPAGNRIDFKARAAALKAEQNAEYSRHSEQRF    210
            +N     N  +GR+ + K++ +   PQ +   +IDFKARAAALKAEQNAEYSR SE RF
Sbjct:  177 DRNRSFAKENHKNGRFTNQKKQGRQEPQSKSP-KIDFKARAAALKAEQNAEYSRQSETRF    235

Query:  211 REEQEAKRQAAKEQELAKAAALKAQEEAQKAKEKLASKPVAKVKEIVNKVAATPSQTADS    270
            R +QEAKR A   ++ AK AALKAQ E    +E   A K + + +        +  TAD+
Sbjct:  236 RAQQEAKRLAELARQEAKEAALKAQAEEMSHREA-ALKSIEEAETKLKSSNISAKSTADN    294

Query:  271 RRKKQTRSDKSRQFSNENEDGQKQTRNKKNWNNQNQVRNQRNSNWNHNKKNKKGK----T    326
            RRKKQ R +K+R+ ++  +++GQK   +NKK+WN+QNQVRNQ+NSNWN NKK KKGK    T
Sbjct:  295 RRKKQARPEKNRELTHHSQEGQK--KNKKSWNSQNQVRNQKNSNWNKNKKTKKGKNVKNT    352

Query:  327 NGAPKPVTERKFHELPKEFEYTEGMTVAEIAKRIKREPAEIVKKLFMMGVMATQNQSLDG    386
            N APKPVTERKFHELPKEFEYTEGMTVAEIAKRIKREPAEIVKKLFMMGVMATQNQSLDG
Sbjct:  353 NTAPKPVTERKFHELPKEFEYTEGMTVAEIAKRIKREPAEIVKKLFMMGVMATQNQSLDG    412

Query:  387 DTIELLMVDYGIEAHAKVEVDEADIERFFADEDYLNPDNLTERPPVVTIMGHVDHGKTTL    446
            DTIELLMVDYGIEA AKVEVD+ADIERFF DE+YLNP+N+ ER PVVTIMGHVDHGKTTL
Sbjct:  413 DTIELLMVDYGIEAKAKVEVDDADIERFFEDENYLNPENIVERAPVVTIMGHVDHGKTTL    472

Query:  447 LDTLRNSRVATGEAGGITQHIGAYQIEEAGKKITFLDTPGHAAFTSMRARGASVTDITIL    506
            LDTLRNSRVATGEAGGITQHIGAYQIEEAGKKITFLDTPGHAAFTSMRARGASVTDITIL
Sbjct:  473 LDTLRNSRVATGEAGGITQHIGAYQIEEAGKKITFLDTPGHAAFTSMRARGASVTDITIL    532

Query:  507 IVAADDGVMPQTVEAINHSKAAGVPIIVAINKIDKPGANPERVISELAEHGVISTAWGGE    566
            IVAADDGVMPQT+EAINHSKAAGVPIIVAINKIDKPGANPERVI+ELAE+G+ISTAWGGE
Sbjct:  533 IVAADDGVMPQTIEAINHSKAAGVPIIVAINKIDKPGANPERVIAELAEYGIISTAWGGE    592

Query:  567 SEFVEISAKFGKNIQELLETVLLVAEMEELKADADVRAIGTVIEARLDKGKGAVATLLVQ    626
             EFVEISAKF KNI ELLETVLLVAE+EELKAD VRAIGTVIEARLDKGKGA+ATLLVQ
Sbjct:  593 CEFVEISAKFNKNIDELLETVLLVAEVEELKADPTVRAIGTVIEARLDKGKGAIATLLVQ    652

Query:  627 QGTLNVQDPIVVGNTFGRVRAMTNDLGRRVKVAGPSTPVSITGLNEAPMAGDHFAVYADE    686
            QGTL+VQDPIVVGNTFGRVRAM NDLGRRVK A PSTPVSITGLNE PMAGDHFAVYADE
Sbjct:  653 QGTLHVQDPIVVGNTFGRVRAMVNDLGRRVKSAEPSTPVSITGLNETPMAGDHFAVYADE    712

Query:  687 KAARAAGEERAKRALLKQRQNTQRVSLENLFDTLKAGEVKSVNVIIKADVQGSVEALAAS    746
            KAARAAGEER+KRALLKQRQNTQRVSL+NLFDTLKAGE+K+VNVIIKADVQGSVEALAAS
Sbjct:  713 KAARAAGEERSKRALLKQRQNTQRVSLDNLFDTLKAGEIKTVNVIIKADVQGSVEALAAS    772

Query:  747 LLKIDVEGVKVNVVHSAVGAINESDVTLAEASNAVIIGFNVRPTPQARQQADADDVEIRQ    806
            L+KI+VEGV+VNVVHSAVGAINESDVTLAEASNAVIIGFNVRPTPQARQQAD DDVEIR
Sbjct:  773 LVKIEVEGVRVNVVHSAVGAINESDVTLAEASNAVIIGFNVRPTPQARQQADTDDVEIRL    832
```

```
-continued
Query:  807 HSIIYKVIEEVEEAMKGKLDPEYQEKILGEAIIRETFKVSKVGTIGGFMVINGKVTRDSS    866
            HSIIYKVIEEVEEAMKGKLDP YQEKILGEAIIRETFKVSKVGTIGGFMVINGKVTRDSS
Sbjct:  833 HSIIYKVIEEVEEAMKGKLDPVYQEKILGEAIIRETFKVSKVGTIGGFMVINGKVTRDSS    892

Query:  867 VRVIRDGVVIFDGKLASLKHYKDDVKEVGNAQEGGLMIENYNDLKEDDTIEAYIMEEIKRK    927
            VRVIRD VVIFDGKLASLKHYKDDVKEVGNAQEGGLMIEN+NDLK DDTIEAYIMEEI RK
Sbjct:  893 VRVIRDSVVIFDGKLASLKHYKDDVKEVGNAQEGGLMIENFNDLKVDDTIEAYIMEEIVRK    953
```

Based on this analysis, it was predicted that this protein and its epitopes, could be useful antigens for vaccines or diagnostics.

EXAMPLE 1127

A DNA sequence (GBSx1202) was identified in *S. agalactiae* <SEQ ID 3491> which encodes the amino acid sequence <SEQ ID 3492>. This protein is predicted to be ribosome binding factor A (rbfA). Analysis of this protein sequence reveals the following:

```
Possible site: 56
>>> Seems to have no N-terminal signal sequence

----- Final Results -----
            bacterial cytoplasm --- Certainty = 0.2557(Affirmative) < succ>
            bacterial membrane  --- Certainty = 0.0000(Not Clear)   < succ>
            bacterial outside   --- Certainty = 0.0000(Not Clear)   < succ>
```

A related GBS nucleic acid sequence <SEQ ID 9567> which encodes amino acid sequence <SEQ ID 9568> was also identified.

A related DNA sequence was identified in *S. pyogenes* <SEQ ID 3493> which encodes the amino acid sequence <SEQ ID 3494>. Analysis of this protein sequence reveals the following:

```
Possible site: 60
>>> Seems to have no N-terminal signal sequence

----- Final Results -----
            bacterial cytoplasm --- Certainty = 0.4765(Affirmative) < succ>
            bacterial membrane  --- Certainty = 0.0000(Not Clear)   < succ>
            bacterial outside   --- Certainty = 0.0000(Not Clear)   < succ>
```

An alignment of the GAS and GBS proteins is shown below.

```
Identities = 93/117 (79%), Positives = 103/117 (87%)
Query:    8 LIMANHRIDRVGMEIKREVNEILRLRVNDPRVQDVTITDVQMLGDLSMAKVFYTIHSTLA    67
            + MANHRIDRVGMEIKREVN+IL+ +V DPRVQ VTIT+VQM GDLS+AKV+YTI S LA
Sbjct:    1 MAMANHRIDRVGMEIKREVNDILQKKVRDPRVQGVTITEVQMQGDLSLAKVYYTIMSDLA    60

Query:   68 SDNQKAQIGLEKATGTIKRELGKNLTMYKIPDLQFVKDESIEYGNKIDEMLRNLDKK     124
            SDNQKAQ GLEKATGTIKRELGK LTMYKIPDL F KD SI YGNKID++LR+LD K
Sbjct:   61 SDNQKAQTGLEKATGTIKRELGKQLTMYKIPDLVFEKDNSIAYGNKIDQLLRDLDNK     117
```

Based on this analysis, it was predicted that these proteins and their epitopes could be useful antigens for vaccines or diagnostics.

EXAMPLE 1128

A DNA sequence (GBSx1203) was identified in *S. agalactiae* <SEQ ID 3495> which encodes the amino acid sequence <SEQ ID 3496>. This protein is predicted to be esterase. Analysis of this protein sequence reveals the following:

```
Possible site: 28
>>> Seems to have a cleavable N-term signal seq.
```

```
----- Final Results -----
           bacterial outside --- Certainty = 0.3000(Affirmative) < succ>
          bacterial membrane --- Certainty = 0.0000(Not Clear) < succ>
          bacterial cytoplasm --- Certainty = 0.0000(Not Clear) < succ>
```

The protein has homology with the following sequences in the GENPEPT database.

```
>GP:AAA79277 GB:M64783 acetyl-hydrolase [Streptomyces hygroscopicus]
Identities = 58/220 (26%), Positives = 90/220 (40%), Gaps = 8/220 (3%)
Query:   98 WNDNGKANQKTIFYLAGGSYLNNPTPYHISMLKTLSTSLDAKIILPIYPKTPRYTYDYAI  157
            W   + + +T+ YL GGSY      H  +  L  + A ++   Y + P   +  A+
Sbjct:   58 WVRPARQDGRTLLYLHGGSYALGSPQSHRHLSSALGDAAGAAVLALHYRRPPESPFPAAV  117

Query:  158 PRLVNLYRHFHEKN---ANLTLMGDSAGGGLALGLAHALSHQSGQEAIPQPKNIILLSPW  214
              V   YR    E+      +TL GDSAG GLA+       AL         P P  + +SPW
Sbjct:  118 EDAVAAYRMLLEQGCPPGRVTLAGDSAGAGLAVAALQALR----DAGTPLPAAAVCISPW  173

Query:  215 LDVTMKHPEIPKYEDTDPILSAWGLARVGEIWANGSNNTNHTYVSPKNAPATKLAPITLF  274
              D+   +        +  + +L    L  R+ E  +  G+ +  H     SP +    T L P+ +
Sbjct:  174 ADLACEGASHTTRKAREILLDTADLRRMAERYLAGT-DPRHPLASPAHGDLTGLPPLLIQ  232

Query:  275 TGTREIFFPDIRDYAAQLQAANHPVNYIAQEGMNHVYPIY                      314
              G+ E+    D R        A  PV +      M HV+  Y
Sbjct:  233 VGSEEVLHDDARALEQAALKAGTPVTFEEWPEMFHVWHWY                      272
```

A related DNA sequence was identified in *S. pyogenes* <SEQ ID 3497> which encodes the amino acid sequence <SEQ ID 3498>. Analysis of this protein sequence reveals the following:

```
Possible site: 27
>>> Seems to have a cleavable N-term signal seq.

----- Final Results -----
           bacterial outside --- Certainty = 0.3000(Affirmative) < succ>
          bacterial membrane --- Certainty = 0.0000(Not Clear) < succ>
          bacterial cytoplasm --- Certainty = 0.0000(Not Clear) < succ>
```

An alignment of the GAS and GBS proteins is shown below.

```
Identities = 244/334 (73%), Positives = 280/334 (83%), Gaps = 6/334 (1%)
Query:    1 MKPSFKKLLLLFSIITILSIACTPHAKASGRSWKSWFIEQYFWLKRDKSYYKVQDESSFQ   60
            +K   +K L+   ++ L +   TP A AS RSWKSWFIEQYFWLKRDKSYY  QD+ SFQ
Sbjct:    1 LKHPIRKTLVTLGLLLTLCLP-TPVA-ASSRSWKSWFIEQYFWLKRDKSYYSKQDDPSFQ   58

Query:   61 KYLNASREQSDKGYYLDPNSVNGGLVQERLFDMQVYSWNDNGKANQKTIFYLAGGSYLNN  120
            +YL+A REQSDK Y LD N VNG LVQE L+ MQVYSWNDNGK +QKTI YLAGGSYLNN
Sbjct:   59 RYLDACREQSDKPYQLDTNLVNGPLVQENLYGMQVYSWNDNGKPDQKTIIYLAGGSYLNN  118

Query:  121 PTPYHISMLKTLSTSLDAKIILPIYPKTPRYTYDYAIPRLVNLYRHFHEKNANLTLMGDS  180
            PT YHI+MLKTLSTSLDAKI+LPIYPK PRYTY+Y +P+LVNLY+H++ KN N+ LMGDS
Sbjct:  119 PTTYHINMLKTLSTSLDAKIVLPIYPKAPRYTYNYTMPKLVNLYQHYYHKNQNVFLMGDS  178

Query:  181 AGGGLALGLAHALSHQSGQEAIPQPKNIILLSPWLDVTMKHPEIPKYEDTDPILSAWGLA  240
            AGGGLALGLAHAL +    E++PQPK ++LLSPWLDVTM HPEIP+YED DPILS+WGL
Sbjct:  179 AGGGLALGLAHALHN----ESVPQPKQLVLLSPWLDVTMSHPEIPEYEDADPILSSWGLK  234

Query:  241 RVGEIWANGSNNTNHTYVSPKNAPATKLAPITLFTGTREIFFPDIRDYAAQLQAANHPVN  300
            RVGE+WA  ++NTNH YVSPKN P T L PITLFTGTREIF+PDIRDYAA+L+AANH +
Sbjct:  235 RVGELWAYSADNTNHIYVSPKNGPITYLPPITLFTGTREIFYPDIRDYAAKLKAANHNIT  294

Query:  301 YIAQEGMNHVYPIYPIEEAKTAQYQMIDIINKTP                            334
            +I QEGMNHVYPIYPIEEAKTAQYQ+ID INKTP
Sbjct:  295 FITQEGMNHVYPIYPIEEAKTAQYQIIDAINKTP                            328
```

A related GBS gene <SEQ ID 8731> and protein <SEQ ID 8732> were also identified. Analysis of this protein sequence reveals the following:

```
Lipop: Possible site: -1 Crend: 6
McG: Discrim Score: 11.88
GvH: Signal Score (-7.5): -1.33
     Possible site: 28
>>> Seems to have a cleavable N-term signal seq.
ALOM program count: 0 value: 4.03 threshold: 0.0
   PERIPHERAL Likelihood = 4.03 174
modified ALOM score: -1.31
*** Reasoning Step: 3

----- Final Results -----
              bacterial outside --- Certainty = 0.3000(Affirmative) < succ>
              bacterial membrane --- Certainty = 0.0000(Not Clear) < succ>
              bacterial cytoplasm --- Certainty = 0.0000(Not Clear) < succ>
```

The protein has homology with the following sequences in the databases:

```
28.4/46.2% over 220aa
Streptomyces hydroscopicus
EGAD|5925| acetyl-hydrolase Insert characterized
ORF00486(5889-1245 of 1602)
EGAD|5925|5724(57-277 of 300) acetyl-hydrolase {Streptomyces hygroscopicus}
% Match = 6.8
% Identity = 28.3   % Similarity = 46.1
Matches = 62   Mismatches = 111   Conservative Sub.s = 39
  462       492       522       552       582       612       642       669
KRDKSYYKVQDESSFQKYLNASREQSDKGYYLDPNSVNGGLVQERLFDMQVYSWNDNGKANQKTIFYLAGGSY-LNNPTP
   :  ::     :    |  :    ::          |    : : :|::||   ||||  |  :|
ELELVRELIELNWHTRNGEMEPRRIAYDRAQEAFGNLGVPPGDVVTGHCTAEWVRPARQDGRTLLYLHGGSYALGSPQS
            20        30        40        50        60        70        80
  696       726       756       786                837       867       897
Y-HISMLKTLSTSLDAKIILPIYPKTPRYTYDYAIPRLVNLYRHFHEKN---ANLTLMGDSAGGGLALGLAHALSHQSGQ
: |:|   |   : |:: | : |:     :  |:   |  ||  :|:       :|| |||||  |||:    :||
HRHLS--SALGDAAGAAVLALHYRRPPESPFPAAVEDAVAAYRMLLEQGCPPGRVTLAGDSAGAGLAVAALQAL----RD
              100       110       120       130       140       150
  927       957       987       1017      1047      1077      1107      1137
EAIPQPKNIILLSPWLDVTMKHPEIPKYEDTDPILSAWGLARVGEIWANGSNNTNHTYVSPKNAPATKLAPITLFTGTRE
    |  |   : :|||  |:       :    : :|   | |: |  :|:    |   ||      ||| : : |: |
AGTPLPAAAVCISPWADLACEGASHTTRKAREILLDTADLRRMAERYLAGTD-PRHPLASPAHGDLTGLPPLLIQVGSEE
            170       180       190       200       210       220       230
  1167      1197      1227      1245      1275      1305      1335      1365
IFFPDIRDYAAQLQAANHPVNYIAQEGMNHV----YPIYPIEEAKTAQYQMIDIINKTP*Y*LSQL*SYKK*TMILTWFI
::  | |       |    | ||   |||    :|:  |       :       :       :        |
VLHDDARALEQAALKAGTPVTFEEWPEMFHVWHWYHPVLPEGRRAAIEVAGAFLRTATGEGLK
            250       260       270       280       290       300
```

SEQ ID 8732 (GBS149) was expressed in *E. coli* as a His-fusion product. SDS-PAGE analysis of total cell extract is shown in FIG. 23 (lane 6; MW 37 kDa).

Figure 291:
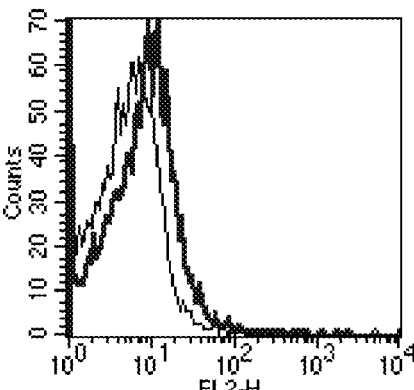

The GBS149-His fusion product was purified (FIG. 196, lane 6) and used to immunise mice. The resulting antiserum was used for FACS (FIG. 291), which confirmed that the protein is immunoaccessible on GBS bacteria.

Based on this analysis, it was predicted that these proteins and their epitopes could be useful antigens for vaccines or diagnostics.

EXAMPLE 1129

A DNA sequence (GBSx1204) was identified in *S. agalactiae* <SEQ ID 3499> which encodes the amino acid sequence <SEQ ID 3500>. This protein is predicted to be CopY. Analysis of this protein sequence reveals the following:

```
Possible site: 22
>>> Seems to have no N-terminal signal sequence

----- Final Results -----
              bacterial cytoplasm --- Certainty = 0.3140(Affirmative) < succ>
              bacterial membrane --- Certainty = 0.0000(Not Clear) < succ>
              bacterial outside --- Certainty = 0.0000(Not Clear) < succ>
```

The protein has homology with the following sequences in the GENPEPT database.

```
>GP:AAG10085 GB:AF296446 CopY [Streptococcus mutans]
Identities = 67/137 (48%), Positives = 98/137 (70%)
Query:    2 TISSAEWEIMRVVWAQQNTTSNEILAVLLEKYDWTPSTVKTLLRRLLDKGYVSREKMGKG   61
            +IS+AEWE+MRVVWA+Q T+S+EI+A+L   Y W+ ST+KTL+ RL +KGY++ ++ G+
Sbjct:    3 SISNAEWEVMRVVWAKQMTSSSEIIAILSRTYCWSASTIKTLITRLSEKGYLTSQRQGRK   62

Query:   62 FSYSPLIDEDLAMMSEVDSVFQKVCQTKHVAIVRHLLESIPMTEKDRLNLQSSLEAKKGK  121
            + YS LI E+ A+  +V  VF ++C TKH A++RHL+E  PMT   D    L++  L +KK
Sbjct:   63 YIYSSLISEEEALEQQVSEVFSRICVTKHQALIRHLVEETPMTLSDIEKLEALLLSKKAN  122

Query:  122 TLERVACNCIPGQCQCH                                            138
             +   V CNCI GQC C+
Sbjct:  123 AVPEVKCNCIVGQCSCY                                            139
```

A related DNA sequence was identified in *S. pyogenes* <SEQ ID 3501> which encodes the amino acid sequence <SEQ ID 3502>. Analysis of this protein sequence reveals the following:

```
Possible site: 13
>>> Seems to have no N-terminal signal sequence

----- Final Results -----
             bacterial cytoplasm --- Certainty = 0.2331(Affirmative) < succ>
             bacterial membrane  --- Certainty = 0.0000(Not Clear)   < succ>
             bacterial outside   --- Certainty = 0.0000(Not Clear)   < succ>
```

An alignment of the GAS and GBS proteins is shown below.

```
Identities = 54/135 (40%), Positives = 84/135 (62%)
Query:    3 ISSAEWEIMRVVWAQQNTTSNEILAVLLEKYDWTPSTVKTLLRRLLDKGYVSREKMGKGF   62
            IS+AEWE+MRVVWA  +  S++I+ +L +KY W+ ST+KTL+ RL+ K +++  + G+ +
Sbjct:   10 ISAAEWEVMRVVWASGDIKSSDIITILRKKYQWSDSTIKTLIGRLVKKNFLTSYRQGRAY   69

Query:   63 SYSPLIDEDLAMMSEVDSVFQKVCQTKHVAIVRHLLESIPMTEKDRLNLQSSLEAKKGKT  122
             Y  L+DE L    + +V  +CQ +H ++   L  +PMT ++     Q   LE KK
Sbjct:   70 IYQALLDETLLQKEALATVLDGICQRQHTRLLLERLYHLPMTLEEIGAFQELLEVKKENA  129

Query:  123 LERVACNCIPGQCQC                                              137
             +  V CNC+PGQC C
Sbjct:  130 VLEVPCNCLPGQCHC                                              144
```

Based on this analysis, it was predicted that these proteins and their epitopes could be useful antigens for vaccines or diagnostics.

EXAMPLE 1130

A DNA sequence (GBSx1206) was identified in *S. agalactiae* <SEQ ID 3503> which encodes the amino acid sequence <SEQ ID 3504>. This protein is predicted to be CopA. Analysis of this protein sequence reveals the following:

```
Possible site: 19
>>> Seems to have no N-terminal signal sequence
    INTEGRAL    Likelihood = -9.82    Transmembrane   382-398  (370-406)
    INTEGRAL    Likelihood = -8.01    Transmembrane   356-372  (344-374)
    INTEGRAL    Likelihood = -2.50    Transmembrane   719-735  (719-738)
    INTEGRAL    Likelihood = -2.28    Transmembrane   202-218  (202-218)
    INTEGRAL    Likelihood = -1.59    Transmembrane   693-709  (691-712)
    INTEGRAL    Likelihood = -1.33    Transmembrane   167-183  (167-183)

----- Final Results -----
             bacterial membrane  --- Certainty = 0.4927(Affirmative) < succ>
             bacterial outside   --- Certainty = 0.0000(Not Clear)   < succ>
             bacterial cytoplasm --- Certainty = 0.0000(Not Clear)   < succ>
```

The protein has homology with the following sequences in the GENPEPT database.

```
>GP:AAG10086 GB:AF296446 CopA [Streptococcus mutans]
Identities = 440/740 (59%), Positives = 571/740 (76%), Gaps = 1/740 (0%)
Query:   5 KETFLIDGMTCASCALTIEKAVNKLDHVDSAVVNLATEKMTVTFDDTTLSPNVIEECVSE  64
           +E FLIDGMTCASCA+ +E AV KLD ++SAVVNL TEKMT+ +D   +S   + + V+
Sbjct:   3 EEVFLIDGMTCASCAINVENAVKKLDGIESAVVNLTTEKMTIDYDAAKVSEADVTKAVAG  62

Query:  65 SGYEASLFKEETSKSQSERHQLAIEKMWHRFWMSAVATIPLLYISMGPMINLWLPSFLMP 124
           +GY A ++   T++SQ +R + + + R   +++ TIPL YI+MG M+ L LP+FL P
Sbjct:  63 AGYGAKVYDPTTAESQKDREEHKLAGIKKRLLWTSIFTIPLFYIAMGSMVGLPLPNFLAP 122

Query: 125 DKGPLNYGMIQLLLTLPVMYFGRIFYQNGFKALFKRHPNMDSLVAIATTAAFIYSLYGLY 184
              PL Y M+ LLLT+PV+    FY NGF++LFK HPNMDSLV++ATTAAF+YSLYG Y
Sbjct: 123 SSAPLTYAMVLLLLTIPVIVLSWSFYDNGFRSLFKGHPNMDSLVSLATTAAFLYSLYGTY 182

Query: 185 EILQGDIHYAHQLYFESVAVILTLITLGKYFEILSKGRTSASIEKLLTLSAKEARVIKDG 244
            +  G  H+AH LY+ESVAVILTLITLGKYFE LSKGRTS +I+KL+  LSAKEA +I+DG
Sbjct: 183 HVYLGHTHHAHHLYYESVAVILTLITLGKYFETLSKGRTSDAIKKLMHLSAKEATLIRDG 242

Query: 245 EDYMVPLDKVKIGETILVKPGEKIPLDGHVVAGESSIDESMLTGESIPVEKKVGSKVYGA 304
           E+  VP+++V+I +  ILVKPGEKIP+DG V++G S+IDESMLTGESIP+EK    S VY
Sbjct: 243 EEIKVPIEQVQIRDQILVKPGEKIPVDGRVLSGHSAIDESMLTGESIPIEKMADSPVYAG 302

Query: 305 SINGQGSLTIFVEKEAGGSLLSQIINLVEAAQTSKAPIANLADKVSGVFVPFVIVIAILS 364
           SINGQGSLT    EK   +LLSQII LVE AQ +KAPIA +ADKVS VFVP +I IAIL+
Sbjct: 303 SINGQGSLTFEAEKVGNETLLSQIIKLVENAQQTKAPIAKIADKVSAVFVPVIITIAILT 362

Query: 365 GLSWYLILGQSFAFSLKIMIAVLVIACPCALGLATPTAIMVASGKAAENGILFKGGEVLE 424
           GL WY ++GQ F FS+ I +AVLVIACPCALGLATPTAIMV +G+AAENGIL+K G+VLE
Sbjct: 363 GLFWYFVMGQDFTFSMTISVAVLVIACPCALGLATPTAIMVGTGRAAENGILYKRGDVLE 422

Query: 425 KAHHIDTIVFDKTGTLTKGKPEVVAIKTYGGDKEEFLGQVASVEKLSNHPLSQTIVNKAK 484
             AH I+TIVFDKTGT+T+GKPEVV   +Y  D+ + +    A++E LS HPLSQ IV+ AK
Sbjct: 423 LAHQINTIVFDKTGTITQGKPEVVHQFSY-HDRTDLVQVTAALEALSEHPLSQAIVDYAK 481

Query: 485 EKELPLREVMAFKNILGYGLSATINGKTMLVGNANLMTKNDVNLDLAKADIEIAQEEAQT 544
              ++   L  V F ++ G GL   +  +T+LVGN  LM +  +++L+ A+AD + A   + QT
Sbjct: 482 KEGTHLLAVDDFTSLTGLGLKGCVADETLLVGNEKLMRQANISLEQAQADFKAATAQGQT 541

Query: 545 VVYVSENGVLSGLITLTDQLKTDSQETVKQLQRLGFNLVLLTGDNKASADAIAQKLGITT 604
             ++V+ +G L GLIT+ D++K DS   TVK LQ +G  + +LTGDN+ +A AIA+++GIT+
Sbjct: 542 PIFVASDGQLLGLITIADKVKNDSAATVKALQNMGVEVAMLTGDNEETAQAIAKEVGITF 601

Query: 605 VVSEVLPDQKANVILELKEKGGQIAMVGDGINDAPALASSDVGISMSSGTDIAIESADIV 664
                V+S+V   +K    IL+L+ +G ++AMVGDGINDAPALA++D+GISM SGTDIA+ESADIV
Sbjct: 602 VISQVFSQEKTQAILDLQAEGKKVAMVGDGINDAPALATADIGISMGSGTDIAMESADIV 661

Query: 665 LMKPELTDLLKAMTISKQTIQIIKENLFWAFFYNVLAIPVAMGVLHLFGGPLLNPMLAGL 724
           LMKP + D++ KA+ IS+ TI   IKENLFWAF YNVL++P+AMGVL+LFGGPLL+PM+AGL
Sbjct: 662 LMKPAMLDIIKALKISRVTIINIKENLFWAFIYNVLSVPIAMGVLYLFGGPLLDPMIAGL 721

Query: 725 AMAFSSVSVVLNALRLKVLK                                         744
           AM+FSSVSVVLNALRLKV+K
Sbjct: 722 AMSFSSVSVVLNALRLKVVK                                         741
```

There is also homology to SEQ ID 3506.

Based on this analysis, it was predicted that this protein and its epitopes, could be useful antigens for vaccines or diagnostics.

EXAMPLE 1131

A DNA sequence (GBSx1207) was identified in *S. agalactiae* <SEQ ID 3507> which encodes the amino acid sequence <SEQ ID 3508>. This protein is predicted to be cation-transporting ATPase, P-type (pacS). Analysis of this protein sequence reveals the following:

```
Possible site: 28
>>> Seems to have no N-terminal signal sequence

----- Final Results -----
         bacterial cytoplasm --- Certainty = 0.1934(Affirmative) < succ>
         bacterial membrane  --- Certainty = 0.0000(Not Clear)   < succ>
         bacterial outside   --- Certainty = 0.0000(Not Clear)   < succ>
```

The protein has homology with the following sequences in the GENPEPT database.

```
>GP: AAG10087 GB: AF296446 CopZ [Streptococcus mutans]
Identities = 31/67 (46%), Positives = 43/67 (63%)

Query:   1 MKHTYRVSGMKCDGCAKTVSDKLSSVIGVDEVNVDLTKNQVVVSGKTFKWLLKRSLKDTK   60
           M+ TY + G+KC GCA  V+ + S +  V++V VDL K +V ++G   KW LKR+LK T
Sbjct:   1 MEKTYHIDGLKCQGCADNVTKRFSELKKVNDVKVDLDKKEVRITGNPSKWSLKRALKGTN   60

Query:  61 YSLEEEI                                                      67
           Y L  EI
Sbjct:  61 YELGAEI                                                      67
```

A related DNA sequence was identified in *S. pyogenes* <SEQ ID 3509> which encodes the amino acid sequence <SEQ ID 3510>. Analysis of this protein sequence reveals the following:

```
Possible site: 18
>>> Seems to have no N-terminal signal sequence

----- Final Results -----
            bacterial cytoplasm --- Certainty = 0.2997(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below.

```
Identities = 33/63 (52%), Positives = 48/63 (75%)

Query:   1 MKHTYRVSGMKCDGCAKTVSDKLSSVIGVDEVNVDLTKNQVVVSGKTFKWLLKRSLKDTK   60
           M+  Y+V+GM CDGCA+TV++KLS+V GV  V V+L K +  V+G+   +L+KR+LKDTK
Sbjct:   1 MEKHYQVTGMTCDGCARTVTEKLSAVPGVQSVQVNLEKGEAKVTGRPLTFLIKRALKDTK   60

Query:  61 YSL                                                          63
           + L
Sbjct:  61 FEL                                                          63
```

Based on this analysis, it was predicted that these proteins and their epitopes could be useful antigens for vaccines or diagnostics.

EXAMPLE 1132

A DNA sequence (GBSx1208) was identified in *S. agalactiae* <SEQ ID 3511> which encodes the amino acid sequence <SEQ ID 3512>. Analysis of this protein sequence reveals the following:

```
Possible site: 20
>>> Seems to have a cleavable N-term signal seq.
      INTEGRAL     Likelihood = -7.59     Transmembrane      67-83  (65-90)
      INTEGRAL     Likelihood = -3.72     Transmembrane      35-51  (31-51)
      INTEGRAL     Likelihood = -3.61     Transmembrane     122-138 (120-139)
      INTEGRAL     Likelihood = -1.59     Transmembrane     154-170 (154-171)

----- Final Results -----
             bacterial membrane --- Certainty = 0.4036(Affirmative) < succ>
              bacterial outside --- Certainty = 0.0000(Not Clear)   < succ>
            bacterial cytoplasm --- Certainty = 0.0000(Not Clear)   < succ>
```

A related GBS nucleic acid sequence <SEQ ID 8733> which encodes amino acid sequence <SEQ ID 8734> was also identified. Analysis of this protein sequence reveals the following:

```
Lipop: Possible site: -1 Crend: 5
McG: Discrim Score: 4.09
GvH: Signal Score (-7.5): 3.87
     Possible site: 20
```

```
                            -continued
>>> Seems to have a cleavable N-term signal seq.
ALOM program count: 4 value: -7.59 threshold: 0.0
    INTEGRAL      Likelihood = -7.59    Transmembrane     65-81  (63-88)
    INTEGRAL      Likelihood = -3.72    Transmembrane     33-49  (29-49)
    INTEGRAL      Likelihood = -3.61    Transmembrane    120-136 (118-137)
    INTEGRAL      Likelihood = -1.59    Transmembrane    152-168 (152-169)
    PERIPHERAL    Likelihood =  0.85       96
modified ALOM score: 2.02
*** Reasoning Step: 3

----- Final Results -----
            bacterial membrane --- Certainty = 0.4036(Affirmative) < succ>
             bacterial outside --- Certainty = 0.0000(Not Clear)   < succ>
           bacterial cytoplasm --- Certainty = 0.0000(Not Clear)   < succ>
```

The protein has homology with the following sequences in the GENPEPT database.

```
>GP: CAB15351 GB: Z99121 similar to hypothetical proteins [Bacillus subti-
lis]
Identities = 107/192 (55%), Positives = 137/192 (70%)

Query:    8 WNILSLVGTVAFASSGAIVAIEEEFDILGLFILGFVTAFGGGAIRNVLIGLPIETLWSQG   67
            W +LS++G +AFA SGAIVA+EEE+DILG++ILG VTAFGGGAIRN+LIG+P+  LW QG
Sbjct:    3 WELLSVIGIIAFAVSGAIVAMEEEYDILGVYILGIVTAFGGGAIRNLLIGVPVSALWEQG   62

Query:   68 IAFYAAAAAILFIMIFPNLLSGKGRDAEVVSDAIGLAAFSVQGALYATQSHQPLSAVIVA  127
              F  A  +I + ++FP LL       +SDAIGLAAF++QGALYA +   PLSAVIVA
Sbjct:   63 AYFQIALLSITIVFLFPKLLLKHWNKWGNLSDAIGLAAFAIQGALYAVKMGHPLSAVIVA  122

Query:  128 AVLTGAGGGIVRDVLAGRKPGVLRSEIYAGWSILVGIILYFKIAKTTTDYYLLVLVVTSL  187
            AVLTG+GGGI+RD+LAGRKP VL++EIYA W+ L G+I+        +   Y+L V+
Sbjct:  123 AVLTGSGGGIIRDLLAGRKPLVLKAEIYAVWAALGGLIVGLGWLGNSFGLYVLFFVLVVC  182

Query:  188 RMLGYKKQWHLP                                                199
            R+   Y    W LP
Sbjct:  183 RVCSYMFNWKLP                                                194
```

A related DNA sequence was identified in *S. pyogenes* <SEQ ID 3513> which encodes the amino acid sequence <SEQ ID 3514>. Analysis of this protein sequence reveals the following:

```
Possible site: 27
>>> Seems to have a cleavable N-term signal seq.
    INTEGRAL      Likelihood = -5.15    Transmembrane     70-86  (65-88)
    INTEGRAL      Likelihood = -4.09    Transmembrane     33-49  (29-49)
    INTEGRAL      Likelihood = -2.13    Transmembrane    120-136 (119-137)
    INTEGRAL      Likelihood = -0.43    Transmembrane    173-189 (172-189)

----- Final Results -----
            bacterial membrane --- Certainty = 0.3060(Affirmative) < succ>
             bacterial outside --- Certainty = 0.0000(Not Clear)   < succ>
           bacterial cytoplasm --- Certainty = 0.0000(Not Clear)   < succ>
```

The protein has homology with the following sequences in the databases:

```
>GP: BAB05428 GB: AP001512 unknown conserved protein [Bacillus halodurans]
Identities = 109/195 (55%), Positives = 137/195 (69%)

Query:    6 WEILNIIGTIAFALSGAIVAMEEEFDILGIFILGFVTAFGGGAIRNTLIGLPIEALWGQK   65
            W++LN+IGTIAFALSG IVAMEE+FD++G++ILGFVTAFGGGAIRN LIG+P+ ALW Q
Sbjct:    3 WDVLNVIGTIAFALSGVIVAMEEDFDLMGVYILGFVTAFGGGAIRNLLIGVPVSALWEQG   62

Query:   66 PEFTCAFFAMVLIMLFPKLMARGWVRAAVLTDAIGLAAFSVQGALHAVRLNQPLSAVIVT  125
              FT AF M +    P L  W++ +L DAIGLAAF++QGAL A  ++ PLSAVIV
Sbjct:   63 TLFTIAFIVMTIAFFLPNLWINHWLKFGLLFDAIGLAAFAIQGALFATSMDHPLSAVIVA  122

Query:  126 AVLTGAGGGVVRDILAGRKPSVLRSEIYAGWSILAAIVLHFKLADSTIECYALVVLLTTL  185
            A LTGAGGG+VRD+LA RKP VL  EIY GW++LA  +    I    L++L+    L
Sbjct:  123 AALTGAGGGIVRDMLARRKPLVLSKEIYIGWAMLAGAAIGLNIVSGPIGIGFLIILVVFL  182
```

```
                                    -continued
Query:  186 RMIGNRKKWNLPKIK                                                 200
            RM+     W LP  K
Sbjct:  183 RMLSVHYNWCLPHRK                                                 197
```

An alignment of the GAS and GBS proteins is shown below.

```
Identities = 133/200 (66%), Positives = 168/200 (83%)

Query:     3 MSIDIWNILSLVGTVAFASSGAIVAIEEEFDILGLFILGFVTAFGGGAIRNVLIGLPIET    62
             M+ID+W IL+++GT+AFA SGAIVA+EEEFDILG+FILGFVTAFGGGAIRN LIGLPIE
Sbjct:     1 MTIDMWEILNIIGTIAFALSGAIVAMEEEFDILGIFILGFVTAFGGGAIRNTLIGLPIEA   60

Query:    63 LWSQGIAFYAAAAAILFIMIFPNLLSGKGRDAEVVSDAIGLAAFSVQGALYATQSHQPLS   122
             LW Q   F  A  A++ IM+FP L++     A V++DAIGLAAFSVQGAL+A + +QPLS
Sbjct:    61 LWGQKPEFTCAFFAMVLIMLFPKLMARGWVRAAVLTDAIGLAAFSVQGALHAVRLNQPLS   120

Query:   123 AVIVAAVLTGAGGGIVRDVLAGRKPGVLRSEIYAGWSILVGIILYFKIAKTTTDYYLLVL   182
             AVIV AVLTGAGGG+VRD+LAGRKP VLRSEIYAGWSIL  I+L+FK+A +T +  Y LV+
Sbjct:   121 AVIVTAVLTGAGGGVVRDILAGRKPSVLRSEIYAGWSILAAIVLHFKLADSTIECYALVV   180

Query:   183 VVTSLRMLGYKKQWHLPVVR                                           202
             ++T+LRM+G +K+W+LP ++
Sbjct:   181 LLTTLRMIGNRKKWNLPKIK                                           200
```

Based on this analysis, it was predicted that these proteins and their epitopes could be useful antigens for vaccines or diagnostics.

EXAMPLE 1133

A DNA sequence (GBSx1209) was identified in *S. agalactiae* <SEQ ID 3515> which encodes the amino acid sequence <SEQ ID 3516>. Analysis of this protein sequence reveals the following:

```
Possible site: 42
>>> Seems to have no N-terminal signal sequence

----- Final Results -----
            bacterial cytoplasm --- Certainty = 0.2805(Affirmative) < succ>
            bacterial membrane  --- Certainty = 0.0000(Not Clear)   < succ>
             bacterial outside  --- Certainty = 0.0000(Not Clear)   < succ>
```

A related GBS nucleic acid sequence <SEQ ID 9569> which encodes amino acid sequence <SEQ ID 9570> was also identified.

The protein has homology with the following sequences in the GENPEPT database.

```
>GP: CAB94816 GB: AJ245582 hypothetical protein
[Streptococcus thermophilus]
Identities = 138/238 (57%), Positives = 184/238 (76%)

Query:     5 KKMIKLIAIDMDGTLLNDEKKIPKENIQAIKEATQAGIKIVLCTGRPMSGILPYFNELGL    64
             +  +KLIAIDMDGTLLN +K+IPKENI+AI+EAT AGIKIVLCTGRP SGI+P+F +LGL
Sbjct:     3 QNQVKLIAIDMDGTLLNSQKEIPKENIKAIQEATAAGIKIVLCTGRPRSGIVPHFEKLGL   62

Query:    65 TKEEYIIMNNGCSTYSTKDWQLIDSATLTHDELIFLEEVVKEFPNVCLTLTAENTFYAVG   124
             ++EE+IIMNNGCSTY TK+W L++S +L+   E+   L +   ++FP V LT T E ++Y VG
Sbjct:    63 SEEEFIIMNNGCSTYETKNWTLLESESLSRSEMEELLQACEDFPGVALTFTGEKSYYVVG   122

Query:   125 EEVPEIVAYDADLVFTKAKSTSLDALRNQEEIVFQAMYMGLDADVTAFQEAVEEALISKF   184
                EVPE+VAYDA  VFT+AK+ SL+ +  + +++FQAMYM      + AFQ AV++ L    +
Sbjct:   123 NEVPELVAYDAGTVFTEAKARSLEEIFEEGQVIFQAMYMAESEPLDAFQNAVQDRLDQSY   182

Query:   185 SGVRSQDYIYEIMPQGVTKARGLKSLIAKLGLDINQVMAIGDAPNDIELLDLVPNSVA     242
             S VRSQ+YI+E+MPQG TKA GLK L  KL ++ +Q+MA+GDA ND+E+L   V  SVA
Sbjct:   183 STVRSQEYIFEVMPQGATKASGLKHLAEKLDINRDQIMALGDAANDLEMLQFVGQSVA     240
```

A related DNA sequence was identified in *S. pyogenes* <SEQ ID 3517> which encodes the amino acid sequence <SEQ ID 3518>. Analysis of this protein sequence reveals the following:

```
Possible site: 14
>>> Seems to have no N-terminal signal sequence

----- Final Results -----
            bacterial cytoplasm --- Certainty = 0.1468(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below.

```
Identities = 152/270 (56%), Positives = 193/270 (71%)

Query:   6 KMIKLIAIDMDGTLLNDEKKIPKENIQAIKEATQAGIKIVLCTGRPMSGILPYFNELGLT   65
           +MI+LIAID+DGTLLN +K+IPKENI AI+EA Q+G+KIVLCTGRP SG  PYF++LGLT
Sbjct:  19 RMIQLIAIDLDGTLLNQDKQIPKENITAIQEAAQSGLKIVLCTGRPQSGTRPYFDQLGLT   78

Query:  66 KEEYIIMNNGCSTYSTKDWQLIDSATLTHDELIFLEEVVKEFPNVCLTLTAENTFYAVGE  125
           +EE++I+NNGCSTYS+ DWQL  S  L   ++   LEE+ + FP++ LTLT EN +   + E
Sbjct:  79 QEEFLIINNGCSTYSSPDWQLRHSKMLKVSDIELLEELSQSFPDIYLTLTEENDYLVLEE  138

Query: 126 EVPEIVAYDADLVFTKAKSTSLDALRNQEEIVFQAMYMGLDADVTAFQEAVEEALISKFS  185
           EVP++V  D DLVFT  K  SL  L +    ++FQAMY+G  A +  AF+ AV    L       F
Sbjct: 139 EVPDLVQEDGDLVFTIVKPVSLAELSDTPRLIFQAMYLGEKAALDAFERAVRNQLSQSFH  198

Query: 186 GVRSQDYIYEIMPQGVTKARGLKSLIAKLGLDINQVMAIGDAPNDIELLDLVPNSVAMGN  245
             VRSQD  I  EI+PQGV+KA  LK L+   LGL  +QVMAIGDAPNDIE+L       VAM N
Sbjct: 199 VVRSQDNILEILPQGVSKASALKELVEDLGLTADQVMAIGDAPNDIEMLTYAGLGVAMEN  258

Query: 246 ASDEIKSRCKYITVDNNKAGVAKAIYDYAL                                275
           AS  IK      +T+ N+ AGVA+AI  +AL
Sbjct: 259 ASAAIKPLADKVTLTNDMAGVAQAIRQFAL                                288
```

Based on this analysis, it was predicted that these proteins and their epitopes could be useful antigens for vaccines or diagnostics.

EXAMPLE 1134

A DNA sequence (GBSx1210) was identified in *S. agalactiae* <SEQ ID 3519> which encodes the amino acid sequence <SEQ ID 3520>. Analysis of this protein sequence reveals the following:

```
Possible site: 18
>>> Seems to have no N-terminal signal sequence
      INTEGRAL      Likelihood = -0.43      Transmembrane     7-23 (7-23)

----- Final Results -----
             bacterial membrane --- Certainty = 0.1171(Affirmative) < succ>
              bacterial outside --- Certainty = 0.0000(Not Clear)   < succ>
            bacterial cytoplasm --- Certainty = 0.0000(Not Clear)   < succ>
```

The protein has homology with the following sequences in the GENPEPT database.

```
>GP: AAA26954 GB: J04479 DNA polymerase I [Streptococcus pneumoniae]
Identities = 655/879 (74%), Positives = 748/879 (84%), Gaps = 4/879 (0%)

Query:   3 NKNKLLLIDGSSVAFRAFFALYNQIDRFKNNSGLHTNAIYGFHLMLNHILGRVQPSHILV   62
           +K  KLLLIDGSSVAFRAFFALY Q+DRFKN +GLHTNAIYGF LML+H+L RV+PSHILV
Sbjct:   2 DKKKLLLIDGSSVAFRAFFALYQQLDRFKNAAGLHTNAIYGFQLMLSHLLERVEPSHILV   61

Query:  63 AFDAGKTTFRTEMYADYKGGRAKTPDEFREQFPYIRQQLDVLGIKHYELEHYEADDIIGT  122
           AFDAGKTTFRTEMYADYKGGRAKTPDEFREQFP+IR+ LD +GI+HYEL  YEADDIIGT
Sbjct:  62 AFDAGKTTFRTEMYADYKGGRAKTPDEFREQFPFIRELLDHMGIRHYELAQYEADDIIGT  121
```

-continued

```
Query: 123 LAKQAEASNEHFDITVVSGDKDLIQLTDTNTVVEISKKGVAEFEEFTPAYLMEKMGITPS 182
            L K AE   + FDIT+VSGDKDLIQLTD +TVVEISKKGVAEFE FTP YLME+MG+TP+
Sbjct: 122 LDKLAE--QDGFDITIVSGDKDLIQLTDEHTVVEISKKGVAEFEAFTPDYLMEEMGLTPA 179

Query: 183 QFIDLKALMGDKSDNIPGVTKIGEKTGLKLLSEYGSLEGIYENIEAMKQSKMKENLINDK 242
            QFIDLKALMGDKSDNIPGVTK+GEKTG+KLL E+GSLEGIYENI+ MK SKMKENLINDK
Sbjct: 180 QFIDLKALMGDKSDNIPGVTKVGEKTGIKLLLEHGSLEGIYENIDGMKTSKMKENLINDK 239

Query: 243 EQAFLSKTLATINIASPITIGLEDILYSGPQDIKALSQFYDEMDFKQFKAALGEETSQED 302
            EQAFLSKTLATI+  +PI IGLED++YSGP D++ L +FYDEM FKQ K AL    ++
Sbjct: 240 EQAFLSKTLATIDTKAPIAIGLEDLVYSGP-DVENLGKFYDEMGFKQLKQALNMSSADVA 298

Query: 303 FEVDFTEVEQLKTEMFSDNDFYYFEMLGDNYHVEDLIGIAWGNSDTIYATSNVSLLQEAL 362
            +DFT V+Q+  +M S+   ++FE+ G+NYH ++L+G AW    D +YAT  + LLQ+ +
Sbjct: 299 EGLDFTIVDQISQDMLSEESIFHFELFGENYHTDNLVGFAWSCGDQLYATDKLELLQDPI 358

Query: 363 FKKALSKP-IKTYDFKRSKVLLNRFNIDLPEPAFDTRLAKYLLSTTEDNLVSTIARLYTN 421
            FK    L K  ++ YDFK+ KVLL RF +DL  PAFD RLAKYLLST EDN ++TIA LY
Sbjct: 359 FKDFLEKTSLRVYDFKKVKVLLQRFGVDLQAPAFDIRLAKYLLSTVEDNEIATIASLYGQ 418

Query: 422 LPLDTDDAVYGKGAKRAIPEKTRFLEHLAKKVKVLVDSEANIMQQLKANEQEELLFEMEQ 481
            L   D+  YGKG K+AIPE+ +FLEHLA K+ VLV++E  ++++ N Q ELL++MEQ
Sbjct: 419 TYLVDDETFYGKGVKKAIPEREKFLEHLACKLAVLVETEPILLEKLSENGQLELLYDMEQ 478

Query: 482 PLANVLAKMEIRGIKVKKNTLNEMAIENQKVIETLTQEIYELAGQEFNINSPKQLGKLLF 541
            PLA VLAKMEI GI VKK TL EM   EN+ VIE LTQEIYELAG+EFN+NSPKQLG LLF
Sbjct: 479 PLAFVLAKMEIAGIVVKKETLLEMQAENELVIEKLTQEIYELAGEEFNVNSPKQLGVLLF 538

Query: 542 ETLGLPVEMTKKTKTGYSTAVDVLERLAPISPLVTKILEYRQITKLQSTYIIGLQDYILE 601
            E LGLP+E TKKTKTGYSTAVDVLERLAPI+P+V KIL+YRQI K+QSTY+IGLQD+IL
Sbjct: 539 EKLGLPLEYTKKTKTGYSTAVDVLERLAPIAPIVKKILDYRQIAKIQSTYVIGLQDWILA 598

Query: 602 DGKIHTRYVQDLTQTGRLSSSDPNLQNIPVRLEQGRLIRKAFVPSEDNAVLLSSDYSQIE 661
            DGKIHTRYVQDLTQTGRLSS DPNLQNIP RLEQGRLIRKAFVP  +++VLLSSDYSQIE
Sbjct: 599 DGKIHTRYVQDLTQTGRLSSVDPNLQNIPARLEQGRLIRKAFVPEWEDSVLLSSDYSQIE 658

Query: 662 LRVLAHISKDEHLIAAFKEGADIHTSTAMRVFGIEKPENVTPNDRRNAKAVNFGIVYGIS 721
            LRVLAHISKDEHLI AF+EGADIHTSTAMRVFGIE+P+NVT NDRRNAKAVNFG+VYGIS
Sbjct: 659 LRVLAHISKDEHLIKAFQEGADIHTSTAMRVFGIERPDNVTANDRRNAKAVNFGVVYGIS 718

Query: 722 DFGLSHNLGIPRKLAKQYIDTYFERYPGIKNYMETVVREAKDKGYVETLFHRRRSLPDIN 781
            DFGLS+NLGI RK AK YIDTYFER+PGIKNYM+ VVREA+DKGYVETLF RRR LPDIN
Sbjct: 719 DFGLSNNLGISRKEAKAYIDTYFERFPGIKNYMDEVVREARDKGYVETLFKRRRELPDIN 778

Query: 782 SRNFNIRQFAERTAINSPIQGSAADILKIAMINLDRVLDKGGYKSKMLLQVHDEIVLEVP 841
            SRNFNIR FAE TAINSPIQGSAADILKIAMI LD+ L   GGY++KMLLQVHDEIVLEVP
Sbjct: 779 SRNFNIRGFAEATAINSPIQGSAADILKIAMIQLDKALVAGGYQTKMLLQVHDEIVLEVP 838

Query: 842 NEEIGAIRELVTKTMESAISLSVPLIADENAGETWYEAK                     880
            E+   +++LV +TME AI LSVPLIADEN G TWYEAK
Sbjct: 839 KSELVEMKKLVKQTMEEAIQLSVPLIADENEGATWYEAK                     877
```

A related DNA sequence was identified in *S. pyogenes* <SEQ ID 3521> which encodes the amino acid sequence <SEQ ID 3522>. Analysis of this protein sequence reveals the following:

```
Possible site: 18
>>> Seems to have no N-terminal signal sequence
      INTEGRAL      Likelihood = -0.43     Transmembrane    7-23 (7-23)

----- Final Results -----
            bacterial membrane --- Certainty = 0.1171(Affirmative) < succ>
             bacterial outside --- Certainty = 0.0000(Not Clear)   < succ>
           bacterial cytoplasm --- Certainty = 0.0000(Not Clear)   < succ>
```

An alignment of the GAS and GBS proteins is shown below.

```
Identities = 665/881 (75%), Positives = 761/881 (85%), Gaps = 2/881 (0%)
Query:   1 MTNKNKLLLIDGSSVAFRAFFALYNQIDRFKNNSGLHTNAIYGFHLMLNHILGRVQPSHI  60
           M NKNKLLLIDGSSVAFRAFFALYNQIDRFKN+SGLHTNAIYGFHLML+H++ RVQP+H+
Sbjct:   1 MENKNKLLLIDGSSVAFRAFFALYNQIDRFKNHSGLHTNAIYGFHLMLDHMMKRVQPTHV  60

Query:  61 LVAFDAGKTTFRTEMYADYKGGRAKTPDEFREQFPYIRQQLDVLGIKHYELEHYEADDII 120
           LVAFDAGKTTFRTEMYADYK GRAKTP+EFREQFPYIR+ L LGI +YELEHYEADDII
```

```
-continued
Sbjct:  61 LVAFDAGKTTFRTEMYADYKAGRAKTPEEFREQFPYIREMLTALGIAYYELEHYEADDII 120

Query: 121 GTLAKQAEASNEHFDITVVSGDKDLIQLTDTNTVVEISKKGVAEFEEFTPAYLMEKMGIT 180
           GTL K AE +   FD+T+VSGDKDLIQLTD NTVVEISKKGVAEFEEFTPAYLMEKMG+T
Sbjct: 121 GTLDKMAERTEVPFDVTIVSGDKDLIQLTDENTVVEISKKGVAEFEEFTPAYLMEKMGLT 180

Query: 181 PSQFIDLKALMGDKSDNIPGVTKIGEKTGLKLLSEYGSLEGIYENIEAMKQSKMKENLIN 240
           P+QFIDLKALMGDKSDNIPGVTKIGEKTGLKLL E+GSLEGIYE+I+  K SKMKENLIN
Sbjct: 181 PNQFIDLKALMGDKSDNIPGVTKIGEKTGLKLLHEFGSLEGIYEHIDGFKTSKMKENLIN 240

Query: 241 DKEQAFLSKTLATINIASPITIGLEDILYSGPQDIKALSQFYDEMDFKQFKAALGEETSQ 300
           D++QAFLSKTLATIN ASPITIGL+DI+Y+GP D+ +LSQFYDEMDF Q  K   L + Q
Sbjct: 241 DRDQAFLSKTLATINTASPITIGLDDIVYNGP-DVASLSQFYDEMDFVQLKKGLASQMPQ 299

Query: 301 EDFEV-DFTEVEQLKTEMFSDNDFYYFEMLGDNYHVEDLIGIAWGNSDTIYATSNVSLLQ 359
           E    V + EV +  ++FS  D +YFE L DNYH E +IG AWG+ + +  IYA++++ LL
Sbjct: 300 EPVAVISYQEVTNVSADLFSAEDIFYFETLRDNYHREAIIGFAWGHGEQIYASTDLGLLA 359

Query: 360 EALFKKALSKPIKTYDFKRSKVLLNRFNIDLPEPAFDTRLAKYLLSTTEDNLVSTIARLY 419
                FK+    KPI TYDFKRSKVLL+     I+L  P++D RLA YLLST EDN +STIAR++
Sbjct: 360 TDSFKQVFQKPIATYDFKRSKVLLSHLGIELVAPSYDARLANYLLSTVEDNELSTIARIF 419

Query: 420 TNLPLDTDDAVYGKGAKRAIPEKTRFLEHLAKKVKVLVDSEANIMQQLKANEQEELLFEM 479
           T++ L+ DD VYGKGAKRA+P+K      LEHLA+KVKVL+DS++ ++ +L A+EQ +L  +
Sbjct: 420 TDISLEEDDTVYGKGAKRAVPDKDVLLEHLARKVKVLLDSKSQMLDKLTAHEQLDLYQNI 479

Query: 480 EQPLANVLAKMEIRGIKVKKNTLNEMAIENQKVIETLTQEIYELAGQEFNINSPKQLGKL 539
           E PLANVLAKMEI GIKV + TL +MA +N+ +IE LTQEIY++AGQEFNINSPKQLG +
Sbjct: 480 ELPLANVLAKMEIEGIKVNRATLQDMAEQNKVIIEALTQEIYDMAGQEFNINSPKQLGSI 539

Query: 540 LFETLGLPVEMTKKTKTGYSTAVDVLERLAPISPLVTKILEYRQITKLQSTYIIGLQDYI 599
           LFE + LP+EMTKKTKTGYSTAV+VLERLAPI+P+V KIL+YRQITKLQSTY+IGLQDYI
Sbjct: 540 LFEKMQLPLEMTKKTKTGYSTAVNVLKRLAPIAPIVAKILDYRQITKLQSTYVIGLQDYI 599

Query: 600 LEDGKIHTRYVQDLTQTGRLSSSDPNLQNIPVRLEQGRLIRKAFVPSEDNAVLLSSDYSQ 659
           L DGKIHTRYVQDLTQTGRLSS DPNLQNIP+RLEQGRLIRKAF PS ++AVLLSSDYSQ
Sbjct: 600 LADGKIHTRYVQDLTQTGRLSSVDPNLQNIPIRLEQGRLIRKAFTPSHEDAVLLSSDYSQ 659

Query: 660 IELRVLAHISKDEHLIAAFKEGADIHTSTAMRVFGIEKPENVTPNDRRNAKAVNFGIVYG 719
           IELRVLAHIS DEHLIAAF EGADIHTSTAMRVFGI++  +VT NDRRNAKAVNFGIVYG
Sbjct: 660 IELRVLAHISGDEHLIAAFNEGADIHTSTAMRVFGIDRAADVTANDRRNAKAVNFGIVYG 719

Query: 720 ISDFGLSHNLGIPRKLAKQYIDTYFERYPGIKNYMETVVREAKDKGYVETLFHRRRSLPD 779
           ISDFGLS+NLGI RK AK YIDTYFERYPGIK YME VVREAKDKGYVETLF RRR LPD
Sbjct: 720 ISDFGLSNNLGITRKQAKSYIDTYFERYPGIKAYMENVVREAKDKGYVETLFKRRRELPD 779

Query: 780 INSRNFNIRQFAERTAINSPIQGSAADILKIAMINLDRVLDKGGYKSKMLLQVHDEIVLE 839
           INSRNFN+R FAERTAINSPIQGSAADILKIAMINLD+ L  GG+++KMLLQVHDEIVLE
Sbjct: 780 INSRNFNVRSFAERTAINSPIQGSAADILKIAMINLDKALQAGGFRAKMLLQVHDEIVLE 839

Query: 840 VPNEEIGAIRELVTKTMESAISLSVPLIADENAGETWYEAK 880
           VPN+E+ AI++LV  TME+A+ L+VPL  DE+ G +WYEAK
Sbjct: 840 VPNDELTAIKKLVKDTMEAAVDLAVPLCVDESTGHSWYEAK 880
```

Based on this analysis, it was predicted that these proteins and their epitopes could be useful antigens for vaccines or diagnostics.

EXAMPLE 1135

A DNA sequence (GBSx1211) was identified in *S. agalactiae* <SEQ ID 3523> which encodes the amino acid sequence <SEQ ID 3524>. Analysis of this protein sequence reveals the following:

```
Possible site: 30
>>> Seems to have no N-terminal signal sequence

----- Final Results -----
            bacterial cytoplasm --- Certainty = 0.1880(Affirmative) < succ>
            bacterial membrane  --- Certainty = 0.0000(Not Clear)  < succ>
             bacterial outside  --- Certainty = 0.0000(Not Clear)  < succ>
```

A related GBS nucleic acid sequence <SEQ ID 9571> which encodes amino acid sequence <SEQ ID 9572> was also identified.

The protein has homology with the following sequences in the GENPEPT database.

```
>GP:BAB05860 GB:AP001514 unknown conserved protein [Bacillus halodurans]
Identities = 72/134 (53%), Positives = 94/134 (69%), Gaps = 3/134 (2%)
Query:  17 NPSDFMLKNYLTKAKTIAVVGLSDRQETAAYQVSKIMQEAGYQIIPVNPKNAGQKILGQM   76
           NPSD +K  L +AK IAVVGLS   +  +Y VS  MQ AGY+IIPVNP      ++LG+
Sbjct:   4 NPSDEKIKQILQEAKRIAVVGLSGNPDRTSYMVSAAMQHAGYEIIPVNP--TVDEVLGEK   61

Query:  77 TYASLKDVTEHIDIVNIFRRSEYLPDIAREFLEVDADIFWAQLGLESQEAETILKQAGHK  136
           SL+D+     +DIVN+FRRSE+LPD+ARE +E+ A +FWAQLGLE++EA     L+Q G
Sbjct:  62 AVPSLQDIEGAVDIVNVFRRSEHLPDVARETVEIGAPVFWAQLGLENKEAYDYLQQHGVT  121

Query: 137 QIVMNKCLKVECQK                                               150
           I  MN+C+KVE  K
Sbjct: 122 SI-MNRCIKVEHAK                                               134
```

A related DNA sequence was identified in *S. pyogenes* <SEQ ID 3525> which encodes the amino acid sequence <SEQ ID 3526>. Analysis of this protein sequence reveals the following:

```
Possible site: 24
>>> Seems to have no N-terminal signal sequence

----- Final Results -----
           bacterial cytoplasm --- Certainty = 0.0837(Affirmative) < succ>
           bacterial membrane  --- Certainty = 0.0000(Not Clear)   < succ>
           bacterial outside   --- Certainty = 0.0000(Not Clear)   < succ>
```

An alignment of the GAS and GBS proteins is shown below.

```
Identities = 87/141 (61%), Positives = 114/141 (80%)
Query:  11 MVYHFQNPSDFMLKNYLTKAKTIAVVGLSDRQETAAYQVSKIMQEAGYQIIPVNPKNAGQ   70
           ++Y FQNPS+ +LK YL  AKTIAVVGLSDR++TAAY V+K MQ   Y+IIPVNPK AGQ
Sbjct:   1 VIYSFQNPSEDVLKAYLESAKTIAVVGLSDRKDTAAYGVAKFMQAMDYRIIPVNPKLAGQ   60

Query:  71 KILGQMTYASLKDVTEHIDIVNIFRRSEYLPDIAREFLEVDADIFWAQLGLESQEAETIL  130
            ILG+  YAS+K +   +DIV++FRRSE+LP++AR+FL  A +FWAQLGLE+QEA+TIL
Sbjct:  61 LILGEKVYASIKAIPFEVDIVDVFRRSEFLPEVARDFLAGQAKVFWAQLGLENQEAQTIL  120

Query: 131 KQAGHKQIVMNKCLKVECQKL                                        151
           + AG +  IVMN+CLK++   +L
Sbjct: 121 RSAGKEAIVMNRCLKIDYLQL                                        141
```

Based on this analysis, it was predicted that these proteins and their epitopes could be useful antigens for vaccines or diagnostics.

EXAMPLE 1136

A DNA sequence (GBSx1212) was identified in *S. agalactiae* <SEQ ID 3527> which encodes the amino acid sequence <SEQ ID 3528>. Analysis of this protein sequence reveals the following:

```
Possible site: 13
>>> Seems to have no N-terminal signal sequence

----- Final Results -----
           bacterial cytoplasm --- Certainty = 0.3367(Affirmative) < succ>
           bacterial membrane  --- Certainty = 0.0000(Not Clear)   < succ>
           bacterial outside   --- Certainty = 0.0000(Not Clear)   < succ>
```

A related GBS nucleic acid sequence <SEQ ID 9573> which encodes amino acid sequence <SEQ ID 9574> was also identified.

A related DNA sequence was identified in *S. pyogenes* <SEQ ID 3529> which encodes the amino acid sequence <SEQ ID 3530>. Analysis of this protein sequence reveals the following:

```
Possible site: 49
>>> Seems to have no N-terminal signal sequence

----- Final Results -----
            bacterial cytoplasm --- Certainty = 0.4960(Affirmative) < succ>
            bacterial membrane  --- Certainty = 0.0000(Not Clear)   < succ>
            bacterial outside   --- Certainty = 0.0000(Not Clear)   < succ>
```

An alignment of the GAS and GBS proteins is shown below.

```
Identities = 113/151 (74%), Positives = 133/151 (87%), Gaps = 1/151 (0%)
Query:   7 MDSHSHGHRPLDAYENVLEHLREKRIRITETRKAIISYMVNSREHPSAEKIYNDLLPEYP   66
           MD HSH  + LDAYENVLEHLREK IRITETRKAIISYM+ S EHPSA+KIY DL P +P
Sbjct:   1 MDIHSH-QQALDAYENVLEHLREKHIRITETRKAIISYMIQSTEHPSADKIYRDLQPNFP   59

Query:  67 NMSLATVYNNLKVLVDEGFVTELKLCNYSTTYYDFMGHQHLNIACEDCGKIVDFVDVDLL  126
           NMSLATVYNNLKVLVDEGFV+ELK+ N  TTYYDFMGHQH+N+ CE CGKI DF+DVD++
Sbjct:  60 NMSLATVYNNLKVLVDEGFVSELKISNDLTTYYDFMGHQHVNVVCEICGKIADFMDVDVM  119

Query: 127 DISREAHQQTGFEVTRVQLVAYGICPECQRK                              157
           DI++EAH+QTG++VTR+ ++AYGICP+CQ K
Sbjct: 120 DIAKEAHEQTGYKVTRIPVIAYGICPDCQAK                              150
```

Based on this analysis, it was predicted that these proteins and their epitopes could be useful antigens for vaccines or diagnostics.

EXAMPLE 1137

A DNA sequence (GBSx1213) was identified in *S. agalactiae* <SEQ ID 3531> which encodes the amino acid sequence <SEQ ID 3532>. Analysis of this protein sequence reveals the following:

```
Possible site: 39
>>> Seems to have no N-terminal signal sequence
    INTEGRAL    Likelihood = -2.13   Transmembrane    16-32    (14-32)
    INTEGRAL    Likelihood = -1.81   Transmembrane   496-512   (496-515)

----- Final Results -----
            bacterial membrane  --- Certainty = 0.1850(Affirmative) < succ>
            bacterial outside   --- Certainty = 0.0000(Not Clear)   < succ>
            bacterial cytoplasm --- Certainty = 0.0000(Not Clear)   < succ>
```

The protein has homology with the following sequences in the GENPEPT database.

```
>GP:CAA06650 GB:AJ005645 sdrc [Staphylococcus aureus]
Identities = 41/146 (28%), Positives = 63/146 (43%), Gaps = 13/146 (8%)
Query:   4 SQYNKWSIRRLKVGAASVMIASGSIVALGQSHIVSAD----EMSQPKTTITAPTANTSTN   59
           ++ NK+SIR+  VG AS+++ +  I  L     +A+     E++Q K   TAP+ N +T
Sbjct:  16 NRLNKFSIRKYSVGTASILVGTTLIFGLSGHEAKAAEHTNGELNQSKNETTAPSENKTT-   74

Query:  60 VESSTDKALSKVTTMETSSEMPK--MQNMAKVEKTSDKPMMVATSVRKMMATPTPVAMT-  116
                D   K  T   +++ PK   M + A V++TS         +      T T    T
Sbjct:  75 --KKVDSRQLKDNTQTATADQPKVTMSDSATVKETSSNMQSPQNATANQSTTKTSNVTTN  132

Query: 117 ---KTTSVDEVKKSTDTAFKQTVDVP                                   139
              TT  +E  KS   T K     P
Sbjct: 133 DKSSTTYSNETDKSNLTQAKDVSTTP                                   158
```

No corresponding DNA sequence was identified in *S. pyogenes*.

A related GBS gene <SEQ ID 8735> and protein <SEQ ID 8736> were also identified. Analysis of this protein sequence reveals the following:

```
Lipop: Possible site: -1 Crend: 7
McG: Discrim Score: -0.92
GvH: Signal Score (-7.5): -2.48
     Possible site: 39
>>> Seems to have no N-terminal signal sequence
ALOM program count: 2 value: -2.13 threshold: 0.0
    INTEGRAL      Likelihood = -2.13    Transmembrane    16-32    (14-32)
    INTEGRAL      Likelihood = -1.81    Transmembrane    496-512  (496-515)
    PERIPHERAL    Likelihood =  7.96    402
modified ALOM score: 0.93
*** Reasoning Step: 3

----- Final Results -----
              bacterial membrane  --- Certainty = 0.1850(Affirmative) < succ>
              bacterial outside   --- Certainty = 0.0000(Not Clear)   < succ>
              bacterial cytoplasm --- Certainty = 0.0000(Not Clear)   < succ>
LPXTG motif: 485-489
```

The protein has homology with the following sequences in the databases:

```
D|5981|5780 leukotoxin > Insert characterized
SP|P16462|HLYA_ACTAC LEUKOTOXIN. > Edit characterized
GP|141834|gb|AAA21922.1||M27399 leukotoxin (LtA) {Actinobacillus
actinomycetemcomitans} Insert characterized
Query:  210 VSLNGNTTGKEGQALLDQIAND---KHSYQATIRVYGAKDGKVDLKNMISPKMVTINIP  266
              ++ NG+    + G+A +D +K  +    KHS + T ++     G +DL +     +T   P
Sbjct:  488 ITRNGDRI-QSGKAYVDYLKKGEELAKHSDKFTKQILDPIKGNIDLSGIKGSTTLTFLNP  546

Query:  267 HITTDMEVKNSLKMAFKEKV-DVPAKYVSAAKAKG-PFLAGVNE--TIPYEAFGGDGMLT  322
              +T   E + + +    E + ++  K  + KKG P   GV +   +  A    D  +
Sbjct:  547 LLTAGKEERKTRQSGKYEFITELKVKGRTDWKVKGVPNSNGVYDFSNLIQHAVTRDNKVL  606

Query:  323 RLILKASEGAKWSDNGVDKNSPLL------PLKDLTKGKYFYQVSLNGNTAGKKGQALLD  376
                L A+ GAK     V    S ++       + D +KG+    ++++G    A K GQ ++
Sbjct:  607 EARLIANLGAKDDYVFVGSGSTIVNAGDGYDVVDYSKGRTG-ALTIDGRNATKAGQYKVE  665

Query:  377 QIKANGSHTYQATITIYGTKDGKV                                      400
              +    +G+   Q  T++    TK  GKV
Sbjct:  666 R-DLSGTQVLQETVSKQETKRGKV                                      688
```

SEQ ID 3532 (GBS1) was expressed in *E. coli* as a GST-fusion product. SDS-PAGE analysis of total cell extract is shown in FIG. 1 (lane 3; MW 78 kDa). It was also expressed in *E. coli* as a His-fusion product. SDS-PAGE analysis of total cell extract is shown in FIG. 2 (lane 3; MW 53 kDa).

The His-fusion protein was purified as shown in FIG. 189, lane 5.

Based on this analysis, it was predicted that these proteins and their epitopes could be useful antigens for vaccines or diagnostics.

EXAMPLE 1138

A DNA sequence (GBSx1214) was identified in *S. agalactiae* <SEQ ID 3533> which encodes the amino acid sequence <SEQ ID 3534>. This protein is predicted to be response regulator (regX3). Analysis of this protein sequence reveals the following:

```
Possible site: 32
>>> Seems to have no N-terminal signal sequence

----- Final Results -----
              bacterial cytoplasm --- Certainty = 0.3585(Affirmative) < succ>
              bacterial membrane  --- Certainty = 0.0000(Not Clear)   < succ>
              bacterial outside   --- Certainty = 0.0000(Not Clear)   < succ>
```

The protein has homology with the following sequences in the GENPEPT database.

```
>GP:CAB54578 GB:AJ006397 response regulator [Streptococcus pneumoniae]
Identities = 143/228 (62%), Positives = 183/228 (79%), Gaps = 1/228 (0%)
Query:   1 MTQKLLLVDDEFEIIDINRRYLEQAGYEVSVAADGIEALKEVDENRFDLIISDIMMPKMD    60
           M + +LLVDDE EI DI++RYL QAGY+V VA DG+EAL+   +   DLII+D+MMP+MD
Sbjct:   1 MGKTILLVDDEVEITDIHQRYLIQAGYQVLVAHDGLEALELFKKKPIDLIITDVMMPRMD    60

Query:  61 GYDFISEVLVREPNQPFLFITAKVSEPDKIYSLSMGADDFISKPFSPRELVLRVKNILRR   120
           GYD ISEV    P QPFLFITAK SE DKIY LS+GADDFI+KPFSPRELVLRV NILRR
Sbjct:  61 GYDLISEVQYLSPEQPFLFITAKTSEQDKIYGLSLGADDFIAKPFSPRELVLRVHNILRR   120

Query: 121 IYGNHQQSEVLTIGDLVIDQKQRLVMVDCNTISLTNKSFDLLWILANHLNRVFSKTELYE   180
           ++    ++E++++G+L ++     V +    + LT KSF+LLWILA++  RVFSKT+LYE
Sbjct: 121 LH-RGGETELISLGNLKMNHSSHEVQIGEEMLDLTVKSFELLWILASNPERVFSKTDLYE   179

Query: 181 RVWGEEFLDDTNTLNVHIHALRNDLAKFSTDNTPTIKTVWGLGYKLEE              228
           ++W E+++DDTNTLNVHIHALR +LAK+S+D TPTIKTVWGLGYK+E+
Sbjct: 180 KIWKEDYVDDTNTLNVHIHALRQELAKYSSDQTPTIKTVWGLGYKIEK              227
```

There is also homology to SEQ ID 1182.

Based on this analysis, it was predicted that this protein and its epitopes, could be useful antigens for vaccines or diagnostics.

EXAMPLE 1139

A DNA sequence (GBSx1215) was identified in *S. agalactiae* <SEQ ID 3535> which encodes the amino acid sequence <SEQ ID 3536>. This protein is predicted to be histidine kinase (resE). Analysis of this protein sequence reveals the following:

```
Possible site: 25
>>> Seems to have an uncleavable N-term signal seq
      INTEGRAL      Likelihood = -9.13      Transmembrane     42-58 (33-65)
      INTEGRAL      Likelihood = -7.54      Transmembrane      7-23 (3-29)

----- Final Results -----
              bacterial membrane --- Certainty = 0.4652(Affirmative) < succ>
              bacterial outside  --- Certainty = 0.0000(Not Clear)   < succ>
              bacterial cytoplasm --- Certainty = 0.0000(Not Clear)   < succ>
```

The protein has homology with the following sequences in the GENPEPT database.

```
>GP: CAB54579 GB: AJ006397 histidine kinase [Streptococcus pneumoniae]
Identities = 190/343 (55%), Positives = 249/343 (72%)

Query:   1 MKLKYYIVIGYLISMLITVAGVFFGLNHMLIETRGVYYILSVTIIACIVGGIVNLFLLSS    60
           MKLK YI++GY+IS L+T+  VF+ +  MLI    +Y++L +TI+A +VG  ++LFLL
Sbjct:   1 MKLKSYILVGYIISTLLTILVVFWAVQKMLIAKGEIYFLLGMTIVASLVGAGISLFLLLP    60

Query:  61 VFTSLKKLKQKMKDISQRCFDTKAQICSPQEFKDLETAFNQMSSELESTFKSLNESEREK   120
           VFTSL KLK+  K ++ + F + ++  P EF+ L    FN+MS +L+ +F SL ESEREK
Sbjct:  61 VFTSLGKLKEHAKRVAAKDFPSNLEVQGPVEFQQLGQTFNEMSHDLQVSFDSLEESEREK   120

Query: 121 TMMIAQLSHDIKTPITSIQSTVEGILDGIISEEEVNYYLNTISRQTNRLNHLVEELSFIT   180
           +MIAQLSHDIKTPITSIQ+TVEGILDGII E E  +YL TI RQT RLN LVEEL+F+T
Sbjct: 121 GLMIAQLSHDIKTPITSIQATVEGILDGIIKESEQAHYLATIGRQTERLNKLVEELNFLT   180

Query: 181 LETMSDTAEPHKEETIYLDKLLIDILSEFQLVFEKENRQVMIDVAPDVSKLSSQYDKLSR   240
              L T  + E    +++I+LDKLLI+ +SEFQ + E+E R V + V P+ +++    Y KLSR
Sbjct: 181 LNTARNQVETTSKDSIFLDKLLIECMSEFQFLIEQERRDVHLQVIPESARIEGDYAKLSR   240

Query: 241 ILLNLISNAVKYSDPGSPLTIKAYSNRQDIVIDIIDQGYGIKDEDLASIFNRLYRVESSR   300
           IL+NL+  NA KYS PG+ L + A  +   + I + D+G GI  EDL +IF RLYRVE+SR
Sbjct: 241 ILVNLVDNAFKYSAPGTKLEVVAKLEKDQLSISVTDEGQGIAPEDLENIFKRLYRVETSR   300

Query: 301 NMKTGGHGLGLYIARQLAHQLNGDILVESQYQKGSKFSLVLKL                   343
           NMKTGGHGLGL IAR+LAHQL G+I V SQY  GS F+LVL L
Sbjct: 301 NMKTGGHGLGLAIARELAHQLGGEITVSSQYGLGSTFTLVLNL                   343
```

There is also homology to SEQ ID 1178.

A related GBS gene <SEQ ID 8737> and protein <SEQ ID 8738> were also identified. Analysis of this protein sequence reveals the following:

```
Lipop: Possible site: -1 Crend: 3
McG: Discrim Score: 8.67
GvH: Signal Score (-7.5): -5.75
     Possible site: 25
>>> Seems to have an uncleavable N-term signal seq
ALOM program count: 2 value: -9.13 threshold: 0.0
     INTEGRAL    Likelihood = -9.13    Transmembrane    42-58 (33-65)
     INTEGRAL    Likelihood = -7.54    Transmembrane     7-23  (3-29)
     PERIPHERAL  Likelihood =  3.92                    196
modified ALOM score: 2.33
*** Reasoning Step: 3

----- Final Results -----
            bacterial membrane --- Certainty = 0.4652(Affirmative) < succ>
            bacterial outside  --- Certainty = 0.0000(Not Clear)   < succ>
          bacterial cytoplasm  --- Certainty = 0.0000(Not Clear)   < succ>
```

The protein has homology with the following sequences in the databases:

```
55.3/72.7% over 343aa
Streptococcus pneumoniae
GP|5830539| histidine kinase Insert characterized
ORF00129 (301-1332 of 1635)
GP|5830539|emb|CAB54579.1||AJ006397 (1-344 of 350) histidine kinase
{Streptococcus pneumoniae}
% Match = 34.0
% Identity = 55.2    % Similarity = 72.7
Matches = 190  Mismatches = 94  Conservative Sub.s = 60
  42          72         102         132         162         192         222         252
VIWLSTKNNVW*WWTAIQFP*PINHLTCFGY*QII*IVFFQKQSFMNVSGAKNF*MTLIL*MFISMPYAMTLLNLVQTIP
  282        312         342         372         402         432         462         492
QLSKQFGD*GIN*RNKMKLKYYIVIGYLISMLITVAGVFFGLNHMLIETRGVYYILSVTIIACIVGGIVNLFLLSSVFTS
                   ||||   ||::||:||  |:|:    ||:  :    |||     :|::|  :||:|    :||      ::||||    ||||
                   MKLKSYILVGYIISTLLTILVVFWAVQKMLIAKGEIYFLLGMTIVASLVGAGISLFLLLPVFTS
                            10          20          30          40          50          60
  522        552         582         612         642         672         702         732
LKKLKQKMKDISQRCFDTKAQICSPQEFKDLETAFNQMSSELESTFKSLNESEREKTMMIAQLSHDIKTPITSIQSTVEG
| |||:  |  ::  :  |:    ::    |  ||:||  :|: :|  ||  ||||  :|||||||||||||||:||||
LGKLKEHAKRVAAKDFPSNLEVQGPVEFQQLGQTFNEMSHDLQVSFDSLEESEREKGLMIAQLSHDIKTPITSIQATVEG
           80          90         100         110         120         130         140
  762        792         822         852         882         912         942         972
ILDGIISEEEVNYYLNTISRQTNRLNHLVEELSFITLETMSDTAEPHKEETIYLDKLLIDILSEFQLVFEKENRQVMIDV
||||||    ||   :|| || ||| |||||:|||   |  : |     :::|:||||||: :||||:: |:| | : |
ILDGIIKESEQAHYLATIGRQTERLNKLVEELNFLTLNTARNQVETTSKDSIFLDKLLIECMSEFQFLIEQERRDVHLQV
          160         170         180         190         200         210         220
 1002       1032        1062        1092        1122        1152        1182        1212
APDVSKLSSQYDKLSRILLNLISNAXKYSDPGSPLTIKAYSNRQDIVIDIIDQGYGIKDEDLASIFNRLYRVESSRNMKT
|: :::     |  ||||||:||: || ||| ||: | :|  :  :| ||  |||  :|| |||||||:|||||
IPESARIEGDYAKLSRILVNLVDNAFKYSAPGTKLEVVAKLEKDQLSISVTDEGQGIAPEDLENIFKRLYRVETSRNMKT
          240         250         260         270         280         290         300
 1242       1272        1302        1332        1362        1392        1422        1452
GGHGLGLYIARQLAHQLNGDILVESQYQKGSKFSLVLKLQK*LGIIPSYFL*CFYKRLSAQ*FGKEGDRYRLIRN*RL*G
||||||| |||:||||| |:|  ||| ||  :|||  |
GGHGLGLAIARELAHQLGGEITVSSQYGLGSTFTLVLNLSGSENKA
           320         330         340         350
```

Figure 157:
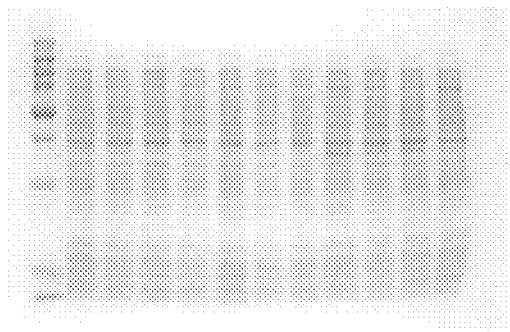
Figure 158:
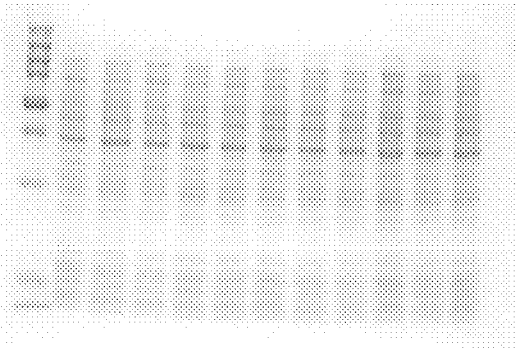

SEQ ID 8738 (GBS28) was expressed in *E. coli* as a GST-fusion product. SDS-PAGE analysis of total cell extract is shown in FIG. 14 (lane 3; MW 64 kDa). It was also expressed in *E. coli* as a His-fusion product. SDS-PAGE analysis of total cell extract is shown in FIG. 85 (lane 5; MW 38.8 kDa) and in FIG. 157 (lane 9-11; MW 39 kDa).

GBS28-His was purified as shown in FIG. 221, lane 6-7.

Based on this analysis, it was predicted that these proteins and their epitopes could be useful antigens for vaccines or diagnostics.

EXAMPLE 1140

A DNA sequence (GBSx1216) was identified in *S. agalactiae* <SEQ ID 3537> which encodes the amino acid sequence <SEQ ID 3538>. Analysis of this protein sequence reveals the following:

```
Possible site: 19
>>> Seems to have no N-terminal signal sequence
    INTEGRAL    Likelihood = -7.70    Transmembrane    125-141 (110-155)
    INTEGRAL    Likelihood = -7.59    Transmembrane     38-54  (36-56)
    INTEGRAL    Likelihood = -6.48    Transmembrane    146-162 (143-174)
    INTEGRAL    Likelihood = -5.57    Transmembrane     72-88  (63-93)
    INTEGRAL    Likelihood = -1.33    Transmembrane    229-245 (227-245)

----- Final Results -----
              bacterial membrane --- Certainty = 0.4079(Affirmative) < succ>
               bacterial outside --- Certainty = 0.0000(Not Clear)   < succ>
             bacterial cytoplasm --- Certainty = 0.0000(Not Clear)   < succ>
```

A related GBS nucleic acid sequence <SEQ ID 9575> which encodes amino acid sequence <SEQ ID 9576> was also identified.

The protein has homology with the following sequences in the GENPEPT database.

```
>GP: CAA79984 GB: Z21972 ORF1 [Bacillus megaterium]
Identities = 35/119 (29%), Positives = 62/119 (51%), Gaps = 15/119 (12%)

Query: 142 SSFRLLLSGNLILAPVLIVVSSLITTKAVIKLV---QQYYSYSISTLVFYTQLESGNYEG  198
           +SF+L+   +++ A  + + S L+    +IK +   QQ++   +     YT LE+
Sbjct: 105 TSFKLI-GASILQAIFIFLWSLLLIIPGIIKAIAYSQQFFL--LKDHPEYTVLEA-----  156

Query: 199 PSKVLVASRELMNGNKLRLFLLDLSFIGWQFLTIFSFGLVYIYLLPYQTTARLIFYRNI   257
           +   S++ M G K + FL+ LSFIGW   L +F+ G+  ++L+PY    T       FY +
Sbjct: 157 ----ITESKKRMKGLKWKYFLMHLSFIGWGILCMFTLGIGLLWLIPYAGTTTAAFYEEL   211
```

A related DNA sequence was identified in *S. pyogenes* <SEQ ID 3539> which encodes the amino acid sequence <SEQ ID 3540>. Analysis of this protein sequence reveals the following:

```
Possible site: 54
>>> Seems to have an uncleavable N-term signal seq
    INTEGRAL    Likelihood = -10.08   Transmembrane    148-164 (143-170)
    INTEGRAL    Likelihood = -8.28    Transmembrane    114-130 (101-141)
    INTEGRAL    Likelihood = -6.69    Transmembrane     60-76  (49-82)
    INTEGRAL    Likelihood = -3.72    Transmembrane     21-37  (21-39)
    INTEGRAL    Likelihood = -2.34    Transmembrane    222-238 (221-239)

----- Final Results -----
              bacterial membrane --- Certainty = 0.5034(Affirmative) < succ>
               bacterial outside --- Certainty = 0.0000(Not Clear)   < succ>
             bacterial cytoplasm --- Certainty = 0.0000(Not Clear)   < succ>
```

The protein has homology with the following sequences in the databases:

```
>GP: CAA79984 GB: Z21972 ORF1 [Bacillus megaterium]
Identities = 63/220 (28%), Positives = 100/220 (44%), Gaps = 31/220 (14%)

Query:  62 LGLILSLFILSASFTMI-DVVRHFRQKVSFAESTTAFSKEFFGNLLVLAITKWLFFLIWS  120
           + L+L LF+++  F +I +V+        +  T   +F  + +A+      L  S
Sbjct:  22 VSLMLLLFLINLVFPLIVEVIGSGGFSEWLMQEETPLWSDIFSMVFSIALIP----LTIS   77

Query: 121 LIWFF-------------GLFIFLSGLSAFLVNAKSGSSTVISLIFLLFGAVLSLIGFGI  167
           WF+             I+  G ++F +   G+S + ++    L+  +L + G
Sbjct:  78 TTWFYLNLVREGNPGIPEVFAIYKDGKTSFKL---IGASILQAIFIFLWSLLLIIPG---  131

Query: 168 YINRYYAYSLSEYLLYDEVKEGTYLGAIAVIETSVAMMKGYKWKLFFLQLSFTGWFLLNI  227
           I +   AYS    +LL D   E T L AI    S   MKG KWK F + LSF GW +L +
Sbjct: 132 -IIKAIAYSQQFFLLKDH-PEYTVLEAIT---ESKKRMKGLKWKYFLMHLSFIGWGILCM  186
```

-continued

```
Query: 228 VTFGLLNIYLLPYFTTANVIFYDQLKKRFKDKDD--PIEG            265
            T G+  ++L+PY T    FY++L   +D DD   IEG
Sbjct: 187 FTLGIGLLWLIPYAGTTTAAFYEELIVPQEDIDDDQQIEG            226
```

An alignment of the GAS and GBS proteins is shown below.

```
Identities = 87/254 (34%), Positives = 137/254 (53%), Gaps = 10/254 (3%)

Query:  16 MTNSEIKNEAKTILSNLQGKNQLFLLPILLSIITLYISFYYQYN-----NMTLLDFFVPL   70
           M+  IK +A+  L NL GK LFL+P LL +   I + Y          ++L  + PL
Sbjct:   1 MSIKAIKGQARDTLKNLSGKYLLFLIPTLLFMFHFGIEIHQGYVLSSGIEVSLAASYFPL   60

Query:  71 PVYFFYTLFIISVSFVMLDVVKNQKLNVRFSDNTYVFSSHIFWKLLSVLVLKGLILSFFY  130
           +    +LFI+S SF M+DVV++ +  V F+++T  FS    F  LL + + K L     +
Sbjct:  61 LLGLILSLFILSASFTMIDVVRHFRQKVSFAESTTAFSKEFFGNLLVLAITKWLFFLIWS  120

Query: 131 LLSTFGLLIIISSFRLLL-----SGNLILAPVLIVVSSLITTKAVIKLVQQYYSYSISTL  185
           L+  FGL I +S      L       + +++ + ++  ++++     + +YY+YS+S
Sbjct: 121 LIWFFGLFIFLSGLSAFLVNAKSGSSTVISLIFLLFGAVLSLIGFGIYINRYYAYSLSEY  180

Query: 186 VFYTQLESGNYEGPSKVLVASRELMNGNKLRLFLLDLSFIGWQFLTIFSFGLVYIYLLPY  245
            + Y +++ G Y G    V+  S  +M G K +LF L LSF GW   L I +FGL+ IYLLPY
Sbjct: 181 LLYDEVKEGTYLGAIAVIETSVAMMKGYKWKLFFLQLSFTGWFLLNIVTFGLLNIYLLPY  240

Query: 246 QTTARLIFYRNITK                                              259
           TTA +IFY  + K
Sbjct: 241 FTTANVIFYDQLKK                                              254
```

A related GBS gene <SEQ ID 8739> and protein <SEQ ID 8740> were also identified. Analysis of this protein sequence reveals the following:

```
Lipop: Possible site: -1 Crend: 4
McG: Discrim Score: -11.32
GvH: Signal Score (-7.5): -5.39
     Possible site: 19
>>> Seems to have no N-terminal signal sequence
ALOM program count: 5 value: -7.70 threshold: 0.0
     INTEGRAL    Likelihood = -7.70    Transmembrane    125-141 (110-155)
     INTEGRAL    Likelihood = -7.59    Transmembrane     38-54 (34-56)
     INTEGRAL    Likelihood = -6.48    Transmembrane    146-162 (143-174)
     INTEGRAL    Likelihood = -5.57    Transmembrane     72-88 (63-93)
     INTEGRAL    Likelihood = -1.33    Transmembrane    229-245 (227-245)
     PERIPHERAL  Likelihood =  0.37    105
modified ALOM score: 2.04
*** Reasoning Step: 3

----- Final Results -----
              bacterial membrane  --- Certainty = 0.4079(Affirmative) < succ>
              bacterial outside   --- Certainty = 0.0000(Not Clear)   < succ>
              bacterial cytoplasm --- Certainty = 0.0000(Not Clear)   < succ>
```

The protein has homology with the following sequences in the databases:

```
ORF00498(901-1071 of 1383)
EGAD|19922|20421(155-211 of 226) hypothetical protein {Bacillus megaterium}
GP|288299|emb|CAA79984.1||Z21971 ORF1 {Bacillus megaterium} PIR|S32215|S32215
hypothetical protein 1 - Bacillus megaterium
% Match = 4.8
% Identity = 36.8   % Similarity = 61.4
Matches = 21   Mismatches = 22   Conservative Sub.s = 14

741        771       801       831       861       891       921       951
LIIISSFRLLLSGNLILAPVLIVVSSLITTKAVIKLVQQYYSYSISTLVFYTQLESGNYEGPSKVLVASRELMNGNKLRL
                                                 :  :   |::  |||      :
GIPEVFAIYKDGKTSFKLIGASILQAIFIFLWSLLLIIPGIIKAIAYSQQFFLLKDHPEYTVLEAITESKKRMKGLKWKY
            110       120       130       140       150       160       170
```

-continued

```
981       1011      1041      1071      1101      1131      1161      1191
FLLDLSFIGWQFLTIFSFGLVYIYLLPYQTTARLIFYRNITKNS*E*FLAIFVI*VLKRTYCLFDTDFRPKYPHSVDVQV
||: ||||||  | :|::|:  ::|:||   |   ||  :
FLMHLSFIGWGILCMFTLGIGLLWLIPYAGTTTAAFYEELIVPQEDIDDDQQIEG
             190       200       210       220
```

Based on this analysis, it was predicted that these proteins and their epitopes could be useful antigens for vaccines or diagnostics.

EXAMPLE 1141

A DNA sequence (GBSx1217) was identified in *S. agalactiae* <SEQ ID 3541> which encodes the amino acid sequence <SEQ ID 3542>. This protein is predicted to be tRNA-guanine transglycosylase (tgt). Analysis of this protein sequence reveals the following:

```
Possible site: 54
>>> Seems to have no N-terminal signal sequence

----- Final Results -----
            bacterial cytoplasm --- Certainty = 0.3706(Affirmative) < succ>
            bacterial membrane  --- Certainty = 0.0000(Not Clear)   < succ>
            bacterial outside   --- Certainty = 0.0000(Not Clear)   < succ>
```

A related GBS nucleic acid sequence <SEQ ID 9577> which encodes amino acid sequence <SEQ ID 9578> was also identified.

The protein has homology with the following sequences in the GENPEPT database.

```
>GP: CAB14731 GB: Z99118 tRNA-guanine transglycosylase [Bacillus subtilis]
Identities = 269/377 (71%), Positives = 320/377 (84%)

Query:   12 MTDHPIKYRLIKQEKHTGARLGEIITPHGTFPTPMFMPVGTQATVKTQSPEELKEMGSGI    71
            M + PI+Y  IK+ K TGARLG++ TPHG+F TP+FMPVGT ATVKT SPEELK M +GI
Sbjct:    1 MAEQPIRYEFIKECKQTGARLGKVHTPHGSFETPVFMPVGTLATVKTMSPEELKAMDAGI   60

Query:   72 ILSNTYHLWLRPGDELIAKAGGLHKFMNWDQAILTDSGGFQVYSLADSRNITEEGVTFKN   131
            ILSNTYHLWLRPG +++ +AGGLHKFMNWD+AILTDSGGFQV+SL+  RNI EEGV F+N
Sbjct:   61 ILSNTYHLWLRPGQDIVKEAGGLHKFMNWDRAILTDSGGFQVFSLSKFRNIEEEGVHFRN  120

Query:  132 HLNGAKMFLSPEKAISIQNNLGSDIMMSFDECPQFYQPYDYVKKSIERTSRWAERGLNAH   191
            HLNG K+FLSPEKA+ IQN LGSDIMM+FDECP +    YDY+K+S+ERTSRWAER LNAH
Sbjct:  121 HLNGDKLFLSPEKAMEIQNALGSDIMMAFDECPPYPAEYDYMKRSVERTSRWAERCLNAH  180

Query:  192 RRPHDQGLFGIVQGAGFEDLRRQSARDLVSMDFPGYSIGGLAVGETHDEMNAVLDFTVPM   251
             R   +QGLFGIVQG  +EDLR QSA+DL+S+DFPGY+IGGL+VGE  D MN VL+FT P+
Sbjct:  181 NRQDEQGLFGIVQGGEYEDLRTQSAKDLISLDFPGYAIGGLSVGEPKDVMNRVLEFTTPL  240

Query:  252 LPNDKPRYLMGVGAPDSLIDAVIRGVDMFDCVLPTRIARNGTCNTSQGRLVVKNAKFAED   311
            LP DKPRYLBGVG+PD+LID  IRGVDMFDCVLPTRIARNGT T++GRL +KNAKF  D
Sbjct:  241 LPKDKPRYLMGVGSPDALIDGAIRGVDMFDCVLPTRIARNGTVFTAEGRLNMKNAKFERD  300

Query:  312 FTPLDPNCDCYTCKNYTRAYIRHLLKADETFGIRLTSYHNLYFLVNLMKDVRQAIMDDNL   371
             F P+D  CDCYTCKNYTRAYIRHL++ +ETFG+RLT+YHNL+FL++LM+ VRQAI +D L
Sbjct:  301 FRPIDEECDCYTCKNYTRAYIRHLIRCNETFGLRLTTYHNLHFLLHLMEQVRQAIREDRL  360

Query:  372 LEFRQDFMERYGYGMNN                                            388
             +FR++F ERYGY   N
Sbjct:  361 GDFREEFFERYGYNKPN                                            377
```

A related DNA sequence was identified in *S. pyogenes* <SEQ ID 3543> which encodes the amino acid sequence <SEQ ID 3544>. Analysis of this protein sequence reveals the following:

```
Possible site: 43
>>> Seems to have no N-terminal signal sequence
```

```
-continued
----- Final Results -----
            bacterial cytoplasm --- Certainty = 0.2590(Affirmative) < succ>
            bacterial membrane  --- Certainty = 0.0000(Not Clear)   < succ>
             bacterial outside  --- Certainty = 0.0000(Not Clear)   < succ>
```

An alignment of the GAS and GBS proteins is shown below.

```
Identities = 351/380 (92%), Positives = 368/380 (96%)

Query:   12 MTDHPIKYRLIKQEKHTGARLGEIITPHGTFPTPMFMPVGTQATVKTQSPEELKEMGSGI    71
            MTD+PIKYRLIK EKHTGARLGEIITPHGTFPTPMFMPVGTQATVKTQSPEELK +GSGI
Sbjct:    1 MTDYPIKYRLIKAEKHTGARLGEIITPHGTFPTPMFMPVGTQATVKTQSPEELKAIGSGI    60

Query:   72 ILSNTYHLWLRPGDELIAKAGGLHKFMNWDQAILTDSGGFQVYSLADSRNITEEGVTFKN   131
            ILSNTYHLWLRPGDELIA++GGLHKFMNWDQ ILTDSGGFQVYSLADSRNITEEGVTFKN
Sbjct:   61 ILSNTYHLWLRPGDELIARSGGLHKFMNWDQPILTDSGGFQVYSLADSRNITEEGVTFKN   120

Query:  132 HLNGAKMFLSPEKAISIQNNLGSDIMMSFDECPQFYQPYDYVKKSIERTSRWAERGLNAH   191
            HLNG+KMFLSPEKAISIQNNLGSDIMMSFDECPQFYQPYDYVKKSIERTSRWAERGL AH
Sbjct:  121 HLNGSKMFLSPEKAISIQNNLGSDIMMSFDECPQFYQPYDYVKKSIERTSRWAERGLKAH   180

Query:  192 RRPHDQGLFGIVQGAGFEDLRRQSARDLVSMDFPGYSIGGLAVGETHDEMNAVLDFTVPM   251
            RRPHDQGLFGIVQGAGFEDLRRQSA DLV+MDFPGYSIGGLAVGE+H+EMNAVLDFT P+
Sbjct:  181 RRPHDQGLFGIVQGAGFEDLRRQSAADLVAMDFPGYSIGGLAVGESHEEMNAVLDETTPL   240

Query:  252 LPNDKPRYLMGVGAPDSLIDAVIRGVDMFDCVLPTRIARNGTCMTSQGRLVVKNAKFAED   311
            LP +KPRYLMGVGAPDSLID VIRGVDMFDCVLPTRIARNGTCMTS+GRLV+KNAKFAED
Sbjct:  241 LPENKPRYLMGVGAPDSLIDGVIRGVDMFDCVLPTRIARNGTCMTSEGRLVIKNAKFAED   300

Query:  312 FTPLDPNCDCYTCKNYTRAYIRHLLKADETFGIRLTSYHNLYFLVNLMKDVRQAIMDDNL   371
            FTPLD +CDCYTC+NY+RAYIRHLLKADETFGIRLTSYHNLYFLVNLMK VRQAIMDDNL
Sbjct:  301 FTPLDHDCDCYTCQNYSRAYIRHLLKADETFGIRLTSYHNLYFLVNLMKKVRQAIMDDNL   360

Query:  372 LEFRQDFMERYGYGMNNRNF                                          391
            LEFRQDF+ERYGY +NRNF
Sbjct:  361 LEFRQDFLERYGYNKSNRNF                                          380
```

Based on this analysis, it was predicted that these proteins and their epitopes could be useful antigens for vaccines or diagnostics.

EXAMPLE 1142

A DNA sequence (GBSx1218) was identified in *S. agalactiae* <SEQ ID 3545> which encodes the amino acid sequence <SEQ ID 3546>. Analysis of this protein sequence reveals the following:

```
Possible site: 56
>>> Seems to have no N-terminal signal sequence

----- Final Results -----
            bacterial cytoplasm --- Certainty = 0.2479(Affirmative) < succ>
            bacterial membrane  --- Certainty = 0.0000(Not Clear)   < succ>
             bacterial outside  --- Certainty = 0.0000(Not Clear)   < succ>
```

A related GBS nucleic acid sequence <SEQ ID 9303> which encodes amino acid sequence <SEQ ID 9304> was also identified. A further related GBS nucleic acid sequence <SEQ ID 10795> which encodes amino acid sequence <SEQ ID 10796> was also identified.

The protein has homology with the following sequences in the GENPEPT database.

```
>GP: CAB16256 GB: Z99164 hypothetical protein [Schizosaccharomyces
pombe]
Identities = 42/91 (46%), Positives = 62/91 (67%), Gaps = 3/91 (3%)

Query:    6 FGIGLDSSSRCYHYHTKLDIVALKCAVCQKYYACYKCHDALEEHCFAA-TKSDETFP-VL    63
            +G +D+ +RC+HYH+K D+VAL+C  C+K+YAC++CHD L  H F      K+     P V+
```

```
                             -continued
Sbjct:  13 YGKLVDNETRCFHYHSKADVVALRCGQCEKFYACFQCHDELNTHPFLPWRKAKFHIPCVI   72

Query:  64 CGSCRQMLTLKEYK-TGFCPYCRMLFNPNCQ                                  93
           CG+C+  LT++EY+ T C YC   FNP C+
Sbjct:  73 CGACKNSLTVEEYRSTVHCKYCNHPFNPKCK                                 103
```

A related DNA sequence was identified in *S. pyogenes* <SEQ ID 3547> which encodes the amino acid sequence <SEQ ID 3548>. Analysis of this protein sequence reveals the following:

```
Possible site: 36
>>> Seems to have no N-terminal signal sequence

----- Final Results -----
              bacterial cytoplasm --- Certainty = 0.2769(Affirmative) < succ>
                bacterial membrane --- Certainty = 0.0000(Not Clear)  < succ>
                 bacterial outside --- Certainty = 0.0000(Not Clear)  < succ>
```

An alignment of the GAS and GBS proteins is shown below.

```
Identities = 55/93 (59%), Positives = 62/93 (66%)

Query:   2 MQEYFGIGLDSSSRCYHYHTKLDIVALKCAVCQKYYACYKCHDALEEHCFAATKSDETFP   61
           M + FGI LD   RC HYHT LDIV LKCA CQ YYACY CHD L +H F  T   ET P
Sbjct:   1 MTDCFGIDLDQEYRCLHYHTPLDIVGLKCASCQTYYACYHCHDQLTDHAFVPTGHQETSP   60

Query:  62 VLCGSCRQMLTLKEYKTGFCPYCRMLFNPNCQR                              94
           V+CG CR++L+  EY  G CPYC+  FNP C R
Sbjct:  61 VICGHCRKLLSRAEYGCGCCPYCQSPFNPACHR                              93
```

Based on this analysis, it was predicted that these proteins and their epitopes could be useful antigens for vaccines or diagnostics.

EXAMPLE 1143

A DNA sequence (GBSx1219) was identified in *S. agalactiae* <SEQ ID 3549> which encodes the amino acid sequence <SEQ ID 3550>. This protein is predicted to be transport protein. Analysis of this protein sequence reveals the following:

```
Possible site: 19
>>> Seems to have no N-terminal signal sequence
      INTEGRAL     Likelihood = -9.45    Transmembrane   300-316 (292-321)
      INTEGRAL     Likelihood = -1.17    Transmembrane   265-281 (265-281)

----- Final Results -----
                 bacterial membrane --- Certainty = 0.4779(Affirmative) < succ>
                  bacterial outside --- Certainty = 0.0000(Not Clear)  < succ>
                bacterial cytoplasm --- Certainty = 0.0000(Not Clear)  < succ>
```

A related GBS nucleic acid sequence <SEQ ID 10113> which encodes amino acid sequence <SEQ ID 10114> was also identified.

The protein has homology with the following sequences in the GENPEPT database.

```
>GP: AAF12002 GB: AE002075 transport protein, putative
[Deinococcus radiodurans]
Identities = 108/295 (36%), Positives = 174/295 (58%), Gaps = 4/295 (1%)

Query:  31 GAWINLVNPSQEESEQVADQFGIDIDDLRAPLDVEETSRISVEDDYTLVIVDVPTYEERN    90
           G WI+    P+ EE  +V+ + G+++D L+ PLD +E SR    ED   L+I+         +
Sbjct:  21 GCWIDAAAPTTEELARVSRETGLELDYLKYPLDPDERSRFEREDGQLLIIMQTSYRLAED    80

Query:  91 NKSYYMTIPMGIIVTDNAVITTC-LEHLTLFDHFYRRRVKNFYTFMKTRFVFQLLYRNAE   149
```

-continued

```
                 +    Y T+P+GI+ TD+ ++T C LE   +         V+   T  K R   QL  RNA+
Sbjct:    81 SDIPYDTVPLGILHTDHCLVTVCSLEENPVVKDVVSGLVRRVSTVKKNRLTLQLFLRNAQ 140

Query:   150 LYLQALRTIDRQSDKIEAQLESATRNEQLIDMMELEKSIVYLKASLKFNERIVKKLTSST 209
             +L   +R I+++ D IE ++E+ATRN +L+D+++LEKS+VY    LK NE +++++
Sbjct:   141 RFLIDVRQINKRVDAIEDKMENATRNRELLDLLKLEKSLVYFITGLKANEAMMERVKRDR 200

Query:   210 SSLKKYIEDEDLLEDTLIETQQAIEMANIYENVLNAMTETTASIIGNNQNTIMKTLALVT 269
             +  Y ED +LL+D LIE  QAIEMA+I  N+L +M    AS+I NN N ++K L + T
Sbjct:   201 I-FEMYEEDSELLDDVLIENLQAIEMASIASNILTSMAGAFASVINNNVNQVVKVLTVTT 259

Query:   270 MTLDIPTVIFSAYGMNFQNNWMPLNGLAHGFIYVVLLAFLMSSFVVFYFIRKKWF       324
             + + IPT++   +GMN +   +P +   +GF V+ +A  ++S + F F R K F
Sbjct:   260 ILVAIPTLVSGFFGMNVEG-LPFSDSPYGFWLVMTVAMGIASLLAFLFYRWKVF       312
```

A related DNA sequence was identified in *S. pyogenes* <SEQ ID 715> which encodes the amino acid sequence <SEQ ID 716>. Analysis of this protein sequence reveals the following:

```
Possible site: 61
>>> Seems to have no N-terminal signal sequence
      INTEGRAL     Likelihood = -8.81     Transmembrane    293-309 (288-311)
      INTEGRAL     Likelihood = -1.28     Transmembrane    255-271 (255-271)

----- Final Results -----
             bacterial membrane  --- Certainty = 0.4524(Affirmative) < succ>
             bacterial outside   --- Certainty = 0.0000(Not Clear)   < succ>
             bacterial cytoplasm --- Certainty = 0.0000(Not Clear)   < succ>
```

An alignment of the GAS and GBS proteins is shown below.

```
Identities = 272/314 (86%), Positives = 296/314 (93%)

Query:    11 MKQMFLSTAIEFKEIETFEPGAWINLVNPSQEESEQVADQFGIDIDDLRAPLDVEETSRI   70
             MKQMFLS+AIEFKEIETFEPGAWI LVNPSQEES ++ADQF IDI DLRAPLDVEETSRI
Sbjct:     1 MKQMFLSSAIEFKEIETFEPGAWIKLVNPSQEESMKIADQFNIDISDLRAPLDVEETSRI   60

Query:    71 SVEDDYTLVIVDVPTYEERNNKSYYMTIPMGIIVTDNAVITTCLEHLTLFDHFYRRRVKN  130
             +VEDDYTL+IVDVP YEERNNKSYY+T+P+GIIVT+NAVITTCL  +TLFDHF+ RRVKN
Sbjct:    61 AVEDDYTLIIVDVPIYEERNNKSYYITMPLGIIVTENAVITTCLHDMTLFDHFHNRRVKN  120

Query:   131 FYTFMKTRFVFQLLYRNAELYLQALRTIDRQSDKIEAQLESATRNEQLIDMMELEKSIVY  190
             FYTFMKTRFVFQ+LYRNAEL+L ALRTIDRQS+++EAQLE+ATRNE+LIDMMELEKSIVY
Sbjct:   121 FYTFMKTRFVFQILYRNAELFLTALRTIDRQSERLEAQLEAATRNEELIDMMELEKSIVY  180

Query:   191 LKASLKFNERIVKKLTSSTSSLKKYIEDEDLLEDTLIETQQAIEMANIYENVLNAMTETT  250
             LKASLKFNERIVKKL+SSTSSLKKYIEDEDLLEDTLIETQQAIEMA IYENVLNAMTETT
Sbjct:   181 LKASLKFNERIVKKLSSSTSSLKKYIEDEDLLEDTLIETQQAIEMAGIYENVLNAMTETT  240

Query:   251 ASIIGNNQNTIMKTLALVTMTLDIPTVIFSAYGMNFQNNWMPLNGLAHGFIYVVLLAFLM  310
             ASII NNQNTIMKTLAL+TM LDIPTVIFSAYGMNFQNNW+PLNGL H F Y+ L+A L+
Sbjct:   241 ASIINNNQNTIMKTLALMTMALDIPTVIFSAYGMNFQNNWLPLNGLEHAFWYITLIAMLL  300

Query:   311 SSFVVFYFIRKKWF  324
             SSFVV YFIRKKWF
Sbjct:   301 SSFVVIYFIRKKWF  314
```

SEQ ID 3550 (GBS257) was expressed in *E. coli* as a His-fusion product. SDS-PAGE analysis of total cell extract is shown in FIG. 44 (lane 3; MW 35 kDa) and in FIG. 169 (lane 9 & 10; MW 50 kDa) and in FIG. 239 (lane 2; MW 50 kDa). It was also expressed in *E. coli* as a GST-fusion product. SDS-PAGE analysis of total cell extract is shown in FIG. 48 (lane 6; MW 60 kDa).

Based on this analysis, it was predicted that these proteins and their epitopes could be useful antigens for vaccines or diagnostics.

EXAMPLE 1144

A DNA sequence (GBSx1220) was identified in *S. agalactiae* <SEQ ID 3551> which encodes the amino acid sequence <SEQ ID 3552>. Analysis of this protein sequence reveals the following:

```
Possible site: 29
>>> Seems to have no N-terminal signal sequence
     INTEGRAL    Likelihood = -12.26    Transmembrane    158-174 (151-182)
     INTEGRAL    Likelihood =  -6.37    Transmembrane     93-109  (91-111)
     INTEGRAL    Likelihood =  -5.68    Transmembrane    188-204 (184-205)
     INTEGRAL    Likelihood =  -0.85    Transmembrane    118-134 (118-134)

----- Final Results -----
            bacterial membrane  --- Certainty = 0.5904(Affirmative) < succ>
             bacterial outside  --- Certainty = 0.0000(Not Clear)   < succ>
           bacterial cytoplasm  --- Certainty = 0.0000(Not Clear)   < succ>
```

The protein has no significant homology with any sequences in the GENPEPT database.

A related DNA sequence was identified in *S. pyogenes* <SEQ ID 3553> which encodes the amino acid sequence <SEQ ID 3554>. Analysis of this protein sequence reveals the following:

```
Possible site: 52
>>> Seems to have no N-terminal signal sequence
     INTEGRAL    Likelihood = -6.95    Transmembrane     92-108  (88-110)
     INTEGRAL    Likelihood = -6.69    Transmembrane    153-169 (151-177)
     INTEGRAL    Likelihood = -2.34    Transmembrane    183-199 (183-200)

----- Final Results -----
            bacterial membrane  --- Certainty = 0.3781(Affirmative) < succ>
             bacterial outside  --- Certainty = 0.0000(Not Clear)   < succ>
           bacterial cytoplasm  --- Certainty = 0.0000(Not Clear)   < succ>
```

The protein has no significant homology with any sequences in the GENPEPT database.

An alignment of the GAS and GBS proteins is shown below.

```
Identities = 135/217 (62%), Positives = 167/217 (76%), Gaps = 1/217 (0%)

Query:   1 MTLQDLTKKNQEFVHIATNQLLADGKSDAEIKAILEEHLPEIIDNQKKGITARSLLGAPT   60
           M LQ+LTKKNQEF+H ATN+L+ DGKSD +IK ILEE +P I++NQKKG+TAR+LLG PT
Sbjct:   1 MELQELTKKNQEFIHTATNKLIQDGKSDEDIKLILEEAIPAILENQKKGVTARNLLGTPT   60

Query:  61 TWAASFTERPEDKARVSVQKNTNPWLMWLDTSLLFLGLVTALNGLMLLFGQSNVNTGLIS  120
             WAASF++ P  KA       KNTNPWLMWLDTSLLF+G+V LNG+M  F   TGLIS
Sbjct:  61 AWAASFSQDPSQKA-AETDKNTNPWLMWLDTSLLFIGIVALLNGIMTFFNTNATVTGLIS  119

Query: 121 ILTLGFGGGAAMYVTYYYIYRHMGKPKSERPGWLKSFAVLALVMLVWFALFAVVPLLPAT  180
           +L LGFGGGA+MY TYY+IYRH+GK KS RP W K  A L+L ML+W AL++    LP +
Sbjct: 120 LLALGFGGGASMYATYYFIYRHLGKDKSLRPSWFKIIAALSLAMLIWIALYSATAFLPTS  179

Query: 181 INPKLPEVVLFIIALASFGLRFYLQRKYNIQSSMAPV                        217
           +NP+LP + L II    S    LR+YLQRKYNIQ++M+PV
Sbjct: 180 LNPQLPPLALLIIGGVSLALRYYLQRKYNIQNTMSPV                        216
```

A related GBS gene <SEQ ID 10787> and protein <SEQ ID 10788> were also identified. Analysis of this protein sequence reveals the following:

```
Lipop: Possible site: -1 Crend: 8
McG: Discrim Score: -9.94
GvH: Signal Score (-7.5): -3.66
    Possible site: 29
>>> Seems to have no N-terminal signal sequence
ALOM program count: 4 value: -12.26 threshold: 0.0
     INTEGRAL    Likelihood = -12.26    Transmembrane    158-174 (151-182)
```

```
       INTEGRAL    Likelihood = -6.37       Transmembrane    93-109  (91-111)
       INTEGRAL    Likelihood = -5.68       Transmembrane   188-204  (184-205)
       INTEGRAL    Likelihood = -0.85       Transmembrane   118-134  (118-134)
       PERIPHERAL  Likelihood =  8.43       50
modified ALOM score: 2.95
*** Reasoning Step: 3

----- Final Results -----
              bacterial membrane  --- Certainty = 0.5904(Affirmative) < succ>
              bacterial outside   --- Certainty = 0.0000(Not Clear)   < succ>
              bacterial cytoplasm --- Certainty = 0.0000(Not Clear)   < succ>
```

Based on this analysis, it was predicted that these proteins and their epitopes could be useful antigens for vaccines or diagnostics.

EXAMPLE 1145

A DNA sequence (GBSx1221) was identified in *S. agalactiae* <SEQ ID 3555> which encodes the amino acid sequence <SEQ ID 3556>. Analysis of this protein sequence reveals the following:

```
Possible site: 28
>>> Seems to have no N-terminal signal sequence

----- Final Results -----
              bacterial cytoplasm --- Certainty = 0.1348(Affirmative) < succ>
              bacterial membrane  --- Certainty = 0.0000(Not Clear)   < succ>
              bacterial outside   --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1146

A DNA sequence (GBSx1222) was identified in *S. agalactiae* <SEQ ID 3557> which encodes the amino acid sequence <SEQ ID 3558>. This protein is predicted to be excinuclease ABC (uvrA). Analysis of this protein sequence reveals the following:

```
Possible site: 18
>>> Seems to have no N-terminal signal sequence

----- Final Results -----
              bacterial cytoplasm --- Certainty = 0.1738(Affirmative) < succ>
              bacterial membrane  --- Certainty = 0.0000(Not Clear)   < succ>
              bacterial outside   --- Certainty = 0.0000(Not Clear)   < succ>
```

A related GBS nucleic acid sequence <SEQ ID 10111> which encodes amino acid sequence <SEQ ID 10112> was also identified.

The protein has homology with the following sequences in the GENPEPT database.

```
>GP: AAC67271 GB: AF017113 excinuclease ABC subunit A [Bacillus subtilis]
Identities = 642/940 (68%), Positives = 785/940 (83%), Gaps = 3/940 (0%)

Query:  9 DKLMIRGARAHNLKNISVDIPRDKLVVVTGLSGSGKSSLAFDTIYAEGQRRYVESLSAYA  68
          D++ ++GARAHNLKNI V IPRD+LVVVTGLSGSGKSSLAFDTIYAEGQRRYVESLSAYA
Sbjct:  4 DRIEVKGARAHNLKNIDVTIPRDQLVVVTGLSGSGKSSLAFDTIYAEGQRRYVESLSAYA  63
```

-continued

```
Query:   69 RQFLGNMEKPDVDSIDGLSPAISIDQKTTSKNPRSTVGTVTEINDYLRLLYARVGTPYCI 128
            RQFLG M+KPDVD+I+GLSPAISIDQKTTS+NPRSTVGTVTEI DYLRLLYARVG P+C
Sbjct:   64 RQFLGQMDKPDVDAIEGLSPAISIDQKTTSRNPRSTVGTVTEIYDYLRLLYARVGKPHCP 123

Query:  129 NGHGAITASSVEQIVDKVLALPERTKMQILAPIIRRKKGQHKSTFEKIQKDGYVRVRIDG 188
               IT+ ++EQ+VD++L  PERTK+Q+LAPI+  +KG H   E+I+K GYVRVRIDG
Sbjct:  124 EHGIEITSQTIEQMVDRILEYPERTKLQVLAPIVSGRKGAHVKVLEQIRKQGYVRVRIDG 183

Query:  189 DIHDVTEVPELSKSKMHNIDIVVDRLINKEGIRSRLFDSVEAALRLSDGYVVIDTMDGNE 248
            ++ ++++  EL K+K H+I++V+DR++ KEG+ +RL DS+E ALRL +G V+ID +   E
Sbjct:  184 EMAELSDDIELEKNKKHSIEVVIDRIVVKEGVAARLSDSLETALRLGEGRVMIDVIGEEE 243

Query:  249 LLFSEHYSCPECGFTVPELEPRLFSFNAPFGSCPTCDGLGIKLEVDIDLVIPDRSKTLRE 308
            L+FSEH++CP CGF++ ELEPRLFSFN+PFG+CPTCDGLG+KLEVD DLVIP++  +L+E
Sbjct:  244 LMFSEHHACPHCGFSIGELEPRLFSFNSPFGACPTCDGLGMKLEVDADLVIPNQDLSLKE 303

Query:  309 GALVPWNPISSNYYPTMLEQAMTQFGVDMDTPFEKLSKAEQDLALYGSGEREFHFHYIND 368
             A+ PW PISS YYP +LE   T +G+DMD P + L K + D  LYGSG+   +F Y ND
Sbjct:  304 NAVAPWTPISSQYYPQLLEAVCTHYGIDMDVPVKDLPKHQLDKVLYGSGDDLIYFRYEND 363

Query:  369 FGGERNIDLPFEGVVNNINRRYHETNSDYTRNVMREYMNELKCNTCHGYRLNDQALCVRV 428
            FG  R  ++ FEGV+ NI RRY ET SD+ R  M +YN++  C TC GYRL  +AL V +
Sbjct:  364 FGQIREGEIQFEGVLRNIERRYKETGSDFIREQMEQYMSQKSCPTCKGYRLKKEALAVLI 423

Query:  429 GGEEGLNIGQVSDLSIADHLELLETLRLSSNEQLIARPIIKEIHDRLSFLNNVGLNYLNL 488
               +G +IG++++LS+AD L   + L LS +  IA  I++EI  +RLSFL+ VGL+YL L
Sbjct:  424 ---DGRHIGKITELSVADALAFFKDLTLSEKDMQIANLILREIVERLSFLDKVGLDYLTL 480

Query:  489 SRSAGTLSGGESQRIRLATQIGSLSGVLY+LDEPSIGLHQRDNDRLIDSLKKMRDLGNT 548
            SR+AGTLSGGE+QRIRLATQIGS LSGVLYVLDEPSIGLHQRDNDRLI +LK MRDLGNT
Sbjct:  481 SRAAGTLSGGEAQRIRLATQIGSRLSGVLYILDEPSIGLHQRDNDRLISALKNMRDLGNT 540

Query:  549 LIVVEHDEDTMMAADWLIDVGPGAGAFGGEIVASGTPKQVAKNTKSITGQYLSGKKVIPV 608
            LIVVEHDEDTMMAAD+LID+GPGAG  GG+++++GTP++V ++  S+TG YLSGKK IP+
Sbjct:  541 LIVVEHDEDTMMAADYLIDIGPGAGIHGGQVISAGTPEEVMEDPNSLTGSYLSGKKFIPL 600

Query:  609 PSERRVGNGRFLEIKGAAENNLQNLDVKFPLGKFIAVTGVSGSGKSTLINSILKKAVAQK 668
            P ERR  +GR++EIKGA+ENNL+ ++ KFPLG F AVTGVSGSGKSTL+N IL KA+AQK
Sbjct:  601 PPERRKPDGRYIEIKGASENNLKKVNAKFPLGTFTAVTGVSGSGKSTLVNEILHKALAQK 660

Query:  669 LNRNSDKPGKYVSLEGIEYVQRLIDIDQSPIGRTPRSNPATYTGVFDDIRDLFAQTNEAK 728
            L++   KPG +  ++G++++D++IDIDQ+PIGRTPRSNPATYTGVFDDIRD+FAQTNEAK
Sbjct:  661 LHKAKAKPGSHKEIKGLDHLDKVIDIDQAPIGRTPRSNPATYTGVFDDIRDVFAQTNEAK 720

Query:  729 IRGYKKGRFSFNVKGGRCESCSGDGIIKIEMHFLPDVYVPCEVCHGTRYNSETLEVNYKE 788
            +RGYKKGRFSFNVGGRCE+C GDGIIKIEMHFLPDVYVPCEVCHG  RYN  ETLEV YK
Sbjct:  721 VRGYKKGRFSFNVKGGRCEACRGDGIIKIEMHFLPDVYVPCEVCHGKRYNRETLEVTYKG 780

Query:  789 KNIAQILDNTVNDAVTFFAAIPKIARKLQTIKDVGLGYVTLGQPATTLSGGEAQRMKLAS 848
            K+I+ +LDMTV DA++FF IPKI RKLQT+ DVGLGY+TLGQPATTLSGGEAQR+KLAS
Sbjct:  781 KSISDVLDMTVEDALSFFENIPKIKRKLQTLYDVGLGYITLGQPATTLSGGEAQRVKLAS 840

Query:  849 ELHKRSTGKSLYILDEPTTGLHADDIARLLKVLDRFVDDGNTVLVIEHNLDVIKTADHII 908
            ELHKRSTG++LYILDEPTTGLH DDIARLL VL R VD+G+T+LVIEHNLD+IKTAD+I+
Sbjct:  841 ELHKRSTGRTLYILDEPTTGLHVDDIARLLVVLQRLVDNGDTVLVIEHNLDIIKTADYIV 900

Query:  909 DLGPEGGIGGGQIVAIGTPEEVAENPKSYTGYYLKEKLAR                    948
            DLGPEGG GGG IVA GTPEE+ E  +SYTG YLK  + R
Sbjct:  901 DLGPEGGAGGGTIVASGTPEEITEVEESYTGRYLKPVIER                    940
```

A related DNA sequence was identified in *S. pyogenes* <SEQ ID 3559> which encodes the amino acid sequence <SEQ ID 3560>. Analysis of this protein sequence reveals the following:

```
Possible site: 52
>>> Seems to have no N-terminal signal sequence

----- Final Results -----
              bacterial cytoplasm --- Certainty = 0.1138(Affirmative) < succ>
              bacterial membrane  --- Certainty = 0.0000(Not Clear)   < succ>
              bacterial outside   --- Certainty = 0.0000(Not Clear)   < succ>
```

An alignment of the GAS and GBS proteins is shown below.

```
Identities = 835/940 (88%), Positives = 896/940 (94%)

Query:     7 MQDKLMIRGARAHNLKNISVDIPRDKLVVVTGLSGSGKSSLAFDTIYAEGQRRYVESLSA    66
             MQ+K++I GARAHNLKNI V+IPRDKLVVVTGLSGSGKSSLAFDTIYAEGQRRYVESLSA
Sbjct:    11 MQNKIIIHGARAHNLKNIDVEIPRDKLVVVTGLSGSGKSSLAFDTIYAEGQRRYVESLSA    70

Query:    67 YARQFLGNMEKPDVDSIDGLSPAISIDQKTTSKNPRSTVGTVTEINDYLRLLYARVGTPY   126
             YARQFLGNMEKPDVDSIDGLSPAISIDQKTTSKNPRSTVGTVTEINDYLRLLYARVGTPY
Sbjct:    71 YARQFLGNMEKPDVDSIDGLSPAISIDQKTTSKNPRSTVGTVTEINDYLRLLYARVGTPY   130

Query:   127 CINGHGAITASSVEQIVDKVLALPERTKMQILAPIIRRKKGQHKSTFEKIQKDGYVRVRI   186
             CINGHGAITASS EQIV++VLALPERT+MQILAP++RRKKGQHK+ FEKIQKDGYVRVR+
Sbjct:   131 CINGHGAITASSAEQIVEQVLALPERTRMQILAPVVRRKKGQHKTVFEKIQKDGYVRVRV   190

Query:   187 DGDIHDVTEVPELSKSKMHNIDIVVDRLINKEGIRSRLFDSVEAALRLSDGYVVIDTMDG   246
             DGDI DVTEVPELSKSKMHNI++V+DRL+NK+GIRSRLFDSVEAALRL DGY++IDTMDG
Sbjct:   191 DGDIFDVTEVPELSKSKMHNIEVVIDRLVNKDGIRSRLFDSVEAALRLGDGYLMIDTMDG   250

Query:   247 NELLFSEHYSCPECGFTVPELEPRLFSFNAPFGSCPTCDGLGIKLEVDIDLVIPDRSKTL   306
             NELLFSEHYSCP CGFTVPELEPRLFSFNAPFGSCPTCDGLGIKLEVD+DLV+PD SK+L
Sbjct:   251 NELLFSEHYSCPVCGFTVPELEPRLFSFNAPFGSCPTCDGLGIKLEVDLDLVVPDPSKSL   310

Query:   307 REGALVPWNPISSNYYPTMLEQAMTQFGVDMDTPFEKLSKAEQDLALYGSGEREFHFHYI   366
             REGAL PWNPISSNYYPTMLEQAM  FGVDMDTPFE L++ E+DL LYGSG+REFHFHY+
Sbjct:   311 REGALAPWNPISSNYYPTMLEQAMASFGVDMDTPFEALTEEERDLVLYGSGDREFHFHYV   370

Query:   367 NDFGGERNIDLPFEGVVNNINRRYHETNSDYTRNVMREYMNELKCNTCHGYRLNDQALCV   426
             NDFGGERNID+PFEGVV N+NRRYHETNSDYTRNVMR YMNEL C TCHGYRLNDQALCV
Sbjct:   371 NDFGGERNIDIPFEGVVTNVNRRYHETNSDYTRNVMRGYMNELTCATCHGYRLNDQALCV   430

Query:   427 RVGGEEGLNIGQVSDLSIADHLELLETLRLSSNEQLIARPIIKEIHDRLSFLNNVGLNYL   486
              VGGEEG +IGQ+S+LSIADHL+LLE L L+ NE   IA+PI+KEIHDRL+FLNNVGLNYL
Sbjct:   431 HVGGEEGTHIGQISELSIADHLQLLEELELTENESTIAKPIVKEIHDRLTFLNNVGLNYL   490

Query:   487 NLSRSAGTLSGGESQRIRLATQIGSNLSGVLYVLDEPSIGLHQRDNDRLIDSLKKMRDLG   546
              LSR+AGTLSGGESQRIRLATQIGSNLSGVLY+LDEPSIGLHQRDNDRLI+SLKKMRDLG
Sbjct:   491 TLSRAAGTLSGGESQRIRLATQIGSNLSGVLYILDEPSIGLHQRDNDRLIESLKKMRDLG   550

Query:   547 NTLIVVEHDEDTMMAADWLIDVGPGAGAFGGEIVASGTPKQVAKNTKSITGQYLSGKKVI   606
             NTLIVVEHDEDTMM ADWLIDVGPGAG FGGEI ASGTPKQVAKN KSITGQYLSGKK I
Sbjct:   551 NTLIVVEHDEDTMMQADWLIDVGPGAGEFGGEITASGTPKQVAKNKKSITGQYLSGKKFI   610

Query:   607 PVPSERRVGNGRFLEIKGAAENNLQNLDVKFPLGKFIAVTGVSGSGKSTLINSILKKAVA   666
             PVP ERR GNGRF+EIKGAA+NNLQ+LDV+FPLGKFIAVTGVSGSGKSTL+NSILKKAVA
Sbjct:   611 PVPLERRSGNGRFIEIKGAAQNNLQSLDVRFPLGKFIAVTGVSGSGKSTLVNSILKKAVA   670

Query:   667 QKLNRNSDKPGKYVSLEGIEYVDRLIDIDQSPIGRTPRSNPATYTGVFDDIRDLFAQTNE   726
             QKLNRN+DKPGKY S+ GIE+++RLIDIDQSPIGRTPRSNPATYTGVFDDIRDLFAQTNE
Sbjct:   671 QKLNRNADKPGKYHSISGIEHIERLIDIDQSPIGRTPRSNPATYTGVFDDIRDLFAQTNE   730

Query:   727 AKIRGYKKGRFSFNVKGGRCESCSGDGIIKIEMHFLPDVYVPCEVCHGTRYNSETLEVHY   786
             AKIRGYKKGRFSFNVKGGRCE+CSGDGIIKIEMHFLPDVYVPCEVCHG RYNSETLEVHY
Sbjct:   731 AKIRGYKKGRFSFNVKGGRCEACSGDGIIKIEMHFLPDVYVPCEVCHGRRYNSETLEVHY   790

Query:   787 KEKNIAQILDMTVNDAVTFFAAIPKIARKLQTIKDVGLGYVTLGQPATTLSGGEAQRMKL   846
             K  KNIA++LDMTV+DA+ FF+AIPKIARK+QTIKDVGLGYVTLGQPATTLSGGEAQRMKL
Sbjct:   791 KGKNIAEVLDMTVDDALVFFSAIPKIARKIQTIKDVGLGYVTLGQPATTLSGGEAQRMKL   850

Query:   847 ASELHKRSTGKSLYILDEPTTGLHADDIARLLKVLDRFVDDGNTVLVIEHNLDVIKTADH   906
             ASELHKRSTGKSLYILDEPTTGLH DDIARLLKVL+RFVDDGNTVLVIEHNLDVIK+ADH
Sbjct:   851 ASELHKRSTGKSLYILDEPTTGLHTDDIARLLKVLERFVDDGNTVLVIEHNLDVIKSADH   910

Query:   907 IIDLGPEGGIGGGQIVAIGTPEEVAENPKSYTGYYLKEKL                      946
             IIDLGPEGG GGGQIVA GTPEEVA+  +SYTG+YLK KL
Sbjct:   911 IIDLGPEGGDGGGQIVATGTPEEVAQVKESYTGHYLKVKL                      950
```

Based on this analysis, it was predicted that these proteins and their epitopes could be useful antigens for vaccines or diagnostics.

EXAMPLE 1147

A DNA sequence (GBSx1223) was identified in *S. agalactiae* <SEQ ID 3561> which encodes the amino acid sequence <SEQ ID 3562>. Analysis of this protein sequence reveals the following:

```
Possible site: 60
>>> Seems to have an uncleavable N-term signal seq
    INTEGRAL    Likelihood = -10.40   Transmembrane   471-487 (463-490)
    INTEGRAL    Likelihood =  -9.29   Transmembrane   246-262 (242-264)
    INTEGRAL    Likelihood =  -7.27   Transmembrane   183-199 (178-207)
    INTEGRAL    Likelihood =  -5.41   Transmembrane   351-367 (349-370)
    INTEGRAL    Likelihood =  -4.41   Transmembrane    87-103 (83-107)
    INTEGRAL    Likelihood =  -3.24   Transmembrane   375-391 (374-392)
    INTEGRAL    Likelihood =  -2.97   Transmembrane    17-33  (16-35)
    INTEGRAL    Likelihood =  -2.28   Transmembrane   420-436 (420-438)
    INTEGRAL    Likelihood =  -1.97   Transmembrane   320-336 (320-337)
    INTEGRAL    Likelihood =  -1.75   Transmembrane   214-230 (214-230)
    INTEGRAL    Likelihood =  -1.75   Transmembrane   288-304 (288-304)
    INTEGRAL    Likelihood =  -1.70   Transmembrane   110-126 (110-126)
    INTEGRAL    Likelihood =  -0.69   Transmembrane   152-168 (151-168)

----- Final Results -----
            bacterial membrane --- Certainty = 0.5161(Affirmative) < succ>
            bacterial outside  --- Certainty = 0.0000(Not Clear)   < succ>
            bacterial cytoplasm --- Certainty = 0.0000(Not Clear)   < succ>
```

The protein has homology with the following sequences in the GENPEPT database.

```
>GP: CAB12192 GB: Z99106 similar to multidrug resistance
protein [Bacillus subtilis]
Identities = 198/481 (41%), Positives = 300/481 (62%), Gaps = 24/481 (4%)

Query:    9 IHGKPYNRTAMITLLLIATFAGVLNQTSLGTAIPTLMNSFNISLSTAQQATTWFLLANGI    68
            I  KP+NR+ ++ +LL   F  +LNQT L TA+P +M  FN+   + AQ   TT F+L NGI
Sbjct:    5 IEQKPFNRSVIVGILLAGAFVAILNQTLLITALPHIMRDFNVDANQAQWLTTSFMLTNGI    64

Query:   69 MIPVSAYLATRFSTKWLYVTSYVVLLIGLLMTTLAPTSNWNLFLVGRIIQAISVGISMPL   128
            +IP++A+L  +F+++ L +T+    G ++    AP N+ + L  RIIQA    GI MPL
Sbjct:   65 LIPITAFLIEKFTSRALLITAMSIFTAGTVVGAFAP--NFPVLLTARIIQAAGAGIMMPL   122

Query:  129 MQVVMVNVFPPEQRGAAMGLNGLVVGLAPAIGPTLAGWILKQEFHFAGHDLTWRAIFLLP   188
            MQ V + +FP E+RG AMG+ GLV+   APAIGPTL+GW +           +WR++F +
Sbjct:  123 MQTVFLTIFPIEKRGQAMGMVGLVISFAPAIGPTLSGWAVEA---------FSWRSLFYII   174

Query:  189 LLILTVTTILSPFVLKDVVDNKSVKLEVPSLILSIIGFGSFLWGFTNVATYGWGDIGYVI   248
            L   +  IL+  ++K+V   +    S+ILS  GFG GL+F++V +YGW      +I
Sbjct:  175 LPFAVIDLILASILMKNVTTLRKTQIDILSVILSTFGFGGLLYGFSSVGSYGWSSSTVLI   234

Query:  249 SPIMVGIIFIALFIHRQLKLETPFLDIRVFKNKQFSVTTAAIALSMMAMMGVEMMLPLYL   308
            S ++VG+I + LFI RQ+KL+ P L+ RVF     FS+TT     L    ++G E +LPLY
Sbjct:  235 S-LLVGVIALLLFITRQMKLKKPMLEFRVFTFGVFSLTTLLGTLVFALLIGTETILPLYT   293

Query:  309 QNVHGLSALDSGLALLPGALMMGIVSPISGAVYDKVGARRMAMIGFTILGVATLPFVFLT   368
            QNV   ++A D+GL LLPGA++MG +SPI G ++D+VG R +A+ GF I+ + +LPF+ LT
Sbjct:  294 QNVRDVTAFDTGLMLLPGAVVMGFMSPIIGRIFDRVGGRGLAIAGFCIIFLTSLPFMQLT   353

Query:  369 TTTPDHFITLLYAVRMFGIAMVMMPLTASAMSALPPHEAAHGTAANNTARQIASAVVVAL   428
                T   +I +LY VR+ G AM+MMP+T + ++ALP H   HGTA NNT RQ+ ++ AL
Sbjct:  354 DHTSLAWIVVLYTVRLLGTAMIMMPVTTAGINALPRHLIPHGTAMNNTIRQVGGSIGTAL   413

Query:  429 LSSVAQNIITNNKPSKDLLTMNPLKYANQMLNASLDGFHVSFAIGFVFAVLGLLVSLFLRK   489
            L SV  N +        +       + +A+L G + +F + V A++G L+S   L+K
Sbjct:  414 LVSVMSNQAAH-------------AGTTNVKHAALHGMNAAFIVAAVIALVGFLLSFTLKK   461
```

There is also homology to SEQ ID 46.

Based on this analysis, it was predicted that this protein and its epitopes, could be useful antigens for vaccines or diagnostics.

EXAMPLE 1148

A DNA sequence (GBSx1224) was identified in *S. agalactiae* <SEQ ID 3563> which encodes the amino acid sequence <SEQ ID 3564>. Analysis of this protein sequence reveals the following:

```
Possible site: 47
>>> Seems to have an uncleavable N-term signal seq
```

```
INTEGRAL      Likelihood = -8.81      Transmembrane      8-24 (5-30)
INTEGRAL      Likelihood = -7.32      Transmembrane      36-52 (31-54)

----- Final Results -----
              bacterial membrane --- Certainty = 0.4524(Affirmative) < succ>
              bacterial outside  --- Certainty = 0.0000(Not Clear)   < succ>
           bacterial cytoplasm  --- Certainty = 0.0000(Not Clear)   < succ>
```

A related GBS nucleic acid sequence <SEQ ID 10109> which encodes amino acid sequence <SEQ ID 10110> was also identified.

A related GBS gene <SEQ ID 8743> and protein <SEQ ID 8744> were also identified. Analysis of this protein sequence reveals the following:

```
Lipop: Possible site: -1 Crend: 8
McG: Discrim Score: 9.52
GvH: Signal Score (-7.5): -3.4
     Possible site: 22
>>> Seems to have an uncleavable N-term signal seq
ALOM program Count: 1 value: -7.32 threshold: 0.0
     INTEGRAL      Likelihood = -7.32      Transmembrane     11-27 (6-29)
     PERIPHERAL    Likelihood = 11.19      130
modified ALOM score: 1.96
*** Reasoning Step: 3

----- Final Results -----
              bacterial membrane --- Certainty = 0.3930(Affirmative) < succ>
              bacterial outside  --- Certainty = 0.0000(Not Clear)   < succ>
           bacterial cytoplasm  --- Certainty = 0.0000(Not Clear)   < succ>
```

The protein has no significant homology with any sequences in the GENPEPT database.

No corresponding DNA sequence was identified in *S. pyogenes*.

SEQ ID 8744 (GBS29) was expressed in *E. coli* as a His-fusion product. SDS-PAGE analysis of total cell extract is shown in FIG. 7 (lane 2; MW 25.6 kDa). It was also expressed in *E. coli* as a GST-fusion product. SDS-PAGE analysis of total cell extract is shown in FIG. 15 (lane 6; MW 51 kDa).

Based on this analysis, it was predicted that these proteins and their epitopes could be useful antigens for vaccines or diagnostics.

EXAMPLE 1149

A DNA sequence (GBSx1225) was identified in *S. agalactiae* <SEQ ID 3565> which encodes the amino acid sequence <SEQ ID 3566>. This protein is predicted to be aminopeptidase P (pepQ). Analysis of this protein sequence reveals the following:

```
Possible site: 41
>>> Seems to have no N-terminal signal sequence

----- Final Results -----
           bacterial cytoplasm --- Certainty = 0.0724(Affirmative) < succ>
           bacterial membrane  --- Certainty = 0.0000(Not Clear)   < succ>
           bacterial outside   --- Certainty = 0.0000(Not Clear)   < succ>
```

The protein has homology with the following sequences in the GENPEPT database.

```
>GP: CAA70068 GB: Y08842 aminopeptidase P [Lactococcus lactis]
Identities = 44/126 (34%), Positives = 78/126 (60%)

Query:   6 RLTRCQTAISQLSCDALLITNLTNIFYLTGFSGTNATVLISPKHRIFVTDSRYALIAKNT   65
           R+ + +  +    + D+LLIT++ NIFYLTGFSGT  TV ++ K  IF+TDSRY+ +A+
Sbjct:   2 RIEKLKVKMLTENIDSLLITDMKNIFYLTGFSGTAGTVFLTQKRNIFMTDSRYSEMARGL   61

Query:  66 VREFDIIISREPLAAILKIIRDDALIAIGFETDISYHMYKHMVEVFEDYRLIEAPSVVEK  125
           ++ F+II +R+P++ + ++    +++   + FE   Y  +K + +      L    + V +
Sbjct:  62 IKNFEIIETRDPISLLTELSASESVKNMAFEETVDYAFFKRLSKAATKLDLFSTSNFVLE  121

Query: 126 LRMIKD                                                        131
           LR IKD
Sbjct: 122 LRQIKD                                                        127
```

There is also homology to SEQ ID 3568.

Based on this analysis, it was predicted that this protein and its epitopes, could be useful antigens for vaccines or diagnostics.

EXAMPLE 1150

A DNA sequence (GBSx1226) was identified in *S. agalactiae* <SEQ ID 3569> which encodes the amino acid sequence <SEQ ID 3570>. This protein is predicted to be aminopeptidase P (pepQ-2). Analysis of this protein sequence reveals the following:

```
Possible site: 44
>>> Seems to have no N-terminal signal sequence

----- Final Results -----
            bacterial cytoplasm --- Certainty = 0.2508(Affirmative) < succ>
            bacterial membrane  --- Certainty = 0.0000(Not Clear)   < succ>
            bacterial outside   --- Certainty = 0.0000(Not Clear)   < succ>
```

The protein has homology with the following sequences in the GENPEPT database.

```
>GP: CAA70068 GB: Y08842 aminopeptidase P [Lactococcus lactis]
Identities = 131/205 (63%), Positives = 163/205 (78%), Gaps = 3/205 (1%)

Query:   2 LDFIKPDRTTELQVANFLDFRMRELGATGPSFDFIVASGYRSAMPHGVASQKTIQSGETL   61
           L FI+P RT E++VANFLDF+MR+L A+G SF+ IVASG RS++PHGVA+ K IQ G+ +
Sbjct: 149 LRFIEPGRT-EIEVANFLDFKMRDLEASGISFETIVASGKRSSLPHGVATSKMIQFGDPV  207

Query:  62 TLDFGCYYQHYVSDMTRTIHIGHVTDQEREIYDIVLKSNQAIIGNVKSGMKRCDYDYLAR  121
           T+DFGCYY+HY SDMTRTI +G V D+ R IY+ V K+N+A+I   VK+GM     YD + R
Sbjct: 208 TIDFGCYYEHYASDMTRTIFVGSVDDKMRTIYETVRKANEALIKQVKAGMTYAQYDNIPR  267

Query: 122 QVIENSGYGNHFTHGIGHGMGLDVHEIPYFGKS--EGVIASGMVVTDEPGIYLDNKYGVR  179
           +VIE + +G +FTHGIGHG+GLDVHEIPYF +S  E  + SGMV+TDEPGIYL    GVR
Sbjct: 268 EVIEKADFGQYFTHGIGHGLGLDVHEIPYFNQSMTENQLRSGMVITDEPGIYLPEFGGVR  327

Query: 180 IEDDLLITETGCEVLTSAPKELIVL                                     204
           IEDDLL+TE GCEVLT APKELIV+
Sbjct: 328 IEDDLLVTENGCEVLTKAPKELIVI                                     352
```

A related DNA sequence was identified in *S. pyogenes* <SEQ ID 3567> which encodes the amino acid sequence <SEQ ID 3568>. Analysis of this protein sequence reveals the following:

```
Possible Site: 45
>>> Seems to have no N-terminal signal sequence

----- Final Results -----
            bacterial cytoplasm --- Certainty = 0.1450(Affirmative) < succ>
            bacterial membrane  --- Certainty = 0.0000(Not Clear)   < succ>
            bacterial outside   --- Certainty = 0.0000(Not Clear)   < succ>
```

An alignment of the GAS and GBS proteins is shown below.

```
Identities = 145/203 (71%), Positives = 171/203 (83%)

Query:   2 LDFIKPDRTTELQVANFLDFRMRELGATGPSFDFIVASGYRSAMPHGVASQKTIQSGETL   61
           LDFIKP  TTE +ANFLDFRMR+ GA+G SFD IVASGY SAMPHG AS K IQ+ E+L
Sbjct: 168 LDFIKPGTTTERDLANFLDFRMRQYGASGTSFDIIVASGYLSAMPHGRASDKVIQNKESL  227

Query:  62 TLDFGCYYQHYVSDMTRTIHIGHVTDQEREIYDIVLKSNQAIIGNVKSGMKRCDYDYLAR  121
           T+DFGCYY HYVSDMTRTIHIG VTD+EREIY +VL +N+A+I    +GM   D+D + R
Sbjct: 228 TMDFGCYYNHYVSDMTRTIHIGQVTDEEREIYALVLAANKALIAKASAGMTYSDFDGIPR  287

Query: 122 QVIENSGYGNHFTHGIGHGMGLDVHEIPYFGKSEGVIASGMVVTDEPGIYLDNKYGVRIE  181
           Q+I  +GYG+ FTHGIGHG+GLD+HE P+FGKSE ++ +GMVVTDEPGIYLDNKYGVRIE
Sbjct: 288 QLITEAGYGSRETHGIGHGIGLDIHENPFFGKSEQLLQAGMVVTDEPGIYLDNKYGVRIE  347
```

```
Query: 182 DDLLITETGCEVLTSAPKELIVL                                        204
           DDL+IT+TGC+VLT APKELIVL
Sbjct: 348 DDLVITKTGCQVLTLAPKELIVL                                        370
```

Based on this analysis, it was predicted that these proteins and their epitopes could be useful antigens for vaccines or diagnostics.

EXAMPLE 1151

A DNA sequence (GBSx1227) was identified in *S. agalactiae* <SEQ ID 3571> which encodes the amino acid sequence <SEQ ID 3572>. This protein is predicted to be yfhC protein (comEB). Analysis of this protein sequence reveals the following:

```
Possible site: 14
>>> Seems to have no N-terminal signal sequence

----- Final Results -----
            bacterial cytoplasm --- Certainty = 0.1401(Affirmative) < succ>
             bacterial membrane --- Certainty = 0.0000(Not Clear)   < succ>
              bacterial outside --- Certainty = 0.0000(Not Clear)   < succ>
```

The protein has homology with the following sequences in the GENPEPT database.

```
>GP: BAB05053 GB: AP001511 late competence operon required for DNA
binding and uptake [Bacillus halodurans]
Identities = 78/146 (53%), Positives = 107/146 (72%)

Query:   1 MNRLSWEDYFMANAELISKRSTCDRAFVGAVLVKNNRIIATGYNGGVSETDNCNEVGHYM   60
           MNR+SW+ YFMA + L++ RSTC R  VGA +V++ RIIA GYNG +S   +C + G Y+
Sbjct:   1 MNRISWDQYFMAQSHLLALRSTCTRLMVGATIVRDKRIIAGGYNGSISGGPHCIDEGCYV   60

Query:  61 EDGNCIRTVHAEMNALIQCAKEGISTNNTEIYVTHFPCINCTKALLQAGVKKITYKANYR  120
           +GHCIRT+HAE+NAL+QCAK G+ T    EIYVTHFPC+NCTKA++Q+G+KK+ Y  +Y+
Sbjct:  61 VEGHCIRTIHAEVNALLQCAKFGVPTEGAEIYVTHFPCVNCTKAIIQSGIKKVYYATDYK  120

Query: 121 PHPFAIELMEAKGVAYVQHDVPEVTL                                   146
           P+A EL    GV  Q ++ E+ L
Sbjct: 121 NSPYAEELFRDAGVDVEQVELEEMIL                                   146
```

A related DNA sequence was identified in *S. pyogenes* <SEQ ID 3573> which encodes the amino acid sequence <SEQ ID 3574>. Analysis of this protein sequence reveals the following:

```
Possible site: 30
>>> Seems to have no N-terminal signal sequence

----- Final Results -----
            bacterial cytoplasm --- Certainty = 0.3155(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below.

```
Identities = 133/146 (91%), Positives = 140/146 (95%)

Query:   2 NRLSWEDYFMANAELISKRSTCDRAFVGAVLVKNNRIIATGYNGGVSETDNCNEVGHYME  61
           NRLSW+DYFMANAELISKRSTCDRAFVGAVLVK+NRIIATGYNGGVS TDNCNE GHYME
Sbjct:  18 NRLSWQDYFMANAELISKRSTCDRAFVGAVLVKDNRIIATGYNGGVSATDNCNEAGHYME  77

Query:  62 DGHCIRTVHAEMNALIQCAKEGISTNNTEIYVTHFPCINCTKALLQAGVKKITYKANYRP 121
           DGHCIRTVHAEMNALIQCAKEGIST+ TEIYVTHFPCINCTKALLQAG+ KITYKA+YRP
Sbjct:  78 DGHCIRTVHAEMNALIQCAKEGISTDGTEIYVTHFPCINCTKALLQAGITKITYKAHYRP 137
```

```
                                 -continued
Query: 122 HPFAIELMEAKGVAYVQHDVPEVTLG                             147
           HPFAIELME KGVAYVQHDVP++ LG
Sbjct: 138 HPFAIELMEKKGVAYVQHDVPQIVLG                             163
```

Based on this analysis, it was predicted that these proteins and their epitopes could be useful antigens for vaccines or diagnostics.

EXAMPLE 1152

A DNA sequence (GBSx1228) was identified in *S. agalactiae* <SEQ ID 3575> which encodes the amino acid sequence <SEQ ID 3576>. Analysis of this protein sequence reveals the following:

```
Possible site: 13
>>> Seems to have no N-terminal signal sequence

----- Final Results -----
          bacterial cytoplasm --- Certainty = 0.2454(Affirmative) < succ>
           bacterial membrane --- Certainty = 0.0000(Not Clear)   < succ>
            bacterial outside --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1153

A DNA sequence (GBSx1229) was identified in *S. agalactiae* <SEQ ID 3577> which encodes the amino acid sequence <SEQ ID 3578>. Analysis of this protein sequence reveals the following:

```
Possible site: 25
>>> Seems to have an uncleavable N-term signal seq
    INTEGRAL     Likelihood = -1.65      Transmembrane     4-20 (3-21)

----- Final Results -----
           bacterial membrane --- Certainty = 0.1659(Affirmative) < succ>
            bacterial outside --- Certainty = 0.0000(Not Clear)   < succ>
          bacterial cytoplasm --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1154

A DNA sequence (GBSx1230) was identified in *S. agalactiae* <SEQ ID 3579> which encodes the amino acid sequence <SEQ ID 3580>. Analysis of this protein sequence reveals the following:

```
Possible site: 54
>>> Seems to have an uncleavable N-term signal seq

----- Final Results -----
           bacterial membrane --- Certainty = 0.0000(Not Clear)   < succ>
```

```
            bacterial outside --- Certainty = 0.0000(Not Clear) < succ>
          bacterial cytoplasm --- Certainty = 0.0000(Not Clear) < succ>
```

The protein has homology with the following sequences in the GENPEPT database.

```
>GP: BAB04699 GB: AP001510 unknown conserved protein [Bacillus halodurans]
Identities = 47/94 (50%), Positives = 65/94 (69%)

Query:   2 LLPVGSVVYLIDGNQKLVIVNRGAIVEQEGQEVYFDYLGGIFPEGLNLEQVYYFNQEDID   61
           +LP+GS+VYL +G  KL+I+NRG I+E   G+    FDY G  +P+GL  ++V+YFN E+ID
Sbjct:   1 MLPIGSIVYLKEGTSKLMILNRGPILEANGENKMFDYSGCFYPQGLVPDKVFYFNHENID   60

Query:  62 EVVFEGYHDEEEERVSRLIEKWKNTEGKNLPKGK                             95
           EVVFEG+ D+EE+R  +L   WK        KGK
Sbjct:  61 EVVFEGFQDDEEQRFQKLFHDWKKENKDRYVKGK                             94
```

No corresponding DNA sequence was identified in *S. pyogenes*.

Based on this analysis, it was predicted that this protein and its epitopes, could be useful antigens for vaccines or diagnostics.

EXAMPLE 1155

A DNA sequence (GBSx1231) was identified in *S. agalactiae* <SEQ ID 3581> which encodes the amino acid sequence <SEQ ID 3582>. Analysis of this protein sequence reveals the following:

```
Possible site: 15
>>> Seems to have no N-terminal signal sequence

----- Final Results -----
          bacterial cytoplasm --- Certainty = 0.3560(Affirmative) < succ>
          bacterial membrane  --- Certainty = 0.0000(Not Clear)   < succ>
          bacterial outside   --- Certainty = 0.000(Not Clear)    < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1156

A DNA sequence (GBSx1232) was identified in *S. agalactiae* <SEQ ID 3583> which encodes the amino acid sequence <SEQ ID 3584>. This protein is predicted to be elongation factor p (efp). Analysis of this protein sequence reveals the following:

```
Possible site: 29
>>> Seems to have no N-terminal signal sequence

----- Final Results -----
          bacterial cytoplasm --- Certainty = 0.3067(Affirmative) < succ>
          bacterial membrane  --- Certainty = 0.0000(Not Clear)   < succ>
          bacterial outside   --- Certainty = 0.0000(Not Clear)   < succ>
```

The protein has homology with the following sequences in the GENPEPT database.

```
>GP: CAB14376 GB: Z99116 elongation factor P [Bacillus subtilis]
Identities = 89/186 (47%), Positives = 120/186 (63%), Gaps = 1/186 (0%)

Query:   1 MIEASKLKAGMTFETADGKLIRVLEASHHKPGKGNTIMRMKLRDVRTGSTFDTSYRPEEK    60
           MI +  + G+T +   DG + RV++  H KPGKG    +R KLR++RTG+  + ++R  BK
Sbjct:   1 MISVNDFRTGLTIDV-DGGIWRVVDFQHVKPGKGAAFVRSKLRNLRTGAIQEKTFRAGEK    59

Query:  61 FEQAIIETVPAQYLYKMDDTAYFMNNETYDQYEIPTVNIENELLYILENSEVKIQFYGTE   120
            +A IET   QYLY  D    FM+  +Y+Q E+    IE EL Y+LEN  V I Y  E
Sbjct:  60 VAKAQIETKTMQYLYANGDQHVFMDTSSYEQLELSATQIEEELKYLLENMSVHIMNYQDE   119
```

-continued
```
Query: 121 VIGVQIPTTVELTVAETQPSIKGATVTGSGKPATMETGLVVNVPDFIEAGQKLVINTAEG 180
            +G+++P TVEL V ET+P IKG T +G  KPA  ETGLVVNVP F+  G  LV+NT++G
Sbjct: 120 TLGIELPNTVELKVVETEPGIKGDTASGGTKPAKTETGLVVNVPFFVNEGDTLVVNTSDG 179

Query: 181 TYVSRA                                                    186
            +YVSRA
Sbjct: 180 SYVSRA                                                    185
```

A related DNA sequence was identified in *S. pyogenes* <SEQ ID 3585> which encodes the amino acid sequence <SEQ ID 3586>. Analysis of this protein sequence reveals the following:

```
Possible site: 14
>>> Seems to have no N-terminal signal sequence

----- Final Results -----
             bacterial cytoplasm --- Certainty = 0.1813(Affirmative) < succ>
              bacterial membrane --- Certainty = 0.0000(Not Clear)   < succ>
               bacterial outside --- Certainty = 0.0000(Not Clear)   < succ>
```

An alignment of the GAS and GBS proteins is shown below.

```
Identities = 170/186 (91%), Positives = 180/186 (96%), Gaps = 1/186 (0%)

Query:   1 MIEASKLKAGMTFETADGKLIRVLEASHHKPGKGNTIMRMKLRDVRTGSTFDTSYRPEEK  60
           MIEASKLKAGMTFE A+GKLIRVLEASHHKPGKGNTIMRMKLRDVRTGSTFDT+YRP+EK
Sbjct:   1 MIEASKLKAGMTFE-AEGKLIRVLEASHHKPGKGNTIMRMKLRDVRTGSTFDTTYRPDEK  59

Query:  61 FEQAIIETVPAQYLYKMDDTAYFMNNETYDQYEIPTVNIENELLYILENSEVKIQFYGTE 120
           FEQAIIETVPAQYLYKMDDTAYFMN +TYDQYEIP  N+E ELLYILENS+VKIQFYG E
Sbjct:  60 FEQAIIETVPAQYLYKMDDTAYFMNTDTYDQYEIPVANVEQELLYILENSDVKIQFYGSE 119

Query: 121 VIGVQIPTTVELTVAETQPSIKGATVTGSGKPATMETGLVVNVPDFIEAGQKLVINTAEG 180
           VIGV +PTTVELTVAETQPSIKGATVTGSGKPAT+ETGLVVNVPDFIEAGQKL+INTAEG
Sbjct: 120 VIGVTVPTTVELTVAETQPSIKGATVTGSGKPATLETGLVVNVPDFIEAGQKLIINTAEG 179

Query: 181 TYVSRA                                                    186
           TYVSRA
Sbjct: 180 TYVSRA                                                    185
```

Based on this analysis, it was predicted that these proteins and their epitopes could be useful antigens for vaccines or diagnostics.

EXAMPLE 1157

A DNA sequence (GBSx1233) was identified in *S. agalactiae* <SEQ ID 3587> which encodes the amino acid sequence <SEQ ID 3588>. Analysis of this protein sequence reveals the following:

```
Possible site: 29
>>> Seems to have no N-terminal signal sequence

----- Final Results -----
             bacterial cytoplasm --- Certainty = 0.1508(Affirmative) < succ>
              bacterial membrane --- Certainty = 0.0000(Not Clear)   < succ>
               bacterial outside --- Certainty = 0.0000(Not Clear)   < succ>
```

The protein has homology with the following sequences in the GENPEPT database.

```
>GP: BAB06505 GB: AP001516 unknown conserved protein [Bacillus halodurans]
Identities = 42/107 (39%), Positives = 70/107 (65%), Gaps = 4/107 (3%)

Query:   5 NLGEIVISPRVLEVITGIAATKVDGVHSLRNK---AVTDSLSKKSLGRGVYLKNEEDDTV  61
           +LG + ISP V+EVI GIAA++V+GV ++R       V + L K+ G+GV + +  D+ +
```

```
                                -continued
Sbjct:  15 DLGRVEISPEVIEVIAGIAASEVEGVATMRGNFAAGVAEKLGYKNHGKGVKV-DLNDEGI   73

Query:  62 AADIYVYLQYGVNVPAVSIAIQQAVKTAVYDMAEVKISSVNIHVEGI                  108
           D+ V + YGV+VP V+  IQQ +K A+   M   +++ S+N+H+ G+
Sbjct:  74 IVDVSVIILYGVSVPEVAKKIQQNIKQALQTMTAIELQSINVHIVGV                  120
```

A related DNA sequence was identified in S. pyogenes <SEQ ID 3589> which encodes the amino acid sequence <SEQ ID 3590>. Analysis of this protein sequence reveals the following:

```
Possible site: 41
>>> Seems to have no N-terminal signal sequence

----- Final Results -----
              bacterial cytoplasm --- Certainty = 0.0882(Affirmative) < succ>
               bacterial membrane --- Certainty = 0.0000(Not Clear)   < succ>
                bacterial outside --- Certainty = 0.0000(Not Clear)   < succ>
```

An alignment of the GAS and GBS proteins is shown below.

```
Identities = 101/129 (78%), Positives = 113/129 (87%)

Query:    1 MTTENLGEIVISPRVLEVITGIAATKVDGVHSLRNKAVTDSLSKKSLGRGVYLKNEEDDT    60
            MTTE +GEIVISPRVLEVITGIA T+V+GVHSL NK + DS +K SLG+GVYL+ EED +
Sbjct:    1 MTTEYIGEIVISPRVLEVITGIATTQVEGVHSLHNKKMADSFNKASLGKGVYLQTEEDGS    60

Query:   61 VAADIYVYLQYGVNVPAVSIAIQQAVKTAVYDMAEVKISSVNIHVEGIVPEKTPKPDLKS   120
            V ADIYVYLQYGV VP VS+ IQ+ VK+AVYDMAEV IS+VNIHVEGIV EKTPKPDLKS
Sbjct:   61 VTADIYVYLQYGVKVPTVSMNIQKTVKSAVYDMAEVPISAVNIHVEGIVAEKTPKPDLKS   120

Query:  121 LFDEDFLDD                                                     129
            LFDEDFLDD
Sbjct:  121 LFDEDFLDD                                                     129
```

Based on this analysis, it was predicted that these proteins and their epitopes could be useful antigens for vaccines or diagnostics.

EXAMPLE 1158

A DNA sequence (GBSx1234) was identified in S. agalactiae <SEQ ID 3591> which encodes the amino acid sequence <SEQ ID 3592>. This protein is predicted to be n utilization substance protein b homolog (nusB). Analysis of this protein sequence reveals the following:

```
Possible site: 27
>>> Seems to have no N-terminal signal sequence
      INTEGRAL      Likelihood = -0.32      Transmembrane      48-64 (47-64)

----- Final Results -----
               bacterial membrane --- Certainty = 0.1128(Affirmative) < succ>
                bacterial outside --- Certainty = 0.0000(Not Clear)   < succ>
              bacterial cytoplasm --- Certainty = 0.0000(Not Clear)   < succ>
```

The protein has homology with the following sequences in the GENPEPT database.

```
>GP: CAB14363 GB: Z99116 similar to transcription termination
[Bacillus subtilis]
Identities = 51/129 (39%), Positives = 82/129 (63%), Gaps = 9/129 (6%)

Query:    9 RRDLRERAFQTLFSLETGGEFIDAAHFAYGYDKTVSEDKVLEVPIFLLNLVNGVVDHKDE    68
            RR  RE+A Q LF ++       ++ A      +  + E+K       F    LV+GV++H+D+
Sbjct:    3 RRTAREKALQALFQIDVSDIAVNEA-----IEHALDEEKT---DPFFEQLVHGVLEHQDQ    54

Query:   69 LDTLISSHLKSGWSLERLTLVDKSLLRLGLYEIKYFDETPDRVALNEIIEIAKKYSDETS   128
            LD +IS HL + W L+R+  VD+++LRL   YE+ Y ++ P   V++NE IE+AK++ D+ +
```

```
                               -continued
Sbjct:  55 LDEMISKHLVN-WKLDRIANVDRAILRLAAYEMAYAEDIPVNVSMNEAIELAKRFGDDKA  113

Query:  129 AKFVNGLLS                                                    137
            KFVNG+LS
Sbjct:  114 TKFVNGVLS                                                    122
```

A related DNA sequence was identified in *S. pyogenes* <SEQ ID 3593> which encodes the amino acid sequence <SEQ ID 3594>. Analysis of this protein sequence reveals the following:

```
Possible site: 44
>>> Seems to have no N-terminal signal sequence
      INTEGRAL      Likelihood = -1.75      Transmembrane     53-69 (53-69)

----- Final Results -----
              bacterial membrane --- Certainty = 0.1702(Affirmative) < succ>
                bacterial outside --- Certainty = 0.0000(Not Clear)  < succ>
              bacterial cytoplasm --- Certainty = 0.0000(Not Clear)  < succ>
```

The protein has homology with the following sequences in the databases:

```
>GP: CAB14363 GB: Z99116 similar to transcription termination
[Bacillus subtilis]
Identities = 47/134 (35%), Positives = 76/134 (56%), Gaps = 10/134 (7%)

Query:   15 RRDLRERAFQALFNIEMGAELLAASQFAYGYDKVTGEDAQVLELPIFLLSLVTGVNNHKE   74
            RR   RE+A QALF I++ +++      + D+   +        F    LV GV  H++
Sbjct:    3 RRTAREKALQALFQIDV-SDIAVNEAIEHALDEEKTDP--------FFEQLVHGVLEHQD   53

Query:   75 ELDNLISTHLKKGWSLERLTLTDKTLLRLGLFEIKYFDKTPDRVALNEIIEVVKKYSDET  134
            +LD +IS HL  W L+R+   D+ +LRL  +E+ Y +   P  V++NE IE+ K++ D+
Sbjct:   54 QLDEMISKHLVN-WKLDRIANVDRAILRLAAYEMAYAEDIPVNVSMNEAIELAKRFGDDK  112

Query:  135 SAKFINGLLSQYVS                                                148
            + KF+NG+LS     S
Sbjct:  113 ATKFVNGVLSNIKS                                                126
```

An alignment of the GAS and GBS proteins is shown below.

```
Identities = 104/142 (73%), Positives = 125/142 (87%), Gaps = 1/142 (0%)

Query:    1 MTSVFKDSRRDLRERAFQTLFSLETGGEFIDAAHFAYGYDKTVSED-KVLEVPIFLLNLV   59
            MT+ F++SRRDLRERAFQ LF++E G E + A+ FAYGYDK   ED +VLE+PIFLL+LV
Sbjct:    7 MTNSFQNSRRDLRERAFQALFNIEMGAELLAASQFAYGYDKVTGEDAQVLELPIFLLSLV   66

Query:   60 NGVVDHKDELDTLISSHLKSGWSLERLTLVDKSLLRLGLYEIKYFDETPDRVALNEIIEI  119
              GV +HK+ELD LIS+HLK GWSLERLTL DK+LLRLGL+EIKYFD TPDRVALNEIIE+
Sbjct:   67 TGVNNHKEELDNLISTHLKKGWSLERLTLTDKTLLRLGLFEIKYFDKTPDRVALNEIIEV  126

Query:  120 AKKYSDETSAKFVNGLLSQFIT                                        141
            KKYSDETSAKF+NGLLSQ+++
Sbjct:  127 VKKYSDETSAKFINGLLSQYVS                                        148
```

Based on this analysis, it was predicted that these proteins and their epitopes could be useful antigens for vaccines or diagnostics.

EXAMPLE 1159

A DNA sequence (GBSx1235) was identified in *S. agalactiae* <SEQ ID 3595> which encodes the amino acid sequence <SEQ ID 3596>. Analysis of this protein sequence reveals the following:

```
Possible site: 20
>>> Seems to have a cleavable N-term signal seq.
      INTEGRAL      Likelihood = -2.81      Transmembrane     239-255 (239-255)
```

----- Final Results -----
```
         bacterial membrane --- Certainty = 0.2126(Affirmative) < succ>
         bacterial outside --- Certainty = 0.0000(Not Clear) < succ>
        bacterial cytoplasm --- Certainty = 0.0000(Not Clear) < succ>
```

The protein has homology with the following sequences in the GENPEPT database.

```
>GP: AAC31628 GB: U46902 ScrR [Streptococcus mutans]
Identities = 225/320 (70%), Positives = 273/320 (85%)

Query:   1 MVAKLTDVAALAGVSPTTVSRVINKKGYLSQKTVTKVNEAMRTLGYKPNNLARSLQGKSA   60
           MVAKLTDVA LAGVSPTTVSRVIN+KGYLS+KT+TKV  AM+TLGYKPNNLARSLQGKSA
Sbjct:   1 MVAKLTDVAKLAGVSPTTVSRVINRKGYLSEKTITKVQAAMKTLGYKPNNLARSLQGKSA   60

Query:  61 KLIGLIFPNIRNIFYAELIEHLEIELFKHGYKTILCNSEKDPIKEKEYLEMLGANQVDGI  120
           KLIGLIFPNI +IFY+ELIE+LEIELFKHGYK I+CNS+ +P KE++YLEML ANQVDGI
Sbjct:  61 KLIGLIFPNISHIFYSELIEYLEIELFKHGYKAIICNSQNNPDKERDYLEMLEANQVDGI  120

Query: 121 ISSSHNLGIDDYEKVEAPIVAFDRNLAPHIPIVSSDNFFGGKMAAQTLKKHGCQKMIMIT  180
           ISSSHNLGIDDYEKV API+AFDRNLAP+IPIVSSDNF GG+MAA+ LKKHGCQ  IMI
Sbjct: 121 ISSSHNLGIDDYEKVSAPIIAFDRNLAPNIPIVSSDNFEGGRMAAKLLKKHGCQHPIMIA  180

Query: 181 GNDNSDSPTGLRRLGFSYESKESKVITVTNGLSNMRREMELKSIISTHKPDGIFTSDDLT  240
           G DNS+SPT LR+LGF    ++ +   ++  LS +R+EME+K I+   KPDGIF SDD+T
Sbjct: 181 GKDNSNSPTALRQLGFKSVFAQAPIFHLSGELSIIRKEMEIKVILQNEKPDGIFLSDDMT  240

Query: 241 ALLVIKLISQLGLSIPEDIKVIGYDGTSFIQDYVPHLTTIKQPIREIAQLMVEILLAKIE  300
           A+L +K+ +QL ++IP ++K+IGYDGT F+++Y P+LTTI+QPI++IA L+V+ILL KI+
Sbjct: 241 AILTMKIANQLNITIPHELKIIGYDGTHFVENYYPYLTTIRQPIKDIAHLLVDILLRRID  300

Query: 301 GQKTNKDYILPVSLIPGSSV                                          320
            Q   KDYILPV L+ G SV
Sbjct: 301 HQDIPKDYILPVGLLSGESV                                          320
```

A related DNA sequence was identified in *S. pyogenes* <SEQ ID 3597> which encodes the amino acid sequence <SEQ ID 3598>. Analysis of this protein sequence reveals the following:

```
Possible site: 20
>>> Seems to have a cleavable N-term signal seq.

----- Final Results -----
         bacterial outside --- Certainty = 0.3000(Affirmative) < succ>
         bacterial membrane --- Certainty = 0.0000(Not Clear) < succ>
        bacterial cytoplasm --- Certainty = 0.0000(Not Clear) < succ>
```

The protein has homology with the following sequences in the databases:

```
>GP: AAC31628 GB: U46902 ScrR [Streptococcus mutans]
Identities = 226/321 (70%), Positives = 269/321 (83%), Gaps = 1/321 (0%)

Query:   1 VVAKLTDVAALAGVSPTTVSRVINKKGYLSQKTVNKVNKAMRELGYKPNNLARSLQGKST   60
           +VAKLTDVA LAGVSPTTVSRVIN+KGYLS+KT+ KV  AM+ LGYKPNNLARSLQGKS
Sbjct:   1 MVAKLTDVAKLAGVSPTTVSRVINRKGYLSEKTITKVQAAMKTLGYKPNNLARSLQGKSA   60

Query:  61 QLIGLIFPNISNIFYAELIEHLEIELFKQGYKTIICNSEHNPVKEREYLEMLAANQVDGI  120
           +LIGLIFPNIS+IFY+ELIE+LEIELFK GYK IICNS++NP KER+YLEML ANQVDGI
Sbjct:  61 KLIGLIFPNISHIFYSELIEYLEIELFKHGYKAIICNSQNNPDKERDYLEMLEANQVDGI  120

Query: 121 ISSSHNLGIEDYERVEAPIVAFDRNLAPNIPVISSDNFEGGKLAAQTLQKHGCQNIVMIT  180
           ISSSHNLGI+DYE+V API+AFDRNLAPNIP++SSDNFEGG++AA+ L+KHGCQ+ +MI
Sbjct: 121 ISSSHNLGIDDYEKVSAPIIAFDRNLAPNIPIVSSDNFEGGRMAAKLLKKHGCQHPIMIA  180

Query: 181 GNDNSDSPTGLRQLGFNYQLKRSAEIIKLPNNLSPVRREMEIKSILATRKPDGLFVSDDL  240
           G DNS+SPT LRQLGF    +  A I  L  LS +R+EMEIK IL   KPDG+F+SDD+
Sbjct: 181 GKDNSNSPTALRQLGFK-SVFAQAPIFHLSGELSIIRKEMEIKVILQNEKPDGIFLSDDM  239

Query: 241 TAILIMKVAKQLHITIPEDMKVIGYDGTTFIQQYVPQLATIRQPIDEIAKLSVEILIKKI  300
           TAIL MK+A QL+ITIP ++K+IGYDGT F++ Y P L TIRQPI +IA L V+IL+KKI
```

```
                            -continued
Sbjct:  240 TAILTMKIANQLNITIPHELKIIGYDGTHFVENYYPYLTTIRQPIKDIAHLLVDILLKKI  299

Query:  301 KKEKTSKDYILPITLLPGASI                                        321
              +  KDYILP+ LL G S+
Sbjct:  300 DHQDIPKDYILPVGLLSGESV                                        320
```

An alignment of the GAS and GBS proteins is shown below.

```
Identities = 247/321 (76%), Positives = 293/321 (90%), Gaps = 1/321 (0%)

Query:    1 MVAKLTDVAALAGVSPTTVSRVINKKGYLSQKTVTKVNEAMRTLGYKPNNLARSLQGKSA   60
            +VAKLTDVAALAGVSPTTVSRVINKKGYLSQKTV KVN+AMR LGYKPNNLARSLQGKS
Sbjct:    1 VVAKLTDVAALAGVSPTTVSRVINKKGYLSQKTVNKVNKAMRELGYKPNNLARSLQGKST   60

Query:   61 KLIGLIFPNIRNIFYAELIEHLEIELFKHGYKTILCNSEKDPIKEKEYLEMLGANQVDGI  120
            +LIGLIFPNI NIFYAELIEHLEIELFK GYKTI+CNSE +P+KE+EYLEML ANQVDGI
Sbjct:   61 QLIGLIFPNISNIFYAELIEHLEIELFKQGYKTIICNSEHNPVKEREYLEMLAANQVDGI  120

Query:  121 ISSSHNLGIDDYEKVEAPIVAFDRNLAPHIPIVSSDNFFGGKMAAQTLKKHGCQKMIMIT  180
            ISSSHNLGI+DYE+VEAPIVAFDRNLAP+IP++SSDNF GGK+AAQTL+KHGCQ ++MIT
Sbjct:  121 ISSSHNLGIEDYERVEAPIVAFDRNLAPNIPVISSDNFEGGKLAAQTLQKHGCQNIVMIT  180

Query:  181 GNDNSDSPTGLRRLGFSYESKES-KVITVTNGLSNMRREMELKSIISTHKPDGIFTSDDL  239
            GNDNSDSPTGLR+LGF+Y+ K S ++I + N LS +RREME+KSI++T KPDG+F SDDL
Sbjct:  181 GNDNSDSPTGLRQLGFNYQLKRSAEIIKLPNNLSPVRREMEIKSILATRKPDGLFVSDDL  240

Query:  240 TALLVIKLISQLGLSIPEDIKVIGYDGTSFIQDYVPHLTTIKQPIREIAQLMVEILLAKI  299
            TA+L++K+  QL ++IPED+KVIGYDGT+FIQ YVP L TI+QPI EIA+L VEIL+KI
Sbjct:  241 TAILIMKVAKQLHITIPEDMKVIGYDGTTFIQQYVPQLATIRQPIDEIAKLSVEILIKKI  300

Query:  300 EGQKTNKDYILPVSLIPGSSV                                        320
            + +KT+KDYILP++L+PG+S+
Sbjct:  301 KKEKTSKDYILPITLLPGASI                                        321
```

Based on this analysis, it was predicted that these proteins and their epitopes could be useful antigens for vaccines or diagnostics.

EXAMPLE 1160

A DNA sequence (GBSx1236) was identified in *S. agalactiae* <SEQ ID 3599> which encodes the amino acid sequence <SEQ ID 3600>. This protein is predicted to be sucrose-6-phosphate hydrolase (cscA). Analysis of this protein sequence reveals the following:

```
Possible site: 52
>>> Seems to have no N-terminal signal sequence

----- Final Results -----
           bacterial cytoplasm --- Certainty = 0.4775(Affirmative) < succ>
            bacterial membrane --- Certainty = 0.0000(Not Clear) < succ>
             bacterial outside --- Certainty = 0.0000(Not Clear) < succ>
```

The protein has homology with the following sequences in the GENPEPT database.

```
>GP: CAA35872 GB: X51507 sucrose-6-phosphate
hydrolase [Streptococcus mutans]
Identities = 303/479 (63%), Positives = 359/479 (74%),
Gaps = 25/479 (5%)

Query:    1 MNLPTEIRYRPYDEWTEEDKENIVKNVSKSPWRATYHLEAKTGLLNDPNGFSYFNGKFHL   60
            MNLP  IRYR Y +WTEE+ ++I  NV+ SPW   TYH+E KTGLLNDPNGFSYFNGKF+L
Sbjct:    1 MNLPQNIRYRRYQDWTEEEIKSIKTNVALSPWHTTYHIEPKTGLLNDPNGFSYFNGKFNL   60

Query:   61 FYQNWPFGAAHGLKQWVHTESDDLVHFKETGIKLKPDHVNDSHGAYSGSALAIDDKLFLF  120
            FYQNWPFGAAHGLK W+HTES+DLVHFKETG  L PD +DSHGAYSGSA  I D+LFLF
Sbjct:   61 FYQNWPFGAAHGLKSWIHTESEDLVHFKETGTVLYPDTSHDSHGAYSGSAYEIGDQLFLF  120

Query:  121 YTGNVRDMKWNRDPRQIGAWMTNDGKITKFDKVLISQPNDVTEHFRDPQIFNYDNQFYAV  180
            YTGNVRD  W R P QIGA+M   G I KF  VLI QPNDVTEHFRDPQIFNY  QFYA+
```

```
                          -continued
Sbjct:  121 YTGNVRDENWVRHPLQIGAFMDKKGNIQKFTDVLIKQPNDVTEHFRDPQIFNYKGQFYAI  180

Query:  181 IGAQNSKKCGFIKLYKALNNDIHHWEFVGDLDFGGTSEYMIECPNIIFVKGKPVLLYSP  240
               +GAQ+                      LDFGG+ SEYMIECPN++F+  +PVL+YSP
Sbjct:  181 VGAQS-----------------------LDFGGSKSEYMIECPNLVFINEQPVLIYSP  215

Query:  241 QGLDKNELDYQNIYPNTYKIGQYFDANSSKIVEPSPIYNLDYGFEAYATQGFNTSDGRAF  300
                QGL K+ELDY NIYPNTYK+ Q FD      +V+ S I NLD+GFE YATQ+FN  DGR
Sbjct:  216 QGLSKSELDYHNIYPNTYKVCQSFDTEKPALVDASEIQNLDFGFECYATQAFNAPDGRVY  275

Query:  301 IVSWIGLPDIDYPSDQFDYQGAMSLVKELSIKNGNLYQYPVPAMKNLRQHQAEFKTQLQT  360
                VSWIGLPDIDYPSD +DYQGA+SLVKELS+K+G LYQYPV A+++LR  +     + +T
Sbjct:  276 AVSWIGLPDIDYPSDSYDYQGALSLVKELSLKHGKLYQYPVEAVRSLRSEKEAVTYKPET  335

Query:  361 NNTYELELLVPRNDLSSFVLFANPKGQGLSITIDTVKGKVIIDRSQAGQQYATEFGTSRQ  420
                NNTYELEL   + ++   +LFA+ KG GL+IT+DT   G ++IDRS+AG+QYA EFG+ R
Sbjct:  336 NNTYELELTFDSSSVNELLLFADNKGNGLAITVDTKMGTILIDRSKAGEQYALEFGSQRS  395

Query:  421 CDIPKDATSINIFIDKSIFEIFINKGEKVFTGRVFPDAEQSGIQLKEGHVHGKYFELKY  479
                 C I    T +NIF+DKSIFEIFINKGEKVFTGRVFP+ +Q+GI +K G   G Y+ELKY
Sbjct:  396 CSIQAKETVVNIFVDKSIFEIFINKGEKVFTGRVFPNDKQTGIVIKSGKPSGNYYELKY  454
```

20

A related DNA sequence was identified in *S. pyogenes* <SEQ ID 3601> which encodes the amino acid sequence <SEQ ID 3602>. Analysis of this protein sequence reveals the following:

```
Possible site: 31
>>> Seems to have no N-terminal signal sequence

----- Final Results -----
              bacterial cytoplasm --- Certainty = 0.4629(Affirmative) < succ>
              bacterial membrane  --- Certainty = 0.0000(Not Clear)   < succ>
              bacterial outside   --- Certainty = 0.0000(Not Clear)   < succ>
```

An alignment of the GAS and GBS proteins is shown below.

```
Identities = 288/479 (60%), Positives = 367/479 (76%)

Query:    1 MNLPTEIRYRPYDEWTEEDKENIVKNVSKSPWRATYHLEAKTGLLNDPNGFSYFNGKFHL   60
              M+LP   IRYRPY EW+ +D + I + +++SPW + +H+E KTGLLNDPNGFSYFNG++HL
Sbjct:    2 MDLPQAIRYRPYKEWSSKDYQAITEKMAQSPWHSQFHVEPKTGLLNDPNGFSYFNGRYHL   61

Query:   61 FYQNWPFGAAHGLKQWVHTESDDLVHFKETGIKLKPDHVNDSHGAYSGSALAIDDKLFLF  120
              FYQNWP+GAAHGLKQWVH  S DLVHF ET  +L PDH +DSHGAYSGSA AIDDKLFLF
Sbjct:   62 FYQNWPYGAAHGLKQWVHMTSTDLVHFTETRSRLLPDHAHDSHGAYSGSAYAIDDKLFLF  121

Query:  121 YTGNVRDMKWNRDPRQIGAWMTNDGKITKFDKVLISQPNDVTEHFRDPQIFNYDNQFYAV  180
              YTGNVRD  W R P Q+GAWM   G I+K  +VLI QP+DVTEHFRDPQ+F+Y   QFYA+
Sbjct:  122 YTGNVRDANWVRTPLQVGAWMDKQGNISKIPQVLIEQPDDVTEHFRDPQLFSYQGQFYAI  181

Query:  181 IGAQNSKKCGFIKLYKALNNDIHHWEFVGDLDFGGTSEYMIECPNIIFVKGKPVLLYSP  240
              IGAQ    G IKLYKA++N +  +W F+ DLDF  +G+EYMIECPN++FV  KPVL++SP
Sbjct:  182 IGAQGLDGKGKIKLYKAVDNHVDNWRFIADLDFDDSGTEYMIECPNLVFVDDKPVLIFSP  241

Query:  241 QGLDKNELDYQNIYPNTYKIGQYFDANSSKIVEPSPIYNLDYGFEAYATQGFNTSDGRAF  300
                QGL K +LDYQNIYPNTYKI + F+  + +++      +NLD+GFEAYATQ F++ DGR
Sbjct:  242 QGLAKADLDYQNIYPNTYKIFESFNPETGQLLGGGALQNLDFGFEAYATQAFSSPOGRVL  301

Query:  301 IVSWIGLPDIDYPSDQFDYQGAMSLVKELSIKNGNLYQYPVPAMKNLRQHQAEFKTQLQT  360
              VSWIGLPDIDYP+D++DYQGA+SLVKEL IK+G LYQ PV A++NLR    F  ++  +
Sbjct:  302 AVSWIGLPDIDYPTDRYDYQGALSLVKELRIKDGILYQTPVSALQNLRGPAELFHNKIDS  361

Query:  361 NNTYELELLVPRNDLSSFVLFANPKGQGLSITIDTVKGKVIIDRSQAGQQYATEFGTSRQ  420
              +N YELEL +P        +LFA+ KG GL + +DT KG++ IDRS+AG YA ++GT R
Sbjct:  362 SNCYELELTIPGQKKLDLLLFADQKGNGLRLKVDTTKGQLSIDRSRAGVQYAQDYGTVRS  421

Query:  421 CDIPKDATSINIFIDKSIFEIFINKGEKVFTGRVFPDAEQSGIQLKEGHVHGKYFELKY  479
                C IP+  ++N+++D SI EIFIN+G+KV T RVFP   Q+GIQ+  EG   G Y+E++Y
Sbjct:  422 CQIPQGHVTLNVYVDNSILEIFINQGQKVLTSRVFPTHGQTGIQVVEGQAFGHYYEMRY  480
```

Based on this analysis, it was predicted that these proteins and their epitopes could be useful antigens for vaccines or diagnostics.

EXAMPLE 1161

A DNA sequence (GBSx1237) was identified in *S. agalactiae* <SEQ ID 3603> which encodes the amino acid sequence <SEQ ID 3604>. Analysis of this protein sequence reveals the following:

```
Possible site: 14
>>> Seems to have no N-terminal signal sequence

----- Final Results -----
         bacterial cytoplasm --- Certainty = 0.2204(Affirmative) < succ>
         bacterial membrane  --- Certainty = 0.0000(Not Clear)   < succ>
         bacterial outside   --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1162

A DNA sequence (GBSx1238) was identified in *S. agalactiae* <SEQ ID 3605> which encodes the amino acid sequence <SEQ ID 3606>. Analysis of this protein sequence reveals the following:

```
Possible site: 27
>>> Seems to have no N-terminal signal sequence
    INTEGRAL    Likelihood = -7.64    Transmembrane    259-275  (250-283)
    INTEGRAL    Likelihood = -4.41    Transmembrane    113-129  (109-130)
    INTEGRAL    Likelihood = -3.03    Transmembrane    180-196  (180-196)
    INTEGRAL    Likelihood = -3.03    Transmembrane    439-455  (438-456)
    INTEGRAL    Likelihood = -2.81    Transmembrane    298-314  (298-317)
    INTEGRAL    Likelihood = -2.02    Transmembrane    396-412  (395-412)

----- Final Results -----
         bacterial membrane  --- Certainty = 0.4057(Affirmative) < succ>
         bacterial outside   --- Certainty = 0.0000(Not Clear)   < succ>
         bacterial cytoplasm --- Certainty = 0.0000(Not Clear)   < succ>
```

The protein has homology with the following sequences in the GENPEPT database.

```
>GP: AAC99320 GB: AF059741 sucrose-specific PTS permease
[Clostridium beijerinckii]
Identities = 235/453 (51%), Positives = 312/453 (67%), Gaps = 15/453 (3%)

Query:   7 IAKQVINAIGGASNVRSVAHCATRLRVMVKDETVIDKNTVENIEKVQGAFFNSGQYQIIF  66
           +AK+++  IGG  N++SV HCATRLR+++ D+  I++  +ENI+ V+G FF++ QYQII
Sbjct:   6 VAKEILENIGGKENIKSVEHCATRLRLILNDKEKINEKAIENIDGVKGQFFSAAQYQIIL  65

Query:  67 GTGTVNKIYDEVVAQGLPTSSTSDQKAEAAKQGNAFQRAIRTFGDVFVPLLPAIVATGLF 126
             GTG VN++YD +V Q    T + K EA  Q   Q+  RTFGDVFVP++P +VATGLF
Sbjct:  66 GTGFVNEVYDVIVGQNSDLV-TGNNKEEAYSQMTLIQKISRTFGDVFVPIIPVLVATGLF 124

Query: 127 MGIRGAINNDTVLALFGTTSKAFSSSNFYTYTVVLTDTAFAFFPALISWSAFRVFGGNPV 186
           MG+RG + N V          + NF  +T VLTDTAFAF PAL++WS  + FGG PV
Sbjct: 125 MGLRGLLTNLGVQM---------NENFVLFTQVLTDTAFAFLPALVAWSTMKKFGGTPV 174

Query: 187 IGLVLGLMMVNSALPNAWAVASGDAHPIKF--FGF-IPVVGYQNSVLPAFFVGLLGAKLE 243
           IG+V+GLM+V+ +LPNA+AVA+G A PI     G  IPVVGYQ SVLPA  +G++ AK +
Sbjct: 175 IGIVIGLMLVSPSLPNAYAVAAGTATPINLTILGLNIPVVGYQGSVLPALVLGIIAAKTQ 234

Query: 244 KWLHKKIPDVLDLLLVPFLTFTVMSILALFVIGPIFHSVENYVLAGTKFVLNLPLGLSGL 303
```

```
                 K L K +PDVLDL++ PF+T          +L L ++GPI H+ E  +     K  + LP GL GL
Sbjct:  235 KALKKVVPDVLDLIVTPFITLLFSMVLGLLIVGPIMHNAEQLIFGAIKGFMGLPFGLGGL  294

Query:  304 ILGGVHQIIVVTGVHHIFNLLEAQLIAADGKDPFNAIITAAMTAQAGATLAVGVKTKNKK  363
            ++GGVHQ+IVVTGVHH  N LE +L+++ GKD FNA+IT  + AQ   A LAV VKTK+KK
Sbjct:  295 VVGGVHQLIVVTGVHHALNALEVELLSSTGKDAFNAMITCGIVAQGAAALAVAVKTKDKK  354

Query:  364 LKALAFPAALSAGLGITEPAIFGVNLRFGKPFIMGLIAGAAGGWLASILKLAGTGFGITI  423
             ++L   +A+ A LGITEPAIFGVNLRF KPFI G   GA GG L+ IL LAGTG GIT
Sbjct:  355 KRSLYISSAIPAFLGITEPAIFGVNLRFIKPFIFGCAGGAVGGMLSGILHLAGTGMGITA  414

Query:  424 IPGTLLYLNGQIVKYLIMVIGTTSLAFVLTYMF                             456
            +PG LLY+N   +  Y+++ +   ++AF LT  F
Sbjct:  415 LPGMLLYVN-NLGSYILVNVVAIAVAFCLTLFF                             446
```

A related DNA sequence was identified in *S. pyogenes* <SEQ ID 3607> which encodes the amino acid sequence <SEQ ID 3608>. Analysis of this protein sequence reveals the following:

```
Possible site: 26
>>> Seems to have no N-terminal signal sequence
    INTEGRAL      Likelihood = -4.99     Transmembrane     111-127 (108-129)
    INTEGRAL      Likelihood = -4.57     Transmembrane     176-192 (176-193)
    INTEGRAL      Likelihood = -4.35     Transmembrane     436-452 (431-453)
    INTEGRAL      Likelihood = -3.88     Transmembrane     295-311 (293-314)
    INTEGRAL      Likelihood = -3.50     Transmembrane     259-275 (253-277)
    INTEGRAL      Likelihood = -2.07     Transmembrane     405-421 (405-421)
    INTEGRAL      Likelihood = -0.43     Transmembrane     219-235 (219-235)

----- Final Results -----
               bacterial membrane  --- Certainty = 0.2996(Affirmative) < succ>
                bacterial outside  --- Certainty = 0.0000(Not Clear)   < succ>
              bacterial cytoplasm  --- Certainty = 0.0000(Not Clear)   < succ>
```

The protein has homology with the following sequences in the databases:

```
>GP: AAC99320 GB: AF059741 sucrose-specific PTS permease [Clostridium
beijerinckii]
Identities = 234/451 (51%), Positives = 312/451 (68%), Gaps = 11/451 (2%)

Query:    1 MDNRQIAAEVIEALGGRENVRSVAHCATRLRVMVYDEGKIDKEKAEAIDKVKGAFFNSGQ  60
            M  + +A E++E +GG+EN++SV HCATRLR+++ D+ KI+++  E ID VKG FF++ Q
Sbjct:    1 MKEQIVAKEILENIGGKENIKSVEHCATRLRLILNDKEKINEKAIENIDGVKGQFFSAAQ  60

Query:   61 YQMIFGTGTVNNIYDEVVALGLPTSSTSEQKAEAGKHGNIFQRAIRTFGDVFVPIIPAIV  120
            YQ+I GTG VN +YD+V       T   K EA    + Q+  RTFGDVFVPIIP +V
Sbjct:   61 YQIILGTGFVNEVYDVIVGQNSDLV-TGNNKEEAYSQMTLIQKISRTFGDVFVPIIPVLV  119

Query:  121 ATGLFMGVRGLVTQPAIMDLFGVHEYGENFLMYTRILTDTAFVYLPALVAWSAFRVFGGN  180
            ATGLFMG+RGL+T +        + ENF+++T++LTDTAF +LPALVAWS   + FGG
Sbjct:  120 ATGLFMGLRGLLTNLGV-------QMNENFVLFTQVLTDTAFAFLPALVAWSTMKKFGGT  172

Query:  181 PIIGIVLGLMLVSNELPNAWVVASGGDVK-PLTFFGF-VPVVGYQGTVLPAFFVGLVGAK  238
            P+IGIV+GLMLVS  LPNA+ VA+G     LT  G  +PVVGYQG+VLPA  +G++ AK
Sbjct:  173 PVIGIVIGLMLVSPSLPNAYAVAAGTATPINLTILGLNIPVVGYQGSVLPALVLGIIAAK  232

Query:  239 LEKWLHKKVPEALDLLVTPFLTFAIMSTLGLFVIGPVFHSLENLVLAGTQAVLHLPFGIA  298
             +K L K VP+ LDL+VTPF+T     LGL ++GP+ H+ E L+     +   + LPFG+
Sbjct:  233 TQKALKKVVPDVLDLIVTPFITLLFSMVLGLLIVGPIMHNAEQLIFGAIKGFMGLPFGLG  292

Query:  299 GLIVGGIQQLIVVTGIHHIFNFLEAQLIANTGKDPFNAYLTAATAAQAGATLAVAVKTKS  358
            GL+VGG+ QLIVVTG+HH  N LE +L+++TGKD FNA +T   AQ   A LAVAVKTK
Sbjct:  293 GLVVGGVHQLIVVTGVHHALNALEVELLSSTGKDAFNAMITCGIVAQGAAALAVAVKTKD  352

Query:  359 TKLKGLAFPSTLSALLGITEPAIFGVNLRYPKVFVSGLIGGALGGWVAGLFGIAGTGFGI  418
              K + L   S + A LGITEPAIFGVNLR+ K F+ G  GGA+GG ++G+  +AGTG GI
Sbjct:  353 KKKRSLYISSAIPAFLGITEPAIFGVNLRFIKPFIFGCAGGAVGGMLSGILHLAGTGMGI  412

Query:  419 TVLPGTLLYLNGQLLQYLVTMLVGLGVAFAI                              449
            T LPG LLY+N   L  Y+++ +V + VAF +
Sbjct:  413 TALPGMLLYVN-NLGSYILVNVVAIAVAFCL                              442
```

An alignment of the GAS and GBS proteins is shown below.

```
Identities = 409/618 (66%), Positives = 491/618 (79%), Gaps = 12/618 (1%)

Query:    4 NTEIAKQVINAIGGASNVRSVAHCATRLRVMVKDETVIDKNTVENIEKVQGAFFNSGQYQ   63
            N +IA +VI A+GG  NVRSVAHCATRLRVMV DE  IDK    E I+KV+GAFFNSGQYQ
Sbjct:    3 NRQIAAEVIEALGGRENVRSVAHCATRLRVMVYDEGKIDKEKAEAIDKVKGAFFNSGQYQ   62

Query:   64 IIFGTGTVNKIYDEVVAQGLPTSSTSDQKAEAAKQGNAFQRAIRTFGDVFVPLLPAIVAT  123
            +IFGTGTVN IYDEVVA GLPTSSTS+QKAEA K GN FQRAIRTFGDVFVP++PAIVAT
Sbjct:   63 MIFGTGTVNNIYDEVVALGLPTSSTSEQKAEAGKHGNIFQRAIRTFGDVFVPIIPAIVAT  122

Query:  124 GLFMGIRGAINNDTVLALFGTTSKAFSSSNFYTYTVVLTDTAFAFFPALISWSAFRVFGG  183
            GLFMG+RG +    ++ LFG       NF  YT +LTDTAF + PAL++WSAFRVFGG
Sbjct:  123 GLFMGVRGLVTQPAIMDLFGVHEYG---ENFLMYTRILTDTAFVYLPALVAWSAFRVFGG  179

Query:  184 NPVIGLVLGLMMVNSALPNAWAVASG-DAHPIKFFGFIPVVGYQNSVLPAFFVGLLGAKL  242
            NP+IG+VLGLM+V++ LPNAW VASG D  P+ FFGF+PVVGYQ +VLPAFFVGL+GAKL
Sbjct:  180 NPIIGIVLGLMLVSNELPNAWVVASGGDVKPLTFFGFVPVVGYQGTVLPAFFVGLVGAKL  239

Query:  243 EKWLHKKIPDVLDLLLVPFLTFTVMSILALFVIGPIFHSVENYVLAGTKFVLNLPLGLSG  302
            EKWLHKK+P+ LDLL+ PFLTF +MS L LFVIGP+FHS+EN VLAGT+ VL+LP G++G
Sbjct:  240 EKWLHKKVPEALDLLVTPFLTFAIMSTLGLFVIGPVFHSLENLVLAGTQAVLHLPFGIAG  299

Query:  303 LILGGVHQIIVVTGVHHIFNLLEAQLIAADGKDPFNAIITAAMTAQAGATLAVGVKTKNK  362
            LI+GG+ Q+IVVTG+HHIFN LEAQLIA  GKDPFNA +TAA  AQAGATLAV VKTK+
Sbjct:  300 LIVGGIQQLIVVTGIHHIFNFLEAQLIANTGKDPFNAYLTAATAAQAGATLAVAVKTKST  359

Query:  363 KLKALAFPAALSAGLGITEPAIFGVNLRFGKPFIMGLIAGAAGGWLASILKLAGTGFGIT  422
            KLK LAFP+ LSA LGITEPAIFGVNLR+ K F+ GLI GA GGW+A +   +AGTGFGIT
Sbjct:  360 KLKGLAFPSTLSALLGITEPAIFGVNLRYPKVFVSGLIGGALGGWVAGLFGIAGTGFGIT  419

Query:  423 IIPGTLLYLNGQIVKYLIMVIGTTSLAFVLTYMFGYEDKDEKAVAEVSPLVEETDDDPTI  482
            ++PGTLLYLNGQ+++YL+ ++     +AF + Y +GY+D++   +    V  V++T D P +
Sbjct:  420 VLPGTLLYLNGQLLQYLVTMLVGLGVAFAIAYTWGYQDRETLPLPAVE--VDQTADQPAL  477

Query:  483 TQTSQLRAETIVSPLDGQVIALDTVSDPVFSSGIMGDGLAIKPRGNTIYSPVDGFVQIAF  542
              +      ET+ SPL+G V+ L  VSDPVFSSG MG GLAIKP  NT+YSPVDG V+I F
Sbjct:  478 AE------ETLYSPLNGTVVDLSAVSDPVFSSGAMGQGLAIKPEDNTLYSPVDGKVEIVF  531

Query:  543 ETGHAYGIKSDKGAEILIHIGIDTVTMNGTGFTSKVKADQKVKKGDILGTFDSAKIAEAG  602
            ETGHAY I S +GAE+L+HIGIDT +M G GF S V   Q VKKGD+LG FD +KIAEAG
Sbjct:  532 ETGHAYAITSSQGAEVLLHIGIDTESMAGDGFESLVAVGQAVKKGDLLGHFDPSKIAEAG  591

Query:  603 LDNTAMIIVTNTADFADV                                           620
            LD+T M+IV+N AD+  V
Sbjct:  592 LDDTTMMIVSNIADYQSV                                           609
```

Based on this analysis, it was predicted that these proteins and their epitopes could be useful antigens for vaccines or diagnostics.

EXAMPLE 1163

A DNA sequence (GBSx1239) was identified in *S. agalactiae* <SEQ ID 3609> which encodes the amino acid sequence <SEQ ID 3610>. This protein is predicted to be fructokinase. Analysis of this protein sequence reveals the following:

```
Possible site: 18
>>> Seems to have no N-terminal signal sequence

----- Final Results -----
         bacterial cytoplasm --- Certainty = 0.2436(Affirmative) < succ>
         bacterial membrane --- Certainty = 0.0000(Not Clear) < succ>
           bacterial outside --- Certainty = 0.0000(Not Clear) < succ>
```

The protein has homology with the following sequences in the GENPEPT database.

```
>GP: BAA02467 GB: D13175 fructokinase [Streptococcus mutans]
Identities = 232/291 (79%), Positives = 257/291 (87%)

Query:   1 MTKLYGSIEAGGTKFVCAVGDEELKVVEKMQFPTTTPQETIKKTVDFFKRFEKKLEAVAI   60
           M+KLYGSIEAGGTKFVCAVGDE   +++EK+QFPTTTP ETI+KTV FFK+FE  L +VAI
Sbjct:   1 MSKLYGSIEAGGTKFVCAVGDENFQILEKVQFPTTTPYETIEKTVAFFKKFEADLASVAI   60
```

```
                        -continued
Query:   61 GSFGPIDIDKKSKTYGYITTTPKLHWANVDLLGLISKDFNVPFYFTTDVNSSAYGEVIAR  120
            GSFGPIDID+ S TYGYIT+TPK +WANVD +GLISKDF +PFYFTTDVNSSAYGE IAR
Sbjct:   61 GSFGPIDIDQNSDTYGYITSTPKPNWANVDFVGLISKDFKIPFYFTTDVNSSAYGETIAR  120

Query:  121 NNIDSLVYYTIGTGIGAGAIQKGEFIGGTGHTEAGHTYMAMHPQDQANDFKGICPFHNSC  180
               +N+ SLVYYTIGTGIGAGAIQ GEFIGG GHTEAGH YMA HP D  + F G CPFH  C
Sbjct:  121 SNVKSLVYYTIGTGIGAGAIQNGEFIGGMGHTEAGHVYMAPHPNDVHHGFVGTCPFHKGC  180

Query:  181 LEGLASGPTLEARTGIRGELIEENSMVWDVQAYYIAQAAIQATVLYRPQVIVFGGGVMAQ  240
               LEGLA+GP+LEARTGIRGELIE+NS VWD+QAYYIAQAAIQATVLYRPQVIVFGGGVMAQ
Sbjct:  181 LEGLAAGPSLEARTGIRGELIEQNSEVWDIQAYYIAQAAIQATVLYRPQVIVFGGGVMAQ  240

Query:  241 EHMLRRVRQTFATLLNGYLPVPDLSDYIVTPAIEENGSATLGNFALAKKIS           291
               EHML RVR+ F +LLN YLPVPD+ DYIVTPA+ ENGSATLGN ALAKKI+
Sbjct:  241 EHMLNRVREKFTSLLNDYLPVPDVKDYIVTPAVAENGSATLGNLALAKKIA           291
```

A related DNA sequence was identified in *S. pyogenes* <SEQ ID 3611> which encodes the amino acid sequence <SEQ ID 3612>. Analysis of this protein sequence reveals the following:

```
Possible site: 52
>>> Seems to have no N-terminal signal sequence

----- Final Results -----
           bacterial cytoplasm --- Certainty = 0.2012(Affirmative) < succ>
           bacterial membrane  --- Certainty = 0.0000(Not Clear)   < succ>
             bacterial outside --- Certainty = 0.0000(Not Clear)   < succ>
```

An alignment of the GAS and GBS proteins is shown below.

```
Identities = 212/293 (72%), Positives = 246/293 (83%)

Query:    1 MTKLYGSIEAGGTKFVCAVGDEELKVVEKMQFPTTTPQETIKKTVDFFKRFEKKLEAVAI   60
            M KLYGSIEAGGTKFVCAVGDEE  VV+K QFPTTTP+ETI +T+ +FK FE    L +AI
Sbjct:    1 MGKLYGSIEAGGTKFVCAVGDEEFTVVDKTQFPTTTPEETIARTIAYFKAFEADLAGMAI   60

Query:   61 GSFGPIDIDKKSKTYGYITTTPKLHWANVDLLGLISKDFNVPFYFTTDVNSSAYGEVIAR  120
            GSFGPIDID   S+TYGYITTTPK  WANVDLLG +S   F  +PF  TTDVNSSAYGEV+AR
Sbjct:   61 GSFGPIDIDPSSETYGYITTTPKSGWANVDLLGQLSAAFKIPFDVTTDVNSSAYGEVLAR  120

Query:  121 NNIDSLVYYTIGTGIGAGAIQKGEFIGGTGHTEAGHTYMAMHPQDQANDFKGICPFHNSC  180
              ++SLVYYTIGTGIGAGAIQ G FIGG GHTEAGHTY+  HP D A  F G+CPFH  C
Sbjct:  121 PGVESLVYYTIGTGIGAGAIQHGHFIGGLGHTEAGHTYVMPHPDDMAKGFLGVCPFHKGC  180

Query:  181 LEGLASGPTLEARTGIRGELIEENSMVWDVQAYYIAQAAIQATVLYRPQVIVFGGGVMAQ  240
               LEG+A+GP++EARTG+RGE +++  + VWD+QA+YIAQAA+QATM+LYRPQVIVFGGGVMAQ
Sbjct:  181 LEGMAAGPSIEARTGVRGERLDQEADVWDIQAFYIAQAALQATMLYRPQVIVFGGGVMAQ  240

Query:  241 EHMLRRVRQTFATLLNGYLPVPDLSDYIVTPAIEENGSATLGNFALAKKISKG         293
               EHM+ RV   F   LL+GYLPVPDL+DYIVTPA+ +NGSATLGNFALAK  ++G
Sbjct:  241 EHMVLRVHDKFTALLSGYLPVPDLTDYIVTPAVADNGSATLGNFALAKLAAQG         293
```

Based on this analysis, it was predicted that these proteins and their epitopes could be useful antigens for vaccines or diagnostics.

EXAMPLE 1164

A DNA sequence (GBSx1240) was identified in *S. agalactiae* <SEQ ID 3613> which encodes the amino acid sequence <SEQ ID 3614>. This protein is predicted to be Mannose-phosphate Isomerase (pmi). Analysis of this protein sequence reveals the following:

```
Possible site: 50
>>> Seems to have no N-terminal signal sequence

----- Final Results -----
           bacterial cytoplasm --- Certainty = 0.4717(Affirmative) < succ>
           bacterial membrane  --- Certainty = 0.0000(Not Clear)   < succ>
             bacterial outside --- Certainty = 0.0000(Not Clear)   < succ>
```

The protein has homology with the following sequences in the GENPEPT database.

```
>GP: BAA04021 GB: D16594 Mannosephosphate Isomerase
[Streptococcus mutans]
Identities = 232/312 (74%), Positives = 262/312 (83%)

Query:    1 MSEPLFLEASMHDKIWGGTKLRDEFGYDIPSETTGEYWAISAHPNGVSRVKNGRFKGCFL   60
            M  PLFL++ MH KIWGG +LR EFGYDIPSETTGEYWAISAHPNGVS VKNG +KG  L
Sbjct:    1 MEGPLFLQSQMHKKIWGGNRLRKEFGYDIPSETTGEYWAISAHPNGVSVVKNGVYKGVPL   60

Query:   61 DKLYQGEKSLFGNPDDTVFPLLTKILDANDWLSVQVHPDDAYALKHEGELGKTECWYIIS  120
            D+LY +  + LFGN    +VFPLLTKILDANDWLSVQVHPD+AYAL+HEGELGKTECWY+IS
Sbjct:   61 DELYAEHRELFGNSKSSVFPLLTKILDANDWLSVQVHPDNAYALEHEGELGKTECWYVIS  120

Query:  121 ADEGSEIIYGHNAKTKEELRQMIESGDWEHLLTRIPVKSGDFYYVPSGTMHAIGKGILIL  180
            ADEG+EIIYGH AK+KEELRQMI +GDW+HLLT+IPVK+GDF+YVPSGTMHAIG+GI+IL
Sbjct:  121 ADEGAEIIYGHEAKSKEELRQMIAAGDWDHLLTKIPVKAGDFFYVPSGTMHAIGRGIMIL  180

Query:  181 ETQQSSDTTYRVYDFDRPDASGKLRDLHIEQSIDVLTIGKPANTVPANMKLKHLSSTLLV  240
            ETQQSSDTTYRVYDFDR  G+ R LHIEQSIDVLTIGKPAN  PA + L+  L +T+LV
Sbjct:  181 ETQQSSDTTYRVYDFDRKDDQGRKRALHIEQSIDVLTIGKPANATPAWLSLQGLETTVLV  240

Query:  241 SNDFFTVYKWEISGVTNFKQFAPYLLVSVLDGAGHITVDNKVYTLKKGDHFILPNDVVKW  300
            S+ FFTVYKW+ISG    +Q APYLLVSVL G G ITV  + Y L+KGDH ILPN +  W
Sbjct:  241 SSPFFTVYKWQISGSVKMQQTAPYLLVSVLAGQGRITVGLEQYALRKGDHLILPNTIKSW  300

Query:  301 DIDGQLEIIASH                                                 312
             DG LEIIASH
Sbjct:  301 QFDGDLEIIASH                                                 312
```

A related DNA sequence was identified in *S. pyogenes* <SEQ ID 3615> which encodes the amino acid sequence <SEQ ID 3616>. Analysis of this protein sequence reveals the following:

```
Possible site: 53
>>> Seems to have no N-terminal signal sequence

----- Final Results -----
           bacterial cytoplasm --- Certainty = 0.3714(Affirmative) < succ>
            bacterial membrane --- Certainty = 0.0000(Not Clear)   < succ>
             bacterial outside --- Certainty = 0.0000(Not Clear)   < succ>
```

An alignment of the GAS and GBS proteins is shown below.

```
Identities = 232/312 (74%), Positives = 264/312 (84%)

Query:    1 MSEPLFLEASMHDKIWGGTKLRDEFGYDIPSETTGEYWAISAHPNGVSRVKNGRFKGCFL   60
            MSEPLFL+++MHD+IWGGTKLRD  F Y+IPS+TTGEYWAISAHPNGVS V NGR++G  L
Sbjct:    1 MSEPLFLKSTMHDRIWGGTKLRDVFAYNIPSDTTGEYWAISAHPNGVSTVTNGRYQGQPL   60

Query:   61 DKLYQGEKSLFGNPDDTVFPLLTKILDANDWLSVQVHPDDAYALKHEGELGKTECWYIIS  120
            + LY  E +LFGNP + VFPLLTKILDANDWLSVQVHPDDAY  +HEGELGKTECWYIIS
Sbjct:   61 NTLYAQEPALFGNPKEEVFPLLTKILDANDWLSVQVHPDDAYGREHEGELGKTECWYIIS  120

Query:  121 ADEGSEIIYGHNAKTKEELRQMIESGDWEHLLTRIPVKSGDFYYVPSGTMHAIGKGILIL  180
            A+EGSEI+YGH AK+KE+LR MIE+G W+ LLTR+PVK+GDF+YVPSGTMHAIGKGILIL
Sbjct:  121 AEEGSEIVYGHQAKSKEDLRAMIEAGAWDDLLTRVPVKAGDFFYVPSGTMHAIGKGILIL  180

Query:  181 ETQQSSDTTYRVYDFDRPDASGKLRDLHIEQSIDVLTIGKPANTVPANMKLKHLSSTLLV  240
            ETQQSSDTTYRVYDFDR D +G LRDLHIE+SIDVLTIGKP N+VPA M L ++ +T LV
Sbjct:  181 ETQQSSDTTYRVYDFDRKDVNGNLRDLHIEKSIDVLTIGKPENSVPATMVLDNMVATTLV  240

Query:  241 SNDFFTVYKWEISGVTNFKQFAPYLLVSVLDGAGHITVDNKVYTLKKGDHFILPNDVVKW  300
            S  FFTVYKW  S + + KQ APYLLVSVL G G + VD K Y L+KG HFILPNDV  W
Sbjct:  241 STPFFTVYKWVTSQMVDMKQAAPYLLVSVLKGQGKLYVDQKAYELEKGMHFILPNDVKSW  300

Query:  301 DIDGQLEIIASH                                                 312
             DGQLE+I SH
Sbjct:  301 SFDGQLEMIVSH                                                 312
```

Based on this analysis, it was predicted that these proteins and their epitopes could be useful antigens for vaccines or diagnostics.

EXAMPLE 1165

A DNA sequence (GBSx1241) was identified in *S. agalactiae* <SEQ ID 3617> which encodes the amino acid sequence <SEQ ID 3618>. This protein is predicted to be preprotein translocase seca subunit (secA). Analysis of this protein sequence reveals the following:

```
Possible site: 53
>>> Seems to have no N-terminal signal sequence

----- Final Results -----
            bacterial cytoplasm --- Certainty = 0.1102(Affirmative) < succ>
             bacterial membrane --- Certainty = 0.0000(Not Clear)   < succ>
              bacterial outside --- Certainty = 0.0000(Not Clear)   < succ>
```

A related GBS nucleic acid sequence <SEQ ID 10107> which encodes amino acid sequence <SEQ ID 10108> was also identified.

The protein has homology with the following sequences in the GENPEPT database.

```
>GP: AAA50286 GB: L32090 secA [Listerie monocytogenes]
Identities = 503/843 (59%), Positives = 643/843 (75%), Gaps = 16/843 (1%)

Query:   11 MANILRTVIENDKGELKKLDKIAKKVDSYADHMAALSDEALQAKTPEFKERYQNGETLDQ   70
            MA +L+ + E+ K ++K L++ A ++ + AD  AALSD+AL+ KT EFKER Q GETLD
Sbjct:    1 MAGLLKKIFESGKKDVKYLERKADEIIALADETAALSDDALREKTVEFKERVQKGETLDD   60

Query:   71 LLPEAFAVVREASKRVLGLYPYHVQIMGGIVLHHGDIPEMRTGEGKTLTATMPVYLNAIS  130
            LL EAFAV RE +KR LGLYP+ VQ+MGGIVLH  +I EM TGEGKTLTAT+PVYLNA+S
Sbjct:   61 LLVEAFAVAREGAKRALGLYPFKVQLMGGIVLHEDNIAEMKTGEGKTLTATLPVYLNALS  120

Query:  131 GLGVHVITVNEYLSTRDATEMGEVYSWLGLSVGINLAAKSPFEKREAYNCDITYSTNAEV  190
            G GVHV+TVNEYL+ RDA EMG +Y++LGLSVG+NL A S  EKREAY CDITYSTN E+
Sbjct:  121 GEGVHVVTVNEYLAHRDAEEMGVLYNFLGLSVGLNLNALSSTEKREAYACDITYSTNNEL  180

Query:  191 GFDYLRDNMVVRQEDMVQRPLNYALVDEVDSVLIDEARTPLIVSGPVSSEMNQLYTRADM  250
            GFDYLRDNMVV +E+MVQRPL +A++DEVDS+L+DEARTPLI+SG  + +   LY RA+
Sbjct:  181 GFDYLRDNMVVYKEEMVQRPLAFAVIDEVDSILVDEARTPLIISGE-AEKSTILYVRANT  239

Query:  251 FVKTL-NSDDYIIDVPTKTIGLSDTGIDKAENYFHLNNLYDLENVALTHYIDNALRANYI  309
            FV+TL   +DY +D+ TK++ L++ G+ K  ENYF + NL+DLEN  + H+I  AL+ANY
Sbjct:  240 FVRTLTEEEDYTVDIKTKSVQLTEDGMTKGENYFDVENLFDLENTVILHHIAQALKANYT  299

Query:  310 MLLNIDYVVSEEQEILIVDQFTGRTMEGRRFSDGLHQAIEAKESVPIQEESKTSASITYQ  369
            M L++DYVV ++ E+LIVDQFTGR M+GRRFS+GLHQA+EAKE V IQ ESKT A+IT+Q
Sbjct:  300 MSLDVDYVV-QDDEVLIVDQFTGRIMKGRRFSEGLHQALEAKEGVTIQNESKTMATITFQ  358

Query:  370 NMFRMYHKLAGMTGTGKTEEEEFREIYNMRVIPIPTNRPVQRIDHSDLLYPTLDSKFRAV  429
            N FRMY KLAGMTGT KTEEEEFR+IYNMRVI IPTN+ + R D  DL+Y T+++KF AV
Sbjct:  359 NYFRMYKKLAGMTGTAKTEEEEFRDIYNMRVIEIPTNKVIIRDDRPDLIYTTMEAKFNAV  418

Query:  430 VADVKERYEQGQPVLVGTVAVETSDLISRKLVAAGVPHEVLNAKNHFKEAQIIMNAGQRG  489
            V D+ ER+ +GQPVLVGTVA+   +LIS KL  G+ H+VLNAK H +EA II +AG+RG
Sbjct:  419 VEDIAERHAKGQPVLVGTVAMNI-ELISSKLKRKGIKHDVLNAKQHEREADIIKHAGERG  477

Query:  490 AVTIATNMAGRGTDIKLGEGVRELGGLCVIGTERHESRRIDNQLRGRSGRQGDPGESQFY  549
            AV IATNMAGRGTDIKLGEG  E GGL VIGTERHESRRIDNQLRGRSGRQGDPG +QFY
Sbjct:  478 AVVIATNMAGRGTDIKLGEGTIEAGGLAVIGTERHESRRIDNQLRGRSGRQGDPGVTQFY  537

Query:  550 LSLEDDLMRRFGTDRIKVVLERMNLAEDDTVIKSKMLTRQVESAQRRVEGNNYDTRKQVL  609
            LS+ED+LMRRFG+D +K ++ER  +AED   I+SKM++R VESAQRRVEGNN+D+RKQVL
Sbjct:  538 LSMEDELMRRFGSDNMKSMMERFGMAED--AIQSKMVSRAVESAQRRVEGNNFDSRKQVL  595

Query:  610 QYDDVMREQREIIYANRREVITAERDLGPELKGMIKRTIKRAVDAHSRSDKNTAA---EA  666
            QYDDV+R+QRE+IY  R EVI AE L    ++ MI+RT+  V +++ S +    A   +
Sbjct:  596 QYDDVLRQQREVIYKQRYEVINAENSLREIIEQMIQRTVNFIVSSNASSHEPEEAWNLQG  655

Query:  667 IVNFARSALLDEEAITVSELRGLKEAEIKELLYERALAVYEQQIAKLKDPEAIIEFQKVL  726
            I+++  + LL E   IT+ +L+      +I+ L+ ++  A Y+++   L   PE   EF+KV+
Sbjct:  656 IIDYVDANLLPEGTITLEDLQNRTSEDIQNLILDKIKAAYDEK-ETLLPPEEFNEFEKVV  714
```

```
                                  -continued
Query:  727 ILMVVDNQWTEHIDALDQLRNSVGLRGYAQNNPIVEYQSEGFRMFQDMIGSIEFDVTRTL  786
            +L VVD +W +HIDA+D LR+ + LR Y Q +P+ EYQSEGF MF+ M+ SI+ DV R +
Sbjct:  715 LLRVVDTKWVDHIDAMDHLRDGIHLRAYGQIDPLREYQSEGFEMFEAMVSSIDEDVARYI  774

Query:  787 MKAQIHEQ-ERER-ASQHATTTAEQNISAQHVPMNNESPEYQGIKRNDKCPCGSGMKFKN  844
            MKA+I + ERE+ A    AE    A+ P+ +    Q I RND CPCGSG K+KN
Sbjct:  775 MKAEIRQNLEREQVAKGEAINPAEGKPEAKRQPIRKD----QHIGRNDPCPCGSGKKYKN  830

Query:  845 CHG                                                           847
            CHG
Sbjct:  831 CHG                                                           833
```

A related DNA sequence was identified in *S. pyogenes* <SEQ ID 3619> which encodes the amino acid sequence <SEQ ID 3620>. Analysis of this protein sequence reveals the following:

```
Possible site: 43
>>> Seems to have no N-terminal signal sequence

----- Final Results -----
            bacterial cytoplasm --- Certainty = 0.4443(Affirmative) < succ>
            bacterial membrane  --- Certainty = 0.0000(Not Clear)   < succ>
             bacterial outside  --- Certainty = 0.0000(Not Clear)   < succ>
```

An alignment of the GAS and GBS proteins is shown below.

```
Identities = 710/837 (84%), Positives = 777/837 (92%), Gaps = 3/837 (0%)

Query:   11 MANILRTVIENDKGELKKLDKIAKKVDSYADHMAALSDEALQAKTPEFKERYQNGETLDQ   70
            MANILR VIENDKGEL+KL+KIAKKV+SYAD MA+LSD  LQ KT EFKERYQ GETL+Q
Sbjct:    1 MANILRKVIENDKGELRKLEKIAKKVESYADQMASLSDRDLQGKTLEFKERYQKGETLEQ   60

Query:   71 LLPEAFAVVREASKRVLGLYPYHVQIMGGIVLHHGDIPEMRTGEGKTLTATMPVYLNAIS  130
            LLPEAFAVVREA+KRVLGL+PY VQIMGGIVLH+GD+PEMRTGEGKTLTATMPVYLNAI+
Sbjct:   61 LLPEAFAVVREAAKRVLGLFPYRVQIMGGIVLHNGDVPEMRTGEGKTLTATMPVYLNAIA  120

Query:  131 GLGVHVITVNEYLSTRDATEMGEVYSWLGLSVGINLAAKSPFEKREAYNCDITYSTNAEV  190
            G GVHVITVNEYLSTRDATEMGEVYSWLGLSVGINLAAKSP EKREAYNCDITYSTN+EV
Sbjct:  121 GEGVHVITVNEYLSTRDATEMGEVYSWLGLSVGINLAAKSPAEKREAYNCDITYSTNSEV  180

Query:  191 GFDYLRDNMVVRQEDMVQRPLNYALVDEVDSVLIDEARTPLIVSGPVSSEMNQLYTRADM  250
            GFDYLRDNMVVRQEDMVQRPLN+ALVDEVDSVLIDEARTPLIVSG VSSE NQLY RADM
Sbjct:  181 GFDYLRDNMVVRQEDMVQRPLNFALVDEVDSVLIDEARTPLIVSGAVSSETNQLYIRADM  240

Query:  251 FVKTLNSDDYIIDVPTKTIGLSDTGIDKAENYFHLNNLYDLENVALTHYIDNALRANYIM  310
            FVKTL S DY+IDVPTKTIGLSD+GIDKAE+YF+L+NLYD+ENVALTH+IDNALRANYIM
Sbjct:  241 FVKTLTSVDYVIDVPTKTIGLSDSGIDKAESYFNLSNLYDIENVALTHFIDNALRANYIM  300

Query:  311 LLNIDYVVSEEQEILIVDQFTGRTMEGRRFSDGLHQAIEAKESVPIQEESKTSASITYQN  370
            LL+IDYVVSE+ EILIVDQFTGRTMEGRRFSDGLHQAIEAKE V IQEESKTSASITYQN
Sbjct:  301 LLDIDYVVSEDGEILIVDQFTGRTMEGRRFSDGLHQAIEAKEGVRIQEESKTSASITYQN  360

Query:  371 MFRMYHKLAGMTGTGKTEEEEFREIYNMRVIPIPTNRPVQRIDHSDLLYPTLDSKFRAVV  430
            MFRMY KLAGMTGT KTEEEEFRE+YNMR+IPIPTNRP+ RIDH+DLLYPTL+SKFRAVV
Sbjct:  361 MFRMYKKLAGMTGTAKTEEEEFREVYNMRIIPIPTNRPIARIDHTDLLYPTLESKFRAVV  420

Query:  431 ADVKERYEQGQPVLVGTVAVETSDLISRKLVAAGVPHEVLNAKNHFKEAQIIMNAGQRGA  490
             DVK R+ +GQP+LVGTVAVETSDLISRKLV AG+PHEVLNAKNHFKEAQIIMNAGQRGA
Sbjct:  421 EDVKTRHAKGQPILVGTVAVETSDLISRKLVEAGIPHEVLNAKNHFKEAQIIMNAGQRGA  480

Query:  491 VTIATNMAGRGTDIKLGEGVRELGGLCVIGTERHESRRIDNQLRGRSGRQGDPGESQFYL  550
            VTIATNMAGRGTDIKLGEGVRELGGLCVIGTERHESRRIDNQLRGRSGRQGDPGESQFYL
Sbjct:  481 VTIATNMAGRGTDIKLGEGVRELGGLCVIGTERHESRRIDNQLRGRSGRQGDPGESQFYL  540

Query:  551 SLEDDLMRRFGTDRIKVVLERMNLAEDDTVIKSKMLTRQVESAQRRVEGNNYDTRKQVLQ  610
            SLEDDLMRRFG+DRIK  L+RM L E+DTVIKS ML RQVESAQ+RVEGNNYDTRKQVLQ
Sbjct:  541 SLEDDLMRRFGSDRIKAFLDRMKLDEEDTVIKSGMLGRQVESAQKRVEGNNYDTRKQVLQ  600

Query:  611 YDDVMREQREIIYANRREVITAERDLGPELKGMIKRTIKRAVDAHSRSDKNTAAEAIVNF  670
            YDDVMREQREIIYANRR+VITA RDLGPE+K MIKRTI RAVDAH+RS++  A +AIV F
Sbjct:  601 YDDVMREQREIIYANRRDVITANRDLGPEIKAMIKRTIDRAVDAHARSNRKDAIDAIVTF  660

Query:  671 ARSALLDEEAITVSELRGLKEAEIKELLYERALAVYEQQIAKLKDPEAIIEFQKVLILMV  730
            AR++L+ EE I+  ELRGLK+ +IKE LY+RALA+Y+QQ++KL+D EAIIEFQKVLILM+
```

-continued

```
Sbjct: 661 ARTSLVPEEFISAKELRGLKDDQIKEKLYQRALAIYDQQLSKLRDQEAIIEFQKVLILMI 720

Query: 731 VDNQWTEHIDALDQLRNSVGLRGYAQNNPIVEYQSEGFRMFQDMIGSIEFDVTRTLMKAQ 790
           VDN+WTEHIDALDQLRN+VGLRGYAQNNP+VEYQ+EGF+MFQDMIG+IEFDVTRT+MKAQ
Sbjct: 721 VDNKWTEHIDALDQLRNAVGLRGYAQNNPVVEYQAEGFKMFQDMIGAIEFDVTRTMMKAQ 780

Query: 791 IHEQERERASQHATTTAEQNISAQHVPMNNESPEYQGIKRNDKCPCGSGMKFKNCHG    847
           IHEQERERASQ ATT A QNI +Q       ++ P+    ++RN+ CPCGSG KFKNCHG
Sbjct: 781 IHEQERERASQRATTAAPQNIQSQQSANTDDLPK---VERNEACPCGSGKKFKNCHG    834
```

Based on this analysis, it was predicted that these proteins and their epitopes could be useful antigens for vaccines or diagnostics.

EXAMPLE 1166

A DNA sequence (GBSx1242) was identified in *S. agalactiae* <SEQ ID 3621> which encodes the amino acid sequence <SEQ ID 3622>. This protein is predicted to be phospho-2-dehydro-3-deoxyheptonate aldolase (aroH). Analysis of this protein sequence reveals the following:

```
Possible site: 31
>>> Seems to have no N-terminal signal sequence

----- Final Results -----
            bacterial cytoplasm --- Certainty = 0.3429(Affirmative) < succ>
            bacterial membrane  --- Certainty = 0.0000(Not Clear)   < succ>
            bacterial outside   --- Certainty = 0.0000(Not Clear)   < succ>
```

The protein has homology with the following sequences in the GENPEPT database.

```
>GP: AAF40753 GB: AE002387 phospho-2-dehydro-3-deoxyheptonate
aldolase, phe-sensitive [Neisseria meningitidis MC58]
Identities = 122/348 (35%), Positives = 187/348 (53%), Gaps = 32/348 (9%)

Query:   1 MGFHQLSDKINIEILKQKTSLDLEVSQKKLAKE---------EELKNIIKGEDQRFLVIV  51
           M H +D I I+ +K+     + + ++KE          +E+ +++ G D+R LVI+
Sbjct:   1 MTHHYPTDDIKIKEVKELLPPIAHLYELPISKEASGLVHRTRQEISDLVHGRDKRLLVII  60

Query:  52 GPCSADNPKAVLTYAKRLAKLEAAFKDKMFLVMRVYTAKPRTNGDGYKGLVHHSDKLGVF 111
           GPCS +PKA L YA+RL KL   +++++ +VMRVY KPRT   G+KGL++      G F
Sbjct:  61 GPCSIHDPKAALEYAERLLKLRKQYENELLIVMRVYFEKPRTT-VGWKGLINDPHLDGTF 119

Query: 112 ------FQARKMHYDIIRETGLLTADELLYPEMLSVMDDLVSYYAIGARSVEDQGHRFIS 165
                 QAR +   + G+ + E L        DL+S+ AIGAR+ E Q HR ++
Sbjct: 120 DINFGLRQARSLLLS-LNNMGMPASTEFLDMITPQYYADLISWGAIGARTTESQVHRELA 178

Query: 166 SGIDAPVGMKNPTSGNLRVMFNAVYAAQNQQELFYQNKQ-----VRTDGNLLSHVILRGY 220
           SG+  PVG KN T GNL++  +A+ AA +     K       V T GN   HVILRG
Sbjct: 179 SGLSCPVGFKNGTDGNLKIAIDAIGAASHSHHFLSVTKAGHSAIVHTGGNPDCHVILRGG 238

Query: 221 HNADYRSIPNYHYENLLETITHYEETDLQNPFIVVDTNHDNSGKQFLEQIRIVKSVLADR 280
                    PNY  E++  E       + +  +++D +H NS K + Q+ + + + A
Sbjct: 239 KE------PNYDAEHVSEAAEQLRAAGVTDK-LMIDCSHANSRKDYTRQMEVAQDIAAQL 291

Query: 281 QWHTKIRNYVRGFLIESYLEDGRQDKPDVFGKSITDPCLGWDKTEMLI            328
           +   +   + G ++ES+L +GRQDKP+V+GKSITD C+GW  TE L+
Sbjct: 292 E---QDGGNIMGVMVESHLVEGRQDKPEVYGKSITDACIGWGATEELL            336
```

A related DNA sequence was identified in *S. pyogenes* <SEQ ID 3623> which encodes the amino acid sequence <SEQ ID 3624>. Analysis of this protein sequence reveals the following:

```
Possible site: 57
>>> Seems to have no N-terminal signal sequence

----- Final Results -----
            bacterial cytoplasm --- Certainty = 0.1171(Affirmative) < succ>
            bacterial membrane  --- Certainty = 0.0000(Not Clear)   < succ>
            bacterial outside   --- Certainty = 0.0000(Not Clear)   < succ>
```

An alignment of the GAS and GBS proteins is shown below.

```
Identities = 52/233 (22%), Positives = 93/233 (39%), Gaps = 40/233 (17%)

Query:   50 IVGPCSADNPKAVLTYAKRLAKLEAAFKDKMFLVMRVYTAKPRTNGDGYKGLVHHSDKLG 109
            IVGPCS ++   +   A    KL   +       R     KPRT+   ++GL
Sbjct:   19 IVGPCSIESYDHIRLAASSAKKLGYNY------FRGGAYKPRTSAASFQGLG------- 64

Query:  110 VFFQARKMHYDIIRETGLLTADELLYPEMLSVMDDLVSYYAIGARSVEDQGHRFISSGID 169
              Q  +  +++ +E GLL+  E++     L      D +    +GAR++++     S ID
Sbjct:   65 --LQGIRYLHEVCQEFGLLSVSEIMSERQLEEAYDYLDVIQVGARNMQNFEFLKTLSHID 122

Query:  170 APVGMKNPTSGNLRVMFNAVYAAQNQQELFYQNKQVRTDGNLLSHVIL--RGYHNADYRS 227
              P+  K        +    A+   Q+  +              S++IL  RG     D
Sbjct:  123 KPILFKRGLMATIEEYLGALSYLQDTGK---------------SNIILCERGVRGYD--- 164

Query:  228 IPNYHYENLLETITHYEETDLQNPFIVVDTNHDNSGKQ-FLEQIRIVKSVLAD        279
              +    +   +++      ++TDL     I+VD +H      +    L   +I K+V A+
Sbjct:  165 VETRNMLDIMAVPIIQQKTDLP---IIVDVSHSTGRRDLLLPAAKIAKAVGAN        214
```

Based on this analysis, it was predicted that these proteins and their epitopes could be useful antigens for vaccines or diagnostics.

EXAMPLE 1167

A DNA sequence (GBSx1243) was identified in *S. agalactiae* <SEQ ID 3625> which encodes the amino acid sequence <SEQ ID 3626>. This protein is predicted to be AcpS (acpS). Analysis of this protein sequence reveals the following:

```
Possible site: 59
>>> Seems to have no N-terminal signal sequence

----- Final Results -----
            bacterial cytoplasm --- Certainty = 0.3620(Affirmative) < succ>
             bacterial membrane --- Certainty = 0.00000(Not Clear) < succ>
              bacterial outside --- Certainty = 0.00000(Not Clear) < succ>
```

The protein has homology with the following sequences in the GENPEPT database.

```
>GP: AAG22706 GB: AF276617 acyl carrier protein synthase; AcpS
[Streptococcus pneumoniae]
Identities = 61/117 (52%), Positives = 90/117 (76%), Gaps = 1/117 (0%)

Query:    1 MIVGHGIDLQEIEAITKAYERNQRFAERVLTEQELLLFKGISNPKRQMSFLTGRWAAKEA  60
            MIVGHGID++E+ +I   A  R++ FA+RVLT QE+  F   +   +RQ+ +L GRW+AKEA
Sbjct:    1 MIVGHGIDIEELASIESAVTRHEGFAKRVLTAQEMERFTSLKG-RRQIEYLAGRWSAKEA  59

Query:   61 YSKALGTGIGKVNFHDIEILSDDKGAPLITKEPFNGKSFVSISHSGNYAQASVILEE    117
            +SKA+GTGI K+ F D+E+L++++GAP  ++ PF+GK ++SISH+  +  ASVILEE
Sbjct:   60 FSKAMGTGISKLGFQDLEVLNNERGAPYFSQAPFSGKIWLSISHTDQFVTASVILEE    116
```

A related DNA sequence was identified in *S. pyogenes* <SEQ ID 3627> which encodes the amino acid sequence <SEQ ID 3628>. Analysis of this protein sequence reveals the following:

```
Possible site: 61
>>> Seems to have no N-terminal signal sequence

----- Final Results -----
            bacterial cytoplasm --- Certainty = 0.2001(Affirmative) < succ>
             bacterial membrane --- Certainty = 0.0000(Not Clear) < succ>
              bacterial outside --- Certainty = 0.0000(Not Clear) < succ>
```

An alignment of the GAS and GBS proteins is shown below.

```
Identities = 76/119 (63%), Positives = 99/119 (82%), Gaps = 1/119 (0%)

Query:   1 MIVGHGIDLQEIEAITKAYERNQRFAERVLTEQELLLFKGISNPKRQMSFLTGRWAAKEA   60
           MIVGHGIDLQEI AI K Y+RN RFA+++LTEQEL +F+     KR++++L GRW+ KEA
Sbjct:   1 MIVGHGIDLQEISAIEKVYQRNPRFAQKILTEQELAIFESFPY-KRRLNYLAGRWSGKEA   59

Query:  61 YSKALGTGIGKVNFHDIEILSDDKGAPLITKEPFNGKSFVSISHSGNYAQASVILEEEK   119
           ++KA+GTGIG++ F DIEIL+D +G P++TK PF G SF+SISHSGNY QASVILE++K
Sbjct:  60 FAKAIGTGIGRLTFQDIEILNDVRGCPILTKSPFKGNSFISISHSGNYVQASVILEDKK   118
```

Based on this analysis, it was predicted that these proteins and their epitopes could be useful antigens for vaccines or diagnostics.

EXAMPLE 1168

A DNA sequence (GBSx1244) was identified in *S. agalactiae* <SEQ ID 3629> which encodes the amino acid sequence <SEQ ID 3630>. Analysis of this protein sequence reveals the following:

```
Possible site: 19
>>> Seems to have no N-terminal signal sequence
     INTEGRAL     Likelihood = -3.24    Transmembrane     78-94 (77-97)

----- Final Results -----
             bacterial membrane --- Certainty = 0.2296(Affirmative) < succ>
             bacterial outside  --- Certainty = 0.0000(Not Clear)   < succ>
             bacterial cytoplasm --- Certainty = 0.0000(Not Clear)  < succ>
```

The protein has homology with the following sequences in the GENPEPT database.

```
>GP: AAD51027 GB: AF171873 alanine racemase [Streptococcus pneumoniae]
Identities = 227/366 (62%), Positives = 270/366 (73%)

Query:    1 MISSYHRPTRALIDLEAIANNVKSVQEHIPSDKKTFAVVKANAYGHGAVEVSKYIESIVD    60
            M +S HRPT+ALI L AI  N++ +  HIP       AVVKANAYGHGAV V+K I+  VD
Sbjct:    1 MKASPHRPTKALIHLGAIRQNIQQMGAHIPQGTLKLAVVKANAYGHGAVAVAKAIQDDVD    60

Query:   61 GFCVSNLDEAIELRQAGIVKMILVLGVVMPEQVILAKNENITLTVASLEWLRLCQTSAVD   120
            GFCVSN+DEAIELRQAG+ K IL+LGV  E V LAK  + TLTVA LEW++      VD
Sbjct:   61 GFCVSNIDEAIELRQAGLSKPILILGVSEIEAVALAKEYDFTLTVAGLEWIQALLDKEVD   120

Query:  121 LSGLEVHIKVDSGMGRIGVRQLDEGNKLISELGESGASVKGIFTHFATADEADNCKFNQQ   180
            L+GL VH+K+DSGMGRIG R+ E +     L + G  V+GIFTHFATADE   + FN Q
Sbjct:  121 LTGLTVHLKIDSGMGRIGFREASEVEQAQDLLQQHGVCVEGIFTHFATADEESDDYFNAQ   180

Query:  181 LTFFKDFISGLDNCPDLVHASNSATSLWHSETIFNAVRLGVVMYGLNPSGTDLDLPYPIN   240
              L  FK ++ +   P+LVHASNSAT+LWH ETIFNAVR+G  MYGLNPSG  LDLPY +
Sbjct:  181 LERFKTILASMKEVPELVHASNSATTLWHVETIFNAVRMGDAMYGLNPSGAVLDLPYDLI   240

Query:  241 PALSLESELVHVKQLHDGSQVGYGATYQVTGDEFVGTVPIGYADGWTRDMQGFSVIVNGE   300
            PAL+LES LVHVK + G+ +GYGATYQ   ++ + TVPIGYADGWTRDMQ FSV+V+G+
Sbjct:  241 PALTLESALVHVKTVPAGACMGYGATYQADSEQVIATVPIGYADGWTRDMQNFSVLVDGQ   300

Query:  301 LCEIIGRVSMDQMTIRLPQKYTIGTKVTLIGQQGSCNITTTDVAQKRQTINYEVLCLLSD   360
              C I+GRVSMDQ+TIRLP+ Y +GTKVTLIG  G    IT T VA R  TINYEV+CLLSD
Sbjct:  301 ACPIVGRVSMDQITIRLPKLYPLGTKVTLIGSNGDKEITATQVATYRVTINYEVVCLLSD   360

Query:  361 RIPRYY                                                        366
            RIPR Y
Sbjct:  361 RIPREY                                                        366
```

A related DNA sequence was identified in *S. pyogenes* <SEQ ID 3631> which encodes the amino acid sequence <SEQ ID 3632>. Analysis of this protein sequence reveals the following:

```
Possible site: 41
>>> Seems to have no N-terminal signal sequence
     INTEGRAL     Likelihood = -2.34    Transmembrane     82-98 (82-98)
```

-continued

```
----- Final Results -----
            bacterial membrane --- Certainty = 0.1935(Affirmative) < succ>
            bacterial outside  --- Certainty = 0.0000(Not Clear)   < succ>
            bacterial cytoplasm --- Certainty = 0.0000(Not Clear)  < succ>
```

The protein has homology with the following sequences in the databases:

```
>GP: AAD51027 GB: AF171873 alanine racemase [Streptococcus pneumoniae]
Identities = 222/366 (60%), Positives = 273/366 (73%)

Query:    1 MISSFHRPTVARVNLQAIKENVASVQKHIPLGVKTYAVVKADAYGHGAVQVSKALLPQVD   60
            M +S HRPT A ++L AI++N+  +  HIP G    AVVKA+AYGHGAV V+KA+    VD
Sbjct:    1 MKASPHRPTKALIHLGAIRQNIQQMGAHIPQGTLKLAVVKANAYGHGAVAVAKAIQDDVD   60

Query:   61 GYCVSNLDEALQLRQAGIDKEILILGVLLPNELELAVANAITVTIASLDWIALARLEKKE  120
            G+CVSN+DEA++LRQAG+ K ILILGV   + LA      T+T+A L+WI   ++ +
Sbjct:   61 GFCVSNIDEAIELRQAGLSKPILILGVSEIEAVALAKEYDFTLTVAGLEWIQALLDKEVD  120

Query:  121 CQGLKVHVKVDSGMGRIGLRSSKEVNLLIDSLKELGADVEGIFTHFATADEADDTKFNQQ  180
               GL VH+K+DSGMGRIG R + EV    D L++ G  VEGIFTHFATADE  D  FN Q
Sbjct:  121 LTGLTVHLKIDSGMGRIGFREASEVEQAQDLLQQHGVCVEGIFTHFATADEESDDYFNAQ  180

Query:  181 LQFFKKLIAGLEDKPRLVHASNSATSIWHSDTIFNAVRLGIVSYGLNPSGSDLSLPFPLQ  240
            L+ FK ++A +++ P LVHASNSAT++WH +TIFNAVR+G    YGLNPSG+ L LP+ L
Sbjct:  181 LERFKTILASMKEVPELVHASNSATTLWHVETIFNAVRMGDAMYGLNPSGAVLDLPYDLI  240

Query:  241 EALSLESSLVHVKMISAGDTVGYGATYTAKKSEYVGTVPIGYADGWTRNMQGFSVLVDGQ  300
            AL+LES+LVHVK + AG  +GYGATY A     + + TVPIGYADGWTR+MQ FSVLVDGQ
Sbjct:  241 PALTLESALVHVKTVPAGACMGYGATYQADSEQVIATVPIGYADGWTRDMQNFSVLVDGQ  300

Query:  301 FCEIIGRVSMDQLTIRLPKAYPLGTKVTLIGSNQQKNISTTDIANYRNTINYEVLCLLSD  360
              C I+GRVSMDQ+TIRLPK YPLGTKVTLIGSN  K I+ T +A YR TINYEV+CLLSD
Sbjct:  301 ACPIVGRVSMDQITIRLPKLYPLGTKVTLIGSNGDKEITATQVATYRVTINYEVVCLLSD  360

Query:  361 RIPRIY                                                        366
            RIPR Y
Sbjct:  361 RIPREY                                                        366
```

An alignment of the GAS and GBS proteins is shown below.

```
Identities = 247/366 (67%), Positives = 295/366 (80%)

Query:    1 MISSYHRPTRALIDLEAIANNVKSVQEHIPSDKKTFAVVKANAYGHGAVEVSKYIESIVD   60
            MISS+HRPT A ++L+AI NV  SVQ+HIP   KT+AVVKA+AYGHGAV+VSK +   VD
Sbjct:    1 MISSFHRPTVARVNLQAIKENVASVQKHIPLGVKTYAVVKADAYGHGAVQVSKALLPQVD   60

Query:   61 GFCVSNLDEAIELRQAGIVKMILVLGVVMPEQVILAKNENITLTVASLEWLRLCQTSAVD  120
            G+CVSNLDEA++LRQAGI K IL+LGV++P ++ LA      IT+T+ASL+W+ L +    +
Sbjct:   61 GYCVSNLDEALQLRQAGIDKEILILGVLLPNELELAVANAITVTIASLDWIALARLEKKE  120

Query:  121 LSGLEVHIKVDSGMGRIGVRQLDEGNKLISELGESGASVKGIFTHFATADEADNCKFNQQ  180
               GL+VH+KVDSGMGRIG+R   E N LI  L E GA V+GIFTHFATADEAD+ KFNQQ
Sbjct:  121 CQGLKVHVKVDSGMGRIGLRSSKEVNLLIDSLKELGADVEGIFTHFATADEADDTKFNQQ  180

Query:  181 LTFFKDFISGLDNCPDLVHASNSATSLWHSETIFNAVRLGVVMYGLNPSGTDLDLPYPIN  240
            L FFK  I+GL++  P LVHASNSATS+WHS+TIFNAVRLG+V YGLNPSG+DL LP+P+
Sbjct:  181 LQFFKKLIAGLEDKPRLVHASNSATSIWHSDTIFNAVRLGIVSYGLNPSGSDLSLPFPLQ  240

Query:  241 PALSLESELVHVKQLHDGSQVGYGATYQVTGDEFVGTVPIGYADGWTRDMQGFSVIVNGE  300
             ALSLES LVHVK +  G  VGYGATY      E+VGTVPIGYADGWTR+MQGFSV+V+G+
Sbjct:  241 EALSLESSLVHVKMISAGDTVGYGATYTAKKSEYVGTVPIGYADGWTRNMQGFSVLVDGQ  300

Query:  301 LCEIIGRVSMDQMTIRLPQKYTIGTKVTLIGQQGSCNITTTDVAQKRQTINYEVLCLLSD  360
             CEIIGRVSMDQ+TIRLP+ Y +GTKVTLIG    NI+TTD+A  R TINYEVLCLLSD
Sbjct:  301 FCEIIGRVSMDQLTIRLPKAYPLGTKVTLIGSNQQKNISTTDIANYRNTINYEVLCLLSD  360

Query:  361 RIPRYY                                                        366
            RIPR Y
Sbjct:  361 RIPRIY                                                        366
```

Based on this analysis, it was predicted that these proteins and their epitopes could be useful antigens for vaccines or diagnostics.

EXAMPLE 1169

A DNA sequence (GBSx1245) was identified in *S. agalactiae* <SEQ ID 3633> which encodes the amino acid sequence <SEQ ID 3634>. This protein is predicted to be immunogenic secreted protein precursor. Analysis of this protein sequence reveals the following:

```
Possible site: 27
>>> Seems to have a cleavable N-term signal seq.

----- Final Results -----
              bacterial outside --- Certainty = 0.3000(Affirmative) < succ>
             bacterial membrane --- Certainty = 0.0000(Not Clear)   < succ>
            bacterial cytoplasm --- Certainty = 0.0000(Not Clear)   < succ>
```

There is also homology to SEQ ID 1988.

A related GBS gene <SEQ ID 8745> and protein <SEQ ID 8746> were also identified. Analysis of this protein sequence reveals the following:

```
Lipop: Possible site: -1 Crend: 4
McG: Discrim Score: 8.81
GvH: Signal Score (-7.5): 0.659999
     Possible site: 27
>>> Seems to have a cleavable N-term signal seq.
ALOM program count: 0 value: 1.06 threshold: 0.0
   PERIPHERAL Likelihood = 1.06 247
modified ALOM score: -0.71
*** Reasoning Step: 3

----- Final Results -----
              bacterial outside --- Certainty = 0.3000(Affirmative) < succ>
             bacterial membrane --- Certainty = 0.0000(Not Clear)   < succ>
            bacterial cytoplasm --- Certainty = 0.0000(Not Clear)
```

SEQ ID 8746 (GBS98) was expressed in *E. coli* as a His-fusion product. SDS-PAGE analysis of total cell extract is shown in FIG. 7 (lane 5; MW 80 kDa).

GBS98-His was purified as shown in FIG. 192, lane 9.

Based on this analysis, it was predicted that these proteins and their epitopes could be useful antigens for vaccines or diagnostics.

EXAMPLE 1170

A DNA sequence (GBSx1246) was identified in *S. agalactiae* <SEQ ID 3635> which encodes the amino acid sequence <SEQ ID 3636>. This protein is predicted to be junction specific DNA helicase (mmsA) (recG). Analysis of this protein sequence reveals the following:

```
Possible site: 17
>>> Seems to have no N-terminal signal sequence
    INTEGRAL    Likelihood = -0.16    Transmembrane    530-546 (530-546)

----- Final Results -----
             bacterial membrane --- Certainty = 0.1065(Affirmative) < succ>
              bacterial outside --- Certainty = 0.0000(Not Clear)   < succ>
            bacterial cytoplasm --- Certainty = 0.0000(Not Clear)   < succ>
```

The protein has homology with the following sequences in the GENPEPT database.

```
>GP: CAA90280 GB: Z49988 MmsA [Streptococcus pneumoniae]
Identities = 483/671 (71%), Positives = 568/671 (83%)

Query:  1 MLLQSPISNLKGFGPKSAEKFQKLDIYTVEDLLLYYPFRYEDFKSKSVFDLVDGEKAVIT  60
          M L  P+  L G GPKSAEK+ KL I  ++DLLLY+PFRYEDFK+K V +L DGEKAV++
```

```
-continued
Sbjct:    1 MNLHQPLHVLPGVGPKSAEKYAKLGIENLQDLLLYFPFRYEDFKTKQVLELEDGEKAVLS   60

Query:   61 GLVVTPANVQYYGFKRNRLSFKLRQGEAVLNVSFFNQPYLADKIELGQEVAVFGKWDATK  120
            G VVTPA+VQYYGFKRNRL F L+QGE V V+FFNQPYLADKIELG +AVFGKWD  K
Sbjct:   61 GQVVTPASVQYYGFKRNRLRFSLKQGEVVFAVNFFNQPYLADKIELGATLAVFGKWDRAK  120

Query:  121 SAITGMKVLAQVEDDMQPVYRVAQGISQSTLIKAIKSAFEISAHLELKENLPATLLEKYR  180
            +++TGMKVLAQVEDD+QPVYR+AQGISQ++L+K IK+AF+    L ++ENLP +LL+KY+
Sbjct:  121 ASLTGMKVLAQVEDDLQPVYRLAQGISQASLVKVIKTAFDQGLDLLIEENLPQSLLDKYK  180

Query:  181 LMGRSQACLAMHFPKDITEYKQALRRIKFEELFYFQMNLQVLKSENKSETNGLPILYSKH  240
            LM R QA  AMHFPKD+ EYKQALRRIKF ELFYFQM LQ LKSEN+ + +GL + +S+
Sbjct:  181 LMSRCQAVRAMHFPKDLAEYKQALRRIKFAELFYFQMQLQTLKSENRVQGSGLVLNWSQE  240

Query:  241 AMETKISSLPFILTNAQKRSLDEILSDMSSGAHMNRLLQGDVGSGKTVIAGLSMYAAYTA  300
              +    +SLPF LT AQ++SL EIL+DM S HMNRLLQGDVGSGKTV+AGL+M+AA TA
Sbjct:  241 KVTAVKASLPFALTQAQEKSLQEILTDMKSDHHMNRLLQGDVGSGKTVVAGLAMFAAVTA  300

Query:  301 GFQSALMVPTEILAEQHYISLQELFPDLSIAILTSGMKAAVKRTVLAAIANGSVDMIVGT  360
            G+Q+ALMVPTEILAEQH+ SLQ LFP+L +A+LT  +KAA KR VL  IA G  D+I+GT
Sbjct:  301 GYQAALMVPTEILAEQHFESLQNLFPNLKLALLTGSLKAAEKREVLETIAKGEADLIIGT  360

Query:  361 HALIQDSVQYHKLGLVITDEQHRFGVKQRRIFREKGENPDVLMMTATPIPRTLAITAFGE  420
            HALIQD V+Y +LGL+I DEQHRFGV QRRI REKG+NPDVLMMTATPIPRTLAITAFG+
Sbjct:  361 HALIQDGVEYARLGLIIIDEQHRFGVGQRRILREKGDNPDVLMMTATPIPRTLAITAFGD  420

Query:  421 MDVSIIDELPAGRKPIITRWVKHEQLGTVLEWVKGELQKDAQVYVISPLIEESEALDLKN  480
            MDVSIID++PAGRKPI+TRW+KHEQL  VL W++GE+QK +Q YVISPLIEESEALDLKN
Sbjct:  421 MDVSIIDQMPAGRKPIVTRWIKHEQLPQVLTWLEGEIQKGSQAYVISPLIEESEALDLKN  480

Query:  481 AVALHAELSTYFEGIAKVALVHGRMKNDEKDAIMQDFKDKKSHILVSTTVIEVGVNVPNA  540
            A+AL  EL+T+F G A+VAL+HGRMK+DEKD IMQDFK++K+ ILVSTTVIEVGVNVPNA
Sbjct:  481 AIALSEELTTHFAGKAEVALLHGRMKSDEKDQIMQDFKERKTDILVSTTVIEVGVNVPNA  540

Query:  541 TIMIIMDADRFGLSQLHQLRGRVGRGYKQSYAVLVANPKTDSGKKRMTIMTETTDGFVLA  600
            T+MIIMDADRFGLSQLHQLRGRVGRG KQSYAVLVANPKTDSGK RM IMTETT+GFVLA
Sbjct:  541 TVMIIMDADRFGLSQLHQLRGRVGRGDKQSYAVLVANPKTDSGKDRMRIMTETTNGFVLA  600

Query:  601 ESDLKMRGSGEIFGTRQSGIPEFQVADIVEDYPILEEARRVASDIVKDNNWKENTEWALI  660
            E DLKMRGSGEIFGTRQSG+PEFQVADI+ED+PILEEAR+VAS I     W+E+ EW +I
Sbjct:  601 EEDLKMRGSGEIFGTRQSGLPEFQVADIIEDFPILEEARKVASYISSIEAWQEDPEWRMI  660

Query:  661 LDNLRQHSDFD                                                  671
            +L +    D
Sbjct:  661 ALHLEKKEHLD                                                  671
```

A related DNA sequence was identified in *S. pyogenes* <SEQ ID 3637> which encodes the amino acid sequence <SEQ ID 3638>. Analysis of this protein sequence reveals the following:

```
Possible site: 17
>>> Seems to have no N-terminal signal sequence
    INTEGRAL     Likelihood = -0.16     Transmembrane     530-546 (530-546)

----- Final Results -----
            bacterial membrane --- Certainty = 0.1065(Affirmative) < succ>
             bacterial outside --- Certainty = 0.0000(Not Clear)   < succ>
              bacterial cytoplasm --- Certainty = 0.0000(Not Clear)   < succ>
```

An alignment of the GAS and GBS proteins is shown below.

```
Identities = 641/671 (95%), Positives = 655/671 (97%)

Query:    1 MLLQSPISNLKGFGPKSAEKFQKLDIYTVEDLLLYYPFRYEDFKSKSVFDLVDGEKAVIT   60
            M+L +P+SNLKGFGPKSAEKFQKLDIYTVEDLLLYYPFRYEDFKSKSVFDLVDGEKAVIT
Sbjct:    1 MILTAPMSNLKGFGPKSAEKFQKLDIYTVEDLLLYYPFRYEDFKSKSVFDLVDGEKAVIT   60

Query:   61 GLVVTPANVQYYGFKRNRLSFKLRQGEAVLNVSFFNQPYLADKIELGQEVAVFGKWDATK  120
            GLVVTPANVQYYGFKRNRLSFKLRQGEAVLNVSFFNQPYLADKIELGQEVAVFGKWDATK
Sbjct:   61 GLVVTPANVQYYGFKRNRLSFKLRQGEAVLNVSFFNQPYLADKIELGQEVAVFGKWDATK  120

Query:  121 SAITGMKVLAQVEDDMQPVYRVAQGISQSTLIKAIKSAFEISAHLELKENLPATLLEKYR  180
            SAITGMKVLAQVEDDMQPVYRVAQGISQSTLIKAIKSAFEI AHLELKENLPATLLEKYR
Sbjct:  121 SAITGMKVLAQVEDDMQPVYRVAQGISQSTLIKAIKSAFEIDAHLELKENLPATLLEKYR  180
```

-continued

```
Query: 181 LMGRSQACLAMHFPKDITEYKQALRRIKFEELFYFQMNLQVLKSENKSETNGLPILYSKH 240
           LMGRSQACLAMHFPKDITEYKQALRRIKFEELFYFQMNLQVLK+ENKSETNGLPILYSK
Sbjct: 181 LMGRSQACLAMHFPKDITEYKQALRRIKFEELFYFQMNLQVLKAENKSETNGLPILYSKR 240

Query: 241 AMETKISSLPFILTNAQKRSLDEILSDMSSGAHMNRLLQGDVGSGKTVIAGLSMYAAYTA 300
           AMETKISSLPFILTNAQKRSLD+ILSDMSSGAHMNRLLQGDVGSGKTVIAGLSMYAAYTA
Sbjct: 241 AMETKISSLPFILTNAQKRSLDDILSDMSSGAHMNRLLQGDVGSGKTVIAGLSMYAAYTA 300

Query: 301 GFQSALMVPTEILAEQHYISLQELFPDLSIAILTSGMKAAVKRTVLAAIANGSVDMIVGT 360
           GFQSALMVPTEILAEQHYISLQELFPDLSIAILTSGMKAAVKRTVLAAIANGSVDMIVGT
Sbjct: 301 GFQSALMVPTEILAEQHYISLQELFPDLSIAILTSGMKAAVKRTVLAAIANGSVDMIVGT 360

Query: 361 HALIQDSVQYHKLGLVITDEQHRFGVKQRRIFREKGENPDVLMMTATPIPRTLAITAFGE 420
           HALIQDSVQYHKLGLVITDEQHRFGVKQRRIFREKGENPDVLMMTATPIPRTLAITAFGE
Sbjct: 361 HALIQDSVQYHKLGLVITDEQHRFGVKQRRIFREKGENPDVLMMTATPIPRTLAITAFGE 420

Query: 421 MDVSIIDELPAGRKPIITRWVKHEQLGTVLEWVKGELQKDAQVYVISPLIEESEALDLKN 480
           MDVSIIDELPAGRKPI+TRWVKHEQLGTVLEWVKGELQKDAQVYVISPLIEESEALDLKN
Sbjct: 421 MDVSIIDELPAGRKPIMTRWVKHEQLGTVLEWVKGELQKDAQVYVISPLIEESEALDLKN 480

Query: 481 AVALHAELSTYFEGIAKVALVHGRMKNDEKDAIMQDFKDKKSHILVSTTVIEVGVNVPNA 540
           AVALHAELSTYFEGIAKVALVHGRMKNDEKDAIMQDFKDKKSHILVSTTVIEVGVNVPNA
Sbjct: 481 AVALHAELSTYFEGIAKVALVHGRMKNDEKDAIMQDFKDKKSHILVSTTVIEVGVNVPNA 540

Query: 541 TIMIIMDADRFGLSQLHQLRGRVGRGYKQSYAVLVANPKTDSGKKRMTIMTETTDGFVLA 600
           TIMIIMDADRFGLSQLHQLRGRVGRGYKQSYAVLVANPKTDSGKKRMTIMTETTDGFVLA
Sbjct: 541 TIMIIMDADRFGLSQLHQLRGRVGRGYKQSYAVLVANPKTDSGKKRMTIMTETTDGFVLA 600

Query: 601 ESDLKMRGSGEIFGTRQSGIPEFQVADIVEDYPILEEARRVASDIVKDNNWKENTEWALI 660
           ESDLKMRGSGEIFGTRQSGIPEFQVADIVEDYPILEEAR+V++ IV D NW    +W L+
Sbjct: 601 ESDLKMRGSGEIFGTRQSGIPEFQVADIVEDYPILEEARKVSAAIVSDPNWIYEKQWQLV 660

Query: 661 LDNLRQHSDFD                                                 671
           N+R+   +D
Sbjct: 661 AQNIRKKEVYD                                                 671
```

Based on this analysis, it was predicted that these proteins and their epitopes could be useful antigens for vaccines or diagnostics.

EXAMPLE 1171

A DNA sequence (GBSx1247) was identified in *S. agalactiae* <SEQ ID 3639> which encodes the amino acid sequence <SEQ ID 3640>. This protein is predicted to be aryl-alcohol dehydrogenase (b1647). Analysis of this protein sequence reveals the following:

```
Possible site: 50
>>> Seems to have no N-terminal signal sequence

----- Final Results -----
            bacterial cytoplasm --- Certainty = 0.1562(Affirmative) < succ>
            bacterial membrane --- Certainty = 0.0000(Not Clear)  < succ>
             bacterial outside --- Certainty = 0.0000(Not Clear)  < succ>
```

A related GBS nucleic acid sequence <SEQ ID 10105> which encodes amino acid sequence <SEQ ID 10106> was also identified.

The protein has homology with the following sequences in the GENPEPT database.

```
>GP: BAB07646 GB: AP001520 aryl-alcohol dehydrogenase [Bacillus halodurans]
Identities = 173/300 (57%), Positives = 224/300 (74%)

Query:   7 IGQTGIQATRIALGCMRMSDLKGKQAEEVVGTALDLGINFFDHADIYGGGLSELRFRDAI    66
           +G + ++     +A+GCMR++ +   K+AE  V TAL+ G NFFDHADIYGGG  E  F DAI
Sbjct:   6 LGSSSLEVPVVAVGCMRINAISKKEAERFVQTALEQGANFFDHADIYGGGECEEIFADAI    65

Query:  67 KHLNVNRDKMIIQSKCGIREGYFDFSKEYILSSVDGILERLGTEYLDFLILHRPDVLVEP   126
           +      R+K+I+QSKCGIREG FDFSKEYIL SVDGIL+RL T+YLD L+LHRPD LVEP
Sbjct:  66 QMNEAVREKIILQSKCGIREGRFDFSKEYILQSVDGILQRLKTDYLDVLLLHRPDALVEP   125
```

```
-continued
Query:  127 EEVAEAFTKLRAEGKVKHFGVSNQNRFQMELLQSYLDEPLAVNQLQLSPAHTPMFDAGLN  186
            EEVAEAF  L + GKV+HFGVSNQN   Q+ELL+ ++ +P+  NQLQLS   +  M  +G+N
Sbjct:  126 EEVAEAFDLLESSGKVRHFGVSNQNPMQIELLKKFVRQPIVANQLQLSITNATMISSGIN  185

Query:  187 VNMLNKASIEHDDGIVDYCRLKRVTIQAWSPFQIDLSRGLFVNHPDYKELNETIAKLAKN  246
            VNM N+++I  D   ++DYCRL  VTIQ WSPFQ      G+F+ +  +  ELN+ I +LA+
Sbjct:  186 VNMENESAINRDGSVLDYCRLHDVTIQPWSPFQYGFFEGVFLGNDLFPELNKKIDELAEK  245

Query:  247 YNVSSEAIVIAWILRHPAKMQAIVGSMNPSRLKAIDKANDIALTRKEWYDIYRSAGNILP  306
            Y VS+   I  IAW+LRHPA MQ  ++G+MN   RLK    KA++I LTR+EWY+IYR+AGNILP
Sbjct:  246 YEVSNTTIAIAWLLRHPANMQPVIGTMNLKRLKDCCKASEIRLTREEWYEIYRAAGNILP  305
```

There is also homology to SEQ ID 780.

Based on this analysis, it was predicted that these proteins and their epitopes could be useful antigens for vaccines or diagnostics.

EXAMPLE 1172

A DNA sequence (GBSx1248) was identified in *S. agalactiae* <SEQ ID 3641> which encodes the amino acid sequence <SEQ ID 3642>. This protein is predicted to be shikimate 5-dehydrogenase (aroE) (aroE). Analysis of this protein sequence reveals the following:

```
Possible site: 21
>>> Seems to have no N-terminal signal sequence

----- Final Results -----
         bacterial cytoplasm --- Certainty = 0.0988(Affirmative) < succ>
         bacterial membrane  --- Certainty = 0.0000(Not Clear)   < succ>
          bacterial outside  --- Certainty = 0.0000(Not Clear)   < succ>
```

The protein has homology with the following sequences in the GENPEPT database.

```
>GP: AAC74762 GB: AE000264 putative oxidoreductase
[Escherichia coli K12]
Identities = 114/279 (40%), Positives = 171/279 (60%),
Gaps = 3/279 (1%)

Query:   10 LTGLIANPARHSLSPLMWNTSFQEKNMNYAYLTFEVEEGKLTEAVRGVRALGIRGVNVSM   69
            L GL+A P RHSLSP M N + ++  + + Y+ FEV+      A+ G++AL +RG  VSM
Sbjct:    9 LIGLMAYPIRHSLSPEMQNKALEKAGLPFTYMAFEVDNDSFPGAIEGLKALKMRGTGVSM   68

Query:   70 PFKQSVIPLLDDLSPQAKLVGAVNTIVNQGGTGRLVGHMTDGIGCFKALAAQGFSAKNKI  129
            P KQ     +D+L+P AKLVGA+NTIVN  G  R    G+ TDG G  +A+    GF K K
Sbjct:   69 PNKQLACEYVDELTPAAKLVGAINTIVNDDGYLR--GYNTDGTGHIRAIKESGFDIKGKT  126

Query:  130 ITIAGIGGSGKAVAVQAAMEGVAEIRLFNRNSSNYDKVIDLSDKIKKQFQIKVVVDYLEN  189
            + + G GG+  A+   Q A+EG+  EI+LFNR     +DK + +  ++ +      V V  L +
Sbjct:  127 MVLLGAGGASTAIGAQGAIEGLKEIKLFNRRDEFFDKALAFAQRVNENTDCVVTVTDLAD  186

Query:  190 KTAFKDAIRTSHFYIDATSLGMRPLDNYSLINDPEILTPNLVVVDLVYKPKETALLRFVR  249
            + AF +A+ ++      + T +GM+PL+N  SL+ND  +L P L+V + VY P   T LL+  +
Sbjct:  187 QQAFAEALASADILTNGTKVGMKPLENESLVNDISLLHPGLLVTECVYNPHMTKLLQQAQ  246

Query:  250 QNGVKHAYNGLGMLIYQGAEAFQLITNQEMPISSVERVL                      288
            Q  G  K   +G GML++QGAE  F  L T ++ P+  V++V+
Sbjct:  247 QAGCK-TIDGYGMLLWQGAEQFTLWTGKDFPLEYVKQVM                      284
```

A related DNA sequence was identified in *S. pyogenes* <SEQ ID 3643> which encodes the amino acid sequence <SEQ ID 3644>. Analysis of this protein sequence reveals the following:

```
Possible site: 54
>>> Seems to have an uncleavable N-term signal seq

----- Final Results -----
          bacterial membrane  --- Certainty = 0.0000(Not Clear) < succ>
           bacterial outside  --- Certainty = 0.0000(Not Clear) < succ>
         bacterial cytoplasm  --- Certainty = 0.0000(Not Clear) < succ>
```

The protein has homology with the following sequences in the databases:

```
>GP: AAC74762 GB: AE000264 putative oxidoreductase
[Escherichia coli]
Identities = 132/280 (47%), Positives = 186/280 (66%),
Gaps = 3/280 (1%)

Query:   11 LVSLLATPIRHSLSPKMHNEAYAKLGLDYAYLAFEVGTEQLADAVQGIRALGIRGSNVSM   70
            L+ L+A PIRHSLSP+M N+A  K GL + Y+AFEV  +     A++G++AL +RG+ VSM
Sbjct:    9 LIGLMAYPIRHSLSPEMQNKALEKAGLPFTYMAFEVDNDSFPGAIEGLKALKMRGTGVSM   68

Query:   71 PNKEAILPLLDDLSPAAELVGAVNTVVNKDGKGHLVGHITDGIGALRALADEGVSVKNKI  130
            PNK+       +D+L+PAA+LVGA+NT+VN DG   +L G+ TDG G +RA+ + G   +K K
Sbjct:   69 PNKQLACEYVDELTPAAKLVGAINTIVNDDG--YLRGYNTDGTGHIRAIKESGFDIKGKT  126

Query:  131 ITLAGVGGAGKAIAVQLAFDGAKEVRLFNRQATRLSSVQKLVTKLNQLTRTKVTLQDLED  190
            + L G GGA  AI  Q A +G KE++LFNR+             ++N+ T   VT+ DL D
Sbjct:  127 MVLLGAGGASTAIGAQGAIEGLKEIKLFNRRDEFFDKALAFAQRVNENTDCVVTVTDLAD  186

Query:  191 QTAFKEAIRESHLFIDATSVGMKPLENLSLITDPELIRPDLVVFDIVYSPAETKLLAFAR  250
            Q  AF  EA+   +  +    + T VGMKPLEN SL+ D   L+ P  L+V + VY+P   TKLL   A+
Sbjct:  187 QQAFAEALASADILTNGTKVGMKPLENESLVNDISLLHPGLLVTECVYNPHMTKLLQQAQ  246

Query:  251 QHGAQKVINGLGMVLYQGAEAFKLITGQDMPVDAIKPLLG                     290
            Q  G   K I+G GM+L+QGAE  F  L TG+D  P++   +K   ++G
Sbjct:  247 QAGC-KTIDGYGMLLWQGAEQFTLWTGKDFPLEYVKQVMG                     285
```

An alignment of the GAS and GBS proteins is shown below.

```
Identities = 166/288 (57%), Positives = 221/288 (76%)

Query:    4 LNGETLLTGLIANPARHSLSPLMWNTSFQEKNMNYAYLTFEVEEGKLTEAVRGVRALGIR   63
            L+G TLL  L+A P RHSLSP M N ++ +    ++YAYL FEV    +L +AV+G+RALGIR
Sbjct:    5 LSGHTLLVSLLATPIRHSLSPKMHNEAYAKLGLDYAYLAFEVGTEQLADAVQGIRALGIR   64

Query:   64 GVNVSMPFKQSVIPLLDDLSPQAKLVGAVNTIVNQGGTGRLVGHMTDGIGCFKALAAQGF  123
            G NVSMP K++++PLLDDLSP A+LVGAVNT+VN+ G G  LVGH+TDGIG   +ALA +G
Sbjct:   65 GSNVSMPNKEAILPLLDDLSPAAELVGAVNTVVNKDGKGHLVGHITDGIGALRALADEGV  124

Query:  124 SAKNKIITIAGIGGSGKAVAVQAAMEGVAEIRLFNRNSSNYDKVIDLSDKIKKQFQIKVV  183
            S  KNKIIT+AG+GG+GKA+AVQ A  +G  E+RLFNR ++       V  L  K+ +   + KV
Sbjct:  125 SVKNKIITLAGVGGAGKAIAVQLAFDGAKEVRLFNRQATRLSSVQKLVTKLNQLTRTKVT  184

Query:  184 VDYLENKTAFKDAIRTSHFYIDATSLGMRPLDNYSLINDPEILTPNLVVVDLVYKPKETA  243
              +   LE++TAFK+AIR SH +IDATS+GM+PL+N SLI DPE++  P+LVV D+VY P ET
Sbjct:  185 LQDLEDQTAFKEAIRESHLFIDATSVGMKPLENLSLITDPELIRPDLVVFDIVYSPAETK  244

Query:  244 LLRFVRQNGVKHAYNGLGMLIYQGAEAFQLITNQEMPISSVERVLQTE             291
            LL F RQ+G +   NGLGM++YQGAEAF+LIT Q+MP+ +++ +L  E
Sbjct:  245 LLAFARQHGAQKVINGLGMVLYQGAEAFKLITGQDMPVDAIKPLLGDE             292
```

Based on this analysis, it was predicted that these proteins and their epitopes could be useful antigens for vaccines or diagnostics.

EXAMPLE 1173

A DNA sequence (GBSx1249) was identified in *S. agalactiae* <SEQ ID 3645> which encodes the amino acid sequence <SEQ ID 3646>. Analysis of this protein sequence reveals the following:

```
Possible site: 13
>>> Seems to have no N-terminal signal sequence
    INTEGRAL     Likelihood = -6.16     Transmembrane     57-73 (53-76)

----- Final Results -----
            bacterial membrane --- Certainty = 0.3463(Affirmative) < succ>
             bacterial outside --- Certainty = 0.0000(Not Clear) < succ>
           bacterial cytoplasm --- Certainty = 0.0000(Not Clear) < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1174

A DNA sequence (GBSx1250) was identified in *S. agalactiae* <SEQ ID 3647> which encodes the amino acid sequence <SEQ ID 3648>. Analysis of this protein sequence reveals the following:

```
Possible site: 17
>>> Seems to have no N-terminal signal sequence

----- Final Results -----
            bacterial cytoplasm --- Certainty = 0.2333(Affirmative) < succ>
            bacterial membrane  --- Certainty = 0.0000(Not Clear)   < succ>
            bacterial outside   --- Certainty = 0.0000(Not Clear)   < succ>
```

A related GBS nucleic acid sequence <SEQ ID 10103> which encodes amino acid sequence <SEQ ID 10104> was also identified.

The protein has homology with the following sequences in the GENPEPT database.

```
>GP: BAB05343 GB: AP001512 L-asparaginase
[Bacillus halodurans ]
Identities = 158/319 (49%), Positives = 214/319 (66%),
Gaps = 4/319 (1%)

Query:    1 MKKILVLHTGGTISMNANEKGQVMSSADNPMKYVDLSLDDL-DLTVVDFLNLPSPQITPH   59
            MKK+LV+HTGGTI+M+ +EKG V      NP+     SL + + V DFLN+PSP +TP
Sbjct:    1 MKKVLVIHTGGTIAMHEDEKGGVQPKETNPLFATVESLTSIASIEVDDFLNIPSPHMTPE   60

Query:   60 HMLDIYHYLKQHASN--FDGVVITHGTDTLEETAYFLDTMILPKIPIIITGAMRSTNELG  117
            M  +  LK   N  FDGVVITHGTDTLEETAY LD ++  ++P+++TGAMRS+NELG
Sbjct:   61 LMFQLAERLKSRVGNESFDGVVITHGTDTLEETAYLLDLLLDWEVPVVVTGAMRSSNELG  120

Query:  118 SDGVYNYLSALRVANSTKAADKGVLVVMNDEIHAAKYVTKTHTTNVSTFQTPTHGPLGII  177
            +DG +N++SA++ A + +A  KGVLVV NDEIH AK VTKTHT+NV+TFQ+P +GP+GI+
Sbjct:  121 ADGPHNFISAVKTAATDEAKGKGVLVVFNDEIHTAKNVTKTHTSNVATFQSPQYGPIGIV  180

Query:  178 MKQDLLFFKATEERVRFDLDKITGTVPIVKAYAGMGDSGIISFLNSQNISGLVIEALGAG  237
            K+ + F A   + +  I    V ++KAYAGM D  ++ +    I GLVIEA G G
Sbjct:  181 TKRGVTFHHAPSYKESYTVSSIDHRVVLLKAYAGM-DGSVVDAIADTGIDGLVIEAFGQG  239

Query:  238 NMPPKAAQEIEELIEQGVPVVLVSRCFNGIAEPVYGYEGGGAKLQESGVMFVKELNAPKA  297
            N+PP     I+ L +  +PVVLVSR +GI +  Y YEGGG L++ GV+F    LN  KA
Sbjct:  240 NLPPAVVPSIKRLHQANIPVVLVSRSVSGIVQETYAYEGGGRHLKDLGVIFTNGLNGQKA  299

Query:  298 RLKLLIALNAGLTGQNLKD                                          316
            RLKLL+AL      + L++
Sbjct:  300 RLKLLVALELTTDRKKLQE                                          318
```

A related DNA sequence was identified in *S. pyogenes* <SEQ ID 3649> which encodes the amino acid sequence <SEQ ID 3650>. Analysis of this protein sequence reveals the following:

```
Possible site: 16
>>> Seems to have no N-terminal signal sequence
    INTEGRAL   Likelihood = -2.28   Transmembrane    245-261 (243-261)

----- Final Results -----
            bacterial membrane  --- Certainty = 0.1914(Affirmative) < succ>
            bacterial outside   --- Certainty = 0.0000(Not Clear)   < succ>
            bacterial cytoplasm --- Certainty = 0.0000(Not Clear)   < succ>
```

The protein has homology with the following sequences in the databases:

```
>GP: BAB05343 GB: AP001512 L-asparaginase [Bacillus halodurans]
Identities = 158/320 (49%), Positives = 218/320 (67%), Gaps = 5/320 (1%)

Query:    1 MKKILVLHTGGTISMQADNSGRVVPNQDNPM-TKIHAAAQDIQLTVSDFLNLPSPHITPH   59
            MKK+LV+HTGGTI+M  D  G V P + NP+   + +     + V DFLN+PSPH+TP
Sbjct:    1 MKKVLVIHTGGTIAMHEDEKGGVQPKETNPLFATVESLTSIASIEVDDFLNIPSPHMTPE  60

Query:   60 HMLSIYHHIQERT--DVFDGIVITHGTDTLEETAYFLDTMALPTNIPVVLTGAMRSSNEV  117
              M +   ++ R   + FDG+VITHGTDTLEETAY LD + L    +PVV+TGAMRSSNE+
Sbjct:   61 LMFQLAERLKSRVGNESFDGVVITHGTDTLEETAYLLDLL-LDWEVPVVVTGAMRSSNEL  119

Query:  118 GSDGIYNYLTALRVASSDKAKEKGVLVVMNDEIHAAKYVTKTHTTNISTFQTPTHGPLGI  177
              G+DG +N+++A++ A++D+AK KGVLVV NDEIH AK VTKTHT+N++TFQ+P +GP+GI
Sbjct:  120 GADGPHNFISAVKTAATDEAKGKGVLVVFNDEIHTAKNVTKTHTSNVATFQSPQYGPIGI  179

Query:  178 IMKNDLLFFKTAEPRIRFDLRCISGTIPIIKAYAGMGDSILSLLTPGSIQGLVIEALGA   237
              + K + F     + + + I   +  ++KAYAGM DGS++  +     I GLVIEA G
Sbjct:  180 VTKRGVTFHHAPSYKESYTVSSIDHRVVLLKAYAGM-DGSVVDAIADTGIDGLVIEAFGQ  238

Query:  238 GNVPPLAVGEIEHLIALGIPVILVSRCFNGMAEPVYAYEGGGAMLQEAGVMFVKELNAPK  297
              GN+PP   V  I+ L    IPV+LVSR +G+ +   YAYEGGG L++ GV+F    LN  K
Sbjct:  239 GNLPPAVVPSIKRLHQANIPVVLVSRSVSGIVQETYAYEGGGRHLKDLGVIFTNGLNGQK  298

Query:  298 ARLKLLIALNAGLTGQELKD                                          317
            ARLKLL+AL          ++L++
Sbjct:  299 ARLKLLVALELTTDRKKLQE                                          318
```

An alignment of the GAS and GBS proteins is shown below.

```
Identities = 242/321 (75%), Positives = 275/321 (85%), Gaps = 1/321 (0%)

Query:    1 MKKILVLHTGGTISMNANEKGQVMSSADNPMKYVDLSLDDLDLTVVDFLNLPSPQITPHH  60
            MKKILVLHTGGTISM A+  G+V+ + DNPM +   +  D+ LTV DFLNLPSP ITPHH
Sbjct:    1 MKKILVLHTGGTISMQADNSGRVVPNQDNPMTKIHAAAQDIQLTVSDFLNLPSPHITPHH  60

Query:   61 MLDIYHYLKQHASNFDGVVITHGTDTLEETAYFLDTMILP-KIPIIITGAMRSTNELGSD  119
            ML IYH++++     FDG+VITHGTDTLEETAYFLDTM LP  IP+++TGAMRS+NE+GSD
Sbjct:   61 MLSIYHHIQERTDVFDGIVITHGTDTLEETAYFLDTMALPTNIPVVLTGAMRSSNEVGSD  120

Query:  120 GVYNYLSALRVANSTKAADKGVLVVMNDEIHAAKYVTKTHTTNVSTFQTPTHGPLGIIMK  179
            G+YNYL+ALRVA+S KA  +KGVLVVMNDEIHAAKYVTKTHTTN+STFQTPTHGPLGIIMK
Sbjct:  121 GIYNYLTALRVASSDKAKEKGVLVVMNDEIHAAKYVTKTHTTNISTFQTPTHGPLGIIMK  180

Query:  180 QDLLFFKATEERVRFDLDKITGTVPIVKAYAGMGDSGIISFLNSQNISGLVIEALGAGNM  239
             DLLFFK  E R+RFDL  I+GT+PI+KAYAGMGD  I+S L   +I GLVIEALGAGN+
Sbjct:  181 NDLLFFKTAEPRIRFDLRCISGTIPIIKAYAGMGDSILSLLTPGSIQGLVIEALGAGNV  240

Query:  240 PPKAAQEIEELIEQGVPVVLVSRCFNGIAEPVYGYEGGGAKLQESGVMFVKELNAPKARL  299
            PP  A  EIE LI  G+PV+LVSRCFNG+AEPVY YEGGGA LQE+GVMFVKELNAPKARL
Sbjct:  241 PPLAVGEIEHLIALGIPVILVSRCFNGMAEPVYAYEGGGAMLQEAGVMFVKELNAPKARL  300

Query:  300 KLLIALNAGLTGQNLKDYIEG                                         320
            KLLIALNAGLTGQ LKDYIEG
Sbjct:  301 KLLIALNAGLTGQELKDYIEG                                         321
```

Based on this analysis, it was predicted that these proteins and their epitopes could be useful antigens for vaccines or diagnostics.

EXAMPLE 1175

A DNA sequence (GBSx1251) was identified in *S. agalactiae* <SEQ ID 3651> which encodes the amino acid sequence <SEQ ID 3652>. Analysis of this protein sequence reveals the following:

```
Possible site: 50
>>> Seems to have no N-terminal signal sequence

----- Final Results -----
          bacterial cytoplasm --- Certainty = 0.4427(Affirmative). < succ>
```

```
                      bacterial membrane --- Certainty = 0.0000(Not Clear) < succ>
                      bacterial outside  --- Certainty = 0.0000(Not Clear) < succ>
```

The protein has homology with the following sequences in the GENPEPT database.

```
>GP: CAB85142 GB: AL162757 conserved hypothetical protein [Neisseria
meningitidis Z2491]
Identities = 87/285 (30%), Positives = 138/285 (47%), Gaps = 35/285 (12%)

Query:     4 KAVFFDIDGTLLNDRKNVQKSTIK-AIRNLKDQGILVGLATGRG----PSFVQPFLENLG    58
             K VFFDID TL    + + ++K A+  L+ +GIL   LATGR     P  V+  +   G
Sbjct:    11 KIVFFDIDDTLYRKYTDTLRPSVKTAVAALRGKGILTALATGRSLATIPEKVRDMMAETG    70

Query:    59 LDFAVTYNGQYIYSRSEIIYTNQLSKTTVYRLIRYAGARRREISLGTASGLLGSGIIGLG   118
             +D   VT NGQ+    + +      +  + R+  +            SLG     +G    G+
Sbjct:    71 MDAVVTINGQFALLHGKTVCEVPMDAGLMGRVCAHLD------SLGMDYAFVGGE--GIA   122

Query:   119 TSRLGQIVSSLVPRKWAKAIERSFKHFIRRIKPQNIDSLMVILREPIYQVVLVATEGE--   176
                S L + V             R+ KH    I              +P+YQ+++ A E E
Sbjct:   123 VSALSECVC-----------RALKH----IASDFFADKDYFSSKPVYQMLVFAEENEMP   166

Query:   177 --SERIQKQFPRVKLTRSSPYSMDVISEGQSKVKGIERVGQRYGFDLSEVIAFGDSDNDI   234
               S+ ++++   +K  R   ++D++  G SK  GI  V +  G ++++V+AFGD  ND+
Sbjct:   167 LWSDIVERE--GLKTVRWHEEAVDLLPAGASKTDGIRSVVEALGLEMADVMAFGDGLNDV   224

Query:   235 EMLSQVGIGVAMGNASQQVRENARYTTADNNDDGISKALAHYGLI                279
             EMLS+VG GVAMGN  Q  +E A+Y     ++DG+ + L    G+I
Sbjct:   225 EMLSEVGFGVAMGNGEQAAKEAAKYVCPGVDEDGVLRGLQDLGVI                269
```

A related DNA sequence was identified in *S. pyogenes* <SEQ ID 3653> which encodes the amino acid sequence <SEQ ID 3654>. Analysis of this protein sequence reveals the following:

```
Possible site: 45
>>> Seems to have no N-terminal signal sequence

----- Final Results -----
                      bacterial cytoplasm --- Certainty = 0.6014(Affirmative) < succ>
                      bacterial membrane  --- Certainty = 0.0000(Not Clear)   < succ>
                      bacterial outside   --- Certainty = 0.0000(Not Clear)   < succ>
```

An alignment of the GAS and GBS proteins is shown below.

```
Identities = 320/459 (69%), Positives = 391/459 (84%)

Query:     1 MAIKAVFFDIDGTLLNDRKNVQKSTIKAIRNLKDQGILVGLATGRGPSFVQPFLENLGLD    60
             + +KAVFFDIDGTLLNDRKN+QK T KAI+ LK QGI+VGLATGRGP FVQPFLEN GLD
Sbjct:     1 LTVKAVFFDIDGTLLNDRKNIQKTTQKAIQQLKKQGIMVGLATGRGPGFVQPFLENFGLD    60

Query:    61 FAVTYNGQYIYSRSEIIYTNQLSKTTVYRLIRYAGARRREISLGTASGLLGSGIIGLGTS   120
             FAVTYNGQYI +R +++Y NQL K+ +Y++IRYA  ++REISLGTASGL GS II +GTS
Sbjct:    61 FAVTYNGQYILTRDKVLYQNQLPKSMIYKVIRYANEKKREISLGTASGLAGSRIIDMGTS   120

Query:   121 RLGQIVSSLVPRKWAKAIERSFKHFIRRIKPQNIDSLMVILREPIYQVVLVATEGESERI   180
               GQ++SS VP+ WA+ +E SFKH IRRIKPQ+  +L+ I+REPIYQVVLVA++ E+++I
Sbjct:   121 PFGQVISSFVPKSWARTVEGSFKHLIRRIKPQSFRNLVTIMREPIYQVVLVASQAETKKI   180

Query:   181 QKQFPRVKLTRSSPYSMDVISEGQSKVKGIERVGQRYGFDLSEVIAFGDSDNDIEMLSQV   240
             Q++FP +K+TRSSPYS+D+IS  QSK+KGIER+G+  GFDLSEV+AFGDSDND+EMLS V
Sbjct:   181 QEKFPHIKITRSSPYSLDLISVDQSKIKGIERLGEMFGFDLSEVMAFGDSDNDLEMLSGV   240

Query:   241 GIGVAMGNASQQVRENARYTTADNNDDGISKALAHYGLIQFEIEKTFSSRDENFNKVKSF   300
             GIG+AMGNA   V++ A +TT  NN+DGISKALAHYGLI F+IEK+F SRDENFNKVK F
Sbjct:   241 GIGIAMGNAETVVKDGAHFTTDSNNNDGISKALAHYGLIHFDIEKSFKSRDENFNKVKDF   300

Query:   301 HLLMDGETIETPRLYDSKEAGFRSDFKVEEIVEFLYAASQGNQKVFDQSIRNLHLAIDKA   360
             H LMD +TIETPR Y   EAG+RS FKVEEIVEFLYAAS+G+Q  F Q+I +LH A+D+A
Sbjct:   301 HRLMDSDTIETPRSYTISEAGYRSGFKVEEIVEFLYAASKGDQQQFTQAIFDLHGAVDQA   360
```

```
                            -continued
Query: 361 RDKVISKDHPETPLVGEVDALTDLLYLTYGSFVLMGVDPKPLFDTVHEANMGKIFPDGKA  420
           +KV +K H ETPL+G+VDAL DLLY TYGSFVLMGVDP+P+F+ VHEANM KIFPDGKA
Sbjct: 361 ANKVQAKKHVETPLIGQVDALADLLYFTYGSFVLMGVDPQPIFEAVHEANMAKIFPDGKA  420

Query: 421 HFDPVTHKILKPDDWEEHFAPEPSIRRELDSQIQKSLNR                      459
           HFDPVTHKI KPD W+E  APE +I++ELD Q+QKSL R
Sbjct: 421 HFDPVTHKIQKPDYWQERHAPEVAIKKELDKQLQKSLQR                      459
```

Based on this analysis, it was predicted that these proteins and their epitopes could be useful antigens for vaccines or diagnostics.

EXAMPLE 1176

A DNA sequence (GBSx1252) was identified in *S. agalactiae* <SEQ ID 3655> which encodes the amino acid sequence <SEQ ID 3656>. Analysis of this protein sequence reveals the following:

```
Possible site: 38
>>> Seems to have no N-terminal signal sequence

----- Final Results -----
             bacterial cytoplasm --- Certainty = 0.1671(Affirmative) < succ>
              bacterial membrane --- Certainty = 0.0000(Not Clear)   < succ>
               bacterial outside --- Certainty = 0.0000(Not Clear)   < succ>
```

A related GBS nucleic acid sequence <SEQ ID 10101> which encodes amino acid sequence <SEQ ID 10102> was also identified.

The protein has homology with the following sequences in the GENPEPT database.

```
>GP: BAB06903 GB: AP001518 unknown conserved protein [Bacillus halodurans]
Identities = 61/141 (43%), Positives = 92/141 (64%)

Query:  22 YERILVAIDGSTESELAFEKAVNVALRNDSELILTHVIDTRALQSFATFDTYIYEKLEKE   81
           Y  ILVA+DGST+++ A  KA N A   ++L + HVID+R+  +  +D +    E +
Sbjct:   2 YNHILVAVDGSTQAKRALYKAFNYAKEFKADLFICHVIDSRSFATVEQYDRTVVGAAELD   61

Query:  82 AKDVLEEYEKQAREKGADKVRQVIEFGNPKTLLAHDIPEKEKVDLIMVGATGLNTFERFX  141
           K +L+ Y ++A + G DKV   +++FG+PK  ++   I +K  +DLI+ GATGLN   ERF
Sbjct:  62 GKKLLQRYSEEAEKAGVDKVHTILDFGSPKANISKTIAQKYDIDLIITGATGLNAVERFL  121

Query: 142 IGSSSEYILRHAKVDLLIVRD                                        162
           +GS SE + RHAK D+LIVR+
Sbjct: 122 MGSVSESVARHAKCDVLIVRN                                        142
```

A related DNA sequence was identified in *S. pyogenes* <SEQ ID 3657> which encodes the amino acid sequence <SEQ ID 3658>. Analysis of this protein sequence reveals the following:

```
Possible site: 51
>>> Seems to have no N-terminal signal sequence

----- Final Results -----
             bacterial cytoplasm --- Certainty = 0.1296(Affirmative) < succ>
              bacterial membrane --- Certainty = 0.0000(Not Clear)   < succ>
               bacterial outside --- Certainty = 0.0000(Not Clear)   < succ>
```

An alignment of the GAS and GBS proteins is shown below.

```
Identities = 117/156 (75%), Positives = 135/156 (86%)

Query:  12 LEEDRLMSQKYERILVAIDGSTESELAFEKAVNVALRNDSELILTHVIDTRALQSFATFD   71
           L+ED  MS KY+RILVAIDGS ESELAF K VNVALRND+ L+L HVIDTRALQS ATFD
Sbjct:  25 LKEDSSMSLKYKRILVAIDGSYESELAFNKGVNVALRNDATLLLVHVIDTRALQSVATFD   84
```

-continued

```
Query:  72 TYIYEKLEKEAKDVLEEYEKQAREKGADKVRQVIEFGNPKTLLAHDIPEKEKVDLIMVGA 131
           TYIYEKLE+EAKDVL+++EKQA+  G    ++Q+IEFGNPK LLAHDIP++E DLIMVGA
Sbjct:  85 TYIYEKLEQEAKDVLDDFEKQAQIAGITNIKQIIEFGNPKNLLAHDIPDRENADLIMVGA 144

Query: 132 TGLNTFERFXIGSSSEYILRHAKVDLLIVRDPNKTM                         167
           TGLNTFER  IGSSSEYI+RHAK+DLL+VRD  KT+
Sbjct: 145 TGLNTFERLLIGSSSEYIMRHAKIDLLVVRDSTKTL                         180
```

Based on this analysis, it was predicted that these proteins and their epitopes could be useful antigens for vaccines or diagnostics.

EXAMPLE 1177

A DNA sequence (GBSx1253) was identified in *S. agalactiae* <SEQ ID 3659> which encodes the amino acid sequence <SEQ ID 3660>. This protein is predicted to be aspartate aminotransferase (aspC). Analysis of this protein sequence reveals the following:

```
Possible site: 47
>>> Seems to have no N-terminal signal sequence

----- Final Results -----
            bacterial cytoplasm --- Certainty = 0.2803(Affirmative) < succ>
            bacterial membrane  --- Certainty = 0.0000(Not Clear)   < succ>
            bacterial outside   --- Certainty = 0.0000(Not Clear)   < succ>
```

The protein has homology with the following sequences in the GENPEPT database.

```
>GP: AAC21948 GB: U32714 aminotransferase [Haemophilus influenzae Rd]
Identities = 142/212 (66%), Positives = 181/212 (84%), Gaps = 1/212 (0%)

Query:   1 MKIFDKSMKLEHVAYDIRGPVLEEADRMRANGEKILRLNTGNPAAFGFEAPDEVIRDLIT  60
           M++F KS KLEHV YDIRGPV +EA R+   G KIL+LN GNPA FGFEAPDE++ D++
Sbjct:   1 MRLFPKSDKLEHVCYDIRGPVHKEALRLEEEGNKILKLNIGNPAPFGFEAPDEILVDVLR  60

Query:  61 NARESEGYSDSKGIFSARKAVMQYYQLQNI-HVDMDDIYIVNGVSEGISMSMQALLDNDD 119
           N   ++GY DSKG++SARKA++QYYQ + I   ++D+YI NGVSE I+M+MQALL++ D
Sbjct:  61 NLPSAQGYCDSKGLYSARKAIVQYYQSKGILGATVNDVYIGNGVSELITMAMQALLNDGD 120

Query: 120 EVLVPMPDYPLWTACVSLAGGNAVHYICDEEANWYPDIDDIKSKITSKTKAIVLINPNNP 179
           EVLVPMPDYPLWTA V+L+GG AVHY+CDE+ANW+P IDDIK+K+ +KTKAIV+INPNNP
Sbjct: 121 EVLVPMPDYPLWTAAVTLSGGKAVHYLCDEDANWFPTIDDIKAKVNAKTKAIVIINPNNP 180

Query: 180 TGAVYPREILQEIVDIARQNDLIIFSDEVYDR                             211
           TGAVY +E+LQEIV+IARQN+LIIF DE+YD+
Sbjct: 181 TGAVYSKELLQEIVEIARQNNLIIFADEIYDK                             212
```

A related DNA sequence was identified in *S. pyogenes* <SEQ ID 3661> which encodes the amino acid sequence <SEQ ID 3662>. Analysis of this protein sequence reveals the following:

```
Possible site: 59
>>> Seems to have no N-terminal signal sequence

----- Final Results -----
            bacterial cytoplasm --- Certainty = 0.2936(Affirmative) < succ>
            bacterial membrane  --- Certainty = 0.0000(Not Clear)   < succ>
            bacterial outside   --- Certainty = 0.0000(Not Clear)   < succ>
```

An alignment of the GAS and GBS proteins is shown below.

```
Identities = 170/212 (80%), Positives = 193/212 (90%), Gaps = 1/212 (0%)

Query:   1 MKIFDKSMKLEHVAYDIRGPVLEEADRMRANGEKILRLNTGNPAAFGFEAPDEVIRDLIT  60
```

```
                  -continued
           MKI +KS KLEHVAYDIRGPVL+EA+RM A+GEKILRLNTGNPAAFGFEAPDEVIRDLI
Sbjct:  13 MKIIEKSSKLEHVAYDIRGPVLDEANRMIASGEKILRLNTGNPAAFGFEAPDEVIRDLIV    72

Query:  61 NARESEGYSDSKGIFSARKAVMQYYQLQNI-HVDMDDIYIVNGVSEGISMSMQALLDNDD   119
           NAR SEGYSDSKGIFSARKA+MQY QL+     VD++DIY+ NGVSE IS+S+QALLDN D
Sbjct:  73 NARLSEGYSDSKGIFSARKAIMQYCQLKGFPDVDIEDIYLGNGVSELISISLQALLDNGD   132

Query: 120 EVLVPMPDYPLWTACVSLAGGNAVHYICDEEANWYPDIDDIKSKITSKTKAIVLINPNNP   179
           EVLVPMPDYPLWTACVSL GG AVHY+CDEEA WYPDI DIKSKITS+TKAIV+INPNNP
Sbjct: 133 EVLVPMPDYPLWTACVSLGGGKAVHYLCDEEAGWYPDIADIKSKITSRTKAIVVINPNNP   192

Query: 180 TGAVYPREILQEIVDIARQNDLIIFSDEVYDR                              211
           TGA+YP+EIL++IV +AR++ LIIF+DE+YDR
Sbjct: 193 TGALYPKEILEDIVALAREHQLIIFADEIYDR                              224
```

Based on this analysis, it was predicted that these proteins and their epitopes could be useful antigens for vaccines or diagnostics.

EXAMPLE 1178

A DNA sequence (GBSx1254) was identified in *S. agalactiae* <SEQ ID 3663> which encodes the amino acid sequence <SEQ ID 3664>. Analysis of this protein sequence reveals the following:

```
Possible site: 60
>>> Seems to have no N-terminal signal sequence
     INTEGRAL      Likelihood = -14.75      Transmembrane     38-54 (29-60)

----- Final Results -----
                bacterial membrane --- Certainty = 0.6901(Affirmative) < succ>
                bacterial outside  --- Certainty = 0.0000(Not Clear)   < succ>
              bacterial cytoplasm  --- Certainty = 0.0000(Not Clear)   < succ>
```

A related GBS nucleic acid sequence <SEQ ID 9389> which encodes amino acid sequence <SEQ ID 9390> was also identified.

The protein has no significant homology with any sequences in the GENPEPT database.

A related DNA sequence was identified in *S. pyogenes* <SEQ ID 3665> which encodes the amino acid sequence <SEQ ID 3666>. Analysis of this protein sequence reveals the following:

```
Possible site: 43
>>> Seems to have no N-terminal signal sequence
     INTEGRAL      Likelihood = -15.97      Transmembrane     35-51 (25-58)

----- Final Results -----
                bacterial membrane --- Certainty = 0.7389(Affirmative) < succ>
                bacterial outside  --- Certainty = 0.0000(Not Clear)   < succ>
              bacterial cytoplasm  --- Certainty = 0.0000(Not Clear)   < succ>
```

The protein has no significant homology with any sequences in the GENPEPT database.

An alignment of the GAS and GBS proteins is shown below.

```
Identities = 51/87 (58%), Positives = 63/87 (71%), Gaps = 7/87 (8%)

Query:  1 MAKKPWEKKVVENNSHRKDKITRTSRGVVSSTPWITAFLSAFFVIVVAILFIVFYTSNRG    60
          MAK+PWE+K+V++     +   TR SR    STPW+TA LS FFVI+VAILFI FYTSN G
Sbjct:  1 MAKEPWEEKIVDDTIGTR---TRKSRNAFISTPWLTALLSVFFVIIVAILFIFFYTSNSG    57

Query: 61 EDRAKETSGFYGASSQKVNSSKTKKAS                                   87
          +R  ET+GFYGAS+ K    KT+KAS
Sbjct: 58 SNRQAETNGFYGASTHK----KTRKAS                                   80
```

Based on this analysis, it was predicted that these proteins and their epitopes could be useful antigens for vaccines or diagnostics.

EXAMPLE 1179

A DNA sequence (GBSx1255) was identified in *S. agalactiae* <SEQ ID 3667> which encodes the amino acid sequence <SEQ ID 3668>. Analysis of this protein sequence reveals the following:

```
Possible site: 22
>>> Seems to have no N-terminal signal sequence

----- Final Results -----
          bacterial cytoplasm --- Certainty = 0.0815(Affirmative) < succ>
          bacterial membrane  --- Certainty = 0.0000(Not Clear)   < succ>
          bacterial outside   --- Certainty = 0.0000(Not Clear)   < succ>
```

The protein has no significant homology with any sequences in the GENPEPT database.

A related DNA sequence was identified in *S. pyogenes* <SEQ ID 3669> which encodes the amino acid sequence <SEQ ID 3670>. Analysis of this protein sequence reveals the following:

```
Possible site: 61
>>> Seems to have no N-terminal signal sequence

----- Final Results -----
          bacterial cytoplasm --- Certainty = 0.0107(Affirmative) < succ>
          bacterial membrane  --- Certainty = 0.000(Not Clear)    < succ>
          bacterial outside   --- Certainty = 0.0000(Not Clear)   < succ>
```

An alignment of the GAS and GBS proteins is shown below.

```
Identities = 43/64 (67%), Positives = 53/64 (82%)

Query:  1 MKVALIPEKCIACGLCQTYSNIFDYQDDGIVKFSDTDNLEKEIPSSDQDTVLAVKSCPTK  60
          MKV++IPEKCIACGLCQTYS++FDY D+GIV FS +   + I  SD+D +LAVKSCPTK
Sbjct:  1 MKVSIIPEKCIACGLCQTYSSLFDYHDNGIVTFSSSSETSQSICPSDKDAILAVKSCPTK  60

Query: 61 ALTI  64
          ALT+
Sbjct: 61 ALTL  64
```

Based on this analysis, it was predicted that these proteins and their epitopes could be useful antigens for vaccines or diagnostics.

EXAMPLE 1180

A DNA sequence (GBSx1256) was identified in *S. agalactiae* <SEQ ID 3671> which encodes the amino acid sequence <SEQ ID 3672>. Analysis of this protein sequence reveals the following:

```
Possible site: 28
>>> Seems to have a cleavable N-term signal seq.
    INTEGRAL    Likelihood = -10.61    Transmembrane    47-63 (41-69)

----- Final Results -----
          bacterial membrane  --- Certainty = 0.5246(Affirmative) < succ>
          bacterial outside   --- Certainty = 0.0000(Not Clear)   < succ>
          bacterial cytoplasm --- Certainty = 0.0000(Not Clear)   < succ>
```

The protein has homology with the following sequences in the GENPEPT database.

```
>GP: AAC36851 GB: L23802 pore-forming peptide [Enterococcus faecalis]
Identities = 42/130 (32%), Positives = 63/130 (48%), Gaps = 9/130 (6%)

Query:    7 KIRYHWQPELSWAIIYWSIAIAPIFIGLSLLYERTE---IPSQVFVLFAIFIVLVGIGFH    63
            K +++WQPEL+  IIYWS    +FI L L  E     I + V V F +F   L   G
Sbjct:    3 KQKFYWQPELASTIIYWSCTFCILFISLILALENNGPYLISNLVMVPFFVFAYL---GIA   59

Query:   64 RYFVIEEDGYLRIVSFNFLRRTKFPIEDIAKIEVTKSSVTIKFNNNHE--RIFYMRKWPK  121
            R F + E   L +    + R+   P+   I K+   + S+ I  +    E   ++F M+K
Sbjct:   60 RSFNMTETS-LIVRDVLWFRKKALPLSQIEKVTYNEKSIEIFSSEFKEGSKVFLMKKKTD  118

Query:  122 KYFLDALAIE                                                   131
            FL+AL  I+
Sbjct:  119 SLFLEALKIK                                                   128
```

A related DNA sequence was identified in *S. pyogenes* <SEQ ID 3673> which encodes the amino acid sequence <SEQ ID 3674>. Analysis of this protein sequence reveals the following:

```
Possible site: 28
>>> Seems to have no N-terminal signal sequence
      INTEGRAL     Likelihood = -9.87     Transmembrane     47-63 (41-69)
      INTEGRAL     Likelihood = -3.35     Transmembrane     20-36 (18-37)

----- Final Results -----
              bacterial membrane  --- Certainty = 0.4949(Affirmative) < succ>
              bacterial outside   --- Certainty = 0.0000(Not Clear)   < succ>
              bacterial cytoplasm --- Certainty = 0.0000(Not Clear)   < succ>
```

The protein has homology with the following sequences in the databases:

```
>GP: AAC36851 GB: L23802 pore-forming peptide [Enterococcus faecalis]
Identities = 42/130 (32%), Positives = 70/130 (53%), Gaps = 12/130 (9%)

Query:    7 KIRYHWQPELSWSIIYWSIAFAPIFVGLSLLYERTE---IPSRVFILFAIFAVLVGIGLH   63
            K +++WQPEL+ +IIYWS   F  +F+ L L  E     I + V + F +FA L   G+
Sbjct:    3 KQKFYWQPELASTIIYWSCTFCILFISLILALENNGPYLISNLVMVPFFVFAYL---GIA   59

Query:   64 RYF-IIENNGILRIVSFKLFGPRKLLISTITKIEVTKSTLCL---HVEDKSYLFYMRKWP  119
            R F + E + I+R V +   F   + L +S I  K+     ++ +        ++ S +F M+K
Sbjct:   60 RSFNMTETSLIVRDVLW--FRKKALPLSQIEKVTYNEKSIEIFSSEFKEGSKVFLMKKKT  117

Query:  120 KKYFLDALAV                                                   129
            FL+AL +
Sbjct:  118 DSLFLEALKI                                                   127
```

An alignment of the GAS and GBS proteins is shown below.

```
Identities = 115/162 (70%), Positives = 132/162 (80%), Gaps = 1/162 (0%)

Query:    1 MIKLFGKIRYHWQPELSWAIIYWSIAIAPIFIGLSLLYERTEIPSQVFVLFAIFIVLVGI   60
            MIKLFGKIRYHWQPELSW+IIYWSIA APIF+GLSLLYERTEIPS+VF+LFAIF VLVGI
Sbjct:    1 MIKLFGKIRYHWQPELSWSIIYWSIAFAPIFVGLSLLYERTEIPSRVFILFAIFAVLVGI   60

Query:   61 GFHRYFVIEEDGYLRIVSFNFLRRTKFPIEDIAKIEVTKSSVTIKFNNNHERIFYMRKWP  120
            G HRYF+IE +G LRIVSF     K  I  I KIEVTKS++ +  +     +FYMRKWP
Sbjct:   61 GLHRYFIIENNGILRIVSFKLFGPRKLLISTITKIEVTKSTLCLHVEDK-SYLFYMRKWP  119

Query:  121 KKYFLDALAIEPTFKGEVELLDNLIKMDYFECYRYDKKALTK                   162
            KKYFLDALA+ P F+GEV L DN IK+DYFE Y++DKKALT+
Sbjct:  120 KKYFLDALAVNPYFQGEVILSDNFIKLDYFEVYQHDKKALTR                   161
```

Based on this analysis, it was predicted that these proteins and their epitopes could be useful antigens for vaccines or diagnostics.

EXAMPLE 1181

A DNA sequence (GBSx1257) was identified in *S. agalactiae* <SEQ ID 3675> which encodes the amino acid sequence <SEQ ID 3676>. This protein is predicted to be peptidase t (pepT). Analysis of this protein sequence reveals the following:

```
Possible site: 49
>>> Seems to have no N-terminal signal sequence

----- Final Results -----
            bacterial cytoplasm --- Certainty = 0.2913(Affirmative) < succ>
             bacterial membrane --- Certainty = 0.0000(Not Clear)   < succ>
              bacterial outside --- Certainty = 0.0000(Not Clear)   < succ>
```

The protein has homology with the following sequences in the GENPEPT database.

```
>GP: AAA20627 GB: L27596 tripeptidase [Lactococcus lactis]
Identities = 274/406 (67%), Positives = 334/406 (81%), Gaps = 4/406 (0%)

Query:   1 MSYEKLLERFLTYVKINTRSNPNSTQTPTTQSQVDFALTVLKPEMEAIGLKDVHYLPSNG   60
           M YEKLL RFL YVK+NTRS+ NST TP+TQ+ V+FA    + +M+A+GLKDVHYL SNG
Sbjct:   1 MKYEKLLPRFLEYVKVNTRSDENSTTTPSTQALVEFAHK-MGEDMKALGLKDVHYLESNG   59

Query:  61 YLVGTLPATSDRLRHKIGFISHMDTADFNAENITPQIVDYKGGD--IELGDSGYILSPKD  118
           Y++GT+PA +D+   KIG ++H+DTADFNAE + PQI++    G+   I+LGD+ + L PKD
Sbjct:  60 YVIGTIPANTDKKVRKIGLLAHLDTADFNAEGVNPQILENYDGESVIQLGDTEFTLDPKD  119

Query: 119 FPNLNNYHGQTLITTDGKTLLGADDKSGIAEIMTAMEYLAS-HPEIEHCEIRVGFGPDEE  177
           FPNL NY GQTL+ TDG TLLG+DDKSG AEIMT +YL + +P+ EH EIRVGFGPDEE
Sbjct: 120 FPNLKNYKGQTLVHTDGTTLLGSDDKSGVAEIMTLADYLLNINPDFEHGEIRVGFGPDEE  179

Query: 178 IGIGADKFDVKDFDVDFAYTVDGGPLGELQYETFSAAGLELTFEGRNVHPGTAKNQMINA  237
           IG+GADKFDV DFDVDFAYTVDGGPLGELQYETFSAAG + F+G+NVHPGTAKN M+NA
Sbjct: 180 IGVGADKFDVADFDVDFAYTVDGGPLGELQYETFSAAGAVIEFQGKNVHPGTAKNMMVNA  239

Query: 238 LQLAMDFHSQLPENERPEQTDGYQGFYHLYDLSGTVDQAKSSYIIRDFEEVDFLKRKHLA  297
           LQLA+D+H+ LPE +RPE+T+G +GF+HL   L GT ++A++ YIIRD EE  F +RK L
Sbjct: 240 LQLAIDYHNALPEFDRPEKTEGREGFFHLLKLDGTPEEARAQYIIRDHEEGKFNERKALM  299

Query: 298 QDIADNMNEALQSERVKVKLYDQYYNMKKVIEKDMTPINIAKEVMEELDIKPIIEPIRGG  357
           Q+IAD MN  L   RVK + DQYYNM ++IEKDM+ I+IAK+ ME LDI PIIEPIRGG
Sbjct: 300 QEIADKMNAELGQNRVKPVIKDQYYNMAQIIEKDMSIIDIAKKAMENLDIAPIIEPIRGG  359

Query: 358 TDGSKISFMGIPTPNLFAGGENMHGRFEFVSLQTMEKAVDVILGIV                403
           TDGSKISFMG+PTPNLFAGGENMHGRFEFVS+QTNEKAVD +L I+
Sbjct: 360 TDGSKISFMGLPTPNLFAGGENMHGRFEFVSVQTMEKAVDTLLEII                405
```

A related DNA sequence was identified in *S. pyogenes* <SEQ ID 3677> which encodes the amino acid sequence <SEQ ID 3678>. Analysis of this protein sequence reveals the following:

```
Possible site: 41
>>> Seems to have no N-terminal signal sequence

----- Final Results -----
            bacterial cytoplasm --- Certainty = 0.2938(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below.

```
Identities = 305/406 (75%), Positives = 352/406 (86%), Gaps = 1/406 (0%)

Query:    1 MSYEKLLERFLTYVKINTRSNPNSTQTPTTQSQVDFALTVLKPEMEAIGLKDVHYLPSNG   60
            M Y+ LL+RF+ YVK+NTRS P+S  TP+T+SQ  FALT+LKPEMEAIGL+DVHY P NG
Sbjct:    5 MKYDNLLDRFIKYVKVNTRSVPDSETTPSTESQEAFALTILKPEMEAIGLQDVHYNPVNG   64

Query:   61 YLVGTLPATSDRLRHKIGFISHMDTADFNAENITPQIVD-YKGGDIELGDSGYILSPKDF  119
            YL+GTLPA +  L  KIGFI+HMDTADFNAEN+ PQI+D Y+GGDI LG S Y L PK F
Sbjct:   65 YLIGTLPANNPTLTRKIGFIAHMDTADFNAENVNPQIIDNYQGGDITLGSSNYKLDPKAF  124

Query:  120 PNLNNYHGQTLITTDGKTLLGADDKSGIAEIMTAMEYLASHPEIEHCEIRVGFGPDEEIG  179
            PNLNNY GQTLITTDG TLLGADDKSGIAEIMTA+E+L S P+IEHC+I+V FGPDEEIG
Sbjct:  125 PNLNNYIGQTLITTDGTTLLGADDKSGIAEIMTAIEFLTSQPQIEHCDIKVAFGPDEEIG  184

Query:  180 IGADKFDVKDFDVDFAYTVDGGPLGELQYETFSAAGLELTFEGRNVHPGTAKNQMINALQ  239
            +GADKF+V DF+VDFAYT+DGGPLGELQYETFSAA LE+TF GRNVHPGTAK+QMINAL+
Sbjct:  185 VGADKFEVADFEVDFAYTMDGGPLGELQYETFSAAALEVTFLGRNVHPGTAKDQMINALE  244

Query:  240 LAMDFHSQLPENERPEQTDGYQGFYHLYDLSGTVDQAKSSYIIRDFEEVDFLKRKHLAQD  299
            LA+DFH +LP  +RPE TDGYQGFYHL  L+GTV++A++SYIIRDFEE  F  RK  ++
Sbjct:  245 LAIDFHEKLPAKDRPEYTDGYQGFYHLTGLTGTVEEARASYIIRDFEEASFEARKVKVEN  304

Query:  300 IADNMNEALQSERVKVKLYDQYYNMKKVIEKDMTPINIAKEVMEELDIKPIIEPIRGGTD  359
            IA +MN  L ++RV V+L DQYYNMKKVIEKDMT I +AKEVMEEL IKP+IEPIRGGTD
Sbjct:  305 IAQSMNAQLGTKRVLVELNDQYYNMKKVIEKDMTAIELAKEVMEELAIKPVIEPIRGGTD  364

Query:  360 GSKISFMGIPTPNLFAGGENMHGRFEFVSLQTMEKAVDVILGIVAK               405
            GSKISFMGIPTPN+FAGGENMHGRFEFVSLQTME+AVDVI+G+V K
Sbjct:  365 GSKISFMGIPTPNIFAGGENMHGRFEFVSLQTMERAVDVIIGLVCK               410
```

Based on this analysis, it was predicted that these proteins and their epitopes could be useful antigens for vaccines or diagnostics.

EXAMPLE 1182

A DNA sequence (GBSx1258) was identified in *S. agalactiae* <SEQ ID 3679> which encodes the amino acid sequence <SEQ ID 3680>. Analysis of this protein sequence reveals the following:

```
Possible site: 43
>>> Seems to have no N-terminal signal sequence
    INTEGRAL    Likelihood = -12.26    Transmembrane    481-497 (477-508)
    INTEGRAL    Likelihood = -9.45     Transmembrane    510-526 (506-534)
    INTEGRAL    Likelihood = -7.96     Transmembrane    316-332 (310-334)
    INTEGRAL    Likelihood = -7.54     Transmembrane    354-370 (351-373)
    INTEGRAL    Likelihood = -7.11     Transmembrane    385-401 (383-409)
    INTEGRAL    Likelihood = -6.58     Transmembrane    215-231 (211-233)
    INTEGRAL    Likelihood = -6.48     Transmembrane     71-87  (69-91)
    INTEGRAL    Likelihood = -6.32     Transmembrane    110-126 (106-133)
    INTEGRAL    Likelihood = -5.10     Transmembrane    446-462 (443-465)
    INTEGRAL    Likelihood = -3.29     Transmembrane    418-434 (418-435)
    INTEGRAL    Likelihood = -2.55     Transmembrane    263-279 (263-279)
    INTEGRAL    Likelihood = -2.02     Transmembrane    142-158 (141-159)
    INTEGRAL    Likelihood = -1.70     Transmembrane    184-200 (184-200)

----- Final Results -----
          bacterial membrane --- Certainty = 0.5904(Affirmative) < succ>
          bacterial outside  --- Certainty = 0.0000(Not Clear)   < succ>
          bacterial cytoplasm --- Certainty = 0.0000(Not Clear)   < succ>
```

A related GBS nucleic acid sequence <SEQ ID 8747> which encodes amino acid sequence <SEQ ID 8748> was also identified. Analysis of this protein sequence reveals the following:

```
Lipop: Possible site: -1 Crend: 6
McG: Discrim Score: -10.58
GvH: Signal Score (-7.5): -1.1
     Possible site: 32
```

-continued

```
>>> Seems to have no N-terminal signal sequence
ALOM program count: 13 value: -12.26 threshold: 0.0
     INTEGRAL      Likelihood = -12.26    Transmembrane    470-486  (466-497)
     INTEGRAL      Likelihood =  -9.45    Transmembrane    499-515  (495-523)
     INTEGRAL      Likelihood =  -7.96    Transmembrane    305-321  (299-323)
     INTEGRAL      Likelihood =  -7.54    Transmembrane    343-359  (340-362)
     INTEGRAL      Likelihood =  -7.11    Transmembrane    374-390  (372-398)
     INTEGRAL      Likelihood =  -6.58    Transmembrane    204-220  (200-222)
     INTEGRAL      Likelihood =  -6.48    Transmembrane     60-76   (58-80)
     INTEGRAL      Likelihood =  -6.32    Transmembrane     99-115  (95-122)
     INTEGRAL      Likelihood =  -5.10    Transmembrane    435-451  (432-454)
     INTEGRAL      Likelihood =  -3.29    Transmembrane    407-423  (407-424)
     INTEGRAL      Likelihood =  -2.55    Transmembrane    252-268  (252-268)
     INTEGRAL      Likelihood =  -2.02    Transmembrane    131-147  (130-148)
     INTEGRAL      Likelihood =  -1.70    Transmembrane    173-189  (173-189)
     PERIPHERAL    Likelihood =   1.43        21 modified ALOM score: 2.95
*** Reasoning Step: 3

----- Final Results -----
             bacterial membrane  --- Certainty = 0.5904(Affirmative) < succ>
             bacterial outside   --- Certainty = 0.0000(Not Clear)   < succ>
             bacterial cytoplasm --- Certainty = 0.0000(Not Clear)   < succ>
```

The protein has homology with the following sequences in the GENPEPT database.

```
>GP: AAC00276 GB: AF008220 YtgP [Bacillus subtilis]
Identities = 178/545 (32%), Positives = 302/545 (54%), Gaps 26/545 (4%)

Query:   24 QMVKGTAWLTAGNFISRLLGAIYIIPWYAWMGKHAAEANALFGMGYEIYALFLLISTVGI   83
            ++++GT  LT G +ISR+LG +Y+IP+   +G   A    ALF  GY  Y LFL I+T+G
Sbjct:    4 KLLRGTFVLTLGTYISRILGMVYLIPFSIMVG---ATGGALFQYGYNQYTLFLNIATMGF   60

Query:   84 PVAVAKQVSKYNTLGKEEMSIYLVRKILQFMLILGGIFALIMYIGSPLFASLSKGGQE--  141
            P AV+K VSKYN+ G  E S +++  + ML+ G I   I+Y+ +P+FA +S GG++
Sbjct:   61 PAAVSKFVSKYNSKGDYETSRKMLKAGMSVMLVTGMIAFFILYLSAPMFAEISLGGKDNN  120

Query:  142 ------LVPILRSLTLAVLVFPSMSVLRGFFQGFNNLKPYAISQVAEQIIRVIWMLLTAF  195
                  +V ++R ++LA+LV P MS++RGFFQG   + P A+SQV EQI+R+I++L   F
Sbjct:  121 GLTIDHVVYIRMVSLALLVVPIMSLVRGFFQGHQMMGPTAVSQVVEQIVRIIFLLSATF  180

Query:  196 YIMRLGSGDYIAAVTQSTFAAFVGMFASIAVLLYFLW--RYNMLSALIGKTPKHIKLDTK  253
             I+++ +G + AV +TFAA +G F  + V+LY   W R    L A++   T     L K
Sbjct:  181 LILKVFNGGLVIAVGYATFAALIGAFGGL-VVLYIYWNKRKGSLLAMMPNTGPTANLSYK  239

Query:  254 EILIETIKEAIPFIITGAAIQIFKLIDQFSFGNTM--ALFTNYSSEELRVMFAYFSSNPG  311
             ++  E    A P++  GAI  ++  ID +F    M  A     S +L ++  Y
Sbjct:  240 KMFFELFSYAAPYVFVGLAIPLYNYIDTNTFNKAMIEAGHQAISQDMLAILTLYVQ----  295

Query:  312 KVTMILIAVATAIAGVGIPLLTENFVKNDKKAAARLVVNNLQMLLMFLLPAVAGSVILAK  371
            K+ MI +++ATA    IP +TE+F  + K  +   +Q +L ++PAV G  +L+
Sbjct:  296 KLVMIPVSLATAFGLTLIPTITESFTSGNYKLLNQQINQTMQTILFLIIPAVVGISLLSG  355

Query:  372 PLYTVFYGL----PQGQALGLFVISLIQTIILSIYTVLAPMLQALFENRKAIIYFLYGLV  427
            P YT FYG     P+   A L  S +  I+ S++TV A +LQ + + A++   G+V
Sbjct:  356 PTYTFFYGSESLHPELGANILLWYSPV-AILFSLFTVNAAILQGINKQKFAVVSLVIGVV  414

Query:  428 AKVILQLPSIFLFHAYGPLFSTTVALCIPVILMYLKIHEITGFKRQAIRRTSALVLILTL  487
             K++L +P I L  AG ++ T +   ++  ++I   G+ + + +   L+L+L+
Sbjct:  415 IKLVLNVPLIKLMQADGAILATALGYIASLLYGFIMIKRHAGYSYKILVKRTVLMLVLSA  474

Query:  488 LMSFIISMIIWLMNLVI-VPDSRLVSLVYIIVIGAIGLGVYGFMALATHLLDKMIGSRAQ  546
             +M  + ++ W++   I   D ++ + + +++ A+G   VY  +    L K++G R
Sbjct:  475 IMGIAVKIVQWVLGFFISYQDGQHQAAIVVVIAAAVGGAVYLYCGYRLGFLQKILGRRLP  534

Query:  547 DLRRK                                                        551
            RK
Sbjct:  535 GFFRK                                                        539
```

A related DNA sequence was identified in *S. pyogenes* <SEQ ID 3681> which encodes the amino acid sequence <SEQ ID 3682>. Analysis of this protein sequence reveals the following:

```
Possible site: 49
>>> Seems to have no N-terminal signal sequence
      INTEGRAL    Likelihood = -8.60    Transmembrane    468-484 (466-493)
      INTEGRAL    Likelihood = -8.39    Transmembrane    305-321 (299-323)
      INTEGRAL    Likelihood = -7.75    Transmembrane    343-359 (340-362)
      INTEGRAL    Likelihood = -6.58    Transmembrane    374-390 (373-398)
      INTEGRAL    Likelihood = -4.25    Transmembrane    138-154 (137-157)
      INTEGRAL    Likelihood = -3.45    Transmembrane    100-116 (98-122)
      INTEGRAL    Likelihood = -3.40    Transmembrane    415-431 (410-432)
      INTEGRAL    Likelihood = -3.35    Transmembrane    499-515 (499-519)
      INTEGRAL    Likelihood = -2.60    Transmembrane    433-449 (432-451)
      INTEGRAL    Likelihood = -2.50    Transmembrane    173-189 (173-190)
      INTEGRAL    Likelihood = -0.59    Transmembrane    201-217 (201-220)

----- Final Results -----
           bacterial membrane --- Certainty = 0.4439(Affirmative) < succ>
            bacterial outside --- Certainty = 0.0000(Not Clear)   < succ>
          bacterial cytoplasm --- Certainty = 0.0000(Not Clear)   < succ>
```

The protein has homology with the following sequences in the databases:

```
>GP: AAC00276 GB: AF008220 YtgP [Bacillus subtilis]
Identities = 169/536 (31%), Positives = 295/536 (54%), Gaps = 24/536 (4%)

Query:  14 MVQGAAWSTAGNFISRLLGVLYIIPWYIWMGQYAIQANALFNMGYNVYAYFLLISTTGLN   73
           +++G   T G +ISR+LG++Y+IP+ I +G        ALF  GYN Y  FL I+T G
Sbjct:   5 LLRGTFVLTLGTYISRILGMVYLIPFSIMVGA---TGGALFQYGYNQYTLFLNIATMGFP   61

Query:  74 VAIAKQVAKYNSMGQTEHSYQLIRSTLKLMLGLGLIFSAIMYLGSPLFASLS-GGDDT-- 130
           A++K V+KYNS G  E S ++++++ + ML G+I   I+YL +P+FA +S GG D
Sbjct:  62 AAVSKFVSKYNSKGDYETSRKMLKAGMSVMLVTGMIAFFILYLSAPMFAEISLGGKDNNG 121

Query: 131 -----LVPIMHSLSLAVFIFPVMSVIRGIFQGHNNIKPYAVSQIAEQLIRVIWMLLTTFF 185
                +V ++  +SLA+ + P+MS++RG FQGH   P AVSQ+ EQ++R+I++L   TF
Sbjct: 122 LTIDHVVYVIRMVSLALLVVPIMSLVRGFFQGHQMMGPTAVSQVVEQIVRIIFLLSATFL 181

Query: 186 IMKLGSGDYASAVTQSTFAAFIGMVASMGVLGYYLW--KQGLLAAIFSKPDHTVSIDIKG 243
           I+K+ +G    AV +TFAA IG   + VL Y W  ++G L A+      T ++  K
Sbjct: 182 ILKVFNGGLVIAVGYATFAALIGAFGGLVVL-YIYWNKRKGSLLAMMPNTGPTANLSYKK 240

Query: 244 LLLETLKESIPFIVTGSAIQAFQLIDQWTFVNTMTLFTDYSRSQ--LLVLFGYFNANPAK 301
             + E   +P++  G AI   + ID TF  M      + SQ  L +L Y        K
Sbjct: 241 MFFELFSYAAPYVFVGLAIPLYNYIDTNTFNKAMIEAGHQAISQDMLAILTLYVQ----K 296

Query: 302 ITMVLIAVAASIGGVGIALLTENYVKKDMKAAARLIINNIEMLVMFLLPALTGAIILARP 361
            + M+ +++A + G   I   +TE+++    + K    + I    ++ ++PA+ G  +L+ P
Sbjct: 297 LVMIPVSLATAFGLTLIPTITESFTSGNYKLLNQQINQTMQTILFLIIPAVVGISLLSGP 356

Query: 362 LYSVFYGASE---ERAIHLFVAVLFQTLLLALYTLFSPMLQALFENRKAIYYFAYGILIK 418
           Y+ FYG+     E   ++ +     +L +L+T+ + +LQ + +  A+       G++IK
Sbjct: 357 TYTFFYGSESLHPELGANILLWYSPVAILFSLFTVNAAILQGINKQKFAVVSLVIGVVIK 416

Query: 419 LVLQIPLIYLLHAYGPLLATTIALVVPIYLMYRRLYQVTHFNRKLLQKRLLLTLIETLLM 478
           LVL +PLI L+ A G +LAT +    +   +  + ++ K+L KR +L L+ + +M
Sbjct: 417 LVLNVPLIKLMQADGAILATALGYIASLLYGFIMIKRHAGYSYKILVKRTVLMLVLSAIM 476

Query: 479 GLVVFVANWLLGYAFK-PTGRLTSLLYLLIIGGLGMTVYTALTLLTHQLDKLIGSK     533
           G+ V + W+LG+      G++ + + ++I  +G  VY      L K++G +
Sbjct: 477 GIAVKIVQWVLGFFISYQDGQMQAAIVVVIAAAVGGAVYLYCGYRLGFLQKILGRR     532
```

An alignment of the GAS and GBS proteins is shown below.

```
dentities = 320/541 (59%), Positives = 431/541 (79%)

IQuery:    12 MSQKTTKVSQQEQMVKGTAWLTAGNFISRLLGAIYIIPWYAWMGKHAAEANALFGMGYEI    71
              MS +  +++Q+E MV+G AW TAGNFISRLLG +YIIPWY WMG++A +ANALF MGY +
Sbjct:      1 MSTEKKQLTQEELMVQGAAWSTAGNFISRLLGVLYIIPWYIWMGQYAIQANALFNMGYNV    60

Query:     72 YALFLLISTVGIPVAVAKQVSKYNTLGKEEMSIYLVRKILQFMLILGGIFALIMYIGSPL   131
              YA FLLIST G+ VA+AKQV+KYN++G+ E S   L+R  L+ ML LG IF+ IMY+GSPL
Sbjct:     61 YAYFLLISTTGLNVAIAKQVAKYNSMGQTEHSYQLIRSTLKLMLGLGLIFSAIMYLGSPL   120

Query:    132 FASLSKGGQELVPILRSLTLAVLVFPSMSVLRGFFQGFNNLKPYAISQVAEQIIRVIWML   191
              FASLS G   LVPI+ SL+LAV +FP MSV+RG FQG NN+KPYA SQ+AEQ+IRVIWML
```

-continued

```
Sbjct:   121 FASLSGGDDTLVPIMHSLSLAVFIFPVMSVIRGIFQGHNNIKPYAVSQIAEQLIRVIWML   180

Query:   192 LTAFYIMRLGSGDYIAAVTQSTFAAFVGMFASIAVLLYFLWRYNMLSALIGKTPKHIKLD   251
             LT F+IM+LGSGDY +AVTQSTFAAF+GM AS+ VL Y+LW+   +L+A+  K    + +D
Sbjct:   181 LTTFFIMKLGSGDYASAVTQSTFAAFIGMVASMGVLGYYLWKQGLLAAIFSKPDHTVSID   240

Query:   252 TKEILIETIKEAIPFIITGAAIQIFKLIDQFSFGNTMALFTNYSSEELRVMFAYFSSNPG   311
             K +L+ET+KE+IPFI+TG+AIQ F+LIDQ++F NTM LFT+YS   +L V+F YF++NP
Sbjct:   241 IKGLLLETLKESIPFIVTGSAIQAFQLIDQWTFVNTMTLFTDYSRSQLLVLFGYFNANPA   300

Query:   312 KVTMILIAVATAIAGVGIPLLTENFVKNDKKAAARLVVNNLQMLLMFLLPAVAGSVILAK   371
             K+TM+LIAVA +I GVGI LLTEN+VK D KAAARL++NN++ML+MFLLPA+ G++ILA+
Sbjct:   301 KITMVLIAVAASIGGVGIALLTENYVKKDMKAAARLIINNIEMLVMFLLPALTGAIILAR   360

Query:   372 PLYTVFYGLPQGQALGLFVISLIQTIILSIYTVLAPMLQALFENRKAIIYFLYGLVAKVI   431
             PLY+VFYG  + +A+ LFV  L QT++L+++YT+ +PMLQALFENRKAI YF  YG++ K++
Sbjct:   361 PLYSVFYGASEERAIHLFVAVLFQTLLLALYTLFSPMLQALFENRKAIYYFAYGILIKLV   420

Query:   432 LQLPSIFLFHAYGPLFSTTVALCIPVILMYLKIHEITGFKRQAIRRTSALVLILTLLMSF   491
             LQ+P I+L HAYGPL +TT+AL +P+ LMY +++++T F R+ +++    L LI TLLM
Sbjct:   421 LQIPLIYLLHAYGPLLATTIALVVPIYLMYRRLYQVTHFNRKLLQKRLLLTLIETLLMGL   480

Query:   492 IISMIIWLMNLVIVPDSRLVSLVYIIVIGAIGLGVYGFMALATHLLDKMIGSRAQDLRRKL   552
             ++ +  WL+      P  RL SL+Y+++IG +G+ VY +   + L TH LDK+IGS+A  LR+KL
Sbjct:   481 VVFVANWLLGYAFKPTGRLTSLLYLLIIGGLGMTVYTALTLLTHQLDKLIGSKASRLRQKL   541
```

Based on this analysis, it was predicted that these proteins and their epitopes could be useful antigens for vaccines or diagnostics.

EXAMPLE 1183

A DNA sequence (GBSx1259) was identified in *S. agalactiae* <SEQ ID 3683> which encodes the amino acid sequence <SEQ ID 3684>. Analysis of this protein sequence reveals the following:

```
Possible site: 40
>>> Seems to have no N-terminal signal sequence

----- Final Results -----
              bacterial cytoplasm --- Certainty = 0.4104(Affirmative) < succ>
              bacterial membrane --- Certainty = 0.0000(Not Clear)   < succ>
               bacterial outside --- Certainty = 0.0000(Not Clear)   < succ>
```

The protein has homology with the following sequences in the GENPEPT database.

```
>GP: BAB06290 GB: AP001515 UDP-N-acetylmuramoylalanyl-D-glutamyl-2,
6-diaminopimelate ligase [Bacillus halodurans]
Identities = 153/468 (32%), Positives = 237/468 (49%), Gaps = 23/468 (4%)

Query:    33 NVTFNALSYDSRQISSDTLFFA-KGATFK-KEYLDSAITAGLSFYVSETDYGADIPVILV    90
              N   +++  DSR++    LFF  KG T   +Y  A++  G    VSE       +PV++V
Sbjct:    21 NPDIHSIHMDSREVVEGGLFFCIKGYTVDGHDYAQQAVSNGAVAVVSERPLELSVPVVVV    80

Query:    91 NDIKKAMSLISMSFYNNPQNKLKLLAFTGTKGKTTAAYFAYHMLKVNHR-PAMLSTMNTT   149
              D ++AM+ ++   FY  P N L+L+  TGT GKTT  +     +++     +   ++ TM T
Sbjct:    81 RDSRRAMAQVATKFYGEPTNDLQLIGVTGTNGKTTITHLIEKIMQDQGKMTGLIGTMYTK   140

Query:   150 LDGKSFFKSHLTTPESLDLFRMMATAVENQMTHLIMEVSSQAYLTKRVYGLTFDVGVFLN   209
              + G    ++  TTPESL L R  A   ++ +T +MEVSS A  + RV G  FDV VF N
Sbjct:   141 I-GHELKETKNTTPESLVLQRTFADMKKSGVTTAMMEVSSHALQSGRVRGCDFDVAVFSN   199

Query:   210 ISPDHIGPIEHPTFEDYFFHKRLLME------NSNAVVVN----SQMDHFNIVKEQVEYI   259
              ++PDH+    H T E YF K LL        V+N    + D    + QV
Sbjct:   200 LTPDHLD--YHGTMERYKFAKGLLFAQLGNTYQGKVAVLNADDPASADFAEMTIAQVVTY   257

Query:   260 PHDFYGDY-SENVITESKAFSFHVKGKLEN-TYDIKLIGKFNQENAIAAGLACLRLGVSI   317
                    + D+ +ENV   S   +F +     E    I LIGKF+  N +AA  A     GV +
Sbjct:   258 GIENEADFQAENVRITSTGTTFELAAFEERMELSIHLIGKFSVYNVLAAAAAYVSGVPL   317

Query:   318 EDIKNGIAQTT-VPGRMEVLTQTNGAKIFVDYAHNGDSLKKLLAVVEEHQKGDIILVLGA   376
              ++IK  + +    V GR E +      + VDYAH  DSL+  +L  V E   KGD+ +V+G
```

```
                          -continued
Sbjct: 318 QEIKKSLEEVKGVAGRFETVKHDQPFTVIVDYAHTPDSLENVLKTVGELAKGDVRVVVGC  377

Query: 377 PGNKGQSRRKDFGDVINQHPNLQVILTADDPNFEDPLVISQEIASHINRPVTIII-DREE  435
           G++ +++R     ++      N Q I T+D+P  E+P+ I +++           ++I DR+E
Sbjct: 378 GGDRDKTKRPVMAEIATTFAN-QAIFTSDNPRSEEPMDILRDMEQGAKGDSYLMIEDRKE  436

Query: 436 AIANASTLTNCKLDAIIIAGKGADAYQIIKGNRDNYSGDLEVAKKYLK             483
           AI  A  L    + D I+IAGKG + YQ +     ++  D  VA++ +K
Sbjct: 437 AIFKAIELAK-EDDIIVIAGKGHETYQQFRDRTIDFD-DRIVAQQAIK             482
```

A related DNA sequence was identified in *S. pyogenes* <SEQ ID 3685> which encodes the amino acid sequence <SEQ ID 3686>. Analysis of this protein sequence reveals the following:

```
Possible site: 59
>>> Seems to have no N-terminal signal sequence

----- Final Results -----
            bacterial cytoplasm --- Certainty = 0.4717(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below.

```
Identities = 350/482 (72%), Positives = 399/482 (82%), Gaps = 1/482 (0%)

Query:   1 MITIDKILEILKNDHNFREILFHEHYYYNWTQNVTFNALSYDSRQISSDTLFFAKGATFK   60
           MITI+++L+ILK DHNFRE+L  + Y+Y++ Q  +F  LSYDSRQ+    TLFFAKGATFK
Sbjct:   1 MITIEQLLDILKKDHNFREVLDADGYHYHY-QGFSFERLSYDSRQVDGKTLFFAKGATFK   59

Query:  61 KEYLDSAITAGLSFYVSETDYGADIPVILVNDIKKAMSLISMSFYNNPQNKLKLLAFTGT  120
           +YL  AIT GL  Y+SE DY  IPV+LV DIKKAMSLI+M+FY NPQ KLKLLAFTGT
Sbjct:  60 ADYLKEAITNGLQLYISEVDYELGIPVVLVTDIKKAMSLIAMAFYGNPQEKLKLLAFTGT  119

Query: 121 KGKTTAAYFAYHMLKVNHRPAMLSTMNTTLDGKSFFKSHLTTPESLDLFRMMATAVENQM  180
           KGKTTAAYFAYHMLK +++PAM STMNTTLDGK+FFKS LTTPESLDLF MMA  V N M
Sbjct: 120 KGKTTAAYFAYHMLKESYKPAMFSTMNTTLDGKTFFKSQLTTPESLDLFAMMAECVTNGM  179

Query: 181 THLIMEVSSQAYLTKRVYGLTFDVGVFLNISPDHIGPIEHPTFEDYFFHKRLLMENSNAV  240
           THLIMEVSSQAYL  RVYGLTFDVGVFLNISPDHIGPIEHPTFEDYF+HKRLLMENS AV
Sbjct: 180 THLIMEVSSQAYLVDRVYGLTFDVGVFLNISPDHIGPIEHPTFEDYFYHKRLLMENSRAV  239

Query: 241 VVNSQMDHFNIVKEQVEYIPHDFYGDYSENVITESKAFSFHVKGKLENTYDIKLIGKFNQ  300
           V+NS MDHF+ + +QV    H FYG  S+N IT S+AFSF  KG+L   YDI+LIG FNQ
Sbjct: 240 VINSGMDHFSFLADQVADQEHVFYGPLSDNQITTSQAFSFEAKGQLAGHYDIQLIGHFNQ  299

Query: 301 ENAIAAGLACLRLGVSIEDIKNGIAQTTVPGRMEVLTQTNGAKIFVDYAHNGDSLKKLLA  360
           ENA+AAGLACLRLG S+ DI+ GIA+T VPGRMEVLT TN AK+FVDYAHNGDSL+KLL+
Sbjct: 300 ENAMAAGLACLRLGASLADIQKGIAKTRVPGRMEVLTMTNHAKVFVDYAHNGDSLEKLLS  359

Query: 361 VVEEHQKGDIILVLGAPGNKGQSRRKDFGDVINQHPNLQVILTADDPNFEDPLVISQEIA  420
           VVEEHQ G ++L+LGAPGNKG+SRR DFG VI+QHPNL VILTADDPNFEDP  IS+EIA
Sbjct: 360 VVEEHQTGKLMLILGAPGNKGESRRADFGRVIHQHPNLTVILTADDPNFEDPEDISKEIA  419

Query: 421 SHINRPVTIIIDREEAIANASTLTNCKLDAIIIAGKGADAYQIIKGNRDNYSGDLEVAKKYL  482
           SHI RPV II DRE+AI  A  +L       DA+IIAGKGADAYQI+KG +   Y+GDL +AK YL
Sbjct: 420 SHIARPVEIISDREQAIQKAMSLCQGAKDAVIIAGKGADAYQIVKGQQVAYAGDLAIAKHYL  481
```

Based on this analysis, it was predicted that these proteins and their epitopes could be useful antigens for vaccines or diagnostics.

EXAMPLE 1184

A DNA sequence (GBSx1260) was identified in *S. agalactiae* <SEQ ID 3687> which encodes the amino acid sequence <SEQ ID 3688>. Analysis of this protein sequence reveals the following:

```
Possible site: 29
>>> Seems to have no N-terminal signal sequence

----- Final Results -----
            bacterial cytoplasm --- Certainty = 0.1421(Affirmative) < succ>
             bacterial membrane --- Certainty = 0.0000(Not Clear)   < succ>
              bacterial outside --- Certainty = 0.0000(Not Clear)   < succ>
```

The protein has no significant homology with any sequences in the GENPEPT database.

No corresponding DNA sequence was identified in S. pyogenes.

Based on this analysis, it was predicted that this protein and its epitopes, could be useful antigens for vaccines or diagnostics.

EXAMPLE 1185

A DNA sequence (GBSx1261) was identified in S. agalactiae <SEQ ID 3689> which encodes the amino acid sequence <SEQ ID 3690>. This protein is predicted to be FhuA (fepC). Analysis of this protein sequence reveals the following:

```
Possible site: 54
>>> Seems to have no N-terminal signal sequence

----- Final Results -----
            bacterial cytoplasm --- Certainty = 0.2785(Affirmative) < succ>
             bacterial membrane --- Certainty = 0.0000(Not Clear)   < succ>
              bacterial outside --- Certainty = 0.0000(Not Clear)   < succ>
```

A related GBS nucleic acid sequence <SEQ ID 9975> which encodes amino acid sequence <SEQ ID 9976> was also identified.

The protein has homology with the following sequences in the GENPEPT database.

```
>GP: AAF98153 GB: AF251216 FhuC [Staphylococcus aureus]
Identities = 141/259 (54%), Positives = 193/259 (74%)

Query:   7 MSHIKAENIIVSYDQKEIINNLSLSILNQKITTIIGANGCGKSTLLKALTRIHKIKDGTI   66
           M+ +  + + +  Y      IIN L + I + K+T+IIG NGCGKSTLLKAL+R+  +K+G +
Sbjct:   1 MNRLHGQQVKIGYGDNTIINKLDVEIPDGKVTSIIGPNGCGKSTLLKALSRLLAVKEGEV    60

Query:  67 TIDGHDIAHLPTKEIAKKIALLPQVLEATEGITVYELISYGRFPHQKYLGNLTNDDRSKI  126
           +DG +I   TKEIAKKIA+LPQ E  +G+TV EL+SYGRFPHQK  G LT +D+ +I
Sbjct:  61 FLDGENIHTQSTKEIAKKIAILPQSPEVADGLTVGELVSYGRFPHQKGFGRLTAEDKKEI  120

Query: 127 HWAMEMTNVAQFANRDVDDLSGGQRQKVWIAMALAQDTDTIFLDEPTTYLDMNHQLEVLE  186
           WAME+T    F +R ++DLSGGQRQ+VWIAMALAQ TD IFLDEPTTYLD+ HQLE+LE
Sbjct: 121 DWAMEVTGTDTFRHRSINDLSGGQRQRVWIAMALAQRTDIIFLDEPTTYLDICHQLEILE  180

Query: 187 LLKKLNDETQKTIIMVLHDLNLSARYSDYLVAMKTGKIIYEGSPSQIMTKDIIKDIFKID  246
           L++KLN E   TI+MVLHD+N +R+SD+L+AMK G II  GS    ++T++I++ +F  ID
Sbjct: 181 LVQKLNQEQGCTIVMVLHDINQAIRFSDHLIAMKEGDIIATGSTEDVLTQEILEKVFNID  240

Query: 247 AHIIQDPISKQPVLLSYQL                                          265
           +  +DP + +P+L++Y L
Sbjct: 241 VVLSKDPKTGKPLLVTYDL                                          259
```

A related DNA sequence was identified in S. pyogenes <SEQ ID 1929> which encodes the amino acid sequence <SEQ ID 1930>. Analysis of this protein sequence reveals the following:

```
Possible site: 48
>>> Seems to have no N-terminal signal sequence

----- Final Results -----
            bacterial cytoplasm --- Certainty = 0.2970(Affirmative) < succ>
```

```
                        -continued
       bacterial membrane --- Certainty = 0.0000(Not Clear) < succ>
       bacterial outside  --- Certainty = 0.0000(Not Clear) < succ>
```

An alignment of the GAS and GBS proteins is shown below.

```
Identities = 166/259 (64%), Positives = 208/259 (80%)

Query:   7 MSHIKAENIIVSYDQKEIINNLSLSILNQKITTIIGANGCGKSTLLKALTRIHKIKDGTI   66
           M+ I AE++ ++Y+Q+ II+ LS  I    KITTIIGANGCGKS+LLKALTR+   K G +
Sbjct:   1 MTTISAEDLTIAYEQRTIIDKLSFYIPEGKITTIIGANGCGKSSLLKALTRLLPPKQGVV   60

Query:  67 TIDGHDIAHLPTKEIAKKIALLPQVLEATEGITVYELISYGRFPHQKYLGNLTNDDRSKI  126
           ++G +IA L TKE+AKK+ALLPQV EAT GITVYEL+SYGRFPHQ Y GNL+  D+   I
Sbjct:  61 YLNGQNIATLETKEVAKKLALLPQVQEATNGITVYELVSYGRFPHQSYFGNLSPADKKAI  120

Query: 127 HWAMEMTNVAQFANRDVDDLSGGQRQKVWIAMALAQDTDTIFLDEPTTYLDMNHQLEVLE  186
           HWAM+ TNV  +A++ VD LSGGQRQ+VW+AMALAQ TDTIFLDEPTTYLD+NHQLE+LE
Sbjct: 121 HWAMQATNVMAYADQPVDALSGGQRQRVWLAMALAQGTDTIFLDEPTTYLDLNHQLEILE  180

Query: 187 LLKKLNDETQKTIIMVLHDLNLSARYSDYLVAMKTGKIIYEGSPSQIMTKDIIKDIFKID  246
           L+K LN +  KTI+MVLHDLNLSARYSD+L+AMK GKI Y G+ + +MT   II+DIF+I
Sbjct: 181 LVKSLNKDAGKTIVMVLHDLNLSARYSDHLIAMKHGKIHYTGTIADVMTSPIIQDIFQIK  240

Query: 247 AHIIQDPISKQPVLLSYQL                                           265
           ++ DPI     P++L+YQL
Sbjct: 241 PVLVDDPIHNCPIVLTYQL                                           259
```

Based on this analysis, it was predicted that these proteins and their epitopes could be useful antigens for vaccines or diagnostics.

EXAMPLE 1186

A DNA sequence (GBSx1262) was identified in *S. agalactiae* <SEQ ID 3691> which encodes the amino acid sequence <SEQ ID 3692>. This protein is predicted to be ferrichrome ABC transporter. Analysis of this protein sequence reveals the following:

```
Possible site: 20
>>> Seems to have a cleavable N-term signal seq.

----- Final Results -----
         bacterial outside  --- Certainty = 0.3000(Affirmative) < succ>
         bacterial membrane --- Certainty = 0.0000(Not Clear)   < succ>
         bacterial cytoplasm --- Certainty = 0.0000(Not Clear)  < succ>
```

The protein has homology with the following sequences in the GENPEPT database.

```
>GP: BAB07609 GB: AP001520 ferrichrome ABC transporter
(ferrichrome-binding protein) [Bacillus halodurans]
Identities = 94/301 (31%), Positives = 177/301 (58%), Gaps = 11/301 (3%)

Query:   6 IIVLTLLTFFLV---SCGQQTKQESTKTTISK--MPKIEGFTYYGKIPENPKKVINFTYS   60
           +++LT+L F L+   +CG  T E      S+  M   E T   ++P NP++V+
Sbjct:   7 LLLLTMLLFALLVVAACGSNTDAEQADELESEDGMITYESETGPIEVPANPQRVV--ALG   64

Query:  61 YTGYLLKLGVNVSSYSLDLEKDSPVFGKQLKEAKKLTADDTEAIAAQKPDLIMVFDQDPN  120
           +TG +L L VNV       K++P + + L++  +++ ++ E I     PDLI+ +    N
Sbjct:  65 FTGNILALDVNVVGVDT-WSKNNPNYEQLLQDVTEVSEENLEQIMELDPDLIIAYSTVQN  123

Query: 121 INTLKKIAPTLVIKYGAQNYLDMMPALGKVFGKEKEANQWVSQWKTKTLAVKKDLHHILK  180
             L++IAPT++  Y  +YL+    +GK+  KE+EA WV +K +     +++    +
Sbjct: 124 AEQLQEIAPTVLYTYNNLDYLEQHVEIGKLLNKEEEAQAWVDDFKARAEQAGEEIKEKIG  183

Query: 181 PNTTFTIMDFYDKNIYLYGNNFGRGGELIYDSLGYAAPEKVKKDVFKKGWFTVSQEAIGD  240
           + T ++++ ++  +Y++GNN+GRG E++Y ++   A PE+V++     G++ +S EA+ +
Sbjct: 184 EDATVSVIETFEDQLYVFGNNWGRGTEILYQTMDLAMPERVEEMALADGYYALSFEALPE  243

Query: 241 YVGDYALVNINKTTKKAASSLKESDVWKNLPAVKKGHIIESNYDVFYFSDPLSLEAQLKSF  30
           + GDY +++ N     +A +S +E++  ++++PAV+ G + E+N   FYF+DPLSLE QL+ F
Sbjct: 244 FAGDYIILSKN---DEADNSFQETNTYQSIPAVQNGQVFEANAKEFYFNDPLSLELQLEFF  301
```

A related DNA sequence was identified in *S. pyogenes* <SEQ ID 3693> which encodes the amino acid sequence <SEQ ID 3694>. Analysis of this protein sequence reveals the following:

```
Possible site: 19
>>> May be a lipoprotein

----- Final Results -----
             bacterial membrane --- Certainty = 0.0000(Not Clear) < succ>
              bacterial outside --- Certainty = 0.0000(Not Clear) < succ>
            bacterial cytoplasm --- Certainty = 0.0000(Not Clear) < succ>
```

The protein has homology with the following sequences in the databases:

```
>GP: BAB07609 GB: AP001520 ferrichrome ABC transporter
(ferrichrome-binding protein) [Bacillus halodurans]
Identities = 112/306 (36%), Positives = 178/306 (57%), Gaps = 3/306 (0%)

Query:   2 KKLTLLLTLCLTTITLIACGNQATNHSNTASKSLSPMPQIAGVTYYGDIPKQPKRVVSLA   61
           K LL  L    + + ACG+         +S  M      T   ++P  P+RVV+L
Sbjct:   5 KHLLLLTMLLFALLVVAACGSNTDAEQADELESEDGMITYESETGPIEVPANPQRVVALG   64

Query:  62 STYTGYLKKLDMNLVGVTSYDKKNPILAKTVKKAKQVAATDLEAVTTLKPDLIVVGSTEE  121
             +TG +   LD+N+VGV ++ K NP  +   +V+  +LE    L PDLI+  ST  +
Sbjct:  65 --FTGNILALDVNVVGVDTWSKNNPNYEQLLQDVTEVSEENLEQIMELDPDLIIAYSTVQ  122

Query: 122 NIKQLAEIAPVISIEYRKRDYLQVLSDFGRIFNKEDKAKKWLKDWKTKTAAYEKEVKAVT  181
           N +QL EIAP +   Y    DYL+   G++ NKE++A+ W+ D+K +     +E+K
Sbjct: 123 NAEQLQEIAPTVLYTYNNLDYLEQHVEIGKLLNKEEEAQAWVDDFKARAEQAGEEIKEKI  182

Query: 182 GDKATFTIMGLYEKDVYLFGKDWGRGGEIIHQAFHYDAPEKVKTEVFKQGYLSLSQEVLP  241
           G+ AT +++  +E  +Y+FG +WGRG EI++Q       PE+V+     GY +LS E LP
Sbjct: 183 GEDATVSVIETFEDQLYVFGNNWGRGTEILYQTMDLAMPERVEEMALADGYYALSFEALP  242

Query: 242 DYIGDYVVVAAEDDKTGSALYESKLWQSIPAVKKHHVIKVNANVFYFTDPLSLEYQLETL  301
           ++ GDY+++ +++D+ ++  E+ +QSIPAV+   V + NA  FYF DPLSLE QLE
Sbjct: 243 EFAGDYIIL-SKNDEADNSFQETNTYQSIPAVQNGQVFEANAKEFYFNDPLSLELQLEFF  301

Query: 302 REAILS                                                        307
           +E  LS
Sbjct: 302 KEHFLS                                                        307
```

An alignment of the GAS and GBS proteins is shown below.

```
Identities = 140/316 (44%), Positives = 212/316 (66%), Gaps = 12/316 (3%)

Query:   1 MKKIGIIV-LTLLTFFLVSCGQQTKQESTKTT--ISKMPKIEGFTYYGKIPENPKKVINF   57
           MKK+ +++ L L T  L++CG Q     S   +  +S MP+I G TYYG IP+ PK+V++
Sbjct:   1 MKKLTLLLTLCLTTITLIACGNQATNHSNTASKSLSPMPQIAGVTYYGDIPKQPKRVVSL   60

Query:  58 TYSYTGYLLKLGVN---VSSYSLDLEKDSPVFGKQLKEAKKLTADDTEAIAAQKPDLIMV  114
           +YTGYL KL +N    V+SY    +K +P+  K +K+AK++ A D EA+   KPDLI+V
Sbjct:  61 ASTYTGYLKKLDMNLVGVTSY----DKKNPILAKTVKKAKQVAATDLEAVTTLKPDLIVV  116

Query: 115 FDQDPNINTLKKIAPTLVIKYGAQNYLDMMPALGKVFGKEKEANQWVSQWKTKTLAVKKD  174
            + NI   L +IAP + I+Y  ++YL ++    G++F KE +A +W+  WKTKT A +K+
Sbjct: 117 GSTEENIKQLAEIAPVISIEYRKRDYLQVLSDFGRIFNKEDKAKKWLKDWKTKTAAYEKE  176

Query: 175 LHHILKPNTTFTIMDFYDKNIYLYGNNFGRGGELIYDSLGYAAPEKVKKDVFKKGWFTVS  234
           +  +     TFTIM  Y+K++YL+G ++GRGGE+I+   Y APEKV  +VFK+G+ ++S
Sbjct: 177 VKAVTGDKATFTIMGLYEKDVYLFGKDWGRGGEIIHQAFHYDAPEKVKTEVFKQGYLSLS  236

Query: 235 QEAIGDYVGDYALVNINKTTKKAASSLKESDVWKNLPAVKKGHIIESNYDVFYFSDPLSL  294
           QE + DY+GDY +     K  S+L ES +W+++PAVKK H+I+ N +VFYF+DPLSL
Sbjct: 237 QEVLPDYIGDYVVVAAE--DDKTGSALYESKLWQSIPAVKKHHVIKVNANVFYFTDPLSL  294

Query: 295 EAQLKSFTKAIKENTN                                              310
           E QL++  +AI + N
Sbjct: 295 EYQLETLREAILSSEN                                              310
```

Based on this analysis, it was predicted that these proteins and their epitopes could be useful antigens for vaccines or diagnostics.

EXAMPLE 1187

A DNA sequence (GBSx1263) was identified in *S. agalactiae* <SEQ ID 3695> which encodes the amino acid sequence <SEQ ID 3696>. Analysis of this protein sequence reveals the following:

```
Possible site: 26
>>> Seems to have no N-terminal signal sequence

----- Final Results -----
          bacterial cytoplasm --- Certainty = 0.3431(Affirmative) < succ>
           bacterial membrane --- Certainty = 0.0000(Not Clear)   < succ>
            bacterial outside --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1188

A DNA sequence (GBSx1264) was identified in *S. agalactiae* <SEQ ID 3697> which encodes the amino acid sequence <SEQ ID 3698>. This protein is predicted to be ferrichrome transport permease (permease). Analysis of this protein sequence reveals the following:

```
Possible site: 39
>>> May be a lipoprotein

INTEGRAL    Likelihood = -12.74    Transmembrane    129-145  (123-150)
        INTEGRAL    Likelihood = -10.67    Transmembrane    248-264  (240-283)
        INTEGRAL    Likelihood = -10.14    Transmembrane    205-221  (196-228)
        INTEGRAL    Likelihood =  -5.95    Transmembrane    319-335  (317-336)
        INTEGRAL    Likelihood =  -3.56    Transmembrane     73-89    (73-90)
        INTEGRAL    Likelihood =  -3.19    Transmembrane    288-304  (288-304)
        INTEGRAL    Likelihood =  -2.76    Transmembrane    266-282  (265-283)
        INTEGRAL    Likelihood =  -2.23    Transmembrane    103-119  (101-122)
        INTEGRAL    Likelihood =  -1.01    Transmembrane    158-174  (158-174)

----- Final Results -----
           bacterial membrane --- Certainty = 0.6095(Affirmative) < succ>
            bacterial outside --- Certainty = 0.0000(Not Clear)   < succ>
          bacterial cytoplasm --- Certainty = 0.0000(Not Clear)   < succ>
```

The protein has homology with the following sequences in the GENPEPT database.

```
>GP: AAF98154 GB: AF251216 FhuB [Staphylococcus aureus]
Identities = 116/313 (37%), Positives = 194/313 (61%), Gaps = 3/313 (0%)

Query:  26 ILFLIGCYASLRFGAINFKTSDLITVLKNPLKNSNAQDVIFDIRLPRIIAAILVGAAMSQ   85
              ++ LI  + S    G   + S +I   + N    ++  Q++I +IR+PR IAA++VG A++
Sbjct:  28 MILLITLFISTLIGDAKIQASTIIEAIFNYNPSNQQQNIINEIRIPRNIAAVIVGMALAV  87

Query:  86 AGAIMQGVTRNAIADPGLLGINAGAGLALVVAYAFLGSMHYSTILIVCLLGSVISCLLVF  145
              +GAI+QGVTRN +ADP L+G+N+GA   AL + YA L +  + ++     LG+++    +V
Sbjct:  88 SGAIIQGVTRNGLADPALIGLNSGASFALALTYAVLPNTSFLILMFAGFLGAILGGAIVL 147

Query: 146 TLSYTKQKGYHQLRLILAGAMISTLFTSVGQVVTLYFKLNRTVIGWQAGGLSQINWKMLI  205
                  +   +++ G++ +R+ILAGA +S + T++  Q + L F+LN+TV  W AGG+S    W  L
Sbjct: 148 MIGRSRRDGFNPMRIILAGAAVSAMLTALSQGIALAFRLNQTVTFWTAGGVSGTTWSHLK 207

Query: 206 IIAPIIILGLLISQLLAHQLTILSLNESVAKALGQKTQLMTAFLLLIVLFLSASSVALIG  265
                P+I + L I   ++ QLTIL+L ES+AK LGQ      ++       L+I + L+   +VA+ G
Sbjct: 208 WAIPLIGIALFIILTISKQLTILNLGESLAKGLGQNVTMIRGICLIIAMILAGIAVAIAG 267

Query: 266 TVSFIGLIIPHFIKLFIPKDYRLLLPLIGFSGATFMIWVDLSSRIINPPSETSISSIISI  325
                 V+F+GL++PH +   I  DY  +LPL    G  ++  D+ +R +     E    +IIS
Sbjct: 268 QVAFVGLMVPHIARFLIGTDYAKILPLTALLGGILVLVADVIARYL---GEAPVGAIISF 324
```

```
Query: 326 VGLPCFLWLIRKG                                                   338
            +G+P FL+L++KG
Sbjct: 325 IGVPYFLYLVKKG                                                   337
```

A related DNA sequence was identified in *S. pyogenes* <SEQ ID 3699> which encodes the amino acid sequence <SEQ ID 3700>. Analysis of this protein sequence reveals the following:

```
Possible site: 54
>>> Seems to have no N-terminal signal sequence

INTEGRAL      Likelihood = -11.09     Transmembrane    256-272 (248-287)
      INTEGRAL      Likelihood = -10.67     Transmembrane     26-42  (23-48)
      INTEGRAL      Likelihood =  -6.90     Transmembrane    137-153 (133-157)
      INTEGRAL      Likelihood =  -5.10     Transmembrane    167-183 (166-187)
      INTEGRAL      Likelihood =  -4.57     Transmembrane    213-229 (210-232)
      INTEGRAL      Likelihood =  -2.02     Transmembrane    112-128 (110-131)

----- Final Results -----
              bacterial membrane --- Certainty = 0.5437(Affirmative) < succ>
               bacterial outside --- Certainty = 0.0000(Not Clear)   < succ>
             bacterial cytoplasm --- Certainty = 0.0000(Not Clear)   < succ>
```

The protein has homology with the following sequences in the databases:

```
>GP: AAF98154 GB: AF251216 FhuB [Staphylococcus aureus]
Identities = 99/274 (36%), Positives = 159/274 (57%), Gaps = 1/274 (0%)

Query:  34 LSFSLCVAIYCHLRFGAVALSHQDLNSILFG-KQNGHKANVLLAIRLPRLFGATLTGSAL    92
           LS  L + ++      G  +    +F     +  N++  IR+PR    A + G AL
Sbjct:  26 LSMILLITLFISTLIGDAKIQASTIIEAIFNYNPSNQQQNIINEIRIPRNIAAVIVGMAL    85

Query:  93 AVSGTIMQAITRNPIAEPGLLGINAGAGLALVLAYAFVPHLYSLIILLSLLGSSLAATL   152
           AVSG I+Q +TRN +A+P L+G+N+GA  AL L YA +P+  + +++     LG+ L    +
Sbjct:  86 AVSGAIIQGVTRNGLADPALIGLNSGASFALALTYAVLPNTSFLILMFAGFLGAILGAI   145

Query: 153 VFGLSYQSGKGYHQLRLVLAGAMVSILLSALGQGITNYYHLANAVIGWQAGGLVGVNWQM   212
            V +       G++ +R++LAGA VS +L+AL QGI    + L    V    W AGG+ G    W
Sbjct: 146 VLMIGRSRRDGFNPMRIILAGAAVSAMLTALSQGIALAFRLNQTVTFWTAGGVSGTTWSH   205

Query: 213 IGYIAPLIILSLCLAQLLSYHLTVLSLSESQAKALGQKTNLISAVFMILVLILSSAAVAI   272
            + +   PLI ++L +   +S   LT+L+L ES AK LGQ    +I   + I+  +IL+   AVAI
Sbjct: 206 LKWAIPLIGIALFIILTISKQLTILNLGESLAKGLGQNVTMIRGICLIIAMILAGIAVAI   265

Query: 273 AGSISFIGLVIPHLMKHFTPHHYRYLLPLCAVSG                            306
           AG ++F+GL++PH+ +          Y  +LPL A+ G
Sbjct: 266 AGQVAFVGLMVPHIARFLIGTDYAKILPLTALLG                            299
```

An alignment of the GAS and GBS proteins is shown below.

```
Identities = 158/295 (53%), Positives = 214/295 (71%), Gaps 1/295 (0%)

Query:   6 KKLVQKNKSNHFWLVFFITLILFLIGCYASLRFGAINFKTSDLITVLKNPLKNSNAQDVI    65
           KK      KS+ FWLVF +         Y   LRFGA+        DL ++L    +N +   +V+
Sbjct:  16 KKTQIITKSHIFWLVFVLLSFSLCVAIYCHLRFGAVALSHQDLNSILFGK-QNGHKANVL    74

Query:  66 FDIRLPRIIAAILVGAAMSQAGAIMQGVTRNAIADPGLLGINAGAGLALVVAYAFLGSMH   125
              IRLPR+   A L G+A++  +G IMQ +TRN IA+PGLLGINAGAGLALV+AYAF+    +H
Sbjct:  75 LAIRLPRLFGATLTGSALAVSGTIMQAITRNPIAEPGLLGINAGAGLALVLAYAFVPHLH   134

Query: 126 YSTILIVCLLGSVISCLLVFTLSYTKQKGYHQLRLILAGAMISTLFTSVGQVVTLYFKLN   185
           YS I+++ LLGS ++  LVF LSY    KGYHQLRL+LAGAM+S L  +++GQ +T Y+ L
Sbjct: 135 YSLIILLSLLGSSLAATLVFGLSYQSGKGYHQLRLVLAGAMVSILLSALGQGITNYYHLA   194

Query: 186 RTVIGWQAGGLSQINWKMLIIIAPIIILGLLISQLLAHQLTILSLNESVAKALGQKTQLM   245
            + VIGWQAGGL  +NW+M+    IAP+IIL L ++QLL++   LT+LSL+ES AKALGQKT L+
Sbjct: 195 NAVIGWQAGGLVGVNWQMIGYIAPLIILSLCLAQLLSYHLTVLSLSESQAKALGQKTNLI   254
```

```
Query: 246 TAFLLLIVLFLSASSVALIGTVSFIGLIIPHFIKLFIPKDYRLLLPLIGFSGATF     300
            +A   +++VL LS+++VA+ G++SFIGL+IPH +K F P  YR LLPL   SGA+F
Sbjct: 255 SAVFMILVLILSSAAVAIAGSISFIGLVIPHLMKHFTPHHYRYLLPLCAVSGASF    309
```

Based on this analysis, it was predicted that these proteins and their epitopes could be useful antigens for vaccines or diagnostics.

EXAMPLE 1189

A DNA sequence (GBSx1265) was identified in *S. agalactiae* <SEQ ID 3701> which encodes the amino acid sequence <SEQ ID 3702>. Analysis of this protein sequence reveals the following:

```
Possible site: 13
>>> Seems to have no N-terminal signal sequence

----- Final Results -----
            bacterial cytoplasm --- Certainty = 0.1492(Affirmative) < succ>
            bacterial membrane  --- Certainty = 0.0000(Not Clear)   < succ>
            bacterial outside   --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1190

A DNA sequence (GBSx1266) was identified in *S. agalactiae* <SEQ ID 3703> which encodes the amino acid sequence <SEQ ID 3704>. This protein is predicted to be ferrichrome transport permease (permease). Analysis of this protein sequence reveals the following:

```
Possible site: 30
>>> Seems to have a cleavable N-term signal seq.

INTEGRAL    Likelihood = -10.35    Transmembrane    282-298 (279-309)
            INTEGRAL    Likelihood =  -7.06    Transmembrane    120-136 (115-141)
            INTEGRAL    Likelihood =  -7.01    Transmembrane     62-78  (61-80)
            INTEGRAL    Likelihood =  -6.10    Transmembrane    250-266 (241-272)
            INTEGRAL    Likelihood =  -5.52    Transmembrane    196-212 (190-215)
            INTEGRAL    Likelihood =  -5.47    Transmembrane    155-171 (151-174)
            INTEGRAL    Likelihood =  -4.99    Transmembrane    304-320 (303-322)
            INTEGRAL    Likelihood =  -3.35    Transmembrane     91-107 (90-110)

----- Final Results -----
            bacterial membrane  --- Certainty = 0.5140(Affirmative) < succ>
            bacterial outside   --- Certainty = 0.0000(Not Clear)   < succ>
            bacterial cytoplasm --- Certainty = 0.0000(Not Clear)   < succ>
```

The protein has homology with the following sequences in the GENPEPT database.

```
>GP: AAF98155 GB: AF251216 FhuG [Staphylococcus aureus]
Identities = 122/334 (36%), Positives = 208/334 (61%), Gaps = 3/334 (0%)

Query:   1 MIQKNKAPFVLISSVIILLLLILV---SISLGYANTSVIDVLKLISGKSDDAFLFIITNI   57
           MI     LI+  +  +LL L       SI+ G  N  V     K + G+ D      I+ +
Sbjct:   1 MISSNNKRRQLIALAVFSILLFLGCTWSITSGEYNIPVERFFKTLIGQGDAIDELILLDF   60

Query:  58 RLPRIIVCIFGGASLGIAGLLLQTLTKNPLADSGILGINAGAGLVIALTIGTFNVSNPTI  117
           RLPR+++ I   GA+L I+G ++Q++TKNP+A+  GILGINAG G    IAL I     ++
Sbjct:  61 RLPRMMITILAGAALSISGAIVQSVTKNPIAEPGILGINAGGGFAIALFIAIGKINADNF  120

Query: 118 LYFLPLFAMFGGLVTIFLIYLMSYRRNHNISPTRLIVTGIGISTIISGVMILIISQSNNQ  177
           +Y LPL ++ GG+ T   +I++ S+ +N   ++P  +++  G+G+ T  G   I  I+S+ +++
Sbjct: 121 VYVLPLISILGGITTALIIFIFSFNKNEGVTPASMVLIGVGLQTALYGGSITIMSKFDDK  180

Query: 178 KMDMIVEWLSGKITISSWTTIITFIPILILLWGLAYSRSRHLNIMNLNEQTALALGLHLK  237
            + D I  W +G I    W   +I F+P ++++      +S  LNI++  +  A  LG+  L
Sbjct: 181 QSDFIAAWFAGNIWGDEWPFVIAFLPWVLIIIPYLLFKSNTLNIIHTGDNIARGLGVRLS  240
```

```
                                -continued
Query:  238 KERIYTLMLTSSLAAISVVLIGNITFIGLLAGHLSRRLLGNNHKIILPSCLLIGAIILLV  297
            +ER+      L++ +V + G+I+FIGL+  H+++R++G   H++ LP   +L+GA +L++
Sbjct:  241 RERLILFFIAVMLSSAAVAVAGSISFIGLMGPHIAKRIVGPRHQLFLPIAILVGACLLVI  300

Query:  298 SDTIGRLLLVGTGIPTGLVVSIIGAPYFLWLMTK                            331
            +DTIG+++L   G+P G+VV+IIGAPYFL+LM K
Sbjct:  301 ADTIGKIVLQPGGVPAGIVVAIIGAPYFLYLMYK                            334
```

A related DNA sequence was identified in *S. pyogenes* <SEQ ID 1939> which encodes the amino acid sequence <SEQ ID 1940>. Analysis of this protein sequence reveals the following:

```
Possible site: 37
>>> Seems to have no N-terminal signal sequence

INTEGRAL    Likelihood = -10.93    Transmembrane    254-270  (252-284)
        INTEGRAL    Likelihood = -10.46    Transmembrane    294-310  (292-320)
        INTEGRAL    Likelihood =  -6.74    Transmembrane     25-41   (18-43)
        INTEGRAL    Likelihood =  -6.26    Transmembrane    103-119  (102-125)
        INTEGRAL    Likelihood =  -3.66    Transmembrane    164-180  (164-186)
        INTEGRAL    Likelihood =  -3.03    Transmembrane    209-225  (207-226)
        INTEGRAL    Likelihood =  -2.71    Transmembrane     74-90   (74-91)
        INTEGRAL    Likelihood =  -2.13    Transmembrane    326-342  (325-343)
        INTEGRAL    Likelihood =  -1.97    Transmembrane    135-151  (135-151)

----- Final Results -----
            bacterial membrane  --- Certainty = 0.5373(Affirmative) < succ>
            bacterial outside   --- Certainty = 0.0000(Not Clear)   < succ>
          bacterial cytoplasm   --- Certainty = 0.0000(Not Clear)   < succ>
```

An alignment of the GAS and GBS proteins is shown below.

```
Identities = 153/322 (47%), Positives = 229/322 (70%), Gaps = 1/322 (0%)

Query:   11 LISSVIILLLLIL-VSISLGYANTSVIDVLKLISGKSDDAFLFIITNIRLPRIIVCIFGG   69
            L +S+I+LL+  ++ +++SLG ++ S +D++ +   GKS  A  FI+ NIRLPRI+
Sbjct:   22 LYTSLILLLVSLMGLALSLGESHLSFLDLVHVFLGKSSHAISFIVINIRLPRILAACLGG   81

Query:   70 ASLGIAGLLLQTLTKNPLADSGILGINAGAGLVIALTIGTFNVSNPTILYFLPLFAMFGG  129
            SL ++GLLLQ LT+NPLADSG+LGI   GAG+ +A+      +    I ++LPLFAM G
Sbjct:   82 GSLALSGLLLQRLTRNPLADSGVLGITIGAGISLAIVVSFSFFEQAHISHYLPLFAMLGA  141

Query:  130 LVTIFLIYLMSYRRNHNISPTRLIVTGIGISTIISGVMILIISQSNNQKMDHIVEWLSGK  189
            +VT F +Y +S  +    I PTRLI+TG+ ++T++S +M+ ++    N  K+D+++ WLSG+
Sbjct:  142 IVTTFSVYWLSLTKQGQIDPTRLILTGVAVTTMLSSLMVALVGHINRYRVDLVINWLSGQ  201

Query:  190 ITISSWTTIITFIPILILLWGLAYSRSRHLNIMNLNEQTALALGLHLKKERIYTLMLTSS  249
              +    W T+    P+L+  W L YS++  LNIM L + TA+ LGL L ++R    L+L +
Sbjct:  202 LIGDDWPTLSVIAPLLLCFWLLTYSQAHFLNIMGLADNTAIGLGLPLNRKRRLILVLAAG  261

Query:  250 LAAISVVLIGNITFIGLLAGHLSRRLLGNNHKIILPSCLLIGAIILLVSDTIGRLLLVGT  309
            L A+SV+L+GNI+FIGL+AGH S  L+G+NHKI +P  +LIG I+LLV+DT+GR+ LVG+
Sbjct:  262 LGALSVLLVGNISFIGLIAGHFSTYLVGSNHKITIPISILIGMILLLVADTVGRVYLVGS  321

Query:  310 GIPTGLVVSIIGAPYFLWLMTK                                        331
            I TG++VS+IGAPYFL+LM K
Sbjct:  322 NIQTGILVSLIGAPYFLYLMAK                                        343
```

There is also homology to SEQ ID 396.

Based on this analysis, it was predicted that these proteins and their epitopes could be useful antigens for vaccines or diagnostics.

EXAMPLE 1191

A DNA sequence (GBSx1267) was identified in *S. agalactiae* <SEQ ID 3705> which encodes the amino acid sequence <SEQ ID 3706>. Analysis of this protein sequence reveals the following:

```
Possible site: 44
>>> Seems to have no N-terminal signal sequence

----- Final Results -----
            bacterial cytoplasm --- Certainty = 0.3785(Affirmative) < succ>
             bacterial membrane --- Certainty = 0.0000(Not Clear)  < succ>
              bacterial outside --- Certainty = 0.0000(Not Clear)  < succ>
```

The protein has homology with the following sequences in the GENPEPT database.

```
>GP: AAC05779 GB: AF051356 unknown [Streptococcus mutans]
Identities = 49/93 (52%), Positives = 63/93 (67%)

Query:   1 MILTFNPGKLERQEFFKELINYLWIHDDVTLRKIKSHFTDYSKIDRLLEEYINHGYILRQ   60
           MI  +N  KL RQ FF +LINYL IHDDVTLR+IK +F D   ++R +E+Y+  GY+LR+
Sbjct:   1 MIKIYNGDKLTRQPFFIKLINYLQIHDDVTLRQIKRNFADTEHLERSIEDYVQAGYVLRE   60

Query:  61 NKRYSLNLPFLSSLDGLVLDDLVFIDSDSQIYQ                             93
           NK Y      L +LDGL LD  +F+D  S IYQ
Sbjct:  61 NKHYYNAFELLENLDGLTLDSQIFVDDQSSIYQ                             93
```

A related DNA sequence was identified in *S. pyogenes* <SEQ ID 3707> which encodes the amino acid sequence <SEQ ID 3708>. Analysis of this protein sequence reveals the following:

```
Possible site: 54
>>> Seems to have no N-terminal signal sequence

----- Final Results -----
            bacterial cytoplasm --- Certainty = 0.3447 (Affirmative) < succ>
             bacterial membrane --- Certainty = 0.0000 (Not Clear)  < succ>
              bacterial outside --- Certainty = 0.0000 (Not Clear)  < succ>
```

An alignment of the GAS and GBS proteins is shown below.

```
Identities = 108/212 (50%), Positives = 143/212 (66%)

Query:    1 MILTFNPGKLERQEFFKELINYLWIHDDVTLRKIKSHFTDYSKIDRLLEEYINHGYILRQ   60
            MI  F+  KL RQ FF++LINYL  HD V LR+IK  F + + ID+ +E Y+  GYI R+
Sbjct:    1 MITVPHSDKLTRQPFFQDLINYLDQHDHVILREIKKAFPNVTGIDKAIESYVQAGYIRRE   60

Query:   61 NKRYSLNLPFLSSLDGLVLDDLVFIDSDSQIYQLLQKRKFVTNLDNPTNHLVFVEETDFE  120
            NKRY +NLP +SS   L LD ++F+D+ S +Y+ +      F T L N TN ++  E+T+
Sbjct:   61 NKRYGINLPLVSSDQQLALDTMLFVDTCSAMYENILAVVFETQLTNQTNRVMIKEKTNIT  120

Query:  121 RNTLTLSNYFYKLTNGYPLSREQKKLYQLLGDVNSEYALKYMSSFILKFLRKDSVKQKRT  180
            R+ LTL+NYFY+L  G    S EQ  LY LLGDVN EYALKYM++F+LKF RKD V QKR
Sbjct:  121 RDDLTLANYFYRLKRGEKPSAEQMDLYDLLGDVNQEYALKYMTTFLLKFTRKDFVMQKRP  180

Query:  181 VIFIQALELLGYISLNQDTTYRLNAKLDVEAL                             212
            +IF++AL  LGY+    + TTY+L   LD E+L
Sbjct:  181 DIFVEALVTLGYLKQVEPTTYQLLMTLDKESL                             212
```

Based on this analysis, it was predicted that these proteins and their epitopes could be useful antigens for vaccines or diagnostics.

EXAMPLE 1192

A DNA sequence (GBSx1268) was identified in *S. agalactiae* <SEQ ID 3709> which encodes the amino acid sequence <SEQ ID 3710>. Analysis of this protein sequence reveals the following:

```
Possible site: 24
>>> Seems to have no N-terminal signal sequence
```

-continued

```
----- Final Results -----
          bacterial cytoplasm --- Certainty = 0.0824 (Affirmative) < succ>
          bacterial membrane  --- Certainty = 0.0000 (Not Clear)   < succ>
          bacterial outside   --- Certainty = 0.0000 (Not Clear)   < succ>
```

The protein has homology with the following sequences in the GENPEPT database.

```
>GP: AAB39104 GB: U57759 intrageneric coaggregation-relevant adhesin
[Streptococcus gordonii]
Identities = 261/311 (83%), Positives = 283/311 (90%)

Query:   1 MSKILVFGHQNPDSDAIGSSVAFAYLAKEAWGLDTEAVALGTPNEETAYVLDYFGVQAPR    60
           MSKILVFGHQNPDSDAIGSS AFAYLA+EA+GLDTEAVALG PNEETA+VLDYFGV APR
Sbjct:   1 MSKILVFGHQNPDSDAIGSSYAFAYLAREAYGLDTEAVALGEPNEETAFVLDYFGVAAPR    60

Query:  61 VVESAKAEGVETVILTDHNEFQQSISDIKDVTVYGVVDHHRVANFETANPLYMRLEPVGS   120
           V+ SAKAEG E VILTDHNEFQQS++DI +V VYGVVDHHRVANFETANPLYMRLEPVGS
Sbjct:  61 VITSAKAEGAEQVILTDHNEFQQSVADIAEVEVYGVVDHHRVANFETANPLYMRLEPVGS   120

Query: 121 ASSIVYRMFKENGVSVPKELAGLLLSGLISDTLLLKSPTTHASDIPVAKELAELAGVNLE   180
           ASSIVYRMFKE+ V+V KE+AGL+LSGLISDTLLLKSPTTH +D  +A ELAELAGVNLE
Sbjct: 121 ASSIVYRMFKEHSVAVSKEIAGLMLSGLISDTLLLKSPTTHPTDKAIAPELAELAGVNLE   180

Query: 181 EYGLEMLKAGTNLSSKTAAELIDIDAKTFELNGEAVRVAQVNTVDINDILARQEEIEVAI   240
           EYGL MLKAGTNL+SK+A ELIDIDAKTFELNG  VRVAQVNTVDI ++L RQ EIE AI
Sbjct: 181 EYGLAMLKAGTNLASKSAEELIDIDAKTFELNGNNVRVAQVNTVDIAEVLERQAEIEAAI   240

Query: 241 QEAIVTEGYSDFVLMITDIVNSNSEILALGSNMAKVEAAFEFTLENNHAFLAGAVSRKKQ   300
           ++AI   GYSDFVLMITDI+NSNSEILA+GSNM KVEAAF F LENNHAFLAGAVSRKKQ
Sbjct: 241 EKAIADNGYSDFVLMITDIINSNSEILAIGSNMDKVEAAFNFVLENNHAFLAGAVSRKKQ   300

Query: 301 VVPQLTESYNA                                                   311
           VVPQLTES+NA
Sbjct: 301 VVPQLTESFNA                                                   311
```

A related DNA sequence was identified in *S. pyogenes* <SEQ ID 3711> which encodes the amino acid sequence <SEQ ID 3712>. Analysis of this protein sequence reveals the following:

```
Possible site: 52
>>> Seems to have no N-terminal signal sequence
INTEGRAL Likelihood = -2.02 Transmembrane 141-157 (141-157)

----- Final Results -----
          bacterial membrane  --- Certainty = 0.1808 (Affirmative) < succ>
          bacterial outside   --- Certainty = 0.0000 (Not Clear)   < succ>
          bacterial cytoplasm --- Certainty = 0.0000 (Not Clear)   < succ>
```

A related sequence was also identified in GAS <SEQ ID 9103> which encodes the amino acid sequence <SEQ ID 9104>. Analysis of this protein sequence reveals the following:

```
Possible site: 50
>>> Seems to have no N-terminal signal sequence
INTEGRAL Likelihood = -2.02 Transmembrane 139-155 (139-155)

----- Final Results -----
          bacterial membrane  --- Certainty = 0.181 (Affirmative) < succ>
          bacterial outside   --- Certainty = 0.000 (Not Clear)   < succ>
          bacterial cytoplasm --- Certainty = 0.000 (Not Clear)   < succ>
```

An alignment of the GAS and GBS proteins is shown below.

```
Identities = 253/311 (81%), Positives = 283/311 (90%)

Query:   1 MSKILVFGHQNPDSDAIGSSVAFAYLAKEAWGLDTEAVALGTPNEETAYVLDYFGVQAPR    60
```

```
                 MSKILVFGHQNPD+DAI SS AF YL+++A+GLDTE VALGTPNEETA+ LDYFGV+APR
Sbjct:     3 MSKILVFGHQNPDTDAIASSYAFDYLSQKAFGLDTEVVALGTPNEETAFALDYFGVEAPR      62

Query:    61 VVESAKAEGVETVILTDHNEFQQSISDIKDVTVYGVVDHHRVANFETANPLYMRLEPVGS     120
             VVESAKA+G E VILTDHNEFQQSI+DI++V VYGVVDHHRVANFETANPLYMR+EPVGS
Sbjct:    63 VVESAKAQGSEQVILTDHNEFQQSIADIREVEVYGVVDHHRVANFETANPLYMREPVGS     122

Query:   121 ASSIVYRMFKENGVSVPKELAGLLLSGLISDTLLLKSPTTHASDIPVAKELAELAGVNLE     180
             ASSIVYRMFKENG+ VPK +AG+LLSGLISDTLLLKSPTTH SD  VA+ELAELA VNLE
Sbjct:   123 ASSIVYRMFKENGIEVPKAIAGMLLSGLISDTLLLKSPTTHVSDHLVAEELAELAEVNLE     182

Query:   181 EYGLEMLKAGTNLSSKTAAELIDIDAKTFELNGEAVRVAQVNTVDINDILARQEEIEVAI     240
             +YG+ +LKAGTNL+SK+   ELI IDAKTFELNG AVRVAQVNTVDI ++L RQE IE AI
Sbjct:   183 DYGMALLKAGTNLASKSEVELIGIDAKTFELNGNAVRVAQVNTVDIAEVLERQEAIEAAI     242

Query:   241 QEAIVTEGYSDFVLMITDIVNSNSEILALGSNMAKVEAAFEFTLENNHAFLAGAVSRKKQ     300
             ++A+   EGYSDFVLMITDIVNSNSEILA+G+NM KVEAAF FTL+NNHAFLAGAVSRKKQ
Sbjct:   243 KDAMAAEGYSDFVLMITDIVNSNSEILAIGANMDKVEAAFNFTLDNNHAFLAGAVSRKKQ     302

Query:   301 VVPQLTESYNA                                                   311
             VVPQLTES+ A
Sbjct:   303 VVPQLTESFGA                                                   313
```

Based on this analysis, it was predicted that these proteins and their epitopes could be useful antigens for vaccines or diagnostics.

EXAMPLE 1193

A DNA sequence (GBSx1269) was identified in *S. agalactiae* <SEQ ID 3713> which encodes the amino acid sequence <SEQ ID 3714>. Analysis of this protein sequence reveals the following:

```
Possible site: 20
>>> Seems to have no N-terminal signal sequence

----- Final Results -----
            bacterial cytoplasm --- Certainty = 0.2769 (Affirmative) < succ>
             bacterial membrane --- Certainty = 0.0000 (Not Clear)  < succ>
              bacterial outside --- Certainty = 0.0000 (Not Clear)  < succ>
```

The protein has homology with the following sequences in the GENPEPT database.

```
>GP: AAC05773 GB: AF051356 pyruvate-formate lyase activating enzyme
[Streptococcus mutans]
Identities = 184/260 (70%), Positives = 217/260 (82%)

Query:     3 EIDYKKVTGMIHSTESFGSVDGPGIRFIIFMQGCKMRCQYCHNPDTWEMETNNSKERTVE      62
             ++DY+KVTG+++STESFGSVDGPGIRF++FMQGC+MRCQYCHNPDTW M+ + + ERT
Sbjct:     4 KVDYEKVTGLVNSTESFGSVDGPGIRFVVFMQGCQMRCQYCHNPDTWAMKNDRATERTAG      63

Query:    63 DVLKEALRYKHFWGKDGGITVSGGEAMLQIDFITALFIEAKKLGIHTTLDTCGFAYRATP     122
             DV KEALR+K FWG  GGITVSGGEA LQ+DF+ ALF  AK+ GIHTTLDTC   +R TP
Sbjct:    64 DVFKEALRFKDFWGDTGGITVSGGEATLQMDFLIALFSLAKEKGIHTTLDTCALTFRNTP     123

Query:   123 EYHAILEKLLDVTDLVLLDLKEIDSEQHKIVTRQSNKNILQFARYLSDRGTPVWIRHVLV     182
             +Y    EKL+ VTDLVLLD+KEI+ +QHKIVT  SNK IL  ARYLSD G PVWIRHVLV
Sbjct:   124 KYLEKYEKLMAVTDLVLLDIKEINPDQHKIVTGHSNKTILACARYLSDIGKPVWIRHVLV     183

Query:   183 PGLTDIDDHLKRLGEFVQTLDNVDKFEVLPYHTMGEFKWRELGIPYPLAGVKPPTPERVK     242
             PGLTD D+ L +LGE+V+TL NV +FE+LPYHTMGEFKWRELGIPYPL GVKPPTP+RV+
Sbjct:   184 PGLTDRDEDLIKLGEYVKTLKNVQRFEILPYHTMGEFKWRELGIPYPLEGVKPPTPDRVR     243

Query:   243 NAKDIMKTESYTEYLKRIQN                                         262
             NAK +M TE+Y EY KRI +
Sbjct:   244 NAKKLMHTETYEEYKKRINH                                         263
```

A related DNA sequence was identified in *S. pyogenes* <SEQ ID 3715> which encodes the amino acid sequence <SEQ ID 3716>. Analysis of this protein sequence reveals the following:

```
Possible site: 44
>>> Seems to have no N-terminal signal sequence

----- Final Results -----
            bacterial cytoplasm --- Certainty = 0.4614(Affirmative) < succ>
             bacterial membrane --- Certainty = 0.0000(Not Clear)  < succ>
              bacterial outside --- Certainty = 0.0000(Not Clear)  < succ>
```

An alignment of the GAS and GBS proteins is shown below.

```
Identities = 223/260 (85%), Positives = 239/260 (91%)

Query:    1 MAEIDYKKVTGMIHSTESFGSVDGPGIRFIIFMQGCKMRCQYCHNPDTWEMETNNSKERT   60
            M E DY +VTGM+HSTESFGSVDGPGIRFIIF+QGCK+RCQYCHNPDTWEMETNNSK RT
Sbjct:   25 MTEKDYGQVTGMVHSTESFGSVDGPGIRFIIFLQGCKLRCQYCHNPDTWEMETNNSKIRT   84

Query:   61 VEDVLKEALRYKHFWGKDGGITVSGGEAMLQIDFITALFIEAKKLGIHTTLDTCGFAYRA  120
            V DVLKEAL+YKHFWGK GGITVSGGEAMLQIDFITALFIEAKKLGIHTTLDTCGF YR
Sbjct:   85 VNDVLKEALQYKHFWGKKGGITVSGGEAMLQIDFITALFIEAKKLGIHTTLDTCGFTYRP  144

Query:  121 TPEYHAILEKLLDVTDLVLLDLKEIDSEQHKIVTRQSNKNILQFARYLSDRGTPVWIRHV  180
            TPEYH +L+ LL VTDL+LLDLKEID +QHKIVTRQ NKNILQFARYLSD+  PVWIRHV
Sbjct:  145 TPEYHQVLDNLLAVTDLILLDLKEIDEKQHKIVTRQPNKNILQFARYLSDKQIPVWIRHV  204

Query:  181 LVPGLTDIDDHLKRLGEFVQTLDNVDKFEVLPYHTMGEFKWRELGIPYPLAGVKPPTPER  240
            LVPGLTDIDDHL RLGEFV+TL NVDKFEVLPYHTMGEFKWRELGIPY L GVKPPT ER
Sbjct:  205 LVPGLTDIDDHLTRLGEFVKTLKNVDKFEVLPYHTMGEFKWRELGIPYQLEGVKPPTKER  264

Query:  241 VKNAKDIMKTESYTEYLKRI                                         260
            V+NAK++M+TESYTEY+ RI
Sbjct:  265 VQNAKNLMQTESYTEYMNRI                                         284
```

Based on this analysis, it was predicted that these proteins and their epitopes could be useful antigens for vaccines or diagnostics.

EXAMPLE 1194

A DNA sequence (GBSx1270) was identified in *S. agalactiae* <SEQ ID 3717> which encodes the amino acid sequence <SEQ ID 3718>. Analysis of this protein sequence reveals the following:

```
Possible site: 28
>>> Seems to have a cleavable N-term signal seq.
     INTEGRAL    Likelihood = -7.06     Transmembrane   105-121 (103-126)
     INTEGRAL    Likelihood = -5.57     Transmembrane   137-153 (136-162)

----- Final Results -----
             bacterial membrane --- Certainty = 0.3824(Affirmative) < succ>
              bacterial outside --- Certainty = 0.0000(Not Clear)  < succ>
            bacterial cytoplasm --- Certainty = 0.0000(Not Clear)  < succ>
```

The protein has homology with the following sequences in the GENPEPT database.

```
>GP: AAC05772 GB: AF051356 putative hemolysin [Streptococcus mutans]
Identities = 347/445 (77%), Positives = 406/445 (90%), Gaps = 1/445 (0%)

Query:    1 MQDPGSQSLLLQFVILLILTLFNAFFSASEMALVSLNRSKVEQKAEEGDKRYRRLLDVLE   60
            M+DPGSQSL+LQF++LLILTL NAFFSA+EMALVSLNR++VEQKAEEG+K+Y RLL VLE
Sbjct:    1 MEDPGSQSLILQFLLLLILTLCNAFFSATEMALVSLNRARVEQKAEEGEKKYIRLLKVLE   60

Query:   61 NPNNFLSTIQVGITFISLLQGASLSASLGHVISGWLGNSATARTAGSIIALIFLTYVSIV  120
            NPNNFLSTIQVGIT I+LL GASL+ SLG  I+ W GNSATARTAGS+I+L FLTY+SIV
Sbjct:   61 NPNNFLSTIQVGITLITLLSGASLADSLGREIAVWFGNSATARTAGSLISLAFLTYISIV  120

Query:  121 LGELYPKRIAMNLKDRLAIVSAPIIIFLGKIVSPFVWLLSASTNLLSRITPMTFDDADEK  180
            LGELYPKRIAMNLK+ LA++SAP+IIFLGK+VSPFVWLLS STNLLSR+TPMTFDDADEK
Sbjct:  121 LGELYPKRIAMNLKENLAVLSAPVIIFLGKVVSPFVWLLSVSTNLLSRLTPMTFDDADEK  180
```

```
                              -continued
Query:  181 MTRDEIEYMLTNSEETLEAEEIEMLQGIFSLDEMMAREVMVPRTDAFMIDINNDAQSNIE  240
            MTRDEIEYMLTNSEETL+A+EIEMLQG+FSLDE+MAREVMVPRTDAFM+DIN+D+   I+
Sbjct:  181 MTRDEIEYMLTNSEETLDADEIEMLQGVFSLDELMAREVMVPRTDAFMVDINDDSSDIIQ  240

Query:  241 GILSQNFSRVPVFDDDKDRVVGVLHTKRLLEAGFKTGFDTIDLRKILQEPLFVPETIFVD  300
            IL++ FSR+PV+DDDKD+++G++HTK LL AGFK GFD I+LR+ILQEPLFVPETI V+
Sbjct:  241 TILNERFSRIPVYDDDKDKIIGIIHTKNLLNAGFKEGFDHINLRRILQEPLFVPETIVVN  300

Query:  301 DLLKALRNTQNQMAILLDEYGGVAGLVTLEDLLEEIVGEIDDETDTAEQFVREIDENIYI  360
            DLL AL+NTQNQMAILLDEYGGVAGLVTLEDLLEEIVGEIDDETD     VREI +N YI
Sbjct:  301 DLLTALKNTQNQMAILLDEYGGVAGLVTLEDLLEEIVGEIDDETDKTAISVREIADNTYI  360

Query:  361 VLGTMTLNEFNDYFETELESDDVDTIAGYYLTGVGSIPNQEEKVAYEVDSKDKHITLIND  420
            VLGTMTLN+FN+YFET+LESD+VDTIAG+YLTGVG+IP+QEEK  +EV+S  KH+ LIND
Sbjct:  361 VLGTMTLNDFNEYFETDLESDNVDTIAGFYLTGVGTIPSQEEKEHFEVESNGKHLELIND  420

Query:  421 KVKDGRITKLKVLLSDIEQ-NIEKD                                    444
            KVKDGR+TKLK+L+S++E+    EKD
Sbjct:  421 KVKDGRVTKLKILVSEVEEKEDEKD                                    445
```

A related DNA sequence was identified in *S. pyogenes* <SEQ ID 3719> which encodes the amino acid sequence <SEQ ID 3720>. Analysis of this protein sequence reveals the following:

```
Possible site: 42
>>> Seems to have no N-terminal signal sequence
     INTEGRAL   Likelihood = -8.76    Transmembrane    22-38  (16-47)
     INTEGRAL   Likelihood = -5.57    Transmembrane   118-134 (117-138)
     INTEGRAL   Likelihood = -3.19    Transmembrane   150-166 (149-169)

----- Final Results -----
              bacterial membrane --- Certainty = 0.4503(Affirmative) < succ>
               bacterial outside --- Certainty = 0.0000(Not Clear)   < succ>
              bacterial cytoplasm --- Certainty = 0.0000(Not Clear)   < succ>
```

The protein has homology with the following sequences in the databases:

```
>GP: AAC05772 GB: AF051356 putative hemolysin [Streptococcus mutans]
Identities = 343/443 (77%), Positives = 401/443 (90%)

Query:   14 MEDPVSQSLVIQFLLLVVLTLLNAFFSASEMALVSLNRSVEQKAADGDKKYARLLRVLE   73
            MEDP SQSL++QFLLL++LTL NAFFSA+EMALVSLNR+RVEQKA +G+KKY RLL+VLE
Sbjct:    1 MEDPGSQSLILQFLLLLILTLCNAFFSATEMALVSLNRARVEQKAEEGEKKYIRLLKVLE   60

Query:   74 EPNHFLSTIQVGITFISLLSGASLSASLGKVISGWLGNSATARTAGTIISLVFLTYVSIV  133
            PN+FLSTIQVGIT I+LLSGASL+ SLG+ I+ W GNSATARTAG++ISL FLTY+SIV
Sbjct:   61 NPNNFLSTIQVGITLITLLSGASLADSLGREIAVWFGNSATARTAGSLISLAFLTYISIV  120

Query:  134 LGELYPKRIAMNLKDKLAIVSAPIIIGLGRLVSPFVWLLSASTNLLSRLTPMTFDDADEQ  193
            LGELYPKRIAMNLK+ LA++SAP+II LG++VSPFVWLLS STNLLSRLTPMTFDDADE+
Sbjct:  121 LGELYPKRIAMNLKENLAVLSAPVIIFLGKVVSPFVWLLSVSTNLLSRLTPMTFDDADEK  180

Query:  194 MTRDEIEYMLSKSEATLDAEEIEMLQGVFSLDEMMAREVMVPRTDAFMIDNDDPLENIQ   253
            MTRDEIEYML+ SE TLDA+EIEMLQGVFSLDE+MAREVMVPRTDAFM+DINDD  + IQ
Sbjct:  181 MTRDEIEYMLTNSEETLDADEIEMLQGVFSLDELMAREVMVPRTDAFMVDINDDSSDIIQ  240

Query:  254 EILKQSFSRIPVYDVDKDKIIGLIHTKRLLESGFRQGFDQINMRKMLQEPLFVPETIFVD  313
            IL + FSRIPVYD DKDKIIG+IHTK LL +GF++GFD IN+R++LQEPLFVPETI V+
Sbjct:  241 TILNERFSRIPVYDDDKDKIIGIIHTKNLLNAGFKEGFDHINLRRILQEPLFVPETIVVN  300

Query:  314 DLLRQLRNTQNQMAILLDEYGGVAGLVTLEDLLEEIVGEIDDETDKAEQFVHEIGDNTYI  373
            DLL  L+NTQNQMAILLDEYGGVAGLVTLEDLLEEIVGEIDDETDK   V EI DNTYI
Sbjct:  301 DLLTALKNTQNQMAILLDEYGGVAGLVTLEDLLEEIVGEIDDETDKTAISVREIADNTYI  360

Query:  374 VVGTMTLNEFNDYFDTELESDDVDTIAGFYLTGIGTIPSQEQKEAYEIDNKDKHLVLIND  433
            V+GTMTLN+FN+YF+T+LESD+VDTIAGFYLTG+GTIPSQE+KE +E+++  KHL LIND
Sbjct:  361 VLGTMTLNDFNEYFETDLESDNVDTIAGFYLTGVGTIPSQEEKEHFEVESNGKHLELIND  420

Query:  434 KVKDGRITKLKLILSNIEQIIEE                                      456
            KVKDGR+TKLK+++S +E+  +E
Sbjct:  421 KVKDGRVTKLKILVSEVEEKEDE                                      443
```

An alignment of the GAS and GBS proteins is shown below.

Identities = 364/444 (81%), Positives = 417/444 (92%)

```
Query:    1 MQDPGSQSLLLQFVILLILTLFNAFFSASEMALVSLNRSKVEQKAEEGDKRYRRLLDVLE    60
            M+DP SQSL++QF++L++LTL  NAFFSASEMALVSLNRS+VEQKA +GDK+Y RLL VLE
Sbjct:   14 MEDPVSQSLVIQFLLLVVLTLLNAFFSASEMALVSLNRSRVEQKAADGDKKYARLLRVLE    73

Query:   61 NPNNFLSTIQVGITFISLLQGASLSASLGHVISGWLGNSATARTAGSIIALIFLTYVSIV   120
             PN+FLSTIQVGITFISLL GASLSASLG VISGWLGNSATARTAG+II+L+FLTYVSIV
Sbjct:   74 EPNHFLSTIQVGITFISLLSGASLSASLGKVISGWLGNSATARTAGTIISLVFLTYVSIV   133

Query:  121 LGELYPKRIAMNLKDRLAIVSAPIIIFLGKIVSPFVWLLSASTNLLSRITPMTFDDADEK   180
            LGELYPKRIAMNLKD+LAIVSAPIII LG++VSPFVWLLSASTNLLSR+TPMTFDDADE+
Sbjct:  134 LGELYPKRIAMNLKDKLAIVSAPIIIGLGRLVSPFVWLLSASTNLLSRLTPMTFDDADEQ   193

Query:  181 MTRDEIEYMLTNSEETLEAEEIEMLQGIFSLDEMMAREVMVPRTDAFMIDINNDAQSNIE   240
            MTRDEIEYML+ SE TL+AEEIEMLQG+FSLDEMMAREVMVPRTDAFMIDIN+D   NI+
Sbjct:  194 MTRDEIEYMLSKSEATLDAEEIEMLQGVFSLDEMMAREVMVPRTDAFMIDINDDPLENIQ   253

Query:  241 GILSQNFSRVPVFDDDKDRVVGVLHTKRLLEAGFKTGFDTIDLRKILQEPLFVPETIFVD   300
             IL Q+FSR+PV+D DKD+++G++HTKRLLE+GF+ GFD I++RK+LQEPLFVPETIFVD
Sbjct:  254 EILKQSFSRIPVYDVDKDKIIGLIHTKRLLESGFRQGFDQINMRKMLQEPLFVPETIFVD   313

Query:  301 DLLKALRNTQNQMAILLDEYGGVAGLVTLEDLLEEIVGEIDDETDTAEQFVREIDENIYI   360
            DLL+ LRNTQNQMAILLDEYGGVAGLVTLEDLLEEIVGEIDDETD AEQFV EI +N YI
Sbjct:  314 DLLRQLRNTQNQMAILLDEYGGVAGLVTLEDLLEEIVGEIDDETDKAEQFVHEIGDNTYI   373

Query:  361 VLGTMTLNEFNDYFETELESDDVDTIAGYYLTGVGSIPNQEEKVAYEVDSKDKHITLIND   420
            V+GTMTLNEFNDYF+TELESDDVDTIAG+YLTG+G+IP+QE+K AYE+D+KDKH+ LIND
Sbjct:  374 VVGTMTLNEFNDYFDTELESDDVDTIAGFYLTGIGTIPSQEQKEAYEIDNKDKHLVLIND   433

Query:  421 KVKDGRITKLKVLLSDIEQNIEKD                                      444
            KVKDGRITKLK++LS+IEQ IE+D
Sbjct:  434 KVKDGRITKLKLILSNIEQIIEED                                      457
```

SEQ ID 3718 (GBS70d) was expressed in *E. coli* as a GST-fusion product. SDS-PAGE analysis of total cell extract is shown in FIG. 120 (lane 8-10; MW 65 kDa). It was also expressed in *E. coli* as a His-fusion product. SDS-PAGE analysis of total cell extract is shown in FIG. 120 (lane 11 & 12; MW 44 kDa) and in FIG. 179 (lane 5; MW 35 kDa).

GBS70d-His was purified as shown in FIG. 231, lane 9-10.

Based on this analysis, it was predicted that these proteins and their epitopes could be useful antigens for vaccines or diagnostics.

EXAMPLE 1195

A DNA sequence (GBSx1271) was identified in *S. agalactiae* <SEQ ID 3721> which encodes the amino acid sequence <SEQ ID 3722>. Analysis of this protein sequence reveals the following:

```
Possible site: 46
>>> Seems to have no N-terminal signal sequence

----- Final Results -----
         bacterial cytoplasm --- Certainty = 0.1212(Affirmative) < succ>
          bacterial membrane --- Certainty = 0.0000(Not Clear) < succ>
           bacterial outside --- Certainty = 0.0000(Not Clear) < succ>
```

The protein has homology with the following sequences in the GENPEPT database.

```
>GP: CAB84230 GB: AL162754 hypothetical protein NMA0960 [Neisseria
meningitidis Z2491]
Identities = 80/184 (43%), Positives = 119/184 (64%), Gaps = 3/184 (1%)

Query:   1 MIKRPIHLSHDFLAEVIDKEAITLDATMGNGNDTVFLAKSSK---KVYAFDIQEEAIAKT    57
           ++K + +H  L + + +    LD T GNG+DT+FLA+++    KV+AFDIQ +A+  T
Sbjct:   2 LLKNILPFAHCLLRQALPEGGNALDGTAGNGHDTLFLAQTAGIRGKVWAFDIQPQALNNT    61

Query:  58 KAKLTEQGISNAELILDGHENLEQYVHTPLRAAIFNLGYLPSADKTVITKPHTTIKAIKN   117
           + +L E G SN  LILDGHENL+QY+   PL  AAIFN G+LP  DK++  T+  T+I A+
```

```
Sbjct:  62 RCRLQEAGYSNVRLILDGHENLKQYIPKPLDAAIFNFGWLPGGDKSLTTRTETSIAALSA 121

Query: 118 VLDILEVGGRLSLMVYYGHDGGKSEKDAVIAFVEQLPQNNFATMLYQPLNQVNTPPFLIM 177
           L +L+   G L  ++Y GH+ GK E +A+  + + LPQ  FA + Y   N+ N+PP+L+
Sbjct: 122 ALSLLKENGMLIAVLYPGHENGKQEAEAIEQWAKNLPQEQFAVLRYSFTNRKNSPPYLLA 181

Query: 178 VEKL                                                        181
           EKL
Sbjct: 182 FEKL                                                        185
```

A related DNA sequence was identified in *S. pyogenes* <SEQ ID 3723> which encodes the amino acid sequence <SEQ ID 3724>. Analysis of this protein sequence reveals the following:

```
Possible site: 55
>>> Seems to have no N-terminal signal sequence
     INTEGRAL    Likelihood = -1.44    Transmembrane    127-143 (123-143)

----- Final Results -----
            bacterial membrane --- Certainty = 0.1574(Affirmative) < succ>
              bacterial outside --- Certainty = 0.0000(Not Clear)  < succ>
            bacterial cytoplasm --- Certainty = 0.0000(Not Clear)  < succ>
```

A related sequence was also identified in GAS <SEQ ID 9101> which encodes the amino acid sequence <SEQ ID 9102>. Analysis of this protein sequence reveals the following:

```
Possible site: 46
>>> Seems to have no N-terminal signal sequence
     INTEGRAL    Likelihood = -1.44    Transmembrane    118-134 (114-134)

----- Final Results -----
            bacterial membrane --- Certainty = 0.157(Affirmative) < succ>
              bacterial outside --- Certainty = 0.000(Not Clear)  < succ>
            bacterial cytoplasm --- Certainty = 0.000(Not Clear)  < succ>
```

An alignment of the GAS and GBS proteins is shown below.

```
Identities = 124/184 (67%), Positives = 156/184 (84%)

Query:   1 MIKRPIHLSHDFLAEVIDKEAITLDATMGNGNDTVFLAKSSKKVYAFDIQEEAIAKTKAK  60
           M+KRPIHLSHDFLAEV+DK ++ +DATMGNGNDT FLA+ +KKVYAFD+QE+AI KT  +
Sbjct:  10 MLKRPIHLSHDFLAEVVDKSSVVVDATMGNGNDTAFLAQLAKKVYAFDVQEQAIRKTSER  69

Query:  61 LTEQGISNAELILDGHENLEQYVHTPLRAAIFNLGYLPSADKTVITKPHTTIKAIKNVLD 120
           L + G+SNAELIL GHE ++QYV  P+RAAIFNLGYLPSADK++IT P+TT++A+   +L
Sbjct:  70 LAQLGLSNAELILAGHEAVDQYVTEPVRAAIFNLGYLPSADKSIITLPNTTLQALSKLLT 129

Query: 121 ILEVGGRLSLMVYYGHDGGKSEKDAVIAFVEQLPQNNFATMLYQPLNQVNTPPFLIMVEK 180
           +L VGGR+++MVYYGHDGG  EKDA++ FV+QL Q  +  MLYQPLNQVNTPPFLIM+EK
Sbjct: 130 LLMVGGRIAIMVYYGHDGGSLEKDALLDFVKQLDQRKVSAMLYQPLNQVNTPPFLIMLEK 189

Query: 181 LQSY                                                        184
           L  +
Sbjct: 190 LADF                                                        193
```

Based on this analysis, it was predicted that these proteins and their epitopes could be useful antigens for vaccines or diagnostics.

EXAMPLE 1196

A DNA sequence (GBSx1272) was identified in *S. agalactiae* <SEQ ID 3725> which encodes the amino acid sequence <SEQ ID 3726>. Analysis of this protein sequence reveals the following:

```
Possible site: 51
>>> Seems to have no N-terminal signal sequence

----- Final Results -----
            bacterial cytoplasm --- Certainty = 0.1948 (Affirmative) < succ>
             bacterial membrane --- Certainty = 0.0000 (Not Clear)  < succ>
              bacterial outside --- Certainty = 0.0000 (Not Clear)  < succ>
```

The protein has homology with the following sequences in the GENPEPT database.

```
>GP: AAC00380 GB: AF008220 YtqA [Bacillus subtilis]
Identities = 161/302 (53%), Positives = 220/302 (72%), Gaps = 4/302 (1%)

Query:   2 KKRYRAINDYYRELFGEKIFKLPIDAGFDCPNRDGTVARGGCTFCTVSGSGDAIVAPEAP   61
           +KRY  +N + RE FG K+FK+ +D GFDCPNRDGTVA GGCTFC+ +GSGD
Sbjct:  13 EKRYHTLNYHLREHFGHKVFKVALDGGFDCPNRDGTVAHGGCTFCSAAGSGDFAGNRTDD   72

Query:  62 IREQFYKEIDFMHRKWPEVNKYLVYFQNFTNTHAKLEIIKERYEQAINEPGVIGINIGTR  121
           +  QF+   + MH KW +  KY+ YFQ FTNTHA +E+++E++E  +    V+GI+I TR
Sbjct:  73 LITQFHDIKNRMHEKWKD-GKYIAYFQAFTNTHAPVEVLREKFESVLALDDVVGISIATR  131

Query: 122 PDCLPDETIYYLAELSERMHVTLELGLQTTYEATSALINRAHSYDLYKKTVKRIRELAPK  181
           PDCLPD+ + YLAEL+ER ++ +ELGLQT +E T+ LINRAH ++ Y + V ++R+
Sbjct: 132 PDCLPDDVVDYLAELNERTYLWVELGLQTVHERTALLINRAHDFNCYVEGVNKLRKHG--  189

Query: 182 VEIVSHLINGLPGETHDMMVENVRRCVTDNDIQGIKLHLLHLMTNTRMQRDYHEGRLRLL  241
           + + SH+INGLP E   DMM+E  +   V D D+QGIK+HLLHL+    T M + Y +G+L   L
Sbjct: 190 IRVCSHIINGLPLEDRDMMMETAK-AVADLDVQGIKIHLLHLLKGTPMVKQYEKGKLEFL  248

Query: 242 SQEDYISIICDQLEIIPKHIVIHRITGDAPRHMLIGPMWSLNKWEVLNAIDKEMEKRQSY  301
           SQ+DY+ ++CDQLEIIP   +++HRITGD P   ++IGPMWS+NKWEVL AI+KE+E R SY
Sbjct: 249 SQDDYVQLVCDQLEIIPPEMIVHRITGDGPIELMIGPMWSVNKWEVLGAINKSLENRGSY  308

Query: 302 QG                                                           303
           QG
Sbjct: 309 QG                                                           310
```

A related DNA sequence was identified in *S. pyogenes* 35 <SEQ ID 3727> which encodes the amino acid sequence <SEQ ID 3728>. Analysis of this protein sequence reveals the following:

```
Possible site: 57
>>> Seems to have no N-terminal signal sequence

----- Final Results -----
            bacterial cytoplasm --- Certainty = 0.2023 (Affirmative) < succ>
             bacterial membrane --- Certainty = 0.0000 (Not Clear)  < succ>
              bacterial outside --- Certainty = 0.0000 (Not Clear)  < succ>
```

An alignment of the GAS and GBS proteins is shown below.

```
Identities = 260/307 (84%), Positives = 290/307 (93%), Gaps = 1/307 (0%)

Query:   1 MKKRYRAINDYYRELFGEKIFKLPIDAGFDCPNRDGTVARGGCTFCTVSGSGDAIVAPEA   60
           MKKRY+ +N++YR+LFG K+FK+PIDAGFDCPNRDGTVA GGCTFCTVSGSGDAIVAP A
Sbjct:   7 MKKRYQTLNEHYRQLFGAKMFKVPIDAGFDCPNRDGTVAHGGCTFCTVSGSGDAIVAPDA   66

Query:  61 PIREQFYKEIDFMHRKWPEVNKYLVYFQNFTNTHAKLEIIKERYEQAINEPGVIGINIGT  120
           PI+EQFYKEIDFMHRKWP+VN+YLVYFQNFTNTH   +++I++RYEQAINEPGV+GINIGT
Sbjct:  67 PIKEQFYKEIDFMHRKWPDVNRYLVYFQNFTNTHDTVDVIRDRYEQAINEPGVVGINIGT   26

Query: 121 RPDCLPDETIYYLAELSERMHVTLELGLQTTYEATSALINRAHSYDLYKKTVKRIRELAP  180
           RPDCLPD+TI YLAELSERMHVT+ELGLQTTYE TS LINRAHSYDLYK+TV+R+R     P
Sbjct: 127 RPDCLPDDTIAYLAELSERMHVTVELGLQTTYEETSRLINRAHSYDLYKETVRRLRHY-P  185

Query: 181 KVEIVSHLINGLPGETHDMMVENVRRCVTDNDIQGIKLHLLHLMTNTRMQRDYHEGRLRL  240
            + IVSHLINGLP ETHDMM+ENVRRCVTDNDIQGIKLHLLHLMTNTRMQRDYHEGRL+L
Sbjct: 186 NINIVSHLINGLPKETHDMMLENVRRCVTDNDIQGIKLHLLHLMTNTRMQRDYHEGRLKL  245

Query: 241 LSQEDYISIICDQLEIIPKHIVIHRITGDAPRHMLIGPMWSLNKWEVLNAIDKEMEKRQS  300
```

-continued
```
            LSQ+DY+SIICDQLEIIPKHIVIHRITGDAPR MLIGPMWSLNKWEVLNAIDKEME+R S
Sbjct: 246 LSQKDYVSIICDQLEIIPKHIVIHRITGDAPRDMLIGPMWSLNKWEVLNAIDKEMERRGS   305

Query: 301 YQGCKAE                                                      307
           +QGCK +
Sbjct: 306 FQGCKVD                                                      312
```

Based on this analysis, it was predicted that these proteins and their epitopes could be useful antigens for vaccines or diagnostics.

EXAMPLE 1197

A DNA sequence (GBSx1273) was identified in *S. agalactiae* <SEQ ID 3729> which encodes the amino acid sequence <SEQ ID 3730>. Analysis of this protein sequence reveals the following:

```
Possible site: 24
>>> Seems to have an uncleavable N-term signal seq
INTEGRAL Likelihood = -9.82 Transmembrane   10-26  (6-30)
INTEGRAL Likelihood = -4.73 Transmembrane   93-109 (87-112)
INTEGRAL Likelihood = -4.57 Transmembrane  163-179 (161-181)
INTEGRAL Likelihood = -2.97 Transmembrane  189-205 (185-205)
INTEGRAL Likelihood = -1.97 Transmembrane   58-74  (58-74)
INTEGRAL Likelihood = -0.75 Transmembrane  130-146 (130-146)

----- Final Results -----
             bacterial membrane --- Certainty = 0.4927 (Affirmative) < succ>
              bacterial outside --- Certainty = 0.0000 (Not Clear) < succ>
             bacterial cytoplasm --- Certainty = 0.0000 (Not Clear) < succ>
```

The protein has homology with the following sequences in the GENPEPT database.

```
>GP: CAA79986 GB: Z21972 ORF2 [Bacillus megaterium]
Identities = 62/159 (38%), Positives = 92/159 (56%), Gaps = 3/159 (1%)

Query:  34 ISFDQTIQESVRGQLPNLSTRFFKLITVIGNTVSQIAIAIMSVTFCY--LKKWYPQARFI   91
           + FD+ +    V+G    L T   K  T IG+T S I ++++ + F Y  LK      F
Sbjct:  34 LKFDEDVISLVQGWESPLLTDIMKFFTYIGSTASLIILSLVILFFLYRILKHRLELVLFT   93

Query:  92 AVNAIISGICILSLKLIFQRVRPTLTHLVFAGGYSFPSGHSMGTFMIFGSIIILLQYYMP  151
           AV  + S +  L +KL FQR RP L  L+   GGYSFPSGH+M  F  ++G +   LL  ++
Sbjct:  94 AV-MVGSPLLNLMVKLFFQRARPDLHRLIDIGGYSFPSGHAMNAFSLYGILTFLLWRHIT  152

Query: 152 KSIWKLLCQGTLGLLIFLIGLSRIYLGVHFPTDVLAGFI                      190
           ++L       L+I   IG+SRIYLGVH+P+D++AG++
Sbjct: 153 ARWARILLILFSMLMILSIGISRIYLGVHYPSDIIAGYL                      191
```

A related DNA sequence was identified in *S. pyogenes* <SEQ ID 1851> which encodes the amino acid sequence <SEQ ID 1852>. Analysis of this protein sequence reveals the following:

```
Possible site: 15
>>> Seems to have an uncleavable N-term signal seq
INTEGRAL Likelihood = -11.30 Transmembrane 154-170 (150-181)
INTEGRAL Likelihood = -10.88 Transmembrane  65-81  (58-93)
INTEGRAL Likelihood =  -8.97 Transmembrane  10-26  (5-31)
INTEGRAL Likelihood =  -3.77 Transmembrane  86-102 (86-105)
INTEGRAL Likelihood =  -2.71 Transmembrane 185-201 (183-202)
INTEGRAL Likelihood =  -1.54 Transmembrane 130-146 (130-148)

----- Final Results -----
             bacterial membrane --- Certainty = 0.5522 (Affirmative) < succ>
              bacterial outside --- Certainty = 0.0000 (Not Clear) < succ>
             bacterial cytoplasm --- Certainty = 0.0000 (Not Clear) < succ>
```

An alignment of the GAS and GBS proteins is shown below.

```
Identities = 88/197 (44%), Positives 134/197 (67%), Gaps = 1/197 (0%)

Query:    1 MLSRQNSKLIQAFIAIILFFSLGLVIKYWPDTVISFDQTIQESVRGQLPNLSTRFFKLIT   60
            M ++Q   LI +F A+++F  +G  +K++P+ +   D TIQ +RG LP + T+FF+ +T
Sbjct:    2 MTNKQTHFLIASF-ALLIFVIIGYTVKFFPERLALLDNTIQAEIRGNLPIVLTQFFRGVT   60

Query:   61 VIGNTVSQIAIAIMSVTFCYLKKWYPQARFIAVNAIISGICILSLKLIFQRVRPTLTHLV  120
            V GN ++Q+ + I+SV    +  KW  +A FI  N  I+    I +LKL +QR RP + HLV
Sbjct:   61 VFGNVMTQVLLVIVSVLVLFFMKWKIEALFILSNGAIAAFLITTLKLFYQRPRPAIEHLV  120

Query:  121 FAGGYSFPSGHSMGTFMIFGSIIILLQYYMPKSIWKLLCQGTLGLLIFLIGLSRIYLGVH  180
            +AGGYSFPSGH+MG+ +IFGS++I+     + + +       +LI LIGLSRIYLGVH
Sbjct:  121 YAGGYSFPSGHAMGSMLIFGSLLIICYQRLHSKLLQFVTSMIFIILILLIGLSRIYLGVH  180

Query:  181 FPTDVLAGFILAYGILN                                            197
            +P+D+LAGF+L +GIL+
Sbjct:  181 YPSDILAGFVLGFGILH                                            197
```

Based on this analysis, it was predicted that these proteins and their epitopes could be useful antigens for vaccines or diagnostics.

EXAMPLE 1198

A DNA sequence (GBSx1274) was identified in *S. agalactiae* <SEQ ID 3731> which encodes the amino acid sequence <SEQ ID 3732>. Analysis of this protein sequence reveals the following:

```
Possible site: 58
>>> Seems to have no N-terminal signal sequence
INTEGRAL Likelihood = -8.44 Transmembrane    35-51  (33-59)
INTEGRAL Likelihood = -6.53 Transmembrane  193-209  (179-211)
INTEGRAL Likelihood = -4.46 Transmembrane    64-80  (60-82)
INTEGRAL Likelihood = -4.09 Transmembrane  108-124  (103-128)
INTEGRAL Likelihood = -2.71 Transmembrane  150-166  (148-166)
INTEGRAL Likelihood = -0.06 Transmembrane  174-190  (174-190)

----- Final Results -----
             bacterial membrane --- Certainty = 0.4376 (Affirmative) < succ>
             bacterial outside  --- Certainty = 0.0000 (Not Clear)  < succ>
             bacterial cytoplasm --- Certainty = 0.0000 (Not Clear)  < succ>
```

A related GBS nucleic acid sequence <SEQ ID 9977> which encodes amino acid sequence <SEQ ID 9978> was also identified.

The protein has homology with the following sequences in the GENPEPT database.

```
>GP:AAC83944 GB:L47648 putative [Bacillus subtilis]
Identities = 53/186 (28%), Positives = 109/186 (58%)

Query:   33 RKMVTIAILSALSFVLMMVSFPLIPGAEFLKVDFSILPMLVAFILFDLKSSYGVLLLRSL   92
            +K+V +++LS+++FVLM+++FP      ++LK+DFS +P ++A +++   +  V  ++++
Sbjct:    4 KKLVVVSMLSSIAFVLMLLNFPFPGLPDYLKIDFSDVPAIIAILIYGPLAGIAVEAIKNV   63

Query:   93 LKVILANRGPETFIGLPMNMVALALFLASFAIFWKNRESAKDFIKASLFGTVSLTVSMVA  152
            L+ I+       +G   N +A  LF+    A +K     SAK    + L GT ++T+ M
Sbjct:   64 LQYIIQGSMAGVPVGQVANFIAGTLFILPTAFLFKKLNSAKGLAVSLLLGTAAMTILMSI  123

Query:  153 LNYVFAIPLYAIFANFDIRTFIGVGNYLLTMVIPFNIVEGILISIVFYLTYVACLPILER  212
            LNYV +P Y  F +    +    ++  ++PFN+++GI+I++VF L ++   P +E+
Sbjct:  124 LNYVLILPAYTWFLHSPALSDSALKTAVVAGILPFNMIKGIVITVVFSLIFIKLKPWIEQ  183

Query:  213 YKKTNV                                                        218
             + ++
Sbjct:  184 QRSAHI                                                        189
```

A related DNA sequence was identified in *S. pyogenes* <SEQ ID 3733> which encodes the amino acid sequence <SEQ ID 3734>. Analysis of this protein sequence reveals the following:

```
Possible site: 26
>>> Seems to have a cleavable N-term signal seq.
INTEGRAL   Likelihood = -6.48 Transmembrane   82-98    (74-100)
INTEGRAL   Likelihood = -3.93 Transmembrane  161-177   (152-178)
INTEGRAL   Likelihood = -3.61 Transmembrane  108-124   (107-126)
INTEGRAL   Likelihood = -3.61 Transmembrane   33-49    (31-50)

----- Final Results -----
            bacterial membrane  --- Certainty = 0.3590 (Affirmative) < succ>
            bacterial outside   --- Certainty = 0.0000 (Not Clear)   < succ>
            bacterial cytoplasm --- Certainty = 0.0000 (Not Clear)   < succ>
```

The protein has homology with the following sequences in the databases:

```
>GP:AAC83944 GB:L47648 putative [Bacillus subtilis]
Identities = 46/182 (25%), Positives = 97/182 (53%)

Query:    3 KTHKMIMIGILSAISFLLMLVSFAIIPGAAFLKIEFSIIPVLFGLMIMDLKSAYLILLLR  62
            K  K++++ +LS+I+F+LML++F      +LKI+FS +P +  ++I   +   + ++
Sbjct:    2 KVKKLVVVSMLSSIAFVLMLLNFPFPGLPDYLKIDFSDVPAIIAILIYGPLAGIAVEAIK  61

Query:   63 SLLKLFLNNRGVNDFIGLPMNIIAIALFVTAFALVWNRQKTLSQYVFASLLGTGLLTFGM 122
            ++L+ +          +G   N IA  LF+   A ++ +  +       + LLGT  +T  M
Sbjct:   62 NVLQYIIQGSMAGVPVGQVANFIAGTLFILPTAFLFKKLNSAKGLAVSLLLGTAAMTILM 121

Query:  123 VVLNYTFAIPLYAIFANIDIRAYIGVTKYMMTMVIPFNLVEGLIFAITFYFVYIASKPIL 182
            +LNY   +P Y F +       +   ++  ++PFN+++G++   + F  ++I   KP +
Sbjct:  122 SILNYVLILPAYTWFLHSPALSDSALKTAVVAGILPFNMIKGIVITVVFSLIFIKLKPWI 181

Query:  183 ER                                                           184
            E+
Sbjct:  182 EQ                                                           183
```

An alignment of the GAS and GBS proteins is shown below.

```
Identities = 110/185 (59%), Positives = 144/185 (77%)
Query:   29 MTNTRKMVTIAILSALSFVLMMVSFPLIPGAEFLKVDFSILPMLVAFILFDLKSSYGVLL  88
            M+ T KM+ I ILSA+SF+LM+VSF +IPGA FLK++FSI+P+L  ++ DLKS+Y +LL
Sbjct:    1 MSKTHKMIMIGILSAISFLLMLVSFAIIPGAAFLKIEFSIIPVLFGLMIMDLKSAYLILL  60

Query:   89 LRSLLKVILANRGPETFIGLPMNMVALALFLASFAIFWKNRESAKDFIKASLFGTVSLTV 148
            LRSLLK+ L NRG   FIGLPMN++A+ALF+ +FA+ W   +++    ++ ASL GT  LT
Sbjct:   61 LRSLLKLFLNNRGVNDFIGLPMNIIAIALFVTAFALVWNRQKTLSQYVFASLLGTGLLTF 120

Query:  149 SMVALNYVFAIPLYAIFANFDIRTFIGVGNYLLTMVIPFNIVEGILISIVFYLTYVACLP 208
               MV LNY FAIPLYAIFAN DIR +IGV  Y++TMVIPFN+VEG++  +I FY  Y+A  P
Sbjct:  121 GMVVLNYTFAIPLYAIFANIDIRAYIGVTKYMMTMVIPFNLVEGLIFAITFYFVYIASKP 180

Query:  209 ILERY                                                        213
            ILERY
Sbjct:  181 ILERY                                                        185
```

Based on this analysis, it was predicted that these proteins and their epitopes could be useful antigens for vaccines or diagnostics.

EXAMPLE 1199

A DNA sequence (GBSx1275) was identified in *S. agalactiae* <SEQ ID 3735> which encodes the amino acid sequence <SEQ ID 3736>. Analysis of this protein sequence reveals the following:

```
Possible site: 31
>>> Seems to have a cleavable N-term signal seq.
INTEGRAL   Likelihood = -11.04  Transmembrane  278-294  (270-298)
```

```
----- Final Results -----
         bacterial membrane --- Certainty = 0.5416 (Affirmative) < succ>
          bacterial outside --- Certainty = 0.0000 (Not Clear)   < succ>
        bacterial cytoplasm --- Certainty = 0.0000 (Not Clear)   < succ>
```

The protein has no significant homology with any sequences in the GENPEPT database.

No corresponding DNA sequence was identified in *S. pyogenes*.

SEQ ID 3736 (GBS150) was expressed in *E. coli* as a His-fusion product. SDS-PAGE analysis of total cell extract is shown in FIG. 23 (lane 7; MW 29.7 kDa) and in FIG. 175 (lane 4 & 5; MW 30 kDa).

Figure 110C:
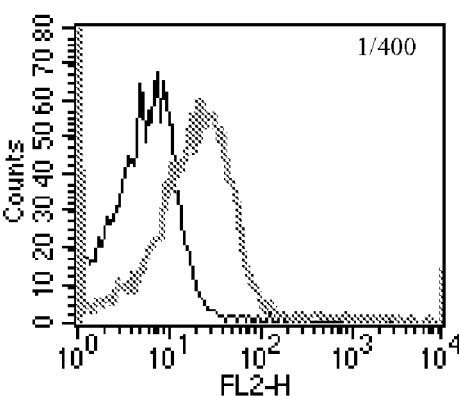
Figure 227:
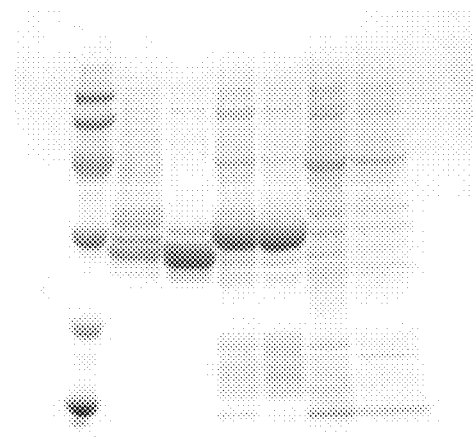

Purified GBS150-His is shown in FIG. 110A, FIG. 199 (lane 5) and FIG. 227 (lanes 6-7).

The purified GBS150-His fusion product was used to immunise mice (lane 1+2 product; 20 μg/mouse).

The resulting antiserum was used for Western blot (FIG. 110B), FACS (FIG. 110C), and in the in vivo passive protection assay (Table III). These tests confirm that the protein is immunoaccessible on GBS bacteria and that it is an effective protective immunogen.

Based on this analysis, it was predicted that this protein and its epitopes, could be useful antigens for vaccines or diagnostics.

EXAMPLE 1200

A DNA sequence (GBSx1276) was identified in *S. agalactiae* <SEQ ID 3737> which encodes the amino acid sequence <SEQ ID 3738>. This protein is predicted to be a fimbria-associated protein. Analysis of this protein sequence reveals the following:

```
Possible site: 40
>>> Seems to have an uncleavable N-term signal seq
INTEGRAL   Likelihood = -15.34   Transmembrane  264-280  (257-285)
INTEGRAL   Likelihood =  -7.64   Transmembrane   23-39    (12-41)

----- Final Results -----
         bacterial membrane --- Certainty = 0.7135 (Affirmative) < succ>
          bacterial outside --- Certainty = 0.0000 (Not Clear)   < succ>
        bacterial cytoplasm --- Certainty = 0.0000 (Not Clear)   < succ>
```

The protein has homology with the following sequences in the GENPEPT database.

```
>GP:AAC13546 GB:AF019629 putative fimbria-associated protein
[Actinomyces naeslundii]
Identities = 95/271 (35%), Positives = 139/271 (51%), Gaps = 16/271 (5%)

Query:   29 VGLLITSYPFISNWYYNIKANNQVTNFDNQTQKLNTKEINRRFELAKAYNRTLDPSRLSD   88
            +GLL  +YP  ++W       +   ++ Q      +  + E A AYN  L     + +
Sbjct:    1 MGLL--TYPTAASWVSQYNQSKVTADYSAQVDGARP-DAKTQVEQAHAYNDALSAGAVLE   57

Query:   89 PYTE------KEKKGIAEYAHMLEIAE--MIGYIDIPSIKQKLPIYAGTTSSVLEKGAGH  140
                      K     +YA++L+      ++ + IPSI    LP+Y GT    L  KG GH
Sbjct:   58 ANNHVPTGAGSSKDSSLQYANILKANNEGLMARLKIPSISLDLPVYHGTADDTLLKGLGH  117

Query:  141 LEGTSLPIGGKSSHTVITAHRGLPKAKLFTDLDKLKKGKIFYIHNIKEVLAYKVDQISVV  200
            LEGTSLP+GG+ +  +VIT HRGL +A +FT+LDK+K G      +   EVL Y+V    VV
Sbjct:  118 LEGTSLPVGGEGTRSVITGHRGLAEATMFTNLDKVKTGDSLIVEVFGEVLTYRVTSTKVV  177

Query:  201 KPDNFSKLLVVKGKDYATLLTCTPYSINSHRLLVRGHRIKYVPPVKEKNYLMKELQTHYK  260
            +P+    L V +GKD   TL+TCTP   IN+HR+L+ G RI Y  P K+       K    +
Sbjct:  178 EPEETEALRVEEGKDLLTLVTCTPLGINTHRILLTGERI-YPTPAKDLAAAGKRPDVPHF  236

Query:  261 LYFLLSILVILILVALLL----YLKRKFKER                              287
            ++ + +    LI+V L L       Y   + KER
Sbjct:  237 PWWAVGLAAGLIVVGLYLWRSGYAAARAKER                              267
```

A related DNA sequence was identified in *S. pyogenes* <SEQ ID 3739> which encodes the amino acid sequence <SEQ ID 3740>. Analysis of this protein sequence reveals the following:

```
Possible site: 49

>>> Seems to have no N-terminal signal sequence

INTEGRAL   Likelihood = -14.01   Transmembrane  225-241  (220-248)
```

```
----- Final Results -----
            bacterial membrane --- Certainty = 0.6604 (Affirmative) < succ>
             bacterial outside --- Certainty = 0.0000 (Not Clear)  < succ>
            bacterial cytoplasm --- Certainty = 0.0000 (Not Clear)  < succ>
```

The protein has homology with the following sequences in the databases:

```
>GP:AAC13546 GB:AF019629 putative fimbria-associated protein
[Actinomyces naeslundii]
Identities = 94/250 (37%), Positives = 133/250 (52%), Gaps = 17/250 (6%)

Query:   1 VECYRDRQLLSTYHKQVTQKKPSEMEEVWQKAKAYNARLGIQPVPDAF--------SFRD  52
           V  Y   ++ + Y QV   +P    +V ++A AYN  L    V +A        S +D
Sbjct:  13 VSQYNQSKVTADYSAQVDGARPDAKTQV-EQAHAYNDALSAGAVLEANNHVPTGAGSSKD  71

Query:  53 GIHDKNYESLLQIENNDIMGYVEVPSIKVTLPIYHYTTDEVLTKGAGHLFGSALPVGGDG 112
              Y  ++L+   N  +M  +++PSI + LP+YH T D+ L KG GHL G++LPVGG+G
Sbjct:  72 S--SLQYANILKANNEGLMARLKIPSISLDLPVYHGTADDTLLKGLGHLEGTSLPVGGEG 129

Query: 113 THTVISAHRGLPSAEMFTNLNLVKKGDTFYFRVLNKVLAYKVDQILTVEPDQVTSLSGVM 172
           T +VI+ HRGL  A MFTNL+ VK GD+    V  +VL Y+V       VEP++  +L
Sbjct: 130 TRSVITGHRGLAEATMFTNLDKVKTGDSLIVEVFGEVLTYRVTSTKVVEPEETEALRVEE 189

Query: 173 GKDYATLVTCTPYGVNTKRLLVRGHRIAYHYKKYQQAKKAMKLVDKSRMWAEVVCAAFGV 232
           GKD   TLVTCTP G+NT R+L+ G RI      Y   K +   K        A G+
Sbjct: 190 GKDLLTLVTCTPLGINTHRILLTGERI------YPTPAKDLAAAGKRPDVPHFPWWAVGL 243

Query: 233 VIAIILVFMY                                                   242
           +I+V +Y
Sbjct: 244 AAGLIVVGLY                                                   253
```

An alignment of the GAS and GBS proteins is shown below.

```
Identities = 93/192 (48%), Positives = 130/192 (67%), Gaps = 2/192 (1%)

Query:  52 VTNFDNQTQKLNTKEINRRFELAKAYNRTLDPSRLSDPYTEKEKKGIAEYAHMLEIA--E 109
           ++ +   Q +    E+   ++ AKAYN  L    + D ++ ++       Y  +L+I   +
Sbjct:  10 LSTYHKQVTQKKPSEMEEVWQKAKAYNARLGIQPVPDAFSFRDGIHDKNYESLLQIENND  69

Query: 110 MIGYIDIPSIKQKLPIYAGTTSSVLEKGAGHLEGTSLPIGGKSSHTVITAHRGLPKAKLF 169
           ++GY+++PSIK   LPIY  TT  VL KGAGHL G++LP GG   +HTVI+AHRGLP A++F
Sbjct:  70 IMGYVEVPSIKVTLPIYHYTTDEVLTKGAGHLFGSALPVGGDGTHTVISAHRGLPSAEMF 129

Query: 170 TDLDKLKKGKIFYIHNIKEVLAYKVDQISVVKPDNFSKLLVVKGKDYATLLTCTPYSINS 229
           T+L+   +KKG  FY     + +VLAYKVDQI   V+PD   + L V GKDYATL+TCTPY +N+
Sbjct: 130 TNLNLVKKGDTFYFRVLNKVLAYKVDQILTVEPDQVTSLSGVMGKDYATLVTCTPYGVNT 189

Query: 230 HRLLVRGHRIKY                                                 241
            RLLVRGHRI Y
Sbjct: 190 KRLLVRGHRIAY                                                 201
```

SEQ ID 3738 (GBS210) was expressed in *E. coli* as a GST-fusion product. SDS-PAGE analysis of total cell extract is shown in FIG. 50 (lane 3; MW 61 kDa).

Figure 152:
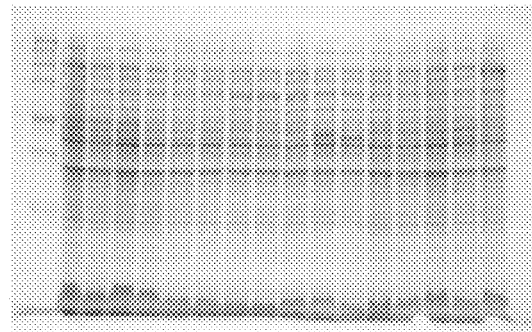

GBS210d was expressed in *E. coli* as a GST-fusion product. SDS-PAGE analysis of total cell extract is shown in FIG. 152 (lane 24; MW 54 kDa) and in FIG. 187 (lane 9; MW 54 kDa). It was also expressed in *E. coli* as a His-fusion product. SDS-PAGE analysis of total cell extract is shown in FIG. 154 (lane 24; MW 28.7 kDa) and in FIG. 182 (lane 13; MW 29 kDa). Purified GBS210d-GST is shown in lane 4 of FIG. 237.

Based on this analysis, it was predicted that these proteins and their epitopes could be useful antigens for vaccines or diagnostics.

EXAMPLE 1201

A DNA sequence (GBSx1277) was identified in *S. agalactiae* <SEQ ID 3741> which encodes the amino acid sequence <SEQ ID 3742>. This protein is predicted to be a fimbria-associated protein. Analysis of this protein sequence reveals the following:

```
            Possible site: 42
            >>> Seems to have an uncleavable N-term signal seq
            INTEGRAL   Likelihood = -10.61   Transmembrane   20-36    (15-40)
            INTEGRAL   Likelihood =  -7.27   Transmembrane  259-275   (258-277)
```

-continued

```
----- Final Results -----
            bacterial membrane --- Certainty = 0.5246 (Affirmative) < succ>
             bacterial outside --- Certainty = 0.0000 (Not Clear) < succ>
           bacterial cytoplasm --- Certainty = 0.0000 (Not Clear) < succ>
```

The protein has homology with the following sequences in the GENPEPT database.

```
>GP:AAC13546 GB:AF019629 putative fimbria-associated protein
[Actinomyces naeslundii]
Identities = 76/219 (34%), Positives = 120/219 (54%), Gaps = 12/219 (5%)

Query:  28 LSILLYPVVSRFYYTIESNNQTQDFERAAKKLSQKEINRRMALAQAYNDSLN-------N  80
           + +L YP + +     + T D+ A    ++ +    ++ A AYND+L+       N
Sbjct:   1 MGLLTYPTAASWVSQYNQSKVTADYS-AQVDGARPDAKTQVEQAHAYNDALSAGAVLEAN  59

Query:  81 VHLEDPYEKKRIQKGVAEYARMLEVSEK--IGTISVPKIGQKLPIFAGSSQEVLSKGAGH 138
           H+  P      +    +YA +L+ + +   + + +P I   LP++ G++ + L KG GH
Sbjct:  60 NHV--PTGAGSSKDSSLQYANILKANNEGLMARLKIPSISLDLPVYHGTADDTLLKGLGH 117

Query: 139 LEGTSLPIGGNSTHTVITAHSGIPDKELFSNLKKLKKGDKFYIQNIKETIAYQVDQIKVV 198
           LEGTSLP+GG  T +VIT H G+ +  +F+NL K+K GD    ++   E + Y+V   KVV
Sbjct: 118 LEGTSLPVGGEGTRSVITGHRGLAEATMFTNLDKVKTGDSLIVEVFGEVLTYRVTSTKVV 177

Query: 199 TPDNFSDLLVVPGHDYATLLTCTPIMINTHRLLVRGHRI                     237
           P+    L V G D  TL+TCTP+ INTHR+L+ G RI
Sbjct: 178 EPEETEALRVEEGKDLLTLVTCTPLGINTHRILLTGERI                      216
```

There is also homology to SEQ ID 3740.

A related GBS gene <SEQ ID 8749> and protein <SEQ ID 8750> were also identified. Analysis of this protein sequence reveals the following:

```
Lipop Possible site: -1  Crend: 10
McG: Discrim Score: 9.66
GvH: Signal Score (-7.5): -6.53
     Possible site: 42
>>> Seems to have an uncleavable N-term signal seq
ALOM program count: 2 value: -10.61 threshold: 0.0
 INTEGRAL     Likelihood = -10.61   Transmembrane 20-36    (15-40)
 INTEGRAL     Likelihood =  -7.27   Transmembrane 259-275  (258-277)
 PERIPHERAL   Likelihood =   5.14   216
 modified ALOM score: 2.62

*** Reasoning Step: 3

----- Final Results -----
            bacterial membrane --- Certainty = 0.5246 (Affirmative) < succ>
             bacterial outside --- Certainty = 0.0000 (Not Clear) < succ>
           bacterial cytoplasm --- Certainty = 0.0000 (Not Clear) < succ>
```

The protein has homology with the following sequences in the databases:

```
33.4/53.0% over 277aa
Actinomyces naeslundii
GP|3036999| putative fimbria-associated protein Insert characterized
ORF00563(382-1179 of 1479)
GP|3036999|gb|AAC13546.1||AF019629(1-278 of 365) putative fimbria-associated
protein {Actinomyces naeslundii}
% Match = 13.4
% Identity = 33.3   % Similarity = 53.0
Matches = 90   Mismatches = 118   Conservative Sub.s = 53
180         210        240       270        300       330       360       390
VVIMKRRQSKEA*G*SLMMYKRS*SCAYDLRVFQ*KYS*IISKSHYLGDDVKTKKIIKKTKKKKKSNLPFIILFLIGLSI
                                                                              : :
                                                                              MGL
420         450        480       510            549       579       609
LLYPVVSRFYYTIESNNQTQDFERAAKKLSQKEINRRMALAQAYNDSLN-------NVHLEDPYEKKRIQKGVAEYARML
| ||   : :       :  | |: |     :: :    ::  |:||||:|        | |: |      :   :|| :|
LTYPTAASWVSQYNQSKVTADYS-AQVDGARPDAKTQVEQAHAYNDALSAGAVLEANNHV--PTGAGSSKDSSLQYANIL
          20         30        40        50        60        70        80
```

-continued

```
          633       663       693       723       753       783       813       843
EVS--EKIGTISVPKIGQKLPIFAGSSQEVLSKGAGHLEGTSLPIGGNSTHTVITAHSGIPDKELFSNLKKLKKGDKFYI
: :    :   : :|  |     ||::  |::  :  |  ||  |||||||||||:|    |  :||   |:  :  :|| |:| ||  : :
KANNEGLMARLKIPSISLDLPVYHGTADDTLLKGLGHLEGTSLPVGGEGTRSVITGHRGLAEATMFTNLDKVKTGDSLIV
         90       100       110       120       130       140       150       160

873       903       933       963       993      1023      1053      1083
QNIKETIAYQVDQIKVVTPDNFSDLLVVPGHDYATLLTCTPIMINTHRLLVRGHRIPYKGPIDEKLIKDGHLNTIYRYLF
:  |  : |:|   |||  |:     |    |    |    |||:||||  ||||:|:  | ||   |     :  |     :  : :
EVFGEVLTYRVTSTKVVEPEETEALRVEEGKDLLTLVTCTPLGINTHRILLTGERI-YPTPAKD-LAAAGKRPDVPHFPW
         170       180       190       200       210       220       230

Y-----ISLVIIAWLLWL--IKRQRQKNR-LASVRKGIES*WEENFRKTLRNRSF*IDG*M*A*YYCS*LVF**PHILLF
:     |:::  ||        |  |  ||  |  |    :  :    :|       |      ::     |     |  :
WAVGLAAGLIVVGLYLWRSGYAAARAKERALARARAAQEEPQPQTWAEQMRIWMDDDAGVEPQRWFTDLPVPPQPSEMEN
         250       260       270       280       290       300       310
```

SEQ ID 8750 (GBS212) was expressed in *E. coli* as a His-fusion product. SDS-PAGE analysis of total cell extract is shown in FIG. 44 (lane 4; MW 36 kDa). It was also expressed in *E. coli* as a GST-fusion product. SDS-PAGE analysis of total cell extract is shown in FIG. 50 (lane 2; MW 61 kDa).

Purified Thio-GBS212-His is shown in FIG. 244, lane 5.

Based on this analysis, it was predicted that these proteins and their epitopes could be useful antigens for vaccines or diagnostics.

EXAMPLE 1202

A DNA sequence (GBSx1278) was identified in *S. agalactiae* <SEQ ID 3743> which encodes the amino acid sequence <SEQ ID 3744>. Analysis of this protein sequence reveals the following:

```
Possible site: 29
>>> Seems to have a cleavable N-term signal seq.
INTEGRAL    Likelihood = -10.40  Transmembrane 680-696 (674-699)

----- Final Results -----
             bacterial membrane --- Certainty = 0.5161 (Affirmative) < succ>
              bacterial outside --- Certainty = 0.0000 (Not Clear) < succ>
            bacterial cytoplasm --- Certainty = 0.0000 (Not Clear) < succ>
```

The protein has homology with the following sequences in the GENPEPT database.

```
>GP:CAA57459 GB:X81869 orf2 [Lactobacillus leichmannii]
Identities = 84/325 (25%), Positives = 122/325 (36%), Gaps = 94/325 (28%)

Query: 397 VNVVYTLKDKD----------------KTVASVSLTKTSKGTI---DLGNGIKFEVSGNF 437
           VNV + +KDKD                TV+    LTK++  T+     D G  + F+ +
Sbjct: 236 VNVPWNIKDKDTFNVVDKPDTGIDIDASTVSIDGLTKSTDYTVNKKDNGYQVVFKTT--- 292

Query: 438 SGKFTGLENKSYMISERVSGYGSAINLENGKVTITNTKDSNPTPLNPTEPKVETHGKKF 497
           S     L  KS  I+              K  T+TN  D     +  T     +G
Sbjct: 293 SAAVQALAGKSLTITY--------------KATLTNNATPDKA--IGNTATLSIGNGTNI 336

Query: 498 VKTNEQGDRL--AGAQFVVKNSAGKYLALKADQSEGQKTLAAKKIALDEAIAAYNKLSAT 555
              T  G R+    GAQFV K+S             +  KTLA  +  L  +   N +S
Sbjct: 337 TSTPANGPRIYTGGAQFVKKDS-----------QSNKTLAGAEFQLVKVDSNGNIVSYA 384

Query: 556 DQKGEKGITAKELIKTKQADYDAAFIEARTAYEWITDKARAITYTSNDQGQFEVTGLADG 615
                Q +                       +Y W     A TYTS+   G    + GL+
Sbjct: 385 TQASDG----------------------SYTWNDSATEATTYTSDANGLVALKGLSYS 420

Query: 616 -------TYNLEETLAPAGFAKLAGNIKFVVNQGSYITGGNIDYVANSNQKDATRVENKK 668
                  +Y L E  AP G+AKL   +KF + QGS+    G+ +  +    N K+
Sbjct: 421 DKLDSGESYALLEIQAPDGYAKLDSPVKFSITQGSF---GDSNKITIDNTKEG------- 470

Query: 669 VTIPQTGGIGTILFTIIGLSIMLGA                                   693
           +P TGG G +F  IG+ IM+ A
Sbjct: 471 -LLPSTGGKGIYIFLAIGIVIMIVA                                   494
```

No corresponding DNA sequence was identified in *S. pyogenes*.

SEQ ID 3744 (GBS59) was expressed in *E. coli* as a His-fusion product. SDS-PAGE analysis of total cell extract is shown in FIG. 7 (lane 8; MW 120 kDa), in FIG. 11 (lane 9; MW 100 kDa) and in FIG. 13 (lane 6; MW 74 kDa).

GBS59-His was purified as shown in FIG. 193, lane 2.

Based on this analysis, it was predicted that this protein and its epitopes, could be useful antigens for vaccines or diagnostics.

EXAMPLE 1203

A DNA sequence (GBSx1279) was identified in *S. agalactiae* <SEQ ID 3745> which encodes the amino acid sequence <SEQ ID 3746>. Analysis of this protein sequence reveals the following:

```
Possible site: 25
>>> Seems to have an uncleavable N-term signal seq
INTEGRAL   Likelihood = -3.13   Transmembrane   870-886   (864-887)

----- Final Results -----
              bacterial membrane --- Certainty = 0.2253 (Affirmative) < succ>
               bacterial outside --- Certainty = 0.0000 (Not Clear)   < succ>
              bacterial cytoplasm --- Certainty = 0.0000 (Not Clear)   < succ>
```

The protein has homology with the following sequences in the GENPEPT database.

```
>GP:AAD33086 GB:AF071083 fibronectin-binding protein I
[Streptococcus pyogenes]
Identities = 58/176 (32%), Positives = 83/176 (46%), Gaps = 19/176 (10%)

Query:     6 KFSKILTLSLFCLSQIPLNTNVLGEST---VPENGA--KGKLVVKKTDDQNKPLSKATFV  60
             K S +L+L+ F L  + +    + G S       NGA  +G    +KK D  NKPL  AT
Sbjct:     8 KLSFLLSLTGFILGLLLVFIGLSGVSVGHAETRNGANKQGSFEIKKVDQNNKPLPGATSS  67

Query:    61 LKTTAHPESKIEKVTAELTGEATFDNLIPGDYTLSEETAPEGYKKTNQTWQVKVESNGKT 120
             L +    + ++ T+  G   NL PG YTL EETAP+GY KT++TW V V  NG T
Sbjct:    68 LTSKDGKGTSVQTFTSNDKGIVDAQNLQPGTYTLKEETAPDGYDKTSRTWTVTVYENGYT 127

Query:   121 TIQNSGDKNSTIGQNQEELDKQYPPTGIYEDTKESYKLEHVKGSVPN--GKSEAKA     174
              +  +    I +             +D   S +LE+ K SV +   GK+E   +
Sbjct:   128 KLVENPYNGEIISKAGS------------KDVSSSLQLENPKMSVVSKYGKTEVSS     171

Identities = 31/92 (33%), Positives = 49/92 (52%), Gaps = 14/92 (15%)

Query:   725 PTITIKNEKKLGEIEFIKVDKDNNKLLLKGATFELQEFNEDYKLYLPIKNNNSKVVTGEN 784
             P+IT+  N K++ ++ F K+   DN  + L  A FEL+    N          N+ K+      N
Sbjct:   501 PSITVANLKRVAQLRFKKMSTDN--VPLPEAAFELRSSN----------GNSQKLEASSN 548

Query:   785 --GKISYKDLKDGKYQLIEAVSPEDYQKITNK                             814
               G++ +KDL   G Y L E  +P+  YQ++T K
Sbjct:   549 TQGEVHFKDLTSGTYDLYETKAPKGYQQVTEK                             580
```

No corresponding DNA sequence was identified in *S. pyogenes*.

SEQ ID 3746 (GBS67) was expressed in *E. coli* as a His-fusion product. SDS-PAGE analysis of total cell extract is shown in FIG. 7 (lane 10; MW 140 kDa), in FIG. 11 (lane 10; MW 150 kDa) and in FIG. 12 (lane 6; MW 95.3 kDa).

GBS67-His was purified as shown in FIG. 192, lane 10.

Based on this analysis, it was predicted that this protein and its epitopes, could be useful antigens for vaccines or diagnostics.

EXAMPLE 1204

A DNA sequence (GBSx1280) was identified in *S. agalactiae* <SEQ ID 3747> which encodes the amino acid sequence <SEQ ID 3748>. This protein is predicted to be Nra. Analysis of this protein sequence reveals the following:

```
Possible site: 34
>>> Seems to have no N-terminal signal sequence

----- Final Results -----
            bacterial cytoplasm --- Certainty = 0.2020 (Affirmative) < succ>
             bacterial membrane --- Certainty = 0.0000 (Not Clear)   < succ>
              bacterial outside --- Certainty = 0.0000 (Not Clear)   < succ>
```

A related GBS nucleic acid sequence <SEQ ID 9979> which encodes amino acid sequence <SEQ ID 9980> was also identified.

A related DNA sequence was identified in *S. pyogenes* <SEQ ID 3749> which encodes the amino acid sequence <SEQ ID 3750>. Analysis of this protein sequence reveals the following:

```
Possible site: 58
>>> Seems to have no N-terminal signal sequence
INTEGRAL   Likelihood = -1.75   Transmembrane   393-409    (392-409)

----- Final Results -----
             bacterial membrane --- Certainty = 0.1702 (Affirmative) < succ>
              bacterial outside --- Certainty = 0.0000 (Not Clear)   < succ>
            bacterial cytoplasm --- Certainty = 0.0000 (Not Clear)   < succ>
```

An alignment of the GAS and GBS proteins is shown below.

```
Identities = 122/325 (37%), Positives = 186/325 (56%), Gaps = 5/325 (1%)

Query:    7 LIENYLEKDILNQIKLLTLCY--DYYPSITLDKSCHQLGLSELLIRKYCHDLTTLFNSQL  64
            LIE YLE  I ++ +L+ L +   Y P   + +   + GL+ L +  YC +L   F    L
Sbjct:    1 LIEKYLESSIESKCQLIVLFFKTSYLP---ITEVAEKTGLTFLQLNHYCEELNAFFPGSL  57

Query:   65 SLNIEKSTIVYQSNGVTREQAFKYIYHQSHVLQLLKFLITNDSGRLPLTYFSEKFGLSCA 124
            S+ I+K  I  Q    +E    +Y  S+VLQLL FLI N S   PLT F+    LS +
Sbjct:   58 SMTIQKRMISCQFTHPFKETYLYQLYASSNVLQLLAFLIKNGSHSRPLTDFARSHFLSNS 117

Query:  125 TAYRIRKHISPLLEKLGFQIVKNTITGDEYRIRYLIAFLNAQFGIEVYPMSKMDKLLIKR 184
            +AYR+R+ + PLL      ++ KN I G+EYRIRYLIA L ++FGI+VY +++ DK I
Sbjct:  118 SAYRMREALIPLLRNFELKLSKNKIVGEEYRIRYLIALLYSKFGIKVYDLTQQDKNTIHS 177

Query:  185 LLLEHSTTFTASHYFPNTFIFFDTLLSLSWKRINYNVVVPYSSLFTELQNIFIYDTLQYC 244
            L   ST    S +   +F F+D LL+LSWKR  ++V +P + +F +L+ +F+YD+L++
Sbjct:  178 FLSHSSTHLKTSPWLSESFSFYDILLALSWKRHQFSVTIPQTRIFQQLKKLFVYDSLKKS 237

Query:  245 VKNVIIDSFKINLKKDDIDYIFLAYLTSHNSFSNPNWTEKRIDNVIAIFENYPKFQKLLQ 304
              ++I    ++N    D+DY++L Y+T++NSF++   WT + I     +FE    F+ LL
Sbjct:  238 SHDIIETYCQLNFSAGDLDYLYLIYITANNSFASLQWTPEHIRQYCQLFEENDTFRLLLN 297

Query:  305 PLKDALPLSGSYHDELVKVAIFFSE                                    329
            P+   LP        LVK  +FFS+
Sbjct:  298 PIITLLPNLKEQKASLVKALMFFSK                                    322
```

Based on this analysis, it was predicted that these proteins and their epitopes could be useful antigens for vaccines or diagnostics.

EXAMPLE 1205

A DNA sequence (GBSx1281) was identified in *S. agalactiae* <SEQ ID 3751> which encodes the amino acid sequence <SEQ ID 3752>. This protein is predicted to be galactosyltransferase. Analysis of this protein sequence reveals the following:

```
Possible site: 21
>>> Seems to have no N-terminal signal sequence (or aa 1-22)

----- Final Results -----
              bacterial cytoplasm --- Certainty = 0.1168 (Affirmative) < succ>
               bacterial membrane --- Certainty = 0.0000 (Not Clear)   < succ>
                 bacterial outside --- Certainty = 0.0000 (Not Clear)   < succ>
```

The protein has homology with the following sequences in the GENPEPT database.

```
>GP:AAB99071 GB:U67549 galactosyltransferase isolog [Methanococcus
jannaschii]
Identities = 108/395 (27%), Positives = 196/395 (49%), Gaps = 28/395 (7%)

Query:    4 KVKTVAVFSGYYLPFLGGIERYTDKMTADLVK-RGYRVVIVTTNHGDLPIIDEDKGR---  59
            K+K + +F GYY+P +GG+E + D+ T   L +    Y + I    N   +P    E + R
Sbjct:    3 KIKLI-IFPGYYIPHIGGLETHVDEFTKHLSEDENYDIYIFAPN---IPKYKEFEIRHNN  58

Query:   60 -KIYRLPTKNIVKQRYPIINK-NREYNTLMKYVSDENIDFVICNTRFQLTTLEGLSFAKN 117
             K+YR P    I+    YP+ N  N ++   +      + D V+  TRF    TL G   FAK
Sbjct:   59 VKVYRYPAFEIIPN-YPVPNIFNIKFWRMFFNLYKIDFDIVMTRTRFFSNTLLGFIFAKL 117

Query:  118 HHLPS--IVLDHGSSHFSVNNRFLDFFGAIYEHLLTARVKHYRPDFYAVSKRSVEWLKHF 175
                   I  ++HGS+   + + F +       Y+ +   +         A+SK      ++
Sbjct:  118 RFKKKKLIHVEHGSAFVKLESEFKNKLSYFYDKTIGKLIFKKADYVVAISKAVKNFILEN 177

Query:  176 NIEAKGV--IYNSVS----ESLGSDFAGTAYLEKSADDIFITYAGRIIKEKGIELLLEAF 229
             +    K +   IY +         ES+G D         EK    + I + + GR+ K  KG+E  +++A+
Sbjct:  178 FVNDKDIPIIYRGLEIEKIESIGED---KKIKEKFKNKIKLCFVGRLYKWKGVENIIKAY 234

Query:  230 S--MSQYSENVYLQIAGDGPELAHLKE---KYQSKQINFLGKLNFEQTMSLMAQTDIFVY 284
                    E + L + G G +L  LK+      Y +     I F GK++FE+  ++++    +DI+++
Sbjct:  235 VDLPKDLKEKIILIVVGYGEDLERLKKLAGNYLNNGIYFTGKVDFEKAIAIVKASDIYIH 294

Query:  285 PSMYPEGLPTSILEAGLLSSAIIATDRGGTVEVIDSPELGIIMEENT-QSLHESLDLLVK 343
                S     GL +S+L+A     AI+A+   G  EV+      GI++++N+ + +   + L++
Sbjct:  295 SSYKGGGLSSSLLQAMCCGKAIVASPYEGADEVVIDGYNGILLKDNSPEEIKRGIIKLIE 354

Query:  344 DKALREKLQQNIAKRIKEHFTWEKTVEKLDYIIQK                          378
            +   LR+    +N      IKE+F W+K+V++    I ++
Sbjct:  355 NNNLRKIYGENAKNFIKENFNWKKSVKEYKKIFER                          389
```

No corresponding DNA sequence was identified in *S. pyogenes*.

Figure 45:
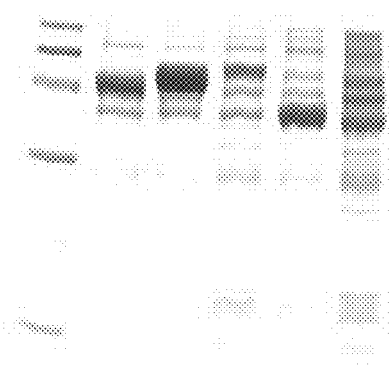

SEQ ID 3752 (GBS258) was expressed in *E. coli* as a His-fusion product. SDS-PAGE analysis of total cell extract is shown in FIG. 45 (lane 2; MW 43 kDa). It was also expressed in *E. coli* as a GST-fusion product. SDS-PAGE analysis of total cell extract is shown in FIG. 48 (lane 7; MW 67.9 kDa).

Based on this analysis, it was predicted that this protein and its epitopes, could be useful antigens for vaccines or diagnostics.

EXAMPLE 1206

A DNA sequence (GBSx1282) was identified in *S. agalactiae* <SEQ ID 3753> which encodes the amino acid sequence <SEQ ID 3754>. Analysis of this protein sequence reveals the following:

```
Possible site: 31
>>> Seems to have no N-terminal signal sequence

----- Final Results -----
              bacterial cytoplasm --- Certainty = 0.1182 (Affirmative) < succ>
               bacterial membrane --- Certainty = 0.0000 (Not Clear)   < succ>
                bacterial outside --- Certainty = 0.0000 (Not Clear)   < succ>
```

The protein has homology with the following sequences in the GENPEPT database.

```
>GP:CAB52237 GB:Z98171 EpsQ protein [Streptococcus thermophilus]
Identities = 112/278 (40%), Positives = 163/278 (58%), Gaps = 2/278 (0%)

Query:    1 MKYLAGIVTFNPNIERLDQNIRAIYPQVSHIYIVDNGSKNKEEISQLVADYNEEGHLTVD  60
            M  AGIV FNP+I+RL +NI A+  Q +H+Y+VDNGS N +E+  L+  YN+   +++
Sbjct:    1 MDISAGIVLFNPDIKRLKENIDAVIIQCTHLYLVDNGSGNVDEVKGLLNQYNQS-KISIL 59

Query:   61 YLTENKGIAYALNCIGQFAVAQEFDWFLTLDQDSVVLGDLIDNYENYLHLPKVGMLSCLY 120
            +  EN+GIA ALN +   A + FDW LTLDQDSVV  +++  +E Y++   VG+L  +
Sbjct:   60 WNRENQGIAKALNQLTSAAQKEGFDWILTLDQDSVVPSNIVGEFEKYINNSSVGILCPII 119

Query:  121 QDMNRENLVMQEFDYKEIEECITSAALMKTSVFEETSGFAEEMFIDFVDSEMNYRLSEMG 180
             D N++  +    D  EI+ECITS +L+   + E  GF E MFID VD ++ YRL + G
Sbjct:  120 CDRNKDEEIKINEDCTEIDECITSGSLLNIKAWSEIGGFDERMFIDGVDFDICYRLRQRG 179

Query:  181 YKTYQVNFIGLLHEIGHSSRVKKFGHVFHVLNHSPFRKYYMIRNAIYIIKKYGKKKRYKY 240
            YK Y ++ + LLHE+GH      +     V NHS FRKYY+ RN IY   KK
Sbjct:  180 YKIYCIHSVVLLHELGHIEYHRFLFWKVLVKNHSAFRKYYIARNIIYTAKKRRSTLLVVK 239

Query:  241 LVFMRNEFVRVLV-AEEQKSKKIVAMIKGLKDGLLMKV                       277
            +    + + +++  EE K  KI  +G+ DG    KV
Sbjct:  240 GLLQEIKLIGIVIFYEEDKLNKIRCICRGIYDGFKGKV                        277
```

No corresponding DNA sequence was identified in *S. pyogenes*.

Based on this analysis, it was predicted that this protein and its epitopes, could be useful antigens for vaccines or diagnostics.

EXAMPLE 1207

A DNA sequence (GBSx1283) was identified in *S. agalactiae* <SEQ ID 3755> which encodes the amino acid sequence <SEQ ID 3756>. This protein is predicted to be EpsU protein (rfbX). Analysis of this protein sequence reveals the following:

```
Possible site: 54
>>> Seems to have an uncleavable N-term signal seq

INTEGRAL   Likelihood = -8.44   Transmembrane  357-373   (352-387)
INTEGRAL   Likelihood = -7.59   Transmembrane   88-104    (79-107)
INTEGRAL   Likelihood = -7.32   Transmembrane  440-456   (433-465)
INTEGRAL   Likelihood = -6.48   Transmembrane  246-262   (245-263)
INTEGRAL   Likelihood = -4.78   Transmembrane  294-310   (290-312)
INTEGRAL   Likelihood = -3.88   Transmembrane  164-180   (162-183)
INTEGRAL   Likelihood = -3.56   Transmembrane  144-160   (136-161)
INTEGRAL   Likelihood = -2.87   Transmembrane  317-333   (316-334)
INTEGRAL   Likelihood = -2.71   Transmembrane  374-390   (374-393)
INTEGRAL   Likelihood = -0.96   Transmembrane   44-60     (44-62)
INTEGRAL   Likelihood = -0.80   Transmembrane   15-31     (15-32)

----- Final Results -----
               bacterial membrane --- Certainty = 0.4376 (Affirmative) < succ>
                bacterial outside --- Certainty = 0.0000 (Not Clear)   < succ>
              bacterial cytoplasm --- Certainty = 0.0000 (Not Clear)   < succ>
```

The protein has homology with the following sequences in the GENPEPT database.

```
>GP: CAB52225 GB: Z98171 EpsU protein [Streptococcus thermophilus]
Identities = 189/462 (40%), Positives = 313/462 (66%)

Query:    1 MKLLKNMFYNTSYQLLTLLLPLVTVPYVSRVLSPQGIGINAYTSSIVMYFTLFGALGISL    60
            M+++KN   YN   YQ+   +++PL+T+PY+SR+L P  GIGIN+YT+SIV YF LFG++G+ L
Sbjct:    1 MQIVKNYLYNAIYQVFIIIVPLLTIPYLSRILGPSGIGINSYTNSIVQYEVLFGSIGLGL    60

Query:   61 YGNREIAFVQSNKYKRSKIFWELVVLKLASVSIATLLFFGFVLLTNEWQLFYLIQGINLL   120
            YGNR+IAFV+ N+ K SK+F+E+ +L+L ++ +A  LF  F+++  ++  +YL Q I ++
Sbjct:   61 YGNRQIAFVRDNQVKMSKVFYEIFILRLFTICLAYFLFVAFLIINGQYYAYYLSQSIAIV   120

Query:  121 ATATDISWYFIGVEDFKIIVIRNTIVKLITVVLTFLVVKTPDDLALYMFLIAFASLLGNL   180
              A A DISW F+G+E+FK+IV+RN IVKL+ +    FL VK+ +DL +Y+ +    ++L+GNL
Sbjct:  121 AAAFDISWAFMGIENFKVIVLRNFIVKLLALFSIFLFVKSYNDLNIYILITVLSTLIGNL   180

Query:  181 TVWHHLKHEIIKIPFSRLDILIHLRPTLMLFLPQITMQIYLSLNKSMLGAMDSVVSAGYF   240
              T + L   ++K+ +  L  + HL+ +L++F+PQI +QIY   LNK+MLG++DSV S+G+F
Sbjct:  181 TFFPSLHRYLVKVNYRELRPIKHLKQSLVMFIPQIALQIYWVLNKTMLGSLDSVTSSGFF   240

Query:  241 DQSDKIIRILFTIVSAIGGVFLPRLSSLFSSGKEKQAKALLLKLVDLSNAISMLMIAGVV   300
            DQSDKI++++   IV+A G V LPR+++ F+  +  + K +         +AIS+ M+ G++
Sbjct:  241 DQSDKIVKLVLAIVTATGTVMLPRVANAFAHREYSKIKEYMYAGFSFVSAISIPMMFGLI   300

Query:  301 GVSSTFAVFFFGKGYEAVGPLMAVESLMIICISYGNALGTQYLLASRRTKAYTMSAVIGL   360
             ++   F     FF    +  V P++ +ES+ II I++ NA+G QYLL + +  K+YT+S +IG
Sbjct:  301 AITPKFVPLFFTSQFSDVIPVLMIESIAIIFIAWSNAIGNQYLLPTNQNKSYTVSVIIGA   360

Query:  361 VANVVLNILLIPILGAMGAIISTVITEFIVSLYQAISLRDVFTFKELTRGMLRYLIAATL   420
            + N++LNI LI   LGA+GA I+TVI+E  V++YQ   +     L    + +YLIA  +
Sbjct:  361 IVNLMLNIPLIIYLGAVGASIATVISEMSVTVYQLFIIHKQLNLHTLFSDLSKYLIAGLV   420

Query:  421 SGAVLYYINTQMSVSLVNYVIQSLVAVTIYVGIVFITKAPVI                    462
             +++ I+    S +  +++  V + IY+ ++   KA +I
Sbjct:  421 MFLIVFKISLLTPTSWIFILLEITVGIIIYIVLLIFLKAEII                    462
```

No corresponding DNA sequence was identified in *S. pyogenes*.

Based on this analysis, it was predicted that this protein and its epitopes, could be useful antigens for vaccines or diagnostics.

EXAMPLE 1208

A DNA sequence (GBSx1284) was identified in *S. agalactiae* <SEQ ID 3757> which encodes the amino acid sequence <SEQ ID 3758>. Analysis of this protein sequence reveals the following:

```
Possible site: 23
>>> Seems to have no N-terminal signal sequence

----- Final Results -----
          bacterial cytoplasm --- Certainty = 0.1742 (Affirmative) < succ>
          bacterial membrane  --- Certainty = 0.0000 (Not Clear)   < succ>
           bacterial outside  --- Certainty = 0.0000 (Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1209

A DNA sequence (GBSx1285) was identified in *S. agalactiae* <SEQ ID 3759> which encodes the amino acid sequence <SEQ ID 3760>. Analysis of this protein sequence reveals the following:

```
Possible site: 25
>>> Seems to have an uncleavable N-term signal seq

----- Final Results -----
            bacterial membrane --- Certainty = 0.0000 (Not Clear) < succ>
             bacterial outside --- Certainty = 0.0000 (Not Clear) < succ>
            bacterial cytoplasm --- Certainty = 0.0000 (Not Clear) < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1210

A DNA sequence (GBSx1286) was identified in *S. agalactiae* <SEQ ID 3761> which encodes the amino acid sequence <SEQ ID 3762>. Analysis of this protein sequence reveals the following:

```
Possible site: 34
>>> Seems to have no N-terminal signal sequence
INTEGRAL Likelihood = -10.56  Transmembrane 214-230  (210-236)
INTEGRAL Likelihood = -10.03  Transmembrane 364-380  (361-386)
INTEGRAL Likelihood =  -7.96  Transmembrane 272-288  (271-291)
INTEGRAL Likelihood =  -6.95  Transmembrane  23-39   (20-41)
INTEGRAL Likelihood =  -5.57  Transmembrane 191-207  (189-209)
INTEGRAL Likelihood =  -5.15  Transmembrane 434-450  (425-451)
INTEGRAL Likelihood =  -4.25  Transmembrane 143-159  (138-162)
INTEGRAL Likelihood =  -3.13  Transmembrane 167-183  (166-186)
INTEGRAL Likelihood =  -1.44  Transmembrane 400-416  (400-416)
INTEGRAL Likelihood =  -1.33  Transmembrane 333-349  (333-349)
INTEGRAL Likelihood =  -0.80  Transmembrane 232-248  (232-251)

----- Final Results -----
            bacterial membrane --- Certainty = 0.5225 (Affirmative) < succ>
             bacterial outside --- Certainty = 0.0000 (Not Clear)   < succ>
            bacterial Cytoplasm --- Certainty = 0.0000 (Not Clear)  < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1211

A DNA sequence (GBSx1287) was identified in *S. agalactiae* <SEQ ID 3763> which encodes the amino acid sequence <SEQ ID 3764>. This protein is predicted to be rhamnosyltransferase. Analysis of this protein sequence reveals the following:

```
Possible site: 17
>>> Seems to have no N-terminal signal sequence

----- Final Results -----
            bacterial cytoplasm --- Certainty = 0.1792 (Affirmative) < succ>
             bacterial membrane --- Certainty = 0.0000 (Not Clear)   < succ>
              bacterial outside --- Certainty = 0.0000 (Not Clear)   < succ>
```

A related GBS nucleic acid sequence <SEQ ID 9981> which encodes amino acid sequence <SEQ ID 9982> was also identified.

The protein has homology with the following sequences in the GENPEPT database.

```
>GP: AAF18951 GB: AF155805 Cps9H [Streptococcus suis]
Identities = 53/116 (45%), Positives = 75/116 (63%), Gaps = 4/116 (3%)

Query:  6 VLMATYNGQGFIHDQLDSIRNQTLRPDYVLMRDDGSTDDTVKVVEDYIKEHRLDGWSITS   65
          VLMATYNG  FI  QLDSIRNQ++   D V++ DD STDDT+K+++DYIK++ LD W ++
Sbjct:  4 VLMATYNGSPFIIKQLDSIRNQSVSADKVIIWDDCSTDDTIKIIKDYIKKYSLDSWVVSQ   63

Query: 66 NDKNLGWRLNFRQLLIDVLAYEVDYVFFSDQDDTWYHHKNKMQVDIMEERQDINLL      121
          N  N G    F L       +   VFFSDQDD W  HK +   + I  +R++++++
Sbjct: 64 NKSNQGHYQTFINL---TKLVQEGIVFFSDQDDIWDCHKIETMLPIF-DRENVSMV      115
```

Based on this analysis, it was predicted that these proteins and their epitopes could be useful antigens for vaccines or diagnostics.

EXAMPLE 1212

A DNA sequence (GBSx1288) was identified in *S. agalactiae* <SEQ ID 3765> which encodes the amino acid sequence <SEQ ID 3766>. This protein is predicted to be rhamnosyltransferase. Analysis of this protein sequence reveals the following:

```
Possible site: 13
>>> Seems to have no N-terminal signal sequence

----- Final Results -----
          bacterial cytoplasm --- Certainty = 0.1278 (Affirmative) < succ>
           bacterial membrane --- Certainty = 0.0000 (Not Clear)   < succ>
             bacterial outside --- Certainty = 0.0000 (Not Clear)   < succ>
```

A related GBS nucleic acid sequence <SEQ ID 9983> which encodes amino acid sequence <SEQ ID 9984> was also identified.

The protein has homology with the following sequences in the GENPEPT database.

```
>GP: AAF18951 GB: AF155805 Cps9H [Streptococcus suis]
Identities = 57/146 (39%), Positives = 81/146 (55%), Gaps = 8/146 (5%)

Query:  10 VLMATYNGEIFISEQLDSIRQQTLKPDYVLLRDDCSTDETVNVVNNYIAKHELEGWKIVK   69
           VLMATYNG  FI +QLDSIR Q++   D V++ DDCSTD+T+ ++ +YI K+ L+ W + +
Sbjct:   4 VLMATYNGSPFIIKQLDSIRNQSVSADKVIIWDDCSTDDTIKIIKDYIKKYSLDSWVVSQ   63

Query:  70 NDKNLGWRLNFRQLLIDVLAYEVDYVFFSDQDDIWYLDKNERQFAIMSDKPQIEVLSADV  129
           N  N G    F L       +    VFFSDQDDIW    K E   I D+ + +     V
Sbjct:  64 NKSNQGHYQTFINL---TKLVQEGIVFFSDQDDIWDCHKIETMLPIF-DRENVSM----V  115

Query: 130 DIKTMSTEASVPHFLTFSSSDRISQY                                   155
           K+   + +       +  +SDRI+ Y
Sbjct: 116 FCKSRLIDENGNIISSPDTSDRINTY                                   141
```

Based on this analysis, it was predicted that these proteins and their epitopes could be useful antigens for vaccines or diagnostics.

EXAMPLE 1213

A DNA sequence (GBSx1289) was identified in *S. agalactiae* <SEQ ID 3767> which encodes the amino acid sequence <SEQ ID 3768>. This protein is predicted to be dTDP-glucose 4-6-dehydratase (galE). Analysis of this protein sequence reveals the following:

```
Possible site: 44
>>> Seems to have no N-terminal signal sequence
INTEGRAL Likelihood = -2.02 Transmembrane 250-266 (250-266)

----- Final Results -----
             bacterial membrane --- Certainty = 0.1808 (Affirmative) < succ>
              bacterial outside --- Certainty = 0.0000 (Not Clear) < succ>
             bacterial cytoplasm --- Certainty = 0.0000 (Not Clear) < succ>
```

A related GBS nucleic acid sequence <SEQ ID 9985> which encodes amino acid sequence <SEQ ID 9986> was also identified.

The protein has homology with the following sequences in the GENPEPT database.

```
>GP: CAC14890 GB: AJ295156 d-TDP-glucose dehydratase [Phragmites
australis]
Identities = 108/327 (33%), Positives = 170/327 (51%), Gaps = 22/327 (6%)

Query:   29 ANKGVLISGSNSMLASYMVFLLAYLNETRNYQTQIIATARNIEKARDKFSDLVGKDYFTL    88
            AN  +L++G    + S++V L        N +  ++I         ++D    +G   F L
Sbjct:   33 ANLRILVTGGAGFIGSHLVDKLM-----ENEKHEVIVADNFFTGSKDNLKKWIGHPRFEL   87

Query:   89 IPYDVEERLEYDGKVDYIIHAASNASPTAILSNPVSIIKANTIGTLNLLDFAKEKTIENF  148
            I +DV + L  +  VD I H A ASP    NPV  IK N IGTLN+L  AK +
Sbjct:   88 IRHDVTQPLLVE--VDQIYHLACPASPIFYKHNPVKTIKTNVIGTLNMLGLAK-RVGARI  144

Query:  149 LFLSTREVYGTSIKEVIDEEAYGGFDILATRACYPESKRMAETLLQSYYDQYKVPFTIAR  208
            L  ST EVYG ++    E  +G  + +  R+CY E KR+AETL+  Y+ Q+ +    IAR
Sbjct:  145 LLTSTSEVYGDPLEHPQTEAYWGNVNPIGVRSCYDEGKRVAETLMFDYHRQHGIEIRIAR  204

Query:  209 IAHSFGPGMELGNDGRIMNDLLSNVIDGKDIVLKSSGTAERAFCYLADAVSGLFTILLNG  268
            I +++GP M + +DGR++++ ++ + G  + ++   GT   R+FCY+AD V GL    L+NG
Sbjct:  205 IFNTYGPRMNI-DDGRVVSNFIAQAVRGDPLTVQKPGTQTRSFCYVADMVDGLIK-LMNG  262

Query:  269 EVGQAYNVANEDQPIMIKDLAQKLVDLFSDKNISVVFDIPKTMSAGYSKMGRTR---LTM  325
              N+ N   +  M+ +LA+K+ +L +            ++  TM+        R R    +T
Sbjct:  263 NNTGPINLGNPGEFTML-ELAEKVKELINP-------EVTVTMTENTPDDPRQRKPDITK  314

Query:  326 AKLEALGWKREVSLESGILKTVQAFEE                                  352
            AK E LGW+ +V L  G++      F E
Sbjct:  315 AK-EVLGWEPKVVLRDGLVLMEDDFRE                                  340
```

Based on this analysis, it was predicted that these proteins and their epitopes could be useful antigens for vaccines or diagnostics.

EXAMPLE 1214

A DNA sequence (GBSx1290) was identified in *S. agalactiae* <SEQ ID 3769> which encodes the amino acid sequence <SEQ ID 3770>. Analysis of this protein sequence reveals the following:

```
Possible site: 53
>>> Seems to have an uncleavable N-term signal seq

----- Final Results -----
             bacterial membrane --- Certainty = 0.0000 (Not Clear) < succ>
              bacterial outside --- Certainty = 0.0000 (Not Clear) < succ>
             bacterial cytoplasm --- Certainty = 0.0000 (Not Clear) < succ>
```

A related GBS nucleic acid sequence <SEQ ID 9987> which encodes amino acid sequence <SEQ ID 9988> was also identified.

The protein has homology with the following sequences in the GENPEPT database.

```
>GP: CAB11866 GB: Z99104 similar to hypothetical proteins [Bacillus
subtilis]
Identities = 77/231 (33%), Positives = 131/231 (56%), Gaps = 6/231 (2%)
```

```
Query:   13 VIFAGGVGRRMNTKGKPKQFLEVHGKPIIVHTIDIFQNTEAIDAVVVVCVSDWLDYMNNL   72
            VI A G G+RM   G+ K F+E+ G P+I+HT+ +F +    D +++V       ++   L
Sbjct:    6 VIPAAGQGKRMKA-GRNKLFIELKGDPVIIHTLRVFDSHRQCDKIILVINEQEREHFQQL   64

Query:   73 VERFNLTKVKAVVAGGETGQMSIFKGLEAAEQLATDDAVVLIHDGVRPLINEEVINANIQ  132
            + +         +VAGG+  Q S++KGL+A +Q    + +VL+HDG RP I   E I+  I
Sbjct:   65 LSDYPFQTSIELVAGGDERQHSVYKGLKAVKQ----EKIVLVHDGARPFIKHEQIDELIA  120

Query:  133 SVKETGSAVTSVRAKETVVLVNDSSKISEVVDRTRSFIAKAPQSFYLSDILSVERDAISK  192
               ++TG+A+ +V  K+T+   V D  ++SE ++R+  +   +PQ+F LS ++    +A  K
Sbjct:  121 EAEQTGAAILAVPVKDTIKRVQDL-QVSETIERSSLWAVQTPQAFRLSLLMKAHAEAERK  179

Query:  193 GITDAIDSSTLMGMYNRELTIVEGPYENIKITTPDDFYMFKALYDARENEQ           243
               G    D+S +  M    + +VEG Y NIK+TTPDD    +A+ ++     +
Sbjct:  180 GFLGTDDASLVEQMEGGSVRVVEGSYTNIKLTTPDDLTSAEAIMESESGNK            230
```

No corresponding DNA sequence was identified in *S. pyogenes*.

SEQ ID 3770 (GBS647) was expressed in *E. coli* as a GST-fusion product. SDS-PAGE analysis of total cell extract is shown in FIG. 130 (lane 9 & 10; MW 55.9 kDa+lane 8; MW 27 kDa) and in FIG. 186 (lane 5; MW 56 kDa). It was also expressed in *E. coli* as a His-fusion product. SDS-PAGE analysis of total cell extract is shown in FIG. 130 (lane 12; MW 31 kDa), in FIG. 140 (lane 9; MW 31 kDa) and in FIG. 178 (lane 6; MW 31 kDa).

Purified GBS647-GST is shown in FIG. 243, lane 4; purified GBS647-His is shown in FIG. 229, lane 6.

Based on this analysis, it was predicted that these proteins and their epitopes could be useful antigens for vaccines or diagnostics.

EXAMPLE 1215

A DNA sequence (GBSx1291) was identified in *S. agalactiae* <SEQ ID 3771> which encodes the amino acid sequence <SEQ ID 3772>. This protein is predicted to be LicD1. Analysis of this protein sequence reveals the following:

```
Possible site: 41
>>> Seems to have no N-terminal signal sequence

----- Final Results -----
            bacterial cytoplasm --- Certainty = 0.2647 (Affirmative) < succ>
            bacterial membrane  --- Certainty = 0.0000 (Not Clear)   < succ>
             bacterial outside  --- Certainty = 0.0000 (Not Clear)   < succ>
```

A related GBS nucleic acid sequence <SEQ ID 9989> which encodes amino acid sequence <SEQ ID 9990> was also identified.

The protein has homology with the following sequences in the GENPEPT database.

```
>GP: AAD37094 GB: AF106539 LicD2 [Streptococcus pneumoniae]
Identities = 85/271 (31%) , Positives = 130/271 (47%) , Gaps = 15/271 (5%)

Query:    1 MKEMTVSEIREVQLEMLAYIDKVARDNKIEYSLGGGSLLGAMRHKGFIPWDDDIDLMLER   60
            M+ +    EI+E+QL +L YID+ + + I Y L  G++LGA+RHKG IPWDDDID+ L R
Sbjct:    1 MQYLEKKEIKEIQLALLDYIDETCKKHDIPYFLSYGTMLGAIRHKGMIPWDDDIDISLYR   60

Query:   61 SQYERLMKALADANNSDFKLLHHSVEKNLW---PFAKLYHTKSMYLSKTDRIHPWTGIFI  117
               YERL+K + + N+   +K+L   S ++ W      FA +    T ++         T +FI
Sbjct:   61 EDYERLLKIIEEENHPRYKVL--SYDTSSWYFHNFASILDTSTVIEDHVKYKRHDTSLFI  118
```

```
-continued
Query:  118 DIFPLDRLPESAEERQRFFKKVHSAAANLMCTTYPNFASGSRKLYANARLILGLP-RFIA   176
            D+FP+DR  + +     + +     + A   L            G  KL    RL     RF+
Sbjct:  119 DVFPIDRFTDLSIVDKSY---KYVALRQLAYIKKSRAVHGDSKLKDFLRLCSWYALRFVN   175

Query:  177 YHGQAKKRAEIVDQVMETYNNQEVPYMGYTD-SRYRLKEYFPREIFSEYEDVMFENIKTR   235
               KK   +DQ+++         Y G     +  +KE FP + F E       FE
Sbjct:  176 PRYFYKK----IDQLVKNAVTNTPQYEGGVGIGKEGMKEIFPVDTFKELILTEFEGRMLP   231

Query:  236 KIKNEHAYLNQLYGGSYMELPPESKRESHSY                               266
            K     +L Q+Y G YM  P +  +E +S+
Sbjct:  232 VPKKYDQFLTQMY-GDYMTPPSKEMQEWYSH                               261
```

No corresponding DNA sequence was identified in *S. pyogenes*.

Based on this analysis, it was predicted that these proteins and their epitopes could be useful antigens for vaccines or diagnostics.

EXAMPLE 1216

A DNA sequence (GBSx1292) was identified in *S. agalactiae* <SEQ ID 3773> which encodes the amino acid sequence <SEQ ID 3774>. Analysis of this protein sequence reveals the following:

```
Possible site: 18
>>> May be a lipoprotein
INTEGRAL Likelihood = -12.05 Transmembrane 554-570 (547-575)

----- Final Results -----
         bacterial membrane --- Certainty = 0.5819 (Affirmative) < succ>
          bacterial outside --- Certainty = 0.0000 (Not Clear)   < succ>
         bacterial cytoplasm --- Certainty = 0.0000 (Not Clear)  < succ>
```

The protein has no significant homology with any sequences in the GENPEPT database.

No corresponding DNA sequence was identified in *S. pyogenes*.

SEQ ID 3774 (GBS182d) was expressed in *E. coli* as a His-fusion product. SDS-PAGE analysis of total cell extract is shown in FIG. 184 (lane 8; MW 62 kDa).

Based on this analysis, it was predicted that this protein and its epitopes, could be useful antigens for vaccines or diagnostics.

EXAMPLE 1217

A DNA sequence (GBSx1293) was identified in *S. agalactiae* <SEQ ID 3775> which encodes the amino acid sequence <SEQ ID 3776>. Analysis of this protein sequence reveals the following:

```
Possible site: 13
>>> Seems to have no N-terminal signal sequence

----- Final Results -----
         bacterial cytoplasm --- Certainty = 0.4653 (Affirmative) < succ>
          bacterial membrane --- Certainty = 0.0000 (Not Clear)   < succ>
          bacterial outside --- Certainty = 0.0000 (Not Clear)    < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1218

A DNA sequence (GBSx1294) was identified in *S. agalactiae* <SEQ ID 3777> which encodes the amino acid sequence <SEQ ID 3778>. This protein is predicted to be DOLICHYL-PHOSPHATE MANNOSE SYNTHASE RELATED PROTEIN. Analysis of this protein sequence reveals the following:

```
Possible site: 29
>>> Seems to have an uncleavable N-term signal seq
INTEGRAL Likelihood = -2.92 Transmembrane 232-248 (231-248)

----- Final Results -----
              bacterial membrane --- Certainty = 0.2168 (Affirmative) < succ>
               bacterial outside --- Certainty = 0.0000 (Not Clear) < succ>
                bacterial cytoplasm --- Certainty = 0.0000 (Not Clear) < succ>
```

A related GBS nucleic acid sequence <SEQ ID 9991> which encodes amino acid sequence <SEQ ID 9992> was also identified.

The protein has homology with the following sequences in the GENPEPT database.

```
>GP: AAC35924 GB: AF071085 putative glycosyl transferase [Enterococcus
faecalis]
Identities = 118/240 (49%), Positives = 152/240 (63%), Gaps = 1/240 (0%)

Query:  14 KILLVIPAYNEEGSIAKTVQTIVDFKASRS-LPFELDYIVINDGSTDGTPELLDRLGLNH   72
           K+LL+IPAYNEE +I +T+ +I  FK     +   ELDY+VINDGSTDGT ++L+    +N
Sbjct:   2 KVLLIIPAYNEEENILRTIASIETFKQEVTHFQHELDYVVINDGSTDGTKQILEVNQINA  61

Query:  73 IDLVQNLGIGGCVQTGYLYANRNHYDVAVQFDGDGQHDIRSIEDVVMPILNDEADFVIGS  132
           I LV NLGIGG VQTGY YA  N YDVA QFDGDG HDI S+ ++ P+     F  GS
Sbjct:  62 IHLVLNLGIGGAVQTGYKYALENEYDVAXQFDGDGXHDIXSLPILLEPLAEGXCXFSXGS 121

Query: 133 RFVDKKHQNFQSTAMRRLGINLISAAIKLTTGHKVYDTTSGYRAANAALIAYLSCHYPVQ 192
           RF+     +FQS  MRR GI L+S        G  +Y  T G RA N +IA+ +   YP
Sbjct: 122 RFIPGNXASFQSXKMRRXGIRLLSFCXXXAXGXTIYXVTXGXRAGNRKVIAFFAKRYPTN 181

Query: 193 YPEPESTARILKKGYRLKEVTANMFEREAGTSSISSLKSIFYMTDVLTSIIIAGFIKEDD 252
           YPEPES   ++KK +  + E    NM ER  G SSI +L S+ YM +V +++I+IA F+KE D
Sbjct: 182 YPEPESIVHLIKKRFVIVERPVNMMERLGGVSSIRALASVKYMLEVGSAILIAPFMKEGD 241
```

A related DNA sequence was identified in *S. pyogenes* <SEQ ID 3779> which encodes the amino acid sequence <SEQ ID 3780>. Analysis of this protein sequence reveals the following:

```
Possible site: 56
>>> Seems to have no N-terminal signal sequence
INTEGRAL Likelihood = -0.80 Transmembrane 211-227 (211-227)

----- Final Results -----
              bacterial membrane --- Certainty = 0.1319 (Affirmative) < succ>
               bacterial outside --- Certainty = 0.0000 (Not Clear) < succ>
                bacterial cytoplasm --- Certainty = 0.0000 (Not Clear) < succ>
```

The protein has homology with the following sequences in the databases:

```
>GP: AAC35924 GB: AF071085 putative glycosyl transferase [Enterococcus
faecalis]
Identities = 104/233 (44%), Positives = 134/233 (56%), Gaps = 9/233 (3%)

Query:     1 VKKLIIIPAYNESSNIVNTIRTIESDAPD-------FDYIIIDDCSTDNTLAICQKQGFN    53
             +K L+IIPAYNE  NI+ TI +IE+   +         DY++I+D STD T  I +    N
Sbjct:     1 MKVLLIIPAYNEEENILRTIASIETFKQEVTHFQHELDYVVINDGSTDGTKQILEVNQIN   60

Query:    54 VISLPINLGIGGAVQTGYRYAQRCGYDVAVQVDGDGQHNPCYLEKMVEVLVQSSVNMVIG  113
             I L +NLGIGGAVQTGY+YA    YDVA Q DGDG H+   L  ++E L  +        G
Sbjct:    61 AIHLVLNLGIGGAVQTGYKYALENEYDVAXQFDGDGXHDIXSLPILLEPLAEGXCXFSXG  120

Query:   114 SRFI--TKEGFQSSFARRIGIKYFTWLIALLTGKKITDATSGLRLIDRSLIERFANHYPD  171
             SRFI    FQS  RR GI+ ++       G I   T G R +R +I  FA  YP
Sbjct:   121 SRFIPGNXASFQSXKMRRXGIRLLSFCXXXAXGXTIYXVTXGXRAGNRKVIAFFAKRYPT  180

Query:   172 DYPEPETVVDVLVSHFKVKEIPVVMNERQGGVSSISLTKSVYYNIKVTLAILV         224
             +YPEPE++V ++   F + E PV M ER GGVSSI    SV YM++V  AIL+
Sbjct:   181 NYPEPESIVHLIKKRFVIVERPVNMMERLGGVSSIRALASVKYMLEVGSAILI         233
```

An alignment of the GAS and GBS proteins is shown below.

```
Identities = 105/231 (45%), Positives = 142/231 (61%), Gaps = 8/231 (3%)

Query:    14 KILLVIPAYNEEGSIAKTVQTIVDFKASRSLPFELDYIVINDGSTDGTPELLDRLGLNHI   73
             K L++IPAYNE  +I  T++TI        S +   + DYI+I+D STD T  +  + G N I
Sbjct:     2 KKLIIIPAYNESSNIVNTIRTI------ESDAPDFDYIIIDDCSTDNTLAICQKQGFNVI   55

Query:    74 DLVQNLGIGGCVQTGYLYANRNHYDVAVQFDGDGQHDIRSIEDVVMPILNDEADFVIGSR  133
             L  NLGIGG VQTGY YA R  YDVAVQ DGDGQH+   +E +V  ++         + VIGSR
Sbjct:    56 SLPINLGIGGAVQTGYRYAQRCGYDVAVQVDGDGQHNPCYLEKMVEVLVQSSVNMVIGSR  115

Query:   134 FVDKKHQNFQSTAMRRLGINLISAAIKLTTGHKVYDTTSGYRAANAALIAYLSCHYPVQY  193
             F+ K  + +FQS+  RR+GI   +  I L TG K+ D TSG R   + +LI   + HYP Y
Sbjct:   116 FITK--EGFQSSFARRIGIKYFTWLIALLTGKKITDATSGLRLIDRSLIERFANHYPDDY  173

Query:   194 PEPESTARILKKGYRLKEVTANMFEREAGTSSISSLKSIFYMTDVLTSIII           244
             PEPE+   +L    +++KE+   M ER+ G SSIS   KS++YM V  +I++
Sbjct:   174 PEPETVVDVLVSHFKVKEIPVVMNERQGGVSSISLTKSVYYMIKVTLAILV           224
```

A related GBS gene <SEQ ID 8751> and protein <SEQ ID 8752> were also identified. Analysis of this protein sequence reveals the following:

```
Lipop: Possible site: -1 Crend: 9
McG: Discrim Score: 0.29
GvH: Signal Score (-7.5): -4.34
Possible site: 29
>>> Seems to have an uncleavable N-term signal seq
ALOM program count: 1 value: -2.92 threshold: 0.0
INTEGRAL Likelihood = -2.92 Transmembrane 222-238 (221-238)
PERIPHERAL   Likelihood =  4.40   4
modified ALOM score: 1.08

*** Reasoning Step: 3

----- Final Results -----
                bacterial membrane --- Certainty = 0.2168 (Affirmative) < succ>
                bacterial outside  --- Certainty = 0.0000 (Not Clear) < succ>
                bacterial cytoplasm --- Certainty = 0.0000 (Not Clear) < succ>
```

The protein has homology with the following sequences in the databases:

```
ORF00548(340-1056 of 1359)
GP|3608398|gb|AAC35924.1||AF071085(2-241 of 241) putative glycosyl transferase
{Enterococcus faecalis}
% Match = 24.7
% Identity = 49.2  % Similarity = 64.2
Matches = 118  Mismatches = 85  Conservative Sub.s = 36
        249       279       309       339       369       399       429       456
    L*QD*GGYGNMVIAKINLSIKLCLNG*XQQIIXIRDKMMKKILLVIPAYNEEGSIAKTVQTIVDFKASRS-LPFELDYIV
                                           |:||:|||||||| :| :|: :|  ||   : :  ||||:|
                                        MKVLLIIPAYNEEENILRTIASIETFKQEVTHFQHELDYVV
                                                   10        20        30        40
        486       516       546       576       606       636       666       696
    INDGSTDGTPELLDRLGLNHIDLVQNLGIGGCVQTGYLYANRNHYDVAVQFDGDGQHDIRSIEDVVMPILNDEADFVIGS
    ||||||||| ::|:  :|  ||  |||||| |||| ||    ||||  ||||||| ||| |:  :: |:       |  ||
    INDGSTDGTKQILEVNQINAIHLVLNLGIGGAVQTGYKYALENEYDVAXQFDGDGXHDIXSLPILLEPLAEGXCXFSXGS
              60        70        80        90        100       110       120
        726       756       786       816       846       876       906       936
    RFEDKKHQNFQSTAMRRLGINLISAAIKLTGHKVYDTTSGYRAANAALIAYLSCHYPVQYPEPESTARILKKGYRLKEV
    ||:    :|||   ||  || |:|      :|  |  |||||: ||  ||||||   ::||   : |  |
    RFIPGNXASFQSXKMRRXGIRLLSFCXXXAXGXTIYXVTXGXRAGNRKVIAFFAKRYPTMYPEPESIVHLIKKRFVIVER
              140       150       160       170       180       190       200
        966       996       1026      1056      1086      1116      1146      1176
    TANMFEREAGTSSISSLKSIFYMTDVLTSIIIAGFIKEDDK*V*HCKLKCLF*PLSYFI*L*EWLIKTHFLLNVLYLGY*
    || || | ||| :| |: || :| ::|:|| |:|| |
    PVNMMERLGGVSSIRALASVKYMLEVGSAILIAPFMKEGD
              220       230       240
```

SEQ ID 8752 (GBS355) was expressed in *E. coli* as a His-fusion product. SDS-PAGE analysis of total cell extract is shown in FIG. 74 (lane 4; MW 27 kDa). It was also expressed in *E. coli* as a GST-fusion product. SDS-PAGE analysis of total cell extract is shown in FIG. 81 (lane 7; MW 52 kDa).

GBS355-GST was purified as shown in FIG. 213 (lane 4) and in FIG. 216 (lane 6).

Based on this analysis, it was predicted that these proteins and their epitopes could be useful antigens for vaccines or diagnostics.

EXAMPLE 1219

A DNA sequence (GBSx1295) was identified in *S. agalactiae* <SEQ ID 3781> which encodes the amino acid sequence <SEQ ID 3782>. Analysis of this protein sequence reveals the following:

```
Possible site: 19
>>> Seems to have no N-terminal signal sequence
INTEGRAL Likelihood = -1.91 Transmembrane 185-201 (185-201)

----- Final Results -----
            bacterial membrane --- Certainty = 0.1765 (Affirmative) < succ>
             bacterial outside --- Certainty = 0.0000 (Not Clear) < succ>
            bacterial cytoplasm --- Certainty = 0.0000 (Not Clear) < succ>
```

The protein has homology with the following sequences in the GENPEPT database.

```
>GP: BAA32090 GB: AB010970 rhamnosyltransferase [Streptococcus mutans]
Identities = 181/315 (57%), Positives = 244/315 (77%), Gaps = 7/315 (2%)

Query:   1 MKVNILMATYNGEKFLAQQIESIQKQTFKEWNLLIRDDGSSDKTCDIIRNFTAKDSRIRF    60
            MKVNILM+TYNG++F+AQQI+SIQKQTF+ WNLLIRDDGSSD T    II +F    D+RIRF
Sbjct:   1 MKVNILMSTYNGQEFIAQQIQSIQKQTFENWNLLIRDDGSSDGTPKIIADFAKSDARIRF    60

Query:  61 INENEHHNLGVIKSFFTLVNYEVADFYFFSDQDDVWLPEKLSVSLEAAKHKASDVPLLVY   120
           IN ++   N GVIK+F+TL+  YE AD+YFFSDQDDVWLP KL  ++L + + +  +PL+VY
Sbjct:  61 INADKRENFGVIKNFYTLLKYEKADYYFFSDQDDVWLPQKLELTLASVEKENNQIPLMVY   120
Query: 121 TDLKVVNQELNILQDSMIRAQSHHANTTLLPELTENTVTGGTMMINHALAEKW-FTPNDI  179
```

-continued

```
             TDL VV+++L +L DSMI+ QSHHANT+LL ELTENTVTGGTMM+NH LA++W     +D+
Sbjct:  121 TDLTVVDRDLQVLHDSMIKTQSHHANTSLLEELTENTVTGGTMMVNHCLAKQWKQCYDDL  180

Query:  180 LMHDWFLALLAASLGEIIYLDLPTQLYRQHDNNVLGARTMDKRFK-ILREGPKSIFTRYW  238
             +MHDW+LALLAASLG++IYLD  T+LYRQH++NVLGART  KR K  LR  P  +  +YW
Sbjct:  181 IMHDWYLALLAASLGKLIYLDETTELYRQHESNVLGARTWSKRLKNWLR--PHRLVKKYW  238

Query:  239 KLIHDSQKQASLIVDKYGDIMTANDLELIKCFIKIDKQPFMTRLRWLWKYGYSKNQFKHQ  298
             L+    SQ+QAS +++     D+   AN    +I+  ++  +    Q  F+  R++WL  +YG++KN+  H
Sbjct:  239 WLVTSSQQQASHLLEL-DLPAANK-AIIRAYVTLLDQSFLNRIKWLKQYGFAKNRAFHT   295

Query:  299 VVFKWLIATNYYNKR                                              313
             VFK LI T + +R
Sbjct:  296 FVFKTLIITKFGYRR                                              310
```

A related DNA sequence was identified in *S. pyogenes* <SEQ ID 817> which encodes the amino acid sequence <SEQ ID 818>. Analysis of this protein sequence reveals the following:

```
Possible site: 43
>>> Seems to have no N-terminal signal sequence

----- Final Results -----
            bacterial cytoplasm --- Certainty = 0.1980(Affirmative) < succ>
            bacterial membrane  --- Certainty = 0.0000(Not Clear)   < succ>
             bacterial outside  --- Certainty = 0.0000(Not Clear)   < succ>
```

An alignment of the GAS and GBS proteins is shown below.

```
Identities = 178/314 (56%), Positives = 232/314 (73%), Gaps = 6/314 (1%)

Query:    1 MKVNILMATYNGEKFLAQQIESIQKQTFKEWNLLIRDDGSSDKTCDIIRNFTAKDSRIRF   60
            M +NIL++TYNGE+FLA+QI+SIQ+QT  +W LLIRDDGS+D T DIIR F  +D RI++
Sbjct:    1 MNINILLSTYNGERFLAEQIQSIQRQTVNDWTLLIRDDGSTDGTQDIIRTFVKEDKRIQW  60

Query:   61 INENEHHNLGVIKSFFTLVNYEVADFYFFSDQDDVWLPEKLSVS-LEAAKHKASDVPLLV  119
            INE +   NLGVIK+F+TL+  ++ AD YFFSDQDD+WL   KL V+ LEA KH+  + PLLV
Sbjct:   61 INEGQTENLGVIKNFYTLLKHQKADVYFFSDQDDIWLDNKLEVTLLEAQKHEMT-APLLV  119

Query:  120 YTDLKVVNQELNILQDSMIRAQSHHANTTLLPELTENTVTGGTMMINHALAEKWFTPNDI  179
            YTDLKVV Q L +  DSMI+ QS HANT+LL  ELTENTVTGGTMMI HALAE+W T + +
Sbjct:  120 YTDLKVVTQHLAVCHDSMIKTQSGHANTSLLQELTENTVTGGTMMITHALAEEWTTCDGL  179

Query:  180 LMHDWFLALLAASLGEIIYLDLPTQLYRQHDNNVLGARTMDKRFKILREGPKSIFTRYWK  239
            LMHDW+LALLA+++G+++YLD+PT+LYRQHD NVLGART  KR K      P  +  +YW
Sbjct:  180 LMHDWYLALLASAIGKLVYLDIPTELYRQHDANVLGARTWSKRMKNWLT-PHHLVNKYWW  238

Query:  240 LIHDSQKQASLIVDKYGDIMTANDLELIKCFIKIDKQPFMTRLRWLWKYGYSKNQFKHQV  299
            LI  SQEQA L++D     + ND EL+  ++  +     PF  RL   L +YG+ KN+  H
Sbjct:  239 LITSSQKQAQLLLDL---PLKPNDHELVTAYVSLLDMPFTKRLATLKRYGFRKNRIFHTF  295

Query:  300 VFKWLIATNYYNKR                                              313
            +F+ L+ T + +R
Sbjct:  296 IFRSLVVTLFGYRR                                              309
```

Based on this analysis, it was predicted that these proteins and their epitopes could be useful antigens for vaccines or diagnostics.

EXAMPLE 1220

A DNA sequence (GBSx1296) was identified in *S. agalactiae* <SEQ ID 3783> which encodes the amino acid sequence <SEQ ID 3784>. This protein is predicted to be rgpAc. Analysis of this protein sequence reveals the following:

```
Possible site: 21
>>> Seems to have no N-terminal signal sequence

----- Final Results -----
            bacterial cytoplasm --- Certainty = 0.1881(Affirmative) < succ>
```

-continued

```
              bacterial membrane --- Certainty = 0.0000(Not Clear) < succ>
              bacterial outside  --- Certainty = 0.0000(Not Clear) < succ>
```

A related GBS nucleic acid sequence <SEQ ID 9993> which encodes amino acid sequence <SEQ ID 9994> was also identified.

The protein has homology with the following sequences in the GENPEPT database.

```
>GP: BAA32089 GB: AB010970 rgpAc [Streptococcus mutans]
Identities = 234/362 (64%), Positives = 284/362 (77%)

Query:   33 VSELINHQKSFDIKYHVACLSDKEHHTHFNFADADCFTINPPQLGPARVIAYDIMAINYA   92
            + EL+ +++S  + YHVACLS+ + H HF +   DCFTI  P+LGPARVIAYD+MAI YA
Sbjct:    1 MEELVKYKQSQQLTYHVACLSETDQHKHFTYLGVDCFTIKAPKLGPARVIAYDMMAIRYA   60

Query:   93 LDLVKTHDLKEPIFYILGNTIGAFIWHFANKIHKVGGLLYVNPDGLEWKRSKWSRPTQRY  152
            L L+K   +K PIFYILGNTIGAF+  FA KI ++GG  Y+NPDGLEW+RSKWSRP Q Y
Sbjct:   61 LKLIKDQKIKHPIFYILGNTIGAFMGPFARKIKRIGGRFYINPDGLEWRRSKWSRPVQAY  120

Query:  153 LKYAEKCMTKNADLIISDNIGIENYIQSTYSNVKTRFIAYGTEINSRKLSSDDPRVKQLF  212
            LKYAEKCMTK ADL+ISDN GIE YI+  Y   KT FIAYGT+++    L  +D +VK +
Sbjct:  121 LKYAEKCMTKKADLVISDNTGIEGYIKQMYPWAKTTFIAYGTDLSPSGLLKNDSKVKDFY  180

Query:  213 KKWNIKSKGYYLIVGRFVPENNYETAIREFMASDTKRDLVIICNHQNNPYFEKLSLKTNL  272
            KKW  IK KGYYLIVGRFVPENNYETAIREFM S  ++RDLVIICN++ N YFE L   KT
Sbjct:  181 KKWAIKDKGYYLIVGRFVPENNYETAIREFMTSSSERDLVIICNYEGNAYFEDLRQKTEF  240

Query:  273 QQDKRVKFVGTLYEKDLLDYVRQQAFAYIHGHEVGGTNPGLLEALANTDLNLVLDVDFNK  332
             +DKR+KFVGT+Y++  LL  Y+R+QAFAYIHGHEVGGTNPGLLEALA+TDLNLVL   +FN
Sbjct:  241 DKDKRIKFVGTVYDRPLLTYIREQAFAYIHGHEVGGTNPGLLEALAHTDLNLVLITEFNY  300

Query:  333 SVAGLSSFYWAKKEGDLAKLINDSDQQQDLSTYGDRAKAIIQENYTWKKIVEEYEDLFLN  392
             +VA  ++ YW +  G LA+LIN  D+Q++ + YG RAK II    YTW+KIVEEYEDLFL+
Sbjct:  301 TVALDAARYWTQDNGSLAQLINQFDKQENFAEYGQRAKEIIVNYYTWEKIVEEYEDLFLH  360

Query:  393 ES                                                           394
            ES
Sbjct:  361 ES                                                           362
```

A related DNA sequence was identified in *S. pyogenes* <SEQ ID 3785> which encodes the amino acid sequence <SEQ ID 3786>. Analysis of this protein sequence reveals the following:

```
Possible site: 23
>>> Seems to have no N-terminal signal sequence
    INTEGRAL     Likelihood = -1.38    Transmembrane    95-111 (95-111)

----- Final Results -----
              bacterial membrane --- Certainty = 0.1553(Affirmative) < succ>
              bacterial outside  --- Certainty = 0.0000(Not Clear)   < succ>
              bacterial cytoplasm --- Certainty = 0.0000(Not Clear)  < succ>
```

An alignment of the GAS and GBS proteins is shown below.

```
Identities = 250/383 (65%), Positives = 307/383 (79%)

Query:   11 MQDVFIIGSRGLPARYGGFETFVSELINHQKSFDIKYHVACLSDKEHHTHFNFADADCFT   70
            MQDVFIIGSRGLPA+YGGFETFV  ELI+HQ S +I+YHVACLSD +H  HF++  ADCF
Sbjct:    1 MQDVFIIGSRGLPAKYGGFETFVEELISHQSSKNIRYHVACLSDTKHKVHFDYKGADCFY   60

Query:   71 INPPQLGPARVIAYDIMAINYALDLVKTHDLKEPIFYILGNTIGAFIWHFANKIHKVGGL  130
            +NPP+LGPARVIAYD+MAI YAL    H ++ PIFY+LGNT+GAFI  F  +IH  GG
Sbjct:   61 LNPPKLGPARVIAYDMMAITYALSYSDQHQIQNPIFYVLGNTVGAFIAPFVKQIHNRGGR  120

Query:  131 LYVNPDGLEWKRSKWSRPTQRYLKYAEKCMTKNADLIISDNIGIENYIQSTYSNVKTRFI  190
            ++NPDGLEWKRSKWSRP Q YLK++EK MT+ ADL+ISDNIGI+ Y++  Y    KT FI
Sbjct:  121 FFINPDGLEWKRSKWSRPVQAYLKFSEKQMTRQADLVISDNIGIDRYLKQVYPWSKTCFI  180
```

```
-continued

Query:  191 AYGTEINSRKLSSDDPRVKQLFKKWNIKSKGYYLIVGRFVPENNYETAIREFMASDTKRD  250
            AYGT+    +L++ D +V+  F+ ++I+ K YYLI+GRFVPENNYETAI+EFMAS TKRD
Sbjct:  181 AYGTQTQPSRLATADSKVRAYFQTFDIREKDYYLILGRFVPENNYETAIKEFMASSTKRD  240

Query:  251 LVIICNHQNNPYFEKLSLKTNLQQDKRVKFVGTLYEKDLLDYVRQQAFAYIHGHEVGGTN  310
            LVIICNH+ N YF++L  +T   +D R+KFVGTLY+K+LL Y+R+QA+AYIHGHEVGGTN
Sbjct:  241 LVIICNHEGNAYFKQLLAETECDKDPRIKFVGTLYDKELLAYIREQAYAYIHGHEVGGTN  300

Query:  311 PGLLEALANTDLNLVLDVDFNKSVAGLSSFYWAKKEGDLAKLINDSDQQQDLSTYGDRAK  370
            PGLLEALA+T+LNLVL VDFN+SVA  ++ YW K++G LA+LIN  D    D    G  AK
Sbjct:  301 PGLLEALAHTNLNLVLGVDFNQSVAKSAALYWTKQKGQLAELINQVDAGFDSDHLGKEAK  360

Query:  371 AIIQENYTWKKIVEEYEDLFLNE  393
            AIIQE+YTW+KIV EYE LFLNE
Sbjct:  361 AIIQEHYTWEKIVGEYEALFLNE  383
```

Based on this analysis, it was predicted that these proteins and their epitopes could be useful antigens for vaccines or diagnostics.

EXAMPLE 1221

A DNA sequence (GBSx1297) was identified in *S. agalactiae* <SEQ ID 3787> which encodes the amino acid sequence <SEQ ID 3788>. This protein is predicted to be dTDP-L-rhamnose synthase. Analysis of this protein sequence reveals the following:

```
Possible site: 61
>>> Seems to have no N-terminal signal sequence

----- Final Results -----
            bacterial cytoplasm --- Certainty = 0.1059(Affirmative) < succ>
            bacterial membrane  --- Certainty = 0.0000(Not Clear)   < succ>
             bacterial outside  --- Certainty = 0.0000(Not Clear)   < succ>
```

The protein has homology with the following sequences in the GENPEPT database.

```
>GP: AAD10184 GB: AF026471 Cps20 [Streptococcus pneumoniae]
Identities = 258/283 (91%), Positives = 274/283 (96%)

Query:    1 MILITGANGQLGSELRHLLDERTQEYVAVDVAEMDITNAEMVDKVFEEVKPSLVYHCAAY   60
            MILITGANGQLG+ELR+LLDER +EYVAVDVAEMDIT+AEMV+KVFEEVKP+LVYHCAAY
Sbjct:    1 MILITGANGQLGTELRYLLDERNEEYVAVDVAEMDITDAEMVEKVFEEVKPTLVYHCAAY   60

Query:   61 TAVDAAEDEGKELDFAINVTGTENVAKAAAKHDATLVYISTDYVFDGEKPVGQEWEVDDL  120
            TAVDAAEDEGKELDFAINVTGT+NVAKA+ KH ATLVYISTDYVFDG+KPVGQEWEVDD
Sbjct:   61 TAVDAAEDEGKELDFAINVTGTKNVAKASEKHGATLVYISTDYVFDGKKPVGQEWEVDDR  120

Query:  121 PDPKTEYGRTKRMGEELVEKYTSKFYTIRTAWVFGNYGKNFVFTMQNLAKTHKTLTVVND  180
            PDP+TEYGRTKRMGEELVEK+ S FY  IRTAWVFGNYGKNFVFTMQNLAKTHKTLTVVND
Sbjct:  121 PDPQTEYGRTKRMGEELVEKHVSNFYIIRTAWVFGNYGKNFVFTMQNLAKTHKTLTVVND  180

Query:  181 QHGRPTWTRTLAEFMTYLAENQKDFGYYHLSNDAKEDTTWYDFAVEILKDTDVEVKPVDS  240
            Q+GRPTWTRTLAEFMTYLAEN+K+FGYYHLSNDA EDTTWYDFAVEILKDTDVEVKPVDS
Sbjct:  181 QYGRPTWTRTLAEFMTYLAENRKEFGYYHLSNDATEDTTWYDFAVEILKDTDVEVKPVDS  240

Query:  241 SQFPAKAKRPLNSTMSLEKAKATGFVIPTWQDALKEFYKQEVK  283
            SQFPAKAKRPLNSTMSL KAKATGFVIPTWQDAL+EFYKQEV+
Sbjct:  241 SQFPAKAKRPLNSTMSLAKAKATGFVIPTWQDALQEFYKQEVR  283
```

A related DNA sequence was identified in *S. pyogenes* <SEQ ID 3789> which encodes the amino acid sequence <SEQ ID 3790>. Analysis of this protein sequence reveals the following:

```
Possible site: 32
>>> Seems to have no N-terminal signal sequence

----- Final Results -----
            bacterial cytoplasm --- Certainty = 0.0618(Affirmative) < succ>
```

```
              bacterial membrane --- Certainty = 0.0000(Not Clear) < succ>
              bacterial outside  --- Certainty = 0.0000(Not Clear) < succ>
```

An alignment of the GAS and GBS proteins is shown below.

```
Identities = 227/284 (79%), Positives = 248/284 (86%)

Query:    1 MILITGANGQLGSELRHLLDERTQEYVAVDVAEMDITNAEMVDKVFEEVKPSLVYHCAAY   60
            MILITG+NGQLG+ELR+LLDER  +YVAVDVAEMDITN + V+ VF +VKP+LVYHCAAY
Sbjct:   21 MILITGSNGQLGTELRYLLDERGVDYVAVDVAEMDITNEDKVEAVFAQVKPTLVYHCAAY   80

Query:   61 TAVDAAEDEGKELDFAINVTGTENVAKAAAKHDATLVYISTDYVFDGEKPVGQEWEVDDL  120
            TAVDAAEDEGK L+ AINVTG+EN+AKA  K+ ATLVYISTDYVFDG KPVGQEW   D
Sbjct:   81 TAVDAAEDEGKALNEAINVTGSENIAKACGKYGATLVYISTDYVFDGNKPVGQEWVETDH  140

Query:  121 PDPKTEYGRTKRMGEELVEKYTSKFYTIRTAWVFGNYGKNFVFTMQNLAKTHKTLTVVND  180
            PDPKTEYGRTKR+GE  VE+Y   FY IRTAWVFGNYGKNFVFTM+ LA+ H  LTVVND
Sbjct:  141 PDPKTEYGRTKRLGELAVERYAEHFYIIRTAWVFGNYGKNFVFTMEQLAENHSRLTVVND  200

Query:  181 QHGRPTWTRTLAEFMTYLAENQKDFGYYHLSNDAKEDTTWYDFAVEILKDTDVEVKPVDS  240
            QHGRPTWTRTLAEFM YL ENQK FGYYHLSNDAKEDTTWYDFA EILKD  VEV PVDS
Sbjct:  201 QHGRPTWTRTLAEFMCYLTENQKAFGYYHLSNDAKEDTTWYDFAKEILKDKAVEVVPVDS  260

Query:  241 SQFPAKAKRPLNSTMSLEKAKATGFVIPTWQDALKEFYKQEVKK                 284
            S FPAKAKRPLNSTM+L+KAKATGFVIPTWQ+ALK FY+Q +KK
Sbjct:  261 SAFPAKAKRPLNSTMNLDKAKATGFVIPTWQEALKAFYQQGLKK                 304
```

Based on this analysis, it was predicted that these proteins and their epitopes could be useful antigens for vaccines or diagnostics.

EXAMPLE 1222

A DNA sequence (GBSx1298) was identified in *S. agalactiae* <SEQ ID 3791> which encodes the amino acid sequence <SEQ ID 3792>. Analysis of this protein sequence reveals the following:

```
Possible site: 32
>>> Seems to have no N-terminal signal sequence

----- Final Results -----
              bacterial cytoplasm --- Certainty = 0.2554(Affirmative) < succ>
              bacterial membrane  --- Certainty = 0.0000(Not Clear)   < succ>
              bacterial outside   --- Certainty = 0.0000(Not Clear)   < succ>
```

The protein has homology with the following sequences in the GENPEPT database.

```
>GP:BAA21508 GB:AB000631 unnamed protein product [Streptococcus mutans]
Identities = 92/108 (85%), Positives = 100/108 (92%)

Query:    5 KQYSEEEVGKIKDRILEALEMVIDPELGIDIVNLGLIYEIRFEDNGRTEIDMTLTTMGCP   64
            K Y+ EE+ KIKDRILEALEMVIDPELGIDIVNLGLIY+IRFED+GRTEIDMTLTTMGCP
Sbjct:    4 KNYTPEEIAKIKDRILEALEMVIDPELGIDIVNLGLIYDIRFEDSGRTEIDMTLTTMGCP   63

Query:   65 LADLLTDQIHDVMKTVPEVTETEVKLVWYPAWSVDKMSRYARIALGIR              112
            LADLLTDQIHD +K VPEV + +VKLVW PAW+VDKMSRYARIALGIR
Sbjct:   64 LADLLTDQIHDALKDVPEVLDIDVKLVWSPAWTVDKMSRYARIALGIR              111
```

A related DNA sequence was identified in *S. pyogenes* <SEQ ID 3793> which encodes the amino acid sequence <SEQ ID 3794>. Analysis of this protein sequence reveals the following:

```
Possible site: 32
>>> Seems to have no N-terminal signal sequence
```

```
----- Final Results -----
          bacterial cytoplasm --- Certainty = 0.2818(Affirmative) < succ>
           bacterial membrane --- Certainty = 0.0000(Not Clear)  < succ>
            bacterial outside --- Certainty = 0.0000(Not Clear)  < succ>
```

An alignment of the GAS and GBS proteins is shown below.

```
Identities = 90/112 (80%), Positives = 102/112 (90%)

Query:   1 MSEVKQYSEEEVGKIKDRILEALEMVIDPELGIDIVNLGLIYEIRFEDNGRTEIDMTLTT    60
           MS+  +Y++++V  IK+RILEALE VIDPELGID+VNLGLIYEIRF DNG TEIDMTLTT
Sbjct:   1 MSDTPKYTQDQVIAIKNRILEALETVIDPELGIDVVNLGLIYEIRFNDNGYTEIDMTLTT    60

Query:  61 MGCPLADLLTDQIHDVMKTVPEVTETEVKLVWYPAWSVDKMSRYARIALGIR          112
           MGCPLADLLTD IHD ++ VPEVT+TEVKLVWYPAW+VDKMSRYARIALGIR
Sbjct:  61 MGCPLADLLTDYIHDALQDVPEVTKTEVKLVWYPAWTVDKMSRYARIALGIR          112
```

Based on this analysis, it was predicted that these proteins and their epitopes could be useful antigens for vaccines or diagnostics.

EXAMPLE 1223

A DNA sequence (GBSx1299) was identified in *S. agalactiae* <SEQ ID 3795> which encodes the amino acid sequence <SEQ ID 3796>. This protein is predicted to be RNA polymerase sigma factor, sigma-70 family (rpoD). Analysis of this protein sequence reveals the following:

```
Possible site: 54
>>> Seems to have no N-terminal signal sequence

----- Final Results -----
          bacterial cytoplasm --- Certainty = 0.3157(Affirmative) < succ>
           bacterial membrane --- Certainty = 0.0000(Not Clear)  < succ>
            bacterial outside --- Certainty = 0.0000(Not Clear)  < succ>
```

The protein is similar to the sigma-42 protein from *S. mutans*:

```
>GP:BAA21507 GB:AB000631 sigma 42 protein [Streptococcus mutans]
Identities = 345/367 (94%), Positives = 358/367 (97%)

Query:  14 EKKGNTTFNVQVADFIRNHKKQGTAIDDEVTEKLVIPFVLDADQIDDLLERLTDGGISIT    73
           +KK ++TFNVQVADFIRNHKK+G A+DDEVTEKLVIPF L+A+QIDDLLERLTDGGISIT
Sbjct:   5 KKKTSSTFNVQVADFIRNHKKEGVAVDDEVTEKLVIPFELEAEQIDDLLERLTDGGISIT    64

Query:  74 DKEGNPSTKYVVEGPKPEELTDEELIGSNSAKVNDPVRMYLKEIGVVPLLTNEEEKELAV   133
           D+EGNPSTKY VE  KPEELTDEEL+GSNSAKVNDPVRMYLKEIGVVPLLTNEEEKELA+
Sbjct:  65 DREGNPSTKYAVEEIKPEELTDEELLGSNSAKVNDPVRMYLKEIGVVPLLTNEEEKELAI   124

Query: 134 AVAEGDLMAKQRLAEANLRLVVSIAKRYVGRGMQFLDLIQEGNMGLMKAVDKFDYSKGFK   193
           AV  GDL AKQRLAEANLRLVVSIAKRYVGRGMQFLDLIQEGNMGLMKAVDKFDYSKGFK
Sbjct: 125 AVENGDLEAKQRLAEANLRLVVSIAKRYVGRGMQFLDLIQEGNMGLMKAVDKFDYSKGFK   184

Query: 194 FSTYATWWIRQAITRAIADQARTIRIPVHMVETINKLVREQRNLLQELGQDPTPEQIAER   253
           FSTYATWWIRQAITRAIADQARTIRIPVHMVETINKLVREQRNLLQELGQDPTPEQIAER
Sbjct: 185 FSTYATWWIRQAITRAIADQARTIRIPVHMVETINKLVREQRNLLQELGQDPTPEQIAER   244

Query: 254 MDMTPDKVREILKIAQEPVSLETPIGEEDDSHLGDFIEDEVIENPVDYTTRVVLREQLDE   313
           MDMTPDKVREILKIAQEPVSLETPIGEEDDSHLGDFIEDEVIENPVDYTTRVVLREQLDE
Sbjct: 245 MDMTPDKVREILKIAQEPVSLETPIGEEDDSHLGDFIEDEVIENPVDYTTRVVLREQLDE   304

Query: 314 VLDTLTDREENVLRLRFGLDDGKMRTLEDVGKVFNVTRERIRQIEAKALRKLRHPSRSKQ   373
           VLDTLTDREENVLRLRFGLDDGKMRTLEDVGKVF+VTRERIRQIEAKALRKLRHPSRSKQ
Sbjct: 305 VLDTLTDREENVLRLRFGLDDGKMRTLEDVGKVFDVTRERIRQIEAKALRKLRHPSRSKQ   364

Query: 374 LKDFMED                                                       380
           L+DF+ED
Sbjct: 365 LRDFVED                                                       371
```

A related DNA sequence was identified in *S. pyogenes* <SEQ ID 3797> which encodes the amino acid sequence <SEQ ID 3798>. Analysis of this protein sequence reveals the following:

```
Possible site: 43
>>> Seems to have no N-terminal signal sequence

----- Final Results -----
            bacterial cytoplasm --- Certainty = 0.1788(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below.

```
Identities = 351/369 (95%), Positives = 364/369 (98%)

Query:  12 MAEKKGNTTFNVQVADFIRNHKKQGTAIDDEVTEKLVIPFVLDADQIDDLLERLTDGGIS   71
           M ++K   TTFNVQVA+FIR+HKK+GTAIDD+VTEKLVIPF LDADQIDDLLERLTDGGIS
Sbjct:   1 MTKQKEITTFNVQVAEFIRHHKKEGTAIDDDVTEKLVIPFALDADQIDDLLERLTDGGIS   60

Query:  72 ITDKEGNPSTKYVVEGPKPEELTDEELIGSNSAKVNDPVRMYLKEIGVVPLLTNEEEKEL  131
           ITDKEGNPS+KY+VE PKPEELTDEELIGSNSAKVNDPVRMYLKEIGVVPLLT+EEEKEL
Sbjct:  61 ITDKEGNPSSKYIVEEPKPEELTDEELIGSNSAKVNDPVRMYLKEIGVVPLLTSEEEKEL  120

Query: 132 AVAVAEGDLMAKQRLAEANLRLVVSIAKRYVGRGMQFLDLIQEGNMGLMKAVDKFDYSKG  191
           AVAVA+GDLMAKQRLAEANLRLVVSIAKRYVGRGMQFLDLIQEGNMGLMKAVDKFDYSKG
Sbjct: 121 AVAVAKGDLMAKQRLAEANLRLVVSIAKRYVGRGMQFLDLIQEGNMGLMKAVDKFDYSKG  180

Query: 192 FKFSTYATWWIRQAITRAIADQARTIRIPVHMVETINKLVREQRNLLQELGQDPTPEQIA  251
           FKFSTYATWWIRQAITRAIADQARTIRIPVHMVETINKLVREQRNLLQELGQDPTPEQIA
Sbjct: 181 FKFSTYATWWIRQAITRAIADQARTIRIPVHMVETINKLVREQRNLLQELGQDPTPEQIA  240

Query: 252 ERMDMTPDKVREILKIAQEPVSLETPIGEEDDSHLGDFIEDEVIENPVDYTTRVVLREQL  311
           ERM+MTPDKVREILKIAQEPVSLETPIGEEDDSHLGDFIEDEVIENPVDYTTRVVLREQL
Sbjct: 241 ERMEMTPDKVREILKIAQEPVSLETPIGEEDDSHLGDFIEDEVIENPVDYTTRVVLREQL  300

Query: 312 DEVLDTLTDREENVLRLRFGLDDGKMRTLEDVGKVFNVTRERIRQIEAKALRKLRHPSRS  371
           DEVLDTLTDREENVLRLRFGLDDGKMRTLEDVGKVFNVTRERIRQIEAKALRKLRHPSRS
Sbjct: 301 DEVLDTLTDREENVLRLRFGLDDGKMRTLEDVGKVFNVTRERIRQIEAKALRKLRHPSRS  360

Query: 372 KQLKDFMED                                                     380
           KQL+DF+ED
Sbjct: 361 KQLRDFIED                                                     369
```

Based on this analysis, it was predicted that these proteins and their epitopes could be useful antigens for vaccines or diagnostics.

EXAMPLE 1224

A DNA sequence (GBSx1300) was identified in *S. agalactiae* <SEQ ID 3799> which encodes the amino acid sequence <SEQ ID 3800>. Analysis of this protein sequence reveals the following:

```
Possible site: 14
>>> Seems to have no N-terminal signal sequence

----- Final Results -----
            bacterial cytoplasm --- Certainty = 0.2853(Affirmative) < succ>
             bacterial membrane --- Certainty = 0.0000(Not Clear)   < succ>
              bacterial outside --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1225

A DNA sequence (GBSx1301) was identified in *S. agalactiae* <SEQ ID 3801> which encodes the amino acid sequence <SEQ ID 3802>. Analysis of this protein sequence reveals the following:

```
Possible site: 40
>>> Seems to have no N-terminal signal sequence

----- Final Results -----
            bacterial cytoplasm --- Certainty = 0.2198(Affirmative) < succ>
             bacterial membrane --- Certainty = 0.0000(Not Clear)   < succ>
              bacterial outside --- Certainty = 0.0000(Not Clear)   < succ>
```

The protein has homology with the following sequences in the GENPEPT database.

```
>GP: BAA03516 GB: D14690 DNA primase [Lactococcus lactis]
Identities = 206/398 (51%), Positives = 294/398 (73%), Gaps = 6/398 (1%)

Query:  37 LAIDKEKISEIKNSVNIVDVIGEVVGLTKTGRNHLGLCPFHKEKTPSFNVIEDRQFFHCF   96
           +++D E ++++K+ VNI D+I + V L++TG+N++GLCPFH EKTPSFNV ++ F+HCF
Sbjct:   2 VSLDTEVVNDLKSKVNIADLISQYVALSRTGKNYIGLCPFHGEKTPSFNVNAEKGFYHCF   61

Query:  97 GCGRSGDVFKFVEDYQHISFLDSVQVLAERSGIPLDTNFKGQVPKKPKANQSLLDIHRVA  156
           GCGRSGD +F+++Y + F+D+V+ LA+ +G+ L N       +K   N  L +I+  A
Sbjct:  62 GCGRSGDAIEFLKEYNQVGFVDAVKELADFAGVTL--NISDDREEKNNPNAPLFEINNQA  119

Query: 157 SGFYHAYLMTTNDGERARQYLAERGVTEDLIKHFQIGLSPGGQDFLYRRLAKEFDEKTLM  216
             + Y+ LM+T  GERAR+YL ERG+T+D+IK F IGL+P   DF+++ L+ +FDE+ +
Sbjct: 120 ARLYNILLMSTELGERARKYLEERGITDDVIKRFNIGLAPEENDFIFKNLSNKFDEEIMA  179

Query: 217 SSGLFNYSENSNQFYDSFNNRIMFPLTNDIGEVIAFSGRVWTQEDIDRKQAKYKNSRATP  276
             SGLF++S  +N+ +D+F NRIMFP+TN+ G+ I FSGR W QE+ D K AKY N+ AT
Sbjct: 180 KSGLFHFS--NNKVFDAFTNRIMFPITNEYGQTIGFSGRKW-QENDDSK-AKYINTSATT  235

Query: 277 IFNKSYELYHLDKARAVINKAHEVYLMEGFMDVIAAYRAGIENVVASMGTALTNEHVRHL  336
           IF+KSYEL++LDKA+   I+K HEVYLMEGFMDVIA+Y+AGI NVVASMGTALT +HVR L
Sbjct: 236 IFDKSYELWNLDKAKPTISKQHEVYLMEGFMDVIASYKAGINNVVASMGTALTEKHVRRL  295

Query: 337 KRFTKKVVLTYDGDRAGQNAIDKSLELLSDMTVDIVRIPNKMDPDEFLQANSAEDFKQLL  396
           K+  KK VL YDGD AGQNAI K+++L+ +  V IV++P +DPDE+ +       L+
Sbjct: 296 KQMAKKFVLVYDGDSAGQNAIYKAIDLIGESAVQIVKVPEGLDPDEYSKNYGLKGLSALM  355

Query: 397 ENGRISNTEFYIHYLKPENTDNLQSEIAYVEKIAKLIA                        434
           E GRI   EF I YL+PEN  NLQ+++ ++E+I+ +IA
Sbjct: 356 ETGRIQPIEFLIDYLRPENLANLQTQLDFIEQISPMIA                        393
```

A related DNA sequence was identified in *S. pyogenes* <SEQ ID 3803> which encodes the amino acid sequence <SEQ ID 3804>. Analysis of this protein sequence reveals the following:

```
Possible site: 13
>>> Seems to have no N-terminal signal sequence

----- Final Results -----
            bacterial cytoplasm --- Certainty = 0.3532(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below.

```
Identities = 378/604 (62%), Positives = 477/604 (78%), Gaps = 2/604 (0%)

Query:  28 MGYFCGGHDLAIDKEKISEIKNSVNIVDVIGEVVGLTKTGRNHLGLCPFHKEKTPSFNVI   87
           MG+   GG DLAIDKE IS++KNSVNIVDVIGEVV L+++GR++LGLCPFHKEKTPSFNV+
Sbjct:   1 MGFLWGGDDLAIDKEMISQVKNSVNIVDVIGEVVKLSRSGRHYLGLCPFHKEKTPSFNVV   60

Query:  88 EDRQFFHCFGCGRSGDVFKFVEDYQHISFLDSVQVLAERSGIPLDTNFKGQV--PKKPKA  145
           EDRQFFHCFGCG+SGDVFKF+E+Y+ +  FL+SVQ++A+++G+ L+     V    +
Sbjct:  61 EDRQFFHCFGCGKSGDVFKFIEEYRQVPFLESVQIIADKTGMSLNIPPSQAVLASQHKP  120

Query: 146 NQSLLDIHRVASGFYHAYLMTTNDGERARQYLAERGVTEDLIKHFQIGLSPGGQDFLYRR  205
           N +L+ +H  A+ FYHA LMTT  G+ AR+YL +RG+ + LI+HF IGL+P    D+LY+
Sbjct: 121 NHALMTLHEDAAKFYHAVLMTTTIGQEARKYLYQRGLDDQLIEHFNIGLAPDESDYLYQA  180
```

-continued

```
Query:  206 LAKEFDEKTLMSSGLFNYSENSNQFYDSFNNRIMFPLTNDIGEVIAFSGRVWTQEDIDRK  265
            L+K+++E  L++SGLF+ S+ SN  YD+F NRIMFPL++D G +IAFSGR+WT  D++++
Sbjct:  181 LSKKYEEGQLVASGLFHLSDQSNTIYDAFRNRIMFPLSDDRGHIIAFSGRIWTAADMEKR  240

Query:  266 QAKYKNSRATPIFNKSYELYHLDKARAVINKAHEVYLMEGFMDVIAAYRAGIENVVASMG  325
            QAKYKNSR T +FNKSYELYHLDKAR VI K HEV+LMEGFMDVIAAYR+G EN VASMG
Sbjct:  241 QAKYKNSRGTVLFNKSYELYHLDKARPVIAKTHEVFLMEGFMDVIAAYRSGYENAVASMG  300

Query:  326 TALTNEHVRHLKRFTKKVVLTYDGDRAGQNAIDKSLELLSDMTVDIVRIPNKMDPDEFLQ  385
            TALT EHV HLK+ TKKVVL YDGD AGQ+AI KSLELL D  V+IVRIPNKMDPDEF+Q
Sbjct:  301 TALTQEHVNHLKQVTKKVVLIYDGDDAGQHAIAKSLELLKDFVVEIVRIPNKMDPDEFVQ  360

Query:  386 ANSAEDFKQLLENGRISNTEFYIHYLKPENTDNLQSEIAYVEKIAKLIAKSPSITAQNSY  445
             +S E F  LL+  RIS+ EF+I YLKP N DNLQS+I YVEK+A LIA+SPSITAQ+SY
Sbjct:  361 RHSPEAFADLLKQSRISSVEFFIDYLKPTNVDNLQSQIVYVEKMAPLIAQSPSITAQHSY  420

Query:  446 ITKVAELLPDFDYFQVEQSVNNERLHHRSQQQASSSVQTSATVQLPQTGKLSAITKTEMQ  505
            I K+A+LLP+FDYFQVEQSVN  R+  R + Q     S   V LP    L+AI KTE
Sbjct:  421 INKIADLLPNFDYFQVEQSVNALRIQDRQKHQGQIAQAVSNLVTLPMPKSLTAIAKTESH  480

Query:  506 LFHRLLNHPYLLNEFRNRDNFYFDTTEIQVLYELLKESGEITSYDLSQESDKVNRTYYII  565
            L HRLL+H YLLNEFR+RD+FYFDT+ +++LY+ LK+ G ITSYDLS+ S++VNR YY +
Sbjct:  481 LMHRLLHHDYLLNEFRHRDDFYFDTSTLELLYQRLKQQGHITSYDLSEMSEEVNRAYYNV  540

Query:  566 LEEQLPVEVSIGEIEAVEKARDRLLKERDLRKQSQLIRQSSNQGDEEGALAALENLIAQK  625
            LEE LP EV++GEI+ +   R +LL ERDL KQ + +R+SSN+GD + AL  LE+ IAQK
Sbjct:  541 LEENLPKEVALGEIDDILSKRAKLLAERDLHKQGKKVRESSNKGDHQAALEVLEHFIAQK  600

Query:  626 RNME                                                         629
            R ME
Sbjct:  601 RKME                                                         604
```

Based on this analysis, it was predicted that these proteins and their epitopes could be useful antigens for vaccines or diagnostics.

EXAMPLE 1226

A DNA sequence (GBSx1302) was identified in *S. agalactiae* <SEQ ID 3805> which encodes the amino acid sequence <SEQ ID 3806>. Analysis of this protein sequence reveals the following:

```
Possible site: 47
>>> Seems to have no N-terminal signal sequence
      INTEGRAL      Likelihood = -6.05    Transmembrane     41-57 (34-58)
      INTEGRAL      Likelihood = -5.79    Transmembrane     93-109 (90-112)

----- Final Results -----
            bacterial membrane  --- Certainty = 0.3421(Affirmative) < succ>
            bacterial outside   --- Certainty = 0.0000(Not Clear)   < succ>
            bacterial cytoplasm --- Certainty = 0.0000(Not Clear)   < succ>
```

A related GBS nucleic acid sequence <SEQ ID 9995> which encodes amino acid sequence <SEQ ID 9996> was also identified.

The protein has homology with the following sequences in the GENPEPT database.

```
>GP: AAC38560 GB: AF029731 large conductance mechanosensitive channel
[Staphylococcus aureus]
Identities = 64/126 (50%), Positives = 83/126 (65%), Gaps = 8/126 (6%)

Query:   23 MIKELKEFLFKGNVLDLAVAVILGAAFNAIITSLVKDVITPLILNPVLKAAGVSNIA-QL   81
            M+KE KEF   KGNVLDLA+AV++GAAFN II+SLV+++I PLI     K  G  +A +
Sbjct:    1 MLKEFKEFALKGNVLDLAIAVVMGAAFNKIISSLVENIIMPLI----GKIFGSVDFAKEW   56

Query:   82 SWNGVAYGNFLSAVINFLIVGTTLFFIVKAANKVMAKKPAEEEIIEVVEPTQEQLLAEIR  141
            S+ G+ YG F+ +VI+F+I+    LF   VK AN +M K+ AEE     E V      LL EIR
Sbjct:   57 SFWGIKYGLFIQSVIDFIIIAFALFIFVKIANTLMKKEEAEE---EAVVEENVVLLTEIR  113

Query:  142 DLLANK                                                       147
            DLL  K
Sbjct:  114 DLLREK                                                       119
```

A related DNA sequence was identified in *S. pyogenes* <SEQ ID 3807> which encodes the amino acid sequence <SEQ ID 3808>. Analysis of this protein sequence reveals the following:

```
Possible site: 28
>>> Seems to have a cleavable N-term signal seq.
    INTEGRAL     Likelihood = -5.95     Transmembrane     71-87 (67-90)

----- Final Results -----
              bacterial membrane --- Certainty = 0.3378(Affirmative) < succ>
              bacterial outside  --- Certainty = 0.0000(Not Clear)   < succ>
              bacterial cytoplasm --- Certainty = 0.0000(Not Clear)   < succ>
```

The protein has homology with the following sequences in the databases:

```
>GP: CAB15653 GB: Z99122 similar to large conductance mechanosensitive
channel protein [Bacillus subtilis]
Identities = 61/126 (48%), Positives = 77/126 (60%), Gaps = 7/126 (5%)

Query:    1 MVKELKAFLFRGNIIELAVAVIIGGAFGAIVTSFVNDIITPLILNPALKAANVENITQLS   60
            M  E KAF  RGNI++LA+ V+IGGAFG IVTS VNDII PL+     L  +   ++
Sbjct:    1 MWNEFKAFAMRGNIVDLAIGVVIGGAFGKIVTSLVNDIIMPLV-GLLLGGLDFSGLSFTF  59

Query:   61 WNG-VKYGSFLGAVINFLIIGTSLFFVVKAAEKAMPKKE-----KEAAAPTQEELLTEIR  114
             +  VKYGSF+ ++NFLII S+F V++      KKE       E A   QEELL EIR
Sbjct:   60 GDAVVKYGSFIQTIVNFLIISFSIFIVIRTLNGLRRKKEAEEEAAEEEAVDAQEELLKEIR 119

Query:  115 DLLAQK                                                         120
            DLL Q+
Sbjct:  120 DLLKQQ                                                         125
```

An alignment of the GAS and GBS proteins is shown below.

```
Identities = 86/125 (68%), Positives = 99/125 (78%), Gaps = 5/125 (4%)

Query:   23 MIKELKEFLFKGNVLDLAVAVILGAAFNAIITSLVKDVITPLILNPVLKAAGVSNIAQLS   82
            M+KELK FLF+GN+++LAVAVI+G AF AI+TS V D+ITPLILNP LKAA V NI QLS
Sbjct:    1 MVKELKAFLFRGNIIELAVAVIIGGAFGAIVTSFVNDIITPLILNPALKAANVENITQLS   60

Query:   83 WNGVAYGNFLSAVINFLIVGTTLFFIVKAANKVMAKKPAEEEIIEVVEPTQEQLLAEIRD  142
            WNGV YG+FL AVINFLI+GT+LFF+VKAA K M KK       E   PTQE+LL EIRD
Sbjct:   61 WNGVKYGSFLGAVINFLIIGTSLFFVVKAAEKAMPKKEK-----EAAAPTQEELLTEIRD  115

Query:  143 LLANK                                                         147
            LLA K
Sbjct:  116 LLAQK                                                         120
```

A related GBS gene <SEQ ID 8753> and protein <SEQ ID 8754> were also identified. Analysis of this protein sequence reveals the following:

```
Lipop: Possible site: -1 Crend: 10
SRCFLG: 0
McG: Length of UR: 4
     Peak Value of UR: 2.96
     Net Charge of CR: 1
McG: Discrim Score: 4.39
GvH: Signal Score (-7.5): -1.79
     Possible site: 25
>>> Seems to have a cleavable N-term signal seq.
Amino Acid Composition: calculated from 26
ALOM program count: 1 value: -5.79 threshold: 0.0
     INTEGRAL     Likelihood = -5.79     Transmembrane     71-87 (68-90)
     PERIPHERAL   Likelihood = 1.06      28
modified ALOM score: 1.66
icm1 HYPID: 7 CFP: 0.331
*** Reasoning Step: 3

----- Final Results -----
              bacterial membrane --- Certainty = 0.3314(Affirmative) < succ>
```

The protein has homology with the following sequences in the databases:

```
ORF00541(367-741 of 1041)
SP|O68285|MSCL_STAAU(1-119 of 120) LARGE-CONDUCTANCE MECHANOSENSITIVE CHANNEL.
GP|3135292|gb|AAC38560.1||AF029731 large conductance mechanosensitive channel
{Staphylococcus aureus}
% Match = 14.9
% Identity = 53.3    % Similarity = 70.5
Matches = 65  Mismatches = 31  Conservative Sub.s = 21
177       207       237       267       297       327       357       387
QVMTSTEITHYSFTFDYIIFSFLCKFFQKLFQGFLLH*FNIKIYR*FETYYLDFSKEICYNERELNNIKELVHMIKELKE
                                                                    |:||:||
                                                                    MLKEFKE
417       447       477       507       537       561       591       621
FLFKGNVLDLAVAVILGAAFNAIITSLVKDVITPLILNPVLKAAGVSNIAQLSWN--GVAYGNFLSAVINFLIVGTTLFF
| :||||||||:||::|||||  ||:|||:::| |||     |   | :|:   |:   |: || |: :||:|:|:   ||
FALKGNVLDLAIAVVMGAAFNKIISSLVENIIMPLI----GKIFGSVDFAK-EWSFWGIKYGLFIQSVIDFIIIAFALFI
          20        30        40        50        60        70        80
651       681       711       741       771       801       831       861
IVKAANKVMAKKPXEEEIIEVVEPTQEQLLXEIRDLLANK**KTRITEFFY*LIVIIYEKTAQF*TVFSYSI*LEFFTFA
 || || :| |:  |||    |||      || ||||||| |
FVKIANTLMKKEEAEEE--AVVE-ENVVLLTEIRDLLREKK
                 100       110       120
```

SEQ ID 8754 (GBS354) was expressed in *E. coli* as a His-fusion product. SDS-PAGE analysis of total cell extract is shown in FIG. 74 (lane 3; MW 17 kDa).

Based on this analysis, it was predicted that these proteins and their epitopes could be useful antigens for vaccines or diagnostics.

EXAMPLE 1227

A DNA sequence (GBSx1303) was identified in *S. agalactiae* <SEQ ID 3809> which encodes the amino acid sequence <SEQ ID 3810>. This protein is predicted to be 30S ribosomal protein S21-related protein. Analysis of this protein sequence reveals the following:

```
Possible site: 29
>>> Seems to have no N-terminal signal sequence

----- Final Results -----
           bacterial cytoplasm --- Certainty = 0.6479(Affirmative) < succ>
            bacterial membrane --- Certainty = 0.0000(Not Clear)   < succ>
             bacterial outside --- Certainty = 0.0000(Not Clear)   < succ>
```

A related GBS nucleic acid sequence <SEQ ID 9391> which encodes amino acid sequence <SEQ ID 9392> was also identified. A related GBS nucleic acid sequence <SEQ ID 10799> which encodes amino acid sequence <SEQ ID 10800> was also identified.

The protein is similar to the 30S ribosomal protein S21 from *Listeria monocytogenes*:

```
>GP: BAA82793 GB: AB023064 30S ribosomal protein
S21 [Listeria monocytogenes]
Identities = 30/34 (88%), Positives = 34/34 (99%)

Query:   1  MTKAGTLQESRKREFYEKPSVKRKRKSEAARKRK  34
            ++K+GTLQESRKREFYEKPSVKRK+KSEAARKRK
Sbjct:  23  VSKSGTLQESRKREFYEKPSVKRKKKSEAARKRK  56
```

A related DNA sequence was identified in *S. pyogenes* <SEQ ID 3811> which encodes the amino acid sequence <SEQ ID 3812>. Analysis of this protein sequence reveals the following:

```
Possible site: 38
>>> Seems to have no N-terminal signal sequence

----- Final Results -----
          bacterial cytoplasm --- Certainty = 0.4815(Affirmative) < succ>
          bacterial membrane  --- Certainty = 0.0000(Not Clear)   < succ>
          bacterial outside   --- Certainty = 0.0000(Not Clear)   < succ>
```

An alignment of the GAS and GBS proteins is shown below.

```
Identities = 35/36 (97%), Positives = 36/36 (99%)

Query:  1 MTKAGTLQESRKREFYEKPSVKRKRKSEAARKRKKF 36
          +TKAGTLQESRKREFYEKPSVKRKRKSEAARKRKKF
Sbjct: 35 VTKAGTLQESRKREFYEKPSVKRKRKSEAARKRKKF 70
```

Based on this analysis, it was predicted that these proteins and their epitopes could be useful antigens for vaccines or diagnostics.

EXAMPLE 1228

A DNA sequence (GBSx1304) was identified in *S. agalactiae* <SEQ ID 3813> which encodes the amino acid sequence <SEQ ID 3814>. Analysis of this protein sequence reveals the following:

```
Possible site: 18
>>> Seems to have an uncleavable N-term signal seq
    INTEGRAL       Likelihood = -7.06    Transmembrane      5-21 (3-23)
    INTEGRAL       Likelihood = -2.28    Transmembrane    191-207 (189-207)

----- Final Results -----
          bacterial membrane  --- Certainty = 0.3824(Affirmative) < succ>
          bacterial outside   --- Certainty = 0.0000(Not Clear)   < succ>
          bacterial cytoplasm --- Certainty = 0.0000(Not Clear)   < succ>
```

The protein has no significant homology with any sequences in the GENPEPT database.

No corresponding DNA sequence was identified in *S. pyogenes*.

A related GBS gene <SEQ ID 8755> and protein <SEQ ID 8756> were also identified. Analysis of this protein sequence reveals the following:

```
Lipop Possible site: -1 Crend: 2
McG: Discrim Score: 8.68
GvH: Signal Score (-7.5): -5.71
    Possible site: 18
>>> Seems to have an uncleavable N-term signal seq
ALOM program count: 2 value: -7.06 threshold: 0.0
    INTEGRAL       Likelihood = -7.06    Transmembrane      5-21 (3-23)
    INTEGRAL       Likelihood = -2.28    Transmembrane    191-207 (189-207)
    PERIPHERAL     Likelihood =  4.35                     142
modified ALOM score: 1.91
*** Reasoning Step: 3

----- Final Results -----
          bacterial membrane  --- Certainty = 0.3824(Affirmative) < succ>
          bacterial outside   --- Certainty = 0.0000(Not Clear)   < succ>
          bacterial cytoplasm --- Certainty = 0.0000(Not Clear)   < succ>
```

SEQ ID 8756 (GBS259) was expressed in *E. coli* as a His-fusion product. SDS-PAGE analysis of total cell extract is shown in FIG. 45 (lane 4; MW 54 kDa).

Based on this analysis, it was predicted that these proteins and their epitopes could be useful antigens for vaccines or diagnostics.

EXAMPLE 1229

A DNA sequence (GBSx1305) was identified in *S. agalactiae* <SEQ ID 3815> which encodes the amino acid sequence <SEQ ID 3816>. Analysis of this protein sequence reveals the following:

```
Possible site: 56
>>> Seems to have no N-terminal signal sequence
    INTEGRAL     Likelihood = -1.38    Transmembrane    136-152 (135-152)

----- Final Results -----
              bacterial membrane --- Certainty = 0.1553(Affirmative) < succ>
                bacterial outside --- Certainty = 0.0000(Not Clear)  < succ>
              bacterial cytoplasm --- Certainty = 0.0000(Not Clear)  < succ>
```

The protein has homology with the following sequences in the GENPEPT database.

```
>GP: AAD47593 GB: AF140784 Vexp2 [Streptococcus pneumoniae]
Identities = 117/212 (55%), Positives = 152/212 (71%)

Query:    1 MLELKNIAYRYKGNDNKTLENINYSFQSGVFYTILGNSGSGKTTLLSLMAGLDSPTEGQV   60
            +L+L+++ YRYK         L   INY+F+ G FY+I+G SG+GK+TLLSL+AGLDSP EG +
Sbjct:    3 LLQLQDVTYRYKNTAEAVLYQINYNFEPGKFYSIIGESGAGKSTLLSLLAGLDSPVEGSI   62

Query:   61 LFNKKDIKEAGYAQHRKKNIALVFQNYNLLDYLTPLENVQLVKPTADKQLLLDLGLKEDM  120
            LF  +DI++ GY+ HR  +I+LVFQNYNL+DYL+PLEN++LV     A K   LL+LGL E
Sbjct:   63 LFQGEDIRKKGYSYHRMHHISLVFQNYNLIDYLSPLENIRLVNKKASKNTLLELGLDESQ  122

Query:  121 LTRNILRLSGGQQQRVAIARALVVGTPAILLDEPTGNLDFDISRDITMRLKDFAHKEKRC  180
            + RN+L+LSGGQQQRVAIAR+LV   P IL DEPTGNLD    + DI    LK  A K  +C
Sbjct:  123 IKRNVLQLSGGQQQRVAIARSLVSEAPVILADEPTGNLDPKTAGDIVELLKSLAQKTGKC  182

Query:  181 VIMVTHSREIAHMADTALQLIGDNLKELSKES                             212
            VI+VTHS+E+A  +D  L+L    L E    S
Sbjct:  183 VIVVTHSKEVAQASDITLELKDKKLTETRNTS                             214
```

SEQ ID 3816 (GBS363) was expressed in *E. coli* as a His-fusion product. SDS-PAGE analysis of total cell extract is shown in FIG. 74 (lane 5; MW 28 kDa). It was also expressed in *E. coli* as a GST-fusion product. SDS-PAGE analysis of total cell extract is shown in FIG. 81 (lane 10; MW 53 kDa).

GBS363-GST was purified as shown in FIG. 216, lane 9.

Based on this analysis, it was predicted that this protein and its epitopes, could be useful antigens for vaccines or diagnostics.

EXAMPLE 1230

A DNA sequence (GBSx1306) was identified in *S. agalactiae* <SEQ ID 3817> which encodes the amino acid sequence <SEQ ID 3818>. This protein is predicted to be Vexp3. Analysis of this protein sequence reveals the following:

```
Possible site: 47
>>> Seems to have an uncleavable N-term signal seq
    INTEGRAL     Likelihood = -14.97   Transmembrane    71-87 (66-97)
    INTEGRAL     Likelihood = -3.61    Transmembrane    2-18 (1-18)

----- Final Results -----
              bacterial membrane --- Certainty = 0.6986(Affirmative) < succ>
                bacterial outside --- Certainty = 0.0000(Not Clear)  < succ>
              bacterial cytoplasm --- Certainty = 0.0000(Not Clear)  < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1231

A DNA sequence (GBSx1307) was identified in *S. agalactiae* <SEQ ID 3819> which encodes the amino acid sequence <SEQ ID 3820>. This protein is predicted to be Vexp3. Analysis of this protein sequence reveals the following:

```
Possible site: 45
>>> Seems to have no N-terminal signal sequence

----- Final Results -----
            bacterial cytoplasm --- Certainty = 0.1986(Affirmative) < succ>
            bacterial membrane  --- Certainty = 0.0000(Not Clear)   < succ>
            bacterial outside   --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1232

A DNA sequence (GBSx1308) was identified in *S. agalactiae* <SEQ ID 3821> which encodes the amino acid sequence <SEQ ID 3822>. This protein is predicted to be Vexp3. Analysis of this protein sequence reveals the following:

```
Possible site: 34
>>> Seems to have no N-terminal signal sequence
    INTEGRAL    Likelihood = -6.05    Transmembrane    22-38 (17-39)

----- Final Results -----
            bacterial membrane  --- Certainty = 0.3421(Affirmative) < succ>
            bacterial outside   --- Certainty = 0.0000(Not Clear)   < succ>
            bacterial cytoplasm --- Certainty = 0.0000(Not Clear)   < succ>
```

The protein has homology with the following sequences in the GENPEPT database.

```
>GP: AAD47594 GB: AF140784 Vexp3 [Streptococcus pneumoniae]
Identities = 39/153 (25%), Positives = 67/153 (43%), Gaps = 9/153 (5%)

Query:    3 LFKRSFLYVSRKKRKSITLFVCLWLVASTLISGIAVKNAGLTA-KKTFSRQTGSILHISS   61
            +   +F YV+RK  KSI +F+ + L+AS  + G+++K A     A ++TF   T S   +
Sbjct:    1 MLHNAFAYVTRKFFKSIVIFLIILLMASLSLVGLSIKGATAKASQETFKNITNS-FSMQI   59

Query:   62 DSTDLVGDGYGSGEIPEKAIVNIASNPNVKRVNNNLMAYAGLTSEKMVTRPNDKEQYKE-  120
            +        G   G+G I  + I   N ++       + A   LT    ++  P  K+
Sbjct:   60 NRRVNQGTPRGAGNIKGEDIKKITENKAIESYVKRINAIGDLTGYDLIETPETKKNLTAD  119

Query:  121 ------QVLQVHGNSYSDTDPKYTAGMISLKGG                            147
                  L + G + S  + K+ +G   L   G
Sbjct:  120 RAKRFGSSLMITGVNDSSKEDKFVSGSYKLVEG                            152
```

No corresponding DNA sequence was identified in *S. pyogenes*.

Based on this analysis, it was predicted that this protein and its epitopes, could be useful antigens for vaccines or diagnostics.

EXAMPLE 1233

A DNA sequence (GBSx1309) was identified in *S. agalactiae* <SEQ ID 3823> which encodes the amino acid sequence <SEQ ID 3824>. Analysis of this protein sequence reveals the following:

```
Possible site: 39
>>> Seems to have an uncleavable N-term signal seq
     INTEGRAL     Likelihood = -15.76     Transmembrane    295-311 (287-317)
     INTEGRAL     Likelihood =  -7.59     Transmembrane     49-65  (46-69)
     INTEGRAL     Likelihood =  -6.90     Transmembrane    340-356 (339-362)
     INTEGRAL     Likelihood =  -5.57     Transmembrane    411-427 (404-430)

----- Final Results -----
              bacterial membrane --- Certainty = 0.7305(Affirmative) < succ>
              bacterial outside  --- Certainty = 0.0000(Not Clear)   < succ>
              bacterial cytoplasm --- Certainty = 0.0000(Not Clear)  < succ>
```

A related GBS nucleic acid sequence <SEQ ID 9695> which encodes amino acid sequence <SEQ ID 9696> was also identified.

The protein has homology with the following sequences in the GENPEPT database.

```
>GP: CAB12182 GB: Z99106 similar to transporter [Bacillus subtilis]
Identities = 95/370 (25%), Positives = 167/370 (44%),
Gaps = 41/370 (11%)

Query: 109 ESVEASLSIDVGSRLKSVSPYNSS--------KEENQVTLAGYQSTEDLRAFQTKALVLK 160
           +++ E+S S D  S   S + NS          + +++ G  ST  + F       +
Sbjct: 115 DAIESSSSSDSSSSSSSSNAKNSQGGGQGGPQMVQADLSIEGVISTALVDDFSDGDSKIT 174

Query: 161 KGSHLAADNT--KQVLVPLKLAQKNHLSVGNKLRLGK---ENVT----IAGIYDANSA-- 209
              G +   +  K  ++ LA++N LSVG+ + +       E+ T    I GIY   S+
Sbjct: 175 DGRAITKSDVGKKVTVINETLAEENDLSVGDSITIESATDEDTTVKLKIVGIYKTTSSGD 234

Query: 210 -KSKNTFNPNIDNTLIAQATLVRKISKQKGYQTV---AVRLSDKRLVDTVIQNIKQWPLD 265
            +++N    N  L   T    +     T+       + D + +DT ++ K+   +D
Sbjct: 235 DQAQNFSFLNPYNKLYTPYTATAALKGDDYKNTIDSAVYYMDDAKNMDTFVKAAKKTSID 294

Query: 266 FGKLDVQTAKEFYGDSYRNIETLHRLVGRIILIVSLVAMAILVVMLTFWINNRIKETGIL 325
            F   + T  + Y      IE +     ++ +VS+   IL +++   I  R   E G+L
Sbjct: 295 FDTYTLNTNDQLYQQMVGPIENVASFSKNVVYLVSVAGAVILGLIVMMSIRERKYEMGVL 354

Query: 326 LAIGKTKFEIIGHYLIEVLLVAGAAFTLSIIGGVFLGKTFAAGLLSQV------------ 373
           +AIG+ ++++IG +L E+L+VA  A  L+ + G  +         LLSQ
Sbjct: 355 MAIGEKRWKLIGQFLTEILIVAVIAIGLASVTGNLVANQLGNQLLSQQISSSTDSTQTAS 414

Query: 374 ------NGGVSSQIVQNSSLIIDRIDNLAVSVGVMDVFRLYAQGALICLFAVVLSSYSIL 427
                 GG+  ++   +SS  +D ID+L V+V + D+     L       G LI +  A  +L S S+L
Sbjct: 415 GQMPGGGGGNGGKMFGHSSSNVDVIDSLNVAVSMNDMLILGGIGILIAIIATLLPSISVL 474

Query: 428 KLQPKQILSR                                                  437
           +L PK  IL++
Sbjct: 475 RLHPKTILTK                                                  484
```

No corresponding DNA sequence was identified in *S. pyogenes*.

A related GBS gene <SEQ ID 8757> and protein <SEQ ID 8758> were also identified. Analysis of this protein sequence reveals the following:

```
Lipop: Possible site: -1 Crend: 9
McG: Discrim Score: 1.50
GvH: Signal Score (-7.5): -8.43
     Possible site: 39
>>> Seems to have an uncleavable N-term signal seq
ALOM program count: 4 value: -15.76 threshold: 0.0
     INTEGRAL     Likelihood = -15.76 Transmembrane    295-311 (287-317)
     INTEGRAL     Likelihood =  -7.59 Transmewbrane     49-65  (46-69)
     INTEGRAL     Likelihood =  -6.90 Transmembrane    340-356 (339-362)
     INTEGRAL     Likelihood =  -5.57 Transmembrane    411-427 (404-430)
     PERIPHERAL   Likelihood =   3.45    386
modified ALOM score: 3.65
*** Reasoning Step: 3

----- Final Results -----
              bacterial membrane --- Certainty = 0.7305(Affirmative) < succ>
              bacterial outside  --- Certainty = 0.0000(Not Clear)   < succ>
              bacterial cytoplasm --- Certainty = 0.0000(Not Clear)  < succ>
```

The protein has homology with the following sequences in the databases:

```
ORF00687(421-1611 of 1917)
EGAD|108957|BS0375(11-484 of 486) hypothetical protein {Bacillus subtilis}
OMNI|NT01BS0429 membrane transport protein GP|1805444|DBJ|BAA09006.1||D50453
homologue of hypothetical protein in a rapamycin synthesis gene cluster of
Streptomyces hygroscopicus {Bacillus subtilis} GP|2632675|emb|CAB12182.1||Z99106
similar to transporter {Bacillus subtilis} PIR|F69762 transporter homolog yclI -
Bacillus subtilis
% Match = 8.6
% Identity = 28.7    % Similarity = 52.2
Matches = 117  Mismatches = 184  Conservative Sub.s = 96
312       342       372       402       432       462       492       522
VL*NH*LIDNVEVDREYLTTSIVILEIIKIEKGGKIVNLWTLSLAYLKRQKMKTVTLFLVFLTIGTCLISLMSIQHSLEK
                                            :| :| ||: ::||  |   ::| ::|| : :|
                                        MNFIKRAFWNMKAKKGKTLLQLFVFTVICVFVLSGLAIQSAAQK
                                             10        20        30        40
543       573       603                                      624       654
N---ILTKQGKSIYLTSKEKAYWPEQAYEALKK--------------------------------AKMVESVEASLSID
:     :||:|    :   :|    |:                              |    :::|:| | |
SSELARQELGGSVTLQVDRQKQMEKQQDSGEKRTFESTPIKVSDANKLAALDHVKSYNYTTSASANAGNFDAIESSSSSD
                60        70        80        90       100       110       120
684       720       750       780       807       834       864
VGSRLKSVSPYNSS--------KEENQVTLAGYQSTEDLRAFQTKALVLKKGSHLA-ADNTKQV-LVPLKLAQKNHLSVG
  |:  |  : ||          :  :::  |  ||        :      :|   |:|  ::    ||::| ||||
SSSSSSSSNAKNSQGGGQGGPQMVQADLSIEGVISTALVDDFSDGDSKITDGRAITKSDVGKKVTVINETLAEENDLSVG
          140       150       160       170       180       190       200
885       903             954       978       1008                1065
NKLRL---GKENVTI----AGIYDANSA---KSKNTFNPNIDNTLIA--QATLVRKISKQKGYQTVAVR-LSDKRLVDTV
: : :      |:|:    ||| |: :::|    |  |  ||     ||     |  |     :  |  : :||
DSITIESATDEDTTVKLKIVGIYKTTSSGDDQAQNFSFLNPYNKLYTPYTATAALKGDDYKNTIDSAVYYMDDAKNMDTF
          220       230       240       250       260       270       280
1095      1125      1155      1185      1215      1245      1275      1305
IQNIKQWPLDFGKLDVQTAKEFYGDSYRNIETLHRLVGRIILIVSLVAMAILVVMLTFWINNRIKETGILLAIGKTKFEI
::    |:   :||     :  |   ::|         ||:   :: ::||    ||  ||: |    |  |:|:||| :  :::
VKAAKKTSIDFDTYTLNTNDQLYQQMVGPIENVASFSKNVVYLVSVAGAVILGLIVMMSIRERKYEMGVLMAIGEKRWKL
          300       310       320       330       340       350       360
1335      1365      1395                              1431      1461      1491
IGHYLIEVLLVAGAAFTLSIIGGVFLGKTFAAGLLSQV-----------------NGGVSSQIVQNSSLIIDRIDNLAV
||::|  |:|:||   |   |:: |  ::     :      ||||                ||:  ::    :||    :|  ||:|  |
IGQFLTEILIVAVIAIGLASVTGNLVANQLGNQLLSQQISSSTDSTQTASGQMPGGGGGMGGKMFGHSSSNVDVIDSLNV
          380       390       400       410       420       430       440
1521      1551      1581      1611      1641      1671      1701      1731
SVGVMDVFRLYAQGALICLFAVVLSSYSILKLQPKQILSRMS*EVNMNLFKRSFLYVSRKKRKSITLFVCLWLVASTLIS
:|  : |::  |      ||| : | :|  | |:|:|:||  ||::
AVSMNDMLILGGIGILIAIIATLLPLISVLRLHPKTILTKQE
          460       470       480
```

Based on this analysis, it was predicted that these proteins and their epitopes could be useful antigens for vaccines or diagnostics.

EXAMPLE 1234

A DNA sequence (GBSx1310) was identified in *S. agalactiae* <SEQ ID 3825> which encodes the amino acid sequence <SEQ ID 3826>. Analysis of this protein sequence reveals the following:

```
Possible site: 24
>>> Seems to have a cleavable N-term signal seq.

----- Final Results -----
         bacterial outside --- Certainty = 0.3000(Affirmative) < succ>
        bacterial membrane --- Certainty = 0.0000(Not Clear)   < succ>
        bacterial cytoplasm --- Certainty = 0.0000(Not Clear)   < succ>
```

The protein has homology with the following sequences in the GENPEPT database.

```
>GP: CAB11993 GB: Z99105 ybdG [Bacillus subtilis]
Identities = 66/224 (29%), Positives = 102/224 (45%), Gaps = 22/224 (9%)
```

```
-continued

Query:   84 IKEYGQKVEVKGKKMNVYTVGEGKVPIVFIPGQGTVTAKHQYHNLISNLSKTHKVVVVEP 143
            +K   G  V+V GKKMNVY  G GK   VF+ G G      ++  L S  SK +K+ VV+
Sbjct:   41 LKGKGTVVDVDGKKMNVYQEGSGKDTFVFMSGSGIAAPAYEMKGLYSKFSKENKIAVVDR 100

Query:  144 FGSGLSDVIDQPRNLANITSDIHEALQKVGITGKYVIASHSIGGVYALKYISTYPKEVLG 203
               G  G S+V    R++  +       +AL  K G     Y++  HSI G+ A+ +   YPKE+
Sbjct:  101 AGYGYSEVSHDDRDIDTVLEQTRKALMKSGNKPPYILMPHSISGIEAMYWAQKYPKEIKA 160

Query:  204 LIGLDTSTP---------GMEGGKQVDF-------------AAPVLKELPKIPKVSDDIN 241
            +I +D   P             G++  K   F                +A    E+ +   ++D+
Sbjct:  161 IIAMDIGLPQQYVTYKLSGVDRLKVRGFHLLTSIGFHRFIPSAVYNPEVIRQSFLTDEEK 220

Query:  242 AQFFAIGHKILNNSNMKEEAKNSSNMINESANYKIPKGIPAMYL                285
               + AI  K    N++M+ E   S     ++S N    PK  P + L
Sbjct:  221 EIYKAINFKQFFNADMEHELLQSYQNGSKSVNLPAPKETPVLIL                264
```

No corresponding DNA sequence was identified in *S. pyogenes*.

SEQ ID 3826 (GBS121) was expressed in *E. coli* as a His-fusion product. SDS-PAGE analysis of total cell extract is shown in FIG. 24 (lane 9; MW 40 kDa). It was also expressed in *E. coli* as a GST-fusion product. SDS-PAGE analysis of total cell extract is shown in FIG. 31 (lane 6; MW 65 kDa).

GBS121-GST was purified as shown in FIG. 198, lane 6.

Based on this analysis, it was predicted that this protein and its epitopes, could be useful antigens for vaccines or diagnostics.

EXAMPLE 1235

A DNA sequence (GBSx1311) was identified in *S. agalactiae* <SEQ ID 3827> which encodes the amino acid sequence <SEQ ID 3828>. Analysis of this protein sequence reveals the following:

```
Possible site: 33
>>> Seems to have a cleavable N-term signal seq.

----- Final Results -----
            bacterial outside   --- Certainty = 0.3000(Affirmative) < succ>
            bacterial membrane  --- Certainty = 0.0000(Not Clear)   < succ>
            bacterial cytoplasm --- Certainty = 0.0000(Not Clear)   < succ>
```

A related GBS nucleic acid sequence <SEQ ID 8759> which encodes amino acid sequence <SEQ ID 8760> was also identified. Analysis of this protein sequence reveals the following:

```
Lipop: Possible site: -1 Crend: 8
McG: Discrim Score: 3.70
GvH: Signal Score (-7.5): -0.0600004
     Possible site: 22
>>> Seems to have a cleavable N-term signal seq.
ALOM program count: 0 value: 8.01 threshold: 0.0
        PERIPHERAL              Likelihood = 8.01              167
modified ALOM score: -2.10
*** Reasoning Step: 3

----- Final Results -----
            bacterial outside   --- Certainty = 0.3000(Affirmative) < succ>
            bacterial membrane  --- Certainty = 0.0000(Not Clear)   < succ>
            bacterial cytoplasm --- Certainty = 0.0000(Not Clear)
```

No corresponding DNA sequence was identified in *S. pyogenes*.

SEQ ID 8760 (GBS60) was expressed in *E. coli* as a His-fusion product. SDS-PAGE analysis of total cell extract is shown in FIG. 16 (lane 7; MW 38.6 kDa).

GBS60-His was purified as shown in FIG. 193, lane 3.

Based on this analysis, it was predicted that these proteins and their epitopes could be useful antigens for vaccines or diagnostics.

EXAMPLE 1236

A DNA sequence (GBSx1312) was identified in *S. agalactiae* <SEQ ID 3829> which encodes the amino acid sequence <SEQ ID 3830>. This protein is predicted to be unnamed protein product. Analysis of this protein sequence reveals the following:

```
Possible site: 21
>>> May be a lipoprotein

----- Final Results -----
            bacterial membrane --- Certainty = 0.0000(Not Clear) < succ>
             bacterial outside --- Certainty = 0.0000(Not Clear) < succ>
           bacterial cytoplasm --- Certainty = 0.0000(Not Clear) < succ>
```

A related GBS nucleic acid sequence <SEQ ID 9693> which encodes amino acid sequence <SEQ ID 9694> was also identified.

No corresponding DNA sequence was identified in *S. pyogenes*.

A related GBS gene <SEQ ID 8761> and protein <SEQ ID 8762> were also identified. Analysis of this protein sequence reveals the following:

```
Lipop: Possible site: 19 Crend: 5
McG: Discrim Score: 9.85
GvH: Signal Score (-7.5): -0.28
    Possible site: 21
>>> May be a lipoprotein
ALOM program count: 0 value: 9.07 threshold: 0.0
   PERIPHERAL Likelihood = 9.07 99
 modified ALOM score: -2.31

----- Final Results -----
            bacterial membrane --- Certainty = 0.0000(Not Clear) < succ>
             bacterial outside --- Certainty = 0.0000(Not Clear) < succ>
           bacterial cytoplasm --- Certainty = 0.0000(Not Clear) < succ>
```

The protein has homology with the following sequences in the databases:

```
37.0/57.2% over 118aa
Bacillus subtilis
EGAD|108627| hypothetical protein Insert characterized
GP|2632485|emb|CAB11993.1||Z99105 ybdG Insert characterized
PIR|D69747|D69747 hypothetical protein ybdG - Insert characterized
ORF00608(553-906 of 1416)
EGAD|108627|BS0200(51-169 of 296) hypothetical protein {Bacillus subtilis}
GP|2632485|emb|CAB11993.1||Z99105 ybdG {Bacillus subtilis} PIR|D69747|D69747
hypothetical protein ybdG - Bacillus subtilis
% Match = 8.7
% Identity = 37.0   % Similarity = 57.1
Matches = 44  Mismatches = 50  Conservative Sub.s = 24
    339       369       399       429       459       489       519       549
ITKLSTVALSLLLCTACAASNTSTSKTQSHHPKQTKLTDKQKEEPKNKEAADQEMHPQGAVDLTKYKAKPVKDYGKKIDV
                             MKTLWKVLKIVFVSLAALVLLVSVSVFTIYHHFQLNKEAALLKGKGTVVD
                                     10        20        30        40
    579       609       639       669       699       729       759       789
GDGKKMNIYETGQGKIPIVFIPGQAEISPRYAYKNLIERLSKKYKIYTVEPLGYGLSDIPTKPRTLENITKEIHTGLNKI
||||||:|: | ||   ||:|   :|   |   ::||: ||  |: |||  |::   |::  ::      ||
VDGKKMNVYQEGSGKDTFVFMSGSGIAAPAYEMKGLYSKFSKENKIAVVDRAGYGYSEVSHDDRDIDTVLEQTRKALMRS
         60        70        80        90       100       110       120
    816       846       876       906       936       966       996      1026
GVKNFY-LAAHSLGGMYSLNYAKNYPEEVRGFIGMDTSTPWMEGEQKTKYDPESAKWAMKXPDVDDKTNEQYLSIAKKIN
|||   |   ||: |:  :: :|: ||:|::  |||     |                             ::
GNKPPYILMPHSISGIEAMYWAQKYPKEIKAIIAMDIGLPQQYVTYKLSGVDRLKVRGFHLLTSIGFHRFIPSAVYNPEV
        140       150       160       170       180       190       200
```

SEQ ID 8762 (GBS21) was expressed in *E. coli* as a His-fusion product. SDS-PAGE analysis of total cell extract is shown in FIG. 11 (lane 3; MW 31.6 kDa).

GBS21-His was purified as shown in FIG. 192, lane 11.

GBS21L was expressed in *E. coli* as a GST-fusion product. SDS-PAGE analysis of total cell extract is shown in FIG. 124 (lane 8-10; MW 66.5 kDa). It was also expressed in *E. coli* as a His-fusion product. SDS-PAGE analysis of total cell extract is shown in FIG. 124 (lane 11; MW 41.5 kDa) and in FIG. 180 (lane 6; MW 41 kDa). GBS21L-His was purified as shown in FIG. 232 (lanes 3 & 4) Based on this analysis, it was predicted that these proteins and their epitopes could be useful antigens for vaccines or diagnostics.

EXAMPLE 1237

A DNA sequence (GBSx1313) was identified in *S. agalactiae* <SEQ ID 3831> which encodes the amino acid sequence <SEQ ID 3832>. This protein is predicted to be endopeptidase 0. Analysis of this protein sequence reveals the following:

```
Possible site: 18
>>> Seems to have no N-terminal signal sequence

----- Final Results -----
            bacterial cytoplasm --- Certainty = 0.3854(Affirmative) < succ>
            bacterial membrane  --- Certainty = 0.0000(Not Clear)   < succ>
             bacterial outside  --- Certainty = 0.0000(Not Clear)   < succ>
```

The protein has homology with the following sequences in the GENPEPT database.

```
>GP:AAF67832 GB:AF179267 endopeptidase PepO2
[Lactococcus lactis]
Identities = 21/36 (58%), Positives = 26/36 (71%)

Query:    1 MRANIPVRNFQEFYDAFGVKKGDSMYLKPEKRLTLW  36
            +RANIP  N +EFY+ F VK+ D MY  PEKRL+W
Sbjct:  592 LRANIPPTNLEEFYETFDVKETDQMYRAPEKRLKIW  627
```

There is also some homology to SEQ ID 2384:

```
Identities = 13/36 (36%), Positives = 25/36 (69%)

Query:    1 MRANIPVRNFQEFYDAFGVKKGDSMYLKPEKRLTLW  36
            +R N+ + NF  F++ F +K+GD+M+  P+ R+ +W
Sbjct:  596 LRTNVTLTNFDAFHETFDIKEGDAMWRAPKDRVIIW  631
```

Based on this analysis, it was predicted that this protein and its epitopes, could be useful antigens for vaccines or diagnostics.

EXAMPLE 1238

A DNA sequence (GBSx1314) was identified in *S. agalactiae* <SEQ ID 3833> which encodes the amino acid sequence <SEQ ID 3834>. This protein is predicted to be endopeptidase 0. Analysis of this protein sequence reveals the following:

```
Possible site: 47
>>> Seems to have no N-terminal signal sequence

----- Final Results -----
            bacterial cytoplasm --- Certainty = 0.3801(Affirmative) < succ>
            bacterial membrane  --- Certainty = 0.0000(Not Clear)   < succ>
             bacterial outside  --- Certainty = 0.0000(Not Clear)   < succ>
```

The protein has homology with the following sequences in the GENPEPT database.

```
>GP:AAA16168 GB:L18760 endopeptidase [Lactococcus lactis]
Identities = 118/268 (44%), Positives = 174/268 (64%), Gaps = 6/268 (2%)

Query:    1 MGDYYGKKYFGEAAKKDVEHMAKKIINVYKTRLKNNTWLSENTKAMAIKKLDNMRLMIGY   60
            +G +YGKKYFGEAAK DV+ M   +I VY+ RL  N WLS+ T   AI+KLD +   IG+
Sbjct:  321 IGLFYGKKYFGEAAKADVKRMVTAMIKVYQVRLSKNEWLSQETAEKAIEKLDAITPFIGF  380

Query:   61 PEDYPDLYRQYQFDSKASFFENNDNYRKLSNKKTFEEFNQSNQREHWQMSANAVNAYNDP  120
            P+   P++Y + +   S  S +E+   + K+   +TFE+F++     + W M A+ VNAY  P
Sbjct:  381 PDKLPEIYSRLKTTS-GSLYEDALKFDKILTARTFEKFSEDVDKTSWHMPAHMVNAYYSP  439
```

```
Query: 121 NTNSIVFPAAIFQSPLYDKTKTVSQNYGAIGAIIGHEISHSFDINGMKYDEKGNLHDWWT 180
           ++N+IVFPAAI Q+P Y    ++ SQNYG IGA+I HEISH+FD NG ++D++GNL+ WW
Sbjct: 440 DSNTIVFPAAILQAPFYSLEQSSSQNYGGIGAVIAHEISHAFDNNGAQFDKEGNLNKWWL 499

Query: 181 KEDLKHYKKKTQAMIDQWDGLKADGGKVDGKLTLAENIADNGGVMASLEALKTEKIQTIK 240
           ED + +++K + MI  +DG++ + G  +GKL ++ENIAD GG+ A+L A K EK    +K
Sbjct: 500 DEDYEAFEEKQKEMIALFDGVETEAGPANGKLIVSENIADQGGITAALTAAKDEKDVDLK 559

Query: 241 NFLNHGQVFGVKKQPKNKVSPQFSQMFM                                 268
           F  +         K   + K S +F QM +
Sbjct: 560 AFFSQW-----AKIWRMKASKEFQQMLL                                 582
```

There is also homology to SEQ ID 2384:

```
Identities = 110/253 (43%), Positives = 161/253 (63%), Gaps = 1/253 (0%)

Query:   1 MGDYYGKKYFGEAAKKDVEHMAKKIINVYKTRLKNNTWLSENTKAMAIKKLDNMRLMIGY  60
           +G +Y + F   AK DVE   ++I VYK+RL+   WL+ T+ AI KL+ +    IGY
Sbjct: 324 LGLWYAGQKFSPEAKADVESKVARMIEVYKSRLETADWLAPATREKAITKLNVITPHIGY 383

Query:  61 PEDYPDLYRQYQFDSKASFFENNDNYRKLSNKKTFEEFNQSNQREHWQMSANAVNAYNDP 120
           PE  P+ Y +    D   S  EN  N  K++   T+ ++N+    R  W M A+ VNAY D
Sbjct: 384 PEKLPETYAKKVIDESLSLVENAQNLAKITIAHTWSKWNKPVDRSEWHMPAHLVNAYYDL 443

Query: 121 NTNSIVFPAAIFQSPLYDKTKTVSQNYGAIGAIIGHEISHSFDINGMKYDEKGNLHDWWT 180
           N  IVFPAAI Q P Y    ++ S NYG IGA+I HEISH+FD NG  +DE G+L+DWWT
Sbjct: 444 QQNQIVFPAAILQEPFYSLDQSSSANYGGIGAVIAHEISHAFDTNGASFDEHGSLNDWWT 503

Query: 181 KEDLKHYKKKTQAMIDQWDGLKADGGKVDGKLTLAENIADNGGVMASLEALKTEKIQTIK 240
           +ED   +K++T   ++ Q+DGL++ G KV+GKLT++EN+AD GGV    +LEA ++E+ + +
Sbjct: 504 QEDYAAFKERTDKIVAQFDGLESHGAKVNGKLTVSENVADLGGVACALEAAQSEEDFSAR 563

Query: 241 N-FLNHGQVFGVK                                                252
           + F+N    ++ +K
Sbjct: 564 DFFINFATIWRMK                                                576
```

Based on this analysis, it was predicted that this protein and its epitopes, could be useful antigens for vaccines or diagnostics.

EXAMPLE 1239

A DNA sequence (GBSx1315) was identified in *S. agalactiae* <SEQ ID 3835> which encodes the amino acid sequence <SEQ ID 3836>. Analysis of this protein sequence reveals the following:

```
Possible site: 39
>>> Seems to have a cleavable N-term signal seq.

----- Final Results -----
            bacterial outside  --- Certainty = 0.3000(Affirmative) < succ>
            bacterial membrane --- Certainty = 0.0000(Not Clear)   < succ>
            bacterial cytoplasm --- Certainty = 0.0000(Not Clear)  < succ>
```

A related GBS nucleic acid sequence <SEQ ID 9691> which encodes amino acid sequence <SEQ ID 9692> was also identified.

The protein has homology with the following sequences in the GENPEPT database.

```
>GP:AAC35997 GB:AF019410 endopeptidase O [Lactobacillus helveticus]
Identities = 85/315 (26%), Positives = 146/315 (45%), Gaps = 8/315 (2%)

Query:  46 NVSPRENLYRAVNDNWLANTKLKQGQTSVNSFSEIEDKLKQLLVSDMAKMASGKIETTN- 104
           N   P++NLY AVN  WL+  ++    QTS    +E++ K+++ ++ D A +ASGK +  +
Sbjct:  20 NAKPQDNLYLAVNSEWLSKAEIPADQTSAGVNTELDIKIEKRMMKDFADIASGKEKMPDI  79

Query: 105 DEQKKMVAYYKQGMDFKTRDKNGLKPLKPVLQKLEAVSSMKDFQSLAHDFVMSGFVLPFG 164
           +   K +A YK   +F RD      P++ LQK+ + +   F+ A +   M + LPF
Sbjct:  80 RDFDKAIALYKIAKNFDKRDAEKANPIQNDLQKILDLINFDKFKDNATELFMGPYALPFV 139
```

-continued

```
Query: 165 LTVETNARDNSQKQLVLRQAPALLESPDQYKKGNKEGEAKLSAYRTSAMALLKQAGKSNI 224
            V+ + ++    L       L    YK   E + L      ++ LL+ AG
Sbjct: 140 FDVDADMKNTDFNVLHFGGPSTFLPDTTTYK--TPEAKKLLDILEKQSINLLEMAGIKE 197

Query: 225 EDRKLVKQAIAFDRLLSEKTQVDQSKITAESETAAGRYNPESMETVHNYAKEFDFKELIE 284
            E R  V+ A+AFD+ LS+       K T E   A  YNP S+       K FD  + ++
Sbjct: 198 EARVYVQNALAFDQKLSKVV-----KSTEEWSDYAAIYNPVSLTEFLAKFKSFDMADFLK 252

Query: 285 KLVGPTNKAVNVEDKTYFKQVNDVINSKQLANMKAWMMISMLVDQSDFLGEQNRQAASAF 344
            ++      + V V + +    +++IN       +K WM++  +    + +L +  R AA  F
Sbjct: 253 TILPEKVERVIVMEPRFLDHADELINPANFDEIKGWMLVKYINSVAKYLSQDFRAAAFPF 312

Query: 345 KNVASGLTQIESKEK                                              359
            SG  ++ S+ K
Sbjct: 313 NQAISGTPELPSQIK                                              327
```

A related GBS gene <SEQ ID 8763> and protein <SEQ ID 8764> were also identified. Analysis of this protein sequence reveals the following:

```
Lipop: Possible site: -1 Crend: 10
McG: Discrim Score: 5.41
GvH: Signal Score (-7.5): -1.39
     Possible site: 36
>>> Seems to have a cleavable N-term signal seq.
ALOM program count: 0 value: 2.76 threshold: 0.0
   PERIPHERAL Likelihood = 2.76 151
modified ALOM score: -1.05
*** Reasoning Step: 3

----- Final Results -----
              bacterial outside --- Certainty = 0.3000(Affirmative) < succ>
              bacterial membrane --- Certainty = 0.0000(Not Clear) < succ>
              bacterial cytoplasm --- Certainty = 0.0000(Not Clear) < succ>
```

SEQ ID 8764 (GBS12) was expressed in *E. coli* as a GST-fusion product. SDS-PAGE analysis of total cell extract is shown in FIG. 1 (lane 7; MW 65 kDa). It was also expressed in *E. coli* as a His-fusion product. SDS-PAGE analysis of total cell extract is shown in FIG. 3 (lane 3; MW 39 kDa).

The GST-fusion protein was purified as shown in FIG. 189, lane 4.

Based on this analysis, it was predicted that these proteins and their epitopes could be useful antigens for vaccines or diagnostics.

EXAMPLE 1240

A DNA sequence (GBSx1317) was identified in *S. agalactiae* <SEQ ID 3839> which encodes the amino acid sequence <SEQ ID 3840>. Analysis of this protein sequence reveals the following:

```
Possible site: 15
>>> Seems to have no N-terminal signal sequence
    INTEGRAL    Likelihood = -1.75   Transmembrane     301-317 (299-317)

----- Final Results -----
              bacterial membrane --- Certainty = 0.1702(Affirmative) < succ>
              bacterial outside --- Certainty = 0.0000(Not Clear) < succ>
              bacterial cytoplasm --- Certainty = 0.0000(Not Clear) < succ>
```

The protein has homology with the following sequences in the GENPEPT database.

```
>GP: CAB42180 GB: A67181 unnamed protein product
[unidentified]
Identities = 245/771 (31%), Positives = 410/771 (52%),
Gaps = 80/771 (10%)
```

-continued

```
Query:   22 VRVIVEFNKESILDYATEQKKTVAQLNQADVEKKLQSIKQEQDKVLKNIEKSVHEDSSIIV  81
            VRVIV  NK + D+ ++   + A + +   +E+   +K  Q+KV+K +E+      +KV
Sbjct:   97 VRVIVSLNKSAAFDHTSKPTGSAASVKK--IEQASDQVKDGQEKVIKQVEE---ITGNKV  151

Query:   82 KR-YDAIINGVALDIQAQEIEKLKTIADVRRVYVSQEYVQTKPLLSSSGQLIGLPEVWNN  140
            +R +  ++N  ++D+  +I+K+K +  V+ V   + Y     P   S+ Q+  +  +VW
Sbjct:  152 RRQFGYLVNAFSIDMDLDDIDKVKDLPQVKNVTPVKVY---HPTDESADQMAQVQDVWQE  208

Query:  141 SQYKGEGTVVAVIDSGVDFKHQALKIKEPNRAKYNKTSIE----KLIHEKNLKGKFYSEK  196
             + KGEG V+++ID+G+D  HQ  LK+        +K+ +E       KL H    GK+Y+EK
Sbjct:  209 QKLKGEGMVISIIDTGIDSSHQDLKLDSGVSTALSKSEVESDKSKLGH-----GKYYTEK  263

Query:  197 VPYGYNYYDYNDNLKDS-YGVMHGMHVTGIVGANDDNQKLYGVAPNAQILAMKVFSDDQQ  255
            VPYGYNY D ND + D+  G MHG HV GI GAN     ++ GVAP+AQ+ LAMKVFS++ +
Sbjct:  264 VPYGYNYADKNDQIVDNGCGEMHGQHVAGIAGANG---QVKGVAPDAQLLAMKVFSNNAK  320

Query:  256 NPTTFTDVWLKALDDAILLKADVVNMSLGTPAGFVHEGKDYPELEVIARACKAGIVIAVA  315
            N   + D + A++D++ L ADV+NMSLG+ +   V  G   P+   +A+A +AG++   ++
Sbjct:  321 NSGAYDDDIISAIEDSVKLGADVINMSLGSVSSDV--GPSDPQQQAVAKASEAGVINVIS  378

Query:  316 AGNE---GNITDGNTYGVKPLAENYDTALIANPALDDNTLAVASMENLKKHAHVLKFK--  370
            AGN    G+  DGN       +E   + + P +   + L VAS EN K    +K +
Sbjct:  379 AGNSGVAGSTADGNPVNNTGTSE---LSTVGTPGVTPDALTVASAENSKVTTDTVKDELG  435

Query:  371 --------DKKSGTEVTEVINLHVAPNASKTIIGLAVDLGAGAPSELS--KHFDLSGKIA  420
                    + K  +VT + + +       K +     VD+G G   + +  K  ++ G++A
Sbjct:  436 GVTFSSNSELKGAAQVTTQLESNYSVLTKKLKL---VDMGLGGADDYTAEKKAEVKGQLA  492

Query:  421 MLEIPEDNKSNGFLEKVQAITKLNPAAILLYNNAKVKDDLGSQLLVESEAAKFNIARITR  480
             +++       + F  KV         A I++YN+    D L S  L +       +++
Sbjct:  493 VVK----RGAYTFSAKVANAKAAGAAGIVIYNSE--DDGLLSMSLDDKTFPTLGMSKADG  546

Query:  481 STY----NNIKNNSNKIITILTERQAIDNSLAGQLSSYSSWGPTPDLRLKPEITAPGGHI  536
             +       ++ +  K  T L     IDNS AG++S ++SWGPTP+L  KPEITAPGG I
Sbjct:  547 KFWLKQQKKVRASRLKFGTAL-----IDNSRAGKMSDFTSWGPTPELDFKPEITAPGGKI  601

Query:  537 FSTVEDNQYADKSGTSMAAPQVAGAAAVLKQYITDKKIPV--DNAADFIKLLLMNTAQPI  594
             +S    DN+Y    SGTSMA+P VAG+ A++ Q I  + + +     F K    MNT+ P+
Sbjct:  602 YSLANDNKYQQMSGTSMASPFVAGSEALILQGIKKQGLNLSGEELVQFAKNSAMNTSHPV  661

Query:  595 IN-KQSKDGKTPYFVRQQGSGAMNLAKALVTTVVATVTGTNDNNADGKLELREL-KEKKF  652
             + + +K+  +P   R+QGSG +N+  A+  TV        N +G       L+E+ ++  F
Sbjct:  662 YDTEHTKEIISP---RRQGSGEINVKDAINNTVEVKAA-----NGNGAAALKEIGRQTTF  713

Query:  653 KARILLRNFGKTNKTYIISSEA--IADPVDEKGFRTQNSEHLVSKKADAVTRKVTVEAGK  710
            K   + L N GK +TY + +        + K     +++ +V +    T KVTV+ G+
Sbjct:  714 K--VTLTNHGKKAQTYAVDNYGGPYTQATEAKSGEIYDTK-IVKGQLTTETPKVTVQPGE  770

Query:  711 TLAVDLDVDYSDAEALTRNNFLEGYLNLK-DTEGVADLHLPFLGFYGSWTE           760
              +VD+   +   +     R NF+EGY+      +    +L LP++GF+GS+++
Sbjct:  771 --SVDVSFTLTLPYSFQRQNFVEGYVGFEAKDQATPNLVLPYMGFFGSYSQ           819
```

A related GBS gene <SEQ ID 8767> and protein <SEQ ID 8768> were also identified. Analysis of this protein sequence reveals the following:

```
Lipop: Possible site: -1 Crend: 10
McG: Discrim Score: -8.37
GvH: Signal Score (-7.5): -6.06
     Possible site: 15
>>> Seems to have no N-terminal signal sequence
ALOM program count: 1  value: -1.75  threshold: 0.0
     INTEGRAL    Likelihood = -1.75    Transmembrane    301-317 (299-317)
     PERIPHERAL  Likelihood = 1.75     614
modified ALOM score: 0.85
*** Reasoning Step: 3

----- Final Results -----
           bacterial membrane --- Certainty = 0.1702(Affirmative) < succ>
           bacterial outside  --- Certainty = 0.0000(Not Clear)   < succ>
           bacterial cytoplasm --- Certainty = 0.0000(Not Clear)  < succ>
```

The protein has homology with the following sequences in the databases:

```
ORF00677(358-3159 of 3255)
EGAD|139899|149200(95-1541 of 1946) prtB protein {Lactobacillus delbrueckii}
GP|1381114|gb|AAC41529.1||L48487 proteinase precursor {Lactobacillus delbrueckii}
PIR|JC6032|JC6032 lactocepin (EC 3.4.21.96) precursor [similarity] -
Lactobacillus delbrueckii subsp. bulgaricus
% Match = 15.5
% Identity = 33.3    % Similarity = 54.6
Matches = 275   Mismatches = 343   Conservative Sub.s = 176
    318       348       378       408       438       468       498       528
KAVTVTKPQGAVAEKATPAVPKPQKVRVIVEFNKESILDYATEQKKTVAQLNQADVEKKLQSIKQEQDKVLKNIEKSVHF
          |||||:||   :  :|:  ::      :  |:         :|:      :|   |:||:|  :|:
SKFQEAAKEQRQASGQAVSKKNESSVRVIVSLNKSAAFDHTSKPTGSAASV--KKIEQASDQVKDGQEKVIKQVEE---I
                 90        100       110       120       130       140
    555       585       615       645       675       705       735       765
DSSKVKR-YDAIINGVALDIQAQEIEKLKTIADVRRVYVSQEYVQTKPLLSSSGQLIGLPEVWNNSQYKGEGTVVAVIDS
 :||:|  :    ::|   ::|:    :|:|:|  :   |:|    : |         |: |:    :||     : ||||  |:::||:
TGNKVRRQFGYLVNAFSIDMDLDDIDKVKDLPQVKNVTPVKVYHPT---DESADQMAQVQDVWQEQKLKGEGMVISIIDT
              160       170       180       190       200       210       220
    795       825       855       885       915       942       972      1002
GVDFKHQALKIKEPNRAKYNKTSIEKLIHEKNLKGKFYSEKVPYGYNYYDYNDNLKDS-YGVMHGMHVTGIVGANDDNQK
|:|   ||   ||:        :|:  :|      |   ||:|:|||||||| ||   : |:    |||| ||  |||    :
GIDSSHQDLKLDSGVSTALSKSEVESDKS-KLGHGKYYTEKVPYGYNYADKNDQIVDNGCGEMHGQHVAGIAGAN---GQ
              240       250       260       270       280       290
   1032      1062      1092      1122      1152      1182      1212      1242
LYGVAPNAQILAMKVFSDDQQNPTTFTDVWLKALDDAILLKADVVNMSLGTPAGFVHEGKDYPELEVIARACKAGIVIAV
: ||||:||:||||||||:: :|    :  |::|::    :  ||:|||||:|||:|    :    :|:|:     :|::
VKGVAPDAQLLAMKVFSNNAKNSGAYDDDIISAIEDSVKLGADVINMSLGSVSSDV--GPSDPQQQAVAKASEAGVINVI
              310       320       330       340       350       360       370
   1272      1302      1326      1356      1386      1416              1656
AAGNEGNITDGNTYGVKPLAENYDTAL--IANPALDDNTLAVASMENLKKHAHVLKFKDKKSGTEVTEV~~~~AAILLYN
:|||  |       |:|    |:    |     :  |   :|:
SAGNSG--VAGSTADGNPVNNTGTSELSTVGTPGVTPDALTVASAENSK-----------------------------
              390       400       410       420
   1686      1716      1746      1776      1806
NAKVKDDLGSQLLVESEAAKFNIARITRSTYNNIKNNSNKIITILTERQA----------------------------
                |  ::    :   :|:      :  ::  | |      :
-------------VTTDTVKDELGGVTFSSNSELKG-AAQVTTQLESNYSVLTKKLKLVDMGLGGADDYT~~~~FWLKQQ
              430       440       450       460       470       480
   1824      1854      1884      1914      1944      1974      2004
--------------IDNSLAGQLSSYSSWGPTPDLRLKPEITAPGGHIFSTVEDNQYADKSGTSMAAPQVAGAAAVLKQY
              ||||  ||:: :::|||||| :||||||||||  ||:   ||||||| |: |:: |
KKVRASRLKFGTALIDNSRAGKMSDFTSWGPTPELDFKPEITAPGGKIYSLANDNKYQQMSGTSMASPFVAGSEALILQG
              570       580       590       600       610       620       630
   2058      2088      2115      2145      2175      2205      2235
ITDKKIPV--DNAADFIKLLLMNTAQPIINKQ-SKDGKTPYFVRQQGSGAMNLAKALVTTVVATVTGTNDNNADGKLELR
|   :  :   ::  ||   |||  :: :|   ::  :    :  :   |:|::   ||:    ::   :
IKKQGLNLSGEELVQFAKNSAMNTSHPVYDTEHTKEIISP---RRQGSGEINVKDAINNTV--EVKAANGNGA---AALK
              650       660       670       680       690       700
   2265      2295            2349      2379      2409      2439      2469
ELKEKKFKARILLRNFGKTNKTYIISSEA--IADPVDEKGFRTQNSEHLVSKKSDAVTRKVTVEAGKTLAVDLDVDYSDA
|:    :::    | ||   ||:||           :      :    |   ||: ||    ||      ::
EIG-RQTTFKVTLTNHGKKAQTYAVDNYGGPYTQATEAKSGEIYDTK-IVKGQLTTETPKVTVQPGES--VDVSFTLTLP
              720       730       740       750       760       770       780
   2499      2526      2556      2586      2616      2646      2676      2706
EALTRNNFLEGYLNLK-DTEGVADLHLPFLGFYGSWTEQKAIDAFEGISEIGNGDKKRRVQFYVNKETNKTSSTFTTNGM
 :: | ||:|||  ::       ::   |  |||:|||::::  :       :                |
YSFQRQNFVEGYVGFEAKDQATPNLVLPYMGFFGSYS-QASVSA-PMLYEGGNSNLINTIHSLVGVMFSNNNDMLGHTGY
              800       810       820       830       840       850
   2724      2754      2781      2811      2841      2871      2901      2931
----LSLPIYNNTVFFSPNSP-FYDKAGVRIAALRNMEYVQYSIIDPDTNKEVRVLGRSHDVRKLYRLDYRNSFAMMPDS
    |  :  :|||   ||   ||   ||    :  :|  :      :      ||
EGDDYSKYTDPDLIAISPNGDGSRDYAYPVLFFDRNYKEYTETITDAQGNK-VKSLGVKEGTKDYYSSSSGEWTTHSLD
   870       880       890       900       910       920       930
   2961      2991      3021      3051      3081      3111
IWDGKIKD*IAKGDKQYIYQIKVQLNNKGVGGDGVQIYQYYIKMDNNKPYLSPKDKTTVEKLEDRWK-------------
|||   |      |    | ||||    ||::   :|| :|     :|:  | :|   :   |     |
KWDGTDADGQVVKDGQYIY--KVEFT-PAIGGQE-QELNIPVKVDSQAPEVSDLQVTKDGKLRLKAKDSGSGLDMTMFVA
              950       960       970       980       990      1000      1010
   3159      3189      3219      3249
---------------------------KITFKVQDTGIGLKDVYLQSVKYVGGGNNNLDLITPPGFKK
                           |: ||  ||
AVNGEEQ~~~~VDGKSWTKLDKDTVQVAENGKVEFKYQDVYGNESKVTTYEVKNIVKEVAAQPELKLTPDGEGKVKAELA
       1520      1530      1540      1550      1560      1570      1580
```

Figure 149:
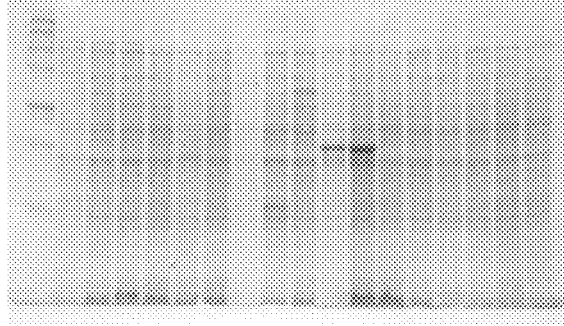
Figure 182:

SEQ ID 8768 (GBS362N) was expressed in *E. coli* as a GST-fusion product. SDS-PAGE analysis of total cell extract is shown in FIG. 149 (lane 10; MW 63.5 kDa). It was also expressed in *E. coli* as a His-fusion product. SDS-PAGE analysis of total cell extract is shown in FIG. 182 (lane 9; MW 38 kDa) and in FIG. 149 (lane 11 & 12; MW 38 kDa). Purified GBS362N is shown in FIG. 235, lanes 3 & 4 GBS362C was expressed in *E. coli* as a GST-fusion product. SDS-PAGE analysis of total cell extract is shown in FIG. 149 (lane 14-16; MW 91 kDa). It was also expressed in *E. coli* as a His-fusion product. SDS-PAGE analysis of total cell extract is shown in FIG. 155 (lane 18; MW 66.3 kDa).

Based on this analysis, it was predicted that these proteins and their epitopes could be useful antigens for vaccines or diagnostics.

EXAMPLE 1241

A DNA sequence (GBSx1318) was identified in *S. agalactiae* <SEQ ID 3841> which encodes the amino acid sequence <SEQ ID 3842>. Analysis of this protein sequence reveals the following:

```
Possible site: 35
>>> Seems to have no N-terminal signal sequence
       INTEGRAL    Likelihood = -4.04    Transmembrane    21-37 (17-38)

----- Final Results -----
              bacterial membrane   --- Certainty = 0.2614(Affirmative) < succ>
              bacterial outside    --- Certainty = 0.0000(Not Clear)   < succ>
              bacterial cytoplasm  --- Certainty = 0.0000(Not Clear)   < succ>
```

The protein has homology with the following sequences in the GENPEPT database.

```
>GP: BAA95000 GB: AB042239 PAa [Streptococcus criceti ]
Identities = 55/166 (33%), Positives = 81/166 (48%), Gaps = 24/166 (14%)

Query:    5 KKTDKFGFRKSKVCRSLCGALLGTVAVVSLATASTEIHADEATTSPTTVTKVPQPVQADT   64
            K+ + FGFRKSK+ +SLCGALLGT  VVS+ A     A++ TTS T+           DT
Sbjct:    2 KRKETFGFRKSKISKSLCGALLGTAIVVSV--AGQRALAEDMTTSTTSA--------VDT   51

Query:   65 TALNTSKTHSTQATTTPVEAKENKVVKSETVQSESRV--MPRD-KVVERPETVKASVNS-  120
            TA+  ++T +       +A +  ++    Q+E +  MP D     E  E VK++   +
Sbjct:   52 TAVVGTETGNPATNLPEKQADSSSQAEASQAQAEQKTGSMPVDVATTELDEAVKSAAEAG  111

Query:  121 -DVSQPITTTPPTI------NEKTVEIPNLAQDTKKVAPKVTVTPE                159
             VSQ  T     T+------+EK+ EI    D  KA  ++T E
Sbjct:  112 VTVSQDETVDKGTVGTSQEADEKSGEI---KADYSKQAETIKITTE                154
```

No corresponding DNA sequence was identified in *S. pyogenes*.

SEQ ID 3842 (GBS222) was expressed in *E. coli* as a His-fusion product. SDS-PAGE analysis of total cell extract is shown in FIG. 44 (lane 6; MW 22 kDa).

Based on this analysis, it was predicted that this protein and its epitopes, could be useful antigens for vaccines or diagnostics.

EXAMPLE 1242

A DNA sequence (GBSx1319) was identified in *S. agalactiae* <SEQ ID 3843> which encodes the amino acid sequence <SEQ ID 3844>. This protein is predicted to be CylK. Analysis of this protein sequence reveals the following:

```
Possible site: 23
>>> Seems to have no N-terminal signal sequence

----- Final Results -----
              bacterial cytoplasm  --- Certainty = 0.3738(Affirmative) < succ>
```

```
            bacterial membrane --- Certainty = 0.0000(Not Clear) < succ>
            bacterial outside --- Certainty = 0.0000(Not Clear) < succ>
```

No corresponding DNA sequence was identified in *S. pyogenes*.

Based on this analysis, it was predicted that this protein and its epitopes, could be useful antigens for vaccines or diagnostics.

EXAMPLE 1243

A DNA sequence (GBSx1320) was identified in *S. agalactiae* <SEQ ID 3845> which encodes the amino acid sequence <SEQ ID 3846>. This protein is predicted to be CylJ. Analysis of this protein sequence reveals the following:

```
Possible site: 20
>>> Seems to have no N-terminal signal sequence

----- Final Results -----
            bacterial cytoplasm --- Certainty = 0.1143(Affirmative) < succ>
            bacterial membrane --- Certainty = 0.0000(Not Clear) < succ>
            bacterial outside --- Certainty = 0.0000(Not Clear) < succ>
```

A related GBS nucleic acid sequence <SEQ ID 9689> which encodes amino acid sequence <SEQ ID 9690> was also identified.

No corresponding DNA sequence was identified in *S. pyogenes*.

Based on this analysis, it was predicted that this protein and its epitopes, could be useful antigens for vaccines or diagnostics.

EXAMPLE 1244

A DNA sequence (GBSx1321) was identified in *S. agalactiae* <SEQ ID 3847> which encodes the amino acid sequence <SEQ ID 3848>. Analysis of this protein sequence reveals the following:

```
Possible site: 22
>>> Seems to have no N-terminal signal sequence

----- Final Results -----
            bacterial cytoplasm --- Certainty = 0.0913(Affirmative) < succ>
            bacterial membrane --- Certainty = 0.0000(Not Clear) < succ>
            bacterial outside --- Certainty = 0.0000(Not Clear) < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1245

A DNA sequence (GBSx1322) was identified in *S. agalactiae* <SEQ ID 3849> which encodes the amino acid sequence <SEQ ID 3850>. This protein is predicted to be CylI (fabF). Analysis of this protein sequence reveals the following:

```
Possible site: 24
>>> Seems to have an uncleavable N-term signal seq
```

```
                        -continued
    INTEGRAL      Likelihood = -2.39    Transmembrane     721-737  (721-738)
    INTEGRAL      Likelihood = -1.97    Transmembrane     326-342  (326-343)
    INTEGRAL      Likelihood = -0.43    Transmembrane     534-550  (534-550)

----- Final Results -----
            bacterial membrane --- Certainty = 0.1956(Affirmative) < succ>
            bacterial outside  --- Certainty = 0.0000(Not Clear)   < succ>
            bacterial cytoplasm --- Certainty = 0.0000(Not Clear)  < succ>
```

A related GBS nucleic acid sequence <SEQ ID 9687> which encodes amino acid sequence <SEQ ID 9688> was also identified.

There is also homology to SEQ ID 3852.

A related GBS gene <SEQ ID 8769> and protein <SEQ ID 8770> were also identified. Analysis of this protein sequence reveals the following:

```
Lipop: Possible site: -1 Crend: 8
McG: Discrim Score: 1.08
GvH: Signal Score (-7.5): -5.97
    Possible site: 24
>>> Seems to have an uncleavable N-term signal seq
ALOM program count: 3 value: -2.39 threshold: 0.0
    INTEGRAL      Likelihood = -2.39    Transmembrane     712-728  (712-729)
    INTEGRAL      Likelihood = -1.97    Transmembrane     317-333  (317-334)
    PERIPHERAL    Likelihood = 3.45     492
modified ALOM score: 0.98
*** Reasoning Step: 3

----- Final Results -----
            bacterial membrane --- Certainty = 0.1956(Affirmative) < succ>
            bacterial outside  --- Certainty = 0.0000(Not Clear)   < succ>
            bacterial cytoplasm --- Certainty = 0.0000(Not Clear)  < succ>
```

SEQ ID 8770 (GBS361) was expressed in *E. coli* as a His-fusion product. SDS-PAGE analysis of total cell extract is shown in FIG. 73 (lane 4; MW 84 kDa).

GBS361-His was purified as shown in FIG. 213, lane 5.

Based on this analysis, it was predicted that these proteins and their epitopes could be useful antigens for vaccines or diagnostics.

EXAMPLE 1246

A DNA sequence (GBSx1323) was identified in *S. agalactiae* <SEQ ID 3853> which encodes the amino acid sequence <SEQ ID 3854>. This protein is predicted to be CylF. Analysis of this protein sequence reveals the following:

```
Possible site: 44
>>> Seems to have no N-terminal signal sequence

----- Final Results -----
            bacterial cytoplasm --- Certainty = 0.3766(Affirmative) < succ>
            bacterial membrane  --- Certainty = 0.0000(Not Clear)   < succ>
            bacterial outside   --- Certainty = 0.0000(Not Clear)   < succ>
```

No corresponding DNA sequence was identified in *S. pyogenes*.

Based on this analysis, it was predicted that this protein and its epitopes, could be useful antigens for vaccines or diagnostics.

EXAMPLE 1247

A DNA sequence (GBSx1324) was identified in *S. agalactiae* <SEQ ID 3855> which encodes the amino acid sequence <SEQ ID 3856>. This protein is predicted to be CylE. Analysis of this protein sequence reveals the following:

```
Possible site: 23
>>> Seems to have no N-terminal signal sequence

----- Final Results -----
          bacterial cytoplasm --- Certainty = 0.3498(Affirmative) < succ>
            bacterial membrane --- Certainty = 0.0000(Not Clear) < succ>
             bacterial outside --- Certainty = 0.0000(Not Clear) < succ>
```

No corresponding DNA sequence was identified in S. pyogenes.

Based on this analysis, it was predicted that this protein and its epitopes, could be useful antigens for vaccines or diagnostics.

EXAMPLE 1248

A DNA sequence (GBSx1325) was identified in S. agalactiae <SEQ ID 3857> which encodes the amino acid sequence <SEQ ID 3858>. This protein is predicted to be ABC transporter homolog CylB. Analysis of this protein sequence reveals the following:

```
Possible site: 56
>>> Seems to have an uncleavable N-term signal seq
      INTEGRAL    Likelihood = -13.90    Transmembrane    271-287  (263-291)
      INTEGRAL    Likelihood = -10.30    Transmembrane     17-33   (14-43)
      INTEGRAL    Likelihood = -8.60     Transmembrane    114-130  (106-138)
      INTEGRAL    Likelihood = -6.69     Transmembrane    152-168  (149-178)
      INTEGRAL    Likelihood = -1.97     Transmembrane    186-202  (185-202)

----- Final Results -----
            bacterial membrane --- Certainty = 0.6562(Affirmative) < succ>
             bacterial outside --- Certainty = 0.0000(Not Clear) < succ>
          bacterial cytoplasm --- Certainty = 0.0000(Not Clear) < succ>
```

A related GBS nucleic acid sequence <SEQ ID 9685> which encodes amino acid sequence <SEQ ID 9686> was also identified.

No corresponding DNA sequence was identified in S. pyogenes.

Based on this analysis, it was predicted that this protein and its epitopes, could be useful antigens for vaccines or diagnostics.

EXAMPLE 1249

A DNA sequence (GBSx1326) was identified in S. agalactiae <SEQ ID 3859> which encodes the amino acid sequence <SEQ ID 3860>. This protein is predicted to be ABC transporter homolog CylA. Analysis of this protein sequence reveals the following:

```
Possible site: 57
>>> Seems to have no N-terminal signal sequence

----- Final Results -----
          bacterial cytoplasm --- Certainty = 0.4122(Affirmative) < succ>
            bacterial membrane --- Certainty = 0.0000(Not Clear) < succ>
             bacterial outside --- Certainty = 0.0000(Not Clear) < succ>
```

A related GBS nucleic acid sequence <SEQ ID 9683> which encodes amino acid sequence <SEQ ID 9684> was also identified. A further related GBS gene <SEQ ID 8771> and protein <SEQ ID 8772> were also identified. Analysis of this protein sequence reveals homology to membrane protein ABC transporters.

A further related DNA sequence was identified in S. pyogenes <SEQ ID 9085> which encodes the amino acid sequence <SEQ ID 9086>. An alignment of the GAS and GBS sequences follows:

```
Score = 85.4 bits (208), Expect = 1e-18
Identities = 68/271 (25%), Positives = 129/271 (47%), Gaps = 17/271 (6%)

Query:   39 KGFTEQHVLKDINFDVYKGDFFGIVGRNGSGKSTLLKIISQIYVPEKGQVT--VDGKMVS   96
            K +      L+DIN   +G F+G++G NG+GK+TL  ++ Q +   G +   VDGK +S
Sbjct:   10 KKYGSFEALRDINLIFEEGKFYGLLGPNGAGKTTLFNLLIQNFKQTSGDIKWEVDGKPLS   69

Query:   97 ----FIELGVGF-----NPELTGRENVYMNGAMLGFTKDEVDDMYNDIVDFAELHHFMNQ  147
              + +G+ F      + LT  EN+   GA+ G +K +V +   D+  + ++      Q
Sbjct:   70 IKDFYRHIGIVFQSNRLDDNLTVEENLISRGALYGLSKSQVRNRLKDLQTYLDITAIKKQ  129

Query:  148 KLKNYSSGMQVRLAFSVAIKAQGDVLILDEVLAVGDEAFQRKCNDYFME-RKDSGKTTIL  206
            K  + S G + ++   + A+  Q  +L+LDE      D   +R   D   +  S  T +L
Sbjct:  130 KYGSLSGGQKRKVDIARALLPQPSLLLLDEPTTGLDPQSRRDLWDAIAQLNQQSQMTVVL  189

Query:  207 VTHDMGAVKKYCNRAVLIEDGLVKAYGEPFDVANQYSVDNTETA-EDAMNAEKISVSDIA  265
            +TH +  +     C+   ++ +G +    G+        Q+S  N    +   + +++S++D
Sbjct:  190 ITHYLEEMSA-CDVLNVLIEGNIYYSGDIKSFIEQHSTTNLNVVLKPEKSLDQLSIADFV  248

Query:  266 KDLKVSLISNPRITPNDTITFEVSYEVLKDD                              296
            K  ++S   I   D I+ E    +V+ D+
Sbjct:  249 N--KCQVLSEREIVFKD-ISVEEMMQVISDN                              276
```

There is also homology to SEQ IDs 358, 482, 644, 686, 1832, 2429, 2720, 3882, 4028, 4104, 4280, 5090, 5498, 6034, 6500.

SEQ ID 8772 (GBS83) was expressed in *E. coli* as a His-fusion product. SDS-PAGE analysis of total cell extract is shown in FIG. 20 (lane 2; MW 37.6 kDa). It was also expressed in *E. coli* as a GST-fusion product. SDS-PAGE analysis of total cell extract is shown in FIG. 21 (lane 5; MW 62.6 kDa) and in FIG. 28 (lane 3; MW 62.6 kDa).

GBS83-GST was purified as shown in FIG. 195, lane 6.

Based on this analysis, it was predicted that these proteins and their epitopes could be useful antigens for vaccines or diagnostics.

EXAMPLE 1250

A DNA sequence (GBSx1327) was identified in *S. agalactiae* <SEQ ID 3861> which encodes the amino acid sequence <SEQ ID 3862>. This protein is predicted to be acyl carrier protein homolog AcpC. Analysis of this protein sequence reveals the following:

```
Possible site: 56
>>> Seems to have no N-terminal signal sequence

----- Final Results -----
            bacterial cytoplasm --- Certainty = 0.3451(Affirmative) < succ>
            bacterial membrane  --- Certainty = 0.0000(Not Clear)   < succ>
            bacterial outside   --- Certainty = 0.0000(Not Clear)   < succ>
```

No corresponding DNA sequence was identified in *S. pyogenes*.

Based on this analysis, it was predicted that this protein and its epitopes, could be useful antigens for vaccines or diagnostics.

EXAMPLE 1251

A DNA sequence (GBSx1328) was identified in *S. agalactiae* <SEQ ID 3863> which encodes the amino acid sequence <SEQ ID 3864>. This protein is predicted to be CylG (fabG). Analysis of this protein sequence reveals the following:

```
Possible site: 39
>>> Seems to have no N-terminal signal sequence

----- Final Results -----
            bacterial cytoplasm --- Certainty = 0.2651(Affirmative) < succ>
```

```
            bacterial membrane --- Certainty = 0.0000(Not Clear) < succ>
            bacterial outside  --- Certainty = 0.0000(Not Clear) < succ>
```

There is also homology to SEQ ID 3866.

Based on this analysis, it was predicted that this protein and its epitopes, could be useful antigens for vaccines or diagnostics.

EXAMPLE 1252

A DNA sequence (GBSx1329) was identified in *S. agalactiae* <SEQ ID 3867> which encodes the amino acid sequence <SEQ ID 3868>. This protein is predicted to be CylD. Analysis of this protein sequence reveals the following:

```
Possible site: 60
>>> Seems to have no N-terminal signal sequence

----- Final Results -----
            bacterial cytoplasm --- Certainty = 0.2030(Affirmative) < succ>
             bacterial membrane --- Certainty = 0.0000(Not Clear)   < succ>
              bacterial outside --- Certainty = 0.0000(Not Clear)   < succ>
```

No corresponding DNA sequence was identified in *S. pyogenes*.

Based on this analysis, it was predicted that this protein and its epitopes, could be useful antigens for vaccines or diagnostics.

EXAMPLE 1253

A DNA sequence (GBSx1330) was identified in *S. agalactiae* <SEQ ID 3869> which encodes the amino acid sequence <SEQ ID 3870>. Analysis of this protein sequence reveals the following:

```
Possible site: 14
>>> Seems to have no N-terminal signal sequence

----- Final Results -----
            bacterial cytoplasm --- Certainty = 0.3219(Affirmative) < succ>
             bacterial membrane --- Certainty = 0.0000(Not Clear)   < succ>
              bacterial outside --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1254

A DNA sequence (GBSx1331) was identified in *S. agalactiae* <SEQ ID 3871> which encodes the amino acid sequence <SEQ ID 3872>. Analysis of this protein sequence reveals the following:

```
Possible site: 56
>>> Seems to have no N-terminal signal sequence
      INTEGRAL     Likelihood = -8.97    Transmembrane    231-247 (226-251)
      INTEGRAL     Likelihood = -7.06    Transmembrane    141-157 (134-164)
      INTEGRAL     Likelihood = -2.76    Transmembrane     28-44  (26-44)
      INTEGRAL     Likelihood = -1.38    Transmembrane    123-139 (121-139)
      INTEGRAL     Likelihood = -0.32    Transmembrane    199-215 (199-215)
```

-continued

```
----- Final Results -----
              bacterial membrane --- Certainty = 0.4588(Affirmative) < succ>
              bacterial outside  --- Certainty = 0.0000(Not Clear)   < succ>
             bacterial cytoplasm --- Certainty = 0.0000(Not Clear)   < succ>
```

The protein has homology with the following sequences in the GENPEPT database.

```
>GP: CAB88836 GB: AL353832 putative integral membrane transport
protein. [Streptomyces coelicolor A3(2)]
Identities = 68/264 (25%), Positives = 123/264 (45%), Gaps = 10/264 (3%)

Query:    6 RMHFIFIKQYMKQIMEYKIDFFVGVLGVFLTQGLNLLFLNVLFQHIPSLEGWTFQQIAFI    65
            R + +    +++  M Y+  F +   G F    L+ + + ++F  + +L G++   ++AF+
Sbjct:   34 RAYGLIAGMWIRSTMAYRTSFALTAFGNFAMTALDFVAILLMFSRVDALGGYSLPEVAFL    93

Query:   66 YGFSLLPKGIDHLFFDNLWALGQRLIRKGEFDKYLTRPISPLFHVLVETFQVDALGELLV   125
            YG S +  G+  L    ++  LG+R +R G   D   L RP    L  V  + F +   LG ++
Sbjct:   94 YGLSGVSFGLADLAIGSMERLGRR-VRDGTLDTLLVRPAPVLAQVAADRFALRRLGRVVQ   152

Query:  126 GFILL--STTVSSISWTVPKVLLFIFIIPFATLIYTSLKIATSSIAFWTKQSGAVIYIF-   182
            G ++L  +  V  I WT  KVLL    +     I+ ++ +A  +  F  + +  V     F
Sbjct:  153 GLLVLGYALVVVDIDWTAAKVLLLPVALISGAGIFCAVFVAAGAFQFAAQDASEVANAFT   212

Query:  183 YMFNDFAKYPVAIYNNLLRWIISFVIPFAFTAYYPAAYFLQDRNVYFNIGGVI-----LI   237
            Y          +YP ++   L    +FV+P AF  + PA+Y L  R     ++ G +       L
Sbjct:  213 YGGTTMLQYPPTVFALDLVRGATFVLPLAFVNWLPASYVL-GRPYPLDLPGWVAFTPPLA   271

Query:  238 SLISFMVSLILWHKGVEVYESAGS                                       261
            +       ++ +  W  G+    Y S GS
Sbjct:  272 AAACCALAGLAWRAGLRSYRSTGS                                       295
```

A related DNA sequence was identified in *S. pyogenes* <SEQ ID 3873> which encodes the amino acid sequence <SEQ ID 3874>. Analysis of this protein sequence reveals the following:

```
Possible site: 49
>>> Seems to have no N-terminal signal sequence
      INTEGRAL    Likelihood = -8.86    Transmembrane  227-243 (225-251)
      INTEGRAL    Likelihood = -7.22    Transmembrane  141-157 (133-164)
      INTEGRAL    Likelihood = -6.37    Transmembrane  123-139 (114-140)
      INTEGRAL    Likelihood = -2.97    Transmembrane   26-42  (26-49)

----- Final Results -----
              bacterial membrane --- Certainty = 0.4545(Affirmative) < succ>
              bacterial outside  --- Certainty = 0.0000(Not Clear)   < succ>
             bacterial cytoplasm --- Certainty = 0.0000(Not Clear)   < succ>
```

The protein has homology with the following sequences in the databases:

```
>GP: CAB88836 GB: AL353832 putative integral membrane transport
protein. [Streptomyces coelicolor A3(2)]
Identities = 69/262 (26%), Positives = 125/262 (47%), Gaps = 10/262 (3%)

Query:    8 HAIFIKQYLKQIMEYKVDFVVGVLGVFLTQGLNLLFLSVLFQHIPSLEGWTFEQIAFIYG    67
            + +    +++  M Y+  F +   G F    L+ + + ++F  + +L G++   ++AF+YG
Sbjct:   36 YGLIAGMWIRSTMAYRTSFALTAFGNFAMTALDFVAILLMFSRVDALGGYSLPEVAFLYG    95

Query:   68 FCLIPKGIDHLFFDNLWALGQRLVRKGEFDKYLTRPISPLFHVLVETFQVDALGELLVGV   127
              +   G+  L    ++  LG+R VR G   D   L RP    L  V  + F +   LG ++ G+
Sbjct:   96 LSGVSFGLADLAIGSMERLGRR-VRDGTLDTLLVRPAPVLAQVAADRFALRRLGRVVQGL   154

Query:  128 ILL--VTTAGSIVWTLPKVLLFILVIPFATLIYTSLKIATASISFWTKQSGAVIYIF-YM   184
            ++L         I WT  KVLL  +      I+ ++ +A  +  F  + +  V     F Y
Sbjct:  155 LVLGYALVVVDIDWTAAKVLLLPVALISGAGIFCAVFVAAGAFQFAAQDASEVANAFTYG   214

Query:  185 FNDFSKYPMSIYHSFLRWLISFIIPFAFTAYYPASYFLTGQHLLFNIGGLV-----VVSL   239
                +YP +++      L    +F++P AF  + PASY L+G+       ++ G +       + +
Sbjct:  215 GTTMLQYPPTVFALDLVRGATFVLPLAFVNWLPASYVL-GRPYPLDLPGWVAFTPPLAAA   273
```

```
                                  -continued
Query: 240 LVLALSLKLWKWGLDAYESAGS                                    261
           AL+   W+ GL +Y S GS
Sbjct: 274 ACCALAGLAWRAGLRSYRSTGS                                    295
```

An alignment of the GAS and GBS proteins is shown below.

```
Identities = 208/261 (79%), Positives = 238/261 (90%)

Query:   1 MTKYQRMHFIFIKQYMKQIMEYKIDFFVGVLGVFLTQGLNLLFLNVLFQHIPSLEGWTFQ   60
           M K + MH IFIKQY+KQIMEYK+DF VGVLGVFLTQGLNLLFL+VLFQHIPSLEGWTF+
Sbjct:   1 MAKLRCMHAIFIKQYLKQIMEYKVDFVVGVLGVFLTQGLNLLFLSVLFQHIPSLEGWTFE   60

Query:  61 QIAFIYGFSLLPKGIDHLFFDNLWALGQRLIRKGEFDKYLTRPISPLFHVLVETFQVDAL  120
           QIAFIYGF L+PKGIDHLFFDNLWALGQRL+RKGEFDKYLTRPISPLFHVLVETFQVDAL
Sbjct:  61 QIAFIYGFCLIPKGIDHLFFDNLWALGQRLVRKGEFDKYLTRPISPLFHVLVETFQVDAL  120

Query: 121 GELLVGFILLSTTVSSISWTVPKVLLFIFIIPFATLIYTSLKIATSSIAFWTKQSGAVIY  180
           GELLVG ILL TT  SI WT+PKVLLFI +IPFATLIYTSLKIAT+SI+FWTKQSGAVIY
Sbjct: 121 GELLVGVILLVTTAGSIVWTLPKVLLFILVIPFATLIYTSLKIATASISFWTKQSGAVIY  180

Query: 181 IFYMFNDFAKYPVAIYNNLLRWIISFVIPFAFTAYYPAAYFLQDRNVYFNIGGVILISLI  240
           IFYMFNDF+KYP++IY++ LRW+ISF+IPFAFTAYYPA+YFL  +++ FNIGG++++SL+
Sbjct: 181 IFYMFNDFSKYPMSIYHSFLRWLISFIIPFAFTAYYPASYFLTGQHLLFNIGGLVVVSLL  240

Query: 241 SFMVSLILWHKGVEVYESAGS                                        261
           +SL LW  G++ YESAGS
Sbjct: 241 VLALSLKLWKWGLDAYESAGS                                        261
```

Based on this analysis, it was predicted that these proteins and their epitopes could be useful antigens for vaccines or diagnostics.

EXAMPLE 1255

A DNA sequence (GBSx1332) was identified in *S. agalactiae* <SEQ ID 3875> which encodes the amino acid sequence <SEQ ID 3876>. Analysis of this protein sequence reveals the following:

```
Possible site: 54
>>> Seems to have no N-terminal signal sequence
     INTEGRAL      Likelihood = -15.60    Transmembrane    147-163  (134-178)
     INTEGRAL      Likelihood =  -8.55    Transmembrane    119-135  (114-141)
     INTEGRAL      Likelihood =  -7.86    Transmembrane    238-254  (235-260)
     INTEGRAL      Likelihood =  -1.70    Transmembrane    215-231  (212-231)
     INTEGRAL      Likelihood =  -1.06    Transmembrane     61-77   (61-77)
     INTEGRAL      Likelihood =  -0.22    Transmembrane     27-43   (27-43)

----- Final Results -----
             bacterial membrane --- Certainty = 0.7241(Affirmative) < succ>
              bacterial outside --- Certainty = 0.0000(Not Clear)   < succ>
            bacterial cytoplasm --- Certainty = 0.0000(Not Clear)   < succ>
```

The protein has homology with the following sequences in the GENPEPT database.

```
>GP: CAB88837 GB: AL353832 putative integral membrane protein.
[Streptomyces coelicolor A3(2)]
Identities = 60/271 (22%), Positives = 118/271 (43%), Gaps = 13/271 (4%)

Query:   6 RRYKPFISTGIQGLITYRVDFILYRIGDVIGAFVAFYLWKAVFDSSSQSLIQGFQLSDMI   65
           R Y    + G +   TYR      + +   + Y +A++D    Q   + G+  +   +
Sbjct:   7 RLYVAVAAGGFRRYATYRAATAAGVFTNTVFGLILVYTYALWDEKPQ--LGGYDQAQAV   64

Query:  66 LYIIMS-FVTNLLTRTDSSFM--IGDEVKDGSIIMRLLRPVHFAASYLFMEIGSRWLIFL  122
           ++ +   +   L        F    + ++ G + + L RP      +L    ++G        L
Sbjct:  65 TFVWLGQALLAALAIGGGGFEDELMERIRTGDVAVDLYRPADLQLWWLAADVGRAVFQLL  124

Query: 123 SIGV-PFLLVITGVRLFLGTDLIQAIVLVVFYIISIILAFLINFFFNICFGFSAFVFKNL  181
             GV  PF+        LF     L + +     ++++++LA ++ F          SAF      +
Sbjct: 125 GRGVVPFVFG----SLFFPVALPREVSVWAAFLVAVVLAMVVGFALRYLVALSAFWLLDG  180
```

```
-continued
Query: 182 WGSNLLKNSLVAFMSGSLIPLTFFPKIVADILGFLPFSSLIYTPVMIIIGKYDGSQIVQA 241
            G  +      F SG L+PL  FP ++ D++  LP+SSL+  P  +++G+ D    +
Sbjct: 181 TGVTQMAWLAGLFCSGMLLPLNVFPGVLGDVVRALPWSSLLQGPADVLLGEADP---LGT 237

Query: 242 LLLQIFWLIVMVALSQLIWKKVQLHITIQGG                              272
            L Q  W + ++AL +L+        + +QGG
Sbjct: 238 YLFQASWAVALLALGRLVQSAATRRVVVQGG                              268
```

A related DNA sequence was identified in *S. pyogenes* <SEQ ID 3877> which encodes the amino acid sequence <SEQ ID 3878>. Analysis of this protein sequence reveals the following:

```
Possible site: 50
>>> Seems to have no N-terminal signal sequence
    INTEGRAL      Likelihood = -9.18    Transmembrane   252-268  (248-277)
    INTEGRAL      Likelihood = -7.22    Transmembrane   161-177  (151-187)
    INTEGRAL      Likelihood = -6.10    Transmembrane   133-149  (128-160)
    INTEGRAL      Likelihood = -2.81    Transmembrane   213-229  (211-230)

----- Final Results -----
            bacterial membrane --- Certainty = 0.4673(Affirmative) < succ>
             bacterial outside --- Certainty = 0.0000(Not Clear)  < succ>
           bacterial cytoplasm --- Certainty = 0.0000(Not Clear)  < succ>
```

The protein has homology with the following sequences in the databases:

```
>GP: AAF11144 GB: AE002002 conserved hypothetical protein [Deinococcus
radiodurans]
Identities = 56/268 (20%), Positives = 113/268 (41%), Gaps = 21/268 (7%)

Query:  15 MWSFWKRYRPFLSAGIQELITYRVNFFLYRIGDVMGAFVAYYLWKAVFDSSKQSLINGFT   74
           M +FW++ R   +  +  + YR    ++ +   +    V   +W     S+   ING+T
Sbjct:   1 MTNFWRKVRVLWAVSLASTLEYRAETIIWMLSGTLN-LVMMLVWMTQAKSAPGGQINGYT   59

Query:  75 LSDMTFYIIMSFVTTLLTKSDSSFMIGEEVKDGSIIMRLLRPV-----HFAASYLFMEIG  129
              Y + +++ +L     + +   +++ G++   LL P+           FAA       +
Sbjct:  60 PQAFAGYFLATWLVSQLLVVWVGWELDYKIRQGTLSPELLHPIDPLWREFAAH--LTDKA  117

Query: 130 FRWIVLMSVGFPPFLMVLSGIKVMAGLSILQVLASSCLYLVSLLLAFL---INFYFNICFG  186
           FR             P ++VL  + + A L+  Q  +      Y   L LA L   + F +      G
Sbjct: 118 FR--------LPIMLVL--LLIFAALTGAQFTSQWWAYPAVLGLALLGLCVRFLWEYTLG  167

Query: 187 SSAFVFKNLWGSNLLKNALVAFMSGSLIPLAFFPKMVSIVLSFLPFSSLVYTPVMIVIGK  246
              AF ++    +      A    G    PL+F+P    + + ++ PF ++    P  ++ GK
Sbjct: 168 LLAFWTESSSSFGEVLWLFYAAFGGMFAPLSFYPGWLQTLAAWTPFPYMLGLPAALLAGK  227

Query: 247 YSLSQIMVALSLQIFWLLVMVVLSQVIW                                 274
           S ++ +      + + WL VM ++ + +W
Sbjct: 228 ASGAEALRGAGVLLGWLAVMWLVRRWVW                                  255
```

An alignment of the GAS and GBS proteins is shown below.

```
Identities = 199/268 (74%), Positives = 236/268 (87%)

Query:   5 WRRYKPFISTGIQGLITYRVDFILYRIGDVIGAFVAFYLWKAVFDSSSQSLIQGFQLSDM   64
           W+RY+PF+S GIQ LITYRV+F LYRIGDV+GAFVA+YLWKAVFDSS QSLI GF LSDM
Sbjct:  19 WKRYRPFLSAGIQELITYRVNFFLYRIGDVMGAFVAYYLWKAVFDSSKQSLINGFTLSDM   78

Query:  65 ILYIIMSFVTNLLTRTDSSFMIGDEVKDGSIIMRLLRPVHFAASYLFMEIGSRWLIFLSI  124
              YIIMSFVT LLT++DSSFMIG+EVKDGSIIMRLLRPVHFAASYLFMEIG RW++ +S+
Sbjct:  79 TFYIIMSFVTTLLTKSDSSFMIGEEVKDGSIIMRLLRPVHFAASYLFMEIGFRWIVLMSV  138

Query: 125 GVPFLLVITGVRLFLGTDLIQAIVLVVFYIISIILAFLINFFFNICFGFSAFVFKNLWGS  184
           G  PFL+V++G+++   G +  +Q +      Y++S++LAFLINF+FNICFG SAFVFKNLWGS
Sbjct: 139 GFPPFLMVLSGIKVMAGLSILQVLASSCLYLVSLLLAFLINFYFNICFGSSAFVFKNLWGS  198

Query: 185 NLLKNSLVAFMSGSLIPLTFFPKIVADILGFLPFSSLIYTPVMIIIGKYDGSQIVQALLL  244
           NLLKN+LVAFMSGSLIPL FFPK+V+  +L FLPFSSL+YTPVMI+IGKY  SQI+ AL L
Sbjct: 199 NLLKNALVAFMSGSLIPLAFFPKMVSIVLSFLPFSSLVYTPVMIVIGKYSLSQIMVALSL  258
```

```
Query:  245 QIFWLIVMVALSQLIWKKVQLHITIQGG                                   272
            QIFWL+VMV LSQ+IWKKVQ H+TIQGG
Sbjct:  259 QIFWLLVMVVLSQVIWKKVQYHLTIQGG                                  286
```

Based on this analysis, it was predicted that these proteins and their epitopes could be useful antigens for vaccines or diagnostics.

EXAMPLE 1256

A DNA sequence (GBSx1333) was identified in *S. agalactiae* <SEQ ID 3879> which encodes the amino acid sequence <SEQ ID 3880>. This protein is predicted to be ABC transporter, ATP-binding protein. Analysis of this protein sequence reveals the following:

```
Possible site: 31
>>> Seems to have no N-terminal signal sequence

----- Final Results -----
            bacterial cytoplasm --- Certainty = 0.2013(Affirmative) < succ>
             bacterial membrane --- Certainty = 0.0000(Not Clear)   < succ>
              bacterial outside --- Certainty = 0.0000(Not Clear)   < succ>
```

A related GBS nucleic acid sequence <SEQ ID 9681> which encodes amino acid sequence <SEQ ID 9682> was also identified.

The protein has homology with the following sequences in the GENPEPT database.

```
>GP: AAF09790 GB: AE001882 ABC transporter, ATP-binding protein
[Deinococcus radiodurans]
Identities = 141/331 (42%), Positives = 201/331 (60%),
Gaps = 34/331 (10%)

Query:   10 MIEVSHLQKNFIKTVKAPGLKGAFQSFLRPEKHTFEAVKDLTFDVPKGQILGFIGANGAG    69
            MIEV HL K+F +                      AV+D++F +P G+I+G++G NGAG
Sbjct:   46 MIEVRHLCKSFARK--------------------PAVQDISFSIPAGEIVGYLGPNGAG    84

Query:   70 KSTTIKMLTGILKPTSGFCRIDGKLPQENRQNYVKDIGVVFGQRTQLWWDLALQETYTVL   129
            KSTTIK+LTG+L P SG  R+ G +P + R+ +V  +G VFGQRT LWWDL ++E+    +L
Sbjct:   85 KSTTIKVLTGLLVPDSGEVRVGGLVPWKQRRQHVARLGAVFGQRTTLWWDLPVRESLELL   144

Query:  130 KEIYDVPDKEFRKRMAFLNEVLELNDFIKDPVRTLSLGQRMRADIAASLLHNPKVLFLDE   189
            + +Y VP    F + +A    E+LEL   F+    P R LSLGQRMRAD+AA+LLH+P++LFLDE
Sbjct:  145 RHVYRVPAARFAENLAGFTELLELGPFLNTPARALSLGQRMRADLAAALLHDPELLFLDE   204

Query:  190 PTIGLDVSVKDNIRRAITQINQEEETTILLTTHDLSDIEQLCHRIFMIDRGQEIFDGTVS   249
            PT+GLDV   K+ IR +   +N E    T+LLTTHDL D+E+L  R+ MID G+ +FDG ++
Sbjct:  205 PTVGLDVVAKERIREFVKAVNAERGVTVLLTTHDLGDVERLARRVMMIDTGRLLFDGPLA   264

Query:  250 QLKETFGRMKTL--SFDLRPGQEHISS-SLIGKSEINIKRNDLVLDIQYDSSRYQTADII   306
            +L+ +G + L  F+  P Q +    +L+G+    ++           Y S    A I
Sbjct:  265 ELQARYGGERELWVEFEKAPAQPALPGLTLLGQDGPRVR---------YGFSGAAAAPIA   315

Query:  307 QQTLADFSVRDLKMTDADIEDIIRRFYRNEL                              337
             Q T A   VRDL + + ++E  IRR Y   L
Sbjct:  316 QVT-ALAPVRDLAVKEPEVEATIRRIYEGNL                              345
```

A related DNA sequence was identified in *S. pyogenes* <SEQ ID 3881> which encodes the amino acid sequence <SEQ ID 3882>. Analysis of this protein sequence reveals the following:

```
Possible site: 60
>>> Seems to have no N-terminal signal sequence

----- Final Results -----
            bacterial cytoplasm --- Certainty = 0.3315(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below.

```
Identities = 272/330 (82%), Positives = 305/330 (92%)

Query:    8 MSMIEVSHLQKNFIKTVKAPGLKGAFQSFLRPEKHTFEAVKDLTFDVPKGQILGFIGANG   67
            M MIEVSHLQKNF KT+K PGLKGA +SF+ P +  FEAVKDL+F+VPKGQILGFIGANG
Sbjct:    1 MVMIEVSHLQKNFSKTIKEPGLKGALKSFVHPPREIFEAVKDLSFEVPKGQILGFIGANG   60

Query:   68 AGKSTTIKMLTGILKPTSGFCRIDGKLPQENRQNYVKDIGVVFGQRTQLWWDLALQETYT  127
            AGKSTTIKMLTGILKPTSG+CRI+GK+PQ+NRQ YV+DIG VFGQRTQLWWDLALQETY
Sbjct:   61 AGKSTTIKMLTGILKPTSGYCRINGKIPQDNRQYYVRDIGAVFGQRTQLWWDLALQETYV  120

Query:  128 VLKEIYDVPDKEFRKRMAFLNEVLELNDFIKDPVRTLSLGQRMRADIAASLLHNPKVLFL  187
            VLKEIYDVP+K FRKRM FLNEVL+LN+FIKDPVRTLSLGQRMRADIAASLLHNPKVLFL
Sbjct:  121 VLKEIYDVPEKAFRKRMDFLNEVLDLNEFIKDPVRTLSLGQRMRADIAASLLHNPKVLFL  180

Query:  188 DEPTIGLDVSVKDNIRRAITQINQEEETTILLTTHDLSDIEQLCHRIFMIDRGQEIFDGT  247
            DEPTIGLDVSVKDNIRRAITQINQEEETTILLTTHDLSDIEQLC RI MID+GQEIFDGT
Sbjct:  181 DEPTIGLDVSVKDNIRRAITQINQEEETTILLTTHDLSDIEQLCDRIIMIDKGQEIFDGT  240

Query:  248 VSQLKETFGKMKTLSFDLRPGQEHISSSLIGKSEINIKRNDLVLDIQYDSSRYQTADIIQ  307
            V+QLK++FGKMK+LSF+L+PGQE + S  +G  +I ++R++L LDIQYDSSRYQTADIIQ
Sbjct:  241 VTQLKQSFGKMKSLSFELKPGQEQVVSQFMGLPDITVERHELSLDIQYDSSRYQTADIIQ  300

Query:  308 QTLADFSVRDLKMTDADIEDIIRRFYRNEL                               337
            +T+ADF+VRD+KMTD DIEDI+RRFYR EL
Sbjct:  301 KTMADFAVRDVKMTDVDIEDIVRRFYRKEL                               330
```

Based on this analysis, it was predicted that these proteins and their epitopes could be useful antigens for vaccines or diagnostics.

EXAMPLE 1257

A DNA sequence (GBSx1334) was identified in *S. agalactiae* <SEQ ID 3883> which encodes the amino acid sequence <SEQ ID 3884>. This protein is predicted to be Fmt. Analysis of this protein sequence reveals the following:

```
Possible site: 32
>>> Seems to have an uncleavable N-term signal seq
     INTEGRAL    Likelihood = -9.39    Transmembrane    21-37 (8-39)
     INTEGRAL    Likelihood = -7.75    Transmembrane    360-376 (359-381)

----- Final Results -----
             bacterial membrane --- Certainty = 0.4758(Affirmative) < succ>
              bacterial outside --- Certainty = 0.0000(Not Clear)   < succ>
            bacterial cytoplasm --- Certainty = 0.0000(Not Clear)   < succ>
```

A related GBS nucleic acid sequence <SEQ ID 8775> which encodes amino acid sequence <SEQ ID 8776> was also identified. Analysis of this protein sequence reveals the following:

```
Lipop: Possible site: -1 Crend: 10
McG: Discrim Score: 8.85
GvH: Signal Score (-7.5): -3.75
     Possible site: 25
>>> Seems to have an uncleavable N-term signal seq
ALOM program count: 2 value: -9.39 threshold: 0.0
    INTEGRAL       Likelihood = -9.39    Transmembrane    21-37 (8-39)
    INTEGRAL       Likelihood = -7.75    Transmembrane    353-369 (352-374)
    PERIPHERAL     Likelihood =  4.24    92
modified ALOM score: 2.38
*** Reasoning Step: 3

----- Final Results -----
             bacterial membrane --- Certainty = 0.4758(Affirmative) < succ>
              bacterial outside --- Certainty = 0.0000(Not Clear)   < succ>
            bacterial cytoplasm --- Certainty = 0.0000(Not Clear)   < succ>
```

The protein has homology with the following sequences in the GENPEPT database.

```
>GP: BAA24012 GB: AB009635 Fmt [Staphylococcus aureus]
Identities = 72/279 (25%), Positives = 125/279 (43%), Gaps = 25/279 (8%)

Query:  49 LHRFMRKNNVNGMMIVSDNTGKPITISHGINRGEVETDIEN--NKLFPMASLQKLMTGII  106
            + ++++ +  NG + + +N GK + +S G    + E  I+N  N +F + S QK  TG++
Sbjct:  79 IDKYLQSSLFNGSVAIYEN-GK-LKMSKGYGYQDFEKGIKNTPNTMFLIGSAQKFSTGLL  136

Query: 107 IQRLIDQDVLSEDDRLSQFFPQVKGSNSITIHQLLTHTSGLREKGVKVSPYLKNEREQLQ  166
            +++L ++  ++ +D +S++ P  K S  I +  L+ H SGL +   K S   KN  + ++
Sbjct: 137 LKQLEEEHKININDPVSKYLPWFKTSKPIPLKDLMLHQSGLYK--YKSSKDYKNLDQAVK  194

Query: 167 FCLKHYNFVNK-KSWYYSNINFSFLTGIATQVTGRTYAELVDDVIKNPLRLDDTQSYQSV  225
              K     K K  Y++ N+  L  +  +VTG++YAE    I +PL+L   T   Y
Sbjct: 195 AIQKRGIDPKKYKKHMYNDGNYLVLAKVIEEVTGKSYAENYYTKIGDPLKLQHTAFYD--  252

Query: 226 VNHDLVSPMRKNGKLNKINIF----NQVSTAYGAGDFFTTPLNFWVLMRSFSKGYFFPT-  280
                + K     N +         N +     YGAG+ + TP +    L+      +      F
Sbjct: 253 -EQPFKKYLAKGYAYNSTGLSFLRPNILDQYYGAGNLYMTPTDMGKLITQIQQYKLFSPK  311

Query: 281 -------DEYTKHQNDAISHYYGGLYMHGRIVNSNGTFF                      312
                   + TK  D    Y  G Y  +   NG FF
Sbjct: 312 ITNPLLHEFGTKQYPD---EYRYGFYAKPTLNRLNGGFF                      347
```

There is also homology to SEQ ID 3886.

A related GBS gene <SEQ ID 8773> and protein <SEQ ID 8774> were also identified. Analysis of this protein sequence reveals the following:

```
Lipop: Possible site: -1 Crend: 6
McG: Discrim Score: 14.89
GvH: Signal Score (-7.5): -3.75
     Possible site: 25
>>> Seems to have an uncleavable N-term signal seq
ALOM program count: 1 value: -9.39 threshold: 0.0
     INTEGRAL      Likelihood = -9.39    Transmembrane     14-30 (1-32)
     PERIPHERAL    Likelihood = 4.24     85
modified ALOM score: 2.38
*** Reasoning Step: 3

----- Final Results -----
            bacterial membrane  --- Certainty = 0.4758(Affirmative) < succ>
            bacterial outside   --- Certainty = 0.0000(Not Clear)   < succ>
            bacterial cytoplasm --- Certainty = 0.0000(Not Clear)   < succ>
```

The protein has homology with the following sequences in the databases:

```
29.6/49.6% over 218aa
Bacillus cereus
GP|4127525|D-stereospecific peptide hydrolase Insert characterized ORF00162(478-1083 of 1644)
GP|4127525|emb|CAA09676.1||AJ011526(67-285 of 389) D-stereospecific peptide
hydrolase {Bacillus cereus}
% Match = 5.8
% Identity = 29.5   % Similarity = 49.5
Matches = 62   Mismatches = 96   Conservative Sub.s = 42

330        360        390        420        450        480        510        540
MILRRLFMVRKFLKSLLSLFLIAVIATGISVACFFFIPENKGNITPILLHRFMRKNNVNGMMIVSDNTGKPITISHGINR
:::          :         |    ||    :|:   :       :          |       |::   :    ||    :  ||
TCASLALLIAGSSLLYTTPTSIVKAEPTQNVSSSLQTNTQRDRTSVKQAMRDTLQLGYPGILAKTSEGGKTWGYAAGIAD
           20         30         40         50         60         70         80

570        600        630        660                   705        735        753
GEVETDIENNKLFPMASLQKLMTGIIIQRLIDQDVLSEDDRLSQFFPQV---KG--SNSITIHQLLTHTSGL----REKG
 :  ::    |  : |:  |  :|: :: |      |||   | |   |            ||  :| ||||:         ||
LRTKKPMKTDFRFRIGSVTKTFTATVVLQLVGENRLKLDDHIEDWLPGVIQGNGYDGNKITIQEILNHTSGIAEYSRSKD
          100        110        120        130        140        150        160

807        834        864        894        924        954        978
VKVSPYLKN--EREQLQFCLKHY-NFVNKKSWYYSNINFSFLTGIATQVTGRTYAELVDDVIKNPLRLDDT--QSYQSVV
 |  :    |:    |  | ::       :|    | ||| |     |||  :|||     || :  | | :|  ||||:          ||
VDFTDTKKSYTAEELVKMGISFPPDFAPGKGWSYSNTGYVLLGILIEKVTGNSYAEEVENRIIEPLELSNTFLPGNSSVI
          180        190        200        210        220        230        240
```

```
993        1023       1053       1083       1113       1143       1173       1203
---NH--DLVSPMRKNGKLNKINIFNQVSTAYGAGDFFTTPLNFWVLMRSFSKGYFFPTDEYTKHQNDAISHYYGGLYMH
   ||  ||   :   :|    |   |||   :|   ::   :    :  |::     :          :  |
PGTNHARGYVQP-DGASELKDVTYYN-PSAGSSAGDMISTADDLNKFFSYLLGGKLLKEQQLKQMLTTVPTGKEGIDGYG
            260       270       280       290       300       310       320
```

SEQ ID 8776 (GBS61) was expressed in *E. coli* as a GST-fusion product. SDS-PAGE analysis of total cell extract is shown in FIG. 33 (lane 3; MW 68 kDa); GBS61-GST was purified as shown in FIG. 195, lane 5.

Based on this analysis, it was predicted that these proteins and their epitopes could be useful antigens for vaccines or diagnostics.

EXAMPLE 1258

A DNA sequence (GBSx1335) was identified in *S. agalactiae* <SEQ ID 3887> which encodes the amino acid sequence <SEQ ID 3888>. Analysis of this protein sequence reveals the following:

```
Possible site: 32
>>> Seems to have no N-terminal signal sequence

----- Final Results -----
            bacterial cytoplasm --- Certainty = 0.2398(Affirmative) < succ>
            bacterial membrane  --- Certainty = 0.0000(Not Clear)   < succ>
            bacterial outside   --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1259

A DNA sequence (GBSx1336) was identified in *S. agalactiae* <SEQ ID 3889> which encodes the amino acid sequence <SEQ ID 3890>. Analysis of this protein sequence reveals the following:

```
Possible site: 28
>>> Seems to have an uncleavable N-term signal seq
    INTEGRAL    Likelihood = -5.57    Transmembrane    16-32 (13-33)

----- Final Results -----
            bacterial membrane  --- Certainty = 0.3230(Affirmative) < succ>
            bacterial outside   --- Certainty = 0.0000(Not Clear)   < succ>
            bacterial cytoplasm --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1260

A DNA sequence (GBSx1337) was identified in *S. agalactiae* <SEQ ID 3891> which encodes the amino acid sequence <SEQ ID 3892>. Analysis of this protein sequence reveals the following:

```
Possible site: 14
>>> Seems to have no N-terminal signal sequence

----- Final Results -----
            bacterial cytoplasm --- Certainty = 0.3910(Affirmative) < succ>
             bacterial membrane --- Certainty = 0.0000(Not Clear)   < succ>
              bacterial outside --- Certainty = 0.0000(Not Clear)   < succ>
```

The protein has no significant homology with any sequences in the GENPEPT database.

No corresponding DNA sequence was identified in S. pyogenes.

Based on this analysis, it was predicted that this protein and its epitopes, could be useful antigens for vaccines or diagnostics.

EXAMPLE 1261

A DNA sequence (GBSx1338) was identified in S. agalactiae <SEQ ID 3893> which encodes the amino acid sequence <SEQ ID 3894>. Analysis of this protein sequence reveals the following:

```
Possible site: 37
>>> Seems to have no N-terminal signal sequence

----- Final Results -----
            bacterial cytoplasm --- Certainty = 0.4239(Affirmative) < succ>
             bacterial membrane --- Certainty = 0.0000(Not Clear)   < succ>
              bacterial outside --- Certainty = 0.0000(Not Clear)   < succ>
```

The protein has no significant homology with any sequences in the GENPEPT database.

No corresponding DNA sequence was identified in S. pyogenes.

Based on this analysis, it was predicted that this protein and its epitopes, could be useful antigens for vaccines or diagnostics.

EXAMPLE 1262

A DNA sequence (GBSx1339) was identified in S. agalactiae <SEQ ID 3895> which encodes the amino acid sequence <SEQ ID 3896>. Analysis of this protein sequence reveals the following:

```
Possible site: 32
>>> Seems to have no N-terminal signal sequence

----- Final Results -----
            bacterial cytoplasm --- Certainty = 0.4349(Affirmative) < succ>
             bacterial membrane --- Certainty = 0.0000(Not Clear)   < succ>
              bacterial outside --- Certainty = 0.0000(Not Clear)   < succ>
```

The protein has no significant homology with any sequences in the GENPEPT database.

No corresponding DNA sequence was identified in S. pyogenes.

Based on this analysis, it was predicted that this protein and its epitopes, could be useful antigens for vaccines or diagnostics.

EXAMPLE 1263

A DNA sequence (GBSx1340) was identified in S. agalactiae <SEQ ID 3897> which encodes the amino acid sequence <SEQ ID 3898>. Analysis of this protein sequence reveals the following:

```
Possible site: 16
>>> Seems to have no N-terminal signal sequence

----- Final Results -----
            bacterial cytoplasm --- Certainty = 0.4962(Affirmative) < succ>
             bacterial membrane --- Certainty = 0.0000(Not Clear)  < succ>
              bacterial outside --- Certainty = 0.0000(Not Clear)  < succ>
```

The protein has no significant homology with any sequences in the GENPEPT database.

No corresponding DNA sequence was identified in S. pyogenes.

Based on this analysis, it was predicted that this protein and its epitopes, could be useful antigens for vaccines or diagnostics.

EXAMPLE 1264

A DNA sequence (GBSx1341) was identified in S. agalactiae <SEQ ID 3899> which encodes the amino acid sequence <SEQ ID 3900>. Analysis of this protein sequence reveals the following:

```
Possible site: 29
>>> Seems to have no N-terminal signal sequence

----- Final Results -----
            bacterial cytoplasm --- Certainty = 0.4014(Affirmative) < succ>
             bacterial membrane --- Certainty = 0.0000(Not Clear)  < succ>
              bacterial outside --- Certainty = 0.0000(Not Clear)  < succ>
```

The protein has homology with the following sequences in the GENPEPT database.

```
>GP: AAG38044 GB: AF295925 Orf28 [Streptococcus
pneumoniae]
Identities = 23/35 (65%), Positives = 28/35 (79%)

Query:   9 LIHWEGNSGDKLIEHQTSATGWYYQVDRSFSQPKG    43
           L +WEGNSGDKL+E QT AT WYYQ+++ FSQ  G
Sbjct: 180 LTYWEGNSGDKLLERQTRATEWYYQIEKGFSQTNG   214
```

No corresponding DNA sequence was identified in S. pyogenes.

Based on this analysis, it was predicted that this protein and its epitopes, could be useful antigens for vaccines or diagnostics.

EXAMPLE 1265

A DNA sequence (GBSx1342) was identified in S. agalactiae <SEQ ID 3901> which encodes the amino acid sequence <SEQ ID 3902>. Analysis of this protein sequence reveals the following:

```
Possible site: 26
>>> Seems to have no N-terminal signal sequence

----- Final Results -----
            bacterial cytoplasm --- Certainty = 0.2036(Affirmative) < succ>
             bacterial membrane --- Certainty = 0.0000(Not Clear)  < succ>
              bacterial outside --- Certainty = 0.0000(Not Clear)  < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1266

A DNA sequence (GBSx1343) was identified in *S. agalactiae* <SEQ ID 3903> which encodes the amino acid sequence <SEQ ID 3904>. Analysis of this protein sequence reveals the following:

```
Possible site: 47
>>> Seems to have a cleavable N-term signal seq.

----- Final Results -----
            bacterial outside --- Certainty = 0.3000(Affirmative) < succ>
           bacterial membrane --- Certainty = 0.0000(Not Clear)   < succ>
          bacterial cytoplasm --- Certainty = 0.0000(Not Clear)   < succ>
```

A related GBS nucleic acid sequence <SEQ ID 10933> which encodes amino acid sequence <SEQ ID 10934> was also identified.

Figure 25:
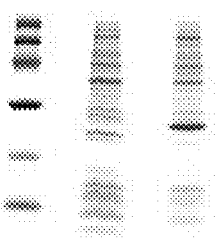

SEQ ID 3904 (GBS153) was expressed in *E. coli* as a His-fusion product. SDS-PAGE analysis of total cell extract is shown in FIG. 25 (lane 3; MW 22 kDa). It was also expressed in *E. coli* as a GST-fusion product. SDS-PAGE analysis of total cell extract is shown in FIG. 31 (lane 4; MW 47 kDa).

GBS153-GST was purified as shown in FIG. 198, lane 4.

Based on this analysis, it was predicted that these proteins and their epitopes could be useful antigens for vaccines or diagnostics.

EXAMPLE 1267

A DNA sequence (GBSx1344) was identified in *S. agalactiae* <SEQ ID 3905> which encodes the amino acid sequence <SEQ ID 3906>. Analysis of this protein sequence reveals the following:

```
Possible site: 13
>>> Seems to have no N-terminal signal sequence

----- Final Results -----
          bacterial cytoplasm --- Certainty = 0.2036(Affirmative) < succ>
           bacterial membrane --- Certainty = 0.0000(Not Clear)   < succ>
            bacterial outside --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1268

A DNA sequence (GBSx1345) was identified in *S. agalactiae* <SEQ ID 3907> which encodes the amino acid sequence <SEQ ID 3908>. Analysis of this protein sequence reveals the following:

```
Possible site: 19
>>> Seems to have no N-terminal signal sequence

----- Final Results -----
             bacterial cytoplasm --- Certainty = 0.2570(Affirmative) < succ>
              bacterial membrane --- Certainty = 0.0000(Not Clear)   < succ>
                bacterial outside --- Certainty = 0.0000(Not Clear)   < succ>
```

The protein has homology with the following sequences in the GENPEPT database.

```
>GP: CAA59773 GB: X85787 tasA [Streptococcus pneu-
moniae]
Identities = 18/33 (54%), Positives = 28/33 (84%)

Query:    2 DVQSDENFAFKIFKVAKAKGLSLDVFDKLVGRF    34
            + QSD+N  F++FKV+K KG++LD FD+++GRF
Sbjct:  320 EYQSDKNPFFEVFKVSKTKGIALDPFDEIIGRF   352
```

A related DNA sequence was identified in *S. pyogenes* <SEQ ID 3909> which encodes the amino acid sequence <SEQ ID 3910>. Analysis of this protein sequence reveals the following:

```
Possible site: 56
>>> Seems to have no N-terminal signal sequence
----- Final Results -----
             bacterial cytoplasm --- Certainty = 0.2405(Affirmative) < succ>
              bacterial membrane --- Certainty = 0.0000(Not Clear)   < succ>
                bacterial outside --- Certainty = 0.0000(Not Clear)   < succ>
```

An alignment of the GAS and GBS proteins is shown below.

```
Identities = 18/34 (52%), Positives = 25/34 (72%)

Query:    1 MDVQSDENFAFKIFKVAKAKGLSLDVFDKLVGRF    34
            +DVQSDE+F FK+ KV K+KG+ L+  D+ V  F
Sbjct:   31 LDVQSDEDFGFKVVKVLKSKGIVLNALDESVCGF   64
```

Based on this analysis, it was predicted that these proteins and their epitopes could be useful antigens for vaccines or diagnostics.

EXAMPLE 1269

A DNA sequence (GBSx1346) was identified in *S. agalactiae* <SEQ ID 3911> which encodes the amino acid sequence <SEQ ID 3912>. This protein is predicted to be a fimbria-associated protein. Analysis of this protein sequence reveals the following:

```
Possible site: 52
>>> Seems to have no N-terminal signal sequence
     INTEGRAL     Likelihood = -1.17    Transmembrane   169-185 (168-185)

----- Final Results -----
              bacterial membrane --- Certainty = 0.1468(Affirmative) < succ>
                bacterial outside --- Certainty = 0.0000(Not Clear)   < succ>
             bacterial cytoplasm --- Certainty = 0.0000(Not Clear)   < succ>
```

The protein has homology with the following sequences in the GENPEPT database.

```
>GP: AAC13546 GB: AF019629 putative fimbria-associated protein
[Actinomyces naeslundii]
Identities = 53/109 (48%), Positives = 75/109 (68%)

Query:  13 IPKINQDLPIYAGSEEDNLQRGVGHLEGISLPIGGASTHAVLSGQRGMPAARLFADLDKM   72
           IP I+ DLP+Y G+ +D L +G+GHLEG SLP+GG  T +V++G RG+  A +F +LDK+
Sbjct:  93 IPSISLDLPVYHGTADDTLLKGLGHLEGTSLPVGGEGTRSVITGHRGLAEATMFTNLDKV  152

Query:  73 KKGDYFYVTNLKETLAYQVDRIMVIEPSQLDAVSIEEDKDYVTLLTCTP            121
           K GD   V    E L Y+V    V+EP + +A+ +EE KD +TL+TCTP
Sbjct: 153 KTGDSLIVEVFGEVLTYRVTSTKVVEPEETEALRVEEGKDLLTLVTCTP            201
```

There is also homology to SEQ ID 3740 and to SEQ ID 3910.

Figure 177:
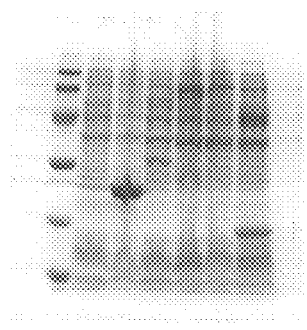

SEQ ID 3912 (GBS194) was expressed in *E. coli* as a His-fusion product. SDS-PAGE analysis of total cell extract is shown in FIG. 177 (lane 2; MW 24 kDa).

Based on this analysis, it was predicted that this protein and its epitopes, could be useful antigens for vaccines or diagnostics.

EXAMPLE 1270

A DNA sequence (GBSx1347) was identified in *S. agalactiae* <SEQ ID 3913> which encodes the amino acid sequence <SEQ ID 3914>. Analysis of this protein sequence reveals the following:

```
Possible site: 42
>>> Seems to have no N-terminal signal sequence
    INTEGRAL    Likelihood = -5.15    Transmembrane    880-896 (876-898)
    INTEGRAL    Likelihood = -4.78    Transmembrane     24-40 (23-42)

----- Final Results -----
              bacterial membrane --- Certainty = 0.3060(Affirmative) < succ>
               bacterial outside --- Certainty = 0.0000(Not Clear)   < succ>
             bacterial cytoplasm --- Certainty = 0.0000(Not Clear)   < succ>
```

A related GBS nucleic acid sequence <SEQ ID 8777> which encodes amino acid sequence <SEQ ID 8778> was also identified. Analysis of this protein sequence reveals the following:

```
Lipop: Possible site: -1 Crend: 8
SRCFLG: 0
McG: Length of UR: 20
     Peak Value of UR: 2.80
     Net Charge of CR: 5
McG: Discrim Score: 10.81
GvH: Signal Score (-7.5): -3.76
     Possible site: 29
>>> Seems to have an uncleavable N-term signal seq
Amino Acid Composition: calculated from 1
ALOM program count: 2 value: -5.15 threshold: 0.0
     INTEGRAL     Likelihood = -5.15    Transmembrane    867-883 (863-885)
     INTEGRAL     Likelihood = -4.78    Transmembrane     11-27 (10-29)
     PERIPHERAL   Likelihood = 7.58     531
modified ALOM score: 1.53
icm1 HYPID: 7 CFP: 0.306
*** Reasoning Step: 3

----- Final Results -----
              bacterial membrane --- Certainty = 0.3060(Affirmative) < succ>
               bacterial outside --- Certainty = 0.0000(Not Clear)   < succ>
             bacterial cytoplasm --- Certainty = 0.0000(Not Clear)   < succ>

LPXTG motif: 859-863
```

No corresponding DNA sequence was identified in *S. pyogenes*.

SEQ ID 8778 (GBS104) was expressed in *E. coli* as a His-fusion product. SDS-PAGE analysis of total cell extract is shown in FIG. 27 (lane 5; MW 95 kDa).

GBS104-His was purified as shown in FIG. 221, lane 9-10.

Based on this analysis, it was predicted that this protein and its epitopes, could be useful antigens for vaccines or diagnostics.

EXAMPLE 1271

A DNA sequence (GBSx1348) was identified in *S. agalactiae* <SEQ ID 3915> which encodes the amino acid sequence <SEQ ID 3916>. This protein is predicted to be a fimbria-associated protein. Analysis of this protein sequence reveals the following:

```
Possible site: 40
>>> Seems to have an uncleavable N-term signal seq
    INTEGRAL    Likelihood = -15.28    Transmembrane    257-273 (252-280)
    INTEGRAL    Likelihood =  -7.11    Transmembrane     19-35 (16-39)

----- Final Results -----
            bacterial membrane --- Certainty = 0.7114(Affirmative) < succ>
             bacterial outside --- Certainty = 0.0000(Not Clear)   < succ>
           bacterial cytoplasm --- Certainty = 0.0000(Not Clear)   < succ>
```

The protein has homology with the following sequences in the GENPEPT database.

```
>GP: AAC13546 GB: AF019629 putative fimbria-associated protein
[Actinomyces naeslundii]
Identities = 79/178 (44%), Positives = 112/178 (62%), Gaps = 7/178 (3%)

Query:   65 RIALANAYNETLSRNPLL-----IDPFTSKQKEGLREYARMLEVHEQ--IGHVAIPSIGV  117
             ++  A+AYN+ LS   +L    +        K+  +YA +L+ + +   +  + IPSI +
Sbjct:   39 QVEQAHAYNDALSAGAVLEANNHVPTGAGSSKDSSLQYANILKANNEGLMARLKIPSISL   98

Query:  118 DIPIYAGTSETVLQKGSGHLEGTSLPVGGLSTHSVLTAHRGLPTARLFTDLNKVKKGQIF  177
             D+P+Y GT++  L KG GHLEGTSLPVGG   T SV+T HRGL   A +FT+L+KVK G
Sbjct:   99 DLPVYHGTADDTLLKGLGHLEGTSLPVGGEGTRSVITGHRGLAEATMFTNLDKVKTGDSL  158

Query:  178 YVTNIKETLAYKVVSIKVVDPTALSEVKIVNGKDYITLLTCTPYMINSHRLLVKGERI    235
                V    E L Y+V S KVV+P     +++  GKD +TL+TCTP  IN+HR+L+ GERI
Sbjct:  159 IVEVFGEVLTYRVTSTKVVEPEETEALRVEEGKDLLTLVTCTPLGINTHRILLTGERI    216
```

There is also homology to SEQ ID 3740.

SEQ ID 3916 (GBS208) was expressed in *E. coli* as a His-fusion product. SDS-PAGE analysis of total cell extract is shown in FIG. 44 (lane 5; MW 35 kDa). It was also expressed in *E. coli* as a GST-fusion product. SDS-PAGE analysis of total cell extract is shown in FIG. 85 (lane 8; MW 59.7 kDa) and in FIG. 160 (lane 5; MW 60 kDa).

GBS208-GST was purified as shown in FIG. 224, lane 7-8.

Based on this analysis, it was predicted that this protein and its epitopes, could be useful antigens for vaccines or diagnostics.

EXAMPLE 1272

A DNA sequence (GBSx1349) was identified in *S. agalactiae* <SEQ ID 3917> which encodes the amino acid sequence <SEQ ID 3918>. This protein is predicted to be a fimbria-associated protein. Analysis of this protein sequence reveals the following:

```
Possible site: 30
>>> Seems to have a cleavable N-term signal seq.
    INTEGRAL     Likelihood = -9.13    Transmembrane    265-281 (260-284)

----- Final Results -----
             bacterial membrane --- Certainty = 0.4652(Affirmative) < succ>
              bacterial outside --- Certainty = 0.0000(Not Clear)   < succ>
            bacterial cytoplasm --- Certainty = 0.0000(Not Clear)   < succ>
```

The protein has homology with the following sequences in the GENPEPT database.

```
>GP: AAC13546 GB: AF019629 putative fimbria-associated protein
[Actinomyces naeslundii]
Identities = 96/265 (36%), Positives = 150/265 (56%), Gaps = 10/265 (3%)

Query:  41 QASHANINAFKEAVTKIDRVEINRRLELAYAYNASI-AGAKTNGEYPALKDPYSAEQKQA    99
           Q + + + A     A      R +   ++E A+AYN ++ AGA           P  A  +
Sbjct:  15 QYNQSKVTADYSAQVDGARPDAKTQVEQAHAYNDALSAGAVLEANNHV---PTGAGSSKD   71

Query: 100 GVVEYARMLEVKEQ--IGHVIIPRINQDIPIYAGSAEENLQRGVGHLEGTSLPVGGESTH   157
           ++YA +L+   +   +  + IP I+ D+P+Y G+A++ L +G+GHLEGTSLPVGGE T
Sbjct:  72 SSLQYANILKANNEGLMARLKIPSISLDLPVYHGTADDTLLKGLGHLEGTSLPVGGEGTR   131

Query: 158 AVLTAHRGLPTAKLFTNLDKVTVGDRFYIEHIGGKIAYQVDQIKVIAPDQLEDLYVIQGE   217
           +V+T HRGL  A +FTNLDKV   GD    +E  G  + Y+V    KV+ P++ E L V +G+
Sbjct: 132 SVITGHRGLAEATMFTNLDKVKTGDSLIVEVFGEVLTYRVTSTKVVEPEETEALRVEEGK   191

Query: 218 DHVTLLTCTPYMINSHRLLVRGKRI-PYVEKTVQKDSKTFRQQQYLTYAMWVVVGLILLS   276
           D +TL+TCTP  IN+HR+L+ G+RI P    K +      K     +  +A+ +  GLI++
Sbjct: 192 DLLTLVTCTPLGINTHRILLTGERIYPTPAKDLAAAGKRPDVPHFPWWAVGLAAGLIVVG   251

Query: 277 LLIW---FKKTKQKKRRKNEKAASQ                                      298
           L +W  +    + K+R       A+Q
Sbjct: 252 LYLWRSGYAAARAKERALARARAAQ                                      276
```

There is also homology to SEQ ID 3740.

SEQ ID 3918 (GBS209) was expressed in *E. coli* as a GST-fusion product. SDS-PAGE analysis of total cell extract is shown in FIG. 50 (lane 4; MW 62 kDa). It was also expressed in *E. coli* as a His-fusion product. SDS-PAGE analysis of total cell extract is shown in FIG. 85 (lane 3; MW 37.2 kDa).

GBS209-His was purified as shown in FIG. 221, lane 8.

Based on this analysis, it was predicted that this protein and its epitopes, could be useful antigens for vaccines or diagnostics.

EXAMPLE 1273

A DNA sequence (GBSx1350) was identified in *S. agalactiae* <SEQ ID 3919> which encodes the amino acid sequence <SEQ ID 3920>. Analysis of this protein sequence reveals the following:

```
Possible site: 27
>>> Seems to have a cleavable N-term signal seq.
    INTEGRAL     Likelihood = -9.66    Transmembrane    281-297 (276-300)

----- Final Results -----
             bacterial membrane --- Certainty = 0.4864(Affirmative) < succ>
              bacterial outside --- Certainty = 0.0000(Not Clear)   < succ>
            bacterial cytoplasm --- Certainty = 0.0000(Not Clear)   < succ>
```

The protein has homology with the following sequences in the GENPEPT database.

```
>GP: BAB04080 GB: AP001508 unknown [Bacillus halodurans]
Identities = 45/241 (31%), Positives = 63/141 (43%), Gaps = 20/141 (14%)
```

-continued

```
Query:    153 TGELDLLKVGVDGDTKKPLAGVVFELYEKNGRTPIRVKNGVHSQDIDAAKHLETDSSGHI  212
              TG L++ KV  D DT + L G  F LY+  G    IR                LET  G
Sbjct:   1084 TGSLEVTKV--DADTGEVLQGATFTLYDSEGEFAIRT--------------LETGEDKA  1127

Query:    213 RISGLIHGDYVLKEIETQSGYQIGQAETAVTIEKSKTVTVTIENKKVPTPKVPSRGGL-I  271
              L++GDY+LKE       GY +G  +T     +    VT+EN+K    +V + G + +
Sbjct:   1128 TFVNLLYGDYLLKEDSAPEGYLVGINDTQRVTIDTVLHEVTVENEKSDINRVSAVGAVQL  1187

Query:    272 PKTGEQQAMALVIIGGILIAL                                        292
                 K   E+   +L    G L AL
Sbjct:   1188 QKVDEETGESL---QGALFAL                                       1205

Identities = 64/259 (24%), Positives = 113/259 (42%), Gaps = 48/259 (18%)

Query:     16 GTMFGISQT---VLAQETHQLTIVHLEARDIDRPNP----QLEIAPKE-GTPIEGVLYQL   67
              G + GI+ T    +    H++T+ + E  DI+R +       QL+    +E G  ++G L+ L
Sbjct:   1147 GYLVGINDTQRVTIDTVLHEVTVEN-EKSDINRVSAVGAVQLQKVDEETGESLQGALFAL  1205

Query:     68 YQLKSTEDGDLLAHWNSLTITELKKQAQQVFEATTNQQGKATFNQLPDGIYYGL----AV  123
                Q    E           +TI E++    + +  A + + G    F +L   + Y L      V
Sbjct:   1206 QQKVDDE---------FVTIAEMETDEEGIVFAGSLEPGDYQFVELNAPVGYKLDETPVV  1256

Query:    124 KAGEKNRNVSAFLVDLSEDKVIYPKIIWSTGELDLLKVGVDGDTKKPLAGVVFELYEKNG  183
                   E++R    +    ++L ++  + P      G + L+KV D D     LG   F L +  G
Sbjct:   1257 FTVEEDRTET---IELQKENHLIP------GSVQLVKVDAD-DAANTLEGAEFTLLDGEG  1306

Query:    184 RTPIRVKNGVHSQDIDAAKHLETDSSGHIRISGLIHGDYVLKEIETQSGYQIGQAETAVT  243
                  V+ G               L TD +G + ++ L  G+Y  E +   +GY++        T
Sbjct:   1307 NV---VQEG----------LTTDENGQVVVTDLKPGEYQFVETKAPAGYELEATPIGFT  1352

Query:    244 IEKS--KTVTVTIENKKVP                                          260
              IE++  +  TV +EN  +P
Sbjct:   1353 IERNQQEVATVAVENHLIP                                         1371
```

No corresponding DNA sequence was identified in *S. pyogenes*.

SEQ ID 3920 (GBS52) was expressed in *E. coli* as a His-fusion product. SDS-PAGE analysis of total cell extract is shown in FIG. 7 (lane 4; MW 30.5 kDa).

GBS52-His was purified as shown in FIG. 192, lane 8.

Based on this analysis, it was predicted that this protein and its epitopes, could be useful antigens for vaccines or diagnostics.

EXAMPLE 1274

A DNA sequence (GBSx1351) was identified in *S. agalactiae* <SEQ ID 3921> which encodes the amino acid sequence <SEQ ID 3922>. Analysis of this protein sequence reveals the following:

```
Possible site: 46
>>> Seems to have no N-terminal signal sequence
    INTEGRAL     Likelihood = -6.26     Transmembrane   554-570  (551-575)
    INTEGRAL     Likelihood = -0.16     Transmembrane    34-50   (34-50)

----- Final Results -----
            bacterial membrane --- Certainty = 0.3506(Affirmative) < succ>
            bacterial outside  --- Certainty = 0.0000(Not Clear)   < succ>
            bacterial cytoplasm --- Certainty = 0.0000(Not Clear)  < succ>
```

A related GBS nucleic acid sequence <SEQ ID 8779> which encodes amino acid sequence <SEQ ID 8780> was also identified. Analysis of this protein sequence reveals the following:

```
Lipop: Possible site: -1 Crend: 0
McG: Discrim Score: -5.81
GvH: Signal Score (-7.5): -1.92
     Possible site: 37
>>> Seems to have a cleavable N-terminal signal sequence
ALOM program count: 2 value: -6.26 threshold: 0.0
```

```
    INTEGRAL     Likelihood = -6.26   Transmembrane   527-543 (524-548)
    PERIPHERAL   Likelihood =  5.36   194
modified ALOM score: 1.75
*** Reasoning Step: 3

----- Final Results -----
              bacterial membrane --- Certainty = 0.3506(Affirmative) < succ>
              bacterial outside  --- Certainty = 0.0000(Not Clear)   < succ>
              bacterial cytoplasm --- Certainty = 0.0000(Not Clear)  < succ>
LPXTG motif: 521-525
```

The protein has homology with the following sequences in the GENPEPT database.

```
>GP: CAA57459 GB: X81869 orf2 [Lactobacillus leichmannii]
Identities = 140/505 (27%), Positives = 220/505 (42%), Gaps = 94/505 (18%)

Query: 102 GEVISNYAKLGDNVKGLQGVQFKRYKVKTDI-----SVDELKKLTTVEAADAKVGTILEE 156
           GE+++++   G    L GV FK Y V        S D  +  T  +DAK      L
Sbjct:  58 GEIMNDFGGTG-----LNGVTFKAYNVTDHYLSLRKSGDSAQDAVTAIQSDAKDSDNLPS 112

Query: 157 --GVSLPQKTNAQGLVVDAL---------DSKSNVR-YLYVEDLKNSPSNITKAYAVPFV 204
             G ++ +T A    D +           DS  N + YL+VE   +SP+++T+  A P V
Sbjct: 113 YAGSAIATETTATSKGEDGIAAFDNLNLKDSDGNYQTYLFVET--DSPTDVTQQ-AAPIV 169

Query: 205 LELPVANSTGTGFLS-EINIYPKNVVTDEPKTDKDVKKLGQDDAGYTI-----------G 252
           L +P+  ++ T  ++ +I IYPKNV +  P T KD+ +   + D    T+            G
Sbjct: 170 LTMPIYKTSDTSAINHDIQIYPKNVKST-PIT-KDLDEASKKDLAVTLPDGSTIYNAQYG 227

Query: 253 EEFKWFLKSTIPANLGDYEKFEITDKFADGLTYKSVGKIKIGSKTLNRDEHYTIDEPTVD 312
           + F + +   +P N+ D + F + DK    G+     +     +      L +   YT+++
Sbjct: 228 KSFGYNITVNVPWNIKDKDTFNVVDKPDTGI---DIDASTVSIDGLTKSTDYTVNK---- 280

Query: 313 NQNTLKITFKPEKFKEIAELLKGMTLVKNQDALDKATANTDDAAFLEIPVASTINEKAVL 372
           N ++ FK        + L G +L                      I  +T+   A
Sbjct: 281 KDNGYQVVFKTTS--AAVQALAGKSLT----------------ITYKATLTNNATP 318

Query: 373 GKAIENTFELQYDHTPDKADNPKPSNPPRKPEVHTGGKRFVKKDSTETQTLGGAEFDLLA 432
           KAI NT L   +  +       S P    P ++TGG +FVKKDS    +TL GAEF L+
Sbjct: 319 DKAIGNTATLSIGNGTNIT-----STPANGPRIYTGGAQFVKKDSQSNKTLAGAEFQLVK 373

Query: 433 --SDGTAVKWTDALIKANTNKNYIAGEAVTGQPIKLKSHTDGTFEIKGLAYAVDANAEGT 490
             S+G  V +          +  N  A EA T      S  +G    +KGL+Y ++    +
Sbjct: 374 VDSNGNIVSYATQASDGSYTWNDSATEATT-----YTSDANGLVALKGLSY---SDKLDS 425

Query: 491 AVTYKLKETKAPEGYVIPDKEIEFTVSQTSYNTKPTDITVDSADATPDTIKNNKRPSIPN 550
           +Y L E +AP+GY   D    ++F+++Q S+        D+   TI N K    +P+
Sbjct: 426 GESYALLEIQAPDGYAKLDSPVKFSITQGSF----------GDSNKITIDNTKEGLLPS 474

Query: 551 TGGIGTAIFVAIGAAVMAFAVKGMK 575
           TGG G  IF+AIG +M   A  G K
Sbjct: 475 TGGKGIYIFLAIGIVIMIVAFGGYK 499
```

No corresponding DNA sequence was identified in S. pyogenes.

SEQ ID 8780 (GBS80) was expressed in E. coli as a His-fusion product. SDS-PAGE analysis of total cell extract is shown in FIG. 16 (lane 6; MW 56.8 kDa).

The GBS80-His fusion product was purified (FIG. 104A; see also FIG. 194, lane 5) and used to immunise mice (lane 1+2 product; 20 μg/mouse). The resulting antiserum was used for Western blot (FIG. 104B), FACS (FIG. 104C), and in the in vivo passive protection assay (Table III). These tests confirm that the protein is immunoaccessible on GBS and that it is an effective protective immunogen.

Based on this analysis, it was predicted that this protein and its epitopes, could be useful antigens for vaccines or diagnostics.

EXAMPLE 1275

A DNA sequence (GBSx1352) was identified in S. agalactiae <SEQ ID 3923> which encodes the amino acid sequence <SEQ ID 3924>. Analysis of this protein sequence reveals the following:

```
Possible site: 17
>>> Seems to have no N-terminal signal sequence

----- Final Results -----
              bacterial cytoplasm --- Certainty = 0.4043(Affirmative) < succ>
              bacterial membrane  --- Certainty = 0.0000(Not Clear)   < succ>
              bacterial outside   --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1276

A DNA sequence (GBSx1353) was identified in *S. agalactiae* <SEQ ID 3925> which encodes the amino acid sequence <SEQ ID 3926>. This protein is predicted to be MsmR. Analysis of this protein sequence reveals the following:

```
Possible site: 32
>>> Seems to have no N-terminal signal sequence
     INTEGRAL    Likelihood = -1.01    Transmembrane    75-91 (75-92)

----- Final Results -----
          bacterial membrane --- Certainty = 0.1404(Affirmative) < succ>
          bacterial outside  --- Certainty = 0.0000(Not Clear)   < succ>
          bacterial cytoplasm --- Certainty = 0.0000(Not Clear)   < succ>
```

A related GBS nucleic acid sequence <SEQ ID 9679> which encodes amino acid sequence <SEQ ID 9680> was also identified.

SEQ ID 3926 (GBS360) was expressed in *E. coli* as a GST-fusion product. SDS-PAGE analysis of total cell extract is shown in FIG. 81 (lane 9; MW 74 kDa).

GBS360-GST was purified as shown in FIG. 216, lane 8.

Based on this analysis, it was predicted that these proteins and their epitopes could be useful antigens for vaccines or diagnostics.

EXAMPLE 1277

A DNA sequence (GBSx1354) was identified in *S. agalactiae* <SEQ ID 3927> which encodes the amino acid sequence <SEQ ID 3928>. Analysis of this protein sequence reveals the following:

```
Possible site: 53
>>> Seems to have no N-terminal signal sequence

----- Final Results -----
          bacterial cytoplasm --- Certainty = 0.1762(Affirmative) < succ>
          bacterial membrane  --- Certainty = 0.0000(Not Clear)   < succ>
          bacterial outside   --- Certainty = 0.0000(Not Clear)   < succ>
```

A related DNA sequence was identified in *S. pyogenes* <SEQ ID 3929> which encodes the amino acid sequence <SEQ ID 3930>. Analysis of this protein sequence reveals the following:

```
Possible site: 28
>>> Seems to have no N-terminal signal sequence

----- Final Results -----
          bacterial cytoplasm --- Certainty = 0.1640(Affirmative) < succ>
          bacterial membrane  --- Certainty = 0.0000(Not Clear)   < succ>
          bacterial outside   --- Certainty = 0.0000(Not Clear)   < succ>
```

An alignment of the GAS and GBS proteins is shown below.

```
Identities = 93/98 (94%), Positives = 96/98 (97%)

Query:   1 MDKIIKSISASGAFRSYVLDSTETVKLAQEKHHTLSSSTVALGRTLIANQILAANQKGDS  60
           MDKIIKSI+ SGAFR+YVLDSTETV LAQEKH+TLSSSTVALGRTLIANQILAANQKGDS
Sbjct:   1 MDKIIKSIAQSGAFRAYVLDSTETVALAQEKHNTLSSSTVALGRTLIANQILAANQKGDS  60

Query:  61 KITVKVIGDSSFGHIISVADTKGHVKGYIQINTGVDIKK                       98
           KITVKVIGDSSFGHIISVADTKGHVKGYIQNTGVDIKK
Sbjct:  61 KITVKVIGDSSFGHIISVADTKGHVKGYIQNTGVDIKK                        98
```

Based on this analysis, it was predicted that these proteins and their epitopes could be useful antigens for vaccines or diagnostics.

EXAMPLE 1278

A DNA sequence (GBSx1355) was identified in *S. agalactiae* <SEQ ID 3931> which encodes the amino acid sequence <SEQ ID 3932>. Analysis of this protein sequence reveals the following:

```
Possible site: 17
>>> Seems to have an uncleavable N-term signal seq

----- Final Results -----
           bacterial membrane --- Certainty = 0.0000(Not Clear) < succ>
            bacterial outside --- Certainty = 0.0000(Not Clear) < succ>
          bacterial cytoplasm --- Certainty = 0.0000(Not Clear) < succ>
```

The protein has homology with the following sequences in the GENPEPT database.

```
>GP: AAC98436 GB: L29324 unknown [Streptococcus pneumoniae]
Identities = 34/48 (70%), Positives = 39/48 (80%)

Query:   1 MQEVLIIARENHQVTHEHVSILLTCVQELIVEVNQTQPLSREFREKYM    48
           + EV IIA+ NHQVTHEHVSILLTC+QELI EV +T PLS +F   KYM
Sbjct:  70 VHEVFIIAKTNHQVTHEHVSILLTCIQELIKEVEKTGPLSEDFCNKYM   117
```

No corresponding DNA sequence was identified in *S. pyogenes*.

Based on this analysis, it was predicted that this protein and its epitopes, could be useful antigens for vaccines or diagnostics.

EXAMPLE 1279

A DNA sequence (GBSx1356) was identified in *S. agalactiae* <SEQ ID 3933> which encodes the amino acid sequence <SEQ ID 3934>. This protein is predicted to be TnpA (orfB). Analysis of this protein sequence reveals the following:

```
Possible site: 13
>>> Seems to have no N-terminal signal sequence

----- Final Results -----
          bacterial cytoplasm --- Certainty = 0.5248(Affirmative) < succ>
           bacterial membrane --- Certainty = 0.0000(Not Clear)   < succ>
            bacterial outside --- Certainty = 0.0000(Not Clear)   < succ>
```

A related GBS nucleic acid sequence <SEQ ID 9907> which encodes amino acid sequence <SEQ ID 9908> was also identified. A further related GBS nucleic acid sequence <SEQ ID 9677> which encodes amino acid sequence <SEQ ID 9678> was also identified. A further related GBS nucleic acid sequence <SEQ ID 10911> which encodes amino acid sequence <SEQ ID 10912> was also identified.

There is homology to SEQ ID 1336.

Based on this analysis, it was predicted that these proteins and their epitopes could be useful antigens for vaccines or diagnostics.

EXAMPLE 1280

A DNA sequence (GBSx1357) was identified in *S. agalactiae* <SEQ ID 3935> which encodes the amino acid sequence <SEQ ID 3936>. Analysis of this protein sequence reveals the following:

```
Possible site: 45
>>> Seems to have no N-terminal signal sequence

----- Final Results -----
            bacterial cytoplasm --- Certainty = 0.4489(Affirmative) < succ>
             bacterial membrane --- Certainty = 0.0000(Not Clear)   < succ>
              bacterial outside --- Certainty = 0.0000(Not Clear)   < succ>
```

The protein has homology with the following sequences in the GENPEPT database.

```
>GP: AAB64982 GB: U43834 Ydr540cp [Saccharomyces cerevisiae]
Identities = 93/171 (54%), Positives = 121/171 (70%), Gaps = 3/171 (1%)

Query:    1 MRVYENKEELKKEISKTFEKYIMEFNNIPENLKDKRIDEVDRTPAANLSYQVGWTNLVLK   60
            MR Y +K+ELK+EI K +EKY  EF  I E+ KD++++ VDRTP+ NLSYQ+GW NL+L+
Sbjct:    1 MREYTSKKELKEEIEKKYEKYDAEFETISESQKDEKVETVDRTPSENLSYQLGWVNLLLE   60

Query:   61 WEEDERKGLQVKTPSDKFKWNQLGELYQWFTDTYAHLSLQELKAKLNENINSIYAMIDLL  120
            WE  E  G  V+TP+   +KWN LG LYQ F   Y    S++E +AKL E +N +Y  I   L
Sbjct:   61 WEAKEIAGYNVETPAPGYKWNNLGGLYQSFYKKYGIYSIKEQRAKLREAVNEVYKWISTL  120

Query:  121 SEEELFEAHMRKWADEATKTATWEVYKFIHVNTVAPFGTFRTKIRKWKKIV          171
            S++ELF+A  RKW    AT  A W VYK+IH+NTVAPF  FR KIRKWK++V
Sbjct:  121 SDDELFQAGNRKW---ATTKAMWPVYKWIHINTVAPFTNFRGKIRKWKRLV          168
```

No corresponding DNA sequence was identified in *S. pyogenes*.

Based on this analysis, it was predicted that this protein and its epitopes, could be useful antigens for vaccines or diagnostics.

EXAMPLE 1281

A DNA sequence (GBSx1358) was identified in *S. agalactiae* <SEQ ID 3937> which encodes the amino acid sequence <SEQ ID 3938>. Analysis of this protein sequence reveals the following:

```
Possible site: 28
>>> Seems to have an uncleavable N-term signal seq
      INTEGRAL    Likelihood = -3.45    Transmembrance    10-26 (2-26)

----- Final Results -----
             bacterial membrane --- Certainty = 0.2381(Affirmative) < succ>
              bacterial outside --- Certainty = 0.0000(Not Clear)   < succ>
            bacterial cytoplasm --- Certainty = 0.0000(Not Clear)   < succ>
```

A related GBS nucleic acid sequence <SEQ ID 8781> which encodes amino acid sequence <SEQ ID 8782> was also identified. Analysis of this protein sequence reveals the following:

```
Lipop: Possible site: -1 Crend: 6
McG: Discrim Score: 8.80
GvH: Signal Score (-7.5): -3.94
     Possible site: 28
>>> Seems to have an uncleavable N-term signal seq
ALOM program count: 1 value: -3.45 threshold: 0.0
     INTEGRAL       Likelihood = -3.45    Transmembrane     7-23 (2-26)
     PERIPHERAL     Likelihood = 10.40    69
modified ALOM score: 1.19
*** Reasoning Step: 3

----- Final Results -----
              bacterial membrane --- Certainty = 0.2381(Affirmative) < succ>
               bacterial outside --- Certainty = 0.0000(Not Clear)   < succ>
             bacterial cytoplasm --- Certainty = 0.0000(Not Clear)
```

The protein has homology with the following sequences in the GENPEPT database.

```
>GP: CAA68889 GB: Y07615 acid phosphatase [Haemophilus influenzae]
Identities = 112/245 (45%), Positives = 148/245 (59%), Gaps = 10/245 (4%)

Query:    5 MKKVLVSSLLVLGITITLQTVVEAKGPKVAYTQEGMTALSDTNKDKVTTISIDEIQKSLE   64
            MK V+ S++ L  +T V  G    YTQ G  A    +  + IS+D+I++SLE
Sbjct:    1 MKNVMKLSVIAL---LTAAAVPAMAGKTEPYTQSGTNAREMLQEQAIHWISVDQIKQSLE  57

Query:   65 GKKPITVSFDIDDTLLFSSQYFQYGKEYVTPGSFDFLHKQKEWDLVAKRGDQDSIPKEYA  124
            GK PI VSFDIDDT+LFSS  F +G++  +PG  D+L  Q FW+ V    D+ SIPK+ A
Sbjct:   58 GKAPINVSFDIDDTVLFSSPCFYHGQQKFSPGKHDYLKNQDFWNEVNAGCDKYSIPKQIA  117

Query:  125 KKLIAMHQKRGDKIVFITGRTRGSMYKEGEVDKTAKALAKDFKLDKPIAVNYTGDKPKKP  184
              LI MHQ RGD++ F TGRT       G+VD    L K F +     V + G + ++
Sbjct:  118 IDLINMHQARGDQVYFFTGRT------AGKVDGVTPILEKTFNIKNMHPVEFMGSR-ERT  170

Query:  185 YKYDKSYYIKKYGSDIHYGDSDDDIHAAREAGARPIRILRAPNSTNLPLPEAGGYGEEVL  244
             KY+K+  I  +    IHYGDSDDD+ AA+EAG R IR++RA NST  P+P  GGYGEEVL
Sbjct:  171 TKYNKTPAIISHKVSIHYGDSDDDVLAAKEAGVRGIRLMRAANSTYQPMPTLGGYGEEVL  230

Query:  245 ENSAY                                                         249
            NS+Y
Sbjct:  231 INSSY                                                         235
```

A related DNA sequence was identified in *S. pyogenes* <SEQ ID 3939> which encodes the amino acid sequence <SEQ ID 3940>. Analysis of this protein sequence reveals the following:

```
Possible site: 56
>>> Seems to have an uncleavable N-term signal seq
     INTEGRAL       Likelihood = -3.98    Transmembrane    6-22 (4-25)

----- Final Results -----
              bacterial membrane --- Certainty = 0.2593(Affirmative) < succ>
               bacterial outside --- Certainty = 0.0000(Not Clear)   < succ>
             bacterial cytoplasm --- Certainty = 0.0000(Not Clear)   < succ>
```

The protein has homology with the following sequences in the databases:

```
>GP: CAA68889 GB: Y07615 acid phosphatase [Haemophilus influenzae]
Identities = 105/237 (44%), Positives = 141/237 (59%), Gaps = 10/237 (4%)

Query:    9 LFTVSFCGIIALPVEASGPKVPYTQEGITA--ISNQATVKLISIADIASSLEGQKPITVS   66
            L ++     A+P  A G  PYTQ G  A    +  + IS+  I  SLEG+ PI VS
Sbjct:    7 LSVIALLTAAAVPAMA-GKTEPYTQSGTNAREMLQEQAIHWISVDQIKQSLEGKAPINVS  65

Query:   67 FDIDDTLLFTSQYFQYGKEYITPGSFDFLHKQKFWDLVAKRGDQDSIPKEYAKQLIAMHQ  126
            FDIDDT+LF+S  F +G++  +PG  D+L  Q FW+ V    D+ SIPK+ A  LI MHQ
Sbjct:   66 FDIDDTVLFSSPCFYHGQQKFSPGKHDYLKNQDFWNEVNAGCDKYSIPKQIAIDLINMHQ  125

Query:  127 KRGDKIVFITGRTRGSMYKKGEIDKTAKSLAKDFKLDKPIAINYTGDKAVKPYQYDKTYY  186
             RGD++ F TGRT       G++D    L K F +     + + G +   +Y+KT
Sbjct:  126 ARGDQVYFFTGRT------AGKVDGVTPILEKTFNIKNMHPVEFMGSRE-RTTKYNKTPA  178
```

```
-continued
Query: 187 IKKNGSQIHYGDSDEDINAAKEAGARPIRILRAPNSTNLPLPKAGGYGEEVLENSAY    243
            I  +    IHYGDSD+D+ AAKEAG R IR++RA NST  P+P  GGYGEEVL NS+Y
Sbjct: 179 IISHKVSIHYGDSDDDVLAAKEAGVRGIRLMRAANSTYQPMPTLGGYGEEVLINSSY    235
```

An alignment of the GAS and GBS proteins is shown below.

```
Identities = 196/245 (80%), Positives = 216/245 (88%), Gaps = 2/245 (0%)

Query:     5 MKKVLVSSLLVLGITITLQTVVEAKGPKVAYTQEGMTALSDTNKDKVTTISIDEIQKSLE   64
             MKK   S L  +       +   VEA GPKV YTQEG+TA+S  N+   V  ISI +I  SLE
Sbjct:     1 MKKEFTSILFTVSFCGIIALPVEASGPKVPYTQEGITAIS--NQATVKLISIADIASSLE   58

Query:    65 GKKPITVSFDIDDTLLFSSQYFQYGKEYVTPGSFDFLHKQKFWDLVAKRGDQDSIPKEYA  124
             G+KPITVSFDIDDTLLF+SQYFQYGKEY+TPGSFDFLHKQKFWDLVAKRGDQDSIPKEYA
Sbjct:    59 GQKPITVSFDIDDTLLFTSQYFQYGKEYITPGSFDFLHKQKFWDLVAKRGDQDSIPKEYA  118

Query:   125 KKLIAMHQKRGDKIVFITGRTRGSMYKEGEVDKTAKALAKDFKLDKPIAVNYTGDKPKKP  184
             K+LIAMHQKRGDKIVFITGRTRGSMYK+GE+DKTAK+LAKDFKLDKPIA+NYTGDK  KP
Sbjct:   119 KQLIAMHQKRGDKIVFITGRTRGSMYKKGEIDKTAKSLAKDFKLDKPIAINYTGDKAVKP  178

Query:   185 YKYDKSYYIKKYGSDIHYGDSDDDIHAAREAGARPIRILRAPNSTNLPLPEAGGYGEEVL  244
             Y+YDK+YYIKK GS IHYGDSD+DI+AA+EAGARPIRILRAPNSTNLPLP+AGGYGEEVL
Sbjct:   179 YQYDKTYYIKKNGSQIHYGDSDEDINAAKEAGARPIRILRAPNSTNLPLPKAGGYGEEVL  238

Query:   245 ENSAY                                                         249
             ENSAY
Sbjct:   239 ENSAY                                                         243
```

SEQ ID 8782 (GBS100) was expressed in *E. coli* as a His-fusion product. SDS-PAGE analysis of total cell extract is shown in FIG. 16 (lane 5; MW 28 kDa). It was also expressed in *E. coli* as a GST-fusion product. SDS-PAGE analysis of total cell extract is shown in FIG. 33 (lane 2; MW 53 kDa).

The GBS100-GST fusion product was purified (FIG. 106A; see also FIG. 197, lane 4) and used to immunise mice (lane 1 product; 9.9 µg/mouse). The resulting antiserum was used for Western blot (FIG. 106B), FACS (FIG. 106C), and in the in vivo passive protection assay (Table III). These tests confirm that the protein is immunoaccessible on GBS and that it is an effective protective immunogen.

Based on this analysis, it was predicted that these proteins and their epitopes could be useful antigens for vaccines or diagnostics.

EXAMPLE 1282

A DNA sequence (GBSx1359) was identified in *S. agalactiae* <SEQ ID 3941> which encodes the amino acid sequence <SEQ ID 3942>. Analysis of this protein sequence reveals the following:

```
Possible site: 19
>>> Seems to have no N-terminal signal sequence

----- Final Results -----
            bacterial cytoplasm --- Certainty = 0.3288(Affirmative) < succ>
            bacterial membrane  --- Certainty = 0.0000(Not Clear)   < succ>
            bacterial outside   --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1283

A DNA sequence (GBSx1360) was identified in *S. agalactiae* <SEQ ID 3943> which encodes the amino acid sequence <SEQ ID 3944>. Analysis of this protein sequence reveals the following:

```
Possible site: 50
>>> Seems to have no N-terminal signal sequence

----- Final Results -----
            bacterial cytoplasm --- Certainty = 0.4004(Affirmative) < succ>
            bacterial membrane  --- Certainty = 0.0000(Not Clear)   < succ>
             bacterial outside  --- Certainty = 0.0000(Not Clear)   < succ>
```

A related GBS nucleic acid sequence <SEQ ID 9675> which encodes amino acid sequence <SEQ ID 9676> was also identified.

The protein has homology with the following sequences in the GENPEPT database.

```
>GP: BAB04406 GB: AP001509 RNA methyltransferase [Bacillus halodurans]
Identities = 198/452 (43%), Positives = 300/452 (65%)

Query:  12 KRKIMLHKNDIIETEISDISHEGMGIAKVDGFVFFVENALPGEIIKMRVLKLRKRIGYGK   71
           K++ ++KND++E  I D++H+G G+AKVDG+  F+  ALPGE +K +V+K++K  G+G+
Sbjct:   3 KQQAPVNKNDVVEVTIEDLTHDGAGVAKVDGYALFIPKALPGERLKAKVVKVKKGYGFGR   62

Query:  72 VEEYLTTSPHRNEGLDYTYLRTGIADLGHLTYEQQLLFKQKQVADNLYKIAHISDVLVEP  131
           V   + SP R E    + + G    L H++Y+ QL +KQKQV D L +I  I+ V V P
Sbjct:  63 VLNMIEASPDRVEAPCPVFNQCGGCQLQHMSYDAQLRYKQKQVQDVLERIGKITAVTVRP  122

Query: 132 TLGMTIPLAYRNKAQVPVRRVDGQLETGFFRKNSHTLVSIEDYLIQEKEIDALINFTRDL  191
           T+GM  P  YRNKAQVPV  +G L  GF+++ SH ++ +++ +IQ +E D +I   ++L
Sbjct: 123 TIGMNEPWRYRNKAQVPVGEREGGLIAGFYQERSHRIIDMDECMIQHEENDKVIRQVKEL  182

Query: 192 LRKFDVKPYDEEQQSGLIRNLVVRRGHYTGQLMLVLVTTRPKIFRIDQMIEKLVSAFPSV  251
              R+ ++ YDEE+  G +R++V R G   TG++M+VL+T  ++    +IE++  A P V
Sbjct: 183 ARELGIRGYDEEKHRGTLRHVVARYGKNTGEIMVVLITRGEELPHKKTLIERIHKAIPHV  242

Query: 252 VSIMQNINDRNSNVIFGKEFRTLYGSDTIEDQMLGNTYAISAQSFYQVNTEMAEKLYQKA  311
            SI+QN+N + +NVIFG + + L+G + I D+    +AISA+SFYQVN E  + LY +A
Sbjct: 243 KSIVQNVNPKRTNVIFGDKTKVLWGEEYIYDTIGDIKFAISARSFYQVNPEQTKVLYDQA  302

Query: 312 IDFSDLNSEDIVIDAYSGIGTIGLSVAKQVKHVYGVEVVEKAVSDAKENATRNGITNSTY  371
           ++F++L   + VIDAY GIGTI L +A+Q KHVYGVE+V +A+SDAK NA  NG  N +
Sbjct: 303 LEFANLTGSETVIDAYCGIGTISLFLAQQAKHVYGVEIVPEAISDAKRNARLNGFANVQF  362

Query: 372 VADSAENAMAKWLKEGIKPTVIMVDPPRKGLTESFVYSAAQTKADKITYISCNSATMARD  431
               AE M W  +G++  VI+VDPPRKG  E+ + +    K D++ Y+SCN AT+ARD
Sbjct: 363 AVGDAEKVMPWWYAQGVRADVIVVDPPRKGCDEALLKTILNMKPDRVVYVSCNPATLARD  422

Query: 432 IKLFEELGYHLVKIQPVDLFPMTHHVECVALL                             463
           +++ E+ GY    +QPVD+FP T H+E VA+L
Sbjct: 423 LRVLEDGGYETKDVQPVDMFPWTTHIESVAVL                             454
```

A related DNA sequence was identified in *S. pyogenes* <SEQ ID 3945> which encodes the amino acid sequence <SEQ ID 3946>. Analysis of this protein sequence reveals the following:

```
Possible site: 33
>>> Seems to have no N-terminal signal sequence
```

```
----- Final Results -----
            bacterial cytoplasm --- Certainty = 0.1262(Affirmative) < succ>
            bacterial membrane  --- Certainty = 0.0000(Not Clear)   < succ>
            bacterial outside   --- Certainty = 0.0000(Not Clear)   < succ>
```

An alignment of the GAS and GBS proteins is shown below.

```
Identities = 332/454 (73%), Positives = 387/454 (85%)

Query:   12 KRKIMLHKNDIIETEISDISHEGMGIAKVDGFVFFVENALPGEIIKMRVLKLRKRIGYGK   71
            KR  ML KNDII+  ISD+SHEG G+AK DGFVFFV+NALP E+I MRVLK+ K  G+GK
Sbjct:    8 KRIRMLKKNDIIQVAISDLSHEGAGVAKHDGFVFFVDNALPEEVIDMRVLKVNKNSGFGK   67

Query:   72 VEEYLTTSPHRNEGLDYTYLRTGIADLGHLTYEQQLLFKQKQVADNLYKIAHISDVLVEP  131
            VE Y   S  RN  ++ TYLRTGIADLGHLTYE QL FK+KQV D+LYKIA ISDV VE
Sbjct:   68 VEAYHYLSSARNADVNLTYLRTGIADLGHLTYEDQLTFKKKQVDSLYKIAGISDVTVES  127

Query:  132 TLGMTIPLAYRNKAQVPVRRVDGQLETGFFRKNSHTLVSIEDYLIQEKEIDALINFTRDL  191
            T+GMT PLAYRNKAQVPVRRV+GQLETGFFRK+SH L+ I DY IQ+KEID LINFTRDL
Sbjct:  128 TIGMTEPLAYRNKAQVPVRRVNGQLETGFFRKHSHDLIPISDYYIQDKEIDRLINFTRDL  187

Query:  192 LRKFDVKPYDEEQQSGLIRNLVVRRGHYTGQLMLVLVTTRPKIFRIDQMIEKLVSAFPSV  251
            LR+FD+KPYDE +Q+GL+RN+VVRRGHY+G++MLVLVTTRPK+FR+DQ+IEK+V AFP+V
Sbjct:  188 LRRFDIKPYDETEQTGLLRNIVVRRGHYSGEMMLVLVTTRPKVFRVDQVIEKIVEAFPAV  247

Query:  252 VSIMQNINDRNSNVIFGKEFRTLYGSDTIEDQMLGNTYAISAQSFYQVNTEMAEKLYQKA  311
            VSI+QNIND+N+N IFGK+F+TLYG DTI D MLGN YAISAQSFYQVNT MAEKLYQ A
Sbjct:  248 VSIIQNINDKNTNAIFGKDFKTLYGKDTITDSMLGNNYAISAQSFYQVNTVMAEKLYQTA  307

Query:  312 IDFSDLNSEDIVIDAYSGIGTIGLSVAKQVKHVYGVEVVEKAVSDAKENATRNGITNSTY  371
            I FSDL+ +DIVIDAYSGIGTIGLS AK VK VYGVEV+E AV DA++NA  NGITN+ +
Sbjct:  308 IAFSDLSKDDIVIDAYSGIGTIGLSFAKTVKAVYGVEVIEAAVRDAQQNAALNGITNAYF  367

Query:  372 VADSAENAMAKWLKEGIKPTVIMVDPPRKGLTESFVYSAAQTKADKITYISCNSATMARD  431
            VAD+AE+AMA W K+GIKP+VI+VDPPRKGLTESF+ ++       KITY+SCN ATMARD
Sbjct:  368 VADTAEHAMATWAKDGIKPSVILVDPPRKGLTESFIQASVAMGPQKITYVSCNPATMARD  427

Query:  432 IKLFEELGYHLVKIQPVDLFPMTHHVECVALLVK                           465
            IK ++ELGY L K+QPVDLFP THHVECV LL+K
Sbjct:  428 IKRYQELGYKLAKVQPVDLFPQTHHVECVVLLIK                           461
```

Based on this analysis, it was predicted that these proteins and their epitopes could be useful antigens for vaccines or diagnostics.

EXAMPLE 1284

A DNA sequence (GBSx1361) was identified in *S. agalactiae* <SEQ ID 3947> which encodes the amino acid sequence <SEQ ID 3948>. This protein is predicted to be PSR protein. Analysis of this protein sequence reveals the following:

```
Possible site: 58
>>> Seems to have no N-terminal signal sequence
     INTEGRAL    Likelihood = -12.15    Transmembrane   135-151 (127-155)

----- Final Results -----
            bacterial membrane  --- Certainty = 0.5861(Affirmative) < succ>
            bacterial outside   --- Certainty = 0.0000(Not Clear)   < succ>
            bacterial cytoplasm --- Certainty = 0.0000(Not Clear)   < succ>
```

The protein has homology with the following sequences in the GENPEPT database.

```
>GP: CAB76822 GB: AJ276232 PSR protein [Enterococcus faecalis]
Identities = 143/409 (34%), Positives = 206/409 (49%), Gaps = 56/409 (13%)

Query:   48 QRRTESPP--TNSYYEEPYSDSYYQDDDFYSEPQLTSQGLPIYQEERAPKKKKQRARKEK  105
             + R E P    S  E  Y DSY +D       T G    ++ P+ KK +   K+K
Sbjct:   31 EHREEEPEELAESLQEPVYEDSYTEDSRRSERRHQTDSGGG-NGSDQPPRGKKDKKPKKK   89
```

-continued

```
Query:  106 QRVKVMAPFPPPKAITPPRKKKKFKGFLKFIGIILLIVLSGMVFMFVKGMRDVNNGKSHYS  165
                            RKK K K F K++ I+L+++ +    MF+KG      + S
Sbjct:   90 -----------------RKKSKTKRFFKWLVILLILLFAYSTVMFLKGKSAAEHDDS-LP  131

Query:  166 PAIIEDFKGKDAVDGT-NILILGSDKRVSERSTDARTDTIMVANVGNKDNKVKMVSFMRD  224
              +E F G + +G NILILGSD R +    R DTIMV +     K K++SFMRD
Sbjct:  132 QEKVETFNGVKSSNGAKNILILGSDTRGEDAG---RADTIMVLQLNGPSKKPKLISFMRD  188

Query:  225 LLVNIPNYSTEGYYDMKLNASFNLGEQDNHKGAEYVRQTLKNHFDIDIKYYVMVDFETFA  284
                V+IP   G    K+NA++  G     GAE VR+TLK +F++D KYY  VDF++F
Sbjct:  189 TFVDIP-----GVGPNKINAAYAYG------GAELVRETLKQNFNLDTKYYAKVDFQSFE  237

Query:  285 DAIDTLFPNGVKINAKFGLVGGQSADSVKVPDDLRMKNGVVPSQKIKVGIQYMDGRTLLN  344
                +D++FP GVKI+A+   L     + D V                I+ G Q MDG LL
Sbjct:  238 KIVDSMFPKGVKIDAEKSL----NLDGVD----------------IEKGQQVMDGHVLLQ  277

Query:  345 YARFRKDDDGDFGRTQRQQQVMRAIVSQIKDPRRLFTGSAAIGKAYALTSSNLSYSFVLT  404
                YARFR D++GDFGR +RQQQVM A++SQ+K+P  L      ++GK    S+++ SF+LT
Sbjct:  278 YARFRMDEEGDFGRVRRQQQVMSAVMSQMKNPMTLLRTPESLGKLVGYMSTDVPVSFMLT  337

Query:  405 DGIPILSDAKNGIKQMTIPREGDWVDDYDQYGGQGLTIDFAKYKKILKK  453
                +G +L   K G++ +++P    W        YG L +D K    ++K
Sbjct:  338 NGPSLLIKGKTGVESLSVPVPDSWNFGESSYAGSILEVDEQKNADAIEK  386
```

A related DNA sequence was identified in *S. pyogenes* <SEQ ID 3949> which encodes the amino acid sequence <SEQ ID 3950>. Analysis of this protein sequence reveals the following:

```
Possible site: 49
>>> Seems to have no N-terminal signal sequence
    INTEGRAL    Likelihood = -7.96    Transmembrane    159-175 (152-180)

----- Final Results -----
              bacterial membrane --- Certainty = 0.4185(Affirmative) < succ>
              bacterial outside  --- Certainty = 0.0000(Not Clear)  < succ>
              bacterial cytoplasm --- Certainty = 0.0000(Not Clear) < succ>
```

The protein has homology with the following sequences in the databases:

```
>GP: CAB76822 GB: AJ276232 PSR protein [Enterococcus faecalis]
Identities = 140/345 (40%), Positives = 195/345 (55%), Gaps = 41/345 (11%)

Query:  140 PRSQK----RKHKKKGCMKWFFNILGLLLMTVLMGLGLMFAKGVFDISTNKANYKPAVSQ  195
              PR +K     +K +KK   K FF L +LL+ +    +MF KG    + +  + V +
Sbjct:   78 PRGKKDKKPKKKRKKSKTKRFFKWLVILLILLFAYSTVMFLKGKSAAEHDDSLPQEKV-E  136

Query:  196 AFDGQETQDGT-NILILGSDQRVTQGSTDARTDTIMVVNVGNHAKKIKMVSFMRDTLINI  254
                F+G ++ +G NILILGSD   T+G    R DTIMV+ +  +KK K++SFMRDT ++I
Sbjct:  137 TFNGVKSSNGAKNILILGSD---TRGEDAGRADTIMVLQLNGPSKKPKLISFMRDTFVDI  193

Query:  255 PGYSYNDNSYDLKLNSAFNLGEQEDHHGAEYVRRALKHNFDIDIKYYVMVDFETFAEAID  314
                PG  N     K+N+A+  G     GAE VR  LK NF++D KYY  VDF++F + +D
Sbjct:  194 PGVGPN------KINAAYAYG------GAELVRETLKQNFNLDTKYYAKVDFQSFEKIVD  241

Query:  315 TLFPNGVKIDAKFATVGGVAVDSVEVPDDLRMKNGVVPNQTIEVGEQRMDGRTLLNYARF  374
                 ++FP GVKIDA+ +    + +D V+             IE G+Q MDG LL YARF
Sbjct:  242 SMFPKGVKIDAEKS----LNLDGVD----------------IEKGQQVMDGHVLLQYARF  281

Query:  375 RKDDEGDFGRTVRQQQVMSAVMSQIKDPTKLFTGSAAIGKIYALTSTNVSFPFVVKNGVS  434
                R D+EGDFGR  RQQQVMSAVMSQ+K+P  L      ++GK+    ST+V F++  NG S
Sbjct:  282 RMDEEGDFGRVRRQQQVMSAVMSQMKNPMTLLRTPESLGKLVGYMSTDVPVSFMLTNGPS  341

Query:  435 VLGSGKNGVEHVTIPENGDWVDEYDMYGGQALYIDFDKYQKTLAK  479
                +L  GK GVE +++P    W        YG L +D K    + K
Sbjct:  342 LLIKGKTGVESLSVPVPDSWNFGESSYAGSILEVDEQKNADAIEK  386
```

An alignment of the GAS and GBS proteins is shown below.

```
Identities = 273/486 (56%), Positives = 340/486 (69%), Gaps = 32/486 (6%)

Query:    1 MSRNNYGQLNHHEELRYNYLLKNIHYLNEREKMEFQYLHYKKTAVRPQRRTESPPTNSYY   60
            M++   G L+HHEELRY YLL+N+ YL+E EK EF +L  K    R    ++   S
Sbjct:    1 MTKYPMGGLSHHEELRYFYLLRNLSYLSENEKKEFAFLKSKLEIGRAYAPSKQHYRKSKR   60

Query:   61 EEPY-SDSYY---------QDDDFYSEPQLTSQGLPIYQEERAPKKKKQRARKEKQRVKV  110
            +EPY  D YY         +DDD +     GLPIY +E     KK     K   R   +
Sbjct:   61 QEPYFEDDYYNDYSPNDLLEDDDVNHDSSFVPYGLPIYPKEDRYLNKKT---KLTARRPI  117

Query:  111 MAPFP----------------PKAITPPRKKKK-FKGFLKFIGIILLIVLSGMVFMFVK  152
            AP P                 P++       KKK  K F   +G++L+ VL G+  MF K
Sbjct:  118 DAPQPIDEDDAFLTESVARCALPRSQKRKHKKKGCMKWFFNILGLLLMTVLMGLGLMFAK  177

Query:  153 GMRDVNNGKSHYSPAIIEDFKGKDAVDGTNILILGSDKRVSERSTDARTDTIMVANVGNK  212
            G+ D++   K++Y PA+ + F G++  DGTNILILGSD+RV++ STDARTDTIMV NVGN
Sbjct:  178 GVFDISTNKANYKPAVSQAFDGQETQDGTNILILGSDQRVTQGSTDARTDTIMVVNVGNH  237

Query:  213 DNKVKMVSFMRDLLVNIPNYS-TEGYYDMKLNASFNLGEQDNHKGAEYVRQTLKNHFDID  271
               K+KMVSFMRD L+NIP YS  +   YD+KLN++FNLGEQ++H GAEYVR+ LK++FDID
Sbjct:  238 AKKIKMVSFMRDTLINIPGYSYNDNSYDLKLNSAFNLGEQEDHHGAEYVRRALKHNFDID  297

Query:  272 IKYYVMVDFETFADAIDTLFPNGVKINAKFGLVGGQSADSVKVPDDLRMKNGVVPSQKIK  331
            IKYYVMVDFETFA+AIDTLFPNGVKI+AKF  VGG + DSV+VPDDLRMKNGVVP+Q I+
Sbjct:  298 IKYYVMVDFETFAEAIDTLFPNGVKIDAKFATVGGVAVDSVEVPDDLRMKNGVVPNQTIE  357

Query:  332 VGIQYMDGRTLLNYARFRKDDDGDFGRTQRQQQVMRAIVSQIKDPRRLFTGSAAIGKAYA  391
            VG Q MDGRTLLNYARFRKDD+GDFGRT RQQQVM A++SQIKDP +LFTGSAAIGK YA
Sbjct:  358 VGEQRMDGRTLLNYARFRKDDEGDFGRTVRQQQVMSAVMSQIKDPTKLFTGSAAIGKIYA  417

Query:  392 LTSSNLSYSFVLTDGIPILSDAKNGIKQMTIPREGDWVDDYDQYGGQGLTIDFAKYKKIL  451
            LTS+N+S+ FV+  +G+ +L   KNG++ +TIP  GDWVD+YD YGGQ L IDF KY+K L
Sbjct:  418 LTSTNVSFPFVVKNGVSVLGSGKNGVEHVTIPENGDWVDEYDMYGGQALYIDFDKYQKTL  477

Query:  452 KKMGLR                                                       457
            K+GLR
Sbjct:  478 AKLGLR                                                       483
```

Based on this analysis, it was predicted that these proteins and their epitopes could be useful antigens for vaccines or diagnostics.

EXAMPLE 1285

A DNA sequence (GBSx1362) was identified in *S. agalactiae* <SEQ ID 3951> which encodes the amino acid sequence <SEQ ID 3952>. This protein is predicted to be shikimate kinase (aroK). Analysis of this protein sequence reveals the following:

```
Possible site: 17
>>> Seems to have a cleavable N-term signal seq.

----- Final Results -----
             bacterial outside --- Certainty = 0.3000(Affirmative) < succ>
            bacterial membrane --- Certainty = 0.0000(Not Clear)   < succ>
           bacterial cytoplasm --- Certainty = 0.0000(Not Clear)   < succ>
```

The protein has homology with the following sequences in the GENPEPT database.

```
>GP: CAA55181 GB: X78413 shikimate kinase [Lactococcus lactis]
Identities = 65/164 (39%), Positives = 98/164 (59%), Gaps = 8/164 (4%)

Query:    1 MPKVLLGFMGVGKTSVANCLENEVIDMDSLIEKHIGMSISRFFTEEGEASFRALESQFLN   60
            M  +L+GFMG GK++VA   L  E  D+D LIE+  I M I+ FF     GEA FR +E++
Sbjct:    1 MSIILIGFMGAGKSTVAKLLAEEFTDLDKIIEEEIEMPIATFFELFGEADFRKIENEVFE   60

Query:   61 ELLKKKNEGLVIASGGGIVLLEENRRLLTLNRHNNIL-LTGSFEVLYHRIKKDEKNRRPL  119
            ++K      ++IA+GGGI+   E  + L  L+R +  ++ LT  F+ L+ RI  D +N RP
Sbjct:   61 LAVQK---DIIIATGGGII--ENPKNLNVLDRASRVVFLTADFDTLWKRISMDWQNVRP-  114
```

```
                                  -continued
Query: 120 FLNHSKEEFYDIYQKRMLLYSGLSDMIIDTDYLTPQKIATVIGE            163
           L    KE    +++KRM YS ++D+ ID    +P++IA  I E
Sbjct: 115 -LAQDKEAAQLLFEKRMKDYSLVADLTIDVTDKSPEQIAEQIRE             157
```

A related DNA sequence was identified in *S. pyogenes* <SEQ ID 3953> which encodes the amino acid sequence <SEQ ID 3954>. Analysis of this protein sequence reveals the following:

```
Possible site: 43
>>> Seems to have a cleavable N-term signal seq.

----- Final Results -----
             bacterial outside --- Certainty = 0.3000(Affirmative) < succ>
             bacterial membrane --- Certainty = 0.0000(Not Clear)  < succ>
           bacterial cytoplasm --- Certainty = 0.0000(Not Clear)  < succ>
```

The protein has homology with the following sequences in the databases:

```
>GP: CAA55181 GB: X78413 shikimate kinase [Lactococcus lactis]
Identities = 63/160 (39%), Positives = 97/160 (60%), Gaps = 5/160 (3%)

Query:   1 MTKVLLGFMGVGKTTVSKHLSMHCKDMDAIIEAKIGMSIAAFFEQHGEIAFRTIESQVLK    60
           M+ +L+GFMG GK+TV+K L+     D+D +IE +I M IA FFE  GE  FR IE++V +
Sbjct:   1 MSIILIGFMGAGKSTVAKLLAEEFTDLDKLIEEEIEMPIATFFELFGEADFRKIENEVFE    60

Query:  61 DLLFANDNSIIVTGGGVVVLQENRQLLRKNHQHNILLVASFETLYQRLKHDKKSQRPLFL   120
           L    + II TGGG++   +N  +L +     + L A F+TL++R+  D ++ RP   L
Sbjct:  61 --LAVQKDIIIATGGGIIENPKNLNVLDR-ASRVVFLTADFDTLWKRISMDWQNVRP--L   115

Query: 121 KYSKEAFYEFYQQRMVFYEGLSDLVIRVDHRTPEEVANII                      160
             KEA    +++RM  Y  ++DL I V  ++PE++A  I
Sbjct: 116 AQDKEAAQLLFEKRMKDYSLVADLTIDVTDKSPEQIAEQI                      155
```

An alignment of the GAS and GBS proteins is shown below.

```
Identities = 88/161 (54%), Positives = 120/161 (73%), Gaps = 1/161 (0%)

Query:   1 MPKVLLGFMGVGKTSVANCLENEVIDMDSLIEKHIGMSISRFFTEEGEASFRALESQFLN    60
           M KVLLGFMGVGKT+V+  L    DMD++IE  IGMSI+ FF + GE +FR +ESQ L
Sbjct:   1 MTKVLLGFMGVGKTTVSKHLSMHCKDMDAIIEAKIGMSIAAFFEQHGEIAFRTIESQVLK    60

Query:  61 ELLKKKNEGLVIASGGGIVLLEENRRLLTLNRHNNILLTGSFEVLYHRIKKDEKNRRPLF   120
           +LL   N+  +I +GGG+V+L+ENR+LL  N  +NILL  SFE LY R+K D+K++RPLF
Sbjct:  61 DLLFA-NDNSIIVTGGGVVVLQENRQLLRKNHQHNILLVASFETLYQRLKHDKKSQRPLF   119

Query: 121 LNHSKEEFYDIYQKRMLLYSGLSDMIIDTDYLTPQKIATVI                     161
           L +SKE FY+ YQ+RM+ Y GLSD++I  D+ TP+++A +I
Sbjct: 120 LKYSKEAFYEFYQQRMVFYEGLSDLVIRVDHRTPEEVANII                     160
```

SEQ ID 3952 (GBS152) was expressed in *E. coli* as a His-fusion product. SDS-PAGE analysis of total cell extract is shown in FIG. 25 (lane 2; MW 20 kDa). It was also expressed in *E. coli* as a GST-fusion product. SDS-PAGE analysis of total cell extract is shown in FIG. 37 (lane 2; MW 45.5 kDa).

Based on this analysis, it was predicted that these proteins and their epitopes could be useful antigens for vaccines or diagnostics.

EXAMPLE 1286

A DNA sequence (GBSx1363) was identified in *S. agalactiae* <SEQ ID 3955> which encodes the amino acid sequence <SEQ ID 3956>. This protein is predicted to be 3-phosphoshikimate 1-carboxyvinyltransferase (aroA). Analysis of this protein sequence reveals the following:

```
Possible site: 39
>>> Seems to have no N-terminal signal sequence
     INTEGRAL      Likelihood = -1.81     Transmembrane    241-257 (240-257)
     INTEGRAL      Likelihood = -0.06     Transmembrane    390-406 (390-406)

----- Final Results -----
              bacterial membrane --- Certainty = 0.1723(Affirmative) < succ>
               bacterial outside --- Certainty = 0.0000(Not Clear)   < succ>
              bacterial cytoplasm --- Certainty = 0.0000(Not Clear)   < succ>
```

A related GBS nucleic acid sequence <SEQ ID 9673> which encodes amino acid sequence <SEQ ID 9674> was also identified.

The protein has homology with the following sequences in the GENPEPT database.

```
>GP: AAD45819 GB: AF169483 5-enolpyruvylshikimate-3-phosphate synthase
[Streptococcus pneumoniae]
Identities = 288/426 (67%), Positives = 347/426 (80%)

Query:    5 MKLLTNANTLKGTIRVPGDKSISHRAIIFGSISQGVTRIVDVLRGEDVLSTIEAFKQMGV    64
            MKL TN   L G IRVPGDKSISHR+IIFGS+++G T++ D+LRGEDVLST++ F+ +GV
Sbjct:    1 MKLKTNIRHLHGIIRVPGDKSISHRSIIFGSLAEGETKVYDILRGEDVLSTMQVFRDLGV    60

Query:   65 LIEDDGEIITIYGKGFAGLTQPNNLLDMGNSGTSMRLIAGVLAGQEFEVTMVGDNSLSKR   124
            IED    +IT+ G G AGL   P N L+MGNSGTS+RLI GVLAG +FEV M GD+SLSKR
Sbjct:   61 EIEDKDGVITVQGVGMAGLKAPQNALNMGNSGTSIRLISGVLAGADFEVEMFGDDSLSKR   120

Query:  125 PMDRIALPLSKMGARISGVTNRDLPPLKLQGTKKLKPIFYHLPVASAQVKSALIFAALQT   184
            PMDR+ LPL KMG  ISG T RDLPPL+L+GTK L+PI Y LP+ASAQVKSAL+FAALQ
Sbjct:  121 PMDRVTLPLKKMGVSISGQTERDLPPLRLKGTKNLRPIHYELPIASAQVKSALMFAALQA   180

Query:  185 KGESLIVEKEQTRNHTEDMIRQFGGNLDIKDKEIRLNGGQSLVGQDIRVPGDISSAAFWI   244
            KGES+I+EKE TRNHTEDM++QFGGHL +   K+I + G Q L GQ + VPGDISSAAFW+
Sbjct:  181 KGESVIIEKEYTRNHTEDMLQQFGGNLSVDGKKITVQGPQKLTGQKVVVPGDISSAAFWL   240

Query:  245 VAGLIIPNSHIILENVGINETRTGILDVVSKMGGKIKLSSVDNQVKSATLTVDYSHLQAT   304
            VAGLI PNS ++L+NVGINETRTGI+DV+   MGGK++++  +D    KSATL V+ S L+ T
Sbjct:  241 VAGLIAPNSRLVLQNVGINETRTGIIDVIRAMGGKLEITEIDPVAKSATLIVESSDLKGT   300

Query:  305 HISGAMIPRLIDELPIIALLATQAQGTTVIADAQELKVKETDRIQVVVESLKQMGADITA   364
              I GA+IPRLIDELPIIALLATQAQG TVI DA+ELKVKETDRIQVV ++L  MGADIT
Sbjct:  301 EICGALIPRLIDELPIIALLATQAQGVTVIKDAEELKVKETDRIQVVADALNSMGADITP   360

Query:  365 TADGMIIRGNTPLHAASLDCHGDHRIGMMIAIAALLVKEGEVDLSGEEAINTSYPNFLEH   424
            TADGMII+G + LH A ++   GDHRIGMM AIAALLV +GEV+L     EAINTSYP+F +
Sbjct:  361 TADGMIIKGKSALHGARVNTFGDHRIGMMTAIAALLVADGEVELDRAEAINTSYPSFFDD   420

Query:  425 LEGLVN                                                        430
            LE L++
Sbjct:  421 LESLIH                                                        426
```

A related DNA sequence was identified in *S. pyogenes* <SEQ ID 3957> which encodes the amino acid sequence <SEQ ID 3958>. Analysis of this protein sequence reveals the following:

```
Possible site: 36
>>> Seems to have no N-terminal signal sequence
     INTEGRAL      Likelihood = -2.18     Transmembrane    240-256 (239-256)

----- Final Results -----
              bacterial membrane --- Certainty = 0.1871(Affirmative) < succ>
               bacterial outside --- Certainty = 0.0000(Not Clear)   < succ>
              bacterial cytoplasm --- Certainty = 0.0000(Not Clear)   < succ>
```

The protein has homology with the following sequences in the databases:

```
>GP: AAD45819 GB: AF169483 5-enolpyruvylshikimate-3-phosphate synthase
[Streptococcus pneumoniae]
Identities = 278/426 (65%), Positives = 346/426 (80%)
```

-continued

```
Query:    4 MKLRTNAGPLQGTIQVPGDKSISHRAVILGAVAKGETRVKGLLKGEDVLSTIQAFRNLGV   63
            MKL+TN   L G I+VPGDKSISHR++I G++A+GET+V  +L+GEDVLST+Q FR+LGV
Sbjct:    1 MKLKTNIRHLHGIIRVPGDKSISHRSIIFGSLAEGETKVYDILRGEDVLSTMQVFRDLGV   60

Query:   64 RIEEKDDQLVIEGQGFQGLNAPCQTLNMGNSGTSMRLIAGLLAGQPFSVKMIGDESLSKR  123
               IE+KD + ++G G GL AP   LNMGNSGTS+RLI+G+LAG  F V+M GD+SLSKR
Sbjct:   61 EIEDKDGVITVQGVGMAGLKAPQNALNMGNSGTSIRLISGVLAGADFEVEMFGDDSLSKR  120

Query:  124 PMDRIVYPLKQMGVEISGETDRQFPPLQLQGNRNLQPITYTLPISSAQVKSAILLAALQA  183
              PMDR+  PLK+MGV ISG+T+R  PPL+L+G +NL+PI Y LPI+SAQVKSA++ AALQA
Sbjct:  121 PMDRVTLPLKKMGVSISGQTERDLPPLRLKGTKNLRPIHYELPIASAQVKSALMFAALQA  180

Query:  184 KGTTQVVEKEITRNHTEEMIQQFGGRLIVDGKRITLVGPQQLTAQEITVPGDISSAAFWL  243
              KG  ++EKE TRNHTE+M+QQFGG L VDGK+IT+ GPQ+LT Q++ VPGDISSAAFWL
Sbjct:  181 KGESVIIEKEYTRNHTEDMLQQFGGHLSVDGKKITVQGPQKLTGQKVVVPGDISSAAFWL  240

Query:  244 VAGLIIPGSELLLKNVGVNPTRTGILEVVEKMGAQIVYEDMNKKEQVTSIRVVYSNMKGT  303
              VAGLI P S L+L+NVG+N TRTGI++V+  MG ++    +++    +  ++ V  S++KGT
Sbjct:  241 VAGLIAPNSRLVLQNVGINETRTGIIDVIRAMGGKLEITEIDPVAKSATLIVESSDLKGT  300

Query:  304 IISGGLIPRLIDELPIIALLATQAQGTTCIKDAQELRVKETDRIQVVTDILNSMGANIKA  363
                I G LIPRLIDELPIIALLATQAQG T  IKDA+EL+VKETDRIQVV D LNSMGA+I
Sbjct:  301 EICGALIPRLIDELPIIALLATQAQGVTVIKDAEELKVKETDRIQVVADALNSMGADITP  360

Query:  364 TADGMIIKGPTVLYGANTSTYGDHRIGMMTAIAALLVKQGQVHLDKEEAIMTSYPTFFKD  423
              TADGMIIKG + L+GA +T+GDHRIGMMTAIAALLV  G+V LD+ EAI TSYP+FF D
Sbjct:  361 TADGMIIKGKSALHGARVNTFGDHRIGMMTAIAALLVADGEVELDRAEAINTSYPSFFDD  420

Query:  424 LERLCH                                                       429
              LE L H
Sbjct:  421 LESLIH                                                       426
```

An alignment of the GAS and GBS proteins is shown below.

```
Identities = 269/424 (63%), Positives = 331/424 (77%)

Query:    5 MKLLTNANTLKGTIRVPGDKSISHRAIIFGSISQGVTRIVDVLRGEDVLSTIEAFKQMGV   64
              MKL TNA  L+GTI+VPGDKSISHRA+I G++++G TR+  +L+GEDVLSTI AF+ +GV
Sbjct:    4 MKLRTNAGPLQGTIQVPGDKSISHRAVILGAVAKGETRVKGLLKGEDVLSTIQAFRNLGV   63

Query:   65 LIEDDGEIITIYGKGFAGLTQPNNLLDMGNSGTSMRLIAGVLAGQEFEVTMVGDNSLSKR  124
                IE+ + + I G+GF GL  P   L+MGNSGTSMRLIAG+LAGQ F V M GD SLSKR
Sbjct:   64 RIEEKDDQLVIEGQGFQGLNAPCQTLNMGNSGTSMRLIAGLLAGQPFSVKMIGDESLSKR  123

Query:  125 PMDRIALPLSKMGARISGVTNRDLPPLKLQGTKKLKPIFYHLPVASAQVKSALIFAALQT  184
              PMDRI  PL +MG  ISG T+R  PPL+LQG + L+PI Y LP++SAQVKSA++ AALQ
Sbjct:  124 PMDRIVYPLKQMGVEISGETDRQFPPLQLQGNRNLQPITYTLPISSAQVKSAILLAALQA  183

Query:  185 KGESLIVEKEQTRNHTEDMIRQFGGHLDIKDKEIRLNGGQSLVGQDIRVPGDISSAAFWI  244
              KG + +VEKE TRNHTE+MI+QFGG L +   K I L G Q L  Q+I VPGDISSAAFW+
Sbjct:  184 KGTTQVVEKEITRNHTEEMIQQFGGRLIVDGKRITLVGPQQLTAQEITVPGDISSAAFWL  243

Query:  245 VAGLIIPNSHIILENVGINETRTGILDVVSKMGGKIKLSSVDNQVKSATLTVDYSHLQAT  304
              VAGLIIP S ++L+NVG+N TRTGIL+VV KMG +I    ++ + + ++ V YS+++ T
Sbjct:  244 VAGLIIPGSELLLKNVGVNPTRTGILEVVEKMGAQIVYEDMNKKEQVTSIRVVYSNMKGT  303

Query:  305 HISGAMIPRLIDELPIIALLATQAQGTTVIADAQELKVKETDRIQVVESLKQMGADITA  364
                ISG +IPRLIDELPIIALLATQAQGTT I DAQEL+VKETDRIQVV + L  MGA+I A
Sbjct:  304 IISGGLIPRLIDELPIIALLATQAQGTTCIKDAQELRVKETDRIQVVTDILNSMGANIKA  363

Query:  365 TADGMIIRGNTPLHAASLDCHGDHRIGMMIAIAALLVKEGEVDLSGEEAINTSYPNFLEH  424
              TADGMII+G T L+ A+    +GDHRIGMM AIAALLVK+G+V L  EEAI TSYP F +
Sbjct:  364 TADGMIIKGPTVLYGANTSTYGDHRIGMMTAIAALLVKQGQVHLDKEEAIMTSYPTFFKD  423

Query:  425 LEGL                                                         428
              LE L
Sbjct:  424 LERL                                                         427
```

Based on this analysis, it was predicted that these proteins and their epitopes could be useful antigens for vaccines or diagnostics.

EXAMPLE 1287

A DNA sequence (GBSx1364) was identified in *S. agalactiae* <SEQ ID 3959> which encodes the amino acid sequence <SEQ ID 3960>. Analysis of this protein sequence reveals the following:

```
Possible site: 38
>>> Seems to have an uncleavable N-term signal seq
     INTEGRAL     Likelihood = -1.12    Transmembrane    6-22 (6-22)

----- Final Results -----
             bacterial membrane --- Certainty = 0.1447(Affirmative) < succ>
             bacterial outside  --- Certainty = 0.0000(Not Clear)   < succ>
             bacterial cytoplasm --- Certainty = 0.0000(Not Clear)  < succ>
```

The protein has homology with the following sequences in the GENPEPT database.

```
>GP: AAF20148 GB: AF208390 actinin-like protein [Entamoeba
histolytica]
Identities = 62/236 (26%), Positives = 107/236 (45%), Gaps = 38/236 (16%)

Query: 144 NYNSTNSSNPESMLFYEKQLKTWLSTH----KNYYLDYK--VTPIYQNNELIPRKIELK-  196
           N N   + N +  +       L  W+++      N+  D+K  V  +      +I+ +
Sbjct: 116 NANQQKNVNAKEEVVENNALLDWVNSFGLNVSNFSSDWKDGVALVKLTEAVSAGQIKFEQ  175

Query: 197 YVGIDKTGKLLPIFIGNKSTQDQFGI------STVTLENTSPNATIDYLSGKAQN-----  245
           + G+D T ++        K   +QF I         +  E    P + + Y+S   +
Sbjct: 176 FSGLDNTQMVIDC---QKLAYEQFKIPILMDVKDLVCERPDPKSIMTYVSVYKERYEQLL  232

Query: 246 TVLSAKEQRKLIAKHEEEKRLAEK-----KVEEEKAAAETQKKL-EEEQARLAAEAQ-RK  298
               KE+++ IA+ E+E++  E+      + E+E+ A E Q++L  EEQ RLA E Q RK
Sbjct: 233 VEKEQKEEQERIAREEQERKQKEEQERLAREEQERLAREEQERLAREEQERLAREEQERK  292

Query: 299 QKEEQARLAAETQKKQETLVQEQTSQGYKRDYRGRWHRPNGQYASKAEIAAAGLQW      354
           QKEEQ RLA E Q++++    QE+ +Q              +P  Q  +  AA    W
Sbjct: 293 QKEEQERLAREEQERKQREEQERLNQ---------QQPTSQQLTFFSVQAAADAW      338
```

A related DNA sequence was identified in *S. pyogenes* <SEQ ID 3961> which encodes the amino acid sequence <SEQ ID 3962>. Analysis of this protein sequence reveals the following:

```
Possible site: 41
>>> Seems to have a cleavable N-term signal seq.

----- Final Results -----
             bacterial outside  --- Certainty = 0.3000(Affirmative) < succ>
             bacterial membrane --- Certainty = 0.0000(Not Clear)   < succ>
             bacterial cytoplasm --- Certainty = 0.0000(Not Clear)  < succ>
```

The protein has homology with the following sequences in the databases:

```
>GP: CAA03161 GB: A49208 unnamed protein product [Streptococcus
pyogenes]
Identities = 54/222 (24%), Positives = 93/222 (41%), Gaps = 39/222 (17%)

Query:  44 HYKNTVSSKLLP--FTANYQLQLGELDNLNRA-----TFSHIQLQDRHETKDVRTKINYD   96
           +YK   +S++ P   F     +   +LD L R      T ++  ++  +   +  K N +
Sbjct:  76 YYKTLGTSQITPALFPKAGDILYSKLDELGRTRTARGTLTYANVEGSYGVRQSFGK-NQN  134

Query:  97 PVGWHN------YQFPYGDG-SKSSWVMNRGHLVGYQFCGLNDEPRNLVAMTAWLNTGAY  149
           P GW        Y+  + +G  S        NR HL+     G    +  + + A   T
Sbjct: 135 PAGWTGNPNHVKYKIEWLNGLSYVGDFWNRSHLIADSLGG------DALRVNAVTGTRTQ  188
```

-continued

```
Query:  150 SGANDSNPEGMLYYENRLDSWLALHPDFWLDYKVTPIYSGNEVVPRQIELQYVGIDSSGE  209
             +          GM Y E R   WL  + D +L Y+V PIY+ +E++PR +
Sbjct:  189 NVGGRDQKGGMRYTEQRAQEWLEANRDGYLYYEVAPIYNADELIPRAV------------  236

Query:  210 LLTIRLNSNKESIDENGVTTVILENSAPNINLDYLNGTATPK                    251
             + + S+  +I+E      V++ N+A     ++Y NGT T K
Sbjct:  237 --VVSMQSSDNTINEK----VLVYNTANGYTINYHNGTPTQK                    272
```

An alignment of the GAS and GBS proteins is shown below.

```
Identities = 117/245 (47%), Positives = 166/245 (67%), Gaps = 4/245 (1%)

Query:    2 KRKQFIKLGIATLLTVISLYTPINLATNHTTENIVTAQEY--KTKENGTLPFKHKRQLVL   59
            K+K  +    + LL++         ++ A   T  N+   A  +    T  + LPF     QL L
Sbjct:    5 KQKASLLTAVLLLLSLSITTITVDAARVRTYPNVSHANTHYKNTVSSKLLPFTANYQLQL   64

Query:   60 GELDDKGRATFAHIQLKVKDEPKKKRVKRLKTTPVGWHNFKFYYNDGTQKAWLMSRGRLI  119
            GELD+  RATF+HIQL+ + E K  R K +    PVGWHN++F Y DG++ +W+M+RG L+
Sbjct:   65 GELDNLNRATFSHIQLQDRHETKDVRTK-INYDPVGWHNYQFPYGDGSKSSWVMNRGHLV  123

Query:  120 CHQFSGLNNERKNLVPMTNWLNTGNYNSTNSSNPESMLFYEKQLKTWLSTHKNYYLDYKV  179
              +QF GLN+E +NLV MT WLNTG Y+   N SNPE ML+YE +L +WL+ H  +++LDYKV
Sbjct:  124 GYQFCGLNDEPRNLVAMTAWLNTGAYSGANDSNPEGMLYYENRLDSWLALHPDFWLDYKV  183

Query:  180 TPIYQNNELIPRKIELKYVGIDKTGKLLPIFI-GNKSTQDQFGISTVTLENTSPNATIDY  238
            TPIY  NE++PR+IEL+YVGID +G+LL I +    NK + D+ G++TV LEN++PN   +DY
Sbjct:  184 TPIYSGNEVVPRQIELQYVGIDSSGELLTIRLNSNKESIDENGVTTVILENSAPNINLDY  243

Query:  239 LSGKA                                                         243
            L+G A
Sbjct:  244 LNGTA                                                         248
```

A related DNA sequence was identified in *S. pyogenes* <SEQ ID 7263> which encodes amino acid sequence <SEQ ID 7264>. An alignment of the GAS and GBS sequences follows:

```
Score = 58.9 bits (140), Expect = 2e-11
Identities = 34/103 (33%), Positives = 55/103 (53%), Gaps = 1/103 (0%)

Query:    1 MPFKTNLKAGILLYAMFMASIFLLVLQVYLSQVTALHKEYQAQTDYVKARLIAEIVYQD-   59
            M  K  LKAGILL A+ +A++F LVLQ YL+++ A   ++Y +Q +   KA L A++ Y+
Sbjct:    1 MILKKKLKAGILLQAIVLAAVFTLVLQFYLARILATERQYHSQIEASKAYLTAQLAYKTI   60

Query:   60 HRYKASNPVFFKGGQVICRERKERWMLIVKLDQQRQYQFEYLK                  102
                 S     +F GG          + V LD+    Y   ++ +
Sbjct:   61 EGDSISGKCYFTGGYASYLQEGNYLQVKVTLDKGGNYNHKFYR                  103
```

Based on this analysis, it was predicted that these proteins and their epitopes could be useful antigens for vaccines or diagnostics.

EXAMPLE 1288

A DNA sequence (GBSx1365) was identified in *S. agalactiae* <SEQ ID 3963> which encodes the amino acid sequence <SEQ ID 3964>. This protein is predicted to be enolase (eno). Analysis of this protein sequence reveals the following:

```
Possible site: 43
>>> Seems to have no N-terminal signal sequence

----- Final Results -----
            bacterial cytoplasm --- Certainty = 0.3025(Affirmative) < succ>
            bacterial membrane  --- Certainty = 0.0000(Not Clear)   < succ>
            bacterial outside   --- Certainty = 0.0000(Not Clear)   < succ>
```

The protein has homology with the following sequences in the GENPEPT database.

```
>GP: BAA81815 GB: AB029313 enolase [Streptococcus intermedius]
Identities = 396/435 (91%), Positives = 414/435 (95%), Gaps = 1/435 (0%)

Query:    1 MSIITDVYAREVLDSRGNPTLEVEVYTESGAFGRGMVPSGASTGEHEAVELRDGDKSRYG    60
            MSIITDVYAREVLDSRGNPTLEVEVYTESGAFGRGMVPSGASTGEHEAVELRDGDKSRYG
Sbjct:    1 MSIITDVYAREVLDSRGNPTLEVEVYTESGAFGRGMVPSGASTGEHEAVELRDGDKSRYG    60

Query:   61 GLGTQKAVDNVNNVIAEAIIGYDVRDQQAIDRAMIALDGTPNKGKLGANAILGVSIAVAR   120
            GLGTQKAVDNVNN+IAEA+IGYDVRDQQAIDRAMIALDGTPNKGKLGANAILGVSIAVAR
Sbjct:   61 GLGTQKAVDNVNNIIAEAVIGYDVRDQQAIDRAMIALDGTPNKGKLGANAILGVSIAVAR   120

Query:  121 AAADYLEVPLYSYLGGFNTKVLPTPMMNIINGGSHSDAPIAFQEFMIMPVGAPTFKEALR   180
            AAADYLE+PLYSYLGGFNTKVLPTPMMNIINGGSHSDAPIAFQEFMI+P GAPTFKEALR
Sbjct:  121 AAADYLEIPLYSYLGGFNTKVLPTPMMNIINGGSHSDAPIAFQEFMIVPAGAPTFKEALR   180

Query:  181 WGAEVFHALKKILKERGLETAVGDEGGFAPKFEGTEDGVETILKAIEAAGYEAGENGIMI   240
            WGAE+FHALKKILK RGL TAVGDEGGFAP+F+GTEDGVETIL AIEAAGY  G++ + +
Sbjct:  181 WGAEIFHALKKILKSRGLATAVGDEGGFAPRFDGTEDGVETILAAIEAAGYVPGKD-VFL   239

Query:  241 GFDCASSEFYDAERKVYDYSKFEGEGGAVRTAAEQIDYLEELVNKYPIITIEDGMDENDW   300
            GFDCASSEFYD ERKVYDY+KFEGEG AVRTA EQIDYLEELVNKYPIITIEDGMDENDW
Sbjct:  240 GFDCASSEFYDKERKVYDYTKFEGEGAAVRTADEQIDYLEELVNKYPIITIEDGMDENDW   299

Query:  301 DGWKALTERLGGRVQLVGDDFFVTNTDYLARGIKEEAANSILIKVNQIGTLTETFEAIEM   360
            DGWK LTERLG +VQ VGDDFFVTNT YL +GI E  ANSILIKVNQIGTLTETF+AIEM
Sbjct:  300 DGWKKLTERLGKKVQPVGDDFFVTNTSYLEKGINEACANSILIKVNQIGTLTETFDAIEM   359

Query:  361 AKEAGYTAVVSHRSGETEDSTIADIAVATNAGQIKTGSLSRTDRIAKYNQLLRIEDQLGE   420
            AKEAGYTAVVSHRSGETEDSTIADIAVA NAGQIKTGSLSRTDRIAKYNQLLRIEDQLGE
Sbjct:  360 AKEAGYTAVVSHRSGETEDSTIADIAVAANAGQIKTGSLSRTDRIAKYNQLLRIEDQLGE   419

Query:  421 VAQYKGIKSFYNLKK                                               435
            VA+Y+G+KSFYNL K
Sbjct:  420 VAEYRGLKSFYNLSK                                               434
```

Proteins in the glycolysis/gluconeogenesis pathway have been experimentally detected on the surface of *Streptococci*.

A related DNA sequence was identified in *S. pyogenes* <SEQ ID 3965> which encodes the amino acid sequence <SEQ ID 3966>. Analysis of this protein sequence reveals the following:

```
Possible site: 43
>>> Seems to have no N-terminal signal sequence

----- Final Results -----
         bacterial cytoplasm --- Certainty = 0.3025(Affirmative) < succ>
         bacterial membrane  --- Certainty = 0.0000(Not Clear)   < succ>
          bacterial outside  --- Certainty = 0.0000(Not Clear)   < succ>
```

The protein has homology with the following sequences in the databases:

```
>GP: BAA81815 GB: AB029313 enolase [Streptococcus intermedius]
Identities = 396/435 (91%), Positives = 415/435 (95%), Gaps = 1/435 (0%)

Query:    1 MSIITDVYAREVLDSRGNPTLEVEVYTESGAFGRGMVPSGASTGEHEAVELRDGDKSRYL    60
            MSIITDVYAREVLDSRGNPTLEVEVYTESGAFGRGMVPSGASTGEHEAVELRDGDKSRY
Sbjct:    1 MSIITDVYAREVLDSRGNPTLEVEVYTESGAFGRGMVPSGASTGEHEAVELRDGDKSRYG    60

Query:   61 GLGTQKAVDNVNNIIAEAIIGYDVRDQQAIDRAMIALDGTPNKGKLGANAILGVSIAVAR   120
            GLGTQKAVDNVNNIIAEA+IGYDVRDQQAIDRAMIALDGTPNKGKLGANAILGVSIAVAR
Sbjct:   61 GLGTQKAVDNVNNIIAEAVIGYDVRDQQAIDRAMIALDGTPNKGKLGANAILGVSIAVAR   120

Query:  121 AAADYLEVPLYTYLGGFNTKVLPTPMMNIINGGSHSDAPIAFQEFMIMPVGAPTFKEGLR   180
            AAADYLE+PLY+YLGGFNTKVLPTPMMNIINGGSHSDAPIAFQEFMI+P GAPTFKE LR
Sbjct:  121 AAADYLEIPLYSYLGGFNTKVLPTPMMNIINGGSHSDAPIAFQEFMIVPAGAPTFKEALR   180

Query:  181 WGAEVFHALKKILKERGLVTAVGDEGGFAPKFEGTEDGVETILKAIEAAGYEAGENGIMI   240
            WGAE+FHALKKILK RGL TAVGDEGGFAP+F+GTEDGVETIL AIEAAGY  G++ + +
Sbjct:  181 WGAEIFHALKKILKSRGLATAVGDEGGFAPRFDGTEDGVETILAAIEAAGYVPGKD-VFL   239
```

-continued
```
Query:  241 GFDCASSEFYDKERKVYDYTKFEGEGAAVRTSAEQVDYLEELVNKYPIITIEDGMDENDW  300
            GFDCASSEFYDKERKVYDYTKFEGEGAAVRT+ EQ+DYLEELVNKYPIITIEDGMDENDW
Sbjct:  240 GFDCASSEFYDKERKVYDYTKFEGEGAAVRTADEQIDYLEELVNKYPIITIEDGMDENDW  299

Query:  301 DGWKVLTERLGKRVQLVGDDFFVTNTEYLARGIKENAANSILIKVNQIGTLTETFEAIEM  360
            DGWK LTERLGK+VQ VGDDFFVTNT YL +GI E  ANSILIKVNQIGTLTETF+AIEM
Sbjct:  300 DGWKKLTERLGKKVQPVGDDFFVTNTSYLEKGINEACANSILIKVNQIGTLTETFDAIEM  359

Query:  361 AKEAGYTAVVSHRSGETEDSTIADIAVATNAGQIKTGSLSRTDRIAKYNQLLRIEDQLGE  420
            AKEAGYTAVVSHRSGETEDSTIADIAVA NAGQIKTGSLSRTDRIAKYNQLLRIEDQLGE
Sbjct:  360 AKEAGYTAVVSHRSGETEDSTIADIAVAANAGQIKTGSLSRTDRIAKYNQLLRIEDQLGE  419

Query:  421 VAQYKGIKSFYNLKK  435
            VA+Y+G+KSFYNL K
Sbjct:  420 VAEYRGLKSFYNLSK  434
```

An alignment of the GAS and GBS proteins is shown below.

```
Identities = 421/435 (96%), Positives = 427/435 (97%)

Query:    1 MSIITDVYAREVLDSRGNPTLEVEVYTESGAFGRGMVPSGASTGEHEAVELRDGDKSRYG   60
            MSIITDVYAREVLDSRGNPTLEVEVYTESGAFGRGMVPSGASTGEHEAVELRDGDKSRY
Sbjct:    1 MSIITDVYAREVLDSRGNPTLEVEVYTESGAFGRGMVPSGASTGEHEAVELRDGDKSRYL   60

Query:   61 GLGTQKAVDNVNNVIAEAIIGYDVRDQQAIDRAMIALDGTPNKGKLGANAILGVSIAVAR  120
            GLGTQKAVDNVNN+IAEAIIGYDVRDQQAIDRAMIALDGTPNKGKLGANAILGVSIAVAR
Sbjct:   61 GLGTQKAVDNVNNIIAEAIIGYDVRDQQAIDRAMIALDGTPNKGKLGANAILGVSIAVAR  120

Query:  121 AAADYLEVPLYSYLGGFNTKVLPTPMMNIINGGSHSDAPIAFQEFMIMPVGAPTFKEALR  180
            AAADYLEVPLY+YLGGFNTKVLPTPMMNIINGGSHSDAPIAFQEFMIMPVGAPTFKE LR
Sbjct:  121 AAADYLEVPLYTYLGGFNTKVLPTPMMNIINGGSHSDAPIAFQEFMIMPVGAPTFKEGLR  180

Query:  181 WGAEVFHALKKILKERGLETAVGDEGGFAPKFEGTEDGVETILKAIEAAGYEAGENGIMI  240
            WGAEVFHALKKILKERGL TAVGDEGGFAPKFEGTEDGVETILKAIEAAGYEAGENGIMI
Sbjct:  181 WGAEVFHALKKILKERGLVTAVGDEGGFAPKFEGTEDGVETILKAIEAAGYEAGENGIMI  240

Query:  241 GFDCASSEFYDAERKVYDYSKFEGEGGAVRTAAEQIDYLEELVNKYPIITIEDGMDENDW  300
            GFDCASSEFYD ERKVYDY+KFEGEG AVRT+AEQ+DYLEELVNKYPIITIEDGMDENDW
Sbjct:  241 GFDCASSEFYDKERKVYDYTKFEGEGAAVRTSAEQVDYLEELVNKYPIITIEDGMDENDW  300

Query:  301 DGWKALTERLGGRVQLVGDDFFVTNTDYLARGIKEEAANSILIKVNQIGTLTETFEAIEM  360
            DGWK LTERLG RVQLVGDDFFVTNT+YLARGIKE AANSILIKVNQIGTLTETFEAIEM
Sbjct:  301 DGWKVLTERLGKRVQLVGDDFFVTNTEYLARGIKENAANSILIKVNQIGTLTETFEAIEM  360

Query:  361 AKEAGYTAVVSHRSGETEDSTIADIAVATNAGQIKTGSLSRTDRIAKYNQLLRIEDQLGE  420
            AKEAGYTAVVSHRSGETEDSTIADIAVATNAGQIKTGSLSRTDRIAKYNQLLRIEDQLGE
Sbjct:  361 AKEAGYTAVVSHRSGETEDSTIADIAVATNAGQIKTGSLSRTDRIAKYNQLLRIEDQLGE  420

Query:  421 VAQYKGIKSFYNLKK  435
            VAQYKGIKSFYNLKK
Sbjct:  421 VAQYKGIKSFYNLKK  435
```

SEQ ID 3964 (GBS311) was expressed in *E. coli* as a His-fusion product. SDS-PAGE analysis of total cell extract is shown in FIG. 45 (lane 3; MW 51 kDa).

GBS311-His was purified as shown in FIG. 203, lane 10.

Based on this analysis, it was predicted that these proteins and their epitopes could be useful antigens for vaccines or diagnostics.

EXAMPLE 1289

A DNA sequence (GBSx1366) was identified in *S. agalactiae* <SEQ ID 3967> which encodes the amino acid sequence <SEQ ID 3968>. Analysis of this protein sequence reveals the following:

```
Possible site: 60
>>> Seems to have no N-terminal signal sequence

----- Final Results -----
          bacterial cytoplasm --- Certainty = 0.1998(Affirmative) < succ>
```

-continued
```
            bacterial membrane --- Certainty = 0.0000(Not Clear) < succ>
            bacterial outside  --- Certainty = 0.0000(Not Clear) < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1290

A DNA sequence (GBSx1367) was identified in *S. agalactiae* <SEQ ID 3969> which encodes the amino acid sequence <SEQ ID 3970>. This protein is predicted to be di-/tripeptide transporter. Analysis of this protein sequence reveals the following:

```
Possible site: 54
>>> Seems to have no N-terminal signal sequence
    INTEGRAL    Likelihood = -14.33   Transmembrane    93-109  (87-122)
    INTEGRAL    Likelihood =  -9.02   Transmembrane   117-133  (110-141)
    INTEGRAL    Likelihood =  -8.44   Transmembrane   333-349  (328-353)
    INTEGRAL    Likelihood =  -5.84   Transmembrane    19-35   (17-38)
    INTEGRAL    Likelihood =  -3.08   Transmembrane   151-167  (151-167)
    INTEGRAL    Likelihood =  -2.55   Transmembrane   264-280  (264-281)
    INTEGRAL    Likelihood =  -2.28   Transmembrane    44-60   (44-60)
    INTEGRAL    Likelihood =  -2.02   Transmembrane   238-254  (238-255)

----- Final Results -----
            bacterial membrane  --- Certainty = 0.6731(Affirmative) < succ>
            bacterial outside   --- Certainty = 0.0000(Not Clear)   < succ>
            bacterial cytoplasm --- Certainty = 0.0000(Not Clear)   < succ>
```

A related GBS nucleic acid sequence <SEQ ID 9395> which encodes amino acid sequence <SEQ ID 9396> was also identified.

The protein has homology with the following sequences in the GENPEPT database.

```
>GP: CAB12175 GB: Z99106 similar to di-tripeptide ABC transporter
(membrane protein) [Bacillus subtilis]
Identities = 175/359 (48%), Positives = 254/359 (70%), Gaps = 9/359 (2%)

Query:   1 MVGNLYGENDSRRDAGFSIFVFGINLGAFISPIVVGYLGQEVNFHLGFSLAAIGMFFGLL   60
           +VG+LY + D RRD+GFSIF  GINLG ++P++VG LGQ+ N+HLGF  AA+GM  GL+
Sbjct: 142 VVGDLYTKEDPRRDSGFSIFYMGINLGGLLAPLIVGTLGQKYNYHLGFGAAAVGMLLGLI  201

Query:  61 QYTLDGKKYLTEESLRPNDPLSPEEKSSLYKKVGLILIGIVIVLILLHLMHMLTIEVIID  120
           + L  KK L        +PLS  +KS++   +G+I++ I +++ +    +LTI+  ID
Sbjct: 202 VFPLTRKKNLGLAGSNVPNPLS--KKSAIGTGIGVIIVAIAVIISVQ--TGVLTIKRFID  257

Query: 121 IFSIIAIAIPIIYFIKILSSKKISSVERSRVWAYIPLFIASILFWSIEEQGSVVLALFAD  180
           + SI+ I IP+IYFI + +SKK    E+SR+ AY+PLFI +++FW+I+EQG+ +LA++AD
Sbjct: 258 LVSILGILIPVIYFIIMFTSKKADKTEKSRLAAYVPLFIGAVMFWAIQEQGATILAVYAD  317

Query: 181 EQTKLYLNFFGHHINFPSSYFQSMNPLFIMLYVPFFAWLWAKWGSKQPSSPKKFAYGLFF  240
           E+ +L L  F         SS+FQS+NPLF++++ P FAWLW K G +QPS+P KF+ G+
Sbjct: 318 ERIRLSLGGF----ELQSSWFQSLNPLFVVIFAPIFAWLWMKLGKRQPSTPVKFSIGIIL  373

Query: 241 AGASFLWMMLPGLLFGVNAKVSPLWLTMSWAIVIVGEMLISPVGLSATSKLAPKAFQAQM  300
            AG SF+ M+ P +  G  A VSPLWL +S+ +V++GE+  +SPVGLS  T+KLAP AF AQ
Sbjct: 374 AGLSFIIMVFPAMQ-GKEALVSPLWLVLSFLLVVLGELCLSPVGLSVTTKLAPAAFSAQT  432

Query: 301 MSIWFLSNAAAQAINAQIVKLYTPDTQTLYYGVVGGITVVFGFILLFYVPRIEKLMSGV  359
           MS+WFL+NAAAQAINAQ+  L+     +T+Y+G +G I++V G ILL   P I++ M GV
Sbjct: 433 MSMWFLTNAAAQAINAQVAGLFDRIPETMYFGTIGLISIVLGGILLLLSPVIKRAMKGV  491
```

No corresponding DNA sequence was identified in *S. pyogenes*.

Based on this analysis, it was predicted that these proteins and their epitopes could be useful antigens for vaccines or diagnostics.

EXAMPLE 1291

A DNA sequence (GBSx1369) was identified in *S. agalactiae* <SEQ ID 3971> which encodes the amino acid sequence <SEQ ID 3972>. Analysis of this protein sequence reveals the following:

```
Possible site: 37
>>> Seems to have an uncleavable N-term signal seq

----- Final Results -----
           bacterial membrane --- Certainty = 0.0000(Not Clear) < succ>
            bacterial outside --- Certainty = 0.0000(Not Clear) < succ>
           bacterial cytoplasm --- Certainty = 0.0000(Not Clear) < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1292

A DNA sequence (GBSx1370) was identified in *S. agalactiae* <SEQ ID 3973> which encodes the amino acid sequence <SEQ ID 3974>. Analysis of this protein sequence reveals the following:

```
Possible site: 30
>>> Seems to have no N-terminal signal sequence

----- Final Results -----
           bacterial cytoplasm --- Certainty = 0.2485(Affirmative) < succ>
            bacterial membrane --- Certainty = 0.0000(Not Clear)   < succ>
            bacterial outside  --- Certainty = 0.0000(Not Clear)   < succ>
```

The protein has homology with the following sequences in the GENPEPT database.

```
>GP: AAF61315 GB: U96166 unknown [Streptococcus cristatus]
Identities = 181/442 (40%), Positives = 270/442 (60%), Gaps = 2/442 (0%)

Query:   1 MINLFDSYTQSSWDLHFSLIKSGYINPTIALNDDGFLPDDVTSPYLYYTGFAKTGAGRPL   60
           MI LFD Y Q+S+DL  SL +G    P + + DDG+L  DV SPY Y+TG    T  GRP+
Sbjct:   1 MICLFDRYDQASFDLLRSLKATGLDCPVVVVQDDGYLSPDVESPYSYFTGDLDTPEGRPI   60

Query:  61 YYNELRVPDTWEIIGFSSGADIVDLGVKKGRIIYANPNHKRLIKEVDWFDEQGRVILKDR  120
           Y+N + P WEI    +I+D+G K+  I Y  P H+R ++ V+W D +G+V    D
Sbjct:  61 YFNLVPKPHLWEIRSSNVNGEILDMGKKRANIFYRQPTHERRVRAVEWLDTEGQVRAADI  120

Query: 121 FNKFGFCFAQTFYNADGQAIQTSYYNKDRQEVISENHMTGDYILNDNNQFKVFKSKVEFV  180
           +N+ G  FAQ Y+  +   T Y+++   VI ENH+TGD IL    +  +FKSK EFV
Sbjct: 121 YNRKGRLFAQITYDQTQRPTHTRYFDQSNVVVIMENHLTGDIILTLEGKRHIFKSKQEFV  180

Query: 181 INYLQEAKFNLDRIFYNSLSTPFLVSFYL--NRLESKDVLFWQEPLVDDIPGNMRLLLNN  238
            + YLQ   ++ DRI YNSL+TPFLV++  L       ++DVLFWQEP+ +PGNM++ +
Sbjct: 181 VFYLQYRGYDTDRIIYNSLATPFLVAYALRPKNGRAEDVLFWQEPIGEALPGNMKVAMKM  240

Query: 239 PSPNTKIVIQSYEAYANAMRLLTDEEQKQVSFLGFMYPLKETEKLHNQALILTNSDQIEA  298
            P  N +I +Q  + Y      L T EE+     +G++Y +     ++ +ALILTNSDQ+E
Sbjct: 241 PHRNIRIAVQDRQVYEKIQSLATPEEKVYFHNIGYIYDYQRLNNMNPEALILTNSDQLEQ  300

Query: 299 LESLVTSLPNLTFNIGALTEMSSDLMNFGKYDNVVLYPNITTNQIQYLSNICAFYLDINH  358
           +E L+T LPN+ F+IGA+TEMS   LM   +Y NV LYPNI    ++     L   C   YLDIN
```

-continued

```
Sbjct: 301 IEQLLTQLPNVHFHIGAITEMSGHLMGLNRYPNVSLYPNIRPAKVAELFERCDLYLDINI 360

Query: 359 HNEILSAVRSAFEHQQLIFAFEETSHQIRFVSPKNIFPKKDIFTFISHLQPLIGNKCNIE 418
           +EIL+A R+AFE+  LI +F  T H  RF++  +I+  +++     + +Q + +    +E
Sbjct: 361 SDEILNACRTAFENNMLILSFTNTCHSRRFIADDHIYAPENVSGMVDKIQSALAHSSEME 420

Query: 419 KALKQQLEDCHVSSSTQYQSVI                                       440
            AL +Q +   + +S  QY+++I
Sbjct: 421 AALTRQKQAANQASLEQYKAII                                       442
```

No corresponding DNA sequence was identified in *S. pyogenes*.

Based on this analysis, it was predicted that this protein and its epitopes, could be useful antigens for vaccines or diagnostics.

EXAMPLE 1293

A DNA sequence (GBSx1371) was identified in *S. agalactiae* <SEQ ID 3975> which encodes the amino acid sequence <SEQ ID 3976>. Analysis of this protein sequence reveals the following:

```
Possible site: 22
>>> Seems to have no N-terminal signal sequence
    INTEGRAL    Likelihood = -0.06    Transmembrane    405-421 (404-422)

----- Final Results -----
            bacterial membrane --- Certainty = 0.1022(Affirmative) < succ>
            bacterial outside  --- Certainty = 0.0000(Not Clear)   < succ>
           bacterial cytoplasm --- Certainty = 0.0000(Not Clear)   < succ>
```

The protein has homology with the following sequences in the GENPEPT database.

```
>GP: BAA94320 GB: AB033763 hypothetical protein [Staphylococcus
aureus]
Identities = 66/195 (33%), Positives = 99/195 (49%), Gaps = 9/195 (4%)

Query: 259 NYYDYQFTNANRFDFFITSTDKQTELLEQQFKQFTNHNPRIITIPVGSID----NLKMPM 314
            N Y + F N NR+   I ST +Q   +       N+   + TIPVG ID     NLK
Sbjct:  15 NTYKHVFNNLNRYSGIIVSTKQQ----QLDISARINNEIPVHTIPVGYIDEHFTNLKRNN  70

Query: 315 DNRRPYSILTASRLASEKHVDWLVRAVIRIREILPEVTFDIYGSGGEEEKIRNIINAANA 374
           +         I++ +R + EK ++  +  V ++ +   P +    +YG G EEEK + +I   N
Sbjct:  71 HSINNNKIISVARYSPEKQLNHQIELVSKLIKEFPNIRLHLYGFGKEEEKYKQLITEYNL 130

Query: 375 TEYIRLMG-HKNLSNVYQNYELYLTASKSEGFGLTLLEAIGAGLPLIGFDVRYGNQTFIK 433
                 + L G  +NLS   Q+  + L  S   EGF L LLE I  G+P +G++ +YG      I
Sbjct: 131 ENNVFLRGFRRNLSAEIQDAYMSLITSNMEGFNLGLLETITEGIPPVGYNSKYGPSELIL 190

Query: 434 DGENGYLIPRFDMDD                                              448
            + ENGYLI + D D+
Sbjct: 191 NNENGYLINKNDKDE                                              205
```

SEQ ID 3976 (GBS426) was expressed in *E. coli* as a His-fusion product. SDS-PAGE analysis of total cell extract is shown in FIG. 80 (lane 4; MW 58.8 kDa). It was also expressed in *E. coli* as a GST-fusion product. SDS-PAGE analysis of total cell extract is shown in FIG. 173 (lane 3; MW 84 kDa).

GBS426-GST was purified as shown in FIG. 220, lane 5.

Based on this analysis, it was predicted that this protein and its epitopes, could be useful antigens for vaccines or diagnostics.

EXAMPLE 1294

A DNA sequence (GBSx1372) was identified in *S. agalactiae* <SEQ ID 3977> which encodes the amino acid sequence <SEQ ID 3978>. This protein is predicted to be preprotein translocase seca subunit (secA). Analysis of this protein sequence reveals the following:

```
Possible site: 42
>>> Seems to have no N-terminal signal sequence
     INTEGRAL      Likelihood = -0.69     Transmembrane    75-91 (75-91)

----- Final Results -----
               bacterial membrane --- Certainty = 0.1277(Affirmative) < succ>
               bacterial outside  --- Certainty = 0.0000(Not Clear)   < succ>
               bacterial cytoplasm --- Certainty = 0.0000(Not Clear)   < succ>
```

The protein has homology with the following sequences in the GENPEPT database.

```
>GP: AAC44957 GB: U56901 involved in protein export [Bacillus subtilis]
Identities = 336/794 (42%), Positives = 506/794 (63%), Gaps = 29/794 (3%)

Query:   5 NSLFSLDKKRLKKLQRTLNTINSLKGQMATLSNEELQAKTTEFRKRLVNGETLDDICAEA    64
           N +F   K+ L + ++  N I++++G    LS++ L+ KT EF++RL  G T DD+  EA
Sbjct:   6 NKMFDPTKRTLNRYEKIANDIDAIRGDYENLSDDALKHKTIEFKERLEKGATTDDLLVEA    65

Query:  65 FAVVREADERVLGLFPYDVQVIGGLVLHQGNTAEMKTGEGKTLTATMPLYLNALEGKGAM   124
           FAVVREA  RV G+FP+ VQ++GG+ LH GN AEMKTGEGKTLT+T+P+YLNAL GKG
Sbjct:  66 FAVVREASRRVTGMFPFKVQLMGGVALHDGNIAEMKTGEGKTLTSTLPVYLNALTGKGVH   125

Query: 125 LLTNNSYLAIRDAEEMGKVYRFLGLSVGVGVSDNEEEDRDAATKRAVYSSDIVYSTSSAL   184
           ++T N YLA RDAE+MGK++ FLGL+VG+ ++     +++    KR  Y++DI YST++ L
Sbjct: 126 VVTVNEYLASRDAEQMGKIFEFLGLTVGLNLNSMSKDE-----KREAYAADITYSTNNEL   180

Query: 185 GFDYLIDNLASSKSQKYMPKLHYAIVDEADAVLLDMAQTPLVISGSPRVQSNLYKIADEL   244
           GFDYL DN+   K Q    LH+A++DE D++L+D A+TPL+ISG    + LY   A+
Sbjct: 181 GFDYLRDNMVLYKEQMVQRPLHFAVIDEVDSILIDEARTPLIISGQAAKSTKLYVQANAF   240

Query: 245 ILSFEEQVDYYFDKERQEVWIKNQGVREAERYFRIPHFYKQSNRELVRHLNLSLKAHKLF   304
             + + + DY +D + + V +   +G+ +AE+ F I + +     L  H+N +LKAH
Sbjct: 241 VRTLKAEKDYTYDIKTKAVQLTEEGMTKAEKAFGIDNLFDVKHVALNHHINQALKAHVAM   300

Query: 305 ERGKDYVVDDGEIKLLDATNGRVLEGTKLQGGVHQAIEQKEHLNVTPESRAMASITYQNL   364
           ++   DYVV+DG++  ++D+  GR+++G +   G+HQAIE KE L +  ES  +A+IT+QN
Sbjct: 301 QKDVDYVVVEDGQVVIVDSFTGRLMKGRRYSEGLHQAIEAKEGLEIQNESMTLATITFQNY   360

Query: 365 FRMFTKLAGMTGTGKTAEKEFIEVYDMEVVRIPTNSPVRRIDYPDKIYTTLPEKIHATIE   424
           FRM+ KLAGMTGT KT E+EF +Y+M+VV IPTN PV R D PD IY T+ K  A E
Sbjct: 361 FRMYEKLAGMTGTAKTEEEEFRNIYNMQVVTIPTNRPVVRDDRPDLIYRTMEGKFKAVAE   420

Query: 425 FVKQVHDTGQPILLVAGSVRMSELFSELLLLSGIPHSLLNAQSAVKEAQMIAEAGQKGAV   484
            V Q + TGQP+L++  +V  SEL S+LL   GIPH +LNA++  +EAQ+I EAGQKGAV
Sbjct: 421 DVAQRYMTGQPVLVGTVAVETSELISKLLKNKGIPHQVLNAKNHEREAQIIEEAGQKGAV   480

Query: 485 TVATNMAGRGTDIKLGKGVSELGGLAVIGTERMKSQRMDLQLRGRSGRQGDIGFSQFFVS   544
           T+ATNMAGRGTDIKLG+GV ELGGLAV+GTER +S+R+D QLRGRSGRQGD G +QF++S
Sbjct: 481 TIATNMAGRGTDIKLGEGVKELGGLAVVGTERHESRRIDNQLRGRSGRQGDPGITQFYLS   540

Query: 545 FEDDLMIESGPKWAQDYFRKNRDKVNPEKPKALGQRRFQKLFQQTQEASDGKGESARSQT   604
            ED+LM   G +       D+   +    + + +++ +Q+    +G      +R Q
Sbjct: 541 MEDELMRRFGAERTMAML----DRFGMDDSTPIQSKMVSRAVESSQKRVEGNNFDSRKQL   596

Query: 605 IEFDSSVQLQREYVYRERNALINGESGHFSPRQIIDTVISSFI-----AYLDGEVEKEEL   659
           +++D  ++ QRE +Y++R  +I+ E    + R+I++  +I S +      AY  E   EE
Sbjct: 597 LQYDDVLRQQREVIYKQRFEVIDSE----NLREIVENMIKSSLERAIAAYTPREELPEE-   651

Query: 660 IFEVNRFI-FDNMSYNLQGISKEMSL--EEIKNYLFKIADEILREKHNLLGDSFG-----   711
           +++ +   +   N +Y +G  ++  +  +E  L   I  DI+ K+N   + FG
Sbjct: 652 -WKLDGLVDLINTTYLDEGALEKSDIFGKEPDEMLELIMDRII-TKYNEKEEQFGKEQMR   709

Query: 712 DFERTAALKAIDEAWIEEVDYLQQLRTVATARQTAQRNPVFEYHKEAYKSYNIMKKEIRE   771
            +FE+   L+A+D W++ +D + QLR   R  AQ NP+ EY  E  +  M + I +
Sbjct: 710 EFEKVIVLRAVDSKWMDHIDAMDQLRQGIHLRAYAQTNPLREYQMEGFAMFEHMIESIED   769
```

```
Query:  772 QTFRNLLLSEVSFN                                                    785
            +  + ++ +E+  N
Sbjct:  770 EVAKFVMKAEIENN                                                    783
```

There is also homology to SEQ ID 3620.

SEQ ID 3978 (GBS425) was expressed in *E. coli* as a His-fusion product. SDS-PAGE analysis of total cell extract is shown in FIG. 80 (lane 3; MW 91 kDa). It was also expressed in *E. coli* as a GST-fusion product. SDS-PAGE analysis of total cell extract is shown in FIG. 173 (lane 2; MW 116 kDa).

GBS425-GST was purified as shown in FIG. 220, lane 4.

Based on this analysis, it was predicted that this protein and its epitopes, could be useful antigens for vaccines or diagnostics.

EXAMPLE 1295

A DNA sequence (GBSx1373) was identified in *S. agalactiae* <SEQ ID 3979> which encodes the amino acid sequence <SEQ ID 3980>. Analysis of this protein sequence reveals the following:

```
Possible site: 43
>>> Seems to have no N-terminal signal sequence

----- Final Results -----
            bacterial cytoplasm --- Certainty = 0.3827(Affirmative) < succ>
            bacterial membrane  --- Certainty = 0.0000(Not Clear)   < succ>
            bacterial outside   --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1296

A DNA sequence (GBSx1374) was identified in *S. agalactiae* <SEQ ID 3981> which encodes the amino acid sequence <SEQ ID 3982>. Analysis of this protein sequence reveals the following:

```
Possible site: 17
>>> Seems to have no N-terminal signal sequence

----- Final Results -----
            bacterial Cytoplasm --- Certainty = 0.2683(Affirmative) < succ>
            bacterial membrane  --- Certainty = 0.0000(Not Clear)   < succ>
            bacterial outside   --- Certainty = 0.0000(Not Clear)   < succ>
```

A related GBS nucleic acid sequence <SEQ ID 10001> which encodes amino acid sequence <SEQ ID 10002> was also identified.

The protein has no significant homology with any sequences in the GENPEPT database.

No corresponding DNA sequence was identified in *S. pyogenes*.

Based on this analysis, it was predicted that these proteins and their epitopes could be useful antigens for vaccines or diagnostics.

EXAMPLE 1297

A DNA sequence (GBSx1375) was identified in *S. agalactiae* <SEQ ID 3983> which encodes the amino acid sequence <SEQ ID 3984>. Analysis of this protein sequence reveals the following:

```
Possible site: 31
>>> Seems to have no N-terminal signal sequence

----- Final Results -----
            bacterial cytoplasm --- Certainty = 0.5410 (Affirmative) < succ>
            bacterial membrane  --- Certainty = 0.0000 (Not Clear)   < succ>
            bacterial outside   --- Certainty = 0.0000 (Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1298

A DNA sequence (GBSx1376) was identified in *S. agalactiae* <SEQ ID 3985> which encodes the amino acid sequence <SEQ ID 3986>. This protein is predicted to be preprotein translocase secy subunit. Analysis of this protein sequence reveals the following:

```
Possible site: 59
>>> Seems to have an uncleavable N-term signal seq
    INTEGRAL    Likelihood = -9.92    Transmembrane    287-303 (278-309)
    INTEGRAL    Likelihood = -9.08    Transmembrane    191-207 (186-210)
    INTEGRAL    Likelihood = -8.44    Transmembrane    104-120 (101-123)
    INTEGRAL    Likelihood = -8.23    Transmembrane     11-27  (9-41)
    INTEGRAL    Likelihood = -3.93    Transmembrane    133-149 (129-150)
    INTEGRAL    Likelihood = -3.19    Transmembrane    347-363 (344-364)
    INTEGRAL    Likelihood = -2.97    Transmembrane    158-174 (155-174)
    INTEGRAL    Likelihood = -1.54    Transmembrane    246-262 (245-262)
    INTEGRAL    Likelihood = -0.90    Transmembrane    372-388 (372-388)
    INTEGRAL    Likelihood = -0.85    Transmembrane     64-80  (64-81)

----- Final Results -----
            bacterial membrane  --- Certainty = 0.4970 (Affirmative) < succ>
            bacterial outside   --- Certainty = 0.0000 (Not Clear)   < succ>
            bacterial cytoplasm --- Certainty = 0.0000 (Not Clear)   < succ>
```

The protein has homology with the following sequences in the GENPEPT database.

```
>GP:AAF30659 GB:AE002122 preprotein translocase [Ureaplasma urealyticum]
Identities = 105/422 (24%), Positives = 213/422 (49%), Gaps = 49/422 (11%)

Query:    2 KLLYIFEKNIILRKILITFSLIIIFLLGRYVPIPGVLISAYKGQDNNFATLYSTVTGGNL    61
            +LL IF+   +L  +++T S++I+F +G  +P+P + ++     G   +F ++ + + GG L
Sbjct:   13 QLLMIFKNKKVLVALIVTLSILILFRIGSVIPMPYIKLNGNFGNQGSFFSIINLLGGGGL    72

Query:   62 SQVGVFSLGIGPMMTTMILLRLFT---------IGKYSSGVSQKVQQFRQNVVMLVIAII   112
            SQ  +F++GIGP +T  I+++L +          + K     +K++    + ++ L +A++
Sbjct:   73 SQFSLFAIGIGPYITAQIIMQLLSSELVPPLAKLSKSGERGRKKIEVITR-IITLPLAVM   131

Query:  113 QGLAITISFQYHNGFSL----------TKLLLATMI--LVTGAYIISWIGNLNAEYGFG-   159
            Q + I      NGF             + L   T I  +V G YI  ++ +L ++ G G
Sbjct:  132 QAVIIINLMTRANGFISIVSNAPFAIGSPLFYVTYIFLMVGGTYISLFLADLISKKGVGN   191

Query:  160 GMTILVVVGMLVGQFNNIPLIFELF------QDGYQLAIILFLLWTLVAMYLMITFERSE   213
            G+T+L++  G++     FN+   IF        +   +  IL++L+ ++ +  ++     S
Sbjct:  192 GITLLILTGIVASLFNHFIAIFSNLGSLTSSKVSQIIGFILYILFYIMILIGVVFVNNST   251
```

-continued

```
Query:  214 YRIPVMRTS-----IHNRLVDDAYMPIKVNASGGMAFMYVYTLLMFPQYIIILLRSIFPT 268
            +IPV +T        H +L    ++PIK+  +G M   ++  ++L  P   +      L
Sbjct:  252 RKIPVQQTGQALILDHEKL---PFLPIKIMTAGVMPVIFASSVLAIPAQVAEFLDK---Q 305

Query:  269 NPDITSYNDYFSLSSIQGVVIYMILMLVLSVAFTFVNIDPTKISEAMRESGDFIPNYRPG 328
            +       ++YF + S  G+ IY++L+L+ +   F++V ++P K++E ++++G FIP  + G
Sbjct:  306 SMGYYVIHNYFIVDSWTGLAIYVVLILLFTFFFSYVQLNPPKMAEDIKKAGRFIPGVQVG 365

Query:  329 KETQSYLSKICYLFGTFSGFFMAFLGGVPLLFALGNDDLR---------TVSSMTGIFMM 379
            +T+ +++K+ Y       +AFL  +P L AL   +          T+    T I +M
Sbjct:  366 MDTEKHITKVIYRVNWIGAPILAFLACLPHLVALVAKTINHGIPVIQPSTIFGGTSIIIM 425

Query:  380 IT                                                          381
            +T
Sbjct:  426 VT                                                          427
```

15

There is also homology to SEQ ID 3988.

A related GBS gene <SEQ ID 8783> and protein <SEQ ID 8784> were also identified. Analysis of this protein sequence reveals the following:

```
Lipop: Possible site: -1 Crend: 8
McG: Discrim Score: 6.32
GvH: Signal Score (-7.5): -4.07
Possible site: 59
>>> Seems to have an uncleavable N-term signal seq
ALOM program count: 10 value: -9.92 threshold: 0.0
     INTEGRAL    Likelihood = -9.92    Transmembrane   287-303 (278-309)
     INTEGRAL    Likelihood = -9.08    Transmembrane   191-207 (186-210)
     INTEGRAL    Likelihood = -8.44    Transmembrane   104-120 (101-123)
     INTEGRAL    Likelihood = -8.23    Transmembrane    11-27  (9-41)
     INTEGRAL    Likelihood = -3.93    Transmembrane   133-149 (129-150)
     INTEGRAL    Likelihood = -3.19    Transmembrane   347-363 (344-364)
     INTEGRAL    Likelihood = -2.97    Transmembrane   158-174 (155-174)
     INTEGRAL    Likelihood = -1.54    Transmembrane   246-262 (245-262)
     INTEGRAL    Likelihood = -0.90    Transmembrane   372-388 (372-388)
     INTEGRAL    Likelihood = -0.85    Transmembrane    64-80  (64-81)
PERIPHERAL   Likelihood = -8.65                           28
modified ALOM score: 2.48

*** Reasoning Step: 3

----- Final Results -----
              bacterial membrane --- Certainty = 0.4970 (Affirmative) < succ>
               bacterial outside --- Certainty = 0.0000 (Not Clear)   < succ>
             bacterial cytoplasm --- Certainty = 0.0000 (Not Clear)   < succ>
```

The protein has homology with the following sequences in the databases:

```
ORF02350(316-1500 of 1827)
EGAD|6621|6420(8-426 of 431) preprotein translocase secy subunit {Bacillus sp.}
SP|P38375|SECY_BACHD PREPROTEIN TRANSLOCASE SECY SUBUNIT.
GP|484251|dbj|BAA01191.1||D10360 secretion protein Y {Bacillus sp.} PIR|B44859|B44859
preprotein translocase secY-Bacillus sp.
% Match = 12.1
% Identity = 26.8   % Similarity = 55.4
Matches = 109   Mismatches = 165   Conservative Sub.s = 116

57        87        117       147       177       207       237       267
EVWNVVDRCITEGKTIYGIRRARKDNQYISFERTMDDFEYLCDTIKQNR*SRRVMVT*ILKSIFLILKLTKLTI*SYLS*

297       327       357       387              441       471       501
REQIDREREIPLKLLYIFEKNIILRKILITFSLIIIFLLGRYVPIPGV--LISAYKGQDNNFATLYSTVTGGNLSQVGVF
                  ||    :   ||::  |: :  |:|  : |  ::|||    :     |    ||     :|
              MFRTISNIFRVGDLRRKVIFTLLMLIVFRIGSFIPVPGTNREVLDFVDQANAFGFL-NTFGGGALGNFSIF
                       10        20        30        40        50        60        70

531       582       594       624       654       681       699
SLGIGPMMTTMILLRLF---TIGKYSSGVSQ------KVQQFRQNVVMLVIAIIQGLAITISPQ-YHNGF----SLTKLL
::|| |  :|    |:::|     :  |::              |:   ::||   || |:::      |:    |:|      |
AMGIMPYITASIVMQLLQMDVVPKFAEWAKEGEAGRRKLAQFTRYGTIVVLGFIQALGMSVGFNNFFPGLIPNPSVSVYL
            80        90       100       110       120       130       140       150

729       759       786       816       846       870       888       918
LATMILTVGAYIISWIGNLNAEYGFG-GMTILVVVGMLVGQFNNIPLIFEL-FQD-GYQL----AIILFLLWTLVAMYLM
:  ::|    |   : |:|     |||   | | |::|:  |:  |     |  ||  ||     :||  |      ::|:  :
FIALVLTAGTAFLMWLGEQITAKGVGNGISIIIFAGIAAGIPNGLNLIYSTRIQDAGEQLFLNIVVILLLALAILAIIVG
           160       170       180       190       200       210       220       230
```

-continued

```
966            1023       1053         1083       1113       1143
ITFERSEYR-IPVM---RTSIHNRLVDDA-YMPIKVNASGGMAFMYVYTLLMFPQYIIILLRSIFPTNPDITSYNDYFSL
: |    :   |  |||    |    |   :   :  ::| :|||| |  :   ::   :||:||   :   |:   |    :     ||
VIFVQQALRKIPVQYAKRLVGRNPVGGQSTHLPLKVNAAGVIPVIFALSLLIFPPTVAGLFGSDHPVAAWVIETFDY---
          240       250        260         270       280        290         300

1173       1203       1233        1263        1293       1323        1353       1383
SSIQGVVIYMILMLVLSVAFTFVNIDPTKISEAMRESGDFIPNYRPGKETQSYLSKICYLFGTFSGFFMAFLGGVPLLFA
: : |:  :|   | : :| | :: ::   |   :  | :::|   :::   :  ||    ||||   ||:::   |  |:      :|:|  :     :|::|
THLIGMAVYALRIIGFTYFYAFIQVNPERMAENLKKQGGYIPGIRPGKATQTYITPILYRLTFVGSLFLAVVAILPVFF-
          320       330        340         350       360        370         380

1413       1440       1470        1500        1530       1560        1590       1620
LGNDDLRTVSSMTGI-FMMITGMSFMILDEFQVIRIRKQYTSVFENEEN*CFILFHLGIMKIVLGMIIITCGISSRLMSV
:   ||     :  |    ::::  |:::    :  :      |:: |
IKFADLPQAIQIGGTGLLIVVGVALDTMKQIEAQLIKRSYKGFIK
          400       410        420         430
```

Based on this analysis, it was predicted that these proteins and their epitopes could be useful antigens for vaccines or diagnostics.

EXAMPLE 1299

A DNA sequence (GBSx1377) was identified in *S. agalactiae* <SEQ ID 3989> which encodes the amino acid sequence <SEQ ID 3990>. Analysis of this protein sequence reveals the following:

```
Possible site: 24
>>> Seems to have no N-terminal signal sequence

----- Final Results -----
          bacterial cytoplasm --- Certainty = 0.3002 (Affirmative) < succ>
          bacterial membrane  --- Certainty = 0.0000 (Not Clear)   < succ>
           bacterial outside  --- Certainty = 0.0000 (Not Clear)   < succ>
```

The protein has homology with the following sequences in the GENPEPT database.

```
>GP:AAF61315 GB:U96166 unknown [Streptococcus cristatus]
Identities = 30/78 (38%), Positives = 41/78 (52%)

Query:  276 ALTVTLTDDIWELEHLLQRCPNTDFHIAAPVYCSDRLKQLVGYPNYYLHEAITEEQFEVL  335
            AL +T +D + ++E LL + PN  FHI A     S  L  L  YPN  L+  I  +    L
Sbjct:  289 ALILTNSDQLEQIEQLLTQLPNVHFHIGAITEMSGHLMGLNRYPNVSLYPNIRPAKVAEL  348

Query:  336 LLNSDIYLDINHGEEVWN                                           353
            D+YLDIN  +E+ N
Sbjct:  349 FERCDLYLDINISDEILN                                           366
```

No corresponding DNA sequence was identified in *S. pyogenes*.

Based on this analysis, it was predicted that this protein and its epitopes, could be useful antigens for vaccines or diagnostics.

EXAMPLE 1300

A DNA sequence (GBSx1378) was identified in *S. agalactiae* <SEQ ID 3991> which encodes the amino acid sequence <SEQ ID 3992>. This protein is predicted to be eps7. Analysis of this protein sequence reveals the following:

```
Possible site: 19
>>> May be a lipoprotein

----- Final Results -----
           bacterial membrane  --- Certainty = 0.0000 (Not Clear) < succ>
            bacterial outside  --- Certainty = 0.0000 (Not Clear) < succ>
          bacterial cytoplasm  --- Certainty = 0.0000 (Not Clear) < succ>
```

The protein has homology with the following sequences in the GENPEPT database.

```
>GP:CAC07458 GB:AX009404 product = eps7 [Streptococcus thermophilus]
Identities = 87/232 (37%), Positives = 133/232 (56%), Gaps = 22/232 (9%)

Query:    10 VSVIIPVYNAAPYLEGCVNTILGQTYQVFEILLIDDGSTDTSASICDQLSLRDNRIRVFH    69
             +S++IPVYN   Y++ C+++IL QT+    EI+L+DDGSTD S   ICD  S   D RI+V H
Sbjct:     3 ISIVIPVYNVQDYIKKCLDSILSQTFSDLEIILVDDGSTDLSGRICDYYSENDKRIKVIH    62

Query:    70 IENGGASRARNFGLARISPESQFVTFVDSDDWVKENYLEVLLAQQEKYNADIVISNYYIY   129
             NGG S+ARN G+   +  S+++TF+DSDD+V  +Y+E L    + +NADI I+++
Sbjct:    63 TANGGQSEARNVGIKNAT--SEWITFIDSDDYVSSDYIEYLYNLIQVHNADISIASF---   117

Query:   130 RETEDIFGYYITDKDFV------IEEISAQTAIDRQVHWHLNSSVFIVIWGKLYRRELFD   183
                         YIT K +      +  + A+TAI R +   LN    + +WGK+YR E F+
Sbjct:   118 --------TYITPKKIIKHGNGEVALMDAKTAIRRML---LNEGFDMGVWGKMYRTEYFN   166

Query:   184 TITFPIDKVFEDELVSVLLFIKSKKTILVNGSYYGYRIRPNSIMTSAFSSKR          235
               F    K+FED L++  +F ++   +        Y Y  R NS +   F+ K+
Sbjct:   167 KYKFVSGKLFEDSLITYQIFSEASTIVFGAKDIYFYVNRKNSTVNGTFNIKK          218
```

Based on this analysis, it was predicted that this protein and its epitopes, could be useful antigens for vaccines or diagnostics.

EXAMPLE 1301

A DNA sequence (GBSx1379) was identified in *S. agalactiae* <SEQ ID 3993> which encodes the amino acid sequence <SEQ ID 3994>. Analysis of this protein sequence reveals the following:

```
Possible site: 14
>>> Seems to have no N-terminal signal sequence

----- Final Results -----
         bacterial cytoplasm --- Certainty = 0.1569 (Affirmative) < succ>
         bacterial membrane  --- Certainty = 0.0000 (Not Clear)  < succ>
         bacterial outside   --- Certainty = 0.0000 (Not Clear)  < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1302

A DNA sequence (GBSx1380) was identified in *S. agalactiae* <SEQ ID 3995> which encodes the amino acid sequence <SEQ ID 3996>. Analysis of this protein sequence reveals the following:

```
Possible site: 26
>>> Seems to have no N-terminal signal sequence

----- Final Results -----
         bacterial cytoplasm --- Certainty = 0.1662 (Affirmative) < succ>
         bacterial membrane  --- Certainty = 0.0000 (Not Clear)  < succ>
         bacterial outside   --- Certainty = 0.0000 (Not Clear)  < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1303

A DNA sequence (GBSx1381) was identified in *S. agalactiae* <SEQ ID 3997> which encodes the amino acid sequence <SEQ ID 3998>. This protein is predicted to be a glycosyl transferase (gspA). Analysis of this protein sequence reveals the following:

```
Possible site: 13
>>> Seems to have no N-terminal signal sequence

----- Final Results -----
            bacterial cytoplasm --- Certainty = 0.2606(Affirmative) < succ>
            bacterial membrane  --- Certainty = 0.0000(Not Clear)   < succ>
             bacterial outside  --- Certainty = 0.0000(Not Clear)   < succ>
```

The protein has homology with the following sequences in the GENPEPT database.

```
>GP: AAF28363 GB: AF224467 putative glycosyl transferase [Haemophilus
ducreyi]
Identities = 62/177 (35%), Positives = 105/177 (59%), Gaps = 8/177 (4%)

Query:   3 YARYYIPQLIDAEKVLYLDIDTLVVDNLDKLFEIELGDYPIAAILD--GDGIY-----FN    55
           + RY+I    I+ +KV+YLD D +V  +L +L++ ++ +Y +AA+ D   + IY      FN
Sbjct:  89 FFRYFISDFIEQDKVIYLDADIVVNGSLTELYQTDISNYFLAAVKDIISEKIYVNNHIFN  148

Query:  56 SGVMLINSLYWMRYRVTEKLLEITERELDNGIFGDQGVLNLLFDNNWLKLEDKYNAQVGN  115
           +G++LIN+   W  + +T+   L  ++E+ +++      DQ +LNL+F + WLKL    YN   +G
Sbjct: 149 AGMLLINNKKWREHNITQFCLSLSEKYINSLPDADQSILNLIFKDKWLKLNRGYNYLIGT  208

Query: 116 DLGAFYENWQGYFDRNFES-PTIIHYCTHDKPWNTFSSSRFRETWWQYEQLDWNEVF     171
             D    F      Y +   E+ P IIHY T  KPW      ++RFR  +W Y +L+W +++
Sbjct: 209 DYLFFKYGKTRYLEDLGETIPLIIHYNTEAKPWLNIFNTRFRNIYWFYYELNWQDIY     265
```

No corresponding DNA sequence was identified in *S. pyogenes*.

Based on this analysis, it was predicted that this protein and its epitopes, could be useful antigens for vaccines or diagnostics.

EXAMPLE 1304

A DNA sequence (GBSx1384) was identified in *S. agalactiae* <SEQ ID 3999> which encodes the amino acid sequence <SEQ ID 4000>. This protein is predicted to be a glycosyl transferase. Analysis of this protein sequence reveals the following:

```
Possible site: 56
>>> Seems to have no N-terminal signal sequence

----- Final Results -----
            bacterial cytoplasm --- Certainty = 0.1157(Affirmative) < succ>
            bacterial membrane  --- Certainty = 0.0000(Not Clear)   < succ>
             bacterial outside  --- Certainty = 0.0000(Not Clear)   < succ>
```

The protein has homology with the following sequences in the GENPEPT database.

```
>GP: AAF28363 GB: AF224467 putative glycosyl transferase [Haemophilus
ducreyi]
Identities = 103/259 (39%), Positives = 156/259 (59%), Gaps = 3/259 (1%)

Query:   7 IALAADFGYQEQVKTIIKSICFHNQFIDFYILNDDFPVEWFQMMEYHLSKMDCTISNTKI   66
           I LAA+   Y E + T IKSI   HN+ I FY+LN D+P EWF ++    L K++  I + K+
Sbjct:  10 IVLAANQSYSEYILTTIKSIYLHNKHIRFYLLNRDYPTEWFDILNNKLRKLNSEIIDIKV   69

Query:  67 FNEEIKHFK-FQKPMPYPTYFRYFIPEVIHEDKVLYLDCMIITSDLTSIFTLDISKYGV   125
            N+  IK+FK +           T+FRYFI + I +DKV+YLD D+++   LT  ++  DIS Y +
Sbjct:  70 TNDTIKNFKTYSHISSDTTFFRYFISDFIEQDKVIYLDADIVVNGSLTELYQTDISNYFL   129
```

```
Query: 126 AAVRDDLLEEYDGKEDYFNSGLLLINNIFWREQGISQRLLDYTRENQGALQYHDQDVLND 185
            AAV+D + E+         FN+G+LLINN  WRE  I+Q  L + +   +L    DQ +LN
Sbjct: 130 AAVKDIISEKIYVNNHIFNAGMLLINNKKWREHNITQFCLSLSEKYINSLPDADQSILNL 189

Query: 186 VLCDNWLELDETYNYHTGADMLYNLFQQSERQLNRRKDLPKVIHY-TATKPWKYLETSVR 244
            + D WL+L+  YNY G D L+ + ++     +  + +P +IHY T   KPW  +  + R
Sbjct: 190 IFKDKWLKLWRGYNYLIGTDYLFFKYGKTRYLEDLGETIPLIIHYNTEAKPWLNI-FNTR 248

Query: 245 WRDIWWEYNRLEWRDIFTR                                          263
            +R+I+W Y  L W+DI+ +
Sbjct: 249 FRNIYWFYYELNWQDIYAK                                          267
```

No corresponding DNA sequence was identified in *S. pyogenes*.

Based on this analysis, it was predicted that this protein and its epitopes, could be useful antigens for vaccines or diagnostics.

EXAMPLE 1305

A DNA sequence (GBSx1385) was identified in *S. agalactiae* <SEQ ID 4001> which encodes the amino acid sequence <SEQ ID 4002>. This protein is predicted to be a glycosyl transferase. Analysis of this protein sequence reveals the following:

```
Possible site: 28
>>> Seems to have no N-terminal signal sequence

----- Final Results -----
            bacterial cytoplasm --- Certainty = 0.2679(Affirmative) < succ>
             bacterial membrane --- Certainty = 0.0000(Not Clear)   < succ>
              bacterial outside --- Certainty = 0.0000(Not Clear)   < succ>
```

The protein has homology with the following sequences in the GENPEPT database.

```
>GP: AAF28363 GB: AF224467 putative glycosyl transferase [Haemophilus
ducreyi]
Identities = 94/263 (35%), Positives = 158/263 (59%), Gaps = 4/263 (1%)

Query:   2 KKTIVLGADFQYRDQVMTTIKSIVSHNQHLTIYIINTDFPVEWFNILNHSLEQFDCRVKN    61
           K  IVL A+  Y +  ++TTIKSI  HN+H+  Y++N D+P EWF+ILN+ L + +  + +
Sbjct:   7 KMNIVLAANQSYSEYILTTIKSIYLHNKHIRFYLLNRDYPTEWFDILNNKLRKLNSEIID   66

Query:  62 IPISSDVFEGIPTLSHISV-AGFFRWFIPIHLEEEIVLYLDSDVIVRGSLDPLFDINLEE  120
           I +++D  +   T SHIS    FFR+FI    +E++ V+YLD+D++V GSL  L+  ++
Sbjct:  67 IKVTNDTIKNFKTYSHISSDTTFFRYFISDFIEQDKVIYLDADIVVNGSLTELYQTDISN  126

Query: 121 NLLGAVADHFSTLYYGDTAPVSFNSGVMLINNSLWKKEEIYNSLMRIADKG-SAVGVGDQ  179
             L AV D  S   Y +        FN+G++LINN  W++  I    + +++K  +++    DQ
Sbjct: 127 YFLAAVKDIISEKIYVNNH--IFNAGMLLINNKKWREHNITQFCLSLSEKYINSLPDADQ  184

Query: 180 EYLNILTQNRWIDIGKQYNVQIGQDVNINAYGRPDLYHFYDDCEPVIVHYNSQDKPWNKY  239
              LN++ +++W+ + +  YN  IG D      YG+        +   P+I+HYN++  KPW
Sbjct: 185 SILNLIFKDKWLKLNRGYNYLIGTDYLFFKYGKTRYLEDLGETIPLIIHYNTEAKPWLNI  244

Query: 240 SQSRYRSEWWYYFGLEWSVIYAQ                                      262
           +R+R+ +W+Y+ L W   IYA+
Sbjct: 245 FNTRFRNIYWFYYELNWQDIYAK                                      267
```

No corresponding DNA sequence was identified in *S. pyogenes*.

Based on this analysis, it was predicted that this protein and its epitopes, could be useful antigens for vaccines or diagnostics.

EXAMPLE 1306

A DNA sequence (GBSx1386) was identified in *S. agalactiae* <SEQ ID 4003> which encodes the amino acid sequence <SEQ ID 4004>. Analysis of this protein sequence reveals the following:

```
Possible site: 13
>>> Seems to have no N-terminal signal sequence

----- Final Results -----
           bacterial cytoplasm --- Certainty = 0.2996(Affirmative) < succ>
            bacterial membrane --- Certainty = 0.0000(Not Clear)   < succ>
             bacterial outside --- Certainty = 0.0000(Not Clear)   < succ>
```

A related GBS nucleic acid sequence <SEQ ID 10003> which encodes amino acid sequence <SEQ ID 10004> was also identified.

The protein has homology with the following sequences in the GENPEPT database.

```
>GP: AAC75095 GB: AE000294 putative Galf transferase [Escherichia coli K12]
Identities = 68/286 (23%), Positives = 122/286 (41%), Gaps = 18/286 (6%)

Query:  77 STRMDGIIAGLGRGDIVVFQVPTWNSTEFDELFLDKLQAYGARIITFVHDIVPLMFESNF 136
           S ++   + GL    D+++F  P           F  +L  +  RI+  +HDI   L
Sbjct:  50 SVKLSTFLCGLENKDVLIFNFPMAKPFWHILSFFHRLLKE--RIVPLIHDIDELRGGGGS 107

Query: 137 YLLDRVIDMYNRSDVVILPTKAMHDYLIEKGMTTSKVLYQEVWDHPVNIDLPRPEC---Q 193
              D V       D+VI     M  YL  K M+   K+    +++D+ V+ D+    +     Q
Sbjct: 108 ---DSV--RLATCDMVISHNPQMTKYL-SKYMSQDKIKDIKIFDYLVSSDVEHRDVTDKQ 161

Query: 194 KVLSFAGDIQRFPFVNDWKENIPLIYYGDGSRLNSEANVHAQGWKDDVELMLSLSKRG-G 252
           + +  +AG++  R      + E      +G       ++ N      G    D +   ++  G
Sbjct: 162 RGVIYAGNLSRHKCSFIYTEGCDFTLFG--VNYENKDNPKYLG-SFDAQSPEKINLPGMQ 218

Query: 253 FGLCWSEDREELVERR---YSRMNASYKLSTFLAAGLPIIANHDISSRDFIKQHGLGFTV 309
           FGL W  D  E       Y + N  +K S +L+   LP+      + DFI   +G+ V
Sbjct: 219 FGLIWDGDSVETCSGAFGDYLKFNNPHKTSLYLSMELPVFIWDKAALADFIVDNRIGYAV 278

Query: 310 ETLEEAVEKINNMEKETYDSYVENVEKIATLLRNGYITKKLLIDAV                355
              +++E  E +++M  ETY     EN + I+  +R G    + +L + +
Sbjct: 279 GSIKEMQEIVDSMTIETYKQISENTKIISQKIRTGSYFRDVLEEVI                324
```

No corresponding DNA sequence was identified in *S. pyogenes*.

Based on this analysis, it was predicted that these proteins and their epitopes could be useful antigens for vaccines or diagnostics.

EXAMPLE 1307

A DNA sequence (GBSx1387) was identified in *S. agalactiae* <SEQ ID 4005> which encodes the amino acid sequence <SEQ ID 4006>. Analysis of this protein sequence reveals the following:

```
Possible site: 33
>>> Seems to have no N-terminal signal sequence

----- Final Results -----
           bacterial cytoplasm --- Certainty = 0.3098 (Affirmative) < succ>
            bacterial membrane --- Certainty = 0.0000 (Not Clear)  < succ>
             bacterial outside --- Certainty = 0.0000 (Not Clear)  < succ>
```

The protein has homology with the following sequences in the GENPEPT database.

```
>GP:AAA73093 GB:M76233 [Rabbit smooth muscle myosin light chain
kinase mRNA, complete CDS.], gene product [Oryctolagus cuniculus]
Identities = 23/63 (36%), Positives = 36/63 (56%)

Query:     5 QPAPALQRVRQCQPAPVLQPVPRCQPALALQRVRQCQPAQVLQQVPRCQPAQVLQQVPRC   64
             +PA  L+ V    +PA  L+PV    +PA  L+ V    +PA+ L+ V    +PA+ L+ V
Sbjct:   225 KPAETLKPVGNAKPAETLKPVGNAKPAETLKPVGNAKPAETLKPVGNAKPAETLKAVANA  284

Query:    65 QPA                                                           67
             +PA
Sbjct:   285 KPA                                                          287
```

No corresponding DNA sequence was identified in *S. pyogenes*.

Based on this analysis, it was predicted that this protein and its epitopes, could be useful antigens for vaccines or diagnostics.

EXAMPLE 1308

A DNA sequence (GBSx1388) was identified in *S. agalactiae* <SEQ ID 4007> which encodes the amino acid sequence <SEQ ID 4008>. Analysis of this protein sequence reveals the following:

```
Possible site: 43
>>> Seems to have no N-terminal signal sequence
      INTEGRAL      Likelihood = -9.24      Transmembrane    189-205 (173-245)
      INTEGRAL      Likelihood = -9.24      Transmembrane    213-229 (206-245)
      INTEGRAL      Likelihood = -7.96      Transmembrane     95-111  (83-185)
      INTEGRAL      Likelihood = -7.96      Transmembrane    115-131 (112-185)
      INTEGRAL      Likelihood = -7.96      Transmembrane    135-151 (132-185)
      INTEGRAL      Likelihood = -7.96      Transmembrane    155-171 (152-185)
      INTEGRAL      Likelihood = -6.85      Transmembrane     15-31   (8-45)
      INTEGRAL      Likelihood = -4.09      Transmembrane     39-55  (35-57)
      INTEGRAL      Likelihood = -4.09      Transmembrane     63-79  (59-81)
      INTEGRAL      Likelihood = -2.71      Transmembrane    235-251 (235-251)
      INTEGRAL      Likelihood = -0.11      Transmembrane    253-269 (253-269)

----- Final Results -----
              bacterial membrane  --- Certainty = 0.4694 (Affirmative) < succ>
              bacterial outside   --- Certainty = 0.0000 (Not Clear)   < succ>
              bacterial cytoplasm --- Certainty = 0.0000 (Not Clear)   < succ>
```

The protein has homology with the following sequences in the GENPEPT database.

```
>GP:AAC16164 GB:AF010496 ice nucleation protein [Rhodobacter apsulatus]
Identities = 85/286 (29%), Positives = 119/286 (40%), Gaps = 17/286 (5%)

Query:     3 ALVLADVDALVETLVLADVVALIEALVLADIEALV----EALVLADIEALVEALVLADID   58
             AL  A  AL  T +   A ++ L  AD+ L      +AL   A I AL + + A
Sbjct:   523 ALSDAQAGALTSTQIGLLSTAAVKGLSTADMAGLTTAEAQALTSAQIAALSSSQIRAMTT  582

Query:    59 ALVEALVLADIEALVEALVL----ADIDALVEALVLADVEALIEALVLALVEALVLADVE  114
             A + AL  A I+ L  + +L    ADI AL       A  + I AL  +LV A+  AD+
Sbjct:   583 AQIAALGTAQIKGLTASNILGLETADIVALTTTQAPALSSSQIAALSTSLVAAMETADLA  642

Query:   115 ALIEALVLAL----VEALVLADVEAL----IEALVLALVEALVLADVEALIEALVLALVE  166
             L   A       + AL   A    A+     I   A ++ L  AD+ AL  A  +
Sbjct:   643 KLSAATFKGFSSTQITALTTAQAGAIGTDQIAQITTAAIKGLESADIAALANATLAKMTT  702

Query:   167 ALVLADVEALIEALVLADVD-ALVLALVEALVLALVEALILAEVEALVLALVEALVLALV  225
             A V     A + L   ++ L A V+AL A + L   ++ AL          AL       V
Sbjct:   703 AQVAVLGSAQLTGLTTTQINTVLTTAQVKALGAAALAGLGTDDIVALTTGQAAALSSTQV  762

Query:   226 EALILALVEALVLADVDALMEALVLADVEALMEALVLADVDALVEA               271
             AL  A + AL   AD   AL  A +       + AL        +DAL  A
Sbjct:   763 AALSTAQISALQTADFAALSTAAIKGLSSTQITALSTGQIDALTTA                808
```

No corresponding DNA sequence was identified in *S. pyogenes*.

Based on this analysis, it was predicted that this protein and its epitopes, could be useful antigens for vaccines or diagnostics.

EXAMPLE 1309

A DNA sequence (GBSx1389) was identified in *S. agalactiae* <SEQ ID 4009> which encodes the amino acid sequence <SEQ ID 4010>. Analysis of this protein sequence reveals the following:

```
Possible site: 41
>>> Seems to have no N-terminal signal sequence

----- Final Results -----
            bacterial cytoplasm --- Certainty = 0.2297 (Affirmative) < succ>
             bacterial membrane --- Certainty = 0.0000 (Not Clear)   < succ>
              bacterial outside --- Certainty = 0.0000 (Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1310

A DNA sequence (GBSx1390) was identified in *S. agalactiae* <SEQ ID 4011> which encodes the amino acid sequence <SEQ ID 4012>. This protein is predicted to be fimbriae-associated protein Fap1. Analysis of this protein sequence reveals the following:

```
Possible site: 50
>>> Seems to have no N-terminal signal sequence

----- Final Results -----
            bacterial cytoplasm --- Certainty = 0.3138 (Affirmative) < succ>
             bacterial membrane --- Certainty = 0.0000 (Not Clear)   < succ>
              bacterial outside --- Certainty = 0.0000 (Not Clear)   < succ>
```

The protein has homology with the following sequences in the GENPEPT database.

```
>GP:BAA97453 GB:AB029393 streptococcal hemagglutinin [Streptococcus gordonii]
Identities = 388/968 (40%), Positives = 518/968 (53%), Gaps = 68/968 (7%)

Query:   13 VDTKSRVKMHKSEKNWVRTVMSHFNLFKAIKGRATVEADVCIQDVEKEDRLSSGNLTYLK   72
            V+  +R K+ KS K+W+R    S F L + +KG      +V   V +E +  G L YLK
Sbjct:   13 VERVTRFKLIKSGKHWLRAATSQFGLLRLMKGADISSVEV---KVAEEQSVEKGGLNYLK  69

Query:   73 GILAAGALVGGASLTSR-VYADETPVVQEQSSSVPTLAEQTEVTV--KTTTVQNHQDGTV  129
            GI+A GA++GGA +TS  VYA+E   +++   +    LA + E  +   T +   +
Sbjct:   70 GIIATGAVLGGAVVTSSSVYAEEEQALEKVIDTRDVLATRGEAVLSEEAATTLSSEGANP  129

Query:  130 SKNIIDSNSVSMSESASTSTSESVSMSMSGSTLTSVSESVSTSALTSASESISTSASESV  189
            +++ D+ S S S SA+ S S S+S+S S S     S S S S+S    S+SES S S S SV
Sbjct:  130 VESLSDTLSASESASAN-SVSTSISISESFSVSASASLSSSSSLSQSSSESASASESLSV  188

Query:  190 SKSTSISEVSNILETQASLTDKGRESFSANQIVTESSLVTDAGKNASVSSLIEITKPKSE  249
            S STS S  S     TQ+S  +    S S+N + T  S V+   +NA V +   +   +E
Sbjct:  189 SASTSQSFSSTTSSTQSSNNESLISSDSSNSLNTNQS-VSARNQNARVRTRRAVAANDTE  247

Query:  250 LQTSKMSNESLITPEKSQVMIASDKTGNESLTPTIRLKSVIQPRSMNLMTLSSEMDLIPL  309
                       K +  + E  +  ++ T N    + ++       N+   ++   L P
Sbjct:  248 APQVKSGDYVVYRGESFEYY--AEITDNSGQVNRVVIR-------NVEGGANSTYLSPN  297
```

-continued

```
Query:  310 EEVSDTEMLGKDVSSELQKVNIALKDNTLSEPGTVKLDSSENLVLNFAFSIASVNEGDVF  369
             TE LG+  ++ +Q       L+      E    ++ + ++     +   +A    G+
Sbjct:  298 WVKYSTENLGRPGNATVQN---PLRTRIFGEVPLNEIVNEKSYYTRYI--VAWDPSGN--  350

Query:  370 TVKLSDNLDTQGIGTILKVQDIMDETGQLLATGSYSPLTHNITY--------TWTRYAST  421
             ++ DN + G+   +    +E       Y P    ++TY          T  R A
Sbjct:  351 ATQMVDNANRNGLERFVLTVKSQNE--------KYDPAESSVTYVNNLSNLSTSEREAVA  402

Query:  422 LNNIKARVNMPVWPDQRI-------ISKTTSDKQCFTATLNNQVASIE---ERVQYNSPS  471
              A  N+P  P   +I        ++ T  DK    T   N V  ++       S S
Sbjct:  403 AAVRAANPNIP--PTAKITVSQNGTVTITYPDKSTDTIPANRVVKDLQISKSNSASQSSS  460

Query:  472 VTEHTNVKTNVRSRIMKLDDERQTETYITQINPEGKEMYFASGLGNLYTIIGSDGTSGSP  531
             V+    +  T+V + I              ++           +  +    ++ S+  S S
Sbjct:  461 VSASQSASTSVSASI---SASMSASVSVSTSASTSASVSASESASTSASVSASESASTS-  516

Query:  532 VNLLNAEVKILKTNSKNLTDSMDQNYDSPEFEDVTSQYSYTNDGSKITIDWKTNSISSTT  591
                  A V    K++S + + S  ++ +      + S+   S         + S+S++T
Sbjct:  517 -----ASVSASKSSSTSASVSASESASTSASVSASESASTSASVSASESASTSASVSAST  571

Query:  592 SYVVLVKIPKQSGVLYSTVSDINQTYGSKYSYGHTNISGDSDANAEIKL-LSESASTSAS  650
             S     +        ST + ++ +   +  S     ++S   A+    +   SESASTSAS
Sbjct:  572 SASTSASVSASESA--STSASVSASESASTS---ASVSASESASTSASVSASESASTSAS  626

Query:  651 TSASTSASMSASTSASTSASMSASTSASTSASMSASTSASTSASTSASTSASTSASTSAS  710
             SAS  S+S  SAS SAS  SAS SAS  SAS SASTSAS+SASTSASTSAS  SASTSASTSAS
Sbjct:  627 VSASESSSTSASVSASESASTSASVSASESASTSASVSASTSASTSASVSASTSASTSAS  686

Query:  711 MSASTSASTSASTSASTSASTSASTSASMSASTSASTSASTSASTSASMSASTSASTSAS  770
             +SASTSASTSAS SAS SASTSAS SAS SASTSAS SASTSASTSAS+SASTSASTSAS
Sbjct:  687 VSASTSASTSASVSASESASTSASVSASESASTSASVSASTSASTSASVSASTSASTSAS  746

Query:  771 TSASTSASMSASTSASTSASTSASMSASTSASTSASTSASTSASMSASTSASTSASTSAS  830
             SAS  SAS SAS  SASTSASTSAS SAS SASTSAS SAST  ASTSAS+SAS  SASTSAS
Sbjct:  747 VSASESASTSASVSASTSASTSASVSASESASTSASVSASTYASTSASVSASESASTSAS  806

Query:  831 TSASMSASTSASTSASMSASTSASTSASMSASTSASTSASMSASTSASTSASMSASTSAS  890
             SAS  SASTSAS  SAS SASTSAS SAS  SASTSAS SAS  SASTSAS SAS  SASTSAS
Sbjct:  807 VSASESASTSASVSASTSASTSASVSASESASTSASVSASESASTSASVSASESASTSAS  866

Query:  891 MSATTSASTSVSTSASTSASTSASTSSSSSVTSNSSKEKVYSALPSTGDQDYSVTATALG  950
             +SA+TSASTS S   SAS  SASTSAS   S+S  S   ++++S    SA     S           +T+
Sbjct:  867 VSASTSASTSASVSASESASTSASVSASESASTSASVSASESASTSASVSASESASTSAS  926

Query:  951 LGLMTGAT  958
             +    T  A+
Sbjct:  927 VSASTSAS  934
```

There is also homology to SEQ ID 760.

SEQ ID 4012 (GBS68) was expressed in *E. coli* as a GST-fusion product. SDS-PAGE analysis of total cell extract is shown in FIG. 33 (lane 4; MW 131.2 kDa).

Figure 153:
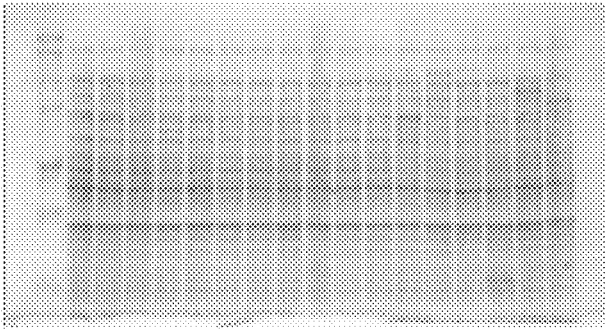

GBS68d was expressed in *E. coli* as a GST-fusion product. SDS-PAGE analysis of total cell extract is shown in FIG. 153 (lane 14; MW 103 kDa) and in FIG. 239 (lane 13; MW 103 kDa). It was also expressed in *E. coli* as a His-fusion product. SDS-PAGE analysis of total cell extract is shown in FIG. 152 (lane 17; MW 78 kDa), in FIG. 153 (lane 17; MW>78 kDa) and in FIG. 184 (lane 10; MW 78 kDa). Purified GBS68d-GST is shown in FIG. 246, lane 5.

Based on this analysis, it was predicted that this protein and its epitopes, could be useful antigens for vaccines or diagnostics.

EXAMPLE 1311

A DNA sequence (GBSx1391) was identified in *S. agalactiae* <SEQ ID 4013> which encodes the amino acid sequence <SEQ ID 4014>. This protein is predicted to be RofA. Analysis of this protein sequence reveals the following:

```
Possible site: 30
>>> Seems to have no N-terminal signal sequence

----- Final Results -----
            bacterial cytoplasm --- Certainty = 0.1738 (Affirmative) < succ>
             bacterial membrane --- Certainty = 0.0000 (Not Clear)   < succ>
               bacterial outside --- Certainty = 0.0000 (Not Clear)  < succ>
```

A related GBS nucleic acid sequence <SEQ ID 10005> which encodes amino acid sequence <SEQ ID 10006> was also identified.

There is also homology to SEQ ID 3750.

Based on this analysis, it was predicted that this protein and its epitopes, could be useful antigens for vaccines or diagnostics.

EXAMPLE 1312

A DNA sequence (GBSx1392) was identified in *S. agalactiae* <SEQ ID 4015> which encodes the amino acid sequence <SEQ ID 4016>. This protein is predicted to be Nra. Analysis of this protein sequence reveals the following:

```
Possible site: 16
>>> Seems to have a cleavable N-term signal seq.

----- Final Results -----
               bacterial outside --- Certainty = 0.3000 (Affirmative) < succ>
              bacterial membrane --- Certainty = 0.0000 (Not Clear)   < succ>
             bacterial cytoplasm --- Certainty = 0.0000 (Not Clear)   < succ>
```

Based on this analysis, it was predicted that this protein and its epitopes, could be useful antigens for vaccines or diagnostics.

EXAMPLE 1313

A DNA sequence (GBSx1393) was identified in *S. agalactiae* <SEQ ID 4017> which encodes the amino acid sequence <SEQ ID 4018>. Analysis of this protein sequence reveals the following:

```
Possible site: 19
>>> Seems to have no N-terminal signal sequence

----- Final Results -----
            bacterial cytoplasm --- Certainty = 0.3674 (Affirmative) < succ>
             bacterial membrane --- Certainty = 0.0000 (Not Clear)   < succ>
               bacterial outside --- Certainty = 0.0000 (Not Clear)  < succ>
```

The protein has homology with the following sequences in the GENPEPT database.

```
>GP:AAA27020 GB:M80215 uvs402 protein [Streptococcus pneumoniae]
Identities = 577/663 (87%), Positives = 633/663 (95%), Gaps = 1/663 (0%)

Query:   1  MIDRKDTNRFKLVSKYSPSGDQPQAIETLVDNIEGGEKAQILKGATGTGKTYTMSQVIAQ    60
            MI+   N+FKLVSKY PSGDQPQAIE LVDNIEGGEKAQIL GATGTGKTYTMSQVI++
Sbjct:   7  MINHITDNQFKLVSKYQPSGDQPQAIEQLVDNIEGGEKAQILMGATGTGKTYTMSQVISK    66

Query:  61  VNKPTLVIAHNKTLAGQLYGEFKEFFPDNAVEYFVSYYDYYQPEAYVPSSDTYIEKDSSV   120
            VNKPTLVIAHNKTLAGQLYGEFKEFFP+NAVEYFVSYYDYYQPEAYVPSSDTYIEKDSSV
Sbjct:  67  VNKPTLVIAHNKTLAGQLYGEFKEFFPENAVEYFVSYYDYYQPEAYVPSSDTYIEKDSSV   126

Query: 121  NDEIDKLRHSATSSLLERNDVIVVASVSCIYGLGSPKEYADSVVSLRPGQEISRDQLLNN   180
            NDEIDKLRHSATS+LLERNDVIVVASVSCIYGLGSPKEYADSVVSLRPG EISRD+LLN+
Sbjct: 127  NDEIDKLRHSATSALLERNDVIVVASVSCIYGLGSPKEYADSVVSLRPGLEISRDKLLND   186
```

-continued

```
Query: 181  LVDIQFERNDIDFQRGKFRVRGDVVEVFPASRDEHAFRIEFFGDEIDRIREIESLTGRVL  240
            LVDIQFERNDIDFQRG+FRVRGDVVE+FPASRDEHAFR+EFFGDEIDRIRE+E+LTG+VL
Sbjct: 187  LVDIQFERNDIDFQRGRFRVRGDVVEIFPASRDEHAFRVEFFGDEIDRIREVEALTGQVL  246

Query: 241  GEVEHLAIFPATHFMTNDEHMEEAISKIQAEMENQVELFEKEGKLIEAQRIRQRTEYDIE  300
            GEV+HLAIFPATHF+TND+HME AI+KIQAE+E Q+ + FEKEGKL+EAQR++QRTEYDIE
Sbjct: 247  GEVDHLAIFPATHFVTNDDHMEVAIAKIQAELEEQLAVFEKEGKLLEAQRLKQRTEYDIE  306

Query: 301  MLREMGYTNGVENYSRHMDGRSEGEPPFTLLDFFPEDFLIMIDESHMTMGQIKGMYNGDR  360
            MLREMGYTNGVENYSRHMDGRSEGEPP+TLLDFFP+DFLIMIDESHMTMGQIKGMYNGDR
Sbjct: 307  MLREMGYTNGVENYSRHMDGRSEGEPPYTLLDFFPDDFLIMIDESHMTMGQIKGMYNGDR  366

Query: 361  SRKEMLVNYGFRLPSALDNRPLRREEFESHVHQIVYVSATPGDYEMEQTDTVVEQIIRPT  420
            SRK+MLVNYGFRLPSALDNRPLRREEFESHVHQIVYVSATPGDYE EQT+TV+EQIIRPT
Sbjct: 367  SRKKMLVNYGFRLPSALDNRPLRREEFESHVHQIVYVSATPGDYENEQTETVIEQIIRPT  426

Query: 421  GLLDPEVEVRPSMGQMDDLLGEINLRTEKGERTFITTLTKRMAEDLTDYLKEMGVKVKYM  480
            GLLDPEVEVRP+MGQ+DDLLGEIN R EK ERTFITTLTE+MAEDLTDY KEMG+KVKYM
Sbjct: 427  GLLDPEVEVRPTMGQIDDLLGEINARVEKNERTFITTLTKKMAEDLTDYFKEMGIKVKYM  486

Query: 481  HSDIKTLERTEIIRDLRLGVFDVLIGINLLREGIDVPEVSLVAILDADKEGFLRNERGLI  540
            HSDIKTLERTEIIRDLRLGVFDVL+GINLLREGIDVPEVSLVAILDADKEGFLRNERGLI
Sbjct: 487  HSDIKTLERTEIIRDLRLGVFDVLVGINLLREGIDVPEVSLVAILDADKEGFLRNERGLI  546

Query: 541  QTIGRAARNSNGHVIMYADKITDSMQRAMDETARRRLQMDYNEKHGIVPQTIKKEIRDL  600
            QTIGRAARNS GHVIMYAD +T SMQRA+DETARRR++QM YNE+HGIVPQTIKKEIRDL
Sbjct: 547  QTIGRAARNSEGHVIMYADTVTQSMQRAIDETARRRKIQMAYNEEHGIVPQTIKKEIRDL  606

Query: 601  IAITKSNDSDKPEKVVDYSSLSKKERQAEIKALQQQMQEAAELLDFELAAQIRDVILELK  660
            IA+TK+   ++ +K VD +SL+K+ER+   +K L++QMQEA E+LDFELAAQIRD++LE+K
Sbjct: 607  IAVTKAVAKEE-DKEVDINSLNKQERKELVKKLEKQMQEAVEVLDFELAAQIRDMMLEVK  665

Query: 661  AID                                                          663
            A+D
Sbjct: 666  ALD                                                          668
```

A related DNA sequence was identified in *S. pyogenes* <SEQ ID 4019> which encodes the amino acid sequence <SEQ ID 4020>. Analysis of this protein sequence reveals the following:

```
Possible site: 55
>>> Seems to have no N-terminal signal sequence

----- Final Results -----
    bacterial cytoplasm --- Certainty = 0.4386 (Affirmative)  <succ>
      bacterial membrane --- Certainty = 0.0000 (Not Clear)   <succ>
       bacterial outside --- Certainty = 0.0000 (Not Clear)   <succ>
```

An alignment of the GAS and GBS proteins is shown below.

```
Identities = 570/663 (85%), Positives = 625/663 (93%)

Query:   1  MIDRKDTNRFKLVSKYSPSGDQPQAIETLVDNIEGGEKAQILKGATGTGKTYTMSQVIAQ   60
            MID++D   FKL SKY PSGDQPQAIE+LVDNIEGGEKAQIL GATGTGKTYTMSQVI++
Sbjct:   1  MIDKRDDKPFKLKSKYKPSGDQPQAIESLVDNIEGGEKAQILLGATGTGKTYTMSQVISK   60

Query:  61  VNKPTLVIAHNKTLAGQLYGEFKEFFPDNAVEYFVSYYDYYQPEAYVPSSDTYIEKDSSV  120
            VNKPTLVIAHNKTLAGQLYGEFKEFFPDNAVEYFVSYYDYYQPEAYVPSSDTYIEKDSSV
Sbjct:  61  VNKPTLVIAHNKTLAGQLYGEFKEFFPDNAVEYFVSYYDYYQPEAYVPSSDTYIEKDSSV  120

Query: 121  NDEIDKLRHSATSSLLERNDVIVVASVSCIYGLGSPKEYADSVVSLRPGQEISRDQLLNN  180
            NDEIDKLRHSATSSLLERNDVIVVASVSCIYGLGSPKEYADS VSLRPGQEISRD  LLN
Sbjct: 121  NDEIDKLRHSATSSLLERNDVIVVASVSCIYGLGSPKEYADSAVSLRPGQEISRDTLLNQ  180

Query: 181  LVDIQFERNDIDFQRGKFRVRGDVVEVFPASRDEHAFRIEFFGDEIDRIREIESLTGRVL  240
            LVDIQFERNDIDFQRG FRVRGDVVEVFPASRDEHAFR+EFFGDEIDRI EIESLTG+ +
Sbjct: 181  LVDIQFERNDIDFQRGCFRVRGDVVEVFPASRDEHAFRVEFFGDEIDRICEIESLTGKTI  240

Query: 241  GEVEHLAIFPATHFMTNDEHMEEAISKIQAEMENQVELFEKEGKLIEAQRIRQRTEYDIE  300
            GEV+HL +FPATHF+TNDEHME++I+KIQAE+  Q++LFS  EGKL+EAQR+RQRTEYDIE
Sbjct: 241  GEVDHLVLFPATHFVTNDEHMEQSIAKIQAELAEQLQLFESEGKLLEAQRLRQRTEYDIE  300
```

```
Query: 301  MLREMGYTNGVENYSRHMDGRSEGEPPFTLLDFFPEDFLIMIDESHMTMGQIKGMYNGDR  360
            MLREMGYT+GVENYSRHMDGRS GEPP+TLLDFFPEDFLIMIDESHMTMGQIKGMYNGD+
Sbjct: 301  MLREMGYTSGVENYSRHMDGRSPGEPPYTLLDFFPEDFLIMIDESHMTMGQIKGMYNGDQ  360

Query: 361  SRKEMLVNYGFRLPSALDNRPLRREEFESHVHQIVYVSATPGDYEMEQTDTVVEQIIRPT  420
            +RK+MLV+YGFRLPSALDNRPLRREEFESHVHQIVYVSATPG+YEM QT+T++EQIIRPT
Sbjct: 361  ARKQMLVDYGFRLPSALDNRPLRREEFESHVHQIVYVSATPGEYEMSQTNTIIEQIIRPT  420

Query: 421  GLLDPEVEVRFSMGQMDDLLGEINLRTEKGERTFITTLTKRMAEDLTDYLKEMGVKVKYM  480
            GLLDPE++VR SMGQMDDLLGEIN R   + ERTFITTLTK+MAEDLTDYLKEMGVKVKYM
Sbjct: 421  GLLDPEIDVRSSMGQMDDLLGEINQRVARDERTFITTLTKKMAEDLTDYLKEMGVKVKYM  480

Query: 481  HSDIKTLERTEIIRDLRLGVFDVLIGINLLREGIDVPEVSLVAILDADKEGFLRNERGLI  540
            HSDIKTLERTEIIRDLRLGVFDVLIGINLLREGIDVPEVSLVAILDADKEGFLRNERGLI
Sbjct: 481  HSDIKTLERTEIIRDLRLGVFDVLIGINLLREGIDVPEVSLVAILDADKEGFLRNERGLI  540

Query: 541  QTIGRAARNSNGHVIMYADKITDSMQRAMDETARRRLQMDYNEKHGIVPQTIKKEIRDL  600
            QTIGRAARN +GHVIMYADK+TDSMQRA+DETARRR +Q+ YN+ HGIVPQTIKK+IR L
Sbjct: 541  QTIGRAARNVDGHVIMYADKMTDSMQRAIDETARRREIQIAYNKAHGIVPQTIKKDIRGL  600

Query: 601  IAITKSNDSDKPEKVVDYSSLSKKERQAEIKALQQQMQEAAELLDFELAAQIRDVILELK  660
            I+I+K++ +D  ++ +DY S+S+ ER+  I   ALQ+QMQEAAELLDFELAAQ+RD+ILELK
Sbjct: 601  ISISKTSHNDISKEEMDYESMSRGERKEAINALQKQMQEAAELLDFELAAQMRDLILELK  660

Query: 661  AID  663
            +D
Sbjct: 661  LMD  663
```

Based on this analysis, it was predicted that these proteins and their epitopes could be useful antigens for vaccines or diagnostics.

EXAMPLE 1314

A DNA sequence (GBSx1394) was identified in *S. agalactiae* <SEQ ID 4021> which encodes the amino acid sequence <SEQ ID 4022>. Analysis of this protein sequence reveals the following:

```
Possible site: 31
>>> Seems to have no N-terminal signal sequence
INTEGRAL   Likelihood = -11.78    Transmembrane 284-300  (274-303)
INTEGRAL   Likelihood = -10.08    Transmembrane  20-36   (16-53)
INTEGRAL   Likelihood =  -5.52    Transmembrane 117-133  (114-137)
INTEGRAL   Likelihood =  -5.15    Transmembrane 203-219  (201-225)
INTEGRAL   Likelihood =  -3.29    Transmembrane 183-199  (182-200)
INTEGRAL   Likelihood =  -1.54    Transmembrane  74-90   (73-90)
INTEGRAL   Likelihood =  -0.48    Transmembrane  37-53   (37-53)

----- Final Results -----
    bacterial membrane --- Certainty = 0.5713 (Affirmative) <succ>
     bacterial outside --- Certainty = 0.0000 (Not Clear)   <succ>
    bacterial cytoplasm --- Certainty = 0.0000 (Not Clear)   <succ>
```

The protein has homology with the following sequences in the GENPEPT database.

```
>Gp:CAA22372 GB:AL034446 putative transmembrane protein
[Streptomyces coelicolor A3(2)]
Identities = 58/190 (30%), Positives = 96/190 (50%), Gaps = 11/190 (5%)

Query: 114  GWS--IGFILFSISVITAYILGGLDFHSYDVSK-ATIFYVVTLLPFWLIQSGTEELLTRG  170
            GW   IGF LF +VIT    G    Y+V   ++   + L+ F    + TEE++ RG
Sbjct:  98  GWGTLIGFGLFG-AVITNLFASGY----YEVDGLGSVQGAIGLVGFMAAAAATEEVVFRG  152

Query: 171  WLLPLINHRFHLAVAIGVSSTLFGILHLVNAHVTFLSIVSI-ICSGVLMSLYMIKSGNIW  229
              L  +I      +A+G++   +FG++HL+N     T    ++I I  G ++   + N+W
Sbjct: 153  VLFRIIEEHIGTYLALGLTGLVFGLMHLLNEDATLWGALAIAIEAGFMLAAAYAATRNLW  212

Query: 230  SVAALHGAWNFSQGNLYGIAVSGQKAGASLLHFTVKENAPDWISGGAFGIEGSLISIFVL  289
                +H  WNF+ G ++    VSG      LL  T+ +  P ++GG    FG EGS+  S+
Sbjct: 213  LTIGVHFGWNFAAGGVFSTVVSGNGDSEGLLDATM--SGPKLLTGGDFGPEGSVYSVGFG  270
```

```
                                    -continued
Query: 290  LAAIIYLLWL                                                   299
            +  +  LWL
Sbjct: 271  VLLTLVFLWL                                                   280
```

No corresponding DNA sequence was identified in *S. pyogenes*.

Based on this analysis, it was predicted that this protein and its epitopes, could be useful antigens for vaccines or diagnostics.

EXAMPLE 1315

A DNA sequence (GBSx1395) was identified in *S. agalactiae* <SEQ ID 4023> which encodes the amino acid sequence <SEQ ID 4024>. This protein is predicted to be glutamine-binding periplasmic protein/glutamine transport system perme. Analysis of this protein sequence reveals the following:

```
Possible site: 20
>>> Seems to have a cleavable N-term signal seq.
INTEGRAL    Likelihood = -8.97   Transmembrane 532-548 (523-553)
INTEGRAL    Likelihood = -7.38   Transmembrane 700-716 (696-720)
INTEGRAL    Likelihood = -4.57   Transmembrane 562-578 (558-588)
INTEGRAL    Likelihood = -0.32   Transmembrane 665-681 (665-681)

----- Final Results -----
    bacterial membrane  --- Certainty = 0.4588 (Affirmative) <succ>
      bacterial outside --- Certainty = 0.0000 (Not Clear)   <succ>
     bacterial cytoplasm --- Certainty = 0.0000 (Not Clear)  <succ>
```

The protein has homology with the following sequences in the GENPEPT database.

```
>GP:AAF16724 GB:AF141644 putative integral membrane protein
[Lactococcus lactis]
Identities = 109/195 (55%), Positives = 156/195 (79%), Gaps = 4/195 (2%)

Query: 466  KMFNNGLASLKKSGEYDKLVKKYLSTASTSSNDKAAKPVDESTILGLISNNYKQLLSGIG   525
            +MFNNGLA+L+ +GEYDK++ KYL++  T +   +AK      E+T  G++ NN++Q+  G+
Sbjct:   1  EMFNNGLANLRANGEYDKIIDKYLAS-DTKTIQSSAK---ENTFFGILQNNWEQIGRGLL    56

Query: 526  TTLSLTLISFAIAMVIGIIFGMMSVSPSNTLRTISMIFVDIVRGIPLMIVAAFIFWGIPN   585
             TL L  ++SF +AM++GIIFG+  SV+PS  LRTI+ I+VD+  R IPL+++  FIF+GIPN
Sbjct:  57  VTLELAVLSFILAMIVGIIFGLFSVAPSKILRTIARIYVDLNRSIPLLVLTIFIFYGIPN   116

Query: 586  LIESITGHQSPINDFVAATIALSLNGGAYIAEIVRGGIEAVPSGQMEASRSLGISYGKTM   645
            L++ ITGHQSP+N+F A   IAL+LN  AYIAEIVR G++AVPSGQMEASRSLG++Y  +M
Sbjct: 117  LLQIITGHQSPLNEFTAGVIALTLNSSAYIAEIVRSGVQAVPSGQMEASRSLGVTYLTSM   176

Query: 646  QKVILPQAVRLMLPN                                               660
            +KVILPQA+++ +P+
Sbjct: 177  RKVILPQAIKITIPS                                               191
```

There is also homology to SEQ ID 1198.

A further related DNA sequence was identified in *S. pyogenes* <SEQ ID 9071> which encodes amino acid sequence <SEQ ID 9072>. Analysis of this protein sequence reveals the following:

```
Possible site: 21
>>> May be a lipoprotein

----- Final Results -----
    bacterial membrane  --- Certainty = 0.0000 (Not Clear) <succ>
      bacterial outside --- Certainty = 0.0000 (Not Clear) <succ>
     bacterial cytoplasm --- Certainty = 0.0000 (Not Clear) <succ>
```

An alignment of the GAS and GBS sequences follows:

```
Score = 80.8 bits (196), Expect = 2e-17
Identities = 64/233 (27%), Positives = 113/233 (48%), Gaps = 13/233 (5%)

Query:  34 IKKTRKLVVAVSPDYAPFEFKALVNGKDTIVGADVQLAQAIADELDVDLELSPMSFDNVL    93
           +K + K+V   S +APFE++   NGK   G D++L + IA +     L++S   FD   L
Sbjct: 268 VKPSYKIVSDSS--FAPPEYQ---NGKGKYTGFDMELIKKIAKQQGFKLDISNPGFDAAL   322

Query:  94 SSLQTGKADLAISGISHTKERAKVYDFSIPYYQAENAIVMRASDAKVTKNISDLNGKKVA   153
           +++Q+G+AD  I+G + T+ R K++DFS PYY    +++++         K+   DL GK V
Sbjct: 323 NAVQSGQADGVIAGATITEARQKIFDFSDPYY--TSSVILAVKKGSNVKSYQDLKGKTVG   380

Query: 154 AQKGSIEEGLVKIQLPKANLISLTAMGEA---INELKAGQVYAVTLEAPVAAGFLAQHKD   210
           A+ G+       +    K N  + A  EA    + + +G + A+  +   V A   + Q +
Sbjct: 381 AKNGTASYTWLSDHADKYN-YHVKAFDEASTMYDSMNSGSIDALMDDEAVLAYAINQGRK   439

Query: 211 LALAPFSLKTSDGDAKAVALPKNSGDLTKAVNKVIAKLDEQERYKSFIAETIA          263
                  P   + S GD           + +L K  N  +A L +     Y    + + ++
Sbjct: 440 FE-TPIKGEKS-GDIGFAVKKGANPELIKMFNNGLASLKKSGEYDKLVKKYLS          490

Score = 74.5 bits (180), Expect = 1e-15
Identities = 59/215 (27%), Positives = 102/215 (47%), Gaps = 12/215 (5%)

Query:  48 YAPFEFKALVNGKDTIVGADVQLAQAIADELDVDLELSPMSFDNVLSSLQTGKADLAISG   107
           YAPFEFK        +    T   G  DV +      +A       ++ ++       FD       ++++Q+G+AD     ++G
Sbjct:  36 YAPFEFK---DSDQTYKGIDVDIVNEVAKRAGWNVNMTYPGFDAAVNAVQSGQADALMAG    92

Query: 108 ISHTKERARVYDFSIPYYQAENAIVMRASDAKVTKNISDLNGKKVAAQKGSIEEGLVKIQ   167
            + T+ R KV++FS  YY   + I+   ++ KVT N    L GK V  + G+   +  ++
Sbjct:  93 TTVTEARKKVFNFSDTYYDT-SVILYTKNNNKVT-NYKQLKGKVVGVKNGTAAQSFLEEN   150

Query: 168 LPKANLISLTAMGEAI--NELKAGQVYAVTLEAPVAAGFLAQHKDLALAPFSLKTSDGDA   225
              K      T    +   N L +G +YA    + PV        + Q   K   A+      +++       +
Sbjct: 151 KSKYGYKVKTFDTSDLMNNSLDSGSIYAAMDDQPVVQFAINQGKAYAI---NMEGEAVGS   207

Query: 226 KAVALPKNSG--DLTKAVNKVIAKLDEQERYKSFI                            258
            A A+ K SG +L K  N   A++       Y   +
Sbjct: 208 FAFAVKKGSGHDNLIKEFNTAFAQMKSDGTYNDIM                            242
```

SEQ ID 4024 (GBS154) was expressed in *E. coli* as a His-fusion product. The purified protein is shown in FIG. 199, lane 6.

Based on this analysis, it was predicted that these proteins and their epitopes could be useful antigens for vaccines or diagnostics.

EXAMPLE 1316

A DNA sequence (GBSx1396) was identified in *S. agalactiae* <SEQ ID 4025> which encodes the amino acid sequence <SEQ ID 4026>. This protein is predicted to be amino acid ABC transporter, ATP-binding protein (glnQ). Analysis of this protein sequence reveals the following:

```
Possible site: 60
>>> Seems to have no N-terminal signal sequence

----- Final Results -----
    bacterial cytoplasm --- Certainty = 0.4183 (Affirmative) <succ>
      bacterial membrane --- Certainty = 0.0000 (Not Clear)   <succ>
       bacterial outside --- Certainty = 0.0000 (Not Clear)   <succ>
```

The protein has homology with the following sequences in the GENPEPT database.

```
>GP:AAB90561 GB:AE001058 glutamine ABC transporter, ATP-binding
protein (glnQ) [Archaeoglobus fulgidus]
Identities = 147/240 (61%), Positives = 192/240 (79%)

Query:   5 KIDVQDLHKSYGQNEVLKGIDAKFYEGDVVCIIGPSGSGKSTFLRTLNLLESITSGKVVV    64
           ++++ DLHK +G+ EVLKG+  K  +G+VV IIGPSGSGKST LR +N LE    TSGK+++
Sbjct:   3 QLEIIDLHKRFGELEVLKGVTMKVEKGEVVVIIGPSGSGKSTLLRCINRLEEPTSGKILL    62
```

-continued

```
Query:   65 DGFELSNPKTDIDKARENIGMVFQHFNLFPHMSVLENITFAPIELGKESKEAAEKHGMEL 124
            DG +++N K DI+K R+ IG+VFQ FNLFPH++ L+N+T API++ K SK   AE+ GM L
Sbjct:   63 DGVDITNSKIDINKVRQRIGIVFQQFNLFPHLTALQNVTLAPIKIKKMSKREAEELGMRL 122

Query:  125 LEKVGLADKANAKPDSLSGGQKQRVAIARSLAMNPDILLFDEPTSALDPEMVGDVLNVMK 184
            LEKVGL DKA+  P  LSGGQ+QRVAIAR+LAMNP+++LFDE TSALDPE+V +VL+VMK
Sbjct:  123 LEKVGLEDKADYYPAQLSGGQQQRVAIARALAMNPEVMLFDEVTSALDPELVKEVLDVMK 182

Query:  185 DLAEQGMTMLIVTHEMGFARQVANRVIFTDGGRFLEDGTPEQIFDTPQHPRLQDFLNKVL 244
             LA  GMTM++VTHEMGFAR+V +RVIF DGG  +E+G PEQIF  P+H R + FL+ + L
Sbjct:  183 QLARDGMTMVVVTHEMGFAREVGDRVIFMDGGVIVEEGKPEQIFSNPKHERTRKFLSMIL 242
```

A related DNA sequence was identified in *S. pyogenes* <SEQ ID 4027> which encodes the amino acid sequence <SEQ ID 4028>. Analysis of this protein sequence reveals the following:

```
Possible site: 60
>>> Seems to have no N-terminal signal sequence

----- Final Results -----
    bacterial cytoplasm --- Certainty = 0.4149 (Affirmative) <succ>
      bacterial membrane --- Certainty = 0.0000 (Not Clear)   <succ>
      bacterial outside  --- Certainty = 0.0000 (Not Clear)   <succ>
```

The protein has homology with the following sequences in the databases:

```
>GP: BAB05180 GB: AP001512 ABC transporter (substrate-binding protein)
[Bacillus halodurans]
Identities = 79/227 (34%), Positives = 126/227 (54%), Gaps = 10/227 (4%)

Query:   35 KKTRKLVVAVSPDYAPFEFKALVNGKDTIVGADVQLAQAIADELDVDLELSPMSFDNVLS  94
            +K   LV+  S DY P+E   + G+  IVG DV +A+ I  EL  +L++  M F+ ++
Sbjct:   48 EKKSVLVMGTSADYPPYESVDVTTGE--IVGFDVDIAEYITSELGYELKIQDMDFNGIIP 105

Query:   95 SLQTGKADLAISGISHTKERAKVYDFSIPYYQAENAIVMRASDAKVTKNISDLNGKKVAA 154
            +LQ G+ D A+SG++ T+ER K  DFS   YY A+N +V +  D     ++ DL GK V
Sbjct:  106 ALQAGRVDFALSGMTPTEERKKSVDFSDVYYDAQNLVVFKEEDG--LSSVEDLAGKTVGV 163

Query:  155 QKGSI-EEGLVKIQ--LPKANLISLTAMGEAINELKAGQVYAVTLEAPVAAGFLAQHKDL 211
            Q  SI EE  V++Q  L   + +  + E + EL AG+V A+ +E   VAAG L  +
Sbjct:  164 QLASIQEEAAVELQEELDGLTIETRNRVPELVQELLAGRVDALIIEDTVAAGHLEANP-- 221

Query:  212 ALAPFSLKTSDGDAKAVALPKNSGDLTKAVNKVIAKLDEQERYKSFI               258
            L  F++++        A+A PK+S +LT+ N+ + ++ E   +  I
Sbjct:  222 GLVRFAIESEGETGSAIAFPKDS-ELTEPFNEKLQEMMEDGTMEELI               267
```

An alignment of the GAS and GBS proteins is shown below.

```
Identities = 223/246 (90%), Positives = 238/246 (96%)

Query:    1 MAELKIDVQDLHKSYGQNEVLKGIDAKFYEGDVVCIIGPSGSGKSTFLRTLNLLESITSG  60
            M ELKIDVQDLHKSYGQNEVLKGIDAKFYEGDVVCIIGPSGSGKSTFLRTLNLLE+ITSG
Sbjct:    1 MTELKIDVQDLHKSYGQNEVLKGIDAKFYEGDVVCIIGPSGSGKSTFLRTLNLLETITSG  60

Query:   61 KVVVDGFELSNPKTDIDKARENIGMVFQHFNLFPHMSVLENITFAPIELGKESKEAAEKH 120
            KV+VDGFELS+PKT+IDKARENIGMVFQHFNLFPHM+VLENI FAP+ELGKESKE A+KH
Sbjct:   61 KVMVDGFELSDPKTNIDKARENIGMVFQHFNLFPHMTVLENIIFAPVELGKESKEVAKKH 120

Query:  121 GMELLEKVGLADKANAKPDSLSGGQKQRVAIARSLAMNPDILLFDEPTSALDPEMVGDVL 180
            GM LLEKVGL+DKA+A P SLSGGQKQRVAIARSLAMNPDI+LFDEPTSALDPEMVGDVL
Sbjct:  121 GMALLEKVGLSDKADAFPGSLSGGQKQRVAIARSLAMNPDIMLFDEPTSALDPEMVGDVL 180

Query:  181 NVMKDLAEQGMTMLIVTHEMGFARQVANRVIFTDGGRFLEDGTPEQIFDTPQHPRLQDFL 240
            NVMKDLAEQGMTMLIVTHEMGFARQVANRVIFTDGG+FLEDGTPE+IFD P+HPRL +FL
Sbjct:  181 NVMKDLAEQGMTMLIVTHEMGFARQVANRVIFTDGGQFLEDGTPEEIFDHPKHPRLIEFL 240

Query:  241 NKVLNV                                                       246
            +KVLNV
Sbjct:  241 DKVLNV                                                       246
```

Based on this analysis, it was predicted that these proteins and their epitopes could be useful antigens for vaccines or diagnostics.

EXAMPLE 1317

A DNA sequence (GBSx1397) was identified in *S. agalactiae* <SEQ ID 4029> which encodes the amino acid sequence <SEQ ID 4030>. Analysis of this protein sequence reveals the following:

```
Possible site: 18
>>> Seems to have no N-terminal signal sequence

----- Final Results -----
            bacterial cytoplasm --- Certainty = 0.2311(Affirmative) < succ>
            bacterial membrane  --- Certainty = 0.0000(Not Clear)   < succ>
            bacterial outside   --- Certainty = 0.0000(Not Clear)   < succ>
```

The protein has no significant homology with any sequences in the GENPEPT database.

A related DNA sequence was identified in *S. pyogenes* <SEQ ID 4031> which encodes the amino acid sequence <SEQ ID 4032>. Analysis of this protein sequence reveals the following:

```
Possible site: 28
>>> Seems to have no N-terminal signal sequence

----- Final Results -----
            bacterial cytoplasm --- Certainty = 0.2702(Affirmative) < succ>
            bacterial membrane  --- Certainty = 0.0000(Not Clear)   < succ>
            bacterial outside   --- Certainty = 0.0000(Not Clear)   < succ>
```

An alignment of the GAS and GBS proteins is shown below.

```
Identities = 45/51 (88%), Positives = 49/51 (95%)

Query:   1 MGDKPISFRDKDGNFVSAADVWNAEKLEELFNTLNPNRKLRLEREKLAKEK  51
           MGDKPISF+DKDGNFVSAADVWNAEKLEELFN LNPNR+LRLEREKL K++
Sbjct:  11 MGDKPISFKDKDGNFVSAADVWNAEKLEELFNLLNPNRRLRLEREKLKKDE  61
```

Based on this analysis, it was predicted that these proteins and their epitopes could be useful antigens for vaccines or diagnostics.

EXAMPLE 1318

A DNA sequence (GBSx1398) was identified in *S. agalactiae* <SEQ ID 4033> which encodes the amino acid sequence <SEQ ID 4034>. This protein is predicted to be spo0b-associated GTP-binding protein (obg). Analysis of this protein sequence reveals the following:

```
Possible site: 14
>>> Seems to have no N-terminal signal sequence

----- Final Results -----
            bacterial cytoplasm --- Certainty = 0.2967(Affirmative) < succ>
            bacterial membrane  --- Certainty = 0.0000(Not Clear)   < succ>
            bacterial outside   --- Certainty = 0.0000(Not Clear)   < succ>
```

The protein has homology with the following sequences in the GENPEPT database.

```
>GP: CAB14752 GB: Z99118 GTPase activity [Bacillus subtilis]
Identities = 297/435 (68%), Positives = 345/435 (79%), Gaps = 7/435 (1%)
```

```
Query:    3 MFLDTAKISVKAGRGGDGMVAFRREKYVPNGGPWGGDGGKGGSVIFKVNEGLRTLMDFRY   62
            MF+D  K+ VK G GG+GMVAFRREKYVP GGP GGDGGKGG V+F+V+EGLRTLMDFRY
Sbjct:    1 MFVDQVKVYVKGGDGGNGMVAFRREKYVPKGGPAGGDGGKGGDVVFEVDEGLRTLMDFRY   60

Query:   63 NRNFKAKAGEKGMTKGMHGRGAEDLIVSLPPGTTVRDATTGKVITDLVEHDQEFVVARGG  122
            ++FKA  GE GM+K  HGR A+D+++ +PPGT V D   T +VI DL EH Q  V+ARGG
Sbjct:   61 KKHFKAIRGEHGMSKNQHGRNADDMVIKVPPGTVVTDDDTKQVIADLTEHGQRAVIARGG  120

Query:  123 RGGRGNIRFATPRNPAPEIAENGEPGEERELQLELKILADVGLVGFPSVGKSTLLSVVSA  182
            RGGRGN RFATP NPAP+++ENGEPG+ER + LELK+LADVGLVGFPSVGKSTLLSVVS+
Sbjct:  121 RGGRGNSRFATPANPAPQLSENGEPGKERYIVLELKVLADVGLVGFPSVGKSTLLSVVSS  180

Query:  183 AKPKIGAYHFTTIVPNLGMVRTKSGDSFAMADLPGLIEGASQGVGLGTQFLRHIERTRVI  242
            AKPKI  YHFTT+VPNLGMV T  G SF MADLPGLIEGA QGVGLG QFLRHIERTRVI
Sbjct:  181 AKPKIADYHFTTLVPNLGMVETDDGRSFVMADLPGLIEGAHQGVGLGHQFLRHIERTRVI  240

Query:  243 LHVIDMSASEGRDPYDDYVSINNELETYNLRLMERPQIIVANKMDMPDSEENLAAFKEKL  302
            +HVIDMS  EGRDPYDDY++IN EL  YNLRL ERPQIIVANKMDMP++ ENL AFKEKL
Sbjct:  241 VHVIDMSGLEGRDPYDDYLTINQELSEYNLRLTERPQIIVANKMDMPEAAENLEAFKEKL  300

Query:  303 AANYDEFDDMPMIFPISSLAHQGLENLMDATAELLANTEEFLLYDETDMQEDEAYYGFNE  362
                     DD P +FPIS++  +GL  L+   A  L NT EF LYDE ++ ++    Y
Sbjct:  301 T------DDYP-VFPISAVTREGLRELLFEVANQLENTPEFPLYDEEELTQNRVMYTMEN  353

Query:  363 DERPFEITRDDDATWVLYGDKLEKLFVMTNMERDESIMKFARQLRGMGVDEALRERGAKD  422
            +E PF ITRD D  +VL GD LE+LF MT+  RDES+ +FARQ RGMGVDEALRERGAKD
Sbjct:  354 EEVPFNITRDPDGVFVLSGDSLERLFKMTDFSRDESVKRFARQMRGMGVDEALRERGAKD  413

Query:  423 GDIVRIGNFEFEFVD                                              437
            GDI+R+  FEFEF+D
Sbjct:  414 GDIIRLLEFEFEFID                                              428
```

A related DNA sequence was identified in *S. pyogenes* <SEQ ID 4035> which encodes the amino acid sequence <SEQ ID 4036>. Analysis of this protein sequence reveals the following:

```
Possible site: 14
>>> Seems to have no N-terminal signal sequence

----- Final Results -----
            bacterial cytoplasm --- Certainty = 0.2588(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below.

```
Identities = 394/437 (90%), Positives = 421/437 (96%)

Query:    1 MSMFLDTAKISVKAGRGGDGMVAFRREKYVPNGGPWGGDGGKGGSVIFKVNEGLRTLMDF   60
            MSMFLDTAKISV+AGRGGDGMVAFRREKYVPNGGPWGGDGGKGGSVIF+V+EGLRTLMDF
Sbjct:    1 MSMFLDTAKISVQAGRGGDGMVAFRREKYVPNGGPWGGDGGKGGSVIFRVDEGLRTLMDF   60

Query:   61 RYNRNFKAKAGEKGMTKGMHGRGAEDLIVSLPPGTTVRDATTGKVITDLVEHDQEFVVAR  120
            RYNR FKAK+GEKGMTKGMHGRGAEDLIV +P GTTVRDA TGKVITDLVEH QE V+A+
Sbjct:   61 RYNRKFKAKSGEKGMTKGMHGRGAEDLIVFVPQGTTVRDAETGKVITDLVEHGQEVVIAK  120

Query:  121 GGRGGRGNIRFATPRNPAPEIAENGEPGEERELQLELKILADVGLVGFPSVGKSTLLSVV  180
            GGRGGRGNIRFATPRNPAPEIAENGEPGEER+L+LELKILADVGLVGFPSVGKSTLLSVV
Sbjct:  121 GGRGGRGNIRFATPRNPAPEIAENGEPGEERQLELELKILADVGLVGFPSVGKSTLLSVV  180

Query:  181 SAAKPKIGAYHFTTIVPNLGMVRTKSGDSFAMADLPGLIEGASQGVGLGTQFLRHIERTR  240
            S+AKPKIGAYHFTTIVPNLGMVRTKSGDSFAMADLPGLIEGASQGVGLGTQFLRHIERTR
Sbjct:  181 SSAKPKIGAYHFTTIVPNLGMVRTKSGDSFAMADLPGLIEGASQGVGLGTQFLRHIERTR  240

Query:  241 VILHVIDMSASEGRDPYDDYVSINNELETYNLRLMERPQIIVANKMDMPDSEENLAAFKE  300
            VILHVIDMSASEGRDPY+DYVSINNELETYNLRLMERPQIIVANKMD+P+++ENL AFK+
Sbjct:  241 VILHVIDMSASEGRDPYEDYVSINNELETYNLRLMERPQIIVANKMDIPEAQENLKAFKK  300

Query:  301 KLAANYDEFDDMPMIFPISSLAHQGLENLMDATAELLANTEEFLLYDETDMQEDEAYYGF  360
            KLAA YDEFDD+PMIFPISSLAHQGLENL++ATAELLA T+EFLLYDE+D+ ++EAYYGF
Sbjct:  301 KLAAQYDEFDDLPMIFPISSLAHQGLENLLEATAELLAKTDEFLLYDESDLVDEEAYYGF  360
```

-continued

```
Query: 361 NEDERPFEITRDDDATWVLYGDKLEKLFVMTNMERDESIMKFARQLRGMGVDEALRERGA 420
           E E+ FEITRDDDATWVL G+KLE+LFVMTNMERDESIMKFARQLRGMGVDEALRERGA
Sbjct: 361 AETEKDFEITRDDDATWVLSGEKLERLFVMTNMERDESIMKFARQLRGMGVDEALRERGA 420

Query: 421 KDGDIVRIGNFEFEFVD                                          437
           KDGD VRIG FEFEFVD
Sbjct: 421 KDGDPVRIGKFEFEFVD                                          437
```

Based on this analysis, it was predicted that these proteins and their epitopes could be useful antigens for vaccines or diagnostics.

EXAMPLE 1319

A DNA sequence (GBSx1399) was identified in *S. agalactiae* <SEQ ID 4037> which encodes the amino acid sequence <SEQ ID 4038>. Analysis of this protein sequence reveals the following:

```
Possible site: 36
>>> Seems to have a cleavable N-term signal seq.

----- Final Results -----
            bacterial outside --- Certainty = 0.3000(Affirmative) < succ>
           bacterial membrane --- Certainty = 0.0000(Not Clear)   < succ>
          bacterial cytoplasm --- Certainty = 0.0000(Not Clear)   < succ>
```

The protein has no significant homology with any sequences in the GENPEPT database.

A related DNA sequence was identified in *S. pyogenes* <SEQ ID 4039> which encodes the amino acid sequence <SEQ ID 4040>. Analysis of this protein sequence reveals the following:

```
Possible site: 39
>>> Seems to have a cleavable N-term signal seq.

----- Final Results -----
            bacterial outside --- Certainty = 0.3000(Affirmative) < succ>
           bacterial membrane --- Certainty = 0.0000(Not Clear)   < succ>
          bacterial cytoplasm --- Certainty = 0.0000(Not Clear)   < succ>
```

An alignment of the GAS and GBS proteins is shown below.

```
Identities = 30/42 (71%), Positives = 37/42 (87%)

Query:    1 MAFGDNGQRKKTGFEKLTLFVVILMVLVTVGGLVFGAISAIM    42
            +AFG+NG RKKT FEK+T+FVVILMVLVTVGGL+  A+S +M
Sbjct:    1 VAFGENGPRKKTTFEKVTMFVVILMVLVTVGGLIASALSVLM    42
```

Based on this analysis, it was predicted that these proteins and their epitopes could be useful antigens for vaccines or diagnostics.

EXAMPLE 1320

A DNA sequence (GBSx1401) was identified in *S. agalactiae* <SEQ ID 4041> which encodes the amino acid sequence <SEQ ID 4042>. Analysis of this protein sequence reveals the following:

```
Possible site: 48
>>> Seems to have no N-terminal signal sequence
```

-continued

```
----- Final Results -----
            bacterial cytoplasm --- Certainty = 0.2484(Affirmative) < succ>
             bacterial membrane --- Certainty = 0.0000(Not Clear)   < succ>
              bacterial outside --- Certainty = 0.0000(Not Clear)   < succ>
```

The protein has homology with the following sequences in the GENPEPT database.

```
>GP: AAD28348 GB: AF102860 aminopeptidase PepS [Streptococcus
hermophilus]
Identities = 247/413 (59%), Positives = 313/413 (74%)

Query:    1 MVLQDFDNLLKKYAQLIISKGLNVQKGHTLALTIDVEQVHLARLLTEAAYEKGASEVIVD   60
            MVL +F    L+KYA+L+++ G+NVQ GHT+AL+IDVEQ  LA LL + AY   GA+EVIV
Sbjct:    1 MVLPNFKENLEKYAKLLVTNGINVQPGHTVALSIDVEQAELAHLLVKEAYALGAAEVIVQ   60

Query:   61 YTDDFITRQRLLHASDEVLTNVPQYTVDKSLALLNKKASRLVVKSSNPNAFATVDPKRLS  120
            ++DD  I R+R LHA    +   VP Y   +    LL KKASRL V+SS+P+AF  V P+RLS
Sbjct:   61 WSDDTINRERFLHAEMNRIEEVPAYKKAEMEYLLEKKASRLGVRSSDPDAFNGVAPERLS  120

Query:  121 ETTRATAIALEEQSRAIQANKVSWNVAAAAGREWAALVFPELKTSDQQVDALWDTIFKLN  180
             +A   A +    A Q+NKVSW VAAAAG+EWA  VFP  + ++ VD  LW+  IFK
Sbjct:  121 AHAKAIGAAFKPMQVATQSNKVSWTVAAAAGKEWAKKVFPNASSDEEAVDLLWNQIFKTC  180

Query:  181 RIYEDDPIAAWDAHEAKLLEKATRLNQEQFDALHYTAPGTDLTGMPKNHIWEAAGSLNA   240
            R+YE DP+ AW  H  +L  KA   LN+ QF ALHYTAPGTDLTLG+PKNH+WE+AG++NA
Sbjct:  181 RVYEKDPVRAWKEHADRLDAKARILNEAQFSALHYTAPGTDLTLGLPKNHVWESAGAINA   240

Query:  241 QGETFIANMPTEEIFSAPDYRRADGYVTSTKPLSYAGVIIENMTFTFKDGKIINVTAEKG   300
            QGE+F+ NMPTEE+F+APD+RRA GYV+STKPLSY G IIE +   TFKDG+I+++TA++G
Sbjct:  241 QGESFLPNMPTEEVFTAPDFRRAYGYVSSTKPLSYNGNIIEGIKVTFKDGEIVDITADQG   300

Query:  301 QETVQRLIEENDGARSLGEVALVPHKTPISLSGLIFFNTLFDENASNHLAIGTAYAFNVE  360
             ++ ++ L+    N+GAR+LGE ALVP  +PIS SG+ FFNTLFDENASNHLAIG AYA +VE
Sbjct:  301 EKVMKNLVFNNNGARALGECALVPDSSPISQSGITFFNTLFDENASNHLAIGAAYATSVE   360

Query:  361 GGTEMTSQELDEAGLNRSSTHVDFMIGSEQMDIDGIRADGTAVPIFRNGEWAI          413
            GG +MT +EL  AGLNRS HVDF+IGS QM+IDGI  DG+ VPIFRNG+W I
Sbjct:  361 GGADMTEEELKAAGLNRSDVHVDFIIGSNQMNIDGIHHDGSRVPIFRNGDWVI          413
```

No corresponding DNA sequence was identified in *S. pyogenes*.

Based on this analysis, it was predicted that this protein and its epitopes, could be useful antigens for vaccines or diagnostics.

EXAMPLE 1321

A DNA sequence (GBSx1403) was identified in *S. agalactiae* <SEQ ID 4045> which encodes the amino acid sequence <SEQ ID 4046>. Analysis of this protein sequence reveals the following:

```
Possible site: 33
>>> Seems to have a cleavable N-term signal seq.
     INTEGRAL    Likelihood = -7.91    Transmembrane    661-677 (657-680)

----- Final Results -----
             bacterial membrane --- Certainty = 0.4163(Affirmative) < succ>
              bacterial outside --- Certainty = 0.0000(Not Clear)   < succ>
            bacterial cytoplasm --- Certainty = 0.0000(Not Clear)   < succ>
```

A related GBS nucleic acid sequence <SEQ ID 8787> which encodes amino acid sequence <SEQ ID 8788> was also identified. Analysis of this protein sequence reveals the following:

```
Lipop: Possible site: -1 Crend: 7
McG: Discrim Score: 6.47
GvH: Signal Score (-7.5): 1.01
     Possible site: 29
```

-continued

```
>>> Seems to have a cleavable N-term signal seq.
ALOM program count: 1 value: -7.91 threshold: 0.0
    INTEGRAL      Likelihood = -7.91    Transmembrane    658-673 (657-680)
    PERIPHERAL    Likelihood = 4.35     555
modified ALOM score: 2.08
*** Reasoning Step: 3

----- Final Results -----
              bacterial membrane --- Certainty = 0.4163(Affirmative) < succ>
              bacterial outside  --- Certainty = 0.0000(Not Clear)   < succ>
              bacterial cytoplasm --- Certainty= 0.0000(Not Clear)   < succ>
LPXTG motif: 647-651
```

The protein has homology with the following sequences in the GENPEPT database.

```
>GP: AAF09821 GB: AE001885 6-aminohexanoate-cyclic-dimer hydrolase
[Deinococcus radiodurans]
Identities = 150/497 (30%), Positives = 233/497 (46%), Gaps = 32/497 (6%)

Query: 110 LTEETYKQKDGQDLANMVRSGQVTSEELVNMAYDIIAKENPSLNAVITTRRQEAIEEARK 169
           LT   Y + D  DLA + R G++++E++   A       N +LNAV+    + + +AR
Sbjct:  45 LTFAEYDRLDALDLAQLFRRGELSAEDMCTAAIHRAQVVNVALNAVVYPLYDQGLAQARA 104

Query: 170 L-------KDTNQPFLGVPLLVKGLGHSIKGGETNNGLIYADGKISTFDSSYVKKYKDLG 222
                   +   PF GVP LVK G  + G         +I  +D    V++++    G
Sbjct: 105 TDAARARGEQATGPFAGVPFLVKDFGSRLAGVPHTGGTRAYRDQIPEWDDELVRRWQAAG 164

Query: 223 FIILGQTNFPEYGWRNITDSKLYGLTHNPWDLAHNAGGSSGGSAAAIASGMTPIASGSDA 282
            + LG+TN PE+     +T+ +L+G T NPWDL   GGSSGGSA+A+A+G+ P+A    D
Sbjct: 165 LLPLGKTNTPEFALMGVTEPELHGPTRNPWDLGRTPGGSSGGSASAVAAGIVPLAGAGDG 224

Query: 283 GGSIRIPSSWTGLVGLKPTRGLV---SNEKPDSYSTAVHFPLTKSSRDAETLLTYLKKSD 339
           GGSIRIP+S   GL GLKP+RG V              AV   LT+S RD+  LL   + D
Sbjct: 225 GGSIRIPASCCGLFGLKPSRGRVPCGDGVGEPWQGAAVEHVLTRSVRDSAALLDLEQGPD 284

Query: 340 QTLVSV-------------NDLKSLPIAYTLKSPMGTEVSQDAKNAIMDNVTFLRKQGFK 386
                              +   L I ++   P+G V   A+       L    G +
Sbjct: 285 AGAALFLPSPERPYSEEVGREPGRLRIGFSTAHPLGRSVHPECVAAVQGAARLLESLGHE 344

Query: 387 VTEIDLPIDGRALMRDYSTLAIGMGGAFSTIEKDLKKHGFTKEDVDPITWAVHVIYQNSD 446
           V E+ LP DG AL + +  L  G  GA      +D        DV+ +TW +  + ++
Sbjct: 345 VEEVALPWDGPALAQAFLMLYFGETGASLAALRDTLGRPARASDVEAVTWLLGQLGRSYS 404

Query: 447 KAELKKSIMEAQKHMDDYRKAMEKLHKQFPIFLSPTTASLAPLNTDFY----VTEEDKRA 502
             A+      A+   + + +AM + H+ + + L+P A+  PL         V      RA
Sbjct: 405 AAD----FAAARASWNVHARAMGRFHQNYDLLLTPVLAT-PPLQIGELQPRGVQAALLRA 459

Query: 503 IYNMENLSQEERIALFNRQWEPMLRRTPFTQIANMTGLPAISIPTYLSESGLPIGTMLMA 562
              M+       R   +    +L + P+TQ+AN+TG PA+S+P + +    GLP+G   +A
Sbjct: 460 AQQMDVSGLLRRSGQVDALATDILEKMPYTQLANLTGQPAMSVPLHWTADGLPVGVQFVA 519

Query: 563 GANYDMVLIKFATFFEK                                            579
            + VL++ A    E+
Sbjct: 520 PLAREDVLLRLAGQLEQ                                            536
```

There is also homology to SEQ ID 4048.

SEQ ID 8788 (GBS173) was expressed in *E. coli* as a GST-fusion product. SDS-PAGE analysis of total cell extract is shown in FIG. 41 (lane 5; MW 96.8 kDa).

The GBS173-GST fusion product was purified (FIG. 116A; see also FIG. 201, lane 7) and used to immunise mice (lane 1+2 product; 15 µg/mouse). The resulting antiserum was used for Western blot, FACS, and in the in vivo passive protection assay (Table III). These tests confirm that the protein is immunoaccessible on GBS bacteria and that it is an effective protective immunogen.

Based on this analysis, it was predicted that these proteins and their epitopes could be useful antigens for vaccines or diagnostics.

EXAMPLE 1322

A DNA sequence (GBSx1404) was identified in *S. agalactiae* <SEQ ID 4049> which encodes the amino acid sequence <SEQ ID 4050>. This protein is predicted to be ribosomal large subunit pseudouridine synthase B (rsuA). Analysis of this protein sequence reveals the following:

```
Possible site: 41
>>> Seems to have no N-terminal signal sequence

----- Final Results -----
            bacterial cytoplasm --- Certainty = 0.3674(Affirmative) < succ>
            bacterial membrane  --- Certainty = 0.0000(Not Clear)   < succ>
             bacterial outside  --- Certainty = 0.0000(Not Clear)   < succ>
```

The protein has homology with the following sequences in the GENPEPT database.

```
>GP: BAB06992 GB: AP001518 16S pseudouridylate synthase
[Bacillus halodurans]
Identities = 110/236 (46%), Positives = 149/236 (62%), Gaps = 4/236 (1%)

Query:   1 MRLDKFLVECGLGSRTQVKLILKKKQISVNGNSETSPKVQVDEYRDEIKYNGTLVSYEKF  60
           MR+DKFL   G GSR VK +LK    + V G       P    V+   + I    G  V Y+ +
Sbjct:   1 MRIDKFLANMGFGSRKDVKKLLKTGAVRVQGQPIKDPSTHVEPESESITVYGEEVEYKPY  60

Query:  61 VYYMLHKPKGVISATDDPSHKTVLDLLDKTARDKAVFPVGRLDIDTTGLLLLTNNGELAH 120
           VY M++KPKGVI AT+D  H+TV+DLL +   R     PVGRLD DT GLLL+TN+G+  H
Sbjct:  61 VYLMMNKPKGVICATEDLEHETVIDLLGEEERHYEPSPVGRLDKDTVGLLLITNDGKFNH 120

Query: 121 KMLSPKKHVDKCYEVKISGIMTEDDILAFDKGIILKD-FTCLPALLEIVEVNQVKKQSLV 179
           ++SPK  HV K Y    + G +TE+D+ AF  G++L D +     PA L I+E        +S +
Sbjct: 121 WLMSPKHHVPKTYRALVEGHVTEEDVGAFSHGVVLDDGYVTKPATLHILEAG---ARSHI 177

Query: 180 KITIKEGKFHQVKRMVAACGKEVLELKRLRMGNLQLDKQLESGQWRRLTIKEIEKL     235
           ++ +  EGKFHQVKRM  A GK VLEL+R+++GNL LD +L  G++R LT +EI    L
Sbjct: 178 ELILTEGKFHQVKRMFQAVGKRVLELERIKIGNLLLDPELARGEYRELTKEEIALL    233
```

A related DNA sequence was identified in *S. pyogenes* <SEQ ID 4051> which encodes the amino acid sequence <SEQ ID 4052>. Analysis of this protein sequence reveals the following:

```
Possible Site: 40
>>> Seems to have no N-terminal signal sequence

----- Final Results -----
            bacterial cytoplasm --- Certainty = 0.0152(Affirmative) < succ>
            bacterial membrane  --- Certainty = 0.0000(Not Clear)   < succ>
             bacterial outside  --- Certainty = 0.0000(Not Clear)   < succ>
```

The protein has homology with the following sequences in the databases:

```
>GP: AAF09821 GB: AE001885 6-aminohexanoate-cyclic-dimer hydrolase
[Deinococcus radiodurans]
Identities = 177/485 (36%), Positives = 259/485 (52%), Gaps = 13/485 (2%)

Query:   5 DATAMAIAVQTGQTTPLELVTQAIYKAKKLNPTLNAITSERFEAALEEAKQRDFSGL---  61
           DA  +A   + G+ +  ++ T AI++A+ +N  LNA+     ++ L +A+  D +
Sbjct:  54 DALDLAQLFRRGELSAEDMCTAAIHRAQVVNVALNAVVYPLYDQGLAQARATDAARGE   113

Query:  62 ----PFAGVPLFLKDLGQELKGHSSTSGSRLFKEYQATKTDLFVKRLEALGFIILGRSNT 117
               PFAGVP  +KD G  L G    T G+R +++       D   V+R +A G + LG++NT
Sbjct: 114 QATGPFAGVPFLVKDFGSRLAGVPHTGGTRAYRDQIPEWDDELVRRWQAAGLLPLGKTNT 173

Query: 118 PEFGFKNISDSSLHGPVNLPRDNTRNAGGSSGGAAALVSSGISALATASDGGGSIRIPAS 177
           PEF     +++ LHGP  P D  R  GGSSGG+A+ V++GI   LA A DGGGSIRIPAS
Sbjct: 174 PEFALMGVTEPELHGPTRNPWDLGRTPGGSSGGSASAVAAGIVPLAGAGDGGGSIRIPAS 233
```

```
-continued
Query:  178 FNGLIGLKPSRGRMPVGPGSYRSWQGASVHFALTKSVRDTRNLLYYLQMEQMESPFPLAT  237
            GL GLKPSRGR+P G G    WQGA+V  LT+SVRD+ LL  Q      + L +
Sbjct:  234 CCGLFGLKPSRGRVPCGDGVGEPWQGAAVEHVLTRSVRDSAALLDLEQGPDAGAALFLPS  293

Query:  238 LTKDSIYQSLQRP--LTIAFYQRLSDGSPVSLDTAKALRQAVTWLREQGHQLVELEEFPV  295
             +    +  + P  L IF    G V +   A++ A   L   GH++ E+    P
Sbjct:  294 PERPYSEEVGREFGRLRIGFSTAHPLGRSVHPECVAAVQGAARLLESLGHEVEEV-ALPW  352

Query:  296 NMTEVIRHYYIMNSVETAAMFADIEDTFGRPMTKDDMETMTWAIYQSGKDIPAWRYSQVL  355
             +    + + + ++   ET A  A + DT GRP     D+E +TW + Q G+    A ++
Sbjct:  353 DGPALAQAFLMLYFGETGASLAALRDTLGRPARASDVEAVTWLLGQLGRSYSAADFAAAR  412

Query:  356 QKWDTYSATMASFHETYDLLLTFTTNTPAPKHGELVP---DSKLMANLAQAEIFSSEEQF  412
             W+ ++   M   FH+ YDLLLT     TP  +  GEL P   +  L+    Q ++   +
Sbjct:  413 ASWNVHARAMGRFHQNYDLLLTPVLATPPLQIGELQPRGVQAALLRAAQQMDVSGLLRRS  472

Query:  413 NLVETMFGKSLAINPYTALPNLTGQPAISLPTYETKEGLSMGIQLIAAKGREDLLLGIAE  472
             V+ +    L     PYT L  NLTGQPA+S+P + T  +GL  +G+Q  +A    RED+LL  +A
Sbjct:  473 GQVDALATDILEKMPYTQLANLTGQPAMSVPLHWTADGLPVGVQFVAPLAREDVLLRLAG  532

Query:  473 QFEAA  477
             Q E A
Sbjct:  533 QLEQA  537
```

An alignment of the GAS and GBS proteins is shown below.

```
Identities = 151/240 (62%), Positives = 183/240 (75%)

Query:    1 MRLDKFLVECGLGSRTQVKLILKKKQISVNGNSETSPKVQVDEYRDEIKYNGTLVSYEKF   60
            MRLDKFLV G+G+R+QVKL+LKKK I VN   ETS K  +DEY+D + Y GT + YE F
Sbjct:    2 MRLDKFLVATGVGTRSQVKLLLKKKAIFVNQKVETSAKAHIDEYKDLVTYQGTPLVYESF   61

Query:   61 VYYMLHKPKGVISATDDPSHKTVLDLLDKTARDKAVFPVGRLDIDTTGLLLLTNNGELAH  120
            VYY+L+KP G +SAT D    TV++LLD TAR KAVFPVGRLD DT GLLLLTNNG+LAH
Sbjct:   62 VYYLLNKPSGYVSATQDRQQATVMELLDDTARQKAVFPVGRLDKDTRGLLLLTNNGQLAH  121

Query:  121 KMLSPKKHVDKCYEVKISGIMTEDDILAFDKGIILKDFTCLPALLEIVEVNQVKKQSLVK  180
              +LSPKKHV K Y K++GIMTE D   F +GI LKD  CLPA LE++   +  ++ SLVK
Sbjct:  122 DLLSPKKHVTKEYLAKVAGIMTEADKDYFARGISLKDHQCLPAHLEVLASDLQQQTSLVK  181

Query:  181 ITIKEGKFHQVKRMVAACGKEVLELKRLRMGNLQLDKQLESGQWRRLTIKEIEKLEKYMQ  240
            ITI+EGKFHQVKRMVAACGKEVL+L+RL MG L+LD   L   G++RRLT +E++ L Y Q
Sbjct:  182 ITIQEGKFHQVKRMVAACGKEVLDLQRLSMGPLKLDPSLAEGEFRRLTPEELQSLAPYCQ  241
```

Based on this analysis, it was predicted that these proteins and their epitopes could be useful antigens for vaccines or diagnostics.

EXAMPLE 1323

A DNA sequence (GBSx1405) was identified in *S. agalactiae* <SEQ ID 4053> which encodes the amino acid sequence <SEQ ID 4054>. Analysis of this protein sequence reveals the following:

```
Possible site: 46
>>> Seems to have no N-terminal signal sequence

----- Final Results -----
         bacterial cytoplasm --- Certainty = 0.2811(Affirmative) < succ>
          bacterial membrane --- Certainty = 0.0000(Not Clear)   < succ>
           bacterial outside --- Certainty = 0.0000(Not Clear)   < succ>
```

A related GBS nucleic acid sequence <SEQ ID 10007> which encodes amino acid sequence <SEQ ID 10008> was also identified.

The protein has homology with the following sequences in the GENPEPT database.

```
>GP:AAA57350 GB:J04483 reductase [Leishmania major]
Identities = 129/277 (46%), Positives = 167/277 (59%), Gaps = 3/277 (1%)
```

-continued

```
Query:    26  TLSNTLNIPKIGFGTWQLTEGEEAYKAVTHALKVGYTHIDTAQIYGNEHSVGRAIRDSGL   85
              TLSN + +P+ G G WQ   GE    AV  AL  GY HIDTA IY NE SVG  +R SG+
Sbjct:    10  TLSNGVKMPQFGLGVWQSPAGEVTENAVNWALCAGYRHIDTAAIYKNEESVGAGLRASGV   69

Query:    86  ARESIFLTTKIWNDKHDYHLAKASIDESLQKLGVDYIDLLLIHWPNPKALRENDAWKAGN  145
              RE +F+TTK+WN +  Y    A+ +ES QKLGVDYIDL LIHWP  K +   +  K
Sbjct:    70  PREDVFITTKLWNTEQGYESTLAAFEESRQKLGVDYIDLYLIHWPRGKDILSKEGKKY--  127

Query:   146  AGTWKAMEEAYKEGKVKAIGVSNFMKHHLEALFETAEIKPMVNQIILAPGCAQEDLVRFC  205
              +W+A E+ YKE KV+AIGVSNF  HHLE +      + PMVNQ+ L P   Q DL  FC
Sbjct:   128  LDSWRAFEQLYKEKKVRAIGVSNFHIHHLEDVLAMCTVTPMVNQVELHPLNNQADLRAFC  187

Query:   206  KGNDILLEAYSPFGTGAIFENESIKAIAEKYGKSVAQVALRWSLDNGFLPLPKSATPKNI  265
                 I +EA+SP G G +  N  + AI  KY K+ AQV LRW++     + +PKS   + I
Sbjct:   188  DAKQIKVEAWSPLGQGKLLSNPILSAIGAKYNKTAAQVILRWNIQKNLITIPKSVHRERI  247

Query:   266  EANLDIFDFQLNEDDIATLIQLDSGIK-PKDPDNVSF                         301
              E N DIFDF+L  +D+ ++  L++  +    DPD   F
Sbjct:   248  EENADIFDFELGAEDVMSIDALNTNSRYGPDPDEAQF                         284
```

A related DNA sequence was identified in *S. pyogenes* <SEQ ID 779> which encodes the amino acid sequence <SEQ ID 780>. Analysis of this protein sequence reveals the following:

```
Possible site: 27
>>> Seems to have no N-terminal signal sequence

----- Final Results -----
              bacterial cytoplasm --- Certainty = 0.0980(Affirmative) < succ>
              bacterial membrane  --- Certainty = 0.0000(Not Clear)   < succ>
              bacterial outside   --- Certainty = 0.0000(Not Clear)   < succ>
```

An alignment of the GAS and GBS proteins is shown below.

```
Identities = 155/282 (54%), Positives = 204/282 (71%), Gaps = 2/282 (0%)

Query:    20  IVMETYTLSNTLNIPKIGFGTWQLTEGEEAYKAVTHALKVGYTHIDTAQIYGNEHSVGRA   79
              +++ T  +++    IP +GFGT+Q  +GEEAY++   A+K GY HIDTA IY NE SVGRA
Sbjct:     1  VMVTTVKMTSGYEIPVLGFGTYQAADGEEAYQSTLAAIKAGYRHIDTAAIYKNEESVGRA   60

Query:    80  IRDSGLARESIFLTTKIWNDKHDYHLAKASIDESLQKLGVDYIDLLLIHWPNPKALREND  139
              I+DSG+ RE +F+TTK+WND H Y  AK ++    SL +LG+DY+DL LIHWPNPKALR  +
Sbjct:    61  IKDSGVLREDLFITTKLWNDAHSYEGAKDALAASLDRLGLDYVDLYLIHWPNPKALR--N  118

Query:   140  AWKAGNAGTWKAMEEAYKEGKVKAIGVSNFMKHHLEALFETAEIKPMVNQIILAPGCAQE  199
               WK  NA  W+ MEEA + G +K+IGVSNFM HHLEAL ETA+I P +NQI LAPGC Q+
Sbjct:   119  TWKEANAQAWQYMEEAVEAGLIKSIGVSNFMVHHLEALQETAKITPAINQIRLAPGCYQK  178

Query:   200  DLVRFCKGNDILLEAYSPFGTGAIFENESIKAIAEKYGKSVAQVALRWSLDNGFLPLPKS  259
              ++V +CK N+ILLEA+SP G G IF+NE+++ +A KY K+VAQVAL WSL  GF+PLPKS
Sbjct:   179  EVVDYCKANEILLEAWSPLGQGEIFDNETMQQLANKYDKTVAQVALAWSLAEGFIPLPKS  238

Query:   260  ATPKNIEANLDIFDFQLNEDDIATLIQLDSGIKPKDPDNVSF                    301
                + I+ N+ IFD  L ++D T+  L        +PD   SF
Sbjct:   239  VHDERIKENMAIFDVSLTQEDKKTIRYLSGMSAIPNPDTTSF                    280
```

Based on this analysis, it was predicted that these proteins and their epitopes could be useful antigens for vaccines or diagnostics.

EXAMPLE 1324

A DNA sequence (GBSx1406) was identified in *S. agalactiae* <SEQ ID 4055> which encodes the amino acid sequence <SEQ ID 4056>. Analysis of this protein sequence reveals the following:

```
Possible site: 26
>>> Seems to have no N-terminal signal sequence
```

-continued

----- Final Results -----
             bacterial cytoplasm --- Certainty = 0.0633(Affirmative) < succ>
              bacterial membrane --- Certainty = 0.0000(Not Clear) < succ>
               bacterial outside --- Certainty = 0.0000(Not Clear) < succ>
```

A related GBS nucleic acid sequence <SEQ ID 10009> which encodes amino acid sequence <SEQ ID 10010> was also identified.

The protein has homology with the following sequences in the GENPEPT database.

```
>GP:CAB12612 GB:Z99108 similar to NAD(P)H-flavin oxidoreductase
[Bacillus subtilis]
Identities = 106/223 (47%), Positives = 150/223 (66%), Gaps = 8/223 (3%)

Query:    29 DIKKQVRRAFDFRMAIRVYN-NNDIPKEDMEYILDTAWLSPSSVGLEGWRFLVLDRQTIA
             D+K Q+   A++FR A + ++ N  +    D E+IL+T  LSPSS+GLE W+F+V+
Sbjct:     3 DLKTQILDAYNFRHATKEFDPNKKVSDSDFEFILETGRLSPSSLGLEPWKFVVVQNP---   59

Query:    88 KFRDKLKEVAWGAQYQLDTASHFVLLLAE--KGAYYNADSMINSLIRRGLGDPAALESRI   145
             +FR+KL+E WGAQ QL TASHFVL+LA   K   YNAD + L           E   +
Sbjct:    60 EFREKLREYTWGAQKQLPTASHFVLILARTAKDIKYNADYIKRHLKEVKQMPQDVYEGYL   119

Query:   146 PLYKSFQENDMKI-DSERSLWDWTAKQTYIALGNMMTAAAMIGVDSCPIEGFDYEKVNNI   204
             + FQ+ND+ + +S+R+L+DW +KQTYIALGNMMTAAA IGVDSCPIEGF Y+ ++ I
Sbjct:   120 SKTEEFQKNDLHLLESDRTLFDWASKQTYIALGNMMTAAAQIGVDSCPIEGFQYDHIHRI   179

Query:   205 LSKEGLIDDKKEAISCMVSFGYRLREPKHSRARKERQEVITWV                   247
             L +EGL+++    IS MV+FGYR+R+P+  + R    ++V+ WV
Sbjct:   180 LEEEGLLENGSFDISVMVAFGYRVRDPR-PKTRSAVEDVVKWV                    221
```

A related DNA sequence was identified in *S. pyogenes* <SEQ ID 4057> which encodes the amino acid sequence <SEQ ID 4058>. Analysis of this protein sequence reveals the following:

```
Possible site: 47
>>> Seems to have no N-terminal signal sequence

----- Final Results -----
             bacterial cytoplasm --- Certainty = 0.1705(Affirmative) < succ>
              bacterial membrane --- Certainty = 0.0000(Not Clear) < succ>
               bacterial outside --- Certainty = 0.0000(Not Clear) < succ>
```

An alignment of the GAS and GBS proteins is shown below.

```
Identities = 126/222 (56%), Positives = 174/222 (77%), Gaps = 4/222 (1%)

Query:    28 EDIKKQVRRAFDFRMAIRVYNNNDIPKEDMEYILDTAWLSPSSVGLEGWRFLVLDRQTIA    87
             + I  Q+++A  FR A+RVY    I  ED+  ILD AWLSPSS+GLEGWRF+VLD + I
Sbjct:     3 QTIHHQIQQALHFRTAVRVYKEEKISDEDLALILDAAWLSPSSIGLEGWRFVVLDNKPI-    61

Query:    88 KFRDKLKEVAWGAQYQLDTASHFVLLLAEKGAYYNADSMINSLIRRGLGDPAALESRIPL   147
             ++++K  AWGAQYQL+TASHF+LL+AEK A Y++ ++ NSL+RRG+ +   L SR+ L
Sbjct:    62 --KEEIKPFAWGAQYQLETASHFILLIAEKHARYDSPAIKNSLLRRGIKEGDGLNSRLKL   119

Query:   148 YKSFQENDMKI-DSERSLWDWTAKQTYIALGNMMTAAAMIGVDSCPIEGFDYEKVNNILS   206
             Y+SFQ+ DM + D+ R+L+DWTAKQTYIALGNMM  AA++G+D+CPIEGF Y+KVN+IL+
Sbjct:   120 YESFQKEDMDMADNPRALFDWTAKQTYIALGNMMMTAALLGIDTCPIEGFHYDKVNHILA   179

Query:   207 KEGLIDDKKEAISCMVSFGYRLREPKHSRARKERQEVITWVE                    248
             K  +ID +KE I+ M+S GYRLR+PKH++ RK ++EVI+ V+
Sbjct:   180 KHNVIDLEKEGIASMLSLGYRLRDPKHAQVRKPKEEVISVVK                    221
```

Based on this analysis, it was predicted that these proteins and their epitopes could be useful antigens for vaccines or diagnostics.

EXAMPLE 1325

A DNA sequence (GBSx1407) was identified in *S. agalactiae* <SEQ ID 4059> which encodes the amino acid sequence <SEQ ID 4060>. This protein is predicted to be lactoylglutathione lyase (gloA). Analysis of this protein sequence reveals the following:

```
Possible site: 25
>>> Seems to have no N-terminal signal sequence

----- Final Results -----
            bacterial cytoplasm --- Certainty = 0.1656(Affirmative) < succ>
              bacterial membrane --- Certainty = 0.0000(Not Clear) < succ>
                bacterial outside --- Certainty = 0.0000(Not Clear) < succ>
```

The protein has homology with the following sequences in the GENPEPT database.

```
>GP:AAC21986 GB:U32717 lactoylglutathione lyase
(gloA) [Haemophilus influenzae Rd]
Identities = 59/131 (45%), Positives = 86/131 (65%), Gaps = 2/131 (1%)

Query:    1 MPFLHTCIRVKDLDASIAFYQEALGFKEVRRNDFPENQFTLVYMALEDDPSY-ELELTYN    59
            M   LHT +RV DLD SI FYQ+ LG + +R ++ PE ++TL ++   ED   S  E+ELTYN
Sbjct:    1 MQILHTMLRVGDLDRSIKFYQDVLGMRLLRTSENPEYKYTLAFLGYEDGESAAEIELTYN    60

Query:   60 YDHEAYDLGNGYGHIAVGVDDLETTYDAHQKAGYSVTKISG-LPGKPNMFYFIQDPDGYK   118
            +  + Y+ G  YGHIA+GVDD+  T +A + +G +VT+ +G + G    +  F++DPDGYK
Sbjct:   61 WGVDKYEHGTAYGHIAIGVDDIYATCEAVRASGGNVTREAGPVKGGSTVIAFVEDPDGYK   120

Query:  119 IEVIRLSQFKA                                                  129
            IE I    K+
Sbjct:  121 IEFIENKSTKS                                                  131
```

A related DNA sequence was identified in *S. pyogenes* <SEQ ID 4061> which encodes the amino acid sequence <SEQ ID 4062>. Analysis of this protein sequence reveals the following:

```
Possible site: 23
>>> Seems to have no N-terminal signal sequence

----- Final Results -----
            bacterial cytoplasm --- Certainty = 0.1382(Affirmative) < succ>
              bacterial membrane --- Certainty = 0.0000(Not Clear) < succ>
                bacterial outside --- Certainty = 0.0000(Not Clear) < succ>
```

An alignment of the GAS and GBS proteins is shown below.

```
Identities = 80/125 (64%), Positives = 93/125 (74%), Gaps = 1/125 (0%)

Query:    1 MPFLHTCIRVKDLDASIAFYQEALGFKEVRRNDFPENQFTLVYMALEDDPSYELELTYNY    60
            M  LHTCIRVKDLD S+AFY  A  FKE  R DFP++QFTLVY+ALE +  SYELELTYNY
Sbjct:    1 MKALHTCIRVKDLDQSVAFYTSAFPFKENYRKDFPDSQFTLVYLALEGE-SYELELTYNY    59

Query:   61 DHEAYDLGNGYGHIAVGVDDLETTYDAHQKAGYSVTKISGLPGKPNMFYFIQDPDGYKIE   120
              H   YDLGNGYGHIA+G + E + H++AG+VT I  L  K   +YFIQDPDGYKIE
Sbjct:   60 GHGDYDLGNGYGHIALGSEHFEADHKKHRQAGFPVTDIKELADKSARYYFIQDPDGYKIE   119

Query:  121 VIRLS                                                         125
            VI L+
Sbjct:  120 VIDLN                                                         124
```

Based on this analysis, it was predicted that these proteins and their epitopes could be useful antigens for vaccines or diagnostics.

EXAMPLE 1326

A DNA sequence (GBSx1408) was identified in *S. agalactiae* <SEQ ID 4063> which encodes the amino acid sequence <SEQ ID 4064>. Analysis of this protein sequence reveals the following:

```
Possible site: 29
>>> Seems to have an uncleavable N-term signal seq
     INTEGRAL    Likelihood = -9.02    Transmembrane    241-257 (229-262)
     INTEGRAL    Likelihood = -4.94    Transmembrane    270-286 (264-287)

----- Final Results -----
              bacterial membrane --- Certainty = 0.4609(Affirmative) < succ>
               bacterial outside --- Certainty = 0.0000(Not Clear)   < succ>
             bacterial cytoplasm --- Certainty = 0.0000(Not Clear)   < succ>
```

The protein has homology with the following sequences in the GENPEPT database.

```
>GP:CAB12688 GB:Z99108 stress response protein [Bacillus subtilis]
Identities = 139/304 (45%), Positives = 200/304 (65%), Gaps = 3/304 (0%)

Query:    3 LLSVIVPCYNEQETVSTFLTEIKKVESEMARYTHFEYIFVNDGSTDRTLELLKKAAKQFD    62
            L+S+I+P YNE    V      +KK E +    Y  +E  F+NDGS D TL+ +K   A
Sbjct:    5 LISIIIPSYNEGYNVKLIHESLKK-EFKNIHYD-YEIFFINDGSVDDTLQQIKDLAATCS   62

Query:   63 NVHYLSFSRHFGKDAALLAGLEHTTGDFITVMDVDLQDPPTLLPEMYLKLQEGYDIVATR  122
               V Y+SFSR+FGK+AA+LAG EH  G+ + VMD DLQ P  LL E       +EGYD V  +
Sbjct:   63 RVKYISFSRNFGKEAAILAGFEHVQGEAVIVMDADLQHPTYLLKEFIKGYEEGYDQVIAQ  122

Query:  123 RKDRKGEPLIRSLFAKLFYKLINQVSDTKMVDGARDFRLMTKQVVDSILELNEVNRFSKG  182
            R +RKG+   +RSL + ++YK IN+   +   + DG   DFRL+++Q V+++L+L+E NRFSKG
Sbjct:  123 R-NRKGDSFVRSLLSSMYYKFINKAVEVDLRDGVGDFRLLSRQAVNALLKLSEGNRFSKG  181

Query:  183 IFSWIGYDVAYISYENRERIAGKTSWSFFNLLKYSLDGFINFSEIPLAIATWIGTLSSVL  242
            +F WIG+D    + YEN ER   G + WSF +L  Y +DG ++F+   PL +   + G      +L
Sbjct:  182 LFCWIGFDQKIVFYENVERKNGTSKWSFSSLFNYGMDGVVSFNHKPLRLCFYTGIFILLL  241

Query:  243 SLLAIIFIIIRKLLFGDPVSGWASTVTIVLFMGGIQLLSLGIIGKYISKIFLETKKRPVY  302
            S++ II    ++  L    G   V G+   +  ++ VLF+GG+QLLSLGIIG+YI  +I+ ETKKRP Y
Sbjct:  242 SIIYIIATFVKILTNGISVPGYFTIISAVLFLGGVQLLSLGIIGEYIGRIYYETKKRPHY  301

Query:  303 IVKE                                                          306
            ++KE
Sbjct:  302 LIKE                                                          305
```

A related DNA sequence was identified in *S. pyogenes* <SEQ ID 4065> which encodes the amino acid sequence <SEQ ID 4066>. Analysis of this protein sequence reveals the following:

```
Possible site: 56
>>> Seems to have an uncleavable N-term signal seq
     INTEGRAL    Likelihood = -9.55    Transmembrane    256-272 (251-282)
     INTEGRAL    Likelihood = -5.31    Transmembrane    290-306 (284-307)

----- Final Results -----
              bacterial membrane --- Certainty = 0.4821(Affirmative) < succ>
               bacterial outside --- Certainty = 0.0000(Not Clear)   < succ>
             bacterial cytoplasm --- Certainty = 0.0000(Not Clear)   < succ>
```

A related sequence was also identified in GAS <SEQ ID 9113> which encodes the amino acid sequence <SEQ ID 9114>. Analysis of this protein sequence reveals the following:

```
Possible cleavage site: 36
>>> Seems to have an uncleavable N-term signal seq ----- Final Results -----
              bacterial membrane --- Certainty = 0.482(Affirmative) < succ>
```

-continued
```
            bacterial outside --- Certainty = 0.000(Not Clear) < succ>
            bacterial cytoplasm --- Certainty = 0.000(Not Clear) < succ>
```

An alignment of the GAS and GBS proteins is shown below.

```
Identities = 207/307 (67%), Positives = 258/307 (83%)

Query:    1 MALLSVIVPCYNEQETVSTFLTEIKKVESEMARYTHFEYIFVNDGSTDRTLELLKKAAKQ    60
            M LLS+IVPC+NE+  +  +  E+ ++E+ M     FEYIF++DGS D TL +L++ A +
Sbjct:   21 MTLLSIIVPCFNEEANILPYFEEMHQLETSMTNQLAFEYIFIDDGSKDNTLGILRELAAR   80

Query:   61 FDNVHYLSFSRHFGKDAALLAGLEHTTGDFITVMDVDLQDPPTLLPEMYLKLQEGYDIVA   120
            F NVHYLSFSRHFGK+A LLAGL+    G++ITVMDVDLQDPP LLP MY KL+EGYDIV
Sbjct:   81 FPNVHYLSFSRHFGKEAGLLAGLKEAKGNYITVMDVDLQDPPELLPIMYAKLKEGYDIVG  140

Query:  121 TRRKDRKGEPLIRSLFAKLFYKLINQVSDTKMVDGARDFRLMTKQVVDSILELNEVNRFS  180
            TRR++R+GEPLIRS+ + LFY LI  +SDT+MV+G RD+RLMT+QVVDSILEL EVNRFS
Sbjct:  141 TRRQNRQGEPLIRSMCSNLFYGLIKHLSDTEMVNGVRDYRLMTRQVVDSILELGEVNRFS  200

Query:  181 KGIFSWIGYDVAYISYENRERIAGKTSWSFFNLLKYSLDGFINFSEIPLAIATWIGTLSS  240
            KGIFSW+GY + Y+S+EN++R  GK+ W F+ LL+YSLDGFINFSE+PL IATW GT S
Sbjct:  201 KGIFSWVGYRITYLSFENQKRKYGKSRWHFWELLRYSLDGFINFSEMPLTIATWTGTFSF  260

Query:  241 VLSLLAIIFIIIRKLLFGDPVSGWASTVTIVLFMGGIQLLSLGIIGKYISKIFLETKKRP  300
            ++S+ AI+FIIIRK+LFGDPVSGWASTV+I+LFMGGIQL  +GIIGKYISKIFLETKKRP
Sbjct:  261 LISIFAILFIIIRKILFGDPVSGWASTVSIILFMGGIQLFCMGIIGKYISKIFLETKKRP  320

Query:  301 VYIVKEE                                                      307
            +YI+KE+
Sbjct:  321 LYIIKEK                                                      327
```

Based on this analysis, it was predicted that these proteins and their epitopes could be useful antigens for vaccines or diagnostics.

EXAMPLE 1327

A DNA sequence (GBSx1409) was identified in *S. agalactiae* <SEQ ID 4067> which encodes the amino acid sequence <SEQ ID 4068>. This protein is predicted to be d-serine/d-alanine/glycine transporter (cycA). Analysis of this protein sequence reveals the following:

```
Possible site: 49
>>> Seems to have no N-terminal signal sequence
      INTEGRAL    Likelihood = -2.44    Transmembrane    50-66 (50-66)
      INTEGRAL    Likelihood = -1.49    Transmembrane    27-43 (27-43)

----- Final Results -----
            bacterial membrane --- Certainty = 0.1977(Affirmative) < succ>
            bacterial outside  --- Certainty = 0.0000(Not Clear)   < succ>
            bacterial cytoplasm --- Certainty = 0.0000(Not Clear)  < succ>
```

The protein has homology with the following sequences in the GENPEPT database.

```
>GP:CAA83253 GB:Z31377 potential amino acid permease
[Lactobacillus delbrueckii]
Identities = 34/55 (61%), Positives = 44/55 (79%)

Query:    7 DHTQKSENGMVRGLENRHVQLIAIAGTIGTGLFLGAGRSISLTGPSIVLVYAITG   61
            D + ++ +G +R L NRHVQ+IAI GTIGTGLFLGAG +IS TGPS++ +YAI G
Sbjct:    5 DRSIENTDGTIRSLSNRHVQMIAIGGTIGTGLFLGAGTTISATGPSVIFIYAIMG   59
```

A related DNA sequence was identified in *S. pyogenes* <SEQ ID 4069> which encodes the amino acid sequence <SEQ ID 4070>. Analysis of this protein sequence reveals the following:

```
Possible site: 53
>>> Seems to have no N-terminal signal sequence
      INTEGRAL     Likelihood = -11.15    Transmembrane    170-186 (161-190)
      INTEGRAL     Likelihood =  -8.44    Transmembrane    256-272 (252-274)
      INTEGRAL     Likelihood =  -8.33    Transmembrane    352-368 (347-375)
      INTEGRAL     Likelihood =  -7.54    Transmembrane    139-155 (133-160)
      INTEGRAL     Likelihood =  -5.73    Transmembrane    420-436 (417-440)
      INTEGRAL     Likelihood =  -3.88    Transmembrane     56- 72  (54-75)
      INTEGRAL     Likelihood =  -3.40    Transmembrane    283-299 (282-300)
      INTEGRAL     Likelihood =  -3.29    Transmembrane    440-456 (439-458)
      INTEGRAL     Likelihood =  -1.49    Transmembrane     31- 47  (31-47)
      INTEGRAL     Likelihood =  -1.33    Transmembrane    109-125 (109-127)

----- Final Results -----
              bacterial membrane  --- Certainty = 0.5458(Affirmative) < succ>
              bacterial outside   --- Certainty = 0.0000(Not Clear)   < succ>
              bacterial cytoplasm --- Certainty = 0.0000(Not Clear)   < succ>
```

The protein has homology with the following sequences in the databases:

```
>GP:CAB14651 GB:Z99117 amino acid permease [Bacillus subtilis]
Identities = 210/454 (46%), Positives = 296/454 (64%), Gaps = 11/454 (2%)

Query:   12 DNNELENGMVRGLENRHVQLIAIAGTIGTGLFLGAGRSIALTGPSIIFVYMITGAFMFMM    71
            DN   +  + RGL+NRH+QL+AI G IGTGLFLG+G+SI   GPSI+F Y+ITG F F +
Sbjct:    8 DNFGQQQKLSRGLKNRHIQLMAIGGAIGTGLFLGSGKSIHFAGPSILFAYLITGVFCFFI    67

Query:   72 MRAIGEMLYYDPDQHTFINFISKYIGPGWGYFSGLSYWISLIFIGMAEITAVGAYVQFWF   131
            +R++GE+L  +    H+F++F+  Y+G    +G +YW    I + MA++TAVG Y Q+W
Sbjct:   68 IRSLGELLLSNAGYHSFVDFVRDYLGNMAAFITGWTYWFCWISLAMADLTAVGIYTQYWL   127

Query:  132 PSWPAWLIQLVFLVLLSSINLIAVRVFGETEFWFAMIKILAILALIATAIFMVLTGFETH   191
            P  P WL  L+ L++L  +NL  V++FGE EFWFA+IK++AILALI  T I ++  GF
Sbjct:  128 PDVPQWLPGLLALIILLIMNLATVKLFGELEFWFALIKVIAILALIVTGILLIAKGFSAA   187

Query:  192 TGHASLSNIFDHFSMFPNGKLKFFMAFQMVFFAYQAIEFVGITTSETANPRKVLPKAIQE   251
            +G ASL+N++  H  MFPNG  F  ++FQMV FA+  IE VG+T  ET NP+KV+PKAI +
Sbjct:  188 SGPASLNNLWSHGGMFPNGWHGFILSFQMVVFAFVGIELVGLTAGETENPQKVIPKAINQ   247

Query:  252 IPTRIVIFYVGALVSIMAIVPWHQLPVDESPFVMFKLIGIKWAAALINFVVLTSAASAL   311
            IP RI++FYVGAL  IM I PW+ L  +ESPFV VF +GI  AA+LINFVVLTSAASA
Sbjct:  248 IPVRILLFYVGALFVIMCIYPWNVLNPNESPFVQVFSAVGIVVAASLINFVVLTSAASAA   307

Query:  312 NSTLYSTGRHLYQIANE--TPNALTNRLKINTLSRQGVPSRAIIASAVVVGISALINILP   369
            NS L+ST R +Y +A +    P  L          L+    VPS A+  S++ + I   +N L
Sbjct:  308 NSALFSTSRMVYSLAKDHHAPGLL------KKLTSSNVPSNALFFSSIAILIGVSLNYLM   361

Query:  370 GVADAFSLITASSSGVYIAIYALTMIAHWKYRQSK--DFMADGYLMPKYKVTTPLTLAFF   427
                F+LIT+ S+   +I+ +  +T+I H KYR+++    A+  +  MP Y ++   LTLAF
Sbjct:  362 -PEQVFTLITSVSTICFIFIWGITVICHLKYRKTRQHEAKANKFKMPFYPLSNYLTLAFL   420

Query:  428 AFVFISLFLQESTYIGAIGATIWIIIFGIYSNVK                            461
            AF+ + L L  T I        +W ++  I   V+
Sbjct:  421 AFILVILALANDTRIALFVTPVWFVLLIILYKVQ                            454
```

An alignment of the GAS and GBS proteins is shown below.

```
Identities = 48/62 (77%), Positives = 51/62 (81%)

Query:  1 MSKNNNDHTQKSENGMVRGLENRHVQLIAIAGTIGTGLFLGAGRSISLTGPSIVLVYAITGA   62
          MS         + ENGMVRGLENRHVQLIAIAGTIGTGLFLGAGRSI+LTGPSI+ VY ITGA
Sbjct:  5 MSIKEQTDNNELENGMVRGLENRHVQLIAIAGTIGTGLFLGAGRSIALTGPSIIFVYMITGA   66
```

Based on this analysis, it was predicted that these proteins and their epitopes could be useful antigens for vaccines or diagnostics.

EXAMPLE 1328

A DNA sequence (GBSx1411) was identified in *S. agalactiae* <SEQ ID 4071> which encodes the amino acid sequence <SEQ ID 4072>. This protein is predicted to be alkylphosphonate uptake protein (phnA). Analysis of this protein sequence reveals the following:

```
Possible site: 29
>>> Seems to have no N-terminal signal sequence

----- Final Results -----
            bacterial cytoplasm --- Certainty = 0.0965(Affirmative) < succ>
              bacterial membrane --- Certainty = 0.0000(Not Clear)  < succ>
                bacterial outside --- Certainty = 0.0000(Not Clear)  < succ>
```

The protein has homology with the following sequences in the GENPEPT database.

```
>GP: AAC77069 GB: AE000483 orf, hypothetical protein [Escherichia coli
K12]
Identities = 79/110 (71%), Positives = 91/110 (81%), Gaps = 1/110 (0%)

Query:   1 MSLPNCPKCNSEYVYEDGILLVCPECAYEWNPEE-IEEEVGLIVLDSNGTRLSDGDTVTV    59
           MSLP+CPKCNSEY YED  + +CPECAYEWN  E   +E   LIV D+NG  L+DGD+VT+
Sbjct:   1 MSLPHCPKCNSEYTYEDNGMYICPECAYEWNDAEPAQESDELIVKDANGNLLADGDSVTI   60

Query:  60 IKDLKVKGAPKDIKQGTRVKNIRLVDGDHNIDCKIDGFGAMKLKSEFVKK            109
           IKDLKVKG+    +K GT+VKNIRLV+GDHNIDCKIDGFG MKLKSEFVKK
Sbjct:  61 IKDLKVKGSSSMLKIGTKVKNIRLVEGDHNIDCKIDGFGPMKLKSEFVKK            110
```

A related DNA sequence was identified in *S. pyogenes* <SEQ ID 4073> which encodes the amino acid sequence <SEQ ID 4074>. Analysis of this protein sequence reveals the following:

```
Possible site: 14
>>> Seems to have no N-terminal signal sequence

----- Final Results -----
            bacterial cytoplasm --- Certainty = 0.3428(Affirmative) < succ>
              bacterial membrane --- Certainty = 0.0000(Not Clear)  < succ>
                bacterial outside --- Certainty = 0.0000(Not Clear)  < succ>
```

An alignment of the GAS and GBS proteins is shown below.

```
Identities = 73/85 (85%), Positives = 79/85 (92%), Gaps = 1/85 (1%)

Query:  26 CAYEWNP-EEIEEEVGLIVLDSNGTRLSDGDTVTVIKDLKVKGAPKDIKQGTRVKNIRLV   84
           CA+EW P EE  EE GL+VLDSNG RLSDGDT+TV+KDLKVKGAPKD+KQGTRVKNIRLV
Sbjct:   2 CAFEWTPGEEATEEEGLVVLDSNGVRLSDGDTITVVKDLKVKGAPKDLKQGTRVKNIRLV   61

Query:  85 DGDHNIDCKIDGFGAMKLKSEFVKK                                    109
           +GDHNIDCKIDGFGAMKLKSEFVKK
Sbjct:  62 EGDHNIDCKIDGFGAMKLKSEFVKK                                     86
```

Based on this analysis, it was predicted that these proteins and their epitopes could be useful antigens for vaccines or diagnostics.

EXAMPLE 1329

A DNA sequence (GBSx1412) was identified in *S. agalactiae* <SEQ ID 4075> which encodes the amino acid sequence <SEQ ID 4076>. Analysis of this protein sequence reveals the following:

```
Possible site: 22
>>> Seems to have no N-terminal signal sequence

----- Final Results -----
          bacterial cytoplasm --- Certainty = 0.3665(Affirmative) < succ>
           bacterial membrane --- Certainty = 0.0000(Not Clear)   < succ>
            bacterial outside --- Certainty = 0.0000(Not Clear)   < succ>
```

The protein has no significant homology with any sequences in the GENPEPT database, but there is homology to SEQ ID 500.

Based on this analysis, it was predicted that this protein and its epitopes, could be useful antigens for vaccines or diagnostics.

EXAMPLE 1330

A DNA sequence (GBSx1414) was identified in *S. agalactiae* <SEQ ID 4077> which encodes the amino acid sequence <SEQ ID 4078>. Analysis of this protein sequence reveals the following:

```
Possible site: 13
>>> Seems to have an uncleavable N-term signal seq
    INTEGRAL    Likelihood = -0.11    Transmembrane    558-574 (558-574)

----- Final Results -----
           bacterial membrane --- Certainty = 0.1044(Affirmative) < succ>
            bacterial outside --- Certainty = 0.0000(Not Clear)   < succ>
          bacterial cytoplasm --- Certainty = 0.0000(Not Clear)   < succ>
```

The protein has homology with the following sequences in the GENPEPT database.

```
>GP: CAB11971 GB: Z99105 L-glutamine-D-fructose-6-phosphate
amidotransferase [Bacillus subtilis]
Identities = 355/604 (58%), Positives = 445/604 (72%), Gaps = 4/604 (0%)

Query:   1 MCGIVGVVGNTNATDILIQGLEKLEYRGYDSAGIFVVGDNKSQLVKSVGRIAEIQAKVGD    60
           MCGIVG +G  +A +IL++GLEKLEYRGYDSAGI V  +    + K  GRIA+++  V
Sbjct:   1 MCGIVGYIGQLDAKEILLKGLEKLEYRGYDSAGIAVANEQGIHVFKEKGRIADLREVVDA   60

Query:  61 SVSGTTGIGHTRWATHGKPTEGNAHPHTSGSGRFVLVHNGVIENYLQIKETYLTKHNLKG   120
           +V    GIGHTRWATHG+P+  NAHPH S  GRF LVHNGVIENY+Q+K+ YL    LK
Sbjct:  61 NVEAKAGIGHTRWATHGEPSYLNAHPHQSALGRFTLVHNGVIENYVQLKQEYLQDVELKS  120

Query: 121 ETDTEIAIHLVEHFVEEDNLSVLEAFKKALHIIEGSYAFALIDSQDADTIYVAKNKSPLL   180
           +TDTE+ + ++E FV     L    EAF+K L +++GSYA AL D+ +  +TI+VAKNKSPLL
Sbjct: 121 DTDTEVVVQVIEQFVN-GGLETEEAFRKTLTLLKGSYAIALFDNDNRETIFVAKNKSPLL  179

Query: 181 IGLGNGYNMVCSDAMAMIRETSEYMEIHDKELVIVKKDSVEVQDYDGNVIERGSYTAELD   240
           +GLG+ +N+V SDAMAM++  T+EY+E+ DKE+VIV   D V +++ DG+VI R SY AELD
Sbjct: 180 VGLGDTFNVVASDAMAMLQVTNEYVELMDKEMVIVTDDQVVIKNLDGDVITRASYIAELD  239

Query: 241 LSDIGKGTYPFYMLKEIDEQPTVMRKLISTYANESGDMNVDSDIIKSVQEADRLYILAAG   300
             SDI KGTYP YMLKE DEQP VMRK+I TY +E+G ++V  DI  +V EADR+YI+  G
Sbjct: 240 ASDIEKGTYPHYMLKETDEQPVVMRKIIQTYQDENGKLSVPGDIAAAVAEADRIYIIGCG  299

Query: 301 TSYHAGFAAKTMIEKLTDTPVELGVSSEWGYNMPLLSKKPMFILLSQSGETADSRQVLVK   360
           TSYHAG    K  IE   + PVE+ V+SE+ YNMPLLSKKP+FI LSQSGETADSR VLV+
Sbjct: 300 TSYHAGLVGKQYIEMWANVPVEVHVASEFSYNMPLLSKKPLFIFLSQSGETADSRAVLVQ  359

Query: 361 ANEMGIPSLTITNVPGSTLSREATYTMLIHAGPEIAVASTKAYTAQVATLAFLAKAVGEA   420
            +G  +LTITNVPGSTLSREA YT+L+HAGPEIAVASTKAYTAQ+A LA LA    +
Sbjct: 360 VKALGHKALTITNVPGSTLSREADYTLLLHAGPEIAVASTKAYTAQIAVLAVLASVAADK  419

Query: 421 NGKAEAKDFDLVHELSIVAQSIEATLSEKDVISEKVEQLLISTRNAFYIGRGNDYYVTME   480
           NG       FDLV EL I A  ++EA    +KD    +   L  +RNAF+IGRG DY+ +E
Sbjct: 420 NGINIG--FDLVKELGIAANAMEALCDQKDEMEMIAREYLTVSRNAFFIGRGLDYFVCVE  477

Query: 481 AALKLKEISYIQTEGFAAGELKHGTISLIEDNTPVIALISADSTIAAHTRGNIQEVVSRG   540
            ALKLKEISYIQ  EGFA GELKHGTI +LIE  TPV AL + +      RGN++EV +RG
Sbjct: 478 GALKLKEISYIQAEGFAGGELKHGTIALIEQGTPVFALATQEH-VNLSIRGNVKEVAARG  536
```

```
Query:  541 ANALIIVEEGLEREGDDIIVNKVHPFLSAISMVIPTQLIAYYASLQRGLDVDKPRNLAKA  600
            AN  II  +GL+   D  ++ +V+P L+ +   V+P QLIAYYA+L RG DVDKPRNLAK+
Sbjct:  537 ANTCIISLKGLDDADDRFVLPEVNPALAPLVSVVPLQLIAYYAALHRGCDVDKPRNLAKS  596

Query:  601 VTVE  604
            VTVE
Sbjct:  597 VTVE  600
```

A related DNA sequence was identified in *S. pyogenes* 10 <SEQ ID 4079> which encodes the amino acid sequence <SEQ ID 4080>. Analysis of this protein sequence reveals the following:

```
Possible site: 39
>>> Seems to have no N-terminal signal sequence
    INTEGRAL    Likelihood = -1.06   Transmembrane   558-574 (558-574)

----- Final Results -----
            bacterial membrane  --- Certainty = 0.1426(Affirmative) < succ>
             bacterial outside  --- Certainty = 0.0000(Not Clear)   < succ>
           bacterial cytoplasm  --- Certainty = 0.0000(Not Clear)   < succ>
```

The protein has homology with the following sequences in the databases:

```
>GP: CAB11971 GB: Z99105 L-glutamine-D-fructose-6-phosphate
amidotransferase [Bacillus subtilis]
Identities = 353/604 (58%), Positives = 445/604 (73%), Gaps = 4/604 (0%)

Query:    1 MCGIVGVVGNRNATDILMQGLEKLEYRGYDSAGIFVANANQTNLIKSVGRIADLRAKIGI   60
            MCGIVG +G  +A +IL++GLEKLEYRGYDSAGI VAN    ++ K  GRIADLR   +
Sbjct:    1 MCGIVGYIGQLDAKEILLKGLEKLEYRGYDSAGIAVANEQGINVFKEKGRIADLREVVDA   60

Query:   61 DVAGSTGIGHTRWATHGQSTEDNAHPHTSQTGRFVLVHNGVIENYLHIKTEFLAGHDFKG  120
            +V    GIGHTRWATHG+ +    NAHPH S  GRF LVHNGVIENY+ +K E+L   + K
Sbjct:   61 NVEAKAGIGHTRWATHGEPSYLNAHPHQSALGRFTLVHNGVIENYVQLKQEYLQDVELKS  120

Query:  121 QTDTEIAVHLIGKFVEEDKLSVLEAFKKSLSIIEGSYAFALMDSQATDTIYVAKNKSPLL  180
             TDTE+ V +I +FV       L    EAF+K+L++++GSYA AL D+   +TI+VAKNKSPLL
Sbjct:  121 DTDTEVVVQVIEQFVNGG-LETEEEAFRKTLTLLKGSYAIALFDNDNRETIFVAKNKSPLL  179

Query:  181 IGLGEGYNMVCSDAMAMIRETSEFMEIHDKELVILTKDKVTVTDYDGKELIRDSYTAELD  240
            +GLG+  +N+V SDAMAM++  T+E++E+ DKE+VI+T D+V  +  DG  + R SY AELD
Sbjct:  180 VGLGDTFNVVASDAMAMLQVTNEYVELMDKEMVIVTDDQVVIKNLDGDVITRASYIAELD  239

Query:  241 LSDIGKGTYPFYMLKEIDEQPTVMRQLISTYADETGNVQVDPAIITSIQEADRLYILAAG  300
              SDI KGTYP YMLKE DEQP VMR++I TY DE G  + V   I ++ EADR+YI+  G
Sbjct:  240 ASDIEKGTYPHYMLKETDEQPVVMRKIIQTYQDENGKLSVPGDIAAAVAEADRIYIIGCG  299

Query:  301 TSYHAGFATKNMLEQLTDTPVELGVASEWGYHMPLLSKKPMFILLSQSGETADSRQVLVK  360
            TSYHAG   K  +E   +   PVE+  VASE+ Y+MPLLSKKP+FI LSQSGETADSR VLV+
Sbjct:  300 TSYHAGLVGKQYIEMWANVPVEVHVASEFSYNMPLLSKKPLFIFLSQSGETADSRAVLVQ  359

Query:  361 ANAMGIPSLTVTNVPGSTLSREATYTMLIHAGPEIAVASTKAYTAQIAALAFLAKAVGEA  420
             A+G  +LT+TNVPGSTLSREA YT+L+HAGPEIAVASTKAYTAQIA LA LA     +
Sbjct:  360 VKALGHKALTITNVPGSTLSREADYTLLLHAGPEIAVASTKAYTAQIAVLAVLASVAADK  419

Query:  421 NGKQEALDFNLVHELSLVAQSIEATLSEKDLVAEKVQALLATTRNAFYIGRGNDYYVAME  480
            NG    + F+LV EL + A  ++EA   +KD  +      L  +RNAF+IGRG DY+V +E
Sbjct:  420 NGIN--IGFDLVKELGIAANAMEALCDQKDEMEMIAREYLTVSRNAFFIGRGLDYFVCVE  477

Query:  481 AALKLKEISYIQCEGFAAGELKHGTISLIEEDTPVIALISSSQLVASHTRGNIQEVAARG  540
            A LKLKEISYIQ EGFA GELKHGTI+LIE+ TPV AL +    + S  RGN++EVAARG
Sbjct:  478 GALKLKEISYIQAEGFAGGELKHGTIALIEQGTPVFALATQEHVNLS-IRGNVKEVAARG  536

Query:  541 AHVLTVVEEGLDREGDDIIVNKVHPFLAPIAMVIPTQLIAYYASLQRGLDVDKPRNLAKA  600
            A+  +   +GLD    D  ++ +V+P LAP+ +  V+P QLIAYYA+L RG DVDKPRNLAK+
Sbjct:  537 ANTCIISLKGLDDADDRFVLPEVNPALAPLVSVVPLQLIAYYAALHRGCDVDKPRNLAKS  596

Query:  601 VTVE  604
            VTVE
Sbjct:  597 VTVE  600
```

An alignment of the GAS and GBS proteins is shown below.

```
Identities = 500/604 (82%), Positives = 552/604 (90%)

Query:    1 MCGIVGVVGNTNATDILIQGLEKLEYRGYDSAGIFVVGDNKSQLVKSVGRIAEIQAKVGD        60
            MCGIVGVVGN NATDIL+QGLEKLEYRGYDSAGIFV  N++ L+KSVGRIA+++AK+G
Sbjct:    1 MCGIVGVVGNRNATDILMQGLEKLEYRGYDSAGIFVANANQTNLIKSVGRIADLRAKIGI       60

Query:   61 SVSGTTGIGHTRWATHGKPTEGNAHPHTSGSGRFVLVHNGVIENYLQIKETYLTKHNLKG      120
            V+G+TGIGHTRWATHG+ TE NAHPHTS +GRFVLVHNGVIENYL IK  +L  H+ KG
Sbjct:   61 DVAGSTGIGHTRWATHGQSTEDNAHPHTSQTGRFVLVHNGVIENYLHIKTEFLAGHDFKG      120

Query:  121 ETDTEIAIHLVEHFVEEDNLSVLEAFKKALHIIEGSYAFALIDSQDADTIYVAKNKSPLL      180
             +TDTEIA+HL+  FVEED LSVLEAFKK+L IIEGSYAFAL+DSQ DTIYVAKNKSPLL
Sbjct:  221 QTDTEIAVHLIGKFVEEDKLSVLEAFKKSLSIIEGSYAFALMDSQATDTIYVAKNKSPLL      180

Query:  181 IGLGNGYNMVCSDAMAMIRETSEYMEIHDKELVIVKKDSVEVQDYDGNVIERGSYTAELD      240
            IGLG GYNMVCSDAMAMIRETSE+MEIHDKELVI+ KD V V DYDG  + R SYTAELD
Sbjct:  181 IGLGEGYNMVCSDAMAMIRETSEFMEIHDKELVILTKDKVTVTDYDGKELIRDSYTAELD      240

Query:  241 LSDIGKGTYPFYMLKEIDEQPTVMRKLISTYANESGDMNVDSDIIKSVQEADRLYILAAG      300
            LSDIGKGTYPFYMLKEIDEQPTVMR+LISTYA+E+G++ VD   II S+QEADRLYILAAG
Sbjct:  241 LSDIGKGTYPFYMLKEIDEQPTVMRQLISTYADETGNVQVDPAIITSIQEADRLYILAAG      300

Query:  301 TSYHAGFAAKTMIEKLTDTPVELGVSSEWGYNMPLLSKKPMFILLSQSGETADSRQVLVK      360
            TSYHAGFA K M+E+LTDTPVELGV+SEWGY+MPLLSKKPMFILLSQSGETADSRQVLVK
Sbjct:  301 TSYHAGFATKNMLEQLTDTPVELGVASEWGYHMPLLSKKPMFILLSQSGETADSRQVLVK      360

Query:  361 ANEMGIPSLTITNVPGSTLSREATYTMLIHAGPEIAVASTKAYTAQVATLAFLAKAVGEA      420
            AN MGIPSLT+TNVPGSTLSREATYTMLIHAGPEIAVASTKAYTAQ+A LAFLAKAVGEA
Sbjct:  361 ANAMGIPSLTVTNVPGSTLSREATYTMLIHAGPEIAVASTKAYTAQIAALAFLAKAVGEA      420

Query:  421 NGKAEAKDFDLVHELSIVAQSIEATLSEKDVISEKVEQLLISTRNAFYIGRGNDYYVTME      480
            NGK EA DF+LVHELS+VAQSIEATLSEKD+++EKV+ LL +TRNAFYIGRGNDYYV ME
Sbjct:  421 NGKQEALDFNLVHELSLVAQSIEATLSEKDLVAEKVQALLATTRNAFYIGRGNDYYVAME      480

Query:  481 AALKLKEISYIQTEGFAAGELKHGTISLIEDNTPVIALISADSTIAAHTRGNIQEVVSRG      540
            AALKLKEISYIQ EGFAAGELKHGTISLIE++TPVIALIS+    +A+HTRGNIQEV +RG
Sbjct:  481 AALKLKEISYIQCEGFAAGELKHGTISLIEEDTPVIALISSSQLVASHTRGNIQEVAARG      540

Query:  541 ANALIIVEEGLEREGDDIIVNKVHPFLSAISMVIPTQLIAYYASLQRGLDVDKPRNLAKA      600
            A+ L +VEEGL+REGDDIIVNKVHPFL+ I+MVIPTQLIAYYASLQRGLDVDKPRNLAKA
Sbjct:  541 AHVLTVVEEGLDREGDDIIVNKVHPFLAPIAMVIPTQLIAYYASLQRGLDVDKPRNLAKA      600

Query:  601 VTVE                                                           604
            VTVE
Sbjct:  601 VTVE                                                           604
```

Based on this analysis, it was predicted that these proteins and their epitopes could be useful antigens for vaccines or diagnostics.

EXAMPLE 1331

A DNA sequence (GBSx1415) was identified in *S. agalactiae* <SEQ ID 4081> which encodes the amino acid sequence <SEQ ID 4082>. Analysis of this protein sequence reveals the following:

```
Possible site: 37
>>> Seems to have a cleavable N-term signal seq.

----- Final Results -----
           bacterial outside --- Certainty = 0.3000(Affirmative) < succ>
          bacterial membrane --- Certainty = 0.0000(Not Clear)   < succ>
          bacterial cytoplasm --- Certainty = 0.0000(Not Clear)   < succ>
```

A related GBS nucleic acid sequence <SEQ ID 9797> which encodes amino acid sequence <SEQ ID 9798> was also identified.

The protein has homology with the following sequences in the GENPEPT database.

```
>GP: AAC44435 GB: U65000 type-I signal peptidase SpsB [Staphylococcus
aureus]
Identities = 62/185 (33%), Positives = 97/185 (51%), Gaps = 12/185 (6%)
```

-continued

```
Query:   10 VKRDFIRNIILALIAVLILILLRYFVFATFKVHKDATNSYFSNGDVVVVN----RNRTPK  65
            +K++ + II  +A +IL ++  F+   + +  ++ +    +G+ V VN    +      +
Sbjct:    1 MKKELLEWIISIAVAFVILFIVGKFIVTPYTIKGESMDPTLKDGERVAVNIIGYKTGGLE  60

Query:   66 YKDFIVYKVGKIF-YISRVIGEPNQKVRVMDDILYLNDVFKDEPYIEKMKNAYSEKKDGQ  124
            + +V+  K     Y+ RVIG P  KV  +D LY+N  +DEPY+       N   + K G
Sbjct:   61 KGNVVVFHANKNDDYVKRVIGVPGDKVEYKNDTLYVNGKKQDEPYL----NYNLKHKQGD  116

Query:  125 MPFTSDFSVETL--TRNKESRVPKGSYLVLNDNRQNKNDSRKFGLIKEKDIRGVITFKVY  182
               T  F V+ L      K + +PKG YLVL DNR+   DSR FGLI E   I G ++F+ +
Sbjct:  117 Y-ITGTFQVKDLPNANPKSNVIPKGKYLVLGDNREVSKDSRAFGLIDEDQIVGKVSFRFW  175

Query:  183 PLSEF                                                        187
            P SEF
Sbjct:  176 PFSEF                                                        180
```

15

A related DNA sequence was identified in *S. pyogenes* <SEQ ID 4083> which encodes the amino acid sequence <SEQ ID 4084>. Analysis of this protein sequence reveals the following:

```
Possible site: 32
>>> Seems to have an uncleavable N-term signal seq
      INTEGRAL      Likelihood = -14.22      Transmembrane     10-26 (4-34)

----- Final Results -----
               bacterial membrane --- Certainty = 0.6689(Affirmative) < succ>
                bacterial outside --- Certainty = 0.0000(Not Clear)   < succ>
              bacterial cytoplasm --- Certainty = 0.0000(Not Clear)   < succ>
```

An alignment of the GAS and GBS proteins is shown below.

```
Identities = 99/185 (53%), Positives = 130/185 (69%)

Query:    9 MVKRDFIRNIILALIAVLILILLRYFVFATFKVHKDATNSYFSNGDVVVVNRNRTPKYKD  68
            MVKRDFIRNI+L LI ++   ILLR FVF+TFKV  +    N+Y  +GD+V +  +N  PKYKD
Sbjct:    1 MVKRDFIRNILLLLIVIIGAILLRIFVFSTFKVSPETANTYLKSGDLVTIKKNIQPKYKD  60

Query:   69 FIVYKVGKIFYISRVIGEPNQKVRVMDDILYLNDVFKDEPYIEKMKNAYSEKKDGQMPFT  128
            F+VY+VGK  Y+SRVI      V   MDDI YLN++ + +   Y+EKMK   Y          +T
Sbjct:   61 FVVYRVGKKDYVSRVIAVEGDSVTYMDDIFYLNNMVESQAYLEKMKAHYLNHAPFGTLYT  120

Query:  129 SDFSVETLTRNKESRVPKGSYLVLNDNRQNKNDSRKFGLIKEKDIRGVITFKVYPLSEFG  188
             DF+V  T+T  +K   +VPKG YL+LNDNR+N  NDSR+FGLI       I+G++TF+V PLS+FG
Sbjct:  121 DDFTVATITADKYQKVPKGKYLLLNDNRKNTNDSRRFGLINASQIKGLVTFRVLPLSDFG  180

Query:  189 FTASE                                                        193
            F   E
Sbjct:  181 FVEVE                                                        185
```

A related GBS gene <SEQ ID 8789> and protein <SEQ ID 8790> were also identified. Analysis of this protein sequence reveals the following:

```
Lipop: Possible site: -1 Crend: 10
McG: Discrim Score: 10.13
GvH: Signal Score (-7.5): 0.45
Possible site: 37
>>> Seems to have a cleavable N-term signal seq.
ALOM program count: 0 value: 3.82 threshold: 0.0
PERIPHERAL  Likelihood =  3.82    69
modified ALOM score: -1.26

*** Reasoning Step: 3

----- Final Results -----
                bacterial outside --- Certainty = 0.3000 (Affirmative) < succ>
               bacterial membrane --- Certainty = 0.0000 (Not Clear)   < succ>
              bacterial cytoplasm --- Certainty = 0.0000 (Not Clear)   < succ>
```

The protein has homology with the following sequences in the databases:

```
36.0/59.9% over 165aa
Bacillus caldolyticus
EGAD|24914|signal peptidase i Insert characterized ORF00169(364-867 of 1179)
EGAD|24914|25718(15-180 of 182) signal peptidase i {Bacillus caldolyticus}
% Match = 11.9
% Identity = 35.9     % Similarity = 59.9
Matches = 60    Mismatches = 61    Conservative Sub.s = 40
     312       342       372       402       432       462       483       510
     L*KHDIMEKRLGVVMVKRDFIRNIILALIAVLILILLRYFVFATFKVHKDATNSYFSNGDVVVVNR---NRTPKYK-DFI
       |       ::         ::||  ::   || |||:  |      :      : :|::::||:     |   : ||
                VTKQKEKRGRRWPWFVAVCVVATLRLFVFSNYVVEGKSMMPTLESGNLLIVNKLSYDIGPIRRFDII
                         10        20        30        40        50        60
     537       567       597       627       657       687       717       747
     VYKVGKIF-YISRVIGEPNQKVRVMDDILYLNDVFKDEPYIEKMKNAYSEKKDGQMPFTSDFSVETLTRNKESRVPKGSY
     |:    |      |:  ||||  |    ::   ||||:      ||||:   |      :   ||::    |||::|  :|    ::|||  |
     VFHANKKEDYVKRVIGLPGDRIAYKNDILYVNGKKVDEPYLRPYKQ---KLLDGRL--TGDFTLEEVT--GKTRVPPGCI
              80        90       100       110       120         130         140
     777       807       837       867       897       927       957       987
     LVLNDNRQNKNDSRKFGLIKEKDIRGVITFKVYPLSEFGFTASE**KNGII*YHSFYVIKWLRNIFF*DR*NF**RXXN*
     :||  |||   :   ||| ||::|       | |  |:  :|:   :| |
     FVLGDNRLSSWDSRHFGFVKINQIVGKVDFRYWPFKQFAFQF
             150       160       170       180
```

Figure 262:
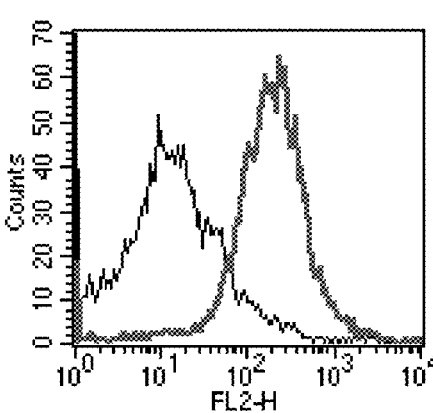

SEQ ID 8790 (GBS7) was expressed in *E. coli* as a GST-fusion product. SDS-PAGE analysis of total cell extract is shown in FIG. 1 (lane 4; MW 46 kDa). It was also expressed in *E. coli* as a His-fusion product. SDS-PAGE analysis of total cell extract is shown in FIG. 2 (lane 4; MW 21 kDa). The GBS7-His fusion product was purified (FIG. 189, lane 6) and used to immunise mice. The resulting antiserum was used for FACS (FIG. 262), which confirmed that the protein is immunoaccessible on GBS bacteria.

Based on this analysis, it was predicted that these proteins and their epitopes could be useful antigens for vaccines or diagnostics.

EXAMPLE 1332

A DNA sequence (GBSx1416) was identified in *S. agalactiae* <SEQ ID 4085> which encodes the amino acid sequence <SEQ ID 4086>. Analysis of this protein sequence reveals the following:

```
Possible site: 54
>>> Seems to have no N-terminal signal sequence

----- Final Results -----
          bacterial cytoplasm --- Certainty = 0.1099 (Affirmative) < succ>
          bacterial membrane  --- Certainty = 0.0000 (Not Clear)   < succ>
           bacterial outside  --- Certainty = 0.0000 (Not Clear)   < succ>
```

A related GBS nucleic acid sequence <SEQ ID 9795> which encodes amino acid sequence <SEQ ID 9796> was also identified.

The protein has homology with the following sequences in the GENPEPT database.

```
>GP:AAF25804 GB:AF172173 pyruvate kinase [treptococcus thermophilus]
Identities = 413/500 (82%), Positives = 451/500 (89%)

Query:   1  MNKRVKIVATLGPAVEFRGGKKFGESGYWGESLDVEASAEKIAQLIKEGANVFRFNFSHG    60
            MNKRVKIVATLGPAVE RGGKKFGE GYW E LD +ASA+ IAQLI+EGANVFRFNFSHG
Sbjct:   1  MNKRVKIVATLGPAVEIRGGKKFGEDGYWSEKLDPDASAKNIAQLIEEGANVFRFNFSHG    60

Query:  61  DHAEQGARMATVRKAEEIAGQKVGFLLDTKGPEIRTELFEDGADFHSYTTGTKLRVATKQ   120
            +HAEQG RM  VR AE IAGQKVGFLLDTKGPEIRTELFE  A   ++Y TG ++R+ATKQ
Sbjct:  61  NHAEQGERMDVVRMAESIAGQKVGFLLDTKGPEIRTELFEGDAKEYAYKTGEQIRIATKQ   120
```

-continued

```
Query:   121 GIKSTPEVIALNVAGGLDIFDDVEVGKQILVDDGKLGLTVFAKDKDTREFEVVVENDGLI  180
             G+KST +VIALNVAG LDIFDDVEVGKQ+LVDDGKLGL V   KD + REF V VENDG+I
Sbjct:   121 GLKSTRDVIALNVAGALDIFDDVEVGKQVLVDDGKLGLRVVDKDAEKREFIVEVENDGII  180

Query:   181 GKQKGVNIPYTKIPFPALAERDNADIRFGLEQGLNFIAISFVRTAKDVNEVRAICEETGN  240
              KQKGVNIPYTKIPFPALAERDNADIRFGLEQG+NFIAISFVRTAKDV EVRAICEETGN
Sbjct:   181 AKQKGVNIPYTKIPFPALAERDNADIRFGLEQGINFIAISFVRTAKDVQEVRAICEETGN  240

Query:   241 GHVKLFAKIENQQGIDNIDEIIEAADGIMIARGDMGIEVPFEMVPVYQKMIITKVNAAGK  300
             GHVKL AKIENQQGIDNIDEIIEAADGIMIARGDMGIEVPFEMVPVYQKMIITKVNAAGK
Sbjct:   241 GHVKLLAKIENQQGIDNIDEIIEAADGIMIARGDMGIEVPFEMVPVYQKMIITKVNAAGK  300

Query:   301 AVITATNMLETMTDKPRATRSEVSDVFNAVIDGTDATMLSGESANGKYPVESVRTMATID  360
              V+TATNMLETMT+KPRATRSEVSDVFNAVIDGTDATMLSGESANG YPVESVRTMATI
Sbjct:   301 IVVTATNMLETMTEKPRATRSEVSDVFNAVIDGTDATMLSGESANGPYPVESVRTMATIH  360

Query:   361 KNAQTLLNEYGRLDSSAFPRNNKTDVIASAVKDATHSMDIKLVVTITETGNTARAISKFR  420
             KNAQTLL EYGRL+SS F R++ T+V+ASAVKDAT+SM I+L+V +TE+GNTA   I  +R
Sbjct:   361 KNAQTLLKEYGRLNSSTFDRSSNTEVVASAVKDATNSMHIQLIVALTESGNTASLIDTYR  420

Query:   421 PDADILAVTFDEKVQRSLMINWGVIPVLADKPASTDDMFEVAERVALEAGFVESGDNIVI  480
             P+ADI A+TFDE  Q+SLM+NWGVIPV+ +  P+STDDMFEVAERVALE+G VESGDNIVI
Sbjct:   421 PEADIWAITFDELTQKSLMLNWGVIPVVTETPSSTDDMFEVAERVALESGLVESGDNIVI  480

Query:   481 VAGVPVGTGGTNTMRVRTVK                                          500
             VAGVPVG+G TNTMR+RTVK
Sbjct:   481 VAGVPVGSGNTNTMRIRTVK                                          500
```

A related DNA sequence was identified in *S. pyogenes* <SEQ ID 4087> which encodes the amino acid sequence <SEQ ID 4088>. Analysis of this protein sequence reveals the following:

```
Possible site: 54
>>> Seems to have no N-terminal signal sequence

----- Final Results -----
             bacterial cytoplasm --- Certainty = 0.0915 (Affirmative) < succ>
             bacterial membrane  --- Certainty = 0.0000 (Not Clear)   < succ>
              bacterial outside  --- Certainty = 0.0000 (Not Clear)   < succ>
RGD motif: 272-274
```

The protein has homology with the following sequences in the databases:

```
>GP:AAF25804 GB:AF172173 pyruvate kinase [Streptococcus thermophilus]
Identities = 404/500 (80%), Positives = 457/500 (90%)

Query:    1 MNKRVKIVATLGPAVEIRGGKKYGEDGYWAGQLDVEESAKKIAELIEAGANVFRFNFSHG   60
            MNKRVKIVATLGPAVEIRGGKK+GEDGYW+ +LD + SAK IA+LIE GANVFRFNFSHG
Sbjct:    1 MNKRVKIVATLGPAVEIRGGKKFGEDGYWSEKLDPDASAKNIAQLIEEGANVFRFNFSHG   60

Query:   61 DHKEQGDRMATVRLAEEIARQKVGFLLDTKGPEMRTELFADDAKEFSYVTGEKIRVATTQ  120
            +H EQG+RM  VR+AE IA QKVGFLLDTKGPE+RTELF  DAKE++Y TGE+IR+AT Q
Sbjct:   61 NHAEQGERMDVVRMAESIAGQKVGFLLDTKGPEIRTELFEGDAKEYAYKTGEQIRIATKQ  120

Query:  121 GIQSTRDVIALNVAGSLDIYDEVEVGHTILIDDGKLGLKVIDKDIATRQFIVEVENDGII  180
            G++STRDVIALNVAG+LDI+D+VEVG  +L+DDGKLGL+V+DKD    R+FIVEVENDGII
Sbjct:  121 GLKSTRDVIALNVAGALDIFDDVEVGKQVLVDDGKLGLRVVDKDAEKREFIVEVENDGII  180

Query:  181 AKQKGVNIPNTKIPFPALAERDNADIRFGLEQGLNFIAISFVRTAKDVEEVREICRETGN  240
            AKQKGVNIP TKIPFPALAERDNADIRFGLEQG+NFIAISFVRTAKDV+EVR IC ETGN
Sbjct:  181 AKQKGVNIPYTKIPFPALAERDNADIRFGLEQGINFIAISFVRTAKDVQEVRAICEETGN  240

Query:  241 DHVQLFAKIENQQGIDNLDEIIEAADGIMIARGDMGIEVPFEMVPVFQKMIITKVNAAGK  300
              HV+L AKIENQQGIDN+DEIIEAADGIMIARGDMGIEVPFEMVPV+QKMIITKVNAAGK
Sbjct:  241 GHVKLLAKIENQQGIDNIDEIIEAADGIMIARGDMGIEVPFEMVPVYQKMIITKVNAAGK  300

Query:  301 AVITATNMLETMTEKPRATRSEVSDVFNAVIDGTDATMLSGESANGKYPVESVRTMATID  360
             V+TATNMLETMTEKPRATRSEVSDVFNAVIDGTDATMLSGESANG YPVESVRTMATI
Sbjct:  301 IVVTATNMLETMTEKPRATRSEVSDVFNAVIDGTDATMLSGESANGPYPVESVRTMATIH  360

Query:  361 RNAQTLLNEYGRLDSSAFPRTNKTDVIASAVKDATHSMDIKLVVTITETGNTARAISKFR  420
            +NAQTLL EYGRL+SS F R++ T+V+ASAVKDAT+SM I+L+V +TE+GNTA   I  +R
```

```
-continued
Sbjct:  361  KNAQTLLKEYGRLNSSTFDRSSNTEVVASAVKDATNSMHIQLIVALTESGNTASLIDTYR  420

Query:  421  PDADILAVTFDEKVQRALMINWGVIPVLAEKPASTDDMFEVAERVAVEAGLVQSGDNIVI  480
             P+ADI A+TFDE  Q++LM+NWGVIPV+ E P+STDDMFEVAERVA+E+GLV SGDNIVI
Sbjct:  421  PEADIWAITFDELTQKSLMLNWGVIPVVTETPSSTDDMFEVAERVALESGLVESGDNIVI  480

Query:  481  VAGVPVGTGGTNTMRVRTVK                                         500
             VAGVPVG+G TNTMR+RTVK
Sbjct:  481  VAGVPVGSGNTNTMRIRTVK                                         500
```

An alignment of the GAS and GBS proteins is shown below.

```
Identities = 440/500 (88%), Positives = 462/500 (92%)

Query:    1  MNKRVKIVATLGPAVEFRGGKKFGESGYWGESLDVEASAEKIAQLIKEGANVFRFNFSHG   60
             MNKRVKIVATLGPAVE RGGKK+GE GYW   LDVE SA+KIA+LI+ GANVFRFNFSHG
Sbjct:    1  MNKRVKIVATLGPAVEIRGGKKYGEDGYWAGQLDVEESAKKIAELIEAGANVFRFNFSHG   60

Query:   61  DHAEQGARMATVRKAEEIAGQKVGFLLDTKGPEIRTELFEDGADFHSYTTGTKLRVATKQ  120
             DH EQG RMATVR AEEIA QKVGFLLDTKGPE+RTELF D A    SY TG K+RVAT Q
Sbjct:   61  DHKEQGDRMATVRLAEEIARQKVGFLLDTKGPEMRTELFADDAKEFSYVTGEKIRVATTQ  120

Query:  121  GIKSTFEVIALNVAGGLDIFDDVEVGKQILVDDGKLGLTVFAKDKDTREFEVVVENDGLI  180
             GI+ST +VIALNVAG LDI+D+VEVG   IL+DDGKLGL V   KD  TR+F V VENDG+I
Sbjct:  121  GIQSTRDVIALNVAGSLDIYDEVEVGHTILIDDGKLGLKVIDKDIATRQFIVEVENDGII  180

Query:  181  GKQKGVNIPYTKIPFPALAERDNADIRFGLEQGLNFIAISFVRTAKDVNEVRAICEETGN  240
              KQKGVNIP TKIPFPALAERDNADIRFGLEQGLNFIAISFVRTAKDV EVR IC ETGN
Sbjct:  181  AKQKGVNIPNTKIPFPALAERDNADIRFGLEQGLNFIAISFVRTAKDVEEVREICRETGN  240

Query:  241  GHVKLFAKIENQQGIDNIDEIIEAADGIMIARGDMGIEVPFEMVPVYQKMIITKVNAAGK  300
             HV+LFAKIENQQGIDN+DEIIEAADGIMIARGDMGIEVPFEMVPV+QKMIITKVNAAGK
Sbjct:  241  DHVQLFAKIENQQGIDNLDEIIEAADGIMIARGDMGIEVPFEMVPVFQKMIITKVNAAGK  300

Query:  301  AVITATNMLETMTDKPRATRSEVSDVFNAVIDGTDATMLSGESANGKYPVESVRTMATID  360
             AVITATNMLETMT+KPRATRSEVSDVFNAVIDGTDATMLSGESANGKYPVESVRTMATID
Sbjct:  301  AVITATNMLETMTEKPRATRSEVSDVFNAVIDGTDATMLSGESANGKYPVESVRTMATID  360

Query:  361  KNAQTLLNEYGRLDSSAFPRNNKTDVIASAVKDATHSMDIKLVVTITETGNTARAISKFR  420
             +NAQTLLNEYGRLDSSAFPR NKTDVIASAVKDATHSMDIKLVVTITETGNTARAISKFR
Sbjct:  361  RNAQTLLNEYGRLDSSAFPRTNKTDVIASAVKDATHSMDIKLVVTITETGNTARAISKFR  420

Query:  421  PDADILAVTFDEKVQRSLMINWGVIPVLADKPASTDDMFEVAERVALEAGFVESGDNIVI  480
             PDADILAVTFDEKVQR+LMINWGVIPVLA+KPASTDDMFEVAERVA+EAG V+SGDNIVI
Sbjct:  421  PDADILAVTFDEKVQRALMINWGVIPVLAEKPASTDDMFEVAERVAVEAGLVQSGDNIVI  480

Query:  481  VAGVPVGTGGTNTMRVRTVK                                         500
             VAGVPVGTGGTNTMRVRTVK
Sbjct:  481  VAGVPVGTGGTNTMRVRTVK                                         500
```

A related GBS gene <SEQ ID 8791> and protein <SEQ ID 8792> were also identified. Analysis of this protein sequence reveals the following:

Belongs to Glycolysis/gluconeogenesis pathway. Proteins belonging to this methabolic pathway have been experimentally detected on the surface of *Streptococci*.

The protein has homology with the following sequences in the databases:

```
>GP|6708108|gb|AAF25804.1|AF172173_2|AF172173 pyruvate kinase
[Streptococcus thermophilus]
Score = 821 bits (2098), Expect = 0.0
Identities = 412/500 (82%), Positives = 450/500 (89%)

Query:    1  MNKRVKIVATLGPAVEFRGGKKFGESGYWGESLDVEASAEKIAQLIKEGANVFRFNFSHG   60
             MNKRVKIVATLGPAVE RGGKKFGE GYW E LD +ASA+ IAQLI+EGANVFRFNFSHG
Sbjct:    1  MNKRVKIVATLGPAVEIRGGKKFGEDGYWSEKLDPDASAKNIAQLIEEGANVFRFNFSHG   60

Query:   61  DHAEQGARMATVRKAEEIAGQKVGFLLDTKGPEIRTELFEDGADFHSYTTGTKLRVATKQ  120
             +HAEQG RM  VR AE IAGQKVGFLLDTKGPEIRTELFE  A   ++Y TG ++R+ATKQ
Sbjct:   61  NHAEQGERMDVVRMAESIAGQKVGFLLDTKGPEIRTELFEGDAKEYAYKTGEQIRIATKQ  120

Query:  121  GIKSTPEVIALNVAGGLDIFDDVEVGKQILVDDGKLGLTVFAKDKDTREFEVVVENDGLI  180
             G+KST +VIALNVAG LDIFDDVEVGKQ+LVDDGKLGL V   KD + REF V VENDG+I
```

-continued

```
Sbjct: 121 GLKSTRDVIALNVAGALDIFDDVEVGKQVLVDDGKLGLRVVDKDAEKREFIVEVENDGII  180

Query: 181 GKQKGVNIPYTKIPFPALAERDNADIRFGLEQGLNFIAISFVRTAKDVNEVRAICEETGX  240
           KQKGVNIPYTKIPFPALAERDNADIRFGLEQG+NFIAISFVRTAKDV EVRAICEETG
Sbjct: 181 AKQKGVNIPYTKIPFPALAERDNADIRFGLEQGINFIAISFVRTAKDVQEVRAICEETGN  240

Query: 241 GHVKLFAKIENQQGIDNIDEIIEAADGIMIARGDMGIEVPFEMVPVYQKMIITKVNAAGK  300
           GHVKL AKIENQQGIDNIDEIIEAADGIMIARGDMGIEVPFEMVPVYQKMIITKVNAAGK
Sbjct: 241 GHVKLLAKIENQQGIDNIDEIIEAADGIMIARGDMGIEVPFEMVPVYQKMIITKVNAAGK  300

Query: 301 AVITATNMLETMTDKPRATRSEVSDVFNAVIDGTDATMLSGESANGKYPVESVRTMATID  360
           V+TATNMLETMT+KPRATRSEVSDVFNAVIDGTDATMLSGESANG YPVESVRTMATI
Sbjct: 301 IVVTATNMLETMTEKPRATRSEVSDVFNAVIDGTDATMLSGESANGPYPVESVRTMATIH  360

Query: 361 KNAQTLLNEYGRLDSSAFPRNNKTDVIASAVKDATHSMDIKLVVTITETGNTARAISKFR  420
           KNAQTLL EYGRL+SS F R++ T+V+ASAVKDAT+SM I+L+V +TE+GNTA  I  +R
Sbjct: 361 KNAQTLLKEYGRLNSSTFDRSSNTEVVASAVKDATNSMHIQLIVALTESGNTASLIDTYR  420

Query: 421 PDADILAVTFDEKVQRSLMINWGVIPVLADKPASTDDMFEVAERVALEAGFVESGDNIVI  480
           P+ADI A+TFDE  Q+SLM+NWGVIPV+ + P+STDDMFEVAERVALE+G VESGDNIVI
Sbjct: 421 PEADIWAITFDELTQKSLMLNWGVIPVVTETPSSTDDMFEVAERVALESGLVESGDNIVI  480

Query: 481 VAGVPVGTGGTNTMRVRTVK  500
           VAGVPVG+G TNTMR+RTVK
Sbjct: 481 VAGVPVGSGNTNTMRIRTVK  500
```

SEQ ID 8792 (GBS330) was expressed in *E. coli* as a His-fusion product. SDS-PAGE analysis of total cell extract is shown in FIG. 73 (lane 5; MW 59 kDa).

GBS330-His was purified as shown in FIG. 213, lane 6.

Based on this analysis, it was predicted that these proteins and their epitopes could be useful antigens for vaccines or diagnostics.

EXAMPLE 1333

A DNA sequence (GBSx1417) was identified in *S. agalactiae* <SEQ ID 4089> which encodes the amino acid sequence <SEQ ID 4090>. Analysis of this protein sequence reveals the following:

```
Possible site: 18
>>> Seems to have no N-terminal signal sequence

----- Final Results -----
            bacterial cytoplasm --- Certainty = 0.0632(Affirmative) < succ>
             bacterial membrane --- Certainty = 0.0000(Not Clear)   < succ>
              bacterial outside --- Certainty = 0.0000(Not Clear)   < succ>
```

The protein has homology with the following sequences in the GENPEPT database.

```
>GP:AAF25803 GB:AF172173 phosphofructokinase
[Streptococcus thermophilus]
Identities = 270/337 (80%), Positives = 302/337 (89%), Gaps = 1/337 (0%)

Query:   1 MKRIAVLTSGGDAPGMNAAIRAVVRKAISEGMEVYGINQGYYGMVTGDIFPLDANSVGDT   60
           MKRIAVLTSGGDAPGMNAA+RAVV KAISEG+EV+GIN+GY GMV GDIF LDA  V +
Sbjct:   1 MKRIAVLTSGGDAPGMNAAVRAVVLKAISEGIEVFGINRGYAGMVEGDIFKLDAKRVENI   60

Query:  61 INRGGTFLRSARYPEFAELEGQLKGIEQLKKHGIEGVVVIGGDGSYHGAMRLTEHGFPAV  120
           ++RGGTFL+SARYPEFA+LEGQLKGIEQLKK+GIEGVVVIGGDGSYHGAMRLTEHGFPAV
Sbjct:  61 LSRGGTFLQSARYPEFAQLEGQLKGIEQLKKYGIEGVVVIGGDGSYHGAMRLTEHGFPAV  120

Query: 121 GLPGTIDNDIVGTDYTIGFDTAVATAVENLDRLRDTSASHNRTFVVEVMGRNAGDIALWS  180
           GLPGTIDNDIVGTDYTIGFDTAVATA E LD+++DT+ SH RTFVVEVMGRNAGDIALW+
Sbjct: 121 GLPGTIDNDIVGTDYTIGFDTAVATATEALDKIQDTAFSHGRTFVVEVMGRNAGDIALWA  180

Query: 181 GIAAGADQIIVPEEEFNIDEVVSNVRAGYAAG-KHHQIIVLAEGVMSGDEFAKTMKAAGD  239
           GIA+GADQIIVPEEE++I+EVV   V+ GY +G K H IIVLAEGVM  +EFA  MK AGD
Sbjct: 181 GIASGADQIIVPEEEYDINEVVRKVKEGYESGEKSHHIIVLAEGVMGAEEFAAKMKEAGD  240
```

```
Query:  240 DSDLRVTMLGHLLRGGSPTARDRVLASRMGAYAVQLLKEGRGGLAVGVHNEEMVESPILG  299
            SDLR TNLGH++RGGSPTARDRVLAS MGA+AV LLKEG GG+AVG+HNE++VESPILG
Sbjct:  241 TSDLRATNLGHVIRGGSPTARDRVLASWMGAHAVDLLKEGIGGVAVGIHNEQLVESPILG  300

Query:  300 LAEEGALFSLTDEGKIVVNNPHKADLRLAALNRDLAN                         336
            AEEGALFSLT++GKI+VNNPHKA L  A LNR LAN
Sbjct:  301 TAEEGALFSLTEDGKIIVNNPHKARLDFAELNRSLAN                         337
```

Proteins in the glycolysis/gluconeogenesis pathway have been experimentally detected on the surface of Streptococci.

A related DNA sequence was identified in *S. pyogenes* <SEQ ID 4091> which encodes the amino acid sequence <SEQ ID 4092>. Analysis of this protein sequence reveals the following:

```
Possible site: 18
>>> Seems to have no N-terminal signal sequence

----- Final Results -----
            bacterial cytoplasm --- Certainty = 0.0632(Affirmative) < succ>
            bacterial membrane  --- Certainty = 0.0000(Not Clear)   < succ>
            bacterial outside   --- Certainty = 0.0000(Not Clear)   < succ>
```

An alignment of the GAS and GBS proteins is shown below.

```
Identities = 274/336 (81%), Positives = 306/336 (90%), Gaps = 1/336 (0%)

Query:    1 MKRIAVLTSGGDAPGMNAAIRAVVRKAISEGMEVYGINQGYYGMVTGDIFPLDANSVGDT   60
            MKRIAVLTSGGDAPGMNAAIRAVVRKAISEGMEVYGIN+GY GMV GDIFPL + VGD
Sbjct:    1 MKRIAVLTSGGDAPGMNAAIRAVVRKAISEGMEVYGINRGYAGMVDGDIFPLGSKEVGDK   60

Query:   61 INRGGTFLRSARYPEFAELEGQLKGIEQLKKHGIEGVVVIGGDGSYHGAMRLTEHGEPAV  120
            I+RGGTFL SARYPEFA+LEGQL GIEQLKKHGIEGVVVIGGDGSYHGAMRLTEHGFPAV
Sbjct:   61 ISRGGTFLYSARYPEFAQLEGQLAGIEQLKKHGIEGVVVIGGDGSYHGAMRLTEHGFPAV  120

Query:  121 GLPGTIDNDIVGTDYTIGFDTAVATAVENLDRLRDTSASHNRTFVVEVMGRNAGDIALWS  180
            G+PGTIDNDI GTDYTIGFDTAV TAVE +D+LRDTS+SH RTFVVEVMGRNAGDIALW+
Sbjct:  121 GIPGTIDNDIAGTDYTIGFDTAVMTAVEAIDKLRDTSSSHGRTFVVEVMGRNAGDIALWA  180

Query:  181 GIAAGADQIIVPEEEFNIDEVVSNVRAGYA-AGKHHQIIVLAEGVMSGDEFAKTMKAAGD  239
            GIA+GADQIIVPEEEF+I++V S ++   +  GK+H IIVLAEGVMSG+ FA+ +K AGD
Sbjct:  181 GIASGADQIIVPEEEFDIEKVASTIQYDFEHKGKNNHIIVLAEGVMSGEAFAQKLKEAGD  240

Query:  240 DSDLRVTNLGHLLRGGSPTARDRVLASRMGAYAVQLLKEGRGGLAVGVHNEEMVESPILG  299
            SDLRVTNLGH+LRGGSPTARDRV+AS MG++AV LLK+G+GGLAVG+HNEE+VESPILG
Sbjct:  241 KSDLRVTNLGHILRGGSPTARDRVIASWMGSHAVELLKDGKGGLAVGIHNEELVESPILG  300

Query:  300 LAEEGALFSLTDEGKIVVNNPHKADLRLAALNRDLA                          335
            AEEGALFSLT+EGKI+VNNPHKA L  AALNR L+
Sbjct:  301 TAEEGALFSLTEEGKIIVNNPHKARLDFAALNRSLS                          336
```

SEQ ID 4090 (GBS313) was expressed in *E. coli* as a His-fusion product. SDS-PAGE analysis of total cell extract is shown in FIG. 45 (lane 5; MW 41 kDa).

Figure 204:
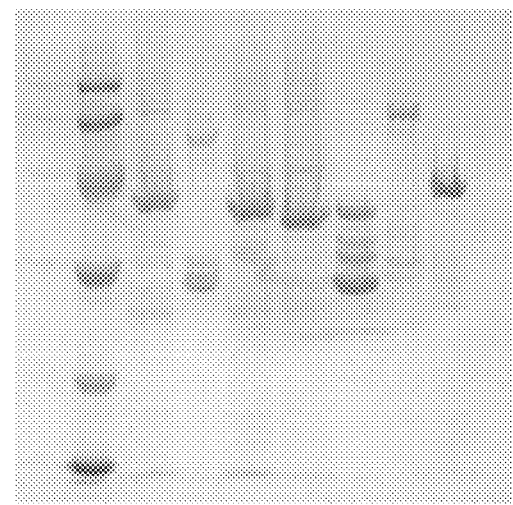

GBS313-His was purified as shown in FIG. 204, lane 4.

Based on this analysis, it was predicted that these proteins and their epitopes could be useful antigens for vaccines or diagnostics.

EXAMPLE 1334

A DNA sequence (GBSx1418) was identified in *S. agalactiae* <SEQ ID 4093> which encodes the amino acid sequence <SEQ ID 4094>. This protein is predicted to be DNA polymerase III alpha subunit (dnaE). Analysis of this protein sequence reveals the following:

```
Possible site: 55
>>> Seems to have no N-terminal signal sequence

----- Final Results -----
            bacterial cytoplasm --- Certainty = 0.1446(Affirmative) < succ>
             bacterial membrane --- Certainty = 0.0000(Not Clear)   < succ>
              bacterial outside --- Certainty = 0.0000(Not Clear)   < succ>
```

There is also homology to SEQ ID 4096.

Based on this analysis, it was predicted that this protein and its epitopes, could be useful antigens for vaccines or diagnostics.

EXAMPLE 1335

A DNA sequence (GBSx1419) was identified in *S. agalactiae* <SEQ ID 4097> which encodes the amino acid sequence <SEQ ID 4098>. This protein is predicted to be YHCF (farR). Analysis of this protein sequence reveals the following:

```
Possible site: 52
>>> Seems to have no N-terminal signal sequence

----- Final Results -----
            bacterial cytoplasm --- Certainty = 0.3316(Affirmative) < succ>
             bacterial membrane --- Certainty = 0.0000(Not Clear)   < succ>
              bacterial outside --- Certainty = 0.0000(Not Clear)   < succ>
```

The protein has homology with the following sequences in the GENPEPT database.

```
>GP:BAB04102 GB:AP001508 transcriptional regulator (GntR family)
[Bacillus halodurans]
Identities = 51/116 (43%), Positives = 79/116 (67%)

Query:   5 FNEKSPIYSQIAEHIKMQIVSQEIKSGDQLPTVRELAQEAGVNPNTMQRAFTELEREGMV    64
           F+   PIY Q+AE +K QIV  E++ G++LP+VR++  EA VNPNT+QR + ELE   +V
Sbjct:   5 FHSSEPIYLQLAERVKRQIVRGELRLGEKLPSVRDMGIEANVNPNTVQRTYRELEGLKIV    64

Query:  65 FSQRTSGRFVTEDNLLIGKIRQQVAKAELATFVNNMKKIGYKLDEITVALDHFIKE       120
              S+R  G FVTED  ++   IR+Q+ + E++ FV  M+++GY  +EI   L+ ++ E
Sbjct:  65 ESKRGQGTFVTEDEQVLQAIREQMKETEISHFVQGMREMGYSDNEIQAGLESYLTE       120
```

A related DNA sequence was identified in *S. pyogenes* <SEQ ID 4099> which encodes the amino acid sequence <SEQ ID 4100>. Analysis of this protein sequence reveals the following:

```
Possible site: 25
>>> Seems to have no N-terminal signal sequence

----- Final Results -----
            bacterial cytoplasm --- Certainty = 0.2075(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below.

```
Identities = 80/120 (66%), Positives = 100/120 (82%)

Query:   1 MAWEFNEKSPIYSQIAEHIKMQIVSQEIKSGDQLPTVRELAQEAGVNPNTMQRAFTELER    60
           M+W+F EKSPIY+QIA+H+ MQI+SQEIKSGDQLPTVRE A+ AGVNPNTMQRAFTELER
Sbjct:   1 MSWKFEEKSPIYAQIAQHVMMQIISQEIKSGDQLPTVREYAEIAGVNPNTMQRAFTELER    60

Query:  61 EGMVFSQRTSGRFVTEDNLLIGKIRQQVAKAELATFVNNMKKIGYKLDEITVALDHFIKE   120
           EGMV+SQRT+GRFVT+D  LI + R+++A +EL +F+ NM K+G+   EI   L  F+KE
Sbjct:  61 EGMVYSQRTAGRFVTDDQKLIARKRRELAISELESFITNMTKMGFSHTEIIPVLTSFLKE   120
```

Based on this analysis, it was predicted that these proteins and their epitopes could be useful antigens for vaccines or diagnostics.

EXAMPLE 1336

A DNA sequence (GBSx1420) was identified in *S. agalactiae* <SEQ ID 4101> which encodes the amino acid sequence <SEQ ID 4102>. This protein is predicted to be ABC transporter, ATP-binding protein (yhcG). Analysis of this protein sequence reveals the following:

```
Possible site: 26
>>> Seems to have no N-terminal signal sequence

----- Final Results -----
            bacterial cytoplasm --- Certainty = 0.2757(Affirmative) < succ>
             bacterial membrane --- Certainty = 0.0000(Not Clear)   < succ>
              bacterial outside --- Certainty = 0.0000(Not Clear)   < succ>
```

The protein has homology with the following sequences in the GENPEPT database.

```
>GP: CAB12735 GB: Z99108 similar to glycine betaine/L-proline
transport [Bacillus subtilis]
Identities = 87/228 (38%), Positives = 150/228 (65%), Gaps = 1/228 (0%)

Query:   5 LQLHHVTKKYHKHTAVNDVTVSIPTGKIIGLLGPNGSGKTTIIKMINGLLQPDKGDIVID    64
           ++L HV+KKY +HTAVNDV++++ +G+I GL+GPNGSGK+T +KM+ GLL P  G + +D
Sbjct:   3 IKLEHVSKKYGRHTAVNDVSITLSSGRIYGLIGPNGSGKSTTLKMMAGLLFPTSGFVKVD    62

Query:  65 GYRPSVETKKIISYLPDTSYLQENMKIKDVVTLFEDFYNDFDSKVAYQLFEDLNLNPRER   124
           + + E  +  +YL +      +  +KD+V  ++   + DF ++   Y+L  ++ LNP ++
Sbjct:  63 EEQVTREMVRQTAYLTELDMFYPHFTVKDMVNFYQSQFPDFHTEQVYKLLNEMQLNPEKK   122

Query: 125 LKNLSKGNKEKVQLILVMSRKARLYILDEPIGGVDPAARDYILKTIISNYSNDAS-VLIS   183
           +K LSKGN+ +++++L ++R+A + +LDEP  G+DP  RD  I+ +++S   +   V+I+
Sbjct: 123 IKKLSKGNRGRLKIVLALARRADVILLDEPFSGLDPMVRDSIVNSLVSYIDFEQQIVVIA   182

Query: 184 THLISDIEPILDEVIFLKEGEIDLQGNADDLREEHNCSIDALFRERFK               231
           TH  I  +IE +LDEVI  L  GE    Q  +D+RE+     S+     F+ + +
Sbjct: 183 THEIDEIETLLDEVIILANGEKVAQREVEDIREQEGMSVLQWFKSKME               230
```

A related DNA sequence was identified in *S. pyogenes* <SEQ ID 4103> which encodes the amino acid sequence <SEQ ID 4104>. Analysis of this protein sequence reveals the following:

```
Possible site: 13
>>> Seems to have no N-terminal signal sequence

----- Final Results -----
            bacterial cytoplasm --- Certainty = 0.1983(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below.

```
Identities = 171/231 (74%), Positives = 200/231 (86%)

Query:   1 MTQLLQLHHVTKKYHKHTAVNDVTVSIPTGKIIGLLGPNGSGKTTIIKMINGLLQPDKGD    60
           M  LLQLHHV+K Y +  A++D+T++IP GKIIGLLGPNGSGKTT+IK+INGLLQP+KG+
Sbjct:   1 MAHLLQLHHVSKSYREKKAIDDLTITIPNGKIIGLLGPNGSGKTTLIKLINGLLQPNKGE    60

Query:  61 IVIDGYRPSVETKKIISYLPDTSYLQENMKIKDVVTLFEDFYNDFDSKVAYQLFEDLNLN   120
           IVIDGYRP VETKKIISYLPDT+YL ENM+IKD++  F DFY+DFD   A  L DL L+
Sbjct:  61 IVIDGYRPCVETKKIISYLPDTTYLNENMRIKDMLEFFSDFYSDFDKSKATSLLRDLELD   120

Query: 121 PRERLKNLSKGNKEKVQLILVMSRKARLYILDEPIGGVDPAARDYILKTIISNYSNDASV   180
           P +R K LSKGNKEKVQLILVMSRKARLY+LDEPIGGVDPAARDYILKTII++Y  +ASV
Sbjct: 121 PEDRFKTLSKGNKEKVQLILVMSRKARLYVLDEPIGGVDPAARDYILKTIINSYCENASV   180
```

```
Query:  181 LISTHLISDIEPILDEVIFLKEGEIDLQGNADDLREEHNCSIDALFRERFK           231
            +ISTHLISDIEPILDEVIFLK+G + L GNADDLR+E+  SID+LFRE +K
Sbjct:  181 IISTHLISDIEPILDEVIFLKQGRLFLSGNADDLRQEYQQSIDSLFRETYK           231
```

Based on this analysis, it was predicted that these proteins and their epitopes could be useful antigens for vaccines or diagnostics.

EXAMPLE 1337

A DNA sequence (GBSx1421) was identified in *S. agalactiae* <SEQ ID 4105> which encodes the amino acid sequence <SEQ ID 4106>. Analysis of this protein sequence reveals the following:

```
Possible site: 48
>>> Seems to have an uncleavable N-term signal seq
    INTEGRAL    Likelihood = -15.39    Transmembrane    120-136 (103-146)
    INTEGRAL    Likelihood =  -9.98    Transmembrane     55-71  (47-79)
    INTEGRAL    Likelihood =  -9.45    Transmembrane     22-38  (15-43)
    INTEGRAL    Likelihood =  -6.05    Transmembrane    192-208 (187-218)
    INTEGRAL    Likelihood =  -4.94    Transmembrane    230-246 (228-253)
    INTEGRAL    Likelihood =  -4.78    Transmembrane    157-173 (155-175)
    INTEGRAL    Likelihood =  -1.44    Transmembrane    103-119 (103-119)

----- Final Results -----
            bacterial membrane  --- Certainty = 0.7156(Affirmative) < succ>
             bacterial outside  --- Certainty = 0.0000(Not Clear)   < succ>
           bacterial cytoplasm  --- Certainty = 0.0000(Not Clear)   < succ>
```

The protein has no significant homology with any sequences in the GENPEPT database.

A related DNA sequence was identified in *S. pyogenes* <SEQ ID 4107> which encodes the amino acid sequence <SEQ ID 4108>. Analysis of this protein sequence reveals the following:

```
Possible site: 28
>>> Seems to have a cleavable N-term signal seq.
    INTEGRAL    Likelihood = -11.52    Transmembrane    190-206 (187-215)
    INTEGRAL    Likelihood = -10.67    Transmembrane    121-137 (104-141)
    INTEGRAL    Likelihood =  -5.73    Transmembrane     63-79  (59-82)
    INTEGRAL    Likelihood =  -4.83    Transmembrane    158-174 (156-181)
    INTEGRAL    Likelihood =  -1.38    Transmembrane    232-248 (232-248)
    INTEGRAL    Likelihood =  -0.85    Transmembrane    104-120 (104-120)

----- Final Results -----
            bacterial membrane  --- Certainty = 0.5607(Affirmative) < succ>
             bacterial outside  --- Certainty = 0.0000(Not Clear)   < succ>
           bacterial cytoplasm  --- Certainty = 0.0000(Not Clear)   < succ>
```

The protein has no significant homology with any sequences in the GENPEPT database.

An alignment of the GAS and GBS proteins is shown below.

```
Identities = 116/267 (43%), Positives = 165/267 (61%), Gaps = 13/267 (4%)

Query:    1 MFGKLLKYELKSVGKWYLTLNAAVLLVSIILGLVLKALG-----GNFSTDTNSTSAQIFT    55
            MFGKLLKYE +S+GKWY  LNA V+ ++ IL  +K       G F   TN     ++
Sbjct:    1 MFGKLLKYEFRSIGKWYFALNAFVIAIAAILSFTIKLFAQSNSDGLFGVLTN----KMLP    56

Query:   56 IILVLLLAMVISGSLLSTLAIIIKRFYSNIFGRQGYLTLTLPVTTNQIICSKLLASLLWS   115
            + L L    +I+GSLLSTL IIIKRF  ++FG +GYLTLTLPV ++QII SKLLAS + S
Sbjct:   57 LTLGLTFGSLIAGSLLSTLLIIIKRFSKSVFGWEGYLTLTLPVNSHQIILSKLLASFICS   116

Query:  116 IFNIFIVIIGIILVILPLVGIGQFVVAFPEIYKIISSSNAPLFIAYFFLSYVAGTLLIYL   175
            +FN I+    I +VI+P+  I + +    F  +K+     N    +AY  LS    LLIYL
Sbjct:  117 VFNTIILAFAIAIVIVPMFNINELLEGFFNSFKNDYFINMLTVLAYVLLSTFTSILLIYL   176
```

```
                          -continued
Query: 176 SIAVGQLFTNKRVLMGIVSYFGISLLITFLTLIIDSIFHIDLFNSHANA-TFSQPVLLY- 233
           SI++GQLF+N+R LM  ++YF + +LI+   + S  HI   N+ A++   F++    +Y
Sbjct: 177 SISIGQLFSNRRGLMAFIAYFILVILISVAATYVHS--HIFNINTSADSFPFTEQKTIYL 234

Query: 234 NILVSIVEIAIFYMLTHSIIKYKLNIQ                                  260
           IL   +E+ +FY+ T+ IIK KLN+Q
Sbjct: 235 LILEQFIEMIMFYLATNFIIKNKLNLQ                                  261
```

Based on this analysis, it was predicted that these proteins and their epitopes could be useful antigens for vaccines or diagnostics.

EXAMPLE 1338

A DNA sequence (GBSx1422) was identified in *S. agalactiae* <SEQ ID 4109> which encodes the amino acid sequence <SEQ ID 4110>. Analysis of this protein sequence reveals the following:

```
Possible site: 17
>>> Seems to have no N-terminal signal sequence

----- Final Results -----
            bacterial cytoplasm --- Certainty = 0.5890(Affirmative) < succ>
             bacterial membrane --- Certainty = 0.0000(Not Clear)   < succ>
              bacterial outside --- Certainty = 0.0000(Not Clear)   < succ>
```

The protein is similar to ORF24 from *S. faecalis*.

No corresponding DNA sequence was identified in *S. pyogenes*.

Based on this analysis, it was predicted that this protein and its epitopes, could be useful antigens for vaccines or diagnostics.

EXAMPLE 1339

A DNA sequence (GBSx1423) was identified in *S. agalactiae* <SEQ ID 4111> which encodes the amino acid sequence <SEQ ID 4112>. Analysis of this protein sequence reveals the following:

```
Possible site: 61
>>> Seems to have no N-terminal signal sequence

----- Final Results -----
            bacterial cytoplasm --- Certainty = 0.3316(Affirmative) < succ>
             bacterial membrane --- Certainty = 0.0000(Not Clear)   < succ>
              bacterial outside --- Certainty = 0.0000(Not Clear)   < succ>
```

The protein is similar to ORF23 from *S. faecalis*. No corresponding DNA sequence was identified in *S. pyogenes*.

Based on this analysis, it was predicted that this protein and its epitopes, could be useful antigens for vaccines or diagnostics.

EXAMPLE 1340

A DNA sequence (GBSx1424) was identified in *S. agalactiae* <SEQ ID 4113> which encodes the amino acid sequence <SEQ ID 4114>. Analysis of this protein sequence reveals the following:

```
Possible site: 25
>>> Seems to have no N-terminal signal sequence

----- Final Results -----
            bacterial cytoplasm --- Certainty = 0.4256(Affirmative) < succ>
             bacterial membrane --- Certainty = 0.0000(Not Clear)   < succ>
              bacterial outside --- Certainty = 0.0000(Not Clear)   < succ>
```

The protein is similar to ORF22 from *S. faecalis*. No corresponding DNA sequence was identified in *S. pyogenes*.

Based on this analysis, it was predicted that this protein and its epitopes, could be useful antigens for vaccines or diagnostics.

EXAMPLE 1341

A DNA sequence (GBSx1425) was identified in *S. agalactiae* <SEQ ID 4115> which encodes the amino acid sequence <SEQ ID 4116>. Analysis of this protein sequence reveals the following:

```
Possible site: 39
>>> Seems to have an uncleavable N-term signal seq
    INTEGRAL    Likelihood = -13.37    Transmembrane    62-78 (55-84)
    INTEGRAL    Likelihood =  -8.44    Transmembrane    19-35 (14-41)

----- Final Results -----
             bacterial membrane --- Certainty = 0.6349(Affirmative) < succ>
             bacterial outside  --- Certainty = 0.0000(Not Clear)   < succ>
             bacterial cytoplasm --- Certainty = 0.0000(Not Clear)  < succ>
```

The protein is similar to ORF21 from *S. faecalis*.

A related DNA sequence was identified in *S. pyogenes* <SEQ ID 4117> which encodes the amino acid sequence <SEQ ID 4118>. Analysis of this protein sequence reveals the following:

```
Possible site: 37
>>> Seems to have no N-terminal signal sequence

----- Final Results -----
             bacterial cytoplasm --- Certainty = 0.2444 (Affirmative) < succ>
             bacterial membrane  --- Certainty = 0.0000 (Not Clear)   < succ>
             bacterial outside   --- Certainty = 0.0000 (Not Clear)   < succ>
```

An alignment of the GAS and GBS proteins is shown below.

```
Identities = 54/236 (22%), Positives = 95/236 (39%), Gaps = 12/236 (5%)
Query: 204 KDGKLRLMKNVWWEYDKLPHMLIAGGTGGGKTYFILTLIEALLHTDSKLYILDPKN----   259
           + GK+ ++K+     DK H  IAG +G GK Y  LT    ++L   S L I+ DPK
Sbjct:  14 QQGKIPVIKHFELNLDKGSHWAIAGNSGSGKPY-ALTYFLSVLKPKSGLIIIDPKFDTPS    72

Query: 260 --ADLADLGSVMANVYYRKEDLLSCIETFYEEMMKRSEEMKQMKNYKTGKNYAYLGLPAH   317
             A  +  +     + K D +S +      ++ + +       + +L +
Sbjct:  73 QWARENKIAVIHPVENHSKSDFVSQVNEQLNQCATLIQKRQAILYDNPNHQFTHLTI---   129

Query: 318 FLIFDEYVAFMEMLGTKENTAVMNKLKQIVMLGRQAGFFLILACQRPDAKYLGDGIRDQF   377
           + DE +A E +     A  + L QI + LG      L L  QR D  +    +R++Q
Sbjct: 130 --VIDEVLALSEGVNKNIKEAFFSLLSQIALLGHATKIHLFLGSQRFDHNTIPISVREQL   187

Query: 378 NFRVALGRMSEMGYGMMFGSDVQKDFFLKRIKGRGYVDVGTSVISEFYTPLVPKGY       433
           N  +G +++     +F    +    G G + V  + S    PL+    Y
Sbjct: 188 NVLLQIGNINQKTTQFLFPDLDPEGIVIPTGHGTGIIQVVDNEHSYQVLPLLCPTY       243
```

Figure 121:
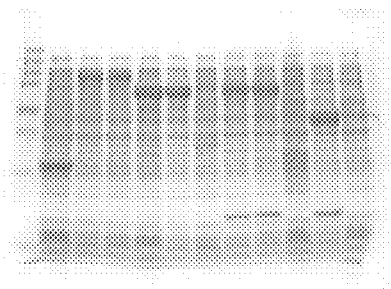

SEQ ID 4116 (GBS109d) was expressed in *E. coli* as a GST-fusion product. SDS-PAGE analysis of total cell extract is shown in FIG. 121 (lane 8 & 9; MW 71 kDa) and in FIG. 184 (lane 2; MW 71 kDa). It was also expressed in *E. coli* as a His-fusion product. SDS-PAGE analysis of total cell extract is shown in FIG. 121 (lane 11; MW 46 kDa), FIG. 128 (lane 4; MW 46 kDa) and FIG. 179 (lane 7; MW 46 kDa).

GBS109d-His was purified as shown in FIG. 232 (lanes 7 & 8). GBS109d-GST was purified as shown in FIG. 236, lane 10.

Based on this analysis, it was predicted that these proteins and their epitopes could be useful antigens for vaccines or diagnostics.

EXAMPLE 1342

A DNA sequence (GBSx1426) was identified in *S. agalactiae* <SEQ ID 4119> which encodes the amino acid sequence <SEQ ID 4120>. Analysis of this protein sequence reveals the following:

```
Possible site: 22
>>> Seems to have a cleavable N-term signal seq.

----- Final Results -----
          bacterial outside --- Certainty = 0.3000 (Affirmative) < succ>
         bacterial membrane --- Certainty = 0.0000 (Not Clear)  < succ>
        bacterial cytoplasm --- Certainty = 0.0000 (Not Clear)  < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1343

A DNA sequence (GBSx1427) was identified in *S. agalactiae* <SEQ ID 4121> which encodes the amino acid sequence <SEQ ID 4122>. Analysis of this protein sequence reveals the following:

```
Possible site: 32
>>> Seems to have no N-terminal signal sequence

----- Final Results -----
        bacterial cytoplasm --- Certainty = 0.4469(Affirmative) < succ>
         bacterial membrane --- Certainty = 0.0000(Not Clear)   < succ>
          bacterial outside --- Certainty = 0.0000(Not Clear)   < succ>
```

A related GBS nucleic acid sequence <SEQ ID 9793> which encodes amino acid sequence <SEQ ID 9794> was also identified.

The protein is similar to ORF20 from *S. faecalis*. No corresponding DNA sequence was identified in *S. pyogenes*.

Based on this analysis, it was predicted that these proteins and their epitopes could be useful antigens for vaccines or diagnostics.

EXAMPLE 1344

A DNA sequence (GBSx1428) was identified in *S. agalactiae* <SEQ ID 4123> which encodes the amino acid sequence <SEQ ID 4124>. Analysis of this protein sequence reveals the following:

```
Possible site: 14
>>> Seems to have no N-terminal signal sequence

----- Final Results -----
        bacterial cytoplasm --- Certainty = 0.1367 (Affirmative) < succ>
         bacterial membrane --- Certainty = 0.0000 (Not Clear)   < succ>
          bacterial outside --- Certainty = 0.0000 (Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1345

A DNA sequence (GBSx1429) was identified in *S. agalactiae* <SEQ ID 4125> which encodes the amino acid sequence <SEQ ID 4126>. Analysis of this protein sequence reveals the following:

```
Possible site: 22
>>> Seems to have no N-terminal signal sequence
    INTEGRAL    Likelihood = -10.77       Transmembrane     39-55 (34-64)
    INTEGRAL    Likelihood = -6.32        Transmembrane     16-32 (10-35)

----- Final Results -----
              bacterial membrane --- Certainty = 0.5310 (Affirmative) < succ>
                bacterial outside --- Certainty = 0.0000 (Not Clear)  < succ>
             bacterial cytoplasm --- Certainty = 0.0000 (Not Clear)  < succ>
```

The protein is similar to ORF19 from *S. faecalis*. No corresponding DNA sequence was identified in *S. pyogenes*.

Based on this analysis, it was predicted that this protein and its epitopes, could be useful antigens for vaccines or diagnostics.

EXAMPLE 1346

A DNA sequence (GBSx1430) was identified in *S. agalactiae* <SEQ ID 4127> which encodes the amino acid sequence <SEQ ID 4128>. This protein is predicted to be antirestriction protein. Analysis of this protein sequence reveals the following:

```
Possible site: 22
>>> Seems to have no N-terminal signal sequence

----- Final Results -----
             bacterial cytoplasm --- Certainty = 0.2918 (Affirmative) < succ>
               bacterial membrane --- Certainty = 0.0000 (Not Clear)  < succ>
                bacterial outside --- Certainty = 0.0000 (Not Clear)  < succ>
```

The protein is similar to ORF18 from *S. faecalis*. No corresponding DNA sequence was identified in *S. pyogenes*.

Based on this analysis, it was predicted that this protein and its epitopes, could be useful antigens for vaccines or diagnostics.

EXAMPLE 1347

A DNA sequence (GBSx1431) was identified in *S. agalactiae* <SEQ ID 4129> which encodes the amino acid sequence <SEQ ID 4130>. Analysis of this protein sequence reveals the following:

```
Possible site: 27
>>> Seems to have a cleavable N-term signal seq.
    INTEGRAL    Likelihood = -3.61        Transmembrane     75-91 (72-94)

----- Final Results -----
              bacterial membrane --- Certainty = 0.2444 (Affirmative) < succ>
                bacterial outside --- Certainty = 0.0000 (Not Clear)  < succ>
             bacterial cytoplasm --- Certainty = 0.0000 (Not Clear)  < succ>
```

The protein is similar to ORF17 from *S. faecalis*. No corresponding DNA sequence was identified in *S. pyogenes*.

A related GBS gene <SEQ ID 8793> and protein <SEQ ID 8794> were also identified. Analysis of this protein sequence reveals the following:

```
Lipop Possible site: -1 Crend: 4
McG: Discrim Score: -7.12
GvH: Signal Score (-7.5): -2.52
    Possible site: 43
>>> Seems to have no N-terminal signal sequence
ALOM program           count: 1       value: -3.61              threshold: 0.0
   INTEGRAL          Likelihood = -3.61    Transmembrane    37-53 (34-56)
   PERIPHERAL        Likelihood = 3.66                  58
modified ALOM score: 1.22

*** Reasoning Step: 3

----- Final Results -----
              bacterial membrane --- Certainty = 0.2444 (Affirmative) < succ>
              bacterial outside  --- Certainty = 0.0000 (Not Clear)   < succ>
           bacterial cytoplasm   --- Certainty = 0.0000 (Not Clear)   < succ>
```

The protein has homology with the following sequences in the databases:

```
100.0/100.0% over 167aa
Enterococcus faecalis
EGAD|14977|hypothetical protein Insert characterized
GP|532550|gb|AAB60016.1||009422 ORF17 Insert characterized
ORF00720(187-690 of 990)
EGAD|14977|15011(1-168 of 168) hypothetical protein {Enterococcus faecalis}
GP|532550|gb|AAB60016.1||U09422 ORF17 {Enterococcus faecalis}
% Match = 50.3
% Identity = 100.0    % Similarity = 100.0
Matches = 168    Mismatches = 0    Conservative Sub.s = 0
120         150        180        210        240        270        300        330
L*AKYQLVFKTILIIKPMVGI*TFQERLSQPIMGFLKSSIKSVGTLLLADFLFYGVAQSATPIFYERIDYMKKIRSYTSI
                                    |||||||||||||||||||||||||||||||||||||||
                                    MGFLKSSIKSVGTLLLADFLFYGVAQSATPIFYERIDYMKKIRSYTSI
                                    10         20         30         40
360        390        420        450        480        510        540        570
WSVEKVLYSINDFRLPFPITFTQMTWFVVSLFAVMILGNLPPLSMIEGAFLKYFGIPVAFTWFMSTKTFDGKKPYGFLKS
|||||||||||||||||||||||||||||||||||||||||||||||||||||||||||||||||||||||||||||
WSVEKVLYSINDFRLPFPITFTQMTWFVVSLFAVMILGNLPPLSMIEGAFLKYFGIPVAFTWFMSTKTFDGKKPYGFLKS
     60         70         80         90         100        110        120
600        630        660        690        720        750        780        810
VIAYALRPKLTYAGKKVTLGRNQPQEAITAVRSEFYGISN*IH*KQSRLE*RRGMLCLL*ACSLQLLISKSRTENTSA*F
|||||||||||||||||||||||||||||||||||||||
VIAYALRPKLTYAGKKVTLGRNQPQEAITAVRSEFYGISN
     140        150        160
```

SEQ ID 8794 (GBS223) was expressed in *E. coli* as a His-fusion product. SDS-PAGE analysis of total cell extract is shown in FIG. 44 (lane 7; MW 18 kDa).

Based on this analysis, it was predicted that these proteins and their epitopes could be useful antigens for vaccines or diagnostics.

EXAMPLE 1348

A DNA sequence (GBSx1432) was identified in *S. agalactiae* <SEQ ID 4131> which encodes the amino acid sequence <SEQ ID 4132>. Analysis of this protein sequence reveals the following:

```
Possible site: 37
>>> Seems to have no N-terminal signal sequence

----- Final Results -----
           bacterial cytoplasm --- Certainty = 0.4292 (Affirmative) < succ>
              bacterial membrane --- Certainty = 0.0000 (Not Clear)   < succ>
                bacterial outside --- Certainty = 0.0000 (Not Clear)   < succ>
```

A related GBS nucleic acid sequence <SEQ ID 9791> which encodes amino acid sequence <SEQ ID 9792> was also identified.

No corresponding DNA sequence was identified in S. pyogenes.

Based on this analysis, it was predicted that these proteins and their epitopes could be useful antigens for vaccines or diagnostics.

EXAMPLE 1349

A DNA sequence (GBSx1433) was identified in S. agalactiae <SEQ ID 4133> which encodes the amino acid sequence <SEQ ID 4134>. Analysis of this protein sequence reveals the following:

```
Possible site: 16
>>> Seems to have no N-terminal signal sequence
    INTEGRAL    Likelihood = -6.21    Transmembrane    350-366 (345-368)
    INTEGRAL    Likelihood = -0.32    Transmembrane    171-187 (171-188)

----- Final Results -----
              bacterial membrane --- Certainty = 0.3484 (Affirmative) < succ>
                bacterial outside --- Certainty = 0.0000 (Not Clear)  < succ>
              bacterial cytoplasm --- Certainty = 0.0000 (Not Clear)  < succ>
```

No corresponding DNA sequence was identified in S. pyogenes.

Based on this analysis, it was predicted that this protein and its epitopes, could be useful antigens for vaccines or diagnostics.

EXAMPLE 1350

A DNA sequence (GBSx1434) was identified in S. agalactiae <SEQ ID 4135> which encodes the amino acid sequence <SEQ ID 4136>. Analysis of this protein sequence reveals the following:

```
Possible site: 45
>>> Seems to have no N-terminal signal sequence
INTEGRAL Likelihood = -10.30 Transmembrane 154-170 (148-177)
INTEGRAL Likelihood = -10.30 Transmembrane  21-37  (17-50)
INTEGRAL Likelihood = -10.03 Transmembrane 320-336 (316-367)
INTEGRAL Likelihood =  -7.43 Transmembrane 346-362 (337-367)
INTEGRAL Likelihood =  -7.01 Transmembrane 186-202 (180-206)
INTEGRAL Likelihood =  -5.36 Transmembrane 411-427 (404-430)
INTEGRAL Likelihood =  -1.17 Transmembrane 386-402 (386-402)

----- Final Results -----
              bacterial membrane --- Certainty = 0.5118 (Affirmative) < succ>
                bacterial outside --- Certainty = 0.0000 (Not Clear)  < succ>
              bacterial cytoplasm --- Certainty = 0.0000 (Not Clear)  < succ>
```

No corresponding DNA sequence was identified in S. pyogenes.

Based on this analysis, it was predicted that this protein and its epitopes, could be useful antigens for vaccines or diagnostics.

EXAMPLE 1351

A DNA sequence (GBSx1436) was identified in S. agalactiae <SEQ ID 4137> which encodes the amino acid sequence <SEQ ID 4138>. Analysis of this protein sequence reveals the following:

```
Possible site: 14
>>> Seems to have no N-terminal signal sequence

----- Final Results -----
            bacterial cytoplasm --- Certainty = 0.6306 (Affirmative) < succ>
              bacterial membrane --- Certainty = 0.0000 (Not Clear) < succ>
                bacterial outside --- Certainty = 0.0000 (Not Clear) < succ>
```

The protein has no significant homology with any sequences in the GENPEPT database.

No corresponding DNA sequence was identified in S. pyogenes.

Based on this analysis, it was predicted that this protein and its epitopes, could be useful antigens for vaccines or diagnostics.

EXAMPLE 1352

A DNA sequence (GBSx1437) was identified in S. agalactiae <SEQ ID 4139> which encodes the amino acid sequence <SEQ ID 4140>. Analysis of this protein sequence reveals the following:

```
Possible site: 22
>>> Seems to have no N-terminal signal sequence

----- Final Results -----
            bacterial cytoplasm --- Certainty = 0.2973 (Affirmative) < succ>
              bacterial membrane --- Certainty = 0.0000 (Not Clear) < succ>
                bacterial outside --- Certainty = 0.0000 (Not Clear) < succ>
```

The protein has no significant homology with any sequences in the GENPEPT database.

No corresponding DNA sequence was identified in S. pyogenes.

Based on this analysis, it was predicted that this protein and its epitopes, could be useful antigens for vaccines or diagnostics.

EXAMPLE 1353

A DNA sequence (GBSx1438) was identified in S. agalactiae <SEQ ID 4141> which encodes the amino acid sequence <SEQ ID 4142>. Analysis of this protein sequence reveals the following:

```
Possible site: 42
>>> Seems to have no N-terminal signal sequence

----- Final Results -----
            bacterial cytoplasm --- Certainty = 0.3382 (Affirmative) < succ>
              bacterial membrane --- Certainty = 0.0000 (Not Clear) < succ>
                bacterial outside --- Certainty = 0.0000 (Not Clear) < succ>
```

There is also homology to SEQ ID 4144.

A related GBS gene <SEQ ID 8795> and protein <SEQ ID 8796> were also identified. Analysis of this protein sequence reveals the following:

```
Lipop: Possible site: -1 Crend: 3
McG: Discrim Score: 11.12
GvH: Signal Score (-7.5): 0.27
     Possible site: 24
>>> Seems to have a cleavable N-term signal seq.
ALOM program count: 0 value: 4.19 threshold: 0.0
PERIPHERAL Likelihood = 4.19 69
modified ALOM score: -1.34
```

-continued

```
*** Reasoning Step: 3

----- Final Results -----
             bacterial outside --- Certainty = 0.3000 (Affirmative) < succ>
             bacterial membrane --- Certainty = 0.0000 (Not Clear) < succ>
             bacterial cytoplasm --- Certainty = 0.0000 (Not Clear) < succ>
```

The protein has homology with the following sequences in the databases:

```
100.0/100.0% over 332aa
Enterococcus faecalis
EGAD|36209|hypothetical protein Insert characterized
GP|532547|gb|AAB60019.1||U09422 ORF14 Insert characterized
ORF00727(301-1299 of 1599)
EGAD|36209|37602(1-333 of 333)hypothetical protein {Enterococcus
faecalis}GP|532547|gb|AAB60019.1||U09422 ORF14{Enterococcus faecalis}
% Match = 61.7
% Identity = 100.0    % Similarity = 100.0
Matches = 333    Mismatches = 0    Conservative Sub.s = 0
249         279         309         339         369         399         429         459
CSKSTTTKYKK*TTNQNRHH*ESR*ETMKLKTLVIGGSGLFLMVFSLLLFVAILFSDEQDSGISNIHYGGVNVSAEVLAH
                            ||||||||||||||||||||||||||||||||||||||||||||||||||
                            MKLKTLVIGGSGLFLMVFSLLLFVAILFSDEQDSGISNIHYGGVNVSAEVLAH
                                    10          20          30          40          50
489         519         549         579         609         639         669         699
KPMVEKYAKEYGVEEYVNILLAIIQVESGGTAEDVMQSSESLGLPPNSLSTEESIKQGVKYFSELLASSERLSVDLESVI
||||||||||||||||||||||||||||||||||||||||||||||||||||||||||||||||||||||||||||||
KPMVEKYAKEYGVEEYVNILLAIIQVESGGTAEDVMQSSESLGLPPNSLSTEESIKQGVKYFSELLASSERLSVDLESVI
         70          80          90         100         110         120         130
729         759         789         819         849         879         909         939
QSYNYGGGFLGYVANRGNKYTFELAQSFSKEYSGGEKVSYPNPIAIPINGGWRYNYGNMFYVQLVTQYLVTTEFDDDTVQ
||||||||||||||||||||||||||||||||||||||||||||||||||||||||||||||||||||||||||||||
QSYNYGGGFLGYVANRGNKYTFELAQSFSKEYSGGEKVSYPNPIAIPINGGWRYNYGNMFYVQLVTQYLVTTEFDDDTVQ
        150         160         170         180         190         200         210
969         999        1029        1059        1089        1119        1149        1179
AIMDEALKYEGWRYVYGGASPTTSFDCSGLTQWTYGKAGINLPRTAQQQYDVTQHIPLSEAQAGDLVFFHSTYNAGSYIT
||||||||||||||||||||||||||||||||||||||||||||||||||||||||||||||||||||||||||||||
AIMDEALKYEGWRYVYGGASPTTSFDCSGLTQWTYGKAGINLPRTAQQQYDVTQHIPLSEAQAGDLVFFHSTYNAGSYIT
        230         240         250         260         270         280         290
1209        1239        1269        1299        1329        1359        1389        1419
HVGIYLGNNRMFHAGDPIGYADLTSPYWQQHLVGAGRIKQ*ERKI***NLEKIRIKKNRYQRKRNLVSIRSILIKRL*LP
|||||||||||||||||||||||||||||||||||||||
HVGIYLGNNRMFHAGDPIGYADLTSPYWQQHLVGAGRIKQ
        310         320         330
```

SEQ ID 8796 (GBS155) was expressed in *E. coli* as a His-fusion product. SDS-PAGE analysis of total cell extract is shown in FIG. 24 (lane 10; MW 38 kDa). It was also expressed in *E. coli* as a GST-fusion product. SDS-PAGE analysis of total cell extract is shown in FIG. 31 (lane 7; MW 62 kDa).

Figure 111:
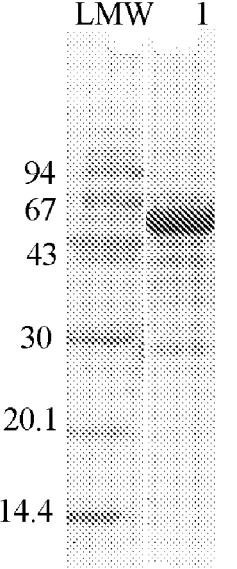

The GBS155-GST fusion product was purified (FIG. 111; see also FIG. 198, lane 74) and used to immunise mice (lane 1 product; 20 kg/mouse). The resulting antiserum was used for Western blot, FACS, and in the in vivo passive protection assay (Table III). These tests confirm that the protein is immunoaccessible on GBS bacteria and that it is an effective protective immunogen.

Based on this analysis, it was predicted that these proteins and their epitopes could be useful antigens for vaccines or diagnostics.

EXAMPLE 1354

A DNA sequence (GBSx1439) was identified in *S. agalactiae* <SEQ ID 4145> which encodes the amino acid sequence <SEQ ID 4146>. Analysis of this protein sequence reveals the following:

```
Possible site: 52
>>> Seems to have no N-terminal signal sequence
INTEGRAL Likelihood = -8.60 Transmembrane 37-53 (35-55)

----- Final Results -----
          bacterial membrane  --- Certainty = 0.4439 (Affirmative) < succ>
            bacterial outside --- Certainty = 0.0000 (Not Clear)   < succ>
          bacterial cytoplasm --- Certainty = 0.0000 (Not Clear)   < succ>
```

A related GBS nucleic acid sequence <SEQ ID 9789> which encodes amino acid sequence <SEQ ID 9790> was also identified.

No corresponding DNA sequence was identified in *S. pyogenes*.

Based on this analysis, it was predicted that these proteins and their epitopes could be useful antigens for vaccines or diagnostics.

EXAMPLE 1355

A DNA sequence (GBSx1440) was identified in *S. agalactiae* <SEQ ID 4147> which encodes the amino acid sequence <SEQ ID 4148>. Analysis of this protein sequence reveals the following:

```
Possible site: 40
>>> Seems to have an uncleavable N-term signal seq
INTEGRAL Likelihood = -0.00 Transmembrane 391-407 (391-407)

----- Final Results -----
          bacterial membrane  --- Certainty = 0.1001 (Affirmative) < succ>
            bacterial outside --- Certainty = 0.0000 (Not Clear)   < succ>
          bacterial cytoplasm --- Certainty = 0.0000 (Not Clear)   < succ>
```

A related GBS nucleic acid sequence <SEQ ID 9787> which encodes amino acid sequence <SEQ ID 9788> was also identified.

A related DNA sequence was identified in *S. pyogenes* <SEQ ID 4149> which encodes the amino acid sequence <SEQ ID 4150>. Analysis of this protein sequence reveals the following:

```
Possible Site: 19
>>> Seems to have no N-terminal signal sequence

----- Final Results -----
          bacterial cytoplasm --- Certainty = 0.2027 (Affirmative) < succ>
           bacterial membrane --- Certainty = 0.0000 (Not Clear)   < succ>
            bacterial outside --- Certainty = 0.0000 (Not Clear)   < succ>
```

An alignment of the GAS and GBS proteins is shown below.

```
Identities = 183/669 (27%), Positives = 305/669 (45%),
Gaps = 63/669 (9%)
Query:   7 KIINIGVLAHVDAGKTTLTESLLYNSGAITELGSVDKGTTRTDNTLLERQRGITIQTGIT   66
           K  NIG++AHVDAGKTT TE +LY +G I ++G    +G +D    E++RGITI +  T
Sbjct:   9 KTRNIGIMAHVDAGKTTTTERILYYTGKIHKIGETHEGASQMDWMEQEQERGITITSAAT   68

Query:  67 SFQWENTKVNIIDTPGHMDFLAEVYRSLSVLDGAILLISAKDGVQAQTRILFHALRKMGI  126
           + QW+  +VNIIDTPGH+DF  EV RSL VLDGA+ ++ ++ GV+ QT  ++    + G+
Sbjct:  69 TAQWDGHRVNIIDTPGHVDFTIEVQRSLRVLDGAVTVLDSQSGVEPQTETVWRQATEYGV  128

Query: 127 PTIFFINKIDQNGIDLSTVYQDIKEKLSAEI------------------VIKQKVELYPN  168
           P I F NK+D+ G D   Q + ++L A                     +IK K E+Y N
Sbjct: 129 PRIVFANKMDKIGADFLYSVQTLHDRLQANAHPIQLPIGAEDDFRGIIDLIKMKAEIYTN  188

Query: 169 MCVTNFTES---EQW------------DTVIEGNDDLLEKYMSGKSLEALELEQEESIRF  213
             T+  E     E++            + V E ++DL+ KY+ G+ +   EL
Sbjct: 189 DLGTDILEEDIPEEYLEQAQEYREKLIEAVAETDEDLMMKYLEGEEITNDELIAGIRKAT  248
```

-continued

```
Query:  214 HNCSLFPVYHGSAKNNIGIDNLIEVI---------------TNKFYSSTHRGPSE----L  254
            N   FPV GSA N G+  +++ +                 N    +   P+
Sbjct:  249 INVEFFPVLCGSAFKNKGVQLMLDAVIAYLPSPLDIPAIKGVNPDTDAEEERPASDEEPF  308

Query:  255 CGNVFKIEYTKKRQRLAYIRLYSGVLHLRDSVRVSEKEKI----KVTEMYTSINGELCKI  310
            FKI        RL + R+YSGVL+    V  + K K       ++ +M+ +    E  I
Sbjct:  309 AALAPFKIMTDPFVGRLTFFRVYSGVLNSGSYVMNTSKGKRERIGRILQMHANSRQE---I  365

Query:  311 DRAYSGEIVILQN-EFLKLNSVLGDTKLLPQRKKIENPHPLLQTTVEPSKPEQREMLLDA  369
              + Y+G+I    +     L D K     + IE P P++Q  VEP      ++ +  A
Sbjct:  366 ETVYAGDIAAAVGLKDTTTGDSLTDEKAKVILESIEVPEPVIQLMVEPKSKADQDKMGVA  425

Query:  370 LLEISDSDPLLRYYVDSTTHEIILSFLGKVQMEVISALLQEKYHVEIELKEPTVIYME--  427
            L ++++ DP  R  +   T E +++ +G++ ++V+     ++ ++ VE  +  P V Y E
Sbjct:  426 LQKLAEEDPTFRVETNVETGETVIAGMGELHLDVLVDRMKREFKVEANVGAPQVSYRETF  485

Query:  428 RPLKNAEYTIHIEVPPNPFWASIGLSVSPLPLGSGMQYESSVSLGYLNQSFQNAVMEGIR  487
             R   A    +    + + +P     G G ++E+++   G + + F  AV +G+
Sbjct:  486 RASTQARGFFKRQSGGKGQFGDVWIEFTPNEEGKGFEFENAIVGGVVPREFIPAVEKGLI  545

Query:  488 YGCEQG-LYGWNVTDCKICFKYGLYYSPVSTPADFRMLAPIVLEQVLKKAGTELLEPYLS  546
                G L G+ + D K     G Y+   S+   F++ A + L++   K A    +LEP +
Sbjct:  546 ESMANGVLAGYPMVDVKAKLYDGSYHDVDSSETAFKIAASLALKEAAKSAQPAILEPMML  605

Query:  547 FKIYAPQEYLSRAYNDAPKYCANIVDTQLKNNEVILSGEIPARCIQEYRSDLTFFTNGRS  606
                I AP++  L                 +   + N  I+   +P   + Y + L    T GR
Sbjct:  606 VTITAPEDNLGDVMGHVTARRGRVDGMEAHGNSQIVRAYVPLAEMFGYATVLRSATQGRG  665

Query:  607 VCLTELKGY                                                    615
               +          Y
Sbjct:  666 TFMMVFDHY                                                    674
```

Based on this analysis, it was predicted that these proteins and their epitopes could be useful antigens for vaccines or diagnostics.

EXAMPLE 1356

A DNA sequence (GBSx1441) was identified in *S. agalactiae* <SEQ ID 4151> which encodes the amino acid sequence <SEQ ID 4152>. Analysis of this protein sequence reveals the following:

```
Possible site: 33
>>> Seems to have no N-terminal signal sequence

----- Final Results -----
         bacterial cytoplasm --- Certainty = 0.2530(Affirmative) < succ>
         bacterial membrane  --- Certainty = 0.0000(Not Clear)   < succ>
          bacterial outside  --- Certainty = 0.0000(Not Clear)   < succ>
```

No corresponding DNA sequence was identified in *S. pyogenes*.

Based on this analysis, it was predicted that this protein and its epitopes, could be useful antigens for vaccines or diagnostics.

EXAMPLE 1357

A DNA sequence (GBSx1442) was identified in *S. agalactiae* <SEQ ID 4153> which encodes the amino acid sequence <SEQ ID 4154>. Analysis of this protein sequence reveals the following:

```
Possible site: 18
>>> Seems to have no N-terminal signal sequence

----- Final Results -----
         bacterial membrane  --- Certainty = 0.0000(Not Clear)   < succ>
          bacterial outside  --- Certainty = 0.0000(Not Clear)   < succ>
         bacterial cytoplasm --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1358

A DNA sequence (GBSx1443) was identified in *S. agalactiae* <SEQ ID 4155> which encodes the amino acid sequence <SEQ ID 4156>. Analysis of this protein sequence reveals the following:

```
Possible site: 17
>>> Seems to have no N-terminal signal sequence

----- Final Results -----
            bacterial cytoplasm --- Certainty = 0.1630(Affirmative) < succ>
            bacterial membrane  --- Certainty = 0.0000(Not Clear)   < succ>
            bacterial outside   --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1359

A DNA sequence (GBSx1444) was identified in *S. agalactiae* <SEQ ID 4157> which encodes the amino acid sequence <SEQ ID 4158>. This protein is predicted to be excisionase-related protein. Analysis of this protein sequence reveals the following:

```
Possible site: 40
>>> Seems to have no N-terminal signal sequence

----- Final Results -----
            bacterial cytoplasm --- Certainty = 0.4481(Affirmative) < succ>
            bacterial membrane  --- Certainty = 0.0000(Not Clear)   < succ>
            bacterial outside   --- Certainty = 0.0000(Not Clear)   < succ>
```

The protein is similar to transposon Tn916 from *S. faecalis*. No corresponding DNA sequence was identified in *S. pyogenes*.

Based on this analysis, it was predicted that this protein and its epitopes, could be useful antigens for vaccines or diagnostics.

EXAMPLE 1360

A DNA sequence (GBSx1445) was identified in *S. agalactiae* <SEQ ID 4159> which encodes the amino acid sequence <SEQ ID 4160>. This protein is predicted to be transposase. Analysis of this protein sequence reveals the following:

```
Possible site: 46
>>> Seems to have no N-terminal signal sequence

----- Final Results -----
            bacterial cytoplasm --- Certainty = 0.4626(Affirmative) < succ>
            bacterial membrane  --- Certainty = 0.0000(Not Clear)   < succ>
            bacterial outside   --- Certainty = 0.0000(Not Clear)   < succ>
```

The protein is similar the Tn1545 integrase from *S. pneumoniae* and to SEQ ID 578.

Based on this analysis, it was predicted that this protein and its epitopes, could be useful antigens for vaccines or diagnostics.

EXAMPLE 1361

A DNA sequence (GBSx1446) was identified in *S. agalactiae* <SEQ ID 4161> which encodes the amino acid sequence <SEQ ID 4162>. Analysis of this protein sequence reveals the following:

```
Possible site: 26
>>> Seems to have an uncleavable N-term signal seq
        INTEGRAL    Likelihood = -10.72    Transmembrane    18-34 (13-41)
        INTEGRAL    Likelihood =  -6.10    Transmembrane    58-74 (55-79)
        INTEGRAL    Likelihood =  -5.04    Transmembrane    97-113 (90-116)
        INTEGRAL    Likelihood =  -1.81    Transmembrane    78-94 (78-94)
        INTEGRAL    Likelihood =  -0.85    Transmembrane    145-161 (145-161)

----- Final Results -----
            bacterial membrane  --- Certainty = 0.5288(Affirmative) < succ>
            bacterial outside   --- Certainty = 0.0000(Not Clear)   < succ>
            bacterial cytoplasm --- Certainty = 0.0000(Not Clear)   < succ>
```

The protein has homology with the following sequences in the GENPEPT database.

```
>GP: AAC74820 GB: AE000270 orf, hypothetical protein [Escherichia coli K12]
Identities = 43/174 (24%), Positives = 84/174 (47%), Gaps = 9/174 (5%)
Query:  24 LIATLVLVVYLYKL------GILNDSNELKDLVHKYEFWGPMIFIVAQIVQIVFPVIPGG   77
           L A L+ + +Y +       +L D  L+ L+ +  F+G  ++I+  I+  +  ++PG
Sbjct:  24 LFACLIFALVIYAIHAFGLFDLLTDLPHLQTLIRQSGFFGYSLYILLFIIATLL-LLPGS   82

Query:  78 VTTVAGFLIFGPTLGFIYNYIGIIIGSVILFWLVKFYGRKFVLLFM-DQKTFDKYESKLE  136
           +  +AG ++FGP LG + + I   + S   F L ++ GR  +L ++     TF   E  +
Sbjct:  83 ILVIAGGIVFGPLLGTLLSLIAATLASSCSFLLARWLGRDLLLKYVGHSNTFQAIEKGIA  142

Query: 137 TSGYEKFFIFCMASPISPADIMVMITGLSNMSIKRFVTIIMITKPISIIGYSYL        190
           +G + F I      P+ P +I      GL+ ++    +  I  +T    I+ Y+ +
Sbjct: 143 RNGID-FLILTRLIPLFPYNIQNYAYGLTTIAFWPYTLISALTTLPGIVIYTVM        195
```

A related DNA sequence was identified in *S. pyogenes* <SEQ ID 4163> which encodes the amino acid sequence <SEQ ID 4164>. Analysis of this protein sequence reveals the following:

```
Possible site: 43
>>> Seems to have an uncleavable N-term signal seq
        INTEGRAL    Likelihood = -4.30    Transmembrane    8-24 (6-29)
        INTEGRAL    Likelihood = -0.80    Transmembrane    57-73 (57-73)
        INTEGRAL    Likelihood = -0.00    Transmembrane    86-102 (86-102)

----- Final Results -----
            bacterial membrane  --- Certainty = 0.2720(Affirmative) < succ>
            bacterial outside   --- Certainty = 0.0000(Not Clear)   < succ>
            bacterial cytoplasm --- Certainty = 0.0000(Not Clear)   < succ>
```

The protein has no significant homology with any sequences in the GENPEPT database.

An alignment of the GAS and GBS proteins is shown below.

```
Identities = 85/114 (74%), Positives = 101/114 (88%)
Query:  89 PTLGFIYNYIGIIIGSVILFWLVKFYGRKFVLLFMDQKTFDKYESKLETSGYEKFFIFCM  148
           P  GFIYNY+GIIIGS+ LF LVK YGRKF+LLF++ KTF KYE +LET GYEK FIFCM
Sbjct:   3 PVTGFIYNYVGIIIGSIALFLLVKTYGRKFILLFVNDKTFYKYERRLETPGYEKLFIFCM   62

Query: 149 ASPISPADIMVMITGLSNMSIKRFVTIIMITKPISIIGYSYLWIYGGDILKNFL        202
           ASP+SPADIMVMITGL++MS+KRFVTI++ITKPISIIGYSYL+I+G D++   FL
Sbjct:  63 ASPVSPADIMVMITGLTDMSLKRFVTILLITKPISIIGYSYLFIFGKDVISWFL        116
```

There is also homology to SEQ ID 1728.

Based on this analysis, it was predicted that these proteins and their epitopes could be useful antigens for vaccines or diagnostics.

EXAMPLE 1362

A DNA sequence (GBSx1447) was identified in *S. agalactiae* <SEQ ID 4165> which encodes the amino acid sequence <SEQ ID 4166>. This protein is predicted to be chlorAM-Phenicol acetyltransferase (cat). Analysis of this protein sequence reveals the following:

```
Possible site: 28
>>> Seems to have no N-terminal signal sequence

----- Final Results -----
            bacterial cytoplasm --- Certainty = 0.4725(Affirmative) < succ>
             bacterial membrane --- Certainty = 0.0000(Not Clear)   < succ>
              bacterial outside --- Certainty = 0.0000(Not Clear)   < succ>
```

The protein has homology with the following sequences in the GENPEPT database.

```
>GP: AAA86871 GB: U19459 VAT B [Staphylococcus aureus]
Identities = 57/130 (43%), Positives = 81/130 (61%), Gaps = 4/130 (3%)
Query:  57 IGAFCSIAQNVT--ITGLNHPTDHITTNPFIYYKSRGFINEDRADLIDEKKNGKVIIGND  114
           IG FC+IA+ +   + G NH + ITT PF       G+ +    L D   G  ++GND
Sbjct:  65 IGKFCAIAEGIEFIMNGANHRMNSITTYPF-NIMGNGW-EKATPSLEDLPFKGDTVVGND  122

Query: 115 VWIGTNVTILPSVTIGNGAIIGAGSVITKDIPDYAVVAGTPAKIIKYRFSEEEITLLNAS  174
           VWIG NVT++P +  IG+GAI+ A SV+TKD+P Y ++ G P++IIK RF +E I   L
Sbjct: 123 VWIGQNVTVMPGIQIGDGAIVAANSVVTKDVPPYRIIGGNPSRIIKKRFEDELIDYLLQI  182

Query: 175 QWWNWSDEAI                                                   184
           +WW+WS + I
Sbjct: 183 KWWDWSAQKI                                                   192
```

There is also homology to SEQ ID 1944.

Based on this analysis, it was predicted that this protein and its epitopes, could be useful antigens for vaccines or diagnostics.

EXAMPLE 1363

A DNA sequence (GBSx1448) was identified in *S. agalactiae* <SEQ ID 4167> which encodes the amino acid sequence <SEQ ID 4168>. Analysis of this protein sequence reveals the following:

```
Possible site: 39
>>> Seems to have no N-terminal signal sequence

----- Final Results -----
            bacterial cytoplasm --- Certainty = 0.2398(Affirmative) < succ>
             bacterial membrane --- Certainty = 0.0000(Not Clear)   < succ>
              bacterial outside --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1364

A DNA sequence (GBSx1449) was identified in *S. agalactiae* <SEQ ID 4169> which encodes the amino acid sequence <SEQ ID 4170>. This protein is predicted to be cation-transporting P-ATPase PacL. Analysis of this protein sequence reveals the following:

```
Possible site: 34
>>> Seems to have no N-terminal signal sequence
     INTEGRAL    Likelihood = -9.18    Transmembrane    873-889 (866-894)
```

```
                     -continued
INTEGRAL      Likelihood = -8.39    Transmembrane    257-273  (251-276)
INTEGRAL      Likelihood = -5.95    Transmembrane     67-83   (65-88)
INTEGRAL      Likelihood = -5.41    Transmembrane    282-298  (281-301)
INTEGRAL      Likelihood = -1.65    Transmembrane     90-106  (89-107)
INTEGRAL      Likelihood = -0.48    Transmembrane    737-753  (736-753)
INTEGRAL      Likelihood = -0.00    Transmembrane    898-914  (898-914)

----- Final Results -----
              bacterial membrane  --- Certainty = 0.4673(Affirmative)  < succ>
              bacterial outside   --- Certainty = 0.0000(Not Clear)    < succ>
              bacterial cytoplasm --- Certainty = 0.0000(Not Clear)    < succ>
```

A related GBS nucleic acid sequence <SEQ ID 10963> which encodes amino acid sequence <SEQ ID 10964> was also identified.

The protein has homology with the following sequences in the GENPEPT database.

```
>GP: AAB85991 GB: AE000912 cation-transporting P-ATPase PacL
[Methanothermobacter thermoautotrophicus]
Identities = 409/922 (44%), Positives = 609/922 (65%),
Gaps = 22/922 (2%)

Query:   10 TNTRFAKEELEEVFEELGTTQGGLSDEEVAVRQKKYGLNLLSEVKQESIILLFLKNFTSL   69
            T T  + E+EEV + L T++ GL  +E   R K +G N L EVK+  +ILLFL N  ++
Sbjct:    4 TMTAIYELEVEEVLQRLETSESGLDPQEAEKRLKIHGPNKLEEVKRRPLILLFLSNLYNV   63

Query:   70 MAILLWVGGFVAIVSNSLELGLAIWMVNVINGIFSFIQEYRASQATQALEKMLPSYSRVL  129
            +A+LLW+    ++ ++ +L +AI MV +IN +FSF QEY A +A +AL+ +LP    +V+
Sbjct:   64 LALLLWIAAILSFITGNYQLAVAIVMVIIINALFSFWQEYEAEKAAEALKNILPVMVKI  123

Query:  130 RKGSEEKILSEQLVPGDIVLIEEGDRISADGRLIKTTDLQVNQSALTGESNPIYKDSNVE  189
            R   E  I +   +V GDI+++EEGD + AD R++++ +L+V+ SALTGES P+ K S+
Sbjct:  124 RASKEVLIPAADVVHGDIIILEEGDTVPADARILESHNLRVDASALTGESKPVRKVSHPV  183

Query:  190 NDQSKTLIECDNMVFAGTTVSSGSATMVVTAIGMQTQFGQIADLTQGMKSEKSPLQRELD  249
             + +     I+  +N++FAGT V+SG+   V A G  T+F +IA LTQ ++ E SPLQR++
Sbjct:  184 RE-ADNYIDTENILFAGTQVTSGTGRAAVFATGRDTEFSRIATLTQEVREEPSPLQRQIS  242

Query:  250 RLTKQISIISITVGIIFFLAATFFVKEPVSKSFIFALGMIVAFIPEGLLPTVTLSLAMAV  309
             + I   +++ +G+I FL    + V+  P+   +FIFA+G++VA +PEGLLP+VTLSLA +
Sbjct:  243 LAARIIGALAVAMGVILFLVNLYIVRLPLETAFIFAIGLMVANVPEGLLPSVTLSLAASA  302

Query:  310 QRMAKEHALVKKLSSVETLGATSVICSDKTGTLTQNEMTVNHLWQNGKSYQVTGLGYAPE  369
             ++MA+E+ALVK+LSSVETLG+T++IC+DKTGTLT+ EMTV  +W  K  +VTG GY PE
Sbjct:  303 RKMARENALVKRLSSVETLGSTTIICTDKTGTLTRGEMTVRKIWIPHKVIEVTGSGYRPE  362

Query:  370 GQILFEGDNICFGNSDRGDLEKLIRFAHLCSNAQVLPPNDDRSTYTVLGDPTEACLNVLL  429
            GQ LF G+ +     + D +L+ L+R A  C+++ ++        ++VLGD TE  L V
Sbjct:  363 GQFLFRGEPV--SHRDMAELKLLMRAATFCNDSALI---HEEGEWSVLGDSTEGALLVAA  417

Query:  430 EKSGINIQENRKFAPRLKELPFDSVRKRMTTIHSLGGDEKDKKISITKGAPKEILDLSDY  489
            EK G + +   K  PR+ ELPFDS RK MT+IH  G     K+++  KGAPK+I+ LS+
Sbjct:  418 EKLGFDAEAELKAMPRITELPFDSRRKSMTSIHEKSG----KRVAYVKGAPKKIIGLSER  473

Query:  490 VLSDGKVIPLNKEERNKIQLANDTFAKDGLRVLAVSYCDIEGFSKEQWTQENLEQHMVFI  549
             +  DG+V  L+ +E+ +I  +D A   GLRVLA +Y ++    E     +E+ +V +
Sbjct:  474 ISVDGRVRALHADEKERIIGIHDEMASKGLRVLAFAYRELPE-DLEVRDPGEVERDLVLV  532

Query:  550 GLIAMSDPPREGVREAIDKCHAASIRIIMVTGDYGLTALSIAKNIGIIRNDDAKVISGLE  609
            G+ AM DPPREGV+EA++ C  A IRIIM+TGDYGLTA +IA+ IGI+     ++I G E
Sbjct:  533 GMAAMHDPPREGVKEAVEHCKTAGIRIIMITGDYGLTAEAIAREIGIVEG-ECRIIKGKE  591

Query:  610 LSEMTDSQLKKELSGE--VVFARVAPEQKYRVVTILQEMGEVVAVTGDGVNDAPALKKSD  667
            L  ++ D++L+  L+ E  ++FAR  PE K R+ ++L++  E+VA+TGDGVNDAPAL+K+D
Sbjct:  592 LDKLKDTELRGILARERNLIFARAVPEHKMRIASVLEDSDEIVAMTGDGVNDAPALRKAD  651

Query:  668 IGVAMGVTGTDVAKESADMILTDDHFASIVHAVEEGRAVYQNIKKFLTYIFNSNTPEAVP  727
            IGVAMG +GTDVAKE+AD++ TDD+FASIV AV EGR VY+NI+KF+TYIF+  T E VP
Sbjct:  652 IGVAMG-SGTDVAKEAADIVLADDNFASIVTAVREGRTVYENIRKFITYIFSHETAEIVP  710

Query:  728 SAFFLFSKGFIPLPLTVMQILAVDLGTDMLPALGLGVEPPETDVMNRPPRRLTDRLLDKG  787
             +FF +  GF IPLP+T+MQILA+DLGTD LPAL LG   PE+DVM  PPR  ++RLL++
Sbjct:  711 --FIMMVLFSIPLPITIMQILAIDLGTDTLPALALGRSLPESDVMKLPPRAPSERLLNRE  768

Query:  788 LLIKSFLWYGTIESVLAMGGFFWAHYLRYGNF---TFFVANGIPYREATTMTLGAIIFSQ  844
             ++++ +L+ GTIE+ L M  +F  Y   G +     A+  Y  ATT+   +I+ +Q
Sbjct:  769 VILRGYLFTGTIEAALIMAAYFLVLY--SGGWLPGQELSASDPLYMRATTVVFAGIVMAQ  826
```

```
Query:  845 IGMVMNSRTSYQSIKALSIFGNKLINFGIIMEILAFLVLVYVPLFHNLFNTASLGLSHWL  904
            +G  +++S+T   S       +  N+ I  G++  I    L+++Y+P    +F  TA  G+   W
Sbjct:  827 LGNLLSSQTLRSSALEAGLLRNRWILAGMVFAISVMLLVIYLPPLQPIFGTAPPGILEWF  886

Query:  905 YLISCPFIMIGLDEVRKLFSSR                                       926
            LI      I+   DE+RK     R
Sbjct:  887 ILILFTPIVFLTDEMRKFIQRR                                       908
```

There is also homology to SEQ ID 4172.

Based on this analysis, it was predicted that these proteins and their epitopes could be useful antigens for vaccines or diagnostics.

EXAMPLE 1365

A DNA sequence (GBSx1450) was identified in *S. agalactiae* <SEQ ID 4173> which encodes the amino acid sequence <SEQ ID 4174>. Analysis of this protein sequence reveals the following:

```
Possible site: 25
>>> Seems to have no N-terminal signal sequence

----- Final Results -----
            bacterial cytoplasm --- Certainty = 0.3740(Affirmative) < succ>
             bacterial membrane --- Certainty = 0.0000(Not Clear)   < succ>
              bacterial outside --- Certainty = 0.0000(Not Clear)   < succ>
```

The protein has homology with the following sequences in the GENPEPT database.

```
>GP: CAB46979 GB: AJ243482 CSRA protein [Enterococcus faecalis]
Identities = 85/132 (64%), Positives = 105/132 (79%)

Query:    2 KETQEELRQRIGHTAYQVTQNSATEHAFTGKYDDFFEEGIYVDIVSGEVLFSSLDKFQSG   61
            K T+EEL+Q +     Y VTQ +ATE   F+G+YDDF+++GIYVDIVSGE LFSSLDK+ +G
Sbjct:    3 KPTEEELKQTLTDLQYAVTQENATERPFSGEYDDFYQDGIYVDIVSGEPLFSSLDKYDAG   62

Query:   62 CGWPAFSKPIENRMVTNHQDHSHGMHRIEVRSRQADSHLGHVFNDGPVDAGGLRYCINSA  121
            CGWP+F+KPIE R V    D SHGMHR+EVRS++ADSHLGHVF DGP+  GGLRYCIN+A
Sbjct:   63 CGWPSFTKPIEKRGVKEKADFSHGMHRVEVRSQEADSHLGHVFTDGPLQEGGLRYCINAA  122

Query:  122 ALDFIPYDQMAK                                                 133
            AL F+P   + K
Sbjct:  123 ALRFVPVADLEK                                                 134
```

A related DNA sequence was identified in *S. pyogenes* <SEQ ID 4175> which encodes the amino acid sequence <SEQ ID 4176>. Analysis of this protein sequence reveals the following:

```
Possible site: 24
>>> Seems to have no N-terminal signal sequence

----- Final Results -----
            bacterial cytoplasm --- Certainty = 0.3692(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below.

```
Identities = 109/142 (76%), Positives = 126/142 (87%)

Query:    3 ETQEELRQRIGHTAYQVTQNSATEHAFTGKYDDFFEEGIYVDIVSGEVLFSSLDKFQSGC   62
            ET +EL+QRIG  +Y+VTQ++ATE   FTG+YD+FFE+GIYVDIVSGEVLFSSLDKF SGC
Sbjct:    2 ETSDELKQRIGDLSYEVTQHAATESPFTGEYDNFFEKGIYVDIVSGEVLFSSLDKFNSGC   61
```

```
                        -continued
Query:   63 GWPAFSKPIENRMVTNHQDHSGMHRIEVRSRQADSHLGHVFNDGPVDAGGLRYCINSAA  122
            GWPAFSKPIENRMVTNH D S+GM R+EV+SR+A SHLGHVF+DGP +AGGLRYCINSAA
Sbjct:   62 GWPAFSKPIENRMVTNHDDSSYGMRRVEVKSREAGSHLGHVFSDGPKEAGGLRYCINSAA  121

Query:  123 LDFIPYDQMAKRGYGDYLSLFD                                       144
            L FIPYDQM K GY   +L+LFD
Sbjct:  122 LKFIPYDQMEKEGYAQWLTLFD                                       143
```

Based on this analysis, it was predicted that these proteins and their epitopes could be useful antigens for vaccines or diagnostics.

EXAMPLE 1366

A DNA sequence (GBSx1451) was identified in *S. agalactiae* <SEQ ID 4177> which encodes the amino acid sequence <SEQ ID 4178>. Analysis of this protein sequence reveals the following:

```
Possible site: 25
>>> Seems to have no N-terminal signal sequence

----- Final Results -----
            bacterial cytoplasm --- Certainty = 0.1674(Affirmative) < succ>
             bacterial membrane --- Certainty = 0.0000(Not Clear)   < succ>
              bacterial outside --- Certainty = 0.0000(Not Clear)   < succ>
```

The protein has homology with the following sequences in the GENPEPT database.

```
>GP: BAB05127 GB: AP001511 unknown [Bacillus halodurans]
Identities = 48/152 (31%), Positives = 77/152 (50%),
Gaps = 1/152 (0%)

Query:    1 MIRRAKEKDLPDIAELLKQILMLHHEVRPDIFHTRGSKFSKEQLKEMLIDESKPIFVYES   60
            +IR A  +D  ++A L  Q+   H + R DIF +       +    +  E   + V+
Sbjct:    2 IIREATVQDYEEVARLHTQVHEAHVKERGDIFRSNEPTLNPSFFQAAVQGEKSTVLVFVD   61

Query:   61 DEGKVVAHLFLQLQEKRDLPR-KSFKTLYIDDLCIDEEVRGQQIGQKLMDFARQYAKKHG  119
             +  K+ A+  +L +    LP  + KT+YI DLC+DE   RG  IG+ + +      Y K H
Sbjct:   62 EREKIGAYSVIHLVQTPLLPTMQQRKTVYISDLCVDETRRGGGIGRLIFEAIISYGKAHQ  121

Query:  120 CYNITLNVWNDNQRAVSFYEKLGFKPQQTQME                             151
             I  L+V++ N RA +FY  LG + Q+  ME
Sbjct:  122 VDAIELDVYDFNDRAKAFYHSLGMRCQKQTME                             153
```

No corresponding DNA sequence was identified in *S. pyogenes*.

Based on this analysis, it was predicted that this protein and its epitopes, could be useful antigens for vaccines or diagnostics.

EXAMPLE 1367

A DNA sequence (GBSx1452) was identified in *S. agalactiae* <SEQ ID 4179> which encodes the amino acid sequence <SEQ ID 4180>. Analysis of this protein sequence reveals the following:

```
Possible site: 52
>>> Seems to have no N-terminal signal sequence

----- Final Results -----
            bacterial cytoplasm --- Certainty = 0.3285(Affirmative) < succ>
             bacterial membrane --- Certainty = 0.0000(Not Clear)   < succ>
              bacterial outside --- Certainty = 0.0000(Not Clear)   < succ>
```

A related GBS nucleic acid sequence <SEQ ID 9785> which encodes amino acid sequence <SEQ ID 9786> was also identified.

The protein has homology with the following sequences in the GENPEPT database.

```
>GP: BAB06554 GB: P001516 unknown conserved protein [Bacillus halodurans]
Identities = 108/211 (51%), Positives = 149/211 (70%)

Query:    7 EDVILNATENMVHHKLKNDPSGHDWFHIVRVRNLAVELAHKEGANTFICQMAALLHDIID    66
            E  IL + E  V  +L ++ SGHDW+HI RV  +A  +  +E  + F+ Q+AAL HD+ID
Sbjct:    3 EQAILQSAEAWVKKQLMDEYSGHDWYHIRRVTLMAKAIGEQEKVDVFVVQIAALFHDLID    62

Query:   67 DKICQDSKQASYELTQWLYSQDLAIAEVEHILDILENISFKAGTGLTMKTLEGQIVQDAD   126
            DK+  D + A  +L  W+ +  +   +++H +DI+   ISFK G G ++ T E  +VQDAD
Sbjct:   63 DKLVDDPETAKQQLIDWMEAAGVPSQKIDHTMDIINTISFKGGHGQSLATREAMVVQDAD   122

Query:  127 RLDAMGAIGIARTMAYSGSKGRLIHDPNLKPRENLTLEEYRNGQDTAIIHFYEKLLKLKD   186
            RLDA+GAIGIART AYSG+KG+ I+DP L  RE +T+EEYR+G+ TAI HFYEKL KLKD
Sbjct:  123 RLDALGAIGIARTFAYSGNKGQPIYDPELPIRETMTVEEYRHGKSTAINHFYEKLFKLKD   182

Query:  187 LMNTKQGKMLAQKRHDFLELYLAEFYAEWNG                              217
            LMNT+ GK LA++RH F+E ++  F +EWNG
Sbjct:  183 LMNTETGKQLAKERHVFMEQFIERFLSEWNG                              213
```

No corresponding DNA sequence was identified in *S. pyogenes*.

Based on this analysis, it was predicted that these proteins and their epitopes could be useful antigens for vaccines or diagnostics.

EXAMPLE 1368

A DNA sequence (GBSx1453) was identified in *S. agalactiae* <SEQ ID 4181> which encodes the amino acid sequence <SEQ ID 4182>. Analysis of this protein sequence reveals the following:

```
Possible site: 21
>>> May be a lipoprotein

----- Final Results -----
           bacterial membrane --- Certainty = 0.0000(Not Clear) < succ>
           bacterial outside  --- Certainty = 0.0000(Not Clear) < succ>
           bacterial cytoplasm Certainty = 0.0000(Not Clear) < succ>
```

The protein has homology with the following sequences in the GENPEPT database.

```
!GB: U25448 internalin [Listeria monocytogenes]
!GB: U25448 internalin [Listeria monocytogenes]
!GB: U25448 internalin [Listeria monocytogenes]
!GB: U25448 internalin [Listeria monocytogenes]
>GP: AAA69530 GB: U25448 internalin [Listeria monocytogenes]
Identities = 78/253 (30%), Positives = 132/253 (51%), Gaps = 2/253 (0%)

Query:  531 LKQLWMTNTGITDYSFLDKMPLLEGLDISQNGIKDLSFLTKYKQLSLIAAANNGITSLKP   590
            L Q+  +N  +TD + L  +  L  +++ N I D++ L      L+ +   NN IT + P
Sbjct:   26 LTQINFSNNQLTDITPLKDLTKLVDILMNNNQIADITPLANLSNLTGLTLFNNQITDIDP    85

Query:  591 LAELPNLQFLVLSHNNISDLTPLSNLTKLQELYLDHNNVKNLSALSGKKDLKVLDLSNNK   650
            L   L NL  L LS N ISD++ LS LT LQ+L L   N V +L  L+      L+ LD+S+NK
Sbjct:   86 LKNLTNLNRLELSSNTISDISALSGLTSLQQLSLG-NQVTDLKPLANLTTLERLDISSNK   144

Query:  651 SADLSTL-KTTSLETLLLNETNTSNLSFLKQNPKVSNLTINNAKLASLDGIEESDEIVKV   709
            +D+S L K T+LE+L+       S+++ L   + L++N +L +  +       +  +
Sbjct:  145 VSDISVLAKLTNLESLIATNNQISDITPLGILTNLDELSLNGNQLKDIGTLASLTNLTDL   204

Query:  710 EAEGNQIKSLVLKNKQGSLKFLNVTNNQLTSLEGVNNYTSLETLSVSKNKLESLDIKTPN   769
                +  NQI +L      L  L +  NQ++++       T+L  L +++N+LE +    +
Sbjct:  205 DLANNQISNLAPLPGLTKLTELKLGANQISNIXPLAGLTALTNLELNENQLEDISPISNL   264
```

-continued

```
Query: 770 KTVTNLDFSHNNV                                              782
            K +T L    NN+
Sbjct: 265 KNLTYLTLYFNNI                                               277

Identities = 91/300 (30%), Positives = 141/300 (46%), Gaps = 42/300 (14%)

Query: 519 INDMTPVLQFKKLKQLWMTNTGITDYSFLDKMPLLEGLDISQNGIKD---LSFLTKYKQL 575
            I D+TP+      L  L +N ITD  L + L  L++S N ID   LS LT  +QL
Sbjct:  58 IADITPLANLSNLTGLTLFNNQITDIDPLKNLTNLNRLELSSNTISDISALSGLTSLQQL 117

Query: 576 SLIAAANNGITSLKPLA---------------------ELPNLQFLVLSHNNISDLTPL 613
            SL    N +T LKPLA                     +L NL+ L+ ++N ISD+TPL
Sbjct: 118 SL----GNQVTDLKPLANLTTLERLDISSNKVSDISVLAKLTNLESLIATNNQISDITPL 173

Query: 614 SNLTKLQELYLDHNNVKNLSALSGKKDLKVLDLSNNKSADLSTLK-TTSLETLLLNETNT 672
            + LT L EL L+ N +K++  L+   +L LDL+NN+ ++L  L   T L  L L
Sbjct: 174 GILTNLDELSLNGNQLKDIGTLASLTNLTDLDLANNQISNLAPLPGLTKLTELKLGANQI 233

Query: 673 SNLSFLKQNPKVSNLTINNAKLASLDGIEESDEIVKVEAEGNQIKSLVLKNKQGSLKFLN 732
            SN+  L    ++NL +N +L + I    + +    N I +  +        L+ L
Sbjct: 234 SNIXPLAGLTALTNLELNENQLEDISPISNLKNLTYLTLYFNNISDISPVSSLTKLQRLF 293

Query: 733 VTNNQLTSLEGVNNYTSLETLSVSKNKLESLDIKTPNKTVTNLDFSHNNVPTSQLKLNEK 792
            NN+++ +   +N T++   LS  N++  L   TP   +T +           +QL LN++
Sbjct: 294 FYNNKVSDVSSLANLTNINWLSAGHNQISDL---TPLANLTRI---------TQLGLNDQ 341

Identities = 73/253 (28%), Positives = 124/253 (48%), Gaps = 4/253 (1%)

Query: 540 GITDYSFLDKMPLLEGLDISQNGIKDLSFLTKYKQLSLIAAANNGITSLKPLAELPNLQF 599
            GI     L+ +  L ++ S N +D++  L   +L  I   NN I + PLA L NL
Sbjct:  13 GIKSIDGLEYLNNLTQINFSNNQLTDITPLKDLTKLVDILMNNNQIADITPLANLSNLTG  72

Query: 600 LVLSHNNISDLTPLSNLTKLQELYLDHNNVKNLSALSGKKDLKVLDLSNNKSADLSTLKT 659
            L L +N I+D+ PL NLT L  L L  N  ++SALSG    L+ L L N  +
Sbjct:  73 LTLFNNQITDIDPLKNLTNLNRLELSSNTISDISALSGLTSLQQLSLGNQVTDLKPLANL 132

Query: 660 TSLETLLLNETNTSNLSFLKQNPKVSNLTINNAKLASLDGIEESDEIVKVEAEGNQIKSL 719
            T+LE L ++      S++S L +  + L    N +++  +   +    +   GNQ+K +
Sbjct: 133 TTLERLDISSNKVSDISVLAKLTNLESLIATNNQISDITPGILTNLDELSLNGNQLKDI 192

Query: 720 VLKNKQGSLKFLNVTNNQLTSLEGVNNYTSLETLSVSKNKLESLDIKTPNKTVTNLDFSH 779
            +L  L++ NNQ+++L +    T L  L +   N++ ++       +TNL+   +
Sbjct: 193 GTLASLTNLTDLDLANNQISNLAPLPGLTKLTELKLGANQISNIXPLAGLTALTNLELNE 252

Query: 780 NNV----PTSQLK                                               788
            N +     P S LK
Sbjct: 253 NQLEDISPISNLK                                               265

Identities = 56/209 (26%), Positives = 115/209 (54%), Gaps = 2/209 (0%)

Query: 575 LSLIAAANNGITSLKPLAELPNLQFLVLSHNNISDLTPLSNLTKLQELYLDHNNVKNLSA 634
            ++ + A   GI S+  L  L NL + S+N ++D+TPL +LTKL ++ +++N + +++
Sbjct:   4 VTTLQADRLGIKSIDGLEYLNNLTQINFSNNQLTDITPLKDLTKLVDILMNNNQIADITP  63

Query: 635 LSGKKDLKVLDLSNNKSADLSTLKT-TSLETLLLNETNTSNLSFLKQNPKVSNLTINNAK 693
            L+  +L  L L NN+ D+  LK  T+L  L L+   S++S L    + L++  N +
Sbjct:  64 LANLSNLTGLTLFNNQITDIDPLKNLTNLNRLELSSNTISDISALSGLTSLQQLSLGN-Q 122

Query: 694 LASLDGIEESDEIVKVEAEGNQIKSLVLKNKQGSLKFLNVTNNQLTSLEGVNNYTSLETL 753
            + L +     +  +++      N++ +    +   K  +L+  L  TNNQ++ +   +   T+L+ L
Sbjct: 123 VTDLKPLANLTTLERLDISSNKVSDISVLAKLTNLESLIATNNQISDITPLGILTNLDEL 182

Query: 754 SVSKNKLESLDIKTPNKTVTNLDFSHNNV                               782
            S++ N+L+ +          +T+LD ++N +
Sbjct: 183 SLNGNQLKDIGTLASLTNLTDLDLANNQI                               211

Identities = 61/228 (26%), Positives = 118/228 (51%), Gaps = 3/228 (1%)

Query: 483 LATVTKINIGQRTNPFQRFGLSLMPNIEVLGIGFTPINDMTPVLQFKKLKQLWMTNTGIT 542
            L ++ ++++G +     +   L+ +  +E L I    ++D++  +  +   L+ L TN I+
Sbjct: 111 LTSLQQLSLGNQVTDLKP--LANLTTLERLDISSNKVSDISVLAKLTNLESLIATNNQIS 168

Query: 543 DYSFLDKMPLLEGLDISQNGIKDLSFLTKYKQLSLIAAANNGITSLKPLAELPNLQFLVL 602
            D + L + L+ L ++ N +KD+   L   L+    ANN I++L PL  L  L  L LL
Sbjct: 169 DITPLGILTNLDELSLNGNQLKDIGTLASLTNLTDLDLANNQISNLAPLPGLTKLTELKL 228

Query: 603 SHNNISDLTPLSNLTKLQELYLDHNNVKNLSALSGKKDLKVLDLSNNKSADLSTLKT-TS 661
              N  +S++  PL+ LT  L  L+ N  ++++S  +S K+L   L L N  +D+S  + + T
Sbjct: 229 GANQISNIXPLAGLTALTNLELNENQLEDISPISNLKNLTYLTLYFNNISDISPVSSLTK 288
```

-continued

```
Query:  662 LETLLLLNETNTSNLSFLKQNPKVSNLTINNAKLASLDGIEESDEIVKV      709
            L+ L      S++S L     ++ L+ + +++ L +     I ++
Sbjct:  289 LQRLFFYNNKVSDVSSLANLTNINWLSAGHNQISDLTPLANLTRITQL      336

Identities = 60/286 (20%), Positives = 129/286 (44%), Gaps = 24/286 (8%)

Query:  369 SNKLSDEDQKKLIYLAEKLGLNPNQIEVLTSEDGSIIFKYPHDDHSHTIASKDIEIGKPI  428
            +N+++D D  K +    +L L+ N I  +++ G               + + + +G  +
Sbjct:   77 NNQITDIDPLKNLTNLNRLELSSNTISDISALSG-------------LTSLQQLSLGNQV  123

Query:  429 PDGHHDHSHAKDKVGMATLKQIGFDDEIIQDILHADAPTPFPSNETNPEKMRQW--LATV  486
            D         K   + TL+++       + DI   T  S       ++       L  +
Sbjct:  124 TD-------LKPLANLTTLERLDISSNKVSDISVLAKLTNLESLIATNNQISDITPLGIL  176

Query:  487 TKIN-IGQRTNPFQRFG-LSLMPNIEVLGIGFTPINDMTPVLQFKKLKQLWMTNTGITDY  544
            T ++ +     N  +   G L+ + N+   L +     I+++ P+     KL  +L +        I++
Sbjct:  177 TNLDELSLNGNQLKDIGTLASLTNLTDLDLANNQISNLAPLPGLTKLTELKLGANQISNI  236

Query:  545 SFLDKMPLLEGLDISQNGIKDLSFLTKYKQLSLIAAANNGITSLKPLAELPNLQFLVLSH  604
                L  + L    L++++N ++D+S ++    K L+ +      N I+ + P++ L  LQ L   +
Sbjct:  237 XPLAGLTALTNLELNENQLEDISPISNLKNLTYLTLYFNNISDISPVSSLTKLQRLFFYN  296

Query:  605 NNISDLTPLSNLTKLQELYLDHNNVKNLSALSGKKDLKVLDLSNNK               650
            N +SD++ L+NLT +  L    HN + +L+ L+     +   L L++ +
Sbjct:  297 NKVSDVSSLANLTNINWLSAGHNQISDLTPLANLTRITQLGLNDQE               342
```

A related DNA sequence was identified in *S. pyogenes* <SEQ ID 4183> which encodes the amino acid sequence <SEQ ID 4184>. Analysis of this protein sequence reveals the following:

```
Possible site: 21
>>> May be a lipoprotein

----- Final Results -----
            bacterial membrane  --- Certainty = 0.000(Not Clear) < succ>
            bacterial outside   --- Certainty = 0.0000(Not Clear) < succ>
           bacterial cytoplasm  --- Certainty = 0.0000(Not Clear) < succ>
```

The protein has homology with the following sequences in the databases:

```
>GP: AAA69530 GB: U25448 internalin [Listeria monocytogenes]
Identities = 88/279 (31%), Positives = 149/279 (52%), Gaps = 2/279 (0%)

Query:  419 LPNLETLGIGFTPIKDISPVLQFKKLKQLLMTKTGVTDYRFLDNMPQLEGIDISQNNLKD  478
            L + TL      IK I  +       L Q+  +   +TD    L ++ +L   I ++ N  + D
Sbjct:    1 LDXVTTLQADRLGIKSIDGLEYLNNLTQINFSNNQLTDITPLKDLTKLVDILMNNNQIAD   60

Query:  479 ISFLSKYKNLTLVAAADNGIEDIRPLGQLPNLKFLVLSNNKISDLSPLASLHQLQELHID  538
            I+ L+    NLT +    +N I DI PL  L NL  L LS+N ISD+S L+ L  LQ+L +
Sbjct:   61 ITPLANLSNLTGLTLFNNQITDIDPLKNLTNLNRLELSSNTISDISALSGLTSLQQLSL-  119

Query:  539 NNQITDLSPVSHKESLTVVDLSRNADVDLATL-QAPKLETLMVNDTKVSHLDFLKNNPNL  597
            NQ+TDL P+++  +L  +D+S N   D++ L +    LE+L+  +  ++S + L      NL
Sbjct:  120 GNQVTDLKPLANLTTLERLDISSNKVSDISVLAKLTNLESLIATNNQISDITPLGILTNL  179

Query:  598 SSLSINRAQLQSLEGIEASSVIVRVEAEGNQIKSLVLKDKQGSLTFLDVTGNQLTSLEGV  657
            LS+N  QL+ +  + + +  ++      NQI +L          LT L +  NQ++++     +
Sbjct:  180 DELSLNGNQLKDIGTLASLTNLTDLDLANNQISNLAPLPGLTKLTELKLGANQISNIXPL  239

Query:  658 NNFTALDILSVSKNQLTNVNLSKPNKTVTNIDISHNNIS                     696
               TAL  L +++NQL +++     K T + +  NNIS
Sbjct:  240 AGLTALTNLELNENQLEDISPISNLKNLTYLTLYFNNIS                     278
```

An alignment of the GAS and GBS proteins is shown below.

```
Identities = 346/753 (45%), Positives = 472/753 (61%), Gaps = 63/753 (8%)

Query:  187 SRLGNQSNSHYRVNSSK--------IAGLHYPTSNGFLFNGRG-IKGTTPTGILVEHHNH  237
            SR G  SN    + SK          +AG+ +PT +GF+          I   T GI+V+H  H
Sbjct:   38 SRKGMTSNKIKPIKKSKKTNKTHKGVAGVDFPTDDGFILTKDSKILSKTDQGIVVDHDGH   97
```

-continued

```
Query:  238 LHFISFADLRKGGW------GSIADRYQPQKKADSKKQSPSSKKPRTENTLPKDI--KDK  289
            HFI +ADL+    +      G+   +    ++A S+  S  +         P DI  +D
Sbjct:   98 SHFIFYADLKGSPFEYLIPKGASLAKPAVAQRAASQGTSKVADPHHHYEFNPADIVAEDA  157

Query:  290 LAYLARE---LHLDI---------------------SRIRVLKTLNGEIGFEYPHDDHT  324
              L Y R    H +                       S +    T NG  G  +P  D
Sbjct:  158 LGYTVRHDDHFHYILKSSLSGQTQAQAKQVATRLPQTSSLVSTATANGIPGLHFPTSDGF  217

Query:  325 HVIMAKDIDLSKPIPNPHHDDEDH-------------HKGHHHD---ESDHKHEEHEHTK  368
             + ++K      HD H              H   +D   +++   E H+  +
Sbjct:  218 QFNGQGIVGVTKDSILVDHDGHLHPISFADLRQGGWAHVADQYDPAKKAEKPAETHQTPE  277

Query:  369 SNKLSDEDQKKLIYLAEKLGLNPNQIEVLTSEDGSIIFKYPHDDHSHTIASKDIEIGKPI  428
                ++   E Q+KL YLAEKLG++P+ I+ +  ++DG  +  +YPH DH+H  +    DIEIGK I
Sbjct:  278 LSEREKEYQEKLAYLAEKLGIDPSTIKRVETQDGKLGLEYPHHDHAHVLMLSDIEIGKDI  337

Query:  429 PDGH---HDHSHAKDKVGMATLKQIGFDDEIIQDILHA-DAPTPFPSNETNPEKMRQWLA  484
            PD H    H       K KVGM TL+ +GFD+E+I DI+   DAPTPFPSNE +P  M++WLA
Sbjct:  338 PDPHAIEHARELEKHKVGMDTLRALGFDEEVILDIVRTHDAPTPFPSNEKDPNMMKEWLA  397

Query:  485 TVTKINIGQRTNPFQRFGLSLMPNIEVLGIGFTPINDMTPVLQFKKLKQLWMTNTGITDY  544
            TV K+++G R +P QR GLSL+PN+E LGIGFTPI D++PVLQFKKLKQL MT TG+TDY
Sbjct:  398 TVIKLDLGSRKDPLQRKGLSLLPNLETLGIGFTPIKDISPVLQFKKLKQLLMTKTGVTDY  457

Query:  545 SFLDKMPLLEGLDISQNGIKDLSFLTKYKQLSLIAAANNGITSLKPLAELPNLQFLVLSH  604
              FLD MP  LEG+DISQN +KD+SFL+KYK L+L+AAA+NGI ++PL +LPNL+FLVLS+
Sbjct:  458 RFLDNMPQLEGIDISQNNLKDISFLSKYKNLTLVAAADNGIEDIRPLGQLPNLKFLVLSN  517

Query:  605 NNISDLTPLSNLTKLQELYLDHNNVKNLSALSGKKDLKVLDLSNNKSADLSTLKTTSLET  664
            N ISDL+PL++L +LQEL++D+N +  +LS +S K+ L V+DLS N    DL+TL+   LET
Sbjct:  518 NKISDLSPLASLHQLQELHIDNNQITDLSPVSHKESLTVVDLSRNADVDLATLQAPKLET  577

Query:  665 LLLNETNTSNLSFLKQNPKVSNLTINNAKLASLDGIEESDEIVKVEAEGNQIKSLVLKNK  724
            L++N+T  S+L FLK NP +S+L+IN A+L SL+GIE S  IV+VEAEGNQIKSLVLK+K
Sbjct:  578 LMVNDTKVSHLDFLKNNPNLSSLSINRAQLQSLEGIEASSVIVRVEAEGNQIKSLVLKDK  637

Query:  725 QGSLKFLNVTNNQLTSLEGVNNYTSLETLSVSKNKLESLDIKTPNKTVTNLDFSHNNVPT  784
            QGSL FL+VT NQLTSLEGVNN+T+L+ LSVSKN+L ++++  PNKTVTN+D SHNN+
Sbjct:  638 QGSLTFLDVTGNQLTSLEGVNNFTALDILSVSKNQLTNVNLSKPNKTVTNIDISHNNISL  697

Query:  785 SQLKLNEKNIPEAVAKNFPAVVEGSMVGNGSLAEKAAMASKEDKQVSD-NTNHQKNTEKS  843
            + LKLNE++IPEA+AKNFPAV EGSMVGNG+  EKAAMA+K  +   + +H N   +
Sbjct:  698 ADLKLNEQHIPEAIAKNFPAVYEGSMVGNGTAEEKAAMATKAKESAQEASESHDYNHNHT  757

Query:  844 AQANADSKKENPKTHDEHHDHEETDHAHVGHHH                            876
              +      E+    D H+HE+ + A    +H
Sbjct:  758 YEDEEGHAHEHRDKDDHDHEHEDENEAKDEQNH                            790
```

SEQ ID 4182 (GBS84) was expressed in *E. coli* as a His-fusion product. SDS-PAGE analysis of total cell extract is shown in FIG. 16 (lane 9; MW 97.6 kDa).

GBS84-His was purified as shown in FIG. 194, lane 7.

Based on this analysis, it was predicted that these proteins and their epitopes could be useful antigens for vaccines or diagnostics.

EXAMPLE 1369

A DNA sequence (GBSx1454) was identified in *S. agalactiae* <SEQ ID 4185> which encodes the amino acid sequence <SEQ ID 4186>. This protein is predicted to be GTP-binding protein lepa (lepA). Analysis of this protein sequence reveals the following:

```
Possible site: 30
>>> Seems to have no N-terminal signal sequence

----- Final Results -----
            bacterial cytoplasm --- Certainty = 0.1962(Affirmative) < succ>
            bacterial membrane  --- Certainty = 0.0000(Not Clear)   < succ>
            bacterial outside   --- Certainty = 0.0000(Not Clear)   < succ>
```

The protein has homology with the following sequences in the GENPEPT database.

```
>GP: CAB14493 GB: Z99117 GTP-binding protein [Bacillus subtilis]
    Identities = 464/603 (76%), Positives = 540/603 (88%)

Query:   8 KRQEKIRNFSIIAHIDHGKSTLADRILEKTETVSSREMQAQLLDSMDLERERGITIKLNA  67
           +RQ +IRNFSIIAHIDHGKSTLADRILEKT  ++ REM+ QLLDSMDLERERGITIKLN+
Sbjct:   9 ERQSRIRNFSIIAHIDHGKSTLADRILEKTSAITQREMKEQLLDSMDLERERGITIKLNS  68
```

```
Query:   68 IELNYTAKDGETYIFHLIDTPGHVDFTYEVSRSLAACEGAILVVDAAQGIEAQTLANVYL  127
            ++L Y AKDGE YIFHLIDTPGHVDFTYEVSRSLAACEGAILVVDAAQGIEAQTLANVYL
Sbjct:   69 VQLKYKAKDGEEYIFHLIDTPGHVDFTYEVSRSLAACEGAILVVDAAQGIEAQTLANVYL  128

Query:  128 ALDNDLEILPVINKIDLPAADPERVRAEVEDVIGLDASEAVLASAKAGIGIEEILEQIVE  187
            ALDNDLEILPVINKIDLP+A+PERVR EVEDVIGLDASEAVLASAKAGIGIEEILEQIVE
Sbjct:  129 ALDNDLEILPVINKIDLPSAEPERVRQEVEDVIGLDASEAVLASAKAGIGIEEILEQIVE  188

Query:  188 KVPAPTGEVDAPLQALIFDSVYDAYRGVILQVRIVNGMVKPGDKIQMMSNGKTFDVTEVG  247
            KVPAPTG+ +APL+ALIFDS+YDAYRGV+  +R+V G VKPG KI+MM+ GK F+VTEVG
Sbjct:  189 KVPAPTGDPEAPLKALIFDSLYDAYRGVVAYIRVVEGTVKPGQKIKMMATGKEFEVTEVG  248

Query:  248 IFTPKAVGRDFLATGDVGYIAASIKTVADTRVGDTITLANNPAIEPLHGYKQMNPMVFAG  307
            +FTPKA    + L  GDVG++ ASIK V DTRVGDTIT A NPA E L GY+++NPMV+G
Sbjct:  249 VFTPKATPTNELTVGDVGFLTASIKNVGDTRVGDTITSAANPAEEALPGYRKLNPMVYCG  308

Query:  308 LYPIESNKYNDLREALEKLQLNDASLQFEPETSQALGFGFRCGFLGLLHMDVIQERLERE  367
            LYPI++ KYNDLREALEKL+LND+SLQ+E ETSQALGFGFRCGFLG+LHM++IQER+ERE
Sbjct:  309 LYPIDTAKYNDLREALEKLELNDSSLQYEAETSQALGFGFRCGFLGMLHMEIIQERIERE  368

Query:  368 FNIDLIMTAPSVVYHVNTTDGEMLEVSNPSEFPDPTRVDSIEEPYVKAQIMVPQEFVGAV  427
            FNIDLI  TAPSV+Y V  TDGE + V NPS  PDP +++ +EEPYVKA +MVP ++VGAV
Sbjct:  369 FNIDLITTAPSVIYDVYMTDGEKVVVDNPSNMPDPQKIERVEEPYVKATMMVPNDYVGAV  428

Query:  428 MELAQRKRGDFVTMDYIDDNRVNVIYQIPLAEIVFDFFDKLKSSTRGYASFDYEISEYRR  487
            MEL Q KRG+F+ M Y+D NRV++IY +PLAEIV++FFD+LKSST+GYASFDYE+  Y+
Sbjct:  429 MELCQGKRGNFIDMQYLDANRVSIIYDMPLAEIVYEFFDQLKSSTKGYASFDYELIGYKP  488

Query:  488 SQLXKMDILLNGDKVDALSFIVHKEFAYERGKLIVDKLKKIIPRQQFEVPIQAAIGQKIV  547
            S+L KMDI+LNG+K+DALSFIVH+++AYERGK+IV+KLK++IPRQQFEVP+QAAIGQKIV
Sbjct:  489 SKLVKMDIMLNGEKIDALSFIVHRDYAYERGKVIVEKLKELIPRQQFEVPVQAAIGQKIV  548

Query:  548 ARSDIKALRKNVLAKCYGGDVSRKRKLLEKQKAGKKRMKAIGSVEVPQEAFLSVLSMDDD  607
            ARS IKA+RKNVLAKCYGGD+SRKRKLLEKQK GK+RMK +GSVEVPQSAF++VL MDD
Sbjct:  549 ARSTIKAMRKNVLAKCYGGDISRKRKLLEKQKEGKRRMKQVGSVEVPQEAFMAVLKMDDS  608

Query:  608 DKK                                                          610
             KK
Sbjct:  609 PKK                                                          611
```

A related GBS sequence was identified <SEQ ID 10775> which encodes the amino acid sequence <SEQ ID 10776>. A further related GBS nucleic acid sequence <SEQ ID 10955> which encodes amino acid sequence <SEQ ID 10956> was also identified.

A related DNA sequence was identified in *S. pyogenes* <SEQ ID 4187> which encodes the amino acid sequence <SEQ ID 4188>. Analysis of this protein sequence reveals the following:

```
Possible site: 30
>>> Seems to have no N-terminal signal sequence

----- Final Results -----
            bacterial cytoplasm --- Certainty = 0.1829(Affirmative) < succ>
            bacterial membrane  --- Certainty = 0.0000(Not Clear)   < succ>
             bacterial outside  --- Certainty = 0.0000(Not Clear)   < succ>
```

The protein has homology with the following sequences in the databases:

```
>GP: CAB14493 GB: Z99117 GTP-binding protein [Bacillus subtilis]
   Identities = 463/603 (76%), Positives = 542/603 (89%)

Query:    8 KRQEKIRNFSIIAHIDHGKSTLADRILEKTETVSSREMQAQLLDSMDLERERGITIKLNA   67
              +RQ +IRNFSIIAHIDHGKSTLADRILEKT  ++ REM+ QLLDSMDLERERGITIKLN+
   Sbjct:    9 ERQSRIRNFSIIAHIDHGKSTLADRILEKTSAITQREMKEQLLDSMDLERERGITIKLNS   68

Query:   68 IELNYTAKDGETYIFHLIDTPGHVDFTYEVSRSLAACEGAILVVDAAQGIEAQTLANVYL  127
              ++L Y AKDGE YIFHLIDTPGHVDFTYEVSRSLAACEGAILVVDAAQGIEAQTLANVYL
   Sbjct:   69 VQLKYKAKDGEEYIFHLIDTPGHVDFTYEVSRSLAACEGAILVVDAAQGIEAQTLANVYL  128

Query:  128 ALDNDLEILPVINKIDLPAADPERVRHEVEDVIGLDASEAVLASAKAGIGIEEILEQIVE  187
              ALDNDLEILPVINKIDLP+A+PERVR EVEDVIGLDASEAVLASAKAGIGIEEILEQIVE
   Sbjct:  129 ALDNDLEILPVINKIDLPSAEPERVRQEVEDVIGLDASEAVLASAKAGIGIEEILEQIVE  188

Query:  188 KVPAPTGDVDAPLQALIFDSVYDAYRGVILQVRIVNGIVKPGDKIQMMSNGKTFDVTEVG  247
              KVPAPTGD +APL+ALIFDS+YDAYRGV+  +R+V G VKPG KI+MM+ GK F+VTEVG
   Sbjct:  189 KVPAPTGDPEAPLKALIFDSLYDAYRGVVAYIRVVEGTVKPGQKIKMMATGKEFEVTEVG  248
```

-continued

```
Query: 248 IFTPKAVGRDFLATGDVGYVAASIKTVADTRVGDTVTLANNPAKEALHGYKQMNPMVFAG 307
            +FTPKA   + L  GDVG++ ASIK V DTRVGDT+T A NPA+EAL GY+++NPMV+ G
Sbjct: 249 VFTPKATPTNELTVGDVGFLTASIKNVGDTRVGDTITSAANPAEEALPGYRKLNPMVYCG 308

Query: 308 IYPIESNKYNDLREALEKLQLNDASLQFEPETSQALGFGFRCGFLGLLHMDVIQERLERE 367
            +YPI++  KYNDLREALEKL+LND+SLQ+E ETSQALGFGFRCGFLG+LHM++IQER+ERE
Sbjct: 309 LYPIDTAKYNDLREALEKLELNDSSLQYEAETSQALGFGFRCGFLGMLHMEIIQERIERE 368

Query: 368 FNIDLIMTAPSVVYHVHTTDEDMIEVSNPSEFPDPTRVAFIEEPYVKAQIMVPQEFVGAV 427
            FNIDLI TAPSV+Y V+ TD + + V NPS  PDP ++  +EEPYVKA +MVP ++VGAV
Sbjct: 369 FNIDLITTAPSVIYDVYMTDGEKVVVDNPSNMPDPQKIERVEEPYVKATMMVPNDYVGAV 428

Query: 428 MELSQRKRGDFVTMDYIDDNRVNVIYQIPLAEIVFDFFDKLKSSTRGYASFDYDMSEYRR 487
            MEL Q KRG+F+ M Y+D NRV++IY +PLAEIV++FFD+LKSST+GYASFDY++   Y+
Sbjct: 429 MELCQGKRGNFIDMQYLDANRVSIIYDMPLAEIVYEFFDQLKSSTKGYASFDYELIGYKP 488

Query: 488 SQLVKMDILLNGDKVDALSFIVHKEFAYERGKIIVEKLKKIIPRQQFEVPIQAAIGQKIV 547
            S+LVKMDI+LNG+K+DALSFIVH+++AYERGK+IVEKLK++IPRQQFEVP+QAAIGQKIV
Sbjct: 489 SKLVKMDIMLNGEKIDALSFIVHRDYAYERGKVIVEKLKELIPRQQFEVPVQAAIGQKIV 548

Query: 548 ARSDIKALRKNVLAKCYGGDVSRKRKLLEKQKAGKKRMKAIGSVEVPQEAFLSVLSMDDD 607
            ARS IKA+RKNVLAKCYGGD+SRKRKLLEKQK GK+RMK +GSVEVPQEAF++VL MDD
Sbjct: 549 ARSTIKAMRKNVLAKCYGGDISRKRKLLEKQKEGKRRMKQVGSVEVPQEAFMAVLKMDDS 608

Query: 608 TKK                                                          610
            KK
Sbjct: 609 PKK                                                          611
```

An alignment of the GAS and GBS proteins is shown below.

```
Identities = 587/610 (96%), Positives = 601/610 (98%)

Query:   1 MNIEDLKKRQEKIRNFSIIAHIDHGKSTLADRILEKTETVSSREMQAQLLDSMDLERERG  60
           MN +DLKKRQEKIRNFSIIAHIDHGKSTLADRILEKTETVSSREMQAQLLDSMDLERERG
Sbjct:   1 MNSQDLKKRQEKIRNFSIIAHIDHGKSTLADRILEKTETVSSREMQAQLLDSMDLERERG  60

Query:  61 ITIKLNAIELNYTAKDGETYIFHLIDTPGHVDFTYEVSRSLAACEGAILVVDAAQGIEAQ 120
           ITIKLNAIELNYTAKDGETYIFHLIDTPGHVDFTYEVSRSLAACEGAILVVDAAQGIEAQ
Sbjct:  61 ITIKLNAIELNYTAKDGETYIFHLIDTPGHVDFTYEVSRSLAACEGAILVVDAAQGIEAQ 120

Query: 121 TLANVYLALDNDLEILPVINKIDLPAADPERVRAEVEDVIGLDASEAVLASAKAGIGIEE 180
           TLANVYLALDNDLEILPVINKIDLPAADPERVR EVEDVIGLDASEAVLASAKAGIGIEE
Sbjct: 121 TLANVYLALDNDLEILPVINKIDLPAADPERVRHEVEDVIGLDASEAVLASAKAGIGIEE 180

Query: 181 ILEQIVEKVPAPTGEVDAPLQALIFDSVYDAYRGVILQVRIVNGMVKPGDKIQMMSNGKT 240
           ILEQIVEKVPAPTG+VDAPLQALIFDSVYDAYRGVILQVRIVNG+VKPGDKIQMMSNGKT
Sbjct: 181 ILEQIVEKVPAPTGDVDAPLQALIFDSVYDAYRGVILQVRIVNGIVKPGDKIQMMSNGKT 240

Query: 241 FDVTEVGIFTPKAVGRDFLATGDVGYIAASIKTVADTRVGDTITLANNPAIEPLHGYKQM 300
           FDVTEVGIFTPKAVGRDFLATGDVGY+AASIKTVADTRVGDT+TLANNPA E LHGYKQM
Sbjct: 241 FDVTEVGIFTPKAVGRDFLATGDVGYVAASIKTVADTRVGDTVTLANNPAKEALHGYKQM 300

Query: 301 NPMVFAGLYPIESNKYNDLREALEKLQLNDASLQFEPETSQALGFGFRCGFLGLLHMDVI 360
           NPMVFAG+YPIESNKYNDLREALEKLQLNDASLQFEPETSQALGFGFRCGFLGLLHMDVI
Sbjct: 301 NPMVFAGIYPIESNKYNDLREALEKLQLNDASLQFEPETSQALGFGFRCGFLGLLHMDVI 360

Query: 361 QERLEREFNIDLIMTAPSVVYHVNTTDGEMLEVSNPSEFPDPTRVDSIEEPYVKAQIMVP 420
           QERLEREFNIDLIMTAPSVVYHV+TTD +M+EVSNPSEFPDPTRV  IEEPYVKAQIMVP
Sbjct: 361 QERLEREFNIDLIMTAPSVVYHVHTTDEDMIEVSNPSEFPDPTRVAFIEEPYVKAQIMVP 420

Query: 421 QEFVGAVMELAQRKRGDFVTMDYIDDNRVNVIYQIPLAEIVFDFFDKLKSSTRGYASFDY 480
           QEFVGAVMEL+QRKRGDFVTMDYIDDNRVNVIYQIPLAEIVFDFFDKLKSSTRGYASFDY
Sbjct: 421 QEFVGAVMELSQRKRGDFVTMDYIDDNRVNVIYQIPLAEIVFDFFDKLKSSTRGYASFDY 480

Query: 481 EISEYRRSQLXKMDILLNGDKVDALSFIVHKEFAYERGKLIVDKLKKIIPRQQFEVPIQA 540
           ++SEYRRSQL KMDILLNGDKVDALSFIVHKEFAYERGK+IV+KLKKIIPRQQFEVPIQA
Sbjct: 481 DMSEYRRSQLVKMDILLNGDKVDALSFIVHKEFAYERGKIIVEKLKKIIPRQQFEVPIQA 540

Query: 541 AIGQKIVARSDIKALRKNVLAKCYGGDVSRKRKLLEKQKAGKKRMKAIGSVEVPQEAFLS 600
           AIGQKIVARSDIKALRKNVLAKCYGGDVSRKRKLLEKQKAGKKRMKAIGSVEVPQEAFLS
Sbjct: 541 AIGQKIVARSDIKALRKNVLAKCYGGDVSRKRKLLEKQKAGKKRMKAIGSVEVPQEAFLS 600

Query: 601 VLSMDDDDKK                                                   610
           VLSMDDD KK
Sbjct: 601 VLSMDDDTKK                                                   610
```

Based on this analysis, it was predicted that these proteins and their epitopes could be useful antigens for vaccines or diagnostics.

EXAMPLE 1370

A DNA sequence (GBSx1455) was identified in *S. agalactiae* <SEQ ID 4189> which encodes the amino acid sequence <SEQ ID 4190>. This protein is predicted to be awd gene product (ndk). Analysis of this protein sequence reveals the following:

```
Possible site: 42
>>> Seems to have no N-terminal signal sequence

----- Final Results -----
            bacterial cytoplasm --- Certainty = 0.2097(Affirmative) < succ>
             bacterial membrane --- Certainty = 0.0000(Not Clear)   < succ>
              bacterial outside --- Certainty = 0.0000(Not Clear)   < succ>
```

The protein has homology with the following sequences in the GENPEPT database.

```
>GP: AAF57188 GB: AE003779 awd gene product [Drosophila melanogaster]
Identities = 73/136 (53%), Positives = 100/136 (72%), Gaps = 5/136 (3%)
Query:    2 EQTFFMIKPDGVKRGFIGEVISRIERRGFSIDRLEVRYADADILKRHYAELTDRPFFPTL   61
            E+TF M+KPDGV+RG +G++I R E++GF +  L+   +A  ++L++HYA+L+ RPFFP L
Sbjct:   25 ERTFIMVKPDGVQRGLVGKIIERFEQKGFKLVALKFTWASKELLEKHYADLSARPFFPGL   84

Query:   62 VDYMTSGPVIIGVISGEEVISTWRTMMGSTNPKDALPGTIRGDFAQAPSPNQATCNIVHG  121
            V+YM SGPV+  V  G  V+ T R M+G+TNP D+LPGTIRGDF     Q   NI+HG
Sbjct:   85 VNYMNSGPVVPMVWEGLNVVKTGRQMLGATNPADSLPGTIRGDFC-----IQVGRNIIHG  139

Query:  122 SDSPESATREIAIWFN                                              137
            SD+ ESA +EIA+WFN
Sbjct:  140 SDAVESAEKEIALWFN                                              155
```

A related DNA sequence was identified in *S. pyogenes* <SEQ ID 4191> which encodes the amino acid sequence <SEQ ID 4192>. Analysis of this protein sequence reveals the following:

```
Possible site: 22
>>> Seems to have no N-terminal signal sequence

----- Final Results -----
            bacterial cytoplasm --- Certainty = 0.2913(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below.

```
Identities = 30/48 (62%), Positives = 35/48 (72%)
Query:   87 MMGSTNPKDALPGTIRGDFAQAPSPNQATCNIVHGSDSPESATREIAI   134
            MM  TNPKDAL GTIR +FAQAP +    N+VHGS S +SA REIA+
Sbjct:    1 MMRVTNPKDALCGTIRENFAQAPGDDGGIFNMVHGSHSRDSARREIAL    48
```

Based on this analysis, it was predicted that these proteins and their epitopes could be useful antigens for vaccines or diagnostics.

EXAMPLE 1371

A DNA sequence (GBSx1456) was identified in *S. agalactiae* <SEQ ID 4193> which encodes the amino acid sequence <SEQ ID 4194>. Analysis of this protein sequence reveals the following:

```
Possible site: 15
>>> Seems to have no N-terminal signal sequence

----- Final Results -----
            bacterial cytoplasm --- Certainty = 0.2734(Affirmative) < succ>
             bacterial membrane --- Certainty = 0.0000(Not Clear)   < succ>
              bacterial outside --- Certainty = 0.0000(Not Clear)   < succ>
```

The protein has no significant homology with any sequences in the GENPEPT database.

A related DNA sequence was identified in *S. pyogenes* <SEQ ID 4195> which encodes the amino acid sequence <SEQ ID 4196>. Analysis of this protein sequence reveals the following:

```
Possible site: 16
>>> Seems to have no N-terminal signal sequence

----- Final Results -----
            bacterial cytoplasm --- Certainty = 0.1985(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below.

```
Identities = 22/34 (64%), Positives = 26/34 (75%)
Query:  28 SFGTIRNSTALKQLTLDSLNLLSFGTIRNSTALK  61
           SFGTI+NS ALKQ   + +N  SFGTI+NS ALK
Sbjct:   7 SFGTIQNSIALKQKAQEEINQRSFGTIQNSIALK  40

Identities = 22/34 (64%), Positives = 26/34 (75%)
Query:   6 SFGTIRNSTALKLYAKQSPAFRSFGTIRNSTALK  39
           SFGTI+NS ALK  A++     RSFGTI+NS ALK
Sbjct:   7 SFGTIQNSIALKQKAQEEINQRSFGTIQNSIALK  40
```

Based on this analysis, it was predicted that these proteins and their epitopes could be useful antigens for vaccines or diagnostics.

EXAMPLE 1372

A DNA sequence (GBSx1457) was identified in *S. agalactiae* <SEQ ID 4197> which encodes the amino acid sequence <SEQ ID 4198>. Analysis of this protein sequence reveals the following:

```
Possible site: 16
>>> Seems to have no N-terminal signal sequence

----- Final Results -----
            bacterial cytoplasm --- Certainty = 0.1407(Affirmative) < succ>
             bacterial membrane --- Certainty = 0.0000(Not Clear)   < succ>
              bacterial outside --- Certainty = 0.0000(Not Clear)   < succ>
```

The protein has no significant homology with any sequences in the GENPEPT database.

A related DNA sequence was identified in *S. pyogenes* <SEQ ID 4199> which encodes the amino acid sequence <SEQ ID 4200>. Analysis of this protein sequence reveals the following:

```
Possible site: 37
>>> Seems to have no N-terminal signal sequence

----- Final Results -----
            bacterial cytoplasm --- Certainty = 0.2055(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below.

```
Identities = 154/221 (69%), Positives = 187/221 (83%)
Query:   1 MIKINFPILDEPLVLSNATILTIEDVSVYSSLVKHFYQYDVDEHLKLFDDKQKSLKATEL  60
           ++ +NF +LDEP+ L   TIL +EDV V+S +V++ YQY+ D  LK FD K K++K +E+
Sbjct:   8 LMNLNFSLLDEPIPLRGGTILVLEDVCVFSKIVQYCYQYEEDSELKFFDHKMKTIKESEI  67
```

-continued
```
Query:  61 MLVTDILGYDVNSAPILKLIHGDLENQFNEKPEVKSMVEKLAATITELIAFECLENELDL 120
           MLVTDILG+DVNS+ ILKLIH DLE+QFNEKPEVKSM++KL ATITELI FECLENELDL
Sbjct:  68 MLVTDILGFDVNSSTILKLIHADLESQFNEKPEVKSMIDKLVATITELIVFECLENELDL 127

Query: 121 EYDEIKILELIKALGVKIETQSDTIFEKCFEIIQVYHYLTKKNLLVFVNSGAYLTKDEVI 180
           EYDEI ILELIK+LGVK+ETQSDTIFEKC EI+Q++ YLTKK LL+FVNSGA+LTKDEV
Sbjct: 128 EYDEITILELIKSLGVKVETQSDTIFEKCLEILQIFKYLTKKKLLIFVNSGAFLTKDEVA 187

Query: 181 KLCEYINLMQKSVLFLEPRRLYDLPQYVIDKDYFLIGENMV                    221
             L EYI+L    +VLFLEPR LYD PQY++D+DYFLI +NMV
Sbjct: 188 SLQEYISLTNLTVLFLEPRELYDFPQYILDEDYFLITKNMV                    228
```

Based on this analysis, it was predicted that these proteins and their epitopes could be useful antigens for vaccines or diagnostics.

EXAMPLE 1373

A DNA sequence (GBSx1458) was identified in *S. agalactiae* <SEQ ID 4201> which encodes the amino acid sequence <SEQ ID 4202>. Analysis of this protein sequence reveals the following:

```
Possible site: 18
>>> Seems to have no N-terminal signal sequence

----- Final Results -----
           bacterial cytoplasm --- Certainty = 0.0842(Affirmative) < succ>
           bacterial membrane  --- Certainty = 0.0000(Not Clear)   < succ>
           bacterial outside   --- Certainty = 0.0000(Not Clear)   < succ>
```

A related GBS nucleic acid sequence <SEQ ID 9783> which encodes amino acid sequence <SEQ ID 9784> was also identified.

The protein has homology with the following sequences in the GENPEPT database.

```
>GP: CAB83918 GB: AL162753 hypothetical protein NMA0629 [Neisseria
meningitidis Z2491]
Identities = 45/104 (43%), Positives = 65/104 (62%), Gaps = 2/104 (1%)
Query:   4 RYMRMILMFDMPTETAEERKAYRIFRKFLLSEGFIMHQFSVYSKLLLNNTANNAMIGRLK   63
           ++MR+I+ FD+P  TA +RKA+  FR+FLL +G+ M Q SVYS+++    +       RL
Sbjct:   5 KFMRIIVFFDLPVITAAKRKAANQFRQFLLKDGYQMLQLSVYSRIVKGRDSLQKHHNRLC  64

Query:  64 VNNPKKGNITLLTVTEKQFARMVYLHGERNT--SVANSDSRLVF                 105
           N P++G+I  L +TEKQ+A M  L GE  T    NSD  L+F
Sbjct:  65 ANLPQEGSIRCLEITEKQYAAMKLLLGELKTQEKKVNSDQLLLF                 108
```

A related DNA sequence was identified in *S. pyogenes* <SEQ ID 4203> which encodes the amino acid sequence <SEQ ID 4204>. Analysis of this protein sequence reveals the following:

```
Possible site: 18
>>> Seems to have no N-terminal signal sequence

----- Final Results -----
           bacterial cytoplasm --- Certainty = 0.0822(Affirmative) < succ>
           bacterial membrane  --- Certainty = 0.0000(Not Clear)   < succ>
           bacterial outside   --- Certainty = 0.0000(Not Clear)   < succ>
```

An alignment of the GAS and GBS proteins is shown below.

```
Identities = 97/112 (86%), Positives = 107/112 (94%)
Query:   1 MSYRYMRMILMFDMPTETAEERKAYRKFRKFLLSEGFIMHQFSVYSKLLLNNTANNAMIG   60
           MSYRYMRMILMFDMPT+TAEERKAYRKFRKFLLSEGFIMHQFS+YSKLLLNNTANNAMIG
Sbjct:   1 MSYRYMRMILMFDMPTDTAEERKAYRKFRKFLLSEGFIMHQFSIYSKLLLNNTANNAMIG   60
```

```
                              -continued
Query:   61 RLKVNNPKKGNITLLTVTEKQFARMVYLHGERNTSVANSDSRLVFLGDSYDQ         112
            RL+ +NP KGNITLLTVTEKQFARM+YLHGERN  +ANSD RLVFLG+++D+
Sbjct:   61 RLREHNPNKGNITLLTVTEKQFARMIYLHGERNNCIANSDERLVFLGEAFDE         112
```

Based on this analysis, it was predicted that these proteins and their epitopes could be useful antigens for vaccines or diagnostics.

EXAMPLE 1374

A DNA sequence (GBSx1459) was identified in *S. agalactiae* <SEQ ID 4205> which encodes the amino acid sequence <SEQ ID 4206>. Analysis of this protein sequence reveals the following:

```
Possible site: 13
>>> Seems to have no N-terminal signal sequence

----- Final Results -----
               bacterial cytoplasm --- Certainty = 0.3185(Affirmative) < succ>
                bacterial membrane --- Certainty = 0.0000(Not Clear)  < succ>
                 bacterial outside --- Certainty = 0.0000(Not Clear)  < succ>
```

The protein has homology with the following sequences in the GENPEPT database.

```
>GP: CAB83919 GB: AL162753 hypothetical protein NMA0630 [Neisseria
meningitidis Z2491]
Identities = 71/224 (31%), Positives = 122/224 (53%)
Query:    4 WRTVVVNTHSKLSYKNNHLIFKDSYQTEMIHLSEIDILIMETTDIVLSTMLIKRLVDENI       63
            WR++++     KLS +   L+ + + ++  + L +I ++I+E  + +++  L+   L +
Sbjct:    3 WRSLLIQNGGKLSLQRRQLLIQQNGESHTVPLEDIAVIIIENRETLITAPLLSALAEHGA       62

Query:   64 LVIFCDDKRLPTAMLMPYYARHDSSLQLSRQMSWIEDVKADVWTSIIAQKILNQSFYLGE      123
            ++ CD++ LP    +PY   H     L  Q++  E +K  +W  I+ QKILNQ+F    E
Sbjct:   63 TLLTCDEQFLPCGQWLPYAQYHRQLKILKLQLNISEPLKKQLWQHIVRQKILNQAFVADE      122

Query:  124 CSFFEKSQSIMNLYHDLEPFDPSNREGHAARIYFNTLFGNDFSREQDNPINAGLDYGYSL      183
                ++ +  L  ++     D   NRE  AA +YF  LFG   F+R  +N +NA L+Y Y++
Sbjct:  123 TGNDLAAKRLRTLASEVRSGDTGNREAQAAALYFQALFGEKFTRNDNNAVNAALNYTYAV      182

Query:  184 LLSMFAREVVKCGCMTQFGLKHANQFNQFNLASDIMEPFRPIVD                   227
            L +  AR +   G +    GL H ++ N FNLA D +EP RP+ D
Sbjct:  183 LRAAVARALTLYGWLPALGLFHRSELNPFNLADDFIEPLRPLAD                   226
```

A related DNA sequence was identified in *S. pyogenes* <SEQ ID 4207> which encodes the amino acid sequence <SEQ ID 4208>. Analysis of this protein sequence reveals the following:

```
Possible site: 13
>>> Seems to have no N-terminal signal sequence

----- Final Results -----
               bacterial cytoplasm --- Certainty = 0.3185(Affirmative) < succ>
                bacterial membrane --- Certainty = 0.0000(Not Clear)  < succ>
                 bacterial outside --- Certainty = 0.0000(Not Clear)  < succ>
```

An alignment of the GAS and GBS proteins is shown below.

```
Identities = 239/289 (82%), Positives = 271/289 (93%)
Query:    1 MAGWRTVVVNTHSKLSYKNNHLIFKDSYQTEMIHLSEIDILIMETTDIVLSTMLIKRLVD       60
            MAGWRTVVVNTHSKLSYKNNHLIFKD+Y+TE+IHLSEIDIL++ETTDIVLSTML+KRLVD
Sbjct:    1 MAGWRTVVVNTHSKLSYKNNHLIFKDAYKTELIHLSEIDILLLETTDIVLSTMLVKRLVD       60

Query:   61 ENILVIFCDDKRLPTAMLMPYYARHDSSLQLSRQMSWIEDVKADVWTSIIAQKILNQSFY      120
            EN+LVIFCDDKRLPTAMLMP+Y RHDSSLQL +QMSW E VK+ VWT+IIAQKILNQS Y
Sbjct:   61 ENVLVIFCDDKRLPTAMLMPFYGRHDSSLQLGKQMSWSETVKSQVWTTIIAQKILNQSCY      120
```

-continued

```
Query: 121 LGECSFFEKSQSIMNLYHDLEPFDPSNREGHAARIYFNTLFGNDFSREQDNPINAGLDYG  180
            LG CS+FEKSQSIM+LYH LE FDPSNREGHAARIYFNTLFGNDFSR+ ++PINAGLDYG
Sbjct: 121 LGACSYFEKSQSIMDLYHGLENFDPSNREGHAARIYFNTLFGNDFSRDLEHPINAGLDYG  180

Query: 181 YSLLLSMFAREVVKCGCMTQFGLKHANQFNQFNLASDIMEPFRPIVDRIIYENRQSDFVK  240
            Y+LLLSMFAREVV  GCMTQFGLKHANQFNQFN ASDIMEPFRP+VD+I+YENR  F K
Sbjct: 181 YTLLLSMFAREVVVSGCMTQFGLKHANQFNQFNFASDIMEPFRPLVDKIVYENRNQPFPK  240

Query: 241 MKRELFSMFSETYSYNGKEMYLSNIVSDYTKKVIKSLNSDGNGIPEFRI             289
            +KRELF++FS+T+SYNGKEMYL+NI+SDYTKKV+K+LN++G G+PEFRI
Sbjct: 241 IKRELFTLFSDTFSYNGKEMYLTNIISDYTKKVVKALNNEGKGVPEFRI             289
```

Based on this analysis, it was predicted that these proteins and their epitopes could be useful antigens for vaccines or diagnostics.

EXAMPLE 1375

A DNA sequence (GBSx1460) was identified in *S. agalactiae* <SEQ ID 4209> which encodes the amino acid sequence <SEQ ID 4210>. Analysis of this protein sequence reveals the following:

```
Possible site: 59
>>> Seems to have no N-terminal signal sequence

----- Final Results -----
            bacterial cytoplasm --- Certainty = 0.1109(Affirmative) < succ>
            bacterial membrane  --- Certainty = 0.0000(Not Clear)   < succ>
            bacterial outside   --- Certainty = 0.0000(Not Clear)   < succ>
```

The protein has homology with the following sequences in the GENPEPT database.

```
>GP: CAB73943 GB: AL139078 hyopthetical protein Cj1523c [Campylobacter
jejuni]
Identities = 165/746 (22%), Positives = 291/746 (38%), Gaps = 115/746 (15%)
Query: 318 LSASMIQRYDEHREDLKQLKQFVKASLPEKYQEI--FADSSKDGYAGYIEGKTNQEAFYK  375
            L+ S  +R    + L LK +        Y++  F +S   Y G +     E  ++
Sbjct:  50 LARSARKRLARRKARLNHLKHLIANEFKLNYEDYQSFDESLAKAYKGSLISP--YELRFR  107

Query: 376 YLSKLLTKQEDSENFLE--KIKNEDFLRKQRTFDNGSIPHQVHLTELKAIIRRQS-----  428
            L++LL+KQ+ +   L    K  + D ++      + G+I    +   E K +   QS
Sbjct: 108 ALNELLSKQDFARVILHIAKRRGYDDIKNSDDKEKGAILKAIKQNEEK-LANYQSVGEYL  166

Query: 429 --EYYPFLKENQDRIEKILTFRIPYY-----------IGPLAREKSDFAW-MTRKTDDSI  474
              EY+    KEN +    +   + Y            + + +++ +F +  ++K ++ +
Sbjct: 167 YKEYFQKFKENSKEFTNVRNKKESYERCIAQSFLKDELKLIFKKQREFGFSFSKKFEEEV  226

Query: 475 RPWNFEDLVDKEKSAEAFIHRMTNNDFYLPEEKVLPKHSLIYEKFTVYNELTKV--RYKN  532
            F         +++ + F H + N  F+  +EK  PK+S +   F     +    KN
Sbjct: 227 LSVAFY-----KRALKDFSHLVGNCSFFT-DEKRAPKNSPLAFMFVALTRIINLLNNLKN  280

Query: 533 EQGETYFFDSNIKQEIFDGVFKEHRKVSK--KKLLDFLAKEYEEFRIVDVIGLDKENKAF  590
            +G  Y  D     + +V K     K KKLL L+ +YE          E   +
Sbjct: 281 TEGILYTKDD--LNALLNEVLKNGTLTYKQTKKLLG-LSDDYE---------FKGEKGTY  328

Query: 591 NASLGTYHDLEKILDKDFLDNPDNESILEDIVQTLTLFEDREMIKKRLENYKDLFTESQL  650
                 Y +  KL+   L   D     L +I + +TL +D    +KK L  Y       ++Q+
Sbjct: 329 FIEFKKYKEFIKALGEHNLSQDD----LNEIAKDITLIKDEIKLKKALAKYD--LNQNQI  382

Query: 651 KKLYRRHYTGWGRLSAKLINGIRDK--ESQKTILDYLIDDGRSNRNFMQLINDDGLSFKS  708
            L + +       +S K + +      E +K      D+ + N    IN+D   F
Sbjct: 383 DSLSKLEFKDHLNISFKALKLVTPLMLEGKK------YDEACNELNLKVAINEDKKDFLP  436

Query: 709 IISKAQAGSHSDNLKEVVGELAGSPAIKKGILQSLKIVDELVKVMGYEPEQIVVEMAREN  768
            ++          N           P + I +  K+++ L+K  G +   +I +E+ARE+
Sbjct: 437 AFNETYYKDEVTN-----------PVVLRAIKEYRKVLNALLKKYG--KVHKINIELAREV  484

Query: 769 QTTNQGR----RNSRQRYKLLDDG---VKNLASDLNG-NILKEYPTDNQALQNERLFLYY  820
            +   R    +   + YK    D      + L   +N  NILK        L L+
Sbjct: 485 GKNHSQRAKIEKEQNENYKAKKDAELECEKLGLKINSKNILK-------------LRLFK  531
```

-continued

```
Query: 821 LQNGRDMYTGEALDIDNLSQ---YDIDHIIPQAFIKDDSIDNRVLVSSAKNRGKSDDVPS     877
            Q      Y+GE + I +L        +IDHI P +    DDS  N+VLV + +N+ K + P
Sbjct: 532 EQKEFCAYSGEKIKISDLQDEKMLEIDHIYPYSRSFDDSYMNKVLVFTKQNQEKLNQTP-     590

Query: 878 LEIVKDCKVFWKKL--LDAKLMSQRKYDNLTKAERGGLTSDDKARFIQRQLVETRQITKH     935
            E    +    W+K+  L    L  ++++   L K         ++  F  R L +TR I +
Sbjct: 591 FEAFGNDSAKWQKIEVLAKNLPTKKQKRILDK----NYKDKEQKNFKDRNLNDTRYIARL     646

Query: 936 VARI---------LDERFNNELDSKGRRIRKVKIVTLKSNLVSNFRKEFGFYKIREVNNY     986
            V            L+  N +L+    ++   KV +         L S R   +GF    N+
Sbjct: 647 VLNYTKDYLDFLPLSDDENTKLNDT-QKGSKVHVEAKSGMLTSALRHTWGFSAKDRNNHL     705

Query: 987 HHAHDAYLNAVVAKAILTKYPQLEPE                                      1012
            HHA DA + A    +I+ +   + E
Sbjct: 706 HHAIDAVIIAYANNSIVKAFSDFKKE                                      731
```

A related DNA sequence was identified in *S. pyogenes* <SEQ ID 4211> which encodes the amino acid sequence <SEQ ID 4212>. Analysis of this protein sequence reveals the following:

```
Possible site: 61
>>> Seems to have no N-terminal signal sequence

----- Final Results -----
          bacterial cytoplasm --- Certainty = 0.0973(Affirmative) < succ>
           bacterial membrane --- Certainty = 0.0000(Not Clear)   < succ>
            bacterial outside --- Certainty = 0.0000(Not Clear)   < succ>
```

An alignment of the GAS and GBS proteins is shown below.

```
Identities = 881/1380 (63%), Positives = 1088/1380 (78%), Gaps = 22/1380 (1%)
Query:   1 MNKPYSIGLDIGTNSVGWSIITDDYKVPAKKMRVLGNTDKEYIKKNLIGALLFDGGNTAA      60
           M+K YSIGLDIGTNSVGW++ITD+YKVP+KK +VLGNTD+   IKKNLIGALLFD G TA
Sbjct:   1 MDKKYSIGLDIGTNSVGWAVITDEYKVPSKKFKVLGNTDRHSIKKNLIGALLFDSGETAE      60

Query:  61 DRRLKRTARRRYTRRRNRILYLQEIFAEEMSKVDDSFFHRLEDSFLVEEDKRGSKYPIFA     120
              RLKRTARRRYTRR+NRI YLQEIF+ EM+KVDDSFFHRLE+SFLVEEDK+  ++PIF
Sbjct:  61 ATRLKRTARRRYTRRKNRICYLQEIFSNEMAKVDDSFFHRLEESFLVEEDKKHERHPIFG     120

Query: 121 TLQEEKDYHEKFSTIYHLRKELADKKEKADLRLIYIALAHIIKFRGHFLIEDDSFDVRNT     180
            + +E   YHEK+ TIYHLRK+L D  +KADLRLIY+ALAH+IKFRGHFLIE D  + N+
Sbjct: 121 NIVDEVAYHEKYPTIYHLRKKLVDSTDKADLRLIYLALAHMIKFRGHFLIEGD-LNPDNS     179

Query: 181 DISKQYQDFLEIFNTTFENNDLLSQNVDVEAILTDKISKSAKKDRILAQYPNQKSTGIFA     240
           D+ K +    ++ +N FE N + +  VD +AIL+ ++SKS + + ++AQ P +K  G+F
Sbjct: 180 DVDKLFIQLVQTYNQLFEENPINASGVDAKAILSARLSKSRRLENLIAQLPGEKKNGLFG     239

Query: 241 EFLKLIVGNQADFKKYFNLEDKTPLQFAKDSYDEDLENLLGQIGDEFADLFSAAKKLYDS     300
            + L +G    +FK  F+L +    LQ  +KD+YD+DL+NLL QIGD++ADLF  AAK L D+
Sbjct: 240 NLIALSLGLTPNFKSNFDLAEDAKLQLSKDTYDDDLDNLLAQIGDQYADLFLAAKNLSDA     299

Query: 301 VLLSGILTVIDLSTKAPLSASMIQRYDEHREDLKQLKQFVKASLPEKYQEIFADSSKDGY     360
           +LLS IL V   TKAPLSASMI+RYDEH +DL  LK  V+  LPEKY+EIF D SK+GY
Sbjct: 300 ILLSDILRVNTEITKAPLSASMIKRYDEHHQDLTLLKALVRQQLPEKYKEIFFDQSKNGY     359

Query: 361 AGYIEGKTNQEAFYKYLSKLLTKQEDSENFLEKIKNEDFLRKQRTFDNGSIPHQVHLTEL     420
           AGYI+G   +QE FYK++  +L K + +E  L K+   ED LRKQRTFDNGSIPHQ+HL EL
Sbjct: 360 AGYIDGGASQEEFYKFIKPILEKMDGTEELLVKLNREDLLRKQRTFDNGSIPHQIHLGEL     419

Query: 421 KAIIRRQSEYYPPFLKENQDRIEKILTFRIPYYIGPLAREKSDFAWMTRKTDDSIRPWNFE     480
            AI+RRQ ++YPPFLK+N+++IEKILTFRIPYY+GPLAR   S FAWMTRK++++I PWNFE
Sbjct: 420 HAILRRQEDFYPPFLKDNREKIEKILTFRIPYYVGPLARGNSRFAWMTRKSEETITPWNFE     479

Query: 481 DLVDKEKSAEAFIHRMTNNDFYLPEEKVLPKHSLIYEKFTVYNELTKVRYKNE-QGETYF     539
            ++VDK  SA++FI RMTN D  LP EKVLPKHSL+YE FTVYNELTKV+Y E    +  F
Sbjct: 480 EVVDKGASAQSFIERMTNFDKNLPNEKVLPKHSLLYEYFTVYNELTKVKYVTEGMRKPAF     539

Query: 540 FDSNIKQEIFDGVFKEHRKVSKKKLLDFLAKEYEEFRIVDVIGLDKENKAFNASLGTYHD     599
                  K+ I D +FK +RKV+ K+L +    K+ E F V++ G++         FNASLGTYHD
Sbjct: 540 LSGEQKKAIVDLLFKTNRKVTVKQLKEDYFKKIECFDSVEISGVEDR----FNASLGTYHD     596

Query: 600 LEKIL-DKDFLDNPDNESILEDIVQTLTLFEDREMIKKRLENYKDLFTESQLKKLYRRHY     658
           L KI+ DKDFLDN +NE ILEDIV TLTLFEDREMI++RL Y  LF +  +K+L RR Y
Sbjct: 597 LLKIIKDKDFLDNEENEDILEDIVLTLTLFEDREMIEERLKTYAHLFDDKVMKQLKRRRY     656
```

-continued

```
Query:   659 TGWGRLSAKLINGIRDKESQKTILDYLIDDGRSNRNFMQLINDDGLSFKSIISKAQAGSH   718
             TGWGRLS KLINGIRDK+S KTILD+L  DG +NRNFMQLI+DD L+FK  I KAQ
Sbjct:   657 TGWGRLSRKLINGIRDKQSGKTILDFLKSDGFANRNFMQLIHDDSLTFKEDIQKAQVSGQ   716

Query:   719 SDNLKEVVGELAGSPAIKKGILQSLKIVDELVKVMG-YEPEQIVVEMAPENQTTNQGRRN   777
             D+L E +  LAGSPAIKKGILQ++K+VDELVKVMG ++PE IV+EMARENQTT +G++N
Sbjct:   717 GDSLHEHIANLAGSPAIKKGILQTVKVVDELVKVMGRHKPENIVIEMARENQTTQKGQKN   776

Query:   778 SRQRYKLLDDGVKNLASDLNGNILKEYPTDNQALQNERLFLYYLQNGRDMYTGEALDIDN   837
             SR+R K +++G+K L S      ILKE+P +N  LQNE+L+LYYLQNGRDMY  + LDI+
Sbjct:   777 SRERMKRIEEGIKELGS----QILKEHPVENTQLQNEKLYLYYLQNGRDMYVDQELDINR   832

Query:   838 LSQYDIDHIIPQAFIKDDSIDNRVLVSSAKNRGKSDDVPSLEIVKDCKVFWKKLLDAKLM   897
             LS YD+DHI+PQ+F+KDDSIDN+VL  S KNRGKSD+VPS E+VK  K +W++LL+AKL+
Sbjct:   833 LSDYDVDHIVPQSFLKDDSIDNKVLTRSDKNRGKSDNVPSEEVVKKMKNYWRQLLNAKLI   892

Query:   898 SQRKYDNLTKAERGGLTSDDKARFIQRQLVETRQITKHVARILDERFNNELDSKGRRIRK   957
             +QRK+DNLTKAERGGL+  DKA FI+RQLVETRQITKHVA+ILD R N + D   + IR+
Sbjct:   893 TQRKFDNLTKAERGGLSELDKAGFIKRQLVETRQITKHVAQILDSRMNTKYDENDKLIRE   952

Query:   958 VKIVTLKSNLVSNFRKEFGFYKIREVNNYHHAHDAYLNAVVAKAILTKYPQLEPEFVYGD  1017
             VK++TLKS LVS+FRK+F FYK+RE+NNYHHAHDAYLNAVV  A++ KYP+LE EFVYGD
Sbjct:   953 VKVITLKSKLVSDFRKDFQFYKVREINNYHHAHDAYLNAVVGTALIKKYPKLESEFVYGD  1012

Query:  1018 YPKYN-------SYKTRKSATEKLFFYSNIMNFFKTKVTLADGTVVVKDDIEVNNDTGEI  1070
             Y Y+       S +    AT K FFYSNIMNFFKT++TLA+G + +  IE N +TGEI
Sbjct:  1013 YKVYDVRKMIAKSEQEIGKATAKYFFYSNIMNFFKTEITLANGEIRKRPLIETNGETGEI  1072

Query:  1071 VWDKKKHFATVRKVLSYPQNNIVKKTEIQTGGFSKESILAHGNSDKLIPRKTKDIYLDPK  1130
             VWDK + FATVRKVLS PQ NIVKKTE+QTGGFSKESIL  NSDKLI RK KD   DPK
Sbjct:  1073 VWDKGRDFATVRKVLSMPQVNIVKKTEVQTGGFSKESILPKRNSDKLIARK-KD--WDPK  1129

Query:  1131 KYGGFDSPIVAYSVLVVADIKKGKAQKLKTVTELLGITIMERSRFEKNPSAFLESKGYLN  1190
             KYGGFDSP VAYSVLVVA ++KGK++KLK+V ELLGITIMERS FEKNP  FLE+KGY
Sbjct:  1130 KYGGFDSPTVAYSVLVVAKVEKGKSKKLKSVKELLGITIMERSSFEKNPIDFLEAKGYKE  1189

Query:  1191 IRADKLIILPKYSLFELENGRRRLLASAGELQKGNELALPTQFMKFLYLASRYNESKGKP  1250
             ++ D +I LPKYSLFELENGR+R+LASAGELQKGNELALP++++ FLYLAS Y + KG P
Sbjct:  1190 VKKDLIIKLPKYSLFELENGRKRMLASAGELQKGNELALPSKYVNFLYLASHYEKLKGSP  1249

Query:  1251 EEIEKKQEFVNQHVSYFDDILQLINDFSKRVILADANLEKINKLYQDNKENISVDELANN  1310
             E+ E+KQ FV QH  Y D+I++ I+++FSKRVILADANL+K+   Y +++   + E A N
Sbjct:  1250 EDNEQKQLFVEQHKHYLDEIIEQISEFSKRVILADANLDKVLSAYNKHRDK-PIREQAEN  1308

Query:  1311 IINLFTFTSLGAPAAFKFFDKIVDRKRYTSTKEVLNSTLIHQSITGLYETRIDLGKLGED  1370
             II+LFT T+LGAPAAFK+FD  +DRKRYTSTKEVL++TLIHQSITGLYETRIDL +LG D
Sbjct:  1309 IIHLFTLTNLGAPAAFKYFDTTIDRKRYTSTKEVLDATLIHQSITGLYETRIDLSQLGGD  1368
```

SEQ ID 4210 (GBS317) was expressed in *E. coli* as a GST-fusion product. SDS-PAGE analysis of total cell extract is shown in FIG. 27 (lane 2; MW 179.3 kDa) and in FIG. 159 (lane 5 & 6; MW 180 kDa).

It was also expressed in *E. coli* as a His-fusion product. SDS-PAGE analysis of total cell extract is shown in FIG. 27 (lane 3; MW 154.3 kDa) and in FIG. 159 (lane 9 & 10; MW 154 kDa).

GBS317-GST was purified as shown in FIG. 224, lane 9-10. GBS317-His was purified as shown in FIG. 222, lane 9.

GBS317N was expressed in *E. coli* as a GST-fusion product. SDS-PAGE analysis of total cell extract is shown in FIG. 149 (lane 24; MW 116 kDa).

Figure 166:
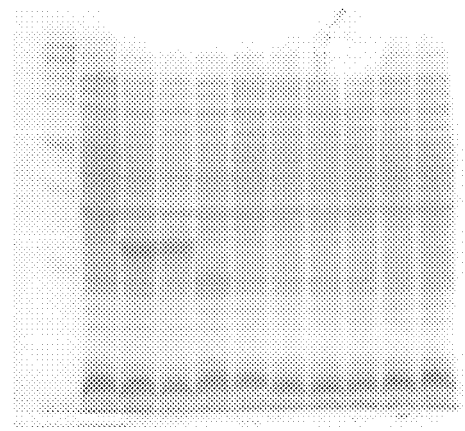

GBS317C was expressed in *E. coli* as a GST-fusion product. SDS-PAGE analysis of total cell extract is shown in FIG. 166 (lane 6-8; MW 92 kDa).

Figure 187:
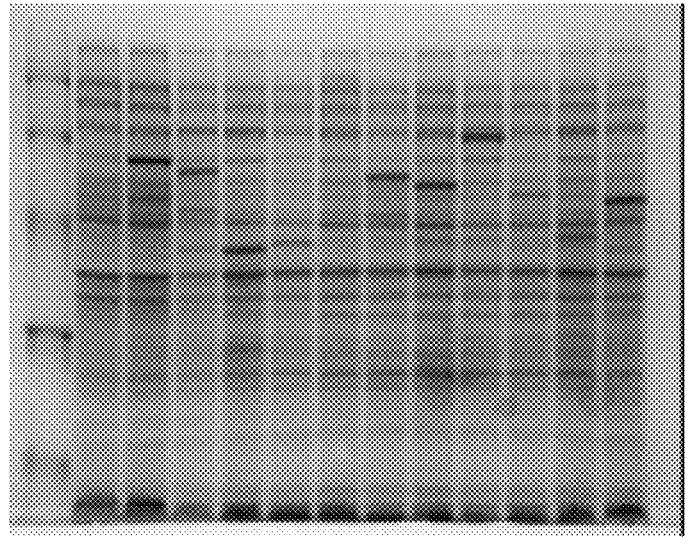

GBS317dN was expressed in *E. coli* as a GST-fusion product. SDS-PAGE analysis of total cell extract is shown in FIG. 187 (lane 7; MW 116 kDa). Purified GBS317dN-GST is shown in FIG. 245, lane 8.

GBS317C was expressed in *E. coli* as a GST-fusion product. SDS-PAGE analysis of total cell extract is shown in FIG. 188 (lane 13; MW 92 kDa). Purified GBS317dC-GST is shown in FIG. 245, lane 9.

Based on this analysis, it was predicted that these proteins and their epitopes could be useful antigens for vaccines or diagnostics.

EXAMPLE 1376

A DNA sequence (GBSx1461) was identified in *S. agalactiae* <SEQ ID 4213> which encodes the amino acid sequence <SEQ ID 4214>. Analysis of this protein sequence reveals the following:

```
Possible site: 25
>>> Seems to have a cleavable N-term signal seq.
        INTEGRAL    Likelihood = -11.94    Transmembrane    132-148  (123-156)
        INTEGRAL    Likelihood = -11.09    Transmembrane    190-206  (183-209)
        INTEGRAL    Likelihood =  -4.94    Transmembrane     95-111   (94-115)

----- Final Results -----
            bacterial membrane --- Certainty = 0.5776(Affirmative) < succ>
```

```
                           -continued
           bacterial outside --- Certainty = 0.0000(Not Clear) < succ>
           bacterial cytoplasm --- Certainty = 0.0000(Not Clear) < succ>
```

The protein has no significant homology with any sequences in the GENPEPT database.

A related sequence was also identified in GAS <SEQ ID 9133> which encodes the amino acid sequence <SEQ ID 9134>. Analysis of this protein sequence reveals the following:

```
Possible site: 22
>>> Seems to have a cleavable N-term signal seq.
     INTEGRAL     Likelihood = -7.32     Transmembrane     126-142
     INTEGRAL     Likelihood = -6.90     Transmembrane     178-194

----- Final Results -----
             bacterial membrane --- Certainty = 0.3930(Affirmative) < succ>
             bacterial outside --- Certainty = 0.0000(Not Clear) < succ>
             bacterial cytoplasm --- Certainty = 0.0000(Not Clear) < succ>
```

An alignment of the GAS and GBS proteins is shown below.

```
Identities = 94/204 (46%), Positives = 139/204 (68%)

Query:    5 LMKDKLLVVLTWIWIISLATLATIYIAWLIYPIEIQFLKLEKVVYLKAETIYYNFNKLMI   64
            +M +   ++ +W+W+++LA L TIY  WL YP+E+  LKLE+VV++   + I +N+N L+
Sbjct:    4 VMVENTKLLCSWVWLLALAILITIYSTWLWYPLEVDHLKLEQVVFMSKDAILHNYNGLLN   63

Query:   65 YLTHPFISDLNMPSFPSSEDGLKHFADVKYLFTLAHGLFVILTFPVIYFLRRGWKQKSIF  124
            YLT+PF++ L   +F SS DGLKHFADVK+LF L   +F+ L +P +    + K K  +
Sbjct:   64 YLTNPFVTRLEFANFHSSADGLKHFADVKWLFHLTQVVFLGLLYPTLKTFTQRLKTKRFW  123

Query:  125 LYEGFFKIAIMLPIFIVVCAFLLGFDQFFTLFHEVLFPGDSTWQFNPLTDPVIWILPETF  184
            L +   +A + P+ I + A  +GF+ FFTLFH+VLF GDS+W F+PL D VIWILPE F
Sbjct:  124 LLQKPLILAALFPLMIGLMASFIGFEHFFTLFHQVLFVGDSSWLFDPLKDSVIWILPEVF  183

Query:  185 FLHCFIIFLLIYETITIILLIIGR                                     208
            FLHCF+ F+++YE I    L+ + R
Sbjct:  184 FLHCFLFFMIVYEIILWSLVGLAR                                     207
```

SEQ ID 4214 (GBS167) was expressed in and purified from *E. coli*. The purified protein is shown in lanes 5 & 6 of FIG. 223.

Based on this analysis, it was predicted that these proteins and their epitopes could be useful antigens for vaccines or diagnostics.

EXAMPLE 1377

A DNA sequence (GBSx1462) was identified in *S. agalactiae* <SEQ ID 4217> which encodes the amino acid sequence <SEQ ID 4218>. This protein is predicted to be p-nitrophenyl phosphatase (pho2). Analysis of this protein sequence reveals the following:

```
Possible site: 48
>>> Seems to have no N-terminal signal sequence

----- Final Results -----
             bacterial cytoplasm --- Certainty = 0.3925(Affirmative) < succ>
             bacterial membrane --- Certainty = 0.0000(Not Clear) < succ>
             bacterial outside --- Certainty = 0.0000(Not Clear) < succ>
```

The protein has homology with the following sequences in the GENPEPT database.

```
>GP: CAB15219 GB: Z99120 similar to N-acetyl-glucosamine catabolism
[Bacillus subtilis]
```

```
                             -continued
Identities = 121/249 (48%), Positives = 172/249 (68%)

Query:    3 YKGYLIDLDGTIYKGKSRIPAGERFIERLQEKGIPYMLVTNNTTRTPESVQEMLRGFNVE    62
            YKGYLIDLDGT+Y G  +I       F+  L+++G+PY+ VTNN++RTP+ V + L  F++
Sbjct:    4 YKGYLIDLDGTMYNGTEKIEEACEFVRTLKDRGVPYLFVTNNSSRTPKQVADKLVSFDIP    63

Query:   63 TPLETIYTATMATVDYMNDMNRGKTAYVIGEEGLKKAIADAGYVEDTKNPAYVVVGLDWN   122
              E ++T +MAT ++     +  + YVIGEEG+++AI + G       +N  +VVVG+D +
Sbjct:   64 ATEEQVFTTSMATAQHIAQQKKDASVYVIGEEGIRQAIEENGLTFGGENADFVVVGIDRS   123

Query:  123 VTYDKLATATLAIQNGALFIGTNPDLNIPTERGLLPGAGSLNALLEAATRIKPVFIGKPN   182
              +TY+K A    LAI+NGA FI TN D+ IPTERGLLPG GSL ++L  +T ++PVFIGKP
Sbjct:  124 ITYEKFAVGCLAIRNGARFISTNGDIAIPTERGLLPGNGSLTSVLTVSTGVQPVFIGKPE   183

Query:  183 AIIMNKALEILNIPRNQAVMVGDNYLTDIMAGINNDIDTLLVTTGFTTVEEVPDLPIQPS   242
              +IIM +A+ +L       ++ +MVGDNY TDIMAGIN  +DTLLV TG T   E + D     +P+
Sbjct:  184 SIIMEQAMRVLGTDVSETLMVGDNYATDIMAGINAGMDTLLVHTGVTKREHMTDDMEKPT   243

Query:  243 YVLASLDEW                                                    251
              +  +  SL EW
Sbjct:  244 HAIDSLTEW                                                    252
```

A related DNA sequence was identified in *S. pyogenes* <SEQ ID 4219> which encodes the amino acid sequence <SEQ ID 4220>. Analysis of this protein sequence reveals the following:

```
Possible site: 48
>>> Seems to have no N-terminal signal sequence
    INTEGRAL    Likelihood = -0.53    Transmembrane    128-144 (128-144)

----- Final Results -----
              bacterial membrane --- Certainty = 0.1213(Affirmative) < succ>
                bacterial outside --- Certainty = 0.0000(Not Clear)  < succ>
              bacterial cytoplasm --- Certainty = 0.0000(Not Clear)  < succ>
```

The protein has homology with the following sequences in the databases:

```
>GP: CAB15219 GB: Z99120 similar to N-acetyl-glucosamine catabolism
[Bacillus subtilis]
Identities = 121/250 (48%), Positives = 166/250 (66%), Gaps = 1/250 (0%)

Query:    3 YKGYLIDLDGTIYQGKNRIPAGERFIKRLQERGIPYLLVTNNTTRTPEMVQSMLANQFHV    62
            YKGYLIDLDGT+Y G  +I       F++ L++RG+PYL VTNN++RTP+ V   L + F +
Sbjct:    4 YKGYLIDLDGTMYNGTEKIEEACEFVRTLKDRGVPYLFVTNNSSRTPKQVADKLVS-FDI    62

Query:   63 ETSIETIYTATMATVDYMNDMNRGKTAYVIGETGLKSAIAAAGYVEELENPAYVVVGLDS   122
              + E ++T +MAT ++     +  + YVIGE G++ AI    G      EN  +VVVG+D
Sbjct:   63 PATEEQVFTTSMATAQHIAQQKKDASVYVIGEEGIRQAIEENGLTFGGENADFVVVGIDR   122

Query:  123 QVTYEMLAIATLAIQKGALFIGTNPDLNIPTERGLMPGAGALNALLEAATRVKPVFIGKP   182
              +TYE A+    LAI+ GA FI TN D+ IPTERGL+PG G+L ++L  +T V+PVFIGKP
Sbjct:  123 SITYEKFAVGCLAIRNGARFISTNGDIAIPTERGLLPGNGSLTSVLTVSTGVQPVFIGKP   182

Query:  183 NAIIMNKSLEVLGIQRSEAVMVGDNYLTDIMAGIQNDIATLVTTGFTRPEEVPTLPIQP    242
              +IIM +++  VLG    SE +MVGDNY TDIMAGI  + T+LV TG T+ E +     +P
Sbjct:  183 ESIIMEQAMRVLGTDVSETLMVGDNYATDIMAGINAGMDTLLVHTGVTKREHMTDDMEKP   242

Query:  243 DHVLSSLDEW                                                   252
              H +  SL EW
Sbjct:  243 THAIDSLTEW                                                   252
```

An alignment of the GAS and GBS proteins is shown below.

```
Identities = 207/250 (82%), Positives = 227/250 (90%), Gaps = 1/250 (0%)

Query:    3  YKGYLIDLDGTIYKGKSRIPAGERFIERLQEKGIPYMLVTNNTTRTPESVQEMLRG-FNV    61
             YKGYLIDLDGTIY+GK+RIPAGERFI+RLQE+GIPY+LVTNNTTRTPE VQ ML   F+V
Sbjct:    3  YKGYLIDLDGTIYQGKNRIPAGERFIKRLQERGIPYLLVTNNTTRTPEMVQSMLANQFHV    62
```

-continued

```
Query:   62 ETPLETIYTATMATVDYMNDMNRGKTAYVIGEEGLKKAIADAGYVEDTKNPAYVVVGLDW  121
            ET +ETIYTATMATVDYMNDMNRGKTAYVIGE GLK AIA AGYVE+ +NPAYVVVGLD
Sbjct:   63 ETSIETIYTATMATVDYMNDMNRGKTAYVIGETGLKSAIAAAGYVEELENPAYVVVGLDS  122

Query:  122 NVTYDKLATATLAIQNGALFIGTNPDLNIPTERGLLPGAGSLNALLEAATRIKPVFIGKP  181
            VTY+ LA ATLAIQ GALFIGTNPDLNIPTERGL+PGAG+LNALLEAATR+KPVFIGKP
Sbjct:  123 QVTYEMLAIATLAIQKGALFIGTNPDLNIPTERGLMPGAGALNALLEAATRVKPVFIGKP  182

Query:  182 NAIIMNKALEILNIPRNQAVMVGDNYLTDIMAGINNDIDTLLVTTGFTTVEEVPDLPIQP  241
            NAIIMNK+LE+L I R++AVMVGDNYLTDIMAGI NDI T+LVTTGFT  EEVP LPIQP
Sbjct:  183 NAIIMNKSLEVLGIQRSEAVMVGDNYLTDIMAGIQNDIATILVTTGFTRPEEVPTLPIQP  242

Query:  242 SYVLASLDEW  251
            +VL+SLDEW
Sbjct:  243 DHVLSSLDEW  252
```

A similar DNA sequence was identified in *S. pyogenes* <SEQ ID 4215> which encodes amino acid sequence <SEQ ID 4216>. An alignment of the GAS and GBS sequences follows:

```
Identities = 94/204 (46%), Positives = 139/204 (68%)

Query:    4 VMVENTKLLCSWVWLLALAILITIYSTWLWYPLEVDHLKLEQVVFMSKDAILHNYNGLLN   63
            +M +    ++ +W+W+++LA L TIY   WL YP+E+  LKLE+VV++  + I +N+N L+
Sbjct:    5 LMKDKLLVVLTWIWIISLATLATIYIAWLIYPIEIQFLKLEKVVYLKAETIYYNFNKLMI   64

Query:   64 YLTNPFVTRLEFANFHSSADGLKHFADVKWLFHLTQVVFLGLLYPTLKTFTQRLKTKRFW  123
            YLT+PF++ L   +F SS DGLKHFADVK+LF L   +F+ L +P +    + K K  +
Sbjct:   65 YLTHPFISDLNMPSFPSSEDGLKHFADVKYLFTLAHGLFVILTFPVIYFLRRGWKQKSIF  124

Query:  124 LLQKPLILAALFPLMIGLMASFIGFEHFFTLFHQVLFVGDSSWLFDPLKDSVIWILPEVF  183
            L +    +A + P+ I + A  +GF+ FFTLFH+VLF GDS+W F+PL D VIWILPE F
Sbjct:  125 LYEGFFKIAIMLPIFIVVCAFLLGFDQFFTLFHEVLFPGDSTWQFNPLTDPVIWILPETF  184

Query:  184 FLHCFLFFMIVYEIILWSLVGLAR  207
            FLHCF+ F+++YE I   L+ + R
Sbjct:  185 FLHCFIIFLLIYETITIILLIIGR  208
```

Based on this analysis, it was predicted that these proteins and their epitopes could be useful antigens for vaccines or diagnostics.

EXAMPLE 1378

A DNA sequence (GBSx1463) was identified in *S. agalactiae* <SEQ ID 4221> which encodes the amino acid sequence <SEQ ID 4222>. This protein is predicted to be oleoyl-acyl carrier protein thioesterase. Analysis of this protein sequence reveals the following:

```
Possible site: 39
>>> Seems to have no N-terminal signal sequence

----- Final Results -----
           bacterial cytoplasm --- Certainty = 0.3332(Affirmative) < succ>
            bacterial membrane --- Certainty = 0.0000(Not Clear)   < succ>
             bacterial outside --- Certainty = 0.0000(Not Clear)   < succ>
```

The protein has homology with the following sequences in the GENPEPT database.

```
>GP:BAB02069 GB:AB026647 acyl carrier protein thioesterase
[Arabidopsis thaliana]
Identities = 59/248 (23%), Positives = 104/248 (41%), Gaps = 30/248 (12%)

Query:    2 GLLYRETYEVPFYESDTNHYMKLPQLLALALQISAKQSLKLGIGDD-----IVFKRYGLV   56
            GL Y+E + V  YE +N    +   + L ++    +G D       ++ L+
Sbjct:   81 GLSYKEKFVVRSYEVGSNKTATVETIANLLQEVGCNHAQSVGFSTDGFATTTMRKLHLI  140
```

```
Query:  57 WVVTDYIIDIERLPKHAEKIVIETEAKAHNKLLCYRYFYIYGE-DGQKIITISSAFVLMD  115
           WV    I+I + P   + + IET  ++  ++   R + +     G+       +S +V+M+
Sbjct: 141 WVTARMHIEIYKYPAWGDVVEIETWCQSEGRIGTRRDWILKDSVTGEVTGRATSKWVMMN  200

Query: 116 FKTRKIHPVLDDITSIY---------------QSQRIKKVIRGPKYHPIGDSKVKQYHVR  160
           TR++  V DD+   Y                 ++ +KK+   PK         +    R
Sbjct: 201 QDTRRLQKVSDDVRDEYLVFCPQEPRLAFPEENNRSLKKI---PKLEDPAQYSMIGLKPR  257

Query: 161 YFDLDMNGHVNNSKYLEWMYDVLDLDFLSSHIPKKIDLKYIKEIQYGTDIKSHWYQDGLV  220
           DLDMN HVNN  Y+ W+ + +   + + +H   + I L Y +E Q     +    D L
Sbjct: 258 RADLDMNQHVNNVTYIGWVLESIPQEIVDTHELQVITLDYRRECQQDDVV------DSLT  311

Query: 221 TRHDIIGG  228
           T    IGG
Sbjct: 312 TTTSEIGG  319
```

A related DNA sequence was identified in *S. pyogenes* <SEQ ID 4223> which encodes the amino acid sequence <SEQ ID 4224>. Analysis of this protein sequence reveals the following:

```
Possible site: 54
>>> Seems to have no N-terminal signal sequence
    INTEGRAL     Likelihood = -3.88     Transmembrane     21-37 (21-38)

----- Final Results -----
           bacterial membrane --- Certainty = 0.2550(Affirmative) < succ>
             bacterial outside --- Certainty = 0.0000(Not Clear) < succ>
           bacterial cytoplasm --- Certainty = 0.0000(Not Clear) < succ>
```

The protein has homology with the following sequences in the databases:

```
>GP:AAB71730 GB:U65643 acyl-ACP thioesterase [Myristica fragrans]
Identities = 41/128 (32%), Positives = 67/128 (52%), Gaps = 11/128 (8%)

Query:  33 FIFMIKRGGLLVDILAYFALLNPDTRKVATIPEDLVAPFETDFVKKLHRV-----PKMPL   87
           F+     K G +L  + + ++N  TR+++ IPE++    E   FV+  H V       K+P
Sbjct: 147 FLRDCKTGEILTRATSVWVMMNKRTRRLSKIPEEVRVEIEPYFVE--HGVLDEDSRKLPK  204

Query:  88 LEQS----IDRDYYVRYFDIDMNGHVNNSKYLDWMYDVLGCEFLKTHQPLKMTLKYVKEV  143
           L   +    I R    R+ D+D+N HVNN KY+ W+ + +     L++H+   MTL+Y KE
Sbjct: 205 LNDNTANYIRRGLAPRWSDLDVNQHVNNVKYIGWILESVPSSLLESHELYGMTLEYRKEC  264

Query: 144 SPGGQITS  151
             G + S
Sbjct: 265 GKDGLLQS  272
```

An alignment of the GAS and GBS proteins is shown below.

```
Identities = 62/144 (43%), Positives = 94/144 (65%)

Query: 101 GQKIITISSAFVLMDFKTRKIHPVLDDITSIYQSQRIKKVIRGPKYHPIGDSKVKQYHVR  160
           G   ++ I + F L++  TRK+  +D+  +++   +KK+ R PK     +   S + Y+VR
Sbjct:  40 GGLLVDILAYFALLNPDTRKVATIPEDLVAPFETDFVKKLHRVPKMPLLEQSIDRDYYVR   99

Query: 161 YFDLDMNGHVNNSKYLEWMYDVLDLDFLSSHIPKKIDLKYIKEIQYGTDIKSHWYQDGLV  220
           YFD+DMNGHVNNSKYL+WMYDVL  +FL +H P K+  LKY+KE+  G    IS ++  D L
Sbjct: 100 YFDIDMNGHVNNSKYLDWMYDVLGCEFLKTHQPLKMTLKYVKEVSPGGQITSSYHLDQLT  159

Query: 221 TRHDIIGGDAIHAQARIEWQEKKE  244
           + H I      ++AQA IEW+ K+
Sbjct: 160 SYHQITSDGQLNAQAMIEWRAIKQ  183
```

Based on this analysis, it was predicted that these proteins and their epitopes could be useful antigens for vaccines or diagnostics.

EXAMPLE 1379

A DNA sequence (GBSx1464) was identified in *S. agalactiae* <SEQ ID 4225> which encodes the amino acid sequence <SEQ ID 4226>. This protein is predicted to be coproporphyrinogen III oxidase. Analysis of this protein sequence reveals the following:

```
Possible site: 40
>>> Seems to have no N-terminal signal sequence

----- Final Results -----
            bacterial cytoplasm --- Certainty = 0.1484(Affirmative) < succ>
             bacterial membrane --- Certainty = 0.0000(Not Clear)   < succ>
              bacterial outside --- Certainty = 0.0000(Not Clear)   < succ>
```

The protein has homology with the following sequences in the GENPEPT database.

```
>GP:BAB05062 GB:AP001511 coproporphyrinogen III oxidase
[Bacillus halodurans]
Identities = 173/375 (46%), Positives = 248/375 (66%), Gaps = 5/375 (1%)

Query:    5 PTSAYVHIPFCTQICYYCDFSKVFIKNQPVDAYLQALIREFR----SYDITELRTLYIGG   60
            P +AY+HIPFC  ICYYCDF+K ++KNQPV+ YLQAL  E              L+TLY+GG
Sbjct:    2 PKAAYIHIPFCEHICYYCDFNKFYLKNQPVNEYLQALETEMAMVVAEQPTKSLQTLYVGG   61

Query:   61 GTPTSISAVQLDYLLTELSRDLNLNTLEEFTIEANPGDLTVDKIEVLQKSAVNRVSLGVQ  120
            GTPT+++A QL  LL  + R L L+ LEEFT E NP  +  +K++VL+    V+R+S+GVQ
Sbjct:   62 GTPTALTADQLAQLLASIKRTLPLSDLEEFTFEVNPDSIDEEKLDVLRSYGVDRLSIGVQ  121

Query:  121 TFNDKHLKRIGRSHNEAQIYSTIDALKTAGFQNISIDLIYALPGQTMDDVRSNVAKALSL  180
            F   LK IGR+H++  +    ++   + AGF N+S+DL+  LP QT +     + +A +L
Sbjct:  122 AFQPLLLKEIGRTHDQKSVEQAVEKSRQAGFANLSLDLMLGLPKQTPEMFAETLKEAFAL  181

Query:  181 NIPHLSLYSLILEHHTVFMNKMRRGKLHLPTEDLEAEMFEYIISEMERNGFEHYEISNFT  240
             + HLS YSL +E   TVF N+ R+G+L LP ED E +M+  +  E  E++GF+ YEISNF
Sbjct:  182 EVEHLSCYSLKVEAKTVFYNRQRQGRLTLPPEDDEVKMYRQLCYETEKHGFKQYEISNFA  241

Query:  241 KPGFESRHNLMYWDNVEYYGVGAGASGYLDGIRYRNRGPIQHYLKGVSEGNARLSE-EVL  299
            K G+ESRHNL+YW+N EYYG GAGA GY+ G+RY N GP+  YL+ + EG    + E   +
Sbjct:  242 KKGYESRHNLVYWNNDEYYGFGAGAHGYVGGVRYMNHGPLPKYLQAMEEGRRPVFESHHV  301

Query:  300 SKNEMMEEELFLGLRKKEGVSIGKFEQKFGTSFEKRYGQIVQELQSDGLLKENNGFIQMT  359
            S+ E  MEE++FLGLRK+ GV      F ++FG S    Y + + +L +  LL+  +++T
Sbjct:  302 SRVEQMEEQMFLGLRKRSGVEERVFVERFGVSMFSLYEKQIAQLVARCLLERTDDRVRLT  361

Query:  360 KKGLFLGDTVAEKFI                                              374
            +GL LG+ V E+F+
Sbjct:  362 DEGLLLGNEVFEQFL                                              376
```

A related DNA sequence was identified in *S. pyogenes* <SEQ ID 4227> which encodes the amino acid sequence <SEQ ID 4228>. Analysis of this protein sequence reveals the following:

```
Possible site: 34
>>> Seems to have no N-terminal signal sequence

----- Final Results -----
            bacterial cytoplasm --- Certainty = 0.3202(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below.

```
Identities = 304/376 (80%), Positives = 343/376 (90%)

Query:    1 MLKKPTSAYVHIPFCTQICYYCDFSKVFIKNQPVDAYLQALIREFRSYDITELRTLYIGG   60
            M KKPTSAYVHIPFCTQICYYCDFSKVFI+NQPVDAYL+ALI+EF SY I +L+TLYIGG
```

```
                         -continued
Sbjct:  33 MSKKPTSAYVHIPFCTQICYYCDFSKVFIQNQPVDAYLKALIQEFDSYGIRDLKTLYIGG  92

Query:  61 GTPTSISAVQLDYLLTELSRDLNLNTLEEFTIEANPGDLTVDKIEVLQKSAVNRVSLGVQ  120
           GTPT+I+A QL+YLL  L R+LNL+ LEEFTIEANPGDLT +KI VLQ+SAVNR+SLGVQ
Sbjct:  93 GTPTAITAKQLEYLLNHLERNLNLDDLEEFTIEANPGDLTPEKIAVLQRSAVNRISLGVQ  152

Query: 121 TFNDKHLKRIGRSHNEAQIYSTIDALKTAGFQNISIDLIYALPGQTMDDVRSNVAKALSL  180
           TFN+K LK+IGRSHNE QIYSTI  LKTAGF NISIDLIYALPGQT+D V+ NVAKAL+L
Sbjct: 153 TFNNKQLKQIGRSHNEEQIYSTIANLKTAGFHNISIDLIYALPGQTLDQVKENVAKALAL  212

Query: 181 NIPHLSLYSLILEHHTVFMNKMRRGKLHLPTEDLEAEMFEYIISEMERNGFEHYEISNFT  240
           +IPHLSLYSLILEHHTVFMNKMRRGKL+LPTEDLEAEMFEYIISEME NGFEHYEISNFT
Sbjct: 213 DIPHLSLYSLILEHHTVFMNKMRRGKLNLPTEDLEAEMFEYIISEMEANGFEHYEISNFT  272

Query: 241 KPGFESRHNLMYWDNVEYYGVGAGASGYLDGIRYRNRGPIQHYLKGVSEGNARLSEEVLS  300
           KPGFESRHNLMYWDNVEY+G GAGASGYL+GIRY+NR PIQHYLK V  GNARL+EEVL
Sbjct: 273 KPGFESRHNLMYWDNVEYFGCGAGASGYLNGIRYQNRVPIQHYLKAVEAGNARLNEEVLR  332

Query: 301 KNEMMEEELFLGLRKKEGVSIGKFEQKFGTSFEKRYGQIVQELQSDGLLKENNGFIQMTK  360
           K EMMEEELFLGLRKK GVSI +F++KFG SFE+RYG IV+ELQ+ GLL +++ F++MTK
Sbjct: 333 KEEMMEEELFLGLRKKTGVSIQRFQEKFGMSFEERYGNIVRELQNQGLLVKDDAFVRMTK  392

Query: 361 KGLFLGDTVAEKFIVE                                             376
           KGLFLGD+VAE+FI++
Sbjct: 393 KGLFLGDSVAERFILD                                             408
```

Based on this analysis, it was predicted that these proteins and their epitopes could be useful antigens for vaccines or diagnostics.

EXAMPLE 1380

A DNA sequence (GBSx1465) was identified in *S. agalactiae* <SEQ ID 4229> which encodes the amino acid sequence <SEQ ID 4230>. Analysis of this protein sequence reveals the following:

```
Possible site: 52
>>> Seems to have no N-terminal signal sequence

----- Final Results -----
          bacterial cytoplasm --- Certainty = 0.3729(Affirmative) < succ>
          bacterial membrane  --- Certainty = 0.0000(Not Clear)   < succ>
          bacterial outside   --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1381

A DNA sequence (GBSx1466) was identified in *S. agalactiae* <SEQ ID 4231> which encodes the amino acid sequence <SEQ ID 4232>. Analysis of this protein sequence reveals the following:

```
Possible site: 61
>>> Seems to have no N-terminal signal sequence

----- Final Results -----
          bacterial cytoplasm --- Certainty = 0.2989(Affirmative) < succ>
          bacterial membrane  --- Certainty = 0.0000(Not Clear)   < succ>
          bacterial outside   --- Certainty = 0.0000(Not Clear)   < succ>
```

The protein has no significant homology with any sequences in the GENPEPT database.

A related DNA sequence was identified in *S. pyogenes* <SEQ ID 4233> which encodes the amino acid sequence <SEQ ID 4234>. Analysis of this protein sequence reveals the following:

```
Possible site: 57
>>> Seems to have no N-terminal signal sequence
```

```
----- Final Results -----
         bacterial cytoplasm --- Certainty = 0.2993(Affirmative) < succ>
         bacterial membrane  --- Certainty = 0.0000(Not Clear)   < succ>
         bacterial outside   --- Certainty = 0.0000(Not Clear)   < succ>
```

An alignment of the GAS and GBS proteins is shown below.

```
Identities = 36/109 (33%), Positives = 58/109 (53%), Gaps = 6/109 (5%)

Query:  9 WAKHKYLVLSKSQKIYLDIRQTLKSPNCT---VLDVQSLIDQAVLLEESPSQVTNAYMHI   65
          WA KY V++ SQ+ Y  +R+  K        VL    LI++A  +  +   +  AY H+
Sbjct: 13 WAYQKYWVMAHSQQHYNALRELFKGNQWSEEKVLTFHCLIEEAQAIPPTVKSLRTAYQHV   72

Query: 66 WGYFKNKAERQEKEEFLTLLEKYRKTGYQRRKLLAFLKQLLAKYPNSYL             114
          WGYFK  A ++EK+ F  L  +      +  ++L FL+++ A Y  SYL
Sbjct: 73 WGYFKKVASQEEKDHFKDLDAQLET---KSEEMLCFLQEMTAHYQPSYL             118
```

Based on this analysis, it was predicted that these proteins and their epitopes could be useful antigens for vaccines or diagnostics.

EXAMPLE 1382

A DNA sequence (GBSx1467) was identified in *S. agalactiae* <SEQ ID 4235> which encodes the amino acid sequence <SEQ ID 4236>. This protein is predicted to be mrsA (mrsA). Analysis of this protein sequence reveals the following:

```
Possible site: 35
>>> Seems to have no N-terminal signal sequence
    INTEGRAL    Likelihood = -0.96    Transmembrane    56-72 (56-72)

----- Final Results -----
         bacterial membrane  --- Certainty = 0.1383(Affirmative) < succ>
         bacterial outside   --- Certainty = 0.0000(Not Clear)   < succ>
         bacterial cytoplasm --- Certainty = 0.0000(Not Clear)   < succ>
```

The protein has homology with the following sequences in the GENPEPT database.

```
>GP:CAB11970 GB:Z99105 similar to phosphoglucomutase (glycolysis)
[Bacillus subtilis]
Identities = 284/451 (62%), Positives = 353/451 (77%), Gaps = 4/451 (0%)

Query:   1 MGKYFGTDGVRGEANVELTPELAFKLGRFGGYVLSQHETDRPRVFVARDTRISGEMLESA    60
           MGKYFGTDGVRG AN ELTPELAFK+GRFGGYVL++ +   RP+V + RDTRISG MLE A
Sbjct:   1 MGKYFGTDGVRGVANSELTPELAFKVGRFGGYVLTK-DKQRPKVLIGRDTRISGHMLEGA    59

Query:  61 LIAGLLSVGIEVYKLGVLATPGVSYLVRTEKASAGVMISASHNPALDNGIKFFGSDGFKL   120
           L+AGLLS+G EV +LGV++TPGVSYL +    A AGVMISASHNP  DNGIKFFG DGFKL
Sbjct:  60 LVAGLLSIGAEVMRLGVISTPGVSYLTKAMDAEAGVMISASHNPVQDNGIKFFGGDGFKL   119

Query: 121 DDDRELEIEALLDAKEDTLPRPSAQGLGTLVDYPEGLRKYEKFMESTGI-DLEGMKVALD   179
            D++E EIE L+D  ED LPRP    LG + DY EG +KY +F++ T   D  G+ VALD
Sbjct: 120 SDEQEAEIERLMDEPEDKLPRPVGADLGLVNDYFEGGQKYLQFLKQTADEDFTGIHVALD   179

Query: 180 TANGAATASARNIFLDLNADISVIGDQPDGLNINDGVGSTHPEQLQSLVRENGSDIGLAF   239
             ANGA ++ A ++F DL+AD+S +G  P+GLNINDGVGSTHPE L + V+E  +D+GLAF
Sbjct: 180 CANGATSSLATHLFADLDADVSTMGTSPNGLNINDGVGSTHPEALSAFVKEKNADLGLAF   239

Query: 240 DGDSDRLIAVDENGEIVDGDKIMFIIGKYLSDKGQLAQNTIVTTVMSNLGFHKALDREGI   299
           DGD DRLIAVDE G IVDGD+IM+I  K+L  +G+L   +T+V+TVMSNLGF+KAL++EGI
Sbjct: 240 DGDGDRLIAVDEKGNIVDGDQIMYICSKHLKSEGRLKDDTVVSTVMSNLGFYKALEKEGI   299

Query: 300 HKAITAVGDRYVVEEMRKSGYNLGGEQSGHVIIMDYNTTGDGQLTAIQLTKVMKETGKKL   359
              TAVGDRYVVE M+K GYN+GGEQSGH+I +DYNTTGDG L+AI L    +K TGK L
Sbjct: 300 KSVQTAVGDRYVVEAMKKDGYNVGGEQSGHLIFLDYNTTGDGLLSAIMLMNTLKATGKPL   359

Query: 360 SELASEVTIYPQKLVNIRVENNMKDKAMEVPAIAEIIAKMEEEMDGNGRILVRPSGTEPL   419
           SELA+E+  +PQ LVN+RV +  K  K  E     +I+++E+EM+G+GRILVRPSGTEPL
```

```
                              -continued
Sbjct: 360 SELAAEMQKFPQLLVNVRVTD--KYKVEENEKVKAVISEVEKEMNGDGRILVRPSGTEPL 417

Query: 420 LRVMAEAPTNEAVDYYVDTIADVVRTEIGLD                             450
           +RVMAEA T E  D YV+ I +VVR+E+GL+
Sbjct: 418 VRVMAEAKTKELCDEYVNRIVEVVRSEMGLE                             448
```

A related DNA sequence was identified in *S. pyogenes* <SEQ ID 4237> which encodes the amino acid sequence <SEQ ID 4238>. Analysis of this protein sequence reveals the following:

```
Possible site: 35
>>> Seems to have no N-terminal signal sequence
     INTEGRAL      Likelihood = -0.96     Transmembrane     56-72 (56-72)

----- Final Results -----
              bacterial membrane --- Certainty = 0.1383(Affirmative) < succ>
                bacterial outside --- Certainty = 0.0000(Not Clear)  < succ>
              bacterial cytoplasm --- Certainty = 0.0000(Not Clear)  < succ>
```

The protein has homology with the following sequences in the databases:

```
>GP:CAB11970 GB:Z99105 similar to phosphoglucomutase (glycolysis)
[Bacillus subtilis]
Identities = 287/451 (63%), Positives = 346/451 (76%), Gaps = 4/451 (0%)

Query:   1 MGKYFGTDGVRGEANVELTPELAFKLGRFGGYVLSQHETERPKVFVARDTRISGEMLESA   60
           MGKYFGTDGVRG AN ELTPELAFK+GRFGGYVL++ + +RPKV + RDTRISG MLE A
Sbjct:   1 MGKYFGTDGVRGVANSELTPELAFKVGRFGGYVLTK-DKQRPKVLIGRDTRISGHMLEGA   59

Query:  61 LIAGLLSVGIEVYKLGVLATPGVSYLVRTEKASAGVMISASHNPALDNGIKFFGNDGFKL  120
           L+AGLLS+G EV +LGV++TPGVSYL +   A AGVMISASHNP  DNGIKFFG DGFKL
Sbjct:  60 LVAGLLSIGAEVMRLGVISTPGVSYLTKAMDAEAGVMISASHNPVQDNGIKFFGGDGFKL  119

Query: 121 ADDQELEIEALLDAPEDTLPRPSAEGLGTLVDYPEGLRKYEKFLVTTGT-DLSGMTVALD  179
           +D+QE EIE L+D PED LPRP    LG + DY EG +KY +FL T    D+G+ VALD
Sbjct: 120 SDEQEAEIERLMDEPEDKLPRPVGADLGLVNDYFEGGQKYLQFLKQTADEDFTGIHVALD  179

Query: 180 TANGAASVSARDVFLDLNAEIAVIGEKPNGLNINDGVGSTRPEQLQELVKETGADLGLAF  239
                 ANGA S  A  +F DL+A+++ +G  PNGLNINDGVGST  PE L    VKE  ADLGLAF
Sbjct: 180 CANGATSSLATHLFADLDADVSTMGTSPNGLNINDGVGSTHPEALSAFVKEKNADLGLAF  239

Query: 240 DGDSDRLIAVDETGEIVDGDRIMFIIGKYLSEKGLLAHNTIVTTVMSNLGFHKALDKQGI  299
           DGD DRLIAVDE G IVDGD+IM+I  K+L  +G L  +T+V+TVMSNLGF+KAL+K+GI
Sbjct: 240 DGDGDRLIAVDEKGNIVDGDQIMYICSKHLKSEGRLKDDTVVSTVMSNLGFYKALEKEGI  299

Query: 300 NKAITAVGDRYVVEEMRSSGYNLGGEQSGHVIIMDYNTTGDGQLTAIQLAKVMKETGKSL  359
             TAVGDRYVVE M+  GYN+GGEQSGH+I +DYNTTGDG L+AI L   +K TGK L
Sbjct: 300 KSVQTAVGDRYVVEAMKKDGYNVGGEQSGHLIFLDYNTTGDGLLSAIMLMNTLKATGKPL  359

Query: 360 SELAAEVTIYPQKLVNIRVENSMKERAMEVPAIANIIAKMEDEMAGNGRILVRPSGTEPL  419
           SELAAE+   +PQ LVN+RV +  K + E    + +I+++ EM G+GRILVRPSGTEPL
Sbjct: 360 SELAAEMQKFPQLLVNVRVTD--KYKVEENEKVKAVISEVEKEMNGDGRILVRPSGTEPL  417

Query: 420 LRVMAEAPTDAEVDYYVDTIADVVRTEIGCD                             450
           +RVMAEA T   D YV+ I +VVR+E+G +
Sbjct: 418 VRVMAEAKTKELCDEYVNRIVEVVRSEMGLE                             448
```

An alignment of the GAS and GBS proteins is shown below.

```
Identities = 400/450 (88%), Positives = 429/450 (94%)

Query:   1 MGKYFGTDGVRGEANVELTPELAFKLGRFGGYVLSQHETDRPRVFVARDTRISGEMLESA   60
           MGKYFGTDGVRGEANVELTPELAFKLGRFGGYVLSQHET+RP+VFVARDTRISGEMLESA
Sbjct:   1 MGKYFGTDGVRGEANVELTPELAFKLGRFGGYVLSQHETERPKVFVARDTRISGEMLESA   60

Query:  61 LIAGLLSVGIEVYKLGVLATPGVSYLVRTEKASAGVMISASHNPALDNGIKFFGSDGFKL  120
           LIAGLLSVGIEVYKLGVLATPGVSYLVRTEKASAGVMISASHNPALDNGIKFFG+DGFKL
Sbjct:  61 LIAGLLSVGIEVYKLGVLATPGVSYLVRTEKASAGVMISASHNPALDNGIKFFGNDGFKL  120
```

-continued

```
Query:  121 DDDRELEIEALLDAKEDTLPRPSAQGLGTLVDYPEGLRKYEKFMESTGIDLEGMKVALDT  180
            DD+ELEIEALLDA EDTLPRPSA+GLGTLVDYPEGLRKYEKF+ +TG DL GM VALDT
Sbjct:  121 ADDQELEIEALLDAPEDTLPRPSAEGLGTLVDYPEGLRKYEKFLVTTGTDLSGMTVALDT  180

Query:  181 ANGAATASARNIFLDLNADISVIGDQPDGLNINDGVGSTHPEQLQSLVRENGSDIGLAFD  240
            ANGAA+ SAR++FLDLNA+I+VIG++P+GLNINDGVGST PEQLQ LV+E G+D+GLAFD
Sbjct:  181 ANGAASVSARDVFLDLNAEIAVIGEKPNGLNINDGVGSTRPEQLQELVKETGADLGLAFD  240

Query:  241 GDSDRLIAVDENGEIVDGDKIMFIIGKYLSDKGQLAQNTIVTTVMSNLGFHKALDREGIH  300
            GDSDRLIAVDE GEIVDGD+IMFIIGKYLS+KG LA NTIVTTVMSNLGFHKALD++GI+
Sbjct:  241 GDSDRLIAVDETGEIVDGDRIMFIIGKYLSEKGLLAHNTIVTTVMSNLGFHKALDKQGIN  300

Query:  301 KAITAVGDRYVVEEMRKSGYNLGGEQSGHVIIMDYNTTGDGQLTAIQLTKVMKETGKKLS  360
            KAITAVGDRYVVEEMR SGYNLGGEQSGHVIIMDYNTTGDGQLTAIQL KVMKETGK LS
Sbjct:  301 KAITAVGDRYVVEEMRSSGYNLGGEQSGHVIIMDYNTTGDGQLTAIQLAKVMKETGKSLS  360

Query:  361 ELASEVTIYPQKLVNIRVENNMKDKAMEVPAIAEIIAKMEEMDGNGRILVRPSGTEPLL  420
            ELA+EVTIYPQKLVNIRVEN+MK++AMEVPAIA IIAKME+EM GNGRILVRPSGTEPLL
Sbjct:  361 ELAAEVTIYPQKLVNIRVENSMKERAMEVPAIANIIAKMEDEMAGNGRILVRPSGTEPLL  420

Query:  421 RVMAEAPTNEAVDYYVDTIADVVRTEIGLD                               450
            RVMAEAPT+  VDYYVDTIADVVRTEIG D
Sbjct:  421 RVMAEAPTDAEVDYYVDTIADVVRTEIGCD                               450
```

SEQ ID 4236 (GBS402) was expressed in *E. coli* as a GST-fusion product. SDS-PAGE analysis of total cell extract is shown in FIG. 84 (lane 5; MW 78 kDa).

GBS402-GST was purified as shown in FIG. 218, lane 3-5.

Based on this analysis, it was predicted that these proteins and their epitopes could be useful antigens for vaccines or diagnostics.

EXAMPLE 1383

A DNA sequence (GBSx1468) was identified in *S. agalactiae* <SEQ ID 4239> which encodes the amino acid sequence <SEQ ID 4240>. Analysis of this protein sequence reveals the following:

```
Possible site: 28
>>> Seems to have a cleavable N-term signal seq.

----- Final Results -----
          bacterial outside  --- Certainty = 0.3000(Affirmative) < succ>
          bacterial membrane --- Certainty = 0.0000(Not Clear)   < succ>
          bacterial cytoplasm --- Certainty = 0.0000(Not Clear)   < succ>
```

The protein has homology with the following sequences in the GENPEPT database.

```
>GP:CAB11969 GB:Z99105 ybbR [Bacillus subtilis]
Identities = 90/324 (27%), Positives = 167/324 (50%), Gaps = 18/324 (5%)

Query:   1 MKKFFTNKFWLGVVSLFLAILLFLTATATSMNHQDNSKIAG-----ASETYTHTLTDVPI   55
           M KF  N++ + +++L A+LL++    A + N      K G       S T   TLTD+P+
Sbjct:   1 MDKFLNNRWAVKIIALLFALLLYV---AVNSNQAPTPKKPGESFFPTSTTDEATLTDIPV   57

Query:  56 DIKYDSDDYFISGYSYGADVYMS-SVNRVKLDSEINEDTRKFKVVADLTNMKPGTHKVPL  114
              YD ++Y ++G     +V +  S + VK  +     T+ F++ AD+ ++K GTHKV L
Sbjct:  58 KAYYDDENYVVTGVPQTVNVTIKGSTSAVKKARQ----TKNFEIYADMEHLKTGTHKVEL  113

Query: 115 KVVNLPSGVNATVSPTTITVTMGKKKTKEFPV-YGHVNDKQIKAGYAVDKMSVDVSKVKV  173
           K  N+  G+   +++P+   TVT+ ++ TK FPV  + N  ++K GY+ ++   V    V++
Sbjct: 114 KAKNVSDGLTISINPSVTTVTIQERTTKSFPVEVEYYNKSKMKKGYSPEQPIVSPKNVQI  173

Query: 174 TSDESIIDRIDHVAANIPDDKVLDDDFNKTVTLQAVTADGTVLASIIHPSKATLSVKVKK  233
           T  +++ID I   A++  +   D+  K   +    DG L  + PS   ++V V
Sbjct: 174 TGSKNVIDNISLHKASVNLENA-DETIEKEAKVTVYDKDGNALPVDVEPSVIKITVPVTS  232

Query: 234 LTKTVPINLIPVGQFSDSISKINYKLSQEKAVISGTKEALEAISVIN-AEVDISDVTKNT  292
            +K VP   +  G    D +S  N +S   + +G+++   L+++   I+   +D+S + K++
Sbjct: 233 PSKKVPFKIERTGSLPDGVSIANIESSPSEVTVYGSQDVLDSLEFIDGVSLDLSKINKDS  292

Query: 293 --EKKINLSANNVSVDPAQVTVQL                                      314
              E   I L         + P++VT+ +
Sbjct: 293 DIEADIPLPDGVKKISPSKVTLHI                                      316
```

A related DNA sequence was identified in *S. pyogenes* <SEQ ID 4241> which encodes the amino acid sequence <SEQ ID 4242>. Analysis of this protein sequence reveals the following:

```
Possible site: 29
>>> Seems to have a cleavable N-term signal seq.

----- Final Results -----
              bacterial outside --- Certainty = 0.3000(Affirmative) < succ>
              bacterial membrane --- Certainty = 0.0000(Not Clear)  < succ>
              bacterial cytoplasm --- Certainty = 0.0000(Not Clear) < succ>
```

The protein has homology with the following sequences in the databases:

```
>GP:CAB11969 GB:Z99105 ybbR [Bacillus subtilis]
Identities = 81/322 (25%), Positives = 154/322 (47%), Gaps = 15/322 (4%)

Query:   1 MKRFLNSRPWLGMVSVFFAILLFLTAASSNH----NNSSSQIYSPIETYTHSLKDVPIDM   56
           M +FLN+R  + ++++ FA+LL++ A +SN        +    T    +L D+P+
Sbjct:   1 MDKFLNNRWAVKIIALLFALLLYV-AVNSNQAPTPKKPGESFFPTSTTDEATLTDIPVKA  59

Query:  57 KYDSDKYFISGYSYGAEVYLT-STNRIKLDSEVNNDTRNFKIVADLTHSHPGTVSVNLRV  115
              YD + Y ++G     V +  ST+ +K   +   T+NF+I AD+ H   GT   V L+
Sbjct:  60 YYDDENYVVTGVPQTVNVTIKGSTSAVKKARQ----TKNFEIYADMEHLKTGTHKVELKA  115

Query: 116 ENLPSGVTATVSPDKISVTIGKKESKVFPVRGS-VDAKQIANGYEISKIETGVNKVEVTS  174
           +N+  G+T +++P  +VTI ++ +K FPV    + ++ GY +      V++T
Sbjct: 116 KNVSDGLTISINPSVTTVTIQERTTKSFPVEVEYYNKSKMKKGYSPEQPIVSPKNVQITG  175

Query: 175 DESTIALIDHVVAKLPDDQVLDRNYSSRVTLQAVSADGTILASAIDPAKTNLSVAVKKIT  234
           ++ I I  A + +  D   +    DG L   ++P+   ++V V   +
Sbjct: 176 SKNVIDNISLHKASVNLENA-DETIEKEAKVTVYDKDGNALPVDVEPSVIKITVPVTSPS  234

Query: 235 KSVPIRVEAVGMMDDSLSDIQYKLSKQTAVISGSREVLEDIDEII-AEVNISDVTKNT--  291
           K VP ++E  G + D +S    + S    + GS++VL+ ++ I    +++S + K++
Sbjct: 235 KKVPFKIERTGSLPDGVSIANIESSPSEVTVYGSQDVLDSLEFIDGVSLDLSKINKDSDI  294

Query: 292 SKTVSLSSSQVSIEPSVVTVQL                                       313
            + L     I PS VT+ +
Sbjct: 295 EADIPLPDGVKKISPSKVTLHI                                       316
```

An alignment of the GAS and GBS proteins is shown below.

```
Identities = 198/319 (62%), Positives = 251/319 (78%), Gaps = 1/319 (0%)

Query:   1 MKKFFTNKFWLGVVSLFLAILLFLTATATSMNHQDNSKIAGASETYTHTLTDVPIDIKYD   60
           MK+F  ++ WLG+VS+F AILLFLTA A+S ++   +S+I    ETYTH+L DVPID+KYD
Sbjct:   1 MKRFLNSRPWLGMVSVFFAILLFLTA-ASSNHNNSSSQIYSPIETYTHSLKDVPIDMKYD   59

Query:  61 SDDYFISGYSYGADVYMSSVNRVKLDSEINEDTRKFKVVADLTNMKPGTHKVPLKVVNLP  120
           SD YFISGYSYGA+VY++S NR+KLDSE+N DTR FK+VADLT+  PGT  V L+V NLP
Sbjct:  60 SDKYFISGYSYGAEVYLTSTNRIKLDSEVNNDTRNFKIVADLTHSHPGTVSVNLRVENLP  119

Query: 121 SGVNATVSPTTITVTMGKKKTKEFPVYGHVNDKQIKAGYAVDKMSVDVSKVKVTSDESII  180
           SGV ATVSP  I+VT+GKK++K FPV G V+ KQI  GY + K+   V+KV+VTSDES I
Sbjct: 120 SGVTATVSPDKISVTIGKKESKVFPVRGSVDAKQIANGYEISKIETGVNKVEVTSDESTI  179

Query: 181 DRIDHVAANIPDDKVLDDDFNKTVTLQAVTADGTVLASIIHPSKATLSVKVKKLTKTVPI  240
            ++IDHV A +PDD+VLD +++    VTLQAV+ADGT+LAS I P+K   LSV VKK+TK+VPI
Sbjct: 180 ALIDHVVAKLPDDQVLDRNYSSRVTLQAVSADGTILASAIDPAKTNLSVAVKKITKSVPI  239

Query: 241 NLIPVGQFSDSISKINYKLSQEKAVISGTKEALEAISVINAEVDISDVTKNTEKKINLSA  300
            +  VG   DS+S I YKLS++  AVISG++E LE I  I AEV+ISDVTKNT K ++LS+
Sbjct: 240 RVEAVGMMDDSLSDIQYKLSKQTAVISGSREVLEDIDEIIAEVNISDVTKNTSKTVSLSS  299

Query: 301 NNVSVDPAQVTVQLTTTKK                                          319
            +  VS++P+  VTVQLTTTKK
Sbjct: 300 SQVSIEPSVVTVQLTTTKK                                          318
```

SEQ ID 4240 (GBS99) was expressed in *E. coli* as a His-fusion product. SDS-PAGE analysis of total cell extract is shown in FIG. 17 (lane 6; MW 35.7 kDa). It was also expressed in *E. coli* as a GST-fusion product. SDS-PAGE analysis of total cell extract is shown in FIG. 21 (lane 9; MW 60.7 kDa).

Figure 293:
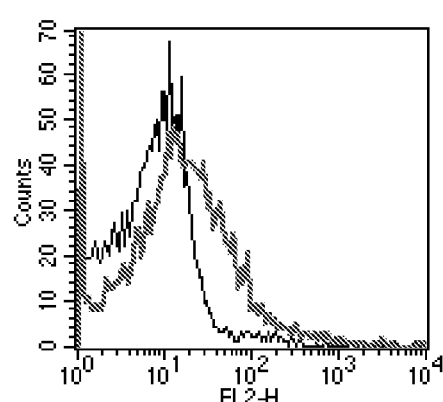

The GBS99-GST fusion product was purified (FIG. 197, lane 9) and used to immunise mice. The resulting antiserum was used for FACS (FIG. 293), which confirmed that the protein is immunoaccessible on GBS bacteria.

Based on this analysis, it was predicted that these proteins and their epitopes could be useful antigens for vaccines or diagnostics.

EXAMPLE 1384

A DNA sequence (GBSx1469) was identified in *S. agalactiae* <SEQ ID 4243> which encodes the amino acid sequence <SEQ ID 4244>. Analysis of this protein sequence reveals the following:

```
Possible site: 16
>>> Seems to have no N-terminal signal sequence

----- Final Results -----
            bacterial cytoplasm --- Certainty = 0.0503(Affirmative) < succ>
            bacterial membrane  --- Certainty = 0.0000(Not Clear)   < succ>
             bacterial outside  --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1385

A DNA sequence (GBSx1470) was identified in *S. agalactiae* <SEQ ID 4245> which encodes the amino acid sequence <SEQ ID 4246>. Analysis of this protein sequence reveals the following:

```
Possible site: 15
>>> Seems to have no N-terminal signal sequence
      INTEGRAL      Likelihood = -9.50      Transmembrane    20-36 (18-46)
      INTEGRAL      Likelihood = -7.64      Transmembrane    48-64 (42-68)
      INTEGRAL      Likelihood = -3.40      Transmembrane    80-96 (80-96)

----- Final Results -----
            bacterial membrane  --- Certainty = 0.4800(Affirmative) < succ>
             bacterial outside  --- Certainty = 0.0000(Not Clear)   < succ>
            bacterial cytoplasm --- Certainty = 0.0000(Not Clear)   < succ>
```

The protein has homology with the following sequences in the GENPEPT database.

```
>GP: CAB11968 GB: Z99105 alternate gene name: ybbQ~similar to
hypothetical proteins [Bacillus subtilis]
Identities = 125/253 (49%), Positives = 186/253 (73%), Gaps = 5/253 (1%)

Query:   27 MDIIIVAVLIYKFIKALAGTKIMSLIQGVILFIIIRFVSEWIGLTTITFLMNQIVTYGVI    86
            +DI++V  +IYK I  +  GTK + L++G+++ +++R  S+++GL+T+ +LM+Q +T+G +
Sbjct:   16 VDILLVWYVIYKLIMVIRGTKAVQLLKGIVVIVLVRMASQYLGLSTLQWLMDQAITWGFL    75

Query:   87 AGVVIFAPEIRTGLEKFGRTPQLFTQRSQLSSDE---KLVDALVKAVAYMSPRKIGALIS   143
               A ++IF PE+R  LE+ GR    F  RS   +E    K ++A+ KA+ YM+ R+IGAL++
Sbjct:   76 AIIIIFQPELRRALEQLGRGR--FFSRSGTPVEEAQQKTIEAITKAINYMAKRRIGALLT   133

Query:  144 IERTQTLQEYIATGIPLDADISSELLINIFIPNTPLHDGAVIVKDKKIATACSYLPLSES   203
              IER   + +YI TGIPL+A  +SSELLINIFIPNTPLHDGAVI+K+  +IA A   YLPLSES
Sbjct:  134 IERDTGMGDYIETGIPLNAKVSSELLINIFIPNTPLHDGAVIMKNNEIAAAACYLPLSES   193

Query:  204 SSISKEFGTRHRAAIGLSENSDALTVIVSEETGGISVALKGEFLHDLSKDSFEAILRTQL   263
                ISKE GTRHRAA+G+SE +D+LT+IVSEETGG SVA   G+   +L++++ + +L   +
Sbjct:  194 PFISKELGTRHRAAVGISEVTDSLTIIVSEETGGVSVAKNGDLHRELTEEALKEMLEAEF   253

Query:  264 IQNQEENSKLAWY                                                 276
             +N +  S   WY
Sbjct:  254 KKNTRDTSSNRWY                                                 266
```

A related DNA sequence was identified in *S. pyogenes* <SEQ ID 4247> which encodes the amino acid sequence <SEQ ID 4248>. Analysis of this protein sequence reveals the following:

```
Possible site: 23
>>> Seems to have no N-terminal signal sequence
     INTEGRAL     Likelihood = -6.64     Transmembrane     20-36 (19-40)
     INTEGRAL     Likelihood = -6.21     Transmembrane     48-64 (47-68)
     INTEGRAL     Likelihood = -2.07     Transmembrane     76-92 (76-92)

----- Final Results -----
               bacterial membrane --- Certainty = 0.3654(Affirmative) < succ>
               bacterial outside  --- Certainty = 0.0000(Not Clear)   < succ>
            bacterial cytoplasm   --- Certainty = 0.0000(Not Clear)   < succ>
```

The protein has homology with the following sequences in the databases:

```
>GP: BAB03984 GB: AP001507 unknown conserved protein [Bacillus halodurans]
Identities = 117/255 (45%), Positives = 178/255 (68%), Gaps = 6/255 (2%)

Query:  19 PWL-LAVHLLDILIVAYLIYRFIKALTGTKIMSLVQGVIFFLVLRFIAEWIGFTTITYLM    77
           PWL   +LDIL+V Y+IY+ I  + GT+ + L++G+    L++  I+ +   T+ +++
Sbjct:   8 PWLNYLTQILDILVVTYVIYKAIMIIRGTRAVQLLKGITVILIVYAISIFFNLRTLGWIV   67

Query:  78 NQVITYGVIAGVVIFTPEIRAGLEKFGRSTQVFLQKQYVSSESAL---VDALIKSVAYMG   134
           NQ ITYG++A ++IF PE+R  LE+ GR        F  +  + E  +  +DA++K+   YMG
Sbjct:  68 NQAITYGLLAVIIIFQPELRRALEQLGRGR--FFASRTANEEETMKKTIDAIVKASTYMG   125

Query: 135 PRKIGALIAIEQTQTLQEYIATGIPLNADISSQLLINIFIPNTPLHDGAVIVGQNKIVAA   194
           R+IGALI++E+    + +Y+  TGIP+NA+++S+LLIN FIPNTPLHDGAVI+  + I+AA
Sbjct: 126 KRRIGALISMERETGMTDYVETGIPMNANLTSELLINTFIPNTPLHDGAVIINNDTILAA   185

Query: 195 CAYLPLSESKAISKEFGTRHRAAIGLSENSDALTIIVSEETGAISVTRKGQFLHDLSTDE   254
               YLPLSE+   ISKE GTRHRAA+G+SE +D LTI+VSEETG IS+T+ G+      DL  ++
Sbjct: 186 ACYLPLSENPFISKELGTRHRAALGVSEVTDCLTIVVSEETGHISLTKNGELHRDLDEEQ   245

Query: 255 FETVLRTYLMSNSNV                                              269
           ++L    L+S + +
Sbjct: 246 LRSLLEAELISEAKM                                              260
```

An alignment of the GAS and GBS proteins is shown below.

```
Identities = 201/283 (71%), Positives = 239/283 (84%), Gaps = 2/283 (0%)

Query:    1 MDIFSAIDSKFWASIMENPWMILIHLMDIIIVAVLIYKFIKALAGTKIMSLIQGVILFII    60
            M+  S+ID KF  S+   +PW++ +HL+DI+IVA LIY+FIKAL GTKIMSL+QGVI F++
Sbjct:    1 MNNLSSIDIKFLLSLFADPWLLAVHLLDILIVAYLIYRFIKALTGTKIMSLVQGVIFFLV    60

Query:   61 IRFVSEWIGLTTITFLMNQIVTYGVIAGVVIFAPEIRTGLEKFGRTPQLFTQRSQLSSDE   120
            +RF++EWIG TTIT+LMNQ++TYGVIAGVVIF PEIR GLEKFGR+ Q+F Q+   +SS+
Sbjct:   61 LRFIAEWIGFTTITYLMNQVITYGVIAGVVIFTPEIRAGLEKFGRSTQVFLQKQYVSSES   120

Query:  121 KLVDALVKAVAYMSPRKIGALISIERTQTLQEYIATGIPLDADISSELLINIFIPNTPLH   180
            +LVDAL+K+VAYM PRKIGALI+IE+TQTLQEYIATGIPL+ADISS+LLINIFIPNTPLH
Sbjct:  121 ALVDALIKSVAYMGPRKIGALIAIEQTQTLQEYIATGIPLNADISSQLLINIFIPNTPLH   180

Query:  181 DGAVIVKDKKIATACSYLPLSESSSISKEFGTRHRAAIGLSENSDALTVIVSEETGGISV   240
            DGAVIV   KI  AC+YLPLSES +ISKEFGTRHRAAIGLSENSDALT+IVSEETG ISV
Sbjct:  181 DGAVIVGQNKIVAACAYLPLSESKAISKEFGTRHRAAIGLSENSDALTIIVSEETGAISV   240

Query:  241 ALKGEFLHDLSKDSFEAILRTQLIQNQEENSKLAWYNQLLRRK                  283
             KG+FLHDLS D FE +LRT L+ N    N   L WY ++L  K
Sbjct:  241 TRKGQFLHDLSTDEFETVLRTYLMSN--SNVTLPWYKKILGGK                  281
```

Based on this analysis, it was predicted that these proteins and their epitopes could be useful antigens for vaccines or diagnostics.

EXAMPLE 1386

A DNA sequence (GBSx1471) was identified in *S. agalactiae* <SEQ ID 4249> which encodes the amino acid sequence <SEQ ID 4250>. Analysis of this protein sequence reveals the following:

```
Possible site: 25
>>> Seems to have no N-terminal signal sequence
     INTEGRAL      Likelihood = -2.60      Transmembrane      33-49 (33-49)

----- Final Results -----
              bacterial membrane --- Certainty = 0.2041(Affirmative) < succ>
               bacterial outside --- Certainty = 0.0000(Not Clear)   < succ>
             bacterial cytoplasm --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1387

A DNA sequence (GBSx1472) was identified in *S. agalactiae* <SEQ ID 4251> which encodes the amino acid sequence <SEQ ID 4252>. Analysis of this protein sequence reveals the following:

```
Possible site: 15
>>> Seems to have no N-terminal signal sequence

----- Final Results -----
             bacterial cytoplasm --- Certainty = 0.1001(Affirmative) < succ>
              bacterial membrane --- Certainty = 0.0000(Not Clear)   < succ>
               bacterial outside --- Certainty = 0.0000(Not Clear)   < succ>
```

A related GBS nucleic acid sequence <SEQ ID 9781> which encodes amino acid sequence <SEQ ID 9782> was also identified.

The protein has homology with the following sequences in the GENPEPT database.

```
>GP: AAC84012 GB: AF080002 UDP-N-acetylmuramyl tripeptide synthetase
MurC [Heliobacillus mobilis]
Identities = 143/442 (32%), Positives = 229/442 (51%), Gaps = 17/442 (3%)

Query:   12 GKSAHYLLSKMGRGST-YPGSLALKFDKDILDTIAKDYE--IVVVTGTNGKTLTTALTVG   68
             GK+A +L  + G G T +PG +   +     IL  +A+   +   +VVTGTNGKT T+ +
Sbjct:    2 GKTAIWLNRRFGHGGTSFPGGIGRRVAPQILTALARQLKRGAMVVTGTNGKTTTSKMLAA   61

Query:   69 ILKEAFGQVVTNPSGANMITGIVSTFLTAKKSKSG--KKIAVLEIDEASLPRITQYIKPS  126
             I++++   +  N +GAN++  GI   F+  +         + ++E+DEA++P++  + +P
Sbjct:   62 IVEKSSLTLTHNRAGANLVGGITTAFIDSATIGGSITSDLGIIEVDEATIPQLVREVQPK  121

Query:  127 LFVFTNIFRDQMDRYGEIYTTYQMILDGAANAP-QATILANGDSPLFNS--KSVTNPVQF  183
              V  TN  FRDQ+DR+GE+  T  ++  +      P Q+  + N D PL    S K    V +
Sbjct:  122 GVVVTNFFRDQLDRFGELDKTVSLVGEALRLLPVQSIAVLNADDPLVASLGKDFPGRVLY  181

Query:  184 YGFNTDKHEPRLAHYNTEGILCPKCQAILTYRLNTYANLGDYTCPNCDFERPNLDYALTR  243
             +G +     + R     + E    C   C    LTY      + LG Y  C +C FERP         +T
Sbjct:  182 FGIDDRSYGAREMLQSAETRFCRLCGHPLTYDWFFFGQLGHYRCSHCGFERPEPKIKVTG  241

Query:  244 LTHLTNTSSGFVIDGQ----QYNINVGGLYNIYNALAAVSVAEYFGVEPSQIKDGFDKSR  299
             +              S F ++        Q     ++  G  YNIYNALAA++ A     +    I+  G       R
Sbjct:  242 IQLKGEEGSAFTVETPRGTWQLELSTPGFYNIYNALAAIASAIRLDLPEKAIRAGLQGYR  301

Query:  300 AVFGRQETFTIGN-KKCTLVLIKNPVGASQALDMIKLAPYPFSLSVLLNANYADGIDTSW  358
                FGR E     + + ++    L LIKNP  G + +      +    P  L V++N  N ADG D SW
Sbjct:  302 TNFGRMERIELEDGRRAFLALIKNPTGCDEVIRTLVQNRGPKRLLVIINDNAADGRDISW  361

Query:  359 IWDANFETI--LTMNIPEIFAGGVRHSEIARRLRVTGYDEKRIK-QADKLQDIMTMIEQQ  415
             +WDA+FE++   +    + +F  G+R   ++A RL  TG     + I+  +A+       I + +E
Sbjct:  362 LWDADFESLEPVYPELRSVFTSGLRGEDMALRLNYTGIPAESIRYEANVESAIRSALEMT  421
```

```
Query: 416 ET-EHAYILATYTAMLEFREIL                                      436
           E  E  YIL TYTA+LE +  L
Sbjct: 422 EPGETLYILPTYTALLESKAAL                                      443
```

A related DNA sequence was identified in *S. pyogenes* <SEQ ID 4253> which encodes the amino acid sequence <SEQ ID 4254>. Analysis of this protein sequence reveals the following:

```
Possible site: 35
>>> Seems to have an uncleavable N-term signal seq

----- Final Results -----
              bacterial membrane --- Certainty = 0.0000(Not Clear) < succ>
              bacterial outside  --- Certainty = 0.0000(Not Clear) < succ>
              bacterial cytoplasm --- Certainty = 0.0000(Not Clear) < succ>
```

An alignment of the GAS and GBS proteins is shown below.

```
Identities = 343/446 (76%), Positives = 393/446 (87%)

Query:    1 MKINTALGVAAGKSAHYLLSKMGRGSTYPGSLALKFDKDILDTIAKDYEIVVVTGTNGKT   60
            MK+  T LG+ AGK+A  +L+K+GRGSTYPG LAL  DKDIL  ++KDY+IVVVTGTNGKT
Sbjct:    1 MKMKTLLGIIAGKAAQSILTKLGRGSTYPGRLALACDKDILKDLSKDYDIVVVTGTNGKT   60

Query:   61 LTTALTVGILKEAFGQVVTNPSGANMITGIVSTFLTAKKSKSGKKIAVLEIDEASLPRIT  120
            LTTALTVGILKEAFG+++TNPSGANMITGI STFL AKK KS ++IAVLEIDEASLPRIT
Sbjct:   61 LTTALTVGILKEAFGEIITNPSGANMITGITSTFLAAKKGKSERQIAVLEIDEASLPRIT  120

Query:  121 QYIKPSLFVFTNIFRDQMDRYGEIYTTYQMILDGAANAPQATILANGDSPLFNSKSVTNP  180
            Y+KPSLFV+TNIFRDQMDRYGEIYTTYQMI+DGA NAP+ATILANGDSP+F+SK + NP
Sbjct:  121 TYLKPSLFVYTNIFRDQMDRYGEIYTTYQMIVDGARNAPKATILANGDSPIFSSKDIVNP  180

Query:  181 VQFYGFNTDKHEPRLAHYNTEGILCPKCQAILTYRLNTYANLGDYTCPNCDFERPNLDYA  240
            VQ+YGF+T KH P+LAHYNTEGILCPKC+ IL YRLNTYANLGDF C NC F+RP LDY
Sbjct:  181 VQYYGFDTAKHAPQLAHYNTEGILCPKCEHILQYRLNTYANLGDFVCLNCQFQRPTLDYQ  240

Query:  241 LTRLTHLTNTSSGFVIDGQQYNINVGGLYNIYNALAAVSVAEYFGVEPSQIKDGFDKSRA  300
            LT LT +T+ SS FVIDGQ Y INVGGLYNIYNALAAVSVAE+FGV P +IK GF+KS+A
Sbjct:  241 LTELTAITHQSSEFVIDGQNYKINVGGLYNIYNALAAVSVAEFFGVSPEKIKAGFNKSKA  300

Query:  301 VFGRQETFTIGNKKCTLVLIKNPVGASQALDMIKLAPYPFSLSVLLNANYADGIDTSWIW  360
            VFGRQETFT+G+K CTL+LIKNPVGASQAL+MI+LA YPFSLSVLLNANYADGIDTSWIW
Sbjct:  301 VFGRQETFTVGDKSCTLILIKNPVGASQALEMIQLADYPFSLSVLLNANYADGIDTSWIW  360

Query:  361 DANFETILTMNIPEIFAGGVRHSEIARRLRVTGYDEKRIKQADKLQDIMTMIEQQETEHA  420
            DANFE I   M I EI AGGVRHSEIARRLRVTG+D+ +IKQA+KL+ I+  IE+QE +HA
Sbjct:  361 DANFELITQMPITEINAGGVRHSEIARRLRVTGFDDTKIKQAEKLEQIIETIEKQEAKHA  420

Query:  421 YILATYTAMLEFREILANHNAIRKEM                                  446
            YILATYTAMLEFR +LA+ + + KEM
Sbjct:  421 YILATYTAMLEFRSLLADRHVVEKEM                                  446
```

Based on this analysis, it was predicted that these proteins and their epitopes could be useful antigens for vaccines or diagnostics.

EXAMPLE 1388

A DNA sequence (GBSx1473) was identified in *S. agalactiae* <SEQ ID 4255> which encodes the amino acid sequence <SEQ ID 4256>. Analysis of this protein sequence reveals the following:

```
Possible site: 32
>>> Seems to have no N-terminal signal sequence

----- Final Results -----
              bacterial cytoplasm --- Certainty = 0.3010(Affirmative) < succ>
              bacterial membrane  --- Certainty = 0.0000(Not Clear)   < succ>
              bacterial outside   --- Certainty = 0.0000(Not Clear)   < succ>
```

The protein has homology with the following sequences in the GENPEPT database.

```
>GP: AAC84011 GB: AF080002 cobyric acid synthase CobQ [Heliobacillus
mobilis]
Identities = 89/250 (35%), Positives = 129/250 (51%), Gaps = 9/250 (3%)
Query:   11 TKDYKYTLNVAHLYGNLLNTYGDNGNILMMKYVGEKLGCQMTFDIVSLEDRFDPNYYQMA   70
            +K    TL + HLY +LLN YGD GNI+ ++    E  G  +     SL ++   +   +
Sbjct:    2 SKTSNRTLTLIHLYPDLLNLYGDRGNIITLRRRCEWRGITLQVHSASLGEKAAFDDADLV   61

Query:   71 FFGGGQDYEQAIVARDLPSKKEDINKFIQNNGV-VLAICGGFQLLGQYYIQANGERIEGI  129
             F GGG D EQ ++ +D      K           G+ +L++CGG+QLLG YY    GE + G+
Sbjct:   62 FMGGGSDREQTLLFQDFQQHKGPALVEAAEGGLPLLSVCGGYQLLGLYYRTHTGEEMPGL  121

Query:  130 GVMGHYTLNQNNNRYIGDIKIHNDEFNE--TYYGFENHQGRTFLSEDE--KPLGTVIYGN  185
             G+     +T    + R IG++       E  T  GFENH  GRTFL       +PL  V   G
Sbjct:  122 GLFDAWT-EAGSTRLIGNVVAQAPLLGEQATLVGFENHSGRTFLGSRGGIQPLAQVTAGF  180

Query:  186 GNNKEDGTEGVHYKNVFGSYFHGPILSRNANLAYRLVATALRNKYG---KEIVLPSYEEI  242
             GNN +D   EG  YKN  G+Y HGP+L  +N   LA   L++  AL    +YG        +   ++E
Sbjct:  181 GNNGDDQGEGAVYKNAVGTYLHGPVLPKNPALADWLLSKALERRYGGGSLSTLQDTWENR  240

Query:  243 LSLEIPEEYG                                                    252
             L  +  +  +G
Sbjct:  241 AHLSVAQRFG                                                    250
```

A related DNA sequence was identified in *S. pyogenes* <SEQ ID 4257> which encodes the amino acid sequence <SEQ ID 4258>. Analysis of this protein sequence reveals the following:

```
Possible site: 32
>>> Seems to have no N-terminal signal sequence

----- Final Results -----
           bacterial cytoplasm --- Certainty = 0.2586(Affirmative) < succ>
           bacterial membrane  --- Certainty = 0.0000(Not Clear)   < succ>
            bacterial outside  --- Certainty = 0.0000(Not Clear)   < succ>
```

An alignment of the GAS and GBS proteins is shown below.

```
Identities = 197/260 (75%), Positives = 224/260 (85%)
Query:    1 MTYTSLKSPTTKDYKYTLNVAHLYGNLLNTYGDNGNILMMKYVGEKLGCQMTFDIVSLED   60
            MTYTSLKSP  +DY Y L +AHLYGNL+NTYGDNGNILM+KYV EKLG ++T DIVS+ D
Sbjct:    1 MTYTSLKSPENQDYIYDLTIAHLYGNLMNTYGDNGNILMLKYVAEKLGARVTVDIVSIND   60

Query:   61 RFDPNYYQMAFFGGGQDYEQAIVARDLPSKKEDINKFIQNNGVVLAICGGFQLLGQYYIQ  120
             F+ +  Y  + FFGGGQDYEQ+IVA+DLPSKK     +I NN VVLAICGGFQLLGQY+Q
Sbjct:   61 TFEQDDYDIVFFGGGQDYEQSIVAKDLPSKKAALADYIANNKVVLAICGGFQLLGQYYVQ  120

Query:  121 ANGERIEGIGVMGHYTLNQNNNRYIGDIKIHNDEFNETYYGFENHQGRTFLSEDEKPLGT  180
               ANG +I+G+G+MGHYTLNQ+ NR+IGDIKIHNDEFNETYYGFENHQGRTFLS DEKPLG
Sbjct:  121 ANGVKIDGLGIMGHYTLNQHQNRFIGDIKIHNDEFNETYYGFENHQGRTFLSGDEKPLGR  180

Query:  181 VIYGNGNNKEDGTEGVHYKNVFGSYFHGPILSRNANLAYRLVATALRNKYGKEIVLPSYE  240
             V+YGNGNNKED TEGVHYKNV+GSYFHGPILSRN NLAYRLV TAL+ KYG   I LPSY+
Sbjct:  181 VVYGNGNNKEDQTEGVHYKNVYGSYFHGPILSRNVNLAYRLVTTALKKKYGSAISLPSYD  240

Query:  241 EILSLEIPEEYGDVKSKADF                                           260
             +IL  EI EEY D+KSKA F
Sbjct:  241 DILKQEITEEYADLKSKASF                                           260
```

Based on this analysis, it was predicted that these proteins and their epitopes could be useful antigens for vaccines or diagnostics.

EXAMPLE 1389

A DNA sequence (GBSx1474) was identified in *S. agalactiae* <SEQ ID 4259> which encodes the amino acid sequence <SEQ ID 4260>. Analysis of this protein sequence reveals the following:

```
Possible site: 21
>>> Seems to have no N-terminal signal sequence

----- Final Results -----
            bacterial cytoplasm --- Certainty = 0.1701(Affirmative) < succ>
             bacterial membrane --- Certainty = 0.0000(Not Clear)   < succ>
              bacterial outside --- Certainty = 0.0000(Not Clear)   < succ>
```

The protein has homology with the following sequences in the GENPEPT database.

```
>GP: BAB04402 GB: AP001509 lipoate-protein ligase [Bacillus halodurans]
Identities = 153/316 (48%), Positives = 212/316 (66%), Gaps = 3/316 (0%)
Query:   10 DPAYNVALEAYAFQKLTDIDEIFIL-WINEPAIIIGRHQNTIQEINKEFIDKNGIHVVRR   68
            DP  N+A+E YA + L DI+E ++L +INEP+IIIGR+QNTI+EIN E+++ NGIHVVRR
Sbjct:   11 DPRINLAIEEYALKNL-DINETYLLFYINEPSIIIGRNQNTIEEINTEYVESNGIHVVRR   69

Query:   69 LSGGGAVYHDLNNLNYTIISNNTQEGAFDFQTFSKPVIDTLAKLGVKAEFTGRNDL-EIN  127
            LSGGGAVYHD NLN++ I+ + E  +FQ F+ PVI  LAKLGV AE  GRND+   +
Sbjct:   70 LSGGGAVYHDHGNLNFSFITKDDGESFSNFQKFTDPVIKALAKLGVTAELKGRNDIIASD  129

Query:  128 GQKFAGNAQAYYKGRMMHHGCLLFDVDMSVLGQALKVSKDKIESKGIKSVRARVTNIVDH  187
            G+K +GNAQ   KGRM HG LLFD ++  + AL VSKDKIESKGIKS+R+RV NI +
Sbjct:  130 GRKISGNAQFSTKGRMFSHGTLLFDSEIDHVVSALNVSKDKIESKGIKSIRSRVANISEF  189

Query:  188 LSDKITVQEFSDAILAQMKEEYPEMDEYVLSDAELSEIQAMRDNQFATWDWTYGKAPEYT  247
            L++KI++ +F  +L + +    + EY L+ + +EI +   ++ WDW YGK+P +
Sbjct:  190 LTEKISIDQFRSLLLESIFDGQANIQEYKLTADDWAEIHELSKERYQNWDWNYGKSPAFN  249

Query:  248 IERGVRYPAGKITTYANVENSTIKSVKIFGDFFGVKPVDDIEKMLEGVRYDYKDVLAALK  307
            ++   R+P G I    V+  TI+  KIFGDFFG   V D+E  L G+RY+  D+  AL
Sbjct:  250 LQHSHRFPVGNIDIRLEVKGGTIQQCKIFGDFFGTGDVRDLEDRLVGIRYERADIEQALA  309

Query:  308 TVDTSQYFSRMTPEEI                                             323
            VD    YF ++  ++I
Sbjct:  310 DVDVKTYFGQVEKDDI                                             325
```

A related DNA sequence was identified in *S. pyogenes* <SEQ ID 4261> which encodes the amino acid sequence <SEQ ID 4262>. Analysis of this protein sequence reveals the following:

```
Possible site: 23
>>> Seems to have no N-terminal signal sequence

----- Final Results -----
            bacterial cytoplasm --- Certainty = 0.1271(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below.

```
Identities = 249/328 (75%), Positives = 292/328 (88%)
Query:    1 MKYIVNTSNDPAYNVALEAYAFQKLTDIDEIFILWINEPAIIIGRHQNTIQEINKEFIDK   60
            MKYIVN S++PA+N+ALEAYAF++L + DE+FILWINEPAIIIG+HQNTIQEINKE+ID+
Sbjct:    1 MKYIVNKSHNPAFNIALEAYAFRELVEEDELFILWINEPAIIIGKHQNTIQEINKEYIDE   60

Query:   61 NGIHVVRRLSGGGAVYHDLNNLNYTIISNNTQEGAFDFQTFSKPVIDTLAKLGVKAEFTG  120
            +GIHVVRRLSGGGAVYHDLNNLNYTIISN T EGAFDF+TFS+PVI TLA LGV A FTG
Sbjct:   61 HGIHVVRRLSGGGAVYHDLNNLNYTIISNKTAEGAFDFKTFSQPVIATLADLGVTANFTG  120

Query:  121 RNDLEINGQKFAGNAQAYYKGRMMHHGCLLFDVDMSVLGQALKVSKDKIESKGIKSVRAR  180
            RND+EI+G+K  GNAQAYYKGRMMHHGCLLFDVDM+VLG ALKVSKDKIESKG+KSVRAR
Sbjct:  121 RNDIEIDGKKICGNAQAYYKGRMMHHGCLLFDVDMTVLGDALKVSKDKIESKGVKSVRAR  180

Query:  181 VTNIVDHLSDKITVQEFSDAILAQMKEEYPEMDEYVLSDAELSEIQAMRDNQFATWDWTY  240
            VTNI++ L +KITV+EFSD ILA+MKE YP+M EYVLS+ EL++I+    QF +WDWTY
Sbjct:  181 VTNILNELPEKITVEEFSDKILAKMKETYPDMTEYVLSEDELAKIEQSAKEQFGSWDWTY  240

Query:  241 GKAPEYTIERGVRYPAGKITTYANVENSTIKSVKIFGDFFGVKPVDDIEKMLEGVRYDYK  300
            GKAPEYTIER VRYPAGKI+T+ANVENS IK++KI+GDFFG+K V DIE +L G +Y+Y+
Sbjct:  241 GKAPEYTIERNVRYPAGKISTFANVENSIIKNLKIYGDFFGIKDVQDIENLLIGCKYEYR  300
```

```
Query: 301 DVLAALKTVDTSQYFSRMTPEEITKAIV                              328
           DV   LKT+DT+QYFSRMT EE+ KAIV
Sbjct: 301 DVFERLKTIDTTQYFSRMTVEEVAKAIV                              328
```

Based on this analysis, it was predicted that these proteins and their epitopes could be useful antigens for vaccines or diagnostics.

EXAMPLE 1390

A DNA sequence (GBSx1475) was identified in *S. agalactiae* <SEQ ID 4263> which encodes the amino acid sequence <SEQ ID 4264>. Analysis of this protein sequence reveals the following:

```
Possible site: 46
>>> Seems to have no N-terminal signal sequence
    INTEGRAL      Likelihood = -1.70    Transmembrane   294-310 (294-312)

----- Final Results -----
              bacterial membrane --- Certainty = 0.1680(Affirmative) < succ>
              bacterial outside  --- Certainty = 0.0000(Not Clear)   < succ>
              bacterial cytoplasm --- Certainty = 0.0000(Not Clear)  < succ>
```

The protein has homology with the following sequences in the GENPEPT database.

```
>GP:AAA21748 GB:L31844 dihydrolipoamide dehydrogenase [Clostridium magnum]
Identities = 229/589 (38%), Positives = 339/589 (56%), Gaps = 25/589 (4%)

Query:   1 MAFDVIMPKLGVDMQEGEILEWKKNEGDTVNEGDVLLEIMSDKTNMEIEAEDTGVLLKIV    60
           MA  V+MPKLG+ M EG ++ WKK EGD V  G++L E+ +DK    E+E+ D G++ K++
Sbjct:   1 MAKIVVMPKLGLTMTEGTLVTWKKAEGDQVKVGEILFEVSTDKLTNEVESSDEGIVRKLL    60

Query:  61 HQAGDVVPVTEVIAYIGEEGEEVGTSSPSADATITAEDGQSVSGPAAPSQETVAAATPKE   120
              GDVV    +A IG  E++ +             +G S    +A   +T A   PK+
Sbjct:  61 VNEGDVVECLNPVAIIGSADEDISSLL----------NGSSEGSGSAEQSDTKA---PKK   107

Query: 121 ELAADEY--DIVVVGGGPAGYYAAIRGAQLGGKIAIVEKTEFGGTCLNVGCIPTKTYLKN   178
           E+ A +   ++VV+GGGP GY AAIR AQLG K+ ++EK   GGTCLNVGCIPTK L +
Sbjct: 108 EVEAVKGGDNLVVIGGGPGGYVAAIRAAQLGAKVTLIEKESLGGTCLNVGCIPTKVLLHS   167

Query: 179 AEILDGLKVAAGRGINLASTNYAIDMDKTVAFKNSVVKTLTGGVRGLLKANKVEIFNGLG   238
           +++L +K       GI++ +  ++           K  V+K L  GV GLL  NKV++  G
Sbjct: 168 SQLLTEMKEGDKLGIDIEGS-IVVNWKHIQKRKKIVIKKLVSGVSGLLTCNKVKVIKGTA   226

Query: 239 QVNPDKSVVIGDK-----VIKGRNVVLATGSKVSRINIPGIESPLVLTSDDILDLREIPK   293
           +     ++++ +       +     N ++ATGS      I G +   V+ S    L    P+
Sbjct: 227 KFESKDTILVTKEDGVAEKVNFDNAIIATGSMPFIPEIEGNKLSGVIDSTGALSLESNPE   286

Query: 294 SLAVMGGGVVGIELGLVWASYGVDVTVIEMADRIIPAMDKEVSLELQKILAKKGMKIKTS   353
           S+A++GGGV+G+E   ++ S G   V++IEM   I+P MD+E+S   + L + G+ I  +
Sbjct: 287 SIAIIGGGVIGVEFASIFNSLGCKVSIIEMLPHILPPMDREISEIAKAKLIRDGININNN   346

Query: 354 VGVSEIVEANNQLTLKL--NNGEEVV-ADKALLSIGRVPQMNGLENLEPELEMERGRIKV   410
           V+ I +  + L +   + GEE +   +K L+++GR   GL+ +  ++ E G I V
Sbjct: 347 CKVTRIEQGEDGLKVSFIGDKGEESIDVEKVLIAVGRRSNIEGLDVEKIGVKTEGGSIIV   406

Query: 411 NAYQETSIPGIYAPGDVNGTRMLAHAAYRMGEVAAENALGGNRKAHLDFTPAAVYTHPE   470
           N    ET++ GIYA GD  G  MLAH A   G VAAEN +G NK K       PA VYT PE
Sbjct: 407 NDKMETNVEGIYAIGDCTGKIMLAHVASDQGVVAAENIMGQNK-KMDYKTVPACVYTKPE   465

Query: 471 VAMVGMTEEQAREQYGDILVGKNSFTGNGRAIASNEAHGFVKVIAEPKYKEILGVHIIGP   530
           +A VG+TEEQA+E+ D  VGK    NG+++ NE  G +K+I + KY+EILGVHI+GP
Sbjct: 466 LASVGLTEEQAKEKGIDYKVGKFQLAANGKSLIMNETGGVIKIITDKKYEEILGVHILGP   525

Query: 531 AAAELINEASTIMENELTVYDVAQSIHGHPTFSEVMYEAFLDVLGEAIH             579
            A  +LI EA+   E T+ ++    ++H HPT  E M EA L V  +AIH
Sbjct: 526 RATDLITEAALALRLEATLEEIITTVHAHPTVGEAMKEAALAVNNQAIH             574
```

A related DNA sequence was identified in *S. pyogenes* <SEQ ID 1819> which encodes the amino acid sequence <SEQ ID 1820>. Analysis of this protein sequence reveals the following:

```
Possible site: 50
>>> Seems to have no N-terminal signal sequence
    INTEGRAL    Likelihood = -1.70    Transmembrane    297-313 (297-315)

----- Final Results -----
            bacterial membrane --- Certainty = 0.1680(Affirmative) < succ>
             bacterial outside --- Certainty = 0.0000(Not Clear)   < succ>
           bacterial cytoplasm --- Certainty = 0.0000(Not Clear)   < succ>
```

An alignment of the GAS and GBS proteins is shown below.

```
Identities = 497/591 (84%), Positives = 538/591 (90%), Gaps = 10/591 (1%)

Query:   1 MAFDVIMPKLGVDMQEGEILEWKKNEGDTVNEGDVLLEIMSDKTNMEIEAEDTGVLLKIV   60
           MA ++IMPKLGVDMQEGEI+EWKK EGDTVNEGD+LLEIMSDKTNME+EAED+GVLLKI
Sbjct:   1 MAVEIIMPKLGVDMQEGEIIEWKKQEGDTVNEGDILLEIMSDKTNMELEAEDSGVLLKIT  60

Query:  61 HQAGDVVPVTEVIAYIGEEGEEVGTSSPSA---DATITAEDGQS--VSGPAAPSQETVAA  115
              QAG+ VPVTEVI YIG EGE V  SSP+A       T ED ++  + P AP+Q    A+
Sbjct:  61 RQAGETVPVTEVIGYIAEGESVEVSSPAASDVNVARTTEDLEAAGLEVPKAPAQ--AAS  118

Query: 116 ATPKEELAADEYDIVVVGGGPAGYYAAIRGAQLGGKIAIVEKTEFGGTCLNVGCIPTKTY  175
           A PK  LA DEYDI+VVGGGPAGYYAAIRGAQLGGKIAIVEK+EFGGTCLNVGCIPTKTY
Sbjct: 119 AAPKAALADDEYDIIVVGGGPAGYYAAIRGAQLGGKIAIVEKSEFGGTCLNVGCIPTKTY  178

Query: 176 LKNAEILDGLKVAAGRGINLASTNYAIDMDKTVAFKNSVVKTLTGGVRGLLKANKVEIFN  235
           LKNAEILDG+K+AAGRGINLASTNY IDMDKTV FKN+VVKTLTGGV+GLLKANKV IFN
Sbjct: 179 LKNAEILDGIKIAAGRGINLASTNYTIDMDKTVDFKNTVVKTLTGGVQGLLKANKVTIFN  238

Query: 236 GLGQVNPDKSVVIGDKVIKGRNVVLATGSKVSRINIPGIESPLVLTSDDILDLREIPKSL  295
           GLGQVNPDK+V IG + IKGRNV+LATGSKVSRINIPGI+S LVLTSDDILDLRE+PKSL
Sbjct: 239 GLGQVNPDKTVTIGSQTIKGRNVILATGSKVSRINIPGIDSKLVLTSDDILDLREMPKSL  298

Query: 296 AVMGGGVVGIELGLVWASYGVDVTVIEMADRIIPAMDKEVSLELQKILAKKGMKIKTSVG  355
           AVMGGGVVGIELGLVWASYGVDVTVIEMADRIIPAMDKEVSLELQKIL+KKGMKIKTSVG
Sbjct: 299 AVMGGGVVGIELGLVWASYGVDVTVIEMADRIIPAMDKEVSLELQKILSKKGMKIKTSVG  358

Query: 356 VSEIVEANNQLTLKLNNGEEVVADKALLSIGRVPQMNGLENLEPELEMERGRIKVNAYQE  415
           VSEIVEANNQLTLKLNNGEEVVA+KALLSIGRV QMNGLENL   LEM+R RIKVN YQE
Sbjct: 359 VSEIVEANNQLTLKLNNGEEVVAEKALLSIGRVSQMNGLENL--NLEMDRNRIKVNDYQE  416

Query: 416 TSIPGIYAPGDVNGTRMLAHAAYRMGEVAAENALGGN-KRKAHLDFTPAAVYTHPEVAMV  474
           TSIPGIYAPGDVNGT+MLAHAAYRMGEVAAENA+ GN   RKA+L +TPAAVYTHPEVAMV
Sbjct: 417 TSIPGIYAPGDVNGTKMLAHAAYRMGEVAAENAMHGNTTRKANLKYTPAAVYTHPEVAMV  476

Query: 475 GMTEEQAREQYGDILVGKNSFTGNGRAIASNEAHGFVKVIAEPKYKEILGVHIIGPAAAE  534
           G+TEEQAREQYGD+L+GKNSFTGNGRAIASNEAHGFVKVIA+ KY EILGVHIIGPAAAE
Sbjct: 477 GLTEEQAREQYGDVLIGKNSFTGNGRAIASNEAHGFVKVIADAKYHEILGVHIIGPAAAE  536

Query: 535 LINEASTIMENELTVYDVAQSIHGHPTFSEVMYEAFLDVLGEAIHNPPKRK           585
           +INEA+TIME+ELTV ++  SIHGHPTFSEVMYEAF DVLGEAIHNPPKRK
Sbjct: 537 MINEAATIMESELTVDELLLSIHGHPTFSEVMYEAFADVLGEAIHNPPKRK           587
```

Figure 165:
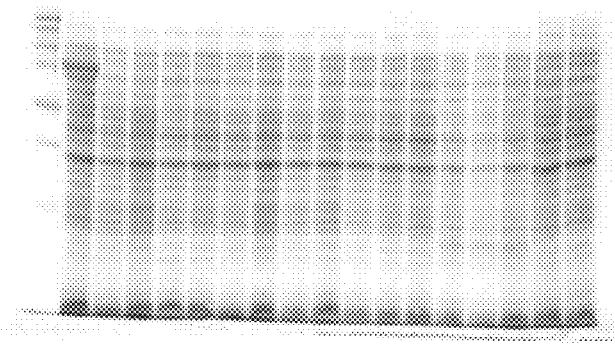

SEQ ID 4264 (GBS681) was expressed in *E. coli* as a His-fusion product. SDS-PAGE analysis of total cell extract is shown in FIG. 165 (lane 2; MW 68.3 kDa) and in FIG. 188 (lane 10; MW 68 kDa).

Figure 240:
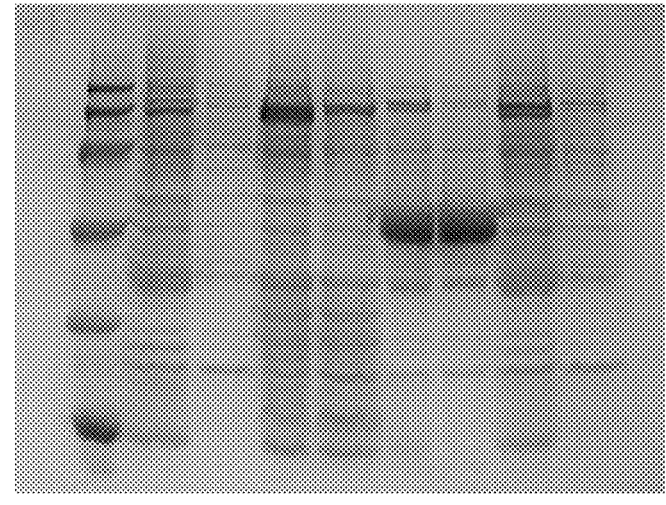

Purified GBS681-His is shown in FIG. 240, lane 5-6.

Based on this analysis, it was predicted that these proteins and their epitopes could be useful, antigens for vaccines or diagnostics.

EXAMPLE 1391

A DNA sequence (GBSx1476) was identified in *S. agalactiae* <SEQ ID 4265> which encodes the amino acid sequence <SEQ ID 4266>. This protein is predicted to be dihydrolipoamide acetyltransferase. Analysis of this protein sequence reveals the following:

```
Possible site: 46
>>> Seems to have no N-terminal signal sequence

----- Final Results -----
           bacterial cytoplasm --- Certainty = 0.4466(Affirmative) < succ>
            bacterial membrane --- Certainty = 0.0000(Not Clear)   < succ>
             bacterial outside --- Certainty = 0.0000(Not Clear)   < succ>
```

The protein has homology with the following sequences in the GENPEPT database.

```
>GP:BAB04497 GB:AP001509 dihydrolipoamide S-acetyltransferase
[Bacillus halodurans]
Identities = 187/462 (40%), Positives = 266/462 (57%), Gaps = 26/462 (5%)

Query:   1  MAVEIIMPKLGVDMQEGEILEWKKQVGDVVNEGDVLLEIMSDKTNMEIEAEDSGVLLKIT    60
            MA EI MPKL  MQEG +L+W K+ GD V  G+ L EIM+DK N+E+EA + G LLK
Sbjct:   1  MAKEIFMPKLSSTMQEGTLLQWFKEEGDRVEVGEPLFEIMTDKINIEVEAYEEGTLLKRY   60

Query:  61  HGNGDVVPVTETIGYIGAEGEEVTEASSSENTSVEENATQVTSEPEKVEETSEPSVPAAT  120
            +G  D +PV   IGYIG   E V   +E     E     T E     T+    P++
Sbjct:  61  YGEDDEIPVNHVIGYIGTPDESVP----TEPPGASEITASSTDEAGDHRTTAVKKAPSSD  116

Query: 121  SGEKVRATPAARKLAREMSIDLALVSGTGANGRVHREDVENFKGAQPRITPLARRIAEDQ  180
              E VRATPAAR++A+E  IDL  V G+G  GRV    DV  FK   + TPLA+++AE +
Sbjct: 117  R-ENVRATPAARRIAKEKRIDLRQVEGSGPEGRVQAVDVATFKKKGQKATPLAKKVAEVK  175

Query: 181  GVDIAEITGSGIRGKIVKNDVLAAMSPQAAEAPVETKATPTTEEKQLPEGVEVIKMSAMR  240
            GV + ++ GSG GK+ + DV A    A +PVE K             +K+S +R
Sbjct: 176  GVALEKVQGSGPYGKVYREDVEHAQ----AASPVEDKGNR-------------VKLSGLR  218

Query: 241  KAISKGMTNSYLTAPSFTLNYDIDMTEMMALRKKLIDPIMAKTGLKVSFTDLIGMAVVKT  300
            K ++K M +S  +AP  T+  +IDM+ + +R +L+  I  +TG ++S+T+++  AV
Sbjct: 219  KVVAKRMVDSAFSAPHVTITTEIDMSSTIKIRSQLLGMIEQETGYRLSYTEIVMKAVAHA  278

Query: 301  LMKPEHRYLNASLINDAQEIELHNFVNIGIAVGLDDGLIVPVVHNADQMSLSDFVIASKD  360
            LM    H  +NAS    +  EI  H  V++IG+AV ++  GL+VPVV +  D+   L+           K
Sbjct: 279  LMS--HPTINASFFEN--EIVYHEDVHIGLAVAVEGGLVVPVVKHVDKKGLAQLTNECKT  334

Query: 361  VIKKTQEGKLKSAEMSGSTFSITNLGMFGTKTFNPIINQPNSAILGVGATIPTPTVVDGE  420
            V     ++ +L     MSG TF+I+NLGM+        F  P+INQP SAILGVG       P    +DG+
Sbjct: 335  VAMAARDNRLSQEMMSGGTFTISNLGMYAIDVFTPVINQPESAILGVGRIQEKPVGIDGQ  394

Query: 421  IVARPIMAMCLTIDHRIVDGMNGAKFMVDLKNLMENPFGLLI                   462
            I  RP+M   L+  DHR++DG   A F+ D+K+++E PF LL+
Sbjct: 395  IELRPMMTASLSFDHRVIDGAPAAAFLTDVKSMLEQPFQLLM                   436
```

A related DNA sequence was identified in *S. pyogenes* <SEQ ID 4267> which encodes the amino acid sequence 35 <SEQ ID 4268>. Analysis of this protein sequence reveals the following:

```
Possible site: 50
>>> Seems to have no N-terminal signal sequence

----- Final Results -----
            bacterial cytoplasm --- Certainty = 0.4774(Affirmative) < succ>
            bacterial membrane  --- Certainty = 0.0000(Not Clear)   < succ>
             bacterial outside  --- Certainty = 0.0000(Not Clear)   < succ>
```

An alignment of the GAS and GBS proteins is shown below.

```
Identities = 354/473 (74%), Positives = 390/473 (81%), Gaps = 15/473 (3%)

Query:    1  MAVEIIMPKLGVDMQEGEILEWKKQVGDVVNEGDVLLEIMSDKTNMEIEAEDSGVLLKIT   60
             MA EIIMPKLGVDMQEGEI+EWKKQ GD VNEGD+LLEIMSDKTNME+EAEDSGVLLKIT
Sbjct:    1  MAFEIIMPKLGVDMQEGEIIEWKKQEGDTVNEGDILLEIMSDKTNMELEAEDSGVLLKIT   60

Query:   61  HGNGDVVPVTETIGYIGAEGEEVTEASSSENTS-----VEENATQVTSEPEKVEETSEPS  115
                GD VPVTE IGYIGAEGE V    +SSE T+       +A  +  E V      + P
Sbjct:   61  RQAGDTVPVTEVIGYIGAEGESVDTIASSEKTTEIPVPASADAGPAVAPKENVASPA-PQ  119

Query:  116  VPAAT----SGEKVRATPAARKLAREMSIDLALVSGTGANGRVHREDVENFKGAQPRITP  171
             V A      +G KVRATPAARK A EM IDL V GTG  GRVH+EDVENFKGAQP+ +P
Sbjct:  120  VAATAIPQGNGGKVRATPAARKAAAEMGIDLGQVPGTGPKGRVHKEDVENFKGAQPKASP  179

Query:  172  LARRIAEDQGVDIAEITGSGIRGKIVKNDVLAAMSPQAAEAPVETKATPTTEEK--QLPE  229
             LAR+IA D+G+D+A ++G+G  GK++K D++A +     A P E KA    EEK   LPE
Sbjct:  180  LARKIAADKGIDLATVSGTGFNGKVMKEDIMAILE---AAKPAEAKAPAAKEEKVVDLPE  236

Query:  230  GVEVIKMSAMRKAISKGMTNSYLTAPSFTLNYDIDMTEMMALRKKLIDPIMAKTGLKVSF  289
             GVE   MSAMRKAISKGMTNSYLTAP+FTLNYDIDMTEM+ALRKKLIDPIMAKTGLKVSF
Sbjct:  237  GVEHKPMSAMRKAISKGMTNSYLTAPTFTLNYDIDMTEMIALRKKLIDPIMAKTGLKVSF  296
```

```
Query:  290 TDLIGMAVVKTLMKPEHRYLNASLINDAQEIELHNFVNIGIAVGLDDGLIVPVVHNADQM  349
            TDLIGMAVVKTLMKPEH Y+NASLINDA +IELH FVN+GIAVGLDDGLIVPV+H A++M
Sbjct:  297 TDLIGMAVVKTLMKPEHEYMNASLINDANDIELHRFVNLGIAVGLDDGLIVPVIHGANKM  356

Query:  350 SLSDFVIASKDVIKKTQEGKLKSAEMSGSTFSITNLGMFGTKTFNPIINQPNSAILGVGA  409
             LSDFV+ASKDVIKK Q GKLK+AEMSGSTFSITNLGMFGTKTFNPIINQPNSAILGVGA
Sbjct:  357 CLSDFVLASKDVIKKAQTGKLKAAEMSGSTFSITNLGMFGTKTFNPIINQPNSAILGVGA  416

Query:  410 TIPTPTVVDGEIVARPIMAMCLTIDHRIVDGMNGAKFMVDLKNLMENPFGLLI         462
            TIPTPTVVDGEIV+RPIMAMCLTIDHR+VDGMNGAKFMVDLK LMENPF LLI
Sbjct:  417 TIPTPTVVDGEIVSRPIMAMCLTIDHRLVDGMNGAKFMVDLKKLMENPFELLI         469
```

Based on this analysis, it was predicted that these proteins and their epitopes could be useful antigens for vaccines or diagnostics.

EXAMPLE 1392

A DNA sequence (GBSx1477) was identified in *S. agalactiae* <SEQ ID 4269> which encodes the amino acid sequence <SEQ ID 4270>. This protein is predicted to be acetoin dehydrogenase (TPP-dependent) beta chain (pdhB). Analysis of this protein sequence reveals the following:

```
Possible site: 18
>>> Seems to have no N-terminal signal sequence

----- Final Results -----
            bacterial cytoplasm --- Certainty = 0.1267(Affirmative) < succ>
            bacterial membrane  --- Certainty = 0.0000(Not Clear)   < succ>
             bacterial outside  --- Certainty = 0.0000(Not Clear)   < succ>
```

A related GBS nucleic acid sequence <SEQ ID 9779> which encodes amino acid sequence <SEQ ID 9780> was also identified.

The protein has homology with the following sequences in the GENPEPT database.

```
>GP:BAB04496 GB:AP001509 acetoin dehydrogenase (TPP-dependent) beta
chain [Bacillus halodurans]
Identities = 189/319 (59%), Positives = 249/319 (77%), Gaps = 1/319 (0%)

Query:   11 EAINVAMSEEMRKDEKVFLMGEDVGVYGGDFGTSVGMLEEFGAKRVRDTPISEAAIAGSA   70
            EAI  AM+ EMRK+E VF++GED+GVYGG FG + GM+EEFG++RVR+TPISEAAI+G+A
Sbjct:    8 EAIREAMTLEMRKNEDVFILGEDIGVYGGAFGVTRGMIEEFGSERVRNTPISEAAISGTA   67

Query:   71 IGAAQTGLRPIVDLTFMDFVTIAMDAIVNQGAKTNYMFGGGLSTPVTFRVASGSGIGSAA  130
            IGAA TG+RPI++L F DF+TIAMD +VNQ AK  YM+GG   P+  R  +GSG G+AA
Sbjct:   68 IGAALTGMRPILELQFSDFITIAMDNMVNQAAKLRYMYGGKAKVPMVLRTPAGSGTGAAA  127

Query:  131 QHSQSLEAWLTHIPGLKVVAPGTVNESKALLKSSILDNNPVIFLEPKALYGKKEEVNMDP  190
            QHSQSLEAW+THIPGLKVV P T  ++K LLK++I DNNPVIF E K  Y K V  +
Sbjct:  128 QHSQSLEAWMTHIPGLKVVQPATAYDAKGLLKAAIDDNNPVIFYEHKLCYRTKCHV-PEE  186

Query:  191 DFYIPLGKGDIKREGTDLTIVSYGRMLERVMQAAEEVAEEGINVEVVDPRTLIPLDKELI  250
            ++ IPLGK D+KR+GTD+T+V+   M+ + ++AA E+ +EGI+VEV+DPRTL+PLD+E I
Sbjct:  187 EYSIPLGKADVKRKGTDVTVVATAVMVHKALEAAVELEKEGISVEVIDPRTLVPLDEETI  246

Query:  251 IDSVKKTGKLILVNDAYKTGGFTGEIATMVAESEAFDYLDHPIVRLASEDVPVPYSRVLE  310
            I SVKKT +LI+V++A K GGF GEIA+++AESEAFDYLD PT RL  + VP+PY+  LE
Sbjct:  247 IRSVKKTSRLIVVHEAVKRGGFGGEIASIIAESEAFDYLDAPIKRLGGKPVPIPYNPTLE  306

Query:  311 QGILPDVAKIKDAIYKVVN                                          329
            +  +P V I +A+ + +N
Sbjct:  307 RAAIPQVPDIIEAVKETLN                                          325
```

A related DNA sequence was identified in *S. pyogenes* <SEQ ID 4271> which encodes the amino acid sequence <SEQ ID 4272>. Analysis of this protein sequence reveals the following:

```
Possible site: 18
>>> Seems to have no N-terminal signal sequence
    INTEGRAL    Likelihood = -0.00    Transmembrane    81-97 (81-97)

----- Final Results -----
              bacterial membrane --- Certainty = 0.1001(Affirmative) < succ>
               bacterial outside --- Certainty = 0.0000(Not Clear)   < succ>
             bacterial cytoplasm --- Certainty = 0.0000(Not Clear)   < succ>
```

The protein has homology with the following sequences in the databases:

```
>GP:BAB04496 GB:AP001509 acetoin dehydrogenase (TPP-dependent) beta
chain [Bacillus halodurans]
Identities = 187/319 (58%), Positives = 244/319 (75%), Gaps = 1/319 (0%)

Query:    11 EAVNLAMTEEMRKDENIFLMGEDVGVYGGDFGTSVGMIEEFGPKRVKDTPISEAAISGAA    70
             EA+  AMT EMRK+E++F++GED+GVYGG FG + GMIEEFG +RV++TPISEAAISG A
Sbjct:     8 EAIREAMTLEMRKNEDVFILGEDIGVYGGAFGVTRGMIEEFGSERVRNTPISEAAISGTA    67

Query:    71 IGAAITGLRPIVDVTFMDFLTIMMDAIVNNGAKNNYMFGGGLITPVTFRVASGSGIGSAA   130
             IGAA+TG+RPI+++ F DF+TI MD +VN  AK  YM+GG      P+  R  +GSG +AA
Sbjct:    68 IGAALTGMRPILELQFSDFITIAMDNMVNQAAKLRYMYGGKAKVPMVLRTPAGSGTGAAA   127

Query:   131 QHSQSLEAWLTHIPGIKVVAPGNANDAKGLLKSAIRDNNIVLFMEPKALYGKKEEVNQDP   190
             QHSQSLEAW+THIPG+KVV P A DAKGLLK+AI DNN V+F E K  Y  K   V  ++
Sbjct:   128 QHSQSLEAWMTHIPGLKVVQPATAYDAKGLLKAAIDDNNPVIFYEHKLCYRTKCHVPEE-   186

Query:   191 DFYIPLGKGDIKREGTDLTIVSYGRMLERVLQAAEEVAADGINVEVVDPRTLIPLDKELI   250
             ++ IPLGK D+KR+GTD+T+V+    M+ + L+AA E+   +GI+VEV+DPRTL+PLD+E I
Sbjct:   187 EYSIPLGKADVKRKGTDVTVVATAVMVHKALEAAVELEKEGISVEVIDPRTLVPLDEETI   246

Query:   251 ISSVKKTGKLMLVNDAYKTGGFIGEIATMITESEAFDYLDHPIVRLASEDVPVPYARVLE   310
             I SVKKT +L++V++A K GGF GEIA++I ESEAFDYLD PI RL   + VP+PY    LE
Sbjct:   247 IRSVKKTSRLIVVHEAVKRGGFGGEIASIIAESEAFDYLDAPIKRLGGKPVPIPYNPTLE   306

Query:   311 QAILPDVEKIKAAIVKMAN                                           329
             +A +P V  I  A++ + N
Sbjct:   307 RAAIPQVPDIIEAVKETLN                                           325
```

An alignment of the GAS and GBS proteins is shown below.

```
Identities = 286/331 (86%), Positives = 310/331 (93%)
Query:     1 MSETKVMALREAINVAMSEEMRKDEKVFLMGEDVGVYGGDFGTSVGMLEEFGAKRVRDTP    60
             MSETK+MALREA+N+AM+EEMRKDE +FLMGEDVGVYGGDFGTSVGM+EEFG KRV+DTP
Sbjct:     1 MSETKLMALREAVNLAMTEEMRKDENIFLMGEDVGVYGGDFGTSVGDMIEEFGPKRVKDTP    60

Query:    61 ISEAAIAGSAIGAAQTGLRPIVDLTFMDFVTIAMDAIVNQGAKTNYMFGGGLSTPVTFRV   120
             ISEAAI+G+AIGAA TGLRPIVD+TFMDF+TI MDAIVN GAK NYMFGGGL TPVTFRV
Sbjct:    61 ISEAAISGAAIGAAITGLRPIVDVTFMDFLTIMMDAIVNNGAKNNYMFGGGLITPVTFRV   120

Query:   121 ASGSGIGSAAQHSQSLEAWLTHIPGLKVVAPGTVNESKALLKSSILDNNPVIFLEPKALY   180
             ASGSGIGSAAQHSQSLEAWLTHIPG+KVVAPG  N++K LLKS+I DNN V+F EPKALY
Sbjct:   121 ASGSGIGSAAQHSQSLEAWLTHIPGIKVVAPGNANDAKGLLISAIRDNNIVLFMEPKALY   180

Query:   181 GKKEEVNMDPDFYIPLGKGDIKREGTDLTIVSYGRMLERVMQAAEEVAEEGINVEVVDPR   240
             GKKEEVN DPDFYIPLGKGDIKREGTDLTIVSYGRMLERV+QAAEEVA +GINVEVVDPR
Sbjct:   181 GKKEEVNQDPDFYIPLGKGDIKREGTDLTIVSYGRMLERVLQAAEEVAADGINVEVVDPR   240

Query:   241 TLIPLDKELIIDSVKKTGKLILVNDAYKTGGFTGEIATMVAESEAFDYLDHPIVRLASED   300
             TLIPLDKELII+SVKKTGKL+LVNDAYKTGGF GEIATM+ ESEAFDYLDHPIVRLASED
Sbjct:   241 TLIPLDKELIIESVKKTGKLMLVNDAYKTGGFIGEIATMITESEAFDYLDHPIVRLASED   300

Query:   301 VPVPYSRVLEQGILPDVAKIKDAIYKVVNKG                               331
             VPVPY+RVLEQ ILPDV KIK AI K+ NKG
Sbjct:   301 VPVPYARVLEQAILPDVEKIKAAIVKMANKG                               331
```

Based on this analysis, it was predicted that these proteins and their epitopes could be useful antigens for vaccines or diagnostics.

EXAMPLE 1393

A DNA sequence (GBSx1478) was identified in *S. agalactiae* <SEQ ID 4273> which encodes the amino acid sequence <SEQ ID 4274>. Analysis of this protein sequence reveals the following:

```
Possible site: 48
>>> Seems to have no N-terminal signal sequence
   INTEGRAL    Likelihood = -3.03     Transmembrane    161-177 (161-178)

----- Final Results -----
              bacterial membrane --- Certainty = 0.2211 (Affirmative) < succ>
               bacterial outside --- Certainty = 0.0000 (Not Clear)   < succ>
             bacterial cytoplasm --- Certainty = 0.0000 (Not Clear)   < succ>
```

A related GBS nucleic acid sequence <SEQ ID 9777> which encodes amino acid sequence <SEQ ID 9778> was also identified.

The protein has homology with the following sequences in the GENPEPT database.

```
>GP: BAB04495 GB: AP001509 acetoin dehydrogenase (TPP-dependent) alpha
chain [Bacillus halodurans]
Identities = 148/317 (46%), Positives = 214/317 (66%), Gaps = 1/317 (0%)
Query:    8 LSKEQHLDMFLKMQRIRDVDMKFNKLVRRGFVQGMTHFSVGEEAASVGAIQDLTDSDIIF    67
            +++++ +D+F +M  IR  + K ++    +G + G TH +VG+EA++VG+I  L + D +
Sbjct:   10 MTEKKLVDLFKQMWLIRYFEEKVDEFFAKGMIHGTTHLAVGQEASAVGSIAVLEERDKLT    69

Query:   68 SNHRGHGQTIAKGIDIGGMFAELAGKATGTSKGRGGSMHLANLERGNYGTNGIVGGGYAL   127
            S HRGHG  IAKG D+  M AEL G+ TG  KG+GGSMH+A++E+GN G NGIVGGG+++
Sbjct:   70 STHRGHGHCIAKGADVNRMMAELFGRETGYCKGKGGSMHIADVERGNLGANGIVGGGFSI   129

Query:  128 AVGAALTQQYEGTDNIVIAFSGDSATNEGSFHESVNLAAVWNLPVIFFIINNRYGISTDI   187
            A GAALT + +    +V+ F GD A+NEGSFHE+VNLA++W LPV+F    NN+YG+S  +
Sbjct:  130 ATGAALTSKMKKEGYVVLCFFGDGASNEGSFHEAVNLASIWKLPVVFICENNQYGMSGSV   189

Query:  188 TYSTKIPHLYMRADAYGIPGHYVEDGNDLMAVYEKMHEVINYVRSGNGPAIVEVESYRWF   247
                     I H+  RA  YGIPG  V DGND+ AV  +    ++  R G GP IVE ++YRW
Sbjct:  190 KEMINIEHISDRAAGYGIPG-MVVDGNDVFAVMNVVGRAVDRARRGEGPTIVEAKTYRWK   248

Query:  248 GHSTADAGVYRTKEEVDSWKAKDPVKRYRAYLIENEIATEEELAAIEAQVIKEVEEGVKF   307
            GHS +DA  YRT+EE   W+ KDP+ R RA L++  I TEES  +I+ +  +++E+ V+F
Sbjct:  249 GHSKSDAKKYRTREEEKEWREKDPIARLRATLVKEGIVTEEEADSIQEEAKQKIEDSVQF   308

Query:  308 AEESPFPDMSVAFEDVF                                            324
            A  SP P++    EDV+
Sbjct:  309 ARNSPEPEIESLLEDVY                                            325
```

A related DNA sequence was identified in *S. pyogenes* <SEQ ID 4275> which encodes the amino acid sequence <SEQ ID 4276>. Analysis of this protein sequence reveals the following:

```
Possible site: 51
>>> Seems to have no N-terminal signal sequence

----- Final Results -----
             bacterial cytoplasm --- Certainty = 0.3502 (Affirmative) < succ>
              bacterial membrane --- Certainty = 0.0000 (Not Clear)   < succ>
               bacterial outside --- Certainty = 0.0000 (Not Clear)   < succ>
```

An alignment of the GAS and GBS proteins is shown below.

```
Identities = 244/326 (74%), Positives = 278/326 (84%)
Query:    1 MEVRMVTLSKEQHLDMFLKMQRIRDVDMKFNKLVRRGFVQGMTHFSVGEEAASVGAIQDL    60
            ME  MVT+SKEQHLDMFLKM+RIR+ D + NKLVRRGFVQGMTHFSVGEEAA+VGA+  L
```

-continued

```
Sbjct:    1 MEAEMVTVSKEQHLDMFLKMERIREFDSRINKLVRRGFVQGMTHFSVGEEAANVGAVAHL   60

Query:   61 TDSDIIFSNHRGHGQTIAKGIDIGGMFAELAGKATGTSKGRGGSMHLANLEKGNYGTNGI  120
            +  DIIFSNHRGHGQ+IAK +D+  M AELAGKATG SKGRGGSMHLA+ EKGNYGTNGI
Sbjct:   61 SYDDIIFSNHRGHGQSIAKDMDLNKMMAELAGKATGVSKGRGGSMHLADFEKGNYGTNGI  120

Query:  121 VGGGYALAVGAALTQQYEGTDNIVIAFSGDSATNEGSFHESVNLAAVWNLPVIFFIINNR  180
            VGGGYALAVGAALTQQY+GT+NI +AFSGD ATNEGSFHESVN+AA W LPVIFFIINNR
Sbjct:  121 VGGGYALAVGAALTQQYKGTNNIAVAFSGDGATNEGSFHESVNMAATWKLPVIFFIINNR  180

Query:  181 YGISTDITYSTKIPHLYMRADAYGIPGHYVEDGNDLMAVYEKMHEVINYVRSGNGPAIVE  240
            YGIS   I  +T  PHLY RA+AYG+PG Y EDGND+MAVYE M + +  +VR GNGPAIVE
Sbjct:  181 YGISMSINNATNTPHLYTRAEAYGVPGFYCEDGNDVMAVYETMGKAVEHVRGGNGPAIVE  240

Query:  241 VESYRWFGHSTADAGVYRTKEEVDSWKAKDPVKRYRAYLIENEIATEEELAAIEAQVIKE  300
            VESYRWFGHSTADAG YRTKEEVD WK KDP+ +YR YL   IAT++EL AI+AQV KE
Sbjct:  241 VESYRWFGHSTADAGKYRTKEEVDEWKEKDPMIKYRTYLTSEGIATDDELDAIQAQVKKE  300

Query:  301 VEEGVKFAEESPFPDMSVAFEDVFVD                                   326
            V++   +FA+ SP P++SVAFEDV+VD
Sbjct:  301 VDDAYEFAQNSPDPELSVAFEDVWVD                                   326
```

A related GBS gene <SEQ ID 8797> and protein <SEQ ID 8798> were also identified. Analysis of this protein sequence reveals the following:

```
Lipop: Possible site: -1 Crend: 10
McG: Discrim Score: -14.75
GvH: Signal Score (-7.5): -4.24
Possible site: 48
>>> Seems to have no N-terminal signal sequence
ALOM program     count: 1             value: -3.03     threshold: 0.0
   INTEGRAL      Likelihood = -3.03   Transmembrane    161-177 (161-178)
   PERIPHERAL    Likelihood = 3.55                     117
modified ALOM score: 1.11

*** Reasoning Step: 3

----- Final Results -----
              bacterial membrane --- Certainty = 0.2211 (Affirmative) < succ>
               bacterial outside --- Certainty = 0.0000 (Not Clear)   < succ>
              bacterial cytoplasm --- Certainty = 0.0000 (Not Clear)   < succ>
```

The protein has homology with the following sequences in the databases:

```
ORF01791(298-1278 of 1578
EGAD|108208|BS0806(3-327 of 333)acetoin dehydrogenase E1 component {Bacillus
subtilis} OMNI|NT01BS0951 acetoin:DCPIP oxidoreductase alpha subunit
GP|2780395|dbj|BAA24296/1||D78509 YfjK {Bacillus subtilis}
GP|2633130|emb|CAB12635.1||Z99108 acetoin dehydrogenase E1 component
(TPP-dependent alpha subunit)
{Bacillus subtilis} GP|2957146|gb|AAC05582.1||AF006075 TPP-dependent
acetoin dehydrogenase E1 component (TPP-dependent alpha subuni) acoA-Ba
% Match = 26.3
% Identity = 45.3    % Similarity = 65.7
Matches = 148    Mismatches = 109    Conservative Sub.s = 67

231         261         291         321         351         381         411         441
F*IEMPFTKTKKAVQILASCEKNLYNN*VIKIFLEVRMVTLSKEQHLDMFLKMQRIRDVDMKFNKLVRRGFVQGMTHFSV
                                 :|:    ::|::|: | |:  ||    ||      |:|  :|   |:
                                 MKLLKREGLSLTEEKALWMYQKMLEIRGFEDKVHELFAQGVLPGFVHLYA
                                      10          20          30          40          50

471         501         531         561         591         621         651         681
GEEAASVGAIQDLTDSDIIFSNHRGHGQTIAKGIDIGGMFAELAGKATGTSKGRGGSMHLANLEKGNYGTNGIVGGGYAL
||||  :||       ||      ||||| :   |||| |:   ||||| |  ||||||| :|: | ||  | ||||| |
GEEAVAVGVCAHLHDGDSITSTHRGHGHCIAKGCDLDGMMAEIFGKATGLCKGKGGSMHIADLDKGMLGANGIVGGGFTL
     60          70          80          90          100         110         120         130

711         741         771         801         831         861         891         921
AVGAALTQQYEGTDNIVIAFSGDSATNEGSFHESVNLAAVWNLPVIFFIINNRYGISTDITYSTKIPHLYMRADAYGIPG
| |:|||  :|:   | |: :  ||| ||:|||:|||||||||||::| |:|  ||  | | ::   :  || || :||
ACGSALTAKYQTKNVSVCFFGDGANNQGTFHEGLNLAAVWNLPVVFVAENNGYGEATPFEYASACDSIADRAAAYNMPG
     140         150         160         170         180         190         200         210

951         981         1011        1041        1071        1098        1128        1158
HYVEDGNDLMAVYEKMHEVINYVRSGNGPAIVEVESYRWFGHSTADAGVYRTKEE-VDSWKAKDPVKRYRAYLIENEIAT
    ||  :|||   |      |:| ||::   :||    ||   ||  |: ||: : :  ||    ||:: ||::      |
-VTVDGKDILAVYQAAEEEAIERARNGGGPSLIECMTYRNYGHFEGDAQTYKTKDERVEHLEEKDAIQGFKNYLLKETDAN
     220         230         240         250         260         270         280
```

```
1188      1218      1248      1278      1308      1338      1368      1398
EEELAAIEAQVIKEVEEGVKFAEESPFPDMSVAFEDVFVD*NNLK*MRFISFYYSID*KTDIRRK**AKLKLWLCAKRLM
  |:  ||  :|  :  :|:  |  |:|:||:|   |   :||:|
--KLSDIEQRVSESIEKAVSFSEDSPYPKDSELLTDVYVSYEKGGM
            300       310       320       330
```

SEQ ID 8798 (GBS403) was expressed in *E. coli* as a GST-fusion product. SDS-PAGE analysis of total cell extract is shown in FIG. 171 (lane 2; MW 64.4 kDa). It was also expressed in *E. coli* as a His-fusion product. SDS-PAGE analysis of total cell extract is shown in FIG. 76 (lane 4; MW 39.5 kDa).

GBS403-GST was purified as shown in FIG. 218, lane 6.

Based on this analysis, it was predicted that these proteins and their epitopes could be useful antigens for vaccines or diagnostics.

EXAMPLE 1394

A DNA sequence (GBSx1479) was identified in *S. agalactiae* <SEQ ID 4277> which encodes the amino acid sequence <SEQ ID 4278>. This protein is predicted to be ABC transporter. Analysis of this protein sequence reveals the following:

```
Possible site: 22
>>> Seems to have no N-terminal signal sequence

----- Final Results -----
          bacterial cytoplasm --- Certainty = 0.2464 (Affirmative) < succ>
          bacterial membrane  --- Certainty = 0.0000 (Not Clear)   < succ>
          bacterial outside   --- Certainty = 0.0000 (Not Clear)   < succ>
```

A related GBS nucleic acid sequence <SEQ ID 9775> which encodes amino acid sequence <SEQ ID 9776> was also identified.

The protein has homology with the following sequences in the GENPEPT database.

```
>GP: CAB12414 GB: Z99107 similar to ABC transporter (ATP-binding
protein) [Bacillus subtilis]
Identities = 328/643 (51%), Positives = 443/643 (68%), Gaps = 9/643 (1%)

Query:   9 MIILQGNKIERSFSGDVLFDNINIQVDQRDRIALVGRNGAGKSTLLKILVGEEAPTKGEI   68
           M+ILQ N++ +SF D + +NI ++V  RDRIA+VGRNGAGKSTLLKI+ G+ +  KGEI
Sbjct:   1 MMILQANQLSKSFGADTILNNIKLEVRNRDRIAIVGRNGAGKSTLLKIIAGQLSYEKGEI   60

Query:  69 NKKRDLSLSYLAQDSRFQSENTIFQEMLQVFDSLREVEKRLRELELQMGQVSGSDLEQLM  128
           K +D+++ YLAQ +   S+ TI +E+L VFD L+ +EK +R +E +M       +LE +M
Sbjct:  61 IKPKDITMGYLAQHTGLDSKLTIKEELLTVFDHLKAMEKEMRAMEEKMAAADPGELESIM  120

Query: 129 KTYDILSEEFREKGGFTYESDIKAILNGFKFNSDMWEMPISELSGGQNTRLALAKMLLEK  188
           KTYD L +EF++KGG+ YE+D++++L+G  F+         +  LSGGQ TRLAL K+LL +
Sbjct: 121 KTYDRLQQEFKDKGGYQYEADVRSVLHGLGFSHFDDSTQVQSLSGGQKTRLALGKLLLTQ  180

Query: 189 PELLVLDEPTNHLDIDTIAWLENYLVNYQGALIIVSHDRYFLDKVATVTYDLTTHSLDRY  248
           P+LL+LDEPTNHLDIDT+ WLE+YL Y GA++IVSHDRYFLDKV     Y+++     +Y
Sbjct: 181 PDLLILDEPTNHLDIDTLTWLEHYLQGYSGAILIVSHDRYFLDKVVNQVYEVSRAESKKY  240

Query: 249 VGNYSKFMDLKAEKIATEEKNFEKQQKEIAKLEDFVQRNIVRASTTKRAQARRKQLEKME  308
            GNYS ++D KA +   + K +EKQQ EIAKL+DFV RN+RASTTKRAQ+RRKQLE+M+
Sbjct: 241 HGNYSAYLDQKAAQYEKDLKMYEKQQDEIAKLQDFVDRNLARASTTKRAQSRRKQLERMD  300

Query: 309 RLDKPNVEQKSANMTFHAGKVSGNVVLTLENAAIGYEG-VSLSEPIDLDVKKFDAIAIVG  367
           + KP ++KSAN F   K SGN VL +++ I YE    L  +  + ++ A+VG
Sbjct: 301 VMSKPLGDEKSANFHFDITKQSGNEVLRVQDLTISYENQPPLLTSVSFMLTRGESAALVG  360

Query: 368 PNGIGKSTLIKSLVGQIPFIKGEAKLGANVETGYYDQSQSNLTKTNTVLDELWDAFSTTP  427
           PNGIGKSTL+K+L+ +   +G    G+NV  GYYDQ Q+ LT +  VLDELWD +   P
Sbjct: 361 PNGIGKSTLLKTLIDTLKPDQGTISYGSNVSVGYYDQEQAELTSSKRVLDELWDEYPGLP  420

Query: 428 EVEIRNRLGAFLFSGDDVKKSVSMLSGGERARLLLAKLSMENNNFLILDEPTNHLDIDSK  487
           E  EIR  LG FLFSGDDV K V  LSGGE+ARL LAKL ++  NFLILDEPTNHLD+DSK
Sbjct: 421 EKEIRTCLGNFLFSGDDVLKPVHSLSGGEKARLALAKLMLQKANFLILDEPTNHLDLDSK  480

Query: 488 EVLENALIEFDGTLLFVSHDRYFINRVATKVLEISDKGSTLYLGDYDYYLTKKAELEELA  547
           EVLENALI++ GTLLFVSHDRYFINR+AT+VLE+S       YLGDYDYY  KK E  EL
Sbjct: 481 EVLENALIDYPGTLLFVSHDRYFINRIATRVLELSSSHIEEYLGDYDYYTEKKTEQLELE  540
```

```
Query:  548 RLNEEEVSASKTEIDVTSD----YETQKANQKEFRKITRRVVEIEARLEVLENDENNING  603
             ++N++E    KT  V SD     YE +K  +K+ R+ RR+ EIE  ++ +E + +  +
Sbjct:  541 KMNQQE-ETDKTPATVKSDSKRSYEEEKEWKKKERQRLRRIEEIETTVQTIEENISRNDE  599

Query:  604 LMLET---NDIGKLSDLQKELESIQEEQLLLMEEWENLNMRLD                  643
            L+ +      D  K+ +  + E + +E   L+ EWE L+   D
Sbjct:  600 LLCDPEVYQDHEKVQAIHADNEKLNQELESLLSEWEELSTEED                  642
```

A related DNA sequence was identified in *S. pyogenes* <SEQ ID 4279> which encodes the amino acid sequence <SEQ ID 4280>. Analysis of this protein sequence reveals the following:

```
Possible site: 56
>>> Seems to have no N-terminal signal sequence

----- Final Results ----
            bacterial cytoplasm --- Certainty = 0.2042 (Affirmative) < succ>
            bacterial membrane  --- Certainty = 0.0000 (Not Clear)  < succ>
             bacterial outside  --- Certainty = 0.0000 (Not Clear)  < succ>
```

An alignment of the GAS and GBS proteins is shown below.

```
Identities = 473/635 (74%), Positives = 545/635 (85%), Gaps = 1/635 (0%)

Query:    9 MIILQGNKIERSFSGDVLFDNINIQVDQRDRIALVGRNGAGKSTLLKILVGEEAPTKGEI   68
            MIILQGNK+ERSFSGDVLF NI++QVD+RDRIALVG NGAGKSTLLK+LVGEE PT GE+
Sbjct:    1 MIILQGNKLERSFSGDVLFQNISLQVDERDRIALVGPNGAGKSTLLKLLVGEETPTSGEV   60

Query:   69 NKKRDLSLSYLAQDSRFQSENTIFQEMLQVFDSLREVEKRLRELELQMGQVSGSDLEQLM  128
            N K+DL+LSYLAQ+SRF+S+ TI++EML+VF++LR+ EKRLR++E+ M   VSG  L +LM
Sbjct:   61 NTKKDLTLSYLAQNSRFESDQTIYEEMLKVFEALRQDEKRLRQMEMDMATVSGQVLTRLM  120

Query:  129 KTYDILSEEFREKGGFTYESDIKAILNGFKFNSDMWEMPISELSGGQNTRLALAKMLLEK  188
              YD+L+E FR++GGFTYESDIKAILNGFKF+   MW+M I+ELSGGQNTRLALAKMLLEK
Sbjct:  121 TDYDLLTEHFRQQGGFTYESDIKAILNGFKFDESMWQMTIAELSGGQNTRLALAKMLLEK  180

Query:  189 PELLVLDEPTNHLDIDTIAWLENYLVNYQGALIIVSHDRYFLDKVATVTYDLTTHSLDRY  248
            PELLVLDEPTNHLDI+TIAWLENYL NYQGALIIVSHDRYFLDKVATVT DLT + LDRY
Sbjct:  181 PELLVLDEPTNHLDIETIAWLENYLANYQGALIIVSHDRYFLDKVATVTLDLTPNGLDRY  240

Query:  249 VGNYSKFMDLKAEKIATEEKNFEKQQKEIAKLEDFVQRNIVRASTTKRAQARRKQLEKME  308
             GNYS+FM LKAEK+  EEK F+KQQKEIAKLEDFVQ+NIVRASTTKRAQARRKQLEK+E
Sbjct:  241 SGNYSRFMALKAEKLVAEEKQFDKQQKEIAKLEDFVQKNIVRASTTKRAQARRKQLEKIE  300

Query:  309 RLDKPNVEQKSANMTFHAGKVSGNVVLTLENAAIGYEGVSLSEPIDLDVKKWDAIAIVGP  368
            RLDKP   +KSA+MTFHA K SGNVVL +E AAIGY    LSEPI++D+ K DAIA+VGP
Sbjct:  301 RLDKPTGGRKSAHMTFHAEKPSGNVVLRVEEAAIGYGDQVLSEPINVDINKLDAIAVVGP  360

Query:  369 NGIGKSTLIKSLVGQIPFIKGEAKLGANVETGYYDQSQSNLTKTNTVLDELWDAFSTTPE  428
            NGIGKSTLIKS++GQ+P +KG+ K GANVETGYYDQ+QS+LT +NTVL+ELW  FSTTPE
Sbjct:  361 NGIGKSTLIKSIIGQLPLLKGQLKYGANVETGYYDQTQSHLTSSNTVLEELWQDFSTTPE  420

Query:  429 VEIRNRLGAFLFSGDDVKKSVSMLSGGERARLLLAKLSMENNNFLILDEPTNHLDIDSKE  488
            V+IRNRLGAFLFSGDDVKKSV+MLSGGE+ARLLLAKLSMENNNFL+LDEPTNHLDIDSKE
Sbjct:  421 VDIRNRLGAFLFSGDDVKKSVAMLSGGEKARLLLAKLSMENNNFLVLDEPTNHLDIDSKE  480

Query:  489 VLENALIEFDGTLLFVSHDRYFINRVATKVLEISDKGSTLYLGDYDYYLTKKAELEELAR  548
            VLENALI+FDGTLLFVSHDRYFINR+ATKVLEI++ GSTLYLGDYDYYL KKAELEELAR
Sbjct:  481 VLENALIDFDGTLLFVSHDRYFINRLATKVLEITENGSTLYLGDYDYYLEKKAELEELAR  540

Query:  549 LNEEEVSASKTEIDVTSDYETQKANQKEFRKITRRVVEIEARLEVLENDENNINGLMLET  608
            L   E      T DY+ QKANQKE R++TRR  EIEARLE +E     I   M    +
Sbjct:  541 LAAGETVEETKEASAT-DYQLQKANQKERRRLTRRYEEIEARLETIEERIGAIQEDMHAS  599

Query:  609 NDIGKLSDLQKELESIQEEQLLLMEEWENLNMRLD                          643
            ND  +L   QKE + + +EQ LMEEWE +  +++
Sbjct:  600 NDTAQLIAWQKEWDQLDQEQEALMEEWETIAEQIE                          634
```

Based on this analysis, it was predicted that these proteins and their epitopes could be useful antigens for vaccines or diagnostics.

EXAMPLE 1395

A DNA sequence (GBSx1480) was identified in *S. agalactiae* <SEQ ID 4281> which encodes the amino acid sequence <SEQ ID 4282>. This protein is predicted to be thiophene degradation protein F (thdF). Analysis of this protein sequence reveals the following:

```
Possible site: 22
>>> Seems to have no N-terminal signal sequence

----- Final Results -----
          bacterial cytoplasm --- Certainty = 0.0876(Affirmative) < succ>
          bacterial membrane  --- Certainty = 0.0000(Not Clear)   < succ>
          bacterial outside   --- Certainty = 0.0000(Not Clear)   < succ>
```

A related GBS nucleic acid sequence <SEQ ID 9773> which encodes amino acid sequence <SEQ ID 9774> was also identified.

A related DNA sequence was identified in *S. pyogenes* <SEQ ID 4283> which encodes the amino acid sequence <SEQ ID 4284>. Analysis of this protein sequence reveals the following:

```
Possible site: 34
>>> Seems to have no N-terminal signal sequence

----- Final Results -----
          bacterial cytoplasm --- Certainty = 0.0795(Affirmative) < succ>
          bacterial membrane  --- Certainty = 0.0000(Not Clear)   < succ>
          bacterial outside   --- Certainty = 0.0000(Not Clear)   < succ>
```

An alignment of the GAS and GBS proteins is shown below.

```
Identities = 384/458 (83%), Positives = 427/458 (92%)

Query:   12 MSITKEFDTIAAISTPLGEGAIGIVRISGTDALKIASKIYRGKDLSAIQSHTLNYGHIVD   71
            MSITKEFDTI AISTPLGEGAIGIVR+SGTDAL IA   +++GK+L  + SHT+NYGHI++
Sbjct:    1 MSITKEFDTITAISTPLGEGAIGIVRLSGTDALAIAQSVFKGKNLEQVASHTINYGHIIN   60

Query:   72 PDKNEILDEVMLGVMLAPKTFTREDVIEINTHGGIAVTNEILQLILRHGARMAEPGEFTK  131
            P      I+DEVM+ VMLAPKTFTRE+V+EINTHGGIAVTNEILQL++R GARMAEPGEFTK
Sbjct:   61 PKTGTIIDEVMVSVMLAPKTFTRENVVEINTHGGIAVTNEILQLLIRQGARMAEPGEFTK  120

Query:  132 RAFLNGRVDLTQAEAVMDLIRAKTDKAMDIAVKQLDGSLKTLINNTRQEILNTLAQVEVN  191
            RAFLNGRVDLTQAEAVMD+IRAKTDKAM IAVKQLDGSL   LIN+TRQEILNTLAQVEVN
Sbjct:  121 RAFLNGRVDLTQAEAVMDIIRAKTDKAMTIAVKQLDGSLSQLINDTRQEILNTLAQVEVN  180

Query:  192 IDYPEYDDVEEMTTTLMREKTQEFQALMENLLRTARRGKILREGLSTAIIGRPNVGKSSL  251
            IDYPEYDDVEEMTT L+REKTQEFQ+L+E+LLRTA+RGKILREGLSTAIIGRPNVGKSSL
Sbjct:  181 IDYPEYDDVEEMTTALLREKTQEFQSLLESLLRTAKRGKILREGLSTAIIGRPNVGKSSL  240

Query:  252 LNNLLREEKAIVTDIEGTTRDVIEEYVNIKGVPLKLVDTAGIRDTDDIVEKIGVERSKKA  311
            LNNLLRE+KAIVTDI GTTRDVIEEYVNIKGVPLKLVDTAGIR+TDD+VE+IGVERSKKA
Sbjct:  241 LNNLLREDKAIVTDIAGTTRDVIEEYVNIKGVPLRLVDTAGIRETDDLVEQIGVERSKKA  300

Query:  312 LEEADLVLLVLNSSEPLTLQDRSLLELSKESNRIVLLNKTDLPQKIEVNELPKNVIPISV  371
            L+EADLVLLVLN+SE LT QDR+LL LS++SNRI+LLNKTDL QKIE+ +LP + IPISV
Sbjct:  301 LQEADLVLLVLNASEKLTDQDRALLNLSQDSNRIILLNKTDLEQKIELEQLPDDYIPISV  360

Query:  372 LENENIDKIEERINDIFFDNAGMVEHDATYLSNARHISLIEKAVDSLKAVNEGLELGMPV  431
            L N+NI+ IE+RIN +FFDNAG+VE DATYLSNARHISLIEKAV SL+AVN+GL LGMPV
Sbjct:  361 LTNQNINLIEDRINQLFFDNAGLVEQDATYLSNARHISLIEKAVQSLEAVNDGLALGMPV  420

Query:  432 DLLQVDMTRTWEILGEITGDAAPDELITQLFSQFCLGK                       469
            DLLQVD+TRTWEILGEITGDAAPDELITQLFSQFCLGK
Sbjct:  421 DLLQVDLTRTWEILGEITGDAAPDELITQLFSQFCLGK                       458
```

Based on this analysis, it was predicted that these proteins and their epitopes could be useful antigens for vaccines or diagnostics.

EXAMPLE 1396

A DNA sequence (GBSx1481) was identified in *S. agalactiae* <SEQ ID 4285> which encodes the amino acid sequence <SEQ ID 4286>. Analysis of this protein sequence reveals the following:

```
Possible site: 41
>>> Seems to have no N-terminal signal sequence
    INTEGRAL    Likelihood = -9.18    Transmembrane   280-296 (276-299)
    INTEGRAL    Likelihood = -4.83    Transmembrane   249-265 (243-266)

----- Final Results -----
            bacterial membrane --- Certainty = 0.4673(Affirmative) < succ>
            bacterial outside  --- Certainty = 0.0000(Not Clear)   < succ>
            bacterial cytoplasm --- Certainty = 0.0000(Not Clear)  < succ>
```

The protein has homology with the following sequences in the GENPEPT database.

```
>GP:AAD40365 GB:AF036485 hypothetical protein [Plasmid pNZ4000]
Identities = 88/306 (28%), Positives = 149/306 (47%), Gaps = 17/306 (5%)

Query:    1 MIVEQKFGNGFTWIN---IEAEQLRTETSEIQAKY-LDSEIITYALDDYERAFMECSHIK   56
            MI  +K  NG WI      I AE+ T     ++ +Y +D +II Y  D+ E       I
Sbjct:    1 MIKPEKTINGTKWIETIQINAEERAT----LEDQYGIDEDIIEYVTDNDESTNYVYD-IN  55

Query:   57 GKEVLTIIFNTIDLKQKESYYETVPMTFCLSHDRLITVTRSRNSYMLELLQKYLDRNPDV  116
            + L  I     L +    Y T P   L    L T  +S   + L    LD NP+V
Sbjct:   56 EDDQLFIFLAPYALDKDALRYITQPFGMLLHKGVLFTFNQSGIPEVNTALYSALD-NPEV 114

Query:  117 -SPKKFLFAALTLITKQYFNVVSKIDREKDILNRQLREQTTNKRLLAMSDLETGSVYLLT  175
             S   F+   L +  +   +    I ++++ L++ L  +T N  L+++S L+    +L +
Sbjct:  115 KSVDAFILETLFTVVVSFIPISRAITKKRNYLDKMLNRKTKNSDLVSLSYLQQTLTFLSS 174

Query:  176 AANQNALVLEQLDVHPSQRFNSEVEKEQLS---DALIEAHQLVSMTQLNSQVLSQLSSTF  232
            A    N   L +LD P    F      +++++     D   IE  Q+  M ++ +QV+ ++    T
Sbjct:  175 AVQTN---LSELDRLPKTHFGVGADQDKIDLFEDVQIEGEQVQRMFEIETQVVDRIDHTL 231

Query:  233 NNVLNNNLNENLTGLNIISINLAIIAAITGFFGMNIPLPLTESRSSWLIVIATSVLLWVI  292
            N++ NNNLN+ +  L I S+ +A+    I+GF+GMN+ LPL   +W++ +   SV+L V
Sbjct:  232 NSLANNNLNDTMKFLTIWSLTMAVPTIISGFYGMNVKLPLAGMQYAWMLTLGISVVLIVA 291

Query:  293 IAQILK                                                       298
            +  +LK
Sbjct:  292 MLIMLK                                                       297
```

Based on this analysis, it was predicted that this protein and its epitopes, could be useful antigens for vaccines or diagnostics.

EXAMPLE 1397

A DNA sequence (GBSx1482) was identified in *S. agalactiae* <SEQ ID 4287> which encodes the amino acid sequence <SEQ ID 4288>. Analysis of this protein sequence reveals the following:

```
Possible site: 38
>>> Seems to have no N-terminal signal sequence

----- Final Results -----
            bacterial cytoplasm --- Certainty = 0.1437(Affirmative) < succ>
            bacterial membrane  --- Certainty = 0.0000(Not Clear)   < succ>
            bacterial outside   --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1398

A DNA sequence (GBSx1483) was identified in *S. agalactiae* <SEQ ID 4289> which encodes the amino acid sequence <SEQ ID 4290>. This protein is predicted to be exonuclease RexA. Analysis of this protein sequence reveals the following:

```
Possible site: 52
>>> Seems to have no N-terminal signal sequence

----- Final Results -----
             bacterial cytoplasm --- Certainty = 0.3165(Affirmative) < succ>
             bacterial membrane  --- Certainty = 0.0000(Not Clear)   < succ>
              bacterial outside  --- Certainty = 0.0000(Not Clear)   < succ>
```

A related GBS nucleic acid sequence <SEQ ID 9771> which encodes amino acid sequence <SEQ ID 9772> was also identified.

The protein has homology with the following sequences in the GENPEPT database.

```
>GP:AAC12966 GB:U76424 exonuclease RexA [Lactococcus lactis]
Identities = 522/1211 (43%), Positives = 747/1211 (61%),
Gaps = 73/1211 (6%)

Query:   28 KRTPEQIEAIYTFGNNVLVSASAGSGKTFVMVERILDKLLRGVPIDSLFISTFTVKAAGE    87
            K TPEQ EAI++  G N+LVSASAGSGKTFVM +RI++K+ +G+ ID LFISTFT KAA E
Sbjct:    5 KLTPEQNEAIHSSGKNILVSASAGSGKTFVMAQRIVEKVKQGIEIDRLFISTFTRKAASE   64

Query:   88 LKERLEKKINESLKSAESDDLKQFLTQQLVGIQTADIGTMDAFTQKIVNQYGYTLGISPI  147
            L+ RLE+ + ++ + +  D+      LT  L  +  ADIGTMD+FTQK+       + I P
Sbjct:   65 LRMRLERDLKKARQESSDDEEAHRLTLALQNLSNADIGTMDSFTQKLTKANFNRVNIDPN  124

Query:  148 FRILQDKNEQDVIKNEVYADLFSDYMTGKNAAS-----FIKLVKNFSGNRKDSKAFREMV  202
            FRIL D+ E D+I+ EV+  L    Y++   + +        F KL+KNFS +R +   F+++V
Sbjct:  125 FRILADQTESDLIRQEVFEQLVESYLSADESLNISKDKFEKLIKNFSKDR-NILGFQKVV  183

Query:  203 YKVYAFSQSTDNPKRWMQTVFLKGAQTYTDFEAIPDQEVSSLLNVMQT--TANQLRDLTD  260
            Y +Y F+ +T+NP  W++  FLKG +TY   +++ D       +NV +    T   +L +
Sbjct:  184 YTIYRFASATENPISWLENQFLKGFETY---KSLTDLSEDFTVNVKENLLTFFELLEAIS  240

Query:  261 QEDYKQLTAKGVPTANYKKHLKIIENL-VHWSQDFNLLYGKKGLTNLARDITNVIPSGND  319
            ++D+    TA         L I  ++ V  S+D L   KK   +   +D+
Sbjct:  241 KKDFVTCTAL---------FLSIDTDIRVGSSKDEALSALKKDFSAQKQDL---------  282

Query:  320 VTVAGVKYPIFKQLHNRIVGLKHLEVIFKYQGESLFLLELLQSFVLDFSEQYLQEKIQEN  379
                  V  P    +L    +KH ++I KYQ ++    +   LQ F++DF + YL+ K   EN
Sbjct:  283 --VGSKSKP--GELRKFVDKIKHGQLIEKYQNQAFEIASDLQKFIIDFYKTYLERKKNEN  338

Query:  380 AFEFSDIAHFAIQILEENHDIRQLYQDKYHEVMVDEYQDNNHTQERMLELLSNGHNRFMV  439
            AFE+SDIAHFAI+ILEEN DIR+  ++ Y E+M+DEYQD +HTQERMLELLSNGHN FMV
Sbjct:  339 AFEYSDIAHFAIEILEENPDIRENLREHYDEIMIDEYQDTSHTQERMLELLSNGHNLFMV  398

Query:  440 GDIKQSIYRFRQADPQIFNDKYKAYQDNPSQGKLIILKENFRSQSEVLDSTNSVFTHLMD  499
            GDIKQSIY FR ADP +F +KYK+Y    +LI LKENFRS+ EVL+ TN +F HLMD
Sbjct:  399 GDIKQSIYGFRLADPGLFLEKYKSYDQAENPNQLIRLKENFRSRGEVLNFTNDIFKHLMD  458

Query:  500 EEVGDILYDESHQLKAGS----PRQQERHPNNKTQVLLLDTDEDDIDDSDSQQYDISPAE  555
            E++G++ Y +   L  G+         P + E+    +  +T E++I+DS+ +    IS  E
Sbjct:  459 EKLGEMTYGKEEALVQGNISDYPVEAEKDFYPELLLYKENTSEEEIEDSEVK---ISDGE  515

Query:  556 AKLVAKEIIRLHKEENVPFQDITLLVSSRTRNDGILQTFDRYGIPLVTDGGEQNYLKSVE  615
            K   A+EI +L  E V  +DI +LV S++ N+  I        Y IP+V D G  ++LKS+E
Sbjct:  516 IKGAAQEIKKL-IEYGVEPKDIAILVRSKSNNNKIEDILLSYDIPVVLDEGRVDFLKSME  574

Query:  616 VMVMLDTLRSIDNPLNDYALVALLRSPMFGFNEDDLTRIAIQDVK-MAFYHKVKLSYHKE  674
            V++MLD LR+IDNPL D +LVA+LRSP+FGFNED+LTRI++Q   +  F+ K+ LS   KE
Sbjct:  575 VLIMLDVLRAIDNPLYDLSLVAMLRSPLFGFNEDELTRISVQGSRDLRFWDKILLSLKKE  634
```

-continued

```
Query:   675 GHHSDLITPELSSKIDHFMKTFQTWRDFAKWHSLYDLIWKIYNDRFYYDYVGALPKAEQR   734
             G + +LI   L  K+  F + F   WR        ++ L+WKIY + +Y+DYVGAL    E R
Sbjct:   635 GKNPELINLSLEQKLKAFNQKFTEWRKLVNKIPIHRLLWKIYTETYYFDYVGALKNGEMR   694

Query:   735 QANLYALALRANQFEKTGFKGLSRFIRMIDKVLENENDLADVEVALPQNAVNLMTIHKSK   794
             QANL AL++RA  +E +G+KGL +F+R+I+K +E  NDLA V + LPQNAV +MT HKSK
Sbjct:   695 QANLQALSVRAESYESSGYKGLFKFVRLINKFMEQNNDLASVNIKLPQNAVRVMTFHKSK   754

Query:   795 GLEFKYVFILNIDKKFSMVDITSPLILSRNQGIGIKYVADMRHELEE-EILPAVKVSMET   853
             GLEF YVF++N+  +F+  D+   +ILSR  G+G+KY+AD++ E +       P V MET
Sbjct:   755 GLEFDYVFLMNLQSRFNDRDLKEDVILSREHGLGMKYIADLKAEPDVITDFPYALVKMET   814

Query:   854 LPYQLNKRELRLATLSEQMRLLYVAMTRAEKKLYLVGKASQT---KWADHYDLVS-ENNH   909
             PY +NK   + A LSE+MR+LYVA TRA+KKLYLVGK    T     + YD   + E
Sbjct:   815 FPYMVNKDLKQRAALSEEMRVLYVAFTRAKKKLYLVGKIKDTDKKAGLELYDAATLEGKI   874

Query:   910 LPLASRETFVTFQDWLLAVHETYKKQELFYDINFVSLEELTDHHIGMVNPSLPFNPDNK-   968
             L   R +    FQ W+LA+     K   L  +N + +EL   +       +     PD K
Sbjct:   875 LSDKFRNSSRGFQHWILALQNATK---LPMKLNVYTKDELETEKLEFTS-----QPDFKK   926

Query:   969 -VENRQSEDIVRAIS--VLESVEQINQTY--KAAIELPTVRTPSQVKK-IYEPILDIEGV   1022
              VE  + D ++ S   + E+ + +N  Y   +AA EL  +++TPSQVKK  YE  L +  V
Sbjct:   927 LVEESEKFDNIMSFSDEIKEAQKIMNYQYPHQAATELSSIQTPSQVKKRSYEKQLQVGEV   986

Query:  1023 D-VMETITKTSVDFKLPDFSTSKKQDPAALGSAVHELMQRIEMSSHVKMEDIQKALTEVN   1081
                V E +  ++DF  DF    KK    A +GSA H   MQ  +   S    +    Q   L E+
Sbjct:   987 QPVSEFVRVKNLDFS--DFG-PKKITAAEMGSATHSFMQYADF-SQADLFSFQATLDEMG   1042

Query:  1082 AETSVKAAIQIEKINYFFQETSLGKYIQEEVEHLHREAPFAMLKEDPESGEKFVVRGIID   1141
              +  +K  I I KI    F +T  G+++ E V+    +EAPF+ML+  D    + E+++VRGI D
Sbjct:  1043 FDEKIKNQIDITKILTLF-DTEFGQFLSENVDKTVKEAPFSMLRTDEFAKEQYIVRGICD   1101

Query:  1142 GYLLLENRIILFDYKTDKFVNP---LELKERYQGQMALYAEALKKSYEIEKIDKYLILLG   1198
             G++ L ++IILFDYKTD+F N        E+KERY+ QM LY+EAL+K+Y + +IDKYLILLG
Sbjct:  1102 GFVKLADKIILFDYKTDRFTNVSAISEIKERYKDQMNLYSEALQKAYHVNQIDKYLILLG   1161

Query:  1199 G-KQLEVVKMD                                                  1208
             G +++  V K+D
Sbjct:  1162 GPRKVFVEKID                                                  1172
```

A related DNA sequence was identified in *S. pyogenes* <SEQ ID 4291> which encodes the amino acid sequence <SEQ ID 4292>. Analysis of this protein sequence reveals the following:

```
Possible site: 61
>>> Seems to have an uncleavable N-term signal seq

----- Final Results -----
          bacterial membrane --- Certainty = 0.0000(Not Clear) < succ>
           bacterial outside --- Certainty = 0.0000(Not Clear) < succ>
         bacterial cytoplasm --- Certainty = 0.0000(Not Clear) < succ>
```

The protein has homology with the following sequences in the databases:

```
>GP:AAC12966 GB:U76424 exonuclease RexA [Lactococcus lactis]
Identities = 478/1206 (39%), Positives = 700/1206 (57%), Gaps = 65/1206 (5%)

Query:    40 KRTAQQIEAIYTSGQNILVSASAGSGKTFVMVERILDKILRGVSIDRLFISTFTVKAATE   99
             K T +Q EAI++SG+NILVSASAGSGKTFVM +RI++K+ +G+ IDRLFISTFT KAA+E
Sbjct:     5 KLTPEQNEAIHSSGKNILVSASAGSGKTFVMAQRIVEKVKQGIEIDRLFISTFTKKAASE   64

Query:   100 LRERIENKLYSQIAQTTDFQMKVYLTEQLQSLCQADIGTMDAFAQKVVSRYGYSIGISSQ   159
             LR R+E  L    +++D +   LT LQ+L  ADIGTMD+F QK+         + I
Sbjct:    65 LRMRLERDLKKARQESSDDEEAHRLTLALQNLSNADIGTMDSFTQKLTKANFNRVNIDPN   124

Query:   160 FRIMQDKAEQDVLKQEVFSKLFNEFMNQKEA-----PVFRALVKNFSGNCKDTSAFRELV   214
             FRI+ D+ E D+++QEVF +L   +++  E+        F   L+KNFS + ++    F+++V
Sbjct:   125 FRILADQTESDLIRQEVFEQLVESYLSADESLNISKDFEKLIKNFSKD-RNILGFQKVV   183

Query:   215 YTCYSFSQSTENPKIWLQENFLSAAKTYQRLEDIPDHDIELLLLAMQDTANQLRDVTDME   274
             YT Y F+ +TENP  WL+  FL   +TY+ L D+ + D + +           T +L +    +
Sbjct:   184 YTIYRFASATENPISWLENQFLKGFETYRSLTDLSE-DFTVNVKENLLTFFELLEAISKK   242
```

-continued

```
Query:   275 DYGQLTKAG-SRSAKYTKHLTIIEKLSDWVRDFKCLYGKAGLDRLIRDVTGLIPSGNDVT  333
             D+   T   S       +   ELS  +DF                            D+
Sbjct:   243 DFVTCTALFLSIDTDIRVGSSKDEALSALKKDFSA-------------------QKQDLV  283

Query:   334 VSKVKYPVFKTLHQKLKQFRHLETILMYQKDCFSLLEQLQDFVLAFSEAYLAVKIQESAF  393
                  SK K   +   K+K  H + I  YQ    F +   LQ F++ F + YL  K  E+AF
Sbjct:   284 GSKSKPGELRKFVDKIK---HGQLIEKYQNQAFEIASDLQKFIIDFYKTYLERKKNENAF  340

Query:   394 EFSDIAHFAIKILEENTDIRQSYQQHYHEVMVDEYQDNNHMQERLLTLLSNGHNRFMVGD  453
                 E+SDIAHFAI+ILEEN DIR++ ++HY E+M DEYQD H QER+L LLSNGHN FMVGD
Sbjct:   341 EYSDIAHFAIEILEENPDIRENLREHYDEIMIDEYQDTSHTQERMLELLSNGHNLFMVGD  400

Query:   454 IKQSIYRFRQADPQIFNQKFRDYQKKPEQGKVILLKENFRSQSEVLNVSNAVFSHLMDES  513
                 IKQSIY FR ADP +F +K+ Y +      ++I LKENFRS+ EVLN +N +F HLMDE
Sbjct:   401 IKQSIYGFRLADPGLFLEKYKSYDQAENPNQLIRLKENFRSRGEVLNFTNDIFKHLMDEK  460

Query:   514 VGDVLYDEQHQLIAG--SHAQTVPYLDRRAQLLLYNSDKDDGNAPSDSEGISFSEVTIVA  571
                 +G++ Y ++  L+ G  S       D   +LLLY + +      IS  E+   A
Sbjct:   461 LGEMTYGKEEALVQGNISDYPVEAEKDFYPELLLYKENTSEEEIEDSEVKISDGEIKGAA  520

Query:   572 KEIIKLHNDKGVPFEDITLLVSSRTRNDIISHTFNQYGIPIATDGGQQNYLKSVEVMVML  631
                 +EI KL + GV +DI +LV S++ N+ I         Y IP+  D G+ ++LKS+EV++ML
Sbjct:   521 QEIKKL-IEYGVEPKDIAILVRSKSNNNKIEDILLSYDIPVVLDEGRVDFLKSMEVLIML  579

Query:   632 DTLRTINNPRNDYALVALLRSPMFAFDEDDLARIALQKDNELDKDCLYDKIQRAVIGRGA  691
                 D LR I+NP  D +LVA+LRSP+F F+ED+L RI++Q    +    +DKI ++     G
Sbjct:   580 DVLRAIDNPLYDLSLVAMLRSPLFGFNEDELTRISVQGSRDLR---FWDKILLSLKKEGK  636

Query:   692 HPELIHDTLLGKLNVFLKTLKSWRRYAKLGSLYDLIWKIFNDRFYFDFVASQAKAEQAQA  751
                 +PELI+ +L  KL  F +       WR+        ++ L+WKI+ + +YFD+V +    E  QA
Sbjct:   637 NPELINLSLEQKLKAFNQKFTEWRKLVNKIPIHRLLWKIYTETYYFDYVGALKNGEMRQA  696

Query:   752 NLYALALRANQFEKSGYKGLYRFIKMIDKVLETQNDLADVEVATPKQAVNLMTIHKSKGL  811
                 NL AL++RA  +E SGYKGL++F+++I+K +E  NDLA V +   P+ AV +MT HKSKGL
Sbjct:   697 NLQALSVRAESYESSGYKGLFKFVRLINKFMEQNNDLASVNIKLPQNAVRVMTFHKSKGL  756

Query:   812 QFPYVFILNCDKRFSMTIDHKSFILNRQHGIGIKYLADIKGLLGE-TTLNSVKVSMETLP  870
                 +F YVF++N   RF+  D+ +    IL+R+HG+G+KY+AD+K         T     V MET P
Sbjct:   757 EFDYVFLMNLQSRFNDRDLKEDVILSREHGLGMKYIADLKAEPDVITDFPYALVKMETFP  816

Query:   871 YQLNKQELRLATLSEEMRLLYVAMTRAEKKVYFIGK---ASKSKSQEITDPKKL-GKLLP  926
                 Y +NK + A LSEEMR+LYVA TRA+KK+Y +GK      K    E+ D   L GK+L
Sbjct:   817 YMVNKDLKQRAALSEEMRVLYVAFTRAKKKLYLVGKIKDTDKKAGLELYDAATLEGKILS  876

Query:   927 LALREQLLTFQDWLLAIADIFSTEDLYFDVRFIEDSDLTQESVGRLQTP---QLLNPDDL  983
                      R    FQ W+LA+    +   L     +     +L E+    P     +L+   +
Sbjct:   877 DKFRNSSRGFQHWILALQ---NATKLPMKLNVYTKDELETEKLEFTSQPDFKKLVEESEK  933

Query:   984 KDNRQSETIARALDMLEAVSQLNANY--EAAIHLPTVRTPSQL-KATYEPLLEPIGVDII  1040
                    DN  S +       ++ EA +N Y   +AA  L +++TPSQ+   K +YE L+       V  +
Sbjct:   934 FDNIMSFSD----EIKEAQKIMNYQYPHQAATELSSIQTPSQVKKRSYEKQLQVGEVQPV  989

Query:  1041 EKSSRSLSDFTLPHFSKKAKVEASHIGSALHQLMQVLPLSKP--INQQTLLDALRGIDSN  1098
                     +  R + +    F  K K+ A+ +GSA H  MQ     S+     + Q  LD + G D
Sbjct:   990 SEFVR-VKNLDFSDFGPK-KITAAEMGSATHSFMQYADFSQADLFSFQATLDEM-GFD--  1044

Query:  1099 EEVKTALDLKKIESFFCDTSLGQFFQTYQKHLYREAPFAILKLDPISQEEYVLRGIIDAY  1158
                     E++K +D+ KI + F DT GQF         +EAPF++L+  D  ++E+Y++RGI D +
Sbjct:  1045 EKIKNQIDITKILTLF-DTEFGQFLSENVDKTVKEAPFSMLRTDEFAKEQYIVRGICDGF  1103

Query:  1159 FLFDDHIVLVDYKTDKYKQP---IELKKRYQQQLELYAEALTQTYKLPVTKRYLVLMGGG  1215
                     D I+L  DYKTD++             E+K+RY+ Q+ LY+EAL + Y +    +YL+L+GG
Sbjct:  1104 VKLADEIILFDYKTDRFTNVSAISEIKERYKDQMNLYSEALQKAYHVNQIDKYLILLGGP  1163

Query:  1216 KPEIVE                                                       1221
                    +  VE
Sbjct:  1164 RKVFVE                                                        1169
```

An alignment of the GAS and GBS proteins is shown below.

```
Identities = 728/1211 (60%), Positives = 916/1211 (75%), Gaps = 5/1211 (0%)
Query:     1 MMTFKPFLNPEDIAVIQTEEKNSDKKQKRTPEQIEAIYTFGNNVLVSASAGSGKTFVMVE   60
                 +++F PFL+PE I  +Q  E+   D+ QKRT +QIEAIYT G N+LVSASAGSGKTFVMVE
Sbjct:    13 VISFAPFLSPEAIKHLQENERCRDQSQKRTAQQIEAIYTSGQNILVSASAGSGKTFVMVE   72

Query:    61 RILDKLLRGVPIDSLFISTFTVKAAGELKERLEKKINESLKSAESDDLKQFLTQQLVGIQ  120
                 RILDK+LRGV ID LFISTFTVKAA EL+ER+E K+    +         +K +LT+QL +
```

-continued

```
Sbjct:   73 RILDKILRGVSIDRLFISTFTVKAATELRERIENKLYSQIAQTTDFQMKVYLTEQLQSLC   132

Query:  121 TADIGTMDAFTQKIVNQYGYTLGISPIFRILQDKNEQDVIKNEVYADLFSDYMTGKNAAS   180
            ADIGTMDAF QK+V++YGY++GIS  FRI+QDK EQDV K EV++ LF+++M  K A
Sbjct:  133 QADIGTMDAFAQKVVSRYGYSIGISSQFRIMQDKAEQDVLKQEVFSKLFNEFMNQKEAPV   192

Query:  181 FIKLVKNFSGNRKDSKAFREMVYKVYAFSQSTDNPKRWMQTVFLKGAQTYTDFEAIPDQE   240
            F  LVKNFSGN KD+ AFRE+VY  Y+FSQST+NPK W+Q  FL  A+TY   E IPD +
Sbjct:  193 FRALVKNFSGNCKDTSAFRELVYTCYSFSQSTENPKIWLQENFLSAAKTYQRLEDIPDHD   252

Query:  241 VSSLLNVMQTTANQLRDLTDQEDYKQLTAKGVPTANYKKHLKIIENLVHWSQDFNLLYGK   300
            + LL  MQ TANQLRD+TD EDY QLT  G +A Y KHL IIE L W +DF  LYGK
Sbjct:  253 IELLLLAMQDTANQLRDVTDMEDYGQLTKAGSRSAKYTKHLTIIEKLSDWVRDFKCLYGK   312

Query:  301 KGLTNLARDITNVIPSGNDVTAGVKYPIFKQLHNRIVGLKHLEVIFKYQGESLFLLELL   360
             GL  L RD+T +IPSGNDVTV+ VKYP+FK LH ++   +HLE I  YQ +   LLE L
Sbjct:  313 AGLDRLIRDVTGLIPSGNDVTVSKVKYPVFKTLHQKLKQFRHLETILMYQKDCFSLLEQL   372

Query:  361 QSFVLDFSEQYLQEKIQENAFEFSDIAHFAIQILEENHDIRQLYQDKYHEVMVDEYQDNN   420
            Q FVL FSE YL  KIQE+AFEFSDIAHFAI +ILEEN DIRQ YQ  YHEVMVDEYQDNN
Sbjct:  373 QDFVLAFSEAYLAVKIQESAFEFSDIAHFAIKILEENTDIRQSYQQHYHEVMVDEYQDNN   432

Query:  421 HTQERMLELLSNGHNRFMVGDIKQSIYRFRQADPQIFNDKYKAYQDNPSQGKLIILKENF   480
            H QER+L LLSNGHNRFMVGDIKQSIYRFRQADPQIFN K++  YQ  P QGK+I+LKENF
Sbjct:  433 HMQERLLTLLSNGHNRFMVGDIKQSIYRFRQADPQIFNQKFRDYQKKPEQGKVILLKENF   492

Query:  481 RSQSEVLDSTNSVFTHLMDEEVGDILYDESHQLKAGSPRQQERHPNNKTQVLLLDTDEDD   540
            RSQSEVL+ +N+VF+HLMDE VGD+LYDE HQL AGS Q   + + +  Q+LL ++D+DD
Sbjct:  493 RSQSEVLNVSNAVFSHLMDESVGDVLYDEQHQLIAGSHAQTVPYLDRRAQLLLYNSDKDD   552

Query:  541 IDDDSQQYDISPAEAKLVAKEIIRLHKEENVPFQDITLLVSSRTRNDGILQTFDRYGIP   600
              ++ S    IS +E  +VAKEII+LH ++ VPF+DITLLVSSRTRND I  TF++YGIP
Sbjct:  553 -GNAPSDSEGISFSEVTIVAKEIIKLHNDKGVPFEDITLLVSSRTRNDIISHTFNQYGIP   611

Query:  601 LVTDGGEQNYLKSVEVMVMLDTLRSIDNPLNDYALVALLRSPMFGFNEDDLTRIAIQD--   658
            + TDGG QNYLKSVEVMVMLDTLR+I+NP NDYALVALLRSPMF F+EDDL RIA+Q
Sbjct:  612 IATDGGQQNYLKSVEVMVMLDTLRTINNPRNDYALVALLRSPMFAFDEDDLARIALQKDN   671

Query:  659 --VKMAFYHKVKLSYHKEGHHSDLITPELSSKIDHFMKTFQTWRDFAKWHSLYDLIWKIY   716
              K   Y K++ +     G H +LI   L  K++ F+KT ++WR +AK  SLYDLIWKI+
Sbjct:  672 ELDKDCLYDKIQRAVIGRGAHPELIHDTLLGKLNVFLKTLKSWRRYAKLGSLYDLIWKIF   731

Query:  717 NDRFYYDYVGALPKAEQRQANLYALALRANQFEKTGFKGLSRFIRMIDKVLENENDLADV   776
            NDRFY+D+V +   KAEQ QANLYALALRANQFEK+G+KGL RFI+MIDKVLE +NDLADV
Sbjct:  732 NDRFYFDFVASQAKAEQAQANLYALALRANQFEKSGYKGLYRFIKMIDKVLETQNDLADV   791

Query:  777 EVALPQNAVNLMTIHKSKGLEFKYVFILNIDKKFSMVDITSPLILSRNQGIGIKYVADMR   836
            EVA P+ AVNLMTIHKSKGL+F YVFILN DK+FSM DI    IL+R  GIGIKY+AD++
Sbjct:  792 EVATPKQAVNLMTIHKSKGLQFPYVFILNCDKRFSMTDIHKSFILNRQHGIGIKYLADIK   851

Query:  837 HELEEEILPAVKVSMETLPYQLNKRELRLATLSEQMRLLYVAMTRAEKKLYLVGKASQTK   896
              L E  L  +KVSMETLPYQLNK ELRLATLSE+MRLLYVAMTRAEKK+Y  GKAS++K
Sbjct:  852 GLLGETTLNSVKVSMETLPYQLNKQELRLATLSEEMRLLYVAMTRAEKKVYFIGKASKSK   911

Query:  897 WADHYDLVSENNHLPLASRETFVTFQDWLLAVHETYKKQELFYDINFVSLEELTDHHIGM   956
              + D    LPLA RE  +TFQDWLLA + +  ++L++D+ F+    LT   +G
Sbjct:  912 SQEITDPKKLGKLLPLALREQLLTFQDWLLAIADIFSTEDLYFDVRFIEDSDLTQESVGR   971

Query:  957 VNPSLPFNPDNKVENRQSEDIVRAISVLESVEQINQTYKAAIELPTVRTPSQVKKIYEPI  1016
              +     NPD+ +NRQSE I RA+ +LE+V Q+N Y+AAI LPTVRTPSQ+K  YEP+
Sbjct:  972 LQTPQLLNPDDLKDNRQSETIARALDMLEAVSQLNANYEAAIHLPTVRTPSQLKATYEPL  1031

Query: 1017 LDIEGVDVMETITKTSVDFKLPDFSTSKKQDPAALGSAVHELMQRIEMSSHVKMEDIQKA  1076
            L+ GVD++E +++ DF LP FS  K + +  +GSA+H+LMQ +S +   +   A
Sbjct: 1032 LEPIGVDIIEKSSRSLSDFTLPHFSKKAKVEASHIGSALHQLMQVLPLSKPINQQTLLDA  1091

Query: 1077 LTEVNAETSVKAAIQIEKINYFFQETSLGKYIQEEVEHLHREAPFAMLKEDPESGEKFVV  1136
            L  +++   VK A+  ++KI  FF  +TSLG++  Q   +HL+REAPFA+LK DP S E++V+
Sbjct: 1092 LRGIDSNEEVKTALDLKKIESFFCDTSLGQFFQTYQKHLYREAPFAILKLDPISQEEYVL  1151

Query: 1137 RGIIDGYLLLENRIILFDYKTDKFVNPLELKERYQGQMALYAEALKKSYEIEKIDKYLIL  1196
            RGIID Y L ++  I+L DYKTDK+  P+ELK+RYQ Q+ LYAEAL ++Y++    +YL+L
Sbjct: 1152 RGIIDAYFLFDDHIVLVDYKTDKYKQPIELKKRYQQQLELYAEALTQTYKLPVTKRYLVL  1211

Query: 1197 LGGKQLEVVKM                                                  1207
            +GG + E+V++
Sbjct: 1212 MGGGKPEIVEV                                                  1222
```

Based on this analysis, it was predicted that these proteins and their epitopes could be useful antigens for vaccines or diagnostics.

EXAMPLE 1399

A DNA sequence (GBSx1484) was identified in *S. agalactiae* <SEQ ID 4293> which encodes the amino acid sequence <SEQ ID 4294>. This protein is predicted to be exonuclease RexB. Analysis of this protein sequence reveals the following:

```
Possible site: 23
>>> Seems to have no N-terminal signal sequence

----- Final Results -----
             bacterial cytoplasm --- Certainty = 0.0660(Affirmative) < succ>
              bacterial membrane --- Certainty = 0.0000(Not Clear)   < succ>
               bacterial outside --- Certainty = 0.0000(Not Clear)   < succ>
```

The protein has homology with the following sequences in the GENPEPT database.

```
>GP: AAC12965 GB: U76424 exonuclease RexB [Lactococcus lactis]
Identities = 363/1093 (33%), Positives = 604/1093 (55%), Gaps = 67/1093 (6%)
Query:    1 MKLLYTDINHDMTEILVNQAAHAAEAGWRIFYIAPNSLSFEKERAVLENLPQ---EASFA    57
            M++LYT+I  D+TE L+  A     E    +++YI P+S+SFEKE+ +LE L +    A F
Sbjct:    1 MEILYTEITQDLTEGLLEIALEELEKNRKVYYIVPSSMSFEKEKEILERLAKGSDTAVFD   60

Query:   58 ITITRFAQLARYFTLNQP-NQKESLNDIGLAMIFYRALASFEDGQLKVFGRLKQDASFIS  116
            + +TRF QL  YF  +    K  L +GL+M+F R L SF+  ++ ++   L+  A F+
Sbjct:   61 LLVTRFKQLPYYFDKREKATMKTELGTVGLSMLFRRVLRSFKKDEIPLYFSLQDSAGFLE  120

Query:  117 QLVDLYKELQTANLSILELKYLHSPEKFEDLLAIFLVVSDLLREGEYDNQSKIAFFTEQV  176
             L+ L   EL TANLS+  L       ++ + +LA F     +   EY N S+   FT ++
Sbjct:  121 MLIQLRAELLTANLSVENLPDNPKNQELKKILAKFEAELSV----EYANYSEFGDFTNRL  176

Query:  177 RSGQLDVDLKNTILIVDGFTRFSAEEEALIKSLSSRCQEIIIGAYASQKAYKANFTNGNI  236
               G+  D  LK+  +I+DG+TRFSAEEE  I+S+  +    ++G Y+ + +  A   + I
Sbjct:  177 VDGEFDQQLKDVTIIIDGYTRFSAEEELFIESIQEKVARFVVGTYSDENSLTAG--SETI  234

Query:  237 YSAGVDFLRYLATTFQTKPEFILSKWESKSGFEMISK-----NIEGKHDFTNSSHILDDT  291
            Y    +     T F+ K    L K  S +   E+ SK        +++ +  T+    L
Sbjct:  235 YVGTSQMI----TRFRNKFPVELRKIASSAVNEVYSKLTRILDLDSRFVITDEKIELKAE  290

Query:  292 AKDCITIWECINQKDEVEHVARAIRQKLYQGYRYKDILVLLGDVDSYKLQLSKIFEQYDI  351
             +   IWE  NQK +E VA+ IRQK+ QG +KD  VL+GD +Y++ L ++F+ Y+I
Sbjct:  291 DEKYFRIWEAENQKVEIERVAKEIRQKIIQGAFFKDFTVLVGDPAAYEITLKEVFDLYEI  350

Query:  352 PYYFGKAETMAAHPLVHFMDSLSRIKRYRFRAEDVLNLFKTGIYGEISQDD--LDYFEAY  409
            P+++  +  E+M+ HPLV F  +SL  IK+  +R +DV+NL K+ +Y + + D+  +DYFE Y
Sbjct:  351 PFFYAQEESMSQHPLVIFFESLFAIKKNNYRTDDVVNLLKSKVYTDANLDEEVIDYFEYY  410

Query:  410 ISYADIKGPKKFFTDFVVGAKKFDLGRLNTIRQSLL---TPLESFV-KTKKQDGIKTLNQ  465
            +      I G KKF +F+  ++    +N +R+ LL     +PL+ F+  +K+ G K ++
Sbjct:  411 VQKYKISGRKKFTEEFIE-SEFSQIELVNEMREKLLGSESPLQVFLGNNRKKTGKKWVSD  469

Query:  466 FMFFLTQVGLSDNLSRLVGQMS-ENEQE---KHQEVWKTFTDILEQFQTIFGQEKLNLDE  521
                 L   + N++        +NE +   KH++VW+    L +F  +F EKL    E
Sbjct:  470 LQGLLENGNVMTNMNAYFSAAELQNEHQMADKHEQVWQMLISTLNEFLAVFSDEKLKSVE  529

Query:  522 FLSLLNSGMMQAEYRMVPATVDVVTVKSYDLVEPHSNQFVYALGMTQSHFPKIAQNKSLI  581
            FL +L +G+  A+YR +PA VDVV VK Y+LVEP +N+++YA+G++Q+ FP+I +N +L+
Sbjct:  530 FLDILLAGLKNAKYRQIPANVDVVNVKDYELVEPKTNKYIYAIGLSQTNFPRIKKNSTLL  589

Query:  582 SDIERQLINDANDTDGHFDIMTQENLKKNHFAALSLFNAAKQELVLTIPQLLNESEDQMS  641
            SD ER  IN  D +  ++  N +KN F  LSL N+AK+ LVL++PQ++    + + S
Sbjct:  590 SDEERLEINQTTDENQFIEQLNVANYQKNQFTVLSLINSAKESLVLSMPQIMANEQGEFS  649

Query:  642 P-YLVELRDIGVPFNHKGR-QSLKEEADNIGNYKALLSRVVDLYRSAIDKEMTKEE-QTF  698
            P + + L+D      K +  +L E  ++IGN +++++ +  + R ++  E T+ E+  F
Sbjct:  650 PVFQLFLKDADEKILQKIQGVNLFESLEHIGNSRSVIAMIGQIERELVESEETSEDKRVF  709

Query:  699 WSVAVRYLRRQLTSKGIEIPIITDSLDTVTVSSDVMTRRFPEDDPLKLSSSALTTFYNNQ  758
            WS   R L +      +   + +DTV ++ D    +   D   S  S+ FYN +
Sbjct:  710 WSSIFRILVKSNADFQKILLDLAKDIDTVNLAPDTLEQIY--GDKIYASVSSFERFYNCE  767
```

```
-continued
Query:   759 YKYFLQYVLGLEEQDSIHPDMRHHGTYLHRVFEILMKNQGI--ESFEEKLNSAINKTNQE   816
             Y+YFL+  L LE ++I + + G + H VFE +MK   + E+F+EKL   + + ++
Sbjct:   768 YQYFLENTLSLETFENIDINSKIVGNFFHEVFEKVMKETDLSAENFDEKLTLVLQEVDKN   827

Query:   817 DVFKSLYSEDAESRYSLEILEDIARATATILR----QDSQMTVESE-------EERFELM   865
             +    +++DA +R++   LE+I R TAT+L+       D    T+ +E         E
Sbjct:   828 --YSRYFTQDATARFTWSNLEEIVRQTATVLKATVSTDELKTLLTESSFGLPKSELGNFS   885

Query:   866 IDNTIKINGIIDRIDRLSDGSLGVVDYKSSAQKFDIQKFYNGLSPQLVTYIDAISRDKEV   925
             +D+ I + G IDR+D+LS   LG +DYKSSA  F +Q+ Y+GLS Q +TY+D I   K+
Sbjct:   886 VDD-IYLRGRIDRLDQLSTDYLGAIDYKSSAHSFKLQEAYDGLSLQFMTYLDVI---KQA   941

Query:   926 EQKPPIFGAMYLHMQEPRQDLSKIKNLDDLVTKNHQALTYKGLFSEAEKEFLANGKYHL-   984
                  I+GA+YL +      +LS+I  L ++     +++ Y+GL  E    E +  G  ++
Sbjct:   942 FPNQKIWGALYLQFKNQPINLSEINQLSEIANILKESMRYEGLVLEDAAEQI-KGIENIA  1000

Query:   985 --KDSLYSETEIAILQAHNQSLYKKASETIKSGKFLINPYTEDAKTVDGD---------Q  1033
               K ++Y+E  E    L    N+   Y+ A + +K GK  INP  + ++ +D
Sbjct:  1001 LKKTNIYNEEEFEQLLKLNEEHYRAAGQRLKKGKIAINPIMKRSEGIDQSGNVRGCRYCP  1060

Query:  1034 FKSITGFEADRHM                                                1046
             KSI  FEA+ HM
Sbjct:  1061 LKSICRFEANIHM                                                1073
```

A related DNA sequence was identified in *S. pyogenes* <SEQ ID 4295> which encodes the amino acid sequence <SEQ ID 4296>. Analysis of this protein sequence reveals the following:

```
Possible site: 23
>>> Seems to have no N-terminal signal sequence

----- Final Results -----
              bacterial cytoplasm --- Certainty = 0.1891(Affirmative) < succ>
              bacterial membrane  --- Certainty = 0.0000(Not Clear)  < succ>
               bacterial outside  --- Certainty = 0.0000(Not Clear)  < succ>
```

An alignment of the GAS and GBS proteins is shown below.

```
Identities = 546/1075 (50%), Positives = 758/1075 (69%), Gaps = 11/1075 (1%)
Query:     1 MKLLYTDINHDMTEILVNQAAHAAEAGWRIFYIAPNSLSFEKERAVLENLPQEASFAITI    60
             MKL+TY++++ MTEILVN+A  AA+ G+R+FYIAPNSLSFEKER VL  LP+  +F+I +
Sbjct:     1 MKLIYTEMSYSMTEILVNEARKAADQGYRVFYIAPNSLSFEKEREVLTLLPERGTFSIIV    60

Query:    61 TRFAQLARYFTLNQPNQKESLNDIGLAMIFYRALASFEDGQLKVFGRLKQDASFISQLVD   120
             TRF Q++RYFT+    K+ L+D  LAMIFYRAL   +   L +GRL+ ++ FI QLV+
Sbjct:    61 TRFVQMSRYFTVESSPSKQHLDDTTLAMIFYRALMQLKPEDLPSYGRLQNNSVFIEQLVE   120

Query:   121 LYKELQTANLSILELKYLHSPEKFEDLLAIFLVVSDLLREGEYDNQSKIAFFTEQVRSGQ   180
             LYKEL+  A LS+ +L  L  P+K EDL+ I  +    ++ + +Y+  S + F    ++ G
Sbjct:   121 LYKELKNAQLSVHDLTGLDHPQKQEDLIKIIELAETIMIQQDYNQDSPLQSFARAIKLGL   180

Query:   181 LDVDLKNTILIVDGFTRFSAEEEALIKSLSSRCQEIIIGAYASQKAYKANFTNGNIYSAG   240
             L+  L   T++++DGF+RFSAEE+ L+  L++ CQE+IIG+Y SQKAY+  +F  GNIY A
Sbjct:   181 LNNQLSKTVVVIDGFSRFSAEEDYLLSLLNNNCQEVIIGSYVSQKAYQKSFIKGNIYEAS   240

Query:   241 VDFLRYLATTFQTKPEFILSKWESKSGFEMISKNIEGKHDFTNSSHILDDTAKDCITIWE   300
             + FL+ LA + KP F S    K F +++ E  HDF+    L  + D   ++W+
Sbjct:   241 LHFLQDLAQKYHIKPVFATSNQVFKPAFSRLTQLFEATHDFSQVDWQLQKSDLDHFSLWQ   300

Query:   301 CINQKDEVEHVARAIRQKLYQGYRYKDILVLLGDVDSYKLQLSKIFEQYDIPYYFGKAET   360
             C +QK+E+EHVA++IRQKLY+GYRYKDILVLLGD+D+Y+LQ+   IF++++IPYY GKAE
Sbjct:   301 CHHQKEEIEHVAKSIRQKLYEGYRYKDILVLLGDMDAYQLQIGPIFDKFEIPYYLGKAEP   360

Query:   361 MAAHPLVHFMDSLSRIKRYRFRAEDVLNLFKTGIYGEISQDDLDYFEAYISYADIKGPKK   420
             MAAHPLV F++SL R +RY +R ED+LN+ K+G++G      D+D FE Y  +ADIKG  K
Sbjct:   361 MAAHPLVQFIESLERSQRYNWRREDILNMLKSGLFGCFDDSDIDRFEEYTQFADIKGFTK   420

Query:   421 FFTDFVV-GAKKFDLGRLNTIRQSLLTPLESFVKTKKQDGIKTLNQFMFFLTQVGLSDNL   479
             F   F +   ++++ L  LN +RQ ++  PL+    K++KQ G   +++ + FL ++  L++N+
Sbjct:   421 FSKPFTINSSRQYPLDFLNEMRQDIVLPLQELFKSQKQLGASLVDKLILFLKKIRLAENM   480

Query:   480 SRLVGQMSENEQEKHQEVWKTFTDILEQFQTIFGQEKLNLDEFLSLLNSGMMQAEYRMVP   539
                    L      S+ E EK++EVWK  FTDIL   F  IFGQEKL L + L+L+  +GM  A+YR+VP
```

-continued

```
Sbjct:   481  QGLA--QSQLEVEKNEEVWKRFTDILTSFHHIFGQEKLRLSDCLALIKTGMKSAQYRVVP       538

Query:   540  ATVDVVTVKSYDLVEPHSNQFVYALGMTQSHFPKIAQNKSLISDIERQLINDANDTDGHF       599
              AT+DVVT+KSYDLV+PHS  FVYA+G+TQSHFPK  +   L+SD ER  IN+  +   HF
Sbjct:   539  ATLDVVTIKSYDLVQPHSKPFVYAIGLTQSHFPKQIHHSGLLSDQERARINEIRNY-RHF       597

Query:   600  DIMTQENLKKNHFAALSLFNAAKQELVLTIPQLLNESEDQMSPYLVELRDIGVPFNHKGR       659
              DI + EN KKNH  ALSLFNAA +ELVL++   ++NE+ D +SPYL EL + G+P    KG+
Sbjct:   598  DIASAENSKKNHQTALSLFNAATKELVLSVSTVINETFDDLSPYLKELINFGLPLLDGK       657

Query:   660  QSLKEEADNIGNYKALLSRVVDLYRSAIDKEMTKEEQTFWSVAVRYLRRQLTSKGIEIPI       719
                 L   +  +IGNYKALLS+++  +  R  +    EM+  +++ FW+V +RYLR+QL   +  +E+P
Sbjct:   658  NYLSYDNSDIGNYKALLSQIIAINRQDL-IEMSDQDKMFWTVVLRYLRKQLRKQQLELPT       716

Query:   720  ITDSLDTVTVSSDVMTRRFPEDDPLKLSSSALTTFYNNQYKYFLQYVLGLEEQDSIHPDM       779
                   L T   +S  +V+     FP+   PLKLS++ALT FYNNQY YFL+YVL L +   +SIHPD
Sbjct:   717  SDYRLSTKPLSKEVIEVCFPKGIPLKLSATALTVFYNNQYNYFLKYVLNLNKTESIHPDS       776

Query:   780  RHHGTYLHRVFEILMKNQGIESFEEKLNSAINKTNQEDVFKSLYSEDAESRYSLEILEDI       839
                R HG YLHRVFE LMK+    E F+  KL   AI   TNQE  F+ +Y ++AE+ YSL ILEDI
Sbjct:   777  RIHGQYLHRVFERLMKDHTQEPFDNKLKQAIYHTNQESFFQQVYQDNAEAEYSLAILEDI       836

Query:   840  ARATATILRQDSQMTVESEEERFELMIDNTIKINGIIDRIDRLSDGSLGVVDYKSSAQKF       899
                 R+TA IL+ +  + V  +E+ F+L + N I  ++GIIDRID+LSDGSLG+VDYKSSA +F
Sbjct:   837  VRSTAPILQLNQNIQVIDQEKNFQLDMGNEILVHGIIDRIDQLSDGSLGIVDYKSSANQF       896

Query:   900  DIQKFYNGLSPQLVTYIDAISR--DKEVEQKPPIFGAMYLHMQEPRQDLSKIKNLDD-LV       956
              DI   FYNGLSPQL+TY+ A+ +      ++ Q    +FGAMYLH+Q+P+ DL     K  +D+  LV
Sbjct:   897  DIGTFYNGLSPQLMTYLAALKQIAPHDINQ---LFGAMYLHLQDPKLDLVTFKQIDNTLV       953

Query:   957  TKNHQALTYKGLFSEAEKEFLANGKYHLKDSLYSETEIAILQAHNQSLYKKASETIKSGK      1016
                   ++ALTYKG+FSE EKE L+ G Y   K++LYS  E+    L  +N+ LY KA++ IK G
Sbjct:   954  ESIYKALTYKGIFSEVEKEHLSTGAYQTKNALYSNDELETLLNYNKYLYLKAAKHIKKGH      1013

Query:  1017  FLINPYTEDAKTVDGDQFKSITGFEADRHMARARALYKLPAKEKRQGFLTLMQQE            1071
              FLINPYT D KTV GDQ K+IT FEAD  M +AR L   LPAKEK++ FLTLM++E
Sbjct:  1014  FLINPYTSDGKTVQGDQLKAITRFEADLDMGQARRLVTLPAKEKKECFLTLMRKE            1068
```

Based on this analysis, it was predicted that these proteins and their epitopes could be useful antigens for vaccines or diagnostics.

EXAMPLE 1400

A DNA sequence (GBSx1485) was identified in *S. agalactiae* <SEQ ID 4297> which encodes the amino acid sequence <SEQ ID 4298>. Analysis of this protein sequence reveals the following:

```
Possible site: 31
>>> Seems to have no N-terminal signal sequence
    INTEGRAL      Likelihood = -7.80       Transmembrane      51-67 (44-69)

----- Final Results -----
            bacterial membrane --- Certainty = 0.4121(Affirmative) < succ>
            bacterial outside  --- Certainty = 0.0000(Not Clear)   < succ>
            bacterial cytoplasm --- Certainty = 0.0000(Not Clear)   < succ>
```

A related GBS nucleic acid sequence <SEQ ID 8799> which encodes amino acid sequence <SEQ ID 8800> was also identified. Analysis of this protein sequence reveals the following:

```
Lipop: Possible site: -1 Crend: 10
McG: Discrim Score: -20.62
GvH: Signal Score (-7.5): -6.25
    Possible site: 31
>>> Seems to have no N-terminal signal sequence
ALOM program count: 1 value: -7.80 threshold: 0.0
    INTEGRAL      Likelihood = -7.80       Transmembrane      47-63 (40-65)
    PERIPHERAL    Likelihood = 3.34        26
modified ALOM score: 2.06
*** Reasoning Step: 3
```

```
----- Final Results -----
          bacterial membrane --- Certainty = 0.4121(Affirmative) < succ>
           bacterial outside --- Certainty = 0.0000(Not Clear)   < succ>
         bacterial cytoplasm --- Certainty = 0.0000(Not Clear)   < succ>
```

The protein has homology with the following sequences in the GENPEPT database.

```
>GP:AAC75528 GB:AE000334 orf, hypothetical protein [Escherichia coli K12]
Identities = 138/297 (46%), Positives = 193/297 (64%), Gaps = 16/297 (5%)
Query:   5 MKIDDLRKSDNVEDRRSSSGGSFSSGGSGLPILQLLLLRGSWKTKLVVLIILLLLG--GG    62
           M+    R+SDNVEDRR+SSGG S GG G  +         S K  L++LI++L+ G  G
Sbjct:   1 MRWQGRRESDNVEDRRNSSGGP-SMGGPGFRL-------PSGKGGLILLIVVLVAGYYGV   52

Query:  63 GLTSIFNDSSSPSSYQSQNVSRSVDNSATREQIDFVNKVLGSTEDFWSQEFQTQGFGNYK  122
           LT +              ++++S + D +A       F + +L +TED W Q+F+  G    Y+
Sbjct:  53 DLTGLMTGQPVSQQQSTRSISPNEDEAAK-----FTSVILATTEDTWGQQFEKMG-KTYQ  106

Query: 123 EPKLVLYTNSIQTGCGIGESASGPFYCSADKKIYLDISFYNELSHKYGATGDFAMAYVIA  182
           +PKLV+Y   +TGCG G+S GPFYC AD +Y+D+SFY+++ K GA GDFA  YVIA
Sbjct: 107 QPKLVMYRGMTRTGCGAGQSIMGPFYCPADGTVYIDLSFYDDMKDKLGADGDFAQGYVIA  166

Query: 183 HEVGHHIQTELGIMDKYNRMRHGLTKKEANALNVRLELQADYYAGVWAHYIRGKNLLEQG  242
           HEVGHH+Q  LGI  K   +++   T+ E N L+VR+ELQAD +AGVW H ++ + +LE G
Sbjct: 167 HEVGHHVQKLLGIEPKVRQLQQNATQAEVNRLSVRMELQADCFAGVWGHSMQQQGVLETG  226

Query: 243 DFEEAMNAAHAVGDDTLQKETYGKLVPDSFTHGTAEQRQRWFNKGFQYGDIQHGDTF      299
           D EEA+NAA A+GDD LQ+++ G++VPDSFTHGT++QR  WF +GF GD    +TF
Sbjct: 227 DLEEALNAAQAIGDDRLQQQSQGRVVPDSFTHGTSQQRYSWFKRGFDSGDPAQCNTF    283
```

A related DNA sequence was identified in *S. pyogenes* <SEQ ID 4299> which encodes the amino acid sequence <SEQ ID 4300>. Analysis of this protein sequence reveals the following:

```
Possible site: 41
>>> Seems to have no N-terminal signal sequence
    INTEGRAL    Likelihood = -6.42    Transmembrane    48-64 (41-67)

----- Final Results -----
          bacterial membrane --- Certainty = 0.3569(Affirmative) < succ>
           bacterial outside --- Certainty = 0.0000(Not Clear)   < succ>
         bacterial cytoplasm --- Certainty = 0.0000(Not Clear)   < succ>
```

The protein has homology with the following sequences in the databases:

```
>GP: AAC75528 GB: AE000334 orf, hypothetical protein [Escherichia coli]
Identities = 143/301 (47%), Positives = 195/301 (64%), Gaps = 21/301 (6%)
Query:   1 MKTDDLRESQQVEDRRGQSSG-SFGGGGLGGGLLLQLLFSRGGWKTKLVILLLLLVMG--   57
           M+    RES  VEDRR S G S GG G       +L  +GG    L++L+++LV G
Sbjct:   1 MRWQGRRESDNVEDRRNSSGGPSMGGPGF------RLPSGKGG----LILLIVVLVAGYY   50

Query:  58 GGGLSGVLGGKPSSTNNNAYQSSQVTRTNGDKASQEQVSFVSKVFASTEDYWTKTFREKG  117
            G  L+G++ G+P S      QS++     N D+A++   F S + A+TED W + F + G
Sbjct:  51 GVDLTGLMTGQPVSQQ----QSTRSISPNEDEAAK----FTSVILATTEDTWGQQFEKMG  102

Query: 118 LTYHKPTLVLYTGATQTACGRGQASSGPFYCPGDQKVYLDISFYNELSTKYGAKGDFAMA  177
            TY +P LV+Y G T+T CG GQ+ GPFYCP D  VY+D+SFY+++  K GA GDFA
Sbjct: 103 KTYQQPKLVMYRGMTRTGCGAGQSIMGPFYCPADGTVYIDLSFYDDMKDKLGADGDFAQG  162

Query: 178 YVIAHEVGHHIQNELGIMDNYASARQGKSKAKANQLNVKLELQADYYAGAWANYVQGQGL  237
           YVIAHEVGHH+Q  LGI      +Q  ++A+ N+L+V++ELQAD +AG W + +Q QG+
Sbjct: 163 YVIAHEVGHHVQKLLGIEPKVRQLQQNATQAEVNRLSVRMELQADCFAGVWGHSMQQQGV  222

Query: 238 LEKGDIEEAMAAAHAVGDDTLQEETYGRTVPDSFTHGTSKQRQRWFDRGYQGDFEHGDTF  298
           LE GD+EEA+ AA A+GDD LQ+++  GR VPDSFTHGTS+QR  WF RG+  GD   +TF
Sbjct: 223 LETGDLEEALNAAQAIGDDRLQQQSQGRVVPDSFTHGTSQQRYSWFKRGFDSGDPAQCNTF 283
```

An alignment of the GAS and GBS proteins is shown below.

```
Identities = 191/303 (63%), Positives = 241/303 (79%), Gaps = 5/303 (1%)
Query:    5 MKIDDLRKSDNVEDRRSSSGGSFSSGG-SGLPILQLLLLRGSWKTKLVVLIILLLLGGGG   63
            MK DDLR+S  VEDRR  S GSF  GG  G  +LQLL  RG WKTKLV+L++LL++GGGG
Sbjct:    1 MKTDDLRESQQVEDRRGQSSGSFGGGGLGGGLLLQLLFSRGGWKTKLVILLLLLVMGGGG   60

Query:   64 LTSIFN---DSSSPSSYQSQNVSRSVDNSATREQIDFVNKVLGSTEDFWSQEFQTQGFGN  120
            L+ +      S++ ++YQS  V+R+  + A++EQ+ FV+KV  STED+W++ F+ +G
Sbjct:   61 LSGVLGGKPSSTNNNAYQSSQVTRTNGDKASQEQVSFVSKVFASTEDYWTKTFREKGL-T  119

Query:  121 YKEPKLVLYTNSIQTGCGIGESASGPFYCSADKKIYLDISFYNELSHKYGATGDFAMAYV  180
            Y +P LVLYT + QT CG G+++SGPFYC  D+K+YLDISFYNELS KYGA GDFAMAYV
Sbjct:  120 YHKPTLVLYTGATQTACGRGQASSGPFYCPGDQKVYLDISFYNELSTKYGAKGDFAMAYV  179

Query:  181 IAHEVGHHIQTELGIMDKYNRMRHGLTKKEANALNVRLELQADYYAGVWAHYIRGKNLLE  240
            IAHEVGHHIQ ELGIMD Y   R G +K +AN LNV+LELQADYYAG WA+Y++G+ LLE
Sbjct:  180 IAHEVGHHIQNELGIMDNYASARQGKSKAKANQLNVKLELQADYYAGAWANYVQGQGLLE  239

Query:  241 QGDFEEAMNAAHAVGDDTLQKETYGKLVPDSFTHGTAEQRQRWFNKGFQYGDIQHGDTFS  300
            +GD EEAM AAHAVGDDTLQ+ETYG+ VPDSFTHGT++QRQRWF++G+QYGD +HGDTFS
Sbjct:  240 KGDIEEAMAAAHAVGDDTLQEETYGRTVPDSFTHGTSKQRQRWFDRGYQYGDFEHGDTFS  299

Query:  301 VEH                                                          303
            + +
Sbjct:  300 IPY                                                          302
```

SEQ ID 8800 (GBS404) was expressed in *E. coli* as a GST-fusion product. SDS-PAGE analysis of total cell extract is shown in FIG. 171 (lane 3; MW 62 kDa).

GBS404-GST was purified as shown in FIG. 218, lane 7.

Based on this analysis, it was predicted that these proteins and their epitopes could be useful antigens for vaccines or diagnostics.

EXAMPLE 1401

A DNA sequence (GBSx1486) was identified in *S. agalactiae* <SEQ ID 4301> which encodes the amino acid sequence <SEQ ID 4302>. This protein is predicted to be phenylalanyl-tRNA synthetase beta chain (pheT). Analysis of this protein sequence reveals the following:

```
Possible site: 19
>>> Seems to have no N-terminal signal sequence

----- Final Results -----
            bacterial cytoplasm --- Certainty = 0.2617(Affirmative) < succ>
            bacterial membrane  --- Certainty = 0.0000(Not Clear)   < succ>
            bacterial outside   --- Certainty = 0.0000(Not Clear)   < succ>
```

The protein has homology with the following sequences in the GENPEPT database.

```
>GP: CAB14823 GB: Z99118 phenylalanyl-tRNA synthetase (beta subunit)
[Bacillus subtilis]
Identities = 376/805 (46%), Positives = 523/805 (64%), Gaps = 6/805 (0%)
Query:    1 MLVSYKWLKELVDVD-VTTAELAEKMSTTGIEVEGVETPAEGLSKLVVGHIVSCEDVPDT   59
            M VSYKWL++ VD+ +   A LAEK++  GIEVEG+E    EG+ +V+GH++  E  P+
Sbjct:    1 MFVSYKWLEDYVDLKGMDPAVLAEKITRAGIEVEGIEYKGEGIKGVVIGHVLEREQHPNA   60

Query:   60 H-LHLCQVDTGDDELRQVVCGAPNVKTGINVIVAVPGARIADNYKIKKGKIRGMESLGMI  118
             L+ C VD G + Q++CGAPNV  G  V VA  GA +  N+KIKK K+RG ES GMI
Sbjct:   61 DKLNKCLVDIGAEAPVQIICGAPNVDKGQKVAVATVGAVLPGNFKIKKAKLRGEESNGMI  120

Query:  119 CSLQELGLSESIIPKEFSDGIQILPEGAIPGDSIFSYLDLDDEIIELSITPNRADALSMR  178
            CSLQELG+  ++ KE+++GI + P A G    + L LDD I+EL +TPNRADA++M
Sbjct:  121 CSLQELGIESKLVAKEYAEGIFVFPNDAETGSDALAALQLDDAILELGLTPNRADAMNML  180

Query:  179 GVAHEVAAIYGKKVHFEEKNLIEEAERAADKISVVIESDKVLS-YSARIVKNVTVAPSPQ  237
            GVA+EVAAI  +V  +   +E+A+D ISV IE  +   Y+A+I+KNVT+APSP
Sbjct:  181 GVAYEVAAILDTEVKLPQTDYPAASEQASDYISVKIEDQEANPLYTAKIIKNVTIAPSPL  240

Query:  238 WLQNKLMNAGIRPINNVVDTNYVLLTYGQPMHAFDFDKFDGTTIVARNAENGEKLITLD  297
            W+Q+ KLMNAGIRP  NNVVD+TN+VLL YGQP+HAFD+D+F    +V R A   E ++TLD
Sbjct:  241 WMQTKLMNAGIRPHNNVVDITNFVLLEYGQPLHAFDYDRFGSKEVVVRKAAENEMIVTLD  300

Query:  298 GEERDLIADDLVIAVNDQPVALAGVMGGQSTEIGSSSKTVVLEAAVFNGTSIRKTSGRLN  357
            +ER L AD LVI    + A+AGVMGG +E+     +KT++LEAA FNG +RK S  L
Sbjct:  301 DQERKLSADHLVITNGTKAQAVAGVMGGAESEVQEDTKTILLEAAYFNGQKVRKASKDLG  360

Query:  358 LRSESSSRFEKGINYDTVSEAMDFAAAMLQELAGGQVLSGQVTEGVLPTEPVEVSTTLGY  417
            LRSESS RFEKGI+   V  A + AA ++      AGG+VL+G V E    L  E   +
Sbjct:  361 LRSESSVRFEKGIDPARVRLAAERAAQLIHLYAGGEVLAGTVEEDHLTIEANNIHVSADK  420
```

```
-continued
Query:  418 VNTRLGTELTYTDIEEVFEKLGFAISGSEVKFTVLVPRRRWDIAIQADLVEEIARIYGYE 477
            V++ LG  ++  ++  ++++LGF + ++    V VP RR DI I+ DL+EE AR+YGY+
Sbjct:  421 VSSVLGLTISKEELISIYKRLGFTVGEADDLLVVTVPSRRGDITIEEDLIEEAARLYGYD 480

Query:  478 KLPTTLPEAGATAGELTSMQRLRRRVRTVAEGAGLSEIITYALTTPEKAVQFSTQATNIT 537
            +P+TLPE   T G LT  Q  RR+VR   EGAGLS+ ITY+LT  +KA  F+ +  +  T
Sbjct:  481 NIPSTLPETAGTTGGLTPYQAKRRKVRRFLEGAGLSQAITYSLTNEKKATAFAIEKSLNT 540

Query:  538 ELMWPMTVDRSALRQNVVSGMLDTIAYNVARKNSNLAVYEIGKVFEQTGNPKEDLPTEVE 597
             L   PM+ +RS LR  ++V  +LD+++YN+AR+  ++A+YE+G VF         ++ P E E
Sbjct:  541 VLALPMSEERSILRHSLVPNLLDSVSYNLARQTDSVALYEVGSVF--LTKEEDTKPVETE 598

Query:  598 TFTFALTGLVEEKDFQTKSKPVDFFYAKGIVEALFIKLK-LDVTFVAQKGLASMHPGRTA 656
                 A+TGL ++ +Q + KPVDFF  KGIVE L   KL   LD        Q    +HPGRTA
Sbjct:  599 RVAGAVTGLWRKQLWQGEKKPVDFFVVKGIVEGLLDKLNVLDSIEFVQSERKQLHPGRTA 658

Query:  657 TILLDGKEIGFVGQVHPQTAKQYDIPETYVAEINLSTIESQMNQALIFEDITKYPSVSRD 716
                ILL+G   IGF+GQVHP    K+ DI ETYV E++L  +  +      L++  I KYPSV+RD
Sbjct:  659 NILLNGSLIGFIGQVHPSLEKELDIKETYVFELDLHALLAAETAPLVYTAIPKYPSVTRD 718

Query:  717 IALLLAESVSHHDIVSAIETSGVKRLTAIKLFDVYAGNNIAEGYKSMAYSLTFQNPNDNL 776
            IAL+ ++V+  + S I+ +G K L + +FDVY G ++ EG KS+A+SL + NP     L
Sbjct:  719 IALVTDKTVTSGQLESVIKEAGGKLLKEVTVFDVYEGEHMEEGKKSVAFSLQYVNPEQTL 778

Query:  777 TDEEVAKYMEKITKSLVEKVNAEIR                                   801
            T+EEV K   K+ K+L +   A +R
Sbjct:  779 TEEEVTKAHSKVLKALEDTYQAVLR                                   803
```

A related DNA sequence was identified in *S. pyogenes* <SEQ ID 4303> which encodes the amino acid sequence <SEQ ID 4304>. Analysis of this protein sequence reveals the following:

```
Possible site: 27
>>> Seems to have no N-terminal signal sequence

----- Final Results -----
            bacterial cytoplasm --- Certainty = 0.1283(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below.

```
Identities = 595/801 (74%), Positives = 687/801 (85%)
Query:    1 MLVSYKWLKELVDVDVTTAELAEKMSTTGIEVEGVETPAEGLSKLVVGHIVSCEDVPDTH   60
            MLVSYKWLKELVD+DVT A LAEKMSTTGIEVEG+E PA+GLSKLVVGH++SCEDVP+TH
Sbjct:    6 MLVSYKWLKELVDIDVTPAALAEKMSTTGIEVEGIEVPADGLSKLVVGHVLSCEDVPETH   65

Query:   61 LHLCQVDTGDDELRQVVCGAPNVKTGINVIVAVPGARIADNYKIKKGKIRGMESLGMICS  120
            LHLCQVDTGD+   RQ+VCGAPNVK GI VIVAVPGARIADNYKIKKGKIRGMESLGMICS
Sbjct:   66 LHLCQVDTGDETPRQIVCGAPNVKAGIKVIVAVPGARIADNYKIKKGKIRGMESLGMICS  125

Query:  121 LQELGLSESIIPKEFSDGIQILPEGAIPGDSIFSYLDLDDEIIELSITPNRADALSMRGV  180
            LQELGLS+SIIPKEFSDGIQILPE A+PGD+IF YLDLDD IIELSITPNRADALSMRGV
Sbjct:  126 LQELGLSDSIIPKEFSDGIQILPEEAVPGDAIFKYLDLDDHIIELSITPNRADALSMRGV  185

Query:  181 AHEVAAIYGKKVHFEEKNLIEEAERAADKISVVIESDKVLSYSARIVKNVTVAPSPQWLQ  240
            AHEVAAIYGK V F +KNL E +  ++ I V I SD VL+Y++R+V+NV V PSPQWLQ
Sbjct:  186 AHEVAAIYGKSVSFPQKNLQESDKATSEAIEVAIASDNVLTYASRVVENVKVKPSPQWLQ  245

Query:  241 NKLMNAGIRPINNVVDVTNYVLLTYGQPMHAFDFDKFDGTTIVARNAENGEKLITLDGEE  300
             N LMNAGIRPINNVVDVTNYVLL +GQPMHAFD+DKF+    IVAR A  GE L+TLDGE+
Sbjct:  246 NLLMNAGIRPINNVVDVTNYVLLYFGQPMHAFDYDKFEDHKIVARAARQGESLVTLDGEK  305

Query:  301 RDLIADDLVIAVNDQPVALAGVMGGQSTEIGSSSKTVVLEAAVFNGTSIRKTSGRLNLRS  360
            RDL  +DLVI V D+PVALAGVMGGQ+TEI  ++S+TVVLEAAVF+G SIRKTSGRLNLRS
Sbjct:  306 RDLTTEDLVITVADKPVALAGVMGGQATEIDANSQTVVLEAAVFDGKSIRKTSGRLNLRS  365

Query:  361 ESSSRFEKGINYDTVSEAMDFAAAMLQELAGGQVLSGQVTEGVLPTEPVEVSTTLGYVNT  420
            ESSSRFEKG+NY TV EA+DFAAAMLQELA GQVLSG V  G LPTEPVEVST+L YVN
Sbjct:  366 ESSSRFEKGVNYATVLEALDFAAAMLQELAEGQVLSGHVQAGQLPTEPVEVSTSLDYVNV  425

Query:  421 RLGTELTYTDIEEVFEKLGFAISGSEVKFTVLVPRRRWDIAIQADLVEEIARIYGYEKLP  480
            RLGTELT+ DI+ +F++LGF ++G E  FTV VPRRRWD++I ADLVEEIARIYGY+KLP
Sbjct:  426 RLGTELTFADIQRIFDQLGFGLTGDETSFTVAVPRRRWDVSIPADLVEEIARIYGYDKLP  485
```

-continued

```
Query: 481 TTLPEAGATAGELTSMQRLRRRVRTVAEGAGLSEIITYALTTPEKAVQFSTQATNITELM 540
            TTLPEAG TA ELT  Q LRR+VR +AEG GL+EII+YALTTPEKAV+F+   +++TELM
Sbjct: 486 TTLPEAGGTAAELTPTQALRRKVRGLAEGLGLTEIISYALTTPEKAVEFAVAPSHLTELM 545

Query: 541 WPMTVDRSALRQNVVSGMLDTIAYNVARKNSNLAVYEIGKVFEQTGNPKEDLPTEVETFT 600
            WPM+V+RSALRQN+VSGMLDT+AYNVARK SNLA+YEIGK+FEQ  NPKEDLP EV  F
Sbjct: 546 WPMSVERSALRQNMVSGMLDTVAYNVARKQSNLALYEIGKIFEQEANPKEDLPNEVNHFA 605

Query: 601 FALTGLVEEKDFQTKSKPVDFFYAKGIVEALFIKLKLDVTFVAQKGLASMHPGRTATILL 660
            FA+ GLV +KDFQT+++ VDF++AKG ++ LF  L L V +V  K LA+MHPGRTA ILL
Sbjct: 606 FAICGLVAQKDFQTQAQAVDFYHAKGNLDTLFANLNLKVQYVPTKDLANMHPGRTALILL 665

Query: 661 DGKEIGFVGQVHPQTAKQYDIPETYVAEINLSTIESQMNQALIFEDITKYPSVSRDIALL 720
            D + IGFVGQVHP TAK Y IPETYVAE++++ +E+ +     F +ITK+P+++RD+ALL
Sbjct: 666 DEQVIGFVGQVHPGTAKAYSIPETYVAELDMAALEAALPSDQTFAEITKFPAMTRDVALL 725

Query: 721 LAESVSHHDIVSAIETSGVKRLTAIKLFDVYAGNNIAEGYKSMAYSLTFQNPNDNLTDEE 780
            L   VSH  IV+AIE++GVKRLT+IKLFDVY G  I  G KSMAYSLTFQNPNDNLTDEE
Sbjct: 726 LDREVSHQAIVTAIESAGVKRLTSIKLFDVYEGATIQAGKKSMAYSLTFQNPNDNLTDEE 785

Query: 781 VAKYMEKITKSLVEKVNAEIR                                        801
            VAKYMEKITK+L E+V AE+R
Sbjct: 786 VAKYMEKITKALTEQVGAEVR                                        806
```

Based on this analysis, it was predicted that these proteins and their epitopes could be useful antigens for vaccines or diagnostics.

EXAMPLE 1402

A DNA sequence (GBSx1487) was identified in *S. agalactiae* <SEQ ID 4305> which encodes the amino acid sequence <SEQ ID 4306>. Analysis of this protein sequence reveals the following:

```
Possible Site: 43
>>> Seems to have no N-terminal signal sequence

----- Final Results -----
         bacterial cytoplasm --- Certainty = 0.0653(Affirmative) < succ>
         bacterial membrane  --- Certainty = 0.0000(Not Clear)   < succ>
          bacterial outside  --- Certainty = 0.0000(Not Clear)   < succ>
```

A related GBS nucleic acid sequence <SEQ ID 9769> which encodes amino acid sequence <SEQ ID 9770> was also identified.

The protein has homology with the following sequences in the GENPEPT database.

```
>GP: CAB15205 GB: Z99120 transcriptional regulator [Bacillus subtilis]
Identities = 60/169 (35%), Positives = 100/169 (58%)
Query:  17 ITFKKVGLDNVNILQNIAIETFRQTFSHDNSEEQLQAFFNESYTLPVLKSEITHAESDTY  76
            + KK  +++ LQ ++IETF  TF  NS E ++A+  ++   L+ E+++  S    +
Sbjct:   3 VKMKKCSREDLQTLQQLSIETFNDTFKEQNSPENMKAYLESAFNTEQLEKELSNMSSQFF  62

Query:  77 FVYLDTDLVGYLKVNWGSQQTEKDLDKAFEIQRIYLLDAYQGQGIGKATFEFALDLAYKS 136
            F+Y D ++ GY+KVN   Q+E+   ++ EI+RIY+ +++Q  G+GK    A+++A +
Sbjct:  63 FIYFDHEIAGYVKVNIDDAQSEEMGAESLEIERIYIKNSFQKHGLGKHLLNKAIEIALER 122

Query: 137 GLDWAWLGVWEFNHKAQAFYAKYGFEKFSEHQFSVGDKVDTDWLLRKSL            185
                WLGVWE N  A AFY K GF +   H F +GD+  TD ++ K+L
Sbjct: 123 NKKNIWLGVWEKNENAIAFYKKMGFVQTGAHSFYMGDEEQTDLIMAKTL            171
```

No corresponding DNA sequence was identified in *S. pyogenes*.

Based on this analysis, it was predicted that these proteins and their epitopes could be useful antigens for vaccines or diagnostics.

EXAMPLE 1403

A DNA sequence (GBSx1488) was identified in *S. agalactiae* <SEQ ID 4307> which encodes the amino acid sequence <SEQ ID 4308>. This protein is predicted to be phenylalanyl-tRNA synthetase (alpha subunit) (pheS). Analysis of this protein sequence reveals the following:

```
Possible site: 45
>>> Seems to have no N-terminal signal sequence

----- Final Results -----
          bacterial cytoplasm --- Certainty = 0.3937(Affirmative) < succ>
          bacterial membrane  --- Certainty = 0.0000(Not Clear)   < succ>
            bacterial outside --- Certainty = 0.0000(Not Clear)   < succ>
```

A related GBS nucleic acid sequence <SEQ ID 9339> which encodes amino acid sequence <SEQ ID 9340> was also identified.

The protein has homology with the following sequences in the GENPEPT database.

```
>GP: CAB14824 GB: Z99118 phenylalanyl-tRNA synthetase (alpha subunit)
[Bacillus subtilis]
Identities = 209/338 (61%), Positives = 270/338 (79%), Gaps = 2/338 (0%)
Query:   1 MKISTQEKLKEM-TGNHTKELQDLRVQVLGKKGSLTELLKGLKDLSNDLRPVVGKQVNEV   59
           +K    QE L+++    +   K + D+RVQ LGKKG +TE+L+G+  LS + RP +G    NEV
Sbjct:   5 LKQLEQEALEQVEAASSLKVVNDIRVQYLGKKGPITEVLRGMGKLSAEERPKMGALANEV  64

Query:  60 RDILTKAFEEQAKVVEAAKIQAQLESESVDVTLPGRQMTLGHRHVLTQTSEEIEDIFLGM  119
           R+ +   A  ++ +  +E   +++ +L    +++DVTLPG   +G RH LT    EEIED+F+GM
Sbjct:  65 RERIANAIADKNEKLEEEEMKQKLAGQTIDVTLPGNPVAVGGRHPLTVVIEEIEDLFIGM  124

Query: 120 GFQVVDGFEVEKDYYNFERMNLPKDHPARDMQDTFYITEEILLRTHTSPVQARTMDQHDF  179
           G+  V +G EVE DYYNFE +NLPK+HPARDMQD+FYITEE L+RT TSPVQ RTM++H+
Sbjct: 125 GYTVEEGPEVETDYYNFESLNLPKEHPARDMQDSFYITEETLMRTQTSPVQTRTMEKHE-  183

Query: 180 SKGPLKMISPGRVFRRDTDDATHSHQFHQIEGLVVGENISMGDLKGTLQLISQKMFGAER  239
            KGP+K+I  PG+V+RRD DDATHSHQF QIEGLVV +NISM DLKGTL+L+++KMFG +R
Sbjct: 184 GKGPVKIICPGKVYRRDNDDATHSHQFMQIEGLVVDKNISMSDLKGTLELVAKKMFGQDR  243

Query: 240 KIRLRPSYFPPTEPSVEVDVSCFKCGGKGCNVCKQTGWIEILGAGMVHPSVLEMSGIDSE  299
           +IRLRPS+FPFTEPSVEVDV+CFKCGG GC+VCK TGWIEILGAGMVHP+VL+M+G D +
Sbjct: 244 EIRLRPSFFPFTEPSVEVDVTCFKCGGNGCSVCKGTGWIEILGAGMVHPNVLKMAGFDPK  303

Query: 300 KYSGFAFGLGQERIAMLRYGINDIRGFYQGDVRFTDQF                        337
           +Y GFAFG+G ERIAML+YGI+DIR FY  DVRF  QF
Sbjct: 304 EYQGFAFGMGVERIAMLKYGIDDIRHFYTNDVRFISQF                        341
```

A related DNA sequence was identified in *S. pyogenes* <SEQ ID 4309> which encodes the amino acid sequence <SEQ ID 4310>. Analysis of this protein sequence reveals the following:

```
Possible site: 19
>>> Seems to have no N-terminal signal sequence

----- Final Results -----
          bacterial cytoplasm --- Certainty = 0.2806(Affirmative) < succ>
          bacterial membrane  --- Certainty = 0.0000(Not Clear)   < succ>
            bacterial outside --- Certainty = 0.0000(Not Clear)   < succ>
```

An alignment of the GAS and GBS proteins is shown below.

```
Identities = 305/337 (90%), Positives = 327/337 (96%)

Query:   1 MKISTQEKLKEMTGNHTKELQDLRVQVLGKKGSLTELLKGLKDLSNDLRPVVGKQVNEVR  60
           +K    T E L+ +TGNHTKELQDLRV VLGKKGSLTELLKGLKDLSNDLRPVVGKQVNEVR
Sbjct:  36 LKTKTLETLQSLTGNHTKELQDLRVAVLGKKGSLTELLKGLKDLSNDLRPVVGKQVNEVR  95
```

```
Query:   61 DILTKAFEEQAKVVEAAKIQAQLESESVDVTLPGRQMTLGHRHVLTQTSEEIEDIFLGMG 120
            D+LTKAFEEQAK+VEAAKIQAQL++ES+DVTLPGRQMTLGHRHVLTQTSEEIEDIFLGMG
Sbjct:   96 DLLTKAFEEQAKIVEAAKIQAQLDAESIDVTLPGRQMTLGHRHVLTQTSEEIEDIFLGMG 155

Query:  121 FQVVDGFEVEKDYYNFERMNLPKDHPARDMQDTFYITEEILLRTHTSPVQARTMDQHDFS 180
            FQ+VDGFEVEKDYYNFERMNLPKDHPARDMQDTFYITEEILLRTHTSPVQAPT+DQHDFS
Sbjct:  156 FQIVDGFEVEKDYYNFERMNLPKDHPARDMQDTFYITEEILLRTHTSPVQARTLDQHDFS 215

Query:  181 KGPLKMISPGRVFRRDTDDATHSHQFHQIEGLVVGENISMGDLKGTLQLISQKMFGAERK 240
            KGPLKM+SPGRVFRRDTDDATHSHQFHQIEGLVVG+NISMGDLKGTL++I +KMFG ER
Sbjct:  216 KGPLKMVSPGRVFRRDTDDATHSHQFHQIEGLVVGKNISMGDLKGTLEMIIKKMFGDERS 275

Query:  241 IRLRPSYFPFTEPSVEVDVSCFKCGGKGCNVCKQTGWIEILGAGMVHPSVLEMSGIDSEK 300
            IRLRPSYFP TEPSVEVDVSCFKCGGKGCNVCK+TGWIEILGAGMVHPSVLEMSG+D+++
Sbjct:  276 IRLRPSYFPFTEPSVEVDVSCFKCGGKGCNVCKKTGWIEILGAGMVHPSVLEMSGVDAKE 335

Query:  301 YSGFAFGLGQERIAMLRYGINDIRGFYQGDVRFTDQF                       337
            YSGFAFGLGQERIAMLRYGINDIRGFYQGD RF++QF
Sbjct:  336 YSGFAFGLGQERIAMLRYGINDIRGFYQGDQRFSEQF                       372
```

Based on this analysis, it was predicted that these proteins and their epitopes could be useful antigens for vaccines or diagnostics.

EXAMPLE 1404

A DNA sequence (GBSx1489) was identified in *S. agalactiae* <SEQ ID 4311> which encodes the amino acid sequence <SEQ ID 4312>. Analysis of this protein sequence reveals the following:

```
Possible site: 13
>>> Seems to have no N-terminal signal sequence

----- Final Results -----
            bacterial cytoplasm --- Certainty = 0.2834(Affirmative) < succ>
            bacterial membrane  --- Certainty = 0.0000(Not Clear)   < succ>
            bacterial outside   --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1405

A DNA sequence (GBSx1490) was identified in *S. agalactiae* <SEQ ID 4313> which encodes the amino acid sequence <SEQ ID 4314>. Analysis of this protein sequence reveals the following:

```
Possible site: 18
>>> Seems to have no N-terminal signal sequence

----- Final Results -----
            bacterial cytoplasm --- Certainty = 0.2762(Affirmative) < succ>
            bacterial membrane  --- Certainty = 0.0000(Not Clear)   < succ>
            bacterial outside   --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes could be useful antigens for vaccines or diagnostics.

EXAMPLE 1406

A DNA sequence (GBSx1491) was identified in *S. agalactiae* <SEQ ID 4315> which encodes the amino acid sequence <SEQ ID 4316>. This protein is predicted to be DNA-entry nuclease. Analysis of this protein sequence reveals the following:

```
Possible site: 13
>>> Seems to have an uncleavable N-term signal seq

----- Final Results -----
            bacterial membrane --- Certainty = 0.0000(Not Clear) < succ>
             bacterial outside --- Certainty = 0.0000(Not Clear) < succ>
           bacterial cytoplasm --- Certainty = 0.0000(Not Clear) < succ>
```

A related GBS nucleic acid sequence <SEQ ID 8801> which encodes amino acid sequence <SEQ ID 8802> was also identified. Analysis of this protein sequence reveals the following:

```
Lipop Possible site: -1 Crend: 5
McG: Discrim Score:10.13
GvH: Signal Score (-7.5): -5.07
    Possible site:23
>>> Seems to have an uncleavable N-term signal seq
ALOM program count: 1 value: -6.79 threshold: 0.0
    INTEGRAL       Likelihood = -6.79   Transmembrane    8-24 (6-27)
    PERIPHERAL     Likelihood = 6.26    258
modified ALOM score: 1.86
*** Reasoning Step: 3

----- Final Results -----
            bacterial membrane --- Certainty = 0.3718(Affirmative) < succ>
             bacterial outside --- Certainty = 0.0000(Not Clear)   < succ>
           bacterial cytoplasm --- Certainty = 0.0000(Not Clear)   < succ>
```

The protein has homology with the following sequences in the GENPEPT database.

```
>GP:CAA38134 GB:X54225 membrane nuclease [Streptococcus pneumoniae]
Identities = 154/232 (66%), Positives = 180/232 (77%), Gaps = 1/232 (0%)

Query:  41 KNVSGTPSRELSESVLTSNVKKQLGTNIAWNQSGAFIINQNKTDLNAKVSSAPYAINEIK  100
           K  S  PS+ L+ESVLT  VK Q+  ++ WN SGAFI+N NKT+L+AKVSS PYA N+ K
Sbjct:  43 KQASEAPSQALAESVLTDAVKSQIKGSLEWNGSGAFIVNGNKTNLDAKVSSKPYADNKTK  102

Query: 101 KVNNQIVPTKANALLTKATRQYRNREETGNGRTYWKPAGWHQINGLKGSYNHAVDRGHLI  160
              V  + VPT ANALL+KATRQY+NR+ETGNG T W P GWHQ+  LKGSY HAVDRGHL+
Sbjct: 103 TVGKETVPTVANALLSKATRQYKNRKETGNGSTSWTPPGWHQVKNLKGSYTHAVDRGHLL  162

Query: 161 GYALVGSLRGFDASTSNPKNIATQAAWANQANSNQSTGQNYYETLVRKALDRHKTVRYRV  220
           GYAL+G L  GFDASTSNPKNIA Q AWANQA +  STGQNYYE+ VRKALD++K VRYRV
Sbjct: 163 GYALIGGLDGFDASTSNPKNIAVQTAWANQAQAEYSTGQNYYESKVRKALDQNKRVRYRV  222

Query: 221 TLIY-DRDNLLSSGSHIEAKSSDGSLEFNVFIPNVQSGLLFDYATGKVKQTK          271
           TL Y   ++L+ S S IEAKSSDG LEFNV +PNVQ GL  DY TG+V  T+
Sbjct: 223 TLYYASNEDLVPSASQIEAKSSDGELEFNVLVPNVQKGLQLDYRTGEVTVTQ           274
```

There is also homology to SEQ IDs 368 and 1302.

SEQ ID 8802 (GBS285) was expressed in *E. coli* as a His-fusion product. SDS-PAGE analysis of total cell extract is shown in FIG. 56 (lane 6; MW 32 kDa). It was also expressed in *E. coli* as a GST-fusion product. SDS-PAGE analysis of total cell extract is shown in FIG. 60 (lane 7; MW 57.5 kDa).

GBS285-GST was purified as shown in FIG. 208 (lane 7) and FIG. 225 (lane 8).

Figure 134:
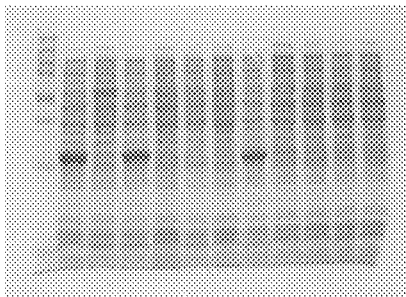

GBS658 was expressed in *E. coli* as a GST-fusion product. SDS-PAGE analysis of total cell extract is shown in FIG. 134 (lane 8 & 9; MW 27 kDa).

Based on this analysis, it was predicted that this protein and its epitopes, could be useful antigens for vaccines or diagnostics.

EXAMPLE 1407

A DNA sequence (GBSx1492) was identified in *S. agalactiae* <SEQ ID 4317> which encodes the amino acid sequence <SEQ ID 4318>. Analysis of this protein sequence reveals the following:

```
Possible site: 27
>>> Seems to have a cleavable N-term signal seq.

----- Final Result -----
             bacterial outside --- Certainty = 0.3000(Affirmative) < succ>
            bacterial membrane --- Certainty = 0.0000(Not Clear)   < succ>
           bacterial cytoplasm --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1408

A DNA sequence (GBSx1493) was identified in *S. agalactiae* <SEQ ID 4319> which encodes the amino acid sequence <SEQ ID 4320>. This protein is predicted to be UDP-N-acetylglucosamine (murA). Analysis of this protein sequence reveals the following:

```
Possible site: 43
>>> Seems to have no N-terminal signal sequence

----- Final Results -----
           bacterial cytoplasm --- Certainty = 0.1814(Affirmative) < succ>
           bacterial membrane  --- Certainty = 0.0000(Not Clear)   < succ>
            bacterial outside  --- Certainty = 0.0000(Not Clear)   < succ>
```

A related GBS nucleic acid sequence <SEQ ID 9767> which encodes amino acid sequence <SEQ ID 9768> was also identified.

The protein has homology with the following sequences in the GENPEPT database.

```
>GP:CAB15693 GB:Z99122 UDP-N-acetylglucosamine
1-carboxyvinyltransferase [Bacillus subtilis]
Identities = 248/423 (58%), Positives = 323/423 (75%), Gaps = 5/423 (1%)

Query:   5 MDKIIVEGGQTQLQGQVVIEGAKNAVLPLLAATILPSQGKTLLTNVPILSDVFTMNNVVR   64
           M+KIIV GGQ +L G V +EGAKNAVLP++AA++L S+ K+++ +VP LSDV+T+N V+R
Sbjct:   1 MEKIIVRGGQ-KLNGTVKVEGAKNAVLPVIAASLLASEEKSVICDVPTLSDVYTINEVLR   59

Query:  65 GLDIQVDFNCDKKEILVDASGDILDVAPYEFVSQMRASIVVLGPILARNGHAKVSMPGGC  124
           L    V F   +  E+ V+AS  +    AP+E+V +MRAS++V+GP+LAR GHA+V++PGGC
Sbjct:  60 HLGADVHF--ENNEVTVNASYALQTEAPFEYVRKMRASVLVMGPLLARTGHARVALPGGC  117

Query: 125 TIGSRPIDLHLKGLEAMGATITQNGGDITAQAE-KLKGANIYMDFPSVGATQNLMMAATL  183
           IGSRPID HLKG EAMGA I    G I A+ + +L+GA IY+DFPSVGAT+NL+MAA L
Sbjct: 118 AIGSRPIDQHLKGFEAMGAEIKVGNGFIEAEVKGRLQGAKIYLDFPSVGATENLIMAAAL  177

Query: 184 ASGTTTIENAAREPEIVDLAQLLNKMGAKVKGAGTETLTIIGVDALHGTEHDVVQDRIEA  243
           A GTTT+EN A+EPEIVDLA  +N MG K++GAGT T+ I GV+ LHG +H ++ DRIEA
Sbjct: 178 AEGTTTLENVAKEPEIVDLANYINGMGGKIRGAGTGTIKIEGVEKLHGVKHHIIPDRIEA  237

Query: 244 GTFMVAAAMTSGNVLVKDAIWEHNRPLISKLMEMGVEVSEEEDGIRVKADTKKLKPVTVK  303
           GTFMVAAA+T GNVLVK A+ EH    LI+K+ EMGV + +E +G+RV      K+LKP+ +K
Sbjct: 238 GTFMVAAAITEGNVLVKGAVPEHLTSLIAKMEEMGVTIKDEGEGLRV-IGPKELKPIDIK  296

Query: 304 TLPHPGFPTDMQAQFTALMAVVNGESTMIETVFENRFQHLEEMRRMGLQTEILRDTAMIH  363
           T+PHPGFPTDMQ+Q  AL+   +G S + ETVFENRF H EE RRM    +I  + +I+
Sbjct: 297 TMPHPGFPTDMQSQMMALLLRASGTSMITETVFENRFMHAEEFRRMNGDIKIEGRSVIIN  356

Query: 364 GGRALQGAPVMSTDLRASAALILAGMVAQGQTVVGQLTHLDRGYYQFHEKLAALGANIKR  423
           G    LQGA V +TDLRA AALILAG+VA+G T V +L HLDRGY  FH+KLAALGA+I+R
Sbjct: 357 GPVQLQGAEVAATDLRAGAALILAGLVAEGHTRVTELKHLDRGYVDFHQKLAALGADIER  416

Query: 424 VSE                                                          426
           V++
Sbjct: 417 VND                                                          419
```

A related DNA sequence was identified in *S. pyogenes* <SEQ ID 4321> which encodes the amino acid sequence <SEQ ID 4322>. Analysis of this protein sequence reveals the following:

```
Possible site: 39
>>> Seems to have no N-terminal signal sequence
     INTEGRAL    Likelihood = -3.03    Transmembrane    377-393 (376-394)

----- Final Results -----
           bacterial membrane  --- Certainty = 0.2211(Affirmative) < succ>
            bacterial outside  --- Certainty = 0.0000(Not Clear)   < succ>
           bacterial cytoplasm --- Certainty = 0.0000(Not Clear)   < succ>
```

The protein has homology with the following sequences in the databases:

```
>GP: CAB15693 GB: Z99122 UDP-N-acetylglucosamine
1-carboxyvinyltransferase [Bacillus subtilis]
Identities = 248/423 (58%), Positives = 318/423 (74%), Gaps = 5/423 (1%)
Query:    1 VDKIIIEGGQTRLEGEVVIEGAKNAVLPLLAASILPSKGKTILRNVPILSDVFTMNNVVR    60
            ++KII+ GGQ +L G V +EGAKNAVLP++AAS+L S+ K+++ +VP LSDV+T+N V+R
Sbjct:    1 MEKIIVRGGQ-KLNGTVKVEGAKNAVLPVIAASLLASEEKSVICDVPTLSDVYTINEVLR    59

Query:   61 GLDIRVDFNEAANEITVDASGHILDEAPYEYVSQMRASIVVLGPILARNGHAKVSMPGGC   120
            L   V F   NE+TV+AS +    EAP+EYV +MRAS++V+GP+LAR GHA+V++PGGC
Sbjct:   60 HLGADVHFEN--NEVTVNASYALQTEAPFEYVRKMRASVLVMGPLLARTGHARVALPGGC   117

Query:  121 TIGSRPINLHLKGLEAMGATITQKGGDITAQAD-RLQGAMIYMDFPSVGATQNLMMAATL   179
            IGSRPI+ HLKG EAMGA I   G I A+   RLQGA IY+DFPSVGAT+NL+MAA L
Sbjct:  118 AIGSRPIDQHLKGFEAMGAEIKVGNGFIEAEVKGRLQGAKIYLDFPSVGATENLIMAAAL   177

Query:  180 ADGVTTIENAAREPEIVDLAQFLNKMGARIRGAGTETLTITGVTHLRGVEHDVVQDRIEA   239
            A+G TT+EN A+EPEIVDLA ++N MG +IRGAGT T+ I GV  L GV+H ++ DRIEA
Sbjct:  178 AEGTTTLENVAKEPEIVDLANYINGMGGKIRGAGTGTIKIEGVEKLHGVKHHIIPDRIEA   237

Query:  240 GTFMVAAAMTSGNVLIRDAVWEHNRPLISKLMEMGVSVTEEEYGIRVQANTPKLKPVTVK   299
            GTFMVAAA+T GNVL++ AV EH   LI+K+ EMGV++ +E  G+RV    +LKP+ +K
Sbjct:  238 GTFMVAAAITEGNVLVKGAVPEHLTSLIAKMEEMGVTIKDEGEGLRV-IGPKELKPIDIK   296

Query:  300 TLPHPGFPTDMQAQFTALMAVVNGESTMVETVFENRFQHLEEMRRMGLQSEILRETAMIH   359
            T+PHPGFPTDMQ+Q  AL+   +G S + ETVFENRF H EE RRM    +I  + +I+
Sbjct:  297 TMPHPGFPTDMQSQMMALLLRASGTSMITETVFENRFMHAEEFRRMNGDIKIEGRSVIIN   356

Query:  360 GGRQLQGAPVMSTDLRASAALILTGIVAQGVTIVNNLVHLDRGYYQPHEKLAKLGATISR   419
            G  QLQGA V +TDLRA AALIL G+VA+G T V   L HLDRGY  FH+KLA LGA I R
Sbjct:  357 GPVQLQGAEVAATDLRAGAALILAGLVAEGHTRVTELKHLDRGYVDFHQKLAALGADIER   416

Query:  420 SSE                                                           422
            ++
Sbjct:  417 VND                                                           419
```

35

An alignment of the GAS and GBS proteins is shown below.

```
Identities = 363/422 (86%), Positives = 391/422 (92%)
Query:    5 MDKIIVEGGQTQLQGQVVIEGAKNAVLPLLAATILPSQGKTLLTNVPILSDVFTMNNVVR    64
            +DKII+EGGQT+L G+VVIEGAKNAVLPLLAA+ILPS+GKT+L NVPILSDVFTMNNVVR
Sbjct:    1 VDKIIIEGGQTRLEGEVVIEGAKNAVLPLLAASILPSKGKTILRNVPILSDVFTMNNVVR    60

Query:   65 GLDIQVDFNCDKKEILVDASGDILDVAPYEFVSQMRASIVVLGPILARNGHAKVSMPGGC   124
            GLDI+VDFN    EI VDASG ILD APYE+VSQMRASIVVLGPILARNGHAKVSMPGGC
Sbjct:   61 GLDIRVDFNEAANEITVDASGHILDEAPYEYVSQMRASIVVLGPILARNGHAKVSMPGGC   120

Query:  125 TIGSRPIDLHLKGLEAMGATITQNGGDITAQAEKLKGANIYMDFPSVGATQNLMMAATLA   184
            TIGSRPI+LHLKGLEAMGATITQ GGDITAQA++L+GA IYMDFPSVGATQNLMMAATLA
Sbjct:  121 TIGSRPINLHLKGLEAMGATITQKGGDITAQADRLQGAMIYMDFPSVGATQNLMMAATLA   180

Query:  185 SGTTTIENAAREPEIVDLAQLLNKMGAKVKGAGTETLTIIGVDALHGTEHDVVQDRIEAG   244
              G TTIENAAREPEIVDLAQ LNKMGA+++GAGTETLTI GV  L G EHDVVQDRIEAG
Sbjct:  181 DGVTTIENAAREPEIVDLAQFLNKMGARIRGAGTETLTITGVTHLRGVEHDVVQDRIEAG   240

Query:  245 TFMVAAAMTSGNVLVKDAIWEHNRPLISKLMEMGVEVSEEEDGIRVKADTKKLKPVTVKT   304
            TFMVAAAMTSGNVL++DA+WEHNRPLISKLMEMGV V+EEE GIRV+A+T KLKPVTVKT
Sbjct:  241 TFMVAAAMTSGNVLIRDAVWEHNRPLISKLMEMGVSVTEEEYGIRVQANTPKLKPVTVKT   300

Query:  305 LPHPGFPTDMQAQFTALMAVVNGESTMIETVFENRFQHLEEMRRMGLQTEILRDTAMIHG   364
            LPHPGFPTDMQAQFTALMAVVNGESTM+ETVFENRFQHLEEMRRMGLQ+EILR+TAMIHG
Sbjct:  301 LPHPGFPTDMQAQFTALMAVVNGESTMVETVFENRFQHLEEMRRMGLQSEILRETAMIHG   360

Query:  365 GRALQGAPVMSTDLRASAALILAGMVAQGQTVVGQLTHLDRGYYQFHEKLAALGANIKRVSE   426
            GR LQGAPVMSTDLRASAALIL G+VAQG T+V   L HLDRGYYQFHEKLA LGA I RSSE
Sbjct:  361 GRQLQGAPVMSTDLRASAALILTGIVAQGVTIVNNLVHLDRGYYQFHEKLAKLGATISRSSE   422
```

Based on this analysis, it was predicted that these proteins and their epitopes could be useful antigens for vaccines or diagnostics.

EXAMPLE 1409

A DNA sequence (GBSx1494) was identified in *S. agalactiae* <SEQ ID 4323> which encodes the amino acid sequence <SEQ ID 4324>. Analysis of this protein sequence reveals the following:

```
Possible site: 49
>>> Seems to have no N-terminal signal sequence

----- Final Results -----
            bacterial cytoplasm --- Certainty = 0.2096(Affirmative) < succ>
             bacterial membrane --- Certainty = 0.0000(Not Clear)   < succ>
              bacterial outside --- Certainty = 0.0000(Not Clear)   < succ>
```

The protein has homology with the following sequences in the GENPEPT database.

```
>GP: BAA23756 GB: AB009314 proton-translocating ATPase, epsiron
subunit [Streptococcus bovis]
Identities = 102/138 (73%), Positives = 121/138 (86%), Gaps = 1/138 (0%)
Query:    1 MAQLTVQVVTPDGIRYDHHASLITVRTPDGEMGILPGHINLIAPLNVHQMKINRSHQEG-   59
            M  +TVQVVTPDGIRYDHHA+ I+V+TPDGEMGILP HINLIAPL VH+MKI+R+
Sbjct:    1 MTFMTVQVVTPDGIRYDHHANFISVKTPDGEMGILPEHINLIAPLTVHEMKIHRTDDPNH   60

Query:   60 VDWVAVNGGIIEVNEDQVTIVADSAERARDIDLNRAERAKERAERALEKAQTTQNIDEMR  119
            VDWVA+NGGIIE+ ++ VTIVADSAER RDID++RAERAK RAER LE+AQ+T +IDE R
Sbjct:   61 VDWVAINGGIIEIKDNLVTIVADSAERERDIDVSRAERAKIRAERKLEQAQSTHDIDEVR  120

Query:  120 RAEVALRRAINRISVGKK                                           137
            RA+VALRRA+NRISVG K
Sbjct:  121 RAQVALRRALNRISVGNK                                           138
```

A related DNA sequence was identified in *S. pyogenes* <SEQ ID 4325> which encodes the amino acid sequence <SEQ ID 4326>. Analysis of this protein sequence reveals the following:

```
Possible site: 49
>>> Seems to have no N-terminal signal sequence

----- Final Results ----
            bacterial cytoplasm --- Certainty = 0.2539(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below.

```
Identities = 100/138 (72%), Positives = 119/138 (85%), Gaps = 1/138 (0%)
Query:    1 MAQLTVQVVTPDGIRYDHHASLITVRTPDGEMGILPGHINLIAPLNVHQMKINRSHQ-EG   59
            M Q+TVQVVTPDGI+YDHHA  I+V TPDGEMGILP HINLIAPL VH+MKI R  + E
Sbjct:    1 MTQMTVQVVTPDGIKYDHHAKFISVTTPDGEMGILPNHINLIAPLQVHEMKIRRGGEDK   60

Query:   60 VDWVAVNGGIIEVNEDQVTIVADSAERARDIDLNRAERAKERAERALEKAQTTQNIDEMR  119
            VDW+A+NGGIIE+ ++ VTIVADSAER RDID++RAERAK RAER + +A+TT NIDE+R
Sbjct:   61 VDWIAINGGIIEIKDNVVTIVADSAERDRDIDVSRAERAKLRAEREIAQAETTHNIDEVR  120

Query:  120 RAEVALRRAINRISVGKK                                           137
            RA+VALRRA+NRI+V KK
Sbjct:  121 RAKVALRRALNRINVSKK                                           138
```

Based on this analysis, it was predicted that these proteins and their epitopes could be useful antigens for vaccines or diagnostics.

EXAMPLE 1410

A DNA sequence (GBSx1495) was identified in *S. agalactiae* <SEQ ID 4327> which encodes the amino acid sequence <SEQ ID 4328>. Analysis of this protein sequence reveals the following:

```
Possible site: 60
>>> Seems to have an uncleavable N-term signal seq

----- Final Results -----
            bacterial membrane --- Certainty = 0.0000(Not Clear) < succ>
             bacterial outside --- Certainty = 0.0000(Not Clear) < succ>
           bacterial cytoplasm --- Certainty = 0.0000(Not Clear) < succ>
```

The protein is similar to the beta subunit of the *S. mutans* ATPase:

```
>GP: AAD13383 GB: U31170 ATPase, beta subunit [Streptococcus mutans]
Identities = 435/466 (93%), Positives = 455/466 (97%)
Query:    1 MSSGKIAQVVGPVVDVVFASGDKLPEINNALIVYKNGDKSQKVVLEVALELGDGLVRTIA    60
            MS+GKIAQVVGPVVDV FA+ DKLPEINNAL+VYK+GDKSQ++VLEVALELGDGLVRTIA
Sbjct:    1 MSTGKIAQVVGPVVDVAFATDDKLPEINNALVVYKDGDKSQRIVLEVALELGDGLVRTIA    60

Query:   61 MESTDGLTRGLEVLDTGRAISVPVGKDTLGRVFNVLGDAIDLEEPFAEDAERQPIHKKAP   120
            MESTDGLTRGLEV DTGRAISVPVGK+TLGRVFNVLGD IDL++PFAEDAERQPIHKKAP
Sbjct:   61 MESTDGLTRGLEVFDTGRAISVPVGKETLGRVFNVLGDTIDLDKPFAEDAERQPIHKKAP   120

Query:  121 SFDELSTSSEILETGIKVIDLLAPYLKGGKVGLFGGAGVGKTVLIQELIHNIAQEHGGIS   180
            SFD+LSTS+EILETGIKVIDLLAPYLKGGKVGLFGGAGVGKTVLIQELIHNIAQEHGGIS
Sbjct:  121 SFDDLSTSTEILETGIKVIDLLAPYLKGGKVGLFGGAGVGKTVLIQELIHNIAQEHGGIS   180

Query:  181 VFTGVGERTREGNDLYWEMKESGVIEKTAMVFGQMNEPPGARMRVALTGLTIAEYFRDVE   240
            VFTGVGERTREGNDLYWEMKESGVIEKTAMVFGQMNEPPGARMRVALTGLTIAEYFRDVE
Sbjct:  181 VFTGVGERTREGNDLYWEMKESGVIEKTAMVFGQMNEPPGARMRVALTGLTIAEYFRDVE   240

Query:  241 GQDVLLFIDNIFRFTQAGSEVSALLGRMPSAVGYQPTLATEMGQLQERITSTKKGSVTSI   300
            GQDVLLFIDNIFRFTQAGSEVSALLGRMPSAVGYQPTLATEMGQLQERITSTKKGSVTSI
Sbjct:  241 GQDVLLFIDNIFRFTQAGSEVSALLGRMPSAVGYQPTLATEMGQLQERITSTKKGSVTSI   300

Query:  301 QAIYVPADDYTDPAPATAFAHLDSTTNLERKLTQMGIYPAVDPLASSSRALTPEIVGDEH   360
            QAIYVPADDYTDPAPATAFAHLDSTTNLER+LTQMGIYPAVDPLASSSRAL+PEIVG EH
Sbjct:  301 QAIYVPADDYTDPAPATAFAHLDSTTNLERRLTQMGIYPAVDPLASSSRALSPEIVGQEH   360

Query:  361 YEVATEVQRVLQRYRELQDIIAILGMDELSDEEKTLVGRARRIQFFLSQNFNVAETFTGQ   420
            Y+VATEVQ VLQRYRELQDIIAILGMDELSDEEKTLVGRARRIQFFLSQNFNVAE FTGQ
Sbjct:  361 YDVATEVQHVLQRYRELQDIIAILGMDELSDEEKTLVGRARRIQFFLSQNFNVAEQFTGQ   420

Query:  421 PGSYVPVEETVRGFKEILDGKHDQIPEDAFRMVGGIEDVIAKAEKM                466
            PGSYVPV ETVRGFKEIL+GK+D++PEDAFR VG IEDV+ KA+KM
Sbjct:  421 PGSYVPVAETVRGFKEILEGKYDELPEDAFRSVGAIEDVVEKAKKM                466
```

A related DNA sequence was identified in *S. pyogenes* <SEQ ID 4329> which encodes the amino acid sequence <SEQ ID 4330>. Analysis of this protein sequence reveals the following:

```
Possible site: 60
>>> Seems to have no N-terminal signal sequence

----- Final Results -----
           bacterial cytoplasm --- Certainty = 0.0275(Affirmative) < succ>
            bacterial membrane --- Certainty = 0.0000(Not Clear) < succ>
             bacterial outside --- Certainty = 0.0000(Not Clear) < succ>
```

An alignment of the GAS and GBS proteins is shown below.

```
Identities = 440/468 (94%), Positives = 456/468 (97%)
Query:    1 MSSGKIAQVVGPVVDVVFASGDKLPEINNALIVYKNGDKSQKVVLEVALELGDGLVRTIA    60
            MSSGKIAQVVGPVVDV+FASGDKLPEINNALIVYK+ DK QK+VLEVALELGDG+VRTIA
Sbjct:    1 MSSGKIAQVVGPVVDVMFASGDKLPEINNALIVYKDSDKKQKIVLEVALELGDGMVRTIA    60
```

```
                       -continued
Query:   61 MESTDGLTRGLEVLDTGRAISVPVGKDTLGRVFNVLGDAIDLEEPFAEDAERQPIHKKAP  120
            MESTDGLTRGLEVLDTGRAISVPVGK+TLGRVFNVLG+IDLEEPFAED +RQPIHKKAP
Sbjct:   61 MESTDGLTRGLEVLDTGRAISVPVGKETLGRVFNVLGETIDLEEPFAEDVDRQPIHKKAP  120

Query:  121 SFDELSTSSEILETGIKVIDLLAPYLKGGKVGLFGGAGVGKTVLIQELIHNIAQEHGGIS  180
            SFDELSTSSEILETGIKVIDLLAPYLKGGKVGLFGGAGVGKTVLIQELIHNIAQEHGGIS
Sbjct:  121 SFDELSTSSEILETGIKVIDLLAPYLKGGKVGLFGGAGVGKTVLIQELIHNIAQEHGGIS  180

Query:  181 VFTGVGERTREGNDLYWEMKESGVIEKTAMVFGQMNEPPGARMRVALTGLTIAEYFRDVE  240
            VFTGVGERTREGNDLYWEMKESGVIEKTAMVFGQMNEPPGARMRVALTGLTIAEYFRDVE
Sbjct:  181 VFTGVGERTREGNDLYWEMKESGVIEKTAMVFGQMNEPPGARMRVALTGLTIAEYFRDVE  240

Query:  241 GQDVLLFIDNIFRFTQAGSEVSALLGRMPSAVGYQPTLATEMGQLQERITSTKKGSVTSI  300
            GQDVLLFIDNIFRFTQAGSEVSALLGRMPSAVGYQPTLATEMGQLQERITST+KGSVTSI
Sbjct:  241 GQDVLLFIDNIFRFTQAGSEVSALLGRMPSAVGYQPTLATEMGQLQERITSTQKGSVTSI  300

Query:  301 QAIYVPADDYTDPAPATAFAHLDSTTNLERKLTQMGIYPAVDPLASSSRALTPEIVGDEH  360
            QAIYVPADDYTDPAPATAFAHLDSTTNLERKLTQMGIYPAVDPLASSSRAL+PEIVG+EH
Sbjct:  301 QAIYVPADDYTDPAPATAFAHLDSTTNLERKLTQMGIYPAVDPLASSSRALSPEIVGEEH  360

Query:  361 YEVATEVQRVLQRYRELQDIIAILGMDELSDEEKTLVGRARRIQFFLSQNFNVAETFTGQ  420
            Y VATEVQRVLQRYRELQDIIAILGMDELSDEEKTLVGRARRIQFFLSQNFNVAE FTG
Sbjct:  361 YAVATEVQRVLQRYRELQDIIAILGMDELSDEEKTLVGRARRIQFFLSQNFNVAEQFTGL  420

Query:  421 PGSYVPVEETVRGFKEILDGKHDQIPEDAFRMVGGIEDVIAKAEKMNY             468
            PGSYVPV +TVRGFKEIL+GK+D++PEDAFR VG IEDVI KAEKM +
Sbjct:  421 PGSYVPVADTVRGFKEILEGKYDELPEDAFRSVGPIEDVIKKAEKMGF             468
```

Based on this analysis, it was predicted that these proteins and their epitopes could be useful antigens for vaccines or diagnostics.

EXAMPLE 1411

A DNA sequence (GBSx1496) was identified in *S. agalactiae* <SEQ ID 4331> which encodes the amino acid sequence <SEQ ID 4332>. Analysis of this protein sequence reveals the following:

```
Possible site: 31
>>> Seems to have no N-terminal signal sequence

----- Final Results -----
           bacterial cytoplasm --- Certainty = 0.1889(Affirmative) < succ>
           bacterial membrane  --- Certainty = 0.0000(Not Clear)   < succ>
             bacterial outside --- Certainty = 0.0000(Not Clear)   < succ>
```

The protein has homology with the following sequences in the GENPEPT database.

```
>GP: BAA23754 GB: AB009314 proton-translocating ATPase, gamma subunit
[Streptococcus bovis]
Identities = 252/293 (86%), Positives = 278/293 (94%),
Gaps = 2/293 (0%)

Query:    1 MAGSLSEIKDKILSTEKTSKITSAMQMVSSAKLVKSEQAARDFQVYASKIRQITTNLLKS   60
            MAGSLSEIK KI+ST+KTS IT AMQMVS+AKL KSEQAA+DFQVYASKIRQITT+LLKS
Sbjct:    1 MAGSLSEIKGKIISTQKTSHITGAMQMVSAAKLTKSEQAAKDFQVYASKIRQITTDLLKS   60

Query:   61 DLVSGSDNPMLSSRPVKKTGYIVITSDKGLVGGYNSKILKAMMDTITDYHTENDDYAIIS  120
            +LV+GS NPML++RPVKKTGYIVITSDKGLVGGYNSKILKAMMD I +YH ++ +YAII+
Sbjct:   61 ELVNGSKNPMLAARPVKKTGYIVITSDKGLVGGYNSKILKAMMDLIEEYH-QDGNYAIIA  119

Query:  121 IGSVGSDFFKARGMNVSFELRGLEDQPSFDQVGKIIAQAVEMYKNELFDELYVCYNHHVN  180
            IG +G+DFFKARGMNV FELRGLEDQPSF+QVG IIA++VEMYKNELFDELYVCYNHHVN
Sbjct:  120 IGGIGADFFKARGMNVVFELRGLEDQPSFEQVGNIIAKSVEMYKNELFDELYVCYNHHVN  179

Query:  181 SLTSQVRMQQMLPIKELDAEEASEDRVITGFELEPNREVILEQLLPQYTESLIYGAIIDA  240
            SLTSQVR+QQMLPI ELDA+EA+E+ V +GFELEPNRE+ILEQLLPQYTESLIYGAI+DA
Sbjct:  180 SLTSQVRVQQMLPIAELDADEAAEEGV-SGFELEPNREMILEQLLPQYTESLIYGAIVDA  238

Query:  241 KTAEHAAGMTAMQTATDNAKNVINDLTIQYNRARQAAITQEITEIVAGANALE         293
            KTAEHAAGMTAMQTATDNAKNVINDLTIQYNRARQAAITQEITEIVAGANALE
Sbjct:  239 KTAEHAAGMTAMQTATDNAKNVINDLTIQYNRARQAAITQEITEIVAGANALE         291
```

A related DNA sequence was identified in *S. pyogenes* <SEQ ID 4333> which encodes the amino acid sequence <SEQ ID 4334>. Analysis of this protein sequence reveals the following:

```
Possible site: 31
>>> Seems to have no N-terminal signal sequence

----- Final Results -----
          bacterial cytoplasm --- Certainty = 0.1969(Affirmative) < succ>
          bacterial membrane  --- Certainty = 0.0000(Not Clear)   < succ>
          bacterial outside   --- Certainty = 0.0000(Not Clear)   < succ>
```

An alignment of the GAS and GBS proteins is shown below.

```
Identities = 251/293 (85%), Positives = 275/293 (93%), Gaps = 2/293 (0%)

Query:    1 MAGSLSEIKDKILSTEKTSKITSAMQMVSSAKLVKSEQAARDFQVYASKIRQITTNLLKS   60
            MAGSLSEIK KI+STEKTSKITSAM+MVSSAKLVKSEQAARDFQ+YASKIRQITT+LLKS
Sbjct:    1 MAGSLSEIKAKIISTEKTSKITSAMRMVSSAKLVKSEQAARDFQIYASKIRQITTDLLKS   60

Query:   61 DLVSGSDNPMLSSRPVKKTGYIVITSDKGLVGGYNSKILKAMMDTITDYHTENDDYAIIS  120
            +L GSDNPML SRPVKKTGYIVITSDKGLVGGYNSKILK++MD IT+YH + DY IIS
Sbjct:   61 ELTIGSDNPMLVSRPVKKTGYIVITSDKGLVGGYNSKILKSVMDMITEYHADG-DYEIIS  119

Query:  121 IGSVGSDFFKARGMNVSFELRGLEDQPSFDQVGKIIAQAVEMYKNELFDELYVCYNHHVN  180
            IGSVGSDFFKARGMNV+FELRGL DQPSF+QV +II+Q+V+M+ NE+FDELYVCYNHHVN
Sbjct:  120 IGSVGSDFFKARGMNVAFELRGLADQPSFEQVRQIISQSVDMFVNEIFDELYVCYNHHVN  179

Query:  181 SLTSQVRMQQMLPIKELDAEEASEDRVITGFELEPNREVILEQLLPQYTESLIYGAIIDA  240
            SLTSQVR+QQMLPI +L A+EA+E+ V TGFELEPNR  IL+QLLPQ+TESLIYGAIIDA
Sbjct:  180 SLTSQVRVQQMLPISDLVADEAAEEGV-TGFELEPNRHDILDQLLPQFTESLIYGAIIDA  238

Query:  241 KTAEHAAGMTAMQTATDNAKNVINDLTIQYNRARQAAITQEITEIVAGANALE         293
            KTAEHAAGMTAMQTATDNAKNVINDLTIQYNRARQAAITQEITEIVAGANALE
Sbjct:  239 KTAEHAAGMTAMQTATDNAKNVINDLTIQYNRARQAAITQEITEIVAGANALE         291
```

Based on this analysis, it was predicted that these proteins and their epitopes could be useful antigens for vaccines or diagnostics.

EXAMPLE 1412

A DNA sequence (GBSx1497) was identified in *S. agalactiae* <SEQ ID 4335> which encodes the amino acid sequence <SEQ ID 4336>. Analysis of this protein sequence reveals the following:

```
Possible site: 25
>>> Seems to have no N-terminal signal sequence

----- Final Results -----
          bacterial cytoplasm --- Certainty = 0.1963(Affirmative) < succ>
          bacterial membrane  --- Certainty = 0.0000(Not Clear)   < succ>
          bacterial outside   --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1413

A DNA sequence (GBSx1498) was identified in *S. agalactiae* <SEQ ID 4337> which encodes the amino acid sequence <SEQ ID 4338>. Analysis of this protein sequence reveals the following:

```
Possible site: 61
>>> Seems to have no N-terminal signal sequence

----- Final Results -----
          bacterial cytoplasm --- Certainty = 0.3146(Affirmative) < succ>
```

```
                      -continued
    bacterial membrane --- Certainty = 0.0000(Not Clear) < succ>
     bacterial outside --- Certainty = 0.0000(Not Clear) < succ>
```

The protein is similar to the alpha subunit of the proton-translocating ATPase from *S. bovis*:

```
>GP: BAA23753 GB: AB009314 proton-translocating ATPase, alpha subunit
[Streptococcus bovis] Length = 501
Identities = 482/501 (96%), Positives = 497/501 (98%)

Query:    1 MAINAQEISALIKKQIEDFQPNFDVTETGIVTYIGDGIARARGLDNAMSGELLEFSNGAY   60
            MAINAQEISALIKKQIE+FQPNFDVTETG+VTYIGDGIARARGLDNAMSGELLEFSNGA+
Sbjct:    1 MAINAQEISALIKKQIENFQPNFDVTETGVVTYIGDGIARARGLDNAMSGELLEFSNGAF   60

Query:   61 GMAQNLESNDVGIIILGDFSEIREGDVVKRTGKIMEVPVGEAMIGRVVNPLGQPVDGLGE  120
            GMAQNLESNDVGIIILGDFS IREGD VKRTGKIMEVPVGEA+IGRVVNPLGQPVDGLG+
Sbjct:   61 GMAQNLESNDVGIIILGDFSTIREGDEVKRTGKIMEVPVGEALIGRVVNPLGQPVDGLGD  120

Query:  121 IETTATRPVETPAPGVMQRKSVFEPLQTGLKAIDALVPIGRGQRELIIGDRQTGKTSVAI  180
            I+TTATRPVETPAPGVMQRKSV EPLQTGLKAIDALVPIGRGQRELIIGDRQTGKTSVAI
Sbjct:  121 IKTTATRPVETPAPGVMQRKSVSEPLQTGLKAIDALVPIGRGQRELIIGDRQTGKTSVAI  180

Query:  181 DAILNQKGQDMICIYVAIGQKESTVRTQVETLRKYGALDYTIVVTASASQPSPLLFIAPY  240
            DAILNQKGQDMICIYVAIGQKESTVRTQVETLRKYGALDYTIVVTASASQPSPLL+IAPY
Sbjct:  181 DAILNQKGQDMICIYVAIGQKESTVRTQVETLRKYGALDYTIVVTASASQPSPLLYIAPY  240

Query:  241 AGVAMAEEFMYNGKHVLIVYDDLSKQAVAYRELSLLLRRPPGREAYPGDVFYLHSRLLER  300
            AGVAMAEEFMYNGKHVLIVYDDLSKQAVAYRELSLLLRRPPGREAYPGDVFYLHSRLLER
Sbjct:  241 AGVAMAEEFMYNGKHVLIVYDDLSKQAVAYRELSLLLRRPPGREAYPGDVFYLHSRLLER  300

Query:  301 SAKVSDALGGGSITALPFIETQAGDISAYIATNVISITDGQIFLQENLFNSGIRPAIDAG  360
            SAKVSDALGGGSITALPFIETQAGDISAYIATNVISITDGQIFLQENLFNSGIRPAIDAG
Sbjct:  301 SAKVSDALGGGSITALPFIETQAGDISAYIATNVISITDGQIFLQENLFNSGIRPAIDAG  360

Query:  361 SSVSRVGGAAQIKAMKRVAGTLRLDLASYRELEAFTQFGSDLDAATQAKLNRGRRTVEVL  420
            SSVSRVGG+AQIKAMK+VAGTLRLDLASYRELEAFTQFGSDLDAATQAKLNRGRRTVEVL
Sbjct:  361 SSVSRVGGSAQIKAMKKVAGTLRLDLASYRELEAFTQFGSDLDAATQAKLNRGRRTVEVL  420

Query:  421 KQPLHKPLPVEKQVVILYALTHGFLDDVPVNDILAFEEALYDYFDAHYDNLFETIRTTKD  480
            KQP+HKPLPVEKQVVILYALTHGFLDDVPVNDILAFEEALYDYFDAHY+++FETIRTTKD
Sbjct:  421 KQPVHKPLPVEKQVVILYALTHGFLDDVPVNDILAFEEALYDYFDAHYESIFETIRTTKD  480

Query:  481 LPEEAELDAAIQAFKDQSQFK                                        501
            LPEE+ LDAAIQAFKDQS+FK
Sbjct:  481 LPEESVLDAAIQAFKDQSEFK                                        501
```

A related DNA sequence was identified in *S. pyogenes* <SEQ ID 4339> which encodes the amino acid sequence <SEQ ID 4340>. Analysis of this protein sequence reveals the following:

```
Possible site: 61
>>> Seems to have no N-terminal signal sequence

----- Final Results -----
         bacterial cytoplasm --- Certainty = 0.3654(Affirmative) < succ>
         bacterial membrane  --- Certainty = 0.0000(Not Clear)   < succ>
         bacterial outside   --- Certainty = 0.0000(Not Clear)   < succ>
```

An alignment of the GAS and GBS proteins is shown below.

```
Identities = 477/501 (95%), Positives = 490/501 (97%)

Query:    1 MAINAQEISALIKKQIEDFQPNFDVTETGIVTYIGDGIARARGLDNAMSGELLEFSNGAY   60
            +AINAQEISALIKKQIE+FQPNFDVTETGIVTYIGDGIARARGLDNAMSGELLEF NGAY
Sbjct:    1 LAINAQEISALIKKQIENFQPNFDVTETGIVTYIGDGIARARGLDNAMSGELLEFENGAY   60

Query:   61 GMAQNLESNDVGIIILGDFSEIREGDVVKRTGKIMEVPVGEAMIGRVVNPLGQPVDGLGE  120
            GMAQNLESNDVGIIILGDFS IREGDVVKRTGKIMEVPVGEA+IGRVVNPLGQPVDGLG+
Sbjct:   61 GMAQNLESNDVGIIILGDFSAIREGDVVKRTGKIMEVPVGEALIGRVVNPLGQPVDGLGD  120
```

-continued

```
Query:  121 IETTATRPVETPAPGVMQRKSVFEPLQTGLKAIDALVPIGRGQRELIIGDRQTGKTSVAI  180
            IETT  RPVETPAPGVMQRKSV EPLQTGLKAIDALVPIGRGQRELIIGDRQTGKTSVAI
Sbjct:  121 IETTGFRPVETPAPGVMQRKSVSEPLQTGLKAIDALVPIGRGQRELIIGDRQTGKTSVAI  180

Query:  181 DAILNQKGQDMICIYVAIGQKESTVRTQVETLRKYGALDYTIVVTASASQPSPLLFIAPY  240
            DAILNQKGQDMICIYVAIGQKESTVRTQVETLR+YGALDYTIVVTASASQPSPLLFIAPY
Sbjct:  181 DAILNQKGQDMICIYVAIGQKESTVRTQVETLRRYGALDYTIVVTASASQPSPLLFIAPY  240

Query:  241 AGVAMAEEFMYNGKHVLIVYDDLSKQAVAYRELSLLLRRPPGREAYPGDVFYLHSRLLER  300
            AGVAMAEEFMY GKHVLIVYDDLSKQAVAYRELSLLLRRPPGREAYPGDVFYLHSRLLER
Sbjct:  241 AGVAMAEEFMYQGKHVLIVYDDLSKQAVAYRELSLLLRRPPGREAYPGDVFYLHSRLLER  300

Query:  301 SAKVSDALGGGSITALPFIETQAGDISAYIATNVISITDGQIFLQENLFNSGIRPAIDAG  360
            SAKVSD LGGGSITALPFIETQAGDISAYIATNVISITDGQIFLQENLFNSGIRPAIDAG
Sbjct:  301 SAKVSDDLGGGSITALPFIETQAGDISAYIATNVISITDGQIFLQENLFNSGIRPAIDAG  360

Query:  361 SSVSRVGGAAQIKAMKRVAGTLRLDLASYRELEAFTQFGSDLDAATQAKLNRGRRTVEVL  420
            SSVSRVGG+AQIKAMK+VAGTLRLDLASYRELEAFTQFGSDLDAATQAKLNRGRRTVE+L
Sbjct:  361 SSVSRVGGSAQIKAMKKVAGTLRLDLASYRELEAFTQFGSDLDAATQAKLNRGRRTVEIL  420

Query:  421 KQPLHKPLPVEKQVVILYALTHGFLDDVPVNDILAFEEALYDYFDAHYDNLFETIRTTKD  480
            KQPLHKPLPVEKQVVILYALTHGFLDDVPV+DILAFEEALYDYFD HY++LFETIRTTKD
Sbjct:  421 KQPLHKPLPVEKQVVILYALTHGFLDDVPVDDILAFEEALYDYFDVHYNDLFETIRTTKD  480

Query:  481 LPEEAELDAAIQAFKDQSQFK                                         501
            LPEEA LDAAI+AFK+ S FK
Sbjct:  481 LPEEAALDAAIKAFKEHSNFK                                         501
```

Based on this analysis, it was predicted that these proteins and their epitopes could be useful antigens for vaccines or diagnostics.

EXAMPLE 1414

A DNA sequence (GBSx1499) was identified in *S. agalactiae* <SEQ ID 4341> which encodes the amino acid sequence <SEQ ID 4342>. Analysis of this protein sequence reveals the following:

```
Possible site: 55
>>> Seems to have no N-terminal signal sequence

----- Final Results -----
            bacterial cytoplasm --- Certainty = 0.1896(Affirmative) < succ>
            bacterial membrane  --- Certainty = 0.0000(Not Clear)   < succ>
             bacterial outside  --- Certainty = 0.0000(Not Clear)   < succ>
```

The protein has homology with the following sequences in the GENPEPT database.

```
>GP: BAA23752 GB: AB009314 proton-translocating ATPase, delta subunit
[Streptococcus bovis]
Identities = 98/178 (55%), Positives = 127/178 (71%)

Query:    1 MNKKTQALIEQYSKSLVEVAIEHKIVEKIQQEVAALIDIFETSELEGVLSSLAVSHDEKQ   60
            M+KKTQAL+EQY+KSLVE+AIE   + ++Q E  AL+  +FE + L   LSSL VS DEK
Sbjct:    1 MDKKTQALVEQYAKSLVEIAIEKDSLAELQSETEALLSVFEETNLADFLSSLVVSRDEKV   60

Query:   61 HFVKTLQTSCSTYLVNFLEVIVQNEREALLYPILKSVDQELIKVNGQYPIQITTAVALSP  120
            + V+ LQ S S Y+ NFLEVI+QNEREA L  IL+ V ++ +    Q+ I +TTAVAL+
Sbjct:   61 KLVRLLQESSSVYMNNFLEVILQNEREAFLKAILEGVQKDFVIATNQHDIVVTTAVALTD  120

Query:  121 EQKERLFDIAKTKLALPNGQLVEHIDPSIVGGFVVNANNKVIDASVRNQLHQFKMKLK    178
            EQKER+  +    K  +  G+LVE+ID SI+GGFV+N NNKVID S+R QL +FKM LK
Sbjct:  121 EQKERILALVAEKFGVKAGKLVENIDESILGGFVINVNNKVIDTSIRRQLQEFKMNLK    178
```

A related DNA sequence was identified in *S. pyogenes* <SEQ ID 4343> which encodes the amino acid sequence <SEQ ID 4344>. Analysis of this protein sequence reveals the following:

```
Possible site: 53
>>> Seems to have no N-terminal signal sequence
```

-continued

```
----- Final Results -----
            bacterial cytoplasm --- Certainty = 0.1668 (Affirmative) < succ>
            bacterial membrane  --- Certainty = 0.0000 (Not Clear)  < succ>
            bacterial outside   --- Certainty = 0.0000 (Not Clear)  < succ>
```

An alignment of the GAS and GBS proteins is shown below.

```
Identities = 86/178 (48%), Positives = 125/178 (69%)

Query:    1 MNKKTQALIEQYSKSLVEVAIEHKIVEKIQQEVAALIDIFETSELEGVLSSLAVSHDEKQ   60
            M KK QALIEQY+KSLVEVA EH  ++ +Q +V A+++ F T+ L+   LSS AV H EK
Sbjct:    1 MTKKEQALIEQYAKSLVEVASEHHSLDALQADVLAILETFVTTNLDQSLSSQAVPHAEKI   60

Query:   61 HFVKTLQTSCSTYLVNFLEVIVQNEREALLYPILKSVDQELIKVNGQYPIQITTAVALSP  120
                + L+ + S Y+ NFL +I+QNEREA LY +L++V   E+    V+ QY +  +T+++ L+
Sbjct:   61 KLLTLLKGNNSVYMNNFLNLILQNEREAYLYQMLQAVLNEIAIVSNQYDVTVTSSLPLTE  120

Query:  121 EQKERLFDIAKTKLALPNGQLVEHIDPSIVGGFVVNANNKVIDASVRNQLHQFKMKLK    178
            EQK R+  +    K A+  G+L+E +DPS++GGF+++ NNKVID S+R QL  FKM LK
Sbjct:  121 EQKSRVRAVVAKKFAVTAGRLIEKVDPSLIGGFIISVNNKVIDTSIRRQLQAFKMNLK    178
```

Based on this analysis, it was predicted that these proteins and their epitopes could be useful antigens for vaccines or diagnostics.

EXAMPLE 1415

A DNA sequence (GBSx1500) was identified in *S. agalactiae* <SEQ ID 4345> which encodes the amino acid sequence <SEQ ID 4346>. This protein is predicted to be ATP synthase b chain (atpF). Analysis of this protein sequence reveals the following:

```
Possible site: 33
>>> Seems to have a cleavable N-term signal seq.

----- Final Results -----
            bacterial outside   --- Certainty = 0.3000 (Affirmative) < succ>
            bacterial membrane  --- Certainty = 0.0000 (Not Clear)  < succ>
            bacterial cytoplasm --- Certainty = 0.0000 (Not Clear)  < succ>
```

The protein has homology with the following sequences in the GENPEPT database.

```
>GP: AAD13379 GB: U31170 ATPase, b subunit [Streptococcus mutans]
Identities = 103/165 (62%), Positives = 130/165 (78%)

Query:    1 MSILINSTTIGDIIIVSGSVLLLFILIKTFAWKQITGIFEAREQKIANDIDTAEQARQQA   60
            MS LIN T++G+++IV+GS +LL +L+K FAW Q+  IF+ RE+KIA DID AE +RQ A
Sbjct:    1 MSTLINGTSLGNLLIVTGSFILLLLVKKFAWSQLAAIFKTREEKIAKDIDDAENSRQNA   60

Query:   61 EAFATKREEELSNAKTEANQIIDNAKETGLAKGDQIISEAKTEADRLKEKAHQDIAQNKA  120
            +      KR+ EL+ AK EA QIIDNAKETG A+  +II+EA  EA RLK+KA+QDIA +KA
Sbjct:   61 QVLENKRQVELNQAKDEAAQIIDNAKETGKAQESKIITEAHEEAGRLKDKANQDIATSKA  120

Query:  121 EALADVKGEVADLTVLLAEKIMVSNLDKEAQSNLIDSYIKKLGDA                165
            EAL+ VK +VADL+VLLAEKIM  NLDK AQ +LIDSY+ KLGDA
Sbjct:  121 EALSSVKADVADLSVLLAEKIMAKNLDKTAQGDLIDSYLDKLGDA                165
```

A related DNA sequence was identified in *S. pyogenes* <SEQ ID 4347> which encodes the amino acid sequence <SEQ ID 4348>. Analysis of this protein sequence reveals the following:

```
Possible site: 32
>>> Seems to have a cleavable N-term signal seq.
```

```
----- Final Results -----
            bacterial outside --- Certainty = 0.3000 (Affirmative) < succ>
           bacterial membrane --- Certainty = 0.0000 (Not Clear)   < succ>
          bacterial cytoplasm --- Certainty = 0.0000 (Not Clear)   < succ>
```

The protein has homology with the following sequences in the databases:

```
>GP: AAD13379 GB: U31170 ATPase, b subunit [Streptococcus mutans]
Identities = 88/159 (55%), Positives = 122/159 (76%)

Query:    6 GELVGNFILVTGSVIVLLLLIKKFAWGAIESILQTRSQQISRDIDQAEQSRLSAQQLEAK    65
            G +GN ++VTGS I+LLLL+KKFAW + +I +TR ++I++DID AE SR +AQ LE K
Sbjct:    7 GTSLGNLLIVTGSFILLLLLVKKFAWSQLAAIFKTREEKIAKDIDDAENSRQNAQVLENK    66

Query:   66 SQANLDASRLQASKIISDAKEIGQLQGDKLVAEATDEAKRLKEKALTDIEQSKSDAISAV   125
            Q  L+ ++ +A++II +AKE G+ Q  K++ EA +EA RLK+KA  DI   SK++A+S+V
Sbjct:   67 RQVELNQAKDEAAQIIDNAKETGKAQESKIITEAHEEAGRLKDKANQDIATSKAEALSSV   126

Query:  126 KTEMSDLTVLLAEKIMGANLDKTAQSQLIDSYLDDLGEA                        164
            K +++DL+VLLAEKIM  NLDKTAQ  LIDSYLD LG+A
Sbjct:  127 KADVADLSVLLAEKIMAKNLDKTAQGDLIDSYLDKLGDA                        165
```

An alignment of the GAS and GBS proteins is shown below.

```
Identities = 81/156 (51%), Positives = 115/156 (72%)

Query:   10 IGDIIIVSGSVLLLFILIKTFAWKQITGIFEAREQKIANDIDTAEQARQQAEAFATKREE    69
            +G+ I+V+GSV++L +LIK FAW  I  I + R Q+I+ DID AEQ+R  A+    K +
Sbjct:    9 VGNFILVTGSVIVLLLLIKKFAWGAIESILQTRSQQISRDIDQAEQSRLSAQQLEAKSQA    68

Query:   70 ELSNAKTEANQIIDNAKETGLAKGDQIISEAKTEADRLKEKAHQDIAQNKAEALADVKGE   129
            L  ++ +A++II +AKE G  +GD++++EA  EA RLKEKA  DI Q+K++A++ VK E
Sbjct:   69 NLDASRLQASKIISDAKEIGQLQGDKLVAEATDEAKRLKEKALTDIEQSKSDAISAVKTE   128

Query:  130 VADLTVLLAEKIMVSNLDKEAQSNLIDSYIKKLGDA                           165
            ++DLTVLLAEKIM +NLDK AQS LIDSY+ LG+A
Sbjct:  129 MSDLTVLLAEKIMGANLDKTAQSQLIDSYLDDLGEA                           164
```

SEQ ID 4346 (GBS169) was expressed in *E. coli* as a His-fusion product. SDS-PAGE analysis of total cell extract is shown in FIG. 34 (lane 6; MW 18 kDa).

The GBS169-His fusion product was purified (FIG. 200, lane 11) and used to immunise mice. The resulting antiserum was used for Western blot (FIG. 250). These tests confirm that the protein is immunoaccessible on GBS bacteria.

Based on this analysis, it was predicted that these proteins and their epitopes could be useful antigens for vaccines or diagnostics.

EXAMPLE 1416

A DNA sequence (GBSx1501) was identified in *S. agalactiae* <SEQ ID 4349> which encodes the amino acid sequence <SEQ ID 4350>. Analysis of this protein sequence reveals the following:

```
Possible site: 29
>>> Seems to have no N-terminal signal sequence
    INTEGRAL    Likelihood = -11.73    Transmembrane    20-36   (14-42)
    INTEGRAL    Likelihood =  -5.20    Transmembrane   207-223  (206-228)
    INTEGRAL    Likelihood =  -4.35    Transmembrane    78-94   (73-97)
    INTEGRAL    Likelihood =  -4.09    Transmembrane   113-129  (113-133)
    INTEGRAL    Likelihood =  -2.39    Transmembrane   174-190  (174-190)

----- Final Results -----
           bacterial membrane --- Certainty = 0.5692 (Affirmative) < succ>
            bacterial outside --- Certainty = 0.0000 (Not Clear)   < succ>
          bacterial cytoplasm --- Certainty = 0.0000 (Not Clear)   < succ>
```

The protein has homology with the following sequences in the GENPEPT database.

```
>GP: BAA23750 GB: AB009314 proton-translocating ATPase, a subunit
[Streptococcus bovis]
```

-continued

Identities = 149/238 (62%), Positives = 180/238 (75%)

```
Query:    1 MESTSNPTVSFLGIDFDLTILAMSLLTITIIFILVFWASRKMTIKPKGKQNVLEYVYELV   60
            ME++ NPT    GI+FDLTILAMSLLT+ I F ++FWA+RKMT+KPKGKQN +EYVYE V
Sbjct:    1 METSVNPTAHVFGIEFDLTILAMSLLTVIISFGIIFWATRKMTLKPKGKQNFIEYVYEFV   60

Query:   61 NNTISQNLGHYTKNYSLLMFILFSFVFIANNLGLMTSLKTHEHNFWTSPTANFGVDITLS  120
             NTI  NLG YT  YSLLMF  F F+ IANNLGL+  L++ ++NFWTSPT+   VD T S
Sbjct:   61 QNTIKPNLGEYTPKYSLLMFTFFFFILIANNLGLLVKLESEDYNFWTSPTSTIMVDCTWS  120

Query:  121 LLVAFICHIEGIRKKGIGGYLKGFLSPTPAMLPMNLLEEVTNVASLALRLFGNIFSGEVV  180
            L+VA + H+EG+RKKG+   YLKG+LSP P MLPMN+LE+ TNV SLALRLFGNI++GEVV
Sbjct:  121 LIVAIVVHVEGVRKKGVKAYLKGYLSPFPMMLPMNILEQFTNVLSLALRLFGNIYAGEVV  180

Query:  181 TGLLLQLAVLSPFTGPLAFALNIVWTAFSMFIGFIQAYVFIILSSSYIGHKVHGDEEE    238
            T L++      S    P A ALN+ W AFS FIG IQAYVF ILSS YI  K+  DE+E
Sbjct:  181 TALIVGFGTKSLIFAPFALALNLAWVAFSAFIGCIQAYVFTILSSKYISEKLPEDEDE    238
```

A related DNA sequence was identified in *S. pyogenes* <SEQ ID 4351> which encodes the amino acid sequence <SEQ ID 4352>. Analysis of this protein sequence reveals the following:

```
Possible site: 33
>>> Seems to have a cleavable N-term signal seq.
    INTEGRAL     Likelihood = -4.73      Transmembrane      79-95  (72-97)
    INTEGRAL     Likelihood = -4.35      Transmembrane     115-131 (112-132)
    INTEGRAL     Likelihood = -2.13      Transmembrane     200-216 (197-216)

----- Final Results -----
              bacterial membrane --- Certainty = 0.2890 (Affirmative) < succ>
              bacterial outside  --- Certainty = 0.0000 (Not Clear)  < succ>
              bacterial cytoplasm --- Certainty = 0.0000 (Not Clear) < succ>
```

An alignment of the GAS and GBS proteins is shown below.

Identities = 124/239 (51%), Positives = 169/239 (69%), Gaps = 3/239 (1%)

```
Query:    1 MESTSNPTVSFLGIDFDLTILAMSLLTITIIFILVFWASRKMTIKPKGKQNVLEYVYELV   60
            ME    P +     I  F+LT+LA+ ++TI I+F VFWASR+M +KP+GKQ  LEY+    V
Sbjct:    1 MEEAKIPMLKLGPITFNLTLLAVCIVTIAIVFAFVFWASRQMKLKPEGKQTALEYLISFV   60

Query:   61 NNTISQNLGH-YTKNYSLLMFILFSFVFIANNLGLMTSLKT-HEHNFWTSPTANFGVDIT  118
                  ++L H   K+YSLL+F +F FV +ANNLGL T L+T +  +N WTSPTAN    D+
Sbjct:   61 DGIGEEHLDHNLQKSYSLLLFTIFLFVAVANNLGLFTKLETVNGYNLWTSPTANLAFDLA  120

Query:  119 LSLLVAFICHIEGIRKKGIGGYLKGFLSPTPAMLPMNLLEEVTNVASLALRLFGNIFSGE  178
            LSL +  + HIEG+R++G+  +LK   +P P M PMNLLEE TN  SLA+RLFGNI AGE
Sbjct:  121 LSLFITLMVHIEGVRRRGLVAHLKRLATPWP-MTPMNLLEEFTNFLSLAIRLFGNIFAGE  179

Query:  179 VVTGLLLQLAVLSPFTGPLAFALNIVWTAFSMFIGFIQAYVFIILSSSYIGHKVHGDEE   237
            VVTGL++QLA    +   P+AF +N+ WTAFS+FI  IQA+VF L+++Y+G KV+    EE
Sbjct:  180 VVTGLIVQLANYRVYWWPIAFLVNMAWTAFSVFISCIQAFVFTKLTATYLGKKVNESEE   238
```

A related GBS gene <SEQ ID 8803> and protein <SEQ ID 8804> were also identified. Analysis of this protein sequence reveals the following:

```
Lipop: Possible site: -1 Crend: 1
McG: Discrim Score: -3.50
GvH: Signal Score (-7.5): -3.36
    Possible site: 29
>>> Seems to have no N-terminal signal sequence
ALOM program        count: 5       value: -11.73       threshold: 0.0
    INTEGRAL     Likelihood = -11.73    Transmembrane      20-36  (14-42)
    INTEGRAL     Likelihood = -5.20     Transmembrane     207-223 (206-228)
    INTEGRAL     Likelihood = -4.35     Transmembrane      78-94  (73-97)
    INTEGRAL     Likelihood = -4.09     Transmembrane     113-129 (113-133)
    INTEGRAL     Likelihood = -2.39     Transmembrane     174-190 (174-190)
    PERIPHERAL   Likelihood =  5.30                        156
```

```
                              -continued
modified ALOM score: 2.85

*** Reasoning Step: 3

----- Final Results -----
                bacterial membrane --- Certainty = 0.5692 (Affirmative) < succ>
                  bacterial outside --- Certainty = 0.0000 (Not Clear)  < succ>
                bacterial cytoplasm --- Certainty = 0.0000 (Not Clear)  < succ>
```

The protein has homology with the following sequences in the databases:

```
ORF01818(301-1014 of 1314)
GP|2662321|dbj|BAA23750.1||AB009314(1-238 of 239) proton-translocating ATPase,
a subunit {Streptococcus bovis}
% Match = 35.0
% Identity = 62.2    % Similarity = 78.6
Matches = 148   Mismatches = 51   Conservative Sub.s = 39
     204       234       264       294       324       354       384       414
XANCQTLMLPGVGFIERYFLRSICVYILSKIDDNLEKKEG*GLESTSNPTVSFLGIDFDLTILAMSLLTITIIFILVFWA
                                        :|::  |||    :||:||||||||||||:  | |  :|||
                                        METSVNPTAHVFGIEFDLTILAMSLLTVIISFGIIFWA
                                                  10        20        30
     444       474       504       534       564       594       624       654
SRKMTIKPKGKQNVLEYVYELVNNTISQNLGHYTKNYSLLMPILFSFVFIANNLGLMTSLKTHEHNFWTSPTANFGVDIT
:||||:|||||||  :|||||:|  |||   ||| ||  ||||||  :|  |::|||||||:  |::  ::||||||:    || |
TRKMTLKPKGKQNFIEYVYEFVQNTIKPNLGEYTPKYSLLMFTFFFFILIANNLGLLVKLESEDYNFWTSPTSTIMVDCT
         50        60        70        80        90       100       110
     684       714       744       774       804       834       864       894
LSLLVAFICHIEGIRKKGIGGYLKGFLSPTPAMLPMNLLEEVTNVASLALRLFGNIFSGEVVTGLLLQLAVLSPFTGPLA
||:||  :  |:||:||||  |    ||||||||| |    |||||| |||  :::  |||||    |:: :      |:|
WSLIVAIVVHVEGVRKKGVKAYLKGYLSPFPMMLPMNILEQFTNVLSLALRLFGNIYAGEVVTALIVGFGTKSLIFAPFA
        130       140       150       160       170       180       190
     924       954       984      1014      1044      1074      1104      1134
FALNIVWTAFSMFIGFIQAYVFIILSSSYIGHKVHGDEEE*EKRGEICQYLLIVQRLVISLSYLALCFSYLS*LRLLHGN
:||||:  |  |||  |||  ||||||  ||||  ||   |:    ||:|
LALNLAWVAFSAFIGCIQAYVPTILSSKYISEKLPEDEDET
        210       220       230
```

Based on this analysis, it was predicted that these proteins and their epitopes could be useful antigens for vaccines or diagnostics.

EXAMPLE 1417

A DNA sequence (GBSx1502) was identified in S. agalactiae <SEQ ID 4353> which encodes the amino acid sequence <SEQ ID 4354>. This protein is predicted to be ATP synthase c subunit (atpE). Analysis of this protein sequence reveals the following:

```
Possible site: 29
>>> Seems to have a cleavable N-term signal seq.
     INTEGRAL     Likelihood = -4.62    Transmembrane     48-64 (42-65)

----- Final Results -----
                bacterial membrane --- Certainty = 0.2848(Affirmative) < succ>
                  bacterial outside --- Certainty = 0.0000(Not Clear)  < succ>
                bacterial cytoplasm --- Certainty = 0.0000(Not Clear)  < succ>
```

The protein has homology with the following sequences in the GENPEPT database.

```
>GP: BAA23749 GB: AB009314 proton-translocating ATPase,
c subunit [Streptococcus bovis]
Identities = 56/65 (86%), Positives = 59/65 (90%)

Query:  1  MNLAILALGFAVMGVSIGEGILVANIAKSAARQPEMFSKLQTLMFTGVAFIEGTFFVLFA   60
           +NL ILALG AV+GVS+GEGILVANIAKSAARQPEMFSKLQTLMF GVAFIEGTFFVL A
Sbjct:  2  LNLKILALGLAVLGVSLGEGILVANIAKSAARQPEMFSKLQTLMFLGVAFIEGTFFVLLA   61
```

```
Query:  61 FTFLV                                                65
           TF V
Sbjct:  62 STFFV                                                66
```

A related DNA sequence was identified in *S. pyogenes* <SEQ ID 4355> which encodes the amino acid sequence <SEQ ID 4356>. Analysis of this protein sequence reveals the following:

```
Possible site: 17
>>> Seems to have a cleavable N-term signal seq.
      INTEGRAL     Likelihood = -5.26     Transmembrane     47-63 (41-64)

----- Final Results -----
             bacterial membrane --- Certainty = 0.3102(Affirmative) < succ>
              bacterial outside --- Certainty = 0.0000(Not Clear)   < succ>
            bacterial cytoplasm --- Certainty = 0.0000(Not Clear)   < succ>
```

The protein has homology with the following sequences in the databases:

```
>GP: AAD00920 GB: AF001955 UncE [Streptococcus sanguinis]
Identities = 50/66 (75%), Positives = 58/66 (87%), Gaps = 1/66 (1%)

Query:  1 MNPIF-ALALACFGVSLAEGFLMANLFKAASRQPEIIGQLRSLMILGVAFIEGTFFVTLV   59
          MN  F  L  ACFGVS+AEG +M+NLFKAASRQPEIIGQLRSL+ILG+AF+EGTFFVTL
Sbjct:  1 MNLTFLGLCFACFGVSIAEGLIMSNLFKAASRQPEIIGQLRSLLILGIAFVEGTFFVTLA   60

Query: 60 MAFILK   65
          MAF++K
Sbjct: 61 MAFVIK   66
```

An alignment of the GAS and GBS proteins is shown below.

```
Identities = 33/62 (53%), Positives = 45/62 (72%)

Query:  5 ILALGFAVMGVSIGEGILVANIAKSAARQPEMFSKLQTLMFTGVAFIEGTFFVLFAFTFLVR   66
          I AL  A  GVS+ EG L+AN+ K+A+RQPE+  +L++LM  GVAFIEGTFFV    F+++
Sbjct:  4 IFALALACFGVSLAEGFLMANLFKAASRQPEIIGQLRSLMILGVAFIEGTFFVTLVMAFILK   65
```

Based on this analysis, it was predicted that these proteins and their epitopes could be useful antigens for vaccines or diagnostics.

EXAMPLE 1418

A DNA sequence (GBSx1503) was identified in *S. agalactiae* <SEQ ID 4357> which encodes the amino acid sequence <SEQ ID 4358>. Analysis of this protein sequence reveals the following:

```
Possible site: 47
>>> Seems to have no N-terminal signal sequence

----- Final Results -----
            bacterial cytoplasm --- Certainty = 0.2562(Affirmative) < succ>
             bacterial membrane --- Certainty = 0.0000(Not Clear)   < succ>
              bacterial outside --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1419

A DNA sequence (GBSx1504) was identified in *S. agalactiae* <SEQ ID 4359> which encodes the amino acid sequence <SEQ ID 4360>. This protein is predicted to be bacterial glycogen synthase (glgA). Analysis of this protein sequence reveals the following:

```
Possible site: 16
>>> Seems to have no N-terminal signal sequence

----- Final Results -----
            bacterial cytoplasm --- Certainty = 0.1574(Affirmative) < succ>
            bacterial membrane  --- Certainty = 0.0000(Not Clear)   < succ>
            bacterial outside   --- Certainty = 0.0000(Not Clear)   < succ>
```

The protein has homology with the following sequences in the GENPEPT database.

```
>GP: BAA19591 GB: D87026 bacterial glycogen synthase [Bacillus
stearothermophilus]
Identities = 220/475 (46%), Positives = 312/475 (65%),
Gaps = 1/475 (0%)

Query:    1 MKIMFVAAEGAPFAKTGGLGDVIGALPKSLSKKGHDVAVVMPYYDMVDQKFGDQIENLMY   60
            MK++F  +E APFAK+GGL DV GALPK L + G D  V++P Y+ +  ++  +++ +
Sbjct:    1 MKVLFAVSECAPFAKSGGLADVAGALPKELRRLGIDARVMLPKYETIAPEWKKKMKKVAE   60

Query:   61 FYTDVGWRHQYVGVKRLSQDNVTFYFIDNQYYFYRGHVYGDWDDGERFAYFQLAALELME  120
            VGWR QY GV+ L  D V +YFIDN+YYF R  +YG +DDGERFAYF  A LE++
Sbjct:   61 LIVPVGWRRQYCGVEELRHDGVIYYFIDNEYYFKRPQLYGHYDDGERFAYFCRAVLEVLP  120

Query:  121 KIDFIPDVLHVHDYHTAMIPFLLKEKYHWIQAYNNIRAVFTIHNIEFQGQFGPEMLGDLF  180
            +I F PDV+H HD+HT M+PFLL+E+Y      Y ++R VFTIHN++FQG F   +L DL
Sbjct:  121 EIQFQPDVIHCHDWHTGMVPFLLREQYRHELFYVDMRTVFTIHNLQFQGLFPRGILEDLL  180

Query:  181 GVGAERYEDGTLRWNNCLNWMKAAILYSDRVTTVSPSYANEIKTPEFGKGLDQIMRMEAG  240
            +   +    L +  C+++MK A++ SD +TTVSP+Y  EI+T  +G+ LD ++R
Sbjct:  181 NLDGRYFTVDHLEFYGCVSFMKGALVASDLITTVSPTYKEEIQTAYYGERLDGLLRARRD  240

Query:  241 KLSGIVNGIDSDLLNPETDAFLPYHFSKSNLEGKIKNKLALQENLGLPQDKNVPLIGIVS  300
            L GI+NGID + NPE D FL   +S   E K  NK ALQ    GLP+  +VPLI +V+
Sbjct:  241 DLLGILNGIDDEFYNPEADPFLTATYSVHTRERKQLNKRALQRQFGLPEWDDVPLIAMVT  300

Query:  301 RLTDQKGFDIIASELDNMLQQDIQMVILGTGYHHFEETFSYFASRYPEKLSANITFDLRL  360
            R+T QKG D++       M+ +D+Q+V+LGTG    FE+ FS  A+ YP K+   I F   L
Sbjct:  301 RMTAQKGLDLVTCVFHEMMSEDMQLVVLGTGDWRFEQFFSQMAAAYPGKVGVYIGFHEPL  360

Query:  361 AQQIYAASDIFMMPSAFEPCGLSQMMAMRYGSLPLVHEVGGLKDTVVAFNQFDGSGTGFS  420
            A  QIYA +D+F++PS FEPCGLSQM+A+RYG++P+V E GGL DTV ++N+     G GFS
Sbjct:  361 AHQIYAGADLFLIPSLFEPCGLSQMIALRYGTIPIVRETGGLNDTVQSYNEITKEGNGFS  420

Query:  421 FNHFSGYWLMQTLKLALEVYNDYPEAWKKLQWQAMSKDFSWDTACVAYEQLYQQL       475
            F +F+ + ++ T++  AL  Y    P  W++L  +AM  D+SW +    Y+Q Y+QL
Sbjct:  421 FTNFNAHDMLYTIRRALSFYRQ-PSVWEQLTERAMRGDYSWRRSANQYKQAYEQL       474
```

No corresponding DNA sequence was identified in S. pyogenes.

Based on this analysis, it was predicted that this protein and its epitopes, could be useful antigens for vaccines or diagnostics.

EXAMPLE 1420

A DNA sequence (GBSx1505) was identified in S. agalactiae <SEQ ID 4361> which encodes the amino acid sequence <SEQ ID 4362>. This protein is predicted to be a subunit of ADP-glucose pyrophosphorylase. Analysis of this protein sequence reveals the following:

```
Possible site: 14
>>> Seems to have no N-terminal signal sequence

----- Final Results -----
            bacterial cytoplasm --- Certainty = 0.3492(Affirmative) < succ>
            bacterial membrane  --- Certainty = 0.0000(Not Clear)   < succ>
            bacterial outside   --- Certainty = 0.0000(Not Clear)   < succ>
```

The protein has homology with the following sequences in the GENPEPT database.

```
>GP:BAA19590 GB:D87026 subunit of ADP-glucose pyrophosphorylase
[Bacillus stearothermophilus]
Identities = 59/178 (33%), Positives = 111/178 (62%), Gaps = 1/178 (0%)

Query:   37 SAEIYVIDTPWLIEKMEEEAQNNEPRKLRFLLRDLIVESNALAFEYTGYLSNISSIKSYY    96
            S E+Y+++T  L++ +  +N+  +   ++RD      +   +EY+GY + I S++ Y+
Sbjct:  157 SLEMYLLETSLLLDLIADY-KNHGYYSIVDVIRDYHRSLSICEYEYSGYAAVIDSVEQYF   215
```

```
Query:  97 DANMDMLTPNKFYSLFFSNQKVYTKVKNEEATYFDKQSNVSNSQLASGSIIKGYLDHSIV 156
           ++M++L  + +  LF  +  +YTKVK+E   T + ++ NV   S +A+G +I+G +++S++
Sbjct: 216 RSSMELLDRDVWEQLFLPSHPIYTKVKDEPPTKYGREGNVKRSMIANGCVIEGTVENSVL 275

Query: 157 SRNCLLEKGTRVVNSIIFPKVKIGEGATIENTIIDKCVKVASGVTLKGSLDKPLVIPK   214
            R+   +  KG  V NSII  K +IG+G  ++   IIDK   KV  GV LKG+ ++P ++ K
Sbjct: 276 FRSVKIGKGAVVRNSIIMQKCQIGDGCVLDGVIIDKDAKVEPGVVLKGTKEQPFIVRK   333
```

No corresponding DNA sequence was identified in *S. pyogenes*.

Based on this analysis, it was predicted that this protein and its epitopes, could be useful antigens for vaccines or diagnostics.

EXAMPLE 1421

A DNA sequence (GBSx1506) was identified in *S. agalactiae* <SEQ ID 4363> which encodes the amino acid sequence <SEQ ID 4364>. This protein is predicted to be subunit of ADP-glucose pyrophosphorylase (glgC-1). Analysis of this protein sequence reveals the following:

```
Possible site: 32
>>> Seems to have an uncleavable N-term signal seq.

----- Final Results -----
             bacterial membrane --- Certainty = 0.0000(Not Clear) < succ>
             bacterial outside  --- Certainty = 0.0000(Not Clear) < succ>
             bacterial cytoplasm --- Certainty = 0.0000(Not Clear) < succ>
```

A related GBS nucleic acid sequence <SEQ ID 9765> which encodes amino acid sequence <SEQ ID 9766> was also identified.

The protein has homology with the following sequences in the GENPEPT database.

```
>GP:BAA19589 GB:D87026 subunit of ADP-glucose pyrophosphorylase
[Bacillus stearothermophilus]
Identities = 195/352 (55%), Positives = 259/352 (73%)

Query:   7 MKNEMLALILAGGQGTRLGKLTQSIAKPAVQFGGRYRIIDFALSNCANSGINNVGVITQY  66
           MK + +A++LAGGQG+RL   LT +IAKPAV FGG+YRIIDF LSNC NSGI+ VGV+TQY
Sbjct:   1 MKKKCIAMLLAGGQGSRLRSLTTNIAKPAVPFGGKYRIIDFTLSNCTNSGIDTVGVLTQY  60

Query:  67 QPLELNTHIGNSSWGLDGIDSGVTVLQPYSATEGNRWFQGTSHAIYQNIDYIDRINPEY 126
           QPL L+++IG GS+W LD  +  GVTVL PYS  G +W++GT++A+YQNI+YI++  NP+Y
Sbjct:  61 QPLLLHSYIGIGSAWDLDRRNGGVTVLPPYSVSSGVKWYEGTANAVYQNINYIEQYNPDY 120

Query: 127 VLILSGDHIYKMNYDDMLQTHKDNLASLTVAVLDVPLKEASRFGIMNTDSNDRIVEFEEK 186
           VL+LSGDHIYKM+Y   ML  H    A  +T++V++VP  +EASRFGIMNT+     IVEF EK
Sbjct: 121 VLVLSGDHIYKMDYQHMLDYHIAKQADVTISVIEVPWEEASRFGIMNTNEEMEIVEFAEK 180

Query: 187 PEHPKSTKASMGIYIFDWKRLRTVLIDGEKNGIDMSDFGKNVIPAYLESGERVYTYNFDG 246
           P   PKS  ASMGIYIF+W  L+  L      N    DFGK+VIP  L   +R + Y F+G
Sbjct: 181 PAEPKSNLASMGIYIFNWPLLKQYLQIDNANPHSSHDFGKDVIPMLLREKKRPFAYPFEG 240

Query: 247 YWKDVGTIESLWEANMEYIGEDNKLHSRDRSWKIYSKNLIAPPNFMTEDANVKDSLVVDG 306
           YWKDVGT++SLWEANN+ + E+N+L   DRSW+IYS N   PP +++ +A V DSLV +G
Sbjct: 241 YWKDVGTVKSLWEANMDLLDENNELDLFDRSWRIYSVNPNQPPQYISPEAEVSDSLVNEG 300

Query: 307 CFVAGNVEHSILSTNVQVKPNAIIKDSFVMSGATIGEGAKINRAIIGEDAVI         358
           C  V G VE S+L     V++    A++K+S +M GA + EGA + RAI+  D++I
Sbjct: 301 CVVEGTVERSVLFQGVRIGKGAVVKESVIMPGAAVSEGAYVERAIVTPDSII         352
```

There is also homology to SEQ ID 2660.

Based on this analysis, it was predicted that these proteins and their epitopes could be useful antigens for vaccines or diagnostics.

EXAMPLE 1422

A DNA sequence (GBSx1507) was identified in *S. agalactiae* <SEQ ID 4365> which encodes the amino acid sequence <SEQ ID 4366>. Analysis of this protein sequence reveals the following:

Possible site: 37
>>> Seems to have no N-terminal signal sequence

----- Final Results -----
                bacterial cytoplasm --- Certainty = 0.2844(Affirmative) < succ>
                 bacterial membrane --- Certainty = 0.0000(Not Clear)   < succ>
                   bacterial outside --- Certainty = 0.0000(Not Clear)  < succ>

The protein has homology with the following sequences in the GENPEPT database.

```
>GP:CAA78440 GB:Z14057 1,4-alpha-glucan branching enzyme
[Bacillus caldolyticus]
Identities = 272/616 (44%), Positives = 371/616 (60%), Gaps = 14/616 (2%)

Query:   6 ELYTFGIGENFHLQNYLGVHSENGSFC----FRVWAPNAENVQVIGDFTDWRNRPLQMNK    61
           E+Y F  G +      G H   G         F VWAP+A V+++G F DW     + K
Sbjct:  10 EVYLFHEGRLYQSYELFGAHVIRGGGAVGTRFCVWAPHAREVRLVGSFNDWNGTNSPLTK    69

Query:  62 -NQAGVWEANSLDAREGDLYKYLVTRKGGQVVEKIDPMAVYMERRPGTASVIKVLRNKKW   120
             N    GVW    +  EG LYKY +      G+V+ K DP A Y E RP TAS++   L+  +W
Sbjct:  70 VNDEGVWTIVVPENLEGHLYKYEIITPDGRVLLKADPYAFYSELRPHTASIVYDLKGYEW   129

Query: 121 EDGLWMGRRKRLGFQKRPINIYEVHAGSWKKDDFGHPMTFSQLKDYLIPYLVEMNYTHVE   180
            D   W   +++R     +P+ IYE+H GSWKK      G    T+ ++ D  LIPY++E   +TH+E
Sbjct: 130 NDSPWQRKKRRKRIYDQPMVIYELHFGSWKKKPDGRFYTYREMADELIPYVLERGFTHIE   189

Query: 181 FMPLMAHPLDMSWGYQLMGYFAFEHTYGTPEEFQDFVEACHKNNIGVLVDWVPGHFIQND   240
              +PL+ HPLD SWGYQ  GY++       YGTP +F  FV+ CH+    +GV++DWVPGHF ++
Sbjct: 190 LLPLVEHPLDRSWGYQGTGYYSVTSRYGTPHDFMYFVDRCHQAGLGVIIDWVPGHFCKDA   249

Query: 241 DALAYFDGTATYEYQNHDRAHNYRWGALNFDLGKNQVQSFLISSALFWIEHYHIDGIRVD   300
                L  FDG  TYEY N     NY WG  NFDLGK +V+SFLIS+ALFW E+YH+DG RVD
Sbjct: 250 HGLYMFDGAPTYEYANEKDRENYVWGTANFDLGKPEVRSFLISNALFWLEYYHVDGFRVD   309

Query: 301 AVSNMLYLDYDEGPWEANQFGDNRNLEGYHFLRKLNKVIKERHPNVMMIAEESTASTPIT   360
            AV+NMLY   ++     +E          N      FLR+LN+ +      PNV MIAE+ST       +T
Sbjct: 310 AVANMLYWPNNDRLYE--------NPYAVEFLRQLNEAVFAYDPNVWMIAEDSTDWPRVT   361

Query: 361 KDLESGGLGFDFKWNMGWMNDILRFYEEDPLYRQYDFNLVTFSFMYIFNENFVLAFSHDE   420
                GGLGF++KWNMGWMND+L++  E   P   R+Y  N V+FS  +Y ++ENF+L FSHDE
Sbjct: 362 APTYDGGLGFNYKWNMGWMNDMLKYMETPPHERKYAHNQVSFSLLYAYSENFILPFSHDE   421

Query: 421 VVHGKKSMMHKMWGDRYNQFAGLRNLYAYQMCHPGKKLLFMGSEFGQFLEWKYNDQLEWE   480
            VVHGKKS+++KM  G      +FA LR LY  Y  M HPGKKLLFMGSEF  QF  EWK+    ++L+W
Sbjct: 422 VVHGKKSLLNKMPGSYEEKFAQLRLLYGYMMAHPGKKLLFMGSEFAQFDEWKFAEELDWV   481

Query: 481 NLNDDMNQKMQRYTKQLNQFYKDHKCLWRIDDSFDGLEIIDADNKSETVLSFIRKDDK-G   539
              + ++++KM   Y KQL     YK  +K  +  +D      G  E  ID  N   +++  SFIR+   K  G
Sbjct: 482 LFDFELHRKMDEYVKQLIACYKRYKPFYELDHDPRGFEWIDVHNAEQSIFSFIRRGKKEG   541

Query: 540 DLLLCVFNMTPVERPNFTIGVPQAGIYEEVLNTEMEEFGGVWKNHNPVTKTQVATWKDYD   599
             D+L+ V NT      ++ + VP      Y EVLN++  EFGG      +             +
Sbjct: 542 DVLVIVCNFTNQAYDDYKVSVPLLAPYREVLNSDAAEFGGSGHVNGKRLPAFSEPFHGKP   601

Query: 600 HTLSFTLPALGASVWR                                              615
            + +   T+P  G S+  R
Sbjct: 602 YHVRMTIPPFGISILR                                              617
```

Based on this analysis, it was predicted that this protein and its epitopes, could be useful antigens for vaccines or diagnostics.

EXAMPLE 1423

A DNA sequence (GBSx1508) was identified in *S. agalactiae* <SEQ ID 4367> which encodes the amino acid sequence <SEQ ID 4368>. This protein is predicted to be pullulanase (pulA). Analysis of this protein sequence reveals the following:

Possible site: 45
>>> Seems to have no N-terminal signal sequence

----- Final Results -----
                bacterial cytoplasm --- Certainty = 0.3194(Affirmative) < succ>

-continued
```
            bacterial membrane --- Certainty = 0.0000(Not Clear) < succ>
            bacterial outside  --- Certainty = 0.0000(Not Clear) < succ>
```

The protein has homology with the following sequences in the GENPEPT database.

```
>GP:AAC44685 GB:U67061 pullulanase [Bacteroides thetaiotaomicron]
Identities = 223/597 (37%), Positives = 331/597 (55%), Gaps = 55/597 (9%)

Query: 139 EYSETKTAFRLWAPTAERVELILYHSTDETASVSKVLSMKRGTAVNYKNHKENTHGVWFT  198
           EY+    T F LW+PTA+ V L+LY +  E     + + M+ G              G W
Sbjct:  46 EYTPEATKFTLWSPTADEVRLMLYEA-GEGGHAYETVKMQSGE-----------EGTWTA   93

Query: 199 ELEGNYNYQAYTYRVYYRRRTFKITRDPYSIATTANGKRSIVIAPEALTPEGFKISHGKE  258
           + +   + YT+ V    +    T    + A    NGKR+ +I  ++   P+G++     +
Sbjct:  94 VVSKDLIGKFYTFNVKIDDKWQGDTPGINARAVGVNGKRAAIIDWQSTNPOGWE----SD  149

Query: 259 AKWRLENPNQAVIYEMHVRDFSISETSGVKTDYHGKFKGLHQKGTVNQHGDKTTFDYVQD  318
           +  L++P   +IYEMH RDFS+  TSGVK    GK+   L + GT+N        T D++ +
Sbjct: 150 TRPPLKSPADMIIYEMHHRDFSVDSTSGVKNK--GKYLALTEHGTMNSDKLLTGIDHLIE  207

Query: 319 LGVNYIQLQPIFDHHQTFDDD-GHYAYNWGYDPENYNVPEASFSSNPHEPATRILELKSA  377
           LGV ++ L P FD+        +YNWGYDP+NYNVP+ S++++P++PATR+ E K
Sbjct: 208 LGVTHVHLLPSFDYASVDETRLNENSYNWGYDPQNYNVPDGSYATDPYQPATRVKEFKQM  267

Query: 378 IQAYHDAGIGVIMDVVYNHTFSSTDSAFQLTVPDYYYRMNHNGTFQNGSGCGNETASEKE  437
           +QA H AGI VIMDVVYNHTF++ +S F+ TVP Y+YR   + T  NGSGCGNETASE+
Sbjct: 268 VQALHKAGIRVIMDVVYNHTFNTDESNFERTVPGYFYRQKEDKTLANGSGCGNETASERL  327

Query: 438 MCRKYILDSVLYWVKEYNIDGFRFDLMGLHDVETMNIIRNELNKIDPRILVYGEGWDMGA  497
           M RK++++SVLYW+KEY++DGFRFDLMG+HD+ETMN IR  +N +DP I +YGEGW   A
Sbjct: 328 MMRKFMVESVLYWIKEYHVDGFRFDLMGIHDIETMNEIRKAVNAVDPTICIYGEGWAAEA  387

Query: 498 GLTPQNK-AKKDNAYQMPGIGFFNDDVRDAV---KGAEIYGEFKKGLVSGNSTEDIVAKG  553
             P +  A K N  Q+PG+ F+D++RD +     G +   GF G+   G   E V G
Sbjct: 388 PQYPADSLAMKGNIAQIPGVAVFSDELRDGLCGPVGDKRKGAFLAGIPGG---EMSVKFG  444

Query: 554 ILGSDE-------LVSYI------DPSQVLNYVEAHDNYNLNDLLWELHPNDNEKQHIYR  600
           I G+ E        V+Y         P Q+++YV  HD   L D L     P+    +Q I
Sbjct: 445 IAGAIEHPQVQCDSVNYTQKPWAKQPVQMISYVSCHDGLCLVDRLKASMPDITPEQLIRL  504

Query: 601 VEVASAMNLLMQGMAFMQLGQEFLRTKCYPTGDKGQLTQADKERAMNSYNAPDQVNQVNW  660
           ++A A+    QG+ F+   G+E +R                DK+    NSY +PD VN ++W
Sbjct: 505 DKLAQAVVFTSQGIPFIYAGEEIMR---------------DKQGVDNSYKSPDAVNAIDW  549

Query: 661 DNVTFHKSTINFIRKIITLKTNSPYFSYSSFEEIRKHVFVESAQYHSGFISFTVEEH  717
            T       + +++I L+ + P F       ++RKH+   +   S   I+F +++H
Sbjct: 550 RRKTTSADVFMYYKRLIDLRKSHPAFRMGDAGQVRKHLEFLPVE-GSNLIAFRLKDH  605
```

Based on this analysis, it was predicted that this protein and its epitopes, could be useful antigens for vaccines or diagnostics.

EXAMPLE 1424

A DNA sequence (GBSx1509) was identified in *S. agalactiae* <SEQ ID 4369> which encodes the amino acid sequence <SEQ ID 4370>. Analysis of this protein sequence reveals the following:

```
Possible site: 40
>>> Seems to have no N-terminal signal sequence

----- Final Results -----
            bacterial cytoplasm --- Certainty = 0.2368(Affirmative) < succ>
            bacterial membrane  --- Certainty = 0.0000(Not Clear)   < succ>
            bacterial outside   --- Certainty = 0.0000(Not Clear)   < succ>
```

The protein has homology with the following sequences in the GENPEPT database.

```
>GP:CAB12492 GB:Z99107 similar to hypothetical proteins
[Bacillus subtilis]
Identities = 151/293 (51%), Positives = 193/293 (65%), Gaps = 5/293 (1%)
```

```
                                  -continued
Query:    5 KKARLIYNPTSGQEIMKKNVAEVLDILEGFGYETSAFQTTPTKNSARDEATRAAQAGFDL   64
            K+AR+IYNPTSG+EI KK++A+VL  E GYETS  TT     A   A AA    FDL
Sbjct:    2 KRARIIYNPTSGREIFKKHLAQVLQKFEQAGYETSTHATT-CAGDATHAAKEAALREFDL   60

Query:   65 IVAAGGDGTINEVVNGIAPLKRRPKMAIIPTGTTNDFARALKIPRGNPIEATKLIGKNQI  124
            I+AAGGDGTINEVVNG+APL  RP + +IP GTTNDFARAL IPR + ++A    +
Sbjct:   61 IIAAGGDGTINEVVNGLAPLDNRPTLGVIPVGTTNDFARALGIPREDILKAADTVINGVA  120

Query:  125 VKMDIGQAQEDNYFINIAAAGSLTELTYSVPSQLKTTFGYLAYLAKGVELLPRVRKVPVK  184
              +DIGQ      YFINIA  G LTELTY VPS+LKT  G LAY  KG+E+LP +R    V+
Sbjct:  121 RPIDIGQVN-GQYFINIAGGGRLTELTYDVPSKLKTMLGQLAYYLKGMEMLPSLRPTEVE  179

Query:  185 ITHDKGEFIGDASMIFVAITNSVGGFEQIAPDAKLDDGKFTLILVKTANLIEIMHLIRLV  244
              I +D      F G+   +  V +TNSVGGFE++APD+ L+DG F L+++K ANL E + +  +
Sbjct:  180 IEYDGKLFQGEIMLFLVTLTNSVGGFEKLAPDSSLNDGMFDLMILKKANLAEFIRVATMA  239

Query:  245 LAGGKHINDKRVEYIKTSYLTIEPLSDERMMINLDGEYGGDAPITLANLKNHI         297
            L  G+HIND+ + Y K + + +     E+M +NLDGEYGG  P    NL  HI
Sbjct:  240 LR-GEHINDQHIIYTKANRVKVN--VSEKMQLNLDGEYGGMLPGEFVNLYRHI         289
```

A related DNA sequence was identified in *S. pyogenes* <SEQ ID 4371> which encodes the amino acid sequence <SEQ ID 4372>. Analysis of this protein sequence reveals the following:

```
Possible site: 40
>>> Seems to have no N-terminal signal sequence

----- Final Results -----
            bacterial cytoplasm --- Certainty = 0.2501(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below.

```
Identities = 272/334 (81%), Positives = 300/334 (89%)

Query:    1 MKKQKKARLIYNPTSGQEIMKKNVAEVLDILEGFGYETSAFQTTPTKNSARDEATRAAQA   60
            MKKQ +ARLIYNPTSGQE+M+K+V EVLDILEGFGYETSAFQTT  KNSA +EA RAA+A
Sbjct:    1 MKKQLRARLIYNPTSGQELMRKSVPEVLDILEGFGYETSAFQTTAQKNSALNEARRAAKA   60

Query:   61 GFDLIVAAGGDGTINEVVNGIAPLKRRPKMAIIPTGTTNDFARALKIPRGNPIEATKLIG  120
            GFDL++AAGGDGTINEVVNGIAPLK+RPKMAIIPTGTTNDFARALK+PRGNP +A KLIG
Sbjct:   61 GFDLLIAAGGDGTINEVVNGIAPLKKRPKMAIIPTGTTNDFARALKVPRGNPSQAAKLIG  120

Query:  121 KNQIVKMDIGQAQEDNYFINIAAAGSLTELTYSVPSQLKTTFGYLAYLAKGVELLPRVRK  180
            KNQ ++MDIG+A++D YFINIAAAGSLTELTYSVPSQLKT FGYLAYLAKGVELLPRV
Sbjct:  121 KNQTIQMDIGRAKKDTYFINIAAAGSLTELTYSVPSQLKTMFGYLAYLAKGVELLPRVSN  180

Query:  181 VPVKITHDKGEFIGDASMIFVAITNSVGGFEQIAPDAKLDDGKFTLILVKTANLIEIMHL  240
            VPVKITHDKG F G  SMIF AITNSVGGFE IAPDAKLDDG FTLIL+KTANL EI+HL
Sbjct:  181 VPVKITHDKGVFEGQVSMIFAAITNSVGGFEMIAPDAKLDDGMFTLILIKTANLFEIVHL  240

Query:  241 IRLVLAGGKHINDKRVEYIKTSYLTIEPLSDERMMINLDGEYGGDAPITLANLKNHIRFF  300
            +RL+L GGKHI D+RVEYIKTS + IEP   +RMMINLDGEYGGDAPITL NLKNHI FF
Sbjct:  241 LRLILDGGKHITDRRVEYIKTSKIVIEPQCGKRMMINLDGEYGGDAPITLENLKNHITFF  300

Query:  301 ANTDEISDDALVLDKDELAIEAIAQKFANEVDDL                           334
            A+TD ISDDALVLD+DEL IE I +KFA+EV+DL
Sbjct:  301 ADTDLISDDALVLDQDELEIEEIVKKFAHEVEDL                           334
```

Based on this analysis, it was predicted that these proteins and their epitopes could be useful antigens for vaccines or diagnostics.

EXAMPLE 1425

A DNA sequence (GBSx1510) was identified in *S. agalactiae* <SEQ ID 4373> which encodes the amino acid sequence <SEQ ID 4374>. This protein is predicted to be DNA ligase (ligA-1) Analysis of this protein sequence reveals the following:

```
Possible site: 16
>>> Seems to have no N-terminal signal sequence
     INTEGRAL     Likelihood = -0.27    Transmembrane   363-379 (363-379)

----- Final Results -----
              bacterial membrane --- Certainty = 0.1107(Affirmative) < succ>
               bacterial outside --- Certainty = 0.0000(Not Clear)   < succ>
             bacterial cytoplasm --- Certainty = 0.0000(Not Clear)   < succ>
```

A related GBS nucleic acid sequence <SEQ ID 9763> which encodes amino acid sequence <SEQ ID 9764> was also identified.

The protein has homology with the following sequences in the GENPEPT database.

```
>GP: CAB12482 GB: Z99107 similar to DNA ligase [Bacillus subtilis]
Identities = 346/657 (52%), Positives = 462/657 (69%), Gaps = 8/657 (1%)

Query:   2 ENRMNELVSLLNQYAKEYYTQDNPTVSDSQYDQLYRELVELEKQHPENILPNSPTHRVGG   61
           + R   EL   +N+Y+ EYYT D P+V D++YD+L +EL+ +E++HP+   P+SPT RVGG
Sbjct:   7 KQRAEELRRTINKYSYEYYTLDEPSVPDAEYDRLMQELIAIEEEHPDLRTPDSPTQRVGG   66

Query:  62 LVLEGFEKYQHEYPLYSLQDAFSKEELIAFDKRVKAEF-PTAAYMAELKIDGLSVSLTYV  120
              VLE F+K  H  P+ SL +AF+ ++L    FD+RV+       AY  ELKIDGL+VSL Y
Sbjct:  67 AVLEAFQKVTHGTPMLSLGNAFNADDLRDFDRRVRQSVGDDVAYNVELKIDGLAVSLRYE  126

Query: 121 NGVLQVGATRGDGNIGENITENLKRVHDIPLHLDQSLDITVRGECYLPKESFEAINIEKR  180
           +G      GATRGDG  GE+ITENLK +  +IPL +++ L I VRGE Y+PK SFEA+N E+
Sbjct: 127 DGYFVRGATRGDGTTGEDITENLKTIRNIPLKMNRELSIEVRGEAYMPKRSFEALNEERI  186

Query: 181 ANGEQEFANPRNAAAGTLRQLNTGIVAKRKLATFLYQEASPTQK--ETQDDVLKELESYG  238
              N E+ FANPRNAAAG+LRQL+   I AKR L  F+Y A    +    ETQ    L L+  G
Sbjct: 187 KNEEEPFANPRNAAAGSLRQLDPKIAAKRNLDIFVYSIAELDEMGVETQSQGLDFLDELG  246

Query: 239 FSVNHHRLISSSMEKIWDFIQTIEKDRVSLPYDIDGIVIKVNSIAMQEELGFTVKAPRWA  298
            F  N  R    S+E++    I  ++ R   LPY+IDGIVIKV+S+   QEELGFT K+PRWA
Sbjct: 247 FKTNQERKKCGSIEEVITLIDELQAKRADLPYEIDGIVIKVDSLDQQEELGFTAKSPRWA  306

Query: 299 IAYKFPAEEKEAEILSVDWTVGRTGVVTPTANLTPVQLAGTTVSRATLHNVDYIAEKDIR  358
           IAYKFPAEE    ++L ++  VGRTGV+TPTA L PV++AGTTVSRA+LHN D I EKDIR
Sbjct: 307 IAYKFPAEEVVTKLLDIELNVGRTGVITPTAILEPVKVAGTTVSRASLHNEDLIKEKDIR  366

Query: 359 IGDTVVVYKAGDIIPAVLNVVMSKRNQQEVML-IPKLCPSCGSELVHFEGEVALRCINPL  417
           I D VVV KAGDIIP V+NV++ +R  +E    +P CP CGSELV  EGEVALRCINP
Sbjct: 367 ILDKVVVKKAGDIIPEVVNVLVDQRTGEEKEFSMPTECPECGSELVRIEGEVALRCINPE  426

Query: 418 CPNQIKERLAHFASRDAMNITGFGPSLVEKLFDAHLIADVADIYRLSIENLLTLDGIKEK  477
           CP QI+E L HF SR+AMNI G G   ++ +LF+ +L+ +VAD+Y+L+ E ++ L+ + EK
Sbjct: 427 CPAQIREGLIHFVSRNAMNIDGLGERVITQLFEENLVRNADLYKLTKERVIQLERMGEK  486

Query: 478 SATKIYHAIQSSKENSAEKLLFGLGIRHVGSKASRLLLEEFGNLRQLSQASQESIASIDG  537
           S    +   +IQ SKENS E+LLFGLGIR +GSKA++ L   F +L  L +AS+E + ++D
Sbjct: 487 STENLISSIQKSKENSLERLLFGLGIRFIGSKAAKTLAMHFESLENLKKASKEELLAVDE  546

Query: 538 LGGVIAKSLHTFFFEKEEVDKLLEELTSYNVNFNYLG----KRVSTDAQLSGLTVVLTGKL  593
            +G +A ++ T+F KEE+ +LL EL    VN Y G     K   +D+   +G T+VLTGKL
Sbjct: 547 IGEKMADAVITYFHKEEMLELLNELQELGVNTLYKGPKKVKAEDSDSYFAGKTIVLTGKL  606

Query: 594 EKMTRNEAKEKLQNLGAKVTGSVSKKTDLIVAGSDAGSKLTKAQDLGITIQDEDWLL     650
           E+++RNEAK +++ LG K+TGSVSK TDL++AG  AGSKLTKAQ+L I + +E+ L+
Sbjct: 607 EELSRNEAKAQIEALGGKLTGSVSKNTDLVIAGEAAGSKLTKAQELNIEVWNEEQLM    663
```

A related DNA sequence was identified in *S. pyogenes* <SEQ ID 4375> which encodes the amino acid sequence <SEQ ID 4376>. Analysis of this protein sequence reveals the following:

```
Possible site: 61
>>> Seems to have no N-terminal signal sequence
     INTEGRAL     Likelihood = -0.43    Transmembrane   363-379 (363-379)

----- Final Results -----
              bacterial membrane --- Certainty = 0.1171(Affirmative) < succ>
               bacterial outside --- Certainty = 0.0000(Not Clear)   < succ>
             bacterial cytoplasm --- Certainty = 0.0000(Not Clear)   < succ>
```

An alignment of the GAS and GBS proteins is shown below.

```
Identities = 472/652 (72%), Positives = 556/652 (84%)

Query:    1 MENRMNELVSLLNQYAKEYYTQDNPTVSDSQYDQLYRELVELEKQHPENILPNSPTHRVG   60
            M+ R+ EL  LLN+Y +YYT+D P+VSDS YD+LYRELV LE+ +PE +L +SPT +VG
Sbjct:    1 MKKRIKELTDLLNRYRYDYYTKDAPSVSDSDYDKLYRELVTLEQSYPEYVLQDSPTQQVG   60

Query:   61 GLVLEGFEKYQHEYPLYSLQDAFSKEELIAFDKRVKAEFPTAAYMAELKIDGLSVSLTYV  120
            G +L+GFEKY+H+YPL+SLQDAFS+EEL AFDKRVKAEFP A Y+AELKIDGLS+SL+Y
Sbjct:   61 GTILKGFEKYRHQYPLFSLQDAFSREELDAFDKRVKAEFPNATYLAELKIDGLSISLSYE  120

Query:  121 NGVLQVGATRGDGNIGENITENLKRVHDIPLHLDQSLDITVRGECYLPKESFEAINIEKR  180
            NG LQVGATRGDGNIGENITEN+K++ DIP  L + L ITVRGE Y+ ++SF+AIN  ++
Sbjct:  121 NGFLQVGATRGDGNIGENITENIKKIKDIPYQLSEPLTITVRGEAYMSRQSFKAINEARQ  180

Query:  181 ANGEQEFANPRNAAAGTLRQLNTGIVAKRKLATFLYQEASPTQKETQDDVLKELESYGFS  240
            NGE EFANPRNAAAGTLRQL+T +VAKR+LATFLYQEASPT + Q++VL EL   GFS
Sbjct:  181 ENGETEFANPRNAAAGTLRQLDTSVVAKRQLATFLYQEASPTARNQQNEVLAELADLGFS  240

Query:  241 VNHHRLISSSMEKIWDFIQTIEKDRVSLPYDIDGIVIKVNSIAMQEELGFTVKAPRWAIA  300
            VN +  ++SSM++IWDFI+TIE  R  L YDIDG+VIKVNS+AMQEELGFTVKAPRWAIA
Sbjct:  241 VNPYYQLTSSMDEIWDFIKTIEAKRDQLAYDIDGVVIKVNSLAMQEELGFTVKAPRWAIA  300

Query:  301 YKFPAEEKEAEILSVDWTVGRTGVVTPTANLTPVQLAGTTVSRATLHNVDYIAEKDIRIG  360
            YKFPAEEKEAEILSVDWTVGRTGVVTPTANLTPVQLAGTTVSRATLHNVDYIAEKDIRIG
Sbjct:  301 YKFPAEEKEAEILSVDWTVGRTGVVTPTANLTPVQLAGTTVSRATLHNVDYIAEKDIRIG  360

Query:  361 DTVVVYKAGDIIPAVLNVVMSKRNQQEVMLIPKLCPSCGSELVHFEGEVALRCINPLCPN  420
            DTV+VYKAGDIIPAVLNVVMSKRNQQEVMLIPKLCPSCGSELVHFE EVALRCINPLCP+
Sbjct:  361 DTVIVYKAGDIIPAVLNVVMSKRNQQEVMLIPKLCPSCGSELVHFEDEVALRCINPLCPS  420

Query:  421 QIKERLAHFASRDAMNITGFGPSLVEKLFDAHLIADVADIYRLSIENLLTLDGIKEKSAT  480
             I+  L HFASRDAMNITG GP++VEKLF A  + DVADIY+L+ E+ + LDGIKEKSA
Sbjct:  421 LIQRSLEHFASRDAMNITGLGPAIVEKLFLAGFVHDVADIYQLTKEDFMQLDGIKEKSAD  480

Query:  481 KIYHAIQSSKENSAEKLLFGLGIRHVGSKASRLLLEEFGNLRQLSQASQESIASIDGLGG  540
            K+  AI++SK NSAEKLLFGLGIRH+GSK SRL+LE +G++  L  A +E IA IDGLG
Sbjct:  481 KLLAAIEASKSNSAEKLLFGLGIRHIGSKVSRLILEVYGDISALLTAKEEEIARIDGLGS  540

Query:  541 VIAKSLHTFFEKEEVDKLLEELTSYNVNFNYLGKRVSTDAQLSGLTVVLTGKLEKMTRNE  600
             IA+SL  +FE++    L++EL +  VN +Y G++V++DA L GLTVVLTGKL ++ RNE
Sbjct:  541 TIAQSLTQYFEQKTAAILVDELKTAGVNMHYSGQKVNSDAALFGLTVVLTGKLNQLNRNE  600

Query:  601 AKEKLQNLGAKVTGSVSKKTDLIVAGSDAGSKLTKAQDLGITIQDEDWLLNL         652
            AK+KL+ LGAKVTGSVSKKTDL++AGSDAGSKL KA+ LGI I+DEDWL L
Sbjct:  601 AKDKLEALGAKVTGSVSKKTDLVIAGSDAGSKLEKAKSLGIRIEDEDWLRQL         652
```

Based on this analysis, it was predicted that these proteins and their epitopes could be useful antigens for vaccines or diagnostics.

EXAMPLE 1426

A DNA sequence (GBSx1511) was identified in *S. agalactiae* <SEQ ID 4377> which encodes the amino acid sequence <SEQ ID 4378>. Analysis of this protein sequence reveals the following:

```
Possible Site: 32
>>> Seems to have a cleavable N-term signal seq.
     INTEGRAL    Likelihood = -5.63    Transmembrane    110-126 (108-128)
     INTEGRAL    Likelihood = -2.13    Transmembrane    142-158 (141-159)
     INTEGRAL    Likelihood = -1.12    Transmembrane     75-91  (75-93)

----- Final Results -----
            bacterial membrane --- Certainty = 0.3251(Affirmative) < succ>
            bacterial outside  --- Certainty = 0.0000(Not Clear)  < succ>
           bacterial cytoplasm --- Certainty = 0.0000(Not Clear)  < succ>
```

The protein has homology with the following sequences in the GENPEPT database.

```
>GP: CAA68244 GB: X99978 citrulline cluster-linked gene [Lactobacillus
plantarum]
Identities = 56/158 (35%), Positives = 91/158 (57%), Gaps = 8/158 (5%)

Query:   13 AIVTAIYIVLTITPPFNAIAYGAYQFRVSEMLNFLAFYHRKYLFAVTLGCMISNLYSFG-    71
            A+V A+Y+VL + P   ++A GA QFRVSE LN LA ++RKY++ +  G ++ + +   G
Sbjct:   13 ALVAAMYVVLCLGPAAFSLASGAIQFRVSEGLNHLAVFNRKYIWGIVAGVILFDAFGPGA    72

Query:   72 -MIDVFVGGGSTLLFVYLGTILFKQYQKDYLFNGLINKAFFFFSFFFAASMITVAVELKI   130
               +++V  GGG +LL + +  T L  +  K        L+N A F   S F   A MIT+      +
Sbjct:   73 SLLNVLFGGGQSLLALLVLTWLAPKL-KTVWQRMLLNIALFTVSMFMIALMITM-----M   126

Query:  131 VAGLPLLLTWLTTAVGELASLLVGAVLVDKLSRHVDFT                        168
            +G+     T+LTTA+ EL  + + A ++  L R + F+
Sbjct:  127 SSGVAFWPTYLTTALSELIIMSITAPIMYSLDRVLHFS                        164
```

A related DNA sequence was identified in *S. pyogenes* <SEQ ID 4379> which encodes the amino acid sequence <SEQ ID 4380>. Analysis of this protein sequence reveals the following:

```
Possible site: 32
>>> Seems to have an uncleavable N-term signal seq
     INTEGRAL     Likelihood = -4.41     Transmembrane      75-91  (70-94)
     INTEGRAL     Likelihood = -3.82     Transmembrane      12-28  (8-28)
     INTEGRAL     Likelihood = -2.28     Transmembrane     141-157 (140-158)
     INTEGRAL     Likelihood = -0.64     Transmembrane     110-126 (110-126)
     INTEGRAL     Likelihood = -0.59     Transmembrane      55-71  (54-73)

----- Final Results -----
             bacterial membrane --- Certainty = 0.2763(Affirmative) < succ>
             bacterial outside  --- Certainty = 0.0000(Not Clear)  < succ>
             bacterial cytoplasm --- Certainty = 0.0000(Not Clear) < succ>
```

An alignment of the GAS and GBS proteins is shown below.

```
Identities = 114/167 (68%), Positives = 137/167 (81%), Gaps = 1/167 (0%)

Query:    1 MNTFTTRDYAHMAIVTAIYIVLTITPPFNAIAYGAYQFRVSEMLNFLAFYHRKYLFAVTL    60
            M   T  DY H+ +V A+Y+VLTITPP NAI+YG YQFR+SEM+NFLAFYHRKY  AVTL
Sbjct:    1 MTKLTVHDYVHIGLVAALYVVLTITPPLNAISYGMYQFRISEMMNFLAFYHRKYIIAVTL    60

Query:   61 GCMISNLYSFGMIDVFVGGGSTLLFVYLGTILFKQYQKDYLFNGLINKAFFFFSFFFAAS   120
            GCMI+N YSFG +DVFVGGGSTL+FV LG ILF +YQKDYLFNG+ NKAF +FSFFFA S
Sbjct:   61 GCMIANFYSFGLIDVFVGGGSTLIFVTLGVILFSKYQKDYLFNGIFNKAFVYFSFFFATS   120

Query:  121 MITVAVELKIVAGLPLLLTWLTTAVGELASLLVGAVLVDKLSRHVDF               167
            M  VA+EL     G P LLTW TTA+GEL SLL+G++++DKLS+ + F
Sbjct:  121 MFNVAIELYFF-GAPFLLTWFTTALGELVSLLIGSLIIDKLSQRISF               166
```

Based on this analysis, it was predicted that these proteins and their epitopes could be useful antigens for vaccines or diagnostics.

EXAMPLE 1427

A DNA sequence (GBSx1513) was identified in *S. agalactiae* <SEQ ID 4381> which encodes the amino acid sequence <SEQ ID 4382>. Analysis of this protein sequence reveals the following:

```
Possible site: 53
>>> Seems to have no N-terminal signal sequence
     INTEGRAL     Likelihood = -11.20    Transmembrane     255-271 (245-281)
     INTEGRAL     Likelihood = -10.72    Transmembrane     141-157 (132-165)
     INTEGRAL     Likelihood = -8.17     Transmembrane     189-205 (185-208)
     INTEGRAL     Likelihood = -7.01     Transmembrane      36-52  (33-60)

----- Final Results -----
             bacterial membrane --- Certainty = 0.5479(Affirmative) < succ>
             bacterial outside  --- Certainty = 0.0000(Not Clear)  < succ>
             bacterial cytoplasm --- Certainty = 0.0000(Not Clear) < succ>
```

The protein has homology with the following sequences in the GENPEPT database.

```
>GP: AAC35915 GB: AF071085 Orfde2 [Enterococcus faecalis]
Identities = 83/276 (30%), Positives = 157/276 (56%), Gaps = 3/276 (1%)

Query:   17 RPIQVFMRHFQSAEMDLSAIAVAYYLLVTAFPLLVIAANIFPYFHINVSDLLSLMQKNLP   76
            R I+     H  +AE+  S++ VAYYLL++ FPLL+    N+ PY  I+ + +L   + + +P
Sbjct:   15 RFIETTQSHMVTAEIGNSSVVVAYYLLLSLFPLLIAVGNVLPYLRIDPNSVLPYIAEAIP   74

Query:   77 KNIYEPASRLAVDAFSKPSTGILGFASLTAFWTMSKSLTSLQKAINKAYGVDQHRDFVIS  136
            K++Y+            ++ S G+L  ++L AFW+ S+S+ +LQ A+NKA+GV+Q ++F++
Sbjct:   75 KDVYKNLEPAIRSLLTQRSGGLLSVSALAAFWSASQSINALQNAMNKAFGVEQRKNFILV  134

Query:  137 RLVGVGTGLIILFLLTFVLIFSTFSKPVLQIIVNMYDLGDTLTAWLLNLAQPVTFLTIFL  196
            R+V      L+ +  +  V++      + +++++ ++    ++        L  P+T + + +
Sbjct:  135 RVVSFLVILLFMVAIVGVVVILGLGQYIIELLQPIFHYSTSVIDTFQALKWPLTTVVLLV  194

Query:  197 GIGILYFILPNARIRKVRYVIPGTLFSTFVIGFFSNLISQYVLNRVEKMVDIKTFGSVVI  256
              + ++Y ++PN ++   +R ++PG +FST      S +    YV      ++  +  GS +
Sbjct:  195 IMCLIYAVVPNRKL-SLRSILPGAIFSTVGWMLLSQIFGLYVKYFSSRIASYQIIGSFI-  252

Query:  257 FILMLWFIFLAHIMILGAILNASVQEIATGKIESRR                          292
            ILMLW  F A I+ILGAI+NA V E    G  E ++
Sbjct:  253 -ILMLWLNFAATIIILGAIVNAVVDEYLXGXKEKKQ                          287
```

A related DNA sequence was identified in *S. pyogenes* <SEQ ID 4383> which encodes the amino acid sequence <SEQ ID 4384>. Analysis of this protein sequence reveals the following:

```
Possible site: 53
>>> Seems to have no N-terminal signal sequence
      INTEGRAL    Likelihood = -12.58    Transmembrane  141-157 (132-168)
      INTEGRAL    Likelihood = -12.15    Transmembrane  189-205 (177-210)
      INTEGRAL    Likelihood = -11.68    Transmembrane  256-272 (245-280)
      INTEGRAL    Likelihood =  -7.54    Transmembrane   36-52  (33-60)

----- Final Results -----
              bacterial membrane  --- Certainty = 0.6031(Affirmative) < succ>
               bacterial outside  --- Certainty = 0.0000(Not Clear)  < succ>
             bacterial cytoplasm  --- Certainty = 0.0000(Not Clear)  < succ>
```

The protein has homology with the following sequences in the databases:

```
>GP: CAA68244 GB: X99978 citrulline cluster-linked gene [Lactobacillus
plantarum]
Identities = 53/170 (31%), Positives = 92/170 (53%), Gaps = 11/170 (6%)

Query:    1 MTKLTVHDYVHIGLVAALYVVLTITPPLNAISYGMYQFRISEMMNFLAFYHRKYIIAVTL   60
            MT+  +  ++    LVAA+YVVL + P   +++ G  QFR+SE +N LA ++RKY+  +
Sbjct:    1 MTQSKIRPWIINALVAAMYVVLCLGPAAFSLASGAIQFRVSEGLNHLAVFNRKYIWGIVA   60

Query:   61 GCMIANFYSFG--LIDVFVGGGSTLIFVTLGVILFSKYQKDYLFNGIFNKAFVYFSFFFA  118
            G ++ + +  G   L++V GGG +L+ + +   L K +      ++ +  +   F
Sbjct:   61 GVILFDAFGPGASLLNVLFGGGQSLLALLVLTWLAPKLKT------VWQRMLLNIA-LFT  113

Query:  119 TSMFNVA--IELYFFGAPFLLTWFTTALGELVSLLIGSLIIDKLSQRISF            166
            +SMF +A  I+    G F  T+ TTAL EL+ + I + I+  L + + F
Sbjct:  114 VSMFMIALMITMMSSGVAFWPTYLTTALSELIIMSITAPIMYSLDRVLHF            163

!GB: AF071085 Orfde2 [Enterococcus faecalis] 176 2e-43
>GP: AAC35915 GB: AF071085 Orfde2 [Enterococcus faecalis]
Identities = 90/271 (33%), Positives = 155/271 (56%), Gaps = 3/271 (1%)

Query:   19 IQVFMRHLQSAEMDLSAIAVAYYLILTAFPLIVIAANIFPYLNIDIADLLRLMKQNLPKD   78
            I+     H+ +AE+  S++ VAYYL+L+ FPL++    N+ PYL  ID    +L  + + +PKD
Sbjct:   17 IETTQSHMVTAEIGNSSVVVAYYLLLSLFPLLIAVGNVLPYLRIDPNSVLPYIAEAIPKD   76

Query:   79 IFRPASAIVENIFSKPSGSVLGVATLTGLWTMSRSLTSLQKAINKAYGASQHRDFFIGHL  138
            +++     + ++ ++ SG +L V+ L    W+ S+S+ +LQ A+NKA+G  Q ++F +   +
Sbjct:   77 VYKNLEPAIRSLLTQRSGGLLSVSALAAFWSASQSINALQNAMNKAFGVEQRKNFILVRV  136

Query:  139 VGLLTSLIILFLLAFALIFSIFSKAAIQVLDKHYHLSDNITTIFLLLIQPITVLIIFVGL  198
            V    L  L+ + +      ++      + I++L +H S ++   F L  P+T +++ V +
```

```
                              -continued
Sbjct: 137 VSFLVILLFMVAIVGVVVILGLGQYIIELLQPIFHYSTSVIDTFQALKWPLTTVVLLVIM  196

Query: 199 MLLYFLLPNVKIKKIRYILPGTLFTSFVMTFLSNLVGNYVVYNVERMVDIKMFGSVMIFI  258
           L+Y ++PN K+  +R ILPG +F++     LS + G YV Y    R+    ++ GS   I
Sbjct: 197 CLIYAVVPNRKL-SLRSILPGAIFSTVGWMLLSQIFGLYVKYFSSRIASYQIIGS--FII  253

Query: 259 IMLWFIFLARILILGAIFNATYQEMSLGKLE                              289
           +MLW  F A I+ILGAI NA    E   G  E
Sbjct: 254 LMLWLNFAATIIILGAIVNAVVDEYLXGXKE                              284
```

An alignment of the GAS and GBS proteins is shown below.

```
Identities = 188/302 (62%), Positives = 244/302 (80%)

Query:   1 MKLKKFFEDLLAKLEYRPIQVFMRHFQSAEMDLSAIAVAYYLLVTAFPLLVIAANIFPYF   60
           M  KK+F+ +L+K +Y PIQVFMRH QSAEMDLSAIAVAYYL++TAFPL+VIAANIFPY
Sbjct:   1 MAEKKWFDKVLSKWQYEPIQVFMRHLQSAEMDLSAIAVAYYLILTAFPLIVIAANIFPYL   60

Query:  61 HINVSDLLSLMQKNLPKNIYEPASRLAVDAFSKPSTGILGFASLTAFWTMSKSLTSLQKA  120
           +I+++DLL LM++NLPK+I+ PAS +   + FSKPS  +LG A+LT  WTMS+SLTSLQKA
Sbjct:  61 NIDIADLLRLMKQNLPKDIFRPASAIVENIFSKPSGSVLGVATLTGLWTMSRSLTSLQKA  120

Query: 121 INKAYGVDQHRDFVISRLVGVGTGLIILFLLTFVLIFSTFSKPVLQIIVNMYDLGDTLTA  180
           INKAYG  QHRDF I  LVG+ T LIILFLL F LIFS FSK  +Q++     Y L D +T
Sbjct: 121 INKAYGASQHRDFFIGHLVGLLTSLIILFLLAFALIFSIFSKAAIQVLDKHYHLSDNITT  180

Query: 181 WLLNLAQPVTFLTIFLGIGILYFILPNARIRKVRYVIPGTLFSTFVIGFFSNLISQYVLN  240
            L L QP+T L IF+G+ +LYF+LPN +I+K+RY++PGTLF++FV+ F SNL+   YV+
Sbjct: 181 IFLLLIQPITVLIIFVGLMLLYFLLPNVKIKKIRYILPGTLFTSFVMTFLSNLVGNYVVY  240

Query: 241 RVEKMVDIKTFGSVVIFILMLWFIFLAHIMILGAILNASVQEIATGKIESRRGDIMSLIQ  300
           VE+MVDIK FGSV+IFI+MLWFIFLA  I+ILGAI NA+ QE++ GK+E R GD++++++
Sbjct: 241 NVERMVDIKMFGSVMIFIIMLWFIFLARILILGAIFNATYQEMSLGKLEGRSGDMIAILK  300

Query: 301 KS                                                            302
           K+
Sbjct: 301 KT                                                            302
```

Based on this analysis, it was predicted that these proteins and their epitopes could be useful antigens for vaccines or diagnostics.

EXAMPLE 1428

A DNA sequence (GBSx1514) was identified in *S. agalactiae* <SEQ ID 4385> which encodes the amino acid sequence <SEQ ID 4386>. Analysis of this protein sequence reveals the following:

```
Possible site: 22
>>> Seems to have no N-terminal signal sequence

----- Final Results -----
         bacterial cytoplasm --- Certainty = 0.4200(Affirmative) < succ>
         bacterial membrane  --- Certainty = 0.0000(Not Clear)   < succ>
         bacterial outside   --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1429

A DNA sequence (GBSx1515) was identified in *S. agalactiae* <SEQ ID 4387> which encodes the amino acid sequence <SEQ ID 4388>. This protein is predicted to be methionine aminopeptidase (map). Analysis of this protein sequence reveals the following:

```
Possible site: 14
>>> Seems to have no N-terminal signal sequence

----- Final Results -----
         bacterial cytoplasm --- Certainty = 0.2342(Affirmative) < succ>
```

```
                                  -continued
            bacterial membrane --- Certainty = 0.0000(Not Clear) < succ>
             bacterial outside --- Certainty = 0.0000(Not Clear) < succ>
```

A related GBS nucleic acid sequence <SEQ ID 9761> which encodes amino acid sequence <SEQ ID 9762> was also identified.

The protein has homology with the following sequences in the GENPEPT database.

```
>GP: AAC35914 GB: AF071085 methionine aminopeptidase A [Enterococcus
faecalis]
Identities = 101/207 (48%), Positives = 128/207 (61%), Gaps = 31/207 (14%)

Query:    1 MITLKSAREIEAMDRAGDFLASIHIGLRDIIKPGVDMWEVEEYVRRRCKEENVLPLQIGV   60
            MITLKS REIE MD +G+ LA +H  LR  IKPG+  W++E +VR   +   + QIG
Sbjct:    1 MITLKSPREIEMMDESGELLADVHRHLRTFIKPGITSWDIEVFVRDFIESHGGVAAQIGY   60

Query:   61 DGAVMDYPYATCCGLNDEVAHAFPRHYTLKQGDLLKVDMVLSEPLDKSIVDVSSLNFDNV  120
            +G     Y YATCC +NDE+ H FPR   LK GDL+KVDM +
Sbjct:   61 EG----YKYATCCSINDEICHGFPRKKVLKDGDLIKVDMCVD------------------   98

Query:  121 AQMKKYTETYSGGLADSCWAYAVGEVSQEVKDLMSVTREAMYIGIEKAVIGNRIGDIGAA  180
                     G ++DSCW+Y VGE + E+  LM VT++A+Y+GIE+A +GNRIGDIG A
Sbjct:   99 ---------LKGAISDSCWSYVVGESTPEIDRLMEVTKKALYLGIEQAQVGNRIGDIGHA  149

Query:  181 IQDYAESRGYGVVRDLVGHGVGPTMHE                                  207
            IQ Y E  GYGVVRD VGHG+GPT+HE
Sbjct:  150 IQTYVEGEGYGVVRDFVGHGIGPTIHE                                  176
```

A related DNA sequence was identified in S. pyogenes <SEQ ID 4389> which encodes the amino acid sequence <SEQ ID 4390>. Analysis of this protein sequence reveals the following:

```
Possible site: 42
>>> Seems to have no N-terminal signal sequence

----- Final Results -----
            bacterial cytoplasm --- Certainty = 0.2082(Affirmative) < succ>
            bacterial membrane  --- Certainty = 0.0000(Not Clear)   < succ>
             bacterial outside  --- Certainty = 0.0000(Not Clear)   < succ>
```

An alignment of the GAS and GBS proteins is shown below.

```
Identities = 256/286 (89%), Positives = 273/286 (94%)

Query:    1 MITLKSAREIEAMDRAGDFLASIHIGLRDIIKPGVDMWEVEEYVRRRCKEENVLPLQIGV   60
            MITLKSAREIEAMDRAGDFLA IHIGLRDIIKPGVDMWEVE YVRRRCKE+NVLPLQIGV
Sbjct:    1 MITLKSAREIEAMDRAGDFLAGIHIGLRDIIKPGVDMWEVEAYVRRRCKEDNVLPLQIGV   60

Query:   61 DGAVMDYPYATCCGLNDEVAHAFPRHYTLKQGDLLKVDMVLSEPLDKSIVDVSSLNFDNV  120
            DG +MDYPYATCCGLNDEVAHAFPRHY LK+GDLLKVDMVLSEPLDKSIVDV++L+FDNV
Sbjct:   61 DGHMMDYPYATCCGLNDEVAHAFPRHYILKEGDLLKVDMVLSEPLDKSIVDVAALDFDNV  120

Query:  121 AQMKKYTETYSGGLADSCWAYAVGEVSQEVKDLMSVTREAMYIGIEKAVIGNRIGDIGAA  180
             +MKK+T +Y+GGLADSCWAYAVG  S E+K LM VT+EAMY GIEKAVIGNRIGDIGAA
Sbjct:  121 PEMKKWTGSYTGGLADSCWAYAVGTPSDEIKQLMDVTKEAMYRGIEKAVIGNRIGDIGAA  180

Query:  181 IQDYAESRGYGVVRDLVGHGVGPTMHEEPMVPNYGTAGRGLRLREGMVLTIEPMINTGTW  240
            +Q+YAES GYGVVRDLVGHGVGPTMHEEPMVPNYGTAGRGLRL+EGMVLT+EPMINTGTW
Sbjct:  181 VQEYAESFGYGVVRDLVGHGVGPTMHEEPMVPNYGTAGRGLRLKEGMVLTVEPMINTGTW  240

Query:  241 EIDTDMKTGWAHKTLDGGLSCQYEHQFVITKDGPVILTSQGEERTY                286
            EIDTD+KTGWAHKTLDGGLSCQYEHQFVITKDGPVILTSQGEERTY
Sbjct:  241 EIDTDIKTGWAHKTLDGGLSCQYEHQFVITKDGPVILTSQGEERTY                286
```

Based on this analysis, it was predicted that these proteins and their epitopes could be useful antigens for vaccines or diagnostics.

EXAMPLE 1430

A DNA sequence (GBSx1516) was identified in *S. agalactiae* <SEQ ID 4391> which encodes the amino acid sequence <SEQ ID 4392>. Analysis of this protein sequence reveals the following:

```
Possible site: 30
>>> Seems to have no N-terminal signal sequence

----- Final Results -----
            bacterial cytoplasm --- Certainty = 0.3473(Affirmative) < succ>
            bacterial membrane  --- Certainty = 0.0000(Not Clear)   < succ>
             bacterial outside  --- Certainty = 0.0000(Not Clear)   < succ>
```

A related GBS nucleic acid sequence <SEQ ID 9759> which encodes amino acid sequence <SEQ ID 9760> was also identified.

The protein has homology with the following sequences in the GENPEPT database.

```
>GP: BAB06894 GB: AP001518 unknown conserved
protein [Bacillus halodurans]
Identities = 158/431 (36%), Positives = 270/431 (61%), Gaps = 6/431 (1%)

Query:   6 SKHQEILEYLENLAVGKRVSVRSISNHLKVSDGTAYRAIKEAENRGIVETRPRSGTVRVA   65
           +KH++IL+Y+ NL VG+++SVR I+  L+VS+GTAYRAIKEAEN+G+V  T  R GT+R+
Sbjct:   3 TKHEQILQYITNLEVGEKISVRRIAKDLQVSEGTAYRAIKEAENQGLVSTIERVGTIRIE   62

Query:  66 QKAKVNIEKLTYAEIARISDSQVVAGIEGLSKEFSKFSIGAMTHRNIEKYLVQGGLLIVG  125
           +K K NIEKLTYAE+   I D QV+ G +GL K  ++F IGAM   + +Y+  G LLIVG
Sbjct:  63 KKQKENIEKLTYAEVVNIVDGQVLGGRDGLHKTLNRFVIGAMKLDAMMRYVEPGNLLIVG  122

Query: 126 DRDEIQHLALQHQNAILVTGGFNVSPSVCRLADKLQIPVMVTHYDTFTVSTMINHTLSNA  185
           +R ++  +AL+    A+L+TGGF+ S    +LAD+L +PV+ T YDTFTV+TMIN  + +
Sbjct: 123 NRYQVHQIALEAGAAVLITGGFDTSDEAIKLADELDLPVISTSYDTFTVATMINRAIYDQ  182

Query: 186 KIRTDLKTVEQVYQSQMDYGFLAQDDTVKEFNLLVKQTKNVRFPIVNQANVVVGVVSVQD  245
              I+ ++  V+ +       D ++   ++ V +++  L ++T + R+P++++   + G+V+ +D
Sbjct: 183 LIKKEITLVDDILIPLQDTYYMTTENVVGKWHELNEKTGHSRYPVIDENMKIQGMVAAKD  242

Query: 246 ILGKDKEVKLATVMSKNIIVAKPRMSLANISQKMIFEDLNMMPVVSDDFELLGVITRRQA  305
           +L    +    + VM+KN I    R S+A ++  M++E + ++PV+    +L+GV++R+
Sbjct: 243 VLNASRHTPIEKVMTKNPITVSERTSVAAVAHVMVWEGIELLPVIDSHRKLIGVVSRQDV  302

Query: 306 VENLSMSQ-----GTDLYTYSDQILSNLQIEDG-HFSFLVEPAMIDHTGSLTQGVLTEFL  359
           ++ L M Q      G +        L+ +   + G  +  + P M +  G+++  GV+T +
Sbjct: 303 LKALQMIQRQPHVGETIEDLMTNGLNESSSDQGDSYEVEITPQMTNQLGTISHGVMTSLV  362

Query: 360 KEICIRVLTRKHQRSIVVKQMTLYFLQPVQIDEIIMVTPTIISEKRREATLDLELKLENK  419
             E     RVL +  +    +VV+ +TLYFL+PVQID  + + P ++   R+     +D+E+   E +
Sbjct: 363 IESGSRVLRKYKKGDLVVENITLYFLKPVQIDSRLTIRPRVLEIGRKHGKIDVEMYHEGE  422

Query: 420 IIAKAMIAVKI                                                  430
           I+ KA+    +I
Sbjct: 423 IVGKALFMAQI                                                  433
```

A related DNA sequence was identified in *S. pyogenes* <SEQ ID 4393> which encodes the amino acid sequence <SEQ ID 4394>. Analysis of this protein sequence reveals the following:

```
Possible site: 30
>>> Seems to have no N-terminal signal sequence

----- Final Results -----
            bacterial cytoplasm --- Certainty = 0.3011(Affirmative) < succ>
            bacterial membrane  --- Certainty = 0.0000(Not Clear)   < succ>
             bacterial outside  --- Certainty = 0.0000(Not Clear)   < succ>
```

An alignment of the GAS and GBS proteins is shown below.

```
Identities = 267/431 (61%), Positives = 351/431 (80%)

Query:    1 MIIVMSKHQEILEYLENLAVGKRVSVRSISNHLKVSDGTAYRAIKEAENRGIVETRPRSG   60
            +II+MSKHQ+IL+YLE LA+GK+VSVRSISNHLKVSDGTAYRAIKEAENRGIVET+PRSG
Sbjct:    1 VIIIMSKHQDILDYLEKLAIGKKVSVRSISNHLKVSDGTAYRAIKEAENRGIVETKPRSG   60

Query:   61 TVRVAQKAKVNIEKLTYAEIARISDSQVVAGIEGLSKEFSKFSIGAMTHRNIEKYLVQGG  120
            TVR+ +K +V I++LTY+EIARISDS+V+AG  GL   EFS+FSIGAMT +NI +YLV+GG
Sbjct:   61 TVRIEKKGRVRIDRLTYSEIARISDSEVLAGHAGLGHEFSRFSIGAMTQQNIRRYLVKGG  120

Query:  121 LLIVGDRDEIQHLALQHQNAILVTGGFNVSPSVCRLADKLQIPVMVTHYDTFTVSTMINH  180
            LLIVGDR+ IQ LAL++ NAILVTGGF VS  V  +A+  +IPVMVTHYDTFTV+TMINH
Sbjct:  121 LLIVGDRETIQLLALENHNAILVTGGFPVSKRVIEMANNQRIPVMVTHYDTFTVATMINH  180

Query:  181 TLSNAKIRTDLKTVEQVYQSQMDYGFLAQDDTVKEFNLLVKQTKNVRFPIVNQANVVVGV  240
             LSN +I+TDLKTVEQV    DYG+L +D +V+EFN L+K+T+ VRFP+++    V+GV
Sbjct:  181 ALSNIRIKTDLKTVEQVMIPITDYGYLCEDSSVEEFNTLIKKTRQVRFPVLDYKRKVIGV  240

Query:  241 VSVQDILGKDKEVKLATVMSKNIIVAKPRMSLANISQKMIFEDLNMMPVVSDDFELLGVI  300
            VS++D++ +    KL VMSKN I A+P  SLANISQKMIFEDLNM+PV ++  LLG+I
Sbjct:  241 VSMRDVVDQLPTTKLTKVMSKNPITARPNTSLANISQKMIFEDLNMLPVTDEENNLLGMI  300

Query:  301 TRRQAVENLSMSQGTDLYTYSDQILSNLQIEDGHFSFLVEPAMIDHTGSLTQGVLTEFLK  360
            TRRQA+ENL  Q  + YTYS+QILSNL+     ++ +VEP MID  G+++ GV++EFLK
Sbjct:  301 TRRQAMENLPNHQPNNPYTYSEQILSNLEETVDYYQVVVEPTMIDSAGNMSNGVISEFLK  360

Query:  361 EICIRVLTRKHQRSIVVKQMTLYFLQPVQIDEIIMVTPTIISEKRREATLDLELKLENKI  420
            EI IR LT+KHQ++I+++QM +YFL  +QI++ + + P II+E RR +T+D+E+ +++++
Sbjct:  361 EISIRALTKKHQKNIIIEQMMVYFLHAIQIEDELKIYPKIITENRRSSTIDIEIFVDDQV  420

Query:  421 IAKAMIAVKIN  431
            IAKA+I  KIN
Sbjct:  421 IAKAIITTKIN  431
```

Based on this analysis, it was predicted that these proteins and their epitopes could be useful antigens for vaccines or diagnostics.

EXAMPLE 1431

A DNA sequence (GBSx1517) was identified in *S. agalactiae* <SEQ ID 4395> which encodes the amino acid sequence <SEQ ID 4396>. Analysis of this protein sequence reveals the following:

```
Possible site: 55
>>> Seems to have no N-terminal signal sequence

----- Final Results -----
            bacterial cytoplasm --- Certainty = 0.2837(Affirmative) < succ>
             bacterial membrane --- Certainty = 0.0000(Not Clear)   < succ>
              bacterial outside --- Certainty = 0.0000(Not Clear)   < succ>
```

The protein has homology with the following sequences in the GENPEPT database.

```
>GP: BAB04556 GB: AP001510 unknown conserved protein
[Bacillus halodurans]
Identities = 56/185 (30%), Positives = 86/185 (46%), Gaps = 4/185 (2%)

Query:    7 MDIWTNLGRFAFIETEHVNLRPVAYTDREAFWRIASKRTNLQFI-FPVQTSKKESDFLLV   65
            M+I  G   +ETE + LR    D A+  AS     +++ +    S K+S+  L
Sbjct:    1 MEIEDIYGDLPTLETERLRLRKFYKDDAAAIYDYASNEQVTKYVLWETHQSIKDSEAFLA   60

Query:   66 HSFMK---EPLGVWAIEDKVSHKMFGVIRFENIDLSKKTAEIGYFLKESSWGQGIMTECL  122
            + K   + +  WAIE K + +M G + F        KTAE+GY L E  WGQGIMTE +
Sbjct:   61 FALNKYDEKDVSPWAIELKRNERMIGTVDFVWWKPKDKTAELGYVLSEPYWGQGIMTEAV  120

Query:  123 KTLSFFAFREFGMDKLIIVTHKENIASQKVALKAHFKQSRSFKGSDRYTRRIRDYIEFQL  182
                L  F F    ++++      ENI+S +V  KA      + +       RD+ + +
Sbjct:  121 NALVEFGFNNMELERIQAKCFAENISSARVMEKAGLIYEGTHRRAIYVKGAHRDFKVYAI  180
```

```
Query: 183 TRGDY                                                      187
             R DY
Sbjct: 181 IREDY                                                      185
```

A related DNA sequence was identified in *S. pyogenes* <SEQ ID 667> which encodes the amino acid sequence <SEQ ID 668>. Analysis of this protein sequence reveals the following:

```
Possible site: 52
>>> Seems to have no N-terminal signal sequence

----- Final Results -----
            bacterial cytoplasm --- Certainty = 0.1096(Affirmative) < succ>
            bacterial membrane  --- Certainty = 0.0000(Not Clear)   < succ>
             bacterial outside  --- Certainty = 0.0000(Not Clear)   < succ>
```

An alignment of the GAS and GBS proteins is shown below.

```
Identities = 94/177 (53%), Positives = 117/177 (65%)

Query:   7 MDIWTNLGRFAFIETEHVNLRPVAYTDREAFWRIASKRTNLQFIFPVQTSKKESDFLLVH   66
           MDIWT L  FAF ET V LRP  Y D   F+ + +   NL ++FP Q +K  SD+LLVH
Sbjct:   1 MDIWTKLAVFAFFETPKVILRPFRYEDHWDFYSMVNDTKNLYYVFPPEQKTKAASDYLLVH   60

Query:  67 SFMKEPLGVWAIEDKVSHKMFGVIRFENIDLSKKTAEIGYFLKESSWGQGIMTECLKTLS  126
           SF+K PLG WAIEDK +H++ G IR E+ D   + A+IGYFL   WGQGIMTE +  L
Sbjct:  61 SFIKFPLGQWAIEDKATHQVIGSIRIEHYDAKTRCADIGYFLNYAFWGQGIMTEVVIKLV  120

Query: 127 FFAFREFGMDKLIIVTHKENIASQKVALKAHFKQSRSFKGSDRYTRRIRDYIEFQLT     183
           + +F EFG+  L I+TH EN ASQKVA KA F+    FKGSDR T +I  Y  +QLT
Sbjct: 121 YLSFHEFGLKTLRIITHLENKASQKVAKKAGFQLKTCFKGSDRNTHKICIYKMYQLT     177
```

Based on this analysis, it was predicted that these proteins and their epitopes could be useful antigens for vaccines or diagnostics.

EXAMPLE 1432

A DNA sequence (GBSx1518) was identified in *S. agalactiae* <SEQ ID 4397> which encodes the amino acid sequence <SEQ ID 4398>. This protein is predicted to be UDP-N-acetylglucosamine-1-carboxyvinyl transferase (murA). Analysis of this protein sequence reveals the following:

```
Possible site: 61
>>> Seems to have no N-terminal signal sequence
     INTEGRAL     Likelihood = -5.63     Transmembrane     25-41 (24-42)

----- Final Results -----
             bacterial membrane  --- Certainty = 0.3251(Affirmative) < succ>
              bacterial outside  --- Certainty = 0.0000(Not Clear)   < succ>
            bacterial cytoplasm  --- Certainty = 0.0000(Not Clear)   < succ>
```

The protein has homology with the following sequences in the GENPEPT database.

```
>GP: AAF86297 GB: AF072894 UDP-N-acetylglucosamine-1-carboxyvinyl
transferase [Listeria monocytogenes]
Identities = 240/412 (58%), Positives = 303/412 (73%),
Gaps = 2/412 (0%)

Query:   3 KIIINGGKQLTGEVAVSGAKNSVVALIPATILADDVVVLDGVPAISDVDSLVDIMETMGA   62
           K+II GGK+L G + V GAKNS VALIPA  ILA+  VVL+G+P ISDV +L +I+E +G
Sbjct:  20 KLIIRGGKKLAGTLQVDGAKNSAVALIPAAILAESEVVLEGLPDISDVHTLYNILEELGG   79
```

-continued

```
Query:   63 KIKRYGETLEIDPCGVKDIPMPYGKINSLRASYYFYGSLLGRYGQATLGLPGGCDLGPRP 122
            ++   +T IDP  + +P+P G +  LRASYY  G++LGR+ +A +GLPGGC LGPRP
Sbjct:   80 TVRYDNKTAVIDPTDMISMPLPSGNVKKLRASYYLMGAMLGRFKKAVIGLPGGCYLGPRP 139

Query:  123 IDLHLKAFEAMGASVSYEGDSMRLATNGKPLQGANIYMDTVSVGATINTIIAAAKANGRT 182
            ID H+K FEA+GA V+ E  ++ L  +   L+GA IY+D VSVGATIN ++AA +A G+T
Sbjct:  140 IDQHIKGFEALGAKVTNEQGAIYLRAD--ELKGARIYLDVVSVGATINIMLAAVRAKGKT 197

Query:  183 VIENAAREPEIIDVATLLNNMGAHIRGAGTDVITIEGVKSLHGTRHQVIPDRIEAGTYIA 242
            VIENAA+EPEIIDVATLL NMGA I+GAGTD I I GV+ LHG  H +IPDRIEAGT++
Sbjct:  198 VIENAAKEPEIIDVATLLTNMGAIIKGAGTDTIRITGVEHLHGCHHTIIPDRIEAGTFMV 257

Query:  243 MAAAIGRGIKVTNVLYEHLESFIAKLDEMGVRMTVEEDSIFVEEQERLKAVSIKTSPYPG 302
            +AAA+G+G+++ NV+  HLE  IAKL EMGV M +EED+IFV E E++K V IKT  YPG
Sbjct:  258 LAAASGKGVRIENVIPTHLEGIIAKLTEMGVPMDIEEDAIFVGEVEKIKKVDIKTYAYPG 317

Query:  303 FATDLQQPLTPLLLTAEGNGSLLDTIYEKRVNHVPELARMGANISTLGGKIVYSGPNQLS 362
            F TDLQQPLT LL  AEG+ +  DTIY  R  H+ E+ RMG     G    V +GP QL
Sbjct:  318 FPTDLQQPLTALLTRAEGSSVITDTIYPSRFKHIAEIERMGGKFKLEGRSAVINGPVQLQ 377

Query:  363 GAPVKATDLRAGAALVIAGLMAEGRTEITNIEFILRGYSNIIEKLTSLGADI         414
            G+ V ATDLRAGAALVIA L+A+G TEI  +E I RGYS IIEKL+++GA+I
Sbjct:  378 GSKVTATDLRAGAALVIAALLADGETEIHGVEHIERGYSKIIEKLSAIGANI         429
```

A related DNA sequence was identified in *S. pyogenes* <SEQ ID 4399> which encodes the amino acid sequence <SEQ ID 4400>. Analysis of this protein sequence reveals the following:

```
Possible site: 21
>>> Seems to have no N-terminal signal sequence
    INTEGRAL      Likelihood = -8.70      Transmembrane      25-41 (23-45)

----- Final Results -----
              bacterial membrane --- Certainty = 0.4482(Affirmative) < succ>
               bacterial outside --- Certainty = 0.0000(Not Clear)  < succ>
             bacterial cytoplasm --- Certainty = 0.0000(Not Clear)  < succ>
```

The protein has homology with the following sequences in the databases:

```
>GP: AAF86297 GB: AF072894 UDP-N-acetylglucosamine-1-carboxyvinyl
transferase [Listeris monocytogenes]
Identities = 244/412 (59%), Positives = 302/412 (73%),
Gaps = 2/412 (0%)

Query:    3 KIIINGGKALSGEVAVSGAKNSVVALIPAIILADDIVILDGVPAISDVDSLIEIMELMGA  62
            K+II GGK L+G + V GAKNS VALIPA  ILA+  V+L+G+P ISDV +LI+E +G
Sbjct:   20 KLIIRGGKKLAGTLQVDGAKNSAVALIPAAILAESEVVLEGLPDISDVHTLYNILEELGG  79

Query:   63 TVNYHGDTLEIDPRGVQDIPMPYGRINSLRASYYFYGSLLGRFGQAVVGLPGGCDLGPRP 122
            TV Y   T IDP  + +P+P G +  LRASYY  G++LGRF +AV+GLPGGC LGPRP
Sbjct:   80 TVRYDNKTAVIDPTDMISMPLPSGNVKKLRASYYLMGAMLGRFKKAVIGLPGGCYLGPRP 139

Query:  123 IDLHLKAFEAMGVEVSYEGENMNLSTNGQKIHGAHIYMDTVSVGATINTMVAATKAQGKT 182
            ID H+K FEA+G +V+ E    + L  +   ++ GA IY+D VSVGATIN M+AA +A+GKT
Sbjct:  140 IDQHIKGFEALGAKVTNEQGAIYLRAD--ELKGARIYLDVVSVGATINIMLAAVRAKGKT 197

Query:  183 VIENAAREPEIIDVATLLNNMGAHIRGAGTDIITIQGVQKLHGTRHQVIPDRIEAGTYIA 242
            VIENAA+EPEIIDVATLL NMGA I+GAGTD I I GV+ LHG  H +IPDRIEAGT++
Sbjct:  198 VIENAAKEPEIIDVATLLTNMGAIIKGAGTDTIRITGVEHLHGCHHTIIPDRIEAGTFMV 257

Query:  243 LAAAIGKGVKITNVLYEHLESFIAKLEEMGVRMTVEEDAIFVEKQESLKAITIKTSPYPG 302
            LAAA GKGV+I NV+  HLE  IAKL EMGV M +EEDAIFV + E +K + IKT  YPG
Sbjct:  258 LAAASGKGVRIENVIPTHLEGIIAKLTEMGVPMDIEEDAIFVGEVEKIKKVDIKTYAYPG 317

Query:  303 FATDLQQPLTPLLLKADGRGTIIDTIYEKRINHVPELMRMGADISVIGGQIVYQGPSRLT 362
            F TDLQQPLT LL +A+G    I DTIY  R  H+ E+ RMG    + G    V QGP +L
Sbjct:  318 FPTDLQQPLTALLTRAEGSSVITDTIYPSRFKHIAEIERMGGKFKLEGRSAVINGPVQLQ 377

Query:  363 GAQVKATDLRAGAALVTAGLIAEGKTEITNIEFILRGYASIIAKLTALGADI         414
            G++V ATDLRAGAALV A L+A+G+TEI  +E I RGY+ II KL+A+GA+I
Sbjct:  378 GSKVTATDLRAGAALVIAALLADGETEIHGVEHIERGYSKIIEKLSAIGANI         429
```

An alignment of the GAS and GBS proteins is shown below.

```
Identities = 344/419 (82%), Positives = 394/419 (93%)

Query:    1 MRKIIINGGKQLTGEVAVSGAKNSVVALIPATILADDVVVLDGVPAISDVDSLVDIMETM   60
            MRKIIINGGK L+GEVAVSGAKNSVVALIPA ILADD+V+LDGVPAISDVDSL++IME M
Sbjct:    1 MRKIIINGGKALSGEVAVSGAKNSVVALIPAIILADDIVILDGVPAISDVDSLIEIMELM   60

Query:   61 GAKIKRYGETLEIDPCGVKDIPMPYGKINSLRASYYFYGSLLGRYGQATLGLPGGCDLGP  120
            GA +  +G+TLEIDP GV+DIPMPYGKINSLRASYYFYGSLLGR+GQA +GLPGGCDLGP
Sbjct:   61 GATVNYHGDTLEIDPRGVQDIPMPYGKINSLRASYYFYGSLLGRFGQAVVGLPGGCDLGP  120

Query:  121 RPIDLHLKAFEAMGASVSYEGDSMRLATNGKPLQGANIYMDTVSVGATINTIIAAAKANG  180
            RPIDLHLKAFEAMG  VSYEG++M L+TNG+ +  GA+IYMDTVSVGATINT++AA KA G
Sbjct:  121 RPIDLHLKAFEAMGVEVSYEGENMNLSTNGQKIHGAHIYMDTVSVGATINTMVAATKAQG  180

Query:  181 RTVIENAAREPEIIDVATLLNNMGAHIRGAGTDVITIEGVKSLHGTRHQVIPDRIEAGTY  240
            +TVIENAAREPEIIDVATLLNNMGAHIRGAGTD+ITI+GV+ LHGTRHQVIPDRIEAGTY
Sbjct:  181 KTVIENAAREPEIIDVATLLNNMGAHIRGAGTDIITIQGVQKLHGTRHQVIPDRIEAGTY  240

Query:  241 IAMAAAIGRGIKVTNVLYEHLESFIAKLDEMGVRMTVEEDSIFVEEQERLKAVSIKTSPY  300
            IA+AAAIG+G+K+TNVLYEHLESFIAKL+EMGVRMTVEED+IFVE+QE LKA++IKTSPY
Sbjct:  241 IALAAAIGKGVKITNVLYEHLESFIAKLEEMGVRMTVEEDAIFVEKQESLKAITIKTSPY  300

Query:  301 PGFATDLQQPLTPLLLTAEGNGSLLDTIYEKRVNHVPELARMGANISTLGGKIVYSGPNQ  360
            PGFATDLQQPLTPLLL A+G G+++DTIYEKR+NHVPEL RMGA+IS +GG+IVY GP++
Sbjct:  301 PGFATDLQQPLTPLLLKADGRGTIIDTIYEKRINHVPELMRMGADISVIGGQIVYQGPSR  360

Query:  361 LSGAPVKATDLRAGAALVIAGLMAEGRTEITNIEFILRGYSNIIEKLTSLGADIQLVEE   419
            L+GA VKATDLRAGAALV AGL+AEG+TEITNIEFILRGY++II KLT+LGADIQL+E+
Sbjct:  361 LTGAQVKATDLRAGAALVTAGLIAEGKTEITNIEFILRGYASIIAKLTALGADIQLIED   419
```

Based on this analysis, it was predicted that these proteins and their epitopes could be useful antigens for vaccines or diagnostics.

EXAMPLE 1433

A DNA sequence (GBSx1519) was identified in *S. agalactiae* <SEQ ID 4401> which encodes the amino acid sequence <SEQ ID 4402>. This protein is predicted to be thiamine phosphate pyrophosphorylase (thiE). Analysis of this protein sequence reveals the following:

```
Possible site: 55
>>> Seems to have no N-terminal signal sequence

----- Final Results -----
          bacterial cytoplasm --- Certainty = 0.0422(Affirmative) < succ>
          bacterial membrane  --- Certainty = 0.0000(Not Clear)   < succ>
           bacterial outside  --- Certainty = 0.0000(Not Clear)   < succ>
```

The protein has homology with the following sequences in the GENPEPT database.

```
>GP: AAF25544 GB: AF109218 ThiE [Staphylococcus carnosus]
Identities = 98/200 (49%), Positives = 140/200 (70%),
Gaps = 1/200 (0%)

Query:    5 LKLYFVCGTVDCSR-KNILTVVEEALQAGITLFQFREKGFTALQGKEKIAMAKQLQILCK   63
            L +YF+CGT D    + I  V++EAL+ GITL+QFREKG A  G++K+A+AK+LQ LCK
Sbjct:    7 LNVYFICGTQDIPEGRTIQEVLKEALEGGITLYQFREKGNGAKTGQDKVALAKELQALCK   66

Query:   64 QYQVPFIIDDDIDLVELIDADGLHIGQNDLPVDEARRRLPDKIIGLSVSTMDEYQKSQLS  123
            Y VPFI++DD+ L E IDADG+H+GQ+D  VD+   R    KIIGLS+  ++E   S L+
Sbjct:   67 SYNVPFIVNDDVALAEEIDADGIHVGQDDEAVDDFNNRFEGKIIGLSIGNLEELNASDLT  126

Query:  124 VVDYIGIGPFNPTQSKADAKPAVGNRTTKAVREINQDIPIVAIGGITSDFVHDIIESGAD  183
            V DYIG+GP    T SK DA   VG +  + +R+   D+PIVAIGGI+ D V ++  ++ AD
Sbjct:  127 YVDYIGVGPIFATPSKDDASEPVGPKMIETLRKEVGDLPIVAIGGISLDNVQEVAKTSAD  186

Query:  184 GIAVISAISKANHIVDATRQ                                          203
            G++VISAI+++ H +   +
Sbjct:  187 GVSVISAIARSPHVTETVHK                                          206
```

No corresponding DNA sequence was identified in *S. pyogenes*.

Based on this analysis, it was predicted that this protein and its epitopes, could be useful antigens for vaccines or diagnostics.

EXAMPLE 1434

A DNA sequence (GBSx1520) was identified in *S. agalactiae* <SEQ ID 4403> which encodes the amino acid sequence <SEQ ID 4404>. This protein is predicted to be hydroxyethylthiazole kinase (b2104). Analysis of this protein sequence reveals the following:

```
Possible site: 54
>>> Seems to have a cleavable N-term signal seq.
      INTEGRAL     Likelihood = -4.94    Transmembrane     198-214 (194-217)

----- Final Results -----
             bacterial membrane --- Certainty = 0.2975(Affirmative) < succ>
             bacterial outside  --- Certainty = 0.0000(Not Clear)   < succ>
           bacterial cytoplasm  --- Certainty = 0.0000(Not Clear)   < succ>
```

A related GBS nucleic acid sequence <SEQ ID 8805> which encodes amino acid sequence <SEQ ID 8806> was also identified. Analysis of this protein sequence reveals the following:

```
Lipop: Possible site: -1 Crend: 7
McG: Discrim Score: -2.93
GvH: Signal Score (-7.5): 1.61
     Possible site: 39
>>> Seems to have no N-terminal signal sequence
ALOM program count: 1 value: -4.94 threshold: 0.0
     INTEGRAL     Likelihood = -4.94    Transmembrane     183-199 (179-202)
     PERIPHERAL   Likelihood =  2.49    151
modified ALOM score: 1.49
*** Reasoning Step: 3

----- Final Results -----
             bacterial membrane --- Certainty = 0.2975(Affirmative) < succ>
             bacterial outside  --- Certainty = 0.0000(Not Clear)   < succ>
           bacterial cytoplasm  --- Certainty = 0.0000(Not Clear)   < succ>
```

The protein has homology with the following sequences in the GENPEPT database.

```
>GP: AAF25543 GB: AF109218 ThiM [Staphylococcus carnosus]
Identities = 114/253 (45%), Positives = 160/253 (63%),
Gaps = 1/253 (0%)

Query:  18 LEQLKEVNPLTICITNNVVKNFTANGLLALGASPAMSECIEDLEDLLKVADALLINIGTL   77
           L+Q++  +PL IC TN+VVKNFTANGLL+LGASP MSE  ++ ED    VA ++LINIGTL
Sbjct:   5 LDQIRTEHPLVICYTNDVVKNFTANGLLSLGASPTMSEAPQEAEDFYPVAGSVLINIGTL   64

Query:  78 TKESWQLYQEAIKIANKNQVPVVLDPVAAGASRFRLEVSLDLLKNYSISLLTGNGSEIAA  137
           TK    E   KIAN+ + P+V DPVA GAS++R +    LK    +++ GN SEI A
Sbjct:  65 TKHHEHAMLENAKIANETETPLVFDPVAVGASKYRKDFCKYFLKKIKPTVIKGNASEILA  124

Query: 138 LIGEKQASKGADGGKVADLESIAVKANQVFDPVPVVVTGETDAIAVRGEVRLLQNGSPLMP  197
           LI +   KG D     D+   IA KA + +   +++TGETD I    +V L NGS   +
Sbjct: 125 LIDDTATMKGTDSADNLDVVDIAEKAYKEYQTAIILTGETDVIVQDNKVVKLSNGSHFLA  184

Query: 198 LVTGTGCLLGAVLAAFIGSSDRSDDLACLTEAMTVYNVAGEIAEKVAKGKGVGSFQVAFL  257
           +TG GCLLGAV+ AF+  +      + L EA++VYN+A E AE+++  KG G+F    F+
Sbjct: 185 KITGAGCLLGAVVGAFL-FRNTHPSIETLIEAVSVYNIAAERAEQLSDSKGPGTFLTQFI  243

Query: 258 DALSQMKSEMIMD                                                270
           DAL ++ S+ + +
Sbjct: 244 DALYRIDSDAVAE                                                256
```

No corresponding DNA sequence was identified in *S. pyogenes*.

SEQ ID 8806 (GBS398) was expressed in *E. coli* as a His-fusion product. SDS-PAGE analysis of total cell extract is shown in FIG. 75 (lane 6; MW 31.8 kDa).

Figure 314:
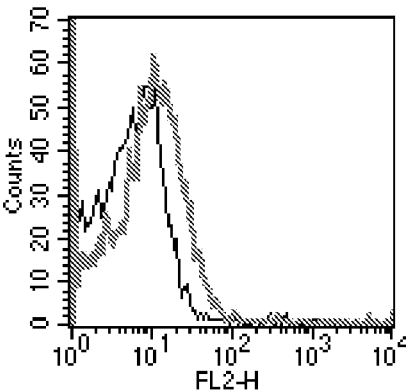

The GBS398-His fusion product was purified (FIG. 214, lane 5) and used to immunise mice. The resulting antiserum was used for FACS (FIG. 314), which confirmed that the protein is immunoaccessible on GBS bacteria.

Based on this analysis, it was predicted that these proteins and their epitopes could be useful antigens for vaccines or diagnostics.

EXAMPLE 1435

A DNA sequence (GBSx1521) was identified in *S. agalactiae* <SEQ ID 4405> which encodes the amino acid sequence <SEQ ID 4406>. This protein is predicted to be ThiD (thiD). Analysis of this protein sequence reveals the following:

```
Possible site: 44
>>> Seems to have an uncleavable N-term signal seq

----- Final Results -----
           bacterial membrane --- Certainty = 0.0000(Not Clear) < succ>
           bacterial outside  --- Certainty = 0.0000(Not Clear) < succ>
           bacterial cytoplasm --- Certainty = 0.0000(Not Clear) < succ>
```

The protein has homology with the following sequences in the GENPEPT database.

```
>GP: AAF25542 GB: AF109218 ThiD [Staphylococcus carnosus]
Identities = 139/258 (53%), Positives = 186/258 (71%), Gaps = 4/258 (1%)

Query:    8 LTIAGTDPSGGAGIMADLKTFQARRTYGMAVVTSVVAQNTCGVRGVQHIETAIIDQQLAC    67
            LTIAGTDP+GGAG+MADLK+F A   YGMA +TS+VAQNT GV+ + +++   + +QL
Sbjct:    8 LTIAGTDPTGGAGVMADLKSFHACGVYGMAAITSIVAQNTKGVQHIHNLDITWLKEQLDS    67

Query:   68 VYDDIKPKAVKTGMLAERETISLVASYLKKYPQ-PYVLDPVMVATSGHRLIDSDAVEALK   126
            ++DD  P+A+KTGM+A  +E + L+ SYL+KYP  PYV+DPVM+A SG   L+D    AL+
Sbjct:   68 IFDDELPQAIKTGMIATKEMMELIRSYLEKYPDIPYVIDPVMLAKSGDSLMDDAGKHALQ   127

Query:  127 EDLLPLATIITPNLPEAEVLVGYDLSDEVSIIKAGYDIQKQYSVRNVLIKGGHLD--GLA   184
            E LLPLA + TPNLPEAE +VG+ L  E +I KAG     +   + V+IKGGH++    +A
Sbjct:  128 EILLPLADVATPNLPEAEEIVGFKLDTEEAIKKAGDIFINEIGSKGVVIKGGHIEDKNIA   187

Query:  185 KDYLFLEKAGLITLSNQRINTIHTHGTGCTFAAVVAAELAKGQSILNAVSTAKSFITSAI   244
            KDYLF  K+GL    ++R ++T HTHGTGCTF+AV+ AELAKG++I   AV  AK FI  +I
Sbjct:  188 KDYLF-TKDGLEVFESERYDTKHTHGTGCTFSAVITAELAKGKTIYEAVKKAKDFIALSI   246

Query:  245 ETAPELGLGNGPVNHTSY                                              262
            +   PE+G G GPVNH +Y
Sbjct:  247 KYTPEIGQGRGPVNHFAY                                              264
```

There is also homology to SEQ ID 4408.

Based on this analysis, it was predicted that this protein and its epitopes, could be useful antigens for vaccines or diagnostics.

EXAMPLE 1436

A DNA sequence (GBSx1522) was identified in *S. agalactiae* <SEQ ID 4409> which encodes the amino acid sequence <SEQ ID 4410>. This protein is predicted to be TenA (tenA). Analysis of this protein sequence reveals the following:

```
Possible site: 42
>>> Seems to have no N-terminal signal sequence

----- Final Results -----
           bacterial cytoplasm --- Certainty = 0.2242(Affirmative) < succ>
           bacterial membrane  --- Certainty = 0.0000(Not Clear)   < succ>
           bacterial outside   --- Certainty = 0.0000(Not Clear)   < succ>
```

The protein has homology with the following sequences in the GENPEPT database.

```
>GP: AAF25541 GB: AF109218 TenA [Staphylococcus carnosus]
Identities = 78/213 (36%), Positives = 127/213 (59%), Gaps = 6/213 (2%)
```

-continued

```
Query:   14 IQSIYQDPFIQGIIKGRLDHDVICHYLQADNIYLGKFADIYALCLAKSDNLRDKQFFLEQ   73
            I  IYQD FIQ ++KG +  + +  YL+AD  YL +FA+IYAL +    +L   +F ++Q
Sbjct:   15 IDEIYQDHFIQELLKGDIKKEALRQYLRADASYLREFANIYALLIPIMPDLESVRFLVDQ   74

Query:   74 IDFTLNRELADGEGPHQALAAYTNRSYQDIIEKGVWYPSADHYIKHMYFHFY-ENGIAGA   132
            I F +N E+       H+ +A Y   +Y +I++K VW PS DHYIKHMY++ Y    A A
Sbjct:   75 IQFIVNGEVE----AHEYMADYIGENYNEIVQKKVWPPSGDHYIKHMYYNVYAHENAAYA   130

Query:  133 LAAMSPCPWIYHQLAKKIIEENQFLNGNPFNNWITFYANDTVEELMENYFRMMDYYAQNL   192
            +AAM+PCP++Y  +AK+ +++       +   W  FY N  ++ L+E     +M+    N+
Sbjct:  131 IAAMAPCPYVYAMIAKRAMKDPNLNKSSILAKWFEFY-NTEMDPLIEVLDDLMNQLTANM   189

Query:  193 SKEKQADLVDAFVKSCQHERRFFQMAINQEKWE                             225
            S+ ++ ++ +  +++S  HE  FF MA    EKW+
Sbjct:  190 SETEKNEVRENYLQSTVHELNFFNMAYTSEKWQ                             222
```

No corresponding DNA sequence was identified in *S. pyogenes*.

Based on this analysis, it was predicted that this protein and its epitopes, could be useful antigens for vaccines or diagnostics.

EXAMPLE 1437

A DNA sequence (GBSx1523) was identified in *S. agalactiae* <SEQ ID 4411> which encodes the amino acid sequence <SEQ ID 4412>. Analysis of this protein sequence reveals the following:

```
Possible site: 35
>>> Seems to have a cleavable N-term signal seq.
    INTEGRAL    Likelihood = -7.06    Transmembrane    43-59   (36-63)
    INTEGRAL    Likelihood = -2.55    Transmembrane    92-108  (92-112)
    INTEGRAL    Likelihood = -1.49    Transmembrane    135-151 (135-151)
    INTEGRAL    Likelihood = -1.06    Transmembrane    69-85   (69-85)
    INTEGRAL    Likelihood = -0.22    Transmembrane    216-232 (216-232)

----- Final Results -----
          bacterial membrane --- Certainty = 0.3824(Affirmative) < succ>
          bacterial outside  --- Certainty = 0.0000(Not Clear)  < succ>
          bacterial cytoplasm --- Certainty = 0.0000(Not Clear) < succ>
```

The protein has homology with the following sequences in the GENPEPT database.

```
>GP: CAA91230 GB: Z56283 orf2 [Lactobacillus helveticus]
Identities = 46/215 (21%), Positives = 96/215 (44%), Gaps = 3/215 (1%)

Query:   21 AITFLCLLIPTFSFSFTLRLRTSLLFLIIVVTLQCFVKVSLKTWAKVNLISFVMGLSLFL   80
            ++ F+   I +    S    L T+L+ +   ++ +K     + + F+    ++F
Sbjct:    4 SLKFILAFIISLEISLKASLTTNLIVIAFALIYLLVTRIKIKELILLIAVPFIASFTIFA   63

Query:   81 GTYFWGKLPHQFVLASLVACRPLIFMNVGLLFHASHSNYDFIESLYQTFKVPSHFAYGIF   140
            +++      P  +    +L + R  ++           + + DF  SL Q   +PS FAYG +
Sbjct:   64 TLFWFSPTPDAYYAWNL-STRVVYTLTIACVTRNTTATDFARSLEQNLHLPSKFAYGVL   122

Query:  141 AVFNLLPLIKLQYQRNRLAFRLKNQVTWALSPRLILSVLLKTIYWVEQLELAMLSKGFEV   200
            A  N++P +K   ++ R +   ++          SP L   +L +    + L  M S G+
Sbjct:  123 AAINIIPRMKTAVKQIRTSAMMRGMYLSFWSPVLYFKAILVALNSADNLAQGMESHGYVE   182

Query:  201 GKERTHASTYPVRFRDYSL-LGMSILLSIGM-IFK                           233
            G++R       P+   +D+ +  +  IL++I  + IFK
Sbjct:  183 GQKRATIVAIPLTKKDWLIFFTLLILVNISLFIFK                           217
```

No corresponding DNA sequence was identified in *S. pyogenes*.

A related GBS gene <SEQ ID 8807> and protein <SEQ ID 8808> were also identified. Analysis of this protein sequence reveals the following:

```
Lipop: Possible Site: -1 Crend: 0
McG: Discrim Score: 4.50
GvH: Signal Score (-7.5): -0.2
     Possible site: 35
>>> Seems to have a cleavable N-term signal seq.
ALOM program count: 5 value: -7.06 threshold: 0.0
    INTEGRAL    Likelihood = -7.06    Transmembrane    43-59   (36-63)
    INTEGRAL    Likelihood = -2.55    Transmembrane    92-108  (92-112)
```

```
   INTEGRAL       Likelihood = -1.49    Transmembrane    135-151 (135-151)
   INTEGRAL       Likelihood = -1.06    Transmembrane     69-85  (69-85)
   INTEGRAL       Likelihood = -0.22    Transmembrane    216-232 (216-232)
   PERIPHERAL     Likelihood =  2.65                     170
modified ALOM score: 1.91
*** Reasoning Step: 3

----- Final Results -----
              bacterial membrane  --- Certainty = 0.3824(Affirmative) < succ>
              bacterial outside   --- Certainty = 0.0000(Not Clear)   < succ>
              bacterial cytoplasm --- Certainty = 0.0000(Not Clear)   < succ>
```

Based on this analysis, it was predicted that these proteins and their epitopes could be useful antigens for vaccines or diagnostics.

EXAMPLE 1438

A DNA sequence (GBSx1524) was identified in *S. agalactiae* <SEQ ID 4413> which encodes the amino acid sequence <SEQ ID 4414>. Analysis of this protein sequence reveals the following:

```
Possible site: 24
>>> Seems to have no N-terminal signal sequence

----- Final Results -----
              bacterial cytoplasm --- Certainty = 0.3007(Affirmative) < succ>
              bacterial membrane  --- Certainty = 0.0000(Not Clear)   < succ>
              bacterial outside   --- Certainty = 0.0000(Not Clear)   < succ>
```

The protein has homology with the following sequences in the GENPEPT database.

```
>GP: CAA91229 GB: Z56283 orf1 [Lactobacillus helveticus]
Identities = 123/424 (29%), Positives = 200/424 (47%),
Gaps = 48/424 (11%)

Query:  17 LFDEVTFSLNPGERILISGYSGCGKSTLALLLSGL--KESGK--GQVLLNGSLIEPSDVG   72
           L +++ ++ PG +LI G +GCGKSTL  +++GL  K +GK  G++ L+G
Sbjct:  12 LINQLNMNIAPGFNLLI-GPTGCGKSTLLKIIAGLYPKYAGKLTGKIDLHGQ-----KAA   65

Query:  73 FLFQNPDLQFCMDTVAHELYFILENLQIEPEQMQDRSEFVLAQVGLKGFQNRLIYTLSQG  132
           +FQN   QF M T   E+ F LENLQI+ +    +   +    ++ I TLS G
Sbjct:  66 MMFQNAAEQFTMTTPREEIIFALENLQIKAKDYDLHIKKAVEFTKIADLLDQKINTLSGG  125

Query: 133 EKQRLALATIFLKSPKLIILDEAFANLDQESASQLLQLVLNYQANNQSMLIVIDHLITYY  192
           ++Q +ALA +    + +LDE FA+ D +   L++ + +    ++ +I+ DH++ Y
Sbjct: 126 QQQHVALAVLIAMDVDVFLLDEPFASCDPNTRHFLIEKLASLAETGRT-IILSDHVLDDY  184

Query: 193 QDIMDHYFWLEKRLTRVNFDYMLNRLNVFELEKKSHN--------TGDKLLSIKDFQVK-  243
           + I DH + E + +    N+L F+ K+ H         TG  +  Q+K
Sbjct: 185 EKICDHLYQFEGKTVKELSANEKNKL--FKQNKQFHEQSYSFALPTGTPVFELNKTQIKQ  242

Query: 244 ----LSKNKFISYLDFDLASGERLCLDGPSGVGKSSLFMGLLGLYRTKGK--------KQ  291
               L +NK  Y        G+   + G +GVGK+SLF   +    KG             +
Sbjct: 243 NRLLLKQNKLKIY-------GKTTLITGSNGVGKTSLFKAMTKMIPYKGNFTYLDNEISK  295

Query: 292 FTHRKQIP-ISFLFQNPLDQFIFSTVYDEIFQVCKDSN------KARDILETINLWDKKQ  344
           +RK + I+  FQ   DQF+ TV DEI   KD N        K + LE + L
Sbjct: 296 IKYRKYLSQIAQFFQKASDQFLTVTVKDEIELSKKDRNNFFTDAKIDEWLEKLQLKQHLD  355

Query: 345 FSPFQLSQGQQRRLAIGSILASDSKLLLLDEPTYGQDAYHANMITTLLLSYCHKNHCGVI  404
           + LS GQQ++L I  +L + +LL+DEP  G D   +++ L+    K   +
Sbjct: 356 QVVYSLSGGQQKKLQILLMLMTKHNVLLIDEPLSGLDHESVDLVLQLMQECQEKLQQTFL  415

Query: 405 FTSH                                                          408
           SH
Sbjct: 416 IISH                                                          419

Identities = 44/185 (23%), Positives = 83/185 (44%), Gaps = 24/185 (12%)

Query:  28 GERILISGYSGCGKSTLALLLSGLKESGKGQVLLNGSLIEP------SDVGFLFQNPDLQ   81
           G+  LI+G +G GK++L    ++ +      L+ + +         S + FQ    Q
```

```
-continued
Sbjct: 256 GKTTLITGSNGVGKTSLFKAMTKMIPYKGNFTYLDNEISKIKYRKYLSQIAQFFQKASDQ 135

Query:  82 FCMDTVAHELYFILENLQIEPEQMQDRSEFV--------LAQVGLKGFQNRLIYTLSQGE 133
           F    TV  E+             +DR+ F         L ++ LK    ++++Y+LS G+
Sbjct: 316 FLTVTVKDEIEL----------SKKDRNNFFTDAKIDEWLEKLQLKQHLDQVVYSLSGGQ 365

Query: 134 KQRLALATIFLKSPKLIILDEAFANLDQESASQLLQLVLNYQANNQSMLIVIDHLITYYQ 193
           +++L +  + +     ++++DE + LD ES  +LQL +    Q   Q    ++I H I
Sbjct: 366 QKKLQILLMLMTKHNVLLIDEPLSGLDHESVDLVLQLMQECQEKLQQTFLIISHQIDALA 425

Query: 194 DIMDH                                                        198
           D  D+
Sbjct: 426 DFCDY                                                        430
```

A related DNA sequence was identified in *S. pyogenes* <SEQ ID 4415> which encodes the amino acid sequence <SEQ ID 4416>. Analysis of this protein sequence reveals the following:

```
Possible site: 30
>>> Seems to have no N-terminal signal sequence

----- Final Results -----
            bacterial cytoplasm --- Certainty = 0.3093(Affirmative) < succ>
            bacterial membrane  --- Certainty = 0.0000(Not Clear)  < succ>
            bacterial outside   --- Certainty = 0.0000(Not Clear)  < succ>
```

An alignment of the GAS and GBS proteins is shown below.

```
Identities = 120/455 (26%), Positives = 203/455 (44%),
Gaps = 47/455 (10%)

Query:   1 MLSVEKLACTHGDSHYLFDEV-TFSLNPGERILISGYSGCGKSTLALLLSGLKE---SGK  56
           M+S E+L  T+ D        ++ T +  G+ I++ G SG GKST    LL+G+   +GK
Sbjct:  21 MISAEQLVFTYHDQKNPACQISTCQIASGQFIVLCGPSGSGKSTFLKLLNGIIPDYYAGK  80

Query:  57 GQVLLNGSLIEPS---------DVGFLFQNPDLQFCMDTVAHELYFILENLQIEPEQMQD 107
           + L+ + +           V +FQNP  QF    V HEL F  EN ++ + +
Sbjct:  81 YEGRLDVADCQAGRDSVETFSRSVASVFQNPASQFFYREVQHELVFPCENQGLDAKVIMK 140

Query: 108 RSEFVLAQVGLKGFQNRLIYTLSQGEKQRLALATIFLKSPKLIILDEAFANLDQESASQL 167
           R    +            N+ ++ LS G+KQR+A+AT ++    +++ DE  ANLD   + +
Sbjct: 141 RLWTLAEDFAFAELLNKDMFGLSGGQKQRVAIATAIMQGTNIMLFDEPTANLDSAGIAAV 200

Query: 168 LQLVLNYQANNQSMLIVIDHLITYYQDIMDHYFW-----LEKRLTRVNF---------DY 213
           +   +A ++ +IV +H + Y  D+ D++F+       L  +LT  N            D
Sbjct: 201 KAYLTQLKAAGKT-IIVAEHRLHYLMDLADNFFYFKNGRLTDKLTTQNLLALTDEQRQDM 259

Query: 214 MLNRLNVFELE-------KKSHNTGDKLLSIKDFQVKLSKNKFISYLDFDLASGERLCLD 266
           L RL++  +L+      +   H    D  L I+   V+          A G       +
Sbjct: 260 GLRRLDLSDLKPVLAGKIESQHYRPDDSLCIEHLTVRAGSKILRCIEQLSFAVGSISGIT 319

Query: 267 GPSGVGKSSLFMGLLGLYRTKGKKQFTHRKQIPISFLFQNPLDQFIFSTVYDEIF--QVC 324
           G +G+GKS L   + G+      KK    + IP+S +        +  V  ++F     V
Sbjct: 320 GSNGLGKSQLVYYIAGI--LDDKKATIKFQGIPLSAKQRLSKTSIVLQEVSLQLFAESVS 377

Query: 325 KDSN-------KARDILETINLWDKKQFSPFQLSQGQQRRLAIGSILASDSKLLLLDEPT 377
           K+ N       + +++E ++L   +  P  LS G+Q+R+ I + L +D  +L+ DEP+
Sbjct: 378 KEVNLGHERHPRTTEVIERLSLTTLLERHPASLSGGEQQRVMIAASLLADKDILIFDEPS 437

Query: 378 YGQDAYHANMITTLLLSYCHKNHCGVIFTSHDPHL                         412
            G D        + LL+       H VI  SHD  L
Sbjct: 438 SGLDLLQMKALANLLMQ-LKTQHKVVILISHDEEL                         471
```

Based on this analysis, it was predicted that these proteins and their epitopes could be useful antigens for vaccines or diagnostics.

EXAMPLE 1439

A DNA sequence (GBSx1525) was identified in *S. agalactiae* <SEQ ID 4417> which encodes the amino acid sequence <SEQ ID 4418>. Analysis of this protein sequence reveals the following:

```
Possible site: 42
>>> Seems to have an uncleavable N-term signal seq
    INTEGRAL    Likelihood = -11.62    Transmembrane      8-24   (1-30)
    INTEGRAL    Likelihood =  -8.17    Transmembrane    145-161  (143-163)
    INTEGRAL    Likelihood =  -6.32    Transmembrane     66-82   (62-84)
    INTEGRAL    Likelihood =  -3.77    Transmembrane    112-128  (111-132)
    INTEGRAL    Likelihood =  -2.66    Transmembrane     43-59   (43-59)

----- Final Results -----
            bacterial membrane  --- Certainty = 0.5649(Affirmative) < succ>
             bacterial outside  --- Certainty = 0.0000(Not Clear)   < succ>
           bacterial cytoplasm  --- Certainty = 0.0000(Not Clear)   < succ>
```

The protein has homology with the following sequences in the GENPEPT database.

```
>GP: CAB13180 GB: Z99110 ykoE [Bacillus subtilis]
Identities = 68/177 (38%), Positives = 117/177 (65%), Gaps = 1/177 (0%)

Query:    5 LKDVLLIALLAVVLGVVYFGAGYISNAFVPFVGPIAHEVIYGIWFVAGPMALYILRKPGT   64
            +K+++++++++V VVY  +  N    GPIA+E IYGIWF+    +A Y++RKPG
Sbjct:    6 VKEIVIMSVISIVFAVVYLLFTHFGNVLAGMFGPIAYEPIYGIWFIVSVIAAYMIRKPGA   65

Query:   65 AIVAELLAALIEVLIGSIYGPSVLVIGTLQGLGSELGFTLFRYHNYKLPAFILSAILTSI  124
            A+V+E++AAL+E L+G+ GP V+VIG +QGLG+E  F   R+  Y LP  +L+ + +S+
Sbjct:   66 ALVSEIIAALVECLLGNPSGPMVIVIGIVQGLGAEAVFLATRWKAYSLPVLMLAGMGSSV  125

Query:  125 FSFAWSFYANGLSAFSFSYNILMLIVRTVS-SIIFFLLTKNICDQLHRSGVLNAYGI    180
              SF +  + +G +A+S  Y ++ML++R +S +++   LL K +    L +GVLN    +
Sbjct:  126 ASFIYDLFVSGYAAYSPGYLLIMLVIRLISGALLAGLLGKAVSGSLAYTGVLNGMAL    182
```

No corresponding DNA sequence was identified in S. pyogenes.

Based on this analysis, it was predicted that this protein and its epitopes, could be useful antigens for vaccines or diagnostics.

EXAMPLE 1440

A DNA sequence (GBSx1526) was identified in S. agalactiae <SEQ ID 4419> which encodes the amino acid sequence <SEQ ID 4420>. Analysis of this protein sequence reveals the following:

```
Possible site: 47
>>> Seems to have no N-terminal signal sequence
    INTEGRAL    Likelihood = -6.69    Transmembrane     65-81   (53-95)
    INTEGRAL    Likelihood = -6.37    Transmembrane     34-50   (31-54)
    INTEGRAL    Likelihood = -6.10    Transmembrane    176-192  (169-195)
    INTEGRAL    Likelihood = -3.66    Transmembrane    130-146  (130-151)
    INTEGRAL    Likelihood = -1.97    Transmembrane      3-19   (3-19)
    INTEGRAL    Likelihood = -0.90    Transmembrane     88-104  (88-104)

----- Final Results -----
            bacterial membrane  --- Certainty = 0.3675(Affirmative) < succ>
             bacterial outside  --- Certainty = 0.0000(Not Clear)   < succ>
           bacterial cytoplasm  --- Certainty = 0.0000(Not Clear)   < succ>
```

A related GBS nucleic acid sequence <SEQ ID 9757> which encodes amino acid sequence <SEQ ID 9758> was also identified.

The protein has no significant homology with any sequences in the GENPEPT database.

No corresponding DNA sequence was identified in S. pyogenes.

A related GBS gene <SEQ ID 8809> and protein <SEQ ID 8810> were also identified. Analysis of this protein sequence reveals the following:

```
Lipop: Possible site: -1 Crend: 8
McG: Discrim Score: -4.09
GvH: Signal Score (-7.5): -4.38
     Possible site: 47
>>> Seems to have no N-terminal signal sequence
ALOM program count: 6 value: -6.69 threshold: 0.0
    INTEGRAL    Likelihood = -6.69    Transmembrane    65-81  (53-95)
    INTEGRAL    Likelihood = -6.37    Transmembrane    34-50  (31-54)
```

```
   INTEGRAL       Likelihood = -6.10    Transmembrane    176-192 (169-195)
   INTEGRAL       Likelihood = -3.66    Transmembrane    130-146 (130-151)
   INTEGRAL       Likelihood = -1.97    Transmembrane      3-19 (3-19)
   INTEGRAL       Likelihood = -0.90    Transmembrane     88-104 (88-104)
   PERIPHERAL     Likelihood =  5.30    158
modified ALOM score: 1.84
*** Reasoning Step: 3

----- Final Results -----
              bacterial membrane  --- Certainty = 0.3675(Affirmative) < succ>
              bacterial outside   --- Certainty = 0.0000(Not Clear)   < succ>
              bacterial cytoplasm --- Certainty = 0.0000(Not Clear)   < succ>
```

Based on this analysis, it was predicted that these proteins and their epitopes could be useful antigens for vaccines or diagnostics.

EXAMPLE 1441

A DNA sequence (GBSx1527) was identified in *S. agalactiae* <SEQ ID 4421> which encodes the amino acid sequence <SEQ ID 4422>. Analysis of this protein sequence reveals the following:

```
Possible site: 23
>>> Seems to have a cleavable N-term signal seq.

----- Final Results -----
              bacterial outside   --- Certainty = 0.3000(Affirmative) < succ>
              bacterial membrane  --- Certainty = 0.0000(Not Clear)   < succ>
              bacterial cytoplasm --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

A related GBS gene <SEQ ID 8811> and protein <SEQ ID 8812> were also identified. Analysis of this protein sequence reveals the following:

```
Lipop: Possible site: -1 Crend: 2
McG: Discrim Score: 6.01
GvH: Signal Score (-7.5): 0.45
     Possible site: 23
>>> Seems to have a cleavable N-term signal seq.
ALOM program count: 0 value: 10.66 threshold: 0.0
   PERIPHERAL Likelihood = 10.66 80
modified ALOM score: -2.63
*** Reasoning Step: 3

----- Final Results -----
              bacterial outside   --- Certainty = 0.3000(Affirmative) < succ>
              bacterial membrane  --- Certainty = 0.0000(Not Clear)   < succ>
              bacterial cytoplasm --- Certainty = 0.0000(Not Clear)   < succ>
```

SEQ ID 4422 (GBS19) was expressed in *E. coli* as a His-fusion product. SDS-PAGE analysis of total cell extract is shown in FIG. 4 (lane 4; MW 24 kDa). It was also expressed in *E. coli* as a GST-fusion product. SDS-PAGE analysis of total cell extract is shown in FIG. 9 (lane 6; MW 46.1 kDa).

The GST-fusion protein was purified as shown in FIG. 190, lane 10.

EXAMPLE 1442

A DNA sequence (GBSx1528) was identified in *S. agalactiae* <SEQ ID 4423> which encodes the amino acid sequence <SEQ ID 4424>. Analysis of this protein sequence reveals the following:

```
Possible site: 30
>>> Seems to have a cleavable N-term signal seq.

----- Final Results -----
              bacterial outside   --- Certainty = 0.3000(Affirmative) < succ>
```

```
                bacterial membrane --- Certainty = 0.0000(Not Clear) < succ>
                bacterial cytoplasm --- Certainty = 0.0000(Not Clear) < succ>
```

A related GBS nucleic acid sequence <SEQ ID 8813> which encodes amino acid sequence <SEQ ID 8814> was also identified. Analysis of this protein sequence reveals the following:

```
Lipop: Possible site: -1 Crend: 6
SRCFLG: 0
McG: Length of UR: 23
     Peak Value of UR: 2.61
     Net Charge of CR: 3
McG: Discrim Score: 9.08
GvH: Signal Score (-7.5): -0.76
     Possible site: 22
>>> Seems, to have a cleavable N-term signal seq.
Amino Acid Composition: calculated from 23
ALOM program count: 0 value: 5.14 threshold: 0.0
   PERIPHERAL Likelihood = 5.14 365
modified ALOM score: -1.53
*** Reasoning Step: 3
Rule gpo1

----- Final Results -----
                bacterial outside  --- Certainty = 0.3000(Affirmative) < succ>
                bacterial membrane --- Certainty = 0.0000(Not Clear)   < succ>
                bacterial cytoplasm --- Certainty = 0.0000(Not Clear)  < succ>
```

The protein has homology with the following sequences in the GENPEPT database.

```
>GP: CAA34476 GB: X16457 precursor polypeptide (AA -26 to 632)
[Staphylococcus aureus]
Identities = 93/372 (25%), Positives = 160/372 (43%), Gaps = 46/372 (12%)

Query:   9 MKKQFLKSAAILSLAVTAVSTSQPVGAIVGKDETKLRQQLGYIDSKKSGKKIDERWGEKI    68
           MKKQ +    A L++A + +      AIV KD +K    +   K G + + KI
Sbjct:   1 MKKQIISLGA-LAVASSLFTWDNKADAIVTKDYSK---ESRVNEKSKKGATVSDYYYWKI   56

Query:  69 YNYLSYELIEANEWINRSEFQEPEYRTILSEFKDKIDSIEYYLINLS----NIAKEDAHQ  124
           +L  +  A + +  ++ +P Y+         ++   + YL+        +  K+
Sbjct:  57 IDSLEAQFTGAIDLLENYKYGDPIYKEAKDRLMTRVLGEDQYLLKKKIDEYELYKKWYKS  116

Query: 125 RNILQSLDKYEKSGIYNLDQGVYNYIYQEISSAKHKFSDGVDKIYRLDSTLFPFSVWYDK  184
           N  ++ + K +YNL   YN I+ +  A ++F+  V +I    +  L   F
Sbjct: 117 SNKNTNMLTFHKYNLYNLTMNEYNDIFNSLKDAVYQFNKEVKEIEHKNVDLKQF------  170

Query: 185 HLDNNDNYKDNKDFKEYIALLNEITRKARLGYQIVNNHKD-GEHKDEAEI-LDILIRDIT  242
                  D   ++K   KE    L++EI     Y      KD GEH   E     LD+++ D
Sbjct: 171 -----DKDGEDKATKEVYDLVSEIDTLVVTYYA----DKDYGEHAKELRAKLDLILGDTD  221

Query: 243 FVSKDAPGYKYIPNKRIAAKIIEDLDGIINDFFKNTGKDKP-SLEKLKDTEFHKKYLNST  301
            K          I N+RI  ++I+DL+ II+DFF  T +++P S+ K    T+ + K +
Sbjct: 222 NPHK-------ITNERIKKEMIDDLNSIIDDFFMETKQNRPNSITKYDPTKHNFKERSEN  274

Query: 302 EPYSIETNLPSNYKELKEKQIKKLEYGYK-KSSKIY--TSAHYALYSEEIDAAKELLQKV  358
           +P    N    +E K K +K+ +  +K K+ K Y T       + EE    +  L KV
Sbjct: 275 KP-----NFDKLVEETK-KAVKEADESWKNKTVKKYEETVTKSPVVKEEKKVEEPQLPKV  328

Query: 359 KIAKDNYNEIKS                                                 370
             N    E+K+
Sbjct: 329 ----GNQQEVKT                                                 336
```

No corresponding DNA sequence was identified in *S. pyogenes*.

SEQ ID 8814 (GBS119) was expressed in *E. coli* as a His-fusion product. SDS-PAGE analysis of total cell extract is shown in FIG. 29 (lane 2; MW 84.3 kDa). It was also expressed in *E. coli* as a GST-fusion product. SDS-PAGE analysis of total cell extract is shown in FIG. 35 (lane 5; 2 bands).

The GBS119-GST fusion product was purified (FIG. 109A; see also FIG. 201, lane 6) and used to immunise mice (lane 1+2+3 product; 20 µg/mouse). The resulting antiserum was used for Western blot, FACS (FIG. 109B), and in the in vivo passive protection assay (Table III). These tests confirm that the protein is immunoaccessible on GBS bacteria and that it is an effective protective immunogen.

Based on this analysis, it was predicted that these proteins and their epitopes could be useful antigens for vaccines or diagnostics.

EXAMPLE 1443

A DNA sequence (GBSx1529) was identified in *S. agalactiae* <SEQ ID 4425> which encodes the amino acid sequence <SEQ ID 4426>. This protein is predicted to be s-adenosylmethionine synthetase (metK). Analysis of this protein sequence reveals the following:

```
Possible site: 41
>>> Seems to have no N-terminal signal sequence

----- Final Results -----
            bacterial cytoplasm --- Certainty = 0.3609(Affirmative) < succ>
            bacterial membrane  --- Certainty = 0.0000(Not Clear)   < succ>
             bacterial outside  --- Certainty = 0.0000(Not Clear)   < succ>
```

The protein has homology with the following sequences in the GENPEPT database.

```
>GP: BAB07019 GB: AP001518 S-adenosylmethionine synthetase
[Bacillus halodurans]
Identities = 266/390 (68%), Positives = 324/390 (82%), Gaps = 1/390 (0%)

Query:   4 RKLFTSESVSEGHPDKIADQISDAILDAILEQDPDAHVAAETAVYTGSVHVFGEISTTAY    63
           R+LFTSESV+EGHPDKI DQISD+ILD IL++DP+A VA ET+V TG V V GEI+T+ Y
Sbjct:   7 RRLFTSESVTEGHPDKICDQISDSILDEILKEDPNARVACETSVTTGLVLVAGEITTSTY   66

Query:  64 VDINRVVRNTIAEIGYDKAEYGFSAESVGVHPSLVEQSPDIAQGVNEALEVR-GSLEQDP  122
           VDI +VVR+TI  IGY +A+YGF +E+  V  S+ EQSPDIAQGVN+ALE R G +
Sbjct:  67 VDIPKVVRDTIRNIGYTRAKYGFDSETCAVLTSIDEQSPDIAQGVNQALEAREGQMTDAE  126

Query: 123 LDLIGAGDQGLMFGFAVDETPELMPLPISLAHQLVKKLTDLRKSGELTYLRPDAKSQVTV  182
           ++ IGAGDQGLMFG+A +ETPELMPLPISL+H+L ++L++ RK   L YLRPD K+QVTV
Sbjct: 127 IEAIGAGDQGLMFGYANNETPELMPLPISLSHKLARRLSEARKGEILPYLRPDGKTQVTV  186

Query: 183 EYDENDQPIRVDAVVISTQHDPNVTNDQLHKDVIEKVINEVIPSHYLDDQTKFFINPTGR  242
           EYDENDQ +R+D +VISTQH P VT +Q+  D+ + VI   V+P    +D++TK+FINPTGR
Sbjct: 187 EYDENDQSVRIDTIVISTQHHPEVTLEQIESDLKQHVIRSVVPEELIDEETKYFINPTGR  246

Query: 243 FVIGGPQGDSGLTGRKIIVDTYGGYSRHGGGAFSGKDATKVDRSASYAARYIAKNIVAAD  302
           FVIGGPQGD+GLTGRKIIVDTYGGY+RHGGGAFSGKD TKVDRS +YAARY+AKNIVAA
Sbjct: 247 FVIGGPQGDAGLTGRKIIVDTYGGYARHGGGAFSGKDPTKVDRSGAYAARYVAKNIVAAG  306

Query: 303 LAKKVEVQLAYAIGVAQPVSVRVDTFGTGVIAEADLEAAVRQIFDLRPAGIINMLDLKRP  362
           LA K EVQLAYAIGVA+PVS+ +DTFGTG ++EA L   VR+ FDLRPAGII MLDL+RP
Sbjct: 307 LADKCEVQLAYAIGVAKPVSISIDTFGTGQVSEARLVELVREHFDLRPAGIIKMLDLRRP  366

Query: 363 IYRQTAAYGHMGRTDIDLPWERVDKVQALK                                392
           IY+QTAAYGH GRTD++LPWE+ DK + L+
Sbjct: 367 IYKQTAAYGHFGRTDVELPWEQTDKAEILR                                396
```

45

A related DNA sequence was identified in *S. pyogenes* <SEQ ID 4427> which encodes the amino acid sequence <SEQ ID 4428>. Analysis of this protein sequence reveals the following:

```
Possible site: 43
>>> Seems to have no N-terminal signal sequence

----- Final Results -----
            bacterial cytoplasm --- Certainty = 0.3389(Affirmative) < succ>
            bacterial membrane  --- Certainty = 0.0000(Not Clear)   < succ>
             bacterial outside  --- Certainty = 0.0000(Not Clear)   < succ>
```

An alignment of the GAS and GBS proteins is shown below.

```
Identities = 333/395 (84%), Positives = 361/395 (91%), Gaps = 1/395 (0%)

Query:   1 MSERKLFTSESVSEGHPDKIADQISDAILDAILEQDPDAHVAAETAVYTGSVHVFGEIST   60
           MSERKLFTSESVSEGHPDKIADQISDAILDAIL +DP+AHVAAET VYTGSVHVFGEIST
Sbjct:   1 MSERKLFTSESVSEGHPDKIADQISDAILDAILAEDPEAHVAAETCVYTGSVHVFGEIST   60
```

-continued

```
Query:   61 TAYVDINRVVRNTIAEIGYDKAEYGFSAESVGVHPSLVEQSPDIAQGVNEALEVRGSLEQ  120
            TAY+DINRVVR+TIAEIGY +AEYGFSAESVGVHPSLVEQS DIAQGVNEA E R   +
Sbjct:   61 TAYIDINRVVRDTIAEIGYTEAEYGFSAESVGVHPSLVEQSGDIAQGVNEAFESREG-DT 119

Query:  121 DPLDLIGAGDQGLMFGFAVDETPELMPLPISLAHQLVKKLTDLRKSGELTYLRPDAKSQV 180
              D L  IGAGDQGLMFGFA++ETPELMPLPISL+HQLV++L +LRKSGE++YLRPDAKSQV
Sbjct:  120 DDLSHIGAGDQGLMFGFAINETPELMPLPISLSHQLVRRLAELRKSGEISYLRPDAKSQV 179

Query:  181 TVEYDENDQPIRVDAVVISTQHDPNVTNDQLHKDVIEKVINEVIPSHYLDDQTKFFINPT 240
            TVEYDE+D+P+RVD VVISTQHDP TNDQ+ +DVIEKVI  VIP+ YLDD TKFFINPT
Sbjct:  180 TVEYDEHDKPVRVDTVVISTQHDPEATNDQIRQDVIEKVIKAVIPADYLDDDTKFFINPT 239

Query:  241 GRFVIGGPQGDSGLTGRKIIVDTYGGYSRHGGGAFSGKDATKVDRSASYAARYIAKNIVA 300
            GRFVIGGPQGDSGLTGRKIIVDTYGGYSRHGGGAFSGKDATKVDRSASYAARYIAKN+VA
Sbjct:  240 GRFVIGGPQGDSGLTGRKIIVDTYGGYSRHGGGAFSGKDATKVDRSASYAARYIAKNLVA 299

Query:  301 ADLAKKVEVQLAYAIGVAQPVSVRVDTFGTGVIAEADLEAAVRQIFDLRPAGIINMLDLK 360
              A L  K EVQLAYAIGVAQPVSVRVDTFGT  + EA LEAAVRQ+FDLRPAGII MLDLK
Sbjct:  300 AGLVTKAEVQLAYAIGVAQPVSVRVDTFGTSTVPEAVLEAAVRQVFDLRPAGIIQMLDLK 359

Query:  361 RPIYRQTAAYGHMGRTDIDLPWERVDKVQALKDFI                          395
            RPIY+QTAAYGHMGRTDIDLPWER++KV AL + +
Sbjct:  360 RPIYKQTAAYGHMGRTDIDLPWERLNKVDALVEAV                          394
```

Based on this analysis, it was predicted that these proteins and their epitopes could be useful antigens for vaccines or diagnostics.

EXAMPLE 1444

A DNA sequence (GBSx1530) was identified in *S. agalactiae* <SEQ ID 4429> which encodes the amino acid sequence <SEQ ID 4430>. This protein is predicted to be a transcriptional repressor of the biotin operon. Analysis of this protein sequence reveals the following:

```
Possible site: 24
>>> Seems to have no N-terminal signal sequence
    INTEGRAL     Likelihood = -0.16    Transmembrane    188-204 (188-204)

----- Final Results -----
              bacterial membrane --- Certainty = 0.1065(Affirmative) < succ>
               bacterial outside --- Certainty = 0.0000(Not Clear)   < succ>
              bacterial cytoplasm --- Certainty = 0.0000(Not Clear)   < succ>
```

A related GBS nucleic acid sequence <SEQ ID 9755> which encodes amino acid sequence <SEQ ID 9756> was also identified.

The protein has homology with the following sequences in the GENPEPT database.

```
>GP: BAB05404 GB: AP001512 transcriptional repressor of the biotin
operon [Bacillus halodurans]
Identities = 102/315 (32%), Positives = 169/315 (53%), Gaps = 18/315 (5%)

Query:   10 ILSKNNNFISGETMANQLNISRTAIWKGIKTLEELGLEIESVTNKGYRLVSG-DILLPEQ  68
            +L+  ++F+SGE ++   +  SRTA+WK I+ L + G E+E+V  KGYR+V   D + P
Sbjct:    9 LLTAGDDFVSGEKISQAIGCSRTAVWKHIEELRKSGYEVEAVQRKGYRIVKRPDQIKPHD  68

Query:   69 LE-----QEIGIKVSLNNNSASTQLDAKMGIESKLKTPHLFLAPNQKKAKGRFDRPFFTS 123
            ++         +  G +++   ++ASTQ  A     +  K H+ LA Q     KGR R +++
Sbjct:   69 IQVVLETERFGREITYLESTASTQTVALKLAQEGAKEGHIVLANEQTSGKGRMGRGWYSP 128

Query:  124 NQGGIYMSLLLQPNVPIEDIKPYTVMVASSAVKAISRLTGITPEIKWVNDIYLDNKKIAG 183
                I MS++ +P +P +     T++ A + V+AI  TG+  +IKW ND+ +D KKI G
Sbjct:  129 PGSSISMSIIFRPQLPPQKAPQLTLLTAVAIVRAIKETTGLDSDIKWPNDLLIDGKKIVG 188

Query:  184 ILTEAIASVESGLVTNVIIGLGINFYIKE--FPRALTKRAGSLFTEQ-PTITRNQLITEI 240
            ILTE  A  +S V +VI G+GIN    +E    F   + K A SL ++      I R LI  I
Sbjct:  189 ILTEMQADQDS--VHSVIQGIGINVNHQEEAFAEEIRKIATSLAIKKGEPIQRAPLIAAI 246
```

```
-continued
Query:  241 W---NLFFNIPLEDHLK----VYREKSLVLDRTVSFMDGQTMYSGKAIDITDKGYLVVEL  293
            LF+++ L+         ++   ++ + + +        +  G A  ITD G L++E
Sbjct:  247 LKNIELFYDLYLQHGFSRIKPLWEAHAISIGKRIRARMLNDVKFGVAKGITDDGVLLLED  306

Query:  294 DDGQLKTLRSGEISL  308
            DDG+L ++ S +I +
Sbjct:  307 DDGKLHSIYSADIEI  321
```

A related DNA sequence was identified in *S. pyogenes* 10 <SEQ ID 4431> which encodes the amino acid sequence <SEQ ID 4432>. Analysis of this protein sequence reveals the following:

```
Possible site: 34
>>> Seems to have no N-terminal signal sequence
    INTEGRAL    Likelihood = -1.49   Transmembrane   194-210 (194-211)

----- Final Results -----
            bacterial membrane  --- Certainty = 0.1595(Affirmative) < succ>
             bacterial outside  --- Certainty = 0.0000(Not Clear)   < succ>
           bacterial cytoplasm  --- Certainty = 0.0000(Not Clear)   < succ>
```

The protein has homology with the following sequences in the databases:

```
>GP: BAB05404 GB: AP001512 transcriptional repressor of the biotin
operon [Bacillus halodurans]
Identities = 98/315 (31%), Positives = 165/315 (52%), Gaps = 18/315 (5%)

Query:   10 LLSQTDDFVSGEYLADQLSISRTSVWKSIKSLENQGIQIDSLKHKGYRMVQG-DILLPKT   68
            LL+  DDFVSGE ++  +   SRT+VWK I+ L   G ++++++ KGYR+V+  D + P
Sbjct:    9 LLTAGDDFVSGEKISQAIGCSRTAVWKHIEELRKSGYEVEAVQRKGYRIVKRPDQIKPHD   68

Query:   69 I-----SQGLGMPVTYTPHSQSTQLDAKQGIEAHNSAPRLYLAPSQEAAKGRLDRQFFSA  123
            I     ++  G  +TY   + STQ  A +   +     + LA  Q + KGR+ R  ++S
Sbjct:   69 IQVVLETERFGREITYLESTASTQTVALKLAQEGAKEGHIVLANEQTSGKGRMGRGWYSP  128

Query:  124 STGGIYMSMYLKPNVPYADMPPYTMMVASSIVKAISRLTGIDTEIKWVNDIYLGNMKVAG  183
                I MS+  +P  +P        P  T++ A +IV+AI   TG+D++IKW ND+ +    K+ G
Sbjct:  129 PGSSISMSIIFRPQLPPQKAPQLTLLTAVAIVRAIKETTGLDSDIKWPNDLLIDGKKIVG  188

Query:  184 ILTEAITSVETGLITDVIIGVGLNFFVTD--FPEAIAQKAGSLFTEK-PTITRNDLIIDI  240
            ILTE     +  +  VI G+G+N   +   F E I+ A SL  +K   I  R  LI  I
Sbjct:  189 ILTE--MQADQDSVHSVIQGIGINVNHQEEAFAEEIRKIATSLAIKKGEPIQRAPLIAAI  246

Query:  241 WK-------LFLSIPVKDHVKVYKEKSLVLNKQVTFIENSQEKRAIAIDLTDQGHLIVQF  293
            K         L+L           +++  ++ + K++      +   K  +A  +TD G L+++
Sbjct:  247 LKNIELFYDLYLQHGFSRIKPLWEAHAISIGKRIRARMLNDVKFGVAKGITDDGVLLLED  306

Query:  294 ENGDLQTLRSGEISL  308
            ++G L ++ S +I +
Sbjct:  307 DDGKLHSIYSADIEI  321
```

An alignment of the GAS and GBS proteins is shown below.

```
Identities = 191/311 (61%), Positives = 257/311 (82%)

Query:    1 MKTYEKIYQILSKNNNFISGETMANQLNISRTAIWKGIKTLEELGLEIESVTNKGYRLVS   60
            MKT EKIYQ+LS+ ++F+SGE +A+QL+ISRT++WK IK+LE  G++I+S+ +KGYR+V
Sbjct:    1 MKTSEKIYQLLSQTDDFVSGEYLADQLSISRTSVWKSIKSLENQGIQIDSLKHKGYRMVQ   60

Query:   61 GDILLPEQLEQEIGIKVSLNNNSASTQLDAKMGIESKLKTPHLFLAPNQKKAKGRFDRPF  120
            GDILLP+ + Q +G+ V+    +S STQLDAK GIE+    P L+LAP+Q+ AKGR DR F
Sbjct:   61 GDILLPKTISQGLGMPVTYTPHSQSTQLDAKQGIEAHNSAPRLYLAPSQEAAKGRLDRQF  120

Query:  121 FTSNQGGIYMSLLLQPNVPIEDIKPYTVMVASSAVKAISRLTGITPEIKWVNDIYLDNKK  180
            F+++ GGIYMS+ L+PNVP  D+ PYT+MVASS VKAISRLTGI  EIKWVNDIYL N K
Sbjct:  121 FSASTGGIYMSMYLKPNVPYADMPPYTMMVASSIVKAISRLTGIDTEIKWVNDIYLGNHK  180
```

-continued

```
Query: 181 IAGILTEAIASVESGLVTNVIIGLGINFYIKEFPRALTKRAGSLFTEQPTITRNQLITEI 240
           +AGILTEAI SVE+GL+T+VIIG+G+NF++ +FP A+ ++AGSLFTE+PTITRN LI +I
Sbjct: 181 VAGILTEAITSVETGLITDVIIGVGLNFFVTDFPEAIAQKAGSLFTEKPTITRNDLIIDI 240

Query: 241 WNLFFNIPLEDHLKVYREKSLVLDRTVSFMDGQTMYSGKAIDITDKGYLVVELDDGQLKT 300
           W LF +IP++DH+KVY+EKSLVL++ V+F++          AID+TD+G+L+V+ ++G L+T
Sbjct: 241 WKLFLSIPVKDHVKVYKEKSLVLNKQVTFIENSQEKRAIAIDLTDQGHLIVQFENGDLQT 300

Query: 301 LRSGEISLSSW                                                  311
           LRSGEISLSSW
Sbjct: 301 LRSGEISLSSW                                                  311
```

Based on this analysis, it was predicted that these proteins and their epitopes could be useful antigens for vaccines or diagnostics.

EXAMPLE 1445

A DNA sequence (GBSx1531) was identified in *S. agalactiae* <SEQ ID 4433> which encodes the amino acid sequence <SEQ ID 4434>. Analysis of this protein sequence reveals the following:

```
Possible site: 15
>>> Seems to have an uncleavable N-term signal seq
        INTEGRAL      Likelihood = -2.76       Transmembrane      3-19 (3-20)

----- Final Results -----
              bacterial membrane --- Certainty = 0.2105(Affirmative) < succ>
               bacterial outside --- Certainty = 0.0000(Not Clear)   < succ>
             bacterial cytoplasm --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1446

A DNA sequence (GBSx1532) was identified in *S. agalactiae* <SEQ ID 4435> which encodes the amino acid sequence <SEQ ID 4436>. Analysis of this protein sequence reveals the following:

```
Possible site: 19
>>> Seems to have a cleavable N-term signal seq.
        INTEGRAL      Likelihood = -2.28       Transmembrane      24-40 (24-40)

----- Final Results -----
              bacterial membrane --- Certainty = 0.1914(Affirmative) < succ>
               bacterial outside --- Certainty = 0.0000(Not Clear)   < succ>
             bacterial cytoplasm --- Certainty = 0.0000(Not Clear)   < succ>
```

The protein has no significant homology with any sequences in the GENPEPT database.

A related DNA sequence was identified in *S. pyogenes* <SEQ ID 4437> which encodes the amino acid sequence <SEQ ID 4438>. Analysis of this protein sequence reveals the following:

```
Possible site: 49
>>> Seems to have a cleavable N-term signal seq.
        INTEGRAL      Likelihood = -1.91       Transmembrane      58-74 (58-75)

----- Final Results -----
              bacterial membrane --- Certainty = 0.1765(Affirmative) < succ>
               bacterial outside --- Certainty = 0.0000(Not Clear)   < succ>
             bacterial cytoplasm --- Certainty = 0.0000(Not Clear)   < succ>
```

An alignment of the GAS and GBS proteins is shown below.

```
Identities = 37/67 (55%), Positives = 54/67 (80%), Gaps = 3/67 (4%)

Query: 1 MTKRQFIFMALLCSFETYFFNQSVMDGSWIFAIFWGVLLLRDLQKVYAISKFTKELIK--  58
         MT RQF+FMA +C+FETYFFN  ++ G+++FA+FWG+LL RDL++V+ I++ TK ++K
```

```
                            -continued
Sbjct:  36 MTIRQFLFMAFVCAFETYFFNDLLLSGNYLFALFWGLLLFRDLRRVHTINQLTKTILKTA   95

Query:  59 -STKKKD                                                         64
           S KKKD
Sbjct:  96 NSPKKKD                                                        102
```

Based on this analysis, it was predicted that these proteins and their epitopes could be useful antigens for vaccines or diagnostics.

EXAMPLE 1447

A DNA sequence (GBSx1533) was identified in S. agalactiae <SEQ ID 4439> which encodes the amino acid sequence <SEQ ID 4440>. This protein is predicted to be DNA polymerase III, gamma subunit (dnaZX). Analysis of this protein sequence reveals the following:

```
Possible site: 60
>>> Seems to have no N-terminal signal sequence

----- Final Results -----
              bacterial cytoplasm --- Certainty = 0.1567(Affirmative) < succ>
               bacterial membrane --- Certainty = 0.0000(Not Clear)   < succ>
                bacterial outside --- Certainty = 0.0000(Not Clear)   < succ>
```

A related DNA sequence was identified in S. pyogenes <SEQ ID 4441> which encodes the amino acid sequence <SEQ ID 4442>. Analysis of this protein sequence reveals the following:

```
Possible site: 60
>>> Seems to have no N-terminal signal sequence
     INTEGRAL      Likelihood = -0.59     Transmembrane    232-248 (232-249)

----- Final Results -----
               bacterial membrane --- Certainty = 0.1235(Affirmative) < succ>
                bacterial outside --- Certainty = 0.0000(Not Clear)   < succ>
              bacterial cytoplasm --- Certainty = 0.0000(Not Clear)   < succ>
```

An alignment of the GAS and GBS proteins is shown below.

```
Identities = 408/558 (73%), Positives = 473/558 (84%), Gaps = 6/558 (1%)

Query:    1 MYQALYRKYRSQTFDEMVGQSVISTTLKQAVSSKKISHAYLFSGPRGTGKTSAAKIFAKA   60
            MYQALYRKYRSQTFDEMVGQSVISTTLKQAV S KISHAYLFSGPRGTGKTSAAKIFAKA
Sbjct:    1 MYQALYRKYRSQTFDEMVGQSVISTTLKQAVESGKISHAYLFSGPRGTGKTSAAKIFAKA   60

Query:   61 MNCPNQINGEPCNHCDICRDITNGSLEDVIEIDAASNNGVDEIRDIRDKSTYAPSRATYK  120
            MNCPNQ++GEPCN CDICRDITNGSLEDVIEIDAASNNGVDEIRDIRDKSTYAPSRATYK
Sbjct:   61 MNCPNQVDGEPCNQCDICRDITNGSLEDVIEIDAASNNGVDEIRDIRDKSTYAPSRATYK  120

Query:  121 VYIIDEVHMLSTGAFNALLKTLEEPTENVVFILATTELHKIPATILSRVQRFEFKAIKLL  180
            VYIIDEVHMLSTGAFNALLKTLEEPTENVVFILATTELHKIPATILSRVQRFEFKAIK
Sbjct:  121 VYIIDEVHMLSTGAFNALLKTLEEPTENVVFILATTELHKIPATILSRVQRFEFKAIKQK  180

Query:  181 AIRDHLAQILDKEAISYDLDALTLVARRAEGGMRDALSILDQALSLAKDNHISLDVAEEI  240
            AIR+HLA +LDKE I+Y++DAL L+ARRAEGGMRDALSILDQALSL+ DN +++ +AEEI
Sbjct:  181 AIREHLAWVLDKEGIAYEVDALNLIARRAEGGMRDALSILDQALSLSPDNQVAIAIAEEI  240

Query:  241 TGSISLSAIDDYVSNILAHDTTEALAKLEVIFDSGKSMSRFATDLLMYLRDLLVVQAGGE  300
            TGSIS+ A+ DYV +      T+ALA LE I+DSGKSMSRFATDLL YLRDLLVV+AGG+
Sbjct:  241 TGSISILALGDYVRYVSQEQATQALAALETIYDSGKSMSRFATDLLTYLRDLLVVKAGGD  300

Query:  301 DSHSSDTFIANLNVKQDILFEMIDKVTSVLPEIKNGSHPKVYAEMMTIQLSEMVEKNSS-  359
              +  S  F   NL++  D +F+MI   VTS LPEIK G+HP++YAEMMTIQL++   S
Sbjct:  301 NQRQSAVFDTNLSLSIDRIFQMITVVTSHLPEIKKGTHPRIYAEMMTIQLAQKEQILSQV  360

Query:  360 NIPADVTAELDSLRRELKSLKNEMSQL-SRADQSSSTQKVKVNNKTFTFKVDRTKILTIM  418
            N+  ++ +E+++L+ EL  LK ++SQL SR D  + K  KT +++VDR   IL IM
```

-continued

```
Sbjct: 361 NLSGELISEIETLKNELAQLKQQLSQLQSRPDSLARSDKTK--PKTTSYRVDRVTILKIM  418

Query: 419 EETVVDSQRSREYLEALKSAWNEILDNITAQDRALLMGSEPVLANSENAILAFDAAFNAE  478
           EETV +SQ+SR+YL+ALK+AWNEILDNI+AQDRALLMGSEPVLANSENAILAF+AAFNAE
Sbjct: 419 EETVRNSQQSRQYLDALKNAWNEILDNISAQDRALLMGSEPVLANSENAILAFEAAFNAE  478

Query: 479 QAMKRTDLNDIFGNIMSKAAGFSPNILAVPRNDFNQIRSDFAKKMKAQK--TETEPEVNH  536
           Q M R +LND+FGNIMSKAAGFSPNILAVPR DF  IR +FA++MK+QK    + E EV
Sbjct: 479 QVMSRNNLNDMFGNIMSKAAGFSPNILAVPRTDFQHIRKEFAQQMKSQKDSVQEEQEVAL  538

Query: 537 QIPEDFSYLAERIAIVED                                            554
           IPE F +L ++I  ++D
Sbjct: 539 DIPEGFDFLLDKINTIDD                                            556
```

Based on this analysis, it was predicted that these proteins and their epitopes could be useful antigens for vaccines or diagnostics.

EXAMPLE 1448

A DNA sequence (GBSx1534) was identified in *S. agalactiae* <SEQ ID 4443> which encodes the amino acid sequence <SEQ ID 4444>. Analysis of this protein sequence reveals the following:

```
Possible site: 40
>>> Seems to have no N-terminal signal sequence (or aa 1-19)

----- Final Results -----
            bacterial membrane --- Certainty = 0.0000(Not Clear) < succ>
            bacterial outside  --- Certainty = 0.0000(Not Clear) < succ>
            bacterial cytoplasm --- Certainty = 0.0000(Not Clear) < succ>
```

The protein has homology with the following sequences in the GENPEPT database.

```
>GP: BAB06927 GB: AP001518 unknown conserved protein [Bacillus halodurans]
Identities = 67/143 (46%), Positives = 96/143 (66%)

Query:   8 ENYQLLLLQAQALFSDETNALANLSNASAMLNAMLPNSVFTGFYLFDGEELILGPFQGGV   67
           E Y L+  Q  AL   E++A+ANL+NASA+L     + GFYL    EL+LGPFQG
Sbjct:  13 EKYSLVTKQLAALLEGESDAIANLANASALLYHFLEEVNWVGFYLIKEGELVLGPFQGLP   72

Query:  68 SCVHITLGKGVCGESAQTAKTLIVDDVTKHANYISCDSKAMSEIVVPMFKNGKLLGVLDL  127
           +CV I +G+GVCG +A+  +T+ V+DV +   +I+CD+ + SEIV+P+F+NG L GVLD+
Sbjct:  73 ACVRIPIGRGVCGTAAKEEQTVRVEDVHQFPGHIACDAASRSEIVIPLFQNGVLYGVLDI  132

Query: 128 DSSLVADYDEIDQEYLEKFVGIL                                      150
           DS  +  + E +Q  LE FV +L
Sbjct: 133 DSPSLNRFSEEEQALLESFVDVL                                      155
```

A related DNA sequence was identified in *S. pyogenes* <SEQ ID 4445> which encodes the amino acid sequence <SEQ ID 4446>. Analysis of this protein sequence reveals the following:

```
Possible site: 27
>>> Seems to have no N-terminal signal sequence

----- Final Results -----
            bacterial cytoplasm --- Certainty = 0.1753(Affirmative) < succ>
            bacterial membrane  --- Certainty = 0.0000(Not Clear)   < succ>
            bacterial outside   --- Certainty = 0.0000(Not Clear)   < succ>
```

An alignment of the GAS and GBS proteins is shown below.

```
Identities = 122/164 (74%), Positives = 144/164 (87%)

Query:   1 MNKSKKIENYQLLLLQAQALFSDETNALANLSNASAMLNAMLPNSVFTGFYLFDGEELIL   60
           MNKSKKIE YQL++  QA+ LF++E+NALANLSNASA+LN   LPNSVFTGFYLFDG+ELIL
Sbjct:   1 MNKSKKIEQYQLMIAQAKELFANESNALANLSNASALLNMTLPNSVFTGFYLFDGQELIL   60
```

```
Query:   61 GPFQGGVSCVHITLGKGVCGESAQTAKTLIVDDVTKHANYISCDSKAMSEIVVPMFKNGK  120
            GPFQG VSCVHI LGKGVCGESAQ+ +T+I++DV +HANYISCD+ AMSEIVVPM K G
Sbjct:   61 GPFQGRVSCVHIKLGKGVCGESAQSRRTIIINDVKQHANYISCDAAAMSEIVVPMVKEGH 120

Query:  121 LLGVLDLDSSLVADYDEIDQEYLEKFVGILVEHTIWNLDMFGVE                 164
            L+GVLDLDSSLVADYDE+DQEYLE FV + +E T +  +MFGV+
Sbjct:  121 LIGVLDLDSSLVADYDEVDQEYLEAFVDLFLEKTTFTFNMFGVK                 164
```

SEQ ID 4444 (GBS282) was expressed in *E. coli* as a His-fusion product. SDS-PAGE analysis of total cell extract is shown in FIG. 52 (lane 9; MW 19.8 kDa). It was also expressed in *E. coli* as a GST-fusion product. SDS-PAGE analysis of total cell extract is shown in FIG. 60 (lane 6; MW 44.8 kDa) and in FIG. 63 (lane 7; MW 47 kDa).

Figure 269:
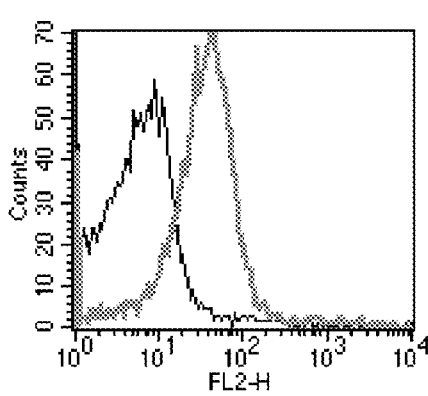

The GBS282-GST fusion product was purified (FIG. 211, lane 4; see also FIG. 225, lane 6) and used to immunise mice. The resulting antiserum was used for FACS (FIG. 269), which confirmed that the protein is immunoaccessible on GBS bacteria.

Based on this analysis, it was predicted that these proteins and their epitopes could be useful antigens for vaccines or diagnostics.

EXAMPLE 1449

A DNA sequence (GBSx1535) was identified in *S. agalactiae* <SEQ ID 4447> which encodes the amino acid sequence <SEQ ID 4448>. This protein is predicted to be uridine kinase (udk). Analysis of this protein sequence reveals the following:

```
Possible site: 24
>>> Seems to have an uncleavable N-term signal seq

----- Final Results -----
                bacterial membrane --- Certainty = 0.0000(Not Clear) < succ>
                bacterial outside  --- Certainty = 0.0000(Not Clear) < succ>
                bacterial cytoplasm --- Certainty = 0.0000(Not Clear) < succ>
```

The protein has homology with the following sequences in the GENPEPT database.

```
>GP: CAB14675 GB: Z99117 uridine kinase [Bacillus subtilis]
Identities = 133/207 (64%), Positives = 167/207 (80%)

Query:    1 MRKKPIIIGVTGGSGGGKTSVSRAILSNFPDQKITMIEHDSYYKDQSHLTFEERVKTNYD  60
            M K P++IG+ GGSG GKTSV+R+I    F    I MI+ D YYKDQSHL FEER+ TNYD
Sbjct:    1 MGKNPVVIGIAGGSGSGKTSVTRSIYEQFKGHSILMIQQDLYYKDQSHLPFEERLNTNYD  60

Query:   61 HPLAFDTNLMIEQLNELIEGRPVDIPVYDYTKHTRSDRTIRQEPQDVIIVEGILVLEDQR 120
            HPLAFD + +IE + +L+ RP++ P+YDY  HTRS+ T+   EP+DVII+EGILVLED+R
Sbjct:   61 HPLAFDNDYLIEHIQDLLNYRPIEKPIYDYKLHTRSEETVHVEPKDVIILEGILVLEDKR 120

Query:  121 LRDLMDIKLFVDTDDDIRIIRRIKRDMEERDRSLDSIIEQYTEVVKPMYHQFIEPTKRYA 180
            LRDLMDIKL+VDTD D+RIIRRI RD+ ER RS+DS+IEQY  VV+PM++QF+EPTKRYA
Sbjct:  121 LRDLMDIKLYVDTDADLRIIRRIMRDINERGRSIDSVIEQYVSVVRPMHNQFVEPTKRYA 180

Query:  181 DIVIPEGVSNIVAIDLINTKVASILNE                                  207
            DI+IPEG  N VAIDL+ TK+ +IL +
Sbjct:  181 DIIIPEGGQNHVAIDLMVTKIQTILEQ                                  207
```

A related DNA sequence was identified in *S. pyogenes* <SEQ ID 4449> which encodes the amino acid sequence <SEQ ID 4450>. Analysis of this protein sequence reveals the following:

```
Possible site: 39
>>> Seems to have an uncleavable N-term signal seq

----- Final Results -----
                bacterial membrane --- Certainty = 0.0000(Not Clear) < succ>
                bacterial outside  --- Certainty = 0.0000(Not Clear) < succ>
                bacterial cytoplasm --- Certainty = 0.0000(Not Clear) < succ>
```

A related sequence was also identified in GAS <SEQ ID 9151> which encodes the amino acid sequence <SEQ ID 9152>. Analysis of this protein sequence reveals the following:

```
Possible site: 35
>>> Seems to have an uncleavable N-term signal seq

----- Final Results -----
            bacterial membrane --- Certainty = 0.0000(Not Clear) < succ>
             bacterial outside --- Certainty = 0.0000(Not Clear) < succ>
            bacterial cytoplasm --- Certainty = 0.0000(Not Clear) < succ>
```

An alignment of the GAS and GBS proteins is shown below.

```
Identities = 173/207 (83%), Positives = 193/207 (92%)

Query:    1 MRKKPIIIGVTGGSGGGKTSVSRAILSNFPDQKITMIEHDSYYKDQSHLTFEERVKTNYD   60
            M KKPIIIGVTGGSGGGKTSVSRAIL +FP+ +I MI+HDSYYKDQSH++FEERVKTNYD
Sbjct:    5 MLKKPIIIGVTGGSGGGKTSVSRAILDSFPNARIAMIQHDSYYKDQSHMSFEERVKTNYD   64

Query:   61 HPLAFDTNLMIEQLNELIEGRPVDIPVYDYTKHTRSDRTIRQEPQDVIIVEGILVLEDQR  120
            HPLAFDT+ MI+QL EL+ GRPVDIP+YDY KHTRS+ T RQ+PQDVIIVEGILVLED+R
Sbjct:   65 HPLAFDTDFMIQQLKELLAGRPVDIPIYDYKKHTRSNTTFRQDPQDVIIVEGILVLEDER  124

Query:  121 LRDLMDIKLFVDTDDDIRIIRRIKRDMEERDRSLDSIIEQYTEVVKPMYHQFIEPTKRYA  180
            LRDLMDIKLFVDTDDDIRIIRRIKRDM ER RSL+SII+QYT VVKPMYHQFIEP+KRYA
Sbjct:  125 LRDLMDIKLFVDTDDDIRIIRRIKRDMMERGRSLESIIDQYTSVVKPMYHQFIEPSKRYA  184

Query:  181 DIVIPEGVSNIVAIDLINTKVASILNE                                  207
            DIVIPEGVSN+VAID+IN+K+ASIL E
Sbjct:  185 DIVIPEGVSNVVAIDVINSKIASILGE                                  211
```

Based on this analysis, it was predicted that these proteins and their epitopes could be useful antigens for vaccines or diagnostics.

EXAMPLE 1450

A DNA sequence (GBSx1536) was identified in *S. agalactiae* <SEQ ID 4451> which encodes the amino acid sequence <SEQ ID 4452>. Analysis of this protein sequence reveals the following:

```
Possible site: 51
>>> Seems to have no N-terminal signal sequence

----- Final Results -----
            bacterial cytoplasm --- Certainty = 0.5083(Affirmative) < succ>
             bacterial membrane --- Certainty = 0.0000(Not Clear)   < succ>
              bacterial outside --- Certainty = 0.0000(Not Clear)   < succ>
```

The protein has homology with the following sequences in the GENPEPT database.

```
>GP: CAB12572 GB: Z99108 similar to RNA helicase [Bacillus subtilis]
Identities = 140/343 (40%), Positives = 202/343 (58%), Gaps = 9/343 (2%)

Query:   10 QDKLTQRQFDDLTDIQNKLFQPITDGDNILGISPTGTGKTLAYLFPTLLKLQPK-KSQQL   68
            Q+      F   T +Q +  Q I DG +++  SPTGTGKTLAY  P L +++P+ K  Q
Sbjct:   16 QENWNASGFQKPTPVQEQAAQLIMDGKDVIAESPTGTGKTLAYALPVLERIKPEQKHPQA   75

Query:   69 LILAPNSELAGQIFDVTKEWAEPLGLTAQLFLSGSSQKRQIERLKKGPEILIGTAGRVFE  128
            +ILAP+ EL  QIF V ++W     L A  + G++ K+Q+E+LKK P I++GT GRVFE
Sbjct:   76 VILAPSRELVMQIFQVIQDWKAGSELRAASLIGGANVKKQVEKLKKHPHIIVGTPGRVFE  135

Query:  129 LVKLKKIKMMNINTIVLDEFDELLGDSQYHFVDNIINRVPRDQQMIYISATNKLDNS---  185
            L+K KK+KM   + TIVLDE D+L+         + II   RD+Q++  SAT K +
Sbjct:  136 LIKAKKLKMHEVKTIVLDETDQLVLPEHRETMKQIIKTTLRDRQLLCFSATLKKETEDVL  195
```

-continued

```
Query:  186 -KLADNTITIDLSNQKLDT--IKHYYITVDKRERTDLLRKFSNIPDFRGLVFFNSLSDLG  242
             +LA    + +    K +   +KH Y+  D+R++  LL+K S +    + LVF    + +L
Sbjct:  196 RELAQEPEVLKVQRSKAEAGKVKHQYLICDQRDKVKLLQKLSRLEGMQALVFVRDIGNLS  255

Query:  243 ACEERLQFNRASAVSLASDINIKFRKVILEKFKNHDISLLLGTDLVARGIDIDNLEYVIN  302
             E+L ++      L S+     R  I+  F++ +  LLL TD+ ARG+DI+NL YVI+
Sbjct:  256 VYAEKLAYHHVELGVLHSEAKKMERAKIIATFEDGEFPLLLATDIAARGLDIENLPYVIH  315

Query:  303 FDIARDKETYTHRSGRTGRMGKEGCVITFVTHKEELKQLKKYA  345
             DI   D++ Y HRSGRTGR GKEG V++ VT   EE K LKK A
Sbjct:  316 ADIP-DEDGYVHRSGRTGRAGKEGNVLSLVTKLEESK-LKKMA  356
```

A related DNA sequence was identified in *S. pyogenes* <SEQ ID 4453> which encodes the amino acid sequence <SEQ ID 4454>. Analysis of this protein sequence reveals the following:

```
Possible site: 39
>>> Seems to have no N-terminal signal sequence

----- Final Results -----
              bacterial cytoplasm --- Certainty = 0.3847(Affirmative) < succ>
              bacterial membrane  --- Certainty = 0.0000(Not Clear)  < succ>
              bacterial outside   --- Certainty = 0.0000(Not Clear)  < succ>
```

An alignment of the GAS and GBS proteins is shown below.

```
Identities = 273/358 (76%), Positives = 312/358 (86%)

Query:    1 MITKFPDQWQDKLTQRQFDDLTDIQNKLFQPITDGDNILGISPTGTGKTLAYLFPTLLKL   60
            MITKFP QWQ+KL Q  F  LT IQ +  FQPI DG N LGISPTGTGKTLAY+FP LL L
Sbjct:   12 MITKFPPQWQEKLDQVAFTHLTPIQEQAFQPIVDGKNFLGISPTGTGKTLAYVFPNLLAL   71

Query:   61 QPKKSQQLLILAPNSELAGQIFDVTKEWAEPLGLTAQLFLSGSSQKRQIERLKKGPEILI  120
            PKKSQQLLILAPN+ELAGQIF+VTK+WA+PLGLTAQLF+SG+SQKRQIERLKKGPEILI
Sbjct:   72 TPKKSQQLLILAPNTELAGQIFEVTKDWAQPLGLTAQLFISGTSQKRQIERLKKGPEILI  131

Query:  121 GTAGRVFELVKLKKIKMMNINTIVLDEFDELLGDSQYHFVDNIINRVPRDQQMIYISATN  180
            GT GR+FEL+KLKKIKMM++NTIVLDE+DELLGDSQY FV   I + VPRD QM+Y+SATN
Sbjct:  132 GTPGRIFELIKLKKIKMMSVNTIVLDEYDELLGDSQYDFVQKISHYVPRDHQMVYMSATN  191

Query:  181 KLDNSKLADNTITIDLSNQKLDTIKHYYITVDKRERTDLLRKFSNIPDFRGLVFFNSLSD  240
            K+D + LA NT  IDLS Q  D I+H+Y+ VDKRERTDLLRKF+NIP FR LVFFNSLSD
Sbjct:  192 KVDQTSLAPNTFCIDLSEQTNDAIQHFYLMVDKRERTDLLRKFTNIPHFRALVFFNSLSD  251

Query:  241 LGACEERLQFNRASAVSLASDINIKFRKVILEKFKNHDISLLLGTDLVARGIDIDNLEYV  300
            LGA EERLQ+N A+AVSLASDIN+KFRK ILEKFK+H +SLLL TDLVARGIDIDNL+YV
Sbjct:  252 LGATEERLQYNGAAAVSLASDINVKFRKTILEKFKSHQLSLLLATDLVARGIDIDNLDYV  311

Query:  301 INFDIARDKETYTHRSGRTGRMGKEGCVITFVTHKEELKQLKKYATVTELVLHNQKLH  358
            I+FD+ARDKE YTHR+GRTGRMGK G VITFV+H E+LK+LKK+A V+E+ L NQ+LH
Sbjct:  312 IHFDVARDKENYTHRAGRTGRMGKSGIVITFVSHPEDLKKLKKFAKVSEISLKNQQLH  369
```

Based on this analysis, it was predicted that these proteins and their epitopes could be useful antigens for vaccines or diagnostics.

EXAMPLE 1451

A DNA sequence (GBSx1537) was identified in *S. agalactiae* <SEQ ID 4455> which encodes the amino acid sequence <SEQ ID 4456>. Analysis of this protein sequence reveals the following:

```
Possible site: 25
>>> Seems to have an uncleavable N-term signal seq
INTEGRAL Likelihood = -1.38 Transmembrane 15-31 (13-31)

----- Final Results -----
              bacterial membrane --- Certainty = 0.1553 (Affirmative) < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1452

A DNA sequence (GBSx1538) was identified in *S. agalactiae* <SEQ ID 4457> which encodes the amino acid sequence <SEQ ID 4458>. This protein is predicted to be peptidoglycan GlcNAc deacetylase. Analysis of this protein sequence reveals the following:

```
Possible site: 28
>>> Seems to have an uncleavable N-term signal seq
INTEGRAL Likelihood = -8.92 Transmembrane 4-20 (1-26)

----- Final Results -----
          bacterial membrane --- Certainty = 0.4567 (Affirmative) < succ>
           bacterial outside --- Certainty = 0.0000 (Not Clear) < succ>
         bacterial cytoplasm --- Certainty = 0.0000 (Not Clear) < succ>
```

The protein has homology with the following sequences in the GENPEPT database.

```
>GP: CAB96552 GB: AJ251472 peptidoglycan GlcNAc deacetylase
[Streptococcus pneumoniae]
Identities = 133/431 (30%), Positives = 228/431 (52%), Gaps = 20/431 (4%)

Query:    5 IIGIFSLIIIAILAWQGFSFLKHK--EIKLQQAVVEKEIRIAEKTVEVVKRQKTERVLFL   62
            +IGI ++ I  +  + F   + K  E K++    EK+ +++E  +   RQ      V+
Sbjct:   21 LIGILAISICLLGGFIAFKIYQQKSFEQKIESLKKEKDDQLSEGNQKEHFRQGQAEVIAY   80

Query:   63 EPKGYDKSLSADILKWNQKSFEHKKFYDNQYIILRPQLADSNFANVKKLSIYQILYQKEK  122
             P   +K +S+    NQ  + +  + DN        Q  +S     V   ++ + +Y
Sbjct:   81 YPLQGEKVISSVRELINQDVKDKLESKDNLVFYYTEQ-EESGLKGVVNRNVTKQIYDLVA  139

Query:  123 GSMFQKSSRLLRTYLLDQNKKPFELDELLAHNISGFKAILENIAPGTQLK--EHDSNKEF  180
             + +      L    L ++ +PF LD+L +       + +++ +    + K  E D +++
Sbjct:  140 FKIEETEKTSLGKVHLTEDGQPFTLDQLFSDASKAKEQLIKELTSFIEDKKIEQDQSEQI  199

Query:  181 LKTGRVTD----GLDVKDGKLII---------NDLKLPLDKLYNVIDESYLKSSDLDLVS  227
            +K      D       D KD ++I+            ++ LP+   ++VI  SYL   D  L
Sbjct:  200 VKNFSDQDLSAWNFDYKDSQIILYPSPVVENLEEIALPVSAFFDVIQSSYLLEKDAALYQ  259

Query:  228 NLKAKAPR--VALTFDDGPNEKTTPKALEILKRYNAKATFFVMGQSAVGHTDILQRMHAE  285
             +   K +    VALTFDDGPN   TTP+ LE L  +Y+  KATFFV+G++   G+ D+++R+ +E
Sbjct:  260 SYFDKKHQKVVALTFDDGPNPATTPQVLETLAKYDIKATFFVLGKNVSGNEDLVKRIKSE  319

Query:  286 GHEIGNHTWDHPNLTKLPAEKIKEEIHKTNDLIMKATGQKPVYLRPPYGATNATVKTVTG  345
             GH  +GNH+W  HP  L++L    ++  K++I  T D++   K   G          +RPPYGA   ++
Sbjct:  320 GHVVGNHSWSHPILSQLSLDEAKKQITDTEDVLTKVLGSSSKLMRPPYGAITDDIRNSLD  379

Query:  346 LKEMLWSVDTEDWKNHNTQAMMTNIKKQLRPGGVILMHDIHQTTIDALPTIMDYLTTQGY  405
            L  ++W VD+ DWK+ N   +++T I+ Q+  G  ++LMHDIH   T++ALP  +++YL    QGY
Sbjct:  380 LSFIMWDVDSLDWKSKNEASILTEIQHQVANGSIVLMHDIHSPTVNALPRVIEYLKNQGY  439

Query:  406 YFVTVGELYST                                                  416
             FVT+  E+   +T
Sbjct:  440 TFVTIPEMLNT                                                  450
```

A related DNA sequence was identified in *S. pyogenes* <SEQ ID 4459> which encodes the amino acid sequence <SEQ ID 4460>. Analysis of this protein sequence reveals the following:

```
Possible site: 22
>>> Seems to have an uncleavable N-term signal seq
INTEGRAL Likelihood = -12.58 Transmembrane 6-22 (1-27)

----- Final Results -----
          bacterial membrane --- Certainty = 0.6031 (Affirmative) < succ>
           bacterial outside --- Certainty = 0.0000 (Not Clear) < succ>
         bacterial cytoplasm --- Certainty = 0.0000 (Not Clear) < succ>
```

The protein has homology with the following sequences in the databases:

```
!GB: AJ251472 peptidoglycan GlcNAc deacetylase [Strep... 239 4e-62
>GP: CAB96552 GB: AJ251472 peptidoglycan GlcNAc deacetylase
[Streptococcus pneumoniae]
Identities = 136/438 (31%), Positives = 230/438 (52%), Gaps = 23/438 (5%)

Query:   3 KLNVILVGLLSILMLSLAI----VFINRWKLNEDSQRIVLAEKKKNTSDLVIKAVKHIKK   58
           K  +L+ L+ IL +S+ +     +      ++      Q+I    +K+K+         +H ++
Sbjct:  13 KTRHVLLALIGILAISICLLGGFIAFKIYQQKSFEQKIESLKKEKDDQLSEGNQKEHFRQ   72

Query:  59 DQKDYYYFSPIK--QADDFFVDNLPVSLYKKKNSDKELILVRPKLQSSHLRSVNTLTISK  116
           Q +   + P++ +         + +    + K  S   L+    + + S L+ V     ++K
Sbjct:  73 GQAEVIAYYPLQGEKVISSVRELINQDVKDKLESKDNLVFYYTEQEESGLKGVVNRNVTK  132

Query: 117 IVYQKKFFHLAKKSEKVISTYHVTDDLKPFQVKDLVSGHL---ERIQEEVEKKYPDAGFN  173
           +Y    F + +  +   H+T+D  +PF +   L S         E++ +E+        D
Sbjct: 133 QIYDLVAFKIEETEKTSLGKVHLTEDGQPFTLDQLFSDASKAKEQLIKELTSFIEDKKIE  192

Query: 174 SDKYNGLKESNS---LLSDGFEVKSGNLIFD--------KKLTIPLTTLFDVINPDFLAN  222
           D+   ++ S    L  +  F+ K   +I         +++ +P++   FDVI    +L
Sbjct: 193 QDQSEQIVKNFSDQDLSAWNFDYKDSQIILYPSPVVENLEEIALPVSAFFDVIQSSYLLE  252

Query: 223 SDRAAYDNYRTYKEQHPKKLVALTFDDGPDPTTTPQVLDILAKYQAKGTFFMIGSKVVNN  282
             D A Y +Y    K Q    K+VALTFDDGP+P TTPQVL+ LAKY K TFF++G  V  N
Sbjct: 253 KDAALYQSYFDKKHQ---KVVALTFDDGPNPATTPQVLETLAKYDIKATFFVLGKNVSGN  309

Query: 283 ENLTKRVSDAGHEIANHTWDHPNLTNLSVSEIQHQVNMTNQAIEKACGKKPRYLRPPYGA  342
           E+L KR+    GH + NH+W HP L+ LS+ E + Q+     T     +K G       + +RPPYGA
Sbjct: 310 EDLVKRIKSEGHVVGNHSWSHPILSQLSLDEAKKQITDTEDVLTKVLGSSSKLMRPPYGA  369

Query: 343 TNATVQQSSGLTQMLWTVDTRDWENHSTDGIMTNVKNQLQPGGVVLMHDIHQTTINALPT  402
                ++ S   L+ ++W VD+ DW++ +     I+T +++Q+   G +VLMHDIH    T+NALP
Sbjct: 370 ITDDIRNSLDLSFIMWDVDSLDWKSKNEASILTEIQHQVANGSIVLMHDIHSPTVNALPR  429

Query: 403 VMEYLKAEGYECVTVSEL                                            420
           V+EYLK +GY   VT+ E+
Sbjct: 430 VIEYLKNQGYTFVTIPEM                                            447
```

An alignment of the GAS and GBS proteins is shown below.

```
Identities = 169/420 (40%), Positives = 259/420 (61%), Gaps = 12/420 (2%)

Query:   4 LIIGIFSLIIIAILAWQGFSFLKHKEIKLQQAVVEKEIRIAEKTVEVVKRQKTER--VLF   61
           +++G+ S+++++ LA    + K E   +   + EK+    ++   ++ VK  K ++     +
Sbjct:   7 ILVGLLSILMLS-LAIVFINRWKLNEDSQRIVLAEKKKNTSDLVIKAVKHIKKDQKDYYY   65

Query:  62 LEPKGYDKSLSADILKWNQKSFEHKKFYDNQYIILRPQLADSNFANVKKLSIYQILYQKE  121
            P      D L     S       KK  D +  I++RP+L   S+    +V  L+I  +I+YQK+
Sbjct:  66 FSPIKQADDFFVDNLP---VSLYKKKNSDKELILVRPKLQSSHLRSVNTLTISKIVYQKK  122

Query: 122 KGSMFQKSSRLLRTYLLDQNKKPFELDELLAHNISGFKAILENIAPGTQLKEHDSNKEFL  181
           + +KS +++ TY +   + KPF++   +L++  ++    +    +E   P        N
Sbjct: 123 FFHLAKKSEKVISTYHVTDDLKPFQVKDLVSGHLERIQEEVEKKYPDAGFNSDKYNGLKE  182

Query: 182 KTGRVTDGLDVKDGKLIIND-LKLPLDKLYNVIDESYLKSSDLDLVSNL---KAKAPR--  235
           ++DG +VK G LI +   L +PL    L++VI+    +L +SD         N     K + P+
Sbjct: 183 SNSLLSDGFEVKSGNLIFDKKLTIPLTTLFDVINPDFLANSDRAAYDNYRTYKEQHPKKL  242

Query: 236 VALTFDDGPNEKTTPKALEILKRYNAKATFFVMGQSAVGHTDILQRMHAEGHEIGNHTWD  295
           VALTFDDGP+  TTP+ L+IL +Y AK TFF++G    V + ++  +R+    GHEI NHTWD
Sbjct: 243 VALTFDDGPDPTTTPQVLDILAKYQAKGTFFMIGSKVVNNENLTKRVSDAGHEIANHTWD  302

Query: 296 HPNLTKLPAEKIKEEIHKTNDLIMKATGQKPVYLRPPYGATNATVKTVTGLKEMLWSVDT  355
           HPNLT L    +I+ +++ TN   I KA G+KP YLRPPYGATNATV+   +GL +MLW+VDT
Sbjct: 303 HPNLTNLSVSEIQHQVNMTNQAIEKACGKKPRYLRPPYGATNATVQQSSGLTQMLWTVDT  362

Query: 356 EDWKNHNTQAMMTNIKKQLRPGGVILMHDIHQTTIDALPTIMDYLTTQGYYFVTVGELYS  415
           +DW+NH+T   +MTN+K QL+PGGV+LMHDIHQTTI+ALPT+M+YL    +GY   VTV ELY+
Sbjct: 363 RDWENHSTDGIMTNVKNQLQPGGVVLMHDIHQTTINALPTVMEYLKAEGYECVTVSELYA  422
```

GBS281d was expressed in *E. coli* as a GST-fusion product. SDS-PAGE analysis of total cell extract is shown in FIG. 152 (lane 8-10; MW 71.5 kDa) and in FIG. 187 (lane 10; MW 71 kDa). It was also expressed in *E. coli* as a His-fusion product. SDS-PAGE analysis of total cell extract is shown in FIG. 152 (lane 12; MW 46.5 kDa) and in FIG. 183 (lane 2; MW 46 kDa). Purified GBS281d-GST is shown in lane 6 of FIG. 237.

Based on this analysis, it was predicted that these proteins and their epitopes could be useful antigens for vaccines or diagnostics.

EXAMPLE 1453

A DNA sequence (GBSx1539) was identified in *S. agalactiae* <SEQ ID 4461> which encodes the amino acid sequence <SEQ ID 4462>. Analysis of this protein sequence reveals the following:

```
Possible site: 57
>>> Seems to have no N-terminal signal sequence

----- Final Results -----
            bacterial cytoplasm --- Certainty = 0.2488 (Affirmative) < succ>
            bacterial membrane  --- Certainty = 0.0000 (Not Clear)   < succ>
            bacterial outside   --- Certainty = 0.0000 (Not Clear)   < succ>
```

A related DNA sequence was identified in *S. pyogenes* <SEQ ID 4463> which encodes the amino acid sequence <SEQ ID 4464>. Analysis of this protein sequence reveals the following:

```
Possible site: 40
>>> Seems to have no N-terminal signal sequence

----- Final Results -----
            bacterial cytoplasm --- Certainty = 0.2799 (Affirmative) < succ>
            bacterial membrane  --- Certainty = 0.0000 (Not Clear)   < succ>
            bacterial outside   --- Certainty = 0.0000 (Not Clear)   < succ>
```

An alignment of the GAS and GBS proteins is shown below.

```
Identities = 311/475 (65%), Positives = 389/475 (81%)

Query:    1 MTKEYQNYVNGEWKSSVNQIEILSPIDDSSLGFVPAMTREEVDHAMKAGREALPAWAALT   60
            + K+Y+N VNGEWK S N+I I +P    LG VPAMT+ EVD   + ++AL  W AL+
Sbjct:    1 LAKQYKNLVNGEWKLSENEITIYAPATGEELGSVPAMTQAEVDAVYASAKKALSDWRALS   60

Query:   61 VYERAQYLHKAADIIERDKEEIATVLAKEISKAYNASVTEVVRTADLIRYAAEEGIRLST  120
            ERA YLHKAADI+ RD E+I   +L+KE++K + A+V+EV+RTA++I YAAEEG+R+
Sbjct:   61 YVERAAYLHKAADILVRDAEKIGAILSKEVAKGHKAAVSEVIRTAEIINYAAEEGLRMEG  120

Query:  121 SADEGGKMDASTGHKLAVIRRQPVGIVLAIAPYNYPVNLSGSKIAPALIGGNVVMFKPPT  180
            EGG  +A++  K+A++RR+PVG+VLAI+P+NYPVNL+GSKIAPALI GNVV  KPPT
Sbjct:  121 EVLEGGSFEAASKKKIAIVRREPVGLVLAISPFNYPVNLAGSKIAPALIAGNVVALKPPT  180

Query:  181 QGSVSGLVLAKAFAEAGLPAGVFNTITGRGSEIGDYIVEHEEVNFINFTGSTPVGKRIGK  240
            QGS+SGL+LA+AFAEAG+PAGVFNTITGRGS IGDYIVEHE V+FINFTGSTP+G+ IGK
Sbjct:  181 QGSISGLLLAEAFAEAGIPAGVFNTITGRGSVIGDYIVEHEAVSFINFTGSTPIGEGIGK  240

Query:  241 LAGMRPIMLELGGKDAGVVLADADLDNAAKQIVAGAYDYSGQRCTAIKRVLVVEEVADEL  300
            LAGMRPIMLELGGKD+ +VL DADL  AAK IVAGA+ YSGQRCTA+KRVLV+++VAD+L
Sbjct:  241 LAGMRPIMLELGGKDSAIVLEDADLALAAKNIVAGAFGYSGQRCTAVKRVLVMDKVADQL  300

Query:  301 AEKISENVAKLSVGDPFDNATVTPVIDDNSADFIESLVVDARQKGAKELNEFKRDGRLLT  360
            A +I   V KLSVG P D+A +TP+ID ++ADF+E L+ DA  KGA  L  F R+G L++
Sbjct:  301 AAEIKTLVEKLSVGMPEDDADITPLIDTSAADFVEGLIKDATDKGATALTAFNREGNLIS  360

Query:  361 PGLFDHVTLDMKLAWEEPFGPILPIIRVKDAEEAVAIANKSDFGLQSSVFTRDFQKAFDI  420
            P LFDHVT DM+LAWEEPFGP+LPIIRV   EEA+ I+N+S++GLQ+S+FT +F KAF I
Sbjct:  361 PVLFDHVTTDMRLAWEEPFGPVLPIIRVTTVEEAIKISNESEYGLQASIFTTNFPKAFGI  420

Query:  421 ANKLEVGTVHINNKTGRGPDNFPPFLGLKGSGAGVQGIRYSIEAMTNVKSIVFDMK       475
            A +LEVGTVH+NNKT RG DNFPPFLG K SGAGVQG++YSIEAMT VKS+VFD++
Sbjct:  421 AEQLEVGTVHLNNKTQRGTDNFPPFLGAKKSGAGVQGVKYSIEAMTTVKSVVFDIQ       475
```

A related GBS gene <SEQ ID 8815> and protein <SEQ ID 8816> were also identified. Analysis of this protein sequence reveals the following:

```
Lipop: Possible site: -1 Crend: 3
McG: Discrim Score: -15.11
GvH: Signal Score (-7.5): 0.17
Possible site: 57
>>> Seems to have no N-terminal signal sequence
ALOM program count: 0 value: 1.22 threshold: 0.0
PERIPHERAL Likelihood = 1.22 187
modified ALOM score: -0.74

*** Reasoning Step: 3

----- Final Results -----
            bacterial cytoplasm --- Certainty = 0.2488 (Affirmative) < succ>
             bacterial membrane --- Certainty = 0.0000 (Not Clear)   < succ>
              bacterial outside --- Certainty = 0.0000 (Not Clear)   < succ>
```

The protein has homology with the following sequences in the databases:

```
66.8/82.6% over 474aa
Streptococcus mutans
EGAD|42413| NADP-dependent glyceraldehyde-3-phosphate dehydrogenase Insert
characterized
EGAD|42413|110509 NADP-dependent glyceraldehyde-3-phosphate dehydrogenase Insert
characterized
SP|Q59931|GAPN_STRMU NADP-DEPENDENT GLYCERALDEHYDE-3-PHOSPHATE DEHYDRAGENASE
(EC 1.2.1.9) (NON-PHOSPHORYLATING GLYCERALDEHYDE 3-PHOSPHATE DEHYDROGENASE)
(GLYCERALDEHYDE-3-PHOSPHATE DEHYDROGENASE [NADP+])
(TRIOSEPHOSPHATE DEHYDROGENASE). Edit characterized
GP|642667|gb|AAA91091.1||L38521 NADP-dependent glyceraldehyde-3-phosphate dehydro
Insert characterized ORF01688(301-1725 of 2025)
EGAD|42413|44796(1-475 of 475) NADP-dependent glyceraldehyde-3-phosphate
dehydrogenase {Streptococcus mutans}EGAD|42413|110509 NADP-dependent
glyceraldehyde-3-phosphate dehydrogenase {Streptococcus mutans}
SP|Q59931|GAPN_STRMU NADP-DEPENDENT GLYCERALDEHYDE-3-PHOSPHATE DEHYDROGENASE
(EC 1.2.1.9) (NON-PHOSPHORYLATING GLYCERALDEHYDE 3-PHOSPHATE DEHYDROGENASE)
(GLYCERALDEHYDE-3-PHOSPHATE DEHYDROGENASE [NADP+])
(TRIOSEPHOSPHATE DEHYDROGENASE).GP|642667|gb|AAA91091.1||L38521
 NADP-dependent glyceraldehyde-3-phosphate dehydro
% Match = 49.3
% Identity = 66.7    % Similarity = 82.5
Matches = 317    Mismatches = 83    Conservative Sub.s = 75

195       225       255       285       315       345       375       405
*GLKNLYFFIESLDIVKFLRKICQIIEINR*SDRINLLQCKRRFTLTKEYQNYVNGEWKSSVNQIEILSPIDDSSLGFVP
                                                     :||:|:|||||||| |:|:|   :  || ||
                                                     MTKQYKNYVNGEWKLSENEIKIYEPASGAELGSVP
                                                      10        20        30

435       465       495       525       555       585       615       645
AMTREEVDHAMKAGREALPAWAALTVYERAQYLHKAADIIERDKEEIATVLAKEISKAYNASVTEVVRTADLIRYAAEEG
||:| |||:    : ::|  ||| ||:   ||| |||| |||:  :|:||::|  |::|||||||::|  ||||||
AMSTEEVDYVYASAKKAQPAWRALSYIERAAYLHKVADILMRDKEKIGAILSKEVAKGYKSAVSEVVRTAEIINYAAEEG
  50        60        70        80        90        100       110

675       705       735       765       795       825       855       885
IRLSTSADEGGKMDASTGHKLAVIRRQPVGIVLAIAPYNYPVNLSGSKIAPALIGGNVVMFKPPTQGSVSGLVLAKAFAE
:|:      |||   :|::   |:|:|:||:|||||||| |:||||||||||||| |||   |||||||:|||:||:||||
LRMEGEVLEGGSFEAASKKKIAVVRREPVGLVLAISPFNYPVNLAGSKIAPALIAGNVIAFKPPTQGSISGLLLAEAFAE
    130       140       150       160       170       180       190

915       945       975       1005      1035      1065      1095      1125
AGLPAGVFNTITGRGSEIGDYIVEHEEVNFINFTGSTPVGKRIGKLAGMRPIMLELGGKDAGVVLADADLDNAAKQIVAG
|||||||||||||||||||||||: ||||||||| :|:||||:|||||||||||||||:  || ||||  || :||
AGLPAGVFNTITGRGSEIGDYIVEHQAVNFINFTGSTGIGERIGKMAGMRPIMLELGGKDSAIVLEDADLELTAKNIIAG
    210       220       230       240       250       260       270

1155      1185      1215      1245      1275      1305      1335      1365
AYDYSGQRCTAIKRVLVVEEVADELAEKISENVAKLSVGXPFDNATVTPVIDDNSADFIESLVVDARQKGAKELNEFKRD
|: |||||||||:|||||:| ||||| |||  |: | |::| :||:||  |||::|  |:  ||  ||| | | ||:
AFGYSGQRCTAVKRVLVMESVADELVEKIREKVLALTIGNPEDDADITPLIDTKSADYVEGLINDANDKGATALTEIKRE
    290       300       310       320       330       340       350

1395      1425      1455      1485      1515      1545      1575      1605
GRLLTPGLFDHVTLDMKLAWEEPFGPILPIIRVKDAEEAVAIANKXDFGLQSSVFTRDFQKAFDIANKLEVGTVHINNKT
| |: | ||| || ||:|||||||:||||||||  |||: :|||  ::|| :||  || ::||  ||:||||||||||
GNLICPILFDKVTTDMRLAWEEPFGPVLPIIRVTSVEEAIEISNKSEYGLQASIFTNDFPRAFGIAEQLEVGTVHINNKT
    370       380       390       400       410       420       430
```

```
1635       1665       1695       1725       1755       1785       1815       1845
GRGPDNFPPFLGLKGSGAGVQGIRYSIEAMTNVKSIVFDMK*T*NDSTIVS*VVL*TSFTLKIKNYIIF*SGFIFVI*LS*
 ||  ||||||||| | ||||:||::|||||||| |||:|||:|
QRGTDNFPPFLGAKKSGAGIQGVKYSIEAMTTVKSVVFDIK
            450        460        470
```

SEQ ID 8816 (GBS127) was expressed in *E. coli* as a His-fusion product. SDS-PAGE analysis of total cell extract is shown in FIG. 29 (lane 10; MW 55.9 kDa).

Figure 200:
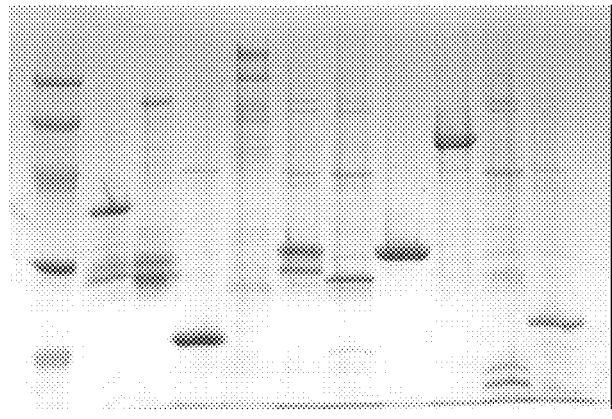

GBS127-His was purified as shown in FIG. 200, lane 9.

Based on this analysis, it was predicted that these proteins and their epitopes could be useful antigens for vaccines or diagnostics.

EXAMPLE 1454

A DNA sequence (GBSx1540) was identified in *S. agalactiae* <SEQ ID 4465> which encodes the amino acid sequence <SEQ ID 4466>. Analysis of this protein sequence reveals the following:

```
Possible site: 17
>>> Seems to have no N-terminal signal sequence
    INTEGRAL    Likelihood = -0.37    Transmembrane    427-443 (427-443)

----- Final Results -----
            bacterial membrane  --- Certainty = 0.1150(Affirmative) < succ>
             bacterial outside  --- Certainty = 0.0000(Not Clear)   < succ>
           bacterial cytoplasm  --- Certainty = 0.0000(Not Clear)   < succ>
```

The protein has homology with the following sequences in the GENPEPT database.

```
>GP: BAA78049 GB: AB027569 phosphoenolpyruvate-protein
phosphotransferase [Streptococcus bovis]
Identities = 534/577 (92%), Positives = 559/577 (96%)

Query:    1 MTEMLKGIAASDGVAVAKAYLLVQPDLSFETVTVEDTNAEEARLDVALQASQDELSVIRE   60
            MTEMLKGIAASDGVAVAKAYLLVQPDLSFETVTVEDT+AEEARLD AL+ASQDELS+IRE
Sbjct:    1 MTEMLKGIAASDGVAVAKAYLLVQPDLSFETVTVEDTSAEEARLDAALKASQDELSIIRE   60

Query:   61 KAVESLGEEAAAVFDAHLMVLSDPEMINQIKETIRAKQVNAETGLKEVTDMFITIFEGME  120
            KAVE+LGEEAAAVFDAHLMVL+DPEMI+QIKETIRAKQ NAE GLKEVTDMFITIFEGME
Sbjct:   61 KAVETLGEEAAAVFDAHLMVLADPEMISQIKETIRAKQTNAEAGLKEVTDMFITIFEGME  120

Query:  121 DNPYMQERAADIRDVAKRVLAHLLGVKLPNPATINEESIVIAHDLTPSDTAQLNKQFVKA  180
            DNPYMQERAADIRDVAKRVLAHLLG KLPNPATI+EESIVIAHDLTPSDTAQLNKQFVKA
Sbjct:  121 DNPYMQERAADIRDVAKRVLAHLLGAKLPNPATIDEESIVIAHDLTPSDTAQLNKQFVKA  180

Query:  181 FVTNIGGRTSHSAIMARTLEIAAVLGTNDITERVQDGQLIAVNGITGEVIIEPTEAQISA  240
            FVTNIGGRTSHSAIMARTLEIAAVLGTNDIT RV+DG ++AVNGITGEVII PT+ Q++
Sbjct:  181 FVTNIGGRTSHSAIMARTLEIAAVLGTNDITSRVKDGDIVAVNGITGEVIINPTDEQVAE  240

Query:  241 FKAAGEAYAKQKAEWALLKDAQTVTADGKHFELAANIGTPKDVEGVNENGAEAVGLYRTE  300
            FKAAGEAYAKQKAEWALLKDA+TVTADGKHFELAANIGTPKDVEGVN NGAEAVGLYRTE
Sbjct:  241 FKAAGEAYAKQKAEWALLKDAKTVTADGKHFELAANIGTPKDVEGVNANGAEAVGLYRTE  300

Query:  301 FLYMDSQDFPTEDEQYEAYKAVLEGMNGKPVVVRTMDIGGDKELPYFDLPKEMNPFLGFR  360
            FLYMDSQDFPTEDEQYEAYKAVLEGMNGKPVVVRTMDIGGDKELPY DLPKEMNPFLGFR
Sbjct:  301 FLYMDSQDFPTEDEQYEAYKAVLEGMNGKPVVVRTMDIGGDKELPYLDLPKEMNPFLGFR  360

Query:  361 ALRISISETGDAMFRTQIRALLRASVHGQLRIMFPMVALLKEFRAAKAIFEEEKANLLAD  420
            ALRISISETG+AMFRTQIRALLRASVHGQLRIMFPMVALLKEFRAAKAIF+EEKANL A+
Sbjct:  361 ALRISISETGNAMFRTQIRALLRASVHGQLRIMFPMVALLKEFRAAKAIFDEEKANLKAE  420

Query:  421 GVAVAEGIEVGIMIEIPAAAMLADQFAKEVDFFSIGTNDLIQYTMAADRMNEQVSYLYQP  480
            GVAV++ I+VGIMIEIPAAAMLADQFAKEVDFFSIGTNDLIQYTMAADRMNEQVSYLYQP
Sbjct:  421 GVAVSDDIQVGIMIEIPAAAMLADQFAKEVDFFSIGTNDLIQYTMAADRMNEQVSYLYQP  480

Query:  481 YNPSILRLINNVIKAAHAEGKWAGMCGEMAGDQTAVPLLVGMGLDEFSMSATSVLRTRSL  540
            YNPSILRLINNVIKAAHAEGKW GMCGEMAGDQ AVPLLV MGLDEFSMSATS+LRTRSL
Sbjct:  481 YNPSILRLINNVIKAAHAEGKWVGMCGEMAGDQKAVPLLVEMGLDEFSMSATSILRTRSL  540

Query:  541 MKKLDTAKMEEYANRALSECSTMEEVIELQKEYVDFD                        577
            MKKLDTAKM+EYANRAL+ECSTMEEV+EL KEYV+ D
Sbjct:  541 MKKLDTAKMQEYANRALTECSTMEEVLELSKEYVNVD                        577
```

A related DNA sequence was identified in *S. pyogenes* <SEQ ID 4467> which encodes the amino acid sequence <SEQ ID 4468>. Analysis of this protein sequence reveals the following:

```
Possible site: 39
>>> Seems to have no N-terminal signal sequence

----- Final Results -----
            bacterial cytoplasm --- Certainty = 0.0875(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below.

```
Identities = 540/577 (93%), Positives = 561/577 (96%)

Query:    1 MTEMLKGIAASDGVAVAKAYLLVQPDLSFETVTVEDTNAEEARLDVALQASQDELSVIRE   60
            MTEMLKGIAASDGVAVAKAYLLVQPDLSFETVTV DTNAEEARLDVALQA+QDELSVIRE
Sbjct:    1 MTEMLKGIAASDGVAVAKAYLLVQPDLSFETVTVADTNAEEARLDVALQAAQDELSVIRE   60

Query:   61 KAVESLGEEAAAVFDAHLMVLSDPEMINQIKETIRAKQVNAETGLKEVTDMFITIFEGME  120
             AVESLGEEAAAVFDAHLMVL+DPEMI+Q+KETIRAKQ NAETGLKEVTDMFITIFEGME
Sbjct:   61 NAVESLGEEAAAVFDAHLMVLADPEMISQVKETIRAKQTNAETGLKEVTDMFITIFEGME  120

Query:  121 DNPYMQERAADIRDVAKRVLAHLLGVKLPNPATINEESIVIAHDLTPSDTAQLNKQFVKA  180
            DNPYMQERAADIRDVAKRVLAHLLGVKLPNPATINEESIVIAHDLTPSDTAQLNKQFVKA
Sbjct:  121 DNPYMQERAADIRDVAKRVLAHLLGVKLPNPATINEESIVIAHDLTPSDTAQLNKQFVKA  180

Query:  181 FVTNIGGRTSHSAIMARTLEIAAVLGTNDITERVQDGQLIAVNGITGEVIIEPTEAQISA  240
            FVTNIGGRTSHSAIMARTLEIAAVLGTNDIT+RV+DG +IAVNGITGEVII+P+E Q+ A
Sbjct:  181 FVTNIGGRTSHSAIMARTLEIAAVLGTNDITKRVKDGDVIAVNGITGEVIIDPSEDQVLA  240

Query:  241 FKAAGEAYAKQKAEWALLKDAQTVTADGKHFELAANIGTPKDVEGVNENGAEAVGLYRTE  300
            FK AG AYAKQKAEW+LLKDA T TADGKHFELAANIGTPKDVEGVN+NGAEAVGLYRTE
Sbjct:  241 FKEAGAAYAKQKAEWSLLKDAHTETADGKHFELAANIGTPKDVEGVNDNGAEAVGLYRTE  300

Query:  301 FLYMDSQDFPTEDEQYEAYKAVLEGMNGKPVVVRTMDIGGDKELPYFDLPKEMNPFLGFR  360
            FLYMDSQDFPTEDEQYEAYKAVLEGMNGKPVVVRTMDIGGDKELPYFDLPKEMNPFLGFR
Sbjct:  301 FLYMDSQDFPTEDEQYEAYKAVLEGMNGKPVVVRTMDIGGDKELPYFDLPKEMNPFLGFR  360

Query:  361 ALRISISETGDAMFRTQIRALLRASVHGQLRIMFPMVALLKEFRAAKAIFEEEKANLLAD  420
            ALRISISETGDAMFRTQ+RALLRASVHGQLRIMFPMVALLKEFRAAKA+F+EEKANLLA+
Sbjct:  361 ALRISISETGDAMFRTQMRALLRASVHGQLRIMFPMVALLKEFRAAKAVFDEEKANLLAE  420

Query:  421 GVAVAEGIEVGIMIEIPAAAMLADQFAKEVDFFSIGTNDLIQYTMAADRMNEQVSYLYQP  480
            GVAVA+ I+VGIMIEIPAAAMLADQFAKEVDFFSIGTNDLIQYTMAADRMNEQVSYLYQP
Sbjct:  421 GVAVADDIQVGIMIEIPAAAMLADQFAKEVDFFSIGTNDLIQYTMAADRMNEQVSYLYQP  480

Query:  481 YNPSILRLINNVIKAAHAEGKWAGMCGEMAGDQTAVPLLVGMGLDEFSMSATSVLRTRSL  540
            YNPSILRLINNVIKAAHAEGKWAGMCGEMAGDQ AVPLLVGMGLDEFSMSATSVLRTRSL
Sbjct:  481 YNPSILRLINNVIKAAHAEGKWAGMCGEMAGDQQAVPLLVGMGLDEFSMSATSVLRTRSL  540

Query:  541 MKKLDTAKMEEYANRALSECSTMEEVIELQKEYVDFD                         577
            MKKLD+AKMEEYANRAL+ECST EEV+EL KEYV D
Sbjct:  541 MKKLDSAKMEEYANRALTECSTAEEVLELSKEYVSED                         577
```

Based on this analysis, it was predicted that these proteins and their epitopes could be useful antigens for vaccines or diagnostics.

EXAMPLE 1455

A DNA sequence (GBSx1541) was identified in *S. agalactiae* <SEQ ID 4469> which encodes the amino acid sequence <SEQ ID 4470>. Analysis of this protein sequence reveals the following:

```
Possible site: 30
>>> Seems to have no N-terminal signal sequence

----- Final Results -----
            bacterial cytoplasm --- Certainty = 0.1421(Affirmative) < succ>
```

```
                bacterial membrane --- Certainty = 0.0000(Not Clear) < succ>
                bacterial outside  --- Certainty = 0.0000(Not Clear) < succ>
```

The protein is similar to a protein from *S. bovis*:

```
>GP: BAA78048 GB: AB027569 histidine containing protein
[Streptococcus bovis]
Identities = 86/87 (98%), Positives = 87/87 (99%)

Query:   1 MASKDFHIVAETGIHARPATLLVQTASKFASDITLDYKGKAVNLKSIMGVMSLGVGQGAD  60
           MASKDFHIVAETGIHARPATLLVQTASKFASDITLDYKGKAVNLKSIMGVMSLGVGQGAD
Sbjct:   1 MASKDFHIVAETGIHARPATLLVQTASKFASDITLDYKGKAVNLKSIMGVMSLGVGQGAD  60

Query:  61 VTISAEGADADDAIAAIEETMTKEGLA                                  87
           VTISAEGADADDA+AAIEETMTKEGLA
Sbjct:  61 VTISAEGADADDALAAIEETMTKEGLA                                  87
```

A related DNA sequence was identified in *S. pyogenes* <SEQ ID 4471> which encodes the amino acid sequence <SEQ ID 4472>. Analysis of this protein sequence reveals the following:

```
Possible site: 30
>>> Seems to have no N-terminal signal sequence

----- Final Results -----
                bacterial cytoplasm --- Certainty = 0.1421(Affirmative) < succ>
                bacterial membrane  --- Certainty = 0.0000(Not Clear)   < succ>
                bacterial outside   --- Certainty = 0.0000(Not Clear)   < succ>
```

An alignment of the GAS and GBS proteins is shown below.

```
Identities = 86/87 (98%), Positives = 87/87 (99%)

Query:   1 MASKDFHIVAETGIHARPATLLVQTASKFASDITLDYKGKAVNLKSIMGVMSLGVGQGAD  60
           MASKDFHIVAETGIHARPATLLVQTASKFASDITLDYKGKAVNLKSIMGVMSLGVGQGAD
Sbjct:   1 MASKDFHIVAETGIHARPATLLVQTASKFASDITLDYKGKAVNLKSIMGVMSLGVGQGAD  60

Query:  61 VTISAEGADADDAIAAIEETMTKEGLA                                  87
           VTISAEGADA+DAIAAIEETMTKEGLA
Sbjct:  61 VTISAEGADAEDAIAAIEETMTKEGLA                                  87
```

Based on this analysis, it was predicted that these proteins and their epitopes could be useful antigens for vaccines or diagnostics.

EXAMPLE 1456

A DNA sequence (GBSx1542) was identified in *S. agalactiae* <SEQ ID 4473> which encodes the amino acid sequence <SEQ ID 4474>. This protein is predicted to be glutaredoxin-like protein nrdh (b2673). Analysis of this protein sequence reveals the following:

```
Possible site: 56
>>> Seems to have no N-terminal signal sequence

----- Final Results -----
                bacterial cytoplasm --- Certainty = 0.4532(Affirmative) < succ>
                bacterial membrane  --- Certainty = 0.0000(Not Clear)   < succ>
                bacterial outside   --- Certainty = 0.0000(Not Clear)   < succ>
```

The protein has homology with the following sequences in the GENPEPT database.

```
>GP: CAA63372 GB: X92690 glutaredoxin-like protein [Lactococcus
lactis]
```

```
                          -continued
Identities = 42/70 (60%), Positives = 53/70 (75%)

Query:    4 ITVFSKNNCMQCKMTKKFLDQHGADFEEINIDEKPEKIEYVKNLGFSAAPVIEAGNVVFS   63
            +TV+SKNNCMQCKM KK+L +H   F EINIDE+PE +E V  +GF AAPVI    + FS
Sbjct:    2 VTVYSKNNCMQCKMVKKWLSEHEIAFNEINIDEQPEFVEKVIEMGFRAAPVITKDDFAFS   61

Query:   64 GFQPSKLKEL                                                    73
            GF+PS+L +L
Sbjct:   62 GFRPSELAKL                                                    71
```

A related DNA sequence was identified in *S. pyogenes* <SEQ ID 4475> which encodes the amino acid sequence <SEQ ID 4476>. Analysis of this protein sequence reveals the following:

```
Possible site: 17
>>> Seems to have no N-terminal signal sequence

----- Final Results -----
            bacterial cytoplasm --- Certainty = 0.4606(Affirmative) < succ>
             bacterial membrane --- Certainty = 0.0000(Not Clear)  < succ>
              bacterial outside --- Certainty = 0.0000(Not Clear)  < succ>
```

An alignment of the GAS and GBS proteins is shown below.

```
Identities = 56/71 (78%), Positives = 68/71 (94%)

Query:    4 ITVFSKNNCMQCKMTKKFLDQHGADFEEINIDEKPEKIEYVKNLGFSAAPVIEAGNVVFS   63
            ITV+SKNNCMQCKMTKKFL+QHG +F+EINIDE PEK++YVK+LGF++APVIEA N+VFS
Sbjct:   13 ITVYSKNNCMQCKMTKKFLEQHGVNFQEINIDEHPEKVDYVKSLGFTSAPVIEADNLVFS   72

Query:   64 GFQPSKLKELV                                                   74
            GFQP+KLKEL+
Sbjct:   73 GFQPAKLKELI                                                   83
```

Based on this analysis, it was predicted that these proteins and their epitopes could be useful antigens for vaccines or diagnostics.

EXAMPLE 1457

A DNA sequence (GBSx1543) was identified in *S. agalactiae* <SEQ ID 4477> which encodes the amino acid sequence <SEQ ID 4478>. This protein is predicted to be ribonucleotide reductase subunit R1E (nrdE). Analysis of this protein sequence reveals the following:

```
Possible site: 49
>>> Seems to have no N-terminal signal sequence

----- Final Results -----
            bacterial cytoplasm --- Certainty = 0.3676(Affirmative) < succ>
             bacterial membrane --- Certainty = 0.0000(Not Clear)  < succ>
              bacterial outside --- Certainty = 0.0000(Not Clear)  < succ>
```

The protein has homology with the following sequences in the GENPEPT database.

```
>GP: AAD41036 GB: AF112535 ribonucleotide reductase alpha-chain
[Corynebacterium glutamicum]
Identities = 366/701 (52%), Positives = 488/701 (69%), Gaps = 19/701 (2%)

Query:   23 NGQIPLHKDKEALTAFFKENVQPNSKAFDSITDKIAYLLKYDYLEEAFLNKYRPEFIEEL   82
            NG+I   KD+EA   +F ++V   N+  F ++ +KI YL++  Y    L+KY  +FI++L
Sbjct:   22 NGKIQFEKDREAANQYFLQHVNQNTVFFHNLQEKIDYLVENKYYDPIVLDKYDFQFIKDL   81

Query:   83 STKLFDKKFRFKSFMAAYKFYQQYALKTNDGEYYLESIEDRVLFNALYFADGDEELATDL  142
            + +   KFRF+SF+ AYK+Y  Y LKT DG  YLE  EDRV   AL  ADGD LA +L
Sbjct:   82 FKRAYGFKFRFQSFLGAYKYYTSYTLKTFDGRRYLERFEDRVCMVALTLADGDRALAENL  141
```

```
Query: 143 ALEMISQRYQPATPSFLNAGRSRRGELVSCFLIQVTDDMNAIGRSINSALQLSRIGGGVG 202
            E++S R+QPATP+FLN+G+++RGE VSCFL+++ D+M +IGRSINSALQLS+ GGGV
Sbjct: 142 VDEIMSGRFQPATPTFLNSGKAQRGEPVSCFLLRIEDNMESIGRSINSALQLSKRGGGVA 201

Query: 203 ISLSNLREAGAPIKGFAGAASGVVPVMKLFEDSFSYSNQLGQRQGAGVVYLDVFHPDIIS 262
            + LSNLREAGAPIK      +SGV+PVMKL ED+FSY+NQLG RQGAG VYL+ HPDI+S
Sbjct: 202 LLLSNLREAGAPIKKIENQSSGVIPVMKLLEDAFSYANQLGARQGAGAVYLNAHHPDILS 261

Query: 263 FLSTKKENADEKVRVKTLSLGITVPDKFYELARNNQEMYLFSPYSIEREYGVPFSYIDIT 322
            FL TK+ENADEK+R+KTLSLG+ +PD  +ELA+ N +MYLFSPY +ER YG PF+ + IT
Sbjct: 262 FLDTKRENADEKIRIKTLSLGVVIPDITFELAKRNDDMYLFSPYDVERIYGKPFADVSIT 321

Query: 323 EKYDELVANPNITKTKINARDLETEISKLQQESGYPYIINIDTANRTNPVDGKIIMSNLC 382
            E YDE+V + I KTKINAR      ++++Q ESGYPYI+ DT N +NP++G+I  SNLC
Sbjct: 322 EHYDEMVDDDRIRKTKINARQFFQTLAEIQFESGYPYIMYEDTVNASNPIEGRITHSNLC 381

Query: 383 SEILQVQKPSLINDAQEYLEMGTDISCNLGSTNVLNMMTSPDFGKSIKTMTRALTFVTDS 442
            SEILQV  PS ND   Y E+G DISCNLGS NV    M SP+F K+I+T  R LT V++
Sbjct: 382 SEILQVSTPSEFNDDLTYAEVGEDISCNLGSLNVAMAMDSPNFEKTIETAIRGLTAVSEQ 441

Query: 443 SNIEAVPTIKNGNAQAHTFGLGAMGLHSYLAKNHIEYGSPESIEFTDIYFMLMNYWTLVE 502
            ++I++VP+I+ GN  AH  GLG M LH Y  + H+ YGS E+++FT+ YF  + Y  L
Sbjct: 442 TSIDSVPSIRKGNEAAHAIGLGQMNLHGYFGREHMHYGSEEALDFTNAYFAAVLYQCLRA 501

Query: 503 SNNIARERQTTFVGFEKSKYADGTYFDKYVSGKFVPQSDKVKSLFA--NHFIPEAKDWEN 560
            SN IA ER   F  FE SKYA G YFD + +  F P+SDKVK LFA  N   P +DW
Sbjct: 502 SNKIATERGERFKNFENSKYATGEYFDDFDANDFAPKSDKVKELFAKSNIHTPTVEDWAA 561

Query: 561 LRYAVMKDGLYHQNRLAVAPNGSISYINDCSASIHPITQRIEERQEKKIGKIYYPANGLA 620
            L+  VM+ GL+++N  AV P GSISYIN+ ++SIHPI  +IE R+E KIG++YYPA  +
Sbjct: 562 LKADVMEHGLFNRNLQAVPPTGSISYINNSTSSIHPIASKIEIRKEGKIGRVYYPAPHMD 621

Query: 621 TDTIPYYTSAYDMDMRKVIDVYAAATEHVDQGLSMTLFLRSELPKELYEWKTESKQTTRD 680
            D + Y+  AY++     K+ID YA AT++VDQGLS+TLF +            TTRD
Sbjct: 622 NDNLEYFEDAYEIGYEKIIDTYAVATKYVDQGLSLTLFFK------------DTATTRD 668

Query: 681 LSILRNYAFNKGVKSIYYI--RTFTDDGSEVGANQCESCVI                   719
            ++  + YA+ KG+K++YYI  R    +G+EV   + C SC++
Sbjct: 669 INRAQIYAWRKGIKTLYYIRLRQVALEGTEV--DGCVSCML                    707
```

A related DNA sequence was identified in *S. pyogenes* <SEQ ID 4479> which encodes the amino acid sequence <SEQ ID 4480>. Analysis of this protein sequence reveals the following:

```
Possible site: 39
>>> Seems to have no N-terminal signal sequence

----- Final Results -----
            bacterial cytoplasm --- Certainty = 0.4241(Affirmative) < succ>
             bacterial membrane --- Certainty = 0.0000(Not Clear)  < succ>
              bacterial outside --- Certainty = 0.0000(Not Clear)  < succ>
```

An alignment of the GAS and GBS proteins is shown below.

```
Identities = 628/719 (87%), Positives = 682/719 (94%)

Query:   1 MSLKNIGDVSYFRLNNEINRPVNGQIPLHKDKEALTAFFKENVQPNSKAFDSITDKIAYL  60
           MSLK++GD+SYFRLNNEINRPVNG+IPLHKDKEAL AF  ENV PN+ +F SIT+KI YL
Sbjct:   1 MSLKDLGDISYFRLNNEINRPVNGKIPLHKDKEALKAFSAENVLPNTMSFTSITEKIEYL  60

Query:  61 LKYDYLEEAFLNKYRPEFIEELSTKLFDKKFRFKSFMAAYKFYQQYALKTNDGEYYLESI 120
           + DY+E AF+ KYRPEFI EL + +  FRFKSFMAAYKFYQQYALKTNDGE+YLE++
Sbjct:  61 ISNDYIESAFIQKYRPEFITELDSIIKSENFRFKSFMAAYKFYQQYALKTNDGEHYLENL 120

Query: 121 EDRVLFNALYFADGDEELATDLALEMISQRYQPATPSFLNAGRSRRGELVSCFLIQVTDD 180
           EDRVLFNALYFADG E+LA DLA+EMI+QRYQPATPSFLNAGRSRRGELVSCFLIQVTDD
Sbjct: 121 EDRVLFNALYFADGQEDLAKDLAVEMINQRYQPATPSFLNAGRSRRGELVSCFLIQVTDD 180

Query: 181 MNAIGRSINSALQLSRIGGGVGISLSNLREAGAPIKGFAGAASGVVPVMKLFEDSFSYSN 240
           MN+IGRSINSALQLSRIGGGVGI+LSNLREAGAPIKG+AGAASGVVPVMKLFEDSFSYSN
Sbjct: 181 MNSIGRSINSALQLSRIGGGVGITLSNLREAGAPIKGYAGAASGVVPVMKLFEDSFSYSN 240
```

-continued

```
Query: 241 QLGQRQGAGVVYLDVFHPDIISFLSTKKENADEKVRVKTLSLGITVPDKFYELARNNQEM 300
           QLGQRQGAGVVYL+VFHPDII+FLSTKKENADEKVRVKTLSLGITVPDKFYELAR N++M
Sbjct: 241 QLGQRQGAGVVYLNVFHPDIIAFLSTKKENADEKVRVKTLSLGITVPDKFYELARKNEDM 300

Query: 301 YLFSPYSIEREYGVPFSYIDITEKYDELVANPNITKTKINARDLETEISKLQQESGYPYI 360
           YLFSPY++E+EYG+PF+Y+DIT  YDELVANP ITKTKI ARDLETEISKLQQESGYPYI
Sbjct: 301 YLFSPYNVEKEYGIPFNYLDITNMYDELVANPKITKTKIKARDLETEISKLQQESGYPYI 360

Query: 361 INIDTANRTNPVDGKIIMSNLCSEILQVQKPSLINDAQEYLEMGTDISCNLGSTNVLNMM 420
           INIDTAN+ NP+DGKIIMSNLCSEILQVQ PSLINDAQE++EMGTDISCNLGSTN+LNMM
Sbjct: 361 INIDTANKANPIDGKIIMSNLCSEILQVQTPSLINDAQEFVEMGTDISCNLGSTNILNMM 420

Query: 421 TSPDFGKSIKTMTRALTFVTDSSNIEAVPTIKNGNAQAHTFGLGAMGLHSYLAKNHIEYG 480
           TSPDFG+SIKTMTRALTFVTDSS+IEAVPTIK+GN+QAHTFGLGAMGLHSYLA++HIEYG
Sbjct: 421 TSPDFGRSIKTMTRALTFVTDSSSIEAVPTIKHGNSQAHTFGLGAMGLHSYLAQHHIEYG 480

Query: 481 SPESIEFTDIYFMLMNYWTLVESNNIARERQTTFVGFEKSKYADGTYFDKYVSGKFVPQS 540
           SPESIEFTDIYFML+NYWTLVESNNIARERQTTFVGFE SKYA+G+YFDKYV+G FVP+S
Sbjct: 481 SPESIEFTDIYFMLLNYWTLVESNNIARERQTTFVGFENSKYANGSYFDKYVTGHFVPKS 540

Query: 541 DKVKSLFANHFIPEAKDWENLRYAVMKDGLYHQNRLAVAPNGSISYINDCSASIHPITQR 600
           D VK LF +HFIP+A DWE LR AV KDGLYHQNRLAVAPNGSISYINDCSASIHPITQR
Sbjct: 541 DLVKDLFKDHFIPQASDWEALRDAVQKDGLYHQNRLAVAPNGSISYINDCSASIHPITQR 600

Query: 601 IEERQEKKIGKIYYPANGLATDTIPYYTSAYDMDMRKVIDVYAAATEHVDQGLSMTLFLR 660
           IEERQEKKIGKIYYPANGL+TDTIPYYTSAYDMDMRKVIDVYAAATEHVDQGLS+TLFLR
Sbjct: 601 IEERQEKKIGKIYYPANGLSTDTIPYYTSAYDMDMRKVIDVYAAATEHVDQGLSLTLFLR 660

Query: 661 SELPKELYEWKTESKQTTRDLSILRNYAFNKGVKSIYYIRTFTDDGSEVGANQCESCVI 719
           SELP ELYEWKT+SKQTTRDLSILRNYAFNKG+KSIYYIRTFTDDG EVGANQCESCVI
Sbjct: 661 SELPMELYEWKTQSKQTTRDLSILRNYAFNKGIKSIYYIRTFTDDGEEVGANQCESCVI 719
```

Based on this analysis, it was predicted that these proteins and their epitopes could be useful antigens for vaccines or diagnostics.

EXAMPLE 1458

A DNA sequence (GBSx1544) was identified in *S. agalactiae* <SEQ ID 4481> which encodes the amino acid sequence <SEQ ID 4482>. This protein is predicted to be ribonucleotide reductase subunit R2F (nrdB). Analysis of this protein sequence reveals the following:

```
Possible site: 44
>>> Seems to have no N-terminal signal sequence

----- Final Results -----
          bacterial cytoplasm --- Certainty = 0.4583(Affirmative) < succ>
          bacterial membrane  --- Certainty = 0.0000(Not Clear)   < succ>
          bacterial outside   --- Certainty = 0.0000(Not Clear)   < succ>
```

A related GBS nucleic acid sequence <SEQ ID 9753> which encodes amino acid sequence <SEQ ID 9754> was also identified.

The protein has homology with the following sequences in the GENPEPT database.

```
>GP: AAC14561 GB: AF050168 ribonucleoside diphosphate reductase small sub-
unit [Corynebacterium ammoniagenes] Identities = 166/313 (53%), Positives
= 215/313 (68%), Gaps = 1/313 (0%)
Query:  10 EAINWNEIEDVIDKSTWEKLTEQFWLDTRIPLSNDLDDWRKLSAQEKDLVGKVFGGLTLL  69
            +AINWN I D  D   W++LT  FWL  +IP+SND+  W K++ QE+    +VF GLTLL
Sbjct:  17 KAINWNVIPDEKDLEVWDRLTGNFWLPEKIPVSNDIQSWNKMTPQEQLATMRVFTGLTLL  76

Query:  70 DTMQSETGVEAIRADVRTPHEEAVLNNIQFMESVHAKSYSSIFSTLNTKSEIEEIFEWTN 129
            DT+Q   G  ++  DV T HEE V  NI FMESVHAKSYS+IF TL +  +I E F W+
Sbjct:  77 DTIQGTVGAISLLPDVETMHEEGVYTNIAFMESVHAKSYSNIFMTLASTPQINEAFRWSE 136

Query: 130 NNEFLQEKARIINDIYANGNALQKKVASTYLETFLFYSGFFTPLYYLGNNKLANVAEIIK 189
            NE LQ KA+II   Y  + L+KKVAST LE+FLFYSGF+ P+Y    KL N A+II+
Sbjct: 137 ENENLQRKAKIIMSYYNGDDPLKKKVASTLLESFLFYSGFYLPMYLSSRAKLTNTADIIR 196
```

-continued

```
Query:  190 LIIRDESVHGTYIGYKFQLGFNELPEDEQENFRDWMYDLLYQLYENEEKYTKTLYDGVGW  249
            LIIRDESVHG YIGYK+Q G  +L E EQE ++ + +DL+Y LYENE +YT+ +YD +GW
Sbjct:  197 LIIRDESVHGYYIGYKYQQGVKKLSEAEQEEYKAYTFDLMYDLYENEIEYTEDIYDDLGW  256

Query:  250 TEEVMTFLRYNANKALMNLGQDPLFPDTANDVNPIVMNGIS-TGTSNHDFFSQVGNGYLL  308
            TE+V  FLRYNANKAL NLG + LFP      V+P +++ +S      NHDFFS  G+ Y++
Sbjct:  257 TEDVKRFLRYNANKALNNLGYEGLFPTDETKVSPAILSSLSPNADENHDFFSGSGSSYVI  316

Query:  309 GSVEAMHDDDYNY                                                321
            G  E   DDD+++
Sbjct:  317 GKAEDTTDDDWDF                                                329
```

A related DNA sequence was identified in *S. pyogenes* <SEQ ID 4483> which encodes the amino acid sequence <SEQ ID 4484>. Analysis of this protein sequence reveals the following:

```
Possible site: 40
>>> Seems to have no N-terminal signal sequence

----- Final Results -----
             bacterial cytoplasm --- Certainty = 0.4583(Affirmative) < succ>
             bacterial membrane  --- Certainty = 0.0000(Not Clear)   < succ>
              bacterial outside  --- Certainty = 0.0000(Not Clear)   < succ>
```

An alignment of the GAS and GBS proteins is shown below.

```
Identities = 315/319 (98%), Positives = 316/319 (98%)

Query:    5 MTTYYEAINWNEIEDVIDKSTWEKLTEQFWLDTRIPLSNDLDDWRKLSAQEKDLVGKVFG   64
            MTTYYEAINWNEIEDVIDKSTWEKLTEQFWLDTRIPLSNDLDDWRKLS QEKDLVGKVFG
Sbjct:    1 MTTYYEAINWNEIEDVIDKSTWEKLTEQFWLDTRIPLSNDLDDWRKLSLQEKDLVGKVFG   60

Query:   65 GLTLLDTMQSETGVEAIRADVRTPHEEAVLNNIQFMESVHAKSYSSIFSTLNTKSEIEEI  124
            GLTLLDTMQSETGVEAIRADVRTPHEEAVLNNIQFMESVHAKSYSSIFSTLNTK EIEEI
Sbjct:   61 GLTLLDTMQSETGVEAIRADVRTPHEEAVLNNIQFMESVHAKSYSSIFSTLNTKKEIEEI  120

Query:  125 FEWTNNNEFLQEKARIINDIYANGNALQKKVASTYLETFLFYSGFFTPLYYLGNNKLANV  184
            FEWTNNNEFLQEKARIINDIYANG+ALQKKVASTYLETFLFYSGFFTPLYYLGNNKLANV
Sbjct:  121 FEWTNNNEFLQEKARIINDIYANGDALQKKVASTYLETFLFYSGFFTPLYYLGNNKLANV  180

Query:  185 AEIIKLIIRDESVHGTYIGYKFQLGFNELPEDEQENFRDWMYDLLYQLYENEEKYTKTLY  244
            AEIIKLIIRDESVHGTYIGYKFQLGFNELPEDEQENFRDWMYDLLYQLYENEEKYTKTLY
Sbjct:  181 AEIIKLIIRDESVHGTYIGYKFQLGFNELPEDEQENFRDWMYDLLYQLYENEEKYTKTLY  240

Query:  245 DGVGWTEEVMTFLRYNANKALMNLGQDPLFPDTANDVNPIVMNGISTGTSNHDFFSQVGN  304
            DGVGWTEEVMTFLRYNANKALMNLGQDPLFPDTANDVNPIVMNGISTGTSNHDFFSQVGN
Sbjct:  241 DGVGWTEEVMTFLRYNANKALMNLGQDPLFPDTANDVNPIVMNGISTGTSNHDFFSQVGN  300

Query:  305 GYLLGSVEAMHDDDYNYGL                                          323
            GYLLGSVEAM DDDYNYGL
Sbjct:  301 GYLLGSVEAMSDDDYNYGL                                          319
```

Based on this analysis, it was predicted that these proteins and their epitopes could be useful antigens for vaccines or diagnostics.

EXAMPLE 1459

A DNA sequence (GBSx1545) was identified in *S. agalactiae* <SEQ ID 4485> which encodes the amino acid sequence <SEQ ID 4486>. Analysis of this protein sequence reveals the following:

```
Possible site: 53
>>> Seems to have no N-terminal signal sequence
     INTEGRAL     Likelihood = -0.27    Transmembrane     50-66 (50-66)

----- Final Results -----
             bacterial membrane  --- Certainty = 0.1107(Affirmative) < succ>
              bacterial outside  --- Certainty = 0.0000(Not Clear)   < succ>
             bacterial cytoplasm --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1460

A DNA sequence (GBSx1546) was identified in *S. agalactiae* <SEQ ID 4487> which encodes the amino acid sequence <SEQ ID 4488>. Analysis of this protein sequence reveals the following:

```
Possible site: 35
>>> Seems to have no N-terminal signal sequence
        INTEGRAL    Likelihood = -14.38    Transmembrane    176-192 (168-201)
        INTEGRAL    Likelihood =  -4.57    Transmembrane     25-41  (22-42)
        INTEGRAL    Likelihood =  -3.88    Transmembrane     94-110 (94-112)
        INTEGRAL    Likelihood =  -1.49    Transmembrane     70-86  (70-86)
        INTEGRAL    Likelihood =  -1.01    Transmembrane    128-144 (128-144)

----- Final Results -----
              bacterial membrane --- Certainty = 0.6753(Affirmative) < succ>
               bacterial outside --- Certainty = 0.0000(Not Clear)   < succ>
             bacterial cytoplasm --- Certainty = 0.0000(Not Clear)   < succ>
```

A related GBS nucleic acid sequence <SEQ ID 9751> which encodes amino acid sequence <SEQ ID 9752> was also identified.

The protein has homology with the following sequences in the GENPEPT database.

```
>GP: CAB15077 GB: Z99119 similar to hypothetical proteins [Bacillus
subtilis]
Identities = 55/184 (29%), Positives = 98/184 (52%), Gaps = 4/184 (2%)

Query:   16 MSKNNNTTCLIETAIFAALAMALSMIP----DFASWFTPSFGAIPLILFALRRGTKYGLF   71
            M+++      LIE AI  A A+ L ++        + S   IP+ L + R G K GL
Sbjct:    1 MNQSKQLVRLIEIAIMTAAAVILDIVSGMFLSMPQGGSVSIMMIPIFLISFRWGVKAGLT   60

Query:   72 AGLIWGLLHFVLSKVYYLSLSQVFIEYILAFISMGLAGVFSAKFKDALSSSSKTKALSLA  131
            GL+ GL+  + ++        Q+ ++YI+AF ++G++G F++  + A   S +K K +
Sbjct:   61 TGLLTGLVQIAIGNLFAQHPVQLLLDYIVAFAAIGISGCFASSVRKAAVSKTKGKLIVSV  120

Query:  132 LSGAILATLVRYVWHYIAGVIFWASYAPKGMSATLYSLSVNGTAGLLTLFFVVISIIILV  191
            +S   +L+RY H I+G +F+  S+APKG     +YSL+ N T   +     I + +L
Sbjct:  121 VSAVPIGSLLRYAAHVISGAVFFGSFAPKGTPVWIYSLTYNATYMVPSFIICAIVLCLLF  180

Query:  192 ISYP                                                         195
            ++  P
Sbjct:  181 MTAP                                                         184
```

A related DNA sequence was identified in *S. pyogenes* <SEQ ID 4489> which encodes the amino acid sequence <SEQ ID 4490>. Analysis of this protein sequence reveals the following:

```
Possible site: 20
>>> Seems to have a cleavable N-term signal seq.
        INTEGRAL    Likelihood = -9.34    Transmembrane    162-178 (156-183)
        INTEGRAL    Likelihood = -9.34    Transmembrane    110-126 (107-130)
        INTEGRAL    Likelihood = -1.22    Transmembrane     55-71  (55-71)

----- Final Results -----
              bacterial membrane --- Certainty = 0.4736(Affirmative) < succ>
               bacterial outside --- Certainty = 0.0000(Not Clear)   < succ>
             bacterial cytoplasm --- Certainty = 0.0000(Not Clear)   < succ>
```

The protein has homology with the following sequences in the databases:

```
>GP: CAB15077 GB: Z99119 similar to hypothetical proteins
[Bacillus subtilis]
Identities = 55/189 (29%), Positives = 100/189 (52%), Gaps = 10/189 (5%)

Query:    1 MSPNTNVKYLIEAAIFAALAMTLSFIPDFAGWF--SPSYGAIALV-----IFSLRRGLKY   53
            M+ +  +  LIE AI  A A+ L +    +G F  P  G+++++      + S R G+K
```

-continued

```
Sbjct:    1 MNQSKQLVRLIEIAIMTAAAVILDIV---SGMFLSMPQGGSVSIMMIPIFLISFRWGVKA   57

Query:   54 GMLAGLIWGLLHFVLGKVYYLSMSQVFIEYILAFTSMGLAGSFSDSLIKTLRRQQTFFAV  113
             G+  GL+ GL+    +G ++       Q+ ++YI+AF ++G++G F+ S+ K     +       +
Sbjct:   58 GLTTGLLTGLVQIAIGNLFAQHPVQLLLDYIVAFAAIGISGCFASSVRKAAVSKTKGKLI  117

Query:  114 FLAIMASLLAVTVRYLWHFLAGIIFWGSYAPKGMSAVWYSFSVNGTAGVLTFLITCLALM  173
              + A +   +RY H ++G +F+GS+APKG    YS + N T  V +F+I   + L
Sbjct:  118 VSVVSAVFIGSLLRYAAHVISGAVFFGSFAPKGTPVWIYSLTYNATYMVPSFIICAIVLC  177

Query:  174 IALPIHPQL                                                    182
              +     P+L
Sbjct:  178 LLFMTAPRL                                                    186
```

An alignment of the GAS and GBS proteins is shown below.

```
Identities = 116/186 (62%), Positives = 138/186 (73%)

Query:   16 MSKNNNTTCLIETAIFAALAMALSMIPDFASWFTPSFGAIPLILFALRRGTKYGLFAGLI   75
             MS N N    LIE AIFAALAM LS IPDFA WF+PS+GAI L++F+LRRG KYG+ AGLI
Sbjct:    1 MSPNTNVKYLIEAAIFAALAMTLSFIPDFAGWFSPSYGAIALVIFSLRRGLKYGMLAGLI   60

Query:   76 WGLLHFVLSKVYYLSLSQVFIEYILAFISMGLAGVFSAKFKDALSSSSKTKALSLALSGA  135
             WGLLHFVL KVYYLS+SQVFIEYILAF SMGLAG FS         L        A+ LA+  +
Sbjct:   61 WGLLHFVLGKVYYLSMSQVFIEYILAFTSMGLAGSFSDSLIKTLRRQQTFFAVFLAIMAS  120

Query:  136 ILATLVRYVWHYIAGVIFWASYAPKGMSATLYSLSVNGTAGLLTLFFVVISIIILVISYP  195
              +LA  VRY+WH++AG+IFW SYAPKGMSA  YS SVNGTAG+LT   ++++I +   +P
Sbjct:  121 LLAVTVRYLWHFLAGIIFWGSYAPKGMSAVWYSFSVNGTAGVLTFLITCLALMIALPIHP  180

Query:  196 SFFLPK                                                       201
              F  PK
Sbjct:  181 QLFDPK                                                       186
```

Based on this analysis, it was predicted that these proteins and their epitopes could be useful antigens for vaccines or diagnostics.

EXAMPLE 1461

A DNA sequence (GBSx1547) was identified in *S. agalactiae* <SEQ ID 4491> which encodes the amino acid sequence <SEQ ID 4492>. Analysis of this protein sequence reveals the following:

```
Possible site: 34
>>> Seems to have no N-terminal signal sequence
      INTEGRAL    Likelihood = -7.43    Transmembrane    206-222 (199-223)
      INTEGRAL    Likelihood = -6.64    Transmembrane     24-40  (19-42)
      INTEGRAL    Likelihood = -6.58    Transmembrane     61-77  (51-78)
      INTEGRAL    Likelihood = -6.58    Transmembrane    134-150 (132-154)
      INTEGRAL    Likelihood = -4.62    Transmembrane    226-242 (224-245)
      INTEGRAL    Likelihood = -3.72    Transmembrane    107-123 (106-125)

----- Final Results -----
            bacterial membrane --- Certainty = 0.3972(Affirmative) < succ>
             bacterial outside --- Certainty = 0.0000(Not Clear)   < succ>
            bacterial cytoplasm --- Certainty = 0.0000(Not Clear)   < succ>
```

A related GBS nucleic acid sequence <SEQ ID 9749> which encodes amino acid sequence <SEQ ID 9750> was also identified.

The protein has no significant homology with any sequences in the GENPEPT database.

A related DNA sequence was identified in *S. pyogenes* <SEQ ID 4493> which encodes the amino acid sequence <SEQ ID 4494>. Analysis of this protein sequence reveals the following:

```
Possible site: 23
>>> Seems to have no N-terminal signal sequence
      INTEGRAL    Likelihood = -10.46   Transmembrane    134-150 (131-159)
      INTEGRAL    Likelihood =  -7.59   Transmembrane    107-123 (103-128)
      INTEGRAL    Likelihood =  -7.48   Transmembrane    225-241 (213-248)
      INTEGRAL    Likelihood =  -7.22   Transmembrane    205-221 (199-224)
```

```
     INTEGRAL    Likelihood = -3.56     Transmembrane     50-66 (50-73)
     INTEGRAL    Likelihood = -1.28     Transmembrane     16-32 (16-33)

----- Final Results -----
              bacterial membrane  --- Certainty = 0.5182(Affirmative) < succ>
              bacterial outside   --- Certainty = 0.0000(Not Clear)   < succ>
              bacterial cytoplasm --- Certainty = 0.0000(Not Clear)   < succ>
```

The protein has no significant homology with any sequences in the GENPEPT database.

An alignment of the GAS and GBS proteins is shown below.

```
Identities = 82/253 (32%), Positives = 149/253 (58%), Gaps = 5/253 (1%)

Query:    6 IKQSDTTFVRIIKSLLIGGFIGAILGSVGALFIIF--GQDKYLSEI--NIVQYFLWVSRI   61
            +K+   +F+R++K  L+    G I+G +   F+ +   G+   +L+ +   +++   + ++R+
Sbjct:    1 MKKKKNSFLRLLKMSLLSSLAGGIIGGMVGAFLGYHGGRLDHLTFLKDDVINLIILLNRL   60

Query:   62 VVIITALFSLIYLYQIQKYQKVFFNVDESQ-SEEIYRQINLRHSYGMTFVSISIVLSIVN  120
            VV+     S ++L Q++K   V+   ++E   SE  YRQ+N +H+Y M  ++++ +LS+ N
Sbjct:   61 VVVTDLTLSFVFLTQLKKETAVYNTIEEDDISENGYRQLNKKHAYTMLLIAVASILSMCN  120

Query:  121 TLFNYKLNIFDDSVTLVIPIYDLSLLFVLLGLHIYFLKVYRNIRGIKMTVAPTLKELKNN  180
                L   L          L IP+ D+ LL +++      +K Y  IRG  +   P LKELK+N
Sbjct:  121 VLLGLTLTNDSQHAMLAIPLLDILLLLMVIPFQALAMKRYNAIRGTDVPYFPNLKELKHN  180

Query:  181 VLQLDEAELESNYKMCFDIVMNLSGFIFPTIYFVLFFISFVFQKVEIVAIIITTSIHIYI  240
            ++ LDEAEL++ +K   F+  V++L+G I P++Y +LFF+       +VE+ AI++    I +Y+
Sbjct:  181 IMALDEAELQAYHKTSFESVLSLNGVIIPSLYVILFFVYLFTGQVELTAILVLVLIQLYL  240

Query:  241 LIKSLKAARHFYR                                                253
            L+KS    R FYR
Sbjct:  241 LVKSATMTRQFYR                                                253
```

Based on this analysis, it was predicted that these proteins and their epitopes could be useful antigens for vaccines or diagnostics.

EXAMPLE 1462

A DNA sequence (GBSx1548) was identified in *S. agalactiae* <SEQ ID 4495> which encodes the amino acid sequence <SEQ ID 4496>. Analysis of this protein sequence reveals the following:

```
Possible site: 57
>>> Seems to have no N-terminal signal sequence

----- Final Results -----
              bacterial cytoplasm --- Certainty = 0.5172(Affirmative) < succ>
              bacterial membrane  --- Certainty = 0.0000(Not Clear)   < succ>
              bacterial outside   --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1463

A DNA sequence (GBSx1549) was identified in *S. agalactiae* <SEQ ID 4497> which encodes the amino acid sequence <SEQ ID 4498>. Analysis of this protein sequence reveals the following:

```
Possible site: 26
>>> Seems to have no N-terminal signal sequence

----- Final Results -----
            bacterial cytoplasm --- Certainty = 0.2059(Affirmative) < succ>
             bacterial membrane --- Certainty = 0.0000(Not Clear)   < succ>
              bacterial outside --- Certainty = 0.0000(Not Clear)   < succ>
```

The protein has homology with the following sequences in the GENPEPT database.

```
>GP: AAC76650 GB: AE000440
   UDP-D-glucose: (galactosyl)lipopolysaccharide
   glucosyltransferase [Escherichia coli K12]
Identities = 70/256 (27%), Positives = 121/256 (46%), Gaps = 14/256 (5%)

Query:   1 MNLLFSIDDMYVDHFKVMLYSLVRQTKNRKLEIYVLQKT----LLKRHTELIQYTQNLEV  56
           +N+ + +D  Y+D   V + S+V    ++  L+ Y++         ++  +L +  Q
Sbjct:  28 LNVAYGVDANYLDGVGVSITSIVLNNRHINLDFYIIADVYNDGFFQKIAKLAEQNQLRIT  87

Query:  57 GYHPIIVGTEVFAQAPTTDRYPDTIYYRLLAHKFLPETLDRILYLDADMLCLNDWSSLYD 116
             Y   + T+     P T +    +Y+RL A + L   TLDR+LYLDAD++C   D S L
Sbjct:  88 LYR---INTDKLQCLPCTQVWSRAMYFRLFAFQLLGLTLDRLLYLDADVVCKGDISQLLH 144

Query: 117 MELGDQLYAAASHNTDGKFLDYVNKLRLKNVELESSYFNTGVLLMNLPAIRKVVHQQTIL 176
            + L       A A+   D + +       RL + EL    YFN+GV+ ++L         + L
Sbjct: 145 LGLNG---AVAAVVKDVEPMQEKAVSRLSDPELLGQYFNSGVVYLDLKKWADAKLTEKAL 201

Query: 177 DYIMQNRGRLILPDQDILNGLYANLVKPIPDEIYNYDARYSLIYQLKSRNEWDLEWVINH 236
            +M           PDQD++N L   +   +P E     Y+  Y++   +LK +    + + +I
Sbjct: 202 SILMSKDNVYKYPDQDVMNVLLKGMTLFLPRE---YNTIYTIKSELKDKTHQNYKKLITE 258

Query: 237 -TVFLHFAGRDKPWKK                                             251
             T+ +H+  G   KPW K
Sbjct: 259 STLLIHYTGATKPWHK                                             274
```

No corresponding DNA sequence was identified in *S. pyogenes*.

Based on this analysis, it was predicted that this protein and its epitopes, could be useful antigens for vaccines or diagnostics.

EXAMPLE 1464

A DNA sequence (GBSx1550) was identified in *S. agalactiae* <SEQ ID 4499> which encodes the amino acid sequence <SEQ ID 4500>. Analysis of this protein sequence reveals the following:

```
Possible site: 20
>>> Seems to have no N-terminal signal sequence

----- Final Results -----
            bacterial cytoplasm --- Certainty = 0.1406(Affirmative) < succ>
             bacterial membrane --- Certainty = 0.0000(Not Clear)   < succ>
              bacterial outside --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1465

A DNA sequence (GBSx1551) was identified in *S. agalactiae* <SEQ ID 4501> which encodes the amino acid sequence <SEQ ID 4502>. Analysis of this protein sequence reveals the following:

```
Possible site: 54
>>> Seems to have an uncleavable N-term signal seq
INTEGRAL Likelihood = -10.72  Transmembrane   7-23  (1-28)
INTEGRAL Likelihood =  -4.30  Transmembrane 222-238 (216-238)
INTEGRAL Likelihood =  -3.66  Transmembrane 151-167 (140-170)
INTEGRAL Likelihood =  -3.50  Transmembrane  35-51  (34-58)
```

```
                           -continued
INTEGRAL Likelihood = -3.35   Transmembrane    71-87  (69-88)
INTEGRAL Likelihood = -3.29   Transmembrane  113-129  (113-132)
INTEGRAL Likelihood = -2.81   Transmembrane  170-186  (168-190)
INTEGRAL Likelihood = -2.71   Transmembrane  198-214  (197-217)

----- Final Results -----
            bacterial membrane  --- Certainty = 0.5288 (Affirmative) < succ>
              bacterial outside --- Certainty = 0.0000 (Not Clear)   < succ>
            bacterial cytoplasm --- Certainty = 0.0000 (Not Clear)   < succ>
```

The protein has homology with the following sequences in the GENPEPT database.

```
>GP: BAB07774 GB: AP001520 unknown conserved protein [Bacillus halodurans]
Identities = 84/242 (34%), Positives = 147/242 (60%), Gaps = 16/242 (6%)

Query:   1 MVGLGTVINVILIIVGGFVGLFLKNFLKESLQKSLMQAMGVAVLFISISGVLEKMMLVEK    60
           MV +GTV+N   I++   +GL +KN + E ++ +LMQA+G+A++ + +    KM L   +
Sbjct:   1 MVLIGTVVNGAAIVIAALIGLLVKN-IPERVKTTLMQAIGLAIVLLGV-----KMGLQTE   54

Query:  61 SHLISNHTNMMIITLALGTVLGELLSLDSYIDKFGNYLKQKTGSGNDIKFVEAFVTSTCT  120
           L I        +I +L +G V+GE+++L+    +D   G  +++ K G     D    AFVT+T
Sbjct:  55 QFLI------VICSLVIGGVIGEMINLEKRLDHLGRWIESKVGGKKDGSIATAFVTTTLI  108

Query: 121 VCIGAMAVVGSIQDGIAADHSILFAKGMLDMIIIAIMTVSLGKGALFSALPVALLQGSLT  180
           +GAMAV+G++   G+   DHS+L  K +LD    +   + T  +LG G LFSA+PV  L  QGS+
Sbjct: 109 YVVGAMAVLGALDSGLRGDHSVLLTKALLDGFLAILFTSTLGIGVLFSAIPVVLYQGSIA  168

Query: 181 IVAF----FMGSLLNPSSLDYLNLVGNMLIFCVGVNLLFNLNIKVINMLPAIILAILWGS  236
            + A      ++ + L  S +  ++   G  ++I  +G+NLL  +NI+V  N+LP++++   +   +
Sbjct: 169 LFASQIDQYVPTALMDSFITEMSATGGVMIVAIGLNLLNVVNIRVANLLPSLVIVAVLVT  228

Query: 237 FI                                                            238
           F+
Sbjct: 229 FV                                                            230
```

No corresponding DNA sequence was identified in S. pyogenes.

Based on this analysis, it was predicted that this protein and its epitopes, could be useful antigens for vaccines or diagnostics.

EXAMPLE 1466

A DNA sequence (GBSx1552) was identified in S. agalactiae <SEQ ID 4503> which encodes the amino acid sequence <SEQ ID 4504>. This protein is predicted to be alanyl-tRNA synthetase (alaS). Analysis of this protein sequence reveals the following:

```
Possible site: 49
>>> Seems to have no N-terminal signal sequence
INTEGRAL Likelihood = -4.41 Transmembrane 805-821 (804-822)

----- Final Results -----
            bacterial membrane  --- Certainty = 0.2763 (Affirmative) < succ>
              bacterial outside --- Certainty = 0.0000 (Not Clear)   < succ>
            bacterial cytoplasm --- Certainty = 0.0000 (Not Clear)   < succ>
```

The protein has homology with the following sequences in the GENPEPT database.

```
>GP: BAB04986 GB: AP001511 alanyl-tRNA synthetase [Bacillus halodurans]
Identities = 482/885 (54%), Positives = 618/885 (69%), Gaps = 27/885 (3%)
Query:   1 MKELSSAQIRQMWLDFWKSKGHSVEPSANLVPVNDPTLLWINSGVATLKKYFDGSVIPEN   60
           MK L+SAQ+RQM+LDF+K KGH VEPSA+LVP +DP+LLWINSGVATLKKYFDG VIPEN
Sbjct:   1 MKYLTSAQVRQMFLDFFKEKGHDVEPSASLVPHDDPSLLWINSGVATLKKYFDGRVIPEN   60

Query:  61 PRITNAQKSIRTNDIENVGKTARHHTMFEMLGNFSIGDYFRDEAIEWGFELLTSPEWFDF  120
           PRITNAQKSIRTNDIENVGKTARHHT FEMLGNFSIGDYF++EAIEW +E LTS +W  F
Sbjct:  61 PRITNAQKSIRTNDIENVGKTARHHTFFEMLGNFSIGDYFKEEAIEWAWEFLTSEKWIGF  120
```

-continued

```
Query: 121 PKDKLYMTYYPDDKDSYNRWIA-CGVEPSHLVPIEDNFWEIGAGPSGPDTEIFFDRGEDF 179
            K+KL +T +P+D ++Y+ W    G+    ++ +E NFW+IG GPSGP+TEIF+DRG ++
Sbjct: 121 DKEKLSVTVHPEDDEAYSYWKEKIGIPEERIIRLEGNFWDIGEGPSGPNTEIFYDRGPEY 180

Query: 180 -----DPENIGLRLLAEDIENDRYIEIWNIVLSQFNADPAVPRSEYKELPNKNIDTGAGL 234
                 DPE    L   ENDRY+E+WN+V SQFN +P      Y  LP KNIDTG GL
Sbjct: 181 GDQPNDPE------LYPGGENDRYLEVWNLVFSQFNHNPD---GSYTPLPKKNIDTGMGL 231

Query: 235 ERLAAVMQGAKTNFETDLFMPIIREVEKLSGKTYDPDGD-NMSFKVIADHIRALSFAIGD 293
            ER+ +V+Q   TNFETDLFMPIIR  EK+SG Y     + ++SFKVIADHIR ++FAIGD
Sbjct: 232 ERMVSVIQNVPTNFETDLFMPIIRATEKISGTEYGSHHEADVSFKVIADHIRTVTFAIGD 291

Query: 294 GALPGNEGRGYVLRRLLRRAVMHGRRLGINETFLYKLVPTVGQIMESYYPEVLEKRDFIE 353
            GALP NEGRGYVLRRLLRRAV + +++GI+ F+Y+LVP VG IM  +YPEV EK  FI+
Sbjct: 292 GALPSNEGRGYVLRRLLRRAVRYAKQIGIDRPFMYELVPVVGDIMVDFYPEVKEKAAFIQ 351

Query: 354 KIVKREEETFARTIDAGSGHLDSLLAQLKAEGKDTLEGKDIFKLYDTYGFPVELTEELAE 413
            K+VK EEE F  T++ G   L+ ++ + K+EG  T+ G D+F+LYDTYGFPV+LTEE  E
Sbjct: 352 KVVKTEEERFHETLNEGLSILEKVIDKAKSEGASTISGSDVFRLYDTYGFPVDLTEEYVE 411

Query: 414 DAGYKIDHEGFKSAMKEQQDRARAAVVKGGSMGMQNETLAGIVEESRF-EYDTYSLESSL 472
             + G ++D +GF++ M+ Q++RAR A  + GSM +Q+E L   I  +S F Y    S E+++
Sbjct: 412 EQGLQVDLDGFEAEMERQRERARTARQQAGSMQVQDEVLGQITVDSTFIGYKQLSTETTI 471

Query: 473 SVIIADNERTEAVSEGQ-ALLVFAQTPFYAEMGGQVADHGVIKNDKGDTVAEVVDVQKAP 531
                I+ D    + V GQ A ++  +TPFYAE GGQVAD G+I+   G   V  VDVQKAP
Sbjct: 472 ETIVLDKTVADYVGAGQEAKVILKETPFYAESGGQVADKGIIRGANGFAV--VSDVQKAP 529

Query: 532 NGQPLHTVNVL-ASLSVGTNYTLEINKERRLAVEKNHTATHLLHAALHNVIGEHATQAGS 590
            NGQ LHTV V  +L V     + + R + KNHTATHLLH AL +V+GEH  QAGS
Sbjct: 530 NGQHLHTVIVKEGTLQVNDQVQAIVEETERSGIVKNHTATHLLHRALKDVLGEHVNQAGS 589

Query: 591 LNEEEFLRFDFTHFEAVSNEELRHIEQEVNEQIWNDLTITTTETDVETAKEMGAMALFGE 650
            L    EE LRFDF+HF V++EE   IE+ VNE+IW + +  +    ++ AK +GAMALFGE
Sbjct: 590 LVSEERLRFDFSHFGQVTDEEKEKIERIVNEKIWQAIKVNISTKTLDEAKAIGAMALFGE 649

Query: 651 KYGKVVRVVQIGNYSVELCGGTHLNNSSEIGLFKIVKEEGIGSGTRRIIAVTGRQAFEAY 710
            KYG +VRVV++G+YS+ELCGG H+ N+SEIGLFKIV E GIG+G RRI AVTG++AF
Sbjct: 650 KYGDIVRVVEVGDYSIELCGGHVTNTSEIGLFKIVSESGIGAGVRRIEAVTGKEAFLFM 709

Query: 711 RNQEDALKEIAATVKAPQLKDAAAKVQALSDSLRDLQKENVELKEKAAAAAAGDVFKDIQ 770
              Q D LKE AATVKA +KD  +V+AL  +R+LQ+EN L  K    AG +   ++Q
Sbjct: 710 AKQLDLLKETAATVKAKNVKDVPVRVEALQQQIRELQRENESLNAKLGNMEAGSLVNEVQ 769

Query: 771 EAKGVRFIASQVDVADAGALRTFADNWKQKDYSDVLVLVAAIGEKVNVLVASKTKDV--- 827
             + +GV +A  +AD  LR+  D KQ+  S V+L A   KVN+ VA  TKD+
Sbjct: 770 KIEGVPVLAKAISGADMDGLRSIVDKLKQEIPSVVIVLGTASEGKVNI-VAGVTKDLINK 828

Query: 828 --HAGNMIKGLAPIVAGRGGGKPDMAMAGGSDASKIAELLAAVAE              870
              HAG ++K +A   G GGG+PDMA AGG    K+ + L+ V E
Sbjct: 829 GYHAGKLVKEVATRCGGGGGRPDMAQAGGKQPEKLQDALSFVYE                 873
```

A related DNA sequence was identified in *S. pyogenes* <SEQ ID 4505> which encodes the amino acid sequence <SEQ ID 4506>. Analysis of this protein sequence reveals the following:

```
Possible site: 21
>>> Seems to have no N-terminal signal sequence
INTEGRAL Likelihood = -4.41 Transmembrane 805-821 (804-822)

----- Final Results -----
          bacterial membrane --- Certainty = 0.2763 (Affirmative) < succ>
          bacterial outside  --- Certainty = 0.0000 (Not Clear)   < succ>
          bacterial cytoplasm --- Certainty = 0.0000 (Not Clear)   < succ>
```

An alignment of the GAS and GBS proteins is shown below.

```
Identities = 862/870 (99%), Positives = 864/870 (99%)

Query:   1 MKELSSAQIRQMWLDFWKSKGHSVEPSANLVPVNDPTLLWINSGVATLKKYFDGSVIPEN  60
           MKELSSAQIRQMWLDFWKSKGH VEPSANLVPVNDPTLLWINSGVATLKKYFDGSVIPEN
Sbjct:   1 MKELSSAQIRQMWLDFWKSKGHCVEPSANLVPVNDPTLLWINSGVATLKKYFDGSVIPEN  60
```

-continued

```
Query:   61 PRITNAQKSIRTNDIENVGKTARHHTMFEMLGNFSIGDYFRDEAIEWGFELLTSPEWFDF  120
            PRITNAQKSIRTNDIENVGKTARHHTMFEMLGNFSIGDYFRDEAIEWGFELLTSP+WFDF
Sbjct:   61 PRITNAQKSIRTNDIENVGKTARHHTMFEMLGNFSIGDYFRDEAIEWGFELLTSPDWFDF  120

Query:  121 PKDKLYMTYYPDDKDSYNRWIACGVEPSHLVPIEDNFWEIGAGPSGPDTEIFFDRGEDFD  180
            PKDKLYMTYYPDDKDSYNRWIACGVEPSHLVPIEDNFWEIGAGPSGPDTEIFFDRGEDFD
Sbjct:  121 PKDKLYMTYYPDDKDSYNRWIACGVEPSHLVPIEDNFWEIGAGPSGPDTEIFFDRGEDFD  180

Query:  181 PENIGLRLLAEDIENDRYIEIWNIVLSQFNADPAVPRSEYKELPNKNIDTGAGLERLAAV  240
            PENIGLRLLAEDIENDRYIEIWNIVLSQFNADPAVPRSEYKELPNKNIDTGAGLERLAAV
Sbjct:  181 PENIGLRLLAEDIENDRYIEIWNIVLSQFNADPAVPRSEYKELPNKNIDTGAGLERLAAV  240

Query:  241 MQGAKTNFETDLFMPIIREVEKLSGKTYDPDGDNMSFKVIADHIRALSFAIGDGALPGNE  300
            MQGAKTNFETDLFMPIIREVEKLSGKTYDPDGDNMSFKVIADHIRALSFAIGDGALPGNE
Sbjct:  241 MQGAKTNFETDLFMPIIREVEKLSGKTYDPDGDNMSFKVIADHIRALSFAIGDGALPGNE  300

Query:  301 GRGYVLRRLLRRAVMHGRRLGINETFLYKLVPTVGQIMESYYPEVLEKRDFIEKIVKREE  360
            GRGYVLRRLLRRAVMHGRRLGINETFLYKLVPTVGQIMESYYPEVLEKRDFIEKIVKREE
Sbjct:  301 GRGYVLRRLLRRAVMHGRRLGINETFLYKLVPTVGQIMESYYPEVLEKRDFIEKIVKREE  360

Query:  361 ETFARTIDAGSGHLDSLLAQLKAEGKDTLEGKDIFKLYDTYGFPVELTEELAEDAGYKID  420
            ETFARTIDAGSGHLDSLLAQLKAEGKDTLEGKDIFKLYDTYGFPVELTEELAEDAGYKID
Sbjct:  361 ETFARTIDAGSGHLDSLLAQLKAEGKDTLEGKDIFKLYDTYGFPVELTEELAEDAGYKID  420

Query:  421 HEGFKSAMKEQQDRARAAVVKGGSMGMQNETLAGIVEESRFEYDTYSLESSLSVIIADNE  480
            HEGFKSAMKEQQDRARAAVVKGGSMGMQNETLAGIVEESRFEYDTYSLESSLSVIIADNE
Sbjct:  421 HEGFKSAMKEQQDRARAAVVKGGSMGMQNETLAGIVEESRFEYDTYSLESSLSVIIADNE  480

Query:  481 RTEAVSEGQALLVFAQTPFYAEMGGQVADHGVIKNDKGDTVAEVVDVQKAPNGQPLHTVN  540
            RTEAVSEGQALLVFAQTPFYAEMGGQVAD G IKNDKGDTVAEVVDVQKA NGQPLHTVN
Sbjct:  481 RTEAVSEGQALLVFAQTPFYAEMGGQVADTGRIKNDKGDTVAEVVDVQKAPNGQPLHTVN  540

Query:  541 VLASLSVGTNYTLEINKERRLAVEKNHTATHLLHAALHNVIGEHATQAGSLNEEEFLRFD  600
            VLASLSVGTNYTLEINKERRLAVEKNHTATHLLHAALHNVIGEHATQAGSLNEEEFLRFD
Sbjct:  541 VLASLSVGTNYTLEINKERRLAVEKNHTATHLLHAALHNVIGEHATQAGSLNEEEFLRFD  600

Query:  601 FTHFEAVSNEELRHIEQEVNEQIWNDLTITTTETDVETAKEMGAMALFGEKYGKVVRVVQ  660
            FTHFEAVSNEELRHIEQEVNEQIWN LTITTTETDVETAKEMGAMALFGEKYGKVVRVVQ
Sbjct:  601 FTHFEAVSNEELRHIEQEVNEQIWNALTITTTETDVETAKEMGAMALFGEKYGKVVRVVQ  660

Query:  661 IGNYSVELCGGTHLNNSSEIGLFKIVKEEGIGSGTRRIIAVTGRQAFEAYRNQEDALKEI  720
            IGNYSVELCGGTHLNNSSEIGLFKIVKEEGIGSGTRRIIAVTGRQAFEAYRNQEDALKEI
Sbjct:  661 IGNYSVELCGGTHLNNSSEIGLFKIVKEEGIGSGTRRIIAVTGRQAFEAYRNQEDALKEI  720

Query:  721 AATVRAPQLKDAAAKVQALSDSLRDLQKENVELKEKAAAAAAGDVEKDIQEAKGVRFIAS  780
            AATVKAPQLKDAAAKVQALSDSLRDLQKEN ELKEKAAAAAGDVFKD+QEAKGVRFIAS
Sbjct:  721 AATVKAPQLKDAAAKVQALSDSLRDLQKENAELKEKAAAAAGDVFKDVQEAKGVRFIAS  780

Query:  781 QVDVADAGALRTFADNWKQKDYSDVLVLVAAIGEKVNVLVASKTKDVHAGNMIKGLAPIV  840
            QVDVADAGALRTFADNWKQKDYSDVLVLVAAIGEKVNVLVASKTKDVHAGNNIK LAPIV
Sbjct:  781 QVDVADAGALRTFADNWKQKDYSDVLVLVAAIGEKVNVLVASKTKDVHAGNMIKELAPIV  840

Query:  841 AGRGGGKPDMAMAGGSDASKIAELLAAVAE                               870
            AGRGGGKPDMAMAGGSDASKIAELLAAVAE
Sbjct:  841 AGRGGGKPDMAMAGGSDASKIAELLAAVAE                               870
```

Based on this analysis, it was predicted that these proteins and their epitopes could be useful antigens for vaccines or diagnostics.

EXAMPLE 1467

A DNA sequence (GBSx1553) was identified in *S. agalactiae* <SEQ ID 4507> which encodes the amino acid sequence <SEQ ID 4508>. Analysis of this protein sequence reveals the following:

```
Possible site: 56
>>> Seems to have no N-terminal signal sequence

----- Final Results -----
            bacterial cytoplasm --- Certainty = 0.2974 (Affirmative) < succ>
            bacterial membrane --- Certainty = 0.0000 (Not Clear) < succ>
            bacterial outside --- Certainty = 0.0000 (Not Clear) < succ>
```

A related GBS nucleic acid sequence <SEQ ID 9747> which encodes amino acid sequence <SEQ ID 9748> was also identified.

The protein has homology with the following sequences in the GENPEPT database.

```
>GP: CAB15920 GB: Z99123 yxjI [Bacillus subtilis]
Identities = 42/144 (29%), Positives = 73/144 (50%), Gaps = 2/144 (1%)

Query:   17 IKEKMFSLGGKFTITDLTGLPCYHVEGSLFPLPKTFKVFDEEEHLISQIEKKVLSFLPKF    76
            +K+KMFS   F I D     + VEG  F L  + ++ D     + IE+K++S LP++
Sbjct:    6 MKQKMFSFKDAFHIYDRDEQETFKVEGRFFSLGDSLQMTDSSGKTLVSIEQKLMSLLPRY   65

Query:   77 NVTLANGNHFTIKKDFSFLKPHYTIEDLDMEVKGNFWDMDFQLLKDNQVIANISQQWFRN   136
            +++           + K  +F KP + I   L+ E+ G+ W  +FQL     V  ++S++W
Sbjct:   66 EISIGGKTVCEVTKKVTFSKPKFVISGLNWEIDGDLWRDEFQLTDGENVRMSVSKKWLSW  125

Query:  137 TSTYQVEVYSETYNDLTISLVIAI                                     160
            +Y +++  E   D+ I   IAI
Sbjct:  126 GDSYHLQIAYE--EDVLICTAIAI                                     147
```

No corresponding DNA sequence was identified in *S. pyogenes*.

Based on this analysis, it was predicted that these proteins and their epitopes could be useful antigens for vaccines or diagnostics.

EXAMPLE 1468

A DNA sequence (GBSx1554) was identified in *S. agalactiae* <SEQ ID 4509> which encodes the amino acid sequence <SEQ ID 4510>. Analysis of this protein sequence reveals the following:

```
Possible site: 30
>>> Seems to have no N-terminal signal sequence

----- Final Results -----
            bacterial cytoplasm --- Certainty = 0.3833 (Affirmative) < succ>
            bacterial membrane  --- Certainty = 0.0000 (Not Clear)   < succ>
            bacterial outside   --- Certainty = 0.0000 (Not Clear)   < succ>
```

The protein has homology with the following sequences in the GENPEPT database.

```
>GP: BAA36674 GB: AB016282 ORF17 [bacteriophage phi-105]
Identities = 45/133 (33%), Positives = 74/133 (54%), Gaps = 5/133 (3%)

Query:    2 KYTYLALFEVDKENGGYNISFPDFHGAFSEADSLNEAIFNAREVLEIYTIMFEDEGKEFP    61
            +Y Y ALF+ D +  G  ++FPD   G  +  +S  EA+  A+E + ++    FE +G    P
Sbjct:    5 RYIYPALFDYDDD--GITVTFPDLPGCITFGNSGGEALTMAKEAMALHLYGFEQDGDIIP    62

Query:   62 KASSFKALASNLASDEDVIQAISVDTELVRERERSKIVNKTVTLPSWLVEVGKENKVNFS   121
            +A+   K +     A +   + I       R   + V KT+T+P W+ ++ KE+KVN+S
Sbjct:   63 EATPSKEIK---AEESQSVVLIETWMPPFRHDMENAAVKKTLTIPRWMDDIAKEHKVNYS  119

Query:  122 QLLQKAIREELQV                                                134
            QLLQ+AI+E L +
Sbjct:  120 QLLQEAIKEHLGI                                                132
```

No corresponding DNA sequence was identified in *S. pyogenes*.

Based on this analysis, it was predicted that this protein and its epitopes, could be useful antigens for vaccines or diagnostics.

EXAMPLE 1469

A DNA sequence (GBSx1555) was identified in *S. agalactiae* <SEQ ID 4511> which encodes the amino acid sequence <SEQ ID 4512>. Analysis of this protein sequence reveals the following:

```
Possible site: 26
>>> Seems to have no N-terminal signal sequence

----- Final Results -----
            bacterial cytoplasm --- Certainty = 0.1484 (Affirmative) < succ>
             bacterial membrane --- Certainty = 0.0000 (Not Clear)   < succ>
              bacterial outside --- Certainty = 0.0000 (Not Clear)   < succ>
```

The protein has homology with the following sequences in the GENPEPT database.

```
>GP: BAA25696 GB: AB010712 NADH oxidase/alkyl hydroperoxidase
reductase [Streptococcus mutans]
Identities = 383/509 (75%), Positives = 441/509 (86%)

Query:    1 MVLDKEIKAQLAQYLDLLESDIVLQADLGDNDNSQKVKDFLDEIVAMSDRISLESTHLKR    60
            M LD EIK QL QYL LLES+IVLQA L D+ NSQKVK+FL EIVAMS   ISLE   L R
Sbjct:    1 MALDAEIKEQLGQYLQLLESEIVLQAQLKDDANSQKVKEFLQEIVAMSPMISLEEKELPR    60

Query:   61 QPSFGIAKKGHESRVIFSGLPMGHEFTSFILALLQVSGRAPKVDEDIIKRIKGIEKTINL   120
            +PSF IAKKG ES V F+GLP+GHEFTSFILALLQVSGR PKV+ DI+KRI+ +++ ++
Sbjct:   61 TPSFRIAKKGQESGVEFAGLPLGHEFTSFILALLQVSGRPPKVETDIVKRIQAVDEPMHF   120

Query:  121 ETYVSLTCHNCPDVVQAFNIMAVLNPNITHTMIEGGMYQDEVKSKGIMSVPTVYKDQEEF   180
            ETYVSLTCHNCPDVVQAFNIM+V+NPNI+HTM+EGGM++DE+++KGIMSVPTVYKD  EF
Sbjct:  121 ETYVSLTCHNCPDVVQAFNIMSVVNPNISHTMVEGGMFKDEIEAKGIMSVPTVYKDGTEF   180

Query:  181 TSGRATIEQLLEQLDGPLDAEAFADKGVYDVLVIGGGPAGNSAAIYAARKGLKTGILAET   240
            TSGRA+IEQLL+ + GPL  +AF DKGV+DVLVIGGGPAGNSAAIYAARKG+KTG+LAET
Sbjct:  181 TSGRASIEQLLDLIAGPLKEDAFDDKGVFDVLVIGGGPAGNSAAIYAARKGVKTGLLAET   240

Query:  241 FGGQVIETVGIENMIGTLYTEGPKLMAQIEEHTKSYDIDIIKSQLATGIEKKELVEVTLA   300
              GGQV+ETVGIENMIGT Y EGP+LMAQ+EEHTKSY +DI+K+  A   I+K +LVEV L
Sbjct:  241 MGGQVMETVGIENMIGTPYVEGPQLMAQVEEHTKSYSVDIMKAPRAKSIQKTDLVEVELD   300

Query:  301 NGAILQAKTAILALGAKWRNINVPGEEEFRNKGVTYCPHCDGPLFEGKDVAVIGGGNSGM   360
            NGA L+AKTA+LALGAKWR INVPGE+EF NKGVTYCPHCDGPLF  K VAVIGGGNSG+
Sbjct:  301 NGAHLKAKTAVLALGAKWRKINVPGEKEFFNKGVTYCPHCDGPLFTDKKVAVIGGGNSGL   360

Query:  361 EAALDLAGVTKHVTVLEFLPELKADQVLQERAAKTDNLTILKNVATKDIVGEDHVTGLNY   420
            EAA+DLAG+  HV +LEFLPELKAD++LQ+RA   DN+TIL NVATK+I+G DHV GL Y
Sbjct:  361 EAAIDLAGLASHVYILEFLPELKADKILQDRAEALDNITILTNVATKEIIGNDHVEGLRY   420

Query:  421 TDRDTNEEKHIDLEGVFVQIGLVPSTSWLKDSGIELNERQEIVVDKFGSTNIPGIFAAGD   480
            +DR TNEE  +DLEGVFVQIGLVPST WLKDSG+ LNE+ EI+V K G+TNIP IFAAGD
Sbjct:  421 SDRTTNEEYLLDLEGVFVQIGLVPSTDWLKDSGLALNEKGEIIVAKDGATNIPAIFAAGD   480

Query:  481 CTDAAYKQIIISMGSGATAAIGAFDYLIR                                509
            CTD+AYKQIIISMGSGATAA+GAFDYLIR
Sbjct:  481 CTDSAYKQIIISMGSGATAALGAFDYLIR                                509
```

A related DNA sequence was identified in *S. pyogenes* <SEQ ID 4513> which encodes the amino acid sequence <SEQ ID 4514>. Analysis of this protein sequence reveals the following:

```
Possible site: 29
>>> Seems to have no N-terminal signal sequence

----- Final Results -----
            bacterial cytoplasm --- Certainty = 0.0654 (Affirmative) < succ>
             bacterial membrane --- Certainty = 0.0000 (Not Clear)   < succ>
              bacterial outside --- Certainty = 0.0000 (Not Clear)   < succ>
```

An alignment of the GAS and GBS proteins is shown below.

```
Identities = 419/510 (82%), Positives = 472/510 (92%)

Query:    1 MVLDKEIKAQLAQYLDLLESDIVLQADLGDNDNSQKVKDFLDEIVAMSDRISLESTHLKR    60
            M L +IK QLAQYL LLE+D+VLQ  LGDN+ SQKVKDF++EI AMS+RIS+E+   L R
Sbjct:    1 MALSPDIKEQLAQYLTLLEADLVLQVSLGDNEQSQKVKDFVEEIAAMSERISIENITLDR    60
```

```
-continued
Query:   61 QPSFGIAKKGHESRVIFSGLPMGHEFTSFILALLQVSGRAPKVDEDIIKRIKGIEKTINL  120
            QPSF +AKKGH S V+F+GLP+GHE TSFILALLQVSGRAPKVD+D+I RIK I++ ++
Sbjct:   61 QPSFKVAKKGHGSGVVFAGLPLGHELTSFILALLQVSGRAPKVDQDVIDRIKAIDRPLHF  120

Query:  121 ETYVSLTCHNCPDVVQAFNIMAVLNPNITHTMIEGGMYQDEVKSKGIMSVPTVYKDQEEF  180
            ETYVSLTCHNCPDVVQA NIM+VLN  I+HTM+EGGM+QDEVK+KGIMSVPTV+ D EEF
Sbjct:  121 ETYVSLTCHNCPDVVQALNIMSVLNDKISHTMVEGGMFQDEVKAKGIMSVPTVFLDGEEF  180

Query:  181 TSGRATIEQLLEQLDGPLDAEAFADKGVYDVLVIGGGPAGNSAAIYAARKGLKTGILAET  240
            TSGRATIEQLLEQ+ GPL  EAFADKG+YDVLVIGGGPAGNSAAIYAARKGLKTG +LAET
Sbjct:  181 TSGRATIEQLLEQIAGPLSEEAFADKGLYDVLVIGGGPAGNSAAIYAARKGLKTGLLAET  240

Query:  241 FGGQVIETVGIENMIGTLYTEGPKLMAQIEEHTKSYDIDIIKSQLATGIEKKELVEVTLA  300
            FGGQV+ETVGIENMIGTLYTEGPKLMA++E HTKSYD+DIIK+QLAT IEKKE +EVTLA
Sbjct:  241 FGGQVMETVGIENMIGTLYTEGPKLMAEVEAHTKSYDVDIIKAQLATSIEKKENIEVTLA  300

Query:  301 NGAILQAKTAILALGAKWRNINVPGEEEFRNKGVTYCPHCDGPLFEGKDVAVIGGGNSGM  360
            NGA+LQAKTAILALGAKWRNINVPGE+EFRNKGVTYCPHCDGPLFEGKDVAVIGGGNSG+
Sbjct:  301 NGAVLQAKTAILALGAKWRNINVPGEDEFRNKGVTYCPHCDGPLFEGKDVAVIGGGNSGL  360

Query:  361 EAALDLAGVTKHVTVLEFLPELKADQVLQERAAKTDNLTILKNVATKDIVGEDHVTGLNY  420
            EAALDLAG+ KHV VLEFLPELKAD+VLQ+RAAKT+N+TI+KNVATKDIVGEDHVTGLNY
Sbjct:  361 EAALDLAGLAKHVYVLEFLPELKADKVLQDRAAKTNNMTIIKNVATKDIVGEDHVTGLNY  420

Query:  421 TDRDTNEEKHIDLEGVFVQIGLVPSTSWLKDSGIELNERQEIVVDKFGSTNIPGIFAAGD  480
            T+RD+ E+KH+DLEGVFVQIGLVP+T+WLKDSG+ L +R EI+VDK GSTNIPGIFAAGD
Sbjct:  421 TERDSGEDKHLDLEGVFVQIGLVPNTAWLKDSGVNLTDRGEIIVDKHGSTNIPGIFAAGD  480

Query:  481 CTDAAYKQIIISMGSGATAAIGAFDYLIRQ                                510
            CTD+AYKQIIISMGSGATAAIGAFDYLIRQ
Sbjct:  481 CTDSAYKQIIISMGSGATAAIGAFDYLIRQ                                510
```

Based on this analysis, it was predicted that these proteins and their epitopes could be useful antigens for vaccines or diagnostics.

EXAMPLE 1470

A DNA sequence (GBSx1556) was identified in *S. agalactiae* <SEQ ID 4515> which encodes the amino acid sequence <SEQ ID 4516>. Analysis of this protein sequence reveals the following:

```
Possible site: 15
>>> Seems to have no N-terminal signal sequence

----- Final Results -----
            bacterial cytoplasm --- Certainty = 0.2906 (Affirmative) < succ>
            bacterial membrane  --- Certainty = 0.0000 (Not Clear)   < succ>
             bacterial outside  --- Certainty = 0.0000 (Not Clear)   < succ>
```

The protein has homology with the following sequences in the GENPEPT database.

```
>GP: BAA25695 GB: AB010712 alkyl hydroperoxidase [Streptococcus mutans]
Identities = 167/186 (89%), Positives = 179/186 (95%)

Query:    1 MSLVGKEIIEFSAQAYHDGKFITVTNEDVKGKWAVFCFYPADFSFVCPTELGDLQEQYET   60
            MSLVGKE++EFSAQAYH G+F+TV NEDVKGKWAVFCFYPADFSFVCPTELGDLQEQY T
Sbjct:    1 MSLVGKEMVEFSAQAYHQGEFVTVNNEDVKGKWAVFCFYPADFSFVCPTELGDLQEQYAT   60

Query:   61 LKSLDVEVYSVSTDTHFVHKAWHDDSDVVGTITYPMIGDPSHLISQGFDVLGQDGLAQRG  120
            L+SL VEVYSVSTDTHFVHKAWHDDSDVVGTITY MIGDPSH++SQGF+VLG+DGLAQRG
Sbjct:   61 LQSLGVEVYSVSTDTHFVHKAWHDDSDVVGTITYTMIGDPSHVLSQGFEVLGEDGLAQRG  120

Query:  121 TFIIDPDGVIQMMEINADGIGRDASTLIDKVRAAQYIRQHTGEVCPAKWKEGAETLTPSL  180
            TFI+DPDG IQMME+NADGIGRDASTLIDKVRAAQYIRQH GEVCPAKWKEGAETL PSL
Sbjct:  121 TFIVDPDGIIQMMEVNADGIGRDASTLIDKVRAAQYIRQHPGEVCPAKWKEGAETLKPSL  180

Query:  181 DLVGKI                                                       186
            DLVGKI
Sbjct:  181 DLVGKI                                                       186
```

A related DNA sequence was identified in *S. pyogenes* <SEQ ID 4517> which encodes the amino acid sequence <SEQ ID 4518>. Analysis of this protein sequence reveals the following:

```
Possible site: 15
>>> Seems to have no N-terminal signal sequence

----- Final Results -----
            bacterial cytoplasm --- Certainty = 0.3022 (Affirmative) < succ>
             bacterial membrane --- Certainty = 0.0000 (Not Clear)   < succ>
              bacterial outside --- Certainty = 0.0000 (Not Clear)   < succ>
```

An alignment of the GAS and GBS proteins is shown below.

```
Identities = 173/186 (93%), Positives = 181/186 (97%)

Query:   1 MSLVGKEIIEFSAQAYHDGKFITVTNEDVKGKWAVFCFYPADFSFVCPTELGDLQEQYET  60
           MSL+GKEI EFSAQAYHDGKFITVTNEDVKGKWAVFCFYPADFSFVCPTELGDLQEQYET
Sbjct:   1 MSLIGKEIAEFSAQAYHDGKFITVTNEDVKGKWAVFCFYPADFSFVCPTELGDLQEQYET  60

Query:  61 LKSLDVEVYSVSTDTHFVHKAWHDDSDVVGTITYPMIGDPSHLISQGFDVLGQDGLAQRG 120
           LKSL VEVYSVSTDTHFVHKAWHDDSDVVGTITYPMIGDPSHLISQ F+VLG+DGLAQRG
Sbjct:  61 LKSLGVEVYSVSTDTHFVHKAWHDDSDVVGTITYPMIGDPSHLISQAFEVLGEDGLAQRG 120

Query: 121 TFIIDPDGVIQMMEINADGIGRDASTLIDKVRAAQYIRQHTGEVCPAKWKEGAETLTPSL 180
           TFI+DPDG+IQMMEINADGIGRDASTLIDK+ AAQY+R+H GEVCPAKWKEGAETLTPSL
Sbjct: 121 TFIVDPDGIIQMMEINADGIGRDASTLIDKIHAAQYVRKHPGEVCPAKWKEGAETLTPSL 180

Query: 181 DLVGKI 186
           DLVGKI
Sbjct: 181 DLVGKI 186
```

Based on this analysis, it was predicted that these proteins and their epitopes could be useful antigens for vaccines or diagnostics.

EXAMPLE 1471

A DNA sequence (GBSx1557) was identified in *S. agalactiae* <SEQ ID 4519> which encodes the amino acid sequence <SEQ ID 4520>. This protein is predicted to be 30S ribosomal protein S2 (rpsB). Analysis of this protein sequence reveals the following:

```
Possible site: 60
>>> Seems to have no N-terminal signal sequence

----- Final Results -----
            bacterial cytoplasm --- Certainty = 0.4462 (Affirmative) < succ>
             bacterial membrane --- Certainty = 0.0000 (Not Clear)   < succ>
              bacterial outside --- Certainty = 0.0000 (Not Clear)   < succ>
```

The protein has homology with the following sequences in the GENPEPT database.

```
>GP: CAA50276 GB: X70925 30S ribosomal protein [Pediococcus
acidilactici]
Identities = 190/260 (73%), Positives 226/260 (86%), Gaps = 4/260 (1%)

Query:   1 MAVISMKQLLEAGVHFGHQTRRWNPKMAKYIFTERNGIHVIDLQQTVKLADQAYEFVRDA  60
           M+VISMKQLLEAGVHFGHQTRRWNPKM  +IFTERNGI++IDLQ+TVKL D AY FV+D
Sbjct:   1 MSVISMKQLLEAGVHFGHQTRRWNPKMKPFIFTERNGIYIIDLQKTVKLIDNAYNFVKDV  60

Query:  61 AANDAVILFVGTKKQAAEAVAEEEAKRAGQYFINHRWLGGTLTNWGTIQKRIARLKEIKRM 120
           AAND V+LFVGTKKQA  A+ EEAKRAGQ+++NHRWLGGTLTNW TIQKRI RLK++K+M
Sbjct:  61 AANDGVVLFVGTKKQAQTAIEEEAKRAGQFYVNHRWLGGTLTNWNTIQKRIKRLKDLKKM 120

Query: 121 EEEGTFELLPKKEVALLNKQRARLEKFLGGIEDMPRIPDVMYVVDPHKEQIAVKEAKKLG 180
           EE+GTF+ LPKKEVALLNKQ+ +LEKFLGGIEDMP IPDV++VVDP KEQIA+KEA+KL
Sbjct: 121 EEDGTFDRLPKKEVALLNKQKDKLEKFLGGIEDMPHIPDVLFVVDPRKEQIAIKEAQKLN 180
```

```
Query: 181 IPVVAMVDTNADPDDIDVIIPANDDAIRAVKLITSKLADAVIEGRQGEDADV----DFAQ    236
           IPVVAMVDTN DPD +DVIIP+NDDAIRAV+LITSK+ADAV+EGRQGED +     + A+
Sbjct: 181 IPVVAMVDTNTDPDQVDVIIPSNDDAIRAVRLITSKMADAVVEGRQGEDDEAVQQEEVAE   240

Query: 237 EAQADSIEEIVEVVEGSNND                                          256
           DS+E++ + VE  +N+
Sbjct: 241 GVSKDSLEDLKKTVEEGSNE                                          260
```

A related DNA sequence was identified in *S. pyogenes* <SEQ ID 4521> which encodes the amino acid sequence <SEQ ID 4522>. Analysis of this protein sequence reveals the following:

```
Possible site: 60
>>> Seems to have no N-terminal signal sequence

----- Final Results -----
            bacterial cytoplasm --- Certainty = 0.4462(Affirmative) < succ>
            bacterial membrane  --- Certainty = 0.0000(Not Clear)   < succ>
             bacterial outside  --- Certainty = 0.0000(Not Clear)   < succ>
```

An alignment of the GAS and GBS proteins is shown below.

```
Identities = 241/254 (94%), Positives = 248/254 (96%)

Query:   1 MAVISMKQLLEAGVHFGHQTRRWNPKMAKYIFTERNGIHVIDLQQTVKLADQAYEFVRDA    60
           MAVISMKQLLEAGVHFGHQTRRWNPKMAKYIFTERNGIHVIDLQQTVKLADQAYEFVRDA
Sbjct:   1 MAVISMKQLLEAGVHFGHQTRRWNPKMAKYIFTERNGIHVIDLQQTVKLADQAYEFVRDA    60

Query:  61 AANDAVILFVGTKKQAAEEAVAEEEAKRAGQYFINHRWLGGTLTNWGTIQKRIARLKEIKRM  120
           AANDAVILFVGTKKQAAEEAVA+EA RAGQYFINHRWLGGTLTNWGTIQKRIARLKEIKRM
Sbjct:  61 AANDAVILFVGTKKQAAEEAVADEATRAGQYFINHRWLGGTLTNWGTIQKRIARLKEIKRM  120

Query: 121 EEEGTFELLPKKEVALLNKQRARLEKFLGGIEDMPRIPDVMYVVDPHKEQIAVKEAKKLG   180
           EEEGTF++LPKKEVALLNKQRARLEKFLGGIEDMPRIPDVMYVVDPHKEQIAVKEAKKLG
Sbjct: 121 EEEGTFDVLPKKEVALLNKQRARLEKFLGGIEDMPRIPDVMYVVDPHKEQIAVKEAKKLG   180

Query: 181 IPVVAMVDTNADPDDIDVIIPANDDAIRAVKLITSKLADAVIEGRQGEDADVDFAQEAQA   240
           IPVVAMVDTNADPDDID+IIPANDDAIRAVKLIT+KLADA+IEGRQGEDADV F  + QA
Sbjct: 181 IPVVAMVDTNADPDDIDIIIPANDDAIRAVKLITAKLADAIIEGRQGEDADVAFEADTQA   240

Query: 241 DSIEEIVEVVEGSN                                                254
           DSIEEIVEVVEG N
Sbjct: 241 DSIEEIVEVVEGDN                                                254
```

Based on this analysis, it was predicted that these proteins and their epitopes could be useful antigens for vaccines or diagnostics.

EXAMPLE 1472

A DNA sequence (GBSx1558) was identified in *S. agalactiae* <SEQ ID 4523> which encodes the amino acid sequence <SEQ ID 4524>. Analysis of this protein sequence reveals the following:

```
Possible Site: 49
>>> Seems to have no N-terminal signal sequence

----- Final Results -----
            bacterial cytoplasm --- Certainty = 0.2648(Affirmative) < succ>
            bacterial membrane  --- Certainty = 0.0000(Not Clear)   < succ>
             bacterial outside  --- Certainty = 0.0000(Not Clear)   < succ>
```

The protein has homology with the following sequences in the GENPEPT database.

```
>GP: CAB73435 GB: AL139077 elongation factor TS [Campylobacter jejuni]
Identities = 169/358 (47%), Positives = 226/358 (62%), Gaps = 19/358 (5%)

Query:   1 MAEITAKLVKELREKSGAGVMDAKKALVETDGDLDKAIELLREKGMAKAAKKADRVAAEG   60
           M EITA +VKELRE +GAG+MD K AL ET+GD DKA++LLREKG+ KAAKKADR+AAEG
Sbjct:   1 MTEITAAMVKELRESTGAGMMDCKNALSETNGDFDKAVQLLREKGLGKAAKKADRLAAEG   60

Query:  61 LTGVYV--DGNVAAVIEVNAETDFVAKNDQFVTLVNETAKVIAEGRPSNNEEALALTMPS  118
           L  V V  D   A V E+N+ETDFVAKNDQF+ L  +T  I       + EE   T+ +
Sbjct:  61 LVSVKVSDDFTSATVSEINSETDFVAKNDQFIALTKDTTAHIQSNSLQSVEELHSSTI-N  119

Query: 119 GETLEQAFVTATATIGEKISFRRFALVEKTDEQHFGAYQHNGGRIGVITV-------VEG  171
           G    E+  + ATIGE + RRFA ++          Y H  GR+GV+            V
Sbjct: 120 GVKFEEYLKSQIATIGENLVVRRFATLKAGANGVVNGYIHTNGRVGVVIAAACDSAEVAS  179

Query: 172 GDDALAKQVSMHVAAMKPTVLSYTELDAQFVHDELAQLNHKIEQDNESRAMV---NKPAL  228
             L +Q+ MH+AAM+P+ LSY +LD  FV +E    L  ++E++NE R  +    NKP
Sbjct: 180 KSRDLLRQICMHIAAMRPSYLSYEDLDMTFVENEYKALVAELEKENEERRRLKDPNKPEH  239

Query: 229 PFLKYGSKAQLTDEVIAQAEEDIKAELAAEGKPEKIWDKIVPGKMDRFMLDNTKVDQEYT  288
            ++  S+ QL+D ++ +AEE IK EL A+GKPEKIWD I+PGKM+ F+ DN+++D + T
Sbjct: 240 KIPQFASRKQLSDAILKEAEEKIKEELKAQGKPEKIWDNIIPGKMNSFIADNSQLDSKLT  299

Query: 289 LLAQVYIMDDSKTVEAYLESV------NAKAVAFVRFEVGEGIEKASNDFEAEVAATM    340
           L+  Q Y+MDD KTVE +         K V F+ FEVGEG+EK + DF AEVAA +
Sbjct: 300 LMGQFYVMDDKKTVEQVIAEKEKEFGGKIKIVEFICFEVGEGLEKKTEDFAAEVAAQL    357
```

A related DNA sequence was identified in *S. pyogenes* <SEQ ID 4525> which encodes the amino acid sequence <SEQ ID 4526>. Analysis of this protein sequence reveals the following:

```
Possible site: 38
>>> Seems to have no N-terminal signal sequence

----- Final Results -----
            bacterial cytoplasm --- Certainty = 0.3942(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below.

```
Identities = 307/344 (89%), Positives = 327/344 (94%)

Query:   1 MAEITAKLVKELREKSGAGVMDAKKALVETDGDLDKAIELLREKGMAKAAKKADRVAAEG   60
           MAEITAKLVKELREKSGAGVMDAKKALVETDGD+DKA+ELLREKGMAKAAKKADRVAAEG
Sbjct:  33 MAEITAKLVKELREKSGAGVMDAKKALVETDGDMDKAVELLREKGMAKAAKKADRVAAEG   92

Query:  61 LTGVYVDGNVAAVIEVNAETDFVAKNDQFVTLVNETAKVIAEGRPSNNEEALALTMPSGE  120
           LTGVYV GNVAAV+EVNAETDFVAKN QFV LVN TAKVIAEG+P+NN EALAL MPSGE
Sbjct:  93 LTGVYVHGNVAAVVEVNAETDFVAKNAQFVELVNATAKVIAEGKPANNDEALALVMPSGE  152

Query: 121 TLEQAFVTATATIGEKISFRRFALVEKTDEQHFGAYQHNGGRIGVITVVEGGDDALAKQV  180
           TL +A+V ATATIGEKISFRRFAL+EK DEQHFGAYQHNGGRIGVI+VVEGGDDALAKQV
Sbjct: 153 TLAEAYVNATATIGEKISFRRFALIEKADEQHFGAYQHNGGRIGVISVVEGGDDALAKQV  212

Query: 181 SMHVAAMKPTVLSYTELDAQFVHDELAQLNHKIEQDNESRAMVNKPALPFLKYGSKAQLT  240
           SMH+AAMKPTVLSYTELDAQF+ DELAQLNH IE DNESRAMV+KPALPFLKYGSKAQL+
Sbjct: 213 SMHIAAMKPTVLSYTELDAQFIKDELAQLNHAIELDNESRAMVDKPALPFLKYGSKAQLS  272

Query: 241 DEVIAQAEEDIKAELAAEGKPEKIWDKIVPGKMDRFMLDNTKVDQEYTLLAQVYIMDDSK  300
           D+VI  AE DIKAELAAEGKPEKIWDKI+PGKMDRFMLDNTKVDQ YTLLAQVYIMDDSK
Sbjct: 273 DDVITAAEADIKAELAAEGKPEKIWDKIIPGKMDRFMLDNTKVDQAYTLLAQVYIMDDSK  332

Query: 301 TVEAYLESVNAKAVAFVRFEVGEGIEKASNDFEAEVAATMAAAL                 344
           TVEAYL+SVNAKA+AF RFEVGEGIEK +NDFE EVAATMAAAL
Sbjct: 333 TVEAYLDSVNAKAIAFARFEVGEGIEKKANDFESEVAATMAAAL                 376
```

Based on this analysis, it was predicted that these proteins and their epitopes could be useful antigens for vaccines or diagnostics.

EXAMPLE 1473

A DNA sequence (GBSx1559) was identified in *S. agalactiae* <SEQ ID 4527> which encodes the amino acid sequence <SEQ ID 4528>. Analysis of this protein sequence reveals the following:

```
Possible site: 21
>>> Seems to have no N-terminal signal sequence

----- Final Results -----
          bacterial cytoplasm --- Certainty = 0.1312(Affirmative) < succ>
          bacterial membrane  --- Certainty= 0.0000(Not Clear)   < succ>
          bacterial outside   --- Certainty = 0.0000(Not Clear)  < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1474

A DNA sequence (GBSx1560) was identified in *S. agalactiae* <SEQ ID 4529> which encodes the amino acid sequence <SEQ ID 4530>. Analysis of this protein sequence reveals the following:

```
Possible site: 26
>>> Seems to have a cleavable N-term signal seq.
     INTEGRAL    Likelihood = -7.86    Transmembrane   128-144 (124-152)
     INTEGRAL    Likelihood = -4.57    Transmembrane    35-51  (33-53)
     INTEGRAL    Likelihood = -4.04    Transmembrane    92-108 (87-111)

----- Final Results -----
          bacterial membrane  --- Certainty= 0.4142(Affirmative) < succ>
          bacterial outside   --- Certainty = 0.0000(Not Clear)  < succ>
          bacterial cytoplasm --- Certainty = 0.0000(Not Clear)  < succ>
```

The protein has homology with the following sequences in the GENPEPT database.

```
>GP: BAB04953 GB: AP001511 small multidrug export related protein
[Bacillus halodurans]
Identities = 47/137 (34%), Positives = 71/137 (51%), Gaps = 5/137 (3%)

Query:   12 IPLVELRGAVPFAIANGIPLWEALAIGVVGNMLPVPIIFFFARKVLEWGADKPYTGKFFT   71
            +P+VELRG +P   +  G+  WEAL G++GN+LP+  I    R+ W      +  + +
Sbjct:    1 MPIVELRGGIPLGVVLGLSPWEALLFGIIGNLLPIVPILLLFRPISGWMLRFKWYQRLYD  60

Query:   72 WCLKKGHSGGQKLEKVAGEKGLFIALLLFVGIPLPGTGAWTGTLAASLLDWEFKHSVIAV  131
            W  +      +EK        I L+LF +PLP TGA++  LAA L    F+ +  AV
Sbjct:   61 WLYNRTMKKSNNVEKFGA-----IGLILFTAVPLTTGAYSACLAAVLFFIPFRFAFFAV  115

Query:  132 MLGVILAGCIMGTLSII                                            148
            GV++AG +M   S I
Sbjct:  116 SAGVVIAGIVMTLFSYI                                            132
```

No corresponding DNA sequence was identified in *S. pyogenes*.

A related GBS gene <SEQ ID 8817> and protein <SEQ ID 8818> were also identified. Analysis of this protein sequence reveals the following:

```
Lipop: Possible site: -1 Crend: 0
McG: Discrim Score: 3.98
GvH: Signal Score (-7.5): -2.35
    Possible site: 26
>>> Seems to have a cleavable N-term signal seq.
ALOM program count: 3 value: -7.86 threshold: 0.0
    INTEGRAL      Likelihood = -7.86    Transmembrane    128-144 (124-152)
    INTEGRAL      Likelihood = -4.57    Transmembrane    35-51 (33-53)
    INTEGRAL      Likelihood = -4.04    Transmembrane    92-108 (87-111)
    PERIPHERAL    Likelihood = 12.20    109
modified ALOM score: 2.07
*** Reasoning Step: 3

----- Final Results -----
              bacterial membrane --- Certainty = 0.4142(Affirmative) < succ>
               bacterial outside --- Certainty = 0.0000(Not Clear)   < succ>
              bacterial cytoplasm --- Certainty = 0.0000(Not Clear)  < succ>
LPXTG motif: 105-109
```

The protein has homology with the following sequences in the databases:

```
186       216       246       276       306       336       366       396
LTIIISNF*KIRK*NLSKDSKTRMTADFSCHY*KDKIKWNNTIERFYLMNYIITFLISMIPLVELRGAVPFAIANGIPLW
                                                   :|: ||||:|:|:    |
                                                   MPFSELRGAIPLALYFGFSPA
                                                       10        20
426       456       486       516       546       576       591       621
EALAIGVVGNMLPVPIIFFFARKVLEWGADKPYTGKFFTWCLKKGHSGGQKLEKVAGEKGL-----FIALLLFVGIPLPG
||  : |:||:|||| :::|    ::          : :       : :|:|    ||:       :: | :|| ||||
EAYLLSVLGNILPVPFLLLFLDYLVRIATKVELLARIYR---------RVVERVERRKGVVERYGYLGLTIFVAIPLPV
             40        50        60                   70        80        90
651       681       711       741       771       801       831       861
TGAWTGTLAASLLDWEFKHSVIAVMLGVILAGCIMGTLSIIGFNLF*KS*GEMTVSPF*YLPIHQFDSKIRHLT*AKCLI
||||||||| | ||          : : :   || :|| ::     ||       |:
TGAWTGTLLAFLLQLNRLKAFLFISAGVCIAGVVVLLASIGIIRLL
             110       120       130
```

Based on this analysis, it was predicted that these proteins and their epitopes could be useful antigens for vaccines or diagnostics.

EXAMPLE 1475

A DNA sequence (GBSx1561) was identified in *S. agalactiae* <SEQ ID 4531> which encodes the amino acid sequence <SEQ ID 4532>. This protein is predicted to be CtsR protein (ctsR). Analysis of this protein sequence reveals the following:

```
Possible site: 34
>>> Seems to have no N-terminal signal sequence

----- Final Results -----
              bacterial cytoplasm --- Certainty = 0.3672 (Affirmative) < succ>
               bacterial membrane --- Certainty = 0.0000 (Not Clear)   < succ>
                bacterial outside --- Certainty = 0.0000 (Not Clear)   < succ>
```

The protein has homology with the following sequences in the GENPEPT database.

```
>GP: CAB91548 GB: AJ249133 CtsR protein [Lactococcus lactis]
Identities = 74/146 (50%), Positives = 103/146 (69%), Gaps = 3/146 (2%)

Query:   4 KNTSDNIEEYIKSLLEQSGIAEIKRSNLADTFQVVPSQINYVIKTRFTESRGYVVESKRG    63
           KNTSD IE Y++ LLE++ + EIKR++LA+ F VVPSQINYVIKTRFT S+G+ VESKRG
Sbjct:   5 KNTSDIIEAYLRQLLEEAQVIEIKRADLANQFDVVPSQINYVIKTRFTASKGFDVESKRG    64

Query:  64 GGGYIRIAKVHFSDQHQLFGNMLSTIGERISEQVFDDLIQLLFDEEIITEREGNLILATS   123
           GGGYI+I K  +S +H+   +   +    +S +   D++QLLFDE+++TEREGNL+L
Sbjct:  65 GGGYIKIVKYQYSARHEFLTALYQKVPANLSSKAAHDIVQLLFDEKVLTEREGNLLLLVI   124
```

```
                            -continued
Query: 124 GDDVLGEQASVIRARMLRKLLQRLDR                               149
           D   G  +   R  M++ ++ RLDR
Sbjct: 125 TD---GAISPFTRGIMMKSIINRLDR                               147
```

A related DNA sequence was identified in *S. pyogenes* <SEQ ID 4533> which encodes the amino acid sequence <SEQ ID 4534>. Analysis of this protein sequence reveals the following:

```
Possible site: 34
>>> Seems to have no N-terminal signal sequence

----- Final Results -----
              bacterial cytoplasm --- Certainty = 0.2514 (Affirmative) < succ>
              bacterial membrane  --- Certainty = 0.0000 (Not Clear)   < succ>
              bacterial outside   --- Certainty = 0.0000 (Not Clear)   < succ>
```

An alignment of the GAS and GBS proteins is shown below.

```
Identities = 117/151 (77%), Positives = 131/151 (86%)

Query:    1 MAIKNTSDNIEEYIKSLLEQSGIAEIKRSNLADTFQVVPSQINYVIKTRFTESRGYVVES   60
            M  KNTSD+IEEYIK LL +SGIAEIKRS LAD+FQVVPSQINYVIKTRFTESRGY VES
Sbjct:    1 MPTKNTSDSIEEYIKELLAKSGIAEIKRSMLADSFQVVPSQINYVIKTRFTESRGYEVES   60

Query:   61 KRGGGGYIRIAKVHFSDQHQLFGNMLSTIGERISEQVFDDLIQLLFDEEIITEREGNLIL  120
            KRGGGGYIRIAKVHFSD+H L GN+++TI + ISEQVF D IQLLFDE ++TEREGN+IL
Sbjct:   61 KRGGGGYIRIAKVHFSDKHHLIGNLMATIEDCISEQVFTDSIQLLFDEHLLTEREGNIIL  120

Query:  121 ATSGDDVLGEQASVIRARMLRKLLQRLDRKG                              151
            A + DDVLG   S IRARML +LLQR+DRKG
Sbjct:  121 AVASDDVLGTDGSTIRARMLYRLLQRIDRKG                              151
```

Based on this analysis, it was predicted that these proteins and their epitopes could be useful antigens for vaccines or diagnostics.

EXAMPLE 1476

A DNA sequence (GBSx1562) was identified in *S. agalactiae* <SEQ ID 4535> which encodes the amino acid sequence <SEQ ID 4536>. This protein is predicted to be ClpC (clpB-1). Analysis of this protein sequence reveals the following:

```
Possible site: 49
>>> Seems to have no N-terminal signal sequence
INTEGRAL   Likelihood = -2.34 Transmembrane 32-48 (32-49)

----- Final Results -----
              bacterial membrane  --- Certainty = 0.1935 (Affirmative) < succ>
              bacterial outside   --- Certainty = 0.0000 (Not Clear)   < succ>
              bacterial cytoplasm --- Certainty = 0.0000 (Not Clear)   < succ>
```

The protein has homology with the following sequences in the GENPEPT database.

```
>GP: AAD01783 GB: AF023422 ClpC [Lactococcus lactis]
Identities = 401/831 (48%), Positives = 571/831 (68%), Gaps = 52/831 (6%)

Query:    4 YSIKLQEVFRLAQFQAARYESHYLESWHLLLAMVLVHDSVAGLTFAEYE---SEVAIEEY   60
            Y+  L  +F  A  A +Y+   +ES HLL AM      S+A  A     S++ I+
Sbjct:    8 YTPTLDRIFEKAAEYAHQYQYGTIESAHLLAAMATTSGSIAYSILAGMNVDSSDLLIDLE   67

Query:   61 EAATILALGRAPKEEITNYQFLEQSPALKKILKLAENISIVVGAEDVGTEHVLLAMLVNK  120
            + ++ + + R+            L  SP  ++++A +++    AE VGTEH+L A+L  +
Sbjct:   68 DLSSHVKVKRSE---------LRFSPRAEEVVTVASFLAVHNNAEAVGTEHLLYALLQVE  118
```

-continued

```
Query:  121 DLLATRILELVGFRGQDDGESVRMVDLRKALERHAGF-TKDDIKAIYELRNPKKAKSGAS    179
            D   ++L+L        + + +V LRK +E+  G     ++ KA+  +   K AK  A
Sbjct:  119 DGFGLQLLKL---------QKINIVSLRKEIEKRTGLIVPENKKAVTPMSKRKMAKGVAE    169

Query:  180 FSDMMKPPSTAGDLADFTRDLSQMAVDGEIEPVIGRDKEISRMVQVLSRKTKNNPVLVGD    239
                       S+   L   + DL++ A  G+++P+IGR+ E+ R++ +LSR+TKNNPVLVG+
Sbjct:  170 -------NSSTPTLDSVSSDLTEAARSGKLDPMIGREAEVDRLIHILSRRTKNNPVLVGE    222

Query:  240 AGVGKTALAYGLAQRIANGNIPYELRDMRVLELDDMMSVVAGTRFRGDFEERMNQIIADIE    299
               GVGK+A+   GLAQRI NG +P  L + R++ L+M +VVAGT+FRG+FE+R+   I+ ++
Sbjct:  223 PGVGKSAIIEGLAQRIVNGQVPIGLMNSRIMALNMATVVAGTKFRGEFEDRLTAIVEEVS    282

Query:  300 EDGHIILFIDELHTIMGSGSGIDSTLDAANILKPALARGTLRTVGATTQEEYQKHIEKDA    359
               D  +I+FIDELHTI+G+G G+DS  DAANILKPALARG  + VGATT  EYQK+IEKD
Sbjct:  283 ADPDVIIFIDELHTIIGAGGGMDSVNDAANILKPALARGDFQMVGATTYHEYQKYIEKDE    342

Query:  360 ALSRRFAKVLVEEPNLEDAYEILLGLKPAYEAFHNVTISDEAVMTAVKVAHRYLTSKNLP    419
               AL  RR A++  V+EP+ ++A  IL GL+   +E +H V  +D+A+  +AV ++ RY+TS+ LP
Sbjct:  343 ALERRLARINVDEPSPDEAIAILQGLREKFEDYHQVKFTDQAIKSAVTLSVRYMTSRKLP    402

Query:  420 DSAIDLLDEASATVQMMIKKNAPSLLT----------EVDQAILDDDMKSA---------    460
               D AIDLLDEA+A V++++K      ++           E+ +A++  D+K++
Sbjct:  403 DKAIDLLDEAAARVKILLKTKKQNVFELEKDFVKAQEELAEAVIKLDVKASRIKEKAVEK    462

Query:  461 --SKALKASYKGKKRKPIAVTEDHIMATLSRLSGIPVEKLTQADSKKYLNLEKELHKRVI    518
                  K   K S K  +KR+    VT+   ++A   S L+G+P+  ++T+++S +  +NLEKELHKRV+
Sbjct:  463 ISDKIYKFSIKEEKRQE--VTDQAVIAVASTLTGVPITQMTKSESDRLINLEKELHKRVV    520

Query:  519 GQDDAVTAISRAIRRNQSGIRTGKRPIGSFMFLGPTGVGKTELAKALAEVLFDDESALIR    578
               GQ++A++A+SRAIRR +SG+     +RP+GSFMFLGPTGVGKTELAKALA+  +F  E   +IR
Sbjct:  521 GQEEAISAVSRAIRRARSGVADSRRPMGSFMFLGPTGVGKTELAKALADSVFGSEDNMIR    580

Query:  579 FDMSEYMEKFAASHLNGAPPGYVGYDEGGELTEKVRNKPYSVLLFDEVEKAHPDIFNVLL    638
                  DMSE+MEK + S L GAPPGYVGYDEGG+LTE+VRNKPYSV+L DEVEKAH D+FN++L
Sbjct:  581 VDMSEFMEKHSTSRLIGAPPGYVGYDEGGQLTERVRNKPYSVVLLDEVEKAHLDVFNIML    640

Query:  639 QVLDDGVLTDSRGRKVDFSNTIIIMTSNLGATALRDDKTVGFGAKDISHDYTAMQKRIME    698
               Q+LDDG +TD++GRKVDF NTIIIMTSNLGATALRDDKTVGFGAK+I+ DY+AMQ RI+E
Sbjct:  641 QILDDGFVTDTKGRKVDFRNTIIIMTSNLGATALRDDKTVGFGAKNITADYSAMQSRILE    700

Query:  699 ELKKAYRPEFINRIDEKVVFHSLSQDNMREVVKIMVKPLILALKDGMDLKFQPSALKHL    758
                  ELK+ YRPEF NRIDE +VFHSL    + ++VKIM K LI   L ++  +K  PSA+K  +
Sbjct:  701 ELKRHYRPEFLNRIDENIVFHSLESQEIEQIVKIMSKSLIKRLAEQDIHVKLTPSAIKLI    760

Query:  759 AEDGYDIEMGARPLRRTIQTQVEDHLSELLLANQVKEGQVIKIGVSKGKLK          809
                  AE G+D E GARPLR+ +Q +VED LSE LL+ ++K G   I IG S  K+K
Sbjct:  761 AEVGFDPEYGARPLRKALQKEVEDLLSEQLLSGEIKAGNHISIGASNKKIK          811
```

A related DNA sequence was identified in *S. pyogenes* <SEQ ID 4537> which encodes the amino acid sequence <SEQ ID 4538>. Analysis of this protein sequence reveals the following:

```
Possible site: 44
>>> Seems to have no N-terminal signal sequence
INTEGRAL Likelihood = -1.75 Transmembrane 32-48 (32-48)

----- Final Results -----
             bacterial membrane --- Certainty = 0.1702 (Affirmative) < succ>
              bacterial outside --- Certainty = 0.0000 (Not Clear) < succ>
              bacterial cytoplasm --- Certainty = 0.0000 (Not Clear) < succ>
RGD motif: 285-287
```

55

An alignment of the GAS and GBS proteins is shown below.

```
Identities = 618/814 (75%), Positives = 716/814 (87%), Gaps = 1/814 (0%)

Query:    1 MSHYSIKLQEVFRLAQFQAARYESHYLESWHLLLAMVLVHDSVAGLTFAEYESEVAIEEY    60
            M   YS K+Q++FR AQFQAAR++SH LE+WH+LLAMV V +S+A +  +EY+++VAIEEY
Sbjct:    1 MIMYSTKMQDIFRQAQFQAARFDSHCLETWHVLLAMVAVDNSLANMILSEYDAQVAIEEY    60

Query:   61 EAATILALGRAPKEEITNYQFLEQSPALKKILKLAENISIVVGAEDVGTEHVLLAMLVNK   120
               EAA  ILA+G+ PKE+++   F QS  L +L  A+ IS +    ++VG+EHVL A+L+N
Sbjct:   61 EAAAILAMGKTPKEQLSRVDFRPQSKTLTNLLAFAQAISQITRDQEVGSEHVLFAILLNP   120
```

```
Query: 121 DLLATRILELVGFRGQDDGESV-RMVDLRKALERHAGFTKDDIKAIYELRNPKKAKSGAS      179
           D++A+R+LE+ G++ +D+G   R+ DLRKA+ERHAG++K+ IKAI+ELR PKK K+  +
Sbjct: 121 DIMASRLLEIAGYQIKDNGNGQPRLADLRKAIERHAGYSKEMIKAIHELRKPKKTKTQGT      180

Query: 180 FSDMMKPPSTAGDLADFTRDLSQMAVDGEIEPVIGRDKEISRMVQVLSRKTKNNPVLVGD      239
           FSDMMKPPSTAG+L+DFTRDL++MA  G +E VIGRD+E+SRM+QVLSRKTKNNPVLVGD
Sbjct: 181 FSDMMKPPSTAGELSDFTRDLTEMARQGLLESVIGRDQEVSRMIQVLSRKTKNNPVLVGD      240

Query: 240 AGVGKTALAYGLAQRIANGNIPYELRDMRVLELDMMSVVAGTRFRGDFEERMNQIIADIE      299
           AGVG+TALAYGLAQRIANG IPYEL++MRVLELDMMSVVAGTRFRGDFEERMNQII DIE
Sbjct: 241 AGVGKTALAYGLAQRIANGAIPYELKEMRVLELDMMSVVAGTRFRGDFEERMNQIIDDIE      300

Query: 300 EDGHIILFIDELHTIMGSGSGIDSTLDAANILKPALARGTLRTVGATTQEEYQKHIEKDA      359
             DG IILF+DELHTIMGSGSGIDSTLDAANILKPAL+RGTL  VGATTQEEYQKHIEKDA
Sbjct: 301 ADGQIILFVDELHTIMGSGSGIDSTLDAANILKPALSRGTLHMVGATTQEEYQKHIEKDA      360

Query: 360 ALSRRFAKVLVEEPNLEDAYEILLGLKPAYEAFHNVTISDEAVMTAVKVAHRYLTSKNLP      419
           ALSRRFAK+L+EEPN EDAY+IL+GLK +YE +HNV+IS+EAV TAVK+AHRYLTSKNLP
Sbjct: 361 ALSRRFAKILIEEPNTEDAYQILMGLKLSYETYHNVSISNEAVKTAVKMAHRYLTSKNLP      420

Query: 420 DSAIDLLDEASATVQMMIKKNAPSLLTEVDQAILDDDMKSASKALKASYKGKKRKPIAVT      479
           DSAIDLLDEASA VQ M+KK+AP  LT +DQA+++ DMK  S+ L    KG+ RKP  VT
Sbjct: 421 DSAIDLLDEASAAVQNMVKKSAPETLTPIDQALINGDMKKVSRLLAKEAKGQMRKPTPVT      480

Query: 480 EDHIMATLSRLSGIPVEKLTQADSKKYLNLEKELHKRVIGQDDAVTAISRAIRRNQSGIR      539
           ED I+ATLS+LSGIP+EKLTQADSKKYLNLEKELHKRVIGQD AVTAISRAIRRNQSGIR
Sbjct: 481 EDDILATLSKLSGIPLEKLTQADSKKYLNLEKELHKRVIGQDAAVTAISRAIRRNQSGIR      540

Query: 540 TGKRPIGSFMFLGPTGVGKTELAKALAEVLFDDESALIRFDMSEYMEKFAASHLNGAPPG      599
           TGKRPIGSFMFLGPTGVGKTELAKALAEVLFDDE+ALIRFDMSEYMEKFAAS LNGAPPG
Sbjct: 541 TGKRPIGSFMFLGPTGVGKTELAKALAEVLFDDEAALIRFDMSEYMEKFAASRLNGAPPG      600

Query: 600 YVGYDEGGELTEKVRNKPYSVLLFDEVEKAHPDIFNVLLQVLDDGVLTDSRGRKVDFSNT      659
           YVGYDEGGELT+KVRNKPYSVLLFDEVEKAHPDIFNVLLQVLDDG+LTDSRGRKVDFSNT
Sbjct: 601 YVGYDEGGELTQKVRNKPYSVLLFDEVEKAHPDIFNVLLQVLDDGILTDSRGRKVDFSNT      660

Query: 660 IIIMTSNLGATALRDDKTVGFGAKDISHDYTAMQKRIMEELKKAYRPEFINRIDEKVVFH      719
           IIIMTSNLGATALRDDKTVGFG  KDI  D+  AM+KRI+EEL+IK YRPEFINRIDEKVVFH
Sbjct: 661 IIIMTSNLGATALRDDKTVGFGVKDIHQDHQAMEKRILEELRKTYRPEFINRIDEKVVFH      720

Query: 720 SLSQDNMREVVKIMVKPLILALKDKGMDLKFQPSALKHLAEDGYDIEMGARPLRRTIQTQ      779
           SL+QDNMR+VVKIMV+PLI L +KG+ LK QP ALKHL+E GYD  MGARPLRRT+QT+
Sbjct: 721 SLTQDNMRDVVKIMVQPLITTLAEKGITLKIQPLALKHLSEVGYDEHMGARPLRRTLQTE      780

Query: 780 VEDHLSELLLANQVKEGQVIKIGVSKGKLKFDIA                            813
           +ED LSEL+L+ ++  G  +KIG+S GKL F IA
Sbjct: 781 IEDKLSELILSRELTSGHTLKIGLSHGKLTFHIA                            814
```

A related GBS gene <SEQ ID 8819> and protein <SEQ ID 8820> were also identified. Analysis of this protein sequence reveals the following:

```
Lipop: Possible Site: -1 Crend: 9
McG: Discrim Score: -13.52
GvH: Signal Score (-7.5): -2.1
   Possible site: 49
 >>> Seems to have no N-terminal signal sequence
ALOM program count: 1 value: -2.34   threshold: 0.0
INTEGRAL    Likelihood = -2.34 Transmembrane 32-48 (32-49)
PERIPHERAL  Likelihood = 0.95  112
modified ALOM score: 0.97

*** Reasoning Step: 3

----- Final Results -----
          bacterial membrane --- Certainty = 0.1935 (Affirmative) < succ>
           bacterial outside --- Certainty = 0.0000 (Not Clear) < succ>
         bacterial cytoplasm --- Certainty = 0.0000 (Not Clear) < succ>
```

The protein has homology with the following sequences in the databases:

```
47.4/69.6% over 804aa
Listeria monocytogenes
EGAD|136761|ClpC ATPase Insert characterized
GP|1314297|gb|AAC44446.1||U40604 ClpC ATPase Insert characterized ORF00207(298-2727 of 3045)
EGAD|136761|145854(2-806 of 825)ClpC ATPase {Listeria monocytogenes}
GP|1314297|gb|AAC44446.1||U40604 ClpC ATPase {Listeria monocytogenes}
% Match = 33.6
% Identity = 47.4    % Similarity = 69.6
Matches = 372   Mismatches = 229    Conservative Sub.s = 174

87       117       147       177       207       237       267       297
          SFF*STPIIWKYVINDWRAYQ*TSF**FDSIIIR*RDNYRT*RKFDSGDIR**RLRRASLCY*SSYAP*IITTIR*KRIP

M
           327       357       387       417       447       477       507       537
          FMSHYSIKLQEVFRLAQFQAARYESHYLESWHLLLAMVLVHDSVAGLTFAEYESEVAIEEYEAATILALGRAPKEEITNY
           :: :   |:|:  |:|  :|  |     |  :|||  :|    :  :|    |  ||  :: |: :    :|   :: :|
          MFGRFTQRAQKVLALSQEEAMRLNHSNLGTEHILLGLVREGEGIAA--KALYELGISSEKVQQEVEGLIGHG-EKAVTTI
                                 20        30        40         50        60        70

567       597       627       657       687       717       744       774
          QFLEQSPALKKILKLAENISIVVGAEDVGTEHVLLAMLVNKDLLATRILXLVGFRGQDDGESV-RMVDLRKALERHAGFT
          |:    |   ||:::|:  :  :|   ||||||:||  ::    :|  |:|   :|    |        |   :::    |
          QYT---PRAKKVIELSMDEARKLGHTYVGTEHILLGLIREGEGVAARVLSNLGISLNKARQQVLQLLGGGDA--------
                        90       100       110       120       130       140

804       834       864       894       924       954       984      1014
          KDDIKAIYELRNPKKAKSGASFSDMMKPPSTAGDLADFTRDLSQMAVDGEIEPVIGRDKEISRMVQVLSRKTKNNPVLVG
                :||          :  :    |     ||    |||  :|  :  ::|||||   |||  |::|||||:||||:|
          ----------------TGAGRQTNTQATPTLDSLA---RDLTVIAREDNLDPVIGRSKEIQRVIEVLSRRTKNNPVLIG
                            150       160       170       180       190       200

1044      1074      1104      1134      1164      1194      1224      1254
          DAGVGKTALAYGLAQRIANGNIPYELRDMRVLELDMMSVVAGTRFRGDFEERMNQIIADIEEDGHIILFIDELHTIMGSG
          :  ||||||:|   ||||  :|   ||  ||: |||  :|||::  |:|: |    :  ::   :  | :: ||||||::|:|
          EPGVGKTAIAEGLAQQIVRNEVPETLRGKRVMTLDMGTVVAGTKYRGEFEDRLKKVMDEIRQAGNVILFIDELHTLIGAG
                    220       230       240       250       260       270       280

1284      1314      1344      1374      1404      1434      1464      1494
          SGIDSTLDAANILKPALARGTLRTVGATTQEEYQKHIEKDAALSRRFAKVLVEEPNLEDAYEILLGLKPAYEAFHNVTIS
            |   : :||:|||||   ||||   |:  :||||    :||:|:||||  ||   |  :|:||   :|| ||  |||  |:
          -GAEGAIDASNILKPPLARGELQCIGATTLDEYRKYIEKDRALERRFQPIKVDEPTVEESIQILHGLRDRYEAHHRVAIT
                    300       310       320       330       340       350       360

1524      1554      1584             1644      1674      1704
          DEAVMTAVKVAHRYLTSKNLPDSAIDLLDEASATVQM----------MIKKNAPSLLTEVDQAILDDDMKSASKALKASY
          |||:  ||:::  ||::   :|||  ||||::|| : |::          :: |    |    |||:    : :   |:
          DEALEAAVRLSDRYISDRFLPDKAIDVIDESGSKVRLKSFTTPKNVKEMENNLSDLKKEKDAAVQGQEFEKAASLRDKEQ
                    380       390       400       410       420       430       440

1725                1737      1767      1797      1827      1857      1887
          KGKK---RKPIA----------------VTEDHIMATLSRLSGIPVEKLTQADSKKYLNLEKELHKRVIGQDDAVTAISR
          | ||    :| :                ||||     ::    |:  :  :|    | | |: :||  ||||  ||||:|
          KLKKSLDKKSLEETKANWQEKQGLDHSEVTEDIVAEVVASWTGIPVAKLAETETNKLLNMEKLLHERVIGQDAAVKAVSL
                    460       470       480       490       500       510       520

1917      1947      1977      2007      2037      2067      2097      2127
          AIRRNQSGIRTGKRPIGSFMFLGPTGVKTELAKALAEVLFDDESALIRFDMSEYMEKFAASHLNGAPPGYVGYDEGGEL
          |:||  ::|::   |||||||: ||||||||| |||| ||:|||| |||||||||||| |  :|  ||||||||: |||:|
          AVRRARAGLKDPKRPIGSFIFLGPTGVKTELARALAESMFGDEDSMIRIDMSEYMEKFSTARLVGAPPGYVGYEEGGQL
                    540       550       560       570       580       590       600

2157      2187      2217      2247      2277      2307      2337      2367
          TEKVRNKPYSVLLFDEVEKAHPDIFNVLLQVLDDGVLTDSRGRKVDFSNTIIIMTSNLGATALRDDKTVGFGAKDISHDY
          |||||   ||||:|:||:|||||:|| |||||||| ||| |||||||| ||| ||||:||    ::  |::| |       |:
          TEKVRQKPYSVVLLDEIEKAHPDVFNMLLQVLDDGRLTDSKGRVVDFRNTVIIMTSNIGAQEMKQDKSMGFNVTDPLKDH
                    620       630       640       650       660       670       680

2397      2427      2457      2487      2517      2547      2577      2607
          TAMQKRIMEELKKAYRPEFINRIDEKVVFHSLSQDNMREVVKIMVKPLILALKDKGMDLKFQPSALKHLAEDGYDIEMGA
            ||: |::::||:|:|||||||||| :||||| | : ::::|  |  :::   | :::  :|   :|:|||| || :| | ||
          KAMEHRVLQDLKQAFRPEFINRIDETIVFHSLQEKELKQIVTLLTAQLTKRLAERDIHVKLTEGAKSKIAKDGYDPEYGA
                    700       710       720       730       740       750       760

2637      2667      2697      2727      2757      2787      2817      2847
          RPLRRTIQTQVEDHLSELLLANQVKEGQVIKIGVSKGKLKFDIAKS*NIPVPMGTGILI*KENVQNILDIFL*IYEK*KD
          |||:|  ||  :|||    ||:||  |||:|||| |||||:
          RPLKRAIQKEVEDMLSEELLRGNIKVGDYVEIGVKDGKLEVRKKDAPKKKTTSKKVKAK
                    780       790       800       810       820
```

There is also homology to SEQ ID 258.

SEQ ID 8820 (GBS26) was expressed in *E. coli* as a His-fusion product. SDS-PAGE analysis of total cell extract is shown in FIG. 7 (lane 9; MW 93.3 kDa), in FIG. 167 (lane 16 & 17; MW 108 kDa) and in FIG. 239 (lane 14; MW 108 kDa). It was also expressed in *E. coli* as a GST-fusion product. SDS-PAGE analysis of total cell extract is shown in FIG. 15 (lane 7; MW 18 kDa).

Based on this analysis, it was predicted that these proteins and their epitopes could be useful antigens for vaccines or diagnostics.

EXAMPLE 1477

A DNA sequence (GBSx1563) was identified in *S. agalactiae* <SEQ ID 4539> which encodes the amino acid sequence <SEQ ID 4540>. Analysis of this protein sequence reveals the following:

```
Possible site: 17
>>> Seems to have a cleavable N-term signal seq.

----- Final Results -----
            bacterial outside  --- Certainty = 0.3000(Affirmative) < succ>
           bacterial membrane  --- Certainty = 0.0000(Not Clear)   < succ>
          bacterial cytoplasm  --- Certainty = 0.0000(Not Clear)   < succ>
```

A related DNA sequence was identified in *S. pyogenes* <SEQ ID 4541> which encodes the amino acid sequence <SEQ ID 4542>. Analysis of this protein sequence reveals the following:

```
Possible site: 17
>>> Seems to have a cleavable N-term signal seq.

----- Final Results -----
            bacterial outside  --- Certainty = 0.3000(Affirmative) < succ>
           bacterial membrane  --- Certainty = 0.0000(Not Clear)   < succ>
          bacterial cytoplasm  --- Certainty = 0.0000(Not Clear)   < succ>
```

An alignment of the GAS and GBS proteins is shown below.

```
Identities = 178/213 (83%), Positives = 199/213 (92%)

Query:    1 MLIVLAGTIGAGKSSLAAALGQHLGTDVFYEAVDNNPVLDLYYQDPQKYAFLLQIFFLNK    60
            MLIVLAGTIGAGKSSLAAALG+HLGTDVFYEAVDNNPVLDLYYQDP+KYAFLLQI+FLNK
Sbjct:    1 MLIVLAGTIGAGKSSLAAALGEHLGTDVFYEAVDNNPVLDLYYQDPKKYAFLLQIYFLNK    60

Query:   61 RFQSIKEAYKANNNVLDRSIFEDELFLTLNYKNGNVTKTELDIYKELLANMLEELEGMPK   120
            RF+SIKEAY+A+NN+LDRSIFEDELFL LNYKNGNVTKTELDIY+ELLANMLEELEGMPK
Sbjct:   61 RFKSIKEAYQADNNILDRSIFEDELFLKLNYKNGNVTKTELDIYQELLANMLEELEGMPK   120

Query:  121 KRPDLLVYIDVSFDKMLERIDKRGRSFEQVDSNPELYDYYKQVHSEYPEWYENYDVSPKI   180
            KRPDLL+YIDVSFDKMLERI++RGRSFEQVD NP L  YY QVH EYP WYE+Y+VSPK+
Sbjct:  121 KRPDLLIYIDVSFDKMLERIERRGRSFEQVDGNPSLEQYYHQVHGEYPTWYEDYEVSPKM   180

Query:  181 RIDGNKLDFVKNPEDLQHVLDTIDSELQKLDLL                             213
            +IDGN LDFV+NP+DL  VL  ID++L++L LL
Sbjct:  181 KIDGNSLDFVQNPQDLATVLKMIDTKLKELHLL                             213
```

A related GBS gene <SEQ ID 8821> and protein <SEQ ID 8822> were also identified. Analysis of this protein sequence reveals the following:

```
Lipop: Possible Site: -1 Crend: 0
McG: Discrim Score: 3.94
GvH: Signal Score (-7.5): 1.42
     Possible site: 17
>>> Seems to have a cleavable N-term signal seq.
ALOM program count: 0 value: 7.69 threshold: 0.0
   PERIPHERAL Likelihood = 7.69 49
modified ALOM score: -2.04
*** Reasoning Step: 3

----- Final Results -----
            bacterial outside  --- Certainty = 0.3000(Affirmative) < succ>
           bacterial membrane  --- Certainty = 0.0000(Not Clear)   < succ>
          bacterial cytoplasm  --- Certainty = 0.0000(Not Clear)   < succ>
```

Figure 318:
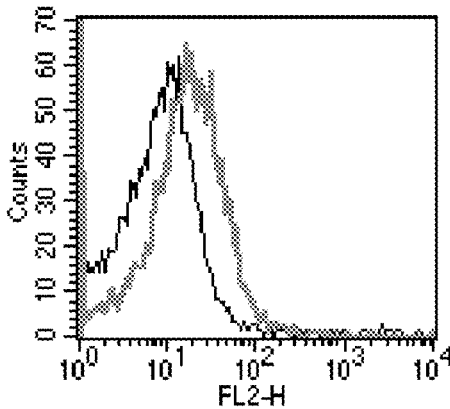

SEQ ID 4540 (GBS9) was expressed in *E. coli* as a GST-fusion product. SDS-PAGE analysis of total cell extract is shown in FIG. 1 (lane 5; MW 52 kDa) and FIG. 12 (lane 2 & 3; MW 50.3 kDa). It was also expressed in *E. coli* as a His-fusion product. SDS-PAGE analysis of total cell extract is shown in FIG. 2 (lane 6; MW 27 kDa) and FIG. 3 (lane 2; MW 25 kDa). The GBS9-GST fusion product was purified (FIG. 191, lane 6) and used to immunise mice. The resulting antiserum was used for FACS (FIG. 318), which confirmed that the protein is immunoaccessible on GBS bacteria.

Based on this analysis, it was predicted that these proteins and their epitopes could be useful antigens for vaccines or diagnostics.

EXAMPLE 1478

A DNA sequence (GBSx1564) was identified in *S. agalactiae* <SEQ ID 4543> which encodes the amino acid sequence <SEQ ID 4544>. Analysis of this protein sequence reveals the following:

```
Possible site: 36
>>> Seems to have no N-terminal signal sequence

----- Final Results -----
            bacterial cytoplasm --- Certainty = 0.1182(Affirmative) < succ>
             bacterial membrane --- Certainty = 0.0000(Not Clear)   < succ>
              bacterial outside --- Certainty = 0.0000(Not Clear)   < succ>
```

A related DNA sequence was identified in *S. pyogenes* <SEQ ID 4545> which encodes the amino acid sequence <SEQ ID 4546>. Analysis of this protein sequence reveals the following:

```
Possible site: 60
>>> Seems to have no N-terminal signal sequence

----- Final Results -----
             bacterial membrane --- Certainty = 0.0000(Not Clear)   < succ>
              bacterial outside --- Certainty = 0.0000(Not Clear)   < succ>
            bacterial cytoplasm --- Certainty = 0.0000(Not Clear)   < succ>
```

An alignment of the GAS and GBS proteins is shown below.

```
Identities = 281/323 (86%), Positives = 305/323 (93%)

Query:   3 QLNSSFMIGKVEIPHRTVLAPMAGITNSAFRTIAKEFGAGLVVMEMISEKGLLYNNEKTL   62
           +LNSSF IG VEIPHRTVLAPMAG+TNSAFRTIAKEFGAGLVVMEMISEKGLLYNNEKTL
Sbjct:  27 KLNSSFRIGDVEIPHRTVLAPMAGVTNSAFRTIAKEFGAGLVVMEMISEKGLLYNNEKTL   86

Query:  63 HMLHIDENEHPMSIQLFGGDAEGLKRAADFIQSNTKADIVDINMGCPVNKVVKNEAGAKW  122
           HMLHIDENEHPMSIQLFGGDAEGLKRAADFIQ+NTKADIVDINMGCPVNKVVKNEAGAKW
Sbjct:  87 HMLHIDENEHPMSIQLFGGDAEGLKRAADFIQTNTKADIVDINMGCPVNKVVKNEAGAKW  146

Query: 123 LRDPEKIYHIVKEVTSVLDIPLTVKMRTGWSDSSNAIENALAAESAGVSALAMHGRTREQ  182
           LRDP+KIYHIVKEVTSVLDIPLTVKMRTGW+DSS A+ENALAAESAGVSALAMHGRTREQ
Sbjct: 147 LRDPDKIYHIVKEVTSVLDIPLTVKMRTGWADSSLAVENALAAESAGVSALAMHGRTREQ  206

Query: 183 MYTGTCDHETLGKVAKAVTSIPFIANGDIRTVHDAKFMIEEIGADAIMVGRGARSNPYIF  242
           MYTGTCDHETL +V+KA+T IPFI NGD+R+V DAKFMIEEIG DA+M+GR A +NPY+F
Sbjct: 207 MYTGTCDHETLARVSKAITKIPFIGNGDVRSVQDAKFMIEEIGVDAVMIGRAAMNNPYLF  266

Query: 243 TQINHFFETGEILFDLPFEKMLDVAEDHLTRLVNLKGETIAVREFRGLAFHYLRGKSGAA  302
           TQINHFFETG+ LPDLPF K LD+A+DHL RL+NLKGETIAVREFRGLAPHYLRG +GAA
Sbjct: 267 TQINHFFETGQELPDLPFAKKLDIAKDHLKRLINLKGETIAVREFRGLAPHYLRGTAGAA  326

Query: 303 KIRGAVSRAETLAEVQELFAGLR                                      325
           K+RGAVSRAETLAEV+ + F  +R
Sbjct: 327 KVRGAVSRAETLAEVEAIFETVR                                      349
```

Based on this analysis, it was predicted that these proteins and their epitopes could be useful antigens for vaccines or diagnostics.

EXAMPLE 1479

A DNA sequence (GBSx1565) was identified in *S. agalactiae* <SEQ ID 4547> which encodes the amino acid sequence <SEQ ID 4548>. Analysis of this protein sequence reveals the following:

```
Possible site: 53
>>> Seems to have no N-terminal signal sequence

----- Final Results -----
            bacterial cytoplasm --- Certainty = 0.2164(Affirmative) < succ>
             bacterial membrane --- Certainty = 0.0000(Not Clear)   < succ>
              bacterial outside --- Certainty = 0.0000(Not Clear)   < succ>
```

There is also homology to SEQ ID 3930:

```
Identities = 235/288 (81%), Positives = 259/288 (89%)

Query:    1 MDKIIKSISTSGSFRAYVLDCTSTVRTAQEKHQTLSSSTVALGRTLIANQILAANQKGNS   60
            MDKIIKSI+ SG+FRAYVLD TETV  AQEKH TLSSSTVALGRTLIANQILAANQKG+S
Sbjct:    1 MDKIIKSIAQSGAFRAYVLDSTETVALAQEKHNTLSSSTVALGRTLIANQILAANQKGDS   60

Query:   61 KVTVKVIGDSSFGHIISVADTKGNVKGYIQNTGVDIKKTATGEVLVGPFMGNGHFVVITD  120
            K+TVKVIGDSSFGHIISVADTKG+VKGYIQNTGVDIKKTATGEVLVGPFMGNGHFV I D
Sbjct:   61 KITVKVIGDSSFGHIISVADTKGHVKGYIQNTGVDIKKTATGEVLVGPFMGNGHFVTIID  120

Query:  121 YATGQPYTSTTPLITGEIGEDFAYYLTESEQTPSAVGLNVLLDDEDKVKVAGGFMLQVLP  180
            Y TG PYTSTTPLITGEIGEDFAYYLTESEQTPSA+GLNVLLD+ DKVKVAGGFM+QVLP
Sbjct:  121 YGTGNPYTSTTPLITGEIGEDFAYYLTESEQTPSAIGLNVLLDENDKVKVAGGFMVQVLP  180

Query:  181 GASDEEISRYEKRIQEMPSISSLLESENHIESLLSAIYGEDDYKRLSEDSLAFYCDCSKE  240
            GAS+EEI+RYEKR+QEMP+IS LL S+NH+++LL AIYG++ YKRLSE+ L+F CDCS+E
Sbjct:  181 GASEEEIARYEKRLQEMPAISHLLASKNHVDALLEAIYGDEPYKRLSEEPLSFQCDCSRE  240

Query:  241 RFEAALLTLGTKELQAMKDEDKGVEITCQFCNQTYYFTEEDLEKIIND             288
            RFEAAL+TL   +LQAM DEDKG EI CQFC   Y F E DLE II+D
Sbjct:  241 RFEAALMTLPKADLQAMIDEDKGAEIVCQFCGTKYQFNESDLEAIISD             288
```

Based on this analysis, it was predicted that this protein and its epitopes, could be useful antigens for vaccines or diagnostics.

EXAMPLE 1480

A DNA sequence (GBSx1566) was identified in *S. agalactiae* <SEQ ID 4549> which encodes the amino acid sequence <SEQ ID 4550>. This protein is predicted to be surface-located membrane protein 1 (Imp1). Analysis of this protein sequence reveals the following:

```
Possible site: 51
>>> Seems to have no N-terminal signal sequence

----- Final Results -----
            bacterial cytoplasm --- Certainty = 0.4312(Affirmative) < succ>
            bacterial membrane --- Certainty = 0.0000(Not Clear) < succ>
              bacterial outside --- Certainty = 0.0000(Not Clear) < succ>
```

The protein has homology with the following sequences in the GENPEPT database.

```
>GP: AAB93480 GB: AF019377 tellurite resistance protein [Rhodobacter
sphaeroides]
Identities = 64/350 (18%), Positives = 146/350 (41%), Gaps = 7/350 (2%)

Query:   44 LTPAQKSAISEKTPALVDTFVGDQNALLDFGQSAVEGVNTTVNHILSEQKKIQIPQVDDL  103
            L  A     E  + + VD +++ FG A   + T   +L++ K    D
Sbjct:   34 LASAPPEKAQEIRRRMAELNVSDSQSIIGFGSKAQAELQTISQQMLADVKNKDVGPAGDS   93

Query:  104 LKNANRELNGFIAKYKDATPAELEKKPNLIQKLFKQSKTSLQEFYFDSQNIEQKMDMMAA  163
            L+     + GF      +  ++ +K +  ++L ++       F    ++++Q++D +
Sbjct:   94 LREVVSTIRGF-----SVSEFDVRRKASWWERLLGRT-APFARFVARYEDVQQQIDRITQ  147

Query:  164 NVVKQEDTLARNIVSAEMLIEDNTKSIENLVGVIAFIESSQAEAANRASHLQQEILALDS  223
            +++ E L ++I  ++L       + L   IA + A+ R    ++ +A
Sbjct:  148 SLLTHEHRLLKDIKGLDILYARTLDFYDELALYIAAGDEVLADLDGRVIPAKEAEVAATP  207

Query:  224 QTSEYQIKSNQLARMTEVINTLEQQHPEYVSRLYVAWATTPQMRNLVKVSSDMRQKLGML  283
              +   IK+ +L +   + LE++     V  + P +R + +     + ++
Sbjct:  208 E-GDRMIKAQELRDLRAARDDLERRVHDLKLTRQVTMQSLPSIRLVQENDKALVTRINST  266

Query:  284 RRNTIPTMKLSIAQLGMMQQSVKSGVTADAIVNANNAALQMLAETSKEAIPMLEKTAQSP  343
                NT+P  +AQ   +Q+S ++            +  N L  AE  ++A  ++  K  +
Sbjct:  267 LVNTVPLWETQLAQAVTIQRSREAAEAVRGASDLTNELLTANAENLQQANKIVRKEMERG  326

Query:  344 TVSIKSVTALAESLVAQNNGIIAAIDKGRKERAQLESAVIKSAETINDSV            393
              I++V     +L+A  N  +A   D+GR  RA  E+ +    + D++
Sbjct:  327 VFDIEAVKKANATLIATINESLAIADEGRARRATAETELQRMEAELRDTL            376
```

A related DNA sequence was identified in *S. pyogenes* <SEQ ID 4551> which encodes the amino acid sequence <SEQ ID 4552>. Analysis of this protein sequence reveals the following:

```
Possible site: 55
>>> Seems to have no N-terminal signal sequence

----- Final Results -----
           bacterial cytoplasm --- Certainty = 0.3230(Affirmative) < succ>
           bacterial membrane  --- Certainty = 0.0000(Not Clear)   < succ>
           bacterial outside   --- Certainty = 0.0000(Not Clear)   < succ>
```

An alignment of the GAS and GBS proteins is shown below.

```
Identities = 333/413 (80%), Positives = 379/413 (91%)

Query:    5 FNFDIDQIADNAITKTDKTTEIISNQTTSQTGQIAFFEKLTPAQKSAISEKTPALVDTFV   64
            FNFDIDQIADNA+ KTDKTT+IIS+  T   GQI+FFEKL+  Q++AI+ K PALVDTF+
Sbjct:    4 FNFDIDQIADNAVIKTDKTTDIISDLPTDTNGQISFFEKLSADQQTAITAKAPALVDTFL   63

Query:   65 GDQNALLDFGQSAVEGVNTTVNHILSEQKKIQIPQVDDLLKNANRELNGFIAKYKDATPA  124
            DQNALLDFGQSAVEGVN TVNHIL+EQKK+QIPQVDDLLK+ NRELNGFIAKYKDATP
Sbjct:   64 ADQNALLDFGQSAVEGVNATVNHILAEQKKLQIPQVDDLLKSTNRELNGFIAKYKDATPV  123

Query:  125 ELEKKPNLIQKLFKQSKTSLQEFYFDSQNIEQKMDMMAANVVKQEDTLARNIVSAEMLIE  184
            +L+KKPN +QKLFKQS+ +LQEFYFDSQNIEQKMD MAA VVKQEDTLARNIVSAE+LIE
Sbjct:  124 DLDKKPNFLQKLFKQSRDTLQEFYFDSQNIEQKMDSMAAAVVKQEDTLARNIVSAELLIE  183

Query:  185 DNTKSIENLVGVIAFIESSQAEAANRASHLQQEILALDSQTSEYQIKSNQLARMTEVINT  244
            DNTKSIE+LVGVIAFIE+SQ EA+ RA+ LQ+++   DS T +YQIK++ LAR TEVINT
Sbjct:  184 DNTKSIEHLVGVIAFIEASQKEASQRAAALQKDLKTKDSATPDYQIKADLLARTTEVINT  243

Query:  245 LEQQHPEYVSRLYVAWATTPQMRNLVKVSSDMRQKLGMLRRNTIPTMKLSIAQLGMMQQS  304
            LEQQH  EY+SRLYVAWATTPQMRNLVKVSSDMRQKLGMLRRNTIPTMKLSIAQLGMMQQS
Sbjct:  244 LEQQHTEYLSRLYVAWATTPQMRNLVKVSSDMRQKLGMLRRNTIPTMKLSIAQLGMMQQS  303

Query:  305 VKSGVTADAIVNANNAALQMLAETSKEAIPMLEKTAQSPTVSIKSVTALAESLVAQNNGI  364
            VKSG+TADAI+NANNAALQMLAETSKEAIP LE++AQ+PT+S+KSVT+LAESLVAQNNGI
Sbjct:  304 VKSGMTADAIINANNAALQMLAETSKEAIPALEQSAQNPTLSMKSVTSLAESLVAQNNGI  363

Query:  365 IAAIDKGRKERAQLESAVIKSAETINDSVKIRDKKIVEALLNEGKSTQEKVDE         417
            IAAID GRKERAQLESA+I+SAETINDSVK+RD+ IV+ALL+EGK TQ+ +D+
Sbjct:  364 IAAIDHGRKERAQLESAIIRSAETINDSVKLRDQNIVQALLSEGKETQKTIDK         416
```

Figure 304:
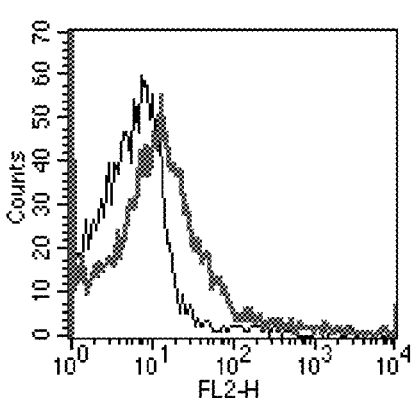

SEQ ID 4550 (GBS201) was expressed in *E. coli* as a His-fusion product. SDS-PAGE analysis of total cell extract is shown in FIG. 49 (lane 5; MW 49 kDa). It was also expressed in *E. coli* as a GST-fusion product. SDS-PAGE analysis of total cell extract is shown in FIG. 54 (lane 3; MW 74.5 kDa) and in FIG. 62 (lane 8 & 9; MW 74.5 kDa). The GBS201-GST fusion product was purified (FIG. 209, lane 9) and used to immunise mice. The resulting antiserum was used for FACS (FIG. 304), which confirmed that the protein is immunoaccessible on GBS bacteria.

Based on this analysis, it was predicted that these proteins and their epitopes could be useful antigens for vaccines or diagnostics.

EXAMPLE 1481

A DNA sequence (GBSx1567) was identified in *S. agalactiae* <SEQ ID 4553> which encodes the amino acid sequence <SEQ ID 4554>. This protein is predicted to be rhoptry protein. Analysis of this protein sequence reveals the following:

```
Possible site: 27
>>> Seems to have an uncleavable N-term signal seq
     INTEGRAL    Likelihood = -6.58    Transmembrane    13-29 (10-31)
     INTEGRAL    Likelihood = -1.54    Transmembrane    33-49 (33-49)

----- Final Results -----
           bacterial membrane  --- Certainty = 0.3633(Affirmative) < succ>
           bacterial outside   --- Certainty = 0.0000(Not Clear)   < succ>
           bacterial cytoplasm --- Certainty = 0.0000(Not Clear)   < succ>
```

The protein has no significant homology with any sequences in the GENPEPT database.

A related DNA sequence was identified in *S. pyogenes* <SEQ ID 4555> which encodes the amino acid sequence <SEQ ID 4556>. Analysis of this protein sequence reveals the following:

```
Possible site: 37
>>> Seems to have a cleavable N-term signal seq.

----- Final Results -----
            bacterial outside --- Certainty = 0.3000(Affirmative) < succ>
            bacterial membrane --- Certainty = 0.0000(Not Clear)   < succ>
            bacterial cytoplasm --- Certainty = 0.0000(Not Clear)  < succ>
```

The protein has no significant homology with any sequences in the GENPEPT database.

An alignment of the GAS and GBS proteins is shown below.

```
Identities = 115/239 (48%), Positives = 162/239 (67%), Gaps = 3/239 (1%)

Query:  32 EVIATLLIIGGGYCAYYVYD-KKRLKRFTSNQRIEALKSDIKETDQDIRHLEILKKDNRS   90
           +++  + I G GY  + V   +KRL +     +++E LK+ I+  D+ +R L+     D+
Sbjct:  42 DILPAIAIGGTGYAIFRVRSHQKRLAKAKIAKQLEDLKAKIQLADRKVRLLDTYLADHDD  101

Query:  91 KEYIKLAHQILPQLDLIRNEANQLQKAIEPNIYKRITKKANTFSNEINEQLIKLHASPEL  150
           +Y  LA Q+LPQL I+ +A  L+  ++P IY+RITKKAN    ++I  QL  L  +  L
Sbjct: 102 FQYNVLAQQLLPQLSDIKAKAITLKDQLDPQIYRRITKKANDVESDITLQLETLQIATTL  161

Query: 151 --EPISDQEDEMIRIAPELKPFYHNIQDDHFAILKKIEEADNKAELAAIHQANMKRFTDV  208
             +P+       +I  APELKP+Y NIQ DH AIL KI+ ADN+ EL A+H ANM+RF D+
Sbjct: 162 NPQPLKTPSPNLINKAPELKPYYDNIQTDHQAILAKIQGADNQEELLALHDANMRRFEDI  221

Query: 209 LAGYIRIKQSPKNFNNAKERLEQALQAIKKFNLDLDETLRQLNESDMKDFDVSLRMMQG   267
           L GY++IK+ PKN+ NA  RLEQA QAI++F+ DLDETLR+LNESD+KDFD+SLR+MQG
Sbjct: 222 LTGYLKIKEEPKNYYNAAARLEQAKQAIQQFDEDLDETLRRLNESDLKDFDISLRIMQG   280
```

SEQ ID 4554 (GBS265) was expressed in *E. coli* as a GST-fusion product. SDS-PAGE analysis of total cell extract is shown in FIG. 54 (lane 2; MW 56 kDa) and in FIG. 62 (lane 6; MW 56.3 kDa).

The GBS265-GST fusion product was purified (FIG. 207, lane 5) and used to immunise mice. The resulting antiserum was used for Western blot (FIG. 258A) and FACS (FIG. 258B). These tests confirm that the protein is immunoaccessible on GBS bacteria.

Based on this analysis, it was predicted that these proteins and their epitopes could be useful antigens for vaccines or diagnostics.

EXAMPLE 1482

A DNA sequence (GBSx1568) was identified in *S. agalactiae* <SEQ ID 4557> which encodes the amino acid sequence <SEQ ID 4558>. This protein is predicted to be glutamate—cysteine ligase (gshA). Analysis of this protein sequence reveals the following:

```
Possible site: 40
>>> Seems to have no N-terminal signal sequence
    INTEGRAL     Likelihood = -1.70      Transmembrane   575-591 (575-591)

----- Final Results -----
            bacterial membrane  --- Certainty = 0.1680(Affirmative) < succ>
            bacterial outside   --- Certainty = 0.0000(Not Clear)   < succ>
            bacterial cytoplasm --- Certainty = 0.0000(Not Clear)   < succ>
```

The protein has homology with the following sequences in the GENPEPT database.

```
>GP: AAG08588 GB: AE004933 glutamate--cysteine ligase
[Pseudomonas aeruginosa]
Identities = 142/468 (30%), Positives 220/468 (46%), Gaps = 62/468 (13%)

Query:  12 SHLPIL-QATFGLERESLRIHQPTQRVAQTPHPKTLGSRNYHPYIQTDYSEPQLELITPI  70
           ++LP+L +   G+ERE LR+    ++A TPHP+ LGS   HP I TDYSE  LE ITP
Sbjct:  16 ANLPLLTECLHGIERECLRVDSDG-KLALTPHPRALGSTLTHPQITTDYSEALLEFITPT  74

Query:  71 AKDSQEAIRFLKAISDVAGRSINHDEYLWPLSMPPKV-REEDIQIAQLEDA----FEYDY  125
            D + + L+ I  A   ++ EYLW SMP ++ EE I IA+ +     +Y Y
Sbjct:  75 ETDVADTLGDLERIHRFASSKLD-GEYLWSPSMPCELPDEESIPIARYGSSMIGRLKYVY  133
```

```
                          -continued
Query: 126 RKYLEKTYGKLIQSISGIHYNLGLGQELLTSLFELSQAD-NAIDFQNQLYMKLSQNFLRY 184
           RK L  YGK +Q I+GIHYN  L + L   L +    ++ +  D+Q+  Y+ L +NF RY
Sbjct: 134 RKGLALRYGKTMQCIAGIHYNFSLPERLWPLLRQAEGSELSERDYQSAAYIALIRNFRRY 193

Query: 185 RWLLTYLYGASPVAEEDFLDQKLNNPVR------------SLRNSHLGYVNHKDIRIS-- 230
           WLL YL+GASP +  FL + +    R             SLR S LGY N+     ++
Sbjct: 194 SWLLMYLFGASPALDAGFLRGRPSQLERLDEHTLYLPYATSLRMSDLGYQNNAQAGLTPC 253

Query: 231 YTSLKDYVNDLENAV--------------------KSGQLIAEKEFYSPVRLR-----G 264
           Y L+ Y++ L AV                        +  L  E E+YS +R +     G
Sbjct: 254 YNDLQSYIDSLRQAVSTPYPPYEKVGTKQDGEWVQLNTNILQIENEYYSSIRPKRVTYTG 313

Query: 265 SKACRNYLEKGITYLEFRTFDLNPFSPIGITQETVDTVHLFLLALLWIDS---------- 314
            + +    +G+ Y+E R  D+NPF P+GI  +     +   FLL    + DS
Sbjct: 314 ERPVQALAARGVQYVEVRCLDINPFLPLGIDLDEARFLDAFLLFCAFSDSPLLNGECSDA 373

Query: 315 SSHIDQDIKEANRLN-DLIALSHPLEKLPNQAPVSDLVDAMQSVIQHFNLSPYYQDLLES 373
            + +    +KE  R   L    P+E       + +    +++        +    L +
Sbjct: 374 TDNFLAVVKEGRRPGLQLQRRGQPVELQVWANELLERIADTAALLDRARGGEAHAAALAA 433

Query: 374 VKRQIQSPELTVAGQLLEMI--EGLSLETFGQRQGQIYHDYAWEAPYA            419
            + ++    ELT + Q+L+++     G S E F    RQ + + +Y    + P A
Sbjct: 434 QRAKVADAELTPSAQVLKVMRERGESFEAFSLRQSREHAEYFRQHPLA            481
```

There is also homology to SEQ ID 4560.

Based on this analysis, it was predicted that this protein and its epitopes, could be useful antigens for vaccines or diagnostics.

EXAMPLE 1483

A DNA sequence (GBSx1569) was identified in *S. agalactiae* <SEQ ID 4561> which encodes the amino acid sequence <SEQ ID 4562>. Analysis of this protein sequence reveals the following:

```
Possible site: 59
>>> Seems to have no N-terminal signal sequence

----- Final Results -----
          bacterial cytoplasm --- Certainty = 0.1504(Affirmative) < succ>
          bacterial membrane  --- Certainty = 0.0000(Not Clear)   < succ>
          bacterial outside   --- Certainty = 0.0000(Not Clear)   < succ>
```

The protein has homology with the following sequences in the GENPEPT database.

```
>GP:CAB73814 GB:AL139078 helix-turn-helix containing protein
[Campylobacter jejuni]
Identities = 107/223 (47%), Positives = 148/223 (65%), Gaps = 7/223 (3%)

Query:   1 MDKEKLDYWKTIITFLHNVLGDNYEIVLHVVDENDIYIGELVNSHISGRTISSPLTTFAL  60
           MD+ +      +  FL  VLG+ YEIV HV+ E+  YI  + NSHISGR++ SPLT FA
Sbjct:   1 MDEGQKQQFIKLTYFLGEVLGEQYEIVFHVITEDGAYIAAIANSHISGRSLDSPLTAFAS  60

Query:  61 DLIKNKVYKEKDFVTNYKAIVSPLNKEVRGSTFFIKNAQNELEGMLCINLDISAYQNIAL 120
           +L++NK Y EKDF+ +YKA+V   +K +RGSTFFIKN ++L G+LCIN D S   +++
Sbjct:  61 ELMQNKKYLEKDFLCDYKALVGK-SKLIRGSTFFIKN-HDKLVGILCINHDTSIMRDLIC 118

Query: 121 DILDLVNL-NVNKILPKSPQKISLPQQEEPVEVLSGNIQDIISEIVDPSLLNQNIHLSQE 179
           ++DL + ++ IL    IS Q   +E LS +I+DI+ + VD S LN +  LS
Sbjct: 119 KMIDLEKIGDMGDIL----GNISFSQNDSSIETLSHSIEDILVQSVDSSYLNSDYQLSIT 174

Query: 180 VKVEIVSKLHEKGVFQLKGAVSKVAEVLNISEPSVYRYLKKIE                 222
            K EI  KL+EKG+F  +KGAV  VA+ L ISEPSVYRYLKK +
Sbjct: 175 QKEEIAEKLYEKGIFNIKGAVPIVAKFLKISEPSVYRYLKKFK                 217
```

A related DNA sequence was identified in *S. pyogenes* <SEQ ID 4563> which encodes the amino acid sequence <SEQ ID 4564>. Analysis of this protein sequence reveals the following:

```
Possible site: 21
>>> Seems to have no N-terminal signal sequence

----- Final Results -----
              bacterial cytoplasm --- Certainty = 0.1636(Affirmative) < succ>
                bacterial membrane --- Certainty = 0.0000(Not Clear)  < succ>
                 bacterial outside --- Certainty = 0.0000(Not Clear)  < succ>
```

An alignment of the GAS and GBS proteins is shown below.

```
Identities = 169/224 (75%), Positives = 198/224 (87%), Gaps = 3/224 (1%)

Query:    1 MDKEKLDYWKTIITFLHNVLGDNYEIVLHVVDENDIYIGELVNSHISGRTISSPLTTFAL   60
            MDKE L+YWKT+ITFLH+VLGDNYEI+LHV+D+NDIYIGELVNSHISGR+  SPLTTFAL
Sbjct:    1 MDKETLNYWKTVITFLHDVLGDNYEIILHVIDKNDIYIGELVNSHISGRSKQSPLTTFAL   60

Query:   61 DLIKNKVYKEKDFVTNYKAIVSPLNKEVRGSTFFIKNAQNELEGMLCINLDISAYQNIAL  120
            DLI NKVYKEKDFVTNYKAIVSP +KEVRGSTFFIK+ +  LEGMLCINLDISAYQ +A
Sbjct:   61 DLITNKVYKEKDFVTNYKAIVSPQHKEVRGSTFFIKDKKGNLEGMLCINLDISAYQGVAR  120

Query:  121 DILDLVNLNVNKILP--KSPQKISLPQQEEPVEVLSGNIQDIISEIVDPSLLNQNIHLSQ  178
            D+L LVNLN+   +P  K P+ ++ PQ EE VE+L+ NIQDII +I+DPSLL  N+HLSQ
Sbjct:  121 DLLKLVNLNLEHFIPTAKEPKTVT-PQPEEAVEILTSNIQDIIGQIIDPSLLRHNVHLSQ  179

Query:  179 EVKVEIVSKLHEKGVFQLKGAVSKVAEVLNISEPSVYRYLKKIE                 222
            +VK++IV+KL+EKGVFQLKGAVSKVA++L ISEPSVYRYLKKIE
Sbjct:  180 DVKIDIVAKLYEKGVFQLKGAVSKVADILCISEPSVYRYLKKIE                 223
```

Based on this analysis, it was predicted that these proteins and their epitopes could be useful antigens for vaccines or diagnostics.

EXAMPLE 1484

A DNA sequence (GBSx1570) was identified in *S. agalactiae* <SEQ ID 4565> which encodes the amino acid sequence <SEQ ID 4566>. This protein is predicted to be regulatory protein pfoR. Analysis of this protein sequence reveals the following:

```
Possible site: 37
>>> Seems to have a cleavable N-term signal seq.
       INTEGRAL    Likelihood = -7.80    Transmembrane    299-315 (296-325)
       INTEGRAL    Likelihood = -7.54    Transmembrane    172-188 (169-193)
       INTEGRAL    Likelihood = -7.17    Transmembrane     71-87  (66-98)
       INTEGRAL    Likelihood = -4.99    Transmembrane    261-277 (260-278)
       INTEGRAL    Likelihood = -2.81    Transmembrane    128-144 (127-149)
       INTEGRAL    Likelihood = -2.18    Transmembrane    101-117 (101-119)
       INTEGRAL    Likelihood = -0.53    Transmembrane    198-214 (197-214)

----- Final Results -----
                bacterial membrane --- Certainty = 0.4121(Affirmative) < succ>
                 bacterial outside --- Certainty = 0.0000(Not Clear)  < succ>
              bacterial cytoplasm --- Certainty = 0.0000(Not Clear)  < succ>
```

The protein has homology with the following sequences in the GENPEPT database.

```
>GP:CAA60239 GB:X86525 pfoS [Clostridium perfringens]
Identities = 96/147 (65%), Positives = 122/147 (82%)

Query:  100 GTGIIPGFLAGYLVGFLVKWMERNIPGGLDLISIIIIGAPLTRLVAKLLTPLINSTLLTI  159
            G GI+PGF+AGYL  F++K++E+ IP GLDLI II++GAPL R +A +  PL+ +TL  I
Sbjct:    1 GFGILPGFIAGYLGSFVIKFLEKKIPAGLDLIVIIVLGAPLVRGIAAISNPLVETTLQNI   60

Query:  160 GDILTSGAHSNPILMGIILGGTIVVVATAPLSSMALTAMLGLTGMPMAIGALSVFGSSFM  219
            G ++T+ + ++PI+MGIILGG + VVATAPLSSMALTAMLGLTG+PMAIGAL+VFGSSFM
Sbjct:   61 GGVITATSTASPIMMGIILGGIVTVVATAPLSSMALTAMLGLTGLPMAIGALAVFGSSFM  120

Query:  220 NGVLFHKLKLGSRKDNIAFAVEPLTQA                                  246
            N V F K+K GS+KD IA A+EPLTQA
Sbjct:  121 NLVFFGKMKFGSKKDTIAVAIEPLTQA                                  147
```

A related DNA sequence was identified in *S. pyogenes* <SEQ ID 4567> which encodes the amino acid sequence <SEQ ID 4568>. Analysis of this protein sequence reveals the following:

```
Possible site: 37
>>> Seems to have a cleavable N-term signal seq.
     INTEGRAL    Likelihood = -8.70    Transmembrane    303-319 (296-325)
     INTEGRAL    Likelihood = -7.11    Transmembrane      70-86 (66-98)
     INTEGRAL    Likelihood = -6.53    Transmembrane    172-188 (169-193)
     INTEGRAL    Likelihood = -4.83    Transmembrane    261-277 (260-278)
     INTEGRAL    Likelihood = -2.55    Transmembrane    101-117 (101-119)
     INTEGRAL    Likelihood = -2.28    Transmembrane    124-140 (124-140)
     INTEGRAL    Likelihood = -1.91    Transmembrane    198-214 (197-215)

----- Final Results -----
               bacterial membrane --- Certainty = 0.4482(Affirmative) < succ>
                bacterial outside --- Certainty = 0.0000(Not Clear) < succ>
              bacterial cytoplasm --- Certainty = 0.0000(Not Clear) < succ>
```

The protein has homology with the following sequences in the databases:

```
>GP:CAA60239 GB:X86525 pfoS [Clostridium perfringens]
Identities = 95/147 (64%), Positives = 123/147 (63%)

Query: 100 GTGIIPGFVAGYVVSFLIKWMEKNIPGGLDLISIIIVGAPLTRFLAQLITPVINSTLLTI  159
           G GI+PGF+AGY+ SF+IK++EK IP GLDLI II++GAPL R +A +  P++ +TL  I
Sbjct:   1 GFGILPGFIAGYLGSFVIKFLEKKIPAGLDLIVIIVLGAPLVRGIAAISNPLVETTLQNI   60

Query: 160 GDILTSSANSNPIIMGMILGGTIVVVATAPLSSMALTAMLGLTGIPMAIGALSVFGSSFM  219
           G ++T+++ ++PI+MG+ILGG + VVATAPLSSMALTAMLGLTG+PMAIGAL+VFGSSFM
Sbjct:  61 GGVITATSTASPIMMGIILGGIVTVVATAPLSSMALTAMLGLTGLPMAIGALAVFGSSFM  120

Query: 220 NGVLFYRLKLGERKDNIAFAIEPLTQA                                  246
           N V F ++K G +KD IA AIEPLTQA
Sbjct: 121 NLVFFGKMKFGSKKDTIAVAIEPLTQA                                  147
```

An alignment of the GAS and GBS proteins is shown below.

```
Identities = 302/339 (89%), Positives = 330/339 (97%)

Query:   1 MNIIIGTSLLILVLAIFTLFNYKAPYGTKAMGALASAACASFLVEAFQDSFFGKVLGFQF   60
           M+IIIGTSLLILVLAIF+LFNYKAP+G KAMGALASAACASFLVEAFQDSFFGKVLGFQF
Sbjct:   1 MDIIIGTSLLILVLAIFSLFNYKAPHGAKAMGALASAACASFLVEAFQDSFFGKVLGFQF   60

Query:  61 LSEVGGANGSLSGVAAAILVAIAIGVTPGYAVLIGLSVSGTGIIPGFLAGYLVGFLVKWM  120
           LSEVGGANGSLSGVAAAILVAIAIGV+PGYAVLIGLSVSGTGIIPGF+AGY+V FL+KWM
Sbjct:  61 LSEVGGANGSLSGVAAAILVAIAIGVSPGYAVLIGLSVSGTGIIPGFVAGYVVSFLIKWM  120

Query: 121 ERNIPGGLDLISIIIIGAPLTRLVAKLLTPLINSTLLTIGDILTSGAHSNPILMGIILGG  180
           E+NIPGGLDLISIII+GAPLTR +A+L+TP+INSTLLTIGDILTS A+SNPI+MG+ILGG
Sbjct: 121 EKNIPGGLDLISIIIVGAPLTRFLAQLITPVINSTLLTIGDILTSSANSNPIIMGMILGG  180

Query: 181 TIVVVATAPLSSMALTAMLGLTGMPMAIGALSVFGSSFMNGVLFHKLKLGSRKDNIAFAV  240
           TIVVVATAPLSSMALTAMLGLTG+PMAIGALSVFGSSFMNGVLF++LKLG RKDNIAFA+
Sbjct: 181 TIVVVATAPLSSMALTAMLGLTGIPMAIGALSVFGSSFMNGVLFYRLKLGERKDNIAFAI  240

Query: 241 EPLTQADVTSANPIPIYVTNFVGGAACGILIALMKLVNDTPGTATPIAGFAVMFAYNPMI  300
           EPLTQADVTSANPIPIYVTNFVGGAACG+LIALMKLVNDTPGTATPIAGFAVMFAYNP+
Sbjct: 241 EPLTQADVTSANPIPIYVTNFVGGAACGVLIALMKLVNDTPGTATPIAGFAVMFAYNPVA  300

Query: 301 KVLITALGCIILSLLAGYFGGIVFKDYKLVTKEELQARD                      339
           KVLITALGCII+SL+ GY GG VFK+Y+LVTK+ELQAR+
Sbjct: 301 KVLITALGCIIISLIVGYIGGSVFKNYRLVTKQELQARN                      339
```

Based on this analysis, it was predicted that these proteins and their epitopes could be useful antigens for vaccines or diagnostics.

EXAMPLE 1485

A DNA sequence (GBSx1571) was identified in *S. agalactiae* <SEQ ID 4569> which encodes the amino acid sequence <SEQ ID 4570>. This protein is predicted to be adenylosuccinate synthetase (purA). Analysis of this protein sequence reveals the following:

```
Possible site: 27
>>> Seems to have no N-terminal signal sequence

----- Final Results -----
              bacterial cytoplasm --- Certainty = 0.0560(Affirmative) < succ>
              bacterial membrane  --- Certainty = 0.0000(Not Clear)   < succ>
               bacterial outside  --- Certainty = 0.0000(Not Clear)   < succ>
```

The protein has homology with the following sequences in the GENPEPT database.

```
>GP: CAB16079 GB: Z99124 adenylosuccinate synthetase [Bacillus subtilis]
Identities = 320/427 (74%), Positives = 378/427 (87%)

Query:   1 MTSVVVVGTQWGDEGKGKITDFLSADAEVIARYQGGDNAGHTIVIDNKKFKLHLIPSGIF  60
           M+SVVVVGTQWGDEGKGKITDFLS +AEVIARYQGG+NAGHTI  D   +KLHLIPSGIF
Sbjct:   1 MSSVVVVGTQWGDEGKGKITDFLSENAEVIARYQGGNNAGHTIKFDGITYKLHLIPSGIF  60

Query:  61 FKEKISVIGNGVVVNPKSLVKELAYLHGEGVTTDNLRISDRAHVILPYHIKLDQLQEDAK 120
           +K+K  VIGNG+VV+PK+LV ELAYLH   V+TDNLRIS+RAHVILPYH+KLD+++E+ K
Sbjct:  61 YKDKTCVIGNGMVVDPKALVTELAYLHERNVSTDNLRISNRAHVILPYHLKLDEVEEERK 120

Query: 121 GDNKIGTTIKGIGPAYMDKAARVGIRIADLLDREVFAERLKINLAEKNRLFEKMYDSTPL 180
           G NKIGTT KGIGPAYMDKAAR+GIRIADLLDR+ FAE+L+ NL EKNRL EKMY++
Sbjct: 121 GANKIGTTKKGIGPAYMDKAARIGIRIADLLDRDAFAEKLERNLEEKNRLLEKMYETEGF 180

Query: 181 EFDDIFEEYYEYGQQIKQYVTDTSVILNDALDAGKRVLFEGAQGVMLDIDQGTYPFVTSS 240
           + +DI +EYYEYGQQIK+YV DTSV+LNDALD G+RVLFEGAQGVMLDIDQGTYPFVTSS
Sbjct: 181 KLEDILDEYYEYGQQIKKYVCDTSVVLNDALDEGRRVLFEGAQGVMLDIDQGTYPFVTSS 240

Query: 241 NPVAGGVTIGSGVGPSKINKVVGVCKAYTSRVGDGPFPTELFDEVGDRIREIGKEYGTTT 300
           NPVAGGVTIGSGVGP+KI  VVGV KAYT+RVGDGPFPTEL DE+GD+IRE+G+EYGTTT
Sbjct: 241 NPVAGGVTIGSGVGPTKIKHVVGVSKAYTTRVGDGPFPTELKDEIGDQIREVGREYGTTT 300

Query: 301 GRPRRVGWFDSVVMRHSRRVSGITNLSLNSIDVLSGLDTVKICVAYDLDGKRIDYYPASL 360
           GRPRRVGWFDSVV+RH+RRVSGIT+LSLNSIDVL+G++T+KICVAY    G+ I+ +PASL
Sbjct: 301 GRPRRVGWFDSVVVRHARRVSGITDLSLNSIDVLAGIETLKICVAYRYKGEIIEEFPASL 360

Query: 361 EQLKRCKPIYEELPGWSEDITACRSLDDLPENARNYVRRVGELVGVRISTFSVGPGREQT 420
           + L  C+P+YEE+PGW+EDIT  +SL +LPENAR+Y+ RV +L G+ +S FSVGP R QT
Sbjct: 361 KALAECEPVYEEMPGWTEDITGAKSLSELPENARHYLERVSQLTGIPLSIFSVGPDRSQT 420

Query: 421 NILESVW                                                     427
           N+L SV+
Sbjct: 421 NVLRSVY                                                     427
```

A related DNA sequence was identified in *S. pyogenes* <SEQ ID 4571> which encodes the amino acid sequence <SEQ ID 4572>. Analysis of this protein sequence reveals the following:

```
Possible site: 27
>>> Seems to have no N-terminal signal sequence

----- Final Results -----
              bacterial cytoplasm --- Certainty = 0.0560(Affirmative) < succ>
              bacterial membrane  --- Certainty = 0.0000(Not Clear)   < succ>
               bacterial outside  --- Certainty = 0.0000(Not Clear)   < succ>
```

An alignment of the GAS and GBS proteins is shown below.

```
Identities = 406/430 (94%), Positives = 421/430 (97%)

Query:    1 MTSVVVVGTQWGDEGKGKITDFLSADAEVIARYQGGDNAGHTIVIDNKKFKLHLIPSGIF   60
            MTSVVVVGTQWGDEGKGKITDFLSADAEVIARYQGGDNAGHTIVID KKFKLHLIPSGIF
Sbjct:    1 MTSVVVVGTQWGDEGKGKITDFLSADAEVIARYQGGDNAGHTIVIDGKKFKLHLIPSGIF   60

Query:   61 FKEKISVIGNGVVVNPKSLVKELAYLHGEGVTTDNLRISDRAHVILPYHIKLDQLQEDAK  120
            F +KISVIGNGVVVNPKSLVKELAYLH EGVTTDNLRISDRAHVILPYHI+LDQLQEDAK
Sbjct:   61 FPQKISVIGNGVVVNPKSLVKELAYLHDEGVTTDNLRISDRAHVILPYHIQLDQLQEDAK  120

Query:  121 GDNKIGTTIKGIGPAYMDKAARVGIRIADLLDREVFAERLKINLAEKNRLFEKMYDSTPL  180
            GDNKIGTTIKGIGPAYMDKAARVGIRIADLLD+++FAERL+INLAEKNRLFEKMYDSTPL
Sbjct:  121 GDNKIGTTIKGIGPAYMDKAARVGIRIADLLDKDIFAERLRINLAEKNRLFEKMYDSTPL  180

Query:  181 EFDDIFEEYYEYGQQIKQYVTDTSVILNDALDAGKRVLFEGAQGVMLDIDQGTYPFVTSS  240
            +FD IFEEYY YGQ+IKQYVTDTSVILNDALDAGKRVLFEGAQGVMLDIDQGTYPFVTSS
Sbjct:  181 DFDAIFEEYYAYGQEIKQYVTDTSVILNDALDAGKRVLFEGAQGVMLDIDQGTYPFVTSS  240

Query:  241 NPVAGGVTIGSGVGPSKINKVVGVCKAYTSRVGDGPFPTELFDEVGDRIREIGKEYGTTT  300
            NPVAGGVTIGSGVGP+KINKVVGVCKAYTSRVGDGPFPTELFDEVG+RIRE+G EYGTTT
Sbjct:  241 NPVAGGVTIGSGVGPNKINKVVGVCKAYTSRVGDGPFPTELFDEVGERIREVGHEYGTTT  300

Query:  301 GRPRRVGWFDSVVMRHSRRVSGITNLSLNSIDVLSGLDTVKICVAYDLDGKRIDYYPASL  360
            GRPRRVGWFDSVVMRHSRRVSGITNLSLNSIDVLSGLDTVKICVAYDLDGKRIDYYPA+L
Sbjct:  301 GRPRRVGWFDSVVMRHSRRVSGITNLSLNSIDVLSGLDTVKICVAYDLDGKRIDYYPANL  360

Query:  361 EQLKRCKPIYEELPGWSEDITACRSLDDLPENARNYVRRVGELVGVRISTFSVGPGREQT  420
            EQLKRCKPIYEELPGW EDIT  RSLD+LPENARNYVRRVGELVGVRISTFSVGPGREQT
Sbjct:  361 EQLKRCKPIYEELPGWQEDITGVRSLDELPENARNYVRRVGELVGVRISTFSVGPGREQT  420

Query:  421 NILESVWSNI                                                    430
            NILESVW++I
Sbjct:  421 NILESVWASI                                                    430
```

Based on this analysis, it was predicted that these proteins and their epitopes could be useful antigens for vaccines or diagnostics.

EXAMPLE 1486

A DNA sequence (GBSx1572) was identified in *S. agalactiae* <SEQ ID 4573> which encodes the amino acid sequence <SEQ ID 4574>. Analysis of this protein sequence reveals the following:

```
Possible site: 46
>>> Seems to have no N-terminal signal sequence
    INTEGRAL    Likelihood = -9.29    Transmembrane      30-46  (22-55)
    INTEGRAL    Likelihood = -2.97    Transmembrane     110-126 (109-126)
    INTEGRAL    Likelihood = -0.11    Transmembrane      89-105 (89-106)

----- Final Results -----
              bacterial membrane --- Certainty = 0.4715(Affirmative) < succ>
               bacterial outside --- Certainty = 0.0000(Not Clear)   < succ>
             bacterial cytoplasm --- Certainty = 0.0000(Not Clear)   < succ>
```

A related GBS nucleic acid sequence <SEQ ID 8823> which encodes amino acid sequence <SEQ ID 8824> was also identified. Analysis of this protein sequence reveals the following:

```
Lipop Possible site: -1 Crend: 10
SRCFLG: 0
McG: Length of UR: 5
     Peak Value of UR: 3.05
     Net Charge of CR: 0
McG: Discrim Score: 4.64
GvH: Signal Score (-7.5): -1.66
     Possible site: 36
>>> Seems to have a cleavable N-term signal seq.
Amino Acid Composition: calculated from 37
```

```
                              -continued
ALOM program count: 2 value: -2.97 threshold: 0.0
   INTEGRAL      Likelihood = -2.97    Transmembrane    100-116 (99-116)
   PERIPHERAL    Likelihood = 1.38     56
modified ALOM score: 1.09
icm1 HYPID: 7 CFP: 0.219
*** Reasoning Step: 3

----- Final Results -----
              bacterial membrane --- Certainty = 0.2190(Affirmative) < succ>
              bacterial outside  --- Certainty = 0.0000(Not Clear)   < succ>
            bacterial cytoplasm  --- Certainty = 0.0000(Not Clear)   < succ>
```

The protein has no significant homology with any sequences in the GENPEPT database and no corresponding DNA sequence was identified in *S. pyogenes*.

Based on this analysis, it was predicted that these proteins and their epitopes could be useful antigens for vaccines or diagnostics.

EXAMPLE 1487

A DNA sequence (GBSx1573) was identified in *S. agalactiae* <SEQ ID 4575> which encodes the amino acid sequence <SEQ ID 4576>. Analysis of this protein sequence reveals the following:

```
Possible site: 15
>>> Seems to have no N-terminal signal sequence

----- Final Results -----
             bacterial cytoplasm --- Certainty = 0.0967(Affirmative) < succ>
              bacterial membrane --- Certainty = 0.0000(Not Clear)   < succ>
               bactarial outside --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1488

A DNA sequence (GBSx1574) was identified in *S. agalactiae* <SEQ ID 4577> which encodes the amino acid sequence <SEQ ID 4578>. This protein is predicted to be SgaT protein (sgaT). Analysis of this protein sequence reveals the following:

```
Possible site: 43
>>> Seems to have no N-terminal signal sequence
   INTEGRAL    Likelihood = -7.80    Transmembrane    441-457 (436-464)
   INTEGRAL    Likelihood = -7.64    Transmembrane    344-360 (339-376)
   INTEGRAL    Likelihood = -6.58    Transmembrane    403-419 (392-422)
   INTEGRAL    Likelihood = -6.48    Transmembrane    237-253 (235-261)
   INTEGRAL    Likelihood = -5.79    Transmembrane    105-121 (99-127)
   INTEGRAL    Likelihood = -5.52    Transmembrane    138-154 (137-155)
   INTEGRAL    Likelihood = -4.78    Transmembrane     18-34  (14-38)
   INTEGRAL    Likelihood = -2.97    Transmembrane    365-381 (365-383)
   INTEGRAL    Likelihood = -0.69    Transmembrane     41-57  (41-57)
   INTEGRAL    Likelihood = -0.16    Transmembrane    160-176 (160-176)

----- Final Results -----
              bacterial membrane --- Certainty = 0.4121(Affirmative) < succ>
               bacterial outside --- Certainty = 0.0000(Not Clear)   < succ>
             bacterial cytoplasm --- Certainty = 0.0000(Not Clear)   < succ>
```

The protein has homology with the following sequences in the GENPEPT database.

```
>GP: AAC77150 GB: AE000491 orf, hypothetical protein [Escherichia coli K12]
Identities = 181/451 (40%), Positives = 274/451 (60%), Gaps = 25/451 (5%)

Query:   11 FSQNILQNPAFFVGLLVLIGYLLLKKPLHDVFAGFIKATVGYLILNVGAGGLVNTFRPIL   70
            F  ++ N     +G++  +GY+LL+K +  +  G IK  +G+++L  G+G L +TF+P++
Sbjct:   30 FFNQVMTNAPLLLGIVTCLGYILLRKSVSVIIKGTIKTIIGFMLLQAGSGILTSTFKPVV   89

Query:   71 VALAKKFNLEAAVIDPYFGLASANAKLETMG-FISVATTALLIGFGINILLVALRKVTKV  129
            +++ + +   A+ D Y   AS   A ++ MG  S       A+L+    +NI   V LR++T +
Sbjct:   90 AKMSEVYGINGAISDTY---ASMMATIDRMGDAYSWVGYAVLLALALNICYVLLRRITGI  146

Query:  130 RTLFITGHIMVQQAATISVFVLLLIPQLRNGFGAWAV----GIICGLYWAVSSNMTVEAT  185
            RT+ +TGHIM QQA   I+V + +         G+ W          I+  LYW ++SNM  + T
Sbjct:  147 RTIMLTGHIMFQQAGLIAVTLFIF------GYSMWTTIICTAILVSLYWGITSNMMYKPT  200

Query:  186 QRLTGGGGFAIGHQQQFAIWFVDKVAPFFGKKEENLDNLKLPTFLNIFHDTVVASATLML  245
            Q +T G GF+IGHQQQFA W    KVAPF GKKEE++++LKLP +LNIFHD +V++A +M
Sbjct:  201 QEVTDGCGFSIGHQQQFASWIAYKVAPFLGKKEESVEDLKLPGWLNIFHDNIVSTAIVMT  260

Query:  246 VFFGGILAVLGPDIMSNVKLIGPGAFVPTKQAFFMYILQTSLTFSVYLFILMQGVRMFVT  305
            +FFG IL   G D +            +   K  + +YILQT  +F+V  +FI+ QGVRMFV
Sbjct:  261 IFFGAILLSFGIDTVQ---------AMAGKVHWTVYILQTGFSFAVAIFIITQGVRMFVA  311

Query:  306 ELTNAFQGISNKLLPGSFPAVDVAASYGFGSSNAVLSGFAFGLIGQLITIALLVVFKNPI  365
            EL+ AF GIS +L+PG+  A+D AA Y F + NAV+ GF +G IGQLI + +LV   + I
Sbjct:  312 ELSEAFNGISQRLIPGAVLAIDCAAIYSF-APNAVVWGFMWGTIGQLIAVGILVACGSSI  370

Query:  366 LIITGFVPVFFDNAAIAVYADKRGGWKAAVALSFISGIIQVALGAVAVGLLGLAGGYHGN  425
            LII GF+P+FF NA I V+A+  GGW+AA+ +  + G+I++       AV L G++  + G
Sbjct:  371 LIIPGFIPMFFSNATIGVFANHFGGWRAALKICLVMGMIEIFGCVWAVKLTGMS-AWMGM  429

Query:  426 IDFEFPWLAFGYIFKYLGIAGYVIVCLFFLA                              456
             D+           F  +GIA   ++ +   LA
Sbjct:  430 ADWSILAPPMMQGFFSIGIAFMAVIIVIALA                              460
```

A related DNA sequence was identified in *S. pyogenes* <SEQ ID 4579> which encodes the amino acid sequence <SEQ ID 4580>. Analysis of this protein sequence reveals the following:

```
Possible site: 43
>>> Seems to have no N-terminal signal sequence
    INTEGRAL    Likelihood = -10.51    Transmembrane    441-457 (435-465)
    INTEGRAL    Likelihood =  -7.80    Transmembrane    344-360 (339-376)
    INTEGRAL    Likelihood =  -7.64    Transmembrane    238-254 (235-261)
    INTEGRAL    Likelihood =  -5.63    Transmembrane    105-121 (100-127)
    INTEGRAL    Likelihood =  -5.52    Transmembrane    138-154 (137-155)
    INTEGRAL    Likelihood =  -5.20    Transmembrane    400-416 (392-422)
    INTEGRAL    Likelihood =  -4.78    Transmembrane     18-34  (14-39)
    INTEGRAL    Likelihood =  -2.97    Transmembrane    365-381 (365-383)
    INTEGRAL    Likelihood =  -1.49    Transmembrane    160-176 (160-177)
    INTEGRAL    Likelihood =  -0.53    Transmembrane     41-57  (41-57)

----- Final Results -----
            bacterial membrane --- Certainty = 0.5203(Affirmative) < succ>
             bacterial outside --- Certainty = 0.0000(Not Clear) < succ>
           bacterial cytoplasm --- Certainty = 0.0000(Not Clear) < succ>
```

The protein has homology with the following sequences in the databases:

```
>GP: AAC77150 GB: AE000491 orf, hypothetical protein [Escherichia coli]
Identities = 182/461 (39%), Positives = 279/461 (60%), Gaps = 25/461 (5%)

Query:    1 MEMLLAPLNWFSQNILQNPAFFVGLLVLIGYLLLKKPIYEVFAGFVKATVGYLILNVGAG   60
            ME+L        F  ++ N     +G++  +GY+LL+K +  +  G K  +G+++L  G+G
Sbjct:   20 MEILYNIFTVFFNQVMTNAPLLLGIVTCLGYILLRKSVSVIIKGTIKTIIGFMLLQAGSG   79

Query:   61 GLVTTFRPILVALAKKFELKAAVIDPYFGLAAANTKLEEMG-FISVATTALLIGFGVNIL  119
             L +TF+P++ +++ + +   A+ D Y + A   ++ MG  S       A+L+    +NI
Sbjct:   80 ILTSTFKPVVAKMSEVYGINGAISDTYASMMAT---IDRMGDAYSWVGYAVLLALALNIC  136
```

```
Query:  120 LVALRKVTKVRTLFITGHIMVQQAATISVFVLLLIPQFQNAFGAWAV----GIICGLYWA  175
            V LR++T +RT+ +TGHIM QQA  I+V + +           +  W      I+  LYW
Sbjct:  137 YVLLRRITGIRTIMLTGHIMFQQAGLIAVTLFIF------GYSMWTTIICTAILVSLYWG  190

Query:  176 ISSNMTVEATQRLTGGGGFAIGHQQQFAIWFVDKVAPFFGKKEENLDNLKLPTFLNIFHD  235
            I+SNM   + TQ +T G GF+IGHQQQFA  W     KVAPF GKKEE++++LKLP +LNIFHD
Sbjct:  191 ITSNMMYKPTQEVTDGCGFSIGHQQQFASWIAYKVAPFLGKKEESVEDLKLPGWLNIFHD  250

Query:  236 TVVASATLMLVFFGAILAVLGPDIMSDVDLIGPGAFNPAKQAFFMYILQTSLTFSVYLFI  295
            +V++A +M +FFGAIL   G D + +              K  + +YILQT  +F+V +FI
Sbjct:  251 NIVSTAIVMTIFFGAILLSFGIDTVQAM---------AGKVHWTVYILQTGFSFAVAIFI  301

Query:  296 LMQGVRMFVSELTNAFQGISSKLLPGSFPAVDVAASYGFGSSNAVLSGFAFGLIGQLITI  355
            + QGVRMFV+EL+ AF GIS +L+PG+  A+D AA Y F + NAV+ GF +G IGQLI +
Sbjct:  302 ITQGVRMFVAELSEAFNGISQRLIPGAVLAIDCAAIYSF-APNAVVWGFMWGTIGQLIAV  360

Query:  356 ALLVIFKNPILIITGFVPVFFDNAAIAVYADKRGGWKAAVALSFISGILQVALGAVAVGL  415
            +LV  +  ILII GF+P+FF NA I V+A+  GGW+AA+ +   + G++++        AV L
Sbjct:  361 GILVACGSSILIIPGFIPMFFSNATIGVFANHFGGWRAALKICLVMGMIEIFGCVWAVKL  420

Query:  416 LGLTGGYHGNIDLVLPWLPFGYLFKFLGIAGYVLVCIFLLA  456
            G++  +  G   D  +   P     F  +GIA ++  +   LA
Sbjct:  421 TGMS-AWMGMADWSILAPPMMQGFFSIGIAFMAVIIVIALA  460
```

An alignment of the GAS and GBS proteins is shown below.

```
Identities = 437/476 (91%), Positives = 457/476 (95%)

Query:    1 MENFLAPLNWFSQNILQNPAFFVGLLVLIGYLLLKKPLHDVFAGFIKATVGYLILNVGAG   60
            ME  LAPLNWFSQNILQNPAFFVGLLVLIGYLLLKKP+++VFAGF+KATVGYLILNVGAG
Sbjct:    1 MEMLLAPLNWFSQNILQNPAFFVGLLVLIGYLLLKLPIYEVFAGFVKATVGYLILNVGAG   60

Query:   61 GLVNTFRPILVALAKKFNLEAAVIDPYFGLASANAKLETMGFISVATTALLIGFGINILL  120
            GLV TFRPILVALAKKF L+AAVIDPYFGLA+AN KLE MGFISVATTALLIGFG+NILL
Sbjct:   61 GLVTTFRPILVALAKKFELKAAVIDPYFGLAAANTKLEEMGFISVATTALLIGFGVNILL  120

Query:  121 VALRKVTKVRTLFITGHIMVQQAATISVFVLLLIPQLRNGFGAWAVGIICGLYWAVSSNM  180
            VALRKVTKVRTLFITGHIMVQQAATISVFVLLLIPQ +N FGAWAVGIICGLYWA+SSNM
Sbjct:  121 VALRKVTKVRTLFITGHIMVQQAATISVFVLLLIPQFQNAFGAWAVGIICGLYWAISSNM  180

Query:  181 TVEATQRLTGGGGFAIGHQQQFAIWFVDKVAPFFGKKEENLDNLKLPTFLNIFHDTVVAS  240
            TVEATQRLTGGGGFAIGHQQQFAIWFVDKVAPFFGKKEENLDNLKLPTFLNIFHDTVVAS
Sbjct:  181 TVEATQRLTGGGGFAIGHQQQFAIWFVDKVAPFFGKKEENLDNLKLPTFLNIFHDTVVAS  240

Query:  241 ATLMLVFFGGILAVLGPDIMSNVKLIGPGAFVPTKQAFFMYILQTSLTFSVYLFILMQGV  300
            ATLMLVFFG ILAVLGPDIMS+V LIGPGAF P KQAFFMYILQTSLTFSVYLFILMQGV
Sbjct:  241 ATLMLVFFGAILAVLGPDIMSDVDLIGPGAFNPAKQAFFMYILQTSLTFSVYLFILMQGV  300

Query:  301 RMFVTELTNAFQGISNKLLPGSFPAVDVAASYGFGSSNAVLSGFAFGLIGQLITIALLVV  360
            RMFV+ELTNAFQGIS+KLLPGSFPAVDVAASYGFGSSNAVLSGFAFGLIGQLITIALLV+
Sbjct:  301 RMFVSELTNAFQGISSKLLPGSFPAVDVAASYGFGSSNAVLSGFAFGLIGQLITIALLVI  360

Query:  361 FKNPILIITGFVPVFFDNAAIAVYADKRGGWKAAVALSFISGIIQVALGAVAVGLLGLAG  420
            FKNPILIITGFVPVFFDNAAIAVYADKRGGWKAAVALSFISGI+QVALGAVAVGLLGL G
Sbjct:  361 FKNPILIITGFVPVFFDNAAIAVYADKRGGWKAAVALSFISGILQVALGAVAVGLLGLTG  420

Query:  421 GYHGNIDFEFPWLAFGYIFKYLGIAGYVIVCLFFLAIPQLQFMKSKDKEAYYRGDA      476
            GYHGNID    PWL FGY+FK+LGIAGYV+VC F LAIPQLQF K+KDKEAYYRG+A
Sbjct:  421 GYHGNIDLVLPWLPFGYLFKFLGIAGYVLVCIFLLAIPQLQFAKAKDKEAYYRGEA      476
```

Based on this analysis, it was predicted that these proteins and their epitopes could be useful antigens for vaccines or diagnostics.

EXAMPLE 1489

A DNA sequence (GBSx1575) was identified in S. agalactiae <SEQ ID 4581> which encodes the amino acid sequence <SEQ ID 4582>. Analysis of this protein sequence reveals the following:

```
Possible site: 37
>>> Seems to have no N-terminal signal sequence

----- Final Results -----
            bacterial cytoplasm --- Certainty = 0.1225(Affirmative) < succ>
             bacterial membrane --- Certainty = 0.0000(Not Clear)   < succ>
               bacterial outside --- Certainty = 0.0000(Not Clear)   < succ>
```

The protein has homology with the following sequences in the GENPEPT database.

```
>GP:AAG34743 GB:AE000033 similar to PTS system:EIIB [Mycoplasma
pneumoniae]
Identities = 40/89 (44%), Positives = 62/89 (68%), Gaps = 1/89 (1%)

Query:   4 VLTACGNGMGSSMVIKMKVENALRQLGVSNFESASCSVGEAKGLAANYDIVVASNHLIHE  63
           ++ ACGNGMG+SM+IK+KVE  +++LG +    A  S+G+ KG+  + DI+++S HL  E
Sbjct:   8 IIAACGNGMGTSMLIKIKVEKIMKELGYTAKVEA-LSMGQTKGMEHSADIIISSIHLTSE  66

Query:  64 LDGRTKGHLVGLDNLMDDNEIKTKLQEIL  92
           +   K  +VG+ NLMD+NEIK  L ++L
Sbjct:  67 FNPNAKAKIVGVLNLMDENEIKQALSKVL  95
```

A related DNA sequence was identified in *S. pyogenes* <SEQ ID 4583> which encodes the amino acid sequence <SEQ ID 4584>. Analysis of this protein sequence reveals the following:

```
Possible site: 42
>>> Seems to have no N-terminal signal sequence

----- Final Results -----
            bacterial cytoplasm --- Certainty = 0.0977(Affirmative) < succ>
             bacterial membrane --- Certainty = 0.0000(Not Clear)   < succ>
               bacterial outside --- Certainty = 0.0000(Not Clear)   < succ>
```

An alignment of the GAS and GBS proteins is shown below.

```
Identities = 85/92 (92%), Positives = 90/92 (97%)

Query:   1 MVKVLTACGNGMGSSMVIKMKVENALRQLGVSNFESASCSVGEAKGLAANYDIVVASNHL  60
           MVKVLTACGNGMGSSMVIKMKVENALRQLGV++ +SASCSVGEAKGLA+ YDIVVASNHL
Sbjct:   1 MVKVLTACGNGMGSSMVIKMKVENALRQLGVTDIQSASCSVGEAKGLASGYDIVVASNHL  60

Query:  61 IHELDGRTKGHLVGLDNLMDDNEIKTKLQEIL  92
           IHELDGRTKGHLVGLDNLMDDNEIKTKLQE+L
Sbjct:  61 IHELDGRTKGHLVGLDNLMDDNEIKTKLQEVL  92
```

Based on this analysis, it was predicted that these proteins and their epitopes could be useful antigens for vaccines or diagnostics.

EXAMPLE 1490

A DNA sequence (GBSx1576) was identified in *S. agalactiae* <SEQ ID 4585> which encodes the amino acid sequence <SEQ ID 4586>. This protein is predicted to be a pentitol phosphotransferase enzyme ii, a component (ptxA). Analysis of this protein sequence reveals the following:

```
Possible site: 38
>>> Seems to have no N-terminal signal sequence

----- Final Results -----
            bacterial cytoplasm --- Certainty = 0.3309(Affirmative) < succ>
             bacterial membrane --- Certainty = 0.0000(Not Clear)   < succ>
               bacterial outside --- Certainty = 0.0000(Not Clear)   < succ>
```

The protein has homology with the following sequences in the GENPEPT database.

```
>GP:AAC77152 GB:AE000491 putative PTS system enzyme II A component
[Escherichia coli K12]
Identities = 64/150 (42%), Positives = 97/150 (64%), Gaps = 2/150 (1%)

Query:    1 MNLKQAFIENDSIRLKLSASDWKEAIKLSIDPLIESGAVDAEYYDAIIESTEEFGPYYIL    60
            M L+ +  EN SIRL+  A  W+EA+K+ +D L+ +  V+  YY AI++  E+FGPY+++
Sbjct:    1 MKLRDSLAENKSIRLQAEAETWQEAVKIGVDLLVAADVVEPRYYQAILDGVEQFGPYFVI   60

Query:   61 MPGMAMPHARPEAGVKRDAFSLITLTEPVVF--PDGKEVSVLLALAATSSAIHTSVAIPQ   118
             PG+AMPH RPE GVK+  FSL+TL +P+ F    D    V +L+ +AA   +H  V I Q
Sbjct:   61 APGLAMPHGRPEEGVKKTGFSLVTLKKPLEFNHDDNDPVDILITMAAVDANTHQEVGIMQ   120

Query:  119 IIALFELENSIQRLTECQEAKEVLAMVEES                                148
            I+ LFE E +  RL  C+  +EVL +++ +
Sbjct:  121 IVNLFEDEENFDRLRACRTEQEVLDLIDRT                                150
```

A related DNA sequence was identified in *S. pyogenes* <SEQ ID 4587> which encodes the amino acid sequence <SEQ ID 4588>. Analysis of this protein sequence reveals the following:

```
Possible site: 42
>>> Seems to have no N-terminal signal sequence

----- Final Results -----
            bacterial cytoplasm --- Certainty = 0.2287(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below.

```
Identities = 113/161 (70%), Positives = 137/161 (84%)

Query:    1 MNLKQAFIENDSIRLKLSASDWKEAIKLSIDPLIESGAVDAEYYDAIIESTEEFGPYYIL   60
            MNLKQAFI+N+SIRL LSA  W+EA++L++ PLI+S AV + YYDAII STE++GPYY+L
Sbjct:    1 MNLKQAFIDNNSIRLGLSADTWQEAVRLAVQPLIDSKAVTSAYYDAIIASTEKYGPYYVL   60

Query:   61 MPGMAMPHARPEAGVKRDAFSLITLTEPVVFPDGKEVSVLLALAATSSAIHTSVAIPQII  120
            MPGMAMPHA   GV R+AF+LITLT+PV F DGKEVSVLL LAAT  +IHT+VAIPQI+
Sbjct:   61 MPGMAMPHAEAGLGVNRNAFALITLTKPVTFSDGKEVSVLLTLAATDPSIHTTVAIPQIV  120

Query:  121 ALFELENSIQRLTECQEAKEVLAMVEESKNSPYLEGLDLES                     161
            ALFEL+N+I+RL  CQ   KEVL MVEESK+SPYLEG+DL +
Sbjct:  121 ALFELDNAIERLVACQSPKEVLEMVEESKDSPYLEGMDLNA                     161
```

Based on this analysis, it was predicted that these proteins and their epitopes could be useful antigens for vaccines or diagnostics.

EXAMPLE 1491

A DNA sequence (GBSx1577) was identified in *S. agalactiae* <SEQ ID 4589> which encodes the amino acid sequence <SEQ ID 4590>. This protein is predicted to be probable hexulose-6-phosphate synthase. Analysis of this protein sequence reveals the following:

```
Possible site: 19
>>> Seems to have no N-terminal signal sequence

----- Final Results -----
            bacterial cytoplasm --- Certainty = 0.1584(Affirmative) < succ>
             bacterial membrane --- Certainty = 0.0000(Not Clear)   < succ>
              bacterial outside --- Certainty = 0.0000(Not Clear)   < succ>
```

The protein has homology with the following sequences in the GENPEPT database.

```
>GP: AAC77153 GB: AE000491 probable hexulose-6-phosphate synthase
[Escherichia coli K12]
Identities = 108/217 (49%), Positives = 141/217 (64%), Gaps = 3/217 (1%)

Query:    5 LPNLQVALDHSDLQGAIKAAVSVGHEVDVIEAGTVCLLQVGSELVEVLRSLFPDKIIVAD    64
            LP LQVALD+  + A +    +  EVD+IE GT+  +  G   V  L++L+P KI++AD
Sbjct:    3 LPMLQVALDNQTMDSAYETTRLIAEEVDIIEVGTILCVGEGVRAVRDLKALYPHKIVLAD   62

Query:   65 TKCADAGGTVAKNNAVRGADWMTCICCATIPTMEAALKAIKEERGDRGEIQIELYGDWTY  124
              K ADAG  +++         ADW+T ICCA I T + AL   KE  GD   +QIEL G WT+
Sbjct:   63 AKIADAGKILSRMCFEANADWVTVICCADINTAKGALDVAKEFNGD---VQIELTGYWTW  119

Query:  125 EQAQQWLDAGISQAIYHQSRDALLAGETWGEKDLNKVKKLIDMGFRVSVTGGLSTDTLQL  184
            EQAQQW DAGI Q +YH+SRDA  AG   WGE D+  +K+L DMGF+V+VTGGL+ + L L
Sbjct:  120 EQAQQWRDAGIGQVVYHRSRDAQAAGVAWGEADITAIKRLSDMGFKVTVTGGLALEDLPL  179

Query:  185 FEGVDVFTFIAGRGITEADDPAAAARAFKDEIKRIWG                        221
            F+G+ +  FIAGR I +A  P  AAR FK  I  +WG
Sbjct:  180 FKGIPIHVFIAGRSIRDAASPVEAARQFKRSIAELWG                        216
```

A related DNA sequence was identified in *S. pyogenes* <SEQ ID 4591> which encodes the amino acid sequence <SEQ ID 4592>. Analysis of this protein sequence reveals the following:

```
Possible site: 27
>>> Seems to have no N-terminal signal sequence

----- Final Results -----
          bacterial cytoplasm --- Certainty = 0.1473(Affirmative) < succ>
           bacterial membrane --- Certainty = 0.0000(Not Clear)   < succ>
             bacterial outside --- Certainty = 0.0000(Not Clear)   < succ>
```

An alignment of the GAS and GBS proteins is shown below.

```
Identities = 206/217 (94%), Positives = 212/217 (96%)

Query:    5 LPNLQVALDHSDLQGAIKAAVSVGHEVDVIEAGTVCLLQVGSELVEVLRSLFPDKIIVAD    64
            +PNLQVALDHSDLQGA+KAAV+VGHEVDVIEAGTVCLLQVGSELVEVLRSLFP+KIIVAD
Sbjct:    4 IPNLQVALDHSDLQGAVKAAVAVGHEVDVIEAGTVCLLQVGSELVEVLRSLFPEKIIVAD   63

Query:   65 TKCADAGGTVAKNNAVRGADWMTCICCATIPTMEAALKAIKEERGDRGEIQIELYGDWTY  124
            TKCADAGGTVAKNNA RGADWMTCICCATIPTMEAALKAIKEERGDRGEIQIELYGDWTY
Sbjct:   64 TKCADAGGTVAKNNAKRGADWMTCICCATIPTMEAALKAIKEERGDRGEIQIELYGDWTY  123

Query:  125 EQAQQWLDAGISQAIYHQSRDALLAGETWGEKDLNKVKKLIDMGFRVSVTGGLSTDTLQL  184
            EQAQ WLDAGISQAIYHQSRDALLAGETWGEKDLNKVK LIDMGFRVSVTGGL  DTL+L
Sbjct:  124 EQAQLWLDAGISQAIYHQSRDALLAGETWGEKDLNKVKTLIDMGFRVSVTGGLDVDTLRL  183

Query:  185 FEGVDVFTFIAGRGITEADDPAAAARAFKDEIKRIWG                        221
            FEGVDVFTFIAGRGITEA+DPAAAARAFKDEIKRIWG
Sbjct:  184 FEGVDVFTFIAGRGITEAEDPAAAARAFKDEIKRIWG                        220
```

Based on this analysis, it was predicted that these proteins and their epitopes could be useful antigens for vaccines or diagnostics.

EXAMPLE 1492

A DNA sequence (GBSx1578) was identified in *S. agalactiae* <SEQ ID 4593> which encodes the amino acid sequence <SEQ ID 4594>. Analysis of this protein sequence reveals the following:

```
Possible site: 36
>>> Seems to have no N-terminal signal sequence

----- Final Results -----
          bacterial cytoplasm --- Certainty = 0.4179(Affirmative) < succ>
           bacterial membrane --- Certainty = 0.0000(Not Clear)   < succ>
             bacterial outside --- Certainty = 0.0000(Not Clear)   < succ>
```

The protein has homology with the following sequences in the GENPEPT database.

```
>GP: AAC22686 GB: U32783 hexulose-6-phosphate isomerase, putative
[Haemophilus influenzae Rd]
Identities = 143/282 (50%), Positives = 199/282 (69%), Gaps = 3/282 (1%)

Query:     5 IGIYEKATPKHFNWLERLQFAKELGFDFVELSIDESDERLARLEWSKEERLELVKAIFET   64
             IGIYEKA PK+  W ERL  AK  GF+F+E+SIDES++RL+RL W+K ER+ L ++I ++
Sbjct:     6 IGIYEKALPKNITWQERLSLAKACGFEFIEMSIDESNDRLSRLNWTKSERIALHQSIIQS   65

Query:    65 GVRVPTITFSGHRRFPMGSNNPEKEARAMDMMKKCIVFAQDIGIRNIQLAGYDVYYEEKS  124
             G+ +P++  S HRRFP GS + +   ++ ++M+K I   + ++GIR IQLAGYDVYYE++
Sbjct:    66 GITIPSMCLSAHRRFPFGSKDKKIRQKSFEIMEKAIDLSVNLGIRTIQLAGYDVYYEKQD  125

Query:   125 PETRARFIKNLRQACTWAEEAQVILSIEIMDDPFMNSIEKYLAVEKEIDSPYLFVYPDTG  184
                 ET   F + +  A T A  AQV L++EIMD PFM+SI ++   +  I+SP+  VYPD G
Sbjct:   126 EETIKYFQEGIEFAVTLAASAQVTLAVEIMDTPFMSSISRWKKWDTIINSPWFTVYPDIG  185

Query:   185 NVSAWHNDLWSEFYNGHRSIAALHIKDTYAVTETSKGQFRDVPFGQGCVDWEEMFAVIKK  244
             N+SAW+N++  E    G    I+A+H+KDTY VTETSKGQFRDVPFGQGCVD+    F+++KK
Sbjct:   186 NLSAWNNNIEEELTLGIDKISAIHLKDTYPVTETSKGQFRDVPFGQGCVDFVHFFSLLKK  245

Query:   245 TNYNGPFLIEMWSENCETVEETRAAIKEAQDFLYPLMEKTGV                    286
             NY G FLIEMW+E     EE    I +A+ ++   MEK G+
Sbjct:   246 LNYRGAFLIEMWTEK---NEEPLLEIIQARKWIVQQMEKAGL                    284
```

A related DNA sequence was identified in *S. pyogenes* <SEQ ID 4595> which encodes the amino acid sequence <SEQ ID 4596>. Analysis of this protein sequence reveals the following:

```
Possible site: 50
>>> Seems to have no N-terminal signal sequence

----- Final Results -----
           bacterial cytoplasm --- Certainty = 0.1489(Affirmative) < succ>
           bacterial membrane  --- Certainty = 0.0000(Not Clear)   < succ>
            bacterial outside  --- Certainty = 0.0000(Not Clear)   < succ>
```

An alignment of the GAS and GBS proteins is shown below.

```
Identities = 240/286 (83%), Positives = 271/286 (93%)

Query:     1 MTRPIGIYEKATPKHFNWLERLQFAKELGFDFVELSIDESDERLARLEWSKEERLELVKA   60
             M RPIGIYEKATPK F W ERLQFAK+LGFDFVE+S+DESD RLARLEW+KEERL+LVKA
Sbjct:    15 MARPIGIYEKATPKQFTWRERLQFAKDLGFDFVEMSVDESDARLARLEWTKEERLDLVKA   74

Query:    61 IFETGVRVPTITFSGHRRFPMGSNNPEKEARAMDMMKKCIVFAQDIGIRNIQLAGYDVYY  120
             I+ETG+R+PTI FSGHRR+P+GSN+P  EA+++ +MK+CI   AQD+G+R IQLAGYDVYY
Sbjct:    75 IYETGIRIPTICFSGHRRYPLGSNDPAIEAKSLKLMKQCIELAQDLGVRTIQLAGYDVYY  134

Query:   121 EEKSPETRARFIKNLRQACTWAEEAQVILSIEIMDDPFMNSIEKYLAVEKEIDSPYLFVY  180
             E+KSPETRARFIKNLRQ+C WAEEAQV+LSIEIMDDPF+NSIEKYLAVEKEIDSPYLFVY
Sbjct:   135 EKKSPETRARFIKNLRQSCDWAEEAQVMLSIEIMDDPFINSIEKYLAVEKEIDSPYLFVY  194

Query:   181 PDTGNVSAWHNDLWSEFYNGHRSIAALHIKDTYAVTETSKGQFRDVPFGQGCVDWEEMFA  240
             PD GNVSAWHNDLWSEFYNGH+SIAALH+KDTYAVTETSKGQFRDVPFGQGCVDW+E+FA
Sbjct:   195 PDAGNVSAWHNDLWSEFYNGHKSIAALHLKDTYAVTETSKGQFRDVPFGQGCVDWQELFA  254

Query:   241 VIKKTNYNGPFLIEMWSENCETVEETRAAIKEAQDFLYPLMEKTGV                286
             V+KKTNYNGPFLIEMWSENC+TVEET+AAIKEAQDFLYPL+EK G+
Sbjct:   255 VLKKTNYNGPFLIEMWSENCDTVEETKAAIKEAQDFLYPLIEKAGL                300
```

Based on this analysis, it was predicted that these proteins and their epitopes could be useful antigens for vaccines or diagnostics.

EXAMPLE 1493

A DNA sequence (GBSx1579) was identified in *S. agalactiae* <SEQ ID 4597> which encodes the amino acid sequence <SEQ ID 4598>. This protein is predicted to be L-ribulose 5-phosphate 4-epimerase. Analysis of this protein sequence reveals the following:

```
Possible site: 23
>>> Seems to have no N-terminal signal sequence

----- Final Results -----
              bacterial cytoplasm --- Certainty = 0.2559(Affirmative) < succ>
              bacterial membrane  --- Certainty = 0.0000(Not Clear)   < succ>
              bacterial outside   --- Certainty = 0.0000(Not Clear)   < succ>
```

The protein has homology with the following sequences in the GENPEPT database.

```
>GP: AAD45716 GB: AF160811 L-ribulose 5-phosphate 4-epimerase
[Bacillus stearothermophilus]
Identities = 143/229 (62%), Positives = 176/229 (76%), Gaps = 2/229 (0%)

Query:    5 LQEMRERVCEANKSLPVHSLVKFTWGNVSEVDREAGLIVIKPSGVDYDQLTPENMVVTDL   64
            L+E+++ V EAN  LP + LV FTWGNVS +DRE GL+VIKPSGV YD+LT ++MVV DL
Sbjct:    2 LEELKQAVLEANLQLPQYRLVTFTWGNVSGIDRERGLVVIKPSGVAYDKLTIDDMVVVDL   61

Query:   65 EGNIVEGDLNPSSDLPTHVQLYKAWPEVGGIVHTHSTEAVGWAQAGRDIPFYGTTHADYF  124
            GN+VEGDL PSSD PTH+ LYK +P +GGIVHTHST A  WAQAG+ IP  GTTHADYF
Sbjct:   62 TGNVVEGDLKPSSDTPTHLWLYKQFPGIGGIVHTHSTWATVWAQAGKGIPALGTTHADYF  121

Query:  125 YGPVPCARSLSEDEVNTAYEKETGSVIIEEFERRDLDPMAVPGIVVRNHGPFTWGKDPAQ  184
            YG +PC R ++ +E+  AYE ETG VI E F  R LDP+ +PG++V HGPF WGKDPA
Sbjct:  122 YGEIPCTRPMTNEEIQGAYELETGKVITETF--RFLDPLQMPGVLVHGHGPFAWGKDPAN  179

Query:  185 AVYHSVVLEEVAKMNRFTEQINPRVEPAPKYIMDKHYLRKHGPNAYYGQ            233
            AV+++VVLEEVAKM   T  +NP  +P  + ++D+HYLRKHG NAYYGQ
Sbjct:  180 AVHNAVVLEEVAKMAARTYMLNPNAKPISQTLLDRHYLRKHGANAYYGQ            228
```

A related DNA sequence was identified in *S. pyogenes* <SEQ ID 4599> which encodes the amino acid sequence <SEQ ID 4600>. Analysis of this protein sequence reveals the following:

```
Possible site: 14
>>> Seems to have no N-terminal signal sequence

----- Final Results -----
              bacterial cytoplasm --- Certainty = 0.2257(Affirmative) < succ>
              bacterial membrane  --- Certainty = 0.0000(Not Clear)   < succ>
              bacterial outside   --- Certainty = 0.0000(Not Clear)   < succ>
```

An alignment of the GAS and GBS proteins is shown below.

```
Identities = 207/234 (88%), Positives = 220/234 (93%)

Query:    1 MAKSLQEMRERVCEANKSLPVHSLVKFTWGNVSEVDREAGLIVIKPSGVDYDQLTPENMV   60
            MAK+LQEMRERVC ANKSLP H LVKFTWGNVSEV RE G IVIKPSGVDYD LTPENMV
Sbjct:    1 MAKNLQEMRERVCAANKSLPQHGLVKFTWGNVSEVCRELGRIVIKPSGVDYDLLTPENMV   60

Query:   61 VTDLEGNIVEGDLNPSSDLPTHVQLYKAWPEVGGIVHTHSTEAVGWAQAGRDIPFYGTTH  120
            VTDL+GN+VEGDLNPSSDLPTHV+LYKAWPEVGGIVHTHSTEAVGWAQAGRDIPFYGTTH
Sbjct:   61 VTDLDGNVVEGDLNPSSDLPTHVELYKAWPEVGGIVHTHSTEAVGWAQAGRDIPFYGTTH  120

Query:  121 ADYFYGPVPCARSLSEDEVNTAYEKETGSVIIEEFERRDLDPMAVPGIVVRNHGPFTWGK  180
            ADYFYGPVPCARSL++ EV+ AYE+ETG+VI+EEF +R LDPMAVPGIVVRNHGPFTWGK
Sbjct:  121 ADYFYGPVPCARSLTKAEVDGAYEQETGNVILEEFSKRGLDPMAVPGIVVRNHGPFTWGK  180

Query:  181 DPAQAVYHSVVLEEVAKMNRFTEQINPRVEPAPKYIMDKHYLRKHGPNAYYGQ         234
             P QAVYHSVVLEEVA+MNR TEQINPRVEPAP+YIMDKHYLRKHGPNAYYGQ
Sbjct:  181 TPEQAVYHSVVLEEVARMNRLTEQINPRVEPAPRYIMDKHYLRKHGPNAYYGQ         234
```

Based on this analysis, it was predicted that these proteins and their epitopes could be useful antigens for vaccines or diagnostics.

EXAMPLE 1494

A DNA sequence (GBSx1580) was identified in *S. agalactiae* <SEQ ID 4601> which encodes the amino acid sequence <SEQ ID 4602>. This protein is predicted to be transaldolase (tal). Analysis of this protein sequence reveals the following:

```
Possible site: 45
>>> Seems to have no N-terminal signal sequence

----- Final Results -----
            bacterial cytoplasm --- Certainty = 0.4232(Affirmative) < succ>
            bacterial membrane  --- Certainty = 0.0000(Not Clear)   < succ>
            bacterial outside   --- Certainty = 0.0000(Not Clear)   < succ>
```

A related GBS nucleic acid sequence <SEQ ID 10149> which encodes amino acid sequence <SEQ ID 10150> was also identified.

The protein has homology with the following sequences in the GENPEPT database.

```
>GP: AAB98962 GB: U67539 transaldolase [Methanococcus jannaschii]
Identities = 124/214 (57%), Positives = 157/214 (72%)

Query:  19 MKYFLDTADVSEIRRLNRLGIVDGVTTNPTIISREGRDFKEVINEICQIVDGPVSAEVTG   78
           MK+FLDTA+V EI++   LG+VDGVTTNPT++++EGRDF EV+ EIC+IV+GPVSAEV
Sbjct:   1 MKFFLDTANVEEIKKYAELGLVDGVTTNPTLVAKEGRDFYEVVKEICEIVEGPVSAEVIS   60

Query:  79 LTCDEMVTEAREIAKWSPNVVVKIPMTEEGLAAVSQLSKEGIKTNVTLIFTVAQGLSAMK  138
             + MV EARE+AK + N+V+KIPMT++G+ AV  LS EGIKTNVTL+F+  Q L A K
Sbjct:  61 TDAEGMVKEARELAKLADNIVIKIPMTKDGMKAVKILSAEGIKTNVTLVFSPLQALVAAK  120

Query: 139 AGATFISPFVGRLEDIGTDAYALIRDLRHIIDFYGFQSEIIAASIRGLAHVEGVAKCGAH  198
           AGAT++SPFVGRL+DIG    LI D+  I   Y  ++E+I AS+R   HV    AK GA
Sbjct: 121 AGATYVSPFVGRLDDIGHVGMKLIEDVVKIYKNYDIKTEVIVASVRHPWHVLEAAKIGAD  180

Query: 199 IATIPDKTFASLFTHPLTDKGIETFLKDWDSFKK                           232
           IAT+P    LF HPLTD G+E FLKDWD + K
Sbjct: 181 IATMPPAVMDKLFNHPLTDIGLERFLKDWDEYLK                           214
```

A related DNA sequence was identified in *S. pyogenes* <SEQ ID 4603> which encodes the amino acid sequence <SEQ ID 4604>. Analysis of this protein sequence reveals the following:

```
Possible site: 15
>>> Seems to have no N-terminal signal sequence

----- Final Results -----
            bacterial cytoplasm --- Certainty = 0.1902(Affirmative) < succ>
            bacterial membrane  --- Certainty = 0.0000(Not Clear)   < succ>
            bacterial outside   --- Certainty = 0.0000(Not Clear)   < succ>
```

An alignment of the GAS and GBS proteins is shown below.

```
Identities = 162/214 (75%), Positives 180/214 (83%)

Query:  19 MKYFLDTADVSEIRRLNRLGIVDGVTTNPTIISREGRDFKEVINEICQIVDGPVSAEVTG   78
           MK+FLDTA+V+ I+ +N LG+VDGVTTNPTIISREGRDF+ VI EIC IVDGP+SAEVTG
Sbjct:   1 MKFFLDTANVAAIKAINELGVVDGVTTNPTIISREGRDFETVIKEICDIVDGPISAEVTG   60

Query:  79 LTCDEMVTEAREIAKWSPNVVVKIPMTEEGLAAVSQLSKEGIKTNVTLIFTVAQGLSAMK  138
           LT D MV EAR IAKW  NVVVKIPMT EGL A + LSKEGIKTNVTLIFTV+QGL AMK
Sbjct:  61 LTADAMVEEARSIAKWHDNVVVKIPMTTEGLKATNILSKEGIKTNVTLIFTVSQGLMAMK  120
```

-continued

```
Query:  139 AGATFISPFVGRLEDIGTDAYALIRDLRHIIDFYGFQSEIIAASIRGLAHVEGVAKCGAH  198
            AGAT+ISPF+GRLEDIGTDAY LI DLR IID Y FQ+EIIAASIR  AHVE VAK GAH
Sbjct:  121 AGATYISPFIGRLEDIGTDAYQLISDLREIIDLYDFQAEIIAASIRTTAHVEAVAKLGAH  180

Query:  199 IATIPDKTFASLFTHPLTDKGIETFLKDWDSFKK  232
            IATIPD  FA +  HPLT  G++TF++DW SFKK
Sbjct:  181 IATIPDPLFAKMTQHPLTTNGLKTFMEDWASFKK  214
```

Based on this analysis, it was predicted that these proteins and their epitopes could be useful antigens for vaccines or diagnostics.

EXAMPLE 1495

A DNA sequence (GBSx1581) was identified in *S. agalactiae* <SEQ ID 4605> which encodes the amino acid sequence <SEQ ID 4606>. Analysis of this protein sequence reveals the following:

```
Possible site: 22
>>> Seems to have no N-terminal signal sequence

----- Final Results -----
            bacterial cytoplasm --- Certainty = 0.1263(Affirmative) < succ>
             bacterial membrane --- Certainty = 0.0000(Not Clear)   < succ>
              bacterial outside --- Certainty = 0.0000(Not Clear)   < succ>
```

The protein has homology with the following sequences in the GENPEPT database.

```
>GP: CAB14129 GB: Z99115 transcriptional regulator (LacI family)
[Bacillus subtilis]
Identities = 108/331 (32%), Positives = 188/331 (56%), Gaps = 12/331 (3%)

Query:    6 TISDIANLVGVSKATVSYYLNGNYKKMSLQTKEKIRLAIKETGYQPSKIAQSLVTKNTRT   65
            TI D+A   GVSK+TVS Y+NG   +S +  + I+ AI E  Y+PSK+AQ L  K ++
Sbjct:   10 TIKDVAECAGVSKSTVSRYINGKIDAISPEKVKNIKKAIAELNYRPSKMAQGLKIKKSKL   69

Query:   66 IGVVIADITNPFISSVMKGIHDTCQQFGYSVNFTNSDNDIDIELENLNRLNQQNVSGIIL  125
            IG V+ADITNPF  +  +G+ + C Q+GYS+   N+DN  + E E L +L    +V G+IL
Sbjct:   70 IGFVVADITNPFSVAAFRGVEEVCDQYGYSIMVCNTDNSPEKEREMLLKLEAHSVEGLIL  129

Query:  126 DSVDPNHSFIETLSNDRL--VMVDRQAKDIKVDTVASDNKESTQIFLEKMQEAGYHDIYF  183
            ++  N +  +   ++ +++DR+ D+K+DTV +DN+   T+   L+K+    GY D+
Sbjct:  130 NATGENKDVLRAFAEQQIPTILIDRKLPDLKLDTVTTDNRWITKEILQKVYSKGYTDVAL  189

Query:  184 VTYPIEGISTRELRYEGFKEVVS-SNPDKLIIITE-DGSTQRILDI------IEHSEQKP  235
              T PI    IS R  R    ++E+ S  N +L+ +  E D    +      L     E  EQK
Sbjct:  190 FTEPISSISPRAERAAVYQEMASVQNVNGLVRLHEIDVKDKEQLKAELRSFHKEMPEQKK  249

Query:  236 GFLMMNGPTLLNFMKKLNQSTVSYPEDYGLGSYEDLEWMQVLTPNVSCIKQDSYGIGCLA  295
            L +NG  +L +  + +  + +  P+D G+   ++D EW +++ P ++ I Q S+ +G  A
Sbjct:  250 AILALNGLIMLKIISCMEELGLRIPQDIGIAGFDDTEWYKLIGPGITTIAQPSHDMGRTA  309

Query:  296 AQCLIEKISQGNEPTTARLLEVKNQIVIRQS  326
            +  ++++I   +      +  +E++  ++++R+S
Sbjct:  310 MERVLKRIE--GDKGAPQTIELEAKVIMRKS  338
```

There is also homology to SEQ ID 2366.

Based on this analysis, it was predicted that this protein and its epitopes, could be useful antigens for vaccines or diagnostics.

EXAMPLE 1496

A DNA sequence (GBSx1582) was identified in *S. agalactiae* <SEQ ID 4607> which encodes the amino acid sequence <SEQ ID 4608>. Analysis of this protein sequence reveals the following:

```
Possible site: 40
>>> Seems to have no N-terminal signal sequence

----- Final Results -----
            bacterial cytoplasm --- Certainty = 0.1661(Affirmative) < succ>
             bacterial membrane --- Certainty = 0.0000(Not Clear)   < succ>
              bacterial outside --- Certainty = 0.0000(Not Clear)   < succ>
```

The protein has no significant homology with any sequences in the GENPEPT database.

No corresponding DNA sequence was identified in S. pyogenes.

Based on this analysis, it was predicted that this protein and its epitopes, could be useful antigens for vaccines or diagnostics.

EXAMPLE 1497

A DNA sequence (GBSx1583) was identified in S. agalactiae <SEQ ID 4609> which encodes the amino acid sequence <SEQ ID 4610>. This protein is predicted to be GLYCERATE DEHYDROGENASE. Analysis of this protein sequence reveals the following:

```
Possible site: 29
>>> Seems to have an uncleavable N-term signal seq

----- Final Results -----
              bacterial membrane --- Certainty = 0.0000(Not Clear) < succ>
               bacterial outside --- Certainty = 0.0000(Not Clear) < succ>
             bacterial cytoplasm --- Certainty = 0.0000(Not Clear) < succ>
```

The protein has homology with the following sequences in the GENPEPT database.

```
>GP: CAB50351 GB: AJ248287 GLYCERATE DEHYDROGENASE [Pyrococcus abyssi]
Identities = 123/325 (37%), Positives = 192/325 (58%),
Gaps = 8/325 (2%)

Query:    1 MDKKKILVTGIVPKEGLRKLMDRFDVTYSED-RPFSRDYVLEHLSEYDGWLLM-GQKGDK    58
            M K ++ +T +P+ G+   L    F+V   ED R   R+ +LE + + D  + M  ++ D+
Sbjct:    1 MSKPRVFITREIPEVGIEMLEKEFEVEVWEDEREIPREILLEKVKDVDALVTMLSERIDR    60

Query:   59 EMIDAGENLQIISLNAVGFDHVDTAYAKEKGIIVSNSPQAVRVPTAEMTFALILAASKRL   118
            E+ +      L+I++  AVG+D++D    A ++GI V+N+P  +     TA++ FAL+LA ++ L
Sbjct:   61 EVFERAPRLRIVANYAVGYDNIDVEEATKRGIYVTNTPGVLTDATADLAFALLLATARHL   120

Query:  119 AFYDSIVRSGEW----IDPSEQRYQGLTLQGSTLGIYGMGRIGLTVANFAKAFGMTVVYN   174
                D   RSGEW      + + G   + G T+GI  G GRIG  +A  A+ F M  ++Y
Sbjct:  121 VKGDKFTRSGEWKKRGVAWHPKWFLGYDVYGKTIGIIGFGRIGQAIAKRARGFDMRILYY   180

Query:  175 DVYRLPEDKEKELGVTYLEFDQLIKTADVITIHAPALPSTIHKFNKDVFAKMKNRSYLIN   234
                   R  PE   EKEL  +    D+L++ +D  +     P      T H  N++      MK   + LIN
Sbjct:  181 SRTRKPE-VEKELNAEFKPLDELLRESDFVVLAVPLNKETYHMINEERLKMMKRTAILIN   239

Query:  235 AARGPIVSEEALIEALKEGEIAGAGLDVFENEPQVSEGLRSLDNVIMSPHAGTGTIEGRR   294
              ARG ++    +ALI+ALKEG IAGAGLDV+E EP   +E L  SLDNV++++PH G+  T   R
Sbjct:  240 VARGKVIDTKALIKALKEGWIAGAGLDVYEEEPYYNEELFSLDNVVLTPHIGSATFGARE   299

Query:  295 TLAEEAADNIIAFFDGK-PQNIVNK                                     318
             +A+  A+N+IAF  G+ P    +VN+
Sbjct:  300 GMAKLVAENLIAFKRGEVPPTLVNR                                     324
```

There is also homology to SEQ ID 124.

Based on this analysis, it was predicted that this protein and its epitopes, could be useful antigens for vaccines or diagnostics.

EXAMPLE 1498

A DNA sequence (GBSx1585) was identified in *S. agalactiae* <SEQ ID 4611> which encodes the amino acid sequence <SEQ ID 4612>. Analysis of this protein sequence reveals the following:

```
Possible site: 34
>>> Seems to have no N-terminal signal sequence

----- Final Results -----
          bacterial cytoplasm --- Certainty = 0.1898(Affirmative) < succ>
          bacterial membrane  --- Certainty = 0.0000(Not Clear)   < succ>
           bacterial outside  --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1499

A DNA sequence (GBSx1586) was identified in *S. agalactiae* <SEQ ID 4613> which encodes the amino acid sequence <SEQ ID 4614>. This protein is predicted to be PTS system, galactitol specific IIC component. Analysis of this protein sequence reveals the following:

```
Possible site: 25
>>> Seems to have no N-terminal signal sequence
    INTEGRAL    Likelihood = -13.27    Transmembrane    254-270 (245-277)
    INTEGRAL    Likelihood =  -9.24    Transmembrane     77-93  (71-100)
    INTEGRAL    Likelihood =  -9.24    Transmembrane    367-383 (364-386)
    INTEGRAL    Likelihood =  -8.28    Transmembrane     32-48  (26-54)
    INTEGRAL    Likelihood =  -7.38    Transmembrane    186-202 (182-215)
    INTEGRAL    Likelihood =  -6.26    Transmembrane    158-174 (151-180)
    INTEGRAL    Likelihood =  -5.79    Transmembrane    279-295 (276-296)
    INTEGRAL    Likelihood =  -1.12    Transmembrane    342-358 (342-359)
    INTEGRAL    Likelihood =  -0.00    Transmembrane    308-324 (308-324)

----- Final Results -----
          bacterial membrane  --- Certainty = 0.6307(Affirmative) < succ>
           bacterial outside  --- Certainty = 0.0000(Not Clear)   < succ>
          bacterial cytoplasm --- Certainty = 0.0000(Not Clear)   < succ>
```

A related GBS nucleic acid sequence <SEQ ID 8825> which encodes amino acid sequence <SEQ ID 8826> was also identified. Analysis of this protein sequence reveals the following:

```
Lipop: Possible site: -1 Crend: 9
McG: Discrim Score: 8.30
GvH: Signal Score (-7.5): 2.97
     Possible site: 58
>>> Seems to have a cleavable N-term signal seq.
ALOM program count: 9 value: -13.27 threshold: 0.0
    INTEGRAL    Likelihood = -13.27    Transmembrane    321-337 (312-344)
    INTEGRAL    Likelihood =  -9.24    Transmembrane    144-160 (138-167)
    INTEGRAL    Likelihood =  -9.24    Transmembrane    434-450 (431-453)
    INTEGRAL    Likelihood =  -8.28    Transmembrane     99-115 (93-121)
    INTEGRAL    Likelihood =  -7.38    Transmembrane    253-269 (249-282)
    INTEGRAL    Likelihood =  -6.26    Transmembrane    225-241 (218-247)
    INTEGRAL    Likelihood =  -5.79    Transmembrane    346-362 (343-363)
    INTEGRAL    Likelihood =  -1.12    Transmembrane    409-425 (409-426)
    INTEGRAL    Likelihood =  -0.00    Transmembrane    375-391 (375-391)
    PERIPHERAL  Likelihood =   0.69    188
modified ALOM score: 3.15
*** Reasoning Step: 3

----- Final Results -----
          bacterial membrane  --- Certainty = 0.6307(Affirmative) < succ>
           bacterial outside  --- Certainty = 0.0000(Not Clear)   < succ>
          bacterial cytoplasm --- Certainty = 0.0000(Not Clear)   < succ>
```

The protein has homology with the following sequences in the GENPEPT database.

```
>GP: BAB03909 GB: AP001507 PTS system, galactitol-specific enzyme II,
C component [Bacillus halodurans]
Identities = 92/347 (26%), positives = 173/347 (49%),
Gaps = 15/347 (4%)

Query:    1 MVKTTGLHLPIVDIGWQAGSLTAFSSEIGLSFFVFGLLIELGLFLLGITRVFVPSNLWNN    60
            MV     G+ L  ++D+GW A S  A++S +        GL++ + + +  T+  + ++WN
Sbjct:   70 MVDRLGVDLNVIDVGWPATSSIAWASVVAAFIIPLGLIVNVIMLVTKTTKT-MNVDIWNF  128

Query:   61 FGYMIWGTMAYAATGNPILSFAFMVFVLLYSLVMSEVLADRWSEYYGVKNATINSIHNIE  120
            + Y      + Y   + I +   V   + +L +++  A    SE+Y +    +I +    I
Sbjct:  129 WHYTFMAAVVYTVSDSIIQALIAAVMFQIVALKVADWTAPMVSEFYELPGVSIATGSTIS  188

Query:  121 TLIPALILDPLWNLLGVNKVKLNPESLKTKLGIFGEPMTLGFILGVIIGVLGSLRNLASI  180
            ++    +   G+      +P++++ + GIFGE + +G ILG   IG+L
Sbjct:  189 YAPGIWLVKGIQKIPGIKHWNADPDTIQRRFGIFGESIFIGLILGAAIGLLAGYNV----  244

Query:  181 DTWGGILGFAVALAAVMTIFPLITGVFASAFAPLAEAVERNKKKESQAEQGALDKKRWFI  240
              G ++    +A+AAVM + P  +        P++E+      K          +  I
Sbjct:  245 ---GEVIEIGMAMAAVMVLMPRMVKILMEGLMPVSESAREWLNKR-------FGDREIHI  294

Query:  241 AVDDGVGFGEPATIIAGLILVPIMVVISLILPGNEALPVVDLIAIPFMIEAMIAVSKGNI  300
            +D  V   G P+  I    LILVP+ V++++ILPGN   LP   DL   IPF++  ++  ++GNI
Sbjct:  295 GLDAAVLLGHPSVISTALILVPLTVLLAVILPGNALLPFGDLATIPFIVAFIVGAARGNI  354

Query:  301 LKAILNGIIWFSLGLYAASALGPIYTEAVKHFGTALPAGVTLIMSFN              347
            + ++L G I  +L LY A+ + P++T+  ++      +P G  LI  S +
Sbjct:  355 IHSVLAGAIMIALSLYMATDIAPVFTKMAENSNFNMPEGSALISSID              401
```

Based on this analysis, it was predicted that this protein and its epitopes, could be useful antigens for vaccines or diagnostics.

EXAMPLE 1500

A DNA sequence (GBSx1587) was identified in *S. agalactiae* <SEQ ID 4615> which encodes the amino acid sequence <SEQ ID 4616>. Analysis of this protein sequence reveals the following:

```
Possible site: 52
>>> Seems to have no N-terminal signal sequence

----- Final Results -----
        bacterial cytoplasm --- Certainty = 0.1013(Affirmative) < succ>
        bacterial membrane  --- Certainty = 0.0000(Not Clear)   < succ>
         bacterial outside  --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1501

A DNA sequence (GBSx1588) was identified in *S. agalactiae* <SEQ ID 4617> which encodes the amino acid sequence <SEQ ID 4618>. Analysis of this protein sequence reveals the following:

```
Possible site: 43
>>> Seems to have no N-terminal signal sequence

----- Final Results -----
        bacterial cytoplasm --- Certainty = 0.1294(Affirmative) < succ>
        bacterial membrane  --- Certainty = 0.0000(Not Clear)   < succ>
         bacterial outside  --- Certainty = 0.0000(Not Clear)   < succ>
```

A related GBS nucleic acid sequence <SEQ ID 10147> which encodes amino acid sequence <SEQ ID 10148> was also identified.

The protein has homology with the following sequences in the GENPEPT database.

```
>GP: AAC76604 GB: AE000435 L-xylulose kinase, cryptic [Escherichia coli
K12]
Identities = 156/496 (31%), Positives = 261/496 (52%),
Gaps = 18/496 (3%)

Query:  16 YYLSIDYGGTNTKALIFDKLGHQIAVSSFETLKNETQSGHRQVNLVKTWNAITSAIREVI   75
            Y+L +D GG+  KA ++D+ G + V         Q G + ++ + W    + IR ++
Sbjct:   4 YWLGLDCGGSWLKAGLYDREGREAGVQRLPLCALSPQPGWAERDMAELWQCCMAVIRALL   63

Query:  76 QISKLSPEQISAVACIGHGKGLYLLDNKLEPLEQGILSTDNRAKDLAQYFESK--LDNIW  133
              S +S EQI +    GKGL+LLD   +PL   ILS+D RA ++ + ++       + ++
Sbjct:  64 THSGVSGEQIVGIGISAQGKGLFLLDKNDKPLGNAILSSDRRAMEIVRRWQEDGIPEKLY  123

Query: 134 ELTRQHIFPSQSPVILRWLKDYQPETYKSIGAVLSAKDFIRYKLTGKVQQEYGDASGNHW  193
             LTRQ ++         +LRWLK+++PE Y  IG V+   D++R+ LTG     E  + S ++
Sbjct: 124 PLTRQTLWTGHPVSLLRWLKEHEPERYAQIGCVMMTHDYLRWCLTGVKGCEESNISESNL  183

Query: 194 INFQTGTYDPAILDFFGIREIENSLPELIDSADLVPGGISSQAAKETGLVEGTPVVGGLF  253
             N    G YDP + D+ GI EI ++LP ++ SA++   G I++Q A   TGL  GTPVVGGLF
Sbjct: 184 YNMSLGEYDPCLTDWLGIAEINHALPPVVGSAEIC-GEITAQTAALTGLKAGTPVVGGLF  242

Query: 254 DIDACALGSGVLESDTFSVISGTWNINT--YPSLKPAKQDSGLMTSYFPDRRYLLEASSP  311
             D+ + AL +G+ +  T ++ GTW + +      L+ +      Y D  +++ +SP
Sbjct: 243 DVVSTALCAGIEDEFTLNAVMGTWAVTSGITRGLRDGEAHPYVYGRYVNDGEFIVHEASP  302

Query: 312 TSAGNLNFMLKMLMHQEIDNAKSSGGSIYDNLEEFLTHTDATHHGLIFFPFLYGSNTSQD  371
             TS+GNL +              G   +D + + +        L F PFLYGSN   +
Sbjct: 303 TSSGNLEWF-----------TAQWGEISFDEINQAVASLPKAGGDLFFLPFLYGSNAGLE  351

Query: 372 ASACFFGLTTKSTKSQMIRAVYEGIAFAHKQHITDLIKSRGSVPKIIRFSGGATNSPAWM  431
             ++ F+G+    T++ +++A+YEG+ F+H  H+ + ++ R +      +R +GG  +S  WM
Sbjct: 352 MTSGFYGMQAIHTRAHLLQAIYEGVVFSHMTHL-NRMRERFTDVHTLRVTGGPAHSDVWM  410

Query: 432 QMFSDILNFPIETVEGTELGGLGGAILARHALDKI-SLKEAVQDMVRVKAIYKPQLSEVK  490
             QM +D+     IE +  E G  G A+ AR      +   EA +D+         P ++   +
Sbjct: 411 QMLADVSGLRIELPQVEETGCFGAALAARVGTGVYHNFSEAQRDLRHPVRTLLPDMTAHQ  470

Query: 491 GYKKKYHAYQKLLETL                                             506
             Y+KKY   YQ L+   L
Sbjct: 471 LYQKKYQRYQHLIAAL                                             486
```

Based on this analysis, it was predicted that these proteins and their epitopes could be useful antigens for vaccines or diagnostics.

EXAMPLE 1502

A DNA sequence (GBSx1589) was identified in *S. agalactiae* <SEQ ID 4619> which encodes the amino acid sequence <SEQ ID 4620>. Analysis of this protein sequence reveals the following:

```
Possible site: 59
>>> Seems to have an uncleavable N-term signal seq

----- Final Results -----
              bacterial membrane --- Certainty = 0.0000(Not Clear) < succ>
              bacterial outside  --- Certainty = 0.0000(Not Clear) < succ>
              bacterial cytoplasm --- Certainty = 0.0000(Not Clear) < succ>
```

The protein has homology with the following sequences in the GENPEPT database.

```
>GP: AAG05648 GB: AE004652 hypothetical
protein [Pseudomonas aeruginosa]
Identities = 59/235 (25%), Positives = 104/235 (44%),
Gaps = 9/235 (3%)

Query:  23 QVQLIKLVKDLGFSRFEIRQELLQDPDRELPALKAEADFYDINLYYSANEDLIK-GGKVN   81
             Q    + L+    G  R E+R+EL  P + AL A       +S+  +L +   G++N
Sbjct:  23 QASFLPLLAMAGAQRVELREELFAGPP-DTEALTAAIQLQGLECVFSSPLELWREDGQLN   81

Query:  82 PYLNKGLKEASQLGAPFIKLNVGQTRNLSKEELEPLKEILKSQTIGIKVENNQDPKAATV  141
             P L   L+ A  GA ++K+++G      + +L  L    ++ + VEN+Q P+   +
```

-continued

```
Sbjct:  82 PELEPTLRRAEACGAGWLKVSLGLLPE--QPDLAALGRRLARHGLQLLVENDQTPQGGRI 139

Query: 142 ENCQYFMTLVKELQIPISFVFDTANWAFINQDLYQAVNNLACDTTYLHCKNFIQVAGKPH 201
            E + F  L+  Q+ ++  FD NW+   Q   +A    L      Y+HCK  I+
Sbjct: 140 EVLERFFRLAERQQLDLAMTFDIGNWRWQEQAADEAALRLGRYVGYVHCKAVIRNRDGKL 199

Query: 202 LSKSLFEGEINLTD-LLKSFSNCEYLALEYPTE----LEILKRDVQRLISISNSQ      251
            ++        ++    LL+ F      A+EYP +    L + +R + L +   Q
Sbjct: 200 VAVPPSAADLQYWQRLLQHFPEGVARAIEYPLQGDDLLSLSRRHIAALARLGQPQ      254
```

No corresponding DNA sequence was identified in *S. pyogenes*.

Based on this analysis, it was predicted that this protein and its epitopes, could be useful antigens for vaccines or diagnostics.

EXAMPLE 1503

A DNA sequence (GBSx1590) was identified in *S. agalactiae* <SEQ ID 4621> which encodes the amino acid sequence <SEQ ID 4622>. Analysis of this protein sequence reveals the following:

```
Possible site: 30
>>> Seems to have no N-terminal signal sequence

----- Final Results -----
            bacterial cytoplasm --- Certainty = 0.0430(Affirmative) < succ>
            bacterial membrane  --- Certainty = 0.0000(Not Clear)   < succ>
            bacterial outside   --- Certainty = 0.0000(Not Clear)   < succ>
```

The protein has homology with the following sequences in the GENPEPT database.

```
>GP: BAB03939 GB: AP001507 unknown conserved
protein [Bacillus halodurans]
Identities = 136/511 (26%), Positives = 234/511 (45%),
Gaps = 29/511 (5%)

Query:   4 LDKKSYDLLFYLLKLEEPETVMAIANALNQSRRKVYYHLEKINDALPSDVPQIVSYPRV-  62
           LD++S  +L  LL         +  +  LN SRR VY  LEKIN  L    + V    R
Sbjct:   3 LDQRSTFILTQLLHARSYLPIQELTQKLNVSRRTVYNDLEKINSWLEEQGLKAVYKVRSQ  62

Query:  63 GILLTEKQKAACRLLLDEVTDYSYVMKSSERLQLSLVSIVVAKDRVTIDRLMQLNDVSRN 122
           G++L E+ K       L  +  +Y  + ER    ++ ++    + + ++ LM   VSRN
Sbjct:  63 GLILDERAKEEIPTKLRSLKSWHYEYSAQERKAWVVIYLLTRLEPLFLEHLMDRTGVSRN 122

Query: 123 TILNDLNELRSELAEKEYNLQLQSTKCRGYFLDGHPL----SIIQYLYKLLDDIYHNGSS 178
           T  ++D+  L+ EL      ++L L+ +   GY + G       +++ YL + L
Sbjct: 123 TTIDDIKCLKDEL--NNFHLALEFERKDGYTISGDETDKRKALVYYLSQALPQQNWETEL 180

Query: 179 SFIDLFNHKLSQAFGASTYFSKEVLDYFHHYLFISQRSLGKKINSQDGQFMIQILPFILM 238
           S I +F   L         F+ E L     + ++  S++ L  KI  D         L F+L
Sbjct: 181 SPIRIF---LRTKRDNGRIFTIEELQKVYDVISESEKVL--KIQYTDDVLHSLSLRFLLF 235

Query: 239 AYRK-----MRLSPEVQTSLNSDFSLVWQRKEYEIAKELADELEENFQLSLDEIEVGLVA 293
               R      +++ P   + L             KEYE AK ++ +LE+ F +   + EV +
Sbjct: 236 MKRVAKGKFIKVHPLEKQVLKGT-------KEYEAAKVMSFKLEQAFGVHYPDEEVLYLT 288

Query: 294 MLMLSFRKDRDN-HLESQ-DYDDMRATLTSFLKELEERYHLHFVHKKDLLRQLLTHCKAL 351
           +LS + +  N  +ES+ +   ++    +TS + ++     + F  K+ L + L  H K
Sbjct: 289 THILSSEINYANGEIESRKESQELTHIVTSMVNDFQKYACVVFEEKELLEKNLFFHIKPA 348

Query: 352 LYRKRYGIFSVNPLTEHIKDKYEELFAITSSSVKLLEKAWQIKLTDDDVAYLTIHLGGEL 411
            YR +YG+    N + E IK  Y ELF +T  V   LE+    + D++VA++T+H  G +
Sbjct: 349 FYRIKYGLEVENNIAESIKTSYPELFLLTRKVVHYLERYVGKSVNDNEVAFITMHFVGWM 408

Query: 412 RNSQQSPNE-LKLVIVSDEGIAIQKLLLKQCQRYLTNSDIEAVFTTEQYQSVSDLMHVDM 470
           R       P K  K +IV   G+    + L Q +          DI  +  +Y+    + VD
Sbjct: 409 RREGTIPTKRKKALIVCANGVGTSQFLENQLEGLFPAVDIIKTCSIREYEKTP--VEVDF 466

Query: 471 VVSTSDALESRFPMLVVHPVLTDDDIIRLIR                             501
           ++ST+  E   P+ +V+P+LT+ +  RL++
Sbjct: 467 IISTTSIPEKNVPIFIVNPILTETEKERLLK                             497
```

A related DNA sequence was identified in *S. pyogenes* <SEQ ID 4623> which encodes the amino acid sequence <SEQ ID 4624>. Analysis of this protein sequence reveals the following:

```
Possible site: 30
>>> Seems to have no N-terminal signal sequence

----- Final Results -----
            bacterial cytoplasm --- Certainty = 0.0745(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below.

```
Identities = 368/548 (67%), Positives = 456/548 (83%)

Query:    1 MIILDKKSYDLLFYLLKLEEPETVMAIANALNQSRRKVYYHLEKINDALPSDVPQIVSYP   60
            M+ILDKKSYDLL YLLKLE PETVMAI++ALNQSRRKVYY L+KIN ALP  V QI+SYP
Sbjct:    1 MMILDKKSYDLLSYLLKLETPETVMAISHALNQSRRKVYYQLDKINQALPKGVDQIISYP   60

Query:   61 RVGILLTEKQKAACRLLLDEVTDYSYVMKSSERLQLSLVSIVVAKDRVTIDRLMQLNDVS  120
            R+GILLT  QKAACRLLL+EVTDY+YVMKS ER +LS + I V+ +RVTID+LMQ+NDVS
Sbjct:   61 RLGILLTADQKAACRLLLEEVTDYNYVMKSDERRRLSSIYIAVSTERVTIDKLMQINDVS  120

Query:  121 RNTILNDLNELRSELAEKEYNLQLQSTKCRGYFLDGHPLSIIQYLYKLLDDIYHNGSSSF  180
            RNTILNDL ELR EL +K+Y +QL +TK RGY+   HP+++IQYLYKLL D+Y  G++SF
Sbjct:  121 RNTILNDLTELREELEDKQYKIQLHATKARGYYFGCHPMALIQYLYKLLVDVYQGGNTSF  180

Query:  181 IDLFNHKLSQAFGASTYFSKEVLDYFHHYLFISQRSLGKKINSQDGQFMIQILPFILMAY  240
            ID+FN KLS+  G S YFSK++L YFH YLF+SQ SLGK IN+QD QFM+QILPF+L++Y
Sbjct:  181 IDIFNRKLSEIQGLSVYFSKDILTYFHEYLFLSQASLGKTINTQDSQFMLQILPFMLLSY  240

Query:  241 RKMRLSPEVQTSLNSDFSLVWQRKEYEIAKELADELEENFQLSLDEIEVGLVAMLMLSFR  300
            R MRL  E +++L  +F L+W+RKEY IA++LA EL  NF+L LD+IEV +VAMLMLSFR
Sbjct:  241 RNMRLDSETKSALKQEFHLIWKRKEYHIAQDLARELYHNFKLHLDDIEVSMVAMLMLSFR  300

Query:  301 KDRDNHLESQDYDDMRATLTSFLKELEERYHLHFVHKKDLLRQLLTHCKALLYRKRYGIF  360
            KD+D+H+ESQDYDDMRAT++ F+ +LE RY LHF HK+DLL++L THCKAL+YRK YGIF
Sbjct:  301 KDQDHHVESQDYDDMRATISHFIDQLESRYQLHFTHKQDLLKRLTTHCKALVYRKAYGIF  360

Query:  361 SVNPLTEHIKDKYEELFAITSSSVKLLEKAWQIKLTDDDVAYLTIHLGGELRNSQQSPNK  420
            VNPLT+H+K+KYEELFA+T S   +LE+ W I LTDDD+AYLTIHLGGELR++      K
Sbjct:  361 LVNPLTDHVKEKYEELFAMTQSCATILEQDWTISLTDDDIAYLTIHLGGELRHNNTEQEK  420

Query:  421 LKLVIVSDEGIAIQKLLLKQCQRYLTNSDIEAVFTTEQYQSVSDLMHVDMVVSTSDALES  480
            +KLVIVSD+GI IQKLL KQCQRYL N  IEAVFTTEQYQSV DL+ VDM+V+T+D L++
Sbjct:  421 TKLVIVSDDGIGIQKLLFKQCQRYLANGQIEAVFTTEQYQSVYDLLAVDMIVATTDTLKT  480

Query:  481 RFPMLVVHPVLTDDDIIRLIRFSKKGNCANSNQFTNELEKTIAQYVKEDSERYVLKSKIE  540
            + PML+V+P+L+DDDII+LIRFSK+G  +  ++F+ EL K I   VK++S+RY L SKIE
Sbjct:  481 KIPMLIVNPILSDDDIIKLIRFSKQGRLSEHSRFSTELTKAIEAVVKDESDRYALVSKIE  540

Query:  541 KLIHQELL                                                     548
            KLIH+ELL
Sbjct:  541 KLIHRELL                                                     548
```

Based on this analysis, it was predicted that these proteins and their epitopes could be useful antigens for vaccines or diagnostics.

EXAMPLE 1504

A DNA sequence (GBSx1591) was identified in *S. agalactiae* <SEQ ID 4625> which encodes the amino acid sequence <SEQ ID 4626>. Analysis of this protein sequence reveals the following:

```
Possible site: 50
>>> Seems to have no N-terminal signal sequence

----- Final Results -----
            bacterial cytoplasm --- Certainty = 0.2692(Affirmative) < succ>
```

```
                            -continued
        bacterial membrane --- Certainty = 0.0000(Not Clear) < succ>
        bacterial outside  --- Certainty = 0.0000(Not Clear) < succ>
```

The protein has homology with the following sequences in the GENPEPT database.

```
>GP: AAC77149 GB: AE000491 orf, hypothetical
protein [Escherichia coli K12]
Identities = 211/363 (58%), Positives = 270/363 (74%),
Gaps = 9/363 (2%)

Query:    1 MPNVKDITRESWILSTFPEWGTWLNEEIEEEVVAEGNFAMWWLGNCGVWIKTPGGANVVM   60
            M  VK ITRESWILSTFPEWG+WLNEEIE+E VA G FAMWWLG  G+W+K+ GG NV +
Sbjct:    3 MSKVKSITRESWILSTFPEWGSWLNEEIEQEQVAPGTFAMWWLGCTGIWLKSEGGTNVCV   62

Query:   61 DLWSNRGKSTKKVKDMVRGHQMANMAGVRKLQPNLRAQPMVIDPFAINELDYYLVSHFHS  120
            D W   GK +      M +GHQM  MAGV+KLQPNLR  P V+DPFAI  ++D  L +H H+
Sbjct:   63 DFWCGTGKQSHGNPLMKQGHQMQRMAGVKKLQPNLRTTPFVLDPFAIRQIDAVLATHDHN  122

Query:  121 DHIDINTAAAIINNPNLDHVKFVGPYECGEIWKKWGVPEERIIVIKPGESFEFKDIKVTA  180
            DHID+N AAA++ N    D V F+GP  C  ++W  WGVP+ER IV+KPG+   + KDI++ A
Sbjct:  123 DHIDVNVAAAVMQNC-ADDVPFIGPKTCVDLWIGWGVPKERCIVVKPGDVVKVKDIEIHA  181

Query:  181 VESFDRTCLVTLPVDGAEEHDGELAGLAVTDEEMARKAVNYIFETPGGTIYHGADSHFSN  240
            +++FDRT L+TLP D          + AG  V  + M  +AVNY+F+TPGG++YH  DSH+SN
Sbjct:  182 LDAFDRTALITLPADQ------KAAG--VLPDGMDDRAVNYLFKTPGGSLYHSGDSHYSN  233

Query:  241 YFAKHGKDYKIDVAINNYGDNPVGIQDKMTSIDLLRMAENLRAKVIIPVHYDIWSNFMAS  300
            Y+AKHG +++IDVA+ +YG+NP GI DKMTS D+LRM E L  AKV+IP H+DIWSNF A
Sbjct:  234 YYAKHGNEHQIDVALGSYGENPRGITDKMTSADMLRMGEALNAKVVIPFHHDIWSNFQAD  293

Query:  301 TDEILQLWKMRKERLQYDFHPFIWEVGGKYTYPQDKDRIEYHHPRGFDDCFEQESNIQFK  360
             EI  LW+M+K+RL+Y F PFIW+VGGK+T+P DKD  EYH+PRGFDDCF  E ++ FK
Sbjct:  294 PQEIRVLWEMKKDRLKYGFKPFIWQVGGKFTWPLDKDNFEYHYPRGFDDCFTIEPDLPFK  353

Query:  361 ALL                                                           363
            + L
Sbjct:  354 SFL                                                           356
```

A related DNA sequence was identified in *S. pyogenes* <SEQ ID 4627> which encodes the amino acid sequence <SEQ ID 4628>. Analysis of this protein sequence reveals the following:

```
Possible site: 35
>>> Seems to have no N-terminal signal sequence

----- Final Results -----
        bacterial cytoplasm --- Certainty = 0.3298(Affirmative) < succ>
        bacterial membrane  --- Certainty = 0.0000(Not Clear)   < succ>
        bacterial outside   --- Certainty = 0.0000(Not Clear)   < succ>
```

An alignment of the GAS and GBS proteins is shown below.

```
Identities = 315/363 (86%), Positives = 348/363 (95%)

Query:    1 MPNVKDITRESWILSTFPEWGTWLNEEIEEEVVAEGNFAMWWLGNCGVWIKTPGGANVVM   60
            M V+DITRESWIL+TFPEWGTWLNEEIE+EVV   NFAMWWLGNCG+WIKTPGGANVVM
Sbjct:    1 MTKVQDITRESWILNTFPEWGTWLNEEIEQEVVPADNFAMWWLGNCGIWIKTPGGANVVM   60

Query:   61 DLWSNRGKSTKKVKDMVRGHQMANMAGVRKLQPNLRAQPMVIDPFAINELDYYLVSHFHS  120
            DLWSNRGK+TK+VKDMVRGHQMANMAG RKLQPNLRAQPMVIDPF INELDYYLVSH+HS
Sbjct:   61 DLWSNRGKATKQVKDMVRGHQMANMAGARKLQPNLRAQPMVIDPFMINELDYYLVSHYHS  120

Query:  121 DHIDINTAAAIINNPNLDHVKFVGPYECGEIWKKWGVPEERIIVIKPGESFEFKDIKVTA  180
            DHIDINTAAAI INNP L+HVKFVGPYECGE+WK WGVP++RI+++KPG+SFEFKDIK TA
Sbjct:  121 DHIDINTAAAIINNPKLNHVKFVGPYECGEVWKNWGVPKDRIMILKPGDSFEFKDIKITA  180

Query:  181 VESFDRTCLVTLPVDGAEEHDGELAGLAVTDEEMARKAVNYIFETPGGTIYHGADSHFSN  240
            VESFDRTCLVTLP+ GA+  DG+LAGLA+TD++MARKAVNYIFETPGGTIYHGADSHFSN
Sbjct:  181 VESFDRTCLVTLPIQGADAQDGDLAGLAITDDDMARKAVNYIFETPGGTIYHGADSHFSN  240
```

```
                       -continued
Query: 241 YFAKHGKDYKIDVAINNYGDNPVGIQDKMTSIDLLRMAENLRAKVIIPVHYDIWSNFMAS 300
           YFAKHG+DY IDV +NNYG+NP+GIQDKMTS+DLLRMAENLRAKV+IPVHYDIWSNFMAS
Sbjct: 241 YFAKHGRDYDIDVVLNNYGENPIGIQDKMTSVDLLRMAENLRAKVVIPVHYDIWSNFMAS 300

Query: 301 TDEILQLWKMRKERLQYDFHPFIWEVGGKYTYPQDKDRIEYHHPRGFDDCFEQESNIQFK 360
           TDEIL+LWKMRKERLQYDFHPFIWEVGGKYTYPQD++RIEYHHPRGFDDCF ++SNIQFK
Sbjct: 301 TDEILELWKMRKERLQYDFHPFIWEVGGKYTYPQDQNRIEYHHPRGFDDCFLEDSNIQFK 360

Query: 361 ALL 363
           ALL
Sbjct: 361 ALL 363
```

Based on this analysis, it was predicted that these proteins and their epitopes could be useful antigens for vaccines or diagnostics.

EXAMPLE 1505

A DNA sequence (GBSx1592) was identified in *S. agalactiae* <SEQ ID 4629> which encodes the amino acid sequence <SEQ ID 4630>. Analysis of this protein sequence reveals the following:

```
Possible site: 38
>>> Seems to have no N-terminal signal sequence

----- Final Results -----
           bacterial cytoplasm --- Certainty = 0.3988(Affirmative) < succ>
           bacterial membrane  --- Certainty = 0.0000(Not Clear)   < succ>
           bacterial outside   --- Certainty = 0.0000(Not Clear)   < succ>
```

A related GBS nucleic acid sequence <SEQ ID 10145> which encodes amino acid sequence <SEQ ID 10146> was also identified.

The protein has homology with the following sequences in the GENPEPT database.

```
>GP: BAA18808 GB: D90917 hypothetical protein [Synechocystis sp.]
Identities = 358/785 (45%), Positives = 494/785 (62%), Gaps = 15/785 (1%)

Query:  22 LEKLDAWWRAANYISAAQMYLKDNPLLRRELVENDLKVHPIGHWGTVPGQNFIYAHLNRA  81
           L ++ +WRAANY++    +YL+DNPLLR  L     +K   +GHWG+ PG +F+Y HLNR
Sbjct:  44 LNQMHGFWRAANYLAVGMIYLRDNPLLREPLQPEQIKHRLLGHWGSSPGISFLYTHLNRI 103

Query:  82 INKYDLDMFYIEGPGHGGQVMVSNSYLDGSYTELNPNIEQTEDGFKQLCKIFSFPCGIAS 141
           I K+D DM Y+ GPGHG    +    YL+GSY+      + EDG K+  K FSFP GI S
Sbjct: 104 IRKFDQDMLYMVGPGHGAPGFLGPCYLEGSYSRFFAECSEDEDGMKRFFKQFSFPGGIGS 163

Query: 142 HAAPETPGSIHEGGELGYALSHATGAILDNPDVIAATVIGDGEGETGPLMAGWLSNTFIN 201
           H   PETPGSIHEGGELGY LSHA GA  DNP++I  + GDGE ETGPL   W SN FIN
Sbjct: 164 HCTPETPGSIHEGGELGYCLSHAYGAAFDNPNLIVVGLAGDGESETGPLATSWHSNKFIN 223

Query: 202 PVNDGAVLPIFYLNGGKIHNPTIFERKTDEELSQFFEGLGWKPIFADVVELSEDHAAAHA 261
           P+ DGAVLP+ +LNG KI+NP++ R + EEL   FEG G+ P F +      D  + H
Sbjct: 224 PIRDGAVLPVLHLNGYKINNPSVLSRISHEELKALFEGYGYTPYFVE----GSDPESMHQ 279

Query: 262 LFAEKLDQAIQEIKTIQSEARQKPAEEAIQAKFPVLVARIPKGWTGPKAWEGTPIEGGFR 321
              A  LD + EI  IQ EAR      A++ ++P++V R PKGWTGP   +G  +EG +R
Sbjct: 280 AMAATLDHCVSEIHQIQQEARSTGI--AVRPRWPMVVMRTPKGWTGPDYVDGHKVEGFWR 337

Query: 322 AHQVPIPVDAHHMEHVDSLLSWLQSYRPEELFDENGKIVDEIAAISPKGDRRMSMNPITN 381
           +HQVP+     + H+ L +W+++SY+PEELFDE G +    AI+P+GD+R+    P  N
Sbjct: 338 SHQVPMGGMHENPAHLQQLEAWMRSYKPEELFDEQGTLKPGFKAIAPEGDKRLGSTPYAN 397

Query: 382 AGIV-KAMDTADWKKFALDINVPGQIMAQDMIEFGKYAADLVDANPDNFRIFGPDETKSN 440
            G++ + +    D++++ +D++  PG I A +     G +  D++  N NFR+FGPDE SN
Sbjct: 398 GGLLRRGLKMPDFRQYGIDVDQPGTIEAPNTAPLGVFLRDVMANNMTNFRLFGPDENSSN 457

Query: 441 RLQEVFTRTSRQWLGRRKPDYDEA--LSPAGRVIDSQLSEHQAEGFLEGYVLTGRHGFFA 498
           +L V+   + +W+        +   LSP GRV++  LSEH  EG+LE Y+LTGRHGFFA
Sbjct: 458 KLHAVYEVSKKFWIAEYLEEDQDGGELSPDGRVME-MLSEHTLEGWLEAYLLTGRHGFFA 516

Query: 499 SYESFLRVVDSMVTQHFKWLRKSKTHTTWRKNYPALNLIAASTVFQQDHNGYTHQDPGIL 558
           +YESF  V+ SMV QH KWL  + H  WR +  +LN++  STV++QDHNG+THQDPG L
```

-continued

```
Sbjct: 517 TYESFAHVITSMVNQHAKWLDICR-HLNWRADISSLNILMTSTVWRQDHNGFTHQDPGFL 575

Query: 559 THLAEKTPEYIREYLPADTNSLLAVMDKAFKAEDKINLIVTSKHPRPQFYSIAEAEELVA 618
             + K+P+ +R YLP D NSLL+V D  ++++ IN+IV  K    Q+  +  A
Sbjct: 576 DVILNKSPDVVRIYLPPDVNSLLSVADHCLQSKNYINIIVCDKQAHLQYQDMTSAIRNCT 635

Query: 619 EGYKVIDWASNVSLNQEPDVVFAAAGTEPNLEALAAISILHKAFPELKIRFVNVLDILKL 678
             +G + +WASN      EPDVV AAAG  P   EALAA ++L + FP  L+IRFV+V+D+LKL
Sbjct: 636 KGVDIWEWASN-DAGTEPDVVMAAAGDIPTKEALAATAMLRQFFPNLRIRFVSVIDLLKL 694

Query: 679 RHPSQDARGLSDEEFNKVFTTDKPVIFAFHGYEDMIRDIFFSRHNH-NLHTHGYRENGDI 737
             + S+   GLSD +F+ +FTTDKP+IF FH Y  +I  + + R NH NLH  GY+E G+I
Sbjct: 695 QPESEHPHGLSDRDFDSLFTTDKPIIFNFHAYPWLIHRLTYRRTNHGNLHVRGYKEKGNI 754

Query: 738 TTPFDMRVMSELDRFHLAQDA--ALASLGNKAQAFSDEMNQMVAYHKDYIREHGDDIPEV 795
              TP D+ + +++DRF LA D    L  L     + +   + M   +Y  EHG D+PE+
Sbjct: 755 NTPMDLAIQNQIDRFSLAIDVIDRLPQLRVAGAHIKEMLKDMQIDCTNYAYEHGIDMPEI 814

Query: 796 QNWKW 800
            NW+W
Sbjct: 815 VNWRW 819
```

No corresponding DNA sequence was identified in *S. pyogenes*.

Based on this analysis, it was predicted that these proteins and their epitopes could be useful antigens for vaccines or diagnostics.

EXAMPLE 1506

A DNA sequence (GBSx1593) was identified in *S. agalactiae* <SEQ ID 4631> which encodes the amino acid sequence <SEQ ID 4632>. Analysis of this protein sequence reveals the following:

```
Possible site: 32
>>> Seems to have no N-terminal signal sequence

----- Final Results -----
              bacterial cytoplasm --- Certainty = 0.3509(Affirmative) < succ>
               bacterial membrane --- Certainty = 0.0000(Not Clear)   < succ>
                 bacterial outside --- Certainty = 0.0000(Not Clear)   < succ>
```

The protein has homology with the following sequences in the GENPEPT database.

```
>GP: AAF37878 GB: AF234619 OpuAA [Lactococcus lactis]
Identities = 274/402 (68%), Positives = 338/402 (83%)

Query:   5 LEVKNLTKIFGKKQKAALEMVKQGKSKTEILEKTGATVGVYDASFEIKEGEIFVIMGLSG  64
             +++++LTKIFGK+ K AL MV++G+ K EIL+KTGATVGVYD +FEI EGEIFVIMGLSG
Sbjct:   5 IKIEHLTKIFGKRIKTALTMVEKGEPKNEILKKTGATVGVYDTNFEINEGEIFVIMGLSG  64

Query:  65 SGKSTLVRMLNRLIDPSSGNIYLDGKDIAKMNVEDLRNIRRHDINMVFQNFGLFPHRTIL 124
             SGKSTL+R+LNRLI+P+SG I++D +D+A +N EDL  +RR  ++MVFQNFGLFPHRTIL
Sbjct:  65 SGKSTLLRLLNRLIEPTSGKIFIDNQDVATLNKEDLLQVRRKTMSMVFQNFGLFPHRTIL 124

Query: 125 ENTEFGLEMRGVSKEERTTLAEKALDNAGLLPFKDQYPSQLSGGMQQRVGLARALANSPK 184
             ENTE+GLE++ V KEER    AEKALDNA LL FKDQYP QLSGGMQQRVGLARALAN P+
Sbjct: 125 ENTEYGLEVQNVPKEERRKRAEKALDNANLLDFKDQYPKQLSGGMQQRVGLARALANDPE 184

Query: 185 ILLMDEAFSALDPLIRREMQDELLDLQDTNKQTIIFISHDLNEALRIGDRIALMKDGEIM 244
             ILLMDEAFSALDPLIRREMQDELL+LQ   ++TIIF+SHDLNEALRIGDRIA+MKDG+IM
Sbjct: 185 ILLMDEAFSALDPLIRREMQDELLELQAKFQKTIIFVSHDLNEALRIGDRIAIMKDGKIM 244

Query: 245 QIGTGEEILTNPANDFVREFVEDVDRSKVLTAQNIMIKPLTTVLEIDGPQVALTRMHREE 304
             QIGTGEEILTNPAND+V+ FVEDVDR+KV+TA+NIMI  LTT +++DGP VAL +M  EE
Sbjct: 245 QIGTGEEILTNPANDYVKTFVEDVDRAKVITAENIMIPALTTNIDVGPSVALKKMKTEE 304

Query: 305 VSMLMATNRRRQLLGSLTADAAIEARKKDLPLSEVIDKDVVTVSKDTVITDIMPLIYDSS 364
             VS LMA +++RQ  G +T++ AI ARK +  PL +V+  DV TVSK+ ++ DI+P+IYD+
Sbjct: 305 VSSLMAVDKKRQFRGVVTSEQAIAARKNNQPLKDVMTTDVGTVSKEMLVRDILPIIYDAP 364
```

```
-continued
Query: 365 APIAVTDDNDRLLGVIIRGRVIEALANVQDETVVESPKETVE           406
           P+AV DDN  L GV+IRG V+EALA++ DE  VE  ++  E
Sbjct: 365 TPLAVVDDNGFLKGVLIRGSVLEALADIPDEDEVEEIEKEEE           406
```

A related DNA sequence was identified in *S. pyogenes* <SEQ ID 4633> which encodes the amino acid sequence <SEQ ID 4634>. Analysis of this protein sequence reveals the following:

```
Possible site: 53
>>> Seems to have no N-terminal signal sequence

----- Final Results -----
              bacterial cytoplasm --- Certainty = 0.3761(Affirmative) < succ>
               bacterial membrane --- Certainty = 0.0000(Not Clear)   < succ>
                bacterial outside --- Certainty = 0.0000(Not Clear)   < succ>
```

An alignment of the GAS and GBS proteins is shown below.

```
Identities = 344/395 (87%), Positives = 374/395 (94%)

Query:   1 MTNILEVKNLTKIFGKKQKAALEMVKQGKSKTEILEKTGATVGVYDASFEIKEGEIFVIM   60
           M  ILEVK+L+KIFGKKQKAALEMVK GK+K+EI +KTGATVGVYDASFE+K+GEIFVIM
Sbjct:   1 METILEVKHLSKIFGKKQKAALEMVKTGKNKSEIFKKTGATVGVYDASFEVKKGEIFVIM   60

Query:  61 GLSGSGKSTLVRMLNRLIDPSSGNIYLDGKDIAKMNVEDLRNIRRHDINMVFQNFGLFPH  120
           GLSGSGKSTLVRMLNRLI+PS+G+I L+GKDI+ M+ + LR +RRHDINMVFQ+F LFPH
Sbjct:  61 GLSGSGKSTLVRMLNRLIEPSAGSILLEGKDISTMSADQLREVRRHDINMVFQSFALFPH  120

Query: 121 RTILENTEFGLEMRGVSKEERTTLAEKALDNAGLLPFKDQYPSQLSGGMQQRVGLARALA  180
           +TILENTEFGLE+RGV KEER  LAEKALDN+GLL FKDQYP+QLSGGMQQRVGLARALA
Sbjct: 121 KTILENTEFGLELRGVPKEERQRLAEKALDNSGLLDFKDQYPNQLSGGMQQRVGLARALA  180

Query: 181 NSPKILLMDEAFSALDPLIRREMQDELLDLQDTNKQTIIFISHDLNEALRIGDRIALMKD  240
           NSPKILLMDEAFSALDPLIRREMQDELLDLQD+ KQTIIFISHDLNEALRIGDRIALMKD
Sbjct: 181 NSPKILLMDEAFSALDPLIRREMQDELLDLQDSMKQTIIFISHDLNEALRIGDRIALMKD  240

Query: 241 GEIMQIGTGEEILTNPANDFVREFVEDVDRSKVLTAQNIMIKPLTTVLEIDGPQVALTRM  300
           G+IMQIGTGEEILTNPANDFVREFVEDVDRSKVLTAQNIMIKPLTT +E+DGPQVAL RM
Sbjct: 241 GQIMQIGTGEEILTNPANDFVREFVEDVDRSKVLTAQNIMIKPLTTTVELDGPQVALNRM  300

Query: 301 HREEVSMLMATNRRRQLLGSLTADAAIEARKKDLPLSEVIDKDVVTVSKDTVITDIMPLI  360
           H EEVSMLMATNRRRQL+GSLTADAAIEARKK LPLSEVID+DV TVSKDT+ITDI+PLI
Sbjct: 301 HNEEVSMLMATNRRRQLVGSLTADAAIEARKKGLPLSEVIDRDVRTVSKDTIITDILPLI  360

Query: 361 YDSSAPIAVTDDNDRLLGVIIRGRVIEALANVQDE                          395
           YDSSAPIAVTDDN+RLLGVIIRGRVIEALAN+ DE
Sbjct: 361 YDSSAPIAVTDDNNRLLGVIIRGRVIEALANISDE                          395
```

Based on this analysis, it was predicted that these proteins and their epitopes could be useful antigens for vaccines or diagnostics.

EXAMPLE 1507

A DNA sequence (GBSx1594) was identified in *S. agalactiae* <SEQ ID 4635> which encodes the amino acid sequence <SEQ ID 4636>. This protein is predicted to be OpuABC (opuAB). Analysis of this protein sequence reveals the following:

```
Possible site: 41
>>> Seems to have no N-terminal signal sequence
    INTEGRAL    Likelihood = -10.67    Transmembrane     48-64  (43-72)
    INTEGRAL    Likelihood =  -9.24    Transmembrane   101-117  (93-122)
    INTEGRAL    Likelihood =  -7.54    Transmembrane   296-312  (290-316)
    INTEGRAL    Likelihood =  -6.21    Transmembrane   252-268  (250-273)
    INTEGRAL    Likelihood =  -5.57    Transmembrane   141-157  (138-170)
    INTEGRAL    Likelihood =  -0.53    Transmembrane   220-236  (220-237)
```

-continued

```
            bacterial membrane --- Certainty = 0.5267(Affirmative) < succ>
            bacterial outside  --- Certainty = 0.0000(Not Clear)   < succ>
            bacterial cytoplasm --- Certainty = 0.0000(Not Clear)  < succ>
```

The protein has homology with the following sequences in the GENPEPT database.

```
>GP: AAF37879 GB: AF234619 OpuABC [Lactococcus lactis]
Identities = 345/578 (59%), Positives = 429/578 (73%),
Gaps = 8/578 (1%)

Query:   1 MENLLQHKLPVAPFVESTTNWITKTFSGLFDFIQTIGNALMDWMTKTLLFINPLLFIVLI    60
           M +L   ++P+A +V S T+WIT TFS  FD IQ  G  LM+ +T  L  +     L I ++
Sbjct:   1 MIDLAIGQVPIANWVSSATDWITSTFSSGFDVIQKSGTVLMNGITGALTAVPFWLMIAVV    60

Query:  61 TIAVFFLAKKKWQLPTFTFIGLLFIYNQGLWEQLINTFNLVLVASLISIIIGVPLGIWMA   120
           TI    ++ KK    P FTFIGL   I NQGLW  L++T  LVL++SL+SIIIGVPLGIWMA
Sbjct:  61 TILAILVSGKKIAFPLFTFIGLSLIANQGLWSDLMSTITLVLLSSLLSIIIGVPLGIWMA   120

Query: 121 KSDKVKQVVNPILDFMQTMPAFVYLIPAVAFFGIGMVPGVFASVVFALPPTVRFTNLAIR   180
           KSD V ++V PILDFMQTMP FVYLIPAVAFFGIG+VPGVFASV+FALPPTVR TNL IR
Sbjct: 121 KSDLVAKIVQPILDFMQTMPGFVYLIPAVAFFGIGVVPGVFASVIFALPPTVRMTNLGIR   180

Query: 181 EIPLELIEASDSFGSTVKQKLFKVELPLAKNTIMAGINQTMMLALSMVVTGSMIGAPGLG   240
              ++  EL+EA+DSFGST +QKLFK+E PLAK TIMAG+NQT+MLALSMVV  SMIGAPGLG
Sbjct: 181 QVSTELVEAADSFGSTARQKLFKLEFPLAKGTIMAGVNQTIMLALSMVVIASMIGAPGLG   240

Query: 241 REVLSALQHADIGTGFVSGLSLVILAIVLDRVSQFFNSKPGEKQAKTSKVKKW---VGLG   297
           R VL+A+Q ADIG GFVSG+SLVILAI++DR +Q  N  P EKQ    + VKKW    + L
Sbjct: 241 RGVLAAVQSADIGKGFVSGISLVILAIIIDRFTQKLNVSPLEKQGNPT-VKKWKRGIALV   299

Query: 298 ALALFILAALGRIVVNMTSGNEAKGQKVKIAYVQWDSEVASTNVIAEVLKSKGYDVELTP   357
            +L   I+     M+ G  A   +KV + Y+  WDSEVAS NV+  + +K  G+DV+ T
Sbjct: 300 SLLALIIGAFS----GMSFGKTASDKKVDLVYMNWDSEVASINVLTQAMKEHGFDVKTTA   355

Query: 358 LDNAVMWQTVANGNADFTTSAWLPKTHGQYFNKYKNSLDDLGPHVENVKIGLVVPKYMNV   417
           LDNAV WQTVANG AD    SAWLP TH   + KY  S+D LGP+++  K+G VVP YMNV
Sbjct: 356 LDNAVAWQTVANGQADGMVSAWLPNTHKTQWQKYGKSVDLLGPNLKGAKVGFVVPSYMNV   415

Query: 418 NSIEELSNQADKQITGIEPGAGIMKSAKQSLKDYPNLSSWKLLSASTGAMTTTLGKAIKN   477
           NSIE+L+NQA+K ITGIEPGAG+M +++++L  Y NL   WKL+  +S+GAMT  LG+AIK
Sbjct: 416 NSIEDLTNQANKTITGIEPGAGVMAASEKTLNSYDNLKDWKLVPSSSGAMTVALGEAIKQ   475

Query: 478 KDQVVITGWSPHWMFAKYDLKYLKDPKKSFGGEEHINTIARKNLKKDMPKVYKIIDKFKW   537
            +VITGWSPHWMF KYDLKYL DPK + G  E+INTI RK LKK+ P+ YK++DKF W
Sbjct: 476 HKDIVITGWSPHWMFNKYDLKYLADPKGTMGTSENINTIVRKGLKKENPEAYKVLDKFNW   535

Query: 538 TKEDMESIMLDMDKGMEPAKAAQKWIKNHKKEVSEWTK   575
           T +DME++MLD+   G  P +AA+ WIK+H+KEV +W K
Sbjct: 536 TTKDMEAVMLDIQNGKTPEEAAKNWIKDHQKEVDKWFK   573
```

A related DNA sequence was identified in *S. pyogenes* <SEQ ID 4637> which encodes the amino acid sequence <SEQ ID 4638>. Analysis of this protein sequence reveals the following:

```
Possible site: 47
>>> Seems to have no N-terminal signal sequence
    INTEGRAL    Likelihood = -8.86    Transmembrane    101-117  (93-121)
    INTEGRAL    Likelihood = -7.54    Transmembrane    252-268  (250-273)
    INTEGRAL    Likelihood = -6.85    Transmembrane     48-64   (43-70)
    INTEGRAL    Likelihood = -5.57    Transmembrane    141-157  (138-170)
    INTEGRAL    Likelihood = -5.26    Transmembrane    295-311  (289-315)
    INTEGRAL    Likelihood = -0.53    Transmembrane    220-236  (220-237)

----- Final Results -----
            bacterial membrane --- Certainty = 0.4545(Affirmative) < succ>
            bacterial outside  --- Certainty = 0.0000(Not Clear)   < succ>
            bacterial cytoplasm --- Certainty = 0.0000(Not Clear)  < succ>
```

The protein has homology with the following sequences in the databases:

```
>GP: AAF37879 GB: AF234619 OpuABC [Lactococcus lactis]
Identities = 340/571 (59%), Positives = 418/571 (72%),
Gaps = 8/571 (1%)

Query:    8 KLPVAQLVEQLTEWLTKTFSGLFDIMQVVGSFLMDWMTKTLLFIHPLLFIVLVTAGMFFL   67
            ++P+A  V   T+W+T TFS  FD++Q  G+ LM+ +T  L +    L I +VT      +
Sbjct:    8 QVPIANWVSSATDWITSTFSSGFDVIQKSGTVLMNGITGALTAVPFWLMIAVVTILAILV   67

Query:   68 AKKKWPLPTFTLLGLLFIYNQGLWKQLMNTFTLVLVASLISVLIGIPLGIWMAKNATVRQ  127
            + KK   P FT +GL  I NQGLW  LM+T TLVL++SL+S++IG+PLGIWMAK  V +
Sbjct:   68 SGKKIAFPLFTFIGLSLIANQGLWSDLMSTITLVLLSSLLSIIIGVPLGIWMAKSDLVAK  127

Query:  128 IVNPILDFMQTMPAFVYLIPAVAFFGIGMVPGVFASVIFALPPTVRFTNLAIRDIPTELI  187
            IV  PILDFMQTMP FVYLIPAVAFFGIG+VPGVFASVIFALPPTVR TNL IR + TEL+
Sbjct:  128 IVQPILDFMQTMPGFVYLIPAVAFFGIGVVPGVFASVIFALPPTVRMTNLGIRQVSTELV  187

Query:  188 EASDAFGSTGKQKLFKVELPLAKNTIMAGVNQTMMLALSMVVTGSMIGAPGLGREVLSAL  247
            EA+D+FGST +QKLFK+E PLAK TIMAGVNQT+MLALSMVV  SMIGAPGLGR VL+A+
Sbjct:  188 EAADSFGSTARQKLFKLEFPLAKGTIMAGVNQTIMLALSMVVIASMIGAPGLGRGVLAAV  247

Query:  248 QHADIGSGFVSGLALVILAIVLDRMTQLFNSKPQEKAKAGKTNKW---IGLAALAVFLIA  304
            Q ADIG GFVSG++LVILAI++DR TQ  N   P EK        KW   I L +L   +I
Sbjct:  248 QSADIGKGFVSGISLVILAIIIDRFTQKLNVSPLEKQGNPTVKKWKRGIALVSLLALIIG  307

Query:  305 ALGRGIMAMTSGMADKGETVNIAYVQWDSEVASTHVIAEVLKNEGYHVTLTPLDNAVMWQ  364
            A         M+ G    + V++ Y+ WDSEVAS +V+ + +K  G+  V  T LDNAV WQ
Sbjct:  308 AFS----GMSFGKTASDKKVDLVYMNWDSEVASINVLTQAMKEHGFDVKTTALDNAVAWQ  363

Query:  365 TVANGNADFSTSAWLPVTHGQQYQKYKSLDDLGPNLKGTKLGLAVPKYMTDVNSIEDLS  424
            TVANG AD   SAWLP TH  Q+QKY   +D LGPNLKG K+G  VP YM +VNSIEDL+
Sbjct:  364 TVANGQADGMVSAWLPNTHKTQWQKYGKSVDLLGPNLKGAKVGFVVPSYM-NVNSIEDLT  422

Query:  425 KQADQKITGIEPGAGIMAAAQKTLKEYHNLSSWELVAASTGAMTTSLDQAIKKKDPIVVT  484
              QA++ ITGIEPGAG+MAA++KTL  Y NL   W+LV +S+GAMT +L  +AIK+    IV+T
Sbjct:  423 NQANKTITGIEPGAGVMAASEKTLNSYDNLKDWKLVPSSSGAMTVALGEAIKQHKDIVIT  482

Query:  485 AWSPHWMFAKYDLKYLKDPKEIFGSTENINTIARKGLKKELPNVYKIIDKFHWTQKDMEA  544
             WSPHWMF KYDLKYL DPK   G++ENINTI RKGLKKE P  YK++DKF+WT KDMEA
Sbjct:  483 GWSPHWMFNKYDLKYLADPKGTMGTSENINTIVRKGLKKENPEAYKVLDKFNWTTKDMEA  542

Query:  545 VMLDINKGMSPEAAAKKWVEANKSKVSSWTK                              575
            VMLDI  G +PE AAK W++ ++ +V  W K
Sbjct:  543 VMLDIQNGKTPEEAAKNWIKDHQKEVDKWFK                              573
```

An alignment of the GAS and GBS proteins is shown below.

```
Identities = 439/576 (76%), Positives = 513/576 (88%),
Gaps = 2/576 (0%)

Query:    1 MENLLQHKLPVAPFVESTTNWITKTFSGLFDFIQTIGNALMDWMTKTLLFINPLLFIVLI   60
            +E +LQ KLPVA  VE T  W+TKTFSGLFD +Q +G+ LMDWMTKTLLFI+PLLFIVL+
Sbjct:    1 LETILQTKLPVAQLVEQLTEWLTKTFSGLFDIMQVVGSFLMDWMTKTLLFIHPLLFIVLV   60

Query:   61 TIAVFFLAKKKWQLPTFTFIGLLFIYNQGLWEQLINTFNLVLVASLISIIIGVPLGIWMA  120
            T  +FFLAKKKW LPTFT +GLLFIYNQGLW+QL+NTF LVLVASLIS++IG+PLGIWMA
Sbjct:   61 TAGMFFLAKKKWPLPTFTLLGLLFIYNQGLWKQLMNTFTLVLVASLISVLIGIPLGIWMA  120

Query:  121 KSDKVKQVVNPILDFMQTMPAFVYLIPAVAFFGIGMVPGVFASVVFALPPTVRFTNLAIR  180
            K+  V+Q+VNPILDFMQTMPAFVYLIPAVAFFGIGMVPGVFASV+FALPPTVRFTNLAIR
Sbjct:  121 KNATVRQIVNPILDFMQTMPAFVYLIPAVAFFGIGMVPGVFASVIFALPPTVRFTNLAIR  180

Query:  181 EIPLELIEASDSFGSTVKQKLFKVELPLAKNTIMAGINQTMMLALSMVVTGSMIGAPGLG  240
            +IP ELIEASD+FGST KQKLFKVELPLAKNTIMAG+NQTMMLALSMVVTGSMIGAPGLG
Sbjct:  181 DIPTELIEASDAFGSTGKQKLFKVELPLAKNTIMAGVNQTMMLALSMVVTGSMIGAPGLG  240

Query:  241 REVLSALQHADIGTGFVSGLSLVILAIVLDRVSQFFNSKPGEKQAKTSKVKKWVGLGALA  300
            REVLSALQHADIG+GFVSGL+LVILAIVLDR++Q FNSKP EK AK  K     KW GL ALA
Sbjct:  241 REVLSALQHADIGSGFVSGLALVILAIVLDRMTQLFNSKPQEK-AKAGKTNKWIGLAALA  299

Query:  301 LFILAALGRIVVNMTSGNEAKGQKVKIAYVQWDSEVASTNVIAEVLKSKGYDVELTPLDN  360
            +F+ +AALGR ++ MTSG    KG+ V IAYVQWDSEVAST VIAEVLK++GY V LTPLDN
Sbjct:  300 VFLIAALGRGIMAMTSGMADKGETVNIAYVQWDSEVASTHVIAEVLKNEGYHVTLTPLDN  359
```

-continued

```
Query: 361 AVMWQTVANGNADFTTSAWLPKTHGQYFNKYKNSLDDLGPHVENVKIGLVVPKYM-NVNS 419
            AVMWQTVANGNADF+TSAWLP THGQ + KYK+ LDDLGP+++  K+GL VPKYM +VNS
Sbjct: 360 AVMWQTVANGNADFSTSAWLPVTHGQQYQKYKSKLDDLGPNLKGTKLGLAVPKYMTDVNS 419

Query: 420 IEELSNQADKQITGIEPGAGIMKSAKQSLKDYPNLSSWKLLSASTGAMTTTLGKAIKNKD 479
            IE+LS QAD++ITGIEPGAGIM +A+++LK+Y NLSSW+L++ASTGAMTT+L +AIK KD
Sbjct: 420 IEDLSKQADQKITGIEPGAGIMAAAQKTLKEYHNLSSWELVAASTGAMTTSLDQAIKKKD 479

Query: 480 QVVITGWSPHWMFAKYDLKYLKDPKKSFGGEEHINTIARKNLKKDMPKVYKIIDKFKWTK 539
            +V+T WSPHWMFAKYDLKYLKDPK+ FG  E+INTIARK LKK++P VYKIIDKF WT+
Sbjct: 480 PIVVTAWSPHWMFAKYDLKYLKDPKEIFGSTENINTIARKGLKKELPNVYKIIDKFHWTQ 539

Query: 540 EDMESIMLDMDKGMEPAKAAQKWIKNHKKEVSEWTK                        575
            +DME++MLD++KGM P  AA+KW++ +K +VS WTK
Sbjct: 540 KDMEAVMLDINKGMSPEAAAKKWVEANKSKVSSWTK                        575
```
15

A related GBS gene <SEQ ID 8827> and protein <SEQ ID 8828> were also identified. Analysis of this protein sequence reveals the following:

```
Lipop: Possible site: -1 Crend: 7
McG: Discrim Score: -6.57
GvH: Signal Score (-7.5): -5.37
Possible site: 41
>>> Seems to have no N-terminal signal sequence
ALOM program count: 6 value: -10.67 threshold: 0.0
INTEGRAL Likelihood = -10.67  Transmembrane   48-64   (43-72)
INTEGRAL Likelihood =  -9.24  Transmembrane  101-117  (93-122)
INTEGRAL Likelihood =  -7.54  Transmembrane  296-312 (290-316)
INTEGRAL Likelihood =  -6.21  Transmembrane  252-268 (250-273)
INTEGRAL Likelihood =  -5.57  Transmembrane  141-157 (138-170)
INTEGRAL Likelihood =  -0.53  Transmembrane  220-236 (220-237)
PERIPHERAL  Likelihood =  2.44  159
modified ALOM score: 2.63

*** Reasoning Step: 3

----- Final Results -----
             bacterial membrane --- Certainty = 0.5267 (Affirmative) < succ>
               bacterial outside --- Certainty = 0.0000 (Not Clear) < succ>
                bacterial cytoplasm --- Certainty = 0.0000 (Not Clear) < succ>
```

The protein has homology with the following sequences in the databases:

```
ORF00938(322-2025 of 2325)
GP|7188801|gb|AAF37879.1|AF234619_2|AF234619(8-573 of 573) OpuABC
{Lactococcus lactis}
% Match = 44.7
% Identity = 60.2   % Similarity = 75.7
Matches = 342   Mismatches = 136   Conservative Sub.s = 88
      255       285       315       345       375       405       435       465
ANVQDETVVESPKETVEA**RGQIILENLLQHKLPVAPFVESTTNWITKTFSGLFDFIQTIGNALMDWMTKTLLFINPLL
                          ::|:|  :|   | |:|||  |||   ||  ||   | ||: :|   |   : |
                         MIDLAIGQVPIANWVSSATDWITSTFSSGFDVIQKSGTVLMNGITGALTAVPFWL
                          10        20        30        40        50
      495       525       555       585       615       645       675       705
FIVLITIAVFFLAKKKWQLPTFTFIGLLFIYNQGLWEQLINTFNLVVASLISIIIGVPLGIWMAKSDKVKQVVNPILDF
| :||    :::  || :| ||||| :| |||||  |::  |||::||:||||||||||||||||| | ::| |||||
MIAVVTILAILVSGKKIAFPLFTFIGLSLIANQGLWSDLMSTITVLLSSLLSIIIGVPLGIWMAKSDLVAKIVQPILDF
        70        80        90       100       110       120       130
      735       765       795       825       855       885       915       945
MQTMPAFVYLIPAVAFFGIGMVPGVFASVVFALPPTVRFTNLAIREIPLELIEASDSFGSTVKQKLFKVELPLAKNTIMA
||||| ||||||||||||||:||||||||:||||||||:|||:|::|||||||::|||||| :|||||:|||||:|||
MQTMPGFVYLIPAVAFFGIGVVPGVFASVIFALPPTVRMTNLGIRQVSTELVEAADSFGSTARQKLFKLEFPLAKGTIMA
        150       160       170       180       190       200       210
      975      1005      1035      1065      1095      1125      1155      1185
GINQTMMLALSMVVTGSMIGAPGLGREVLSALQHADIGTGFVSGLSLVILAIVLDRVSQFFNSKPGEKQAKTSKVKKWVG
|:|||:||||||||:|||||||||| |||| ||:|||| ||||:||| ||| ::|| ||: :| :||| | |      ||||
GVNQTIMLALSMVVIASMIGAPGLGRGVLAAVQSADIGKGFVSGISLVILAIIIDRFTQKLNVSPLEKQG-NPTVKKW-K
        230       240       250       260       270       280       290
     1215      1245      1275      1305      1335      1365      1395      1425
LGALALFILAALGRIVVNMTSGNEAKGQKVKIAYVQWDSEVASTNVIAEVLKSKGYDVELTPLDNAVMWQTVANGNADFT
|  : :||  :      |  |   :||  |  ||: |:|||||:|:  :| |::|:|: | ||||| ||||||| ||
RGIALVSLLALIIGAFSGMSFGKTASDKKVDLVYMNWDSEVASINVLTQAMKEHGFDVKTTALDNAVAWQTVANGQADGM
        310       320       330       340       350       360       370
```

```
     1455      1485      1515      1545      1575      1605      1635      1665
TSAWLPKTHGQYFNKYKNSLDDLGPHVENVKIGLVVPKYMNVNSIEELSNQADKQITGIEPGAGIMKSAKQSLKDYPNLS
 |||||  ||   :  ||   |:| |||:::   |:: |||  ||||||||: | ||:| ||||||||||||:|  :::::|   || ||
VSAWLPNTHKTQWQKYGKSVDLLGPNLKGAKVGFVVPSYMNVNSIEDLTNQANKTITGIEPGAGVMAASEKTLNSYDNLK
          390       400       410       420       430       440       450

1695      1725      1755      1785      1815      1845      1875      1905
SWKLLSASTGAMTTTLGKAIKNKDQVVITGWSPHWMFAKYDLKYLKDPKKSFGGEEHINTIARKNLKKDMPKVYKIIDKF
 |||:  :|:||||    ||:|||       :|||||||||||  ||:|| |    |: |||||  |||||   |:  ||::|||
DWKLVPSSSGAMTVALGEAIKQHKDIVITGWSPHWMFNKYDLKYLADPKGTMGTSENINTIVRKGLKKENPEAYKVLDKF
          470       480       490       500       510       520       530

1935      1965      1995      2025      2055      2085      2115      2145
KWTKEDMESIMLDMDKGMEPAKAAQKWIKNHKKEVSEWTK*YRKKHVSFRACFLM*LKSF*LFNISFILF*YIKSERMKE
 ||  :|||::|||:      |   |  :||:  |||:|||| :|  ||
NWTTKDMEAVMLDIQNGKTPEEAAKNWIKDHQKEVDKWFK
          550       560       570
```

Based on this analysis, it was predicted that these proteins and their epitopes could be useful antigens for vaccines or diagnostics.

EXAMPLE 1508

A DNA sequence (GBSx1596) was identified in *S. agalactiae* <SEQ ID 4639> which encodes the amino acid sequence <SEQ ID 4640>. This protein is predicted to be a transposase. Analysis of this protein sequence reveals the following:

```
Possible site: 45
>>> Seems to have no N-terminal signal sequence
INTEGRAL Likelihood = -1.65 Transmembrane 223-239 (223-240)

----- Final Results -----
         bacterial membrane --- Certainty = 0.1659 (Affirmative) < succ>
           bacterial outside --- Certainty = 0.0000 (Not Clear) < succ>
             bacterial cytoplasm --- Certainty = 0.0000 (Not Clear) < succ>
```

A related GBS nucleic acid sequence <SEQ ID 10057> which encodes amino acid sequence <SEQ ID 10058> was also identified. A related GBS nucleic acid sequence <SEQ ID 10031> which encodes amino acid sequence <SEQ ID 10032> was also identified. A related GBS nucleic acid sequence <SEQ ID 10801> which encodes amino acid sequence <SEQ ID 10802> was also identified.

The protein has homology with the following sequences in the GENPEPT database.

```
>GP: CAA50689 GB: X71844 putative transposase [Clostridium perfringens]
Identities = 94/364 (25%), Positives 160/364 (43%), Gaps = 35/364 (9%)

Query:    8 KHKHLTLLDRNDIQSGLDRGETFKAIGLNLLKHPTTIAKEVKRN--KQLRESTKDCLDCP   65
            K+KHL + +R ++  L G+         L +   T+  E++R   KQ+++ +  +
Sbjct:   12 KNKHLNMKERMIVEIRLKDGFSAYKNTKELNRPINTVLNEIRRGTTKQIKQGKEFHVYFA   71

Query:   66 LLRKAPYVCNGCPKRRINCGYKKTFYLAKQAQRNYEKLLVESREGIPLNKETFWKIDRVL  125
            +A Y  N   + + N  YK        ++  K  +V+         K    W +D +
Sbjct:   72 DTGEAVYKKN---RLKSNRKYKLL------ECSDFIKYVVDKV------KNDHWSLDACV  116

Query:  126 SNGVKKGQRIYHILKTNDLEVSSSTVYRHIKKGYLSITPIDLPRAVKFKKRRKSTLPPIP  185
                G+ ++    +    +S+ T+Y ++   G L I   IDLP   K   +KST
Sbjct:  117 ------GEALHSSRFSPSQIISTKTLYNYVDLGLLPIKNIDLP--AKLHRNKKSTRVRNN  168

Query:  186 KAIKEGRRYEDFIEHM-NQSELNSWLEMDTVIGRIGGK--VLLTFNVAFCNFIFAKLMDS  242
            K  K G      D    + N+ E    W E+D V+G    K   VLLT       +   M S
Sbjct:  169 KK-KLGTSISDRPNSIENREEFGHW-EIDCVLGEKSNKDKVLLTLVERKTRYAIISEMSS  226

Query:  243 KTAIETAKHIQVIKRTLYDNKRDFFELFPVILTDNGGEFARVDDIEIDVCGQSQLFFCDP  302
            + I     K +  IK L       F E+F I  DNG EFA + + E+    +++++F  P
Sbjct:  227 HSTISVTKALDKIKEFLGSK---FSEVFKSITADNGSEFADLSEFELKT--KTKVYFTHP  281

Query:  303 NRSDQKARIEKNHTLVRDILPKGTSFDNLTQEDINLALSHINSVKRQALNGKTAYELFSF  362
               S  +K   E+++  L+R  +PKG     + + E I+     +  +N++ R+ L+ KT  ELF
Sbjct:  282 YSSFEKGTNERHNGLIRRFIPKGKRISDYSLETISFIENWMNTLPRKLLDYKTPEELFEI  341

Query:  363 TYGK                                                        366
            K
Sbjct:  342 HLDK                                                        345
```

No corresponding DNA sequence was identified in *S. pyogenes*.

Based on this analysis, it was predicted that these proteins and their epitopes could be useful antigens for vaccines or diagnostics.

EXAMPLE 1509

A DNA sequence (GBSx1597) was identified in *S. agalactiae* <SEQ ID 4641> which encodes the amino acid sequence <SEQ ID 4642>. Analysis of this protein sequence reveals the following:

```
Possible site: 33
>>> Seems to have an uncleavable N-term signal seq
INTEGRAL Likelihood = -11.30  Transmembrane    56-72  (48-79)
INTEGRAL Likelihood =  -6.85  Transmembrane    11-27  (6-30)
INTEGRAL Likelihood =  -6.69  Transmembrane  129-145  (126-158)
INTEGRAL Likelihood =  -6.53  Transmembrane   94-110  (90-117)
INTEGRAL Likelihood =  -1.54  Transmembrane  216-232  (215-232)
INTEGRAL Likelihood =  -1.22  Transmembrane  147-163  (147-165)

----- Final Results -----
            bacterial membrane --- Certainty = 0.5522 (Affirmative) < succ>
             bacterial outside --- Certainty = 0.0000 (Not Clear)   < succ>
            bacterial cytoplasm --- Certainty = 0.0000 (Not Clear)   < succ>
```

A related GBS nucleic acid sequence <SEQ ID 9431> which encodes amino acid sequence <SEQ ID 9432> was also identified.

The protein has homology with the following sequences in the GENPEPT database.

```
>GP: BAB07666 GB: AP001520 unknown conserved protein [Bacillus halodurans]
Identities = 112/224 (50%), Positives = 150/224 (66%), Gaps = 2/224 (0%)

Query:    8 IKDILWFIIPSLFGVLLLMTPFKYNGMTTVAVSVISKTINQWINAVFPIHYIILLIIFIS   67
            +KD LWF+IPS+ GV L M P + +   T+ V+ ++K +   ++   P   I+L I +
Sbjct:   19 LKDYLWFLIPSIIGVGLFMVPIQKDNAITIPVAFLAKQLQGALDDHLPAILTIMLAIVV-   77

Query:   68 CVLALCYRLFRPSFIEKNDLLKEISDITIFWLIIRLIGLALGLMTVLHIGPEMVWGKETG  127
              VL+    LF+P+   KN LLK + I   WL++R++G    MT+L +GPE VW + TG
Sbjct:   78 -VLSCVATLFKPNLFMKNGLLKSLFVIHPMWLVVRVLGFIFAFMTLLQLGPEAVWSEGTG  136

Query:  128 GLILFDLIGGLFTIFLAAGFILPFLTEFGLLEFVGVFLTPIMRPFFQLPGRSAVNCVASF  187
            L+L+DL+  LFTIFL AG  LPFL  FGLLE GV L   MRP F LPGRS+++C+AS+
Sbjct:  137 ALLLYDLLPLLFTIFLFAGLFLPFLLNFGLLELFGVLLNKFMRPVFTLPGRSSIDCLASW  196

Query:  188 VGDGTIGIALTDKQYVEGYYTSREAATISTTFSAVSITFCLXXL                231
            +GDGTIG+ LT+KQY EG+YT REA ISTTFS VSITF + L
Sbjct:  197 MGDGTIGVLLTNKQYEEGFYTQREAAVISTTFSVVSITFSIVVL                240
```

No corresponding DNA sequence was identified in *S. pyogenes*.

Based on this analysis, it was predicted that these proteins and their epitopes could be useful antigens for vaccines or diagnostics.

EXAMPLE 1510

A DNA sequence (GBSx1599) was identified in *S. agalactiae* <SEQ ID 4643> which encodes the amino acid sequence <SEQ ID 4644>. This protein is predicted to be Na/H antiporter homolog (kefB). Analysis of this protein sequence reveals the following:

```
Possible site: 17
>>> Seems to have an uncleavable N-term signal seq
INTEGRAL Likelihood = -10.14  Transmembrane  176-192  (171-203)
INTEGRAL Likelihood =  -9.34  Transmembrane  353-369  (348-373)
INTEGRAL Likelihood =  -9.24  Transmembrane    3-19   (1-26)
INTEGRAL Likelihood =  -7.17  Transmembrane  145-161  (142-168)
INTEGRAL Likelihood =  -7.01  Transmembrane   86-102  (81-108)
```

```
INTEGRAL Likelihood = -6.53    Transmembrane   52-68   (51-72)
INTEGRAL Likelihood = -5.79    Transmembrane   24-40   (23-49)
INTEGRAL Likelihood = -5.52    Transmembrane  214-230 (209-233)
INTEGRAL Likelihood = -4.04    Transmembrane  260-276 (258-278)
INTEGRAL Likelihood = -3.66    Transmembrane  287-303 (287-308)
INTEGRAL Likelihood = -2.71    Transmembrane  113-129 (112-129)
INTEGRAL Likelihood = -2.66    Transmembrane  332-348 (330-349)

----- Final Results -----
             bacterial membrane --- Certainty = 0.5055 (Affirmative) < succ>
              bacterial outside --- Certainty = 0.0000 (Not Clear)  < succ>
             bacterial cytoplasm --- Certainty = 0.0000 (Not Clear)  < succ>
```

The protein has homology with the following sequences in the GENPEPT database.

```
>GP: CAA51756 GB: X73329 Na/H antiporter homolog [Lactococcus lactis]
Identities = 208/376 (55%), Positives = 285/376 (75%), Gaps = 3/376 (0%)

Query:    1 MHIIIQITIILLASVLATLISKRIGIPAVVGQLLVGIIIGPAMLGLVHQNQVLHVLSEIG    60
            M+ I+Q+TI+L+AS++ATL S+R+ IPAV+GQ+LVGI+I P++LGLVH   VL V+SEIG
Sbjct:    1 MNDILQLTIVLIASLIATLASRRLKIPAVIGQMLVGILIAPSVLGLVHSGHVLEVMSEIG   60

Query:   61 VILLMFLAGLEANFDLLKKYLKPSLLVAITGVIVPMALFYFLTRLFGFQINTAIFYGLVF   120
            VILLMFLAGLE++ +LKK K S+LVAI GVIVP+ +F  +     FG+ ++T+ FYG+VF
Sbjct:   61 VILLMFLAGLESDLTVLKKNFKASMLVAIGGVIVPLIVFGLVAFSFGYGMSTSFFYGIVF  120

Query:  121 AATSISITVEVLQEYNRVKTDTGAIILGAAVADDVLAVLLLSVFIA--TNGSSSNIGLQI   178
            AATS+SITVEVLQEY ++ T  G+IILGAAV DD+LAVL+LS+F +    GS +++  Q
Sbjct:  121 AATSVSITVEVLQEYGKLSTRAGSIILGAAVVDDILAVLILSIFTSFKNGGSGTHLFFQF  180

Query:  179 IIQLLFFVFLFICMKYLVPALFKLIEKVHFFEKYTILAILICFSLSILADKVGMSSIIGS   238
            +++LLFF FLF+ K L+P  +K ++K+    K TI+A++IC  LS+LAD VGMS++IGS
Sbjct:  181 LLELLFFAFLFVVHK-LIPRFWKFVQKLPIANKNTIVALIICLGLSLLADSVGMSAVIGS  239

Query:  239 FFAGLAIGQTSFVDKVEHKISLLSYTFFIPIFFASIALPLKFDGMMSHLHTILIFTALAV   298
            FFAGLAI QT   K+E  S + Y FIP+FF IA+ ++FD ++ H   IL+FT LA+
Sbjct:  240 FFAGLAISQTEVSHKIEEYTSAIGYVIFIPVFFVLIAISVQFDSLIHHPWIILLFTLLAI  299

Query:  299 LSKLIPGYFVGRGFNFSKLESLTIGGGMVSRGEMALIIVQVGLAAKIISSTTYSELVIVV   358
            L+K IP YFVG+    S  ES+ IG GM+SRGEMALI+ Q+GL + II+   YSELVIV+
Sbjct:  300 LTKFIPAYFVGKSNKLSTGESMLIGTGMISRGEMALIVAQIGLTSAIITDEVYSELVIVI  359

Query:  359 ILSTIIAPFILKYSFK                                              374
            IL+T++APF++K   K
Sbjct:  360 ILATVLAPFLIKLVLK                                              375
```

No corresponding DNA sequence was identified in *S. pyogenes*.

Based on this analysis, it was predicted that this protein and its epitopes, could be useful antigens for vaccines or diagnostics.

EXAMPLE 1511

A DNA sequence (GBSx1600) was identified in *S. agalactiae* <SEQ ID 4645> which encodes the amino acid sequence <SEQ ID 4646>. Analysis of this protein sequence reveals the following:

```
Possible site: 22
>>> Seems to have a cleavable N-term signal seq.

----- Final Results -----
             bacterial outside  --- Certainty = 0.3000 (Affirmative) < succ>
             bacterial membrane --- Certainty = 0.0000 (Not Clear)  < succ>
             bacterial cytoplasm --- Certainty = 0.0000 (Not Clear)  < succ>
```

The protein has homology with the following sequences in the GENPEPT database.

```
>GP: CAB14269 GB: Z99116 ypuA [Bacillus subtilis]
Identities = 86/319 (26%), Positives = 147/319 (45%), Gaps = 34/319 (10%)

Query:    3 IKKLLFAGLAFILFTLASPAYAASDVQKVIDETYVQPDYVLGYSLNQEQRAQTLQLLNYD   62
            +KK+    LA + L P + +D    + + V    LG L++ + + L  +N
Sbjct:    1 MKKIWIGMLAAAVLLLMVPKVSLADA--AVGDVIV----TLGADLSESDKQKVLDEMNVP   54

Query:   63 ESRDTKVKTLNTSSYAKIMNIADDASIQLY----SSVKIKKLGSNDTLAVNIVTPENITK  118
            ++  T V   N  + +   +A I      SS+ I K GS    +N+ T  NI+
Sbjct:   55 DNATT-VTVTNKEEHEYLGKYISNAQIGSRAISSSSITIAKKGSG----LNVET-HNISG  108

Query:  119 VTEDMYRNAAVTLGIEHATISVAAPIKVTGESALAGIYYSLE-KNGASVSSENKQLAQEE  177
            +T++MY NA +T G++ A + V AP +V+G +AL G+  + E +  ++S + KQ+A +E
Sbjct:  109 ITDEMYLNALMTAGVKDAKVYVTAPFEVSGTAALTGLIKAYEVSSDEAISEDVKQVANQE  168

Query:  178 LSTLSGINAENKGKEGYDADKLNVALTDIKSAVAKGGSDLSKDDIRKIVEETLKNYHLDN  237
               L T S +  + G E  A    + IK   AK G  +K D I K V++ + +  L+
Sbjct:  169 LVTTSEL-GDKIGNENAAA-----LIAKIKEEFAKNGVPDNKADIEKQVDDAASD--LNV  220

Query:  238 AVTENQINLIVNFAVNLSQSNVIKNSDFTNTLNNLKDNIVSKAGSKFKNINVNFNANKAV  297
             +T++Q N +V     S N +KN+D    + D +  KA K   +    +
Sbjct:  221 TLTDSQKNQLV------SLFNKMKNADI--DWGQVSDQL-DKAKDKITKFIESDEGKNFI  271

Query:  298 ESGKGFLANIWQQIVNFFQ                                          316
            +   F  +IW  IV+ F+
Sbjct:  272 QKVIDFFVSIWNAIVSIFK                                          290
```

No corresponding DNA sequence was identified in S. pyogenes.

Based on this analysis, it was predicted that this protein and its epitopes, could be useful antigens for vaccines or diagnostics.

EXAMPLE 1512

A repeated DNA sequence (GBSx1602) was identified in S. agalactiae <SEQ ID 4647> which encodes the amino acid sequence <SEQ ID 4648>. Analysis of this protein sequence reveals the following:

```
Possible site: 19
>>> Seems to have no N-terminal signal sequence

----- Final Results -----
         bacterial cytoplasm --- Certainty = 0.0603 (Affirmative) < succ>
          bacterial membrane --- Certainty = 0.0000 (Not Clear)   < succ>
           bacterial outside --- Certainty = 0.0000 (Not Clear)   < succ>
```

The protein has homology with the following sequences in the GENPEPT database.

```
>GP: CAB15719 GB: Z99122 similar to hypothetical proteins [Bacillus
subtilis]
Identities = 76/138 (55%), Positives = 91/138 (65%), Gaps = 12/138 (8%)

Query:    1 MKLKAVHHIAIIVSDYEKSKDFYVNKLGFEIIRENHRPERHDYKLDLRC-GDIELEIFGN   59
            M LK++HHIAII SDYEKSK FYV+KLGF++I+E +R ER  YKLDL  G   +E+F
Sbjct:    1 MLLKSIHHIAIICSDYEKSKAFYVHKLGFQVIQETYREERGSYKLDLSLNGSYVIELF--   58

Query:   60 RLDDPEYETPPQRIGRPNWPREACGLRHLAFYVPDVEAYKVELENLGIFVEPIRYDDYTG  119
             +   PP+R  RP    EA GLRHLAF V ++    EL   GI  EPIR D  TG
Sbjct:   59 -----SFPDPPERQTRP----EAAGLRHLAFTVGSLDKAVQELHEKGIETEPIRTDPLTG  109

Query:  120 KKMTFFFDPDGLPLELHE                                           137
            K+ TFFFDPD LPLEL+E
Sbjct:  110 KRFTFFFDPDQLPLELYE                                           127
```

A related DNA sequence was identified in S. pyogenes <SEQ ID 4649> which encodes the amino acid sequence <SEQ ID 4650>. Analysis of this protein sequence reveals the following:

```
Possible site: 20
>>> Seems to have no N-terminal signal sequence

----- Final Results -----
           bacterial cytoplasm --- Certainty = 0.1205 (Affirmative) < succ>
            bacterial membrane --- Certainty = 0.0000 (Not Clear)   < succ>
             bacterial outside --- Certainty = 0.0000 (Not Clear)   < succ>
```

An alignment of the GAS and GBS proteins is shown below.

```
Identities = 99/137 (72%), Positives = 116/137 (84%)

Query:    1 MKLKAVHHIAIIVSDYEKSKDFYVNKLGFEIIRENHRPERHDYKLDLRCGDIELEIFGNR    60
            MKL A+HH+AIIVSDY  SKDFYVNKLGFEIIREN+RP++HDYKLDL CG IELEIFG
Sbjct:    2 MKLNAIHHVAIIVSDYHLSKDFYVNKLGFEIIRENYRPDKHDYKLDLSCGRIELEIFGKV    61

Query:   61 LDDPEYETPPQRIGRPNWPREACGLRHLAFYVPDVEAYKVELENLGIFVEPIRYDDYTGK   120
            DP Y+ PP+R+   P +  EACGLRHLAF V ++E+Y  +L++LGI VEPIR+DDYTG+
Sbjct:   62 TSDPNYQAPPKRVSEPEFKSEACGLRHLAFRVTNIESYVDDLKSLGIPVEPIRHDDYTGE   121

Query:  121 KMTFFFDPDGLPLELHE                                             137
            KMTFFFDPDGLPLELHE
Sbjct:  122 KMTFFFDPDGLPLELHE                                             138
```

Based on this analysis, it was predicted that these proteins and their epitopes could be useful antigens for vaccines or diagnostics.

EXAMPLE 1513

A DNA sequence (GBSx1603) was identified in *S. agalactiae* <SEQ ID 4651> which encodes the amino acid sequence <SEQ ID 4652>. This protein is predicted to be alpha-amylase. Analysis of this protein sequence reveals the following:

```
Possible site: 40
>>> Seems to have an uncleavable N-term signal seq
INTEGRAL Likelihood = -11.62 Transmembrane 14-30 (7-36)

----- Final Results -----
            bacterial membrane --- Certainty = 0.5649 (Affirmative) < succ>
             bacterial outside --- Certainty = 0.0000 (Not Clear)   < succ>
           bacterial cytoplasm --- Certainty = 0.0000 (Not Clear)   < succ>
```

The protein has homology with the following sequences in the GENPEPT database.

```
>GP: AAG41778 GB: AF213261 sortase [Streptococcus gordonii]
Identities = 136/247 (55%), Positives = 174/247 (70%), Gaps = 2/247 (0%)

Query:    2 RNKKKSHGFFNFVRWLLVVLLIIVGLALVFNKPIRNAFIAHQSNHYQISRVSKKTIEKNK    61
            R  KK     N +  +L V+L++V LAL+FN  IRN  +   +N YQ+S+VSKK IEKNK
Sbjct:    6 RRAKKKRSRRNIILNILSVILLLVALALIFNSSIRNMIMVWHTNKYQVSKVSKKEIEKNK    65

Query:   62 KSKTSYDFSSVKSISTESILSAQTKSHNLPVIGGIAIPDVEINLPIFKGLGNTELSYGAG   121
            SK S++F  V+ +STE++L+AQ K+  LPVIGGIAIP++ +NLPIF GL N  L YGAG
Sbjct:   66 ASKGSFNFEKVEPLSTEAVLNAQWKAQQLPVIGGIAIPELSLNLPIFNGLENAGLYYGAG   125

Query:  122 TMKENQIMGGPNNYALASHHVFGLTGSSKMLFSPLEHAKKGMKVYLTDKSKVYTYTITEI   181
            TMKE Q M G  NYALASHHVFG+TG+++MLFSPL+ AK GMK+YLTDK KVYTY+IT +
Sbjct:  126 TMKETQEM-GKGNYALASHHVFGITGANEMLFSPLDRAKAGMKIYLTDKEKVYTYSITSV   184

Query:  182 SKVTPEHVEVIDD-TPGKSQLTLVTCTDPEATERIIVHAELEKTGEFSTADESILKAFSK   240
              V PE V+V+DD   G +++TLVTC D  AT R IV   LE +    +  IL  F+K
Sbjct:  185 ENVEPERVDVVDDAADGTAEVTLVTCEDAAATSRTIVKGVLESETPYKETPKKILNYFNK   244

Query:  241 KYNQINL                                                       247
            YNQ+ L
Sbjct:  245 SYNQMQL                                                       251
```

A related DNA sequence was identified in *S. pyogenes* <SEQ ID 4653> which encodes the amino acid sequence <SEQ ID 4654>. Analysis of this protein sequence reveals the following:

```
Possible site: 34
>>> Seems to have an uncleavable N-term signal seq
INTEGRAL Likelihood =  -8.12 Transmembrane     18-34   (13-38)
INTEGRAL Likelihood =  -0.32 Transmembrane     94-110  (94-110)

----- Final Results -----
bacterial membrane  --- Certainty = 0.4248 (Affirmative) < succ>
bacterial outside   --- Certainty = 0.0000 (Not Clear)  < succ>
bacterial cytoplasm --- Certainty = 0.0000 (Not Clear)  < succ>
```

The protein has homology with the following sequences in the databases:

```
>GP: AAA73122 GB: M77279 alpha-amylase [unidentified cloning vector]
Identities = 60/122 (49%), Positives = 85/122 (69%)

Query:   7 RRKIKSMSWARKLLIAVLLILGLALLFNKPIRNTLIARNSNKYQVTKVSKKQIKKNKEAKS    67
           + K +   +W       L+ +L I+GLAL+FN   IR+ ++ +NS  Y V+K+    +KKN    ++
Sbjct:   4 KEKKRGKNWLINSLLVLLFIIGLALIFNNQIRSWVVQQNSRSYAVSKLKPADVKKNMARET    64

Query:  68 TFDFQAVEPVSTESVLQAQMAAQQLPVIGGIAIPELGINLPIFKGLGNTELIYGAGTMKEE   127
           TFDF +VE +STE+V++AQ     + LPVIG IAIP + INLPIFKGL N  L+ GAGTMKE+
Sbjct:  65 TFDFDSVESLSTEAVMKAQFENKNLPVIGAIAIPSVEINLPIFKGLSNVALLTGAGTMKED   124
```

An alignment of the GAS and GBS proteins is shown below.

```
Identities = 147/245 (60%), Positives = 192/245 (78%)

Query:   2 RNKKKSHGFFNFVRWLLVVLLIIVGLALVFNKPIRNAFIAHQSNHYQISRVSKKTIEKNK    61
           + K++       ++ R LL+ +L+I+GLAL+FNKPIRN  IA  SN  YQ+++VSKK I+KNK
Sbjct:   4 KQKRRKIKSMSWARKLLIAVLLILGLALLFNKPIRNTLIARNSNKYQVTKVSKKQIKKNK    63

Query:  62 KSKTSYDFSSVKSISTESILSAQTKSHNLPVIGGIAIPDVEINLPIFKGLGNTELSYGAG   121
           ++K+++DF +V+ +STES+L AQ +    LPVIGGIAIP++ INLPIFKGLGNTEL YGAG
Sbjct:  64 EAKSTFDFQAVEPVSTESVLQAQMAAQQLPVIGGIAIPELGINLPIFKGLGNTELIYGAG   123

Query: 122 TMKENQIMGGPNNYALASHHVFGLTGSSKMLFSPLEHAKKGMKVYLTDKSKVYTYTITEI   181
           TMKE Q+MGG NNY+LASHH+FG+TGSS+MLFSPLE A+ GM +YLTDK K+Y Y I ++
Sbjct: 124 TMKEEQVMGGENNYSLASHHIFGITGSSQMLFSPLERAQNGMSIYLTDKEKIYEYIIKDV   183

Query: 182 SKVTPEHVEVIDDTPGKSQLTLVTCTDPEATERIIVHAELEKTGEFSTADESILKAFSKK   241
              V PE V+VIDDT G  ++TLVTCTD EATERIIV  EL+    +F  A    +LKAF+
Sbjct: 184 FTVAPERVDVIDDTAGLKEVTLVTCTDIEATERIIVKGELKTEYDFDKAPADVLKAFNHS   243

Query: 242 YNQIN                                                         246
           YNQ++
Sbjct: 244 YNQVS                                                         248
```

SEQ ID 4652 (GBS266) was expressed in *E. coli* as a His-fusion product. SDS-PAGE analysis of total cell extract is shown in FIG. 49 (lane 1; MW 26 kDa).

Figure 205:
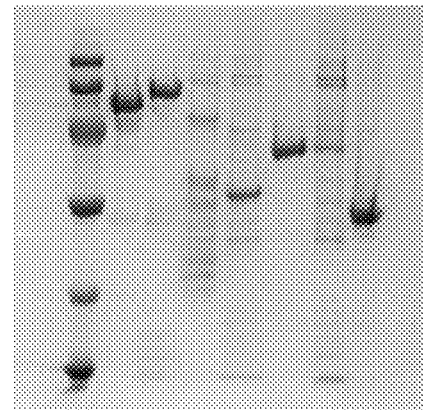

GBS266-His was purified as shown in FIG. 205, lane 10.

Based on this analysis, it was predicted that these proteins and their epitopes could be useful antigens for vaccines or diagnostics.

EXAMPLE 1514

A DNA sequence (GBSx1604) was identified in *S. agalactiae* <SEQ ID 4655> which encodes the amino acid sequence <SEQ ID 4656>. Analysis of this protein sequence reveals the following:

```
Possible site: 31
>>> Seems to have no N-terminal signal sequence

----- Final Results -----
bacterial cytoplasm --- Certainty = 0.1934 (Affirmative) < succ>
bacterial membrane  --- Certainty = 0.0000 (Not Clear)  < succ>
bacterial outside   --- Certainty = 0.0000 (Not Clear)  < succ>
```

A related DNA sequence was identified in *S. pyogenes* <SEQ ID 4657> which encodes the amino acid sequence <SEQ ID 4658>. Analysis of this protein sequence reveals the following:

```
Possible site: 31
>>> Seems to have no N-terminal signal sequence

----- Final Results -----
bacterial cytoplasm --- Certainty = 0.1934 (Affirmative) < succ>
bacterial membrane  --- Certainty = 0.0000 (Not Clear)   < succ>
bacterial outside   --- Certainty = 0.0000 (Not Clear)   < succ>
```

An alignment of the GAS and GBS proteins is shown below.

```
Identities = 711/819 (86%), Positives = 767/819 (92%)

Query:    1 MQDKNLVDVNLTSEMKTSFIDYAMSVIVARALPDVRDGLKPVHRRILYGMNELGVTPDKP   60
            MQD+NL+DVNLTSEMKTSFIDYAMSVIVARALPDVRDGLKPVHRRILYGMNELGVTPDKP
Sbjct:    1 MQDRNLIDVNLTSEMKTSFIDYAMSVIVARALPDVRDGLKPVHRRILYGMNELGVTPDKP   60

Query:   61 HKKSARITGDVMGKYHPHGDSSIYEAMVRMAQWWSYRHMLVDGHGNFGSMDGDGAAAQRY  120
            HKKSARITGDVMGKYHPHGDSSIYEAMVRMAQWWSYRHMLVDGHGNFGSMDGDGAAAQRY
Sbjct:   61 HKKSARITGDVMGKYHPHGDSSIYEAMVRMAQWWSYRHMLVDGHGNFGSMDGDGAAAQRY  120

Query:  121 TEARMSKIALEMLRDINKNTVDFQDNYDGSEREPLVLPARFPNLLVNGATGIAVGMATNI  180
            TEARMSKIALE+LRDINKNTV+FQDNYDGSEREP+VLPARFPNLLVNGATGIAVGMATNI
Sbjct:  121 TEARMSKIALELLRDINKNTVNFQDNYDGSEREPVVLPARFPNLLVNGATGIAVGMATNI  180

Query:  181 PPHNLGESIDAVKLVMDNPDVTTRELMEVIPGPDFPTGALVMGRSGIHRAYETGKGSIVL  240
            PPHNL ESIDAVK+VM++PD TTRELMEVIPGPDFPTGALVMGRSGIHRAY+TGKGSIVL
Sbjct:  181 PPHNLAESIDAVKMVMEHPDCTTRELMEVIPGPDFPTGALVMGRSGIHRAYDTGKGSIVL  240

Query:  241 RSRTEIETTSNGKERIVVTEFPYGVNKTKVHEHIVRLAQEKRIEGITAVRDESSREGVRF  300
            RSRTEIETT  G+ERIVVTEFPYGVNKTKVHEHIVRLAQEKR+EGITAVRDESSREGVRF
Sbjct:  241 RSRTEIETTQTGRERIVVTEFPYGVNKTKVHEHIVRLAQEKRLEGITAVRDESSREGVRF  300

Query:  301 VIEVRRAASANVILNNLFKLTSLQTNFSFNMLAIEKGVPKILSLRQIIDNYIEHQKEVIV  360
            VIE+RR ASA VILNNLFKLTSLQTNFSFNMLAIE GVPKILSLRQIIDNYI HQKEVI+
Sbjct:  301 VIEIRREASATVILNNLFKLTSLQTNFSFNMLAIENGVPKILSLRQIIDNYISHQKEVII  360

Query:  361 RRTQFDKAKAGARAHILEGLLVALDHLDEVITIIRNSETDTIAQAELMSRFELSERQSQA  420
            RRT+FDK KA ARAHILEGLL+ALDHLDEVI IIRNSETD IAQ ELMSRF+LSERQSQA
Sbjct:  361 RRTRFDKDKAEARAHILEGLLIALDHLDEVIAIIRNSETDVIAQTELMSRFDLSERQSQA  420

Query:  421 ILDMRLRRLTGLERDKIQSEYNDLLALIADLADILAKPERVVTIIKEEMDEVKRKYADAR  480
            ILDMRLRRLTGLERDKIQSEY+DLLALIADL+DILAKPER++TIIKEEMDE+KRKYA+ R
Sbjct:  421 ILDMRLRRLTGLERDKIQSEYDDLLALIADLSDILAKPERIITIIKEEMDEIKRKYANPR  480

Query:  481 RTELMIGEVLSLEDEDLIEEEDVLITLSNKGYIKRLAQDEFRAQKRGGRIQGTGVNNDD   540
            RTELM+GEVLSLEDEDLIEEEDVLITLSNKGYIKRLAQDEFRAQKRGGRG+QGTGVNNDD
Sbjct:  481 RTELMVGEVLSLEDEDLIEEEDVLITLSNKGYIKRLAQDEFRAQKRGGRGVQGTGVNNDD  540

Query:  541 FVRELVSTSTHDTVLFFTNLGRVYRLKAYEIPEYGRTAKGLPIVNLLKLDEGETIQTIIN  600
            FVREL+STSTHDT+LFFTN GRVYRLKAYEIPEYGRTAKGLPIVNLLKL++GETIQTIIN
Sbjct:  541 FVRELISTSTHDTLLFFTNFGRVYRLKAYEIPEYGRTAKGLPIVNLLKLEDGETIQTIIN  600

Query:  601 ARKEDVANKYFFFTTQQGIVKRTSVSEFSNIRQNGLRAINLKENDELINVLLIDENEDVI  660
            ARKE+ A K FFFTT+QGIVKRT VSEF+NIRQNGLRA+ LKE D+LINVLL    +D+I
Sbjct:  601 ARKEETAGKSFFFTTKQGIVKRTEVSEFNNIRQNGLRALKLKEGDQLINVLLTSGQDDII  660

Query:  661 IGTRTGYSVRFKVNAVRNMGRTATGVRGVLNREGDKVVGASRIVNGQEVLIITEKGYGKR  720
            IGT +GYSVRF  +++RNMGR+ATGVRGV LRE D+VVGASRI + QEVL+ITE G+GKR
Sbjct:  661 IGTHSGYSVRFNEASIRNMGRSATGVRGVKLREDDRVVGASRIQDNQEVLVITENGFGKR  720

Query:  721 TEASEYPTKGRGGKGIKTANITAKNGPLARLVTINGNEDIMVITDTGVIIRTNVANISQT  780
            T A++YPTKGRGGKGIKTANIT KNG LA LVT++G EDIMVIT+ GVIIRTNVANISQT
Sbjct:  721 TSATDYPTKGRGGKGIKTANITPKNGQLAGLVTVDGTEDIMVITNKGVIIRTNVANISQT  780

Query:  781 GRSTMGVKVMRLDQEAKIVTVALVEQEIEDKSNIEDTKE                     819
            GR+T+GVK+M+LD +AKIVT  LV+ E   + I    +E
Sbjct:  781 GRATLGVKIMKLDADAKIVTFTLVQPEDSSIAEINTDRE                     819
```

Based on this analysis, it was predicted that these proteins and their epitopes could be useful antigens for vaccines or diagnostics.

EXAMPLE 1515

A DNA sequence (GBSx1605) was identified in *S. agalactiae* <SEQ ID 4659> which encodes the amino acid sequence <SEQ ID 4660>. Analysis of this protein sequence reveals the following:

```
Possible site: 25
>>> Seems to have no N-terminal signal sequence

----- Final Results -----
            bacterial membrane --- Certainty = 0.0000(Not Clear) < succ>
             bacterial outside --- Certainty = 0.0000(Not Clear) < succ>
           bacterial cytoplasm --- Certainty = 0.0000(Not Clear) < succ>
```

The protein has homology with the following sequences in the GENPEPT database.

```
>GP: CAA04010 GB: AJ000336 L-lactate dehydrogenase [Streptococcus
pneumoniae]
Identities = 290/329 (88%), Positives = 313/329 (94%), Gaps = 1/329 (0%)

Query:    1 MTATKQHKKVILVGDGAVGSSYAFALVNQGIAQELGIIEIPALFDKAVGDAEDLSHALAF   60
            MT+TKQHKKVILVGDGAVGSSYAFALVNQGIAQELGIIEIP L +KAVGDA DLSHALAF
Sbjct:    1 MTSTKQHKKVILVGDGAVGSSYAFALVNQGIAQELGIIEIPQLHEKAVGDALDLSHALAF   60

Query:   61 TSPKKIYAATYADCADADLVVITAGAPQKPGETRLDLVGKNLAINKSIVTQVVESGFNGI  120
            TSPKKIYAA Y+DCADADLVVITAGAPQKPGETRLDLVGKNLAINKSIVTQVVESGF GI
Sbjct:   61 TSPKKIYAAQYSDCADADLVVITAGAPQKPGETRLDLVGKNLAINKSIVTQVVESGFKGI  120

Query:  121 FLVAANPVDVLTYSTWKFSGFPKERVIGSGTSLDSARFRQALADKIGVDARSVHAYIMGE  180
            FLVAANPVDVLTYSTWKFSGFPKERVIGSGTSLDSARFRQALA+K+ VDARSVHAYIMGE
Sbjct:  121 FLVAANPVDVLTYSTWKFSGFPKERVIGSGTSLDSARFRQALAEKLDVDARSVHAYIMGE  180

Query:  181 HGDSEFAVWSHANVAGVQLEQWLQENRDIDEQGLVDLFISVRDAAYSIINKKGATYYGIA  240
            HGDSEFAVWSHAN+AGV LE++L++ +++ E  L++LF  VRDAAY+IINKKGATYYGIA
Sbjct:  181 HGDSEFAVWSHANIAGVNLEEFLKDTQNVQEAELIELFEGVRDAAYTIINKKGATYYGIA  240

Query:  241 VALARITKAILDDENAVLPLSVYQEGQYGDVKDVFIGQPAIVGAHGIVRPVNIPLNDAEL  300
            VALARITKAILDDENAVLPLSV+QEGQYG V++VFIGQPA+VGAHGIVRPVNIPLNDAE
Sbjct:  241 VALARITKAILDDENAVLPLSVFQEGQYG-VENVFIGQPAVVGAHGIVRPVNIPLNDAET  299

Query:  301 QKMQASAEQLKDIIDEAWKNPEFQEASKN                                329
            QKMQASA++L+ IIDEAWKNPEFQEASKN
Sbjct:  300 QKMQASAKELQAIIDEAWKNPEFQEASKN                                328
```

A related DNA sequence was identified in *S. pyogenes* <SEQ ID 4661> which encodes the amino acid sequence <SEQ ID 4662>. Analysis of this protein sequence reveals the following:

```
Possible site: 25
>>> Seems to have no N-terminal signal sequence
    INTEGRAL      Likelihood = -1.17    Transmembrane   106-122 (106-122)

----- Final Results -----
            bacterial membrane --- Certainty = 0.1468(Affirmative) < succ>
             bacterial outside --- Certainty = 0.0000(Not Clear)   < succ>
           bacterial cytoplasm --- Certainty = 0.0000(Not Clear)   < succ>
```

The protein has homology with the following sequences in the databases:

```
>GP: AAB81558 GB: U60997 L(+)-lactate dehydrogenase [Streptococcus
bovis]
Identities = 278/329 (84%), Positives = 297/329 (89%), Gaps = 2/329 (0%)

Query:    1 MTATKQHKKVILVGDGAVGSSYAFALVTQNIAQELGIIDIFK--EKTQGDAEDLSHALAF   58
            MTATKQHKKVILVGDGAVGSSYAFALV Q IAQELGII+I +    K  GDAEDLSHALAF
Sbjct:    1 MTATKQHKKVILVGDGAVGSSYAFALVNQGIAQELGIIEIPQLFNKAVGDAEDLSHALAF   60
```

```
-continued

Query:   59 TSPKKIYAADYSDCHDADLVVLTAGAPQKPGETRLDLVEKNLRINKEVVTQIVASGFKGI  118
            TSPKKIYAA Y DC DADLVV+TAGAPQKPGETRLDLV KNL INK +VT++V SGFKGI
Sbjct:   61 TSPKKIYAAKYEDCADADLVVITAGAPQKPGETRLDLVGKNLAINKSIVTEVVKSGFKGI  120

Query:  119 FLVAANPVDVLTYSTWKFSGFPKERVIGSGTSLDSARFRQALAAKIGVDARSVHAYIMGE  178
            FLVAANPVDVLTYSTWKFSGFPKERVIGSGTSLDSARFRQALA K+ VDARSVHAYIMGE
Sbjct:  121 FLVAANPVDVLTYSTWKFSGFPKERVIGSGTSLDSARFRQALAEKLDVDARSVHAYIMGE  180

Query:  179 HGDSEFAVWSHANVAGVGLYDWLQANRDIDEQGLVDLFISVRDAAYSIINKKGATFYGIA  238
            HGDSEFAVWSHANVAGV L  +L+  ++++E  LV+LF  VRDAAYSIINKKGATFYGIA
Sbjct:  181 HGDSEFAVWSHANVAGVNLESYLKDVQNVEEAELVELFEGVRDAAYSIINKKGATFYGIA  240

Query:  239 VALARITKAILDDENAVLPLSVFQEGQYEGVEDCYIGQPAIVGAYGIVRPVNIPLNDAEL  298
            VALARITKAIL+DENAVLPLSVFQEGQY  V DCYIGQPAIVGA+GIVRPVNIPLNDAE
Sbjct:  241 VALARITKAILNDENAVLPLSVFQEGQYANVTDCYIGQPAIVGAHGIVRPVNIPLNDAEQ  300

Query:  299 QKMQASANQLKAIIDEAFAKEEFASAAKN                                327
            QKM+ASA +LKAIIDEAF+KEEFASA KN
Sbjct:  301 QKMEASAKELKAIIDEAFSKEEFASACKN                                329
```

An alignment of the GAS and GBS proteins is shown below.

```
Identities = 286/329 (86%), Positives = 299/329 (89%), Gaps = 2/329 (0%)

Query:    1 MTATKQHKKVILVGDGAVGSSYAFALVNQGIAQELGIIEIPALFDKAVGDAEDLSHALAF   60
            MTATKQHKKVILVGDGAVGSSYAFALV Q IAQELGII+I   +K GDAEDLSHALAF
Sbjct:    1 MTATKQHKKVILVGDGAVGSSYAFALVTQNIAQELGIIDI--FKEKTQGDAEDLSHALAF   58

Query:   61 TSPKKIYAATYADCADADLVVITAGAPQKPGETRLDLVGKNLAINKSIVTQVVESGFNGI  120
            TSPKKIYAA Y+DC DADLVV+TAGAPQKPGETRLDLV KNL INK +VTQ+V SGF GI
Sbjct:   59 TSPKKIYAADYSDCHDADLVVLTAGAPQKPGETRLDLVEKNLRINKEVVTQIVASGFKGI  118

Query:  121 FLVAANPVDVLTYSTWKFSGFPKERVIGSGTSLDSARFRQALADKIGVDARSVHAYIMGE  180
            FLVAANPVDVLTYSTWKFSGFPKERVIGSGTSLDSARFRQALA KIGVDARSVHAYIMGE
Sbjct:  119 FLVAANPVDVLTYSTWKFSGFPKERVIGSGTSLDSARFRQALAAKIGVDARSVHAYIMGE  178

Query:  181 HGDSEFAVWSHANVAGVQLEQWLQENRDIDEQGLVDLFISVRDAAYSIINKKGATYYGIA  240
            HGDSEFAVWSHANVAGV L  WLQ NRDIDEQGLVDLFISVRDAAYSIINKKGAT+YGIA
Sbjct:  179 HGDSEFAVWSHANVAGVGLYDWLQANRDIDEQGLVDLFISVRDAAYSIINKKGATFYGIA  238

Query:  241 VALARITKAILDDENAVLPLSVYQEGQYGDVKDVFIGQPAIVGAHGIVRPVNIPLNDAEL  300
            VALARITKAILDDENAVLPLSV+QEGQY V+D +IGQPAIVGA+GIVRPVNIPLNDAEL
Sbjct:  239 VALARITKAILDDENAVLPLSVFQEGQYEGVEDCYIGQPAIVGAYGIVRPVNIPLNDAEL  298

Query:  301 QKMQASAEQLKDIIDEAWKNPEFQEASKN                                329
            QKMQASA QLK IIDEA+  EF A+KN
Sbjct:  299 QKMQASANQLKAIIDEAFAKEEFASAAKN                                327
```

SEQ ID 4660 (GBS312) was expressed in *E. coli* as a His-fusion product. SDS-PAGE analysis of total cell extract is shown in FIG. 49 (lane 7; MW 40 kDa).

GBS312-His was purified as shown in FIG. 205, lane 9.

Based on this analysis, it was predicted that these proteins and their epitopes could be useful antigens for vaccines or diagnostics.

EXAMPLE 1516

A DNA sequence (GBSx1606) was identified in *S. agalactiae* <SEQ ID 4663> which encodes the amino acid sequence <SEQ ID 4664>. This protein is predicted to be NADH oxidase (nox). Analysis of this protein sequence reveals the following:

```
Possible site: 27
>>> Seems to have no N-terminal signal sequence

----- Final Results -----
            bacterial cytoplasm --- Certainty = 0.1888(Affirmative) < succ>
            bacterial membrane  --- Certainty = 0.0000(Not Clear)   < succ>
             bacterial outside  --- Certainty = 0.0000(Not Clear)   < succ>
```

The protein has homology with the following sequences in the GENPEPT database.

```
>GP: AAC26485 GB: AF014458 NADH oxidase [Streptococcus pneumoniae]
(ver 2)
Identities = 363/458 (79%), Positives = 408/458 (88%), Gaps = 3/458 (0%)
```

```
Query:    1 MSKIVVVGTNHAGTAAIKTMLSNYGEANEIVTFDQNSNISFLGCGMALWIGEQIDGPEGL   60
            MSKIVVVG NHAGTA I TML N+G  NEIV FDQNSNISFLGCGMALWIGEQIDG EGL
Sbjct:    1 MSKIVVVGANHAGTACINTMLDNFGNENEIVVFDQNSNISFLGCGMALWIGEQIDGAEGL   60

Query:   61 FYSDKEQLESMGAKVYMNSPVLNIDYDKKEVTALVDGKEHVESYEKLILATGSQPIIPPI  120
            FYSDKE+LE+ GAKVYMNSPVL+IDYD K VTA V+GKEH ESYEKLI ATGS PI+PPI
Sbjct:   61 FYSDKEKLEAKGAKVYMNSPVLSIDYDNKVVTAEVEGKEHKESYEKLIFATGSTPILPPI  120

Query:  121 KGVEIQEGSREFKATLENLQFVKLYQNSEEVIEKLAKPG--INRVAVVGAGYIGVELAEA  178
            +GVEI +G+REFKATLEN+QFVKLYQN+EEVI KL+     ++R+AVVG GYIGVELAEA
Sbjct:  121 EGVEIVKGNREFKATLENVQFVKLYQNAEEVINKLSDKSQHLDRIAVVGGGYIGVELAEA  180

Query:  179 FQRIGKEVTLVDVADTCMGGYYDRDFTDMMSKNLEDHGIRLAFGQAVQAVEGDGKVERLV  238
            F+R+GKEV LVD+ DT + GYYD+DFT MM+KNLEDH IRLA GQ V+A+EGDGKVERL+
Sbjct:  181 FERLGKEVVLVDIVDTVLNGYYDKDFTQMMAKNLEDHNIRLALGQTVKAIEGDGKVERLI  240

Query:  239 TDKETFDVDMVILAVGFRPNTELGAGKLDTFRNGAWVVDKKQETSVKDVYAIGDCATIWD  298
            TDKE+FDVDMVILAVGFRPNT L  GK++ FRNGA++VDKKQETS+  VYA+GDCAT++D
Sbjct:  241 TDKESFDVDMVILAVGFRPNTALADGKIELFRNGAFLVDKKQETSIPGVYAVGDCATVYD  300

Query:  299 NSRDDINYIALASNAVRTGIVAAHNACGTELEGAGVQGSNGISIYGLNMVSTGLTLEKAK  358
            N+R D +YIALASNAVRTGIV A+NACG ELEG GVQGSNGISIYGL+MVSTGLTLEKAK
Sbjct:  301 NARKDTSYIALASNAVRTGIVGAYNACGHELEGIGVQGSNGISIYGLHMVSTGLTLEKAK  360

Query:  359 QAGYNAVETGFNDLQKPEFIKHNNHEVAIKIVYDKDSRVILGCQMVSHE-DVSMGIHMFS  417
             AGYNA ETGFNDLQKPEF+KH+NHEVAIKIV+DKDSR ILG QMVSH+  +SMGIHMFS
Sbjct:  361 AAGYNATETGFNDLQKPEFMKHDNHEVAIKIVFDKDSREILGAQMVSHDIAISMGIHMFS  420

Query:  418 LAIQEKVTIEKLALTDIFFLPHFNKPYNYITMAALGAK                       455
            LAIQE VTI+KLALTD+FFLPHFNKPYNYITMAAL A+
Sbjct:  421 LAIQEHVTIDKLALTDLFFLPHFNKPYNYITMAALTAE                       458
```

A related DNA sequence was identified in *S. pyogenes* <SEQ ID 4665> which encodes the amino acid sequence <SEQ ID 4666>. Analysis of this protein sequence reveals the following:

```
Possible site: 14
>>> Seems to have no N-terminal signal sequence

----- Final Results -----
          bacterial cytoplasm --- Certainty = 0.2068(Affirmative) < succ>
          bacterial membrane  --- Certainty = 0.0000(Not Clear)  < succ>
           bacterial outside  --- Certainty = 0.0000(Not Clear)  < succ>
```

An alignment of the GAS and GBS proteins is shown below.

```
Identities = 362/456 (79%), Positives = 403/456 (87%)

Query:    1 MSKIVVVGTNHAGTAAIKTMLSNYGEANEIVTFDQNSNISFLGCGMALWIGEQIDGPEGL   60
            MSKIVVVG NHAGTA IKTML+NYG+ANEIV FDQNSNISFLGCGMALWIGEQI GPEGL
Sbjct:    1 MSKIVVVGANHAGTACIKTMLTNYGDANEIVVFDQNSNISFLGCGMALWIGEQIAGPEGL   60

Query:   61 FYSDKEQLESMGAKVYMNSPVLNIDYDKKEVTALVDGKEHVESYEKLILATGSQPIIPPI  120
            FYSDKE+LES+GAKVYM SPV +IDYD K VTALVDGK HVE+Y+KLI ATGSQPI+PPI
Sbjct:   61 FYSDKEELESLGAKVYMESPVQSIDYDAKTVTALVDGKNHVETYDKLIFATGSQPILPPI  120

Query:  121 KGVEIQEGSREFKATLENLQFVKLYQNSEEVIEKLAKPGINRVAVVGAGYIGVELAEAFQ  180
            KG EI+EGS EF+ATLENLQFVKLYQNS +VI KL   I RVAVVGAGYIGVELAEAFQ
Sbjct:  121 KGAEIKEGSLEFEATLENLQFVKLYQNSADVIAKLENKDIKRVAVVGAGYIGVELAEAFQ  180

Query:  181 RIGKEVTLVDVADTCMGGYYDRDFTDMMSKNLEDHGIRLAFGQAVQAVEGDGKVERLVTD  240
            R GKEV L+DV DTC+ GYYDRD TD+M+KN E+HGI+LAFG+ V+ V G+GKVE+++TD
Sbjct:  181 RKGKEVVLIDVVDTCLAGYYDRDLTDLMAKNMEEHGIQLAFGETVKEVAGNGKVEKIITD  240

Query:  241 KETFDVDMVILAVGFRPNTELGAGKLDTFRNGAWVVDKKQETSVKDVYAIGDCATIWDNS  300
            K  +DVDMVILAVGFRPNT LG GK+D FRNGA++V+K+QETS+  VYAIGDCATI+DN+
Sbjct:  241 KNEYDVDMVILAVGFRPNTTLGNGKIDLFRNGAFLVNKRQETSIPGVYAIGDCATIYDNA  300

Query:  301 RDDINYIALASNAVRTGIVAAHNACGTELEGAGVQGSNGISIYGLNMVSTGLTLEKAKQA  360
             D NYIALASNAVRTGIVAAHNACGT+LEG GVQGSNGISIYGL+MVSTGLTLEKAK+
Sbjct:  301 TRDTNYIALASNAVRTGIVAAHNACGTDLEGIGVQGSNGISIYGLHMVSTGLTLEKAKRL  360
```

-continued

```
Query: 361 GYNAVETGFNDLQKPEFIKHNNHEVAIKIVYDKDSRVILGCQMVSHEDVSMGIHMFSLAI 420
           G++A  T + D QKPEFI+H N  V IKIVYDKDSR ILG QM + EDVSMGIHMFSLAI
Sbjct: 361 GFDAAVTEYTDNQKPEFIEHGNFPVTIKIVYDKDSRRILGAQMAAREDVSMGIHMFSLAI 420

Query: 421 QEKVTIEKLALTDIFFLPHFNKPYNYITMAALGAKD 456
           QE VTIEKLALTDIFFLPHFNKPYNYITMAALGAKD
Sbjct: 421 QEGVTIEKLALTDIFFLPHFNKPYNYITMAALGAKD 456
```

Based on this analysis, it was predicted that these proteins and their epitopes could be useful antigens for vaccines or diagnostics.

EXAMPLE 1517

A DNA sequence (GBSx1607) was identified in *S. agalactiae* <SEQ ID 4667> which encodes the amino acid sequence <SEQ ID 4668>. Analysis of this protein sequence reveals the following:

```
Possible site: 26
>>> Seems to have no N-terminal signal sequence

----- Final Results -----
        bacterial cytoplasm --- Certainty = 0.2319(Affirmative) < succ>
         bacterial membrane --- Certainty = 0.0000(Not Clear)   < succ>
          bacterial outside --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1518

A DNA sequence (GBSx1608) was identified in *S. agalactiae* <SEQ ID 4669> which encodes the amino acid sequence <SEQ ID 4670>. Analysis of this protein sequence reveals the following:

```
Possible site: 22
>>> Seems to have a cleavable N-term signal seq.
    INTEGRAL    Likelihood = -7.75    Transmembrane    160-176 (157-179)
    INTEGRAL    Likelihood = -7.38    Transmembrane     73-89  (70-97)
    INTEGRAL    Likelihood = -5.47    Transmembrane    289-305 (284-312)
    INTEGRAL    Likelihood = -4.09    Transmembrane    107-123 (106-124)
    INTEGRAL    Likelihood = -3.24    Transmembrane     43-59  (43-59)
    INTEGRAL    Likelihood = -1.91    Transmembrane    258-274 (258-275)
    INTEGRAL    Likelihood = -1.33    Transmembrane    234-250 (233-251)
    INTEGRAL    Likelihood = -0.00    Transmembrane    209-225 (209-225)

----- Final Results -----
           bacterial membrane --- Certainty = 0.4100(Affirmative) < succ>
            bacterial outside --- Certainty = 0.0000(Not Clear)   < succ>
          bacterial cytoplasm --- Certainty = 0.0000(Not Clear)   < succ>
```

A related GBS nucleic acid sequence <SEQ ID 9805> which encodes amino acid sequence <SEQ ID 9806> was also identified.

The protein has homology with the following sequences in the GENPEPT database.

```
>GP: CAB15146 GB: Z99120 similar to hypothetical proteins [Bacillus
subtilis]
Identities = 172/318 (54%), Positives = 234/318 (73%)

Query:   5 LSLTTIFALLFSSMLIYATPLIFTSIGGTFSERGGIVNVGLEGIMVIGAFSGVVFNLEFA  64
           + +  I +++  + L+YA PLI T++GG FSER G+VN+GLEG+M+IGAF+ V+FNL F
Sbjct:   1 MDIVQILSIIVPATLVYAAPLILTALGGVFSERSGVVNIGLEGLMIIGAFTSVLFNLFFG  60

Query:  65 SVFGDATPWISVLVGGLVGLIFSVIHAVATVNFRADHIISGTVLNLMAPSLAVFLIKVLY 124
             G A PW+S+L    G +FS+IHA A ++FRAD  +SG +N++A    +F++K++Y
Sbjct:  61 QELGAAAPWLSLLAAMAAGALFSLIHAAAAISFRADQTVSGVAINMLALGATLFIVKLIY 120
```

-continued

```
Query: 125 NKGQTDNIQESFGKFNFPILSDIPFVGDIFFKGTSLVGYIAILFSFLAWFILYKTRFGLR 184
            K QTD I E F K   P L DIP +G IFF        +AI  +F++WFIL+KT FGLR
Sbjct: 121 GKAQTDKIPEPFYKTKIPGLGDIPVLGKIFFSDVYYTSILAIALAFISWFILFKTPFGLR 180

Query: 185 LRSVGEHPQAADTLGINVYLMRYSGVLISGFLGGIGGAVYAQSISVNFAATTILGPGFIS 244
            +RSVGEHP AADT+GINVY MRY GV+ISG  GG+GG VYA +I+++F  +TI G GFI+
Sbjct: 181 IRSVGEHPMAADTMGINVYKMRYIGVMISGLFGGLGGGVYASTIALDFTHSTISGQGFIA 240

Query: 245 LAAMIFGKWNPIGAMLASLFFGLSQSLAVIGSHLPLLSNIPTVYLQIAPYVLTIIVLAAF 304
            LAA++FGKW+PIGA+ A+LFFG +QSL++IGS LPL   +IP VY+ +APY+LTI+ L  F
Sbjct: 241 LAALVFGKWHPIGALGAALFFGFAQSLSIIGSLLPLFKDIPNVYMLMAPYILTILALTGF 300

Query: 305 FGQAVAPKADGINYIKTK                                        322
            G+A APKA+G+ YIK K
Sbjct: 301 IGRADAPKANGVPYIKGK                                         318
```

A related DNA sequence was identified in *S. pyogenes* [15] <SEQ ID 4671> which encodes the amino acid sequence <SEQ ID 4672>. Analysis of this protein sequence reveals the following:

```
Possible site: 22
>>> Seems to have a cleavable N-term signal seq.
    INTEGRAL    Likelihood = -8.92   Transmembrane    73-89  (69-97)
    INTEGRAL    Likelihood = -5.04   Transmembrane   160-176 (158-177)
    INTEGRAL    Likelihood = -4.62   Transmembrane   289-305 (284-312)
    INTEGRAL    Likelihood = -3.98   Transmembrane   234-250 (232-251)
    INTEGRAL    Likelihood = -2.13   Transmembrane   107-123 (106-123)
    INTEGRAL    Likelihood = -2.02   Transmembrane    43-59  (43-59)
    INTEGRAL    Likelihood = -0.53   Transmembrane   258-274 (258-274)

----- Final Results -----
            bacterial membrane --- Certainty = 0.4567(Affirmative) < succ>
             bacterial outside --- Certainty = 0.0000(Not Clear)   < succ>
           bacterial cytoplasm --- Certainty = 0.0000(Not Clear)   < succ>
```

The protein has homology with the following sequences in the databases:

```
>GP: CAB15146 GB: Z99120 similar to hypothetical proteins [Bacillus
subtilis]
Identities = 176/318 (55%), Positives = 239/318 (74%)

Query:   5 MSLVTIFALLMSSMLIYATPLIFTSIGGTFSERSGVVNVGLEGIMVMGAFSGIVFNLEFA  64
           M +V I ++++ + L+YA PLI T++GG FSERSGVVN+GLEG+M++GAF+ ++FNL F
Sbjct:   1 MDIVQILSIIVPATLVYAAPLILTALGGVFSERSGVVNIGLEGLMIIGAFTSVLFNLFFG  60

Query:  65 ETFGKATPWIAVLVGGIVGLIFSLIHAVATINFRADHIVSGTVLNLLAPSFAVFLVKAMY 124
           +   G A PW+++L    G +FSLIHA A I+FRAD VSG +N+LA    +F+VK +Y
Sbjct:  61 QELGAAAPWLSLLAAMAAGALFSLIHAAAAISFRADQTVSGVAINMLALGATLFIVKLIY 120

Query: 125 GKGQTDNIQQSFGKFDFPGLSQIPVIGDIFFKNTSLIGYFAIAFSFFAWFLLYKTRFGLR 184
           GK QTD I + F K   PGL  IPV+G IFF +     AIA +F +WF+L+KT FGLR
Sbjct: 121 GKAQTDKIPEPFYKTKIPGLGDIPVLGKIFFSDVYYTSILAIALAFISWFILFKTPFGLR 180

Query: 185 LRSVGEHPQAADTLGINVYLMKYYGVMISGFLGGIGGAVYAQSISVNFAVTTILGPGFIA 244
           +RSVGEHP AADT+GINVY M+Y GVMISG  GG+GG VYA +I+++F  +TI G GFIA
Sbjct: 181 IRSVGEHPMAADTMGINVYKMRYIGVMISGLFGGLGGGVYASTIALDFTHSTISGQGFIA 240

Query: 245 LAAMIFGKWNPVGAMLSSLFFGLSQSLAVIGAQLPLLEKIPTVYLQIAPYMVTIIILAAF 304
           LAA++FGKW+P+GA+ ++LFFG +QSL++IG+ LPL + IP VY+ +APY++TI+ L  F
Sbjct: 241 LAALVFGKWHPIGALGAALFFGFAQSLSIIGSLLPLFKDIPNVYMLMAPYILTILALTGF 300

Query: 305 FGQAVAPKADGINYIKSK                                        322
           G+A APKA+G+ YIK K
Sbjct: 301 IGRADAPKANGVPYIKGK                                         318
```

An alignment of the GAS and GBS proteins is shown below.

```
Identities = 272/322 (84%), Positives = 301/322 (93%)

Query:    1 MVSKLSLTTIFALLFSSMLIYATPLIFTSIGGTFSERGGIVNVGLEGIMVIGAFSGVVFN   60
            +V+K+SL TIFALL SSMLIYATPLIFTSIGGTFSER G+VNVGLEGIMV+GAFSG+VFN
Sbjct:    1 VVNKMSLVTIFALLMSSMLIYATPLIFTSIGGTFSERSGVVNVGLEGIMVMGAFSGIVFN   60

Query:   61 LEFASVFGDATPWISVLVGGLVGLIFSVIHAVATVNFRADHIISGTVLNLMAPSLAVFLI  120
            LEFA  FG ATPWI+VLVGG+VGLIFS+IHAVAT+NFRADHI+SGTVLNL+APS AVFL+
Sbjct:   61 LEFAETFGKATPWIAVLVGGIVGLIFSLIHAVATINFRADHIVSGTVLNLLAPSFAVFLV  120

Query:  121 KVLYNKGQTDNIQESFGKFNFPPILSDIPFVGDIFFKGTSLVGYIAILFSFLAWFILYKTR  180
            K +Y KGQTDNIQ+SFGKF+FP LS IP +GDIFFK TSL+GY AI FSF AWF+LYKTR
Sbjct:  121 KAMYGKGQTDNIQQSFGKFDFPPGLSQIPVIGDIFFKNTSLIGYFAIAFSFFAWFLLYKTR  180

Query:  181 FGLRLRSVGEHPQAADTLGINVYLMRYSGVLISGFLGGIGGAVYAQSISVNFAATTILGP  240
            FGLRLRSVGEHPQAADTLGINVYLM+Y GV+ISGFLGGIGGAVYAQSISVNFA TTILGP
Sbjct:  181 FGLRLRSVGEHPQAADTLGINVYLMKYYGVMISGFLGGIGGAVYAQSISVNFAVTTILGP  240

Query:  241 GFISLAAMIFGKWNPIGAMLASLFFGLSQSLAVIGSHLPLLSNIPTVYLQIAPYVLTIIV  300
            GFI+LAAMIFGKWNP+GAML+SLFFGLSQSLAVIG+ LPLL   IPTVYLQIAPY++TII+
Sbjct:  241 GFIALAAMIFGKWNPVGAMLSSLFFGLSQSLAVIGAQLPLLEKIPTVYLQIAPYMVTIII  300

Query:  301 LAAFFGQAVAPKADGINYIKTK                                        322
            LAAFFGQAVAPKADGINYIK+K
Sbjct:  301 LAAFFGQAVAPKADGINYIKSK                                        322
```

A related GBS gene <SEQ ID 8829> and protein <SEQ ID 8830> were also identified. Analysis of this protein sequence reveals the following:

```
Lipop: Possible site: -1 Crend: 3
McG: Discrim Score: 8.61
GvH: Signal Score (-7.5): -1.53
     Possible site: 22
>>> Seems to have a cleavable N-term signal seq.
ALOM program count: 8 value: -7.75 threshold: 0.0
     INTEGRAL    Likelihood = -7.75    Transmembrane   160-176 (157-179)
     INTEGRAL    Likelihood = -7.38    Transmembrane    73-89  (70-97)
     INTEGRAL    Likelihood = -5.47    Transmembrane   289-305 (284-312)
     INTEGRAL    Likelihood = -4.09    Transmembrane   107-123 (106-124)
     INTEGRAL    Likelihood = -3.24    Transmembrane    43-59  (43-59)
     INTEGRAL    Likelihood = -1.91    Transmembrane   258-274 (258-275)
     INTEGRAL    Likelihood = -1.33    Transmembrane   234-250 (233-251)
     INTEGRAL    Likelihood = -0.00    Transmembrane   209-225 (209-225)
     PERIPHERAL  Likelihood =  3.34    139
modified ALOM score: 2.05
*** Reasoning Step: 3

----- Final Results -----
         bacterial membrane --- Certainty = 0.4100(Affirmative) < succ>
          bacterial outside --- Certainty = 0.0000(Not Clear)   < succ>
        bacterial cytoplasm --- Certainty = 0.0000(Not Clear)   < succ>
```

The protein has homology with the following sequences in the databases:

```
ORF00914(313-1266 OF 1566)
EGAD|108729|BS3151(1-318 OF 319) hypothetical protein {Bacillus subtilis}
GP|1934814|emb|CAB07939.1||Z93937 unknown {Bacillus subtilis}
GP|263653|emb|CAB15146.1||Z99120 similar to hypothetical proteins {Bacillus
subtilis} PIR|F70009|F70009 conserved hypothetical protein yufQ-Bacillus subtilis
% Match = 34.9
% Identity = 54.1    % Similarity = 76.4
Matches = 172    Mismatches = 75    Conservative Sub.s = 71

216       246       276       306       336       366       396       426
TLQVFHLS*LKL*QLQSSSS*VSITLLSMLLNLKNK*KVVSKLSLTTIFALLFSSMLIYATPLIFTSIGGTFSERGGIVN
                                   : :  |::::  :||  ||||  ||:||  |||| |:||
                                       MDIVQILSIIVPATLVYAAPLILTALGGVFSERSGVVN
                                             10        20        30

456       486       516       546       576       606       636       666
VGLEGIMVIGAFSGVVFNLEFASVFGDATPWISVLVGGLVGLIFSVIHAVATVNFRADHIISGTVLNLMAPSLAVFLIKV
:||||:|:||||  |:|||  :|||   |  ||:|:|   |:|||| | ::||||  :||  :||  :|||   :::|:
IGLEGLMIIGAFTSVLFNLFFGQELGAAAPWLSLLAAMAAGALFSLIHAAAAISFRADQTVSGVAINMLALGATLFIVKL
      50        60        70        80        90       100       110
```

-continued

```
     696       726       756       786       816       846       876       906
LYNKGQTDNIQESFGKFNFPILSDIPFVGDIFFKGTSLVGYIAILFSFLAWFILYKTRFGLRLRSVGEHPQAADTLGINV
 :| ||| | |   |   | |||  :| |||       :||  ::|::||||:|| ||||:||||||  ||||:||||
IYGKAQTDKIPEPFYKTKIPGLGDIPVLGKIFFSDVYYTSILAIALAFISWFILFKTPFGLRIRSVGEHPMAADTMGINV
        130       140       150       160       170       180       190
     936       966       996       1026      1056      1086      1116      1146
YLMRYSGVLISGFLGGIGGAVYAQSISVNFAATTILGPGFISLAAMIFGKWNPIGAMLASLFFGLSQSLAVIGSHLPLLS
| ||| ||:|||::||:| |||  :|:::| || |||||||||| ||||||:  |:||||:|::|||:||| |||:
YKMRYIGVMISGLFGGLGGGVYASTIALDFTHSTISGQGFIALAALVFGKWHPIGALGAALFFGFAQSLSIIGSLLPLFK
        210       220       230       240       250       260       270
     1176      1206      1236      1266      1296      1326      1356      1386
NIPTVYLQIAPYVLTIIVLAAFFGQAVAPKADGINYIKTK*IKRN*YKLVSFYCL*ICEKILCENFT*IIIQ*Q*NIKK*
:|| ||: :|||:|||:   |   |:| ||||:|: ||| |
DIPNVYMLMAPYILTILALTGFIGRADAPKANGVPYIKGKR
        290       300       310
```

Based on this analysis, it was predicted that these proteins and their epitopes could be useful antigens for vaccines or diagnostics.

EXAMPLE 1519

A DNA sequence (GBSx1609) was identified in *S. agalactiae* <SEQ ID 4673> which encodes the amino acid sequence <SEQ ID 4674>. This protein is predicted to be ribose/galactose ABC transporter, permease protein (rbsC-1). Analysis of this protein sequence reveals the following:

```
Possible site: 55
>>> Seems to have an uncleavable N-term signal seq
     INTEGRAL    Likelihood = -14.59    Transmembrane    205-221 (200-228)
     INTEGRAL    Likelihood = -13.69    Transmembrane     21-37  (13-45)
     INTEGRAL    Likelihood =  -7.27    Transmembrane    302-318 (290-321)
     INTEGRAL    Likelihood =  -7.17    Transmembrane    115-131 (111-138)
     INTEGRAL    Likelihood =  -4.25    Transmembrane    251-267 (250-268)
     INTEGRAL    Likelihood =  -2.97    Transmembrane     63-79  (63-80)
     INTEGRAL    Likelihood =  -2.87    Transmembrane    333-349 (328-349)

----- Final Results -----
             bacterial membrane  --- Certainty = 0.6838(Affirmative) < succ>
             bacterial outside   --- Certainty = 0.0000(Not Clear)   < succ>
             bacterial cytoplasm --- Certainty = 0.0000(Not Clear)   < succ>
```

A related GBS nucleic acid sequence <SEQ ID 8831> which encodes amino acid sequence <SEQ ID 8832> was also identified. Analysis of this protein sequence reveals the following:

```
Lipop: Possible Site: -1 Crend: 6
SRCFLG: 0
McG: Length of UR: 24
     Peak Value of UR: 3.06
     Net Charge of CR: 3
McG: Discrim Score: 12.53
GvH: Signal Score (-7.5): -5.31
     Possible site: 46
>>> Seems to have an uncleavable N-term signal seq
Amino Acid Composition: calculated from 1
ALOM program count: 7 value: -14.59 threshold: 0.0
     INTEGRAL    Likelihood = -14.59    Transmembrane    196-212 (191-219)
     INTEGRAL    Likelihood = -13.69    Transmembrane     12-28  (4-36)
     INTEGRAL    Likelihood =  -7.27    Transmembrane    293-309 (281-312)
     INTEGRAL    Likelihood =  -7.17    Transmembrane    106-122 (102-129)
     INTEGRAL    Likelihood =  -4.25    Transmembrane    242-258 (241-259)
     INTEGRAL    Likelihood =  -2.97    Transmembrane     54-70  (54-71)
     INTEGRAL    Likelihood =  -2.87    Transmembrane    324-340 (319-340)
     PERIPHERAL  Likelihood =   0.16    133
modified ALOM score: 3.42
icm1 HYPID: 7 CFP: 0.684
*** Reasoning Step: 3

----- Final Results -----
             bacterial membrane  --- Certainty = 0.6838(Affirmative) < succ>
             bacterial outside   --- Certainty = 0.0000(Not Clear)   < succ>
             bacterial cytoplasm --- Certainty = 0.0000(Not Clear)   < succ>
```

The protein has homology with the following sequences in the GENPEPT database.

```
>GP: CAB15145 GB: Z99120 similar to hypothetical
proteins [Bacillus subtilis]
Identities = 154/349 (44%), Positives = 220/349 (62%), Gaps = 6/349 (1%)

Query:   10 MSKKAQKIAVPLISVVLGIILGAIIMLIFGYDPLWGYEGLFQTAFGSIKNIGEIFRAMGP   69
            M K+   + VPLI+++LG+  GA+IML+ GY    GY  L+   FG I +GE  R + P
Sbjct:    1 MVKRLSHLLVPLIAIILGLAAGALIMLVSGYSVASGYSALWNGIFGEIYYVGETIRQITP   60

Query:   70 LILIALGFSVASRAGFFNIGLPGQALSGWIAAGWFALSHPDMPRPAMILCTIIIGIVAGG  129
            IL  L + A R G FNIG+ GQ L GW AA W   + D P      +I    AGG
Sbjct:   61 YILSGLAVAFAFRTGLFNIGVEGQLLVGWTAAVWVGTAF-DGPAYIHLPLALITAAAAGG  119

Query:  130 ITGAIPGILRAYLGTSEVIVTIMMNYIVLYSGNAIVQRVFPKSIMRTSDSSVYVSANASY  189
            + G IPGIL+A      EVIVTIMMNYI L+  N I+  V          D +  + +AS
Sbjct:  120 LWGFIPGILKARFYVHEVIVTIMMNYIALHMTNYIISNVLTDH----QDKTGKIHESASL  175

Query:  190 QTDWLSSLTNNSRINIGIFIAIIAVVLVWFLLNKTTLGFEIRSVGLNPNASEYAGMSAKR  249
            ++ +L  +T+ SR+++GI +A++A V++WF++NK+T GFE+R+VG N +AS+YAGMS ++
Sbjct:  176 RSPFLEQITDYSRLHLGIIVALLAAVIMWFIINKSTKGFELRAVGFNQHASQYAGMSVRK  235

Query:  250 TIILSMIISGAFAGLGGVVEGLGTFENVFVQPSSLAIGFDGMAVSLLAANSPIGILFAAF  309
            I+ SM+ISGAFAGL G +EGLGTFE    V+ +    +GFDG+AV+LL  N+ +G++ AA
Sbjct:  236 NIMTSMLISGAFAGLAGAMEGLGTFEYAAVKGAFTGVGFDGIAVALLGGNTAVGVVLAAC  295

Query:  310 LFGVLSVGAPGMNI-AGIPPELIKVVTASIIFFVGVHYIIEYVIKPKKQ            357
            L G L +GA  M I +G+P E++ +V A II FV   Y I +V+   K+
Sbjct:  296 LLGGLKIGALNMPIESGVPSEVVDIVIAIIILFVASSYAIRFVMGKLKK             344
```

A related DNA sequence was identified in *S. pyogenes* <SEQ ID 2149> which encodes the amino acid sequence <SEQ ID 2150>. Analysis of this protein sequence reveals the following:

```
Possible site: 39
>>> Seems to have an uncleavable N-term signal seq
    INTEGRAL      Likelihood = -12.74    Transmembrane    205-221 (200-228)
    INTEGRAL      Likelihood = -12.42    Transmembrane     21-37  (14-45)
    INTEGRAL      Likelihood =  -7.22    Transmembrane    115-131 (111-135)
    INTEGRAL      Likelihood =  -4.78    Transmembrane    251-267 (249-269)
    INTEGRAL      Likelihood =  -2.50    Transmembrane     70-86  (69-86)
    INTEGRAL      Likelihood =  -2.34    Transmembrane    302-318 (300-318)
    INTEGRAL      Likelihood =  -1.44    Transmembrane    148-164 (147-165)
    INTEGRAL      Likelihood =  -1.33    Transmembrane    326-342 (326-342)

----- Final Results -----
             bacterial membrane --- Certainty = 0.6095(Affirmative) < succ>
              bacterial outside --- Certainty = 0.0000(Not Clear)   < succ>
            bacterial cytoplasm --- Certainty = 0.0000(Not Clear)   < succ>
```

An alignment of the GAS and GBS proteins is shown below.

```
identities = 293/358 (81%), Positives = 333/358 (92%), Gaps = 1/358 (0%)

Query:    6 RRREMSKKAQKIAVPLISVVLGIILGAIIMLIFGYDPLWGYEGLFQTAFGSIKNIGEIFR   65
            RR+ MSK AQKIAVPLISV+LG +LGAIIM+IFGYDP+WGYEGLFQ AFGS+KNIGEIFR
Sbjct:    6 RRKVMSKNAQKIAVPLISVLLGFLLGAIIMVIFGYDPIWGYEGLFQIAFGSVKNIGEIFR   65

Query:   66 AMGPLILIALGFSVASRAGFFNIGLPGQALSGWIAAGWFALSHPDMPRPAMILCTIIIGI  125
            +MGPLILIALGF+VASRAGFFN+GL GQAL+GWI+AGWFAL  PDMPRP +IL T +IG+
Sbjct:   66 SMGPLILIALGFTVASRAGFFNVGLSGQALAGWISAGWFALLNPDMPRPLLILMTALIGM  125

Query:  126 VAGGITGAIPGILRAYLGTSEVIVTIMMNYIVLYSGNAIVQRVFPKSIMRTSDSSVYVSA  185
            +AGGI GAIPGILRAYLGTSEVIVTIMMNYI+LY GNAIVQR +P+S+ ++ DS++ VS
Sbjct:  126 IAGGIAGAIPGILRAYLGTSEVIVTIMMNYIILYVGNAIVQRGYPESVKQSIDSTIQVSD  185

Query:  186 NASYQTDWLSSLTNNSRINIGIFIAIIAVVLVWFLLNKTTLGFEIRSVGLNPNASEYAGM  245
            NASYQT WLS+LTNNSRINIGIF AIIA+ L+WFLLNKTTLGFEIRSVGLNP+ASEYAGM
Sbjct:  186 NASYQTHWLSALTNNSRINIGIFFAIIAIALIWFLLNKTTLGFEIRSVGLNPHASEYAGM  245

Query:  246 SAKRTIILSMIISGAFAGLGGVVEGLGTFENVFVQPSSLAIGFDGMAVSLLAANSPIGIL  305
            S+KRTIILSMIISGA AGLGGVVEGLGTFENVFVQ SSLA+GFDGMAVSLLAANSP+GI
Sbjct:  246 SSKRTIILSMIISGALAGLGGVVEGLGTFENVFVQGSSLAVGFDGMAVSLLAANSPLGIF  305
```

-continued

```
Query: 306 FAAFLFGVLSVGAPGMNIAGIPPELIKVVTASIIFFVGVHYIIE-YVIKPKKQMKGGK  362
            F++FLFGVL++GAPGMNIAGIPPEL+KVVTASIIFFVG HY+IE Y+I+PKK +KGGK
Sbjct: 306 FSSFLFGVLNIGAPGMNIAGIPPELVKVVTASIIFFVGSHYLIERYIIRPKKLVKGGK  363
```

Based on this analysis, it was predicted that these proteins and their epitopes could be useful antigens for vaccines or diagnostics.

EXAMPLE 1520

A DNA sequence (GBSx1610) was identified in *S. agalactiae* <SEQ ID 4675> which encodes the amino acid sequence <SEQ ID 4676>. This protein is predicted to be sugar ABC transporter, ATP-binding protein (mglA). Analysis of this protein sequence reveals the following:

```
Possible site: 57
>>> Seems to have no N-terminal signal sequence

----- Final Results -----
              bacterial cytoplasm --- Certainty = 0.3851(Affirmative) < succ>
              bacterial membrane  --- Certainty = 0.0000(Not Clear)   < succ>
              bacterial outside   --- Certainty = 0.0000(Not Clear)   < succ>
```

A related GBS nucleic acid sequence <SEQ ID 9803> which encodes amino acid sequence <SEQ ID 9804> was also identified.

The protein has homology with the following sequences in the GENPEPT database.

```
>GP: CAB15144 GB: Z99120 similar to ABC transporter (ATP-binding
protein) [Bacillus subtilis]
Identities = 311/497 (62%), Positives = 396/497 (79%), Gaps = 1/497 (0%)

Query:  14 VIEMKEITKKFGDFVANDHINLTVEKGEIHALLGENGAGKSTLMNMLAGLLEPTDGQIFI   73
           VIEM  I K F   VAND+INL V+KGEIHALLGENGAGKSTLMN+L GL +P  G+I +
Sbjct:   4 VIEMLNIRKAFPGIVANDNINLQVKKGEIHALLGENGAGKSTLMNVLFGLYQPERGEIRV   63

Query:  74 NGQPVTIDSPSKSSQLGIGMVHQHFMLVEAFTVAENIVLGNETTQNGVLDIKTAAKEIKE  133
           G+ V I+SP+K++  LGIGMVHQHFMLV+ FTVAENI+LG E  + G +D K A +E+++
Sbjct:  64 RGEKVHINSPNKANDLGIGMVHQHFMLVDTFTVAENIILGKEPKKFGRIDRKRAGQEVQD  123

Query: 134 LSEKYGLSVNPNAKISDISVGAQQRVEILKTLYRGADILIFDEPTAVLTPSEIKELMTIM  193
           +S++YGL ++P AK +DISVG QQR EILKTLYRGADILIFDEPTAVLTP EIKELM IM
Sbjct: 124 ISDRYGLQIHPEAKAADISVGMQQRAEILKTLYRGADILIFDEPTAVLTPHEIKELMQIM  183

Query: 194 KSLVKEGKSIILITHKLDEIRAVADKVTVIRRGKSIETVPVAGASSQQLAEMMVGRSVSF  253
           K+LVKEGKSIILITHKL EI  + D+VTVIR+GK I+T+ V     +LA +MVGR VSF
Sbjct: 184 KNLVKEGKSIILITHKLKEIMEICDRVTVIRKGKGIKTLDVRDTNQDELASLMVGREVSF  243

Query: 254 RTEKKEANPTDIILSVKDLVVEENRGGVLAVKNLSLDVRAGEIVGIAGIDGNGQSELIQA  313
           +TEK+ A P    +L++  + V++ R G+   V++LSL V+AGEIVGIAG+DGNGQSELI+A
Sbjct: 244 KTEKRAAQPGAEVLAIDGITVKDTR-GIETVRDLSLSVKAGEIVGIAGVDGNGQSELIEA  302

Query: 314 ITGLRKVTSGQIVIKGKDVTKFSSRQITELSVGHVPEDRHRDGLVLDMTMAENLALQTYY  373
           +TGLRK  SG I + GK +     R+ITE  +GH+P+DRH+ GLVLD  +EN+ LQ+YY
Sbjct: 303 VTGLRKTDSGTITLNGKQIQNLTPRKITESGIGHIPQDRHKHGLVLDFPIGENILLQSYY  362

Query: 374 KEPLSHKGILNFAKIKEYARQLMTEFDVRGAGEHVLARGFSGGNQQKAIIAREVDRDPDL  433
           K+P S  G+L+ ++ + AR L+TE+DVR   E+  AR  SGGNQQKAII RE+DR+PDL
Sbjct: 363 KKPYSALGVLHKGEMYKKARSLITEYDVRTPDEYTHARALSGGNQQKAIIGREIDRNPDL  422

Query: 434 LIVSQPTRGLDVGAIEYIHKRLIEERDKGKAVLVVSFELDEILNLSDRIAVIHDGKIQGI  493
           LI +QPTRGLDVGAIE++HK+LIE+RD GKAVL++SFEL+EI+NLSDRIAVI +G+I
Sbjct: 423 LIAAQPTRGLDVGAIEFVHKKLIEQRDAGKAVLLLSFELEEIMNLSDRIAVIFEGRIIAS  482

Query: 494 VKPDQTNKQELGILMAG                                            510
           V P +T +QELG+LMAG
Sbjct: 483 VNPQETTEQELGLLMAG                                            499
```

-continued

```
Identities = 75/242 (30%), Positives = 128/242 (51%), Gaps = 24/242 (9%)

Query:  280 GVLAVKNLSLDVRAGEIVGIAGIDGNGQSELIQAITGLRKVTSGQIVIKGKDVTKFSSRQ  339
            G++A  N++L V+ GEI  + G +G G+S L+  + GL +    G+I ++G+ V   S  +
Sbjct:   16 GIVANDNINLQVKKGEIHALLGENGAGKSTLMNVLFGLYQPERGEIRVRGEKVHINSPNK   75

Query:  340 ITELSVGHVPEDRHRDGLVLD-MTMAENLALQTYYKEPLSHKGILNFAKI--KEYARQLM  396
            +L +G V     H+  +++D  T+AEN+ L     KEP       F +I  K   +++
Sbjct:   76 ANDLGIGMV----HQHFMLVDTFTVAENIILG---KEPKK------FGRIDRKRAGOEVQ  122

Query:  397 TEFDVRGAGEHVLARG--FSGGNQQKAIIAREVDRDPDLLIVSQPTRGL---DVGAIEYI  451
                D    G  H  A+    S G QQ+A I +  + R  D+LI  +PT  L   ++   + I
Sbjct:  123 DISDRYGLQIHPEAKAADISVGMQQRAEILKTLYRGADILIFDEPTAVLTPHEIKELMQI  182

Query:  452 HKRLIEERDKGKAVLVVSFELDEILNLSDRIAVIHDGKIQGIVKPDQTNKQELGILMAGG  511
                K L++E     GK++++++  +L EI+ + DR+ VI   GK     +     TN+ EL  LM G
Sbjct:  183 MKNLVKE---GKSIILITHKLKEIMEICDRVTVIRKGKGIKTLDVRDTNQDELASLMVGR  239

Query:  512 KI                                                          513
            ++
Sbjct:  240 EV                                                          241
```

A related DNA sequence was identified in *S. pyogenes* <SEQ ID 4677> which encodes the amino acid sequence <SEQ ID 4678>. Analysis of this protein sequence reveals the following:

```
Possible site: 60
>>> Seems to have no N-terminal signal sequence

----- Final Results -----
            bacterial cytoplasm --- Certainty = 0.3558(Affirmative) < succ>
            bacterial membrane  --- Certainty = 0.0000(Not Clear)  < succ>
            bacterial outside   --- Certainty = 0.0000(Not Clear)  < succ>
```

An alignment of the GAS and GBS proteins is shown below.

```
Identities = 431/511 (84%), Positives = 467/511 (91%), Gaps = 1/511 (0%)

Query:   10 MTQNVIEMKEITKKFGDFVANDHINLTVEKGEIHALLGENGAGKSTLMNMLAGLLEPTDG   69
            MTQ+VIEM+EITKKFGDFVANDHINL V KGEIHALLGENGAGKSTLMNMLAGLLEPT G
Sbjct:    7 MTQHVIEMREITKKFGDFVANDHINLNVRKGEIHALLGENGAGKSTLMNMLAGLLEPTSG   66

Query:   70 QIFINGQPVTIDSPSKSSQLGIGMVHQHFMLVEAFTVAENIVLGNETTQNGVLDIKTAAK  129
            +I IN +PV IDSPSKS++LGIGMVHQHFMLVEAFTVAENI+LGNE  +NG LD+  A+K
Sbjct:   67 EIVINDKPVQIDSPSKSAKLGIGMVHQHFMLVEAFTVAENIILGNEVVKNGCLDLNQASK  126

Query:  130 EIKELSEKYGLSVNPNAKISDISVGAQQRVEILKTLYRGADILIFDEPTAVLTPSEIKEL  189
            +IK LSEKYGL++NP+AK+SDISVGAQQRVEILKTLYRGADILIFDEPTAVLTP+EIKEL
Sbjct:  127 DIKVLSEKYGLAINPSAKVSDISVGAQQRVEILKTLYRGADILIFDEPTAVLTPAEIKEL  186

Query:  190 MTIMKSLVKEGKSIILITHKLDEIRAVADKVTVIRRGKSIETVPVAGASSQQLAEMMVGR  249
            MTIMK+LVKEGKSIILITHKLDEIRAVAD+VTVIRRGKSIETV VAGA+SQ LAEMMVGR
Sbjct:  187 MTIMKNLVKEGKSIILITHKLDEIRAVADRVTVIRRGKSIETVDVAGATSQDLAEMMVGR  246

Query:  250 SVSFRTEKKEANPTDIILSVKDLVVEENRGGVLAVKNLSLDVRAGEIVGIAGIDGNGQSE  309
            SVSF T KK A P D++LS+K+L V+ENR GV AVK LSLDVRAGEIVGIAGIDGNGQSE
Sbjct:  247 SVSFTTSKKAAEPKDVVLSIKNLEVDENR-GVPAVKGLSLDVRAGEIVGIAGIDGNGQSE  305

Query:  310 LIQAITGLRKVTSGQIVIKGKDVTKFSSRQITELSVGHVPEDRHRDGLVLDMTMAENLAL  369
            LIQAITGLRKV SG I+IK  +VT   SSR+ITELSVGHVPEDRHRDGL+LD+++AEN AL
Sbjct:  306 LIQAITGLRKVKSGSIMIKNNEVTHLSSRKITELSVGHVPEDRHRDGLILDLSLAENTAL  365

Query:  370 QTYYKEPLSHKGILNFAKIKEYARQLMTEFDVRGAGEHVLARGFSGGNQQKAIIAREVDR  429
            QTYYK+PLS  GILN+ KI +YARQLM EFDVRGA E V ARGFSGGNQQKAIIAREVDR
Sbjct:  366 QTYYKQPLSQNGILNYTKINDYARQLMKEFDVRGANELVPARGFSGGNQQKAIIAREVDR  425

Query:  430 DPDLLIVSQPTRGLDVGAIEYIHKRLIEERDKGKAVLVVSFELDEILNLSDRIAVIHDGK  489
            DPDLLIVSQPTRGLDVGAIEYIHKRLI+ERDKGKAVLVVSFELDEILNLSDRIAVIHDGK
Sbjct:  426 DPDLLIVSQPTRGLDVGAIEYIHKRLIKERDKGKAVLVVSFELDEILNLSDRIAVIHDGK  485

Query:  490 IQGIVKPDQTNKQELGILMAGGKIEKEERDV                              520
            IQGIV P+ TNKQELGILMAGG I KEE  V
Sbjct:  486 IQGIVSPENTNKQELGILMAGGSIHKEEGHV                              516
```

Based on this analysis, it was predicted that these proteins and their epitopes could be useful antigens for vaccines or diagnostics.

EXAMPLE 1521

A DNA sequence (GBSx1612) was identified in *S. agalactiae* <SEQ ID 4679> which encodes the amino acid sequence <SEQ ID 4680>. Analysis of this protein sequence reveals the following:

```
Possible Site: 22
>>> May be a lipoprotein

----- Final Results -----
            bacterial membrane --- Certainty = 0.0000(Not Clear) < succ>
            bacterial outside  --- Certainty = 0.0000(Not Clear) < succ>
            bacterial cytoplasm --- Certainty = 0.0000(Not Clear) < succ>
```

The protein has homology with the following sequences in the GENPEPT database.

```
>GP: CAB15143 GB: Z99120 similar to ABC transporter (lipoprotein)
[Bacillus subtilis]
Identities = 164/335 (48%), Positives = 224/335 (65%), Gaps = 10/335 (2%)

Query:  18 LAACGHRGASKSGGKS-DSLKVAMVTDTGGVDDKSFNQSGWEGMQAWGKKNGLKKGA-GF   75
           L ACG+    S   G+ +    VAMVTD GGVDDKSFNQS WEG+QA+GK+NGLKKG  G+
Sbjct:  11 LGACGNSEKSSGSGEGKNKFSVAMVTDVGGVDDKSFNQSAWEGIQAFGKENGLKKGKNGY   70

Query:  76 DYFQSASESDYATNLDTAVSSGYKLIFGIGFSLHDAIKAADNNKDVNYVIVDDVIKGKD  135
           DY QS S++DY TNL+     + LI+G+G+ + D+I + AD  K+ N+ I+D V+  KD
Sbjct:  71 DYLQSKSDADYTTNLNKLARENFDLIYGVGYLMEDSISEIADQRKNTNFAIIDAVVD-KD  129

Query: 136 NVASVVFADNESAYLAGIAAAKTTKTKTVGFVGGMESEVITRFEKGFEAGVKSVDKSIKI  195
           NVAS+ F + E ++L G+AAA ++K+  +GFVGGMESE+I +FE GF AGV++V+    +
Sbjct: 130 NVASITFKEQEGSFLVGVAAALSSKSGKIGFVGGMESELIKKFEVGFRAGVQAVNPKAVV  189

Query: 196 KVDYAGSFGDAAKGKTIAAAQYASGADIVYQVAGGTGAGVFSEAKSRNESLKEADKVWVL  255
           +V YAG F  A  GK  A + Y SG D++Y  AG TG GVF+EAK+  +    + D VWV+
Sbjct: 190 EVKYAGGFDKADVGKATAESMYKSGVDVIYHSAGATGTGVFTEAKNLKKEDPKRD-VWVI  248

Query: 256 GVDRDQAAEGKYTSKDGKASNFVLASSIKEVGKSVELIATKTSKGKFPGGNVTTYGLKDG  315
           GVD+DQ AEG+    +G  N  L S +K+V  VE +   K S GKFPGG    TYGL
Sbjct: 249 GVDKDQYAEGQV---EGTDDNVTLTSMVKKVDTVVEDVTKKASDGKFPGGETLTYGLDQD  305

Query: 316 GVDIATT--NLSDDAVKAIKEAKAKIISGDIKVPS                          348
           GV I+ +  NLSDD +KA+ + K KII G +++P+
Sbjct: 306 GVGISPSKQNLSDDVIKAVDKWKKKIIDG-LEIPA                          339
```

A related DNA sequence was identified in *S. pyogenes* <SEQ ID 861> which encodes the amino acid sequence <SEQ ID 862>. Analysis of this protein sequence reveals the following:

```
Possible site: 19
>>> May be a lipoprotein

----- Final Results -----
            bacterial membrane --- Certainty = 0.0000(Not Clear) < succ>
            bacterial outside  --- Certainty = 0.0000(Not Clear) < succ>
            bacterial cytoplasm --- Certainty = 0.0000(Not Clear) < succ>
```

An alignment of the GAS and GBS proteins is shown below.

```
Identities = 275/351 (78%), Positives = 312/351 (88%), Gaps = 3/351 (0%)

Query:   1 MNKKIAGIGLASIAVLSLAACGHRGASKSG--GKSDSLKVAMVTDTGGVDDKSFNQSGWE   58
           MNKK  G+GLAS+AVLSLAACG+RGASK G   GK+D LKVAMVTDTGGVDDKSFNQS WE
Sbjct:   1 MNKKFIGLGLASVAVLSLAACGNRGASKGGASGKTD-LKVAMVTDTGGVDDKSFNQSAWE   59
```

-continued
```
Query:   59 GMQAWGKKNGLKKGAGFDYFQSASESDYATNLDTAVSSGYKLIFGIGFSLHDAIDKAADN 118
            G+Q+WGK+ GL+KG GFDYFQS SES+YATNLDTAVS GY+LI+GIGF+L DAI KAA +
Sbjct:   60 GLQSWGKEMGLQKGTGFDYFQSTSESEYATNLDTAVSGGYQLIYGIGFALKDAIAKAAGD 119

Query:  119 NKDVNYVIVDDVIKGKDNVASVVFADNESAYLAGIAAAKTTKTKTVGFVGGMESEVITRF 178
            N+ V +VI+DD+I+GKDNVASV FAD+E+AYLAGIAAAKTTKTKTVGFVGGME  VITRF
Sbjct:  120 NEGVKFVIIDDIIEGKDNVASVTFADHEAAYLAGIAAAKTTKTKTVGFVGGMEGTVITRF 179

Query:  179 EKGFEAGVKSVDKSIKIKVDYAGSFGDAAKGKTIAAAQYASGADIVYQVAGGTGAGVFSE 238
            EKGFEAGVKSVD +I++KVDYAGSFGDAAKGKTIAAAQYA+GAD++YQ AGGTGAGVF+E
Sbjct:  180 EKGFEAGVKSVDDTIQVKVDYAGSFGDAAKGKTIAAAQYAAGADVIYQAAGGTGAGVFNE 239

Query:  239 AKSRNESLKEADKVWVLGVDRDQAAEGKYTSKDGKASNFVLASSIKEVGKSVELIATKTS 298
            AK+ NE   EADKVWV+GVDRDQ  EGKYTSKDGK +NFVLASSIKEVGK+V+LI  + +
Sbjct:  240 AKAINEKRSEADKVWVIGVDRDQKDEGKYTSKDGKEANFVLASSIKEVGKAVQLINKQVA 299

Query:  299 KGKFPGGNVTTYGLKDGGVDIATTNLSDDAVKAIKEAKAKIISGDIKVPSK           349
               KFPGG  T YGLKDGGV+IATTN+S +AVKAIKEAKAKI SGDIKVP K
Sbjct:  300 DKKFPGGKTTVYGLKDGGVEIATTNVSKEAVKAIKEAKAKIKSGDIKVPEK           350
```

A related DNA sequence was identified in *S. pyogenes* <SEQ ID 9061> which encodes amino acid sequence <SEQ ID 9062>. Analysis of this protein sequence reveals the following:

```
Possible site: 17
>>> May be a lipoprotein

----- Final Results -----
            bacterial membrane --- Certainty = 0.0000(Not Clear) < succ>
            bacterial outside  --- Certainty = 0.0000(Not Clear) < succ>
            bacterial cytoplasm --- Certainty = 0.0000(Not Clear) < succ>
```

An alignment of the GAS and GBS sequences follows:

```
Score = 414 bits (1052), Expect = e-117
Identities = 196/347 (56%), Positives = 253/347 (72%), Gaps = 2/347 (0%)

Query:    1 MNKKVMSLGLVSTALFTLGGCTNNSAKQT--TDNSLKIAMITNQTGIDDKSFNQSAWEGL  58
            MNKK+  +GL S A+ +L  C +  A ++    +SLK+AM+T+  G+DDKSFNQS WEG+
Sbjct:    1 MNKKIAGIGLASIAVLSLAACGHRGASKSGGKSDSLKVAMVTDTGGVDDKSFNQSGWEGM  60

Query:   59 QAWGKENKLEKGKGYDYFQSANESEFTTNLESAVTNGYNLVFGIGFPLHDAVEKVAANNP 118
            QAWGK+N L+KG G+DYFQSA+ES++ TNL++AV++GY L+FGIGF LHDA++K A NN
Sbjct:   61 QAWGKKNGLKKGAGFDYFQSASESDYATNLDTAVSSGYKLIFGIGFSLHDAIDKAADNNK 120

Query:  119 DNHFAIVDDVIKGQKNVASITFSDHEAAYLAGVXXXXXXXXXXQVGFVGGMEGDVVKRFEK 178
            D ++ IVDDVIKG+ NVAS+ F+D+E+AYLAG+          VGFVGGME +V+ RFEK
Sbjct:  121 DVNYVIVDDVIKGKDNVASVVFADNESAYLAGIAAAKTTKTKTVGFVGGMESEVITRFEK 180

Query:  179 GFEAGVKSVDDTIKVRVAYAGSFXXXXXXXXXXXXXXXXEGADVIYHAAGGTGAGVFSEAK 238
            GFEAGVKSVD +IK++V YAGSF                GAD++Y AGGTGAGVFSEAK
Sbjct:  181 GFEAGVKSVDKSIKIKVDYAGSFGDAAKGKTIAAAQYASGADIVYQVAGGTGAGVFSEAK 240

Query:  239 SINEKRKEEDKVWVIGVDRDQSEDGKYTTKDGKSANFVLTSSIKEVGKALVKVAVKTSED 298
            S NE  KE DKVWV+GVDRDQ+ +GKYT+KDGK++NFVL SSIKEVGK++  +A KTS+
Sbjct:  241 SRNESLKEADKVWVLGVDRDQAAEGKYTSKDGKASNFVLASSIKEVGKSVELIATKTSKG 300

Query:  299 QFPGGQITTFGLKEGGVSLTTDALTQDTXXXXXXXXXXXXXGTITVP              345
            +FPGG +TT+GLK+GGV + T  L+ D              G I VP
Sbjct:  301 KFPGGNVTTYGLKDGGVDIATTNLSDDAVKAIKEAKAKIISGDIKVP              347
```

SEQ ID 4680 (GBS211) was expressed in *E. coli* as a His-fusion product. SDS-PAGE analysis of total cell extract is shown in FIG. 49 (lane 6; MW 40 kDa).

Figure 259A:
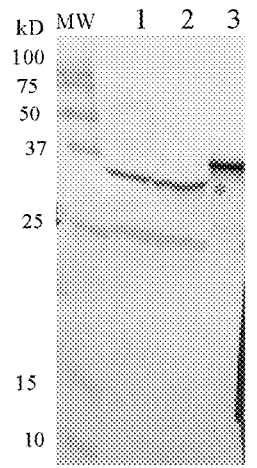
Figure 259B:
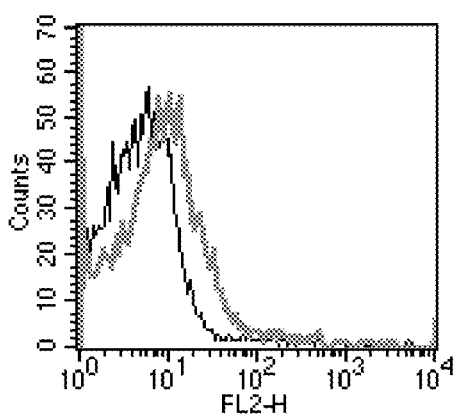

The GBS211-His fusion product was purified (FIG. 205, lane 8) and used to immunise mice. The resulting antiserum was used for Western blot (FIG. 259A) and FACS (FIG. 259B). These tests confirm that the protein is immunoaccessible on GBS bacteria.

Based on this analysis, it was predicted that these proteins and their epitopes could be useful antigens for vaccines or diagnostics.

EXAMPLE 1522

A DNA sequence (GBSx1613) was identified in *S. agalactiae* <SEQ ID 4681> which encodes the amino acid sequence <SEQ ID 4682>. This protein is predicted to be cytidine deaminase (cdd). Analysis of this protein sequence reveals the following:

```
Possible site: 42
>>> Seems to have no N-terminal signal sequence

----- Final Results -----
            bacterial cytoplasm --- Certainty = 0.2112(Affirmative) < succ>
             bacterial membrane --- Certainty = 0.0000(Not Clear)   < succ>
              bacterial outside --- Certainty = 0.0000(Not Clear)   < succ>
```

A related GBS nucleic acid sequence <SEQ ID 9801> which encodes amino acid sequence <SEQ ID 9802> was also identified.

The protein has homology with the following sequences in the GENPEPT database.

```
>GP: CAB51906 GB: AJ237978 cytidine deaminase [Bacillus psychrophilus]
Identities = 66/114 (57%), Positives = 81/114 (70%)

Query:  26 KASENAYVPYSKFPVGAALRTAEGKIFTGCNVENISYGLANCAERTAIFKAVSEGYKDFS   85
           KA E AYVPYSKFPVGAAL   +G I+ GCN+EN +Y + NCAERTA FKAVS+G + F
Sbjct:  12 KAREQAYVPYSKFPVGAALLAEDGTIYHGCNIENSAYSMTNCAERTAFFKAVSDGVRSFK   71

Query:  86 EIAIYGNTEEPISPCGACRQVMVEFFNKNAKVTLIAKNGKTVETTVGELLPYSF        139
            +A+   +TE P+SPCGACRQV+ EF N +  V L    G    ETTV +LLP +F
Sbjct:  72 ALAVVADTEGPVSPCGACRQVIAEFCNGSMPVYLTNLKGDIEETTVAKLLPGAF        125
```

A related DNA sequence was identified in *S. pyogenes* <SEQ ID 4683> which encodes the amino acid sequence <SEQ ID 4684>. Analysis of this protein sequence reveals the following:

```
Possible site: 13
>>> Seems to have no N-terminal signal sequence

----- Final Results -----
            bacterial cytoplasm --- Certainty = 0.0041(Affirmative) < succ>
             bacterial membrane --- Certainty = 0.0000(Not Clear)   < succ>
              bacterial outside --- Certainty = 0.0000(Not Clear)   < succ>
```

The protein has homology with the following sequences in the databases:

```
>GP: CAB15143 GB: Z99120 similar to ABC transporter (lipoprotein)
[Bacillus subtilis]
Identities = 152/339 (44%), Positives = 223/339 (64%),
Gaps = 11/339 (3%)

Query:   8 LGLVSTALFTLGGCTNN---SAKQTTDNSLKIAMITNQTGIDDKSFNQSAWEGLQAWGKE   64
           + LV  A  LG C N+   S    N  +AM+T+  G+DDKSFNQSAWEG+QA+GKE
Sbjct:   1 MSLVIAAGTILGACGNSEKSSGSGEGKNKFSVAMVTDVGGVDDKSFNQSAWEGIQAFGKE   60

Query:  65 NKLEKGK-GYDYFQSANESEFTTNLESAVTNGYNLVFGIGFPLHDAVEKVAANNPDNHFA  123
           N L+KGK GYDY QS +++++TTNL      ++L++G+G+ + D++ ++A    + +FA
Sbjct:  61 NGLKKGKNGYDYLQSKSDADYTTNLNKLARENFDLIYGVGYLMEDSISEIADQRKNTNFA  120

Query: 124 IVDDVIKGQKNVASITFSDHEAAYLAGVAAAKTTKTQVGFVGGMEGDVVKRFEKGFEAG  183
           I+D V+  + NVASITF + E ++L GVAAA ++K+ ++GFVGGME +++K+FE GF AG
Sbjct: 121 IIDAVVD-KDNVASITFKEQEGSFLVGVAAALSSKSGKIGFVGGMESELIKKFEVGFRAG  179

Query: 184 VKSVDDTIKVRVAYAGSFADAAKGKTIAAAQYAEGADVIYHAAGGTGAGVFSEAKSINEK  243
           V++V+    V V YAG F  A  GK  A + Y  G DVIYH+AG TG GVF+EAK++ ++
Sbjct: 180 VQAVNPKAVVEVKYAGGFDKADVGKATAESMYKSGVDVIYHSAGATGTGVFTEAKNLKKE  239

Query: 244 RKEEDKVWVIGVDRDQSEDGKYTTKDGKSANFVLTSSIKEVGKALVKVAVKTSEDQFPGG  303
             + D VWVIGVD+DQ  +G+    +G  N  LTS +K+V    V  K S+ +FPGG
Sbjct: 240 DPKRD-VWVIGVDKDQYAEGQV---EGTDDNVTLTSMVKKVDTVVEDVTKKASDGKFPGG  295

Query: 304 QITTFGLKEGGVSLTTDA--LTQDTKKAIEAAKKAIIEG                      340
            + T+GL + GV ++      L+ D  KA++  KK II+G
Sbjct: 296 ETLTYGLDQDGVGISPSKQNLSDDVIKAVDKWKKKIIDG                      334
```

An alignment of the GAS and GBS proteins is shown below.

```
Identities = 88/128 (68%), Positives = 107/128 (82%)

Query:   15 MGNIELKKLAVKASENAYVPYSKFPVGAALRTAEGKIFTGCNVENISYGLANCAERTAIF   74
            MG  +L   AV+ASE AYVPYS FPVGAAL+T +G I+TGCN+EN+S+GL NC ERTAIF
Sbjct:    1 MGTTDLVSCAVQASEYAYVPYSHFPVGAALKTKDGTIYTGCNIENVSFGLTNCGERTAIF   60

Query:   75 KAVSEGYKDFSEIAIYGNTEEPISPCGACRQVMVEFFNKNAKVTLIAKNGKTVETTVGEL  134
            KA+S+G+K+  EIAIYG T +P+SPCGACRQVM EFF+ ++ VTLIARNG+TVE TVG+L
Sbjct:   61 KAISDGHKELVEIAIYGETMQPVSPCGACRQVMAEFFDPSSLVTLIAKNGQTVEMTVGDL  120

Query:  135 LPYSFVDL                                                     142
            L YSF DL
Sbjct:  121 LLYSFTDL                                                     128
```

Based on this analysis, it was predicted that these proteins and their epitopes could be useful antigens for vaccines or diagnostics.

EXAMPLE 1523

A DNA sequence (GBSx1614) was identified in *S. agalactiae* <SEQ ID 4685> which encodes the amino acid sequence <SEQ ID 4686>. Analysis of this protein sequence reveals the following:

```
Possible site: 34
>>> Seems to have no N-terminal signal sequence

----- Final Results -----
             bacterial cytoplasm --- Certainty = 0.2979(Affirmative) < succ>
              bacterial membrane --- Certainty = 0.0000(Not Clear)   < succ>
               bacterial outside --- Certainty = 0.0000(Not Clear)   < succ>
```

A related GBS nucleic acid sequence <SEQ ID 9799> which encodes amino acid sequence <SEQ ID 9800> was also identified.

The protein has homology with the following sequences in the GENPEPT database.

```
>GP: CAB11882 GB: Z99104 alternate gene name: ybaA~similar to
hypothetical proteins [Bacillus subtilis]
Identities = 90/201 (44%), Positives = 144/201 (70%), Gaps = 5/201 (2%)

Query:    1 MANMYYTENPNVEHDIHELNVKLLGESFSFLTDAGVFSKRMIDYGSQVLLNSLHF-EKNK   59
            M+  YY+E P+V+ +    + +L  + F+F +D+GVFSK+ +D+GS++L++S     E
Sbjct:    1 MSEHYYSEKPSVKSNKQTWSFRLRNKDFTFTSDSGVFSKKEVDFGSRLLIDSFEEPEVEG   60

Query:   60 SLLDLGCGYGPLGISLAK-VQGVKATMVDINTRALELAKKNATRNGVV-VEVFQSNIYEN  117
            +LD+GCGYGP+G+SLA  +      M+D+N RA+EL+ +NA +NG+  V+++QS+++ N
Sbjct:   61 GILDVGCGYGPIGLSLASDFKDRTIHMIDVNERAVELSNENAEQNGITNVKIYQSDLFSN  120

Query:  118 I--SKTFDYIISNPPIRAGKQVVHSIIEESICYLNTGGSLTIVIQKKQGAPSAKAKMLDT  175
            +  ++TF  I++NPPIRAGK+VVH+I E+S  +L   G L IVIQKKQGAPSA  K+ +
Sbjct:  121 VDSAQTFASILTNPPIRAGKKVVHAIFEKSAEHLKASGELWIVIQKKQGAPSAIEKLEEL  180

Query:  176 FGNCDILKKDKGYYILRSEKV                                        196
            F     +++K KGYYI++++KV
Sbjct:  181 FDEVSVVQKKKGYYIIKAKKV                                        201
```

A related DNA sequence was identified in *S. pyogenes* <SEQ ID 4687> which encodes the amino acid sequence <SEQ ID 4688>. Analysis of this protein sequence reveals the following:

```
Possible site: 49
>>> Seems to have no N-terminal signal sequence

----- Final Results -----
            bacterial cytoplasm --- Certainty = 0.4232(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below.

```
Identities = 139/195 (71%), Positives = 165/195 (84%)

Query:   1 MANMYYTENPNVEHDIHELNVKLLGESFSFLTDAGVFSKRMIDYGSQVLLNSLHFEKNKS    60
           M  MYY ENP+  HDIHE+ V+LL    F+FLTD+GVFSK+M+D+GSQVLL  +L+F++N+
Sbjct:  12 MTKMYYDENPDSLHDIHEVKVELLNHPFTFLTDSGVFSKKMVDFGSQVLLKTLNFKENER   71

Query:  61 LLDLGCGYGPLGISLAKVQGVKATMVDINTRALELAKKNATRNGVVVEVFQSNIYENISK  120
           +LDLGCGYGPLGISLAKVQ V AT+VDIN RAL+LA+KNAT N V V +FQSNIYENIS
Sbjct:  72 VLDLGCGYGPLGISLAKVQRVDATLVDINNRALDLARKNATNNQVAVTIFQSNIYENISG  131

Query: 121 TFDYIISNPPIRAGKQVVHSIIEESICYLNTGGSLTIVIQKKQGAPSAKAKMLDTFGNCD  180
              F++IISNPPIRAGK+VVHSIIE+SI +L   G LTIVIQKKQGAPSAKAKM   FGN +
Sbjct: 132 HFEHIISNPPIRAGKRVVHSIIEKSIDFLVVNGDLTIVIQKKQGAPSAKAKMATIFGNVE  191

Query: 181 ILKKDKGYYILRSEK                                               195
           IL+KDKGYY+LRS K
Sbjct: 192 ILRKDKGYYVLRSIK                                               206
```

Based on this analysis, it was predicted that these proteins and their epitopes could be useful antigens for vaccines or diagnostics.

EXAMPLE 1524

A DNA sequence (GBSx1615) was identified in *S. agalactiae* <SEQ ID 4689> which encodes the amino acid sequence <SEQ ID 4690>. This protein is predicted to be pantothenate kinase (coaA). Analysis of this protein sequence reveals the following:

```
Possible site: 28
>>> Seems to have no N-terminal signal sequence

----- Final Results -----
            bacterial cytoplasm --- Certainty = 0.5021(Affirmative) < succ>
             bacterial membrane --- Certainty = 0.0000(Not Clear)   < succ>
              bacterial outside --- Certainty = 0.0000(Not Clear)   < succ>
```

The protein has homology with the following sequences in the GENPEPT database.

```
>GP: BAB06594 GB: AP001516 pantothenate kinase [Bacillus halodurans]
Identities = 140/307 (45%), Positives = 203/307 (65%), Gaps = 5/307 (1%)

Query:   4 EFINFDRISRENWKDLHQQSQALLTEKELESIKSLNDNINIQDVIDIYLPLINLIQIYKR   63
           +F +  +SR  WK L + S   + E+ELE +  LN+ I + +V DIY+PL  L+ ++
Sbjct:   8 DFFPYTVLSRSQWKSLRKASSLPINEQELEQLVGLNEPITLNEVADIYVPLAELLHVAT   67

Query:  64 SQENLSFSKAIFLKKENYQRPFIIGISGSVAVGKSTTSRLLQLLISRTFKDSHVELVTTD  123
           + + L   K F      + PFIIG++GSVAVGKSTT+RLLQ L+     +  HV+LVTTD
Sbjct:  68 AYQRLQQQKRGFFHHGKNRSPFIIGLAGSVAVGKSTTARLLQKLLKAWPEHHHVDLVTTD  127

Query: 124 GFLYPNEKLIQNGILNRKGFPESYDMESLLNFLDTIKNGIT-AKIPIYSHEIYDIVPNQL  182
           GFLYPNE L    G++++KGFPESYD+ +L+ FL  +K G    K P+YSH  Y+IV
Sbjct: 128 GFLYPNETLEARGLMDKKGFPESYDLPALIRFLSDVKAGEPYVKAPVYSHLTYNIVEGDY  187

Query: 183 QTIETPDFLILEGINVFQ-NQQNHRL---YMNDYFDFSIYIDAENKQIEEWYLQRFNSLL  238
           Q +  PD +I +EGINV Q N++NH +      +++D+FDFSIY+DA+ +QI +WY++RF  L
Sbjct: 188 QVVHEPDIVIVEGINVLQVNKRNHHIPNVFVSDFFDFSIYVDAKEEQILQWYIERFKLLQ  247
```

```
                          -continued
Query: 239 QLAEADPSNYYHKFTQIPPHKAMELAKDIWKTINLVNLEKYIEPTRNRADFIIHKGKHHK  298
           A  DP++Y+H+F  +    +A + A   IWK IN VNL +  I PT++RAD ++ KG HH
Sbjct: 248 NTAFQDPNSYFHRFRHLSEVEAEQFATSIWKNINGVNLHENILPTKHRADLVLQKGPHHF  307

Query: 299 IDEIYLK                                                      305
           IDE+ L+
Sbjct: 308 IDEVKLR                                                      314
```

A related DNA sequence was identified in *S. pyogenes* <SEQ ID 4691> which encodes the amino acid sequence <SEQ ID 4692>. Analysis of this protein sequence reveals the following:

```
Possible site: 28
>>> Seems to have no N-terminal signal sequence

----- Final Results -----
           bacterial cytoplasm --- Certainty = 0.4790(Affirmative) < succ>
           bacterial membrane  --- Certainty = 0.0000(Not Clear)   < succ>
             bacterial outside --- Certainty = 0.0000(Not Clear)   < succ>
```

An alignment of the GAS and GBS proteins is shown below.

```
Identities = 219/306 (71%), Positives = 269/306 (87%)

Query:   1 MNNEFINFDRISRENWKDLHQQSQALLTEKELESIKSLNDNINIQDVIDIYLPLINLIQI   60
           M+NEFINF++ISRE+WK LHQ+++ALLT++EL+SI SLNDNI+I DVIDIYLPLINLIQ+
Sbjct:   1 MSNEFINFEKISRESWKTLHQKAKALLTQEELKSITSLNDNISINDVIDIYLPLINLIQV   60

Query:  61 YKRSQENLSFSKAIFLKKENYQRPFIIGISGSVAVGKSTTSRLLQLLISRTFKDSHVELV  120
           YK +QENLSFSK++FLKK+   RPFIIGISGSVAVGKSTTSRLLQLL+SRT  +S VELV
Sbjct:  61 YKIAQENLSFSKSLFLKKDIQLRPFIIGISGSVAVGKSTTSRLLQLLLSRTHPNSQVELV  120

Query: 121 TTDGFLYPNEKLIQNGILNRKGFPESYDMESLLNFLDTIKNGITAKIPIYSHEIYDIVPN  180
           TTDGFLYPN+ LI+ G+LNRKGFPESY+ME LL+FLD+IKNG TA  P+YSH+IYDI+PN
Sbjct: 121 TTDGFLYPNQFLIEQGLLNRKGFPESYNMELLLDFLDSIKNGQTAFAPVYSHDIYDIIPN  180

Query: 181 QLQTIETPDFLILEGINVFQNQQNHRLYMNDYFDFSIYIDAENKQIEEWYLQRFNSLLQL  240
           Q Q+    PDFLI+EGINVFQNQQN+RLYM+DYFDFSIYIDA++  IE WY++RF S+L+L
Sbjct: 181 QKQSFNNPDFLIVEGINVFQNQQNNRLYMSDYFDFSIYIDADSSHIETWYIERFLSILKL  240

Query: 241 AEADPSNYYHKFTQIPPHKAMELAKDIWKTINLVNLEKYIEPTRNRADFIIHKGKHHKID  300
           A+  DP NYY ++ Q+P  +A+  A+++WKT+NL NLEK+IEPTRNRA+ I+HK   HKID
Sbjct: 241 AKRDPHNYYAQYAQLPRSEAIAFARNVWKTVNLENLEKFIEPTRNRAELILHKSADHKID  300

Query: 301 EIYLKK                                                       306
           EIYLKK
Sbjct: 301 EIYLKK                                                       306
```

Based on this analysis, it was predicted that these proteins and their epitopes could be useful antigens for vaccines or diagnostics.

EXAMPLE 1525

A DNA sequence (GBSx1616) was identified in *S. agalactiae* <SEQ ID 4693> which encodes the amino acid sequence <SEQ ID 4694>. Analysis of this protein sequence reveals the following:

```
Possible site: 59
>>> Seems to have no N-terminal signal sequence

----- Final Results -----
           bacterial cytoplasm --- Certainty = 0.3866(Affirmative) < succ>
           bacterial membrane  --- Certainty = 0.0000(Not Clear)   < succ>
             bacterial outside --- Certainty = 0.0000(Not Clear)   < succ>
```

The protein has homology with the following sequences in the GENPEPT database.

```
>GP: BAB05058 GB: AP001511 ribosomal protein S20 (BS20)
[Bacillus halodurans]
Identities = 47/86 (54%), Positives = 59/86 (67%), Gaps = 7/86 (8%)

Query:   3 VKTLANIKSAIKRAELNVKQNEKNSAQKSAMRTAIKAFEA---NPSEELYRA----ASSS   55
           +K  ANIKSAIKR + N K+  +N++ KSA+RTAIK FEA    N   E  +A    A+
Sbjct:   1 MKGNANIKSAIKRVKTNEKRRIQNASVKSALRTAIKQFEAKVENNDAEAAKAAFVEATKK  60

Query:  56 IDKAASKGLIHTNKASRDKARLATKL                                    81
           +DKAA+KGLIH N ASR K+RLA KL
Sbjct:  61 LDKAANKGLIHKNAASRQKSRLAKKL                                    86
```

A related DNA sequence was identified in *S. pyogenes* <SEQ ID 4695> which encodes the amino acid sequence <SEQ ID 4696>. Analysis of this protein sequence reveals the following:

```
Possible site: 59
>>> Seems to have no N-terminal signal sequence

----- Final Results -----
           bacterial cytoplasm --- Certainty = 0.3872(Affirmative) < succ>
            bacterial membrane --- Certainty = 0.0000(Not Clear)  < succ>
             bacterial outside --- Certainty = 0.0000(Not Clear)  < succ>
```

An alignment of the GAS and GBS proteins is shown below.

```
Identities = 76/82 (92%), Positives = 78/82 (94%)

Query:   1 MEVKTLANIKSAIKRAELNVKQNEKNSAQKSAMRTAIKAFEANPSEELYRAASSSIDKAA  60
           +EVKTLANIKSAIKRAELNVK NEKNSAQKSAMRTAIKAFEANPSEEL+RAASSSIDKA
Sbjct:   1 LEVKTLANIKSAIKRAELNVKANEKNSAQKSAMRTAIKAFEANPSEELFRAASSSIDKAE  60

Query:  61 SKGLIHTNKASRDKARLATKLG                                        82
           SKGLIH NKASRDKARLA KLG
Sbjct:  61 SKGLIHKNKASRDKARLAAKLG                                        82
```

Based on this analysis, it was predicted that these proteins and their epitopes could be useful antigens for vaccines or diagnostics.

EXAMPLE 1526

A DNA sequence (GBSx1617) was identified in *S. agalactiae* <SEQ ID 4697> which encodes the amino acid sequence <SEQ ID 4698>. Analysis of this protein sequence reveals the following:

```
Possible Site: 48
>>> Seems to have no N-terminal signal sequence
     INTEGRAL     Likelihood = -10.99    Transmembrane    31-47 (25-51)

----- Final Results -----
            bacterial membrane --- Certainty = 0.5394(Affirmative) < succ>
             bacterial outside --- Certainty = 0.0000(Not Clear)  < succ>
           bacterial cytoplasm --- Certainty = 0.0000(Not Clear)  < succ>
```

The protein has homology with the following sequences in the GENPEPT database.

```
>GP: AAC35851 GB: AF086736 amino acid-binding protein Abp
[Streptococcus uberis]
Identities = 169/269 (62%), Positives = 203/269 (74%), Gaps = 2/269 (0%)

Query:  29 KNILLTIIFGLFMIILSACGMSNKEMAGIDNWEHYQKEKKITIGFDNTFVPMGFESRSGD  88
           K ILLT +    + L ACG S+   A  D W+ Y+KEK IT+GFDNTFVPMGF+  SG
Sbjct:   4 KKILLTTLALASTLFLVACGKSSA--AKTDQWDTYKKEKSITLGFDNTFVPMGFKDESGK  61
```

-continued

```
Query:  89 YTGFDIDLANAVFKEYGISVKWQPINWDMKETELNNGNIDLIWNGYSKTAERAKKVAFTN  148
           TGFD++LA AVF+EYGI VK+QPINWD +KETEL NG ID+IWNGYS T ER   KVAF+
Sbjct:  62 NTGFDVELAKAVFQEYGIKVKFQPINWDLKETELKNGKIDMIWNGYSVTKERQAKVAFST  121

Query: 149 PYMNNHQVIVTKTSSHINSIKDMKGKKLGAQSGSSGFDAFNAKPDILKKFVKGKEAVQYD  208
           PYM N QV+VTK SS+I S   MKGK LGAQSGSSG+DAF + P  +LK  VK   +A QY+
Sbjct: 122 PYMKNEQVLVTKKSSNITSFAAMKGKVLGAQSGSSGYDAFTSNPKVLKDIVKDNDATQYE  181

Query: 209 TFTQALIDLKNNRIDGLLIDEVYANYYLKQEGNIKAYYFVKTAYQGENFVVGARKVDRRL  268
           TF QA IDLKN+RIDGLLID+VYANYYLKQEG +   Y  VK+ + GE+F VG RK D+ L
Sbjct: 182 TFIQAFIDLKNDRIDGLLIDKVYANYYLKQEGELTNYNIVKSEFDGEDFAVGVRKEDKIL  241

Query: 269 IEKINKAFKQLHNKGRFQKISYKWFGEDV                                297
           ++ IN AF +L+   G+FQ+IS KWFGEDV
Sbjct: 242 LKNINSAFTKLYKTGKFQEISQKWFGEDV                                270
```

A related DNA sequence was identified in *S. pyogenes*[15] <SEQ ID 4699> which encodes the amino acid sequence <SEQ ID 4700>. Analysis of this protein sequence reveals the following:

```
Possible site: 21
>>> May be a lipoprotein

----- Final Results -----
            bacterial membrane --- Certainty = 0.0000(Not Clear) < succ>
             bacterial outside --- Certainty = 0.0000(Not Clear) < succ>
           bacterial cytoplasm --- Certainty = 0.0000(Not Clear) < succ>
```

The protein has homology with the following sequences in the databases:

```
>GP: AAC35851 GB: AF086736 amino acid-binding protein Abp
[Streptococcus uberis]
Identities = 176/277 (63%), Positives = 220/277 (78%), Gaps = 1/277 (0%)

Query:   1 MIIKKRTVAILAIASSFFLVACQATKSLKSGDAWGVYQKQKSITVGFDNTFVPMGYKDES   60
           M +KK +   LA+AS+ FLVAC   + K+ D W  Y+K+KSIT+GFDNTFVPMG+KDES
Sbjct:   1 MNLKKILLTTLALASTLFLVACGKSSAAKT-DQWDTYKKEKSITLGFDNTFVPMGFKDES   59

Query:  61 GRCKGFDIDLAKEVFHQYGLKVNFQAINWDMKEAELNNGKIDVIWNGYSITKERQDKVAF  120
           G+   GFD++LAK VF +YG+KV FQ INWD+KE EL NGKID+IWNGYS+TKERQ KVAF
Sbjct:  60 GKNTGFDVELAKAVFQEYGIKVKFQPINWDLKETELKNGKIDMIWNGYSVTRERQAKVAF  119

Query: 121 TDSYMRNEQIIVVKKRSDIKTISDMKHKVLGAQSASSGYDSLLRTPKLLKDFIKNKDANQ  180
             + YM+NEQ++V KK S+I + + MK KVLGAQS SSGYD+     PK+LKD +K+ DA Q
Sbjct: 120 STPYMKNEQVLVTKKSSNITSFAAMKGKVLGAQSGSSGYDAFTSNPKVLKDIVKDNDATQ  179

Query: 181 YETFTQAFIDLKSDRIDGILIDKVYANYYLAKEGQLENYRMIPTTFENEAFSVGLRKEDK  240
           YETF QAFIDLK+DRIDG+LIDKVYANYYL +EG+L NY ++ + F+ E F+VG+RKEDK
Sbjct: 180 YETFIQAFIDLKNDRIDGLLIDKVYANYYLKQEGELTNYNIVKSEFDGEDFAVGVRKEDK  239

Query: 241 TLQAKINRAFRVLYQNGKFQAISEKWFGDDVATANIK                         277
            L   IN AF  LY+ GKFQ IS+KWFG+DVAT N+K
Sbjct: 240 ILLKNINSAFTKLYKTGKFQEISQKWFGEDVATENVK                         276
```

An alignment of the GAS and GBS proteins is shown below.

```
Identities = 151/266 (56%), Positives = 189/266 (70%), Gaps = 4/266 (1%)

Query:  32 LLTIIFGLFMIILSACGMSNKEMAGIDNWEHYQKEKKITIGFDNTFVPMGFESRSGDYTG   91
           +L I   F++   AC   + K +   D W  YQK+K IT+GFDNTFVPMG++  SG    G
Sbjct:  10 ILAIASSFFLV---AC-QATKSLKSGDAWGVYQKQKSITVGFDNTFVPMGYKDESGRCKG   65

Query:  92 FDIDLANAVFKEYGISVKWQPINWDMKETELNNGNIDLIWNGYSKTAERAKKVAFTNPYM  151
           FDIDLA  VF +YG+ V +Q INWDMKE ELNNG ID+IWNGYS T ER  KVAFT+ YM
Sbjct:  66 FDIDLAKEVFHQYGLKVNFQAINWDMKEAELNNGKIDVIWNGYSITKERQDKVAFTDSYM  125

Query: 152 NNHQVIVTKTSSHINSIKDMKGKKLGAQSGSSGFDAFNAKPDILKKFVKGKEAVQYDTFT  211
            N+Q+IV K  S +I +I DMK K LGAQS SSG+D+    P +LK F+K K+A QY+TFT
Sbjct: 126 RNEQIIVVKKRSDIKTISDMKHKVLGAQSASSGYDSLLRTPKLLKDFIKNKDANQYETFT  185
```

```
-continued
Query:  212 QALIDLKNNRIDGLLIDEVYANYYLKQEGNIKAYYFVKTAYQGENFVVGARKVDRRLIEK  271
            QA IDLK++RIDG+LID+VYANYYL +EG ++ Y   + T ++ E F VG RK D+ L  K
Sbjct:  186 QAFIDLKSDRIDGILIDKVYANYYLAKEGQLENYRMIPTTFENEAFSVGLRKEDKTLQAK  245

Query:  272 INKAFKQLHNKGRFQKISYKWFGEDV                                   297
            IN+AF+ L+  G+FQ IS KWFG+DV
Sbjct:  246 INRAFRVLYQNGKFQAISEKWFGDDV                                   271
```

A related GBS gene <SEQ ID 8833> and protein <SEQ ID 8834> were also identified. Analysis of this protein sequence reveals the following:

```
Lipop Possible site: 22 Crend: 4
     Sequence Pattern: CGMS
SRCFLG: 0
McG: Length of UR: 22
     Peak Value of UR: 3.05
     Net Charge of CR: 2
McG: Discrim Score: 11.16
GvH: Signal Score (-7.5): -1.96
     Possible site: 24
>>> May be a lipoprotein
Amino Acid Composition: calculated from 23
ALOM program count: 0 value: 8.96 threshold: 0.0
   PERIPHERAL Likelihood = 8.96 68
modified ALOM score: -2.29
*** Reasoning Step: 3

----- Final Results -----
               bacterial membrane --- Certainty = 0.0000(Not Clear) < succ>
               bacterial outside  --- Certainty = 0.0000(Not Clear) < succ>
               bacterial cytoplasm --- Certainty = 0.0000(Not Clear) < succ>
```

The protein has homology with the following sequences in the databases:

```
62.2/75.8% over 270aa
Streptococcus uberis
GP|3603430|amino acid-binding protein Abp Insert characterized
ORF00904(385-1203 of 1503)
GP|3603430|gb|AAC3581.1||AF086736(4-274 of 277)amino acid-binding protein Abp
{Streptococcus uberis}
% Match = 34.8
% Identity = 62.1    % Similarity = 75.7
Matches = 169    Mismatches = 65    Conservative Sub.s = 37
153         183         213         243         273         303         333         363
PHYLGGKSNVSH*LVR**LIHRLLVMMSQLALLIQSCVKK*KN*FYKIEKQV*HKL**HMIFNLLKVYLIRFSKLILSRL
393         423         453         483         513         543         573         603
GGRLLTHKNILLTIIFGLFMIILSACGMSNKEMAGIDNWEHYQKEKKITIGFDNTFVPMGFESRSGDYTGFDIDLANAVF
            :  | ||| :       :  | ||| |:    |    |: :||| ||:||||||||||:  ||   |||::|| |||
            MNLKKILLTTLALASTLFLVACGKSS--AAKTDQWDTYKKEKSITLGFDNTFVPMGFKDESGKNTGFDVELAKAVF
            10          20          30          40          50          60          70
633         663         693         723         753         783         813         843
KEYGISVKWQPINWDMKETELNNGNIDLIWNGYSKTAERAKKVAFTNPYMNNHQVIVTKTSSHINSIKDMKGKKLGAQSG
:|||| ||:|||||||:||||| |||:|||||| ||   |||||:||| |   ||||  ||| |   || |:||||||
QEYGIKVKFQPINWDLKETELKNGKIDMIWNGYSVTKERQAKVAFSTPYMKNEQVLVTKKSSNITSFAAMKGKVLGAQSG
            90          100         110         120         130         140         150
873         903         933         963         993         1023        1053        1083
SSGFDAFNAKPDILKKFVKGKEAVQYDTFTQALIDLKNNRIDGLLIDEVYANYYLKQEGNIKAYYFVKTAYQGENFVVGA
|||:|||   |  :||  ||    :| ||:|| |||||||||||||:|||||||||:|   ||::  ||:|  |||
SSGYDAFTSNPKVLKDIVKDNDATQYETFIQAFIDLKNDRIDGLLIDKVYANYYLKQEGELTNYNIVKSEDFGEDFAVGV
            170         180         190         200         210         220         230
1113        1143        1173        1203        1233        1263        1293        1323
RKVDRRLIEKINKAFKQLHNKGRFQKISYKWFGEDVYSKE*KTRNFS*SFILRKN*IKNIDISDVF*VN*PSLVARRALS
|| |:|::  || || ||:|  |:||:||  ||||||||  ::
RKEDKILLKNINSAFTKLYKTGKFQEISQKWFGEDVATENVKK
            250         260         270
```

Figure 266:
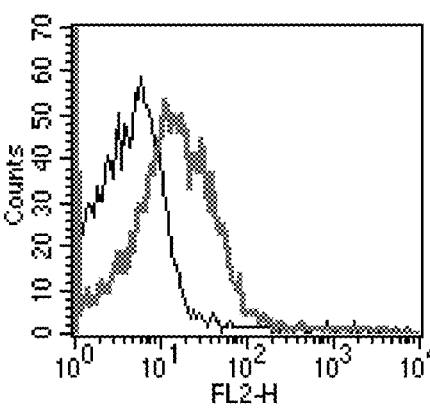

SEQ ID 8834 (GBS225) was expressed in *E. coli* as a His-fusion product. SDS-PAGE analysis of total cell extract is shown in FIG. 49 (lane 10; MW 32 kDa). The GBS225-His fusion product was purified (FIG. 205, lane 7) and used to immunise mice. The resulting antiserum was used for FACS (FIG. 266), which confirmed that the protein is immunoaccessible on GBS bacteria.

Based on this analysis, it was predicted that these proteins and their epitopes could be useful antigens for vaccines or diagnostics.

EXAMPLE 1527

A DNA sequence (GBSx1618) was identified in *S. agalactiae* <SEQ ID 4701> which encodes the amino acid sequence <SEQ ID 4702>. This protein is predicted to be arginine ABC transporter, ATP-binding protein (glnQ). Analysis of this protein sequence reveals the following:

```
Possible site: 39
>>> Seems to have no N-terminal signal sequence

----- Final Results -----
            bacterial cytoplasm --- Certainty = 0.3229(Affirmative) < succ>
              bacterial membrane --- Certainty = 0.0000(Not Clear) < succ>
              bacterial outside --- Certainty = 0.0000(Not Clear) < succ>
```

The protein has homology with the following sequences in the GENPEPT database.

```
>GP: AAB49429 GB: U73111 glutamine transport ATP-binding protein GLNQ
[Salmonella typhimurium]
Identities = 94/210 (44%), Positives = 146/210 (68%), Gaps = 3/210 (1%)

Query:    1 MLELKNISKCYGQKEIFKDFNLTVEEGKILSLVGPSGGGKTTLLRMLAGLEKIDSGTIVH   60
            M+E KN+SK +G   ++ +L + +G+++ ++GPSG GK+TLLR +  LE+I SG ++
Sbjct:    1 MIEFKNVSKHFGPTQVLHNIDLNIRQGEVVVIIGPSGSGKSTLLRCINKLEEITSGDLIV   60

Query:   61 DGKEVS---VDHLETLNLLGFVFQDFQLFPHLTVLDNLILSPVKTMGLSKELAKEKALVL  117
            DG +V+    VD      G VFQ F LFPHLT L+N++  P++  G+ KE A+++A  L
Sbjct:   61 DGLKVNDPKVDERLIRQEAGMVFQQFYLFPHLTALENVMFGPLRVRGVKKEEAEKQAKAL  120

Query:  118 LERLGLKDHALVYPFSLSGGQKQRVALARAMMIDPQIIGYDEPTSALDPELRQEVEKLIL  177
            L ++GL + A  YP  LSGGQ+QRVA+ARA+ + P+++ +DEPTSALDPELR EV K++
Sbjct:  121 LAKVGLAERAHHYPSELSGGQQQRVAIARALAVKPKMMLFDEPTSALDPELRHEVLKVMQ  180

Query:  178 QNRETGMTQIVVTHDLQFAESISDTILKIN                               207
              E GMT ++VTH++ FAE ++  ++ I+
Sbjct:  181 DLAEEGMTMVIVTHEIGFAEKVASRLIFID                               210
```

A related DNA sequence was identified in *S. pyogenes* <SEQ ID 4703> which encodes the amino acid sequence <SEQ ID 4704>. Analysis of this protein sequence reveals the following:

```
Possible site: 39
>>> Seems to have no N-terminal signal sequence

----- Final Results -----
            bacterial cytoplasm --- Certainty = 0.2146(Affirmative) < succ>
              bacterial membrane --- Certainty = 0.0000(Not Clear) < succ>
              bacterial outside --- Certainty = 0.0000(Not Clear) < succ>
```

An alignment of the GAS and GBS proteins is shown below.

```
Identities = 164/209 (78%), Positives = 183/209 (87%)

Query:    1 MLELKNISKCYGQKEIFKDFNLTVEEGKILSLVGPSGGGKTTLLRMLAGLEKIDSGTIVH   60
            MLELKNISK +GQK IF  FNLTV++G++LSLVGPS GGKTTLLRMLAGLE IDSG + +
Sbjct:    1 MLELKNISKQFGQKTIFDGFNLTVQDGEVLSLVGPSSGGKTTLLRMLAGLESIDSGQVFY   60

Query:   61 DGKEVSVDHLETLNLLGFVFQDFQLFPHLTVLDNLILSPVKTMGLSKELAKEKALVLLER  120
            +G++V +DHLE  NLLGFVFQDFQLFPHLTVLDNL LSP  TMG K  AKEKAL LL R
Sbjct:   61 NGEDVGIDHLENRNLLGFVFQDFQLFPHLTVLDNLTLSPTITMGKQKADAKEKALDLLAR  120

Query:  121 LGLKDHALVYPFSLSGGQKQRVALARAMMIDPQIIGYDEPTSALDPELRQEVEKLILQNR  180
            LGLK+HA VYP+SLSGGQKQRVALARAMMIDPQIIGYDEPTSALDPELRQ VE LI+QNR
Sbjct:  121 LGLKEHAQVYPYSLSGGQKQRVALARAMMIDPQIIGYDEPTSALDPELRQTVEALIVQNR  180

Query:  181 ETGMTQIVVTHDLQFAESISDTILKINPK                                209
            E G+TQIVVTHDL FAE+ISD I+++NPK
Sbjct:  181 EMGITQIVVTHDLVFAEAISDRIIRVNPK                                209
```

Based on this analysis, it was predicted that these proteins and their epitopes could be useful antigens for vaccines or diagnostics.

EXAMPLE 1528

A DNA sequence (GBSx1619) was identified in *S. agalactiae* <SEQ ID 4705> which encodes the amino acid sequence <SEQ ID 4706>. This protein is predicted to be amino acid ABC transporter, permease protein (glnP). Analysis of this protein sequence reveals the following:

```
Possible site: 16
>>> Seems to have a cleavable N-term signal seq.
     INTEGRAL    Likelihood = -8.12    Transmembrane    102-118 (96-120)

----- Final Results -----
                bacterial membrane --- Certainty = 0.4248(Affirmative) < succ>
                 bacterial outside --- Certainty = 0.0000(Not Clear)   < succ>
                bacterial cytoplasm --- Certainty = 0.0000(Not Clear)   < succ>
```

A related GBS nucleic acid sequence <SEQ ID 9341> which encodes amino acid sequence <SEQ ID 9342> was also identified.

The protein has homology with the following sequences in the GENPEPT database.

```
>GP: BAA98402 GB: AP002545 ABC amino acid transporter permease
[Chlamydophila pneumoniae J138]
Identities = 55/127 (43%), Positives = 83/127 (65%), Gaps = 1/127 (0%)

Query:    3 AAIIAFTMNYAAYFAEIFRGGIESIPKGQYEAAKVLKFSKFQTVWYIVLPQVFKIVLPSV    62
            A IIA +MN AAY AE  RGGI S+  GQ+E+A VL + K+Q   YI+ PQVFK +LPS+
Sbjct:   89 AGIIALSMNSAAYLAENIRGGINSLSIGQWESAMVLGYKKYQIFVYIIYPQVFKNILPSL   148

Query:   63 FNETITLVKDSSLVYILGVGDLLLESKTAANRDATLAPMF-IAGGIYLLLIGLLTILSKQ   121
            NE ++L+K+SS++ ++GV +L    +K    +R+     M+ I  G+Y L+    +S+
Sbjct:  149 TNEFVSLIKESSILMVVGVPELTKVTKDIVSRELNPMEMYLICAGLYFLMTSSFSCISRL   208

Query:  122 VEKRFNY                                                      128
            EKR +Y
Sbjct:  209 SEKRRSY                                                      215
```

A related DNA sequence was identified in *S. pyogenes* <SEQ ID 4707> which encodes the amino acid sequence <SEQ ID 4708>. Analysis of this protein sequence reveals the following:

```
Possible site: 34
>>> Seems to have no N-terminal signal sequence
     INTEGRAL    Likelihood = -11.57    Transmembrane    21-37   (7-44)
     INTEGRAL    Likelihood = -10.93    Transmembrane    185-201 (178-206)
     INTEGRAL    Likelihood = -3.29     Transmembrane    63-79   (62-81)

----- Final Results -----
                bacterial membrane --- Certainty = 0.5628(Affirmative) < succ>
                 bacterial outside --- Certainty = 0.0000(Not Clear)   < succ>
                bacterial cytoplasm --- Certainty = 0.0000(Not Clear)   < succ>
```

The protein has homology with the following sequences in the databases:

```
>GP: BAB05181 GB: AP001512 ABC transporter (permease) [Bacillus halodurans]
Identities = 86/206 (41%), Positives = 126/206 (60%), Gaps = 1/206 (0%)

Query:    4 IQQVLPSLLDGALVTLQVFFIVIILSIPLGAILAFLMKIPFKPLQWFLTLYVWMMRGTPL    63
            IQ  +P +L+G  VTLQ  + ++  + LG +LA       ++WF    Y  + RGTPL
Sbjct:    8 IQPFMPFMLEGVWVTLQFVSVSLLFGLVLGIVLAIFKISKYRLFRWFADFYTSIFRGTPL    67

Query:   64 LLQLIFFYYVLPSVGISFDRMPAAILAFTLNYAAYFAEIFRGGIEAIPKGQYEAAKVLKL   123
            +LQL+  Y  LP G+     +   AA LAF LN AAY +EI R GI+A+ KGQ EAA+ L +
Sbjct:   68 ILQLLMIYLALPQFGVDISQFQAAFLAFGLNSAAYVSEIIRAGIQAVDKGQREAAEALGI   127

Query:  124 KPLQTIRYIILPQVFKIVLPSVFNEVINLVKDSSLVYVLGVGDLL-LASKTAANRDATLA   182
              + IILPQ  +LP++FNE INL K+S++V V+GV DL+  A  T+A     L
Sbjct:  128 PYRPMMLRIILPQAMRNILPALFNEFINLTKESAIVSVIGVTDLMRRAQITSAETYLYLE   187
```

-continued

```
Query: 183 PMFIAGLIYLLLIGLVTIISKQVEKR                         208
            P+   GLIY +L+  +T+I + +E+R
Sbjct: 188 PLLFVGLIYYVLVMGLTVIGRLLERR                         213
```

An alignment of the GAS and GBS proteins is shown below.

```
Identities = 112/130 (86%), Positives = 121/130 (92%)

Query:   1 MPAAIIAFTMNYAAYFAEIFRGGIESIPKGQYEAAKVLKFSKFQTVWYIVLPQVFKIVLP   60
           MPAAI+AFT+NYAAYFAEIFRGGIE+IPKGQYEAAKVLK   QT+ YI+LPQVFKIVLP
Sbjct:  84 MPAAILAFTLNYAAYFAEIFRGGIEAIPKGQYEAAKVLKLKPLQTIRYIILPQVFKIVLP  143

Query:  61 SVFNETITLVKDSSLVYILGVGDLLLESKTAANRDATLAPMFIAGGIYLLLIGLLTILSK  120
           SVFNE I LVKDSSLVY+LGVGDLLL SKTAANRDATLAPMFIAG IYLLLIGL+TI+SK
Sbjct: 144 SVFNEVINLVKDSSLVYVLGVGDLLLASKTAANRDATLAPMFIAGLIYLLLIGLVTIISK  203

Query: 121 QVEKRFNYYK                                                  130
           QVEKRFNYY+
Sbjct: 204 QVEKRFNYYQ                                                  213
```

Based on this analysis, it was predicted that these proteins and their epitopes could be useful antigens for vaccines or diagnostics.

EXAMPLE 1529

A DNA sequence (GBSx1620) was identified in *S. agalactiae* <SEQ ID 4709> which encodes the amino acid sequence <SEQ ID 4710>. This protein is predicted to be minidiscs. Analysis of this protein sequence reveals the following:

```
Possible site: 61
>>> Seems to have an uncleavable N-term signal seq
     INTEGRAL     Likelihood = -9.66     Transmembrane      44-60   (39-66)
     INTEGRAL     Likelihood = -7.96     Transmembrane     129-145 (123-147)
     INTEGRAL     Likelihood = -5.15     Transmembrane      13-29   (9-33)
     INTEGRAL     Likelihood = -2.39     Transmembrane      94-110  (94-110)

----- Final Results -----
              bacterial membrane --- Certainty = 0.4864(Affirmative) < succ>
              bacterial outside  --- Certainty = 0.0000(Not Clear)   < succ>
              bacterial cytoplasm --- Certainty = 0.0000(Not Clear)  < succ>
```

The protein has homology with the following sequences in the GENPEPT database.

```
>GP: AAF49688 GB: AE003532 mnd gene product [Drosophila melanogaster]
Identities = 48/145 (33%), Positives = 78/145 (53%), Gaps = 8/145 (5%)

Query:   7 IKQTYGLMTTIAMIVGVVIGSGIYFKVDDILKFTGGDVFLGMVILVLGSFSIVFGSLSIS   66
           +K+  GL+  +A+IVGV++GSGI+    +LKF+ G +  +++ VL    + G+L  +
Sbjct:  39 LKKQIGLLDGVAIIVGVIVGSGIFVSPKGVLKFS-GSIGQSLIVWVLSGVLSMVGALCYA   97

Query:  67 ELAIRTSESGGIFSYYEKYVSPALAATLGLFASFLYL-PTLTAIVSWVAAFYTLGE----  121
           EL    +SGG ++Y     P L A L++ + L L PT  AI +   A Y L
Sbjct:  98 ELGTMIPKSGGDYAYIGTAFGP-LPAFLYLWVALLILVPTGNAITALTFAIYLLKPFWPS  156

Query: 122 -SSSLESQIILAAVYILALSLMNIF                                   145
            + +E+  +LAA  I  L+L+N +
Sbjct: 157 CDAPIEAVQLLAAAMICVLTLINCY                                   181
```

No corresponding DNA sequence was identified in S. pyogenes.

Based on this analysis, it was predicted that this protein and its epitopes, could be useful antigens for vaccines or diagnostics.

EXAMPLE 1530

A DNA sequence (GBSx1621) was identified in S. agalactiae <SEQ ID 4711> which encodes the amino acid sequence <SEQ ID 4712>. Analysis of this protein sequence reveals the following:

```
Possible site: 21
>>> Seems to have an uncleavable N-term signal seq

----- Final Results -----
            bacterial membrane --- Certainty = 0.0000(Not Clear) < succ>
            bacterial outside  --- Certainty = 0.0000(Not Clear) < succ>
            bacterial cytoplasm --- Certainty = 0.0000(Not Clear) < succ>
```

The protein has no significant homology with any sequences in the GENPEPT database.

No corresponding DNA sequence was identified in S. pyogenes.

Based on this analysis, it was predicted that this protein and its epitopes, could be useful antigens for vaccines or diagnostics.

EXAMPLE 1531

A DNA sequence (GBSx1622) was identified in S. agalactiae <SEQ ID 4713> which encodes the amino acid sequence <SEQ ID 4714>. This protein is predicted to be TRK potassium uptake system protein. Analysis of this protein sequence reveals the following:

```
Possible site: 27
>>> Seems to have no N-terminal signal sequence
      INTEGRAL     Likelihood = -0.06    Transmembrane    232-248 (232-248)

----- Final Results -----
            bacterial membrane --- Certainty = 0.1022(Affirmative) < succ>
            bacterial outside  --- Certainty = 0.0000(Not Clear)   < succ>
            bacterial cytoplasm --- Certainty = 0.0000(Not Clear)  < succ>
```

A related GBS nucleic acid sequence <SEQ ID 8835> which encodes amino acid sequence <SEQ ID 8836> was also identified. Analysis of this protein sequence reveals the following:

```
Lipop: Possible site: -1 Crend: 5
McG: Discrim Score: -4.65
GvH: Signal Score (-7.5): -3.64
      Possible site: 27
>>> Seems to have no N-terminal signal sequence
ALOM program count: 1 value: -0.06 threshold: 0.0
      INTEGRAL      Likelihood = -0.06    Transmembrane    228-244 (228-244)
      PERIPHERAL    Likelihood = 1.27     428
modified ALOM score: 0.51
*** Reasoning Step: 3

----- Final Results -----
            bacterial membrane --- Certainty = 0.1022(Affirmative) < succ>
            bacterial outside  --- Certainty = 0.0000(Not Clear)   < succ>
            bacterial cytoplasm --- Certainty = 0.0000(Not Clear)  < succ>
```

The protein has homology with the following sequences in the GENPEPT database.

```
>GP: AAB90401 GB: AE001046 TRK potassium uptake system protein
(trkA-2) [Archaeoglobus fulgidus]
Identities = 136/446 (30%), Positives = 238/446 (52%), Gaps = 12/446 (2%)

Query:  5 MRIIVVGGGKVGTALCRSLVAEKHDVVLIEKKENVLKRVTKQHDIMGIVGNGANYKILEQ  64
          MRI++  G G+VG  L  SL A  HDV++IEK  +  +RV++  D++ I GN AN K+L
Sbjct:  1 MRIVIAGAGEVGYHLAMSL-APNHDVIIIEKDVSRFERVSEL-DVVAINGNAANMKVLRD  58
```

```
Query:   65 AEVKNCDIFIAITDRDEVNMISAVLAKKMGAKETVVRMRNPEYSNPYFKDKNFLGFSSVV 124
            A V+  D+F+A+T  DEVN++S + AKK+GAK  +VR+ NPEY +    ++ LG+  ++
Sbjct:   59 AGVERADVFLAVTGNDEVNLLSGLAAKKVGAKNVIVRVENPEYVDRPIVKEHPLGYDVLI 118

Query:  125 NPELLAAQYIANTIEFPNATSVEHFANGRVMLMEFKILEGNKLCHTSMSQIRKKFGNIVI 184
            P+L  AQ  A   I  P A  V  F+ G+V ++E +++EG+K   +++  +    N+VI
Sbjct:  119 CPQLSLAQEAARLIGIPGAIEVVTFSGGKVEMIELQVMEGSKADGKAIADLYLP-QNVVI 177

Query:  185 CAIERDGKLIIPDGDATIQVKDKIFVTGNRIEMILFHNYVKNKVVKNLMVIGAGRIAYYL 244
             +I R+G + IP GD  ++  D++  +     ++ +        V + + + GAG I Y
Sbjct:  178 ASIYRNGHIEIPRGDTVLRAGDRVAIVSKTEDVEMLKGIFGPPVTRRVTIFGAGTIGSYT 237

Query:  245 LNILKNTNTHVKLVELNQEQAEYFSQEFPNVPVVHGDGTAKNILLEESVTSFDAVATLTG 304
              IL      T VKL+E + E+ E   S  E   V +V GD T    L+EE +    DAV     T
Sbjct:  238 AKILAKGMTSVKLIESSMERCEALSGELEGVRIVCGDATDIEFLIEEEIGKSDAVLAATE 297

Query:  305 VDEENIITSMFLESIGIPKNITKVNRTSLLEIIDDKQLSSIITPKRIAVDHVMHFVRGRV 364
            DE+N++ S+  +++G       I KV +    +++ +   +   + P+  +   + V    +R
Sbjct:  298 SDEKNLLISLLSKNLGARIAIAKVEKREYVKLFEAVGVDVALNPRSVTYNEVSKLLR--- 354

Query:  365 NAQDSNLEAMHHIANDRIETLQFEIKETSKLANRSLASLKLKQNILIAAIIRNNKTIFPT 424
               +E +  I    +  +     ++L  ++L   L L ++ +I AI+R N+ + P
Sbjct:  355 ---TMRIETLAEIEGTAVVEV---VVRNTRLVGKALKDLPLPKDAIIGAIVRGNECLIPR 408

Query:  425 GEDVLTVGDRIVVITLLKNITRTSDM                                   450
            G+  +    DR++V       I +  ++
Sbjct:  409 GDTTIEYEDRLLVFAKWDEIEKIEEI                                   434

Identities = 48/212 (22%), Positives = 99/212 (46%), Gaps = 15/212 (7%)

Query:    3 VKMRIIVVGGGKVGTALCRSLVAEKHDVVLIEKKENVLKRVTKQHDIMGIV-GNGANYKI  61
            V  R+ +  G G +G+   + L       V LIE    + ++ + + +  IV G+  + +
Sbjct:  221 VTRRVTIFGAGTIGSYTAKILAKGMTSVKLIESSMERCEALSGELEGVRIVCGDATDIEF 280

Query:   62 LEQAEVKNCDIFIAITDRDEVNMISAVLAKKMGAKETVVRMRNPEYSNPYFKDKNFLGFS 121
            L + E+    D  +A T+  DE N++  ++L+K +GA+  +  ++     EY   +       +G
Sbjct:  281 LIEEEIGKSDAVLAATESDEKNLLISLLSKNLGARIAIAKVEKREYVKLF----EAVGVD 336

Query:  122 SVVNPELLAAQYIA---NTIEFPNATSVEHFANGRVMLMEFKILEGNKLCHTSMSQIRKK 178
               +NP +   ++  ++     T+       +E  A  V++     +++ G L       +  +
Sbjct:  337 VALNPRSVTYNEVSKLLRTMRIETLAEIEGTAVVEVVVRNTRLV-GKALKDLPLPK---- 391

Query:  179 FGNIVICAIERDGKLIIPDGDATIQVKDKIFV                             210
             + +I AI R   + +IP GD TI+ +D++ V
Sbjct:  392 --DAIIGAIVRGNECLIPRGDTTIEYEDRLLV                             421
```

There is also homology to SEQ ID 4716.

SEQ ID 8836 (GBS384) was expressed in *E. coli* as a His-fusion product. SDS-PAGE analysis of total cell extract is shown in FIG. 69 (lane 2; MW 53 kDa). It was also expressed in *E. coli* as a GST-fusion product. SDS-PAGE analysis of total cell extract is shown in FIG. 72 (lane 6; MW 78 kDa).

Figure 279:
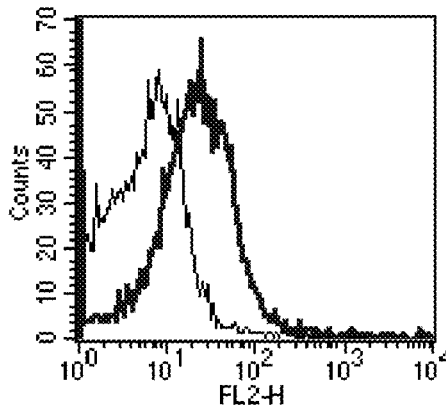

The GBS384-GST fusion product was purified (FIG. 212, lane 9) and used to immunise mice. The resulting antiserum was used for FACS (FIG. 279), which confirmed that the protein is immunoaccessible on GBS bacteria.

Based on this analysis, it was predicted that this protein and its epitopes, could be useful antigens for vaccines or diagnostics.

EXAMPLE 1532

A DNA sequence (GBSx1623) was identified in *S. agalactiae* <SEQ ID 4717> which encodes the amino acid sequence <SEQ ID 4718>. Analysis of this protein sequence reveals the following:

```
Possible site: 52
>>> Seems to have no N-terminal signal sequence

----- Final Results -----
           bacterial cytoplasm --- Certainty = 0.4948(Affirmative) < succ>
           bacterial membrane  --- Certainty = 0.0000(Not Clear)   < succ>
           bacterial outside   --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1533

A DNA sequence (GBSx1624) was identified in *S. agalactiae* <SEQ ID 4719> which encodes the amino acid sequence <SEQ ID 4720>. Analysis of this protein sequence reveals the following:

```
Possible site: 22
>>> Seems to have an uncleavable N-term signal seq
     INTEGRAL    Likelihood = -12.58    Transmembrane    37-53   (33-61)
     INTEGRAL    Likelihood = -11.57    Transmembrane   183-199  (179-214)
     INTEGRAL    Likelihood = -10.03    Transmembrane   397-413  (392-424)
     INTEGRAL    Likelihood =  -6.79    Transmembrane    14-30   (5-31)
     INTEGRAL    Likelihood =  -6.42    Transmembrane    71-87   (69-93)
     INTEGRAL    Likelihood =  -4.99    Transmembrane   278-294  (274-295)
     INTEGRAL    Likelihood =  -4.19    Transmembrane   133-149  (132-152)
     INTEGRAL    Likelihood =  -4.09    Transmembrane   327-343  (324-344)
     INTEGRAL    Likelihood =  -2.44    Transmembrane   236-252  (234-252)
     INTEGRAL    Likelihood =  -0.59    Transmembrane   456-472  (456-472)

----- Final Results -----
              bacterial membrane  --- Certainty = 0.6031(Affirmative) < succ>
              bacterial outside   --- Certainty = 0.0000(Not Clear)   < succ>
              bacterial cytoplasm --- Certainty = 0.0000(Not Clear)   < succ>
```

A related GBS nucleic acid sequence <SEQ ID 10065> which encodes amino acid sequence <SEQ ID 10066> was also identified.

The protein has homology with the following sequences in the GENPEPT database.

```
>GP: AAB90400 GB: AE001046 TRK potassium uptake system protein (trkH)
[Archaeoglobus fulgidus]
Identities = 166/480 (34%), Positives = 262/480 (54%), Gaps = 10/480 (2%)

Query:    1 MNKSMIRFLLSKLLLIEAALLAIPLTVGLIYREP-QSVMMSIVITMIILIILGLLGSLFK   59
            MN +  +L KLL++ +    +PL    ++ EP    ++  +++++  +LG  G    +
Sbjct:    1 MNLRLTASILGKLLMLFSFSFILPLIAAHVFEEPYHPFLIPAALSLLVGAVLGY-GIKTE  59

Query:   60 PKNYHIYTKEGMLIVALCWILWSFFGALPFVISGQIPNIIDAFFEVSSGFTTTGATILDD  119
              +  +  KE   IVAL W+  S FG++P++I G  P  +DAFFE  SGFTTTGA++L
Sbjct:   60 SEFDSLRHKESFAIVALIWLFMSIFGSIPYIIFGISP--VDAFFESMSGFTTTGASVLTP 117

Query:  120 VSVLSPALLFWRSFTHLIGGMGVLVFALAIMENSKNSHLEVMRAEVPGPVFGKVVSKLKK  179
                L +LL WRS T  IGGMG++V  LAI  N        + +AE PG    K+  +++
Sbjct:  118 EE-LPKSLLLWRSLTQWIGGMGIIVLFLAIFPNVAKRSTVLFQAEYPGVSLSKLKPRIRD 176

Query:  180 TAQILYLLYLLMFAVFAVILYFAGMPFFDSIIIAMGTAGTGGFAVYNDSIAHYNSPLITN  239
            TA   LY +YLL+       +LY  G+  FD+I    T  TGG++ +++SIA +     +
Sbjct:  177 TALSLYKVYLLLTIAEVALLYALGLSLFDAINHTFTTLSTGGYSTHSESIAFFKDVRVEA 236

Query:  240 LVSIGMLIFGVNFNLYYLLLLRKIKAFFGDEELKTYLRIVAIATFMIALNVIGMYDNFRQ  299
              +V+    + G NF L Y LL  K    F + E + Y+  +A+A+  +IA    Y F +
Sbjct:  237 VVAFFAFLGGANFALIYFLLSGK-PVIFRNTEFRAYVCFLALASVVIAAVNLDRYSIF-E 294

Query:  300 GLEHIFFEVSAIITTTGFGVTDITRWPLFSQVILLFLMFIGGSAGSTAGGFKVMRSLILA  359
              L +  F+  +I+TTTGF    D  W    +++IL+ LMFIGGS+GST GG KV+R  +L
Sbjct:  295 SLRYSIFQAVSIMTTTGFTTADFDAWSDSAKLILVVLMFIGGSSGSTGGGIKVIRIYLLI 354

Query:  360 KIARNQVLSTLYPNRVMSLHINKSVLDKNTQHGVLKYLTIYLAIFMALVLVLTLDTNDFL  419
            K A +Q+L     P V ++     + K     + +  +Y+ IF    ++++L  D +
Sbjct:  355 KYAVHQILRAAEPRTVRAVKFEGRAIKKEILDDIAAFFVLYILIFAVSSILVSLSGYDIV 414

Query:  420 VVISAAASCFNNIGP---LLGSNETFSFFSPFSKLLLSFAMIAGRLEIYPVLLMFIPKTW  476
             ISA A+   N+GP   L G+ E ++ F   +K+LL+  M  GRLEI+ V+ +FIP  W
Sbjct:  415 TSISATAATLGNVGPGLGLAGAAENYASFPSLTKILLAVNMWIGRLEIFTVVSLFIPTFW 474
```

No corresponding DNA sequence was identified in *S. pyogenes*.

Based on this analysis, it was predicted that this protein and its epitopes, could be useful antigens for vaccines or diagnostics.

EXAMPLE 1534

A DNA sequence (GBSx1625) was identified in *S. agalactiae* <SEQ ID 4721> which encodes the amino acid sequence <SEQ ID 4722>. Analysis of this protein sequence reveals the following:

```
Possible site: 22
>>> Seems to have no N-terminal signal sequence (or aa 1-20)

----- Final Results -----
             bacterial cytoplasm --- Certainty = 0.2870(Affirmative) < succ>
             bacterial membrane  --- Certainty = 0.0000(Not Clear)   < succ>
              bacterial outside  --- Certainty = 0.0000(Not Clear)   < succ>
```

The protein has homology with the following sequences in the GENPEPT database.

```
>GP: AAD36530 GB: AE001797 conserved hypothetical protein
[Thermotoga maritima]
Identities = 43/75 (57%), Positives = 57/75 (75%), Gaps = 1/75 (1%)

Query:   2 LKSFLIFLVRFYQKNISPAFPASCRYRPTCSTYMIEAIQKHG-LKGVLMGIARILRCHPL   60
           +K  LI L+RFYQ+ ISP  P +CR+ PTCS Y I+A++KHG LKG  +G+ RILRC+PL
Sbjct:   1 MKKLLIMLIRFYQRYISPLKPPTCRFTPTCSNYFIQALEKHGLLKGTFLGLRRILRCNPL   60

Query:  61 AHGGNDPVPDHFSLR                                               75
           + GG DPVP+ FS +
Sbjct:  61 SKGGYDPVPEEFSFK                                               75
```

A related DNA sequence was identified in *S. pyogenes* <SEQ ID 4723> which encodes the amino acid sequence <SEQ ID 4724>. Analysis of this protein sequence reveals the following:

```
Possible site: 38
>>> Seems to have no N-terminal signal sequence

----- Final Results -----
             bacterial cytoplasm --- Certainty = 0.3639(Affirmative) < succ>
             bacterial membrane  --- Certainty = 0.0000(Not Clear)   < succ>
              bacterial outside  --- Certainty = 0.0000(Not Clear)   < succ>
```

An alignment of the GAS and GBS proteins is shown below.

```
Identities = 53/78 (67%), Positives = 60/78 (75%)

Query:   1 MLKSFLIFLVRFYQKNISPAFPASCRYRPTCSTYMIEAIQKHGLKGVLMGIARILRCHPL   60
           M+K  LI  V+ YQK ISP  P SCRY+PTCS YM+ AI+KHG KG+LMGIARILRCHP
Sbjct:   1 MMKKLLIVSVKAYQKYISPLSPPSCRYKPTCSAYMLTAIEKHGTKGILMGIARILRCHPF   60

Query:  61 AHGGNDPVPDHFSLRRNK                                            78
              GG DPVP+ FSL RNK
Sbjct:  61 VAGGVDPVPEDFSLMRNK                                            78
```

SEQ ID 4722 (GBS233) was expressed in *E. coli* as a GST-fusion product. SDS-PAGE analysis of total cell extract is shown in FIG. 58 (lane 3; MW 35.6 kDa).

Figure 280:
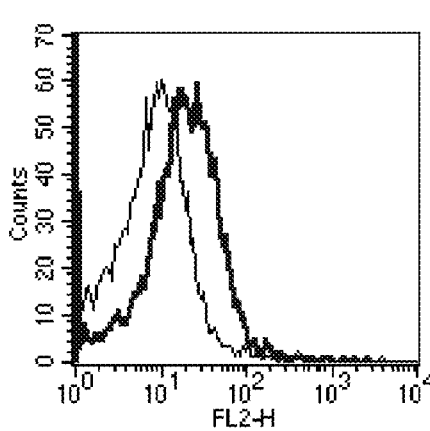

The GBS233-GST fusion product was purified (FIG. 207, lane 10) and used to immunise mice. The resulting antiserum was used for FACS (FIG. 280), which confirmed that the protein is immunoaccessible on GBS bacteria.

Based on this analysis, it was predicted that these proteins and their epitopes could be useful antigens for vaccines or diagnostics.

EXAMPLE 1535

A DNA sequence (GBSx1626) was identified in *S. agalactiae* <SEQ ID 4725> which encodes the amino acid sequence <SEQ ID 4726>. This protein is predicted to be ribosomal large subunit pseudouridine synthase B (rluB). Analysis of this protein sequence reveals the following:

```
Possible site: 18
>>> Seems to have no N-terminal signal sequence

----- Final Results -----
            bacterial cytoplasm --- Certainty = 0.2957(Affirmative) < succ>
              bacterial membrane --- Certainty = 0.0000(Not Clear)  < succ>
               bacterial outside --- Certainty = 0.0000(Not Clear)  < succ>
```

The protein has homology with the following sequences in the GENPEPT database.

```
>GP: BAB05295 GB: AP001512 pseudouridylate synthase [Bacillus halodurans]
Identities = 130/239 (54%), Positives = 175/239 (72%), Gaps = 2/239 (0%)

Query:    2 RINKYIAHAGIASRRKAEELIKQGMVTINGQVVNELATQVKAG-DLVEIEGSPIYNEEKV   60
            R+ K IA AGIASRRKAE+LI +G V +NGQVV EL  +V    D +E+EG P+  EE V
Sbjct:    3 RLQKVIAQAGIASRRKAEQLILEGKVKVNGQVVKELGIKVNPNQDDIEVEGVPVEKEEPV   62

Query:   61 YYLLNKPRGVISSVSDDKGRKTVIDLLPQVKERIYPVGRLDWDTTGLLILTNDGDFTDKM  120
            Y+LL KP GVISSV DDKGRK V D L ++++R+YPVGRLD+DT+GLL+LTNDG+F + +
Sbjct:   63 YFLLYKPTGVISSVKDDKGRKVVTDFL-EIEQRVYPVGRLDYDTSGLLLLTNDGEFANLL  121

Query:  121 IHPRNEIDKVYLARVKGIATKENLRPLTRGVVIDGKKTKPARYTIIKVDHEKNRSVVELT  180
            +HPR++I+KVY+A+VKGI T++ L+ L RGV ++    T PA+  ++ VD  K  ++V+LT
Sbjct:  122 MHPRHKIEKVYVAKVKGIPTRDQLKLLARGVKLEDGPTAPAKVKMLSVDRRKQTAIVKLT  181

Query:  181 IHEGRNHQVKKMFEQVGLLVDKLSRTQFGTLDLTGLRPGEARRLNKKEISQLHNAAINK   239
            IHEGRN QV++MFE +G  V KL R QF  LDL+G+ PG+ R L   E+  L   A+ K
Sbjct:  182 IHEGRNRQVRRMFETIGCEVMKLKREQFAFLDLSGMNPGDVRPLKPIEVKHLRELAVTK   240
```

A related DNA sequence was identified in S. pyogenes <SEQ ID 4727> which encodes the amino acid sequence <SEQ ID 4728>. Analysis of this protein sequence reveals the following:

```
Possible site: 18
>>> Seems to have no N-terminal signal sequence

----- Final Results -----
            bacterial cytoplasm --- Certainty = 0.1587(Affirmative) < succ>
              bacterial membrane --- Certainty = 0.0000(Not Clear)  < succ>
               bacterial outside --- Certainty = 0.0000(Not Clear)  < succ>
```

An alignment of the GAS and GBS proteins is shown below.

```
Identities = 210/239 (87%), Positives = 228/239 (94%)

Query:    1 MRINKYIAHAGIASRRKAEELIKQGMVTINGQVVNELATQVKAGDLVEIEGSPIYNEEKV   60
            MRINKYIAHAGIASRRKAEELIKQG+VT+NGQV+ +LAT VK+GD+VEIEGSPIYNEEKV
Sbjct:    9 MRINKYIAHAGIASRRKAEELIKQGLVTLNGQVITDLATTVKSGDVVEIEGSPIYNEEKV   68

Query:   61 YYLLNKPRGVISSVSDDKGRKTVIDLLPQVKERIYPVGRLDWDTTGLLILTNDGDFTDKM  120
            YYLLNKPRG ISSVSDDKGRKTV+DLLPQVKERIYPVGRLDWDT+G+LILTNDGDFTD M
Sbjct:   69 YYLLNKPRGAISSVSDDKGRKTVLDLLPQVKERIYPVGRLDWDTSGVLILTNDGDFTDTM  128

Query:  121 IHPRNEIDKVYLARVKGIATKENLRPLTRGVVIDGKKTKPARYTIIKVDHEKNRSVVELT  180
            IHPRNEIDKVYLARVKGIATKENLRPLTRG+VIDGKKTKPARY I++V+ +K+RS+VELT
Sbjct:  129 IHPRNEIDKVYLARVKGIATKENLRPLTRGIVIDGKKTKPARYNIVRVEADKSRSIVELT  188

Query:  181 IHEGRNHQVKKMFEQVGLLVDKLSRTQFGTLDLTGLRPGEARRLNKKEISQLHNAAINK   239
            IHEGRNHQVKKMFE VGLLVDKLSRT+FGT+DL GLRPGEARRLNKKEISQLHN A  K
Sbjct:  189 IHEGRNHQVKKMFESVGLLVDKLSRTRFGTVDLKGLRPGEARRLNKKEISQLHNLANTK   247
```

Based on this analysis, it was predicted that these proteins and their epitopes could be useful antigens for vaccines or diagnostics.

EXAMPLE 1536

A DNA sequence (GBSx1627) was identified in *S. agalactiae* <SEQ ID 4729> which encodes the amino acid sequence <SEQ ID 4730>. Analysis of this protein sequence reveals the following:

```
Possible site: 15
>>> Seems to have no N-terminal signal sequence

----- Final Results -----
             bacterial cytoplasm --- Certainty = 0.1476(Affirmative) < succ>
              bacterial membrane --- Certainty = 0.0000(Not Clear)   < succ>
               bacterial outside --- Certainty = 0.0000(Not Clear)   < succ>
```

The protein has homology with the following sequences in the GENPEPT database.

```
>GP: BAB05280 GB: AP001512 unknown conserved protein [Bacillus halodurans]
Identities = 75/180 (41%), Positives = 107/180 (58%), Gaps = 10/180 (5%)

Query:    6 SIEALLFVAGEDGLSLRQMAELLSLTPSALIQQLEKLAKRYEEDDDSSLLLLETAQTYKL   65
            +IE +LFV G++G++L ++ +LL L+    +   LE+L    Y  D+   L + E A  ++L
Sbjct:    9 AIEGILFVRGDEGVTLEELCDLLELSTDVVYAALEELRLSYT-DEARGLRIEEVAHAFRL   67

Query:   66 VTKDSYMTLLRDYAKAPINQSLSRASLEVLSIIAYKQPITRIEIDDIRGVNSSGAITRLI  125
               TK       +   A + +    LS+A+LE L+IIAY+QPITRIE+D++RGV S  AI   L
Sbjct:   68 STKPELAPYFKKLALSTLQSGLSQAALETLAIIAYRQPITRIEVDEVRGVKSEKAIQTLT  127

Query:  126 AFGLIKEAGKKEVLGRPNLYETTNYFLDYMGINQLDDL------IDASSIELVDEEVSLF  179
             +  LIKE G+ +   GRP LY TT  FLD+ G+    L +L         ID SSI      EE    LF
Sbjct:  128 SRLLIKEVGRAQGTGRPILYGTTPQFLDHFGLKSLKELPPLPEDIDESSI---GEEADLF  184
```

A related DNA sequence was identified in *S. pyogenes* <SEQ ID 4731> which encodes the amino acid sequence <SEQ ID 4732>. Analysis of this protein sequence reveals the following:

```
Possible site: 31
>>> Seems to have no N-terminal signal sequence

----- Final Results -----
             bacterial cytoplasm --- Certainty = 0.1062(Affirmative) < succ>
              bacterial membrane --- Certainty = 0.0000(Not Clear)   < succ>
               bacterial outside --- Certainty = 0.0000(Not Clear)   < succ>
```

An alignment of the GAS and GBS proteins is shown below.

```
Identities = 130/179 (72%), Positives = 159/179 (88%)

Query:    1 MTYLGSIEALLFVAGEDGLSLRQMAELLSLTPSALIQQLEKLAKRYEEDDDSSLLLLETA   60
            MTYL  IEALLFVAGE+GLSLR +A +LSLTP+AL QQLEKL+++YE+D  SSL L+ETA
Sbjct:    1 MTYLSQIEALLFVAGEEGLSLRHLASMLSLTPTALQQQLEKLSQKYEKDQHSSLCLIETA   60

Query:   61 QTYKLVTKDSYMTLLRDYAKAPINQSLSRASLEVLSIIAYKQPITRIEIDDIRGVNSSGA  120
             TY+LVTK+ +    LLR YAK P+NQSLSRASLEVLSI+AYKQPITRIEIDDIRGVNSSGA
Sbjct:   61 NTYRLVTKEGFAELLRAYAKTPMNQSLSRASLEVLSIVAYKQPITRIEIDDIRGVNSSGA  120

Query:  121 ITRLIAFGLIKEAGKKEVLGRPNLYETTNYFLDYMGINQLDDLIDASSIELVDEEVSLF   179
              +++L+AF LI+EAGKK+V+GRP+LY TT+YFLDYMGIN LD+LI+ S++E  DEE++LF
Sbjct:  121 LSKLLAFDLIREAGKKDVVGRPHLYATTDYFLDYMGINHLDELIEVSAVEPADEEIALF  179
```

Based on this analysis, it was predicted that these proteins and their epitopes could be useful antigens for vaccines or diagnostics.

EXAMPLE 1537

A DNA sequence (GBSx1628) was identified in *S. agalactiae* <SEQ ID 4733> which encodes the amino acid sequence <SEQ ID 4734>. Analysis of this protein sequence reveals the following:

```
Possible site: 47
>>> Seems to have no N-terminal signal sequence

----- Final Results -----
              bacterial cytoplasm --- Certainty = 0.1012(Affirmative) < succ>
               bacterial membrane --- Certainty = 0.0000(Not Clear)   < succ>
                 bacterial outside --- Certainty = 0.0000(Not Clear)   < succ>
```

The protein has homology with the following sequences in the GENPEPT database.

```
>GP: CAB14254 GB: Z99116 similar to hypothetical proteins [Bacillus
subtilis]
Identities = 89/246 (36%), Positives = 145/246 (58%), Gaps = 19/246 (7%)

Query:   3 IKLKDFEGPLDLLLHLVSKYEVDIYDVPIVEVIEQYLAYIATLQAMRLEVAGEYMLMASQ    62
           +K+  FEGPLDLLLHL+++ E+DIYD+P+ ++ EQYL Y+ T++ + L++A EY++MA+
Sbjct:   6 VKIDTFEGPLDLLLHLINRLEIDIYDIPVAKITEQYLLYVHTMRVLELDIASEYLVMAAT    65

Query:  63 LMLIKSRNLLPK----VVESNPI-EDDPEMELLSQLEEYRRFKVLSEELANQHQERAKYF   117
           L+ IKSR LLPK    + E   + E+DP  EL+ +L EYR++K  +++L + +ER K F
Sbjct:  66 LLSIKSRMLLPKQEEELFEDELLEEEDPREELIEKLIEYRKYKDAAKDLKEREEERQKSF   125

Query: 118 SKPKQEVIFEDAILLHDKSVMDLFLTFSQMMSQKQKELSNS------QTVIEKEDYRIED   171
           +KP  ++    +      +S   L +T   M+   QK L       +T I ++D  IE
Sbjct: 126 TKPPSDL--SEYAKEVKQSEQKLSVTVYDMIGAFQKVLKRKKINRPMETTITRQDIPIEA   183

Query: 172 MMIVIERHFNLKKKTT---LQEVFADCQTKSEMITLFLAMLELIKLHQITVEQDSNFSQV   228
              M  I    +LK+ + T      ++F    + K  ++   FLA+LEL+K    +EQ+ NFS +
Sbjct: 184 RMNEIVH--SLKSRGTRINFMDLF-PYEQKEHLVVTFLAVLELMKNQLVLIEQEHNFSDI   240

Query: 229 ILRKEE                                                        234
           +    E
Sbjct: 241 YITGSE                                                        246
```

A related DNA sequence was identified in *S. pyogenes* <SEQ ID 4735> which encodes the amino acid sequence <SEQ ID 4736>. Analysis of this protein sequence reveals the following:

```
Possible site: 60
>>> Seems to have no N-terminal signal sequence
    INTEGRAL    Likelihood = -3.61    Transmembrane    199-215 (199-218)

----- Final Results -----
              bacterial membrane --- Certainty = 0.2444(Affirmative) < succ>
               bacterial outside --- Certainty = 0.0000(Not Clear)   < succ>
             bacterial cytoplasm --- Certainty = 0.0000(Not Clear)   < succ>
```

The protein has homology with the following sequences in the databases:

```
>GP: CAB14254 GB: Z99116 similar to hypothetical proteins [Bacillus subtilis]
Identities = 86/239 (35%), Positives = 145/239 (59%), Gaps = 15/239 (6%)

Query:   3 IKLKDFEGPLDLLLHLVSQYKVDIYEVPIVEVIEQYLNYIETLQVMKLEVAGDYMLMASQ    62
           +K+  FEGPLDLLLHL+++ ++DIY++P+ ++ EQYL Y+ T++V++L++A +Y++MA+
Sbjct:   6 VKIDTFEGPLDLLLHLINRLEIDIYDIPVAKITEQYLLYVHTMRVLELDIASEYLVMAAT    65

Query:  63 LMLIKSRRLLPKVVEHI-------EEDLEQDLLEKIEEYSRFKAVSQALAKQHDQRAKWY   115
           L+ IKSR LLPK  E +        EED  ++L+EK+ EY ++K  ++ L ++ ++R K +
Sbjct:  66 LLSIKSRMLLPKQEEELFEDELLEEEDPREELIEKLIEYRKYKDAAKDLKEREEERQKSF   125

Query: 116 SKPKQELI-FEDAILQEDK----TVMDLFLAFSNIMAAKRAVLKNNHTVIERDDYKIEDM   170
           +KP +L  + Q ++      TV D+  AF ++    K+ + +      T  I R D   IE
Sbjct: 126 TKPPSDLSEYAKEVKQSEQKLSVTVYDMIGAFQKVLKRKK-INRPMETTITRQDIPIEAR   184

Query: 171 MASIKQRLEKENV-IRLSAIFEECQTLNEVISIFLASLELIKLHVVFVEQLSNFGAIIL    228
              M  I  L+      I    +F  Q  +V++ FLA LEL+K  +V +EQ  NF  I +
Sbjct: 185 MNEIVHSLKSRGTRINFMDLFPYEQKEHLVVT-FLAVLELMKNQLVLIEQEHNFSDIYI   242
```

45

An alignment of the GAS and GBS proteins is shown below.

```
Identities = 156/235 (66%), Positives = 191/235 (80%), Gaps = 2/235 (0%)

Query:    1 MDIKLKDFEGPLDLLLHLVSKYEVDIYDVPIVEVIEQYLAYIATLQAMRLEVAGEYMLMA    60
            MDIKLKDFEGPLDLLLHLVS+Y+VDIY+VPIVEVIEQYL YI TLQ M+LEVAG+YMLMA
Sbjct:    1 MDIKLKDFEGPLDLLLHLVSQYKVDIYEVPIVEVIEQYLNYIETLQVMKLEVAGDYMLMA    60

Query:   61 SQLMLIKSRNLLPKVVESNPIEDDPEMELLSQLEEYRRFKVLSEELANQHQERAKYFSKP   120
            SQLMLIKSR LLPKVVE    IE+D E +LL ++EEY RFK +S+ LA QH +RAK++SKP
Sbjct:   61 SQLMLIKSRRLLPKVVEH--IEEDLEQDLLEKIEEYSRFKAVSQALAKQHDRAKWYSKP   118

Query:  121 KQEVIFEDAILLHDKSVMDLFLTFSQMMSQKQKELSNSQTVIEKEDYRIEDMMIVIERHF   180
            KQE+IFEDAIL  DK+VMDLFL FS +M+ K+  L N+ TVIE++DY+IEDMM  I++
Sbjct:  119 KQELIFEDAILQEDKTVMDLFLAFSNIMAAKRAVLKNNHTVIERDDYKIEDMMASIKQRL   178

Query:  181 NLKKKTTLQEVFADCQTKSEMITLFLAMLELIKLHQITVEQDSNFSQVILRKEEK       235
              +    L  +F +CQT +E+I++FLA LELIKLH + VEQ SNF  +ILRKE+K
Sbjct:  179 EKENVIRLSAIFEECQTLNEVISIFLASLELIKLHVVFVEQLSNFGAIILRKEKK       233
```

Based on this analysis, it was predicted that these proteins and their epitopes could be useful antigens for vaccines or diagnostics.

EXAMPLE 1538

A DNA sequence (GBSx1629) was identified in *S. agalactiae* <SEQ ID 4737> which encodes the amino acid sequence <SEQ ID 4738>. This protein is predicted to be pXO1-18. Analysis of this protein sequence reveals the following:

```
Possible site: 15
>>> Seems to have no N-terminal signal sequence
    INTEGRAL    Likelihood = -4.14    Transmembrane    128-144 (127-145)

----- Final Results -----
              bacterial membrane --- Certainty = 0.2657(Affirmative) < succ>
              bacterial outside  --- Certainty = 0.0000(Not Clear)   < succ>
              bacterial cytoplasm --- Certainty = 0.0000(Not Clear)  < succ>
```

The protein has homology with the following sequences in the GENPEPT database.

```
>GP: BAB05248 GB: AP001512 integrase/recombinase
[Bacillus halodurans]
 Identities = 67/271 (24%), Positives = 117/271 (42%), Gaps = 35/271 (12%)

Query:   11 LKTMINDINNFIESKK----LSLNSRKSYHYDLKQFYKII--------GGHVNSEKLALY    58
            ++T+ N++  F+  +K     LS N+ +SY  DLKQ+ + +         ++ E +  Y
Sbjct:    1 METVNNNLQQFLHFQKVERGLSNNTIQSYGRDLKQYIQYVERVEEIRSARNITRETILHY    60

Query:   59 QQSLSEFKL--TARKRKLSAVNQFLFFLYNRGTLKEFYRL-----QETEKITLAQTKSQI   111
              L E     T+ R ++A+ F  FL           +    + T+++ A T  ++
Sbjct:   61 LYHLREQGRAETSIARAVAAIRSFHQFLLREKLSDSDPTVHVEIPKATKRLPKALTIEEV   120

Query:  112 MDLSNFYQDTDYPSGRLIALLIL--SLGLTPAEIANLKKADFDTTFNILS-IEKSQMKRI   168
               L N Q  D  S R  A+L L   + G+  +E+  L +D     +   + K   +RI
Sbjct:  121 EALLNSPQGRDPFSLRNKAMLELLYATGMRVSELIGLTLSDIHLSMGFVRCLGKGNKERI   180

Query:  169 LKLPEDLLPFLLESLEEDG----------DLVF-EHNGKPYSRQWFFNQLTDFLNEKN-E   216
             + + +    +ES   +G           D VF  H+G+P SRQ F+  L       N +
Sbjct:  181 IPIGQ-VATEAVESYLANGRGKLMKKQSHDHVFVNHHGRPLSRQGFWKMLKQLAKNVNID   239

Query:  217 QQLTAQLLREQFILKQKENGKTMTELSRLLG                              247
            +  LT   LR  F       ENG +  +  +LG
Sbjct:  240 KPLTPHTLRHSFATHLLENGADLRAVQEMLG                              270
```

A related DNA sequence was identified in *S. pyogenes* <SEQ ID 4739> which encodes the amino acid sequence <SEQ ID 4740>. Analysis of this protein sequence reveals the following:

```
Possible site: 20
>>> Seems to have no N-terminal signal sequence
    INTEGRAL    Likelihood = -0.90   Transmembrane   111-127 (110-127)

----- Final Results -----
            bacterial membrane --- Certainty = 0.1362(Affirmative) < succ>
             bacterial outside --- Certainty = 0.0000(Not Clear)   < succ>
           bacterial cytoplasm --- Certainty = 0.0000(Not Clear)   < succ>
```

The protein has no significant homology with any sequences in the GENPEPT database.

An alignment of the GAS and GBS proteins is shown below.

```
Identities = 117/243 (48%), Positives = 167/243 (68%), Gaps = 1/243 (0%)

Query:   18 INNFIESKKLSLNSRKSYHYDLKQFYRIIGGHVNSEKLALYQQSLSEFKLTARKRKLSAV   77
            I  FI SK LS NS+F+Y YDL+QF ++IG  VN +KL LYQ S++    L+A+KRKLS
Sbjct:    5 IEPFIASKALSQNSQKAYRYDLQQFCQLIGERVNQDKLLLYQNSIANLSLSAKKRKLSTA   64

Query:   78 NQFLFFLYNRGTLKEFYRLQETEKITLAQTK-SQIMDLSNFYQDTDYPSGRLIALLILSL  136
            NQFL++LY      L  ++RL +T K+   + + + I++   FYQ T +  G+LI+LLIL L
Sbjct:   65 NQFLYYLYQIKYLNSYFRLTDTMKVMRTEKQQAAIINTDIFYQKTPFVWGQLISLLILEL  124

Query:  137 GLTPAEIANLKKADFDTTFNILSIEKSQMKRILKLPEDLLPFLLESLEEDGDLVFEHNGK  196
            GLTP+E+A ++ A+ D  F +L+++  +   R+L L + L+PFL + L      +FEH G
Sbjct:  125 GLTPSEVAGIEVANLDLNFQMLTLKTKKGVRVLPLSQILIPFLEQQLVGKEVYLFEHRGI  184

Query:  197 PYSRQWFFNQLTDFLNEKNEQQLTAQLLREQFILKQKENGKTMTELSRLLGLKTPITLER  256
            P+SRQWFFN L  F+      + LTAQ LREQFILK+K  GK++ ELS +LGLK+P+TLE+
Sbjct:  185 PFSRQWFFNHLKTFVRSIGYEGLTAQKLREQFILKEKLAGKSIIELSDILGLKSPMTLEK  244

Query:  257 YYR                                                          259
            YY+
Sbjct:  245 YYK                                                          247
```

SEQ ID 4738 (GBS383) was expressed in *E. coli* as a His-fusion product. SDS-PAGE analysis of total cell extract is shown in FIG. 68 (lane 7; MW 32 kDa). It was also expressed in *E. coli* as a GST-fusion product. SDS-PAGE analysis of total cell extract is shown in FIG. 72 (lane 5; MW 57.1 kDa).

Figure 308:
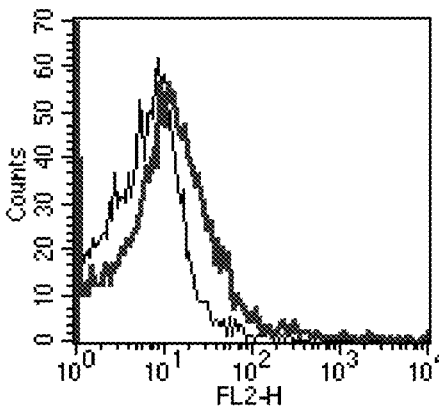

The GBS383-GST fusion product was purified (FIG. 212, lane 8) and used to immunise mice. The resulting antiserum was used for FACS (FIG. 308), which confirmed that the protein is immunoaccessible on GBS bacteria.

Based on this analysis, it was predicted that these proteins and their epitopes could be useful antigens for vaccines or diagnostics.

EXAMPLE 1539

A DNA sequence (GBSx1630) was identified in *S. agalactiae* <SEQ ID 4741> which encodes the amino acid sequence <SEQ ID 4742>. Analysis of this protein sequence reveals the following:

```
Possible site: 21
>>> Seems to have no N-terminal signal sequence

----- Final Results -----
           bacterial cytoplasm --- Certainty = 0.2465(Affirmative) < succ>
            bacterial membrane --- Certainty = 0.0000(Not Clear)   < succ>
             bacterial outside --- Certainty = 0.0000(Not Clear)   < succ>
```

The protein has homology with the following sequences in the GENPEPT database.

```
>GP: BAB05201 GB: AP001512 unknown conserved protein in B. subtilis
[Bacillus halodurans]
Identities = 38/136 (27%), Positives = 73/136 (52%), Gaps = 1/136 (0%)

Query:    7 ESFLLNHLDHYLIPAEDVAIFVDTHNADHVMLLLASNGFSRVPVITKEKKYVGTISISDI   66
            ++ + N L  +IP E VA    ++ +H +L+L  +G++ +PV+ +   K   G IS S I
Sbjct:    7 QNIMDNDLKELVIPFEKVAHVHLSNPLEHALLVLIKSGYTAIPVLDEHSKLHGVISKSLI   66

Query:   67 MGYQSKGQLTDWE-MAQTDIVEMVNTKIEPINEAATLTAIMHKIVDYPFLPVISDQNDFR  125
            +     + + E +A   + +++N +I  I+  A+ +  +   +PF+ ++ D    F
Sbjct:   67 LDALLGVERIEMERLAHLVVKDVMNPEIPTIHHKASFSRALKVSIAHPFICILDDDGSFL  126

Query:  126 GIITRKSILKAINSLL                                             141
            GI+TR +IL  IN  L
Sbjct:  127 GILTRSTILSFINRQL                                             142
```

A related DNA sequence was identified in *S. pyogenes* <SEQ ID 4743> which encodes the amino acid sequence <SEQ ID 4744>. Analysis of this protein sequence reveals the following:

```
Possible site: 47
>>> Seems to have no N-terminal signal sequence

----- Final Results -----
           bacterial cytoplasm --- Certainty = 0.3539(Affirmative) < succ>
           bacterial membrane  --- Certainty = 0.0000(Not Clear)   < succ>
           bacterial outside   --- Certainty = 0.0000(Not Clear)   < succ>
```

An alignment of the GAS and GBS proteins is shown below.

```
Identities = 119/153 (77%), Positives = 137/153 (88%)

Query:    1 MIAKEFESFLLNHLDHYLIPAEDVAIFVDTHNADHVMLLLASNGFSRVPVITKEKKYVGT   60
            MIAKEFE+FL++HLD+YLIP +D+AIF+DTHNADHVMLLL SNGFSRVPVIT+EKKYVGT
Sbjct:    1 MIAKEFETFLMSHLDNYLIPEQDLAIFIDTHNADHVMLLLVSNGFSRVPVITREKKYVGT   60

Query:   61 ISISDIMGYQSKGQLTDWEMAQTDIVEMVNTKIEPINEAATLTAIMHKIVDYPFLPVISD  120
            ISISDIM YQSK QLTDWEM+QTDI EMVNTKIE I+  ++LT IMHK++D+PFLPV+
Sbjct:   61 ISISDIMMYQSKRQLTDWEMSQTDIGEMVNTKIETISITSSLTEIMHKLIDFPFLPVVDR  120

Query:  121 QNDFRGIITRKSILKAINSLLHDFTDEYTITPK                            153
             N F GIITRKSILKA+NSLLHDFTD+YTI  K
Sbjct:  121 ANRFVGIITRKSILKAVNSLLHDFTDDYTIIKK                            153
```

Based on this analysis, it was predicted that these proteins and their epitopes could be useful antigens for vaccines or diagnostics.

EXAMPLE 1540

A DNA sequence (GBSx1631) was identified in *S. agalactiae* <SEQ ID 4745> which encodes the amino acid sequence <SEQ ID 4746>. Analysis of this protein sequence reveals the following:

```
Possible site: 14
>>> Seems to have no N-terminal signal sequence

----- Final Results -----
           bacterial cytoplasm --- Certainty = 0.4421(Affirmative) < succ>
           bacterial membrane  --- Certainty = 0.0000(Not Clear)   < succ>
           bacterial outside   --- Certainty = 0.0000(Not Clear)   < succ>
```

The protein has homology with the following sequences in the GENPEPT database.

```
>GP: BAB06785 GB: AP001517 unknown conserved protein [Bacillus halodurans]
Identities = 55/169 (32%), Positives = 95/169 (55%), Gaps = 1/169 (0%)

Query:    5 KLVVMSDSHGDRDIVKDIKNHYLGKVDAIFHNGDSELPSSDPIWEGIHVVTGNCDYDSGY   64
            KL+++SDSHG  D +K + + +  +VDAI H GDSELP  D   EG+++V GNCD+   +
Sbjct:    2 KLLILSDSHGWSDELKAVADKHRQEVDAIIHCGDSELPRDDRALEGMNIVRGNCDFGVDF   61

Query:   65 PEVLVTKIDNAVIVQTHGHLHQINFTWDKLDLLAQQEDADICLYGHLHRADAWKNGKTIF  124
            PE +  + +   THGHL+ +  ++   L   A++   A +  +GH H A +++    +F
Sbjct:   62 PEDFIKTVGDFNVYVTHGHLYNVKMSYVSLTYRAEEVGAQLVCFGHSHVATSFQENGIVF  121

Query:  125 INPGSVLQPRGPINEKLYAVVTITDSKVLVEYYTRQHQPYPNLTKELSR             173
            +NPGS+  PR     E+ Y +  + D ++ + +  R       +L +   R
Sbjct:  122 VNPGSLRLPRNR-KEQTYCLAYVRDDQIELTFLDRDGHEVTDLQRTYLR             169
```

A related DNA sequence was identified in *S. pyogenes* <SEQ ID 4747> which encodes the amino acid sequence <SEQ ID 4748>. Analysis of this protein sequence reveals the following:

```
Possible site: 14
>>> Seems to have no N-terminal signal sequence

----- Final Results -----
              bacterial cytoplasm --- Certainty = 0.3835(Affirmative) < succ>
                bacterial membrane --- Certainty = 0.0000(Not Clear)  < succ>
                 bacterial outside --- Certainty = 0.0000(Not Clear)  < succ>
```

An alignment of the GAS and GBS proteins is shown below.

```
Identities = 117/173 (67%), Positives = 143/173 (82%)

Query:    1 MAIRKLVVMSDSHGDRDIVKDIKNHYLGKVDAIFHNGDSELPSSDPIWEGIHVVTGNCDY   60
            MA + ++VMSDSHGDRDIV+ IK+ YLG+VDAIFHNGDSEL SSDPIW GI+VV GNCDY
Sbjct:    1 MASKTIIVMSDSHGDRDIVQAIKDKYLGQVDAIFHNGDSELNSSDPIWAGIYVVGGNCDY   60

Query:   61 DSGYPEVLVTKIDNAVIVQTHGHLHQINFTWDKLDLLAQQEDADICLYGHLHRADAWKNG  120
            D+GYP+ LVT++  I QTHGHL+ INFTWDKLD  AQ+  ADICLYGHLHR  AW+ G
Sbjct:   61 DTGYPDRLVTQLGTVTIAQTHGHLYHINFTWDKLDYFAQEVVADICLYGHLHRPAAWQVG  120

Query:  121 KTIFINPGSVLQPRGPINEKLYAVVTITDSKVLVEYYTRQHQPYPNLTKELSR         173
            +T+F+NPGSV QPRG INEKLYA V +TD+++ V+Y+TR H+ YP+L+KE   R
Sbjct:  121 QTLFMNPGSVTQPRGEINEKLYARVELTDTQIKVDYFTRDHKLYPSLSKEFKR         173
```

Based on this analysis, it was predicted that these proteins and their epitopes could be useful antigens for vaccines or diagnostics.

EXAMPLE 1541

A DNA sequence (GBSx1632) was identified in *S. agalactiae* <SEQ ID 4749> which encodes the amino acid sequence <SEQ ID 4750>. This protein is predicted to be HAM1 family protein. Analysis of this protein sequence reveals the following:

```
Possible site: 23
>>> Seems to have no N-terminal signal sequence

----- Final Results -----
              bacterial cytoplasm --- Certainty = 0.1218(Affirmative) < succ>
                bacterial membrane --- Certainty = 0.0000(Not Clear)  < succ>
                 bacterial outside --- Certainty = 0.0000(Not Clear)  < succ>
```

The protein has homology with the following sequences in the GENPEPT database.

```
>GP: CAB14796 GB: Z99118 similar to hypothetical proteins [Bacillus
subtilis]
Identities = 96/189 (50%), Positives = 130/189 (67%), Gaps = 1/189 (0%)

Query:  128 LIATHNEGKTKEFRELFGKLGLKVENLNDYPDLPEVEETGMTFEENARLKAETISKLTGK  187
            +IATHN GK KEF+E+    G  V++L +     E+EETG TFEENA +KAE ++K    K
Sbjct:    8 IIATHNPGKVKEFKEILEPRGYDVKSLAEIGFTEEIEETGHTFEENAIMKAEAVAKAVNK   67

Query:  188 MVISDDSGLKVDALGGLPGVWSARFSGPDATDARNNAKLLHELAMVFDKERRSAQFHTTL  247
            MVI+DDSGL +D LGG PGV+SAR++G    D  N  K+L EL  + +KE+R+A+F    L
Sbjct:   68 MVIADDSGLSIDNLGGRPGVYSARYAGEQKDDQANIEKVLSELKGI-EKEQRTARFRCAL  126

Query:  248 VVSAPNKESLVVEAEWPGYIGTEPKGENGFGYDPLFIVGEGSRTAAELSAQEKNNLSHRG  307
            VS P +E+  VE    GYI  EP+GE GFGYDP+FIV +  +T AEL++ EKN +SHR
Sbjct:  127 AVSIPGEETKTVEGHVEGYIAEEPRGEYGFGYDPIFIVKDKDKTMAELTSDEKNKISHRA  186

Query:  308 QAVRKLMEV                                                    316
            A++KL ++
Sbjct:  187 DALKKLSKL                                                    195
```

A related DNA sequence was identified in *S. pyogenes* <SEQ ID 4751> which encodes the amino acid sequence <SEQ ID 4752>. Analysis of this protein sequence reveals the following:

```
Possible site: 39
>>> Seems to have no N-terminal signal sequence

----- Final Results -----
            bacterial cytoplasm --- Certainty = 0.2590 (Affirmative) < succ>
             bacterial membrane --- Certainty = 0.0000 (Not Clear)  < succ>
              bacterial outside --- Certainty = 0.0000 (Not Clear)  < succ>
```

An alignment of the GAS and GBS proteins is shown below.

```
Identities = 214/325 (65%), Positives = 253/325 (77%), Gaps = 5/325 (1%)

Query:   1 MTKTIFESKTEGNWFLGSFQAFNYFTCFG-NDESYEAIQDVFHRLLSTLKVE---GLQLH   56
           M++ I+E K E NWF+G      N + +G    + + I D+    + +TL E   G   +
Sbjct:  14 MSEKIYEYKDENNWFIGKMTGHNLISGWGVKHTTIKKIDDLLDGIAATLDWENPKGYDVS   73

Query:  57 VVQMTSDFQLLAFLVDMINQEYSRHIKVTQHKGAILVSEDDQLFLVHLPKEGTSLEKFFD  116
           VV+   S    L+ F++DMINQE   R IKVT H G IL+ E+ +L  V+LP+ G S     FF
Sbjct:  74 VVRHQSPLSLITFIIDMINQETQREIKVTPHAGTILLMENAKLLAVYLPEGGVSTATFF-  132

Query: 117 LKNDNNFGDTILIATHNEGKTKEFRELFGKLGLKVENLNDYPDLPEVEETGMTFEENARL  176
              ++   FGD ILIAT NEGKTKEFR LFG+LG +VENLNDYP+LPEV ETG TFEENARL
Sbjct: 133 ATSEQGFGDIILIATRNEGKTKEFRNLFGQLGYRVENLNDYPELPEVAETGTTFEENARL  192

Query: 177 KAETISKLTGKMVISDDSGLKVDALGGLPGVWSARFSGPDATDARNNAKLLHELAMVFDK  236
           KAETIS+LTGKMV++DDSGLKVDALGGLPGVWSARFSGPDATDA+NNAKLLHELAMVFD+
Sbjct: 193 KAETISRLTGRMVLADDSGLKVDALGGLPGVWSARFSGPDATDAKNNAKLLHELAMVFDQ  252

Query: 237 ERRSAQFHTTLVVSAPNKESLVVEAEWPGYIGTEPKGENGFGYDPLFIVGEGSRTAAELS  296
           ++RSAQFHTTLVV+APNK+SLVVEA+WPGYI T+PKGENGFGYDP+FIVGE      AAEL
Sbjct: 253 KKRSAQFHTTLVVAAPNKDSLVVEADWPGYIATQPKGENGFGYDPVFIVGETGHHAAELE  312

Query: 297 AQEKNNLSHRGQAVRKLMEVFPKWQ                                    321
           A +KN LSHRGQAVRKLMEVFP WQ
Sbjct: 313 ADQKNQLSHRGQAVRKLMEVFPAWQ                                    337
```

Based on this analysis, it was predicted that these proteins and their epitopes could be useful antigens for vaccines or diagnostics.

EXAMPLE 1542

A DNA sequence (GBSx1633) was identified in *S. agalactiae* <SEQ ID 4753> which encodes the amino acid sequence <SEQ ID 4754>. This protein is predicted to be glutamate racemase (murI). Analysis of this protein sequence reveals the following:

```
Possible site: 45
>>> Seems to have no N-terminal signal sequence
INTEGRAL Likelihood = -1.86 Transmembrane 114-130 (114-130)

----- Final Results -----
             bacterial membrane --- Certainty = 0.1744 (Affirmative) < succ>
              bacterial outside --- Certainty = 0.0000 (Not Clear)  < succ>
            bacterial cytoplasm --- Certainty = 0.0000 (Not Clear)  < succ>
```

A related GBS nucleic acid sequence <SEQ ID 10067> which encodes amino acid sequence <SEQ ID 10068> was also identified.

The protein has homology with the following sequences in the GENPEPT database.

```
>GP: AAF72713 GB: AF263927 glutamate racemase [Carnobacterium sp. St2]
Identities = 160/267 (59%), Positives = 202/267 (74%), Gaps = 3/267 (1%)

Query:  27 MDSRPIGFLDSGVGGLTVVKEMFRQLPEEEVIFIGDQARAPYGPRPAQQIREFTWQMVNF   86
           M +  IGF+DSGVGGLTVVKE  RQLP E + ++GD AR PYGPRP  Q+R+FTW+M +F
Sbjct:   1 MKKQAIGFIDSGVGGLTVVKEAMRQLPNESIYYVGDTARCPYGPRPEDQVRKFTWEMTHF   60
```

```
                            -continued
Query:   87 LLTKNVKMIVIACNTATAVAWQEIKEKLDIPVLGVILPGASAAIKSTNLGKVGIIGTPMT   146
            LL  KN+KM+VIACNTATA A ++IK+KL IPV+GVILPG+ AAIK+T+  ++G+IGT   T
Sbjct:   61 LLDKNIKMLVIACNTATAAALKDIKKKLAIPVIGVILPGSRAAIKATHTNRIGVIGTEGT   120

Query:  147 VKSDAYRQKIQALSPNTAVVSLACPKFVPIVESNQMSSSLAKKVVYETLSPLVGK-LDTL   205
            VKS+ Y++ I +      V SLACPKFVP+VESN+ SS++AKKVV ETL PL  + LDTL
Sbjct:  121 VKSNQYKKMIHSKDTKALVTSLACPKFVPLVESNEYSSAIAKKVVAETLRPLKNEGLDTL   180

Query:  206 ILGCTHYPLLRPIIQNVMGAEVKLIDSGAETVRDISVLLNYFEINHNWQNKH-GGHHFYT   264
            ILGCTHYPLLRPIIQN +G  V LIDSGAETV ++S +L+YF +  + QNK        +FYT
Sbjct:  181 ILGCTHYPLLRPIIQNTLGDSVTLIDSGAETVSEVSTILDYFNLAVDSQNKEKAERNFYT   240

Query:  265 TASPKGFKEIAEQWLS-QEINVERIVL                                   290
            T S + F  IA +WL   ++ VE I L
Sbjct:  241 TGSSQMFHAIASEWLQLDDLAVEHITL                                   267
```

A related DNA sequence was identified in *S. pyogenes* <SEQ ID 4755> which encodes the amino acid sequence <SEQ ID 4756>. Analysis of this protein sequence reveals the following:

```
Possible site: 19
>>> Seems to have an uncleavable N-term signal seq
INTEGRAL Likelihood = -1.70 Transmembrane 88-104 (86-104)

----- Final Results ----- bacterial membrane --- Certainty = 0.1680 (Affirmative) < succ>
               bacterial outside --- Certainty = 0.0000 (Not Clear) < succ>
              bacterial cytoplasm --- Certainty = 0.0000 (Not Clear) < succ>
```

The protein has homology with the following sequences in the databases:

```
>GP: AAF72713 GB: AF263927 glutamate racemase [Carnobacterium sp. St2]
Identities = 149/267 (55%), Positives = 202/267 (74%), Gaps = 3/267 (1%)

Query:    1 MDTRPIGFLDSGVGGLTVVCELIRQLPHEKIVYIGDSARAPYGPRPKKQIKEYTWELVNF    60
            M + IGF+DSGVGGLTVV E +RQLP+E I Y+GD+AR PYGPRP+ Q++++TWE+ +F
Sbjct:    1 MKKQAIGFIDSGVGGLTVVKEAMRQLPNESIYYVGDTARCPYGPRPEDQVRKFTWEMTHF    60

Query:   61 LLTQNVKMIVFACNTATAVAWEEVKAALDIPVLGVVLPGASAAIKSTTKGQVGVIGTPMT   120
            LL +N+KM+V ACNTATA A +++K  L IPV+GV+LPG+ AAIK+T   ++GVIGT  T
Sbjct:   61 LLDKNIKMLVIACNTATAAALKDIKKKLAIPVIGVILPGSRAAIKATHTNRIGVIGTEGT   120

Query:  121 VASDIYRKKIQLLAPSIQVRSLACPKFVPIVESNEMCSSIAKKIVYDSLAPLVGK-IDTL   179
            V S+ Y+K I       V SLACPKFVP+VESNE  S+IAKK+V ++L PL  + +DTL
Sbjct:  121 VKSNQYKKMIHSKDTKALVTSLACPKFVPLVSSNEYSSAIAKKVVAETLRPLKNEGLDTL   180

Query:  180 VLGCTHYPLLRPIIQNVMGPSVKLIDSGAECVRDISVLLNYFDIN-GNYHQKAVEHRFFT   238
            +LGCTHYPLLRPIIQN +G SV LIDSGAE V ++S +L+YF++     +++   E  F+T
Sbjct:  181 ILGCTHYPLLRPIIQNTLGDSVTLIDSGAETVSEVSTILDYFNLAVDSQNKEKAERNFYT   240

Query:  239 TANPEIFQEIASIWLK-QKINVEHVTL                                  264
            T + ++F  IAS WL+    + VEH+TL
Sbjct:  241 TGSSQMFHAIASEWLQLDDLAVEHITL                                  267
```

An alignment of the GAS and GBS proteins is shown below.

```
Identities = 195/264 (73%), Positives = 231/264 (86%)

Query:   27 MDSRPIGFLDSGVGGLTVVKEMFRQLPEEEVIFIGDQARAPYGPRPAQQIREFTWQMVNF    86
            MD+RPIGFLDSGVGGLTVV E+ RQLP E++++IGD ARAPYGPRP +QI+E+TW++VNF
Sbjct:    1 MDTRPIGFLDSGVGGLTVVCELIRQLPHEKIVYIGDSARAPYGPRPKKQIKEYTWELVNF    60

Query:   87 LLTKNVKMIVIACNTATAVAWQEIKEKLDIPVLGVILPGASAAIKSTNLGKVGIIGTPMT   146
            LLT+NVKMIV ACNTATAVAW+E+K  LDIPVLGV+LPGASAAIKST  G+VG+IGTPMT
Sbjct:   61 LLTQNVKMIVFACNTATAVAWEEVKAALDIPVLGVVLPGASAAIKSTTKGQVGVIGTPMT   120

Query:  147 VKSDAYRQKIQALSPNTAVVSLACPKFVPIVESNQMSSSLAKKVVYETLSPLVGKLDTLI   206
            V SD YR+KIQ L+P+  V SLACPKFVPIVESN+M SS+AKK+VY++L+PLVGK+DTL+
Sbjct:  121 VASDIYRKKIQLLAPSIQVRSLACPKFVPIVESNEMCSSIAKKIVYDSLAPLVGKIDTLV   180
```

```
                                       -continued
Query: 207 LGCTHYPLLRPIIQNVMGAEVKLIDSGAETVRDISVLLNYFEINHNWQNKHGGHHFYTTA  266
           LGCTHYPLLRPIIQNVMG  VKLIDSGAE VRDISVLLNYF+IN N+  K   H F+TTA
Sbjct: 181 LGCTHYPLLRPIIQNVMGPSVKLIDSGAECVRDISVLLNYFDINGNYHQKAVEHRFFTTA  240

Query: 267 SPKGFKEIAEQWLSQEINVERIVL                                     290
           +P+ F+EIA  WL Q+INVE + L
Sbjct: 241 NPEIFQEIASIWLKQKINVEHVTL                                     264
```

Based on this analysis, it was predicted that these proteins and their epitopes could be useful antigens for vaccines or diagnostics.

EXAMPLE 1543

A DNA sequence (GBSx1634) was identified in *S. agalactiae* <SEQ ID 4757> which encodes the amino acid sequence <SEQ ID 4758>. Analysis of this protein sequence reveals the following:

```
Possible site: 21
>>> Seems to have an uncleavable N-term signal seq
INTEGRAL Likelihood = -11.36 Transmembrane 3-19 (1-27)

----- Final Results -----
           bacterial membrane --- Certainty = 0.5543 (Affirmative) < succ>
           bacterial outside  --- Certainty = 0.0000 (Not Clear)  < succ>
           bacterial cytoplasm --- Certainty = 0.0000 (Not Clear)  < succ>
```

The protein has homology with the following sequences in the GENPEPT database.

```
>GP: CAB13675 GB: Z99113 alternate gene name: yoxG [Bacillus subtilis]
Identities = 26/72 (36%), Positives = 42/72 (58%)

Query:   1 MSITIWILLIIVALFGGLVGGIFIARKQIEKEIGEHPRLTPDAIREMMSQMGQKPSEAKV   60
           M++ + IL+ +VAL  G+  G FIARK +   + ++P +    +R MM QMG KPS+ K+
Sbjct:   1 MTLWVGILVGVVALLIGVALGFFIARKYMMSYLKKNPPINEQMLRMMMMQMGMKPSQKKI   60

Query:  61 QQTYRNIVKHAK                                                 72
           Q  +  +   K
Sbjct:  61 NQMMKAMNNQTK                                                 72
```

A related DNA sequence was identified in *S. pyogenes* <SEQ ID 4759> which encodes the amino acid sequence <SEQ ID 4760>. Analysis of this protein sequence reveals the following:

```
Possible site: 15
>>> Seems to have an uncleavable N-term signal seq
     INTEGRAL     Likelihood = -10.72     Transmembrane    7-23 (1-27)

----- Final Results -----
           bacterial membrane  --- Certainty = 0.5288(Affirmative) < succ>
           bacterial outside   --- Certainty = 0.0000(Not Clear)   < succ>
           bacterial cytoplasm --- Certainty = 0.0000(Not Clear)   < succ>
```

An alignment of the GAS and GBS proteins is shown below.

```
Identities = 62/79 (78%), Positives = 69/79 (86%)

Query:   1 MSITIWILLIIVALFGGLVGGIFIARKQIEKEIGEHPRLTPDAIREMMSQMGQKPSEAKV   60
           MS  IWILL+IVAL G+ GGIFIARKQIEKEIGEHPRLTP+AIREMMSQMGQKPSEAK+
Sbjct:   1 MSTAIWILLLIVALGVGVFGGIFIARKQIEKEIGEHPRLTPEAIREMMSQMGQKPSEAKI   60

Query:  61 QQTYRNIVKHAKTAIKTKK                                          79
           QQTYRNI+K +K A+    K
Sbjct:  61 QQTYRNIIKQSKAAVSKGK                                          79
```

Based on this analysis, it was predicted that these proteins and their epitopes could be useful antigens for vaccines or diagnostics.

EXAMPLE 1544

A DNA sequence (GBSx1635) was identified in *S. agalactiae* <SEQ ID 4761> which encodes the amino acid sequence <SEQ ID 4762>. Analysis of this protein sequence reveals the following:

```
Possible site: 57
>>> Seems to have no N-terminal signal sequence
     INTEGRAL    Likelihood = -7.86    Transmembrane      82-98 (79-103)

----- Final Results -----
             bacterial membrane --- Certainty = 0.4142(Affirmative) < succ>
              bacterial outside --- Certainty = 0.0000(Not Clear) < succ>
            bacterial cytoplasm --- Certainty = 0.0000(Not Clear) < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1545

A DNA sequence (GBSx1636) was identified in *S. agalactiae* <SEQ ID 4763> which encodes the amino acid sequence <SEQ ID 4764>. Analysis of this protein sequence reveals the following:

```
Possible site: 30
>>> Seems to have no N-terminal signal sequence
     INTEGRAL    Likelihood = -10.83    Transmembrane     56-72 (50-105)
     INTEGRAL    Likelihood =  -7.27    Transmembrane     27-43 (17-48)
     INTEGRAL    Likelihood =  -6.26    Transmembrane     76-92 (73-105)
     INTEGRAL    Likelihood =  -4.83    Transmembrane    119-135 (118-141)
     INTEGRAL    Likelihood =  -1.65    Transmembrane    160-176 (160-176)

----- Final Results -----
             bacterial membrane --- Certainty = 0.5331(Affirmative) < succ>
              bacterial outside --- Certainty = 0.0000(Not Clear) < succ>
            bacterial cytoplasm --- Certainty = 0.0000(Not Clear) < succ>
```

A related GBS nucleic acid sequence <SEQ ID 8837> which encodes amino acid sequence <SEQ ID 8838> was also identified.

The protein has no significant homology with any sequences in the GENPEPT database.

A related DNA sequence was identified in *S. pyogenes* <SEQ ID 4765> which encodes the amino acid sequence <SEQ ID 4766>. Analysis of this protein sequence reveals the following:

```
Possible site: 19
>>> Seems to have a cleavable N-term signal seq.
     INTEGRAL    Likelihood = -10.99    Transmembrane     45-61 (37-94)
     INTEGRAL    Likelihood =  -7.06    Transmembrane     74-90 (62-94)
     INTEGRAL    Likelihood =  -3.45    Transmembrane    110-126 (108-130)
     INTEGRAL    Likelihood =  -2.18    Transmembrane    149-165 (149-165)
     INTEGRAL    Likelihood =  -1.91    Transmembrane     21-37 (20-37)

----- Final Results -----
             bacterial membrane --- Certainty = 0.5394(Affirmative) < succ>
              bacterial outside --- Certainty = 0.0000(Not Clear) < succ>
            bacterial cytoplasm --- Certainty = 0.0000(Not Clear) < succ>
```

The protein has no significant homology with any sequences in the GENPEPT database.

An alignment of the GAS and GBS proteins is shown below.

```
Identities = 111/173 (64%), Positives = 145/173 (83%)

Query:   12 MSKKTTQMVSYTSILVAFAIMIPIIMPAKIIIGPASFTLASHVPLFLSIFISVPVAILVA   71
            M+KK TQ+++YTSILVAFAI+IPIIMP K+IIGPASFTLASHVPLFL+IF+S+PVAILVA
Sbjct:    1 MTKKPTQLIAYTSILVAFAILIPIIMPLKLIIGPASFTLASHVPLFLAIFMSIPVAILVA   60

Query:   72 LGTGLGFLLAGFPIVIVLRALSHIGFALIAAFLIKSKPSLLMSKWQTLLFAVAINIIHGL  131
            LGT LGFLLAG P++IVLRALSH+ FA++AA+ +  KP L+ S  +   FA  IN+IHGL
Sbjct:   61 LGTTLGFLLAGLPLIIVLRALSHLLFAILAAWWLSRKPQLMTSAVKCFSFAFFINVINGL  120

Query:  132 LEFITVYIITMTSNSSSTYLWSLFSLIGLGSLLHGLVDFYIALFIWKWMTQKL         184
            EF+ VYI+T T+ +S +Y WS+  LIGLGSL+HG++DFY+AL +W+++ + L
Sbjct:  121 AEFLVVYILTATTATSMSYFWSMLGLIGLGSLIHGILDFYLALVLWRFLAKNL         173
```

A related GBS gene <SEQ ID 10789> and protein <SEQ ID 10790> were also identified. Analysis of this protein sequence reveals the following:

```
Lipop: Possible site: -1 Crend: 3
SRCFLG: 0
McG: Length of UR: 24
     Peak Value of UR: 3.16
     Net Charge of CR: 2
McG: Discrim Score: 12.56
GvH: Signal Score (-7.5): -0.16
     Possible site: 19
>>> Seems to have a cleavable N-term signal seq.
Amino Acid Composition: calculated from 20
ALOM program count: 5 value: -10.83 threshold: 0.0
    INTEGRAL     Likelihood = -10.83     Transmembrane      45-61   (39-94)
    INTEGRAL     Likelihood =  -6.26     Transmembrane      65-81   (62-94)
    INTEGRAL     Likelihood =  -4.83     Transmembrane     108-124  (107-130)
    INTEGRAL     Likelihood =  -1.65     Transmembrane     149-165  (149-165)
    INTEGRAL     Likelihood =  -0.27     Transmembrane      24-40   (24-40)
    PERIPHERAL   Likelihood =   0.42                         86
modified ALOM score: 2.67
icm1 HYPID: 7 CFP: 0.533
*** Reasoning Step: 3

----- Final Results -----
           bacterial membrane  --- Certainty = 0.5331(Affirmative) < succ>
           bacterial outside   --- Certainty = 0.0000(Not Clear)   < succ>
           bacterial cytoplasm --- Certainty = 0.0000(Not Clear)   < succ>
```

Based on this analysis, it was predicted that these proteins and their epitopes could be useful antigens for vaccines or diagnostics.

EXAMPLE 1546

A DNA sequence (GBSx1637) was identified in *S. agalactiae* <SEQ ID 4767> which encodes the amino acid sequence <SEQ ID 4768>. This protein is predicted to be transcriptional regulator, biotin repressor family. Analysis of this protein sequence reveals the following:

```
Possible site: 27
>>> Seems to have no N-terminal signal sequence

----- Final Results -----
           bacterial cytoplasm --- Certainty = 0.2237(Affirmative) < succ>
           bacterial membrane  --- Certainty = 0.0000(Not Clear)   < succ>
           bacterial outside   --- Certainty = 0.0000(Not Clear)   < succ>
```

The protein has homology with the following sequences in the GENPEPT database.

```
>GP: CAB14749 GB: Z99118 yrxA [Bacillus subtilis]
Identities = 72/165 (43%), Positives = 112/165 (67%), Gaps = 2/165 (1%)

Query:    6 RRENILTTLKGTKEAISASTLAKIFSVSRQVIVGDIALLRAQQCDIISTPKGYL-MSSAL   64
            RR+ +L  LK +K  ++   LAK +VSRQVIV DI+LL+A+   II+T +GY+ M +A
Sbjct:   12 RRDQLLLWLKESKSPLTGGELAKKANVSRQVIQDISLLKAKNVPIIATSQGYVYMDAAA   71

Query:   65 STHQFTARLV-CQHGIEQTEEELEIILRYQGIIMNVEVEHPIYGMLTAPLNIQSQKDIDN  123
               HQ   R++ C HG E+TEEEL++I+     + +V++EHP+YG LTA + + ++K++ +
Sbjct:   72 QQHQQAERIIACLHGPERTEEELQLIVDEGVTVKDVKIEHPVYGDLTAAIQVGTRKEVSH  131

Query:  124 FTAKLKVSNAELLSSLTDGLHTHMISCQDQSVFDQICEALKKAGI                168
              F  K+  +NA  LS LTDG+H H ++  D+   DQ C+AL++AGI
Sbjct:  132 FIKKINSTNAAYLSQLTDGVHLHTLTAPDEHRIDQACQALEEAGI                176
```

A related DNA sequence was identified in *S. pyogenes* <SEQ ID 4769> which encodes the amino acid sequence <SEQ ID 4770>. Analysis of this protein sequence reveals the following:

```
Possible site: 38
>>> Seems to have no N-terminal signal sequence

----- Final Results -----
              bacterial cytoplasm --- Certainty = 0.2971(Affirmative) < succ>
              bacterial membrane  --- Certainty = 0.0000(Not Clear)  < succ>
               bacterial outside  --- Certainty = 0.0000(Not Clear)  < succ>
```

An alignment of the GAS and GBS proteins is shown below.

```
Identities = 109/170 (64%), Positives = 136/170 (79%)

Query:    1 MKAQERRENILTTLKGTKEAISASTLAKIFSVSRQVIVGDIALLRAQQCDIISTPKGYLM   60
            MKA++RR+ I+  L    ++A+SA+ L K+  VSRQVIVGDIALLRAQQ DIISTPKGY+M
Sbjct:    1 MKAEDRRQKIIECLNSEQKAVSATRLGKLLGVSRQVIVGDIALLRAQQIDIISTPKGYIM   60

Query:   61 SSALSTHQFTARLVCQHGIEQTEEELEIILRYQGIIMNVEVEHPIYGMLTAPLNIQSQKD  120
            S+AL +HQF AR+VCQH +E+T++ELEIIL +QGII  VEVEHPIYGM+TAPLNI++  D
Sbjct:   61 STALYSHQFCARIVCQHNVEETKKELEIILAHQGIITTVEVEHPIYGMITAPLNIKTHSD  120

Query:  121 IDNFTAKLKVSNAELLSSLTDGLHTHMISCQDQSVFDQICEALKKAGILY            170
             + NF +KL  S AELLSSLT+GLH+H+ISC  Q F  I   L+ AGILY
Sbjct:  121 VTNFMSKLSQSKAELLSSLTEGLHSHLISCPSQEAFLAIKHDLELAGILY            170
```

Based on this analysis, it was predicted that these proteins and their epitopes could be useful antigens for vaccines or diagnostics.

EXAMPLE 1547

A DNA sequence (GBSx1638) was identified in *S. agalactiae* <SEQ ID 4771> which encodes the amino acid sequence <SEQ ID 4772>. Analysis of this protein sequence reveals the following:

```
Possible site: 37
>>> Seems to have no N-terminal signal sequence
         INTEGRAL    Likelihood = -8.44    Transmembrane   143-159 (138-165)
         INTEGRAL    Likelihood = -8.17    Transmembrane   164-180 (160-184)
         INTEGRAL    Likelihood = -7.17    Transmembrane    56-72  (53-78)
         INTEGRAL    Likelihood = -5.63    Transmembrane    24-40  (21-44)
         INTEGRAL    Likelihood = -4.94    Transmembrane   113-129 (108-131)
```

```
     INTEGRAL    Likelihood = -2.39    Transmembrane     86-102 (86-103)
     INTEGRAL    Likelihood = -1.06    Transmembrane    203-219 (203-219)

----- Final Results -----
              bacterial membrane --- Certainty = 0.4376(Affirmative) < succ>
               bacterial outside --- Certainty = 0.0000(Not Clear)   < succ>
             bacterial cytoplasm --- Certainty = 0.0000(Not Clear)   < succ>
```

A related GBS nucleic acid sequence <SEQ ID 10069> which encodes amino acid sequence <SEQ ID 10070> was also identified.

The protein has homology with the following sequences in the GENPEPT database.

```
>GP: AAC18360 GB: AF064763 putative membrane spanning protein
[Lactococcus lactis subsp. cremoris]
Identities = 97/188 (51%), Positives = 133/188 (70%)

Query:  38 IMLYMFPQNMIAIMQKMPGLYFGAIILELVLVFVASGAARRNTPAALPLFLIYSALNGFT   97
           IM+  F  NM AI+Q           I+ LV+V    G A +N+  ALP+F+ Y+A  GF
Sbjct:   1 IMITFFLDNMRAILQSGSLFLLVLWIIPLVMVVSLQGLAMKNSKMALPIFIGYAAFMGFL   60

Query:  98 LSFIIARYTQTTVLQAFITSAAVFFAMALIGAKTKKDLSGMRKALMAALIGILIASLVNL  157
           +SF +   YT T +  AFIT++A+FF +++ G   TK++LSGM KAL  A+ G+++A L+NL
Sbjct:  61 ISFTLLMYTATDITLAFITASAMFFGLSVYGRFTKRNLSGMGKALGVAVWGLIVAMLLNL  120

Query: 158 FIGSGGMSYIISIVCVIIFSGLIAYDNQMIKYVYNSQGGQVADGWAVSMALSLYLDFINL  217
            F   S G++ +IS+V V+IFSGLIA+DNQ I  VYN+  GQV+DGWA+SMALSLYLDFIN+
Sbjct: 121 FFASTGLTILISLVGVVIFSGLIAWDNQKITQVYNAHNGQVSDGWAISMALSLYLDFINM  180

Query: 218 FLNILRLF                                                     225
           FL +LRLF
Sbjct: 181 FLFLLRLF                                                     188
```

A related DNA sequence was identified in *S. pyogenes* <SEQ ID 4773> which encodes the amino acid sequence <SEQ ID 4774>. Analysis of this protein sequence reveals the following:

```
Possible site: 40
>>> Seems to have no N-terminal signal sequence
     INTEGRAL    Likelihood = -8.97    Transmembrane    143-159 (138-165)
     INTEGRAL    Likelihood = -5.89    Transmembrane    164-180 (160-184)
     INTEGRAL    Likelihood = -5.68    Transmembrane     56-72  (55-77)
     INTEGRAL    Likelihood = -4.78    Transmembrane    113-129 (110-130)
     INTEGRAL    Likelihood = -2.81    Transmembrane    203-219 (203-222)
     INTEGRAL    Likelihood = -2.76    Transmembrane     24-40  (23-41)
     INTEGRAL    Likelihood = -2.76    Transmembrane     86-102 (86-104)

----- Final Results -----
              bacterial membrane --- Certainty = 0.4588(Affirmative) < succ>
               bacterial outside --- Certainty = 0.0000(Not Clear)   < succ>
             bacterial cytoplasm --- Certainty = 0.0000(Not Clear)   < succ>
```

The protein has homology with the following sequences in the databases:

```
>GP: AAC18360 GB: AF064763 putative membrane spanning protein
[Lactococcus lactis subsp. cremoris]
Identities = 90/189 (47%), Positives = 133/189 (69%)

Query:  38 LMLYPFRENLISILVNQPMIYYGAAIIELILVFVASSAARKNTPAALPIFLIYSALNGFT   97
           +M+  F +N+ +IL +    +  II L++V    A KN+  ALPIF+ Y+A  GF
Sbjct:   1 IMITFFLDNMRAILQSGSLFLLVLWIIPLVMVVSLQGLAMKNSKMALPIFIGYAAFMGFL   60

Query:  98 LSFIIVAYAQTTVFQAFLSSAAVFFAMSIIGVKTKRDMSGLRKAMFAALIGVVVASLINL  157
           +SF ++  Y  T +  AF++++A+FF +S+ G   TKR++SG+ KA+  A+ G+++VA L+NL
Sbjct:  61 ISFTLLMYTATDITLAFITASAMFFGLSVYGRFTKRNLSGMGKALGVAVWGLIVAMLLNL  120

Query: 158 FIGSGMMSYVISVISVLIFSGLIASDNQMIKRVYQATNGQVGDGWAVAMALSLYLDFINL  217
           F   S  ++ +IS++ +IFSGLIA DNQ I +VY A NGQV DGWA++MALSLYLDFIN+
Sbjct: 121 FFASTGLTILISLVGVVIFSGLIAWDNQKITQVYNAHNGQVSDGWAISMALSLYLDFINM  180
```

```
Query:  218 FISLLRIFG                                              226
            F+ LLR+FG
Sbjct:  181 FLFLLRLFG                                              189
```

An alignment of the GAS and GBS proteins is shown below.

```
Identities = 167/229 (72%), Positives = 202/229 (87%)

Query:    1 MNDNVIYTQSDSGLNQFFAKIYGLVGIGVGLSAAVSAIMLYMFPQNMIAIMQKMPGLYFG   60
            MND+VIYTQSD GLNQFFAKIY LVG+GVGLSA VS +MLY F +N+I+I+   P +Y+G
Sbjct:    1 MNDHVIYTQSDVGLNQFFAKIYSLVGMGVGLSAFVSYLMLYPFRENLISILVNQPMIYYG   60

Query:   61 AIILELVLVFVASGAARRNTPAALPLFLIYSALNGFTLSFIIARYTQTTVLQAFITSAAV  120
            A I+EL+LVFVAS AAR+NTPAALP+FLIYSALNGFTLSFII  Y QTTV QAF++SAAV
Sbjct:   61 AAIIELILVFVASSAARKNTPAALPIFLIYSALNGFTLSFIIVAYAQTTVFQAFLSSAAV  120

Query:  121 FFAMALIGAKTKKDLSGMRKALMAALIGILIASLVNLFIGSGGMSYIISIVCVIIFSGLI  180
            FFAM+IG KTK+D+SG+RKA+ AALIG+++ASL+NLFIGSG MSY+IS++ V+IFSGLI
Sbjct:  121 FFAMSIIGVKTKRDMSGLRKAMFAALIGVVVASLINLFIGSGMMSYVISVISVLIFSGLI  180

Query:  181 AYDNQMIKYVYNSQGGQVADGWAVSMALSLYLDFINLFLNILRLFARND            229
            A DNQMIK VY +  GQV DGWAV+MALSLYLDFINLF+++LR+F RND
Sbjct:  181 ASDNQMIKRVYQATNGQVGDGWAVAMALSLYLDFINLFISLLRIFGRND            229
```

Based on this analysis, it was predicted that these proteins and their epitopes could be useful antigens for vaccines or diagnostics.

EXAMPLE 1548

A DNA sequence (GBSx1639) was identified in *S. agalactiae* <SEQ ID 4775> which encodes the amino acid sequence <SEQ ID 4776>. Analysis of this protein sequence reveals the following:

```
Possible site: 44
>>> Seems to have no N-terminal signal sequence

----- Final Results -----
        bacterial cytoplasm --- Certainty = 0.2495(Affirmative) < succ>
        bacterial membrane  --- Certainty = 0.0000(Not Clear)   < succ>
          bacterial outside --- Certainty = 0.0000(Not Clear)   < succ>
```

A related GBS nucleic acid sequence <SEQ ID 10071> which encodes amino acid sequence <SEQ ID 10072> was also identified.

The protein has no significant homology with any sequences in the GENPEPT database.

A related DNA sequence was identified in *S. pyogenes* <SEQ ID 4777> which encodes the amino acid sequence <SEQ ID 4778>. Analysis of this protein sequence reveals the following:

```
Possible site: 60
>>> Seems to have no N-terminal signal sequence

----- Final Results -----
        bacterial cytoplasm --- Certainty = 0.3277(Affirmative) < succ>
        bacterial membrane  Certainty = 0.0000(Not Clear)   < succ>
          bacterial outside --- Certainty = 0.0000(Not Clear)   < succ>
```

An alignment of the GAS and GBS proteins is shown below.

```
Identities = 127/163 (77%), Positives = 141/163 (85%)

Query:    7 YQDDKDFMDLVGHLIDHPRFQKLEAIVQHHHSTRLEHSINVSYTSYKIAKKFGWDASSTA   66
            Y +DK++M+ VGHLI HPRFQKL  IVQH HSTRLEHSINVSY+SYK+AK+FGWDA STA
Sbjct:    3 YTEDKEYMEHVGHLIAHPRFQKLSHIVQHQHSTRLEHSINVSYSSYKLAKRFGWDAKSTA   62

Query:   67 RGGLLHDFFYYDWRVTKFNKSHAWVHPRIAVRNARKLTDLNAREEDIILKHMWGATIAPP  126
            RGGLLHDFFYYDWRVTKFNK HAWVHPRIAVRNA+KLT+LN +EEDIILKHMWGATIA P
Sbjct:   63 RGGLLHDFFYYDWRVTKFNKGHAWVHPRIAVRNAKKLTELNKKEEDIILKHMWGATIAFP  122
```

```
Query: 127 RYKESYIVTMVDKYWAVREASRPLKRIFKKPIRFSRKFLGSHN            169
            RYKESYIVTMVDKYWAV+EA  PL++ +      RK L SHN
Sbjct: 123 RYKESYIVTMVDKYWAVKEAVTPLRQKWSNRRFLRRKTLQSHN            165
```

Based on this analysis, it was predicted that these proteins and their epitopes could be useful antigens for vaccines or diagnostics.

EXAMPLE 1549

A DNA sequence (GBSx1640) was identified in *S. agalactiae* <SEQ ID 4779> which encodes the amino acid sequence <SEQ ID 4780>. Analysis of this protein sequence reveals the following:

```
Possible site: 37
>>> Seems to have no N-terminal signal sequence
    INTEGRAL    Likelihood = -3.03    Transmembrane   213-229 (212-229)

----- Final Results -----
             bacterial membrane --- Certainty = 0.2211(Affirmative) < succ>
             bacterial outside  --- Certainty = 0.0000(Not Clear)   < succ>
           bacterial cytoplasm  --- Certainty = 0.0000(Not Clear)   < succ>
```

A related GBS nucleic acid sequence <SEQ ID 9413> which encodes amino acid sequence <SEQ ID 9414> was also identified.

The protein has homology with the following sequences in the GENPEPT database.

```
>GP: AB14825 GB: Z99118 similar to rRNA methylase [Bacillus subtilis]
Identities = 96/228 (42%), Positives = 143/228 (62%), Gaps = 5/228 (2%)

Query:   3 QKKYRKSSYLIEGWHLFEEAEKYGAQFLNIFVT-ETAIDR-LRKPERAIVVTDDVLKELT   60
           +++ + +++LIEG HL EEA K       I V  ET I   L    +  ++++D    +T
Sbjct:  22 KERTKTNTFLIEGEHLVEEALKSPGIVKEILVKDETRIPSDLETGIQCYMLSEDAFSAVT   81

Query:  61 DSQTPQGIVAEIAFQETRWTDIKKGRFLVLEDVQDPGNLGTMVRTADAANFDAVFLSQKS  120
           +++TPQ I A     E +    +K   L+++ VQDPGNLGTM+RTADAA  DAV L   +
Sbjct:  82 ETETPQQIAAVCHMPEEKLATARK--VLLIDAVQDPGNLGTMIRTADAAGLDAVVLGDGT  139

Query: 121 ADLYNQKTLRSMQGSHFHLPVFRVEIEQFVNFCKAEGITMIATTLSEQSVNYKNLPKYDY  180
           AD +N KTLRS QGSHFH+PV R   +V+   KAEG+ + T L +     Y+ +P+ +
Sbjct: 140 ADAFNGKTLRSAQGSHFHIPVVRRNLPSYVDELKAEGVKVYGTAL-QNGAPYQEIPQSES  198

Query: 181 FALIMGNEGQGISKTMTEEADVLAHIEMPGQAESLNVAVAAGVVIFSL            228
           FALI+GNEG G+   + E+ D+  ++ + GQAESLNVAVAA ++++ L
Sbjct: 199 FALIVGNEGAGVDAALLEKTDLNLYVPLYGQAESLNVAVAAAILVYHL            246
```

A related DNA sequence was identified in *S. pyogenes* <SEQ ID 4781> which encodes the amino acid sequence <SEQ ID 4782>. Analysis of this protein sequence reveals the following:

```
Possible site: 61
>>> Seems to have no N-terminal signal sequence
    INTEGRAL    Likelihood = -2.97    Transmembrane     229-245 (228-245)

----- Final Results -----
             bacterial membrane --- Certainty = 0.2190 (Affirmative) < succ>
             bacterial outside  --- Certainty = 0.0000 (Not Clear)   < succ>
           bacterial cytoplasm  --- Certainty = 0.0000 (Not Clear)   < succ>
```

An alignment of the GAS and GBS proteins is shown below.

```
Identities = 141/229 (61%), Positives = 178/229 (77%)

Query:    1 MLQKKYRKSSYLIEGWHLFEEAEKYGAQFLNIFVTETAIDRLRKPERAIVVTDDVLKELT   60
            +LQKK+RK SYLIEGWHLFEEA+K G  F +IFV E  ++RL  +  ++V+  VLKELT
Sbjct:   17 LLQKKHRKQSYLIEGWHLFEEAQKSGQVFRHIFVLEEMVERLAGEQELVIVSPQVLKELT   76

Query:   61 DSQTPQGIVAEIAFQETRWTDIKKGRFLVLEDVQDPGNLGTMVRTADAANFDAVFLSQKS  120
            DS +PQGIVAE+  +  +    KG++LVLEDVQDPGNLGT++RTADAA FD VFLS+KS
Sbjct:   77 DSPSPQGIVAEVEIPKLAFPSDYKGKYLVLEDVQDPGNLGTIIRTADAARFDGVFLSEKS  136

Query:  121 ADLYNQKTLRSMQGSHFHLPVFRVEIEQFVNFCKAEGITMIATTLSEQSVNYKNLPKYDY  180
            AD+YNQKTLRSMQGSHFHLP++R ++ Q       +  ++ATTLS++SV+YK+L  ++
Sbjct:  137 ADIYNQKTLRSMQGSHFHLPIWRTDVYQLCRELQEYETPILATTLSKKSVDYKSLTHHER  196

Query:  181 FALIMGNEGQGISKTMTEEADVLAHIEMPGQAESLNVAVAAGVVIFSLI             229
             AL++GNEGQGIS  M    AD L HI MPGQAESLNVAVAAG++IFSLI
Sbjct:  197 LALVLGNEGQGISAEMAALADQLVHITMPGQAESLNVAVAAGILIFSLI             245
```

Based on this analysis, it was predicted that these proteins and their epitopes could be useful antigens for vaccines or diagnostics.

A related GBS gene <SEQ ID 8839> and protein <SEQ ID 8840> were also identified. Analysis of this protein sequence reveals the following:

```
Lipop: Possible site: -1 Crend: 7
McG: Discrim Score: -7.98
GvH: Signal Score (-7.5): -3.86
    Possible site: 37
>>> Seems to have no N-terminal signal sequence
ALOM program count: 1 value: -3.03 threshold: 0.0
    INTEGRAL     Likelihood = -3.03    Transmembrane     213-229 (212-229)
    PERIPHERAL   Likelihood = 5.14     149
modified ALOM score: 1.11

*** Reasoning Step: 3

----- Final Results -----
          bacterial membrane --- Certainty = 0.2211 (Affirmative) < succ>
           bacterial outside --- Certainty = 0.0000 (Not Clear)   < succ>
          bacterial cytoplasm --- Certainty = 0.0000 (Not Clear)   < succ>
```

The protein has homology with the following sequences in the databases:

```
ORF02468(259-984 of 1287)
EGAD|107730|BS2859(4-246 of 248) hypothetical protein {Bacillus subtilis}
GP|1770029|emb|CAA99602.1||Z75208 hypothetical protein {Bacillus subtilis}
GP|2635330|emb|CAB14825.1||Z99118 similar to rRNA methylase {Bacillus subtilis}
PIR|G69984 rRNA methylase homolog ysgA-Bacillus subtilis
% Match = 20.3
% Identity = 43.0    % Similarity = 62.3
Matches = 105   Mismatches = 87   Conservative Sub.s = 47
    186        216        246        276        306        330        360        390
A*RNPTP*TRPETIK*TFFIT*PLF*YNRXMTTIITSKSNNLIKKTKKLLQKKYR--KSSYLIEGWHLFEEAEKYGAQFL
                                         |   |  :|  ||| ||  |   :::||||  ||  ||| |
                                    MKQIESAKNQKVKDWKKLHTKKERTKTNTFLIEGEHLVEEALKSPGIVK
                                              10         20         30         40
    417        444        474        504        534        564        594        624
NIFVT-ETAI-DRLRKPERAIVVTDDVLKELTDSQTPQGIVAEIAFQETRWTDIKKGRFLVLEDVQDPGNLGTMVRTADA
 |:|   ||  |      :  :|:::| :   :|:::|||  | :       :||||||   :||||| :
EILVKDETRIPSDLETGIQCYMLSEDAFSAVTETETPQQIAAVCHMPEEKLA--TARKVLLIDAVQDPGNLGTMIRTADA
       60         70         80         90        100        110        120
    654        684        714        744        774        804        834        864
ANFDAVFLSQKSADLYNQKTLRSMQGSHFHLPVFRVEIEQFVNFCKAEGITMIATTLSEQSVNYKNLPKYDYFALIMGNE
|  :|||  |   :||  :||  |||||:||  ||||||:||  |    :|:    ||||  |  |    |:  :| :   ||||:|||
AGLDAVVLGDGTADAFNGKTLRSAQGSHFHIPVVRRNLPSYVDELKAEGVKVYGTAL-QNGAPYQEIPQSESFALIVGNE
         140        150        160        170        180        190        200
    894        924        954        984       1014       1044       1074       1104
GQGISKTMTEEADVLAHIEMPGQAESLNVAVAAGVVIFSLI*VHML*YPQRGDYNEKVSRR*GLHGFGRSPY*PSTFPKT
| |:  : |:  |  :: : ||||||||||||||| ::::  |
GAGVDAALLEKTDLNLYVPLTGQAESLNVAVAAAILVYHLRG
         220        230        240
```

SEQ ID 8840 (GBS430) was expressed in *E. coli* as a His-fusion product. SDS-PAGE analysis of total cell extract is shown in FIG. 77 (lane 5; MW 29 kDa).

GBS430-GST was purified as shown in FIG. 220, lane 8.

EXAMPLE 1550

A DNA sequence (GBSx1641) was identified in *S. agalactiae* <SEQ ID 4783> which encodes the amino acid sequence <SEQ ID 4784>. This protein is predicted to be acylphosphatase (acyP). Analysis of this protein sequence reveals the following:

```
Possible site: 48
>>> Seems to have an uncleavable N-term signal seq

----- Final Results -----
          bacterial membrane --- Certainty = 0.0000 (Not Clear) < succ>
           bacterial outside --- Certainty = 0.0000 (Not Clear) < succ>
         bacterial cytoplasm --- Certainty = 0.0000 (Not Clear) < succ>
```

A related GBS nucleic acid sequence <SEQ ID 10073> which encodes amino acid sequence <SEQ ID 10074> was also identified.

The protein has homology with the following sequences in the GENPEPT database.

```
>GP: AAD36630 GB: AE001801 acylphosphatase, putative [Thermotoga
maritima]
Identities = 35/88 (39%), Positives = 52/88 (58%), Gaps = 3/88 (3%)

Query:  24 MKKVHLIVSGRVQGVGFRYATYSLALEIGDIYGRVWNNDDGTVEILAQSTDSNKMTQFIQ    83
           MK + + V G VQGVGFRY T  +A  +G + G V N DDG+V I A+  D N + +F+
Sbjct:   1 MKALKIRVEGIVQGVGFRYFTRRVAKSLG-VKGYVMNMDDGSVFIHAEG-DENALRRFLN   58

Query:  84 KIRKGPSKWSKVTYVDIKLDNFDDFNDF                                 111
           ++ KGP   + VT V ++    + + DF
Sbjct:  59 EVAKGPPA-AVVTNVSVEETTPEGYEDF                                  85
```

A related DNA sequence was identified in *S. pyogenes* <SEQ ID 4785> which encodes the amino acid sequence <SEQ ID 4786>. Analysis of this protein sequence reveals the following:

```
Possible site: 34
>>> Seems to have no N-terminal signal sequence

----- Final Results -----
         bacterial cytoplasm --- Certainty = 0.2433 (Affirmative) < succ>
          bacterial membrane --- Certainty = 0.0000 (Not Clear) < succ>
           bacterial outside --- Certainty = 0.0000 (Not Clear) < succ>
```

An alignment of the GAS and GBS proteins is shown below.

```
Identities = 69/95 (72%), Positives = 85/95 (88%)

Query:  19 KRGQVMKKVHLIVSGRVQGVGFRYATYSLALEIGDIYGRVWNNDDGTVEILAQSTDSNKM    78
           K   +M+KV LIVSGRVQGVGFRYAT++LAL+IGDIYGRVWNN+DGTVEILAQS DS+K+
Sbjct:   7 KEALLMQKVRLIVSGRVQGVGFRYATHTLALDIGDIYGRVWNNNDGTVEILAQSKDSDKI   66

Query:  79 TQFIQKIRKGPSKWSKVTYVDIKLDNFDDFNDFKM                          113
           FIQ++RKGPSKW+KVTYVD+ + NF+DF DF++
Sbjct:  67 ATFIQEVRKGPSKWAKVTYVDVTMANFEDFQDFQI                          101
```

Based on this analysis, it was predicted that these proteins and their epitopes could be useful antigens for vaccines or diagnostics.

EXAMPLE 1551

A DNA sequence (GBSx1642) was identified in *S. agalactiae* <SEQ ID 4787> which encodes the amino acid sequence <SEQ ID 4788>. This protein is predicted to be membrane protein homolog (yidC). Analysis of this protein sequence reveals the following:

```
Possible site: 16
>>> May be a lipoprotein
     INTEGRAL      Likelihood = -12.52    Transmembrane          60-76 (54-83)
     INTEGRAL      Likelihood = -3.66     Transmembrane         178-194 (177-196)
     INTEGRAL      Likelihood = -2.76     Transmembrane         140-156 (137-157)
     INTEGRAL      Likelihood = -2.60     Transmembrane         216-232 (213-232)

----- Final Results -----
               bacterial membrane --- Certainty = 0.6010 (Affirmative) < succ>
                bacterial outside --- Certainty = 0.0000 (Not Clear)   < succ>
              bacterial cytoplasm --- Certainty = 0.0000 (Not Clear)   < succ>
```

A related OBS nucleic acid sequence <SEQ ID 10075> which encodes amino acid sequence <SEQ ID 10076> was also identified.

The protein has homology with the following sequences in the GENPEPT database.

```
>GP: AAF03934 GB: AF139908 membrane protein homolog [Listeria
monocytogenes]
Identities = 82/222 (36%), Positives = 133/222 (58%), Gaps = 4/222 (1%)

Query:    44 PMANLITYFAQHQGLGFGVAIIIVTVIVRVVILPLGLYQSWKASYQAEKMAYFKPLFEPI  103
              P  + I + A+   G  +G+AIII T+++R +I+PL L  +         KMA  KP + I
Sbjct:     3 PFTSFIMFVAKFVGGNYGIAIIITTLLIRALIMPLNLRTAKAQMGMQSKMAVAKPEIDEI   62

Query:   104 NERLRNAKTQEEKLAAQTELMTAQRENGLSMFGGIGCLPLLIQMPFFSAIFFAARYTPGV  163
                RL+ A ++EE+    Q E+M   +  ++      +GCLPLLIQMP    A ++A R +  +
Sbjct:    63 QARLKRATSKEEQATIQKEMMAVYSKYNINPMQ-MGCLPLLIQMPILMAFYYAIRGSSEI  121

Query:   164 SSATFLGLNLGQKSLTLTVIIAILYFVQSWLSMQGVPDEQRQQMKTMMYLMPIMMVFMSI  223
              +S TFL  NLG   + L +I  ++Y  Q ++SM G    EQ++QMK +   + PIM++F+S
Sbjct:   122 ASHTFLWFNLGSPDMVLAIIAGLVYLAQYFVSMIGYSPEQKKQMKIIGLMSPIMILFVSF  181

Query:   224 SLPASVALYWFIGGIFSIIQQLVT--TYVLK-PKLRRKVEEE                   262
              + P+++ALYW +GG+F    Q L+T    Y+ K  P+++    +EE
Sbjct:   182 TAPSALALYWAVGGLFLAGQTLLTKKLYMNKHPEIKVMEQEE                   223
```

A related DNA sequence was identified in *S. pyogenes* <SEQ ID 4789> which encodes the amino acid sequence <SEQ ID 4790>. Analysis of this protein sequence reveals the following:

```
Possible site: 31
>>> May be a lipoprotein
     INTEGRAL      Likelihood = -9.55    Transmembrane          62-78 (54-82)

INTEGRAL      Likelihood = -2.81    Transmembrane         178-194 (177-195)

INTEGRAL      Likelihood = -0.90    Transmembrane         216-232 (215-232)

----- Final Results -----
               bacterial membrane --- Certainty = 0.4821 (Affirmative) < succ>
                bacterial outside --- Certainty = 0.0000 (Not Clear)   < succ>
              bacterial cytoplasm --- Certainty = 0.0000 (Not Clear)   < succ>
```

The protein has homology with the following sequences in the databases:

```
>GP: AAF03934 GB: AF139908 membrane protein homolog [Listeria monocytogenes]
Identities = 89/218 (40%), Positives = 132/218 (59%), Gaps = 2/218 (0%)

Query:  43 KPMSYFIDYFANNAGLGYGLAIIIVTIIVRTLILPLGLYQSWKASYQSEKMAFLKPVFEP   102
           +P + FI + A   G  YG+AIII T+++R LI+PL L +          KMA  KP +
Sbjct:   2 QPFTSFIMFVAKFVGGNYGIAIIITTLLIRALIMPLNLRTAKAQMGMQSKMAVAKPEIDE   61

Query: 103 INKRIKQANSQEEKMAAQTELMAAQRAHGINPLGGIGCLPLLIQMPFFSAMYFAAQYTKG   162
           I  R+K+A S+EE+   Q E+MA    + INP+ +GCLPLLIQMP   A Y+A + +
Sbjct:  62 IQARLKRATSKEEQATIQKEMMAVYSKYNINPMQ-MGCLPLLIQMPILMAFYYAIRGSSE   120

Query: 163 VSTSTFMGIDLGSRSLVLTAIIAALYFFQSWLSMMAVSEEQREQMKTMMYTMPIMMIFMS   222
           +++ TF+  +LGS +VL I   +Y  Q ++SM+  S EQ++QMK +    PIM++F+S
Sbjct: 121 IASHTFLWFNLGSPDMVLAIIAGLVYLAQYFVSMIGYSPEQKKQMKIIGLMSPIMILFVS   180

Query: 223 FSLPAGVGLYWLVGGFFSIIQQLITTYLLKPRLHKQIK                        260
           F+ P+ + LYW VGG F   Q L+T  L    + H +IK
Sbjct: 181 FTAPSALALYWAVGGLFLAGQTLLTKKLYMNK-HPEIK                        217
```

An alignment of the GAS and GBS proteins is shown below.

```
Identities = 203/309 (65%), Positives = 254/309 (81%), Gaps = 2/309 (0%)

Query:    1 MKKTLKRILFSSLSLSMLLLLTGCVSVDKAGKPYGVIWNTLGVPMANLITYFAQHQGLGF   60
            +K TL RILFS L+LS+LL LTGCV  D  G P G+IW  LG PM+  I YFA + GLG+
Sbjct:    1 LKLTLNRILFSGLALSILLLTLTGCVGRDAHGNPKGMIWEFLGKPMSYFIDYFANNAGLGY   60

Query:   61 GVAIIIVTVIVRVVILPLGLYQSWKASYQAEKMAYFKPLFEPINERLRNAKTQEEKLAAQ   120
            G+AIIIVT+IVR +ILPLGLYQSWKASYQ+EKMA+ KP+FEPIN+R++  A +QEEK+AAQ
Sbjct:   61 GLAIIIVTIIVRTLILPLGLYQSWKASYQSEKMAFLKPVFEPINKRIKQANSQEEKMAAQ   120

Query:  121 TELMTAQRENGLSMFGGIGCLPLLIQMPFFSAIFFAARYTPGVSSATFLGLNLGQKSLTL   180
            TELM AQR +G++  GGIGCLPLLIQMPFFSA++FAA+YT GVS++TF+G++LG +SL L
Sbjct:  121 TELMAAQRAHGINPLGGIGCLPLLIQMPFFSAMYFAAQYTKGVSTSTFMGIDLGSRSLVL   180

Query:  181 TVIIAILYFVQSWLSMQGVPDEQRQQMKTMMYLMPIMMVFMSISLPASVALYWFIGGIFS   240
            T IIA LYF QSWLSM  V +EQR+QMKTMMY MPIMM+FMS SLPA V LYW +GG FS
Sbjct:  181 TAIIAALYFFQSWLSMMAVSEEQREQMKTMMYTMPIMMIFMSFSLPAGVGLYWLVGGFFS   240

Query:  241 IIQQLVTTYVLKPKLRRKVEEEYTKNPPKAYKANNARKDVTNSTKATESNQAIITSKKTN   300
            IIQQL+TTY+LKP+L ++++EEY KNPPKAY++ ++RKDVT S    ++N +    K+N
Sbjct:  241 IIQQLITTYLLKPRLHKQIKEEYAKNPPKAYQSTSSRKDVTPSQNMEQAN--LPKKIKSN   298

Query:  301 RNAGKQKRR                                                    309
            RNAGKQ++R
Sbjct:  299 RNAGKQRKR                                                    307
```

A related GBS gene <SEQ ID 8841> and protein <SEQ ID 8842> were also identified. Analysis of this protein sequence reveals the following:

```
Lipop: Possible site: 23 Crend: 6
McG: Discrim Score: 8.74
GvH: Signal Score (-7.5): -1.47
   Possible site: 16
>>> May be a lipoprotein
ALOM program count: 4 value: -12.52 threshold: 0.0
    INTEGRAL   Likelihood = -12.52    Transmembrane    60-76   (54-83)
    INTEGRAL   Likelihood =  -3.66    Transmembrane   178-194  (177-196)
    INTEGRAL   Likelihood =  -2.76    Transmembrane   140-156  (137-157)
    INTEGRAL   Likelihood =  -2.60    Transmembrane   216-232  (213-232)
PERIPHERAL Likelihood = 0.74  235
modified ALOM score: 3.00

*** Reasoning Step: 3

----- Final Results -----
            bacterial membrane  --- Certainty = 0.6010 (Affirmative) < succ>
            bacterial outside   --- Certainty = 0.0000 (Not Clear)   < succ>
            bacterial cytoplasm --- Certainty = 0.0000 (Not Clear)   < succ>
```

The protein has homology with the following sequences in the databases:

```
37.9/63.7% over 193aa
Bacillus subtilis
EGAD|45886| hypothetical 30.7 kd lipoprotein in glnq-ansr intergenic region
precursor Insert characterized
SP|P54544|YQJG_BACSU HYPOTHETICAL 30.7 KDA LIPOPROTEIN IN GLNQ-ANSR INTERGENIC
REGION PRECURSOR. Insert characterized
GP|1303958|dbj|BAA12613.1||D84432 YqjG Insert characterized
GP|2634823|emb|CAB14320.1||Z99116 similar to lipoprotein SpoIIIJ=like Insert
characterized
PIR|G69963|G69963 lipoprotein SpoIIIJ-like homolog yqjG-Insert characterized
ORF02470(478-1038 of 1530)
EGAD|45886|BS2384(63-256 of 275) hypothetical 30.7 kd lipoprotein in glnq-ansr
intergenic region precursor {Bacillus subtilis}SP|P54544|YQJG_BACSU HYPOTHETICAL
30.7 KDA LIPOPROTEIN IN GLNQ-ANSR INTERGENIC REGION
PRECURSOR.GP|1303958|dbj|BAA12613.1||D84432 YqjG {Bacillus subtilis}
GP|2634823|emb|CAB14320.1||Z99116 similar to lipoprotein SpoIIIJ-like
{Bacillus subtilis}PIR|G69963|G69963 lipoprotein SpoIIIJ-like homolog yqjG-
Bacillus subtilis
% Match = 13.0
% Identity = 37.9    % Similarity = 63.7
Matches = 72    Mismatches = 65    Conservative Sub.s = 49
     252       282       312       342       372       402       432       462
FCGSIV*FLKKK*NR*VY*KLEELKTLKKTLKRILFSSLSLSMLLLLTGCVSVDKAGKPYGVIWNTLGVPMANLITYFAQ MLKTYQKLLAMGIFLIVLCSGNAAFAATNQVGGLSNVGFFHDYLIEPFSALLKGVAG
                                 10        20        30        40        50
     492       522       552       582       612       642       672       702
HQGLGFGVAIIIVTVIVRVVILPLGLYQSWKASYQAEKMAYFKPLFEPINERLRNAKTQEEKLAAQTELMTAQRENGLSM
 :|::||:||:||||:||| :  |     ||||  ||   |:|    |:: |   |:|       ||    |
LFHGEYGLSIILVTIIVRIVVLPLFVNQFKKQRIFQEKMAVIKPQVDSIQVKLKKTDPEKQKELQMEMMKLYQEHNINP
         70        80        90        100       110       120       130
     732       762       792       822       852       894       918
FGGIGCLPLLIQMPFFSAIFFAARYTPGVSSATFLGLNLGQKSLTLTVIIAILYFVQSW----LSMQ--GVPDE--QRQQ
 :||||:|||  |   :::| | ||::| :|| ::|  :|::   |:||||::  ||: ||   :|
-LAMGCLPMLIQSPIMIGLYYAIRSTPEIASHSFLWSFLGQSDILMSLSAGIMYFVQAYIAQKLSAKYSAVPQNPAAQQS
         150       160       170       180       190       200       210
     948       978       1008      1038      1068      1098      1128      1158
MKTMMYLMPIMMVFMSISLPASVALYWFIGGIFSIIQQLVTTYVLKPKLRRKVEEEYTKNPPKAYKANNARKDVTNSTKA
 | |:::|:||      |:::||:: ||||  |:|   :|   :|    :        |   |
AKLMVFIFPVMMTIFSLNVPAALPLYWFTSGLFLTVQNIVLQMTHHKSKKTAALTESVK
         230       240       250       260       270
37.2/62.0% over 220aa
Listeria monocytogenes
GP|6117974|membrane protein homolog Insert characterized
ORF02470(430-1086 of 1530)
GP|6117974|gb|AAF03934.1|AF139908_4|AF139908(3-223 of 237) membrane protein
homolog {Listeria monocytogenes}
% Match = 14.6
% Identity = 37.1    % Similarity = 62.0
Matches = 82    Mismatches = 81    Conservative Sub.s = 55
     285       315       345       375       405       435       465       495
K*NR*VY*KLEELKTLKKTLKRILFSSLSLSMLLLLTGCVSVDKAGKPYGVIWNTLGVPMANLITYFAQHQGLGFGVAII
                                                       | :::|: |:   | :|:|||
                                                    IQPFTSFIMFVAKFVGGNYGIAII
                                                               10        20
     525       555       585       615       645       675       705       735
IVTVIVRVVILPLGLYQSWKASYQAEKMAYFKPLFEPINERLRNAKTQEEKLAAQTELMTAQRENGLSMFGGIGCLPLLI
| |::: :|:||  |     ||| |   :    |  |   |:|    |:: |   |:|       ||  :||||||
ITTLLIRALIMPLNLRTAKAQMGMQSKMAVAKPEIDEIQARLKRATSKEEQATIQKEMMAVYSKYNINP-MQMGCLPLLI
            40        50        60        70        80        90        100
     765       795       825       855       885       915       945       975
QMPFFSAIFFAARYTPGVSSATFLGLNLGQKSLTLTVIIAILYFVQSWLSMQGVPDEQRQQMKTMMYLMPIMMVFMSISL
|||  :  ::|| |  :   ::| |||  :||| :|||  :|:|  ::|:  |  ::||    ||::|:  :  ||::|: :
QMPILMAFYYAIRGSSEIASHTFLWFNLGSPDMVLAIIAGLVYLAQYFVSMIGYSPEQKKQMKIIGLMSPIMILFVSFTA
            120       130       140       150       160       170       180
     1005      1035      1086      1116      1146      1176      1206
PASVALYWFIGGIFSIIQQLVTT--YVLK-PKLRRKVEEEYTKNPPKAYKANNARKDVTNSTKATESNQAIITSKKTNRN
|:::||||:||:|    |:|    | |:::        :|||
PSALALYWAVGGLFLAGQTLLTKKLYMNKHPEIKVMEQEEKEFEQIVEEQKKEK
            200       210       220       230
```

Based on this analysis, it was predicted that these proteins and their epitopes could be useful antigens for vaccines or diagnostics.

EXAMPLE 1552

A DNA sequence (GBSx1644) was identified in *S. agalactiae* <SEQ ID 4791> which encodes the amino acid sequence <SEQ ID 4792>. This protein is predicted to be amino acid ABC transporter, permease protein. Analysis of this protein sequence reveals the following:

```
Possible site: 48
>>> Seems to have no N-terminal signal sequence
INTEGRAL Likelihood = -9.98 Transmembrane  32-48 (23-53)
INTEGRAL Likelihood = -9.18 Transmembrane 195-211 (189-213)
INTEGRAL Likelihood = -8.70 Transmembrane  72-88 (62-93)

----- Final Results -----
            bacterial membrane --- Certainty = 0.4991 (Affirmative) < succ>
             bacterial outside --- Certainty = 0.0000 (Not Clear)   < succ>
           bacterial cytoplasm --- Certainty = 0.0000 (Not Clear)   < succ>
```

The protein has homology with the following sequences in the GENPEPT database.

```
>GP: CAB12131 GB: Z99105 similar to amino acid ABC transporter
(permease) [Bacillus subtilis]
Identities = 116/217 (53%), Positives = 168/217 (76%)

Query:   2 INWDAIFNLELAVKAFPSVIQGLPYTIGLSLVGFILGAIVGFFVALMKMSHFRLLRYLAN  61
           I W+ IFN +LA+++FP VI+G+ YT+ +S V    G ++G F++L +MS   LLR+ A
Sbjct:   5 IQWEYIFNTKLAIESFPYVIKGIGYTLLISFVSMFAGTVIGLFISLARMSKLALLRWPAK  64

Query:  62 IHISLMRGIPLMVLLFLIYFGLPFIGIQLDAVTASIVGFTMMSSAYISEIIRAALLAVDH 121
           ++IS MRG+P++V+LF++YFG P+IGI+  AVTA+++GF++ S+AYI+EI R+A+ +V+
Sbjct:  65 LYISFMRGVPILVILFILYFGFPYIGIEFSAVTAALIGFSLNSAAYIAEINRSAISSVEK 124

Query: 122 GQWEAARALGLKTPTIYRGIIIPQATRIALPSLSNVLLDMVKSSSLTAMITVPDIFNNAK 181
           GQWEAA +LGL     RGII+PQ+ RIALP L+NVLLD++K+SSL AMITVP++  +AK
Sbjct: 125 GQWEAASSLGLSYWQTMRGIILPQSIRIALPPLANVLLDLIKASSLAAMITVPELLQHAK 184

Query: 182 IVGGTYSDYMTAYILVALIYWVICTLYAIIQDWWEKR                        218
           I+GG   DYMT YIL ALIYW IC++ A+ Q+  EK+
Sbjct: 185 IIGGREFDYMTMYILTALIYWAICSIAAVFQNILEKK                        221
```

A related DNA sequence was identified in *S. pyogenes* <SEQ ID 4793> which encodes the amino acid sequence <SEQ ID 4794>. Analysis of this protein sequence reveals the following:

```
Possible site: 23
>>> Seems to have an uncleavable N-term signal seq
INTEGRAL Likelihood = -6.79 Transmembrane 186-202 (184-205)
INTEGRAL Likelihood = -5.84 Transmembrane  26-42 (21-43)
INTEGRAL Likelihood = -4.78 Transmembrane  57-73 (56-84)
INTEGRAL Likelihood = -1.59 Transmembrane  86-102 (86-103)

----- Final Results -----
            bacterial membrane --- Certainty = 0.3718 (Affirmative) < succ>
             bacterial outside --- Certainty = 0.0000 (Not Clear)   < succ>
           bacterial cytoplasm --- Certainty = 0.0000 (Not Clear)   < succ>
```

The protein has homology with the following sequences in the databases:

```
>GP: CAB12131 GB: Z99105 similar to amino acid ABC transporter
(permease) [Bacillus subtilis]
Identities = 113/214 (52%), Positives = 157/214 (72%)

Query:   1 MINIPLMKDSLGFVLSGLPYTLGISLLSFFTGLFLGLGLALLGRSRQPLIHYLVRAYISI  60
           + N  L +S +V+ G+ YTL IS +S F G  +GL ++L   S+  L+ +   YIS
Sbjct:  10 IFNTKLAIESFPYVIKGIGYTLLISFVSMFAGTVIGLFISLARMSKLALLRWPAKLYISF  69

Query:  61 MRGVPMIVVLFVLYFGLPYYGLELPALLCAYLGFSMVSAAYISEVFRSSIEAIDKGQWEA 120
           MRGVP++V+LF+LYFG PY G+E  A+   A +GFS+ SAAYI+E+ RS+I +++GQWEA
Sbjct:  70 MRGVPILVILFILYFGFPYIGIEFSAVTAALIGFSLNSAAYIAEINRSAISSVEKGQWEA 129

Query: 121 AKALGLPYALMVKKIILPQAFRIAVPPLGNVIIDMVKSSSLAAMITVPDIFQNAKIIGGR 180
           A +LGL Y    ++ IILPQ+ RIA+PPL NV++D++K+SSLAAMITVP++  Q+AKIIGGR
Sbjct: 130 ASSLGLSYWQTMRGIILPQSIRIALPPLANVLLDLIKASSLAAMITVPELLQHAKIIGGR 189

Query: 181 EWDYMSMYILVAFIYWLIAFLLERYQEFLENKLA                           214
           E+DYM+MYIL A IYW I +   +Q  LE K A
Sbjct: 190 EFDYMTMYILTALIYWAICSIAAVFQNILEKKYA                           223
```

An alignment of the GAS and GBS proteins is shown below.

```
Identities = 110/213 (51%), Positives = 156/213 (72%)

Query:    7 IFNLELAVKAFPSVIQGLPYTIGLSLVGFILGAIVGFFVALMKMSHFRLLRYLANIHISL   66
            + N+ L   +   V+ GLPYT+G+SL+ F  G  +G  +AL+  S   L+ YL   +IS+
Sbjct:    1 MINIPLMKDSLGFVLSGLPYTLGISLLSFFTGLFLGLGLALLGRSRQPLIHYLVRAYISI   60

Query:   67 MRGIPLMVLLFLIYFGLPFIGIQLDAVTASIVGFTMMSSAYISEIIRAALLAVDHGQWEA  126
            MRG+P++V+LF++YFGLP+ G++L A+   +  +GF+M+S+AYISE+ R+++ A+D GQWEA
Sbjct:   61 MRGVPMIVVLFVLYFGLPYYGLELPALLCAYLGFSMVSAAYISEVFRSSIEAIDKGQWEA  120

Query:  127 ARALGLKTPTIYRGIIIPQATRIALPSLSNVLLDMVKSSSLTAMITVPDIFNNAKIVGGT  186
            A+ALGL    + + II+PQA RIA+P L NV++DMVKSSSL AMITVPDIF NAKI GG
Sbjct:  121 AKALGLPYALMVKKIILPQAFRIAVPPLGNVIIDMVKSSSLAAMITVPDIFQNAKIIGGR  180

Query:  187 YSDYMTAYILVALIYWVICTLYAIIQDWWEKRL                            219
              DYM+ YILVA IYW+I  L    Q++ E +L
Sbjct:  181 EWDYMSMYILVAFIYWLIAFLLERYQEFLENKL                            213
```

Based on this analysis, it was predicted that these proteins and their epitopes could be useful antigens for vaccines or diagnostics.

EXAMPLE 1553

A DNA sequence (GBSx1645) was identified in *S. agalactiae* <SEQ ID 4795> which encodes the amino acid sequence <SEQ ID 4796>. Analysis of this protein sequence reveals the following:

```
Possible site: 18
>>> May be a lipoprotein

----- Final Results -----
            bacterial membrane --- Certainty = 0.0000(Not Clear) < succ>
            bacterial outside  --- Certainty = 0.0000(Not Clear) < succ>
          bacterial cytoplasm  --- Certainty = 0.0000(Not Clear) < succ>
```

The protein has homology with the following sequences in the GENPEPT database.

```
>GP: CAB12132 GB: Z99105 similar to amino acid ABC transporter
(binding protein) [Bacillus subtilis]
Identities = 127/276 (46%), Positives = 183/276 (66%), Gaps = 12/276 (4%)

Query:    3 KTILLGLVGLSAMTLAACS--NGQSSKETTWDNIKKDGVLKVATPATLYPTSYYDDHK--   58
            K ++          + LAACS  N    SK+T W+ IK  G + VAT   TLYPTSY+D
Sbjct:    8 KAVIFSFTMAFFLILAACSGKNEADSKDTGWEQIKDKGKIVVATSGTLYPTSYHDTDSGS   67

Query:   59 -KLTGYEIDMMKAIAKKLKIKVKFVEVGVAESFTSVDSGKVDVAVNNFDTTPERLKKYNF  117
             KLTGYE+++++  AK+L +KV+F E+G+    T+V+SG+VD A N+ D T +R +K+ F
Sbjct:   68 DKLTGYEVEVVREAAKRLGLKVEFKEMGIDGMLTAVNSGQVDAAANDIDVTKDREEKFAF  127

Query:  118 SQPYKYSVGGMIVRADGSSKITAKDLSDWKGKKAGGGAGTQYMKIAKQQGAEPVIYDNVT  177
            S PYKYS G  IVR D  S I   K L D KGKKA G A T YM++A++ GA+ VIYDN T
Sbjct:  128 STPYKYSYGTAIVRKDDLSGI--KTLKDLKGKKAAGAATTVYMEVARKYGAKEVIYDNAT  185

Query:  178 NDVYLRDVSTGRTDFIPNDYYTQVIAVKYVTKQYPDIKVKM-GDVKYNPTEQGIVMSKKD  236
            N+ YL+DV+ GRTD I NDYY Q +A+      +PD+ + +  D+KY P +Q +VM K +
Sbjct:  186 NEQYLKDVANGRTDVILNDYYLQTLAL----AAFPDLNITIHPDIKYMPNKQALVMKKSN  241

Query:  237 KSLKTKIDAAIKDMKKDGSLKKISEKYYAGQDLTKE                         272
            +L+ K++ A+K+M KDGSL K+S++++   D++K+
Sbjct:  242 AALQKKMNEALKEMSKDGSLTKLSKQFFNKADVSKK                         277
```

There is also homology to SEQ ID 1190.

SEQ ID 4796 (GBS183) was expressed in *E. coli* as a His-fusion product. SDS-PAGE analysis of total cell extract is shown in FIG. 26 (lane 2; MW 33 kDa). GBS183-His was purified as shown in FIG. 199, lane 7.

Based on this analysis, it was predicted that this protein and its epitopes, could be useful antigens for vaccines or diagnostics.

EXAMPLE 1554

A DNA sequence (GBSx1646) was identified in *S. agalactiae* <SEQ ID 4797> which encodes the amino acid sequence <SEQ ID 4798>. Analysis of this protein sequence reveals the following:

```
Possible site: 61
>>> Seems to have no N-terminal signal sequence

----- Final Results -----
              bacterial cytoplasm --- Certainty = 0.1514(Affirmative) < succ>
               bacterial membrane --- Certainty = 0.0000(Not Clear)   < succ>
                bacterial outside --- Certainty = 0.0000(Not Clear)   < succ>
```

The protein has homology with the following sequences in the GENPEPT database.

```
>GP: AAF09821 GB: AE001885 6-aminohexanoate-cyclic-dimer hydrolase
[Deinococcus radiodurans]
Identities = 178/488 (36%), Positives = 265/488 (53%), Gaps = 17/488 (3%)

Query:    5 DATAMVQAIKQHKISSQELVEQAIYKIEEQNVSVNAVVSKQYNEARQAAKYANESNA---    61
            DA  + Q  ++ ++S++++   AI++ +  NV++NAVV   Y++    A+  + + A
Sbjct:   54 DALDLAQLFRRGELSAEDMCTAAIHRAQVVNVALNAVVYPLYDQGLAQARATDAARARGE  113

Query:   62 ----PFAGVPILLKDLGQNQKGQLSTSGSQLFKHYHAKQTDYLVQSFEKLGFIILGRTNT  117
                PFAGVP L+KD G      T G++ ++    + D LV+ ++  G + LG+TNT
Sbjct:  114 QATGPFAGVPFLVKDFGSRLAGVPHTGGTRAYRDQIPEWDDELVRRWQAAGLLPLGKTNT  173

Query:  118 PEFGFKNISDGQLHGNVNLPFDHSRNAGGSSGGAAAAVSSGMVPIAGASDGGGSIRIPAS  177
            PEF     +++ +LHG      P+D  R  GGSSGG+A+AV++G+VP+AGA DGGGSIRIPAS
Sbjct:  174 PEFALMGVTEPELHGPTRNPWDLGRTPGGSSGGSASAVAAGIVPLAGAGDGGGSIRIPAS  233

Query:  178 FNGLIGLKPSRGRIPVGPSSYRGWQGASSHFALTKSVRDTKRLLYYLQSYQVES----PF  233
             GL GLKPSRGR+P G        WQGA+    LT+SVRD+  LL   Q     +      P
Sbjct:  234 CCGLFGLKPSRGRVPCGDGVGEPWQGAAVEHVLTRSVRDSAALLDLEQGPDAGAALFLPS  293

Query:  234 PLKKLSKESLFEFSVSKPLKIAVLMDSPLKTKVSSEEAKAAIKEAADFLSQKGNHLELVEQ  293
            P +   S+E  E       L+I     PL     V  E AA++ AA  L   G+ +E V
Sbjct:  294 PERPYSEEVGRE---PGRLRIGFSTAHPLGRSVHPECVAAVQGAARLLESLGHEVEEVAL  350

Query:  294 PLDGIHSMKTYCMMNSVETAAMFDDIEKSLGRSMEFSDMELMTWAMYQSGQRVLAKDYSK  353
            P DG  + + M+   ET A   +  +LGR   SD+E +TW + Q G+   A D++
Sbjct:  351 PWDGPALAQAFLMLYFGETGASLAALRDTLGRPARASDVEAVTWLLGQLGRSYSAADFAA  410

Query:  354 LLDSWDQFAATMARFHENYDLILTAATNQPAPFHGQFD---LDETLQKQLRHMGEFSVSE  410
                SW+  A  M RFH+NYDL+LT     P    G+    +  L +  + M    +
Sbjct:  411 ARASWNVHARAMGRFHQNYDLLLTPVLATPPLQIGELQPRGVQAALLRAAQQMDVSGLLR  470

Query:  411 QQDLIWKMFEDSMAWTPFTHQPNLTGQPSLAIPTHLTKEGLPLGVQLTAAKGREDLLLAV  470
              +  +  + D + P+T   NLTGQP++++P H T +GLP+GVQ  A   RED+LL +
Sbjct:  471 RSGQVDALATDILEKMPYTQLANLTGQPAMSVPLHWTADGLPVGVQFVAPLAREDVLLRL  530

Query:  471 AELFEKEK                                                      478
            A   E+ +
Sbjct:  531 AGQLEQAR                                                      538
```

A related DNA sequence was identified in *S. pyogenes* <SEQ ID 4047> which encodes the amino acid sequence <SEQ ID 4048>. Analysis of this protein sequence reveals the following:

```
Possible site: 15
>>> Seems to have an uncleavable N-term signal seq

----- Final Results -----
               bacterial membrane --- Certainty= 0.0000 (Not Clear) < succ>
                bacterial outside --- Certainty = 0.0000(Not Clear) < succ>
              bacterial cytoplasm --- Certainty = 0.0000(Not Clear) < succ>
```

An alignment of the GAS and GBS proteins is shown below.

```
Identities = 277/484 (57%), Positives = 348/484 (71%), Gaps = 2/484 (0%)

Query:   1 MVFKDATAMVQAIKQHKISSQELVEQAIYKIEEQNVSVNAVVSKQYNEARQAAKYANESN   60
           M ++DATAM  A++  + +  ELV QAIYK ++ N ++NA+ S+++  A + AK  + S
Sbjct:   1 MTYQDATAMAIAVQTGQTTPLELVTQAIYKAKKLNPTLNAITSERFEAALEEAKQRDFSG   60

Query:  61 APFAGVPILLKDLGQNQKGQLSTSGSQLFKHYHAKQTDYLVQSFEKLGFIILGRTNTPEF  120
             PFAGVP+ LKDLGQ  KG  STSGS+LFK Y A +TD V+  E LGFIILGR+NTPEF
Sbjct:  61 LPFAGVPLFLKDLGQELKGHSSTSGSRLFKEYQATKTDLFVKRLEALGFIILGRSNTPEF  120

Query: 121 GFKNISDGQLHGNVNLPFDHSRNAGGSSGGAAAAVSSGMVPIAGASDGGGSIRIPASFNG  180
           GFKNISD  LHG VNLP D++RNAGGSSGGAAA VSSG+  +A ASDGGGSIRIPASFNG
Sbjct: 121 GFKNISDSSLHGPVNLPRDNTRNAGGSSGGAAALVSSGISALATASDGGGSIRIPASFNG  180

Query: 181 LIGLKPSRGRIPVGPSSYRGWQGASSHFALTKSVRDTKRLLYYLQSYQVESPFPLKKLSK  240
           LIGLKPSRGR+PVGP SYR WQGAS HFALTKSVRDT+ LLYYLQ  Q+ESPFPL  L+K
Sbjct: 181 LIGLKPSRGRMPVGPGSYRSWQGASVHFALTKSVRDTRNLLYYLQMEQMESPFPLATLTK  240

Query: 241 ESLFEFSVSKPLKIAVLMDSPLKTKVSSEAKAAIKEAADFLSQKGNHL-ELVEQPLDGIH  299
           +S+++ S+ +PL IA         + VS +   A+++A  +L ++G+ L EL E P++
Sbjct: 241 DSIYQ-SLQRPLTIAFYQRLSDGSPVSLDTAKALRQAVTWLREQGHQLVELEEFPVNMTE  299

Query: 300 SMKTYCMMNSVETAAMFDDIEKSLGRSMEFSDMELMTWAMYQSGQRVLAKDYSKLLDSWD  359
              ++ Y +MNSVETAAMF DIE + GR M   DME MTWA+YQSG+  A   YS++L  WD
Sbjct: 300 VIRHYYIMNSVETAAMFADIEDTFGRPMTKDDMETMTWAIYQSGKDIPAWRYSQVLQKWD  359

Query: 360 QFAATMARFHENYDLILTAATNQPAPFHGQFDLDETLQKQLRHMGEFSVSEQQDLIWKMF  419
            ++ATMA  FHE YDL+LT  TN  PAP HG+   D L   L    FS  EQ +L+ MF
Sbjct: 360 TYSATMASFHETYDLLLTFTTNTPAPKHGELVPDSKLMANLAQAEIFSSEEQFNLVETMF  419

Query: 420 EDSMAWTPFTHQPNLTGQPSLAIPTHLTKEGLPLGVQLTAAKGREDLLLAVAELFEKEKQ  479
            +S+A  P+T  PNLTGQP++++PT+ TKEGL +G+QL AAKGREDLLL +AE FE
Sbjct: 420 GKSLAINPYTALPNLTGQPAISLPTYETKEGLSMGIQLIAAKGREDLLLGIAEQFEAAGL  479

Query: 480 FKGP  483
              K P
Sbjct: 480 LKIP  483
```

Based on this analysis, it was predicted that these proteins and their epitopes could be useful antigens for vaccines or diagnostics.

EXAMPLE 1555

A DNA sequence (GBSx1647) was identified in *S. agalactiae* <SEQ ID 4799> which encodes the amino acid sequence <SEQ ID 4800>. This protein is predicted to be transcription elongation factor (greA). Analysis of this protein sequence reveals the following:

```
Possible site: 53
>>> Seems to have no N-terminal signal sequence

----- Final Results -----
          bacterial cytoplasm --- Certainty = 0.5003(Affirmative) < succ>
           bacterial membrane --- Certainty = 0.0000(Not Clear)   < succ>
            bacterial outside --- Certainty = 0.0000(Not Clear)   < succ>
```

The protein has homology with the following sequences in the GENPEPT database.

```
>GP: CAB14674 GB: Z99117 transcription elongation factor
[Bacillus subtilis]
Identities = 86/154 (55%), Positives = 114/154 (73%), Gaps = 1/154 (0%)

Query:   3 EKTYPMTQVEKDQLEKELEELKLVRRPEVVERIKIARSYGDLSENSEYDAAKDEQAFVEG   62
           EK +PMT    K +LE+ELE LK V+R EVVERIKIARS+GDLSENSEYD+AK+EQAFVEG
Sbjct:   4 EKVFPMTAEGKQKLEQELEYLKTVKRKEVVERIKIARSFGDLSENSEYDSAKEEQAFVEG  63

Query:  63 QIQILETKIRYAEIIDSDAVAKDEVAIGKTVLVQEVGTNDKDTYHIVGAAGADIFSGKIS  122
           ++  LE  IR A+II+ D    + V GKTV  E+     D+++Y IVG+A AD F GKIS
Sbjct:  64 RVTTLENMIRNAKIIEDDG-GSNVVGLGKTVTFVELPDGDEESYTIVGSAEADPFEGKIS  122
```

```
Query: 123 NESPIAHALIGKKTGDLATIESPAGSYQVEIISV                          156
            N+SPIA +L+GKK  +   T+++P G   V+I+ +
Sbjct: 123 NDSPIAKSLLGKKVDEEVTVQTPGGEMLVKIVKI                          156
```

A related DNA sequence was identified in *S. pyogenes* <SEQ ID 4801> which encodes the amino acid sequence <SEQ ID 4802>. Analysis of this protein sequence reveals the following:

```
Possible site: 27
>>> Seems to have no N-terminal signal sequence

----- Final Results -----
            bacterial cytoplasm --- Certainty = 0.4434(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below.

```
Identities = 145/160 (90%), Positives = 149/160 (92%)

Query:   1 MAEKTYPMTQVEKDQLEKELEELKLVRRPEVVERIKIARSYGDLSENSEYDAAKDEQAFV  60
           MAEKTYPMT   EK+QLEKELEELKLVRRPE+VERIKIARSYGDLSENSEYDAAKDEQAFV
Sbjct:  17 MAEKTYPMTLTEKEQLEKELEELKLVRRPEIVERIKIARSYGDLSENSEYDAAKDEQAFV  76

Query:  61 EGQIQILETKIRYAEIIDSDAVAKDEVAIGKTVLVQEVGTNDKDTYHIVGAAGADIFSGK 120
           EGQI  LETKIRYAEIIDSDAVAKDEVAIGKTV+VQEVGT DKDTYHIVGAAGADIFSGK
Sbjct:  77 EGQISTLETKIRYAEIIDSDAVAKDEVAIGKTVIVQEVGTTDKDTYHIVGAAGADIFSGK 136

Query: 121 ISNESPIAHALIGKKTGDLATIESPAGSYQVEIISVEKTN                     160
           ISNESPIA ALIGKKTGD   IESPA +Y VEIISVEKTN
Sbjct: 137 ISNESPIAQALIGKKTGDKVRIESPAATYDVEIISVEKTN                     176
```

Based on this analysis, it was predicted that these proteins and their epitopes could be useful antigens for vaccines or diagnostics.

EXAMPLE 1556

A DNA sequence (GBSx1648) was identified in *S. agalactiae* <SEQ ID 4803> which encodes the amino acid sequence <SEQ ID 4804>. This protein is predicted to be aminodeoxychorismate lyase-like protein. Analysis of this protein sequence reveals the following:

```
Possible site: 58
>>> Seems to have no N-terminal signal sequence
    INTEGRAL    Likelihood = -13.64    Transmembrane    238-254 (230-260)

----- Final Results -----
             bacterial membrane --- Certainty = 0.6456(Affirmative) < succ>
              bacterial outside --- Certainty = 0.0000(Not Clear)   < succ>
            bacterial cytoplasm --- Certainty = 0.0000(Not Clear)   < succ>
```

The protein has homology with the following sequences in the GENPEPT database.

```
>GP: AAF77615 GB: AF151720 aminodeoxychorismate lyase-like protein
[Streptococcus thermophilus]
Identities = 135/210 (64%), Positives = 171/210 (81%)

Query: 373 KTTSTPYKADDFLKLVQDETFIKKMVAKYPNLLGSLPDKSKAIYQLEGYLFPATYNYYKD 432
           K +ST  K  DFLKL++D+ FI KM AKYP LL +LP+ + A Y LEGYLFPATYN + D
Sbjct:   5 KHSSTGLKEKDFLKLMKDDAFITKMKAKYPTLLANLPNSTDAKYVLEGYLFPATYNIHDD  64

Query: 433 TTLEGLVEDMISTMNTKMAPYYNTIKAKNMSVNDVLTLSSLVEKEGSTDEDRRKIASVFY 492
           TT+E L E+M+ TM+T ++PYY TI + N +VN++LTL+SLVEKEG+TD+DR+ IASVFY
Sbjct:  65 TTVESLAEEMLFTMDTHLSPYYATILSSNHNVNEILTLASLVEKEGATDDDRKNIASVFY 124
```

```
Query: 493 NRLSAGQALQSNIAILYAMGKLGDKTSLAEDAQINTSIKSPYNIYTNTGLMPGPVDSPSI 552
           NRL++   ALQSNIA+LY +GKLG +T+L EDA I+T+I SPYN Y + GLMPGPVDSPS+
Sbjct: 125 NRLNSDMALQSNIAVLYVLGKLGQETTLKEDATIDTNIDSPYNDYVHKGLMPGPVDSPSL 184

Query: 553 SAIEATIKPASTDYLYFVADVKTGNVYYAK 582
           SAIEA I P+ST Y+YFVADV TGNVY+A+
Sbjct: 185 SAIEAVINPSSTKYMYFVADVSTGNVYFAE 214
```

A related DNA sequence was identified in *S. pyogenes* 10 <SEQ ID 4805> which encodes the amino acid sequence <SEQ ID 4806>. Analysis of this protein sequence reveals the following:

```
Possible site: 59
>>> Seems to have no N-terminal signal sequence
INTEGRAL Likelihood = -7.91 Transmembrane 161-177 (155-183)

----- Final Results -----
            bacterial membrane --- Certainty = 0.4163 (Affirmative) < succ>
             bacterial outside --- Certainty = 0.0000 (Not Clear) < succ>
            bacterial cytoplasm --- Certainty = 0.0000 (Not Clear) < succ>
```

The protein has homology with the following sequences in the databases:

```
>GP: AAF77615 GB: AF151720 aminodeoxychorismate lyase-like protein
[Streptococcus thermophilus]
Identities = 135/212 (63%), Positives = 161/212 (75%)

Query: 295 KTKKAKTPFNEKDFLDLVTDEAFIQDMVKRYPKLLATIPTKEKAIYRLEGYLFPATYNYY 354
           K  K + T    EKDFL L+ D+AFI  M  +YP LLA +P    A Y LEGYLFPATYN +
Sbjct:   3 KGKHSSTGLKEKDFLKLMKDDAFITKMKAKYPTLLANLPNSTDAKYVLEGYLFPATYNIH  62

Query: 355 KETTMRELVEDMLAAMDATLVPYYDKIAASGKTVNEVLTLASLVEKEGSTDDDRRQIASV 414
           +TT+  L E+ML  MD L PYY  I +S   VNE+LTLASLVEKEG+TDDDR+ IASV
Sbjct:  63 DDTTVESLAEEMLFTMDTHLSPYYATILSSNHNVNEILTLASLVEKEGATDDDRKNIASV 122

Query: 415 FYNRLNSGMALQSNIAILYAMGKLGEKTTLAEDATIDTTINSPYNIYTNTGLMPGPVASS 474
           FYNRLNS MALQSNIA+LY +GKLG++TTL EDATIDT I+SPYN Y + GLMPGPV S
Sbjct: 123 FYNRLNSDMALQSNIAVLYVLGKLGQETTLKEDATIDTNIDSPYNDYVHKGLMPGPVDSP 182

Query: 475 GVSAIEATLNPASTDYLYFVANVHTGEVYYAK 506
           +SAIEA +NP+ST Y+YFVA+V TG VY+A+
Sbjct: 183 SLSAIEAVINPSSTKYMYFVADVSTGNVYFAE 214
```

An alignment of the GAS and GBS proteins is shown below.

```
Identities = 310/603 (51%), Positives 403/603 (66%), Gaps = 86/603 (14%)

Query:   1 MTEFNDDQHSNHDQKSFKEQILAELEEANRLRKLREEELYQKEQEAKEAARRTAQLMADY  60
           +T+F D     + Q+SFKEQILAELE+AN++RK +EEEL+
Sbjct:   3 LTDFKDKDQQDQ-QRSFKEQILAELEKANQIRKEKEEELF--------------------  41

Query:  61 EAQRLKDEREARAKALETKQRLEEQEKARIEAKLLAEAAREEERRQAEQALASQEEQVIN 120
           ++  LE +E AR  A+L AE    R++         A Q+E + +
Sbjct:  42 ------------------QKELEAKEAARRTAQLYAEYKRQD---------AFQKESIAH  74

Query: 121 QGMEPSRELDSGSKSSEFRTTENVPDIDLKADKTDVATAVPNQETEEIFLVRATDIPTEG 180
                            +T ++       +A K  V T+   + T          + +E
Sbjct:  75 NN---------------KTAKH-----FQAIKGAVMTSEALKPT----------LLSEK 103

Query: 181 ENVKLGEISELEPVAKEPIRVEDLSKEEEGIALSAKNKHNKRER---RQKADNVAKRIAR 237
           EN  L    ++     A E   +++ + +E  + L+ +   H+ R +   RQ+ +   AK+I+
Sbjct: 104 ENSSLKTTNKRVVQANE---LQETASKESQVPLTIEKGHSVRRKLSKRQQTERAAKKIST 160

Query: 238 ILISIIILVLLLTAFVGYRFVDSAIKPVDSNSNKFVQVEIPIGSGNKLIGQILEKAGVIK 297
           +LIS II+ LL     G  +V SA+ PVD NS+ FVQVEIP GSGNKLIGQIL+K G+IK
Sbjct: 161 VLISSIIITLLAVTLAGAGYVYSALNPVDKNSDAFVQVEIPSGSGNKLIGQILQKKGLIK 220
```

-continued

```
Query: 298 SATVFNYYSKFKNYSNFQSGYYNLKKSMTLDQIAAELEKGGTAEPTKPALGKILITEGYT 357
            ++TVF++Y+KFKN++NFQSGYYNL+KSM+L++IA+ L++GGTAEPTKP+LGKILI EGYT
Sbjct: 221 NSTVFSFYTKFKNFTNFQSGYYNLQKSMSLEEIASALQEGGTAEPTKPSLGKILIPEGYT 280

Query: 358 IKQIAKAIESN-KIDTKTTSTPYKADDFLKLVQDETFIKKMVAKYPNLLGSLPDKSKAIY 416
            IKQIAKA+E N K  TK   TP+   DFL LV DE FI+ MV +YP LL ++P K KAIY
Sbjct: 281 IKQIAKAVEHNSKGKTKKAKTPFNEKDFLDLVTDEAFIQDMVKRYPKLLATIPTKEKAIY 340

Query: 417 QLEGYLFPATYNYYKDTTLEGLVEDMISTMNTKMAPYYNTIKAKNMSVNDVLTLSSLVEK 476
            +LEGYLFPATYNYYK+TT+  LVEDM++ M+  + PYY+ I A   +VN+VLTL+SLVEK
Sbjct: 341 RLEGYLFPATYNYYKETTMRELVEDMLAAMDATLVPYYDKIAASGKTVNEVLTLASLVEK 400

Query: 477 EGSTDEDRRKIASVFYNRLSAGQALQSNIAILYAMGKLGDKTSLAEDAQINTSIKSPYNI 536
            EGSTD+DRR+IASVFYNRL++G ALQSNIAILYAMGKLG+KT+LAEDA I+T+I SPYNI
Sbjct: 401 EGSTDDDRRQIASVFYNRLNSGMALQSNIAILYAMGKLGEKTTLAEDATIDTTINSPYNI 460

Query: 537 YTNTGLMPGPVDSPSISAIEATIKPASTDYLYFVADVKTGNVYYAKDFETHKANVEKYIN 596
            YTNTGLMPGPV S  +SAIEAT+ PASTDYLYFVA+V TG VYYAK FE H ANVEKY+N
Sbjct: 461 YTNTGLMPGPVASSGVSAIEATLNPASTDYLYFVANVHTGEVYYAKTFEEHSANVEKYVN 520

Query: 597 SQI                                                         599
            SQI
Sbjct: 521 SQI                                                         523
```

A related GBS gene <SEQ ID 8843> and protein <SEQ ID 8844> were also identified. Analysis of this protein sequence reveals the following:

```
Lipop: Possible site: -1 Crend: 8
McG: Discrim Score: -17.88
GvH: Signal Score (-7.5): -3.51
    Possible site: 58
>>> Seems to have no N-terminal signal sequence
ALOM program count: 1 value: -13.64 threshold: 0.0
    INTEGRAL     Likelihood = -13.64 Transmembrane 238-254 (230-260)
    PERIPHERAL   Likelihood    285
                 = 5.78
modified ALOM score: 3.23

*** Reasoning Step: 3

----- Final Results -----
             bacterial membrane --- Certainty = 0.6456 (Affirmative) < succ>
             bacterial outside  --- Certainty = 0.0000 (Not Clear)  < succ>
             bacterial cytoplasm --- Certainty = 0.0000 (Not Clear) < succ>
```

The protein has homology with the following sequences in the databases:

```
ORF00931(1417-2046 of 2400)
GP|8574530|gb|AAF77615.1|AF151720_1|AF151720(5-214 of 214) aminodeoxychorismate
lyase-like protein {Streptococcus thermophilus}
% Match = 17.5
% Identity = 64.3  % Similarity = 81.4
Matches = 135  Mismatches = 39  Conservative Sub.s = 36

1236      1266      1296      1326      1356      1386      1416      1446
NYYSKFKNYSNFQSGYYNLKKSMTLDQIAAELEKGGTAEPTKPALGKILITEGYTIKQIAKAIESNKIDTKTTSTPYKAD
                                                                 | :|| |
                                                                 AKKDKHSSTGLKEK
                                                                         10

1476      1506      1536      1566      1596      1626      1656      1686
DFLKLVQDETFIKKMVAKYPNLLGSLPDKSKAIYQLEGYLFPATYNYYKDTTLEGLVEDMISTMNTKMAPYYNTIKAKNM
||||::|:  || || |||| ::|: : | |||||:|  ||||||||| :||: ||:: :: ||| ||  :  |
DFLKLMKDDAFITKMKAKYPTLLANLPNSTDAKYVLEGYLFPATYNIHDDTTVESLAEEMLFTMDTHLSPYYATILSSNH
        30        40        50        60        70        80        90

1716      1746      1776      1806      1836      1866      1896      1926
SVNDVLTLSSLVEKEGSTDEDRRKIASVFYNRLSAGQALQSNIAILYAMGKLGDKTSLAEDAQINTSIKSPYNIYTNTGL
:||::|||:|||||||:|:|:||: ||||||||||:|  ||:|| |:|  :|:: ||| |:||:|| ||||  |||| ||
NVNEILTLASLVEKEGATDDDRKNIASVFYNRLNSDMALQSNIAVLYVLGKLGQETTLKEDATIDTNIDSPYNDYVHKGL
        110       120       130       140       150       160       170

1956      1986      2016      2046      2076      2106      2136      2166
MPGPVDSPSISAIEATIKPASTDYLYFVADVKTGNVYYAKDFETHKANVEKYINSQIN*KYKHGASHHVYIFDLKK*KEK
||||||||||:|||| | :| |:|:||||||  |:|:
MPGPVDSPSLSAIEAVINPSSTKYMYFVADVSTGNVYFAE
        190       200       210
```

SEQ ID 8844 (GBS370) was expressed in *E. coli* as a His-fusion product. SDS-PAGE analysis of total cell extract is shown in FIG. 64 (lane 6; MW 70 kDa).

GBS370-His was purified as shown in FIG. 209, lane 10.

Based on this analysis, it was predicted that these proteins and their epitopes could be useful antigens for vaccines or diagnostics.

EXAMPLE 1557

A DNA sequence (GBSx1649) was identified in *S. agalactiae* <SEQ ID 4807> which encodes the amino acid sequence <SEQ ID 4808>. Analysis of this protein sequence reveals the following:

```
Possible site: 53
>>> Seems to have no N-terminal signal sequence

----- Final Results -----
            bacterial cytoplasm --- Certainty = 0.0183 (Affirmative) < succ>
            bacterial membrane  --- Certainty = 0.0000 (Not Clear)   < succ>
             bacterial outside  --- Certainty = 0.0000 (Not Clear)   < succ>
```

A related GBS nucleic acid sequence <SEQ ID 10077> which encodes amino acid sequence <SEQ ID 10078> was also identified.

The protein has homology with the following sequences in the GENPEPT database.

```
>GP:CAA98889 GB: Z74367 ORF YDR071c [Saccharomyces cerevisiae]
Identities = 52/174 (29%), Positives = 81/174 (45%), Gaps 18/174 (10%)

Query:  27 MSMIIRNGCLEDLQQVISIEQINFSEAEAASKKAMQERLTIMTDT---FLVAEINGR---    80
              + M IR   +EDL+Q++++E   F    E AS++ +  RL     +     + EI G+
Sbjct:  10 LHMYIRPLIIEDLKQILNLESQGFPPNERASEEIISFRLINCPELCSGLFIREIEGKEVK  69

Query:  81 ---LAGYIEGPVIKGRYLTDDLFHKVSEFPVRVGGFIGITSLSIHPDFKGQGIGTALLAA  137
                    L  G+I G   I     Y+T +    K+    V       IGI S+ I P+++ + + T LL
Sbjct:  70 KETLIGHIMGTKIPHEYITIESMGKLQ---VESSNHIGIHSVVIKPEYQKKNLATLLLTD  126

Query: 138 MKDLVVSQE-RDGISLTCHDDLISFYEMNGFKDEGES-----DSKHGGSLWYNM        185
              + +QE  + I L  H+ LI FYE   GFK   E+      D       W +M
Sbjct: 127 YIQKLSNQEIGNKIVLIAHEPLIPFYERVGFKIIAENTNVAKDKNFAEQKWIDM        180
```

A related DNA sequence was identified in *S. pyogenes* <SEQ ID 4809> which encodes the amino acid sequence <SEQ ID 4810>. Analysis of this protein sequence reveals the following:

```
Possible site: 15
>>> Seems to have no N-terminal signal sequence

----- Final Results -----
            bacterial cytoplasm --- Certainty = 0.2576(Affirmative) < succ>
            bacterial membrane  --- Certainty = 0.0000(Not Clear)   < succ>
             bacterial outside  --- Certainty = 0.0000(Not Clear)   < succ>
```

An alignment of the GAS and GBS proteins is shown below.

```
Identities = 87/159 (54%), Positives = 117/159 (72%), Gaps = 1/159 (0%)

Query:  29 MIIRNGCLEDLQQVISIEQINFSEAEAASKKAMQERLTIMTDTFLVAEINGRLAGYIEGP   88
              M+IR     DL+ + +IE  NFS  EA ++   ++E + ++ DTFLVA I+  + GYIEGP
Sbjct:   1 MLIRQVQGSDLEVIATIESDNFSPQEATTRAVLEEHIRLIPDTFLVALIDQEIVGYIEGP   60

Query:  89 VIKGRYLTDDLFHKVSEFPVRVGGFIGITSLSIHPDFKGQGIGTALLAAMKDLVVSQERD  148
              V+      L D LFH V++  P + GG+I ITSLSI       F+ QG+GTALLAA+KDLVV+Q+R
Sbjct:  61 VVTTPILEDSLFHGVTKNP-KTGGYIAITSLSIAKHFQQQGVGTALLAALKDLVVAQQRT  119

Query: 149 GISLTCHDDLISFYEMNGFKDEGESDSKHGGSLWYNMIW                      187
              G+ LTCHD LIS+YEMNGF ++G S+S+HGG LWY MIW
Sbjct: 120 GLILTCHDYLISYYEMNGFINQGISESQHGGTLWYQMIW                      158
```

Based on this analysis, it was predicted that these proteins and their epitopes could be useful antigens for vaccines or diagnostics.

EXAMPLE 1558

A DNA sequence (GBSx1650) was identified in *S. agalactiae* <SEQ ID 4811> which encodes the amino acid sequence <SEQ ID 4812>. This protein is predicted to be udp-n-acetylmuramate—alanine ligase (murC/ddlA). Analysis of this protein sequence reveals the following:

```
Possible site: 31
>>> Seems to have a cleavable N-term signal seq.
     INTEGRAL    Likelihood = -2.60    Transmembrane    272-288 (270-288)

----- Final Results -----
              bacterial membrane --- Certainty = 0.2041(Affirmative) < succ>
              bacterial outside  --- Certainty = 0.0000(Not Clear)   < succ>
              bacterial cytoplasm --- Certainty = 0.0000(Not Clear)  < succ>
```

The protein has homology with the following sequences in the GENPEPT database.

```
>GP: AAC00294 GB: AF008220 putative UDP-N-acetylmuramate-alanine
ligase [Bacillus subtilis]
Identities = 238/432 (55%), Positives = 315/432 (72%), Gaps = 3/432 (0%)

Query:   5 YHFIGIKGSGMSALALMLHQMGHNVQGSDVDKYYFTQRGLEQAGVTILPFSPNNISEDLE    64
           YHF+GIKG+GMS LA +LH  G+ VQGSD++K+ FTQ  LE+  +TILPFS  NI    +
Sbjct:   4 YHFVGIKGTGMSPLAQILHDNGYTVQGSDIEKFIFTQTALEKRNITILPFSAENIKPGMT   63

Query:  65 IIAGNAFRPDNNEELAYVIEKGYQFKRYHEFLGDFMRQFTSLGVAGAHGKTSTTGLLAHV  124
           +IAGNAF PD + E+   + +G   RYH+FLGD+M++FTS+ V GAHGKTSTTGLLAHV
Sbjct:  64 VIAGNAF-PDTHPEIEKAMSEGIPVIRYHKFLGDYMKKFTSVAVTGAHGKTSTTGLLAHV  122

Query: 125 LKNITDTSFLIGDGTGRGSANANYFVFEADEYERHFMPYHPEYSIITNIDFDHPDYFTGL  184
           ++N   TSFLIGDGTG+G+ N+ YFVFEA EY RHF+ Y P+Y+I+TNIDFDHPDYF+ +
Sbjct: 123 IQNAKPTSFLIGDGTGQGNENSEYFVFEACEYRRHFLSYQPDYAIMTNIDFDHPDYFSSI  182

Query: 185 EDVFNAFNDYAKQVQKGLFIYGEDPKLHEITSEAPIYYYGFEDSNDFIAKDITRTVNGSD  244
           +DVF+AF + A QV KG+    G+D L +I +  P+ YYG  + NDF A++I ++  G+
Sbjct: 183 DDVFDAFQEMALQVNKGIIACGDDEHLPKIHANVPVVYYGTGEENDFQARNIVKSTEGTT  242

Query: 245 FKVFYNQEEIGQFHVPAYGKHNILNATAVIANLYIMGIDMALVAEHLKTFSGVKRRFTEK  304
           F VF       F++PAYG HN+LN+ AVIA  +   ID +++  LK+F GVKRRF EK
Sbjct: 243 FDVFVRNTFYDTFYIPAYGHHNVLNSLAVIALCHYEEIDSSIIKHALKSFGGVKRRFNEK  302

Query: 305 IIDDTVIIDDFAHHPTEIIATLDAARQKYPSKEIVAIFQPHTFTRTIALLDEFAHALSQA  364
            + D V+IDD+AHHPTEI  T++AARQKYP +EIVA+FQPHTFTRT   LDEFA +LS A
Sbjct: 303 QLGDQVLIDDYAHHPTEIKVTIEAARQKYPDREIVAVFQPHTFTRTQQFLDEFAESLSGA  362

Query: 365 DSVYLAQIYGSAREVDNGEVKVEDLAAKIVKHSDLVTVENVSPLLNHDNAVYVFMGAGDI  424
           D VYL  I+GSARE + G++ + DL  KI  ++ L+   ++ S L  HD AV +FMGAGDI
Sbjct: 363 DCVYLCDIFGSARE-NAGKLTIGDLQGRI-HNAKLIEEDDTSVLKAHDKAVLIFMGAGDI  420

Query: 425 QLYERSFEELLA                                                 436
           Q Y R++E ++A
Sbjct: 421 QKYMRAYENVMA                                                 432
```

A related DNA sequence was identified in *S. pyogenes* <SEQ ID 4813> which encodes the amino acid sequence <SEQ ID 4814>. Analysis of this protein sequence reveals the following:

```
Possible site: 31
>>> Seems to have a cleavable N-term signal seq.
     INTEGRAL    Likelihood = -4.57    Transmembrane    271-287 (269-288)

----- Final Results -----
              bacterial membrane --- Certainty = 0.2826(Affirmative) < succ>
              bacterial outside  --- Certainty = 0.0000(Not Clear)   < succ>
              bacterial cytoplasm --- Certainty = 0.0000(Not Clear)  < succ>
```

The protein has homology with the following sequences in the databases:

```
>GP: AAC00294 GB: AF008220 putative UDP-N-acetylmuramate-alanine
ligase [Bacillus subtilis]
Identities = 236/431 (54%), Positives = 310/431 (71%), Gaps = 2/431 (0%)

Query:   5 YHFIGIKGSGMSALALMLHQMGHKVQGSDVEKYYFTQRGLEQAGITILPFSEDNITPDME    64
           YHF+GIKG+GMS LA +LH  G+ VQGSD+EK+ FTQ  LE+  ITILPFS +NI P M
Sbjct:   4 YHFVGIKGTGMSPLAQILHDNGYTVQGSDIEKFIFTQTALEKRNITILPFSAENIKPGMT   63

Query:  65 LIVGNAFRENNKEVAYALRHQIPFKRYHDFLGDFMKSFISFAVAGAHGKTSTTGLLSHVL  124
           +I GNAF + + E+  A+   IP  RYH FLGD+MK F S AV GAHGKTSTTGLL+HV+
Sbjct:  64 VIAGNAFPDTHPEIEKAMSEGIPVIRYHKFLGDYMKKFTSVAVTGAHGKTSTTGLLAHVI  123

Query: 125 KNITDTSYLIGDGTGRGSANAQYFVFESDEYERHFMPYHPEYSIITNIDFDHPDYFTGIA  184
           +N    TS+LIGDGTG+G+ N++YFVFE+ EY RHF+ Y P+Y+I+TNIDFDHPDYF+ I
Sbjct: 124 QNAKPTSFLIGDGTGQGNENSEYFVFEACEYRRHFLSYQPDYAIMTNIDFDHPDYFSSID  183

Query: 185 DVRNAFNDYAKQVKKALFVYGEDDELKKIEAPAPIYYYGFEEGNDFIAYDITRTTNGSDF  244
           DV +AF + A QV K +  G+D+ L KI A  P+ YYG  E NDF A +I ++T G+ F
Sbjct: 184 DVFDAFQEMALQVNKGIIACGDDEHLPKIHANVPVVYYGTGEENDFQARNIVKSTEGTTF  243

Query: 245 KVKHQGEVIGQFHVPAYGKHNILNATAVIANLFVAGIDMALVADHLKTFSGVKRRFTEKI  304
           V  +      F++PAYG HN+LN+ AVIA     ID +++   LK+F GVKRRF EK
Sbjct: 244 DVFVRNTFYDTFYIPAYGHHNVLNSLAVIALCHYEEIDSSIIKHALKSFGGVKRRFNEKQ  303

Query: 305 INDTIIIDDFAHHPTEIVATIDAARQKYPSKEIVAIFQPHTFTRTIALLEDFACALNEAD  364
           + D ++IDD+AHHPTEI   TI AARQKYP +EIVA+FQPHTFTRT   L++FA +L+ AD
Sbjct: 304 LGDQVLIDDYAHHPTEIKVTIEAARQKYPDREIVAVFQPHTFTRTQQFLDEFAESLSGAD  363

Query: 365 SVYLAQIYGSAREVDKGEVKVEDLAAKIIKPSQVVTVENVSPLLDHDNAVYVFMGAGDIQ  424
              VYL  I+GSARE + G++ + DL  K I  ++++ ++ S L  HD AV +FMGAGDIQ
Sbjct: 364 CVYLCDIFGSARE-NAGKLTIGDLQGK-IHNAKLIEEDDTSVLKAHDKAVLIFMGAGDIQ  421

Query: 425 LYEHSFEELLA                                                  435
           Y   ++E ++A
Sbjct: 422 KYMRAYENVMA                                                  432
```

An alignment of the GAS and GBS proteins is shown below.

```
Identities = 369/443 (83%), Positives = 406/443 (91%), Gaps = 1/443 (0%)

Query:   1 MSKTYHFIGIKGSGMSALALMLHQMGHNVQGSDVDKYYFTQRGLEQAGVTILPFSPNNIS   60
           MSKTYHFIGIKGSGMSALALMLHQMGH VQGSDV+KYYFTQRGLEQAG+TILPFS +NI+
Sbjct:   1 MSKTYHFIGIKGSGMSALALMLHQMGHKVQGSDVEKYYFTQRGLSQAGITILPFSEDNIT   60

Query:  61 EDLEIIAGNAFRPDNNEELAYVIEKGYQFKRYHEFLGDFMRQFTSLGVAGAHGKTSTTGL  120
           D+E+I GNAFR +NN+E+AY +    FKRYH+FLGDFM+ F S  VAGAHGKTSTTGL
Sbjct:  61 PDMELIVGNAFR-ENNKEVAYALRHQIPFKRYHDFLGDFMKSFISFAVAGAHGKTSTTGL  119

Query: 121 LAHVLKNITDTSFLIGDGTGRGSANANYFVFEADEYERHFMPYHPEYSIITNIDFDHPDY  180
           L+HVLKNITDTS+LIGDGTGRGSANA YFVFE+DEYERHFMPYHPEYSIITNIDFDHPDY
Sbjct: 120 LSHVLKNITDTSYLIGDGTGRGSANAQYFVFESDEYERHFMPYHPEYSIITNIDFDHPDY  179

Query: 181 FTGLEDVFNAFNDYAKQVQKGLFIYGEDPKLHEITSEAPIYYYGFEDSNDFIAKDITRTV  240
           FTG+ DV NAFNDYAKQV+K LF+YGED +L +I + APIYYYGFE+ NDFIA DITRT
Sbjct: 180 FTGIADVRNAFNDYAKQVKKALFVYGEDDELKKIEAPAPIYYYGFEEGNDFIAYDITRTT  239

Query: 241 NGSDFKVFYNQEEIGQFHVPAYGKHNILNATAVIANLYIMGIDMALVAEHLKTFSGVKRR  300
           NGSDFKV +  E IGQFHVPAYGKHNILNATAVIANL++ GIDMALVA+HLKTFSGVKRR
Sbjct: 240 NGSDFKVKHQGEVIGQFHVPAYGKHNILNATAVIANLFVAGIDMALVADHLKTFSGVKRR  299

Query: 301 FTEKIIDDTVIIDDFAHHPTEIIATLDAARQKYPSKEIVAIFQPHTFTRTIALLDEFAHA  360
           FTEKII+DT+IIDDFAHHPTEI+AT+DAARQKYPSKEIVAIFQPHTFTRTIALL++FA A
Sbjct: 300 FTEKIINDTIIIDDFAHHPTEIVATIDAARQKYPSKEIVAIFQPHTFTRTIALLEDFACA  359

Query: 361 LSQADSVYLAQIYGSAREVDNGEVKVEDLAAKIVKHSDLVTVENVSPLLNHDNAVYVFMG  420
           L++ADSVYLAQIYGSAREVD GEVKVEDLAAKI+K S +VTVENVSPLL HDNAVYVFMG
Sbjct: 360 LNEADSVYLAQIYGSAREVDKGEVKVEDLAAKIIKPSQVVTVENVSPLLDHDNAVYVFMG  419

Query: 421 AGDIQLYERSFEELLANLTKNTQ                                       443
           AGDIQLYE SFEELLANLTKN Q
Sbjct: 420 AGDIQLYEHSFEELLANLTKNNQ                                       442
```

SEQ ID 4812 (GBS157) was expressed in *E. coli* as a His-fusion product. SDS-PAGE analysis of total cell extract is shown in FIG. 24 (lane 11; MW 49 kDa). It was also expressed in *E. coli* as a GST-fusion product. SDS-PAGE analysis of total cell extract is shown in FIG. 31 (lane 8; MW 74 kDa), FIG. 33 (lane 8; MW 74 kDa) and FIG. 37 (lane 3; MW 74 kDa).

The GBS157-GST fusion product was purified (FIG. 112A; see also FIG. 200, lane 3) and used to immunise mice (lane 1+2 product; 19.5 μg/mouse). The resulting antiserum was used for Western blot (FIG. 112B), FACS, and in the in vivo passive protection assay (Table III). These tests confirm that the protein is immunoaccessible on GBS bacteria and that it is an effective protective immunogen.

SEQ ID 4812 (GBS157) was expressed in *E. coli* as a GST-fusion product. SDS-PAGE analysis of total cell extract is shown in FIG. 183 (lane 11-13; MW 74 kDa).

Based on this analysis, it was predicted that these proteins and their epitopes could be useful antigens for vaccines or diagnostics.

EXAMPLE 1559

A DNA sequence (GBSx1651) was identified in *S. agalactiae* <SEQ ID 4815> which encodes the amino acid sequence <SEQ ID 4816>. Analysis of this protein sequence reveals the following:

```
Possible site: 19
>>> Seems to have no N-terminal signal sequence

----- Final Results -----
         bacterial cytoplasm --- Certainty = 0.1980(Affirmative) < succ>
         bacterial membrane  --- Certainty = 0.0000(Not Clear)   < succ>
          bacterial outside  --- Certainty = 0.0000(Not Clear)   < succ>
```

The protein has no significant homology with any sequences in the GENPEPT database.

A related DNA sequence was identified in *S. pyogenes* <SEQ ID 4817> which encodes the amino acid sequence <SEQ ID 4818>. Analysis of this protein sequence reveals the following:

```
Possible site: 25
>>> Seems to have no N-terminal signal sequence

----- Final Results -----
         bacterial cytoplasm --- Certainty = 0.2731(Affirmative) < succ>
         bacterial membrane  --- Certainty = 0.0000(Not Clear)   < succ>
          bacterial outside  --- Certainty = 0.0000(Not Clear)   < succ>
```

An alignment of the GAS and GBS proteins is shown below.

```
Identities = 80/201 (39%), Positives = 126/201 (61%), Gaps = 9/201 (4%)

Query:   7 RFPLIADDEPVMSPLVKMNLYDNEDLINNIRDFYQEKTYQSMVKSNYEHEEISHPKVIEN  66
           +FPL+AD   +  P  +M LY+NEDLI NIR +YQ+K Y  + ++     EE +
Sbjct:   5 QFPLVADGIAISDPAKQMALYENEDLITNIRGYYQDKEYDDIARN----EEFTAKATSRQ  60

Query:  67 DPVPPQ--SFVKKATELSKSRQEAKRSVREKRQAYYAKQEFKAPSKEAFQQQLKATVPKK 124
              P   +   S  +K   + ++RQ+AK+  ++EKRQAY AK+        P + +QQ    + P +
Sbjct:  61 TPSSKRFCSNDEKHHYVKEARQKAKQDLKEKRQAYLAKEMAYVPKQVSKKQQPADSSPSQ 120

Query: 125 QTQRKVTELSHLSDRLQQESYILAEIPIIFQEPDNTPNP-KTKKNNFDFLKRSQVYNKQD 183
            +   +  TE+S  + +L Q++YILAE+P  ++EP N P     TKKNN+DFLK SQ+YN ++
Sbjct: 121 K--QATTEMSRFTKKLHQDNYILAELPKEYKEPKNLPQQGTTKKNNYDFLKSSQIYNNKE 178

Query: 184 NQFHKERAKAQELNLTRFKDI                                        204
            +  +E+   AQELNL+RF+D+
Sbjct: 179 MRQQREKTIAQELNLSRFEDL                                        199
```

Based on this analysis, it was predicted that these proteins and their epitopes could be useful antigens for vaccines or diagnostics.

EXAMPLE 1560

A DNA sequence (GBSx1652) was identified in *S. agalactiae* <SEQ ID 4819> which encodes the amino acid sequence <SEQ ID 4820>. Analysis of this protein sequence reveals the following:

```
Possible site: 29
>>> Seems to have no N-terminal signal sequence

----- Final Results -----
           bacterial cytoplasm --- Certainty = 0.4959(Affirmative) < succ>
            bacterial membrane --- Certainty = 0.0000(Not Clear)   < succ>
             bacterial outside --- Certainty = 0.0000(Not Clear)   < succ>
```

The protein has no significant homology with any sequences in the GENPEPT database.

No corresponding DNA sequence was identified in S. pyogenes.

Based on this analysis, it was predicted that this protein and its epitopes, could be useful antigens for vaccines or diagnostics.

EXAMPLE 1561

A DNA sequence (GBSx1653) was identified in S. agalactiae <SEQ ID 4821> which encodes the amino acid sequence <SEQ ID 4822>. This protein is predicted to be SNF. Analysis of this protein sequence reveals the following:

```
Possible site: 28
>>> Seems to have no N-terminal signal sequence
     INTEGRAL    Likelihood = -0.32    Transmembrane    743-759 (743-759)

----- Final Results -----
             bacterial membrane --- Certainty = 0.1128(Affirmative) < succ>
              bacterial outside --- Certainty = 0.0000(Not Clear)   < succ>
            bacterial cytoplasm --- Certainty = 0.0000(Not Clear)   < succ>
```

The protein has homology with the following sequences in the GENPEPT database.

```
>GP: CAA67095 GB: X98455 SNF [Bacillus cereus]
Identities = 259/678 (38%), Positives = 406/678 (59%), Gaps = 21/678 (3%)

Query:  369 QNEILLQMVFDYGNDLTVHNRQELEQLTFASHFKHEEKVFKLLEKYGFAPHFSTSHPAYS   428
            +N +L  + F YGN +     ++ +   F     K E+++ ++ +  FA      + ++
Sbjct:  388 KNRLLAGLEFHYGNVVINPLEEDGQPSVFNRDEKKEKEILDIMSESAFAKT-EGGYFMHN   446

Query:  429 AQELYDFYTYMLPQFKKMGTV--SLSAKLESYRLIERPQIDIEAKGSL--LDISFDFSDL   484
             + Y+F +++P  K +  + +KL ++     P I+  K + L    FD      +
Sbjct:  447 EEAEYNFLYHIVPTLKGLVDIYATTAIKLRIHKGDTAPLIRVRRKERIDWLSFRFDIKGI   506

Query:  485 LENDVDQALVALFDNNPYFVNKSGQLVIFD-EETKKVSATLQ--GLRARRAKNGHIELDN   541
              E ++   L AL +   Y+   +G L+  + +E  +++ ++    G+R           + +
Sbjct:  507 PEAEIKGVLAALEEKRKYYRLANGSLLSLESKEFNEINQFVKESGIRKEFLHGEEVNVPL   566

Query:  542 IAAFQLSELFANQDNVSFSQHFYQLIEDLRHPEKFK--IPGLSVSASLRDYQLTGVRWLS   599
            I + +          + +S   +    L+E +++P+K K   +P  ++ A +R+YQ+  G    W+
Sbjct:  567 IRSVKWMNGLHEGNVLSLDESVQDLVESIQNPKKLKFTVPP-TLHAVMREYQVYGFEWMK   625

Query:  600 MLDHYGFAGILADDMGLGKTLQTISFLSTKLT--RDSR--VLILSPSSLIYNWQDEFHKF   655
            L +Y F GILADDMGLGKTLQ+I+++ + L    R+ +    +L++SPSSL+YNW  E  KF
Sbjct:  626 TLAYYRFGGILADDMGLGKTLQSIAYIDSVLPEIREKKLPILVVSPSSLVYNWFSELKKF   685

Query:  656 APDVDVAVAYGSKIRRDEIIAE--RHQVIITSYSSFRQDFETYSEGNYDYLILDEAQVMK   713
            AP +   +A G++  R +I+ +      V+ITSY    R+D  +Y+        +   L LDEAQ   K
Sbjct:  686 APHIRAVIADGNQTERRKILKDVAEFDVVITSYPLLRRDVRSYARP-FHTLFLDEAQAFK   744

Query:  714 NAQTKIAHSLRSFEVKNCFALSGTPIENKLLEIWSIFQIILPGLLPGKKEFLKLNPKQVA   773
            N   T+ A ++++ + +    F L+GTP+EN L E+WSIF ++  P LLPG+KEF    L    + +A
Sbjct:  745 NPTTQTARAVKTIQAEYRFGLTGTPVENSLEELWSIFHVVFPELLPGRKEFGDLRREDIA   804

Query:  774 RYIKPFVMRRRKEEVLPELPDLIEMNYPNEMTDSQKVIYLAQLRQI-QESIQHSSDADLN   832
              +KPFV+RR KE+VL ELPD IE     +E+    QK +Y A L  ++  +E+++H       L
Sbjct:  805 NAVKPFVLRRLKEDVLQELPDKIEHLQSSELLPDQKRLYAAYLAKLREETLKHLDKDTLR   864

Query:  833 RRKIEILSGITRLRQICDTPRLFMD-YDGESGKLESLRQLLTQIKENGHRALIFSQFRGM   891
             + KI  IL+G+TRLRQIC+  P LF+D  Y G S   KLE  L   +L + +   G R   LIFSQF   M
Sbjct:  865 KNKIRILAGLTRLRQICNHPALFVDDYKGSSAKLEQLLDILEECRSTGKRILIFSQFTKM   924
```

```
Query:  892 LDIAEREMVAMGLTTYKITGSTPANERHEMTRAFNAGSKDAFLISLKAGGVGLNLTGADT    951
            L I  RE+     + + + G+TP+ ER E+    FN G D FLISLKAGG GLNLTGADT
Sbjct:  925 LSIIGRELNRQAIPYFYLDGNTPSQERVELCNRFNEGEGDLFLISLKAGGTGLNLTGADT    984

Query:  952 VVLIDLWWNPAVEMQAISRAHRLGQKENVEVYRLITRGTIEEKILEMQETKKHLVTTVLD   1011
            V+L DLWWNPAVE QA  RA+R+GQK  V+V +L+  GTIEEK+ E+QE+KKHL+  V++
Sbjct:  985 VILYDLWWNPAVEQQAADRAYRMGQKNTVQVIKLVAHGTIEEKMHELQESKKHLIAEVIE   1044

Query: 1012 -GNETHASMSVDDIREIL                                            1028
             G E  +S++ ++IR+IL
Sbjct: 1045 PGEEKLSSITEEEIRDIL                                            1062
```

A related DNA sequence was identified in *S. pyogenes* <SEQ ID 4823> which encodes the amino acid sequence <SEQ ID 4824>. Analysis of this protein sequence reveals the following:

```
Possible site: 26
>>> Seems to have no N-terminal signal sequence

----- Final Results -----
            bacterial cytoplasm --- Certainty = 0.3909(Affirmative) < succ>
            bacterial membrane  --- Certainty = 0.0000(Not Clear)  < succ>
             bacterial outside  --- Certainty = 0.0000(Not Clear)  < succ>
```

An alignment of the GAS and GBS proteins is shown below.

```
Identities = 674/1031 (65%), Positives = 834/1031 (80%), Gaps = 2/1031 (0%)

Query:    1 MSRMIPGRIRNQGIELYEQGLVSLISQEGNLLKAKVGDCQIEYSLVTEETKCSCDFFARK     60
            M+R+IPGR+RN+GI+LYEQGLVS        +L+ +V  Q++Y    E+  C CD F  K
Sbjct:    2 MARLIPGRVRNEGIKLYEQGLVSFQDDNKGILQIEVETYQVQYGADDEDITCQCDTFHMK     61

Query:   61 GYCQHLAALEHFLKNDPEGKAILSKVQVQQESQQETKKKTSFGSVFLDSLIINEDDTIKY    120
            YC+H+AA+E+FLKND +GK L ++  Q + ++ TKK TSFGS+FLDSL +NEDD++KY
Sbjct:   62 HYCKHIAAVEYFLKNDQKGKLFLKQLTNQTKIKETTKKMTSFGSLFLDSLAMNEDDSVKY    121

Query:  121 QLSAQGEQNPYANDIWWTLKIRRLPDDRSYVIRDIKAFLNTVRKEAYYQIGKQYFETLSL    180
            +LSA G ++P+++D WW+LKI RLPDDRSYVIRDIK FL  ++KE +YQIGK YFE LS
Sbjct:  122 RLSALGSRSPFSSDYWWSLKINRLPDDRSYVIRDIKGFLQLIKKEGFYQIGKNYFEQLSW    181

Query:  181 IQFDETSQELIEFLWRLIPSHSSKIDLEFILPNQGRHLSLTRGFFEEGVTLMNALENFSF    240
            +QFD +SQ LIEFLWRL  S + K D E I PN RHL L  GFFEEG+  +L +F+F
Sbjct:  182 LQFDPSSQALIEFLWRLA-SDTDKGDNENIFPNHARHLRLPSGFFEEGIHYLTSLYDFTF    240

Query:  241 ESDFHQFNHLYFKELEGEDHLYQFKVIVHRQSIELEIKEKDLKPLFANSYLFYRDTFYHL    300
            E     ++HL+ + LE E  LY+FKV VHR+SIEL+I EK+++ LF N YL Y+DTFYHL
Sbjct:  241 EGPSQTYHHLFVRSLEAEAGLYEFKVEVHRKSIELQIAEKNVQYLFDNDYLLYQDTFYHL    300

Query:  301 NLKQEKMVTAIRSLPIEGDLAKHIHFDLDDQDKLAAHLLDFKEIGLVDAPRSFSIHDFKV    360
             LKQ KMV AIRSLPIE DLAKHIHFDLDD  KLAA L DFK+IGLV+AP+SF+I DF+V
Sbjct:  301 TLKQRKMVQAIRSLPIEADLAKHIHFDLDDHAKLAASLSDFKQIGLVEAPKSFAIRDFEV    360

Query:  361 NFEFDINSQNEILLQMVFDYGNDLTVHNRQELEQLTFASHFKHEEKVFKLLEKYGFAPHF    420
             F+FD+ +++EI  Q++FDYGN  V ++ LE L FASH K EEK+ L  +GF+P F
Sbjct:  361 TFQFDLLNRDEISCQLMFDYGN-YQVSDKASLEALPFASHLKKEEKINRSLLAFGFSPQF    419

Query:  421 STSHPAYSAQELYDFYTYMLPQFKKMGTVSLSAKLESYRLIERPQIDIEAKGSLLDISFD    480
            +        SA+ELY F+   +P F+++G V+LS   +++ ++ E P+I I     LLDISFD
Sbjct:  420 YSKKRLTSAKELYTFFFEETVPCFERLGNVALSTAIQALQVKEMPKIAIRRNQGLLDISFD    479

Query:  481 FSDLLENDVDQALVALFDNNPYFVNKSGQLVIFDEETKKVSATLQGLRARRAKNGHIELD    540
            FS ++END+DQA+ ALF NNPYFV+++GQLV+FD+ET+KVS +LQ LRAR+ KNGH++LD
Sbjct:  480 FSTIIENDIDQAVTALFQNNPYFVSQTGQLVVFDDETQKVSKSLQELRARQLKNGHLQLD    539

Query:  541 NIAAFQLSELFANQDNVSFSQHFYQLIEDLRHPEKFKIPGLSVSASLRDYQLTGVRWLSM    600
                I A Q+S+LF    +V FS+   +L    L+HPE F I  L V A +RDYQ  GV+WLSM
Sbjct:  540 GIRALQVSKLFEGMTSVHFSKELEELAYHLQHPETFSIKPLPVKAQMRDYQRNGVQWLSM    599

Query:  601 LDHYGFAGILADDMGLGKTLQTISFLSTKLTRDSRVLILSPSSLIYNWQDEFHKFAPDVD    660
            L+HYGF GILADDMGLGKTLQT++FL++ L  DS+VLILSPSSLIYNW DE  KF P +D
Sbjct:  600 LNHYGFGGILADDMGLGKTLQTLAFLASHLKSDSKVLILSPSSLIYNWFDECQKFTPQLD    659
```

-continued

```
Query:    661 VAVAYGSKIRRDEIIAERHQVIITSYSSFRQDFETYSEGNYDYLILDEAQVMKNAQTKIA   720
              V V+YG K  RD+II E HQ+ ITSYSSFRQDFETY    +YDYLILDEAQV+KNAQTKI+
Sbjct:    660 VVVSYGLKQIRDQIIEEGHQITITSYSSFRQDFETYQAFHYDYLILDEAQVIKNAQTKIS   719

Query:    721 HSLRSFEVKNCFALSGTPIENKLLEIWSIFQIILPGLLPGKKEFLKLNPKQVARYIKPFV   780
              H LR+F   NCFALSGTPIENK+LEIWSIFQI+LPGLLP KKEFLKL  +QV+RYIKPFV
Sbjct:    720 HCLRAFNTANCFALSGTPIENKMLEIWSIFQIVLPGLLPTKKEFLKLTAEQVSRYIKPFV   779

Query:    781 MRRRKEEVLPELPDLIEMNYPNEMTDSQKVIYLAQLRQIQESIQHSSDADLNRRKIEILS   840
              MRR+KE+VLPELPDLIE+NY NEMTD QK IYLAQLRQ+Q+ I++SSD D++R+KIEILS
Sbjct:    780 MRRKKEDVLPELPDLIEINYSNEMTDEQKAIYLAQLRQMQDQIRNSSDVDISRQKIEILS   839

Query:    841 GITRLRQICDTPRLFMDYDGESGKLESLRQLLTQIKENGHRALIFSQFRGMLDIAEREMV   900
              GITRLRQICDTP LFMDY G+SGKL+SLR LLTQIKENGHRALIFSQFRGMLD+A++EM
Sbjct:    840 GITRLRQICDTPSLFMDYQGKSGKLDSLRILLTQIKENGHRALIFSQFRGMLDLAKQEMT   899

Query:    901 AMGLTTYKITGSTPANERHEMTRAFNAGSKDAFLISLKAGGVGLNLTGADTVVLIDLWWN   960
              A+GLT+Y++TGSTPANER EMTRAFN GSKDAFLISLKAGGVG+NLTGADTV+LIDLWWN
Sbjct:    900 ALGLTSYQMTGSTPANERQEMTRAFNNGSKDAFLISLKAGGVGINLTGADTVILIDLWWN   959

Query:    961 PAVEMQAISRAHRLGQKENVEVYRLITRGTIEEKILEMQETKKHLVTTVLDGNETHASMS   1020
              PAVEMQAISRA+R+GQKENVEVYRLITRGTIEEKILE+QE+K++LVTTVLDGNE+ ASMS
Sbjct:    960 PAVEMQAISRAYRIGQKENVEVYRLITRGTIEEKILELQESKRNLVTTVLDGNESRASMS   1019

Query:   1021 VDDIREILGVS                                                   1031
              +++I+EILG++
Sbjct:   1020 IEEIKEILGLN                                                   1030
```

SEQ ID 4822 (GBS369) was expressed in E. coli as a His-fusion product. SDS-PAGE analysis of total cell extract is shown in FIG. 64 (lane 5; MW 120 kDa). It was also expressed in E. coli as a GST-fusion product. SDS-PAGE analysis of total cell extract is shown in FIG. 69 (lane 6; MW 142 kDa).

Figure 303:
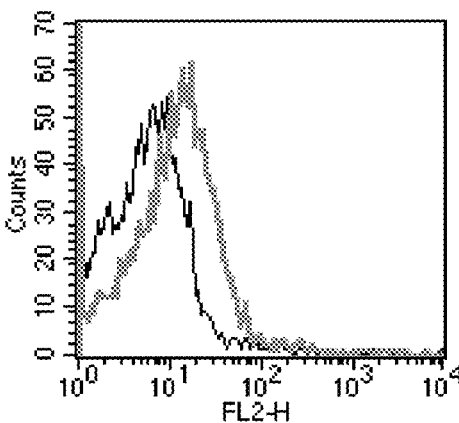

The GBS369-GST fusion product was purified (FIG. 215, lane 7) and used to immunise mice. The resulting antiserum was used for FACS (FIG. 303), which confirmed that the protein is immunoaccessible on GBS bacteria.

Based on this analysis, it was predicted that these proteins and their epitopes could be useful antigens for vaccines or diagnostics.

EXAMPLE 1562

A DNA sequence (GBSx1654) was identified in S. agalactiae <SEQ ID 4825> which encodes the amino acid sequence <SEQ ID 4826>. Analysis of this protein sequence reveals the following:

```
Possible site: 41
>>> Seems to have no N-terminal signal sequence

----- Final Results -----
           bacterial cytoplasm --- Certainty = 0.3391(Affirmative) < succ>
           bacterial membrane  --- Certainty = 0.0000(Not Clear)   < succ>
           bacterial outside   --- Certainty = 0.0000(Not Clear)   < succ>
```

The protein has no significant homology with any sequences in the GENPEPT database.

There is also homology to SEQ ID 1034:

```
Identities = 34/38 (89%), Positives = 37/38 (96%)

Query:  1 MEKEAKQIIDLKRNLFKIDVRAQKDEEKVFMRTACQFS   38
          +EKEAKQ+IDLKRNLFKIDVRAQKDEEKVFMRTAC+ S
Sbjct:  1 LEKEAKQMIDLKRNLFKIDVRAQKDEEKVFMRTACRQS   38
```

Based on this analysis, it was predicted that this protein and its epitopes, could be useful antigens for vaccines or diagnostics.

EXAMPLE 1563

A DNA sequence (GBSx1656) was identified in S. agalactiae <SEQ ID 4827> which encodes the amino acid sequence <SEQ ID 4828>. This protein is predicted to be phosphoglycerate dehydrogenase (era2). Analysis of this protein sequence reveals the following:

```
Possible site: 31
>>> Seems to have no N-terminal signal sequence

----- Final Results -----
             bacterial cytoplasm --- Certainty = 0.3709(Affirmative) < succ>
              bacterial membrane --- Certainty = 0.0000(Not Clear)   < succ>
                bacterial outside --- Certainty = 0.0000(Not Clear)   < succ>
```

The protein has homology with the following sequences in the GENPEPT database.

```
>GP: BAA88823 GB: AB016077 phosphoglycerate dehydrogenase
[Streptococcus mutans]
Identities = 377/436 (86%), Positives = 414/436 (94%)

Query:    1 MVLPTVAIVGRPNVGKSTLFNRIAGERISIVEDVEGVTRDRIYTTGEWLNRKFSLIDTGG   60
            M LPTVAIVGRPNVGKS LFNRIAGERISIVEDVEGVTRDRIYT  EWLNR+FS+IDTGG
Sbjct:    1 MALPTVAIVGRPNVGKSALFNRIAGERISIVEDVEGVTRDRIYTKAEWLNRQFSIIDTGG   60

Query:   61 IDDVDAPFMEQIKHQADIAMTEADVIVFVVSGKEGVTDADEYVSRILYKTNKPVILAVNK  120
            IDDVDAPFMEQIKHQADIAMTEADVIVFVVS KEG+TDADEYV++ILY+T+KPVILAVNK
Sbjct:   61 IDDVDAPFMEQIKHQADIAMTEADVIVFVVSAKEGITDADEYVAKILYRTHKPVILAVNK  120

Query:  121 VDNPEMRNDIYDFYSLGLGDPYPLSSVHGIGTGDILDAIVENLPVEEENENPDIIRFSLI  180
            VDNPEMR+ IYDFY+LGLGDPYP+SS HGIGTGD+LDAIV+NLP E + E+ DII+FSLI
Sbjct:  121 VDNPEMRSAIYDFYALGLGDPYPVSSAHGIGTGDVLDAIVDNLPAEAQEESSDIIKFSLI  180

Query:  181 GRPNVGKSSLINAILGEDRVIASPVAGTTRDAIDTNFVDSQGQEYTMIDTAGMRKSGKVY  240
            GRPNVGKSSLINAILGEDRVIASPVAGTTRDAIDT F D +GQE+TMIDTAGMRKSGKVY
Sbjct:  181 GRPNVGKSSLINAILGEDRVIASPVAGTTRDAIDTTFTDEEGQEFTMIDTAGMRKSGKVY  240

Query:  241 ENTEKYSVMRSMRAIDRSDVVLMVINAEEGIREYDKRIAGFAHETGKGIIIVVNKWDTIE  300
            ENTEKYSVMR+MRAIDRSD+VLMV+NAEEGIREYDKRIAGFAHE GKGI+++VVNKWD I+
Sbjct:  241 ENTEKYSVMRAMRAIDRSDIVLMVLNAEEGIREYDKRIAGFAHEAGKGIVVVVNKWDAIK  300

Query:  301 KDNHTVSQWEADIRDNFQFLSYAPIIFVSAETKQRLHKLPDMIKRISESQNKRIPSAVLN  360
            KDN TV+QWE DIRDNFQ++ YAPI+FVSA TKQRLHKLPD+IK++S+SQN RIPS+VLN
Sbjct:  301 KDNRTVAQWETDIRDNFQYIPYAPIVFVSAVTKQRLHKLPDVIKQVSQSQNTRIPSSVLN  360

Query:  361 DVIMDAIAINPTPTDKGKRLKIFYATQVAVKPPTFVVFVNEEELMHFSYLRFLENQIREA  420
            DV+MDA+AINPTPTDKGKRLKIFYATQV+VKPPTFV+FVNEEELMHFSYLRFLENQIR+A
Sbjct:  361 DVVMDAVAINPTPTDKGKRLKIFYATQVSVKPPTFVIFVNEEELMHFSYLRFLENQIRQA  420

Query:  421 FVFEGTPINLIARKRK                                             436
            FVFEGTPI LIARKRK
Sbjct:  421 FVFEGTPIRLIARKRK                                             436
```

A related DNA sequence was identified in *S. pyogenes* <SEQ ID 4829> which encodes the amino acid sequence <SEQ ID 4830>. Analysis of this protein sequence reveals the following:

```
Possible site: 46
>>> Seems to have no N-terminal signal sequence

----- Final Results -----
             bacterial cytoplasm --- Certainty = 0.3463(Affirmative) < succ>
              bacterial membrane --- Certainty = 0.0000(Not Clear)   < succ>
                bacterial outside --- Certainty = 0.0000(Not Clear)   < succ>
```

An alignment of the GAS and GBS proteins is shown below.

```
Identities = 403/436 (92%), Positives = 422/436 (96%)

Query:    1 MVLPTVAIVGRPNVGKSTLFNRIAGERISIVEDVEGVTRDRIYTTGEWLNRKFSLIDTGG   60
            MVLPTVAIVGRPNVGKSTLFNRIAGERISIVEDVEGVTRDRIY TGEWLNR+FSLIDTGG
Sbjct:    1 MVLPTVAIVGRPNVGKSTLFNRIAGERISIVEDVEGVTRDRIYATGEWLNRQFSLIDTGG   60

Query:   61 IDDVDAPFMEQIKHQADIAMTEADVIVFVVSGKEGVTDADEYVSRILYKTNKPVILAVNK  120
            IDDVDAPFMEQIKHQA IAM EADVIVFVVSGKEGVTDADEYVS+ILY+TN PVILAVNK
Sbjct:   61 IDDVDAPFMEQIKHQAQIAMEEADVIVFVVSGKEGVTDADEYVSKILYRTNTPVILAVNK  120
```

```
                                           -continued
Query:  121 VDNPEMRNDIYDFYSLGLGDPYPLSSVHGIGTGDILDAIVENLPVEEENENPDIIRFSLI  180
            VDNPEMRNDIYDFYSLGLGDPYP+SSVHGIGTGD+LDAIVENLPVEE  EN DIIRFSLI
Sbjct:  121 VDNPEMRNDIYDFYSLGLGDPYPVSSVHGIGTGDVLDAIVENLPVEEAEENDDIIRFSLI  180

Query:  181 GRPNVGKSSLINAILGEDRVIASPVAGTTRDAIDTNFVDSQGQEYTMIDTAGMRKSGKVY  240
            GRPNVGKSSLINAILGEDRVIASPVAGTTRDAIDT+F D+ GQE+TMIDTAGMRKSGK+Y
Sbjct:  181 GRPNVGKSSLINAILGEDRVIASPVAGTTRDAIDTHFTDADGQEFTMIDTAGMRKSGKIY  240

Query:  241 ENTEKYSVMRSMRAIDRSDVVLMVINAEEGIREYDKRIAGFAHETGKGIIIVVNKWDTIE  300
            ENTEKYSVMR+MRAIDRSDVVLMVINAEEGIREYDKRIAGFAHE GKG+IIVVNKWDTI+
Sbjct:  241 ENTEKYSVMRAMRAIDRSDVVLMVINAEEGIREYDKRIAGFAHEAGKGMIIVVNKWDTID  300

Query:  301 KDNHTVSQWEADIRDNFQFLSYAPIIFVSAETKQRLHKLPDMIKRISESQNKRIPSAVLN  360
            KDNHTV++WEADIRD FQFL+YAPIIFVSA TKQRL+KLPD+IKRISESQNKRIPSAVLN
Sbjct:  301 KDNHTVAKWEADIRDQFQFLTYAPIIFVSALTKQRLNKLPDLIKRISESQNKRIPSAVLN  360

Query:  361 DVIMDAIAINPTPTDKGKRLKIFYATQVAVKPPTFVVFVNEEELMHFSYLRFLENQIREA  420
            DVIMDAIAINPTPTDKGKRLKIFYATQV+VKPPTFVVFVNEEELMHFSYLRFLENQIR A
Sbjct:  361 DVIMDAIAINPTPTDKGKRLKIFYATQVSVKPPTFVVFVNEEELMHFSYLRFLENQIRAA  420

Query:  421 FVFEGTPINLIARKRK                                             436
            F FEGTPI+LIARKRK
Sbjct:  421 FTFEGTPIHLIARKRK                                             436
```

Based on this analysis, it was predicted that these proteins and their epitopes could be useful antigens for vaccines or diagnostics.

EXAMPLE 1564

A DNA sequence (GBSx1657) was identified in *S. agalactiae* <SEQ ID 4831> which encodes the amino acid sequence <SEQ ID 4832>. Analysis of this protein sequence reveals the following:

```
Possible site: 51
>>> Seems to have no N-terminal signal sequence

----- Final Results -----
             bacterial cytoplasm --- Certainty = 0.2734(Affirmative) < succ>
              bacterial membrane --- Certainty = 0.0000(Not Clear) < succ>
               bacterial outside --- Certainty = 0.0000(Not Clear) < succ>
```

The protein has homology with the following sequences in the GENPEPT database.

```
>GP: AAC00359 GB: AF008220 DnaI [Bacillus subtilis]
Identities = 105/313 (33%), Positives = 191/313 (60%), Gaps = 17/313 (5%)

Query:    1 MKSVGQALENQGRVP--RNTNDELIQMILADAQVAEFIKTHQ--LSQREINISMSKFNQF   56
            M+ +G++L+       P +    +++ + ++ D  V   F+K ++   + Q+ I   S++K  ++
Sbjct:    1 MEPIGRSLQGVTGRPDFQKRLEQMKEKVMKDQDVQAFLKENEEVIDQKMIEKSLNKLYEY   60

Query:   57 LIERQK-----FKNKDSQYIAKGYEPILVMNEGYADVSYLE--TRELIEAQKKQAISDRI  109
            IE+ K       ++++   + +GY P LV+N    D+ Y E   +  ++ QKKQ       +
Sbjct:   61 -IEQSKNCSYCSEDENCNNLLEGYHPKLVVNGRSIDIEYYECPVKRKLDQQKKQ--QSLM  117

Query:  110 NLVNLPKSYRNIRMTDFDINNESRMKAMSQLLDFVETYPSYNH-KGLYLYGDMGVGKSYL  168
             + + +              DI++ SR+     + DF+++Y       KGLYLYG GVGK+++
Sbjct:  118 KSMYIQQDLLGATFQQVDISDPSRLAMFQHVTDFLKSYNETGKGKGLYLYGKFGVGKTFM  177

Query:  169 MAAMARELSERKGVSTTLLHFPSFAIDVKNAISSGTVKDEIDAVKSVPILILDDIGAEQA  228
            +AA+A EL+E++    S+ +++ P F  ++KN++     T++++++ VK+ P+L+LDDIGAE
Sbjct:  178 LAAIANELAEKE-YSSMIVYVPEFVRELKNSLQDQTLEEKLNMVKTTPVLMLDDIGAESM  236

Query:  229 TSWVRDEILQVILQHRMLEELPTFFTSNYSFNDLERKWA-NIKGSDETWQAKRVMERVRY  287
            TSWVRDE++  +LQHRM ++LPTFF+SN+S ++L+  +  ++G  E  +A R+MER+ Y
Sbjct:  237 TSWVRDEVIGTVLQHRMSQQLPTFFSSNFSPDELKHHFTYSQRGEKEEVKAARLMERILY  296

Query:  288 LAIEFHLEGPNRR                                                300
            LA    L+G NRR
Sbjct:  297 LAAPIRLDGENRR                                                309
```

A related DNA sequence was identified in *S. pyogenes* <SEQ ID 4833> which encodes the amino acid sequence <SEQ ID 4834>. Analysis of this protein sequence reveals the following:

```
Possible site: 19
>>> Seems to have no N-terminal signal sequence

----- Final Results -----
              bacterial cytoplasm --- Certainty = 0.1944(Affirmative) < succ>
               bacterial membrane --- Certainty = 0.0000(Not Clear)   < succ>
                bacterial outside --- Certainty = 0.0000(Not Clear)   < succ>
```

An alignment of the GAS and GBS proteins is shown below.

```
Identities = 228/300 (76%), Positives = 264/300 (88%)

Query:   1 MKSVGQALENQGRVPRNTNDELIQMILADAQVAEFIKTHQLSQREINISMSKFNQFLIER   60
           M+ +G+ +    G+  R  +D+LIQ ILAD +VA FI  H LSQ +IN+S+SKFNQFL+ER
Sbjct:   1 MEKIGETMAKLGQNTRVNSDQLIQTILADPEVASFISQHHLSQEQINLSLSKFNQFLVER   60

Query:  61 QKFKNKDSQYIAKGYEPILVMNEGYADVSYLETRELIEAQKKQAISDRINLVNLPKSYRN  120
           QK++  KD  YIAKGY+PIL MNEGYADVSYLET+EL+EAQK+ AIS+RI LV+LPKSYR+
Sbjct:  61 QKYQLKDPSYIAKGYQPILAMNEGYADVSYLETKELVEAQKQAAISERIQLVSLPKSYRH  120

Query: 121 IRMTDFDINNESRMKAMSQLLDFVETYPSYNHKGLYLYGDMGVGKSYLMAAMARELSERK  180
           I ++D D+NN SRM+A S +LDFVE YPS   KGLYLYGDMG+GKSYL+AAMA ELSE+K
Sbjct: 121 IHLSDIDVNNASRMEAFSAILDFVEQYPSAEQKGLYLYGDMGIGKSYLLAAMAHELSEKK  180

Query: 181 GVSTTLLHFPSFAIDVKNAISSGTVKDEIDAVKSVPILILDDIGAEQATSWVRDEILQVI  240
           GVSTTLLHFPSFAIDVKNAIS+G+VK+EIDAVK+VP+LILDDIGAEQATSWVRDE+LQVI
Sbjct: 181 GVSTTLLHFPSFAIDVKNAISNGSVKEEIDAVKNVPVLILDDIGAEQATSWVRDEVLQVI  240

Query: 241 LQHRMLEELPTFFTSNYSFNDLERKWANIKGSDETWQAKRVMERVRYLAIEFHLEGPNRR  300
           LQ+RMLEELPTFFTSNYSF DLERKWA IKGSDETWQAKRVMERVRYLA EFHLEG NRR
Sbjct: 241 LQYRMLEELPTFFTSNYSFADLERKWATIKGSDETWQAKRVMERVRYLAREFHLEGANRR  300
```

Based on this analysis, it was predicted that these proteins and their epitopes could be useful antigens for vaccines or diagnostics.

EXAMPLE 1565

A DNA sequence (GBSx1658) was identified in *S. agalactiae* <SEQ ID 4835> which encodes the amino acid sequence <SEQ ID 4836>. Analysis of this protein sequence reveals the following:

```
Possible site: 37
>>> Seems to have no N-terminal signal sequence

----- Final Results -----
              bacterial cytoplasm --- Certainty = 0.2660(Affirmative) < succ>
               bacterial membrane --- Certainty = 0.0000(Not Clear)   < succ>
                bacterial outside --- Certainty = 0.0000(Not Clear)   < succ>
```

The protein has no significant homology with any sequences in the GENPEPT database.

A related DNA sequence was identified in *S. pyogenes* <SEQ ID 4837> which encodes the amino acid sequence <SEQ ID 4838>. Analysis of this protein sequence reveals the following:

```
Possible site: 35
>>> Seems to have no N-terminal signal sequence

----- Final Results -----
              bacterial cytoplasm --- Certainty = 0.2135(Affirmative) < succ>
               bacterial membrane --- Certainty = 0.0000(Not Clear)   < succ>
                bacterial outside --- Certainty = 0.0000(Not Clear)   < succ>
```

An alignment of the GAS and GBS proteins is shown below.

```
Identities = 217/391 (55%) Positives = 309/391 (78%)

Query:    1 MMSPIDEFTYIKQNKIVYDSNSLIQLYFPIMGSDAMALYDYFVHFFDDGIRRHKFSEVLN   60
            MM PID FTY+K+NK+  DS +LIQLYFPI+GSDA+++Y YF+HFFDDG++RHKFS++LN
Sbjct:    1 MMKPIDTFTYLKRNKVTLDSVTLIQLYFPIIGSDAVSIYQYFIHFFDDGLQRHKFSDILN   60

Query:   61 HLQYGMPRFQDALVMLTALDLLTVYQATGTYLVKLNQAMSNELFLSNPIYRRLLEKRIGE  120
            HLQ+GM RF+DAL +LTA++L++VYQ + TYL+ L+Q +S +LF  +P Y RLLE++IGE
Sbjct:   61 HLQFGMKRFEDALAILTAMELVSVYQLSDTYLITLHQPLSRDLFFQHPAYSRLLEQKIGE  120

Query:  121 VAVAELDMKIPKNARDISKKFTDVFSDLGQPKQEVNRSKNVFDLESFKRLMMRDGLRFNN  180
            VAV+EL + +P  AR+ISK+F+D+F   G        + +  FDL SF++LM+RDGL+F +
Sbjct:  121 VAVSELQVTVPSQARNISKRFSDIFGVQGDLTNVPQKPQKNFDLSSFQQLMVRDGLQFED  180

Query:  181 EKDDVLGIYSVSELYHLNWYDTYQLAKQTAINGMIAPQRMKVQQNEGQHIKDNQSFTNNE  240
            + D++ +YS++E Y + W+DTYQ+AK TA+NG I P+R+  ++N+          ++F+  E
Sbjct:  181 NQKDIISLYSIAEQYDMTWFDTYQIAKATAVNGKIRPERLLAKKNQSMTKPSKENFSQAE  240

Query:  241 KVILRESKNDSALVFLEKIKRSRKAVTTSGEKTLLEDLAKMNFLDEVINVMVLYTLNKTK  300
            ++ILRE+K DSALVFLEKIK++R+A  T  E+ LL+ LAKMNFLD+VINVMVLYT NKTK
Sbjct:  241 QIILREAKQDSALVFLEKIKKARRATITKDERILLQTLAKMNFLDDVINVMVLYTFNKTK  300

Query:  301 SANLNKAYIMKVANDFAFQNVMTAEDAVLKIRDFSDQKVRTKTETKKKQSNVPEWSNPDY  360
            SANL K+Y++K+ANDFA+Q V TAE+A++ +R F+D++ R +++  K  QSNVP+WSNPDY
Sbjct:  301 SANLQKSYVLKMANDFAYQKVSTAEEAIVVLRAFTDRQSRRQSKVKTSQSNVPKWSNPDY  360

Query:  361 KDEVSPEKEIELEQFKTDALKRLERLGKDGE                              391
            ++  S E++ +L+QFK  ALKRLE LGK G+
Sbjct:  361 QETTSQEEQAKLDQFKQAALKRLENLGKGGD                              391
```

Based on this analysis, it was predicted that these proteins and their epitopes could be useful antigens for vaccines or diagnostics.

EXAMPLE 1566

A DNA sequence (GBSx1659) was identified in *S. agalactiae* <SEQ ID 4839> which encodes the amino acid sequence <SEQ ID 4840>. Analysis of this protein sequence reveals the following:

```
Possible site: 19
>>> Seems to have no N-terminal signal sequence

----- Final Results -----
           bacterial cytoplasm --- Certainty = 0.4485(Affirmative) < succ>
           bacterial membrane  --- Certainty = 0.0000(Not Clear)   < succ>
            bacterial outside  --- Certainty = 0.0000(Not Clear)   < succ>
```

The protein has homology with the following sequences in the GENPEPT database.

```
>GP: BAB06865 GB: AP001517 unknown conserved protein [Bacillus halodurans]
Identities = 80/150 (53%), Positives = 115/150 (76%)

Query:    1 MRCPKCGYNKSSVVDSRQAEEGTTIRRRRECEKCGNRFTTFERLEELPLLVIKKDGTREQ   60
            MRCP C +N + V+DSR A EG +IRRRRECE C +RFTTFE +EE+PL+V+KKDGTR++
Sbjct:    1 MRCPACHHNGTRVLDSRPAHEGRSIRRRRECESCNHRFTTFEMIEEVPLIVVKKDGTRQE   60

Query:   61 FSRDKILNGIIQSAQKRPVSSEDIENCILRIERKIRSEYEDEVSSITIGNLVMDELAELD  120
            FS DKIL G+I++ +KRPV  E +E +   +ER++R + ++EV S   IG LVM+ LA +D
Sbjct:   61 FSSDKILRGLIRACEKRPVPLETLEGIVNEVERELRGQGKNEVDSKEIGELVMERLANVD  120

Query:  121 EITYVRFASVYKSFKDVDEIEELLQQITKR                              150
            ++ YVRFASVY+ FKD++   + L+++ +R
Sbjct:  121 DVAYVRFASVYRQFKDINVFIQELKELMER                              150
```

A related DNA sequence was identified in *S. pyogenes* <SEQ ID 4841> which encodes the amino acid sequence <SEQ ID 4842>. Analysis of this protein sequence reveals the following:

```
Possible site: 19
>>> Seems to have no N-terminal signal sequence

----- Final Results -----
              bacterial cytoplasm --- Certainty = 0.4365(Affirmative) < succ>
               bacterial membrane --- Certainty = 0.0000(Not Clear)   < succ>
                bacterial outside --- Certainty = 0.0000(Not Clear)   < succ>
```

An alignment of the GAS and GBS proteins is shown below.

```
Identities = 131/155 (84%), Positives = 143/155 (91%)

Query:    1 MRCPKCGYNKSSVVDSRQAEEGTTIRRRRECEKCGNRFTTFERLEELPLLVIKKDGTREQ   60
            +RCPKC Y+KSSVVDSRQAE+G TIRRRRECE+C  RFTTFER+EELPLLVIKKDGTREQ
Sbjct:    1 VRCPKCNYHKSSVVDSRQAEDGNTIRRRRECEQCHTRFTTFERVEELPLLVIKKDGTREQ   60

Query:   61 FSRDKILNGIIQSAQKRPVSSEDIENCILRIERKIRSEYEDEVSSITIGNLVMDELAELD  120
            FSRDKILNG++QSAQKRPVSS DIEN I RIE+++R+ YE+EVSS  IGNLVMDELAELD
Sbjct:   61 FSRDKILNGVVQSAQKRPVSSTDIENVISRIEQEVRTTYENEVSSTAIGNLVMDELAELD  120

Query:  121 EITYVRFASVYKSFKDVDEIEELLQQITKRVRSKK                          155
            EITYVRFASVYKSFKDVDEIEELLQQIT RVR KK
Sbjct:  121 EITYVRFASVYKSFKDVDEIEELLQQITNRVRGKK                          155
```

Based on this analysis, it was predicted that these proteins and their epitopes could be useful antigens for vaccines or diagnostics.

EXAMPLE 1567

A DNA sequence (GBSx1660) was identified in *S. agalactiae* <SEQ ID 4843> which encodes the amino acid sequence <SEQ ID 4844>. This protein is predicted to be CsrS (mtrB). Analysis of this protein sequence reveals the following:

```
Possible site: 35
>>> Seems to have no N-terminal signal sequence
     INTEGRAL    Likelihood = -11.30    Transmembrane    22-38   (18-43)
     INTEGRAL    Likelihood =  -9.66    Transmembrane   189-205 (187-212)

----- Final Results -----
              bacterial membrane  --- Certainty = 0.5522(Affirmative) < succ>
              bacterial outside   --- Certainty = 0.0000(Not Clear)   < succ>
              bacterial cytoplasm --- Certainty = 0.0000(Not Clear)   < succ>
```

A related DNA sequence was identified in *S. pyogenes* <SEQ ID 2109> which encodes the amino acid sequence <SEQ ID 2110>. Analysis of this protein sequence reveals the following:

```
Possible site: 35
>>> Seems to have a cleavable N-term signal seq.
     INTEGRAL    Likelihood = -6.32    Transmembrane   196-212 (189-214)

----- Final Results -----
              bacterial membrane  --- Certainty = 0.3527(Affirmative) < succ>
              bacterial outside   --- Certainty = 0.0000(Not Clear)   < succ>
              bacterial cytoplasm --- Certainty = 0.0000(Not Clear)   < succ>
```

An alignment of the GAS and GBS proteins is shown below.

```
Identities = 248/501 (49%), Positives = 363/501 (71%), Gaps = 4/501 (0%)

Query:   1 MKNKKDQFIGVKQPLSKKLSQLVFILFFSLFTVFSVLVYTSATRYVLHREKINVGRSLEK   60
           M+N+K +    K  L K+LS + F+LFF +F+ F+++ Y+S   ++L +EK +V +++
Sbjct:   1 MENQKQKQKKYKNSLPKRLSNIFFVLFFCIFSAFTLIAYSSTNYFLLKKEKQSVFQAVNI   60
```

-continued

```
Query:   61 TRVRLSQANSSLTSDDILEILYNQVFADDIYPHKRQNGIVRTGESIDSILYVNQEMTLYD 120
            RVRLS+ +S+ T +++ E+LY           ++ + ++R+     I + L  NQ++ +Y+
Sbjct:   61 VRVRLSEVDSNFTLENLAEVLYKNDKTHLRIDDRKGSRVIRSERDITNTLDANQDIYVYN 120

Query:  121 VNRKPVFST-LRTGMPTIGKSMGKVIISKVADM-EGFVGTKAIYSQKTGQLLGYVQIFYN 178
            ++++ +F+T      P +    +G+V   + D   GF   T+ +YS +TG+ +GYVQ+F++
Sbjct:  121 IDKQMIFTTDNEESSPGLHGPIGRVYHDHIEDQYRGFSMTQKVYSNRTGKFVGYVQVFHD 180

Query:  179 LGRYYSMRQNIIVFLIMMEVLGTVLALVVINSATKRIVRPVKNLHDLMHQISENPSNLEI 238
            LG YY +R   ++ +L+++E+ GT LA ++I    T+R ++P+ NLH++M  ISENP+NL +
Sbjct:  181 LGNYYVIRARLLFWLLVVELFGTSLAYLIILITTRRFLKPLHNLHEVMRNISENPNNLNL 240

Query:  239 RSKVRSEDEIGELSRIFDGMLDQLEDYTRRQSQFISDVSHELRTPVAVVKGHIGLLQRWG 298
            RS + S DEI ELS IFD MLD+LE +T+ QS+FISDVSHELRTPVA++KGHIGLLQRWG
Sbjct:  241 RSDISSGDEIEELSVIFDNMLDKLETHTKLQSRFISDVSHELRTPVAIIKGHIGLLQRWG 300

Query:  299 KDDPEILEESLAAAYHEADRMSLMINDMLNMIRVQGSLELHQDEVTDLSSSISVVIENFR 358
            KDD +ILEESL A   HEADRM++MINDML+MIRVQGS E  HQ+++T L   SI  V+ NFR
Sbjct:  301 KDDSDILEESLTATAHEADRMAIMINDMLDMIRVQGSFEGHQNDMTVLEDSIETVVGNFR 360

Query:  359 ILREDFQFIFENNISDIVWGKIYKIHFEQALMILIDNAIKYSPSYKEVSVVLSVDNDFAT 418
            +LREDF F +++     +  +IYK HFEQALMILIDNA+KYS    K++++ LSV
Sbjct:  361 VLREDFIFTWQSENPKTI-ARIYKNHFEQALMILIDNAVKYSRKEKKIAINLSVTGKQEA 419

Query:  419 VV-VKDKGEGISDEDIEFIFDRFYRTDKSRNRESTQAGLGIGLSVFKQIMDAYHLKVDIK 477
            +V V+DKGEGIS  EDIE IF+RFYRTDKSRNR STQAGLGIGLS+ KQI+D YHL++ ++
Sbjct:  420 IVRVQDKGEGISKEDIEHIFERFYRTDKSRNRTSTQAGLGIGLSILKQIVDGYHLQMKVE 479

Query:  478 SELNQGTEFIVRIPIKKFEET                                       498
            SELN+G+ FI+ IP+ + +E+
Sbjct:  480 SELNEGSVFILHIPLAQSKES                                       500
```

A related GBS gene <SEQ ID 8845> and protein <SEQ ID 8846> were also identified. Analysis of this protein sequence reveals the following:

```
Lipop: Possible site: -1 Crend: 5
SRCFLG: 0
McG: Length of UR: 5
     Peak Value of UR: 0.74
     Net Charge of CR: 2
McG: Discrim Score: -10.19
GvH: Signal Score (-7.5): -3.66
     Possible site: 35
>>> Seems to have no N-terminal signal sequence
Amino Acid Composition: calculated from 1
ALOM program count: 2 value: -11.30 threshold: 0.0
     INTEGRAL     Likelihood = -11.30    Transmembrane   22-38  (18-43)
     INTEGRAL     Likelihood = -9.66     Transmembrane  189-205 (187-212)
     PERIPHERAL   Likelihood = 2.86      405
modified ALOM score: 2.76
icml HYPID: 7 CFP: 0.552
*** Reasoning Step: 3

----- Final Results -----
             bacterial membrane --- Certainty = 0.5522(Affirmative) < succ>
             bacterial outside  --- Certainty = 0.0000(Not Clear)   < succ>
             bacterial cytoplasm --- Certainty = 0.0000(Not Clear)  < succ>
```

SEQ ID 8846 (GBS321) was expressed in *E. coli* as a GST-fusion product. SDS-PAGE analysis of total cell extract is shown in FIG. 173 (lane 6; MW 84 kDa). It was also expressed in *E. coli* as a His-fusion product. SDS-PAGE analysis of total cell extract is shown in FIG. 80 (lane 2; MW 58.7 kDa).

GBS321-GST was purified as shown in FIG. 220, lane 3.

Based on this analysis, it was predicted that these proteins and their epitopes could be useful antigens for vaccines or diagnostics.

EXAMPLE 1568

A DNA sequence (GBSx1661) was identified in *S. agalactiae* <SEQ ID 4845> which encodes the amino acid sequence <SEQ ID 4846>. This protein is predicted to be CsrR (trcR). Analysis of this protein sequence reveals the following:

```
Possible site: 61
>>> Seems to have no N-terminal signal sequence

----- Final Results -----
           bacterial cytoplasm --- Certainty = 0.2649(Affirmative) < succ>
            bacterial membrane --- Certainty = 0.0000(Not Clear)   < succ>
              bacterial outside --- Certainty = 0.0000(Not Clear)   < succ>
```

A related DNA sequence was identified in *S. pyogenes* <SEQ ID 3259> which encodes the amino acid sequence <SEQ ID 3260>. Analysis of this protein sequence reveals the following:

```
Possible site: 61
>>> Seems to have no N-terminal signal sequence

----- Final Results -----
           bacterial cytoplasm --- Certainty = 0.3226(Affirmative) < succ>
            bacterial membrane --- Certainty = 0.0000(Not Clear)   < succ>
              bacterial outside --- Certainty = 0.0000(Not Clear)   < succ>
```

An alignment of the GAS and GBS proteins is shown below.

```
Identities = 193/229 (84%), Positives = 211/229 (91%), Gaps = 1/229 (0%)

Query:    1 MGKKILIIEDEKNLARFVSLELLHEGYDVVVETNGREGLDTALEKDFDLILLDLMLPEMD   60
            M KKILIIEDEKNLARFVSLEL HEGY+V+VE NGREGL+TALEK+FDLILLDLMLPEMD
Sbjct:    1 MTKKILIIEDEKNLARFVSLELQHEGYEVIVEVNGREGLETALEKEFDLILLDLMLPEMD   60

Query:   61 GFEITRRLQAEKTTYIMMMTARDSVMDIVAGLDRGADDYIVKPFAIEELLARVRAIFRRQ  120
             GFE+TRRLQ EKTTYIMMMTARDS+MD+VAGLDRGADDYIVKPFAIEELLAR+RAIFRRQ
Sbjct:   61 GFEVTRRLQTEKTTYIMMMTARDSIMDVVAGLDRGADDYIVKPFAIEELLARIRAIFRRQ  120

Query:  121 EIETKTKEKGDSGSFRDLSLNTHNRSAMRGDEEISLTKREFDLLNVLMTNMNRVMTREEL  180
             +IE++ K+    G +RDL LN  NRS  RGD+EISLTKRE+DLLN+LMTNMNRVMTREEL
Sbjct:  121 DIESE-KKVPSQGIYRDLVLNPQNRSVNRGDDEISLTKREYDLLNILMTNMNRVMTREEL  179

Query:  181 LEHVWKYDVAAETNVVDVYIRYLRGKIDIPGRESYIQTVRGMGYVIREK             229
             L +VWKYD A ETNVVDVYIRYLRGKIDIPG+ESYIQTVRGMGYVIREK
Sbjct:  180 LSNVWKYDEAVETNVVDVYIRYLRGKIDIPGKESYIQTVRGMGYVIREK             228
```

Based on this analysis, it was predicted that these proteins and their epitopes could be useful antigens for vaccines or diagnostics.

EXAMPLE 1569

A DNA sequence (GBSx1662) was identified in *S. agalactiae* <SEQ ID 4847> which encodes the amino acid sequence <SEQ ID 4848>. Analysis of this protein sequence reveals the following:

```
Possible site: 60
>>> Seems to have no N-terminal signal sequence

----- Final Results -----
           bacterial cytoplasm --- Certainty = 0.3864(Affirmative) < succ>
            bacterial membrane --- Certainty = 0.0000(Not Clear)   < succ>
              bacterial outside --- Certainty = 0.0000(Not Clear)   < succ>
```

The protein has homology with the following sequences in the GENPEPT database.

```
>GP: AAG32547 GB: U12643 YlbN-like hypothetical protein [Streptococcus
gordonii]
Identities = 91/174 (52%), Positives = 133/174 (76%), Gaps = 3/174 (1%)

Query:    3 LTEIKKSPEGLYFDKKIDIKESLMERHSEIMDISDIQVSGHVVYEDGLYLLDYNMAYDIT   62
            + EI+K+P+GL F+KK+D+ E L ER++EI+D+ DI  SG   YEDGLY LDY ++Y IT
Sbjct:    4 IQEIRKNPDGLAFEKKLDLAEEELKERNAEILDVQDIVASGRAQYEDGLYFLDYELSYTIT   63
```

```
Query:   63 LPSSRSMKPVVLSEKQTINEVFIEAENVSTKKELVDQELVLILEEDDINLEESVIDNILL  122
            L SSRSM+PV    E   +NE+F+E    V++ +E++DQ+LVL +E  +IN+ ESV DNILL
Sbjct:   64 LASSRSMEPVERKESYLVNEIFMEDGQVAS-QEMIDQDLVLPIENGEINVAESVADNILL  122

Query:  123 NIPLRVL-AADEVGVEADLSGKNWSLMTEKQYEEKQAKEKEKSNPFAALEGMFD         175
            NIPL+VL AA+E G +    +G++W +MTE  Y++ QA++KE+++PFA L+G+FD
Sbjct:  123 NIPLKVLTAAEEAGSDLP-TGRDWQVMTEDDYQKYQAEKKEENSPFAGLQGLFD         175
```

A related DNA sequence was identified in *S. pyogenes* <SEQ ID 4849> which encodes the amino acid sequence <SEQ ID 4850>. Analysis of this protein sequence reveals the following:

```
Possible site: 42
>>> Seems to have no N-terminal signal sequence

----- Final Results -----
            bacterial cytoplasm --- Certainty = 0.3032(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below.

```
Identities = 86/175 (49%), Positives = 135/175 (77%)

Query:    1 MLLTEIKKSPEGLYFDKKIDIKESLMERHSEIMDISDIQVSGHVVYEDGLYLLDYNMAYD   60
            + ++EI+K P+GL FD+  D+K  L+ER  +I+DI ++   G+V Y+ GLYLLDY ++Y+
Sbjct:    3 LAISEIRKHPDGLSFDRLCDVKSMLLERDQQIIDIKAVKAVGNVRYDKGLYLLLDYQLSYE  62

Query:   61 ITLPSSRSMKPVVLSEKQTINEVFIEAENVSTKKELVDQELVLILEEDDINLEESVIDNI  120
            + LPSSRSM PV LSE Q I E+FIEA +++ KKELV+  LVL+L++D INLEES++DNI
Sbjct:   63 VILPSSRSMVPVCLSEVQHIQELFIEATDLADKKELVEDNLVLVLDKDAINLEESIVDNI  122

Query:  121 LLNIPLRVLAADEVGVEADLSGKNWSLMTEKQYEEKQAKEKEKSNPFAALEGMFD       175
            LL  IP++VL  +E   +   +G+NW+++TE+ Y+  +  ++++++NPFA+L+G+FD
Sbjct:  123 LLAIPVQVLTEEEKKSKELPAGQNWAVLTEEDYQCLKEEKQKENNPFASLQGLFD       177
```

Based on this analysis, it was predicted that these proteins and their epitopes could be useful antigens for vaccines or diagnostics.

EXAMPLE 1570

A DNA sequence (GBSx1663) was identified in *S. agalactiae* <SEQ ID 4851> which encodes the amino acid sequence <SEQ ID 4852>. This protein is predicted to be heat shock protein (htpX). Analysis of this protein sequence reveals the following:

```
Possible site: 25
>>> Seems to have a cleavable N-term signal seq.
    INTEGRAL    Likelihood = -11.30    Transmembrane    195-211 (190-221)
    INTEGRAL    Likelihood = -11.09    Transmembrane     43-59  (31-62)
    INTEGRAL    Likelihood =  -3.61    Transmembrane    153-169 (153-174)

----- Final Results -----
             bacterial membrane --- Certainty = 0.5522(Affirmative) < succ>
              bacterial outside --- Certainty = 0.0000(Not Clear)   < succ>
            bacterial cytoplasm --- Certainty = 0.0000(Not Clear)   < succ>
```

The protein has homology with the following sequences in the GENPEPT database.

```
>GP: AAB70525 GB: AF017421 putative heat shock protein HtpX
[Streptococcus gordonii]
Identities = 220/297 (74%), Positives = 261/297 (87%), Gaps = 1/297 (0%)

Query:    1 MLYQQIASNKRKTVVLLIVFFCLLAAIGAAVGYLVLGSYQFGLVLALIIGVIYAVSMIFQ   60
            ML++QIA+NKR+T  LL+ FF LLA IGAA GYL + S   G+++A IIG+IYA++MIFQ
Sbjct:    1 MLFEQIAANKRRTWFLLVAFFALLALIGAAAGYLWMNSPLGGVIIAFIIGLIYAITMIFQ   60
```

-continued

```
Query:   61 STNVVMSMNNAREVTEDEAPNYFHIVEDMAMIAQIPMPRVFIVEDDSLNAFATGSKPENA 120
            ST VVMSMN AR+V+E EAP  +HIV+DMAM+AQIPMPRV+IVEDDS NAFATGS PENA
Sbjct:   61 STEVVMSMNGARQVSEQEAPELYHIVQDMANVAQIPMPRVYIVEDDSPNAFATGSNPENA 120

Query:  121 AVAATTGLLAVMNREELEGVIGHEVSHIRNYDIRISTIAVALASAVTLISSIGSRMLFYG 180
            AVAATTGLL +MNREELEGVIGHEVSHIRNYDIRISTIAVALASA+T+ISS+  RM++YG
Sbjct:  121 AVAATTGLLRLMNREELEGVIGHEVSHIRNYDIRISTIAVALASAITMISSVAGRMNWYG 180

Query:  181 GGRRRDDDREDGG-NILVLIFSILSLILAPLAASLVQLAISRQREYLADASSVELTRNPQ 239
            GGRRR+D  +D G  +L+L+FS++++ILAPLAA+LVQLAISRQRE+LADASSVELTRNPQ
Sbjct:  181 GGRRRNDRDDDSGLGLLMLVFSLIAIILAPLAATLVQLAISRQREFLADASSVELTRNPQ 240

Query:  240 GMISALEKLDRSEPMGHPVDDASAALYINDPTKKEGLKSLFYTHPPIADRIERLRHM     296
            GMI AL+KLD SEPM   VDDASAALYI+DP KK GL+ LFYTHPPI++R+ERLR M
Sbjct:  241 GMIRALQKLDNSEPMHRHVDDASAALYISDPKKKGGLQKLFYTHPPISERVERLRKM     297
```

15

A related DNA sequence was identified in *S. pyogenes* <SEQ ID 4853> which encodes the amino acid sequence <SEQ ID 4854>. Analysis of this protein sequence reveals the following:

```
Possible site: 31
>>> Seems to have a cleavable N-term signal seq.
    INTEGRAL      Likelihood = -9.77    Transmembrane   197-213 (192-223)
    INTEGRAL      Likelihood = -8.33    Transmembrane    43-59  (33-61)
    INTEGRAL      Likelihood = -3.82    Transmembrane   153-169 (153-174)

----- Final Results -----
            bacterial membrane --- Certainty = 0.4906(Affirmative) < succ>
             bacterial outside --- Certainty = 0.0000(Not Clear)  < succ>
           bacterial cytoplasm --- Certainty = 0.0000(Not Clear)  < succ>
```

30

The protein has homology with the following sequences in the databases:

```
>GP: AAB70525 GB: AF017421 putative heat shock protein HtpX [Streptococcus
gordonii]
Identities = 208/298 (69%), Positives = 257/298 (85%), Gaps = 1/298 (0%)

Query:    1 MLYQQISQNKQRTVVLLVGFFALLALIGASAGYLLLDNYAMGLVLALVIGVIYATSMIFQ  60
            ML++QI+ NK+RT  LLV FFALLALIGA+AGYL +++    G+++A +IG+IYA +MIFQ
Sbjct:    1 MLFEQIAANKRRTWFLLVAFFALLALIGAAAGYLWMNSPLGGVIIAFIIGLIYATTMIFQ  60

Query:   61 STSLVMSMNNAREVTEKEAPGFFHIVEDMAMVAQIPMPRVFIIEDPSLNAFATGSSPQNA 120
            ST +VMSMN AR+V+E+EAP  +HIV+DMAMVAQIPMPRV+I+ED S NAFATGS+P+NA
Sbjct:   61 STEVVMSMNGARQVSEQEAPELYHIVQDMAMVAQIPMPRVYIVEDDSPNAFATGSNPENA 120

Query:  121 AVAATTGLLEVMNREELEGVIGHEISHIRNYDIRISTIAVALASAVTVISSIGGRMLWYG 180
            AVAATTGLL +MNREELEGVIGHE+SHIRNYDIRISTIAVALASA+T+ISS+ GRM+WYG
Sbjct:  121 AVAATTGLLRLMNREELEGVIGHEVSHIRNYDIRISTIAVALASAITMISSVAGRMMWYG 180

Query:  181 GGSRRQRDDGDDDVLRIITLLLSLLSLLLAPLVASLIQLAISRQREYLADASSVELTRNP 240
            GG RR+ D  DD  L ++ L+ SL++++LAPL A+L+QLAISRQRE+LADASSVELTRNP
Sbjct:  181 GG-RRRNDRDDDSGLGLLMLVFSLIAIILAPLAATLVQLAISRQREFLADASSVELTRNP 239

Query:  241 QGMIKALEKLQLSQPMKHPVDDASAALYINEPRKKRSFSSLFSTHPPIEERIERLKNM   298
            QGMI+AL+KL  S+PM   VDDASAALYI++P+KK      LF THPPI ER+ERL+ M
Sbjct:  240 QGMIRALQKLDNSEPMHRHVDDASAALYISDPKKKGGLQKLFYTHPPISERVERLRKM   297
```

An alignment of the GAS and GBS proteins is shown below.

```
Identities = 233/298 (78%), Positives = 262/298 (87%), Gaps = 2/298 (0%)

Query:    1 MLYQQIASNKRKTVVLLIVFFCLLAAIGAAVGYLVLGSYQFGLVLALIIGVIYAVSMIFQ  60
            MLYQQI+ NK++TVVLL+ FF LLA IGA+ GYL+L +Y  GLVLAL+IGVIYA SMIFQ
Sbjct:    1 MLYQQISQNKQRTVVLLVGFFALLALIGASAGYLLLDNYAMGLVLALVIGVIYATSMIFQ  60

Query:   61 STNVVMSMNNAREVTEDEAPNYFHIVEDMAMIAQIPMPRVFIVEDDSLNAFATGSKPENA 120
            ST++VMSMNNAREVTE EAP +FHIVEDMAM+AQIPMPRVFI+ED SLNAFATGS P+NA
Sbjct:   61 STSLVMSMNNAREVTEKEAPGFFHIVEDMAMVAQIPMPRVFIIEDPSLNAFATGSSPQNA 120
```

```
-continued
Query: 121 AVAATTGLLAVMNREELEGVIGHEVSHIRNYDIRISTIAVALASAVTLISSIGSRMLFYG  180
            AVAATTGLL VMNREELEGVIGHE+SHIRNYDIRISTIAVALASAVT+ISSIG RML+YG
Sbjct: 121 AVAATTGLLEVMNREELEGVIGHEISHIRNYDIRISTIAVALASAVTVISSIGGRMLWYG  180

Query: 181 GG--RRRDDDREDGGNILVLIFSILSLILAPLAASLVQLAISRQREYLADASSVELTRNP  238
            GG  R+RDD  +D    I+ L+ S+LSL+LAPL ASL+QLAISRQREYLADASSVELTRNP
Sbjct: 181 GGSRRQRDDGDDDVLRIITLLLSLLSLLLAPLVASLIQLAISRQREYLADASSVELTRNP  240

Query: 239 QGMISALEKLDRSEPMGHPVDDASAALYINDPTKKEGLKSLFYTHPPIADRIERLRHM   296
            QGMI ALEKL  S+PM HPVDDASAALYIN+P KK     SLF THPPI +RIERL++M
Sbjct: 241 QGMIKALEKLQLSQPMKHPVDDASAALYINEPRKKRSFSSLFSTHPPIEERIERLKNM   298
```

A related GBS gene <SEQ ID 8847> and protein <SEQ ID 8848> were also identified. Analysis of this protein sequence reveals the following:

```
Lipop: Possible site: -1 Crend: 10
McG: Discrim Score: 9.61
GvH: Signal Score (-7.5): -0.97
    Possible site: 25
>>> Seems to have a cleavable N-term signal seq.
ALOM program count: 3 value: -11.30   threshold: 0.0
    INTEGRAL  Likelihood = -11.30  Transmembrane       195-211 (190-221)
    INTEGRAL  Likelihood = -11.09  Transmembrane        43-59  (31-62)
    INTEGRAL  Likelihood =  -3.61  Transmembrane       153-169 (153-174)
PERIPHERAL   Likelihood =   5.89      87
modified ALOM score: 2.76

*** Reasoning Step: 3

----- Final Results -----
            bacterial membrane --- Certainty = 0.5522 (Affirmative) < succ>
             bacterial outside --- Certainty = 0.0000 (Not Clear)  < succ>
            bacterial cytoplasm --- Certainty = 0.0000 (Not Clear)  < succ>
```

The protein has homology with the following sequences in the databases:

```
73.8/88.3% over 296aa
imported
SP|O30795| PUTATIVE HEAT SHOCK PROTEIN HTPX. Insert characterized
GP|2407215|gb|AAB70525.1||AF-17421 putative heat shock protein HtpX
{Streptococcus gordonii} Insert characterized
PIR|T48855|T48855 probable heat shock protein HtpX - Streptococcus gordonii
Insert characterized
ORF02338(301-1188 of 1488)
SP|O30795|HTPX_STRGC(1-297 of 297) PUTATIVE HEAT SHOCK PROTEIN
HTPX.GP|2407215|gb|AAB70525.1||AF-17421 putative heat shock protein HtpX
{Streptococcus gordonii}PIR|T48855|T48855 probable heat shock protein HtpX
[imported] - Streptococcus gordonii
% Match = 44.0
% Identity = 73.7  % Similarity = 88.2
Matches = 219  Mismatches = 34   Conservative Sub.s = 43
141       171       201       231       261       291       321       351
NFLFTSVI*HNNIQL*CEIRNFPK*YCWKTIWVQTKPILRNS*RRKRSAKSFL*LLEKGERLLLYQQIASNKRKTVVLL
                                                         :|::|||:|||:|   ||
                                                         MLFEQIAANKRRTWFLL
                                                                 10
381       411       441       471       501       531       561       591
IVFFCLLAAIGAAVGYLVLGSYQFGLVLALIIGVIYAVSMIFQSTNVVMSMNNAREVTEDEAPNYFHIVEDMAMIAQIPM
: || ||| |||| |||  : |   |:::|:|||:|||::|||||  |||||   ||:|: |||    :|||:||||:||||
VAFFALLALIGAAAGYLWMNSPLGGVIIAFIIGLIYAITMIFQSTEVVMSMNGARQVSEQEAPELYHIVQDMAMVAQIPM
          30        40        50        60        70        80        90
621       651       681       711       741       771       801       831
PRVFIVEDDSLNAFATGSKPENAAVAATTGLLAVMNREELEGVIGHEVSHIRNYDIRISTIAVALASAVTLISSIGSRML
|||:||||||  ||||||  ||||||||||||:  ||||||||||||||||||||||||||||||||:|||:  ||:
PRVYIVEDDSPNAFATGSNPENAAVAATTGLLRLMNREELEGVIGHEVSHIRNYDIRISTIAVALASAITMISSVAGRMM
          110       120       130       140       150       160       170
861       888       918       948       978       1008      1038      1068
FYGGGRRRDDDREDGG-NILVLIFSILSLILAPLAASLVQLAISRQREYLADASSVELTRNPQGMISALEKLDRSEPMGH
:|||||||:|  :|  |  :|:||::::||||||||||||:|||||||||:|||||||||||||||||:|:||||  |||
WYGGGRRRNDRDDDSGLGLLMLVFSLIAIILAPLAATLVQLAISRQREFLADASSVELTRNPQGMIRALQKLDNSEPMHR
          190       200       210       220       230       240       250
1098      1128      1158      1188      1218      1248      1278      1308
PVDDASAALYINDPTKKEGLKSLFYTHPPIADRIERLRHM*SLTKRRVAMPCVLFF*DKACKT*YNMTYTIKGDTCYLQ
||||||||||||:|| || ||: |||||||||::|:|||| |
HVDDASAALYISDPKKKGGLQKLFYTHPPISERVERLRKM
          270       280       290
```

SEQ ID 8848 (GBS179) was expressed in *E. coli* as a GST-fusion product. SDS-PAGE analysis of total cell extract is shown in FIG. 175 (lane 11; MW 58 kDa).

GBS179-GST was purified as shown in FIG. 227, lane 5.

Based on this analysis, it was predicted that these proteins and their epitopes could be useful antigens for vaccines or diagnostics.

EXAMPLE 1571

A DNA sequence (GBSx1665) was identified in *S. agalactiae* <SEQ ID 4855> which encodes the amino acid sequence <SEQ ID 4856>. Analysis of this protein sequence reveals the following:

```
Possible site: 20
>>> Seems to have an uncleavable N-term signal seq
INTEGRAL Likelihood = -15.44 Transmembrane 4-20 (1-27)

----- Final Results -----
            bacterial membrane --- Certainty = 0.7177 (Affirmative) < succ>
             bacterial outside --- Certainty = 0.0000 (Not Clear) < succ>
           bacterial cytoplasm --- Certainty = 0.0000 (Not Clear) < succ>
```

The protein has homology with the following sequences in the GENPEPT database.

```
>GP: AAG23700 GB: AF017421 LemA-like protein [Streptococcus gordonii]
Identities = 124/182 (68%), Positives = 152/182 (83%)

Query:   1 MGTMILIAIIALFVIWLIVAYNSLVRSRMHTKESWSQIDVQLKRRNDLIPNLIETVKGYA   60
           M +I IA+I + V+++I  YNSLVR+RM T+E+WSQIDVQLKRRNDL+PNLIETVKGY
Sbjct:   1 MSFIITIAVIVVIVLFVISVYNSLVRARMQTQEAWSQIDVQLKRRNDLLPNLIETVKGYG   60

Query:  61 AYEGKTLEKIAELRAQVAKANTPAEAMTASNELTRQLSSILAVAENYPDLKANNSFVKLQ  120
           YE  TLEK+ +LRAQVA A++PA+AM AS+ LTRQ+S I AVAE+YPDLKAN +++KLQ
Sbjct:  61 KYEQATLEKVTQLRAQVASASSPADAMKASDALTRQISGIFAVAESYPDLKANENYLKLQ  120

Query: 121 EELTNTENKISYSRQLYNTTTSNYNVKLETFPPSNIVGKLFGFKPSQFLETPEEEKEVPKV  180
           EELTNTENKISYSRQLYN+    NYNVKL+ FPSN++  F F+P+ FL TPEEEK VPKV
Sbjct: 121 EELTNTENKISYSRQLYNSVAGNYNVKLQAFPSNVIAGMFAFRPADFLSTPEEEKAVPKV  180

Query: 181 SF                                                           182
            F
Sbjct: 181 DF                                                           182
```

A related DNA sequence was identified in *S. pyogenes* <SEQ ID 4857> which encodes the amino acid sequence <SEQ ID 4858>. Analysis of this protein sequence reveals the following:

```
Possible site: 15
>>> Seems to have a cleavable N-term signal seq.

----- Final Results -----
              bacterial outside --- Certainty = 0.3000 (Affirmative) < succ>
             bacterial membrane --- Certainty = 0.0000 (Not Clear) < succ>
            bacterial cytoplasm --- Certainty = 0.0000 (Not Clear) < succ>
```

The protein has homology with the following sequences in the databases:

```
>GP: AAC44350 GB: U66186 LemA [Listeria monocytogenes]
Identities = 91/181 (50%), Positives = 121/181 (66%), Gaps = 2/181 (1%)

Query:   5 LIILVVLGVLALWLMISYNSLVKSRMHTKEAWSQIDVQLKRRNDLIPNLIETVKGYASYE   64
           +I + V+ +L L     YNSLVK R   E W+QIDVQLKRR DLIPNL+ETVKGYA +E
Sbjct:   5 IIAIAVVVILVLIYFGLYNSLVKYRNRVDETWAQIDVQLKRRFDLIPNLVETVKGYAKHE   64
```

```
Query:   65 QKTFEKITDLRARVAN--ASTPQETMAASNELSKQVTSLFAVAENYPDLKANENFLKLQE   122
            ++T ++ + R ++     A  Q  + A N LS  + S+FA+ E YPDLKAN +F++LQ
Sbjct:   65 KETLTQVIEARNKMMEVPADNRQGQIEADNMLSGALKSIFALGEAYPDLKANTSFIELQH   124

Query:  123 ELTNTENKISYSRQLYNSTTSNYNLQLESFPSNIAGKLFGFKPSEFLQTPEAEKEVPKVEF   183
            ELT TENK++YSRQLYN+T  YN +++S P+NI  KL F  + L  PE E+  PKVEF
Sbjct:  125 ELTTTENKVAYSRQLYNTTVMTYNTKVQSVPTNIVAKLHNFTERDMLSIPEVERVAPKVEF   185
```

An alignment of the GAS and GBS proteins is shown below.

```
Identities = 135/181 (74%), Positives = 165/181 (90%)

Query:    4 MILIAIIALFVIWLIVAYNSLVRSRMHTKESWSQIDVQLKRRNDLIPNLIETVKGYAAYE    63
            +I++ ++ +   +WL+++YNSLV+SRMHTKE+WSQIDVQLKRRNDLIPNLIETVKGYA+YE
Sbjct:    5 LIILVVLGVLALWLMISYNSLVKSRMHTKEAWSQIDVQLKRRNDLIPNLIETVKGYASYE    64

Query:   64 GKTLEKIAELRAQVAKANTPAEAMTASNELTRQLSSILAVAENYPDLKANNSFVKLQEEL   123
              KT EKI +LRA+VA A+TP E M ASNEL++Q++S+ AVAENYPDLKAN +F+KLQEEL
Sbjct:   65 QKTFEKITDLRARVANASTPQETMAASNELSKQVTSLFAVAENYPDLKANENFLKLQEEL   124

Query:  124 TNTENKISYSRQLYNTTTSNYNVKLETFPSNIVGKLFGFKPSQFLETPEEEKEVPKVSFDF   184
            TNTENKISYSRQLYN+TTSNYN++LE+FPSNI GKLFGFKPS+FL+TPE EKEVPKV F+F
Sbjct:  125 TNTENKISYSRQLYNSTTSNYNLQLESFPSNIAGKLFGFKPSEFLQTPEAEKEVPKVEFNF   185
```

A related GBS gene <SEQ ID 8849> and protein <SEQ ID 8850> were also identified. Analysis of this protein sequence reveals the following:

```
Lipop: Possible site: -1 Crend: 0
McG: Discrim Score: 14.63
GvH: Signal Score (-7.5): -3.19
   Possible site: 20
>>> Seems to have an uncleavable N-term signal seq
ALOM program count: 1 value: -15.44 threshold: 0.0
   INTEGRAL    Likelihood = -15.44 Transmembrane    4-20 (1-27)
   PERIPHERAL  Likelihood =  8.86        146
modified ALOM score: 3.59
*** Reasoning Step: 3

----- Final Results -----
            bacterial membrane  --- Certainty = 0.7177 (Affirmative) < succ>
             bacterial outside  --- Certainty = 0.0000 (Not Clear)  < succ>
            bacterial cytoplasm --- Certainty = 0.0000 (Not Clear)  < succ>
```

The protein has homology with the following sequences in the databases:

```
51.4/68.9% over 183aa Listeria monocytogenes
EGAD|149857|LemA protein Insert characterized
GP|1519287|gb|AAC44350.1||U66186 LemA Insert characterized
ORF-1545(301-846 of 1152)
EGAD|149857|159923(2-185 of 185) LemA protein {Listeria monocytogenes}
GP|1519287|gb|AAC44350.1||U66186 LemA {Listeria monocytogenes}
% Match = 23.8
% Identity = 51.4   % Similarity = 68.9
Matches = 94  Mismatches = 56  Conservative Sub.s = 32
        42         72        102        132        162        192        222        252
CFK*TSSLSVIAVRLIFSFHSTRSLK*VSNCFFCLSVSVIPCSIRTNAWGVIVNLNFYIVLYFITNTNNGNNRTFL
       282        312        342        372        402        432        462        492
I*RKLL*WKKCKGATTMGTMILIAIIALFVIWLIVAYNSLVRSRMHTKESWSQIDVQLKRRNDLIPNLIETVKGYAAYEG
                :| :|  ||::  ::|:    |||||: |     |:|:||||||||| |||||:||||||| :|
                MIGWIIAIAVVVILVLIYFGLYNSLVKYRNRVDETWAQIDVQLKRRFDLIPNLVETVKGYAKHEK
                         10         20         30         40         50         60
       522        546        576        606        636        666        696        726
KTLEKIAELRAQVAK--ANTPAEAMTASNELTRQLSSILAVAENYPDLKANNSFVKLQEELTNTENKISYSRQLYNTTTS
:|| :: | | :: :  |:       : |  | |  |:|: | ||||||| ::: ||| |||| ||::||||||||
ETLTQVIEARNKMMEVPADNRQGQIEADNMLSGALKSIFALGEAYPDLKANTSFIELQHELTTTENKVAYSRQLYNTTVM
       80         90        100        110        120        130        140
       756        786        816        846        876        906        936        966
NYNVKLETFPSNIVGKLFGFKPSQFLETPEEEKEVPKVSFDF*LRRERGFCCINKLQVIREKQLSC*LSSSVF*QLLEQL
 ||  |::: |:|||  ||  |   | ||:   |||:
TYNTKVQSVPTNIVAKLHNFTERDMLSIPEVERVAPKVEF
           160        170        180
```

SEQ ID 4856 (GBS42) was expressed in *E. coli* as a His-fusion product. SDS-PAGE analysis of total cell extract is shown in FIG. 5 (lane 2; MW 21.8 kDa) and in FIG. 168 (lane 5-7; MW 36 kDa). It was also expressed in *E. coli* as a GST-fusion product. SDS-PAGE analysis of total cell extract is shown in FIG. 13 (lane 8; MW 46 kDa). Purified Thio-GBS42-His is shown in FIG. 244, lane 11.

Based on this analysis, it was predicted that these proteins and their epitopes could be useful antigens for vaccines or diagnostics.

EXAMPLE 1572

A DNA sequence (GBSx1666) was identified in *S. agalactiae* <SEQ ID 4859> which encodes the amino acid sequence <SEQ ID 4860>. This protein is predicted to be glucose inhibited division protein b (gidB). Analysis of this protein sequence reveals the following:

```
Possible site: 47
>>> Seems to have no N-terminal signal sequence

----- Final Results -----
          bacterial cytoplasm --- Certainty = 0.2430 (Affirmative) < succ>
          bacterial membrane  --- Certainty = 0.0000 (Not Clear)   < succ>
          bacterial outside   --- Certainty = 0.0000 (Not Clear)   < succ>
```

A related GBS nucleic acid sequence <SEQ ID 10079> which encodes amino acid sequence <SEQ ID 10080> was also identified.

The protein has homology with the following sequences in the GENPEPT database.

```
>GP:CAB16137 GB:Z99124 glucose-inhibited division protein
[Bacillus subtilis]
Identities = 130/239 (54%), Positives = 170/239 (70%), Gaps = 4/239 (1%)

Query:   5 MTPQAFYQVLIEHGITLTDKQKKQFETYFRLLVEWNEKINLTAITDKEEVYLKHFYDSIA   64
           M  + F   L E GI+L+ +Q +QFE Y+ +LVEWNEKINLT+IT+K+EVYLKHFYDSI
Sbjct:   1 MNIEEFTSGLAEKGISLSPRQLEQFELYYDMLVEWNEKINLTSITEKKEVYLKHFYDSIT   60

Query:  65 PILQGYID-NSPLSILDIGAGAGFPSIPMKILYPEIDITIIDSLNKRINFLNILANELEL  123
                Y+D N  +I D+GAGAGFPS+P+KI +P + +TI+DSLNKRI  FL  L+   L+L
Sbjct:  61 AAF--YVDFNQVNTICDVGAGAGFPSLPIKICFPHLHVTIVDSLNKRITFLEKLSEALQL  118

Query: 124 SGVHFFHGRAEDFGQDRVFRAKFDIVTARAVAKMQVLAELTIPFLKVNGRLIALKAAAAE  183
              F H RAE FGQ +  R  +DIVTARAVA++ VL+EL +P +K NG  +ALKAA+AE
Sbjct: 119 ENTTFCHDRAETFGQRKDVRESYDIVTARAVARLSVLSELCLPVKKNGLFVALKAASAE  178

Query: 184 EELISAEKALKTLFSQVTVNKNYKLP-NGDDRNITIVSKKKETPNKYPRKAGTPNKKPL  241
           EEL + +KA+ TL  ++    ++KLP    DRNI ++ K K TP KYPRK  GTPNK P+
Sbjct: 179 EELNAGKKAITTLGGELENIHSFKLPIEESDRNIMVIRKIKNTPKKYPRKPGTPNKSPI  237
```

A related DNA sequence was identified in *S. pyogenes* <SEQ ID 4861> which encodes the amino acid sequence <SEQ ID 4862>. Analysis of this protein sequence reveals the following:

```
Possible site: 21
>>> Seems to have no N-terminal signal sequence

----- Final Results -----
          bacterial cytoplasm --- Certainty = 0.4862 (Affirmative) < succ>
          bacterial membrane  --- Certainty = 0.0000 (Not Clear)   < succ>
          bacterial outside   --- Certainty = 0.0000 (Not Clear)   < succ>
```

An alignment of the GAS and GBS proteins is shown below.

```
Identities = 170/237 (71%), Positives = 202/237 (84%)

Query:   5 MTPQAFYQVLIEHGITLTDKQKKQFETYFRLLVEWNEKINLTAITDKEEVYLKHFYDSIA   64
           MTPQ FY+ L E G +L+ KQK+QF+TYF+ LVEWN KINLTAIT++  EVYLKHFYDSIA
Sbjct:   1 MTPQDFYRTLEEDGFSLSSKQKEQFDTYFKSLVEWNTKINLTAITEENEVYLKHFYDSIA   60

Query:  65 PILQGYIDNSPLSILDIGAGAGFPSIPMKILYPEIDITIIDSLNKRINFLNILANELELS  124
           PILQG++  N P+ +LDIGAGAGFPS+PMKIL+P   +++TIIDSLNKRI+FL +LA EL L
Sbjct:  61 PILQGFLANEPIKLLDIGAGAGFPSLPMKILFPNLEVTIIDSLNKRISFLTLLAQELGLE  120
```

-continued
```
Query: 125 GVHFFHGRAEDFGQDRVFRAKFDIVTARAVAKMQVLAELTIPFLKVNGRLIALKAAAAEE 184
            VHFFHGRAEDFGQD+ FR +FD+VTARAVA+MQVL+ELTIPFLK+ G+LIALKA AA++
Sbjct: 121 NVHFFHGRAEDFGQDKAFRGQFDVVTARAVARMQVLSELTIPFLKIGGKLIALKAQAADQ 180

Query: 185 ELISAEKALKTLFSQVTVNKNYKLPNGDDRNITIVSKKKETPNKYPRKAGTPNKKPL    241
            EL  A+ AL  LF +V  N +Y+LPNGD R ITIV KKKETPNKYPRKAG PNKKPL
Sbjct: 181 ELEEAKNALCLLFGKVIKNHSYQLPNGDSRFITIVEKKKETPNKYPRKAGLPNKKPL    237
```

Based on this analysis, it was predicted that these proteins and their epitopes could be useful antigens for vaccines or diagnostics.

EXAMPLE 1573

A DNA sequence (GBSx1667) was identified in S. agalactiae <SEQ ID 4863> which encodes the amino acid sequence <SEQ ID 4864>. Analysis of this protein sequence reveals the following:

```
Possible site: 13
>>> Seems to have a cleavable N-term signal seq.

----- Final Results -----
        bacterial outside --- Certainty = 0.3000 (Affirmative) < succ>
       bacterial membrane --- Certainty = 0.0000 (Not Clear)   < succ>
      bacterial cytoplasm --- Certainty = 0.0000 (Not Clear)   < succ>
```

The protein has no significant homology with any sequences in the GENPEPT database.

No corresponding DNA sequence was identified in S. pyogenes.

Based on this analysis, it was predicted that this protein and its epitopes, could be useful antigens for vaccines or diagnostics.

EXAMPLE 1574

A DNA sequence (GBSx1668) was identified in S. agalactiae <SEQ ID 4865> which encodes the amino acid sequence <SEQ ID 4866>. This protein is predicted to be v-type sodium ATP synthase subunit j. Analysis of this protein sequence reveals the following:

```
Possible site: 45
>>> Seems to have a cleavable N-term signal seq.
    INTEGRAL    Likelihood = -10.14    Transmembrane    371-387 (362-391)
    INTEGRAL    Likelihood =  -7.48    Transmembrane    200-216 (190-217)
    INTEGRAL    Likelihood =  -4.94    Transmembrane    425-441 (423-446)
    INTEGRAL    Likelihood =  -4.67    Transmembrane    327-343 (325-349)
    INTEGRAL    Likelihood =  -3.77    Transmembrane     81-97  (81-98)
    INTEGRAL    Likelihood =  -2.66    Transmembrane    140-156 (139-157)
    INTEGRAL    Likelihood =  -1.33    Transmembrane     55-71  (53-71)
    INTEGRAL    Likelihood =  -0.27    Transmembrane    247-263 (247-263)
    INTEGRAL    Likelihood =  -0.11    Transmembrane    165-181 (165-181)

----- Final Results -----
       bacterial membrane --- Certainty = 0.5055 (Affirmative) < succ>
        bacterial outside --- Certainty = 0.0000 (Not Clear)   < succ>
      bacterial cytoplasm --- Certainty = 0.0000 (Not Clear)   < succ>
```

A related GBS nucleic acid sequence <SEQ ID 10081> which encodes amino acid sequence <SEQ ID 10082> was also identified.

The protein has homology with the following sequences in the GENPEPT database.

```
>GP:BAA04279 GB:D17462 Na+ -ATPase subunit J [Enterococcus hirae]
Identities = 170/461 (36%), Positives = 262/461 (55%), Gaps = 28/461 (6%)

Query:  12 KTMSVARKLSISFIAVILLGSILLSLPIFQYANAPKTHYIDHLFTTVSMVCVTGLSVFPI  71
            K +S  + ++   F  +IL G  LL+LP F   +     TH+ID LFT  S VCVTGL+
Sbjct:  10 KRLSPVQLIAAGFFILILFGGSLLTLPFFS-RSGESTHFIDALFTATSAVCVTGLTTLNT  68

Query:  72 SKVYNGWGQIVAILLMQTGGLGLVTLMSLSYYTLRRKMSLNDQTLLQSAITYNSSTDLKK  131
            ++ +N GQ + + L++ GGLG + +    L +   ++K+S + + +L+ A+       + + K
Sbjct:  69 AEHWNSAGQFLIMTLIEIGGLGFMMIPILFFAIAKKKISFSMRIVLKEALNLEEMSGVIK  128
```

```
                           -continued
Query: 132 YLYMIFKVTLTLEVLAASILAIDFIPRFGLGHGIFNSIFLAVSAFCNAGFDNLEATSLAQ 191
           +  I K + ++V+ A  L++ FIP FG   GI+ SIF AVS+FCNAGFD L  + LA
Sbjct: 129 LMIYILKFAVVIQVIGAVALSVVFIPEFGWAKGIWFSIFHAVSSFCNAGFDLLGDSLLAD 188

Query: 192 FKLNPLVNIIVCFLIISGGLGFAVWKDLIEATIQTSHKGPKLIKTFPKRLSNHSKLVLKT 251
            + N  + ++V LII+GGLGF VW+D++      + H+        K+++ HSK+ L
Sbjct: 189 -QTNVYLIMVVSALIIAGGLGFIVWRDIL-----SYHR--------VKKITLHSKVALSV 234

Query: 252 TTIILLTGTLLSWLLEFGNFRTIANLSLPKQLMVSFFQTVTMRTAGFSTIDYTQTDFATN 311
           T ++L+ G +L +L+    N  T+   +  ++L +FF +VT RTAG+ +IDY Q   A
Sbjct: 235 TALLLIGGFIL-FLITERNGLTLVKGTFTERLANTFFMSVTPRTAGYYSIDYLQMSHAGL 293

Query: 312 LVYIIQMLIGGAPGGTAGGFKVTVIAILLLLFKAELSGQSQVTFHYRTIPSSIIKQTLSI 371
           ++ +  M IGG  G TAGG K T + ILL+      A    G+++         RTI  + +   L
Sbjct: 294 ILTMFLMYIGGTSGSTAGGLKTTTLGILLIQMHAMFKGKTRAEAFGRTIRQAAV---LRA 350

Query: 372 LTFFFII--LISGYLLLLELNPHIDPFS----LFFEASSALATVGVTMNTTNQLTLGGRI 425
           LT FF+   L     +++L +     I     S     + FE   SA  TVG+TM  T   LTL G++
Sbjct: 351 LTLFFVTLSLCVVAIMVLSVTETIPKTSGIEYIAFEVFSAFGTVGLTMGLTPDLTIGKL 410

Query: 426 VIMFLMFIGRVGPITVLLSILQK---KEKEIHYAETEIILG                   463
           VI+ LM+IGRVG +TV+LS+L K     E       Y E  I+LG
Sbjct: 411 VIISLMYIGRVGIMTVVLSLLVKANRAEANYKYPEESIMLG                   451
```

A related DNA sequence was identified in *S. pyogenes* <SEQ ID 4867> which encodes the amino acid sequence <SEQ ID 4868>. Analysis of this protein sequence reveals the following:

```
Possible site: 42
>>> Seems to have no N-terminal signal sequence
      INTEGRAL      Likelihood = -15.12     Transmembrane    371-387 (364-396)
      INTEGRAL      Likelihood =  -7.32     Transmembrane     20-36  (18-42)
      INTEGRAL      Likelihood =  -6.53     Transmembrane    425-441 (417-446)
      INTEGRAL      Likelihood =  -6.16     Transmembrane     89-105 (81-106)
      INTEGRAL      Likelihood =  -5.79     Transmembrane    200-216 (196-223)
      INTEGRAL      Likelihood =  -3.35     Transmembrane    140-156 (139-157)
      INTEGRAL      Likelihood =  -3.03     Transmembrane     55-71  (53-74)
      INTEGRAL      Likelihood =  -3.03     Transmembrane    247-263 (246-264)
      INTEGRAL      Likelihood =  -1.12     Transmembrane    393-409 (393-409)
      INTEGRAL      Likelihood =  -0.11     Transmembrane    165-181 (165-181)

----- Final Results -----
           bacterial membrane --- Certainty = 0.7050 (Affirmative) < succ>
            bacterial outside --- Certainty = 0.0000 (Not Clear)  < succ>
          bacterial cytoplasm --- Certainty = 0.0000 (Not Clear)  < succ>
```

The protein has homology with the following sequences in the databases:

```
>GP:BAA04279 GB:D17462 Na+ -ATPase subunit J [Enterococcus hirae] Identities
= 168/466 (36%), Positives = 260/466 (55%), Gaps = 26/466 (5%)
Query:   6 MKRSFIKSLSVTQRLTFSFAIVILIGTLLLSMPFTHYQNGPNTVYLDHFFNVVSMVCVTG  65
           MK+    K LS  Q +   F I+IL G   LL++PF   ++G +T ++D F    S VCVTG
Sbjct:   4 MKKRVRKRLSPVQLIAAGFFILILFGGSLLTLPFFS-RSGESTHFIDALFTATSAVCVTG  62

Query:  66 LSVVPVAEVYNGIGQTIAMALMQIGCLGVTLIAVSTFAL-KRKMRLSDQTLLQSALNRG 124
           L+ +   AE +N  GQ +  M L++IG LG + +I +  FA+  K+K+    S + +L+ ALN
Sbjct:  63 LTTLNTAEHWNSAGQFLIMTLIEIGGLGFM-MIPILFFAIAKKKISFSMRIVLKEALNLE 121

Query: 125 DSKDLKHYLFFAYKVTFSLEAFAAIVIMIDFIPRFGWKNGIFNSIFLAVSAFCNAGFDNL 184
            +  +  ++   K     ++     A+  +  FIP FGW  GI+ SIF AVS+FCNAGFD L
Sbjct: 122 EMSGVIKLMIYILKFAVVIQVIGAVALSVVFIPEFGWAKGIWFSIFHAVSSFCNAGFDLL 181

Query: 185 GSSSLKDFMLNPTLNVIITFLIISGGLGFAVWVDLGVAFKKYFFERPHCYGATFRKLSNQ 244
           G  S L D    N L ++++ LII+GGLGF VW D+ +++ +                  +K++
Sbjct: 182 GDSLLAD-QTNVYLIMVVSALIIAGGLGFIVWRDI-LSYHR-----------VKKITLH 227

Query: 245 SRLVLQTTAVILFLGTFLTWFLEKDNSKTIANFSLHQQLMVSFFQTVTMRTAGFATISYN 304
           S++ L  TA++L +G F+ + + +  N   T+    + ++L +FF +VT RTAG+ +I Y
Sbjct: 228 SKVALSVTALLL-IGGFILFLITERNGLTLVKGTFTERLANTFFMSVTPRTAGYYSIDYL 286

Query: 305 DTLAPTNILYMIQMVIGGAPGGTAGGIKVTTAAITFLLFKAELSGQSEVTFRNRIIANKT 364
                  IL M  M IGG  G TAGG+K TT  I  +   A    G++        R I
Sbjct: 287 QMSHAGLILTMFLMYIGGTSGSTAGGLKTTTLGILLIQMHAMFKGKTRAEAFGRTIRQAA 346
```

-continued

```
Query: 365 IKQTMTVLIFFFAVLMIGFILLLSVEPHIAPIP----LLFESISAIATVGVSMDLTPQLS 420
            + + +T L F    L +  I++LSV  I       + FE   SA   TVG++M LTP L+
Sbjct: 347 VLRALT-LFFVTLSLCVVAIMVLSVTETIPKTSGIEYIAFEVFSAFGTVGLTMGLTPDLT 405

Query: 421 TAGRLIVIVLMFVGRVGPITVLISLI---QRKEKTIQYATTDILVG              463
            G+L++I LM++GRVG +TV++SL+    R E   +Y    I++G
Sbjct: 406 LIGKLVIISLMYIGRVGIMTVVLSLLVKANRAEANYKYPEESIMLG              451
```

An alignment of the GAS and GBS proteins is shown below.

```
Identities = 275/462 (59%), Positives = 351/462 (75%), Gaps = 1/462 (0%)

Query:   2 GASMKHFFDYKTMSVARKLSISFIAVILLGSILLSLPIFQYANAPKTHYIDHLFTTVSMV   61
           G +MK F   K++SV ++L+ SF  VIL+G++LLS+P    Y N P T Y+DH  F  VSMV
Sbjct:   3 GGNMKRSF-IKSLSVTQRLTFSFAIVILIGTLLLSMPFTHYQNGPNTVYLDHFFNVVSMV   61

Query:  62 CVTGLSVFPISKVYNGWGQIVAILLMQTGGLGLVTMSLSYYTLRRKMSLNDQTLLQSAI  121
           CVTGLSV P+++VYNG GQ +A+ LMQ G LGLVTL+++S +   L+RKM L+DQTLLQSA+
Sbjct:  62 CVTGLSVVPVAEVYNGIGQTIAMALMQIGCLGLVTLIAVSTFALKRKMRLSDQTLLQSAL  121

Query: 122 TYNSSTDLKKYLYMIFKVTLTLEVLAASILAIDFIPRFGLGHGIFNSIFLAVSAFCNAGF  181
             S DLK YL+  +KVT +LE  AA ++ IDFIPRFG  +GIFNSIFLAVSAFCNAGF
Sbjct: 122 NRGDSKDLKHYLFFAYKVTFSLEAFAAIVIMIDFIPRFGWKNGIFNSIFLAVSAFCNAGF  181

Query: 182 DNLEATSLAQFKLNPLVNIIVCFLIISGGLGFAVWKDLIEATIQTSHKGPKLIKTFPKRL  241
           DNL ++SL  F LNP +N+I+ FLIISGGLGFAVW DL  A +   + P         ++L
Sbjct: 182 DNLGSSSLKDFMLNPTLNVIITFLIISGGLGFAVWVDLGVAFKKYFFERPHCYGATFRKL  241

Query: 242 SNHSKLVLKTTTIILLTGTLLSWLLEFGNFRTIANLSLPKQLMVSFFQTVTMRTAGFSTI  301
           SN S+LVL+TT +IL  GT L+W LE  N +TIAN SL +QLMVSFFQTVTMRTAGF+TI
Sbjct: 242 SNQSRLVLQTTAVILFLGTFLTWFLEKDNSKTIANFSLHQQLMVSFFQTVTMRTAGFATI  301

Query: 302 DYTQTDFATNLVYIIQMLIGGAPGGTAGGFKVTVIAILLLLFKAELSGQSQVTFHYRTIP  361
            Y T   TN++Y+IQM+IGGAPGGTAGG KVT AI LLFKAELSGQS+VTF  R I
Sbjct: 302 SYNDTLAPTNILYMIQMVIGGAPGGTAGGIKVTTAAITFLLFKAELSGQSEVTFRNRIIA  361

Query: 362 SSIIKQTLSILTFFFIILISGYLLLLELNPHIDPFSLFFEASSALATVGVTMNTTNQLTL  421
           +  IKQT+++L FFF +L+ G++LLL + PHI P  L FE+  SA+ATVGV+M+ T QL+
Sbjct: 362 NKTIKQTMTVLIFFFAVLMIGFILLLSVEPHIAPIPLLFESISAIATVGVSMDLTPQLST  421

Query: 422 GGRIVIMFLMFIGRVGPITVLLSILQKKEKEIHYAETEIILG                   463
            GR++++ LMF+GRVGPITVL+S++Q+KEK I YA  T+I++G
Sbjct: 422 AGRLIVIVLMFVGRVGPITVLISLIQRKEKTIQYATTDILVG                   463
```

A related GBS gene <SEQ ID 8851> and protein <SEQ ID 8852> were also identified. Analysis of this protein sequence reveals the following:

```
Lipop: Possible site: -1  Crend: 9
McG: Discrim Score: 0.86
GvH: Signal Score (-7.5): 0.64
     Possible site: 45
>>> Seems to have a cleavable N-term signal seq.
ALOM program count: 9 value: -10.14 threshold: 0.0
     INTEGRAL    Likelihood = -10.14   Transmembrane    371-387 (362-391)
     INTEGRAL    Likelihood =  -7.48   Transmembrane    200-216 (190-217)
     INTEGRAL    Likelihood =  -4.94   Transmembrane    425-441 (423-446)
     INTEGRAL    Likelihood =  -4.67   Transmembrane    327-343 (325-349)
     INTEGRAL    Likelihood =  -3.77   Transmembrane     81-97  (81-98)
     INTEGRAL    Likelihood =  -2.66   Transmembrane    140-156 (139-157)
     INTEGRAL    Likelihood =  -1.33   Transmembrane     55-71  (53-71)
     INTEGRAL    Likelihood =  -0.27   Transmembrane    247-263 (247-263)
     INTEGRAL    Likelihood =  -0.11   Transmembrane    165-181 (165-181)
     PERIPHERAL  Likelihood =   2.49                   308
modified ALOM score: 2.53

*** Reasoning Step: 3

----- Final Results -----
            bacterial membrane --- Certainty = 0.5055 (Affirmative) < succ>
             bacterial outside --- Certainty = 0.0000 (Not Clear) < succ>
           bacterial cytoplasm --- Certainty = 0.0000 (Not Clear) < succ>
```

The protein has homology with the following sequences in the databases:

```
ORF-2334(334-1689 of 1989)
EGAD|22151|22827(10-451 of 451) v-type sodium ATP synthase subunit j {Enterococcus
hirae} SP|P43440|NTPJ_ENTHR V-TYPE SODIUM ATP SYNTHASE SUBUNIT J (EC 3.6.1.34)
(NA(+)- TRANSLOCATING ATPASE SUBUNIT J). GP|487282|dbj|BAA04279.1||D17462 Na+-ATPase
subunit J {Enterococcus hirae}
% Match = 18.8
% Identity = 38.5    % Similarity = 60.4
Matches = 170  Mismatches = 166  Conservative Sub.s = 97
186         216         246         276         306         336         366         396
TIFTSNCK*KL*VT*W**PKYHNR*QEKRNA**IPS*SWYSKQEAFVKLGASMKHFFDYKTMSVARKLSISFIAVILLGS
                                                  | :|   : ::  |  :|||:|
                                          MTIMKKRVRKRLSPVQLIAAGFFILILFGG
                                                  10           20         30
426         456         486         516         546         576         606         636
ILLSLPIFQYANAPKTHYIDHLFTTVSMVCVTGLSVFPISKVYNGWGQIVAILLMQTGGLGLVTLMSLSYYTLRRKMSLN
 ||:||  |    :     ||:||   |||   | ||||||: :   ::|   ||   |||   ||| |||::: :   ::|:|:::
SLLTLPFFSRSGES-THFIDALFTATSAVCVTGLTTLNTAEHWNSAGQFLIMTLIEIGGLGFMMIPILFFAIAKKKISFS
         40          50          60          70          80          90         100
666         696         726         756         786         816         846         876
DQTLLQSAITYNSSTDLKKYLYMIFKVTLTLEVLAASILAIDFIPRFGLGHGIFNSIFLAVSAFCNAGFDNLEATSLAQF
  : :|:  |:      : :  |:       |:|  : ::|: |   |::  |||     ||: |||  |||:||||||||    ||
MRIVLKEALNLEEMSGVIKLMIYILKFAVVIQVIGAVALSVVFIPEFGWAKGIWFSIFHAVSSFCNAGFD-LLGDSLLAD
         120         130         140         150         160         170         180
906         936         966         996        1026        1056        1086        1116
KLNPLVNIIVCPLIISGGLGFAVWKDLIEATIQTSHKGPKLIKTFPKRLSNHSKLVLKTTTIILLTGTLLSWLLEFGNFR
: |    : ::|   |||:||||||   ||:|:             |          |::: |||:   |    :||   |::|:  |
QTNVYLIMVVSALIIAGGLGFIVWRDI-------------LSYHRVKKITLHSKVALSVTA-LLLIGGFILFLITERNGL
         200         210                      220         230         240         250
1146        1176        1206        1236        1266        1296        1326        1356
TIANLSLPKQLMVSFFQTVTMRTAGFSTIDYTQTDFATNLVYIIQMLIGGAPGGTAGGFKVTVIAILLLLFKAELSGQSQ
|:   ::  ::|    :||  |||||  |:||  : ||   :|||         | ||||||||:|   |   :|||:   |  |:::
TLVKGTFTERLANTFFMSVTPRTAGYYSIDYLQMSHAGLILTMFLMYIGGTSGSTAGGLKTTTLGILLIQMHAMFKGKTR
         270         280         290         300         310         320         330
1386        1416        1461        1491        1518        1548        1578
VTFHYRTIPSSIIKQTLSILTFFFIIL----ISGYLL-LLELNPHIDPFS-LFFEASSALATVGVTMNTTNQLTLGGRIV
       |||   : :     |   ||:|||:      ::   :|: |   |       : ||   ||: |||:|    |    ||| ::|
AEAFGRTIRQAAV---LRALTLFFVTLSLCVVAIMVLSVTETIPKTSGIEYIAFEVFSAFGTVGLTMGLTPDLTLIGKLV
          350         360         370         380         390         400         410
1608        1638        1659        1689        1719        1749        1779        1809
IMFLMFIGRVGPITVLLSILQK---KEKEIHYAETEIILG*KRSFMKTKIIGVLGLGIFGQTLAQELSNFEQDVIAIDSN
|: ||:||||| :||:||:|   |         |    |  |:||
IISLMYIGRVGIMTVVLSLLVKANRAEANYKYPEESIMLG
         430         440         450
```

Based on this analysis, it was predicted that these proteins and their epitopes could be useful antigens for vaccines or diagnostics.

EXAMPLE 1575

A DNA sequence (GBSx1669) was identified in *S. agalactiae* <SEQ ID 4869> which encodes the amino acid sequence <SEQ ID 4870>. This protein is predicted to be TrkA (ktrA). Analysis of this protein sequence reveals the following:

```
Possible site: 19
>>> Seems to have a cleavable N-term signal seq.

----- Final Results -----
          bacterial outside  --- Certainty = 0.3000 (Affirmative) < succ>
          bacterial membrane --- Certainty = 0.0000 (Not Clear)  < succ>
          bacterial cytoplasm --- Certainty = 0.0000 (Not Clear)  < succ>
```

The protein has homology with the following sequences in the GENPEPT database.

```
>GP: AAC46144 GB: AF001974 putative TrkA [Thermoanaerobacter
ethanolicus]
Identities = 69/177 (38%), Positives = 110/177 (61%), Gaps = 2/177 (1%)

Query:  8 VLGLGIFGQTLAQELSNFEQDVIAIDSNPEN--VQAVAEVVTKAAIGDITDLAFLKHIGI   65
          V+GLG FG +LA+ L    DV+ ID + E   VQA+  +VT A    D TD  LK +  +
Sbjct:  6 VIGLGSFGISLAKTLYEMGNDVLVIDEDEEEELVQAMNGLVTHAVRADATDENVLKSLRV   65
```

-continued

```
Query:   66 SDCDTVIIATGNSLESSVLAVMHCKKLGVPQVIAKARNLVYEEVLYEIGADLVISPERES  125
            + D  I+A G ++ESS++  M  K+LGV   VIAKA N ++  VLY++GAD V+ PE++
Sbjct:   66 KNFDVAIVAIGKNMESSIMVTMLVKELGVKYVIAKAHNELHARVLYKVGADRVVMPEKDM  125

Query:  126 GQNVAANLMRNKITDVFQIESDISVIEFKIPKSWVGKTVEQLNIRHKFDLNLIGIRK     182
              G   VA N+ + + D+ +    + S+ E     + W GKT++++N+R K+ LN++ ++K
Sbjct:  126 GIRVARNVFSSNLIDLIEFSKEYSIAEILPIEEWFGKTLKEINVREKYGLNVVAVKK     182
```

A related DNA sequence was identified in *S. pyogenes* 10 <SEQ ID 4715> which encodes the amino acid sequence <SEQ ID 4716>. Analysis of this protein sequence reveals the following:

```
Possible site: 20
>>> Seems to have an uncleavable N-term signal seq

----- Final Results -----
            bacterial membrane --- Certainty = 0.0000 (Not Clear) < succ>
            bacterial outside  --- Certainty = 0.0000 (Not Clear) < succ>
          bacterial cytoplasm --- Certainty = 0.0000 (Not Clear) < succ>
```

An alignment of the GAS and GBS proteins is shown below.

```
Identities = 132/221 (59%), positives = 176/221 (78%)

Query:    1 MKTKIIGVLGLGIFGQTLAQELSNFEQDVIAIDSNPENVQAVAEVVTKAAIGDITDLAFL   60
            +K  K +GVLGLGIFG+T+A+ELSNF+QDVIAID    +V+ VA++VTKAA+GDITD  FL
Sbjct:    2 LKRKTVGVLGLGIFGRTVARELSNFDQDVIAIDIRESHVKEVADLVTKAAVGDITDKEFL   61

Query:   61 KHIGISDCDTVIIATGNSLESSVLAVMHCKKLGVPQVIAKARNLVYEEVLYEIGADLVIS  120
               +GI   CDTV+IA+GN+LESSVLAVMHCKKLGVP +IAKA+N ++EEVLY IGA   VI+
Sbjct:   62 LAVGIEHCDTVVIASGNNLESSVLAVMHCKKLGVPTIIAKAKNKIFEEVLYGIGATKVIT  121

Query:  121 PERESGQNVAANLMRNKITDVFQIESDISVIEFKIPKSWVGKTVEQLNIRHKFDLNLIGI  180
            PER+SG+ VA+NL+R  I  +  +E   IS+IEF IPKSW G+++ +L++R K++LN+IG+
Sbjct:  122 PERDSGKRVASNLLRRHIESIIYLEHGISMIEFVIPKSWEGQSLSELDVRRKYELNVIGM  181

Query:  181 RKAKNKPVDTEVPINSPLEEGIILVAIANSDAFQRYDYLGY                     221
            R+ + K +DT V    PLE   I+VAIAN   F+++DYLGY
Sbjct:  182 RQKEVKTLDTNVKPFEPLEPNTIIVAIANDHTFEKFDYLGY                     222
```

A related GBS gene <SEQ ID 8853> and protein <SEQ ID 8854> were also identified. Analysis of this protein sequence reveals the following:

```
Lipop: Possible site: -1 Crend: 3
McG: Discrim Score: 5.14
GvH: Signal Score (-7.5): -0.860001
     Possible site: 19
>>> Seems to have a cleavable N-term signal seq.
ALOM program count: 0 value: 1.06 threshold: 0.0
     PERIPHERAL    Likelihood = 1.06     192
modified ALOM score: -0.71

*** Reasoning Step: 3

----- Final Results -----
            bacterial outside  --- Certainty = 0.3000 (Affirmative) < succ>
            bacterial membrane --- Certainty = 0.0000 (Not Clear) < succ>
          bacterial cytoplasm --- Certainty = 0.0000 (Not Clear)
```

The protein has homology with the following sequences in the databases:

```
38.0/61.6% over 182aa
Thermoanaerobacter etbanolicus
GP|2581796|putative TrkA Insert characterized
ORF02030(322-864 of 1269
GP|2581796|gb|AAC46144.1||AF001974(6-188 of 195) putative TrkA
{Thermoanaerobacter ethanolicus}
% Match = 15.5
% Identity = 37.9    % Similarity = 61.5
Matches = 69    Mismatches = 69    Conservative Sub.s = 43
    60        90       120       150       180       210       240       270
LISGYLLLLELNPHIDPFSLFFEASSALATVGVTMNTTNQLTLGGRIVIMFLMFIGRVGPITVLLSILQKKEKEIHYAET
   300       330       360       390                 444       474       504
EIILG*KRSFMKTKIIGVLGLGIFGQTLAQELSNFEQDVIAIDSNPEN--VQAVAEVVTKAAIGDITDLAFLKHIGISDC
         |:||| ||  :|       ||: ||  :  |     |||:  :||  |   ||    ||  : :
                MKQFVVIGLGSFGISLAKTLYEMGNDVLVIDEDEEEELVQAMNGLVTHAVRADATDENVLKSLRVKNF
                  10        20        30        40        50        60
   534       564       594       624       654       684       714       744
DTVIIATGNSLESSVLAVMHCKKLGVPQVIAKARNLVXEEVLYEIGADLVISPERESGQNVAANLMRNKITDVFQIESDI
|  |:|  |  ::|||::  |   |:|||  ||||| |   |||::||| |:  ||::  || |:     |  ||  : :
DVAIVAIGKNMESSIMVTMLVKELGVKYVIAKAHNELHARVLYKVGADRVVMPEKDMGIRVARNVFSSNLIDLIEFSKEY
               80        90       100       110       120       130       140
   774       804       834       864       894       924       954       984
SVIEFKIPKSWVGKTVEQLNIRHKFDLNLIGIRKAKNKPVDTEVPINSPLEEXIILVAIANSDAFQRYDYLRYFY*RK*K
|: |         : |   |||:::::|:|    |:    ||::     ::|       ::   :     :
SIAEILPIEEWFGKTLKEINVREKYGLNVVAVKKFNDEIIVSPGAGL
              160       170       180       190
```

SEQ ID 8854 (GBS57) was expressed in *E. coli* as a His-fusion product. SDS-PAGE analysis of total cell extract is shown in FIG. 19 (lane 6; MW 26 kDa). It was also expressed in *E. coli* as a GST-fusion product. SDS-PAGE analysis of total cell extract is shown in FIG. 21 (lane 11; MW 51.1 kDa) and in FIG. 183 (lane 9 & 10; MW 51 kDa).

The GBS57-GST fusion product was purified (FIG. 99A; see also FIG. 195, lane 8) and used to immunise mice (lane 1 product; 20 µg/mouse). The resulting antiserum was used for Western blot (FIG. 99B), FACS (FIG. 99C), and in the in vivo passive protection assay (Table III). These tests confirm that the protein is immunoaccessible on GBS bacteria and that it is an effective protective immunogen.

Based on this analysis, it was predicted that these proteins and their epitopes could be useful antigens for vaccines or diagnostics.

EXAMPLE 1576

A DNA sequence (GBSx1670) was identified in *S. agalactiae* <SEQ ID 4871> which encodes the amino acid sequence <SEQ ID 4872>. Analysis of this protein sequence reveals the following:

```
Possible site: 40
>>> Seems to have no N-terminal signal sequence
    INTEGRAL    Likelihood = -11.62    Transmembrane     73-89  (68-96)
    INTEGRAL    Likelihood = -11.30    Transmembrane    254-270 (248-274)
    INTEGRAL    Likelihood =  -4.73    Transmembrane    127-143 (124-144)
    INTEGRAL    Likelihood =  -4.19    Transmembrane     50-66  (47-67)
    INTEGRAL    Likelihood =  -3.29    Transmembrane     25-41  (25-45)

----- Final Results -----
            bacterial membrane --- Certainty = 0.5649 (Affirmative) < succ>
            bacterial outside  --- Certainty = 0.0000 (Not Clear)   < succ>
            bacterial cytoplasm --- Certainty = 0.0000 (Not Clear)  < succ>
```

A related GBS nucleic acid sequence <SEQ ID 8855> which encodes amino acid sequence <SEQ ID 8856> was also identified. Analysis of this protein sequence reveals the following:

```
Lipop Possible site: -1 Crend: 9
McG: Discrim Score: -10.49
GvH: Signal Score (-7.5): -1.14
Possible site: 40
    >>> Seems to have no N-terminal signal sequence
ALOM program count: 5 value: -11.62 threshold: 0.0
    INTEGRAL    Likelihood = -11.62    Transmembrane     73-89  (68-96)
    INTEGRAL    Likelihood = -11.30    Transmembrane    254-270 (248-274)
    INTEGRAL    Likelihood =  -4.73    Transmembrane    127-143 (124-144)
    INTEGRAL    Likelihood =  -4.19    Transmembrane     50-66  (47-67)
    PERIPHERAL  Likelihood =   3.76    201
modified ALOM score: 2.82
```

```
*** Reasoning Step: 3

----- Final Results -----
              bacterial membrane --- Certainty = 0.5649 (Affirmative) < succ>
               bacterial outside --- Certainty = 0.0000 (Not Clear)  < succ>
             bacterial cytoplasm --- Certainty = 0.0000 (Not Clear)  < succ>
```

The protein has homology with the following sequences in the GENPEPT database.

```
>GP: CAB13178 GB: Z99110 ykoC [Bacillus subtilis]
Identities = 61/226 (26%), Positives = 108/226 (46%), Gaps = 12/226 (5%)

Query:  49 FLIVVSLGSLVLFRLAKIKWQQVSFVMTLVVVFAVLNIIMVYLFAPHYGDKIYGSSSLLL  108
           F I++  G L+   +   KW      +   + F +L    V+  A    K+  +    L
Sbjct:  36 FYIIIVAGVLLAAGIPLKKW------LLFTIPFLILAFGCVWTAAVF--GKVPTTPDNFL   87

Query: 109 KGIGPYDVTSQELFYLFNLILKYFCTVPLALLFLMTTNPSQFASSL-NQLGLSYKIAYAV  167
             GP  + S  +    +L +  C    L+++F+ TT+P  F   SL Q   LS K+AY V
Sbjct:  88 FQAGPISINSDNVSVGISLGFRILCFSALSMMFVFTTDPILFMLSLVQQCRLSPKLAYGV  147

Query: 168 SLTLRYIPDVQEEFYTIRRAQEARGIELSKKSNLVARIKGNLQIVTPLIFSSLERIDTVA  227
              R++P +++E    I++A + RG   + +S ++ +I     PL+ S++ +  +    A
Sbjct: 148 IAGFRFLPLLKDEVQLIQQAHKIRGG--AAESGIINKISALKRYTIPLLASAIRKAERTA  205

Query: 228 TAMELRRFGKNKRRTWYSKQSLEKSDIVLIILALASLFVSLYLIHL                273
             AME + F  ++ RT+Y    S+ + D V   L L  LF   +L+ L
Sbjct: 206 LAMESKGFTGSRNRTYYRTLSVNRRDWVFFCLVLL-LFAGSFLVSL                250
```

Based on this analysis, it was predicted that this protein and its epitopes, could be useful antigens for vaccines or diagnostics.

EXAMPLE 1577

A DNA sequence (GBSx1671) was identified in *S. agalactiae* <SEQ ID 4873> which encodes the amino acid sequence <SEQ ID 4874>. This protein is predicted to be cobalt ABC transporter, ATP-binding protein (cbiO). Analysis of this protein sequence reveals the following:

```
Possible site: 49
>>> Seems to have no N-terminal signal sequence
     INTEGRAL      Likelihood = -1.91    Transmembrane       436-452 (435-452)

----- Final Results -----
              bacterial membrane --- Certainty = 0.1765 (Affirmative) < succ>
               bacterial outside --- Certainty = 0.0000 (Not Clear)  < succ>
             bacterial cytoplasm --- Certainty = 0.0000 (Not Clear)  < succ>
```

The protein has homology with the following sequences in the GENPEPT database.

```
>GP: CAB13179 GB: Z99110 similar to cation ABC transporter
(ATP-binding protein) [Bacillus subtilis]
Identities = 151/483 (31%), Positives = 248/483 (51%), Gaps = 19/483 (3%)

Query:   8 KDFTFQYDVQSEPTLKGINLSIPKGEKVLILGPSGSGKSTLGHCLNGIIPNTHKGQYSGI   67
           +  +F Y+  +P   + I+   + KGE VL+LGPSG GKS+L  CLNG+   P   G SG
Sbjct:  11 EQLSFSYEEDEKPVFQDISFELQKGECVLLLGPSGCGKSSLALCLNGLYPEACDGIQSGH   70

Query:  68 FTINHKNAFDLSIYDK-SHLVSTVLQDPDGQFIGLTVAEDIAFALENDVVAQEEMASIVE  126
            +   + K  D +            V QDPD QF  LTV ++IAF LEN + +EEM    +
Sbjct:  71 VFLFQKPVTDAETSETITQHAGVVFQDPDQQFCMLTVEDEIAFGLENLQIPKEEMTEKIN  130

Query: 127 MWAKRLEIAPLLSKRPQDLSGGQKQRVSLAGVLVDDSPILLFDEPLANLDPQSGQDIMAL  186
              +L   I   L  K    LSGGQKQ+V+LA +L  +   +++ DEP + LDP S ++ + L
Sbjct: 131 AVLGKLRITHLKEKMISTLSGGQKQKVALACILAMEPELIILDEPTSLLDPFSAREFVHL  190

Query: 187 VDRIHQEQDATTIIIEHRLED--VFYERVDRVVLFSDGQIIYNGEPDQLL--KTNFLSEY  242
            +  + +E+ +  ++IEH+L++     + ER   +VL    G+     +G   L    +  L +
Sbjct: 191 MKDLQREKGFSLLVIEHQLDEWAPWIERT--IVLDKSGKKALDGLTKNLFQHEAETLKKL  248
```

-continued

```
Query:  243 GIREPLYISALKNLGYDFEKQNTMTSIDDFDFSELLIPKMRALDLDKHTDKLLSVQHLSV  302
            GI  P     +L   F     M  +        + K +A       + +L V  LS
Sbjct:  249 GIAIPKVCHLQEKLSMPFTLSKEMLFKEPIPAGH--VKKKKA----PSGESVLEVSSLSF  302

Query:  303 SYDLENNTLDDVSFDLYKGQRLAIVGKNGAGKSTLAKALCQFI-PNNATLIYNNEDVSQD  361
              +    +   D+SF L +G  A+VG NG GKSTL    L  + P +  ++  ++ + +
Sbjct:  303 ARG-QQAIFKDISFSLREGSLTALVGPNGTGKSTLLSVLASLMKPQSGKILLYDQPLQKY  361

Query:  362 SIKERAERIGYVLQNPNQMISQAMVFDEVALGLRLRGFSDNDIESRVYDILKVCGLYQFR  421
               KE  +R+G+V QNP        V+DE+   G +    ++ + E +    +L+  GL
Sbjct:  362 KEKELRKRMGFVFQNPEHQFVTDTVYDELLFGQK----ANAETEKKAQHLLQRFGLAHLA  417

Query:  422 NWPISALSFGQKKRVTIASILILNPEVIILDEPTAGQDMKHYTEMMSFLDKLSCDGHTIV  481
              +    A+S GQK+R+++A++L+ + +V++LDEPT GQD  +   E M   + +G  ++
Sbjct:  418 DHHPFAISQGGQKRRLSVATMLMHDVKVLLLDEPTFGQDARTAAECMEMIQRIKAEGTAVL  477

Query:  482 MIT  484
            MIT
Sbjct:  478 MIT  480
```

There is also homology to SEQ ID 4416.

SEQ ID 4874 (GBS424d) was expressed in *E. coli* as a GST-fusion product. SDS-PAGE analysis of total cell extract is shown in FIG. 146 (lane 2 & 4; MW 77 kDa) and in FIG. 239 (lane 10; MW 77 kDa). It was also expressed in *E. coli* as a His-fusion product. SDS-PAGE analysis of total cell extract is shown in FIG. 146 (lane 5 & 7; MW 52 kDa) and in FIG. 182 (lane 4; MW 52 kDa). Purified GBS424d-His is shown in FIG. 241, lanes 6 & 7. Purified GBS424d-GST is shown in FIG. 246, lane 12.

Based on this analysis, it was predicted that this protein and its epitopes, could be useful antigens for vaccines or diagnostics.

EXAMPLE 1578

A DNA sequence (GBSx1672) was identified in *S. agalactiae* <SEQ ID 4875> which encodes the amino acid sequence <SEQ ID 4876>. Analysis of this protein sequence reveals the following:

```
Possible site: 58
>>> Seems to have no N-terminal signal sequence
    INTEGRAL    Likelihood = -8.12    Transmembrane    39-55   (35-63)
    INTEGRAL    Likelihood = -3.98    Transmembrane    72-88   (71-90)
    INTEGRAL    Likelihood = -3.66    Transmembrane   108-124  (106-127)
    INTEGRAL    Likelihood = -2.34    Transmembrane   182-198  (181-198)
    INTEGRAL    Likelihood = -1.44    Transmembrane   141-157  (139-158)

----- Final Results -----
             bacterial membrane --- Certainty = 0.4248 (Affirmative) < succ>
             bacterial outside  --- Certainty = 0.0000 (Not Clear)   < succ>
             bacterial cytoplasm --- Certainty = 0.0000 (Not Clear)  < succ>
```

The protein has homology with the following sequences in the GENPEPT database.

```
>GP: CAB59830 GB: AJ012388 hypothetical protein [Lactococcus lactis]
Identities = 109/182 (59%), Positives = 141/182 (76%)

Query:   31 MNTNTIKKVVATGIGAALFIIIGMLVNIPTPIPNTNIQLQYAVLALFAVIYGPGVGFFTG   90
            M  N++K VVATGIGAALF+IIG L+NIPTPIPNT+IQLQYAVLALF+ ++GP GF  G
Sbjct:    1 MKNNSVKIVVATGIGAALFVIIGWLINIPTPIPNTSIQLQYAVLALFSALFGPLAGFLIG   60

Query:   91 FIGHALKDSIQYGSPWWTWVLVSGLLGLMIGFFAKKLAIQLSGMTKKDLLLFNVVQVIAN  120
            FIGHALKDS  YG+PWWTWVL SGL+GL +GF  K+ ++         K+++ FN+VQ +AN
Sbjct:   61 FIGHALKDSFLYGAPWWTWVLGSGLMGLFLGFGVKRESLTQGIFGNKEIIRFNIVQFLAN  120

Query:  151 LIGWSVVAPYGDIFFYSEPASKVFAQGFLSSLVNSITIGVGGTLLLLAYAKSRPQKGSLS  210
             ++ W ++AP GDI  YSEPA+KVF QG ++ LVN++TI V GTLLL  YA +R + G+L
Sbjct:  121 VVVWGLIAPIGDILVYSEPANKVFTQGVVAGLVNALTIAVAGTLLLKLYAATRTKSGTLD  180

Query:  211 KD  212
            K+
Sbjct:  181 KE  182
```

No corresponding DNA sequence was identified in *S. pyogenes*.

A related GBS gene <SEQ ID 8857> and protein <SEQ ID 8858> were also identified. Analysis of this protein sequence reveals the following:

```
Lipop: Possible site: -1 Crend: 6
McG: Discrim Score: -5.01
GvH: Signal Score (-7.5): -5.9
   Possible site: 50
>>> Seems to have no N-terminal signal sequence
ALOM program count: 5 value:      threshold: 0.0
                     -8.12
    INTEGRAL  Likelihood = -8.12  Transmembrane   31-47  (27-55)
    INTEGRAL  Likelihood = -3.98  Transmembrane   64-80  (63-82)
    INTEGRAL  Likelihood = -3.66  Transmembrane  100-116 (98-119)
    INTEGRAL  Likelihood = -2.34  Transmembrane  174-190 (173-190)
    INTEGRAL  Likelihood = -1.44  Transmembrane  133-149 (131-150)
    PERIPHERAL   Likelihood = 5.78      9
modified ALOM score: 2.12

*** Reasoning Step: 3

----- Final Results -----
           bacterial membrane --- Certainty = 0.4248 (Affirmative) < succ>
            bacterial outside --- Certainty = 0.0000 (Not Clear) < succ>
           bacterial cytoplasm --- Certainty = 0.0000 (Not Clear) < succ>
```

The protein has homology with the following sequences in the databases:

```
ORF02330(367-912 of 1212)
GP|6165407|emb|CAB59830.1||AJ012388(1-182 of 182) hypothetical protein
{Lactococcus lactis}
% Match = 28.1
% Identity = 59.9   % Similarity = 78.6
Matches = 109   Mismatches = 39   Conservative Sub.s = 34
   102       132       162       192       222       252       282       312
MQVVGVGFIVGVIQDSCETALNSSTDVLFTAVAEKSVFGKK*TNEGLRYSI*DLFWYLILFSIVFQFFLSIRFQISLKYD 342       372       402       432       462       492       522       552
KIEQIVSDCLSLFFREVFMNTNTIKKVVATGIGAALFIIIGMLVNIPTPIPNTNIQLQYAVLALFAVIYGPGVGFFTGFI
                  |   |::|  ||||||||||:|||  |:|||||||||:|||||||||: ::||    ||: |||
                 MKNNSVKIVVATGIGAALFVIIGWLINIPTPIPNTSIQLQYAVLALFSALFGPLAGFLIGFI
                   10        20        30        40        50        60

582       612       642       672       702       732       762       792
GHALKDSIQYGSPWWTWVLVSGLLGLMIGFFAKKLAIQLSGMTKKDLLLFNVVQVIANLIGWSVVAPYGDIFFYSEPASK
||||||| ||:|||||| |||:||   ||:||  |:  : :|::  |::: |  ::|| |||: ||||||:|
GHALKDSFLYGAPWWTWVLGSGLMGLFLGFGVKRESLTQGIFGNKEIIRFNIVQFLANVVVWGLIAPIGDILVYSEPANK
       80        90        100       110       120       130       140

822       852       882       912       942       972       1002      1032
VFAQGFLSSLVNSITIGVGGTLLLLAYAKSRPQKGSLSKD*DKRVIYERFY*MEGFYLSI*RSI*TNFKRD*LKHS*R*K
|| ||  :: |||::||  |  |||||   ||  |:  : |:|  |:
VFTQGVVAGLVNALTIAVAGTLLLKLYAATRTKSGTLDKE
      160       170       180
```

Based on this analysis, it was predicted that these proteins and their epitopes could be useful antigens for vaccines or diagnostics.

EXAMPLE 1579

A DNA sequence (GBSx1673) was identified in *S. agalactiae* <SEQ ID 4877> which encodes the amino acid sequence <SEQ ID 4878>. Analysis of this protein sequence reveals the following:

```
Possible site: 42
>>> Seems to have no N-terminal signal sequence
INTEGRAL Likelihood = -6.85 Transmembrane 86-102 (80-106)

----- Final Results -----
           bacterial membrane --- Certainty = 0.3739 (Affirmative) < succ>
            bacterial outside --- Certainty = 0.0000 (Not Clear) < succ>
           bacterial cytoplasm --- Certainty = 0.0000 (Not Clear) < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1580

A DNA sequence (GBSx1674) was identified in *S. agalactiae* <SEQ ID 4879> which encodes the amino acid sequence <SEQ ID 4880>. Analysis of this protein sequence reveals the following:

```
Possible site: 47
>>> Seems to have a cleavable N-term signal seq.
INTEGRAL Likelihood = -3.61 Transmembrane 107-123 (96-124)
INTEGRAL Likelihood = -1.86 Transmembrane 124-140 (124-142)
INTEGRAL Likelihood = -1.38 Transmembrane  83-99  (83-100)
INTEGRAL Likelihood =  1.12 Transmembrane 142-158 (142-160)

----- Final Results -----
            bacterial membrane --- Certainty = 0.2444 (Affirmative) < succ>
             bacterial outside --- Certainty = 0.0000 (Not Clear)   < succ>
            bacterial cytoplasm --- Certainty = 0.0000 (Not Clear)   < succ>
```

A related GBS nucleic acid sequence <SEQ ID 9415> which encodes amino acid sequence <SEQ ID 9416> was also identified.

The protein has homology with the following sequences in the GENPEPT database.

```
>GP: AAC76124 GB: AE000391 putative transport protein [Escherichia
coli K12]
Identities = 139/178 (78%), Positives = 159/178 (89%)

Query:    1 MVGTMLFVALVVNPIIAFVMMRKNPYPLVLRCLKDSGITAFFTRSSAANIPVNMRLCEDL   60
            +VG ML VALVVNP++ +  +R+NP+PLVL CL++SG+ AFFTRSSAANIPVNM LCE L
Sbjct:  222 LVGCMLLVALVVNPLLVWWKIRRNPFPLVLLCLRESGVYAFFTRSSAANIPVNMALCEKL  281

Query:   61 GLDKDTYSVSIPLGAAINMAGAAITINILTLAAVNTLGITVDFPTAFLLSVVAAVSACGA  120
            LD+DTYSVSIPLGA INMAGAAITI +LTLAAVNTLGI VD PTA LLSVVA++ ACGA
Sbjct:  282 NLDRDTYSVSIPLGATINMAGAAITITVLTLAAVNTLGIPVDLPTALLLSVVASLCACGA  341

Query:  121 SGVTGGSLLLIPVACSLFGISNDVAMQVVGVGFIVGVIQDSCETALNSSTDVLFTAVA   178
            SGV GGSLLLIP+AC++FGISND+AMQVV VGFI+GV+QDSCETALNSSTDVLFTA A
Sbjct:  342 SGVAGGSLLLIPLACNMFGISNDIAMQVVAVGFIIGVLQDSCETALNSSTDVLFTAAA   399
```

A related DNA sequence was identified in *S. pyogenes* <SEQ ID 4881> which encodes the amino acid sequence <SEQ ID 4882>. Analysis of this protein sequence reveals the following:

```
Possible site: 58
>>> Seems to have an uncleavable N-term signal seq
INTEGRAL Likelihood = -13.69 Transmembrane 212-228 (202-239)
INTEGRAL Likelihood =  -7.38 Transmembrane  78-94  (74-108)
INTEGRAL Likelihood =  -6.53 Transmembrane 179-195 (175-200)
INTEGRAL Likelihood =  -6.10 Transmembrane 315-331 (312-341)
INTEGRAL Likelihood =  -5.36 Transmembrane  44-60  (42-61)
INTEGRAL Likelihood =  -4.41 Transmembrane  13-29  (11-41)
INTEGRAL Likelihood =  -3.19 Transmembrane 340-356 (333-358)
INTEGRAL Likelihood =  -3.08 Transmembrane 145-161 (144-162)
INTEGRAL Likelihood =  -0.90 Transmembrane 358-374 (358-376)

----- Final Results -----
            bacterial membrane --- Certainty = 0.6477 (Affirmative) < succ>
             bacterial outside --- Certainty = 0.0000 (Not Clear)   < succ>
            bacterial cytoplasm --- Certainty = 0.0000 (Not Clear)   < succ>
```

The protein has homology with the following sequences in the databases:

```
>GP: AAF95950 GB: AE004347 sodium/dicarboxylate symporter [Vibrio
cholerae]
Identities = 243/385 (63%), Positives = 299/385 (77%), Gaps = 2/385 (0%)

Query:   9 VRVSLIKKIGIGVVIGVMLGILAPDLTG-FSILGKLFVGGLKAIAPLLVFALVSQAISHQ   67
           VR +L+ +I  G+++G +     +P+        ++G LFVG LKA+AP+LVF LV+ +I++Q
Sbjct:  11 VRGNLVLQILAGILLGAAMATFSPEYAQKVGLIGNLFVGALKAVAPVLVFILVASSIANQ   70

Query:  68 KKGKQTNMTLIIVLYLFGTFASALVAVLTAYLFPLTLVLNTPVNTELSPPQGVAEVFQSL  127
           KK + T M  I+VLYLFGTF++AL AV+ ++LFP TLVL T      +PPQG+AEV  +L
Sbjct:  71 KKNQHTYMRPIVVLYLFGTFSAALTAVILSFLFPTTLVLATGAEGA-TPPQGIAEVLNTL  129

Query: 128 LLKLVDNPINALATANYIGVLSWAIIFGLALKAASKETKHLIKTAAEVTSQIVVWIINLA  187
           L KLVDNP++AL  ANYIG+L+W +  GLAL  +S  TK + +    SQIV +II LA
Sbjct: 130 LFKLVDNPVSALMNANYIGILAWGVGLGLALHHSSSTTKAVFEDLSHGISQIVRFIIRLA  189

Query: 188 PIGIMSLVFTTISENGVGILSDYAFLILVLVGTMLFVALVVNPLIAVLITRQNPYPLVLR  247
           P GI   LV +T +  G    L+ YA L+ VL+G M F+ALVVNP+I       R+NP+PLVL+
Sbjct: 190 PFGIFGLVASTFATTGFDALAGYAQLLAVLLGAMAFIALVVNPMIVYYKIRRNPFPLVLQ  249

Query: 248 CLRESGLTAFFTRSSAANIPVNMQLCQKIGLSKDTYSVSIPLGATINMGGAAITINVLTL  307
           CLRESG+TAFFTRSSAANIPVNM LC+K+ L +DTYSVSIPLGATINM GAAITI VLTL
Sbjct: 250 CLRESGVTAFFTRSSAANIPVNMALCEKLKLDEDTYSVSIPLGATINMAGAAITITVLTL  309

Query: 308 AAVHTFGIPIDELTALLLSVVAAVSACGASGVAGGSLLLIPVACSLFGISNDLAMQVVGV  367
           AAVHT GI +D +TALLLSVVAAVSACGASGVAGGSLLLIP+AC LFGISND+AMQVV V
Sbjct: 310 AAVHTMGIEVDLMTALLLSVVAAVSACGASGVAGGSLLLIPLACGLFGISNDIAMQVVAV  369

Query: 368 GFIVGVIQDSCETALNSSTDVLFTA                                    392
           GFI+GVIQDS ETALNSSTDVLFTA
Sbjct: 370 GFIIGVIQDSAETALNSSTDVLFTA                                    394
```

An alignment of the GAS and GBS proteins is shown below.

```
Identities = 153/186 (82%), Positives = 172/186 (92%)

Query:   1 MVGTMLFVALVVNPIIAFVMMRKNPYPLVLRCLKDSGITAFFTRSSAANIPVNMRLCEDL   60
           +VGTMLFVALVVNP+IA ++ R+NPYPLVLRCL++SG+TAFFTRSSAANIPVNM+LC+ +
Sbjct: 217 LVGTMLFVALVVNPLIAVLITRQNPYPLVLRCLRESGLTAFFTRSSAANIPVNMQLCQKI  276

Query:  61 GLDKDTYSVSIPLGAAINMAGAAITINILTLAAVNTLGITVDFPTAFLLSVVAAVSACGA  120
           GL KDTYSVSIPLGA INM GAAITIN+LTLAAV+T GI +DF TA LLSVVAAVSACGA
Sbjct: 277 GLSKDTYSVSIPLGATINMGGAAITINVLTLAAVHTFGIPIDFLTALLLSVVAAVSACGA  336

Query: 121 SGVTGGSLLLIPVACSLFGISNDVAMQVVGVGFIVGVIQDSCETALNSSTDVLFTAVAEK  180
           SGV GGSLLLIPVACSLFGISND+AMQVVGVGFIVGVIQDSCETALNSSTDVLFTA+AE
Sbjct: 337 SGVAGGSLLLIPVACSLFGISNDLAMQVVGVGFIVGVIQDSCETALNSSTDVLFTAIAEN  396

Query: 181 SVFGKK                                                       186
           + + +K
Sbjct: 397 AFWKRK                                                       402
```

Based on this analysis, it was predicted that these proteins and their epitopes could be useful antigens for vaccines or diagnostics.

EXAMPLE 1581

A DNA sequence (GBSx1675) was identified in *S. agalactiae* <SEQ ID 4883> which encodes the amino acid sequence <SEQ ID 4884>. This protein is predicted to be acid phosphatase. Analysis of this protein sequence reveals the following:

```
Possible site: 40
>>> Seems to have no N-terminal signal sequence

----- Final Results -----
          bacterial cytoplasm --- Certainty = 0.2436 (Affirmative) < succ>
          bacterial membrane  --- Certainty = 0.0000 (Not Clear)   < succ>
          bacterial outside   --- Certainty = 0.0000 (Not Clear)   < succ>
```

A related GBS nucleic acid sequence <SEQ ID 9427> which encodes amino acid sequence <SEQ ID 9428> was also identified.

The protein has homology with the following sequences in the GENPEPT database.

```
>GP: CAA73175 GB: Y12602 acid phosphatase [Streptococcus equisimilis]
Identities = 167/251 (66%), Positives = 209/251 (82%)

Query:   7 EQKTKFKNISLSSNKLLAKENTMSVLWYQNSAEAKALYLQGYNVAKMKLDDWLQKPSEKP    66
           ++  K   ++ S  +L +  ENTMSVLWYQ +AEAKALYLQGY +A  +L + L + ++KP
Sbjct:  34 KETVKQTKVTYSDEQLRSNENTMSVLWYQRAAEAKALYLQGYQLATDRLKNQLGQATDKP    93

Query:  67 YSIILDLDETVLDNSPYQAKNIKDGSSFTPESWDKWVQKKSAKAVAGAKEFLKYANEKGI   126
           YSI+LD+DETVLDNSPYQAKNI +G+SFTPESWD WVQKK AK VAGAKEFL++A++ G+
Sbjct:  94 YSIVLDIDETVLDNSPYQAKNILEGTSFTPESWDVWVQKKEAKPVAGAKEFLQFADQNGV   153

Query: 127 KIYYVSDRTDAQVDATKENLEKEGIPVQGKDHLLFLKKGMKSKESRRQAVQKDTNLIMLF   186
           +IYY+SDR  +QVDAT ENL+KEGIPVQG+DHLLFL++G+KSKE +RRQ V++ TNLIMLF
Sbjct: 154 QIYYISDRAVSQVDATMENLQKEGIPVQGRDHLLFLEEGVKSKEARRQKVKETTNLIMLF   213

Query: 187 GDNLVDFADFSKSSSTDREQLLTKLQSEFGSKFIVFPNPMYGSWESAIYQGKHLDVQKQL   246
           GDNLVDFADFSK S   DR  LL++LQ EFG +FI+FPNPMYGSWESA+Y+G  LD    QL
Sbjct: 214 GDNLVDFADFSKKSEEDRTALLSELQEEFGRQFIIFPNPMYGSWESAVYKGDKLDASHQL   273

Query: 247 KERQKMLHSYD                                                  257
           KER+K L S++
Sbjct: 274 KERRKALESFE                                                  284
```

25

A related DNA sequence was identified in *S. pyogenes* <SEQ ID 4885> which encodes the amino acid sequence <SEQ ID 4886>. Analysis of this protein sequence reveals the following:

```
Possible site: 25
>>> May be a lipoprotein

----- Final Results -----
              bacterial membrane --- Certainty = 0.0000(Not Clear) < succ>
              bacterial outside  --- Certainty = 0.0000(Not Clear) < succ>
              bacterial cytoplasm --- Certainty = 0.0000(Not Clear) < succ>
```

The protein has homology with the following sequences in the databases:

```
>GP:CAA73175 GB:Y12602 acid phosphatase [Streptococcus equisimilis]
Identities = 234/284 (82%), Positives = 261/284 (91%)
Query:    1 MKSKKVVSVISLTLSLFLVTGCAKVDNNKSVNLKPATKQTYNSYSDDQLRSRENTMSVLW    60
            MK+K+V SVISL LSLFLVTGCA++D+  +VN K   KQT  +YSD+QLRS ENTMSVLW
Sbjct:    1 MKTKQVASVISLALSLFLVTGCAQLDHKANVNSKETVKQTKVTYSDEQLRSNENTMSVLW    60

Query:   61 YQRAAETQALYLQGYQLATDRLKEQLNKPTDKPYSIVLDIDETVLDNSPYQAKNVLEGTG   120
            YQRAAE +ALYLQGYQLATDRLK QL + TDKPYSIVLDIDETVLDNSPYQAKN+LEGT
Sbjct:   61 YQRAAEAKALYLQGYQLATDRLKNQLGQATDKPYSIVLDIDETVLDNSPYQAKNILEGTS   120

Query:  121 FTPESWDYWVQKKEAKPVAGAKDFLQFADQNGVQIYYISDRSTTQVDATMENLQKEGIPV   180
            FTPESWD WVQKKEAKPVAGAK+FLQFADQNGVQIYYISDR+ +QVDATMENLQKEGIPV
Sbjct:  121 FTPESWDVWVQKKEARPVAGAKEFLQFADQNGVQIYYISDRAVSQVDATMENLQKEGIPV   180

Query:  181 QGRDHLLFLEKGVKSKESRRQKVKETTNVTMLFGDNLLDFADFSKKSQEDRTALLSDLQE   240
            QGRDHLLFLE+GVKSKE+RRQKVKETTN+ MLFGDNL+DFADFSKKS+EDRTALLS+LQE
Sbjct:  181 QGRDHLLFLEEGVKSKEARRQKVKETTNLIMLFGDNLVDFADFSKKSEEDRTALLSELQE   240

Query:  241 EFGRRFIIFPNPMYGSWEGAIYKGEKLDVLKQLEERRKSLKSFK                 284
            EFGR+FIIFPNPMYGSWE A+YKG+KLD   QL+ERRK L+SF+
Sbjct:  241 EFGRQFIIFPNPMYGSWESAVYKGDKLDASHQLKERRKALESFE                 284
```

An alignment of the GAS and GBS proteins is shown below.

```
Identities = 166/247 (67%), Positives = 207/247 (83%)
Query:  10 TKFKNISLSSNKLLAKENTMSVLWYQNSAEAKALYLQGYNVAKMKLDDWLQKPSEKPYSI   69
            TK    S S ++L ++ENTMSVLWYQ +AE +ALYLQGY +A  +L + L KP++KPYSI
Sbjct:  37 TKQTYNSYSDDQLRSRENTMSVLWYQRAAETQALYLQGYQLATDRLKEQLNKPTDKPYSI   96

Query:  70 ILDLDETVLDNSPYQAKNIKDGSSFTPESWDKWVQKKSAKAVAGAKEFLKYANEKGIKIY  129
            +LD+DETVLDNSPYQAKN+ +G+ FTPESWD WVQKK AK VAGAK+FL++A++ G++IY
Sbjct:  97 VLDIDETVLDNSPYQAKNVLEGTGFTPESWDYWVQKKEAKPVAGAKDFLQFADQNGVQIY  156

Query: 130 YVSDRTDAQVDATKENLEKEGIPVQGKDHLLFLKKGMKSKESRRQAVQKDTNLIMLFGDN  189
            Y+SDR+   QVDAT ENL+KEGIPVQG+DHLLFL+KG+KSKESRRQ V++ TN+ MLFGDN
Sbjct: 157 YISDRSTTQVDATMENLQKEGIPVQGRDHLLFLEKGVKSKESRRQKVKETTNVTMLFGDN  216

Query: 190 LVDFADFSKSSSTDREQLLTKLQSEFGSKFIVFPNPMYGSWESAIYQGKHLDVQKQLKER  249
            L+DFADFSK S  DR  LL+ LQ EFG +FI+FPNPMYGSWE AIY+G+ LDV KQL+ER
Sbjct: 217 LLDFADFSKKSQEDRTALLSDLQEEFGRRFIIFPNPMYGSWEGAIYKGEKLDVLKQLEER  276

Query: 250 QKMLHSY                                                      256
            +K L S+
Sbjct: 277 RKSLKSF                                                      283
```

Figure 136:
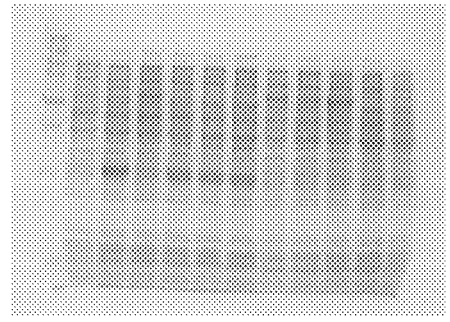

SEQ ID 9428 (GBS661) was expressed in *E. coli* as a GST-fusion product. SDS-PAGE analysis of total cell extract is shown in FIG. 136 (lane 2 & 4; MW 61 kDa+lane 3; MW 27 kDa) and in FIG. 186 (lane 11; MW 61 kDa). It was also expressed in *E. coli* as a His-fusion product. SDS-PAGE analysis of total cell extract is shown in FIG. 136 (lane 5-7; MW 25 kDa).

Figure 237:
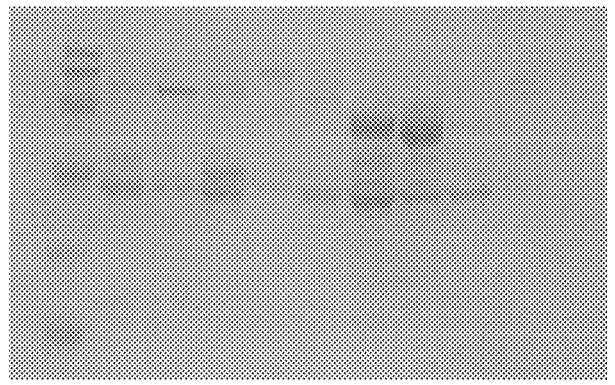

GBS661-GST was purified as shown in FIG. 237, lane 5.

Based on this analysis, it was predicted that these proteins and their epitopes could be useful antigens for vaccines or diagnostics.

EXAMPLE 1582

A DNA sequence (GBSx1676) was identified in *S. agalactiae* <SEQ ID 4887> which encodes the amino acid sequence <SEQ ID 4888>. This protein is predicted to be unnamed protein product. Analysis of this protein sequence reveals the following:

```
Possible site: 58
>>> Seems to have no N-terminal signal sequence

----- Final Results -----
         bacterial cytoplasm --- Certainty = 0.3462(Affirmative) < succ>
         bacterial membrane  --- Certainty = 0.0000(Not Clear)   < succ>
          bacterial outside  --- Certainty = 0.0000(Not Clear)   < succ>
```

A related DNA sequence was identified in *S. pyogenes* <SEQ ID 4889> which encodes the amino acid sequence <SEQ ID 4890>. Analysis of this protein sequence reveals the following:

```
Possible site: 58
>>> Seems to have no N-terminal signal sequence

----- Final Results -----
         bacterial cytoplasm --- Certainty = 0.3462(Affirmative) < succ>
         bacterial membrane  --- Certainty = 0.0000(Not Clear)   < succ>
          bacterial outside  --- Certainty = 0.0000(Not Clear)   < succ>
```

An alignment of the GAS and GBS proteins is shown below.

```
Identities = 395/398 (99%), Positives = 398/398 (99%)
Query:   1 MAKLTVKDVDLKGKKVLVRVDFNVPLKDGVITNDNRITAALPTIKYIIEQGGRAILFSHL   60
           MAKLTVKDVDLKGKKVLVRVDFNVPLKDGVITNDNRITAALPTIKYIIEQGGRAILFSHL
Sbjct:   1 MAKLTVKDVDLKGKKVLVRVDFNVPLKDGVITNDNRITAALPTIKYIIEQGGRAILFSHL   60

Query:  61 GRVKEEADKEGKSLAPVAADLAAKLGQDVVFPGVTRGAKLEEAINALEDGQVLLVENTRF  120
           GRVKEEADKEGKSLAPVAADLAAKLGQDVVFPGVTRG+KLEEAINALEDGQVLLVENTRF
Sbjct:  61 GRVKEEADKEGKSLAPVAADLAAKLGQDVVFPGVTRGSKLEEAINALEDGQVLLVENTRF  120

Query: 121 EDVDGKKESKNDEELGKYWASLGDGIFVNDAFGTAHRAHASNVGISANVEKAVAGFLLEN  180
           EDVDGKKESKNDEELGKYWASLGDGIFVNDAFGTAHRAHASNVGISANVEKAVAGFLLEN
Sbjct: 121 EDVDGKKESKNDEELGKYWASLGDGIFVNDAFGTAHRAHASNVGISANVEKAVAGFLLEN  180
```

```
Query:  181 EIAYIQEAVETPERPFVAILGGSKVSDKIGVIENLLEKADKVLIGGGMTYTFYKAQGIEI  240
            EIAYIQEAVETPERPFVAILGGSKVSDKIGVIENLLEKADKVLIGGGMTYTFYKAQGIEI
Sbjct:  181 EIAYIQEAVETPERPFVAILGGSKVSDKIGVIENLLEKADKVLIGGGMTYTFYKAQGIEI  240

Query:  241 GNSLVEEDKLDVAKDLLEKSNGKLILPVDSKEANAFAGYTEVRDTEGEAVSEGFLGLDIG  300
            GNSLVEEDKLDVAKDLLEKSNGKLILPVDSKEANAFAGYTEVRDTEGEAVSEGFLGLDIG
Sbjct:  241 GNSLVEEDKLDVAKDLLEKSNGKLILPVDSKEANAFAGYTEVRDTEGEAVSEGFLGLDIG  300

Query:  301 PKSIAKFDEALTGAKTVVWNGPMGVFENPDFQAGTIGVMDAIVKQPGVKSIIGGGDSAAA  360
            PKSIA+FD+ALTGAKTVVWNGPMGVFENPDFQAGTIGVMDAIVKQPGVKSIIGGGDSAAA
Sbjct:  301 PKSIAEFDQALTGAKTVVWNGPMGVFENPDFQAGTIGVMDAIVKQPGVKSIIGGGDSAAA  360

Query:  361 AINLGRADKFSWISTGGGASMELLEGKVLPGLAALTEK                       398
            AINLGRADKFSWISTGGGASMELLEGKVLPGLAALTEK
Sbjct:  361 AINLGRADKFSWISTGGGASMELLEGKVLPGLAALTEK                       398
```

Based on this analysis, it was predicted that these proteins and their epitopes could be useful antigens for vaccines or diagnostics.

EXAMPLE 1583

A DNA sequence (GBSx1677) was identified in *S. agalactiae* <SEQ ID 4891> which encodes the amino acid sequence <SEQ ID 4892>. Analysis of this protein sequence reveals the following:

```
Possible site: 53
>>> Seems to have no N-terminal signal sequence
    INTEGRAL   Likelihood = -8.39   Transmembrane    97-113   (93-118)
    INTEGRAL   Likelihood = -3.66   Transmembrane    25-41    (24-48)
    INTEGRAL   Likelihood = -3.40   Transmembrane   121-137  (121-140)
    INTEGRAL   Likelihood = -3.24   Transmembrane    72-88    (72-88)
    INTEGRAL   Likelihood = -2.07   Transmembrane   143-159  (143-160)

----- Final Results -----
           bacterial membrane --- Certainty = 0.4354(Affirmative) < succ>
            bacterial outside --- Certainty = 0.0000(Not Clear)   < succ>
          bacterial cytoplasm --- Certainty = 0.0000(Not Clear)   < succ>
```

The protein has no significant homology with any sequences in the GENPEPT database.

A related DNA sequence was identified in *S. pyogenes* <SEQ ID 4893> which encodes the amino acid sequence <SEQ ID 4894>. Analysis of this protein sequence reveals the following:

```
Possible site: 53
>>> Seems to have no N-terminal signal sequence
    INTEGRAL   Likelihood = -8.23   Transmembrane    97-113   (93-118)
    INTEGRAL   Likelihood = -7.17   Transmembrane   121-137  (119-140)
    INTEGRAL   Likelihood = -4.19   Transmembrane    25-41    (24-48)
    INTEGRAL   Likelihood = -3.24   Transmembrane    72-88    (72-88)
    INTEGRAL   Likelihood = -2.55   Transmembrane   154-170  (154-170)

----- Final Results -----
           bacterial membrane --- Certainty = 0.4291(Affirmative) < succ>
            bacterial outside --- Certainty = 0.0000(Not Clear)   < succ>
          bacterial cytoplasm --- Certainty = 0.0000(Not Clear)   < succ>
```

The protein has no significant homology with any sequences in the GENPEPT database.

An alignment of the GAS and GBS proteins is shown below.

```
                 Identities = 155/178 (87%), Positives = 169/178 (94%)

Query:    1 MKTLKKLLSNYKFDIKKFKLGMRTFKTGLSVFLVLLVFHLFGWKGLQIGALTAVFSLRED   60
                    MKTL+KLLSNYKFDIKKFKLGMRT KTGLSVFLVLLVFHLFGWKGLQIGALTAVFSLRED
        Sbjct:    1 MKTLRKLLSNYKFDIKKFKLGMRTLKTGLSVFLVLLVFHLFGWKGLQIGALTAVFSLRED   60

Query:   61 FDKSVHFGFSRIIGNSIGGLLSLVFFAFNEIFHQAFWVTLLIVPICTMLCIMINVACNNK  120
                    FDKSVHFGFSRIIGNSIGGLLSLVFFAFNEIFHQAFWVTLLIVPICTMLCIM+NVACNNK
        Sbjct:   61 FDKSVHFGFSRIIGNSIGGLLSLVFFAFNEIFHQAFWVTLLIVPICTMLCIMVNVACNNK  120
```

```
Query: 121 SGIIGGTAALLIITLSIPSGETILYVFARIFETFCGVFIAMMVNTDIEILRKKLKNNK  178
            SGIIG  AALLIITLSIP+G+T +YV +R+FETFCGVF+A++VNTD+E+++ K  N K
Sbjct: 121 SGIIGAVAALLIITLSIPTGQTFIYVTSRVFETFCGVFVAILVNTDVELIKNKWFNKK  178
```

Based on this analysis, it was predicted that these proteins and their epitopes could be useful antigens for vaccines or diagnostics.

EXAMPLE 1584

A DNA sequence (GBSx1678) was identified in *S. agalactiae* <SEQ ID 4895> which encodes the amino acid sequence <SEQ ID 4896>. This protein is predicted to be regulatory protein glnr (glnR). Analysis of this protein sequence reveals the following:

```
Possible site: 17
>>> Seems to have an uncleavable N-term signal seq

----- Final Results -----
             bacterial membrane --- Certainty = 0.0000(Not Clear) < succ>
              bacterial outside --- Certainty = 0.0000(Not Clear) < succ>
            bacterial cytoplasm --- Certainty = 0.0000(Not Clear) < succ>
```

The protein has homology with the following sequences in the GENPEPT database.

```
>GP: BAA00402 GB: D00513 ORF129 [Bacillus cereus]
Identities = 59/123 (47%), Positives = 89/123 (71%),
Gaps = 5/123 (4%)

Query:   4 RELRRTMAVFPIGAVMKLTDLTARQIRYYEDQGLITPERTEGNRRMFSLNDMDRLLEIKD   63
           +E RR+  +FPIG VM LT L+ARQIRYYE+   L++P RT+GNRR+FS ND+D+LLEIKD
Sbjct:   2 KEDRRSAPLFPIGIVMDLTQLSARQIRYYEEHNLVSPTRTKGNRRLFSFNDVDKLLEIKD   61

Query:  64 FISDGLHISDIKNEYMQRQH-----KSKEKQKSLSDAEVRRLLQDELRNQGRFSSPSQHI  118
           +   GL+++ IK  + +++      K KE+ K +S  E+R++L+DEL++ GRF+   S
Sbjct:  62 LLDQGLNMAGIKQVLLMKENQTEAVKVKEETKEISKTELRKILRDELQHTGRFNRTSLRQ  121

Query: 119 GNM                                                          121
           G++
Sbjct: 122 GDI                                                          124
```

A related DNA sequence was identified in *S. pyogenes* <SEQ ID 4897> which encodes the amino acid sequence <SEQ ID 4898>. Analysis of this protein sequence reveals the following:

```
Possible site: 20
>>> Seems to have an uncleavable N-term signal seq

----- Final Results -----
             bacterial membrane --- Certainty = 0.0000(Not Clear) < succ>
              bacterial outside --- Certainty = 0.0000(Not Clear) < succ>
            bacterial cytoplasm --- Certainty = 0.0000(Not Clear) < succ>
```

The protein has homology with the following sequences in the databases:

```
>GP: BAA00402 GB: D00513 ORF129 [Bacillus cereus]
Identities = 59/122 (48%), Positives = 83/122 (67%),
Gaps = 5/122 (4%)

Query:   4 KELRRSMAVFPIGTVMTLTDLSARQIRYYEDQGLIKPERTQGNRRMFSLNDMDRLLEIKD   63
           KE RRS  +FPIG VM LT LSARQIRYYE+   L+ P RT+GNRR+FS ND+D+LLEIKD
Sbjct:   2 KEDRRSAPLFPIGIVMDLTQLSARQIRYYEEHNLVSPTRTKGNRRLFSFNDVDKLLEIKD   61
```

```
                                          -continued
Query:  64 FLSEGLNIAAIKREYVERQG-----KLMQKQKALTDADVRRILHDEMLTQSGFSTPSQHI  118
           L +GLN+A IK+  + ++       K+ ++ K ++  ++R+IL DE+     F+   S
Sbjct:  62 LLDQGLNMAGIKQVLLMKENQTEAVKVKEETKEISKTELRKILRDELQHTGRFNRTSLRQ  121

Query: 119 GN                                                           120
           G+
Sbjct: 122 GD                                                           123
```

An alignment of the GAS and GBS proteins is shown below.

```
Identities = 90/123 (73%), Positives = 108/123 (87%)

Query:    1 MKERELRRTMAVFPIGAVMKLTDLTARQIRYYEDQGLITPERTEGNRRMFSLNDMDRLLE    60
            MKE+ELRR+MAVFPIG VM LTDL+ARQIRYYEDQGLI PERT+GNRRMFSLNDMDRLLE
Sbjct:    1 MKEKELRRSMAVFPIGTVMTLTDLSARQIRYYEDQGLIKPERTQGNRRMFSLNDMDRLLE    60

Query:   61 IKDFISDGLHISDIKNEYMQRQHKSKEKQKSLSDAEVRRLLQDELRNQGRFSSPSQHIGN   120
            IKDF+S+GL+I+  IK EY++RQ K  +KQK+L+DA+VRR+L DE+  Q  FS+PSQHIGN
Sbjct:   61 IKDFLSEGLNIAAIKREYVERQGKLMQKQKALTDADVRRILHDEMLTQSGFSTPSQHIGN   120

Query:  121 MHL                                                          123
             +
Sbjct:  121 FRI                                                          123
```

Based on this analysis, it was predicted that these proteins and their epitopes could be useful antigens for vaccines or diagnostics.

EXAMPLE 1585

A DNA sequence (GBSx1679) was identified in *S. agalactiae* <SEQ ID 4899> which encodes the amino acid sequence <SEQ ID 4900>. This protein is predicted to be glutamine synthetase (glnA). Analysis of this protein sequence reveals the following:

```
Possible site: 29
>>> Seems to have no N-terminal signal sequence

----- Final Results -----
            bacterial cytoplasm --- Certainty = 0.2157(Affirmative) < succ>
             bacterial membrane --- Certainty = 0.0000(Not Clear)   < succ>
              bacterial outside --- Certainty = 0.0000(Not Clear)   < succ>
```

A related DNA sequence was identified in *S. pyogenes* <SEQ ID 4901> which encodes the amino acid sequence <SEQ ID 4902>. Analysis of this protein sequence reveals the following:

```
Possible site: 29
>>> Seems to have no N-terminal signal sequence
    INTEGRAL      Likelihood = -0.00    Transmembrane     347-363 (347-363)

----- Final Results -----
             bacterial membrane --- Certainty = 0.1001(Affirmative) < succ>
              bacterial outside --- Certainty = 0.0000(Not Clear)   < succ>
            bacterial cytoplasm --- Certainty = 0.0000(Not Clear)   < succ>
```

An alignment of the GAS and GBS proteins is shown below.

```
Identities = 392/448 (87%), Positives = 421/448 (93%)

Query:    1 MTITAEDIRREVKEKNVTFLRLMFTDILGVMKNVEIPATDEQLDKVLSNKAMFDGSSIEG    60
            M IT  DIRREVKEKNVTFLRLMFTDI+GVMKNVEIPAT EQLDKVLSNK MFDGSSIEG
Sbjct:    1 MAITVADIRREVKEKNVTFLRLMFTDIMGVMKNVEIPATKEQLDKVLSNKVMFDGSSIEG    60
```

-continued

```
Query:   61 FVRINESDMYLYPDLDTWIVFPWGDENGAVAGLICDIYTAEGEPFAGDPRGNLKRNMKRM  120
            FVRINESDMYLYPDLDTWIVFPWGDENGAVAGLICDIYTAEG+PFAGDPRGNLKR +K M
Sbjct:   61 FVRINESDMYLYPDLDTWIVFPWGDENGAVAGLICDIYTAEGKPFAGDPRGNLKRALKHM  120

Query:  121 QEMGYKSFNLGPEPEFFLFKMDENGNPTLDVNDKGGYFDLAPTDLADNTRREIVNVLTQM  180
              E+GYKSFNLGPEPEFFLFKMD+ GNPTL+VND GGYFDLAP DLADNTRREIVN+LT+M
Sbjct:  121 NEIGYKSFNLGPEPEFFLFKMDDKGNPTLEVNDNGGYFDLAPIDLADNTRREIVNILTKM  180

Query:  181 GFEVEASHHEVAVGQHEIDFKYDDVLKACDNIQLFKLVVKTIARKHGLYATFMAKPKFGI  240
            GFEVEASHHEVAVGQHEIDFKY DVLKACDNIQ+FKLVVKTIAR+HGLYATFMAKPKFGI
Sbjct:  181 GFEVEASHHEVAVGQHEIDFKYADVLKACDNIQIFKLVVKTIAREHGLYATFMAKPKFGI  240

Query:  241 NGSGMHCNMSLFDNEGNNAFFDPEDPRGMQLSEDAYYFLGGLMKHAYNYTAIINPTVNSY  300
               GSGMHCNMSLFDN+GNNAF+D   D RGMQLSEDAYYFLGGLMKHAYNYTAI NPTVNSY
Sbjct:  241 AGSGMHCNMSLFDNQGNNAFYDEADKRGMQLSEDAYYFLGGLMKHAYNYTAITNPTVNSY  300

Query:  301 KRLVPGYEAPVYVAWAGRNRSPLIRVPASRGMGTRLELRSVDPTANPYLALSVLLGSGLE  360
            KRLVPGYEAPVYVAWAG NRSPLIRVPASRGMGTRLELRSVDPTANPYLAL+VLL +GL+
Sbjct:  301 KRLVPGYEAPVYVAWAGSNRSPLIRVPASRGMGTRLELRSVDPTANPYLALAVLLEAGLD  360

Query:  361 GIENKIEAPEPIETNIYAMTVEERRQAGIVDLPSTLHNALEALEEDEVVKAALGTHIYTN  420
            GI NKIEAPEP+E NIY MT+EER +AGI+DLPSTLHNAL+AL++D+VV+ ALG HIYTN
Sbjct:  361 GIINKIEAPEPVEANIYTMTMEERNEAGIIDLPSTLHNALKALQKDDVVQKALGYHIYTN  420

Query:  421 FLDAKRIEWASYATYVSQWEIDNYLDLY                                 448
            FL+AKRIEW+SYAT+VSQWEID+Y+  Y
Sbjct:  421 FLEAKRIEWSSYATFVSQWEIDHYIHNY                                 448
```

Based on this analysis, it was predicted that these proteins and their epitopes could be useful antigens for vaccines or diagnostics.

EXAMPLE 1586

A DNA sequence (GBSx1680) was identified in *S. agalactiae* <SEQ ID 4903> which encodes the amino acid sequence <SEQ ID 4904>. This protein is predicted to be SceB precursor. Analysis of this protein sequence reveals the following:

```
Possible site: 28
>>> Seems to have no N-terminal signal sequence

----- Final Results -----
              bacterial membrane --- Certainty = 0.0000(Not Clear) < succ>
               bacterial outside --- Certainty = 0.0000(Not Clear) < succ>
              bacterial cytoplasm --- Certainty = 0.0000(Not Clear) < succ>
```

The protein has homology with the following sequences in the GENPEPT database.

```
>GP: CAA66624 GB: X97985 ORF1 [Staphylococcus aureus]
Identities = 44/119 (36%), Positives = 66/119 (54%),
Gaps = 4/119 (3%)

Query:   26 SFASTNADANTYNYAVDVDYLASAEEIAQAHPA-SNTFPLGQCTWGVKE-MATWAGNWWG   83
              S AS + +N +           ++  I+  + + SN +  GQCT+ V + +    G+ WG
Sbjct:  117 SGASYSTTSNNVHVTTTAAPSSNGRSISNGYASGSNLYTSGQCTYYVFDRVGGKIGSTWG  176

Query:   84 NGGDWAASAASADYTVGTQPRVGSIVCWTDGSYGHVAYVTAVDPVTNKIQVLESNYAGH  142
            N  +WA +AAS+ YTV   P+VG+I+   T G YGHVAYV  V+     ++V E NY GH
Sbjct:  177 NASNWANAAASSGYTVNNTPKVGAIMQTTQGYYGHVAYVEGVNS-NGSVRVSEMNY-GH  233
```

A related DNA sequence was identified in *S. pyogenes* <SEQ ID 1013> which encodes the amino acid sequence <SEQ ID 1014>. Analysis of this protein sequence reveals the following:

```
Possible site: 17
>>> Seems to have a cleavable N-term signal seq.

----- Final Results -----
bacterial outside   --- Certainty = 0.3000 (Affirmative) < succ>
bacterial membrane  --- Certainty = 0.0000 (Not Clear)  < succ>
bacterial cytoplasm --- Certainty = 0.0000 (Not Clear)  < succ>
```

An alignment of the GAS and GBS proteins is shown below.

```
Identities = 60/115 (52%), Positives = 81/115 (70%), Gaps = 7/115 (6%)

Query:   55 AHPASNTFPLGQCTWGVKEMATWAGNWWGNGGDWAASAASADYTVGTQPRVGSIVCWTDG  114
            ++ +SNT+P+GQCTWG K +A WAGN WGNGG WA SA +A Y  G+ P VG+I  W DG
Sbjct:  291 SYDSSNTYPVGQCTWGAKSLAPWAGNNWGNGGQWAYSAQAAGYRTGSTPMVGAIAVWNDG  350

Query:  115 SYGHVAYVTAVDPVTNKIQVLESNYAGHQWIDNYRGWFDPQNTVTPGVVSYIYPN        169
            YGHVA V  V    ++ I+V+ESNY+G Q+I ++RGWF+P        V++IYP+
Sbjct:  351 GYGHVAVVVEVQSASS-IRVMESNYSGRQYIADHRGWFNPTG------VTFIYPH       398
```

A related GBS gene <SEQ ID 8859> and protein <SEQ ID 8860> were also identified. Analysis of this protein sequence reveals the following:

```
Lipop: Possible site: -1 Crend: 8
McG: Discrim Score: 5.85
GvH: Signal Score (-7.5): 3.11
Possible site: 24
>>> Seems to have a cleavable N-term signal seq.
ALOM program count: 0 value: 6.74 threshold: 0.0
PERIPHERAL Likelihood = 6.74 115
modified ALOM score: -1.85

*** Reasoning Step: 3

----- Final Results -----
bacterial outside   --- Certainty = 0.3000 (Affirmative) < succ>
bacterial membrane  --- Certainty = 0.0000 (Not Clear)  < succ>
bacterial cytoplasm --- Certainty = 0.0000 (Not Clear)  < succ>
```

The protein has homology with the following sequences in the databases:

```
37.5/56.7% over 200aa
Staphylococcus aureus
GP|1340128|ORF1 Insert characterized
ORF00255(376-726 of 1107)
GP|1340128|emb|CAA66624.1||X97985(33-233 of 255) ORF1 {Staphylococcus aureus}
% Match = 9.0
% Identity = 37.5    % Similarity = 56.7
Matches = 45    Mismatches = 47    Conservative Sub.s = 23

294           324           354           384           414
SVIWI**TRSHQMEENMNIKQLKSKTMLGTVALVSAFSFASTNADANTYNYAVDVD----------------------~~~~
                :  :              |  :   :| :| : :|| | :|
        MKKIVTATIATAGLATIAFAGHDAQAAEQNNNGYNSNDAQSYSYTYTIDAQGNYHYTWTGNWNPSQLTQNN~~~~
                  10            20            30            40            50            60            70

462           489           516           546           576           606
------------------YLASAEEIAQAHPA-SNTFPLGQCTWGV-KEMATWAGNWWGNGGDWAASAASADYTVGTQ
                    ::       |:   : :  ||  :    ||||:  |       :   |: |||   :|:|||:  |||
GSGASYSTTSNNVHVTTTAAPSSNGRSISNGYASGSNLYTSGQCTYYVFDRVGGKIGSTWGNASNWANAAASSGYTVNNT
          130           140           150           160           170           180           190

636           666           696           726           756           786           816           846
PRVGSIVCWTDGSYGHVAYVTAVDPVTNKIQVLESNYAGHQWIDNYRGWFDPQNTVTPGVVSYIYPN*SIKNSSHRRYKS
|:||:|:  |   | |||||||||  |:     ::| | ||| ||                      :   :
PKVGAIMQTTQGYYGHVAYVEGVNS-NGSVRVSEMNY-GHGAGVVTSRTISANQAGSYNFIH
          210           220           230           240           250
```

SEQ ID 8860 (GBS30) was expressed in *E. coli* as a His-fusion product. SDS-PAGE analysis of total cell extract is shown in FIG. 8 (lane 2; MW 19.2 kDa). It was also expressed in *E. coli* as a GST-fusion product. SDS-PAGE analysis of total cell extract is shown in FIG. 16 (lane 2; MW 44.2 kDa).

GBS30-GST was purified as shown in FIG. 193, lane 8.

Based on this analysis, it was predicted that these proteins and their epitopes could be useful antigens for vaccines or diagnostics.

EXAMPLE 1587

A DNA sequence (GBSx1681) was identified in *S. agalactiae* <SEQ ID 4905> which encodes the amino acid sequence <SEQ ID 4906>. Analysis of this protein sequence reveals the following:

```
Possible site: 14
>>> Seems to have an uncleavable N-term signal seq
INTEGRAL Likelihood = -3.93 Transmembrane 2-18 (1-18)

----- Final Results -----
bacterial membrane  --- Certainty = 0.2572 (Affirmative) < succ>
bacterial outside   --- Certainty = 0.0000 (Not Clear)  < succ>
bacterial cytoplasm --- Certainty = 0.0000 (Not Clear)  < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1588

A DNA sequence (GBSx1682) was identified in *S. agalactiae* <SEQ ID 4907> which encodes the amino acid sequence <SEQ ID 4908>. Analysis of this protein sequence reveals the following:

```
Possible site: 28
>>> Seems to have no N-terminal signal sequence

----- Final Results -----
bacterial cytoplasm --- Certainty = 0.2160 (Affirmative) < succ>
bacterial membrane  --- Certainty = 0.0000 (Not Clear)  < succ>
bacterial outside   --- Certainty = 0.0000 (Not Clear)  < succ>
```

The protein has homology with the following sequences in the GENPEPT database.

```
>GP: BAB06381 GB: AP001516 unknown conserved protein [Bacillus halodurans]
Identities = 353/550 (64%), Positives = 443/550 (80%)

Query:   6 LKPEEVGVYAIGGLGEIGKNTYGIEYQDEIIIVDAGIKFPEDDLLGIDYVIPDYSYIVEN   65
           LK  + VYA+GGLGEIGKNTY +++QDEII++DAGIKFPED+LLGIDYVIPDYSY+V+N
Sbjct:   4 LKNNQTAVYALGGLGEIGKNTYAVQFQDEIILIDAGIKFPEDELLGIDYVIPDYSYLVKN   63

Query:  66 IDRIKALVITHGHEDHIGGIPFLLKQANLPIYAGPLALALIKGKLEEHGLLRDATLYEIH  125
           ++IK L ITHGHEDHIGGIP+LL++ N+PIY G LAL L++GKLEEHGLLR A L++I
Sbjct:  64 ENKIKGLFITHGHEDHIGGIPYLLREVNIPIYGGKLALGLLRGKLEEHGLLRKAKLHDIQ  123

Query: 126 ANTELTFKNLSVTFFRTTHSIPEPLGIVIHTPQGKVICTGDFKFDFTPVGEPADLHRMAA  185
           +  + F   SV+FFRTTHSIP+  GIV+ TP G ++ TGDFKFDFTPVGEPA+L +MA
Sbjct: 124 EDDIIKFAKTSVSFFRTTHSIPDSYGIVVKTPPGNIVHTGDFKFDFTPVGEPANLTKMAK  183

Query: 186 LGEDGVLCLLSDSTNAEVPTFTNSEKIVGQSIMKIIEGIEGRIIFASFASNIFRLQQAAE  245
           +GE+GVLCLLSDSTN+E+P  FT SE+ VG+SI  I   +EGRIIFA+FASNI RLQQA E
Sbjct: 184 IGEEGVLCLLSDSTNSEIPEFTMSERKVGESIDHIFRRVEGRIIFATFASNIHRLQQAVE  243

Query: 246 AAVKTGRKIAVFGRSMEKAIVNGIELGYIKVPKGTFIEPSELKNLHASEVLIMCTGSQGE  305
           +AV+ GRK+AVFGRSME AI   G ELGYIK PK TFIEP++L  L  +EV+I+CTGSQGE
Sbjct: 244 SAVRYGRKVAVFGRSMESAINIGQELGYIKAPKNTFIEPNQLNKLPDNEVMILCTGSQGE  303

Query: 306 SMAALARIANGTHRQVTLQPGDTVIFSSSPIPGNTTSVNKLINTIQEAGVDVIHGKINNI  365
            MAAL+R+A GTHRQ+ + PGDTVIFSSSPIPGNT SV+K IN + +AG +VIHG +N+I
Sbjct: 304 PMAALSRVAFGTHRQIQIIPGDTVIFSSSPIPGNTLSVSKTINQLYKAGANVIHGSLNDI  363
```

-continued
```
Query:  366 HTSGHGGQQEQKLMLRLIKPKYFMPVHGEYRMQKVHAGLAVDTGIPKENIFIMENGDVLA  425
            HTSGHGGQ+EQKLMLRLIKPKYFMP+HGEYRM K+H  LA D G+P EN FIM+NGDVLA
Sbjct:  364 HTSGHGGQEEQKLMLRLIKPKYFMPIHGEYRMLKMHTKLAEDCGVPAENCFIMDNGDVLA  423

Query:  426 LTSDSARIAGHFNAQDIYVDGNGIGDIGAAVLRDRHDLSEDGVVLAVATVDFDSKMILAG  485
            L  D A IAG  +  +YVDGNGIGDIG  VLRDR  LSE+G+V+ V +++      + AG
Sbjct:  424 LHPDEAGIAGKIPSGSVYVDGNGIGDIGNIVLRDRRILSEEGLVVVVVSLNMKEYKVTAG  483

Query:  486 PDILSRGFIYMRESGDLIRESQHILFNAIRIALKNKDASIQSVNGAIVNALRPFLYEKTE  545
            PD++SRGF+YMRESGDLI+E+Q +L N ++  ++ K      +   I +  L PFLY++T+
Sbjct:  484 PDLISRGFVYMRESGDLIQEAQRLLANHLQEVMERKTNQWSEIKNEITDVLGPFLYDRTK  543

Query:  546 REPIIIPMVL                                                  555
            R+P+I+P+++
Sbjct:  544 RKPMILPIIM                                                  553
```

A related DNA sequence was identified in *S. pyogenes*[15] <SEQ ID 4909> which encodes the amino acid sequence <SEQ ID 4910>. Analysis of this protein sequence reveals the following:

```
Possible site: 28
>>> Seems to have no N-terminal signal sequence
INTEGRAL   Likelihood = -0.11  Transmembrane   468-484 (468-484)

----- Final Results -----
bacterial membrane --- Certainty = 0.1044 (Affirmative) < succ>
bacterial outside  --- Certainty = 0.0000 (Not Clear)  < succ>
bacterial cytoplasm --- Certainty = 0.0000 (Not Clear)  < succ>
```

The protein has homology with the following sequences in the databases:

```
>GP: BAB06381 GB: AP001516 unknown conserved protein [Bacillus halodurans]
Identities = 353/550 (64%), Positives = 444/550 (80%)

Query:    6 LKPNEVGVFAIGGLGEIGKNTYGIEYQDEIIIVDAGIKFPEDDLLGIDYVIPDYSYIVDN   65
            LK N+   V+A+GGLGEIGKNTY +++QDEII++DAGIKFPED+LLGIDYVIPDYSY+V N
Sbjct:    4 LKNNQTAVYALGGLGEIGKNTYAVQFQDEIILIDAGIKFPEDELLGIDYVIPDYSYLVKN   63

Query:   66 LDRVKALVITHGHEDHIGGIPFLLKQANIPIYAGPLALALIRGKLEEHGLWREATVYEIN  125
            +++K L ITHGHEDHIGGIP+LL++ NIPIY G LAL L+RGKLEEHGL R+A +++I
Sbjct:   64 ENKIKGLFITHGHEDHIGGIPYLLREVNIPIYGGKLALGLLRGKLEEHGLLRKAKLHDIQ  123

Query:  126 HNTELTFKNMSVTFFKTTHSIPEPVGIVIHTPQGKIICTGDFKFDFTPVGDPADLQRMAA  185
              +  + F   SV+FF++TTHSIP+   GIV+ TP G I+ TGDFKFDFTPVG+PA+L +MA
Sbjct:  124 EDDIIKFAKTSVSFFRTTHSIPDSYGIVVKTPPGNIVHTGDFKFDFTPVGEPANLTKMAK  183

Query:  186 LGEEGVLCLLSDSTNAEIPTFTNSEKVVGQSILKIIEGIHGRIIFASFASNIYRLQQAAE  245
            +GEEGVLCLLSDSTN+EIP FT SE+ VG+SI  I  + GRIIFA+FASNI+RLQQA E
Sbjct:  184 IGEEGVLCLLSDSTNSEIPEFTMSERKVGESIDHIFRRVEGRIIFATFASNIHRLQQAVE  243

Query:  246 AAVKTGRKIAVFGRSMEKAIVNGIELGYIKVPKGTFIEPSELKNLHASEVLIMCTGSQGE  305
            +AV+ GRK+AVFGRSME AI  G ELGYIK PK TFIEP++L  L   +EV+I+CTGSQGE
Sbjct:  244 SAVRYGRKVAVFGRSMESAINIGQELGYIKAPKNTFIEPNQLNKLPDNEVMILCTGSQGE  303

Query:  306 SMAALARIANGTHRQVTLQPGDTVIFSSSPIPGNTTSVNKLINTIQEAGVDVIHGKVNNI  365
              MAAL+R+A GTHRQ+ +  PGDTVIFSSSPIPGNT SV+K IN + +AG +VIHG +N+I
Sbjct:  304 PMAALSRVAFGTHRQIQIIPGDTVIFSSSPIPGNTLSVSKTINQLYKAGANVIHGSLNDI  363

Query:  366 HTSGHGGQQEQKLMLSLIKPKYFMPVHGEYRMQKVHAGLAMDIGIPKENIFIMENGDVLA  425
            HTSGHGGQ+EQKLML LIKPKYFMP+HGEYRM K+H  LA D G+P EN FIM+NGDVLA
Sbjct:  364 HTSGHGGQEEQKLMLRLIKPKYFMPIHGEYRMLKMHTKLAEDCGVPAENCFIMDNGDVLA  423

Query:  426 LTSDSARIAGHFNAQDIYVDGNGIGDIGAAVLRDRRDLSEDGVVLAVATVDFNTQMILAG  485
            L  D A IAG  +  +YVDGNGIGDIG  VLRDRR LSE+G+V+ V +++      + AG
Sbjct:  424 LHPDEAGIAGKIPSGSVYVDGNGIGDIGNIVLRDRRILSEEGLVVVVVSLNMKEYKVTAG  483

Query:  486 PDILSRGFIYMRESGDLIRESQRVLFNAIRIALKNKDASIQSVNGAIVNALRPFLYEKTE  545
            PD++SRGF+YMRESGDLI+E+QR+L N ++  ++ K      +   I +  L PFLY++T+
Sbjct:  484 PDLISRGFVYMRESGDLIQEAQRLLANHLQEVMERKTNQWSEIKNEITDVLGPFLYDRTK  543

Query:  546 REPIIIPMVL                                                  555
            R+P+I+P+++
Sbjct:  544 RKPMILPIIM                                                  553
```

An alignment of the GAS and GBS proteins is shown below.

```
Identities = 523/559 (93%), Positives = 550/559 (97%)

Query:    1 MSNINLKPEEVGVYAIGGLGEIGKNTYGIEYQDEIIIVDAGIKFPEDDLLGIDYVIPDYS   60
            M+NI+LKP EVGV+AIGGLGEIGKNTYGIEYQDEIIIVDAGIKFPEDDLLGIDYVIPDYS
Sbjct:    1 MTNISLKPNEVGVFAIGGLGEIGKNTYGIEYQDEIIIVDAGIKFPEDDLLGIDYVIPDYS   60

Query:   61 YIVENIDRIKALVITHGHEDHIGGIPFLLKQANLPIYAGPLALALIKGKLEEHGLLRDAT  120
            YIV+N+DR+KALVITHGHEDHIGGIPFLLKQAN+PIYAGPLALALI+GKLEEHGL R+AT
Sbjct:   61 YIVDNLDRVKALVITHGHEDHIGGIPFLLKQANIPIYAGPLALALIRGKLEEHGLWREAT  120

Query:  121 LYEIHANTELTFKNLSVTFFRTTHSIPEPLGIVIHTPQGKVICTGDFKFDFTPVGEPADL  180
            +YEI+ NTELTFKN+SVTFF+TTHSIPEP+GIVIHTFQGK+ICTGDFKFDFTPVG+PADL
Sbjct:  121 VYEINHNTELTFKNMSVTFFKTTHSIPEPVGIVIHTPQGKIICTGDFKFDFTPVGDPADL  180

Query:  181 HRMAALGEDGVLCLLSDSTNAEVPTFTNSEKIVGQSIMKIIEGIEGRIIFASFASNIFRL  240
               RMAALGE+GVLCLLSDSTNAE+PTFTNSEK+VGQSI+KIIEGI GRIIFASFASNI+RL
Sbjct:  181 QRMAALGEEGVLCLLSDSTNAEIPTFTNSEKVVGQSILKIIEGIHGRIIFASFASNIYRL  240

Query:  241 QQAAEAAVKTGRKIAVFGRSMEKAIVNGIELGYIKVPKGTFIEPSELKNLHASEVLIMCT  300
            QQAAEAAVKTGRKIAVFGRSMEKAIVNGIELGYIKVPKGTFIEPSELKNLHASEVLIMCT
Sbjct:  241 QQAAEAAVKTGRKIAVFGRSMEKAIVNGIELGYIKVPKGTFIEPSELKNLHASEVLIMCT  300

Query:  301 GSQGESMAALARIANGTHRQVTLQPGDTVIFSSSPIPGNTTSVNKLINTIQEAGVDVIHG  360
            GSQGESMAALARIANGTHRQVTLQPGDTVIFSSSPIPGNTTSVNKLINTIQEAGVDVIHG
Sbjct:  301 GSQGESMAALARIANGTHRQVTLQPGDTVIFSSSPIPGNTTSVNKLINTIQEAGVDVIHG  360

Query:  361 KINNIHTSGHGGQQEQKLMLRLIKPKYFMPVHGEYRMQKVHAGLAVDTGIPKENIFIMEN  420
            K+NNIHTSGHGGQQEQKLML LIKPKYFMPVHGEYRMQKVHAGLA+D GIPKENIFIMEN
Sbjct:  361 KVNNIHTSGHGGQQEQKLMLSLIKPKYFMPVHGEYRMQKVHAGLAMDIGIPKENIFIMEN  420

Query:  421 GDVLALTSDSARIAGHFNAQDIYVDGNGIGDIGAAVLRDRHDLSEDGVVLAVATVDFDSK  480
            GDVLALTSDSARIAGHFNAQDIYVDGNGIGDIGAAVLRDR DLSEDGVVLAVATVDF+++
Sbjct:  421 GDVLALTSDSARIAGHFNAQDIYVDGNGIGDIGAAVLRDRRDLSEDGVVLAVATVDFNTQ  480

Query:  481 MILAGPDILSRGFIYMRESGDLIRESQHILFNAIRIALKNKDASIQSVNGAIVNALRPFL  540
            MILAGPDILSRGFIYMRESGDLIRESQ +LFNAIRIALKNKDASIQSVNGAIVNALRPFL
Sbjct:  481 MILAGPDILSRGFIYMRESGDLIRESQRVLFNAIRIALKNKDASIQSVNGAIVNALRPFL  540

Query:  541 YEKTEREPIIIPMVLTPDK                                          559
            YEKTEREPIIIPMVLTPDK
Sbjct:  541 YEKTEREPIIIPMVLTPDK                                          559
```

Based on this analysis, it was predicted that these proteins and their epitopes could be useful antigens for vaccines or diagnostics.

EXAMPLE 1589

A DNA sequence (GBSx1683) was identified in *S. agalactiae* <SEQ ID 4911> which encodes the amino acid sequence <SEQ ID 4912>. Analysis of this protein sequence reveals the following:

```
Possible site: 32
>>> Seems to have no N-terminal signal sequence

----- Final Results -----
          bacterial cytoplasm --- Certainty = 0.2932(Affirmative) < succ>
           bacterial membrane --- Certainty = 0.0000(Not Clear) < succ>
            bacterial outside --- Certainty = 0.0000(Not Clear) < succ>
```

The protein has homology with the following sequences in the GENPEPT database.

```
>GP: CAB13327 GB: Z99111 ykzG [Bacillus subtilis]
Identities = 27/75 (36%), Positives = 44/75 (58%), Gaps = 7/75 (9%)

Query:    1 MIYKVFYQETKERNPRREQTKTLYVTIDAANELEGRIAARKLVEENTAYNIEFIELLSDK   60
            MIYKVFYQE   + P RE+T +LY+  +  ++  ++  +K      +NIEFI +
Sbjct:    1 MIYKVFYQEKADEVPVREKTDSLYIEGVSERDVRTKLKEKK-------FNIEFITPVDGA   53
```

```
Query:  61 HLEYEKETGVFELTE                                               75
           LEYE+++  F++ E
Sbjct:  54 FLEYEQQSENFKVLE                                               68
```

A related DNA sequence was identified in *S. pyogenes* <SEQ ID 4913> which encodes the amino acid sequence <SEQ ID 4914>. Analysis of this protein sequence reveals the following:

```
Possible site: 32
>>> Seems to have no N-terminal signal sequence

----- Final Results -----
           bacterial cytoplasm --- Certainty = 0.3428(Affirmative) < succ>
            bacterial membrane --- Certainty = 0.0000(Not Clear)   < succ>
             bacterial outside --- Certainty = 0.0000(Not Clear)   < succ>
```

An alignment of the GAS and GBS proteins is shown below.

```
Identities = 60/76 (78%), Positives = 70/76 (91%)

Query:   1 MIYKVFYQETKERNPRREQTKTLYVTIDAANELEGRIAARKLVEENTAYNIEFIELLSDK   60
           MIYKVFYQETK+++PRRE TK LY+ IDA +EL+GRI AR+LVE+NT YN+EFIELLSDK
Sbjct:   1 MIYKVFYQETKDQSPRRESTKALYLNIDATDELDGRIKARRLVEDNTYYNVEFIELLSDK   60

Query:  61 HLEYEKETGVFELTEF                                              76
           HL+YEKETGVFELTEF
Sbjct:  61 HLDYEKETGVFELTEF                                              76
```

Based on this analysis, it was predicted that these proteins and their epitopes could be useful antigens for vaccines or diagnostics.

EXAMPLE 1590

A DNA sequence (GBSx1684) was identified in *S. agalactiae* <SEQ ID 4915> which encodes the amino acid sequence <SEQ ID 4916>. This protein is predicted to be glycoprotein endopeptidase. Analysis of this protein sequence reveals the following:

```
Possible site: 13
>>> Seems to have no N-terminal signal sequence (or aa 1-17)

----- Final Results -----
           bacterial cytoplasm --- Certainty = 0.0430(Affirmative) < succ>
            bacterial membrane --- Certainty = 0.0000(Not Clear)   < succ>
             bacterial outside --- Certainty = 0.0000(Not Clear)   < succ>
```

The protein has homology with the following sequences in the GENPEPT database.

```
>GP: CAA76861 GB: Y17797 hypothetical protein [Enterococcus faecalis]

Identities = 94/182 (51%), Positives = 127/182 (69%), Gaps = 6/182 (3%)

Query:   2 MKVLAFDTSSKALSVAVLNNMECLATVTINIKKNHSINLMPAIDFLMQSIDLEPQDLDRI   61
           +++LA DTS++ LS+AV  N + T   +K+NHS+ LMPAID+LM  ++L P  +DR
Sbjct:  13 VRILAIDTSNQTLSIAVCENQKILGSYTATVKRNHSLTLMPAIDYLMSQLNLAPTAIDRF   72

Query:  62 VVAEGPGSYTGLRVAVATAKMLAYTLKIDLVGVSSLYAL-TNGFSENDLLVPLIDARRNN  120
           VVAEGPGSYTGLR+ V TAK LAYTLK +LVG+SSL AL  N  +  L+VPL DARR N
Sbjct:  73 VVAEGPGSYTGLRLGVTTAKTLAYTLKKELVGISSLQALAANCVGQTGLIVPLFDARRKN  132
```

```
                            -continued
Query:  121 VYVGFYQNGDTV----KPDCHTSLEEVLQEVGNKANVHFVGE-VAAFFDQIKKALPHAKI  175
            VY G Y+  D V       PD H SL E+L+++ N+ N+ FVGE V  F ++I + +PH +I
Sbjct:  133 VYAGAYRFVDGVWQNELPDQHISLRELLEQLKNEPNLFFVGEDVEKFTEEIAQIIPHGEI  192

Query:  176 TE                                                             177
            +
Sbjct:  193 CD                                                             194
```

A related DNA sequence was identified in *S. pyogenes* <SEQ ID 4917> which encodes the amino acid sequence <SEQ ID 4918>. Analysis of this protein sequence reveals the following:

```
Possible site: 36
>>> Seems to have no N-terminal signal sequence
    INTEGRAL    Likelihood = -1.38    Transmembrane    99-115 (99-115)

----- Final Results -----
             bacterial membrane --- Certainty = 0.1553(Affirmative) < succ>
             bacterial outside  --- Certainty = 0.0000(Not Clear)   < succ>
             bacterial cytoplasm --- Certainty = 0.0000(Not Clear)   < succ>
```

A related sequence was also identified in GAS <SEQ ID 9159> which encodes the amino acid sequence <SEQ ID 9160>. Analysis of this protein sequence reveals the following:

```
Possible site: 25
>>> Seems to have no N-terminal signal sequence
    INTEGRAL    Likelihood = -1.38    Transmembrane    88-104 (88-104)

----- Final Results -----
             bacterial membrane --- Certainty = 0.1553(Affirmative) < succ>
             bacterial outside  --- Certainty = 0.0000(Not Clear)   < succ>
             bacterial cytoplasm --- Certainty = 0.0000(Not Clear)   < succ>
```

An alignment of the GAS and GBS proteins is shown below.

```
Identities = 134/232 (57%), Positives = 172/232 (73%), Gaps = 3/232 (1%)

Query:    2 MKVLAFDTSSKALSVAVLNNMECLATVTINIKKNHSINLMPAIDFLMQSIDLEPQDLDRI   61
            MK LAFDTS+K LS+A+L++   LA +T+NI+K HS++LMPAIDFLM   DL+PQDL+RI
Sbjct:   12 MKTLAFDTSNKTLSLAILDDETLLADMTLNIQKKHSVSLMPAIDFLMTCTDLKPQDLERI   71

Query:   62 VVAEGPGSYTGLRVAVATAKMLAYTLKIDLVGVSSLYALTNGFSE---NDLLVPLIDARR  118
            VVA+GPGSYTGLRVAVATAK LAY+L I LVG+SSLYAL       +   N L+VPLIDARR
Sbjct:   72 VVAKGPGSYTGLRVAVATAKTLAYSLNIALVGISSLYALAASTCKQYPNTLVVPLIDARR  131

Query:  119 NNVYVGFYQNGDTVKPDCHTSLEEVLQEVGNKANVHFVGEVAAFFDQIKKALPHAKITET  178
             N YVG+Y+ G +V P  H SLE +++++ +  + FVGE A F ++I+K LP A +  T
Sbjct:  132 QNAYVGYYRQGKSVMPQAHASLEVIIEQLVEEGQLIFVGETAPFAEKIQKKLPQAILLPT  191

Query:  179 LPCAVAIGRKGQKMKSVNVDAFVPRYLKRVEAEENWLKNHCETNTEEYIKRV          230
            LP A   G GQ +   NVDAFVP+YLKRVEAEENWLK++   +   Y+KR+
Sbjct:  192 LPSAYECGLLGQSLAPENVDAFVPQYLKRVEAEENWLKDNEIKDDSHYVKRI          243
```

SEQ ID 4916 (GBS69) was expressed in *E. coli* as a His-fusion product. SDS-PAGE analysis of total cell extract is shown in FIG. 17 (lane 9; MW 28.9 kDa). It was also expressed in *E. coli* as a GST-fusion product. SDS-PAGE analysis of total cell extract is shown in FIG. 20 (lane 4; MW 53.9 kDa).

Figure 285:
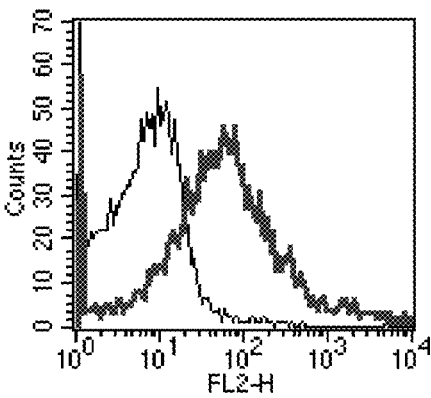

The GBS69-GST fusion product was purified (FIG. 197, lane 6) and used to immunise mice. The resulting antiserum was used for FACS (FIG. 285), which confirmed that the protein is immunoaccessible on GBS bacteria.

Based on this analysis, it was predicted that these proteins and their epitopes could be useful antigens for vaccines or diagnostics.

EXAMPLE 1591

A DNA sequence (GBSx1685) was identified in *S. agalactiae* <SEQ ID 4919> which encodes the amino acid sequence <SEQ ID 4920>. This protein is predicted to be ribosomal-protein-alanine acetyltransferase. Analysis of this protein sequence reveals the following:

```
Possible site: 22
>>> Seems to have a cleavable N-term signal seq.

----- Final Results -----
            bacterial outside  --- Certainty = 0.3000(Affirmative) < succ>
            bacterial membrane --- Certainty = 0.0000(Not Clear)   < succ>
            bacterial cytoplasm --- Certainty = 0.0000(Not Clear)  < succ>
```

A related GBS nucleic acid sequence <SEQ ID 10137> which encodes amino acid sequence <SEQ ID 10138> was also identified.

The protein has homology with the following sequences in the GENPEPT database.

```
>GP: AAC06803 GB: AE000696 ribosomal-protein-alanine cetyltransferase
[Aquifex aeolicus]
Identities = 44/141 (31%), Positives = 74/141 (52%), Gaps = 8/141 (5%)

Query:   9 LREFEMESSEQALAIWSVLSDVYDKSPWSLSQISEDLKKDSTDYFFVYNDGEVIGFLALQ   68
           +RE E  E  E+    ++ +  + +    WS    +D +    + F +  DG+V+G++
Sbjct:   4 VREMEREDVER---VYEINRESFTTDAWSRFSFEKDFENKFSRRFVLEEDGKVVGYVIFW   60

Query:  69 QLVGEVEITNIAVKKNYQGKGYAYQLM----SMIADIEVPVFLEVRYSNIVAQKLYERCG  124
           +   E  I   A+   Y+GKGY  +L+      S + D    V L+VR SN+ A  LY++ G
Sbjct:  61 VVKEEATIMTFAIAPGYRGKGYGEKLLREAISRLGDKVKRVVLDVRKSNLRAINLYKKLG  120

Query: 125 FVVLRKRKNYYHDPIEDAIVM                                         145
           F V+ +RK YY D  E+A++M
Sbjct: 121 FKVVTERKGYYSDG-ENALLM                                         140
```

A related DNA sequence was identified in *S. pyogenes* <SEQ ID 4921> which encodes the amino acid sequence <SEQ ID 4922>. Analysis of this protein sequence reveals the following:

```
Possible site: 35
>>> Seems to have no N-terminal signal sequence

----- Final Results -----
            bacterial cytoplasm --- Certainty = 0.3800(Affirmative) < succ>
            bacterial membrane  --- Certainty = 0.0000(Not Clear)   < succ>
            bacterial outside   --- Certainty = 0.0000(Not Clear)   < succ>
```

An alignment of the GAS and GBS proteins is shown below.

```
Identities = 65/140 (46%), Positives = 96/140 (68%), Gaps = 1/140 (0%)

Query:   9 LREFEMES-SEQALAIWSVLSDVYDKSPWSLSQISEDLKKDSTDYFFVYNDGEVIGFLAL   67
           L E M++   EQA  I+ +L  VY   SPW+L Q+   D+++D TDYF +Y+   +++GFLA+
Sbjct:   6 LSESNMKTVEEQAKNIYQLLEMVYGTSPWTLEQVLIDIRRDQTDYFLLYDHDKLLGFLAI   65

Query:  68 QQLVGEVEITNIAVKKNYQGKGYAYQLMSMIADIEVPVFLEVRYSNIVAQKLYERCGFVV  127
           Q L GEVE+T IA+    ++Q  G A QLM+ +    IE   +FLEVR SN   AQ LY++ GF
Sbjct:  66 QDLAGEVEMTQIAILPSHQELGLASQLMTHLDSIESDIFLEVRESNHRAQGLYQKFGFKF  125

Query: 128 LRKRKNYYHDPIEDAIVMRK                                          147
           +  KR +YY +PIE A++M++
Sbjct: 126 IGKRPDYYRNPIETALLMKR                                          145
```

Based on this analysis, it was predicted that these proteins and their epitopes could be useful antigens for vaccines or diagnostics.

EXAMPLE 1592

A DNA sequence (GBSx1686) was identified in *S. agalactiae* <SEQ ID 4923> which encodes the amino acid sequence <SEQ ID 4924>. Analysis of this protein sequence reveals the following:

```
Possible site: 21
>>> Seems to have no N-terminal signal sequence

----- Final Results -----
            bacterial cytoplasm --- Certainty = 0.0334(Affirmative) < succ>
             bacterial membrane --- Certainty = 0.0000(Not Clear)   < succ>
              bacterial outside --- Certainty = 0.0000(Not Clear)   < succ>
```

The protein has no significant homology with any sequences in the GENPEPT database.

No corresponding DNA sequence was identified in S. pyogenes.

Based on this analysis, it was predicted that this protein and its epitopes, could be useful antigens for vaccines or diagnostics.

EXAMPLE 1593

A DNA sequence (GBSx1687) was identified in S. agalactiae <SEQ ID 4925> which encodes the amino acid sequence <SEQ ID 4926>. Analysis of this protein sequence reveals the following:

```
Possible site: 38
>>> Seems to have no N-terminal signal sequence
    INTEGRAL      Likelihood = -1.75    Transmembrane    86-102 (86-104)

----- Final Results -----
             bacterial membrane --- Certainty = 0.1702(Affirmative) < succ>
              bacterial outside --- Certainty = 0.0000(Not Clear)   < succ>
           bacterial cytoplasm --- Certainty= 0.0000(Not Clear)    < succ>
```

The protein has homology with the following sequences in the GENPEPT database.

```
>GP: BAB04267 GB: AP001508 glycoprotein endopeptidase
[Bacillus halodurans]
Identities = 194/331 (58%), Positives = 263/331 (78%), Gaps = 1/331 (0%)

Query:   6 ILAVESSCDETSVAILKNDKELLANIIASQVESHKRFGGVVPEVASRHHVEVVTTCFEDA    65
           ILA+E+SCDETS A+++N   +L+N+++SQ++SHKRFGGVVPE+ASRHHVE +T   E+A
Sbjct:  12 ILAIETSCDETSAAVIENGTTILSNVVSSQIDSHKRFGGVVPEIASRHHVEQITVIVEEA    71

Query:  66 LQEAGIVASDLDAVAVTYGPGLVGALLVGMAAAKAFAWANKLPLIPINHMAGHLMAARDV   125
           + EAG+  +DL AVAVT GPGLVGALL+G+ AAKA A+A++LPLI ++H+AGH+ A R +
Sbjct:  72 MHEAGVDFADLAAVAVTEGPGLVGALLIGVNAAKAIAFAHQLPLIGVHHIAGHIYANRLL   131

Query: 126 KELQYPLLALLVSGGHTELVYVSEPGDYKIVGETRDDAVGEAYDKVGRVMGLTYPAGREI   185
           KEL++PLLAL+VSGGHTEL+Y+    G+++++GETRDDAVGEAYDKV R +GL YP G  I
Sbjct: 132 KELEFPLLALVVSGGHTELIYMENHGEFEVIGETRDDAVGEAYDKVARTLGLPYPGGPHI   191

Query: 186 DQLAHKGQDTYHFPRAMIKEDHLEFSFSGLKSAFINLHHNAEQKGEALVLEDLCASFQAA   245
           D+LA  G+DT  FPRA ++ D +FSFSGLKSA IN  HNA+Q+GE +  ED+ ASFQA+
Sbjct: 192 DRLAVNGEDTLQFPRAWLEPDSFDFSFSGLKSAVINTLHNAKQRGENVQAEDVAASFQAS   251

Query: 246 VLDILLAKTQKALLKYPVKTLVVAGGVAANQGLRERLATDISPD-IDVVIPPLRLCGDNA   304
           V+D+L+  KT+KA  +Y V+ +++AGGVAAN+GLR  L     + ID+VIPPL LC DNA
Sbjct: 252 VIDVLVTKTKKAAEEYKVRQVLLAGGVAANKGLRTALEEAFFKEPIDLVIPPLSLCTDNA   311

Query: 305 GMIALAAAIEFEKENFASLKLNAKPSLAFES                              335
           MI   AA+I+F+++  FA + LN +PSL   E+
Sbjct: 312 AMIGAAASIKFKQQTFAGMDLNGQPSLELEN                              342
```

A related DNA sequence was identified in S. pyogenes <SEQ ID 4927> which encodes the amino acid sequence <SEQ ID 4928>. Analysis of this protein sequence reveals the following:

```
Possible site: 38
>>> Seems to have no N-terminal signal sequence
    INTEGRAL      Likelihood = -2.76    Transmembrane      86-102 (85-104)

----- Final Results -----
               bacterial membrane --- Certainty = 0.2105(Affirmative) < succ>
                bacterial outside --- Certainty = 0.0000(Not Clear)   < succ>
              bacterial cytoplasm --- Certainty = 0.0000(Not Clear)   < succ>
```

The protein has homology with the following sequences in the databases:

```
22 GP: BAB04267 GB: AP001508 glycoprotein endopeptidase
[Bacillus halodurans]
Identities = 196/330 (59%), Positives = 255/330 (76%), Gaps = 2/330 (0%)

Query:    6 ILAVESSCDETSVAILKNESTLLSNVIASQVESHKRFGGVVPEVASRHHVEVITTCFEDA   65
            ILA+E+SCDETS A+++N +T+LSNV++SQ++SHKRFGGVVPE+ASRHHVE IT   E+A
Sbjct:   12 ILAIETSCDETSAAVIENGTTILSNVVSSQIDSHKRFGGVVPEIASRHHVEQITVIVEEA   71

Query:   66 LQEAGISASDLSAVAVTYGPGLVGALLVGLAAAKAFAWANHLPLIPVNHMAGHLMAAREQ  125
            + EAG+  +DL+AVAVT GPGLVGALL+G+ AAKA A+A+ LPLI V+H+AGH+ A R
Sbjct:   72 MHEAGVDFADLAAVAVTEGPGLVGALLIGVNAAKAIAFAHQLPLIGVHHIAGHIYANRLL  131

Query:  126 KPLVYPLIALLVSGGHTELVYVPEPGDYHIIGETRDDAVGEAYDKVGRVMGLTYPAGREI  185
            K L +PL+AL+VSGGHTEL+Y+    G++ +IGETRDDAVGEAYDKV R +GL YP G  I
Sbjct:  132 KELEFPLLALVVSGGHTELIYMENHGEFEVIGETRDDAVGEAYDKVARTLGLPYPGGPHI  191

Query:  186 DQLAHKGQDTYHFPRAMITEDHLEFSFSGLKSAFINLHHNAKQKGDELILEDLCASFQAA  245
            D+LA  G+DT  FPRA +  D  +FSFSGLKSA IN  HNAKQ+G+  +  ED+ ASFQA+
Sbjct:  192 DRLAVNGEDTLQFPRAWLEPDSFDFSFSGLKSAVINTLHNAKQRGENVQAEDVAASFQAS  251

Query:  246 VLDILLAKTKKALSRYPAKMLVVAGGVAANQGLRDRLAQEI--THIEVVIPKLRLCGDNA  303
            V+D+L+ KTKKA   Y  + +++AGGVAAN+GLR  L +     I++VIP L LC DNA
Sbjct:  252 VIDVLVTKTKKAAEEYKVRQVLLAGGVAANKGLRTALEEAFFKEPIDLVIPPLSLCTDNA  311

Query:  304 GMIALAAAIEYDKQHFANMSLNAKPSLAFD                               333
            MI   AA+I++ +Q FA M LN +PSL  +
Sbjct:  312 AMIGAAASIKFKQQTFAGMDLNGQPSLELE                               341
```

An alignment of the GAS and GBS proteins is shown below.

```
Identities = 288/334 (86%), Positives = 313/334 (93%), Gaps = 1/334 (0%)

Query:    1 MKDRYILAVESSCDETSVAILKNDKELLANIIASQVESHKRFGGVVPEVASRHHVEVVTT   60
            M DRYILAVESSCDETSVAILKN+  LL+N+IASQVESHKRFGGVVPEVASRHHVEV+TT
Sbjct:    1 MTDRYILAVESSCDETSVAILKNESTLLSNVIASQVESHKRFGGVVPEVASRHHVEVITT   60

Query:   61 CFEDALQEAGIVASDLDAVAVTYGPGLVGALLVGMAAAKAFAWANKLPLIPINHMAGHLM  120
            CFEDALQEAGI ASDL AVAVTYGPGLVGALLVG+AAAKAFAWAN LPLIP+NHMAGHLM
Sbjct:   61 CFEDALQEAGISASDLSAVAVTYGPGLVGALLVGLAAAKAFAWANHLPLIPVNHMAGHLM  120

Query:  121 AARDVKELQYPLLALLVSGGHTELVYVSEPGDYKIVGETRDDAVGEAYDKVGRVMGLTYP  180
            AAR+ K L YPL+ALLVSGGHTELVYV EPGDY I+GETRDDAVGEAYDKVGRVMGLTYP
Sbjct:  121 AAREQKPLVYPLIALLVSGGHTELVYVPEPGDYHIIGETRDDAVGEAYDKVGRVMGLTYP  180

Query:  181 AGREIDQLAHKGQDTYHFPRAMIKEDHLEFSFSGLKSAFINLHHNAEQKGEALVLEDLCA  240
            AGREIDQLAHKGQDTYHFPRAMI EDHLEFSFSGLKSAFINLHHNA+QKG+ L+LEDLCA
Sbjct:  181 AGREIDQLAHKGQDTYHFPRAMITEDHLEFSFSGLKSAFINLHHNAKQKGDELILEDLCA  240

Query:  241 SFQAAVLDILLAKTQKALLKYPVKTLVVAGGVAANQGLRERLATDISPDIDVVIPPLRLC  300
            SFQAAVLDILLAKT+KAL +YP K LVVAGGVAANQGLR+RLA +I   I+VVIP LRLC
Sbjct:  241 SFQAAVLDILLAKTKKALSRYPAKMLVVAGGVAANQGLRDRLAQEIT-HIEVVIPKLRLC  299

Query:  301 GDNAGMIALAAAIEFEKENFASLKLNAKPSLAFE                            334
            GDNAGMIALAAAIE++K++FA++ LNAKPSLAF+
Sbjct:  300 GDNAGMIALAAAIEYDKQHFANMSLNAKPSLAFD                            333
```

SEQ ID 4926 (GBS371) was expressed in *E. coli* as a His-fusion product. SDS-PAGE analysis of total cell extract is shown in FIG. 64 (lane 7; MW 41 kDa), in FIG. 170 (lane 4 & 5; MW 55 kDa) and in FIG. 239 (lane 6; MW 55 kDa). It was also expressed in *E. coli* as a GST-fusion product. SDS-PAGE analysis of total cell extract is shown in FIG. 69 (lane 7; MW 65 kDa).

Based on this analysis, it was predicted that these proteins and their epitopes could be useful antigens for vaccines or diagnostics.

EXAMPLE 1594

A DNA sequence (GBSx1688) was identified in *S. agalactiae* <SEQ ID 4929> which encodes the amino acid sequence <SEQ ID 4930>. Analysis of this protein sequence reveals the following:

```
Possible site: 33
>>> Seems to have no N-terminal signal sequence

----- Final Results -----
            bacterial cytoplasm --- Certainty = 0.1027(Affirmative) < succ>
            bacterial membrane  --- Certainty = 0.0000(Not Clear)   < succ>
            bacterial outside   --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1595

A DNA sequence (GBSx1689) was identified in *S. agalactiae* <SEQ ID 4931> which encodes the amino acid sequence <SEQ ID 4932>. Analysis of this protein sequence reveals the following:

```
Possible site: 20
>>> Seems to have no N-terminal signal sequence

----- Final Results -----
            bacterial cytoplasm --- Certainty = 0.1307(Affirmative) < succ>
            bacterial membrane  --- Certainty = 0.0000(Not Clear)   < succ>
            bacterial outside   --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1596

A DNA sequence (GBSx1690) was identified in *S. agalactiae* <SEQ ID 4933> which encodes the amino acid sequence <SEQ ID 4934>. This protein is predicted to be L4171-60 protein. Analysis of this protein sequence reveals the following:

```
Possible site: 36
>>> Seems to have a cleavable N-term signal seq.

----- Final Results -----
            bacterial outside   --- Certainty = 0.3000(Affirmative) < succ>
            bacterial membrane  --- Certainty = 0.0000(Not Clear)   < succ>
            bacterial cytoplasm --- Certainty = 0.0000(Not Clear)   < succ>
```

A related GBS nucleic acid sequence <SEQ ID 10135> which encodes amino acid sequence <SEQ ID 10136> was also identified.

The protein has homology with the following sequences in the GENPEPT database.

```
>GP: AAC24656 GB: AE001274 L4171.5 [Leishmania major]
Identities = 118/282 (41%), Positives = 167/282 (58%), Gaps = 4/282 (1%)

Query:   2 GGTQTNQVVISSMLASYEGVIAAETGHVSSHEAGAIEFSGHKVLTLPSHNGKLLASEVAT    61
           GGTQTN +  S L  +E VIA + GH+S+HE GAIE +GHKV+T P  +GKL  ++
Sbjct:  74 GGTQTNLIACSLALRPWEAVIATQLGHISTHETGAIEATGHKVVTAPCPDGKLRVAD---  130

Query:  62 YIETFYADGNYQHMVFPGMVYISHPTEYGTLYSKAELEELSKICKHYQIPLFIDGARLGY   121
           IE+  +   +HMV P +VYIS+ TE GT Y+K ELE++S  CK + + LF+DGARL
Sbjct: 131 -IESALHENRSEHMVIPKLVYISNTTEVGTQYTKQELEDISASCKEHGLYLFLDGARLAS  189

Query: 122 GLAAKDTDVDFPTIAALSDVFYIGGTKMGALAGEAVVFTKKNRPKQFTTIVKQHGALLAK   181
           L++   D+    IA L+D+FYIG TK G + GEA++            ++KQ GAL+AK
Sbjct: 190 ALSSPVNDLTLADIARLTDMFYIGATKAGGMFGEALIILNDALKPNARHLIKQRGALMAK  249

Query: 182 GRLLGLAFDRFFTDNLYLKIGRHAIDLAEELKIILEEKGYSFYLKSPTNQQFIIVENTKL   241
           G LLG+ F+    DNL+ ++G H+  +A  LK  LE  G     S +NQ F I+ENT +
Sbjct: 250 GWLLGIQFEVLMKDNLFFELGAHSNKMAAILKAGLEACGIRLAWPSASNQLFPILENTMI  309

Query: 242 ADLAKNVAYSFWEKYDDHHTVIRLATSWSTSREDVTALRNVL                    283
           A+L  +       E  D   ++RL TSW+T ++      VL
Sbjct: 310 AELNNDFDMYTVEPLKDGTCIMRLCTSWATEEKECHRFVEVL                    351
```

No corresponding DNA sequence was identified in *S. pyogenes*.

SEQ ID 4934 (GBS648) was expressed in *E. coli* as a GST-fusion product. SDS-PAGE analysis of total cell extract is shown in FIG. 131 (lane 8-10; MW 60 kDa) and in FIG. 186 (lane 6; MW 60 kDa). It was also expressed in *E. coli* as a His-fusion product. SDS-PAGE analysis of total cell extract is shown in FIG. 131 (lane 12; MW 35 kDa), in FIG. 140 (lane 10; MW 35 kDa) and in FIG. 178 (lane 7; MW 35 kDa).

Purified GBS648-GST is shown in FIG. 243, lane 6; purified GBS648-His is shown in FIG. 229, lane 7.

Based on this analysis, it was predicted that this protein and its epitopes, could be useful antigens for vaccines or diagnostics.

EXAMPLE 1597

A DNA sequence (GBSx1691) was identified in *S. agalactiae* <SEQ ID 4935> which encodes the amino acid sequence <SEQ ID 4936>. Analysis of this protein sequence reveals the following:

```
Possible site: 13
>>> Seems to have no N-terminal signal sequence

----- Final Results -----
            bacterial cytoplasm --- Certainty = 0.2279(Affirmative) < succ>
            bacterial membrane  --- Certainty = 0.0000(Not Clear)   < succ>
            bacterial outside   --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1598

A DNA sequence (GBSx1692) was identified in *S. agalactiae* <SEQ ID 4937> which encodes the amino acid sequence <SEQ ID 4938>. This protein is predicted to be ribosomal protein S14 (rpsN). Analysis of this protein sequence reveals the following:

```
Possible site: 60
>>> Seems to have no N-terminal signal sequence

----- Final Results -----
            bacterial cytoplasm --- Certainty = 0.3848(Affirmative) < succ>
            bacterial membrane  --- Certainty = 0.0000(Not Clear)   < succ>
            bacterial outside   --- Certainty = 0.0000(Not Clear)   < succ>
```

The protein has homology with the following sequences in the GENPEPT database.

```
>GP: CAB12716 GB: Z99108 similar to ribosomal protein S14 [Bacillus
subtilis]
Identities = 67/89 (75%), Positives = 76/89 (85%)

Query:   1 MAKKSKIAKFQKQQKLVEQYAELRRELKEKGDYEALRKLPKDSNPNRLKNRDLIDGRPHA   60
           MAKKSK+AK  K+Q+LVEQYA +RRELKEKGDYEAL KLP+DS P RL NR ++ GRP A
Sbjct:   1 MAKKSKVAKELKRQQLVEQYAGIRRELKEKGDYEALSKLPRDSAPGRLHNRCMVTGRPRA   60

Query:  61 YMRKFGMSRINFRNLAYKGQIPGIKKASW                                 89
           YMRKF MSRI FR LA+KGQIPG+KKASW
Sbjct:  61 YMRKFKMSRIAFRELAHKGQIPGVKKASW                                 89
```

A related DNA sequence was identified in *S. pyogenes* <SEQ ID 4939> which encodes the amino acid sequence <SEQ ID 4940>. Analysis of this protein sequence reveals the following:

```
Possible site: 31
>>> Seems to have no N-terminal signal sequence

----- Final Results -----
              bacterial cytoplasm --- Certainty = 0.3799(Affirmative) < succ>
               bacterial membrane --- Certainty = 0.0000(Not Clear)   < succ>
                bacterial outside --- Certainty = 0.0000(Not Clear)   < succ>
```

An alignment of the GAS and GBS proteins is shown below.

```
Identities = 73/89 (82%), Positives = 85/89 (95%)

Query:   1 MAKKSKIAKFQKQQKLVEQYAELRRELKEKGDYEALRKLPKDSNPNRLKNRDLIDGRPHA   60
           MAKKSKIAK+QKQ +L+EQYA+LRR+LK KGDYE+LRKLP+DSNPNRLKNRD IDGRPHA
Sbjct:   1 MAKKSKIAKYQKQLQLIEQYADLRRDLKAKGDYESLRKLPRDSNPNRLKNRDKIDGRPHA   60

Query:  61 YMRKFGMSRINFRNLAYKGQIPGIKKASW                                 89
           YMRKFG+SRINFR+LA+KGQ+PG+ KASW
Sbjct:  61 YMRKFGVSRINFRDLAHKGQLPGVTKASW                                 89
```

Based on this analysis, it was predicted that these proteins and their epitopes could be useful antigens for vaccines or diagnostics.

EXAMPLE 1599

A DNA sequence (GBSx1693) was identified in *S. agalactiae* <SEQ ID 4941> which encodes the amino acid sequence <SEQ ID 4942>. Analysis of this protein sequence reveals the following:

```
Possible site: 58
>>> Seems to have no N-terminal signal sequence

----- Final Results -----
              bacterial cytoplasm --- Certainty = 0.5183(Affirmative) < succ>
               bacterial membrane --- Certainty = 0.0000(Not Clear)   < succ>
                bacterial outside --- Certainty = 0.0000(Not Clear)   < succ>
```

The protein has homology with the following sequences in the GENPEPT database.

```
>GP: CAB95931 GB: AL359989 galactose-1-phosphate uridylyltransferase
[Streptomyces coelicolor A3(2)]
Identities = 31/105 (29%), Positives = 51/105 (48%), Gaps = 4/105 (3%)

Query:  27 DKCPFC--DKSQLGKILDVKDDMIWVENKYPTL--EETYQTLVIESNDHNGDISVYSESK    82
           D+CP C  D  +L +I D  D++ EN++P+L     +V ++DH+   + SE +
Sbjct:  68 DQCPLCPSDGERLSEIPDSAYDVVVFENRFPSLAGDSGRCEVVCFTSDHDASFADLSEEQ   127
```

```
Query:   83 MRQLLDYLLSKWQLMEESGHYRSVVLYRNFGPLSGGSLRHPHSQI            127
            R+LD      +    +         V   + N G    G +L HPH QI
Sbjct:  128 ARLVLDAWTDRTSELSHLPSVEQVFCFENRGAEIGVTLGHPHGQI            172
```

No corresponding DNA sequence was identified in *S. pyogenes*.

Based on this analysis, it was predicted that this protein and its epitopes, could be useful antigens for vaccines or diagnostics.

EXAMPLE 1600

A DNA sequence (GBSx1694) was identified in *S. agalactiae* <SEQ ID 4943> which encodes the amino acid sequence <SEQ ID 4944>. Analysis of this protein sequence reveals the following:

```
Possible site: 18
>>> Seems to have an uncleavable N-term signal seq

----- Final Results -----
            bacterial membrane --- Certainty = 0.0000(Not Clear) < succ>
             bacterial outside --- Certainty = 0.0000(Not Clear) < succ>
            bacterial cytoplasm --- Certainty = 0.0000(Not Clear) < succ>
```

A related GBS nucleic acid sequence <SEQ ID 10133> which encodes amino acid sequence <SEQ ID 10134> was also identified.

The protein has homology with the following sequences in the GENPEPT database.

```
>GP: BAB06998 GB: AP001518 unknown conserved protein [Bacillus halodurans]
Identities = 186/410 (45%), Positives = 258/410 (62%), Gaps = 27/410 (6%)

Query:    4 YDTIIIGGGPAGMMAAISSNFYGNKTLLIEKNKRLGKKLAGTGGGRCNVTNNGNLDELLA    63
            ++ I+IGGGPAG+MA++S+  +G + LL++K  +LG+KLA +GGGRCNVTN   LDEL+A
Sbjct:    2 HEVIVIGGGPAGLMASVSAAEHGARVLLLDKGDKLGRKLAISGGGRCNVTNBMPLDELIA   61

Query:   64 GIPGNGRFLYSVFSQFDNHDIINFFQDNGVTLKEEDHGRMFPTTDKSRTIINALENKIKE   123
             IPGNGRF+YS FS F+N DII FF+  G+ LKEED GRMFP +DK+ T++   L  +I +
Sbjct:   62 HIPGNGRFMYSPFSVFNNEDIIRFFERLGIALKEEDRGRMFPVSDKATTVVQTLLKRIND  121

Query:  124 LGGQIMTDTEVVSK-KIGDSFYIKTKDTQFASDK-LIVTTGGKSYPSTGSTGFGHDIAR   181
            LG  + T+T V S++    G    ++ K+  +     K +IV TGG+S P TGSTG   A+
Sbjct:  122 LGVTVRTNTAVASLEYDDGRIAMVQLKNGERLKTKTVIVATGGQSVPHTGSTGDAYPWAK  181

Query:  182 HFKLEVTDMEAAESPLLTDFP---HKKLQGISLDDVTLSF----EKHIITH--DLLFTHF   232
               +T++   E P+ +  P      KKLQG+SL D+ LS       K I  TH   D++FTHF
Sbjct:  182 AAGHTITELYPTEVPITSAEPFIQEKKLQGLSLRDIELSVYAPNGKQIKTHDGDMIFTHF  241

Query:  233 GLSGPAALRISSFVKGGETIY--------LDVLPNISVKEL-EIHFQN---EREKSLKNA   280
            GLSGPAALR S +V         Y            +D+ P I  + L +    QN    E +K+LK
Sbjct:  242 GLSGPAALRCSQYVVKALKKYKQPTIEMRIDLRPTIPAEALFQETIQNIKAEPKKALKTV  301

Query:  281 LKILLPERLAEFYAEDL--PEKVKQVSVKD--LEMLIQKLKKLPILVTGKMSLAKSFVTK   336
            L+  +  PER ++   E L    + SV+   +  ++Q+LK     V G +S+ K+FVT
Sbjct:  302 LRGIAPERFLQYIYERLRIDSNLPCASVRHEVIREIVQQLKSFSFHVNGTLSIEKAFVTG  361

Query:  337 GGVDLKEINPKTLESKKVAGLHFAGEVLDINAHTGGFNITSALCTGWVAG            386
            GGV +KEI PKT+ SKK AGL F GEVLDI+ +TGG+NIT A  TG+ AG
Sbjct:  362 GGVSVKEIEPKTMHSKKKAGLFFCGEVLDIHGYTGGYNITCAFSTGYTAG            411
```

A related DNA sequence was identified in *S. pyogenes* <SEQ ID 4945> which encodes the amino acid sequence <SEQ ID 4946>. Analysis of this protein sequence reveals the following:

```
Possible site: 23
>>> Seems to have no N-terminal signal sequence

----- Final Results -----
          bacterial cytoplasm --- Certainty = 0.0448 (Affirmative) < succ>
           bacterial membrane --- Certainty = 0.0000 (Not Clear)   < succ>
           bacterial outside  --- Certainty = 0.0000 (Not Clear)   < succ>
```

An alignment of the GAS and GBS proteins is shown below.

```
Identities = 308/386 (79%), Positives = 344/386 (88%)

Query:    1 NKHYDTIIIGGGPAGMMAAISSNFYGNKTLLIEKNKRLGKKLAGTGGGRCNVTNNGNLDE     60
            M  YDTIIIGGGPAGMMAAISS++YG KTLLIEKN+RLGKKLAGTGGGRCNVTN+GNLD
Sbjct:    1 MTQYDTIIIGGGPAGMMAAISSSYYGYKTLLIEKNRRLGKKLAGTGGGRCNVTNSGNLDV    60

Query:   61 LLAGIPGNGRFLYSVFSQFDNHDIINFFQDNGVTLKEEDHGRMFPTTDKSRTIINALENK   120
            L+AGIPGNGRFLYSVFSQFDNHDII FF++NGV LKEEDHGRMFPTTDKSRTII+ALE K
Sbjct:   61 LMAGIPGNGRFLYSVFSQFDNHDIIAFFEENGVKLKEEDHGRMFPTTDKSRTIIDALEKK   120

Query:  121 IKELGGQIMTDTEVVSVKKIGDSFYIKTKDTQFASDKLIVTTGGKSYPSTGSTGFGHDIA   180
            IK LGGQ++T TEVVSVKK D FY+K+ D F   KLIVTTGGKSYPSTGSTGFGHDIA
Sbjct:  121 IKALGGQVLTSTEVVSVKKQDDLFYLKSADQTFTCQKLIVTTGGKSYPSTGSTGFGHDIA   180

Query:  181 RHFKLEVTDMEAAESPLLTDFPHKKLQGISLDDVTLSFEKHIITHDLLFTHGLSGPAAL    240
            RHFKL VTD+EAAESPLLTDFPHK LQGISLDDVTLS++KH+ITHDLLFTHGLSGPAAL
Sbjct:  181 RHFKLTVTDLEAAESPLLTDFPHKVLQGISLDDVTLSYDKHVITHDLLFTHGLSGPAAL   240

Query:  241 RISSFVKGGETIYLDVLPNISVKELEIHFQNEREKSLKNALKILLPERLAEFYAEDLPEK   300
            R+SSFVKGGE   LD LP++S  +L  +  ++R+K++KNALK LLPER+A+F +ED PEK
Sbjct:  241 RLSSFVKGGEIAELDFLPHLSTDDLTAYLSDQRDKNIKNALKGLLPERVADFLSEDYPEK   300

Query:  301 VKQVSVKDLEMLIQKLKKLPILVTGKMSLAKSFVTKGGVDLKEINPKTLESKKVAGLHFA   360
            VKQ+S K  + L+ KLK L I +TGKMSLAKSFVTKGGVDLKEINPKTLESKKV GL+FA
Sbjct:  301 VKQLSPKQEKELLDKLKHLQIPITGKMSLAKSFVTKGGVDLKEINPKTLESKKVPGLYFA   360

Query:  361 GEVLDINAHTGGFNITSALCTGWVAG                                    386
            GEVLDINAHTGGFNITSALC+GW+AG
Sbjct:  361 GEVLDINAHTGGFNITSALCSGWIAG                                    386
```

SEQ ID 4944 (GBS196) was expressed in *E. coli* as a His-fusion product. SDS-PAGE analysis of total cell extract is shown in FIG. 26 (lane 3; MW 44.5 kDa). It was also expressed in *E. coli* as a GST-fusion product. SDS-PAGE analysis of total cell extract is shown in FIG. 37 (lane 4; MW 69.5 kDa).

Based on this analysis, it was predicted that these proteins and their epitopes could be useful antigens for vaccines or diagnostics.

EXAMPLE 1601

A DNA sequence (GBSx1695) was identified in *S. agalactiae* <SEQ ID 4947> which encodes the amino acid sequence <SEQ ID 4948>. Analysis of this protein sequence reveals the following:

```
Possible site: 36
>>> Seems to have no N-terminal signal sequence

----- Final Results -----
          bacterial cytoplasm --- Certainty = 0.1550 (Affirmative) < succ>
           bacterial membrane --- Certainty = 0.0000 (Not Clear)   < succ>
           bacterial outside  --- Certainty = 0.0000 (Not Clear)   < succ>
```

A related GBS nucleic acid sequence <SEQ ID 10131> which encodes amino acid sequence <SEQ ID 10132> was also identified.

The protein has homology with the following sequences in the GENPEPT database.

```
>GP: CAA73267 GB: Y12736 orfX [Lactococcus lactis subsp. cremoris]
Identities = 51/173 (29%), Positives = 87/173 (49%), Gaps = 20/173 (11%)

Query:  19 KTVSELAEILGVSRQAMNNRV-KTLPEECVEK---NSKGVTVVNRDGLIKLEEIYKKTIL   74
            KT+ ELA+ LGVS+Q + N++ K    E+ V+           V+N  G      + KKT+
Sbjct:   6 KTIKELADELGVSKQTIRNKIDKDFREKFVQTIKIKGNNTLVINNAGY----SLLKKTLQ   61

Query:  75 EEEPIDEEASRRELLEILVDEKNTEITRLYEQLKAKDIQIASKDEQLHVKDIQIAEKDKQ  134
              +      + + + + +     I  L EQL  K+ Q++ KD+QL  KD QI++
Sbjct:  62 NDTAQTAKTLQNDTAQTKL------ICFLEEQLDKKEQQLSVKDKQLENKDTQISQMQNL  115

Query: 135 LDQQQQLTLTAMEDTQRLQLELNEAKA------EVEEIQEAKEEKIQELEAVK        181
           LDQQQ+L  L  +  +  + E+NE KA          ++++    + E  +E+E +K
Sbjct: 116 LDQQQRLALQDKKLLEEYKSEINELKALKMPREDMKDGSSIRGEAQEEIERLK        168
```

A related DNA sequence was identified in *S. pyogenes* <SEQ ID 4949> which encodes the amino acid sequence <SEQ ID 4950>. Analysis of this protein sequence reveals the following:

```
Possible site: 14
>>> Seems to have no N-terminal signal sequence

----- Final Results -----
           bacterial cytoplasm --- Certainty = 0.3951 (Affirmative) < succ>
           bacterial membrane  --- Certainty = 0.0000 (Not Clear)   < succ>
           bacterial outside   --- Certainty = 0.0000 (Not Clear)   < succ>
```

An alignment of the GAS and GBS proteins is shown below.

```
Identities = 132/194 (68%), Positives = 154/194 (79%), Gaps = 4/194 (2%)

Query:   1 MIFFYKKI---STKEEVMTVEKTVSELAEILGVSRQAMNNRVKTLPEECVEKNSKGVTVV   57
           M+ F  +I   S KEE M +EKTVSELA+ILGVSRQA+NNRVK+LPEE ++KN KGVTVV
Sbjct:   1 MVLFLIRIFSDSDKEENMGIEKTVSELADILGVSRQAVNNRVKSLPEEDLDKNEKGVTVV   60

Query:  58 NRDGLIKLEEIYKKTILEEEPIDEEASRRELLEILVDEKNTEITRLYEQLKAKDIQIASK  117
            R GL+KLEEIYKKTI ++EPI EE  +RELLEILVDEKNTEITRLYEQLKAKD Q+ASK
Sbjct:  61 KRSGLVKLEEIYKKTIFDDEPISEETKQRELLEILVDEKNTEITRLYEQLKAKDAQLASK  120

Query: 118 DEQLHVKDIQIAEKDKQLDQQQQLTLTAMEDTQRLQLELNEAKAEVEEIQEAKEEKIQEL  177
           DEQ+  VKD+QIAEKDKQLDQQQQLT  AM D + L+LEL EAKAE + +   E++Q
Sbjct: 121 DEQMRVKDVQIAEKDKQLDQQQQLTAKAMADKETLKLELEEAKAEANQAR-LQVEEVQAE  179

Query: 178 EAVKKSFFGRFFNK                                               191
              KK  FF R F K
Sbjct: 180 VGPKKGFFTRLFAK                                               193
```

Based on this analysis, it was predicted that these proteins and their epitopes could be useful antigens for vaccines or diagnostics.

EXAMPLE 1602

A DNA sequence (GBSx1697) was identified in *S. agalactiae* <SEQ ID 4951> which encodes the amino acid sequence <SEQ ID 4952>. Analysis of this protein sequence reveals the following:

```
Possible site: 53
>>> Seems to have no N-terminal signal sequence

----- Final Results -----
           bacterial cytoplasm --- Certainty = 0.2157 (Affirmative) < succ>
           bacterial membrane  --- Certainty = 0.0000 (Not Clear)   < succ>
           bacterial outside   --- Certainty = 0.0000 (Not Clear)   < succ>
```

The protein has homology with the following sequences in the GENPEPT database.

```
>GP: BAB06137 GB: AP001515 DNA polymerase III (alpha subunit)
[Bacillus halodurans]
Identities = 31/87 (35%), Positives = 52/87 (59%), Gaps = 1/87 (1%)

Query:   13 EYIAFDLEFNTVGE-HSNIIQVSAVKYSNHQEIALFDTYVHTKVPLQSFINGLTGITARD   71
            E++ FD+E    +  ++ II+++AVK  N + I  F+ +      PL + I   LTGIT
Sbjct:  418 EFVVFDVETTGLSAVYNKIIELAAVKVKNGEIIDREERFADPHEPLTNTIIELTGITDDM  477

Query:   72 IIGAPKIEIVLTDFQSFVGDTPLIGYN                                   98
            + G P++E VL +F +F+GD  L+ +N
Sbjct:  478 LKGQPEVEQVLNEFHAFIGDAVLVAHN                                  504
```

A related DNA sequence was identified in *S. pyogenes* <SEQ ID 4953> which encodes the amino acid sequence <SEQ ID 4954>. Analysis of this protein sequence reveals the following:

```
Possible site: 29
>>> Seems to have no N-terminal signal sequence

----- Final Results -----
            bacterial cytoplasm --- Certainty = 0.3427 (Affirmative) < succ>
             bacterial membrane --- Certainty = 0.0000 (Not Clear)   < succ>
              bacterial outside --- Certainty = 0.0000 (Not Clear)   < succ>
```

An alignment of the GAS and GBS proteins is shown below.

```
Identities = 136/200 (68%), Positives = 159/200 (79%)

Query:    3 FLGEIMKQLQEYIAFDLEFNTVGEHSHIIQVSAVKYSNHQEIALFDTYVHTKVPLQSFIN   62
            FL E MK L  YIAFDLEFNTV + SHIIQVSAVKY +H+E+  FDTYV+T VPLQSFIN
Sbjct:    9 FLEENMKHLDTYIAFDLEFNTVNDVSHIIQVSAVKYDHHKEVDSFDTYVYTDVPLQSFIN   68

Query:   63 GLTGITARDIIGAPKIEIVLTDFQSFVGDTPLIGYNGYKSDLPLLVENGLDLTSQYQVDL  122
            GLTGIT+  I   PK+E V+  F++FVG+ PLIGYN  KSDLP+L ENGLDL  QYQ+DL
Sbjct:   69 GLTGITSDKIAAEPRVEEVMAAFKNFVGELPLIGYNAQKSDLPILAENGLDLRDQYQIDL  128

Query:  123 YDEAFVRRSTDLNGIVNLKLTTVADFLGIKGKAHNSLEDARMTARVYEKFLDLDENKIYL  182
            +DEA+ RRS DLNGI NL+L TVA FLGIKG+ HNSLEDARMTA +Y+ FL+ D NK YL
Sbjct:  129 FDEAYDRRSADLNGIANLRLQTVATFLGIKGRGHNSLEDARMTAVIYKSFLETDTNKAYL  188

Query:  183 KQQKEVAVDSPFATLGNLFD                                         202
             QQ+EV  D+PFA LG+ FD
Sbjct:  189 SQQEEVTTDNPFAALGDFFD                                         208
```

Based on this analysis, it was predicted that these proteins and their epitopes could be useful antigens for vaccines or diagnostics.

EXAMPLE 1603

A DNA sequence (GBSx1698) was identified in *S. agalactiae* <SEQ ID 4955> which encodes the amino acid sequence <SEQ ID 4956>. Analysis of this protein sequence reveals the following:

```
Possible site: 46
>>> Seems to have no N-terminal signal sequence
INTEGRAL Likelihood = -12.10 Transmembrane 143-159 (136-166)
INTEGRAL Likelihood =  -4.73 Transmembrane 169-185 (168-188)

----- Final Results -----
             bacterial membrane --- Certainty = 0.5840 (Affirmative) < succ>
              bacterial outside --- Certainty = 0.0000 (Not Clear)   < succ>
            bacterial cytoplasm --- Certainty = 0.0000 (Not Clear)   < succ>
```

The protein has homology with the following sequences in the GENPEPT database.

```
>GP: CAB42766 GB: AL049841 transcriptional regulator [Streptomyces
coelicolor A3(2)]
Identities = 46/141 (32%), Positives = 71/141 (49%), Gaps = 11/141 (7%)

Query:    5 YSTGDLAKEAGVTVRTVQYYDKRGILSPSELSEGGRRVYSIADLEKLRQIIYLRDLDFSI   64
            YS G +A  AGVTVRT+ +YD  G+L PSE S   G R YS ADL++L+QI++ R+L F +
Sbjct:    3 YSVGQVAGFAGVTVRTLHHYDDIGLLVPSERSHAGHRRYSDADLDRLQQILFYRELGFPL   62

Query:   65 DNIKNLFTEDNASQILELFLQVQIRELRL--------AIDSKKDKLDKAVNLLKTVEKQD  116
            D +  L  + A      L Q ++  R+         A++   +   +NL      ++
Sbjct:   63 DEVAALLDDPAADPRAHLRRQHELLSARIGKLQKMAAAVEQAMEARSMGINL---TPEEK  119

Query:  117 SKTLGYLSDIVLMEENKRKWG                                         137
            +  G            EE + +WG
Sbjct:  120 FEVFGDFDPDQYEEEVRERWG                                         140
```

There is also homology to SEQ ID 1712.

SEQ ID 4956 (GBS372) was expressed in *E. coli* as a GST-fusion product. SDS-PAGE analysis of total cell extract is shown in FIG. 69 (lane 8; MW 55 kDa).

GBS372-GST was purified as shown in FIG. 215, lane 8.

Based on this analysis, it was predicted that this protein and its epitopes, could be useful antigens for vaccines or diagnostics.

EXAMPLE 1604

A DNA sequence (GBSx1699) was identified in *S. agalactiae* <SEQ ID 4957> which encodes the amino acid sequence <SEQ ID 4958>. This protein is predicted to be cyclopropane-fatty-acyl-phospholipid synthase (mma2). Analysis of this protein sequence reveals the following:

```
Possible site: 53
>>> Seems to have no N-terminal signal sequence

----- Final Results -----
            bacterial cytoplasm --- Certainty = 0.3145 (Affirmative) < succ>
             bacterial membrane --- Certainty = 0.0000 (Not Clear)   < succ>
              bacterial outside --- Certainty = 0.0000 (Not Clear)   < succ>
```

The protein has homology with the following sequences in the GENPEPT database.

```
>GP: AAD07482 GB: AE000557 cyclopropane fatty acid synthase (cfa)
[Helicobacter pylori 26695]
Identities = 167/397 (42%), Positives = 254/397 (63%), Gaps = 14/397 (3%)

Query:    2 VMDSLIIKQLIKSTFDIPLQVTYPNGNIETYNGSNPHVKLKLNKNFSVSELSKDPSIVLG   61
            ++  ++K + K +    QV + + ++    +P  LK+++   S++ KD S+ +
Sbjct:    1 MISKFLLKSMFKQWKNGDYQVVFWDNSVYRNGEHSPKFTLKIHRPLKFSDIKKDMSLTIA   60

Query:   62 EAVMDGDIEIYGSIQELILSAY-RCGDSFLRNSKFSKLIPKQFHDKKHSKSDIQKHYDIG  120
            EA MDG I+I GS+ E++ S Y +     L     +K I K  +    S+I KHYD+G
Sbjct:   61 EAYMDGVIDIEGSMDEVMHSLYLQTNYEHLHKHDNAKAIQKPIKES----SNISKHYDLG  116

Query:  121 NDFYKLWLDDTMTYSCAYFKHENDSLEQAQLNKVHHILNKLNAQPGGKLLDIGCGWGTLI  180
            NDFY +WLD+T++YSCAYFK ++D+L  AQL K+ H L KL+ +PG KLLDIGCGWG L
Sbjct:  117 NDFYSIWLDETLSYSCAYFKKDDDTLHAAQLQKLDHTLKKLHLKPGEKLLDIGCGWGYLS  176

Query:  181 ITAAKEYGLNATGITLSEEQASFITKRIKEEGLENKVTVLIKDYRDI---RETYDYITSV  237
            + AA+EYG    GIT+S EQ    KR++E GLE+KVT+ + +Y+D+      +D + SV
Sbjct:  177 VKAAQEYGAEVMGITISSEQYKQANKRVQELGLEDKVTIKLLNYQDLDGRLYRFDKVVSV  236

Query:  238 GMFEHVGKENLSQYFQTISKRLNINGLALIHGITGQVGGNHGSGTNSWINKYIFPGGYIP  297
            GMFEHVGK+NL  YF+ + + L  G+ L+H I    G    TN+W++KYIFPGGY+P
Sbjct:  237 GMFEHVGKDNLPFYFKKVKEVLKRGGMFLLHSILCCFEGK----TNAWVDKYIFPGGYLP  292
```

```
-continued
Query:  298 RLTENLNHIASAGLQIADLEPLRRHYQKTLELWTKNFHNALPEVQK-THDKRFINMWDLY  356
            L E ++ ++      +    E LR HY KTL++W  NF++ L +V++ ++D+RFI MWDLY
Sbjct:  293 SLREVMSVMSECDFHLLMAESLRIHYAKTLDIWRNNFNHNLDQVKRLSYDERFIRMWDLY  352

Query:  357 LQSCAASFESGNIDIFQYLLSKGVSKDTMPMTRDYMY                         393
            L++CA++F  G+ D+FQ LL+  V  +T P+T++Y+Y
Sbjct:  353 LRTCASAFRVGSADLFQLLLTNSVD-NTFPLTKEYIY                         388
```

No corresponding DNA sequence was identified in S. pyogenes.

Based on this analysis, it was predicted that this protein and its epitopes, could be useful antigens for vaccines or diagnostics.

EXAMPLE 1605

A DNA sequence (GBSx1700) was identified in *S. agalactiae* <SEQ ID 4959> which encodes the amino acid sequence <SEQ ID 4960>. Analysis of this protein sequence reveals the following:

```
Possible site: 35
>>> Seems to have no N-terminal signal sequence

----- Final Results -----
              bacterial cytoplasm --- Certainty = 0.4903 (Affirmative) < succ>
               bacterial membrane --- Certainty = 0.0000 (Not Clear) < succ>
                bacterial outside --- Certainty = 0.0000 (Not Clear) < succ>
```

The protein has homology with the following sequences in the GENPEPT database.

```
>GP: CAB11796 GB: Z99104 similar to hypothetical proteins [Bacillus subtilis]
Identities = 44/97 (45%), Positives = 60/97 (61%)

Query:   1 MMNMQNMMRQAQKLQKQMEQKQADLAASQFTGKSAQELVTVTFTGDKKLISIDYKEAVVD   60
           M NMQ MM+Q QK+QK M + Q +LA      G +    +VTV    G K+++ +   KE VVD
Sbjct:   5 MGNMQKMMKQMQKMQKDMAKAQEELAEKVVEGTAGGGMVTVKANGQKEILDVIIKEEVVD   64

Query:  61 PEDIETLQDMTTQAINDALSQVDDATKKIMGAFAGKM                         97
           PEDI+ LQD+    A N+AL +VD+ T + MG F   M
Sbjct:  65 PEDIDMLQDLVLAATNEALKKVDEITNETMGQFTKGM                        101
```

A related DNA sequence was identified in *S. pyogenes* <SEQ ID 4961> which encodes the amino acid sequence <SEQ ID 4962>. Analysis of this protein sequence reveals the following:

```
Possible site: 35
>>> Seems to have no N-terminal signal sequence

----- Final Results -----
              bacterial cytoplasm --- Certainty = 0.4451 (Affirmative) < succ>
               bacterial membrane --- Certainty = 0.0000 (Not Clear) < succ>
                bacterial outside --- Certainty = 0.0000 (Not Clear) < succ>
```

An alignment of the GAS and GBS proteins is shown below.

```
Identities = 84/99 (84%), Positives = 94/99 (94%)

Query:   1 MMNMQNMMRQAQKLQKQMEQKQADLAASQFTGKSAQELVTVTFTGDKKLISIDYKEAVVD  60
           MMNMQNMM+QAQKLQKQMEQKQADLAA QFTGKSAQ+LVT TFTGDKKL+ ID+KEAVVD
Sbjct:   1 MMNMQNMMKQAQKLQKQMEQKQADLAAMQFTGKSAQDLVTATFTGDKKLVGIDFKEAVVD  60

Query:  61 PEDIETLQDMTTQAINDALSQVDDATKKIMGAFAGKMPF                      99
           PED+ETLQDMTTQAINDAL+Q+D+ TKK +GAFAGK+PF
Sbjct:  61 PEDVETLQDMTTQAINDALTQIDETTKKTLGAFAGKLPF                      99
```

Based on this analysis, it was predicted that these proteins and their epitopes could be useful antigens for vaccines or diagnostics.

EXAMPLE 1606

A DNA sequence (GBSx1701) was identified in *S. agalactiae* <SEQ ID 4963> which encodes the amino acid sequence <SEQ ID 4964>. Analysis of this protein sequence reveals the following:

```
Possible site: 17
>>> Seems to have no N-terminal signal sequence

----- Final Results -----
          bacterial cytoplasm --- Certainty = 0.3963 (Affirmative) < succ>
           bacterial membrane --- Certainty = 0.0000 (Not Clear)   < succ>
            bacterial outside --- Certainty = 0.0000 (Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1607

A DNA sequence (GBSx1702) was identified in *S. agalactiae* <SEQ ID 4965> which encodes the amino acid sequence <SEQ ID 4966>. Analysis of this protein sequence reveals the following:

```
Possible site: 48
>>> Seems to have no N-terminal signal sequence
INTEGRAL Likelihood = -2.76 Transmembrane 21-37 (19-39)

----- Final Results -----
           bacterial membrane --- Certainty = 0.2105 (Affirmative) < succ>
            bacterial outside --- Certainty = 0.0000 (Not Clear)   < succ>
          bacterial cytoplasm --- Certainty = 0.0000 (Not Clear)   < succ>
```

A related GBS nucleic acid sequence <SEQ ID 10129> which encodes amino acid sequence <SEQ ID 10130> was also identified.

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1608

A DNA sequence (GBSx1703) was identified in *S. agalactiae* <SEQ ID 4967> which encodes the amino acid sequence <SEQ ID 4968>. Analysis of this protein sequence reveals the following:

```
Possible site: 36
>>> Seems to have no N-terminal signal sequence

----- Final Results -----
          bacterial cytoplasm --- Certainty = 0.1783 (Affirmative) < succ>
           bacterial membrane --- Certainty = 0.0000 (Not Clear)   < succ>
            bacterial outside --- Certainty = 0.0000 (Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1609

A DNA sequence (GBSx1704) was identified in *S. agalactiae* <SEQ ID 4969> which encodes the amino acid sequence <SEQ ID 4970>. This protein is predicted to be probable 1,4-dihydroxy-2-naphthoate octaprenyltransferase. Analysis of this protein sequence reveals the following:

```
Possible site: 32
>>> Seems to have no N-terminal signal sequence
INTEGRAL Likelihood = -8.76 Transmembrane 239-255 (219-260)
INTEGRAL Likelihood = -8.33 Transmembrane 221-237 (219-238)
INTEGRAL Likelihood = -6.74 Transmembrane  91-107  (89-113)
INTEGRAL Likelihood = -6.32 Transmembrane  39-55   (35-59)
INTEGRAL Likelihood = -3.77 Transmembrane 111-127 (111-132)
INTEGRAL Likelihood = -2.97 Transmembrane 144-160 (143-161)
INTEGRAL Likelihood = -1.28 Transmembrane 275-291 (275-291)
INTEGRAL Likelihood = -0.59 Transmembrane 177-193 (177-193)

----- Final Results -----
            bacterial membrane --- Certainty = 0.4503 (Affirmative) < succ>
            bacterial outside  --- Certainty = 0.0000 (Not Clear)   < succ>
            bacterial cytoplasm --- Certainty = 0.0000 (Not Clear)  < succ>
```

The protein has homology with the following sequences in the GENPEPT database.

```
>GP: CAB15875 GB: Z99123 alternate gene name: ipa-6d~similar to
quinone biosynthesis [Bacillus subtilis]
Identities = 75/290 (25%), Positives = 139/290 (47%), Gaps = 15/290 (5%)

Query:    5 IFLELVEMKAKTASVLPFLIGLCFSAYYYNSVHPVYVGLFFVAMFLFNMFVDIWNNYNDY   64
            I +L      TAS +P L+G   + +Y     +++ + F  +++  + +++N Y D+
Sbjct:   21 ILWQLTRPHTLTASFVPVLLGTVLAMFYVKVDLLLFLAMLFSCLWI-QIATNLFNEYYDF   79

Query:   65 RNAVDL-DYKNDTNIIGRENLSLRQIEVIMASLVITSSMIGLVLVSQVGLPLLWMGLFCF  123
            +  +D +       I R + + I  +  +   + ++G+ + +      L  +GL
Sbjct:   80 KRGLDTAESVGIGGAIVRHGMKPKTILQLALASYGIAILLGVYICASSSWWLALIGLVGM  139

Query:  124 GIGVLYSFGPRPLSSLPLGEVFSGLTMGFMISLICVYLNTYQNFSWDILNLSKIFLISLP  183
              IG LY+ GP P++   P GE+FSG+ MG +  LI  ++  T       D +N+   I LIS+P
Sbjct:  140 AIGYLYTGGPLPIAYTPFGELFSGICMGSVFVLISFFIQT------DKINMQSI-LISIP  192

Query:  184 NTLWIANLMLANNLCDKEEDEKNHRYTLVHYTGIRGGLLLFAISNSIALLAIVFEFLFGL  243
            + +   + L+NN+ D  EED+K   R TL     G +G + L A S ++A + +V   + G
Sbjct:  193 IAILVGAINLSNNIRDIEEDKKGGRKTLAILMGHKGAVTLLAASFAVAYIWVVGLVITGA  252

Query:  244 APVTVLLSLLLIPFIYKQTKLLWQKQVKRETFVCAVRILALGSATQVLTY           293
             A   + +  L +P    +   K   Q ++           I+A+ S   Q   T+
Sbjct:  253 ASPWLFVVFLSVPKPVQAVKGFVQNEMPMN------MIVAMKSTAQTNTF           296
```

No corresponding DNA sequence was identified in *S. pyogenes*.

Based on this analysis, it was predicted that this protein and its epitopes, could be useful antigens for vaccines or diagnostics.

EXAMPLE 1610

A DNA sequence (GBSx1705) was identified in *S. agalactiae* <SEQ ID 4971> which encodes the amino acid sequence <SEQ ID 4972>. Analysis of this protein sequence reveals the following:

```
Possible site: 16
>>> Seems to have no N-terminal signal sequence
     INTEGRAL     Likelihood = -0.22    Transmembrane    155-171 (154-171)

----- Final Results -----
              bacterial membrane --- Certainty = 0.1086(Affirmative) < succ>
              bacterial outside  --- Certainty = 0.0000(Not Clear)   < succ>
              bacterial cytoplasm --- Certainty = 0.0000(Not Clear)  < succ>
```

The protein has homology with the following sequences in the GENPEPT database.

```
>GP: CAB15200 GB: Z99120 similar to NADH dehydrogenase [Bacillus subtilis]
Identities = 178/403 (44%), Positives = 249/403 (61%), Gaps = 7/403 (1%)

Query:   3 EILVLGAGYAGLKAVRNLQKQSG--DFHITLVDMNDYHYEATELHEVAAGSQPKEKITFP    60
           +I++LGAGY GL  V  L K  G  D  ITLV+ ++YHYE T +HE +AG+   ++   +
Sbjct:   7 KIVILGAGYGGLMTVTRLTKYVGPNDADITLVNKHNYHYETTWMHEASAGTLHHDRCRYQ   66

Query:  61 IKDVINTNKVNFMQDEVLRVDAENKTVTVKNNGELHYDYVVVALGFVSETFGIKGAMENA  120
           IKDVIN ++VNF+QD V   +  K V + N GEL YDY+V+ LG V ETFGIKG  E A
Sbjct:  67 IKDVINQSRVNFVQDTVKAIKIDEKKVVLAN-GELQYDYLVIGLGAVPETFGIKGLKEYA  125

Query: 121 LQMTNISQAENIHNHIVNTMKLYRETKDE--NLLKLLVCGAGFTGIELAGAMVDERPKYA  178
            + NI+ +  + HI     Y    ++   + L ++V GAGFTGIE  G +      P+
Sbjct: 126 FPIANINTSRLLREHIELQFATYNTEAEKRPDRLTIVVGGAGFTGIEFLGELAARVPELC  185

Query: 179 ALAGVKPEQIEIICVEAATRILPMFDDELAQYGVNLIKDLGINLMLGSMIKEIKPGEVVY  238
             V   + IICVEAA  +LP FD EL  Y V+ +++ G+    +G+ ++E  P  V
Sbjct: 186 KEYDVDRSLVRIICVEAAPTVLPGFDPELVDYAVHYLEENGVEFKIGTAVQECTPEGVRV  245

Query: 239 GTSKEDEELKSITAGTIIWTTGVSGSPVMGESGFDQRRGRVMVNSDLRDPKYDNVYVIGD  298
           G   K+DEE + I + T++W   GV G P++ E+GF+  RGRV VN DLR P +DNV+++GD
Sbjct: 246 G--KKDEEPEQIKSQTVVWAAGVRGHPIVEEAGFENMRGRVKVNPDLRAPGHDNVFILGD  303

Query: 299 VSAFMDTESGRPFPTTAQIATRMGAHVAKNLLHQIKGEATEDFSYSPQGTVASVGNTHGL  358
            S  FM+ ++ RP+P TAQIA + G  VAKNL    IKG   E+F    +GTVAS+G  + +
Sbjct: 304 SSLFMNEDTERPYPPTAQIAMQQGITVAKNLGRLIKGGELEEFKPDIKGTVASLGEHNAV  363

Query: 359 GVVGKTKIKKYPASVMKKIIMNKSLVDMGGLKELLAKGRFDLY                  401
           GVV   K+K  PAS MKK+I N+SL  +GGL   L KG+F   +
Sbjct: 364 GVVYGRKLKGTPASFMKKVIDNRSLFMIGGLGLTLKKGKFKFF                  406
```

There is also homology to SEQ ID 4666.

Based on this analysis, it was predicted that this protein and its epitopes, could be useful antigens for vaccines or diagnostics.

EXAMPLE 1611

A DNA sequence (GBSx1706) was identified in S. agalactiae <SEQ ID 4973> which encodes the amino acid sequence <SEQ ID 4974>. This protein is predicted to be cytochrome d ubiquinol oxidase, subunit I (cydA-1). Analysis of this protein sequence reveals the following:

```
Possible site: 42
>>> Seems to have no N-terminal signal sequence
     INTEGRAL     Likelihood = -6.64    Transmembrane     19-35  (15-38)
     INTEGRAL     Likelihood = -5.73    Transmembrane    226-242 (222-244)
     INTEGRAL     Likelihood = -4.94    Transmembrane    130-146 (126-149)
     INTEGRAL     Likelihood = -4.83    Transmembrane    429-445 (422-446)
     INTEGRAL     Likelihood = -3.77    Transmembrane     55-71  (53-74)
     INTEGRAL     Likelihood = -3.56    Transmembrane    342-358 (340-359)
     INTEGRAL     Likelihood = -1.06    Transmembrane     89-105 (89-106)
     INTEGRAL     Likelihood = -0.59    Transmembrane    186-202 (186-202)

----- Final Results -----
              bacterial membrane --- Certainty = 0.3654(Affirmative) < succ>
              bacterial outside  --- Certainty = 0.0000(Not Clear)   < succ>
              bacterial cytoplasm --- Certainty = 0.0000(Not Clear)  < succ>
```

The protein has homology with the following sequences in the GENPEPT database.

```
>GP: CAB15902 GB: Z99123 cytochrome bd ubiquinol oxidase (subunit I)
[Bacillus subtilis]
Identities = 246/470 (52%), Positives = 319/470 (67%), Gaps = 12/470 (2%)

Query:    6 LARFQFAMTTVFHFFFVPFTIGTCLVVAIMETMYVITKNEEYKKLTKFWGNIMLLSFAVG   65
            LAR QFA TT+FHF FVP +IG   +VA+MET+Y++ KNE Y K+ KFWG++ L++FAVG
Sbjct:    6 LARIQFASTTLFHFLFVPMSIGLVFMVALMETLYLVKKNELYLKMAKFWGHLFLINFAVG   65

Query:   66 VVTGIIQEFQFGMNWSDYSRFVGDIFGAPLAIEALLAFFMESTFLGLWMFTWDNKKISKK  125
            VVTGI+QEFQFG+NWSDYSRFVGD+FGAPLAIEALLAFFMES F+GLW+F WD  ++ KK
Sbjct:   66 VVTGILQEFQFGLNWSDYSRFVGDVFGAPLAIEALLAFFMESIFIGLWIFGWD--RLPKK  123

Query:  126 LHVTFIWLVVFGSLMSAMWILTANSFMQHPVGYEVVNGRAQMTDFLALVKNPQFFYEFTH  185
            +H    IWLV FG++MS+ WILTANSFMQ PVG+ + NGRA+M DF AL+ NPQ + EF H
Sbjct:  124 IHALCIWLVSFGTIMSSFWILTANSFMQEPVGFTIKNGRAEMNDFGALITNPQLWVEFPH  183

Query:  186 VIFGAITMGGTVVAGMSAFRLLKSEQLKDTTVELYKKSVRIGLVVALLGSISVMGVGDLQ  245
            VIFGA+   G   +AG+SAF+LLK ++      V  +K+S ++ ++V L   + V  G +Q
Sbjct:  184 VIFGALATGAFFIAGVSAFKLLKKKE-----VPFFKQSFKLAMIVGLCAGLGVGLSGHMQ  238

Query:  246 MKALIHDQPMKFAAMEGDYEDSGDPAAWSVVAWANEAEHKQVFGIKIPYMLSILSYGKPS  305
            + L+  QPMK AA EG +EDSGDPAAW+   A +   K    IK+PY LS L+Y K S
Sbjct:  239 AEHLMESQPMKMAASEGLWEDSGDPAAWTAPATIDTKNEKSSNEIKVPYALSYLAYQKFS  298

Query:  306 GSVKGMDTANKELVAKYGKDNYYPMVNLLFYGFRTMAAMGTAINGVSVLGLFLTRKKKPI  365
            GSVKGM T    E     YGK +Y P V    F+ FR M    G  ++   ++ GL+L R+KK
Sbjct:  299 GSVKGMKTLQAEYEKIYGKGDYIPPVKTTFWSFRIMVGAGVVMILAALGGLWLNRRKK--  356

Query:  366 LYKHKWMLWIVALTTFAPFLANTFGWIVTEQGRYPWTVYGLFKIKDSVSPNVSVASLFVS  425
                L    KW L I+        PFLAN+ GWI+TE GR PWTV GL      SVSPNV+  SL   S
Sbjct:  357 LENSKWYLRIMIALISFPPLANSAGWIMTEIGRQPWTVMGLMTTAQSVSPNVTAGSLLFS  416

Query:  426 NTVYFLLFGGLAVMMISLTIRELKKGPEYEDEHGHHGAYTSIDPFEEGAY           475
              + +++  L   +++ L IRE+KKG E+++   HH     S DPF +  Y
Sbjct:  417 IIAFGVMYMILGALLVFLFIREIKKGAEHDN---HHDVPVSTDPFSQEVY           463
```

No corresponding DNA sequence was identified in *S. pyogenes*.

Based on this analysis, it was predicted that this protein and its epitopes, could be useful antigens for vaccines or diagnostics.

EXAMPLE 1612

A DNA sequence (GBSx1707) was identified in *S. agalactiae* <SEQ ID 4975> which encodes the amino acid sequence <SEQ ID 4976>. This protein is predicted to be cytochrome oxidase subunit 11 (cydB-1). Analysis of this protein sequence reveals the following:

```
Possible site: 22
>>> Seems to have an uncleavable N-term signal seq
    INTEGRAL    Likelihood = -14.49    Transmembrane   226-242 (220-250)
    INTEGRAL    Likelihood =  -8.12    Transmembrane   254-270 (250-282)
    INTEGRAL    Likelihood =  -7.64    Transmembrane   198-214 (196-218)
    INTEGRAL    Likelihood =  -6.95    Transmembrane    85-101 (76-103)
    INTEGRAL    Likelihood =  -6.74    Transmembrane     6-22  (1-27)
    INTEGRAL    Likelihood =  -6.16    Transmembrane   300-316 (298-322)
    INTEGRAL    Likelihood =  -5.36    Transmembrane   119-135 (117-143)
    INTEGRAL    Likelihood =  -4.04    Transmembrane   159-175 (155-178)

----- Final Results -----
         bacterial membrane --- Certainty = 0.6795(Affirmative) < succ>
          bacterial outside --- Certainty = 0.0000(Not Clear) < succ>
        bacterial cytoplasm --- Certainty = 0.0000(Not Clear) < succ>
```

The protein has homology with the following sequences in the GENPEPT database.

```
>GP: CAB15901 GB: Z99123 cytochrome bd ubiquinol oxidase (subunit II)
[Bacillus subtilis]
Identities = 158/331 (47%), Positives = 223/331 (66%), Gaps = 1/331 (0%)

Query:    1 MSALQFFWFFLIGLLFSGFFFLEGFDFGVGMAVQTLTHNEHEKDQVVETIGPVWDGNEVW  60
            M++L   WF L+ +LF GFFFLEGFDFGVGMA + L HNE E+  ++ TIGP WD NEVW
Sbjct:    1 MASLHDLWFILVAVLFVGFFFLEGFDFGVGMATRFLGHNELERRVLINTIGPFWDANEVW  60

Query:   61 LLTGGGAMFASFPYWYASLFSGYYLILLTILFGLIIRGVSFEFRHKVPAEK-KQFWNWTL 119
            LLTG GA+FA+FP WYA++ SGYY+  + +L  L+ RGV+FEFR KV   K  + W+W +
Sbjct:   61 LLTGAGAIFAAFPNWYATMLSGYYIPFVIVLLALMGRGVAFEFRGKVDHLKWVKVWDWVV 120

Query:  120 TIGSAIVPFFFGIMFISLIQGMPLDASGNLSAQFSDYFNIFSLVGGVAMVLLAYLHGLNY 179
             GS I PF  G++F +L +GMP+DA   N+ A   SDY N++S++GGV + LL + HGL +
Sbjct:  121 FFGSLIPPFVLGVLFTTLFRGMPIDADMNIHAHVSDYINVYSILGGVTVTLLCFQHGLMF 180

Query:  180 IALKTEGPIRERARNYAQLLYWVLYLGLALFAVLLYFKTDFFSNHPIVTTIMVLVIVVLA 239
            I  L+T G ++ RAR  AQ +  V+++ +  FA L  ++TD F+     +T + ++IV+
Sbjct:  181 ITLRTIGDLQNRARKMAQKIMGVVFVAVLAFAALSAYQTDMFTRRGEITIPLAVLIVICF 240

Query:  240 VLAHASTFKGAEMTAFLASGLSLVSVVVLLFQGLFPRVMISSISPKYDLLIQNASSTPYT 299
            +LA    K +   F  +G L   V ++F LFPRVM+SS+    YDL + NASS Y+
Sbjct:  241 MLAAVFIRKKKDGWTFGMTGAGLALTVGMIFISLFPRVMVSSLHSAYDLTVANASSGDYS 300

Query:  300 LKVMSIVAITLVPFVLAYTAWAYYIFRKRIT                             330
            LKVMSI A+TL+PFV+     W+YY+FRKR++
Sbjct:  301 LKVMSIAALTLLPFVIGSQIWSYYVFRXRVS                             331
```

No corresponding DNA sequence was identified in *S. pyogenes*.

Based on this analysis, it was predicted that this protein and its epitopes, could be useful antigens for vaccines or diagnostics.

EXAMPLE 1613

A DNA sequence (GBSx1708) was identified in *S. agalactiae* <SEQ ID 4977> which encodes the amino acid sequence <SEQ ID 4978>. Analysis of this protein sequence reveals the following:

```
Possible site: 29
>>> Seems to have an uncleavable N-term signal seq

----- Final Results -----
         bacterial membrane --- Certainty = 0.0000(Not Clear) < succ>
          bacterial outside --- Certainty = 0.0000(Not Clear) < succ>
         bacterial cytoplasm --- Certainty = 0.0000(Not Clear) < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1614

A DNA sequence (GBSx1709) was identified in *S. agalactiae* <SEQ ID 4979> which encodes the amino acid sequence <SEQ ID 4980>. This protein is predicted to be transport ATP-binding protein cydc (cydD). Analysis of this protein sequence reveals the following:

```
Possible site: 27
>>> Seems to have an uncleavable N-term signal seq
         INTEGRAL    Likelihood = -16.82     Transmembrane    158-174 (144-182)
         INTEGRAL    Likelihood =  -6.48     Transmembrane     15-31  (14-34)
         INTEGRAL    Likelihood =  -5.31     Transmembrane    243-259 (238-266)
         INTEGRAL    Likelihood =  -2.55     Transmembrane    136-152 (134-152)
         INTEGRAL    Likelihood =  -0.48     Transmembrane    263-279 (263-279)

----- Final Results -----
         bacterial membrane --- Certainty = 0.7729(Affirmative) < succ>
          bacterial outside --- Certainty = 0.0000(Not Clear)   < succ>
         bacterial cytoplasm --- Certainty = 0.0000(Not Clear)  < succ>
```

The protein has homology with the following sequences in the GENPEPT database.

```
>GP: CAB15900 GB: Z99123 ABC membrane transporter (ATP-binding
protein) [Bacillus subtilis]
Identities = 279/569 (49%), Positives = 401/569 (70%), Gaps = 6/569 (1%)

Query:   2 LDKAVMRLSGIHKLLGLLAGLDVLQAIFIIGQAYYLSLSITGLWEGQKLSSQTVYILLFM   61
           + K + R  G+ ++L L+  L ++Q   II QA +LS ++TGL+ G+ ++S    I  F+
Sbjct:   1 MGKDLFRYKGMKRILTLITCLTLIQTAAIIMQAEWLSEAVTGLFNGRGITSLLPVIGFFL   60

Query:  62 VSYLGRHVIDYIKNRKLDDFSTAQSSLLRRQLLDKLFDLGPKVVQEQGTGNVVTMALDGV  121
           ++++ RH +   + + ++     + LR+   LD+LF LGP+   +++GTG +VT+A++G+
Sbjct:  61 IAFIARHGMTVARQKIVYQYAARTGADLRKSFLDQLFRLGPRFAKKEGTGQMVTLAMEGI  120

Query: 122 SLVENYLRLVLNKMINMSIIPWIILAYIFYLDIESGAILLIVFPLIIIFMIILGYAAQAK  181
           S    YL L L KM++M+I+P  ++ Y+F+ D  S   IL+    P++IIFMI+LG  AQ K
Sbjct: 121 SQFRRYLELFLPKMVSMAIVPAAVVIYVFFQDRTSAIILVAAMPILIIFMILLGLVAQRK  180

Query: 182 ADKQYESYQVLSNHFLDSLRGIDTLKYFGLSKRYGKSIYQTSESFRKATMSTLKIGILST  241
           AD+Q++SYQ LSNHF+DSLRG++TL++ GLSK + K+I+  SE +RKATMSTL++  LS+
Sbjct: 181 ADRQWKSYQRLSNHFVDSLRGLETLRFLGLSKSHSKNIFYVSERYRKATMSTLRVAFLSS  240

Query: 242 FALDEFTTLSIAIVAVFLGLRLLNEQIYLLPALTILILSPEYFLPVRDFSSDYHATLDGK  301
           FALDFFT LS+A VAVFLGLRL++    I L  PALT LIL+PEYFLPVR+  +DYHATL+G+
Sbjct: 241 FALDFFTMLSVATVAVFLGLRLIDGDILLGPALTALILAPEYFLPVREVGNDYHATLNGQ  300

Query: 302 NAFQAIQKVLHKTGIKGE-QLVIDDWSKESRLDLENIAIAYDQKRVVEDVTLRFRGHQKV  360
              A + IQ++L++  G K E  L ++ WS  +  L L   +++     R V D+ L F+G +K+
Sbjct: 301 EAGRTIQEILSQPGFKEETPLQLEAWSDQDELKLSGVSVG----RSVSDIHLSFKGKKKI  356

Query: 361 ALVGVSGSGKSSLINLLSGFLGPDNGSLKVDGREVTNLDQEDWHKQMIYIPQTPYVFEMS  420
            ++G SG+GKS+LI++L GFL PD G ++V+G    ++L   W K ++YIPQ PY+F+  +
Sbjct: 357 GIIGASGAGKSTLIDILGGFLEPDGGMIEVNGTSRSHLQDGSWQKNLLYIPQHPYIFDDT  416

Query: 421 LRDNITFYTPNASDEEVVRAIHMVGLDSLLSELPDGLETRIGNGARPLSGGQAQRIALAR  480
           L +NI FY P+AS E+  RA     GL  L++ LPDGLE RIG G R LSGGQAQR+ALAR
Sbjct: 417 LGNNIRFYHPSASAEDTTRAAASAGLTELVNNLPDGLEGRIGEGGRALSGGQAQRVALAR  476

Query: 481 AFLDQNRRIMVFDEPTAHLDIETELELKEKMLPLMSDRLVIFATHRLHWLNQMDVIVVME  540
           AFL  NR I++ DEPTAHLDIETE E+KE ML L  D+LV  ATHRLHW+  MD I+V++
Sbjct: 477 AFLG-NRPILLLDEPTAHLDIETEYEIKETMLDLFEDKLVFLATHRLHWMLDMDEIIVLD  535

Query: 541 KGRVAEVGSYQELLAKKGYLYQLKHAMGG                                569
           GRVAE+G++ ELL K G  +L   A G
Sbjct: 536 GGRVAEIGTHNELLEKNGVYTKLVKAQLG                                564
```

A related DNA sequence was identified in *S. pyogenes* [40] <SEQ ID 4981> which encodes the amino acid sequence <SEQ ID 4982>. Analysis of this protein sequence reveals the following:

```
     Possible site: 53
>>> Seems to have no N-terminal signal sequence
INTEGRAL Likelihood =  -10.61 Transmembrane 159-175 (154-190)
INTEGRAL Likelihood =  -10.03 Transmembrane  70-86  (63-91)
INTEGRAL Likelihood =   -3.03 Transmembrane 282-298 (282-301)
INTEGRAL Likelihood =   -1.44 Transmembrane 261-277 (260-278)

----- Final Results -----
            bacterial membrane --- Certainty = 0.5246 (Affirmative) < succ>
             bacterial outside --- Certainty = 0.0000 (Not Clear)  < succ>
           bacterial cytoplasm --- Certainty = 0.0000 (Not Clear)  < succ>
```

[55]

The protein has homology with the following sequences in the databases:

```
>GP: AAC22320 GB: U32749 ATP-binding transport protein (cydD)
[Haemophilus influenzae Rd]
Identities = 167/544 (30%), Positives = 279/544 (50%), Gaps 15/544 (2%)

Query:  46 MISFYLIAKTFSTFILGHAIALGRLAGLLLLLNVVGFVLAILGK---QLQGIASQFARDS  102
           + S+ L A  F     L A+ LG +  L L        A GK    Q   AS +
Sbjct:  17 VFSYILQAAYFHELSLLSAVILGIVLIAALALR------AFAGKKSVQASYFASTKVKHE   70
```

-continued

```
Query: 103 LKQSFFEAFIDLDGQFDAHASDADILTLASQGIDSLDTYYGYYL-SLSMRTKWNCTTIMI 161
            L+  +     +        S + I+ +AS+G++ L+ Y+G YL  L        T
Sbjct:  71 LRSLIYRKLASMPLNQVNQQSTSSIIQVASEGVEQLEIYFGRYLPQLFYSLLAPLTLFAF 130

Query: 162 LVFLIYPLAGLVFLGVLPLIPLSIVAMQKRSQPNMSHYWSSYMDVGNLFMDDLKGLNTLY 221
            L+F + A ++ L +PLIP+SI+A+ K ++   ++ YWS Y+ +G+ F+D+L+GL TL
Sbjct: 131 LIFFSFKTA-IILLICVPLIPMSIIAVNKIAKKLLAKYWSIYVGLGSSFLDNLQGLITLK 189

Query: 222 SYQATERYEQEFSGKAEQFRKATMSLLGFQLQAVGYMDAVMYLGIGLSGFLAVQALATGQ 281
               YQ        +AE FRK TM +L  QL +V MD + YG +    A+         Q
Sbjct: 190 IYQDDAYKAKAMDKEAEHFRKITMKVLTMQLNSVSLMDLLAYGGAAIGILTALLQFQNAQ 249

Query: 282 LSFFNFLFFLLIATEFFTPIREQGYGMHLVMMNTKMADRIFSFLDS-VPARKDNKSKTAI 340
            LS     + F+L+++EFF P+R  G    H+ M      +D+IF+ LD+ V  ++     A
Sbjct: 250 LSVLGVILFILLSSEFFIPLRLLGSFFHVAMNGKAASDKIFTLLDTPVETQQSAVDFEAK 309

Query: 341 NFNQIDIQNISLAY-EKKTVLSGVTMTLTKGQLTAIAGVSGQGKTSLAQLLLKRQSATTG 399
            N  Q++I+++  +Y E+K  ++G+ +++    QL+  G SG GK++L  LL+    A G
Sbjct: 310 NNVQVEIKDLHFSYSEEKPAITGLNLSILPNQLSVFVGKSGCGKSTLVSLLMGFNKAQQG 369

Query: 400 HILFDGLDSDNLSQETINQQVLYVSDQSTLLNRSIYDNLRLA-ANLSKKEILDWIDQHGL 458
             ILF+G ++ N+ + +  Q+V  VS  S +   ++ +N+ +A  + + ++I    ++Q  L
Sbjct: 370 EILFNGQNALNIDRTSFYQKVSLVSHSSYVFKGTLRENMTMAKIDATDEQIYACLEQVNL 429

Query: 459 LSFINWLPDGLDTIVGENGNLLSPGQKQQVICARALLSKRSLYIFDEATSSLDAENERII 518
              F+     GLD +  G  LS GQ Q++ ARALL    LYIFDEATS++D E+E II
Sbjct: 430 AQFVR-DNGGLDMQLLSRGANLSGGQIQRLALARALLHNAELYIFDEATSNIDVESEEII 488

Query: 519 DNLITRLAKTAIVIVITHKMSRLKGANQVLFLNTGQPACLGKPCDLYRDQPTYRHLVDTQ 578
                I + +   +++I+H+++    A+ + L+ G+    G    +L  Q Y +    Q
Sbjct: 489 LQFIQQFKQQKTIVMISHRLANAVNADCINVLDQGKLIEQGTHKELMEKQGAYAEMFQQQ 548

Query: 579 ARLE                                                       582
             LE
Sbjct: 549 KDLE                                                       552
```

An alignment of the GAS and GBS proteins is shown below.

```
Identities = 143/552 (25%), Positives = 260/552 (46%), Gaps = 12/552 (2%)

Query:   1 MLDKAVMRLSGIHKLLGLLAGLDVLQAIFIIGQAYYLSLSITGLWEGQKLSSQTVYILLF   60
           +L +   R++     LL + A L LQ +  +  Y ++ + +   G  ++  +  LL
Sbjct:  16 LLKRLRERIAPKRYLLYVSAFLSWLQFVMRMISFYLIAKTFSTFILGHAIALGRLAGLLL   75

Query:  61 MVSYLGRHVIDYIKNRKLDDFSTAQSSLLRRQLLDKLFDLGPKVVQEQGTGNVVTMALDG  120
            +++ +G V+ + +     S     L++  + DL +         +++T+A  G
Sbjct:  76 LLNVVG-FVLAILGKQLQGIASQFARDSLKQSFFEAFIDLDGQFDAHASDADILTLASQG  134

Query: 121 VSLVENYLRLVLNKMINMSIIPWIILAYIFYLDIESGAILLIVFPLIIIFMIILGYAAQA  180
             + ++ Y    L+ +        I+ +F +  +G + V PLI + ++ +    +Q
Sbjct: 135 IDSLDTYYGYYLSLSMRTKWNCTTIMILVFLIYPLAGLVFLGVLPLIPLSIVAMQKRSQP  194

Query: 181 KADKQYESYQVLSNHFLDSLRGIDTLKYFGLSKRYGKSIYQTSESFRKATMSTLKIGILS  240
              + SY  + N F+D L+G++TL + ++RY +    +E FRKATMS L  +  +
Sbjct: 195 NMSHYWSSYMDVGNLFMDDLKGLNTLYSYQATERYEQEFSGKAEQFRKATMSLLGFQLQA  254

Query: 241 TFALDFFTTLSIAIVAVFLGLRLLNEQIYLLPALTILILSPEYFLPVRDFSSDYHATLDG  300
             +D    L I +      L    Q+     L L+++ E+F P+R+       H +
Sbjct: 255 VGYMDAVMYLGIGLSGFLAVQALATGQLSFFNFLFFLLIATEFFTPIREQGYGMHLVMMN  314

Query: 301 KNAFQAIQKVLNKTGIKGEQLVIDDWSKE----SRLDLENIAIAYDQKRVVEDVTLRFRG  356
                I  L+     +   D+ SK    +++D++NI++AY++K V+   VT+
Sbjct: 315 TKMADRIFSFLDSVPARK-----DNKSKTAINFNQIDIQNISLAYEKKTVLSGVTMTLTK  369

Query: 357 HQKVALVGVSGSGKSSLINLLSGFLGPDNGSLKVDGREVTNLDQEDWHKQMIYIPQTPYV  416
              Q  A+ GVSG GK+SL  LL    G +  DG +  NL QE ++Q++Y+ +
Sbjct: 370 GQLTAIAGVSGQGKTSLAQLLLKRQSATTGHILFDGLDSDNLSQETINQQVLYVSDQSTL  429

Query: 417 FEMSLRDNITFYTPNASDEEVVRAIHMVGLDSLLSELPDGLETRIGNGARPLSGGQAQRI  476
              S+ DN+    N S +E++  I   GL S ++  LPDGL+T +G    LS GQ Q++
Sbjct: 430 LNRSIYDNLRL-AANLSKKEILDWIDQHGLLSFINWLPDGLDTIVGENGNLLSPGQKQQV  488
```

```
                              -continued
Query:  477 ALARAFLDQNRRIMVFDEPTAHLDIETELELKEKMLPLMSDRLVIFATHRLHWLNQMDVI  536
            ARA L + R + +FDE T+ LD E E  +   + L   +VI  TH++  L   + +
Sbjct:  489 ICARALLSK-RSLYIFDEATSSLDAENERIIDNLITRLAKTAIVIVITHKMSRLKGANQV  547

Query:  537 VVMEKGRVAEVG                                                  548
            + +   G+ A +G
Sbjct:  548 LFLNTGQPACLG                                                  559
```

Based on this analysis, it was predicted that these proteins and their epitopes could be useful antigens for vaccines or diagnostics.

EXAMPLE 1615

A DNA sequence (GBSx1710) was identified in *S. agalactiae* <SEQ ID 4983> which encodes the amino acid sequence <SEQ ID 4984>. This protein is predicted to be transport ATP-binding protein cydd (cydC). Analysis of this protein sequence reveals the following:

```
Possible site: 49
>>> Seems to have no N-terminal signal sequence
INTEGRAL Likelihood = -12.84  Transmembrane 260-276 (258-284)
INTEGRAL Likelihood =  -9.34  Transmembrane 172-188 (147-199)
INTEGRAL Likelihood =  -6.53  Transmembrane 150-166 (147-171)
INTEGRAL Likelihood =  -6.05  Transmembrane  31-47  (29-52)
INTEGRAL Likelihood =  -3.35  Transmembrane  68-84  (67-84)
INTEGRAL Likelihood =  -1.17  Transmembrane 293-309 (292-310)
INTEGRAL Likelihood =  -0.69  Transmembrane 494-510 (493-510)

----- Final Results -----
             bacterial membrane --- Certainty = 0.6137 (Affirmative) < succ>
              bacterial outside --- Certainty = 0.0000 (Not Clear)   < succ>
            bacterial cytoplasm --- Certainty = 0.0000 (Not Clear)   < succ>
```

A related GBS nucleic acid sequence <SEQ ID 10127> which encodes amino acid sequence <SEQ ID 10128> was also identified.

The protein has homology with the following sequences in the GENPEPT database.

```
>GP: CAB15899 GB: Z99123 ABC membrane transporter (ATP-binding
protein) [Bacillus subtilis]
Identities = 262/573 (45%), Positives = 389/573 (67%), Gaps = 14/573 (2%)

Query:   16 LKTDQWIKPFFKQYKVSLVIALFLGFMTFFSASALMFNSGYLISKSASLPSNILLVYVPI   75
            +K ++WI P+ KQ     V+ +FLG +T FSA+ LMF SG+LISK+A+ P NILL+YVPI
Sbjct:    1 MKKEEWILPYIKQNARLFVLVIFLGAVTIFSAAFLMFTSGFLISKAATRPENILLIYVPI   60

Query:   76 VLTRAFGIGRPVFRYIERLTSHNWVLRMTSQLRLKLYHSLESNAIFMKRDFRLGDVMGLL  135
            V R FGI R V RY+ERL  H+ +L++ S +R++LY+ LE  A+ ++  FR GD++G+L
Sbjct:   61 VAVRTFGIARSVSRYVERLVGHHIILKIVSDMRVRLYNMLEPGALMLRSRFRTGDMLGIL  120

Query:  136 AEDINYLQNLYLRTIFPTIIAWILYSFIIIATGFFSLWFALMMLLYLAIMIFLFPLWSIL  195
            +EDI +LQ+ +L+TIFP I A +LY+  +IA GFFS  FA+++ LYL +++ LFP  S+L
Sbjct:  121 SEDIEHLQDAFLKTIFPAISALLLYAVSVIALGFFSWPFAILLALYLFVLVVLFPVVSLL  180

Query:  196 ANGARQTREKELKNHLYTDLTDNVLGISDWIFSQRGQEYVALHERSESELMAVQKKIRSF  255
            A+    + K   +N LY+ LTD V+G+SDW+FS R    ++ +E+ E +   +++K + F
Sbjct:  181 VTRAKNAKLKSGRNVLYSRLTDAVMGVSDWMFSGRRHAFIDAYEKEERDWFELERKKQRF  240

Query:  256 DNRRALIVELVFGFLAILVIIWASNQFIGHRGGEA--NWIAAFVLTVFPLSEAFAGLSAA  313
             +R    + +  L +L++ W + Q       GE    IAAFVL VFPL+EAF  LS A
Sbjct:  241 TRWRDFAAQCLVAGLILLMLFWTAGQ---QADGELAKTMIAAFVLVVFPLTEAFLPLSDA  297

Query:  314 AQETNKYSDSIHRLN------ELSETYFETTQNQLPNKPYDFSVKNLSFQYKPQEKWVLH  367
             +E   Y DSI R+N       E S+T E+    L +   + ++++F Y   + VLH
Sbjct:  298 LGEVPGYQDSIRRMNNVAPQPEASQT--ESGDQILDLQDVTLAFRDVTFSYDNSSQ-VLH  354

Query:  368 HLDLDIKEGEKIAILGRSGSGKSTLASLLRGDLKASQGEITLGDADVSIVGDCISNYIGV  427
              +    +++GEK+A+LGRSGSGKST +L+  G LK     G +TL    + +++ D I++ + V
Sbjct:  355 NFSFTLRQGEKMALLGRSGSGKSTSLALIEGALKPDSGSVTLNGVETALLKDQIADAVAV  414
```

-continued

```
Query: 428 IQQAPYLFNTTLLNNIRIGNQDASEEDVWKVLERVGLKEMVTDLSDGLYTMVDEAGLRFS 487
            + Q P+LF+T++LNNIR+GN +AS+EDV +  ++V L + +  L DG +T V E G+RFS
Sbjct: 415 LNQKPHLFDTSILNNIRLGNGEASDEDVRRAAKQVKLHDYIESLPDGYHTSVQETGIRFS 474

Query: 488 GGERHRIALARILLKDVPIVILDEPTVGLDPITEQALLRVFMKELEGKTLVWITHHLKGI 547
            GGER RIALARILL+D PI+ILDEPTVGLDPITE+ L+    + L+GKT++WITHHL G+
Sbjct: 475 GGERQRIALARILLQDTPIIILDEPTVGLDPITERELMETVFEVLKGKTILWITHHLAGV 534

Query: 548 EHADRILFIENGQLELEGSPQELSQSSQRYRQL                           580
            E AD+I+F+ENG+ E+EG+ +EL   +++RYR+L
Sbjct: 535 EAADKIVFLENGKTEMEGTHEELLAANERYRRL                           567
```

A related GBS gene <SEQ ID 8861> and protein <SEQ ID 8862> were also identified. Analysis of this protein sequence reveals the following:

```
Lipop: Possible site: -1 Crend: 8
McG: Discrim Score: -15.90
GvH: Signal Score (-7.5): 1.97
     Possible site: 49
>>> Seems to have no N-terminal signal sequence
ALOM program count: 7 value: -12.84 threshold: 0.0
INTEGRAL Likelihood = -12.84  Transmembrane 260-276 (258-284)
INTEGRAL Likelihood =  -9.34  Transmembrane 172-188 (147-199)
INTEGRAL Likelihood =  -6.53  Transmembrane 150-166 (147-171)
INTEGRAL Likelihood =  -6.05  Transmembrane  31-47  (29-52)
INTEGRAL Likelihood =  -3.35  Transmembrane  68-84  (67-84)
INTEGRAL Likelihood =  -1.17  Transmembrane 293-309 (292-310)
INTEGRAL Likelihood =  -0.69  Transmembrane 494-510 (493-510)
PERIPHERAL Likelihood = 3.29    412
 modified ALOM score: 3.07

*** Reasoning Step: 3

----- Final Results -----
              bacterial membrane --- Certainty = 0.6137 (Affirmative) < succ>
              bacterial outside  --- Certainty = 0.0000 (Not Clear)   < succ>
              bacterial cytoplasm --- Certainty = 0.0000 (Not Clear)   < succ>
```

The protein has homology with the following sequences in the databases:

```
ORF00997(346-2052 of 2364)
EGAD|98910|BS3866(1-571 of 575) transport ATP-binding protein cydd {Bacillus
subtilis} OMNI|NT01BS4517 ABC transporter CydC, putative SP|P94367|CYDD_BACSU
TRANSPORT ATP-BINDING PROTEIN CYDD. GP|1783253|dbj|BAA11730.1||D83026 homologous
to many ATP-binding transport proteins; hypothetical {Bacillus subtilis}
GP|2636408|emb|CAB15899.1||Z99123 ABC membrane transporter (ATP-binding protein)
{Bacillus subtilis} PIR|D69611|D69611 ABC transporter required for expression of
cytochrome bd (ATP-)cydD-Bacillus subtilis
% Match = 31.9
% Identity = 45.2    % Similarity = 69.1
Matches = 257 Mismatches = 172 Conservative Sub.s = 136

300        330        360        390        420        450        480        510
LKKDISIN*SMLWEEMMFKIPLFKELKTDQWIKPFFKQYKVSLVIALFLGFMTFFSASALMFNSGYLISKSASLPSNILL
                                  :| ::|| |: ||     :|: :||| :| ||| ||| ||:||||:| ||||
                                  MKKEEWILPYIKQNARLFVLVIFLGAVTIFSAAFLMFTSGFLISKAATRPENILL
                                     10         20         30         40         50

540        570        600        630        660        690        720        750
VYVPIVLTRAFGIGRPVFRYIERLTSHNWVLRMTSQLRLKLYHSLESNAIFMKRDFRLGDVMGLLAEDINYLQNLYLRTI
:|||| | ||| | ||:||| |: :|:: | :|::|: ||  |: ::    || ||::|:|:||| :||: :|:||
IYVPIVAVRTFGIARSVSRYVERLVGHHIILKIVSDMRVRLYNMLEPGALMLRSRFRTGDMLGILSEDIEHLQDAFLKTI
 70         80         90        100        110        120        130

780        810        840        870        900        930        960        990
FPTIIAWILYSFIIIATGFFSLWFALMMLLYLAIMIFLFPLWSILANGARQTREKELKNHLYTDLTDNVLGISDWIFSQR
||| |  :||:  :||  ||| ||  ||::: :||  :||: |:|  |    :| ||: |||  |:|:||| ||
FPAISALLLYAVSVIALGFFSWPFAILLALYLFVLVVLFPVVSLLVTRAKNAKLKSGRNVLYSRLTDAVMGVSDWMFSGR
150        160        170        180        190        200        210

1020       1050       1080       1110       1140            1194       1224
GQEYVALHERSESELMAVQKKIRSFDNRRALIVELVFGFLAILVIIWASNQFIGHRGGE--ANWIAAFVLTVFPLSEAFA
: ::   :|: |  :  :::|    |      |:   |:| |   :   :  ||       ||||| ||||:|||
RHAFIDAYEKEERDWFELERKKQRFTRWRDFAAQCLVAGLILLMLFWTAGQ---QADGELAKTMIAAFVLVVFPLTEAFL
    230        240        250        260        270        280        290
```

```
                  -continued
1254      1284      1302      1332      1362      1392      1422      1452
GLSAAAQETNKYSDSIHRLNELS----ETYFETTQNQLPNKPYDFSVKNLSFQYKPQEKWVLHHLDLDIKEGEKIAILGR
||| |    | ||| :|  ::      :    |:    |   :    :: ::::|  |      |||::  : :::|||:|||
PLSDALGEVPGYQDSIRRMNNVAPQPEASQTESGDQILDLQDVTLAFRDVTSSY-DNSSQVLHNFSFTLRQGEKMALLGR
              310       320       330       340       350       360       370
1482      1512      1542      1572      1602      1632      1662      1692
SGSGKSTLASLLRGDLKASQGEITLGDADVSIVGDCISNYIGVIQQAPYXFNTTLLNTFRIGNQDASEEDVWKVLERVGL
||||||| :|: ||| |     |:||  | :::  |  |::  :   |: | | : |:|::||   |:|  :||:|||  :  ||
SGSGKSTSLALIEGALKPDSGSVTLNGVETALLKDQIADAVAVLNQKPHLFDTSILNNIRLGNGEASDEDVRRAAKQVKL
              390       400       410       420       430       440       450
1722      1752      1782      1812      1842      1872      1902      1932
KEMVTDLSDGLYTMVDEAGLRFSGGERHRIALARILLKDVPIVILDEPTVGLDPITEQALLRVFMKELEGKTLVWITHHL
  : :    |  ||  : |   |  | |:|||||||:|||||||||||:|  ||:|||||||||||||: |:       :  |:|||::|||||
HDYIESLPDGYHTSVQETGIRFSGGERQRIALARILLQDTPIIILDEPTVGLDPITERELMETVFEVLKGKTILWITHHL
              470       480       490       500       510       520       530
1962      1992      2022      2052      2082      2112      2142      2172
KGIEHADRILFIENGQLELEGSPQELSQSSQRYRQLKASDDGDLLIGAINK*KNIP*LLF*HCGMFFYYLNFAF*K
|:|  ||:|:|:|||:  |:||: ::||    :::|||:|  |
AGVEAADKIVFLENGKTEMEGTHEELLAANERYRRLYHLDVPVK
              550       560       570
```

There is also homology to SEQ ID 478.

Based on this analysis, it was predicted that these proteins and their epitopes could be useful antigens for vaccines or diagnostics.

EXAMPLE 1616

A DNA sequence (GBSx1711) was identified in *S. agalactiae* <SEQ ID 4987> which encodes the amino acid sequence <SEQ ID 4988>. This protein is predicted to be spore germination protein C3 (ispB). Analysis of this protein sequence reveals the following:

```
Possible site: 45
>>> Seems to have no N-terminal signal sequence
    INTE- Likelihood = -1.06 Transmembrane 111-127 (111-128)
GRAL ----- Final Results -----
              bacterial membrane --- Certainty = 0.1426 (Affirmative) < succ>
              bacterial outside  --- Certainty = 0.0000 (Not Clear)   < succ>
              bacterial cytoplasm --- Certainty = 0.0000 (Not Clear)   < succ>
```

The protein has homology with the following sequences in the GENPEPT database.

```
>GP: CAB14190 GB: Z99115 heptaprenyl diphosphate synthase component II
[Bacillus subtilis]
Identities = 101/318 (31%), Positives = 184/318 (57%), Gaps = 5/318 (1%)

Query:   8 YPELKKNIDETNQLIQERIQVRNKDIEAALSQLTAAGGKQLRPAFFYLFSQLGNKENQDT   67
           Y L +ID  + +++ ++     +   A    L  AGGK++RP F  L    G+     D
Sbjct:  35 YSFLNDDIDVIERELEQTVRSDYPLLSEAGLHLLQAGGKRIRPVFVLLSGMFGD---YDI   91

Query:  68 QQLKKIAASLEILHVATLIHDDVIDDSPLRRGNMTIQSKFGKDIAVYTGDLLFTVFFDLI  127
              ++K +A +LE++H+A+L+HDDVIDD+ LRRG  TI++K+   IA+YTGD +    +++
Sbjct:  92 NKIKYVAVTLEMIHMASLVHDDVIDDAELRRGKPTIKAKWDNRIAMYGDYMLAGSLEMM  151

Query: 128 LESMADTPFMRINAKSMRKILMGELDQMHLRYNQQQGIHHYLRAISGKTAELFKLASKEG  187
           + +    RI ++++ ++ +GE++Q+  +YN +Q +    YLR I  KTA L  ++ + G
Sbjct: 152 TR-INEPKAHRILSQTIVEVCLGEIEQIKDKYNMEQNLRTYLRRIKRKTALLIAVSCQLG  210

Query: 188 AYFGGAEKEVVRLAGHIGFNIGMTFQILDDILDYTADKKTFNKPVLEDLAQGIYSLPLLL  247
            A   GA++++ +      G+ +GM++QI+DDILD+T+ ++   KPV DL QG +LP+L
Sbjct: 211 AIASGADEKIHKALYWFGYYVGMSYQIIDDILDFTSTEEELGKPVGGDLLQGNVTLPVLY  270

Query: 248 AIEENPDIFKPILDKKTDMATEDMEKIAYLVVSHRGVDKARHLARKFTEKAISDINKLPQ  307
           A+ +NP +    +   ++ E +E I   + ++ + ++ + +KA   +N LP+
Sbjct: 271 AL-KNPALKNQLKLINSETTQEQLEPIIEEIKKTDAIEASMAVSEMYLQKAFQKLNTLPR  329

Query: 308 SSAKKQLLQLTNYLLKRK                                            325
           A+   L +  Y+ KRK
Sbjct: 330 GRARSSLAAIAKYIGKRK                                            347
```

There is also homology to SEQ ID 284. An alignment of the GAS and GBS proteins is shown below:

```
Identities = 65/227 (28%), Positives = 98/227 (42%), Gaps = 9/227 (3%)

Query:   43 AGGKQLRPAFFYLFSQLGNKENQDTQQLKKIAASLEILHVATLIHDDV--IDDSPLRRGN  100
            +GGK++RP      +    Q+    +AA+LE++H +LIHDD+  +D+   RRG
Sbjct:   36 SGGKRIRPLILLEMIEGFGVSLQNAHF--DLAAALEMIHTGSLIHDDLPAMDNDDYRRGR  93

Query:  101 MTIQSKFGKDIAVYTGDLLFTVFFDLILESM--ADTPFMRINAKSMRKILMGELDQMHLR  158
            +T  +FG+ A+ GD LF  F LI ++   ++    I   S+   G +     L
Sbjct:   94 LTNHKQFGEATAILAGDSLFLDPFGLIAQAELNSEVKVALIQELSLASGTFGMVGGQMLD  153

Query:  159 Y---NQQQGIHHYLRAISGKTAELFKLASKEGAYFGGAEKEVVRLAGHIGFNIGMTFQIL  215
                NQ  +      KT +L   K A      V +    G IG  FQI
Sbjct:  154 MKGENQALSLPQLSLIHLNKTGKLLAFPFKAAALITEQAMTVRQQLEQAGMLIGHAFQIR  213

Query:  216 DDILDYTADKKTFNKPVLEDLAQGIYSLPLLLAIEENPDIFKPILDK               262
            DDILD TA  +   K  +DL    + P LL +E +  +    LD+
Sbjct:  214 DDILDVTASFEDLGKTPKKDLFAEKATYPSLLGLEASYQLLTESLDQ                260
```

Based on this analysis, it was predicted that these proteins and their epitopes could be useful antigens for vaccines or diagnostics.

EXAMPLE 1617

A DNA sequence (GBSx1712) was identified in *S. agalactiae* <SEQ ID 4989> which encodes the amino acid sequence <SEQ ID 4990>. Analysis of this protein sequence reveals the following:

```
Possible site: 49
>>> Seems to have no N-terminal signal sequence

----- Final Results -----
            bacterial cytoplasm --- Certainty = 0.3995 (Affirmative) < succ>
             bacterial membrane --- Certainty = 0.0000 (Not Clear) < succ>
              bacterial outside --- Certainty = 0.0000 (Not Clear) < succ>
```

The protein has homology with the following sequences in the GENPEPT database.

```
>GP: AAA25232 GB: M58315 dipeptidyl peptidase IV [Lactococcus lactis]
Identities = 385/767 (50%), Positives = 504/767 (65%), Gaps = 21/767 (2%)

Query:    1 MRYNQFSYIPTKPNEAFEELKGLGFPLNKKNSDKANLEAFLRHSFLNQTDTDYALSLLIV  60
            MR+N FS +   +E  EL LGF +    +K  L+ FL  S + TD        L
Sbjct:    1 MRFNHFSIVDKNFDEQLAELDQLGFRWSVFWDEKKILKDFLIQSPSDMTD-------LQA  53

Query:   61 DAKTDALTFFKSNSDLTLENLQWIYLQLLGFIPFVDFKDPKAF-------LQDINFPVSY  113
             A+ D + F KS+ +L  E   I LQLL F+P  DF+  KAF       L  I   ++
Sbjct:   54 TAELDVIEFLKSSIELDWEIFWNIALQLLDFVPNFDFEIGKAFEYAKNSNLPQIEAEMTT  113

Query:  114 DNIFQSLHHLLACRGKSGNTLIDQLVADGLLHADNHYHFFNGKSLATFNTNQLIREVVYV  173
            +NI  + ++LL  R K+G L++  V++GLL  DNHYHFFN KSLATF+++ L REV++V
Sbjct:  114 ENIISAFYYLLCTRRKNGMILVEHWVSEGLLPLDNHYHFFNDKSLATFDSSLLEREVLWV  173

Query:  174 ETSLDTMSSGEHDLVKVNIIRPTTEHTIPTMMTASPYHQGINDPAADQKTYQMEGALAVK  233
            E+ +D+   GE+DL+K+ IIRP +   +P +MTASPYH GIND A D     + M    L  K
Sbjct:  174 ESPVDSEQRGENDLIKIQIIRPKSTEKLPVVMTASPYHLGINDKANDLALHDMNVELEEK  233

Query:  234 QPKHIQVDTKPFKEEVKHPSKLPI-SPATESFTHIDSYSLNDYFLSRGFANIYVSGVGTA  292
                 I V+ K  ++          +LPI  A    FTH  +YSLNDYFL+RGFA+IYV+GVGT
Sbjct:  234 TSHEIHVEQKLPQKLSAKAKELPIVDKAPYRFTHGWTYSLNDYFLTRGFASIYVAGVGTR  293

Query:  293 GSTGFMTSGDYQQIQSFKAVIDWLNGKVTAFTSHKRDKQVKANWSNGLVATTGKSYLGTM  352
             S GF TSGDYQQI S  AVIDWLNG+  A+TS K+  ++KA+W+NG VA TGKSYLGTM
Sbjct:  294 SSDGFQTSGDYQQIYSMTAVIDWLNGRARAYTSRKKTHEIKASWANGKVAMTGKSYLGTM  353

Query:  353 STGLATTGVEGLKVIIAEAAISTWYDYYRENGLVCSPGGYPGEDLDVLTELTYSRNLLAG  412
             + G ATTGVEGL+VI+AEA IS+WY+YYRENGLV SPGG+PGEDLDVL  LTYSRNL
Sbjct:  354 AYGAATTGVEGLEVILAEAGISSWYNYYRENGLVRSPGGFPGEDLDVLAALTYSRNLDGA  413
```

-continued

```
Query:  413 DYIKNNDCYQALLNEQSKAIDRQSGDYNQYWHDRNYLTHVNNVKSRVVYTHGLQDWNVKP  472
            D++K N  Y+  L E + A+DR+SGDYNQ+WHDRNYL + + VK+ V+  HGLQDWNV P
Sbjct:  414 DFLKGNAEYEKRLAEMTAALDRKSGDYNQFWHDRNYLINTDKVKADVLIVHGLQDWNVTP  473

Query:  473 RHVYKVFNALPQTIKKHLFLHQGQHVYMHNWQSIDFRESMNALLSQELLGIDNHFQLEEV  532
                Y + ALP+   KH FLH+G H+YM++WQSIDF E++NA   +LL  D +  L  V
Sbjct:  474 EQAYNFWKALPEGHAKHAFLHRGAHIYMNSWQSIDFSETINAYFVAKLLDRDLNLNLPPV  533

Query:  533 IWQDNTTEQTWQVLDAFGGNHQEQIGLGD---SKKLIDNHYDKEAFDTYCKDFNVFKNDL  589
            I Q+N+ +Q W +++ FG N Q ++ LG     S    DNHYD E  F  Y KDFNVFK DL
Sbjct:  534 ILQENSKDQVWTMMNDFGANTQIKLPLGKTAVSFAQFDNHYDDETFKKYSKDFNVFKKDL  593

Query:  590 FKGNNKTNQITINLPLKKNYLLNGQCKLHLRVKTSDKKAILSAQILDYGPKKRFKDTPTI  649
            F+   NK N+  I+L L    +NG  +L LR+K +D K  LSAQILD+G KKR +D   +
Sbjct:  594 FE--NKANEAVIDLELPSMLTINGPVELELRLKLNDTKGFLSAQILDFGQKKRLEDKARV  651

Query:  650 KFLNSLDNGKNFAREALRELPFTKDHYRVISKGVLNLQNRTDLLTIEAIEPEQWFDIEFS  709
            K     LD G+NF  + L ELP  +  Y++I+KG  NLQN+ +LLT+  ++ ++WF I+F
Sbjct:  652 KDFKVLDRGRNFMLDDLVELPLVESPYQLITKGFTNLQN-NLLTVSDLKADEWFTIKFE  710

Query:  710 LQPSIYQLSKGDNLRIILYTTDFEHTIRDNASYSITVDLSQSYLTIP              756
            LQP+IY L K D LR+ILY+TDFEHT+RDN   +  +DLSQS L IP
Sbjct:  711 LQPTIYHLEKADKLRVILYSTDFEHTVRDNRKVTYEIDLSQSKLIIP              757
```

A related DNA sequence was identified in *S. pyogenes* <SEQ ID 4991> which encodes the amino acid sequence <SEQ ID 4992>. Analysis of this protein sequence reveals the following:

```
Possible site: 16
>>> Seems to have no N-terminal signal sequence

----- Final Results -----
            bacterial cytoplasm --- Certainty = 0.2553(Affirmative) < succ>
             bacterial membrane --- Certainty = 0.0000(Not Clear) < succ>
              bacterial outside --- Certainty = 0.0000(Not Clear) < succ>
```

An alignment of the GAS and GBS proteins is shown below.

```
Identities = 481/758 (63%), Positives = 587/758 (76%), Gaps = 4/758 (0%)

Query:    1 MRYNQFSYIPTKPNEAFEELKGLGFPLNKKNSDKANLEAFLRHSFLNQTDTDYALSLLIV   60
            MRYNQFSYIPT    A EELK LGF L+ + +  KA+LE+FLR  F +  D+DY LS LI
Sbjct:    1 MRYNQFSYIPTSLERAAEELKELGFDLDLQKTAKASLESFLRKLFFHYPDSDYPLSHLIA   60

Query:   61 DAKTDALTFEKSNSDLTLENLQWIYLQLLGFIPFVDFKDPKAFLQDINFPVSYDN--IFQ  118
            DA ++ L+FF+S  +L+ E   + LQ+LGFIP VDF +  AFL +  FP+ +D    I +
Sbjct:   61 KNDMDALSFFQSEQELSKEVFDLLALQVLGFIPGVDFTEADAFLDKLAFPIHFDETEIIK  120

Query:  119 SLHHLLACRGKSGNTLIDQLVADGLLHADNHYHFFNGKSLATFNTNQLIREVVYETSLD  178
             +HHLLA R KSG TLID LV+ G+L   DN YHFFNGKSLATF+T+QLIREVVYE  LD
Sbjct:  121 HIHHLLATRCKSGMTLIDDLVSQGMLTMDNDYHFFNGKSLATFDTSQLIREVVYEAPLD  180

Query:  179 TMSSGEHDLVKVNIIRPTTEHTIPTMMTASPYHQGINDPAADQKTYQMEGALAVKQPKHI  238
            T    G+ DL+KVNIIRP ++   +PT+MT SPYHQGIN  A  D+K Y+ME   L VK+ + I
Sbjct:  181 TDQDGQLDLIKVNIIRPQSQKPLPTLMTPSPYHQGINEVANDKKLYRMEKELVVKKRRQI  240

Query:  239 QVDTKPFKEEVKHPSKLPISPATESFTHIDSYSLNDYFLSRGFANIYVSGVGTAGSTGFM  298
              V+ + F     P KLPI    ESF++I+SYSLNDYFL+RGFANIYVSGVGTAGSTGFM
Sbjct:  241 TVEDRDFIPLETQPCKLPIGQNLESFSYINSYSLNDYFLARGFANIYVSGVGTAGSTGFM  300

Query:  299 TSGDYQQIQSFKAVIDWLNGKVTAFTSHKRDKQVKANWSNGLVATTGKSYLGTMSTGLAT  358
            TSG+Y QI+SFKAVIDWLNG+ TA+TSH +   QV+A+W NGLV TTGKSYLGTMSTGLAT
Sbjct:  301 TSGNYAQIESFKAVIDWLNGRATAYTSHSKTHQVRADWANGLVCTTGKSYLGTMSTGLAT  360

Query:  359 TGVEGLKVIIAEAAISTWYDYYRENGLVCSPGGYPGEDLDVLTELTYSRNLLAGDYIKNN  418
            TGV+GL  +IIAE+AIS+WY+YYRENGLVCSPGGYPGEDLDVLTELTYSRNLLAGDY+++N
Sbjct:  361 TGVDGLAMIIAESAISSWYNYYRENGLVCSPGGYPGEDLDVLTELTYSRNLLAGDYLRHN  420

Query:  419 DCYQALLNEQSKAIDRQSGDYNQYWHDRNYLTHVNNVKSRVVYTHGLQDWNVKPRHVYKV  478
            D  YQ  LLN+QS+A+DRQSGDYNQ+WHDRNYL + + +K   VVYTHGLQDWNVKPR VY++
Sbjct:  421 DRYQELLNQQSQALDRQSGDYNQFWHDRNYLKNAHQIKCDVVYTHGLQDWNVKPRQVYEI  480
```

-continued

```
Query:  479 FNALPQTIKKHLFLHQGQHVYMHNWQSIDFRESMNALLSQELLGIDNHFQLEEVIWQDNT  538
            FNALP TI KHLFLHQG+HVYMHNWQSIDFRESMNALL Q+LLG+ N F L E+IWQDNT
Sbjct:  481 FNALPSTINKHLFLHQGEHVYMHNWQSIDFRESMNALLCQKLLGLANDFSLPEMIWQDNT  540

Query:  539 TEQTWQVLDAFGGNHQEQIGLGDSKKLIDNHYDKEAFDTYCKDFNVFKNDLFKGNNKTNQ  598
              Q WQ    FG +  +++ LG     LIDNHY ++ F  Y KDF  FK  LFKG  K NQ
Sbjct:  541 CPQNWQERKVFGTSTIKELDLGQELLLIDNHYGEDEFKAYGKDFRAFKAALFKG--KANQ  598

Query:  599 ITINLPLKKNYLLNGQCKLHLRVKTSDKKAILSAQILDYGPKKRFKDTPTIKFLNSLDNG  658
              I++ L+++   +NG+  L L+VK+S+ K +LSAQILDYG KKR  D P     +S+DNG
Sbjct:  599 ALIDILLEEDLPINGEIVLQLKVKSSENKGLLSAQILDYGKKKRLGDLPIALTQSSIDNG  658

Query:  659 KNFAREALRELPFTKDHYRVISKGVLNLQNRTDLLTIEAIEPEQWFDIEFSLQPSIYQLS  718
              +NF+RE L+ELPF +D YRVISKG +NLQNR +L +IE I    +W +     LQP+IY L
Sbjct:  659 QNFSREPLKELPFREDSYRVISKGFMNLQNRNNLSSIETIPNNKWMTVRLPLQPTIYHLE  718

Query:  719 KGDNLRIILYTTDFEHTIRDNASYSITVDLSQSYLTIP                       756
              KGD LR+ILYTTDFEHT+RDN++Y++T+DLSQS  L +P
Sbjct:  719 KGDTLRVILYTTDFEHTVRDNSNYALTIDLSQSQLIVP                       756
```

Based on this analysis, it was predicted that these proteins and their epitopes could be useful antigens for vaccines or diagnostics.

EXAMPLE 1618

A DNA sequence (GBSx1713) was identified in *S. agalactiae* <SEQ ID 4993> which encodes the amino acid sequence <SEQ ID 4994>. This protein is predicted to be PrfA. Analysis of this protein sequence reveals the following:

```
Possible site: 54
>>> Seems to have no N-terminal signal sequence

----- Final Results -----
              bacterial cytoplasm --- Certainty = 0.3976(Affirmative) < succ>
               bacterial membrane --- Certainty = 0.0000(Not Clear)   < succ>
                 bacterial outside --- Certainty = 0.0000(Not Clear)   < succ>
```

A related GBS nucleic acid sequence <SEQ ID 10125> which encodes amino acid sequence <SEQ ID 10126> was also identified.

The protein has homology with the following sequences in the GENPEPT database.

```
>GP: CAA65740 GB: X97014 PrfA [Listeria seeligeri]
Identities = 54/181 (29%), Positives = 95/181 (51%), Gaps = 1/181 (0%)

Query:   38 DYTYILKDGIVKQSVLSKYGTEFNLRYVTGLEITSILNTDYSQHMGEPYNVRIESETAHF   97
             +Y   L +G+ K +  +S+ G    NL+Y  G  I      D  +G  YN+ + SE A
Sbjct:   36 EYCIFLHEGVAKLTSISESGDILNLQYYKGAFIIMTGFIDTEKSLGY-YNLEVVSEQAAA   94

Query:   98 YKVRRSTFLKDINNDIELQGYVKDFYHNRLEKSMKKMQCMLTNGRIGAISTQLYDLSKMF  157
              Y ++ S   + ++ D++    Y+ D   ++  S+ K     +NG++G+I  Q   L+ ++
Sbjct:   95 YIIKISDLKELVSKDLKQLFYIIDTLQKQVSYSLAKFNDFSSNGKVGSICGQFLILAYVY  154

Query:  158 GEERDNGDIYINFVITNEELGKFCGISTGSSVSRILKQLKDDHIIRIEKQHIIITNVEKLK  218
              GEE  NG     +T +ELG    GI+  S+VSRI+ +LK +++I  +  + I N+  LK
Sbjct:  155 GEETPNGIKITLEKLTMQELGCSSGIAHSSAVSRIISKLKQENVIEYKDSYFYIKNIAYLK  215
```

A related DNA sequence was identified in *S. pyogenes* <SEQ ID 4995> which encodes the amino acid sequence <SEQ ID 4996>. Analysis of this protein sequence reveals the following:

```
Possible site: 13
>>> Seems to have no N-terminal signal sequence

----- Final Results -----
              bacterial cytoplasm --- Certainty = 0.4088(Affirmative) < succ>
               bacterial membrane --- Certainty = 0.0000(Not Clear)   < succ>
                 bacterial outside --- Certainty = 0.0000(Not Clear)   < succ>
```

An alignment of the GAS and GBS proteins is shown below.

```
Identities = 186/223 (83%), Positives = 203/223 (90%)

Query:    1 MEEVMNHQILQNYINSHNLPIIEKDYHKYLTFESLEEDYTYILKDGIVKQSVLSKYGTEF   60
            +E+ +NH ILQ YI++HN PIIEK YHKYLTFESLEED+TYILKDGIVKQSVLSKYG EF
Sbjct:   17 LEKSVNHHILQRYIDNHNFPIIEKSYHKYLTFESLEEDFTYILKDGIVKQSVLSKYGMEF   76

Query:   61 NLRYVTGLEITSILNTDYSQHMGEPYNVRIESETAHFYKVRRSTFLKDINNDIELQGYVK  120
            NLRYVTGLEITS+LNT YS+ MGEPYNVRIESE A FYKVRRS FLKDIN DIELQGYVK
Sbjct:   77 NLRYVTGLEITSVLNTGYSKDMGEPYNVRIESEKASFYKVRRSAFLKDINEDIELQGYVK  136

Query:  121 DFYHNRLEKSMKKMQCMLTNGRIGAISTQLYDLSKMFGEERDNGDIYINFVITNEELGKF  180
            DFYHNRL+KSMKKMQCMLTNGRIGAISTQ+YDL  +FGEE  NG I INFVITNEELGKF
Sbjct:  137 DFYHNRLQKSMKKMQCMLTNGRIGAISTQIYDLMTLFGEELPNGQILINFVITNEELGKF  196

Query:  181 CGISTGSSVSRILKQLKDDHIIRIEKQHIIITNVEKLKDHIVF                  223
            CGIST SSVSRILKQLK+ +IIRI+KQHIIITN++KLKD+IVF
Sbjct:  197 CGISTASSVSRILKQLKEKNIIRIDKQHIIITNLDKLKDNIVF                  239
```

Based on this analysis, it was predicted that these proteins and their epitopes could be useful antigens for vaccines or diagnostics.

EXAMPLE 1619

A DNA sequence (GBSx1714) was identified in *S. agalactiae* <SEQ ID 4997> which encodes the amino acid sequence <SEQ ID 4998>. Analysis of this protein sequence reveals the following:

```
Possible site: 46
>>> Seems to have an uncleavable N-term signal seq
      INTEGRAL    Likelihood = -14.33    Transmembrane   167-183 (159-193)
      INTEGRAL    Likelihood =  -7.96    Transmembrane    18-34  (10-37)
      INTEGRAL    Likelihood =  -7.75    Transmembrane   373-389 (369-392)
      INTEGRAL    Likelihood =  -5.68    Transmembrane   214-230 (212-234)
      INTEGRAL    Likelihood =  -4.78    Transmembrane   243-259 (241-262)
      INTEGRAL    Likelihood =  -2.71    Transmembrane    48-64  (47-65)
      INTEGRAL    Likelihood =  -2.60    Transmembrane   283-299 (283-300)

----- Final Results -----
            bacterial membrane  --- Certainty = 0.6731(Affirmative) < succ>
             bacterial outside  --- Certainty = 0.0000(Not Clear)   < succ>
           bacterial cytoplasm  --- Certainty = 0.0000(Not Clear)   < succ>
```

The protein has homology with the following sequences in the GENPEPT database.

```
>GP: CAB15662 GB: Z99122 similar to antibiotic resistance protein
[Bacillus subtilis]
Identities = 106/401 (26%), Positives = 199/401 (49%), Gaps = 21/401 (5%)

Query:    3 DKLFNKHFIGITILNFIVYMVYYLFTVIIAFIATKELGVSTSQAGLATGIYIVGTLIARL   62
            D ++ K FI + ++N V++ +Y F ++     +ELG + SQ GL   ++++  +I R
Sbjct:    5 DAIWTKDFIMVLLVNLFVFVFFYTFLTVLPIYTLQELGGTESQGGLLISLFLLSAIITRP   64

Query:   63 IFGKQLEVLGRKLVLRGGAIFYLLTTLAYFYMPSIGVMYLVRFLNGFGYGVVSTATNTIV  122
            G  +E  G+K +      + L++  Y  + +++  +RF  G  + +++T T  I
Sbjct:   65 FSGAIVERFGKKRMAIVSMALFALSSFLYMPIHNFSLLLGLRFFQGIWFSILTTVTGAIA  124

Query:  123 TAYIPADKRGEGINFYGLSTSLAAAIGPFVGTFMLDNLHINFKMVIVLCSILIAIVVLGA  182
               IPA +RGEG+ ++ +S +LA AIGPF+G  ++    ++F +    ++ +    +L +
Sbjct:  125 ADIIPAKRRGEGLGYFAMSMNLAMAIGPFLGLNLMRV--VSFPVFFTAFALFMVAGLLVS  182

Query:  183 FVFPVKNITLNPEQLAKSKSWTIDSF-----IEKKAIFITIIAFLMGISYASVLGFQKLY  237
            F+  V        +K    T+ F       EK A+ I  +   Y++V + ++
Sbjct:  183 FLIKVPQ--------SKDSGTTVFRFAFSDMFEKGALKIATVGLFISFCYSTVTSYLSVF  234

Query:  238 TTEINLMTVGAYFFIVYALVITLTRPSMGRLMDAKGDKWVLYPSYLFLTLGLALLGSAMG  297
              ++L +   YFF+ +A+ + + RP  G+L D   G   V+YPS L  ++GL +L
Sbjct:  235 AKSVDLSDISGYFFVCFAVTMMIARPFTGKLFDKVGPGIVIYPSILIFSVGLCMLSFTHS  294
```

-continued

```
Query: 298 SVTYLLSGALIGFGYGTFMSCGQAASIKGVEEHRFNTAMSTYMIGLDLGLGAGPYILGLV 357
            +  LLSGA+IG GYG+ + C Q  +I+     HR   A +T+    D G+  G Y+ GL
Sbjct: 295 GLMLLLSGAVIGLGYGSIVPCMQTLAIQKSPAHRSGFATATFFTFFDSGIAVGSYVFGL- 353

Query: 358 KDGFLGAGVQSFRELFWIAAIIPVVCGILYFLKSSRQVETK                    398
            F+ +     F  ++  A +  ++   +LY       + E +
Sbjct: 354 ---FVASA--GFSAIYLTAGLFVLIALLLYTWSQKKPAEAE                    389
```

A related DNA sequence was identified in *S. pyogenes* <SEQ ID 4999> which encodes the amino acid sequence 10 <SEQ ID 5000>. Analysis of this protein sequence reveals the following:

```
Possible site: 35
>>> Seems to have an uncleavable N-term signal seq
    INTEGRAL    Likelihood = -12.31    Transmembrane    202-218 (194-225)
    INTEGRAL    Likelihood =  -7.80    Transmembrane     53-69  (44-71)
    INTEGRAL    Likelihood =  -7.17    Transmembrane    407-423 (404-426)
    INTEGRAL    Likelihood =  -5.26    Transmembrane    249-265 (247-269)
    INTEGRAL    Likelihood =  -3.77    Transmembrane    279-295 (276-297)
    INTEGRAL    Likelihood =  -2.23    Transmembrane     11-27  (10-27)
    INTEGRAL    Likelihood =  -2.13    Transmembrane     83-99  (82-99)
    INTEGRAL    Likelihood =  -1.91    Transmembrane    312-328 (311-328)

----- Final Results -----
            bacterial membrane --- Certainty = 0.5925(Affirmative) < succ>
             bacterial outside --- Certainty = 0.0000(Not Clear)   < succ>
           bacterial cytoplasm --- Certainty = 0.0000(Not Clear)   < succ>
```

The protein has homology with the following sequences in the databases:

```
>GP: CAB15662 GB: Z99122 similar to antibiotic resistance protein
[Bacillus subtilis]
Identities = 110/390 (28%), Positives = 194/390 (49%), Gaps = 11/390 (2%)

Query:  38 EKLFNKHFVAITVINFIVYMVYYLFTVIIAFVATRELGAQTSQAGLATGIYILGTLLARL  97
            + ++ K F+ + ++N  V++ +Y  F  ++       +ELG   SQ GL    +++L  ++ R
Sbjct:   5 DAIWTKDFIMVLLVNLFVFVFFYTFLTVLPIYTLQELGGTESQGGLLISLFLLSAIITRP  64

Query:  98 IFGKQLEVFGRRLVLRGGAIFYLLTTLAYFYMPTISMMYLVRFLNGFGYGVVSTATNTIV 157
             G  +E FG++ +        + L++ Y  +    S++   +RF  G   + +++T  T    I
Sbjct:  65 FSGAIVERFGKKRMAIVSMALFALSSFLYMPIHNFSLLLGLRFFQGIWFSILTTVTGAIA 124

Query: 158 TAYIPARKRGEGINFYGLSTSLAAAIGPFVGTFMLDNLHIDFRMIIVLCSVLIGCVVVGA 217
            IPA++RGEG+  ++ +S +LA AIGPF+G  ++     + F +     ++ +    ++ +
Sbjct: 125 ADIIPAKRRGEGLGYFAMSMNLAMAIGPFLGLNLMRV--VSFPVFFTAFALFMVAGLLVS 182

Query: 218 FAFPVKNMSLNAEQLAKTKSWTVDSFIEKKALFITAIAFLMGIAYASVLGFQKLYTSEIH 277
            F  V     + ++  + +      EK AL I +  +    Y++V  + ++         +
Sbjct: 183 FLIKVPQSKDSGTTVFR---FAFSDMFEKGALKIATVGLFISFCYSTVTSYLSVFAKSVD 239

Query: 278 LTTVGAYFFVVYALIITITRPAMGRLMDAKGDKWVLYPSYLFLAMGLFLLGSVSSGGSYL 337
            L+ +    YFFV +A+ + I RP  G+L D  G   V+YPS L  ++GL +L    SG    L
Sbjct: 240 LSDISGYFFVCFAVTMMIARPFTGKLFDKVGPGIVIYPSILIFSVGLCMLSFTHSGLMLL 299

Query: 338 LSGALIGFGYGTFMSCGQAASIQGVDEHRFNTAMSTYMIGLDLGLGAGPYLLGLIKDLAL 397
            LSGA+IG GYG+ + C Q  +IQ     HR   A +T+    D G+  G Y+  GL
Sbjct: 300 LSGAVIGLGYGSIVPCMQTLAIQKSPAHRSGFATATFFTFFDSGIAVGSYVFGLF----- 354

Query: 398 GSGVASFRHLFWLAAVIPLICTLLYLLKTK                                427
             A F   ++  A +  LI  LLY      K
Sbjct: 355 -VASAGFSAIYLTAGLFVLIALLLYTWSQK                                383
```

An alignment of the GAS and GBS proteins is shown below.

```
Identities = 328/396 (82%), Positives = 370/396 (92%), Gaps = 1/396 (0%)

Query:   1 MEDKLFNKHFIGITILNFIVYMVYYLFTVIIAFIATKELGVSTSQAGLATGIYIVGTLIA  60
            ME+KLFNKHF+ IT++NFIVYMVYYLFTVIIAF+AT+ELG  TSQAGLATGIYI+GTL+A
Sbjct:  36 MEEKLFNKHFVAITVINFIVYNVYYLFTVIIAFVATRELGAQTSQAGLATGIYILGTLLA  95
```

-continued

```
Query:   61 RLIFGKQLEVLGRKLVLRGGAIFYLLTTLAYFYMPSIGVMYLVRFLNGFGYGVVSTATNT 120
            RLIFGKQLEV GR+LVLRGGAIFYLLTTLAYFYMP+I +MYLVRFLNGFGYGVVSTATNT
Sbjct:   96 RLIFGKQLEVFGRRLVLRGGAIFYLLTTLAYFYMPTISMMYLVRFLNGFGYGVVSTATNT 155

Query:  121 IVTAYIPADKRGEGINFYGLSTSLAAAIGPFVGTFMLDNLHINFKMVIVLCSILIAIVVL 180
            IVTAYIPA KRGEGINFYGLSTSLAAAIGPFVGTFMLDNLHI+F+M+IVLCS+LI  VV+
Sbjct:  156 IVTAYIPARKRGEGINFYGLSTSLAAAIGPFVGTFMLDNLHIDFRMIIVLCSVLIGCVVV 215

Query:  181 GAFVFPVKNITLNPEQLAKSKSWTIDSFIEKKAIFITIIAFLMGISYASVLGFQKLYTTE 240
            GAF FPVKN++LN EQLAK+KSWT+DSFIEKKA+FIT IAFLMGI+YASVLGFQKLYT+E
Sbjct:  216 GAFAFPVKNMSLNAEQLAKTKSWTVDSFIEKKALFITAIAFLMGIAYASVLGFQKLYTSE 275

Query:  241 INLMTVGAYFFIVYALVITLTRPSMGRLMDAKGDKWVLYPSYLFLTLGLALLGSAMGSVT 300
            I+L TVGAYFF+VYAL+IT+TRP+MGRLMDAKGDKWVLYPSYLFL +GL LLGS     +
Sbjct:  276 IHLTTVGAYFFVVYALIITITRPAMGRLMDAKGDKWVLYPSYLFLAMGLFLLGSVSSGGS 335

Query:  301 YLLSGALIGFGYGTFMSCGQAASIKGVEEHRFNTAMSTYMIGLDLGLGAGPYILGLVKDG 360
            YLLSGALIGFGYGTEMSCGQAASI+GV+EHRFNTAMSTYMIGLDLGLGAGPY+LGL+KD
Sbjct:  336 YLLSGALIGFGYGTFMSCGQAASIQGVDEHRFNTAMSTYMIGLDLGLGAGPYLLGLIKDL 395

Query:  361 FLGAGVQSFRELFWIAAIIPVVCGILYFLKS-SRQV                        395
            LG+GV SFR LFW+AA+IP++C +LY LK+ +RQV
Sbjct:  396 ALGSGVASFRHLFWLAAVIPLICTLLYLLKTKTRQV                        431
```

A related GBS gene <SEQ ID 8863> and protein <SEQ ID 8864> were also identified. Analysis of this protein sequence reveals the following:

```
Lipop: Possible site: -1 Crend: 8
McG: Discrim Score: 8.26
GvH: Signal Score (-7.5): -5.21
Possible site: 46
>>> Seems to have an uncleavable N-term signal seq
ALOM program count: 7 value: -14.33 threshold: 0.0
INTEGRAL Likelihood = -14.33 Transmembrane 167-183 (159-193)
INTEGRAL Likelihood =  -7.96 Transmembrane  18-34  (10-37)
INTEGRAL Likelihood =  -7.75 Transmembrane 373-389 (369-392)
INTEGRAL Likelihood =  -5.68 Transmembrane 214-230 (212-234)
INTEGRAL Likelihood =  -4.78 Transmembrane 243-259 (241-262)
INTEGRAL Likelihood =  -2.71 Transmembrane  48-64  (47-65)
INTEGRAL Likelihood =  -2.60 Transmembrane 283-299 (283-300)
PERIPHERAL  Likelihood = 0.69  341
modified ALOM score: 3.37

*** Reasoning Step: 3

----- Final Results -----
            bacterial membrane --- Certainty = 0.6731 (Affirmative) < succ>
             bacterial outside --- Certainty = 0.0000 (Not Clear)   < succ>
           bacterial cytoplasm --- Certainty = 0.0000 (Not Clear)   < succ>
                                                45
```

The protein has homology with the following sequences in the databases:

```
ORF01003 (307-1494 of 1800)
EGAD|108032|BS3640 (5-389 of 396) hypothetical protein {Bacillus subtilis}
GP|1684651|emb|CAB05383.1||Z82987 unknown similar to quinolon resistance protein
NorA {Bacillus subtilis} GP|2636170|emb|CAB15662.1||Z99122 similar to antibiotic
resistance protein {Bacillus subtilis} PIR|B70065|B70065 antibiotic resistance
protein homolog ywoG-Bacillus subtilis
% Match = 14.9
% Identity = 26.3    % Similarity = 53.4
Matches = 102    Mismatches = 178    Conservative Sub.s = 105

204       234       264       294       324       354       384       414
TTLTFVNAV*Y*HLYYTIEISYLLIFL*NVYENEIEKKEPFALEDKLFNKHFIGITILNFIVYMVYYLFTVIIAFIATKE
                                             |  ::  ||  :  ::|: |:::  :| | ::     :|
                                             MKKADAIWTKDFIMVLLVNLFVFVFFYTFLTVLPIYTLQE
                                                            10        20        30        40

444       474       504       534       564       594       624       654
LGVSTSQAGLATGIYIVGTLIARLIFGKQLEVLGRKLVLRGGAIFYLLTTLAYFYMPSIGVMYLVRFLNGFGYGVVSTAT
||  :  ||      ::::  :|   |   :|  :|:|  :      ::   |::: |   :   :: |::| |  :::||
LGGTESQGGLLISLFLLSAIITRPFSGAIVERFGKKRMAIVSMALFALSSFLYMPIHNFSLLLGLRFFQGIWFSILTTVT
      50        60        70        80        90       100       110       120
```

```
      684         714         744         774         804         834         864         894
NTIVTAYIPADKRGEGINFYGLSTSLAAAIGPFVGTFMLDNLHINFKMVIVLCSILIAIVVLGAFVFPVKNITLNPEQLA
       |  |||  :||||: :: :|  :|| ||||:|  ::     ::| :       ::::    :| :|:  |    :   :
GAIAADIIPAKRRGEGLGYFAMSMNLAMAIGPFLGLNLM--RVVSFPVFFTAFALFMVAGLLVSFLIKVPQSKDSGTTVF
        130         140         150         160         170         180         190

924         954         984        1014        1044        1074        1104        1134
KSKSWTIDSFIEKKAIFITIIAFLMGISYASVLGFQKLYTTEINLMTVGAYFFIVYALVITLTRPSMGRLMDAKGDKWVL
 :    :|    ||| |: | ::: |:|      ::|    |||:|||  :  |     |:|    |:|   |    |:
R---FAFSDMFEKGALKIATVGLFISFCYSTVTSYLSVFAKSVDLSDISGYFFVCFAVTMMIARPFTGKLFDKVGPGIVI
        210         220         230         240         250         260         270

1164        1194        1224        1254        1284        1314        1344        1374
YPSYLFLTLGLALLGSAMGSVTYLLSGALIGFGYGTFMSCGQAASIKGVEEHRFNTAMSTYMIGLDLGLGAGPYILGLVK
||| |  ::: ||  :|       :  |||||:||:|||: :   |  |      ||     |:|    :|  |:    | |::||
YPSILIFSVGLCMLSFTHSGLMLLLSGAVIGLGYGSIVPCMQTLAIQKSPAHRSGFATATFFTFFDSGIAVSSYVFGL--
        290         300         310         320         330         340         350

1404        1434        1464        1494        1524        1554        1584        1614
DGFLGAGVQSFRELFWIAAIIPVVCGILYFLKSSRQVETKTI*KGGIKL*HKNMSVFLLLLMGLTSQNWR*KKG*MLLFV
       |  :: |  :: :||       :  |:
----FVASAGFSAIYLTAGLFVLIALLLYTWSQKKPAEAEGKVSIAE
      360         370         380         390
```

Based on this analysis, it was predicted that these proteins and their epitopes could be useful antigens for vaccines or diagnostics.

EXAMPLE 1620

A DNA sequence (GBSx1715) was identified in *S. agalactiae* <SEQ ID 5001> which encodes the amino acid sequence <SEQ ID 5002>. Analysis of this protein sequence reveals the following:

```
Possible site: 46
>>> Seems to have no N-terminal signal sequence

----- Final Results -----
            bacterial cytoplasm --- Certainty = 0.0151 (Affirmative) < succ>
            bacterial membrane  --- Certainty = 0.0000 (Not Clear)   < succ>
            bacterial outside   --- Certainty = 0.0000 (Not Clear)   < succ>
```

The protein has homology with the following sequences in the GENPEPT database.

```
>GP: BAB06903 GB: AP001518 unknown conserved protein [Bacillus halodurans]
Identities = 52/143 (36%), Positives = 84/143 (58%)

Query:   5 YERILIAIDGSYESELAVEKGINVALRNDAELLLTHVIDAHAYQSEGVFSDYVFDRQEQE    64
           Y  IL+A+DGS +++ A+ K  N A    A+L + HVID+ ++ +   +   V   E +
Sbjct:   2 YNHILVAVDGSTQAKRALYKAFNYAKEFKADLFICHVIDSRSFATVEQYDRTVVGAAELD   61

Query:  65 SADVLAYFEKLAHSKGLTKIKKITEIGNPKTLLAKDIPIREKADLIMVGATGLNTFERLL  124
           +L  + + A   G+ K+  I + G+PK ++K I +    DLI+ GATGLN   ER  L
Sbjct:  62 GKKLLQRYSEEAEKAGVDKVHTILDFGSPKANISKTIAQKYDIDLIITGATGLNAVERFL  121

Query: 125 IGSTSEYILRHSKVDMLVVRDSK                                      147
           +GS SE + RH+K D+L+VR+ +
Sbjct: 122 MGSVSESVARHAKCDVLIVRNDQ                                      144
```

There is also homology to SEQ ID 3658:

```
Identities = 105/150 (70%), Positives = 121/150 (80%)

Query:   1 MTQKYERILIAIDGSYESELAVEKGINVALRNDAELLLTHVIDAHAYQSEGVFSDYVFDR   60
           M+ KY+RIL+AIDGSYESELA  KG+NVALRNDA LLL HVID  A QS   F  Y++++
Sbjct:  31 MSLKYKRILVAIDGSYESELAFNKGVNVALRNDATLLLVHVIDTRALQSVATFDTYIYEK   90

Query:  61 QEQESADVLAYFEKLAHSKGLTKIKKITEIGNPKTLLAKDIPIREKADLIMVGATGLNTF  120
           +EQE+  DVL   FEK A    G+T IK+I E GNPK LLA DIP RE ADLIMVGATGLNTF
Sbjct:  91 LEQEAKDVLDDFEKQAQIAGITNIKQIIEFGNPKNLLAHDIPDRENADLIMVGATGLNTF  150

Query: 121 ERLLIGSTSEYILRHSKVDMLVVRDSKKTL                               150
           ERLLIGS+SEYI+RH+K+D+LVVRDS KTL
Sbjct: 151 ERLLIGSSSEYIMRHAKIDLLVVRDSTKTL                               180
```

Based on this analysis, it was predicted that this protein and its epitopes, could be useful antigens for vaccines or diagnostics.

EXAMPLE 1621

A DNA sequence (GBSx1716) was identified in *S. agalactiae* <SEQ ID 5003> which encodes the amino acid sequence <SEQ ID 5004>. This protein is predicted to be glycerol uptake facilitator protein (glpF). Analysis of this protein sequence reveals the following:

```
Possible site: 29
>>> Seems to have an uncleavable N-term signal seq
INTEGRAL Likelihood = -8.65 Transmembrane 261-277 (257-281)
INTEGRAL Likelihood = -5.73 Transmembrane 201-217 (199-222)
INTEGRAL Likelihood = -4.51 Transmembrane  92-108 (91-110)
INTEGRAL Likelihood = -4.30 Transmembrane  44-60  (42-62)
INTEGRAL Likelihood = -2.18 Transmembrane  15-31  (11-31)
INTEGRAL Likelihood = -1.54 Transmembrane 150-166 (149-166)

----- Final Results -----
            bacterial membrane --- Certainty = 0.4461 (Affirmative) < succ>
             bacterial outside --- Certainty = 0.0000 (Not Clear)   < succ>
           bacterial cytoplasm --- Certainty = 0.0000 (Not Clear)   < succ>
```

The protein has homology with the following sequences in the GENPEPT database.

```
>GP: AAA25231 GB: M58315 putative [Lactococcus lactis]
Identities = 183/290 (63%), Positives = 228/290 (78%), Gaps = 10/290 (3%)

Query:    2 IEITWTVKYITEFIATAFLIILGNGAVANVDLKGTKGNNSGWIIIAIGYGLGVMMPALMF   61
            +++TWTVKYITEF+ TA LII+GNGAVANV+LKGTK +   W+II GYGLGVM+PA+ F
Sbjct:    1 MDVTWTVKYITEFVGTALLIIMGNGAVANVELKGTKAHAQSWMIIGWGYGLGVMLPAVAF   60

Query:   62 GNVSGNHINPAFTLGLAFSGLFPWAHVGQYILAQILGAMFGQLVVVMVYQPYFVKTENPN  121
            GN++ + INPAFTLGLA SGLFPWAHV QYI+AQ+LGAMFGQL+VMVY+PY++KT+NPN
Sbjct:   61 GNIT-SQINPAFTLGLAASGLFPWAHVAQYIIAQVLGAMFGQLLIVMVYRPYYLKTQNPN  119

Query:  122 HVLGSFSTISALDDGQKSSRKAAYINGFLNEFVGSFVLFFGALALTKNYFGVE----LVG  177
              +LG+FSTI +DD   + R  A INGFLNEF+GSFVLFFGA+A T  +FG +     +
Sbjct:  120 AILGTFSTIDNVDDNSEKTRLGATINGFLNEFLGSFVLFFGAVAATNIFFGSQSITWMTN  179

Query:  178 KLVQAGYDQTTAATRISPYVTGSLA-----VAHLGIGFLVMTLVASLGGPTGPALNPARD  232
             L   G D +++     +V  S A      +AHL +GFLVM LV +LGGPTGP LNPARD
Sbjct:  180 YLKGQGADVSSSDVMNQIWVQASGASASKMIAHLFLGFLVMGLVVALGGPTGPGLNPARD  239

Query:  233 LGPRIVHRLLPKQILGQAKEDSKWWYAWVPVLAPIVASILAVALFKLLYL           282
            GPR+VH LLPK +LG+AK   SKWWYAWVPVLAPI+AS+ AVALFK++YL
Sbjct:  240 FGPRLVHSLLPKSVLGEAKGSSKWWYAWVPVLAPILASLAAVALFKMIYL           289
```

A related DNA sequence was identified in *S. pyogenes* <SEQ ID 5005> which encodes the amino acid sequence <SEQ ID 5006>. Analysis of this protein sequence reveals the following:

```
Possible site: 16
>>> Seems to have an uncleavable N-term signal seq
INTEGRAL Likelihood = -9.18 Transmembrane 293-309 (288-314)
INTEGRAL Likelihood = -7.43 Transmembrane   2-18  (1-20)
INTEGRAL Likelihood = -7.38 Transmembrane 233-249 (228-256)
INTEGRAL Likelihood = -5.57 Transmembrane 124-140 (123-142)
INTEGRAL Likelihood = -2.87 Transmembrane  76-92  (75-93)
INTEGRAL Likelihood = -2.18 Transmembrane  47-63  (43-63)
INTEGRAL Likelihood = -1.54 Transmembrane 182-198 (181-198)

----- Final Results -----
            bacterial membrane --- Certainty = 0.4673 (Affirmative) < succ>
             bacterial outside --- Certainty = 0.0000 (Not Clear)   < succ>
           bacterial cytoplasm --- Certainty = 0.0000 (Not Clear)   < succ>
```

The protein has homology with the following sequences in the databases:

```
>GP: AAA25231 GB: M58315 putative [Lactococcus lactis]
Identities = 176/290 (60%), Positives = 228/290 (77%), Gaps = 10/290 (3%)

Query:   34 MEMTWTVKYITEFIATAFLIILGNGAVANVDLKGTKGHNSGWLVIAFGYGLGVMMPALMF   93
            M++TWTVKYITEF+ TA LII+GNGAVANV+LKGTK H   W++I +GYGLGVM+PA+ F
Sbjct:    1 MDVTWTVKYITEFVGTALLIIMGNGAVANVELKGTKAHAQSWMIIGWGYGLGVMLPAVAF   60

Query:   94 GNVSGNHINPAFTVGLAVSGLFPWAHVLQYVVAQLLGAIFGQLVVVMVYKPYFMKTENPN  153
            GN++ + INPAFT+GLA SGLFPWAHV QY++AQ+LGA+FGQL++VMVY+PY++KT NPN
Sbjct:   61 GNIT-SQINPAFTLGLAASGLFPWAHVAQYIIAQVLGAMFGQLLIVMVYRPYYLKTQNPN  119

Query:  154 HVLGSFSTISSLDNGQKDSHKASYINGFLNEFVGSFVLFFGALALTKNYFGVELVGKLIE  213
              +LG+FSTI ++D+  + +    + INGFLNEF+GSFVLFFGA+A T  +FG + +  +
Sbjct:  120 AILGTFSTIDNVDDNSEKTRLGATINGFLNEFLGSFVLFFGAVAATNIFFGSQSITWMTN  179

Query:  214 ------AGYDQTTAATQISPYVTGSLA---VAHIGIGFLVMVLVTSLGGPTGPALNPARD  264
                      A   +   QI    +G+ A   +AH+ +GFLVM LV +LGGPTGP LNPARD
Sbjct:  180 YLKGQGADVSSSDVMNQIWVQASGASASKMIAHLFLGFLVMGLVVALGGPTGPGLNPARD  239

Query:  265 FGPRLLHHFLPKSVLGQAKGDSKWWYAWVPVVAPILAAIVAVAAFKYLYI            314
            FGPRL+H  LPKSVLG+AKG SKWWYAWVPV+APILA++ AVA FK +Y+
Sbjct:  240 FGPRLVHSLLPKSVLGEAKGSSKWWYAWVPVLAPILASLAAVALFKMIYL            289
```

An alignment of the GAS and GBS proteins is shown below.

```
Identities = 240/281 (85%), Positives = 267/281 (94%)

Query:    2 IEITWTVKYITEFIATAFLIILGNGAVANVDLKGTKGNNSGWIIIAIGYGLGVMMPALMF   61
            +E+TWTVKYITEFIATAFLIILGNGAVANVDLKGTKG+NSGW++IA GYGLGVMMPALMF
Sbjct:   34 MEMTWTVKYITEFIATAFLIILGNGAVANVDLKGTKGHNSGWLVIAFGYGLGVMMPALMF   93

Query:   62 GNVSGNHINPAFTLGLAFSGLFPWAHVGQYILAQILGAMFGQLVVVMVYQPYFVKTENPN  121
            GNVSGNHINPAFT+GLA SGLFPWAHV QY++AQ+LGA+FGQLVVVMVY+PYF+KTENPN
Sbjct:   94 GNVSGNHINPAFTVGLAVSGLFPWAHVLQYVVAQLLGAIFGQLVVVMVYKPYFMKTENPN  153

Query:  122 HVLGSFSTISALDDGQKSSRKAAYINGFLNEFVGSFVLFFGALALTKNYFGVELVGKLVQ  181
            HVLGSFSTIS+LD+GQK S KA+YINGFLNEFVGSFVLFFGALALTKNYFGVELVGKL++
Sbjct:  154 HVLGSFSTISSLDNGQKDSHKASYINGFLNEFVGSFVLFFGALALTKNYFGVELVGKLIE  213

Query:  182 AGYDQTTAATRISPYVTGSLAVAHLGIGFLVMTLVASLGGPTGPALNPARDLGPRIVHRL  241
            AGYDQTTAAT+ISPYVTGSLAVAH+GIGFLVM LV SLGGPTGPALNPARD GPR++H
Sbjct:  214 AGYDQTTAATQISPYVTGSLAVAHIGIGFLVMVLVTSLGGPTGPALNPARDFGPRLLHHF  273

Query:  242 LPKQILGQAKEDSKWWYAWVPVLAPIVASILAVALFKLLYL                    282
            LPK +LGQAK DSKWWYAWVPV+API+A+I+AVA FK LY+
Sbjct:  274 LPKSVLGQAKGDSKWWYAWVPVVAPILAAIVAVAAFKYLYI                    314
```

A related GBS gene <SEQ ID 8865> and protein <SEQ ID 8866> were also identified. Analysis of this protein sequence reveals the following:

```
Lipop: Possible site: -1 Crend: 8
McG: Discrim Score: 2.81
GvH: Signal Score (-7.5): -3.6
Possible site: 29
>>> Seems to have an uncleavable N-term signal seq
ALOM program count: 6 value: -8.65 threshold: 0.0
INTEGRAL Likelihood = -8.65 Transmembrane 261-277 (257-281)
INTEGRAL Likelihood = -5.73 Transmembrane 201-217 (199-222)
INTEGRAL Likelihood = -4.51 Transmembrane  92-108  (91-110)
INTEGRAL Likelihood = -4.30 Transmembrane  44-60   (42-62)
INTEGRAL Likelihood = -2.18 Transmembrane  15-31   (11-31)
INTEGRAL Likelihood = -1.54 Transmembrane 150-166 (149-166)
PERIPHERAL  Likelihood =  2.92  72
modified ALOM score: 2.23

*** Reasoning Step: 3

----- Final Results -----
           bacterial membrane --- Certainty = 0.4461 (Affirmative) < succ>
            bacterial outside --- Certainty = 0.0000 (Not Clear) < succ>
          bacterial cytoplasm --- Certainty = 0.0000 (Not Clear) < succ>
```

The protein has homology with the following sequences in the databases:

```
ORF01006(304-1146 of 1446)
EGAD|14239|14211(1-289 of 289)hypothetical 30.9 kd protein in pepx 5'region
{Lactococcus lactis}SP|P22094|YDP1_LACLC HYPOTHETICAL 30.9 KDA PROTEIN IN PEPX
5'REGION(ORF1).GP|455286|gb|AAA25206.1||M35865 ORF1 (put.); putative {Lactococcus
lactis} GP|149527|gb|AAA25231.1||M58315 putative {Lactococcus lactis}
PIR|B43747|B43747 hypothetical protein (pepXP 5'region)-Lactococcus lactis subsp.
cremoris PIR|B43748|B43748 hypothetical protein(pepX 5'region)-Lactococcus lactis
subsp. lactis
% Match = 37.5
% Identity = 64.4    % Similarity = 81.3
Matches = 183    Mismatches = 49    Conservative Sub.s = 48
   123       153       183       213       243       273       303       333
*YASRS***ENLIN*IK*STR*SEPSTLFFIKYIWLKILLILFCDKLYNIKLTW*NG*CCKYFFGRKQGLIEITWTVKYI
                                                                  :::|||||||
                                                                  MDVTWTVKYI
                                                                          10
   363       393       423       453       483       513       543       573
TEFIATAFLIILGNGAVANVDLKGTKGNNSGWIIIAIGYGLGVMMPALMFGNVSGNHINPAFTLGLAFSGLFPWAHVGQY
|||: ||:|||:||||||||:|||||  :  |:|| ||||||||||:||:: ::||||||||:||||||||| ||
TEFVGTALLIIMGNGAVANVELKGTKAHAQSWMIIGWGYGLGVMLPAVAFGNIT-SQINPAFTLGLAASGLFPWAHVAQY
         20        30        40        50        60        70        80
   603       633       663       693       723       753       783       813
ILAQILGAMFGQLVVVMVYQPYFVKTENPNHVLGSFSTISALDDGQKSSRKAAYINGFLNEFVGSFVLFFGALALTKNYF
|:||:|||||||::||||:||::||:|||  :||:|||| ||  :|  :|  |   ||||||||:||||||||:|  :|
IIAQVLGAMFGQLLIVMVYRPYYLKTQNPNAILGTFSTIDNVDDNSEKTRLGATINGFLNEFLGSFVLFFGAVAATNIFF
        100       110       120       130       140       150       160
   831       861       885       906       936       966       996      1026
G----VELVGKLVQAGYDQTTA--ATRISPYVTG---SLAVAHLGIGFLVMTLVASLGGPTGPALNPARDLGPRIVHRLL
|    :   |  | |:::     :|    :|   :||| :|||||  ||||||| :|||||||:|||:||:||
GSQSITWMTNYLKGQGADVSSSDVMNQIWVQASGASASKMIAHLFLGFLVMGLVVALGGPTGPGLNPARDFGPRLVHSLL
        180       190       200       210       220       230       240
  1056      1086      1116      1146      1176      1206      1236      1266
PKQILGQAKEDSKWWYAWVPVLAPIVASILAVALFKLLYL**LKKDRFTGLFLF*I*KSASLAS*FRLMMTFGHSFFKGR
|| :||:||  |||||||||||||:||:|| ||||||::||
PKSVLGEAKGSSKWWYAWVPVLAPILASLAAVALFKMIYL
        260       270       280
```

Based on this analysis, it was predicted that these proteins and their epitopes could be useful antigens for vaccines or diagnostics.

EXAMPLE 1622

A DNA sequence (GBSx1717) was identified in *S. agalactiae* <SEQ ID 5007> which encodes the amino acid sequence <SEQ ID 5008>. Analysis of this protein sequence reveals the following:

```
Possible site: 44
>>> Seems to have an uncleavable N-term signal seq
INTEGRAL Likelihood = -8.70 Transmembrane 266-282 (262-290)
INTEGRAL Likelihood = -7.96 Transmembrane  25-41  (24-50)
INTEGRAL Likelihood = -6.42 Transmembrane 110-126 (105-140)
INTEGRAL Likelihood = -6.26 Transmembrane 194-210 (190-215)
INTEGRAL Likelihood = -5.47 Transmembrane 290-306 (289-310)
INTEGRAL Likelihood = -4.35 Transmembrane 128-144 (127-147)
INTEGRAL Likelihood = -3.29 Transmembrane 157-173 (156-174)
INTEGRAL Likelihood = -2.76 Transmembrane 221-237 (221-240)

----- Final Results -----
          bacterial membrane  --- Certainty = 0.4482 (Affirmative) < succ>
           bacterial outside  --- Certainty = 0.0000 (Not Clear)   < succ>
          bacterial cytoplasm --- Certainty = 0.0000 (Not Clear)   < succ>
```

The protein has no significant homology with any sequences in the GENPEPT database.

A related sequence was also identified in GAS <SEQ ID 9177> which encodes the amino acid sequence <SEQ ID 9178>. Analysis of this protein sequence reveals the following:

```
Possible cleavage site: 21
>>> Seems to have a cleavable N-term signal seq.
INTEGRAL Likelihood = -10.77 Transmembrane 139-155 (133-161)
INTEGRAL Likelihood =  -8.28 Transmembrane 245-261 (240-269)
INTEGRAL Likelihood =  -7.48 Transmembrane 269-285 (263-289)
INTEGRAL Likelihood =  -7.06 Transmembrane  97-113  (83-125)
INTEGRAL Likelihood =  -6.10 Transmembrane 173-189 (169-194)
INTEGRAL Likelihood =  -1.44 Transmembrane 200-216 (200-217)

----- Final Results -----
            bacterial membrane --- Certainty = 0.531  (Affirmative) < succ>
             bacterial outside --- Certainty = 0.0000 (Not Clear)   < succ>
           bacterial cytoplasm --- Certainty = 0.0000 (Not Clear)   < succ>
```

An alignment of the GAS and GBS proteins is shown below.

```
Identities = 225/301 (74%), Positives = 263/301 (86%)

Query:  10 LTVSLFFCRLDIMNETLLLHGIQLILIIAMIITFYQIVRHIRSQKINPFKRFFTGLWIGF    69
           LT +FFC+L  MNE L+L  IQ +L+ AM+  F+ +V+H++  KINPFKRF+TG WIG
Sbjct:   1 LTAKVFFCKLVFMNEMLILRLIQALLVSAMLFIFFMLVKHLKKNKINPFKRFWTGFWIGL   60

Query:  70 VTDALDTLGIGSFATTTTFFKLTKLVEDDRKIPATMTAAHVLPVLLQSLCFIFVVKVEAL   129
           +TDALDTLGIGSFATTTT FKLTKLV DDR++P TMT AHVLPVL+QSLCFIFVVKVE L
Sbjct:  61 LTDALDTLGIGSFATTTTCFKLTKLVTDDRQLPGTMTVAHVLPVLIQSLCFIFVVKVEVL  120

Query: 130 TLITMAGAAFIGAFVGAKMTKNWHAPTVQRILGTLLITAAIIMLYRMITNPGAGISDSVH   189
           TL+ MA AAFIGA+ G  +TKNWHAPTVQRILG+LLI AAIIM+ R+I +PG  +SD++H
Sbjct: 121 TLLAMAAAAFIGAYFGTHITKNWHAPTVQRILGSLLIIAAIIMIIRIIYHPGEHLSDTIH  180

Query: 190 GLHGIWLFVGIGFNFIIGVLMTMGLGNYAPELIFFSLMGLSPAVAMPVMMLDAAMIMTAS   249
           GLHGIWLFVGIGFNFI+GVLMTMGLGNYAPELIFFSLMGLSP VAMPVMMLDAAMIMTAS
Sbjct: 181 GLHGIWLFVGIGFNFIVGVLMTMGLGNYAPELIFFSLMGLSPTVAMPVMMLDAAMIMTAS  240

Query: 250 STQFIKSGRVNWNGFAGLVTGGILGVIVAVLFLTNLDLNSLKTLVVGIVLFTGAMLIRSSF   310
           S+QFIK+ RV+W+GFAG+V+GGI+GV++AV FLTNLD+NSLK LV+ IV FTG MLIRSSF
Sbjct: 241 SSQFIKANRVSWDGFAGIVSGGIIGVLLAVFFLTNLDINSLKLLVIAIVFFTGGMLIRSSF  301
```

A related GBS gene <SEQ ID 8867> and protein <SEQ ID 8868> were also identified. Analysis of this protein sequence reveals the following:

```
Lipop: Possible site: -1 Crend: 8
McG: Discrim Score: 2.32
GvH: Signal Score (-7.5): -5.59
Possible site: 44
>>> Seems to have an uncleavable N-term signal seq
ALOM program count: 8 value: -8.70 threshold: 0.0
INTEGRAL Likelihood = -8.70 Transmembrane 266-282 (262-290)
INTEGRAL Likelihood = -7.96 Transmembrane  25-41  (24-50)
INTEGRAL Likelihood = -6.42 Transmembrane 110-126 (105-140)
INTEGRAL Likelihood = -6.26 Transmembrane 194-210 (190-215)
INTEGRAL Likelihood = -5.47 Transmembrane 290-306 (289-310)
INTEGRAL Likelihood = -4.35 Transmembrane 128-144 (127-147)
INTEGRAL Likelihood = -3.29 Transmembrane 157-173 (156-174)
INTEGRAL Likelihood = -2.76 Transmembrane 221-237 (221-240)
PERIPHERAL  Likelihood = 3.87   67
modified ALOM score: 2.24

*** Reasoning Step: 3

----- Final Results -----
            bacterial membrane --- Certainty = 0.4482 (Affirmative) < succ>
             bacterial outside --- Certainty = 0.0000 (Not Clear)   < succ>
           bacterial cytoplasm --- Certainty = 0.0000 (Not Clear)   < succ>
```

A related DNA sequence was identified in *S. pyogenes* <SEQ ID 5009> which encodes amino acid sequence <SEQ ID 5010>:

```
Possible site: 33
>>> Seems to have no N-terminal signal sequence
INTEGRAL Likelihood = -10.77  Transmembrane  151-167   (145-173)
INTEGRAL Likelihood =  -9.13  Transmembrane   22-38    (15-42)
INTEGRAL Likelihood =  -8.28  Transmembrane  257-273   (252-281)
INTEGRAL Likelihood =  -7.48  Transmembrane  281-297   (275-301)
INTEGRAL Likelihood =  -7.06  Transmembrane  109-125   (95-137)
INTEGRAL Likelihood =  -6.10  Transmembrane  185-201   (181-206)
INTEGRAL Likelihood =  -1.44  Transmembrane  212-228   (212-229)
INTEGRAL Likelihood =  -0.27  Transmembrane    5-21    (5-21)

----- Final Results -----
             bacterial membrane --- Certainty = 0.5310 (Affirmative) < succ>
              bacterial outside --- Certainty = 0.0000 (Not Clear)   < succ>
            bacterial cytoplasm --- Certainty = 0.0000 (Not Clear)   < succ>
```

An alignment of the GAS and GBS sequences follows:

```
Score = 405 bits (1029), Expect = e-115
Identities = 198/301 (65%), Positives = 228/301 (74%)

Query:   1 LTAKVFFCKLVFMNEMLILRLIQALLVSAMLFIFFMLVKHLKKNKINPFKRFWTGFWIGL    60
           LT  +FFC+L  MNE L+L  IQ +L+ AM+  F+ +V+H++  KINPFKRF+TG WIG
Sbjct:  10 LTVSLFFCRLDIMNETLLLHGIQLILIIAMIITFYQIVRHIRSQKINPFKRFFTGLWIGF   69

Query:  61 LTDALDTLGIGSFATTTTCFKLTKLVTDDRQLPGTMTVAHVLPVLIQSLCFIFVVKVEVX  120
           +TDALDTLGIGSFATTTT FKLTKLV DDR++P TMT AHVLPVL+QSLCFIFVVKVE
Sbjct:  70 VTDALDTLGIGSFATTTTFFKLTKLVEDDRKIPATMTAAHVLPVLLQSLCFIFVVKVEAL  129

Query: 121 XXXXXXXXXXFIGAYFGTHITKNWHAPTVQRILGSLLXXXXXXXXXXXXXYHPGEHLSDTIH  180
                     FIGA+ G  +TKNWHAPTVQRILG+LL             +PG   +SD++H
Sbjct: 130 TLITMAGAAFIGAFVGAMTKNWHAPTVQRILGTLLITAAIIMLYRMITNPGAGISDSVH   189

Query: 181 GLHGIWLFVGIGFNFIVGVLMTMGLGNYAPELIFFSLMGLSPTVAMPVMMLDAAMIMTAS  240
           GLHGIWLFVGIGFNFI+GVLMTMGLGNYAPELIFFSLMGLSP VAMPVMMLDAAMIMTAS
Sbjct: 190 GLHGIWLFVGIGFNFIIGVLMTMGLGNYAPELIFFSLMGLSPAVAMPVMMLDAAMIMTAS  249

Query: 241 SSQFIKANRVSWDXXXXXXXXXXXXXXXXXXXFFLTNLDINSLKLLVIAIVFFTGGMLIRSSF  301
           S+QFIK+ RV+W+                   FLTNLD+NSLK LV+ IV FTG MLIRSSF
Sbjct: 250 STQFIKSGRVNWNGFAGLVTGGILGVIVAVLFLTNLDLNSLKTLVVGIVLFTGAMLIRSSF  310
```

Based on this analysis, it was predicted that these proteins and their epitopes could be useful antigens for vaccines or diagnostics.

EXAMPLE 1623

A DNA sequence (GBSx1718) was identified in *S. agalactiae* <SEQ ID 5011> which encodes the amino acid sequence <SEQ ID 5012>. This protein is predicted to be C3-degrading proteinase. Analysis of this protein sequence reveals the following:

```
Possible site: 45
>>> Seems to have no N-terminal signal sequence

----- Final Results -----
            bacterial cytoplasm --- Certainty = 0.2851(Affirmative) < succ>
             bacterial membrane --- Certainty = 0.0000(Not Clear)   < succ>
              bacterial outside --- Certainty = 0.0000(Not Clear)   < succ>
```

The protein has homology with the following sequences in the GENPEPT database.

```
>GP: AAD37110 GB: AF112358 C3-degrading proteinase
[Streptococcus pneumoniae]
Identities = 92/240 (38%), Positives = 142/240 (58%),
Gaps = 11/240 (4%)

Query:  12 PVLRVNNRDLNIAFYQESLGFKLISEENAIAVFSAWQNKEASFIIEESPTYRTRAVNGTK   71
           P L+ NNR LN  FY E+LG K +  EE+A          E   ++EE+P+ RTR V G K
Sbjct:  11 PTLKANNRKLNETFYIETLGMKALLEESAFLSLGDQTGLE-KLVLEEAPSMRTRKVEGRK   69
```

```
                              -continued
Query:  72 KLAKIIVKSQDAKDIEKLLANGAQAIQVYQGQNGYAYETVSPEGDLFLLHAEDDLSQLVA  131
           KLA++IVK ++  +IE +L+      ++Y+GQNGYA+E  SPE DL L+HAEDD++ LV
Sbjct:  70 KLARLIVKVENPLEIEGILSKTDSIHRLYKGQNGYAFEIFSPEDDLILIHAEDDIASLVE  129

Query: 132 I-ERPELEKKDDTTGLSNFAFQSISLNVPDAVKAEAFYDKVFAGKFPINLSFKEAQGQDL  190
           + E+PE +     +  LS F   S+ L++P  + E+F +   + +    +L F  AQGQDL
Sbjct: 130 VGEKPEFQTDLASISLSKFEI-SMELHLPTDI--ESFLE---SSEIGASLDFIPAQGQDL  183

Query: 191 QIAPNETWDIEILECCVNEDTNLNDLKSTFESLGLDVYLDSKEKILVISDTSNIEIWISK  250
            +      TWD+ +L+  VNE  ++ L+ FES   + ++  EK  +  D +N+E+W  +
Sbjct: 184 TVDNTVTWDLSMLKFLVNE-LDIASLRQKFES--TEYFIPKSEKFFLGKDRNNVELWFEE  240
```

A related DNA sequence was identified in *S. pyogenes* <SEQ ID 5013> which encodes the amino acid sequence <SEQ ID 5014>. Analysis of this protein sequence reveals the following:

```
Possible site: 42
>>> Seems to have no N-terminal signal sequence

----- Final Results -----
              bacterial cytoplasm --- Certainty = 0.3267(Affirmative) < succ>
              bacterial membrane  --- Certainty = 0.0000(Not Clear)   < succ>
              bacterial outside   --- Certainty = 0.0000(Not Clear)   < succ>
```

An alignment of the GAS and GBS proteins is shown below.

```
Identities = 130/250 (52%), Positives = 177/250 (70%)

Query:   1 MTLFHSLTFKHPVLRVNNRDLNIAFYQESLGFKLISEENAIAVFSAWQNKEASFIIEESP   60
           MTL  ++TFK PVLRVN+RDLNIAFYQ +LG L+SEENAIA+FS+W   + F+IEESP
Sbjct:   1 MTLMENITFKTPVLRVNDRDLNIAFYQNNLGLRLVSEENAIAIFSSWGEGQECFVIEESP   60

Query:  61 TYRTRAVNGTKKLAKIIVKSQDAKDIEKLLANGAQAIQVYQGQNGYAYETVSPEGDLFLL  120
           + RTRAV G KK+  I++K+   K+IE+LLA+GA     +++GQNGYA+ET+SPEGD FLL
Sbjct:  61 SVRTRAVEGPKKVNTIVIKTNQPKEIEQLLAHGAHYDALFKGQNGYAFETISPEGDRFLL  120

Query: 121 HAEDDLSQLVAIERPELEKKDDTTGLSNFAFQSISLNVPDAVKAEAFYDKVFAGKFPINL  180
           HAE D+  L  + P LEK     GL+ F F  I LNV    +++AFY  +F+ + PI +
Sbjct: 121 HAEQDIKHLQGTDLPSLEKDATFKGLTQFKFDIIVLNVISEERSKAFYRDLFSDQLPITM  180

Query: 181 SFKEAQGQDLQIAPNETWDIEILECCVNEDTNLNDLKSTFESLGLDVYLDSKEKILVISD  240
            F + +G DL I P+  WD+EILE  V++D ++  LK+T E  G  VY+D K K+LV+SD
Sbjct: 181 DFIQEEGPDLAIDPHIAWDLEILEFQVSKDYDMKVLKATLEEDGHKVYIDKKHKVLVLSD  240

Query: 241 TSNIEIWISK                                                   250
            S IE+W +K
Sbjct: 241 PSQIEVWFTK                                                   250
```

Based on this analysis, it was predicted that these proteins and their epitopes could be useful antigens for vaccines or diagnostics.

EXAMPLE 1624

A DNA sequence (GBSx1719) was identified in *S. agalactiae* <SEQ ID 5015> which encodes the amino acid sequence <SEQ ID 5016>. Analysis of this protein sequence reveals the following:

```
Possible site: 31
>>> Seems to have no N-terminal signal sequence

----- Final Results -----
              bacterial cytoplasm --- Certainty = 0.2510(Affirmative) < succ>
              bacterial membrane  --- Certainty = 0.0000(Not Clear)   < succ>
              bacterial outside   --- Certainty = 0.0000(Not Clear)   < suec>
```

The protein has homology with the following sequences in the GENPEPT database.

```
>GP: CAC16441 GB: AL450165 putative esterase [Streptomyces coelicolor]
Identities = 89/323 (27%), Positives = 143/323 (43%),
Gaps = 51/323 (15%)

Query:   10 NTVLELIKEQIKDNLYHGASLAIY-ENGEWHEHYLGT-------IDGNEKVKAGLVYDLA   61
            +T+ EL+ E  +  + GA+ ++      G     + GT      +DG++      V+DLA
Sbjct:    2 STLAELLAEGREQRICSGAAWSVGGPQGPLDRGWTGTRCWDGPPLDGDD------VWDLA   55

Query:   62 SVSKVVGVGTLLAKLVYQGTIDIDKPLRYYYPTFH---HQTLTVRQLATHSSCIDPFIP-  117
            SV+K  +  G ++  LV +G + +D  +  Y P +       LTVRQL   H+SGI    +P
Sbjct:   56 SVTKPIA-GLVVMALVERGALGLDDTVGGYLPDYRGGDKAELTVRQLLAHTSGIPGQVPL  114

Query:  118 NRDQLNATQLKDAINHIKVLEDKSFK--YTDINFLLLGFMLEEVLGDSLDKLFKRYIFTP  175
               RD       L +A+  + +     +   Y+    F++LG + E    G+ L+ L +R +   P
Sbjct:  115 YRDHPTRAALLEAVRLLPLTAQPGTRVQYSSQGFIVLGLIAEAAAGEPLEALVERLVCAP  174

Query:  176 FQMKETSFGPRVEAVPTVVGIND---------GIVHDPKAKVLGKHTGSAGLFSTIDDLQ  226
             +++T F P         V  D           G VHD  A VLG   G AGLFST+ D++
Sbjct:  175 LGLRDTVFRPDAGRRARAVATEDCPWRGRRVVGEVHDENAVVLGGVGGHAGLFSTLADME  234

Query:  227 RFSIHYL--------KDDFA-KPLWNNYSLSKSRSLAWD------------IDKDWINHT  265
             R              + FA  +    L+  R+LAW               +    HT
Sbjct:  235 RLGAALAAGGRGLLRPETFALMTAAHTDGLALRRALAWQGRDPVGSPAGEVFGPESYGHT  294

Query:  266 GYTGPFIALNYQKQAAAIFLTNR                                       288
            G+TG  + ++    + A+ LTNR
Sbjct:  295 GFTGTSLWVDPATRRYAVLLTNR                                       317
```

A related DNA sequence was identified in *S. pyogenes* <SEQ ID 3885> which encodes the amino acid sequence <SEQ ID 3886>. Analysis of this protein sequence reveals the following:

```
Possible site: 28
>>> Seems to have no N-terminal signal sequence
      INTEGRAL      Likelihood = -1.33       Transmembrane     57-73 (57-74)

----- Final Results -----
            bacterial membrane --- Certainty = 0.1532(Affirmative) < succ>
            bacterial outside  --- Certainty = 0.0000(Not Clear)   < succ>
            bacterial cytoplasm --- Certainty = 0.0000(Not Clear)  < succ>
```

An alignment of the GAS and GBS proteins is shown below.

```
Identities = 174/302 (57%), Positives = 229/302 (75%),
Gaps = 1/302 (0%)

Query:    9 TNTVLELIKEQIKDNLYHGASLAIYENGEWHEHYLGTIDGNEKVKAGLVYDLASVSKVVG   68
            T  V++ I+  +   +Y GASLA++++G W E+++GTIDG    V A LVYDLASVSKVVG
Sbjct:    6 TLAVIKCIENHLHKKVYKGASLALFQSGRWQEYHIGTIDGRRPVDANLVYDLASVSKVVG   65

Query:   69 VGTLLAKLVYQGTIDIDKPLRYYYPTFHHQTLTVRQLATHSSGIDPFIPNRDQLNATQLK  128
            V T+  L+  GT+ +D PL+ YYP+    T+T+RQL TH+SG+DP+IPNRD LNA QL+
Sbjct:   66 VATICNILLNNGTLALDDPLKVYYPSIADATVTIRQLLTHTSGLDPYIPNRDVLNAQQLR  125

Query:  129 DAINHIKVLEDKSFKYTDINFLLLGFMLEEVLGDSLDKLFKRYIFTPFQMKETSFGPRVE  188
             A+NH+   E+K+F YTD+NFLLLGFMLEE+ +SLD++ +  IFTPF M  TSFGPR E
Sbjct:  126 KALNHLTQKENKNFYYTDVNFLLLGFMLEELFSESLDQIFDKTIFTPFGMYHTSFGPRPE  185

Query:  189 AVPTVVGINDGIVHDPKAKVLGKHTGSAGLFSTIDDLQRFSIHYLKDDFAKPLWNNYSLS  248
            AVPT+ G++DG VHDPKAK+L KH+GSAGLFST+ DL+ FS HYL D F+  LW NYS
Sbjct:  186 AVPTLKGVSDGEVHDPKAKILKKHSGSAGLFSTLADLESFSNHYLNDPFSDCLWRNYSQQ  245

Query:  249 K-SRSLAWDIDKDWINHTGYTGPFIALNYQKQAAAIFLTNRTFSYDDRPLWIKKRRHVQE  307
              RSL W++D DWI+HTGYTGPF+ LN ++Q AAIFLTNRT+  DD+  W+K+R+ +
Sbjct:  246 TIERSLGWNLDGDWISHTGYTGPFLMLNKKEQTAAIFLTNRTYDEDDKSKWLKERQLLYN  305

Query:  308 AI                                                            309
            A+
Sbjct:  306 AL                                                            307
```

Based on this analysis, it was predicted that these proteins and their epitopes could be useful antigens for vaccines or diagnostics.

EXAMPLE 1625

A DNA sequence (GBSx1720) was identified in *S. agalactiae* <SEQ ID 5017> which encodes the amino acid sequence <SEQ ID 5018>. Analysis of this protein sequence reveals the following:

```
Possible site: 31
>>> Seems to have no N-terminal signal sequence

----- Final Results -----
            bacterial cytoplasm --- Certainty = 0.0935(Affirmative) < succ>
             bacterial membrane --- Certainty = 0.0000(Not Clear)   < succ>
              bacterial outside --- Certainty = 0.0000(Not Clear)   < succ>
```

The protein has homology with the following sequences in the GENPEPT database.

```
>GP: BAA25177 GB: D21804 FMN-binding protein [Desulfovibrio vulgaris]
Identities = 53/124 (42%), Positives = 76/124 (60%), Gaps = 2/124 (1%)

Query:    1 MLNHKFLQVLKYEGVVSITSWIELAPHVTNTWNSYLTITDDQRILAPAAGMTHLENDLNN    60
            ML   F +VLK EGVV+I +  E  PH+ NTWNSYL + D  RI+ P  GM    E ++
Sbjct:    1 MLPGTFFEVLKNEGVVAIATQGEDGPHLVNTWNSYLKVLDGNRIVVPVGGMHKTEANVAR   60

Query:   61 NSKIIMTLGSREVEGRDGYQGTGFRIEGTAKLLEAGSDFEIVKEKYPFLRKVLEVTPINV  120
            + +++MTLGSR+V GR+G  GTGF I G+A       G +FE +  ++ + R  L +T ++
Sbjct:   61 DERVLMTLGSRKVAGRNG-PGTGFLIRGSAAFRTDGPEFEAI-ARFKWARAALVITVVSA  118

Query:  121 IQLL                                                         124
              Q L
Sbjct:  119 EQTL                                                         122
```

No corresponding DNA sequence was identified in *S. pyogenes*.

Based on this analysis, it was predicted that this protein and its epitopes, could be useful antigens for vaccines or diagnostics.

EXAMPLE 1626

A DNA sequence (GBSx1721) was identified in *S. agalactiae* <SEQ ID 5019> which encodes the amino acid sequence <SEQ ID 5020>. Analysis of this protein sequence reveals the following:

```
Possible site: 30
>>> Seems to have no N-terminal signal sequence

----- Final Results -----
            bacterial cytoplasm --- Certainty = 0.3799(Affirmative) < succ>
             bacterial membrane --- Certainty = 0.0000(Not Clear)   < succ>
              bacterial outside --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1627

A DNA sequence (GBSx1722) was identified in *S. agalactiae* <SEQ ID 5021> which encodes the amino acid sequence <SEQ ID 5022>. Analysis of this protein sequence reveals the following:

```
Possible site: 56
>>> Seems to have no N-terminal signal sequence

----- Final Results -----
            bacterial cytoplasm --- Certainty = 0.3175(Affirmative) < succ>
             bacterial membrane --- Certainty = 0.0000(Not Clear)   < succ>
              bacterial outside --- Certainty = 0.0000(Not Clear)   < succ>
```

A related GBS nucleic acid sequence <SEQ ID 10123> which encodes amino acid sequence <SEQ ID 10124> was also identified.

The protein has homology to a pyruvate formate-lyase from *S. mutans*:

```
>GP: BAA09085 GB: D50491 Pyruvate formate-lyase [Streptococcus mutans]
Identities = 709/770 (92%), Positives = 750/770 (97%)

Query:   7 MATVKTNTDIFEQAWEGFKGVDWKEKASIARFVQANYAPYDGDESFLAGATERSLHIKKV   66
           MATVKTNTD+FE+AWEGFKG DWK++ASI+RFVQ NY PYDG ESFLAG TERSLHIKKV
Sbjct:   1 MATVKTNTDVFEKAWEGFKGTDWKDRASISRFVQDNYTPYDGGESFLAGPTERSLHIKKV   60

Query:  67 IEETKAHYEETRFPMDTRVASISELPAGFIDKDNELIFGIQNDELFKLNFMPKGGIRMAE  126
           +EETKAHYEETRFPMDTR+ SI+++PAG+IDK+NELIFGIQNDELFKLNFMPKGGIRMAE
Sbjct:  61 VEETKAHYEETRFPMDTRITSIADIPAGYIDKENELIFGIQNDELFKLNFMPKGGIRMAE  120

Query: 127 TTLKENGYEPDPAVHEIFTKYATTVNDGIFRAYTSNIRRARHAHTVTGLPDAYSRGRIIG  186
           T LKE+GYEPDPAVHEIFTKYATTVNDGIFRAYTSNIRRARHAHTVTGLPDAYSRGRIIG
Sbjct: 121 TALKEHGYEPDPAVHEIFTKYATTVNDGIFRAYTSNIRRARHAHTVTGLPDAYSRGRIIG  180

Query: 187 VYARLAVYGADYLMQEKVNDWNALNDIDEESIRLREEINLQYQALGEVVKLGDLYGVDVR  246
           VYARLA+YGADYLMQEKVNDWN++ +IDEESIRLREEINLQYQALGEVV+LGDLYG+DVR
Sbjct: 181 VYARLALYGADYLMQEKVNDWNSIAEIDEESIRLREEINLQYQALGEVVRLGDLYGLDVR  240

Query: 247 KPAMNTKEAIQWVNIAFMAVCRVINGAATSLGRVPIVLDIFAERDLARGTFTESEIQEFV  306
           KPAMN KEAIQW+NIAFMAVCRVINGAATSLGRVPIVLDIFAERDLARGTFTESEIQEFV
Sbjct: 241 KPAMNVKEAIQWINIAFMAVCRVINGAATSLGRVPIVLDIFAERDLARGTFTESEIQEFV  300

Query: 307 DDFVLKLRTVKFARTKAYDALYSGDPTFITTSMAGMGADGRHRVTKMDYRFLNTLDNIGN  366
           DDFV+KLRTVKFARTKAYD LYSGDPTFITTSMAGMGADGRHRVTKMDYRFLNTLDNIGN
Sbjct: 301 DDFVMKLRTVKFARTKAYDELYSGDPTFITTSMAGMGADGRHRVTKMDYRFLNTLDNIGN  360

Query: 367 SPEPNLTVLWSDQLPYAFRRYCMSMSHKHSSIQYEGVSTMAKEGYGEMSCISCCVSPLDP  426
           +PEPNLTVLWS +LPY+FR YCMSMSHKHSSIQYEGV+TMAKEGYGEMSCISCCVSPLDP
Sbjct: 361 APEPNLTVLWSSKLPYSFRHYCMSMSHKHSSIQYEGVTTMAKEGYGEMSCISCCVSPLDP  420

Query: 427 ENEDKRHNLQYFGARVNVMKALLTGLNGGYDDVHKDYKVFDIDPIRDEVLNFDTVKANFE  486
           ENED+RHNLQYFGARVNV+KALLTGLNGGYDDVHKDYKVFD++PIRDEVL+F+TVKANFE
Sbjct: 421 ENEDRRHNLQYFGARVNVLKALLTGLNGGYDDVHKDYKVFDVEPIRDEVLDFETVKANFE  480

Query: 487 KSLDWLTDTYVDAMNIIHYMTDKYNYEAVQMAFLPSHVRANMGFGICGFANTVDSLSAIK  546
           K+LDWLTDTYVDAMNIIHYMTDKYNYEAVQMAFLP+ V+ANMGFGICGF+NTVDSLSAIK
Sbjct: 481 KALDWLTDTYVDAMNIIHYMTDKYNYEAVQMAFLPTRVKANMGFGICGFSNTVDSLSAIK  540

Query: 547 YATVKPIRDEDGYIYDYETVGDFPRYGEDDDRVDSIAEWLLEAFHGRLAKHKLYKDAEAT  606
           YATVKPIRDEDGYIYDYETVG+FPRYGEDDDRVDSIAEWLLEAFH RLA+HKLYKD+EAT
Sbjct: 541 YATVKPIRDEDGYIYDYETVGNFPRYGEDDDRVDSIAEWLLEAFHTRLARHKLYKDSEAT  600

Query: 607 VSLLTITSNVAYSKQTGNSPVHKGVYLNEDGSVNLSKVEFFSPGANPSNKAKGGWLQNLN  666
           VSLLTITSNVAYSKQTGNSPVHKGVYLNEDGSVNLSKVEFFSPGANPSNKA GGWLQNLN
Sbjct: 601 VSLLTITSNVAYSKQTGNSPVHKGVYLNEDGSVNLSKVEFFSPGANPSNKASGGWLQNLN  660

Query: 667 SLSKLDFAHANDGISLTTQVSPRALGKTFDEQVDNLVTVLDGYFENGGQHVNLNVMDLKD  726
           SL KLDFAHANDGISLTTQVSP+ALGKTFDEQV NLVT+LDGYFE GGQHVNLNVMDLKD
Sbjct: 661 SLKKLDFAHANDGISLTTQVSPKALGKTFDEQVANLVTILDGYFEGGGQHVNLNVMDLKD  720

Query: 727 VYDKIMNGEDVIVRISGYCVNTKYLTPEQKTELTQRVFHEVLSMDDALTN            776
           VYDKIMNGEDVIVRISGYCVNTKYLT EQKTELTQRVFHEVLSMDDA T+
Sbjct: 721 VYDKIMNGEDVIVRISGYCVNTKYLTKEQKTELTQRVFHEVLSMDDAATD            770
```

A related DNA sequence was identified in *S. pyogenes* <SEQ ID 5023> which encodes the amino acid sequence <SEQ ID 5024>. Analysis of this protein sequence reveals the following:

```
Possible site: 59
>>> Seems to have no N-terminal signal sequence

----- Final Results -----
             bacterial cytoplasm --- Certainty = 0.3184(Affirmative) < succ>
              bacterial membrane --- Certainty = 0.0000(Not Clear)  < succ>
                bacterial outside --- Certainty = 0.0000(Not Clear)  < succ>
```

An alignment of the GAS and GBS proteins is shown below.

```
Identities = 701/773 (90%), Positives = 742/773 (95%),
Gaps = 1/773 (0%)

Query:   2 FKEKTMATVKTNTDIFEQAWEGFKGVDWKEKASIARFVQANYAPYDGDESFLAGATERSL  61
           FKEK MATVKTNTD+FE+AWEGFKG DWKEKAS++RFVQANY PYDGDESFLAGATERSL
Sbjct:   5 FKEKFMATVKTNTDVFEKAWEGFKGTDWKEKASVSRFVQANYTPYDGDESFLAGATERSL  64

Query:  62 HIKKVIEETKAHYEETRFPMDTRVASISELPAGFIDKDNELIFGIQNDELFKLNFMPKGG 121
           HIKKVIEETKAHYE TRFP DTR  SI+++PAGFIDK+NELI+GIQNDELFKLNFMPKGG
Sbjct:  65 HIKKVIEETKAHYEATRFPYDTRPTSIADIPAGFIDKENELIYGIQNDELFKLNFMPKGG 124

Query: 122 IRMAETTLKENGYEPDPAVHEIFTKYATTVNDGIFRAYTSNIRRARHAHTVTGLPDAYSR 181
           IRMAETTLKENGYEPDPAVHEIFTKY TTVNDGIFRAYTSNIRRARHAHTVTGLPDAYSR
Sbjct: 125 IRMAETTLKENGYEPDPAVHEIFTKYVTTVNDGIFRAYTSNIRRARHAHTVTGLPDAYSR 184

Query: 182 GRIIGVYARLAVYGADYLMQEKVNDWNALNDIDEESIRLREEINLQYQALGEVVKLGDLY 241
           GRIIGVYARLA+YGADYLMQEKVNDWNA+ +IDEESIRLREE+NLQYQALGEVVKLGDLY
Sbjct: 185 GRIIGVYARLALYGADYLMQEKVNDWNAITEIDEESIRLREEVNLQYQALGEVVKLGDLY 244

Query: 242 GVDVRKPAMNTKEAIQWVNIAFMAVCRVINGAATSLGRVPIVLDIFAERDLARGTFTESE 301
           GVDVR+PA N KEAIQWVNIAFMAVCRVINGAATSLGRVPIVLDIFAERDLARGTFTESE
Sbjct: 245 GVDVRRPAQNVKEAIQWVNIAFMAVCRVINGAATSLGRVPIVLDIFAERDLARGTFTESE 304

Query: 302 IQEFVDDFVLKLRTVKFARTKAYDALYSGDPTFITTSMAGMGADGRHRVTKMDYRFLNTL 361
           IQEFVDDFVLKLRTVKF RTKAYDALYSGDPTFITTSMAGMG DGRHRVTKMDYRFLNTL
Sbjct: 305 IQEFVDDFVLKLRTVKFGRTKAYDALYSGDPTFITTSMAGMGNDGRHRVTKMDYRFLNTL 364

Query: 362 DNIGNSPEPNLTVLWSDQLPYAFRRYCMSMSHKHSSIQYEGVSTMAKEGYGEMSCISCCV 421
           DNIGNSPEPNLTVLW+DQLP  FRRYCM MSHKHSSIQYEGV+TMAKEGYGEMSCISCCV
Sbjct: 365 DNIGNSPEPNLTVLWTDQLPETFRRYCMKMSHKHSSIQYEGVTTMAKEGYGEMSCISCCV 424

Query: 422 SPLDPENEDKRHNLQYFGARVNVMKALLTGLNGGYDDVHKDYKVFD-IDPIRDEVLNFDT 480
           SPLDPENE++RHN+QYFGARVNV+KALLTGLNGGYDDVH+DYKVF+ ++PI  EVL +D
Sbjct: 425 SPLDPENEEQRHNIQYFGARVNVLKALLTGLNGGYDDVHRDYKVFNVVEPITSEVLEYDE 484

Query: 481 VKANFEKSLDWLTDTYVDAMNIIHYMTDKYNYEAVQMAFLPSHVRANMGFGICGFANTVD 540
           V ANFEKSLDWLTDTYVDA+NIIHYMTDKYNYEAVQMAFLP+H RANMGFGICGFANTVD
Sbjct: 485 VMANFEKSLDWLTDTYVDALNIIHYMTDKYNYEAVQMAFLPTHQRANMGFGICGFANTVD 544

Query: 541 SLSAIKYATVKPIRDEDGYIYDYETVGDFPRYGEDDDRVDSIAEWLLEAFHGRLAKHKLY 600
           +LSAIKYATVK IRDE+GYIYDYE  GDFPRYGEDDDRVD IA+WL+EA+H RLA HKLY
Sbjct: 545 TLSAIKYATVKTIRDENGYIYDYEVTGDFPRYGEDDDRVDDIAKWLMEAYHTRLASHKLY 604

Query: 601 KDAEATVSLLTITSNVAYSKQTGNSPVHKGVYLNEDGSVNLSKVEFFSPGANPSNKAKGG 660
           K+AEA+VSLLTITSNVAYSKQTGNSPVH+GV+LNEDG+VN S+VEFFSPGANPSNKAKGG
Sbjct: 605 KNAEASVSLLTITSNVAYSKQTGNSPVHRGVFLNEDGTVNTSQVEFFSPGANPSNKAKGG 664

Query: 661 WLQNLNSLSKLDFAHANDGISLTTQVSPRALGKTFDEQVDNLVTVLDGYFENGGQHVNLN 720
           WLQNLNSL+KL+F+HANDGISLTTQVSPRALGKTFDEQVDNLVTVLDGYFENGGQHVNLN
Sbjct: 665 WLQNLNSLAKLEFSHANDGISLTTQVSPRALGKTFDEQVDNLVTVLDGYFENGGQHVNLN 724

Query: 721 VMDLKDVYDKIMNGEDVIVRISGYCVNTKYLTPEQKTELTQRVFHEVLSMDDA         773
           VMDL DVYDKIMNGEDVIVRISGYCVNTKYLTPEQKTELTQRVFHEVLSMDDA
Sbjct: 725 VMDLNDVYDKIMNGEDVIVRISGYCVNTKYLTPEQKTELTQRVFHEVLSMDDA         777
```

Based on this analysis, it was predicted that these proteins and their epitopes could be useful antigens for vaccines or diagnostics.

EXAMPLE 1628

A DNA sequence (GBSx1723) was identified in *S. agalactiae* <SEQ ID 5025> which encodes the amino acid sequence <SEQ ID 5026>. This protein is predicted to be DNA-damage inducible protein P (dinP). Analysis of this protein sequence reveals the following:

```
Possible site: 31
>>> Seems to have an uncleavable N-term signal seq

----- Final Results -----
              bacterial membrane --- Certainty = 0.0000(Not Clear) < succ>
               bacterial outside --- Certainty = 0.000(Not Clear) < succ>
             bacterial cytoplasm --- Certainty = 0.0000(Not Clear) < succ>
```

A related GBS nucleic acid sequence <SEQ ID 10121> which encodes amino acid sequence <SEQ ID 10122> was also identified.

The protein has homology with the following sequences in the GENPEPT database.

```
>GP: AAF95431 GB: AE004300 DNA-damage-inducible
protein P [Vibrio cholerae]
Identities = 136/349 (38%), Positives = 210/349 (59%), Gaps = 14/349 (4%)

Query:  12 INDTSRKIIHIDMDAFFASVEERDNPSLKGKPVIIGSDPRKTGGRGVVSTCNYEARKFGV   71
            + D  RKIIH+DMD FFA+VE RDNP+ +    + +G   ++   RGV+STCNY+ARKFGV
Sbjct:   1 MQDRIRKIIHVDMDCFFAAVEMRDNPAYREIALAVGGHEKQ---RGVISTCNYQARKFGV   57

Query:  72 HSAMSSKEAYERCPQAIFISGNYQKYRQVGMEVRDIFKKYTDLVEPMSIDEAYLDVTENK  131
              SAM + +A +  CPQ    + G     Y+ V  +++ IF++YT L+EP+S+DEAYLDV+E+
Sbjct:  58 RSAMPTAQALKLCPQLHVVPGRMSVYKSVSQQIQTIFQRYTSLIEPLSLDEAYLDVSEST  117

Query: 132 MGIKSAVKLAKMIQYDIWNDVHLTCSAGISYNKFLAKLASDFEKPKGLTLILPDQAQDFL  191
              SA  +A+ I+ DIW +++LT SAG++  KFLAK+ASD  KP GL ++ PD+ Q+ +
Sbjct: 118 AYQGSATLIAQAIRRDIWQELNLTASAGVAPIKFLAKVASDLNKPDGLYVVTPDKVQEMV  177

Query: 192 KPLPIEKFHGVGKRSVEKLHALGVYTGEDLLSLSEISLIDMFGRFGYDLYRKARGINASP  251
              LP+EK  GVGK ++EKLH  G+Y G D+     L+  FGR G  L++K+ GI+
Sbjct: 178 DSLPLEKIPGVGKVALEKLHQAGLYVGADVRRADYRKLLHQFGRLGASLWKKSHGIDERE  237

Query: 252 VKPDRVRKSIGSEKTYGKLLYNEADIKAEISKNVQRVVASLEKNKKVGKTIV---LKVRY  308
            V  +R RKS+G E T+ + +      +    I + +    + +       + I+    +KV++
Sbjct: 238 VVTERERKSVGVEYTFSQNISTFQECWQVIEQKLYPELDARLSRAHPQRGIIKQGIKVKF  297

Query: 309 ADFETLTKRMTLEEYTQDF--QIIDVAKAIFDTLEESVFGIRLLGVTV              355
            ADF+  T      D+ ++++QV       +       IRLLG++V
Sbjct: 298 ADFQQTTIEHVHPALELDYFHELLEQV------LTRQQGREIRLLGLSV            340
```

A related DNA sequence was identified in *S. pyogenes* <SEQ ID 5027> which encodes the amino acid sequence <SEQ ID 5028>. Analysis of this protein sequence reveals the following:

```
Possible site: 27
>>> Seems to have no N-terminal signal sequence

----- Final Results -----
             bacterial cytoplasm --- Certainty = 0.1921(Affirmative) < succ>
              bacterial membrane --- Certainty = 0.0000(Not Clear)   < succ>
               bacterial outside --- Certainty = 0.0000(Not Clear)   < succ>
```

An alignment of the GAS and GBS proteins is shown below.

```
Identities = 276/363 (76%), Positives = 323/363 (88%)

Query:   6 MLIFPLINDTSRKIIHIDMDAFFASVEERDNPSLKGKPVIIGSDPRKTGGRGVVSTCNYE   65
           MLIFPLINDTSRKIIHIDMDAFFA+VEERDNP+LKGKPV+IG DPR TGGRGVVSTCNYE
Sbjct:   1 MLIFPLINDTSRKIIHIDMDAFFAAVEERDNPALKGKPVVIGKDPRETGGRGVVSTCNYE   60

Query:  66 ARKFGVHSAMSSKEAYERCPQAIFISGNYQKYRQVGMEVRDIFKKYTDLVEPMSIDEAYL  125
           ARK+G+HSAMSSKEAYERCP+AIFISGNY+KYR VG ++R IFK+YTD+VEPMSIDEAYL
Sbjct:  61 ARKYGIHSAMSSKEAYERCPKAIFISGNYEKYRTVGDQIRRIFKRYTDVVEPMSIDEAYL  120

Query: 126 DVTENKMGIKSAVKLAKMIQYDIWNDVHLTCSAGISYNKFLAKLASDFEKPKGLTLILPD  185
           DVT+NK GIKSAVK AK+IQ+DIW +V LTCSAG+SYNKFLAKLASDFEKP GLTL+L +
Sbjct: 121 DVTDNKLGIKSAVKIAKLIQHDIWKEVGLTCSAGVSYNKFLAKLASDFEKPHGLTLVLKE  180
```

-continued

```
Query: 186 QAQDFLKPLPIEKFHGVGKRSVEKLHALGVYTGEDLLSLSEISLIDMFGRFGYDLYRKAR 245
           A  FL  LPIEKFHGVGK+SV+KLH +G+YTG+DLL++ E++LID FGRFG+DLYRKAR
Sbjct: 181 DALCFLAKLPIEKFHGVGKKSVKKLHDMGIYTGQDLLAVPEMTLIDHFGRFGFDLYRKAR 240

Query: 246 GINASPVKPDRVRKSIGSEKTYGKLLYNEADIKAEISKNVQRVVASLEKNKKVGKTIVLK 305
           GI+ SPVK DR+RKSIGSE+TY KLLY E DIKAEISKNV+RV A L+ +KK+GKTIVLK
Sbjct: 241 GISNSPVKYDRIRKSIGSERTYAKLLYQETDIKAEISKNVKRVAALLQDHKKLGKTIVLK 300

Query: 306 VRYADFETLTKRMTLEEYTQDFQIIDQVAKAIFDTLEESVFGIRLLGVTVTTLENEHEAI 365
           VRYADF TLTKR+TL E T++   I+QVA IFD+L E+  GIRLLGVT+T LE++   I
Sbjct: 301 VRYADFTTLTKRVTLPELTRNAAQIEQVAGDIFDSLSENPAGIRLLGVTMTNLEDKVADI 360

Query: 366 YLD                                                         368
           LD
Sbjct: 361 SLD                                                         363
```

Based on this analysis, it was predicted that these proteins and their epitopes could be useful antigens for vaccines or diagnostics.

EXAMPLE 1629

A DNA sequence (GBSx1724) was identified in *S. agalactiae* <SEQ ID 5029> which encodes the amino acid sequence <SEQ ID 5030>. Analysis of this protein sequence reveals the following:

```
Possible site: 41
>>> Seems to have an uncleavable N-term signal seq
    INTEGRAL      Likelihood = -13.11    Transmembrane     70-86 (58-92)
    INTEGRAL      Likelihood =  -5.20    Transmembrane    105-121 (100-123)
    INTEGRAL      Likelihood =  -4.25    Transmembrane    126-142 (123-144)
    INTEGRAL      Likelihood =  -2.71    Transmembrane     18-34 (18-34)

----- Final Results -----
              bacterial membrane --- Certainty = 0.6243(Affirmative) < succ>
              bacterial outside  --- Certainty = 0.0000(Not Clear)   < succ>
            bacterial cytoplasm  --- Certainty = 0.0000(Not Clear)   < succ>
```

The protein has no significant homology with any sequences in the GENPEPT database.

A related DNA sequence was identified in *S. pyogenes* <SEQ ID 5031> which encodes the amino acid

```
Possible site: 32
>>> Seems to have an uncleavable N-term signal seq
    INTEGRAL      Likelihood = -13.00    Transmembrane     69-85 (62-93)
    INTEGRAL      Likelihood =  -6.85    Transmembrane     16-32 (11-37)
    INTEGRAL      Likelihood =  -4.30    Transmembrane     99-115 (96-121)
    INTEGRAL      Likelihood =  -3.66    Transmembrane    126-142 (121-143)

----- Final Results -----
              bacterial membrane --- Certainty = 0.6201(Affirmative) < succ>
              bacterial outside  --- Certainty = 0.0000(Not Clear)   < succ>
            bacterial cytoplasm  --- Certainty = 0.0000(Not Clear)   < succ>
```

The protein has no significant homology with any sequences in the GENPEPT database.

An alignment of the GAS and GBS proteins is shown below.

```
Identities = 57/155 (36%), Positives = 96/155 (61%), Gaps = 5/155 (3%)

Query:   1 MVSYEKVRRSLRTATITIIVLNSLSLVFRLFTGISVQLAKTEI-NKGNTGNLPKEHIEAV  59
           M+SYEKVR++L+T+TI II+LN L +V  L     +  ++++ N+     L E +  +
Sbjct:   1 MISYEKVRQALKTSTIAIIILNGLGVVLSLMGFAGIFYLQSQLKNEAFRAQLTTEQLAQL  60

Query:  60 LSATTPFMLFVTALIVLVNIAIVIFCIKNLRAIKRNQTVNYLPYYLGFAITVGLVILGFL 119
             S+ TPFM+F++  L VL   IAI++FC +NL  +K+   TV+Y+PY LG  ++V  ++  F
Sbjct:  61 QSSMTPFMIFLSVLNVLAIIAIIVFCAQNLSKLKQGLTVSYIPYILGLILSVIGLVNQFT 120

Query: 120 TTKAPWAIAINIVFQAIFGLLYFHAYQKAQKLNER                          154
           TT +     + ++  A++G     A+  KA+  LNE+
Sbjct: 121 TTMSMVGTILILIQAALYGF----AFYKAKTLNEK                          151
```

Figure 119:
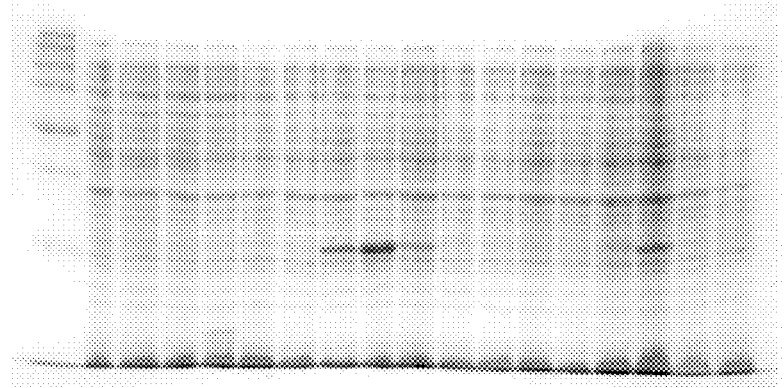

SEQ ID 5030 (GBS227) was expressed in *E. coli* as a His-fusion product. SDS-PAGE analysis of total cell extract is shown in FIG. 119 (lane 5; MW 21.2 kDa).

GBS227-His was purified as shown in FIG. 227, lane 8-9.

Based on this analysis, it was predicted that these proteins and their epitopes could be useful antigens for vaccines or diagnostics.

EXAMPLE 1630

A DNA sequence (GBSx1725) was identified in *S. agalactiae* <SEQ ID 5033> which encodes the amino acid sequence <SEQ ID 5034>. Analysis of this protein sequence reveals the following:

```
Possible site: 47
>>> Seems to have no N-terminal signal sequence

----- Final Results -----
            bacterial cytoplasm --- Certainty = 0.1224(Affirmative) < succ>
            bacterial membrane  --- Certainty = 0.0000(Not Clear)   < succ>
            bacterial outside   --- Certainty = 0.0000(Not Clear)   < succ>
```

The protein has homology with the following sequences in the GENPEPT database.

```
>GP:CAB14706 GB:Z99118 similar to conjugation transfer protein
[Bacillus subtilis]
Identities = 328/754 (43%), Positives = 484/754 (63%), Gaps = 25/754 (3%)

Query:   2 EVFFTGTIERIIFENASNFFKILLLEIEDTDSDFDDVEVIITGTMADVIEGEEYTFWGTL  61
           E +  GT+  +I+ N +N + +L +++ +T   +D  V +TG   + E E YTF+G +
Sbjct:  13 EPYLKGTVNTVIYHNDTNLYTVLKVKVTETSEAIEDKAVSVTGYFPALQEEETYTFYGKI  72

Query:  62 TQHPKYGEQLQSVRYERAKPTSG-GLVKYFSSEQFKGIGKKTAQRIVELYGDNTIDKILE 120
           T HPK+G  Q  Q+  +++   PT+   G+++Y SS+ F+GIGKKTA+  IV+  GD+ I+KIL
Sbjct:  73 VTHPKFGLQFQAEHFKKEIPTTKEGIIQYLSSDLFEGIGKKTAEEIVKKLGDSAINKILA 132

Query: 121 SPEQLSTISGLSKINREAFIAKLKLNYGTEQVLAKLAEYGLSNRAAIQIFDHYKEESLEV 180
            +    L  + LSK +      L+ + G EQ++  L ++G    + +++I+  Y+ E+LE
Sbjct: 133 DASVLYDVPRLSKKKADTLAGALQRHQGLEQIMISLNQFGFGPQLSMKIYQAYESETLEK 192

Query: 181 INENPYQLVEDIQGIGFKIADQLAEQVGIESDSPKRFRAAIIHTLVESSMEQGDTYIEAR 240
           I ENPYQLV+D++ GIGF  AD+L  ++G+  + P+R +AAI++TL  + + +G TYIE
Sbjct: 193 IQENPYQLVKDVEGIGFGKADELGSRMGLSGNHPERVKAAILYTLETTCLSEGHTYIETE 252

Query: 241 TLLEKTITLLEEA-----RQIELDPS---IVAKELTNLIAEDKVQHIGTKIFSNTLFFAE 292
           L+   T +LL ++     R   E+D +    I  E   +++ ED   +  + + +LF+AE
Sbjct: 253 QLIIDTQSLLNQSAREGQRITEMDAANAIIALGENKDIVIEDG------RCYFPSLFYAE 306

Query: 293 EGIKKNLQRILNQP-LDKQLNHKDIDREIRDIQKSLNIHYDNIQEKAIREALLSKVFILT 351
           + + K ++ I +Q   + Q         +   + + ++++ +++ Y   Q++AI++AL S + +LT
Sbjct: 307 QNVAKRVKHIASQTEYENQFPESEFLLALGELEERMDVQYAPSQKEAIQKALSSFMLLLT 366

Query: 352 GGPGTGKTTVINGIIEAYSELHHIDLN----KND--IPIVLAAPTGRAARRMNELTGLPS 405
           GGPGTGKTTVI  GI+E Y  ELH + +L+        K D    PIVLAAPTGRAA+RM+E  TGLP+
Sbjct: 367 GGPGTGKTTVIRGIVELYGELHGVSLDPSAYKKDEAFPIVLAAPTGRAAKRMSESTGLPA 426

Query: 406 ATIHRHLGLNGDSDYQSLDDY-LDCSLIIIDEFSMVDTWLAHQLFDALDSHTQVIIVGDS 464
            TIHR LG NG     +D ++   L+IIDE SM+D WLAN LF A+  H Q+IIVGD
Sbjct: 427 VTIHRLLGWNGAEGFTHTEDQPIEGKLLIIDEASMLDIWLANHLFKAIPDHIQIIIVGDE 486

Query: 465 DQLPSVGPGQVLADLLNINALPHVKLEKIFRQSEESTIVTLANQMRQGFLPEDFTAKKAD 524
           DQLPSVGPGQVL DLL    +P V+L   I+RQ+E  S+IV  LA+QM+  G LP + TA      D
Sbjct: 487 DQLPSVGPGQVLRDLLASQVIPTVRLTDIYRQAEGSSIVELAHQMKNGLLPNNLTAPTKD 546

Query: 525 RSYFEASANIIPNMISKIVQSALKSGIEAHEIQILAPMYRGQAGINNLNLIMQNLLNPLK 584
           RS+        + I  ++ K+V +ALK G  A  +IQ+LAPMYRG+AGIN  LN+++Q++LNP K
Sbjct: 547 RSFIRCGGSQIKEVVEKVVANALKKGYTAKDIQVLAPMYRGKAGINELNVMLQDILNPPK 606

Query: 585 D-NNQFTFNDINFRIGDKVLHLVNDTELNVFNGDIGYITDLIPAKYTESKQDEIYMTFDG 643
           +  +   F D+ +R GDK+L LVN  E NVFNGDIG IT +   AK     K+D     ++FDG
Sbjct: 607 EKRRELKFCDVVYRTGDKILQLVNQPENNVFNGDIGEITSIFYAKENTEKEDMAVVSFDG 666

Query: 644 QEVIYQRKEWLKITLAYAMSIHKSQGSEFQVVILPITRQSGRMLQRNLIYTAITRSKSKL 703
           +E+ + +K++ + + T AY   SIHKSQGSEF +V+LP+ +      RML+RNL+YTAITR+K   L
Sbjct: 667 NEMTFTKKDFNQFTHAYCCSIHKSQGSEFPIVVLPVVKGYYRMLRRNLLYTAITRAKKFL 726

Query: 704 ILLGEIGAFDFAVKNEGAK-RNTYLIERFENKQE                           736
           IL GE  A  ++ VKN   A   R TL  R  + E
Sbjct: 727 ILCGEEEALEWGVKNNDATVRQTSLKNRLSVQVE                           760
```

A related DNA sequence was identified in *S. pyogenes* <SEQ ID 5035> which encodes the amino acid sequence <SEQ ID 5036>. Analysis of this protein sequence reveals the following:

```
Possible site: 47
>>> Seems to have an uncleavable N-term signal seq

----- Final Results -----
             bacterial membrane --- Certainty = 0.0000(Not Clear) < succ>
             bacterial outside  --- Certainty = 0.0000(Not Clear) < succ>
             bacterial cytoplasm --- Certainty = 0.0000(Not Clear) < succ>
RGD motif: 232-234
```

The protein has homology with the following sequences in the databases:

```
>GP:CAB14706 GB:Z99118 similar to conjugation transfer protein
[Bacillus subtilis]
Identities = 318/769 (41%), Positives = 473/769 (61%), Gaps = 29/769 (3%)

Query:     7 GTVDRIIFENQANFFKILLLAIEDTDSDIDDFEIIITGTMADIIEGDDYTFWGELTQHPK   66
             GTV+ +I+ N  N + +L + + +T   I+D  + +TG    + E + YTF+G++ HPK
Sbjct:    18 GTVNTVIYHNDTNLYTVLKVKVTETSEAIEDKAVSVTGYFPALQEEETYTFYGKIVTHPK   77

Query:    67 YGQQLKLSRYQKIKPSSS-GLVNYFSSDHFKGIGKKTAEKIIALYGHNTIDHILEDPSKL  125
             +G Q +   ++K P++  G++ Y SSD F+GIGKKTAE+I+    G + I+ IL D S L
Sbjct:    78 FGLQFQAEHFKKEIPTTKEGIIQYLSSDLFEGIGKKTAEEIVKKLGDSAINKILADASVL  137

Query:   126 ETISGLSKANRQAFVAKLKLNYGTEQLIAGLVELGLSNRFALQAFEKYKEEALDLVKENP  185
                + LSK          L+ + G EQ++  L + G    + +++ ++ Y+ E L+ ++ENP
Sbjct:   138 YDVPRLSKKKADTLAGALQRHQGLEQIMISLNQFGFGPQLSMKIYQAYESETLEKIQENP  197

Query:   186 YQLVEDLQGFGFKMADALAENLGIESDSPKRFRAALLHCLLEESINRGDTYVQARQLLDF  245
             YQLV+D++G GF   AD L   +G+  + P+R +AA+L+ L       ++ G TY++  QL+
Sbjct:   198 YQLVKDVEGIGFGKADELGSRMGLSGNHPERVKAAILYTLETTCLSEGHTYIETEQLIID  257

Query:   246 AITLL-----EDARQVECDPAAVAEQLSE---LIIEGKIKNSDTKLFDASLYFAEEGIAN  297
             +LL      E R  E D A     L E    ++IE       D + +  SL++AE+  +A
Sbjct:   258 TQSLLNQSAREGQRITEMDAANAIIALGENKDIVIE------DGRCYFPSLFYAEQNVAK  311

Query:   298 NISRLLD-TPLSQSFSHDTIQTTIQAVQKDFAITYDQVQQEAITKALTSKVFLLTGGPGT  356
             +  +     T    F          + +++   + Y  Q+EAI KAL+S + LLTGGPGT
Sbjct:   312 RVKHIASQTEYENQFPESEFLLALGELEERMDVQYAPSQKEAIQKALSSPMLLLTGGPGT  371

Query:   357 GKTTVIRGILQAYANLHQIDLD----KKD--LPILLAAPTGRAARRMNELTGLPSATIHR  410
             GKTTVIRGI++ Y  LH + LD     KKD   PI+LAAPTGRAA+RM E TGLP+ TIHR
Sbjct:   372 GKTTVIRGIVELYGELHGVSLDPSAYKKDEAFPIVLAAPTGRAAKRMSESTGLPAVTIHR  431

Query:   411 HLGLNGDNDYQAMEDY-LDCDLLIVDEFSMVDTWLANQLLGAINSTTQVIIVGDSDQLPS  469
               LG NG          ED ++  LLI+DE SM+D WLAN L  AI       Q+IIVGD DQLPS
Sbjct:   432 LLGWNGAEGFTHTEDQPIEGKLLIIDEASMLDIWLANHLFKAIPDHIQIIIVGDEDQLPS  491

Query:   470 VGPGQVLSDLLKVNSLPQIALQKIFRQSQESTIVNLADQMRRGILAADFRDKKADRSYFE  529
             VGPGQVL DLL   +P + L  I+RQ++ S+IV LA QM+ G+L +       DRS+
Sbjct:   492 VGPGQVLRDLLASQVIPTVRLTDIYRQAEGSSIVELAHQMKNGLLPNNLTAPTKDRSFIR  551

Query:   530 AQAAFIPDMIQKIVLSAIKSGIPAEEIQILAPMYKGQAGINHLNQLMQELLN-PLQGQTE  588
              + I ++++K+V +A+K G  A++IQ+LAPMY+G+AGIN LN ++Q++LN P + E
Sbjct:   552 CGGSQIKEVVEKVVANALKKGYTAKDIQVLAPMYRGKAGINELNVMLQDILNPPKEKRRE  611

Query:   589 FLFNDTHFRKGDKVLHLVNDAQLNVFNGDIGYITDLIPAKYTESKQDELILDFDGSEVTY  648
              F D +R GDK+L LVN + NVFNGDIG IT + AK    K+D  ++ FDG+E+T+
Sbjct:   612 LKFGDVVYRTGDKILQLVNQPENNVFNGDIGEITSIFYAKENTEKEDMAVVSFDGNEMTF  671

Query:   649 PRNEWLKLTLAYAMSIHKSQGSEFQVVILPITRQSGRLLQRNVIYTAITRSKSKLILLGE  708
              + ++ + T AY   SIHKSQGSEF +V+LP+ +    R+L+RN++YTAITR+K   LIL GE
Sbjct:   672 TKKDFNQFTHAYCCSIHKSQGSEFPIVVLPVVKGYYRMLRRNLLYTAITRAKKFLILCGE  731

Query:   709 YTAFEYAIK-HEGDKRQTYLIERFQEQSDLASSQPNQELKSKEQTSLFS            756
              A E+ +K ++    RQT L R  Q +    + + EL++ ++  FS
Sbjct:   732 EEALEWGVKNNDATVRQTSLKNRLSVQVE----EMDAELEALQKELPFS            776
```

An alignment of the GAS and GBS proteins is shown below.

```
Identities = 544/816 (66%), Positives = 665/816 (80%), Gaps = 10/816 (1%)

Query:    1 MEVFFTGTIERIIFENASNFFKILLLEIEDTDSDFDDVEVIITGTMADVIEGEEYTFWGT   60
            ME  FTGT++RIIFEN +NFFKILLL IEDTDSD DD E+IITGTMAD+IEG++YTFWG
Sbjct:    1 MEYVFTGTVDRIIFENQANFFKILLLAIEDTDSDIDDFEIIITGTMADIIEGDDYTFWGE   60

Query:   61 LTQHPKYGEQLQSVRYERAKPTSGGLVKYFSSEQFKGIGKKTAQRIVELYGDNTIDKILE  120
            LTQHPKYG+QL+  RY++ KP+S GLV YFSS+ FKGIGKKTA++I+ LYG NTID ILE
Sbjct:   61 LTQHPKYGQQLKLSRYQKIKPSSSGLVNYFSSDHFKGIGKKTAEKIIALYGHNTIDHILE  120

Query:  121 SPEQLSTISGLSKINREAFIAKLKLNYGTEQVLAKLAEYGLSNRAAIQIFDHYKEESLEV  180
             P +L TISGLSK NR+AF+AKLKLNYGTEQ++A L E GLSNR A+Q F+ YKEE+L++
Sbjct:  121 DPSKLETISGLSKANRQAFVAKLKLNYGTEQLIAGLVELGLSNRFALQAFEKYKEEALDL  180

Query:  181 INENPYQLVEDIQGIGFKIADQLAEQVGIESDSPKRFRAAIIHTLVESSMEQGDTYIEAR  240
            + ENPYQLVED+QG GFK+AD LAE +GIESDSPKRFRAA++H L+E S+ +GDTY++AR
Sbjct:  181 VKENPYQLVEDLQGFGFKMADALAENLGIESDSPKRFRAALLHCLLEESINRGDTYVQAR  240

Query:  241 TLLEKTITLLEEARQIELDPSIVAKELTNLIAEDKVQHIGTKIFSNTLFFAEEGIKKNLQ  300
             LL+   ITLLE+ARQ+E DP+ VA++L+ LI E K+++  TK+F  +L+FAEEGI  N+
Sbjct:  241 QLLDFAITLLEDARQVECDPAAVAEQLSELIIEGKIKNSDTKLFDASLYFAEEGIANNIS  300

Query:  301 RILNQPLDKQLNHKDIDREIRDIQKSLNIHYDNIQEKAIREALLSKVFILTGGPGTGKTT  360
            R+L+ PL +  +H  I    I+ +QK    I YD +Q++AI +AL SKVF+LTGGPGTGKTT
Sbjct:  301 RLLDTPLSQSFSHDTIQTTIQAVQKDFAITYDQVQQEAITKALTSKVFLLTGGPGTGKTT  360

Query:  361 VINGIIEAYSELHHIDLNKNDIPIVLAAPTGRAARRMNELTGLPSATIHRHLGLNGDSDY  420
            VI GI++AY+ LH IDL+K D+PI+LAAPTGRAARRMNELTGLPSATIHRHLGLNGD+DY
Sbjct:  361 VIRGILQAYANLHQIDLDKKDLPILLAAPTGRAARRMNELTGLPSATIHRHLGLNGDNDY  420

Query:  421 QSLDDYLDCSLIIIDEFSMVDTWLANQLFDALDSHTQVIIVGDSDQLPSVGPGQVLADLL  480
            Q+++DYLDC L+I+DEFSMVDTWLANQL  A++S TQVIIVGDSDQLPSVGPGQVL+DLL
Sbjct:  421 QAMEDYLDCDLLIVDEFSMVDTWLANQLLGAINSTTQVIIVGDSDQLPSVGPGQVLSDLL  480

Query:  481 NINALPHVKLEKIFRQSEESTIVTLANQMRQGFLPEDFTAKKADRSYFEASANIIPNMIS  540
            +N+LP + L+KIFRQS+ESTIV LA+QMR+G L  DF  KKADRSYFEA A  IP+MI
Sbjct:  481 KVNSLPQIALQKIFRQSQESTIVNLADQMRRGILAADFRDKKADRSYFEAQAAFIPDMIQ  540

Query:  541 KIVQSALKSGIEAHEIQILAPMYRGQAGINNLNLIMQNLLNPLKDNNQFTFNDINFRIGD  600
            KIV SA+KSGI A EIQILAPMY+GQAGIN+LN +MQ LLNPL+   +F ND +FR GD
Sbjct:  541 KIVLSAIKSGIPAEEIQILAPMYKGQAGINHLNQLMQELLNPLQGQTEFLFNDTHFRKGD  600

Query:  601 KVLHLVNDTELNVFNGDIGYITDLIPAKYTESKQDEIYMTFDGQEVIYQRKEWLKITLAY  660
            KVLHLVND +LNVFNGDIGYITDLIPAKYTESKQDE+ + FDG EV Y R EWLK+TLAY
Sbjct:  601 KVLHLVNDAQLNVFNGDIGYITDLIPAKYTESKQDELILDFDGSEVTYPRNEWLKLTLAY  660

Query:  661 AMSIHKSQGSEFQVVILPITRQSGRMLQRNLIYTAITRSKSKLILLGEIGAFDFAVKNEG  720
            AMSIHKSQGSEFQVVILPITRQSGR+LQRN+IYTAITRSKSKLILLGE  AF++A+K+EG
Sbjct:  661 AMSIHKSQGSEFQVVILPITRQSGRLLQRNVIYTAITRSKSKLILLGEYTAFEYAIKHEG  720

Query:  721 AKRNTYLIERFENKQEIANSQKIEDSSIDQKI----------DNTIINTSIPKTATPIEQ  770
             KR TYLIERF+ + ++A+SQ ++    ++        D++  ++S   + P E
Sbjct:  721 DKRQTYLIERFQEQSDLASSQPNQELKSKEQTSLFSNTATLEDDSQKSSSQSTNSNPTEN  780

Query:  771 TNLSKITYRLTEENYLTIDPMIGINQQDISAIFDSK                         806
            +       +RLT ENY TID MIG+ + DI+  F  K
Sbjct:  781 SQSDNDDFRLTPENYSTIDSMIGLTESDIALFFQKK                         816
```

Based on this analysis, it was predicted that these proteins and their epitopes could be useful antigens for vaccines or diagnostics.

EXAMPLE 1631

A DNA sequence (GBSx1726) was identified in *S. agalactiae* <SEQ ID 5037> which encodes the amino acid sequence <SEQ ID 5038>. Analysis of this protein sequence reveals the following:

```
Possible site: 35
>>> Seems to have an uncleavable N-term signal seq
   INTEGRAL     Likelihood = -8.23    Transmembrane    9-25 (7-29)
```

-continued

```
----- Final Results -----
             bacterial membrane --- Certainty = 0.4291(Affirmative) < succ>
              bacterial outside --- Certainty = 0.0000(Not Clear)   < succ>
            bacterial cytoplasm --- Certainty = 0.0000(Not Clear)   < succ>
```

The protein has homology with the following sequences in the GENPEPT database.

```
>GP:AABE9116 GB:U90721 signal peptidase I [Streptococcus pneumoniae]
Identities = 120/201 (59%), Positives = 144/201 (70%), Gaps = 9/201 (4%)

Query:     2 KEFIKEWGVFILILSLFLLSRIFLWQFVKVDGHSMDPTLADKEQLVVLKQTKINRFDIVV    61
             K F+KEWG+F+LILSL  LSRIF W  V+V+GHSMDPTLAD E L V+K    I+RFDIVV
Sbjct:     5 KNFLKEWGLFLLILSLLALSRIFFWSNVRVEGHSMDPTLADGEILFVVKHLPIDRFDIVV    64

Query:    62 ANEEEGGQKKKIVKRVIGMPGDVIKYKNDTLTINNKKTEEPYLKEYTKLFKKDKLQEKYS   121
             A+EE+G    K IVKRVIGMPGD I+Y+ND L IN+K+T+EPYL +Y K FK DKLQ  YS
Sbjct:    65 AHEEDG--NKDIVKRVIGMPGDTIRYENDKLYINDKETDEPYLADYIKRFKDDKLQSTYS   122

Query:   122 -------YNPLFQDLAQSSTAFTTDSNGSSEFTTVVPKGHYYLVGDDRIVSKDSRAVGPF   174
                    F+ +AQ + AFT D N ++ F+   VP+G Y L+GDDR+VS DSR VG F
Sbjct:   123 GKGFEGNKGTFFRSIAQKAQAFTVDVNYNTNFSFTVPEGEYLLLGDDRLVSSDSRHVGTF   182

Query:   175 KKSTIVGEVKFRFWPIRRFGT                                         195
             K    I GE KFRFWPI R GT
Sbjct:   183 KAKDITGEAKFRFWPITRIGT                                         203
```

A related DNA sequence was identified in *S. pyogenes* <SEQ ID 5039> which encodes the amino acid sequence <SEQ ID 5040>. Analysis of this protein sequence reveals the following:

```
Possible site: 52
>>> Seems to have no N-terminal signal sequence
    INTEGRAL     Likelihood = -2.50    Transmembrane   35-51 (35-51)

----- Final Results -----
             bacterial membrane --- Certainty = 0.1999(Affirmative) < succ>
              bacterial outside --- Certainty = 0.0000(Not Clear)   < succ>
            bacterial cytoplasm --- Certainty = 0.0000(Not Clear)   < succ>
```

A related sequence was also identified in GAS <SEQ ID 9157> which encodes the amino acid sequence <SEQ ID 9158>. Analysis of this protein sequence reveals the following:

```
Possible site: 43
>>> Seems to have a cleavable N-term signal seq.

----- Final Results -----
              bacterial outside --- Certainty = 0.0300(Affirmative) < succ>
             bacterial membrane --- Certainty = 0.000(Not Clear)    < succ>
            bacterial cytoplasm --- Certainty = 0.000(Not Clear)    < succ>
```

An alignment of the GAS and GBS proteins is shown below.

```
Identities = 131/197 (66%), Positives = 152/197 (76%)

Query:     1 MKEFIKEWGVFILILSLFLLSRIFLWQFVKVDGHSMDPTLADKEQLVVLKQTKINRFDIV    60
             MK+FIKEWG F L L LF LSR+FLWQ VKVDGHSMDPTLA  E+L+V  Q +I+RFDIV
Sbjct:    23 MKQFIKEWGPFTLFLILFGLSRLFLWQAVKVDGHSMDPTLAHGERLIVFNQARIDRFDIV    82

Query:    61 VANEEEGGQKKKIVKRVIGMPGDVIKYKNDTLTINNKKTEEPYLKEYTKLFKKDKLQEKY   120
             VA EEE GQKK+IVKRVIG+PGD I Y +DTL IN KKT EPYL EY K FK DKLQ+ Y
Sbjct:    83 VAQEEENGQKKEIVKRVIGLPGDTISYNDDTLYINGKKTVEPYLAEYLKQFKNDKLQKTY   142

Query:   121 SYNPLFQDLAQSSTAFTTDSNGSSEFTTVVPKGHYYLVGDDRIVSKDSRAVGPFKKSTIV   180
             +YN LFQ LA++S AFTT+S G + F   VPKG Y L+GDDRIVS+DSR VG FKK  ++
Sbjct:   143 AYNTLFQQLAETSDAFTTNSEGQTRFEMSVPKGEYLLLGDDRIVSRDSREVGSFKKENLI   202
```

```
Query:  181 GEVKFRFWPIRRFGTIN                                               197
            GEVK RFWP+ +    N
Sbjct:  203 GEVKARFWPLNKMTVFN                                               219
```

SEQ ID 5038 (GBS268) was expressed in *E. coli* as a GST-fusion product. SDS-PAGE analysis of total cell extract is shown in FIG. 54 (lane 4; MW 50.3 kDa). It was also expressed in *E. coli* as a His-fusion product. SDS-PAGE analysis of total cell extract is shown in FIG. 85 (lane 9; MW 25.3 kDa) and in FIG. 160 (lane 24; MW 25.3 kDa).

GBS268-His was purified as shown in FIG. 222, lane 8.

Based on this analysis, it was predicted that these proteins and their epitopes could be useful antigens for vaccines or diagnostics.

EXAMPLE 1632

A DNA sequence (GBSx1727) was identified in *S. agalactiae* <SEQ ID 5041> which encodes the amino acid sequence <SEQ ID 5042>. This protein is predicted to be ribonuclease HIII (rnhB). Analysis of this protein sequence reveals the following:

```
Possible site: 37
>>> Seems to have no N-terminal signal sequence

----- Final Results -----
            bacterial cytoplasm --- Certainty = 0.4728(Affirmative) < succ>
            bacterial membrane  --- Certainty = 0.0000(Not Clear)   < succ>
             bacterial outside  --- Certainty = 0.0000(Not Clear)   < succ>
```

A related GBS nucleic acid sequence <SEQ ID 10119> which encodes amino acid sequence <SEQ ID 10120> was also identified.

The protein has homology with the following sequences in the GENPEPT database.

```
>GP:AAC45437 GB:U93576 ribonuclease HII [Streptococcus pneumoniae]
Identities = 176/282 (62%), Positives = 219/282 (77%), Gaps = 13/282 (4%)

Query:   16 EKIRTDLAQHHISNNNPYVVFSAKISGATVLLYTSGKLVFQGSNASHIAQKYGF--IEQK   73
            E  +T LA     + NPY+ +  K+  ATV +YTSGK++ QG  A    A +G+  +EQ
Sbjct:   18 EHYQTSLAP----SKNPYIRYFLKLPQATVSIYTSGKILLQGEGAEKYASFFGYQAVEQ-   72

Query:   74 ESCSSESQDIPIIGTDEVGNGSYFGGLAVVASFVTPKDHAYLKKLGVGDSKTLTDQKIKQ   133
                +  Q++P+IGTDEVGNGSYFGGLAVVA+FVTP  H +L+KLGVGDSKTLTDQKI+Q
Sbjct:   73 ----TSGQNLPLIGTDEVGNGSYFGGLAVVAAFVTPDQHDFLRKLGVGDSKTLTDQKIRQ   128

Query:  134 IAPLLEKAIPHKALLLSPQKYNQVVSPNNKHNAVSVKVALHNQAIFLLLQDGFEPEKIVI   193
            IAP+L++ I H+ALLLSP KYN+V+     +++NAVSVKVALHNQAI LLLQ G +PEKIVI
Sbjct:  129 IAPILKEKIQHQALLLSPSKYNEVIG--DRYNAVSVKVALHNQAIYLLLQKGVQPEKIVI   186

Query:  194 DAFTSSKNYQNYLKNEKNQFKQTITLEEKAENKYLAVAVSSIIARNLFLENLNKLSDDVG   253
            DAFTS+KNY   YL  E N+F   I+LEEKAE KYLAVAVSS+IAR+LFLENL  L  ++G
Sbjct:  187 DAFTSAKNYDKYLAQETNRFSNPISLEEKAEGKYLAVAVSSVIARDLFLENLENLGRELG   246

Query:  254 YKLPSGAGHQSDKVASQLLKAYGISSLEHCAKLHFANTKKAQ                   295
            Y+LPSGAG  SDKVASQ+L+AYG+  L  CAKLHF NT+KA+
Sbjct:  247 YQLPSGAGTASDKVASQILQAYGMQGLNFCAKLHFKNTEKAK                   288
```

A related DNA sequence was identified in *S. pyogenes* <SEQ ID 5043> which encodes the amino acid sequence <SEQ ID 5044>. Analysis of this protein sequence reveals the following:

```
Possible site: 35
>>> Seems to have no N-terminal signal sequence

----- Final Results -----
            bacterial cytoplasm --- Certainty = 0.2148(Affirmative) < succ>
            bacterial membrane  --- Certainty = 0.0000(Not Clear)   < succ>
             bacterial outside  --- Certainty = 0.0000(Not Clear)   < succ>
```

An alignment of the GAS and GBS proteins is shown below.

```
Identities = 194/298 (65%), Positives = 240/298 (80%), Gaps = 2/298 (0%)

Query:    3 MNTIVMQADKKLQEKIRTDLAQHHISNNNPYVVFSAKISGATVLLYTSGKLVFQGSNASH   62
            MNT+V++ D  L + ++  LA + IS+ N YV F+AK +G TVLLY SGKLV QG+ A+
Sbjct:    1 MNTLVLKIDAILSKHLKKQLAPYTISSQNTYVAFAAKKNGVTVLLYKSGKLVLQGNGANA   60

Query:   63 IAQKYGFIEQKE--SCSSESQDIPIIGTDEVGNGSYFGGLAVVASFVTPKDHAYLKKLGV  120
            +AQ+      K    S+ SQDIPIIG+DEVGNGSYFGG+AVVASFV PKDH++LKKLGV
Sbjct:   61 LAQELNLPVAKTVFEASNNSQDIPIIGSDEVGNGSYFGGIAVVASFVDPKDHSFLKKLGV  120

Query:  121 GDSKTLTDQKIKQIAPLLEKAIPHKALLLSPQKYNQVVSPNNKHNAVSVKVALHNQAIFL  180
            DSK L+D+ I+QIAPLLEK IPH++LLLSP+KYN++V  +  +NA+S+KVALHNQAIFL
Sbjct:  121 DDSKKLSDKTIQQIAPLLEKQIPHQSLLLSPKKYNELVGKSKPYNAISIKVALHNQAIFL  180

Query:  181 LLQDGFEPEKIVIDAFTSSKNYQNYLKNEKNQFKQTITLEEKAENKYLAVAVSSIIARNL  240
            LLQ G +P++IVIDAFTS  NY+ +LK EKN F   +T +EKAE+ YLAVAVSSIIARNL
Sbjct:  181 LLQKGIQPKQIVIDAFTSQSNYEKHLKKEKNHFPNPLTFQEKAESHYLAVAVSSIIARNL  240

Query:  241 FLENLNKLSDDVGYKLPSGAGHQSDKVASQLLKAYGISSLEHCAKLHFANTKKAQALL    298
            FL+NL++L  D+GY+LPSGAG  SDKVASQLL AYG+SSLE+ AKLHFANT KAQALL
Sbjct:  241 FLDNLDQLGQDLGYQLPSGAGSASDKVASQLLAAYGMSSLEYSAKLHFANTHKAQALL    298
```

Based on this analysis, it was predicted that these proteins and their epitopes could be useful antigens for vaccines or diagnostics.

EXAMPLE 1633

A DNA sequence (GBSx1728) was identified in *S. agalactiae* <SEQ ID 5045> which encodes the amino acid sequence <SEQ ID 5046>. This protein is predicted to be heat shock protein 70. Analysis of this protein sequence reveals the following:

```
Possible site: 25
>>> Seems to have no N-terminal signal sequence

----- Final Results -----
        bacterial cytoplasm --- Certainty = 0.3874(Affirmative) < succ>
        bacterial membrane  --- Certainty = 0.0000(Not Clear)   < succ>
        bacterial outside   --- Certainty = 0.0000(Not Clear)   < succ>
```

The protein has no significant homology with any sequences in the GENPEPT database.

A related DNA sequence was identified in *S. pyogenes* <SEQ ID 5047> which encodes the amino acid sequence <SEQ ID 5048>. Analysis of this protein sequence reveals the following:

```
Possible site: 58
>>> Seems to have no N-terminal signal sequence

----- Final Results -----
        bacterial cytoplasm --- Certainty = 0.3442(Affirmative) < succ>
        bacterial membrane  --- Certainty = 0.0000(Not Clear)   < succ>
        bacterial outside   --- Certainty = 0.0000(Not Clear)   < succ>
```

An alignment of the GAS and GBS proteins is shown below.

```
Identities = 65/92 (70%), Positives = 76/92 (81%)

Query:   11 NRYKFVFGDKPLTLTTDKDNLFMEEIERVATEKYEAIKEKLPNADNETIAILMAINALSV   70
            NRYKF FG+K LTLTTDKDNLFMEE+ERVA EKY+A+K  LP AD+ETIAILMAIN LS
Sbjct:    5 NRYKFTFGEKTLTLTTDKDNLFMEEVERVAKEKYQALKNHLPEADDETIAILMAINTLST   64

Query:   71 QLSREIDIEKMEDELNKLRSKTISDIKEKVSE                             102
            QLSREI IEKME E+  LR KT+  ++EK ++
Sbjct:   65 QLSREIAIEKMEAEILDLRQKTLVGLQEKANQ                              96
```

Based on this analysis, it was predicted that these proteins and their epitopes could be useful antigens for vaccines or diagnostics.

EXAMPLE 1634

A DNA sequence (GBSx1729) was identified in *S. agalactiae* <SEQ ID 5049> which encodes the amino acid sequence <SEQ ID 5050>. Analysis of this protein sequence reveals the following:

```
Possible site: 48
>>> Seems to have an uncleavable N-term signal seq
    INTEGRAL    Likelihood = -10.99    Transmembrane    124-140 (114-148)
    INTEGRAL    Likelihood =  -5.84    Transmembrane     22-38  (21-40)
    INTEGRAL    Likelihood =  -4.88    Transmembrane      2-18  (1-20)
    INTEGRAL    Likelihood =  -1.97    Transmembrane     84-100 (84-100)

----- Final Results -----
             bacterial membrane --- Certainty = 0.5394(Affirmative) < succ>
              bacterial outside --- Certainty = 0.0000(Not Clear)   < succ>
            bacterial cytoplasm --- Certainty = 0.0000(Not Clear)   < succ>
```

The protein has homology with the following sequences in the GENPEPT database.

```
>GP:BAB06827 GB:AP001517 unknown conserved protein in B. subtilis
[Bacillus halodurans]
Identities = 59/182 (32%), Positives = 98/182 (53%), Gaps = 14/182 (7%)

Query:    1 MLSLLLLIIVIWHFYIGYSRGIFLQVFYVLMSMVSLMIASQFYQELASQITLWVPYS--N    58
            MLS++LL I++  F+IG  RG+ LQ+ ++L  +  +A ++Y  +A+ I LW+PY    +
Sbjct:    1 MLSVILLFILLCSFFIGKRRGLILQLVHLLGFVAAFFVAYKYYAPVATYIRLWIPYPQFS   60

Query:   59 PVQGVEVYFFKDISKFQLSHVYYAGVAFVFIY----SLSYLVGRLLGVLLHLAPVEHFDS  114
              P  V +     I  F    +VYY+G+AF ++      L ++VG +L  L HL  +
Sbjct:   61 PDSPVTML----IEAFNFENVYYSGIAFALLFIGTKILLHIVGSMDFLTHLPILRSV--  114

Query:  115 LQNNIISGFLAVLVCLLFMSMCLTILATVPMSFVQEKLWNSLFVRFLINDLPFFSQFLVR  174
               N   +G L +    L M + L + A +P+  VQ  L  SL  +F++N  PF S+F+
Sbjct:  115 --NGWLGGILGFVEVYLIMFVLLYVGALLPIETVQTHLNQSLVAQFIMNHTPFLSEFIRN  172

Query:  175 TW                                                           176
             W
Sbjct:  173 LW                                                           174
```

A related DNA sequence was identified in *S. pyogenes* <SEQ ID 5051> which encodes the amino acid sequence <SEQ ID 5052>. Analysis of this protein sequence reveals the following:

```
Possible site: 59
>>> Seems to have a cleavable N-term signal seq.
    INTEGRAL    Likelihood = -8.17    Transmembrane    124-140 (117-148)
    INTEGRAL    Likelihood = -4.73    Transmembrane     84-100 (78-105)
    INTEGRAL    Likelihood = -0.00    Transmembrane    156-172 (156-172)

----- Final Results -----
             bacterial membrane --- Certainty = 0.4270(Affirmative) < succ>
              bacterial outside --- Certainty = 0.0000(Not Clear)   < succ>
            bacterial cytoplasm --- Certainty = 0.0000(Not Clear)   < succ>
```

The protein has homology with the following sequences in the databases:

```
>GP:BAB06827 GB:AP001517 unknown conserved protein in B. subtilis
[Bacillus halodurans]
Identities = 57/177 (32%), Positives = 98/177 (55%), Gaps = 2/177 (1%)

Query:    1 MLSLLIVLILTWNFYIGYSRGIILQSFYVLGALLSLLVANRFYIGLAHKLTLWIPYSNPV   60
            MLS++++  IL  +F+IG  RG+ILQ  ++LG + +  VA  ++Y  +A  + LWIPY
Sbjct:    1 MLSVILLFILLCSFFIGKRRGLILQLVHLLGFVAAFFVAYKYYAPVATYIRLWIPYPQFS   60
```

```
Query:    61 EGTSVFFFKSVDIFVLDKVYYAGLAFFIIFLLGYALSRFLGIFVHFLLLNYFDNQWTKCL 120
             + V       ++ F  + VYY+G+AF ++F+    L  +G + FL              L
Sbjct:    61 PDSPVTML--IEAFNFENVYYSGIAFALLFIGTKILLHIVGSMLDFLTHLPILRSVNGWL 118

Query:   121 SGGLAFLVSLLFLNMLLSIFATVPMPFLQHYLHSSFLARLVIEHLPPLTIIIQKLWI    177
                G L F+   L + +LL + A +P+   +Q +L+ S +A+ ++ H P L+   I+ LWI
Sbjct:   119 GGILGFVEVYLIMFVLLYVGALLPIETVQTHLNQSLVAQFIMNHTPFLSEFIRNLWI    175
```

An alignment of the GAS and GBS proteins is shown below.

```
Identities = 87/176 (49%), Positives = 123/176 (69%)

Query:     1 MLSLLLLIIVIWHFYIGYSRGIFLQVFYVLMSMVSLMIASQFYQELASQITLWVPYSNPV  60
             MLSLL+++I+ W+FYIGYSRGI LQ FYVL +++SL++A++FY  LA ++TLW+PYSNPV
Sbjct:     1 MLSLLIVLILTWNFYIGYSRGIILQSFYVLGALLSLLVANRFYIGLAHKLTLWIPYSNPV  60

Query:    61 QGVEVYFFKDISKFQLSHVYYAGVAFVFIYSLSYLVGRLLGVLLHLAPVEHFDSLQNNII 120
             +G  V+FFK +  F L  VYYAG+AF  I+ L Y + R LG+ +H     + +FD+         +
Sbjct:    61 EGTSVFFFKSVDIFVLDKVYYAGLAFFIIFLLGYALSRFLGIFVHFLLLNYFDNQWTKCL 120

Query:   121 SGFLAVLVCLLFMSMCLTILATVPMSFVQEKLWNSLFVRFLINDLPFFSQFLVRTW     176
             SG LA LV LLF++M L+I ATVPM F+Q  L +S     R +I   LP +  + + W
Sbjct:   121 SGGLAFLVSLLFLNMLLSIFATVPMPFLQHYLHSSFLARLVIEHLPPLTIIIQKLW     176
```

Based on this analysis, it was predicted that these proteins and their epitopes could be useful antigens for vaccines or diagnostics.

EXAMPLE 1635

A DNA sequence (GBSx1730) was identified in *S. agalactiae* <SEQ ID 5053> which encodes the amino acid sequence <SEQ ID 5054>. Analysis of this protein sequence reveals the following:

```
Possible site: 49
>>> Seems to have no N-terminal signal sequence

----- Final Results -----
         bacterial cytoplasm --- Certainty = 0.4176(Affirmative) < succ>
         bacterial membrane  --- Certainty = 0.0000(Not Clear)   < succ>
          bacterial outside  --- Certainty = 0.0000(Not Clear)   < succ>
```

A related GBS nucleic acid sequence <SEQ ID 10117> which encodes amino acid sequence <SEQ ID 10118> was also identified.

The protein has homology with the following sequences in the GENPEPT database.

```
>GP:CAB14818 GB:Z99118 similar to DNA mismatch repair protein
[Bacillus subtilis]
Identities = 320/790 (40%), Positives = 466/790 (58%), Gaps = 18/790 (2%)

Query:    10 MNNKILEQLEFNKVKELILPYLKTEQSQEELSELEPMTEAPKIEKSFNEISDMEQIFVEH  69
             M K+L  LEF+KVKE ++ +  +    +E L EL+P     +I+K +E+ +   I
Sbjct:     1 MQQKVLSALEFHKVKEQVIGHAASSLGKEMLLELKPSASIDEIKKQLDEVDEASDIIRLR  60

Query:    70 HSFGIVSLSSISESLKRLELSADLNIQELLAIKKVLQSSSDMIHFYSDL--DNVSFQSLD 127
                    L  I +L+R E+ + L+  E   I  +L +     M HF + +   D V       +
Sbjct:    61 GQAPFGGLVDIRGALRRAEIGSVLSPSEFTEISGLLYAVKQMKHFITQMAEDGVDIPLIH 120

Query:   128 RLFENLEQFPNLQGSFQA-INDGGFLEHFASPELERIRRQLTNSERRVRQILQDMLKEKA 186
              + E L   +L+   + I+D G +    AS L   IR QL   E RVR  L+ ML+  +
Sbjct:   121 QHAEQLITLSDLERDINSCIDDHGEVLDHASETLRGIRTQLRTLESRVRDRLESMLRSSS 180

Query:   187 --ELLSENLIASRSGRSVLPVKNTYRNRISGVVHDISSSGSTVYIEPRAVVTLNEEITQL 244
               ++LS+ ++   R+ R V+PVK  YR+   G+VHD SSSG+T++IEP+A+V +N   + Q
Sbjct:   181 ASKMLSDTIVTIRNDRFVIPVKQEYRSSYGGIVHDTSSSGATLFIEPQAIVDMNNSLQQA 240
```

```
-continued

Query:   245 RADERHEESRILHAFSDLLRPHVATIRNNAWILGHLDFVRAKYLFMSDNKATIPEISNDS  304
             +  E+ E RIL  ++   +    +   +L LDF+ AK +    KAT P +++
Sbjct:   241 KVKEKQEIERILRVLTEKTAEYTEELFLDLQVLQTLDFIFAKARYAKAVKATKPIMNDTG  300

Query:   305 TLALINVRHPLL--SNPVANDLHFDQDLTAIVITGPNTGGKTIMLKTLGLAQLMGQSGLP  362
             + L   RHPLL     VAND+  +D + IVITGPNTGGKT+ LKTLGL  LM QSGL
Sbjct:   301 FIRLKKARHPLLPPDQVVANDIELGRDFSTIVITGPNTGGKTVTLKTLGLLTLMAQSGLH  360

Query:   363 VLADKGSKIAVFNNIFADIGDEQSIEQSLSTFSSHMTHIVSILNEADHNSLVLFDELGAG  422
             + AD+GS+ AVF ++FADIGDEQSIEQSLSTFSSHM +IV IL + + NSLVLFDELGAG
Sbjct:   361 IPADEGSEAAVFEHVFADIGDEQSIEQSLSTFSSHMVNIVGILEQVNENSLVLFDELGAG  420

Query:   423 TDPQEGASLAMAILEHLRLSNIKTMATTHYPELKAYGIETNFVENASMEFDAETLSPTYR  482
             TDPQEGA+LAM+IL+ +   +N + +ATTHYPELKAYG     V NAS+EFD ETLSPTY+
Sbjct:   421 TDPQEGAALAMSILDDVHRTNARVLATTHYPELKAYGYNREGVMNASVEFDIETLSPTYK  480

Query:   483 FMQGVPGRSNAFEIASRLGLAPFIVQAK-QMTDSDSDVNRIIEQLEAQTLETRRRLDHI   541
             + GVPGRSNAFEI+ RLGL   I+ QAK +MT  ++V+ +I  LE          L
Sbjct:   481 LLIGVPGRSNAFEISKRLGLPDHIIGQAKSEMTAEHNEVDTMIASLEQSKKRAEEELSET  540

Query:   542 KEVEQENLKFNRAVKKLYNEFSHERDKELEKIYQEAQEIVDMALNESDTILKKL----ND  597
             + + +E  K ++ +++    E + ++DK LE+  Q+A E V  A+ E++ I+ +L    +
Sbjct:   541 ESIRKEAEKLHKELQQQIIELNSKKDKMLEEAEQQAAEKVKAAMKEAEDIIHELRTIKEE  600

Query:   598 KSQLKPHEIIDAKAQIKKLAPQVDLSKNKVLNKAKKIKAARAPRIGDDIIVTSYGQRGTL  657
               K HE+I+AK +++   P  + SK    K +K   R   + GD++ V  ++GQ+GTL
Sbjct:   601 HKSFKDHELINAKKRLEGAMPAFEKSKKPEKPKTQK----RDFKPGDEVKVLTFGQKGTL  656

Query:   658 TSQLKDGRWEAQVGIIKMTLTQDEFTLVRVQEEQKVKSKQINVVKKADSSGPRARLDLRG  717
             +      W  Q+GI+KM + + +     ++   E K K K I   VK  D       LDLRG
Sbjct:   657 LEKTGGNEWNVQIGILKMKVKEKDLEFIKSAPEPK-KEKMITAVKGKDYH-VSLELDLRG  714

Query:   718 KRYEEAMQELDNFIDQALLNNMGQVDIIHGIGTGVIREGVTKYLRRNKHVKHFAYAPQNA  777
             +RYE A+  ++ ++D A+L    +V IIHG GTG +R+GV      L+ ++ VK    +
Sbjct:   715 ERYENALSRVEKYLDDAVLAGYPRVSIIHGKGTGALRKGVQDLLKNHRSVKSSRFGEAGE  774

Query:   778 GGSGATIVTL                                                   787
             GGSG T+V L
Sbjct:   775 GGSGVTVVEL                                                   784
```

A related DNA sequence was identified in *S. pyogenes* <SEQ ID 5055> which encodes the amino acid sequence <SEQ ID 5056>. Analysis of this protein sequence reveals the following:

```
Possible site: 20
>>> Seems to have no N-terminal signal sequence

----- Final Results -----
          bacterial cytoplasm --- Certainty = 0.3843(Affirmative) < succ>
           bacterial membrane --- Certainty = 0.0000(Not Clear)   < succ>
            bacterial outside --- Certainty = 0.0000(Not Clear)   < succ>
```

An alignment of the GAS and GBS proteins is shown below.

```
Identities = 775/787 (98%), Positives = 781/787 (98%)

Query:     2 INLGIMKSMNNKILEQLEFNKVKELILPYLKTEQSQEELSELEPMTEAPKIEKSFNEISD   61
             I LGIMKSMNNKILEQLEFNKVKEL+LPYLKTEQSQEEL ELEPMTEAPKIEKSFNEISD
Sbjct:    32 IILGIMKSMNNKILEQLEFNKVKELLLPYLKTEQSQEELLELEPMTEAPKIEKSFNEISD   91

Query:    62 MEQIFVEHHSFGIVSLSSISESLKRLELSADLNIQELLAIKKVLQSSSDMIHFYSDLDNV  121
             MEQIFVEHHSFGIVSLSSISESLKRLELS DLNIQELLAIKKVLQSSSDMIHFYSDLDNV
Sbjct:    92 MEQIFVEHHSFGIVSLSSISESLKRLELSTDLNIQELLAIKKVLQSSSDMIHFYSDLDNV  151

Query:   122 SFQSLDRLFENLEQFPNLQGSFQAINDGGFLEHFASPELERIRRQLTNSERRVRQILQDM  181
             SFQSLDRLFENLEQFPNLQGSFQAINDGGFLEHFASPELERIRRQLTNSERRVRQILQDM
Sbjct:   152 SFQSLDRLFENLEQFPNLQGSFQAINDGGFLEHFASPELERIRRQLTNSERRVRQILQDM  211

Query:   182 LKEKAELLSENLIASRSGRSVLPVKNTYRNRISGVVHDISSSGSTVYIEPRAVVTLNEEI  241
             LKEKAELLSENLIASRSGRSVLPVKNTYRNRISGVVHDISSSGSTVYIEPRAVVTLNEEI
Sbjct:   212 LKEKAELLSENLIASRSGRSVLPVKNTYRNRISGVVHDISSSGSTVYIEPRAVVTLNEEI  271
```

```
Query:  242 TQLRADERHEESRILHAFSDLLRPHVATIRNNAWILGHLDFVRAKYLFMSDNKATIPEIS  301
             TQLRADERHEE RILHAFSDLLRPHVATIRNNAWILGHLDFVRAKYLFMSDNKATIP+IS
Sbjct:  272 TQLRADERHEEGRILHAFSDLLRPHVATIRNNAWILGHLDFVRAKYLFMSDNKATIPKIS  331

Query:  302 NDSTLALINVRHPLLSNPVANDLHFDQDLTAIVITGPNTGGKTIMLKTLGLAQLMGQSGL  361
             NDSTLALINVRHPLLSNPVANDLHFD DLTAIVITGPNTGGKTIMLKTLGLAQLMGQSGL
                                      m
Sbjct:  332 NDSTLALINVRHPLLSNPVANDLHFDHDLTAIVITGPNTGGKTIMLKTLGLAQLMGQSGL  391

Query:  362 PVLADKGSKIAVFNNIFADIGDEQSIEQSLSTFSSHMTHIVSILNEADHNSLVLFDELGA  421
             PVLADKGSKIAVFNNIFADIGDEQSIEQSLSTFSSHMTHIVSILNEADHNSLVLFDELGA
Sbjct:  392 PVLADKGSKIAVFNNIFADIGDEQSIEQSLSTFSSHMTHIVSILNEADHNSLVLFDELGA  451

Query:  422 GTDPQEGASLAMAILEHLRLSNIKTMATTHYPELKAYGIETNFVENASMEFDAETLSPTY  481
             GTDPQEGASLAMAILEHLRLS+IKTMATTHYPELKAYGIETNFVENASMEFDAETLSPTY
Sbjct:  452 GTDPQEGASLAMAILEHLRLSHIKTMATTHYPELKAYGIETNFVENASMEFDAETLSPTY  511

Query:  482 RFMQGVPGRSNAFEIASRLGLAPFIVKQAKQMTDSDSDVNRIIEQLEAQTLETRRRLDHI  541
             RFMQGVPGRSNAFEIASRLGLAPFIVKQAKQMTDSDSDVNRIIEQLEAQTLETRRRLDHI
Sbjct:  512 RFMQGVPGRSNAFEIASRLGLAPFIVKQAKQMTDSDSDVNRIIEQLEAQTLETRRRLDHI  571

Query:  542 KEVEQENLKFNRAVKKLYNEFSHERDKELEKIYQEAQEIVDMALNESDTILKKLNDKSQL  601
             KEVEQENLKFNRAVKKLYNEFSHERDKELEKIYQEAQEIVDMALNESDTILKKLNDKSQL
Sbjct:  572 KEVEQENLKFNRAVKKLYNEFSHERDKELEKIYQEAQEIVDMALNESDTILKKLNDKSQL  631

Query:  602 KPHEIIDAKAQIKKLAPQVDLSKNKVLNKAKKIKAARAPRIGDDIIVTSYGQRGTLTSQL  661
             KPHEIIDAKAQIKKLAPQVDLSKNKVLNKAKKIKAARAPRIGDDIIVTSYGQRGTLTSQL
Sbjct:  632 KPHEIIDAKAQIKKLAPQVDLSKNKVLNKAKKIKAARAPRIGDDIIVTSYGQRGTLTSQL  691

Query:  662 KDGRWEAQVGIIKMTLTQDEFTLVRVQEEQKVKSKQINVVKKADSSGPRARLDLRGKRYE  721
             KDGRWEAQVGIIKMTLTQDEF+LVRVQEEQKVK+KQINVVKKAD SGPRARLDLRGKRYE
Sbjct:  692 KDGRWEAQVGIIKMTLTQDEFSLVRVQEEQKVKNKQINVVKKADGSGPRARLDLRGKRYE  751

Query:  722 EAMQELDNFIDQALLNNMGQVDIIHGIGTGVIREGVTKYLRRNKHVKHFAYAPQNAGGSG  781
             EAMQELD+FIDQALLNNMGQVDIIHGIGTGVIREGVTKYLRRNKHVKHFAYAPQNAGGSG
Sbjct:  752 EAMQELDHFIDQALLNNMGQVDIIHGIGTGVIREGVTKYLRRNKHVKHFAYAPQNAGGSG  811

Query:  782 ATIVTLG  788
             ATIVTLG
Sbjct:  812 ATIVTLG  818
```

Based on this analysis, it was predicted that these proteins and their epitopes could be useful antigens for vaccines or diagnostics.

EXAMPLE 1636

A DNA sequence (GBSx1731) was identified in *S. agalactiae* <SEQ ID 5057> which encodes the amino acid sequence <SEQ ID 5058>. This protein is predicted to be thioredoxin (trxA). Analysis of this protein sequence reveals the following:

```
Possible site: 48
>>> Seems to have no N-terminal signal sequence

----- Final Results -----
         bacterial cytoplasm --- Certainty = 0.2721(Affirmative) < succ>
         bacterial membrane  --- Certainty = 0.0000(Not Clear)   < succ>
         bacterial outside   --- Certainty = 0.0000(Not Clear)   < succ>
```

A related GBS nucleic acid sequence <SEQ ID 10115> which encodes amino acid sequence <SEQ ID 10116> was also identified.

The protein has homology with the following sequences in the GENPEPT database.

```
>GP:CAB40815 GB:AJ133006 thioredoxin [Listeria monocytogenes] (ver 2)
Identities = 64/100 (64%), Positives = 78/100 (78%), Gaps = 1/100 (1%)

Query:    15  MALEVTDATFVEETKEGLVLIDFWATWCGPCRMQAPILEQLSQEIDEDELKILKMDVDEN   74
              M  E+TDATF +ET EGLVL DFWATWCGPCRM AP+LE++ +E  E  LKI+KMDVDEN
Sbjct:     1  MVKEITDATFEQETSEGLVLTDFWATWCGPCRMVAPVLEEIQEERGE-ALKIVKMDVDEN   59

Query:    75  PETARQFGIMSIPTLMFKKDGEVVKQVAGVHTKDQLKAII                      114
              PET    FG+MSIPTL+ KKDGEVV+ + G    K++L  +I
Sbjct:    60  PETPGSFGVMSIPTLLIKKDGEVVETIIGYRPKEELDEVI                      99
```

A related DNA sequence was identified in *S. pyogenes* <SEQ ID 5059> which encodes the amino acid sequence <SEQ ID 5060>. Analysis of this protein sequence reveals the following:

```
Possible site: 48
>>> Seems to have no N-terminal signal sequence

----- Final Results -----
          bacterial cytoplasm --- Certainty = 0.2721(Affirmative) < succ>
           bacterial membrane --- Certainty = 0.0000(Not Clear)   < succ>
            bacterial outside --- Certainty = 0.0000(Not Clear)   < succ>
```

Based on this analysis, it was predicted that these proteins and their epitopes could be useful antigens for vaccines or diagnostics.

EXAMPLE 1637

A DNA sequence (GBSx1732) was identified in *S. agalactiae* <SEQ ID 5061> which encodes the amino acid sequence <SEQ ID 5062>. Analysis of this protein sequence reveals the following:

```
Possible site: 33
>>> Seems to have no N-terminal signal sequence
    INTEGRAL    Likelihood = -7.54     Transmembrane   170-186 (167-191)
    INTEGRAL    Likelihood = -5.52     Transmembrane    87-103  (86-107)
    INTEGRAL    Likelihood = -4.62     Transmembrane   105-121 (104-126)

----- Final Results -----
           bacterial membrane --- Certainty = 0.4015(Affirmative) < succ>
            bacterial outside --- Certainty = 0.0000(Not Clear)   < succ>
          bacterial cytoplasm --- Certainty = 0.0000(Not Clear)   < succ>
```

The protein has homology with the following sequences in the GENPEPT database.

```
>GP:CAA60798 GB:X87369 ORF3 [Clostridium perfringens]
Identities = 27/67 (40%), Positives = 52/67 (77%)

Query: MEIGQQIIRYRKQQALSQEELAEKVYVSRQSISNWENDKTYPDIHSLLLLSQIFQVSLDQ   60
1
       M++ +++   RK++ LSQE+LAEK+ +SRQ++S WE+ ++ PD++ L++LS+++ V++D
Sbjct: MKLAEKLQLMRKREGLSQEDLAEKLGISRQAVSKWESGQSVPDLNKLIILSELYNVTIDY   60
1

Query: LIKGDIE                                                         67
61
       L+K   E
Sbjct: LVKETYE                                                         67
61
```

A related DNA sequence was identified in *S. pyogenes* <SEQ ID 1739> which encodes the amino acid sequence <SEQ ID 1740>. Analysis of this protein sequence reveals the following:

```
Possible site: 36
>>> Seems to have no N-terminal signal sequence
INTEGRAL        Likelihood = -8.86      Transmembrane   173-189 (169-194)
INTEGRAL        Likelihood = -5.52      Transmembrane    90-106 (89-110)
INTEGRAL        Likelihood = -4.62      Transmembrane   108-124 (107-129)

----- Final Results -----
              bacterial membrane --- Certainty = 0.4545(Affirmative) < succ>
               bacterial outside --- Certainty = 0.0000(Not Clear)   < succ>
             bacterial cytoplasm --- Certainty = 0.0000(Not Clear)   < succ>
```

An alignment of the GAS and GBS proteins is shown below.

```
Identities = 187/195 (95%), Positives = 191/195 (97%)

Query:     1 MEIGQQIIRYRKQQALSQEELAEKVYVSRQSISNWENDKTYPDIHSLLLLSQIFQVSLDQ    60
             MEIGQQIIRYRKQQALSQE+LAEKVYVSRQSISNWENDKTYPDIHSLLLLSQIFQVSLDQ Sbjct:     4 MEIGQQIIRYRKQQALSQEKLAEKVYVSRQSISNWENDKTYPDIHSLLLLSQIFQVSLDQ    63

Query:    61 LIKGDIEKMKYTITQVDKKNFERDTKVMVTLMILLMISSYPLVYFLEWLGLGIFVLLSII   120
             LIKGDIEKMKYTITQVDKKNF+RDTKVMVTLMILLMISSYPLVYFLEWLGLGIFVLLSII Sbjct:    64 LIKGDIEKMKYTITQVDKKNFKRDTKVMVTLMILLMISSYPLVYFLEWLGLGIFVLLSII   123

Query:   121 TMTYANRVERFKKKYDVQTYKEILAVSSGKLLDEIEKREERAKLPYQKPLIVTVFFLITV   180
             TMTYANRVERFKKKYDVQ YKEILAVS+GKLLDEIEKREERA LPYQKPLIVTVFFLITV Sbjct:   124 TMTYANRVERFKKKYDVQPYKEILAVSNGKLLDEIEKREERATLPYQKPLIVTVFFLITV   183

Query:   181 ATFFASRFIFTWLFH                                                195
             A  FASRF+FTWLFH Sbjct:   184 AFAFASRFMFTWLFH                                                198
```

Based on this analysis, it was predicted that these proteins and their epitopes could be useful antigens for vaccines or diagnostics.

EXAMPLE 1638

A DNA sequence (GBSx1733) was identified in *S. agalactiae* <SEQ ID 5063> which encodes the amino acid sequence <SEQ ID 5064>. This protein is predicted to be adenine glycosylase (mutY). Analysis of this protein sequence reveals the following:

```
Possible site: 30
>>> Seems to have no N-terminal signal sequence

----- Final Results -----
             bacterial cytoplasm --- Certainty = 0.2385(Affirmative) < succ>
              bacterial membrane --- Certainty = 0.0000(Not Clear)   < succ>
               bacterial outside --- Certainty = 0.0000(Not Clear)   < succ>
```

A related GBS nucleic acid sequence <SEQ ID 9425> which encodes amino acid sequence <SEQ ID 9426> was also identified.

The protein has homology with the following sequences in the GENPEPT database.

```
>GP:BAB04650 GB:AP001510 adenine glycosylase [Bacillus halodurans]
Identities = 130/331 (39%), Positives = 190/331 (57%), Gaps = 15/331 (4%)

Query:    1 MLQQTQVNTVIPYYKRFLEWFPQIKDLADAPEEQLLKAWEGLGYYSRVRNMQKAAQQVMV    60
            MLQQT+V+TVIPYY+ F+  FP ++ LA A E+Q+LKAWEGLGYYSR RN+Q A ++V+
Sbjct:   45 MLQQTRVDTVIPYYQAFMRQFPTLETLAYAEEDQVLKAWEGLGYYSRARNLQSAVREVVE  104

Query:   61 DFGGIFPHTYDDIASLKGIGPYTAGAIASISFNLPEPAVDGNVMRVMARLFEVNYDIGDP   120
               +GG  P T  +I+ LKG+GPYTAGAI SI+++ PEPAVDGNVMRV++R+  +   DI
Sbjct:  105 SYGGEVPSTRKEISKLKGVGPYTAGAILSIAYDQPEPAVDGNVMRVLSRVLYIEEDIAKV  164

Query:  121 KNRKIFQAIMEILIDPDRPGDFNQALMDLGTDIESAKTPRPDESPIRFFNAAYLNGTYSK   180
            K R +F++++ LI  + P  FNQ LM+LG  + +    +P      P+R    A+   G    +
Sbjct:  165 KTRTLFESLLYDLISKENPSFFNQGLMELGALVCTPTSPGCLLCPVRDHCRAFAAGVQEQ  224

Query:  181 YPIKNTKKKPKPMRIQAFVIRNQNGQYLLEKNTKGRLLGGFWSFPIIETSPLSQQLDLFD   240
                PIK   KKKPK  ++ A VIRN+ GQ L+E+  +  LL   W FP +E        L
Sbjct:  225 LPIKAKKKKPKAKQLIAAVIRNEKGQVLIERRPEKGLLAKLWQFPNVE---------LES  275

Query:  241 DNQSNPIIWQTQNETFQREYQLKPQWTDNHFPNIKHTFSHQKWTIELIEGVVKAT-DLPN   299
             +   ++    +E F   +            +     ++H FSH   W I + E  VK     L +
Sbjct:  276 TKNAQQVLGDYIHERFHLDAAV-----GEYVQTVEHVFSHLIWNIRVYEATVKGVPSLND  330

Query:  300 APHLKWVAIEDFSLYPFATPQKKMLETYLKQ                              330
                    WV       Y F      +K+++  L++
Sbjct:  331 KYEADWVDDRTIENYAFPVSHQKIIQGNLRK                              361
```

A related DNA sequence was identified in *S. pyogenes* <SEQ ID 5065> which encodes the amino acid sequence <SEQ ID 5066>. Analysis of this protein sequence reveals the following:

```
Possible site: 60
>>> Seems to have no N-terminal signal sequence

----- Final Results -----
            bacterial cytoplasm --- Certainty = 0.3579(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below.

```
Identities = 330/333 (99%), Positives = 331/333 (99%)

Query:    1 MLQQTQVNTVIPYYKRFLEWFPQIKDLADAPEEQLLKAWEGLGYYSRVRNMQKAAQQVMV    60
            MLQQTQVNTVIPYYKRFLEWFPQIKDLADAPEEQLLKAWEGLGYYSRVRNMQKAAQQVMV
Sbjct:   52 MLQQTQVNTVIPYYKRFLEWFPQIKDLADAPEEQLLKAWEGLGYYSRVRNMQKAAQQVMV   111

Query:   61 DFGGIFPHTYDDIASLKGIGPYTAGAIASISFNLPEPAVDGNVMRVMARLFEVNYDIGDP   120
            DFGGIFPHTYDDIASLKGIGPYTAGAIASISFNLPEPAVDGNVMRVMARLFEVNYDIGDP
Sbjct:  112 DFGGIFPHTYDDIASLKGIGPYTAGAIASISFNLPEPAVDGNVMRVMARLFEVNYDIGDP   171

Query:  121 KNRKIFQAIMEILIDPDRPGDFNQALMDLGTDIESAKTPRPDESPIRFFNAAYLNGTYSK   180
            KNRKIFQAIMEILIDPDRPGDFNQALMDLGTDIESAKTPRPDESPIRFFNAAYLNGTY K
Sbjct:  172 KNRKIFQAIMEILIDPDRPGDFNQALMDLGTDIESAKTPRPDESPIRFFNAAYLNGTYGK   231

Query:  181 YPIKNTKKKPKPMRIQAFVIRNQNGQYLLEKNTKGRLLGGFWSFPIIETSPLSQQLDLFD   240
            YPIKN KKKPKPMRIQAFVIRNQNGQYLLEKNTKGRLLGGFWSFPIIETSPLSQQLDLFD
Sbjct:  232 YPIKNPKKKPKPMRIQAFVIRNQNGQYLLEKNTKGRLLGGFWSFPIIETSPLSQQLDLFD   291

Query:  241 DNQSNPIIWQTQNETFQREYQLKPQWTDNHFPNIKHTFSHQKWTIELIEGVVKATDLPNA   300
            DNQSNPIIWQTQNETF+REYQLKPQWTDNHFPNIKHTFSHQKWTIELIEGVVKATDLPNA
Sbjct:  292 DNQSNPIIWQTQNETFEREYQLKPQWTDNHFPNIKHTFSHQKWTIELIEGVVKATDLPNA   351

Query:  301 PHLKWVAIEDFSLYPFATPQKKMLETYLKQKNA                            333
            PHLKWVAIEDFSLYPFATPQKKMLETYLKQKNA
Sbjct:  352 PHLKWVAIEDFSLYPFATPQKKMLETYLKQKNA                            384
```

Based on this analysis, it was predicted that these proteins and their epitopes could be useful antigens for vaccines or diagnostics.

EXAMPLE 1639

A DNA sequence (GBSx1734) was identified in *S. agalactiae* <SEQ ID 5067> which encodes the amino acid sequence <SEQ ID 5068>. This protein is predicted to be maltose/maltodextrin transport system (malG). Analysis of this protein sequence reveals the following:

```
Possible site: 52
>>> Seems to have an uncleavable N-term signal seq
    INTEGRAL    Likelihood = -10.30    Transmembrane      14-30  (5-35)
    INTEGRAL    Likelihood =  -6.95    Transmembrane     248-264 (242-267)
    INTEGRAL    Likelihood =  -5.15    Transmembrane      75-91  (74-94)
    INTEGRAL    Likelihood =  -3.19    Transmembrane     110-126 (110-127)
    INTEGRAL    Likelihood =  -2.13    Transmembrane     141-157 (138-157)
    INTEGRAL    Likelihood =  -0.32    Transmembrane     188-204 (188-204)

----- Final Results -----
              bacterial membrane  --- Certainty = 0.5118(Affirmative) < succ>
              bacterial outside   --- Certainty = 0.0000(Not Clear)   < succ>
             bacterial cytoplasm  --- Certainty = 0.0000(Not Clear)   < succ>
```

The protein has homology with the following sequences in the GENPEPT database.

```
>GP:BAB06643 GB:AP001517 maltose/maltodextrin transport system (permease)
[Bacillus halodurans]
Identities = 117/281 (41%), Positives = 169/281 (59%), Gaps = 5/281 (1%)

Query:    1 MNKK--KRLNLTFVYILLIVLSIMWLFPIVWVVLTSFRGEGSAFVNYFIPKTWTLDNYAK   58
            MNKK   RL +T +Y+ L+V+ I+ L+P++W V  S    S F +  IP+T +   +Y
Sbjct:    1 MNKKVKSRLEVTAIYLFLLVMGIVILYPLLWTVGLSLNPGTSLFSSRMIPETISFRHYEW   60

Query:   59 LFTQNTFPFGQWFLNTLFVATCTCILSTLITVAMAYSLSRIKFKHRNGFLKLALVLNMFP  118
            LF    + QW+ NTL VA+ T + ST +    AY+ SR +F  R   L    L+L MFP
Sbjct:   61 LFFDPRSNYLQWYKNTLIVASVTSVCSTFLVALTAYAFSRYRFVGRTYGLYGFLLLQMFP  120

Query:  119 GFMSMIAVYYILKALNLDQTLTALIFVY-SAGAALTFYIAKGFFDTIPYSLDESAMIDGA  177
               M+M+A+Y +L  +NL   TL   LI +Y       +  ++ KG+FDTIP  LDESA +DGA
Sbjct:  121 VLMAMVALYILLNTVNLLDTLLGLILIYVGTSIPMNAFLVKGYFDTIPRELDESAKLDGA  180

Query:  178 TRLDIFLKITLPLSKPIIVYTALIAFMGPWMDFIFAKVILGDATSKYTVAIGLFSMLQQD  237
                  IF  I LPL+KPI+    AL  FM P+MDFI  ++IL   +   YT+A+GLF+ +
Sbjct:  181 GHFRIFFTIMLPLAKPILAVVALFNFMSPFMDFILPRIIL-RSPENYTLALGLFNFVNDQ  239

Query:  238 TINQWFMSFTAGSVIIAIPITILFMFMQKYYVEGITGGSVK                    278
             N  F  F AG+++IAIPI   +F+F+Q+Y + G+T G+ K
Sbjct:  240 FANN-FTRFAAGAILIAIPIATVFLFLQRYLISGLTTGATK                    279
```

A related DNA sequence was identified in *S. pyogenes* <SEQ ID 5069> which encodes the amino acid sequence <SEQ ID 5070>. Analysis of this protein sequence reveals the following:

```
Possible site: 39
>>> Seems to have a cleavable N-term signal seq.
    INTEGRAL    Likelihood = -6.42    Transmembrane      76-92  (71-97)
    INTEGRAL    Likelihood = -6.05    Transmembrane     248-264 (242-267)
    INTEGRAL    Likelihood = -3.50    Transmembrane     110-126 (110-127)
    INTEGRAL    Likelihood = -1.33    Transmembrane     129-145 (129-145)
    INTEGRAL    Likelihood = -1.33    Transmembrane     188-204 (188-204)

----- Final Results -----
              bacterial membrane  --- Certainty = 0.3569(Affirmative) < succ>
              bacterial outside   --- Certainty = 0.0000(Not Clear)   < succ>
             bacterial cytoplasm  --- Certainty = 0.0000(Not Clear)   < succ>
```

The protein has homology with the following sequences in the databases:

```
>GP:CAA60006 GB:X86014 cymG [Klebsiella oxytoca]
Identities = 119/270 (44%), Positives = 172/270 (63%), Gaps = 7/270 (2%)

Query:    11 LVYATLIILSIIWLFPIAWVILTSFRSEGTAYVNYFIPKTFTLNHYINLFTNETFPFGKW    70
             LVY L++ +++ L P+ W +++S +    + + F  +FTL HY NL T    P+ KW
Sbjct:    12 LVYLFLLLNALVVLGPVIWTVMSSLKPGNNLFSSGFTEISFTLEHYHNLLTGT--PYLKW    69

Query:    71 FMNTLIVATFTCIISTFITVAIAYSLSRIKFKFRNGFLKLALILNMFPGFMSMIAIYYIL   130
             + NT I+AT  +IS +   A+ SR +FK +   L   L+L MFP F+SM AIY +L
Sbjct:    70 YKNTFILATCNMLISLVVVTITAFIFSRYRFKAKKKILMSILVLQMFPAFLSMTAIYILL   129

Query:   131 KALGLTQTLTALVLVYSSGAALGF--YIAKGFFDTIPYSLDESAMIDGATRMDIFFKITL   188
             + L  T   L+LVY +G+ L F  ++ KG+FD IP SLDE+A IDGA  + IFF+I L
Sbjct:   130 SKMNLIDTYIGLLLVYVTGS-LPFMTWLVKGYFDAIPTSLDEAAKIDGAGHLTIFFEIIL   188

Query:   189 PLAKPIIVYTALLAFMGPWIDFIFAQVILGDATSKYTVAIGLFSMLQPDTINNWFMAFTA   248
             PLAKPI+V+ AL++F GPW+DFI  +IL +  K T+AIG+FS +  ++  N F  F A
Sbjct:   189 PLAKPILVFVALVSFTGPWMDFILPTLIL-RSEDKMTLAIGIFSWISSNSAEN-FTLFAA   246

Query:   249 GSVLIAVPITLLFMFMQKYYVEGITGGSVK                               278
             G++L+AVPITLLF+  QK+    G+  G+VK
Sbjct:   247 GALLVAVPITLLFIVTQKHITTGLVSGAVK                               276
```

An alignment of the GAS and GBS proteins is shown below.

```
Identities = 227/278 (81%), Positives = 253/278 (90%)

Query:     1 MNKKKRLNLTFVYILLIVLSIMWLFPIVWVVLTSFRGEGSAFVNYFIPKTWTLDNYAKLF    60
             M  K+R L  VY LI+LSI+WLFPI WV+LTSFR EG+A+VNYFIPKT+TL++Y  LF
Sbjct:     1 MKNKRRFQLGLVYATLIILSIIWLFPIAWVILTSFRSEGTAYVNYFIPKTFTLNHYINLF    60

Query:    61 TQNTFPFGQWFLNTLFVATCTCILSTLITVAMAYSLSRIKFKHRNGFLKLALVLNMFPGF   120
             T  TFPFG+WF+NTL VAT TCI+ST ITVA+AYSLSRIKFK RNGFLKLAL+LNMFPGF
Sbjct:    61 TNETFPFGKWFMNTLIVATFTCIISTFITVAIAYSLSRIKFKFRNGFLKLALILNMFPGF   120

Query:   121 MSMIAVYYILKALNLDQTLTALIFVYSAGAALTFYIAKGFFDTIPYSLDESAMIDGATRL   180
             MSMIA+YYILKAL L QTLTAL+ VYS+GAAL FYIAKGFFDTIPYSLDESAMIDGATR+
Sbjct:   121 MSMIAIYYILKALGLTQTLTALVLVYSSGAALGFYIAKGFFDTIPYSLDESAMIDGATRM   180

Query:   181 DIFLKITLPLSKPIIVYTALIAFMGPWMDFIFAKVILGDATSKYTVAIGLFSMLQQDTIN   240
             DIF KITLPL+KPIIVYTAL+AFMGPW DFIFA+VILGDATSKYTVAIGLFSMLQ DTIN
Sbjct:   181 DIFFKITLPLAKPIIVYTALLAFMGPWIDFIFAQVILGDATSKYTVAIGLFSMLQPDTIN   240

Query:   241 QWFMSFTAGSVIIAIPITILFMFMQKYYVEGITGGSVK                        278
              WFM+FTAGSV+IA+PIT+LFMFMQKYYVEGITGGSVK
Sbjct:   241 NWFMAFTAGSVLIAVPITLLFMFMQKYYVEGITGGSVK                        278
```

Based on this analysis, it was predicted that these proteins and their epitopes could be useful antigens for vaccines or diagnostics.

EXAMPLE 1640

A DNA sequence (GBSx1735) was identified in *S. agalactiae* <SEQ ID 5071> which encodes the amino acid sequence <SEQ ID 5072>. This protein is predicted to be cymF protein (malF). Analysis of this protein sequence reveals the following:

```
Possible site: 36
>>> Seems to have no N-terminal signal sequence
    INTEGRAL    Likelihood = -11.46    Transmembrane    427-443   (417-447)
    INTEGRAL    Likelihood = -10.24    Transmembrane     99-115    (96-121)
    INTEGRAL    Likelihood =  -9.39    Transmembrane    166-182   (154-185)
    INTEGRAL    Likelihood =  -6.21    Transmembrane    259-275   (257-276)
    INTEGRAL    Likelihood =  -6.21    Transmembrane    229-245   (223-247)
    INTEGRAL    Likelihood =  -6.10    Transmembrane     44-60     (40-66)
    INTEGRAL    Likelihood =  -4.51    Transmembrane    314-330   (312-331)
```

-continued

```
----- Final Results -----
 bacterial membrane --- Certainty = 0.5585 (Affirmative) < succ>
  bacterial outside --- Certainty = 0.0000 (Not Clear) < succ>
bacterial cytoplasm --- Certainty = 0.0000 (Not Clear) < succ>
```

The protein has homology with the following sequences in the GENPEPT database.

```
>GP:CAA60005 GB:X86014 cymF [Klebsiella oxytoca]
Identities = 174/428 (40%), Positives = 263/428 (60%), Gaps = 21/428 (4%)

Query:   27 SFLIMGLANLKNKQIVKGLLFLISEILFLITFVYQVIPAVKGLISLGTQEQGMTTKTVDG   86
            SFLIMG   L +   +KG +FL+ +I+ +I+ +   ++ A +GLI+LGT   Q     T   G
Sbjct:   15 SFLIMGATQLISGHWIKGSVFLLFQIV-VISNINLLLNATQGLITLGTVAQ-----TRSG   68

Query:   87 IKIQVATQGDNSMLMLIFGLASLIFCCVFAYIYWSNIKSAAHLLTLKEEGREIPSFKKDI   146
             I      GDNS+ ML+ G+ + IF      ++YW NIK A       +         SF + +
Sbjct:   69 FDI---VAGDNSIFMLVEGVVAFIFLFFSIFVYWLNIKDAQVCEKCHQ------SFTEQL  119

Query:  147 KSLTDGRFHMTLMSIPLIGVLLFTILPLVYMICLAFTNYDH-NHLPPKSLFDWVGFANFG   205
            +++  D RF    +++   I  + F I+P++  + ++ TNY   +H+PPK+L DWVG  NF
Sbjct:  120 RTIYDNRFATIMLAPAFIACIAFIIMPMIITVLVSLTNYSAPHHIPPKNLVDWVGLKNFI  179

Query:  206 NIFSGRMAS-TFFPVLSWTLIWAVFATVTNFFFGIILALLINTKGLKFKKMWRTIFVITM   264
             +F  R+ S TF +   WT++WA FAT+       FG +LAL +   K +   KK WR +F++
Sbjct:  180 TLFELRIWSKTFVGIGVWTVLWAFFATLCTCSFGFLLALALENKKIIAKKAWRVVFILPY  239

Query:  265 AVPQFISLLIMRNLLSDAGPVNALLIKWGLISSAHPLPFLSDPVWAKFSIIFVNMWVGIP   324
            A+P F++LLI R LL+  GPVN+ L  WG+ S     + FLSDP+  AK ++I V++WVG P
Sbjct:  240 AIPAFVTLLIFRLLLNGIGPVNSTLNSWGIDS----IGFLSDPLIAKMTVIAVSVWVGAP  295

Query:  325 VTMLVATGIIMNLPAEQIEAAEIDGANKFQVFQSITFPQILLIMTPTLIQQFIGNINNFN   384
              ML+ TG +  N+P +   EA+E+DGA+KFQ F+ IT P +L  + P+L+  F   N NNF
Sbjct:  296 YFMLLITGAMTNIPRDLYEASEVDGASKFQQFREITLPMVLHQVAPSLVMTFAHNFNNFG  355

Query:  385 VIYLLTQGGPTNSTYYQAGSTDLLVTWLYNLTVTAADYNLASVVGILIFILSAVFSLLAY   444
             IYLLT+GGP N  Y    AG TD+L+TW+Y  LT+     Y +ASV+ I+IF+   ++F++    +
Sbjct:  356 AIYLLTEGGPINPEYRFAGHTDILITWIYKLTLDFQQYQIASVISIIIFLFLSIFAIWQF  415

Query:  445 TRTNSYKE                                                       452
             R    S+KE
Sbjct:  416 RRMKSFKE                                                       423
```

A related DNA sequence was identified in *S. pyogenes* <SEQ ID 5073> which encodes the amino acid sequence <SEQ ID 5074>. Analysis of this protein sequence reveals the following:

```
Possible site: 36
>>> Seems to have no N-terminal signal sequence
    INTEGRAL    Likelihood = -10.93    Transmembrane     98-114 (95-122)
    INTEGRAL    Likelihood =  -9.55    Transmembrane    165-181 (152-184)
    INTEGRAL    Likelihood =  -9.24    Transmembrane    424-440 (419-443)
    INTEGRAL    Likelihood =  -7.91    Transmembrane     43-59  (39-71)
    INTEGRAL    Likelihood =  -7.59    Transmembrane    258-274 (256-275)
    INTEGRAL    Likelihood =  -6.21    Transmembrane    228-244 (222-246)
    INTEGRAL    Likelihood =  -4.09    Transmembrane    311-327 (309-328)

----- Final Results -----
         bacterial membrane --- Certainty = 0.5373 (Affirmative) < succ>
          bacterial outside --- Certainty = 0.0000 (Not Clear) < succ>
        bacterial cytoplasm --- Certainty = 0.0000 (Not Clear) < succ>
```

The protein has homology with the following sequences in the databases:

```
>GP:CAA60005 GB:X86014 cymF [Klebsiella oxytoca]
Identities = 179/426 (42%), Positives = 266/426 (62%), Gaps = 19/426 (4%)

Query:   26 SSIIMGFANFANKQFIKGILFLISELIFLVAFVSQIIPAIRGLVTLGTQTQGMTTKTIDG    85
            S +IMG    +  +IKG +FL+ +++ +++ ++ ++ A +GL+TLGT  Q      T  G
Sbjct:   15 SFLIMGATQLISGHWIKGSVFLLFQIV-VISNINLLLNATQGLITLGTVAQ-----TRSG    68

Query:   86 INIQVAVDGDNSMLMLIFGLASLIFCLVFAYIYWCNLKSARNLYLFKQKGQKIPSFKEDL   145
            +I   V GDNS+ ML+ G+ + IF     ++YW N+K A+        Q     SF E L
Sbjct:   69 FDI---VAGDNSIFMLVEGVVAFIFLFFSIFVYWLNIKDAQVCEKCHQ------SFTEQL   119

Query:  146 ATLTNGRFHMTLMAIPLIGVLLFTILPLIYMICLAFTNFDH-NHLPPKSLFDWVGLANFG   204
            T+ + RF    ++A   I   + F I+P+I  + ++ TN+    +H+PPK+L DWVGL NF
Sbjct:  120 RTIYDNRFATIMLAPAFIACIAFIIMPMIITVLVSLTNYSAPHHIPPKNLVDWVGLKNFI   179

Query:  205 NVLSGRM-AGTFFPIFSWTLIWAVFATVTNFFFGIILALLINTKGLKWKKMWRTIFVITI   263
            +     R+ + TF    I     WT++WA FAT+   FG +LAL +   K + KK WR +F++
Sbjct:  180 TLFELRIWSKTFVGIGVWTVLWAFFATLCTCSFGFLLALALENKKIIAKKAWRVVFILPY   239

Query:  264 AVPQFISLLIMRNLLNDEGPLNALLNKIGLINGSLPFLSDPLWAKFSIIFVNMWIGIPFT   323
            A+P F++LLI R LLN  GP+N+ LN  G+   S+ FLSDPL AK ++I V++W+G P+
Sbjct:  240 AIPAFVTLLIFRLLLNGIGPVNSTLNSWGI--DSIGFLSDPLIAKMTVIAVSVWVGAPYF   297

Query:  324 MLIATGIIMNLPSEQIEAAEIDGASKFQVFKSITFPQILLIMTPNLIQQFIGNINNFNVI   383
            ML+  TG + N+P +   EA+E+DGASKFQ F+  IT P +L+   + P+L+   F N NNF   I
Sbjct:  298 MLLITGAMTNIPRDLYEASEVDGASKFQQFREITLPMVLHQVAPSLVMTFAHNFNNFGAI   357

Query:  384 YLLTGGGPTNSEYYQAGTTDLLVTWLYKLTVTAADYNLASVIGILIFTVSAIFSLLAYTR   443
            YLLT GGP N  EY  AG  TD+L+TW+YKLT+      Y +ASVI  I+IF     +IF++   + R
Sbjct:  358 YLLTEGGPINPEYRFAGHTDILITWIYKLTLDFQQYQIASVISIIIFLFLSIFAIWQFRR   417

Query:  444 TASYKE                                                        449
               S+KE
Sbjct:  418 MKSFKE                                                        423
```

An alignment of the GAS and GBS proteins is shown below.

```
Identities = 357/446 (80%), Positives = 404/446 (90%), Gaps = 2/446 (0%)

Query:   11 MSLKEVFQKGDLATKLSFLIMGLANLKNKQIVKGLLFLISEILFLITFVYQVIPAVKGLI    70
            +S+ E  ++G   KLS +IMG AN  NKQ +KG+LFLISE++FL+   FV Q+IPA++GL+
Sbjct:   10 ISVIEALKRGSWDIKLSSIIMGFANFANKQFIKGILFLISELIFLVAFVSQIIPAIRGLV    69

Query:   71 SLGTQEQGMTTKTVDGIKIQVATQGDNSMLMLIFGLASLIFCCVFAYIYWSNIKSAAHLL   130
            +LGTQ QGMTTKT+DGI IQVA  GDNSMLMLIFGLASLIFC VFAYIYW N+KSA +L
Sbjct:   70 TLGTQTQGMTTKTIDGINIQVAVDGDNSMLMLIFGLASLIFCLVFAYIYWCNLKSAPNLY   129

Query:  131 TLKEEGREIPSFKKDIKSLTDGRFHMTLMSIPLIGVLLFTILPLVYMICLAFTNYDHNHL   190
             K++G++IPSFK+D+  +LT+GRFHMTLM+IPLIGVLLFTILPL+YMICLAFTN+DHNHL
Sbjct:  130 LFKQKGQKIPSFKEDLATLTNGRFHMTLMAIPLIGVLLFTILPLIYMICLAFTNFDHNHL   189

Query:  191 PPKSLFDWVGFANFGNIFSGRMASTFFPVLSWTLIWAVFATVTNFFFGIILALLINTKGL   250
            PPKSLFDWVG ANFGN+ SGRMA TFFP+ SWTLIWAVFATVTNFFFGIILALLINTKGL
Sbjct:  190 PPKSLFDWVGLANFGNVLSGRMAGTFFPIFSWTLIWAVFATVTNFFFGIILALLINTKGL   249

Query:  251 KFKKMWRTIFVITMAVPQFISLLIMRNLLSDAGPVNALLIKWGLISSAHPLPFLSDPVWA   310
            K+KKMWRTIFVIT+AVPQFISLLIMRNLL+D GP+NALL K GLI+ +  LPFLSDP WA
Sbjct:  250 KWKKMWRTIFVITIAVPQFISLLIMRNLLNDEGPLNALLNKIGLINGS--LPFLSDPLWA   307

Query:  311 KFSIIFVNMWVGIPVTMLVATGIIMNLPAEQIEAAEIDGANKFQVFQSITFPQILLIMTP   370
            KFSIIFVNMW+GIP TML+ATGIIMNLP+EQIEAAEIDGA+KFQVF+SITFPQILLIMTP
Sbjct:  308 KFSIIFVNMWIGIPFTMLIATGIIMNLPSEQIEAAEIDGASKFQVFKSITFPQILLIMTP   367

Query:  371 TLIQQFIGNINNFNVIYLLTQGGPTNSTYYQAGSTDLLVTWLYNLTVTAADYNLASVVGI   430
             LIQQFIGNINNFNVIYLLT GGPTNS YYQAG+TDLLVTWLY LTVTAADYNLASV+GI
Sbjct:  368 NLIQQFIGNINNFNVIYLLTGGGPTNSEYYQAGTTDLLVTWLYKLTVTAADYNLASVIGI   427

Query:  431 LIFILSAVFSLLAYTRTNSYKEGAAK                                    456
            LIF +SA+FSLLAYTRT SYKEGAAK
Sbjct:  428 LIFTVSAIFSLLAYTRTASYKEGAAK                                    453
```

A related GBS gene <SEQ ID 8869> and protein <SEQ ID 8870> were also identified. Analysis of this protein sequence reveals the following:

```
Lipop: Possible site: -1 Crend: 8
McG: Discrim Score: -12.73
GvH: Signal Score (-7.5): -6.04
Possible site: 36
>>> Seems to have no N-terminal signal sequence
ALOM program count: 7   value: -11.46        threshold: 0.0
  INTEGRAL            Likelihood = -11.46  Transmembrane 427-443 (417-
                                                         447)

INTEGRAL            Likelihood =  -9.87  Transmembrane  99-115 (96-121)

INTEGRAL            Likelihood =  -9.39  Transmembrane 166-182 (154-
                                                         185)

INTEGRAL            Likelihood =  -6.21  Transmembrane 259-275 (257-
                                                         276)
  INTEGRAL            Likelihood =  -6.21  Transmembrane 229-245 (223-
                                                         247)
  INTEGRAL            Likelihood =  -6.10  Transmembrane  44- 60 (40-66)
  INTEGRAL            Likelihood =  -4.51  Transmembrane 314-330 (312-
                                                         331)
  PERIPHERAL          Likelihood =   0.90   212
modified ALOM score: 2.79

*** Reasoning Step: 3

----- Final Results -----
 bacterial membrane --- Certainty = 0.5585 (Affirmative) < succ>
  bacterial outside --- Certainty = 0.0000 (Not Clear) < succ>
bacterial cytoplasm --- Certainty = 0.0000 (Not Clear) < succ>
```

The protein has homology with the following sequences in the databases:

```
ORF01027(379-1656 of 1968)
EGAD|33392|34706(15-423 of 427) cymF protein {Klebsiella oxytoca}
GP|854233|emb|CAA60005.1||X86014 cymF {Klebsiella oxytoca} PIR|S63615 malF
protein homolog cymF-Klebsiella oxytoca
% Match = 23.8
% Identity = 41.3    % Similarity = 64.5
Matches = 171    Mismatches = 140    Conservative Sub.s = 96
132         162         192         222         252         282         312         342
VLLFLAILTVVKSNLAITLNV*NNSIKTSLKQNSTSRVMR*GEYSSFQLRVLPISYFVK*QLKETIMNKKLISLDGMSLK
                                                                               ML
372         402         432         462         492         522         552         582
EVFQKGDLATKLSFLIMGLANLKNKQIVKGLLFLISEILFLITFVYQVIPAVKGLISLGTQEQGMTTKTVDGIKIQVATQ
     ||||||    |  :  :||  :||: :   |  ||  :  ::   :|:   ::|||||    |      |   |
LSEGKSMRIFPASFLIMGATQLISGHWIKGSVFLLFQI-VVISNINLLLNATQGLITLGTVAQ-----TRSGFDI---VA
           20          30          40          50          60          70
612         642         672         702         732         762         792         822
GDNSMLMLIFGLASLIFXCVFAYIYWSNIXSAAHLLTLKEEGREIPSFKKDIKSLTDGRFHMTLMSIPLIGVLLFTILPL
||||::||:  |: :: ||      ::|| ||        :   :    ||  : ::::  ||  :::   :|  : |:
GDNSIFMLVEGVVAFIFLFFSIFVYWLNI------KDAQVCEKCHQSFTEQLRTIYDNRFATIMLAPAFIACIAFIIMPM
           90         100         110         120         130         140
852         879         909         939         966         996        1026        1056
VYMICLAFTNYDH-NHLPPKSLFDWVGFANFGNIFSGRMAS-TFFPVLSWTLIWAVFATVTNFFFGIILALLINTKGLKF
:  : :::|||  |||| |||| :||||:|  | ||: |  |:::||| | | :||:| ||||  ::||  | : |: |
IITVLVSLTNYSAPHHIPPKNLVDWVGLKNFITLFELRIWSKTFVGIGVWTVLWAFFATLCTCSFGFLLALALENKKIIA
          160         170         180         190         200         210         220
1086        1116        1146        1176        1206        1236        1266        1296
KKMWRTIFVITMAVPQFISLLIMRNLLSDAGPVNALLIKWGLISSAHPLPFLSDPVWAKFSIIFVNMWVGIPVTMLVATG
|| ||  :|::    |:| |::|||  ||  ||:|   ||       : ||||: ||  ::|:: |:   :|||  ||:||
KKAWRVVFILPYAIPAFVTLLIFRLLLNGIGPVNSTLNSWG----IDSIGFLSDPLIAKMTVIAVSVWVGAPYFMLLITG
          240         250         260         270         280         290         300
1326        1356        1386        1416        1446        1476        1506        1536
IIMNLPAEQIEAAEIDGANKFQVFQSITFPQILLIMTPTLIQQFIGNINNFNVIYLLTQGGPTNSTYYQAGSTDLLVTWL
:  |:| :   ||:|:|||:|:  | |: :|  |:| |:  |:| :   |||   |||:||| |  ||||:|||:
AMTNIPRDLYEASEVDGASKFQQFREITLPMVLHQVAPSLVMTFAHNFNNFGAIYLLTEGGPINPEYRFAGHTDILITWI
          320         330         340         350         360         370         380
1566        1596        1626        1656        1686        1716        1746        1776
YNLTVTAADYNLASVVGILIFILSAVFSLLAYTRTNSYKEGAAKIRKNVLTLLLFIFYYYQLCGSFPLFGSFSQAS
|||:         |  :|||:||::::|| |        |  :|                |  :||
YKLTLDFQQYQIASVISIIIFLFLSIFAIWQFRRMKSFKEDVGM
          400         410         420
```

Based on this analysis, it was predicted that these proteins and their epitopes could be useful antigens for vaccines or diagnostics.

EXAMPLE 1641

A DNA sequence (GBSx1736) was identified in *S. agalactiae* <SEQ ID 5075> which encodes the amino acid sequence <SEQ ID 5076>. This protein is predicted to be maltose/maltodextrin-binding protein precursor. Analysis of this protein sequence reveals the following:

```
Possible site: 41
>>> Seems to have no N-terminal signal sequence
    INTEGRAL    Likelihood = -3.98       Transmembrane    25-41 (24-43)

----- Final Results -----
            bacterial membrane --- Certainty = 0.2593 (Affirmative) < succ>
             bacterial outside --- Certainty = 0.0000 (Not Clear)   < succ>
           bacterial cytoplasm --- Certainty = 0.0000 (Not Clear)   < succ>
```

A related GBS nucleic acid sequence <SEQ ID 9999> which encodes amino acid sequence <SEQ ID 10000> was also identified.

The protein has homology with the following sequences in the GENPEPT database.

```
>GP:AAA26925 GB:L08611 MalX [Streptococcus pneumoniae]
Identities = 117/418 (27%), Positives = 186/418 (43%), Gaps = 43/418 (10%)

Query:   15 TKMEKNTWKKLLVSTAALSVVAGGAIAATHSNSVDAASKTTIKLWVPTDSKASYKAIVKK   74
            +K  K+T    V+ A+L +VA G+  A        ++    + ++V    K+  + + K
Sbjct:    3 SKFMKSTAVLGTVTLASLLLVACGSKTADKPADSGSSEVKELTVYVDEGYKSYIEEVAKA   62

Query:   75 FZKE-NKGVTVKMIESNDSKAQENVKKDPSKAADVFSLPHDQLGQLVESGVIQEIPEQYS  133
            ++KE    VT+K  ++        + ++     DV    P+D++G L    G + E+  + S
Sbjct:   63 YEKEAGVKVTLKTGDALGGLDKLSLDNQSGNVPDVMMAPYDRVGSLGSDGQLSEV--KLS  120

Query:  134 KEIAKNDTKQSLTGAQYKGKTYAFPFGIESQVLYYNKTKLTADDVKSYETITSKGKFGXQ  193
                +DT +SL  A   GK Y   P   IES V+YYNK  L  D  K++  +  +    K
Sbjct:  121 DGAKTDDTTKSLVTAA-NGKVYGAPAVIESLVMYYNKD-LVKDAPKTFADLENLAKDSKY  178

Query:  194 LKAA-------------NSYVTGPXFLSVGDTLFGKSGEDAKGTNWGNEAGVSVL-----  235
            A                 N Y T     G      +FG++G+DAK     N+  ++ +
Sbjct:  179 AFAGEDGKTTAFLADWTNFYYTYGLLAGNGAYVFGQNGKDAKDIGLANDGSIAGINYAKS  238

Query:  236 ---KWIADQKKNDGFVNLTAENTMSKFGDGSVHAFESGPWDYDAAKKAVGEDKIGVAVYP  292
               KW     +  +G  NL       ++F  +G   A    GPW     A K A    +   GVA P
Sbjct:  239 WYEKWPKGMQDTEGAGNLI----QTQFQEGKTAAIIDGPWKAQAFKDA--KVNYGVATIP  292

Query:  293 TMKIGDKEVQQKAFLGVKLYAVNQAPAGSNTKRISASYKLAAYLTNAESQKIQFEKRHIV  352
            T+  G     + AF  G K + +  QA        K + AS  K    +L     E  QK+ ++K  +  +
Sbjct:  293 TLPNGK---EYAAFGGGKAWVIPQA------VKNLEASQKFVDFLVATEQQKVLYDKTNEI  344

Query:  353 PANSSIQSSDSVQKDELAKAVIEMGSSDKYTTVMPKLSQMSTFWTESAAILSDTYSGK    410
            PAN+  +S     + DEL  AVI+       K T   +P +SQMS   W   +L D   SG+
Sbjct:  345 PANTEARSYAEGKNDELTTAVIK---QFKNTQPLPNISQMSAVWDPAKNMLFDAVSGQ    399
```

A related DNA sequence was identified in *S. pyogenes* <SEQ ID 5077> which encodes the amino acid sequence <SEQ ID 5078>. Analysis of this protein sequence reveals the following:

```
Possible site: 28

>>> May be a lipoprotein

----- Final Results -----
            bacterial membrane --- Certainty = 0.0000(Not Clear) < succ>
             bacterial outside --- Certainty = 0.0000(Not Clear) < succ>
           bacterial cytoplasm --- Certainty = 0.0000(Not Clear) < succ>
```

The protein has homology with the following sequences in the databases:

```
>GP:AAA26925 GB:L08611 MalX [Streptococcus pneumoniae]
Identities = 126/423 (29%), Positives = 191/423 (44%), Gaps = 50/423 (11%)

Query:   13 SLTLASTLLVGCGSGSKDK--KEAGADSKTIKLWVPTGSKKSYADTIAK-FEKDSGYTVK    69
            ++TLAS LLV CGS + DK      ++ K + ++V  G  KSY + +AK +EK++G  V
Sbjct:   14 TVTLASLLLVACGSKTADKPADSGSSEVKELTVYVDEG-YKSYIEEVAKAYEKEAGVKVT    72

Query:   70 VVESEDPKAQEKIKKD--ASTAADVFSLPHDQLGQLVESGTIQEVPEKYNKEIAATSTDQ   127
            +    + +K+ D +    DV   P+D++G L   G + EV K +       T +
Sbjct:   73 LKTGDALGGLDKLSLDNQSGNVPDVMMAPYDRVGSLGSDGQLSEV--KLSDGAKTDDTTK   130

Query:  128 ALVGAQYKGKTYAFPPFGIESQVLFYNKSKLAAEDVTSYD----TITTKATFGGTFKQ---  180
            +LV A  GK Y P  IES V++YNK  +     T D      +K  F G     +
Sbjct:  131 SLVTAA-NGKVYGAPAVIESLVMYYNKDLVKDAPKTFADLENLAKDSKYAFAGEDGKTTA   189

Query:  181 -----ANTYATGPLFMSVGNTLFGENGEDVKGTNWGNEKGAAVL--------KWIADQAS   227
                 N Y T  L   G +FG+NG+D K      N+    A +         KW
Sbjct:  190 FLADWTNFYYTYGLLAGNGAYVFGQNGKDAKDIGLANDGSIAGINYAKSWYEKWPKGMQD   249

Query:  228 NKGFVSLDANNVMSKFGDGSVASFESGPWDYEAAQKAIGKENLGVAIYPKVTIGGETVQQ   287
             +G         N + ++F +G  A+    GPW  +A  K N GVA  P +   G E
Sbjct:  250 TEG----AGNLIQTQFQEGKTAAIIDGPWKAQAFKDA--KVNYGVATIPTLPNGKE---Y   300

Query:  288 KAFLGVKLYAVNQAPAKGDTKRIAASYKLASYLTNAESQENQFKTRNIVPANKEVQSSEA   347
              AF G K + + QA         K + AS K   +L    E Q+  +    N +PAN E +S
Sbjct:  301 AAFGGGKAWVIPQA-----VKNLEASQKFVDFLVATEQQKVLYDKTNEIPANTEARSYAE   355

Query:  348 VQSNELAKTVITMGSSSDYTVVMPKLSQMGTFWTESAAILSDAFNG----KIKENDYLTK   403
            +++EL    VI  +    T  +P +SQM     W  +  +L DA +G       K   ND +T
Sbjct:  356 GKNDELTTAVIKQFKN---TQPLPNISQMSAVWDPAKNMLFDAVSGQKDAKTAANDAVTL   412

Query:  404 LQQ   406
            +++
Sbjct:  413 IKE   415
```

An alignment of the GAS and GBS proteins is shown below.

```
Identities = 278/415 (66%), Positives = 334/415 (79%), Gaps = 6/415 (1%)

Query:   21 TWKKLLVSTAALSVVAGGAIAATHSNSVD----AASKTTIKLWVPTDSKASYKAIVKKFZ    76
            +W+K++V  A+L++ A  +    S S D    A     TIKLWVPT SK SY   + KF+
Sbjct:    3 SWQKVIVGGASLTL-ASTLLVGCGSGSKDKKEAGADSKTIKLWVPTGSKKSYADTIAKFE    61

Query:   77 KENKGVTVKMIESNDSKAQENVKKDPSKAADVFSLPHDQLGQLVESGVIQEIPEQYSKEI   136
            K++ G TVK++ES D KAQE +KKD S AADVFSLPHDQLGQLVESG IQE+PE+Y+KEI
Sbjct:   62 KDS-GYTVKVVESEDPKAQEKIKKDASTAADVFSLPHDQLGQLVESGTIQEVPEKYNKEI   120

Query:  137 AKNDTKQSLTGAQYKGKTYAFPPFGIESQVLYYNKTKLTADDVKSYETITSKGKFGXQLKA   196
            A   T Q+L GAQYKGKTYAFPPFGIESQVL+YNK+KL A+DV SY+TIT+K  FG   K
Sbjct:  121 AATSTDQALVGAQYKGKTYAFPPFGIESQVLFYNKSKLAAEDVTSYDTITTKATFGGTFKQ   180

Query:  197 ANSYVTGPXFLSVGDTLFGKSGEDAKGTNWGNEAGVSVLKWIADQKKNDGFVNLTAENTM   256
            AN+Y TGP F+SVG+TLFG++GED KGTNWGNE G +VLKWIADQ  N GFV+L A N M
Sbjct:  181 ANTYATGPLFMSVGNTLFGENGEDVKGTNWGNEKGAAVLKWIADQASNKGFVSLDANNVM   240

Query:  257 SKFGDGSVHAFESGPWDYDAAKKAVGEDKIGVAVYPTMKIGDKEVQQKAFLGVKLYAVNQ   316
            SKFGDGSV +FESGPWDY+AA+KA+G++  +GVA+YP +  IG + VQQKAFLGVKLYAVNQ
Sbjct:  241 SKFGDGSVASFESGPWDYEAAQKAIGKENLGVAIYPKVTIGGETVQQKAFLGVKLYAVNQ   300

Query:  317 APAGSNTKRISASYKLAAYLTNAESQKIQFEKRHIVPANSSIQSSDSVQKDELAKAVIEM   376
            APA  +TKRI+ASYKLA+YLTNAESQ+ QF+ R+IVPAN  +QSS++VQ +ELAK VI M
Sbjct:  301 APAKGDTKRIAASYKLASYLTNAESQENQFKTRNIVPANKEVQSSEAVQSNELAKTVITM   360
```

```
Query:  377  GSSDKYTTVMPKLSQMSTFWTESAAILSDTYSGKIKSSDYLKRLKQFDKDIAKTK          431
             GSS  YT VMPKLSQM TFWTESAAILSD ++GKIK +DYL +L+QFDKDIA TK
Sbjct:  361  GSSSDYTVVMPKLSQMGTFWTESAAILSDAFNGKIKENDYLTKLQQFDKDIAATK          415
```

Figure 132:
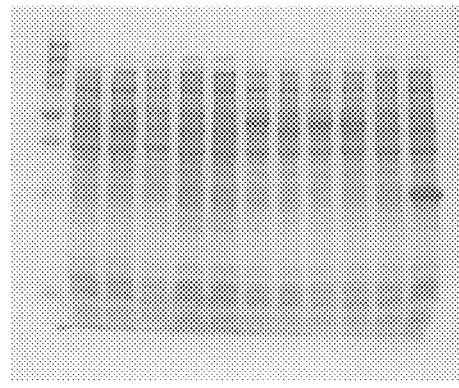

SEQ ID 5076 (GBS649) was expressed in *E. coli* as a GST-fusion product. SDS-PAGE analysis of total cell extract is shown in FIG. 132 (lane 2 & 3; MW 76 kDa) and in FIG. 186 (lane 7; MW 76 kDa). It was also expressed in *E. coli* as a His-fusion product. SDS-PAGE analysis of total cell extract is shown in FIG. 132 (lane 7; MW 51 kDa) and in FIG. 178 (lane 8; MW 51 kDa).

GBS649-His was purified as shown in FIG. 229, lane 8. Purified GBS649-GST is shown in FIG. 245, lanes 6 &73.

Based on this analysis, it was predicted that these proteins and their epitopes could be useful antigens for vaccines or diagnostics.

EXAMPLE 1642

A DNA sequence (GBSx1737) was identified in *S. agalactiae* <SEQ ID 5079> which encodes the amino acid sequence <SEQ ID 5080>. Analysis of this protein sequence reveals the following:

```
Possible site: 51
>>> Seems to have no N-terminal signal sequence

----- Final Results -----
                     bacterial cytoplasm --- Certainty = 0.2462(Affirmative) < succ>
                     bacterial membrane  --- Certainty = 0.0000(Not Clear)   < succ>
                      bacterial outside  --- Certainty = 0.0000(Not Clear)   < succ>
```

The protein has homology with the following sequences in the GENPEPT database.

```
>GP:AAD02112 GB:AF039082 putative maltose operon transcriptional repressor
[Lactococcus lactis]
Identities = 43/61 (70%), Positives = 49/61 (79%)

Query:    2  VTIKDVAAKAGVNPSTVSRVLKDNASISSKTKERVKKAMEELGYVPNVAAQMLASGLTQN    61
             VTIKDVA KAGVN STVSRV+KD++ IS KTK +V+KAM ELGY  N AAQ+LASG T
Sbjct:    3  VTIKDVAKKAGVNASTVSRVIKDSSEISDKTKVKVRKAMHELGYRRNAAAQILASGKTNT   62

Query:   62  I                                                              62
             I
Sbjct:   63  I                                                              63
```

A related DNA sequence was identified in *S. pyogenes* <SEQ ID 5081> which encodes the amino acid sequence <SEQ ID 5082>. Analysis of this protein sequence reveals the following:

```
Possible site: 44
>>> Seems to have no N-terminal signal sequence
    INTEGRAL    Likelihood = -3.93      Transmembrane   269-285 (266-287)

----- Final Results -----
                     bacterial membrane  --- Certainty = 0.2572(Affirmative) < succ>
                      bacterial outside  --- Certainty = 0.0000(Not Clear)   < succ>
                     bacterial cytoplasm --- Certainty = 0.0000(Not Clear)   < succ>
```

An alignment of the GAS and GBS proteins is shown below.

```
Identities = 53/62 (85%), Positives = 57/62 (91%)

Query:    1 MVTIKDVAAKAGVNPSTVSRVLKDNASISSKTKERVKKAMEELGYVPNVAAQMLASGLTQ   60
            MVTIKDVA KAGVNPSTVSRVLKDN SIS KTKE+V+KAM +LGYVPNVAAQ+LASGLT
Sbjct:   26 MVTIKDVAQKAGVNPSTVSRVLKDNRSISMKTKEKVRKAMADLGYVPNVAAQILASGLTH   85

Query:   61 NI   62
            NI
Sbjct:   86 NI   87
```

Based on this analysis, it was predicted that these proteins and their epitopes could be useful antigens for vaccines or diagnostics.

EXAMPLE 1643

A DNA sequence (GBSx1738) was identified in *S. agalactiae* <SEQ ID 5083> which encodes the amino acid sequence <SEQ ID 5084>. Analysis of this protein sequence reveals the following:

```
Possible site: 56
>>> Seems to have an uncleavable N-term signal seq
    INTEGRAL    Likelihood = -7.70    Transmembrane    14-30 (8-34)
    INTEGRAL    Likelihood = -6.90    Transmembrane    66-82 (63-85)
    INTEGRAL    Likelihood = -6.69    Transmembrane    110-126 (105-128)
    INTEGRAL    Likelihood = -3.93    Transmembrane    132-148 (129-149)

----- Final Results -----
              bacterial membrane --- Certainty = 0.4079(Affirmative) < succ>
               bacterial outside --- Certainty = 0.0000(Not Clear) < succ>
             bacterial cytoplasm --- Certainty = 0.0000(Not Clear) < succ>
```

A related GBS nucleic acid sequence <SEQ ID 9443> which encodes amino acid sequence <SEQ ID 9444> was also identified.

The protein has homology with the following sequences in the GENPEPT database.

```
>GP:AAC67260 GB:AF017113 YvjA [Bacillus subtilis]
Identities = 83/227 (36%), Positives = 140/227 (61%)

Query:    9 FGWDSAFFIMIINIPLLLLCYFGLGKQTFLKTVYGSWIFPVFIKLTQSVPTLTHNPLLAA   68
            +G+++A+    IINIPL +      LG + LKT+ GS    P+ + LT+ +    TH+ LLAA
Sbjct:   52 YGFEAAYVQWIINIPLFIAGVILLGGKFGLKTLAGSVFLPLVVFLTRDIQPATHHELLAA  111

Query:   69 LFGGVIVGCLGIVFWSDSSTGGTGIIIQFLGKYTPISLGQGVILIDGLVTIVGFLAFDS  128
            +FGGV +G G+GIV+     STGGT +   Q + KY+ +SLG+ + +IDG++ +  + F+
Sbjct:  112 IFGGVGIGIGIGIVYLGKGSTGGTALAAQIIHKYSGLSLGKCLAIIDGMIVVTAMIVFNI  171

Query:  129 DTVNFSIIGLITISYIINAIQTGFTTLSTVLIVSQEHQKIKTYINTVADRGVTEIPVKGG  188
            +  +++++G+    S   I+ +Q GF          LI++++ Q  +K  +     DRGVT+I    GG
Sbjct:  172 EQGLYAMLGVYVSSKTIDVVQVGFNRSKMALIITKQEQAVKEAVLQKIDRGVTKISAVGG  231
```

```
-continued

Query:  189  YSGTNQIMLMTTIAGYEFAKLQEAIAEIDETAFITVTPTSQASGRGF        235
             Y+   ++ +LM +     EF KL++ + +IDE+AF+ V    S+   G GF
Sbjct:  232  YTDDDRPILMCVVGQTEFTKLKQIVKQIDESAFVIVADASEVLGEGF        278
```

A related DNA sequence was identified in *S. pyogenes* <SEQ ID 5085> which encodes the amino acid sequence <SEQ ID 5086>. Analysis of this protein sequence reveals the following:

```
Possible site: 57
>>> Seems to have a cleavable N-term signal seq.
     INTEGRAL    Likelihood = -6.21    104-120 (101-123)
                 Transmembrane
     INTEGRAL    Likelihood = -3.93    147-163 (142-167)
                 Transmembrane
     INTEGRAL    Likelihood = -3.29    169-185 (169-186)
                 Transmembrane ----- Final Results -----
              bacterial membrane --- Certainty = 0.3484 (Affirmative) < succ>
               bacterial outside --- Certainty = 0.0000 (Not Clear)   < succ>
             bacterial cytoplasm --- Certainty = 0.0000 (Not Clear)   < succ>
```

The protein has homology with the following sequences in the databases:

```
>GP:AAC67260 GB:AF017113 YvjA [Bacillus subtilis]
Identities = 106/267 (39%), Positives = 169/267 (62%), Gaps = 1/267 (0%)

Query:    7  DLLLVTIGSFITAIGFNTMFVDNHIASGGMVGIAVVIKALFGISPSLFLMASNIPLLLMC   66
             D + +  IG+ ITA+ FN     + N IA+GG+ GI+ ++++ +G    +    NIPL +
Sbjct:   13  DYVYILIGAAITAVSFNVFLLPNKIAAGGVSGISTILQS-YGFEAAYVQWIINIPLFIAG   71

Query:   67  YFFLGKQNFIKTLYGSWIYPIAIRSTNSLPTLTHNQLLAAIFGGIICGIGLGMVFWGNSS  126
                  LG + +KTL GS   P+  +    T  +    TH++LLAAIFGG+  GIG+G+V+  G   S
Sbjct:   72  VILLGGKFGLKTLAGSVFLPLVVFLTRDIQPATHHELLAAIFGGVGIGIGIGIVYLGKGS  131

Query:  127  TGGTGILTQILHKYSPLSLGVAMTIVDGISVLMGFIALSADDVMYSTIGLFVIGYVISVM  186
             TGGT +  QI+HKYS LSLG  + +DG+ V+      I   +  +Y+ +G++V    I V+
Sbjct:  132  TGGTALAAQIIHKYSGLSLGKCLAIIDGMIVVTAMIVFNIEQGLYAMLGVYVSSKTIDVV  191

Query:  187  ENGFDSSKNVMIISKDYQAIREYITTVMDRGVTKLPIRGGYTTSDKIMLMAIVSSHELPT  246
             + GF+ SK   +II+K  QA++E +   +DRGVTK+   GGYT  D+ +LM +V   E
Sbjct:  192  QVGFNRSKMALIITKQEQAVKEAVLQKIDRGVTKISAVGGYTDDDRPILMCVVGQTEFTK  251

Query:  247  LQEKILEIDDTAFIVVMPAAQVMGRGF                                   273
             L++ + +ID++AF++V  A++V+G GF
Sbjct:  252  LKQIVKQIDESAFVIVADASEVLGEGF                                   278
```

45

An alignment of the GAS and GBS proteins is shown below.

```
Identities = 135/252 (53%), Positives = 190/252 (74%)

Query:    1  MAVSFHEVFGWDSAFFIMIINIPLLLLCYFGLGKQTFLKTVYGSWIFPVFIKLTQSVPTL   60
                +AV     +FG   + F+M  NIPLLL+CYF LGKQ F+KT+YGSWI+P+ I+  T S+PTL
Sbjct:   39  IAVVIKALFGISPSLFLMASNIPLLLMCYFFLGKQNFIKTLYGSWIYPIAIRSTNSLPTL   98

Query:   61  THNPLLAALFGGVIVGCGLGIVFWSDSSTGGTGIIIQFLGKYTPISLGQGVILIDGLVTI  120
             THN LLAA+FGG+I G GLG+VFW +SSTGGTGI  Q L KY+P+SLG   ++DG+   +
Sbjct:   99  THNQLLAAIFGGIICGIGLGMVVFWGNSSTGGTGILTQILHKYSPLSLGVAMTIVDGISVL  158

Query:  121  VGFLAFDSDTVMFSIIGLITISYIINAIQTGFTTLSTVLIVSQEHQKIKTYINTVADRGV  180
             +GF+A  +D VM+S IGL  I Y+I+  ++ GF +    V+I+S+++Q I+ YI TV DRGV
Sbjct:  159  MGFIALSADDVMYSTIGLFVIGYVISVMENGFDSSKNVMIISKDYQAIREYITTVNDRGV  218

Query:  181  TEIPVKGGYSGTNQIMLMTTIAGYEFAKLQEAIAEIDETAFITVTPTSQASGRGFSLQKN  240
             T++P++GGY+ +++IMLM ++ +E   LQE I EID+TAFI V P +Q  GRGFSL  K
```

-continued

```
Sbjct:  219 TKLPIRGGYTTSDKIMLMAIVSSHELPTLQEKILEIDDTAFIVVMPAAQVMGRGFSLTKQ278

Query:  241 HGRLDEDILMPM                                                252
            + R D+D+L+PM
Sbjct:  279 YKREDKDVLLPM                                                290
```

A related GBS gene <SEQ ID 8871> and protein <SEQ ID 8872> were also identified. Analysis of this protein sequence reveals the following:

```
Lipop: Possible site: -1 Crend: 6
McG: Discrim Score: 1.57
GvH: Signal Score (-7.5): -2.56
Possible site: 56
>>> Seems to have an uncleavable N-term signal seq
ALOM program  count: 4 value: -7.70  threshold: 0.0
    INTEGRAL    Likelihood = -7.70      Transmembrane    14-30  (8-34)
    INTEGRAL    Likelihood = -6.90      Transmembrane    66-82  (63-85)
    INTEGRAL    Likelihood = -6.69      Transmembrane   110-126 (105-128)
    INTEGRAL    Likelihood = -3.93      Transmembrane   132-148 (129-149)
    PERIPHERAL  Likelihood =  3.71      37
modified ALOM score: 2.04

*** Reasoning Step: 3

----- Final Results -----
              bacterial membrane  --- Certainty = 0.4079 (Affirmative) < succ>
              bacterial outside   --- Certainty = 0.0000 (Not Clear)   < succ>
              bacterial cytoplasm --- Certainty = 0.0000 (Not Clear)   < succ>
```

The protein has homology with the following sequences in the databases:

```
ORF02139(118-1008 of 1356)
OMNI|NT01BS4111(51-325 of 327) conserved hypothetical protein
% Match = 19.3
% Identity = 37.1    % Similarity = 62.1
Matches = 101    Mismatches = 99    Conservative Sub.s = 68

27         57        87        117              165
         ARAIPSFIVGSALTGALVGLAGIKLMAPHGGIFVIALTSNPLLYIL----FILIGAVVSGVLFGLF---
                                           |  |:||       :|||||  ::   ||  |:|
VCFFISYILDFTAALAYYHCIWVLFTSNQGRIKMLSESIGRNGGYMMDVRNKTLWILRDYVYILIGAAITAVSFNVFLLP
         10        20        30        40        50        60        70        80

216       246       276       306       336       366       396       426
RKIK*LISTYPNLH*IKGE*XIVILXXLIN*XXGGISGLAVSFXEVFGWDSAFFIMIINIPLLLLCYFGLGKQTFLKTVY
 ||                              ||:||::    : :|:::|:   ||||||::    || :  |||:
NKI--------------------------AAGGVSGIST-ILQSYGFEAAYVQWIINIPLFIAGVILGGKFGLKTLA
                                        90       100      110      120       130

456       486       516       546       576       606       636       666
GSWIFPVFIKLTQSVPTLTHNPLLAALFGGVIVGCGLGIVFWSDSSTGGTGIIIQFLGKYTPISLGQGVILIDGLVTIVG
||  :|:  :||:  :   ||: ||||:|||| :| |:|||:    ||||| :  |: :|||: :  :|||:: :
GSVFLPLVVFLTRDIQPATHHELLAAIFGGVGIGIGIGIVYLGKGSTGGTALAAQIIHKYSGLSLGKCLAIIDGMIVVTA
             150       160       170       180       190       200       210

696       726       756       786       816       846       876       906
FLAFDSDTVMFSIIGLITISYIINAIQTGFTTLSTVLIVSQEHQKIKTYINTVADRGVTEIPVKGGYSGTNQIMLMTTIA
:  |: :  :::::|:     |   |: :|  ||      ||:::: |:    ||||||:|  |||  :: :||   :
MIVFNIEQGLYAMLGVYVSSKTIDVVQVGFNRSKMALIITKQEQAVKEAVLQKIDRGVTKISAVGGYTDDDRPILMCVVG
             230       240       250       260       270       280       290

936       966       996       1026      1056      1086      1116
GYEFAKLQEAIAEIDETAFITVTPTSQASGRGFSLQKNHGRLDEDILMPM*SIDN*SFF**NSR*NIHKR*QNC
  ||  ||::  :  :|||:||: |   |:  ||
QTEFTKLKQIVKQIDESAFVIVADASEVLGEGFKRA
             310       320
```

Based on this analysis, it was predicted that these proteins and their epitopes could be useful antigens for vaccines or diagnostics.

EXAMPLE 1644

A DNA sequence (GBSx1739) was identified in *S. agalactiae* <SEQ ID 5087> which encodes the amino acid sequence <SEQ ID 5088>. This protein is predicted to be ABC transporter, ATP-binding protein (b0820). Analysis of this protein sequence reveals the following:

```
Possible site: 56
>>> Seems to have no N-terminal signal sequence

----- Final Results -----
            bacterial cytoplasm --- Certainty = 0.3122 (Affirmative) < succ>
             bacterial membrane --- Certainty = 0.0000 (Not Clear)   < succ>
              bacterial outside --- Certainty = 0.0000 (Not Clear)   < succ>
```

The protein has homology with the following sequences in the GENPEPT database.

```
>GP:AAC24918 GB:AF012285 YkpA [Bacillus subtilis]
Identities = 355/540 (65%), Positives = 451/540 (82%), Gaps = 4/540 (0%)

Query:     1 MLTVSDVSLRFSDRKLFDEVNINFTAGNTYGLIGANGAGKSTFLKILAGDIEPTTGHIAL    60
             M+ V++VSLRF+DRKLF++VNI FT GN YGLIGANGAGKSTFLK+L+G+IEP TG + +

Sbjct:     1 MIAVNNVSLRFADRKLFEDVNIKFTPGNCYGLIGANGAGKSTFLKVLSGEIEPQTGDVHM    60

Query:    61 GPDERLSVLRQNHFDYEDERVIDVVIMGNETLYSIMKERDAIYMKEDFSDEDGVRAAELE   120
              P ERL+VL+QNHF+YE+   V+ VVIMG++ LY +M+EKDAIYMK DFSDEDG+RAAELE Sbjct:    61 SPGERLAVLKQNHFEYEEYEVLKVVIMGHKRLYEVMQEKDAIYMKPDFSDEDGIRAAELE   120

Query:   121 GEFAELGGWEAESEASQLLQNLNISEELHYQNMSELANGDKVKVLLAKALFGKPDVLLLD   180
             GEFAEL GWEAESEA+ LL+ L ISE+LH + M++L   +KVKVLLA+ALFGKPDVLLLD Sbjct:   121 GEFAELNGWEAESEAAILLKGLGISEDLHTKKMADLGGSEKVKVLLAQALFGKPDVLLLD   180

Query:   181 EPTNGLDIQSITWLEDFLIDFENTVIVVSHDRNFLNKVCTHMADLDFGKIKLFVGNYDFW   240
             EPTN LD+Q+I WLE+FLI+FENTVIVVSHDRHFLNKVCTH+ADLDF KI+++VGNYDFW Sbjct:   181 SPTNHLDLQAIQWLEEFLINFENTVIVVSHDRHFLNKVCTHIADLDFNKIQIYVGNYDFW   240

Query:   241 KESSELAARLQADRNAKAEEKIKQLQEFVARFSANASKSKQATSRKKMLDKIELEEIVPS   300
              ESS+LA +L  + N K EE+IKQLQEFVARFSANASKSKQATSRKK+L+KI L++I PS Sbjct:   241 YESSQLALKLSQEANKKKEEQIKQLQEFVARFSANASKSKQATSRKKLLEKITLDDIKPS   300

Query:   301 SRKYPFVNFKAEREMGNDLLTVENLSVTIDGEKILDNISFILRPGDKTALIGQNDIQTTA   360
             SR+YP+VNF  ERE+GND+L VE L+ TIDG K+LDN+SFI    DK A  G+N++  T Sbjct:   301 SRRYPYVNFTPEREIGNDVLRVEGLTKTIDGVKVLDNVSFINNREDKIAFTGRNELAVTT   360

Query:   361 LIRALMGDIEYE-GTIKWGVTTSRSYLPKDNSRDFASGE-SILEWLRQFASKEEDDNTFL   418
             L + + G++E + GT KWGVTTS++Y PKDNS  F   + ++++WLRQ+ S  +   +FL Sbjct:   361 LFKIISGEMEADSGTFKWGVTTSQAYFPKDNSEYFEGSDLNLVDWLRQY-SPHDQSESFL   419

Query:   419 RGFLGRMLFSGDEVNKSVNVLSGGEKVRVMLSKLMLLKSNVLVLDDPTNHLDLESISSLN   478
             RGFLGRMLFSG+EV+K  NVLSGGEKVR MLSK ML  +N+L+LD+PTNHLDLESI++LN Sbjct:   420 RGFLGRMLFSGEEVHKKANVLSGGEKVRCMLSKAMLSGANILILDEPTNHLDLESITALN   479
```

-continued

```
Query:  479 DGLKDFKESIIFASHDHEFIQTLANHIIVLSKNGVIDRIDETYDEFLENTEVQAKVAQLW  538
            +GL  FK +++F SHDH+F+QT+AN II ++ NG++D+   +YDEFLEN +VQ K+ +L+
Sbjct:  480 NGLISFKGAMLFTSHDHQFVQTIANRIIEITPNGIVDK-QMSYDEFLENADVQKKLTELY  538
```

A related DNA sequence was identified in *S. pyogenes* <SEQ ID 5089> which encodes the amino acid sequence <SEQ ID 5090>. Analysis of this protein sequence reveals the following:

```
Possible site: 56
>>> Seems to have no N-terminal signal sequence

----- Final Results -----
            bacterial cytoplasm --- Certainty = 0.3124(Affirmative) < succ>
             bacterial membrane --- Certainty = 0.0000(Not Clear) < succ>
              bacterial outside --- Certainty = 0.0000(Not Clear) < succ>
```

An alignment of the GAS and GBS proteins is shown below.

```
Identities = 497/539 (92%), Positives = 525/539 (97%)

Query:    1 MLTVSDVSLRFSDRKLFDEVNINFTAGNTYGLIGANGAGKSTFLKILAGDIEPTTGHIAL   60
            +LTVSDVSLRFSDRKLFD+VNI FTAGNTYGLIGANGAGKSTFLKILAGDIEP+TGHI+L
Sbjct:    1 LLTVSDVSLRFSDRKLFDDVNIKFTAGNTYGLIGANGAGKSTFLKILAGDIEPSTGHISL   60

Query:   61 GPDERLSVLRQNHFDYEDERVIDVVIMGNETLYSIMKEKDAIYMKEDFSDEDGVRAAELE  120
            GPDERLSVLRQNHFDYE+ER IDVVIMGNE LY+IMKEKDAIYMK DFS+EDGVRAAELE
Sbjct:   61 GPDERLSVLRQNHFDYEEERAIDVVIMGNEQLYNIMKEKDAIYMKADFSEEDGVRAAELE  120

Query:  121 GEFAELGGWEAESEASQLLQNLNISEELHYQNMSELANGDKVKVLLAKALFGKPDVLLLD  180
            G FAELGGWEAESEASQLLQNLNI E+LHYQNMSELANGDKVKVLLAKALFGKPDVLLLD
Sbjct:  121 GIFAELGGWEAESEASQLLQNLNIPEDLHYQNMSELANGDKVKVLLAKALFGKPDVLLLD  180

Query:  181 EPTNGLDIQSITWLEDFLIDFENTVIVVSHDRHFLNKVCTHMADLDFGKIKLFVGNYDFW  240
            EPTNGLDIQSI+WLEDFLIDFENTVIVVSHDRHFLNKVCTHMADLDFGKIKLFVGNYDFW
Sbjct:  181 EPTNGLDIQSISWLEDFLIDFENTVIVVSHDRHFLNKVCTHMADLDFGKIKLFVGNYDFW  240

Query:  241 KESSELAARLQADRNAKAEEKIKQLQEFVARFSANASKSKQATSRKKMLDKIELEEIVPS  300
            K+SSELAARLQADRNAKAEEKIK+LQEFVARFSANASKSKQATSRKKMLDKIELEEIVPS
Sbjct:  241 KQSSELAARLQADRNAKAEEKIKELQEFVARFSANASKSKQATSRKKMLDKIELEEIVPS  300

Query:  301 SRKYPFVNFKAEREMGNDLLTVENLSVTIDGEKILDNISFILRPGDKTALIGQNDIQTTA  360
            SRKYPF+NFKAEREMGND LTVENLSVTIDGEKI+DNISFILRFGDK A+IGQNDIQTTA
Sbjct:  301 SRKYPFINFKAEREMGNDFLTVENLSVTIDGEKIIDNISFILRFGDKAAIIGQNDIQTTA  360

Query:  361 LIRALMGDIEYEGTIKWGVTTSRSYLPKDNSRDFASGESILEWLRQFASKEEDDNTFLRG  420
            L+RAL  DI+YEGTIKWGVTTSRSYLPKDNS+DFA+ ESILSWLRQFASK EDD+TFLRG
Sbjct:  361 LMRALADDIDYEGTIKWGVTTSRSYLPKDNSKDFATEESILEWLRQFASKGEDDDTFLRG  420

Query:  421 FLGRMLFSGDEVNKSVNVLSGGEKVRVMLSKLMLLKSNVLVLDDPTNHLDLESISSLNDG  480
            FLGRMLFSGDEV KSVNVLSGGEKVRVMLSKLMLLKSNVL+LDDPTNHLDLESISSLNDG
Sbjct:  421 FLGRMLFSGDEVKKSVNVLSGGEKVRVMLSKLMLLKSNVLILDDPTNHLDLESISSLNDG  480

Query:  481 LKDFKESIIFASHDHEFIQTLANHIIVLSKNGVIDRIDETYDEFLENTEVQAKVAQLWK  539
            +KDFKES+IFASHDHEFIQT+ANHI+V+SKNGVIDRIDETYDEFL+N EVQA+VA+LWK
Sbjct:  481 IKDFKESVIFASHDHEFIQTIANHIVVISKNGVIDRIDETYDEFLDNPEVQARVAELWK  539
```

Based on this analysis, it was predicted that these proteins and their epitopes could be useful antigens for vaccines or diagnostics.

EXAMPLE 1645

A DNA sequence (GBSx1740) was identified in *S. agalactiae* <SEQ ID 5091> which encodes the amino acid sequence <SEQ ID 5092>. Analysis of this protein sequence reveals the following:

```
Possible site: 30
>>> Seems to have an uncleavable N-term signal seq
    INTEGRAL    Likelihood = -9.71    Transmembrane    14-30   (8-35)
    INTEGRAL    Likelihood = -7.70    Transmembrane    384-400 (382-403)
    INTEGRAL    Likelihood = -7.22    Transmembrane    412-428 (408-433)
    INTEGRAL    Likelihood = -5.73    Transmembrane    163-179 (155-180)
    INTEGRAL    Likelihood = -5.52    Transmembrane    322-338 (320-344)
    INTEGRAL    Likelihood = -5.10    Transmembrane    297-313 (290-314)
    INTEGRAL    Likelihood = -4.41    Transmembrane    360-376 (357-377)
    INTEGRAL    Likelihood = -4.35    Transmembrane    438-454 (437-455)
    INTEGRAL    Likelihood = -4.09    Transmembrane    136-152 (136-153)
    INTEGRAL    Likelihood = -3.35    Transmembrane    110-126 (106-128)
    INTEGRAL    Likelihood = -2.28    Transmembrane    232-248 (232-248)
    INTEGRAL    Likelihood = -1.81    Transmembrane    832-848 (832-848)
    INTEGRAL    Likelihood = -1.12    Transmembrane    200-216 (200-216)

----- Final Results -----
               bacterial membrane --- Certainty = 0.4885 (Affirmative) < succ>
                bacterial outside --- Certainty = 0.0000 (Not Clear) < succ>
              bacterial cytoplasm --- Certainty = 0.0000 (Not Clear) < succ>
```

The protein has homology with the following sequences in the GENPEPT database.

```
>GP:AAC14608 GB:U95840 transmembrane protein Tmp5 [Lactococcus
lactis]
Identities = 140/260 (53%), Positives = 182/260 (69%), Gaps = 6/260 (2%)

Query:    16 SFLLPFIIIVCILFTKNIYWGSPTTILASDGFHQYVIFNQALRNILH--GSNSLFYTFTS    73
             SF +P I++V +    L IYWGS +ILA D +HQYV +    RNILH  GS     YTFTS
Sbjct:    14 SFFIPLILMVIVLAMTGIYWGSSRSILAGDAYHQYVAIHSLYRNILHSGGSQGFLYTFTS    73

Query:    74 GLGLNFYALSSYYLGSFLSPIVYFFNLKNMPDAIYLLTICKIGLIGLSMFVTLCKRHCKV    133
             GLGLN YA S+YY+GSFL P  +FF++K+MPDA+YL TI K GLIGLS FV+     K+
Sbjct:    74 GLGLNLYAFSAYYMGSFLMPFTFFFDVKSMPDALYLFTIIKFGLIGLSSFVSFKNMYQKL    133

Query:   134 NRVLLLVISTCYSLMSFSISQIEINMWLDVFILIPLVVLGVDQLLWERKPILYFLSLTAL    193
             + + +L IST ++LMSF  SQ+EI MWLDVFIL+PL++ G+ +L+ ERK  LYF+SL L
Sbjct:   134 SNLTVLSISTAFALMSFLTSQLEITMWLDVFILLPLIIWGLHRLMDERKRWLYFVSLLIL    193

Query:   194 FIQNYYFGFMTAIFTSLYFIVQITRNTDSKVAFKQFLHFTFLSLLAGMTSSIMILPTYFD    253
             FIQNYYFGFM AIF  LYF    + R T  K ++ + L F   S LAG+ S IM+LP Y D
Sbjct:   194 FIQNYYFGFMVAIFLVLYF---LARMTYEKWSWTKVLDFVVSSTLAGIASLIMLLPMYLD    250

Query:   254 L-TTHGEKLTKVSKMFTENS                                           272
             L + + + L+ +S +FTENS
Sbjct:   251 LKSNNSDALSTLSGIFTENS                                           270
```

A related DNA sequence was identified in *S. pyogenes* <SEQ ID 5093> which encodes the amino acid sequence <SEQ ID 5094>. Analysis of this protein sequence reveals the following:

```
Possible site: 51
>>> Seems to have an uncleavable N-term signal seq
    INTEGRAL    Likelihood = -9.29    Transmembrane    15-31  (6-35)
    INTEGRAL    Likelihood = -8.81    Transmembrane   201-217 (196-220)
    INTEGRAL    Likelihood = -6.79    Transmembrane   410-426 (402-428)
    INTEGRAL    Likelihood = -6.05    Transmembrane   230-246 (227-252)
    INTEGRAL    Likelihood = -5.57    Transmembrane   161-177 (153-178)
    INTEGRAL    Likelihood = -4.46    Transmembrane   291-307 (290-311)
    INTEGRAL    Likelihood = -3.82    Transmembrane   133-149 (130-151)
    INTEGRAL    Likelihood = -3.77    Transmembrane   380-396 (376-400)
    INTEGRAL    Likelihood = -3.61    Transmembrane   105-121 (103-124)
    INTEGRAL    Likelihood = -3.45    Transmembrane   832-848 (830-848)
    INTEGRAL    Likelihood = -2.66    Transmembrane   436-452 (435-453)
    INTEGRAL    Likelihood = -2.13    Transmembrane   318-334 (314-336)
    INTEGRAL    Likelihood = -1.54    Transmembrane   356-372 (355-372)
    INTEGRAL    Likelihood = -0.27    Transmembrane    80-96  (80-96)

----- Final Results -----
            bacterial membrane  --- Certainty = 0.4715(Affirmative) < succ>
            bacterial outside   --- Certainty = 0.0000(Not Clear)   < succ>
            bacterial cytoplasm --- Certainty = 0.0000(Not Clear)   < succ>
```

The protein has homology with the following sequences in the databases:

```
>GP: AAC14608 GB: U95840 transmembrane protein Tmp5 [Lactococcus lactis]
Identities = 134/269 (49%), Positives = 183/269 (67%), Gaps = 8/269 (2%)

Query:   5 NKWIIAGLASFLFPLSIIFIILLSMGIYYNSDKTILASDAFHQYVIFAQNFRNIMH--GS  62
           NKW + LASF PL ++ I+L   GIY+ S ++ILA DA+HQYV    +RNI+H  GS
Sbjct:   7 NKWAL--LASFFIPLILMVIVLAMTGIYWGSSRSILAGDAYHQYVAIHSLYRNILHSGGS  64

Query:  63 DSFFYTFTSGLGINFYALMCYYLGSFFSPLLFFFNLTSMPDAIYLFTLIKFGLIGLAACY 122
             F YTFTSGLG+N YA   YY+GSF  P   FFF++ SMPDA+YLFT+IKFGLIGL++
Sbjct:  65 QGFLYTFTSGLGLNLYAFSAYYMGSFLMPFTFFFDVKSMPDALYLFTIIKFGLIGLSSFV 124

Query: 123 SFHRLYPKISAFLMISISVFYSLMSFLTSQMELNSWLDVFILLPLVILGLNKLITENKTR 182
           SF  +Y K+S    ++SIS ++LMSFLTSQ+E+   WLDVFILLPL+I GL++L+ E K
Sbjct: 125 SFKNMYQKLSNLTVLSISTAFALMSFLTSQLEITMWLDVFILLPLIIWGLHRLMDERKRW 184

Query: 183 TYYLSISLLFIQNYYFGYMIALFCILYALVCLLRLNDFNKMFIAFVRFTAVSICAALTSA 242
            Y++S++ LFIQNYYFG+M+A+F +LY L   R+      +  F   S A + S
Sbjct: 185 LYFVSLLILFIQNYYFGFMVAIFLVLYFLA---RMTYEKWSWTKVLDFVVSSTLAGIASL 241

Query: 243 LVILPTYLDL-STYGENLSPIKQLVTNNA                                270
           +++LP YLDL S    + LS +  + T N+
Sbjct: 242 IMLLPMYLDLKSNNSDALSTLSGIFTENS                                270
```

An alignment of the GAS and GBS proteins is shown below.

```
Identities = 432/836 (51%), Positives = 569/836 (67%), Gaps = 2/836 (0%)

Query:   16 SFLLPFIIIVCILFTKNIYWGSPTTILASDGFHQYVIFNQALRNILHGSNSLFYTFTSGL   75
            SFL P  II  IL +  IY+ S TILASD FHQYVIF Q  RNI+HGS+S FYTFTSGL
Sbjct:   14 SFLFPLSIIFIILLSMGIYYNSDKTILASDAFHQYVIFAQNFRNIMHGSDSFFYTFTSGL   73

Query:   76 GLNFYALSSYYLGSFLSPIVYFFNLKNMPDAIYLLTICKIGLIGLSMFVTLCKRHCKVNR  135
            G+NFYAL   YYLGSF SP+++FFNL +MPDAIYL T+ K GLIGL+  +  + + K++
Sbjct:   74 GINFYALMCYYLGSFFSPLLFFFNLTSMPDAIYLFTLIKFGLIGLAACYSFHRLYPKISA  133

Query:  136 VLLLVISTCYSLMSFSISQIEINMWLDVFILIPLVVLGVDQLLWERKPILYFLSLTALFI  195
             L++ IS  YSLMSF SQ+E+N WLDVFIL+PLV+LG+++L+ E K   Y+LS++ LFI
Sbjct:  134 FLMISISVFYSLMSFLTSQMELNSWLDVFILLPLVILGLNKLITENKTRTYYLSISLLFI  193

Query:  196 QNYYFGFMTAIFTSLYFIVQITRNTDSKVAFKQFLHFTFLSLLAGMTSSIMILPTYFDLT  255
            QNYYFG+M A+F  LY +V + R D    F  F+ FT +S+ A +TS+++ILPTY DL+
Sbjct:  194 QNYYFGYMIALFCILYALVCLLRLNDFNKMFIAFVRFTAVSICAALTSALVILPTYLDLS  253

Query:  256 THGEKLTKVSKMFTENSWYMDLFAKNMIGAYDTTKFGSIPMIYVGLLPLLLSLLYFTIKE  315
            T+GE L+ + ++ T N+W++D+ AK  IG YDTTKF ++PMIYVGL PL+LS++YFT++
Sbjct:  254 TYGENLSPIKQLVTNNAWFLDIPAKLSIGVYDTTKFNALPMIYVGLFPLMLSVIYFTLES  313

Query:  316 VPRRTRLAYGFLIIFVIASFYITPLDLFWQGMHAPNMFLHRYSWVLSVLICLLAAECLEY  375
            +P + +LA   L+ F+I SFY+ PLDLFWQGMH+PNMFLHRY+W  S++I LLA E L
Sbjct:  314 IPLKIKLANACLLTFIIISFYLQPLDLFWQGMHSPNMFLHRYAWSFSIVILLLACETLSR  373

Query:  376 LDNISWKKILGVNLILVSGFIITFLFKKHYHYLNLELLLLTLTFLSAYIILTISFVSKQI  435
            L  ++  K    + L+    + + F + Y++L L L LL++  L  Y I    SF + QI
Sbjct:  374 LKEVTQIKAGFAFIFLIILTSLPYSFSQQYNFLPLTLFLLSVFLLLGYTISLFSFRNSQI  433

Query:  436 PKLVFYPFLIGFVVLEMTLNTFYQLNSLNDEWIFPSRQGYAKYNHSISKLVRKTERNNST  495
            P         F++  F +LE  LNT+YQL  +N EW FPSRQ Y    I+  LV    +N+
Sbjct:  434 PSTFISAFILIFSLLESGLNTYYQLQGINKEWGFPSRQIYNSQLKDINNLVNSVSKNSQP  493

Query:  496 FFRTERWLGQTGNDSNKYNYNGISQFSSIRNRSSSQVLDRLGFKSDGTNLNLRYQNNTLI  555
            FFR ER L QTGNDSMK+NY GISQFSS+RNR SS +LDRLGF+S GTNLNLRYQNNT+I
Sbjct:  494 FFRMERLLPQTGNDSMKFNYYGISQFSSVRNRLSSSLLDRLGFQSKGTNLNLRYQNNTII  553

Query:  556 ADSLFGVKYNLTEYPFDKFGFIKKAQDKQTILYKNQFASQLAILTNQVYQDKPFTVNTLD  615
             DSL G+KYNL+E P +KFGF K     T LY+N ++S LAILT  VY+D    VNTLD
Sbjct:  554 MDSLLGIKYNLSEGPPNKFGFTKLKTSGNTTLYQNHYSSPLAILTRNVYKDVNLNVNTLD  613

Query:  616 NQTTLLNQLSGLKETYFEHLIPNSVSGQTTLNKQVFVK-KNKQGNTEITYNITIPKNSQL  674
            NQT LLNQLSG   TYF     +SG    N Q+  +  + Q +  + Y I IPK+SQL
Sbjct:  614 NQTKLLNQLSGKSLTYFNLQPAQLISGANQFNGQISAQASDYQNSVTLNYQINIPKHSQL  673

Query:  675 YVSMPFINFNNEENKIVQISVNNGPFVPNTLDNAYSFFNIGSFAENSRIKVKFQFPHNDQ  734
            YVS+P I F+N + K ++I +N F+ T DNAYSFF++G FA+      F FP N Q
Sbjct:  674 YVSIPNIIFSNPDAKEMRIQTDNHNFI-YTTDNAYSFFDLGYFADAKVATFSFVFPKNKQ  732

Query:  735 VSFPIPHFYGLKLEAYQKAMTVINKRKVKVRTDHNKVIANYTSPNRSSLFFTIPYDRGWK  794
            +SF  PHFY L +E+Y +AM  I ++ V    N VI +Y S  + SL FT+PYD GW
Sbjct:  733 ISFKEPHFYSLSIESYLEAMNSIKQKNVHTYAKSNTVITDYNSKTKGSLIFTLPYDKGWS  792

Query:  795 AYQNNKEIKIFKAQKGFMKINIPKGKGKVTLIFIPYGFKFGVGLSITGIVLFTVYY      850
            A ++ K + + KAQ GF+ + IPKGKG+V L FIP GFK G+ LS  GI+ + +Y
Sbjct:  793 AQKDGKNLPVKKAQGGFLSVTIPKGKGRVILTFIPNGFKLGLSLSCVGIIAYMLLY      848
```

Based on this analysis, it was predicted that these proteins and their epitopes could be useful antigens for vaccines or diagnostics.

EXAMPLE 1646

A DNA sequence (GBSx1741) was identified in *S. agalactiae* <SEQ ID 5095> which encodes the amino acid sequence <SEQ ID 5096>. Analysis of this protein sequence reveals the following:

```
Possible site: 50
>>> Seems to have no N-terminal signal sequence

----- Final Results -----
             bacterial cytoplasm --- Certainty = 0.4624(Affirmative) < succ>
              bacterial membrane --- Certainty = 0.0000(Not Clear)   < succ>
               bacterial outside --- Certainty = 0.0000(Not Clear)   < succ>
```

The protein has homology with the following sequences in the GENPEPT database.

```
>GP: AAC45340 GB: AE000658 ORF1 [Streptococcus pneumoniae]
Identities = 111/159 (69%), Positives = 136/159 (84%)

Query:   1 MKLKIITVGKLKEKYLKEGVAEYQKRLNRFSKIETIELADEKTPDKASISENQRILDIEG   60
           MK+K++TVGKLKEKYLK+G+AEY KR++RF+K E IEL+DEKTPDKAS SENQ+IL+IEG
Sbjct:   1 MKIKVVTVGKLKEKYLKDGIAEYSKRISRFAKFEMIELSDEKTPDKASESENQKILEIEG   60

Query:  61 ERILSKIGERDYVIGLAIEGKQLPSESFSHLIDQKMISGYSTITFVIGGSLGLSQKVKKR  120
           +RILSKI +RD+VI LAIEGK   SE FS   +++  I G+ST+TF+IGGSLGLS  VK R
Sbjct:  61 QRILSKIADRDFVIVLAIEGKTFFSEEFSKQLEETSIKGFSTLTFIIGGSLGLSSSVKNR  120

Query: 121 ADYLMSFGLLTLPHQLMKLVLMEQIYRAFMIRQGTPYHK                      159
           A+  +SFG LTLPHQLM+LVL+EQIYRAF I+QG PYHK
Sbjct: 121 ANLSVSFGRLTLPHQLMRLVLVEQIYRAFTIQQGFPYHK                      159
```

A related DNA sequence was identified in *S. pyogenes* <SEQ ID 5097> which encodes the amino acid sequence <SEQ ID 5098>. Analysis of this protein sequence reveals the following:

```
Possible site: 50
>>> Seems to have no N-terminal signal sequence

----- Final Results -----
             bacterial cytoplasm --- Certainty = 0.4462(Affirmative) < succ>
              bacterial membrane --- Certainty = 0.0000(Not Clear)   < succ>
               bacterial outside --- Certainty = 0.0000(Not Clear)   < succ>
```

An alignment of the GAS and GBS proteins is shown below.

```
Identities = 112/159 (70%), Positives = 133/159 (83%)

Query:   1 MKLKIITVGKLKEKYLKEGVAEYQKRLNRFSKIETIELADEKTPDKASISENQRILDIEG   60
           MK+K+I VGKLKE+YLK+G++EYQKRL+RF + E IEL DE+TPDKAS ++NQ I+  E
Sbjct:   1 MKVKLICVGKLKERYLKDGISEYQKRLSRFCQFEMIELTDERTPDKASFADNQLIMSKEA   60

Query:  61 ERILSKIGERDYVIGLAIEGKQLPSESFSHLIDQKMISGYSTITFVIGGSLGLSQKVKKR  120
           +RI  KIGERD+VI LAIEGKQ PSE+FS LI   +  GYSTITF+IGGSLGL   +KKR
Sbjct:  61 QRIHKKIGERDFVIALAIEGKQFPSETFSELISGVTVKGYSTITFIIGGSLGLDSIIKKR  120

Query: 121 ADYLMSFGLLTLPHQLMKLVLMEQIYRAFMIRQGTPYHK                      159
           A+ LMSFGLLTLPHQLM+LVL EQIYRAFMI QG+PYHK
Sbjct: 121 ANMLMSFGLLTLPHQLMRLVLTEQIYRAFMITQGSPYHK                      159
```

Based on this analysis, it was predicted that these proteins and their epitopes could be useful antigens for vaccines or diagnostics.

EXAMPLE 1647

A DNA sequence (GBSx1742) was identified in *S. agalactiae* <SEQ ID 5099> which encodes the amino acid sequence <SEQ ID 5100>. Analysis of this protein sequence reveals the following:

```
Possible site: 24
>>> Seems to have no N-terminal signal sequence

----- Final Results -----
            bacterial cytoplasm --- Certainty = 0.3785(Affirmative) < succ>
            bacterial membrane  --- Certainty = 0.0000(Not Clear)   < succ>
             bacterial outside  --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1648

A DNA sequence (GBSx1743) was identified in *S. agalactiae* <SEQ ID 5101> which encodes the amino acid sequence <SEQ ID 5102>. This protein is predicted to be a serine protease. Analysis of this protein sequence reveals the following:

```
Possible site: 29
>>> Seems to have no N-terminal signal sequence

----- Final Results -----
            bacterial cytoplasm --- Certainty = 0.4533(Affirmative) < succ>
            bacterial membrane  --- Certainty = 0.0000(Not Clear)   < succ>
             bacterial outside  --- Certainty = 0.0000(Not Clear)   < succ>
```

A related GBS nucleic acid sequence <SEQ ID 9445> which encodes amino acid sequence <SEQ ID 9446> was also identified.

The protein has homology with the following sequences in the GENPEPT database.

```
>GP: AAC45334 GB: AF000658 putative serine protease
[Streptococcus pneumoniae]
Identities = 215/370 (58%), Positives = 278/370 (75%), Gaps = 20/370 (5%)

Query:   4 NDNIPNGGVTKTSKVNYNNITPTTKAVKKVQNSVVSVINYKQQESRSDLSDFYSHFFGNQ    63
           N++ N +T+T+    Y N   TT+AV KV+++VVSVI Y     S          FGN
Sbjct:  46 NNSNNNSTITQTA---YKNENSTTQAVNKVKDAVVSVITYSANRQNS--------VFGND   94

Query:  64 GGNTDKGLQVYGEGSGVIYKKDGKNAYVVTNNHVIDGAKQIEIQLADGSKAVGKLVGSDT   123
            +TD    ++  EGSGVIYKK+ K AY+VTNNHVI+GA +++I+L+DG+K  G++VG+DT
Sbjct:  95 DTDTDSQ-RISSEGSGVIYKKNDKEAYIVTNNHVINGASKVDIRLSDGTKVPGEIVGADT  153

Query: 124 YSDLAVVKIPSDKVSNIAEFADSSKLNIGETAIAIGSPLGTEYANSVTQGIVSSLKRTVT   183
           +SD+AVVKI S+KV+ +AEF DSSKL +GETAIAIGSPLG+EYAN+VTQGIVSSL R V+
Sbjct: 154 FSDIAVVKISSEKVTTVAEFGDSSKLTVGETAIAIGSPLGSEYANTVTQGIVSSLNRNVS   213

Query: 184 MTNEEGQTVSTNAIQTDAAINPGNSGGALINIEGQVIGINSSKISSTSNQTSGQSSGNSV   243
            + +E+GQ +ST AIQTD AINPGNSGG LINI+GQVIGI SSKI++         + G SV
Sbjct: 214 LKSEDGQAISTKAIQTDTAINPGNSGGPLINIQGQVIGITSSKIAT--------NGGTSV   265

Query: 244 EGMGFAIPSNDVVKIINQLESNGQVERPALGISMAGLSNLPSDVISKLKIPSNVTNGIVV   303
           EG+GFAIP+ND +  II QLE NG+V RPALGI M  LSN+ +    I +L IPSNVT+G++V
```

-continued
```
Sbjct: 266 EGLGFAIPANDAINIIEQLEKNGKVTRPALGIQMVNLSNVSTSDIRRLNIPSNVTSGVIV 325

Query: 304 ASIQSGMPAQGKLKKYDVITKVDDKEVVSPSDLQSLLYGHQVGDSITVTFYRGENKQTVT 363
            S+QS MPA G L+KYDVITKVDDKE+ S +DLQS LY H +GD+I +T+YR   ++T +
Sbjct: 326 RSVQSNMPANGHLEKYDVITKVDDKEIASSTDLQSALYNHSIGDTIKITYYRNGKEETTS 385

Query: 364 IKLTKTSKDL                                                  373
            IKL K+S DL
Sbjct: 386 IKLNKSSGDL                                                  395
```

A related DNA sequence was identified in *S. pyogenes* <SEQ ID 5103> which encodes the amino acid sequence <SEQ ID 5104>. Analysis of this protein sequence reveals the following:

```
Possible site: 24
>>> Seems to have an uncleavable N-term signal seq
    INTEGRAL     Likelihood = -8.76     Transmembrane     11-27 (6-31)

----- Final Results -----
              bacterial membrane --- Certainty = 0.4503(Affirmative) < succ>
                bacterial outside --- Certainty = 0.0000(Not Clear)   < succ>
              bacterial cytoplasm --- Certainty = 0.0000(Not Clear)   < succ>
```

An alignment of the GAS and GBS proteins is shown below.

```
Identities = 250/375 (66%), Positives = 299/375 (79%), Gaps = 5/375 (1%)

Query:   3 HNDNIPNGGVTKTSKVNYNNITPTTKAVKKVQNSVVSVINYKQQESRSDLSDFYSHFFGN   62
           H+ +  N G   TS + +NN T TTKAVK VQN+VVSVINY+   S S LS+ Y+  FG
Sbjct:  34 HSPSKINSGKATTSNMVFNNTTNTTKAVKAVQNAVVSVINYQDNPS-SSLSNPYTKLFGE   92

Query:  63 QGG--NTDKGLQVYGEGSGVIYKKDGKNAYVVTNNHVIDGAKQIEIQLADGSKAVGKLVG  120
              N D  L ++ EGSGVIY+KDG +AYVVTNNHVIDGAK+IEI +ADGSK VG+LVG
Sbjct:  93 GRSKENKDAELSIFSEGSGVIYRKDGNSAYVVTNNHVIDGAKRIEILMADGSKVVGELVG  152

Query: 121 SDTYSDLAVVKIPSDKVSNIAEFADSSKLNIGETAIAIGSPLGTEYANSVTQGIVSSLKR  180
           +DTYSDLAVVKI SDK+   +AEFADS+KLN+GE AIAIGSPLGT+YANSVTQGIVSSL R
Sbjct: 153 ADTYSDLAVVKISSDKIKTVAEFADSTKLNVGEVAIAIGSPLGTQYANSVTQGIVSSLSR  212

Query: 181 TVTMTNEEGQTVSTNAIQTDAAINPGNSGGALINIEGQVIGINSSKISSTSNQTSGQSSG  240
           TVT+ NE G+TVSTNAIQTDAAINPGNSGG LINIEGQVIGINSSKISST    ++G S
Sbjct: 213 TVTLKNENGETVSTNAIQTDAAINPGNSGGPLINIEGQVIGINSSKISSTPTGSNGNS--  270

Query: 241 NSVEGMGFAIPSNDVVKIINQLESNGQVERPALGISMAGLSNLPSDVISKLKIPSNVTNG  300
             +VEG+GFAIPS DV+KII QLE+NG+V RPALGISM  L++L ++ +S++ IP++VT G
Sbjct: 271 GAVEGIGFAIPSTDVIKIIKQLETNGEVIRPALGISMVNLNDLSTNALSQINIPTSVGG   330

Query: 301 IVVASIQSGMPAQGKLKKYDVITKVDDKEVVSPSDLQSLLYGHQVGDSITVTFYRGENKQ  360
           IVVA ++ GMPA GKL +YDVIT++D K V S SDLQS LYGH + D+I VTFYRG  K+
Sbjct: 331 IVVAEVKEGMPASGKLAQYDVITEIDGKTVNSISDLQSSLYGHDINDTIKVTFYRGTTKK  390

Query: 361 TVTIKLTKTSKDLAK                                             375
              IKLTKT++DL K
Sbjct: 391 KADIKLTKTTQDLTK                                             405
```

A related GBS gene <SEQ ID 8873> and protein <SEQ ID 8874> were also identified. Analysis of this protein sequence reveals the following:

```
Lipop: Possible site: -1 Crend: 10
McG: Discrim Score: 12.68
GvH: Signal Score (-7.5): -1.33
Possible site: 21
>>> Seems to have a cleavable N-term signal seq.
ALOM program count: 0 value: 4.56 threshold: 0.0
    PERIPHERAL Likelihood = 4.56       301
modified ALOM score: -1.41

*** Reasoning Step: 3

----- Final Results -----
              bacterial outside --- Certainty = 0.3000 (Affirmative) < succ>
```

```
                       bacterial membrane --- Certainty = 0.0000 (Not Clear) < succ>
                      bacterial cytoplasm --- Certainty = 0.0000 (Not Clear) < succ>
```

The protein has homology with the following sequences in the databases:

```
57.4/75.6% over 386aa
Streptococcus pneumoniae
GP|2109443|putative serine protease Insert characterized
ORF02135(307-1506 of 1827)
GP|2109443|gb|AAC45334.1||AF000658(9-395 of 397) putative serine protease
{Streptococcus pneumoniae}
% Match = 34.6
% Identity = 57.3   % Similarity = 75.6
Matches = 223   Mismatches = 89   Conservative   Sub.s = 71
     228       258       288       318       348       378       399       429
RLSTSCGYFLFLAFKV*LRSLS*D*YKNLRR*LFVKKKLVSSLLKCSLIIIVSFAGGAFASFVMNH---NDNIPNGGVTK
                                   :     :    |  :      : :    ::|::|    ||: ||   : :        :: |
                                  MEANMKHLKTFYKKWFQLLVVIVISFFSGALGSFSITQLTQKSSVNNSNNNS
                                           10        20        30        40        50
     456       486       516       546       576       606       636       666
T-SKVNYNNITPTTKAVKKVQNSVVSVINYKQQESRSDLSDFYSHFFGNQGGNTDKGLQVYGEGSGVIYKKDGKNAYVVT
| :::   ||      ||:||  ||:::|||||| |          |      ||  :||     ::   ||||||||: |  ||:||
TITQTAYKNENSTTQAVNKVKDAVVSVITYSANRQNS--------VFGNDDTDTDS-QRISSEGSGVIYKKNDKEAYIVT
             70        80        90       100       110       120
     696       726       756       786       816       846       876       906
NNHVIDGAKQIEIQLADGSKAVGKLVGSDTYSDLAVVKIPSDKVSNIAEFADSSKLNIGETAIAIGSPLGTEYANSVTQG
||||||:|||   :::|:|:|:|:|    |::|||:||:|||||||   ::|||||||||||:|||||||||||: ||||
NNHVINGASKVDIRLSDGTKVPGEIVGADTFSDIAVVKISSEKVTTVAEFGDSSKLTVGETAIAIGSPLGSEYANTVTQG
            140       150       160       170       180       190       200
     936       966       996      1026      1056      1086      1116      1146
IVSSLKRTVTMTNEEGQTVSTNAIQTDAAINPGNSGGALINIEGQVIGINSSKISSTSNQTSGQSSGNSVEGMGFAIPSN
|||||  |  |:: :|:|   :||  |||||  ||||||||||     :|         |:|      |  | |||||:||||:
IVSSLNRNVSLKSEDGQAISTKAIQTDTAINPGNSGGPLINIQGQVIGITSSKIA-----TNG---GTSVEGLGFAIPAN
            220       230       240       250       260       270
    1176      1206      1236      1266      1296      1326      1356      1386
DVVKIINQLESNGQVERPALGISMAGLSNLPSDVISKLKIPSNVTNGIVVASIQSGMPAQGKLKKYDVITKVDDKEVVSP
| :  ||  ||||:|  ||||||     |||     :  :|   |||||||  ::|    ||| :  |:|   ||||||||||: |
DAINIIEQLEKNGKVTRPALGIQMVNLSNVSTSDIRRLNIPSNVTSGVIVRSVQSNMPANGHLEKYDVITKVDDKEIASS
            290       300       310       320       330       340       350
    1416      1446      1476      1506      1536      1566      1596      1626
SDLQSLLYGHQVGDSITVTFYRGENKQTVTIKLTKTSKDLAKQRANN*INSSYFN*DIVKLKGLVR*TNPFSKSIESEV*
:||||  ||  |   ::||:|    :|:||        ::|   :|||  |:|
TDLQSALYNHSIGDTIKITYYRNGKEETTSIKLNKSSGDLES
            370       380       390
```

Based on this analysis, it was predicted that these proteins and their epitopes could be useful antigens for vaccines or diagnostics.

EXAMPLE 1649

A DNA sequence (GBSx1744) was identified in *S. agalactiae* <SEQ ID 5105> which encodes the amino acid sequence <SEQ ID 5106>. This protein is predicted to be SPSpoJ (spo0J). Analysis of this protein sequence reveals the following:

```
Possible site: 53

>>> Seems to have no N-terminal signal sequence

----- Final Results -----
                    bacterial cytoplasm --- Certainty = 0.4152 (Affirmative) < succ>
                    bacterial membrane  --- Certainty = 0.0000 (Not Clear)   < succ>
                    bacterial outside   --- Certainty = 0.0000 (Not Clear)   < succ>
```

The protein has homology with the following sequences in the GENPEPT database.

```
>GP:AAC45335 GB:AF000658 SPSpoJ [Streptococcus pneumoniae]
Identities = 138/257 (53%), Positives = 188/257 (72%), Gaps = 5/257 (1%)

Query:    1  MEYLETININHIAPNPYQPRLEFNTKELEELANSIKINGLIQPIIVRPSAVFGYELVAGE    60
             ME  E I+I  I  NPYQPR EF+ ++L+ELA SIK NG+IQPIIVR S V GYE++AGE
Sbjct:    1  MEKFEMISITDIQKNPYQPRKEFDREKLDELAQSIKENGVIQPIIVRQSPVIGYEILAGE    60

Query:   61  RRLRAAKLAKLESIPAIIKSYNNDDSMQLAIVENLQRSNLSPIEEAKAYSQLLQKKSMTH   120
             RR RA+ LA L SIPA++K  ++ + M  +I+ENLQR NL+PIEEA+AY  L++ K  TH
Sbjct:   61  RRYRASLLAGLRSIPAVVKQISDQEMMVQSIIENLQRENLNPIEEARAYVSLVE-KGFTH   119

Query:  121  EELAKYMGKSRPYISNTIRLLNLPPLITSAIEEGKLSSGHARALLSLPDASQQKDWYQRI   180
              E+A    GKSRPYISN+IRLL+LP  I S +E GKLS  HAR+L+ L +  QQ  ++QRI
Sbjct:  120  AEIADKEGKSRPYISNSIRLLSLPEQILSEVENGKLSQAHARSLVGL-NKEQQDYFFQRI   178

Query:  181  LTEDISVRRLEKLLKQEKKTNHKSLQNKDVFLKHQENELAQFLGSKVKLTINKDGAGNIK   240
             + EDISVR+LE LL ++K+    K Q  + F++++E +L + LG V++ ++K  +G I
Sbjct:  179  IEEDISVRKLEALLTEKKQ---KKQQKTNHFIQNEEKQLRKLLGLDVEIKLSKKDSGKII   235

Query:  241  IAFANQEELNRIINTLK                                             257
             I+F+NQEE +RIIN+LK
Sbjct:  236  ISFSNQEEYSRIINSLK                                             252
```

A related DNA sequence was identified in *S. pyogenes* <SEQ ID 5107> which encodes the amino acid sequence <SEQ ID 5108>. Analysis of this protein sequence reveals the following:

```
Possible site: 51
>>> Seems to have no N-terminal signal sequence

----- Final Results -----
            bacterial cytoplasm --- Certainty = 0.1758 (Affirmative) < succ>
            bacterial membrane  --- Certainty = 0.0000 (Not Clear)  < succ>
             bacterial outside  --- Certainty = 0.0000 (Not Clear)  < succ>
```

An alignment of the GAS and GBS proteins is shown below.

```
Identities = 146/256 (57%), Positives = 191/256 (74%), Gaps = 1/256 (0%)

Query:    2  EYLETININHIAPNPYQPRLEFNTKELEELANSIKINGLIQPIIVRPSAVFGYELVAGER    61
             E L  + I  I  NPYQPR++FN +EL++LA SIK NGLIQPIIVR S +FGYELVAGER
Sbjct:   14  ELLIDLPIEDIVTNPYQPRIQFNQRELQDLATSIKSNGLIQPIIVRKSDIFGYELVAGER    73

Query:   62  RLRAAKLAKLESIPAIIKSYNNDDSMQLAIVENLQRSNLSPIEEAKAYSQLLQKKSMTHE   121
             RL+A+K+A L+ +PAIIK   + +SMQ AIVENLQRSNL+ IEEAKAY L++KK MTH+
Sbjct:   74  RLKASKMAGLKKVPAIIKKISTLESMQQAIVENLQRSNLNAIEEAKAYQLLVEKKHMTHD   133

Query:  122  ELAKYMGKSRPYISNTIRLLNLPPLITSAIEEGKLSSGHARALLSLPDASQQKDWYQRIL   181
             E+AKYMGKSRPYISNT+RLL LP  I    AIEEGK+S+GHARALL+L D  QQ     +I
Sbjct:  134  EIAKYMGKSRPYISNTLRLLQLPAPIIKAIEEGKISAGHARALLTLSDDKQQLYLTHKIQ   193

Query:  182  TEDISVRRLEKLLKQEKKTNHKSLQNKDVFLKHQENELAQFLGSKVKLTINKDGAGNIKI   241
              E +SVR++E+L+     ++ S + K++F    E +LA+ LG V + +  +G ++I
Sbjct:  194  NEGLSVRQIEQLV-TSTPSSKLSKKTKNIFATSLEKQLAKSLGLSVNMKLTANHSGYLQI   252

Query:  242  AFANQEELNRIINTLK                                              257
             +F+N +ELNRIIN LK
Sbjct:  253  SFSNDDELNRIINKLK                                              268
```

Based on this analysis, it was predicted that these proteins and their epitopes could be useful antigens for vaccines or diagnostics.

EXAMPLE 1650

A DNA sequence (GBSx1745) was identified in *S. agalactiae* <SEQ ID 5109> which encodes the amino acid sequence <SEQ ID 5110>. Analysis of this protein sequence reveals the following:

```
Possible site: 54
>>> Seems to have no N-terminal signal sequence
    INTEGRAL    Likelihood = -0.37    Transmembrane    2-18 (1-18)

----- Final Results -----
            bacterial membrane --- Certainty = 0.1150 (Affirmative) < succ>
              bacterial outside --- Certainty = 0.0000 (Not Clear)  < succ>
            bacterial cytoplasm --- Certainty = 0.0000 (Not Clear)  < succ>
```

A related GBS nucleic acid sequence <SEQ ID 10297> which encodes amino acid sequence <SEQ ID 10298> was also identified.

A related DNA sequence was identified in *S. pyogenes* <SEQ ID 5111> which encodes the amino acid sequence <SEQ ID 5112>. Analysis of this protein sequence reveals the following:

```
Possible site: 23
>>> Seems to have no N-terminal signal sequence

----- Final Results -----
            bacterial cytoplasm --- Certainty = 0.3646 (Affirmative) < succ>
             bacterial membrane --- Certainty = 0.0000 (Not Clear)   < succ>
              bacterial outside --- Certainty = 0.0000 (Not Clear)   < succ>
```

An alignment of the GAS and GBS proteins is shown below.

```
Identities = 353/455 (77%), Positives = 401/455 (87%), Gaps = 6/455 (1%)

Query:   32 MTENEQLFWNRVLELSRSQIAPAAYEFFVLEARLLKIEHQTAVITLDNIEMKKLFWEQNL   91
            MTENEQ+FWNRVLEL++SQ+  A YEFFV +ARLLK++   A I LD  +MK+LFWE+NL
Sbjct:    1 MTENEQIFWNRVLELAQSQLKQATYEFFVHDARLLKVDKHIATIYLD--QMKELFWEKNL   58

Query:   92 GPVILTAGFEIFNAEITANYV-SNDLHLQETSFS-NYQQSSNEVNTLPIRKIDSNLKEKY  149
               VILTAGFE++NA+I+ +YV   DL +++    N +    +N+LP   + S+L  KY
Sbjct:   59 KDVILTAGFEVYNAQISVDYVFEEDLMIEQNQTKINQKPKQQALNSLPT--VTSDLNSKY  116

Query:  150 TFANFVQGDENRWAVSASIAVADSPGTTYNPLFIWGGPGLGKTHLLNAIGNQVLRDNPNA  209
            +F NF+QGDENRWAV+ASIAVA++PGTTYNPLFIWGGPGLGKTHLLNAIGN VL +NPNA
Sbjct:  117 SFENFIQGDENRWAVAASIAVANTPGTTYNPLFIWGGPGLGKTHLLNAIGNSVLLENPNA  176

Query:  210 RVLYITAENFINEFVSHIRLDSMEELKEKFRNLDLLLIDDIQSLAKKTLGGTQEEFFNTF  269
            R+ YITAENFINEFV HIRLD+M+ELKEKFRNLDLLLIDDIQSLAKKTL GTQEEFFNTF
Sbjct:  177 RIKYITAENFINEFVIHIRLDTMDELKEKFRNLDLLLIDDIQSLAKKTLSGTQEEFFNTF  236

Query:  270 NALHTNDKQIVLTSDRNPNQLNDLEERLVTRFSWGLPVNITPPDFETRVAILTNKIQEYP  329
            NALH N+KQIVLTSDR P+ LNDLE+RLVTRF WGL VNITPPDFETRVAILTNKIQEY
Sbjct:  237 NALHNNNKQIVLTSDRTPDHLNDLEDRLVTRFKWGLTVNITPPDFETRVAILTNKIQEYN  296

Query:  330 YDFPQDTIEYLAGEFDSNVRELEGALKNISLVADFKHAKTITVDIAAEAIRARKNDGPIV  389
            + FPQDTIEYLAG+FDSNVR+LEGALK+ISLVA+FK   TITVDIAAEAIRARK DGP +
Sbjct:  297 FIFPQDTIEYLAGQFDSNVRDLEGALKDISLVANFKQIDTITVDIAAEAIRARKQDGPKM  356

Query:  390 TVIPIEEIQIQVGKFYGVTVKEIKATKRTQDIVLARQVAMYLAREMTDNSLPKIGKEFGG  449
            TVIPIEEIQ QVGKFYGVTVKEIKATKRTQ+IVLARQVAM+LAREMTDNSLPKIGKEFGG
Sbjct:  357 TVIPIEEIQAQVGKFYGVTVKEIKATKRTQNIVLARQVAMFLAREMTDNSLPKIGKEFGG  416

Query:  450 RDHSTVLHAYNKIKNMVAQDDNLRIEIETIKNKIR                           484
            RDHSTVLHAYNKIKNM++QD++LRIEIETIKNKI+
Sbjct:  417 RDHSTVLHAYNKIKNMISQDESLRIEIETIKNKIK                           451
```

Based on this analysis, it was predicted that these proteins and their epitopes could be useful antigens for vaccines or diagnostics.

EXAMPLE 1651

A DNA sequence (GBSx1746) was identified in *S. agalactiae* <SEQ ID 5113> which encodes the amino acid sequence <SEQ ID 5114>. Analysis of this protein sequence reveals the following:

```
Possible site: 14
>>> Seems to have no N-terminal signal sequence

----- Final Results -----
              bacterial cytoplasm --- Certainty = 0.0556 (Affirmative) < succ>
              bacterial membrane  --- Certainty = 0.0000 (Not Clear)   < succ>
               bacterial outside  --- Certainty = 0.0000 (Not Clear)   < succ>
```

The protein has homology with the following sequences in the GENPEPT database.

```
>GP:AAC45337 GB:AF000658 beta subunit of DNA polymerase III
[Streptococcus pneumoniae]
Identities = 278/378 (73%), Positives = 324/378 (85%)

Query:    1 MIHFSINKNFFLHALTVTKRAISHKNAIPILSTVKIEVTRDAIILTGSNGQISIENTIPA   60
            MIHFSINKN FL AL +TKRAIS KNAIPILSTVKI+VT + + L GSNGQISIEN I
Sbjct:    1 MIHFSINKNLFLQALNITKRAISSKNAIPILSTVKIDVTNEGVTLIGSNGQISIENFISQ   60

Query:   61 SNENAGLLVTNPGSILLEAGFFINIISSLPDVTLEFTEIEQHQIVLTSGKSEITLKGKDV  120
             NE+AGLL+T+ GSILLEA FFIN++SSLPDVTL+F EIEQ+QIVLTSGKSEITLKGKD
Sbjct:   61 KNEDAGLLITSLGSILLEASFFINVVSSLPDVTLDFKEIEQNQIVLTSGKSEITLKGKDS  120

Query:  121 DQYPRLQEMTTDTPLTLETKLLKSIINETAFAASQQESRPILTGVHLVISQNKYFKAVAT  180
            +QYPR+QE++  TPL LETKLLK IINETAFAAS QESRPILTGVH V+SQ+K  K VAT
Sbjct:  121 EQYPRIQEISASTPLILETKLLKKIINETAFAASTQESRPILTGVHFVLSQHKELKTVAT  180

Query:  181 DSHRMSQRTFQLEKSANNFDLVVPSKSLREFSAVFTDDIETVEVFFSDSQMLFRSENISF  240
            DSHR+SQ+    LEK++++FD+V+PS+SLREFSAVFTDDIETVE+FF+++Q+LFRSENISF
Sbjct:  181 DSHRLSQKKLTLEKNSDDFDVVIPSRSLREFSAVFTDDIETVEIFFANNQILFRSENISF  240

Query:  241 YTRLLEGNYPDTDRLLTNQFETEIIFNTNALRHAMERAYLISNATQNGTVRLEIQNETVS  300
            YTRLLEGNYPDTDRL+   F T I FN   LR +MERA L+S+ATQNGTV+LEI++  VS
Sbjct:  241 YTRLLEGNYPDTDRLIPTDFNTTITFNVVNLRQSMERARLLSSATQNGTVKLEIKDGVVS  300

Query:  301 AHVNSPEVGKVNEELDTVSLKGDSLNISFNPTYLIESLKAVKSETVTIRFISPVRPFTLT  360
            AHV+SPEVGKVNEE+DT  + G+ L ISFNPTYLI+SLKA+ SE VTI FIS VRPFTL
Sbjct:  301 AHVHSPEVGKVNEEIDTDQVTGEDLTISFNPTYLIDSLKALNSEKVTISFISAVRPFTLV  360

Query:  361 PGEDTEDFIQLITPVRTN                                           378
            P +  EDF+QLITPVRTN
Sbjct:  361 PADTDEDFMQLITPVRTN                                           378
```

A related DNA sequence was identified in *S. pyogenes* <SEQ ID 5115> which encodes the amino acid sequence <SEQ ID 5116>. Analysis of this protein sequence reveals the following:

```
Possible site: 14
>>> Seems to have no N-terminal signal sequence
     INTEGRAL     Likelihood = -1.70    Transmembrane    67-83 (67-83)

----- Final Results -----
              bacterial membrane  --- Certainty = 0.1680(Affirmative) < succ>
               bacterial outside  --- Certainty = 0.0000(Not Clear)   < succ>
              bacterial cytoplasm --- Certainty = 0.0000(Not Clear)   < succ>
```

An alignment of the GAS and GBS proteins is shown below.

```
Identities = 295/378 (78%), Positives = 334/378 (88%)

Query:    1 MIHFSINKNFFLHALTVTKRAISHKNAIPILSTVKIEVTRDAIILTGSNGQISIENTIPA   60
            MI FSIN+  F+HAL  TKRAIS KNAIPILS++KIEVT  + LTGSNGQISIENTIP
Sbjct:    1 MIQFSINRTLFIHALNTTKRAISTKNAIPILSSIKIEVTSTGVTLTGSNGQISIENTIPV   60

Query:   61 SNENAGLLVTNPGSILLEAGFFINIISSLPDVTLEFTEIEQHQIVLTSGKSEITLKGKDV  120
            SNENAGLL+T+PG+ILLEA FFINIISSLPD+++    EIEQHQ+VLTSGKSEITLKGKDV
Sbjct:   61 SNENAGLLITSPGAILLEASFFINIISSLPDISINVKEIEQHQVVLTSGKSEITLKGKDV  120

Query:  121 DQYPRLQEMTTDTPLTLETKLLKSIINETAFAASQQESRPILTGVHLVISQNKYFKAVAT  180
            DQYPRLQE++T+ PL L+TKLLKSII ETAFAAS QESRPILTGVH+V+S +K FKAVAT
Sbjct:  121 DQYPRLQEVSTENPLILKTLLKSIIAETAFAASLQESRPILTGVHIVLSNHKDFKAVAT  180

Query:  181 DSHRMSQRTFQLEKSANNFDLVVPSKSLREFSAVFTDDIETVEVFFSDSQMLFRSENISF  240
            DSHRMSQR   L+ ++ +FD+V+PSKSLREFSAVFTDDIETVEVFFS SQ+LFRSE+ISF
Sbjct:  181 DSHRMSQRLITLDNTSADFDVVIPSKSLREFSAVFTDDIETVEVFFSPSQILFRSEHISF  240

Query:  241 YTRLLEGNYPDTDRLLTNQFETEIIFNTNALRHAMERAYLISNATQNGTVRLEIQNETVS  300
            YTRLLEGNYPDTDRLL  +FETE++FNT +LRHAMERA+LISNATQNGTV+LEI    +S
Sbjct:  241 YTRLLEGNYPDTDRLLMTEFETEVVFNTQSLRHAMERAFLISNATQNGTVKLEITQNHIS  300

Query:  301 AHVNSPEVGKVNEELDTVSLKGDSLNISFNPTYLIESLKAVKSETVTIRFISPVRPFTLT  360
            AHVNSPEVGKVNE+LD VS  G  L ISFNPTYLIESLKA+KSETV I F+SPVRPFTLT
Sbjct:  301 AHVNSPEVGKVNEDLDIVSQSGSDLTISFNPTYLIESLKAIKSETVKIHFLSPVRPFTLT  360

Query:  361 PGEDTEDFIQLITPVRTN                                            378
            PG++  E FIQLITPVRTN
Sbjct:  361 PGDEEESFIQLITPVRTN                                            378
```

Based on this analysis, it was predicted that these proteins and their epitopes could be useful antigens for vaccines or diagnostics.

EXAMPLE 1652

A DNA sequence (GBSx1747) was identified in *S. agalactiae* <SEQ ID 5117> which encodes the amino acid sequence <SEQ ID 5118>. Analysis of this protein sequence reveals the following:

```
Possible site: 19
>>> Seems to have no N-terminal signal sequence

----- Final Results -----
            bacterial cytoplasm --- Certainty = 0.0857(Affirmative) < succ>
            bacterial membrane  --- Certainty = 0.0000(Not Clear)   < succ>
             bacterial outside  --- Certainty = 0.0000(Not Clear)   < succ>
```

A related GBS nucleic acid sequence <SEQ ID 10299> which encodes amino acid sequence <SEQ ID 10300> was also identified.

The protein has homology with the following sequences in the GENPEPT database.

```
>GP: AAC00282 GB: AF008220 Ytlr [Bacillus subtilis]
Identities = 83/298 (27%), Positives = 138/298 (45%), Gaps = 35/298 (11%)

Query:   19 YIIANPHAGNKNASTIVGKIQE--LYHTEDISVFYTEQKDDEK--KQVINILRSFKESDH   74
            + I NP AG++N  +   IQ+  +     F TE    + I+ ++ +K
Sbjct:    5 FFIINPTAGHRNGLRVWKSIQKELIKRKVEHRSFLTEHPGHAEVLARQISTIQEYKLK-R   63

Query:   75 LMIIGGDGTLSKVMTYLPQ--HIPCTYYPVGSGNDFARALKIPNL---------KETLTA  123
            L++IGGDGT+ +V+  L    I  ++ P G+ NDF+R   I +           K  LT
Sbjct:   64 LIVIGGDGTMHEVVNGLKDVDDIELSFVPAGAYNDFSRGFSIKKIDLIQEIKKVKRPLT-  122

Query:  124 IQTERLKEINCFIYDKGLIL---NSLDLGFAAYVVWKASNSKIKNILNRYRLGKITYIVI  180
            +T  L +N F+ DK  IL     N + +GF AYV  KA    ++ +     RL  + Y +
Sbjct:  123 -RTFHLGSVN-FLQDKSQILYFMNHIGIGFDAYVNKKAMEFPLRRVFLFLRLRFLVYPL-  179
```

```
-continued
Query: 181 AIKSLLHSSK------VQVLVEGETGQQIKLNDLYFFALANNTYFGGGITIWPKASALTA  234
             S LH+S           + E ET +     +D++F ++N+ ++GGG+    P A+
Sbjct: 180 ---SHLHASATFKPFTLACTTEDETRE---FHDVWFAVVSNHPFYGGGMKAAPLANPREK  233

Query: 235 ELDMVYAKGHTFLKRLSILLSLVFKRHTTSKSIKHQTFKAMTVYFPKNSLIEIDGEIV   292
             D+V +    FLK+ +L + F +HT    +   K +T Y         DGEI+
Sbjct: 234 TFDIVIVENQPFLKKYWLLCLMAFGKHTKMDGVTMFKAKDITFYTKDKIPFHADGEIM   291
```

Based on this analysis, it was predicted that these proteins and their epitopes could be useful antigens for vaccines or diagnostics.

EXAMPLE 1653

A DNA sequence (GBSx1748) was identified in *S. agalactiae* <SEQ ID 5121> which encodes the amino acid sequence <SEQ ID 5122>. Analysis of this protein sequence reveals the following:

```
Possible site: 15
>>> Seems to have no N-terminal signal sequence

----- Final Results -----
            bacterial cytoplasm --- Certainty = 0.3792(Affirmative) < succ>
            bacterial membrane  --- Certainty = 0.0000(Not Clear)   < succ>
            bacterial outside   --- Certainty = 0.0000(Not Clear)   < succ>
```

The protein has homology with the following sequences in the GENPEPT database.

```
>GP: AAC45338 GB: AF000658 ORFX [Streptococcus pneumoniae]
Identities = 46/63 (73%), Positives = 57/63 (90%)

Query:   1 MYQVGSLVEMKKPHACVIKETGKKANQWKVLRVGADIKIQCTNCQHVIMMSRYDFERKLK  60
           MYQVG+ VEMKKPHAC IK TGKKAN+W++ RVGADIKI+C+NC+HV+MM RYDFERK+
Sbjct:   1 MYQVGNFVEMKKPHACTIKSTGKKANRWEITRVGADIKIKCSNCEHVVMMGRYDFERKMN  60

Query:  61 KVL                                                          63
           K++
Sbjct:  61 KII                                                          63
```

A related DNA sequence was identified in *S. pyogenes* <SEQ ID 5123> which encodes the amino acid sequence <SEQ ID 5124>. Analysis of this protein sequence reveals the following:

```
Possible site: 56
>>> Seems to have no N-terminal signal sequence

----- Final Results -----
            bacterial cytoplasm --- Certainty = 0.4038(Affirmative) < succ>
            bacterial membrane  --- Certainty = 0.0000(Not Clear)   < succ>
            bacterial outside   --- Certainty = 0.0000(Not Clear)   < succ>
```

An alignment of the GAS and GBS proteins is shown below.

```
Identities = 63/65 (96%), Positives = 64/65 (97%)

Query:   1 MYQVGSLVEMKKPHACVIKETGKKANQWKVLRVGADIKIQCTNCQHVIMMSRYDFERKLK  60
           MYQ+GS VEMKKPHACVIKETGKKANQWKVLRVGADIKIQCTNCQHVIMMSRYDFERKLK
Sbjct:   1 MYQIGSFVEMKKPHACVIKETGKKANQWKVLRVGADIKIQCTNCQHVIMMSRYDFERKLK  60

Query:  61 KVLQP                                                         65
           KVLQP
Sbjct:  61 KVLQP                                                         65
```

Based on this analysis, it was predicted that these proteins and their epitopes could be useful antigens for vaccines or diagnostics.

EXAMPLE 1654

A DNA sequence (GBSx1749) was identified in *S. agalactiae* <SEQ ID 5125> which encodes the amino acid sequence <SEQ ID 5126>. Analysis of this protein sequence reveals the following:

```
Possible site: 15
>>> Seems to have no N-terminal signal sequence
      INTEGRAL      Likelihood= -4.99   Transmembrane       48-64(47-66)

----- Final Results -----
             bacterial membrane --- Certainty = 0.2996(Affirmative) < succ>
              bacterial outside --- Certainty = 0.0000(Not Clear)   < succ>
            bacterial cytoplasm --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1655

A DNA sequence (GBSx1750) was identified in *S. agalactiae* <SEQ ID 5127> which encodes the amino acid sequence <SEQ ID 5128>. Analysis of this protein sequence reveals the following:

```
Possible site: 15
>>> Seems to have no N-terminal signal sequence

----- Final Results -----
            bacterial cytoplasm --- Certainty = 0.4171(Affirmative) < succ>
             bacterial membrane --- Certainty = 0.0000(Not Clear)   < succ>
              bacterial outside --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1656

A DNA sequence (GBSx1751) was identified in *S. agalactiae* <SEQ ID 5129> which encodes the amino acid sequence <SEQ ID 5130>. This protein is predicted to be GTP-binding protein. Analysis of this protein sequence reveals the following:

```
Possible site: 41
>>> Seems to have no N-terminal signal sequence

----- Final Results -----
            bacterial cytoplasm --- Certainty = 0.3952(Affirmative) < succ>
             bacterial membrane --- Certainty = 0.0000(Not Clear)   < succ>
              bacterial outside --- Certainty = 0.0000(Not Clear)   < succ>
```

A related GBS nucleic acid sequence <SEQ ID 8875> which encodes amino acid sequence <SEQ ID 8876> was also identified. Analysis of this protein sequence reveals the following:

```
Lipop: Possible site: -1 Crend: 0
McG: Discrim Score: 0.53
GvH: Signal Score (-7.5): -0.13
     Possible site: 29
>>> Seems to have a cleavable N-term signal seq.
ALOM program count: 0 value: 1.48 threshold: 0.0
   PERIPHERAL Likelihood = 1.48 195
modified ALOM score: -0.80
*** Reasoning Step: 3

----- Final Results -----
                bacterial outside --- Certainty = 0.3000(Affirmative) < succ>
               bacterial membrane --- Certainty = 0.0000(Not Clear)   < succ>
              bacterial cytoplasm --- Certainty = 0.0000(Not Clear)   < succ>
```

The protein has homology with the following sequences in the GENPEPT database.

```
>GP: BAB07770 GB: AP001520 GTP-binding protein [Bacillus halodurans]
Identities = 223/329 (67%), Positives = 273/329 (82%), Gaps = 5/329 (1%)

Query:   1 MVEVPDERLQKLTELITPKKTVPTTFEFTDIAGIVKGASKGEGLGNKFLANIREVDAIVH   60
           +VEVPD RLQKLTEL+ PKKTVPT FEFTDIAGIV+GASKGEGLGN+FL++IR+VDAI H
Sbjct:  43 IVEVPDPRLQKLTELVNPKKTVPTAFEFTDIAGIVEGASKGEGLGNQFLSHIRQVDAISH  102

Query:  61 VVRAFDDENVMREQGREDAFVDPIADIDTINLELILADLESINKRYARVEKMARTQKDKE  120
           VVR FDDEN+     G     VDPI DI  INLELILADLES++KR++RV+K+A+T KDKE
Sbjct: 103 VVRCFDDENITHVSGS----VDPIRDISVINLELILADLESVDKRFSRVQKLAKT-KDKE  157

Query: 121 SVAEFNVLQKIKPVLEDGKSARTIEFTEEEAKVVKGLFLLTTKPVLYVANVDEDKVADPD  180
           +VAE   VL+K+K   E+ K AR+IEFTEE+ K+VKGL LLT+KPVLYVANV ED V  PD
Sbjct: 158 AVAELEVLEKLKDAFENEKPARSIEFTEEQQKIVKGLHLLTSKPVLYVANVSEDDVLSPD  217

Query: 181 DIDYVNQIRAFAETENAEVVVISARAEEEISELDDEDKLEFLEAIGLTESGVDKLTRAAY  240
           D  +V +++AFA   EN+EV+V+SA+ EEEI+ELD E+K  FLE +G+ ESG+D+L RAAY
Sbjct: 218 DNPFVQKVKAFAAEENSEVIVVSAKIEEEIAELDGEEKAMFLEELGIQESGLDQLIRAAY  277

Query: 241 HLLGLGTYFTAGEKEVRAWTFKRGIKAPQAASIIHSDFERGFIRAVTMSYDDLIQYGSEK  300
            LLGL TYFTAGE+EVRAWTF++G KAPQAA IIHSDFE+GFIRA T+SY+DL++ GS
Sbjct: 278 SLLGLQTYFTAGEQEVRAWTFRKGTKAPQAAGIIHSDFEKGFIRAETVSYNDLVEAGSMA  337

Query: 301 AVKEAGRLREEGKEYIVQDGDIMEFRFNV                                329
             KE G++R EGKEY+VQDGD++ FRFNV
Sbjct: 338 VAKERGKVRLEGKEYVVQDGDVIHFRFNV                                366
```

A related DNA sequence was identified in *S. pyogenes* <SEQ ID 5131> which encodes the amino acid sequence <SEQ ID 5132>. Analysis of this protein sequence reveals the following:

```
Possible site: 29
>>> Seems to have a cleavable N-term signal seq.

----- Final Results -----
                bacterial outside --- Certainty = 0.3000(Affirmative) < succ>
               bacterial membrane --- Certainty = 0.0000(Not Clear)   < succ>
              bacterial cytoplasm --- Certainty = 0.0000(Not Clear)   < succ>
```

The protein has homology with the following sequences in the databases:

```
>GP: BAB07770 GB: AP001520 GTP-binding protein [Bacillus halodurans]
Identities = 259/371 (69%), Positives = 314/371 (83%), Gaps = 5/371 (1%)

Query:   1 MALTAGIVGLPNVGKSTLFNAITKAGAEAANYPFATIDPNVGMVEVPDERLQKLTELITP   60
           MALT GIVGLPNVGKSTLFNAIT+AGAE+ANYPF TIDPNVG+VEVPD RLQKLTEL+ P
Sbjct:   1 MALTTGIVGLPNVGKSTLFNAITQAGAESANYPFCTIDPNVGIVEVPDPRLQKLTELVNP   60
```

```
-continued
Query:   61 KKTVPTTFEFTDIAGIVKGASRGEGLGNKFLANIREIDAIVHVVRAFDDENVMREQGRED 120
            KKTVPT FEFTDIAGIV+GAS+GEGLGN+FL++IR++DAI HVVR FDDEN+    G
Sbjct:   61 KKTVPTAFEFTDIAGIVEGASKGEGLGNQFLSHIRQVDAISHVVRCFDDENITHVSGS-- 118

Query:  121 AFVDPIADIDTINLELILADLESINKRYARVEKMARTQKDKESVAEFNVLQKIKPVLEDG 180
               VDPI DI  INLELILADLES++KR++RV+K+A+T KDKE+VAE  VL+K+K    E+
Sbjct:  119 --VDPIRDISVINLELILADLESVDKRFSRVQKLAKT-KDKEAVAELEVLEKLKDAFENE 175

Query:  181 KSARTIEFTEDEAKVVKGLFLLTTKPVLYVANVDEDKVANPDGIDYVKQIRDFAATENAE 240
              K AR+IEFTE++ K+VKGL LLT+KPVLYVANV ED V +PD     +V++++ FAA EN+E
Sbjct:  176 KPARSIEFTEEQQKIVKGLHLLTSKPVLYVANVSEDDVLSPDDNPFVQKVKAFAAEENSE 235

Query:  241 VVVISARAEEEISELDDEDKEEFLEAIGLTESGVDKLTRAAYHLLGLGTYFTAGEKEVRA 300
              V+V+SA+ EEEI+ELD E+K   FLE +G+ ESG+D+L RAAY LLGL TYFTAGE+EVRA
Sbjct:  236 VIVVSAKIEEEIAELDGEEKAMFLEELGIQESGLDQLIRAAYSLLGLGQTYFTAGEQEVRA 295

Query:  301 WTFKRGIKAPQAAGIIHSDFERGFIRAVTMSYDDLMTYGSEKAVKEAGRLREEGKEYVVQ 360
              WTF++G KAPQAAGIIHSDFE+GFIRA T+SY+DL+   GS     KE G++R EGKEYVVQ
Sbjct:  296 WTFRKGTKAPQAAGIIHSDFEKGFIRAETVSYNDLVEAGSMAVAKERGKVRLEGKEYVVQ 355

Query:  361 DGDIMEFRFNV                                                 371
              DGD++ FRFNV
Sbjct:  356 DGDVIHFRFNV                                                 366
```

An alignment of the GAS and GBS proteins is shown below.

```
Identities = 316/329 (96%), Positives = 322/329 (97%)

Query:    1 MVEVPDERLQKLTELITPKKTVPTTFEFTDIAGIVKGASKGEGLGNKFLANIREVDAIVH   60
            MVEVPDERLQKLTELITPKKTVPTTFEFTDIAGIVKGAS+GEGLGNKFLANIRE+DAIVH
Sbjct:   43 MVEVPDERLQKLTELITPKKTVPTTFEFTDIAGIVKGASRGEGLGNKFLANIREIDAIVH  102

Query:   61 VVRAFDDENVMREQGREDAFVDPIADIDTINLELILADLESINKRYARVEKMARTQKDKE  120
            VVRAFDDENVMREQGREDAFVDPIADIDTINLELILADLESINKRYARVEKMARTQKDKE
Sbjct:  103 VVRAFDDENVMREQGREDAFVDPIADIDTINLELILADLESINKRYARVEKMARTQKDKE  162

Query:  121 SVAEFNVLQKIKPVLEDGKSARTIEFTEEEAKVVKGLFLLTTKPVLYVANVDEDKVADPD  180
            SVAEFNVLQKIKPVLEDGKSARTIEFTE+EAKVVKGLFLLTTKPVLYVANVDEDKVA+PD
Sbjct:  163 SVAEFNVLQKIKPVLEDGKSARTIEFTEDEAKVVKGLFLLTTKPVLYVANVDEDKVANPD  222

Query:  181 DIDYVNQIRAFAETENAEVVVISARAEEEISELDDEDKLEFLEAIGLTESGVDKLTRAAY  240
             IDYV QIR FA TENAEVVVISARAEEEISELDDEDK EFLEAIGLTESGVDKLTRAAY
Sbjct:  223 GIDYVKQIRDFAATENAEVVVISARAEEEISELDDEDKEEFLEAIGLTESGVDKLTRAAY  282

Query:  241 HLLGLGTYFTAGEKEVRAWTFKRGIKAPQAASIIHSDFERGFIRAVTMSYDDLIQYGSEK  300
            HLLGLGTYFTAGEKEVRAWTFKRGIKAPQAA IHSDFERGFIRAVTMSYDDL+ YGSEK
Sbjct:  283 HLLGLGTYFTAGEKEVRAWTFKRGIKAPQAAGIIHSDFERGFIRAVTMSYDDLMTYGSEK  342

Query:  301 AVKEAGRLREEGKEYIVQDGDIMEFRFNV                               329
            AVKEAGRLREEGKEY+VQDGDIMEFRFNV
Sbjct:  343 AVKEAGRLREEGKEYVVQDGDIMEFRFNV                               371
```

SEQ ID 8876 (GBS177) was expressed in *E. coli* as a His-fusion product. SDS-PAGE analysis of total cell extract is shown in FIG. 38 (lane 4; MW 41.2 kDa).

Figure 118:
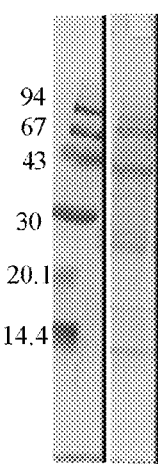

The GBS177-His fusion product was purified (FIG. 118A; see also FIG. 202, lane 7) and used to immunise mice (lane 1 product; 20 μg/mouse). The resulting antiserum was used for Western blot, FACS, and in the in vivo passive protection assay (Table III). These tests confirm that the protein is immunoaccessible on GBS bacteria and that it is an effective protective immunogen.

Based on this analysis, it was predicted that these proteins and their epitopes could be useful antigens for vaccines or diagnostics.

EXAMPLE 1657

A DNA sequence (GBSx1752) was identified in *S. agalactiae* <SEQ ID 5133> which encodes the amino acid sequence <SEQ ID 5134>. This protein is predicted to be stage V sporulation protein C (pth). Analysis of this protein sequence reveals the following:

```
Possible site: 19
>>> Seems to have no N-terminal signal sequence

----- Final Results -----
            bacterial cytoplasm --- Certainty = 0.2212(Affirmative) < succ>
            bacterial membrane  --- Certainty = 0.0000(Not Clear)   < succ>
            bacterial outside   --- Certainty = 0.0000(Not Clear)   < succ>
```

A related GBS nucleic acid sequence <SEQ ID 10301> which encodes amino acid sequence <SEQ ID 10302> was also identified.

The protein has homology with the following sequences in the GENPEPT database.

```
>GP: BAB03787 GB: AP001507 stage V sporulation protein C
(peptidyl-tRNA hydrolase) [Bacillus halodurans]
Identities = 89/187 (47%), Positives = 127/187 (67%), Gaps = 2/187 (1%)

Query:    6 VKMIVGLGNPGSKYNDTKHNIGFMAVDRIVKDLDVNFTEDKNFKAEIGSDFINGEKIYFI    65
            +K+IVGLGNPG+KY+ T+HN+GF  VD + + L++   + K       G   I+GEKI+ +
Sbjct:    1 MKLIVGLGNPGAKYDGTRHNVGFDVVDAVARRLNIEIKQSKA-NGLYEGRIDGEKIFLL   59

Query:   66 KPTTFMNNSGIAVKALLTYYNISIKDMIIYDDLDMEVGKIRFRQKGSAGGHNGIKSIIA   125
            KP TFMN SG +V+  L  YYN+ ++D+++IYDDLD+ VGKIR RQKGSAGGHNG+KS+IA
Sbjct:   60 KPQTFMNRSGESVRPFLEYYNMEVEDLLVIYDDLDLPVGKIRLRQKGSAGGHNGMKSLIA  119

Query:  126 HLGTQEFDRIKVGIGRPNGRMTVINHVLGKFDKNDEIMILNTLDKVDNAVNYYLQTNDFQ  185
            HLGT +F RI+VG+ RP    TV+ HVLG++  ++  I    +D   A  + +    F
Sbjct:  120 HLGTSDFKRIRVGVDRPAPGETVVQHVLGRYRPEEKDAISEAIDLSAEAAEAFTK-KPFL  178

Query:  186 KTMQKYN                                                      192
            + M  +N
Sbjct:  179 EVMNTFN                                                      185
```

A related DNA sequence was identified in *S. pyogenes* <SEQ ID 5135> which encodes the amino acid sequence <SEQ ID 5136>. Analysis of this protein sequence reveals the following:

```
Possible site: 30
>>> Seems to have no N-terminal signal sequence

----- Final Results -----
            bacterial cytoplasm --- Certainty = 0.2840(Affirmative) < succ>
             bacterial membrane --- Certainty = 0.0000(Not Clear) < succ>
              bacterial outside --- Certainty = 0.0000(Not Clear) < succ>
```

An alignment of the GAS and GBS proteins is shown below.

```
Identities = 148/189 (78%), Positives = 166/189 (87%)

Query:    5 MVKMIVGLGNPGSKYNDTKHNIGFMAVDRIVKDLDVNFTEDKNFKAEIGSDFINGEKIYF   64
            MVKMIVGLGNPGSKY  TKHNIGFMA+D IVK+LDV FT+DKNFKA+IGS FIN EK+YF
Sbjct:   16 MVKMIVGLGNPGSKYEKTKHNIGFMAIDNIVKNLDVTFTDDKNFKAQIGSTFINHEKVYF   75

Query:   65 IKPTTFMNNSGIAVKALLTYYNISIKDMIIYDDLDMEVGKIRFRQKGSAGGHNGIKSII  124
            +KPTTFMNNSGIAVKALLTYYNI I D+I+IYDDLDMEV K+R R KGSAGGHNGIKSII
Sbjct:   76 VKPTTFMNNSGIAVKALLTYYNIDITDLIVIYDDLDMEVSKLRLRSKGSAGGHNGIKSII  135

Query:  125 AHLGTQEFDRIKVGIGRPNGRMTVINHVLGKFDKNDEIMILNTLDKVDNAVNYYLQTNDF  184
            AH+GTQEF+RIKVGIGRP   MTVINHV+G+F+  D I I  TLD+V NAV +YLQ NDF
Sbjct:  136 AHIGTQEFNRIKVGIGRPLKGMTVINHVMGQFNTEDNIAISLTLDRVVNAVKFYLQENDF  195

Query:  185 QKTMQKYNG                                                    193
            +KTMQK+NG
Sbjct:  196 EKTMQKFNG                                                    204
```

Based on this analysis, it was predicted that these proteins and their epitopes could be useful antigens for vaccines or diagnostics.

EXAMPLE 1658

A DNA sequence (GBSx1753) was identified in *S. agalactiae* <SEQ ID 5137> which encodes the amino acid sequence <SEQ ID 5138>. This protein is predicted to be transcription-repair coupling factor (mfd). Analysis of this protein sequence reveals the following:

```
Possible site: 37
>>> Seems to have no N-terminal signal sequence

----- Final Results -----
            bacterial cytoplasm --- Certainty = 0.2456(Affirmative) < succ>
             bacterial membrane --- Certainty = 0.0000(Not Clear) < succ>
              bacterial outside --- Certainty = 0.0000(Not Clear) < succ>
```

The protein has homology with the following sequences in the GENPEPT database.

```
>GP: AAD03810 GB: AF054624 transcription-repair coupling factor
[Lactobacillus sakei]
Identities = 523/1051 (49%), Positives = 733/1051 (68%),
Gaps = 20/1051 (1%)

Query:    1 MNIIELFSQNKVVRTWHSGLVTNSRQLVMGFSGASKAIAIASAYEKLSKKIMVVTATQTD   60
            M++I +    + V++             RQL+ G SG++K + +A+ Y++  + ++++ +
Sbjct:    1 MDLISMLGNTQQVQSVLENQKPGVRQLLTGLSGSAKTLFLATIYKQQRQPLLIIESNMFQ   60

Query:   61 SDKLSSDISSLIGEDNVYQFFADDVPAAEFIFSSLDKSISRLSALRFLKDPEKNGVLITS  120
            +++++ D+++ +  D +Y F  ++V AAE    SS +    R+  L FL   +K G+++TS
Sbjct:   61 ANQVAEDLANQLNGDQIYTFPVEEVMAAEIAVSSPESRAERVRTLSFLATGKK-GIVVTS  119

Query:  121 ISGLRLLLPNPEVFSKSQYKFEIGQECYLDKLCKNLVNLGYQKVSQVFSPGEFSQRGDIL  180
            ++G+R LLP    + SQ + E+G E      L    L +GY +   V PGEF+ RGDI+
Sbjct:  120 VAGMRRLLPTVRQWRDSQTQIEMGGEVDPKILGAQLAEMGYHRDKLVGKPGEFAMRGDII  179

Query:  181 DIFEMTQEYPYRLEFFGDEIDGIRQFDIDTQKSLKQLESVQISPADDIILQDADFERAKK  240
            DIF +   E P R+E F  E+D IR F+ DTQ+S++ LESV I PA D++   A  E A +
Sbjct:  180 DIFPLDTENPVRIELFDTEVDAIRSFEADTQRSIENLESVAIMPATDLLANAAQLEMAGE  239

Query:  241 KLEG-YLVTASEVQ------------RTYLSEVLSTTENHFKHSDIRRFLSIFYEKEWGI  287
             L+  Y  TA+++              T +S +L+     + ++ F+     Y      +
Sbjct:  240 ALQADYQQTAAKITAKDDQKALAVNFETPISRLLAGE----RLENLALFVDYLYPDHTSL  295

Query:  288 LDYIPEGTPLFVDDFQKIVDRNAKLDLEIASLLTEDLQQGKSHSSLNYFSDPYKQLRQYQ  347
            +DY    + +   DD+ +I +    L E A+  T+ L  +    +   D +  ++Q Q
Sbjct:  296 IDYFKNSGLVVFDDYPRIQETQRVLAEEAANWQTDMLGSRRLLPAQKLLVDVHHLMKQDQ  355

Query:  348 -PATFFSNFHKGLGNLKFDKLHHFTQYGMQEFFNQFPLLVDEINRYKKSGATVLLQVDSQ  406
             P   + S F KG+G LK D L +     +Q+FF+Q PLL  E++R++K   TV++ V
Sbjct:  356 HPHLYLSLFQKGMGKLKLDTLGNMPTRNVQQFFSQMPLLKTEMSRWQKQQQTVVVLVSDA  415

Query:  407 KGLNLLQENLKEYGLDLIISDKNDIVQKESQLIVGHLSNGFYFADEKIVLITEREIYHRR  466
            K +  + +  ++ ++ ++  K +V + Q++ G L NGF    D K+V++TE+E+++
Sbjct:  416 KRVKKIDQTFHDFEIEATVTTKTKLVAGQIQIVQGSLQNGFELPDLKLVVLTEKELFNTA  475

Query:  467 VKRKIRRSNISNAERLKDYNELSVGDYVVHNVHGVGKFLGIETIEIQGIHRDYLTIQYQN  526
             K+K+RR  ++NAERLK Y+EL  GDYVVH  HG+G++G+ET+E+  G+H+DY+TI Y++
Sbjct:  476 PKKKVRRQTLANAERLKSYSELKPGDYVVHNHGIGEYVGMETLEVDGVHQDYITILYRD  535

Query:  527 ADRISIPVEQIELLTKYVSADGKEPKINTLNDGRFKKAKQRVAKQVEDIADDLLKLYAER  586
             + IPV Q++++ KYVSA+ K PKIN L     ++K K +V+ ++EDIADDL++LYA+R
Sbjct:  536 NGKLFIPVTQLDMVQKYVSAESKTPKINKLGGAEWQKTKSKVSAKIEDIADDLIELYAQR  595

Query:  587 SQLQGFAFSPDDNMQNDFDNDFAYVETEDQLRSIKEIKQDMEGNRPMDRLLVGDVGFGKT  646
            +  +G+AF  DD +Q DF+N FAY ET+DQLRS  EIK  DME   RPMDRLLVGDVGFGKT
Sbjct:  596 EAEKGYAFPKDDQLQADFENQFAYPETDDQLRSTAEIKHDMEKVRPMDRLLVGDVGFGKT  655

Query:  647 EVAMRAAFKAVNDHKQVVVLVPTTVLAQQHFENFKERFSNYPVTVDVLSRFRSKKEQTDT  706
            EVA++RAAFKAV   KQV  LVPTT+LAQQH+EN   RF+++PV + +LSRF+++KE T  T
Sbjct:  656 EVALRAAFKAVAAGKQVAFLVPTTILAQQHYENMLARFADFPVELGLLSRFKTRKEVTAT  715
```

-continued

```
Query:  707  LKRLSKGQVDIIIGTHRLLSQDVVFSDLGLIVIDEEQRFGVKHKEKLKELKTKVDVLTLT    766
             LK L  KGQVDI+IGTHRLLS+DVVF DLGL+++DEEQRFGVKHKE+LK+LK +VDVLTLT
Sbjct:  716  LKGLEKGQVDIVIGTHRLLSKDVVFKDLGLLIVDEEQRFGVKHKERLKQLKAQVDVLTLT    775

Query:  767  ATPIPRTLHMSMLGIRDLSVIETPPTNRYPVQTYVLETNPGLVREAIIREIDRGGQVFYV    826
             ATPIPRTLHMSMLG+RDLSVIETPPTNRYP+QTYV+E N G +REAI RE++R GQVFY+
Sbjct:  776  ATPIPRTLHMSMLGVRDLSVIETPPTNRYPIQTYVMEQNAGAMREAIERELERNGQVFYL   835

Query:  827  YNKVDTIDQKVSELQELVPEASIGFVHGQMSEIQLENTLIDFINGDYDVLVATTIIETGV    886
             +N+V   I+Q V E+Q LVPEA++G+ HGQM+E QLE   + DF+ G YDVLV TTIIETGV
Sbjct:  836  HNRVSDIEQTVDEIQALVPEATVGYAHGQMTEAQLEGVIYDFVQGKYDVLVTTTIIETGV   895

Query:  887  DISNVNTLFVENADHMGLSTLYQLRGRVGRSNRIAYAYLMYRPDKVLTEISEKRLDAIKG    946
             D+ NVNT+ VE+ADH GLS LYQLRGR+GRS+R+AY Y MY+PDKVLTE+SEKRL AIK
Sbjct:  896  DMPNVNTMIVEDADHYGLSQLYQLRGRIGRSSRVAYGYFMYKPDKVLTEVSEKRLQAIKD   955

Query:  947  FTELGSGFKIAMRDLSIRGAGNILGASQSGFIDSVGFEMYSQLLEQAIATKQGKSLIRQK   1006
             FTELGSGFKIAMRDLSIRGAGN+LG   Q GFIDSVGF++YSQ+L +A+A KQGK +  K
Sbjct:  956  FTELGSGFKIAMRDLSIRGAGNLLGKQQHGFIDSVGFDLYSQMLSEAVAKKQGKK-VAAK  1014

Query: 1007  GNAELALQIDAYLPAEYISDERQKIEIYKRI                               1037
             NAE+ L+++AYLP +YI+D+RQKIEIYKRI
Sbjct: 1015  TNAEIDLKLEAYLPDDYINDQRQKIEIYKRI                               1045
```

A related DNA sequence was identified in *S. pyogenes* <SEQ ID 5139> which encodes the amino acid sequence <SEQ ID 5140>. Analysis of this protein sequence reveals the following:

```
Possible site: 39
>>> Seems to have no N-terminal signal sequence

----- Final Results -----
            bacterial cytoplasm --- Certainty = 0.2826(Affirmative) < succ>
            bacterial membrane  --- Certainty = 0.0000(Not Clear)  < succ>
             bacterial outside  --- Certainty = 0.0000(Not Clear)  < succ>
```

An alignment of the GAS and GBS proteins is shown below.

```
Identities = 875/1161 (75%), Positives = 1032/1161 (88%)

Query:    1  MNIIELFSQNKVVRTWHSGLVTNSRQLVMGFSGASKAIAIASAYEKLSKKIMVVTATQTD     60
             M+I+ELFSQNK V++WHSGL T  RQLVMG SG+SK +AIASAY   KKI+VVT+TQ +
Sbjct:    1  MDILELFSQNKKVQSWHSGLTTLGRQLVMGLSGSSKTLAIASAYLDDQKKIVVVTSTQNE    60

Query:   61  SDKLSSDISSLIGEDNVYQFFADDVPAAEFIFSSLDKSISRLSALRFLKDPEKNGVLITS   120
             +KL+SD+SSL+ E+ V+QFFADDV AAEFIF+S+DK++SR+  L+FL++P+  GVLI S
Sbjct:   61  VEKLASDLSSLLDEELVFQFFADDVAAAEFIFASMDKALSRIETLQFLRNPKSQGVLIVS   120

Query:  121  ISGLRLLLPNPEVFSKSQYKFEIGQECYLDKLCKNLVNLGYQKVSQVFSPGEFSQRGDIL   180
             +SGLR+LLPNP VF+KSQ +   +G++   D L K L+ +GYQKVSQV SPGEFS+RGDIL
Sbjct:  121  LSGLRILLPNPDVFTKSQIQLTVGEDYDSDTLTKQLMTIGYQKVSQVISPGEFSRRGDIL   180

Query:  181  DIFEMTQEYPYRLEFFGDEIDGIRQFDIDTQKSLKQLESVQISPADDIILQDADFERAKK   240
             DI+E+TQE PYRLEFFGD+ID IRQF  +TQKS +QLE + I+PA D+I +DF+R  +
Sbjct:  181  DIYEITQELPYRLEFFGDDIDSIRQFHPETQKSFEQLEGIFINPASDLIFEVSDFQRGIE   240

Query:  241  KLEGYLVTASEVQRTYLSEVLSTTENHFKHSDIRRFLSIFYEKEWGILDYIPEGTPLFVD   300
             +LE   L TA + +++YL +VL+ ++N FKH DIR+F S+FYEKEW +LDYIP+GTP+F D
Sbjct:  241  QLEKALQTAQDDKKSYLEDVLAVSKNGFKHKDIRKFQSLFYEKEWSLLDYIPKGTPIFFD   300

Query:  301  DFQKIVDRNAKLDLEIASLLTEDLQQGKSHSSLNYFSDPYKQLRQYQPATFFSNFHKGLG   360
             DFQK+VD+NA+ DLEIA+LLTEDLQQGK+ S+LNYF+D Y++LR YKPATFFSNFHKGLG
Sbjct:  301  DFQKLVDKNARFDLEIANLLTEDLQQGKALSNLNYFTDNYRELRHYKPATFFSNFHKGLG   360

Query:  361  NLKFDKLHHFTQYGMQEFFNQFPPLLVDEINRYKKSGATVLLQVDSQKGLNLLQENLKEYG   420
             N+KFD++H  TQY MQEFFNQFPLL+DEI RY+K+ TV++QV+SQ     L+++ ++Y
Sbjct:  361  NIKFDQMHQLTQYAMQEFFNQFPLLIDEIKRYQKNQTTVIVQVESQYAYERLEKSFQDYQ   420

Query:  421  LDLIISDKNDIVQKESQLIVGHLSNGFYADEKIVLITEREIYHRRVKRKIRRSNISNAE   480
              L +    N IV +ESQ+++G +S+GFYADEK+ LITE EIYH+++KR+ RRSNISNAE
Sbjct:  421  FRLPLVSANQIVSRESQIVIGAISSGFYADEKLALITEHEIYHKKIKRRARRSNISNAE   480
```

-continued

```
Query:    481 RLKDYNELSVGDYVVHNVHGVGKFLGIETIEIQGIHRDYLTIQYQNADRISIPVEQIELL    540
              RLKDYNEL+VGDYVVHNVHG+G+FLGIETI+IQGIHRDY+TIQYQN+DRIS+P++QI   L
Sbjct:    481 RLKDYNELAVGDYVVHNVHGIGRFLGIETIQIQGIHRDYVTIQYQNSDRISLPIDQISSL    540

Query:    541 TKYVSADGKEPKINTLNDGRFKKAKQRVAKQVEDIADDLLKLYAERSQLQGFAFSPDDNM    600
              +KYVSADGKEPKIN LNDGRF+K KQ+VA+QVEDIADDLLKLYAERSQ +GF+FSPDD++
Sbjct:    541 SKYVSADGKEPKINKLNDGRFQKTKQKVARQVEDIADDLLKLYAERSQQKGFSFSPDDDL    600

Query:    601 QNDFDNDFAYVETEDQLRSIKEIKQDMEGNRPMDRLLVGDVGFGKTEVAMRAAFKAVNDH    660
              Q   FD+DFA+VETEDQLRSIKEIK  DME   +PMDRLLVGDVGFGKTEVAMRAAFKAVNDH
Sbjct:    601 QRAFDDDFAFVETEDQLRSIKEIKADMESMQPMDRLLVGDVGFGKTEVAMRAAFKAVNDH    660

Query:    661 KQVVVLVPTTVLAQQHFENFKERFSNYPVTVDVLSRFRSKKEQTDTLKRLSKGQVDIIIG    720
              KQV VLVPTTVLAQQH+ENFK RF NYPV VDVLSRFRSKKEQ +TL+R+ KGQ+DIIIG
Sbjct:    661 KQVAVLVPTTVLAQQHYENFKARFENYPVEVDVLSRFRSKKEQAETLERVRKGQIDIIIG    720

Query:    721 THRLLSQDVVFSDLGLIVIDEEQRFGVKHKEKLKELKTKVDVLTLTATPIPRTLHMSMLG    780
              THRLLS+DVVFSDLGLIVIDEEQRFGVKHKE LKELKTKVDVLTLTATPIPRTLHMSMLG
Sbjct:    721 THRLLSKDVVFSDLGLIVIDEEQRFGVKHKETLKELKTKVDVLTLTATPIPRTLHMSMLG    780

Query:    781 IRDLSVIETPPTNRYPVQTYVLETNPGLVREAIIREIDRGGQVFYVYNKVDTIDQKVSEL    840
              IRDLSVIETPPTNRYPVQTYVLE NPGLVREAIIRE+DRGGQ+FYVYNKVDTI++KV+EL
Sbjct:    781 IRDLSVIETPPTNRYPVQTYVLENNPGLVREAIIREMDRGGQIFYVYNKVDTIEKKVAEL    840

Query:    841 QELVPEASIGFVHGQMSEIQLENTLIDFINGDYDVLVATTIIETGVDISNVNTLFVENAD    900
              QELVPEASIGFVHGQMSEIQLENTLIDFINGDYDVLVATTIIETGVDISNVNTLF+ENAD
Sbjct:    841 QELVPEASIGFVHGQMSEIQLENTLIDFINGDYDVLVATTIIETGVDISNVNTLFIENAD    900

Query:    901 HMGLSTLYQLRGRVGRSNRIAYAYLMYRPDKVLTEISEKRLDAIKGFTELGSGFKIAMRD    960
              HMGLSTLYQLRGRVGRSNRIAYAYLMYRPDKVLTE+SEKRL+AIKGFTELGSGFKIAMRD
Sbjct:    901 HMGLSTLYQLRGRVGRSNRIAYAYLMYRPDKVLTEVSEKRLEAIKGFTELGSGFKIAMRD    960

Query:    961 LSIRGAGNILGASQSGFIDSVGFEMYSQLLEQAIATKQGKSLIRQKGNAELALQIDAYLP   1020
              LSIRGAGNILGASQSGFIDSVGFEMYSQLLEQAIA+KQGK+ +RQKGN E+ LQIDAYLP
Sbjct:    961 LSIRGAGNILGASQSGFIDSVGFEMYSQLLEQAIASKQGKTTVRQKGNTEINLQIDAYLP   1020

Query:   1021 AEYISDERQKIEIYKRIRELETRADYEALQDELIDRFGEYPDQVAYLLEIGLLKAYLDLA   1080
              +YI+DERQKI+IYKRIRE+++R DY    LQDEL+DRFGEYPDQVAYLLEI LLK Y+D A
Sbjct:   1021 DDYIADERQKIDIYKRIREIQSREDYLNLQDELMDRFGEYPDQVAYLLEIALLKHYMDNA   1080

Query:   1081 FTELVERKGNEISILFEKASLKYFLTQDYFEALSKTQLKARISETNGKMEVVFNIKHKKN   1140
              F ELVERK N++ + FE  SL YFLTQDYFEALSKT LKA+ISE  GK+++VF+++H+K+
Sbjct:   1081 FAELVERKNNQVIVRFEVTSLTYFLTQDYFEALSKTHLKAKISEHQGKIDIVFDVRHQKD   1140

Query:   1141 YEIIEELLKFAECFIEIKSRK                                         1161
              Y I+EEL+ F E    EIK RK
Sbjct:   1141 YRILEELMLFGERLSEIKIRK                                         1161
```

Based on this analysis, it was predicted that these proteins and their epitopes could be useful antigens for vaccines or diagnostics.

EXAMPLE 1659

A DNA sequence (GBSx1754) was identified in *S. agalactiae* <SEQ ID 5141> which encodes the amino acid sequence <SEQ ID 5142>. Analysis of this protein sequence reveals the following:

```
Possible site: 39
>>> Seems to have no N-terminal signal sequence

----- Final Results -----
            bacterial cytoplasm --- Certainty = 0.4347(Affirmative) < succ>
            bacterial membrane  --- Certainty = 0.0000(Not Clear)   < succ>
             bacterial outside  --- Certainty = 0.0000(Not Clear)   < succ>
```

The protein has homology with the following sequences in the GENPEPT database.

```
>GP:CA811835 GB:Z99104 similar to hypothetical proteins
[Bacillus subtilis]
Identities = 50/84 (59%), Positives = 70/84 (82%)
```

```
Query:   1 MRLDKYLKVSRIIKRRPVAKEVADKGRVKVNGVLAKSSTDLKLNDQVEIRFGNKLLTVKV     60
           MRLDK+LKVSR+IKRR +AKEVAD+GR+ +NG  AK+S+D+K  D++ +RFG KL+TV+V
Sbjct:   1 MRLDKFLKVSRLIKRRTLAKEVADQGRISINGNQAKASSDVKPGDELTVRFGQKLVTVQV     60

Query:  61 LEMKDSTKKEDAIKMYEIINETRI                                        84
              E+KD+TKKE+A  MY I+ E ++
Sbjct:  61 NELKDTTKKEEAANMYTILKEEKL                                        84
```

A related DNA sequence was identified in *S. pyogenes* <SEQ ID 5143> which encodes the amino acid sequence <SEQ ID 5144>. Analysis of this protein sequence reveals the following:

```
Possible site: 27
>>> Seems to have no N-terminal signal sequence

----- Final Results -----
bacterial cytoplasm --- Certainty = 0.2963 (Affirmative) <succ>
 bacterial membrane --- Certainty = 0.0000 (Not Clear)   <succ>
  bacterial outside --- Certainty = 0.0000 (Not Clear)   <succ>
```

An alignment of the GAS and GBS proteins is shown below.

```
Identities = 72/90 (80%), Positives = 85/90 (94%)

Query:   1 MRLDKYLKVSRIIKRRPVAKEVADKGRVKVNGVLAKSSTDLKLNDQVEIRFGNKLLTVKV     60
           MRLDKYLKVSR+IKRR VAKEVADKGR+KVNG+LAKSST++KLND +EI FGNKLLTV+V
Sbjct:   9 MRLDKYLKVSRLIKRRSVAKEVADKGRIKVNGILAKSSTNIKLNDHIEISFGNKLLTVRV     68

Query:  61 LEMKDSTKKEDAIKMYEIINETRIETDEQA                                  90
            +E+KDSTKKEDA+KMYEII+ETRI  +E+A
Sbjct:  69 IEIKDSTKKEDALKMYEIISETRITLNEEA                                  98
```

Based on this analysis, it was predicted that these proteins and their epitopes could be useful antigens for vaccines or diagnostics.

EXAMPLE 1660

A DNA sequence (GBSx1755) was identified in *S. agalactiae* <SEQ ID 5145> which encodes the amino acid sequence <SEQ ID 5146>. This protein is predicted to be DivIC homolog. Analysis of this protein sequence reveals the following:

```
Possible site: 50
>>> Seems to have no N-terminal signal sequence
INTEGRAL    Likelihood = -8.12    Transmembrane 34-50 (31-56)

----- Final Results -----
 bacterial membrane --- Certainty = 0.4248 (Affirmative) <succ>
  bacterial outside --- Certainty = 0.0000 (Not Clear)   <succ>
bacterial cytoplasm --- Certainty = 0.0000 (Not Clear)   <succ>
```

The protein has homology with the following sequences in the GENPEPT database.

```
>GP:AAC98903 GB:AF023181 DivIC homolog [Listeria monocytogenes]
Identities = 36/119 (30%), Positives = 65/119 (54%), Gaps = 2/119 (1%)

Query:   2 SKPNVVQLNNQYINDE-NLKKRYEAEELRRKNRLMGWVLIFVMLLFILPTYNLVKSYRTL    60
           +K  V ++ N+YI D  +KK       +   RL  +IF ++  +L T     K    TL
Sbjct:   4 AKSKVARIENRYIKDTATMKKTRSRRRIALFRRLAFMAIIFAVVGGLL-TITYTKQVLTL    62

Query:  61 QERRQEVVKLTKDYQTLTNRTENQKLLAKQLKNPDYVQKYARAKYYFSKTGEMIYPLPD   119
            +E++++ V++ K    +  ++    K+L N DY+ K AR++YY SK GE+I+ +P+
Sbjct:  63 KEKKEKQVQVDKKMVAMKDEQDSLNEQIKKLHNDDYIAKLARSEYYLSKDGEIIFNPIE  121
```

A related DNA sequence was identified in *S. pyogenes* <SEQ ID 5147> which encodes the amino acid sequence <SEQ ID 5148>. Analysis of this protein sequence reveals the following:

```
Possible site: 50
>>> Seems to have no N-terminal signal sequence
INTEGRAL    Likelihood = -3.93    Transmembrane 34-50 (32-51)

----- Final Results -----
 bacterial membrane --- Certainty = 0.2572 (Affirmative) <succ>
  bacterial outside --- Certainty = 0.0000 (Not Clear)   <succ>
bacterial cytoplasm --- Certainty = 0.0000 (Not Clear)   <succ>
```

The protein has homology with the following sequences in the databases:

```
>GP:AAC98903 GB:AF023181 DivIC homolog [Listeria monocytogenes]
Identities = 27/116 (23%), Positives = 59/116 (50%)

Query:   3 KPSIVQLNNHYIKKENLKKKFEEEESQKRNRFMGWILVSMMFLFILPTYNLVKSYVDFEK   62
           K  + ++ N YIK     KK           R + ++ +    + L T     K  + ++
Sbjct:   5 KSKVARIENRYIKDTATMKKTRSRRRIALFRRLAFMAIIFAVVGGLLTITYTKQVLTLKE   64

Query:  63 QNQQVVKLKKEYNELSESTKKEKQLAERLKDDNFVKKYARAKYYLSREGEMIYPIP      118
           + ++ V++ K+   + +         +  ++L +D+++ K AR++YYLS++GE+I+ IP
Sbjct:  65 KKEKQVQVDKKMVAMKDEQDSLNEQIKKLHNDDYIAKLARSEYYLSKDGEIIFNIP      120
```

An alignment of the GAS and GBS proteins is shown below.

```
Identities = 73/123 (59%), Positives = 99/123 (80%)

Query:    1 MSKPNVVQLNNQYINDENLKKRYEAEELRRKNRLMGWVLIFVMLLFILPTYNLVKSYRTL    60
            M KP++VQLNN YI   ENLKK++E EE +++NR MGW+L+ +M LFILPTYNLVKSY
Sbjct:    1 MKKPSIVQLNNHYIKKENLKKKFEEEESQKRNRFMGWILVSMMFLFILPTYNLVKSYVDF    60

Query:   61 QERRQEVVKLTKDYQTLTNRTENQKLLAKQLKNPDYVQKYARAKYYFSKTGEMIYPLPDL   120
            +++ Q+VVKL K+Y  L+   T+ +K LA++LK+ ++V+KYARAKYY S+ GEMIYP+P L
Sbjct:   61 EKQNQQVVKLKKEYNELSESTKKEKQLAERLKDDNFVKKYARAKYYLSREGEMIYPIPGL   120

Query:  121 LPK                                                           123
            LPK
Sbjct:  121 LPK                                                           123
```

SEQ ID 5146 (GBS418) was expressed in *E. coli* as a GST-fusion product. SDS-PAGE analysis of total cell extract is shown in FIG. 172 (lane 3; MW 42 kDa).

GBS418-GST was purified as shown in FIG. 219, lane 4-5.

Based on this analysis, it was predicted that these proteins and their epitopes could be useful antigens for vaccines or diagnostics.

EXAMPLE 1661

A DNA sequence (GBSx1756) was identified in *S. agalactiae* <SEQ ID 5149> which encodes the amino acid sequence <SEQ ID 5150>. Analysis of this protein sequence reveals the following:

```
Possible site: 15
>>> Seems to have no N-terminal signal sequence

----- Final Results -----
bacterial cytoplasm --- Certainty = 0.4355 (Affirmative) <succ>
 bacterial membrane --- Certainty = 0.0000 (Not Clear)   <succ>
  bacterial outside --- Certainty = 0.0000 (Not Clear)   <succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1662

A DNA sequence (GBSx1757) was identified in *S. agalactiae* <SEQ ID 5151> which encodes the amino acid sequence <SEQ ID 5152>. Analysis of this protein sequence reveals the following:

```
Possible site: 21
>>> Seems to have an uncleavable N-term signal seq
INTEGRAL     Likelihood = -5.52   Transmembrane 4-20 (3-22)

----- Final Results -----
 bacterial membrane --- Certainty = 0.3208 (Affirmative) <succ>
  bacterial outside --- Certainty = 0.0000 (Not Clear)   <succ>
bacterial cytoplasm --- Certainty = 0.0000 (Not Clear)   <succ>
```

The protein has no significant homology with any sequences in the GENPEPT database.

A related DNA sequence was identified in *S. pyogenes* <SEQ ID 5153> which encodes the amino acid sequence <SEQ ID 5154>. Analysis of this protein sequence reveals the following:

```
Possible site: 21
>>> Seems to have a cleavable N-term signal seq.

----- Final Results -----
  bacterial outside --- Certainty = 0.3000 (Affirmative) <succ>
 bacterial membrane --- Certainty = 0.0000 (Not Clear)   <succ>
bacterial cytoplasm --- Certainty = 0.0000 (Not Clear)   <succ>
```

The protein has no significant homology with any sequences in the GENPEPT database.

An alignment of the GAS and GBS proteins is shown below.

```
Identities = 205/428 (47%), Positives = 285/428 (65%)

Query:   1 MKKVLTFLLCSLYFVSIPAISTEEPLTLSQNRRYALTQTVVDKEMYFDAIPERPTTKIEI    60
           M+K+L  +L + +   +P ISTE+ L  S+N  Y L Q VV    +++ IP  P    E
Sbjct:   1 MRKLLAAMLMTFFLTPLPVISTEKKLIFSKNAVYQLKQDVVQSTQFYNQIPSNPNLYQET    60

Query:  61 SSFQDEALTITGETLVPNTLLSIVSLTINSNGIPVFTLSNGQFIKASREAIFNDLVSKQQ   120
              +++D  LT+    L  N  L I SL +N   +PVF L++G +++A+R+ I++D+V  Q
Sbjct:  61 CAYKDSDLTLPAGRLGVNQPLLIKSLVLNKESLPVFELADGTYVEANRQLIYDDIVLNQV   120

Query: 121 SVSLDYWLKPSFVTYEAPYTNGVSEVKNNLKPYSRVHLVEQAETEHGIYYKTDSGFWISV   180
            +    +W +     Y APY  G  + ++     +VH  + A+T HG YY   D    W S
Sbjct: 121 DIDSYFWTQKKLRLYSAPYVLGTQTIPSSFLFAQKVHATQMAQTNHGTYYLIDDKGWASQ   180

Query: 181 EDLSVADNRMAKVQEVLLEKYNKDKYGIYIKQLNTQTVAGINIDRSMYSASIAKLATLYA   240
           EDL   DNRM KVQE+LL+KYN   Y I++KQLNTQT AGIN D+ MY+ASI+KLA LY
Sbjct: 181 EDLVQFDNRMLKVQEMLLQKYNNPNYSIFVKQLNTQTSAGINADKKMYAASISKLAPLYI   240

Query: 241 SQEQVKLGKLSLDSKFEYKDNVNQFPNSYDPSGSGKLEKKADHKLYTVKELLEATAKESD   300
            Q+Q++  KL +     Y  +VN F   YDP GSGK+ K AD+K Y V++LL+A A++SD
Sbjct: 241 VQKQLQKKKLAENKTLTYTKDVNHFYGDYDPLGSGKISKIADNKDYRVEDLLKAVAQQSD   300

Query: 301 NVATNMLGYYVNNQYDSMFQTQVDTISGMHWDMKKRQISPQAAGKMMEAIYYQNGDIVNY   360
           NVATN+LGYY+ +QYD  F++++   +SG+ WDM++R ++  ++A  MMEAIY+Q G I++Y
Sbjct: 301 NVATNILGYYLCHQYDKAFRSEIKALSGIDWDMEQRLLTSRSAANMMEAIYHQKGQIISY   360

Query: 361 LSKTDFDNTRIPKNIPVKVAHKIGDAYDYKHDAAIVYAEQPFIMIIFTDKSSYDDITKIA   420
           LS T+FD  RI  KNA V VAHKIGDAYDYKHD AIVY    PFI+ IFT+KS+Y+DIT IA
```

```
                              -continued
Sbjct: 361 LSNTEFDQQRITKNITVPVAHKIGDAYDYKHDVAIVYGNTPFILSIFTNKSTYEDITAIA 420

Query: 421 DDVYQVLK                                                      428
           DDVY +LK
Sbjct: 421 DDVYGILK                                                      428
```

Figure 316:
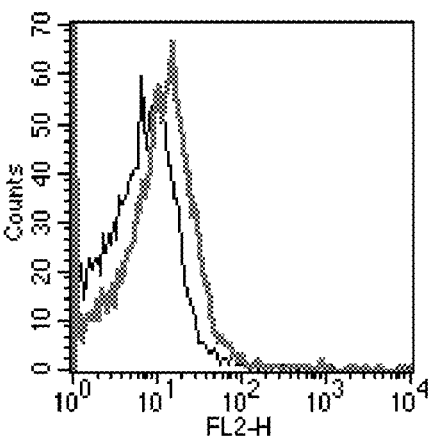

SEQ ID 5152 (GBS116) was expressed in *E. coli* as a His-fusion product. SDS-PAGE analysis of total cell extract is shown in FIG. 38 (lane 3; MW 48.5 kDa). The GBS116-His fusion product was purified (FIG. 202, lane 6) and used to immunise mice. The resulting antiserum was used for FACS (FIG. 316), which confirmed that the protein is immunoaccessible on GBS bacteria.

Based on this analysis, it was predicted that these proteins and their epitopes could be useful antigens for vaccines or diagnostics.

EXAMPLE 1663

A DNA sequence (GBSx1758) was identified in *S. agalactiae* <SEQ ID 5155> which encodes the amino acid sequence <SEQ ID 5156>. Analysis of this protein sequence reveals the following:

```
Possible site: 28
>>> Seems to have no N-terminal signal sequence

----- Final Results -----
bacterial cytoplasm --- Certainty = 0.2260 (Affirmative) <succ>
 bacterial membrane --- Certainty = 0.0000 (Not Clear)   <succ>
  bacterial outside --- Certainty = 0.0000 (Not Clear)   <succ>
```

The protein has homology with the following sequences in the GENPEPT database.

```
>GP:AAD35664 GB:AE001733 conserved hypothetical protein
[Thermotoga maritima]
Identities = 100/404 (24%), Positives = 181/404 (44%), Gaps = 61/404 (15%)

Query:  19 QKVLIAVSGGIDSINLLQFLYQYQKELSISIGIAHINHGQRKESEKEEEYIRQWGQIHDV    78
           + VL+AVSGGIDS+ LL   L ++    L I I   AH++H  R+ S ++ E++ +   + ++
Sbjct:   6 EHVLVAVSGGIDSMTLLYVLRKFSPLLKIKITAAHLDHRIRESSRRDREFVERICRQWNI    65

Query:  79 PVFISYF--------QGIFSEDRARNHRYNFFSKVMREEGYTALVTAHHADDQAETVFMR   130
           PV  S          G    E+ AR  RY+F  +  ++ G + +   AHH +D  ETV  R
Sbjct:  66 PVETSEVDVPSLWKDSGKTLEEIAREVRYDFLKRTAKKVGASKIALAHHKNDLLETVVHR   125

Query: 131 ILRGSRLRYLSGIKQVSAFANGQLIRPFLPYKKELLP------NIFHFEDASNASSDYLR   184
           ++RG+    L+ I          + IRPFL +K+  +         N+   D +N +  Y R
Sbjct: 126 LIRGTGPLGLACISP----KREEFIRPFLVFKRSEIEEYARKNNVPYVVDETNYNVKYTR   181

Query: 185 NRIRNVYFPALERENNQLKDSLITLSEETECLFTALTDLTRSIEVTNCYDF---------   235
           N IR+   P ++ N  ++D++ L    T L   +      N Y +
Sbjct: 182 NFIRHRIVPLMKELNPTVEDAVYRLVSVTHLLRNFVERTVQDFVERNVYFYKDYAVFVEP   241

Query: 236 --LRQTHSVQEFLLQDYISKFPDLQVSKEQFRVILKLIRTKANIDYTIKSGYFLHKDYES   293
             L    V ++L++   + P+ +           KLI T  +   + SG F+ + +
Sbjct: 242 EDLFLFLEVTRWVLKEMYGRVPEYE----------KLIGTLKSKRVELWSGIFVERSFGY   291

Query: 294 FHITKIHPKTDSFKVEKRLELHNIQIFSQYLFSYGKFISQADITIPIYDT---SPIILRR   350
           + K      FK + R+E+        G   +    I + +        +R
Sbjct: 292 VAVGK-----TVFKKKYRVEVK-----------GDMLEMEGFKIRVVNNRNDMKFWVRN   334

Query: 351 RKEGDRIFLGNHTKKIRRLFIDEKIT--LKEREEAVIGEQNKEL                 392
           RKEGDRI +     +K++ +FI++K+   ++R  ++ E+++ L
Sbjct: 335 RKEGDRIIVNGRERKLKDVFIEKKVPTFYRDRVPLLVDEEDRVL                 378
```

A related DNA sequence was identified in *S. pyogenes* <SEQ ID 5157> which encodes the amino acid sequence <SEQ ID 5158>. Analysis of this protein sequence reveals the following:

```
Possible site: 33
>>> Seems to have no N-terminal signal sequence

----- Final Results -----
bacterial cytoplasm --- Certainty = 0.2187 (Affirmative) <succ>
 bacterial membrane --- Certainty = 0.0000 (Not Clear)   <succ>
  bacterial outside --- Certainty = 0.0000 (Not Clear)   <succ>
```

An alignment of the GAS and GBS proteins is shown below.

```
Identities = 218/424 (51%), Positives = 290/424 (67%), Gaps = 2/424 (0%)

Query:   2 YNTILKDTLSKGLFTAHQKVLIAVSGGIDSINLLQFLYQYQKELSISIGIAHINHGQRKE   61
           Y  I  +  +K  F  H+ VLIAVSGG+DS+NLL FLY +Q +L I IGIAH+NH QR E
Sbjct:   4 YQEIFNEIKNKAYFKNHRHVLIAVSGGVDSMNLLHFLYLFQDKLKIRIGIAHVNHKQRSE   63

Query:  62 SEKEEEYIRQWGQIHDVPVFISYFQGIFSEDRARNHRYNFFSKVMREEGYTALVTAHHAD  121
           S+ EE Y++ W + HD+P+++S F+GIFSE  AR+ RY FF  +M +  Y+ALVTAHH+D
Sbjct:  64 SDSEEAYLKCWAKKHDIPIYVSNFEGIFSEKAARDWRYAFFKSIMLKNNYSALVTAHHSD  123

Query: 122 DQAETVFMRILRGSRLRYLSGIKQVSAFANGQLIRPFLPYKKELLPNIFHFEDASNASSD  181
           DQAET+ MR++RGSRLR+LSGIK V   FANGQLIRPFL + K+ LP IFHFED+SN
Sbjct: 124 DQAETILMRLIRGSRLRHLSGIKSVQPFANGQLIRPFLTFSKKDLPEIFHFEDSSNRELS  183

Query: 182 YLRNRIRNVYFPALERENNQLKDSLITLSEETECLFTALTDLTRSIEVTNCYDFLRQTHS  241
           +LRNR+RN Y P L++EN +    L  L+E    LF A  +LT  I  T+   +F  Q+ S
Sbjct: 184 FLRNRVRNNYLPLLKQENPRFIQGLNQLALENSLLFQAFKELTNHITTTDLTEFNEQSKS  243

Query: 242 VQEFLLQDYISKFPDLQVSKEQFRVILKLIRTKANIDYTIKSGYFLHKDYESFHITKIHP  301
           +Q FLLQDY+   FPDL + K QF  +L++I+T     Y +K  Y++  D  SF ITKI P
Sbjct: 244 IQYFLLQDYLEGFPDLDLKKSQFTQLLQIIQTAKQGYYYLKKDYYIFIDKFSFKITKIVP  303

Query: 302 KTDSFKVEKRLELHNIQIFSQYLFSY--GKFISQADITIPIYDTSPIILRRRKEGDRIFL  359
           KT+  K EK LE  +    + Y FS+     Q ++IP++  S I LR R+ GD I
Sbjct: 304 KTELVKEEKMLEYDSNLCYRDYYFSFMPKSNEDQGQVSIPLFSLSSIKLRSRQSGDYISF  363

Query: 360 GNHTKKIRRLFIDEKITLKEREEAVIGEQNKELIFVIVAGRTYLRKPSEHDIMKGKLYIE  419
           G+ +KKIRRLFIDEK T+ ER+ A+IGEQ++++IFV++  +TYLRK  +HDIM  KLYI+
Sbjct: 364 GHFSKKIRRLFIDEKFTIAERQNAIIGEQDEQIIFVLIGNKTYLRKACKHDIMLAKLYID  423

Query: 420 NLEK                                                          423
            LEK
Sbjct: 424 KLEK                                                          427
```

Based on this analysis, it was predicted that these proteins and their epitopes could be useful antigens for vaccines or diagnostics.

EXAMPLE 1664

A DNA sequence (GBSx1759) was identified in *S. agalactiae* <SEQ ID 5159> which encodes the amino acid sequence <SEQ ID 5160>. This protein is predicted to be hypoxanthine-guanine phosphoribosyltransferase (hpt). Analysis of this protein sequence reveals the following:

```
Possible site: 50
>>> Seems to have no N-terminal signal sequence
INTEGRAL   Likelihood = -0.32   Transmembrane 37-53 (37-53)

----- Final Results -----
 bacterial membrane --- Certainty = 0.1128 (Affirmative) <succ>
  bacterial outside --- Certainty = 0.0000 (Not Clear)   <suco>
bacterial cytoplasm --- Certainty = 0.0000 (Not Clear)   <succ>
```

The protein has homology with the following sequences in the GENPEPT database.

```
>GP:CAA48876 GB:X69123 hypoxanthine guanine phosphoribosyltransferase
[Lactococcus lactis]
Identities = 121/179 (67%), Positives = 152/179 (84%), Gaps = 1/179 (0%)

Query:    2 LENDIKKVLYSEEDIILKTKELGAKLTADYAGKNPLLVGVLKGSVPFMAELLKHIDTHVE   61
            L+  I+KVL SEE+II K+KELG  LT +Y GKNPL++G+L+GSVPF+AEL+KHID H+E
Sbjct:    6 LDKAIEKVLSEEEIIEKSKELGEILTKEYEGKNPLVLGILRGSVPFLAELIKHIDCHLE   65

Query:   62 IDFMVVSSYHGGTTSSGEVKILKDVDTNIEGRDVIFIEDIIDTGRTLKYLRDMFKYRQAN  121
             DFM VSSYHGGT SSGEVK++ DVDT ++GRD++ +EDIIDTGRTLKYL+++ ++R AN
Sbjct:   66 TDFMTVSSYHGGTKSSGEVKLILDVDTAVKGRDILIVEDIIDTGRTLKYLKELLEHRGAN  125

Query:  122 SVKVATLFDKPEGRLVDIDADYVCYDIPNEFIVGFGLDYAENYRNLPYVGVLKEEIYSK   180
            VK+ TL DKPEGR+V+I  DY  + IPNEF+VGFGLDY ENYRNLPYVGVLK E+Y+K
Sbjct:  126 -VKIVTLLDKPEGRIVEIKPDYSGFTIPNEFVVGFGLDYEENYRNLPYVGVLKPEVYNK  183
```

A related DNA sequence was identified in *S. pyogenes* <SEQ ID 5161> which encodes the amino acid sequence <SEQ ID 5162>. Analysis of this protein sequence reveals the following:

```
Possible site: 52
>>> Seems to have no N-terminal signal sequence

----- Final Results -----
bacterial cytoplasm --- Certainty = 0.4095 (Affirmative) <succ>
 bacterial membrane --- Certainty = 0.0000 (Not Clear)   <succ>
  bacterial outside --- Certainty = 0.0000 (Not Clear)   <succ>
```

An alignment of the GAS and GBS proteins is shown below.

```
Identities = 153/180 (85%), Positives = 171/180 (95%)

Query:    1 MLENDIKKVLYSEEDIILKTKELGAKLTADYAGKNPLLVGVLKGSVPFMAELLKHIDTHV   60
            MLE DI+K+LYSE DII KTK+LG +LT DY  KNPL++GVLKGSVPFMAEL+KHIDTHV
Sbjct:    1 MLEQDIQKILYSENDIIRKTKKLGEQLTKDYQEKNPLMIGVLKGSVPFMAELMKHIDTHV   60

Query:   61 EIDFMVVSSYHGGTTSSGEVKILKDVDTNIEGRDVIFIEDIIDTGRTLKYLRDMFKYRQA  120
            EIDFMVVSSYHGGT+SSGEVKILKDVDTNIEGRD+I +EDIIDTGRTLKYLRDMFKYR+A
Sbjct:   61 EIDFMVVSSYHGGTSSSGEVKILKDVDTNIEGRDIIIVEDIIDTGRTLKYLRDMFKYRKA  120

Query:  121 NSVKVATLFDKPEGRLVDIDADYVCYDIPNEFIVGFGLDYAENYRNLPYVGVLKEEIYSK  180
            N++K+ATLFDKPEGR+V  I+ADYVCY+IPNEFIVGFGLDYAENYRNLPYVGVLKEE+YSK
Sbjct:  121 NTIKIATLFDKPEGRVVKIEADYVCYNIPNEFIVGFGLDYAENYRNLPYVGVLKEEVYSK  180
```

Based on this analysis, it was predicted that these proteins and their epitopes could be useful antigens for vaccines or diagnostics.

EXAMPLE 1665

A DNA sequence (GBSx1760) was identified in *S. agalactiae* <SEQ ID 5163> which encodes the amino acid sequence <SEQ ID 5164>. This protein is predicted to be cell division protein FtsH (ftsH). Analysis of this protein sequence reveals the following:

```
Possible site: 25
>>> Seems to have an uncleavable N-term signal seq
INTEGRAL    Likelihood = -7.11  Transmembrane 139-155 (133-158)
INTEGRAL    Likelihood = -4.62  Transmembrane   8-24    (7-31)

----- Final Results -----
 bacterial membrane --- Certainty = 0.3845 (Affirmative) <succ>
  bacterial outside --- Certainty = 0.0000 (Not Clear)   <succ>
bacterial cytoplasm --- Certainty = 0.0000 (Not Clear)   <succ>
```

The protein has homology with the following sequences in the GENPEPT database.

```
>GP: AAC16243 GB: AF061748 cell division protein FtsH
[Streptococcus pneumoniae] (ver 2)
Identities = 490/652 (75%), Positives = 561/652 (85%),
Gaps = 5/652 (0%)

Query:     5 KNNGFLKNSFIYILLIIAVITTFQYYLKGTSSQ-NQQISYTKLVKQLKAGEIKSISYQPS    63
             +NNG +KN F+++L I  ++T FQY+  G +S  +QQI+YT+LV+++  G +K ++YQP+
Sbjct:     4 QNNGLIKNPFLWLLFIFFLVTGFQYFYSGNNSGGSQQINYTELVQEITDGNVKELTYQPN   63

Query:    64 GGVVEVSGTYKKAKTIKSANSFTFLGGSVATKVTGFNSVILPNDSSIKSLVSAAEENNTN  123
                G V+EVSG YK   KT K      F    SV TKV  F S ILP D+++  L   A ++
Sbjct:    64 GSVIEVSGVYKNPKTSKEGTGIQFFTPSV-TKVEKFTSTILPADTTVSELQKLATDHKAE  122

Query:   124 IQVKHESSSGTWISYIASFLPLVIMIGFFMMMMNQGGGGGARGAMSFGKNKARSSSKDEV  183
               + VKHESSSG WI+ + S +P  I+  F      MM   GGG  R  MSFG++KA++++K+++
Sbjct:   123 VTVKHESSSGIWINLLVSIVPFGILFFFLFSMMGNMGGGNGRNPMSFGRSKAKAANKEDI  182

Query:   184 KVRFSDVAGAEEEKQELIEVVDFLKDPKRYKSLGARIPAGVLLEGPPGTGKTLLAKAVAG  243
                KVRFSDVAGAEEEKQEL+EVV+FLKDPKR+  LGARIPAGVLLEGPPGTGKTLLAKAVAG
Sbjct:   183 KVRFSDVAGAEEEKQELVEVVEFLKDPKRFTKLGARIPAGVLLEGPPGTGKTLLAKAVAG  242

Query:   244 EAGVPFFSISGSDFVEMFVGVGASRVRSLFEDAKKAERAIIFIDEIDAVGRRRGAGMGGG  303
                EAGVPFFSISGSDFVEMFVGVGASRVRSLFEDAKKA  AIIFIDEIDAVGR+RG  G+GGG
Sbjct:   243 EAGVPFFSISGSDFVEMFVGVGASRVRSLFEDAKKAAPAIIFIDEIDAVGRQRGVGLGGG  302

Query:   304 NDEREQTLNQLLIEMDGFEGNESIIVIAATNRSDVLDPALLRPGRFDRKVLVGQPDVKGR  363
                NDEREQTLNQLLIEMDGFEGNE IIVIAATNRSDVLDPALLRPGRFDRKVLVG+PDVKGR
Sbjct:   303 NDEREQTLNQLLIEMDGFEGNEGIIVIAATNRSDVLDPALLRPGRFDRKVLVGRPDVKGR  362

Query:   364 EAILRVHAKNKPLADNVDLKVVAQQTPGFVGADLENVLNEAALVAARRNKKVIDASDIDE  423
                EAIL+VHAKNKPLA++VDLK+VAQQTPGFVGADLENVLNEAALVAARRNK +IDASDIDE
Sbjct:   363 EAILKVHAKNKPLAEDVDLKLVAQQTPGFVGADLENVLNEAALVAARRNKSIIDASDIDE  422

Query:   424 AEDRVIAGPSKKDRTISERERAMVAYHEAGHTIVGLILSNARVVHKVTIVPRGRAGGYMI  483
                AEDRVIAGPSKKD+T+S++ER +VAYHEAGHTIVGL+LSNARVVHKVTIVPRGRAGGYMI
Sbjct:   423 AEDRVIAGPSKKDKTVSQKERELVAYHEAGHTIVGLVLSNARVVHKVTIVPRGRAGGYMI  482

Query:   484 ALPKEDQMLLSKDDMKEQLAGLMGGRVAEEIIFNAQTTGASNDFEQATAMARAMVTEYGM  543
                ALPKEDQMLLSK+DMKEQLAGLMGGRVAEEIIFN QTTGASNDFEQAT MARAMVTEYGM
Sbjct:   483 ALPKEDQMLLSKEDMKEQLAGLMGGRVAEEIIFNVQTTGASNDFEQATQMARAMVTEYGM  542

Query:   544 SEKLGPVQYEGNHAMMAGQMSPEKSYSAQTAQLIDDEVRHLLNEARNKAADIINENRDTH  603
                SEKLGPVQYEGNHAM+ G  SP+KS S QTA  ID+EVR LLNEARNKAA+II  NR+TH
Sbjct:   543 SEKLGPVQYEGNHAML-GAQSPQKSISEQTAYEIDEEVRSLLNEARNKAAEIIQSNRETH  601

Query:   604 KLIAEALLKYETLDAAQIKSIFETGKMPETENDEDKARALSYDEIKEKMQEE         655
                KLIAEALLKYETLD+ QIK+++ETGKMPE   E+++ ALSYDE+K KM +E
Sbjct:   602 KLIAEALLKYETLDSTQIKALYETGKMPEAV--EEESHALSYDEVKSKMNDE         651
```

A related DNA sequence was identified in *S. pyogenes* <SEQ ID 5165> which encodes the amino acid sequence <SEQ ID 5166>. Analysis of this protein sequence reveals the following:

```
Possible site: 38
>>> Seems to have a cleavable N-term signal seq.
   INTEGRAL     Likelihood = -7.38    Transmembrane     138-154 (132-158)

----- Final Results -----
              bacterial membrane --- Certainty = 0.3951(Affirmative) < succ>
               bacterial outside --- Certainty = 0.0000(Not Clear)   < succ>
              bacterial cytoplasm --- Certainty = 0.0000(Not Clear)   < succ>
```

The protein has homology with the following sequences in the databases:

```
>GP: AAC16243 GB: AF061748 cell division protein FtsH
[Streptococcus pneumoniae] (ver 2)
Identities = 487/654 (74%), Positives = 565/654 (85%),
Gaps = 7/654 (1%)

Query:     5 KNNGFVKNSFIYILMIIVVITGFQFYLKGTSTQ-SQQISYSKLIKHLKAGDIKSLSYQPS   63
             +NNG +KN F+++L I  ++TGFQ++  G ++  SQQI+Y++L++  +  G++K L+YQP+
```

```
                    -continued
Sbjct:    4 QNNGLIKNPFLWLLFIFFLVTGFQYFYSGNNSGGSQQINYTELVQEITDGNVKELTYQPN     63

Query:   64 GSIIEVKGKYEKPQKVTVNSGLSFLGGRASTQVTEFSSLVLPSDTILKEMTAAADKNGTE    123
            GS+IEV G Y+ P+       +G+ F      T+V +F+S +LP+DT + E+   A  + E
Sbjct:   64 GSVIEVSGVYKNPKTSKEGTGIQFFTPSV-TKVEKFTSTILPADTTVSELQKLATDHKAE    122

Query:  124 LTVKQESSSGTWITFLMSFLPIVIFAAFMMMMM-NQGGGGARGAMSFGKNKAKSQSKGNV    182
            +TVK ESSSG WI  L+S +P  I    F+  MM N GGG  R  MSFG++KAK+ +K ++
Sbjct:  123 VTVKHESSSGIWINLLVSIVPFGILFFFLFSMMGNMGGGNGRNPMSFGRSKAKAANKEDI    182

Query:  183 KVRFTDVAGAEEEKQELVEVVDFLKNPKKYKSLGARIPAGVLLEGPPGTGKTLLAKAVAG    242
            KVRF+DVAGAEEEKQELVEVV+FLK+PK++  LGARIPAGVLLEGPPGTGKTLLAKAVAG
Sbjct:  183 KVRFSDVAGAEEEKQELVEVVEFLKDPKRFTKLGARIPAGVLLEGPPGTGKTLLAKAVAG    242

Query:  243 EAGVPFFSISGSDFVEMFVGVGASRVRSLFEDAKKAERAIIFIDEIDAVGRRRGAGMGGG    302
            EAGVPFFSISGSDFVEMFVGVGASRVRSLFEDAKKA  AIIFIDEIDAVGR+RG G+GGG
Sbjct:  243 EAGVPFFSISGSDFVEMFVGVGASRVRSLFEDAKKAAPAIIFIDEIDAVGRQRGVGLGGG    302

Query:  303 NDEREQTLNQLLIEMDGFEGNENIIVIAATNRSDVLDPALLRPGRFDRKVLVGRPDVKGR    362
            NDEREQTLNQLLIEMDGFEGNE IIVIAATNRSDVLDPALLRPGRFDRKVLVGRPDVKGR
Sbjct:  303 NDEREQTLNQLLIEMDGFEGNEGIIVIAATNRSDVLDPALLRPGRFDRKVLVGRPDVKGR    362

Query:  363 EAILRVHAKNKPLANDVNLKVVAQQTPGFVGADLENVLNEAALVAARRNKIKIDASDIDE    422
            EAIL+VHAKNKPLA DV+LK+VAQQTPGFVGADLENVLNEAALVAARRNK  IDASDIDE
Sbjct:  363 EAILKVHAKNKPLAEDVDLKLVAQQTPGFVGADLENVLNEAALVAARRNKSIIDASDIDE    422

Query:  423 AEDRVIAGPSKKDRTISQKEREMVAYHEAGHTIVGLVLSNARVVHKVTIVPRGRAGGYMI    482
            AEDRVIAGPSKKD+T+SQKERE+VAYHEAGHTIVGLVLSNARVVHKVTIVPRGRAGGYMI
Sbjct:  423 AEDRVIAGPSKKDKTVSQKERELVAYHEAGHTIVGLVLSNARVVHKVTIVPRGRAGGYMI    482

Query:  483 ALPKEDQMLLSKEDLKEQLAGLMGGRVAEEIVFNAQTSGASNDFEQATQIARAMVTEYGM    542
            ALPKEDQMLLSKED+KEQLAGLMGGRVAEEI+FN QT+GASNDFEQATQ+ARAMVTEYGM
Sbjct:  483 ALPKEDQMLLSKEDMKEQLAGLMGGRVAEEIIFNVQTTGASNDFEQATQMARAMVTEYGM    542

Query:  543 SEKLGPVQYEGNHAMMPGQISPEKAYSAQTAQMIDDEVRELLNQARNQAADIINENRDTH    602
            SEKLGPVQYEGNHAM+  Q SP+K+ S QTA   ID+EVR LLN+ARN+AA+II  NR+TH
Sbjct:  543 SEKLGPVQYEGNHAMLGAQ-SPQKSISEQTAYEIDEEVRSLLNEARNKAAEIIQSNRETH    601

Query:  603 KLIAEALLKYETLDAAQIKSIYETGKMPVDLETDDNEAHALSYDEIKNKMTESE         656
            KLIAEALLKYETLD+ QIK++YETGKMP   E  E+HALSYDE+K+KM + +
Sbjct:  602 KLIAEALLKYETLDSTQIKALYETGKMP---EAVEEESHALSYDEVKSKMNDEK         652
                                          35
```

An alignment of the GAS and GBS proteins is shown below.

```
Identities = 550/657 (83%), Positives = 612/657 (92%),
Gaps = 2/657 (0%)

Query:    1 MKNNKNNGFLKNSFIYILLIIAVITTFQYYLKGTSSQNQQISYTKLVKQLKAGEIKSISY     60
            MKNNKNNGF+KNSFIYIL+II VIT FQ+YLKGTS+Q+QQISY KL+K LKAG+IKS SY
Sbjct:    1 MKNNKNNGFVKNSFIYILMIIVVITGFQFYLKGTSTQSQQISYSKLIKHLKAGDIKSLSY     60

Query:   61 QPSGGVVEVSGTYKKAKTIKSANSFTFLGGSVATKVTGFNSVILPNDSSIKSLVSAAEEN    120
            QPSG ++EV G Y+K + +   + +FLGG +T+VT F+++LP+D+ +K  +AA++N
Sbjct:   61 QPSGSIIEVKGKYEKPQKVTVNSGLSFLGGRASTQVTEFSSLVLPSDTILKEMTAAADKN    120

Query:  121 NTNIQVKHESSSGTWISYIASFLPLVIMIGFFMMMMNQGGGGARGAMSFGKNKARSSSK    180
             T + VK ESSSGTWI+++ SFLP+VI   F MMMMNQGGGG ARGAMSFGKNKA+S SK
Sbjct:  121 GTELTVKQESSSGTWITFLMSFLPIVIFAAFMMMMMNQGGGG-ARGAMSFGKNKAKSQSK    179

Query:  181 DEVKVRFSDVAGAEEEKQELIEVVDFLKDPKRYKSLGARIPAGVLLEGPPGTGKTLLAKA    240
              VKVRF+DVAGAEEEKQEL+EVVDFLK+PK+YKSLGARIPAGVLLEGPPGTGKTLLAKA
Sbjct:  180 GNVKVRFTDVAGAEEEKQELVEVVDFLKNPKKYKSLGARIPAGVLLEGPPGTGKTLLAKA    239

Query:  241 VAGEAGVPFFSISGSDFVEMFVGVGASRVRSLFEDAKKAERAIIFIDEIDAVGRRRGAGM    300
            VAGEAGVPFFSISGSDFVEMFVGVGASRVRSLFEDAKKAERAIIFIDEIDAVGRRRGAGM
Sbjct:  240 VAGEAGVPFFSISGSDFVEMFVGVGASRVRSLFEDAKKAERAIIFIDEIDAVGRRRGAGM    299

Query:  301 GGGNDEREQTLNQLLIEMDGFEGNESIIVIAATNRSDVLDPALLRPGRFDRKVLVGQPDV    360
            GGGNDEREQTLNQLLIEMDGFEGNE+IIVIAATNRSDVLDPALLRPGRFDRKVLVG+PDV
Sbjct:  300 GGGNDEREQTLNQLLIEMDGFEGNENIIVIAATNRSDVLDPALLRPGRFDRKVLVGRPDV    359

Query:  361 KGREAILRVHAKNKPLADNVDLKVVAQQTPGFVGADLENVLNEAALVAARRNKKVIDASD    420
            KGREAILRVHAKNKPLA++V+LKVVAQQTPGFVGADLENVLNEAALVAARRNK  IDASD
Sbjct:  360 KGREAILRVHAKNKPLANDVNLKVVAQQTPGFVGADLENVLNEAALVAARRNKIKIDASD    419

Query:  421 IDEAEDRVIAGPSKKDRTISERERAMVAYHEAGHTIVGLILSNARVVHKVTIVPRGRAGG    480
            IDEAEDRVIAGPSKKDRTIS++ER MVAYHEAGHTIVGL+LSNARVVHKVTIVPRGRAGG
```

-continued

```
Sbjct:  420 IDEAEDRVIAGPSKKDRTISQKEREMVAYHEAGHTIVGLVLSNARVVHKVTIVPRGRAGG  479

Query:  481 YMIALPKEDQMLLSKDDMKEQLAGLMGGRVAEEIIFNAQTTGASNDFEQATAMARAMVTE  540
            YMIALPKEDQMLLSK+D+KEQLAGLMGGRVAEEI+FNAQT+GASNDFEQAT +ARAMVTE
Sbjct:  480 YMIALPKEDQMLLSKEDLKEQLAGLMGGRVAEEIVFNAQTSGASNDFEQATQIARAMVTE  539

Query:  541 YGMSEKLGPVQYEGNHAMMAGQMSPEKSYSAQTAQLIDDEVRHLLNEARNKAADIINENR  600
            YGMSEKLGPVQYEGNHAMM GQ+SPEK+YSAQTAQ+IDDEVR LLN+ARN+AADIINENR
Sbjct:  540 YGMSEKLGPVQYEGNHAMMPGQISPEKAYSAQTAQMIDDEVRELLNQARNQAADIINENR  599

Query:  601 DTHKLIAEALLKYETLDAAQIKSIFETGKMP-ETENDEDKARALSYDEIKEKMQEED     656
            DTHKLIAEALLKYETLDAAQIKSI+ETGKMP + E D+++A ALSYDEIK KM E +
Sbjct:  600 DTHKLIAEALLKYETLDAAQIKSIYETGKMPVDLETDDNEAHALSYDEIKNKMTESE     656
```

SEQ ID 5164 (GBS115) was expressed in *E. coli* as a His-fusion product. SDS-PAGE analysis of total cell extract is shown in FIG. 35 (lane 8; MW 73 kDa) and in FIG. 39. (lane 3; MW 73.3 kDa).

Based on this analysis, it was predicted that these proteins and their epitopes could be useful antigens for vaccines or diagnostics.

EXAMPLE 1666

A DNA sequence (GBSx1769) was identified in *S. agalactiae* <SEQ ID 5167> which encodes the amino acid sequence <SEQ ID 5168>. Analysis of this protein sequence reveals the following:

```
Possible site: 28
>>> Seems to have no N-terminal signal sequence

----- Final Results -----
            bacterial cytoplasm --- Certainty = 0.2983(Affirmative) < succ>
             bacterial membrane --- Certainty = 0.0000(Not Clear)   < succ>
              bacterial outside --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1667

A DNA sequence (GBSx1770) was identified in *S. agalactiae* <SEQ ID 5169> which encodes the amino acid sequence <SEQ ID 5170>. Analysis of this protein sequence reveals the following:

```
Possible site: 14
>>> Seems to have no N-terminal signal sequence

----- Final Results -----
            bacterial cytoplasm --- Certainty = 0.2424(Affirmative) < succ>
             bacterial membrane --- Certainty = 0.0000(Not Clear)   < succ>
              bacterial outside --- Certainty = 0.0000(Not Clear)   < succ>
```

A related GBS nucleic acid sequence <SEQ ID 9547> which encodes amino acid sequence <SEQ ID 9548> was also identified.

The protein has homology with the following sequences in the GENPEPT database.

```
>GP: CAB12187 GB: Z99106 similar to homoserine dehydrogenase [Bacillus
subtilis]
Identities = 223/448 (49%), Positives = 313/448 (69%)

Query:    1 MKVVKFGGSSLASSQQLYKVLNIIKSDYTRRFVVVSAPGKRYEEDLKMTDALIQYYQNYI   60
            MKVVKFGGSSLAS  QL KV +I+ SD  R+ VVVSAPGK Y ED K+TD LI    + Y+
Sbjct:    1 MKVVKFGGSSLASGAQLDKVFHIVTSDPARKAVVVSAPGKHYAEDTKVTDLLIACAEQYL   60

Query:   61 NGKDIVKDQTWIINRYQEIISDLSLGSTIAEEITRSIEQLASLPIENNQFLYDCFLAAGE  120
               +       ++ RY  I ++L LG +I E+I    + L      N +    D   A+GE
Sbjct:   61 ATGSAPELAEAVVERYALIANELQLGQSIIEKIRDDLFTLLEGDKSNPEQYLDAVKASGE  120

Query:  121 DNNAKLVATFFNQNDIPARYVHPNEAGIIVTKEPCNARIIPGSYDKIENLCLYNEVLVIP  180
              DNNAKL+A +F    + A YV+P +AG+ VT EP NA+++P SY  +   L   + +++ P
Sbjct:  121 DNNAKLIAAYFRYKGVKAEYVNPKDAGLFVTNEPGNAQVLPESYQNLYRLRERDGLIIFP  180

Query:  181 GFFGVTEDNQICTFSRGGSDITGSLIAAGIKADLYENFTDVDGIFAAHPGVVKNPHAIPE  240
              GFFG ++D  +  TFSR GSDITGS++A G++ADLYENFTDVD +++  +P  V+NP  I E
Sbjct:  181 GFFGFSKDGDVITFSRSGSDITGSILANGLQADLYENFTDVDAVYSVNPSFVENPKEISE  240

Query:  241 LTYKEMRELAYAGFSVLHDEALLPAYRGRIPLVIKNTNNPQQPGTKIVLKHTRSNIAVTG  300
              LTY+EMREL+YAGFSV HDEAL+PA+R   IP+ IKNTNNP     GT++V K   +N  V G
Sbjct:  241 LTYREMRELSYAGFSVFHDEALIPAFRAGIPVQIKNTNNPSAEGTRVVSKRDNTNGPVVG  300

Query:  301 IASDSRFASINVSKYLMNREVGFGRKVLQILEDLNISFEHMPTGIDDLSIVLREKELTPI  360
              IASD+  F  SI +SKYLMNRE+GFGR+ LQILE+   +++EH+P+GIDD++I+LR+ ++
Sbjct:  301 IASDTGFCSIYISKYLMNREIGFGRRALQILEEHGLTYEHVPSGIDDMTIILRQGQMDAA  360

Query:  361 KEQEILNYLTRKLEVDYVDIQHNLSTIVIVGENMKSQIGVTATATQALSREKINITMISQ  420
                E+ ++  +    L   D V ++H+L+  I++VGE M+    +G TA A +ALS  ++NI MI+Q
Sbjct:  361 TERSVIKRIEEDLHADEVIVEHHLALIMVVGEAMRHNVGTTARAAKALSEAQVNIEMINQ  420

Query:  421 GSSEVSIMFVINSKDEKRAIKALYETFF                                 448
              GSSEVS+MF +    +E++A++ALY+ FF
Sbjct:  421 GSSEVSMMFGVKEAEERKAVQALYQEFF                                 448
```

No corresponding DNA sequence was identified in *S. pyogenes*.

Based on this analysis, it was predicted that this protein and its epitopes, could be useful antigens for vaccines or diagnostics.

EXAMPLE 1668

A DNA sequence (GBSx1771) was identified in *S. agalactiae* <SEQ ID 5171> which encodes the amino acid sequence <SEQ ID 5172>. This protein is predicted to be CbbY family protein. Analysis of this protein sequence reveals the following:

```
Possible site: 59
>>> Seems to have no N-terminal signal sequence

----- Final Results -----
          bacterial cytoplasm --- Certainty = 0.2699(Affirmative) < succ>
          bacterial membrane  --- Certainty = 0.0000(Not Clear)  < succ>
           bacterial outside  --- Certainty = 0.0000(Not Clear)  < succ>
```

The protein has homology with the following sequences in the GENPEPT database.

```
>GP: AAF96016 GB: AE004353 CbbY family protein [Vibrio cholerae]
Identities = 59/190 (31%), Positives = 93/190 (48%),
Gaps = 10/190 (5%)

Query:     4 YKAIIFDMDGVLFDTELFYYKRRERFLKQHGITIDHLPMNFFIGGNMKQVWKSVLGDQYD    63
             ++A IFDMDG+L DTE    +   +     G+         IG N K +   +L   Y
Sbjct:     6 FQAAIFDMDGLLLDTERVCMRVFQEACTACGLPFRQEVYLSVIGCNAKTI-NGILSQAYG   64

Query:    64 TWDIDKL----QQDYSRYKEDNPLPYKDLIFQDCKRVIEKLHHKGYLLGLASSSTRHDIM   119
              D+ +L    +Q Y+       +P+KD +      ++E L   +  +A+S+  +    +
Sbjct:    65 E-DLPRLHNEWRQRYNAVVMHEAIPHKDGVIA----LLEWLKARSIPVAVATSTQKEVAL  119

Query:   120 LALESFNLDTYFKVILSGEEFSESKPNPAIYNRAAELLDIPKQQILIVEDSEKGITAGIA   179
              + L+   LD YF  I +G E ++ KP+P IY  AAE L +  QQ L   EDS   GI A +A
Sbjct:   120 IKLQLAGLDHYFANITTGCEVTQGKPHPEIYLLAAERLGVEPQQCLAFEDSNNGIKAAMA  179

Query:   180 AGIDVWAIED                                                    189
              A +  + I D
Sbjct:   180 AQMHAFQIPD                                                    189
```

There is also homology to SEQ ID 448.

Based on this analysis, it was predicted that this protein and its epitopes, could be useful antigens for vaccines or diagnostics.

EXAMPLE 1669

A DNA sequence (GBSx1772) was identified in *S. agalactiae* <SEQ ID 5173> which encodes the amino acid sequence <SEQ ID 5174>. This protein is predicted to be *Pseudomonas putida* enoyl-CoA hydratase II homologue (b1394). Analysis of this protein sequence reveals the following:

```
Possible site: 45
>>> Seems to have an uncleavable N-term signal seq
    INTEGRAL    Likelihood = -2.18    Transmembrane    128-144 (128-145)
    INTEGRAL    Likelihood = -1.06    Transmembrane    154-170 (154-170)

----- Final Results -----
              bacterial membrane --- Certainty = 0.1871(Affirmative) < succ>
              bacterial outside  --- Certainty = 0.0000(Not Clear)   < succ>
              bacterial cytoplasm --- Certainty = 0.0000(Not Clear)  < succ>
```

A related GBS nucleic acid sequence <SEQ ID 9549> which encodes amino acid sequence <SEQ ID 9550> was also identified.

A related DNA sequence was identified in *S. pyogenes* <SEQ ID 5175> which encodes the amino acid sequence <SEQ ID 5176>. Analysis of this protein sequence reveals the following:

```
Possible site: 27
>>> Seems to have no N-terminal signal sequence
    INTEGRAL    Likelihood = -3.08    Transmembrane    110-126 (109-128)

----- Final Results -----
              bacterial membrane --- Certainty = 0.2232(Affirmative) < succ>
              bacterial outside  --- Certainty = 0.0000(Not Clear)   < succ>
              bacterial cytoplasm --- Certainty = 0.0000(Not Clear)  < succ>
```

An alignment of the GAS and GBS proteins is shown below.

```
Identities = 150/263 (57%), Positives = 197/263 (74%)

Query:    19 LKFENIIYGIDGNVATIMLNRPDISNGFNIPMCQEIIDAIRLVSENKDVMFLVIEAQGPI    78
             ++F++II+ +  ++AT+ LNRP++SNGFNIP+CQEI+ A+    V  +    V FL+I+A G +
Sbjct:     1 MQFKHIIFDVVDDLATLTLNRPEVSNGFNIPICQEILVALAEVKRDTSVRFLLIKAVGKV    60
```

-continued

```
Query:  79 FSIGGDLKVMKAAVESDDISSLTKIAELVNQISYDLLQLEKPVVMCVDGAVAGAAANIAL  138
           FS+GGDL M+ AV D++ SL KIAELV +IS+ + L KPV++C DGAVAGAA NIAL
Sbjct:  61 FSVGGDLVEMQEAVAKDNVQSLVKIAELVQEISFAIKHLPKPVILCADGAVAGAAFNIAL  120

Query: 139 AADFVIASKKSKFIQAFVGVGLAPDAGGLLLLSKSIGITRAVQLALTGESLSAEKAEALG  198
           A DF IAS ++KFIQAFV VGLAPDAGGL LL++++G+ RA  L +TGE ++A+K    G
Sbjct: 121 AVDFCIASTQTKFIQAFVNVGLAPDAGGLFLLTRAVGLNRATHLVMTGEGITADKGLDYG  180

Query: 199 IVYKLCESDKIGKIKDQLLKRLSRHSINSYQAIKSLAWEAAFKDWEQYKKLELQLQESLA  258
              VY+  ESDK+ K+  QLLKRL R S NSY  +KSL W++ F  WE Y K EL +QE LA
Sbjct: 181 FVYRTAESDKLDKVCLQLLKRLRRGSSNSYAGMKSLVWQSFFTGWEDYAKAELAIQEELA  240

Query: 259 FKQDFKEGVRAHADRRRPNFLGK                                      281
           FK+DFKEGV A  +RRRPNF GK
Sbjct: 241 FKEDFKEGVIAFGERRRPNFQGK                                      263
```

A related GBS gene <SEQ ID 8877> and protein <SEQ ID 8878> were also identified. Analysis of this protein sequence reveals the following:

```
Lipop: Possible site: -1 Crend: 10
SRCFLG: 0
McG: Length of UR: 9
Peak Value of UR: 1.45
Net Charge of CR: -1
McG: Discrim Score: -5.99
GvH: Signal Score (-7.5): -4.37
Possible site: 27
>>> Seems to have no N-terminal signal sequence
Amino Acid Composition: calculated from 1
ALOM program count: 2         value: -2.18 threshold: 0.0
INTEGRAL Likelihood = -2.18 Transmembrane 110-126 (110-127)
INTEGRAL Likelihood = -1.06 Transmembrane 136-152 (136-152)
PERIPHERAL Likelihood = 1.32  49
modified ALOM score: 0.94
icm1 HYPID: 7 CFP: 0.187

*** Reasoning Step: 3

----- Final Results -----
bacterial membrane --- Certainty = 0.1871 (Affirmative) < succ>
bacterial outside  --- Certainty = 0.0000 (Not Clear)  < succ>
bacterial cytoplasm --- Certainty = 0.0000 (Not Clear) < succ>
```

The protein has homology with the following sequences in the databases:

```
ORF01047(355-1143 of 1443)
GP|3253198|gb|AAC24330.1||AF029714(1-263 of 263) PhaB {Pseudomonas putida}
% Match = 15.4
% Identity = 33.3   % Similarity = 56.4
Matches = 88   Mismatches = 113   Conservative Sub.s = 61
      96         126         156         186         216         246         276         306
*KTVRRGLQLVLQPVLMCGLLKINTLE*ISRRLMY**AI*VNPL*N*ITIKNGKFNSVFLFFILP*KLGL**NTKHDNLI
     336         366         396         426         456         486         516         546
IKLFFIFLSLLKRGDILKFENIIYGIDGNVATIMLNRPDISNGFNIPMCQEIIDAIRLVSENKDVMFLVIEAQGPIFSIG
                                        : |::|:: |:  ||  :|||:   ||| |  |: :|::  |: :    |:: |:|     |  |
                         MTFQHILFSIEDGVAFLSLNRPEQLNSFNAAMHLEVREALKQVRQSSDARVLLLTAEGRGFCAG
                                      10           20          30          40          50          60
     576         606         636         666         696         726         756         786
GDLKVMKAAVESDDISSLTKIAELVNQISYDLLQLEKPVVMCVDGAVAGAAANIALAADFVIASKKSKFIQAFVGVGLAP
||       |  | :::  |:  |  |    |    | :|     ||    |: ||| |  |:   : | ||||:   :||
QDLSDRNVAPDAEVPDLGESIDKFYNPLVRTLRDLPLPVICAVNGVAAGAGANIPLACDLVLAGRSASFIQAFCKIGLVP
          80          90         100         110         120         130         140
     816         846         876         906         936         966         996        1026
DAGGLLLLSKSIGITRAVQLALTGESLSAEKAEALGIVYKLCESDKIGKIKDQLLKRLSRHSINSYQAIKSLAWEAAFKD
|:|| || : :| ||  ||: || || ||||: |:::::: :  :         |::|: :  ||  : :|: :
DSGGTWLLPRLVGMARAKALAMLGERLGAEQAQQWGLIHRVVDDAALRDEALTLARQLASQPTYGLALIK-RSLNASFDN
         160         170         180         190         200         210         220
    1053        1083        1113        1143        1173        1203        1233        1263
-WEQYKKLELQLQESLAFKQDFKEGVRAHADRRRPNFLGK*FENQII*D*SLANKFEL*YNLIIKV*CEVVISWNTIRLI
 ::: :||  ||         :|::|||    |   :: |    |  |:
GFEDQLELERDLQRLAGRSEDYREGVSAFMNKRTPAFKGR
         240         250         260
```

SEQ ID 8878 (GBS374) was expressed in *E. coli* as a His-fusion product. SDS-PAGE analysis of total cell extract is shown in FIG. 64 (lane 8; MW 32 kDa). It was also expressed in *E. coli* as a GST-fusion product. SDS-PAGE analysis of total cell extract is shown in FIG. 71 (lane 2; MW 57 kDa).

Figure 307:
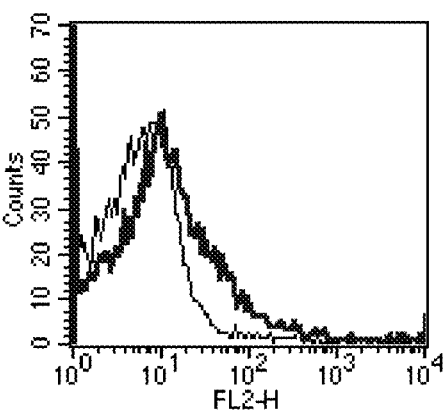

The GBS374-GST fusion product was purified (FIG. 215, lane 9) and used to immunise mice. The resulting antiserum was used for FACS (FIG. 307), which confirmed that the protein is immunoaccessible on GBS bacteria.

Based on this analysis, it was predicted that these proteins and their epitopes could be useful antigens for vaccines or diagnostics.

EXAMPLE 1670

A DNA sequence (GBSx1773) was identified in *S. agalactiae* <SEQ ID 5177> which encodes the amino acid sequence <SEQ ID 5178>. This protein is predicted to be a 16.1 kDa transcriptional regulator. Analysis of this protein sequence reveals the following:

```
Possible site: 56
>>> Seems to have no N-terminal signal sequence

----- Final Results -----
bacterial cytoplasm --- Certainty = 0.1738 (Affirmative) < succ>
bacterial membrane  --- Certainty = 0.0000 (Not Clear)   < succ>
bacterial outside   --- Certainty = 0.0000 (Not Clear)   < succ>
```

The protein has homology with the following sequences in the GENPEPT database.

```
>GP: AAD05186 GB: AF110185 unknown [Burkholderia pseudomallei]
Identities = 30/102 (29%), Positives = 60/102 (58%)

Query: 32 DVSLKEMHTIEIIGKHSEVTPSDVARELMLTGTVTTSLNKLEKKGYIERKRSSIDRRVV    91
             +++ +++   I ++ +     TP +++R+L    G++T  L++LEKKG++ R RS   DRRV+
Sbjct: 39 ELTAQQISVILLLARGYARTPFELSRKLSYDSGSMTRMLDRLEKKGFVVRARSESDRRVI   98

Query: 92 HLSLTKRGRLLDRLHSKFHKSMVSHIIEDLGEEDIKMLTSAL                   133
             L+LT+RG   R      + ++  +E    +++ +LT  L
Sbjct: 99 ELALTERGAHAARALPALIATELNAQLEGFSADELALLTDLL                  140
```

A related DNA sequence was identified in *S. pyogenes* <SEQ ID 5179> which encodes the amino acid sequence <SEQ ID 5180>. Analysis of this protein sequence reveals the following:

```
Possible site: 42
>>> Seems to have no N-terminal signal sequence

----- Final Results -----
bacterial cytoplasm --- Certainty = 0.1412 (Affirmative) < succ>
bacterial membrane  --- Certainty = 0.0000 (Not Clear)   < succ>
bacterial outside   --- Certainty = 0.0000 (Not Clear)   < succ>
```

An alignment of the GAS and GBS proteins is shown below.

```
Identities = 111/144 (77%), Positives = 129/144 (89%)

Query:   1 HEYDQINSYLVDIFNRIMIIEEMSLKTSQFSDVSLKEMHTIEIIGKHSEVTPSDVARELM   60
             +EYD+I   YLVDIFNRI++IEEMSLKTSQFSDVSLKEMHTIEIIGK+ +VTPSD+ARELM
Sbjct:   7 LEYDKIYPYLVDIFNRILVIEEMSLKTSQFSDVSLKEMHTIEIIGKYDQVTPSDIARELM   66

Query:  61 LTLGTVTTSLNKLEKKGYIERKRSSIDRRVVHLSLTKRGRLLDRLHSKFHKSMVSHIIED  120
             +TLGTVTTSLNKLE KGYI R RS   DRRV++LSLTKRGRLLDRLH+KFHK+MV H+I D
Sbjct:  67 VTLGTVTTSLNKLEAKGYIARTRSRSDRRVVYLSLTKRGRLLDRLHAKFHKNMVGHVIAD  126

Query: 121 LGEEDIKMLTSALGNLHKFLEDLV                                    144
             +  +E+++ L     LGNLH+FLEDLV
Sbjct: 127 MSDEEMQALVRGLGNLHQFLEDLV                                    150
```

Based on this analysis, it was predicted that these proteins and their epitopes could be useful antigens for vaccines or diagnostics.

EXAMPLE 1671

A DNA sequence (GBSx1774) was identified in *S. agalactiae* <SEQ ID 5181> which encodes the amino acid sequence <SEQ ID 5182>. This protein is predicted to be 3-oxoacyl-(acyl-carrier-protein) synthase III (fabH-2). Analysis of this protein sequence reveals the following:

```
Possible site: 15
>>> Seems to have no N-terminal signal sequence
INTEGRAL Likelihood = 1.12  Transmernbrane 103-119 (103-119)

----- Final Results -----
bacterial membrane --- Certainty = 0.1447 (Affirmative) < succ>
bacterial outside  --- Certainty = 0.0000 (Not Clear)   < succ>
bacterial cytoplasm --- Certainty = 0.0000 (Not Clear)  < succ>
```

The protein has homology with the following sequences in the GENPEPT database.

```
>GP: AAF98271 GB: AF197933 beta-ketoacyl-ACP synthase III
[Streptococcus pneumoniae]
Identities = 225/324 (69%), Positives = 276/324 (84%), Gaps = 1/324 (0%)

Query:    1 MVFAKISQLAHYAPSQIIKNEDLSLIMDTSDDWISSRTGIKQRHISKNETTADLANKVAE   60
            M FAKISQ+AHY P Q++ N DL+ IMDT+D+WISSRTGI+QRHIS+ E+T+DLA +VA+
Sbjct:    1 MAFAKISQVAHYVPEQVVTNHDLAQIMDTNDEWISSRTGIRQRHISRTESTSDLATEVAK   60

Query:   61 QLIEKSGYSASQIDFIIVATMTPDSMMPSTAARVQAHIGASNAFAFDLSAACSGFVFALS  120
            +L+ K+G +   ++DFII+AT+TPDSMMPSTAARVQA+IGA+  AFAFDL+AACSGFVFALS
Sbjct:   61 KLMAKAGITGEELDFIILATITPDSMMPSTAARVQANIGANKAFAFDLTAACSGFVFALS  120

Query:  121 TAEKLISSGSYQKGLVIGAETVSKVLDWTDRGTAVLFGDGAGGVLLEASKEKHFLAESLN  180
            TAEK I+SG +QKGLVIG+ET+SK +DW+DR TAVLFGDGAGGVLLEAS+++HFLAESLN
Sbjct:  121 TAEKFIASGRFQKGLVIGSETLSKAVDWSDRSTAVLFGDGAGGVLLEASEQEHFLAESLN  180

Query:  181 TDGSR-QGLQSSQVGLNSPFSDEVLDDKFLKNDGRAIFDFAIKEVSKSINHLIETSYLEK  239
            +DGSR + L     GL+SPFSD+   D FLKMDGR +FDFAI++V+KSI   I+ S +E
Sbjct:  181 SDGSRSECLTYGHSGLHSPFSDQESADSFLKMDGRTVFDFAIRDVAKSIKQTIDESPIEV  240

Query:  240 EDIDYLFLHQANRRILDKMSRKIDIARDKFPENMMDYGNTSAASIPILLSESYENGLLKL  299
            +D+DYL LHQAN RILDKM+RKI + R K P NMM+YGNTSAASIPILLSE  E GL+ L
Sbjct:  241 TDLDYLLLHQANDRILDKMARKIGVDRAKLPANMMEYGNTSAASIPILLSECVEQGLIPL  300

Query:  300 DGNQTILLSGFGGGLTWGSLIVKI                                     323
            DG+QT+LLSGFGGGLTWG+LI+ I
Sbjct:  301 DGSQTVLLSGFGGGLTWGTLILTI                                     324
```

A related DNA sequence was identified in *S. pyogenes* <SEQ ID 5183> which encodes the amino acid sequence <SEQ ID 5184>. Analysis of this protein sequence reveals the following:

```
Possible site: 61
>>> Seems to have no N-terminal signal sequence
    INTEGRAL    Likelihood = -0.16     Transmembrane    103-119 (103-120)

----- Final Results -----
              bacterial membrane --- Certainty = 0.1065(Affirmative) < succ>
                bacterial outside --- Certainty = 0.0000(Not Clear)   < succ>
              bacterial cytoplasm --- Certainty = 0.0000(Not Clear)   < succ>
```

The protein has homology with the following sequences in the databases:

```
>GP:AAF98271 GB:AF197933 beta-ketoacyl-ACP synthase III
[Streptococcus pneumoniae]
Identities = 212/324 (65%), Positives = 263/324 (80%)

Query:    1  MIFSKISQVAHYVPQQLVTNNDLASIMDTSHEWIFSRTGIAERHISRDEMTSDLAIQVAD    60
             M F+KISQVAHYVP+Q+VTN+DLA IMDT+ EWI SRTGI +RHISR E TSDLA +VA
Sbjct:    1  MAFAKISQVAHYVPEQVVTNHDLAQIMDTNDEWISSRTGIRQRHISRTESTSDLATEVAK    60

Query:   61  QLLTQSGLKADAIDFIIVATISPDATMPSTAAKVQAAIAATSAFAFDMTAACSGFVFALA   120
             +L+ ++G+  + +DFII+ATI+PD+ MPSTAA+VQA I A  AFAFD+TAACSGFVFAL+
Sbjct:   61  KLMAKAGITGEELDFIILATITPDSMMPSTAARVQANIGANKAFAFDLTAACSGFVFALS   120

Query:  121  MADKLIASGAYQNGMVIGAETLSKLVNWQDRATAVLFGDGAGGVLLEASKDKHVLAETLH   180
             A+K IASG +Q G+VIG+ETLSK V+W DR+TAVLFGDGAGGVLLEAS+ +H LAE+L+
Sbjct:  121  TAEKFIASGRFQKGLVIGSETLSKAVDWSDRSTAVLFGDGAGGVLLEASEQEHFLAESLN   180

Query:  181  TDGARCQSLISGETSLSSPYSIGKKAIATIQMDGRAIFDFAIRDVSKSILTLMAQSDITK   240
             +DG+R + L  G + L SP+S  + A +  +MDGR +FDFAIRDV+KSI    + +S I
Sbjct:  181  SDGSRSECLTYGHSGLHSPFSDQESADSFLKMDGRTVFDFAIRDVAKSIKQTIDESPIEV   240

Query:  241  DDIDYCLLHQANRRILDKIARKIDVPREKFLENMMRYGNTSAASIPILLSEAVQKGQIRL   300
             D+DY LLHQAN RILDK+ARKI V R K   NMM YGNTSAASIPILLSE V++G I L
Sbjct:  241  TDLDYLLLHQANDRILDKMARKIGVDRAKLPANMMEYGNTSAASIPILLSECVEQGLIPL   300

Query:  301  DGTQKILLSGFGGGLTWGSLIVRI                                      324
             DG+Q +LLSGFGGGLTWG+LI+ I
Sbjct:  301  DGSQTVLLSGFGGGLTWGTLILTI                                      324
```

An alignment of the GAS and GBS proteins is shown below.

```
Identities = 216/324 (66%), Positives = 271/324 (82%), Gaps = 1/324 (0%)

Query:    1  MVFAKISQLAHYAPSQIIKNEDLSLIMDTSDDWISSRTGIKQRHISKNETTADLANKVAE    60
             M+F+KISQ+AHY P Q++ N DL+ IMDTS +WI SRTGI +RHIS++E T+DLA +VA+
Sbjct:    1  MIFSKISQVAHYVPQQLVTNNDLASIMDTSHEWIFSRTGIAERHISRDEMTSDLAIQVAD    60

Query:   61  QLIEKSGYSASQIDFIIVATMTPDSMMPSTAARVQAHIGASNAFAFDLSAACSGFVFALS   120
             QL+ +SG A  IDFIIVAT++PD+ MPSTAA+VQA I A++AFAFD++AACSGFVFAL+
Sbjct:   61  QLLTQSGLKADAIDFIIVATISPDATMPSTAAKVQAAIAATSAFAFDMTAACSGFVFALA   120

Query:  121  TAEKLISSGSYQKGLVIGAETVSKVLDWTDRGTAVLFGDGAGGVLLEASKEKHFLAESLN   180
             +A+KLI+SG+YQ G+VIGAET+SK+++W DR TAVLFGDGAGGVLLEASK+KH LAE+L+
Sbjct:  121  MADKLIASGAYQNGMVIGAETLSKLVNWQDRATAVLFGDGAGGVLLEASKDKHVLAETLH   180

Query:  181  TDGSR-QGLQSSQVGLNSPFSDEVLDDKFLKMDGRAIFDFAIKEVSKSINHLIETSYLEK   239
             TDG+R Q L S + L+SP+S        ++MDGRAIFDFAI++VSKSI   L+  S  K
Sbjct:  181  TDGARCQSLISGETSLSSPYSIGKKAIATIQMDGRAIFDFAIRDVSKSILTLMAQSDITK   240

Query:  240  EDIDYLFLHQANRRILDKMSRKIDIARDKFPENMMDYGNTSAASIPILLSESYENGLLKL   299
             +DIDY  LHQANRRILDK++RKID+ R+KF ENMM YGNTSAASIPILLSE+ + G++L
Sbjct:  241  DDIDYCLLHQANRRILDKIARKIDVPREKFLENMMRYGNTSAASIPILLSEAVQKGQIRL   300

Query:  300  DGNQTILLSGFGGGLTWGSLIVKI                                      323
             DG Q ILLSGFGGGLTWGSLIV+I
Sbjct:  301  DGTQKILLSGFGGGLTWGSLIVRI                                      324
```

Based on this analysis, it was predicted that these proteins and their epitopes could be useful antigens for vaccines or diagnostics.

EXAMPLE 1672

A DNA sequence (GBSx1775) was identified in *S. agalactiae* <SEQ ID 5185> which encodes the amino acid sequence <SEQ ID 5186>. This protein is predicted to be acyl carrier protein (acpP). Analysis of this protein sequence reveals the following:

```
Possible site: 59
>>> Seems to have no N-terminal signal sequence

----- Final Results -----
            bacterial cytoplasm --- Certainty = 0.3083(Affirmative) < succ>
             bacterial membrane --- Certainty = 0.0000(Not Clear)   < succ>
              bacterial outside --- Certainty = 0.0000(Not Clear)   < succ>
```

A related GBS nucleic acid sequence <SEQ ID 9551> which encodes amino acid sequence <SEQ ID 9552> was also identified.

The protein has homology with the following sequences in the GENPEPT database.

```
>GP:AAF98272 GB:AF197933 acyl carrier protein [Streptococcus pneumoniae]
Identities = 64/74 (86%), Positives = 67/74 (90%)

Query:  17 MAVFEKVQEIIVEELGKDAEEVTLNTTFDDLDADSLDVFQVISEIEDAFDIQIETEEGLN  76
           MAVFEKVQEIIVEELGKDA EVTL +TFDDLDADSLD+FQVISEIEDAFDIQIE E   L
Sbjct:   1 MAVFEKVQEIIVEELGKDASEVTLESTFDDLDADSLDLFQVISEIEDAFDIQIEAENDLK  60

Query:  77 TVGDLVAYVEEKVK                                                90
           TVGDLVAYVEE+ K
Sbjct:  61 TVGDLVAYVEEQAK                                                74
```

A related DNA sequence was identified in *S. pyogenes* <SEQ ID 5187> which encodes the amino acid sequence <SEQ ID 5188>. Analysis of this protein sequence reveals the following:

```
Possible site: 43
>>> Seems to have no N-terminal signal sequence

----- Final Results -----
            bacterial cytoplasm --- Certainty = 0.2995(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below.

```
Identities = 70/74 (94%), Positives = 71/74 (95%)

Query:  17 MAVFEKVQEIIVEELGKDAEEVTLNTTFDDLDADSLDVFQVISEIEDAFDIQIETEEGLN  76
           MAVFEKVQEIIVEELGK+ EEVTL TTFDDLDADSLDVFQVISEIEDAFDIQIETEEGLN
Sbjct:   1 MAVFEKVQEIIVEELGKETEEVTLETTFDDLDADSLDVFQVISEIEDAFDIQIETEEGLN  60

Query:  77 TVGDLVAYVEEKVK                                                90
           TVGDLVAYVEEK K
Sbjct:  61 TVGDLVAYVEEKSK                                                74
```

Based on this analysis, it was predicted that these proteins and their epitopes could be useful antigens for vaccines or diagnostics.

EXAMPLE 1673

A DNA sequence (GBSx1777) was identified in *S. agalactiae* <SEQ ID 5189> which encodes the amino acid sequence <SEQ ID 5190>. Analysis of this protein sequence reveals the following:

```
Possible site: 31
>>> Seems to have no N-terminal signal sequence
    INTEGRAL    Likelihood = -0.27    Transmembrane    156-172 (156-173)

----- Final Results -----
             bacterial membrane --- Certainty = 0.1107(Affirmative) < succ>
              bacterial outside --- Certainty = 0.0000(Not Clear)   < succ>
            bacterial cytoplasm --- Certainty = 0.0000(Not Clear)   < succ>
```

The protein has homology with the following sequences in the GENPEPT database.

```
>GP:AAF98273 GB:AF197933 trans-2-enoyl-ACP reductase II
[Streptococcus pneumoniae]
Identities = 257/318 (80%), Positives = 277/318 (86%), Gaps = 1/318 (0%)

Query:    1 MKTRITELLNIKYPIFQGGMAWVADGDLAGAVSKAGGLGIIGGGNAPKEVVKANIDKIKS    60
            MKTRITELL I YPIFQGGMAWVADGDLAGAVSKAGGLGIIGGGNAPKEVVKANIDKIKS
Sbjct:    1 MKTRITELLKIDYPIFQGGMAWVADGDLAGAVSKAGGLGIIGGGNAPKEVVKANIDKIKS    60

Query:   61 MTDKPFGVNIMLLSPFVDDIVDLVIEEGVKVVTTGAGNPGKYMERFHEAGITVIPVVPSV   120
            +TDKPFGVNIMLLSPFV+DIVDLVIEEGVKVVTTGAGNP KYMERFHEAGI VIPVVPSV
Sbjct:   61 LTDKPFGVNIMLLSPFVEDIVDLVIEEGVKVVTTGAGNPSKYMERFHEAGIIVIPVVPSV   120

Query:  121 ALAKRMEKLGADAIITEGMEAGGHIGKLTTMTLVRQVVDAVTIPVIAAGGIADGRGAAAG   180
            ALAKRMEK+GADA+I EGMEAGGHIGKLTTMTLVRQV  A++IPVIAAGGIADG GAAAG
Sbjct:  121 ALAKRMEKIGADAVIAEGMEAGGHIGKLTTMTLVRQVATAISIPVIAAGGIADGEGAAAG   180

Query:  181 FMLGADAVQVGTRFVVAKESNAHPNYKAKILKAKDIDTAVSAQVVGHPVRALKNKLVTTY   240
            FMLGA+AVQVGTRFVVAKESNAHPNYK KILKA+DIDT +SAQ  GH VRA+KN+L   +
Sbjct:  181 FMLGAEAVQVGTRFVVAKESNAHPNYKEKILKARDIDTTISAQHFGHAVRAIKNQLTRDF   240

Query:  241 SQAEKDYLAGRISINEI-EELGAGALRNAVVDGDVINGSVMAGQIAGLIKSEETCQEILE   299
              AEKD           EI E++GAGAL  AVV GDV  GSVMAGQIAGL+  EET +EIL+
Sbjct:  241 ELAEKDAFKQEDPDLEIFEQMGAGALAKAVVHGDVDGGSVMAGQIAGLVSKEETAEEILK   300

Query:  300 DIYSGARQVILSEASRWS                                          317
            D+Y GA + I  EASRW+
Sbjct:  301 DLYYGAAKKIQEEASRWT                                          318
```

A related DNA sequence was identified in *S. pyogenes* <SEQ ID 5191> which encodes the amino acid sequence <SEQ ID 5192>. Analysis of this protein sequence reveals the following:

```
Possible site: 35
>>> Seems to have no N-terminal signal sequence
    INTEGRAL    Likelihood = -1.70    Transmembrane    106-122 (106-124)
    INTEGRAL    Likelihood = -0.22    Transmembrane    156-172 (156-173)

----- Final Results -----
             bacterial membrane --- Certainty = 0.1680(Affirmative) < succ>
              bacterial outside --- Certainty = 0.0000(Not Clear)   < succ>
            bacterial cytoplasm --- Certainty = 0.0000(Not Clear)   < succ>
```

The protein has homology with the following sequences in the databases:

```
>GP:AAF98273 GB:AF197933 trans-2-enoyl-ACP reductase II
[Streptococcus pneumoniae]
Identities = 252/320 (78%), Positives = 276/320 (85%), Gaps = 1/320 (0%)
```

```
Query:    1 MKTRITELLNIDYPIFQGGMAWVADGDLAGAVSNAGGLGIIGGGNAPKEVVKANIDRVKA   60
            MKTRITELL IDYPIFQGGMAWVADGDLAGAVS AGGLGIIGGGNAPKEVVKANID++K+
Sbjct:    1 MKTRITELLKIDYPIFQGGMAWVADGDLAGAVSKAGGLGIIGGGNAPKEVVKANIDKIKS   60

Query:   61 ITDRPFGVNIMLLSPFADDIVDLVIEEGVKVVTTGAGNPGKYMERLHQAGIIVVPVVPSV  120
            +TD+PFGVNIMLLSPF +DIVDLVIEEGVKVVTTGAGNP KYMER H+AGIIV+PVVPSV
Sbjct:   61 LTDKPFGVNIMLLSPFVEDIVDLVIEEGVKVVTTGAGNPSKYMERFHEAGIIVIPVVPSV  120

Query:  121 ALAKRMEKLGVDAVIAEGMEAGGHIGKLTTMSLVRQVVEAVSIPVIAAGGIADGHGAAAA  180
            ALAKRMEK+G DAVIAEGMEAGGHIGKLTTM+LVRQV  A+SIPVIAAGGIADG GAAA
Sbjct:  121 ALAKRMEKIGADAVIAEGMEAGGHIGKLTTMTLVRQVATAISIPVIAAGGIADGEGAAAG  180

Query:  181 FMLGAEAVQIGTRFVVAKESNAHQNFKDKILAAKDIDTVISAQVVGHPVRSIKNKLTSAY  240
            FMLGAEAVQ+GTRFVVAKESNAH N+K+KIL A+DIDT ISAQ  GH VR+IKN+LT  +
Sbjct:  181 FMLGAEAVQVGTRFVVAKESNAHPNYKEKILKARDIDTTISAQHFGHAVRAIKNQLTRDF  240

Query:  241 AKAEK-AFLIGQKTATDIEEMGAGSLRHAVIEGDVVNGSVMAGQIAGLVRKEESCETILK  299
                AEK AF           E+MGAG+L  AV+ GDV  GSVMAGQIAGLV KEE+ E ILK
Sbjct:  241 ELAEKDAFKQEDPDLEIFEQMGAGALAKAVVHGDVDGGSVMAGQIAGLVSKEETAEEILK  300

Query:  300 DIYYGAARVIQNEAKRWQSV                                         319
            D+YYGAA+ IQ EA RW  V
Sbjct:  301 DLYYGAAKKIQEEASRWTGV                                         320
```

An alignment of the GAS and GBS proteins is shown below.

```
Identities = 253/319 (79%), Positives = 291/319 (90%)

Query:    1 MKTRITELLNIKYPIFQGGMAWVADGDLAGAVSKAGGLGIIGGGNAPKEVVKANIDKIKS   60
            MKTRITELLNI YPIFQGGMAWVADGDLAGAVS AGGLGIIGGGNAPKEVVKANID++K+
Sbjct:    1 MKTRITELLNIDYPIFQGGMAWVADGDLAGAVSNAGGLGIIGGGNAPKEVVKANIDRVKA   60

Query:   61 MTDKPFGVNIMLLSPFVDDIVDLVIEEGVKVVTTGAGNPGKYMERFHEAGITVIPVVPSV  120
            +TD+PFGVNIMLLSPF DDIVDLVIEEGVKVVTTGAGNPGKYMER H+AGI V+PVVPSV
Sbjct:   61 ITDRPFGVNIMLLSPFADDIVDLVIEEGVKVVTTGAGNPGKYMERLHQAGIIVVPVVPSV  120

Query:  121 ALAKRMEKLGADAIITEGMEAGGHIGKLTTMTLVRQVVDAVTIPVIAAGGIADGRGAAAG  180
            ALAKRMEKLG DA+I EGMEAGGHIGKLTTM+LVRQVV+AV+IPVIAAGGIADG GAAA
Sbjct:  121 ALAKRMEKLGVDAVIAEGMEAGGHIGKLTTMSLVRQVVEAVSIPVIAAGGIADGHGAAAA  180

Query:  181 FMLGADAVQVGTRFVVAKESNAHPNYKAKILKAKDIDTAVSAQVVGHPVRALKNKLVTTY  240
            FMLGA+AVQ+GTRFVVAKESNAH N+K KIL AKDIDT +SAQVVGHPVR++KNKL + Y
Sbjct:  181 FMLGAEAVQIGTRFVVAKESNAHQNFKDKILAAKDIDTVISAQVVGHPVRSIKNKLTSAY  240

Query:  241 SQAEKDYLAGRISINEIEELGAGALRNAVVDGDVINGSVMAGQIAGLIKSEETCQEILED  300
            ++AEK +L G+ +  +IEE+GAG+LR+AV++GDV+NGSVMAGQIAGL++ EE+C+   IL+D
Sbjct:  241 AKAEKAFLIGQKTATDIEEMGAGSLRHAVIEGDVVNGSVMAGQIAGLVRKEESCETILKD  300

Query:  301 IYSGARQVILSEASRWSDL                                          319
            IY GA +VI +EA RW  +
Sbjct:  301 IYYGAARVIQNEAKRWQSV                                          319
```

Based on this analysis, it was predicted that these proteins and their epitopes could be useful antigens for vaccines or diagnostics.

EXAMPLE 1674

A DNA sequence (GBSx1778) was identified in *S. agalactiae* <SEQ ID 5193> which encodes the amino acid sequence <SEQ ID 5194>. This protein is predicted to be MCAT (fabD). Analysis of this protein sequence reveals the following:

```
Possible site: 19
>>> Seems to have no N-terminal signal sequence

----- Final Results -----
bacterial cytoplasm --- Certainty = 0.1276 (Affirmative) <succ>
 bacterial membrane --- Certainty = 0.0000 (Not Clear)   <succ>
  bacterial outside --- Certainty = 0.0000 (Not Clear)   <succ>
```

The protein has homology with a *S. pneumoniae* sequence:

```
Identities = 203/306 (66%), Positives = 242/306 (78%), Gaps = 1/306 (0%)

Query:   1  MNKVSFLFAGQGAQKLGMARDLYETFPIVKETFDKASHVLGYDLRELIDKDLDKLNQTKY    60
            M K +FLFAGQGAQ LGM RD Y+ +PIVKET D+AS VLGYDLR LID + DKLNQT+Y
Sbjct:   1  MTKTAFLFAGQGAQYLGMGRDFYDQYPIVKETIDRASQVLGYDLRYLIDTEEDKLNQTRY    60

Query:  61  TQPAILTTSTAIYRLILKEIELRPDMVAGLSLGEYSALVASGAIRFEDAVVLVARRGQLM   120
            TQPAIL TS AIYRL L+E   +PDMVAGLSLGEYSALVASGA+ FEDAV LVA+RG  M
Sbjct:  61  TQPAILATSVAIYRL-LQEKGYQPDMVAGLSLGEYSALVASGALDFEDAVALVAKRGAYM   119

Query: 121  EAAAPAGSGKMVAVLNADRQIIEDACKKASQFGIVSPANYNTPKQIVIGGESIAVNAAVE   180
            E AAPA SGKMVAVLN   ++IE+AC+KAS+ G+V+PANYNTP QIVI GE +AV+ AVE
Sbjct: 120  EEAAPADSGKMVAVLNTPVEVIEEACQKASELGVVTPANYNTPAQIVIAGEVVAVDRAVE   179

Query: 181  ELKQQGVKRLIPLNVSGPFHTALLKPASQKLSDVLDKVHFSVSEIPVIGNTEAQIMKKDD   240
            L++ G KRLIPL VSGPFHTALL+PASQKL++ L +V FS      P++GNTEA +M+K+D
Sbjct: 180  LLQEAGAKRLIPLKVSGPFHTALLEPASQKLAETLAQVSFSDFTCPLVGNTEAAVMQKED   239

Query: 241  IKSLLARQVMEPVRFDESIETMKKMGMTQVVEIGPGKVLSGFLKKIDSSLSVHSVEDKIG   300
            I   LL RQV EPVRF ESI  M++ G++  +EIGPGKVLSGF+KKID +  + VED+
Sbjct: 240  IAQLLTRQVKEPVRFYESIGVMQEAGISNFIEIGPGKVLSGFVKKIDQTAHLAHVEDQAS   299

Query: 301  FNNLKE                                                        306
                L E
Sbjct: 300  LVALLE                                                        305
```

A related DNA sequence was identified in *S. pyogenes* <SEQ ID 5195> which encodes the amino acid sequence <SEQ ID 5196>. Analysis of this protein sequence reveals the following:

```
Possible Site: 19
>>> Seems to have no N-terminal signal sequence

----- Final Results -----
bacterial cytoplasm --- Certainty = 0.1602 (Affirmative) <succ>
 bacterial membrane --- Certainty = 0.0000 (Not Clear)   <succ>
  bacterial outside --- Certainty = 0.0000 (Not Clear)   <succ>
```

An alignment of the GAS and GBS proteins is shown below.

```
Identities = 201/299 (67%), Positives = 248/299 (82%), Gaps = 1/299 (0%)

Query:   1  MNKVSFLFAGQGAQKLGMARDLYETFPIVKETFDKASHVLGYDLRELIDKDLDKLNQTKY    60
            M K +FLFAGQGAQKLGMARD Y+ F IV++TFD+AS VLGYDLR LID D  KLNQT Y
Sbjct:   3  MTKTAFLFAGQGAQKLGMARDFYDNFAIVRKTFDQASQVLGYDLRRLIDSDELKLNQTSY    62

Query:  61  TQPAILTTSTAIYRLILKEIELRPDMVAGLSLGEYSALVASGAIRFEDAVVLVARRGQLM   120
            TQPAILT+S AIYR +L      ++PDMVAGLSLGEYSALVASGA+ FED + LVA+RG+LM
Sbjct:  63  TQPAILTSSIAIYR-VLGLHHVKPDMVAGLSLGEYSALVASGALSFEDTLSLVAKRGRLM   121

Query: 121  EAAAPAGSGKMVAVLNADRQIIEDACKKASQFGIVSPANYNTPKQIVIGGESIAVNAAVE   180
            E AAP GSGKMVAV+N D Q+IE+ C+ A++ G+V+PANYNTP QIVIGG++ AVN AVE
Sbjct: 122  EEAAPQGSGKMVAVMNTDVQVIEEVCQIAAKHGVVAPANYNTPSQIVIGGQTDAVNVAVE   181

Query: 181  ELKQQGVKRLIPLNVSGPFHTALLKPASQKLSDVLDKVHFSVSEIPVIGNTEAQIMKKDD   240
            LK++GVKRLIPLNVSGPFHTALL+PAS+ L+   L++ +FS   + IP++GNTEA IM+KD
Sbjct: 182  LLKERGVKRLIPLNVSGPFHTALLEPASRLLAKELERYNFSDFKIPLVGNTEANIMEKDR   241

Query: 241  IKSLLARQVMEPVRFDESIETMKKMGMTQVVEIGPGKVLSGFLKKIDSSLSVHSVEDKI    299
            I   LLARQVMEPVRF +S+ T+ + G+TQ +E+GPGKVL+GF+KKID +L     SVE+ +
Sbjct: 242  IPELLARQVMEPVRFYDSVATLVESGITQFIEVGPGKVLTGFVKKIDKNLLCTSVENMV   300
```

Based on this analysis, it was predicted that these proteins and their epitopes could be useful antigens for vaccines or diagnostics.

EXAMPLE 1675

A DNA sequence (GBSx1779) was identified in *S. agalactiae* <SEQ ID 5197> which encodes the amino acid sequence <SEQ ID 5198>. This protein is predicted to be beta-ketoacyl-ACP reductase (fabG). Analysis of this protein sequence reveals the following:

```
Possible site: 29
>>> Seems to have no N-terminal signal sequence

----- Final Results -----
bacterial cytoplasm --- Certainty = 0.0930 (Affirmative) <succ>
 bacterial membrane --- Certainty = 0.0000 (Not Clear)   <succ>
  bacterial outside --- Certainty = 0.0000 (Not Clear)   <succ>
```

The protein has homology with the following sequences in the GENPEPT database.

```
>GP:AAF98275 GB:AF197933 beta-ketoacyl-ACP reductase
[Streptococcus pneumoniae]
Identities = 184/243 (75%), Positives = 212/243 (86%)

Query:    1 MQLKDKNIFITGSSRGIGLAIAHQFAQLGANIVLNGRSEISEDLIAEFADYGVKVIAISG   60
            M+L+ KNIFITGSSRGIGLAIAH+FAQ GANIVLN R  ISE+L+AEF++YG+KV+ ISG
Sbjct:    1 MKLEHKNIFITGSSRGIGLAIAHKFAQAGANIVLNSRGAISEELLAEFSNYGIKVVPISG   60

Query:   61 DVSSFEDANRMIKEAIASLGSVDVLVNNAGITNDKLMLKMTVEDFESVLKINLTGAFNMT  120
            DVS F DA RMI +AIA LGSVDVLVNNAGIT D LMLKMT DFE  VLK+NLTGAFNMT
Sbjct:   61 DVSDFADAKRMIDQAIAELGSVDVLVNNAGITQDTLMLKMTEADFEKVLKVNLTGAFNMT  120

Query:  121 QSVLKPMTKARQGAIINISSVVGLTGNVGQANYAASKAGLIGFTKSVAREVAARGIRVNA  180
            QSVLKPM KAR+GAIIN+SSVVGL GN+GQANYAASKAGLIGFTKSVAREVA+R IRVN
Sbjct:  121 QSVLKPMMKAREGAIINMSSVVGLMGNIGQANYAASKAGLIGFTKSVAREVASRNIRVNV  180

Query:  181 IAPGFIESDMTDVIPEKMQEAILAQIPMKRIGKGKEVAQVASFLAEQEYLTGQVIAIDGG  240
            IAPG IESDMT ++ +K++EA LAQIPMK  G+ ++VA +  FLA  Q+YLTGQV+AIDGG
Sbjct:  181 IAPGMIESDMTAILSDKIKEATLAQIPMKEFGQAEQVADLTVFLAGQDYLTGQVVAIDGG  240

Query:  241 MTM                                                          243
            ++M
Sbjct:  241 LSM                                                          243
```

A related DNA sequence was identified in *S. pyogenes* <SEQ ID 3865> which encodes the amino acid sequence <SEQ ID 3866>. Analysis of this protein sequence reveals the following:

```
Possible site: 29
>>> Seems to have no N-terminal signal sequence

----- Final Results -----
bacterial cytoplasm --- Certainty = 0.1088 (Affirmative) <succ>
 bacterial membrane --- Certainty = 0.0000 (Not Clear)   <succ>
  bacterial outside --- Certainty = 0.0000 (Not Clear)   <succ>
```

An alignment of the GAS and GBS proteins is shown below.

```
Identities = 201/244 (82%), Positives = 220/244 (89%)

Query:    1 MQLKDKNIFITGSSRGIGLAIAHQFAQLGANIVLNGRSEISEDLIAEFADYGVKVIAISG   60
            M++K KNIFITGS+RGIGLA+AHQFA L ANIVLNGRS ISE+L+A F DYGV V+ ISG
Sbjct:    1 MEIKGKNIFITGSTRGIGLAMAHQFASLEANIVLNGRSAISEELVASFTDYGVTVVTISG   60

Query:   61 DVSSFEDANRMIKEAIASLGSVDVLVNNAGITNDKLMLKMTVEDFESVLKINLTGAFNMT  120
            DVS   +A RM+ EAI SLGS+DVLVNNAGITNDKLMLKMT EDFE VLKINLTGAFNMT
```

```
-continued
Sbjct:  61 DVSEASEAKRMVNEAIESLGSIDVLVNNAGITNDKLMLKMTEEDFERVLKINLTGAFNMT  120

Query: 121 QSVLKPMTKARQGAIINISSVVGLTGNVGQANYAASKAGLIGFTKSVAREVAARGIRVNA  180
           QSVLKPM KARQGAIIN+SSVVGLTGN+GQANYAASKAG+IGFTKSVAREVAAR I VNA
Sbjct: 121 QSVLKPMIKARQGAIINVSSVVGLTGNIGQANYAASKAGMIGFTKSVAREVAARNICVNA  180

Query: 181 IAPGFIESDMTDVIPEKMQEAILAQIPMKRIGKGKEVAQVASFLAEQEYLTGQVIAIDGG  240
           IAPGFIESDMT V+PEKMQE IL+QIPMKRIGK +EVA +ASFL EQ+Y+TGQVIAIDGG
Sbjct: 181 IAPGFIESDMTGVLPEKMQEQILSQIPMKRIGKAQEVAHLASFLVEQDYITGQVIAIDGG  240

Query: 241 MTMQ                                                          244
           MTMQ
Sbjct: 241 MTMQ                                                          244
```

Based on this analysis, it was predicted that these proteins and their epitopes could be useful antigens for vaccines or diagnostics.

EXAMPLE 1676

A DNA sequence (GBSx1780) was identified in *S. agalactiae* <SEQ ID 5199> which encodes the amino acid sequence <SEQ ID 5200>. This protein is predicted to be 3-oxoacyl-(acyl-carrier-protein) synthase II (fabF). Analysis of this protein sequence reveals the following:

```
Possible site: 51
>>> Seems to have no N-terminal signal sequence
    INTEGRAL    Likelihood = -0.37    Transmembrane    338-354 (338-354)

----- Final Results -----
          bacterial membrane --- Certainty = 0.1150(Affirmative) < succ>
           bacterial outside --- Certainty = 0.0000(Not Clear)   < succ>
          bacterial cytoplasm --- Certainty = 0.0000(Not Clear)   < succ>
```

The protein has homology with the following sequences in the GENPEPT database.

```
>GP: AAF98276 GB: AF197933 beta-ketoacyl-ACP synthase II
[Streptococcus pneumoniae]
Identities = 340/410 (82%), Positives = 375/410 (90%)

Query:   1 MTLQRVVVTGYGVTSPIGNTPEEFWNSLKEGNVGIGPITKFDSSDFMVKNAAEIHDFPFD   60
           M L RVVVTGYGVTSPIGNTPEEFWNSL G +GIG ITKFD SDF V NAAEI DFPFD
Sbjct:   1 MKLNRVVVTGYGVTSPIGNTPEEFWNSLATGKIGIGGITKFDHSDFDVHNAAEIQDFPFD   60

Query:  61 KYFVKKDLNRFDMYSLYALYASSEAIQHANLNLDEIDADRFGVIVASGIGGIQEIEEQVI  120
           KYFVKKD NRFD YSLYALYA+ EA+ HANL+++ ++ DRFGVIVASGIGGI+EIE+QV+
Sbjct:  61 KYFVKKDTNRFDNYSLYALYAAQEAVNHANLDVEALNRDRFGVIVASGIGGIKEIEDQVL  120

Query: 121 RLHEKGPKRVKPMTLPKALPNMAAGNVAMRLGAHGVCKSINTACASSNDAIGDAFRNIKF  180
           RLHEKGPKRVKPMTLPKALPNMA+GNVAMR GA+GVCKSINTAC+SSNDAIGDAFR+IKF
Sbjct: 121 RLHEKGPKRVKPMTLPKALPNMASGNVAMRFGANGVCKSINTACSSSNDAIGDAFRSIKF  180

Query: 181 GIQDIMVVGGAEAAITKFAIAGFQSLTALSTTEDPSRASIPFDKDRNGFIMGEGSGMLVL  240
           G QD+M+VGG EA+IT FAIAGFQ+LTALSTTEDP+RASIPFDKDRNGF+MGEGSGMLVL
Sbjct: 181 GFQDVMLVGGTEASITPFAIAGFQALTALSTTEDPTRASIPFDKDRNGFVMGEGSGMLVL  240

Query: 241 ESLEHAEKRGATILAEVVGYGNTCDAYHMTSPHPEGLGATKAIQLALVEANIKPEEVNYV  300
           ESLEHAEKRGATILAEVVGYGNTCDAYHMTSPHPEG GA KAI+LAL EA I PE+V YV
Sbjct: 241 ESLEHAEKRGATILAEVVGYGNTCDAYHMTSPHPEGQGAIKAIKLALEEAEISPEQVAYV  300

Query: 301 NAHGTSTPANEKGESQAIVAALGTDVPVSSTKSFTGHLLGAAGAVEAIATIEAIRHSYVP  360
           NAHGTSTPANEKGES AIVA LG +VPVSSTKSFTGHLLGAAGAVEAI TIEA+RH++VP
Sbjct: 301 NAHGTSTPANEKGESGAIVAVLGKEVPVSSTKSFTGHLLGAAGAVEAIVTIEAMRHNFVP  360

Query: 361 MTAGTTELSEDITANVIFGQGQDADIRYAISNTFGFGGHNAVLAFKRWED            410
           MTAGT+E+S+ I ANV++GQG + +I YAISNTFGFGGHNAVLAFKRWE+
Sbjct: 361 MTAGTSEVSDYIEANVVYGQGLEKEIPYAISNTFGFGGHNAVLAFKRWEN            410
```

A related DNA sequence was identified in *S. pyogenes* <SEQ ID 3851> which encodes the amino acid sequence <SEQ ID 3852>. Analysis of this protein sequence reveals the following:

```
Possible site: 51
>>> Seems to have no N-terminal signal sequence

----- Final Results -----
            bacterial cytoplasm --- Certainty = 0.0890(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below.

```
Identities = 346/410 (84%), Positives = 377/410 (91%)

Query:     1 MTLQRVVVTGYGVTSPIGNTPEEFWNSLKEGNVGIGPITKFDSSDFMVKNAAEIHDFPFD    60
             MT +RVVVTGYG+TSPIG+ PE FWN+LK G +GIGPITKFD++D+ VKNAAEI DFPFD
Sbjct:     1 MTFKRVVVTGYGLTSPIGHDPETFWNNLKAGQIGIGPITKFDTTDYAVKNAAEIQDFPFD    60

Query:    61 KYFVKKDLNRFDMYSLYALYASSEAIQHANLNLDEIDADRFGVIVASGIGGIQEIEEQVI   120
             KYFVKKDLNRFD YSLYALYA+ EAI HA+LN++ +D+DRFGVIVASGIGGI EIEEQVI
Sbjct:    61 KYFVKKDLNRFDRYSLYALYAAKEAINHADLNIEMVDSDRFGVIVASGIGGIAEIEEQVI   120

Query:   121 RLHEKGPKRVKPMTLPKALPNMAAGNVAMRLGAHGVCKSINTACASSNDAIGDAFRNIKF   180
             RLHEKGPKRVKPMTLPKALPNMAAGNVAM L A GVCKSINTACASSNDAIGDAFR IKF
Sbjct:   121 RLHEKGPKRVKPMTLPKALPNMAAGNVAMSLKAQGVCKSINTACASSNDAIGDAFRAIKF   180

Query:   181 GIQDIMVVGGAEAAITKFAIAGFQSLTALSTTEDPSRASIPFDKDRNGFIMGEGSGMLVL   240
             G QD+M+VGG+EAAITKFAIAGFQSLTALSTTEDPSR+SIPFDKDRNGFIMGEGSGMLVL
Sbjct:   181 GTQDVMIVGGSEAAITKFAIAGFQSLTALSTTEDPSRSSIPFDKDRNGFIMGEGSGMLVL   240

Query:   241 ESLEHAEKRGATILAEVVGYGNTCDAYHMTSPHPEGLGATKAIQLALVEANIKPEEVNYV   300
             ESLEHA++RGATILAE+VGYGNTCDAYHMTSP+PEGLGA KAI LAL EA I+    +NYV
Sbjct:   241 ESLEHAQERGATILAEIVGYGNTCDAYHMTSPNPEGLGARKAIHLALQEAGIEASAINYV   300

Query:   301 NAHGTSTPANEKGESQAIVAALGTDVPVSSTKSFTGHLLGAAGAVEAIATIEAIRHSYVP   360
             NAHGTSTPANEKGESQAIVA LG DVPVSSTKSFTGHLLGAAGA+EAIATIEA+RH+YVP
Sbjct:   301 NAHGTSTPANEKGESQAIVAVLGKDVPVSSTKSFTGHLLGAAGAIEAIATIEAMRHNYVP   360

Query:   361 MTAGTTELSEDITANVIFGQGQDADIRYAISNTFGFGGHNAVLAFKRWED            410
             MTAGT  LSEDI ANVIFG+G++  I YAISNTFGFGGHNAVLAFK WE+
Sbjct:   361 MTAGTQALSEDIEANVIFGEGKETAINYAISNTFGFGGHNAVLAFKCWEE            410
```

Based on this analysis, it was predicted that these proteins and their epitopes could be useful antigens for vaccines or diagnostics.

EXAMPLE 1677

A DNA sequence (GBSx1781) was identified in *S. agalactiae* <SEQ ID 5201> which encodes the amino acid sequence <SEQ ID 5202>. Analysis of this protein sequence reveals the following:

```
Possible site: 14
>>> Seems to have no N-terminal signal sequence

----- Final Results -----
            bacterial cytoplasm --- Certainty = 0.3052(Affirmative) < succ>
             bacterial membrane --- Certainty = 0.0000(Not Clear)   < succ>
              bacterial outside --- Certainty = 0.0000(Not Clear)   < succ>
```

A related GBS nucleic acid sequence <SEQ ID 9553> which encodes amino acid sequence <SEQ ID 9554> was also identified.

The protein has homology with the following sequences in the GENPEPT database.

```
>GP: AAF98277 GB: AF197933 biotin carboxyl carrier protein
[Streptococcus pneumoniae]
Identities = 103/169 (60%), Positives = 127/169 (74%), Gaps = 11/169 (6%)

Query:   19 LDIQEIKDLMTQFDESSLREFSFKTSDGELSFSKNEGKAPLVPTMSPMSHQPEATPTIAT    78
            +++ +IKDLMTQFD+SSLREFS+K    EL FSKNE +   VP ++   Q    P +AT
Sbjct:    1 MNLNDIKDLMTQFDQSSLREFSYKNGTDELQFSKNEARP--VPEVAT---QVAPAPVLAT    55

Query:   79 PVSNEAGEQTKQATEVVSEIP---ESTVTVAEGDVVESPLVGVAYLASGPDKPNFVSVGD   135
            P  +    + A V  E+P     E++V    EG++VESPLVGV YLA+GPDKP FV+VGD
Sbjct:   56 P--SPVAPTSAPAETVAEEVPAPAEASVAT-EGNLVESPLVGVVYLAAGPDKPAFVTVGD   112

Query:  136 SVKKGQTLMIIEAMKVMNEVPAPHDGVVTEILVANEEVIEFGKGLVRIK              184
            SVKKGQTL+IIEAMKVMNE+PAP DGVVTEILV+NEE++EFGKGLVRIK
Sbjct:  113 SVKKGQTLVIIEAMKVMNEIPAPKDGVVTEILVSNEEMVEFGKGLVRIK              161
```

A related DNA sequence was identified in *S. pyogenes* <SEQ ID 5203> which encodes the amino acid sequence <SEQ ID 5204>. Analysis of this protein sequence reveals the following:

```
Possible site: 48
>>> Seems to have no N-terminal signal sequence

----- Final Results -----
          bacterial cytoplasm --- Certainty = 0.3132(Affirmative) < succ>
           bacterial membrane --- Certainty = 0.0000(Not Clear)   < succ>
            bacterial outside --- Certainty = 0.0000(Not Clear)   < succ>
```

An alignment of the GAS and GBS proteins is shown below.

```
Identities = 107/171 (62%), Positives = 126/171 (73%), Gaps = 10/171 (5%)

Query:   19 LDIQEIKDLMTQFDESSLREFSFKTSDGELSFSKNEGKAPLVPTMSPMSHQPEATPT---    75
            L+IQEIKDLM QFD SSLREF FKT++GEL FSKNE        +  S+Q   A P
Sbjct:    1 LNIQEIKDLMAQFDTSSLREFLFKTNEGELIFSKNEQHLN-----ASTSNQEHAVPVPQV    55

Query:   76 --IATPVSNEAGEQTKQATEVVSEIPESTVTVAEGDVVESPLVGVAYLASGPDKPNFVSV   133
              +  P ++EA          V E P++    VAEGD+VESPLVGVAYLA+ PDKP FV+V
Sbjct:   56 QLVPNPTASEASSPASVKDVPVEEQPQAESFVAEGDIVESPLVGVAYLAASPDKPPFVAV   115

Query:  134 GDSVKKGQTLMIIEAMKVMNEVPAPHDGVVTEILVANEEVIEFGKGLVRIK             184
            GD+VKKGQTL+IIEAMKVMNEVPAP DGV+TEILV+NE+VIEFG+GLVRIK
Sbjct:  116 GDTVKKGQTLVIIEAMKVMNEVPAPCDGVITEILVSNEDVIEFGQGLVRIK             166
```

Based on this analysis, it was predicted that these proteins and their epitopes could be useful antigens for vaccines or diagnostics.

EXAMPLE 1678

A DNA sequence (GBSx1782) was identified in *S. agalactiae* <SEQ ID 5205> which encodes the amino acid sequence <SEQ ID 5206>. This protein is predicted to be beta-hydroxyacyl-ACP dehydratase (fabZ). Analysis of this protein sequence reveals the following:

```
Possible site: 59
>>> Seems to have no N-terminal signal sequence

----- Final Results -----
          bacterial cytoplasm --- Certainty = 0.2267(Affirmative) < succ>
           bacterial membrane --- Certainty = 0.0000(Not Clear)   < succ>
            bacterial outside --- Certainty = 0.0000(Not Clear)   < succ>
```

The protein has homology with the following sequences in the GENPEPT database.

```
>GP: AAF98278 GB: AF197933 beta-hydroxyacyl-ACP dehydratase
[Streptococcus pneumoniae]
Identities = 130/140 (92%), Positives = 135/140 (95%)

Query:    1 MIDIKEIREALPHRYPMLLVDRVLEVSEDEIVAIKNVSINEPFFNGHFPEYPVMPGVLIM    60
            MIDI+ I+EALPHRYPMLLVDRVLEVSED IVAIKNV+INEPFFNGHFP+YPVMPGV+IM
Sbjct:    1 MIDIQGIKEALPHRYPMLLVDRVLEVSEDTIVAIKNVTINEPFFNGHFPQYPVMPGVVIM    60

Query:   61 EALAQTAGVLELSKEENKGKLVFYAGMDKVKFKKQVVPGDQLVMTAKFVKRRGTIAVVEA   120
            EALAQTAGVLELSK ENKGKLVFYAGMDKVKFKKQVVPGDQLVMTA FVKRRGTIAVVEA
Sbjct:   61 EALAQTAGVLELSKPENKGKLVFYAGMDKVKFKKQVVPGDQLVMTATFVKRRGTIAVVEA   120

Query:  121 IAEVDGKLAASGTLTFAIGN                                         140
            AEVDGKLAASGTLTFAIGN
Sbjct:  121 KAEVDGKLAASGTLTFAIGN                                         140
```

A related DNA sequence was identified in *S. pyogenes* <SEQ ID 5207> which encodes the amino acid sequence <SEQ ID 5208>. Analysis of this protein sequence reveals the following:

```
Possible site: 59
>>> Seems to have no N-terminal signal sequence

----- Final Results -----
            bacterial cytoplasm --- Certainty = 0.1882(Affirmative) < succ>
             bacterial membrane --- Certainty = 0.0000(Not Clear) < succ>
              bacterial outside --- Certainty = 0.0000(Not Clear) < succ>
```

An alignment of the GAS and GBS proteins is shown below.

```
Identities = 127/139 (91%), Positives = 133/139 (95%)

Query:    1 MIDIKEIREALPHRYPMLLVDRVLEVSEDEIVAIKNVSINEPFFNGHFPEYPVMPGVLIM    60
            M+DI+EI+ ALPHRYPMLLVDRVLEVS+D IVAIKNV+INEPFFNGHFP YPVMPGVLIM
Sbjct:    1 MMDIREIQAALPHRYPMLLVDRVLEVSDDHIVAIKNVTINEPFFNGHFPHYPVMPGVLIM    60

Query:   61 EALAQTAGVLELSKEENKGKLVFYAGMDKVKFKKQVVPGDQLVMTAKFIKRRGTIAVVEA   120
            EALAQTAGVLELSKEENKGKLVFYAGMDKVKFKKQVVPGDQLVMTA F+KRRGTIAVVEA
Sbjct:   61 EALAQTAGVLELSKEENKGKLVFYAGMDKVKFKKQVVPGDQLVMTATFIKRRGTIAVVEA   120

Query:  121 IAEVDGKLAASGTLTFAIG                                          139
            AEVDGKLAASGTLTFA G
Sbjct:  121 RAEVDGKLAASGTLTFACG                                          139
```

Based on this analysis, it was predicted that these proteins and their epitopes could be useful antigens for vaccines or diagnostics.

EXAMPLE 1679

A DNA sequence (GBSx1783) was identified in *S. agalactiae* <SEQ ID 5209> which encodes the amino acid sequence <SEQ ID 5210>. This protein is predicted to be acetyl-coenzyme A carboxylase, biotin carboxylase (accC). Analysis of this protein sequence reveals the following:

```
Possible site: 30
>>> Seems to have no N-terminal signal sequence

----- Final Results -----
            bacterial cytoplasm --- Certainty = 0.1203(Affirmative) < succ>
             bacterial membrane --- Certainty = 0.0000(Not Clear) < succ>
              bacterial outside --- Certainty = 0.0000(Not Clear) < succ>
```

The protein has homology with the following sequences in the GENPEPT database.

```
>GP: AAF98279 GB: AF197933 acetyl-CoA carboxylase biotin carboxylase
subunit [Streptococcus pneumoniae]
Identities = 361/451 (80%), Positives = 405/451 (89%)

Query:    1 MFKKILIANRGEIAVRIIRAAREMGISTVAIYSEADKESLHTILADEAICVGPAKSAESY   60
            MF+KILIANRGEIAVRIIRAARE+GI+TVA+YS ADKE+LHT+LADEA+C+GP K+ ESY
Sbjct:    1 MFRKILIANRGEIAVRIIRAARELGIATVAVYSTADKEALHTLLADEAVCIGPGKATESY   60

Query:   61 LNVNAILSAAIVTGAEAVHPGFGFLSENSKFATMCEEMNLKFIGPSGEVMDKMGDKINAR  120
            LN+NA+LSAA++T AEA+HPGFGFLSENSKFATMCEE+ +KFIGPSG VMD MGDKINAR
Sbjct:   61 LNINAVLSAAVLTEAEAIHPGFGFLSENSKFATMCEEVGIKFIGPSGHVMDMMGDKINAR  120

Query:  121 TEMIKADVPVIPGSDGQVTSVEEAVSIAEEIGYPLMLKASAGGGGKGIRKVKSADELKPA  180
             +MIKA VPVIPGSDG+V + EEA+ +AE+IGYP+MLKASAGGGGKGIRKV+  D+L  A
Sbjct:  121 AQMIKAGVPVIPGSDGEVHNSEEALIVAEKIGYPVMLKASAGGGGKGIRKVEKPDDLVSA  180

Query:  181 FESASQEALAAFGNGAMYIEKVIYPARHIEVQILGDSFGKIVHLGERDCSLQRNNQKVLE  240
            FE+AS EA A +GNGAMYIE+VIYPARHIEVQILGD  G ++HLGERDCSLQRNNQKVLE
Sbjct:  181 FETASSEAKANYGNGAMYIERVIYPARHIEVQILGDEHGHVIHLGERDCSLQRNNQKVLE  240

Query:  241 ESPSVAIGNTLRQQIGEAAVRAAEAVSYENAGTIEFLLDENSGQFYFMEMNTRVQVEHPV  300
            ESPS+AIG TLR +IG AAVRAAE V YENAGTIEFLLDE S  FYFMEMNTRVQVEHPV
Sbjct:  241 ESPSIAIGKTLRHEIGAAAVRAAEFVGYENAGTIEFLLDEASSNFYFMEMNTRVQVEHPV  300

Query:  301 TEFVTGVDIVKEQIRIAAGIPLSVSQNDIKLTGHAIECRINAENPQFNFAPCPGTINGLH  360
            TEFV+GVDIVKEQI  IAAG PLSV Q DI L GHAIECRINAENP FNFAP PG I  L+
Sbjct:  301 TEFVSGVDIVKEQICIAAGQPLSVKQEDIVLRGHAIECRINAENPAFNFAPSPGKITNLY  360

Query:  361 LPAGGMGLRVDSAVYTGYTIPPYYDSMIAKVIVHGENRFDALMKMQRALYELEIDGIVTN  420
            LP+GG+GLRVDSAVY GYTIPPYYDSMIAK+IVHGENRFDALMKMQRALYELEI+G+ TN
Sbjct:  361 LPSGGVGLRVDSAVYPGYTIPPYYDSMIAKIIVHGENRFDALMKMQRALYELEIEGVQTN  420

Query:  421 TEFQMDLISDKKVLAGDYDTSFLMEDFLPRY                              451
            +FQ+DLISD+ V+AGDYDTSFLME FLP+Y
Sbjct:  421 ADFQLDLISDRNVIAGDYDTSFLMETFLPKY                              451
```

A related DNA sequence was identified in *S. pyogenes* <SEQ ID 5211> which encodes the amino acid sequence <SEQ ID 5212>. Analysis of this protein sequence reveals the following:

```
Possible site: 48
>>> Seems to have no N-terminal signal sequence

----- Final Results -----
           bacterial cytoplasm --- Certainty = 0.1784(Affirmative) < succ>
            bacterial membrane --- Certainty = 0.0000(Not Clear)   < succ>
             bacterial outside --- Certainty = 0.0000(Not Clear)   < succ>
```

An alignment of the GAS and GBS proteins is shown below.

```
Identities = 369/451 (81%), Positives = 421/451 (92%)

Query:    1 MFKKILIANRGEIAVRIIRAAREMGISTVAIYSEADKESLHTILADEAICVGPAKSAESY   60
            MFKKILIANRGEIAVRIIRAARE+GISTVA+YSEADKE+LHTILADEAIC+GPA+S ESY
Sbjct:   17 MFKKILIANRGEIAVRIIRAARELGISTVAVYSEADKEALHTILADEAICIGPARSKESY   76

Query:   61 LNVNAILSAAIVTGAEAVHPGFGFLSENSKFATMCEEMNLKFIGPSGEVMDKMGDKINAR  120
            LN+N++LSAAIVTGA+A+HPGFGFLSENSKFATMCEEMN KFIGPS  VMDKMGDKINAR
Sbjct:   77 LNMNSVLSAAIVTGAQAIHPGFGFLSENSKFATMCEEMNIKFIGPSASVMDKMGDKINAR  136

Query:  121 TEMIKADVPVIPGSDGQVTSVEEAVSIAEEIGYPLMLKASAGGGGKGIRKVKSADELKPA  180
            +EMIKA VPVIPGSDG+V + +EA++IA +IGYP+MLKASAGGGGKGIRKV++   +L+ A
Sbjct:  137 SEMIKAGVPVIPGSDGEVYNAQEALAIANKIGYPVMLKASAGGGGKGIRKVETEADLEAA  196

Query:  181 FESASQEALAAFGNGAMYIEKVIYPARHIEVQILGDSFGKIVHLGERDCSLQRNNQKVLE  240
            F +ASQEAL AFGNGAMY+EKVIYPARHIEVQILGD++G I+HLGERDCSLQRNNQKVLE
Sbjct:  197 FNAASQEALGAFGNGAMYLEKVIYPARHIEVQILGDAYGNIIHLGERDCSLQRNNQKVLE  256

Query:  241 ESPSVAIGNTLRQQIGEAAVRAAEAVSYENAGTIEFLLDENSGQFYFMEMNTRVQVEHPV  300
            ESPS+AIGNTLR  +G+AAVRAAEAV+YENAGTIEFLLDE+S +FYFMEMNTR+QVEHPV
Sbjct:  257 ESPSIAIGNTLRHEMGQAAVRAAEAVAYENAGTIEFLLDEDSEKFYFMEMNTRIQVEHPV  316
```

```
Query:  301 TEFVTGVDIVKEQIRIAAGIPLSVSQNDIKLTGHAIECRINAENPQFNFAPCPGTINGLH  360
            TEFVTGVDIVKEQI+IAAG PL+++Q DI +TGHAIECRINAEN  FNFAP PG I   L+
Sbjct:  317 TEFVTGVDIVKEQIKIAAGQPLAINQEDITITGHAIECRINAENTAFNFAPSPGKITDLY  376

Query:  361 LPAGGMGLRVDSAVYTGYTIPPYYDSMIAKVIVHGENRFDALMKMQRALYELEIDGIVTN  420
            +P+GG+GLRVDSAVY GY IPPYYDSMIAK+IVHG NRFDALMKMQRAL ELEI+GI+TN
Sbjct:  377 MPSGGVGLRVDSAVYNGYAIPPYYDSMIAKIIVHGSNRFDALMKMQRALVELEIEGIITN  436

Query:  421 TEFQMDLISDKKVLAGDYDTSFLMEDFLPRY  451
            T+FQ+DLISDK+V+AGDYDTSFLME FLP Y
Sbjct:  437 TDFQLDLISDKRVIAGDYDTSFLMETFLPHY  467
```

Based on this analysis, it was predicted that these proteins and their epitopes could be useful antigens for vaccines or diagnostics.

EXAMPLE 1680

A DNA sequence (GBSx1784) was identified in *S. agalactiae* <SEQ ID 5213> which encodes the amino acid sequence <SEQ ID 5214>. This protein is predicted to be acetyl-CoA carboxylase beta subunit (accD). Analysis of this protein sequence reveals the following:

```
Possible site: 60
>>> Seems to have no N-terminal signal sequence

----- Final Results -----
            bacterial cytoplasm --- Certainty = 0.3571(Affirmative) < succ>
            bacterial membrane  --- Certainty = 0.0000(Not Clear)   < succ>
             bacterial outside  --- Certainty = 0.0000(Not Clear)   < succ>
```

The protein has homology with the following sequences in the GENPEPT database.

```
>GP: AAF98280 GB: AF197933 acetyl-CoA carboxylase beta subunit
[Streptococcus pneumoniae]
Identities = 221/285 (77%), Positives = 248/285 (86%), Gaps = 1/285 (0%)

Query:    1 MALFSKKDKYIRISPNKALGSSDKRSLPEVPDELFAKCPSCKHMIYQKDLGLAKICPACS   60
            MALFSKKDKYIRI+PN+++    +   PEVPDELF++CP CKH IYQKDLG +ICP CS
Sbjct:    1 MALFSKKDKYIRINPNRSVREKPQAK-PEVPDELFSQCPGCKHTIYQKDLGSERICPHCS   59

Query:   61 YNFRISAQERLLLTVDEDSFEELFTGIETKDPLNFPNYREKLAATRQKTNLDEAVVTGLA  120
            Y FRISAQERL LT+D  +F+ELFTGIE+KDPL+FP Y++KLA+ R+KT L EAVVTG A
Sbjct:   60 YTFRISAQERLALTIDMGTFKELFTGIESKDPLHFPGYQKKLASMREKTGLHEAVVTGTA  119

Query:  121 KIKGQTTALAIMDSHFIMASMGTVVGEKLTRLFELATEKKLPIVIFTASGGARMQEGIMS  180
             IKGQT AL IMDS+FIMASMGTVVGEK+TRLFE AT +KLP+V+FTASGGARMQEGIMS
Sbjct:  120 LIKGQTVALGIMDSNFIMASMGTVVGEKITRLFEYATVEKLPVVLFTASGGARMQEGIMS  179

Query:  181 LMQMAKVSAAVKRHSNQGLFYLTILTDPTTGGVTASFAMEGDIILAEPQALVGFAGRRVI  240
            LMQMAK+SAAVKRHSN GLFYLTILTDPTTGGVTASFAMEGDIILAEPQ+LVGFAGRRVI
Sbjct:  180 LMQMAKISAAVKRHSNAGLFYLTILTDPTTGGVTASFAMEGDIILAEPQSLVGFAGRRVI  239

Query:  241 ETTVREDLPEGFQKAEFLLEHGFVDAIINRTELRDCIAQLIAFHG  285
            E TVRE LPE FQKAEFLLEHGFVDAI+ R +L D IA L+  HG
Sbjct:  240 ENTVRESLPEDFQKAEFLLEHGFVDAIVKRRDLPDTIASLVRLHG  284
```

A related DNA sequence was identified in *S. pyogenes* <SEQ ID 5215> which encodes the amino acid sequence <SEQ ID 5216>. Analysis of this protein sequence reveals the following:

```
Possible site: 60
>>> Seems to have no N-terminal signal sequence

----- Final Results -----
            bacterial cytoplasm --- Certainty = 0.4092(Affirmative) < succ>
            bacterial membrane  --- Certainty = 0.0000(Not Clear)   < succ>
             bacterial outside  --- Certainty = 0.0000(Not Clear)   < succ>
```

An alignment of the GAS and GBS proteins is shown below.

```
Identities = 232/285 (81%), Positives = 253/285 (88%)

Query:    1 MALFSKKDKYIRISPNKALGSSDKRSLPEVPDELFAKCPSCKHMIYQKDLGLAKICPACS   60
            MALF KKDKYIRI+PN +L  S   ++PEVPDELFAKCP+CKHMIY+KDLGLAKICP CS
Sbjct:    1 MALFRKKDKYIRITPNNSLKGSVSHNVPEVPDELFAKCPACKHMIYKKDLGLAKICPTCS   60

Query:   61 YNFRISAQERLLLTVDEDSFEELFTGIETKDPLNFPNYREKLAATRQKTNLDEAVVTGLA  120
            YNFRISAQERL LTVDE SF+ELFT IETKDPL FP Y+EKL   ++ T L EAV+TG A
Sbjct:   61 YNFRISAQERLTLTVDEGSFQELFTSIETKDPLRFPGYQEKLQKAKETTGLHEAVLTGKA  120

Query:  121 KIKGQTTALAIMDSHFIMASMGTVVGEKLTRLFELATEKKLPIVIFTASGGARMQEGIMS  180
            +K Q   ALAIMDSHFIMASMGTVVGEK+TRLFELA E+ LP+VIFTASGGARMQEGIMS
Sbjct:  121 MVKEQKIALAIMDSHFIMASMGTVVGEKITRLFELAIEENLPVVIFTASGGARMQEGIMS  180

Query:  181 LMQMAKVSAAVKRHSNQGLFYLTILTDPTTGGVTASFAMEGDIILAEPQALVGFAGRRVI  240
            LMQMAKVSAAVKRHSN GLFYLTILTDPTTGGVTASFAMEGDIILAEPQ+LVGFAGRRVI
Sbjct:  181 LMQMAKVSAAVKRHSNAGLFYLTILTDPTTGGVTASFAMEGDIILAEPQSLVGFAGRRVI  240

Query:  241 ETTVREDLPEGFQKAEFLLEHGFVDAIINRTELRDCIAQLIAFHG                285
            ETTVRE+LP+ FQKAEFL +HGFVDAI+ RTELRD IA L+AFHG
Sbjct:  241 ETTVRENLPDDFQKAEFLQDHGFVDAIVKRTELRDKIAHLVAFHG                285
```

Based on this analysis, it was predicted that these proteins and their epitopes could be useful antigens for vaccines or diagnostics.

EXAMPLE 1681

A DNA sequence (GBSx1785) was identified in *S. agalactiae* <SEQ ID 5217> which encodes the amino acid sequence <SEQ ID 5218>. This protein is predicted to be acetyl-CoA carboxylase alpha subunit (accA). Analysis of this protein sequence reveals the following:

```
Possible site: 50
>>> Seems to have no N-terminal signal sequence
     INTEGRAL    Likelihood = -1.22    Transmembrane    149-165 (149-165)

----- Final Results -----
              bacterial membrane  --- Certainty = 0.1489(Affirmative) < succ>
               bacterial outside  --- Certainty = 0.0000(Not Clear)   < succ>
             bacterial cytoplasm  --- Certainty = 0.0000(Not Clear)   < succ>
```

A related GBS nucleic acid sequence <SEQ ID 9555> which encodes amino acid sequence <SEQ ID 9556> was also identified.

The protein has homology with the following sequences in the GENPEPT database.

```
>GP: AAF98281 GB: AF197933 acetyl-CoA carboxylase alpha subunit
[Streptococcus pneumoniae]
Identities = 186/254 (73%), Positives = 222/254 (87%)

Query:   13 DVTRILKDARDQGRLTALDYAELIFDNFMELHGDRQFADDKSIIGGLGYLAGRPVTIVGI   72
            ++ +I+++AR+Q RLT LD+A  IFD F++LHGDR F DD +++GG+G+L  + VT+VGI
Sbjct:    2 NIAKIVREAREQSRLTTLDFATGIFDEFIQLHGDRSFRDDGAVVGGIGWLGDQAVTVVGI   61

Query:   73 QKGKNLQDNLDRHFGQPHPEGYRKALRLMKQAEKFGRPVITFINTAGAYPGVGAEERGQG  132
            QKGK+LQDNL R+FGQPHPEGYRKALRLMKQAEKFGRPV+TFINTAGAYPGVGAEERGQG
Sbjct:   62 QKGKSLQDNLKRNFGQPHPEGYRKALRLMKQAEKFGRPVVTFINTAGAYPGVGAEERGQG  121

Query:  133 EAIARNLLEMSDLKVPIIAIIIGEGGSGGALALAVADKVWMLEHTVYSILSPEGFASILW  192
            EAIARNL+EMSDLKVPIIAIIIGEGGSGGALALAVAD+VWMLE+++Y+ILSPEGFASILW
Sbjct:  122 EAIARNLMEMSDLKVPIIAIIIGEGGSGGALALAVADRVWMLENSIYAILSPEGFASILW  181

Query:  193 KDGTRTTEAAQLMKMTAGELYHMEVVDKVIPEHGYFSSEIVDMIKTSLISELEVLSQLSL  252
            KDGTR  EAA+LMK+T+ EL  M+VVDKVI E G  S E++  +K  L +EL LSQ  L
Sbjct:  182 KDGTRAMEAAELMKITSHELLEMDVVDKVISEIGLSSKELIKSVKKELQTELARLSQKPL  241
```

```
Query: 253 EDLLEQRYQRFRKY                                            266
            E+LLE+RYQRFRKY
Sbjct: 242 EELLEERYQRFRKY                                            255
```

A related DNA sequence was identified in *S. pyogenes* <SEQ ID 5219> which encodes the amino acid sequence <SEQ ID 5220>. Analysis of this protein sequence reveals the following:

```
Possible site: 61

>>> Seems to have no N-terminal signal sequence

INTEGRAL Likelihood = -1.22 Transmembrane 139-155 (139-155)

----- Final Results -----
            bacterial membrane --- Certainty = 0.1489 (Affirmative) < succ> bacterial outside --- Certainty = 0.0000 (Not Clear) < succ> bacterial cytoplasm --- Certainty = 0.0000 (Not Clear) < succ>
```

The protein has homology with the following sequences in the databases:

```
>GP:AAF98281 GB:AF197933 acetyl-CoA carboxylase alpha subunit
[Streptococcus pneumoniae]

Identities = 189/254 (74%), Positives = 225/254 (88%)

Query:   3 DVSRILKEARDQGRLTTLDYANLIFDDFMELHGDRHFSDDGAIVGGLAYLAGQPVTVIGI   62
           ++++I++EAR+Q RLTTLD+A  IFD+F++LHGDR F DDGA+VGG+ +L  Q VTV+GI
Sbjct:   2 NIAKIVREAREQSRLTTLDFATGIFDEFIQLHGDRSFRDDGAVVGGIGWLGDQAVTVVGI   61

Query:  63 QKGKNLQDNLARNFGQPNPEGYRKALRLNKQAEKFGRPVVTFINTAGAYPGVGAEERGQG  122
           QKGK+LQDNL RNFGQP+PEGYRKALRLMKQAEKfGRPVVTFINThGAYPGVGAEERGQG
Sbjct:  62 QKGRSLQDNLKRNFGQPHPEGYRKALRLmKQAEKFGRPVVTFINTAGAYPGVGAEERGQG  121

Query: 123 EAIARNLMEMSDLKVPIIAIIIGEGGSGGALALAVADQVWMLENTMYAVLSPEGFASILW  182
           EAIA+NLMEMSDLKVPITAI1IGEGGSGGALALAVAD+VWMLEN++YA LSPEGFASILW
Sbjct: 122 EAIARNLMEMSDLKVPIIAIIIGEGGSGGALALAVADRVWMLENSIYAILSPEGFASILW  181

Query: 183 KDGSRATEAAELMKITAGELYKNGIVDRIIPEHGYFSSEIVDIIKANLIEQITSLQAKPL  242
           KDG+RA EAAELMKIT+ EL +N +VD++I E G  S E++ +K  L  ++  L  RPL
Sbjct: 182 KDGTRANEAAELMKITSHELLEMDVVDKVISEIGLSSKELIKSVKKELQTELARLSQKPL  241

Query: 243 DQLLDERYQRFRKY                                            256
           ++LL+ERYQRFRKY
Sbjct: 242 EELLEERYQRFRKY                                            255
```

An alignment of the GAS and GBS proteins is shown below.

```
Identities = 204/254 (80%), Positives = 236/254 (92%)

Query:  13 DVTRILKDARDQGRLTALDYAELIFDNFMELHGDRQFADDKSIIGGLGYLAGRPVTIVGI   72
           DV+RILK+ARDQGRLT LDYA LIFD+FNELHGDR F+DD +I+GGL YLAG+PVT++GI
Sbjct:   3 DVSRILKEARDQGRLTTLDYANLIFDDFMELHGDRHFSDDGAIVGGLAYLAGQPVTVIGI   62

Query:  73 QKGKNLQDNLDRHFGQPHPEGYRKALRLMKQAEKFGRPVITFINTAGAYPGVGAEERGQG  132
           QKGKNLQDNL R+FGQP+PEGYRKALRLMKQAEKFGRPV+TFINTAGAYPGVGAEERGQG
Sbjct:  63 QKGKNLQDNLARNFGQPNPEGYRKALRLMKQAEKFGRPVVTFINTAGAYPGVGAEERGQG  122

Query: 133 EAIARNLLEMSDLKVPIIAIIIGEGGSGGALALAVADKVWMLEHTVYSILSPEGFASILW  192
           EAIA+NL+EMSDLKVPIIAIIIGEGGSGGALALAVAD+VWMLE+T+Y++LSPEGFASILW
Sbjct: 123 EAIAKNLMEMSDLKVPIIAIIIGEGGSGGALALAVADQVWMLENTMYAVLSPEGFASILW  182

Query: 193 KDGTRTTEAAQLMKMTAGELYHMEVVDKVIPEHGYFSSEIVDMIKTSLISELEVLSQLSL  252
           KDG+R TEAA+LMK+TAGELY M +VD++IPEHGYFSSEIVD IK +LI ++  L    L
```

```
                                -continued
Sbjct: 183 KDGSRATEAAELHKITAGELYKMGIVDRIIPEHGYFSSEIVDIIKANLIEQITSLQAKPL 242

Query: 253 EDLLEQRYQRFRKY                                              266
           + LL++RYQRFRKY
Sbjct: 243 DQLLDERYQRFRKY                                              256
```

Based on this analysis, it was predicted that these proteins and their epitopes could be useful antigens for vaccines or diagnostics.

EXAMPLE 1682

A DNA sequence (GBSx1786) was identified in *S. agalactiae* <SEQ ID 5221> which encodes the amino acid sequence <SEQ ID 5222>. This protein is predicted to be sakacin A production response regulator. Analysis of this protein sequence reveals the following:

```
Possible site: 56

>>> Seems to have no N-terminal signal sequence

----- Final Results -----
            bacterial cytoplasm --- Certainty = 0.3304 (Affirmative) < succ> bacterial membrane  --- Certainty = 0.0000 (Not Clear)   < succ> bacterial outside   --- Certainty = 0.0000 (Not Clear)   < succ>
```

A related GBS nucleic acid sequence <SEQ ID 9557> which encodes amino acid sequence <SEQ ID 9558> was also identified.

The protein has homology with the following sequences in the GENPEPT database.

```
>GP:BAA88824 GB:AB016077 sakacin A production response regulator
[Streptococcus mutans]

Identities = 76/142 (53%), Positives = 99/142 (69%)

Query:  36 MQTFKAKGQLARNSFTELSRALEQRNDGFKMQRVSNWANQAQVGRPHFWVYYRKDTDQLD    95
           M   K  GQ AR  FTE+++ L  ++  F+M RVSNWANQAQV RPHEW YY++  D  D
Sbjct:   1 MIALKTLGQSARAEFTEIAKVLALKVSPFEMMRVSNWANQAQVVRPHFWCYYKQPEDNQD    60

Query:  96 DVAVALRVYGVKDSFGVSLEVSFVERQKSDKTLEKQARVLSIPIASPLYFMVQRQGETHR   155
           DV +A+R+YG   +FG+S+EVSF+ER+KS   TL KQ +VL IPIA PLY+  Q + E+HR
Sbjct:  61 DVGLAIRLYGNSANFGISVEVSFIERKRSKATLAKQHKVLDIPIAEPLYYFAQEKSESHR   120

Query: 156 EEGNEENRQRLMQEIKSGKVRK                                        177
           G E RQ L Q++G+VRK
Sbjct: 121 VSGTEAYRQMLRQKVADGQVRK                                        142
```

No corresponding DNA sequence was identified in *S. pyogenes*.

Based on this analysis, it was predicted that this protein and its epitopes, could be useful antigens for vaccines or diagnostics.

EXAMPLE 1683

A DNA sequence (GBSx1787) was identified in *S. agalactiae* <SEQ ID 5223> which encodes the amino acid sequence <SEQ ID 5224>. This protein is predicted to be seryl-tRNA synthetase (serS). Analysis of this protein sequence reveals the following:

```
Possible site: 60

>>> Seems to have no N-terminal signal sequence

----- Final Results -----
            bacterial cytoplasm --- Certainty = 0.1866 (Affirmative) < succ>
```

```
                   bacterial membrane --- Certainty = 0.0000 (Not Clear) < succ> bacterial outside --- Certainty = 0.0000 (Not Clear) < succ>
```

The protein has homology with the following sequences in the GENPEPT database.

```
>GP:CAB11789 GB:Z99104 seryl-tRNA synthetase [Bacillus subtilis]

Identities = 262/425 (61%), Positives = 322/425 (75%), Gaps = 1/425 (0%)

Query:    1 MLDLKRIRTDFDVVAKKLATRGVDQETLTTLKELDIKRRELLIKAEEAKAQRNVASAAIA    6
            MLD K +R +F  +   KL +G D       + LD +RREL+ K EE K +RN  S  +A
Sbjct:    1 MLDTKNLRANFQEIKAKLVHKGEDLTDFDKFEALDDRRRELIGKVEELKGKRNEVSQQVA   60

Query:   61 QAKRNKENADEQIAAMQTLSADIKAIDAELADVDANLQSMVTVLPNTPADDVPLGADEDE  120
              KR K++AD   I  M+ +   +IK +D EL  V+A L +++   +PN P + VP+G  ED+
Sbjct:   61 VLKREKKDADHIIKEHREVGEEIKKLDEELRTVEAELDTILLSIPNIPHESVPVGETEDD  120

Query:  121 NVEVRRWGTPREFDFETKAHWDLGESLGILDWERGAKVTGSRFLFYKGLGARLERAIYSF  180
            NVEVR+WG       F +E K HWD+ + LGILD+ER AKVTGSRF+FYKGLGARLERA+Y+F
Sbjct:  121 NVEVRKWGEKPSFAYEPKPHWDIADELGILDFERAAKVTGSRFVFYKGLGARLERALYNF  180

Query:  181 MLDEHAKE-GYTEVIPPYMVNHDSMFGTGQYPKFKEDTFELADSPFVLIPTAEVPLTNYY  239
            MLD H  E   YTEVIPPYMVN  SM GTGQ PKF+ED F++ +   + LIPTAEVP+TN +
Sbjct:  181 MLDLHVDEYNYTEVIPPYMVNRASMTGTGQLPKFEEDAFKIREEDYFLIPTAEVPITNMH  240

Query:  240 RDEIIDGKELPIYFTAMSPSFRSEAGSAGRDTRGLIRLHQFHKVEMVKFAKPEESYQELE  299
            RDEI+ G  LPI + A S   FRSEAGSAGRDTRGLIR HQF+KVE+VKF KPE+SY+ELE
Sbjct:  241 RDEILSGDSLPINYAAFSACFRSEAGSAGRDTRGLIRQHQFNKVELVKFVKPEDSYEELE  300

Query:  300 KMTANAENILQKLNLPYRVITLCTGDMGFSAAKTYDLEVWIPAQNTYREISSCSNTEDFQ  359
            K+T   AE +LQ L LPYRV+++CTGD+GF+AAK YD+SVWIP+Q+TYRSISSCSN E FQ
Sbjct:  301 KLTNQAERVLQLLSLPYRVMSMCTGDLGFTAAKKYDISVWIPSQDTYRSISSCSNFSAFQ  360

Query:  360 ARRAQIRYRDSVDGKVRLLHTLNGSGLAVGRTVAAILSNYQNEDGSVTIPSVLRPYMGNI  419
            ARRA  IR+R E  GK    +HTLNGSGLAVGRTVAAILSNYQ EDGSV IP+VLRPYMGN
Sbjct:  361 ARRANIRFRREAKGKPSHVHTLNGSGLAVGRTVAAILSNYQQEDGSVVIPKVLRPYMGNR  420

Query:  420 DIIKP                                                        424
            +++KP
Sbjct:  421 EVMKP                                                        425
```

A related DNA sequence was identified in *S. pyogenes* <SEQ ID 5225> which encodes the amino acid sequence <SEQ ID 5226>. Analysis of this protein sequence reveals the following:

```
Possible site: 60

>>> Seems to have no N-terminal signal sequence

----- Final Results -----
               bacterial cytoplasm --- Certainty = 0.2453 (Affirmative) < succ> bacterial membrane --- Certainty = 0.0000 (Not Clear) < succ> bacterial outside --- Certainty = 0.0000 (Not Clear) < succ>
```

An alignment of the GAS and GBS proteins is shown below.

```
Identities = 357/424 (84%), Positives = 386/424 (90%)

Query:    1 MLDLKRIRTDFDVVAKKLATRGVDQETLTTLKELDIKRRELLIKAEEAKAQRNVASAAIA   60
            MLDLKRIRTDFD VA KL  RGV ++TLT LKELD KRR LL+++EE KA+RN+ASAAIA
Sbjct:    1 MLDLKRIRTDFDTVAAKLKNRGVSEDTLTHLKELDEKRRALLVQSEELKAERNIASAAIA   60

Query:   61 QAKRNKENADEQIAAMQTLSADIKAIDASLADVDANLQSMVTVLPNTPADDVPLGADEDE  120
            QAKR KE+A +QIA MQ +SADIK  ID +L  +D +   ++TVLPNTP D VP+GADE++
Sbjct:   61 QAKRQKEDATQQIADMQKVSADIKTIDNQLVAIDQQVTDIITVLPNTPHDSVPVGADEED  120
```

```
                           -continued
Query: 121 NVEVRRWGTPREFDFETKAHWDLGESLGILDWERGAKVTGSRFLFYKGLGARLERAIYSF 180
           NVE+RRWGTPR+FDFE KAHWDLGE L ILDWERGAKVTG+RFLFYK LGARLERA+Y+F
Sbjct: 121 NVEIRRWGTPRDFDFEVKAHWDLGEDLDILDWERGAKVTGARFLFYKNLGARLERALYNF 180

Query: 181 MLDEHAKEGYTEVIPPYMVNHDSMFGTGQYPKFKEDTFELADSPFVLIPTAEVPLTNYYR 240
           MLDEH KEGY E+I PYMVNHDSMFGTGQYPKFKEDTFELAD+ FVLIPTAEVPLTNYYR
Sbjct: 181 MLDSHIKEGYQEIITPYMVNHDSMFGTGQYPKFKEDTFELADTNFVLIPTAEVPLTNYYR 240

Query: 241 DEIIDGKELPIYFTAMSPSFRSEAGSAGRDTRGLIRLHQFHKVEMVKFAKPEESYQELEK 300
           EI+DGKELPIYFTANSPSFRSEAGSAGRDTRGLIRLHQFHKVEMVKFAKPEESYQELEK
Sbjct: 241 GEILDGKELPIYFTANSPSFRSEAGSAGRDTRGLIRLHQFHKVEMVKFAKPEESYQELEK 300

Query: 301 MTANAENILQKLNLPYRVITLCTGDMGFSAAKTYDLEVWIPAQNTYREISSCSNTEDFQA 360
           MTANAENILQKL LPYRVI+LCTGDMGFSAAKTYDLEVWIPAQNTYREISSCSNTEDFQA
Sbjct: 301 MTANAENILQKLGLPYRVISLCTGDMGFSAAKTYDLEVWIPAQNTYREISSCSNTEDFQA 360

Query: 361 RRAQIRYRDEVDGKVRLLHTLNGSGLAVGRTVAAILENYQNEDGSVTIPEVLRPYMGNID 420
           RRAQIRYRDE DGKV+LLHTLNGSGLAVGRTVAAILENYQNEDGSVTIPEVLRPYMG
Sbjct: 361 RRAQIRYRDEADGKVKLLHTLNGSGLAVGRTVAAILENYQNEDGSVTIPEVLRPYMGGET 420

Query: 421 IIKP                                                        424
           +I P
Sbjct: 421 VISP                                                        424
```

Based on this analysis, it was predicted that these proteins and their epitopes could be useful antigens for vaccines or diagnostics.

EXAMPLE 1684

A DNA sequence (GBSx1788) was identified in *S. agalactiae* <SEQ ID 5227> which encodes the amino acid sequence <SEQ ID 5228>. Analysis of this protein sequence reveals the following:

```
Possible site: 36

>>> Seems to have no N-terminal signal sequence

INTEGRAL    Likelihood = -11.36 Transmembrane 313-329 (306-332)

INTEGRAL    Likelihood =  -9.24 Transmembrane 159-175 (155-179)

INTEGRAL    Likelihood =  -4.19 Transmembrane  20-36  (16-37)

INTEGRAL    Likelihood =  -3.29 Transmembrane 271-287 (271-287)

INTEGRAL    Likelihood =  -2.97 Transmembrane 210-226 (209-227)

INTEGRAL    Likelihood =  -2.87 Transmembrane 242-258 (241-258)

INTEGRAL    Likelihood =  -2.13 Transmembrane  52-68  (50-68)

----- Final Results -----
              bacterial membrane  --- Certainty = 0.5543 (Affirmative) < succ> bacterial outside --- Certainty = 0.0000 (Not Clear)  < succ> bacterial cytoplasm --- Certainty = 0.0000 (Not Clear)  < succ>
```

A related GBS nucleic acid sequence <SEQ ID 9559> which encodes amino acid sequence <SEQ ID 9560> was also identified.

The protein has homology with the following sequences in the GENPEPT database.

```
>Gp:CAA07406 GB:AJ006986 transmembrane protein
[Streptococcus pneumoniae]

Identities = 72/330 (21%), Positives = 143/330 (42%), Gaps = 32/330 (9%)

Query:  14 RHYGLDLLRIISMFNIVITHVLGKGGLRSSVEGHADSYFIVTWIIQVLVYGAVNCYALIS  73
           R+  LDLL++++    +V+ H    GG + +     +Y      + ++  VN Y L+
Sbjct:   5 RNINLDLLKVLACVGVVLLHTT-MGGFKETGAWNFLTYLYYLGTYSIPLFFNVNGYLLL-  62
```

-continued

```
Query:   74 GYVGINSRYRYSKLLSIWAQVFFYTFTITALFAITGHE------VTLLNWRDAFFPIVSG 127
            G   I  Y   K+  +   V +TF I LF    E      +  L  +  FF
Sbjct:   63 GKREITYSYILQKIKWLLITVSSWTF-IVWLFKRDFTENLIKKIIGSLIQKGYFF----- 116

Query:  128 QYWYITAYFGLLVFMPVINNGLNALTDKQLKQLVLLMFI--IFSILPAVLNNRVPEFSLS 185
            Q+W+  A   +  +P++    LN+     L  L LLM I  IF +   +L   +  +  +
Sbjct:  117 QEWFFGALILIYLCLPILRQFLNS-KRSYLYSLSLLMTIGLIFELSNILLQMPIQTYVIQ 175

Query:  186 KGFEMTWLLILYIIGAYLKRIDL----NIFKTSYLLIIYLLSLVATYAMKFSVGDIW--- 238
               TW    Y++G Y+ +  +   + FK   ++  LL L++   + F    I+
Sbjct:  176 TFRLWTW-FFYYLLGGYIAQFTIEEIESRFKNWMKIVSILLLLISPIILFFIAKTIYHNL 234

Query:  239 ---YWYVSPTLTLGAVSLFILFARASIKPSGFLKKIIVVLAPSTLGVYLCHLHPLIVKYF 295
               Y+Y +  +  +  +F+     ++  +   ++ IV L+   T+GV++   +H  I+K +
Sbjct:  235 FAEYFYDTLFVKVSTLGIFLTILMLTLNEN--RRESIVSLSNQTMGVFI--IHTYIMKVW 290

Query:  296 VRDFAETFVYESIYLYPFLILGAGILIYLL                              325
             +     FV  +    F  +  + I++ +L
Sbjct:  291 SKVLGFNFVGAYLLFALFTLSVSFIIVGML                              320
```

No corresponding DNA sequence was identified in S. pyogenes.

Based on this analysis, it was predicted that this protein and its epitopes, could be useful antigens for vaccines or diagnostics.

EXAMPLE 1685

A DNA sequence (GBSx1789) was identified in S. agalactiae <SEQ ID 5229> which encodes the amino acid sequence <SEQ ID 5230>. Analysis of this protein sequence reveals the following:

```
Possible site: 59

>>> Seems to have no N-terminal signal sequence

----- Final Results -----
         bacterial cytoplasm --- Certainty = 0.2752 (Affirmative) < succ> bacterial membrane  --- Certainty = 0.0000 (Not Clear)   < succ> bacterial outside   --- Certainty = 0.0000 (Not Clear)   < succ>
```

A related GBS nucleic acid sequence <SEQ ID 9561> which encodes amino acid sequence <SEQ ID 9562> was also identified.

The protein has homology with the following sequences in the GENPEPT database.

```
>GP:AAD46488 GB:AF130465 unknown [Streptococcus salivarius]

Identities = 88/112 (78%), Positives = 96/112 (85%)

Query:    1 MAQSLNKTVEFQTTGVSYLGNGNKVGKFLVGDQALEFYNDKNVNDYIQIPWTSINQIGAN    60
            MAQSLNKTVE  TTGVSY+ +G KVGKFL+GD ALEFY D NV  YIQIPWTSI QIGAN
Sbjct:    1 MAQSLNKTVELHTTGVSYMAIGGKVGKFLIGDVALEFYPDVNVEQYIQIPWTSITQIGAN    60

Query:   61 VSRKKISRHFEVFTDQGKFLFASKDSGTILKHARRHIGDDKVVKLPTLIQTI          112
            VS K+ISRHFEV TD+ KFLFASKDSG ILK AR H+G++KVVKLPTLIQTI
Sbjct:   61 VSGKRISRHFEVLTDKSKFLFASKDSGKILKIAREHLGNEKVVKLPTLIQTI          112
```

A related DNA sequence was identified in S. pyogenes <SEQ ID 5231> which encodes the amino acid sequence <SEQ ID 5232>. Analysis of this protein sequence reveals the following:

```
Possible site: 59

>>> Seems to have no N-terminal signal sequence

----- Final Results -----
         bacterial cytoplasm --- Certainty = 0.3301 (Affirmative) < succ>
```

```
            bacterial membrane --- Certainty = 0.0000 (Not Clear) < succ> bacterial outside  --- Certainty = 0.0000 (Not Clear) < succ>
```

An alignment of the GAS and GBS proteins is shown below.

```
Identities = 87/116 (75%), Positives = 101/116 (87%)

Query:   1 MAQSLNKTVEFQTTGVSYLGMGNKVGKFLVGDQALEFYNDKNVNDYIQIPWTSINQIGAN    60
           MAQSLN +VE++T  VSYLGMG KVG  L+GD+ALEFYNDKNVNDYIQIPWT+IN IGAN
Sbjct:   1 MAQSLNTSVEYKTKAVSYLGMGGKVGHILLGDKALEFYNDKNVNDYIQIPWTAINHIGAN    60

Query:  61 VSRKKISRHFEVFTDQGKFLFASKDSGTILKHARRHIGDDKVVKLPTLIQTILKIF     116
           VSRKK+SRHFE+FTDQGKFLFAS DSG ILK  R+HIG++KV+ LPTL+QT +  F
Sbjct:  61 VSRKKVSRHFEIFTDQGKFLFASGDSGKILKITRQHIGNEKVITLPTLMQTFINKF     116
```

Based on this analysis, it was predicted that these proteins and their epitopes could be useful antigens for vaccines or diagnostics.

EXAMPLE 1686

A DNA sequence (GBSx1790) was identified in *S. agalactiae* <SEQ ID 5233> which encodes the amino acid sequence <SEQ ID 5234>. This protein is predicted to be mannose-specific phosphotransferase system component IID (manZ). Analysis of this protein sequence reveals the following:

```
Possible site: 39

>>> Seems to have no N-terminal signal sequence

INTEGRAL Likelihood = -8.92 Transmembrane 281-297 (279-302)

INTEGRAL Likelihood = -4.88 Transmembrane 187-203 (185-205)

INTEGRAL Likelihood = -4.35 Transmembrane 260-276 (257-277)

INTEGRAL Likelihood = -1.01 Transmembrane 129-145 (129-145)

----- Final Results -----
            bacterial membrane  --- Certainty = 0.4567 (Affirmative) < succ> bacterial outside   --- Certainty = 0.0000 (Not Clear)   < succ> bacterial cytoplasm --- Certainty = 0.0000 (Not Clear)   < succ>
```

The protein has homology with the following sequences in the GENPEPT database.

```
>GP:AAD46487 GB:AF130465 mannose-specific phosphotransferase system
component IID [Streptococcus salivarius]

Identities = 247/303 (81%) , Positives = 276/303 (90%)

Query:    1 MTEQIKLSKSDRQKVWWRSQFLQGSWNYERNQNMGWAYALIPALKKLYTTKEDRAAALER    60
            M E+I+LS++DR+KVWWRSQFLQGSWNYERNQN+GWAY+LIPA+KKLYT KED+AAAL+R
Sbjct:    1 MAEKIQLSQADRKKVWWRSQFLQGSWNYERNQNLGWAYSLIPAIKKLYTNKEDQAAALKR    60

Query:   61 HMEFFNTHPYVAAPIIGVTLALEEEKASGTPVEDKAIQGVKIGMMGPLAGIGDPVFWFTV   120
            H+EFFNTHPYVAAPI+GVTLALEEEKA+GT +ED AIQGVKIGM NGPLAGIGDPVFWFTV
Sbjct:   61 HLEFFNTHPYVAAPIMGVTLALEEEKANGTDIEDAAIQGVKIGMMGPLAGIGDPVFWFTV   120

Query:  121 RPILGALGASLASAGNILGPIIFFVGWNLIRMSFLWYTQELGYKSGKEITKDMSGGILQD   180
            RPILGALGASLA AGNI GP+IFF+GWNLIRM+FLWYTQELGYK+G  EITKDMSGGIL+D
Sbjct:  121 RPILGALGASLAQAGNIAGPLIFFIGWNLIRMAFLWYTQELGYKAGSEITKDMSGGILKD   180

Query:  181 ITKGASILGMFILAVLVKRWVAINFTVDLPKKTLSEGAYINFPKDHVSGQQLHDILGQVQ   240
            ITKGASILGMFILAVLV+RWV+I FTV+LP K LS+GAYI +PK +VSG QL   ILGQV
Sbjct:  181 ITKGASILGMFILAVLVERWVSIVFTVNLPGKVLSKGAYIEWPKGNVSGDQLKTILGQVN   240
```

-continued

```
Query: 241 SGLSLDKNQFQTLQGQLDSLIPGLAGLLLTFFCNWLLKKKVSPITIIIGLFIVGILARLA 300
            LS DK+Q  TLQ QLDSLIPGL GLLLTF CNWLLKKKVSPITIIIGL +VGI+A
Sbjct: 241 DKLSFDKIQVDTLQKQLDSLIPGLNGLLLTFACNWLLKKKVSPITIIIGLFVVGIVASFF 300

Query: 301 GVM 303
            G+M
Sbjct: 301 GIM 303
```

A related DNA sequence was identified in *S. pyogenes* <SEQ ID 5235> which encodes the amino acid sequence <SEQ ID 5236>. Analysis of this protein sequence reveals the following:

```
Possible site: 55

>>> Seems to have no N-terminal signal sequence

INTEGRAL Likelihood = -8.39 Transmembrane 284-300 (279-302)

INTEGRAL Likelihood = -4.88 Transmembrane 261-277 (257-278)

INTEGRAL Likelihood = -4.51 Transmembrane 181-197 (180-198)

----- Final Results -----
           bacterial membrane --- Certainty = 0.4354 (Affirmative) < succ> bacterial outside --- Certainty = 0.0000 (Not Clear) < succ> bacterial cytoplasm --- Certainty = 0.0000 (Not Clear) < succ>
```

The protein has homology with the following sequences in the databases:

```
>GP:AAD46487 GB:AF130465 mannose-specific phosphotransferase system
component IID [Streptococcus salivarius]

Identities 239/303 (78%), Positives = 268/303 (87%)

Query:   1 MTEQIKLTKSDRQRVWWRSQFLQGSWNYERNQNMGWAYALIPALKKLYTSPEDRAAALER   60
           M E+I+L+++DR++VWWRSQFLQGSWNYERNQN+GWAY+LIPA+KKLYT+  ED+AAAL+R
Sbjct:   1 MA KIQLSQADRKKVWWRSQFLQGSWNYERNQNLGWAYSLIPAIKKLYTNKEDQAAALKR   60

Query:  61 HMEFFNTHPYVAAPIIGVTLALEEERANGTPIDDKAIQGVKIGMMGPLAGIGDPVFWFTI  120
           H+EFFNTHPYVAAPI+GVTLALEEE+ANGT I+D AIQGV+IGMNGPLAGIGDPVFWFT+
Sbjct:  61 HLEFFNTHPYVAAPIMGVTLALEEEKANGTDIEDAAIQGVRIGMMGPLAGIGDPVFWFTV  120

Query: 121 RPILGALGASLASTGNIVGPLLFFFGWNLIRMAFLWYTQEFGYKAGSEITKDMSGGILQD  180
           RPILGALGASLA  GNI GPL+FF GWNLIRMAFLWYTQE GYKAGSEITKDMSGGIL+D
Sbjct: 121 RPILGALGASLAQAGNIAGPLIFFIGWNLIRMAFLWYTQELGYKAGSEITKDHSGGILKD  180

Query: 181 ITKGASILGMFILAVLVQRWVSINFTIDLPGKQLSDGAYVVFPDGAVKGAELKTILANAI  240
           ITKGASILGMFILAVLV+RWVSI FT++LPGK LS GAY+ +P G V G +LKTIL
Sbjct: 181 ITKGASILGMFILAVLVERWVSIVFTVNLPGKVLSKGAYIEWPKGNVSGDQLKTILGQVN  240

Query: 241 GGMSLDKVQAQTLQGQLDSLIPCLAGLLLTFLCMWLLKKKVSPIAIIIGLFAFGILAHLA  300
           +S DK+Q  TLQ QLDSLIPGL GLLLTF CMWLLKKKVSPI IIIGLF  GI+A
Sbjct: 241 DKLSFDKIQVDTLQKQLDSLIPGLHGLLLTFACMWLLKKKVSPITIIIGLFVVGIVASFF  300

Query: 301 GIM 303
           GIM
Sbjct: 301 GIM 303
```

An alignment of the GAS and GBS proteins is shown below.

```
Identities = 255/303 (84%), Positives = 277/303 (91%)

Query:   1 MTEQIKLSKSDRQKVWWRSQFLQGSWNYERNQNMGWAYALIPALKKLYTTKEDRAAALER   60
           MTEQIKL+KSDRQ+VWWRSQFLQGSWNYERNQNMGWAYALIPALKKLYT+ EDRAAALER
Sbjct:   1 MTEQIKLTKSDRQRVWWRSQFLQGSWNYERMQNMGWAYALIPALKKLYTSPEDRAAALER   60

Query:  61 HMEFFNTHPYVAAPIIGVTLALESEKASGTPVEDKAIQGVKIGMMGPLAGIGDPVFWFTV  120
           HMEFFNTHPYVAAPIIGVTLALEEE+A+GTP++DKAIQGVKIGMMGPLAGIGDPVFWFT+
```

```
-continued
Sbjct:  61 HMEFFNTHPYVAAPIIGVTLALEEERANGTPIDDKAIQGVKIGMMGPLAGIGDPVFWFTI  120

Query: 121 RPILGALGASLASAGNILGPIIFFVGWNLIRMSFLWYTQELGYKSGKEITKDMSGGILQD  180
           RPILGALGASLAS GNI+GP++FF GWNLIRN+FLWYTQE GYK+G EITKDMSGGILQD
Sbjct: 121 RPILGALGASLASTGNIVGPLLFFFGWNLIRNAFLWYTQEFGYKAGSEITKDMSGGILQD  180

Query: 181 ITKGASILGMFILAVLVKRWVAINFTVDLFKKTLSEGAYINFPKDHVSGQQLHDILGQVQ  240
           ITKGASILGMFILAVLV+RWV+INFT+DLP K LS+GAY+ FP   V G +L   IL
Sbjct: 181 ITKGASILGMFILAVLVQRWVSINFTIDLPGKQLSDGAYVVFPDGAVKGAELKTILANAI  240

Query: 241 SGLSLDKMQPQTLQGQLDSLIPGLAGLLLTFFCMWLLKKKVSPITIIIGLFIVGILARLA  300
            G+SLDK+Q QTLQGQLDSLIPGLAGLLLTF CMWLLKKKVSPI IIIGLF  GILA LA
Sbjct: 241 GGMSLDKVQAQTLQGQLDSLIPGLAGLLLTFLCMWLLKKKVSPIAIIIGLFAFGILAHLA  300

Query: 301 GVM                                                          303
           G+M
Sbjct: 301 GIM                                                          303
```

Based on this analysis, it was predicted that these proteins and their epitopes could be useful antigens for vaccines or diagnostics.

EXAMPLE 1687

A DNA sequence (GBSx1791) was identified in *S. agalactiae* <SEQ ID 5237> which encodes the amino acid sequence <SEQ ID 5238>. Analysis of this protein sequence reveals the following:

```
Possible site: 22

>>> Seems to have no N-terminal signal sequence

----- Final Results -----
            bacterial cytoplasm --- Certainty = 0.2580 (Affirmative) < succ> bacterial membrane --- Certainty = 0.0000 (Not Clear) < succ> bacterial outside --- Certainty = 0.0000 (Not Clear) < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1688

A DNA sequence (GBSx1792) was identified in *S. agalactiae* <SEQ ID 5239> which encodes the amino acid sequence <SEQ ID 5240>. This protein is predicted to be mannose-specific phosphotransferase system component IIC (manY). Analysis of this protein sequence reveals the following:

```
Possible site: 39

>>> Seems to have a cleavable N-term signal seq.

INTEGRAL    Likelihood = -5.95    Transmembrane 142-158 (137-165)

INTEGRAL    Likelihood = -2.60    Transmembrane 65-81 (61-81)

INTEGRAL    Likelihood = -1.97    Transmembrane 103-119 (103-122)

----- Final Results -----
              bacterial membrane --- Certainty = 0.3378 (Affirmative) < succ> bacterial outside --- Certainty = 0.0000 (Not Clear) < succ> bacterial cytoplasm --- Certainty = 0.0000 (Not Clear) < succ>
```

A related GBS nucleic acid sequence <SEQ ID 9301> which encodes amino acid sequence <SEQ ID 9302> was also identified.

The protein has homology with the following sequences in the GENPEPT database.

```
>GP:AAD46486 GB:AF130465 mannose-specific phosphotransferase system
component IIC [Streptococcus salivarius]

Identities = 134/186 (72%), Positives = 154/186 (82%), Gaps = 1/186 (0%)

Query:    1 MVKSGDFTQKGINFAFSTAVPLAIAGLFLTMIVRTISTALVHAGDKAASEGNFAAIERFH   60
            +VK G+FT +GI  A +TA+PLA+AGLFLTM+VRT S ALVHA DKAA  GN A +ER H
Sbjct:   86 LVKGGNFTTEGIGVATATAIPLAVAGLFLTMLVRTASVALVHAADKAAESGNIAGVERAH  145

Query:   61 FIALLLQGLRIAFPAALLLAIPSSSVQSILEAHPDWLNGGMQVGGANVVAVGYAHVINHN  120
            ++ALLLQGLRIA PAALLLAIP+ SVQ  L  HP WLN GM VGG MVVAVGYAHVIHHN
Sbjct:  146 YLALLLQGLRIAVPAALLLAIPAESVQHALGLHPSWLNHGHVVGGGMVVAVGYAMVIHHN  205

Query:  121 ATREVWPFFALGFALAALHQLTLIAMGTIGVAIALIYISLSKHGGSK-GTSHAGSHDPIG  179
            ATREVWPFFA+GFA AA++QLTLIA+G IGVAIA IY++LSK GG   G +++ GS DPIG
Sbjct:  206 ATREVWPFFAIGFAFAAISQLTLIALGAIGVAIAFIYLHLSKQGGGNGGGTSSGSGDPIG  265

Query:  180 DILEDY                                                        185
            DILEDY
Sbjct:  266 DILEDY                                                        271
```

A related DNA sequence was identified in *S. pyogenes* <SEQ ID 5241> which encodes the amino acid sequence <SEQ ID 5242>. Analysis of this protein sequence reveals the following:

```
Possible Site: 36

>>> Seems to have an uncleavable N-term signal seq

INTEGRAL    Likelihood = -11.30    Transmembrane   4-20    (1-28)

INTEGRAL    Likelihood =  -7.64    Transmembrane 226-242 (212-247)

INTEGRAL    Likelihood =  -4.14    Transmembrane 102-118 (101-123)

INTEGRAL    Likelihood =  -3.77    Transmembrane  71-87   (69-87)

INTEGRAL    Likelihood =  -3.40    Transmembrane 150-166 (146-167)

INTEGRAL    Likelihood =  -2.13    Transmembrane 186-202 (186-202)

INTEGRAL    Likelihood =  -0.37    Transmembrane  37-53   (37-53)

----- Final Results -----
              bacterial membrane --- Certainty = 0.5522 (Affirmative) < succ> bacterial outside  --- Certainty = 0.0000 (Not Clear)  < succ> bacterial cytoplasm --- Certainty = 0.0000 (Not Clear)  < succ>
```

The protein has homology with the following sequences in the databases:

```
>GP:AAD46486 GB:AF130465 mannose-specific phosphotransferase system
component IIC [Streptococcus salivarius]

Identities = 211/271 (77%), Positives = 237/271 (86%), Gaps = 2/271 (0%)

Query:    1 MSDISIISAILVVIIAFFAGLEGILDQFQMHQPLVACTLIGLVTGHLEAGVILGGTLQML   60
            MSD+SIISAILVV++AF AGL GILDQFQ HQPLVACTLIG  TG+L AG++LGG+LQM+
Sbjct:    1 MSDMSIISAILVVVVAFLAGLEGILDQFQFHQPLVACTLIGAATGNLTAGIMLGGSLQMI   60

Query:   61 ALGWANIGAAVAPDAALASVAAAIIMVKSGDFTQKGITFAYSTAIPLAVAGLFLTMIVRT  120
            AL WANIGAAVAPDAALASVAAAII+VK G+FT +GI   A +TAIPLAVAGLFLTM+VRT
Sbjct:   61 ALAWANIGAAVAPDAALASVAAAIILVKGGNFTTEGIGVATATAIPLAVAGLFLTHLVRT  120

Query:  121 LSTALVHAGDKAAAEGNFAGIERFHFIALLLQGLRIAVPAALLVAVPTSAVQSVLNANPN  180
              S ALVHA DKAA  GN AG+ER H++ALLLQGLRIAVPAALL+A+P   +VQ  L  MP+
Sbjct:  121 ASVALVHAADKAAESGNIAGVERAHYLALLLQGLRIAVPAALLLAIPAESVQHALGLMPS  180
```

```
                                          -continued
Query:  181 WLNEGMQIGGAMVVAVGYAMVINMMATREVWPFFALGFALAAISQLTLIAMGVIGVAIAF  240
            WLN GM +GG MVVAVGYAMVINMMATREVWPFFA+GFA AAISQLTLIA+G IGVAIAF
Sbjct:  181 WLNHGMVVGGGMVVAVGYAMVINMMATREVWPFFAIGFAFAAISQLTLIALGAIGVAIAF  240

Query:  241 IYLNLSKKGG--NGGNAAGSADPIGDILEDY                              269
            IYLNLSK+GG   GG ++GS DPIGDILEDY
Sbjct:  241 IYLNLSKQGGGNGGGTSSGSGDPIGDILEDY                              271
```

An alignment of the GAS and GBS proteins is shown below.

```
Identities = 155/185 (83%), Positives = 173/185 (92%), Gaps = 1/185 (0%)

Query:    1 MVKSGDFTQKGINFAFSTAVPLAIAGLFLTMIVRTISTALVHAGDKAASEGNFAAIERFH   60
            MVKSGDFTQKGI FA+STA+PLA+AGLFLTMIVRT+STALVHAGDKAA+EGNFA IERFH
Sbjct:   86 MVKSGDFTQKGITFAYSTAIPLAVAGLFLTMIVRTLSTALVHAGDKAAAEGNFAGIERFH  145

Query:   61 FIALLLQGLRIAFPAALLLAIPSSSVQSILEAMPDWLNGGMQVGGAMVVAVGYAMVINMM  120
            FIALLLQGLRIA PAALL+A+P+S+VQS+L AMP+WLN GMQ+GGAMVVAVGYAMVINMM
Sbjct:  146 FIALLLQGLRIAVPAALLVAVPTSAVQSVLNAMPNWLNEGMQIGGANVVAVGYAMVINMM  205

Query:  121 ATREVWPFFALGFALAALNQLTLIAMGTIGVAIALIYISLSKMGGSKGTSNAGSNDPIGD  180
            ATREVWPFFALGFALAA++QLTLIAMG IGVAIA IY++LSK GG+ G + AGS DPIGD
Sbjct:  206 ATREVWPFFALGFALAAISQLTLIAMGVIGVAIAFIYLNLSKKGGNGGNA-AGSADPIGD  264

Query:  181 ILEDY                                                        185
            ILEDY
Sbjct:  265 ILEDY                                                        269
```

Based on this analysis, it was predicted that these proteins and their epitopes could be useful antigens for vaccines or diagnostics.

EXAMPLE 1689

A DNA sequence (GBSx1793) was identified in *S. agalactiae* <SEQ ID 5243> which encodes the amino acid sequence <SEQ ID 5244>. Analysis of this protein sequence reveals the following:

```
Possible site: 37

>>> Seems to have a cleavable N-terminal signal sequence

----- Final Results -----
            bacterial cytoplasm --- Certainty = 0.3171 (Affirmative) < succ> bacterial membrane --- Certainty = 0.0000 (Not Clear)  < succ> bacterial outside --- Certainty = 0.0000 (Not Clear)  < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1690

A DNA sequence (GBSx1794) was identified in *S. agalactiae* <SEQ ID 5245> which encodes the amino acid sequence <SEQ ID 5246>. This protein is predicted to be pseudouridine synthase (rluC). Analysis of this protein sequence reveals the following:

```
Possible site: 28

>>> Seems to have no N-terminal signal sequence
```

```
----- Final Results -----
            bacterial cytoplasm --- Certainty = 0.2717 (Affirmative) < succ> bacterial membrane --- Certainty = 0.0000 (Not Clear)  < succ> bacterial outside --- Certainty = 0.0000 (Not Clear)  < succ>
```

The protein has homology with the following sequences in the GENPEPT database.

```
>GP:BAB06566 GB:AP001516 unknown conserved protein [Bacillus halodurans]

Identities = 124/281 (44%), Positives = 171/281 (60%), Gaps = 8/281 (2%)

Query:  16 LLKSHDVSRGLLAKIKYRGGKIFVNGEEQNAIFLLEIGDVVTIDIPDE-PSHETL-EPVP   73
           L +    VS+  LA IK++GG I +NGEE    + + D VT+++P E PS    + EPVP
Sbjct:  24 LREGKHVSKRSLAAIKFKGGTILLNGEEVTVRETVHVNDQVTLELPHEYPSPSMIAEPVP   83

Query:  74 HDLDIIYEDDHFLILNKPFGFASIPSSIH-SNTIANFIKHYYVSNNYANQQVHIVTRLDR  132
             D+IYE+DH+L++NKP G  +IPS  H   T+AN + +Y+      A   H V RLD+
Sbjct:  84 --FDVIYENDHYLVVNKPAGVPTIPSRDHPQGTLAHGLLNYFQRQKMA-ATFHAVHRLDK  140

Query: 133 DTSGLMLFAKHGYAHARLDKQLQAKAIEKRYYALVSGSGDLADSGDIIAPIARDVDSIIT  192
           DTSGL++ AKH  AH +L KQ +   I++ Y A+V G  +  + G I APIAR  +S+IT
Sbjct: 141 DTSGLLIVARHQLAHDQLSKQQRQGNIKRTYMAIVQGEIEQQE-GTITAPIARKEESLIT  199

Query: 193 RRVHESGRYAHTSYQVVARYGDVRLVDIKLHTGRTHQIRVHFAHIGFPLLGDDLYGGRND  252
           R V E G+ A T ++V+ R     +V ++L TGRTHQIRVHF+++G+PL  GDDLYGG
Sbjct: 200 REVREDGQLAITHFKVIDRLNQGTIVQVQLETGRTHQIRVHFSYLGYPLFGDDLYGGERR  259

Query: 253 LGINRQALHCSLSFYDPFMGKINKQTLDLTDDFDSVIMEL                     293
            GI RQALH     L+ + PF         T L D  +I  L
Sbjct: 260 -GIERQALHSTELTIHCPFTEVEQTFTEGLPPDMKELIRHL                    299
```

A related DNA sequence was identified in *S. pyogenes* <SEQ ID 5247> which encodes the amino acid sequence <SEQ ID 5248>. Analysis of this protein sequence reveals the following:

```
Possible site: 28

>>> Seems to have no N-terminal signal sequence

----- Final Results -----
            bacterial cytoplasm --- Certainty = 0.2786 (Affirmative) < succ> bacterial membrane --- Certainty = 0.0000 (Not Clear)  < succ> bacterial outside --- Certainty = 0.0000 (Not Clear)  < succ>
```

An alignment of the GAS and GBS proteins is shown below.

```
Identities = 223/294 (75%), Positives = 251/294 (84%), Gaps = 1/294 (0%)

Query:   1 MKFEYVAKERCKVRTLLKSHDVSRGLLAKIKYRGGKIFVNGEEQNAIFLLEIGDVVTIDI   60
           M+FE+VA +R KVKTLLKS+DVS+GLLAKIKY+GG I VNG EQNAI +L++GDVVTIDI
Sbjct:   1 MRFEFVADKRIKVKTLLKSYDVSKGLLAKIKYKGGNILVNGIEQNAIYLLQVGDVVTIDI   60

Query:  61 PDEPSHETLEPVPHDLDIIYEDDHFLILNKPFGFASIPSSIHSNTIANFIKHYYVSNNYA  120
           P+E   E LE +P DLDI++EDDHFL++NKP GFASIPS+IHSNTIANFIK YYV  N+Y
Sbjct:  61 PNEEPFEKLEAIPFDLDIVHEDDHFLVINKPIGFASIPSAIHSNTIANFIKAYYVDNHYL  120

Query: 121 NQQVHIVTRLDRDTSGLMLFAKHGYAHARLDKQLQAKAIEKRYYALVSGSGDLADSGDII  180
            +QQVHIVTRLDRDTSGLMLFAKHGYAHARLDKQLQ  ++IEKRY+ALVSG+G L D GDII
Sbjct: 121 DQQVHIVTRLDRDTSGLMLFAKHGYAHARLDKQLQTRSIEKRYFALVSGNGMLPDEGDII  180

Query: 181 APIARDVDSIITRRVHESGKYAHTSYQVVARYGD-VRLVDIRLHTGRTHQIRVHFAHIGF  239
           API R  DSIITR V   GKYA TSY+VVARY + V LVDI KLHTGRTHQIRVHFAHIGF
Sbjct: 181 APIGRSKDSIITRAVDPMGKYAKTSYKVVARYSENVHLVDIKLHTGRTHQIRVHFAHIGF  240
```

```
Query:  240 PLLGDDLYGGRMDLGINRQALHCHSLSFYDFFMGKINKQTLDLTDDFDSVIMEL        293
            PLLGDDLYGGR+DLGI RQALHCH L+F DPF         + LTDDFDSVI+ L
Sbjct:  241 PLLGDDLYGGRLDLGITRQALHCHYLNFKDPFTES0CSYAIHLTDDFDSVIIGL        294
```

Based on this analysis, it was predicted that these proteins and their epitopes could be useful antigens for vaccines or diagnostics.

EXAMPLE 1691

A DNA sequence (GBSx1795) was identified in *S. agalactiae* <SEQ ID 5249> which encodes the amino acid sequence <SEQ ID 5250>. Analysis of this protein sequence reveals the following:

```
Possible site: 33

>>> Seems to have no N-terminal signal sequence

----- Final Results -----
            bacterial cytoplasm --- Certainty = 0.1521 (Affirmative) < succ> bacterial membrane  --- Certainty = 0.0000 (Not Clear)   < succ> bacterial outside   --- Certainty = 0.0000 (Not Clear)   < succ>
```

A related GBS nucleic acid sequence <SEQ ID 9845> which encodes amino acid sequence <SEQ ID 9846> was also identified.

The protein has homology with the following sequences in the GENPEPT database.

```
>GP:CAB13018 GB:Z99110 similar to hypothetical proteins
[Bacillus subtilis]

Identities = 120/267 (44%), Positives = 174/267 (64%), Gaps = 3/267 (1%)

Query:   13 RVAIIANGKYQSKRVASKLFAAFKHDPDFYLSKKDPDIVISIGGDGMLLSAFHMYEKQLD    72
            + A+ + G   S  + SK+  A+  D D  L + +P+IVIS+GGDG LL AFH  Y  +LD
Sbjct:    2 KFAVSSKGDQVSDTLKSKI-QAYLLDFDMELDENEPEIVISVGGDGTLLYAFHRYSDRLD    60

Query:   73 KVRFVGVHTGHLGFYTDYRDFEVDTLINNLKNDKGEQISYPILKVTITL-EDGRVIRARA   131
            K  FVGVHTGHLGFY D+   E++ L+  +       + YP+L+V +T  E+  R  R A
Sbjct:   61 KTAFVGVHTGHLGFYADWVPHEIEKLVLAIAKTPYHTVEYPLLEVIVTYHENEREERYLA   120

Query:  132 LNESTIKRIEKTMVADVVINQVVFERFRGDGILVSTPTGSTAYNKSLGGAVLHPTIEALQ   191
            LNE TIK  IE ++VADV I   +FE FRGDG+  +STP+GSTAYNK+LGGA++HP+I A+Q
Sbjct:  121 LNECTIKSIEGSLVADVEIKGQLFETFRGDGLCLSTPSGSTAYNKALGGAIIHPSIRAIQ   180

Query:  192 LTEISSLNNRVYRTLGSSVIIPKKDAIEIVPKRVGVYTISIDNKTVHYKNVTKIEYSIDE   251
            L  E++S+NNRV+RT+GS  +++P       I P+   + ++ID+ T+ +K+V  I    +
Sbjct:  181 LAEMASINNRVFRTVGSPLLLPSHHDCMIKPRNEVDFQVTIDHLTLLHKDVKSIRCQVAS   240

Query:  252 KSINFVSTPSHTSFWERVNDAFIGEPE                                  278
            + + F       FW+RV D+FIG+ E
Sbjct:  241 EKVRFARFRPF-PFWKRVQDSEIGKGE                                  266
```

A related sequence was also identified in GAS <SEQ ID 9137> which encodes the amino acid sequence <SEQ ID 9138>. Analysis of this protein sequence reveals the following:

```
Possible site: 16

>>> Seems to have no N-terminal signal sequence

----- Final Results -----
            bacterial cytoplasm --- Certainty = 0.2190 (Affirmative) < succ> bacterial membrane  --- Certainty = 0.0000 (Not Clear)   < succ>
```

```
                                 -continued
              bacterial outside --- Certainty = 0.0000 (Not Clear) < succ>

RGD motif: 155-157
```

An alignment of the GAS and GBS proteins is shown below.

```
Identities = 232/276 (84%), Positives = 257/276 (93%)

Query:   1 MMTQMNFTDRATRVAIIANGKYQSRRVASKLFAAFKHDPDFYLSKKDPDIVISIGGDGML   60
           +MTQMN+T +  RVAIIANGKYQSKRVASKLF+ FK DPDFYLSKK+PDIVISIGGDGML
Sbjct:   1 VNTQMNYTGKVKRVAIIANGKYQSKRVASKLFSVFKDDPDFYLSKKNPDIVISIGGDGML   60

Query:  61 LSAFHMYEKQLDKVRFVGVHTGHLGFYTDYRDFEVDTLINNLKNDKGEQISYPILKVTIT  120
           LSAFHMYEK+LDKVRFVG+HTGHLGFYTDYRDFEVD LI+NL+ DKGEQISYPILKV IT
Sbjct:  61 LSAFHMYEKELDKVRFVGIHTGHLGFYTDYRDFEVDKLIDNLRKDKGEQISYPILKVAIT  120

Query: 121 LEDGRVIRARALNESTIKRIEKTMVADVVINQVVFERFRGDGILVSTPTGSTAYNKSLGG  180
           L+DGRV++ARALNE+T+KRIEKTMVADV+IN V FE FRGDGI VSTPTGSTAYNKSLGG
Sbjct: 121 LDDGRVVKARALNEATVKRIEKTMVADVIINHVKFESFRGDGISVSTPTGSTAYNKSLGG  180

Query: 181 AVLHPTIEALQLTEISSLNNRVYRTLGSSVIIPKKDAIEIVPKRVGVYTISIDNKTVHYK  240
           AVLHPTIEALQLTEISSLNNRV+RTLGSS+IIPKKD IE+VPKR+G+YTISIDNKT   K
Sbjct: 181 AVLHPTIEALQLTEISSLNNRVFRTLGSSIIIPKKDKIELVPKRLGIYTISIDNKTYQLK  240

Query: 241 NVTKIEYSIDEKSINFVSTPSHTSFWERVNDAFIGE                         276
           NVTK+EY ID++ I+FVS+PSHTSFWERV DAFIGE
Sbjct: 241 NVTKVEYFIDDEKIHFVSSPSHTSFNERVKDAFIGE                         276
```

A related GBS gene <SEQ ID 8879> and protein <SEQ ID 8880> were also identified. Analysis of this protein sequence reveals an RGD motif at residues 159-161.

The protein has homology with the following sequences in the databases:

```
45.0/65.6% over 264aa
Bacillus subtilis
EGAD|107338|hypothetical protein Insert characterized OMNI|NT01BS1363 BC541A
protein-related Insert characterized
SP|O31612|YJBN_BACSU HYPOTHETICAL 30.0 KDA PROTEIN IN MECA-TENA INTERGENIC REGION.
Insert characterized
GP|2633515|emb|CAB13018.1||Z99110 similar to hypothetical proteins Insert
characterized
PIR|F69844|F69844 conserved hypothetical protein yjbN-Insert characterized ORF02026(337-1134 of 1437)
EGAD|107338|BS1162(2-266 of 266)hypothetical protein {Bacillus subtilis}
OMNI|NT01BS1363 BC541A protein-related SP|O31612|YJBN_BACSU HYPOTHETICAL 30.0 KDA
PROTEIN IN MECA-TENA INTERGENIC REGION. GP|2633515|emb|CAB13018.1||Z99110 similar
to hypothetical proteins {Bacillus subtilis} PIR|F69844 conserved hypothetical
protein yjbN-Bacillus subtilis
% Match = 22.8
% Identity = 44.9    % Similarity = 65.5
Matches = 120    Mismatches = 89    Conservative Sub.s = 55
87          117         147         177         207         237         267         297
RKF*QKYKSELWL*IFGQPSNIH*ITSIRGTSLKKLNKDWRKQQKSL*NWMKKCVRFAKIFVKHSFYLIL*IEN*AMV*E
327         357         387         417         447         477         507         537
IVMTQMNFTDRATRVAIIANGKYQSKRVASKLFAAFKHDPDFYLSKKDPDIVISIGGDGMLLSAFHMYEKQLDKVRFVGV
              : |: |  |  : ||: | :  | | |  | : :|:||||:|||| || |||  | :|||  ||||
           MKFAVSSKGDQVSDTLKSKIQA-YLLDFDMELDENEPEIVISVGGDGTLLYAFHRYSDRLDKTAFVGV
                      10         20        30        40        50         60
567         597         627         657         684         714         744         774
HTGHLGFYTDYRDFEVDTLINNLKNDKGEQISYPILKVTITL-EDGRVIRARALNESTIKRIEKTMVADVVINQVVFERF
|||||||| |:  |::  |:  :         :  ||:|:| :|  | | |  ||| ||| ||  ::|||| |  :||   |
HTGHLGFYADWVPHEIEKLVLAIAKTPYHTVEYPLLEVIVTYHENEREERYLALNECTIKSIEGSLVADVEIKGQLFETF
              80        90         100        110       120        130         140
804         834         864         894         924         954         984         1014
RGDGILVSTPTGSTAYNKSLGGAVLHPTIEALQLTEISSLNNRVYRTLGSSVIIPKKDAIEIVPKRVGVYTISIDNKTVH
||||: :|||| ||||||| |||||||||||||||:|||| |||||||::  |:  |||| |   ||  :       |:
RGDGLCLSTPSGSTAYNKALGGAIIHPSIRAIQLAEMASINNRVFRTVGSPLLLPSHHDCMIKPRNEVDFQVTIDHLTLL
              160        170        180        190       200        210         220
1044        1074        1104        1134        1164        1194        1224        1254
YKNVTKIEYSIDEKSINFVSTPSHTSFWERVNDAFIGEPEH*NLNT*QKKGAKLKHF*KVMMFQGGY*QRLSTEVVRFLL
:|| |  :   :  |    ||:|| |:|||  |
HKDVKSIRCQVASEKVRF-ARFRPFPFWKRVQDSFIGKGE
              240         250         260
```

A related DNA sequence was identified in *S. pyogenes* <SEQ ID 5251> which encodes the amino acid sequence <SEQ ID 5252>. Analysis of this protein sequence reveals the following:

```
Possible site: 20

>>> Seems to have no N-terminal signal sequence

----- Final Results -----
              bacterial cytoplasm --- Certainty = 0.2190 (Affirmative) < succ> bacterial membrane --- Certainty = 0.0000 (Not Clear) < succ> bacterial outside --- Certainty = 0.0000 (Not Clear) < succ>
```

An alignment of the GAS and GBS sequences follows:

```
Score = 481 bits (1224), Expect = e-138

Identities = 233/276 (84%), Positives = 257/276 (92%)

Query:    1 VMTQMNYTGKVKRVAIIANGKYQSKRVASKLFSVFKDDPDFYLSKRNPDIVISIGGDGML   60
            VMTQMN+T +  RVAIIANGKYQSKRVASKLF+ FR DFDFYLSKK+PDIVISIGGDGML
Sbjct:    1 VMTQMNFTDRATRVAIIANGKYQSKRVASKLFAAFKHDPDFYLSKKDPDIVISIGGDGML   60

Query:   61 LSAFHMYEKELDKVRFVGIHTGHLGFYTDYRDFEVDKLIDNLRKDKGEQISYPILKVAIT  120
            LSAFHMYEK+LDKVRFVG+HTGHLGFYTDYRDFEVD LI+NL+ DKGEQISYPILKV IT
Sbjct:   61 LSAFHMYEKQLDKVRFVGVHTGHLGFYTDYRDFEVDTLINNLKNDKGEQISYPILKVTIT  120

Query:  121 LDDGRVVKARALNEATVKRIEKTMVADVIINHVEFESFRGDGISVSTPTGSTAYNKSLGG  180
            L+DGRV++ARALNE+T+KRIEKTMVADV+IN V FE FRGDGI VSTPTGSTAYNKSLGG
Sbjct:  121 LEDGRVIRARALNESTIKRIEKTMVADVVINQVVFERFRGDGILVSTPTGSTAYNKSLGG  180

Query:  181 AVLHPTIEALQLTEISSLNNRVFRTLGSSIIIPKKDKIELVPKRLGIYTISIDNKTYQLK  240
            AVLHPTIEALQLTEISSLNNRV+RTLGSS+IIPKKD IE+VPKR+G+YTISIDNKT   K
Sbjct:  181 AVLHPTIEALQLTEISSLNNRVYRTLGSSVIIPKKDAIEIVPKRVGVYTISIDNKTVHYK  240

Query:  241 NVTKVEYFIDDEKIHFVSSPSHTSFWERVKDAFIGE                         276
            NVTK+EY ID++ I+FVS+PSHTSFWERV DAFIGE
Sbjct:  241 NVTKIEYSIDEKSINFVSTPSHTSFWERVNDAFIGE                         276
```

SEQ ID 8880 (GBS308) was expressed in *E. coli* as a His-fusion product. SDS-PAGE analysis of total cell extract is shown in FIG. 57 (lane 4; MW 34 kDa). It was also expressed in *E. coli* as a GST-fusion product. SDS-PAGE analysis of total cell extract is shown in FIG. 77 (lane 3; MW 59 kDa).

GBS308-GST was purified as shown in FIG. 226, lane 8.

Based on this analysis, it was predicted that these proteins and their epitopes could be useful antigens for vaccines or diagnostics.

EXAMPLE 1692

A DNA sequence (GBSx1796) was identified in *S. agalactiae* <SEQ ID 5253> which encodes the amino acid sequence <SEQ ID 5254>. This protein is predicted to be permease. Analysis of this protein sequence reveals the following:

```
Possible site: 17
>>> Seems to have no N-terminal signal sequence

----- Final Results -----
bacterial cytoplasm --- Certainty = 0.3653 (Affirmative) < succ>
bacterial membrane --- Certainty = 0.0000 (Not Clear) < succ>
bacterial outside --- Certainty = 0.0000 (Not Clear) < succ>
```

The protein has homology with the following sequences in the GENPEPT database.

```
>GP:BAB06568 GB:AP001516 GTP pyrophosphokinase
[Bacillus halodurans]
Identities = 115/208 (55%), Positives = 159/208 (76%), Gaps = 3/208 (1%)

Query:    4 DWETFLDPYIQTVGELKIKLRGIRKQFRKQNRHSPIEFVTGRVKSVESIQEKMVLRGISE  63
            +W+ FL PY Q V ELK+KL+GIR+Q++K ++H+PIEFVTGRVK + SI +K + + I
Sbjct:    3 NWDVFLTPYKQAVEELKVKLKGIREQYQKSSKHTPIEFVTGRVKPISSILDKAIRKNIPL 62

Query:   64 ENLAQDLQDIAGLRIMVQFVDDVDEVLALLRKRHDMTVVQERDYITHMKSSGYRSYHVVV 123
            + L + +QD+AGLRI+ QFV+D++ V+ L+R R D  +V+ERDY+    K SGYRSYH+V+
Sbjct:   63 DQLEEKMQDLAGLRIVTQFVEDIETVVQLIRSRSDFEIVEERDYVEQKKDSGYRSYHLVL 122

Query:  124 EYPVDTIDGQKKVLAEIQIRTLAMNFWATIEHSLNYKYQGDFPEEIKQRLEKTAKIALEL 183
              YPV TI+G+K++L E+QIRTLAMNFWATIEHSLNYKY G+ P   IK RL++ A+ A  L
Sbjct:  123 RYPVQTIEGEKRILVELQIRTLAMNFWATIEHSLNYKYSGEIPLNIKTRLQRAAEAAFRL 182

Query:  184 DEEMRKIREDIREAQLLFDPLNRKLSDG                                211
            DEEM +IR+++REAQ +   + RK   G
Sbjct:  183 DEEMSQIRDEVREAQQI---ITRKQEQG                                207
```

A related DNA sequence was identified in *S. pyogenes* <SEQ ID 5255> which encodes the amino acid sequence <SEQ ID 5256>. Analysis of this protein sequence reveals the following:

```
Possible site: 17
>>> Seems to have no N-terminal signal sequence

----- Final Results -----
bacterial cytoplasm --- Certainty = 0.4064 (Affirmative) < succ>
bacterial membrane  --- Certainty = 0.0000 (Not Clear)   < succ>
bacterial outside   --- Certainty = 0.0000 (Not Clear)   < succ>
```

An alignment of the GAS and GBS proteins is shown below.

```
Identities = 196/223 (87%), Positives = 213/223 (94%)

Query:    1 MSMDWETFLDPYIQTVGELKIKLRGIRKQFRKQNRHSPIEFVTGRVKSVESIQEKMVLRG  60
            M++DWE FLDPYIQTVGELKIRLRGIRKQ+RKQNR+SPIEFVTGRVKS+ESI+EKM+LRG
Sbjct:    1 MTLDWEEFLDPYIQTVGELKIKLRGIRKQYRKQNRYSPIEFVTGRVKSIESIKEKMILRG  60

Query:   61 ISEENLAQDLQDIAGLRIMVQFVDDVDEVLALLRKRHDMTVVQERDYITHMKSSGYRSYH 120
            + EEN+AQD+QDIAGLRIMVQFVDDV+EVLALLR+R DMT+V ERDYI +MKSSGYRSYH
Sbjct:   61 VIEENIAQDIQDIAGLRIMVQFVDDVEEVLALLRQRQDMTIVYERDYIRNMKSSGYRSYH 120

Query:  121 VVVEYPVDTIDGQKKVLAEIQIRTLAMNFWATIEHSLNYKYQGDFPEEIKQRLEKTAKIA 180
            VVVEYPVDTI+GQKKVLAEIQIRTLAMNFWATIEHSLNYKY GDFPEEIK+RLE TAKIA
Sbjct:  121 VVVEYPVDTIEGQKKVLAEIQIRTLAMNFWATIEHSLNYKYGGDFPEEIKKRLEVTAKIA 180

Query:  181 LELDEEMRKIREDIREAQLLFDPLNRKLSDGVGNSDDTDEFYR                 223
            LELDEEMRKIREDIREAQLLFDP+ R LSDGVGNSDDTDE YR
Sbjct:  181 LELDEEMRKIREDIREAQLLFDPVTRNLSDGVGNSDDTDELYR                 223
```

Based on this analysis, it was predicted that these proteins and their epitopes could be useful antigens for vaccines or diagnostics.

EXAMPLE 1693

A DNA sequence (GBSx1797) was identified in *S. agalactiae* <SEQ ID 5257> which encodes the amino acid sequence <SEQ ID 5258>. Analysis of this protein sequence reveals the following:

```
Possible site: 33
>>> Seems to have no N-terminal signal sequence

----- Final Results -----
bacterial cytoplasm --- Certainty = 0.2266 (Affirmative) < succ>
bacterial membrane  --- Certainty = 0.0000 (Not Clear)   < succ>
bacterial outside   --- Certainty = 0.0000 (Not Clear)   < succ>
```

The protein has homology with the following sequences in the GENPEPT database.

```
>GP:CAB13015 GB:Z99110 yjbK [Bacillus subtilis]
Identities = 63/184 (34%), Positives = 99/184 (53%), Gaps = 10/184 (5%)

Query:    4 LEIEYKTLLNKDEFNRLTSLFSHVQP--ITQTNYYFDTETFEMKAHRMSLRIRTLPNRAE   61
            +EIE+K +L K EF + S        Q N+YFDT++F +K    +LRIR      +
Sbjct:    5 IEIEFKNMLTKQEFKNIASALQLTEKDFTDQKNHYFDTDSFALKQKHAALRIRRKNGKYV   64

Query:   62 LTLKIPREVGNLEHNHDLT--LEEAKYIVKNGQFPEDTEIASLILEKGVDPTKLAVFGQL  119
            LTLK P +VG LE +  L+   + A + V  G  P    ++  L     +D   +  FG L
Sbjct:   65 LTLKEPADVGLLETHQQLSEVSDLAGFSVPEG--PVKDQLHKL----QIDTDAIQYFGSL  118

Query:  120 TTTRREMETSIGLMALDSNIYADIKDYELELEVKQPKQGKRDFDQFLKENNINFKYAKSK  179
              T  R E ET   GL+ LD + Y + +DYE+E E     +G++ F++ L++ +I  +  K+K
Sbjct:  119 ATNRAEKETEKGLIVLDHSRYLNKEDYEIEFEAADWHEGRQAFEKLLQQFSIPQRETKNK  178

Query:  180 VARF                                                          183
            + RF
Sbjct:  179 ILRF                                                          182
```

A related DNA sequence was identified in *S. pyogenes* <SEQ ID 5259> which encodes the amino acid sequence <SEQ ID 5260>. Analysis of this protein sequence reveals the following:

```
Possible site: 59
>>> Seems to have no N-terminal signal sequence

----- Final Results -----
bacterial cytoplasm --- Certainty = 0.3470 (Affirmative) < succ>
bacterial membrane  --- Certainty = 0.0000 (Not Clear)   < succ>
bacterial outside   --- Certainty = 0.0000 (Not Clear)   < succ>
```

An alignment of the GAS and GBS proteins is shown below.

```
Identities = 114/188 (60%), Positives = 139/188 (73%), Gaps = 1/188 (0%)

Query:    1 MTHLEIEYKTLLNKDEFNRLTSLFSHVQPITQTNYYFDTETFEMKAHRMSLRIRTLPNRA   60
            MT+LEIEYKTLL K+E+NRL S   HV P+TQTNYY DT+ F++KA++MSLRIRT  N A
Sbjct:    1 MTNLEIEYKTLLTKNEYNRLLSQMKHVTPVTQTNYYIDTKAFDLKANKMSLRIRTFVNSA   60

Query:   61 ELTLKIPREVGNLEHNHDLTLEEAKYIVKNGQFPEDTEIASLILEKGVDPTKLAVFGQLT  120
            ELTLK+P +VGN E+N  L LE+AK ++K+G  PE T   +I+ KG+ P+ L  FG LT
Sbjct:   61 ELTLKVPEKVGNREYNVPLFLEQAKDMIKHGNLPESTAL-DIIISKGIKPSALVTFGNLT  119

Query:  121 TTRREMETSIGLMALDSNIYADIKDYELELEVKQPKQGKRDFDQFLKENNINFKYAKSV  180
            T RRE     IG +ALD N+YA+ KDYELELEV   QGK DFD FL E +I FKYAKSV
Sbjct:  120 TVRRETVIPIGKLALDYNLYANTKDYELELEVSDALQGKIDFDSFLSEYHITFKYAKSV  179

Query:  181 ARFSATLK                                                    188
            AR   TLK
Sbjct:  180 ARCINTLK                                                    187
```

Based on this analysis, it was predicted that these proteins and their epitopes could be useful antigens for vaccines or diagnostics.

EXAMPLE 1694

A DNA sequence (GBSx1798) was identified in *S. agalactiae* <SEQ ID 5261> which encodes the amino acid sequence <SEQ ID 5262>. Analysis of this protein sequence reveals the following:

```
Possible site: 30
>>> Seems to have no N-terminal signal sequence

----- Final Results ----
bacterial cytoplasm --- Certainty = 0.1815 (Affirmative) < succ>
```

```
                              -continued
bacterial membrane --- Certainty = 0.0000 (Not Clear) < succ>
bacterial outside  --- Certainty = 0.0000 (Not Clear) < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1695

A DNA sequence (GBSx1799) was identified in *S. agalactiae* <SEQ ID 5263> which encodes the amino acid sequence <SEQ ID 5264>. Analysis of this protein sequence reveals the following:

```
Possible site: 38
>>> Seems to have no N-terminal signal sequence

----- Final Results -----
bacterial cytoplasm --- Certainty = 0.0621 (Affirmative) < succ>
bacterial membrane  --- Certainty = 0.0000 (Not Clear)   < succ>
bacterial outside   --- Certainty = 0.0000 (Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1696

A DNA sequence (GBSx1800) was identified in *S. agalactiae* <SEQ ID 5265> which encodes the amino acid sequence <SEQ ID 5266>. This protein is predicted to be ribose-phosphate pyrophosphokinase (prsA). Analysis of this protein sequence reveals the following:

```
Possible site: 22
>>> Seems to have no N-terminal signal sequence

----- Final Results -----
bacterial cytoplasm --- Certainty = 0.3369 (Affirmative) < succ>
bacterial membrane  --- Certainty = 0.0000 (Not Clear)   < succ>
bacterial outside   --- Certainty = 0.0000 (Not Clear)   < succ>
```

The protein has homology with the following sequences in the GENPEPT database.

```
>GP:CAB11827 GB:Z99104 phosphoribosyl pyrophosphate synthetase
[Bacillus subtilis]
Identities = 166/319 (52%), Positives = 231/319 (72%), Gaps = 4/319 (1%)

Query:   1 MAEQYADKQIKLFSLTANREIAEKISQASGIPLGKMSSRQFSDGEIMINIEETVRGDDIY   60
           M+ QY DK +K+FSL +N E+A++I+   G+ LGK S  +FSDGE+ INIEE++RG D Y
Sbjct:   1 MSNQYGDKNLKIFSLNSNPELAKEIADIVGVQLGKCSVTRFSDGEVQINIEESIRGCDCY   60

Query:  61 IIQSTSFPVNDNLWELLIMIDACKRASANTVNIVVPYFGYSRQDRIAASREPITAKLVAN  120
           IIQSTS PVN+++ ELLIM+DA KRASA T+NIV+PY+GY+RQDR A SREPITAKL AN
Sbjct:  61 IIQSTSDPVNEHIMELLIMVDALKRASAKTINIVIPYYGYARQDRKARSREPITAKLFAN  120

Query: 121 MLVKAGVDRVLTLDLHAVQVQGFFDIPVDNLFTVPLFAEHYNQLGLSGEDVVVVSPKNSG  180
           +L  AG  RV+ LDLHA Q+QGFFDIP+D+L   VP+   E++   G + ED+V+VSP + G
Sbjct: 121 LLETAGATRVIALDLHAPQIQGFFDIPIDHLMGVPILGEYFE--GKNLEDIVIVSPDHGG  178
```

-continued

```
Query: 181 IKRARSLAEYLDSPIAIIDYAQD-DSEREEGYIIGEVEGKKAIIIDDILNTGKTFAEAAK 239
            + RAR LA+ L +PIAIID  +   + E    I+G +EGK AI+IDDI++T  T   AA
Sbjct: 179 VTRARKLADRLKAPIAIIDKRRPRPNVAEVMNIVGNIEGKTAILIDDIIDTAGTITLAAN 238

Query: 240 ILERGGATEIYAVASHGLFAGGAADILESAPIREIIVTDSV-LSKERIPSNIKYLTASHL 298
              L   GA E+YA  +H + +G A + + ++ I+E++VT+S+ L +E+    K L+   L
Sbjct: 239 ALVENGAKEVYACCTHPVLSGPAVERINNSTIKELVVTNSIKLPEEKKIERFKQLSVGPL 298

Query: 299 IADAIIRIHERKPLSPLFS                                         317
            +A+AIIR+HE++ +S LFS
Sbjct: 299 LAEAIIRVHEQQSVSYLFS                                         317
```

A related DNA sequence was identified in *S. pyogenes* <SEQ ID 5267> which encodes the amino acid sequence <SEQ ID 5268>. Analysis of this protein sequence reveals the following:

```
Possible site: 22

>>> Seems to have no N-terminal signal sequence

----- Final Results -----
            bacterial cytoplasm --- Certainty = 0.1830 (Affirmative) < succ> bacterial membrane --- Certainty = 0.0000 (Not Clear) < succ> bacterial outside --- Certainty = 0.0000 (Not Clear) < succ>
```

An alignment of the GAS and GBS proteins is shown below.

```
Identities = 278/324 (85%), Positives = 305/324 (93%)

Query:   1 MAEQYADKQIKLFSLTANREIAEKISQASGIPLGKNSSRQFSDGEIMINIEETVRGDDIY  60
           M E+YADKQIKLFSLT+N  IAEKI++A+GIPLGKMSSRQFS+GEIMINIEETVRGDDIY
Sbjct:   1 MTERYADKQIKLFSLTSNLPIAEKIAKAAGIPLGKMSSRQFSNGEIMINIEETVRGDDIY  60

Query:  61 IIQSTSFPVNDNLWELLINIDACKRASANTVNIVVPYFGYSRQDRIAASREPITAKLVAN 120
           IIQSTSFPVNDNLWELLIMIDACKRASANTVNIV+PYFGYSRQDR+A  REPITAKLVAN
Sbjct:  61 IIQSTSFPVNDNLWELLIMIDACKRASANTVNIVLPYFGYSRQDRVAKPREPITAKLVAN 120

Query: 121 MLVKAGVDRVLTLDLHAVQVQGFFDIPVDNLFTVPLFAEHYNQLGLSGEDVVVVSPKNSG 180
           ML KAG+DRV+TLDLHAVQVQGFFDIPVDNLFTVPLFAE Y++LGLSG DVVVVSPKNSG
Sbjct: 121 MLTKAGIDRVVTLDLHAVQVQGFFDIPVDNLFTVPLFAERYSKLGLSGSDVVVVSPKNSG 180

Query: 181 IKRARSLAEYLDSPIAIIDYAQDDSEREEGYIIGEVEGKKAIIIDDILNTGKTFAEAAKI 240
           IKRARSLAEYLDSPIAIIDYAQDDSERE+GYIIG+V GKKAI+IDDILNTGKTFAEAAKI
Sbjct: 181 IKRARSLAEYLDSPIAIIDYAQDDSEREQGYIIGDVSGKKAILIDDILNTGKTFAEAAKI 240

Query: 241 LERGGATEIYAVASHGLFAGGAADILESAFIREIIVTDSVLSKERIPSNIKYLTASHLIA 300
           LER GAT+ YAVASHGLFAGGAAD+LE+API+EIIVTDSV +K R+P N+ YL+AS LIA
Sbjct: 241 LERSGATDTYAVASHGLFAGGAADVLETAPIKEIIVTDSVKTKNRVPENVTYLSASDLIA 300

Query: 301 DAIIRIHERKPLSPLFSYRSDKED                                    324
           +AIIRIHER+PLSPLFSY+    K+
Sbjct: 301 EAIIRIHERRPLSPLFSYQPKGKN                                    324
```

Based on this analysis, it was predicted that these proteins and their epitopes could be useful antigens for vaccines or diagnostics.

EXAMPLE 1697

A DNA sequence (GBSx1801) was identified in *S. agalactiae* <SEQ ID 5269> which encodes the amino acid sequence <SEQ ID 5270>. This protein is predicted to be Fe—S cluster formation protein. Analysis of this protein sequence reveals the following:

```
Possible site: 16

>>> Seems to have no N-terminal signal sequence
```

-continued

```
----- Final Results -----
            bacterial cytoplasm --- Certainty = 0.1981 (Affirmative) < succ> bacterial membrane --- Certainty = 0.0000 (Not Clear) < succ> bacterial outside --- Certainty = 0.0000 (Not Clear) < succ>
```

The protein has homology with the following sequences in the GENPEPT database.

```
>GP:BAB04979 GB:AP001511 Fe-S cluster formation protein
[Bacillus halodurans]

Identities = 174/373 (46%), Positives = 237/373 (62%), Gaps = 6/373 (1%)

Query:   3 IYLDNAATTALTPSVIEKMTNVMTSHYGNPSSIHTFGRQANQLLRECRQIIAEYLNVNSR     62
           IYLD+AAT+ + P VI+M      +GNPSSIH FGR+A Q +   E R    IA L    +
Sbjct:   4 IYLDHAATSPVHPEVIQAMLPYYEEQFGNPSSIHQFGRRARQGVDEARGTIARLLQADPS    63

Query:  63 EIIFTSGGTESNNTAIKGYALANQLKGKHIITSEIEHHSVLHTMTYLSSRFGFDITYLKP   122
           E IFTSGGTE++N AI GYA  ++ KG HIITS++EHH+VLH    L E  GF++TY+
Sbjct:  64 EFIFTSGGTEADNLAIFGYAYQHRGKGNHIITSQVEHHAVLHACQEL-EHQGFEVTYVPV   122

Query: 123 NH-GQITAKDVQEALRDDTIMVSLMFVNNETGDFLPIQEIGQLLRNHQAVFHVDAVQVFS   181
             +  G+++ +DV++ALRDDTI+V+LM+  NNE G    PI EIG   LL++HQAV H DAVQ F
Sbjct: 123 DQTGRVSVEDVRQALRDDTILVTLMYGNNEVGTIQPIAEIGALLQDHQAVLHTDAVQAFG   182

Query: 182 KMELDPHSLGIDFLAASAHKFHGPKGVGILYCAPH-HFDSLLHGGDQEEKRRASTENIIG   240
             + ++    L +D L+ SAHK +GPKGVG+LY            L+GG+QE K+RA   TEN+
Sbjct: 183 AISIELDHLPVDMLSVSAHKINGPKGVGLLYVRDGIVLKPALYGGEQERKKRAGTENVAA   242

Query: 241 IAGMSQALTDATTNTLKNWTHISQLRTTFLDAISD--LDFYLNNGQDC-LPHVLNIGFPG   297
            I G ++A+  A  N +    TF D       +F+N Q    LPH+ N +FPG
Sbjct: 243 IIGFAKAVEIAIANREERQKAYFDYCQTFFDQFQQEGVQFVMNGHQTWRLPHIFNVSFPG   302

Query: 298 QNNGLLLTQLDLAGFAVSTGSACTAGTVEPSHVLTSLYGANSPRLNESIRISFSELNTQE   357
             +    LL  LDLAG A S+GSACTAG++EPSHVL +++G++S  +   + R SF   NT+E
Sbjct: 303 VHVEALLVNLDLAGIAASSGSACTAGSIEPSHVLVAHHGSDSELVTSGVRFSFGLGNTKE   362

Query: 358 EILELAKTLRKII                                                 370
            +    AK   KI+
Sbjct: 363 HVQWAAKETAKIV                                                 375
```

A related DNA sequence was identified in *S. pyogenes* <SEQ ID 5271> which encodes the amino acid sequence <SEQ ID 5272>. Analysis of this protein sequence reveals the following:

```
Possible site: 19

>>> Seems to have no N-terminal signal sequence

----- Final Results -----
            bacterial cytoplasm --- Certainty = 0.1477 (Affirmative) < succ> bacterial membrane --- Certainty = 0.0000 (Not Clear) < succ> bacterial outside --- Certainty = 0.0000 (Not Clear) < succ>
```

An alignment of the GAS and GBS proteins is shown below.

```
Identities = 235/370 (63%), Positives = 285/370 (76%)

Query:   2 MIYLDNAATTALTPSVIEKMTNVMTSNYGNPSSIHTFGRQANQLLRECRQIIAEYLNVNS    61
           M Y DNAATT L+P+VI  MT   M N+GNPSSIH +GR+AN++LRECRQ IA  L    +
Sbjct:   1 MTYFDNAATTPLSPNVIRAMTAAMQDNFGNPSSIHFYGRRANKILRECRQAIARNLGASE    60

Query:  62 REIIFTSGGTESNNTAIKGYALANQLKGKHIITSEIEHHSVLHTMTYLSERFGWDITYLK   121
            ++II TSGGTESMN AIKGYALA+Q KGKH+IT+ IEHHSVLHTM YL ERFGF++TYL
Sbjct:  61 QQIIVTSGGTESNNMAIKGYALAHQAKGKHLITTTIEHHSVLHTMAYLEERFGFEVTYLP   120
```

-continued

```
Query:   122 PNHGQITAKDVQEALRDDTIMVSLMFVHNETGDFLPIQEIGQLLRNHQAVFHVDAVQVFS  181
             +GQI   D+++ALRDDTI+VS+M+ NNETGD LPI++IG LL++HQA FHVDAVQ
Sbjct:   121 CQNGQINLSDLKQALRDDTILVSIMYANNETGDLLPIKDIGNLLKDHQAAFHVDAVQAVG  180

Query:   182 KMELDFHSLGIDFLAASAHKFHGPKGVGILYCAPHHFDSLLHGGDQEEKRRASTENIIGI
             K+++ P  LGIDFL+ASAHKFHGPKG G LY      D LLHGGDQE KRRASTEH++GI
Sbjct:   181 KLKIIPSELGIDFLSASAHKFHGPKGCGFLYSNGQPIDPLLHGGDQEGKRRASTENMLGI  240

Query:   242 AGMSQALTDATTNTLKNWTHISQLRTTFLDAISDLDFYLNNGQDCLPHVLHIGFPGQNNG  301
             GM+QALTDA T   ++  HI  LR  +  +  L +Y+N G    LPHVLNIGF G  N
Sbjct:   241 IGMAQALTDANTCLDQSTDHIISLRHHLISLLEGLPYYINQGTHYLPHVLNIGFLGYQNT  300

Query:   302 LLLTQLDLAGFAVSTGSACTAGTVEPSHVLTSLYGANSPRLNESIRISFSELNTQEEILE  361
             +LLTQLDLAG AVSTGSACTAG V PSHVL + YG +S RL  ESIRISFS+ N+ E++ +
Sbjct:   301 ILLTQLDLAGIAVSTGSACTAGAVNPSHVLAAYYGDDSSRLKESIRISFSDQNSIEDVNQ  360

Query:   362 LAKTLRKIIG                                                   371
             LA+TL+  I+G
Sbjct:   361 LAQTLKNILG                                                   370
```

Based on this analysis, it was predicted that these proteins and their epitopes could be useful antigens for vaccines or diagnostics.

EXAMPLE 1698

A DNA sequence (GBSx1802) was identified in *S. agalactiae* <SEQ ID 5273> which encodes the amino acid sequence <SEQ ID 5274>. Analysis of this protein sequence reveals the following:

```
Possible site: 43
>>> Seems to have no N-terminal signal sequence

----- Final Results -----
          bacterial cytoplasm --- Certainty = 0.2753(Affirmative) < succ>
          bacterial membrane  --- Certainty = 0.0000(Not Clear)   < succ>
           bacterial outside  --- Certainty = 0.0000(Not Clear)   < succ>
```

The protein has homology with the following sequences in the GENPEPT database.

```
>GP:CAB12416 GB:Z99107 ydiH [Bacillus subtilis]

Identities = 96/202 (47%), Positives = 140/202 (68%), Gaps = 4/202 (1%)

Query:     7 IPKATAKRLSLYYRIFKRFNTDGIEKASSKQIADALGIDSATVRRDFSYFGELGRRGFGY   66
             IP+ATAKRL LYYR  K  +  G ++ SS +++DA+ + DSAT+RRDFSYFG LG++G+GY
Sbjct:     8 IPQATAKRLPLYYRFLKNLHASGKQRVSSAELSDAVKVDSATIRRDFSYFGALGKKGYGY   67

Query:    67 DVKKLMNFFAEILNDHSTTNVMLVGCGNIGRALLHYRFHDRNKNQISHAFDLDSNDLVGK  126
             +V  L++FF + L+    T+V+L+G GN+G A LHY F   N  +ISMAFD++ + +
Sbjct:    68 NVDYLLSFFRKTLDQDEMTDVILIGVGNLGTAFLHYNFTKNNNTKISMAFDINESKI--G  125

Query:   127 TTEDGIPVYGISTINDHLIDSDIETAILTVPSTEAQEVADILVKAGIKGILSFSPVHLTL  186
             T   G+PVY +  + H+ D  +   AILTVP+  AQ  + D LV  GIKGIL+ F+P  L +
Sbjct:   126 TEVGGVPVYNLDDLEQHVKDESV--AILTVPAVAAQSITDRLVALGIKGILNFTPARLNV  183

Query:   187 PKDIIVQYVDLTSELQTLLYFM                                       208
             P+ I + ++DL  ELQ+L+YF+
Sbjct:   184 PEHIRIHHIDLAVELQSLVYFL                                       205
```

A related DNA sequence was identified in *S. pyogenes* <SEQ ID 5275> which encodes the amino acid sequence <SEQ ID 5276>. Analysis of this protein sequence reveals the following:

```
Possible site: 43

>>> Seems to have no N-terminal signal sequence

----- Final Results -----
          bacterial cytoplasm --- Certainty = 0.2313 (Affirmative) < succ>
```

An alignment of the GAS and GBS proteins is shown below.

```
Identities = 167/210 (79%), Positives = 189/210 (89%)

Query:   1 MINDKSIPKATAKRLSLYYRIFRRFNTDGIEKASSKQIADALGIDSATVRRDFSYFGELG   60
           +++DKSIPKATAKRLSLYYRIFKRF+ D +EKASSKQIADA+GIDSATVRRDFSYFGELG
Sbjct:   1 VVIDKSIPKATAKRLSLYYRIFKRFHADQVEKASSKQIADAMGIDSATVRRDFSYFGELG   60

Query:  61 RRGFGYDVKKLMNFFAEILNDHSTTNVMLVGCGNIGRALLHYRFHDRNKMQISMAFDLDS  120
           RRGFGYDV KLMNFFA++LNDHSTTNV+LVGCGNIGRALLHYRFHDRNKMQI+M FD D
Sbjct:  61 RRGFGYDVTKLMNEFADLLNDHSTTNVILVGCGNIGRALLHYRFHDRNKMQIAMGFDTDD  120

Query: 121 NDLVGKTTEDGIPVYGISTINDHLIDSDIETAILTVPSTEAQEVADILVKAGIKGILSFS  180
             N LVG  T D IPV+GIS++ + + ++DIETAILTVPS  AQEV D  L++AGIKGILSF+
Sbjct: 121 NALVGTKTADNIPVHGISSVKERIANTDIETAILTVPSIHAQEVTDQLIEAGIKGILSWA  180

Query: 181 PVHLTLPKDIIVQYVDLTSELQTLLYFMNQ                               210
           PVNL +PK +IVQ VDLTSELQTLLYFMNQ
Sbjct: 181 PVNLQVPKGVIVQSVDLTSELQTLLYFMNQ                               210
```

Based on this analysis, it was predicted that these proteins and their epitopes could be useful antigens for vaccines or diagnostics.

EXAMPLE 1699

A DNA sequence (GBSx1803) was identified in *S. agalactiae* <SEQ ID 5277> which encodes the amino acid sequence <SEQ ID 5278>. Analysis of this protein sequence reveals the following:

```
Possible site: 43

>>> Seems to have no N-terminal signal sequence

----- Final Results -----
           bacterial cytoplasm --- Certainty = 0.2966 (Affirmative) < succ>
           bacterial membrane  --- Certainty = 0.0000 (Not Clear)   < succ>
           bacterial outside   --- Certainty = 0.0000 (Not Clear)   < succ>
```

A related GBS nucleic acid sequence <SEQ ID 9847> which encodes amino acid sequence <SEQ ID 9848> was also identified.

The protein has homology with the following sequences in the GENPEPT database.

```
>GP:CAB14764 GB:Z99118 similar to DNA repair protein [Bacillus subtilis]

Identities = 90/210 (42%), Positives = 136/210 (63%)

Query:  24 PRERLVDLGADRLSNQELLAILLRTGIKEKPVLEISTQILENISSLADWGQLSLQELQSI   83
           PRERL+ +GA+ L+N ELLAILLRTG K + VL++S ++L +     + S++EL SI
Sbjct:  19 PRERLLKVGAENLANHELLAILLRTGTKHESVLDLSNRLLRSFDGLRLLKEASVEELSSI   78

Query:  84 KGIGQVKSVEIKAMLELAKRIHKAEYDRKEQILSSEQLARKMNLELGDKKQEHLVAIYMD  143
              GIG VK+++I A +EL  RIHK  +    I S E A  +M ++    QEH V +Y++
Sbjct:  79 PGIGMVKAIQILAAVELGSRIHKLANEEHFVIRSPEDGANLVMEDMRFLTQEHFVCLYLN  138

Query: 144 TQNRIIEQRTIFIGTVRRSVAEPREILHYACKNMATSLIIIHNHPSGSPKPSESDLSFTK  203
           T+N++I +RT+FIG++  S+  PRE+    A K A  S I +HNHPSG P PS  D+  T+
Sbjct: 139 TKNQVIHKRTVFIGSLNSSIVHPREVFKEAFKRSAASFICVHNHPSGDPTPSREDIEVTR  198
```

-continued

```
Query: 204 KIKRSCDHLGIVCLDHIIVGKNKYYSFREE                                   233
           ++    + +GI  LDH+++G  K+ S +E+
Sbjct: 199 RLFECGNLIGIELLDHLVIGDKKFVSLKEK                                   228
```

A related DNA sequence was identified in *S. pyogenes* <SEQ ID 5279> which encodes the amino acid sequence <SEQ ID 5280>. Analysis of this protein sequence reveals the following:

```
Possible site: 59

>>> Seems to have no N-terminal signal sequence

----- Final Results -----
             bacterial cytoplasm --- Certainty = 0.3307 (Affirmative) < succ> bacterial membrane --- Certainty = 0.0000 (Not Clear) < succ> bacterial outside --- Certainty = 0.0000 (Not Clear) < succ>
```

An alignment of the GAS and GBS proteins is shown below.

```
Identities = 145/225 (64%), Positives = 182/225 (80%)

Query:  12 MYHIELKKEALLPRERLVDLGADRLSNQELLAILLRTGIKEKPVLEISTQILENISSLAD   71
           MY I+      +PRERL+ LGA  LSNQELLAILLRTG KEK VLE+S+ +L ++ SLAD
Sbjct:   1 MYSIKCDDNKAMPRERLMRLGAESLSNQELLAILLRTGNKEKEVLELSSYLLSHLDSLAD   60

Query:  72 FGQLSLQELQSIKGIGQVKSVEIKAMLELAKRIHKAEYDRKEQILSSEQLARKMMLELGD  131
           F ++SLQELQ + GIG+VK++EIKAM+EL  RI  +    + +L+S Q+A KMM  LGD
Sbjct:  61 FKKMSLQELQHLAGIGKVKAIEIKAMIELVSRILATDKTLTDSVLTSVQVAEKMMAALGD  120

Query: 132 KKQEHLVAIYMDTQNRIIEQRTIFIGTVRRSVAEPREILHYACKNMATSLIIIHNHPSGS  191
           KKQEELV +Y+D QNRIIE++TIFIGTVRRS+AEPREIL+YACKNMATSLI+IHNHPSG+
Sbjct: 121 KKQEHLVVLYLDNQNRIIEEKTIFIGTVRRSLAEPREILYYACKNMATSLIVIHNHPSGN  180

Query: 192 PKPSESDLSFTKKIKRSCDHLGIVCLDHIIVGKNKYYSFREEADI                 236
            +PS +D  FT+KIKRSC+ LGI+CLDHIIV   YYSFRE++ +
Sbjct: 181 IEPSSNDYGFTEKIKRSCEDLGIICLDHIIVSYKDYYSFREKSTL                 225
```

Based on this analysis, it was predicted that these proteins and their epitopes could be useful antigens for vaccines or diagnostics.

EXAMPLE 1700

A DNA sequence (GBSx1804) was identified in *S. agalactiae* <SEQ ID 5281> which encodes the amino acid sequence <SEQ ID 5282>. This protein is predicted to be a permease. Analysis of this protein sequence reveals the following:

```
Possible site: 29

>>> Seems to have an uncleavable N-term signal seq

INTEGRAL    Likelihood = -7.86 Transmembrane 258-274 (255-290)

INTEGRAL    Likelihood = -7.32 Transmembrane  89-105  (79-109)

INTEGRAL    Likelihood = -4.88 Transmembrane 176-192 (170-194)

INTEGRAL    Likelihood = -4.78 Transmembrane 339-355 (326-359)

INTEGRAL    Likelihood = -4.57 Transmembrane 237-253 (236-257)

INTEGRAL    Likelihood = -3.98 Transmembrane  39-55   (38-59)

INTEGRAL    Likelihood = -3.40 Transmembrane 292-308 (282-308)

INTEGRAL    Likelihood = -1.38 Transmembrane 317-333 (317-333)

INTEGRAL    Likelihood = -0.27 Transmembrane   8-24    (8-24)
```

```
----- Final Results -----
             bacterial membrane --- Certainty = 0.4142 (Affirmative) < succ> bacterial outside --- Certainty = 0.0000 (Not Clear) < succ> bacterial cytoplasm --- Certainty = 0.0000 (Not Clear) < succ>
```

The protein has homology with the following sequences in the GENPEPT database.

```
>GP:AAC05771 GB:AF051356 putative permease [Streptococcus mutans]

Identities = 88/366 (24%), Positives = 175/366 (47%), Gaps = 27/366 (7%)

Query:    3 FEKRQVYYVVITFAICYAIQAYW---GAVSNILTTLHKAIF-PFLNGAGIAYIINIVMSV   58
            F+ ++++ +   +     I   W    G++ N   ++ K  F PFL+G  + YI N+++
Sbjct:    2 FKSSKLFFWTVEILLVTLILFIWRQMGSIFNPFFSVAKTFFLPFLLGGFLYYITNPIVTF   61

Query:   59 YERLYIKLFKGSRLLMAIKRSVSMILSYATFIGLIVWLFSIVIPDLISSLSSLLVIDTGA  118
            E  +            IKR  + L +A  + L+V+   ++IP+LI+ L+ L+
Sbjct:   62 LENRF----------KIKRIWGITLIFAVLLSLLVFSITSLIPNLINQLTDLISASQNI  110

Query:  119 LAKLVNNLNENKQISEVLNYMGTDKDLVSTLSGYSQQILKQVLSVLTNLLTSVSSIAATL  178
            L +  NE K       N     D+   L  ++  +  +VL ++  SVSSI   +
Sbjct:  111 YVGLQDLFNEWKSNPAFKNI-----DIPVLLKQFNLSYVDILTNVLDSVTVSVSSIVYMI  165

Query:  179 LNVFVSFIFS----IYVLANKEQLGRQFNLLIDTYLGSTGKTFHYVRNILHQRFHGFFVS  234
            N  + + +       Y+L +K+ L      +L  T L +       + + +++      +
Sbjct:  166 TNTVMILVLTPVILFYLLKDKDGL---MPMLDRTILKNDRHNISQLLNQMNKTISRYISG  222

Query:  235 QTLEANILGSLTVIGMLIFQFPYALTVGVLVAFTALIPVVGAYIGVTIGFILIATESLTE  294
            ++A +     +IG   I      YA      ++    T +IP VG Y+G+T    +       +
Sbjct:  223 VAIDAAFIFVFALIGYQIMGVQYAFLFALVAGITNVIPYVGPYLGLTPVVLAYVVSDPKK  282

Query:  295 AFLFVLFLILLQQFEGNVIYPKVVGGSIGLPSMWVLMAITIGGALWGILGNLLAVPVAAT  354
               + +++++ LQQ +GN++YP+VVG ++ +  + +++ + +GG  + G++GML+AVP   A
Sbjct:  283 MIIAIIYIMTLQQIDGNIVYPRVVGSTMKIHPLTINVLLVLGGNIAGLVGMLVAVPAYAI  342

Query:  355 IYQIVK                                                       360
            I +IVK
Sbjct:  343 IKEIVK                                                       348
```

A related DNA sequence was identified in *S. pyogenes* <SEQ ID 5283> which encodes the amino acid sequence <SEQ ID 5284>. Analysis of this protein sequence reveals the following:

```
Possible site: 55

>>> Seems to have an uncleavable N-term signal seq

INTEGRAL   Likelihood = -8.70 Transmembrane  87-103 (83-116)

INTEGRAL   Likelihood = -7.27 Transmembrane 178-194 (166-202)

INTEGRAL   Likelihood = -6.74 Transmembrane 278-294 (256-297)

INTEGRAL   Likelihood = -5.41 Transmembrane 299-315 (295-321)

INTEGRAL   Likelihood = -4.46 Transmembrane  14-30  (13-32)

INTEGRAL   Likelihood = -3.56 Transmembrane 340-356 (333-366)

INTEGRAL   Likelihood = -3.35 Transmembrane 258-274 (256-277)

----- Final Results -----
             bacterial membrane --- Certainty = 0.4482 (Affirmative) < succ> bacterial outside --- Certainty = 0.0000 (Not Clear) < succ> bacterial cytoplasm --- Certainty = 0.0000 (Not Clear) < succ>
```

The protein has homology with the following sequences in the databases:

```
>GP:AAC05771 GB:AF051356 putative permease [Streptococcus mutans]

Identities = 87/373 (23%), Positives = 168/373 (44%), Gaps = 41/373 (10%)

Query:   10 FEKKQVFYLVLTFILCYGILANWRNGTAIVTTIYKTS----LPFFYGAAGAYIVNIVMSA   65
            F+  ++F+  +  +L    IL  WR   +I    +  +    LPF  G    YI N +++
Sbjct:    2 FKSSKLFFWTVEILLVTLILFIWRQMGSIFNPFFSVAKTFFLPFLLGGFLYYITNPIVTF   61

Query:   66 YEKVYVYIFKDWSHVLKVRRGICLLLAYLTFFILITWIISIVIPDLITSISTLTKFDT--  123
             E   +              K+KR  + L +     L+ + I+ +IP+LI  ++ L
Sbjct:   62 LENRF----------KIKRIWGITLIFAVLLSLLVFSITSLIPNLINQLTDLISASQNI  110

Query:  124 -ITIQEVVNNLEHNKLLARTIQYIGGDGKLTETIANYSQQLLKQFLTVLTNILTSVTVIA  182
             +  +Q++  N   + N              I    +Q    ++ +LTN+L SVTV
Sbjct:  111 YVGLQDLFNEWKSNPAFKNI-----------DIPVLLKQFNLSYVDILTNVLDSVTVSV  158

Query:  183 SAIINLFISFVFSL--------YVLASKEDLCRQGNTLVDTYTGKYAKRIHYLLELLHQR  234
            S+I+ +  + V  L        Y+L  K+ L      L  T       I    LL  +++
Sbjct:  159 SSIVYMITNTVMILVLTPVILFYLLKDKDGLHPM---LDRTILKNDRHNISQLLNQMNKT  215

Query:  235 FHGFFVSQTLEAMILGSLTASGMFILRLPFAGTIGVLVAFTALIPVIGASIGAAIGFILI  294
                      +     ++A  +     G  I+ +  +A    ++    T  +IP +G  +G  +
Sbjct:  216 ISRYISGVAIDAAFIFVFALIGYQIMGVQYAFLFALVAGITNVIPYVGPYLGLTPVVLAY  275

Query:  295 MTQSMSQAIIFIIFLIILQQIEGNFIYPKVVGGSIGLPANWVLMAITIGASLKGIVGHII  354
             +       + II II+++ LQQI+GN +YP+VVG ++  +  + +++ +  +G ++  G+VGM++
Sbjct:  276 VVSDPKKMIIAIIYIMTLQQIDGNIVYPRVVGSTMKIHPLTIMVLLVLGGNIAGLVGMLV  335

Query:  355 AVPLAATLYQVIK                                                367
            AVP  A +  +++K
Sbjct:  336 AVPAYAIIKEIVK                                                348
```

An alignment of the GAS and GBS proteins is shown below.

```
Identities = 218/370 (58%), Positives = 291/370 (77%)

Query:    1 MKFEKRQVYYVVITFAICYAIQAYWGAVSNILTTLHKAIFPPLMGAGIAYIINIVMSVYE   60
            MKFEK+QV+Y+V+TF +CY I A W    + I+TT++K  PF  GA  AYI+NIVMS YE
Sbjct:    8 MKFEKKQVFYLVLTFILCYGILANWRNGTAIVTTIYKTSLPFFYGAAGAYIVNIVMSAYE   67

Query:   61 RLYIKLFKGSRLLMAIKRSVSMILSYATFIGLIVWLFSIVIPDLISSLSSLLVIDTGALA  120
             ++Y+ +FK     ++ +KR +  ++L+Y TF LI  W+ F  SIVIPDLI+S+S+L   DT  +
Sbjct:   68 KVYVYIFKDWSHVLKVKRGICLLLAYLTPFILITWIISIVIPDLITSISTLTKFDTITIQ  127

Query:  121 KLVNNLNENEQISEVLNYMGTDKDLVSTLSGYSQQILKQVLSVLTNLLTSVSSIAATLLN  180
             ++VNNL  NK ++  + Y+G D  L  T++ YSQQ+LKQ L+VLTN+LTSV  IA+  ++N
Sbjct:  128 EVVNNLEHNKLLARTIQYIGGDGKLTETIANYSQQLLKQFLTVLTNILTSVTVIASAIIN  187

Query:  181 VFVSFIFSIYVLANKEQLGRQFNLLIDTYLGSTGKTFHYVRHILHQRFHGFFVSQTLEAM  240
             +F+SF+FS+YVLA+KE L RQ N L+DTY G   K   HY+   +LHQR HGFFVSQTLEAM
Sbjct:  188 LFISFVFSLYVLASKEDLCRQGNTLVDTYTGKYAKRIHYLLELLHQRFHGFFVSQTLEAM  247

Query:  241 ILGSLTVIGMLIFQFPYALTVGVLVAFTALIPVVGAYIGVTIGFILIATESLTEAFLFVL  300
            ILGSLT  GM I + P+A T+GVLVAFTALIPV+GA IG   IGFILI T+S+++A  +F++
Sbjct:  248 ILGSLTASGMFILRLPFAGTIGVLVAFTALIPVIGASIGAAIGFILIMTQSMSQAIIFII  307

Query:  301 WLILLQQFEGNVIYPKVVGGSIGLPSMWVLMAITIGGALWGILGMLLAVPVAATIYQIVK  360
             +LI+LQQ EGN IYPKVVGGSIGLP+MWVLMAITIG +L GI+GM++AVP AAT YQ++K
Sbjct:  308 FLIILQQIEGNFIYPKVVGGSIGLPANWVLMAITIGASLKGIVGMIIAVPLAATLYQVIK  367

Query:  361 DHIIKRQTLR                                                   370
            D+I KRQ ++
Sbjct:  368 DNIQKRQAIQ                                                   377
```

Based on this analysis, it was predicted that these proteins and their epitopes could be useful antigens for vaccines or diagnostics.

EXAMPLE 1701

A DNA sequence (GBSx1805) was identified in *S. agalactiae* <SEQ ID 5285> which encodes the amino acid sequence <SEQ ID 5286>. Analysis of this protein sequence reveals the following:

```
Possible site: 18

>>> Seems to have no N-terminal signal sequence

----- Final Results -----
              bacterial cytoplasm --- Certainty = 0.1081 (Affirmative) < succ> bacterial membrane --- Certainty = 0.0000 (Not Clear)  < succ> bacterial outside --- Certainty = 0.0000 (Not Clear)  < succ>
```

A related GBS nucleic acid sequence <SEQ ID 9849> which encodes amino acid sequence <SEQ ID 9850> was also identified.

The protein has homology with the following sequences in the GENPEPT database.

```
>GP:AAA69226 GB:U29579 6-phospho-beta-glucosidase [Escherichia coli]

Identities = 290/478 (60%), Positives = 369/478 (76%), Gaps = 2/478 (0%)

Query:    2 MVKQVFPKGFLWGGATAANQCEGAYNVDGRGLANVDVVPTGEDRFAIISGQKKNFDFESG   61
            M   VFP+ FLWGGA AANQ EGA+    +GL  VD++P GE R A+  G +K F   +
Sbjct:    1 MKMSVFPESFLWGGALAAWQSEGAFREGDKGLTTVDMIPHGEHRMAVKLGLEKRFQLRDD   60

Query:   62 YFYPARESIDFYHHYKEDLALLAEMGFKTYRNSIAWTRIFPKGDELYPNEAGLQFYENIF  121
            +FYP+ E+ DFYH YKED+AL+AEMGFK +R SIAW+R+FP+GDE+ PN+ G+ FY ++F
Sbjct:   61 EFYPSHEATDFYHRYKEDIALMAEMGFKVFRTSIAWSRLFPQGDEITPNQQGIAFYRSVF  120

Query:  122 KECRKYGIEPLVTITHFDCPIYLIKHYGGWRSRKNIGFYERLVRALFTRFKGLVKYWLTF  181
            +EC+KYGIEPLVT+ HFD P++L+   YG WR+RK++ F+ R  R   F  GLVKYWLTF
Sbjct:  121 EECKKYGIEPLVTLCHFDVPNHLVTEYGSWRNRKLVEFFSRYARTCFEAFDGLVKYWLTF  180

Query:  182 NEINMILHAPFMGAGLYFEDGENQEQIKYQAAHHELVASAIAVKIAHEVDPNNQIGCMLA  241
            NEIN++LH+PF GAGL FE+GENQ+Q+KYQAAHH+LVASA+A KIAHEV+P NQ+GCMLA
Sbjct:  181 NEINIMLHSPFSGAGLVFEEGENQDQVKYQAAHHQLVASALATKIAHEVNPQNQVGCMLA  240

Query:  242 AGQYYPNTCHPQDYWASMQKNRENYFFIDVQARGKYPNYAKKHFEHLGISIQMTAEDLAL  301
            G +YP  C P+D WA+++K+REN FFIDVQARG YP Y+ + F    G++I    D   +
Sbjct:  241 GGNFYPYSCKPEDVWAALEKDRENLFFIDVQARGTYPAYSARVFREKGVTINKAPGDDEI  300

Query:  302 LRDYTVDFISFSYYSSRVASGNPTVSEQVQENIFASLKNPYLKSSEWCWQIDPLGLRITL  361
            L++ TVDF+SFSYY+SR AS      + +    N+  SL+NPYL+ S+WGW IDPLGLRIT+
Sbjct:  301 LKN-TVDFVSFSYYASRCASAENNANNSSAANVVKSLRNPYLQVSDWGWGIDPLGLRITM  359

Query:  362 NAIWDRYQKPMFIVENGLGAVDIPDENGYVEDDYRIDYLRQHIAANRDAIYVDGVNLIGY  421
            N ++DRYQKP+F+VENGLGA D   NG + DDYRI YLR+HI AM +AI  DG+ L+GY
Sbjct:  360 NMNYDRYQKPLFLVENGLGAKDEFAANGEINDDYRISYLREHIRAMGEAI-ADGIPLMGY  418

Query:  422 TTWGCIDLVSAGTGEMEKRYGFIYVDRNNKGEGTLKRYKKKSFYWYKKVIASNGSQIE    479
            TTWGCIDLVSA TGEM KRYGF++VDR++ G GTL R +KKSF+WYKKVIASNG  +E
Sbjct:  419 TTWGCIDLVSASTGEMSKRYGFVFVDRDDAGNGTLTRTRKKSFWWYKKVIASNGEDLE    476
```

There is also homology to SEQ ID 5288.

Based on this analysis, it was predicted that this protein and its epitopes, could be useful antigens for vaccines or diagnostics.

EXAMPLE 1702

A DNA sequence (GBSx1806) was identified in *S. agalactiae* <SEQ ID 5289> which encodes the amino acid sequence <SEQ ID 5290>. This protein is predicted to be platelet-activating factor acetylhydrolase isoform Ib beta subunit, pu. Analysis of this protein sequence reveals the following:

```
Possible site: 30
>>> Seems to have no N-terminal signal sequence

----- Final Results -----
            bacterial cytoplasm --- Certainty = 0.5323(Affirmative) < succ>
             bacterial membrane --- Certainty = 0.0000(Not Clear)   < succ>
              bacterial outside --- Certainty = 0.0000(Not Clear)   < succ>
```

The protein has homology with the following sequences in the GENPEPT database.

```
>GP: AAC27974 GB: AF016048 platelet-activating factor acetylhydrolase
alpha 2 subunit [Rattus norvegicus]
Identities = 43/177 (24%), Positives = 84/177 (47%), Gaps = 9/177 (5%)

Query:   28 QEGAIVFTGDSIVEF---FPLKKHLGRDYPLVNRGVAGSDTYWLLENLRTQVWELLPSKV    84
            +E  ++F GDS+V+     + + + L      +N G+ G  T  +L  L+    E +  KV
Sbjct:   38 KEPDVLFVGDSMVQLMQQYEIWRELFSPLHALNFGIGGDTTRHVLWRLKNGELENIKPKV   97

Query:   85 FIL-IGTNDIGLGHSQSEIIANITDIIAEIRAESYMTEINILSVLPVSEEDDYIERVKVR   143
            ++ +GTN+     ++  E+   I  I+   I         +I +L +LP  E+ + + +  +
Sbjct:   98 IVVWVGTNNHE--NTAEEVAGGIEAIVQLINTRQPQAKIIVLGLLPRGEKPNPLRQKNAK   155

Query:  144 NNQTIKALNKTLSVISGINYIELYDLLVDEKGQLASSFTKDGLHLTDQAYAKISETI     200
            NQ +K    +L  ++ +  +++        V    G ++         D LHLT    YAKI + +
Sbjct:  156 VNQLLKV---SLPKLANVQLLDIDGGFVHSDGAISCHDMFDFLHLTGGGYAKICKPL   209
```

A related DNA sequence was identified in *S. pyogenes* <SEQ ID 5291> which encodes the amino acid sequence <SEQ ID 5292>. Analysis of this protein sequence reveals the following:

```
Possible site: 35
>>> Seems to have no N-terminal signal sequence

----- Final Results -----
            bacterial cytoplasm --- Certainty = 0.5979(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below.

```
Identities = 92/204 (45%), Positives = 133/204 (65%)

Query:    1 MLEVIDKALRDYQMKREQFFEINNQTVQEGAIVFTGDSIVEFFPLKKHLGRDYPLVNRGV    60
            MLE++ + LR YQ ++   +    NQ   +G IVF GDS++EFFPLKK   G   P++NRG+
Sbjct:    1 MLEIVSEELRHYQEQKLIEYRNKNQLAPKGGIVFAGDSLIEFFPLKKAFGSCLPIINRGI    60

Query:   61 AGSDTYWLLENLRTQVWELLPSKVFILIGTNDIGLGHSQSEIIANITDIIAEIRAESYMT   120
            AG D+ WLL +   Q+ +L P  +F+LIG NDIGLG+ +   I+  I ++I++IR+    +
Sbjct:   61 AGIDSQWLLRHFSVQITDLEPKHIFLLIGCNDIGLGYDKCHIVKTIVELISQIRSHCVYS   120

Query:  121 EINILSVLPVSEEDDYIERVKVRNNQTIKALNKTLSVISGINYIELYDLLVDEKGQLASS   180
            +I  +LS+LPVS    Y + VK+R N   I A+NK L++I   + +I L   L DEKG L+
Sbjct:  121 QIYLLSLLPVSNNPRYQKTVKIRTNAMIDAINKDLAMIPTVEFINLNTCLKDEKGGLSDE   180

Query:  181 FTKDGLHLTDQAYAKISETIKLYL                                       204
              T DGLHL    AYAK++E IK Y+
Sbjct:  181 NTLDGLHLNFPAYAKLAEIIKSYI                                      204
```

Based on this analysis, it was predicted that these proteins and their epitopes could be useful antigens for vaccines or diagnostics.

EXAMPLE 1703

A DNA sequence (GBSx1807) was identified in *S. agalactiae* <SEQ ID 5293> which encodes the amino acid sequence <SEQ ID 5294>. Analysis of this protein sequence reveals the following:

```
Possible site: 43
>>> Seems to have no N-terminal signal sequence

----- Final Results -----
            bacterial cytoplasm --- Certainty = 0.5226(Affirmative) < succ>
             bacterial membrane --- Certainty = 0.0000(Not Clear)   < succ>
              bacterial outside --- Certainty = 0.0000(Not Clear)   < succ>
```

A related GBS nucleic acid sequence <SEQ ID 9851> which encodes amino acid sequence <SEQ ID 9852> was also identified.

The protein has homology with the following sequences in the GENPEPT database.

```
>GP: BAA35556 GB: D90723 Hypothetical 30.2 kd protein in idh-deoR
intergenic region. [Escherichia coli]
Identities = 104/265 (39%), Positives = 154/265 (57%), Gaps = 4/265 (1%)

Query:    2 IKLIATDMDGTFLRSDKTYDKARFSSLLTLMEKYDIKFVAASGNLYDQLLLNFLEYPNRI   61
            IKLIA DMDGTFL   KTY++ RF +    M+   I+FV ASGN Y QL+   F E  N I
sbjct:    4 IKLIAVDMDGTFLSDQKTYNRERFMAQYQQMKAQGIRFVVASGNQYYQLISFFPEIANEI   63

Query:   62 AYVAENGGRVIDQDGTLLKETYLSNDTVAAVLSYLYQNYPETLISLSGEKRSYLERRTPI  121
            A+VAENGG V+ + G +    LS D  A V+ +L    PE  I   G+  +Y ++
Sbjct:   64 AFVAENGGWVVSE-GKDVFNGELSKDAFATVVEHLLTR-PEVEIIACGKNSAYTLKKYDD  121

Query:  122 NRRTELEYYMPNFIYKDHLLPLDDDRYFQMTLWVNENLVSEMLLDISEHFKNHHIRLTSS  181
              +T  E Y      Y D+    L+D  +F+  L +++ L+ ++     + E   +  ++  +
Sbjct:  122 AMKTVAEMYYHRLEYVDNFDNLEDI-FFKFGLNLSDELIPQVQKALHEAIGDIMVSV-HT  179

Query:  182 GFGCIDVLPADVNKADGIAILLEKWGLKQDQVMVFGDGGNDVEMLRAANISYAMSNAPEE  241
              G G ID++    V+KA+G+   L + WG+    +V+VFGDGGND+EMLR A   S+AM NA
Sbjct:  180 GNGSIDLIIPGVHKANGLRQLQKLWGIDDSEVVVFGDGGNDIEMLRQAGFSFAMENAGSA  239

Query:  242 IKAIAKYQTVSNDQDGVLETIENFL                                    266
            + A AKY+   SN+++GVL+ I+  L
Sbjct:  240 VVAAAKYRAGSNNREGVLDVIDKVL                                    264
```

There is also homology to SEQ ID 1158.

Based on this analysis, it was predicted that this protein and its epitopes, could be useful antigens for vaccines or diagnostics.

EXAMPLE 1704

A DNA sequence (GBSx1808) was identified in *S. agalactiae* <SEQ ID 5295> which encodes the amino acid sequence <SEQ ID 5296>. This protein is predicted to be transcriptional regulator (AraC/XylSfamily). Analysis of this protein sequence reveals the following:

```
Possible site: 50
>>> Seems to have no N-terminal signal sequence

----- Final Results -----
            bacterial cytoplasm --- Certainty = 0.4984(Affirmative) < succ>
             bacterial membrane --- Certainty = 0.0000(Not Clear)   < succ>
              bacterial outside --- Certainty = 0.0000(Not Clear)   < succ>
```

The protein has homology with the following sequences in the GENPEPT database.

```
>GP: AAF89977 GB: AF206272 transcriptional regulator [Streptococcus
mutans]
Identities = 195/287 (67%), Positives = 237/287 (81%)

Query:    5 DNLLSHNLEDNRHLLPYEHMHTEVRNGYPDILFHWHPELEISYVHEGTARYHIDYDFFNS   64
            D    H +  +  LLPY+    T + NGYPD LFHWHPELEISY++EGTA YHIDYD FNS
Sbjct:   10 DENFKHEINFDNDLLPYKIYQTTIANGYPDTLFHWHPELEISYIYEGTAQYHIDYDYFNS   69

Query:   65 QSGDIILIRPNGMHSIHPIENKSHITDSIKFHLDLIGYSIVDQVSLRYLQPLQTSSFKFI  124
            Q+ DIIL+RPNGMHSIHPI+NK       ++ FHLDL+GYS++DQ+SLRYLQPLQ S+FK +
```

```
                              -continued
Sbjct:  70 QTDDIILVRPNGMHSIHPIKNKMQKAQTLLFHLDLVGYSLLDQISLRYLQPLQNSTFKLV  129

Query: 125 QCIKPSMTGYNDIKNCLFDIFNISKEENRHFELLLKAKLNELLYLLYYHQYVIKKHTDDT  184
              CIKP M GY DIKNCLF IF+I + +  RHFELLLKAKL EL+YLLY+HQYV++KH+DD
Sbjct: 130 PCIKPDMLGYQDIKNCLFAIFDIYQRQGRHFELLLKAKLQELIYLLYFHQYVLRKHSDDM  189

Query: 185 YRKNERIRDLIDYINNNYQQNLTIEFLADYMGYSKTHFMTVFKQHTGTSCTEFIIQVRLN  244
              YRKNE+IR+LIDYI+ +YQ+ L+I   LAD +GYSKTHFMTVFKQHTGTSCT+FIIQ RL+
Sbjct: 190 YRKNEKIRELIDYIHQHYQEKLSIISLADIIGYSKTHFMTVFKQHTGTSCTDFIIQFRLS  249

Query: 245 KASEHLINSTTAIIDIANSVGFNNLSNFNRQFKRYYHTTPRQYRKQF             291
              KA + L+NS   I+++A+ VGF NLSNFNRQFKRYY  TP QYRKQF
Sbjct: 250 KACDLLVNSIKPILEVASEVGFTNLSNFNRQFKRYYQITPSQYRKQF             296
```

A related DNA sequence was identified in *S. pyogenes* <SEQ ID 5297> which encodes the amino acid sequence <SEQ ID 5298>. Analysis of this protein sequence reveals the following:

```
Possible site: 28
>>> Seems to have no N-terminal signal sequence

----- Final Results -----
           bacterial cytoplasm --- Certainty = 0.1000(Affirmative) < succ>
           bacterial membrane  --- Certainty = 0.0000(Not Clear)   < succ>
            bacterial outside  --- Certainty = 0.0000(Not Clear)   < succ>
```

An alignment of the GAS and GBS proteins is shown below.

```
Identities = 43/169 (25%), Positives = 83/169 (48%), Gaps = 16/169 (9%)

Query: 136 DIKNCLFDIFNISKEENRHFELLLKAKLNELLYLLYYHQYV------IKKHTDDTYRKN-  188
              D+K+  F +F+  +  R F +L K     ++ ++ Q +       +KK  D T + N
sbjct: 319 DVKHVSFLLFS---DIYRQFPILDKMTYLSMVKTIHDSQSIDCILRELKKVLDVTNQNNS  375

Query: 189 ------ERIRDLIDYINNNYQQNLTIEFLADYMGYSKTHFMTVFKQHTGTSCTEFIIQVR  242
                    + + + ID I    Y Q LT++ +AD + + +   FK  T  S T+++ VR
Sbjct: 376 PEKRYSDLVSETIDCIRKEYHQELTLKAIADRLHVNGVYLGQCFKNETERSFTQYLNHVR  435

Query: 243 LNKASEHLINSTTAIIDIANSVGFNNLSNFNRQFKRYYHTTPRQYRKQF             291
              + KA + L+ +   +I +IA   G+N    F +FK+    +P+++R ++
sbjct: 436 IQKAQQLLLYTNQSINEIAYETGYNTNHYFIKMFKKLNGLSPKEFRDRY              484
```

Based on this analysis, it was predicted that these proteins and their epitopes could be useful antigens for vaccines or diagnostics.

EXAMPLE 1705

A DNA sequence (GBSx1809) was identified in *S. agalactiae* <SEQ ID 5299> which encodes the amino acid sequence <SEQ ID 5300>. Analysis of this protein sequence reveals the following:

```
Possible site: 34
>>> Seems to have no N-terminal signal sequence

----- Final Results -----
           bacterial cytoplasm --- Certainty = 0.3705(Affirmative) < succ>
           bacterial membrane  --- Certainty = 0.0000(Not Clear)   < succ>
            bacterial outside  --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1706

A DNA sequence (GBSx1810) was identified in *S. agalactiae* <SEQ ID 5301> which encodes the amino acid sequence <SEQ ID 5302>. Analysis of this protein sequence reveals the following:

```
Possible site: 39
>>> Seems to have no N-terminal signal sequence
    INTEGRAL      Likelihood = -11.25    Transmembrane     59-75   (56-82)
    INTEGRAL      Likelihood = -7.48     Transmembrane     23-39   (12-41)
    INTEGRAL      Likelihood = -6.64     Transmembrane    231-247  (225-255)
    INTEGRAL      Likelihood = -5.15     Transmembrane    335-351  (333-355)
    INTEGRAL      Likelihood = -4.19     Transmembrane    309-325  (305-327)
    INTEGRAL      Likelihood = -4.14     Transmembrane    272-288  (268-292)
    INTEGRAL      Likelihood = -4.04     Transmembrane    402-418  (400-419)
    INTEGRAL      Likelihood = -3.88     Transmembrane    191-207  (190-208)
    INTEGRAL      Likelihood = -2.71     Transmembrane    365-381  (364-381)
    INTEGRAL      Likelihood = -1.86     Transmembrane    165-181  (164-182)

----- Final Results -----
            bacterial membrane --- Certainty = 0.5501(Affirmative) < succ>
            bacterial outside  --- Certainty = 0.0000(Not Clear)   < succ>
            bacterial cytoplasm --- Certainty = 0.0000(Not Clear)  < succ>
```

The protein has homology with the following sequences in the GENPEPT database.

```
>GP: AAF96429 GB: AE004383 conserved hypothetical protein
[Vibrio cholerae]
Identities = 142/443 (32%), Positives = 241/443 (54%),
Gaps = 20/443 (4%)

Query:    6 NEFQFSLESILGFVWRGIVVGLIAGFVVSIFRLAIEKIFLVVMELYKS--AHYQPIILLS    63
            N+F      ++      ++  ++VG++AG V + F  A+  +      + KS    + P+ L +
Sbjct:   21 NQFLSKDKTPFSVLFLSLLVGILAGLVGTYFEQAVHLVSETRTDWLKSEIGSFLPLWLAA    80

Query:   64 ITVTSIIAAVIIGFFI--KSDPDIKGSGIPHVEGELKGMLSPDWFSIVWKKFIAGILAIS   121
            +++  +A    IG+F+   +   P+  GSGIP  +EG + GM     W+ ++   KF  G+ A+
Sbjct:   81 FLISAFLA--FIGYFLVHRFAPEAAGSGIPEIEGAMDGMRPVRWWRVLPVKFFGGMGALG   138

Query:  122 SGLMLGREGPSIQLGAMTGKGIAQYLNASRMEKR-VLIASGAAAGLSAAFNAPIAGLLFV   180
            SG++LGREGP++Q+G    G+ I+         + R   L+A+GAA  GL+AAFNAP+AG++FV
Sbjct:  139 SGMVLGREGPTVQMGGAVGRMISDIFRVKNEDTRHSLLAAGAAGGLAAAFNAPLAGIMFV   198

Query:  181 VEEIYHHFS-RLVWITALVASLV-ANFVSLNIFGLTPVLALPSELPSLNLNFYWIFLLMG   238
            +EE+    F   L+ +A++ S V AN V   I G   V+ +P +  +  L+     +FLL+G
Sbjct:  199 IEEMRPQFRYTLISVRAVIISAVAANIVFRVINGQDAVITMP-QYDAPELSTLGLFLLLG   257

Query:  239 LFLGILGFIYEWVIL----RFHVIYDYLGKLFHLPSHLYGILAVIFILPIGYYFPQLLGG   294
               G+ G ++ ++I        F  +   K + L  +G    + L    Y P+L GG
Sbjct:  258 ALFGVFGVLFNYLITLAQDLFVKFHRNDRKRYLLTGSMIGGCFGLLLL---YVPELTGG   313

Query:  295 GNGLIVSLPRSNLSLMMLGLFFLIRFLWSMLSYSSGLPGGIFLPILALGSLAG-AFFAVG   353
            G  LI ++        +L L F+ R   ++L + SG PGGIF P+LALG+L G AF  +
Sbjct:  314 GISLIPTITNGGYGAGILLLLFVGRIFTTLLCFGSGAPGGIFAPMLALGTLFGYAFGLIA   373

Query:  354 MQYFGIISHQQISLFVVLGMAGYFGAISKAPLTAMILVTEMVGDLKQLMAIGIVTMVSYI   413
             +F  ++ +   +F + GM   F A  +AP+T ++LV EM    ++ + I ++  + I
Sbjct:  374 KMWFPELNIEP-GMFAIAGMGALFAATVRAPITGILLVIEMTNNYHLILPLIITSLGAVI   432

Query:  414 VMDLLKGEPIYEAMLAKMTFNPK                                      436
             + +LL+G+PIY  +L +   N K
Sbjct:  433 FAQLLGGQPIYSQLLHRTLKNQK                                      455
```

A related DNA sequence was identified in *S. pyogenes* <SEQ ID 5303> which encodes the amino acid sequence <SEQ ID 5304>. Analysis of this protein sequence reveals the following:

```
Possible site: 31
>>> Seems to have no N-terminal signal sequence
    INTEGRAL      Likelihood = -11.68    Transmembrane     71-87  (66-95)
    INTEGRAL      Likelihood =  -9.45    Transmembrane     36-52  (26-56)
    INTEGRAL      Likelihood =  -5.63    Transmembrane    346-362 (342-367)
    INTEGRAL      Likelihood =  -5.36    Transmembrane    376-392 (375-393)
    INTEGRAL      Likelihood =  -5.15    Transmembrane    413-429 (410-432)
    INTEGRAL      Likelihood =  -5.10    Transmembrane    321-337 (318-340)
    INTEGRAL      Likelihood =  -4.19    Transmembrane    203-219 (202-220)
    INTEGRAL      Likelihood =  -4.19    Transmembrane    244-260 (242-265)
    INTEGRAL      Likelihood =  -4.19    Transmembrane    284-300 (280-304)
    INTEGRAL      Likelihood =  -1.86    Transmembrane    177-193 (176-194)

----- Final Results -----
             bacterial membrane --- Certainty = 0.5670(Affirmative) < succ>
              bacterial outside --- Certainty = 0.0000(Not Clear)   < succ>
            bacterial cytoplasm --- Certainty = 0.0000(Not Clear)   < succ>
```

The protein has homology with the following sequences in the databases:

```
>GP: AAF96429 GB: AE004383 conserved hypothetical protein
[Vibrio cholerae]
Identities = 144/442 (32%), Positives = 236/442 (52%),
Gaps = 30/442 (6%)

Query:  18 NEFTFSNKSIIAYVWRGVVVGIIAGVIVSLFRLLIEVTADWVIEWYRYAHINSLLLLPIL  77
           N+F  +K+  + ++  ++VGI+AG++ + F    + + ++   +W + + I S L L +
Sbjct:  21 NQFLSKDKTPFSVLFLSLLVGILAGLVGTYFEQAVHLVSETRTDWLK-SEIGSFLPLWLA  79

Query:  78 SVSLLAVL-FVGFLV--KSDSDIKGSGIPHVEGELKGLMSPDWWSVLWKKFLGGIMAISM  134
           + + A L F+G+ +  +   + GSGIP +EG + G+    WW VL  KF GG+ A+
Sbjct:  80 AFLISAFLAFIGYFLVHRFAPEAAGSGIPEIEGAMDGMRPVRWWRVLPVKFFGGMGALGS  139

Query: 135 GFMLGREGPSIQLGAMSAKGLAKFLKSSRLEKR-VLIASGAAAGLSAAFNAPIAGLLFVV  193
           G +LGREGP++Q+G   + ++    +    + R  L+A+GAA GL+AAFNAP+AG++FV+
Sbjct: 140 GMVLGREGPTVQMGGAVGRMISDIFRVKNEDTRHSLLAAGAAGGLAAAFNAPLAGIMFVI  199

Query: 194 EEIYHHFS-RLIWITALVASLV-ANFISLNIFGLKPVLAMSEAMPFLGLNQYWLLLLLGL  251
           EE+    F   LI + A++ S V AN+    I G    V+ M +     L+   L LLLG
Sbjct: 200 EEMRPQFRYTLISVRAVIISAVAANIVFRVINGQDAVITMPQ-YDAPELSTLGLFLLLGA  258

Query: 252 FLGCLGYLYEIVIL-----------NFNKLYVILGSWLHLPDYFYGIIMVFLILPIGYYL  300
             G  G L+ +I            N  K Y++ GS +     +G++++         Y+
Sbjct: 259 LFGVFGVLFNYLITLAQDLFVKFHRNDRKRYLLTGSMI---GGCFGLLLL--------YV  307

Query: 301 PQLLGGGHGLILSLSNQQLPLMTIFFYFIIRFIVSMFSYGSGLPGGIFLPILTLGALAGL  360
           P+L GGG  LI +++N      +    F+ R   ++ +GSG PGGIF  P+L LG L G
Sbjct: 308 PELTGGGISLIPTITNGGYGAGILLLLFVGRIFTTLLCFGSGAPGGIFAPMLALGTLFGY  367

Query: 361 LFGQIASQLGLLNQSFLSLFLILGMAGYFAAISKAPLTGMILVTEMVGDLKPLMAIAVVT  420
             FG  IA           +F I GM    FAA  +AP+TG++LV EM +   ++ + +
Sbjct: 368 AFGLIAKMWFPELNIEPGMFAIAGMGALFAATVRAPITGILLVIEMTNNYHLILPLIITS  427

Query: 421 FVSYLVMDLLNGQPIYEAMLDK                                       442
           + +     LL GQPIY  +L +
Sbjct: 428 LGAVIFAQLLGGQPIYSQLLHR                                       449
```

An alignment of the GAS and GBS proteins is shown below.

```
Identities = 343/510 (67%), Positives = 410/510 (80%)

Query:   1 MENHKNEFQFSLESILGFVWRGIVVGLIAGFVVSIFRLAIEKIFLVVMELYKSAHYQPII   60
           MENHKNEF FS +SI+ +VWRG+VVG+IAG +VS+FRL IE    V+E Y+ AH   ++
Sbjct:  13 MENHKNEFTFSNKSIIAYVWRGVVVGIIAGVIVSLFRLLIEVTADWVIEWYRYAHINSLL   72

Query:  61 LLSITVTSIIAAVIIGFFIKSDPDIKGSGIPHVEGELKGMLSPDWFSIVWKKFIAGILAI  120
           LL I   S++A + +GF +KSD DIKGSGIPHVEGELKG++SPDW++VWKKF+ GI+AI
Sbjct:  73 LLPILSVSLLAVLFVGFLVKSDSDIKGSGIPHVEGELKGLMSPDWWSVLWKKFLGGIMAI  132
```

```
-continued
Query:  121 SSGLMLGREGPSIQLGAMTGKGIAQYLNASRMEKRVLIASGAAAGLSAAFNAPIAGLLFV  180
            S G MLGREGPSIQLGAM+ KG+A++L +SR+EKRVLIASGAAAGLSAAFNAPIAGLLFV
Sbjct:  133 SMGFMLGREGPSIQLGAMSAKGLAKFLKSSRLSKRVLIASGAAAGLSAAFNAPIAGLLFV  192

Query:  181 VEEIYHHFSRLVWITALVASLVANFVSLNIFGLTPVLALPSELPSLNLNFYWIFLLMGLF  240
            VEEIYHHFSRL+WITALVASLVANF+SLNIFGL PVLA+    +P L LN YW +LL+GLF
Sbjct:  193 VEEIYHHFSRLIWITALVASLVANFISLNIFGLKPVLAMSEAMPFLGLNQYWLLLLLGLF  252

Query:  241 LGILGFIYEWVILRFHVIYDYLGKLFHLPSHLYGILAVIFILPIGYYFPQLLGGGNGLIV  300
            LG LG++YE VIL F+ +Y LG   HLP + YGI+ V  ILPIGYY PQLLGGG+GLI+
Sbjct:  253 LGCLGYLYEIVILNFNKLYVILGSWLHLPDYFYGIIMVFLILPIGYYLPQLLGGGHGLIL   31

Query:  301 SLPRSNLSLMMLGLFFLIRFLWSMLSYSSGLPGGIFLPILALGSLAGAFFAVGMQYFGII  360
            SL     L LM +  +F+IRF+ SM SY SGLPGGIFLPIL LG+LAG  F      G++
Sbjct:  313 SLSNQQLPLMTIFFYFIIRFIVSMFSYGSGLPGGIFLPILTLGALAGLLFGQIASQLGLL  372

Query:  361 SHQQISLFVVLGMAGYFGAISKAPLTAMILVTEMVGDLKQLMAIGIVTMVSYIVMDLLKG  420
            +    +SLF++LGMAGYF AISKAPLT MILVTEMVGDLK LMAI +VT VSY+VMDLL G
Sbjct:  373 NQSFLSLFLILGMAGYFAAISKAPLTGMILVTEMVGDLKPLMAIAVVTFVSYLVMDLLNG  432

Query:  421 EPIYEAMLAKMTFNPKDKVMTPTLIELTVSDKISGKYVRDLELPENVLITTQIMHKTSAV  480
            +PIYEAML KM         ++ PTLIELTV DKI+GKYV++L+LPENVLITTQIHH+ S V
Sbjct:  433 QPIYEAMLDKMMAKHPTNLVEPTLIELTVGDKIAGKYVKELKLPENVLITTQIHHQKSQV  492

Query:  481 VSGNTILNAGDTIFLVVNESEIKEVREQLM                               510
            VSGNT L +G TIFLVVNE++   VRE LM
Sbjct:  493 VSGNTRLLSGATIFLVVNEADTGFVREVLM                               522
```

Based on this analysis, it was predicted that these proteins and their epitopes could be useful antigens for vaccines or diagnostics.

EXAMPLE 1707

A DNA sequence (GBSx1811) was identified in *S. agalactiae* <SEQ ID 5305> which encodes the amino acid sequence <SEQ ID 5306>. This protein is predicted to be spermidine/putrescine-binding periplasmic protein precursor (potD-1). Analysis of this protein sequence reveals the following:

```
Possible site: 38
>>> Seems to have an uncleavable N-term signal seq
    INTEGRAL     Likelihood = -9.02    Transmembrane     20-36(14-40)

----- Final Results -----
              bacterial membrane --- Certainty = 0.4609(Affirmative) < succ>
               bacterial outside --- Certainty = 0.0000(Not Clear)   < succ>
             bacterial cytoplasm --- Certainty = 0.0000(Not Clear)   < succ>
```

A related GBS nucleic acid sequence <SEQ ID 8881> which encodes amino acid sequence <SEQ ID 8882> was also identified. Analysis of this protein sequence reveals the following:

```
Lipop: Possible site: -1 Crend: 2
SRCFLG: 0
McG: Length of UR: 22
     Peak Value of UR: 4.16
     Net Charge of CR: 2
McG: Discrim Score: 18.94
GvH: Signal Score (-7.5): -3.29
     Possible site: 25
>>> Seems to have an uncleavable N-term signal seq
Amino Acid Composition: calculated from 1
ALOM program count: 1 value: -9.02 threshold: 0.0
    INTEGRAL        Likelihood = -9.02      Transmembrane       7-23 (1-27)
    PERIPHERAL      Likelihood = 6.05       170
modified ALOM score: 2.30
icm1 HYPID: 7 CFP: 0.461
*** Reasoning Step: 3

----- Final Results -----
              bacterial membrane --- Certainty = 0.4609(Affirmative) < succ>
               bacterial outside --- Certainty = 0.0000(Not Clear)   < succ>
             bacterial cytoplasm --- Certainty = 0.0000(Not Clear)   < succ>
```

The protein has homology with the following sequences in the GENPEPT database.

```
>GP: AAF94581 GB: AE004221 spermidine/putrescine ABC transporter,
periplasmic spermidine/putrescine-binding protein [Vibrio cholerae]
Identities = 126/327 (38%), Positives = 196/327 (59%),
Gaps = 2/327 (0%)

Query:   42 SSSTPNSDKLVIYNWGDYIDPALLKKFTKETGIEVQYETFDSNEAMHTKIKQGGTTYDIA  101
            +++      +L  YNW +YI   +L+ FTKETGI+V Y T++SNE+M+ K+K  G  YD+
Sbjct:   18 TNAMAKDQELYFYNWSEYIPSEVLEDFTKETGIKVIYSTYESNESMYAKLKTQGAGYDLV   77

Query:  102 VPSDYMIDKMIKENLLVKLDHSKIANWDAIGARFKNLSFDPKNKYSIPYFWGTVGIVYN-  160
            VPS Y + KM KE +L ++DHSK+++++ +    +F N  FDP NK+SIPY WG  GI  N
Sbjct:   78 VPSTYFVSKMRKEGMLQEIDHSKLSHFKDLDPNYLNKPFDPGNKFSIPYIWGATGIGINT  137

Query:  161 DQLVKTPPKHWDDLWRPEFRNKIMLVDSAREVIGVGLNSLGYGLNTKNISELKAASKKLD  220
            D  L K    K+W DLW  ++  ++ML+D AREV  + L+ LGY  NT N  E+KAA ++L
Sbjct:  138 DMLDKKSLKNWGDLWDAKWAGQLMLMDDAREVFHIALSKLGYSPNTTNPKEIKAAYRELK  197

Query:  221 ALTPNVKAIVADEMKGYMIQGDAAIGVTFSGEAREMLDGNKHLHYVVPSEGSNLWFDNIV  280
             L PNV    +D       + G+ ++G+ ++G A        + + P +G+   W D+I
Sbjct:  198 KLMPNVLVFNSDFPANPYLAGEVSLGMLWNGSAYMARQEGAPIQIIWPEKGTIFWNDSIS  257

Query:  281 IPKTVKHRKEAYAFINFMMEPKNAAQNAEYIGYATPNLKAKALLPADIKNDKAFYPPDKT  340
            IP   K+ + A+   I+F++ P+NAA+ A  IGY TP   A   LLP +   ND  YPP
Sbjct:  258 IPAGAKNIEAAHKMIDFLLRPENAAKIALEIGYPTPVKTAHDLLPKEFANDPSIYPPQSV  317

Query:  341 IDHLEVYNNLGQKWLGIYNDLYLQFKM                                  367
            ID+ E    +G+  +  +Y++ + + K+
Sbjct:  318 IDNGEWQDEVGEASV-LYDEYFQKLKV                                  343
```

A related DNA sequence was identified in *S. pyogenes* <SEQ ID 5307> which encodes the amino acid sequence <SEQ ID 5308>. Analysis of this protein sequence reveals the following:

```
Possible site: 22
>>> Seems to have an uncleavable N-term signal seq
    INTEGRAL       Likelihood = -8.44     Transmembrane    8-24 (1-27)

----- Final Results -----
              bacterial membrane --- Certainty = 0.4376(Affirmative) < succ>
               bacterial outside --- Certainty = 0.0000(Not Clear) < succ>
             bacterial cytoplasm --- Certainty = 0.0000(Not Clear) < succ>
```

The protein has homology with the following sequences in the databases:

```
>GP: AAC74207 GB: AE000212 spermidine/putrescine periplasmic transport
protein [Escherichia coli]
Identities = 134/342 (39%), Positives = 199/342 (58%), Gaps = 3/342 (0%)

Query:   17 ILTSLSFILQKKSGSGSQSDKLVIYNWGDYIDPALLKKFTKETGIEVQYETFDSNEAMYT   76
            +L + +  L  +      ++ L  YNW +Y+ P LL++FTKETGI+V Y T++SNE MY
Sbjct:    8 LLAAGALALGMSAAHADDNNTLYFYNWTEYVPPGLLEQFTKETGIKVIYSTYESNETMYA   67

Query:   77 KIKQ-GGTTYDIAVPSDYTIDKMIKENLLNKLDKSKLVGMDNIGKEFLGKSFDPQNDYSL  135
            K+K     YD+ VPS Y +DKM KE ++ K+DKSKL     N+   + K FDP NDYS+
Sbjct:   68 KLKTYKDGAYDLVVPSTYYVDKMRKEGMIQKIDKSKLTFNSNLDPDMLNKPFDPNNDYSI  127

Query:  136 PYFWGTVGIVYNDQLVD-KAPMHWEDLWRPEYKNSIMLIDGAREMLGVGLTTFGYSVNSK  194
            PY WG+    +N   VD K+   W DLW+PEYK S++L D ARE+   L   GYS N+
Sbjct:  128 PYIWGATAIGVNGDAVDPKSVTSWADLWKPEYKGSLLLTDDAREVFQMALRKLGYSGNTT  187

Query:  195 NLEQLQAAERKLQQLTPNVKAIVADEMKGYMIQGDAAIGITFSGEASEMLDSNEHLHYIV  254
             + ++++AA  +L++L PNV A  +D       + G+  +G+ ++G A      +  +
Sbjct:  188 DPKEIEAAYNELKKLMPNVAAFNSDNPANPYMEGEVNLGMIWNGSAFVARQAGTPIDVVW  247

Query:  255 PSEGSNLWFDNLVLPKTMKHEKEAYAFLNFINRPENAAQNAAYIGYATPNKKAKALLPDE  314
            P EG   W D+L +P   K+++ A   +NF+ RP+ A Q A  IGY TPN  A+  LL  E
Sbjct:  248 PKEGGIFWMDSLAIPANAKNKEGALKLINFLLRPDVAKQVAETIGYPTPNLAARKLLSPE  307

Query:  315 IKNDPAFYPTDDIIKKLEVYDNLGSRWLGIYNDLYLQFKMYR                   356
             + ND  YP + IK E +++G+    IY + Y +  K  R
Sbjct:  308 VANDKTLYPDAETIKNGEWQNDVGAA-SSIYEEYYQKLKAGR                   348
```

An alignment of the GAS and GBS proteins is shown below.

```
Identities = 270/357 (75%), Positives = 306/357 (85%)

Query:   14 MRRVYSFLGGIVLVILILFGLTTYLEKKSSSTPNSDKLVIYNWGDYIDPALLKKFTKETG   73
            MR++YSFL G++ VI+IL  L+   L+KKS S    SDKLVIYNWGDYIDPALLKKFTKETG
Sbjct:    1 MRKLYSFLAGVLGVIVILTSLSFILQKKSGSGSQSDKLVIYNWGDYIDPALLKKFTKETG   60

Query:   74 IEVQYETFDSNEAMHTKIKQGGTTYDIAVPSDYMIDKMIKENLLVKLDHSKIANWDAIGA  133
            IEVQYETFDSNEAM+TKIKQGGTTYDIAVPSDY IDKMIKENLL KLD SK+    D IG
Sbjct:   61 IEVQYETFDSNEAMYTKIKQGGTTYDIAVPSDYTIDKMIKENLLNKLDKSKLVGMDNIGK  120

Query:  134 RFKNLSFDPKNKYSIPYFWGTVGIVYNDQLVKTPPKHWDDLWRPEFRNKIMLVDSAREVI  193
                F  SFDP+N YS+PYFWGTVGIVYNDQLV   P HW+DLWRPE++N IML+D ARE++
Sbjct:  121 EFLGKSFDPQNDYSLPYFWGTVGIVYNDQLVDKAPMHWEDLWRPEYKNSIMLIDGAREML  180

Query:  194 GVGLNSLGYGLNTKNISELKAASKKLDALTPNVKAIVADEMKGYMIQGDAAIGVTFSGEA  253
            GVGL + GY +N+KN+ +L+AA +KL   LTPNVKAIVADEMKGYMIQGDAAIG+TFSGEA
Sbjct:  181 GVGLTTFGYSVNSKNLEQLQAAERKLQQLTPNVKAIVADEMKGYMIQGDAAIGITFSGEA  240

Query:  254 REMLDGNKHLHYVVPSEGSNLWFDNIVIPKTVKHRKEAYAFINFMMEPKNAAQNAEYIGY  313
            EMLD N+HLHY+VPSEGSNLWFDN+V+PKT+KH KEAYAF+NF+  P+NAAQNA YIGY
Sbjct:  241 SEMLDSNEHLHYIVPSEGSNLWFDNLVLPKTMKHEKEAYAFLNFINRPENAAQNAAYIGY  300

Query:  314 ATPNLKAKALLPADIKNDKAFYPPDKTIDHLEVYNNLGQKWLGIYNDLYLQFKMYRK     370
            ATPN KAKALLP +IKND AFYP D  I   LEVY+NLG +WLGIYNDLYLQFKMYRK
Sbjct:  301 ATPNKKAKALLPDEIKNDPAFYPTDDIIKKLEVYDNLGSRWLGIYNDLYLQFKMYRK     357
```

SEQ ID 8882 (GBS135) was expressed in *E. coli* as a His-fusion product. SDS-PAGE analysis of total cell extract is shown in FIG. 35 (lane 6; MW 40 kDa).

GBS135-His was purified as shown in FIG. 201, lane 10.

Based on this analysis, it was predicted that these proteins and their epitopes could be useful antigens for vaccines or diagnostics.

EXAMPLE 1708

A DNA sequence (GBSx1812) was identified in *S. agalactiae* <SEQ ID 5309> which encodes the amino acid sequence <SEQ ID 5310>. This protein is predicted to be spermidine/putrescine ABC transporter, permease protein (potC). Analysis of this protein sequence reveals the following:

```
Possible site: 51
>>> Seems to have an uncleavable N-term signal seq
      INTEGRAL    Likelihood = -12.05    Transmembrane     17-33  (10-37)
      INTEGRAL    Likelihood =  -8.65    Transmembrane    236-252 (232-259)
      INTEGRAL    Likelihood =  -7.75    Transmembrane    137-153 (132-158)
      INTEGRAL    Likelihood =  -7.17    Transmembrane     63-79  (60-92)
      INTEGRAL    Likelihood =  -6.32    Transmembrane    108-124 (107-136)

----- Final Results -----
             bacterial membrane  --- Certainty = 0.5819(Affirmative) < succ>
             bacterial outside   --- Certainty = 0.0000(Not Clear)   < succ>
             bacterial cytoplasm --- Certainty = 0.0000(Not Clear)   < succ>
```

A related GBS nucleic acid sequence <SEQ ID 8883> which encodes amino acid sequence <SEQ ID 8884> was also identified. Analysis of this protein sequence reveals the following:

```
Lipop: Possible site: -1 Crend: 2
SRCFLG: 0
McG: Length of UR: 26
     Peak Value of UR: 3.65
     Net Charge of CR: 2
McG: Discrim Score: 16.58
GvH: Signal Score (-7.5): -6.17
     Possible site: 43
>>> Seems to have an uncleavable N-term signal seq
Amino Acid Composition: calculated from 1
```

```
                           -continued
ALOM program count: 4 value: -12.05 threshold: 0.0
   INTEGRAL      Likelihood = -12.05   Transmembrane    9-25 (2-29)
   INTEGRAL      Likelihood =  -7.75   Transmembrane  129-145 (124-150)
   INTEGRAL      Likelihood =  -7.17   Transmembrane   55-71 (52-84)
   INTEGRAL      Likelihood =  -6.32   Transmembrane  100-116 (99-128)
   PERIPHERAL    Likelihood =   0.53   174
modified ALOM score: 2.91
icm1 HYPID: 7 CFP: 0.582
*** Reasoning Step: 3

----- Final Results -----
                bacterial membrane --- Certainty = 0.5819(Affirmative) < succ>
                 bacterial outside --- Certainty = 0.0000(Not Clear)   < succ>
               bacterial cytoplasm --- Certainty = 0.0000(Not Clear)   < succ>
```

The protein has homology with the following sequences in the GENPEPT database.

```
>GP: AAB91527 GB: AE001165 spermidine/putrescine ABC transporter,
permease protein (potC) [Borrelia burgdorferi]
Identities = 97/249 (38%), Positives = 159/249 (62%), Gaps = 3/249 (1%)

Query:  10 KKFANIYLALVFIILYIPIIYLIFYSFNKGGDMNSFTGFTFSHYGELFQDSRLMLILVQT   69
             + F NI+L L+   +Y+PII LI YSFN G    + GF+   Y E+F  S++   +  T
Sbjct:   3 RAFKNIFLFLILSFIYLPIIILIIYSFNSGDSGFIWQGFSLKWYKEIFASSQIKSAIFNT   62

Query:  70 FFLAFLSALLATIIGTFGAIWIYQVRRRH-QTSILSLNNILLVAPDVMIGASFLLVFTVI  128
              +A +S+L + +IG  GA   IY+    +T +LS+N I ++ PD++ G S +  ++ I
Sbjct:  63 ILIAIISSLTSVVIGIIGAYAIYKSENKKLKTILLSVNKITIINPDIVTGISLMTFYSAI  122

Query: 129 GLQLGFTSVLLSHVAFSIPIVVLMVLPRLKEMNDDMINASYDLGASTWQMLKEVMLPYLS  188
             +QLGF+++L+SH+ FS P VV+++LP+L  +  ++I+A+ DLGAS  Q+   ++ P ++
Sbjct: 123 KMQLGFSTMLISHIIFSTPYVVIIILPKLYSLPKNIIDAAKDLGASEIQIFFNIIYPEIA  182

Query: 189 SGIISGFFMAFTYSLDDFAVTFFVTGNGFSTLSVEIYSRARRGISLEINALSTIVF--LF  246
             I  +G  +AFT S+DDF ++FF TG GF+ LS+ I S  +RGI    INA+S I+F   +
Sbjct: 183 GSIATGALIAFTLSIDDFLISFFTTGQGFNNLSILINSLTKRGIKPVINAISAILFFTIL  242

Query: 247 SILLVIGYY                                                     255
            S+L +I +
Sbjct: 243 SLLFIINKF                                                     251
```

A related DNA sequence was identified in *S. pyogenes* <SEQ ID 5311> which encodes the amino acid sequence <SEQ ID 5312>. Analysis of this protein sequence reveals the following:

```
Possible site: 49
>>> Seems to have an uncleavable N-term signal seq
      INTEGRAL      Likelihood = -8.17   Transmembrane    9-25 (4-29)
      INTEGRAL      Likelihood = -8.12   Transmembrane  228-244 (224-250)
      INTEGRAL      Likelihood = -7.91   Transmembrane  129-145 (124-150)
      INTEGRAL      Likelihood = -7.06   Transmembrane   62-78 (54-87)
      INTEGRAL      Likelihood = -3.93   Transmembrane  100-116 (99-118)

----- Final Results -----
                bacterial membrane --- Certainty = 0.4270(Affirmative) < succ>
                 bacterial outside --- Certainty = 0.0000(Not Clear)   < succ>
               bacterial cytoplasm --- Certainty = 0.0000(Not Clear)   < succ>
```

The protein has homology with the following sequences in the databases:

```
>GP: AAB91527 GB: AE001165 spermidine/putrescine ABC transporter,
permease protein (potC) [Borrelia burgdorferi]
Identities = 91/249 (36%), Positives = 154/249 (61%), Gaps = 3/249 (1%)

Query:   2 KKFANLYLASVFVLLYIPIFYLIFYSFNKGGDMNGFTGFTLEHYQTMFEDSRLMTILLQT   61
             + F N++L +   +Y+PI  LI YSFN G     + GF+L+ Y+ +F  S++ + + T
Sbjct:   3 RAFKNIFLFLILSFIYLPIIILIIYSFNSGDSGFIWQGFSLKWYKEIFASSQIKSAIFNT   62
```

```
-continued

Query:   62 FVLAFSSALLATIIGIFGAIFIHHVRGK-YQNAMLSANNVLMVSPDVMIGASFLILFTSL 120
            ++A  S+L + +IGI GA  I+    K  +  +LS N + +++PD++ G S +   ++++
Sbjct:   63 ILIAIISSLTSVVIGIIGAYAIYKSENKKLKTILLSVNKITIINPDIVTGISLMTFYSAI 122

Query:  121 KFQLGMSSVLLSHIAFSIPIVVLMVLPRLKEMNQDMVNAAYDLGANYFQMLKEVMLPYFT 180
               K  QLG S++L+SHI  FS P  VV+++LP+L  +  +++++AA DLGA+  Q+    ++ P
Sbjct:  123 KMQLGFSTMLISHIIFSTPYVVIIILPKLYSLPKNIIDAAKDLGASEIQIFFNIIYPEIA 182

Query:  181 PGIIAGYFMAFTYSLDDFAVTFFLTGNSVTTLSVEIYSRARQGISLDINALSTIVFF--F 238
                I  G  +AFT S+DDF ++FF  TG      LS+ I S  ++GI    INA+S I+FF
Sbjct:  183 GSIATGALIAFTLSIDDFLISFFTTGQGFNNLSILINSLTKRGIKPVINAISAILFFTIL 242

Query:  239 SILLVIGYY                                                    247
             S+L +I  +
Sbjct:  243 SLLFIINKF                                                    251
```

An alignment of the GAS and GBS proteins is shown below.

```
Identities = 196/258 (75%), Positives = 231/258 (88%)

Query:    9 MKKFANIYLALVFIILYIPIIYLIFYSFNKGGDMNSFTGFTFSHYGELFQDSRLMLILVQ  68
            MKKFAN+YLA VF++LYIPI YLIFYSFNKGGDMN FTGFT  HY  +F+DSRLM IL+Q
Sbjct:    1 MKKFANLYLASVFVLLYIPIFYLIFYSFNKGGDMNGFTGFTLEHYQTMFEDSRLMTILLQ  60

Query:   69 TFFLAFLSALLATIIGTFGAIWIYQVRRRHQTSILSLNNILLVAPDVMIGASFLLVFTVI 128
            TF LAF SALLATIIG FGAI+I+ VR ++Q ++LS NN+L+V+PDVMIGASFL++FT +
Sbjct:   61 TFVLAFSSALLATIIGIFGAIFIHHVRGKYQNAMLSANNVLMVSPDVMIGASFLILFTSL 120

Query:  129 GLQLGFTSVLLSHVAFSIPIVVLMVLPRLKEMNDDMINASYDLGASTWQMLKEVMLPYLS 188
               QLG +SVLLSH+AFSIPIVVLMVLPRLKEMN DM+NA+YDLGA+ +QMLKEVMLPY +
Sbjct:  121 KFQLGMSSVLLSHIAFSIPIVVLMVLPRLKEMNQDMVNAAYDLGANYFQMLKEVMLPYFT 180

Query:  189 SGIISGFFMAFTYSLDDFAVTFFVTGNGFSTLSVEIYSRARRGISLEINALSTIVFLFSI 248
                GII+G+FMAFTYSLDDFAVTFF+TGN   +TLSVEIYSRAR+GISL+INALSTIVF FSI
Sbjct:  181 PGIIAGYFMAFTYSLDDFAVTFFLTGNSVTTLSVEIYSRARQGISLDINALSTIVFFFSI 240

Query:  249 LLVIGYYYISKEKGEKNA                                          266
            LLVIGYYY+S++K EK+A
Sbjct:  241 LLVIGYYYMSQDKEEKHA                                          258
```

Based on this analysis, it was predicted that these proteins and their epitopes could be useful antigens for vaccines or diagnostics.

EXAMPLE 1709

A DNA sequence (GBSx1813) was identified in *S. agalactiae* <SEQ ID 5313> which encodes the amino acid sequence <SEQ ID 5314>. This protein is predicted to be spermidine/putrescine ABC transporter, permease protein (potB). Analysis of this protein sequence reveals the following:

```
Possible site: 35
>>> Seems to have a cleavable N-term signal seq.
    INTEGRAL      Likelihood = -9.55    Transmembrane    250-266 (244-269)
    INTEGRAL      Likelihood = -3.93    Transmembrane    148-164 (146-166)
    INTEGRAL      Likelihood = -3.35    Transmembrane     65-81  (64-85)
    INTEGRAL      Likelihood = -1.97    Transmembrane     96-112 (96-115)

----- Final Results -----
          bacterial membrane  --- Certainty = 0.4821(Affirmative) < succ>
           bacterial outside  --- Certainty = 0.0000(Not Clear)   < succ>
         bacterial cytoplasm  --- Certainty = 0.0000(Not Clear)   < succ>
```

A related GBS nucleic acid sequence <SEQ ID 9853> which encodes amino acid sequence <SEQ ID 9854> was also identified.

The protein has homology with the following sequences in the GENPEPT database.

```
>GP: AAC22990 GB: U32813 spermidine/putrescine ABC transporter,
permease protein (potB) [Haemophilus influenzae Rd]
Identities = 90/255 (35%), Positives = 153/255 (59%),
Gaps = 11/255 (4%)

Query:   21 AWLFLFVLAPVALIAWNSFFDINGH------FTLANYQTFFSSGTYLKMSFNSVLYAGIV    74
            +WL FVL P L+   SF    +G       T+ NY  F+   Y ++ +NS+   +GI
Sbjct:   18 SWLIFFVLIPNLLVLAVSFLTRDGSNFYAFPITIENYTNLFNP-LYAQVVWNSLSMSGIA    76

Query:   75 SFITLLISYPAAYLLTKL--KHKQLWLMLVILPTWINLLLKAYAFMGIFGQQGGINAFLT   132
            + I LLI YP A++++K+   K++ L L LV+LP W N L++ Y       G +G +N  L
Sbjct:   77 TIICLLIGYPFAFMMSKIHPKYRPLLLFLVVLPFWTNSLIRIYGMKVFLGVKGILNTMLI   136

Query:  133 FIGI--GPKQILFTDFSFLFVAAYIELPFMLLPIFNALDDIDQNLIYASDDLGANAWQTF   190
            +GI    P +IL T+ + +     Y+ LPFM+LP+++A++ +D   L+ A+ DLGAN +Q F
Sbjct:  137 DMGILSAPIRILNTEIAVIIGLVYLLLPFMILPLYSAIEKLDNRLLEAARDLGANTFQRF   196

Query:  191 QKVIFPLSLNGVRAGVQSVFIPSLSLFMLTRLIGGNRVITLGTAIEQHFLITQNKGMGST   250
            +VI PL++ G+ AG     V +P++ +F +   L+GG +V+ +G   I+   FLI++N   GS
Sbjct:  197 FRVILPLTMPGIIAGCLLVLLPAMGMFYVADLLGGAKVLLVGNVIKSEFLISRNWPFGSA   256

Query:  251 IGVLILVMVAIMWL                                                265
            + + L ++M   ++++
Sbjct:  257 VSIGLTVLMALLIFV                                                271
```

A related DNA sequence was identified in *S. pyogenes* <SEQ ID 5315> which encodes the amino acid sequence <SEQ ID 5316>. Analysis of this protein sequence reveals the following:

```
Possible site: 31
>>> Seems to have an uncleavable N-term signal seq
    INTEGRAL       Likelihood = -7.38      Transmembrane         19-35    (11-40)
    INTEGRAL       Likelihood = -6.79      Transmembrane        250-266  (245-268)
    INTEGRAL       Likelihood = -4.83      Transmembrane         65-81    (63-85)
    INTEGRAL       Likelihood = -1.97      Transmembrane         96-112   (96-115)
    INTEGRAL       Likelihood = -1.91      Transmembrane        148-164  (148-165)

----- Final Results -----
                bacterial membrane  --- Certainty = 0.3951(Affirmative) < succ>
                bacterial outside   --- Certainty = 0.0000(Not Clear)   < succ>
                bacterial cytoplasm --- Certainty = 0.0000(Not Clear)   < succ>
```

The protein has homology with the following sequences in the databases:

```
>GP: AAC22990 GB: U32813 spermidine/putrescine ABC transporter,
permease protein (potB) [Haemophilus influenzae Rd]
Identities = 91/262 (34%), Positives = 158/262 (59%), Gaps = 11/262 (4%)

Query:   20 FLWILFFVVAPVTLLFYKSFFDIEGR------VTLANYETFFSSWTYLRMSVNSILYAGI    73
            F W++FFV+ P L+   SF    +G        +T+ NY  F+   Y ++  NS+   +GI
Sbjct:   17 FSWLIFFVLIPNLLVLAVSFLTRDGSNFYAFPITIENYTNLFNP-LYAQVVWNSLSMSGI    75

Query:   74 ITLVTLLISYPTALFLTRL--KHKQLWLMLIILPTWVNLLLKAYAFMGIFGQQGGINSFL   131
            T++ LLI YP A  ++++   K++ L L L++LP W N L++ Y       G +G +N+ L
Sbjct:   76 ATIICLLIGYPFAFMMSKIHPKYRPLLLFLVVLPFWTNSLIRIYGMKVFLGVKGILNTML   135

Query:  132 TFMGI--GPQQILFTDFSFIFVASYIELPFMMLPIFNALDDIDHNVINASRDLGASEFQA   189
            + MGI    P +IL T+ + I    Y+ LPFM+LP+++A++ +D+ ++ A+RDLGA+  FQ
Sbjct:  136 IDMGILSAPIRILNTEIAVIIGLVYLLLPFMILPLYSAIEKLDNRLLEAARDLGANTFQR   195

Query:  190 FSKVIFPLSLNGVRAGVQSVFIPSLSLFMLTRLIGGNRVITLGTAIEQHFLTTQNWGMGS   249
            F  +VI PL++ G+ AG     V +P++ +F +    L+GG +V+ +G   I+   FL ++NW   GS
Sbjct:  196 FFRVILPLTMPGIIAGCLLVLLPAMGMFYVADLLGGAKVLLVGNVIKSEFLISRNWPFGS   255

Query:  250 TIGVVLILTMVAIMWLTKEKSK                                         271
            + + L + M   ++++      +K
Sbjct:  256 AVSIGLTVLMALLIFVYYRANK                                         277
```

An alignment of the GAS and GBS proteins is shown below.

```
Identities = 215/266 (80%), Positives = 239/266 (89%)

Query:    4 RRREMKKTSSLFSIPYMAWLFLFVLAPVALIAWNSFFDINGHFTLANYQTFFSSGTYLKM   63
            RR  MKKTSSLFSIPY W+  FV+APV L+ + SFFDI G  TLANY+TFFSS TYL+M
Sbjct:    4 RRSVMKKTSSLFSIPYFLWILFFVVAPVTLLFYKSFFDIEGRVTLANYETFFSSWTYLRM   63

Query:   64 SFNSVLYAGIVSFITLLISYPAAYLLTKLKHKQLWLMLVILPTWINLLLKAYAFMGIFGQ  123
            S NS+LYAGI++ +TLLISYP A  LT+LKHKQLWLML+ILPTW+NLLLKAYAFMGIFGQ
Sbjct:   64 SVNSILYAGIITLVTLLISYPTALFLTRLKHKQLWLMLIILPTWVNLLLKAYAFMGIFGQ  123

Query:  124 QGGINAFLTFIGIGPKQILFTDFSFLFVAAYIELPFMLLPIFNALDDIDQNLIYASDDLG  183
            QGGIN+FLTF+GIGP+QILFTDFSF+FVA+YIELPFM+LPIFNALDDID N+I AS DLG
Sbjct:  124 QGGINSFLTFMGIGPQQILFTDFSFIFVASYIELPFMMLPIFNALDDIDHNVINASRDLG  183

Query:  184 ANAWQTFQKVIFPLSLNGVRAGVQSVFIPSLSLFMLTRLIGGNRVITLGTAIEQHFLITQ  243
            A+ +Q F KVIFPLSLNGVRAGVQSVFIPSLSLFMLTRLIGGNRVITLGTAIEQHFL TQ
Sbjct:  184 ASEFQAFSKVIFPLSLNGVRAGVQSVFIPSLSLFMLTRLIGGNRVITLGTAIEQHFLTTQ  243

Query:  244 NKGMGSTIGVILILVMVAIMWLTKER                                   269
            N GMGSTIGV+LIL MVAIMWLTKE+
Sbjct:  244 NWGMGSTIGVVLILTMVAIMWLTKEK                                   269
```

Based on this analysis, it was predicted that these proteins and their epitopes could be useful antigens for vaccines or diagnostics.

EXAMPLE 1710

A DNA sequence (GBSx1814) was identified in *S. agalactiae* <SEQ ID 5317> which encodes the amino acid sequence <SEQ ID 5318>. This protein is predicted to be spermidine/putrescine ABC transporter, ATP-binding protein (potA). Analysis of this protein sequence reveals the following:

```
Possible site: 47
>>> Seems to have no N-terminal signal sequence

----- Final Results -----
            bacterial cytoplasm --- Certainty = 0.3031(Affirmative) < succ>
             bacterial membrane --- Certainty = 0.0000(Not Clear)   < succ>
              bacterial outside --- Certainty = 0.0000(Not Clear)   < succ>
```

The protein has homology with the following sequences in the GENPEPT database.

```
>GP: AAB91525 GB: AE001165 spermidine/putrescine ABC transporter,
ATP-binding protein (potA) [Borrelia burgdorferi]
Identities = 166/345 (48%), Positives = 240/345 (69%), Gaps = 1/345 (0%)

Query:    1 MTNPIIAFKNVSKVFEDSNTVVLKDINFELEEGKFYTLLGASGSGKSTILNIIAGLLEAS   60
            M N I+  KN+S  ++++    L +IN ++++ +F TLLG SG GK+T++  I+ G L
Sbjct:    1 MDNCILEIKNLSHYYDNNGNKTLDNINLKIKKNEFITLLGPSGCGKTTLIKILGGFLSQK   60

Query:   61 TGDIYLDGKRINDVPTNKRDVHTVFQNYALFPHMTVFENVAFPLKLKKMDKKEIQKRVQE  120
              G+IY   K I+    NKR+++TVFQNYALFPHM VF+N++F L++KK  K  I+++V+
Sbjct:   61 NGEIYFFSKEISKTSPNKREINTVFQNYALFPHMNVFDNISFGLRMKKTPKDIIKEKVKT  120

Query:  121 TLKMVRLEGFEKRAIQKLSGGQRQRVAIARAIINQPKVVLLDEPLSALDLKLRTEMQYEL  180
            +L ++ +  + R I +LSGGQ+QRVAIARA++ +PK++LLDEPLSALDLK+R EMQ EL
Sbjct:  121 SLSLIGMPKYAYRNINELSGGKQRVAIARAMVMEPKLLLLDEPLSALDLKMRQEMQKEL  180

Query:  181 RELQQRLGITFVFVTHDQEEALAMSDWIFVMNEGEIVQSGTPVDIYDEPINHFVATFIGE  240
            +++Q++LGITF++VTHDQEEAL MSD I VMNEG I+Q GTP +IY+EP   FVA FIGE
Sbjct:  181 KKIQRQLGITFIYVTHDQEEALTMSDRIVVMNEGIILQIGTPEEIYNEPKTKFVADFIGE  240

Query:  241 SNILSGKMIEDYLVEFNGKRFEAVDGGMRPNESVQVVIRPEDLQITLPDEGKLQVKVDTQ  300
            SNI  G   ++ +V   G  FE +D G    E+V +VIRPED+++    +G L   + +
Sbjct:  241 SNIFDGTYKKELVVSLLGHEFECLDKGFEAEEAVDLVIRPEDVKLLPKGKGHLSGTITSA  300

Query:  301 LFRGVHYEIIAYDDLGNEWMIHSTRKAIEGEVIGLDFTPEDIHIM                345
            +F+GVHYE+    N W++ STR   GE + +  P+DIH+M
Sbjct:  301 IFQGVHYEMTLEIQKTN-WIVQSTRLTKVGEEVDIFLEPDDIHVM                344
```

There is also homology to SEQ ID 1292 Based on this analysis, it was predicted that this protein and its epitopes, could be useful antigens for vaccines or diagnostics.

EXAMPLE 1711

A DNA sequence (GBSx1815) was identified in *S. agalactiae* <SEQ ID 5319> which encodes the amino acid sequence <SEQ ID 5320>. Analysis of this protein sequence reveals the following:

```
Possible site: 53
>>> Seems to have no N-terminal signal sequence

----- Final Results -----
            bacterial cytoplasm --- Certainty = 0.4990(Affirmative) < succ>
             bacterial membrane --- Certainty = 0.0000(Not Clear)   < succ>
              bacterial outside --- Certainty = 0.0000(Not Clear)   < succ>
```

The protein has homology with the following sequences in the GENPEPT database.

```
>GP: BAB06283 GB: AP001515 UDP-N-acetylenolpyruvoylglucosamine
reductase [Bacillus halodurans]
Identities = 119/286 (41%), Positives = 166/286 (57%), Gaps = 1/286 (0%)

Query:  13 DIRFDEPLKKYTYTKVGGPADYLAFPRNRLELSRIVKFANSQNIPWMVLGNASNIIVRDG   72
           ++R +E L  +T K+GGPAD    P +   L   +K         W V+G  SNI+V D
Sbjct:  15 EVRVNESLAHHTTWKIGGPADVFVIPNDIEGLKNTMKLIQETGCKWRVIGRGSNILVSDK   74

Query:  73 GIRGFVIMFDK-LSTVTVNGYVIEAEAGANLIETTRIARYHSLTGFEFACGIPGSVGGAV  131
           G+RG  I  DK L  + VNG  I   AG +++   +     L G EFA GIPGSVGGAV
Sbjct:  75 GLRGVTIKLDKGLDHLEVNGESITVGAGFPVVKLATVISRQGLAGLEFAAGIPGSVGGAV  134

Query: 132 FMNAGAYGGEIAHILLSAQVLTPQGELKTIEARNMQFGYRHSVIQESGDIVISAKFALKP  191
           FMNAGA+G +I+ IL  A VL P G L+ +    M F YR S++Q++  I + A F+L
Sbjct: 135 FMNAGAHGSDISQILTKAHVLFPDGTLRWLTNEEMAFSYRTSLLQKNDGICVEAIFSLTR  194

Query: 192 GDHLMITQEMDRLTYLRELKQPLEYPSCGSVFKRPPGHFAGQLISEAHLKGQRIGGVEVS  251
           GD   I +++ +    R    QP  +P+CGSVF+ P   +AGQLI +A LKG +IGG ++S
Sbjct: 195 GDKEDIKKKLQKNKDYRRDTQPWNHPTCGSVFRNPLPEYAGQLIEKAGLKGYQIGGAQIS  254

Query: 252 QKHAGFMVNIAEGSAQDYENLIEHVINTVESTSGVHLEPEVRIIGE               297
               HA F+VN  + A D   LI HV +T++     +++E EV +IGE
Sbjct: 255 TMHANFIVNTGDAKAADVLALIHHVKDTIQKQYQMNMETEVELIGE               300
```

A related DNA sequence was identified in *S. pyogenes* <SEQ ID 5321> which encodes the amino acid sequence <SEQ ID 5322>. Analysis of this protein sequence reveals the following:

```
Possible site: 47
>>> Seems to have no N-terminal signal sequence

----- Final Results -----
            bacterial cytoplasm --- Certainty = 0.4557(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below.

```
Identities = 229/292 (78%), Positives = 267/292 (91%)

Query:   8 ELEGLDIRFDEPLKKYTYTKVGGPADYLAFPRNRLELSRIVKFANSQNIPWMVLGNASNI   67
           EL G+DIR +EPLK YTYTKVGGPAD+LAFPRN  ELSRIV +AN +N+PW+VLGNASN+
Sbjct:   4 ELHGIDIRENEPLKHYTYTKVGGPADFLAFPRNHYELSRIVAYANKENMPWLVLGNASNL   63

Query:  68 IVRDGGIRGFVIMFDKLSTVTVNGYVIEAEAGANLIETTRIARYHSLTGFEFACGIPGSV  127
           IVRDGGIRGFVIMFDKL+ V +NGY +EAEAGANLIETT+IA++HSLTGFEFACGIPGS+
Sbjct:  64 IVRDGGIRGFVIMFDKLNAVHLNGYTLEAEAGANLIETTKIAKFHSLTGFEFACGIPGSI  123

Query: 128 GGAVFMNAGAYGGEIAHILLSAQVLTPQGELKTIEARNMQFGYRHSVIQESGDIVISAKF  187
           GGAVFMNAGAYGGEI+HI LSA+VLTP GE+KTI AR+M FGYRHS IQE+GDIVISAKF
Sbjct: 124 GGAVFMNAGAYGGEISHIFLSAKVLTPSGEIKTISARDMAFGYRHSAIQETGDIVISAKF  183
```

-continued

```
Query:  188 ALKPGDHLMITQEMDRLTYLRELKQPLEYPSCGSVFKRPPGHFAGQLISEAHLKGQRIGG  247
            ALKPG++   I+QEM+RL  +LR+LKQPLE+PSCGSVFKRPPGHFAGQLI EA+LKG RIGG
Sbjct:  184 ALKPGNYDTISQEMNRLNHLRQLKQPLEFPSCGSVFKRPPGHFAGQLIMEANLKGHRIGG  243

Query:  248 VEVSQKHAGFMVNIAEGSAQDYENLIEHVINTVESTSGVHLEPEVRIIGESL         299
            VEVS+KH GFM+N+A+G+A+DYE+LI +VI TVE+ SGV LEPEVRIIGE+L
Sbjct:  244 VEVSEKHTGFMINVADGTAKDYEDLIAYVIETVENHSGVRLEPEVRIIGENL         295
```

Based on this analysis, it was predicted that these proteins and their epitopes could be useful antigens for vaccines or diagnostics.

EXAMPLE 1712

A DNA sequence (GBSx1816) was identified in *S. agalactiae* <SEQ ID 5323> which encodes the amino acid sequence <SEQ ID 5324>. This protein is predicted to be 2-amino-4-hydroxy-6-hydroxymethyldihydropterin pyrophosphokinase/dihyd. Analysis of this protein sequence reveals the following:

```
Possible site: 47
>>> Seems to have no N-terminal signal sequence

----- Final Results -----
            bacterial cytoplasm --- Certainty = 0.1122(Affirmative) < succ>
            bacterial membrane  --- Certainty = 0.0000(Not Clear)   < succ>
            bacterial outside   --- Certainty = 0.0000(Not Clear)   < succ>
```

The protein has homology with the following sequences in the GENPEPT database.

```
>GP: BAB03814 GB: AP001507
2-amino-4-hydroxy-6-hydroxymethyldihydropteridine
pyrophosphokinase [Bacillus halodurans]
Identities = 64/146 (43%), Positives = 94/146 (63%)

Query:    5 YLSLGSNIGDRETFLKQALFSIDHLQKTKVAQISAIYETAAWGNTNQEDFFNICCQVETD   64
            Y++LGSNIGDR  FL++A+  +    K  V   S+IYET    G T+Q  F N+  +V T
Sbjct:    6 YIALGSNIGDRSRFLEEAIQQLAEHDKVTVTCCSSIYETDPVGYTDQSPFLNMVVEVSTS   65

Query:   65 LAPFELLDYCQEIEKCLKRVRHEHWGPRTIDIDILLFGNQVINQEDLVVPHPYMTKRAFV  124
            L   +LL+  Q+IE+   R RH  WGPRT+D+DILL+  +     E+L++PHP M +RAFV
Sbjct:   66 LPVEQLLEVTQKIERYCGRERHIRWGPRTLDLDILLYDQENREMENLIIPHPRMWERAFV  125

Query:  125 LVPLLEIAPQLSLPNGSKLEDYLEKL                                   150
            L+PL+E+ P +  P+G  +E  +L
Sbjct:  126 LIPLMELNPSIVAPSGKTIEQVVREL                                   151
```

A related DNA sequence was identified in *S. pyogenes* <SEQ ID 5325> which encodes the amino acid sequence <SEQ ID 5326>. Analysis of this protein sequence reveals the following:

```
Possible site: 45
>>> Seems to have no N-terminal signal sequence

----- Final Results -----
            bacterial cytoplasm --- Certainty = 0.0479 (Affirmative) < succ>
            bacterial membrane  --- Certainty = 0.0000 (Not Clear)   < succ>
            bacterial outside   --- Certainty = 0.0000 (Not Clear)   < succ>
```

An alignment of the GAS and GBS proteins is shown below.

```
Identities = 85/156 (54%), Positives = 111/156 (70%), Gaps = 1/156 (0%)

Query:    1 MTTVYLSLGSNIGDRETFLKQALFSIDHLQKTKVAQISAIYETAAWGNTNQEDFFNICCQ   60
```

```
                 MT VYLSLG+N+GDR  +L++AL ++   L  +T++    S+IYET AWG T Q DF N+ CQ
Sbjct:    1 MTIVYLSLGTNMGDRAAYLQKALEALADLPQTRLLAQSSIYETTAWGKTGQADFLNMACQ     60

Query:   61 VETDLAPFELLDYCQEIEKCLKRVRHEHWGPRTIDIDILLFGNQVINQEDLVVPHPYMTK    120
            ++T L   + L    Q IE+ L RVRHE WG RTIDIDILLFG +V + ++L VPHPYMT+
Sbjct:   61 LDTQLTAADFLKETQAIEQSLGRVRHEKWGSRTIDIDILLFGEEVYDTKELKVPHPYMTE    120

Query:  121 RAFVLVPLLEIAPQLSLPNGSK-LEDYLEKLNLGEV                             155
            RAFVL+PLLE+ P L LP    K L DYL  L+  ++
Sbjct:  121 RAFVLIPLLELQPDLKLPPNHKFLRDYLAALDQSDI                             156
```

Based on this analysis, it was predicted that these proteins and their epitopes could be useful antigens for vaccines or diagnostics.

EXAMPLE 1713

A DNA sequence (GBSx1817) was identified in *S. agalactiae* <SEQ ID 5327> which encodes the amino acid sequence <SEQ ID 5328>. Analysis of this protein sequence reveals the following:

```
Possible site: 44
>>> Seems to have no N-terminal signal sequence

----- Final Results -----
            bacterial cytoplasm --- Certainty = 0.2826 (Affirmative) < succ>
             bacterial membrane --- Certainty = 0.0000 (Not Clear)   < succ>
              bacterial outside --- Certainty = 0.0000 (Not Clear)   < succ>
```

A related DNA sequence was identified in *S. pyogenes* <SEQ ID 5329> which encodes the amino acid sequence <SEQ ID 5330>. Analysis of this protein sequence reveals the following:

```
Possible site: 50
>>> Seems to have no N-terminal signal sequence

----- Final Results -----
            bacterial cytoplasm --- Certainty = 0.3547 (Affirmative) < succ>
             bacterial membrane --- Certainty = 0.0000 (Not Clear)   < succ>
              bacterial outside --- Certainty = 0.0000 (Not Clear)   < succ>
```

An alignment of the GAS and GBS proteins is shown below.

```
Identities = 75/119 (63%), Positives = 92/119 (77%)

Query:    1 MDKIYLNKCRFYGYHGAFSEEQTLGQVFQVDAVLSLDLAKASQTDDLIDTVHYGEVFDCI     60
            MDKI L  CRFYGYHGAF EEQTLGQ+F VD  LS+DL  AS +D L DTVHYG VFD +
Sbjct:    1 MDKIVLEGCRFYGYHGAFKEEQTLGQIFLVDLELSVDLQAASLSDQLTDTVHYGMVFDSV     60

Query:   61 KNHVENEQYQLIEKLAGVIVEDIFLQFHPVQAITLKITKDNPPINGHYESVGIELERRR     119
            +  VE E++ LIE+LAG I E +F +F P++AI + I K+NPPI GHY++VGIELER+R
Sbjct:   61 RQLVEGEKFILIERLAGAICEQLFNEFPPIEAIKVAIKKENPPIAGHYKAVGIELERQR    119
```

Based on this analysis, it was predicted that these proteins and their epitopes could be useful antigens for vaccines or diagnostics.

EXAMPLE 1714

A DNA sequence (GBSx1818) was identified in *S. agalactiae* <SEQ ID 5331> which encodes the amino acid sequence <SEQ ID 5332>. Analysis of this protein sequence reveals the following:

```
Possible site: 26
>>> Seems to have an uncleavable N-term signal seq

----- Final Results -----
            bacterial membrane --- Certainty = 0.0000 (Not Clear) < succ>
            bacterial outside  --- Certainty = 0.0000 (Not Clear) < succ>
            bacterial cytoplasm --- Certainty = 0.0000 (Not Clear) < succ>
```

A related DNA sequence was identified in *S. pyogenes* <SEQ ID 5333> which encodes the amino acid sequence <SEQ ID 5334>. Analysis of this protein sequence reveals the following:

```
Possible site: 26
>>> Seems to have an uncleavable N-term signal seq

----- Final Results -----
            bacterial membrane --- Certainty = 0.0000 (Not Clear) < succ>
            bacterial outside  --- Certainty = 0.0000 (Not Clear) < succ>
            bacterial cytoplasm --- Certainty = 0.0000 (Not Clear) < succ>
```

An alignment of the GAS and GBS proteins is shown below.

```
Identities = 181/267 (67%), Positives = 224/267 (83%), Gaps = 1/267 (0%)

Query:   1 MKIGQYDITGKACIMGILNVTPDSFSDGGSYTTIDSALNQVGEMLEQGVAIVDIGGESTR   60
           MKIG++ I G A IMGILNVTPDSFSDGGSYTT+  AL+ V +M+  G  I+D+GGESTR
Sbjct:   1 MKIGKFVIEGNAAIMGILNVTPDSFSDGGSYTTVQKALDHVEQMIADGAKIIDVGGESTR   60

Query:  61 PGAVFVTAEEEIKRVVPMIKAIREVYPDLLLSIDTYKTEVAQAALDAGVHILNDVWSGLY  120
           PG  FV+A +EI RVVP+IKAI+E Y D+L+SIDTYKTE A+AAL+AG  ILNDVW+GLY
Sbjct:  61 PGCQFVSATDEIDRVVPVIKAIKENY-DILISIDTYKTETARAALEAGADILNDVWAGLY  119

Query: 121 DGKMLSLAAERNVPIILMHNQEEAVYQDIKKEVCEFLLERAERALEAGVSKDNIWIDPGF  180
           DG+M +LAAE + PIILMHNQ+E VYQ++ ++VC+FL  RA+ AL+AGV K+NIW+DPGF
Sbjct: 120 DGQMFALAAEYDAPIILMHNQDEEVYQEVTQDVCDFLGNRAQAALDAGVPKNNIWVDPGF  179

Query: 181 GFAKTEEQNLELLKGLEQVCDLGYPVLFGISRKRTVNYLLGGNREVTERDMGTAALSAWA  240
           GFAK+ +QN ELLKGL++VC LGYPVLFGISRKR V+ LLGGN +  ERD   TAALSA+A
Sbjct: 180 GFAKSVQQNTELLKGLDRVCQLGYPVLFGISRKRVVDALLGGNTKAKERDGATAALSAYA  239

Query: 241 IAKGCQIVRVHNVEVNKDIVTVISQLV                                  267
           + KGCQIVRVH+V+ N+DIV V+SQL+
Sbjct: 240 LGKGCQIVRVHDVKANQDIVAVLSQLM                                  266
```

Based on this analysis, it was predicted that these proteins and their epitopes could be useful antigens for vaccines or diagnostics.

EXAMPLE 1715

A DNA sequence (GBSx1819) was identified in *S. agalactiae* <SEQ ID 5335> which encodes the amino acid sequence <SEQ ID 5336>. Analysis of this protein sequence reveals the following:

```
Possible site: 19
>>> Seems to have no N-terminal signal sequence

----- Final Results -----
            bacterial cytoplasm --- Certainty = 0.2429(Affirmative) < succ>
            bacterial membrane  --- Certainty = 0.0000(Not Clear)   < succ>
            bacterial outside   --- Certainty = 0.0000(Not Clear)   < succ>
```

A related DNA sequence was identified in *S. pyogenes* <SEQ ID 5337> which encodes the amino acid sequence <SEQ ID 5338>. Analysis of this protein sequence reveals the following:

```
Possible site: 32
>>> Seems to have no N-terminal signal sequence

----- Final Results -----
            bacterial cytoplasm --- Certainty = 0.1590(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below.

```
Identities = 151/184 (82%), Positives = 166/184 (90%)

Query:    3 NQEKMEKAIYQFLEALGENPNREGLKDTPKRVAKMYIEMFSGLNQDPKEQFTAVFSENHE   62
            N+EK E AIYQFLEA+GENPNREGL DTPKRVAKMY EMF GL +DPKE+FTAVF E HE
Sbjct:   16 NKEKAEAAIYQFLEAIGENPNREGLLDTPKRVAKMYAEMFLGLGKDPKEEFTAVFKEQHE   75

Query:   63 EVVIVKDIPFYSMCEHHLVPFYGKAHIAYLPNDGRVTGLSKLARAVEVASKRPQLQERLT  122
            +VVIVKDI FYS+CEHHLVPFYGKAHIAYLP+DGRVTGLSKLARAVEVASKRPQLQERLT
Sbjct:   76 DVVIVKDISFYSICEHHLVPFYGKAHIAYLPSDGRVTGLSKLARAVEVASKRPQLQERLT  135

Query:  123 AQVAQALEDALAPKGIFVMIEAEHMCMTMRGIKKPGSKTITTVARGLYKDDRYERQEILS  182
            +Q+A AL +AL PKG VM+EAEHMCMTMRGIKKPGSKTITT ARGLYK+ R ERQE++S
Sbjct:  136 SQIADALVEALNPKGTLVMVEAEHMCMTMRGIKKPGSKTITTTARGLYKESRAERQEVIS  195

Query:  183 LIQK                                                          186
            L+ K
Sbjct:  196 LMTK                                                          199
```

Based on this analysis, it was predicted that these proteins and their epitopes could be useful antigens for vaccines or diagnostics.

EXAMPLE 1716

A DNA sequence (GBSx1820) was identified in *S. agalactiae* <SEQ ID 5339> which encodes the amino acid sequence <SEQ ID 5340>. This protein is predicted to be folylpolyglutamate synthase (folC). Analysis of this protein sequence reveals the following:

```
Possible site: 17
>>> Seems to have no N-terminal signal sequence

----- Final Results -----
            bacterial cytoplasm --- Certainty = 0.2836 (Affirmative) < succ>
             bacterial membrane --- Certainty = 0.0000 (Not Clear)   < succ>
              bacterial outside --- Certainty = 0.0000 (Not Clear)   < succ>
```

A related GBS nucleic acid sequence <SEQ ID 9855> which encodes amino acid sequence <SEQ ID 9856> was also identified.

The protein has homology with the following sequences in the GENPEPT database.

```
>GP: CAB14768 GB: Z99118 folyl-polyglutamate synthetase [Bacillus subtilis]
Identities = 154/426 (36%), Positives = 245/426 (57%), Gaps = 17/426 (3%)

Query:    3 YQEALEWIHSKLAFGIKPGLERMRWMLEQLGNPQNNLSAIHVVGTNGKGSTTSYLQHIFT   62
            YQ+A  WIH +L FG+KPGL RM+ ++ +LG+P+  + A HV GTNGKGST ++++ +
Sbjct:    5 YQDARSWIHGRLKFGVKPGLGRMKQLMARLGHPEKKIRAFHVAGTNGKGSTVAFIRSMLQ   64

Query:   63 NSGYQVGTFTSPYIVDFRERISIDGQMIPESDFIKLVETVRPVVERLHLETNLEPATEFE  122
            +GY VGTFTSPYI+ F ERIS++G  I + ++  LV   ++P VE L  +T     TEFE
Sbjct:   65 EAGYTVGTFTSPYIITFNERISVNGIPISDEEWTALVNQMKPHVEALD-QTEYGQPTEFE  123
```

-continued
```
Query:  123 VITVLMFYYFGNSCPVDIVIIEAGMGGYYDSTNMFKALAVTCPSIGLDHQEVLGRTYVDI  182
            ++T   F YF      VD VI E G+GG +DSTN+ + L     SIG DH  +LG T  +I
Sbjct:  124 IMTACAFLYFAEFHKVDFVIFETGLGGRFDSTNVVEPLLTVITSIGHDHMNILGNTIEEI  183

Query:  183 AEQKVGVLKKGVPFVYANDRQDVEEVFQIKAKETHSQTYRLHNDFYIKEEE-----NYFN  237
            A +K G++K+G+P V A  + +  +V + +A+   +    LH+   I  EE       F+
Sbjct:  184 AGEKAGIIKEGIPIVTAVTQPEALQVIRHEAERHAAPFQSLHDACVIFNEEALPAGEQFS  243

Query:  238 YIGPQANIDHIQLQMPGHHQVSNASIAI-TTSLLLRDKYPKLTLQTIKDGLEMTKWVGRT  296
              +   +  + I+  + G HQ  NA+++I     L ++      ++ + ++ GL     W GR
Sbjct:  244 FKTEEKCYEDIRTSLIGTHQRQNAALSILAAEWLNKENIAHISDEALRSGLVKAAWPGRL  303

Query:  297 ELI--FPNVMIDGAHNNESVDALVQVIK-KYQQKNVHILFAAINTKPIESMLESLSSIA-  352
            EL+     P V +DGAHN E V+ L + +K  ++       + ++F+A+   KP ++M++L  +IA
Sbjct:  304 ELVQEHPPVYLDGAHNEEGVEKLAETMKQRFANSRISVVFSALKDKPYQNMIKRLETIAH  363

Query:  353 PVSVTSFDYPK-SINLDKYPKAYTRVSDWKKWLHDI-----NLTSDKDFYVITGSLYFIS  406
               +      SFD+P+ S+  D Y  +        W +   D+   +        +ITGSLYFIS
Sbjct:  364 AIHFASFDFPRASLAKDLYDASEISNKSWSEDPDDVIKFIESKKGSNEIVLITGSLYFIS  423

Query:  407 QVRQEL                                                        412
            +R+ L
Sbjct:  424 DIRKRL                                                        429
```

A related DNA sequence was identified in *S. pyogenes* <SEQ ID 5341> which encodes the amino acid sequence <SEQ ID 5342>. Analysis of this protein sequence reveals the following:

```
Possible site: 26
>>> Seems to have an uncleavable N-term signal seq
INTEGRAL    Likelihood = -1.28         Transmembrane      12-28 (12-28)

----- Final Results -----
            bacterial membrane --- Certainty = 0.1510 (Affirmative) < succ>
            bacterial outside  --- Certainty = 0.0000 (Not Clear)  < succ>
            bacterial cytoplasm --- Certainty = 0.0000 (Not Clear)  < succ>
```

An alignment of the GAS and GBS proteins is shown below.

```
Identities = 230/411 (55%), Positives = 295/411 (70%), Gaps = 1/411 (0%)

Query:    1 MTYQEALEWIHSKLAFGIKPGLERMRWMLEQLGNPQNNLSAIHVVGTNGKGSTTSYLQHI   60
            MTY+E LEWIH  L FGIKPGL+RM W+L QLGNPQ N+  +H+VGTNGKGST ++LQHI
Sbjct:   34 MTYEETLEWIHDHLVFGIKPGLKRMLWVLGQLGNPQKNVKGVHIVGTNGKGSTVNHLQHI   93

Query:   61 FTNSGYQVGTFTSPYIVDFRERISIDGQMIPESDFIKLVETVRPVVERLHLETNLEPATE  120
            FT +GY+VGTFTSPYI+DF+ERISI+G+MI  E D +    +RP+ ERL  ET+     TE
Sbjct:   94 FTTAGYEVGTFTSPYIMDFKERISINGRMISEKDLVIAANRIRPLTERLVQETDFGEVTE  153

Query:  121 FEVITVLMFYYFGNSCPVDIVIIEAGMGGYYDSTNMFKALAVTCPSIGLDHQEVLGRTYV  180
            FEVIT++MF YFG+   PVDI IIEAG+GG YDSTN+F+A+ V CPSIGLDHQ +LG TY
Sbjct:  154 FEVITLIMFLYFGDMHPVDIAIIEAGLGGLYDSTNVFQAMVVVCPSIGLDHQAILGETYA  213

Query:  181 DIAEQKVGVLKKGVPFVYANDRQDVEEVFQIKAKETHSQTYRLHNDFYIKEEEENYFNIG  240
             +IA QK GVL+  G    V+A +        EVF   KA++   +         F + E   + + +
Sbjct:  214 NIAAQKAGVLEGGETLVFAVENPSAREVFLTKAEQVGASIWEWQEQFQMAENASGYRFTS  273

Query:  241 PQANIDHIQLQMPGHHQVSNASIAITTSLLLRDKYPKLTLQTIKDGLEMTKWVGRTELIF  300
               P    I    I  + MPGHHQVSNA++AI  T L  L+D+YP+LT    I++GL   + W+GRTEL+
Sbjct:  274 PLGVISDIHIAMPGHHQVSNAALAIMTCLTLQDRYPRLTPDHIREGLANSLWLGRTELLA  333

Query:  301 PNVMIDGAHNNESVDALVQVIK-KYQQKNVHILFAAINTKPIESMLESLSSIAPVSVTSF  359
            PN+MIDGAHNNESV ALV V+K    Y  K +HILF AI+TKPI   ML +L   I    + VTSF
Sbjct:  334 PNLMIDGAHNNESVAALVAVLKNNYNDKKLHILFGAIDTKPIADMLVALEQIGDLQVTSF  393

Query:  360 DYPKSINLDKYPKAYTRVSDWKKWLHDINLTSDKDFYVITGSLYFISQVRQ           410
                YP +   L+KYP+ + RV+D+K  +L          DF+VITGSLYFIS++RQ
Sbjct:  394 HYPNAYPLEKYPERFGRVADFKDFLALRKHAKADDFFVITGSLYFISEIRQ           444
```

Based on this analysis, it was predicted that these proteins and their epitopes could be useful antigens for vaccines or diagnostics.

EXAMPLE 1717

A DNA sequence (GBSx1821) was identified in *S. agalactiae* <SEQ ID 5343> which encodes the amino acid sequence <SEQ ID 5344>. This protein is predicted to be rarD. Analysis of this protein sequence reveals the following:

```
Possible site: 38
>>> Seems to have a cleavable N-term signal seq.
INTEGRAL    Likelihood = -12.31    Transmembrane    130-146 (125-151)
INTEGRAL    Likelihood = -10.24    Transmembrane    269-285 (262-291)
INTEGRAL    Likelihood =  -7.75    Transmembrane    212-228 (207-233)
INTEGRAL    Likelihood =  -5.52    Transmembrane     80-96  (75-99)
INTEGRAL    Likelihood =  -4.14    Transmembrane    106-122 (104-125)
INTEGRAL    Likelihood =  -3.50    Transmembrane    182-198 (180-204)
INTEGRAL    Likelihood =  -2.44    Transmembrane     40-56  (39-57)
INTEGRAL    Likelihood =  -0.96    Transmembrane    153-169 (152-169)
INTEGRAL    Likelihood =  -0.32    Transmembrane    251-267 (250-267)

----- Final Results -----
            bacterial membrane --- Certainty = 0.5925 (Affirmative) < succ>
             bacterial outside --- Certainty = 0.0000 (Not Clear)  < succ>
           bacterial cytoplasm --- Certainty = 0.0000 (Not Clear)  < succ>
```

The protein has homology with the following sequences in the GENPEPT database.

```
>GP: BAB07585 GB: AP001520 unknown conserved protein [Bacillus halodurans]
Identities = 109/288 (37%), Positives = 185/288 (63%), Gaps = 6/288 (2%)

Query:   7 GIILGLSAYVLWGLLSLYWKLLSGIEAYSTFAYRIIFTVLTMLIYMLVSGRKTVYLKDLK    66
           G+I  +SAY++WG L LYWKL+  + A    A+RI++++  M+ I  V +     ++++
Sbjct:   8 GVIAAISAYLIWGFLPLYWKLVDEVPASEMLAHRIVWSLGFMVILLAVMKKNRQVMREIL    67

Query:  67 GLVNNKKSFWTMFVASILISINWLVYIFAVTHGHATEASLGYYMMPIISILLSVLVLREH   126
             + NKK+ + + VA+ILIS+NW ++I+AV+        EASLGYY+ P+I++LL+++ LRE
Sbjct:  68 DTLANKKTAFGITVAAILISMNWFIFIYAVSSDKVIEASLGYYINPLINVLLAIVFLRES   127

Query: 127 LARVVSLAILIAIMGVGILVYQTGHFPLISLTLALSFGFYGLLKKSISLSSDFSMLVESS   186
           L++    + L+A  GV +     G FP ++    LA+SFG YGL+KK +SLS+    S+ +E+
Sbjct: 128 LSKWEVASFLLAAAGVLNITLHYGSFPWVAFALAISFGVYGLIKKVVSLSAWASLTIETL   187

Query: 187 FIAPFALIYIVFF----AKDFLTDYNILQLVLLSLSGIITAVPLLLFAEAIKRAPLNII   241
            + PFAL+++++       A  F ++ +    L+ SG TA+PLLLFA   KR    ++I
Sbjct: 188 IMTPFALLFLLYIPLSGGASAFSLNH-LSTAWLIIASGAATALPLLLFATGAKRISFSLI   246

Query: 242 GFIQYINPTIQLLLALFIFKETIVSGEVIGFIFIWLAILVFSIGQVHT              289
           GF+QY+  PTI L+L +F+F+E    + + F+ IW  +++F+I +  T
Sbjct: 247 GFLQYLAPTIMLMLGVFLFQEPFSRVQFVSFLLIWTGLIIFTISRSRT              294
```

No corresponding DNA sequence was identified in *S. pyogenes*.

A related GBS gene <SEQ ID 8885> and protein <SEQ ID 8886> were also identified. Analysis of this protein sequence reveals the following:

```
Lipop: Possible site: -1 Crend: 3
McG: Discrim Score: 5.30
GvH: Signal Score (-7.5): -1.64
Possible site: 38
>>> Seems to have a cleavable N-term signal seq.
ALOM program        count: 9      value: -12.31        threshold: 0.0
INTEGRAL            Likelihood = -12.31   Transmembrane    130-146 (125-151)
INTEGRAL            Likelihood = -10.24   Transmembrane    269-285 (262-291)
INTEGRAL            Likelihood =  -7.75   Transmembrane    212-228 (207-233)
INTEGRAL            Likelihood =  -5.52   Transmembrane     80-96  (75-99)
INTEGRAL            Likelihood =  -4.14   Transmembrane    106-122 (104-125)
INTEGRAL            Likelihood =  -3.50   Transmembrane    182-198 (180-204)
INTEGRAL            Likelihood =  -2.44   Transmembrane     40-56  (39-57)
INTEGRAL            Likelihood =  -0.96   Transmembrane    153-169 (152-169)
INTEGRAL            Likelihood =  -0.32   Transmembrane    251-267 (250-267)
PERIPHERAL          Likelihood =   7.96                    229
modified ALOM score: 2.96
```

```
*** Reasoning Step: 3

----- Final Results -----
           bacterial membrane --- Certainty = 0.5925 (Affirmative) < succ>
           bacterial outside  --- Certainty = 0.0000 (Not Clear)   < succ>
           bacterial cytoplasm --- Certainty = 0.0000 (Not Clear)  < succ>
```

The protein has homology with the following sequences in the databases:

```
ORF02052 (319-1152 of 1485)
GP|965601|gb|AAF93371.1||AE004110 (13-289 of 302) rarD protein {Vibrio cholerae}
% Match = 20.4
% Identity = 37.7   % Similarity = 66.3
Matches = 104   Mismatches = 89   Conservative Sub.s = 79
117         147         177         207         237         267         297         327
KDIVNLW*RNLK**NKSALKMVRMLLICLEQDRR*WFCVRKKKNKQLSQS*VNYV*VDRFKCLILSEKE*ELRKDNLGII
                                                                              ||:
                                                                  MFMTPDQQDAKKGIL
                                                                              10
357         387         417         441         471         501         531         561
LGLSAYVLWGLLSLYWKLLSGIEAYSTFAYRII--FTVLTMLIYMLVSGRKTVYLKDLKGLVNNKKSFWTMFVASILISI
|:|||  :||:   :|:|    :  |    :::::    |:| :||::       |     |:|:   :  ||  ::|:
LAISAYTMWGIAPIYFKALGAVSALEILSHRVVWSFVLLAVLIHLGRRWRSVV------GVVHTPRKFWLLLVTALLVGG
       30          40          50          60                70          80
591         621         651         681         711         741         771         801
NWLVYIFAVTHGHATEASLGYYMMPIISILLSVLVLREHLARVVSLAILIAIMGVGILVYQTGHFPLISLTLALSFGFYG
|||:|::::    :|||||||:|:::||  |   |    |  |    :: :|   :   |  |||:|  :||::|||||
NWLIFIWSINANHMLDASLGYYINPLLNVLLGMLFLGERLRKLQWFAVALAAIGVGIQLVVFGSVPIVAIALATSFGFYG
      100         110         120         130         140         150         160
831         861         891         921         942         972         1002        1032
LLKKSISLSSDFSMLVESSFIAPFALIYIVFFAKDFLTDY--NILQL-VLLSLSGIITAVPLLLFAEAIKRAPLNIIGFI
||:|   | :     :::|:  |   ||   ||||||::|        :|   |  ||   :|||   :|||      |   |::||
LLRKKIQVDAQTGLFLETLFMLPAAAIYLIWLADTPTSDMALNTWQLNLLLVCAGVVTTLPLLCFTGAAARLKLSTLGFF
      180         190         200         210         220         230         240
1062        1092        1122        1152        1182        1212        1242        1272
QYINPTIQLLLLALFIFKETIVSGEVIGFIFIWLAILVFSIGQVHTMLKKGK*DDLSRSARMDS**ISFWY*TRFGTYEMD
|||  |::  :|||:::: |    |  |  |  |  |  | |:::||:
QYIGPSLMFLLAVLVYGEAFTSDKAITFAFIWSALVIFSVDGLKAGHAARRAR
      260         270         280         290         300
```

Based on this analysis, it was predicted that these proteins and their epitopes could be useful antigens for vaccines or diagnostics.

EXAMPLE 1718

A DNA sequence (GBSx1822) was identified in S. agalactiae <SEQ ID 5345> which encodes the amino acid sequence <SEQ ID 5346>. Analysis of this protein sequence reveals the following:

```
Possible site: 34
>>> Seems to have no N-terminal signal sequence

----- Final Results -----
           bacterial cytoplasm --- Certainty = 0.5200 (Affirmative) < succ>
           bacterial membrane  --- Certainty = 0.0000 (Not Clear)   < succ>
           bacterial outside   --- Certainty = 0.0000 (Not Clear)   < succ>
```

The protein has no significant homology with any sequences in the GENPEPT database.

No corresponding DNA sequence was identified in S. pyogenes.

Based on this analysis, it was predicted that this protein and its epitopes, could be useful antigens for vaccines or diagnostics.

EXAMPLE 1719

A DNA sequence (GBSx1823) was identified in *S. agalactiae* <SEQ ID 5347> which encodes the amino acid sequence <SEQ ID 5348>. Analysis of this protein sequence reveals the following:

```
Possible site: 20
>>> Seems to have no N-terminal signal sequence

----- Final Results -----
            bacterial cytoplasm --- Certainty = 0.0881(Affirmative) < succ>
             bacterial membrane --- Certainty = 0.0000(Not Clear)   < succ>
              bacterial outside --- Certainty = 0.0000(Not Clear)   < succ>
```

The protein has homology with the following sequences in the GENPEPT database.

```
>GP: AAC44297 GB: U41735 homoserine kinase homolog [Streptococcus
pneumoniae]
Identities = 188/289 (65%), positives = 232/289 (80%), Gaps = 1/289 (0%)

Query:    1 MRIIVPATSANIGPGFDSIGVALSKYLIIEVLEESTEWLVEHNLVN-IPKDHTNLLIQTA   59
            M+IIVPATSANIGPGFDS+GVA++KYL IEV EE  EWL+EH +   IP D  NLL+  A
Sbjct:    1 MKIIVPATSANIGPGFDSVGVAVTKYLQIEVSEERDEWLIEHQIGKWIPHDERNLLLTIA   60

Query:   60 LHVKSDLAPHRLKMFSDIPLARGLGSSSSVIVAGIELANQLGNLALSQKEKLEIATRLEG  119
            L +  DL P RLKM SD+PLARGLGSSSSVIVAGIELANQLG L LS   EKL++AT++EG
Sbjct:   61 LQIVPDLQPRRLKMTSDVPLARGLGSSSSVIVAGIELANQLGQLNLSDHEKLQLATKIEG  120

Query:  120 HPDNVAPAIFGDLVISSIVKNDIKSLEVMFPDSSFIAFIPNYELKTSDSRNVLPQKLSYE  179
            HPDNVAPAI+G+LVI+S V+  + ++    FP+   F+A+IPNYEL+T DSR+VLP+KLSY+
Sbjct:  121 HPDNVAPAIYGNLVIASSVEGQVSAIVADFPECDFLAYIPNYELRTRDSRSVLPKKLSYK  180

Query:  180 DAVASSSVANVMVASLLKGDLVTAGWAIERDLFHERYRQPLVKEFEVIKQISTQNGAYAT  239
            +AVA+SS+ANV VA+LL GD+VTAG AIE DLFHERYRQ LV+EF +IKQ++ +NGAYAT
Sbjct:  181 EAVAASSIANVAVAALLAGDMVTAGQAIEGDLFHERYRQDLVREFAMIKQVTKENGAYAT  240

Query:  240 YLSGAGPTVMVLCSKEKEQAIVTELSKLCLGGQIQVLNIERKGVRVEKR             288
            YLSGAGPTVMVL S +K    I  EL K     G++   L ++ +GVRVE +
Sbjct:  241 YLSGAGPTVMVLASHDKMPTIKAELEKQPFKGKLHDLRVDTQGVRVEAK             289
```

No corresponding DNA sequence was identified in *S. pyogenes*.

Based on this analysis, it was predicted that this protein and its epitopes, could be useful antigens for vaccines or diagnostics.

EXAMPLE 1720

A DNA sequence (GBSx1824) was identified in *S. agalactiae* <SEQ ID 5349> which encodes the amino acid sequence <SEQ ID 5350>. This protein is predicted to be homoserine dehydrogenase (hom). Analysis of this protein sequence reveals the following:

```
Possible site: 30
>>> Seems to have no N-terminal signal sequence

----- Final Results -----
             bacterial membrane --- Certainty = 0.0000(Not Clear) < succ>
              bacterial outside --- Certainty = 0.0000(Not Clear) < succ>
            bacterial cytoplasm --- Certainty = 0.0000(Not Clear) < succ>
```

A related GBS nucleic acid sequence <SEQ ID 9857> which encodes amino acid sequence <SEQ ID 9858> was also identified.

The protein has homology with the following sequences in the GENPEPT database.

```
>GP: CAA65713 GB: X96988 hom [Lactococcus lactis]
Identities = 221/432 (51%), Positives = 307/432 (70%), Gaps = 11/432 (2%)
```

-continued

```
Query:   15 MTIKIALLGFGTVAKGIPYLLKENQHKLLSLEGEDIVIDKVLVRDNESRQRFINQGFTYN   74
            M + IA+LGFGTV  G+P LL EN+ KL  +  E+IVI KVL+RDN++ ++  +QGF Y+
Sbjct:    1 MAVNIAILGFGTVGTGLPTLLSENKEKLAKILDEEIVISKVLMRDNKAIEKARSQGFNYD   60

Query:   75 FVTEINTILQDSQIDIVVELMGGIEPAKTYLSQALGFGKHIVTANKDLIALHGKELMDLA  134
            FV  ++ IL DS+I IVVELMG IEPAKTY++QA+  GK++VTANKDL+A+HG EL   LA
Sbjct:   61 FVLNLDDILADSEISIVVELMGRIEPAKTYITQAIEAGKNVVTANKDLLAVHGVELRSLA  120

Query:  135 DARGLALFYEGAVAGGIPILRTLSHSFASDKMTRLLGILNGTSNFMLTKMFEEGWSYEQA  194
              +AL+YE AVAGGIPILRTL++SF+SDK+T LLGILNGTSNFM+TKM EEGW+Y+++
Sbjct:  121 QKHHVALYYEAAVAGGIPILRTLANSFSSDKITHLLGILNGTSNFMMTKMSEEGWTYDES  180

Query:  195 LKKAQELGYAESDPTNDVEGIDTAYKATILSQFGFGMPIDFDDVNYKGISSIRSEDVEVA  254
            L KAQELGYAESDPTNDV+GID +YK   ILS+F FGM +  DD+   G+ SI+  DVE+A
Sbjct:  181 LAKAQELGYAESDPTNDVDGIDASYKLAILSEFAFGMTLAPDDIAKSGLRSIQKTDVEIA  240

Query:  255 QEMGFAIKLVADLRETPTGISVDVSPTLISQKHPLAAVNHVMNAVFIESIGIGQSLFYGP  314
            Q+ G+ +KL  ++ E  +GI  +VSPT + + HPLA+VN VMNAVFIES GIG S+FYG
Sbjct:  241 QQFGYVLKLTGEINEVDSGIFAEVSPTFLPKSHPLASVNGVMNAVFIESEGIGDSVFYGA  300

Query:  315 GAGQNPTATSVLADIIDISRSIRSQIKIKPMNTYHCPCRLSMQSDIFNEYYLAISLRNAE  374
            GAGQ PTATSVLADI+ I + ++     K  N Y    L+   DI N+YY ++     E
Sbjct:  301 GAGQKPTATSVLADIVRIVKRVKDGTIGKSFNEYARSTSLANPHDIENKYYFSV-----E  355

Query:  375 DSDTLGR------YFEQENIGLKNVIEKALGDKQQEIYVLTDEVSQEKITQFIEEFPESG  428
            D+ G+        F  EN+  + V+++    K+  + +++ ++++ +++   ++  +
Sbjct:  356 TPDSTGQLLLLVELFTSENVSFEQVLQQKGNGKRAVVVIISHKINRVQLSAIQDKLNQEK  415

Query:  429 VIQLINVFKVIG                                                 440
            +L+N FKV+G
Sbjct:  416 DFKLLNRFKVLG                                                 427
```

No corresponding DNA sequence was identified in *S. pyogenes*.

Based on this analysis, it was predicted that this protein and its epitopes, could be useful antigens for vaccines or diagnostics.

EXAMPLE 1721

A DNA sequence (GBSx1825) was identified in *S. agalactiae* <SEQ ID 5351> which encodes the amino acid sequence <SEQ ID 5352>. Analysis of this protein sequence reveals the following:

```
Possible site: 21
>>> Seems to have no N-terminal signal sequence

----- Final Results -----
         bacterial cytoplasm --- Certainty = 0.4548(Affirmative) < succ>
          bacterial membrane --- Certainty = 0.0000(Not Clear) < succ>
            bacterial outside --- Certainty = 0.0000(Not Clear) < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1722

A DNA sequence (GBSx1826) was identified in *S. agalactiae* <SEQ ID 5353> which encodes the amino acid sequence <SEQ ID 5354>. Analysis of this protein sequence reveals the following:

```
Possible site: 29
>>> Seems to have an uncleavable N-term signal seq
     INTEGRAL    Likelihood = -12.79   Transmembrane    20-36 (14-41)
```

-continued
```
----- Final Results -----
             bacterial membrane --- Certainty = 0.6116(Affirmative) < succ>
              bacterial outside --- Certainty = 0.0000(Not Clear)   < succ>
            bacterial cytoplasm --- Certainty = 0.0000(Not Clear)   < succ>
```

The protein has homology with the following sequences in the GENPEPT database.

```
>GP: CAB15906 GB: Z99123 similar to hypothetical proteins [Bacillus
subtilis]
Identities = 105/272 (38%), Positives = 149/272 (54%), Gaps = 20/272 (7%)

Query:  25 FLLIALIGIFLFFNNRSKQEIKT-----KTNASSHRKIVTSIKKKK-----WIKQKTPVK   74
           FL I L+G  L    + QE         K          ++KK+      WIK + P K
Sbjct:   5 FLSIFLLGSCLALAACADQEANAEQPMPKAEQKKPEKKAVQVQKKEDDTSAWIKTEKPAK   64

Query:  75 IPILMYHAVHVMDPSEAASANLIVAPDIFESHIKRLKKEGYYFLAPNEAYRALNENALPE  134
           +PILMYH++          ++   +L V    FE+H+K L   GY   L  PEA   L ++  P
Sbjct:  65 LPILMYHSI-------SSGNSLRVPKKEFEAHMKWLHDNGYQTLTPKEASLMLTQDKKPS  117

Query: 135 KKVIWITFDDGNADFYTKAYPILKKYKVKATNNIITGFVQEGRESNLNVQQMLEMKQNGM  194
           +K + ITFDDG   D Y   AYP+LKKY +KAT   +I    +   G  +L  +QM EM Q+G+
Sbjct: 118 EKCVLITFDDGYTDNYQDAYPVLKKYGMKATIFMIGKSI--GHKHHLTEEQMKEMAQHGI  175

Query: 195 SFQGHTVTHPNLSLLTPELQTQEMTLSKQFLDQKLSQDTLAIAYPSGRYNPTTLDIASQY  254
           S   + HT+  H    L+ LTP+ Q   EM   SK+    D      Q T    I+YP GRYN    TL   A +
Sbjct: 176 SIESHTIDHLELNGLTPQQQQSEMADSKKLFDNMFHQQTTIISYPVGRYNEETLKAAEKT  235

Query: 255 -YKLGLTTNEGVATKDNGLLSLNRIRILPTTS                             285
            Y++G+TT   G A++D G+ +L+R+R+ P  S
Sbjct: 236 GYQMGVTTEPGAASRDQGMYALHRVRVSPGMS                             267
```
                                       30

A related DNA sequence was identified in *S. pyogenes* <SEQ ID 5355> which encodes the amino acid sequence <SEQ ID 5356>. Analysis of this protein sequence reveals the following:

```
Possible site: 24
>>> May be a lipoprotein

----- Final Results -----
             bacterial membrane --- Certainty = 0.0000(Not Clear) < succ>
              bacterial outside --- Certainty = 0.0000(Not Clear) < succ>
            bacterial cytoplasm --- Certainty = 0.0000(Not Clear) < succ>
```

The protein has homology with the following sequences in the databases:

```
>GP: CAB15906 GB: Z99123 similar to hypothetical proteins [Bacillus
subtilis]
Identities = 97/240 (40%), Positives = 140/240 (57%), Gaps = 9/240 (3%)

Query:  71 KKTHFDSSKSQKKAHSKLTWTKQETPVKIPILMYHAIHVMSPEETANANLIVNPDLFDQQ  130
           KR    + + QKK       W K E P K+PILMYH+I         ++  +L V    F+
Sbjct:  37 KKPEKKAVQVQKKEDDTSAWIKTEKPAKLPILMYHSI-------SSGNSLRVPKKEFEAH   89

Query: 131 LQKMKDEGYYFLSPEEVYRALSNNELPAKKVVWLTFDDSMIDFYNVAYPILKKYDAKATN  190
           ++  + D GY  L+P+E     L+  ++ P+++K V +TFDD    D Y   AYP+LKKY   KAT
Sbjct:  90 MKWLHDNGYQTLTPKEASLMLTQDKKPSEKCVLITFDDGYTDNYQDAYPVLKKYGMKATI  149

Query: 191 NVITGLTEMGSAANLTLKQMKEMKQVGMSFQDHTVNHPDLEQASPDVQTTEMKDSKDYLD  250
           +I      +G    +LT +QMKEM Q G+S +  HT++H  +L   +P  Q  +EM DSK    D
Sbjct: 150 FMIG--KSIGHKKHHLTEEQMKEMAQHGISIESHTIDHLELNGLTPQQQQSEMADSKKLFD  207

Query: 251 KQLNQNTIAIAYPSGRYNDTTLQIAARLNYKLGVTTNEGIASAANGLLSLNRIRILPNMS  310
           +Q T   I+YP GRYN+TL+  A +     Y++GVTT    G AS    G+ +L+R+R+ P MS
Sbjct: 208 NMFHQQTTIISYPVGRYNEETLKAAEKTGYQMGVTTEPGAASRDQGMYALHRVRVSPGMS  267
```
                                       65

An alignment of the GAS and GBS proteins is shown below.

```
Identities = 153/265 (57%), Positives = 199/265 (74%), Gaps = 4/265 (1%)

Query:  33 IFLFFNNRSKQEIKTK---TNASSHRKIVTSIKKKKWIKQKTPVKIPILMYHAVHVMDPS    89
            I LF + ++ ++  TK    T+ S +    +  K  W KQ+TPVKIPILMYHA+HVM P
Sbjct:  54 ISLFHHKKTAKKETTKLKKTHFDSSKSQKKAHSKLTWTKQETPVKIPILMYHAIHVMSPE   113

Query:  90 EAASANLIVAPDIFESHIKRLKKEGYYFLAPNEAYRALNENALPEKKVIWITFDDGNADF   149
            E A+ANLIV PD+F+  ++++K EGYYFL+P E YRAL+ N LP KKV+W+TFDD    DF
Sbjct: 114 ETANANLIVNPDLFDQQLQKMKDEGYYFLSPEEVYRALSNNELPAKKVVWLTFDDSMIDF   173

Query: 150 YTKAYPILKKYKVKATNNIITGFVQEGRESNLNVQQMLEMKQNGMSFQGHTVTHPNLSLL   209
            Y   AYPILKKY  KATNN+ITG  + G  +NL ++QM EMKQ GMSFQ HTV HP+L
Sbjct: 174 YNVAYPILKKYDAKATNNVITGLTEMGSAANLTLKQMKEMKQVGMSFQDHTVNHPDLEQA   233

Query: 210 TPELQTQEMTLSKQFLDQKLSQDTLAIAYPSGRYNPTTLDIASQY-YKLGLTTNEGVATK   268
            +P++QT EM  SK +LD++L+Q+T+AIAYPSGRYN TTL IA++   YKLG+TTNEG+A+
Sbjct: 234 SPDVQTTEMKDSKDYLDKQLNQNTIAIAYPSGRYNDTTLQIAARLNYKLGVTTNEGIASA   293

Query: 269 DNGLLSLNRIRILPTTSDDDLIKTI                                     293
             NGLLSLNRIRILP  S ++L++T+
Sbjct: 294 ANGLLSLNRIRILPNMSPENLLQTM                                     318
```

SEQ ID 5354 (GBS287d) was expressed in *E. coli* as a GST-fusion product. SDS-PAGE analysis of total cell extract is shown in FIG. 145 (lane 3 & 4; MW 57 kDa) and in FIG. 185 (lane 2; MW 57 kDa). It was also expressed in *E. coli* as a His-fusion product. SDS-PAGE analysis of total cell extract is shown in FIG. 145 (lane 6; MW 32 kDa) and in FIG. 181 (lane 5; MW 32 kDa).

Purified GBS287d-GST is shown in FIG. 243, lanes 10-11; purified GBS287d-His is shown in FIG. 234, lanes 7-8.

Based on this analysis, it was predicted that these proteins and their epitopes could be useful antigens for vaccines or diagnostics.

EXAMPLE 1723

A DNA sequence (GBSx1828) was identified in *S. agalactiae* <SEQ ID 5357> which encodes the amino acid sequence <SEQ ID 5358>. Analysis of this protein sequence reveals the following:

```
Possible site: 21
>>> Seems to have no N-terminal signal sequence

----- Final Results -----
        bacterial membrane --- Certainty = 0.0000(Not Clear) < succ>
        bacterial outside  --- Certainty = 0.0000(Not Clear) < succ>
        bacterial cytoplasm --- Certainty = 0.0000(Not Clear) < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1724

A DNA sequence (GBSx1829) was identified in *S. agalactiae* <SEQ ID 5359> which encodes the amino acid sequence <SEQ ID 5360>. Analysis of this protein sequence reveals the following:

```
Possible site: 40
>>> Seems to have no N-terminal signal sequence

----- Final Results -----
        bacterial cytoplasm --- Certainty = 0.3352(Affirmative) < succ>
```

```
              bacterial membrane --- Certainty = 0.0000(Not Clear) < succ>
              bacterial outside  --- Certainty = 0.0000(Not Clear) < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1725

A DNA sequence (GBSx1830) was identified in *S. agalactiae* <SEQ ID 5361> which encodes the amino acid sequence <SEQ ID 5362>. This protein is predicted to be glycine betaine transporter BetL (opuD). Analysis of this protein sequence reveals the following:

```
Possible site: 61

>>> Seems to have an uncleavable N-term signal seq

INTEGRAL    Likelihood = -12.68 Transmembrane 439-455 (435-491)

INTEGRAL    Likelihood = -12.10 Transmembrane 256-272 (249-281)

INTEGRAL    Likelihood = -11.30 Transmembrane 464-480 (456-491)

INTEGRAL    Likelihood = -10.83 Transmembrane  49-65  (44-74)

INTEGRAL    Likelihood = -10.40 Transmembrane  11-27  (5-34)

INTEGRAL    Likelihood =  -9.98 Transmembrane 396-412 (390-419)

INTEGRAL    Likelihood =  -9.29 Transmembrane 224-240 (220-247)

INTEGRAL    Likelihood =  -7.11 Transmembrane 347-363 (341-366)

INTEGRAL    Likelihood =  -2.87 Transmembrane 143-159 (143-159)

INTEGRAL    Likelihood =  -2.60 Transmembrane 192-208 (191-208)

INTEGRAL    Likelihood =  -1.44 Transmembrane  86-102 (86-105)

----- Final Results -----
              bacterial membrane  --- Certainty = 0.6074 (Affirmative) < succ>
              bacterial outside   --- Certainty = 0.0000 (Not Clear)  < succ>
              bacterial cytoplasm --- Certainty = 0.0000 (Not Clear)  < succ>
```

The protein has homology with the following sequences in the GENPEPT database.

```
>GP:AAD30266 GB:AF102174 glycine betaine transporter BetL
[Listeria monocytogenes]

Identities = 277/503 (55%), Positives = 365/503 (72%), Gaps = 1/503 (0%)

Query:    4 KHITPVFTGSLIVSLILVLLGIIVPRGFQSWTQILREQVSTNFGWLYLLLVTSILALCVF   63
            K +T VF GS  + L+ VL G  +P  F+++T  +++ +++NFGW YL++V  I+   C+F
Sbjct:    2 KKLTNVFWGSGFLVLLAVLFGAFLPEQFETFTNHIQKFLTSNFGWYYLIVVAIIIIFCLF   61

Query:   64 FIMSPLGQIRLGQPHSRPEYSTVSWIAMMFSAGMGIGLVFYGAAEPLSHFAISTPGAPKE  123
             ++SP+G  IRLG+P   P YS   SW  AM+FSAGMGIGLVF+GAAEPLSH+A+   PG
Sbjct:   62 LVLSPIGSIRLGKPGEEPGYSNKSWFAMLFSAGMGIGLVFWGAAEPLSHYAVQAPGGEVG  121

Query:  124 SQTALADAFRFTFFHWGIHAWAVYALVALALAYFGFRKQEKYLLSVTLKPLFGDKTDGWL  183
            +Q A+ DA R++FFHWGI AW++YA+VALALAYF FRK     L+S TL P+ G     G +
Sbjct:  122 TQAAMKDALRYSFFHWGISAWSIYAIVALALAYFKFRKNAPGLISATLYPILGKHAKGPI  181

Query:  184 GKIVDITTVVATVIGVATTLGFGAAQINGGLSFLLGVPNNAFVQIVIILITTALFVMSAL  243
            G+++DI   V ATVIGVATTLG GA QINGGL++L GVPNN   VQ   II+I T LF++SA+
```

-continued

```
Sbjct: 182 GQLIDIIAVFATVIGVATTLGLGAQQINGGLTYLFGVPNNFTVQFTIIVIVTILFMLSAM 241

Query: 244 SGLGKGVKILSNLNLILAVALLALVIVLGPTVRIFDTLTESLGSYLQNFFGMSFRAAAFD 303
           SGL KG+++LSN+N+ +A  LL L ++LGPT+ I +  T S G YLQN   MSF+ A
Sbjct: 242 SGLDKGIQLLSNVNIYVAGVLLVLTLILGPTLFIMNNFTNSFGDYLQNIIQMSFQTAPDA 301

Query: 304 NTKRSWIDNWTIFYWAWWISWSPFVGVFIARISKGRSIREFLTVVLLIPTLLSFVWFAAF 363
             R WID+WTIFYWAWW+SWSPFVG+FIARIS+GR+IR+FL  V+++P L+S  WFA F
Sbjct: 302 PDARKWIDSWTIFYWAWWLSWSPFVGIFIARISRGRTIRQFLLGVIVLPALVSVFWFAVF 361

Query: 364 GTLSTQVQQLG-TNLTKFATEEVLFATFNHYTLGWLLSIIAIILIFSFFITSADSATYVL 422
           G  +  V+Q G + L+  ATE+VLF  FN +  G +LSI+A+ILI   FFITSADSAT+VL
Sbjct: 362 GGSAIFVEQHGNSGLSSLATEQVLFGVFNEFPGGMMLSIVAMILIAVFFITSADSATFVL 421

Query: 423 ANLTEDGNLNPKNRTKVIWGLVLAVIAIVLLLSGGLLALQNVLIIVALPFSFVMILMMLA 482
             M T  G+LNP N  KV WGL+ A IA VLL +GGL ALQN   II A PFS V+ILM+++
Sbjct: 422 GMQTTGGSLNPPNSVKVTWGLLQAGIASVLLYAGGLTALQNASIIAAFPFSIVIILMIVS 481

Query: 483 LLVELFHEKKEMGLSISPDRYPR                                     505
           L V L  E++++GL + P + R
Sbjct: 482 LFVSLTREQEKLGLYVRPKKSQR                                     504
```

No corresponding DNA sequence was identified in *S. pyogenes*.

A related GBS gene <SEQ ID 8887> and protein <SEQ ID 8888> were also identified. Analysis of this protein sequence reveals the following:

```
Lipop: Possible site: -1 Crend: 4

McG: Discrim Score: 15.28

GvH: Signal Score (-7.5): -4.24

Possible site: 61

>>> Seems to have an uncleavable N-term signal seq

ALOM program count: 11 value: -12.68 threshold: 0.0

INTEGRAL    Likelihood = -12.68 Transmembrane 439-455 (435-491)

INTEGRAL    Likelihood = -12.10 Transmembrane 256-272 (249-281)

INTEGRAL    Likelihood = -11.30 Transmembrane 464-480 (456 491)

INTEGRAL    Likelihood = -10.83 Transmembrane 49-65 (44-74)

INTEGRAL    Likelihood = -10.40 Transmembrane 11-27 (5-34)

INTEGRAL    Likelihood = -9.98 Transmembrane 396-412 (390-419)

INTEGRAL    Likelihood = -9.29 Transmembrane 224-240 (220-247)

INTEGRAL    Likelihood = -7.11 Transmembrane 347-363 (341-366)

INTEGRAL    Likelihood = -2.87 Transmembrane 143-159 (143-159)

INTEGRAL    Likelihood = -2.60 Transmembrane 192-208 (191-208)

INTEGRAL    Likelihood = -1.44 Transmembrane 86-102 (86-105)

PERIPHERAL  Likelihood = 3.50    319 modified ALOM score:  3.04

*** Reasoning Step: 3

----- Final Results -----
            bacterial membrane --- Certainty = 0.6074 (Affirmative) < succ>
            bacterial outside --- Certainty = 0.0000 (Not Clear) < succ>
            bacterial cytoplasm --- Certainty = 0.0000 (Not Clear) < succ>
```

The protein has homology with the following sequences in the databases:

```
ORF02057 (310-1821 of 2145)
GP|4835822|gb|AAD30266.1|AF102174_1|AF102174(2-506 of 507) glycine betaine
transporter BetL {Listeria monocytogenes} PIR|T48645 glycine betaine transport
protein betL [validated]- Listeria monocytogenes
% Match = 38.7
% Identity = 54.9    % Similarity = 74.7
Matches = 277    Mismatches = 127    Conservative Sub.s = 100
    54        84       114       144       174       204       234       264
IQGGHHYRNYRLEVLKIQDMVVS*ANLDLMPLSTNIWYLHQIVINH*VKHKNQIMLFGSFLLRRQGEVLIQVVKMRGVFI 294       324       354       384       414       444       474       504
KVCYTILV*EEILSKKHITPVFTGSLIVSLILVLLGIIVPRGFQSWTQILREQVSTNFGWLYLLLVTSILALCVFFIMSP
           |:|  |||  ||    :   |:   ||:|       :|      |:::|     :::    ::: ||||    ||::|     |:  :|:|:::||
              MKKLTNVFWGSGFLVLLAVLFGAFLPEQFETFTNHIQKFLTSNFGWYYLIVVAIIIIFCLFLVLSP
              10        20        30        40        50        60
   534       564       594       624       654       684       714       744
LGQIRLGQPHSRPEYSTVSWIAMMFSAGMGIGLVFYGAAEPLSHFAISTPGAPKESQTALADAFRFTFFHWGIHAWAVYA
:|  ||||:|    |  ||    ||  ||  ||:|||||||||||||:|||||||||:|   ||       :|   |:  ||:|::||||||   ||::||
IGSIRLGKPGEEPGYSNKSWFAMLFSAGMGIGLVFWGAAEPLSHYAVQAPGGEVGTQAAMKDALRYSFFHWGISAWSIYA
              80        90       100       110       120       130       140
   774       804       834       864       894       924       954       984
LVALALAYFGFRKQEKYLLSVTLKPLFGDKTDGWLGKIVDITTVVATVIGVATTLGFGAAQINGGLSFLLGVPNNAFVQI
:||||||||  |||        |:|  ||  ||:|           |  :|:::|     |   |||||||||||||:||  ||||||::|:||||||     ||
IVALALAYFKFRKNAPGLISATLYPILGKHAKGPIGQLIDIIAVFATVIGVATTLGLGAQQINGGLTYLFGVPNNFTVQF
              160       170       180       190       200       210       220
  1014      1044      1074      1104      1134      1164      1194      1224
VIILITTALFVMSALSGLGKGVKILSNLNLILAVALLALVIVLGPTVRIFDTLTESLGSYLQNFFGMSFRAAAFDNTKRS
 ||:|  ||::||:|||  ||:::|||:|: :|   || |  ::|||||   |  : :|  :|  ||||     |||:|         |
TIIVIVTILFMLSAMSGLDKGIQLLSNVNIYVAGVLLVLTLILGPTLFIMNNFTNSFGDYLQNIIQMSFQTAPDAPDARK
              240       250       260       270       280       290       300
  1254      1284      1314      1344      1374      1404      1431      1461
WIDNWTIFYWAWWISWSPFVGVFIARISKGRSIREFLTVVLLIPTLLSFVWFAAFGTLSTQVQQLGTN-LTKFATEEVLF
|||:||||||||||| :|||||||:||||||||:||:||  |:||: ||:   |:|   |||  ||    :  |:|  |:  :|||:|||
WIDSWTIFYWAWWLSWSPFVGIFIARISRGRTIRQFLLGVIVLPALVSVFWFAVFGGSAIFVEQHGNSGLSSLATEQVLF
              320       330       340       350       360       370       380
  1491      1521      1551      1581      1641      1671      1701
ATFNHYTLGWLLSIIAIILIFSFFITSADSATYVLAMLTEDGNLNPKNRTKVIWGLVLAVIAIVLLLSGGLLALQNVLII
  ||  :   |  :|||:|:|||    ||||||||||:||    |   |:|||    ||  ||||  | ||  |||  :|||  |||| ||
GVFNEFPGGMMLSIVAMILIAVFFITSADSATFVLGMQTTGGSLNPPNSVKVTWGLLQAGIASVLLYAGGLTALQNASII
              400       410       420       430       440       450       460
  1731      1761      1791      1821      1851      1881      1911      1941
VALPFSFVMILMMLALLVELFHEKKEMGLSISPDRYPRKNEPFKSYEE*KEARRLLFIG*SS*SDHHR**LVRYEFD*EK
|:|||  |:|||:::|:|   |    |:::::||   |   :    |
AAFPFSIVIILMIVSLFVSLTREQEKLGLYVRPKKSQRSQL
              480       490       500
```

Based on this analysis, it was predicted that these proteins and their epitopes could be useful antigens for vaccines or diagnostics.

EXAMPLE 1726

A DNA sequence (GBSx1831) was identified in *S. agalactiae* <SEQ ID 5363> which encodes the amino acid sequence <SEQ ID 5364>. This protein is predicted to be succinic semialdehyde dehydrogenase (gabD-1). Analysis of this protein sequence reveals the following:

```
Possible site: 43

>>> Seems to have no N-terminal signal sequence

----- Final Results -----
         bacterial cytoplasm --- Certainty = 0.2733 (Affirmative) < succ>
         bacterial membrane  --- Certainty = 0.0000 (Not Clear)  < succ>
         bacterial outside   --- Certainty = 0.0000 (Not Clear)  < succ>
```

A related GBS nucleic acid sequence <SEQ ID 9859> which encodes amino acid sequence <SEQ ID 9860> was also identified.

The protein has homology with the following sequences in the GENPEPT database.

```
>GP:AAD19405 GB:AF102543 succinic semialdehyde dehydrogenase
[Zymomonas mobilis]
```

-continued

```
Identities = 229/455 (50%), Positives = 305/455 (66%), Gaps = 5/455 (1%)

Query:   10 MAYKTIYPYTNEVLHEFDNISDSDLEQSLDIAHALYKTWRKEDNVEERQNQLHKVADLLR   69
            MAY+++ P T E + ++ + SD   ++ S+D A  ++K    + + ER   LHK A++ R
Sbjct:    1 MAYESVNPATGETVKKYPDFSDKQVKDSVDRAATVFKNDWSQRTIAERSKVLHKAAEIFR   60

Query:   70 KDRDKYAEVMTKDNGKLFTEAQGEVDLCADIADYYADNGQKFLKPVPLESPNGEAYYLKQ  129
            D DKYA++T DMGK    EA+GEV+L ADI DYYA NG+KFL P  +E    G A
Sbjct:   61 SDVDKYAKLLTIDNGKKIAEARGEVNLSADILDYYAKNGEKFLAPQKVEEKPG-AVVKAF  119

Query:  130 AVGVLLAVEPWNFPFYQINRVFAPNFIVGNTNLLKHASICPASAQAFEDLVREAGAPEGA  189
            +G+LLA+EPWNFP+YQ+ R+  P  I GN +L+KH+S   P SA AFE ++ EAGAP+G
Sbjct:  120 PLGLLLAIEPWNFPYYQLARIAGPYLIAGNALLVKHSSSVPQSAHAFEAVLEEAGAPKGI  179

Query:  190 FKNIFASYDQVSNLISDFRVAGVCLTGSERGGASIAAEAGKNLKKSSMELGGNDAFLILD  249
            + N+  AS DQVS +I DPRV GV +TGS   GA +AA+AGK  KKS MELGG+DAF++LD
Sbjct:  180 YTNLDASPDQVSQIIEDPRVRGVTVTGSASVGAELAAKAGKNWKKSVMELGGSDAFIVLD  239

Query:  250 DADFD--LLSKTIFFARLYNAGQVCTSSKRFIVMADKYDE-FVNNVVETFKSAKWGDPND  306
            D D    L+ K +   RL+NAGQV ++KRFI++  K  E F    + F++ K GDPMD
Sbjct:  240 GVDIDDKLIDKAAY-GRLFNAGQVWCAAKRFIIVGQKRAELFTEKLKQRFEALKIGDPND  298

Query:  307 SETTLAPLSSAGAKDDVLKQIKLAVDHGAEVVFGNDTIDHPGNFVNPTVLTNITKANPIY  366
              T L PLSS GA+D V+KQ++ AV +GA++V G    I+  G F+    +LT+I + NP Y
Sbjct:  299 ESTDLGPLSSVGARDQVVKQVEKAVQNGAKLVCGGKAIEGKGAFMKAGILTDIKRENPAY  358

Query:  367 NQEIFGPVASIYKVDTEEEAIALANDSSYGLGSTVFSSDPEHAKKVAAQIETGMTFINSG  426
            +E FGP+A IY V  E EAI LANDS YGLG  VF+ D E   +KVA QIETGM  IN
Sbjct:  359 FEEFFGPIAQIYAVKDEAEAIELANDSPYGLGGAVFAPDVEQGRKVAEQIETGMVAINKP  418

Query:  427 WTSLPELPFGGIKNSGYGRELSQLGFDAFVNEHLV                          461
             + PELPFGG+K+SGYGRELS  G   F+N  L+
Sbjct:  419 LWTAPELPFGGVKHSGYGRELSHFGIQEFINWKLI                          453
```

30

A related DNA sequence was identified in *S. pyogenes* <SEQ ID 5365> which encodes the amino acid sequence <SEQ ID 5366>. Analysis of this protein sequence reveals the following:

```
Possible site: 27

>>> Seems to have no N-terminal signal sequence

----- Final Results -----
         bacterial cytoplasm --- Certainty = 0.2887 (Affirmative) < succ>
          bacterial membrane --- Certainty = 0.0000 (Not Clear)   < succ>
           bacterial outside --- Certainty = 0.0000 (Not Clear)   < succ>
```

An alignment of the GAS and GBS proteins is shown below.

```
Identities = 335/457 (73%), Positives = 397/457 (86%)

Query:    9 IMAYRTIYPYTNEVLHEFDNISDSDLEQSLDIAHALYRTWRKEDNVEERQNQLHKVADLL   68
            +MAY+TIYPYTNEVLH FDN++D L    L+ AH LYK WRKED++EER+ QLH+VA++L
Sbjct:    1 VMAYQTIYPYTWEVLHTFDNMTDQGLADVLERAHLLYKKWRKEDHLEERKAQLHQVANIL   60

Query:   69 RKDRDKYAEVMTKDMGKLFTEAQGEVDLCADIADYYADNGQKFLKPVPLESPNGEAYYLK  128
            R+DRDKYAE+MTKDMGKLFTEAQGEV+LCADIADYYAD  +FL   PLE+  +G+AYYLK
Sbjct:   61 RRDRDRYAEIMTKDMGKLFTEAQGEVNLCADIADYYADKADEFLMSTPLETDSGQAYYLK  120

Query:  129 QAVGVLLAVEPWNFPFYQIMRVFAPNFIVGNTMLLKHASICPASAQAFEDLVREAGAPEG  188
            Q+ GV+LAVEPWNFP+YQIMRVFAPNFIVGN M+LKHASICP SAQ+FE+LV EAGA  G
Sbjct:  121 QSTGVILAVEPWNFPYYQIMRVFAPNFIVGNPMVLKHASICPRSAQSFEELVLEAGAEAG  180

Query:  189 AFKNIFASYDQVSNLISDPRVAGVCLTGSERGGASIAAEAGKNLKKSSMELGGNDAFLIL  248
            +  N+F SYDQVS +I+D RV GVCLTGSERGGASIA EAGKNLKK+++ELGG+DAF+IL
Sbjct:  181 SITNLFISYDQVSQVIADKRVVGVCLTGSERGGASIAEEAGKNLKKTTLELGGDDAFIIL  240

Query:  249 DDADFDLLSKTIFFARLYNAGQVCTSSKRFIVMADKYDEFVNMVVETFKSAKWGDPMDSE  308
            DDAD+D L K ++F+RLYNAGQVCTSSKRFIV+  YD F ++ + FK+AKWGDPMD E
Sbjct:  241 DDADWDQLEKVLYFSRLYNAGQVCTSSKRFIVLDKDYDRFKELLTKVFKTAKWGDPMDPE  300
```

-continued

```
Query: 309 TTLAPLSSAGAKDDVLKQIKLAVDHGAEVVFGNDTIDHPGNFVMPTVLTNITKANPIYNQ 368
            TTLAPLSSA AK DVL QIKLA+DHGAE+V+G +  IDHPG+FVMPT++  +TK NPIY Q
Sbjct: 301 TTLAPLSSAQAKADVLDQIKLALDHGAELVYGGEAIDHPGHFVMPTIIAGLTKDNPIYYQ 360

Query: 369 EIFGPVASIYKVDTEEEAIALANDSSYGLGSTVFSSDPKHAKKVAAQIETGMTFINSGWT 428
            EIFGPV  IYKV +EEEAI +ANDS+YGLG T+FSS+ EHAK VAA+IETGM+FINSGWT
Sbjct: 361 EIFGPVGEIYKVSSEEEAIEVANDSNYGLGGTIFSSNQEHAKAVAAKIETGMSFINSGWT 420

Query: 429 SLPELPFGGIKNSGYGRELSQLGFDAFVNEHLVFTPN                        465
            SLPELPFGGIK+SGYGRELS+LGF +FVNEHL++ PN
Sbjct: 421 SLPELPFGGIKHSGYGRELSELGFTSFVNEHLIYIPN                        457
```

Based on this analysis, it was predicted that these proteins and their epitopes could be useful antigens for vaccines or diagnostics.

EXAMPLE 1727

A DNA sequence (GBSx1832) was identified in *S. agalactiae* <SEQ ID 5367> which encodes the amino acid sequence <SEQ ID 5368>. Analysis of this protein sequence reveals the following:

```
Possible site: 31

>>> Seems to have a cleavable N-term signal seq.

----- Final Results -----
             bacterial outside --- Certainty = 0.3000 (Affirmative) < succ>
            bacterial membrane --- Certainty = 0.0000 (Not Clear)   < succ>
            bacterial cytoplasm --- Certainty = 0.0000 (Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1728

A DNA sequence (GBSx1833) was identified in *S. agalactiae* <SEQ ID 5369> which encodes the amino acid sequence <SEQ ID 5370>. Analysis of this protein sequence reveals the following:

```
Possible site: 41
>>> Seems to have a cleavable N-term signal seq.
INTEGRAL    Likelihood = -7.91      Transmembrane       94-110 (86-115)
INTEGRAL    Likelihood = -7.75      Transmembrane      154-170 (150-176)
INTEGRAL    Likelihood = -7.11      Transmembrane      316-332 (312-339)
INTEGRAL    Likelihood = -6.16      Transmembrane      258-274 (253-278)
INTEGRAL    Likelihood = -2.71      Transmembrane      218-234 (217-234)
INTEGRAL    Likelihood = -1.49      Transmembrane      286-302 (283-302)
INTEGRAL    Likelihood = -0.96      Transmembrane       73-89  (73-89)
INTEGRAL    Likelihood = -0.27      Transmembrane      121-137 (121-137)

----- Final Results -----
            bacterial membrane --- Certainty = 0.4163 (Affirmative) < succ>
             bacterial outside --- Certainty = 0.0000 (Not Clear)   < succ>
            bacterial cytoplasm --- Certainty = 0.0000 (Not Clear)   < succ>
```

A related GBS nucleic acid sequence <SEQ ID 9861> which encodes amino acid sequence <SEQ ID 9862> was also identified.

The protein has homology with the following sequences in the GENPEPT database.

```
>GP: AAC75219 GB: AE000305 orf, hypothetical protein [Escherichia coli K12]
Identities = 102/331 (30%), Positives = 172/331 (51%), Gaps = 26/331 (7%)

Query:   12 IPGLILCFIIA-IPSWLLGLYLPLIGAPVF-----AILIGIIVGSFYQNR--QLFNKGIA       63
            IPGL L  +I +   W G +P +     F      AIL+G+++G+         + G+
Sbjct:   17 IPGLALSAVITGVALW---GGSIPAVAGAGFSALTLAILLGMVLGNTIYPHIWKSCDGGVL    74

Query:   64 FTSKYILQTAVVLLGFGLNLMQVMKVGISSLPIIIMTISISLIIAYVL-QKLFKLDKTIA      122
            F  +Y+L+  ++L GF L   Q+  VGIS + I  ++T+S + ++A  L QK+F LDK  +
Sbjct:   75 FAKQYLLRLGIILYGFRLTFSQIADVGISGIIIDVLTLSSTFLLACFLGQKVFGLDKHTS     134

Query:  123 TLIGVGSSICGGSAIAATAPVINAKDDEVAQAISVIFLFNILAALIFPTLGNFIG--LSD      180
             LIG GSSICG +A+ AT PV+ A+   +V  A++ + +F  +A   ++P +    +  S
Sbjct:  135 WLIGAGSSICGAAAVLATEPVVKAEASKVTVAVATVVIFGTVAIFLYPAIYPLMSQWFSP    194

Query:  181 HGFALFAGTAVNDTSSVTAT--ATAWDAINHSNTLGGATIVKLTRTLAIIPITIVLSIYH      238
              F ++ G+ V++ + V A    A  + DA N          A I K+ R + + P  I+L+
Sbjct:  195 ETFGIYIGSTVHEVAQVVAAGHAISPDAEN------AAVISKMLRVMMLAPFLILLAA-R    247

Query:  239 MKQTQKEQSVSVTKI-FPKFVLYFILASLLTTIVASLGFSLRIFEPLKVLSKFFIVMAMG      297
            +KQ      S   +KI  P F + FI+ ++ +               + L   L F + MAM
Sbjct:  248 VKQLSGANSGEKSKITIPWFAILFIVVAIFNSFHL---LPQSVVNMLVTLDTFLLAMAMA    304

Query:  298 AIGINTNVSKLIKTGGKSILLGAACWLGIII                                 328
            A+G+ T+VS L K G K +L+    +I+
Sbjct:  305 ALGLTTHVSALKKAGAKPLLMALVLFAWLIV                                 335
```

A related DNA sequence was identified in *S. pyogenes* <SEQ ID 5371> which encodes the amino acid sequence <SEQ ID 5372>. Analysis of this protein sequence reveals the following:

```
Possible site: 37
>>> Seems to have an uncleavable N-term signal seq
INTEGRAL    Likelihood = -9.29    Transmembrane     30-46    (22-50)
INTEGRAL    Likelihood = -8.12    Transmembrane     314-330  (311-338)
INTEGRAL    Likelihood = -6.05    Transmembrane     8-24     (7-29)
INTEGRAL    Likelihood = -6.00    Transmembrane     150-166  (146-172)
INTEGRAL    Likelihood = -5.57    Transmembrane     257-273  (252-277)
INTEGRAL    Likelihood = -3.50    Transmembrane     91-107   (87-108)
INTEGRAL    Likelihood = -2.60    Transmembrane     69-85    (68-87)
INTEGRAL    Likelihood = -2.55    Transmembrane     289-305  (289-305)

----- Final Results -----
         bacterial membrane  --- Certainty = 0.4715 (Affirmative) < succ>
         bacterial outside   --- Certainty = 0.0000 (Not Clear)  < succ>
         bacterial cytoplasm --- Certainty = 0.0000 (Not Clear)  < succ>
```

The protein has homology with the following sequences in the databases:

```
>GP: AAC75219 GB: AE000305 orf, hypothetical protein [Escherichia
coli]
Identities = 100/329 (30%), Positives = 173/329 (52%), Gaps = 21/329 (6%)

Query:    8 LPGLLLCLLLALPAWCLGRLFPIIGAP----VFAILLGMLLA-LFYEHRDKTKEG-ISFT       61
            +PGL L  ++   A  G +  + GA       AILLGM+L    Y H K+ +G + F
Sbjct:   17 IPGLALSAVITGVALWGGSIPAVAGAGFSALTLAILLGMVLGNTIYPHIWKSCDGGVLFA     76

Query:   62 SKYILQTAVVLLGFGLNLTQVMAVGMQSLPIIISTIATALLVAYGL-QKWLRLDVNTATL    120
            +Y+L+  ++L GF L   +Q+  VG+ + I + T+++  L+A  L QK     LD +T+ L
Sbjct:   77 KQYLLRLGIILYGFRLTFSQIADVGISGIIIDVLTLSSTFLLACFLGQKVFGLDKHTSWL    136

Query:  121 VGVGSSICGGSAVAATAPVIKAKDDEVAKAISVIFLFNMLAALLFPSLGQLLG--LSNEG    178
            +G GSSICG +AV AT PV+KA+   +V  A++ + +F  +A  L+P++  L+    S E
Sbjct:  137 IGAGSSICGAAAVLATEPVVKAEASKVTVAVATVVIFGTVAIFLYPAIYPLMSQWFSPET    196

Query:  179 FAIFAGTAVNDTSSVTATATAWDALHHSNTLDGATIVKLTRTLAILPITLGLSLYRAKKE    238
            F I+ G+ V++ + V A A    A       +  A I K+ R + +  P   L  R K+
Sbjct:  197 FGIYIGSTVHEVAQVVAAGHAIS----PDAENAAVISKMLRVMMLAPFLILLAA-RVKQL    251

Query:  239 HDIVTEENFSLRKSFPRFILFFLLASLITTLMTSLGVSADSFHYLKTLSKFFIVMAMAAI    298
              + E     +   + P F + F++ ++                 + L TL  F + MAMAA+
Sbjct:  252 SGANSGEKSKI--TIPWFAILFIVVAIFNSFHL---LPQSVVNMLVTLDTFLLAMAMAAL    306

Query:  299 GLNTNLVKLIKTGGQAILLGAI--CWVAI                                   325
```

```
                   GL T++  L K G + +L+  +   W+ +              -continued
Sbjct: 307 GLTTHVSALKKAGAKPLLMALVLFAWLIV                          335
```

An alignment of the GAS and GBS proteins is shown below.

```
Identities = 225/333 (67%), Positives = 277/333 (82%), Gaps = 3/333 (0%)

Query:  11 KIPGLILCFIIAIPSWLLGLYLPLIGAPVFAILIGIIVGSFYQNRQLFNKGIAFTSKYIL   70
           K+PGL+LC ++A+P+W LG   P+IGAPVFAIL+G+++  FY++R    +GI+FTSKYIL
Sbjct:   7 KLPGLLLCLLLALPAWCLGRLFPIIGAPVFAILLGMLLALFYEHRDKTKEGISFTSKYIL   66

Query:  71 QTAVVLLGFGLNLMQVMKVGISSLPIIIMTISISLIIAYVLQKLFKLDKTIATLIGVGSS  130
           QTAVVLLGFGLNL QVM VG+ SLPIII TI+ +L++AY LQK  +LD   ATL+GVGSS
Sbjct:  67 QTAVVLLGFGLNLTQVMAVGMQSLPIIISTIATALLVAYGLQKWLRLDVNTATLVGVGSS  126

Query: 131 ICGGSAIAATAPVINAKDDEVAQAISVIFLFNILAALIFPTLGNFIGLSDHGFALFAGTA  190
           ICGGSA+AATAPVI AKDDEVA+AISVIFLFN+LAAL+FP+LG  +GLS+ GFA+FAGTA
Sbjct: 127 ICGGSAVAATAPVIKAKDDEVAKAISVIFLFNMLAALLFPSLGQLLGLSNEGFAIFAGTA  186

Query: 191 VNDTSSVTATATAWDAINHSNTLGGATIVKLTRTLAIIPITIVLSIYHMKQTQ---KEQS  247
           VNDTSSVTATATAWDA++HSNTL GATIVKLTRTLAI+PIT+ LS+Y  K+         E++
Sbjct: 187 VNDTSSVTATATAWDALHHSNTLDGATIVKLTRTLAILPITLGLSLYRAKKEHDIVTEEN  246

Query: 248 VSVTKIFPKFVLYFILASLLTTIVASLGFSLRIFEPLKVLSKFFIVMAMGAIGINTNVSK  307
           S+ K FP+F+L+F+LASL+TT++ SLG S   F  LK LSKFFIVMAM AIG+NTN+ K
Sbjct: 247 FSLRKSFPRFILFFLLASLITTLMTSLGVSADSFHYLKTLSKFFIVMAMAAIGLNTNLVK  306

Query: 308 LIKTGGKSILLGAACWLGIIIVSLTMQAILGTW                            340
           LIKTGG++ILLGA CW+ I +VSL MQ  LG W
Sbjct: 307 LIKTGGQAILLGAICWVAITLVSLAMQLSLGIW                            339
```

A related GBS gene <SEQ ID 8889> and protein <SEQ ID 8890> were also identified. Analysis of this protein sequence reveals the following:

```
Lipop: Possible site: -1 Crend: 10
McG: Discrim Score: 22.17
GvH: Signal Score (-7.5): -0.429999
Possible site: 41
>>> Seems to have a cleavable N-term signal seq.
ALOM program        count: 8        value: -7.91        threshold: 0.0
INTEGRAL          Likelihood = -7.91     Transmembrane      94-110 (86-115)
INTEGRAL          Likelihood = -7.75     Transmembrane     154-170 (150-176)
INTEGRAL          Likelihood = -7.11     Transmembrane     316-332 (312-339)
INTEGRAL          Likelihood = -6.16     Transmembrane     258-274 (253-278)
INTEGRAL          Likelihood = -2.71     Transmembrane     218-234 (217-234)
INTEGRAL          Likelihood = -1.49     Transmembrane     286-302 (283-302)
INTEGRAL          Likelihood = -0.96     Transmembrane      73-89  (73-89)
INTEGRAL          Likelihood = -0.27     Transmembrane     121-137 (121-137)
PERIPHERAL        Likelihood =  3.29                      175
modified ALOM score: 2.08

*** Reasoning Step: 3

----- Final Results -----
              bacterial membrane --- Certainty = 0.4163 (Affirmative) < succ>
               bacterial outside --- Certainty = 0.0000 (Not Clear) < succ>
             bacterial cytoplasm --- Certainty = 0.0000 (Not Clear) < succ>
```

The protein has homology with the following sequences in the databases:

```
ORF02059 (334-1284 of 1620)
EGAD|10465|EC2158 (17-335 of 349) hypothetical 36.9 kd protein in lysp-nfo
intergenic region {Escherichia coli} OMNI|NT01EC2574 conserved hypothetical protein
SP|P33019|YEIH_ECOLI HYPOTHETICAL 36.9 KDA PROTEIN IN LYSP-NFO INTERGENIC REGION.
GP|405879|gb|AAA60511.1||U00007 yeiH {Escherichia coli}
GP|1788482|gb|AAC75219.1||AE000305 orf, hypothetical protein {Escherichia coli}
PIR|E64984|E64984 hypothetical 36.9 kD protein in lysP-nfo intergenic region-
Escherichia coli (strain K-12)
% Match = 12.7
% Identity = 32.3   % Similarity = 57.1
Matches = 103     Mismatches = 125     Conservative Sub.s = 79
```

-continued

```
        270       300       330       360       390              435       462
        YSGPLSVFLSRFKACDIIVNVRRTIMLFKEKIPGLILCFIIAIPSWLLGLYLPLI-----GAPVFAILIGIIVG-SFYQN
                            ||||  |   :|       | |  :|  :        |  :|||:|:::|  :  | :
                            MTNITLQKQHRTLWHFIPGLALSAVIT-GVALWGGSIPAVAGAGFSALTLAILLGMVLGNTIYPH
                            10        20        30        40        50        60

489       519       549       579       609       636       666       696
        R-QLFNKGIAFTSKYILQTAVVLLGFGLNLMQVMKVGISSLPIIIMTISISLIIAYVL-QKLFKLDKTIATLIGVGSSIC
         :  :|:  |   :|:|:    ::|  ||  |  |:  ||||  |   |  ::|:|::::|    | |: |||    |  |
        IWKSCDGGVLFAKQYLLRLGIILYGFRLTFSQIADVGISGIIIDVLTLSSTFLLACFLGQKVFGLDKHTSWLIGAGSSIC
                  80        90       100       110       120       130       140

726       756       786       816       840       870       900       930
        GGSAIAATAPVINAKDDEVAQAISVIFLFNILAALIFPTLGNFIG--LSDHGFALFAGTAVNDTSSVTATATAWDAINHS
        | :|:  ||  ||:  |:    :|  |::  : :|  :|:::|   :   ::|   |:: |:  |:: :  | |   |||
        GAAAVLATEPVVKAEASKVTVAVATVVIFGTVAIFLYPAIYPLMSQWFSPETFGIYIGSTVHEVAQVVA---AGHAI-SP
                 160       170       180       190       200       210       220

960       990      1020      1050      1077      1107      1134      1164
        NTLGGATIVKLTRTLAIIPITIVLSIYHMKQTQKEQSVSVTKI-FPKFVLYFILASLLTTIVASLGF-SLRIFEPLKVLS
        :    |   | |:  |   |:|| :||     |     :||      |  :    :  :   |: :    :      |
        DAENAAVISKMLRVMMLAPFLILLAA-RVKQLSGANSGEKSKITIPWFAILFIVVAIF----NSFHLLPQSVVNMLVTLD
                 230       240       250       260       270       280       290

1194      1224      1254      1284      1314      1344      1374      1404
        KFFIVMAMGAIGINTNVSKLIKTGGKSILLGAACWLGIIIVSLTMQAILGTW*SCLKLNICNRFHKCYNEDIKRREHYGI
         |::  |||  |:|:  |:||    |    |:|     :  |:        :  :|:
        TFLLAMAMAALGLTTHVSALKKAGAKPLLMALVLFAWLIVGGGAINYVIQSVIA
                 310       320       330       340
```

Based on this analysis, it was predicted that these proteins and their epitopes could be useful antigens for vaccines or diagnostics.

EXAMPLE 1729

A DNA sequence (GBSx1834) was identified in *S. agalactiae* <SEQ ID 5373> which encodes the amino acid sequence <SEQ ID 5374>. Analysis of this protein sequence reveals the following:

```
Possible site: 57
>>> Seems to have an uncleavable N-term signal seq
INTEGRAL    Likelihood = -10.93         Transmembrane     7-23 (1-27)

----- Final Results -----
            bacterial membrane --- Certainty = 0.5373 (Affirmative) < succ>
             bacterial outside --- Certainty = 0.0000 (Not Clear)   < succ>
           bacterial cytoplasm --- Certainty = 0.0000 (Not Clear)   < succ>
```

The protein has no significant homology with any sequences in the GENPEPT database.

A related DNA sequence was identified in *S. pyogenes* <SEQ ID 5375> which encodes the amino acid sequence <SEQ ID 5376>. Analysis of this protein sequence reveals the following:

```
Possible site: 40
>>> Seems to have an uncleavable N-term signal seq
INTEGRAL    Likelihood = -16.34         Transmembrane     22-38 (13-42)

----- Final Results -----
            bacterial membrane --- Certainty = 0.7538 (Affirmative) < succ>
             bacterial outside --- Certainty = 0.0000 (Not Clear)   < succ>
           bacterial cytoplasm --- Certainty = 0.0000 (Not Clear)   < succ>
```

The protein has no significant homology with any sequences in the GENPEPT database.

An alignment of the GAS and GBS proteins is shown below.

```
Identities = 56/215 (26%), Positives = 111/215 (51%), Gaps = 5/215 (2%)

Query:   7  VFLTVLVLILIVGAGGLYFWNNHQSLEGKWRTVSLEKQVEKEIEQQLGSQAADMGISAAD   66
            +F+ ++ LIL+     G+ + N+    S+EG WRT S+++++   +   ++L       I    +
```

```
                     -continued
Sbjct:   22 LFVFIIFLILLAVLFGVRYRNS--SIEGIWRTTSIDQKLGDDFAKRLTGLHQSPLIDDS-   78

Query:   67 LVKGANMHMNVKNDEAKITVTAQIDEVKFHQAIKTFIDKALEKQLKDQGLTYNDLSEAGK  126
            L+    + M + VKN+     ++ + Q++      F + +  +      L K LK+  L    DLS     +
Sbjct:   79 LLTSSQMILTVKNNNVDLSFSVQVERDIFVKRLAAYHQNELLKTLKENHLVVGDLSSKER  138

Query:  127 KIFDETKITDQQIDQQIDRSFQSAAQAAGGKYNTNTGEMTLPVMDGKVHRLTSVIKV-SH  185
            +I + +       +++ +D++F+   A     GGKYN    TG ++   V+ GKV+R+     I +
Sbjct:  139 QIIENSMPASHELEMILDQAFEKLASQIGGKYNQKTGHLSAVVLKGKVNRILHTIDIKEE  198

Query:  186 INKKANAFYGNIVKNGEKTAYKKEGSKL-ILGNEK                          219
            +       +F    ++           Y + G KL +LG+EK
Sbjct:  199 VAAGHTSFSKGLLTPNGYFDYTRFGKKLELLGDEK                          233
```

SEQ ID 5374 (GBS288) was expressed in *E. coli* as a GST-fusion product. SDS-PAGE analysis of total cell extract is shown in FIG. 59 (lane 3; MW 53.7 kDa).

GBS288d was expressed in *E. coli* as a His-fusion product. SDS-PAGE analysis of total cell extract is shown in FIG. 154 (lane 8-10; MW 26 kDa) and in FIG. 183 (lane 3; MW 26 kDa). It was also expressed in *E. coli* as a GST-fusion product. SDS-PAGE analysis of total cell extract is shown in FIG. 187 (lane 11; MW 51 kDa). Purified GBS288d-GST is shown in lane 8 of FIG. 237.

Based on this analysis, it was predicted that these proteins and their epitopes could be useful antigens for vaccines or diagnostics.

EXAMPLE 1730

A DNA sequence (GBSx1835) was identified in *S. agalactiae* <SEQ ID 5377> which encodes the amino acid sequence <SEQ ID 5378>. Analysis of this protein sequence reveals the following:

```
Possible site: 51
>>> Seems to have no N-terminal signal sequence

----- Final Results -----
            bacterial cytoplasm --- Certainty = 0.3885 (Affirmative) < succ>
            bacterial membrane  --- Certainty = 0.0000 (Not Clear)   < succ>
             bacterial outside  --- Certainty = 0.0000 (Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1731

A DNA sequence (GBSx1836) was identified in *S. agalactiae* <SEQ ID 5379> which encodes the amino acid sequence <SEQ ID 5380>. Analysis of this protein sequence reveals the following:

```
Possible site: 51
>>> Seems to have no N-terminal signal sequence
INTEGRAL    Likelihood = -12.37        Transmembrane         67-83   (63-89)
INTEGRAL    Likelihood =  -3.72        Transmembrane        139-155 (137-158)
INTEGRAL    Likelihood =  -1.54        Transmembrane        115-131 (114-131)

----- Final Results -----
             bacterial membrane  --- Certainty = 0.5946 (Affirmative) < succ>
              bacterial outside  --- Certainty = 0.0000 (Not Clear)   < succ>
            bacterial cytoplasm  --- Certainty = 0.0000 (Not Clear)   < succ>
```

A related GBS nucleic acid sequence <SEQ ID 10905> which encodes amino acid sequence <SEQ ID 10906> was also identified.

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1732

A DNA sequence (GBSx1837) was identified in *S. agalactiae* <SEQ ID 5381> which encodes the amino acid sequence <SEQ ID 5382>. Analysis of this protein sequence reveals the following:

```
Possible site: 38
>>> Seems to have no N-terminal signal sequence

----- Final Results -----
            bacterial cytoplasm --- Certainty = 0.4709 (Affirmative) < succ>
            bacterial membrane  --- Certainty = 0.0000 (Not Clear)   < succ>
             bacterial outside  --- Certainty = 0.0000 (Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1733

A DNA sequence (GBSx1838) was identified in *S. agalactiae* <SEQ ID 5383> which encodes the amino acid sequence <SEQ ID 5384>. Analysis of this protein sequence reveals the following:

```
Possible site: 29
>>> Seems to have no N-terminal signal sequence

----- Final Results -----
            bacterial cytoplasm --- Certainty = 0.2191(Affirmative) < succ>
            bacterial membrane  --- Certainty = 0.0000(Not Clear)   < succ>
             bacterial outside  --- Certainty = 0.0000(Not Clear)   < succ>
```

The protein has homology with the following sequences in the GENPEPT database.

```
>GP: AAC98427 GB: M63481 20-kDa protein [Streptococcus sanguinis]
Identities = 119/163 (73%), Positives = 146/163 (89%)

Query:    1 MTTFLGNPVTFTGKQLQVGDIAKDFLLIATDLSQKSLKDFEGKKKVISVVPSIDTGICSK    60
            MTTFLGNPVTFTGKQLQVGD A DF L ATDLS+K+L DF GKKKV+S++PSIDTG+CS
Sbjct:    1 MTTFLGNPVTFTGKQLQVGDTAHDFSLTATDLSKKTLADFAGKKKVLSIIPSIDTGVCST   60

Query:   61 QTRTFNEELSELDNTVVITVSMDLPFAQKRWCSAEGLDNVILLSDFYDHSFGQEYALLMN  120
             QTR FN+ELS+LDNTVVITVS+DLPFAQ +WC+AEG++N ++LSD++DHSFG++YA+L+N
Sbjct:   61 QTRRFNQELSDLDNTVVITVSVDLPFAQGKWCAAEGIENAVMLSDYFDHSFGRDYAVLIN  120

Query:  121 EWHLLTRAVLILDEHNKVTYTEYVDNVNSDVDYEAAINAAKIL                  163
            EWHLL RAVL+LDE+N VTY EYVDN+N++ DY+AAI A K L
Sbjct:  121 EWHLLARAVLVLDENNTVTYAEYVDNINTEPDYDAAIAAVKSL                  163
```

No corresponding DNA sequence was identified in S. pyogenes.

Based on this analysis, it was predicted that this protein and its epitopes, could be useful antigens for vaccines or diagnostics.

EXAMPLE 1734

A DNA sequence (GBSx1839) was identified in S. agalactiae <SEQ ID 5385> which encodes the amino acid sequence <SEQ ID 5386>. This protein is predicted to be DNA alkylation repair enzyme. Analysis of this protein sequence reveals the following:

```
Possible site: 15
>>> Seems to have no N-terminal signal sequence

----- Final Results -----
            bacterial cytoplasm --- Certainty = 0.4729(Affirmative) < succ>
            bacterial membrane  --- Certainty = 0.0000(Not Clear)   < succ>
             bacterial outside  --- Certainty = 0.0000(Not Clear)   < succ>
```

The protein has homology with the following sequences in the GENPEPT database.

```
>GP: CAB40581 GB: AJ010128 DNA alkylation repair enzyme [Bacillus
cereus]
Identities = 67/217 (30%), Positives = 119/217 (53%), Gaps = 5/217 (2%)

Query:   6 SLERKFKAASDKEVSKQQEAYLRHHFKCYGIKSPERRMLYKELIKAAKRQAKIDWQLLDK    65
           +L+  F A  + E ++    Y+++HF   GI++PERR L K++I+     + D+Q++ +
Sbjct:   7 ALQEHFIANQNPEKAEPMARYMKNHFPFLGIQTPERRQLLKDVIQIHTLPDQKDFQVIVR   66

Query:  66 -CWQSDYREYHHFVLDYLLAMSQFLTYNDCSRLEFYARHQQWWDSIDVLTKIF-GNLSLK  123
             W   RE+   LD +    +    LE   + WWD++D +  F GN+ L+
Sbjct:  67 ELWDLPEREFQAAALDMMQKYKMHINETHIPFLEELIVTKSWWDTVDSIVPTFLGNIFLQ  126

Query: 124 DDKVMNL-LSEWSLDQDFWMRRLAIEHQLGFKEKTNTDILSLFILRNTGSQEFFINKAIG  182
            ++++  + +W   + W++R AI  QL +K+K + ++L   I +   S+EFFI KAIG
Sbjct: 127 HPELISAYIPKWIASDNIWLQRAAILFQLKYKQKMDEELLFWVIGQLHSSKEFFIQKAIG  186

Query: 183 WALRDYSKYNKVWVKDFISNHCDELSTLSIREGSKYL                         219
            W LR+Y+K    V +++ N  +EL+ LS RE  K++
Sbjct: 187 WVLREYAKTKSDVVWEYVQN--NELAPLSRREAIKHI                         221
```

No corresponding DNA sequence was identified in S. pyogenes.

Based on this analysis, it was predicted that this protein and its epitopes, could be useful antigens for vaccines or diagnostics.

EXAMPLE 1735

A DNA sequence (GBSx1841) was identified in S. agalactiae <SEQ ID 5387> which encodes the amino acid sequence <SEQ ID 5388>. Analysis of this protein sequence reveals the following:

```
Possible site: 19
>>> Seems to have no N-terminal signal sequence

----- Final Results -----
            bacterial cytoplasm --- Certainty = 0.2117(Affirmative) < succ>
            bacterial membrane  --- Certainty = 0.0000(Not Clear)   < succ>
             bacterial outside  --- Certainty = 0.0000(Not Clear)   < succ>
```

The protein has homology with the following sequences in the GENPEPT database.

```
>GP: CAA81648 GB: Z27121 unknown [Mycoplasma hominis]
Identities = 67/281 (23%), Positives = 113/281 (39%), Gaps = 52/281 (18%)
```

```
-continued
Query:    3 FVFDIDGTLCFDGMS--LSKEIQGILERAQIDYGHRVTFATARSYRDTIGILGDKLSLSK    60
            F D+DGTL  D  +  + +  +++A +  GH V+  T R +R T+ +  +KL L+
Sbjct:   14 FAIDLDGTLLADSANGTVHPKTEEAIKKA-VAQGHIVSIITGRPWRSTLPVY-EKLGLNA    71

Query:   61 IIG-LNGATLHENGHLVDSYYLQSDFFSTIISYCHRHQIPYFVD------EVFNYATYQA   113
            I+G  NGA +H              FF  I+Y  +++ Y +       E+ NYA
Sbjct:   72 IVGNYNGAHIHNPA---------DPFFIPAITYLDLNEVLYILGDEKVKKEITNYAIEGP   122

Query:  114 SKIPFIAYVDPQ-----------KRGELLEVSKIE----------KPIKMVLYFGDQLGR   152
            +  + + DP           K  E + + KI          KP  VL    L R
Sbjct:  123 DWVQLM-HRDPNLERVFGFNQATKFRECINLEKIPLKPTGIVFDVKPDTDVLELLTYLKR   181

Query:  153 ADQMLAELNRFGLSSHFFHEFEKCLYINPIAVDKGKATKKLFG------NRFIAFGNDKN   206
                L E + +         F+    I  I +DKGK    +         +A G+  N
Sbjct:  182 RYGDLGEFSSWSKGEGLSPVFD----ITSIGIDKGKVISLIMRYYNIDIDDTVAMGDSYN   237

Query:  207 DISMFDAAHYSVQVGDFDELTPYANLRVSRESVHEGITTLF                    247
            D+SM++ A+  V   + + L    +  V +++   EG     F
Sbjct:  238 DLSMYNVANVCVSPANAEPLIKKMSTVVMKQTNKEGAVGYF                    278
```

Based on this analysis, it was predicted that this protein and its epitopes, could be useful antigens for vaccines or diagnostics.

EXAMPLE 1736

A DNA sequence (GBSx1842) was identified in *S. agalactiae* <SEQ ID 5389> which encodes the amino acid sequence <SEQ ID 5390>. Analysis of this protein sequence reveals the following:

```
Possible site: 27
>>> Seems to have no N-terminal signal sequence

----- Final Results -----
          bacterial cytoplasm --- Certainty = 0.2383(Affirmative) < succ>
           bacterial membrane --- Certainty = 0.0000(Not Clear)   < succ>
             bacterial outside --- Certainty = 0.0000(Not Clear)   < succ>
```

The protein has homology with the following sequences in the GENPEPT database.

```
>GP: AAB90005 GB: AE001018 A. fulgidus predicted
coding region AF1244 [Archaeoglobus fulgidus]
Identities = 22/48 (45%), Positives = 35/48 (72%)

Query:  150 GKSIGELNVWHQTGATIVAIEHEGKFIVSPGPFSVIEQGDHIFFVGDE   197
            GKSIGEL +  +TGAT++A+  + K  I+SP P +V+E GD  +   +G++
Sbjct:  102 GKSIGELGIRSKTGATVIAVLKKEKTIISPSPETVLEPGDKVVVIGEK   149
```

A related DNA sequence was identified in *S. pyogenes* <SEQ ID 5391> which encodes the amino acid sequence <SEQ ID 5392>. Analysis of this protein sequence reveals the following:

```
Possible site: 27
>>> Seems to have no N-terminal signal sequence

----- Final Results -----
          bacterial cytoplasm --- Certainty = 0.2446(Affirmative) < succ>
           bacterial membrane --- Certainty = 0.0000(Not Clear)   < succ>
             bacterial outside --- Certainty = 0.0000(Not Clear)   < succ>
```

An alignment of the GAS and GBS proteins is shown below.

```
Identities = 163/213 (76%), Positives = 196/213 (91%)

Query:     1 MVSEQSEIVTSKYQKIAVAVAQRIANGDYEVGEKLKSRTTIASTFNVSPETARKGLNILA    60
             ++S + EI +SKYQKIA++VAQRIANG+YEVGEKLKSRTTIASTFNVSPETARKGLNILA
Sbjct:     1 VISPKKEITSSKYQKIAISVAQRIANGEYEVGEKLKSRTTIASTFNVSPETARKGLNILA    60

Query:    61 DLQILTLKHGSGAIILSKEKAIEFLNQYETSHSVAILKGKIRDNIKAQQQEMEELATLVD   120
             DL+ILTLKHGSGAI+LSKE+AIEF+NQYE++HS+A+LK KIR+ I  Q + ME++A LV+
Sbjct:    61 DLKILTLKHGSGAIVLSKERAIEFINQYESTHSIAVLKEKIRETINDQGKAMEKMAVLVN   120

Query:   121 DFLLQTRAVSKQYPLAPYEIIVSEDSEHLGKSIGELNVWHQTGATIVAIEHEGKFIVSPG   180
             DFL+Q+++VSKQYPLAPYEII ++DSEH GESIG LN+WHQTGATIVAIEH G+FIVSPG
Sbjct:   121 DFLMQSQSVSKQYPLAPYEIICNQDSEHFGKSIGVLNIWHQTGATIVAIEHAGQFIVSPG   180

Query:   181 PFSVIEQGDHIFFVGDEDVYARMKTYFNLRMGL                             213
             P+SVIE+GDHI+FVGDE V +RMKT+FNLR GL
Sbjct:   181 PYSVIEKGDHIYFVGDESVISRMKTFFNLRKGL                             213
```

Based on this analysis, it was predicted that these proteins and their epitopes could be useful antigens for vaccines or diagnostics.

EXAMPLE 1737

A DNA sequence (GBSx1844) was identified in *S. agalactiae* <SEQ ID 5393> which encodes the amino acid sequence <SEQ ID 5394>. This protein is predicted to be gls24. Analysis of this protein sequence reveals the following:

```
Possible site: 16
>>> Seems to have no N-terminal signal sequence

----- Final Results -----
          bacterial cytoplasm --- Certainty = 0.2855(Affirmative) < succ>
           bacterial membrane --- Certainty = 0.0000(Not Clear)   < succ>
            bacterial outside --- Certainty = 0.0000(Not Clear)   < succ>
```

A related GBS nucleic acid sequence <SEQ ID 9361> which encodes amino acid sequence <SEQ ID 9362> was also identified.

The protein has homology with the following sequences in the GENPEPT database.

```
>GP: AAA86383 GB: U23376 putative 20-kDa protein [Lactococcus lactis]
Identities = 63/124 (50%), Positives = 84/124 (66%)

Query:     1 MSGGFFSNLKNSVVNSDSVTDGVNVEVGTKEVAVDLDIVVEYGKDIPAIVESIKAIVSQN    60
             + GGFFSNL   ++N+D VT GV+VEVG +VAVDL +V EY K++P I E IK ++ +
Sbjct:    55 VEGGFFSNLTGKLINTDDVTTGVDVEVGKTQVAVDLKVVTEYRKNVPDIYEKIKEVIRKE   114

Query:    61 VEVMTHLKVVELNANVVDIKTKAEHEADSVTVQDRVSDAAQATGNFASEQAGKAKAAISS   120
             V  MT L+VVE+N  V DIKTK + + D V++QDRV+ AAQ TG F SEQ  K K  +
Sbjct:   115 VAAMTELEVVEVNVTVTDIKTKEQQKEDDVSIQDRVTSAAQTTGKFTSEQVDKVKDKVED   174

Query:   121 GAEK                                                          124
             +K
Sbjct:   175 NTDK                                                          178
```

A related DNA sequence was identified in *S. pyogenes* <SEQ ID 5395> which encodes the amino acid sequence <SEQ ID 5396>. Analysis of this protein sequence reveals the following:

```
Possible site: 43
>>> Seems to have no N-terminal signal sequence

----- Final Results -----
          bacterial cytoplasm --- Certainty = 0.2534(Affirmative) < succ>
           bacterial membrane --- Certainty = 0.0000(Not Clear)   < succ>
            bacterial outside --- Certainty = 0.0000(Not Clear)   < succ>
```

An alignment of the GAS and GBS proteins is shown below.

```
Identities = 94/137 (68%), Positives = 108/137 (78%), Gaps = 8/137 (5%)

Query:     1 MSGGFFSNLKNSVVNSDSVTDGVNVEVGTKEVAVDLDIVVEYGKDIPAIVESIKAIVSQN   60
             ++GGFFSN+KN++VNS+SVTDGV+VEVG+KEVAVDL I+VEYGKDIPAI ESIKAIVSQN
Sbjct:    35 VTGGFFSNIKNNLVNSESVTDGVSVEVGSKEVAVDLAIIVEYGKDIPAIAESIKAIVSQN   94

Query:    61 VEVMTHLKVVELNANVVDIKTKAEHEADSVTVQDRVSDAAQATGNFASEQAGKAKAAISS  120
             V+ MTHLKVVE+N NVVDI+TK EHEA SVTVQDRV+ AA +T  F SEQ  K K  IS
Sbjct:    95 VDSMTHLKVVEVNVNVVDIRTKEEHEAASVTVQDRVTSAASSTSQFVSEQTEKLKDTISD  154

Query:   121 GAEKTKEAVSNGTEAAK                                            137
                          N   EAAK
Sbjct:   155 --------TVNSDEAAK                                            163
```

Based on this analysis, it was predicted that these proteins and their epitopes could be useful antigens for vaccines or diagnostics.

EXAMPLE 1738

A DNA sequence (GBSx1845) was identified in *S. agalactiae* <SEQ ID 5397> which encodes the amino acid sequence <SEQ ID 5398>. Analysis of this protein sequence reveals the following:

```
possible site: 21
>>> Seems to have no N-terminal signal sequence

----- Final Results -----
          bacterial cytoplasm --- Certainty = 0.3393(Affirmative) < succ>
          bacterial membrane  --- Certainty = 0.0000(Not Clear)   < succ>
          bacterial outside   --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1739

A DNA sequence (GBSx1846) was identified in *S. agalactiae* <SEQ ID 5399> which encodes the amino acid sequence <SEQ ID 5400>. Analysis of this protein sequence reveals the following:

```
Possible site: 16
>>> Seems to have no N-terminal signal sequence

----- Final Results -----
          bacterial cytoplasm --- Certainty = 0.3168(Affirmative) < succ>
          bacterial membrane  --- Certainty = 0.0000(Not Clear)   < succ>
          bacterial outside   --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1740

A DNA sequence (GBSx1847) was identified in *S. agalactiae* <SEQ ID 5401> which encodes the amino acid sequence <SEQ ID 5402>. This protein is predicted to be gls24. Analysis of this protein sequence reveals the following:

```
Possible site: 61
>>> Seems to have no N-terminal signal sequence

----- Final Results -----
             bacterial cytoplasm --- Certainty = 0.2718(Affirmative) < succ>
              bacterial membrane --- Certainty = 0.0000(Not Clear)   < succ>
                bacterial outside --- Certainty = 0.0000(Not Clear)   < succ>
```

The protein has homology with the following sequences in the GENPEPT database.

```
>GP: AAA86383 GB: U23376 putative 20-kDa protein [Lactococcus lactis]
Identities = 95/157 (60%), Positives = 120/157 (75%)

Query:  18 VRGELTFEDKVIEKIVGIAIEHVDGLLAVNGGFFSNLKNSVVNSDSVTDGVNVEVGKKQV    77
           ++G LT+EDKV++KIVG+A+E VDGLL+V GGFFSNL   ++N+D VT GV+VEVGK QV
Sbjct:  27 IKGALTYEDKVVQKIVGLALESVDGLLSVEGGFFSNLTGKLINTDDVTTGVDVEVGKTQV    86

Query:  78 AVDLDIVAEYQKHVPTIFADIKKVVEAEVKRMTDLEVVEVNVNVVDIKTRAQHEEDSVTL   137
           AVDL +V EY+K+VP I+   IK+V+  EV  MT+LEVVEVNV V DIKT+ Q +ED V++
Sbjct:  87 AVDLKVVTEYRKNVPDIYEKIKEVIRKEVAAMTELEVVEVNVTVTDIKTKEQQKEDDVSI   146

Query: 138 QDRVTSAAQATGEFASNQVSNVKSAVGSGVDKVEDMK                        174
           QDRVTSAAQ TG+F S QV  VK V   DK  +K
Sbjct: 147 QDRVTSAAQTTGKFTSEQVDKVKDKVEDNTDKEARVK                        183
```

A related DNA sequence was identified in *S. pyogenes* <SEQ ID 5403> which encodes the amino acid sequence <SEQ ID 5404>. Analysis of this protein sequence reveals the following:

```
Possible site: 53
>>> Seems to have no N-terminal signal sequence

----- Final Results -----
             bacterial cytoplasm --- Certainty = 0.3896(Affirmative) < succ>
              bacterial membrane --- Certainty = 0.0000(Not Clear)   < succ>
                bacterial outside --- Certainty = 0.0000(Not Clear)   < succ>
```

An alignment of the GAS and GBS proteins is shown below.

```
Identities = 123/180 (68%), Positives = 158/180 (87%), Gaps = 1/180 (0%)

Query:   1 MTETYIKNTTNNSGTTAVRGELTFEDKVIEKIVGIAIEHVDGLLAVNGGFFSNLKNSVVN    60
           MTETYIKNT+ +   T+A+RG+LT++DKVIEKIVG+A+E+VDGLL VNGGFF+NLK+ +VN
Sbjct:   1 MTETYIKNTSKDL-TSAIRGQLTYDDKVIEKIVGLALENVDGLLGVNGGFFANLKDKLVN    59

Query:  61 SDSVTDGVNVEVGKKQVAVDLDIVAEYQKHVPTIFADIKKVVEAEVKRMTDLEVVEVNVN   120
           ++SV DGVNVEVGKKQVAVDLDIVAEYQKHVPTI+   IK +VE EVKRMTDL+V+EVNV
Sbjct:  60 TESVRDGVNVEVGKKQVAVDLDIVAEYQKHVPTIYDSIKSIVEEEVKRMTDLDVIEVNVK   119

Query: 121 VVDIKTRAQHEEDSVTLQDRVTSAAQATGEFASNQVSNVKSAVGSGVDKVEDMKSEPRVQ   180
           VVDIKT+ Q E + V+LQD+V+  A++T EF S+QV NVK++V +GV+K++D K+EPRV+
Sbjct: 120 VVDIKTKEQFEAEKVSLQDKVSDMARSTSEFTSHQVENVKASVDNGVEKLQDQKAEPRVK   179
```

Based on this analysis, it was predicted that these proteins and their epitopes could be useful antigens for vaccines or diagnostics.

EXAMPLE 1741

A DNA sequence (GBSx1848) was identified in *S. agalactiae* <SEQ ID 5405> which encodes the amino acid sequence <SEQ ID 5406>. This protein is predicted to be a 6-kDa protein. Analysis of this protein sequence reveals the following:

```
Possible site: 22
>>> Seems to have a cleavable N-term signal seq.
INTEGRAL    Likelihood = -9.29      Transmembrane     25-41 (23-52)

----- Final Results -----
            bacterial membrane --- Certainty = 0.4715 (Affirmative) < succ>
             bacterial outside --- Certainty = 0.0000 (Not Clear)   < succ>
           bacterial cytoplasm --- Certainty = 0.0000 (Not Clear)   < succ>
```

The protein has homology with the following sequences in the GENPEPT database.

```
>GP: AAA86382 GB: U23376 putative 6-kDa protein [Lactococcus lactis]
Identities = 27/61 (44%), Positives = 45/61 (73%)

Query:  3 EFVRKYRYPLGGAVIGLVLAAMIVTIGFFKTILALVIIVLGAYAGLYVQRTGMLDQFFNK  62
          ++  K RYP+ G ++G ++A  I TIGF+K IL L +I LG Y GL+++++G++DQF N+
Sbjct:  2 DYFEKNRYPIIGGIVGALIAVCIFTIGFWKMILVLFLIGLGIYIGLFLKKSGIIDQFINR  61

Query: 63 R                                                              63
          +
Sbjct: 62 K                                                              62
```

A related DNA sequence was identified in *S. pyogenes* <SEQ ID 5407> which encodes the amino acid sequence <SEQ ID 5408>. Analysis of this protein sequence reveals the following:

```
Possible site: 28
>>> Seems to have an uncleavable N-term signal seq
INTEGRAL    Likelihood = -11.73     Transmembrane     11-27 (6-50)
INTEGRAL    Likelihood = -7.11      Transmembrane     33-49 (27-50)

----- Final Results -----
            bacterial membrane --- Certainty = 0.5692 (Affirmative) < succ>
             bacterial outside --- Certainty = 0.0000 (Not Clear)   < succ>
           bacterial cytoplasm --- Certainty = 0.0000 (Not Clear)   < succ>
```

An alignment of the GAS and GBS proteins is shown below.

```
Identities = 28/61 (45%), Positives = 48/61 (77%)

Query:  3 EFVRKYRYPLGGAVIGLVLAAMIVTIGFFKTILALVIIVLGAYAGLYVQRTGMLDQFFNKR  63
          EF  K++YP+ G ++GL++A +++  G FKT+LA++ I+LG Y GLY ++TG++DQF N++
Sbjct:  2 EFYEKFKYPIIGGLVGLIIAILLMAFGLFKTLLAIIFIILGIYGGLYAKKTGIIDQFLNRK  62
```

A related GBS gene <SEQ ID 8891> and protein <SEQ ID 8892> were also identified. Analysis of this protein sequence reveals the following:

```
Lipop: Possible site: -1 Crend: 8
McG: Discrim Score: 12.56
GvH: Signal Score (-7.5): -1.11
Possible site: 22
>>> Seems to have a cleavable N-term signal seq.
ALOM program      count: 1       value: -9.29         threshold: 0.0
INTEGRAL          Likelihood = -9.29    Transmembrane 25-41 (23-52)
PERIPHERAL        Likelihood = 12.25    44
modified ALOM score: 2.36

*** Reasoning Step: 3

----- Final Results -----
            bacterial membrane --- Certainty = 0.4715 (Affirmative) < succ>
             bacterial outside --- Certainty = 0.0000 (Not Clear)   < succ>
           bacterial cytoplasm --- Certainty = 0.0000 (Not Clear)   < succ>
```

The protein has homology with the following sequences in the databases:

```
44.3/73.8% over 60aa
Lactococcus lactis
EGAD|42618|putative 6-kDa protein Insert characterized
GP|727435|gb|AAA86382.1||U23376 putative 6-kDa protein Insert characterized ORF01006(307-489 of 792)
EGAD|42618|45008(2-62 of 62) putative 6-kDa protein {Lactococcus lactis}
GP|727435|gb|AAA86382.1||U23376 putative 6-kDa protein {Lactococcus lactis}
% Match = 11.6
% Identity = 44.3  % Similarity = 73.8
Matches = 27    Mismatches = 16    Conservative Sub.s = 18
159         189         219         249         279         309         339         369
TNVPEQLEHIQSDVELGLKEFFGLEKKMNTRVFVKQVEEENVGNAKTNKSRVE*ESNMSEFVRKYRYPLGGAVIGLVLAA
                                                    ::   | |||:  |  ::|  ::|
                                                       MDYFEKNRYPIIGGIVGALIAV
                                                             10          20

399         429         459         489         519         549         579         609
MIVTIGFFKTILALVIIVLGAYAGLYVQRTGMLDQFFNKRK*NFSFIFILHYLNKRKRNYYD*NLHQKHN*QFWHDSCSW
  ||||:| ||  |  :|  ||  | ||::::|:::|||  |::
CIFTIGFWKMILVLFLIGLGIYIGLFLKKSGIIDQFINRK
           40          50          60
```

Figure 263:
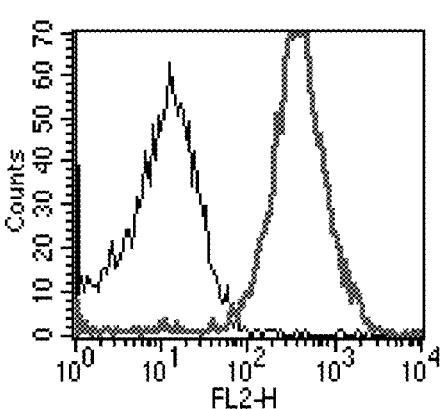

SEQ ID 5406 (GBS14) was expressed in *E. coli* as a GST-fusion product. SDS-PAGE analysis of total cell extract is shown in FIG. 9 (lane 4; MW 33.3 kDa). The GBS14-GST fusion product was purified (FIG. 190, lane 8) and used to immunise mice. The resulting antiserum was used for FACS (FIG. 263), which confirmed that the protein is immunoaccessible on GBS bacteria.

Based on this analysis, it was predicted that these proteins and their epitopes could be useful antigens for vaccines or diagnostics.

EXAMPLE 1742

A DNA sequence (GBSx1849) was identified in *S. agalactiae* <SEQ ID 5409> which encodes the amino acid sequence <SEQ ID 5410>. Analysis of this protein sequence reveals the following:

```
Possible site: 27
>>> Seems to have an uncleavable N-term signal seq
INTEGRAL    Likelihood = -18.63        Transmembrane    61-77 (51-83)
INTEGRAL    Likelihood = -7.91         Transmembrane    10-26 (7-28)

----- Final Results -----
            bacterial membrane  --- Certainty = 0.8451 (Affirmative) < succ>
            bacterial outside   --- Certainty = 0.0000 (Not Clear)   < succ>
            bacterial cytoplasm --- Certainty = 0.0000 (Not Clear)   < succ>
```

The protein has no significant homology with any sequences in the GENPEPT database.

A related DNA sequence was identified in *S. pyogenes* <SEQ ID 5411> which encodes the amino acid sequence <SEQ ID 5412>. Analysis of this protein sequence reveals the following:

```
Possible site: 29
>>> Seems to have a cleavable N-term signal seq.
INTEGRAL    Likelihood = -16.19        Transmembrane    71-87 (63-93)

----- Final Results -----
            bacterial membrane  --- Certainty = 0.7474 (Affirmative) < succ>
            bacterial outside   --- Certainty = 0.0000 (Not Clear)   < succ>
            bacterial cytoplasm --- Certainty = 0.0000 (Not Clear)   < succ>
```

The protein has no significant homology with any sequences in the GENPEPT database.

An alignment of the GAS and GBS proteins is shown below.

```
Identities = 87/193 (45%), Positives = 127/193 (65%), Gaps = 4/193 (2%)

Query:    1 MSKGLKSLYTLLGLISLTLLGFVAVISKQHIYLP-SFNWLDWDFN-LPSPIDVGMYHYFF   58
            MSK LK  Y L+GL+ L++ G+V  I+   +IYLP S+ WL W  +  P+ +D    + +Y+F
Sbjct:    9 MSKLLKISYCLVGLVLLSVFGWVVGITGGYIYLPYSYRWLSWGMDSFPNLLDSALSYYYF   68

Query:   59 WGALVLFVIVLLAILVVLFYPRRYTEYKLA--DKTGKLMLKKSAIEGFVKTEVLKTGLMK  116
            W ALVLFVI  LA+LV++ YPR YTE +L    +K G L+LKKSAIE +V T +    GLM
Sbjct:   69 WTALVLFVITFLALLVIILYPRIYTEVQLRHKNKKGTLLLKKSAIESYVATAIQTAGLMP  128

Query:  117 SPSVTAHLYKKKVKVDVKGLLTSRTNVPEQLEHIQSDVELGLKEFFGLEKKMNTRVFVKQ  176
            +P+VTA LYK+K  + VKG L SR  V +Q+  ++  +E GL EFFG+     +N +V+VK
Sbjct:  129 NPTVTAKLYKRKFNIIVKGRLASRVAVADQISGVKEGIEKGLTEFFGINYPVNFKVYVKD  188

Query:  177 VEEENVGNAKTNK                                                189
            + + +    +     N+
Sbjct:  189 IADSDRKHITRNR                                                201
```

Based on this analysis, it was predicted that these proteins and their epitopes could be useful antigens for vaccines or diagnostics.

EXAMPLE 1743

A DNA sequence (GBSx1850) was identified in *S. agalactiae* <SEQ ID 5413> which encodes the amino acid sequence <SEQ ID 5414>. Analysis of this protein sequence reveals the following:

```
Possible site: 17
>>> Seems to have an uncleavable N-term signal seq
      INTEGRAL      Likelihood = -9.82      Transmembrane      56-72 (52-81)
      INTEGRAL      Likelihood = -6.42      Transmembrane       4-20 (1-23)

----- Final Results -----
              bacterial membrane --- Certainty = 0.4927(Affirmative) < succ>
              bacterial outside  --- Certainty = 0.0000(Not Clear)   < succ>
              bacterial cytoplasm --- Certainty = 0.0000(Not Clear)  < succ>
```

The protein has homology with the following sequences in the GENPEPT database.

```
>GP: CAB12244 GB: Z99106 similar to hypothetical proteins
from B. subtilis [Bacillus subtilis]
Identities = 31/76 (40%), Positives = 48/76 (62%)

Query:    1 MSLIWSLIVGAIIGAIAGAVTNKGGSMGWIANILAGLVGSFVGQSLLGTWGPKLAGMALI   60
            +S +   SL+V +IG I  A+        G    +++AGL+G++G  LLGTWGP LAG A+
Sbjct:    2 LSFLVSLVVAIVIGLIGSAIVGNRLPGGIFGSMIAGLIGAWIGHGLLGTWGPSLAGFAIF   61

Query:   61 PSIVGAIIVVIVTSFV                                             76
            P+I+GA I V +  +
Sbjct:   62 PAIIGAAIFVFLLGLI                                             77
```

A related DNA sequence was identified in *S. pyogenes* <SEQ ID 5415> which encodes the amino acid sequence <SEQ ID 5416>. Analysis of this protein sequence reveals the following:

```
Possible site: 55
>>> Seems to have a cleavable N-term signal seq.
      INTEGRAL      Likelihood = -7.59      Transmembrane      60-76 (56-80)

----- Final Results -----
              bacterial membrane --- Certainty = 0.4036(Affirmative) < succ>
              bacterial outside  --- Certainty = 0.0000(Not Clear)   < succ>
              bacterial cytoplasm --- Certainty = 0.0000(Not Clear)  < succ>
```

The protein has homology with the following sequences in the databases:

```
>GP: CAB12244 GB: Z99106 similar to hypothetical
proteins from B. subtilis [Bacillus subtilis]
Identities = 28/76 (36%), Positives = 47/76 (61%)

Query:   1 MGLIWTLIVGALIGVIAGALTKKGGSMGWIANIAAGLVGSSVGQALLGSWGPSLAGMSLI  60
             +  + +L+V  +IG+I  A+          G    ++ AGL+G+ +G  LLG+WGPSLAG ++
Sbjct:   2 LSFLVSLVVAIVIGLIGSAIVGNRLPGGIFGSMIAGLIGAWIGHGLLGTWGPSLAGFAIF  61

Query:  61 PSVIGAVIVVMITSFV                                              76
             P++IGA  I  V +   +
Sbjct:  62 PAIIGAAIFVFLLGLI                                              77
```

An alignment of the GAS and GBS proteins is shown below.

```
Identities = 63/82 (76%), Positives = 74/82 (89%)

Query:   1 MSLIWSLIVGAIIGAIAGAVTNKGGSMGWIANILAGLVGSFVGQSLLGTWGPKLAGMALI  60
             M LIW+LIVGA+IG IAGA+T KGGSMGWIANI AGLVGS VGQ+LLG+WGP LAGM+LI
Sbjct:   1 MGLIWTLIVGALIGVIAGALTKKGGSMGWIANIAAGLVGSSVGQALLGSWGPSLAGMSLI  60

Query:  61 PSIVGAIIVVIVTSFVLGKMNN                                       82
             PS++GA+IVV++TSFVL K NN
Sbjct:  61 PSVIGAVIVVMITSFVLNKTNN                                       82
```

Based on this analysis, it was predicted that these proteins and their epitopes could be useful antigens for vaccines or diagnostics.

EXAMPLE 1744

A DNA sequence (GBSx1851) was identified in *S. agalactiae* <SEQ ID 5417> which encodes the amino acid sequence <SEQ ID 5418>. Analysis of this protein sequence reveals the following:

```
Possible site: 59
>>> Seems to have no N-terminal signal sequence
     INTEGRAL    Likelihood = -9.82    Transmembrane   88-104 (84-111)
     INTEGRAL    Likelihood = -8.07    Transmembrane   29-45 (27-54)

----- Final Results -----
              bacterial membrane --- Certainty = 0.4927(Affirmative) < succ>
               bacterial outside --- Certainty = 0.0000(Not Clear)  < succ>
             bacterial cytoplasm --- Certainty = 0.0000(Not Clear)  < succ>
```

The protein has homology with the following sequences in the GENPEPT database.

```
>GP: CAB12244 GB: Z99106 similar to hypothetical proteins
from B. subtilis [Bacillus subtilis]
Identities = 29/77 (37%), Positives = 47/77 (60%)

Query:  31 IMGLIWSLIVGAIIGAIAGAITNKGGSMGWIANILAGLVGSFVGQSLLGTWGPKLADMAL  90
            ++  + SL+V  +IG I  AI         G    +++AGL+G+++G  LLGTWGP LA   A+
Sbjct:   1 MLSFLVSLVVAIVIGLIGSAIVGNRLPGGIFGSMIAGLIGAWIGHGLLGTWGPSLAGFAI  60

Query:  91 IPSIVGAIIVIIVTSFV                                            107
             P+I+GA  I + +   +
Sbjct:  61 FPAIIGAAIFVFLLGLI                                            77
```

There is also homology to SEQ ID 5416:

```
Identities = 60/79 (75%), Positives = 72/79 (90%)

Query:  32 MGLIWSLIVGAIIGAIAGAITNKGGSMGWIANILAGLVGSFVGQSLLGTWGPKLADMALI  91
             MGLIW+LIVGA+IG IAGA+T KGGSMGWIANI AGLVGS VGQ+LLG+WGP LA M+LI
Sbjct:   1 MGLIWTLIVGALIGVIAGALTKKGGSMGWIANIAAGLVGSSVGQALLGSWGPSLAGMSLI  60
```

-continued

```
Query:  92 PSIVGAIIVIIVTSFVLGK                                          110
           PS++GA+IV+++TSFVL K
Sbjct:  61 PSVIGAVIVVMITSFVLNK                                           79
```

Based on this analysis, it was predicted that these proteins and their epitopes could be useful antigens for vaccines or diagnostics.

EXAMPLE 1745

A DNA sequence (GBSx1852) was identified in *S. agalactiae* <SEQ ID 5419> which encodes the amino acid sequence <SEQ ID 5420>. This protein is predicted to be ATP-dependent DNA helicase Rep (uvrD). Analysis of this protein sequence reveals the following:

```
Possible site: 22
>>> Seems to have no N-terminal signal sequence

----- Final Results -----
              bacterial cytoplasm --- Certainty = 0.1364(Affirmative) < succ>
              bacterial membrane  --- Certainty = 0.0000(Not Clear)   < succ>
               bacterial outside  --- Certainty = 0.0000(Not Clear)   < succ>
```

A related GBS nucleic acid sequence <SEQ ID 9863> which encodes amino acid sequence <SEQ ID 9864> was also identified.

The protein has homology with the following sequences in the GENPEPT database.

```
>GP: AAD51119 GB: AF176554 DNA helicase
PcrA [Leuconostoc citreum]
Identities = 414/764 (54%), Positives = 537/764 (70%),
Gaps = 23/764 (3%)

Query:   6 VEMNPLIIGMNDKQAEAVQTTDGPLLIMAGAGSGKTRVLTHRIAYLIDEKYVNPWNILAI    65
           + + L GMN+KQAEAVQTT+GPLLIMAGAGSGKTRVLTHRIA+L+ +  V PW ILAI
Sbjct:   1 MSVETLTNGMNNKQAEAVQTTEGPLLIMAGAGSGKTRVLTHRIAHLVQDLNVFPWRILAI    60

Query:  66 TFTNKAAREMRERAIAL--NPATQDTLIATFHSMCVRILRREADYIGYNRNFTIVDPGEQ   123
           TFTNKAAREMRER  AL     +D  ++TFH++ VRILRR+ + IG  +NFTI+D    Q
Sbjct:  61 TFTNKAAREMRERIAALLSEDVARDIWVSTFHALAVRILRRDGEAIGLAKNFTIIDTSAQ   120

Query: 124 RTLMKRIIKQLNLDTKKWNERSILGTISNAKNDLLDEIAYEKQAGDMYTQVIAKCYKAYQ   183
           RTLMKR+I  LNLDT +++ R+ILG ISNAKND+L      Y K A + + +A+ Y AYQ
Sbjct: 121 RTLMKRVINDLNLDTNQYDPRTILGMISNAKNDMLQPRDYAKAADNAFQETVAEVYTAYQ   180

Query: 184 EELRRSEAMDFDDLIMMTLRLFDQNKDVLAYYQQRYQYIHVDEYQDTNHAQYQLVKLLAS   243
           EL+RS+++DFDDLIM+T+ LF   DVLA YQQ+++Y+HVDEYQDTN AQY +V LLA
Sbjct: 181 AELKRSQSVDFDDLIMLTIDLFQSAPDVLARYQQQFEYLHVDEYQDTNDAQYTIVNLLAQ   240

Query: 244 RFKNICVVGDADQSIYGWRGADMQNILDFEKDYPQAKVVLLEENYRSTKKILQAANNVIN   303
           R KN+ VVGDADQSIYGWRGA+M NIL+FEKDYP A  V+LE+NYRST+ IL AAN VIN
Sbjct: 241 RSKNLAVVGDADQSIYGWRGANMNNILNFEKDYPNAHTVMLEQNYRSTQNILDAANAVIN   300

Query: 304 HNKNRRPKKLWTQNDEGEQIVYHRANNEQEEAVFVASTIDNIVREQGKNFKDFAVLYRTN   363
           HN  R  PKKLWT+N +G+QI Y+RA  E +EA F+ S I  +    +   + DFAVLYRTN
Sbjct: 301 HNNERVPKKLWTENGKGDQITYYRAQTEHDEANFILSNIQQLRETKHMAYSDFAVLYRTN   360

Query: 364 AQSRTIEEALLKSNIPYTMVGGTKFYSRKEIRDVIAYLNILANTSDNISFERIVNEPKRG   423
           AQSR IEE+L+K+N+PY+MVGG KFY RKEI D++AY++++  N  DN +FER+VNEPKRG
Sbjct: 361 AQSRNIEESLVKANMPYSMVGGHKFYERKEILDIMAYMSLITNPDDNAAFERVVNEPKRG   420

Query: 424 VGPGTLEKIRSFAYEQSMSLLDASSNVMMSP-LKGKAAQAVWDLANLILTLRSNLDSLTV   482
           +G  +L ++R  A   ++S + A  ++  ++P + KAA       A ++   LR   + L V
Sbjct: 421 LGATSLTRLRELANRLNVSYMKAIGSIELAPSITTKAASKFLTFAEMMHNLRQQSEFLNV   480

Query: 483 TEITENLLDKTGYLEALQVQNTLESQARIENIEEFLSVTKNFDDNPEITVEGETGLDRLS   542
           TE+TE ++  ++GY + L   +N  +SQAR+EN+EEFLSVTK FDD    +    E   +D ++
Sbjct: 481 TELTELVMTQSGYRQMLAEKNDPDSQARLENLEEFLSVTKEFDD--KYQPEDPESIDPVT   538

Query: 543 RFLNDLALIADTDDSATETAEVTLMTLHAAKGLEFPVVFLIGMEEGVFPLSRAIEDADEL   602
           FL   AL++D DD         VTLMTLHAAKGLEFPVVFLIG++EG+FPLSRA+ D D L
```

-continued

```
Sbjct: 539 DFLGTTALMSDLDDFEEGDGAVTLMTLHAAKGLEFPVVFLIGLKEGIFPLSRAMMDEDLL 598

Query: 603 EEERRLAYVGITRAEQILFLTNANTRTLFGKTSYNRPTRFIREIDDELIQ--YQGLARPV 660
            EEERRLAYVGITRA + LFLTNA +R L+G+T  N P+RFI EI  EL++  Y GL+R
Sbjct: 599 EEERRLAYVGITRAMKKLFLTNAFSRLLYGRTQANEPSRFIAEISPELLETAYSGLSRDK 658

Query: 661 NSSFGVKYSKEQPTQFGQGMSLQQALQARKSNSQSQVTAQLQALN-ANNSHETSWEIGDV 719
            + + ++                       R + +  Q T   +  N       +TSW  GD
Sbjct: 659 TQKKTLPFDRK---------------MQRATATTYQATPVTKITNGVTGGDQTSWSTGDK 703

Query: 720 ATHKKWGDGTVLEVSGSGKTQELKINFPGIGLKKLLASVAPISK 763
            +HKKWG GTV+ VSG    QELK+ FP  G+K+LLA+ API K
Sbjct: 704 VSHKKWGVGTVISVSGRADDQELKVAFPSEGVKQLLAAFAPIQK 747
```

A related DNA sequence was identified in *S. pyogenes* <SEQ ID 5421> which encodes the amino acid sequence <SEQ ID 5422>. Analysis of this protein sequence reveals the following:

```
Possible site: 15
>>> Seems to have no N-terminal signal sequence

----- Final Results -----
            bacterial cytoplasm --- Certainty = 0.0214(Affirmative) < succ>
            bacterial membrane  --- Certainty = 0.0000(Not Clear)   < succ>
             bacterial outside  --- Certainty = 0.0000(Not Clear)   < succ>
```

An alignment of the GAS and GBS proteins is shown below.

```
Identities = 622/772 (80%), Positives = 699/772 (89%),
Gaps = 15/772 (1%)

Query:   8 MNPLIIGMNDKQAEAVQTTDGPLLIMAGAGSGKTRVLTHRIAYLIDEKYVNPWNILAITF  67
           MNPL+ GMND+QA+AVQTT+GPLLIMAGAGSGKTRVLTHRIAYLIDEK+VNPWNILAITF
Sbjct:   1 MNPLLNGMNDRQAQAVQTTEGPLLIMAGAGSGKTRVLTHRIAYLIDEKFVNPWNILAITF  60

Query:  68 TNKAAREMRERAIALNPATQDTLIATFHSMCVRILRREADYIGYNRNFTIVDPGEQRTLM 127
           TNKAAREM+ERA+ALNPAT+DTLIATFHSMCVRILRREAD+IGYNRNFTIVDPGEQRTLM
Sbjct:  61 TNKAAREMKERALALNPATKDTLIATFHSMCVRILRREEADHIGYNRNFTIVDPGEQRTLM 120

Query: 128 KRIIKQLNLDTKKWNERSILGTISNAKNDLLDEIAYEKQAGDMYTQVIAKCYKAYQEELR 187
           KRI+KQLN+D KKWNERSILGTISNAKNDLLDE  YE QA DMY+Q++A+CYKAYQEELR
Sbjct: 121 KRILKQLNIDPKKWNERSILGTISNAKNDLLDEKGYEAQAADMYSQIVARCYKAYQEELR 180

Query: 188 RSEAMDFDDLIMMTLRLFDQNKDVLAYYQQRYQYIHVDEYQDTNHAQYQLVKLLASRFKN 247
           RSEA+DFDDLIMMTLRLFD N DVLAYYQQRYQYIHVDEYQDTNHAQYQL+KLLASRFKN
Sbjct: 181 RSEALDFDDLIMMTLRLFDANPDVLAYYQQRYQYIHVDEYQDTNHAQYQLIKLLASRFKN 240

Query: 248 ICVVGDADQSIYGWRGADMQNILDFEKDYPQAKVVLLEENYRSTKKILQAANNVINHNKN 307
           ICVVGDADQSIYGWRGADMQNILDFEKDYP AKVVLLEENYRSTKKILQAAN+VIN+N+N
Sbjct: 241 ICVVGDADQSIYGWRGADMQNILDFEKDYPDAKVVLLEENYRSTKKILQAANDVINNRN 300

Query: 308 RRPKKLWTQNDEGEQIVYHRANNEQEEAVFVASTIDNIVREQGKNFKDFAVLYRTNAQSR 367
           RRPKKLWTQN +GEQ+VY+RAN+E++EAVFVASTI N+ +E GKNFKDFAVLYRTNAQSR
Sbjct: 301 RRPKKLWTQNADGEQLVYYRANDERDEAVFVASTISNMSQELGKNFKDFAVLYRTNAQSR 360

Query: 368 TIEEALLKSNIPYTMVGGTKFYSRKEIRDVIAYLNILANTSDNISFERIVNEPKRGVGPG 427
           TIEEALLKSNIPYTMVGGTKFYSRKEIRD+IAYL I+AN +DNISFERIVNEPKRGVGPG
Sbjct: 361 TIEEALLKSNIPYTMVGGTKFYSRKEIRDLIAYLTIVANPADNISFERIVNEPKRGVGPG 420

Query: 428 TLEKIRSFAYEQSMSLLDASSNVMMSPLKGKAAQAVWDLANLILTLRSNLDSLTVTEITE 487
           TL+K+R FAYE   SLL+A+SN++MSPLKGKAAQA+ DLAN++  LR  +LD +++T++ E
Sbjct: 421 TLDKLRQFAYESDQSLLEAASNLLMSPLKGKAAQAIMDLANILGQLRQDLDQMSITDLAE 480

Query: 488 NLLDKTGYLEALQVQNTLESQARIENIEEFLSVTKNFDDNPEITVEGETGLDRLSRFLND 547
           LL+KTGYL++L+++QNTLESQARIENIEEFLSVTKNFD++   E ETG+DRL RFLND
Sbjct: 481 ALLEKTGYLDSLRLQNTLESQARIENIEEFLSVTKNFDESSASQEEDETGVDRLGRFLND 540

Query: 548 LALIADTDDSATETAEVTLMTLHAAKGLEFPVVFLIGMEEGVFPLSRAIEDADELEEERR 607
           LALIADTDDS E AEVTLMTLHAAKGLEFPVVFLIGMEEGVFPLSRA ED  DELEEERR
Sbjct: 541 LALIADTDDSQAEAAEVTLMTLHAAKGLEFPVVFLIGMEEGVFPLSRASEDPDELEEERR 600

Query: 608 LAYVGITRAEQILFLTNANTRTLFGKTSYNRPTRFIREIDDELIQYQGLARPVNSSFGVK 667
           LAYVGITRAE++LF+TNANTRTLFGK+SYNRPTRF++EI +EL+ Y+GLARP  SSFGV+
Sbjct: 601 LAYVGITRAEEVLFMTNANTRTLFGKSSYNRPTRFLKEISEELLSYKGLARPAQSSFGVR 660
```

-continued

```
Query: 668 YSKEQPTQFGQGMSLQQALQARKSNSQSQVTAQ-LQA-------------LNANNS-HET 712
            +S  E   TQFGQGMSL +ALQARK+ +Q + +AQ +QA              +N+S  E
Sbjct: 661 FSTETHTQFGQGMSLSEALQARKAQAQVRQSAQPMQAHTIPSASTSSVLPFGSNSSVEEV 720

Query: 713 SWEIGDVATHKKWGDGTVLEVSGSGKTQELKINFPGIGLKKLLASVAPISKK          764
            +W+IGD+A HKKWGDGTVLEVSGSGKT ELKI FP +GLKKLLASVAPI KK
Sbjct: 721 TWQIGDIAHHKKWGDGTVLEVSGSGKTMELKIKFPEVGLKKLLASVAPIEKK          772
```

Based on this analysis, it was predicted that these proteins and their epitopes could be useful antigens for vaccines or diagnostics.

EXAMPLE 1746

A DNA sequence (GBSx1853) was identified in *S. agalactiae* <SEQ ID 5423> which encodes the amino acid sequence <SEQ ID 5424>. Analysis of this protein sequence reveals the following:

```
Possible site: 43
>>> Seems to have no N-terminal signal sequence

----- Final Results -----
            bacterial cytoplasm --- Certainty = 0.4741(Affirmative) < succ>
              bacterial membrane --- Certainty = 0.0000(Not Clear)   < succ>
               bacterial outside --- Certainty = 0.0000(Not Clear)   < succ>
```

The protein has homology with the following sequences in the GENPEPT database.

```
>GP:AAA88579 GB:M14339 unknown [Streptococcus pneumoniae]
Identities = 43/57 (75%), Positives = 50/57 (87%)
Query:  41 AHGGYLFTLCDQVSGLVAISTG-                                    97
            YEAVTLQSNINYLRAGRLDDLLTVIGTCVHNGRTT
            AHGGYLFTLCDQ+SGLV IS G + VTLQS+INYL+AG+LDD+LT+ G CVH GRTT
Sbjct:   1 AHGGYLFTLCDQISGLVVIS-                                       57
            LGLDGVTLQSSINYLKAGKLDDVLTIKGECVHQGRTT
```

A related DNA sequence was identified in *S. pyogenes* <SEQ ID 5425> which encodes the amino acid sequence <SEQ ID 5426>. Analysis of this protein sequence reveals the following:

```
Possible site: 48
>>> Seems to have no N-terminal signal sequence

----- Final Results -----
            bacterial cytoplasm --- Certainty = 0.1210 (Affirmative) < succ>
              bacterial membrane --- Certainty = 0.0000 (Not Clear)  < succ>
               bacterial outside --- Certainty = 0.0000 (Not Clear)  < succ>
```

An alignment of the GAS and GBS proteins is shown below.

```
Identities = 57/97 (58%), Positives = 74/97 (75%)
Query:   2  KFNLEQVKVFENYEIENWEEGQVTLTTKVVDSSLNYYGNAHGGYLFTLCDQVSGLVAIST   61
            +  L  + +F+NY+IE  E+G + L+T+V +++LNYYGNAHGGYLFTLCDQV GLVA +T
Sbjct:   7  EMTLNVISIFDNYQIELAEKGHLILSTEVTETALNYYGNAHGGYLFTLCDQVGGLVARTT   66

Query:  62  GYEAVTLQSNINYLRAGRLDDLLTVIGTCVHNGRTTK                         98
            G E+VTLQ+N NYL+AG   D L V G  VH GRTT+
Sbjct:  67  GVESVTLQANANYLKAGHKGDKLMVEGRLVHGGRTTQ                        103
```

Based on this analysis, it was predicted that these proteins and their epitopes could be useful antigens for vaccines or diagnostics.

EXAMPLE 1747

A DNA sequence (GBSx1854) was identified in *S. agalactiae* <SEQ ID 5427> which encodes the amino acid sequence <SEQ ID 5428>. Analysis of this protein sequence reveals the following:

```
Possible site: 22
>>> Seems to have no N-terminal signal sequence

----- Final Results -----
            bacterial cytoplasm --- Certainty = 0.3187 (Affirmative) < succ>
             bacterial membrane --- Certainty = 0.0000 (Not Clear)  < succ>
              bacterial outside --- Certainty = 0.0000 (Not Clear)  < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1748

A DNA sequence (GBSx1855) was identified in *S. agalactiae* <SEQ ID 5429> which encodes the amino acid sequence <SEQ ID 5430>. This protein is predicted to be uracil permease (uraA). Analysis of this protein sequence reveals the following:

```
Possible site: 54
>>> Seems to have no N-terminal signal sequence
INTEGRAL    Likelihood = -8.65      Transmembrane 122-138 (117-146)
INTEGRAL    Likelihood = -8.65      Transmembrane 212-228 (204-233)
INTEGRAL    Likelihood = -7.32      Transmembrane  60-76   (49-80)
INTEGRAL    Likelihood = -6.53      Transmembrane 149-165 (145-172)
INTEGRAL    Likelihood = -6.48      Transmembrane 402-418 (401-420)
INTEGRAL    Likelihood = -4.04      Transmembrane 422-438 (420-445)
INTEGRAL    Likelihood = -3.72      Transmembrane 365-381 (364-385)
INTEGRAL    Likelihood = -3.40      Transmembrane 184-200 (182-202)
INTEGRAL    Likelihood = -3.08      Transmembrane 346-362 (345-363)
INTEGRAL    Likelihood = -1.38      Transmembrane 260-276 (260-276)

----- Final Results -----
             bacterial membrane --- Certainty = 0.4461 (Affirmative) < succ>
              bacterial outside --- Certainty = 0.0000 (Not Clear)  < succ>
            bacterial cytoplasm --- Certainty = 0.0000 (Not Clear)  < succ>
```

A related GBS nucleic acid sequence <SEQ ID 9865> which encodes amino acid sequence <SEQ ID 9866> was also identified.

The protein has homology with the following sequences in the GENPEPT database.

```
>GP:CAA53697 GB:X76083 uracil permease [Bacillus caldolyticus]
Identities = 208/416 (50%), Positives = 291/416 (69%), Gaps = 11/416 (2%)
Query:   32 LLDIDEKPELFQGLLLSFQHVFAMFGATILVPLILGMPVSVALFASGCGTLIYQVATKFK    91
            +LDI ++P + Q + LS QH+FAMFGATILVP ++G+  S+AL  SG GTL + + TK++
Sbjct:    5 VLDIQDRPTVGQWITLSLQHLFAMFGATILVPYLVGLDPSIALLTSGLGTLAFLLITKWQ    64

Query:   92 VPVYLGSSFAYITAMALAMKQMHGDISAAQTGILFVGLIYVVVATVIKFVGNSWVDKILP   151
            VP YLGSSFAYI + A + G   AA G    GL+Y VVA +IK  G  WV K+LP
Sbjct:   65 VPAYLGSSFAYIAPIIAA--KTAGGPGAAMIGSFLAGLVYGVVALIIKKAGYRWVMKLLP   122

Query:  152 PIIIGPMIIVIGLGLANSAVTNA--GFVAKGDWRKMLVAVVTFLIAAFINTKGKGFIKII   209
            P+++GP+IIVIGLGLA +AV  A G   K         VA+VT   +    +G + +I
Sbjct:  123 PVVVGPVIIVIGLGLAGTAVGMAMNGPDGKYSLLHFSVALVTLAATIVCSVLARGMLSLI   182
```

-continued

```
Query:  210  PFLFAIIGGYILSIILGLVDLSPVEKAAWFELPKFYLPFKTGLFHSYKLYFGPEMLAIL-  268
             P L  I+ GY+ ++ +GLVDLS V  A  WFE P F +PF       Y +    E++ ++
Sbjct:  183  PVLVGIVVGYLYALAVGLVDLSKVAAAKWFEWPDFLIPFA-----DYPVRVTWEIVMLMV  237

Query:  269  PISIVTIAENIGDHTVLGQICGRNFLKKPGLNRLLIGDGLATAFSALIGGPAETTYGENT  328
             P++IVT++E+IG    VL ++ GR+ ++KPGL+R ++GDG AT  SAL+GGP +TTYGEN
Sbjct:  238  PVAIVTLSEHIGHQLVLSKVVGRDLIQKPGLHRSILGDGTATMISALLGGPPKTTYGENI  297

Query:  329  GVIGMTRIASVTVIRNAAFIAIAFSFFGKFTALISTIPSAVLGGMAILLYGVIASNGLKV  388
             GV+ +TR+ SV V+  AA IAIAF F GK TALIS+IP+  V+GG++ILL+G+IAS+GL++
Sbjct:  298  GVLAITRVYSVYVLAGAAVIAIAFGFVGKITALISSIPTPVMGGVSILLFGIIASSGLRM  357

Query:  389  LIENRVNFAEVRNLIIASSMLVLGLGGAVLDLG-ALTLSGTALSAIVGIILNLILP      443
             LI++RV+F + RNL+IAS +LV+G+GGAVL +  +   ++G ALSAIVG++LNLILP
Sbjct:  358  LIDSRVDFGQTRNLVIASVILVIGIGGAVLKISDSFQITGMALSAIVGVLLNLILP      413
```

15

A related DNA sequence was identified in *S. pyogenes* <SEQ ID 5431> which encodes the amino acid sequence <SEQ ID 5432>. Analysis of this protein sequence reveals the following:

```
Possible site: 27
>>> Seems to have no N-terminal signal sequence
INTEGRAL    Likelihood = -10.72    Transmembrane 177-193  (171-206)
INTEGRAL    Likelihood =  -8.55    Transmembrane 313-329  (304-339)
INTEGRAL    Likelihood =  -8.17    Transmembrane 154-170  (152-175)
INTEGRAL    Likelihood =  -7.91    Transmembrane 376-392  (374-395)
INTEGRAL    Likelihood =  -7.48    Transmembrane  25-41    (22-43)
INTEGRAL    Likelihood =  -5.84    Transmembrane 120-136  (116-142)
INTEGRAL    Likelihood =  -4.99    Transmembrane  96-112   (90-117)
INTEGRAL    Likelihood =  -3.29    Transnembrane 339-355  (338-360)
INTEGRAL    Likelihood =  -1.91    Transnembrane 396-412  (396-413)

----- Final Results -----
            bacterial membrane --- Certainty = 0.5288 (Affirmative) < succ>
             bacterial outside --- Certainty = 0.0000 (Not Clear)   < succ>
           bacterial cytoplasm --- Certainty = 0.0000 (Not Clear)   < succ>
```

35

The protein has homology with the following sequences in the databases:

```
>GP:CAB89870 GB:AJ132624 uracil transporter [Lactococcus lactis]
Identities = 294/421 (69%), Positives = 359/421 (84%), Gaps = 5/421 (1%)
Query:    3  DVIYDVEEVPKAGMLVGLSFQHLFAMFGATVLVPILVGIDPSVALLSSGLGTLAHLSVTK   62
             D+I  V+E P A    GLSFQHLFAMFG+TVLVPILVGI+P++ALLSSGLGTLAH+SVTK
Sbjct:    5  DIILKVDEKPAASQWFGLSFQHLFAMFGSTVLVPILVGINPAIALLSSGLGTLAHMSVTK   64

Query:   63  FKIPAYMGSSFAYIAAMQLLMKTNGIGAVAQGAMTGGLVYLIVALIVKAIGNDWIDNILP  122
             FK+PAYMGSSFAYI AM LLMK G+ A+AQGAMTGGLVYLIVALIVK  G WID +LP
Sbjct:   65  FKVPAYMGSSFAYIGAMTLLMKNGGMPAIAQGAMTGGLVYLIVALIVKFAGKGWIDKVLP  124

Query:  123  PIVVGPIVMVIGLSLASTAVNDVMLKN----GNYNLTYLVIGLVTLLSVIFFNIYGKGIV  178
             PIVVGPIVMVIGLSLA TA+ND M +      Y+L Y++I L+T+LS++  ++IYGKG +
Sbjct:  125  PIVVGPIVMVIGLSLAPTAINDAMYTDVANLKGYSLAYIIIALITVLSIVVYSIYGKGFL  184

Query:  179  AIVPLLLGLLVGYVVALLVGVLTGQEIVDFTNVAQAKWFSIPSVEIPFLTYGVKFYPSAI  238
             ++VP+LLG++ GYV A+++G  +TG   IV FT ++QAKW ++P +EIPF +Y   FYPSAI
Sbjct:  185  SVVPILLGIITGYVAAMIIGKITGMNIVSFTGISQAKWLTLPPMEIPFASYKWAFYPSAI  244

Query:  239  LTMAPIAFVTMTEHFGHIMVLNSLTKRDYFKDPGLEKTLTGDGFAQIIAGFLGAPPVTSY  298
             LTMAPIAFVTMTEHFGHIMVLNSLTK+DYFK PGLEKTLTGDG AQIIAGF+GAPPVTSY
Sbjct:  245  LTMAPIAFVTMTEHFGHIMVLNSLTKKDYFKEPGLEKTLTGDGLAQIIAGFIGAPPVTSY  304

Query:  299  GENIGVMALNKIFSVYVIAGAAVIAALLSFIGKVSALIQSIPTPVIGGISVALFGVIASS  358
             GENIGVMA+ KI S+YVIAGAAV+A  ++SF+GK++AL+QSIP PVIGG S+ALFGVIA+S
Sbjct:  305  GENIGVMAITKIHSIYVIAGAAVLAIVVSFVGKITALLQSIPAPVIGGASIALFGVIAAS  364

Query:  359  GLKILIESKVDMDNKKNLLIASVILVSGIGGLMLQV-NGLQISGVAFSTLLGIILYQVLPE  418
             GLKIL+E+KVD D K+NLLI+SV+LV GIGG+++ +    LQIS  VA +T+LGI+L  VLP+
Sbjct:  365  GLKILVENKVDFDIKRNLLISSVVLVIGIGGMIINITQNLQISSVAIATILGIVLNLVLPK  425
```

65

An alignment of the GAS and GBS proteins is shown below.

```
Identities = 186/425 (43%), Positives = 282/425 (65%), Gaps = 17/425 (4%)
Query:  30 NLLLDIDEKPELFQGLLLSFQHVFAMFGATILVPLILGMPVSVALFASGCGTLIYQVATK    89
           +++ D++E P+    + LSFQH+FAMFGAT+LVP+++G+  SVAL +SG GTL +    TK
Sbjct:   3 DVIYDVEEVPKAGMLVGLSFQHLFAMFGATVLVPILVGIDPSVALLSSGLGTLAHLSVTK    62

Query:  90 FKVPVYLGSSFAYITAMALAMKQMHGDISAAQTGILFVGLIYVVVATVIKFVGNSWVDKI   149
           FK+P Y+GSSFAYI AM L MK      I A  G +  GL+Y++VA  ++K +GN W+D I
Sbjct:  63 FKIPAYMGSSFAYIAAMQLLMKT--NGIGAVAQGAMTGGLVYLIVALIVKAIGNDWIDNI   120

Query: 150 LPPIIIGPMIIVIGLGLANSAVTNAGFVAKGDWRK--MLVAVVTFLIAAFINTKGKGFIK   207
           LPPI++GP+++VIGL LA++AV +   +   G++      +++ +VT L   F N  GKG +
Sbjct: 121 LPPIVVGPIVMVIGLSLASTAVNDV-MLKNGNYNLTYLVIGLVTLLSVIFFNIYGKGIVA   179

Query: 208 IIPFLFAIIGGYILSIILG------LVDLSPVEKAAWFELPKFYLPFKTGLFHSYKLYFG   261
           I+P L  ++ GY++++++G          +VD + V +A WF +P    +PF T      Y + F
Sbjct: 180 IVPLLLGLLVGYVVALLVGVLTGQEIVDFTNVAQAKWFSIPSVEIPFLT-----YGVKFY   234

Query: 262 PE-MLAILPISIVTIAENIGDHTVLGQICGRNFLKKPGLNRLLIGDGLATAFSALIGGPA   320
           P  +L  +PI +VT +E +G    VL  +    R++ K PGL + L GDG A    + +G P
Sbjct: 235 PSAILTMAPIAFVTMTEHFGHIMVLNSLTKRDYFKDPGLEKTLTGDGFAQIIAGFLGAPP   294

Query: 321 ETTYGENTGVIGMTRIASVTVIRNAAFIAIAFSFFGKFTALISTIPSAVLGGMAILLYGV   380
            T+YGEN GV+ +  +I SV VI   AA IA    SF GK  +ALI +IP+ V+GG+++  L+GV
Sbjct: 295 VTSYGENIGVMALNKIFSVYVIAGAAVIAALLSFIGKVSALIQSIPTPVIGGISVALFGV   354

Query: 381 IASNGLKVLIENRVNFAEVRNLIIASSMLVLGLGGAVLDLGALTLSGTALSAIVGIILNL   440
           IAS+GLK+LIE++V+       +NL+IAS  +LV G+GG +L +  L +SG A S  ++GIIL
Sbjct: 355 IASSGLKILIESKVDMDNKKNLLIASVILVSGIGGLMLQVNGLQISGVAFSTLLGIILYQ   414

Query: 441 ILPKE                                                         445
           +LP++
Sbjct: 415 VLPEK                                                         419
```

Based on this analysis, it was predicted that these proteins and their epitopes could be useful antigens for vaccines or diagnostics.

EXAMPLE 1749

A DNA sequence (GBSx1856) was identified in *S. agalactiae* <SEQ ID 5433> which encodes the amino acid sequence <SEQ ID 5434>. Analysis of this protein sequence reveals the following:

```
Possible site: 20
>>> Seems to have no N-terminal signal sequence

----- Final Results -----
          bacterial cytoplasm --- Certainty = 0.3863 (Affirmative) < succ>
           bacterial membrane --- Certainty = 0.0000 (Not Clear)   < succ>
            bacterial outside --- Certainty = 0.0000 (Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1750

A DNA sequence (GBSx1857) was identified in *S. agalactiae* <SEQ ID 5435> which encodes the amino acid sequence <SEQ ID 5436>. This protein is predicted to be sodium/alanine symporter. Analysis of this protein sequence reveals the following:

```
Possible site: 22
>>> Seems to have no N-terminal signal sequence
INTEGRAL    Likelihood = -10.88     Transmembrane 191-207 (184-214)
```

```
-continued
INTEGRAL    Likelihood = -8.97     Transmembrane 151-167  (148-171)
INTEGRAL    Likelihood = -8.39     Transmembrane 217-233  (216-238)
INTEGRAL    Likelihood = -6.74     Transmembrane 312-328  (310-333)
INTEGRAL    Likelihood = -6.26     Transmembrane 357-373  (349-376)
INTEGRAL    Likelihood = -5.10     Transmembrane 424-440  (422-441)
INTEGRAL    Likelihood = -5.04     Transmembrane 396-412  (390-417)
INTEGRAL    Likelihood = -0.37     Transmembrane  25-41    (25-41)

----- Final Results -----
              bacterial membrane --- Certainty = 0.5352 (Affirmative) < succ>
               bacterial outside --- Certainty = 0.0000 (Not Clear)  < succ>
             bacterial cytoplasm --- Certainty = 0.0000 (Not Clear)  < succ>
```

A related GBS nucleic acid sequence <SEQ ID 9867> which encodes amino acid sequence <SEQ ID 9868> was also identified.

The protein has homology with the following sequences in the GENPEPT database.

```
>GP:AAC22541 GB:U32770 amino acid carrier protein, putative
[Haemophilus influenzae Rd]
Identities = 255/443 (57%), Positives = 333/443 (74%), Gaps = 4/443 (0%)
Query:  11  TLFTHINSFVWGPPLLALLVGTGIYLSFRLGFIQLRQLSRAFKLIFREDNG-QGDISSYA    69
            ++ + I+SF+WG PLL LL GTG+YL+  RLGFIQ+R L RA    +F++D G +GD+SS+A
Sbjct:   5  SILSAIDSFIWGAPLLILLSGTGLYLTLRLGFIQIRYLPRALGYLFKKDKGGKGDVSSFA    64

Query:  70  ALATALAATVGTGNIVGVATAIKSGGPGALFWMWVAAFFGMATKYAEGLLAIKYRTKDTN   129
            AL  TALAAT+GTGNIVGVATA+++GGPGA+FWMW+ A   GMATKYAE  LLA+KYR +D N
Sbjct:  65  ALCTALAATIGTGNIVGVATAVQAGGPGAIFWMWLVALLGMATKYAECLLAVKYRVRDKN   124

Query: 130  GEISGGPMYYIINGMGQKWKPLAVFFSAAGILVALLGIGTFTQVNAIASSLEHTFKISTR   189
            G ++GGPMYYI  G+G +W  LA F+  G++VA  GIGTF QVNAI  +++  TF I
Sbjct: 125  GFMAGGPMYYIERGLGIRW--LAKLFALFGVMVAFFGIGTFPQVNAITHAMQDTFNIPVL   182

Query: 190  FTSLILAVIVLFIIFGGIKSISKVSEKIVPFMAISYILATLIIIAVNYNKIPHTFQLIFS   249
                T++I+ ++V  II GG+K I+  S   IVPFMAI Y+    +L+II +N  K+P    LI
Sbjct: 183  VTAIIVTLLVGLIILGGVKRIATASSVIVPFMAILYVTTSLVIILLNIEKVPDAILLIID   242

Query: 250  GAFSGTAAIGGFSGAIVKEAIQKGIARGVFSNESGLGSAPIAAAAAKTKEPVEQGLISMT   309
                AF   AA+GG  G  V +AIQ G+ARG+FSNESGLGSAPIAAAAA+T+EPV QGLISMT
Sbjct: 243  SAFDPQAALGGAVGLTVMKAIQSGVARGIFSNESGLGSAPIAAAAAQTREPVRQGLISMT   302

Query: 310  GTFIDTIVICTLTGIAILVTGKWLEFDLQGAPLTQASFNTVFG-SLGSFALTFCLVLFAF   368
            GTF+DTI+++CT+TGI ++++TG W   +L GA +T  +F       G S+G+  +T  L+ FAF
Sbjct: 303  GTFLDTIIVCTMTGIVLVLTGAWNNPELAGATVTNYAFAQGLGTSIGATIVTVGLLFFAF   362

Query: 369  TTILGWSYYGERCFEYLFGTKFINAYRIIFVIMVGLGGFLQLDLIWVIADIVNGLMALPN   428
            TTILGW YYGERCF YL G + +   YR+  ++++VGLG FL L+LIW+IADIVNGLMA PN
Sbjct: 363  TTILGWCYYGERCFVYLVGIRGVKLYRLAYIMLVGLGAFLHLNLIWIIADIVNGLMAFPN   422

Query: 429  LIALLALSPIIVKETQKYFSETK                                        451
            LIAL+  L  +I++ET+ YF   K
Sbjct: 423  LIALIGLRKVIIEETKDYFQRLK                                        445
```

A related DNA sequence was identified in *S. pyogenes* <SEQ ID 5437> which encodes the amino acid sequence <SEQ ID 5438>. Analysis of this protein sequence reveals the following:

```
Possible site: 45
>>> Seems to have an uncleavable N-term signal seq
INTEGRAL    Likelihood = -11.36    Transmembrane 183-199  (175-206)
INTEGRAL    Likelihood =  -7.80    Transmembrane 143-159  (140-163)
INTEGRAL    Likelihood =  -7.11    Transmembrane 209-225  (208-229)
INTEGRAL    Likelihood =  -5.95    Transmembrane 416-432  (413-434)
INTEGRAL    Likelihood =  -5.15    Transmembrane 304-320  (302-324)
INTEGRAL    Likelihood =  -4.46    Transmembrane 387-403  (382-408)
INTEGRAL    Likelihood =  -3.35    Transmembrane 348-364  (345-366)
INTEGRAL    Likelihood =  -1.17    Transmembrane  11-27    (10-28)

----- Final Results -----
              bacterial membrane --- Certainty = 0.5543 (Affirmative) < succ>
               bacterial outside --- Certainty = 0.0000 (Not Clear)  < succ>
             bacterial cytoplasm --- Certainty = 0.0000 (Not Clear)  < succ>
```

The protein has homology with the following sequences in the databases:

```
>GP:AAF94579 GB:AE004221 sodium/alanine symporter [Vibrio cholerae]
Identities = 261/441 (59%), Positives = 328/441 (74%), Gaps = 7/441 (1%)
Query:   3 ALVKLIDNLVWGPPLLILLVGTGIYLTSHLGLIQILKLPRAFKLIFSDDEG---HGDISS    59
           + ++ +D+LVWGPPLLILLVGTG+Y T  LGL+Q  +LP A   ++F  ++     GD+SS
Sbjct:   6 SFLQTVDSLVWGPPLLILLVGTGVYFTFRLGLLQFRRLPTALAMVFGREKSSDKQGDVSS    65

Query:  60 FAALATALAATVGTGNIVGVATAIKSGGPGALFWMWVAAFFGMATKYAEGVLAIKYRTKD   119
           FAAL TAL+AT+GTGNIVGVATAIK GGPGALFWMW+AA FGMATKYAE +LA+KYR  D
Sbjct:  66 FAALCTALSATIGTGNIVGVATAIKLGGPGALFWMWLAALFGMATKYAECLLAVKYRQID   125

Query: 120 ANGHISGGPMYYIVNGMGTKWKPLAVLFAGSGILVALFGIGTFAQVNSITSSLGHSFGLS   179
              G + GGPMYY+ +G+ +K    LAVLFA   + VA FGIGTF  QVN+I +   SFG+
Sbjct: 126 DKGQMVGGPMYYLRDGVSSK--TLAVLFAVFAVGVACFGIGTFPQVNAILDATQISFGVP   183

Query: 180 PQMVSIVLAIFVAAIIFGGIHSISKVAEKVVPFMAIFYILSSLAVIFSHYQQLLPVIRLV   239
                + ++VL + VA +  GGI SI+KVA KVVP MA+FYI++   L+VI ++   +L   + LV
Sbjct: 184 REASAVVLTVLVAIVTIGGIQSIAKVAGKVVPAMALFYIIACLSVIVTNADKLADAVELV   243

Query: 240 FQSAFTPTAAIGGFAGSLMKDAIQKGIARGVFSNESGLRSAPIAAAAAKTNEPVEQGLIS   299
              SAFT TAA GGF G+ +   AIQ GIARGVFSNESGL SAP+AAAAKT+  VEQGLIS
Sbjct: 244 LVSAFTSTAATGGFLGASIMLAIQSGIARGVFSNESGLGSAPMAAAAAKTDSCVEQGLIS   303

Query: 300 MTGTFIDTIIICTLTGLSILVTGQWTGQLEGAPLTQSAFATVFG--NLGTFGLTFSLVLF   357
           MTGTF DTIIICT+TGL+++ +TG W   L GA +T   AFAT      +G   ++  L+ F
Sbjct: 304 MTGTFFDTIIICTMTGLALILTGAWQSDLSGAAMTTYAFATGLNAQTIGPMLVSIGLMFF   363

Query: 358 AFTTILGWSYYGERCFEFLFGITHLTYFRIVFILMVGLGGFLKLELIWVLADIVNGLMAL   417
           AFTTILGW+YYGERC  FLFG  +  ++IVFI ++     G  FL  L+LIW++ADIVNGLMA+
Sbjct: 364 AFTTILGWNYYGERCMVFLFGTKAVLPYKIVFIGLIASGAFLHLDLIWIIADIVNGLMAI   423

Query: 418 PNLIALLALSPVVILETKHYF                                         438
           PNLI L+AL   VV+ ETK YF
Sbjct: 424 PNLIGLVALRHVVVEETKQYF                                         444
```

An alignment of the GAS and GBS proteins is shown below.

```
Identities = 323/439 (73%), Positives = 380/439 (85%), Gaps = 1/439 (0%)
Query:   9 MLTLFTHINSFVWGPPLLALLVGTGIYLSFRLGFIQLRQLSRAFKLIFREDNGQGDISSY    68
           M+ L   I++ VWGPPLL LLVGTGIYL+  LG IQ+ + L RAFKLIF +D G GDISS+
Sbjct:   1 MIALVKLIDNLVWGPPLLILLVGTGIYLTSHLGLIQILKLPRAFKLIFSDDEGHGDISSF    60

Query:  69 AALATALAATVGTGNIVGVATAIKSGGPGALFWMWVAAFFGMATKYAEGLLAIKYRTKDT   128
           AALATALAATVGTGNIVGVATAIKSGGPGALFWMWVAAFFGMATKYAEG+LAIKYRTKD
Sbjct:  61 AALATALAATVGTGNIVGVATAIKSGGPGALFWMWVAAFFGMATKYAEGVLAIKYRTKDA   120

Query: 129 NGEISGGPMYYIINGMGQKWKPLAVFFSAAGILVALLGIGTFTQVNAIASSLEHTFKIST   188
           NG ISGGPMYYI+NGMG KWKPLAV F+ +GILVAL GIGTF QVN+I SSL H+F  +S
Sbjct: 121 NGHISGGPNYYIVNGMGTKWKPLAVLFAGSGILVALFGIGTFAQVNSITSSLGHSFGLSP   180

Query: 189 RFTSLILAVIVLFIIFGGIKSISKVSEKIVPFMAISYILATLIIIAVNYNKIPHTFQLIF   248
           + S++LA+ V  IIFGGI SISKV+EK+VPFMAI YIL++L +I   +Y ++    +L+F
Sbjct: 181 QMVSIVLAIFVAAIIFGGIHSISKVAEKVVPFMAIFYILSSLAVIFSHYQQLLPVIRLVF   240

Query: 249 SGAFSGTAAIGGFSGAIVKEAIQKGIARGVFSNESGLGSAPIAAAAAKTKEPVEQGLISM   308
             AF+ TAAIGGF+G+++K+AIQKGIARGVFSNESGL SAPIAAAAAKT EPVEQGLISM
Sbjct: 241 QSAFTPTAAIGGFAGSLMKDAIQKGIARGVFSNESGLRSAPIAAAAAKTNEPVEQGLISM   300

Query: 309 TGTFIDTIVICTLTGIAILVTGKWLEFDLQGAPLTQASFNTVFGSLGSFALTFCLVLFAF   368
           TGTFIDTI+ICTLTG++ILVTG+W   L+GAPLTQ++F  TVFG+LG+F LTF LVLFAF
Sbjct: 301 TGTFIDTIIICTLTGLSILVTGQWTG-QLEGAPLTQSAFATVFGNLGTFGLTFSLVLFAF   359

Query: 369 TTILGWSYYGERCFEYLFGTKFINAYRIIFVIMVGLGGFLQLDLIWVIADIVNGLMALPN   428
           TTILGWSYYGERCFE+LFG       +RI+F++MVGLGGFL+L+LIWV+ADIVNGLMALPN
Sbjct: 360 TTILGWSYYGERCFEFLFGITHLTYFRIVFILMVGLGGFLKLELIWVLADIVNGLMALPN   419

Query: 429 LIALLALSPIIVKETQKYF                                           447
           LIALLALSP+++ ET+ YF
Sbjct: 420 LIALLALSPVVILETKHYF                                           438
```

Based on this analysis, it was predicted that these proteins and their epitopes could be useful antigens for vaccines or diagnostics.

EXAMPLE 1751

A DNA sequence (GBSx1858) was identified in *S. agalactiae* <SEQ ID 5439> which encodes the amino acid sequence <SEQ ID 5440>. Analysis of this protein sequence reveals the following:

```
Possible site: 33
>>> Seems to have a cleavable N-term signal seq.
INTEGRAL    Likelihood = -6.16        Transmembrane   85-101   (80-108)
INTEGRAL    Likelihood = -5.36        Transmembrane  118-134  (115-137)
INTEGRAL    Likelihood = -2.81        Transmembrane  177-193  (177-193)
INTEGRAL    Likelihood = -0.48        Transmembrane   49-65    (49-65)

----- Final Results -----
              bacterial membrane --- Certainty = 0.3463 (Affirmative) < succ>
                bacterial outside --- Certainty = 0.0000 (Not Clear)  < succ>
             bacterial cytoplasm --- Certainty = 0.0000 (Not Clear)  < succ>
```

The protein has homology with the following sequences in the GENPEPT database.

```
>GP:CAB12451 GB:Z99107 alternate gene name: ydxT~similar to cation
efflux system membrane protein [Bacillus subtilis]
Identities = 118/282 (41%), Positives = 181/282 (63%)
Query:    6 ENLQLAKRGPIISIIAYITLAVAKLAAGYWFDATSLVADGFNNLSDILGNVALLIGLHLA    65
            + L+  + G ++SI AY+ L+   KL  GY F + +L ADG NN +DI+ +VA+LIGL ++
Sbjct:    5 DELKKGESGALVSIAAYLVLSAIKLIIGYLFHSEALTADGLNNTTDIIASVAVLIGLRIS    64

Query:   66 SQPADSNHRFGHWKIEDLASLITSFIMFVVGIQVFIQTVTKIINNTDTNIDPLGAIVGAI   125
            +P D +H +GH++ E +ASLI SFIM VVG+QV        I +    D + A   A
Sbjct:   65 QKPPDEDHPYGHFRAETIASLIASFIMMVVGLQVLFSAGESIFSAKQETPDMIAAWTAAG   124

Query:  126 SALVMLGVYFYNKQLSQRVKSSALVAASKDNLSDAVTSIGTSIAIIAASLNFPIIDRLAA   185
            +A++ML VY YNK+L+++VKS AL+AA+ DN SDA  SIGT I I+AA  +  ID + A
Sbjct:  125 GAVLMLIVYRYNKRLAKKVKSQALLAAAADNKSDAFVSIGTFIGIVAAQFHLAWIDTVTA   184

Query:  186 IIITYFILKTAYDIFIESAFSLSDGFDDYQLKQYEKAILTIPKISAVKSQRGRTYGSNIY   245
            +I   I KTA+DIF ES+ SL+DGFD   + Y++  I  I  +S +K  + R  GS ++
Sbjct:  185 FVIGLLICKTAWDIFKESSHSLTDGFDIKDISAYKQTIEKISGVSRLKDIKARYLGSTVH   244

Query:  246 LDIVLEMNPDLSVFESHAITERVEKLLSDKFSVYDIDIHVEP                   287
            +D+V+E++ DL++ ESH I  +E+ + ++ ++         +H+EP
Sbjct:  245 VDVVVEVSADLNITESHDIANEIERRMKEEHAIDYSHVMEP                    286
```

40

A related DNA sequence was identified in *S. pyogenes* <SEQ ID 5441> which encodes the amino acid sequence <SEQ ID 5442>. Analysis of this protein sequence reveals the following:

```
Possible site: 46
>>> Seems to have a cleavable N-term signal seq.
INTEGRAL    Likelihood = -8.01        Transmembrane  121-137  (114-139)
INTEGRAL    Likelihood = -5.41        Transmembrane   86-102   (84-109)
INTEGRAL    Likelihood = -5.04        Transmembrane  178-194  (176-197)
INTEGRAL    Likelihood = -0.69        Transmembrane   50-66    (50-66)
INTEGRAL    Likelihood = -0.64        Transmembrane  158-174  (158-174)

----- Final Results -----
              bacterial membrane --- Certainty = 0.4206 (Affirmative) < succ>
                bacterial outside --- Certainty = 0.0000 (Not Clear)  < succ>
             bacterial cytoplasm --- Certainty = 0.0000 (Not Clear)  < succ>
```

The protein has homology with the following sequences in the databases:

```
>GP:CAB12451 GB:Z99107 alternate gene name: ydxT~similar to cation
efflux system membrane protein [Bacillus subtilis]
Identities = 127/280 (45%), Positives = 187/280 (66%)
Query:    9 LKLARKGPIVSIIVYLSLSVAKLLAGYLLNASSLIADGFNNLSDIVGNVALLIGLHLASQ    68
            LK   G +VSI  YL LS KL+ GYL ++ +L ADG NN +DI+ +VA+LIGL ++ +
Sbjct:    7 LKKGESGALVSIAAYLVLSAIKLIIGYLFHSEALTADGLNNTTDIIASVAVLIGLRISQK    66
```

```
                            -continued
Query:  69 PADANHKFGHWKIEDLSSLVTSFIMFLVGFQVLIHTIKSIFSGQQVDIDPLGAIVGIVSA  128
           P D +H +GH++ E ++SL+ SFIM +VG QVL    +SIFS +Q    D + A      A
Sbjct:  67 PPDEDHPYGHFRAETIASLIASFIMMVVGLQVLFSAGESIFSAKQETPDMIAAWTAAGGA  126

Query: 129 FVMLGVYVFNKRLSKRVKSSALVAASKDNLADAVTSIGTSIAIIAASLHLPVIDHIAAMI  188
            +ML VY +NKRL+K+VKS AL+AA+ DN +DA  SIGT I I+AA   HL  ID + A +
Sbjct: 127 VLMLIVYRYNKRLAKKVKSQALLAAAADNKSDAFVSIGTFIGIVAAQFHLAWIDTVTAFV  186

Query: 189 ITFFILKTAFDIFMESSFSLSDGFDSRHLKKYEKAILEIPKIVAVKSQRARTYGSNVYLD  248
           I    I KTA+DIF ESS SL+DGFD + +  Y++ I +I  +   + K  +AR  GS V++D
Sbjct: 187 IGLLICKTAWDIFKESSHSLTDGFDIKDISAYKQTIEKISGVSRLKDIKARYLGSTVHVD  246

Query: 249 IVLEMNPDLSVYESHSITEKVEQLLSDQFSIYDIDIHVEP                      288
           +V+E++ DL++ ESH I    +E+ + ++ +I     +H+EP
Sbjct: 247 VVVEVSADLNITESHDIANEIERRMKEEHAIDYSHVNMEP                      286
```

An alignment of the GAS and GBS proteins is shown below.

```
Identities = 274/406 (67%), Positives = 340/406 (83%), Gaps = 4/406 (0%)
Query:   7 NLQLAKRGPIISIIAYITLAVAKLAAGYWFDATSLVADGFNNLSDILGNVALLIGLHLAS   66
           NL+LA++GPI+SII Y++L+VAKL AGY    +A+SL+ADGFNNLSDI+GNVALLIGLHLAS
Sbjct:   8 NLKLARKGPIVSIIVYLSLSVAKLLAGYLLNASSLIADGFNNLSDIVGNVALLIGLHLAS   67

Query:  67 QPADSNHRFGHWKIEDLASLITSFIMFVVGIQVFIQTVTKIINNTDTNIDPLGAIVGAIS  126
           QPAD+NH+FGHWKIEDL+SL+TSFIMF+VG QV I T+    I +      +IDPLGAIVG +S
Sbjct:  68 QPADANHKFGHWKIEDLSSLVTSFIMFLVGFQVLIHTIKSIFSGQQVDIDPLGAIVGIVS  127

Query: 127 ALVMLGVYFYNKQLSQRVKSSALVAASKDNLSDAVTSIGTSIAIIAASLNFPIIDRLAAI  186
           A VMLGVY +NK+LS+RVKSSALVAASKDNL+DAVTSIGTSIAIIAASL+ P+ID   +AA+
Sbjct: 128 AFVMLGVYVFNKRLSKRVKSSALVAASKDNLADAVTSIGTSIAIIAASLHLPVIDHIAAM  187

Query: 187 IITYFILKTAYDIFIESAFSLSDGFDDYQLKQYEKAILTIPKISAVKSQRGRTYGSNIYL  246
           IIT+FILKTA+DIF+ES+FSLSDGFD    LK+YEKAIL  IPKI AVKSQR RTYGSN+YL
Sbjct: 188 IITFFILKTAFDIFMESSFSLSDGFDSRHLKKYEKAILEIPKIVAVKSQRARTYGSNVYL  247

Query: 247 DIVLEMNPDLSVFESHAITERVEKLLSDKFSVYDIDIHVEPASIPEDEIFDNVYQKLYKN  306
           DIVLEMNPDLSV+ESH+ITE+VE+LLSD+FS+YDIDIHVEPA IPE+EIFDNV  +KLY+
Sbjct: 248 DIVLEMNPDLSVYESHSITEKVEQLLSDQFSIYDIDIHVEPAMIPEEEIFDNVAKKLYRY  307

Query: 307 EKIILAKIPGYETFISPDFYMINEKGNIITSDMLTNATNHSLASNFKYFNVKSISQKTKL  366
           EK+IL+K+P Y+ +I+  F +I+  G  +    N  +     SNF +F ++SISQKT L
Sbjct: 308 EKLILSKVPDYDHYIAKSFQLIDANGQTVNYEQFLNQEIY-YPSNFNHFQIESISQKTML  366

Query: 367 VSYELEGKRHTSIWRRNEKWFLIYHQIT--AKSSPYKTRRYQITSL                410
           V+Y+L G + TSIWRR+E W L++HQIT   AK    + T Y+I +
Sbjct: 367 VTYQLNGNQRTSIWRRHESWSLLFHQITPIAKKQLHHT-HYRIVKM                411
```

Based on this analysis, it was predicted that these proteins and their epitopes could be useful antigens for vaccines or diagnostics.

EXAMPLE 1752

A DNA sequence (GBSx1859) was identified in *S. agalactiae* <SEQ ID 5443> which encodes the amino acid sequence <SEQ ID 5444>. Analysis of this protein sequence reveals the following:

```
Possible site: 55
>>> Seems to have no N-terminal signal sequence
INTEGRAL    Likelihood = -8.12     Transmembrane 171-187 (161-194)
INTEGRAL    Likelihood = -6.32     Transmembrane 118-134 (113-138)
INTEGRAL    Likelihood = -5.89     Transmembrane  59-75  (53-77)
INTEGRAL    Likelihood = -5.52     Transmembrane 231-247 (226-252)
INTEGRAL    Likelihood = -3.24     Transmembrane  86-102 (84-103)
INTEGRAL    Likelihood = -0.32     Transmembrane  31-47  (31-47)

----- Final Results -----
            bacterial membrane  --- Certainty = 0.4248 (Affirmative) < succ>
             bacterial outside  --- Certainty = 0.0000 (Not Clear)  < succ>
           bacterial cytoplasm  --- Certainty = 0.0000 (Not Clear)  < succ>
```

A related GBS nucleic acid sequence <SEQ ID 9869> which encodes amino acid sequence <SEQ ID 9870> was also identified.

The protein has homology with the following sequences in the GENPEPT database.

```
>GP:CAB14850 GB:Z99118 similar to hypothetical proteins [Bacillus subtilis]
Identities = 80/226 (35%), Positives = 136/226 (59%), Gaps = 1/226 (0%)
Query:   27 TNNPIFGIMLTVWAYYIGIRIFRKYPSPAT-TPLLLATILLIAFLKLTHISYKDYYNGGS   85
            T +P FGI++++ A+ IG  +F+K      TPL +A  +L IAFLK+   SY DY NGG
Sbjct:    4 TMSPYFGIVVSLAAFGIGTFLFKKTKGFFLFTPLFVAMVLGIAFLKIGGFSYADYNNGGE   63

Query:   86 FLTMLITPSTVVLAIPLYRTFHLMKHHIKSISISIILASVINTVFTAIVAKFFGMKYFLA  145
            +   + P+T+  AIPLY+    +K +   I  SII S+ +     ++AK  +    +
Sbjct:   64 IIKFFLEPATIAFAIPLYKQRDKLKKYWWQIMASIIAGSICSVTIVYLLAKGIHLDSAVM  123

Query:  146 ISLFPKSVTTAMAVGITSKAGGLATITLVVVVITGILTSVLGPIFLKLLRIEDPVAIGLA  205
            S+ P++ TTA+A+ ++    GG++ IT   V+   ++   LG  +FLK+ ++++P++ GLA
Sbjct:  124 KSMLPQAATTAIALPLSKGIGGISDITAFAVIFNAVIVYALGALFLKVFKVKNPISKGLA  183

Query:  206 LGGTGHAIGTGQALKYGQVQGAMAGLAIGITGICYVIVSPLVAGLI               251
            LG +GHA+G     ++ G+V+ AMA +A+ +  G+  V+V P+    LI
Sbjct:  184 LGTSGHALGVAVGIEMGEVEAAMASIAVVVVGVVTVLVIPVFVQLI               229
```

No corresponding DNA sequence was identified in *S. pyogenes*.

A related GBS gene <SEQ ID 8893> and protein <SEQ ID 8894> were also identified. Analysis of this protein sequence reveals the following:

```
Lipop:       Possible site: -1 Crend: 0
SRCFLG:      0
McG:         Length of UR: 22
             Peak Value of UR: 2.57
             Net Charge of CR: 0
McG:         Discrim Score: 6.51
GvH:         Signal Score (-7.5): -5.91
Possible site: 33
>>> Seems to have an uncleavable N-term signal seq
Amino Acid Composition: calculated from 1
ALOM program count: 6 value: 8.12 threshold: 0.0
INTEGRAL     Likelihood = -8.12     Transmembrane 149-165  (139-172)
INTEGRAL     Likelihood = -6.32     Transmembrane  96-112   (91-116)
INTEGRAL     Likelihood = -5.89     Transmembrane  37-53    (31-55)
INTEGRAL     Likelihood = -5.52     Transmembrane 209-225  (204-230)
INTEGRAL     Likelihood = -3.24     Transmembrane  64-80    (62-81)
INTEGRAL     Likelihood = -0.32     Transmembrane   9-25     (9-25)
PERIPHERAL   Likelihood =  1.06     121
modified ALOM score: 2.12
icm1 HYPID: 7 CFP: 0.425

*** Reasoning Step: 3

----- Final Results -----
            bacterial membrane --- Certainty = 0.4248 (Affirmative) < succ>
             bacterial outside --- Certainty = 0.0000 (Not Clear)  < succ>
            bacterial cytoplasm --- Certainty = 0.0000 (Not Clear)  < succ>
```

The protein has homology with the following sequences in the databases:

```
ORF01066(325-999 of 1305)
EGAD|107753|BS2884(4-229 of 231) hypothetical protein {Bacillus subtilis}
OMNI|NT01BS3363 LrgB GP|1770004|emb|CAA99613.1||Z75208 hypothetical protein
{Bacillus subtilis} GP|2635355|emb|CAB14850.1||Z99118 similar to hypothetical
proteins {Bacillus subtilis} PIR|D69983|D69983 conserved hypothetical protein
ysbB-Bacillus subtilis
% Match = 17.2
% Identity = 35.4 % Similarity = 62.4
Matches = 80      Mismatches = 84      Conservative Sub.s = 61
192          222         252         282         312         342         372         402
WSTFKT*SPIFLG*LSLS*ERYFSIF*LLDWYPNGSKRDMKEIIQKLEVKMATLTNNPIFGIMLTVWAYYIGIRIFRKYP
                                                                  :| ||:::: |: ||  :|:|
                                                             MESTMSPYFGIVVSLAAFGIGTFLFKKTK
                                                                  10           20
```

-continued

```
429       459       489       519       549       579       609       639
SPAT-TPLLLATILLIAFLKLTHISYKDYYNGGSFLTMLITPSTVVLAIPLYRTFHLMKHHIKSISISIILASVINTVFT
   |||::|  :|  |||||:   ||  ||  |||   :   ::  |:|:  :|||||:     :|  :   |   |||   |:  :
GFFLFTPLFVAMVLGIAFLKIGGFSYADYNNGGEIIKFFLEPATIAFAIPLYKQRDKLKKYWWQIMASIIAGSICSVTIV
         40        50        60        70        80        90       100

669       699       729       759       789       819       849       879
AIVAKFFGMKYFLAISLPPKSVTTAMAVGITSKAGGLATITLVVVVITGILTSVLGPIFLKLLRIEDPVAIGLALGGTGH
  ::|| :    ::  |::|::  |||:|:  ::     ||::  ||    |:    ::   ||  :|||::::::|::  |||||  :||
YLLAKGIHLDSAVMKSMLPQAATTAIALPLSKGIGGISDITAFAVIFNAVIVYALGALFLKVFKVKNPISKGLALGTSGH
       120       130       140       150       160       170       180

909       939       969       999      1029      1059      1089      1119
AIGTGQALKYGQVQGAMAGLAIGITGICYVIVSPLVAGLILK*G*GK*TQNNYVIIFKNRI*DK*L*YR*KK*LLERLSV
|:|    ::  |:|:  |||  :|:  :  |:     |:|  |:      ||
ALGVAVGIEMGEVEAAMASIAVVVVGVVTVLVIPVFVQLIGG
       200       210       220       230
```

Based on this analysis, it was predicted that these proteins and their epitopes could be useful antigens for vaccines or diagnostics.

EXAMPLE 1753

A DNA sequence (GBSx1860) was identified in *S. agalactiae* <SEQ ID 5445> which encodes the amino acid sequence <SEQ ID 5446>. Analysis of this protein sequence reveals the following:

```
Possible site: 28
>>> May be a lipoprotein

----- Final Results -----
          bacterial membrane --- Certainty = 0.0000 (Not Clear) < succ>
           bacterial outside --- Certainty = 0.0000 (Not Clear) < succ>
         bacterial cytoplasm --- Certainty = 0.0000 (Not Clear) < succ>
```

The protein has homology with the following sequences in the GENPEPT database.

```
>GP:CAA76857 GB:Y17797 hypothetical protein [Enterococcus faecalis]
Identities = 44/194 (22%), Positives = 90/194 (45%), Gaps = 13/194 (6%)

Query:    21 TACSSSNTQQTSTSKSNVSQHKNIKADHEELRLKFNKVKLGVKANNFKGGTSLAELKQLF    80
             T  S ++T++ S+ K +   + K    D+ +L+   ++K+ +G    N+ +GG++   E+K +
Sbjct:    60 TNSSKNDTKKESSEKKSEDKSK----DNSDLKATYDKINVGDIMNSSEGGSTEDEVKAIL   115

Query:    81 GGEPNEKFDTPAGNVTLKGYRW-NVDD----ISITIQLLNDSSIVRSISNFKFIRDANIT   135
             GEP       T    ++   W NV         SIT+   +   + +S+S  K  +    +T
Sbjct:   116 -GEPASSSTTDIQGISTTTLSWTNVKGGDLLASITVSFSDGKAASKSVSGLKVAKHDKVT   174

Query:   136 TKDYNSLKNGMSYN--KVKELLGEPDDISQAVSSDKEELQAAWISGIQSSDSDPGINLTF   193
               N++      SY+  + ++ LG+P   I+      + ++       W+    +   D      + ++F
Sbjct:   175 ADQVNNIATDGSYSEEQARKDLGDPTGITSTNINGEKNDTLIWMKNL-DGDLGATVTVSF   233

Query:   194 ENDKLTNKQQHGLK                                                207
              N    +K   GLK
Sbjct:   234 SNGNAISKSSSGLK                                                247
```

A related DNA sequence was identified in *S. pyogenes* <SEQ ID 5447> which encodes the amino acid sequence <SEQ ID 5448>. Analysis of this protein sequence reveals the following:

```
Possible site: 21
>>> May be a lipoprotein

----- Final Results -----
          bacterial membrane --- Certainty = 0.0000 (Not Clear) < succ>
           bacterial outside --- Certainty = 0.0000 (Not Clear) < succ>
``` bacterial cytoplasm --- Certainty = 0.0000 (Not Clear) < succ>

The protein has homology with the following sequences in the databases:

```
>GP:CAA76857 GB:Y17797 hypothetical protein [Enterococcus faecalis]
Identities = 34/166 (20%), Positives = 74/166 (44%), Gaps = 8/166 (4%)
Query:  47  HQDKRANFEKIKLATVDSSFTGGTSLEELISLFGEPSQHDPKTAGEVTIDAYTWQFDQ--  104
            + D +A ++KI +  + +S  GG++ +E+ ++ GEP+         ++      +W   +
Sbjct:  83  NSDLKATYDKINVGDIMNSSEGGSTEDEVKAILGEPASSSTTDIQGISTTTLSWTNVKGG  142

Query: 105  ---VTLTVNLYQNSSIVKTISNFTFARELGLSQKEYQQLQKGMSY--EDVKKILTEPDNY  159
               ++TV+    +  K++S    A+   ++  +   +    SY  E  +K  L  +P
Sbjct: 143  DLLASITVSFSDGKAASKSVSGLKVAKHDKVTADQVNNIATDGSYSEEQARKDLGDPTGI  202

Query: 160  SQASSSDHQTLQAIWVSGLKTDTSGANISLVFENNQLTEMSQVGLE                205
            +  ++   +     IW+  L  D   GA +++ F N          S   GL+
Sbjct: 203  TSTNINGEKNDTLIWMKNLDGDL-GATVTVSFSNGNAISKSSSGLK                247
```

An alignment of the GAS and GBS proteins is shown below.

```
Identities = 84/199 (42%), Positives = 126/199 (63%), Gaps = 3/199 (1%)
Query:  11  TIVCLSFLG--LTACSSSNTQQTSTSKSNVSQHKNIKADHEELRLKFNKVKLGVKANNFK   68
            T++ +SF    L ACS++ ++   S S +   +  +A H++ R  F  K+KL      ++F
Sbjct:   8  TLLLISFFTSFLVACSTTKDKEPQPSDSEIITPRLHQAAHQDKRANFEKIKLATVDSSFT   67

Query:  69  GGTSLAELKQLFGGEPNEKFDTPAGNVTLKGYRWNVDDISITIQLLNDSSIVRSISNFKF  128
            GGTSL  EL  LFG EP++         AG VT+  Y  W  D  +++T+   L   +SSIV++ISNF F
Sbjct:  68  GGTSLEELISLFG-EPSQHDPKTAGEVTIDAYTWQFDQVTLTVNLYQNSSIVKTISNFTF  126

Query: 129  IRDANITTKDYNSLKNGMSYNKVKELLGEPDDISQAVSSDKEELQAAWISGIQSSDSDPG  188
                R+  ++ K+Y  L+  GMSY    VK++L  EPD+  SQA  SSD  +  LQA  W+SG+++       S
Sbjct: 127  ARELGLSQKEYQQLQKGMSYEDVKKILTEPDNYSQASSSDHQTLQAIWVSGLKTDTSGAN  186

Query: 189  INLTFENDKLTNKQQHGLK                                           207
            I+L FEN++LT    Q GL
Sbjct: 187  ISLVFENNQLTEMSQVGLE                                           205
```

Figure 178:
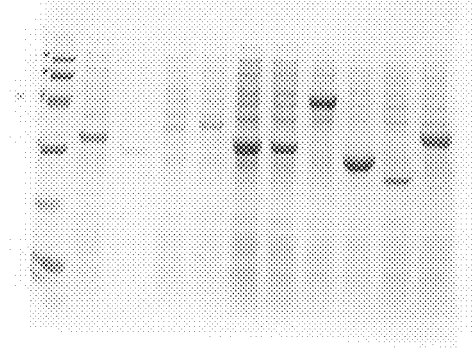

SEQ ID 5446 (GBS650) was expressed in *E. coli* as a His-fusion product. SDS-PAGE analysis of total cell extract is shown in FIG. 178 (lane 9; MW 28 kDa).

Based on this analysis, it was predicted that these proteins and their epitopes could be useful antigens for vaccines or diagnostics.

EXAMPLE 1754

A DNA sequence (GBSx1861) was identified in *S. agalactiae* <SEQ ID 5449> which encodes the amino acid sequence <SEQ ID 5450>. This protein is predicted to be ribosomal protein S1 homolog; Sequence specific DNA-binding protein (r. Analysis of this protein sequence reveals the following:

```
Possible site: 46
>>> Seems to have no N-terminal signal sequence

----- Final Results -----
            bacterial cytoplasm --- Certainty = 0.2950 (Affirmative) < succ>
            bacterial membrane  --- Certainty = 0.0000 (Not Clear)   < succ>
             bacterial outside  --- Certainty = 0.0000 (Not Clear)   < succ>
```

A related GBS nucleic acid sequence <SEQ ID 9363> which encodes amino acid sequence <SEQ ID 9364> was also identified.

The protein has homology with the following sequences in the GENPEPT database.

```
>GP:AAA97575 GB:U27517 ribosomal S1 protein [Homo sapiens]
Identities = 156/305 (51%), Positives = 214/305 (70%), Gaps = 7/305 (2%)
Query:   1  MEARKAWDKLVGREGEVVTVKGTRAVKGGLSVEFEGLRGFIPASMIDTRFVRNTEKFVGQ   60
            ++ARKAW+ L   EG+ V K  AV+GGL V+  G+RGF+PASM+    RFV +  +F  +
Sbjct:  53  LDARKAWENLSFAEGDTVDAKVINAVRGGLIVDVNGVRGFVPASMVAERFVSDLNQFKNK  112

Query:  61  EFDAKIKEVDAAENRFILSRREVVEESAAAARKEVFSNIEVGSVVTGKVARLTSFGAFID  120
            + A++ E+D A R ILSR+ V + AA    EVFS + VG VV G VARLT  FGAF+D
Sbjct: 113  DIKAQVIEIDPANARLILSRKAVAAQERAAQLAEVFSKLSVGEVVEGTVARLTDFGAFVD  172

Query: 121  LGGVDGLVHVTELSHERNVSPKSVVTVGEEVEVKVLSIDEEAGRVSLSLKATTPGPWDGV  180
            LGGVDGLVHV+E+SH+R  +P  V+T G++V+VK+L++D E  GR+SLS+KAT  GPWD
Sbjct: 173  LGGVDGLVHVSEISHDRVKNPADVLTKGDKVDVKILALDTEKGRISLSIKATQRGPWDEA  232

Query: 181  EQKLAAGDVIEGKVKRLTDFGAFVEVLPGIDGLVHISQISHKRVENPKDVLSAGQEVTVK  240
               ++AAG V+EG VKR+ DFGAFVE+LPGI+GLVH+SQIS+KR+ENP  +VL +G +V VK
Sbjct: 233  ADQIAAGSVLEGTVKRVKDFGAFVEILPGIEGLVHVSQISNKRIENPSEVLKSGDKVQVK  292

Query: 241  VLEVNSDAERVSLSMKALEERPAQAEGEKEEKRQSRPRRPRRQEKRDYELPETQTGFSMA  300
            VL++     ER+SLSMKALEE+P      + E R+       R +  Y+ +  + ++
Sbjct: 293  VLDIKPAEERISLSMKALEEKP------EREDRRGNDGSASRADIAAYK-QQDDSAATLG  345

Query: 301  DLFGD                                                         305
            D+FGD
Sbjct: 346  DIFGD                                                         350
```

A related DNA sequence was identified in *S. pyogenes* <SEQ ID 5451> which encodes the amino acid sequence <SEQ ID 5452>. Analysis of this protein sequence reveals the following:

```
Possible site: 26
>>> Seems to have no N-terminal signal sequence

----- Final Results -----
         bacterial cytoplasm --- Certainty = 0.3312 (Affirmative) < succ>
          bacterial membrane --- Certainty = 0.0000 (Not Clear)  < succ>
           bacterial outside --- Certainty = 0.0000 (Not Clear)  < succ>
```

An alignment of the GAS and GBS proteins is shown below.

```
Identities = 284/309 (91%), Positives = 296/309 (94%), Gaps = 1/309 (0%)
Query:   1  MEARKAWDKLVGREGEVVTVKGTRAVKGGLSVEFEGLRGFIPASMIDTRFVRNTEKFVGQ   60
            +EARKAWDKLVGREGEVVTVKGTRAVKGGLSVEFEGLRGFIPASMIDTRFVRNTEKFVGQ
Sbjct:  93  LEARKAWDKLVGREGEVVTVKGTRAVKGGLSVEFEGLRGFIPASMIDTRFVRNTEKFVGQ  152

Query:  61  EFDAKIKEVDAAENRFILSRREVVEESAAAARKEVFSNIEVGSVVTGKVARLTSFGAFID  120
            EFDAKIKEVDAAENRFILSRREV+EE+A  AR EVFS I  G+VVTG VARLTSFGAFID
Sbjct: 153  EFDAKIKEVDAAENRFILSRREVIEEAAKEARAEVFSKISEGAVVTGTVARLTSFGAFID  212

Query: 121  LGGVDGLVHVTELSHERNVSPKSVVTVGEEVSVKVLSIDEEAGRVSLSLKATTPGPWDGV  180
            LGGVDGLVHVTELSHERNVSPKSVV+VGEEVEVKVLSIDEEAGRVSLSLKATTPGPWDGV
Sbjct: 213  LGGVDGLVHVTELSHERNVSPKSVVSVGEEVEVKVLSIDEEAGRVSLSLKATTPGPWDGV  272

Query: 181  EQKLAAGDVIEGKVKRLTDFGAFVEVLPGIDGLVHISQISHKRVENPKDVLSAGQEVTVK  240
            EQKLA GDV+EGKVKRLTDFGAFVEVLPGIDGLVHISQISHKRVENPKDVLS GQEVTVK
Sbjct: 273  EQKLAQGDVVEGKVKRLTDFGAFVEVLPGIDGLVHISQISHKRVENPKDVLSVGQEVTVK  332

Query: 241  VLEVNSDAERVSLSMKALEERPAQAEGE-KEEKRQSRPRRPRRQEKRDYELPETQTGFSM  299
            VLEVN+   ERVSLS+KALEERPAQAEG+ KEEKRQSRPRRP+R+ +RDYELPETQTGFSM
Sbjct: 333  VLEVNAADERVSLSIKALEERPAQAEGDNKEEKRQSRPRRPKRESRRDYELPETQTGFSM  392

Query: 300  ADLFGDIEL                                                     308
            ADLFGDIEL
Sbjct: 393  ADLFGDIEL                                                     401
```

Based on this analysis, it was predicted that these proteins and their epitopes could be useful antigens for vaccines or diagnostics.

EXAMPLE 1755

A DNA sequence (GBSx1862) was identified in *S. agalactiae* <SEQ ID 5453> which encodes the amino acid sequence <SEQ ID 5454>. This protein is predicted to be dihydroorotate dehydrogenase a (pyrD). Analysis of this protein sequence reveals the following:

```
Possible site: 33
>>> Seems to have no N-terminal signal sequence

----- Final Results -----
              bacterial cytoplasm --- Certainty = 0.1708 (Affirmative) < succ>
              bacterial membrane  --- Certainty = 0.0000 (Not Clear)   < succ>
              bacterial outside   --- Certainty = 0.0000 (Not Clear)   < succ>
```

The protein has homology with the following sequences in the GENPEPT database.

```
>GP:CAB51330 GB:AJ131985 dihydroorotate dehydrogenase
[Streptococcus pneumoniae]
Identities = 227/310 (73%), Positives = 268/310 (86%)
Query:   1 MVSLKTEIAGFSFDNCLMNAAGIYCMTKEELLAIENSEAGSFVTKTGTLEAREGNPQPRY   60
           MVS KT+IAGF FDNCLMNAAG+ CMT EEL ++NS AG+FVTKT TL+ R+GNP+PRY
Sbjct:   1 MVSTKTQIAGFEFDNCLMNAAGVACMTIEELEEVKNSAAGTFVTKTATLDFRQGNPEPRY   60

Query:  61 ADTDWGSINSMGLPNKGIDYYLDFVTELQDQDNSKNHVLSLVGLSPEETHIILKKVENSS  120
              D  GSINSMGLPN G+DYYLD++ +LQ++++++   LSLVG+SPEETH ILKKV+ S
Sbjct:  61 QDVPLGSINSMGLPNNGLDYYLDYLLDLQEKESNRTFFLSLVGMSPEETHTILKKVQESD  120

Query: 121 YNGLIELNLSCPNVPGKPQIAYDFEMTDLILSEIFSYYQKPLGIKLPPYFDIVHFDQAAT  180
           + GL ELNLSCPNVPGKPQIAYDFE TD IL+E+F+Y+ KPLGIKLPPYFDIV+FDQAA
Sbjct: 121 FRGLTELNLSCPNVPGKPQIAYDFETTDRILAEVFAYFTKPLGIKLPPYFDIVYFDQAAA  180

Query: 181 IFNKYPLAFINCVNSIGNGLVIDDETVVIKPKNGFGGIGGDFIKPTALANVHAFYKRLNP  240
           IFNKYPL F+NCVNSIGNGL I+DE+VVI+PKNGFGGIGG++IKPTALANVHAFY+RLNP
Sbjct: 181 IFNKYPLKFVNCVNSIGNGLYIEDESVVIRPKNGFGGIGGEYIKPTALANVHAFYQRLNP  240

Query: 241 SIKIIGTGGVKNGRDAFEHILCGASMVQIGTALQKEGPEIFQRVSRELKEIMADKGYQSL  300
            I+IIGTGGV  GRDAFEHILCGASMVQ+GT L KEG   F R++ ELK IM +KGY+SL
Sbjct: 241 QIQIIGTGGVLTGRDAFEHILCGASMVQVGTTLHKEGVSAFDRITNELKAIMVEKGYESL  300

Query: 301 EDFRGQLNYL                                                   310
           EDFRG+L Y+
Sbjct: 301 EDFRGKLRYI                                                   310
```

A related DNA sequence was identified in *S. pyogenes* <SEQ ID 5455> which encodes the amino acid sequence <SEQ ID 5456>. Analysis of this protein sequence reveals the following:

```
Possible site: 33
>>> Seems to have no N-terminal signal sequence

----- Final Results -----
              bacterial cytoplasm --- Certainty = 0.2689 (Affirmative) < succ>
              bacterial membrane  --- Certainty = 0.0000 (Not Clear)   < succ>
              bacterial outside   --- Certainty = 0.0000 (Not Clear)   < succ>
```

An alignment of the GAS and GBS proteins is shown below.

```
Identities = 239/309 (77%), Positives = 262/309 (84%)
Query:   1 MVSLKTEIAGFSFDNCLMNAAGIYCMTKEELLAIENSEAGSFVTKTGTLEAREGNPQPRY   60
           MVS  T+I  FSFDNCLMNAAG+YCMTKEEL+ +E S+A SFVTKTGTLE R GNP+PRY
Sbjct:   5 MVSTATQIGHFSFDNCLMNAAGVYCMTKEELMEVEKSQAASFVTKTGTLEVRPGNPEPRY   64
```

-continued

```
Query:  61 ADTDWGSINSMGLPNKGIDYYLDFVTELQDQDNSKNHVLSLVGLSPEETHIILKKVENSS  120
           ADT  GSINSMGLPN G  YYLDFV++L        K H LS+VGLSP  ET  ILK +  S
Sbjct:  65 ADTRLGSINSMGLPNNGFRYYLDFVSDLAKTGQHKPHFLSVVGLSPTETETILKAIMASD  124

Query: 121 YNGLIELNLSCPNVPGKPQIAYDFEMTDLILSEIFSYYQKPLGIKLPPYFDIVHFDQAAT  180
           Y GL+ELNLSCPNVPGKPQIAYDFE TD +L  IF+YY KPLGIKLPPYFDIVHFDQAA
Sbjct: 125 YEGLVELNLSCPNVPGKPQIAYDFETTDQLLENIFTYYTKPLGIKLPPYFDIVHFDQAAA  184

Query: 181 IFNKYPLAFINCVNSIGNGLVIDDETVVIKPKNGFGGIGGDFIKPTALANVHAFYKRLNP  240
           IFNKYPL+F+NCVNSIGNGLVI DE V+IKPKNGFGGIGGD+IKPTALANVHAFYKRL P
Sbjct: 185 IFNKYPLSFVNCVNSIGNGLVIKDEQVLIKPKNGFGGIGGDYIKPTALANVHAFYKRLKP  244

Query: 241 SIKIIGTGGVKNGRDAFEHILCGASMVQIGTALQKEGPEIFQRVSRELKEIMADKGYQSL  300
           SI IIGTGGVK GRDAFEHILCGASMVQIGTAL +EGP IF+RV++ELK IM +KGYQSL
Sbjct: 245 SIHIIGTGGVKTGRDAFEHILCGASMVQIGTALHQEGPAIFERVTKELKTIMVEKGYQSL  304

Query: 301 EDFRGQLNY                                                    309
           +DFRG L Y
Sbjct: 305 DDFRGNLRY                                                    313
```

Based on this analysis, it was predicted that these proteins and their epitopes could be useful antigens for vaccines or diagnostics.

EXAMPLE 1756

A DNA sequence (GBSx1863) was identified in *S. agalactiae* <SEQ ID 5457> which encodes the amino acid sequence <SEQ ID 5458>. This protein is predicted to be beta-lactam resistance factor. Analysis of this protein sequence reveals the following:

```
Possible site: 30
>>> Seems to have no N-terminal signal sequence

----- Final Results -----
            bacterial cytoplasm --- Certainty = 0.4437 (Affirmative) < succ>
            bacterial membrane  --- Certainty = 0.0000 (Not Clear)   < succ>
             bacterial outside  --- Certainty = 0.0000 (Not Clear)   < succ>
```

The protein has homology with the following sequences in the GENPEPT database.

```
>GP:CAB89121 GB:AJ277485 betalactani resistance factor
[Streptococcus pneumoniae]
Identities = 238/410 (58%), Positives = 304/410 (74%)
Query:   1 MALKELTAKEFESYSGNYDLQSFMQTPEMAKLLKKRGYDITYMGYQIDGKMEIISIVYTI   60
           MAL  LT +EF++YS      +SFMQ+ +M  LL+KRG  I Y+   + +G++++ ++VY++
Sbjct:   1 MALTTLTKEEFQTYSDQVSSRSFMQSVQMGDLLEKRGARIVYLALKQEGEIQVAALVYSL   60

Query:  61 PMTGGLHMEVNSGPAHSNSKYLKHFYKELQNYAKSQGALELLIKPYDTYQEFTGEGKPKG  120
           PM GGLHME+NSGP ++    L  FY EL+ YAK  G LELL+KPY+TYQ F  +G P
Sbjct:  61 PMLGGLHMELNSGPIYTQQDALPVFYAELKEYAKQNGVLELLVKPYETYQTFDSQGNPID  120

Query: 121 APNTYLIDDLTSIGYHHDGLHIGYPGGEPDWHYVKNLEGITPQNLLKSFSKKGRPLVKKA  180
           A    +I DLT +GY  DGL  GYPGGEPDW Y K+L   +T ++LLKSFSKKG+PLVKKA
Sbjct: 121 AEKKSIIQDLTDLGYQFDGLTTGYPGGEPDWLYYKDLTELTEKSLLKSFSKKGKPLVKKA  180

Query: 181 MSFGIKIRVLKREELHIFKDITSSTSDRRDYMDKSLDYYQDFYDSFGDKAEFVIATLNFR  240
              +FGI+++  LKREEL IFK +IT   TS+RR+Y DKSL+YY+   FYD+FG++AEF IA+LNF
Sbjct: 181 ETFGIRLKKLKREELSIFKNITKETSERREYSDKSLEYYEHFYDTFGEQAEFLIASLNFS  240

Query: 241 EYDHNLQLNAKKLEEQITVLDNRHQNNTDSAKYHRQRTELVNQLASLDKRRKEVEPFIQK  300
           +Y   LQ     KLEE +  L        N S K  Q  E  +Q + + R+ E    I+K
Sbjct: 241 DYMSKLQGEQSKLEENLDKLRLDLSKNPHSEKKQNQLREYSSQFETFEVRKAEARDLIEK  300

Query: 301 FGNQDVVLAGSLFIYSPKETVYLFSGSYTEFNKFYAPAVLQEYVMQEALKRQSTFYNFLG  360
           +G  +D+VLAGSLF+Y P+ET YLFSGSYTEFNKFYAPA+LQ+YVM E++KR    YNFLG
Sbjct: 301 YGEEDIVLAGSLFVYMPQETTYLFSGSYTEFNKFYAPALLQKYVMLESIKRGIPKYNFLG  360
```

-continued

```
Query:  361 IQGNFDGSDGVLRFKQNFNGYIVRKMGTFRYYPNPLKYKSIQLLKRILRR          410
            IQG FDGSDGVLRFKQNFNGYIVRK GTFRY+P+PLKYK+IQLLKKI+ R
Sbjct:  361 IQGIFDGSDGVLRFKQNFNGYIVRKAGTFRYHPSPLKYKAIQLLKKIVGR          410
```

A related DNA sequence was identified in *S. pyogenes* <SEQ ID 5459> which encodes the amino acid sequence <SEQ ID 5460>. Analysis of this protein sequence reveals the following:

```
Possible site: 34
>>> Seems to have no N-terminal signal sequence

----- Final Results -----
             bacterial cytoplasm --- Certainty = 0.2652 (Affirmative)  < succ>
              bacterial membrane --- Certainty = 0.0000 (Not Clear)    < succ>
               bacterial outside --- Certainty = 0.0000 (Not Clear)    < succ>
```

An alignment of the GAS and GBS proteins is shown below.

```
Identities = 216/410 (52%), Positives = 291/410 (70%)
Query:    1 MALKELTAKEFESYSGNYDLQSFMQTPEMAKLLKKRGYDITYMGYQIDGKMEIISIVYTI   60
            MAL E++ ++F+ Y  +     SF+QT EMA L+ KRG      ++G + DG++++ ++V++
Sbjct:    1 MALIEISQEQFDHYCHSLVHHSFIQTSEMASLMAKRGAKPQFLGLEKDGELKVAAMVFSQ   60

Query:   61 PMTGGLHMEVNSGPAHSNSKYLKHFYKELQNYAKSQGALELLIKPYDTYQEFTGEGKPKG  120
            + GG  ME+N+GP ++ + L+HFY +L++YAK +  +EL++KPYD YQ F  +G P
Sbjct:   61 KVAGGWRMELNAGPNTNHPEELEHFYTQLKDYAKQKDVIELILKPYDNYQSFDTDGIPIS  120

Query:  121 APNTYLIDDLTSIGYHHDGLHIGYPGGEPDWHYVKNLEGITPQNLLKSFSKKGRPLVKKA  180
              PNT LI  LT++GY HDGL  GYP GEP WHYVK LEGI     L +SFSKKG+ L+KKA
Sbjct:  121 RPNTDLISLLTALGYKHDGLKTGYPEGEPVWHYVKKLEGIDSSRLTRSFSKKGKALIKKA  180

Query:  181 MSFGIKIRVLKREELHIFKDITSSTSDRRDYMDKSLDYYQDFYDSFGDKAEFVIATLNFR  240
             +FGIK+R LKR+ELH FK+IT +TSDRRDY+DKSL YYQDFYDSFGD  EF++ATLNF
Sbjct:  181 NTFGIKLRQLKRDELHHFKEITEATSDRRDYLDKSLSYYQDFYDSFGDSCEFMVATLNFE  240

Query:  241 EYDHNLQLNAKKLEEQITVLDNRHQNNTDSAKYHRQRTELVNQLASLDKRRKEVEPFIQK  300
            +Y +NL+   +L  I +    N S K    + EL +Q  +   R  E   F+++
Sbjct:  241 DYLNNLKQRQLQLATSINKVKGDLGKNPHSEKKQNRLKELSSQFETWQVRISEALHFLEE  300

Query:  301 FGNQDVVLAGSLFIYSPKETVYLFSGSYTEFNKFYAPAVLQEYVMQEALKRQSTFYNFLG  360
            +G +DV LAGSLFIY+ +E VYLFSGSY +FNKFY+PA+LQE+ M +A+  +     YNFLG
Sbjct:  301 YGTKDVFLAGSLFIYTEQEAVYLFSGSYPKFNKFYSPALLQEHAMLKAIHKGIKQYNFLG  360

Query:  361 IQGNFDGSDGVLRFKQNFNGYIVRKMGTFRYYPNPLKYKSIQLLKKILRR          410
            I G FDGSDGVLRFKQNFNG+I++K GTFR YP P+KY  I+L KK+L R
Sbjct:  361 ITGKFDGSDGVLRFKQNFNGFILQKPGTFRCYPFPIKYHFIRLAKKLLNR          410
```

A related GBS gene <SEQ ID 8895> and protein <SEQ ID 8896> were also identified. Analysis of this protein sequence reveals the following:

Homology to resistance proteins

The protein has homology with the following sequences in the databases:

```
57.4/74.9% over 409aa
Streptococcus pneumoniae
GP|7649683|beta-lactam resistance factor Insert characterized ORF01118 (301-1530 of 1833)
GP|7649683|emb|CAB89121.1||AJ277485 (1-410 of 410) beta-lactam resistance factor
{Streptococcus pneumoniae}
% Match = 39.0
% Identity = 57.3   % Similarity = 74.9
Matches = 235     Mismatches = 103     Conservative Sub.s = 72
```

-continued

```
           240       270       300       330       360       390       420       450
     IPVNRLLYKASNYVYALRKKRNS*LGKDTFMALKELTAKEFESYSGNYDLQSFMQTPEMAKLLKKRGYDITYMGYQIDGK
                                  |||  ||  :||::||      :||||:  :|    ||:|||    | |:   : :|:
                                  MALTTLTKEEFQTYSDQVSSRSFMQSVQMGDLLEKRGARIVYLALKQEGE
                                  10        20        30        40        50
           480       510       540       570       600       630       660       690
     MEIISIVYTIPMTGGLHMEVNSGPAHSNSKYLKHFYKELQNYAKSQGALELLIKPYDTYQEFTGEGKPKGAPNTYLIDDL
     :::  ::||::||  |||||||||  ||         |         |:    |||||||::|||||:|| ||        :|||
     IQVAALVYSLPMLGGLHMELNSGPIYTQQDALPVFYAELKEYAKQNGVLELLVKPYETYQTFDSQGNPIDAEKKSIIQDL
           60        70        80        90        100       110       120       130
           720       750       780       810       840       870       900       930
     TSIGYHHDGLHIGYPGGEPDWHYVKNLEGITPQNLLKSFSKKGRPLVKKAMSFGIKIRVLKREELHIFKDITSSTSDRRD
     | :|:  |||   ||||||||||  | |:   : | ::   :||||||:|||||  :|||::   |||||   ||:|   ||::
     TDLGYQFDGLTTGYPGGEPDWLYYKDLTELTEKSLLKSFSKKGKPLVKKAETFGIRLKKLKREELSIPKNITKETSERRE
           140       150       160       170       180       190       200       210
           960       990      1020      1050      1080      1110      1140      1170
     YMDKSLDYYQDFYDSFGDKAEFVIATLNFREYDHNLQLNAKKLEEQITVLDNRHQNNTDSAKYHRQRTELVNQLASLDKR
     |  ||||   |::    ||:    |||:|::||||    |:|||||  :||  ||  |     : :|||  :: ::: |
     YSDKSLEYYEHFYDTFGEQAEFLIASLNFSDYMSKLQGEQSKLEENLDKLRLDLSKNPHSEKKQNQLREYSSQFETFEVR
           220       230       240       250       260       270       280       290
          1200      1230      1260      1290      1320      1350      1380      1410
     RKEVEPFIQKFGNQDVVLAGSLFIYSPKETVYLFSGSYTEFNKFYAPAVLQEYVMQEALKRQSTFYXFLGIQGNFDGS G
     :     :|::||  :|:||||||||:||  |:||||||||||||||||  |:|||  ::||:|||| |||:| ||||:  |
     KAEARDLIEKYGEEDIVLAGSLFVYMPQETTYLFSGSYTEFNKFYAPALLQKYVMLESIKRGIPKYNFLGIQGIFDGSDG
           300       310       320       330       340       350       360       370
          1440      1470      1500      1530      1560      1590      1620      1650
     VLXFKQNFNGYIVRKMGTFRYYPNPLKYKSIQLLKKILRRT*KISLHKLIFYAL*KASFISLLLLFIQTIMFVI*RNFIT
     || ||||||||||||:|||||: ||||||||:|||||:|| |
     VLRFKQNFNGYIVRKAGTFRYHPSPLKYKAIQLLKKIVGR
           380       390       400       410
```

SEQ ID 8896 (GBS198) was expressed in *E. coli* as a His-fusion product. SDS-PAGE analysis of total cell extract is shown in FIG. 26 (lane 6; MW 48.8 kDa). It was also expressed in *E. coli* as a GST-fusion product. SDS-PAGE analysis of total cell extract is shown in FIG. 85 (lane 6; MW 73.8 kDa).

GBS198-GST was purified as shown in FIG. 223, lane 4.

Based on this analysis, it was predicted that these proteins and their epitopes could be useful antigens for vaccines or diagnostics.

EXAMPLE 1757

A DNA sequence (GBSx1864) was identified in *S. agalactiae* <SEQ ID 5461> which encodes the amino acid sequence <SEQ ID 5462>. This protein is predicted to be MurM protein. Analysis of this protein sequence reveals the following:

```
Possible site: 52
>>> Seems to have no N-terminal signal sequence

----- Final Results -----
            bacterial cytoplasm --- Certainty = 0.4418 (Affirmative)   < succ>
            bacterial membrane  --- Certainty = 0.0000 (Not Clear)     < succ>
            bacterial outside   --- Certainty = 0.0000 (Not Clear)     < succ>
```

The protein has homology with the following sequences in the GENPEPT database.

```
>GP:CAB89539 GB:AJ250767 MurM protein [Streptococcus pneumoniae]
Identities = 204/410 (49%), Positives = 286/410 (69%), Gaps = 17/410 (4%)
Query:    1 MYRE---ITAVEHDRFVSESNQTNLLQSSNWPKVKDNWGSQLLGFFDGETQIASASILIK    57
            MYR    I  +E+D+FV E    N+LQSS W KVK +W  +  LG ++GE    +A AS+LIK
Sbjct:    1 MYRYQIGIPTLEYDQFVKEHELANVLQSSAWEKVKSDWNHERLGVYEGENLLAVASVLIK    60

Query:   58 SLPLGFSMLYIPRGPIMDYSNLDIVTKVLKDLKAFGKKQRALFIKCDPLIYLK--MVNAK    115
            SLPLG+ M YIPRGPI+DY +  +++   VL+ +K++ +   +RA+F+   DP I L    +VN
Sbjct:   61 SLPLGYKMFYIPRGPILDYMDKELLKFVLQSIKSYARSKRAVFVTFDPSICLSQHLVN--    118
```

-continued

```
Query:  116  DFENSPDEKEGLIAIDHLQRAGADWTGRTTDLAHTIQPRFQANLYANQFGLDKMSKKTRQ  175
             ++  +  E L  ++ L + G  W+G+TT++  TIQPR  QA +Y    F  DK+SK TRQ
Sbjct:  119  --QDKREYPENLAIVEILGQLGVKWSGQTTEMDDTIQPRIQAKIYKENFEEDKLSKSTRQ  176

Query:  176  AIRTSKNKGVDIQFGSHELLEDFAELMKKTEDRKGINLRGIDYYQKLLDTYPNNSYITMA  235
             AIRT++NKG++IQ+G  ELL+ F+ELMKKTE RK I+LR   YY+KLLD +   +SYIT+
Sbjct:  177  AIRTARNKGLEIQYGGLELLDSFSELMKKTEKRKEIHLRNEAYYRKLLDNFKEDSYITLT  236

Query:  236  SLDVAKRLEKIEKECQIAQSERIKS--LELNREKKVKQHQGTIDRLNKEIDFLKEAQKAY  293
             +LDV+KRL ++E+ Q+A+++ ++       E R    KV+  +    +RL +EIDFL +
Sbjct:  237  NLDVSKRLRELEE--QLAKNKALEEAFTESTRTSKVEAQKKEKERLVEEIDFL-QGYMNM  293

Query:  294  DRDIIPLAATLTLEFGNTSENIYAGMDDYFKSYSAPIYTWFETAQRAFERGNIWQNMGGI  353
             ++  IPLAATL+LEFG TS N+YAGMDD FK Y+API  TW+ETA+ AFERG +WQN+GG+
Sbjct:  294  EKSNIPLAATLSLEFGTTSVNLYAGMDDDFKRYNAPILTWYETARYAFERGMVWQNLGGV  353

Query:  354  ENDLSGGLYHFKSKFEPIIEEFIGEFNIPVN---RLLYKASNYVYALRRK           400
             EN L+GGLYHFK  KF P IEE++GEF +P +     LL  A ++  LRKK
Sbjct:  354  ENSLNGGLYHFKEKFNPTIEEYLGEFTMPTHPLYPLLRLALDFRKTLRKK           403
```

A related DNA sequence was identified in *S. pyogenes* <SEQ ID 5463> which encodes the amino acid sequence <SEQ ID 5464>. Analysis of this protein sequence reveals the following:

```
Possible site: 60
>>> Seems to have no N-terminal signal sequence

----- Final Results -----
            bacterial cytoplasm --- Certainty = 0.2239 (Affirmative)   < succ>
            bacterial membrane  --- Certainty = 0.0000 (Not Clear)     < succ>
             bacterial outside  --- Certainty = 0.0000 (Not Clear)     < succ>
```

An alignment of the GAS and GBS proteins is shown below.

```
Identities = 203/399 (50%), Positives = 274/399 (67%), Gaps = 4/399 (1%)
Query:    5  ITAVEHDRFVSESNQTNLLQSSNWPKVKDNWGSQLLGFFDGETQIASASILIKSLPLGFS   64
             I+  EHD+FV   Q    LLQSS W KVKDNW + +  F++   Q+A+A+ LI+ LPLGF+
Sbjct:   13  ISPEEHDQFVLAQPQAGLLQSSKWGKVKDNWKHERISFYENGVQVAAAACLIRKLPLGFT   72

Query:   65  MLYIPRGPIMDYSNLDIVTKVLKDLKAFGKKQRALFIKCDPLIYLKMVNAKDFENSPDEK  124
             M+YIPRGPIMDY+N +++   V+K LK FGK +RALFIK DP  +K    + + S +
Sbjct:   73  MIYIPRGPIMDYANFELLDFVIKTLKTFGKSKRALFIKIDPSLVIKQT--LEGKESKEND  130

Query:  125  EGLIAIDHLQRAGADWTGRTTDLAHTIQPRFQANLYANQFGLDKMSKKTRQAIRTSKNKG  184
                L  I  L++ G +W+GRT +L  TIQPR QAN+YA  F  D + KK +Q+IRT+ NEG
Sbjct:  131  VTLSIIAFLKKLGVEWSGRTKELEDTIQPRIQANIYAKDFDFDSLPKKAKQSIRTATNKG  190

Query:  185  VDIQFGSHELLEDFAELMKKTEDRKGINLRGIDYYQKLLDTYPNNSYITMASLDVAKRLE  244
             V++  G  ELL+DF+ LMKKTE+RKGI LRG  YYQKLL  Y   SYITMASLD+ ++ +
Sbjct:  191  VNVTIGGSELLDDFSALMKKTENRKGIILRGKSYYQKLLGIYAGQSYITMASLDLPEQKK  250

Query:  245  KIEKECQIAQSERIKSLELNREKKVKQHQGTIDRLNKEIDFLKEAQKAYDRDIIPLAATL  304
             +  ++    A +E+ +  + ++  KV ++Q TI RL K++   L E A  +   IPLAATL
Sbjct:  251  LLIQQLDKALAEQARLTDKSKPSKVAENQKTIARLQKDLTILSE-QLATGQTRIPLAATL  309

Query:  305  TLEFGNTSENIYAGMDDYFKSYSAPIYTWFETAQRAFERGNIWQNMGGIENDLSGGLYHF  364
             TL +G TSEN+YAGNDD +++Y AP+ TW+ETA+ AF+RG  W N+GG+EN   GGLYHF
Sbjct:  310  TLIYGETSENLYAGMDDDYRNYQAPLLTWYETAKEAFKRGCRWHNLGGVENQQDGGLYHF  369

Query:  365  KSKFEPIIEEFIGEFNIPVNRLLYKASNYVYALRKKRNS                      403
             K++  P IEEF GEFNIPV  L+   +   Y LRKK  S
Sbjct:  370  KARLNPTIEEFAGEFNIPVG-LVSSLAILTYNLRKKLRS                      407
```

Based on this analysis, it was predicted that these proteins and their epitopes could be useful antigens for vaccines or diagnostics.

EXAMPLE 1758

A DNA sequence (GBSx1865) was identified in *S. agalactiae* <SEQ ID 5465> which encodes the amino acid sequence <SEQ ID 5466>. Analysis of this protein sequence reveals the following:

```
Possible site: 28
>>> Seems to have no N-terminal signal sequence

----- Final Results -----
            bacterial cytoplasm --- Certainty = 0.2669 (Affirmative) < succ>
             bacterial membrane --- Certainty = 0.0000 (Not Clear)   < succ>
              bacterial outside --- Certainty = 0.0000 (Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1759

A DNA sequence (GBSx1866) was identified in *S. agalactiae* <SEQ ID 5467> which encodes the amino acid sequence <SEQ ID 5468>. This protein is predicted to be beta-lactam resistance factor. Analysis of this protein sequence reveals the following:

```
Possible site: 41
>>> Seems to have no N-terminal signal sequence
INTEGRAL    Likelihood = -2.07        Transmembrane 56-72 (55-74)

----- Final Results -----
             bacterial membrane --- Certainty = 0.1829 (Affirmative) < succ>
              bacterial outside --- Certainty = 0.0000 (Not Clear)   < succ>
            bacterial cytoplasm --- Certainty = 0.0000 (Not Clear)   < succ>
```

A related GBS nucleic acid sequence <SEQ ID 9625> which encodes amino acid sequence <SEQ ID 9626> was also identified.

The protein has homology with the following sequences in the GENPEPT database.

```
>GP:CAB89120 GB:AJ277484 beta-lactam resistance factor
[Streptococcus pneumoniae]
Identities = 166/410 (40%), Positives = 250/410 (60%), Gaps = 10/410 (2%)
Query:   6 MYHVTVGISEKEYDAFAIASSQTNLLHSSKWAQVKSNWQNERLGFYKDDQLVAVASILIK    65
           MY   +GI   EYD F      N+L SS W +VKSNWQ+E+ G Y++++L+A ASILI+
Sbjct:   1 MYRYQIGIPTLEYDQFVKEHELANVLQSSAWEEVKSNWQHEKFGVYREEKLLATASILIR    60

Query:  66 SLPLGFTMLYIPRGPIMDYSNKELVNFVLKTLKNFGRKKRAVFAKFDPALLLRQYHLKEE   125
           +LPLG+ M YIPRGPI+DY +KEL+NF ++++K++ R KRAVF  FDP++ L Q  + +E
Sbjct:  61 TLPLGYKMFYIPRGPILDYGDKELLNFAIQSIKSYARSKRAVFVTFDPSICLSQSLINQE   120

Query: 126 NVAEEIDESRQAIDNLKSAGAQWIGPTKAISETIQPRFQANIYTKANIEENFPKHTKRLI   185
              E  E+   ID+L+  G +W G T+ + +TIQPR QA IY +   E+   K TK+ I
Sbjct: 121 KT--EFPENLAIIDSLQQMGVRWSGKTEEMGDTIQPRIQAKIYKENFEEDKLSKSTKQAI   178

Query: 186 KDAKHRGVQIYRANIDDLPKFATVVALTENRKGVALRNENYFHQLMTIYGEDAYLYLAKV   245
           + A+++G++I    ++ L  F+ ++  TE RK + LRNE Y+ +L+  + + AY+ LA+
Sbjct: 179 RTARNKGLEIQYGGLELLDSFSELMKKTEKRKEIHLRNEAYYKKLLDNFKDKAYITLATL   238

Query: 246 NLPKRLAQFKEQLLQIQKDLSETPSHQKSRLTRLNQQEASVKQYILEFQEFSKKYPD---   302
           ++ KR  +EQL +   L ET + + +R +++     Q+    K+ +LE   F ++Y D
Sbjct: 239 DVSKRSQELEEQLAK-NRALEETFT-ESTRTSKVEAQKKE-KERLLEELTFLQEYIDVGQ   295

Query: 303 -EPVIAGILSIRFGNVLEMLYAGMDDSFRKFYPQYLLNARVFEDAFKNDIVSANLGGVEG   361
             +A  LS+ FG       +YAGMDD F+++     L       AF+  ++   NLGGVE
```

```
                                     -continued
Sbjct: 296  ARVPLAATLSLEFGTTSVNIYAGMDDDFKRYNAPILTWYETARYAFERGMIWQNLGGVEN  355

Query: 362  SLNDGLTKFKSNFNPMFEEYIGEFNLAINPLLYKLANLAYTIRKKQRHSH           411
            SLN GL  FK  FNP  EEY+GEF + +P LY L   LA   RK  R  H
Sbjct: 356  SLNGGLYHFKEKFNPTIEEYLGEFTMPTHP-LYPLLRLALDFRKTLRKKH           404
```

A related DNA sequence was identified in *S. pyogenes* <SEQ ID 5469> which encodes the amino acid sequence <SEQ ID 5470>. Analysis of this protein sequence reveals the following:

```
Possible site: 32
>>> Seems to have no N-terminal signal sequence
INTEGRAL     Likelihood = -0.32       Transmembrane 59-75 (59-75)

----- Final Results -----
              bacterial membrane --- Certainty = 0.1128 (Affirmative) < succ>
                bacterial outside --- Certainty = 0.0000 (Not Clear)  < succ>
              bacterial cytoplasm --- Certainty = 0.0000 (Not Clear)  < succ>
```

The protein has homology with the following sequences in the databases:

```
>GP:CAB89120 GB:AJ277484 beta-lactam resistance factor
[Streptococcus pneumoniae]
Identities = 166/402 (41%), Positives = 255/402 (63%), Gaps = 5/402 (1%)
Query:   9  KIGISSEEHDSFVKEHQQISVLQGSDWAKIKNQWQNERIGIYKEEKQVASLSLLIKLLPL   68
            +IGI   E+D FVKEH+  +VLQ S W  ++K+ WQ+E+ G+Y+EEK +A+ S+LI+ LPL
Sbjct:   5  QIGIPTLEYDQFVKEHELANVLQSSAWEEVKSNWQHEKFGVYREEKLLATASILIRTLPL   64

Query:  69  GRSIIYIPRGPVMDYLDRDLVAFTMKTLKDYGKTKKALFIKYDPAILLKQYALGQEEEEK  128
            G + YIPRGP++DY D++L+ F ++++K Y ++K+A+F+ +DP+I L Q  + QE+ E
Sbjct:  65  GYKMFYIPRGPILDYGDKELLNFAIQSIKSYARSKRAVFVTFDPSICLSQSLINQEKTEF  124

Query: 129  PLALAAIKNLQEAGVHWTGLTMEIADSIQPRFQANIYTQENLEMQFPKHTRRLIKDAKQR  188
            P  LA I +LQ+ GV W+G T E+ D+IQPR QA IY +   E +   K T++ I+ A+ +
Sbjct: 125  PENLAIIDSLQQMGVRWSGKTEEMGDTIQPRIQAKIYKENFEEDKLSKSTKQAIRTARNK  184

Query: 189  GVKTYRVSQSELHKFSKIVSLTEKRKNISLRNEAYFQKLMTTYGDKAYLHLAKVNIPQKL  248
            G++           L  FS+++   TEKRK I LRNEAY++KL+  + DKAY+ LA +++ ++
Sbjct: 185  GLEIQYGGLELLDSFSELMKKTEKRKEIHLRNEAYYKKLLDNFKDKAYITLATLDVSKRS  244

Query: 249  DQYRQQLILINQDITRTQAHQKKRLKKLEDQKASLERYITE---FEGFTDQYPEEVVVAG  305
              + +QL  N++ +  T  + R   K+E QK    ER + E     + + D   V +A
Sbjct: 245  QELEEQLAK-NRALEETFT-ESTRTSKVEAQKKEKERLLEELTFLQEYIDVGQARVPLAA  302

Query: 306  ILSISYGNVMEMLYAGMNDDFKKFYPQYLLYPNVFQDAYQDGIIWANMGGVEGSLDDGLT  365
             LS+ +G     +YAGM+DDFK++    L +      + A++  G+IW N+GGVE SL+ GL
Sbjct: 303  TLSLEFGTTSVNIYAGMDDDFKRYNAPILTWYETARYAFERGMIWQNLGGVENSLNGGLY  362

Query: 366  KFKANFAPTIEEFIGEFNLPVSPLYHIANTMYKIRKQLKNKH                   407
             FK  F PTIEE++GEF +P  PLY +         RK L+ KH
Sbjct: 363  HFKEKFNPTIEEYLGEFTMPTHPLYPLLRLALDFRKTLRKKH                   404
```

An alignment of the GAS and GBS proteins is shown below.

```
Identities = 226/407 (55%), Positives = 318/407 (77%), Gaps = 3/407 (0%)
Query:   5  LMYHVTVGISEKEYDAFAIASSQTNLLHSSKWAQVKSNWQNERLGFYKDDQLVAVASILI   64
            L ++  +GISE+E+D+F      Q ++L  S WA++K+ WQNER+G YK+++ VA   S+LI
Sbjct:   4  LTFYAKIGISEEEHDSFVKEHQQISVLQGSDWAKIKNQWQNERIGIYKEEKQVASLSLLI   63

Query:  65  KSLPLGFTMLYIPRGPIMDYSNKELVNFVLKTLKNFGRKKRAVFAKFDPALLLRQYHLKE  124
            K LPLG  + YIPRGP+MDY +++LV F +KTLK++G+ K+A+F K+DPA+LL+QY L +
Sbjct:  64  KLLPLGRSIIYIPRGPVMDYLDRDLVAFTMKTLKDYGKTKKALFIKYDPAILLKQYALGQ  123

Query: 125  ENVAEEIDESRQAIDNLKSAGAQWIGPTKAISETIQPRFQANIYTKANIEENFPKHTKRL  184
            E   EE  +  + AI NL+ AG  W GPT  I+++IQPRFQANIYT+ N+E  FPKHT+RL
Sbjct: 124  EE--EEKPLALAAIKNLQEAGVHWTGLTMEIADSIQPRFQANIYTQENLEMQFPKHTRRL  181

Query: 185  IKDAKHRGVQIYRANIDDLPKFATVVALTENRKGVALRNENYFHQLMTIYGEDAYLYLAK  244
            IKDAK RGV+ YR +  +L KF +V+ LTE RK ++LRNE YF QLMT YG+ AYL+LAK
Sbjct: 182  IKDAKQRGVKTYRVSQSELHKFSKIVSLTEKRKNISLRNEAYFQKLMTTYGDKAYLHLAK  241
```

-continued

```
Query:  245  VNLPKRLAQFKEQLLQIQKDLSETPSHQKSRLTRLNQQEASVKQYILEFQEFSKKYPDEP  304
             VN+P++L Q+++QL+ I +D++ T +HQK RL +L  Q+AS+++YI EF+ F+ +YP+E
Sbjct:  242  VNIPQKLDQYRQQLILINQDITRTQAHQKKRLKKLEDQKASLERYITEFEGFTDQYPEEV  301

Query:  305  VIAGILSIRFGNVLEMLYAGMDDSFRKFYPQYLLNARVFEDAFKNDIVSANLGGVEGSLN  364
             V+AGILSI +GNV+EMLYAGM+D F+KFYPQYLL    VF+DA+++ I+ AN+GGVEGSL+
Sbjct:  302  VVAGILSISYGNVMEMLYAGMNDDFKKFYPQYLLYPNVFQDAYQDGIIWANMGGVEGSLD  361

Query:  365  DGLTKFKSNFNPMFEEYIGEFNLAINPLLYKLANLAYTIRKKQRHSH              411
             DGLTKFK+NF P   EE+IGEFNL ++P LY +AN  Y IRK+ ++ H
Sbjct:  362  DGLTKFKANFAPTIEEFIGEFHLPVSP-LYHIANTMYKIRKQLKNKH              407
```

SEQ ID 5468 (GBS377) was expressed in *E. coli* as a His-fusion product. SDS-PAGE analysis of total cell extract is shown in FIG. 65 (lane 4; MW 49 kDa). It was also expressed in *E. coli* as a GST-fusion product. SDS-PAGE analysis of total cell extract is shown in FIG. 71 (lane 4; MW 74 kDa).

GBS377-GST was purified as shown in FIG. 212, lane 4.

Based on this analysis, it was predicted that these proteins and their epitopes could be useful antigens for vaccines or diagnostics.

EXAMPLE 1760

A DNA sequence (GBSx1867) was identified in *S. agalactiae* <SEQ ID 5471> which encodes the amino acid sequence <SEQ ID 5472>. Analysis of this protein sequence reveals the following:

```
Possible site: 22
>>> Seems to have no N-terminal signal sequence

----- Final Results -----
           bacterial cytoplasm --- Certainty = 0.2073 (Affirmative) < succ>
           bacterial membrane  --- Certainty = 0.0000 (Not Clear)   < succ>
            bacterial outside  --- Certainty = 0.0000 (Not Clear)   < succ>
```

A related GBS nucleic acid sequence <SEQ ID 9627> which encodes amino acid sequence <SEQ ID 9628> was also identified.

The protein has homology with the following sequences in the GENPEPT database.

```
>GP:AAC76720 GB:AE000446 orf, hypothetical protein [Escherichia coli K12]
Identities = 127/269 (47%), Positives = 189/269 (70%), Gaps = 1/269 (0%)
Query:    7  SIKLVAVDIDGTLLNSKREITPEVAKAVQEAKSKGVKIVIATGRPIIGVQDLLEELKLNE   66
             +IKL+A+D+DGTLL       I+P V  A+  A+++GV +V+ TGRP  GV L+EL + +
Sbjct:    2  AIKLIAIDMDGTLLLPDHTISPAVKNAIAAARARGVNVVLTTGRPYAGVHNYLKELHMEQ   61

Query:   67  EGDYVITFNGGLVQDTATGDDIIKETLTYEDYLDFELLARKLGVHMHAITKEGIYTANRD  126
              GDY IT+NG LVQ  A G  + + L+Y+DY   E L+R++G H HA+ +  +YTANRD
Sbjct:   62  PGDYCITYNGALVQKAADGSTVAQTALSYDDYRFLEKLSREVGSHFHALDRTTLYTANRD  121

Query:  127  IGKYTIHEVTLVNMPLFYRTPEEMG-DKEIIKLMMIDQPDILDAAIAKIPKKVLDNYTIV  185
             I  YT+HE  +  +PL +     E+M   + ++K+MMID+P ILD AIA+IP++V + YT++
Sbjct:  122  ISYYTVHESFVATIPLVFCEAEKMDPNTQFLKVMMIDEPAILDQAIARIPQEVKEKYTVL  181

Query:  186  KSTPFYLEILPKNVNKGTALLHLAEKMGLTVDQTMAIGDEENDRAMLEVVGNPVVMQNGN  245
             KS P++LEIL K VNKGT +  LA+ +G+  ++ MAIGD+END AM+E  G  V M N
Sbjct:  182  KSAPYFLEILDKRVNKGTGVKSLADVLGIKPEEIMAIGDQENDIAMIEYAGVGVAMDNAI  241

Query:  246  PELKKIAKYITKSNEESGVAYALREWVIN                                274
             P +K++A  ++TKSN E GVA+A+ ++V+N
Sbjct:  242  PSVKEVANFVTKSNLEDGVAFAIEKYVLN                                270
```

A related DNA sequence was identified in *S. pyogenes* <SEQ ID 3407> which encodes the amino acid sequence <SEQ ID 3408>. Analysis of this protein sequence reveals the following:

```
Possible site: 36
>>> Seems to have no N-terminal signal sequence

----- Final Results -----
            bacterial cytoplasm --- Certainty = 0.3474(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below.

```
Identities = 197/268 (73%), Positives = 235/268 (87%)

Query:    7 SIKLVAVDIDGTLLNSKREITPEVAKAVQEAKSKGVKIVIATGRPIIGVQDLLEELKLNE   66
            SIKLVAVDIDGTLL   R IT +V +AVQEAK++GV +VIATGRPI GV  LLE+L+LN
Sbjct:    2 SIKLVAVDIDGTLLTDDRRITDDVFQAVQEAKAQGVHVVIATGRPIAGVISLLEQLELNH   61

Query:   67 EGDYVITFNGGLVQDTATGDDIIKETLTYEDYLDFELLARKLGVHMHAITKEGIYTANRD  126
            +G++VITFNGGLVQD  TG++I+KE +TY+DYL+ E L+RKLGVHMHAITKEGIYTANR+
Sbjct:   62 KGNHVITFNGGLVQDAETGEEIVKELMTYDDYLETEFLSRKLGVHMHAITKEGIYTANRN  121

Query:  127 IGKYTIHEVTLVNMPLFYRTPEEMGDKEIIKLMMIDQPDILDAAIAKIPKKVLDNYTIVK  186
            IGKYT+HE TLVNMP+FYRTPEEM +KEIIK+MMID+PD+LDAAI +IP+  D YTIVK
Sbjct:  122 IGKYTVHESTLVNMPIFYRTPEEMTNKEIIKMMMIDEPDLLDAAIKQIPQHFFDKYTIVK  181

Query:  187 STPFYLEILPKNVNKGTALLHLAEKMGLTVDQTMAIGDEENDRAMLEVVGNPVVMQNGNP  246
            STPFYLE +PK V+KG A+ HLA+K+GL + QTMAIGD ENDRAMLEVV NPVVM+NG P
Sbjct:  182 STPFYLEFMPKTVSKGNAIKHLAKKLGLDMSQTMAIGDAENDRAMLEVVANPVVMENGVP  241

Query:  247 ELKKIAKYITKSNEESGVAYALREWVIN                                 274
            ELKKIAKYITKSN +SGVA+A+R+WV+N
Sbjct:  242 ELKKIAKYITKSNNDSGVAHAIRKWVLN                                 269
```

Based on this analysis, it was predicted that these proteins and their epitopes could be useful antigens for vaccines or diagnostics.

EXAMPLE 1761

A DNA sequence (GBSx1868) was identified in *S. agalactiae* <SEQ ID 5473> which encodes the amino acid sequence <SEQ ID 5474>. Analysis of this protein sequence reveals the following:

```
Possible site: 48
>>> Seems to have no N-terminal signal sequence

----- Final Results -----
            bacterial cytoplasm --- Certainty = 0.2360(Affirmative) < succ>
             bacterial membrane --- Certainty = 0.0000(Not Clear)   < succ>
              bacterial outside --- Certainty = 0.0000(Not Clear)   < succ>
```

The protein has homology with the following sequences in the GENPEPT database.

```
>GP: BAB07537 GB: AP001520 unknown conserved protein [Bacillus halodurans]
Identities = 211/423 (49%), Positives = 285/423 (66%),
Gaps = 5/423 (1%)

Query:    3 EKVFRDPVHTYIHVNNQVIYDLINTKEFQRLRRIKQTSTTSFTFHGAEHSRFSHCLGVYE   62
            EKVF+DPVH YIHV +++I+ LI TKEFQRLRR++Q  TT  TFHGAEH+RF+H LGVYE
Sbjct:   12 EKVFKDPVHRYIHVRDELIWALIGTKEFQRLRRVRQLGTTFLTFHGAEHTRFNHSLGVYE   71

Query:   63 LARKVTEIFDEHYSDLWNKNESLLTMAAALLHDIGHGAYSHTFERLFNTDHEAYTQEIIT  122
            + R++ E+F       WN+ E LLT+ AALLHDIGHG +SH+FE++F+TDHE +T+ +I
Sbjct:   72 ITRRIIEVFQGR--PYWNEEERLLTLCAALLHDIGHGPFSHSFEKVFDTDHEEWTRRMIV  129

Query:  123 NPTTEINAILRKVAPDFPDKVASVINHSYPNKQVVQLISSQIDCDRMDYLLRDSYYTAAS  182
              T EI+ +L K+  DFP KVA VI  +YPNK V +ISSQID DRMDYL RD+YYT  S
Sbjct:  130 GDT-EIHNVLLKMGDDFPQKVADVIEKTYPNKLVTSIISSQIDADRMDYLQRDAYYTGVS  188
```

```
                              -continued
Query: 183 YGQFDLTRILRVIRPTDSGIAFARNGMHAVEDYIVSRFQMYMQVYFHPASRAMELLLQNL 242
           YG FD+ RILRV+RP +   +   ++GMHAVEDYI+SR+QMY QVYFHP +R+ E++L   +
Sbjct: 189 YGHFDMERILRVMPMEDQVVIKQSGMHAVEDYIMSRYQMYWQVYFHPVTRSAEVILSKV 248

Query: 243 LKRARFLFDTHRDFFEQTSPNLIPFFTDQYDLQDYLALDDGVMNTYFQSWMQADDNILAD 302
           KR + L++      F+Q    +     F     L DYL LD+ +   YFQ W + +D IL+D
Sbjct: 249 FKRVKDLYEQGYK-FKQEPKHFYSLFEGNMSLDDYLRLDESITMYYFQIWQEEEDRILSD 307

Query: 303 LANRFINRKVFKSITFEESDKEN-LVKMKELVSQVGFDPDYYTGVHANFDLPYDVYRPEH 361
           L  RFINR++FK I F  + + N    ++++L +Q    DP+YY  V ++ DLPYD YRP
Sbjct: 308 LCVRFINRQLFKYIEFNPNLQMNDWPRLQQLFAQAEIDPEYYLVVDSSSDLPYDFYRPGE 367

Query: 362 SNPRTEIQIIQKNGQLAELSSLSPIVKALTGSNYGDQRFYFPKEMLTLDSLFSSTKEEFQ 421
            R   I +I   NG+L ELS  S +V+A++G      D + YFP + LT  S      K+E
Sbjct: 368 EEERLPIHLIMPNGKLRELSRESDVVEAISGKKRTDHKLYFPMDCLTDQSDHKEIKQEIL 427

Query: 422 SYI 424
           S +
Sbjct: 428 SLL 430
```

A related DNA sequence was identified in *S. pyogenes* <SEQ ID 5475> which encodes the amino acid sequence <SEQ ID 5476>. Analysis of this protein sequence reveals the following:

```
Possible site: 55
>>> Seems to have no N-terminal signal sequence

----- Final Results -----
          bacterial cytoplasm --- Certainty = 0.2220(Affirmative) < succ>
            bacterial membrane --- Certainty = 0.0000(Not Clear)   < succ>
             bacterial outside --- Certainty = 0.0000(Not Clear)   < succ>
```

An alignment of the GAS and GBS proteins is shown below.

```
Identities = 321/428 (75%), Positives = 379/428 (88%)

Query:   1 MNEKVFRDPVHTYIHVNNQVIYDLINTKEFQRLRRIKQTSTTSFTFHGAEHSRFSHCLGV  60
           MNEKVFRDPVH  YIH++N +IYDLINTKEFQRLRRIKQ  TT+FTFHGAEHSRFSHCLGV
Sbjct:   1 MNEKVFRDPVHNYIHIDNPLIYDLINTKEFQRLRRIKQVPTTAFTFHGAEHSRFSHCLGV  60

Query:  61 YELARKVTEIFDEHYSDLWNKNESLLTMAAALLHDIGHGAYSHTFERLFNTDHEAYTQEI 120
           YE+AR+VT IF+E Y+D+WNK+ESL+TM AALLHDIGHGAYSHTFE LF+TDHEA+TQEI
Sbjct:  61 YEIARRVTAIFEEKYADIWNKDESLVTMTAALLHDIGHGAYSHTFEVLFHTDHEAFTQEI 120

Query: 121 ITNPTTEINAILRKVAPDFPDKVASVINHSYPNKQVVQLISSQIDCDRMDYLLRDSYYTA 180
           ITNP TEINAIL + APDFPDKVASVINH+YPNKQVVQLISSQIDCDRMDYLLRDSY++A
Sbjct: 121 ITNPETEINAILVRHAPDFPDKVASVINHTYPNKQVVQLISSQIDCDRMDYLLRDSYFSA 180

Query: 181 ASYGQFDLTRILRVIRPTDSGIAFARNGMHAVEDYIVSRFQMYMQVYFHPASRMELLLQ 240
           A+YGQFDL RILRVIRP + GI F   +GMHAVEDYIVSRFQMYMQVYFHPASRA EL+LQ
Sbjct: 181 ANYGQFDLMRILRVIRPVEDGIVFEHSGMHAVEDYIVSRFQMYMQVYFHPASRAVELILQ 240

Query: 241 NLLKRARFLFDTHRDFFEQTSPNLIPFFTDQYDLQDYLALDDGVMNTYFQSWMQADDNIL 300
           NLLKRA+ L+  +  ++F++T+P LIPFF  + +L DY+ALDDGVMNTYFQ WM ++D+IL
Sbjct: 241 NLLKRAQHLYPEQQAYFQKTAPGLIPFFEKKANLADYIALDDGVMNTYFQVWMASEDHIL 300

Query: 301 ADLANRFINRKVFKSITFEESDKENLVKMKELVSQVGFDPDYYTGVHANFDLPYDVYRPE 360
           +DLA+RFINRK+ KS+TF++  +     L ++++LV  VGFDPDYYTG+H NFDLPYD+YRPE
Sbjct: 301 SDLASRFINRKILKSVTFDQDSQGELERLRQLVESVGFDPDYYTGIHINFDLPYDIYRPE 360

Query: 361 HSNPRTEIQIIQKNGQLAELSSLSPIVKALTGSNYGDQRFYFPKEMLTLDSLFSSTKEEF 420
              NPRT+I+++QK+G LAELS LSPIVKALTG+ YGD+RFYFPKEML LD LF+ +KE F
Sbjct: 361 LENPRTQIEMMQKDGSLAELSQLSPIVKALTGTTYGDRRFYFPKEMLELDDLFAPSKETF 420

Query: 421 QSYITNEH                                                     428
           SYI+N H
Sbjct: 421 MSYISNGH                                                     428
```

Based on this analysis, it was predicted that these proteins and their epitopes could be useful antigens for vaccines or diagnostics.

EXAMPLE 1762

A DNA sequence (GBSx1869) was identified in *S. agalactiae* <SEQ ID 5477> which encodes the amino acid sequence <SEQ ID 5478>. Analysis of this protein sequence reveals the following:

```
Possible site: 46
>>> Seems to have no N-terminal signal sequence

----- Final Results -----
            bacterial cytoplasm --- Certainty = 0.4789(Affirmative) < succ>
             bacterial membrane --- Certainty = 0.0000(Not Clear)   < succ>
              bacterial outside --- Certainty = 0.0000(Not Clear)   < succ>
```

The protein has no significant homology with any sequences in the GENPEPT database.

A related DNA sequence was identified in *S. pyogenes* <SEQ ID 5479> which encodes the amino acid sequence <SEQ ID 5480>. Analysis of this protein sequence reveals the following:

```
Possible site: 57
>>> Seems to have no N-terminal signal sequence

----- Final Results -----
            bacterial cytoplasm --- Certainty = 0.3650(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below.

```
Identities = 64/127 (50%), Positives = 89/127 (69%)

Query:    5 MKLEINNNIQIDNETEMIHEIHDCQFIEKGSYVYLNYINAEGERVVIKANHEELLMTRFS    64
            MKL++ N+I+  +ETE+I EIHDC++ EKG Y YL Y N + E+VVIK N   +EL M+RFS
Sbjct:    1 MKLQLTNHIRFGDETEIIQEIHDCEWREKGGYQYLIYQNTDKEKVVIKYNETELTMSRFS    60

Query:   65 NPKSVMRFHRETPALVNIPTPLGVQHLITETSHYQFDLSQQRLHINYVLKQTETGDCFAN   124
            NP+S+M+F      L+ +PTP+GVQ  +T+TSHY  D S Q+L ++Y L Q +T    FA+
Sbjct:   61 NPQSIMKFFAGKKVLIALPTPMGVQQFLTDTSHYHLDCSCQKLDLHYHLLQAQTEMLFAS   120

Query:  125 YELRIQW                                                       131
            Y L + W
Sbjct:  121 YHLELSW                                                       127
```

Based on this analysis, it was predicted that these proteins and their epitopes could be useful antigens for vaccines or diagnostics.

EXAMPLE 1763

A DNA sequence (GBSx1870) was identified in *S. agalactiae* <SEQ ID 5481> which encodes the amino acid sequence <SEQ ID 5482>. This protein is predicted to be cation-transporting ATPase PacL (ctpF). Analysis of this protein sequence reveals the following:

```
Possible site: 14
>>> Seems to have no N-terminal signal sequence
    INTEGRAL     Likelihood = -13.27    Transmembrane    256-272 (246-276)
    INTEGRAL     Likelihood =  -9.02    Transmembrane     64-80  (58-85)
    INTEGRAL     Likelihood =  -8.49    Transmembrane    833-849 (828-855)
    INTEGRAL     Likelihood =  -8.17    Transmembrane     89-105 (81-107)
    INTEGRAL     Likelihood =  -7.48    Transmembrane    864-880 (860-884)
    INTEGRAL     Likelihood =  -3.29    Transmembrane    287-303 (284-306)
    INTEGRAL     Likelihood =  -2.55    Transmembrane    754-770 (753-773)
    INTEGRAL     Likelihood =  -0.85    Transmembrane    695-711 (694-711)
    INTEGRAL     Likelihood =  -0.75    Transmembrane    793-809 (792-809)
```

-continued
```
----- Final Results -----
           bacterial membrane --- Certainty = 0.6307(Affirmative) < succ>
           bacterial outside  --- Certainty = 0.0000(Not Clear)   < succ>
           bacterial cytoplasm --- Certainty = 0.0000(Not Clear)  < succ>
```

The protein has homology with the following sequences in the GENPEPT database.

```
>GP: CAB13439 GB: Z99112 similar to calcium-transporting ATPase
[Bacillus subtilis]
Identities = 380/888 (42%), Positives = 545/888 (60%),
Gaps = 49/888 (5%)

Query:   10 FYTQGQEEVLTSLESS-REGLSTTEAKNRLEMYGRNELEEGKKRSLIAKFFDQFKDLMII   68
            F+  GQ ++L +  +S ++GL+  E K RL+ +G NEL+EGKK S +  FF QFKD M++
Sbjct:    3 FHEMGQTDLLEATNTSMKQGLTEKEVKKRLDKHGPNELQEGKKTSALLLFFAQFKDFMVL   62

Query:   69 ILLVAAALSVITEGMHG-LTDALIILAVVILNAAFGVYQEGQAEAAIEALKDMSSPIARV  127
            +LL A  +S    G  G  DA+ I+A+V +N   G +QE +AE +++ALK++S+P
Sbjct:   63 VLLAATLIS----GFLGEYVDAVAIIAIVFVNGILGFFQERRAEQSLQALKELSTPHVMA  118

Query:  128 RRDGHTIEVDSKELVPGDLVMLEAGDVVPADLRLLEAASLKIEEAALTGESVPVEKDISQ  187
            R+G   ++ SKELVPGD+V  +GD + AD+R++EA SL+IEE+ALTGES+PV K    +
Sbjct:  119 LREGSWTKIPSKELVPGDIVKFTSGDRIGADVRIVEARSLEIEESALTGESIPVVKHADK  178

Query:  188 VVAEDAGIGDRVNMAYQNSNVTYGRGYGVVTNTGMYTEVGKIADMLANADESETPLKQSL  247
            +  D +GD NMA+  + VT G G GVV  TGM T +GKIADML +A      TPL++ L
Sbjct:  179 LKKPDVSLGDITNMAFMGTIVTRGSGVGVVVGTGMNTAMGKIADMLESAGTLSTPLQRRL  238

Query:  248 VQLSKLLTYLIVIIAVITFLVGIFVRKEGWIEGLMTSVALAVAAIPEGLPAIVTIVLSMG  307
             QL K+L + +++ V+   VG+ ++            V+LAVAAIPEGLPAIVT+ LS+G
Sbjct:  239 EQLGKILIVVALLLTVLVVAVGV-IQGHDLYSMFLAGVSLAVAAIPEGLPAIVTVALSLG  297

Query:  308 TKTLAKRNSIVRKLPAVETLGSTEIIASDKTGTLTMNQMTVEKVYT--------------  353
             + + K+ SIVRKLPAVETLG   II SDKTGT+T N+MTV  V++
Sbjct:  298 VQRMIKQKSIVRKLPAVETLGCASIICSDKTGTMTQNKMTVTHVWSGGKTWRVAGAGYEP  357

Query:  354 NGVLQSSSEEISVDNNTL--------RIMNFSNDTKIDPSGKLIGDPTETALVQFGLDKN  405
             G    + +EISV+ +             + N SN  K D     L GDPTE AL++
Sbjct:  358 KGSFTLNEKEISVNEHKPLQQMLLFGALCNNSNIEKRDGEYVLDGDPTEGALLTAARKGG  417

Query:  406 FDVREVLKNEPRVAELPFDSDRKLMSTIHKESDGRYFIAVKGAPDQLLKRVTKIEDNGLV  465
            F    V N  + E PFDS RK+M+ I  +  D + +I  KGAPD L++R ++I  +G
Sbjct:  418 FSKEFVESNYRVIEEFPFDSARKMMTVIVENQDRKRYIITKGAPDVLMQRSSRIYYDGSA  477

Query:  466 RDITAEDKEAILNTNKELAKQALRVLMMAYK--YETQIPSLETDIVESDLVFSGLVGMID  523
             + E K       + LA QALR + +AY+    + PS+E     E DL   GL G+ID
Sbjct:  478 ALFSNERKAETEAVLRHLASQALRTIAVAYRPIKAGETPSMEQ--AEKDLTMLGLSGIID  535

Query:  524 PERPEAAEAVRVAKEAGIRPIMITGDHQDTAEAIAKRLGIIDANDTEDHVFTGAELNELS  583
            P RPE +A++ +EAGI+ +MITGDH +TA+AIAK L ++ +      +  G LNELS
Sbjct:  536 PPRPEVRQAIKECREAGIKTVMITGDHVETAKAIAKDLRLLPKS---GKIMDGKMLNELS  592

Query:  584 DEEFQKVFKQYSVYARVSPEHKVRIVKAWQNDGKVVAMTGDGVNDAPSLKTADIGIGMGI  643
             EE   V +  V+ARVSPEHK++IVKA+Q +G +VAMTGDGVNDAP++K ADIG+ MGI
Sbjct:  593 QEELSHVVEDVYVFARVSPEHKLKIVKAYQENGHIVAMTGDGVNDAPAIKQADIGVSMGI  652

Query:  644 TGTEVSKGASDMVLADDNFATIIVAVEEGRKVFSNIQKSIQYLLSANMAEVFTIFFATLL  703
            TGT+V+K AS +VL DDNFATI  A++EGR ++ NI+K I+YLL++N+ E+   FA LL
Sbjct:  653 TGTDVAKEASSLVLVDDNFATIKSAIKEGRNIYENIRKFIRYLLASNVGEILVMLFAMLL  712

Query:  704 GWDV-LAPVHLLWINLVTDTLPAIALGVEPAEPGVMTHKPRGRQSNFFDGGVMGAIIYQG  762
              +   L P+ +LW+NLVTD LPA+ALG++    E VM KPR + +   F   +  +G
Sbjct:  713 ALPLPLVPIQILWVNLVTDGLPAMALGMDQPEGDVMKRKPRHPKEGVFARKLGWKVVSRG  772

Query:  763 ILQTILVLGVYGWALMY---PEHAGYRMIHADALTMAFATLGLIQLVHAFNVKSVYQSIF  819
             L   I V  +   ++Y    PE+   Y       A T+AFATL L QL+H F+  +S    S+F
Sbjct:  773 FL--IGVATILAFIIVYHRNPENLAY------AQTIAFATLVLAQLIHVFDCRS-ETSVF  823

Query:  820 TVGAFKNRTFNWSIPVAFILLMVTIVVPGFNKLFHVTHLSSTQWLTVV             867
             +    F+N    ++   +  + ++L++V I  P    +FH  ++     W+ V+
Sbjct:  824 SRNPFQNLYLIGAVLSSILLMLVVIYYPPLQPIFHTVAITPGDWMLVI             871
```

A related DNA sequence was identified in *S. pyogenes* <SEQ ID 4171> which encodes the amino acid sequence <SEQ ID 4172>. Analysis of this protein sequence reveals the following:

```
Possible site: 34
>>> Seems to have no N-terminal signal sequence
    INTEGRAL      Likelihood = -12.47    Transmembrane   863-879  (856-883)
    INTEGRAL      Likelihood = -10.08    Transmembrane    64-80   (58-86)
    INTEGRAL      Likelihood =  -8.97    Transmembrane   256-272  (249-275)
    INTEGRAL      Likelihood =  -8.55    Transmembrane    89-105  (81-107)
    INTEGRAL      Likelihood =  -5.84    Transmembrane   832-848  (827-850)
    INTEGRAL      Likelihood =  -3.13    Transmembrane   287-303  (284-307)
    INTEGRAL      Likelihood =  -2.66    Transmembrane   762-778  (761-779)
    INTEGRAL      Likelihood =  -0.37    Transmembrane   685-701  (685-701)

----- Final Results -----
              bacterial membrane --- Certainty = 0.5989(Affirmative) < succ>
               bacterial outside --- Certainty = 0.0000(Not Clear)   < succ>
             bacterial cytoplasm --- Certainty = 0.0000(Not Clear)   < succ>
```

An alignment of the GAS and GBS proteins is shown below.

```
Identities = 735/892 (82%), Positives = 813/892 (90%), Gaps = 1/892 (0%)
Query:   3 KEQKKSLFYTQGQEEVLTSLESSREGLSTTEAKNRLEMYGRNELEEGKKRSLIAKFFDQF    62
           KEQ+    FYTQ +E VL  LE+SREGL++ +AK RL  YGRNEL+EG+KRSL  KF DQF
Sbjct:   3 KEQRHEAFYTQSEETVLAQLETSREGLTSAQAKERLAEYGRNELDEGEKRSLFMRFLDQF    62

Query:  63 KDLMIIILLVAAALSVITEGMHGLTDALIILAVVILNAAFGVYQEGQAEAAIEALKDMSS   122
           KDLMIIIL+VAA LSV+TEGM GLTDA+IILAVVILNAAFGVYQEGQAEAAIEALK MSS
Sbjct:  63 KDLMIIILIVAALLSVLTEGMEGLTDAIIILAVVILNAAFGVYQEGQAEAAIEALKSMSS   122

Query: 123 PIARVRRDGHTIEVDSKELVPGDLVMLEAGDVVPADLRLLEAASLKIEEAALTGESVPVE   182
           P+AR+RRDGH  E+DSKELVPGD+V+LEAGDVVPADLRLLEA SLKIEEAALTGESVPVE
Sbjct: 123 PLARIRRDGHVTEIDSKELVPGDIVLLEAGDVVPADLRLLEANSLKIEEAALTGESVPVE   182

Query: 183 KDISQVVAEDAGIGDRVNMAYQNSNVTYGRGYGVVTNTGMYTEVGKIADMLANADESETP   242
           KD+S  V+EDAGIGDRVNM YQNSNVTYGRG GV+TNTGMYTEVG IA MLANADE++TP
Sbjct: 183 KDLSTAVSEDAGIGDRVNMGYQNSNVTYGRGIGVITNTGMYTEVGHIAGMLANADETDTP   242

Query: 243 LKQSLVQLSKLLTYLIVIIAVITFLVGIFVRKEGWIEGLMTSVALAVAAIPEGLPAIVTI   302
           LKQ+L  LSK+LTY I++IA +TF VG+F+R +  +EGLMTSVALAVAAIPEGLPAIVT+
Sbjct: 243 LKQNLDNLSKILTYAILVIAAVTFAVGVFLRGQHPLEGLMTSVALAVAAIPEGLPAIVTV   302

Query: 303 VLSMGTKTLAKRNSIVRKLPAVETLGSTEIIASDKTGTLTMNQMTVEKVYTNGVLQSSSE   362
           VLS+GT+ LAKRN+I+RKLPAVETLGSTEIIASDKTGTLTMNQMTVEKVYTNG LQSSS
Sbjct: 303 VLSLGTQVLAKRNAIIRKLPAVETLGSTEIIASDKTGTLTMNQMTVEKVYTNGTLQSSSA   362

Query: 363 EISVDNNTLRIMNFSNDTKIDPSGKLIGDPTETALVQFGLDKNFDVREVLKNEPRVAELP   422
            +I+ DN TLR+MNF+NDTK+DPSGKLIGDPTETALV+FGLD NFDVRE +  EPRVAELP
Sbjct: 363 DIAFDNTTLRVMNFANDTKVDPSGKLIGDPTETALVEFGLDHNFDVREAMVAEPRVAELP   422

Query: 423 FDSDRKLMSTIHKESDGRYFIAVKGAPDQLLKRVTKIEDNGLVRDITAEDKEAILNTNKE   482
           FDSDRKLMSTIHK++DG+YFIAVKGAPDQLLKRVT+IE+NG +R IT  DK+  IL+TNK
Sbjct: 423 FDSDRKLMSTIHKQADGKYFIAVKGAPDQLLKRVTQIEENGQIRPITADDKKTILDTNKS   482

Query: 483 LAKQALRVLMMAYKYETQIPSLETDIVESDLVFSGLVGMIDPERPEAAEAVRVAKEAGIR   542
           LAKQALRVLMMAYKY   +P+LET+IVE++LVFSGLVGMIDPERPEA+AV+VAKEAGIR
Sbjct: 483 LAKQALRVLMMAYKYSDALPTLETEIVEANLVFSGLVGMIDPERPEAAQAVKVAKEAGIR   542

Query: 543 PIMITGDHQDTAEAIAKRLGIIDANDTEDHVFTGAELNELSDEEFQKVFKQYSVYARVSP   602
           PIMITGDHQDTA+AIAKRLGII+  D  DHVFTGAELNELSDEEFQKVFKQYSVYARVSP
Sbjct: 543 PIMITGDHQDTAKAIAKRLGIIE-EDGVDHVFTGAELNELSDEEFQKVFKQYSVYARVSP   601

Query: 603 EHKVRIVKAWQNDGKVVAMTGDGVNDAPSLKTADIGIGMGITGTEVSKGASDMVLADDNF   662
           EHKVRIVKAWQN+GKVVAMTGDGVNDAPSLKTADIGIGMGITGTEVSKGASDMVLADDNF
Sbjct: 602 EHKVRIVKAWQNEGKVVAMTGDGVNDAPSLKTADIGIGMGITGTEVSKGASDMVLADDNF   661

Query: 663 ATIIVAVEEGRKVFSNIQKSIQYLLSANMAEVFTIFFATLLGWDVLAPVHLLWINLVTDT   722
           ATIIVAVEEGRKVFSNIQK+IQYLLSANMAEVFTIF  ATL GWDVL PVHLLWINLVTDT
Sbjct: 662 ATIIVAVEEGRKVFSNIQKTIQYLLSANMAEVFTIFLATLFGWDVLQPVHLLWINLVTDT   721

Query: 723 LPAIALGVEPAEPGVMTHKPRGRQSNFFDGGVMGAIIYQGILQTILVLGVYGWALMYPEH   782
           LPAIALGVEPAEPGVM HKPRGR+S+FFDGGV  AI+YQG QTILVLGVYG+ALM PEH
Sbjct: 722 LPAIALGVEPAEPGVMHKPRGRKSSFFDGGVKEAILYQGAFQTILVLGVYGFALMFPEH   781

Query: 783 AGYRMIHADALTMAFATLGLIQLVHAFNVKSVYQSIFTVGAFKNRTFNWSIPVAFILLMV   842
            Y  +HADALTMA+ TLGLIQLVHA+NVKSVYQSIFTVG FKN+ FN+SIPVAF+ LM
Sbjct: 782 TSYHDVHADALTMAYVTLGLIQLVHAYNVKSVYQSIFTVGLFKNKLFNYSIPVAFVALMA   841
```

-continued

```
Query: 843 TIVVPGFNKLFHVTHLSSTQWLTVVIGSLLMVVLTEIVKFIQRKLGQDEKAI  894
            T+VVPGFN+ FHVTHL+ TQWL V+IGSLLMVVL E+VK +QR LGQDEKAI
Sbjct: 842 TVVVPGFNQFFHVTHLTITQWLVVIIGSLLMVVLVELVKAVQRSLGQDEKAI  893
```

A related GBS gene <SEQ ID 8897> and protein <SEQ ID 8898> were also identified. Analysis of this protein sequence reveals the following:

```
Lipop: Possible site: -1 Crend: 6
McG: Discrim Score: -9.88
GvH: Signal Score (-7.5): -6.96
Possible site: 14
>>> Seems to have no N-terminal signal sequence
ALOM program      count: 9        value: -13.27           threshold: 0.0
INTEGRAL          Likelihood = -13.27    Transmembrane    256-272 (246-276)
INTEGRAL          Likelihood = -9.02     Transmembrane     64-80  (58-85)
INTEGRAL          Likelihood = -8.49     Transmembrane    833-849 (828-855)
INTEGRAL          Likelihood = -8.17     Transmembrane     89-105 (81-107)
INTEGRAL          Likelihood = -7.48     Transmembrane    864-880 (860-884)
INTEGRAL          Likelihood = -3.29     Transmembrane    287-303 (284-306)
INTEGRAL          Likelihood = -2.55     Transmembrane    754-770 (753-773)
INTEGRAL          Likelihood = -0.85     Transmembrane    695-711 (694-711)
INTEGRAL          Likelihood = -0.75     Transmembrane    793-809 (792-809)
PERIPHERAL        Likelihood = 1.06                       714
modified ALOM score: 3.15

*** Reasoning Step: 3

----- Final Results -----
              bacterial membrane --- Certainty = 0.6307 (Affirmative) < succ>
               bacterial outside --- Certainty = 0.0000 (Not Clear)  < succ>
             bacterial cytoplasm --- Certainty = 0.0000 (Not Clear)  < succ>
```

The protein has homology with the following sequences in the databases:

```
ORF01112(328-2901 of 3282)
EGAD|108247|BS1566(3-871 of 890) hypothetical protein {Bacillus subtilis}
OMNI|NT01BS1841 cation-transporting ATPase PacL GP|2337795|emb|CAA74269.1||Y13937
putative PacL protein {Bacillus subtilis} GP|2633938|emb|CAB13439.1||Z99112 similar
to calcium-transporting ATPase {Bacillus subtilis} PIR|H69877|H69877 calcium-
transporting ATPase homolog ylob-Bacillus subtilis
% Match = 29.0
% Identity = 43.9 % Similarity = 64.5
Matches = 376    Mismatches = 291    Conservative Sub.s = 176

249       279       309       339       369       396       426       456
GVVLNSETCFHKNRSLFVCGETKGGKVLLKEQKKSLFYTQGQEEVLTSLESS-REGLSTTEAKNRLEMYGRNELEEGKKR
                                   |: || ::| :  :|  ::||:  |    |  | ||: ||  ||||
                                   MKFHEMGQTDLLEATNTSMKQGLTEKEVKKRLDKHGPNELQEGKKT
                                             10        20        30        40

486       516       546       576       606       636       666       696
SLIAKFFDQFKDLMIIILLVAAALSVITEGMHGLTDALIILAVVILNAAFGVYQEGQAEAAIEALKDMSSPIARVRRDGH
| :  ||  ||||:|:::||      |  ::|:  :  ||: ||  |  :  :|| :|  :::||::|:|      |:|
SALLLFFAQFKDPMVLVLL---AATLISGFLGEYVDAVAIIAIVFVNGILGFFQERRAEQSLQALKELSTPHVMALREGS
          60        70        80        90       100       110       120

726       756       786       816       846       876       906       936
TIEVDSKELVPGDLVMLEAGDVVPADLRLLEAASLKIEEAALTGESVPVEKDISQVVAEDAGIGDRVNMAYQNSNVTYGR
 :: |||||||||:| : :|| : ||::|::|| |:|:|||||||:|||| | |  ||  | ||: ||   : || |
WTKIPSKELVPGDIVKFTSGDRIGADVRIVEARSLEIEESALTGESIPVVKHADKLKKPDVSLGDITNMAFMGTIVTRGS
          140       150       160       170       180       190       200
```

-continued

```
      966       996      1026      1056      1086      1116      1146      1176
GYGVVTNTGMYTEVGKIADMLANADESETPLKQSLVQLSKLLTYLIVIIAVITFLVGIFVRKEGWIEGLMTSVALAVAAI
 | |||   ||| :|||||||  :|     |||::  | ||  |:|  : ::: |:   ||: ::      :: |:||||||
GVGVVVGTGMNTAMGKIADMLESAGTLSTPLQRRLEQLGKILIVVALLLTVLVVAVGV-IQGHDLYSMFLAGVSLAVAAI
             220       230       240       250       260       270       280

1206      1236      1266      1296      1326      1356              1374
PEGLPAIVTIVLSMGTKTLAKRNSIVRKLPAVETLGSTEIIASDKTGTLTMNQMTVEKVYT--------------NGVLQ
|||||||||:  ||:|  :  : |: ||||||||||||| ||  ||||||  |:|||     |::           |  :
PEGLPAIVTVALSLGVQRMIKQKSIVRKLPAVETLGCASIICSDKTGTMTQNKMTVTHVWSGGKTWRVAGAGYEPKGSFT
             300       310       320       330       340       350       360

1404                1440      1470      1500      1530      1560      1590
SSSEEISVDNNT--------LRIMNFSNDTKIDPSGKLIGDPTETALVQFGLDKNFDVREVLKNEPRVAELPFDSDRKLM
:  : |||| :  :                  :  |||   | |   |||||:         |       |   :  :|||| ||:|
LNEKEISVNEHKPLQQMLLFGALCNNSNIEKRDGEYVLDGDPTEGALLTAARKGGFSKEFVESNYRVIEEFPFDSARKMM
             380       390       400       410       420       430       440

1620      1650      1680      1710      1740      1770      1794      1824
STIHKESDGRYFIAVKGAPDQLLKRVTKIEDNGLVRDITAEDKEAILNTNKELAKQALRVLMMAYK--YETQIPSLETDI
:  |   :  | : :|   |||||  ::| ::|    :|    | |:  :    |  : ::||   :     |  ||:|
TVIVENQDRKRYIITKGAPDVLMQRSSRIYYDGSAALFSNERKAETEAVLRHLASQALRTIAVAYRPIKAGETPSME--Q
              460       470       480       490       500       510       520

1854      1884      1914      1944      1974      2004      2034      2064
VESDLVFSGLVGMIDPERPEAAEAVRVAKEAGIRPIMITGDHQDTAEAIAKRLGIIDANDTEDHVFTGAELNELSDEEFQ
 | ||       || |:||| |||     :|::  :|||: :|||||| :||::||| |  |     :     |||||  ||:
AEKDLTMLGLSGIIDPPRPEVRQAIKECREAGIKTVMITGDHVETAKAIAKDL---RLLPKSGKIMDGKMLNELSQEELS
           530       540       550       560       570       580       590
     2094      2124      2154      2184      2214      2244      2274      2304
KVFKQYSVYARVSPEHKVRIVKAWQNDGKVVAMTGDGVNDAPSLKTADIGIGMGITGTEVSKGASDMVLADDNFATIIVA
  | :   |:||||||||::||||:  :|  :|:||||||||||||::| ||||:  |||||||:|: |   :|| ||||||||||  |
HVVEDVYVFARVSPEHKLKIVKAYQENGHIVAMTGDGVNDAPAIKQADIGVSMGITGTDVAKEASSLVLVDDNFATIKSA
           610       620       630       640       650       660       670

2334      2364      2394             2451      2481      2511      2541
VEEGRKVFSNIQKSIQYLLSANMAEVFTIFFATLLGWDV-LAPVHLLWINLVTDTLPAIALGVEPAEPGVMTHKPRGRQS
::|||  :: ||:| |:|||::|: |:: ::::|||   :    :     | |:::||:|||||||| :::  ::    ||    |||   ||
IKEGRNIYENIRKFIRYLLASNVGEILVMLFAMLLALPLPLVPIQILWVNLVTDGLPAMALGMDQPEGDVMKRKPRHPKE
           690       700       710       720       730       740       750

2571      2601      2631      2661      2691      2721      2751      2781
NFFDGGVMGAIIYQGILQTILVLGVYGWALMYPEHAGYRMIHADALTMAFATLGLIQLVHAFNVKSVYQSIFTVGAFKNR
  |      :  ::: :|      |        :    :::|     | |||| ||||:| |: :|    |: :       |:|
GVFARKLGWKVVSRGFLIG--VATILAFIIVY--HRN-PENLAYAQTIAFATLVLAQLIHVFDCRS-ETSVFSRNPFQNL
           770       780       790       800       810       820       830

2811      2841      2871      2901      2931      2961      2991      3021
TFNWSIPVAFILLMVTIVVPGFNKLFHVTHLSSTQWLTVVIGSLLMVVLTEIVKFIQRKLGQDEKAI*FS**KNSLRISK
 :   ::  : :|::|      |    |:  ||      |        :||
YLIGAVLSSILLMLVVIYYPPLQPIFHTVAITPGDWMLVIGMSAIPTFLLAGSLLTRKK
             850       860       870       880       890
```

Based on this analysis, it was predicted that these proteins and their epitopes could be useful antigens for vaccines or diagnostics.

EXAMPLE 1764

A DNA sequence (GBSx1871) was identified in *S. agalactiae* <SEQ ID 5483> which encodes the amino acid sequence <SEQ ID 5484>. Analysis of this protein sequence reveals the following:

```
Possible site: 48
>>> Seems to have no N-terminal signal sequence

----- Final Results -----
         bacterial cytoplasm --- Certainty = 0.2905 (Affirmative) < succ>
          bacterial membrane --- Certainty = 0.0000 (Not Clear)   < succ>
           bacterial outside --- Certainty = 0.0000 (Not Clear)   < succ>
```

The protein has homology with the following sequences in the GENPEPT database.

```
>GP:CAB48940 GB:AJ248283 hypothetical protein [Pyrococcus abyssi]
Identities = 60/221 (27%), Positives = 100/221 (45%), Gaps = 37/221 (16%)
Query:   33 KIDHLHIA------GDISNHFTKDTLP-FINNLKKH---IKLSYNLGNHDMLDLTE--TE   80
            KID L I       GD+SN+   D +  I+ L    + L   GNHD+  L +
Sbjct:   15 KIDVLKIPDIAIQLGDLSNYGEPDIIENLISELVTQLDPVPLLVIPGNHDIYGLNDIFAA   74

Query:   81 IQRLDFQTYR------------FDKKMLLAFHGWYDYSFSNN--RDIKDVEKLKKTFWFD  126
            QR +      R              ++ ++  GWYDYS +       KD  ++K  F F
Sbjct:   75 FQRFNKLVKRAGAIPLMEGPLILEEIGIVGVPGWYDYSLAPGYLNMTKDEYEIK-AFGFR  133

Query:  127 RR-----LKRPNNDVTIQASILKRLDEILAKVDSS--NIIIAMHFVPHKQFTMT--HPRF  177
             R      +K   +D  +    L  L++ ++++   S   ++I+A+HF P K       +P
Sbjct:  134 RLEDADYIKSSLSDEELVRWNLNLLEKFISEIRESVNDVILALHFAPFKDSLKYTGNPEI  193

Query:  178 SPFNAFLGSQAYHDLFQKYHIKDVVFGHAHRSFGDVKIGET                    218
               F+A++GSQ + +   +++I  +V GH HRS  +   IG+T
Sbjct:  194 DYFSAYMGSQRFGEFALRHNIGLIVHGHTHRSI-EYYIGKT                    233
```

No corresponding DNA sequence was identified in *S. pyogenes*.

Based on this analysis, it was predicted that this protein and its epitopes, could be useful antigens for vaccines or diagnostics.

EXAMPLE 1765

A DNA sequence (GBSx1872) was identified in *S. agalactiae* <SEQ ID 5485> which encodes the amino acid sequence <SEQ ID 5486>. Analysis of this protein sequence reveals the following:

```
Possible site: 44
>>> Seems to have no N-terminal signal sequence
INTEGRAL     Likelihood = -2.18        Transmembrane      173-189 (173-189)

----- Final Results -----
              bacterial membrane --- Certainty = 0.1871 (Affirmative) < succ>
               bacterial outside --- Certainty = 0.0000 (Not Clear)   < succ>
             bacterial cytoplasm --- Certainty = 0.0000 (Not Clear)   < succ>
```

The protein has homology with the following sequences in the GENPEPT database.

```
>GP:CAB16056 GB:Z99124 fructose-1,6-bisphosphatase [Bacillus subtilis]
Identities = 314/642 (48%), Positives = 446/642 (68%), Gaps = 7/642 (1%)
Query:    2 SNFYKLLKEKFPRKEDIVTEMINLEAICQLPKGTEYFISDLHGEYDAVDYLLRTGAGSIR   61
            S +  LL +K+  +E +VTE+INL+AI   LPKGTE+F+SDLHGEY A  ++LR G+G ++
Sbjct:   33 SKYLDLLAQKYDCEEKVVTEIINLKAILNLPKGTEHFVSDLHGEYQAFQHVLRNGSGRVK   92

Query:   62 AKLLDCFDWQKIVAVDLDDFCILLYYPKEKLAFDKMNLSASAYKTKLW-EMIPLQIQVLK  120
            K+ D F     I   ++D+    L+YYP++KL    K  + A      + + E I   I+++
Sbjct:   93 EKIRDIFSGV-IYDREIDELAALVYYPEDKLKLIKHDFDAKEALNEWYKETIHRMIKLVS  151

Query:  121 YFSSKYTKSKVRKQLSGKFAYIIEELLAEIDRNPEKKSYFDTIIEKLFELDQVEDLIIVL  180
            Y SSKYT+SK+RK L  +FAYI EELL + ++    K+ Y+  II+++ EL Q + LI  L
Sbjct:  152 YCSSKYTRSKLRKALPAQFAYITEELLYKTEQAGNKEQYYSEIIDQIIELGQADKLITGL  211

Query:  181 SQTIQVLIIDHLHVVGDIYDRGRYPDRILNRLMAFPNLDIQWGNHDVTWMGAASGSYLCN  240
            + ++Q L++DHLHVVGDIYDRG  PDRI   L+ +  ++DIQWGNHDV W+GA SGS +C+
Sbjct:  212 AYSVQRLVVDHLHVVGDIYDRGPQPDRIMEELINYHSVDIQWGNHDVLWIGAYSGSKVCL  271

Query:  241 VNVIRIAARYNNITLIEDRYGINLRRLVDYSRRYYEPLPSFVPILDGEEMTHPDELDLLN  300
             N+IRI ARY+N+ +IED YGINLR L++ + +YY+  P+F P  D  E    DE+ +
Sbjct:  272 ANIIRICARYDNLDIIEDVYGINLRPLLNLAEKYYDDNPAFRPKAD--ENRPEDEIKQIT  329

Query:  301 MIQQATAILQFKLEAQLIDRRPEFQMHNRQLINQVNYKDLSISIKEVVHQLKDFNSRCID  360
             I  QA A++QFKLE+ +I RRP F M  R L+ +++Y    I++    +QL++      I+
Sbjct:  330 KIHQAIAMIQFKLESPIIKRRPNFNMEERLLLEKIDYDKNEITLNGKTYQLENTCFATIN  389

Query:  361 SKNPSRLTSEEEELLQQLMIAFQTSESLKKHIDFLFEKGSMYLTYNDNLLFHGCIPMHSN  420
             +  P +L  EE E++  +L+ + Q SE L +H++F+ +KGS+YL YN NLL HGCIP+  N
Sbjct:  390 PEQPDQLLEEEAEVIDKLLFSVQHSEKLGRHMNFMMKKGSLYLKYNGNLLIHGCIPVDEN  449
```

-continued

```
Query: 421 GDFKSFKIAGKTYGGRDLLDLFESQIRLAYARPEKHDDLATDIIWYLWCGENSSLFGKNA 480
            G+ ++  I  K Y GR+LLD+FE  +R A+A PE+ DDLATD+ WYLW GE SSLFGK A
Sbjct: 450 GNMETMMIEDKPYAGRELLDVFERFLREAFAHPEETDDLATDMAWYLWTGEYSSLFGKRA 509

Query: 481 MTTFERYYVSDKVTHQERKNPYFKLRDKDDICTALLQEFDL-PKFGHIVNGHTPVKEKNG 539
            MTTFERY++ +K TH+E+KNPY+ LR+ +  C  +L EF L P  GHI+NGHTPVKE  G
Sbjct: 510 MTTFERYFIKEKETHKEKKNPYYYLREDEATCRNILAEFGLNPDHGHIINGHTPVKEIEG 569

Query: 540 EQPIKANGKMLVIDGGFAKGYQKNTGLAGYTLIYNSYGIQLISHLPFTSIEEVLSGTNYI 599
            E PIKANGKM+VIDGGF+K YQ  TG+AGYTL+YNSYG+QL++H  F S   EVLS   +
Sbjct: 570 EDPIKANGKMIVIDGGFSKAYQSTTGIAGYTLLYNSYGMQLVAHKHFNSKAEVLSTGTDV 629

Query: 600 IDTKRLVEEAKDRILVKDTTIGQKLTKEIKDLDHL--YRHFQ                  639
            +   KRLV++  +R  VK+T +G++L +E+   L+ L  YR+ +
Sbjct: 630 LTVKRLVDKELERKKVKETNVGEELLQEVAILESLREYRYMK                  671
```

15

No corresponding DNA sequence was identified in *S. pyogenes*.

Figure 168:
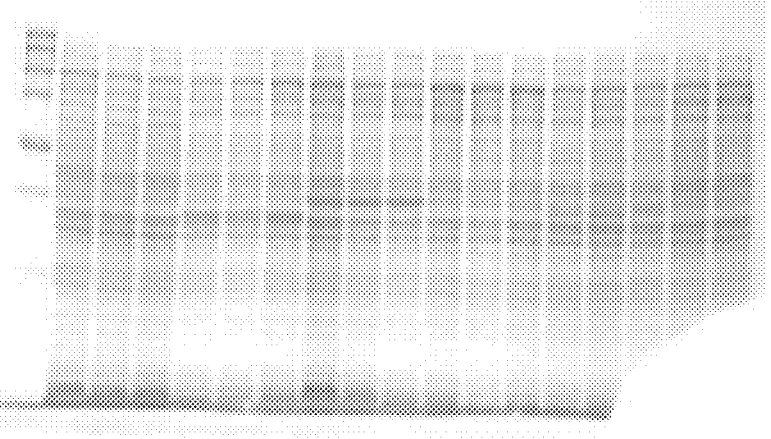
Figure 169:
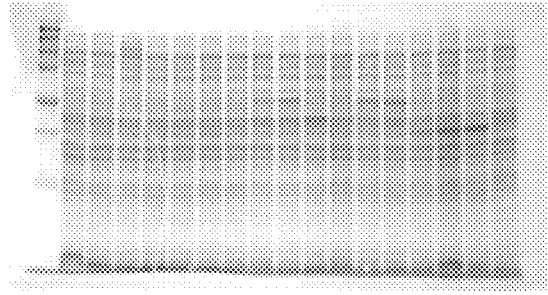
Figure 170:
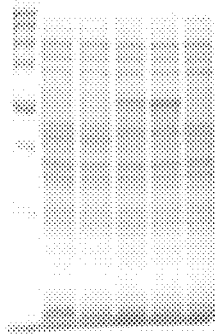

SEQ ID 5486 (GBS197) was expressed in *E. coli* as a His-fusion product. SDS-PAGE analysis of total cell extract is shown in FIG. 168 (lane 17 & 18; MW 89 kDa) and in FIG. 169 (lane 2; MW 89 kDa). It was also expressed in *E. coli* as a GST-fusion product. SDS-PAGE analysis of total cell extract is shown in FIG. 37 (lane 6; MW 99 kDa).

Purified Thio-GBS197-His is shown in FIG. 244, lane 6.

Based on this analysis, it was predicted that this protein and its epitopes, could be useful antigens for vaccines or diagnostics.

EXAMPLE 1766

A DNA sequence (GBSx1873) was identified in *S. agalactiae* <SEQ ID 5487> which encodes the amino acid sequence <SEQ ID 5488>. Analysis of this protein sequence reveals the following:

```
Possible site: 24
>>> Seems to have no N-terminal signal sequence

----- Final Results -----
              bacterial cytoplasm --- Certainty = 0.2433 (Affirmative) < succ>
              bacterial membrane  --- Certainty = 0.0000 (Not Clear)   < succ>
              bacterial outside   --- Certainty = 0.0000 (Not Clear)   < succ>
```

The protein has homology with the following sequences in the GENPEPT database.

```
>GP:CAB12719 GB:Z99108 alternate gene name: ygaP~similar to
hypothetical proteins [Bacillus subtilis]
Identities = 176/367 (47%), Positives = 240/367 (64%), Gaps = 6/367 (1%)
Query:   3 IKAEIQKLAKEIGISKIGFTTADNFDYLEKSLRASVEEGRNSGFEHKVIEDRIYPERLLE   62
           +K E+ + AK IG+ KIGFTTAD FD L+  L    G  SGFE   IE R+ P+ LL
Sbjct:  55 LKEELIEYAKSIGVDKIGFTTADTFDSLKDRLILQESLGYLSGFEEPDIEKRVTPKLLLP  114

Query:  63 SAKTIISIGVAYPHKLPQQPQKT-SYKRGKITPNSWGLDYHYVVGEKLDRLSKGIEELCR  121
           +AK+I++I +AYP ++    P+ T + +RG   SWG DYH V+   EKLD L    ++
Sbjct: 115 KAKSIVAIALAYPSRMKDAPRSTRTERRGIFCRASWGKDYHDVLREKLDLLEDFLKSKHE  174

Query: 122 DFPLQQKAMVDTGALVDTAVAQRAGIGFIGKNGLVISKEYGSYMFLGELITNLEIEPDKP  181
           D  ++ K+MVDTG L D AVA+RAGIGF  KN ++ + EYGSY++L E+ITN+  EPD P
Sbjct: 175 D--IRTKSMVDTGELSDRAVAERAGIGFSAKNCMITTPEYGSYVYLAEMITNIPFEPDVP  232

Query: 182 VDYDCGDCRRCLDACPTSCLIGDGSMNAKRCLSFQTQDKGMMDIEFRKKIKTVIYGCDIC  241
           ++   CG C +CLDACPT  L+  G +NA+RC+SF TQ KG +   EFR KI   +YGCD C
Sbjct: 233 IEDMCGSCTKCLDACPTGALVNPGQLNAQRCISFLTQTKGFLPDEFRTKIGNRLYGCDTC  292

Query: 242 QICCPYNKGINNPLATEI--DPELAQPELIPFLSLSNGQFKEKFGMIAGSWRGKNILQRN  299
           Q  CP NKG + L  E+  DPE+A+P L P L++SN +FKEKFG ++GSWRGK +QRN
Sbjct: 293 QTVCPLNKGKDFHLHPEMEPDPEIAKPLLKPLLAISNREFKEKFGHVSGSWRGKKPIQRN  352
```

```
-continued
Query:  300 AIIALANAHDKTAVVKLIEIIDKNNNPIHTATAIWALGEIVKKPNDEILEFMSNLTLKDE  359
            AI+ALA+   D  +A+ +L E++ K+  P+     TA WA+G+I      E LE         KDE
Sbjct:  353 AILALAHFKDASALPELTELMHKDPRPVIRGTAAWAIGKIGDPAYAEELEKALEKE-KDE  411

Query:  360 DSRKELE                                                       366
            +++ E+E
Sbjct:  412 EAKLEIE                                                       418
```

A related DNA sequence was identified in *S. pyogenes* <SEQ ID 5489> which encodes the amino acid sequence <SEQ ID 5490>. Analysis of this protein sequence reveals the following:

```
Possible site: 21
>>> Seems to have no N-terminal signal sequence

----- Final Results -----
              bacterial cytoplasm --- Certainty = 0.3337(Affirmative) < succ>
               bacterial membrane --- Certainty = 0.0000(Not Clear)   < succ>
                 bacterial outside --- Certainty = 0.0000(Not Clear)   < succ>
```

An alignment of the GAS and GBS proteins is shown below.

```
Identities = 363/374 (97%), Positives = 367/374 (98%)
Query:    1 MDIKAEIQKLAKEIGISKIGFTTADNFDYLEKSLRASVEEGRNSGFEHKVIEDRIYPERL   60
            M IKAEI+ LAKEIGISKIGFTTADNFDYLEKSLRASVEEGRNSGFEHKVIEDRIY ERL
Sbjct:   18 MTIKAEIKALAKEIGISKIGFTTADNFDYLEKSLRASVEEGRNSGFEHKVIEDRIYTERL   77

Query:   61 LESAKTIISIGVAYPHKLPQQPQKTSYKRGKITPNSWGLDYHYVVGEKLDRLSKGIEELC  120
            LESAKTIISIGVAYPHKLPQQPQKT YKRGKITP+SWGLDYHYVVGEKLDRLSKGIEELC
Sbjct:   78 LESAKTIISIGVAYPHKLPQQPQKTPYKRGKITPSSWGLDYHYVVGEKLDRLSKGIEELC  137

Query:  121 RDFPLQQKAMVDTGALVDTAVAQRAGIGFIGKNGLVISKEYGSYMFLGELITNLEIEPDK  180
            RDFPLQQKAMVDTGALVDTAVAQRAGIGFIGKNGLVISKEYGSYMFLGELITNLEIEPDK
Sbjct:  138 RDFPLQQKAMVDTGALVDTAVAQRAGIGFIGKNGLVISKEYGSYMFLGELITNLEIEPDK  197

Query:  181 PVDYDCGDCRRCLDACPTSCLIGDGSMNAKRCLSFQTQDKGMMDIEFRKKIKTVIYGCDI  240
            PVDYDCGDCRRCLDACPTSCLIGDGSMNAKRCLSFQTQDKGMMDIEFRKKIKTVIYGCDI
Sbjct:  198 PVDYDCGDCRRCLDACPTSCLIGDGSMNAKRCLSFQTQDKGMMDIEFRKKIKTVIYGCDI  257

Query:  241 CQICCPYNKGINNPLATEIDPELAQPELIPFLSLSNGQFKEKFGMIAGSWRGKNILQRNA  300
            CQICCPYNKGINN  ATEIDPELAQPELIPFLSLSNG+FKEKFGMIAGSWRGKNILQRNA
Sbjct:  258 CQICCPYNKGINNSPATEIDPELAQPELIPFLSLSNGKFKEKFGMIAGSWRGKNILQRNA  317

Query:  301 IIALANAHDKTAVVKLIEIIDKNNNPIHTATAIWALGEIVKKPNDEILEFMSNLTLKDED  360
            IIALANAHDKTAVVKLIEIIDKNNNPIHTATAIWALGEIVKKPNDEIL FMS+LTLKDED
Sbjct:  318 IIALANAHDKTAVVKLIEIIDKNNNPIHTATAIWALGEIVKKPNDEILAFMSHLTLKDED  377

Query:  361 SRKELELIRHKWQF                                                374
            SRKELELIRHKWQF
Sbjct:  378 SRKELELIRHKWQF                                                391
```

Based on this analysis, it was predicted that these proteins and their epitopes could be useful antigens for vaccines or diagnostics.

EXAMPLE 1767

A DNA sequence (GBSx1874) was identified in *S. agalactiae* <SEQ ID 5491> which encodes the amino acid sequence <SEQ ID 5492>. This protein is predicted to be peptide chain release factor 2, fragment (prfB). Analysis of this protein sequence reveals the following:

```
Possible site: 23
>>> Seems to have no N-terminal signal sequence

----- Final Results -----
              bacterial cytoplasm --- Certainty = 0.4903(Affirmative) < succ>
               bacterial membrane --- Certainty = 0.0000(Not Clear)   < succ>
                 bacterial outside --- Certainty = 0.0000(Not Clear)   < succ>
```

The protein has homology with the following sequences in the GENPEPT database.

```
>GP:AAC67303 GB:AF017113 putative peptide chain release factor RF-2
[Bacillus subtilis]
Identities = 194/336 (57%), Positives = 251/336 (73%), Gaps = 2/336 (0%)
Query:    2 EEEIALLENQMTEPDFWNDNIAAQKTSQELNELKGKYDTFHNMQELSDETELLLEMLDE-   60
            E  IA L+ QM +P+FWND   AQ    E N LK   +++  + E  +E ++  ++L E
Sbjct:   30 EARIAELDEQMADPEFWNDQQKAQTVINEANGLKDYVNSYKKLNESHEELQMTHDLLKEE   89

Query:   61 -DDSLKEELEENLMQLDKIMGAYEMTLLLSEPYDHNNAILEIHPGSGGTEAQDWGDLLLR   119
             D  L+ ELE+ L  L K     +E+ LLLSEPYD NNAILE+HPG+GGTE+QDWG +LLR
Sbjct:   90 PDTDLQLELEKELKSLTKEFNEFELQLLLSEPYDKNNAILELHPGAGGTESQDWGSMLLR   149

Query:  120 MYTRFGNANGFKVEVLDYQAGDEAGIKSVTLSFEGPNAYGLLKSEMGVHRLVRISPFDSA   179
            MYTR+G   GFKVE LDY  GDEAGIKSVTL  +G NAYG LK+E GVHRLVRISPFDS+
Sbjct:  150 MYTRWGERRGFKVETLDYLPGDEAGIKSVTLLIKGHNAYGYLKAEKGVHRLVRISPFDSS   209

Query:  180 KRRHTSFASVEVMPELDDTIEVEVRDDDIKMDTFRSGGAGGQNVNKVSTGVRLTHIPTGI   239
             RRHTSF S EVMPE +D I++++R +DIK+DT+R+ GAGGQ+VN    + VR+TH+PT +
Sbjct:  210 GRRHTSFVSCEVMPEFNDEIDIDIRTEDIKVDTYRASGAGGQHVNTTDSAVRITHLPTNV   269

Query:  240 VVSSTVDRTQYGNRDRAMKMLQAKLYQLEQEKKAQEVDALKGDKKEITWGSQIRSYVFTP   299
             VV+   +R+Q NR+RAMKML+AKLYQ   E++  E+D ++G++KEI WGSQIRSYVF P
Sbjct:  270 VVTCQTERSQIKNRERAMKMLKAKLYQRRIEEQQAELDEIRGEQKEIGWGSQIRSYVFHP   329

Query:  300 YTMVKDHRTNFELAQVDKVMDGEINGFIDAYLKWRI   335
            Y+MVKDHRTN E+  V  VMDG+I+ FIDAYL+ ++
Sbjct:  330 YSMVKDHRTNTEMGNVQAVMDGDIDTFIDAYLRSKL   365
```

A related DNA sequence was identified in *S. pyogenes* <SEQ ID 5493> which encodes the amino acid sequence <SEQ ID 5494>. Analysis of this protein sequence reveals the following:

```
Possible site: 23
>>> Seems to have no N-terminal signal sequence

----- Final Results -----
            bacterial cytoplasm --- Certainty = 0.4779(Affirmative) < succ>
            bacterial membrane  --- Certainty = 0.0000(Not Clear)   < succ>
             bacterial outside  --- Certainty = 0.0000(Not Clear)   < succ>
```

An alignment of the GAS and GBS proteins is shown below.

```
Identities = 334/337 (99%), Positives = 336/337 (99%)
Query:    1 MEEEIALLENQMTEPDFWNDNIAAQKTSQELNELKGKYDTFHNMQELSDETELLLEMLDE   60
            +EEEIALLEN MTEPDFWNDNIAAQKTSQELNELKGKYDTFHNMQELSDETELLLEMLDE
Sbjct:    1 LEEEIALLENHMTEPDFWNDNIAAQKTSQELNELKGKYDTFHNMQELSDETELLLEMLDE   60

Query:   61 DDSLKEELEENLMQLDKIMGAYEMTLLLSEPYDHNNAILEIHPGSGGTEAQDWGDLLLRM   120
            DDSLKEELEENLMQLDKIMGAYEMTLLLSEPYDHNNAILEIHPGSGGTEAQDWGDLLLRM
Sbjct:   61 DDSLKEELEENLMQLDKIMGAYEMTLLLSEPYDHNNAILEIHPGSGGTEAQDWGDLLLRM   120

Query:  121 YTRFGNANGFKVEVLDYQAGDEAGIKSVTLSFEGPNAYGLLKSEMGVHRLVRISPFDSAK   180
            YTRFGNANGFK+EVLDYQAGDEAGIKSVTLSFEGPNAYGLLKSEMGVHRLVRISPFDSAK
Sbjct:  121 YTRFGNANGFKIEVLDYQAGDEAGIKSVTLSFEGPNAYGLLKSEMGVHRLVRISPFDSAK   180

Query:  181 RRHTSFASVEVMPELDDTIEVEVRDDDIKMDTFRSGGAGGQNVNKVSTGVRLTHIPTGIV   240
            RRHTSFASVEVMPELDDTIEVEVRDDDIKMDTFRSGGAGGQNVNKVSTGVRLTHIPTGIV
Sbjct:  181 RRHTSFASVEVMPELDDTIEVEVRDDDIKMDTFRSGGAGGQNVNKVSTGVRLTHIPTGIV   240

Query:  241 VSSTVDRTQYGNRDRAMKMLQAKLYQLEQEKKAQEVDALKGDKKEITWGSQIRSYVFTPY   300
            VSSTVDRTQYGNRDRAMKMLQAKLYQLEQEKKAQEVDALKGDKKEITWGSQIRSYVFTPY
Sbjct:  241 VSSTVDRTQYGNRDRAMKMLQAKLYQLEQEKKAQEVDALKGDKKEITWGSQIRSYVFTPY   300

Query:  301 TMVKDHRTNFELAQVDKVMDGEINGFIDAYLKWRIED   337
            TMVKDHRTNFELAQVDKVMDGEINGFIDAYLKWRIED
Sbjct:  301 TMVKDHRTNFELAQVDKVMDGEINGFIDAYLKWRIED   337
```

Based on this analysis, it was predicted that these proteins and their epitopes could be useful antigens for vaccines or diagnostics.

EXAMPLE 1768

A DNA sequence (GBSx1875) was identified in *S. agalactiae* <SEQ ID 5495> which encodes the amino acid sequence <SEQ ID 5496>. This protein is predicted to be cell-division ATP-binding protein (ftsE). Analysis of this protein sequence reveals the following:

```
Possible site: 42
>>> Seems to have no N-terminal signal sequence

----- Final Results -----
              bacterial cytoplasm --- Certainty = 0.3928(Affirmative) < succ>
               bacterial membrane --- Certainty = 0.0000(Not Clear)   < succ>
                bacterial outside --- Certainty = 0.0000(Not Clear)   < succ>
```

The protein has homology with the following sequences in the GENPEPT database.

```
>GP:AAC67262 GB:AF017113 cell division ATP-binding protein
[Bacillus subtilis]
Identities = 138/228 (60%), Positives = 179/228 (77%)
Query:   3 LIEMSGVTKKYRRSTTALRNLNLSIQQGEFVYLVGPSGAGKSSLIRLLYREEKLSSGRLK   62
           +IEM   V K Y      AL  ++++I  GEFVY+VGPSGAGKS+ I+++YREEK + G++
Sbjct:   1 MIEMKEVYKAYPNGVKALNGISVTIHPGEFVYVVGPSGAGKSTFIKMIYREEKPTKGQIL   60

Query:  63 VGEFNLNKLKRRQIPILRRSIGVVFQDYKLLPTKTVYENVAFAMQVIGAKRRHIKKRVPE  122
           +    +L  +K ++IP +RR IGVVFQD+KLLP  TV+ENVAFA++VIG +   IKKRV E
Sbjct:  61 INHKDLATIKEKEIPFVRRKIGVVFQDFKLLPKLTVFENVAFALEVIGEQPSVIKKRVLE  120

Query: 123 VLELVGLKHKMRSFPTQLSGGEQQRVAIARAIVNNPKLLIADEPTGNLDPEIAWEIMHLL  182
           VL+LV LKHK R FP QLSGGEQQRV+IAR+IVNNP ++IADEPTGNLDP+ +WE+M  L
Sbjct: 121 VLDLVQLKHKARQFPDQLSGGEQQRVSIARSIVNNPDVVIADEPTGNLDPDTSWEVMKTL  180

Query: 183 ERINLQGTTVLMATHNSQIVNTLRHRVIEIEAGSVIRDEEKGEYGYHD             230
           E IN +GTTV+MATHN +IVNT++ RVI IE G ++RDE +GBYG +D
Sbjct: 181 EEINNRGTTVVMATHNKEIVNTMKKRVIAIEDGIIVRDESRGEYGSYD             228
```

A related DNA sequence was identified in *S. pyogenes* <SEQ ID 5497> which encodes the amino acid sequence <SEQ ID 5498>. Analysis of this protein sequence reveals the following:

```
Possible site: 47
>>> Seems to have no N-terminal signal sequence

----- Final Results -----
              bacterial cytoplasm --- Certainty = 0.3728(Affirmative) < succ>
               bacterial membrane --- Certainty = 0.0000(Not Clear)   < succ>
                bacterial outside --- Certainty = 0.0000(Not Clear)   < succ>
```

An alignment of the GAS and GBS proteins is shown below.

```
Identities = 191/230 (83%), Positives = 214/230 (93%)
Query:   1 MALIEMSGVTKKYRRSTTALRNLNLSIQQGEFVYLVGPSGAGKSSLIRLLYREEKLSSGR   60
           MALIEMSGVTKKYRRSTTALR++N+S+ QGEFVYLVGPSGAGKS+ I+LLYREE+L++G+
Sbjct:   1 MALIEMSGVTKKYRRSTTALRDVNVSVNQGEFVYLVGPSGAGKSTFIKLLYREEQLTTGK   60

Query:  61 LKVGEFNLNKLKRRQIPILRRSIGVVFQDYKLLPTKTVYENVAFAMQVIGAKRRHIKKRV  120
           L VGEFNL KLK R +PILRR IGVVFQDYKLLP KTV+ENVA+AM+VIG KRRHIKKRV
Sbjct:  61 LYVGEFNLTKLKARDVPILRRHIGVVFQDYKLLPRKTVFENVAYAMEVIGEKRRHIKKRV  120

Query: 121 PEVLELVGLKHKMRSFPTQLSGGEQQRVAIARAIVNNPKLLIADEPTGNLDPEIAWEIMH  180
           PEVL+LVGLKHKMRSFP+QLSGGEQQRVAIARAIVNNPKLLIADEPTGNLDPEI+WEIM
Sbjct: 121 PEVLDLVGLKHKMRSFPSQLSGGEQQRVAIARAIVNNPKLLIADEPTGNLDPEISWEIMQ  180

Query: 181 LLERINLQGTTVLMATHNSQIVNTLRHRVIEIEAGSVIRDEEKGEYGYHD            230
           LLERIN+QGTT+LMATHNS IVNT RHRV+ IE G ++RDEEKG+YGY D
Sbjct: 181 LLERINVQGTTILMATHNSHIVNTFRHRVVAIEDGRIVRDEEKGDYGYDD            230
```

Based on this analysis, it was predicted that these proteins and their epitopes could be useful antigens for vaccines or diagnostics.

EXAMPLE 1769

A DNA sequence (GBSx1876) was identified in *S. agalactiae* <SEQ ID 5499> which encodes the amino acid sequence <SEQ ID 5500>. This protein is predicted to be ftsE protein (ftsX). Analysis of this protein sequence reveals the following:

```
Possible site: 45
>>> Seems to have no N-terminal signal sequence
      INTEGRAL    Likelihood = -10.77    Transmembrane    296-312 (291-322)
      INTEGRAL    Likelihood =  -9.24    Transmembrane    203-219 (198-228)
      INTEGRAL    Likelihood =  -6.16    Transmembrane     49-65  (40-68)
      INTEGRAL    Likelihood =  -3.40    Transmembrane    255-271 (252-273)

----- Final Results -----
             bacterial membrane --- Certainty = 0.5310(Affirmative) < succ>
             bacterial outside  --- Certainty = 0.0000(Not Clear)   < succ>
           bacterial cytoplasm  --- Certainty = 0.0000(Not Clear)   < succ>
```

A related GBS nucleic acid sequence <SEQ ID 9629> which encodes amino acid sequence <SEQ ID 9630> was also identified.

The protein has homology with the following sequences in the GENPEPT database.

```
>GP:AAC67264 GB:AF017113 cell division protein [Bacillus subtilis]
Identities = 112/311 (36%), Positives = 182/311 (58%), Gaps = 31/311 (9%)
Query:  27 RHFWESLKNLKRNFWMTFASVTSVTITLLLVGLFSSVLLNVEKLTTDVSGNFTISAFLNV   86
           RH  ES K+L RN WMTFAS+++VT+TL+LVG+F  ++LN+  + T+      I   +++
Sbjct:   7 RHLRESFKSLGRNTWMTFASISAVTVTLILVGVFLVIMLNLNNMATNAEKQVEIKVLIDL   66

Query:  87 DSTDAQKQVKDKDGKLKDNPDYHKVYDKIKRISGVEKVTYSSKAEQLKEVQKEYGSDVID  146
           +           D K +D       K+ + IK + G++ VT+SSK ++L ++    +G
Sbjct:  67 TA----------DQKAQD-----KLQNDIKELKGIQSVTFSSREKELDQLVDSFGDSGKS  111

Query: 147 DTYKDA---LLDVYVVGTSSAKVSKSVSEAIGRIEGV---DYTKEPIDST-KLSNLTDNI  199
             T KD    L D +VV T+   + +V++ I +++ V   Y KE +   K+  ++ NI
Sbjct: 112 LTMKDQENPLNDAFVVKTTDPHDTPNVAKKIEKMDHVYKVTYGKEEVSRLFKVVGVSRNI  171

Query: 200 RIWGFGGVALLIVL---AIFLISNTIRMSIMSRRTDIEIMRLVGAKNSYIRGPFFFEGAW  256
              G+AL+I L    A+FLISNTI+++I +RR +IEIM+LVGA N +IR PFF EG
Sbjct: 172 ------GIALIIGLVFTAMFLISNTIKITIFARRKEIEIMKLVGATNWFIRWPFFLEGLL  225

Query: 257 VGILGAIVPSLIFYFGYQFVFNKFNPKFETSHVSLYPMDIMVPAIIGGMVIIGIIGSLG  316
           +G+ G+++P +     YQ+V    PK + S VSL P +  V +    ++ IG +IG  G
Sbjct: 226 LGVFGSVIPIALVLSTYQYVIGWVVPKVQGSFVSLLPYNPFVFQVSLVLIAIGAVIGVWG  285

Query: 317 SVLSMRRYLKI                                                  327
           S+ S+R++L++
Sbjct: 286 SLTSIRKFLRV                                                  296
```

A related DNA sequence was identified in *S. pyogenes* <SEQ ID 5501> which encodes the amino acid sequence <SEQ ID 5502>. Analysis of this protein sequence reveals the following:

```
Possible site: 51
>>> Seems to have no N-terminal signal sequence
      INTEGRAL    Likelihood = -7.70    Transmembrane    195-211 (189-219)
      INTEGRAL    Likelihood = -6.74    Transmembrane     39-55  (30-58)
      INTEGRAL    Likelihood = -5.52    Transmembrane    294-310 (288-314)
      INTEGRAL    Likelihood = -1.49    Transmembrane    246-262 (245-263)

----- Final Results -----
             bacterial membrane --- Certainty = 0.4079(Affirmative) < succ>
             bacterial outside  --- Certainty = 0.0000(Not Clear)   < succ>
           bacterial cytoplasm  --- Certainty = 0.0000(Not Clear)   < succ>
```

The protein has homology with the following sequences in the databases:

```
>GP:AAC67264 GB:AF017113 cell division protein [Bacillus subtilis]
Identities = 117/311 (37%), Positives = 184/311 (58%), Gaps = 19/311 (6%)
Query:   11 MIRYFFRHIWESIKNLKRNFWMTFASVSMVAVTLTLVGVFAATLLNIQRVASGVENNVHI   70
            MI+   RH+ ES K+L RN WMTFAS+S V VTL LVGVF  +LN+  +A+  E   V I
Sbjct:    1 MIKILGRHLRESFKSLGRNTWMTFASISAVTVTLILVGVFLVIMLNLNNMATNAEKQVEI   60

Query:   71 NTYLQVDSTDAAKVIQNTAGEPVNNDNYHSVYDKIAQIKGVKKITFSSKDEQLKKLQETL  130
            + + +    A+      + + ND        I ++KG++ +TFSSK+++L +L ++
Sbjct:   61 KVLIDLTADQKAQ-------DKLQND--------IKELKGIQSVTFSSKEKELDQLVDSF  105

Query:  131 GDVWN---MYDQDTNPLQDIYLIETQTPKQVKAITKKIRTIEGVEAADYGGINSDKLFKF  187
            GD      M DQ+ NPL D ++++T  P    + KKI ++  V    YG      +LFK
Sbjct:  106 GDSGKSLTMKDQE-NPLNDAFVVKTTDPHDTPNVAKKIEKMDHVYKVTYGKEEVSRLFKV  164

Query:  188 STLIQTWGLIGTAMLLFVAVFLISNTIRMTIMSRKRDIEIMRLVGAKNSYIRGPFFFEGA  247
             + +  G+      L+F A+FLISNTI++TI +R+++IEIM+LVGA N +IR PFF EG
Sbjct:  165 VGVSRNIGIALIIGLVFTAMFLISNTIKITIFARRKEIEIMKLVGATNWFIRWPFFLEGL  224

Query:  248 WVGLLGAVLPSLLIYYGYDLVYKHFAQELQRNNLSMYPLDPYVYYLIGALFVIGIMIGSL  307
             +G+ G+V+P  L+   Y  V     ++Q  +S+ P +P+V+ +    L  IG +IG
Sbjct:  225 LLGVFGSVIPIALVLSTYQYVIGWVVPKVQGSFVSLLPYNPFVFQVSLVLIAIGAVIGVW  284

Query:  308 GSVLSMRRYLK                                                  318
            GS+ S+R++L+
Sbjct:  285 GSLTSIRKFLR                                                  295
```

An alignment of the GAS and GBS proteins is shown below.

```
Identities = 173/318 (54%), Positives = 238/318 (74%), Gaps = 5/318 (1%)
Query:   13 MKRRENMVIMIN-FFRHFWESLKNLKRNFWMTFASVTSVTITLLLVGLFSSVLLNVEKLT   71
            MK++E MV MI   FFRH WES+KNLKRNFWMTFASV+ V +TL LVG+F++ LLN++++
Sbjct:    2 MKKKEIMVTMIRYFFRHIWESIKNLKRNFWMTFASVSMVAVTLTLVGVFAATLLNIQRVA   61

Query:   72 TDVSGNFTISAFLNVDSTDAQKQVKDKDGKLKDNPDYHKVYDKIKRISGVEKVTYSSKAE  131
            + V  N  I+ +L VDSTDA K +++  G+   +N +YH VYDKI +I GV+K+T+SSK E
Sbjct:   62 SGVENNVHINTYLQVDSTDAAKVIQNTAGEPVNNDNYHSVYDKIAQIKGVKKITFSSKDE  121

Query:  132 QLKEVQKEYGSDVID--DTYKDALLDVYVVGTSSAKVSKSVSEAIGRIEGVDYTKEP-ID  188
            QLK++Q+  G DV +  D   L D+Y++ T + K  K++++  I  IEGV+       I+
Sbjct:  122 QLKKLQETLG-DVWNMYDQDTNPLQDIYLIETQTPKQVKAITKKIRTIEGVEAADYGGIN  180

Query:  189 STKLSNLTDNIRIWGFGGVALLIVLAIFLISNTIRMSIMSRRTDIEIMRLVGAKNSYIRG  248
            S KL  +   I+ WG  G A+L+  +A+FLISNTIRM+IMSR  DIEIMRLVGAKNSYIRG
Sbjct:  181 SDKLFKFSTLIQTWGLIGTAMLLFVAVFLISNTIRMTIMSRKRDIEIMRLVGAKNSYIRG  240

Query:  249 PFFFEGAWVGILGAIVPSLIFYFGYQFVFNKFNPKFETSHVSLYPMDIMVPAIIGGMVII  308
            PFFFEGAWVG+LGA++PSL+ Y+GY V+  F + + +++S+YP+D  V  +IG + +I
Sbjct:  241 PFFFEGAWVGLLGAVLPSLLIYYGYDLVYKHFAQELQRNNLSMYPLDPYVYYLIGALFVI  300

Query:  309 GIIIGSLGSVLSMRRYLK                                           326
            GI+IGSLGSVLSMRRYLK
Sbjct:  301 GIMIGSLGSVLSMRRYLK                                           318
```

Based on this analysis, it was predicted that these proteins and their epitopes could be useful antigens for vaccines or diagnostics.

EXAMPLE 1770

A DNA sequence (GBSx1877) was identified in *S. agalactiae* <SEQ ID 5503> which encodes the amino acid sequence <SEQ ID 5504>. This protein is predicted to be carboxymethylenebutenolidase-related protein. Analysis of this protein sequence reveals the following:

```
Possible site: 24
>>> Seems to have a cleavable N-term signal seq.

----- Final Results -----
           bacterial outside --- Certainty = 0.3000(Affirmative) < succ>
          bacterial membrane --- Certainty = 0.0000(Not Clear)   < succ>
          bacterial cytoplasm --- Certainty = 0.0000(Not Clear)  < succ>
```

The protein has homology with the following sequences in the GENPEPT database.

```
>GP:AAF10898 GB:AE001979 carboxymethylenebutenolidase-related
protein [Deinococcus radiodurans]
Identities = 65/183 (35%), Positives = 98/183 (53%), Gaps = 3/183 (1%)
Query:   56 SKGKVKANIIFYQGALVEEEAYSQLARDLADKGDNTYILKTPLNLPVLSPHRAKTIINQN  115
            +  +VK  ++FY G  V  +AY  L R LA +G   T I    PL+L +     +A+ +I +
Sbjct:  100 ASAEVKTLLVFYPGGRVRPQAYEWLGRALAVRGVQTVIPAFPLDLAITGTERAEGLIARY  159

Query:  116 HL-TNVYLAGHSLGGVVASQNAKVAP--VRGLILLASYPSRKSDLSHKNLRVLSITASND  172
                 V LAGHSLGG VA+Q A + P   + GL+LLA+YP+   +L         LS+ A  D
Sbjct:  160 GAGKRVVLAGHSLGGTVAAQYAALRPDKIDGLLLLAAYPAPNVNLHDARFPALSLLAEKD  219

Query:  173 HILNWEKYEEAKKRLPNSSTFRTIVGGNHSRFGNYGHQKGDGKATLSHKSSEKQLATFIS  232
              + +         +RLP ++    + G  HS FG YG Q+GDG   T+S     +E+++   +
Sbjct:  220 GVADAGLVRGGLERLPKNTRLTVLPGAVHSFFGRYGPQQGDGVPTVSRARAEREIVQAVE  279

Query:  233 NFI                                                            235
                FI
Sbjct:  280 TFI                                                            282
```

No corresponding DNA sequence was identified in *S. pyogenes*.

SEQ ID 5504 (GBS158) was expressed in *E. coli* as a His-fusion product. SDS-PAGE analysis of total cell extract is shown in FIG. 26 (lane 4; MW 27 kDa). It was also expressed in *E. coli* as a GST-fusion product. SDS-PAGE analysis of total cell extract is shown in FIG. 37 (lane 5; MW 52 kDa).

Figure 113:
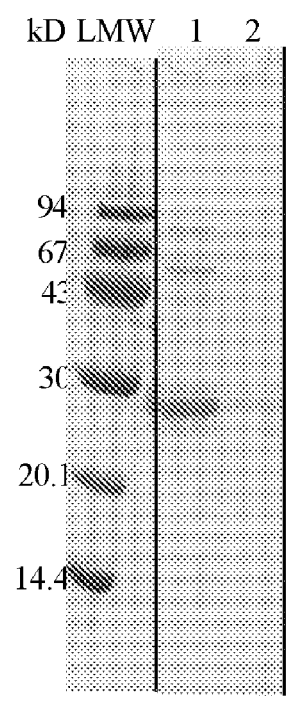

The GBS158-GST fusion product was purified (FIG. 113; see also FIG. 201, lane 4) and used to immunise mice (lane 1+2 product; 14.5 kg/mouse). The resulting antiserum was used for Western blot, FACS, and in the in vivo passive protection assay (Table III). These tests confirm that the protein is immunoaccessible on GBS bacteria and that it is an effective protective immunogen.

Based on this analysis, it was predicted that this protein and its epitopes, could be useful antigens for vaccines or diagnostics.

EXAMPLE 1771

A DNA sequence (GBSx1878) was identified in *S. agalactiae* <SEQ ID 5505> which encodes the amino acid sequence <SEQ ID 5506>. Analysis of this protein sequence reveals the following:

```
Possible site: 54
>>> Seems to have no N-terminal signal sequence

----- Final Results -----
             bacterial cytoplasm --- Certainty = 0.0281(Affirmative) < succ>
             bacterial membrane  --- Certainty = 0.0000(Not Clear)   < succ>
             bacterial outside   --- Certainty = 0.0000(Not Clear)   < succ>
```

The protein has homology with the following sequences in the GENPEPT database.

```
>GP:BAB06539 GB:AP001516 unknown conserved protein [Bacillus halodurans]
Identities = 83/197 (42%), Positives = 114/197 (57%), Gaps = 4/197 (2%)
Query:   35 NTYYLVNDQAV-ILIDPGSNGQEIIAKIKSFEKPLVAILLTHTHYDHIFSLDLVRDTFDN   93
            N Y    NDQ   I+ DPG   +++I  ++   +    +AILLTH H+DHI +++ VR+TF +
Sbjct:   14 NWYIQTNDQGEGIIFDPGGEVEKLITWLRDRQITPLAILLTHAHFDHIGAVEDVRNTF-H   72

Query:   94 PPVYVSEKEAAWLSSPDDNLSGLGRHDDIINVIARPAENFFKLKQPYQLNGFEFTVLPTP  153
              PVY+  E E  WL   P  N S L        I    AR AE+     +Q    +  F + VL TP
Sbjct:   73 IPVYIHENEKEWLIDPQRNGSSLFIPGSSIK--AREAEHLITGEQDLSIGSFSYQVLETP  130

Query:  154 GHSWGGVSFVFHSDELVVTGDALFRETIGRTDLPTSNFEDLITGIRQELFTLPSHYSVHP  213
             GHS  G +S+      D++V +GDALF   +IGRTDLP  + +  L+     I  +L  LP    +V
Sbjct:  131 GHSPGSLSYYAKEDKIVFSGDALFAGSIGRTDLPGGDHQLLLDSIHDKLLELPEDTTVAS  190

Query:  214 GHGMNTTIGHEKNFNPF                                              230
             GHG  TTIGHE + NPF
Sbjct:  191 GHGPTTTIGHEMDGNPF                                              207
```

A related DNA sequence was identified in *S. pyogenes* <SEQ ID 5507> which encodes the amino acid sequence <SEQ ID 5508>. Analysis of this protein sequence reveals the following:

```
Possible site: 54
>>> Seems to have no N-terminal signal sequence

----- Final Results -----
            bacterial cytoplasm --- Certainty = 0.0407(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below.

```
Identities = 217/231 (93%), Positives = 224/231 (96%)

Query:   1 MPFIFRHSFFNKVLIFWYTIIMKIYKTINHIAGENTYYLVNDQAVILIDPGSNGQEIIAK    60
           +PFIFR+SFFNKVLIFWYTI+MKIYKTINHIAGENTYYLVNDQAVILIDPGSNGQEIIAK
Sbjct:   1 LPFIFRYSFFNKVLIFWYTILMKIYKTINHIAGENTYYLVNDQAVILIDPGSNGQEIIAK    60

Query:  61 IKSFEKPLVAILLTHTHYDHIFSLDLVRDTFDNPPVYVSEKEAAWLSSPDDNLSGLGRHD   120
           IKSFEKPLVAILLTHTHYDHIFSLDLVRD FD+PPVYVSEKEAAWLSSPDDNLSGLGRHD
Sbjct:  61 IKSFEKPLVAILLTHTHYDHIFSLDLVRDAFDHPPVYVSEKEAAWLSSPDDNLSGLGRHD   120

Query: 121 DIINVIARPAENFFKLKQPYQLNGFEFTVLPTPGHSWGGVSFVFHSDELVVTGDALFRET   180
           DII VIARPAENFFKLKQPYQLNGFEFTVLPT GHSWGGVSFVFHSDELVVTGDALFRET
Sbjct: 121 DIITVIARPAENFFKLKQPYQLNGFEFTVLPTSGHSWGGVSFVFHSDELVVTGDALFRET   180

Query: 181 IGRTDLPTSNFEDLITGIRQELFTLPSHYSVHPGHGMNTTIGHEKNFNPFF           231
           IGRTDLPTSNFEDLITGIRQELFTLP+HY V+PGHG +TTI HEKN NPFF
Sbjct: 181 IGRTDLPTSNFEDLITGIRQELFTLPNHYRVYPGHGPSTTICHEKNANPFF           231
```

Based on this analysis, it was predicted that these proteins and their epitopes could be useful antigens for vaccines or diagnostics.

EXAMPLE 1772

A DNA sequence (GBSx1879) was identified in *S. agalactiae* <SEQ ID 5509> which encodes the amino acid sequence <SEQ ID 5510>. This protein is predicted to be acetoin reductase (fabG). Analysis of this protein sequence reveals the following:

```
Possible site: 28
>>> Seems to have no N-terminal signal sequence

----- Final Results -----
            bacterial cytoplasm --- Certainty = 0.1596(Affirmative) < succ>
             bacterial membrane --- Certainty = 0.0000(Not Clear)   < succ>
              bacterial outside --- Certainty = 0.0000(Not Clear)   < succ>
```

A related GBS nucleic acid sequence <SEQ ID 9631> which encodes amino acid sequence <SEQ ID 9632> was also identified.

The protein has homology with the following sequences in the GENPEPT database.

```
>GP: AAC48769 GB: U71200 acetoin reductase [Bos taurus]
Identities = 162/254 (63%), Positives = 188/254 (73%), Gaps = 2/254 (0%)

Query:  12 KVAIVTGAGQGIGFAIAKRLHADGFKIGVLDYNEETAQAAVDKLSPED--AVAVVADVSK    69
           KVA+VTG QGIG AI   L ADGF + V D NE  +       +    A+AV  DVS
Sbjct:   4 KVAMVTGGAQGIGEAIVXXLSADGFAVAVADLNEAKSKXVATDIEKNGGTAIAVKLDVSD    63

Query:  70 RDQVFDAFQKVVDTFGDLNVVVNNAGVAPTTPLDTITEEQFEKAFAINVGGTIWGSQAAQ   129
           R+   F A ++V +  G   +V+NNAG+ PTTP+DTIT E F+K + INV G IWG QAA
Sbjct:  64 REGFFAAVKEVAEKLGGFDVLVNNAGLGPTTPIDTITPELFDKVYHINVAGDIWGIQAAV   123
```

-continued

```
Query:  130 KHFRELGHGGKIINATSQAGCEGNPNLTVYGGTKFAVRGITQTLAKDLASEGITVNAYAP  189
             + F++ G+GGKIINATSQAG  GNPNL++Y  TKFAVR +T   A+DLA + ITVNAYAP
Sbjct:  124 EQFKKNGNGGKIINATSQAGVVGNPNLSLYSSTKFAVRCLTPVAARDLAEQNITVNAYAP  183

Query:  190 GIVKTPMMFDIAHEVGKNAGKDDEWGMEQFAKDITLKRLSEPEDVANAVGFLAGDDSNYI  249
             GIVKTP  FDIAHEVGKNAGKDDEWGM+ FAKDI LKRLSEPEDVA AV FLAG DSNYI
Sbjct:  184 GIVKTPXXFDIAHEVGKNAGKDDEWGMQTFAKDIALKRLSEPEDVAAAVAFLAGPDSNYI  243

Query:  250 TGQTIVVDGGMVFH                                              263
             TGQTI VDGGM FH
Sbjct:  244 TGQTIEVDGGMQFH                                              257
```

A related DNA sequence was identified in *S. pyogenes* <SEQ ID 5511> which encodes the amino acid sequence <SEQ ID 5512>. Analysis of this protein sequence reveals the following:

```
Possible site: 50
>>> Seems to have no N-terminal signal sequence

----- Final Results -----
            bacterial cytoplasm --- Certainty = 0.1131(Affirmative) < succ>
            bacterial membrane  --- Certainty = 0.0000(Not Clear)   < succ>
             bacterial outside  --- Certainty = 0.0000(Not Clear)   < succ>
```

An alignment of the GAS and GBS proteins is shown below.

```
Identities = 209/213 (98%), Positives = 212/213 (99%)

Query:    1 MTKEYEVEDMSKVAIVTGAGQGIGFAIAKRLHADGFKIGVLDYNEETAQAAVDKLSPEDA   60
            +TK+YEVEDMSKVAIVTGAGQGIGFAIAKRLHADGFKIG+LDYNEETAQAAVDKLSPEDA
Sbjct:    1 LTKKYEVEDMSKVAIVTGAGQGIGFAIAKRLHADGFKIGILDYNEETAQAAVDKLSPEDA   60

Query:   61 VAVVADVSKRDQVFDAFQKVVDTFGDLNVVVNNAGVAPTTPLDTITEEQFEKAFAINVGG  120
            VAVVADVSKRDQVFDAFQKVVDTFGDLNVVVNNAGVAPTTPLDTITEEQFEKAFAINVGG
Sbjct:   61 VAVVADVSKRDQVFDAFQKVVDTFGDLNVVVNNAGVAPTTPLDTITEEQFEKAFAINVGG  120

Query:  121 TIWGSQAAQKHFRELGHGGKIINATSQAGCEGNPNLTVYGGTKFAVRGITQTLAKDLASE  180
            TIWGSQAAQKHFRELGHGGKIINATSQAGCEGNPNLTVYGGTKFAVRGITQTLAKDLASE
Sbjct:  121 TIWGSQAAQKHFRELGHGGKIINATSQAGCEGNPNLTVYGGTKFAVRGITQTLAKDLASE  180

Query:  181 GITVNAYAPGIVKTPMMFDIAHEVGKNAGKDDE                            213
            GITVNAYAPGIVKTPMMF IAHEVGKNAGKDDE
Sbjct:  181 GITVNAYAPGIVKTPMMFAIAHEVGKNAGKDDE                            213
```

Based on this analysis, it was predicted that these proteins and their epitopes could be useful antigens for vaccines or diagnostics.

EXAMPLE 1773

A DNA sequence (GBSx1880) was identified in *S. agalactiae* <SEQ ID 5513> which encodes the amino acid sequence <SEQ ID 5514>. This protein is predicted to be ATP-dependent DNA helicase. Analysis of this protein sequence reveals the following:

```
Possible site: 37
>>> Seems to have no N-terminal signal sequence

----- Final Results -----
            bacterial cytoplasm --- Certainty = 0.3735(Affirmative) < succ>
            bacterial membrane  --- Certainty = 0.0000(Not Clear)   < succ>
             bacterial outside  --- Certainty = 0.000(Not Clear)    < succ>
```

The protein has homology with the following sequences in the GENPEPT database.

```
>GP: AAB38451 GB: L47709 22.4% identity with Escherichia coli
DNA-damage inducible protein . . . ; putative [Bacillus subtilis]
Identities = 132/461 (28%), Positives = 231/461 (49%), Gaps = 22/461 (4%)

Query:   21 RKYAVVDLEATGAGPNAS--IIQVGIVIIQGNKIIDSYETDVNPHESLDEHIVHLTGITD     78
            +++ V+D+E TG P      IIQ+ V+I+ +I + +   +NP++S+   I   LTGI++
Sbjct:    4 QRFVVIDVETTGNSPKKGDKIIQIAAVVIENGQITERFSKYINPNKSIPAFIEQLTGISN     63

Query:   79 KQLAKAPDFGQVAHHIYQLIEDCIFVAHNVKFDANLLAEQLFLEGCELRTPRI-DTVELS    137
            + +      F  VA  ++QL++    FVAHN+ FD    +L   G +L    + DTVELS
Sbjct:   64 QMVENEQPFEAVAEEVFQLLDGAYFVAHNIHFDLGFVKYELHKAGFQLPDCEVLDTVELS    123

Query:  138 QVFYPCLEKYSLGALAESLNIELTDAHTAIADARATAQLFIKLKAKISSLPKEVLETILT    197
            ++ +P   E Y L   L+E L +      H A +DA  T  +F+++  K+   LP    L+ +
Sbjct:  124 RIVFPGFEGYKLTELSEELQLRHDQPHRADSDAEVTGLIFLEILEKLRQLPYPTLKQLRR    183

Query:  198 FADNLLFESYLLIEEAYQEADFVNPKEYYFWQGLVLKKEKAVGKPKKLSSDFQ-------    250
             + + +    L++    E           Y +     +++ +A+         +F
Sbjct:  184 LSQHFISDLTHLLDMFINENRHTEIPGYTRFSSFSVREPEAIDVRINEDENFSFEIESWE    243

Query:  251 ------VNMALLGMDARPKQVVFADLVKAHFNDQTTTFLEAQPGLGKTYGYLLP--LLDQ    302
                  ++  + G + R Q++      V   F ++    +EA PG+GKT GYL+P  L   +
Sbjct:  244 AGNEKALSELMPGYEKRDGQDMMMMREVADAFANREHALIEAPPGIGKTIGYLIPAALFAK    303

Query:  303 SQKQQIIVSVPTKILQDQIMAKEIKHIQELFHIPCHS--IKGPRNYLKLDAFYKSLQVQD    360
             K+ +I+S + +LQ QI+ K++  +Q+LF  P +    +KG  +YL L  F + L  +D
Sbjct:  304 KSKKPVIISTYSTLLQQQILTKDLPIVQDLFPFPVTAAILKGQSHYLCLYKFEQVLHEED    363

Query:  361 RNRLINRFKMQLLVWLTETTTGDLDEIKQKQRLESYFDQLKHDGE-VTQSSLFYDLDFWK    419
            N      K QLLVWLTET TGD+ E+          +D+L +D +   +S   + F++
Sbjct:  364 DNYDAVLTKAQLLVWLTETNTGDVAELNLPSGGKLLWDRLAYDDDSYKRSRSEHVIGFYE    423

Query:  420 RSYDKVAQSQLVIINHAYFL-ERVQDDKDFAKGKVLVFDEA                     459
            R+    +S LVI NH+  L +     K     +  + DEA
Sbjct:  424 RAKQIAMRSDLVITNHSLLLTDEGSHKKRLPESGTFIIDEA                     464

Identities = 63/195 (32%), Positives = 88/195 (44%), Gaps = 16/195 (8%)

Query:  629 KVWIDTSMPNILDLSPEQYAYEIAKRLQDIMTLKQPT-LVLLTSKQTMFMVSDYLDKWEI    687
            +V I   M +I D    ++  + A+ ++ +   KQP  LVL TS +      V     E+
Sbjct:  720 QVMIPKEMKSIQDTGQPEFIQDTARYIELMAKEKQPKILVLFTSHDMLKKVHQ-----EL    774

Query:  688 KH---------LTQD-KNGLAYNVKKRFDRGESNLLLGTGSFWEGVDFVHRDRLIEVITR    737
            KH          L Q     G   + K F      +LLGT  FWEGVDF  +   +I R
Sbjct:  775 KHNMSASGIQLLAQGITGGSPGKLMKTFKTSNQAILLGTNHFWEGVDFPGDELTTVMIVR    834

Query:  738 LPFDTPKDYFIQKLSQSLTKEGKNFFYDYSLPMTVLKLKQALGRTTRREEQKSAVIILDS    797
            LPF +P       + K+GKN F   SLP  VL +Q +GR   R   K +IILD
Sbjct:  835 LPFRSPDHPLHAAKCELARKKGKNPFQTVSLPEAVLTFRQGIGRLLRSAGDKGTIIILDR    894

Query:  798 RLVIKSYGQTIMHSL                                                812
            R+    YG+  + +L
Sbjct:  895 RIKTAGYGRLFLDAL                                                909
```

A related DNA sequence was identified in *S. pyogenes* <SEQ ID 5515> which encodes the amino acid sequence <SEQ ID 5516>. Analysis of this protein sequence reveals the following:

```
Possible site: 37
>>> Seems to have no N-terminal signal sequence

----- Final Results -----
            bacterial cytoplasm --- Certainty = 0.3735(Affirmative) < succ>
            bacterial membrane  --- Certainty = 0.0000(Not Clear)   < succ>
            bacterial outside   --- Certainty = 0.0000(Not Clear)   < succ>
```

An alignment of the GAS and GBS proteins is shown below.

```
Identities = 500/835 (59%), Positives = 626/835 (74%), Gaps = 2/835 (0%)

Query:    1 MFCFIDIACYNRLTMTQKKLRKYAVVDLEATGAGPNASIIQVGIVIIQGNKIIDSYETDV   60
            MFCFIDIACYNRLTMTQKKLRKYAVVDLEATGAGPNASIIQVGIVIIQGNKIIDSYETDV
Sbjct:    1 MFCFIDIACYNRLTMTQKKLRKYAVVDLEATGAGPNASIIQVGIVIIQGNKIIDSYETDV   60

Query:   61 NPHESLDEHIVHLTGITDKQLAKAPDFGQVAHHIYQLIEDCIFVAHNVKFDANLLAEQLF  120
            NPHESLDEHIVHLTGITDKQLAKAPDFGQVAHHIYQLIEDCIFVAHNVKFDANLLAE LF
Sbjct:   61 NPHESLDEHIVHLTGITDKQLAKAPDFGQVAHHIYQLIEDCIFVAHNVKFDANLLAEALF  120

Query:  121 LEGCELRTPRIDTVELSQVFYPCLEKYSLGALAESLNIELTDAHTAIADARATAQLFIKL  180
            LEG EL  PR+DTVEL+Q+F+P  EKY+L  L+  LNI+L +AHTAIADARATA LF++L
Sbjct:  121 LEGYELTIPRVDTVELAQLFFPRFEKYNLSHLSRQLNIDLAEAHTAIADARATAILFLRL  180

Query:  181 KAKISSLPKEVLETILTFADNLLFESYLLIEEAYQEADFVNPKEYYFWQGLVLKKEKAVG  240
              KI SLP E LE++L ++D+LLFE+ ++I+E   +A   +P +Y   + ++L K
Sbjct:  181 LQKIESLPIECLESLLVYSDSLLFETAMVIQEGLAKAKPYDPNKYIKIRQILLPKGSKAL  240

Query:  241 KPKKLSSDFQVNMALLGMDARPKQVVFADLVKAHFNDQTTTFLEAQPGLGKTYGYLLPLL  300
            KP ++S  F +NMALLG++ RPKQ  FA L+    ++      +F+EAQ G+GKTYGYLLPLL
Sbjct:  241 KPYQISKSFPINMALLGLEERPKQTQFAQLIDEDYHQGVASFIEAQTGIGKTYGYLLPLL  300

Query:  301 DQSQKQQIIVSVPTKILQDQIMAKEIKHIQELFHIPCHSIKGPRNYLKLDAFYKSLQVQD  360
              +  + QIIVSVPTK+LQDQ+MA E+  IQE FHI CHS+KGP NYLKLD+F  SL   D
Sbjct:  301 AKEDQNQIIVSVPTKLLQDQLMAGEVAAIQEQFHIACHSLKGPANYLKLDSFADSLDQND  360

Query:  361 RNRLINRFKMQLLVWLTETTTGDLDEIKQKQRLESYFDQLKHDGEVTQSSLFYDLDFWKR  420
             +NRL+NR+KMQLLVWL ET TGDLDEIKQKQR  +YF+QLKHDG++ QSS FYD DFW+
Sbjct:  361 QNRLVNRYKMQLLVWLLETKTGDLDEIKQKQRFAAYFEQLKHDGDIKQSSEFYDYDFWRV  420

Query:  421 SYDKVAQSQLVIINHAYFLERVQDDKDFAKGKVLVFDEAQKLVLGLENFSRGQLDISHQL  480
            SY+K    ++L+I NHAYFL RVQDDKDFA+ KVLVFDEAQKL+L+  SR QL+++  L
Sbjct:  421 SYEKAKTARLLITNHAYFLHRVQDDKDFARNKVLVFDEAQKLMLQLDQLSRHQLNLTVFL  480

Query:  481 QVIQKIIDSSIPLLQKRLLESISYELSHAVELFYRHNSFEFSETWLKRLKNSINALEVVG  540
            Q IQ + + +PLL+KRLLES+S+EL      +Y++  + + W  R+        L
Sbjct:  481 QTIQAKLSNPLPLLEKRLLESLSFELGQVSSDYYQNKEHQLAHDW-SRIAGYAKELTGAD  539

Query:  541 LDELQTFFTATYTNYWFETDKVNEKRLTILRGAREDFLKFSKFLPPTKKTYMISATLQIS  600
              ELQ FF +  +YW  ++K   EKR+T L   A + F+  F + LP T KTY +SATL IS
Sbjct:  540 YQELQAFFATSDGDYWLSSEKQEEKRVTYLNSASKAFIHFQQLLPETVKTYFVSATLTIS  599

Query:  601 PKVYLSDLLGGFSSISTEKIAHEKNANQKVWIDTSMPNILDLSPEQYAYEIAKRLQDIMT  660
              +V L+DLL GF        I   +K  +Q V +D    P + ++S + Y    IAKR++ +
Sbjct:  600 SEVTLADLL-GFEEYLYHVIEKDKKQDQLVLVDQEAPIVTEVSDQIYVEAIAKRIESLKQ  658

Query:  661 LKQPTLVLLTSKQTMFMVSDYLDKWEIKHLTQDKNGLAYNVKKRFDRGESNLLLGTSFW  720
                 P LVL  SK+ + +VSDYLD+W++  HL Q+KNG AYN+KKRFD+GE   +LLG GSFW
Sbjct:  659 EGYPILVLFNSKKHLLLVSDYLDQWQVPHLAQEKNGTAYNIKKRFDQGEQTILLGLGSFW  718

Query:  721 EGVDFVHRDRLIEVITRLPFDTPKDYFIQKLSQSLTKEGKNFFYDYSLPMTVLKLKQALG  780
            EGVDF+  DR+I +I RLPFD P+D+F++K+S  L ++GKN F DY LPMT+L+LKQA+G
Sbjct:  719 EGVDFIQADRMITLIARLPFDNPEDFFVKKMSHYLLEKGKNPFRDYFLPMTILRLKQAIG  778

Query:  781 RTTRREEQKSAVIILDSRLVIKSYGQTIMHSLGRDFEISKEKINKVLTEMAKFLI       835
            RT RR++QKS VIILD RL+ KSYGQ I+  LG++F IS++   + L E   FLI
Sbjct:  779 RTMRRQDQKSVVIILDRRLLTKSYGQVILEGLGQEFLISQQNFHDCLVETDCFLI       833
```

Based on this analysis, it was predicted that these proteins and their epitopes could be useful antigens for vaccines or diagnostics.

EXAMPLE 1774

A DNA sequence (GBSx1881) was identified in *S. agalactiae* <SEQ ID 5517> which encodes the amino acid sequence <SEQ ID 5518>. Analysis of this protein sequence reveals the following:

```
Possible site: 27
>>> Seems to have no N-terminal signal sequence

----- Final Results -----
          bacterial cytoplasm --- Certainty = 0.2042(Affirmative) < succ>
```

```
                                -continued
            bacterial membrane --- Certainty = 0.0000(Not Clear) < succ>
             bacterial outside --- Certainty = 0.0000(Not Clear) < succ>
```

A related GBS nucleic acid sequence <SEQ ID 9633>
which encodes amino acid sequence <SEQ ID 9634> was
also identified.

The protein has homology with the following sequences in
the GENPEPT database.

```
>GP: AAF12702 GB: AF035157 aspartate aminotransferase [Lactococcus
lactis]
Identities = 270/391 (69%), Positives = 314/391 (80%)

Query:     7 MTYLSERVLNMEESVTLAAGAKARELRVQGRDILSLTLGEPDFATPKNIQQAAIEAITDG    66
             M   S+ VL M+ESVTLAA  +A+ L+ QGRDI+ LTLG+PDF TPK I QAAIEAI +G
Sbjct:     1 MKKCSDFVLKMDESVTLAAANRAKALKAQGRDIIDLTLGQPDFPTPKKIGQAAIEAINNG    60

Query:    67 RASFYTPSSGLPELKSAINAYFERFYGYSLKPNQVVVGTGAKFILYTFFMTVLNPGDEVI   126
             +ASFYT +  GLPELK A+   Y+ RFY Y ++ N++++  GAKF LY +FM  ++P DEVI
Sbjct:    61 QASFYTQAGGLPELKKAVQHYWTRFYAYEIQTNEILITAGAKFALYAYFMATVDPLDEVI   120

Query:   127 IPTPYWVSYADQIKMAEGKPVFVTAKEVNHFKVTVEQLEAVRTDKTKVILLNSPSNPTGM   186
             IP PYWVSY DQ+KMA G PV V AK+ N+FKVTVEQLE  RT KTK++LLNSPSNPTGM
Sbjct:   121 IPAPYWVSYVDQVKMAGGNPVIVEAKQENNFKVTVEQLEKARTSKTKILLLNSPSNPTGM   180

Query:   187 IYKAEELEAIGNWAVEHDILILADDIYGRLVYNGNIFTPISSLSESIRNQTIVINGVSKT   246
             IY   EEL AIG WAV HD+LILADDIY RLVYNG  FT ISSLS+ IRN+T VINGVSKT
Sbjct:   181 IYSKEELTAIGEWAVAHDLLILADDIYHRLVYNGAEFTAISSLSDEIRNRTTVINGVSKT   240

Query:   247 YAMTGWRVGFAVGNHDIIAAMSKVVSQTTSNLTAVSQYATIEALNGSQESFEKMRLAFEE   306
             +AMTGWR+G AVG+ +IIAAM+K+ SQTTSN TAV+QYA IEA    + +SFEKM  AFEE
Sbjct:   241 FAMTGWRIGLAVGDPEIIAAMTKIASQTTSNPTAVAQYAAIEAFEENDKSFEKMHAAFEE   300

Query:   307 RLNIIYPLLCQVPGFEVVKPQGAFYLFPNVTKAMEMKGYTDVTAFTDAILEEVGLALVTG   366
             RLN IY   L +VPGFE+VKP GAFYLFP VTKAM MKGYTDVT FT AILEE G+ALVTG
Sbjct:   301 RLNKIYLQLSEVPGFELVKPNGAFYLFPKVTKAMAMKGYTDVTDFTTAILEEAGVALVTG   360

Query:   367 AGFGAPENVRLSYATDLETLKEAVRRLHVFM                               397
             AGFG+PENVRLSYAT LETL+ AV RL  +M
Sbjct:   361 AGFGSPENVRLSYATSLETLEAAVTRLKDWM                               391
```

A related DNA sequence was identified in *S. pyogenes*
<SEQ ID 1005> which encodes the amino acid sequence
<SEQ ID 1006>. Analysis of this protein sequence reveals the
following:

```
Possible site: 30
>>> Seems to have no N-terminal signal sequence
    INTEGRAL    Likelihood = -0.48    Transmembrane    95-111 (95-113)

----- Final Results -----
            bacterial membrane --- Certainty = 0.1192(Affirmative) < succ>
             bacterial outside --- Certainty = 0.0000(Not Clear) < succ>
            bacterial cytoplasm --- Certainty = 0.0000(Not Clear) < succ>
```

An alignment of the GAS and GBS proteins is shown
below.

```
Identities = 301/397 (75%), Positives = 343/397 (85%)
Query:     7 MTYLSERVLNMEESVTLAAGAKARELRVQGRDILSLTLGEPDFATPKNIQQAAIEAITDG    66
             M   LS+RVL M+ESVTLAAGA+A+ L+ QGRD+L+LTLGEPDF TPK+IQ  AIE+I +G
Sbjct:     1 MPKLSKRVLEMKESVTLAAGARAKALKAQGRDVLNLTLGEPDFFTPKHIQDKAIESIQNG    60

Query:    67 RASFYTPSSGLPELKSAINAYFERFYGYSLKPNQVVVGTGAKFILYTFFMTVLNPGDEVI   126
              ASFYT +SGLPELK+AI  Y +   YGY L P+Q+V GTGAKFILY FFM VLNPGD+V+
Sbjct:    61 TASFYTNASGLPELKAAIATYLKNQYGYHLSPDQIVAGTGAKFILYAFFMAVLNPGDQVL   120

Query:   127 IPTPYWVSYADQIKMAEGKPVFVTAKEVNHFKVTVEQLEAVRTDKTKVILLNSPSNPTGM   186
             IPTPYWVSY+DQ+KMAEG+P+FV    E N FKVTV+QLE  RT KTKV+L+NSPSNPTGM
Sbjct:   121 IPTPYWVSYSDQVKMAEGQPIFVQGLEENQFKVTVDQLERARTSKTKVVLINSPSNPTGM   180
```

```
                              -continued
Query:  187 IYKAEELEAIGNWAVEHDILILADDIYGRLVYNGNIFTPISSLSESIRNQTIVINGVSKT  246
            IY AEEL AIG WAV +DILILADDIYG LVYNGN F PIS+LSE+IR QTI +NGV+K+
Sbjct:  181 IYGAEELRAIGEWAVHNDILILADDIYGSLVYNGNQFVPISTLSEAIRRQTITVNGVAKS  240

Query:  247 YAMTGWRVGFAVGNHDIIAAMSKVVSQTTSNLTAVSQYATIEALNGSQESFEKMRLAFEE  306
            YAMTGWRVGFA G  +II+AMSK++ QTTSNLT VSQYA IEA GSQ S E+MRLAFEE
Sbjct:  241 YAMTGWRVGFAAGEPEIISAMSKIIGQTTSNLTTVSQYAAIEAFCGSQSSLEEMRLAFEE  300

Query:  307 RLNIIYPLLCQVPGFEVVKPQGAFYLFPNVTKAMEMKGYTDVTAFTDAILEEVGLALVTG  366
            RLNI YPLLCQVPGFEVVKPQGAFY FPNV KAMEM G++DVT+F +AILEEVGLA+V+G
Sbjct:  301 RLNITYPLLCQVPGFEVVKPQGAFYFFPNVKKAMEMTGFSDVTSFANAILEEVGLAVVSG  360

Query:  367 AGFGAPENVRLSYATDLETLKEAVRRLHVFMGSNEIN                         403
            AGFGAPENVRLSYATD+ETLKEAVRRLHVFM SNEIN
Sbjct:  361 AGFGAPENVRLSYATDIETLKEAVRRLHVFMESNEIN                         397
```

Based on this analysis, it was predicted that these proteins and their epitopes could be useful antigens for vaccines or diagnostics.

EXAMPLE 1775

A DNA sequence (GBSx1882) was identified in *S. agalactiae* <SEQ ID 5519> which encodes the amino acid sequence <SEQ ID 5520>. This protein is predicted to be asparaginyl-tRNA synthetase (asnS). Analysis of this protein sequence reveals the following:

```
Possible site: 46
>>> Seems to have no N-terminal signal sequence

----- Final Results -----
            bacterial cytoplasm --- Certainty = 0.1488(Affirmative) < succ>
            bacterial membrane  --- Certainty = 0.0000(Not Clear)  < succ>
             bacterial outside  --- Certainty = 0.0000(Not Clear)  < succ>
```

The protein has homology with the following sequences in the GENPEPT database.

```
>GP:BAB05415 GB:AP001512 asparaginyl-tRNA synthetase
[Bacillus halodurans]
Identities = 252/442 (57%), Positives = 316/442 (71%), Gaps = 15/442 (3%)
Query:    7 SIVDVKDYVGQEVTIGAWVANKSGKGKIAFVQLRDGSAFFQGVAFKPNFIEKYGEESGLE   66
            +I  +   YV QEVT+GAW+ANK   GKIAF+QLRDG+ F QGV  K          E G E
Sbjct:    4 TIAKIGQYVDQEVTLGAWLANKRSSGKIAFLQLRDGTGFIQGVVVKA--------EVGDE   55

Query:   67 KFDVIKRLNQETSVYVTGIVKEDERSKFGYELDITDLEVIGESHEYPITPKEHGTDFLMD  126
                  F   K L  QE+S+YVTGIV++DER+  GYEL +T  ++I E+ +YPITPKEHGT+FLMD
Sbjct:   56 WFQKAKNLTQESSLYVTGIVRKDERAPSGYELTVTSFDIIHEATDYPITPKEHGTEFLMD  115

Query:  127 NRHLWLRSRKQMAVMQIRNAIIYSTYEFFDQNGFIKFDSPILSENAAEDSTELFETDYFG  186
            +RHLW+RSRKQ AV++IRN II +TYEFF +NGF+K D PIL+ +A E +TELF T  YF
Sbjct:  116 HRHLWIRSRKQHAVLRIRNEIIRATYEFFHENGFVKVDPPILTGSAPEGTTELFHTKYFD  175

Query:  187 KPAFLSQSGQLYLEAGAMALGRVFDFGPVFRAEKSKTRRHLTEFWMMDAEYSFLSHEESL  246
              + AFLSQSGQLY+EA A+A GRVF FGP FRAEKSKTRRHL EFWM++ E +F+   EESL
Sbjct:  176 EDAFLSQSGQLYMEAAALAFGRVFSFGPTFRAEKSKTRRHLIEFWMIEPEMAFVEFEESL  235

Query:  247 DLQEAYVKALIQGVLDRAPQALDILERDVEALKRYIAEPFKRVSYDDAITLLQEHEADED  306
            ++QE YV  ++Q VL      L  L RD  L+  I   PF R+SYDDAI  L E    D+
Sbjct:  236 EIQENYVAYIVQSVLKHCAIELKTLGRDTSVLES-IQAPFPRISYDDAIKFLHEKGFDD-  293

Query:  307 TDYEHLEHGDDFGSPHETWISNYFGVPTFVVNYPASFKAFYMKPVPGNPERVLCADLLAP  366
             +E  GDDFG+PHET I+ +F   P F+   +YP S K FYM+P P    + VLCADL+AP
Sbjct:  294 -----IEWGDDFGAPHETAIAEHFDKPVFITHYPTSLKPFYMEPDPNRDDVVLCADLIAP  348

Query:  367 EGYGEIIGGSMREDDYDALVAKMDELGMDKSEYDFYLDLRKYGSVPHGGFGIGIERMVTF  426
            EGYGEIIGGS R  DYD L  +++E  +     Y +YLDLRKYGSVPH GFG+G+ER V +
Sbjct:  349 EGYGEIIGGSQRISDYDLLKKRLEEHDLSLDAYAWYLDLRKYGSVPHSGFGLGLERTVGW  408

Query:  427 VAGTKHIREAIPFPRMLHRIKP                                       448
             ++G   H+RE IPFPR+L+R+  P
Sbjct:  409 ISGAGHVRETIPFPRLLNRLYP                                       430
```

A related DNA sequence was identified in *S. pyogenes* <SEQ ID 5521> which encodes the amino acid sequence <SEQ ID 5522>. Analysis of this protein sequence reveals the following:

```
Possible site: 46
>>> Seems to have no N-terminal signal sequence

----- Final Results -----
            bacterial cytoplasm --- Certainty = 0.1488(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below.

```
Identities = 443/448 (98%), Positives = 447/448 (98%)
Query:   1 MSKKLISIVDVKDYVGQEVTIGAWVANKSGKGKIAFVQLRDGSAFFQGVAFKPNFIEKYG    60
           MSKKLISIVDVKDYVGQEVTIGAWVANKSGKGKIAFVQLRDGSAFFQGVAFKPNFIEKYG
Sbjct:   1 MSKKLISIVDVKDYVGQEVTIGAWVANKSGKGKIAFVQLRDGSAFFQGVAFKPNFIEKYG    60

Query:  61 EESGLEKFDVIKRLNQETSVYVTGIVKEDERSKFGYELDITDLEVIGESHEYPITPKEHG   120
           EESGLEKFDVIKRLNQETSVYVTGIVKEDERSKFGYELDITDLE+IGESHEYPITPKEHG
Sbjct:  61 EESGLEKFDVIKRLNQETSVYVTGIVKEDERSKFGYELDITDLEIIGESHEYPITPKEHG   120

Query: 121 TDFLMDNRHLWLRSRKQMAVMQIRNAIIYSTYEFFDQNGFIKFDSPILSENAAEDSTELF   180
           TDFLMDNRHLWLRSRKQMAVMQIRNAIIY+TYEFFDQNGFIKFDSPILSENAAEDSTELF
Sbjct: 121 TDFLMDNRHLWLRSRKQMAVMQIRNAIIYATYEFFDQNGFIKFDSPILSENAAEDSTELF   180

Query: 181 ETDYFGKPAFLSQSGQLYLEAGAMALGRVFDFGPVFRAEKSKTRRHLTEFWMMDAEYSFL   240
           ETDYFGKPAFLSQSGQLYLEAGAMALGRVFDFGPVFRAEKSKTRRHLTEFWMMDAEYSFL
Sbjct: 181 ETDYFGKPAFLSQSGQLYLEAGAMALGRVFDFGPVFRAEKSKTRRHLTEFWMMDAEYSFL   240

Query: 241 SHEESLDLQEAYVKALIQGVLDRAPQALDILERDVEALKRYIAEPFKRVSYDDAITLLQE   300
           SHEESLDLQEAYVKALIQGVLDRAPQALDILERDVEALKRYI EPFKRVSYDDAITLLQE
Sbjct: 241 SHEESLDLQEAYVKALIQGVLDRAPQALDILERDVEALKRYITEPFKRVSYDDAITLLQE   300

Query: 301 HEADEDTDYEHLEHGDDFGSPHETWISNYFGVPTFVVNYPASFKAFYMKPVPGNPERVLC   360
           HEADEDTDYEHLEHGDDFGSPHETWISNYFGVPTFVVNYPASFKAFYMKPVPGNPERVLC
Sbjct: 301 HEADEDTDYEHLEHGDDFGSPHETWISNYFGVPTFVVNYPASFKAFYMKPVPGNPERVLC   360

Query: 361 ADLLAPEGYGEIIGGSMREDDYDALVAKMDELGMDKSEYDFYLDLRKYGSVPHGGFGIGI   420
           ADLLAPEGYGEIIGGSMRED+YDALVAKMDELGMDKSEYDFYLDLRKYGSVPHGGFGIGI
Sbjct: 361 ADLLAPEGYGEIIGGSMREDNYDALVAKMDELGMDKSEYDFYLDLRKYGSVPHGGFGIGI   420

Query: 421 ERMVTFVAGTKHIREAIPFPRMLHRIKP                                  448
           ERMVTFVAGTKHIREAIPFPRMLHRI+P
Sbjct: 421 ERMVTFVAGTKHIREAIPFPRMLHRIRP                                  448
```

Based on this analysis, it was predicted that these proteins and their epitopes could be useful antigens for vaccines or diagnostics.

EXAMPLE 1776

A DNA sequence (GBSx1883) was identified in *S. agalactiae* <SEQ ID 5523> which encodes the amino acid sequence <SEQ ID 5524>. Analysis of this protein sequence reveals the following:

```
Possible site: 17
>>> Seems to have a cleavable N-term signal seq.
    INTEGRAL    Likelihood = -6.85     Transmembrane    103-119  (102-127)
    INTEGRAL    Likelihood = -5.04     Transmembrane     73-89    (68-93)
    INTEGRAL    Likelihood = -4.19     Transmembrane     31-47    (31-49)
    INTEGRAL    Likelihood = -1.86     Transmembrane    157-173  (157-173)

----- Final Results -----
             bacterial membrane --- Certainty = 0.3739(Affirmative) < succ>
              bacterial outside --- Certainty = 0.0000(Not Clear)   < succ>
            bacterial cytoplasm --- Certainty = 0.0000(Not Clear)   < succ>
```

The protein has homology with the following sequences in the GENPEPT database.

```
>GP:AAD40355 GB:AF036485 hypothetical protein [Plasmid pNZ4000]
Identities = 39/135 (28%), Positives = 72/135 (52%), Gaps = 4/135 (2%)
Query:    3 KSPARLISFISIAIAINLVGANLALFLRLPIYLDTIGTLLIAVILGPWYAASTAFLSALI   62
            K  A  ++ I  A+ IN V   LA   L+LP++L ++GT L +++ GP    A + F++ +I
Sbjct:   15 KLSAATMTLIPAAVGINYVAKALAEGLKLPVWLGSLGTFLASMLAGPVAGAISGFINNVI   74

Query:   63 NWMTTDIFSLYYSPVAIVVAIITGILIKRNCKPSS--LLWKSLIISLPGTIIASVITVIL  120
            ++T    S  Y+  +I + I  G+L       S+  +  ++II++    +I++ + VI
Sbjct:   75 YGLTLSPISTVYAITSIGIGIAVGVLHANGWFSSARRVFVSAIIIAIVSAVISTPLNVIF  134

Query:  121 FKGIT--SSGSSIIA                                              133
            + G T   + G S+ A
Sbjct:  135 WGGQTGIAWGDSLFA                                              149
```

No corresponding DNA sequence was identified in *S. pyogenes*.

Based on this analysis, it was predicted that this protein and its epitopes, could be useful antigens for vaccines or diagnostics.

EXAMPLE 1777

A DNA sequence (GBSx1884) was identified in *S. agalactiae* <SEQ ID 5525> which encodes the amino acid sequence <SEQ ID 5526>. Analysis of this protein sequence reveals the following:

```
Possible site: 25
>>> Seems to have no N-terminal signal sequence

----- Final Results -----
         bacterial cytoplasm --- Certainty = 0.1873(Affirmative) < succ>
         bacterial membrane  --- Certainty = 0.0000(Not Clear)   < succ>
           bacterial outside --- Certainty = 0.0000(Not Clear)   < succ>
```

The protein has homology with the following sequences in the GENPEPT database.

```
>GP:AAC75223 GB:AE000305 orf, hypothetical protein [Escherichia coli K12]
Identities = 97/305 (31%), Positives = 160/305 (51%), Gaps = 10/305 (3%)
Query:    1 MNKEKIIIDCDPGIDDTLALMYAIQHPKLEVVAITITAGNSPVELGLKNTFVTLELLNRH   60
            M K KII+DCDPG DD +A+M A +HP ++++ ITI AGN  ++  L N    + L
Sbjct:    1 MEKRKIILDCDPGHDDAIAIMMAAKHPAIDLLGITIVAGNQTLDKTLINGLNVCQKL-EI   59

Query:   61 DIPVYVGDNLPLQREFVSAQDTHGMDGLGENNFTLAQPIIFQEESADC---FLANYFEHK  117
             ++PVY G   P+ R+ + A + HG   GL   F   +P+  Q  ES           +
Sbjct:   60 NVPVYAGMPQPIMRQQIVADNIHGETGLDGPVF---EPLTRQAESTHAVKYIIDTLMASD  116

Query:  118 NDTSIIALGPLTNIARALQTNPKLGKHCKRFISMGGSFKSHGNCSPVAEYNYWCDPHAAQ  177
             D +++ +GPL+NIA A++  P +     +  + MGG++ + GN +P AE+N + DP AA+
Sbjct:  117 GDITLVPVGPLSNIAVAMRMQPAILPKIREIVLMGGAYGT-GNFTPSAEFNIFADPEAAR  175

Query:  178 YVFENLDKKIEMVGLDITRHIVLTPNHLSYMERINPDVSSFIQKITKFYFDFHWQYEHII  237
             VF +    + M+GLD+T   V  TP+  ++ MER      I   F   ++    +
Sbjct:  176 VVFTS-GVPLVMMGLDLTNQTVCTPDVIARMERAGGPAGELFSDIMNFTLKTQFENYGLA  234

Query:  238 GCVINDPLAIAYFVNENIATGFDSYTDVACH-GIAMGQTIVDQYHFYKKDANSKILTSVN  296
            G   ++D   I Y +N +       + Y +V    G   G+T+ D+      K AN+K+    +++
Sbjct:  235 GGPVHDATCIGYLINPDGIKTQEMYVEVDVNSGPCYGRTVCDELGVLGKPANTKVGITID  294

Query:  297 TNLFW                                                        301
            T+ FW
Sbjct:  295 TDWFW                                                        299
```

No corresponding DNA sequence was identified in *S. pyogenes*.

Based on this analysis, it was predicted that this protein and its epitopes, could be useful antigens for vaccines or diagnostics.

EXAMPLE 1778

A DNA sequence (GBSx1885) was identified in *S. agalactiae* <SEQ ID 5527> which encodes the amino acid sequence <SEQ ID 5528>. Analysis of this protein sequence reveals the following:

```
Possible site: 53
>>> Seems to have no N-terminal signal sequence

----- Final Results -----
            bacterial cytoplasm --- Certainty = 0.1860(Affirmative) < succ>
             bacterial membrane --- Certainty = 0.0000(Not Clear)  < succ>
              bacterial outside --- Certainty = 0.0000(Not Clear)  < succ>
```

The protein has homology with the following sequences in the GENPEPT database.

```
>GP:CAB62728 GB:AL133423 hypothetical protein SC4A7.24c
[Streptomyces coelicolor A3(2)]
Identities = 36/134 (26%), Positives = 57/134 (41%), Gaps = 7/134 (5%)
Query:   1 MLYEVTSSNTQGVDGKVYLSNGKIVETNHPLNHL----PGFNPEELIALAWSTCLNATIK   56
           +LY   ++   G DG+V  +G++    +P        G NPE+L A  +S C      +
Sbjct:   8 VLYTAVATAENGRDGRVATDDGRLDVVVNPPKEMGGNGAGTNPEQLFAAGYSACFQGALG   67

Query:  57 AILEQKGFKDLKSRVDVTCQLMKERQVGKGFYFQVNAVASIEKLSLSDSKLIVNKAHSRC  116
            +  Q+G     S V   + K     GF    V  A I  +   ++ +V KAH  C
Sbjct:  68 VVARQEGADISGSTVTAKVGIGKNDD---GFGIIVEISAEIPTVDAATARSLVEKAHQVC  124

Query: 117 PISKLISNAKTINL                                              130
           P SK      T+ L
Sbjct: 125 PYSKATRGNITVTL                                              138
```

No corresponding DNA sequence was identified in *S. pyogenes*.

Based on this analysis, it was predicted that this protein and its epitopes, could be useful antigens for vaccines or diagnostics.

EXAMPLE 1779

A DNA sequence (GBSx1886) was identified in *S. agalactiae* <SEQ ID 5529> which encodes the amino acid sequence <SEQ ID 5530>. Analysis of this protein sequence reveals the following:

```
Possible site: 61
>>> Seems to have no N-terminal signal sequence

----- Final Results -----
            bacterial cytoplasm --- Certainty = 0.0531(Affirmative) < succ>
             bacterial membrane --- Certainty = 0.0000(Not Clear)  < succ>
              bacterial outside --- Certainty = 0.0000(Not Clear)  < succ>
```

A related GBS nucleic acid sequence <SEQ ID 9635> which encodes amino acid sequence <SEQ ID 9636> was also identified.

The protein has homology with the following sequences in the GENPEPT database.

```
>GP:CAB15482 GB:Z99121 similar to hypothetical proteins
[Bacillus subtilis]
Identities = 164/285 (57%), Positives = 207/285 (72%), Gaps = 2/285 (0%)
Query:   6 IKLVIVTGMSGAGKTVAIQSFEDLGYFTIDNMPPTLVPKFLELAAQSGDT-SKIAMVVDM   64
           I+LVI+TGMSGAGKTVAIQSFEDLGYF +DN+PP+L+PKFLEL  +S    SK+A+V+D+
Sbjct:   9 IQLVIITGMSGAGKTVAIQSFEDLGYFCVDNLPPSLLPKFLELMKESNSKMSKVALVMDL   68

Query:  65 RSRLFFREINSILDSLEINDNINFKILFLDATDTELVSRYKETRRSHPLAADGRVLDGIS  124
           R R FF +   LD + N I  +ILFLDA D+ LV+RYKETRRSHPLAA G  L+GI+
Sbjct:  69 RGREFFDRLIEALDEMAENPWITPRILFLDAKDSILVTRYKETRRSHPLAATGLPLEGIA  128

Query: 125 LERELLAPLKSMSQNVVDTSELTPRQLRKVISKEFSNQDSQSSFRIEVMSFGFKYGIPLD  184
           LERELL  LK SQ + DTS++ PR LR+ I K F    ++ F + VMSFGFKYGIP+D
Sbjct: 129 LERELLEELKGRSQIIYDTSDMKPRDLREKIVKHFATNQGET-FTVNVMSFGFKYGIPID  187

Query: 185 ADLVFDVRFLPNPYYKPELRDKTGLDTEVYDYVMSFDESDDFYDHLLALIKPILPGYQNE  244
           ADLVFDVRFLPNPYY  +R  TG D EV  YVM ++E+  F + L+ L+  +LP Y+ E
Sbjct: 188 ADLVFDVRFLPNPYYIESMRPLTGKDKEVSSYVMKWNETQKFNEKLIDLLSFMLPSYKRE  247
```

```
                         -continued
Query:  245 GKSVLTVAIGCTGGQHRSTAFAHRLSEDLKADWTVNESHRDKNKR              289
            GKS + +AIGCTGGQHRS   A  L++  K D+  + +HRD  KR
Sbjct:  248 GKSQVVIAIGCTGGQHRSVTLAENLADYFKKDYYTHVTHRDIEKR              292
```

A related DNA sequence was identified in *S. pyogenes* <SEQ ID 5531> which encodes the amino acid sequence <SEQ ID 5532>. Analysis of this protein sequence reveals the following:

```
Possible site: 20
>>> Seems to have an uncleavable N-term signal seq

----- Final Results -----
              bacterial membrane --- Certainty = 0.0000(Not Clear) < succ>
               bacterial outside --- Certainty = 0.0000(Not Clear) < succ>
             bacterial cytoplasm --- Certainty = 0.0000(Not Clear) < succ>
```

The protein has homology with the following sequences in the databases:

```
>GP:CAB15482 GB:Z99121 similar to hypothetical proteins
[Bacillus subtilis]
Identities = 164/291 (56%), Positives = 213/291 (72%), Gaps = 3/291 (1%)
Query:    1 MSDKH-INLVIVTGMSGAGKTVAIQSFEDLGYFTIDNMPPALVPKFLELIEQTNENR-RV   58
            +S+ H I LVI+TGMSGAGKTVAIQSFEDLGYF +DN+PP+L+PKFLEL++++N    +V
Sbjct:    3 VSESHDIQLVIITGMSGAGKTVAIQSFEDLGYFCVDNLPPSLLPKFLELMKESNSKMSKV   62

Query:   59 ALVVDMRSRLFFKEINSTLDSIESNPSIDFRILFLDATDGELVSRYKETRRSHPLAADGR  118
            ALV+D+R R FF  +    LD +  NP I  RILFLDA D  LV+RYKETRRSHPLAA G
Sbjct:   63 ALVMDLRGREFFDRLIEALDEMAENPWITPRILFLDAKDSILVTRYKETRRSHPLAATGL  122

Query:  119 VLDGIRLERELLSPLKSMSQHVVDTTKLTPRQLRKTISDQFSEGSNQASFRIEVMSFGFK  178
              L+GI LERELL  LK  SQ + DT+ + PR LR+ I    F+    + +F + VMSFGFK
Sbjct:  123 PLEGIALERELLEELKGRSQIIYDTSDMKPRDLREKIVKHFATNQGE-TFTVNVMSFGFK  181

Query:  179 YGLPLDADLVFDVRFLPNPYYQVELREKTGLDEDVFNYVMSHPESEVFYKHLLNLIVPIL  238
            YG+P+DADLVFDVRFLPNPYY  +R  TG D++V +YVM   E++ F + L++L+   +L
Sbjct:  182 YGIPIDADLVFDVRFLPNPYYIESMRPLTGKDKEVSSYVMKWNETQKFNEKLIDLLSFML  241

Query:  239 PAYQKEGKSVLTVAIGCTGGQHRSVAFAHCLAESLATDWSVNESHRDQNRR          289
            P+Y++EGKS + +AIGCTGGQHRSV  A  LA+    D+  + +HRD  +R
Sbjct:  242 PSYKREGKSQVVIAIGCTGGQHRSVTLAENLADYFKKDYYTHVTHRDIEKR          292
```

An alignment of the GAS and GBS proteins is shown below.

```
Identities = 234/296 (79%), Positives = 263/296 (88%)
Query:    1 MSDEQIKLVIVTGMSGAGKTVAIQSFEDLGYFTIDNMPPTLVPKFLELAAQSGDTSKIAM   60
            MSD+ I LVIVTGMSGAGKTVAIQSFEDLGYFTIDNMPP LVPKFLEL Q+ +   ++A+
Sbjct:    1 MSDKHINLVIVTGMSGAGKTVAIQSFEDLGYFTIDNMPPALVPKFLELIEQTNENRRVAL   60

Query:   61 VVDMRSRLFFREINSILDSLEINDNINFKILFLDATDTELVSRYKETRRSHPLAADGRVL  120
            VVDMRSRLFF+EINS LDS+E N +I+F+ILFLDATD ELVSRYKETRRSHPLAADGRVL
Sbjct:   61 VVDMRSRLFFKEINSTLDSIESNPSIDFRILFLDATDGELVSRYKETRRSHPLAADGRVL  120

Query:  121 DGISLERELLAPLKSMSQNVVDTSELTPRQLRKVISKEFSNQDSQSSFRIEVMSFGFKYG  180
            DGI LERELL+PLKSMSQ+VVDT++LTPRQLRK IS +FS   +Q+SFRIEVMSFGFKYG
Sbjct:  121 DGIRLERELLSPLKSMSQHVVDTTKLTPRQLRKTISDQFSEGSNQASFRIEVMSFGFKYG  180

Query:  181 IPLDADLVFDVRFLPNPYYKPELRDKTGLDTEVYDYVMSFDESDDFYDHLLALIKPILPG  240
            +PLDADLVFDVRFLPNPYY+ ELR+KTGLD +V++YVMS  ES+ FY HLL LI PILP
Sbjct:  181 LPLDADLVFDVRFLPNPYYQVELREKTGLDEDVFNYVMSHPESEVFYKHLLNLIVPILPA  240

Query:  241 YQNEGKSVLTVAIGCTGGQHRSTAFAHRLSEDLKADWTVNESHRDKNKRKETVNRS      296
            YQ EGKSVLTVAIGCTGGQHRS AFAH L+E L  DW+VNESHRD+N+RKETVNRS
Sbjct:  241 YQKEGKSVLTVAIGCTGGQHRSVAFAHCLAESLATDWSVNESHRDQNRRKETVNRS      296
```

Based on this analysis, it was predicted that these proteins and their epitopes could be useful antigens for vaccines or diagnostics.

EXAMPLE 1780

A DNA sequence (GBSx1887) was identified in *S. agalactiae* <SEQ ID 5533> which encodes the amino acid sequence <SEQ ID 5534>. Analysis of this protein sequence reveals the following:

```
Possible site: 36
>>> Seems to have an uncleavable N-term signal seq

----- Final Results -----
              bacterial membrane --- Certainty = 0.0000(Not Clear) < succ>
               bacterial outside --- Certainty = 0.0000(Not Clear) < succ>
             bacterial cytoplasm --- Certainty = 0.0000(Not Clear) < succ>
```

The protein has homology with the following sequences in the GENPEPT database.

```
>GP:CAB96620 GB:AJ400630 hypothetical protein
[Streptococcus pneumoniae bacteriophage MM1]
Identities = 254/321 (79%), Positives = 286/321 (88%), Gaps = 1/321 (0%)
Query:    1 MRKPKITVIGGGTGIPVILKSLRLEDVEITAVVTVADDGGSSGELRSVMQ-LTPPGDLRN    59
            MRKPKITVIGGGTGIPVILKSLR +DVEI A+VTVADDGGSSGELR  MQ LTPPGDLRN
Sbjct:    1 MRKPKITVIGGGTGIPVILKSLREKDVEIAAIVTVADDGGSSGELRKNMQQLTPPGDLRN    60

Query:   60 VLVALSDMPKFYEQIFQYRFAEGDGDFAGHPLGNLIIAGVAEMQGSTYNAMQSLTQFFHT   119
            VLVA+SDMPKFYE++FQYRF+E  G FAGHPLGNLIIAG++EMQGSTYNAMQ L++FFHT
Sbjct:   61 VLVAMSDMPKFYEKVFQYRFSEDAGAFAGHPLGNLIIAGLSEMQGSTYNANQLLSKFFHT   120

Query:  120 TGKIYPSSEHPLTLHAVFKDGHEVVGESQIADYKGMIDHVYVTNTYNEETPTASRKVVDA   179
            TGKIYPSS+HPLTLHAVF+DG EV GES I D++G+ID+VYVTN N++TP ASR+VV
Sbjct:  121 TGKIYPSSDHPLTLHAVFQDGTEVAGESHIVDHRGIIDNVYVTNALNDDTPLASRRVVQT   180

Query:  180 ILESDMIVLGPGSLFTSILPNLVIPEIKQALLETRAEVAYVCNIMTQRGETEHFTDADHV   239
            ILESDMIVLGPGSLFTSILPN+VI EI +ALLET+AE+AYVCNIMTQRGETEHFTD+DHV
Sbjct:  181 ILESDMIVLGPGSLFTSILPNIVIKEIGRALLETKAEIAYVCNIMTQRGETEHFTDSDHV   240

Query:  240 EVLKRHLGQDAIDTVLVNIEKVPESYMENNHFDEYLVQVEHDFSGLRKHARRVISSNFLK   299
            EVL RHLG+   IDTVLVNIEKVP+ YM +N FDEYLVQVEHDF GL K   RVISSNFL+
Sbjct:  241 EVLHRHLGRPFIDTVLVNIEKVPQEYMNSNRFDEYLVQVEHDFVGLCKQVSRVISSNFLR   300

Query:  300 LEKGGAFHHGDFVVEELMNLV                                         320
            LE GGAFH GD +V+ELM ++
Sbjct:  301 LENGGAFHDGDLIVDELMRII                                         321
```

A related DNA sequence was identified in *S. pyogenes* <SEQ ID 5535> which encodes the amino acid sequence <SEQ ID 5536>. Analysis of this protein sequence reveals the following:

```
Possible site: 36
>>> Seems to have an uncleavable N-term signal seq

----- Final Results -----
              bacterial membrane --- Certainty = 0.0000(Not Clear) < succ>
               bacterial outside --- Certainty = 0.0000(Not Clear) < succ>
             bacterial cytoplasm --- Certainty = 0.0000(Not Clear) < succ>
```

An alignment of the GAS and GBS proteins is shown below.

```
Identities = 251/320 (78%), Positives = 284/320 (88%)
Query:    1 MRKPKITVIGGGTGIPVILKSLRLEDVEITAVVTVADDGGSSGELRSVMQLTPPGDLRNV   60
            M+ PK+TVIGGGTGI +ILKSLR E V+ITAVVTVADDGGSSGELR+ MQL PPGDLRNV
Sbjct:    1 MKNPKMTVIGGGTGISIILKSLRNEAVDITAVVTVADDGGSSGELRNAMQLAPPGDLRNV   60
```

-continued

```
Query:  61 LVALSDMPKFYEQIFQYRFAEGDGDFAGHPLGNLIIAGVAEMQGSTYNAMQSLTQFFHTT  120
           L+A+SDMPKFYE++FQYRF E DG  AGHPLGNLIIAG++EMQGSTYNA+Q LT+FFH T
Sbjct:  61 LLAMSDMPKFYERVFQYRFNESDGALAGHPLGNLIIAGISEMQGSTYNAIQILTKFFHIT  120

Query: 121 GKIYPSSEHPLTLHAVFKDGHEVVGESQIADYKGMIDHVYVTNTYNEETPTASRKVVDAI  180
           GKIYPSSE  LTLHAVFKDGHEV GES IA Y GMIDHVYVTNTYN++ P ASRKVV+AI
Sbjct: 121 GKIYPSSEQALTLHAVFKDGHEVAGESSIAKYPGMIDHVYVTNTYNDQKPQASRKVVEAI  180

Query: 181 LESDMIVLGPGSLFTSILPNLVIPEIKQALLETRAEVAYVCNIMTQRGETEHFTDADHVE  240
           LESDMIVLGPGSLFTSILPNLVIPEIK+AL +T+AEV Y+CNIMTQ GETE F+DADHV
Sbjct: 181 LESDMIVLGPGSLFTSILPNLVIPEIKEALRQTKAEVVYICNIMTQYGETEQFSDADHVA  240

Query: 241 VLKRHLGQDAIDTVLVNIEKVPESYMENNHFDEYLVQVEHDFSGLRKHARRVISSNFLKL  300
           VL +HLG+D IDTVLVN+ KVP++YM +N FDEYLVQV+HDF+GL + A+RVISS FL+L
Sbjct: 241 VLNQHLGRDLIDTVLVNVAKVPQAYMNSNKFDEYLVQVDHDFAGLCRAAKRVISSYFLRL  300

Query: 301 EKGGAFHHGDFVVEELMNLV                                         320
           E GGAFH G+ VVEELMNLV
Sbjct: 301 ENGGAFHDGNLVVEELMNLV                                         320
```

SEQ ID 5534 (GBS269) was expressed in *E. coli* as a His-fusion product. SDS-PAGE analysis of total cell extract is shown in FIG. 49 (lane 12; MW 35 kDa). It was also expressed in *E. coli* as a GST-fusion product. SDS-PAGE analysis of total cell extract is shown in FIG. 54 (lane 5; MW 60.5 kDa).

Based on this analysis, it was predicted that these proteins and their epitopes could be useful antigens for vaccines or diagnostics.

EXAMPLE 1781

A DNA sequence (GBSx1888) was identified in *S. agalactiae* <SEQ ID 5537> which encodes the amino acid sequence <SEQ ID 5538>. Analysis of this protein sequence reveals the following:

```
Possible site: 34
>>> Seems to have no N-terminal signal sequence

----- Final Results -----
            bacterial cytoplasm --- Certainty = 0.2479(Affirmative) < succ>
            bacterial membrane  --- Certainty = 0.0000(Not Clear)   < succ>
              bacterial outside --- Certainty = 0.0000(Not Clear)   < succ>
```

The protein has homology with the following sequences in the GENPEPT database.

```
>GP: CAB96619 GB: AJ400630 hypothetical protein
[Streptococcus pneumoniae bacteriophage MM1]
Identities = 209/303 (68%), Positives = 260/303 (84%)

Query:   1 MSFTVKVKEELLGHKSENKMELSAIIKMSGSLGLANHGLNLSITTENAKIARHIYSMLEE   60
           MSFTV VKEE+LG    ++ ELSAIIKMSGS+GL+  GL LS+ TENAK+ARH+Y
Sbjct:   1 MSFTVAVKEEILGQHHLSRHELSAIIKMSGSIGLSTSGLTLSVVTENAKLARHLYESFLH   60

Query:  61 HYHLQPEIKYHQKTNLRKNRVYTVFIEEKVDVILADLKLADAFFGIETGIEHSILDNDEN  120
           Y ++ EI++HQ++NLRKNRVYTVF +EKV  +L+DL LAD+FFG+ETGI+ +IL ++E
Sbjct:  61 FYEIKSEIRHHQRSNLRKNRVYTVFTDEKVQDLLSDLHLADSFFGLETGIDEAILSDEEA  120

Query: 121 GRAYLRGAFLSTGTVREPDSGKYQLEIFSVYLDHAQDLANLMKKFMLDAKVIEHKHGAVT  180
           GRAYL GAFL+ G++R+P+SGKYQLEI SVYLDHAQ +A+L+++F+LDAKV+E K GAVT
Sbjct: 121 GRAYLCGAFLANGSIRDPESGKYQLEISSVYLDHAQGIASLLQQFLLDAKVLERKKGAVT  180

Query: 181 YLQKAEDIMDFLIVIDAMEARDAFEEIKMIRETRNDINRANNVETANIARTITASMKTIN  240
           YLQ+AEDIMDFLIVI AM+ARD FE +K++RETRND+NRANN ETANIART++ASMKTIN
Sbjct: 181 YLQRAEDIMDFLIVIGAMQARDDFERVKILRETRNDLNRANNAETANIARTVSASMKTIN  240

Query: 241 NIIKIMDTIGFDALPSDLRQVAQVRVAHPDYSIQQIADSLETPLSKSGVNHRLRKINKIA  300
           NI KI D +G + LP DL++VAQ+R+ HPDYSIQQ+ADSL TPL+KSGVNHRLRKINKIA
Sbjct: 241 NISKIKDIMGLENLPVDLQEVAQLRIQHPDYSIQQLADSLSTPLTKSGVNHRLRKINKIA  300

Query: 301 DEL                                                          303
           DEL
Sbjct: 301 DEL                                                          303
```

A related DNA sequence was identified in *S. pyogenes* <SEQ ID 5539> which encodes the amino acid sequence <SEQ ID 5540>. Analysis of this protein sequence reveals the following:

```
Possible site: 35
>>> Seems to have no N-terminal signal sequence

----- Final Results -----
            bacterial cytoplasm --- Certainty = 0.1698(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below.

```
Identities = 222/303 (73%), Positives = 269/303 (88%)

Query:    1 MSFTVKVKEELLGHKSENKMELSAIIKMSGSLGLANHGLNLSITTENAKIARHIYSMLEE   60
            MSFT KVKEEL+  + +  EL+AIIK+SGSLGLA+  L+LSITTENAKIAR+IYS++E+
Sbjct:    1 MSFTTKVKEELIHLSTGDNNELAAIIKLSGSLGLAHQSLHLSITTENAKIARYIYSLIED   60

Query:   61 HYHLQPEIKYHQKTNLRKNRVYTVFIEEKVDVILADLKLADAFFGIETGIEHSILDNDEN  120
            Y + PEI+YHQKTNLRKNRVYTV++E+ V+ ILADLKLAD+FFG+ETGIE  +L +D
Sbjct:   61 AYVIVPEIRYHQKTNLRKNRVYTVYVEQGVETILADLKLADSFFGLETGIEPQVLSDDNA  120

Query:  121 GRAYLRGAFLSTGTVREPDSGKYQLEIFSVYLDHAQDLANLMKKFMLDAKVIEHKHGAVT  180
            GR+YL+GAFL+ G++R+P+SGKYQLEI+SVYLDHAQDLA LM+KFMLDAK IEHK GAVT
Sbjct:  121 GRSYLKGAFLAAGSIRDPESGKYQLEIYSVYLDHAQDLAQLMQKFMLDAKTIEHKSGAVT  180

Query:  181 YLQKAEDIMDFLIVIDAMEARDAFEEIKMIRETRNDINRANNVETANIARTITASMKTIN  240
            YLQKAEDIMDFLI+I AM  ++ FE IK++RE RNDINRANN ETANIA+TI+ASMKTIN
Sbjct:  181 YLQKAEDIMDFLIIIGAMSCKEDFEAIKLLREARNDINRANNAETANIAKTISASMKTIN  240

Query:  241 NIIKIMDTIGFDALPSDLRQVAQVRVAHPDYSIQQIADSLETPLSKSGVNHRLRKINKIA  300
            NIIKIMDTIG ++LP +L+QVAQ+RV HPDYSIQQ+AD+LE P++KSGVNHRLRKINKIA
Sbjct:  241 NIIKIMDTIGLESLPIELQQVAQLRVKHPDYSIQQVADALEFPITKSGVNHRLRKINKIA  300

Query:  301 DEL                                                          303
            D+L
Sbjct:  301 DDL                                                          303
```

Based on this analysis, it was predicted that these proteins and their epitopes could be useful antigens for vaccines or diagnostics.

EXAMPLE 1782

A DNA sequence (GBSx1889) was identified in *S. agalactiae* <SEQ ID 5541> which encodes the amino acid sequence <SEQ ID 5542>. This protein is predicted to be dipeptidase. Analysis of this protein sequence reveals the following:

```
Possible site: 23
>>> Seems to have no N-terminal signal sequence

----- Final Results -----
            bacterial cytoplasm --- Certainty = 0.3544(Affirmative) < succ>
             bacterial membrane --- Certainty = 0.0000(Not Clear)   < succ>
              bacterial outside --- Certainty = 0.0000(Not Clear)   < succ>
```

The protein has homology with the following sequences in the GENPEPT database.

```
>GP: CAA86210 GB: Z38063 dipeptidase [Lactobacillus helveticus]
Identities = 218/473 (46%), Positives = 310/473 (65%), Gaps = 14/473 (2%)

Query:    3 CTTILVGKKASYDGSTMIARTEDSVNGDFTPKKLKVMTSKDQPRHYKSVLSNFEVD---L   59
            CTTILVGKKAS DGSTMIAR+ED       P+   KV+  +DQP+HY SV+S   +D   L
Sbjct:    6 CTTILVGKKASIDGSTMIARSEDG-GRVIIPEGFKVVNPEDQPKHYTSVISKQKIDDEDL   64
```

-continued
```
Query:   60 PDNPLPYTSVPDALGKDGIWGEAGINSKNVAMSATETITTNSRVLGADPLVSD---GIGE  116
            + PL YTS PD  GK+GIWG AGIN+ NVAM+ATETITTNSR+ G DP++      G+GE
Sbjct:   65 AETPLRYTSAPDVSGKNGIWGAAGINADNVAMTATETITTNSRIQGVDPILDPSEGGLGE  124

Query:  117 EDILTLVLPYIQSAREGVERLGAILEKYGTYESNGIAFSDTEEIWWLETIGGHHWIARRV  176
            ED +TL LPY+ SA +GV+R+G ++EKYGTYE NG+AFSD + IW+LETIGGHHWIARR+
Sbjct:  125 EDFVTLTLPYLHSAFDGVKRVGYLVEKYGTYEMNGMAFSDKDNIWYLETIGGHHWIARRI  184

Query:  177 PDDVYVTNPNQLGIDHFEFNNCDDYMCSSDLKEFIEQYHLDLTYSNEHFNPRYAFGSQRD  236
            PDD YV  PN+L ID F+F++ +++  +SDLK+ I++YHL+      E +N R+ FGS
Sbjct:  185 PDDAYVIAPNRLNIDTFDFDDSENFAAASDLKDLIDEYHLN--PDREGYNMRHIFGSSTI  242

Query:  237 KDRHYNTPRSWAMQRFLNPEIEQDPRSLFIPWCQKPYRKITVEDIKYVLSDHYQDSVYDP  296
            KD HYN PR+W +  + +P+      P     P+   +  R I++EDIK+  S  HYQD+ YD
Sbjct:  243 KDAHYNNPRAWYIHNYFDPDFGGTPADQDQPFICRANRLISIEDIKWAESSHYQDTPYDA  302

Query:  297 YGPEGDAVSRRAFRSVGINRTSQTSILQLRPNKSLETTGVQWLSYGSMPFATMVPLFTQV  356
            YG +G   ++ FR +GINR  +T ILQ+R +   E  GVQWL++G   F +M+P +T V
Sbjct:  303 YGDQGTPEQKKTFRPIGINRNFETHILQIRNDVPAEIAGVQWLAFGPNTFNSMLPFYTNV  362

Query:  357 ETVPNYFSNTTKDASTDNFYWTNRLIAALADPHFYQHEADIESYIERTMAQGHAHINGVD  416
             T  P   +   T K  + +  +W N+L A L D ++  +    +++ ++++AQ H   +  D
Sbjct:  363 TTTPEAWQTTPK-FNLNKIFWLNKLTAQLGDTNYRVYGELEDAFEQKSLAQCHKIQHETD  421

Query:  417 REVAENKEIDFQQK----NQEMSDYIQKESQELLNRILFDASNLMTNRFSMGD         465
            +EV      + Q K      NQ+MSD +   + ELL +++ +    LMT ++ + D
Sbjct:  422 KEVKNLSGKELQDKLIAANQKMSDTVYNNTVELLGQMVDEGHGLMTLKYDLLD          474
```

A related DNA sequence was identified in *S. pyogenes* <SEQ ID 5543> which encodes the amino acid sequence <SEQ ID 5544>. Analysis of this protein sequence reveals the following:

Possible site: 30

>>> Seems to have no N-terminal signal sequence

----- Final Results -----
            bacterial cytoplasm --- Certainty = 0.0514(Affirmative) < succ>
             bacterial membrane --- Certainty = 0.0000(Not Clear)   < succ>
              bacterial outside --- Certainty = 0.0000(Not Clear)   < succ>

An alignment of the GAS and GBS proteins is shown below.

```
Identities = 345/464 (74%), Positives = 407/464 (87%)

Query:    2 ACTTILVGKKASYDGSTMIARTEDSVNGDFTPKKLKVMTSKDQPRHYKSVLSNFEVDLPD   61
            +CTTILVGKKASYDGSTM+ARTEDS NGDFTPKK+ V+  +DQPRHY+SV S+FE+DLPD
Sbjct:    9 SCTTILVGKKASYDGSTMVARTEDSQNGDFTPKKMIVVKPEDQPRHYRSVQSSFEMDLPD   68

Query:   62 NPLPYTSVPDALGKDGIWGEAGINSKNVAMSATETITTNSRVLGADPLVSDGIGEEDILT  121
            NP+ YTSVPDALGKDGIW EAG+N  NVAMSATETITTNSRVLGADPLV+ GIGEED++T
Sbjct:   69 NPMTYTSVPDALGKDGIWAEAGVNEANVAMSATETITTNSRVLGADPLVASGIGEEDMVT  128

Query:  122 LVLPYIQSAREGVERLGAILEKYGTYESNGIAFSDTEEIWWLETIGGHHWIARRVPDDVY  181
            LVLPYI+SAREGV RLGAILE YGTYESNG+AFSD  +IWWLETIGGHHWIARRVPDD Y
Sbjct:  129 LVLPYIRSAREGVLRLGAILEDYGTYESNGVAFSDEHDIWWLETIGGHHWIARRVPDDAY  188

Query:  182 VTNPNQLGIDHFEFNNCDDYMCSSDLKEFIEQYHLDLTYSNEHFNPRYAFGSQRDKDRHY  241
            VTNPNQ GIDHFEFNN +DY+CS+DLK+FI+ YHLDLTYS+EHFNPRYAFGSQRDKDR Y
Sbjct:  189 VTNPNQFGIDHFEFNNPEDYLCSADLKDFIDTYHLDLTYSHEHFNPRYAFGSQRDKDRQY  248

Query:  242 NTPRSWAMQRFLNPEIEQDPRSLFIPWCQKPYRKITVEDIKYVLSDHYQDSVYDPYGPEG  301
            NTPR+W MQ+FLNPEI QDPRS  + WCQKPYRKITVED+KYVLS HYQD+ YDPYG EG
Sbjct:  249 NTPRAWIMQKFLNPEIVQDPRSFALAWCQKPYRKITVEDVKYVLSSHYQDTGYDPYGSEG  308

Query:  302 DAVSRRAFRSVGINRTSQTSILQLRPNKSLETTGVQWLSYGSMPFATMVPLFTQVETVPN  361
              VS++  FR +GINRTSQT+IL +RPNK  E    +QW++YGSMPF TMVP FTQV+T+P+
Sbjct:  309 TPVSKKVFRPIGINRTSQTAILHIRPNKPQEIAAIQWMAYGSMPFNTMVPFFTQVKTIPD  368

Query:  362 YFSNTTKDASTDNFYWTNRLIAALADPHFYQHEADIESYIERTMAQGHAHINGVDREVAE  421
            YF+NT ++   TDNFYWTNRLIAALADPH+  HE D+++Y+E TMA+GHA ++ V+ ++
Sbjct:  369 YFANTYENVFTDNFYWTNRLIAALADPHYNHHETDLDNYLEETMAKGHAMLHAVEVQLLA  428

Query:  422 NKEIDFQQKNQEMSDYIQKESQELLNRILFDASNLMTNRFSMGD                  465
            + +D +++NQ+MSDY+Q E+Q  LLN+ILFDASNLMTNRFS+ D
Sbjct:  429 GETVDLEEENQKMSDYVQGETQTLLNKILFDASNLMTNRFSLSD                  472
```

Based on this analysis, it was predicted that these proteins and their epitopes could be useful antigens for vaccines or diagnostics.

EXAMPLE 1783

A DNA sequence (GBSx1890) was identified in *S. agalactiae* <SEQ ID 5545> which encodes the amino acid sequence <SEQ ID 5546>. Analysis of this protein sequence reveals the following:

```
Possible site: 15
>>> Seems to have a cleavable N-term signal seq.

----- Final Results -----
  bacterial outside  --- Certainty = 0.3000 (Affirmative) <succ>
 bacterial membrane  --- Certainty = 0.0000 (Not Clear)   <succ>
bacterial cytoplasm  --- Certainty = 0.0000 (Not Clear)   <succ>
```

The protein has homology with the following sequences in the GENPEPT database.

```
>GP:CAA96185 GB:Z71552 AdcA protein [Streptococcus pneumoniae]
Identities = 257/429 (59%), Positives = 312/429 (71%), Gaps = 7/429 (1%)

Query:    1 MRKKFLLLMSFVAMFAAWQLVQVKQVWADSKLKVVTTFYPVYEFTKNVVGDKADVSMLIK   60
            M+K  LLL S  A+F    +    Q   AD KL +VTTFYPVYEFTK V GD A+V +LI
Sbjct:    1 MKKISLLLASLCALFL---VACSNQKQADGKLNIVTTFYPVYEFTKQVAGDTANVELLIG   57

Query:   61 AGTEPHDFEPSTKNIAAIQDSNAFVYMDDNMETWAPKVAKSVKSKKVTTIKGTGDMLLTK  120
            AGTEPH++EPS K +A IQD++ FVY ++NMETW PK+   ++  KKV TIK TGDMLL
Sbjct:   58 AGTEPHEYEPSAKAVAKIQDADTFVYENENMETWVPKLLDTLDKKKVKTIKATGDMLLLP  117

Query:  121 GVEEEGEEHEGHGHEGHHHELDPHVWLSPERAISVVENIRNKFVKAYPKDAASFNKNADA  180
            G EEE +H+ HG EGHHHE DPHVWLSP RAI +VE+IR+       YP    +F KNA A
Sbjct:  118 GGEEEEGDHD-HGEEGHHHEFDPHVWLSPVRAIKLVEHIRDTLSADYPDKKETFEKNAAA  176

Query:  181 YIAKLKELDKEYKNGLSNAKQKSFVTQHAAFGYMALDYGLNQVPIAGLTPDAEPSSKRLG  240
            YI KL+ LDK Y   GLS AK+KSFVTQHAAF Y+ALDYGL QV I+GL+PDAEPS+ RL
Sbjct:  177 YIEKLQSLDKAYAEGLSQAKEKSFVTQHAAFNYLALDYGLKQVAISGLSPDAEPSAARLA  236

Query:  241 ELAKYIKKYNINYIYFEENASNKVAKTLADEVGVKTAVLSPLEGLSKKEMAAGEDYFSVM  300
            EL +Y+KK  I  YIYFEENAS  +A TL+ E GVKT VL+PLE L++++  AGE+Y SVM
Sbjct:  237 ELTEYVKKNKIAYIYFEENASQALANTLSKEAGVKTDVLNPLESLTEEDTKAGENYISVM  296

Query:  301 RRNLKVLKKTTDVAGKEVAPEE-DKTKTVETGYFKTKDVKDRKLTDYSGNWQSVYPLLQD  359
             +NLK LK+TTD  G  + PE+ + TKTV+ GYF+    VKDR L+DY+GNWQSVYP L+D
Sbjct:  297 EKNLKALKQTTDQEGPAIEPEKAEDTKTVQNGYFEDAAVKDRTLSDYAGNWQSVYPFLED  356

Query:  360 GTLDPVWDYKAKSKKDMTAAEYKKYYTAGYKTDVESIKIDGKKHQMTFVRNGKSQTFTYK  419
            GT D V+DYKAK    MT AEYK YYT GY+TDV  I I    + M FV+ G+S+ +TYK
Sbjct:  357 GTFDQVFDYKAKLTGKMTQAEYKAYYTKGYQTDVTKINI--TDNTMEFVQGGQSKKYTYK  414

Query:  420 YAGYKILTY                                                    428
            Y G KILTY
Sbjct:  415 YVGKKILTY                                                    423
```

A related DNA sequence was identified in *S. pyogenes* <SEQ ID 5547> which encodes the amino acid sequence <SEQ ID 5548>. Analysis of this protein sequence reveals the following:

```
Possible site: 17
>>> Seems to have a cleavable N-term signal seq.

----- Final Results -----
  bacterial outside  --- Certainty = 0.3000 (Affirmative) <succ>
 bacterial membrane  --- Certainty = 0.0000 (Not Clear)   <succ>
bacterial cytoplasm  --- Certainty = 0.0000 (Not Clear)   <succ>
```

The protein has homology with the following sequences in the databases:

```
>GP:CAA96185 GB:Z71552 AdcA protein [Streptococcus pneumoniae]
Identities = 259/438 (59%), Positives = 326/438 (74%), Gaps = 16/438 (3%)

Query:   1   MKKKILLMMSLISVFFAWQLTQAKQVLAEGKVKVVTTFYPVYEFTKGVIGNDGDVFMLMK    60
             MKK  LL+ SL ++F    +  + Q A+GK+ +VTTFYPVYEFTK V G+    +V +L+
Sbjct:   1   MKKISLLLASLCALFL---VACSNQKQADGKLNIVTTFYPVYEFTKQVAGDTANVELLIG    57

Query:  61   AGTEPHDFEPSTKDIKKIQDADAFVYMDDNMETWVSDVKKSLTSKKVTIVKGTGNMLLVA   120
             AGTEPH++EPS K + KIQDAD FVY ++NMETWV +  +L  KKV +K TG+MLL+
Sbjct:  58   AGTEPHEYEPSAKAVAKIQDADTFVYENENMETWVPKLLDTLDKKKVKTIKATGDMLLLP   117

Query: 121   GAGHDHPHEDADKKHEHNKHSEEGHNHAFDPHVWLSPYRSITVVENIRDSLSKAYPEKAE   180
             G           E+ +  H+H    EEGH+H FDPHVWLSP R+I +VE+IRD+LS   YP+K E
Sbjct: 118   GG------EEEEGDHDHG---EEGHHHEFDPHVWLSPVRAIKLVEHIRDTLSADYPDKKE   168

Query: 181   NFKANAATYIEKLKELDKDYTAALSDAKQKSFVTQHAAFGYMALDYGLNQISINGVTPDA   240
              F+ NAA YIEKL+ LDK Y   LS AK+KSFVTQHAAF Y+ALDYGL Q+++ G++PDA
Sbjct: 169   TFEKNAAAYIEKLQSLDKAYAEGLSQAKEKSFVTQHAAFNYLALDYGLKQVAISGLSPDA   228

Query: 241   EPSAKRIATLSKYVKKYGIKYIYFEENASSKVAKTLAKEAGVKAAVLSPLEGLTEKEMKA   300
             EPSA R+A L++YVKK   I  YIYFEENAS  +A TL+KEAGVK  VL+PLE LTE++ KA
Sbjct: 229   EPSAARLAELTEYVKKNIAYIYFEENASQALANTLSKEAGVKTDVLNPLESLTEEDTKA   288

Query: 301   GQDYFTVMRKNLETLRLTTDVAGKEILPEK-DTTKTVYNGYFKDKEVKDRQLSDWSGSWQ   359
             G++Y +VM KNL+ L+ TTD  G I PEK + TKTV NGYF+D VKDR LSD++G+WQ
Sbjct: 289   GENYISVMEKNLKALKQTTDQEGPAIEPEKAEDTKTVQNGYFEDAAVKDRTLSDYAGNWQ   348

Query: 360   SVYPYLQDGTLDQVWDYKAKKSKGKMTAAEYKDYYTTGYKTDVEQIKINGKKKTMTFVRN   419
             SVYP+L+DGT DQV+DYKAK + GKMT AEYK YYT GY+TDV    KIN     TM FV+
Sbjct: 349   SVYPFLEDGTFDQVFDYKAKLT-GKMTQAEYKAYYTKGYQTDV--TKINITDNTMEFVQG   405

Query: 420   GEKKTFTYTYAGKEILTY                                            437
             G+ K +TY Y GK+ILTY
Sbjct: 406   GQSKKYTYKYVGKKILTY                                            423
```

An alignment of the GAS and GBS proteins is shown below.

```
Identities = 353/515 (68%), Positives = 422/515 (81%), Gaps = 9/515 (1%)

Query:   1   MRKKFLLLMSFVAMFAAWQLVQVKQVWADSKLKVVTTFYPVYEFTKNVVGDKADVSMLIK    60
             M+KK LL+MS +++F AWQL Q KQV A+ K+KVVTTFYPVYEFTK V+G+   DV ML+K
Sbjct:   1   MKKKILLMMSLISVFFAWQLTQAKQVLAEGKVKVVTTFYPVYEFTKGVIGNDGDVFMLMK    60

Query:  61   AGTEPHDFEPSTKNIAAIQDSNAFVYMDDNMETWAPKVAKSVKSKKVTTIKGTGDMLLTK   120
             AGTEPHDFEPSTK+I   IQD++AFVYMDDNMETW  V KS+ SKKVT +KGTG+MLL
Sbjct:  61   AGTEPHDFEPSTKDIKKIQDADAFVYMDDNMETWVSDVKKSLTSKKVTIVKGTGNMLLVA   120

Query: 121   GV--------EEEGEEHEGHGHEGHHHELDPHVWLSPERAISVVENIRNKFVKAYPKDAA   172
             G          ++  EH  H  EGH+H  DPHVWLSP R+I+VVENIR+   KAYP+ A
Sbjct: 121   GAGHDHPHEDADKKHEHNKHSEEGHNHAFDPHVWLSPYRSITVVENIRDSLSKAYPEKAE   180

Query: 173   SFNKNADAYIAKLKELDKEYKNGLSNAKQKSFVTQHAAFGYMALDYGLNQVPIAGLTPDA   232
             +F  NA  YI KLKELDK+Y   LS+AKQKSFVTQHAAFGYMALDYGLNQ+  I G+TPDA
Sbjct: 181   NFKANAATYIEKLKELDKDYTAALSDAKQKSFVTQHAAFGYMALDYGLNQISINGVTPDA   240

Query: 233   EPSSKRLGELAKYIKKYNINYIYFEENASNKVAKTLADEVGVKTAVLSPLEGLSKKEMAA   292
             EPS+KR+  L+KY+KKY I YIYFEENAS+KVAKTLA E GVK AVLSPLEGL++KEM A
Sbjct: 241   EPSAKRIATLSKYVKKYGIKYIYFEENASSKVAKTLAKEAGVKAAVLSPLEGLTEKEMKA   300

Query: 293   GEDYFSVMRRNLKVLKKTTDVAGKEVAPEEDKTKTVETGYFKTKDVKDRKLTDYSGNWQS   352
             G+DYF+VMR NL+ L+ TTDVAGKE+ PE+D TKTV  GYFK K+VKDR L+D+SG+WQS
Sbjct: 301   GQDYFTVMRKNLETLRLTTDVAGKEILPEKDTTKTVYNGYFKDKEVKDRQLSDWSGSWQS   360

Query: 353   VYPLLQDGTLDPVWDYKA-KSKKDMTAAEYKKYYTAGYKTDVESIKIDGKKHQMTFVRNG   411
             VYP LQDGTLD VWDYKA KSK  MTAAEYK YYT GYKTDVE IKI+GKK  MTFVRNG
Sbjct: 361   VYPYLQDGTLDQVWDYKAKKSKGKMTAAEYKDYYTTGYKTDVEQIKINGKKKTMTFVRNG   420

Query: 412   KSQTFTYKYAGYKILTYKKGNRGVRYLFEAKEKDAGQFKYIQFSDHGIKPNKAEHFHIFW   471
             +++TFTY YAG +ILTY KGNRGVR++FEAKE DAG+FKY+QFSDH I P KA+HFH++W
Sbjct: 421   EKKTFTYTYAGKEILTYPKGNRGVRFMFEAKEADAGEFKYVQFSDHAIAPEKAKHFHLYW   480

Query: 472   GSESQEKLFEEMENWPTYFPAKMSGREVAQDLMSH                           506
             G +SQEKL +E+E+WPTY+   +SGRE AQ++ +H
Sbjct: 481   GGDSQEKLHKELEHWPTYYGSDLSGREIAQEINAH                           515
```

Based on this analysis, it was predicted that these proteins and their epitopes could be useful antigens for vaccines or diagnostics.

A related GBS gene <SEQ ID 8899> and protein <SEQ ID 8900> were also identified. Analysis of this protein sequence reveals the following:

```
Lipop:          Possible site: -1              Crend: 3
SRCFLG: 0
McG:            Length of UR: 19
                Peak Value of UR: 2.79
                Net Charge of CR: 3
McG:            Discrim Score: 9.08
GvH:            Signal Score (-7.5): 2.59
Possible site: 15
>>> Seems to have a cleavable N-term signal seq.
Amino Acid Composition: calculated from 16
ALOM program count: 0 value: 7.69 threshold: 0.0
PERIPHERAL         Likelihood = 7.69              264
modified ALOM score: -2.04

*** Reasoning Step: 3

Rule gpo1

----- Final Results -----
  bacterial outside  --- Certainty = 0.3000 (Affirmative)  <succ>
 bacterial membrane  --- Certainty = 0.0000 (Not Clear)    <succ>
bacterial cytoplasm  --- Certainty = 0.0000 (Not Clear)    <succ>
```

The protein has homology with the following sequences in the databases:

```
3758895|emb|CAA96185.1||Z71552 AdcA protein {Streptococcus pneumoniae}
>PIR|T46756|T46756 Zn-binding lipoprotein adcA [imported] -
Streptococcus pneumoniae (fragment)
Score = 508 bits (1294), Expect = e-143
Identities = 257/429 (59%), Positives = 312/429 (71%), Gaps = 7/429 (1%)

Query:   1  MRKKFLLLMSFVAMFAAWQLVQVKQVWADSKLKVVTTFYPVYEFTKNVVGDKADVSMLIK   60
            M+K  LLL S  A+F    +    Q   AD KL +VTTFYPVYEFTK V GD A+V +LI
Sbjct:   1  MKKISLLLASLCALFL---VACSNQKQADGKLNIVTTFYPVYEFTKQVAGDTANVELLIG  57

Query:  61  AGTEPHDFEPSTKNIAAIQDSNAFVYMDDNMETWAPKVAKSVKSKKVTTIKGTGDMLLTK  120
            AGTEPH++EPS K +A IQD++ FVY ++NMETW PK+  ++  KKV TIK TGDMLL
Sbjct:  58  AGTEPHEYEPSAKAVAKIQDADTFVYENENMETWVPKLLDTLDKKKVKTIKATGDMLLLP 117

Query: 121  GVEEEGEEHEGHGHEGHHHELDPHVWLSPERAISVVENIRNKFVKAYPKDAASFNKNADA 180
            G EEE  +H+ HG EGHHHE DPHVWLSP RAI +VE+IR+    YP   +F  KNA A
Sbjct: 118  GGEEEGDHD-HGEEGHHHEFDPHVWLSPVRAIKLVEHIRDTLSADYPDKKETFEKNAAA  176

Query: 181  YIAKLKELDKEYKNGLSNAKQKSFVTQHAAFGYMALDYGLNQVPIAGLTPDAEPSSKRLG 240
            YI KL+ LDK Y  GLS AK+KSFVTQHAAF Y+ALDYGL QV I+GL+PDAEPS+ RL
Sbjct: 177  YIEKLQSLDKAYAEGLSQAKEKSFVTQHAAFNYLALDYGLKQVAISGLSPDAEPSAARLA 236

Query: 241  ELAKYIKKYNINYIYFEENASNKVAKTLADEVGVKTAVLSPLEGLSKKEMAAGEDYFSVM 300
            EL +Y+KK  I YIYFEENAS  +A TL+ E GVKT VL+PLE L++++  AGE+Y SVM
Sbjct: 237  ELTEYVKKNKIAYIYFEENASQALANTLSKEAGVKTDVLNPLESLTEEDTKAGENYISVM 296

Query: 301  RRNLKVLKKTTDVAGKEVAPEE-DKTKTVETGYFKTKDVKDRKLTDYSGNWQSVYPLLQD 359
             +NLK LK+TTD  G  + PE+ + TKTV+ GYF+   VKDR L+DY+GNWQSVYP L+D
Sbjct: 297  EKNLKALKQTTDQEGPAIEPEKAEDTKTVQNGYFEDAAVKDRTLSDYAGNWQSVYPFLED 356

Query: 360  GTLDPVWDYKAKSKKDMTAAEYKKYYTAGYKTDVESIKIDGKXHQMTFVRNGKSQTFTYK 419
            GT D V+DYKAK   MT AEYK YYT GY+TDV  I I    + M FV+ G+S+ +TYK
Sbjct: 357  GTFDQVFDYKAKLTGKMTQAEYKAYYTKGYQTDVTKINI--TDNTMEFVQGGQSKKYTYK 414

Query: 420  YAGYKILTY                                                     428
            Y G KILTY
Sbjct: 415  YVGKKILTY                                                     423
```

SEQ ID 8900 (GBS325) was expressed in *E. coli* as a His-fusion product. SDS-PAGE analysis of total cell extract is shown in FIG. 65 (lane 3; MW 58 kDa).

The GBS325-His fusion product was purified (FIG. 210, lane 7) and used to immunise mice. The resulting antiserum was used for Western blot (FIG. 257A) and FACS (FIG. 257B). These tests confirm that the protein is immunoaccessible on GBS bacteria.

EXAMPLE 1784

A DNA sequence (GBSx1891) was identified in *S. agalactiae* <SEQ ID 5549> which encodes the amino acid sequence <SEQ ID 5550>. This protein is predicted to be ribosomal protein L31 (rl31). Analysis of this protein sequence reveals the following:

```
Possible site: 61
>>> Seems to have no N-terminal signal sequence

----- Final Results -----
bacterial cytoplasm --- Certainty = 0.1948 (Affirmative) <succ>
 bacterial membrane --- Certainty = 0.0000 (Not Clear)   <succ>
  bacterial outside --- Certainty = 0.0000 (Not Clear)   <succ>
```

A related GBS nucleic acid sequence <SEQ ID 9637> which encodes amino acid sequence <SEQ ID 9638> was also identified.

The protein has homology with the following sequences in the GENPEPT database.

```
>GP:AAF80389 GB:AF160251 ribosomal protein L31 [Listeria innocua]
Identities = 61/81 (75%), Positives = 71/81 (87%), Gaps = 1/81 (1%)

Query:  9 MKKDIHPDYRPVVFLDTTTGYKFLSGSTKSTKETVEFE-GETYPLIRVEISSDSHPFYTG  67
          MK  IHP+YRPVVF+DT+T +KFLSGSTKS+ ET+++E G  YPL+RVEISSDSHPFYTG
Sbjct:  1 MKTGIHPEYRPVVFVDTSTDFKFLSGSTKSSSETIKWEDGNEYPLLRVEISSDSHPFYTG  60

Query: 68 RQKFTQADGRVDRFNKKYGLK                                        88
          +QK   ADGRVDRFNKKYGLK
Sbjct: 61 KQKHATADGRVDRFNKKYGLK                                        81
```

A related DNA sequence was identified in *S. pyogenes* <SEQ ID 5551> which encodes the amino acid sequence <SEQ ID 5552>. Analysis of this protein sequence reveals the following:

```
Possible site: 53
>>> Seems to have no N-terminal signal sequence

----- Final Results -----
bacterial cytoplasm --- Certainty = 0.1910 (Affirmative) <succ>
 bacterial membrane --- Certainty = 0.0000 (Not Clear)   <succ>
  bacterial outside --- Certainty = 0.0000 (Not Clear)   <succ>
```

An alignment of the GAS and GBS proteins is shown below.

```
Identities = 81/86 (94%), Positives = 86/86 (99%)

Query:  9 MKKDIHPDYRPVVFLDTTTGYKFLSGSTKSTKETVEFEGETYPLIRVEISSDSHPFYTGR  68
          M+KDIHPDYRPVVFLDTTTGY+FLSGSTK++KETVEFEGETYPLIRVEISSDSHPFYTGR
Sbjct:  1 MRKDIHPDYPRVVFLDTTTGYQFLSGSTKASKETVEFEGETYPLIRVEISSDSHPFYTGR  60

Query: 69 QKFTQADGRVDRFNKKYGLKDANAAQ                                   94
          QKFTQADGRVDRFNKKYGLKDANAA+
Sbjct: 61 QKFTQADGRVDRFNKKYGLKDANAAK                                   86
```

EXAMPLE 1785

A DNA sequence (GBSx1892) was identified in *S. agalactiae* <SEQ ID 5553> which encodes the amino acid sequence <SEQ ID 5554>. This protein is predicted to be aspartate aminotransferase (aspC). Analysis of this protein sequence reveals the following:

```
Possible site: 61
>>> Seems to have no N-terminal signal sequence

----- Final Results -----
              bacterial cytoplasm --- Certainty = 0.1740(Affirmative) < succ>
               bacterial membrane --- Certainty = 0.0000(Not Clear)   < succ>
                 bacterial outside --- Certainty = 0.0000(Not Clear)   < succ>
```

A related GBS nucleic acid sequence <SEQ ID 9421> which encodes amino acid sequence <SEQ ID 9422> was also identified.

The protein has homology with the following sequences in the GENPEPT database.

```
>GP: AAC21948 GB: U32714 aminotransferase [Haemophilus influenzae Rd]
Identities = 200/323 (61%), Positives = 264/323 (80%), Gaps = 1/323 (0%)

Query:   1 MQYYQLQNI-HVDMDDIYIVNGVSEGISMSMQALLDNDDEVLVPMPDYPLWTACVSLAGG   59
           +QYYQ + I   ++D+YI NGVSE I+M+MQALL++ DEVLVPMPDYPLWTA V+L+GG
Sbjct:  82 VQYYQSKGILGATVNDVYIGNGVSELITMAMQALLNDGDEVLVPMPDYPLWTAAVTLSGG  141

Query:  60 NAVHYICDEEANWYPDIDDIKSKITSKTKAIVLINPNNPTGAVYPREILQEIVDIARQND  119
           AVHY+CDE+ANW+P IDDIK+K+ +KTKAIV+INPNNPTGAVY +E+LQEIV+IARQN+
Sbjct: 142 KAVHYLCDEDANWFPTIDDIKAKVNAKTKAIVIINPNNPTGAVYSKELLQEIVEIARQNN  201

Query: 120 LIIFSDEVYDRLVMDGMEHIPIASIAEDIFTVTLSGLSKSHRICGFRVGWMVLSGPRQHV  179
           LIIF+DE+YD+++ DG  H   IA++A D+ TVTL+GLSK++R+ GFR GWM+L+GP+ +
Sbjct: 202 LIIFADEIYDKILYDGAVHHHIAALAPDLLTVTLNGLSKAYRVAGFRQGWMILNGPKHNA  261

Query: 180 KGYIEGLNMLANMRLCSNVLAQQVIQTSLGGQQSIDSMLLPGGRIYEQRNYIHKAINEIP  239
           KGYIEGL+MLA+MRLC+NV  Q   IQT+LGG QSI+   +LPGGR+ EQRN  +   I +IP
Sbjct: 262 KGYIEGLDMLASMRLCANVPMQHAIQTALGGYQSINEFILPGGRLLEQRNKAYDLITQIP  321

Query: 240 GLSAVKPNAGLYLFPKIDTDMYRIDNDEEFVLNFLKQEKVLLTHGRGFNMNTADHFRIVY  299
           G++ VKP  +Y+FPKID  + I +DE+ VL+ L+QEKVLL HG+GFN ++ DHFRIV
Sbjct: 322 GITCVKPMGAMYMFPKIDVKKFNIHSDEKMVLDLLRQEKVLLVHGKGFNWHSPDHFRIVT  381

Query: 300 LPRVDELTELQEKMARFLSQYKR                                      322
           LP V++L E  K+ARFLS Y++
Sbjct: 382 LPYVNQLEEAITKLARFLSDYRQ                                      404
```

There is also homology to SEQ ID 3662.

Based on this analysis, it was predicted that this protein and its epitopes, could be useful antigens for vaccines or diagnostics.

EXAMPLE 1786

A DNA sequence (GBSx1893) was identified in *S. agalactiae* <SEQ ID 5555> which encodes the amino acid sequence <SEQ ID 5556>. Analysis of this protein sequence reveals the following:

```
Possible site: 52
>>> Seems to have no N-terminal signal sequence
    INTEGRAL      Likelihood = -2.02    Transmembrane   164-180 (163-181)

----- Final Results -----
               bacterial membrane --- Certainty = 0.1808(Affirmative) < succ>
                 bacterial outside --- Certainty = 0.0000(Not Clear)   < succ>
              bacterial cytoplasm --- Certainty = 0.0000(Not Clear)   < succ>
```

A related GBS nucleic acid sequence <SEQ ID 10099> which encodes amino acid sequence <SEQ ID 10100> was also identified.

The protein has homology with the following sequences in the GENPEPT database.

```
>GP: BAB06181 GB: AP001515 transcriptional pleiotropic repressor
[Bacillus halodurans]
Identities = 129/257 (50%), Positives = 181/257 (70%), Gaps = 3/257 (1%)

Query:   23 NLLEKTRKITSILQRSVDSLDAELPYNTMAAQLADIIDCNACIINGGGNLLGYAMKYKTN    82
             +LL + RKI  +LQ+S       + +  MA  L D+I  N  +++  G LLG+A+K +
Sbjct:    2 SLLSRMRKINDMLQKSGVQ---HVNFREMAETLRDVISANIFVVSRRGKLLGFAIKQEIE    58

Query:   83 TDRVEEFFETKQFPDYYVKSASRVYDTEANLSVDNDLSIFPVETKENFQDGITTIAPIYG   142
             +R+++  E +QFP+ Y      +V +T ANL ++++ + FPVE KE F+ G+TTI PI G
Sbjct:   59 NERMKKMLEDRQFPEEYTTGLFKVEETSANLDINSEFTAFPVENKELFKTGLTTIVPISG   118

Query:  143 GGMRLGTFIIWRNDKEFSDDDLILVEIASTVVGIQLLNLQTENLEENIRKQTAVTMAINT   202
            GG RLGT I+ R +   F+DDDLIL E  +TVVG+++L+ +T+ +EE  R +  V MAI++
Sbjct:  119 GGQRLGTLILARLNDSFNDDDLILAEYGATVVGMEILHEKTQEIEEEARSKAVVQMAISS   178

Query:  203 LSYSEMKAVAAILGELDGLEGRLTASVIADRIGITRSVIVNALRKLESAGIIESRSLGMK   262
            LSYSE++AV   I  ELDG EG L AS IADR+GITRSVIVNALRKLESAG+IESRSLGMK
Sbjct:  179 LSYSELEAVEHIFEELDGKEGLLVASKIADRVGITRSVIVNALRKLESAGVIESRSLGMK   238

Query:  263 GTYLKVINEGIFDKLKE                                            279
            GTY+KV+N+    +L++
Sbjct:  239 GTYIKVLNDKFLVELEK                                            255
```

A related DNA sequence was identified in *S. pyogenes* <SEQ ID 5557> which encodes the amino acid sequence <SEQ ID 5558>. Analysis of this protein sequence reveals the following:

```
Possible site: 38
>>> Seems to have no N-terminal signal sequence
    INTEGRAL      Likelihood = -0.64      Transmembrane    144-160 (143-161)

----- Final Results -----
               bacterial membrane --- Certainty = 0.1256(Affirmative) < succ>
               bacterial outside  --- Certainty = 0.0000(Not Clear)  < succ>
              bacterial cytoplasm --- Certainty = 0.0000(Not Clear)  < succ>
```

The protein has homology with the following sequences in the databases:

```
>GP: CAB13490 GB: Z99112 transcriptional regulator [Bacillus subtilis]
Identities = 131/255 (51%), Positives = 179/255 (69%), Gaps = 3/255 (1%)

Query:    4 LLEKTRKITSILQRSVDSLETELPYNTMASRLADIIDCNACIINGGGTLLGYAMKYKTNT    63
            LL+KTR I S+LQ +       + +  MA  L D+ID N  +++  G LLGY++   +
Sbjct:    3 LLQKTRIINSMLQAAAGK---PVNFKEMAETLRDVIDSNIFVVSRRGKLLGYSINQQIEN    59

Query:   64 DRVEEFFEAKQFPDTYVKAASRVYDTEANLSVENELTIFPVESKDTYPGGLTTIAPIYGG   123
            DR+++  E +QFP+ Y K     V +T +NL + +E T FPVE++D+  GLTTI PI GG
Sbjct:   60 DRMKKMLEDRQFPEEYTKNLFNVPETSSNLDINSEYTAFPVENRDLFQAGLTTIVPIIGG   119

Query:  124 GMRLGSLIIWRNDNEFSDDDLILVEISSTVVGIQLLNLQTENLEDTIRKQTAVNMAINTL   183
            G RLG+LI+ R  ++F+DDDLIL E  +TVVG+++L  + E +E+  R +  V MAI++L
Sbjct:  120 GERLGTLILSRLQDQFNDDDLILAEYGATVVGMEILREKAEEIEEEARSKAVVQMAISSL   179

Query:  184 SYSEMKAVAAILGELDGNEGRLTASVIADRIGITRSVIVNALRKLESAGIIESRSLGMKG   243
            SYSE++A+   I  ELDGNEG L AS IADR+GITRSVIVNALRKLESAG+IESRSLGMKG
Sbjct:  180 SYSELEAIEHIFEELDGNEGLLVASKIADRVGITRSVIVNALRKLESAGVIESRSLGMKG   239

Query:  244 TYLKVINEGIFAKLK                                              258
            TY+KV+N    +L+
Sbjct:  240 TYIKVLNNKFLIELE                                              254
```

An alignment of the GAS and GBS proteins is shown below.

```
Identities = 232/260 (89%), Positives = 247/260 (94%)

Query:   21 MPNLLEKTRKITSILQRSVDSLDAELPYNTMAAQLADIIDCNACIINGGGNLLGYAMKYK   80
            MPNLLEKTRKITSILQRSVDSL+ ELPYNTMA++LADIIDCNACIINGGG LLGYAMKYK
Sbjct:    1 MPNLLEKTRKITSILQRSVDSLETELPYNTMASRLADIIDCNACIINGGGTLLGYAMKYK   60

Query:   81 TNTDRVEEFFETKQFPDYYVKSASRVYDTEANLSVDNDLSIFPVETKENFQDGITTIAPI  140
            TNTDRVEEFFE KQFPD YVK+ASRVYDTEANLSV+N+L+IFPVE+K+ + G+TTIAPI
Sbjct:   61 TNTDRVEEFFEAKQFPDTYVKAASRVYDTEANLSVENELTIFPVESKDTYPGGLTTIAPI  120

Query:  141 YGGGMRLGTFIIWRNDKEFSDDDLILVEIASTVVGIQLLNLQTENLEENIRKQTAVTMAI  200
            YGGGMRLG+ IIWRND EFSDDDLILVEI+STVVGIQLLNLQTENLE+ IRKQTAV MAI
Sbjct:  121 YGGGMRLGSLIIWRNDNEFSDDDLILVEISSTVVGIQLLNLQTENLEDTIRKQTAVNMAI  180

Query:  201 NTLSYSEMKAVAAILGELDGLEGRLTASVIADRIGITRSVIVNALRKLESAGIIESRSLG  260
            NTLSYSEMKAVAAILGELDG EGRLTASVIADRIGITRSVIVNALRKLESAGIIESRSLG
Sbjct:  181 NTLSYSEMKAVAAILGELDGNEGRLTASVIADRIGITRSVIVNALRKLESAGIIESRSLG  240

Query:  261 MKGTYLKVINEGIFDKLKEY                                         280
            MKGTYLKVINEGIF KLKE+
Sbjct:  241 MKGTYLKVINEGIFAKLKEF                                         260
```

A related GBS gene <SEQ ID 8901> and protein <SEQ ID 8902> were also identified. Analysis of this protein sequence reveals the following:

```
Lipop: Possible site: -1 Crend: 9
McG: Discrim Score: -6.84
GvH: Signal Score (-7.5): -5.37
     Possible site: 13
>>> Seems to have no N-terminal signal sequence
ALOM program count: 1 value: -2.02 threshold: 0.0
    INTEGRAL      Likelihood = -2.02    Transmembrane    114-130 (113-131)
    PERIPHERAL    Likelihood = 3.61     179
modified ALOM score: 0.90
*** Reasoning Step: 3

----- Final Results -----
             bacterial membrane  --- Certainty = 0.1808(Affirmative) < succ>
             bacterial outside   --- Certainty = 0.0000(Not Clear)   < succ>
             bacterial cytoplasm --- Certainty = 0.0000(Not Clear)   < succ>
```

The protein has homology with the following sequences in the databases:

```
ORF02556(223-987 of 1293)
EGAD|13275|BS1617(4-255 of 259) cody protein {Bacillus subtilis} OMNI|NT01BS1895
cody protein (vegetative protein 286b) (veg286b) GP|535351|gb|AAB03372.1||U13634 CodY
{Bacillus subtilis} GP|2633989|emb|CAB13490.1||Z99112 transcriptional regulator
{Bacillus subtilis} PIR|S61496|S61496 transcription pleiotropic repressor codY-
Bacillus subtilis
% Match = 29.1
% Identity = 50.6    % Similarity = 71.5
Matches = 128   Mismatches = 71   Conservative Sub.s = 53
     177       207       237       267       297       327       357       387
DCKS*NALI*L*RKTYKG*RKCRIYLEKTRKITSILQRSVDSLDAELPYNTMAAQLADIIDCNACIINGGGNLLGYAMKY
                      |:|||   |   |:||   :           :   :   ||   |:||       |   |||::
                      MALLQKTRIINSMLQAAAGK---PVNFKEMAETLRDVIDSNIFVVSRRGKLLGYSINQ
                               10        20           30        40        50
     417       447       477       507       537       567       597       627
KTNTDRVEEFFETKQFPDYYVKSASRVYDTEANLSVDNDLSIFPVETKENFQDGITTIAPIYGGGMRLGTFIIWRNDKEF
:   ||:::  :| :|||  |  |:     |  :|  :||  ::::  :  ||||   ::  || |:|||  ||  |||||::| :     :|
QIENDRMKKMLEDRQFPEEYTKNLFNVPETSSNLDINSEYTAFPVENRDLFQAGLTTIVPIIGGGERLGTLILSRLQDQF
                   70        80        90       100       110       120       130
     657       687       717       747       777       807       837       867
SDDDLILVEIASTVVGIQLLNLQTENLEENIRKQTAVTMAINTLSYSEMKAVAAILGELDGLEGRLTASVIADRIGITRS
:|||||| |  :||||:::|    :   |:||      |   |||::|||||::|:    |:   |||| ||   ||   ||||:|||||
NDDDLILAEYGATVVGMEILREKAEEIEEEARSKAVVQMAISSLSYELEAIEHIFEELDGNEGLLVASKIADRVGITRS
                  150       160       170       180       190       200       210
     897       927       957       987      1017      1047      1077      1107
VIVNALRKLESAGIIESRSLGMKGTYLKVINEGIFDKLKEYN*S*HGTGSSFQFLFWNQEEIRRKMTXXN*LXXLFS*RL
||||||||||||||:|||||||||||||:||:|    :  :|:
VIVNALRKLESAGVIESRSLGMKGTYIKVLNNKFLIELENLKSH
                  230       240       250
```

SEQ ID 8902 (GBS431) was expressed in *E. coli* as a GST-fusion product. SDS-PAGE analysis of total cell extract is shown in FIG. 173 (lane 7; MW 54 kDa). It was also expressed in *E. coli* as a His-fusion product. SDS-PAGE analysis of total cell extract is shown in FIG. 77 (lane 6; MW 29 kDa).

GBS431-GST was purified as shown in FIG. 223, lane 8.

Based on this analysis, it was predicted that these proteins and their epitopes could be useful antigens for vaccines or diagnostics.

EXAMPLE 1787

A DNA sequence (GBSx1894) was identified in *S. agalactiae* <SEQ ID 5559> which encodes the amino acid sequence <SEQ ID 5560>. This protein is predicted to be isochorismatase. Analysis of this protein sequence reveals the following:

```
Possible site: 35
>>> Seems to have no N-terminal signal sequence
     INTEGRAL    Likelihood = -2.81    Transmembrane    126-142 (125-142)

----- Final Results -----
              bacterial membrane --- Certainty = 0.2126(Affirmative) < succ>
                bacterial outside --- Certainty = 0.0000(Not Clear)   < succ>
             bacterial cytoplasm --- Certainty = 0.0000(Not Clear)   < succ>
```

The protein has homology with the following sequences in the GENPEPT database.

```
>GP: CAB15164 GB: Z99120 similar to pyrazinamidase/nicotinamidase
[Bacillus subtilis]
Identities = 99/181 (54%), Positives = 132/181 (72%)

Query:   1 MTKALISIDYTYDFVADDGKLTAGKPAQSIASAIADVTEKAYRSGDYIFFAIDNHDIGDV   60
           M KALI IDYT DFVA DGKLT G+P + I  AI ++T++    +GDY+  A+D+HD GD
Sbjct:   1 MKKALICIDYTNDFVASDGKLTCGEPGRMIEEAIVNLTKEFITNGDYVVLAVDSHDEGDQ   60

Query:  61 FHPESNLFPEHNIKGTSGRNLYGPLGTLYETIKEDSRVFWIDKRHYSAFSGTDLDIRLRE  120
           +HPE+ LFP HNIKGT G++LYG L  LY+ + +  V++++K  YSAF+GTDL+++LRE
Sbjct:  61 YHPETRLFPPHNIKGTEGKDLYGKLLPLYQKHEHEPNVYYMEKTRYSAFAGTDLELKLRE  120

Query: 121 RRVDTLILTGVLTDICVLHTAIDAYNLGYKIEVPAAAVASLNDSNHQWALNHFKTVLGATI  181
           R++  L L GV TDICVLHTA+DAYN G++I V   AVAS N   H WAL+HF   +GA +
Sbjct: 121 RQIGELHLAGVCTDICVLHTAVDAYNKGFRIVVHKQAVASFNQEGHAWALSHFANSIGAQV  181
```

A related DNA sequence was identified in *S. pyogenes* <SEQ ID 5561> which encodes the amino acid sequence <SEQ ID 5562>. Analysis of this protein sequence reveals the following:

```
Possible site: 31
>>> Seems to have no N-terminal signal sequence
     INTEGRAL    Likelihood = -2.60    Transmembrane    126-142 (126-142)

----- Final Results -----
              bacterial membrane --- Certainty = 0.2041(Affirmative) < succ>
                bacterial outside --- Certainty = 0.0000(Not Clear)   < succ>
             bacterial cytoplasm --- Certainty = 0.0000(Not Clear)   < succ>
```

The protein has homology with the following sequences in the databases:

```
>GP: CAB15164 GB: Z99120 similar to pyrazinamidase/nicotinamidase
[Bacillus subtilis]
Identities = 90/179 (50%), Positives = 127/179 (70%)

Query:   3 RALISIDYTNDFVADDGKLSAGKSAQAIATKIAEVTKTAFDQGDYIFFAIDCHDQNDSWH   62
           +ALI IDYTNDFVA DGKL+ G+ + I  I +TK    GDY+  A+D HD+ D +H
Sbjct:   3 KALICIDYTNDFVASDGKLTCGEPGRMIEEAIVNLTKEFITNGDYVVLAVDSHDEGDQYH   62
```

-continued

```
Query:  63 PESKLFAAHNIKGTTGRHLYGPLAEVYSYMKQHPRVFWIDKRYYSAFSGTDLDIRLRERG  122
           PE++LF  HNIKGT G+ LYG L  +Y   +  P V++++K  YSAF+GTDL+++LRER
Sbjct:  63 PETRLFPPHNIKGTEGKDLYGKLLPLYQKHEHEPNVYYMEKTRYSAFAGTDLELKLRERQ  122

Query: 123 ITQLVLTGVLSDICVLHTAIDAYHLGYQLEIVKSAVASLTKESYEWSLAHFEQVLGAKL   181
           I +L L GV +DICVLHTA+DAY+ G+++ + K AVAS  +E + W+L+HF    +GA++
Sbjct: 123 IGELHLAGVCTDICVLHTAVDAYNKGFRIVVHKQAVASFNQEGHAWALSHFANSIGAQV   181
```

An alignment of the GAS and GBS proteins is shown below.

```
Identities = 121/180 (67%), Positives = 150/180 (83%)

Query:   3 KALISIDYTYDFVADDGKLTAGKPAQSIASAIADVTEKAYRSGDYIFFAIDNHDIGDVFH   62
           +ALISIDYT DFVADDGKL+AGK AQ+IA+ IA+VT+ A+  GDYIFFAID HD  D +H
Sbjct:   3 RALISIDYTNDFVADDGKLSAGKSAQAIATKIAEVTKTAFDQGDYIFFAIDCHDQNDSWH   62

Query:  63 PESNLFPEHNIKGTSGRNLYGPLGTLYETIKEDSRVFWIDKRHYSAFSGTDLDIRLRERR  122
           PES LF  HNIKGT+GR+LYGPL  +Y  +K+  RVFWIDKR+YSAFSGTDLDIRLRER
Sbjct:  63 PESKLFAAHNIKGTTGRHLYGPLAEVYSYMKQHPRVFWIDKRYYSAFSGTDLDIRLRERG  122

Query: 123 VDTLILTGVLTDICVLHTAIDAYNLGYKIEVPAAAVASLNDSNHQWALNHFKTVLGATIL  182
           +   L+LTGVL+DICVLHTAIDAY+LGY++E+   +AVASL   +++W+L HF+ VLGA ++
Sbjct: 123 ITQLVLTGVLSDICVLHTAIDAYHLGYQLEIVKSAVASLTKESYEWSLAHFEQVLGAKLI  182
```

Based on this analysis, it was predicted that these proteins and their epitopes could be useful antigens for vaccines or diagnostics.

EXAMPLE 1788

A DNA sequence (GBSx1895) was identified in *S. agalactiae* <SEQ ID 5563> which encodes the amino acid sequence <SEQ ID 5564>. Analysis of this protein sequence reveals the following:

```
Possible site: 16
>>> Seems to have no N-terminal signal sequence

----- Final Results -----
         bacterial cytoplasm --- Certainty = 0.1539(Affirmative) < succ>
          bacterial membrane --- Certainty = 0.0000(Not Clear)   < succ>
           bacterial outside --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1789

A DNA sequence (GBSx1896) was identified in *S. agalactiae* <SEQ ID 5565> which encodes the amino acid sequence <SEQ ID 5566>. This protein is predicted to be 3-hydroxyacyl-CoA dehydrogenase (hbd-10). Analysis of this protein sequence reveals the following:

```
Possible site: 46
>>> Seems to have an uncleavable N-term signal seq
    INTEGRAL    Likelihood = -0.27    Transmembrane    3-19  (1-19)
    INTEGRAL    Likelihood = -0.11    Transmembrane    277-293 (277-294)

----- Final Results -----
          bacterial membrane --- Certainty = 0.1107(Affirmative) < succ>
           bacterial outside --- Certainty = 0.0000(Not Clear)   < succ>
         bacterial cytoplasm --- Certainty = 0.0000(Not Clear)   < succ>
```

The protein has homology with the following sequences in the GENPEPT database.

```
>GP: AAF12219 GB: AE001862 3-hydroxyacyl-CoA dehydrogenase, putative
[Deinococcus radiodurans]
Identities = 151/321 (47%), Positives = 196/321 (61%),
Gaps = 36/321 (11%)

Query:  56 NMTIKNLTVAGSGVLGSQIAFQAAYKGMSVTIYDINDEALNKGKERIKKLAKVYQSEIET   115
            +M+IK +TV GSGVLGSQIAFQ A+ G  V +YDIND A+ K +E + KL   YQ +++
Sbjct:  51 SMSIKTVTVCGSGVLGSQIAFQTAFHGFDVHLYDINDAAIAKARETLGKLQARYQQDLKV   110

Query: 116 AKEAYSDKAKSIKYNKNLLPSLDHIFLSKVADSLDLIADLPNQITFSKNLDQAVSDADLV   175
            +   D                              +I+F  ++ +AV    DLV
Sbjct: 111 DAQQTGDAFA------------------------------RISFFTDIAEAVKGVDLV   138

Query: 176 IEAVPETVSIKEDFYKQLAKVAPSKTIFATNSSTLVPSQFADITGRPDKFLAMHFANNIW   235
            IEA+PE + IK  FY QL +VA   TIFATNSSTL+PSQF + TGRP+KFLA+HFAN IW
Sbjct: 139 IEAIPENMDIKRKFYNQLGEVADPNTIFATNSSTLLPSQFMEETGRPEKFLALHFANEIW   198

Query: 236 QNNIVEIMGHKGTDDEVIKEALAFSKDIGMVPLHIHKEQPGYILNSILVPFLESALALYY   295
             + N  EIM    TDD V   + F+KDIGMV L ++KEQ GYILN++LVP L +AL L
Sbjct: 199 KFNTAEIMRTPRTDDAVFDTVVQFAKDIGMVALPMYKEQAGYILNTLLVPLLGAALELVV   258

Query: 296 DKVSDSETIDKTWKLGTGAPMGPLEILDIIGIDTAYNIMKNYSDTNSDPNSLHAHLAKML   355
            ++D +T+DKTW + TGAP GP  LD+IG+ T YNI  N +   ++P  S   A  AK +
Sbjct: 259 KGIADPQTVDKTWMIATGAPRGPFAFLDVIGLTTPYNI--NMASAETNPGS--AAAAKYI   314

Query: 356 KEEFIDKGRTGKAAGHGFYDY                                         376
            KE +IDKG+ G A G GFY Y
Sbjct: 315 KENYIDKGKLGTATGEGFYKY                                         335
```

No corresponding DNA sequence was identified in *S. pyogenes*.

Based on this analysis, it was predicted that this protein and its epitopes, could be useful antigens for vaccines or diagnostics.

A related GBS gene <SEQ ID 8903> and protein <SEQ ID 8904> were also identified. Analysis of this protein sequence reveals the following:

```
Lipop: Possible site: -1 Crend: 3
SRCFLG: 0
McG: Length of UR: 20
     Peak Value of UR: 1.55
     Net Charge of CR: 1
McG: Discrim Score: -0.60
GvH: Signal Score (-7.5): -3.93
     Possible site: 21
>>> Seems to have no N-terminal signal sequence
Amino Acid Composition: calculated from 1
ALOM program count: 1 value: -0.11 threshold: 0.0
    INTEGRAL      Likelihood = -0.11    Transmembrane   221-237 (221-238)
    PERIPHERAL    Likelihood = 4.61     6
modified ALOM score: 0.52
icm1 HYPID: 7 CFP: 0.104
*** Reasoning Step: 3

----- Final Results -----
              bacterial membrane  --- Certainty = 0.1044(Affirmative) < succ>
              bacterial outside   --- Certainty = 0.0000(Not Clear)   < succ>
              bacterial cytoplasm --- Certainty = 0.0000(Not Clear)   < succ>
```

The protein has homology with the following sequences in the databases:

```
37.5/60.5% over 278aa
Archaeoglobus fulgidus
EGAD|103851|3-hydroxyacyl-CoA dehydrogenase Insert characterized OMNI|AF2273
3-hydroxyacyl-CoA dehydrogenase (hbd-10) Insert characterized
GP|2648250|gb|AAB88983.1||AE000948 3-hydroxyacyl-CoA dehydrogenase (hbd-10)
Insert characterized PIR|A69534|A69534 3-hydroxyacyl-CoA dehydrogenase (hbd-10)
homolog-Insert characterized ORF01176(475-1431 of 1731)
EGAD|103851|AF2273(17-295 of 668) 3-hydroxyacyl-CoA dehydrogenase {Archaeglobus
fulgidus} OMNI|AF2273 3-hydroxyacyl-CoA dehydrogenase (hbd-10)
GP|2648250|gb|AAB88983.1||AE000948 3-hydroxyacyl-CoA dehydrogenase (hbd-10)
{Archaeoglobus fulgidus} PIR|A69534|A69534 3-hydroxyacyl-CoA dehydrogenase
(hbd-10) homolog-Archaeoglobus fulgidus
% Match = 14.8
% Identity = 37.5  % Similarity = 60.4
Matches = 106   Mismatches = 106   Conservative Sub.s = 65
       387       417       447       477       507       537       567       597
KKRYYFKNNHTIYLLLDISFVKLSSKTFSNISIGGCNMTIKNLTVAGSGVLGSQIAFQAAYKGMSVTIYDINDEALNKGK
               :         :           ||:|  |:|::|  ||    |  |:||:  ||   |:::|
                        MPRRVKQVINMDVRERIKTVAVLGAGLMGHGIAEVCAMAGYNVTMRDIKQEFVDRGM
                              10        20        30        40        50

624       651       681       711       741       771       801       831
ERIKK-LAKVYQS-EIETAKEAYSDKAKSIKYNKNLLPSLDHIFLSKVADSLDLIADLPNQITFSKNLDQAVSDADLVIE
   ||: |||:  |   :|::|:|    |                                 :|   : ::::|| ||||||
NMIKESLAKLEQKGKIKSAEEVLS--------------------------------------RIKPTVDLEEAVKDADLVIE
       70        80                                                  90       100

861       891       921       951       981      1011      1041      1071
AVPETVSIKEDFYKQLAKVAPSKTIFATNSSTLVPSQPADITGRPDKFLAMHFANNIWQNNIVEIMGHKGTDDEVIKEAL
|||| | ||:  ::::  |:|    || :|:|:  :   :|| ||:|| :|||   |              :||::   :  | |||:   :
AVPEVVEIKKQVWEEVDKLAKPDCIFTSNTSTMRITMLADFTSRPEKFAGLHFFNPPVLMRLVEVIRGEKTSDEVMDLLV
       120       130       140       150       160       170       180

1101      1131      1161      1191      1221      1251      1281      1311
AFSKDIGMVPLHIHKEQPGYILNSILVPFLESALALYYDKVSDSETIDKTWKLGTGAPMGPLEILDIIGIDTAYNIMKNY
 |  ||  ||:  :  |:  ||||:|:   :    |:         |||||:|||  ||||:|:||   |   |   |:|
EFVKSIGKTPVRVEKDVPGFIVNRVQAPASVLLMAILEKGIATPEEVDATVR-RLGLPMGPFELVDYTGVDILYNALKYY
       200       210       220       230       240       250       260

1341      1371      1401      1431      1461      1491      1521      1551
SDTNSDPNSLHAHLAKMLKEEFIDKGRTGKAAGHGFYDYD*TIKEVR*KSNLFYNSTKE*LHQEQF*NDLKPIDDYYHL:
: |  |  |:    :      :  || :      :|:   |:||||:       ::             :        |
AQTIS-PD----YEPPKFLEEMVKANKLGRKTGQGFYDWSKGRPQIDSSKATDKINPMDFTFVEINEAVKLVEMGVATP(
       270       280       290       300       310       320       330
```

SEQ ID 8904 (GBS112) was expressed in *E. coli* as a His-fusion product. SDS-PAGE analysis of total cell extract is shown in FIG. 28 (lane 5; MW 39 kDa). It was also expressed in *E. coli* as a GST-fusion product. SDS-PAGE analysis of total cell extract is shown in FIG. 34 (lane 3; MW 64 kDa).

GBS112-GST was purified as shown in FIG. 198, lane 10.

EXAMPLE 1790

A DNA sequence (GBSx1897) was identified in *S. agalactiae* <SEQ ID 5567> which encodes the amino acid sequence <SEQ ID 5568>. Analysis of this protein sequence reveals the following:

```
Possible site: 14
>>> Seems to have no N-terminal signal sequence

----- Final Results -----
           bacterial cytoplasm --- Certainty = 0.3332(Affirmative) < succ>
           bacterial membrane  --- Certainty = 0.0000(Not Clear)   < succ>
           bacterial outside   --- Certainty = 0.0000(Not Clear)   < succ>
```

A related GBS nucleic acid sequence <SEQ ID 10097> which encodes amino acid sequence <SEQ ID 10098> was also identified.

The protein has homology with the following sequences in the GENPEPT database.

```
>GP:CAB14467 GB:Z99117 similar to hypothetical proteins [Bacillus subtilis]
Identities = 62/169 (36%), Positives = 109/169 (63%), Gaps = 3/169 (1%)

Query:   1 MAVLSMLGIIDAKPKVGYFYLGQYHASIGTSHFEKMTVSEIMGIPLTVHQKDSVYDVIVH  60
            +A+L+M G ++A+P+VGYFY G+    +     +K+ V +   IP+ +H+  SVYD I
Sbjct:  43 LAILTMSGFLEARPRVGYFYTGKTGTQLLADKLKKLQVKDFQSIPVVIHENVSVYDAICT 102

Query:  61 IFMEDAGCAFILDDDDFLCGVVSRKDLLKISIGGGDLSKMPIGMVMTRMPHVTTVLENES 120
            +F+ED G  F++D D  L GV+SRKDLL+  SIG  +L+ +P+ ++MTRMP++T     +
Sbjct: 103 MFLEDVGTLFVVDRDAVLVGVLSRKDLLRASIGQQELTSVPVHIIMTRMPNITVCRREDY 162

Query: 121 LFAAADKLVSRKVDSLPVVRHDKQYPEKFKVIGKLSKTILASLFLEIRD            169
            +   A  L+ +++D+LPV+    K   + F+VIG+++KT +  + + +
Sbjct: 163 VMDIAKHLIEKQIDALPVI---KDTDKGFEVIGRVTKTNMTKILVSLSE            208
```

No corresponding DNA sequence was identified in *S. pyogenes*.

Based on this analysis, it was predicted that this protein and its epitopes, could be useful antigens for vaccines or diagnostics.

EXAMPLE 1791

A DNA sequence (GBSx1898) was identified in *S. agalactiae* <SEQ ID 5569> which encodes the amino acid sequence <SEQ ID 5570>. Analysis of this protein sequence reveals the following:

```
Possible site: 22
>>> Seems to have no N-terminal signal sequence
INTEGRAL    Likelihood = -0.53    Transmembrane 60-76 (60-76)

----- Final Results -----
 bacterial membrane --- Certainty = 0.1213 (Affirmative) <succ>
  bacterial outside --- Certainty = 0.0000 (Not Clear)   <succ>
bacterial cytoplasm --- Certainty = 0.0000 (Not Clear)   <succ>
```

The protein has homology with the following sequences in the GENPEPT database.

```
>GP:BAB05092 GB:AP001511 unknown conserved protein [Bacillus halodurans]
Identities = 126/256 (49%), Positives = 183/256 (71%), Gaps = 1/256 (0%)

Query:   7 IFIISDSLGETAKAIAKACLSQFPGHDDWHFQRFSYINSQERLEQVFEEASQKTVFMMFS  66
            ++++SDS+GETA+ + KA  SQF G        +R  Y+  +E +++V + A Q    + F+
Sbjct:  10 VYVVSDSVGETAELVVKAAASQFSGAGI-EVRRIPYVEDKETVDEVIQLAKQADAIIAFT  68

Query:  67 LVDVALASYAQKRCESEHYAYVDLLTNVIQGISRISGIDPLGEPGILRRLDNDYFKRVES 126
            LV  + +Y ++          VD++  +++ IS ++    +P  EPGI+ RLD DYF++VE+
Sbjct:  69 LVVPGIRTYLLEKATEAKVETVDIIGPMLEKISSLTKEEPRYEPGIVYRLDEDYFRKVEA 128

Query: 127 IEFAVKYDDGRDPRGILQADLVIIGISRTSKTPLSMFLADKNIKVINIPLVPEVPVPKEL 186
            IEFAVKYDDGRDPRGI++ADLV+IG+SRTSKTPLS +LA K +KV N+PLVPEV  P+EL
Sbjct: 129 IEFAVKYDDGRDPRGIVRADLVLIGVSRTSKTPLSQYLAHKRLKVANVPLVPEVEPPEEL 188

Query: 187 RMIDSRRIIGLTNSVDHLNQVRKVRLKSLGLSSTANYASLERILEETRYAEEVMKNLGCP 246
             +  +++IGL  S + LN +R  RLK+LGL S ANYA+++RI EE    YAE +MK +GCP
Sbjct: 189 FKLSPKKVIGLKISPEQLNGIRAERLKTLGLKSQANYANIDRIKEELAYAEGIMKRIGCP 248

Query: 247 IINVSDKAIEETATII                                             262
            +I+VS+KA+EETA +I
Sbjct: 249 VIDVSNKAVEETANLI                                             264
```

No corresponding DNA sequence was identified in *S. pyogenes*.

SEQ ID 5570 (GBS378) was expressed in *E. coli* as a His-fusion product. SDS-PAGE analysis of total cell extract is shown in FIG. 68 (lane 4; MW 34 kDa). It was also expressed in *E. coli* as a GST-fusion product. SDS-PAGE analysis of total cell extract is shown in FIG. 72 (lane 2; MW 59 kDa).

GBS378-GST was purified as shown in FIG. 212, lane 6.

Based on this analysis, it was predicted that this protein and its epitopes, could be useful antigens for vaccines or diagnostics.

EXAMPLE 1792

A DNA sequence (GBSx1899) was identified in *S. agalactiae* <SEQ ID 5571> which encodes the amino acid sequence <SEQ ID 5572>. Analysis of this protein sequence reveals the following:

```
Possible site: 47
>>> Seems to have no N-terminal signal sequence

----- Final Results -----
bacterial cytoplasm --- Certainty = 0.3703 (Affirmative) <succ>
 bacterial membrane --- Certainty = 0.0000 (Not Clear)   <succ>
  bacterial outside --- Certainty = 0.0000 (Not Clear)   <succ>
```

The protein has homology with the following sequences in the GENPEPT database.

```
>GP:AAD35361 GB:AE001709 pyruvate, orthophosphate dikinase
[Thermotoga maritima]
Identities = 494/882 (56%), Positives = 639/882 (72%), Gaps = 9/882 (1%)

Query:   1 METKFVYHFD----EGCKEMKELLGGKGANLAEMTSIGLPVPQGFTITTQACNDYYDNAC   56
             M K+VY F     EG +MK++LGGKGANLAEMT++G+PVP GFTI+  + C  YYD+
Sbjct:   1 MAKKYVYFFANGKAEGRADMKDILGGKGANLAEMTNLGIPVPVPGFTISAEVCKYYYDHGR  60

Query:  57 HIRESILSQIDQAMAQLEVEQNKQLGSVDDPLLVSVRSGSVFSMPGMMDTVLNLGLNDRS  116
              E +  Q+++AM +LE    K+ G  ++PLLVSVRSG+   SMPGMMDTVLNLGLND +
Sbjct:  61 TYPEELKEQVEEAMRRLEEVTGKKFGDPNNPLLVSVRSGAAISMPGMMDTVLNLGLNDET  120

Query: 117 VQGLVKKTEDERFAYDSYRRFIQMFADVVTGIPKYKFDTILDRLKTDKCYQDDTELTGSD  176
             V+GL K T +ERFAYD+YRRF+QMF DVV  IP  KF+  L+   LK +K + DTEL  D
Sbjct: 121 VKGLAKLTNNERFAYDAYRRFLQMFGDVVLKIPHEKFEKALEELKKEKGVKLDTELDAED  180

Query: 177 LKRLVEFYKELYQKEAGEKFPQDPKRQLLLAIEAVFKSWNNPRAKIYRKLNDIPE--TLG  234
             LK+LVE YK++Y KE G++FPQDP +QL LAI+AVF SW N RA  YR+++  I E  LG
Sbjct: 181 LKKLVERYKQIY-KEEGKEFPQDPWKQLWLAIDAVFGSWMNERAIKYRQIHGIKEGDLLG  239

Query: 235 TAVNIQAMVFGNMGNNSGTGVAFTRNPSTGAANLFGEYLINAQGEDVVAGIRTPQSISKL  294
             TAVNI AMVFGNMG +SGTGVAFTR+P+TG    +GE+L NAQGEDVVAGIRTP  +L
Sbjct: 240 TAVNIVAMVFGNMGEDSGTGVAFTRDPNTGEKKPYGEFLPNAQGEDVVAGIRTPLKLEEL  299

Query: 295 AEQMPIIYQEFVSVTQKLEAHYRDMQDMEFTIENGNLYMLQTRSGKRTAKAAIKIAVDQV  354
               +MP +Y + + +   KLE HYRDMQD +EFT+E G LY+LQTR+GKRT++AAI+IAVD V
Sbjct: 300 KNRMPEVYNQLLEIMDKLEKHYRDMQDIEFTVERGKLYILQTRNGKRTSQAAIRIAVDMV  359

Query: 355 NEGLISKEEAILRIEPKQLDQLLHPSFDLKSLKKAIILTTGLPASPGAAYGKVYFHAEDV  414
             +EGLI+KEEAILR+ P+ ++Q+LHP FD K   +A ++  GLPASPGAA  GKV F+A+
Sbjct: 360 HEGLITKEEAILRVRPEDVEQVLHPVFDPKEKAQAKVIAKGLPASPGAATGKVVFNAKKA  419

Query: 415 VKEMKKGNPVLLVRQETSPEDIEGMVSANGIITARGGMTSHAAVVARGMGKPCVAGCSQL  474
              + K G V+LVR ETSPED+ GM +A GI+T+RGGMTSHAAVVARGMGKP V G  +
Sbjct: 420 EELGKAGEQVILVRPETSPEDVGGMAAAQGILTSRGGMTSHAAVVARGMGKPAVVGAESI  479

Query: 475 LVDEVRREISIGHQTIKEGEMLSIDGATGNVYIGQV-PMAETSVDRDFEIFMKWVDENRD  533
             V     +G   +KEGE +SIDG TG V +G+V +         ++     ++W DE R
Sbjct: 480 EVHPEEGYFKVGDVVVKEGEWISIDGTTGEVLLGKVTTIKPQGLEGPVAELLQWADEIRR  539

Query: 534 MMVCSNADNPRDAQKALDFGAEGIGLCRTEHMFFDDERIPVVREMILADEILSRRKALER  593
             + V +NAD PRDA+ A  FGAEGIGLCRTEHMFF+ +RIP VR  MILA    R KAL+
Sbjct: 540 LGVRTNADIPRDAEVARKFGAEGIGLCRTEHMFFEKDRIPKVRRMILAKTKEEREKALDE  599

Query: 594 LLSFQRDDFYQIFKVLKGKACTIRLLDPPLHEFLPHDKESIESMARQMGISTLAIEKRIQ  653
             LL  Q++DF +F+V+KG   TIRL+DPPLHEFLP + E I+ +A QMG+S  ++ ++
Sbjct: 600 LLPLQKFDFKGLFRVMKGLPVTIRLIDPPLHEFLPQEDEQIKEVAEQMGVSFEELKNVVE  659

Query: 654 TLEEFNPMLGHRGCRLAITYPEIYQMQVRALVQGAI-LAMKEGYEAKPEIMIPLVTAHEE  712
             L+E NPMLGHRGCRL ITYPEI  MQ +A++ +  AI L  +EG   PEIMIPLV    E
Sbjct: 660 NLKELNPMLGHRGCRLTITYPEIAVMQTKAIIGAAIELKKEEGIDVIPEIMIPLVGHVNE  719
```

```
                             -continued
Query:  713  ISIIRDLIEETIVEESKSKKINLSFPIGTMIETPRACMIADDIAKFADFFSFGTNDLTQM  772
             +  ++ +I+ET      K    + L++ IGTMIE PRA + A  IA+  A+FFSFGTNDLTQM
Sbjct:  720  LRYLKKIIKETADALIKEAGVELTYKIGTMIEVPRAAVTAHQIAEEAEFFSFGTNDLTQM  779

Query:  773  SFGFSRDDAGKFLGEYVDKGLLKKDPFQVLDQKGIGRFIGQAVRLGKEVKPNLKIGICGE  832
             +FGFSRDD GKFL EY++KG+L+ DPF+ LD  G+G +        G+  +P+LK+ G+CGE
Sbjct:  780  TFGFSRDDVGKFLPEYLEKGILEHDPFKTLDYDGVGELVRMGKEKGRSTRPDLKVGVCGE  839

Query:  833  HGGEPSSIEFCYQLGLHYVSCSPFRIPIAKLAAAQAKIKQSR                    874
             HGG+P SI F  ++GL YVSCSP+R+P+A+LAAAQA  +K  +
Sbjct:  840  HGGDPRSILFFDKIGLDYVSCSPYRVPVARLAAAQAALKNKK                    881
```

Based on this analysis, it was predicted that these proteins and their epitopes could be useful antigens for vaccines or diagnostics.

EXAMPLE 1793

A DNA sequence (GBSx1900) was identified in *S. agalactiae* <SEQ ID 5573> which encodes the amino acid sequence <SEQ ID 5574>. This protein is predicted to be glutamyl-tRNA (Gln) amidotransferase subunit C (gatC). Analysis of this protein sequence reveals the following:

```
Possible site: 56
>>> Seems to have no N-terminal signal sequence

----- Final Results -----
bacterial cytoplasm --- Certainty = 0.3229 (Affirmative)  <succ>
 bacterial membrane --- Certainty = 0.0000 (Not Clear)    <succ>
  bacterial outside --- Certainty = 0.0000 (Not Clear)    <succ>
```

The protein has homology with the following sequences in the GENPEPT database.

```
>GP:BAB04384 GB:AP001509 glutamyl-tRNA (Gln) amidotransferase
subunit C [Bacillus halodurans]
Identities = 42/94 (44%), Positives = 63/94 (66%)

Query:   2  KISEEEVRHVANLSKLRFSDQETKEFASSLSKIVDMIELLNEVDTEGVPVTTTMADRKTV  61
            +IS E+V+HVA+L++L  +++E K F   L  I+   E LNE+DTEGV  T+  + D K V
Sbjct:   3  RISMEQVKHVAHLARLAITEEEAKLFTEQLGDIIQFAEQLNELDTEGVEPTSHVLDMKNV  62

Query:  62  MREDIAQPGHNRDDLFKNVPQHQDYYIKVPAILE                           95
            +RED   + G   +D+ KN P H+D  I+VP++LE
Sbjct:  63  LREDKPEKGLPVEDVLKNAPDHEDGQIRVPSVLE                           96
```

A related DNA sequence was identified in *S. pyogenes* <SEQ ID 5575> which encodes the amino acid sequence <SEQ ID 5576>. Analysis of this protein sequence reveals the following:

```
Possible site: 60
>>> Seems to have no N-terminal signal sequence

----- Final Results -----
bacterial cytoplasm --- Certainty = 0.3247 (Affirmative)  <succ>
 bacterial membrane --- Certainty = 0.0000 (Not Clear)    <succ>
  bacterial outside --- Certainty = 0.0000 (Not Clear)    <succ>
```

An alignment of the GAS and GBS proteins is shown below.

```
Identities = 72/100 (72%), Positives = 88/100 (88%)

Query:   1  MKISEEEVRHVANLSKLRFSDQETKEFASSLSKIVDMIELLNEVDTEGVPVTTTMADRKT  60
            MKISEEEVRHVA LSKL FS+ ET  FA++LSKIVDM+ELLNEVDTEGV +TTTMAD+K
Sbjct:   5  MKISEEEVRHVAKLSKLSFSESETTTFATTLSKIVDMVELLNEVDTEGVAITTTMADKKN  64
```

```
Query:  61  VMREDIAQPGHNRDDLFKNVPQHQDYYIKVPAILEDGGDA                 100
            VMR+D+A+ G +R  LFKNVP+ ++++IKVPAIL+DGGDA
Sbjct:  65  VMRQDVAEEGTDRALLFKNVPEKENHFIKVPAILDDGGDA                 104
```

Based on this analysis, it was predicted that these proteins and their epitopes could be useful antigens for vaccines or diagnostics.

EXAMPLE 1794

A DNA sequence (GBSx1900) was identified in *S. agalactiae* <SEQ ID 5577> which encodes the amino acid sequence <SEQ ID 5578>. Analysis of this protein sequence reveals the following:

```
Possible site: 30
>>> Seems to have an uncleavable N-term signal seq
INTEGRAL    Likelihood = -7.64    Transmembrane 7-23 (6-24)

----- Final Results -----
 bacterial membrane --- Certainty = 0.4057 (Affirmative) <succ>
  bacterial outside --- Certainty = 0.0000 (Not Clear)   <succ>
bacterial cytoplasm --- Certainty = 0.0000 (Not Clear)   <succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1795

A DNA sequence (GBSx1902) was identified in *S. agalactiae* <SEQ ID 5579> which encodes the amino acid sequence <SEQ ID 5580>. This protein is predicted to be glutamyl-tRNA amidotransferase, subunit A (gatA). Analysis of this protein sequence reveals the following:

```
Possible site: 55
>>> Seems to have no N-terminal signal sequence

----- Final Results -----
        bacterial cytoplasm --- Certainty = 0.2855(Affirmative) < succ>
         bacterial membrane --- Certainty = 0.0000(Not Clear)   < succ>
          bacterial outside --- Certainty = 0.0000(Not Clear)   < succ>
```

The protein has homology with the following sequences in the GENPEPT database.

```
>GP:BAB04385 GB:AP001509 glutamyl-tRNA (Gln) amidotransferase
            subunit A [Bacillus halodurans]
Identities = 285/486 (58%), Positives = 367/486 (74%), Gaps = 4/486 (0%)

Query:    1  MSFNNQSIDQLHDFLVKKEISATELTKATLEDIHAREQAVGSFITISDEMAIAQAKEID-   59
             MS + + +H  L +KEIS ++L    + I  +  V +F+ +++E A A AKE+D
Sbjct:    1  MSLFDLKLKDVHTKLHEKEISVSDLVDEAYKRIEQVDGQVEAFLALNEEKARAYAKELDA  60

Query:   60  --DKGIDADNVMSGIPLAVKNDISTKGILTTAASKMLYNYEPIFDATAVEKLYAKDMIVI  117
               D+ +A  ++ GIP+ VKDNI TK + TT +S++L N++PI+DAT V KL    + I
Sbjct:   61  ALDRS-EARGLLFGIPIGVKDNIVTKNLRTTCSSRILGNFDPIYDATVVHKLREAQAVTI  119

Query:  118  GKANMDEFAMGGSTETSYFKKTNNAWDNSKVPGGSSGGSAAAVASGQVRLSLGSDTGGSI  177
             GK NMDEFAMG STE S F+KT N W+    VPGGSSGGSAAAVA+G+V +LGSDTGGSI
Sbjct:  120  GKLNMDEFAMGSSTENSAFQKTKNPWNLEYVPGGSSGGSAAAVAAGEVPFTLGSDTGGSI  179

Query:  178  RQPASFNGIVGMKPTYGRVSRFGLFAFGSSLDQIGPMSQTVKENAQLLTVISGHDVRDST  237
             RQPA++ G+VG+KPTYGRVSR+GL AF SSLDQIGP+++ V++NA LL   ISGHD  DST
Sbjct:  180  RQPAAYCGVVGLKPTYGRVSRYGLVAFASSLDQIGPITRNVEDNAYLLQAISGHDPMDST  239

Query:  238  SSERTVGDFTAKIGQDIQGMKIALPKEYLGEGIAQGVKETIIKAAKHLEKLGAVIEEVSL  297
             S+    V D+ + +  DI+G+KIA+PKEYLGEG+  + VK++++  A K LE  GA    EEVSL
Sbjct:  240  SANLDVPDYLSALTGDIKGLKIAVPKEYLGEGVKEEVKOSVLDALKVLEGLGATWEEVSL  299

Query:  298  PHSKYGVAVYYIVASSEASSNLQRFDGIRYGYRTENYKNLDDIYVNTRSEGFGDEVKRRI  357
             PHSKY +A YY++ASSEAS+NL RFDG+RYG+R++N  NL D+Y  TR+EGFGDEVKRRI
Sbjct:  300  PHSKYALATYYLLASSEASANLARFDGVRYGFRSDNADNLLDMYKQTRAEGFGDEVKRRI  359
```

-continued

```
Query:  358  MLGTFSLSSGYYDAYYKKAGQVRSLIIQDFEKVFADYDLILGPTAPTTAFDLDSLNHDPV  417
             MLGTF+LSSGYYDAYYKKA QVR+LI QDFEKVF YD+I+GPT PT AF +      DP+
Sbjct:  360  MLGTFALSSGYYDAYYKKAQQVRTLIKQDFEKVFEQYDVIIGPTTPTPAFKIGEKTDDPL  419

Query:  418  AMYLADILTIPVNLAGLPGISIPAGFDQGLPVGMQLIGPKFSEETIYQVAAAFEATTDYH  477
              MY  DILTIPVNLAG+P IS+P GFD GLP+G+Q+IG   F E ++Y+VA AFE  TDYH
Sbjct:  420  TMYANDILTIPVNLAGVPAISVPCGFDNGLPLGLQIIGKNFDEGSVYRVAHAFEQATDYH  479

Query:  478  KQQPKI  483
             ++P +
Sbjct:  480  TKRPTL  485
```

A related DNA sequence was identified in *S. pyogenes* [15] <SEQ ID 5581> which encodes the amino acid sequence <SEQ ID 5582>. Analysis of this protein sequence reveals the following:

```
Possible site: 57
>>> Seems to have no N-terminal signal sequence
----- Final Results -----
             bacterial cytoplasm --- Certainty = 0.2364(Affirmative) < succ>
             bacterial membrane  --- Certainty = 0.0000(Not Clear)   < succ>
              bacterial outside  --- Certainty = 0.0000(Not Clear)   < succ>
```

An alignment of the GAS and GBS proteins is shown below.

```
Identities = 392/487 (80%), Positives = 442/487 (90%)

Query:    1  MSFNNQSIDQLHDFLVKKEISATELTKATLEDIHAREQAVGSFITISDEMAIAQAKEIDD   60
             MSFN+++I++LHD LV KEISATELT+ATLEDI +RE+AVGSFIT+S+E+A+ QA   ID
Sbjct:    1  MSFNHKTIEELHDLLVAKEISATELTQATLEDIKSREEAVGSFITVSEEVALKQAAAIDA   60

Query:   61  KGIDADNVMSGIPLAVKDNISTKGILTTAASKMLYNYEPIFDATAVEKLYAKDMIVIGKA  120
             KGIDADN+MSGIPLAVKDNISTK ILTTAASKMLYNYEPIF+AT+V   YAKDMIVIGK
Sbjct:   61  KGIDADNLMSGIPLAVKDNISTKEILTTAASKMLYNYEPIFNATSVANAYAKDMIVIGKT  120

Query:  121  NMDEFAMGGSTETSYFKKTNNAWDHSKVPGGSSGGSAAAVASGQVRLSLGSDTGGSIRQP  180
             NMDEFAMGGSTETSYFKKT NAWDH+KVPGGSSGGSA AVASGQVRLSLGSDTGGSIRQP
Sbjct:  121  NMDEFAMGGSTETSYFKKTKNAWDHTKVPGGSSGGSATAVASGQVRLSLGSDTGGSIRQP  180

Query:  181  ASFNGIVGMKPTYGRVSRFGLFAFGSSLDQIGPMSQTVKENAQLLTVISGHDVRDSTSSE  240
             A+FN +VG+KPTYG VSR+GL AFGSSLDQIGP + TVKENAQLL VI+  DV+D+TS+
Sbjct:  181  AAFNSVVGLKPTYGTVSRYGLIAFGSSLDQIGPFAPTVKENAQLLNVIASSDVKDATSAP  240

Query:  241  RTVGDFTAKIGQDIQGMKIALPKEYLGEGIAQGVKETIIKAAKHLEKLGAVIEEVSLPHS  300
              + D+T+KIG+DI+GMKIALPKEYLGEGI   +KET++ + K  E LGA +EEVSLPHS
Sbjct:  241  VRIADYTSKIGRDIKGMKIALPKEYLGEGIDPEIKETVLASVKQFEALGATVEEVSLPHS  300

Query:  301  KYGVAVYYIVASSEASSNLQRFDGIRYGYRTENYKNLDDIYVNTRSEGFGDEVKRRIMLG  360
             KYGVAVYYI+ASSEASSNLQRFDGIRYG+R ++ KNLD+IYVNTRS+GFGDEVKRRIMLG
Sbjct:  301  KYGVAVYYIIASSEASSNLQRFDGIRYGFRADDAKNLDEIYVNTRSQGFGDEVKRRIMLG  360

Query:  361  TFSLSSGYYDAYYKKAGQVRSLIIQDFEKVFADYDLILGPTAPTTAFDLDSLNHDPVAMY  420
             TFSLSSGYYDAY+KKAGQVR+LIIQDF+KVFADYDLILGPT PT AF LD+LNHDPVAMY
Sbjct:  361  TFSLSSGYYDAYFKKAGQVRTLIIQDFDKVFADYDLILGPTTPTVAFGLDTLNHDPVAMY  420

Query:  421  LADILTIPVNLAGLPGISIPAGFDQGLPVGMQLIGPKFSEETIYQVAAAFEATTDYHKQQ  480
             LAD+LTIPVNLAGLPGISIPAGF  GLPVG+QLIGPK++EETIYQ AAAFEA TDYHKQQ
Sbjct:  421  LADLLTIPVNLAGLPGISIPAGFVDGLPVGLQLIGPKYAEETIYQAAAAFEAVTDYHKQQ  480

Query:  481  PKIFGGE  487
             P IFGG+
Sbjct:  481  PIIFGGD  487
```

Based on this analysis, it was predicted that these proteins and their epitopes could be useful antigens for vaccines or diagnostics.

EXAMPLE 1796

A DNA sequence (GBSx1903) was identified in *S. agalactiae* <SEQ ID 5583> which encodes the amino acid sequence <SEQ ID 5584>. This protein is predicted to be glutamyl-tRNAGln amidotransferase subunit B (gatB). Analysis of this protein sequence reveals the following:

```
Possible site: 27
>>> Seems to have no N-terminal signal sequence

------ Final Results ------
              bacterial cytoplasm --- Certainty = 0.3935(Affirmative) < succ>
              bacterial membrane  --- Certainty = 0.0000(Not Clear)   < succ>
              bacterial outside   --- Certainty = 0.0000(Not Clear)   < succ>
```

A related GBS nucleic acid sequence <SEQ ID 10095> which encodes amino acid sequence <SEQ ID 10096> was also identified.

The protein has homology with the following sequences in the GENPEPT database.

```
>GP:BAB04386 GB:AP001509 glutamyl-tRNA (GLn) amidotransferase
            subunit B [Bacillus halodurans]
 Identities = 308/476 (64%), Positives = 361/476 (75%), Gaps = 1/476 (0%)

Query:   1  MNFETVIGLEVHVELNTNSKIFSPSSAHFGQEQNANTNVIDWSFPGVLPVMNKGVIDAGI   60
            MNFETVIGL VHVEL T SKIFS S  HFG E NANT+VID +PGVLPV+NK  ++   +
Sbjct:   1  MNFETVIGLEVHVELKTESKIFSASPNHFGAEPNANTSVIDLGYPGVLPVLNKAAVEFAM   60

Query:  61  KAALALNMDIHQNMHFDRKNYFYPDNPKAYQISQFDEPIGYNGWIEIELEDGTRKKIRIE   120
            KAA+ALN ++   +   FDRKNYFYPDNPKAYQISQFD+PIG NGWIEIE+ DGT+KKI I
Sbjct:  61  KAAMALNCEVATDTKFDRKNYFYPDNPKAYQISQFDKPIGENGWIEIEV-DGTKKKIGIT   119

Query: 121  RAHLEEDAGKNTHGTDGYSYVDLNRQGVPLIEIVSEADMRSPEEAYAYLTALKEIIQYTG   180
            R HLEEDAGK TH +GYS VD NRQG PLIEIVSE D+R+P+EAYAYL  LK IIQYTG
Sbjct: 120  RLHLEEDAGKLTHSGNGYSLVDFNRQGTPLIEIVSEPDIRTPQEAYAYLEKLKSIIQYTG   179

Query: 181  ISDVKMEEGSMRVDANISLRPYGQEEFGTKAELKNLNSFNNVRKGLIHEEKRQAQVLRSG   240
            +SD KMEEGS+R DANISLRP GQEEFGTK ELKNLNSFN VRKGL +EEKRQAQVL SG
SbjCt: 180  VSDCKMEEGSLRCDANISLRPVGQEEFGTKTELKNLNSFNFVRKGLFYEEKRQAQVLLSG   239

Query: 241  GQIQQETRRFDETTGETILMRVKEGSSDYRYFPEPDLPLFDISDEWIDQVRLELPEFPQE   300
            G+I QETRR+DE   +T+LMRVKEGS DYRYFPEPDL    I DEW ++R E+PE P
Sbjct: 240  GEILQETRRYDEAANKTVLMRVKEGSDDYRYFPEPDLVALHIDDEWKARIRSEIPELPDA   299

Query: 301  RRAKYVSSFGLSSYDASQLTATKATSDFFEKAVAIGGDAKQVSNWLQGEVAQFLNSESKS   360
            R+ +YV   GL +YDA  LT TK  SDFFE+ +A G D K  SNWL GEV +LN+E K
Sbjct: 300  RKKRYVEELGLPAYDAMVLTLTKEMSDFFEETIAKGADPKLASNWLMGEVSGYLNAEQKE   359

Query: 361  IEEIGLTPENLVEMIGLIADGTISSKIAKKVFVHLAKNGGSAEEFVKKAGLVQISDPEVL   420
            ++E+ LTP+ L +MI LI  GTISSKIAKKVF  L + GG  EE VK  GLVQISD    L
Sbjct: 360  LDEVALTPDGLAKMIQLIEKGTISSKIAKKVFKDLIEKGGDPEEIVKAKGLVQISDEGEL   419

Query: 421  IPIIHQVFADNEAAVIDFKSGKRNADKAFTGYLMKATKGQANPQVALKLLAQELAK      476
              + +V +N+ ++ DFK+GK  A     G +MKATKG+ANP +  KLL +E+  K
Sbjct: 420  RKYVVEVLDNNQQSIDDFKNGKDRAIGFLVGQIMKATKGKANPPMVNKLLLEEIWK      475
```

A related DNA sequence was identified in *S. pyogenes* <SEQ ID 5585> which encodes the amino acid sequence <SEQ ID 5586>. Analysis of this protein sequence reveals the following:

```
Possible site: 27
>>> Seems to have no N-terminal signal sequence

----- Final Results -----
              bacterial cytoplasm --- Certainty = 0.3935(Affirmative) < succ>
              bacterial membrane  --- Certainty = 0.0000(Not Clear)   < succ>
              bacterial outside   --- Certainty = 0.0000(Not Clear)   <succ>
```

An alignment of the GAS and GBS proteins is shown below.

```
Identities = 410/479 (85%), Positives = 447/479 (92%)

Query:   1  MNFETVIGLEVHVELNTNSKIFSPSSAHFGQEQNANTNVIDWSFPGVLPVMNKGVIDAGI   60
            MNFET+IGLEVHVELNTNSKIFSPSSAHFG++ NANTNVIDWSFPGVLPVMNKGVIDAGI
Sbjct:   1  MNFETIIGLEVHVELNTNSKIFSPSSAHFGEDPNANTNVIDWSFPGVLPVMNKGVIDAGI   60

Query:  61  KAALALNMDIHQNMHFDRKNYFYPDNPKAYQISQFDEPIGYNGWIEIELEDGTRKKIRIE  120
            KAALALNMDIH+ MHFDRKNYFYPDNPKAYQISQFDEPIGYNGWI+I+LEDG+ KKIRIE
Sbjct:  61  KAALALNMDIHKEMHFDRKNYFYPDNPKAYQISQFDEPIGYNGWIDIKLEDGSTKKIRIE  120

Query: 121  RAHLEEDAGKNTHGTDGYSYVDLNRQGVPLIEIVSEADMRSPEEAYAYLTALKEIIQYTG  180
            RAHLEEDAGKNTHGTDGYSYVDLNRQGVPLIEIVSEADMRSPEEAYAYLTALKEIIQYTG
Sbjct: 121  RAHLEEDAGKNTHGTDGYSYVDLNRQGVPLIEIVSEADMRSPEEAYAYLTALKEIIQYTG  180

Query: 181  ISDVKMEEGSMRVDANISLRPYGQEEFGTKAELKNLNSFNNVRKGLIHEEKRQAQVLRSG  240
            ISDVKMEEGSMRVDANISLRPYGQE+FGTK ELKNLNSF+NVRKGL  E +RQA++LRSG
Sbjct: 181  ISDVKMEEGSMRVDANISLRPYGQEQFGTKTELKNLNSFSNVRKGLEFEVERQAKLLRSG  240

Query: 241  GQIQQETRRFDETTGETILMRVKEGSSDYRYFPEPDLPLFDISDEWIDQVRLELPEFPQE  300
            G I+QETRR+DE    TILMRVKEG++DYRYFPEPDLPL++I D WID++R +LP+FP +
Sbjct: 241  GVIRQETRRYDEANKGTILMRVKEGAADYRYFPEPDLPLYEIDDAWIDEMRAQLPQFPAQ  300

Query: 301  RRAKYVSSFGLSSYDASQLTATKATSDFFEKAVAIGGDAKQVSNWLQGEVAQFLNSESKS  360
            RRAKY    GLS+YDASQLTATK  SDFFE AV++GGDAKQVSNWLQGEVAQFLN+E K+
Sbjct: 301  RRARYEEELGLSAYDASQLTATKVLSDFFETAVSLGGDARQVSNWLQGEVAQFLNAEGKT  360

Query: 361  IEEIGLTPENLVEMIGLIADGTISSKIAKKVFVHLAKNGGSAEEFVKKAGLVQISDPEVL  420
            IEEI LTPENLVEMI +IADGTISSK+AKKVFVHLAKNGGSA  +V+KAGLVQISDP VL
Sbjct: 361  IEEIALTPENLVEMIAIIADGTISSKMAKKVFVHLAKNGGSARAYVEKAGLVQISDPAVL  420

Query: 421  IPIIHQVFADNEAAVIDFKSGKRNADKAFTGYLMKATKGQANPQVALKLLAQELAKLKE  479
            +PIIHQVFADNEAAV DFKSGKRNADKAFTG+LMKATKGQANPQVA +LLAQEL KL++
Sbjct: 421  VPIIHQVFADNEAAVADFKSGKRNADKAFTGFLMKATKGQANPQVAQQLLAQELQKLRD  479
```

Based on this analysis, it was predicted that these proteins and their epitopes could be useful antigens for vaccines or diagnostics.

EXAMPLE 1797

A DNA sequence (GBSx1904) was identified in *S. agalactiae* <SEQ ID 5587> which encodes the amino acid sequence <SEQ ID 5588>. Analysis of this protein sequence reveals the following:

```
Possible site: 34
>>> Seems to have an uncleavable N-term signal seq
    INTEGRAL      Likelihood = -7.27    Transmembrane   108-124   (105-125)
    INTEGRAL      Likelihood = -7.27    Transmembrane   278-294   (268-301)
    INTEGRAL      Likelihood = -6.05    Transmembrane   191-207   (188-208)
    INTEGRAL      Likelihood = -5.63    Transmembrane   219-235   (215-242)
    INTEGRAL      Likelihood = -3.93    Transmembrane    41-57     (39-58)
    INTEGRAL      Likelihood = -3.88    Transmembrane   132-148   (131-150)
    INTEGRAL      Likelihood = -3.03    Transmembrane   254-270   (253-272)
    INTEGRAL      Likelihood = -3.03    Transmembrane    79-95     (79-95)

----- Final Results -----
         bacterial membrane --- Certainty = 0.3909(Affirmative) < succ>
          bacterial outside --- Certainty = 0.0000(Not Clear)   < succ>
         bacterial cytoplasm --- Certainty = 0.0000(Not Clear)   < succ>
```

A related GBS nucleic acid sequence <SEQ ID 10093> which encodes amino acid sequence <SEQ ID 10094> was also identified.

The protein has homology with the following sequences in the GENPEPT database.

```
>GP:CAA04271 GB:AJ000733 hypothetical protein [Bacillus megaterium]
 Identities = 102/292 (34%), Positives = 169/292 (56%), Gaps = 3/292 (1%)

Query:   6  TKKEKGTMMTLAAGLAWGISGISGQYLMSH-GVHVNLLTSLRLLITGIFLLSLARSKQKE   64
            +++  G ++ +       WG+SG  QYL  H  +   L +R+L++G+ LL++A SKQ+
Sbjct:   1  SRRAWGLLLVIIGATMWGVSGTVAQYLFQHKSFNAEWLVVVRMLVSGLLLLAIA-SKQR-   58
```

```
Query:  65   HLVAAWKQPKFLKQVLLFSIFGLVLNQYAFLRAIHLTNAGTATVLQYMAPILILSIVCIL  124
             ++ A WI +   +LLF + G++ QY + AI   NA TATVLQY +PI I+ + +
Sbjct:  59   NIFAIWKTKEERTSLLLFGVIGMLGVQYTYFAAIEAGNAATATVLQYTSPIFIIGYLAVQ  118

Query: 125   NRQRPTSFEIIAIAMAILGTYMIATHGRLGSLAITPKGLMWGLGSAITYSIYILLPVKLI  184
             R+ P    E+I++ + I GT+ +AT G     L+IT   L WG+G+A+T + Y L P +L+
Sbjct: 119   ARKWPVKVEMISVVLVIAGTFFLATSGNFNELSITGWALFWGIGAAVTSAFYTLQPKRLL  178

Query: 185   HEWGSTIVIGSGHFIGGILFSLVTKAWQYPLQINVMSILAYIGIIGIGTIFAYTFFLKGV  244
             +W S  V+G GM IGG   FS +   W    + +++S+ A + +I   GT+ A+  +L+ +
Sbjct: 179   AKWSSIEVVGWGMVIGGASFSFIHPPWHIAGEWSLLSLCAVLFVIIFGTLIAFYCYLESL  238

Query: 245   SIVGAVKGSLLASVEPVSSVFLTVLVLGEIFYPIDLLGMLFIFLAVTLISYK           296
             + A +  +LAS EP+S+  L+VL L      F     + LG + I    V L+S +
Sbjct: 239   KHISASEAIVLASREPLSAAALSVLWLHVTFGWTEWLGTILIIATVFLLSQR          290
```

No corresponding DNA sequence was identified in S. pyogenes.

Based on this analysis, it was predicted that this protein and its epitopes, could be useful antigens for vaccines or diagnostics.

EXAMPLE 1798

A DNA sequence (GBSx1905) was identified in S. agalactiae <SEQ ID 5589> which encodes the amino acid sequence <SEQ ID 5590>. Analysis of this protein sequence reveals the following:

```
Possible site: 59
>>> Seems to have no N-terminal signal sequence

----- Final Results -----
            bacterial cytoplasm --- Certainty = 0.2103(Affirmative) < succ>
            bacterial membrane  --- Certainty = 0.0000(Not Clear)  < succ>
             bacterial outside  --- Certainty = 0.0000(Not Clear)  < succ>
```

A related GBS nucleic acid sequence <SEQ ID 10091> which encodes amino acid sequence <SEQ ID 10092> was also identified.

The protein has homology with the following sequences in the GENPEPT database.

```
>GP:CAB14510 GB:Z99117 similar to hypothetical proteins [Bacillus subtilis]
 Identities = 52/153 (33%), Positives = 88/153 (56%)

Query:  17   YRPTFVVEAVYDLRAEDLLRHGIRAVLVDLDNTLIAWNNPDGTAEVRAWLDEMTTADISV    76
             + P    V+ ++ +  E L    ++ ++ DLDNTL+ W+ P+ T   +   W +EM    I V
Sbjct:   6   FLPDEFVKNIFHITPERLKERNVKGIITDLDNTLVEWDRPNATPRLIEWFEEMKEHGIKV    65

Query:  77   VVVSNNNHARVERAVSRFGVDFVSRAMKPFTRGINMAIERYGFDRDEVIMVGDQLMTDIR   136
             +VSNNN   RV+        G+ F+ +A KP  +  N A+      +++ +++GDQL+TD+
Sbjct:  66   TIVSNNNERRVKLFSEPLGIPFIYKARKPMGKAFNRAVRNMELKKEDCVVIGDQLLTDVL   125

Query: 137   ASHRAGIKSVLVKPIVKSDAWNTKFNRLRERRV                              169
             +R G  ++LV P+   SD +T+FNR  ERR+
Sbjct: 126   GGNRNGYHTILVVPVASSDGFITRFNRQVERRI                              158
```

A related DNA sequence was identified in S. pyogenes <SEQ ID 5591> which encodes the amino acid sequence <SEQ ID 5592>. Analysis of this protein sequence reveals the following:

```
Possible site: 51
>>> Seems to have no N-terminal signal sequence

----- Final Results -----
            bacterial cytoplasm --- Certainty = 0.4252 (Affirmative) < succ>
            bacterial membrane  --- Certainty = 0.0000 (Not Clear)  < succ>
             bacterial outside  --- Certainty = 0.0000 (Not Clear)  < succ>
```

An alignment of the GAS and GBS proteins is shown below.

```
Identities = 147/175 (84%), Positives = 158/175 (90%)

Query:   12 LSIDDYRPTFVVEAVYDLRAEDLLRHGIRAVLVDLDNTLIAWNNPDGTAEVRAWLDEMTT   71
            +SIDDYRPT++VEA+YDLRA DLLRHGI AVLVDLDNTLIAWNNPDGT EVRAWLDEMT
Sbjct:   20 MSIDDYRPTYMVEAIYDLRANDLLRHGITAVLVDLDNTLIAWNNPDGTPEVRAWLDEMTI   79

Query:   72 ADISVVVVSNNNHARVERAVSRFGVDFVSRAMKPFTRGINMAIERYGFDRDEVIMVGDQL  131
            ADISVVVVSNN H+RVERAVSRFGVDF+SRA+KPF  GI  AI RYGFDR+EVIMVGDQL
Sbjct:   80 ADISVVVVSNNKHSRVERAVSRFGVDFISRALKPFAYGIEKAIARYGFDRNEVIMVGDQL  139

Query:  132 MTDIRASHRAGIKSVLVKPIVKSDAWNTKFNRLRERRVWKKIEENYGKIVYQKGI       186
            MTDIRASHRAGIKSVLVKP+V SDAWNTK NR RERRV K+EE YGK+ YQKGI
Sbjct:  140 MTDIRASHRAGIKSVLVKPLVASDAWNTKINRWRERRVMAKLEEKYGKLSYQKGI       194
```

Based on this analysis, it was predicted that these proteins and their epitopes could be useful antigens for vaccines or diagnostics.

EXAMPLE 1799

A DNA sequence (GBSx1906) was identified in *S. agalactiae* <SEQ ID 5593> which encodes the amino acid sequence <SEQ ID 5594>. Analysis of this protein sequence reveals the following:

```
Possible site: 15
>>> Seems to have no N-terminal signal sequence

----- Final Results -----
            bacterial cytoplasm --- Certainty = 0.1091 (Affirmative) < succ>
             bacterial membrane --- Certainty = 0.0000 (Not Clear)  < succ>
              bacterial outside --- Certainty = 0.0000 (Not Clear)  < succ>
```

The protein has homology with the following sequences in the GENPEPT database.

```
>GP:CAB14509 GB:Z99117 similar to hypothetical proteins
[Bacillus subtilis]
Identities = 220/373 (58%), Positives = 280/373 (74%), Gaps = 8/373 (2%)

Query:    1 MEELFCIGCGARIQTENKDAAGYTPRAALEKGLETGELYCQRCFRLRHYNEITDVHITDD   60
            ME++ CIGCG  IQTE+K  GY P A+L K    + CQRCFRL++YNEI DV +TDD
Sbjct:    1 MEKVVCIGCGVTIQTEDKTGLGYAPPASLTKE----NVICQRCFRLKNYNEIQDVSLTDD   56

Query:   61 EFLKLLHEVGDSDALVVNVIDIFDFNGSIIPGLSRFVAGNDVLLVGNKKDILPKSVKDGK  120
            +FL +LH +G++D+LVV ++DIFDFNGS I GL R V GN +LLVGNK DILPKS+K +
Sbjct:   57 DFLNILHGIGETDSLVVKIVDIFDFNGSWINGLQRLVGGNPILLVGNKADILPKSLKRER  116

Query:  121 VTQWLTERAHEEGLRPVDVILTSAQNHHAIKDLIDTIEKYRHGQDVYVVGVTNVGKSTLI  180
            + QW+   A E GL+PVDV L SA      I+++ID IE YR+G+DVYVVG TNVGKST I
Sbjct:  117 LIQWMKREAKELGLKPVDVFLVSAGRGQGIREVIDAIEHYRNGKDVYVVGCTNVGKSTFI  176

Query:  181 NAIIREITGSRDVITTSRFPGTTLDKIEIPLDDGSYIFDTPGIIHRHQMAHYLTAKNLKY  240
            N II+E++G  D+ITTS+FPGTTLD IEIPLDDGS ++DTPGII+ HQMAHY+  K+LK
Sbjct:  177 NRIIKEVSGEEDIITTSQFPGTTLDAIEIPLDDGSSLYDTPGIINNHQMAHYVNKKDLKI  236

Query:  241 VSPKKEIKPKTYQLNSEQTLFLAGLARFDFISGQKQGFTAYFDNNLNLHRTKLVGADEFY  300
            +SPKKE+KP+T+QLN +QTL+  GLARFD++SG++   F  Y  N L +HRTKL  AD  Y
Sbjct:  237 LSPKKELKPRTFQLNDQQTLYFGGLARFDYVSGERSPFICYMPNELMIHRTKLENADALY  296

Query:  301 TKHVGKLLTPPTGKEVSDFPKLVRHEFTIKD-KMDIVYSGLGWIRVKSEAENPVVAAWA  359
              KH G+LLTPP   E+ +FP+LV H FTIKD K DIV+SGLGW+ V     +  V A+A
Sbjct:  297 EKHAGELLTPPGKDEMDEFPELVAHTFTIKDKKTDIVFSGLGWVTVHDADKK---VTAYA  353

Query:  360 PEGVAVVLRKALI                                                372
            P+GV V +R++LI
Sbjct:  354 PKGVHVFVRRSLI                                                366
```

A related DNA sequence was identified in *S. pyogenes* <SEQ ID 5595> which encodes the amino acid sequence <SEQ ID 5596>. Analysis of this protein sequence reveals the following:

```
Possible site: 15
>>> Seems to have an uncleavable N-term signal seq

----- Final Results -----
             bacterial membrane --- Certainty = 0.0000 (Not Clear) < succ>
              bacterial outside --- Certainty = 0.0000 (Not Clear) < succ>
             bacterial cytoplasm --- Certainty = 0.0000 (Not Clear) < succ>
```

The protein has homology with the following sequences in the databases:

```
>GP:CAB14509 GB:Z99117 similar to hypothetical proteins
[Bacillus subtilis]
Identities = 220/373 (58%), Positives = 286/373 (75%), Gaps = 8/373 (2%)

Query:    1 MEELFCIGCGIQIQTEDKEKAGFTPAAALKKGMETGELYCQRCFRLRHYNEITDVHITDD   60
            ME++ CIGCG+ IQTEDK   G+ P A+L K     + CQRCFRL++YNEI DV +TDD
Sbjct:    1 MEKVVCIGCGVTIQTEDKTGLGYAPPASLTKE----NVICQRCFRLKNYNEIQDVSLTDD   56

Query:   61 EFLRLLHEVGDSDALVVNVIDIFDFNGSIIPGLSRFISGNDVLLVGNKKDILPKSVKDGK  120
            +FL +LH +G++D+LVV ++DIFDFNGS I GL R + GN +LLVGNK DILPKS+K  +
Sbjct:   57 DFLNILHGIGETDSLVVKIVDIFDFNGSWINGLQRLVGGNPILLVGNKADILPKSLKRER  116

Query:  121 VTQWLTERAHEEGLRPLDVMLTSAQNKYAIKDLIGRINELRNGRDVYVVGVTNVGKSTLI  180
            + QW+   A E GL+P+DV L SA     I+++I  I   RNG+DVYVVG TNVGKST I
Sbjct:  117 LIQWMKREAKELGLKPVDVFLVSAGRGQGIREVIDAIEHYRNGKDVYVVGCTNVGKSTFI  176

Query:  181 NAIIQEITGNKDVITTSRFPGTTLDKIEIPLDDGTFIFDTPGIIHRHQMAHYLSPKELKI  240
            N II+E++G +D+ITTS+FPGTTLD IEIPLDDG+ ++DTPGII+ HQMAHY++ K+LKI
Sbjct:  177 NRIIKEVSGEEDIITTSQFPGTTLDAIEIPLDDGSSLYDTPGIINNHQMAHYVNKKDLKI  236

Query:  241 VSPKKEIKPKTYQLNPEQTLFLGGLARFDFINGERQGFTAFFDNQLELHRTKLAGADAFY  300
            +SPKKE +KP+T+QLN +QTL+ GGLARFD+++GER  F  +  N+L +HRTKL  ADA Y
Sbjct:  237 LSPKKELKPRTFQLNDQQTLYFGGLARFDYVSGERSPFICYMPNELMIHRTKLENADALY  296

Query:  301 DKHVGTLLTPPDKKELTAFPKLVRHEFTI-DQKMDIVFSGLGWIRVNGQKDSKAIVAAWA  359
            +KH G LLTPP K E+  FP+LV H FTI D+K DIVFSGLGW+ V+    D+    V A+A
Sbjct:  297 EKHAGELLTPPGKDEMDEFPELVAHTFTIKDKKTDIVFSGLGWVTVH---DADKKVTAYA  353

Query:  360 PEGVAVIVRKAII                                                372
            P+GV V VR+++I
Sbjct:  354 PKGVHVFVRRSLI                                                366
```

An alignment of the GAS and GBS proteins is shown below.

```
Identities = 308/372 (82%), Positives = 343/372 (91%)

Query:    1 MEELFCIGCGARIQTENKDAAGYTPRAALEKGLETGELYCQRCFRLRHYNEITDVHITDD   60
            MEELFCIGCG +IQTE+K+ AG+TP AAL+KG+ETGELYCQRCFRLRHYNEITDVHITDD
Sbjct:    1 MEELFCIGCGIQIQTEDKEKAGFTPAAALKKGMETGELYCQRCFRLRHYNEITDVHITDD   60

Query:   61 EFLKLLHEVGDSDALVVNVIDIFDFNGSIIPGLSRFVAGNDVLLVGNKKDILPKSVKDGK  120
            EFL+LLHEVGDSDALVVNVIDIFDFNGSIIPGLSRF++GNDVLLVGNKKDILPKSVKDG+
Sbjct:   61 EFLRLLHEVGDSDALVVNVIDIFDFNGSIIPGLSRFISGNDVLLVGNKKDILPKSVKDGR  120

Query:  121 VTQWLTERAHEEGLRPVDVILTSAQNHHAIKDLIDTIEKYRHGQDVYVVGVTNVGKSTLI  180
            VTQWLTERAHEEGLRP+DV+LTSAQN +AIKDLI   I + R+G+DVYVVGVTNVGKSTLI
Sbjct:  121 VTQWLTERAHEEGLRPLDVMLTSAQNKYAIKDLIGRINELRNGRDVYVVGVTNVGKSTLI  180

Query:  181 NAIIREITGSRDVITTSRFPGTTLDKIEIPLDDGSYIFDTPGIIHRHQMAHYLTAKNLKY  240
            NAII+EITG++DVITTSRFPGTTLDKIEIPLDDG++IFDTPGIIHRHQMAHYL+ K LK+
Sbjct:  181 NAIIQEITGNKDVITTSRFPGTTLDKIEIPLDDGTFIFDTPGIIHRHQMAHYLSPKELKI  240

Query:  241 VSPKKEIKPKTYQLNSEQTLFLAGLARFDFISGQKQGFTAYFDNNLNLHRTKLVGADEFY  300
            VSPKKEIKPKTYQLN EQTLFL GLARFDFI+G++QGFTA+FDN L +HRTKL GAD FY
Sbjct:  241 VSPKKEIKPKTYQLNPEQTLFLGGLARFDFINGERQGFTAFFDNQLELHRTKLAGADAFY  300

Query:  301 TKHVGKLLTPPTGKEVSDFPKLVRHEFTIKDKMDIVYSGLGWIRVKSEAENPVVAAWAP  360
             KHVG LLTPP  KE++ FPKLVRHEFTI  KMDIV+SGLGWIRV  +   +VAAWAP
Sbjct:  301 DKHVGTLLTPPDKKELTAFPKLVRHEFTIDQKMDIVFSGLGWIRVNGQKDSKAIVAAWAP  360
```

```
Query: 361 EGVAVVLRKALI                                                  372
            EGVAV++RKA+I
Sbjct: 361 EGVAVIVRKAII                                                  372
```

Based on this analysis, it was predicted that these proteins and their epitopes could be useful antigens for vaccines or diagnostics.

EXAMPLE 1800

A DNA sequence (GBSx1907) was identified in *S. agalactiae* <SEQ ID 5597> which encodes the amino acid sequence <SEQ ID 5598>. Analysis of this protein sequence reveals the following:

```
Possible site: 18
>>>Seems to have no N-terminal signal sequence

----- Final Results -----
            bacterial cytoplasm --- Certainty = 0.2948 (Affirmative) < succ>
            bacterial membrane  --- Certainty = 0.0000 (Not Clear)   < succ>
             bacterial outside  --- Certainty = 0.0000 (Not Clear)   < succ>
```

The protein has homology with the following sequences in the GENPEPT database.

```
>GP:CAB14507 GB:Z99117 similar to dihydrodipicolinate reductase
[Bacillus subtilis]
Identities = 49/97 (50%), Positives = 67/97 (68%), Gaps = 2/97 (2%)

Query:   1 MLTSKQRAFLKSEAHSMKPIIQIGKNGLNDQIKTSVRNALDARELIKVTLLQNTDEDIHD   60
           MLT KQ+ FL+S+AH + PI Q+GK G+ND +   +  AL+ARELIKV++LQN +ED +D
Sbjct:   1 MLTGKQKRFLRSKAHHLTPIFQVGKGGVNDNMIKQIAEALEARELIKVSVLQNCEEDKND   60

Query:  61 VAEVLEDEIGCDTVLKIGRILILYKESARKENRKISV                         97
           VAE L           V  IG  ++LYKES   KEN++I +
Sbjct:  61 VAEALVKGSRSQLVQTIGNTIVLYKES--KENKQIEL                         95
```

A related DNA sequence was identified in *S. pyogenes* <SEQ ID 5599> which encodes the amino acid sequence <SEQ ID 5600>. Analysis of this protein sequence reveals the following:

```
Possible site: 42
>>> Seems to have no N-terminal signal sequence

----- Final Results ----
            bacterial cytoplasm --- Certainty = 0.2839 (Affirmative) < succ>
            bacterial membrane  --- Certainty = 0.0000 (Not Clear)   < succ>
             bacterial outside  --- Certainty = 0.0000 (Not Clear)   < succ>
```

An alignment of the GAS and GBS proteins is shown below.

```
Identities = 89/102 (87%), Positives = 98/102 (95%)
Query:   1 MLTSKQRAFLKSEAHSMKPIIQIGKNGLNDQIKTSVRNALDARELIKVTLLQNTDEDIHD   60
           MLTSKQRAFLKSEAHS+KPI+QIGKNGLND IKTS+R ALDARELIKVTLLQNTDEDIH+
Sbjct:   1 MLTSKQRAFLKSEAHSLKPIVQIGKNGLNDHIKTSIRQALDARELIKVTLLQNTDEDIHE   60

Query:  61 VAEVLEDEIGCDTVLKIGRILILYKESARKENRKISVKVKAV                   102
           VAE+LE+EIGCDTVLKIGRILILYK SA+KENRK+S KVKA+
Sbjct:  61 VAEILEEEIGCDTVLKIGRILILYKVSAKKENRKLSPKVKAI                   102
```

Based on this analysis, it was predicted that these proteins and their epitopes could be useful antigens for vaccines or diagnostics.

EXAMPLE 1801

A DNA sequence (GBSx1908) was identified in *S. agalactiae* <SEQ ID 5601> which encodes the amino acid sequence <SEQ ID 5602>. Analysis of this protein sequence reveals the following:

```
Possible site: 16
>>> Seems to have no N-terminal signal sequence
INTEGRAL   Likelihood = -2.66    Transmembrane    3-19     (1-21)

----- Final Results -----
bacterial membrane --- Certainty = 0.2062 (Affirmative) < succ>
bacterial outside  --- Certainty = 0.0000 (Not Clear)  < succ>
bacterial cytoplasm --- Certainty = 0.0000 (Not Clear)  < succ>
```

A related GBS nucleic acid sequence <SEQ ID 10089> which encodes amino acid sequence <SEQ ID 10090> was also identified.

The protein has homology with the following sequences in the GENPEPT database.

```
>GP:CAB14506 GB:Z99117 similar to hypothetical proteins
[Bacillus subtilis]
Identities = 85/187 (45%), Positives = 134/187 (71%)

Query:  38 KQIGIMGGNFNPVHNAHLVVADQVRQQLCLDQVLLMPEFQPPHIDKKETIDEQHRLKMLE  97
           K+IGI GG F+P HN HL++A++V  Q  LD++  MP    PPH    ++  D  HR++ML+
Sbjct:   2 KKIGIFGGTFDPPHNGHLLMANEVLYQAGLDEIWFMPNQIPPHKQNEDYTDSFHRVEMLK  61

Query:  98 LAIEGIDGLSIEPIEIERKGISYTYDTMKLLIEKNPDVDYYFIIGADMVEYLPKWHRIDE 157
           LAI+       +E +E+ER+G SYT+DT+ LL ++ P+    +FIIGADM+EYLPKW+++DE
Sbjct:  62 LAIQSNPSFKLELVEMEREGPSYTFDTVSLLKQRYPNDQLFFIIGADMIEYLPKWYKLDE 121

Query: 158 LVKMVQFVGVQRPKYKAGTSYPVIWVDLPLMDISSSMIRQFIKSNRQPNYLLPREVLDYI 217
           L+ ++QF+GV+RP +   T YP+++ D+P  ++SS+MIR+  KS +   +YL+P +V   Y+
Sbjct: 122 LLNLIQFIGVKRPGFHVETPYPLLFADVPEFEVSSTMIRERFKSKKPTDYLIPDKVKKYV 181

Query: 218 RKEGLYK                                                     224
           +  GLY+
Sbjct: 182 EENGLYE                                                     188
```

A related DNA sequence was identified in *S. pyogenes* <SEQ ID 5603> which encodes the amino acid sequence <SEQ ID 5604>. Analysis of this protein sequence reveals the following:

```
Possible site: 44
>>> Seems to have no N-terminal signal sequence

----- Final Results -----
bacterial cytoplasm --- Certainty = 0.4660 (Affirmative) < succ>
bacterial membrane  --- Certainty = 0.0000 (Not Clear)  < succ>
bacterial outside   --- Certainty = 0.0000 (Not Clear)  < succ>
```

An alignment of the GAS and GBS proteins is shown below.

```
Identities = 172/210 (81%), Positives = 196/210 (92%)
Query:  15 MALELLTPFTKVELEEKKRDTNRKQIGIMGGNFNPVHNAHLVVADQVRQQLCLDQVLLMP  74
           MALELLTPFTKVELEE+K+++NRKQIGI+GGNFNP+HNAHLVVADQVRQQL LDQVLLMP
Sbjct:   1 MALELLTPFTKVELEEEKKESNRKQIGILGGNFNPIHNAHLVVADQVRQQLGLDQVLLMP  60

Query:  75 EFQPPHIDKKETIDEQHRLKMLELAIEGIDGLSIEPIEIERKGISYTYDTMKLLIEKNPD 134
           E +PPH+D KETIDE+HRL+MLELAIE ++GL+IE   E+ER+GISYTYDTM  L E++PD
Sbjct:  61 ECKPPHVDAKETIDEKHRLRMLELAIEDVEGLAIETCELERQGISYTYDTMLYLTEQHPD 120
```

```
                          -continued
Query: 135 VDYYFIIGADMVEYLPKWHRIDELVKMVQFVGVQRPKYKAGTSYPVIWVDLPLMDISSSM 194
           VD+YFIIGADMV+YLPKWHRIDELVK+VQFVGVQRPKYKAGTSYPVIWVDLPL+DISSSM
Sbjct: 121 VDFYFIIGADMVDYLPKWHRIDELVKLVQFVGVQRPKYKAGTSYPVIWVDLPLIDISSSM 180

Query: 195 IRQFIKSNRQPNYLLPREVLDYIRKEGLYK                               224
           IR FIK RQPNYLLP+ VLDYI +EGLY+
Sbjct: 181 IRDFIKKGRQPNYLLPKRVLDYITQEGLYQ                               210
```

SEQ ID 5602 (GBS651) was expressed in *E. coli* as a GST-fusion product. SDS-PAGE analysis of total cell extract is shown in FIG. 132 (lane 8-10; MW 53.3 kDa) and in FIG. 186 (lane 8; MW 53 kDa). It was also expressed in *E. coli* as a His-fusion product. SDS-PAGE analysis of total cell extract is shown in FIG. 132 (lane 12; MW 28.4 kDa) and in FIG. 140 (lane 11; MW 20 kDa).

Purified GBS651-GST is shown in FIG. 243, lane 4; purified GBS651-His is shown in FIG. 229, lane 9.

Based on this analysis, it was predicted that these proteins and their epitopes could be useful antigens for vaccines or diagnostics.

EXAMPLE 1802

A DNA sequence (GBSx1909) was identified in *S. agalactiae* <SEQ ID 5605> which encodes the amino acid sequence <SEQ ID 5606>. Analysis of this protein sequence reveals the following:

```
Possible site: 32
>>> Seems to have no N-terminal signal sequence

----- Final Results -----
bacterial cytoplasm --- Certainty = 0.4281 (Affirmative) < succ>
bacterial membrane  --- Certainty = 0.0000 (Not Clear)   < succ>
bacterial outside   --- Certainty = 0.0000 (Not Clear)   < succ>
```

The protein has homology with the following sequences in the GENPEPT database.

```
>GP:CAB14505 GB:Z99117 similar to hypothetical proteins
[Bacillus subtilis]
Identities = 79/180 (43%), Positives = 115/180 (63%)

Query:   9 LDRTELLSKVRHMMSDKRFNHVLGVERAAIELAERYGYDKEKAGLAALLHDYAKELSDDE  68
           ++R E L+ V+  +++ R+ H +GV    AIELAER+G D +KA +AA+ HDYAK    +E
Sbjct:   1 MNREEALACVKQQLTEHRYIHTVGVMNTAIELAERFGADSKKAEIAAIFHDYAKFRPKEE  60

Query:  69 FLRLIDKYQPDPDLKKWGNNIWHGLVGIYKIQEDLAIKDQDILAAIAKHTVGSAQMSTLD 128
           ++I + +      L     +WH  VG Y +Q +  ++D+DIL AI  HT G   M+ L+
Sbjct:  61 MKQIIAREKMPAHLLDHNPELWHAPVGAYLVQREAGVQDEDILDAIRYHTSGRPGMTLLE 120

Query: 129 KIVYVADYIEHNRDFPGVEEARELAKVDLNKAVAYETARTVAFLASKAQPIYPKTIETYN 188
           K++YVADYIE NR FPGV+E R+LA+ DLN+A+      T+ FL  K QP++P T  TYN
Sbjct: 121 KVIYVADYIEPNRAFPGVDEVRKLAETDLNQALIQSIKNTMVFLMKKNQPVFPDTFLTYN 180
```

A related DNA sequence was identified in *S. pyogenes* <SEQ ID 5607> which encodes the amino acid sequence <SEQ ID 5608>. Analysis of this protein sequence reveals the following:

```
Possible site: 41
>>> Seems to have no N-terminal signal sequence

----- Final Results -----
bacterial cytoplasm --- Certainty = 0.2615 (Affirmative) < succ>
bacterial membrane  --- Certainty = 0.0000 (Not Clear)   < succ>
bacterial outside   --- Certainty = 0.0000 (Not Clear)   < succ>
```

An alignment of the GAS and GBS proteins is shown below.

```
Identities = 130/194 (67%), Positives = 159/194 (81%)

Query:    1 MTYKDYTGLDRTELLSKVRHMMSDKRFNHVLGVERAAIELAERYGYDKEKAGLAALLHDY  60
            MTY+DY    RTELL+K+  MS KRF HVLGVE+AA+ LAE YG + +KAGLAALLHDY
Sbjct:    1 MTYEDYLPYSRTELLAKIAEQMSPKRFKHVLGVEKAALSLAECYGCNPDKAGLAALLHDY  60

Query:   61 AKELSDDEFLRLIDKYQPDPDLKKWGNNIWHGLVGIYKIQEDLAIKDQDILAAIAKHTVG 120
            AKE  D  FL LIDKYQ  P+L KW NN+WHG+VGIYKIQEDL +KD+DIL AI  HTVG
Sbjct:   61 AKECPDQVFLDLIDKYQLSPELAKWNNNVWHGMVGIYKIQEDLGLKDKDILRAIEIHTVG 120

Query:  121 SAQMSTLDKIVYVADYIEHNRDFPGVEEARELAKVDLNKAVAYETARTVAFLASKAQPIY 180
            +A+M+ LDK++YVADYIE  R FP V++AR++AK+DLN+AVAYET  TVA+LASKAQPI+
Sbjct:  121 AAEMTLLDKVLYVADYIEEGRIFPLVDDARKIAKLDLNQAVAYETVNTVAYLASKAQPIF 180

Query:  181 PKTIETYNAYIPYL                                                194
            P+T++TYNA+  YL
Sbjct:  181 PQTLDTYNAFCSYL                                                194
```

Based on this analysis, it was predicted that these proteins and their epitopes could be useful antigens for vaccines or diagnostics.

EXAMPLE 1803

A DNA sequence (GBSx1910) was identified in *S. agalactiae* <SEQ ID 5609> which encodes the amino acid sequence <SEQ ID 5610>. Analysis of this protein sequence reveals the following:

```
Possible site: 56
>>> Seems to have an uncleavable N-term signal seq
INTEGRAL  Likelihood = -2.34   Transmembrane  12-28    (10-28)

----- Final Results -----
bacterial membrane --- Certainty = 0.1935 (Affirmative) < succ>
bacterial outside  --- Certainty = 0.0000 (Not Clear)  < succ>
bacterial cytoplasm --- Certainty = 0.0000 (Not Clear)  < succ>
```

A related GBS nucleic acid sequence <SEQ ID 10087> which encodes amino acid sequence <SEQ ID 10088> was also identified.

The protein has homology with the following sequences in the GENPEPT database.

```
>GP:AAG19496 GB:AE005041 Vng1100c
[Halobacterium sp. NRC-1]
Identities = 46/175 (26%), Positives = 82/175 (46%), Gaps = 12/175 (6%)

Query:   22 ALLLIDIQQGIMDKK--PKHLTNFAVLLDDLLLSAKGSNCEVIWIRHHDKE----LPQGS  75
            AL+L+D QQG  D       ++ +   ++LL + + +   +  +RH+  E     L QG
Sbjct:    7 ALVLVDFQQGFADPAWGDRNNPDAEAHAEELLAAWRDAAAPIAHVRHNSTEATSPLRQGE  66

Query:   76 PQWEIWEQRHLVTHHKIIDKTYNSCFKDTHLHDYLQSKHISQLIMMGLQTEYCFDTSVKV 135
            P  +   +           K+ N  F DT L  +L+ +     L++ GL T++C  T+V++
Sbjct:   67 PGFAYTDGLAPAADEPEFVKSVNGAFVDTALEGWLRDRDTGSLVVCGLTTDHCVSTTVRM 126

Query:  136 AFEYGYDIFIPQGGHLTFDTPTLSGDSIKK---HYENIWHHR--FATMVAKDSLL      185
            A   G+D+ + +    T D  TL G+ +       H   + H R  FAT+    ++L
Sbjct:  127 ADNRGFDVTLVRDATATHDR-TLDGERLPPSVVHRTALAHLRGEFATLATTATVL      180
```

No corresponding DNA sequence was identified in *S. pyogenes*.

Figure 133:
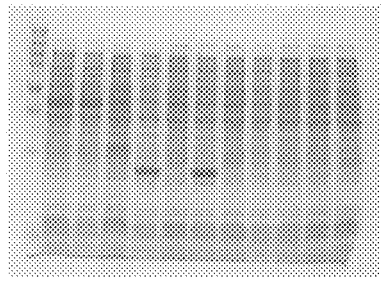

SEQ ID 5610 (GBS652) was expressed in *E. coli* as a GST-fusion product. SDS-PAGE analysis of total cell extract is shown in FIG. 133 (lane 2 & 3; MW 49.7 kDa)+lane 4; MW 27 kDa) and in FIG. 186 (lane 9; MW 50 kDa). It was also expressed in *E. coli* as a His-fusion product. SDS-PAGE analysis of total cell extract is shown in FIG. 133 (lane 5 & 7; MW 24.8 kDa) and in FIG. 178 (lane 10; MW 25 kDa). Purified GBS652-GST is shown in FIG. 243, lane 9; purified GBS652-His is shown in FIG. 229, lane 10.

Based on this analysis, it was predicted that this protein and its epitopes, could be useful antigens for vaccines or diagnostics.

EXAMPLE 1804

A DNA sequence (GBSx1911) was identified in *S. agalactiae* <SEQ ID 5611> which encodes the amino acid sequence <SEQ ID 5612>. Analysis of this protein sequence reveals the following:

```
Possible site: 34
>>> Seems to have no N-terminal signal sequence

----- Final Results -----
bacterial cytoplasm --- Certainty = 0.0945 (Affirmative) <succ>
 bacterial membrane --- Certainty = 0.0000 (Not Clear)   <succ>
  bacterial outside --- Certainty = 0.0000 (Not Clear)   <succ>
```

The protein has homology with the following sequences in the GENPEPT database.

```
>GP:CAB14504 GB:Z99117 similar to hypothetical proteins
[Bacillus subtilis]
Identities = 55/118 (46%), Positives = 82/118 (68%)

Query:  1 MTEKDLLQLVVKAADEKRAEDIVILDLQPVTSVADYFVIMSASNSRQLEAIADNIREQVK   60
          M +K +L++   A D+KRAEDI+ LD++ ++ VADYF+I   ++  +Q++AIA  I++Q
Sbjct:  1 MNQKSILKIAAAACDDKRAEDILALDMEGISLVADYFLICHGNSDKQVQAIAREIKDQAD   60

Query: 61 GNGGDASHLEGDSKAGWVLLDLNSVVVHIFSEDERQHYNLEKLWHEAPLLDAEVFMTE    118
             NG    +EG  +A WVL+DL  VVVH+F +DER +YNLEKLW +APL D +  M +
Sbjct: 61 ENGIQVKKMEGFDEARWVLVDLGDVVVHVFHKDERSYYNLEKLWGDAPLADLDFGMNQ    118
```

A related DNA sequence was identified in *S. pyogenes* <SEQ ID 5613> which encodes the amino acid sequence <SEQ ID 5614>. Analysis of this protein sequence reveals the following:

```
Possible site: 50
>>> Seems to have no N-terminal signal sequence
INTEGRAL    Likelihood = -0.69   Transmembrane 91-107 (91-107)

----- Final Results -----
 bacterial membrane --- Certainty = 0.1277 (Affirmative) <succ>
  bacterial outside --- Certainty = 0.0000 (Not Clear)   <succ>
bacterial cytoplasm --- Certainty = 0.0000 (Not Clear)   <succ>
```

The protein has homology with the following sequences in the databases:

```
>GP:CAB14504 GB:Z99117 similar to hypothetical proteins
[Bacillus subtilis]
Identities = 55/113 (48%), Positives = 80/113 (70%)

Query: 17 MKKEELLKIVVEATEEKRAKDILALDLEGLTSLTDYFVIASATNSRQLEAIADNIREKVK    76
          M ++ +LKI   A ++KRA+DILALD+EG++ + DYF+I     + +Q++AIA   I+++
Sbjct:  1 MNQKSILKIAAAACDDKRAEDILALDMEGISLVADYFLICHGNSDKQVQAIAREIKDQAD   60

Query: 77 EAGGDASHVEGNSQAGWVLLDLTDVVVHLFLEDERYHYNLEKLWHEAPAVALD        129
          E G     +EG  +A WVL+DL DVVVH+F +DER +YNLEKLW +AP    LD
Sbjct: 61 ENGIQVKKMEGFDEARWVLVDLGDVVVHVFHKDERSYYNLEKLWGDAPLADLD        113
```

An alignment of the GAS and GBS proteins is shown below.

```
Identities = 78/116 (67%), Positives = 100/116 (85%)
Query:  1 MTEKDLLQLVVKAADEKRAEDIVILDLQPVTSVADYFVIMSASNSRQLEAIADNIREQVK   60
          M +++LL++VV+A +EKRA+DI+ LDL+ +TS+ DYFVI  SA+NSRQLEAIADNIRE+VK
Sbjct: 17 MKKEELLKIVVEATEEKRAKDILALDLEGLTSLTDYFVIASATNSRQLEAIADNIREKVK   76

Query: 61 GNGGDASHLSGDSKAGWVLLDLNSVVVHIFSEDERQHYNLEKLWHEAPLLDAEVFM      116
             GGDASH+EG+S+AGWVLLDL  VVVH+F EDER HYNLEKLWHEAP  + + ++
Sbjct: 77 EAGGDASHVEGNSQAGWVLLDLTDVVVHLFLEDERYHYNLEKLWHEAPAVALDAYL      132
```

Based on this analysis, it was predicted that these proteins and their epitopes could be useful antigens for vaccines or diagnostics.

EXAMPLE 1805

A DNA sequence (GBSx1912) was identified in *S. agalactiae* <SEQ ID 5615> which encodes the amino acid sequence <SEQ ID 5616>. Analysis of this protein sequence reveals the following:

```
Possible site: 19
>>> Seems to have no N-terminal signal sequence

----- Final Results -----
bacterial cytoplasm --- Certainty = 0.2415 (Affirmative) <succ>
 bacterial membrane --- Certainty = 0.0000 (Not Clear)   <succ>
  bacterial outside --- Certainty = 0.0000 (Not Clear)   <succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1806

A DNA sequence (GBSx1913) was identified in *S. agalactiae* <SEQ ID 5617> which encodes the amino acid sequence <SEQ ID 5618>. Analysis of this protein sequence reveals the following:

```
Possible site: 21
>>> Seems to have no N-terminal signal sequence

----- Final Results -----
bacterial cytoplasm --- Certainty = 0.1570 (Affirmative) <succ>
 bacterial membrane --- Certainty = 0.0000 (Not Clear)   <succ>
  bacterial outside --- Certainty = 0.0000 (Not Clear)   <succ>
```

The protein has homology with the following sequences in the GENPEPT database.

```
>GP:CAB14503 GB:Z99117 similar to hypothetical proteins [Bacillus subtilis]
Identities = 86/242 (35%), Positives = 154/242 (63%), Gaps = 4/242 (1%)

Query:    4  YETFAAVYDAVMDDTLYAKWTDFSLRHFPKGKKKLLELACGTGIQSVRFAQAGYAVTGLD    63
             Y+ FA+VYD +M    Y +WT +     P+ K ++L+LACGTG   S+R A+ G+ VTG+D
Sbjct:    3  YQGFASVYDELMSHAPYDQWTKWIEASLPE-KGRILDLACGTGEISIRLAEKGFEVTGID    61

Query:   64  LSGDMLKLAKKRATSAHQSIQFIEGNMLDLSNV-GKYDLITCYSDSICYMQDEVEVGDVF   122
             LS +ML  A+++ +S+ Q I F++ +M +++    G++D +     DS+ Y++ + +V + F
Sbjct:   62  LSEEMLSFAQQKVSSS-QPILFLQQDMREITGFDGQFDAVVICCDSLNYLKTKNDVIETF   120

Query:  123  IEVYKALEENGVFIFDVHSTYQTDKVFPGYSYHENADDFAMVWDTYEDDAPHSIVHELTF   182
               V++ L+  G+ +FDVHS+++  +VFP  ++ +  +D + +W ++      S++H+++F
Sbjct:  121  KSVFRVLKPEGILLFDVHSSFKIAEVFPDSTFADQDEDISYIWQSFAGSDELSVIHDMSF   180

Query:  183  FVQEEDGRFTRHDEVHEERTYDILTYDILLEQAGFKDVKVYADFEDKKPTATSARWFFVA   242
             FV    + + R DE HE+RT+ +   Y+ +L+   GF+   +V ADF D +P+A S R   FF A
Sbjct:  181  FVWNGEA-YDRFDETHEQRTFPVEEYEEMLKNCGFQLHRVTADFTDTEPSAQSERLFFKA   239

Query:  243  HK                                                            244
              K
Sbjct:  240  QK                                                            241
```

A related DNA sequence was identified in *S. pyogenes* <SEQ ID 5619> which encodes the amino acid sequence <SEQ ID 5620>. Analysis of this protein sequence reveals the following:

```
Possible site: 53
>>> Seems to have no N-terminal signal sequence

----- Final Result -----
bacterial cytoplasm --- Certainty = 0.2315 (Affirmative) <succ>
 bacterial membrane --- Certainty = 0.0000 (Not Clear)   <succ>
  bacterial outside --- Certainty = 0.0000 (Not Clear)   <succ>
```

An alignment of the GAS and GBS proteins is shown below.

```
Identities = 191/243 (78%), Positives = 215/243 (87%), Gaps = 2/243 (0%)

Query:   4 YETFAAVYDAVMDDTLYAKWTDFSLRHFPK--GKKKLLELACGTGIQSVRFAQAGYAVTG   61
           YE FA+VYDAVMDD+LY  WTDFSLRH PK  G+ +LLELACGTGIQSVRFAQAG+ VTG
Sbjct:  21 YEKFASVYDAVMDDSLYDLWTDFSLRHLPKSKGRNRLLELACGTGIQSVRFAQAGFDVTG   80

Query:  62 LDLSGDMLKLAKKRATSAHQSIQFIEGNMLDLSNVGKYDLITCYSDSICYMQDEVEVGDV  121
           LDLS DML +AKKRA SA + I FI+GNMLDLS VG++D +TCYSDSICYMQDEV+VGDV
Sbjct:  81 LDLSQDMLAIAKKRAQSAKKKIDFIQGNMLDLSQVGQFDFVTCYSDSICYMQDEVDVGDV  140

Query: 122 FIEVYKALEENGVFIFDVHSTYQTDKVFPGYSYHENADDFAMVWDTYEDDAPHSIVHELT  181
           F EVY  L  +G+FIFDVHSTYQTD+ FPGYSYHENADDFAMVWDTY D+APHS+VHELT
Sbjct: 141 FKEVYDVLANDGIFIFDVHSTYQTDECEPGYSYHENADDFAMVWDTYADEAPHSVVHELT  200

Query: 182 FFVQEEDGRFTRHDEVHEERTYDILTYDILLEQAGFKDVKVYADFEDKKPTATSARWFFV  241
           FF+QE+DGRF+R DEVHEERTY++LTYDILLEQAGFK  KVYADFEDK+PT TS RWFFV
Sbjct: 201 FFIQEDDGRFSRFDEVHEERTYELLTYDILLEQAGFKSFKVYADFEDKEPTKTSKRWFFV  260

Query: 242 AHK                                                          244
           A+K
Sbjct: 261 AYK                                                          263
```

Based on this analysis, it was predicted that these proteins and their epitopes could be useful antigens for vaccines or diagnostics.

EXAMPLE 1807

A DNA sequence (GBSx1914) was identified in *S. agalactiae* <SEQ ID 5621> which encodes the amino acid sequence <SEQ ID 5622>. Analysis of this protein sequence reveals the following:

```
Possible site: 54
>>> Seems to have no N-terminal signal sequence

----- Final Results -----
bacterial cytoplasm --- Certainty = 0.3538 (Affirmative) <succ>
 bacterial membrane --- Certainty = 0.0000 (Not Clear)   <succ>
  bacterial outside --- Certainty = 0.0000 (Not Clear)   <succ>
```

The protein has homology with the following sequences in the GENPEPT database.

```
>GP:BAB06304 GB:AP001516 unknown conserved protein [Bacillus halodurans]
 Identities = 129/367 (35%), Positives = 184/367 (49%), Gaps = 45/367 (12%)

Query:   1 MTVTGIVAEFNPFHNGHKYLLEQAQ-----GIKVIAMSGNFMQRGEPAIVDKWTRSQMAL   55
           M   G+V E+NPFHNGH + L +A+      + + MSG F+QRGEPAI+ KW R+ +AL
Sbjct:   1 MKAVGVVVEYNPFHNGHLHHLTEARKQAKADVVIAVMSGYFLQRGEPAILPKWERTSLAL   60

Query:  56 ENGADLVIELPFLVSVQSADYFASGAVSILARLGVDNLCFGTEE--MLDYARIGDIYVNK  113
           + GADLV+ELP+   S Q A++FA+GAVSILA L  D LCFG+EE  +  + R+
Sbjct:  61 QGGADLVVELPYAFSTQKAEWFATGAVSILAALEADALCFGSEEGTIEPFHRLYHFMAKH  120
```

-continued

```
Query: 114  KEEMEAFLKKQSD-SLSYPQKMQAMWQEFAGIT--FSGQTPNHILGLAYTKAA--SQNGI  168
            +   +  +K++ D +SYP      ++   G      PN+ILG  Y KA       I
Sbjct: 121  RLAWDRMIKEELDKGMSYPTATSLAFKRLEGSAEHDLSRPNNILGFHYVKAIYDLHTSI  180

Query: 169  RLNPIQRQGAGYHSSEKTE-IFASATSLRK--------HQSDRFF------VEKGMPNSD  213
            +   I R  AGYH    E   ASATS+RK           DR         + K
Sbjct: 181  KAMTIPRIKAGYHDDSLNESSIASATSIRKSLKTKEGWQMVDRVVPSYTTEMLRSFEKET  240

Query: 214  LFLNSPQVVWQDYFSLLKYQIMTHS--DLTQIYQVNEEIANRIKSQIRYVETVDELVDKV  271
             FL S    W+  F LLKY+++T +  L  IY+ E + R   I   + + + K+
Sbjct: 241  TFLPS----WERLFPLLKYRLLTATPEQLHAIYEGEEGLEYRALKTIVSATSFHDWMTKM  296

Query: 272  ATKRYTKARIRRLLTYILINAVESPIPNA---------IHVLGFTQKGQQHLKSVKK--  319
            TKRYT  RI+R T++ N  + I +           I +LG T +GQ +L   KK
Sbjct: 297  KTKRYTWTRIQRYATHLFTNTTKEEIHSVLPRGTSSLPYIRLLGMTSRGQMYLNGKKKQL  356

Query: 320  SVDIVTR  326
            +   ++TR
Sbjct: 357  TTPVITR  363
```

A related DNA sequence was identified in *S. pyogenes* <SEQ ID 5623> which encodes the amino acid sequence <SEQ ID 5624>. Analysis of this protein sequence reveals the following:

```
Possible site: 33
>>> Seems to have no N-terminal signal sequence

----- Final Results ------
            bacterial cytoplasm --- Certainty = 0.3165(Affirmative) < succ>
            bacterial membrane  --- Certainty = 0.0000(Not Clear)  < succ>
             bacterial outside  --- Certainty = 0.0000(Not Clear)  < succ>
```

An alignment of the GAS and GBS proteins is shown below.

```
 Identities = 221/359 (61%), Positives = 288/359 (79%)

Query:   1  MTVTGIVAEFNPFHNGHKYLLEQAQGIKVIAMSGNFMQRGEPAIVDKWTRSQMALENGAD  60
            MTVTGI+AEFNPFHNGHKYLLE A+G+K+IAMSGNFMQRGEPA++DKW RS+MAL+NGAD
Sbjct:   1  MTVTGIIAEFNPFHNGHKYLLETAEGLKIIAMSGNFMQRGEPALIDKWIRSEMALKNGAD  60

Query:  61  LVIELPFLVSVQSADYFASGAVSILARLGVDNLCFGTEEMLDYARIGDIYVNKKEEMEAF  120
            +V+ELPF VSVQSADYFA GA+ IL +LG+  L FGTE ++DY ++  Y  K E+M A+
Sbjct:  61  IVVELPFFVSVQSADYFAQGAIDILCQLGIQQLAFGTENVIDYQKLIKVYEKKSEQMTAY  120

Query: 121  LKKQSDSLSYPQKMQAMWQEFAGITFSGQTPNHILGLAYTKAASQNGIRLNPIQRQGAGY  180
            L    D+ SYPQK Q MW+ FAG+ FSGQTPNHILGL+Y KA++   I+L PI+RQGA Y
Sbjct: 121  LSTLEDTFSYPQKTQKMWEIFAGVKFSGQTPNHILGLSYAKASAGKHIQLCPIKRQGAAY  180

Query: 181  HSSEKTEIFASATSLRKHQSDRFFVEKGMPNSDLFLNSPQVVWQDYFSLLKYQIMTHSDL  240
            HS +K  + ASA+++R+H +D  F+     +PN+ L +N+P  W    YFS LKYQI+ HSDL
Sbjct: 181  HSKDKNHLLASASAIRQHLNDWDFISHSVPNAGLLINNPHMSWDHYFSFLKYQILNHSDL  240

Query: 241  TQIYQVNEEIANRIKSQIRYVETVDELVDKVATKRYTKARIRRLLTYILINAVESPIPNA  300
            T I+QVN+E+A+RIK  I+   + +D LVD VATKRYTKAR+RR LTYIL+NA E   +P
Sbjct: 241  TSIFQVNDELASRIKKAIKVSQNIDHLVDTVATKRYTKARVRRILTYILVNAKEPTLPKG  300

Query: 301  IHVLGFTQKGQQHLKSVKKSVDIVTRIGSQTWDSLTQRADSVYQMGNANIAEQTWGRIP  359
            IH+LGFT KGQ HLK +KKS  ++TRIG++TWD +TQ+ADS+YQ+G+ +I EQ++GRIP
Sbjct: 301  IHILGFTSKGQAHLKKLKKSRPLITRIGAETWDEMTQKADSIYQLGHQDIPEQSFGRIP  359
```

Based on this analysis, it was predicted that these proteins and their epitopes could be useful antigens for vaccines or diagnostics.

EXAMPLE 1808

A DNA sequence (GBSx1915) was identified in *S. agalactiae* <SEQ ID 5625> which encodes the amino acid sequence <SEQ ID 5626>. This protein is predicted to be transcriptional activator tipa. Analysis of this protein sequence reveals the following:

```
Possible site: 17
>>> Seems to have no N-terminal signal sequence

----- Final Results -----
              bacterial cytoplasm --- Certainty = 0.3117(Affirmative) < succ>
               bacterial membrane --- Certainty = 0.0000(Not Clear)   < succ>
                 bacterial outside --- Certainty = 0.0000(Not Clear)   < succ>
```

The protein has homology with the following sequences in the GENPEPT database.

```
>GP:CAB15677 GB:Z99122 transcriptional regulator [Bacillus subtilis]
 Identities = 91/246 (36%), Positives = 144/246 (57%), Gaps = 14/246 (5%)

Query:    4 VKEISHISGISVRTLHYYDEIDLLSPSFVGENGYRYYDDESLIKLQEILLFKELEFPLKK   63
            VK+++ ISG+S+RTLH+YD I+LL+PS + + GYR Y D  L +LQ+IL FKE+ F L +
Sbjct:    5 VKQVAEISGVSIRTLHHYDNIELLNPSALTDAGYRLYSDADLERLQQILFFKEIGFRLDE   64

Query:   64 IKEIMDSPNYDRNQALLDQIRWLELKKQRLEEVIEHAK----SIQRGKNMSD---FTAYN  116
            IKE++D PN+DR  AL Q   L KKQR++E+I+         S+  G+ M+     F  +
Sbjct:   65 IKEMLDHPNFDRKAALQSQKEILMKKKQRMDEMIQTIDRTLLSVDGGETMNKRDLFAGLS  124

Query:  117 QEELEAFQ----EEARTRWGD--TDSYKEFENSHSKNDFSMISQAMSQIFKDFGQLKELS  170
             +++E Q    +E R +G   + ++ +++S +D+ I      I++       +
Sbjct:  125 MKDIEEHQQTYADEVRKLYGKEIAEETEKRTSAYSADDWRTIMAEFDSIYRRIAARMKHG  184

Query:  171 PTDEKVQKQVQILQDYITAQFYNCTNDLLASLGIMYIQDERFQKSIDNWGGQGTALFVSK  230
            P D ++Q  V  +D+I    Y+CT D+   LG +YI DERF  SI+ + G+G A F+ +
Sbjct:  185 PDDAEIQAAVGAFRDHICQYHYDCTLDIFRGLGEVYITDERFTDSINQY-GEGLAAFLRE  243

Query:  231 AIDSYC                                                       236
            AI  YC
Sbjct:  244 AIIIYC                                                       249
```

There is also homology to SEQ ID 1712.

Based on this analysis, it was predicted that this protein and its epitopes, could be useful antigens for vaccines or diagnostics.

EXAMPLE 1809

A DNA sequence (GBSx1916) was identified in *S. agalactiae* <SEQ ID 5627> which encodes the amino acid sequence <SEQ ID 5628>. Analysis of this protein sequence reveals the following:

```
Possible site: 39
>>> Seems to have no N-terminal signal sequence

----- Final Results -----
              bacterial cytoplasm --- Certainty = 0.2590(Affirmative) < succ>
               bacterial membrane --- Certainty = 0.0000(Not Clear)   < succ>
                 bacterial outside --- Certainty = 0.0000(Not Clear)   < succ>
```

The protein has homology with the following sequences in the GENPEPT database.

```
>GP:CAB14597 GB:Z99117 yrkC [Bacillus subtilis]
 Identities = 56/129 (43%), Positives = 74/129 (56%), Gaps = 7/129 (5%)

Query:   2  KGFHGNIEKLTLGNTNFRQVLYTAEHCQLVLMTLPVGGEIGSEIHAENDQFFRFEAGHGK    61
            K F  NI + T  N  FR  L+T +H Q+ LM+L +G +IG EIH   DQF R EG  G
Sbjct:  59  KPFVVNINRATKQNNTFRTALWTGKHFQVTLMSLGIGEDIGLEIHPNVDQFLRIEQGRGI   118

Query:  62  VVIDGN------EYEVADGDAIIVPAGAEHNVINTSETEMLKLYTIYSPAHHKDGIIRAT   115
            V + +         + V D AI+VPAG  HNVINT   T   LKLY+IY+P +H  G +  T
Sbjct: 119  VKMGKSKDHLNFQRNVYDDSAIVVPAGTWHNVINTGNTP-LKLYSIYAPPNHPFGTVHET   177

Query: 116  REEAEENEE                                                    124
            + +A   E+
Sbjct: 178  KADAVAAED                                                    186
```

No corresponding DNA sequence was identified in *S. pyogenes*.

Based on this analysis, it was predicted that this protein and its epitopes, could be useful antigens for vaccines or diagnostics.

EXAMPLE 1810

A DNA sequence (GBSx1917) was identified in *S. agalactiae* <SEQ ID 5629> which encodes the amino acid sequence <SEQ ID 5630>. This protein is predicted to be glycerol uptake facilitator (glpF). Analysis of this protein sequence reveals the following:

```
Possible site: 61
>>>> Seems to have an uncleavable N-term signal seq
    INTEGRAL      Likelihood = -9.08     Transmembrane   156-172    (153-180)
    INTEGRAL      Likelihood = -6.21     Transmembrane   135-151    (132-155)
    INTEGRAL      Likelihood = -4.09     Transmembrane    86-102     (80-103)
    INTEGRAL      Likelihood = -3.93     Transmembrane   213-229    (212-230)
    INTEGRAL      Likelihood = -3.72     Transmembrane     8-24       (5-28)
    INTEGRAL      Likelihood = -2.76     Transmembrane    38-54      (36-58)

----- Final Results -----
            bacterial membrane --- Certainty = 0.4630(Affirmative) < succ>
             bacterial outside --- Certainty = 0.0000(Not Clear)   < succ>
            bacterial cytoplasm --- Certainty = 0.0000(Not Clear)  < succ>
```

The protein has homology with the following sequences in the GENPEPT database.

```
>GP:BAB04811 GB:AP001510 glycerol uptake facilitator [Bacillus halodurans]
 Identities = 135/230 (58%), Positives = 171/230 (73%)

Query:   1  MTQFLGEFLGTFILVLLGDGVVAGNVLSKTKEEGTGWTAIVFGWGIACTVAVYVSGLFSP    60
            M+ FLGE +GT IL++LG GVVAG VL  K E GW   I   WG+A  AVY   G  S
Sbjct:   1  MSPFLGEVIGTMILIILGGGVVAGVVLKGTKSENGGWIVITAAWGLAVATAVYCVGQISG    60

Query:  61  AHLNPAVTLAMASIGAISWGQVIPFIIAQMLGAMVAATILWLHYYPHWKETKDSGLILAS   120
            AHLNPAVT+ +A +GA   W QV  +I+AQMLGAM+ AT+++LHYYPH+K T+D G  LA
Sbjct:  61  AHLNPAVTIGLALVGAFEWSQVAGYIVAQMLGAMIGATLVFLHYYPHFKATEDQGAKLAV   120

Query: 121  FSTGPAIRHTPSNLLGEIIGTAILVITIMAIGPSKVAAGLGPIIVGIVIFAVGFSLDPTT   180
            FST PAI+H P+N   E++GT +LV+ I+AIG ++   GL P+IVG++I  +G SL  TT
Sbjct: 121  FSTDPAIKHLPANFFSEVLGTFVLVLGILAIGANEFTEGLNPLIVGLLIVVIGLSLGGTT   180

Query: 181  GYAINPARDLGPRLMHAILPIEHKGNSDWSYAWIPVVGPIIGGVLGAILY             230
            GYAINPARDLGPR+ H +LPI  KG+S+WSYAWIP+VGFIIGG +GA+ Y
Sbjct: 181  GYAINPARDLGPRIAHFLLPIPGKGSSNWSYAWIPIVGPIIGGGIGALTY             230
```

There is also homology to SEQ ID 2854.

Based on this analysis, it was predicted that this protein and its epitopes, could be useful antigens for vaccines or diagnostics.

EXAMPLE 1811

A DNA sequence (GBSx1918) was identified in *S. agalactiae* <SEQ ID 5631> which encodes the amino acid sequence <SEQ ID 5632>. Analysis of this protein sequence reveals the following:

```
Possible site: 37
>>> Seems to have no N-terminal signal sequence

----- Final Results -----
          bacterial cytoplasm --- Certainty = 0.1694(Affirmative) < succ>
           bacterial membrane --- Certainty = 0.0000(Not Clear)   < succ>
            bacterial outside --- Certainty = 0.0000(Not Clear)   < succ>
```

The protein has homology with the following sequences in the GENPEPT database.

```
>GP: BAB07114 GB: AP001518 unknown conserved protein in others
[Bacillus halodurans]
Identities = 64/118 (54%), Positives = 85/118 (71%)

Query:   5 GIIVVSHSKNIAQGVVDLISEVAKDVSITYVGGTEDGEIGTSFDQVQQIVEQNDKKTLLA    64
           GI++ SH   +A+G+V L+ E AKDVSITY GGT+D ++G SF+++QQ V   N+    L
Sbjct:   7 GIVISSHVPALAEGIVTLLKEAAKDVSITYAGGTDDDQVGASFEKIQQAVMDNEADELFV   66

Query:  65 FFDLGSAKMNLELVADFSEKNIIINSVPVVEGAYTAAALLQAGADLDSIQSQLAELTI    122
           F+DLGSAKMN+E+V + SEK I +  V +VEGAYTAAAL Q GA  ++I   QL   LTI
Sbjct:  67 FYDLGSAKMNVEMVMELSEKTIHLMDVALVEGAYTAAALTQGGASFETIMEQLQPLTI   124
```

No corresponding DNA sequence was identified in *S. pyogenes*.

Based on this analysis, it was predicted that this protein and its epitopes, could be useful antigens for vaccines or diagnostics.

EXAMPLE 1812

A DNA sequence (GBSx1919) was identified in *S. agalactiae* <SEQ ID 5633> which encodes the amino acid sequence <SEQ ID 5634>. Analysis of this protein sequence reveals the following:

```
Possible site: 59
>>> Seems to have no N-terminal signal sequence

----- Final Results -----
          bacterial cytoplasm --- Certainty = 0.4753 (Affirmative) < succ>
           bacterial membrane --- Certainty = 0.0000 (Not Clear)   < succ>
            bacterial outside --- Certainty = 0.0000 (Not Clear)   < succ>
```

The protein has homology with the following sequences in the GENPEPT database.

```
>GP: BAB07115 GB: AP001518 unknown conserved protein in others
[Bacillus halodurans]
Identities = 98/190 (51%), Positives = 135/190 (70%), Gaps = 2/190 (1%)

Query:   3 VKTAIEWMHTFNQKIQSNKDYLSELDTPIGDGDHGGNMARGMTAVIENLDNNEFSSAADV    62
           V+   +W+H F++K+Q+N+ YLSELD+ IGDGDHG NMARG+  V   L  N F S  +V
Sbjct:   4 VENTTKWLHAFHEKVQANQSYLSELDSAIGDGDHGTNMARGLAEVERKLKENLFESPQEV   63

Query:  63 FKTVSMQLLSKVGGASGPLYGSAFMGITK-AEQSKSTISEALGAGLEMIQKRGKAELNEK   121
           K  +M L+SK GGASGPLYG+A + +K       I +++ AGL  I  KRGKA    EK
Sbjct:  64 LKMAAMALISKTGGASGPLYGTALLEMSKQVANDPQNIGKSIEAGLNGILKRGKATTGEK   123
```

```
-continued
Query:  122 TMVDVWHGVIEAI-EKNELTEDRIDSLVDATKGMKATKGRASYVGERSVGHIDPGSFSSG  180
            TMVD+W  V+E++  + +L+++RI    V  TK MKATKGRASY+GERS+GH+DPG+ SSG
Sbjct:  124 TMVDIWKPVVESLMAEQQLSKERIQQFVSETKEMKATKGRASYLGERSLGHLDPGAVSSG  183

Query:  181 LLFKALLEVG                                                   190
            LF+A+++ G
Sbjct:  184 YLFEAMIDGG                                                   193
```

Based on this analysis, it was predicted that this protein and its epitopes, could be useful antigens for vaccines or diagnostics.

EXAMPLE 1813

A DNA sequence (GBSx1920) was identified in *S. agalactiae* <SEQ ID 5637> which encodes the amino acid sequence <SEQ ID 5638>. This protein is predicted to be dihydroxyacetone kinase (b1200). Analysis of this protein sequence reveals the following:

```
Possible site: 59
>>> Seems to have no N-terminal signal sequence

----- Final Results -----
            bacterial cytoplasm --- Certainty = 0.2080(Affirmative) < succ>
            bacterial membrane  --- Certainty = 0.0000(Not Clear)   < succ>
            bacterial outside   --- Certainty = 0.0000(Not Clear)   < succ>
```

The protein has homology with the following sequences in the GENPEPT database.

```
>GP: BAB07116 GB: AP001518 dihydroxyacetone kinase [Bacillus halodurans]
Identities = 204/329 (62%), Positives = 261/329 (79%)

Query:    1 MKKILNQPTDVVTEMLDGLAYVHNDLVHRIEGFDIIARNEEKSGKVALISGGGSGHEPSH   60
            MKKILN P +V+ EMLDG  Y +   LV R+ G  +I R   E   GKVAL+SGGGSGHEPSH
Sbjct:    1 MKKILNDPQNVLDEMLDGFVYANGHLVERVAGTGVIRRTYEDKGKVALVSGGGSGHEPSH   60

Query:   61 AGFVGEGMLSAAVCGAVFTSPTPDQVLEAIKEADEGAGVFMVIKNYSGDIMNFEMAQDMA  120
            AGFVG+GMLSAAVCG VFTSPTPDQ+  E  IK AD+G GV ++IKNY+GD+MNFEMA +MA
Sbjct:   61 AGFVGQGMLSAAVCGEVFTSPTPDQIFEGIKAADQGGGVLLIIKNYTGDVMNFEMAGEMA  120

Query:  121 EMEGIEVASVVVDDDIAVEDSLYTQGKRGVAGTILVHKILGHAARHGKSLQEIKAIADEL  180
            E EGI V   ++V+DDIAVEDS +T G+RGVAGTI+VHKI+G AA    G SLQ +K + + +
Sbjct:  121 EAEGITVDHIIVNDDIAVEDSSFTAGRRGVAGTIIVHKIVGAAAEAGLSLQSLKVLGETV  180

Query:  181 VPNIHTVGLALSGATVPEVGKPGFVLAEDEIEFGIGIHGEPGYRKEKMQPSKALATELVD  240
            + N  T+G+++  ATVP VGKPGF L +DE+E+G+GIHGEPGYRKEK++ SK +A EL+
Sbjct:  181 IENTKTIGVSILPATVPAVGKPGFELGDDEMEYGVGIHGEPGYRKEKLKSSKEIAEELIL  240

Query:  241 KLIESFDAKSGEKYGVLINGMGATPLMEQYVFANDVAKLLEDKGIEVNYKKLGNYMTSID  300
            KL E+F     G+EYGVL+NG+GATPLMEQYVF NDVA  L  ++G+ +  +KK G++MTSID
Sbjct:  241 KLKEAFGWSEGDEYGVLVNGLGATPLMEQYVFMNDVANELTEEGLNIQFKKVGSFMTSID  300

Query:  301 MAGLSLTLIKLENQEWLEALNSDVTTIAW                                329
            MAG+SLTLIK+   ++WL+  N +V T+ W
Sbjct:  301 MAGVSLTLIKIVEEKWLDYWNHEVKTVDW                                329
```

No corresponding DNA sequence was identified in *S. pyogenes*.

Based on this analysis, it was predicted that this protein and its epitopes, could be useful antigens for vaccines or diagnostics.

EXAMPLE 1814

A DNA sequence (GBSx1921) was identified in *S. agalactiae* <SEQ ID 5639> which encodes the amino acid sequence <SEQ ID 5640>. Analysis of this protein sequence reveals the following:

```
Possible site: 23
>>> Seems to have no N-terminal signal sequence

----- Final Results -----
            bacterial cytoplasm --- Certainty = 0.1997(Affirmative) < succ>
             bacterial membrane --- Certainty = 0.0000(Not Clear)   < succ>
              bacterial outside --- Certainty = 0.0000(Not Clear)   < succ>
```

The protein has homology with the following sequences in the GENPEPT database.

```
>GP: BAB07113 GB: AP001518 unknown [Bacillus halodurans]
Identities = 59/142 (41%), Positives = 82/142 (57%), Gaps = 5/142 (3%)

Query:   1 MTSSLITKKKIAKSFKRLFISQAFDKISVSDIMEDAGIRRQTFYNHFVDKYALLEWIFQT    60
           MT+S+ITKK IAK+FK L   Q F KISVSDIM  A +RRQTFY HF DK+ LL WI++
Sbjct:   1 MTNSIITKKVIAKAFKDLMEVQPFSKISVSDIMNRANMRRQTFYYHFQDKFELLHWIYKQ    60

Query:  61 ELSEQVTDNLDYISGFQLLSELLTFFKMNQEFYIKLFQIEDQNDFSSYFESYCEQLVDKL   120
           E  E   D L Y    +   L+ +F  NQ FY +    + QN F+ Y   + + L
Sbjct:  61 ETKEHSIDFLAYDDIHTIFRHLMHYFYENQTFYQRAMVVNGQNGFTDYLYEHIQTL---Y   117

Query: 121 LSDYSKSNFNQKERVTFINYHS                                         142
           L++  +    +QK+R   +++S
Sbjct: 118 LNEIDRR--SQKDREFISSFYS                                         137
```

A related DNA sequence was identified in *S. pyogenes* <SEQ ID 5641> which encodes the amino acid sequence <SEQ ID 5642>. Analysis of this protein sequence reveals the following:

```
Possible site: 31
>>> Seems to have no N-terminal signal sequence

----- Final Results -----
            bacterial cytoplasm --- Certainty = 0.2101(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below.

```
Identities = 31/115 (26%), Positives = 58/115 (49%), Gaps = 6/115 (5%)

Query:   7 TKKKIAKSFKRLFISQAFDKISVSDIMEDAGIRRQTFYNHFVDKYALLEWIFQTELSEQV    66
           TK   +     L   Q+F+ ++VSD+ + AGI R TFY H+ DK+ ++    F+ +  + +
Sbjct:   8 TKAYVKTALTTLLTEQSFETLTVSDLTKKAGINRGTFYLHYTDKFDMMNH-FKNDTLDDL    66

Query:  67 TDNLD----YISGFQLLSELLTFFKMNQEFYIKLFQIEDQNDFSSYFESYCEQLV       117
           L+    Y    Q+L++ L++    ++EF   L  I    F    + +C Q +
Sbjct:  67 YRLLNQAEIYTDTRQVLNQTLSYLIEHREFITALATI-SYLKFPQLIKDFCYQFL       120
```

Based on this analysis, it was predicted that these proteins and their epitopes could be useful antigens for vaccines or diagnostics.

EXAMPLE 1815

A DNA sequence (GBSx1922) was identified in *S. agalactiae* <SEQ ID 5643> which encodes the amino acid sequence <SEQ ID 5644>. Analysis of this protein sequence reveals the following:

```
Possible site: 45
>>> Seems to have no N-terminal signal sequence

----- Final Results -----
            bacterial cytoplasm --- Certainty = 0.1974(Affirmative) < succ>
             bacterial membrane --- Certainty = 0.0000(Not Clear)   < succ>
              bacterial outside --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1816

A DNA sequence (GBSx1923) was identified in *S. agalactiae* <SEQ ID 5645> which encodes the amino acid sequence <SEQ ID 5646>. This protein is predicted to be dihydroxyacetone kinase (b1200). Analysis of this protein sequence reveals the following:

```
Possible site: 55
>>> Seems to have no N-terminal signal sequence

----- Final Results -----
            bacterial cytoplasm --- Certainty = 0.1806(Affirmative) < succ>
             bacterial membrane --- Certainty = 0.0000(Not Clear)   < succ>
              bacterial outside --- Certainty = 0.0000(Not Clear)   < succ>
```

The protein has homology with the following sequences in the GENPEPT database.

```
>GP: BAB07112 GB: AP001518 dihydroxyacetone kinase [Bacillus halodurans]
Identities = 141/285 (49%), Positives = 197/285 (68%), Gaps = 1/285 (0%)

Query:  45 IPILSGGGSGHEPAHFGYVGEGMLSAAISGPIFVPPCASDILETIRFINRGKGVFVIIKN 104
           +PI+SGGGSGHEP H GYVGEGML+AA+ G +FVPP A  +L IR +++GKGV +IIKN
Sbjct:  46 VPIISGGGSGHEPGHLGYVGEGMLAAAVHGDVFVPPSAQQVLAAIRQMDQGKGVLLIIKN 105

Query: 105 FEADLEEFSQAIEQARQEGIPIKYIVSHDDISVET-SNFKIRHRGVAGTVLLHKIIGQAA 163
           F ADL  F  A  QAR EG + +++ +DD+SVE+ ++F+ R RGVAG VL+HKIIG AA
Sbjct: 106 FVADLATFLSAEVQARAEGRDVAHVIVNDDVSVESDASFEKRRRGVAGAVLVHKIIGAAA 165

Query: 164 LEGASLDELEQLGLSLTTSMATLGVASKSATILGQHQPVFDIEEGYISFGIGIHGEPGYR 223
              EG SL+ L+++G  +  ++ATLGVA   A +  +P F  EEG + FG+GIHGE GYR
Sbjct: 166 KEGYSLEALQEIGEQVVKNLATLGVALTHADLPERREPQFLLEEGEVYFGVGIHGEQGYR 225

Query: 224 TMPFVSMEHLANELVNKLKMKLRWQDGEAFILLINNLGGSSKMEELLFTNAVMEFLALDD 283
              VS E LA ELVNKLK  RW  +  + +LIN LGG+  +E+  +F N V    LA+++
Sbjct: 226 KEKLVSSELLAVELVNKLKSLYRWDKNDQYAVLINGLGGTPLIEQYVFANDVRRLLAIEN 285

Query: 284 LQLPFIKTGHLITSLDMAGLSVTLCRVKDSRWIDYLKHKTDARAW                328
           L + F+R G  +TSL+M G+S+T+ ++  D +W+ +L    D     W
Sbjct: 286 LHVSFVKVGTQLTSLNMKGISLTMLKICDEQWVKWLYAPVDVAHW                330
```

No corresponding DNA sequence was identified in *S. pyogenes*.

Based on this analysis, it was predicted that this protein and its epitopes, could be useful antigens for vaccines or diagnostics.

EXAMPLE 1817

A DNA sequence (GBSx1924) was identified in *S. agalactiae* <SEQ ID 5647> which encodes the amino acid sequence <SEQ ID 5648>. Analysis of this protein sequence reveals the following:

```
Possible site: 53
>>> Seems to have no N-terminal signal sequence

----- Final Results -----
            bacterial cytoplasm --- Certainty = 0.3902(Affirmative) < succ>
            bacterial membrane  --- Certainty = 0.0000(Not Clear)   < succ>
             bacterial outside  --- Certainty = 0.0000(Not Clear)   < succ>
```

A related GBS nucleic acid sequence <SEQ ID 10085> which encodes amino acid sequence <SEQ ID 10086> was also identified.

The protein has homology with the following sequences in the GENPEPT database.

```
>GP: AAC75047 GB: AE000290 orf, hypothetical protein
[Escherichia coli K12]
Identities = 182/237 (76%), Positives = 201/237 (84%)

Query:  20 MGRKWANIVAKKTAKDGANSKVYAKFGVEIYVAAKQGEPDPESNSALKFVLDRAKQAQVP   79
           MGRKWANIVAKKTAKDGA SK+YAKFGVEIY AAKQGEPDPE N++LKFV++RAKQAQVP
Sbjct:   1 MGRKWANIVAKKTAKDGATSKIYAKFGVEIYAAAKQGEPDPELNTSLKFVIERAKQAQVP   60

Query:  80 KHVIDKAIDKAKGNTDETFVEGRYEGFGPNGSMIIVDTLTSNVNRTAANVRTAYGKNGGN  139
           KHVIDKAIDKAKG  DETFV+GRYEGFGPNGSMII +TLTSNVNRT ANVRT + K GGN
Sbjct:  61 KHVIDKAIDKAKGGGDETFVQGRYEGFGPNGSMIIAETLTSNVNRTIANVRTIFNKKGGN  120

Query: 140 MGASGSVSYLFDKKGVIVFAGDDADTVFEQLLEADVDVDDVEAEEGTITVYTAPTDLHKG  199
            +GA+GSVSY+FD  GVIVF G D D +FE LLEA+VDV DV  EEG I +YT PTDLHKG
Sbjct: 121 IGAAGSVSYMFDNTGVIVFKGTDPDHIFEILLEAEVDVRDVTEEEGNIVIYTEPTDLHKG  180

Query: 200 IQALRDNGVEEFQVTELEMIPQSEVVLEGDDLETFEKLIDALESDDDVQKVYHNVAD     256
           I AL+  G+ EF   TELEMI QSEV L  +DLE FE L+DALE DDDVQKVYHNVA+
Sbjct: 181 IAALKAAGITEFSTTELEMIAQSEVELSPEDLEIFEGLVDALEDDDDVQKVYHNVAN     237
```

A related DNA sequence was identified in *S. pyogenes* <SEQ ID 5649> which encodes the amino acid sequence <SEQ ID 5650>. Analysis of this protein sequence reveals the following:

```
Possible site: 34
>>> Seems to have no N-terminal signal sequence

----- Final Results -----
            bacterial cytoplasm --- Certainty = 0.2926(Affirmative) < succ>
            bacterial membrane  --- Certainty = 0.0000(Not Clear)   < succ>
             bacterial outside  --- Certainty = 0.0000(Not Clear)   < succ>
```

An alignment of the GAS and GBS proteins is shown below.

```
Identities = 233/238 (97%), Positives = 236/238 (98%)

Query:  20 MGRKWANIVAKKTAKDGANSKVYAKFGVEIYVAAKQGEPDPESNSALKFVLDRAKQAQVP   79
           MGRKWANIVAKKTAKDGA SKVYAKFGVEIYVAAKQGEPDPE N+ALKFV+DRAKQAQVP
Sbjct:   1 MGRKWANIVAKKTAKDGATSKVYAKFGVEIYVAAKQGEPDPELNTALKFVIDRAKQAQVP   60
```

```
                                  -continued
Query:   80 KHVIDKAIDKAKGNTDETFVEGRYEGFGPNGSMIIVDTLTSNVNRTAANVRTAYGKNGGN  139
            KHVIDKAIDKAKGNTDETFVEGRYEGFGPNGSMIIVDTLTSNVNRTAANVRTAYGKNGGN
Sbjct:   61 KHVIDKAIDKAKGNTDETFVEGRYEGFGPNGSMIIVDTLTSNVNRTAANVRTAYGKNGGN  120

Query:  140 MGASGSVSYLFDKKGVIVFAGDDADTVFEQLLEADVDVDDVEAEEGTITVYTAPTDLHKG  199
            MGASGSVSYLFDKKGVIVFAGDDAD+VFEQLLEADVDVDDVEAEEGTITVYTAPTDLHKG
Sbjct:  121 MGASGSVSYLFDKKGVIVFAGDDADSVFEQLLEADVDVDDVEAEEGTITVYTAPTDLHKG  180

Query:  200 IQALRDNGVEEFQVTELEMIPQSEVVLEGDDLETFEKLIDALESDDDVQKVYHNVADF    257
            IQALRDNGVEEFQVTELEMIPQSEVVLEGDDLETFEKLIDALESDDDVQKVYHNVADF
Sbjct:  181 IQALRDNGVEEFQVTELEMIPQSEVVLEGDDLETFEKLIDALESDDDVQKVYHNVADF    238
```

Based on this analysis, it was predicted that these proteins and their epitopes could be useful antigens for vaccines or diagnostics.

EXAMPLE 1818

A DNA sequence (GBSx1925) was identified in *S. agalactiae* <SEQ ID 5651> which encodes the amino acid sequence <SEQ ID 5652>. Analysis of this protein sequence reveals the following:

```
Possible site: 17
>>> Seems to have no N-terminal signal sequence

----- Final Results -----
          bacterial cytoplasm --- Certainty = 0.2507(Affirmative) < succ>
          bacterial membrane  --- Certainty = 0.0000(Not Clear)   < succ>
          bacterial outside   --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1819

A DNA sequence (GBSx1926) was identified in *S. agalactiae* <SEQ ID 5653> which encodes the amino acid sequence <SEQ ID 5654>. Analysis of this protein sequence reveals the following:

```
Possible site: 52
>>> Seems to have no N-terminal signal sequence

----- Final Results -----
          bacterial cytoplasm --- Certainty = 0.1523(Affirmative) < succ>
          bacterial membrane  --- Certainty = 0.0000(Not Clear)   < succ>
          bacterial outside   --- Certainty = 0.0000(Not Clear)   < succ>
```

The protein has homology with the following sequences in the GENPEPT database.

```
>GP: CAA20826 GB: AL031541 hypothetical protein SCI35.37 [Streptomyces
coelicolor A3(2)]
Identities = 73/178 (41%), Positives = 101/178 (56%), Gaps = 2/178 (1%)

Query:   35 VKNAGGLPVILPISEAESAKAYVEMIDKLIISGGQNVLPSYYGEEKIIESDDYSLARDIF   94
            V+ AGGL +LP    E A V +D ++I+GG +V P  YG E   +  + ARD +
Sbjct:   37 VQRAGGLAAMLPPDAPEHAAATVARVDGVVIAGGPDVEPVRYGAEPDPRTGPPARARDTW   96

Query:   95 EFALVEEALKQNKPIFAICRGMQLVNVALGGTLNQSIDNHYQEPYIGFAHYLNVEKGSFL  154
            E AL+E AL     P+  ICRGMQL+NVALGGTL Q I+ H +    H +     G+
Sbjct:   97 ELALIEAALAARVPLLGICRGMQLLNVALGGTLVQHIERHAEVVGVFGGHPVRPVPGTLY  156
```

```
                               -continued
Query: 155 EGFISGDFKINSLHRQSVKLLAEGLIVSARDPRDGTVEAYESRT-EQCIIGVQWHPEL    211
           G + + + + H Q+V  L  GL+ SA    DGTVEA E  +   ++GVQWHPE+
Sbjct: 157 AGAVPEETFVPTYHHQAVDRLGSGLVASAH-AADGTVEALEMPSGSGWVLGVQWHPEM    213
```

A related DNA sequence was identified in *S. pyogenes* <SEQ ID 5655> which encodes the amino acid sequence <SEQ ID 5656>. Analysis of this protein sequence reveals the following:

```
Possible site: 52
>>> Seems to have no N-terminal signal sequence

----- Final Results -----
              bacterial cytoplasm --- Certainty = 0.1210(Affirmative) < succ>
              bacterial membrane  --- Certainty = 0.0000(Not Clear)   < succ>
              bacterial outside   --- Certainty = 0.0000(Not Clear)   < succ>
```

An alignment of the GAS and GBS proteins is shown below.

```
 Identities = 111/230 (48%), Positives = 145/230 (62%), Gaps = 3/230 (1%)

Query:   2 LTKPIIGITGNEREMSDIPGYYYDSVSRHISEGVKNAGGLPVILPISEAESAKAYVEMID    61
           +TKPIIGIT N+R   +    +     + V +GGLP++LPI +  +AK YV M+D
Sbjct:   1 MTKPIIGITANQRLNMALDNLPWSYAPTGFVQAVTQSGGLPLLLPIGDEAAAKTYVSMVD    60

Query:  62 KLIISGGQNVLPSYYGEEKIIESDDYSLARDIFEFALVEEALKQNKPIFAICRGMQLVNV   121
           K+I+ GGQNV P YY EEK   DD+S  RD FE A+++EA+   KPI   ICRG QL+NV
Sbjct:  61 KIILIGGQNVDPKYYQEEKAAFDDDFSPERDTFELAIIKEAITLKKPILGICRGTQLMNV   120

Query: 122 ALGGTLNQSIDNHYQE-PYIGFAHYLNVEKGSFLEGFISGDFKINSLHRQSVKLLAEGLI   180
           ALGG LNQ ID+H+QE P   +H + +E  S L        INS HRQS+K +A+ L
Sbjct: 121 ALGGNLNQHIDSHWQEAPSDFLSHEMIIEPDSILYPIYGHKTLINSFHRQSLKTVAKDLK   180

Query: 181 VSARDPRDGTVEAYESRTEQC-IIGVQWHPELMLH-QIENQTLFGYFVNE             228
           V ARDPRDGT+EA  S +    +GVQWHPEL+  + E+  LF  FVN+
Sbjct: 181 VIARDPRDGTIEAVISTNDAIPFLGVQWHPELLQGVRDEDLQLFRLFVND             230
```

Based on this analysis, it was predicted that these proteins and their epitopes could be useful antigens for vaccines or diagnostics.

EXAMPLE 1820

A DNA sequence (GBSx1927) was identified in *S. agalactiae* <SEQ ID 5657> which encodes the amino acid sequence <SEQ ID 5658>. Analysis of this protein sequence reveals the following:

```
Possible site: 31
>>> Seems to have no N-terminal signal sequence

----- Final Results -----
              bacterial cytoplasm --- Certainty = 0.5794(Affirmative) < succ>
              bacterial membrane  --- Certainty = 0.0000(Not Clear)   < succ>
              bacterial outside   --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1821

A DNA sequence (GBSx1928) was identified in *S. agalactiae* <SEQ ID 5659> which encodes the amino acid sequence <SEQ ID 5660>. Analysis of this protein sequence reveals the following:

```
Possible site: 15
>>> Seems to have no N-terminal signal sequence

----- Final Results -----
              bacterial cytoplasm --- Certainty = 0.0524(Affirmative) < succ>
              bacterial membrane  --- Certainty = 0.0000(Not Clear)   < succ>
              bacterial outside   --- Certainty = 0.0000(Not Clear)   < succ>
```

A related GBS nucleic acid sequence <SEQ ID 8905> which encodes amino acid sequence <SEQ ID 8906> was also identified. Analysis of this protein sequence reveals the following:

```
Lipop: Possible site: 22 Crend: 4
McG: Discrim Score: 8.37
GvH: Signal Score (-7.5): 0.64
     Possible site: 21
>>> May be a lipoprotein
ALOM program    count: 0     value: 6.74 threshold: 0.0
   PERIPHERAL Likelihood = 6.74    112
 modified ALOM score: -1.85

*** Reasoning Step: 3

----- Final Results -----
              bacterial membrane --- Certainty = 0.0000(Not Clear) < succ>
                bacterial outside --- Certainty = 0.0000(Not Clear) < succ>
              bacterial cytoplasm --- Certainty = 0.0000(Not Clear)
```

A related DNA sequence was identified in *S. pyogenes* <SEQ ID 2919> which encodes the amino acid sequence <SEQ ID 2920>. Analysis of this protein sequence reveals the following:

```
Possible site: 21
>>> May be a lipoprotein

----- Final Results -----
              bacterial membrane --- Certainty = 0.0000(Not Clear) < succ>
                bacterial outside --- Certainty = 0.0000(Not Clear) < succ>
              bacterial cytoplasm --- Certainty = 0.0000(Not Clear) < succ>
```

An alignment of the GAS and GBS proteins is shown below.

```
 Identities = 120/162 (74%), Positives = 141/162 (86%), Gaps = 5/162 (3%)

Query:    6  LAACSSKSHTTKTGK----KEVNFATVGTTAPFSYVKDGKLTGFDIEVAKAVFKGSDNYK   61
             LAAC S S T ++G     KEV FATVGTTAPFSY K G+LTG+DIEVAKAVFKGSD+YK
SbjCt:   20  LAACGS-SKTAESGNQGSSKEVLFATVGTTAPFSYEKGGQLTGYDIEVAKAVFKGSDDYK   78

Query:   62  VTFKKTEWSSVFTGIDSGKFQMGGNNISYSSERSQKYLFSYPIGSTPSVLAVPKNSNIKA  121
             V+FKKTEWSS+FTG+DSGK+QMGGNNIS++ ERS KYLFSYPIGSTPSVL VPK+S+IK+
Sbjct:   79  VSFKKTEWSSIFTGLDSGKYQMGGNNISFTKERSAKYLFSYPIGSTPSVLVVPKDSDIKS  138

Query:  122  YNDISGHKTQVVQGTTTAKQLENFNKEHQKNPVTLKYTNENL                   163
             ++DI GH TQVVQGTT+  QLE+FNK+H  NPVTLK+TNEN+
Sbjct:  139  FDDIQGHTTQVVQGTTSVAQLEDFNKKHSONPVTLKFTNENI                   180
```

SEQ ID 8906 (GBS71) was expressed in *E. coli* as a His-fusion product. SDS-PAGE analysis of total cell extract is shown in FIG. 17 (lane 4; MW 31.8 kDa).

GBS71-His was purified as shown in FIG. 196, lane 7.

Based on this analysis, it was predicted that these proteins and their epitopes could be useful antigens for vaccines or diagnostics.

EXAMPLE 1822

A DNA sequence (GBSx1929) was identified in *S. agalactiae* <SEQ ID 5661> which encodes the amino acid sequence <SEQ ID 5662>. Analysis of this protein sequence reveals the following:

```
Possible site: 18
>>> Seems to have no N-terminal signal sequence

----- Final Results ------
              bacterial cytoplasm --- Certainty = 0.2179(Affirmative) < succ>
               bacterial membrane --- Certainty = 0.0000(Not Clear)    < succ>
                bacterial outside --- Certainty = 0.0000(Not Clear)    < succ>
```

The protein has no significant homology with any sequences in the GENPEPT database.
There is also homology to SEQ ID 2920:

```
Identities = 64/91 (70%), Positives = 78/91 (85%)

Query:   1  MSDGKADFKLFDGPTVNAIIRNQGLTNLKTIPLTMRDQPYIYFIFGQDQKDLQKYVNNRL   60
            +S+GKADFK+FD PTVNAIIKNQGL NLKTI LT  +QP+IYFIF QDQ+ LQ +VN R+
Sbjct: 187  LSEGKADFKIFDAPTVNAIIRNQGLDNLKTIELTSTEQPFIYFIFSQDQEKLQSFVNKRI   246

Query:  61  KQLRKDGTLSKIAKEYLGGDYVPNEKDLVTP                               91
            K+L  DGTLSK+AKE+LGGDYVP++K+L P
Sbjct: 247  KELTADGTLSKLAKEHLGGDYVPSDKELKLP                               277
```

Based on this analysis, it was predicted that this protein and its epitopes, could be useful antigens for vaccines or diagnostics.

EXAMPLE 1823

A DNA sequence (GBSx1930) was identified in *S. agalactiae* <SEQ ID 5663> which encodes the amino acid sequence <SEQ ID 5664>. This protein is predicted to be 28 kDa outer membrane protein (yaeC). Analysis of this protein sequence reveals the following:

```
Possible site: 41
>>> Seems to have no N-terminal signal sequence
      INTEGRAL     Likelihood = 1.44     Transmembrane    25-41       (25-42)

----- Final Results -----
              bacterial membrane --- Certainty = 0.1574(Affirmative) < succ>
               bacterial outside --- Certainty = 0.0000(Not Clear)   < succ>
              bacterial cytoplasm --- Certainty = 0.0000(Not Clear)   < succ>
```

The protein has homology with the following sequences in the GENPEPT database.

```
>GP:CAB59825 GB:AJ012388 hypothetical protein [Lactococcus lactis]
 Identities = 110/283 (38%), Positives = 175/283 (60%), Gaps = 13/283 (4%)

Query:  22  KLKHIVLGLALTTLLGV----TFSNQEVSASSTSSKVVKVGVMTFSDTEKARWDKIEKLV   77
            K ++I++ +A+ L+ +     + ++Q   +S   K VKVG+M+    ++ W +
Sbjct:   4  KNRNIIIAVAVLILVALVAFFSLNHQGGVKASAGEKTVKVGIMSGDKQDQEVWKSVANTA   63

Query:  78  GDK--AKIKETEFTDYTQPNQATANKDVDINAFQHYNFLENWNKENKKNLIPLEKTYLAP  135
             +K    K+KF  F+DY QPN+A   + D+DINAFQ YN+++ WNK +K +++ +   TY+ P
Sbjct:  64  KEKYDLKLKFVYFSDYNQPNEALLSGDIDINAFQSYNYVKTWNKAHKSDIVAVGNTYITP  123

Query: 136  IRIYSEKVKSLKKLKKGATIAIPNDATNGSRALYVLQSAGLIKLNVS-GKKVATVANITS  194
            + IYS+++  L  LK+G+T+AIPNDA+N SRAL+VLQSAGL+KL  S    K+   + +IT
Sbjct: 124  MHIYSKEISKLSDLKEGSTVAIPNDASNESRALFVLQSAGLLKLTTSDSSKLVGLPDITE  183

Query: 195  NKKDINIQELDASQTPRALKDVDAAIINNTYIEQANLKPSDAIFVEKSDKNSKQWINIIA  254
            N   +E+DASQTPPAL V   +++N Y   A+L  S+++F+E +K S Q+IN IA
Sbjct: 184  NPHQLKFKEVDASQTPRALDSVALSVVNYNYATAASLPKSESVFMEPLNKTSAQYINFIA  243

Query: 255  GRKNWKKQKNAKAIQAILDAYHTDEVKKVIKDTSAD---IPQW                  294
            K+KN K + +   AY +   +K IK+    D   +P W
Sbjct: 244  ---TTSKEKNNKVYKEVAKAYASKATEKAIKEQYPDGGELPAW                  283
```

There is also homology to SEQ ID 2132.

Based on this analysis, it was predicted that this protein and its epitopes, could be useful antigens for vaccines or diagnostics.

A related GBS gene <SEQ ID 8907> and protein <SEQ ID 8908> were also identified. Analysis of this protein sequence reveals the following:

```
Lipop: Possible site: -1 Crend: 4
McG: Discrim Score: 7.47
GVH: Signal Score (-7.5): -4.79
     Possible site: 21
>>> Seems to have an uncleavable N-term signal seq
ALOM program  count: 1  value: -1.44  threshold: 0.0
```

```
        INTEGRAL      Likelihood =  -1.44    Transmembrane      5-21       (5-22)
    PERIPHERAL Likelihood =  5.20     147
modified ALOM score: 0.79

*** Reasoning Step: 3

----- Final Results -----
               bacterial membrane --- Certainty = 0.1574(Affirmative) < succ>
                bacterial outside --- Certainty = 0.0000(Not Clear)   < succ>
              bacterial cytoplasm --- Certainty = 0.0000(Not Clear)   < succ>
```

The protein has homology with the following sequences in the databases:

```
40.6/63.1% over 279aa
Lactococcus lactis
GP|6165402|hypothetical protein Insert characterized ORF00442(364-1182 of 1482)
GP|6165402|emb|CAB59B25.1||AJ012388 (4-283 of 287) hypothetical protein
{Lactococcus lactis}
% Match = 21.0
% Identity = 40.6    % Similarity = 63.0
Matches = 112    Mismatches = 96    Conservative Sub.s = 62

162       192       222       252       282       312       342       372
WDTFKNS*RIPWR*LRTK*ERSRYS*GEVVIKTKEMSILSFLLYSLKL*QETVYNNLILITSYGIISLSQKLREFIMKLK
                                                                            | :
                                                                          MNPKNR 402             450       480       510       540       564       594
HIVLGLALTTLLG--VTFS--NQEVSASSTSSKVVKVGVMTFSDTEKARWDKIEKLVGDK--AKIKFTEFTDYTQPNQAT
: | : :  : | :      | :    |   | |||| |:         ::    |     :|   |: ||  |: || |||: |
NIIIAVAVLILVALVAFFSLNHQGGVKASAGEKTVKVGIMSGDKQDQEVWKSVANTAKEKYDLKLKFVYFSDYNQPNEAL
          20        30        40        50        60        70        80

624       654       684       714       744       774       804       834
ANKDVDINAFQHYNFLENWNKENKKNLIPLEKTYLAPIRIYSEKVKSLKKLKKGATIAIPNDATNGSRALYVLQSAGLIK
 : | :|||||| ||::: |||  :|   ::: ||:  |: |||:|: ||||||:|  ||||:||||||::| 
LSGDIDINAFQSYNYVKTWNKAHKSDIVAVGNTYITPMHIYSKEISKLSDLKEGSTVAIPNDASNESRALFVLQSAGLLK
          100       110       120       130       140       150       160

861       891       921       951       981      1011      1041      1071
LNVS-GKKVATVANITSNKKDINIQELDASQTPRALKDVDAAIINNTYIEQANLKPSDAIFVEKSDKNSKQWINIIAGRK
|   |: : :||    : :|||||||||  |  :::   |     ||:|::|   :| :|| : :|| ||:| 
LTTSDSSKLVGLPDITENPHQLKFKEVDASQTPRALDSVALSVVNYNYATAASLPKSESVFMEPLNKTSAQYINFIA---
          180       190       200       210       220       230       240

1101      1131      1161      1182      1212      1242      1272      1302
NWKKQKNAKAIQAILDAYHTDEVKKVIKDTSAD---IPQW*RELTV*V*QGILIGYNLSAI*P*RAWDEYNVPGSWIVFE
|:||  |   :  :  ||  | ||:       :| |:|
TTSKEKNNKVYKEVAKAYASKATEKAIKEQYPDGGELPAWDLKL
          260       270       280
```

SEQ ID 8908 (GBS35) was expressed in E. coli as a His-fusion product. SDS-PAGE analysis of total cell extract is shown in FIG. 11 (lane 2; MW 31.6 kDa).

The GBS35-His fusion product was purified (FIG. 96A; see also FIG. 192, lane 6) and used to immunise mice (lane 2 product; 20 kg/mouse). The resulting antiserum was used for Western blot (FIG. 96B), FACS (FIG. 96C), and in the in vivo passive protection assay (Table III). These tests confirm that the protein is immunoaccessible on GBS bacteria and that it is an effective protective immunogen.

EXAMPLE 1824

A DNA sequence (GBSx1931) was identified in S. agalactiae <SEQ ID 5665> which encodes the amino acid sequence <SEQ ID 5666>. Analysis of this protein sequence reveals the following:

```
Possible site: 37

>>> Seems to have no N-terminal signal sequence

----- Final Results -----
              bacterial cytoplasm --- Certainty = 0.3126(Affirmative) < succ>
               bacterial membrane --- Certainty = 0.0000(Not Clear)   < succ>
                bacterial outside --- Certainty = 0.0000(Not Clear)   < succ>
```

The protein has homology with the following sequences in the GENPEPT database.

```
GP:AAF11560 GB:AE002038 ArgE/DapE/Acyl family protein {Deinococcus radiodurans}
 Identities = 129/419 (30%), Positives = 210/419 (49%), Gaps = 14/419 (3%)

Query:   26 LRDLIAIKSIFAQKVGLNDLSSYLGEVFIKAGAEVIIDDSYSAPFIVANFKSSKVDAKRI      85
            LR L+A+ S+ AQ   L + +  + +     G  V        AP ++A             +
Sbjct:   16 LRALVALPSVSAQGRMLPETADAVAGLLRAEGFGVQQFPGTVAPVLLAEAGEGPFT---L     72

Query:   86 IFYNHYDTVPADEVEQWTEDPFTLSLRYGKMYGRGVDDDKGHITARLSAVKKYLSRHKGE    145
            + YNHYD  P D +E W    PF L+ R G++YGRG  DDKG + +RL+AV+  +    G
Sbjct:   73 LIYNHYDVQPEDPLELWDTPPFELTERGGRLYGRGASDDKGELASRLAAVRA-VREQLGH    131

Query:  146 LPLDITFIVEGAEESASVGLDYYLEKYQEQLQGADLIVWEDGPKNPKGQLEIAGGNKGIV    205
            LP+ I +++EG EE  S   L+ ++ ++   +LQ AD    WE G  +P+G+  ++ G KG++
Sbjct:  132 LPVKIKWLIEGEEEVGSPTLERFVAEHAAELQ-ADGCWWEFGGISPEGRPILSLGLKGVM    190

Query:  206 TFDLSVSSADVDIHSSFGGVVDSSTWYLIQALNTLRDNKGHILVEGIYDKVIPPTKRELE    265
             +L     AD D+HSS G V+D+  + L +A+ +LRD +G++ + G YD V    +   + +
Sbjct:  191 CLELRCRVADSDLHSSLGAVIDNPLYCLARAVASLRDEQGNVTIPGFYDDVRAASGADRQ    250

Query:  266 LVEKYSRSAKALEGAYQLVLPSLADSHKTFLRKLYFEPSIAIEGITSGYQGEGVKTILP    325
             + +       +A+   + +  P     + +   +    P + + G   GYQGEG  KT+LP
Sbjct:  251 AIAQIP-GDGQAVRDTFGVRRP--LATGPAYNERTNLHPVVNVNGWGGGYQGEGSKTVLP    307

Query:  326 AYAKCKAEVRLVPGLTPKGVLDSIQNHLKENGFKDIELT-YTLGEMSYRSDMSAPSILKV    384
                 K + RLVP    P    VL  ++ HL   G   DIE+         +   R+D   P +
Sbjct:  308 GAGFVKLDFRLVPDQDPARVLSLLREHLTAQGLSDIEVVELEAHQKPARADAGHPFVQAC    367

Query:  385 VDLAEQFYPEGISLLPTSPGTGPMY-----LVHQALRAPIAAIGIGHANSRDHGVDENV    438
            V  A  + +  + P+S +GPM+            L  P  A+GIG+   R H  +EN+
Sbjct:  368 VAAARAAHGQDPIVHPSSGASGPMFPFTGGAGGGLGIPCVAVGIGNHAGRVHAPNENI    426
```

There is also homology to SEQ ID 2588.

Based on this analysis, it was predicted that this protein and its epitopes, could be useful antigens for vaccines or diagnostics.

EXAMPLE 1825

A DNA sequence (GBSx1932) was identified in *S. agalactiae* <SEQ ID 5667> which encodes the amino acid sequence <SEQ ID 5668>. This protein is predicted to be amino acid ABC transporter, ATP-binding protein. Analysis of this protein sequence reveals the following:

```
Possible site: 47
>>> Seems to have no N-terminal signal sequence

----- Final Results -----
            bacterial cytoplasm --- Certainty = 0.5366(Affirmative) < succ>
            bacterial membrane  --- Certainty = 0.0000(Not Clear)   < succ>
             bacterial outside  --- Certainty = 0.0000(Not Clear)   < succ>
```

The protein has homology with the following sequences in the GENPEPT database.

```
>GP:CAB59828 GB:AJ012388 hypothetical protein [Lactococcus lactis]
 Identities = 187/338 (55%), Positives = 256/338 (75%), Gaps = 12/338 (3%)

Query:    6 IIKLDNIDVTFHQKKREINAVKDVTIHINQGDIYGIVGYSGAGKSTLVRVINLLQEPSAG     65
            II+L+N+ V FHQK R + AVK+ T+HI +GDIYG++GYSGAGKSTLVR INLLQ+P+G
Sbjct:    4 IIELNNLSVQFHQKGRLVTAVKNATLHIEKGDIYGVIGYSGAGKSTLVRTINLLQKPTEG     63

Query:   66 KITIDDQVIYD--NKVTLTSTQLREQRREIGMIFQHFNLMSQLTAEQNVAFALKHSG---    120
            +I I+ + I+D   N V   T  +LRE R++IGMIFQHFNL+S+ T    NVAFAL+HS
Sbjct:   64 QIVINGEKIFDSENPVKFTGAKLREFRQKIGMIFQHFNLLSEKTVFNNVAFALQHSQIED    123

Query:  121 -------LSKEAKAAKVAKLLELVGLSDRAQNYPSQLSGGQKQRVAIARALANDPKILIS    173
                   L+K+ K   KV +LL+LV L+D +   YP+QLSGGQKQRVAIARALANDP+ILIS
Sbjct:  124 KNGKKRYLTKKEKNDKVTELLKLVDLADLSDKYPAQLSGGQKQRVAIARALANDPEILIS    183

Query:  174 DESTSALDPKTTKQILALLQDLNKKLGLTIVLITHEMQIVKDIANRVAVMQNGKLIEEGS    233
            DE TSALDPKTT QIL LL+ L++KLG T+VLITHEMQ +VK+ IAN+VAVMQNG++IE+ S
```

-continued

```
Sbjct:  184  DEGTSALDPKTTNQILDLLKSLHEKLGITVVLITHEMQVVKEIANKVAVMQNGEIIEQNS  243

Query:  234  VLDIFSHPRESLTQDFIKIATGIDEAMLKIEQQEVVKNLPVGSKLVQLKYAGHSTDEPLL  293
             ++DIF+ P+E+LT+ FI+  + ++   +  + + E++   L    +L+ L Y+G    ++P++
Sbjct:  244  LIDIFAQPKEALTKQFIETTSSVNRFIASLSKTELLAQLADDEELIHLDYSGSELEDPVV  303

Query:  294  NQIYKEFEVTANILYGNIEILDGIPVGEMVVILSGDEE                        331
             +  I  K+F+VT NI YGN+E+L G P G +V+ L G  E
Sbjct:  304  SDITKKFDVTTNIFYGNVELLQGQPFGSLVLTLKGSSE                        341
```

There is also homology to SEQ ID 76.

Based on this analysis, it was predicted that this protein and its epitopes, could be useful antigens for vaccines or diagnostics.

EXAMPLE 1826

A DNA sequence (GBSx1933) was identified in *S. agalactiae* <SEQ ID 5669> which encodes the amino acid sequence <SEQ ID 5670>. This protein is predicted to be ABC transporter, permease protein. Analysis of this protein sequence reveals the following:

```
Possible site: 55
>>> Seems to have no N-terminal signal sequence
        INTEGRAL    Likelihood = -12.79    Transmembrane    203-219    (197-225)
        INTEGRAL    Likelihood =  -8.86    Transmembrane     73-89     (69-102)
        INTEGRAL    Likelihood =  -7.38    Transmembrane     38-54     (35-56)
        INTEGRAL    Likelihood =  -1.12    Transmembrane    103-119    (103-119)

----- Final Results -----
            bacterial membrane  --- Certainty = 0.6116(Affirmative) < succ>
            bacterial outside   --- Certainty = 0.0000(Not Clear)   < succ>
            bacterial cytoplasm --- Certainty = 0.0000(Not Clear)   < succ>
```

A related GBS nucleic acid sequence <SEQ ID 10083> which encodes amino acid sequence <SEQ ID 10084> was also identified.

The protein has homology with the following sequences in the GENPEPT database.

```
>GP:CAB59829 GB:AJ012388 hypothetical protein [Lactococcus lactis]
 Identities = 137/231 (59%), Positives = 171/231 (73%), Gaps = 1/231 (0%)

Query:    1  MIEWIQTHLPNVYQMGWEGAYGWQTAIVQTLYMTFWSFLIGGLMGLLGGLFLVLTSPRGV   60
             M EW      PNV  +GW G  GW TAIVQTLYMTF S LIGGL+GL+ G+ +V+T+   G+
Sbjct:    1  MAEWFAHTFPNVVYLGWTGETGWWTAIVQTLYMTFISALIGGLLGLIFGIGVVVTAEDGI   60

Query:   61  IANKLVFGVLDKVVSVFRALPFIILLALIAPVTRVIVGTTLGSPAALVPLSLAVFPFFAR  120
              N+  +F +LDK+VS+ RA  PFIILLA  IAP+T+++VGT +G   AALVPL+L V PF+AR
Sbjct:   61  TPNRPLFWILDKIVSIGRAFPFIILLAAIAPLTKILVGTQIGVTAALVPLALGVAPFYAR  120

Query:  121  QVQVVLAELDGGVIEAAQASGGTLWDII-VVYLREGLPDLIRVSTVTLISLVGETAMAGA  179
             QVQ  L  +D G +EAAQ  G        DI+  VYLRE L   LIRVSTVTLISL+G  TAMAGA
Sbjct:  121  QVQASLESVDHGKVEAAQTVGADFLDIVFTVYLREELASLIRVSTVTLISLIGLTAMAGA  180

Query:  180  IGAGGLGSVAITKGYNYSRDDITLVATILILLLIFFIQFLGDFLTRRLSHK           230
             IGAGGLG+ AI+ GYN   +D+T  ATILIL+ +  +Q +GDFL RR+SH+
Sbjct:  181  IGAGGLGNTAISYGYNRFANDVTWFATILILIFVLLVQLVGDFLARRVSHR           231
```

A related DNA sequence was identified in *S. pyogenes* <SEQ ID 5671> which encodes the amino acid sequence <SEQ ID 5672>. Analysis of this protein sequence reveals the following:

```
     Possible site: 32
>>> Seems to have an uncleavable N-term signal seq
        INTEGRAL    Likelihood = -11.15    Transmembrane 194-210    (187-215)
        INTEGRAL    Likelihood = -10.67    Transmembrane  28-44     (20-52)
        INTEGRAL    Likelihood =  -8.12    Transmembrane  70-86     (62-91)

----- Final Results -----
            bacterial membrane  --- Certainty = 0.5458(Affirmative) < succ>
            bacterial outside   --- Certainty = 0.0000(Not Clear)   < succ>
            bacterial cytoplasm --- Certainty = 0.0000(Not Clear)   < succ>
```

The protein has homology with the following sequences in the databases:

```
>GP:CAB59829 GB:AJ012388 hypothetical protein [Lactococcus lactis]
 Identities = 123/213 (57%), Positives = 153/213 (71%), Gaps = 1/213 (0%)

Query:   9 GDAGWGLAIWNTLYMTIVPFIVGGAIGLLLGLLLVLTGPDGVIENKTICWVIDKVTSIFR  68
           G+ GW  AI  TLYMT + ++GG +GL+ G+ +V+T  DG+  N+ + W++DK+ SI R
Sbjct:  19 GETGWWTAIVQTLYMTFISALIGGLLGLIFGIGVVVTAEDGITPNRPLFWILDKIVSIGR  78

Query:  69 AIPFVILIAILASFTYLLLRTTLGATAALVPLTFATFPPFYARQVQVVFSELDKGVIEAAQ 128
           A PF+IL+A +A  T +L+ T +G TAALVPL    PFYARQVQ    +D G +EAAQ
Sbjct:  79 AFPFIILLAAIAPLTKILVGTQIGVTAALVPLALGVAPFYARQVQASLESVDHGKVEAAQ 138

Query: 129 ASGATFWDIV-KVYLSEGLPDLIRVSTVTLISLVGETAMAGAIGAGGLGNVAISYGYNRF 187
              GA F DIV  VYL E L  LIRVSTVTLISL+G TAMAGAIGAGGLGN AISYGYNRF
Sbjct: 139 TVGADFLDIVFTVYLREELASLIRVSTVTLISLIGLTAMAGAIGAGGLGNTAISYGYNRF 198

Query: 188 NNDVTWVATIIILLIIFAIQFIGDSLTRRFSHK                             220
            NDVTW ATI+IL+ +  +Q +GD L RR SH+
Sbjct: 199 ANDVTWFATILILIFVLLVQLVGDFLARRVSHR                             231
```

An alignment of the GAS and GBS proteins is shown below.

```
 Identities = 146/212 (68%), Positives = 172/212 (80%)

Query:  19 GAYGWQTAIVQTLYMTFWSFLIGGLMGLLGGLFLVLTSPRGVIANKLVFGVLDKVVSVFR  78
           G  GW  AI  TLYMT  F++GG +GLL GL LVLT P GVI NK +  V+DKV S+FR
Sbjct:   9 GDAGWGLAIWNTLYMTIVPFIVGGAIGLLLGLLLVLTGPDGVIENKTICWVIDKVTSIFR  68

Query:  79 ALPFIILLALIAPVTRVIVGTTLGSPAALVPLSLAVFPFFARQVQVVLAELDGGVIEAAQ 138
           A+PF+IL+A++A  T +++  TTLG+ AALVPL+ A FPF+ARQVQVV +ELD GVIEAAQ
Sbjct:  69 AIPFVILIAILASFTYLLLRTTLGATAALVPLTFATFPFYARQVQVVFSELDKGVIEAAQ 128

Query: 139 ASGGTLWDIIVVYLREGLPDLIRVSTVTLISLVGETAMAGAIGAGGLGSVAITKGYNYSR 198
           ASG T WDI+ VYL EGLPDLIRVSTVTLISLVGETAMAGAIGAGGLG+VAI+ GYN
Sbjct: 129 ASGATFWDIVKVYLSEGLPDLIRVSTVTLISLVGETAMAGAIGAGGLGNVAISYGYNRFN 188

Query: 199 DDITLVATILILLLIFFIQFLGDFLTRRLSHK                              230
           +D+T VATI+ILL+IF IQF+GD LTRR SHK
Sbjct: 189 NDVTWVATIIILLIIFAIQFIGDSLTRRFSHK                              220
```

Based on this analysis, it was predicted that these proteins and their epitopes could be useful antigens for vaccines or diagnostics.

EXAMPLE 1827

A DNA sequence (GBSx1934) was identified in *S. agalactiae* <SEQ ID 5673> which encodes the amino acid sequence <SEQ ID 5674>. This protein is predicted to be alcohol dehydrogenase, zinc-containing (Zn-dependent). Analysis of this protein sequence reveals the following:

```
Possible site: 21
>>> Seems to have no N-terminal signal sequence
        INTEGRAL     Liklihood = -2.92    Transmembrane      71-87      (69-87)

----- Final Results -----
               bacterial membrane --- Certainly = 0.2168(Affirmative) < succ>
                 bacterial outside --- Certainly = 0.0000(Not clear) < succ>
               bacterial cytoplasm --- Certainly = 0.0000(Not clear) < succ>
```

A related GBS nucleic acid sequence <SEQ ID 9419> which encodes amino acid sequence <SEQ ID 9420> was also identified.

The protein has homology with the following sequences in the GENPEPT database.

```
>GP:AAE41759 GB:AE002488 alcohol dehydrogenase, zinc-containing
            [Neisseria meningitidis MC58]
 Identities = 135/246 (54%), Positives = 186/246 (74%), Gaps = 1/246 (0%)
```

-continued

```
Query:   3 SHCEDGGWILGHLIEGTQAEYVHIPHADGSLYHAPEGVCDDALVMLSDILPTSYEIGVLP    62
           SHC +GGWILG++I+GTQAEYV  P+AD SL    P+ V ++  ++LSD LPT++EIGV
Sbjct: 102 SHCRNGGWILGYMIDGTQAEYVRTPYADNSLVPLPDNVEEIALLLSDALPTAHEIGVQY   161

Query:  63 SHIKPGDTVCIVGAGPIGLSALLTAQFYSPAKIIMVDLSQRRLEASKKFGATHTILSTST   122
           +KPGDTV I GAGP+G+SALLTAQ YSPA II+ D+ + RL+ +K+ GATHTI + ++
Sbjct: 162 GDVKPGDTVFIAGAGPVGMSALLTAQLYSPAAIIVCDMDENRLKLAKELGATHTI-NPAS   220

Query: 123 QEVKEEIDKITKGRGVDVVLECVGYPATFDICQNVVSIGGHIANVGVHGKPVEFNLQDLW   182
           EV +++  I    GVD  +E VG PAT+++CQ++V  GGHIA VGVHG+ V+F L+ LW
Sbjct: 221 GEVSKQVFAIVGEDGVDCAIEAVGIPATWNMCQDIVKPGGHIAVVGVHGQSVDFKLEKLW   280

Query: 183 IKNITLNTGLVNANTTEMLLEVLETGKIDATQLVTHHFKLSEIEEAYKVFKAAEENNTLK   242
           IK + + TGLVNANTTEML++ + +   +D T+++THHFK SE+E+AY VEK A EN   +K
Sbjct: 281 IKKLAITTGLVNANTTEMLNKAISSSSVDYTKMLTHHFKFSELEKAYDVFKHAAENQVMK   340

Query: 243 VIIEND                                                        248
           V++E D
Sbjct: 341 VVLEAD                                                        346
```

A related DNA sequence was identified in *S. pyogenes* <SEQ ID 785> which encodes the amino acid sequence <SEQ ID 786>. Analysis of this protein sequence reveals the following:

```
Possible site: 23
>>> Seems to have no N-terminal signal sequence
       INTEGRAL    Likelihood = -5.41    Transmembrane    184-200    (183-203)

----- Final Results -----
              bacterial membrane --- Certainty = 0.3166(Affirmative) < succ>
              bacterial outside  --- Certainty = 0.0000(Not Clear)   < succ>
              bacterial cytoplasm --- Certainty = 0.0000(Not Clear)   < succ>
```

An alignment of the GAS and GBS proteins is shown below.

```
 Identities = 199/250 (79%), Positives = 226/250 (89%)

Query:   1 MPSHCEDGGWILGHLIEGTQAEYVHIPHADGSLYHAPEGVCDDALVMLSDILPTSYEIGV    60
           + SHC+DGGWILGHLI GTQAEYVHIPHADGSLYHAP+ + D+ALVMLSDILPTSYEIGV
Sbjct: 114 LSSHCQDGGWILGHLINGTQAEYVHIPHADGSLYHAPDTIDDEALVMLSDILPTSYEIGV   173

Query:  61 LPSHIKPGDTVCIVGAGPIGLSALLTAQFYSPAKIIMVDLSQRRLEASKKFGATHTILST   120
           LPSH+KPGD VCIVGAGP+GL+ALLT QF+SPA IIMVDLSQ RLEA+K FGATHTI S
Sbjct: 174 LPSHVKPGDNVCIVGAGPVGLAALLTVQFFSPANIIMVDLSQNRLEAAKTFGATHTICSG   233

Query: 121 STQEVKEEIDKITKGRGVDVVLECVGYPATFDICQNVVSIGGHIANVGVHGKPVEFNLQD   180
           S++EVK  ID IT GRGVD+ +ECVGYPATFDICQ  ++S+GGHIANVGVHGKPV+FNL +
Sbjct: 234 SSSEVKAIIDDITNGRGVDISMECVGYPATFDICQKIISVGGHIANVGVHGKPVDFNLDE   293

Query: 181 LWIKNITLNTGLVNANTTEMLLEVLETGKIDATQLVTHHFKLSEIEEAYKVFKAAEENNT   240
           LWIKNITLNTGLVNANTTEMLL VL+TGKIDAT+L+THHFKLSE+E+AY+FK A   NN
Sbjct: 294 LWIKNITLNTGLVNANTTEMLLNVLKTGKIDATRLITHHFKLSEVEKAYETFKHAGANNA   353

Query: 241 LKVIIENDIT                                                    250
           LKVII+NDI+
Sbjct: 354 LKVIIDNDIS                                                    363
```

Based on this analysis, it was predicted that these proteins and their epitopes could be useful antigens for vaccines or diagnostics.

EXAMPLE 1828

A DNA sequence (GBSx1935) was identified in *S. agalactiae* <SEQ ID 5675> which encodes the amino acid sequence <SEQ ID 5676>. This protein is predicted to be a dehydrogenase fragment. Analysis of this protein sequence reveals the following:

```
Possible site: 20
>>> Seems to have no N-terminal signal sequence
      INTEGRAL    Likelihood =            Transmembrane     47-63      (33-66)
                          -10.46

----- Final Results -----
              bacterial membrane --- Certainty = 0.5182(Affirmative) < succ>
              bacterial outside  --- Certainty = 0.0000(Not Clear)   < succ>
              bacterial cytoplasm --- Certainty = 0.0000(Not Clear)  < succ>
```

The protein has no significant homology with any sequences in the GENPEPT database.

There is also homology to SEQ ID 786:

```
Identities = 23/38 (60%), Positives = 28/38 (73%)

Query: WRNSNMRAATYLSANELSLTDKAKPQVIKPTDAVVXLV     44
7
       ++ NM+AATYLS L L DK KP +IKPTDA+V LV
Sbjct: YKKLNMKAATYLSTGNLQLIDKPKPVIIKPTDAIVQLV     47
10
```

Based on this analysis, it was predicted that this protein and its epitopes, could be useful antigens for vaccines or diagnostics.

EXAMPLE 1829

A DNA sequence (GBSx1936) was identified in *S. agalactiae* <SEQ ID 5677> which encodes the amino acid sequence <SEQ ID 5678>. Analysis of this protein sequence reveals the following:

```
Possible site: 39
>>> Seems to have no N-terminal signal sequence

----- Final Results -----
              bacterial cytoplasm --- Certainty = 0.1001(Affirmative) < succ>
              bacterial membrane  --- Certainty = 0.0000(Not Clear)   < succ>
              bacterial outside   --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1830

A DNA sequence (GBSx1937) was identified in *S. agalactiae* <SEQ ID 5679> which encodes the amino acid sequence <SEQ ID 5680>. This protein is predicted to be branched chain amino acid transport system II carrier protein (brnQ). Analysis of this protein sequence reveals the following:

```
Possible site: 44
>>> Seems to have an uncleavable N-term signal seq
    INTEGRAL       Likelihood = -9.66    Transmembrane    158-174  (154-177)
    INTEGRAL       Likelihood = -6.64    Transmembrane    233-249  (231-252)
    INTEGRAL       Likelihood = -5.20    Transmembrane     37-53   (30-57)
    INTEGRAL       Likelihood = -3.98    Transmembrane     90-106  (87-108)
    INTEGRAL       Likelihood = -0.80    Transmembrane    130-146  (130-146)

----- Final Results -----
              bacterial membrane  --- Certainty = 0.4864(Affirmative) < succ>
              bacterial outside   --- Certainty = 0.0000(Not Clear)   < succ>
              bacterial cytoplasm --- Certainty = 0.0000(Not Clear)   < succ>
```

A related GBS nucleic acid sequence <SEQ ID 9417> which encodes amino acid sequence <SEQ ID 9418> was also identified.

The protein has homology with the following sequences in the GENPEPT database.

```
>GP:AAC00400 G8:AF008220 branch-chain amino acid transporter
           [Bacillus subtilis]
 Identities = 89/250 (35%), Positives = 139/250 (55%), Gaps = 18/250 (7%)

Query:   1  MDALASIAFAIIVIQASKQYGAITKKEITSMALKSGAIATFLLAFIYIFVGRIGATSQSL    60
            MDALASI F ++V+ A K G     K + + +K+G IA   L FIY+ +  +GATS +
Sbjct: 199  MDALASIVFGVVVVNAVKSKGVTQSKALAAACIKAGVIAALGLTFIYVSLAYLGATSTNA   258

Query:  61  FKFANGSFLLHNTPI-DGGHVLSQSANFYLGIVGQAILGTAIFLACLTTATGLITACAEY   119
                          P+ +G  +LS S+++  G +G  +LG AI +ACLTT+ GL+T+C +Y
Sbjct: 259  IG-----------PVGEGAKILSASSHYLFGSLGNIVLGAAITVACLTTSIGLVTSCGQY   307

Query: 120  FHKLLPKISHITWATIFTLIAITPYFGGLSEIIRWSLPVLYLLYPLTIVLIFLVFFDQKF   179
            F KL+P +S+   TI TL ++     GL++II +S+P+L  +YPL IV+I L F D+ F
Sbjct: 308  FSKLIPALSYKIVVTIVTLFSLIIANFGLAQIIAFSVPILSAIYPLAIVIIVLSFIDKIF   367

Query: 180  ESSRIVYQTSIAATAVAALYDALSKLGEMTGLFTIPSALTTFFFTKVVPLGEYSMGWISFA   239
            +  R VY  +  T + ++ D +     G    G       +L   F   +PL    +GW+
Sbjct: 368  KERREVYIACLIGTGLFSILDGIKAAGFSLG------SLDVFLNANLPLYSLGIGWVLPG   421

Query: 240  ICGVLVGLIL                                                     249
            I G ++G +L
Sbjct: 422  IVGAVIGYVL                                                     431
```

A related DNA sequence was identified in *S. pyogenes* <SEQ ID 2233> which encodes the amino acid sequence <SEQ ID 2234>. Analysis of this protein sequence reveals the following:

```
Possible site: 21
>>> Seems to have a cleavable N-term signal seq.
        INTEGRAL     Likelihood =         Transmembrane    235-251   (228-258)
                     -10.83
        INTEGRAL     Likelihood =         Transmembrane    434-450   (429-454)
                     -8.49
        INTEGRAL     Likelihood =         Transmembrane    359-375   (356-377)
                     -8.12
        INTEGRAL     Likelihood =         Transmembrane    150-166   (144-171)
                     -7.86
        INTEGRAL     Likelihood =         Transmembrane    298-314   (288-316)
                     -6.00
        INTEGRAL     Likelihood =         Transmembrane    42-58     (38-63)
                     -5.95
        INTEGRAL     Likelihood =         Transmembrane    336-352   (335-354)
                     -3.35
        INTEGRAL     Likelihood =         Transmembrane    199-215   (198-218)
                     -2.81
        INTEGRAL     Likelihood =         Transmembrane    120-136   (120-138)
                     -2.18
        INTEGRAL     Likelihood =         Transmembrane    390-406   (390-407)
                     -1.81
        INTEGRAL     Likelihood =         Transmembrane    81-97     (81-97)
                     -1.01

----- Final Results -----
            bacterial membrane  --- Certainty = 0.5331(Affirmative) < succ>
            bacterial outside   --- Certainty = 0.0000(Not Clear)   < succ>
            bacterial cytoplasm --- Certainty = 0.0000(Not Clear)   < succ>
```

An alignment of the GAS and GBS proteins is shown below.

```
 Identities = 161/253 (63%), Positives = 197/253 (77%)

Query:   1  MDALASIAFAIIVIQASKQYGAITKKEITSMALKSGAIATFLLAFIYIFVGRIGATSQSL    60
            MDALAS+ FAI+VI+A+KQ+GA T KE+T + L SGAIA   LLA +YIFVGRIGATSQSL
Sbjct: 202  MDALASLVFAILVIEATKQFGAKTDKEMTKITLISGAIAILLLALVYIFVGRIGATSQSL   261

Query:  61  FKFANGSFLLHNTPIDGGHVLSQSANFYLGIVGQAILGTAIFLACLTTATGLITACAEYF   120
            F F +GSF LH  P++GG +LS ++ FYLG +GQA L    IFLACLTT+TGLIT+ AEYF
Sbjct: 262  FPFIDGSFTLHGNPVNGGQILSHASRFYLGGIGQAFLAVVIFLACLTTSTGLITSSAEYF   321
```

-continued

```
Query: 121  HKLLPKISHITWATIFTLIAITFYFGGLSEIIRWSLPVLYLLYPLTIVLIFLVFFDQKFE  180
            HKL+P +SHI WATIFTL++  FYFGGLS II WS PVL+LLYPLT+ LIFLV   + F
Sbjct: 322  HKLVPALSHIAWATIFTLLSAFFYFGGLSVIINWSAPVLFLLYPLTVDLIFLVLAQKCFN  381

Query: 181  SSRIVYQTSIAATAVAALYDALSKLGEMTGLFTIPSALTTFFTKVVPLGEYSMGWISFAI  240
            +  IVY+T+I  T + A++DAL  L +MTGLF +P A+ TFF K VPLG++SMGWI FA
Sbjct: 382  NDPIVYRTTIGLTFIPAIFDALLTLSQMTGLFHLPEAVVTFFQKTVPLGQFSMGWIIFAA  441

Query: 241  CGVLVGLILKKVK                                                253
              G L+GLIL K K
Sbjct: 442  IGFLIGLILSKTK                                                454
```

Based on this analysis, it was predicted that these proteins and their epitopes could be useful antigens for vaccines or diagnostics.

EXAMPLE 1831

A DNA sequence (GBSx1938) was identified in *S. agalactiae* <SEQ ID 5681> which encodes the amino acid sequence <SEQ ID 5682>. This protein is predicted to be 30S ribosomal protein S12 (rpsL). Analysis of this protein sequence reveals the following:

```
Possible site: 52
>>> Seems to have no N-terminal signal sequence

----- Final Results -----
            bacterial cytoplasm --- Certainty = 0.3698(Affirmative) < succ>
            bacterial membrane  --- Certainty = 0.0000(Not Clear)   < succ>
             bacterial outside  --- Certainty = 0.0000(Not Clear)   < succ>
```

A related GBS nucleic acid sequence <SEQ ID 9429> which encodes amino acid sequence <SEQ ID 9430> was also identified.

The protein has homology with the following sequences in the GENPEPT database.

```
>GP:CAA78825 GB:Z15120 ribosomal protein S12 [Streptococcus pneumoniae]
  Identities = 64/71 (90%), Positives = 68/71 (95%)

Query:   1  MPTINQLVRKPRKSKVEKSDSPALNIGYNSHRKVHTKLSAPQKRGVATRVGTMTPKKPNS  60
            MPTINQLVRKPRKSKVEKS SPALN+GYNSH+KV T +S+PQKRGVATRVGTMTPKKPNS
Sbjct:   1  MPTINQLVRKPRKSKVEKSKSPALNVGYNSHKKVQTNVSSPQKRGVATRVGTMTPKKPNS  60

Query:  61  ALRKFARVRLS                                                  71
            ALRKFARVRLS
Sbjct:  61  ALRKFARVRLS                                                  71
```

A related DNA sequence was identified in *S. pyogenes* <SEQ ID 5683> which encodes the amino acid sequence <SEQ ID 5684>. Analysis of this protein sequence reveals the following:

```
Possible Site: 29
>>> Seems to have no N-terminal signal sequence

----- Final Results -----
            bacterial cytoplasm --- Certainty = 0.3879(Affirmative) < succ>
            bacterial membrane  --- Certainty = 0.0000(Not Clear)   < succ>
             bacterial outside  --- Certainty = 0.0000(Not Clear)   < succ>
```

An alignment of the GAS and GBS proteins is shown below.

```
 Identities = 44/48 (91%), Positives = 47/48 (97%)

Query:  24  LNIGYNSHRKVHTKLSAPQKRGVATRVGTMTPKKPNSALRRFARVRLS   71
            LNIGYNSH+KV TK++APQKRGVATRVGTMTPKKPNSALRRFA VRLS
Sbjct:   1  LNIGYNSHKKVQTKMAAPQKRGVATRVGTMTPKKPNSALRKFARVRLS   48
```

Based on this analysis, it was predicted that these proteins and their epitopes could be useful antigens for vaccines or diagnostics.

EXAMPLE 1832

A DNA sequence (GBSx1939) was identified in *S. agalactiae* <SEQ ID 5685> which encodes the amino acid sequence <SEQ ID 5686>. This protein is predicted to be purR. Analysis of this protein sequence reveals the following:

```
Possible site: 30
>>> Seems to have an uncleavable N-term signal seq
      INTEGRAL    Likelihood = -0.37    Transmembrane    142-158    (142-159)

----- Final Results -----
              bacterial membrane --- Certainty = 0.1150(Affirmative) < succ>
              bacterial outside  --- Certainty = 0.0000(Not Clear)   < succ>
              bacterial cytoplasm --- Certainty = 0.0000(Not Clear)  < succ>
```

The protein has homology with the following sequences in the GENPEPT database.

```
>GP:CAA10902 GB:AJ222642 purR [Lactococcus lactis]
 Identities = 143/269 (53%), Positives = 195/269 (72%), Gaps = 1/269 (0%)

Query:   3  LRRSERMVVISNYLINNPYTLTSLNTFASKYGAAKSSISEDIAIIKKAFEQAQIGDIKTV   62
            ++R+ER+V  +N+LIN+P  + +LN  +   Y  AKSSISED+  IK+ FE    +G ++T
Sbjct:   1  MKRNERLVDFTNFLINHPNQMLNLNELSKHYEVAKSSISEDLVFIKRVFENQGVGLVETF   60

Query:  63  TGASGGVIFTPTIAEAEAKEIVEELRQRLSENDRILPGGYIYLSDLLSTPKMLQSIGRII  122
             G+ GGV FTP I +  + E+ +E+ + L E +RILPGGYIYLSD+L TP   L+ IG+II
Sbjct:  61  PGSLGGVRFTPYITDERSLEMSQEIAELLREENRILPGGYIYLSDILGTPSNLRKIGQII  120

Query: 123  ANAYRGQKIDAVMTVATKGVPLANAVANVLDVPFVIVRRDLKITEGSTVSVNYASGSSGR  182
            A+ Y   +++D VMT+ATKG+P+A +VA +LDVPFVIVRRD K+TEG+T++VNY SGSS R
Sbjct: 121  AHEYHEKQVDVVMTIATKGIPIAQSVAEILDVPFVIVRRDPKVTEGATLNVNYMSGSSSR  180

Query: 183  IEKMFLSKRSLKPNSRVLIVDDFLKGGGTVSGMISLLSEFDSTLVGVAVFAENA-QEQRE  241
            +E M LSKRSL     VLIVDDF+KG GT++GM SL+ EFD  L GVAVF E    + +R
Sbjct: 181  VENMTLSKRSLSIGQNVLIVDDFMKGAGTINGMRSLVHEFDCLLAGVAVFLEGPFKGERL  240

Query: 242  KMAYKSLLRVSEIDVKNNRVSVEAGNIFD                                270
                YKS+L+V  ID+ N  + V+ GNIF+
Sbjct: 241  IDDYKSILKVDRIDIANRSIDVQLGNIFN                                269
```

A related DNA sequence was identified in *S. pyogenes* <SEQ ID 5687> which encodes the amino acid sequence <SEQ ID 5688>. Analysis of this protein sequence reveals the following:

```
     Possible site: 41
>>> Seems to have an uncleavable N-term signal seq
      INTEGRAL    Likelihood = -1.97    Transmembrane    142-158    (142-160)

----- Final Results -----
              bacterial membrane --- Certainty = 0.1786(Affirmative) < succ>
              bacterial outside  --- Certainty = 0.0000(Not Clear)   < succ>
              bacterial cytoplasm --- Certainty = 0.0000(Not Clear)  < succ>
```

The protein has homology with the following sequences in the databases:

```
>GP:CAA10902 GB:AJ222642 purR [Lactococcus lactis]
 Identities = 142/269 (52%), Positives = 196/269 (72%), Gaps = 1/269 (0%)

Query:   3  LRRSERMVVISNYLINNPYKLTSLNTFATKYEAAKSSISEDIAIIKKAFEEANIGDIDTL   62
            ++R+ER+V  +N+LIN+P ++ +LN  +   YE AKSSISED+  IK+ FE    +G ++T
Sbjct:   1  MKRNERLVDFTNFLINHPNQMLNLNELSKHYEVAKSSISEDLVFIKRVFENQGVGLVETF   60

Query:  63  TGASGGVIFTPSISETEARTIVEDLCQRLSESDRILPGGYIYLSDLLSTPKILQNIGRII  122
             G+ GGV FTP I++  +  +++ + L E +RILPGGYIYLSD+L TP   L+ IG+II
Sbjct:  61  PGSLGGVRFTPYITDERSLEMSQEIAELLREENRILPGGYIYLSDILGTPSNLRKIGQII  120
```

```
                             -continued
Query: 123 ANAFKGEKIDAVMTVATKGVPLANAVANILSVPFVIVRRDLKITEGSTVSVNYASASSSDR  182
           A+ +   +++D VMT+ATRG+P+A +VA IL VPFVIVRRD K+TEG+T++VNY S SS R
Sbjct: 121 AHEYHEKQVDVVMTIATKGIPIAQSVAEILDVPFVIVRRDPKVTEGATLNVNYMSGSSSR   180

Query: 183 IEKMFLSKRSLKPNSRVLIVDDFLKGGGTITGMISLLTEFDSTLVGVAVFAENA-QSERE   241
           +E M LSKRSL      VLIVDDF+KG GTI GM SL+ EFD  L GVAVF E   + ER
Sbjct: 181 VENMTLSKRSLSIGQNVLIVDDFMKGAGTINGMRSLVHEFDCLLAGVAVFLEGPFKGERL   240

Query: 242 QMTFKSLLKVSEIDVKNNNVVVEVGNIFD                                270
              +KS+LKV  ID+ N ++ V++GNIF+
Sbjct: 241 IDDYKSILKVDRIDIANRSIDVQLGNIFN                                269
```

An alignment of the GAS and GBS proteins is shown below.

```
Identities = 234/270 (86%) , Positives = 255/270 (93%)

Query:   1 MKLRRSERMVVISNYLINNPYTLTSLNTFASKYGAAKSSISEDIAIIKKAFEQAQIGDIK   60
           MKLRRSERMVVISNYLINNPY LTSLNTFA+KY AAKSSISEDIAIIKKAFE+A IGDI
Sbjct:   1 MKLRRSERMVVISNYLINNPYKLTSLNTFATKYEAAKSSISEDIAIIKKAFEEANIGDID   60

Query:  61 TVTGASGGVIFTPTIAEAEAKEIVEELRQRLSENDRILPGGYIYLSDLLSTPKMLQSIGR  120
           T+TGASGGVIFTP+I+E EA+ IVE+L QRLSE+DRILPGGYIYLSDLLSTPK+LQ+IGR
Sbjct:  61 TLTGASGGVIFTPSISETEARTIVEDLCQRLSESDRILPGGYIYLSDLLSTPKILQNIGR  120

Query: 121 IIANAYRGQKIDAVMTVATKGVPLANAVANVLDVPFVIVRRDLKITEGSTVSVNYASGSS  180
           IIANA++G+KIDAVMTVATKGVPLANAVAN+L VPFVIVRRDLKITEGSTVSVNYAS SS
Sbjct: 121 IIANAFKGEKIDAVMTVATKGVPLANAVANILSVPFVIVRRDLKITEGSTVSVNYASASS  180

Query: 181 GRIEKMFLSKRSLKPNSRVLIVDDFLKGGGTVSGMISLLSEFDSTLVGVAVFAENAQEQR  240
            RIEKMFLSKRSLKPNSRVLIVDDFLKGGGT++GMISLL+EFDSTLVGVAVFAENAQ +R
Sbjct: 181 DRIEKMFLSKRSLKPNSRVLIVDDFLKGGGTITGMISLLTEFDSTLVGVAVFAENAQSER  240

Query: 241 EKMAYKSLLRVSEIDVKNNRVSVEAGNIFD                               270
           E+M +KSLL+VSEIDVKNN V VE GNIFD
Sbjct: 241 EQMTFKSLLKVSEIDVKNNNVVVEVGNIFD                               270
```

Based on this analysis, it was predicted that these proteins and their epitopes could be useful antigens for vaccines or diagnostics.

EXAMPLE 1833

A DNA sequence (GBSx1940) was identified in *S. agalactiae* <SEQ ID 5689> which encodes the amino acid sequence <SEQ ID 5690>. This protein is predicted to be cmp-binding-factor 1. Analysis of this protein sequence reveals the following:

```
Possible site: 53
>>> Seems to have no N-terminal signal sequence

----- Final Results -----
          bacterial cytoplasm --- Certainty = 0.1753(Affirmative) < succ>
          bacterial membrane  --- Certainty = 0.0000(Not Clear)   < succ>
           bacterial outside  --- Certainty = 0.0000(Not Clear)   < succ>
```

The protein has homology with the following sequences in the GENPEPT database.

```
>GP:AAC44803 GB:U21636 cmp-binding-factor 1 [Staphylococcus aureus]
 Identities = 140/310 (45%), Positives = 195/310 (62%), Gaps = 6/310 (1%)

Query:   3 INQMKKDELFEGFYLIKKASVRKTRAGKDFIAFTFQDDTGEISGNMWDAQTYNVEEFVAG   62
           I +    + F+L+ KA    T GKD++    QD +GEI   W A   ++
Sbjct:   4 IENLNPGDSVDHFFLVHKATQGVTAQGKDYMTLHLQDKSGEISAKFWTATKNDMATIKPE   63

Query:  63 KIVHMKGRREVYNGTPQ--VNQITLRNIKDGEPNDPRDFKEKPPINVDNVREYMEQMLFK  120
           +IVH+KG    Y G Q  VNQI L  +D   F + P++   ++E +   L
Sbjct:  64 EIVHVKGDIINYRGNKQMKVNQIRLATTEDQLKTE--QFVDGAPLSPAEIQEEISHYLLD  121
```

```
-continued
Query: 121  IENATWQRVVRALYRKYNKEFFTYPAAKTNHHAFESGLAYHTATMVRLADSIGDIYPELN  180
            IENA  QR+ R L +KY + F+TYPAA ++HH F SGL+YH  TM+R+A SI DIYP LN
Sbjct: 122  IENANLQRITRHLLKKYQERFYTYPAASSHHHNFASGLSYHVLTMLRIAKSICDIYPLLN  181

Query: 181  KSLMFAGIMLHDLAKVIELSGPDNTEYTIRGNLIGHISLIDEELTKILAELNIDDTKEEV  240
            KSL+++GI+LHD+ KV ELSGP  T YT+ GNL+GHIS+  +E+ +    ELNI+   EE+
Sbjct: 182  KSLLYSGIILHDIGKVRELSGPVATSYTVEGNLLGHISIASDEVVEAARELNIEG--EEI  239

Query: 241  TVLRHVILSHHGQLEYGSPVRPRIMEAEIIHMIDNIDANMMMMTTALNRVNEGEMTNRIF  300
             +LRH+ILSHHG+LEYGSP  P + EAEI+  IDNIDA M M    A  + ++G+ T++IF
Sbjct: 240  MLLRHHILSHHGKLEYGSPKLPYLKEAEILCYIDNIDARMNMFEKAYKKTDKGQFTDKIF  299

Query: 301  AMDNRSFYKP                                                    310
            ++NR FY P
Sbjct: 300  GLENRRFYNP                                                    309
```

A related DNA sequence was identified in *S. pyogenes* <SEQ ID 5691> which encodes the amino acid sequence <SEQ ID 5692>. Analysis of this protein sequence reveals the following:

```
Possible site: 38
>>> Seems to have no N-terminal signal sequence

----- Final Results -----
            bacterial cytoplasm --- Certainty = 0.1822(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below.

```
 Identities = 275/311 (88%), Positives = 300/311 (96%)

Query:   1  MKINQMKKDELFEGFYLIKKAEVRKTRAGKDFIAFTFQDDTGEISGNMWDAQTYNVEEFV   60
            MKINQMKKD+LFEGFYLIK AEVRKTRAGKDFI+ TFQDDTGEISGN+WDAQ YNVEEF
Sbjct:   1  MKINQMKKDQLFEGFYLIKSAEVRKTRAGKDFISLTFQDDTGEISGNLWDAQPYNVEEFT   60

Query:  61  AGKIVNMKGRREVYNGTPQVNQITLRNIKDGEPNDPRDFKEKPPINVDNVREYMEQMLFK  120
            AGK+V MKGRREVYNGTPQVNQITLRN++ GEPNDP+DFKEK P++V  VR+Y+EQMLFK
Sbjct:  61  AGKVVFMKGRREVYNGTPQVNQITLRNVRPGEPNDPKDFKEKAPVSVTEVRDYLEQMLFK  120

Query: 121  IENATWQRVVRALYRKYNKEFFTYPAAKTNHHAFESGLAYHTATMVRLADSIGDIYPELN  180
            IENATWQR+VRALYRKY+KEF+TYPAAKTNHHAFESGLAYHTATMVRLADSIGDIYP+LN
Sbjct: 121  IENATWQRIVRALYRKYDKEFYTYPAAKTNHHAFESGLAYHTATMVRLADSIGDIYPDLN  180

Query: 181  KSLMFAGIMLHDLAKVIELSGPDNTEYTIRGNLIGHISLIDEELTKILASLNIDDTKEEV  240
            KSL+FAGIMLHDLAKVIEL+GPDNTEYT+RGNLIGHISLI+EE+TK+++EL IDDTKEEV
Sbjct: 181  KSLLFAGIMLHDLAKVIELTGPDNTEYTVRGNLIGHISLINEEITKVISELQIDDTKESV  240

Query: 241  TVLRHVILSHHGQLEYGSPVRPRIMEAEIIHMIDNIDANMMMMTTALNRVNEGEMTNRIF  300
             VLRHVILSHHGQLEYGSPVRPRIMEAEIIHMIDNIDANMMMMTTAL+RV+EGEMTNRIF
Sbjct: 241  IVLRHVILSHHGQLEYGSPVRPRIMEAEIIHMIDNIDANMMMMTTALSRVSEGEMTNRIF  300

Query: 301  AMDNRSFYKPN                                                   311
            AMDNRSFYKPN
Sbjct: 301  AMDNRSFYKPN                                                   311
```

Based on this analysis, it was predicted that these proteins and their epitopes could be useful antigens for vaccines or diagnostics.

EXAMPLE 1834

A DNA sequence (GBSx1941) was identified in *S. agalactiae* <SEQ ID 5693> which encodes the amino acid sequence <SEQ ID 5694>. Analysis of this protein sequence reveals the following:

```
Possible site: 21
>>> Seems to have an uncleavable N-term signal seq
      INTEGRAL    Likelihood = -14.59   Transmembrane    2-18       (1-22)
```

```
----- Final Results -----
          bacterial membrane --- Certainty = 0.6838(Affirmative) < succ>
          bacterial outside  --- Certainty = 0.0000(Not Clear)   < succ>
          bacterial cytoplasm --- Certainty = 0.0000(Not Clear)  < succ>
```

A related DNA sequence was identified in *S. pyogenes* <SEQ ID 5695> which encodes the amino acid sequence <SEQ ID 5696>. Analysis of this protein sequence reveals the following:

```
    Possible site: 17

>>> Seems to have an uncleavable N-term signal seq
    INTEGRAL    Likelihood = -12.05    Transmembrane    3-19    (1-26)

----- Final Results -----
          bacterial membrane  --- Certainty = 0.5819(Affirmative) < succ>
          bacterial outside   --- Certainty = 0.0000(Not Clear)   < succ>
          bacterial cytoplasm --- Certainty = 0.0000(Not Clear)   < succ>
```

An alignment of the GAS and GBS proteins is shown below.

```
Identities = 309/424 (72%), Positives = 370/424 (86%), Gaps = 3/424 (0%)

Query:   1 MLVIILIIVLASLTVTIISYQKMTELTKSVEKQLEDNADNLSDQLTYQIEVAQKDQILTL  60
           +++ +L++VL  L   ++    K+  L   + + LE NADNLSDQ+TYQ++ A K Q+L L
Sbjct:   3 LILFLLVLVLLGLGAYLLF--KVNGLQHQLAQTLEGNADNLSDQMTYQLDTANKQQLLEL  60

Query:  61 TNQLNRMQQEIYQLLTDMRTELNQHLTESRDRSDKRLELINSNLSQSVQKMQDSNEKRLD 120
           T  +NR Q  +YQ LTD+R  L++ L++SRDRSDKRLE IN   ++QS++ MQ+SNEKRL+
Sbjct:  61 TQLMNRQQAGLYQQLTDIRDVLHRSLSDSRDRSDKRLSKINQQVNQSLKNMQESNEKRLE 120

Query: 121 QMRQTVEEKLEKTLQTRLQTSFETVSRQLESVNQGLGEMKTVAQDVGTLNKVLSNTKTRG 180
           +MRQ VEEKLE+TL+ RL  SF++VS+QLESVN+GLGEM++VAQDVGTLNKVLSNTKTRG
Sbjct: 121 KMRQIVEEKLEETLKNRLHASFDSVSKQLESVNKGLGEMRSVAQDVGTLNKVLSNTKTRG 180

Query: 181 ILGELQLGQIIEDIMTVSQYEREFPTVSGSSERVEYAIKLPGNGQGDYIYLPIDSKFPLE 240
           ILGELQLGQIIEDIMT SQYEREF TVSGSSERVEYAIKLPGNGQG YIYLPIDSKFPLE
Sbjct: 181 ILGELQLGQIIEDIMTSSQYEREFVTVSGSSERVEYAIKLPGNGQGGYIYLPIDSKFPLE 240

Query: 241 DYYRLEDAYELGDKVQIELYRKSLLASIRKFAKDINNKYLNPPETTNFGIMFLPTEGLYS 300
           DYYRLEDAYE+GDK+ IE  RK+LLA+I++FAKDI+ KYLNPPETTNFG+MFLPTEGLYS
Sbjct: 241 DYYRLEDAYEVGDKLAIEASRKALLAAIKRFAKDIHKKYLNPPETTNFGVMFLPTEGLYS 300

Query: 301 EVVRNATFFDSLRRDENIVVAGPSTLSALLNSLSVGFKTLNIQKNANDISKILGNVKVEF 360
           EVVRNA+FFDSLRR+ENIVVAGPSTLSALLNSLSVGFKTLNIQKNA+DISKILGNVK+EF
Sbjct: 301 EVVRNASFFDSLRREENIVVAGPSTLSALLNSLSVGFKTLNIQKNADDISKILGNVKLEF 360

Query: 361 GKFGGMLSKAQKQLNTASKSIDSLLTTRTNAIIRVLNTVEEHQDQATTSLLNLPITEEEE 420
            KFGG+L+KAQKQ+NTA+  ++D L++TRTNAI+R LNTVE +QDQAT SLLN+P+ EEE
Sbjct: 361 DKFGGLLAKAQKQMNTANNTLDQLISTRTNAIVRALNTVETYQDQATKSLLNMPLLEEEN 420

Query: 421 INEN                                                        424
            NEN
Sbjct: 421 -NEN                                                        423
```

SEQ ID 5694 (GBS88) was expressed in *E. coli* as a His-fusion product. SDS-PAGE analysis of total cell extract is shown in FIG. 18 (lane 2; MW 48 kDa).

Based on this analysis, it was predicted that these proteins and their epitopes could be useful antigens for vaccines or diagnostics.

EXAMPLE 1835

A DNA sequence (GBSx1942) was identified in *S. agalactiae* <SEQ ID 5697> which encodes the amino acid sequence <SEQ ID 5698>. Analysis of this protein sequence reveals the following:

```
    Possible site: 44
>>> Seems to have no N-terminal signal sequence

----- Final Results -----
          bacterial cytoplasm --- Certainty = 0.2722(Affirmative) < succ>
          bacterial membrane  --- Certainty = 0.0000(Not Clear)   < succ>
          bacterial outside   --- Certainty = 0.0000(Not Clear)   < succ>
```

The protein has homology with the following sequences in the GENPEPT database.

```
>GP:CAB13453 GB:Z99112 ylos [Bacillus subtilis]
 Identities = 75/217 (34%), Positives = 109/217 (49%), Gaps = 12/217 (5%)

Query:   1  MTKIALFAGG------DLTYFEYDFDYFVGIDRGSLFLLKNGLSLDMAVGDFDSITEDEL   54
            M  I + AGG       DLT +  +   ++G+D+G++ LL   G+    A GDFDSITE E
Sbjct:   1  MKTINIVAGGPKNLIPDLTGYTDEHTLWIGVDKGTVTLLDAGIIPVEAFGDFDSITEQER   60

Query:  55  LYIKHYCSNIVSASAEKNDTDTELALKTIFKEFPEAQVTVFGAFGGRIDHMMSNIFLPSD  114
             I+     +       AEK+ TD +LAL      ++ P+  +  +FG   GGR DH + NI  L
Sbjct:  61  RRIEKAAPALHVYQAEKDQTDLDLALDWALEKQPDI-IQIFGITGGRADHFLGNIQLLYK  119

Query: 115  RDLEPFMSQIRLKDEQNIVTYLPSGKNQVSRIEGMSYVSFMPESES--TLQISGAKYELN  172
                  +IRL D+QN +      P G+  + + E    Y+SF+P SE       L ++G  KY LN
Sbjct: 120  GVKTNI--KIRLIDKQNHIQMFPPGEYDIEKDENKRYISFIPFSEDIHELTLTGFKYPLN  177

Query: 173  KSNY-FKKKMYSSNEFMTSPIEVELKDGYLIIIYSKD                         208
             +        +  SNE + S           G LI+I S D
Sbjct: 178  NCHITLGSTLCISNELIHSRGTFSFAKGILIHIRSTD                         214
```

A related DNA sequence was identified in *S. pyogenes* <SEQ ID 5699> which encodes the amino acid sequence <SEQ ID 5700>. Analysis of this protein sequence reveals the following:

```
Possible site: 55
>>> Seems to have no N-terminal signal sequence

----- Final Results -----
           bacterial cytoplasm --- Certainty = 0.2467(Affirmative) < succ>
            bacterial membrane --- Certainty = 0.0000(Not Clear)   < succ>
             bacterial outside --- Certainty = 0.0000(Not Clear)   < succ>
```

An alignment of the GAS and GBS proteins is shown below.

```
Identities = 130/208 (62%), Positives = 166/208 (79%)
Query:   1  MTKIALFAGGDLTYFEYDFDYFVGIDRGSLFLLKNGLSLDMAVGDFDSITEDELLYIKHY   60
            M+K+ALFAGGDL+Y     DFDYFVGIDRGSLFLL+NGL L+MAVGDFDS+++      IK
Sbjct:   1  MSKVALFAGGDLSYISRDFDYFVGIDRGSLFLLENGLPLNMAVGDFDSVSQKAFTDIKEK   60

Query:  61  CSNIVSASAEKNDTDTELALKTIFKEFPEAQVTVFGAFGGRIDHMMSNIFLPSDRDLEPF  120
              ++A   EKNDTDTELALK +F   FPEA+VT+FGAFGGR+DH++SNIFLPSD    + PF
Sbjct:  61  AELFITAHPEKNDTDTELALKEVFARFPEAEVTIFGAFGGRMDHLLSNIFLPSDPGIAPF  120

Query: 121  MSQIRLKDEQNIVTYLPSGKNQVSRIEGMSYVSFMPESESTLQISGAKYELNKSNYFKKK  180
            M+QI L+D+QN++TY P+G++ + + EGM+YV+FM E E+ L I+GAK+EL + N+FKKK
Sbjct: 121  MAQIALRDQQNMITYRPAGQHLIHQEEGMTYVAFMAEGEADLTITGAKFELTQDNFFKKK  180

Query: 181  MYSSNEFMTSPIEVELKDGYLIIIYSKD                                 208
            +YSSN F+  PI V L  GYLIII SKD
Sbjct: 181  IYSSNAFIHQPITVSLPSGYLIIIQSKD                                 208
```

Based on this analysis, it was predicted that these proteins and their epitopes could be useful antigens for vaccines or diagnostics.

EXAMPLE 1836

A DNA sequence (GBSx1943) was identified in *S. agalactiae* <SEQ ID 5701> which encodes the amino acid sequence <SEQ ID 5702>. This protein is predicted to be ribulose-phosphate 3-epimerase (rpe). Analysis of this protein sequence reveals the following:

```
Possible site: 18
>>> Seems to have no N-terminal signal sequence
     INTEGRAL    Likelihood = -1.59    Transmembrane    124-140    (124-141)

----- Final Results -----
            bacterial membrane --- Certainty = 0.1638(Atfirmative) < succ>
             bacterial outside --- Certainty = 0.0000(Not Clear)   < succ>
           bacterial cytoplasm --- Certainty = 0.0000(Not Clear)   < succ>
```

The protein has homology with the following sequences in the GENPEPT database.

```
>GP:BAB0E221 GB:AP001515 unknown conserved protein [Bacillus halodurans]
 Identities = 113/211 (53%), Positives = 153/211 (71%)

Query:    5 KIAPSILAADYANFANELKRIEETTAEYVHIDIMDGQFVPNISFGADVVSSMRKHSKLVF   64
            KIAPSIL+AD+AN  NE++ +E   A+Y+H+D+MDG FVPNI+ G  +V ++R  + L
Sbjct:    3 KIAPSILSADFANLGNEIQDVERGGADYIHVDVMDGHFVPNITIGPLIVDAIRPVTTLPL   62

Query:   65 DCHLMVVDPERYIEAFAQAGADIMTIHVEATKHIHGALQKIKEAGHKAGVVINPGTPVES  124
            D HLM+  P+ YI APA+AGADI+T+HVEA   H+H  L    IKE+G+KAGVV+NP TPV S
Sbjct:   63 DVHLMIEQPDGYIPAFAKAGADIITVHVEACPHLHRTLHLIKESGVKAGVVLNPATPVSS  122

Query:  125 LIPILDLVDQILIMTVNPGFGGQAFIPEMMSKVKTVAAWRKEYGHHYDIEVDGGIDNTTI  184
            +  +L   VD +L MTVNPGFGGQ FIP ++ K+K +A+ +KE G  ++IEVDGG++   T
Sbjct:  123 IQHVLSDVDMVLFMTVNPGFGGQRFIPSVLPKLKELASLKKEQGLTFEIEVDGGVNEETA  182

Query:  185 KAAAEEAGANVFVAGSYLFKASDLPAQVETLR                              215
            K      EAGANV VAGS +F   D   A ++ +R
Sbjct:  183 KQCVEAGANVLVAGSAVFNEEDRAAAIKGIR                               213
```

A related DNA sequence was identified in *S. pyogenes* <SEQ ID 5703> which encodes the amino acid sequence <SEQ ID 5704>. Analysis of this protein sequence reveals the following:

```
Possible site: 49
>>> Seems to have no N-terminal signal sequence

----- Final Results -----
            bacterial cytoplasm --- Certainty = 0.0072(Affirmative) < succ>
            bacterial membrane  --- Certainty = 0.0000(Not Clear)   < succ>
            bacterial outside   --- Certainty = 0.0000(Not Clear)   < succ>
```

An alignment of the GAS and GBS proteins is shown below.

```
 Identities = 183/219 (83%), Positives = 198/219 (89%)

Query:    1 MSTNKIAPSILAADYANFANELKRIEETTAEYVHIDIMDGQFVPNISFGADVVSSMRKHS   60
            MST KIAPSILAADYANFA+EL  RIEET AEYVHIDIMDGQFVPNISFGADVV+SMRKHS
Sbjct:    1 MSTLKIAPSILAADYANFASELARIEETDAEYVHIDIMDGQFVPNISFGADVVASMRKHS   60

Query:   61 KLVFDCHLMVVDPERYIEAFAQAGADIMTIHVEATKHIHGALQKIKEAGMKAGVVINPGT  120
            KLVFDCHLMVVDPERY+EAFAQAGADIMTIH E+T++HIHGALQKIK AGMKAGVVINPGT
Sbjct:   61 KLVFDCHLMVVDPERYVEAFAQAGADIMTIHTESTRHIHGALQKIKAAGMKAGVVINPGT  120

Query:  121 PVESLIPILDLVDQILIMTVNPGFGGQAFIPEMMSKVKTVAAWRKEYGHHYDIEVDGGID  180
            P  +L P+LDLVDQ+LIMTVNPGFGGQAFIPE + KV TVA WR E G  +DIEVDGG+D
Sbjct:  121 PATALEPLLDLVDQVLIMTVNPGFGGQAFIPECLEKVATVAKWRDEKGLSFDIEVDGGVD  180

Query:  181 NTTIKAAAEEAGANVFVAGSYLFKASDLPAQVETLRVALD                      219
            N TI+A   EAGANVFVAGSYLFKASDL +QV+TLR AL+
Sbjct:  181 NKTIRACYEAGANVFVAGSYLFKASDLVSQVQTLRTALN                       219
```

Based on this analysis, it was predicted that these proteins and their epitopes could be useful antigens for vaccines or diagnostics.

EXAMPLE 1837

A DNA sequence (GBSx1944) was identified in *S. agalactiae* <SEQ ID 5705> which encodes the amino acid sequence <SEQ ID 5706>. Analysis of this protein sequence reveals the following:

```
Possible site: 17
>>> Seems to have no N-terminal signal sequence

----- Final Results -----
            bacterial cytoplasm --- Certainty = 0.2098(Affirmative) < succ>
            bacterial membrane  --- Certainty = 0.0000(Not Clear)   < succ>
            bacterial outside   --- Certainty = 0.0000(Not Clear)   < succ>
```

The protein has homology with the following sequences in the GENPEPT database.

```
>GP: CAB13451 GB: Z99112 similar to hypothetical proteins
[Bacillus subtilis]
Identities = 148/296 (50%), Positives = 202/296 (68%),
Gaps = 14/296 (4%)

Query:    2 QGRIVKSLAGFYYV----ESDGVVYQTRARGNFRKKGQIPYVGDWVEFSSQDQSEGYILS   57
            +G+I+K+L+GFYYV      E    V Q R RG FRK    P VGD+V + +++  EGY++
Sbjct:    3 EGKIIKALSGFYYVLDESEDSDKVIQCRGRGIFRKNKITPLVGDYVVYQAENDKEGYLME   62

Query:   58 IEERKNSLVRPPIVNIDQAVVIMSAKEPDFNANLLDRFLVLLEYKMIQPIIYISKLDLLD  117
            I+ER N L+RPPI N+DQAV++ SA +P F+  LLDRFLVL+E   IQPII I+K+DL++
Sbjct:   63 IKERTNELIRPPICNVDQAVLVFSAVQPSFSTALLDRFLVLVEANDIQPIICITKMDLIE  122

Query:  118 DLVVIDDIR---EHYQNIGY-VFCYSQEE------LLPLLANKVTVFMGQTGVGKSTLLN  167
            D     D I+   E Y+NIGY V+  S ++      ++P   +K TVF GQ+GVGKS+LLN
Sbjct:  123 DQDTEDTIQAYAEDYRNIGYDVYLTSSKDQDSLADIIPHFQDKTTVFAGQSGVGKSSLLN  182

Query:  168 KIAPELKLETGEISGSLGRGRHTTRAVSFYNVHKGKIADTPGFSSLDYEVDNAEDLNESF  227
             +PEL L T EIS  LGRG+HTTR V  +   G +ADTPGFSSL++      E+L  +F
Sbjct:  183 AISPELGLRTNEISEHLGRGKHTTRHVELIHTSGGLVADTPGFSSLEFTDIEEEELGYTF  242

Query:  228 PELRRLSHFCKFRSCTHTHEPKCAVKEALTQGQLWQVRYDNYLQFLSEIESRRETY      283
            P++R  S  CKFR  C H  EPKCAVK+A+  G+L Q RYD+Y++F++EI+ R+  Y
Sbjct:  243 PDIREKSSSCKFRGCLHLKEPKCAVKQAVEDGELKQYRYDHYVEFMTEIKDRKPRY     298
```

A related DNA sequence was identified in *S. pyogenes* [25] <SEQ ID 5707> which encodes the amino acid sequence <SEQ ID 5708>. Analysis of this protein sequence reveals the following:

```
Possible site: 17
>>> Seems to have no N-terminal signal sequence

----- Final Results -----
            bacterial cytoplasm --- Certainty = 0.2290(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below.

```
Identities = 230/290 (79%), Positives = 257/290 (88%)

Query:    1 MQGRIVKSLAGFYYVESDGVVYQTRARGNFRKKGQIPYVGDWVEFSSQDQSEGYILSIEE   60
            +QG+I+KSLAGFYYVES+G VYQTRARGNFRK+G+ PYVGD V+FS++D SEGYIL+I
Sbjct:    1 LQGKIIKSLAGFYYVESEGQVYQTRARGNFRKRGETPYVGDIVDFSAEDNSEGYILAIHP   60

Query:   61 RKNSLVRPPIVNIDQAVVIMSAKEPDFNANLLDRFLVLLEYKMIQPIIYISKLDLLDDLV  120
            RKNSLVRPPIVNIDQAVVIMSAKEP+FN+NLLDRFL+LLE+K I P++YISK+DLLD
Sbjct:   61 RKNSLVRPPIVNIDQAVVIMSAKEPEFNSNLLDRFLILLEHKAIHPVVYISKMDLLDSPE  120

Query:  121 VIDDIREHYQNIGYVFCYSQEELLPLLANKVTVFMGQTGVGKSTLLNKIAPELKLETGEI  180
               I  I     YQ IGY F  S EELLPLLA+K+TVFMGQTGVGKSTLLN+IAPEL LE GEI
Sbjct:  121 EIKAIGRQYQAIGYDFVTSLEELLPLLADKITVFMGQTGVGKSTLLNRIAPELALEIGEI  180

Query:  181 SGSLGRGRHTTRAVSFYNVHKGKIADTPGFSSLDYEVDNAEDLNESFPELRRLSHFCKFR  240
            S  SLGRGRHTTRAVSFYN H GKIADTPGFSSLDY++  NAEDLNE+FPELRRLSH CKFR
Sbjct:  181 SDSLGRGRHTTRAVSFYNTHGGKIADTPGFSSLDYDIANAEDLNEAFPELRRLSHECKFR  240

Query:  241 SCTHTHEPKCAVKEALTQGQLWQVRYDNYLQFLSEIESRRETYKKVIKRK            290
            SCTHTHEPKCAVK AL  G+LW VRY++YLQFLSEIE+RRETYKKVIKRK
Sbjct:  241 SCTHTHEPKCAVKAALETGELWPVRYEHYLQFLSEIENRRETYKKVIKRK            290
```

Based on this analysis, it was predicted that these proteins and their epitopes could be useful antigens for vaccines or diagnostics.

EXAMPLE 1838

A DNA sequence (GBSx1945) was identified in *S. agalactiae* <SEQ ID 5709> which encodes the amino acid sequence <SEQ ID 5710>. This protein is predicted to be rRNA. Analysis of this protein sequence reveals the following:

```
Possible site: 17
>>> Seems to have no N-terminal signal sequence
    INTEGRAL     Likelihood = -0.43    Transmembrane    259-275 (259-275)

----- Final Results -----
            bacterial membrane --- Certainty = 0.1171(Affirmative) < succ>
            bacterial outside  --- Certainty = 0.0000(Not Clear)   < succ>
          bacterial cytoplasm  --- Certainty = 0.0000(Not Clear)   < succ>
```

The protein has homology with the following sequences in the GENPEPT database.

```
>GP: CAB15937 GB: Z99124 similar to hypothetical proteins
[Bacillus subtilis]
Identities = 95/278 (34%), Positives = 147/278 (52%),
Gaps = 16/278 (5%)

Query:   14 SYFACPKCQNPLIKESN-SLKCSDN-HCFDLSKFGYVNLLGGKKVDEHYDKKSFENR-QL   70
            S F CP C + +   S  SL C++ H FDLS+ GYVN L   K V   Y   + FE R +L
Sbjct:    8 SMFRCPLCDSSMDAASGKSLICTERGHTFDLSRHGYVNFLT-KPVKTSYGAELFEARSRL   66

Query:   71 VLENGYYNHILEAISKVLENNSQFH---SVLDIGCGEGFYSRQLVNKHEKTFLAF----D  123
              + E G+++ + +AI++++ +     H   ++LD GCGEG +      L     A      D
Sbjct:   67 IGECGFFDPLHDAIAELISHPKSGHEAFTILDSGCGEGSHLNALCGFDYAGKAAIGTGID  126

Query:  124 ISKDSIQLAAKSDQSRLVKWFVSDLANLPIQDSSIDIILDIFSPANYKEFRRVLSDDGIL  183
             +SKD I  A+K+ +  +   W V+D+A   P   D    D++L IFSP+NY EF R+L +DG+L
Sbjct:  127 LSKDGILKASKAFKDLM--WAVADVARAPFHDRQFDVVLSIFSPSNYAEFHRLLKNDGML  184

Query:  184 VKVVPVAEHVQELREKASQYLKQKDYSNQKILDHFRENFEIISEQKVVQSYNCSQQERQA  243
             +KVVP ++++ ELR+          ++ YSN  ++ F  N          ++          QQ
Sbjct:  185 IKVVPRSDYLIELRQFLYTDSPRRTYSNTAAVERFTANAAHSRPVRLRYVKTLDQQAIHW  244

Query:  244 FIDMTPLLFSVDKTTIDW---ASISEITVGALIVIGKK                        278
             + MTPL +S  K  +       ++ITV   I+IG K
Sbjct:  245 LLKMTPLAWSAPKDRVSLLKEMKSADITVDVDILIGMK                        282
```

No corresponding DNA sequence was identified in *S. pyogenes*.

Based on this analysis, it was predicted that this protein and its epitopes, could be useful antigens for vaccines or diagnostics.

EXAMPLE 1839

A DNA sequence (GBSx1946) was identified in *S. agalactiae* <SEQ ID 5711> which encodes the amino acid sequence <SEQ ID 5712>. This protein is predicted to be dimethyladenosine transferase (ksgA). Analysis of this protein sequence reveals the following:

```
Possible site: 61
>>> Seems to have no N-terminal signal sequence

----- Final Results -----
          bacterial cytoplasm --- Certainty = 0.3257(Affirmative) < succ>
           bacterial membrane --- Certainty = 0.0000(Not Clear)   < succ>
            bacterial outside --- Certainty = 0.0000(Not Clear)   < succ>
```

The protein has homology with the following sequences in the GENPEPT database

```
>GP: CAB11818 GB: Z99104 dimethyladenosine transferase
[Bacillus subtilis]
Identities = 157/284 (55%), Positives = 215/284 (75%),
Gaps = 2/284 (0%)

Query:    3 IADKTVTRAILERHGFTFKKSFGQNFLTDTNILQKIVDTAEIDKGVNVIEIGPGIGALTE   62
            IA    T+ IL+++GF+FKKS GQNFL DTNIL +IVD AE+ +   VIEIGPGIGALTE
Sbjct:    5 IATPIRTKEILKKYGFSFKKSLGQNFLIDTNILNRIVDHAEVTEKTGVIEIGPGIGALTE   64

Query:   63 FLAENAAEVMAFEIDDRLIPILADTLARFDNVQVVNQDILKADLQTQIQA-FKNPDLPIK  121
            LA+ A +V+AFEID RL+PIL DTL+ ++NV V++QD+LKAD+++ I+   F++ D  I
Sbjct:   65 QLAKRAKKVVAFEIDQRLLPILKDTLSPYENVTVIHQDVLKADVKSVIEEQFQDCD-EIM  123

Query:  122 VVANLPYYITTPILMHLIESKIPFAEFVVMIQKEVADRISAMPNTKAYGSLSIAVQYYMT  181
            VVANLPYY+TTPI+M L+E  +P    VVM+QKEVA+R++A P++K YGSLSIAVQ+Y
Sbjct:  124 VVANLPYYVTTPIIMKLLEEHLPLKGIVVMLQKEVAERMAADPSSKEYGSLSIAVQFYTE  183

Query:  182 AKVSFIVPRTVFVPAPNVDSAILKMVRRDQPVVSVQDEDFFFRVSKVAFVHRRKTLWNNL  241
            AK   IVP+TVFVP PNVDSA+++++ RD P V V++E FFF++ K +F  RRKTL NNL
Sbjct:  184 AKTVMIVPKTVFVPQPNVDSAVIRLILRDGPAVDVENESFFFQLIKASFAQRRKTLLNNL  243

Query:  242 TSHFGKSEDTKAKLEKALEIAKIKPSIRGEALSIPDFASLADAL                285
            ++   + +    K+ +E+ LE    I      RGE+LSI +FA+L++  L
Sbjct:  244 VNNLPEGKAQKSTIEQVLEETNIDGKRRGESLSIEEFAALSNGL                287
```

A related DNA sequence was identified in S. pyogenes <SEQ ID 5713> which encodes the amino acid sequence <SEQ ID 5714>. Analysis of this protein sequence reveals the following:

```
Possible site: 19
>>> Seems to have no N-terminal signal sequence

----- Final Results -----
            bacterial cytoplasm --- Certainty = 0.2420(Affirmative) < succ>
            bacterial membrane  --- Certainty = 0.0000(Not Clear)   < succ>
            bacterial outside   --- Certainty = 0.0000(Not Clear)   < succ>
```

An alignment of the GAS and GBS proteins is shown below.

```
Identities = 257/290 (88%), Positives = 275/290 (94%)

Query:    1 MRIADKTVTRAILERHGFTFKKSFGQNFLTDTNILQKIVDTAEIDKGVNVIEIGPGIGAL   60
            MRIAD +VT+A+L+RHGFTFKKSFGQNFLTDTNILQKIVDTAEID+ VNVIEIGPGIGAL
Sbjct:    9 MRIADYSVTKAVLDRHGFTFKKSFGQNFLTDTNILQKIVDTAEIDQNVNVIEIGPGIGAL   68

Query:   61 TEFLAENAAEVMAFEIDDRLIPILADTLARFDNVQVVNQDILKADLQTQIQAFKNPDLPI  120
            TEFLAENAAEVMAFEIDDRL+PILADTL  FDNVQVVNQDILKADLQTQI+ FKNPDLPI
Sbjct:   69 TEFLAENAAEVMAFEIDDRLVPILADTLRDFDNVQVVNQDILKADLQTQIKQFKNPDLPI  128

Query:  121 KVVANLPYYITTPILMHLIESKIPFAEFVVMIQKEVADRISAMPNTKAYGSLSIAVQYYM  180
            KVVANLPYYITTPILMHLIESKIPF EFVVM+Q+EVADRISA PNTKAYGSLSIAVQYYM
Sbjct:  129 KVVANLPYYITTPILMHLIESKIPFQEFVVMMQREVADRISAEPNTKAYGSLSIAVQYYM  188

Query:  181 TAKVSFIVPRTVFVPAPNVDSAILKMVRRDQPVVSVQDEDFFFRVSKVAFVHRRKTLWNN  240
            TAKV+FIVPRTVFVPAPNVDSAILKMVRRDQP++ V+DEDFFFRVS+++FVHRRKTLWNN
Sbjct:  189 TAKVAFIVPRTVFVPAPNVDSAILKMVRRDQPLIEVKDEDFFFRVSRLSFVHRRKTLWNN  248

Query:  241 LTSHFGKSEDTKAKLEKALEIAKIKPSIRGEALSIPDFASLADALKEVGI           290
            LTSHFGKSED KAKLEK L +A IKPSIRGEALSI DF  LADALKEVG+
Sbjct:  249 LTSHFGKSEDIKAKLEKGLALADIKPSIRGEALSIQDFGKLADALKEVGL           298
```

Based on this analysis, it was predicted that these proteins and their epitopes could be useful antigens for vaccines or diagnostics.

EXAMPLE 1840

A DNA sequence (GBSx1947) was identified in *S. agalactiae* <SEQ ID 5715> which encodes the amino acid sequence <SEQ ID 5716>. Analysis of this protein sequence reveals the following:

```
Possible site: 20
>>> Seems to have no N-terminal signal sequence

----- Final Results -----
            bacterial cytoplasm --- Certainty = 0.0736 (Affirmative) <succ>
            bacterial membrane  --- Certainty = 0.0000 (Not Clear)   <succ>
              bacterial outside --- Certainty = 0.0000 (Not Clear)   <succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1841

A DNA sequence (GBSx1948) was identified in *S. agalactiae* <SEQ ID 5717> which encodes the amino acid sequence <SEQ ID 5718>. Analysis of this protein sequence reveals the following:

```
Possible site: 59
>>> Seems to have no N-terminal signal sequence

----- Final Results -----
            bacterial cytoplasm --- Certainty = 0.3031 (Affirmative) <succ>
            bacterial membrane  --- Certainty = 0.0000 (Not Clear)   <succ>
              bacterial outside --- Certainty = 0.0000 (Not Clear)   <succ>
```

The protein has homology with the following sequences in the GENPEPT database.

```
>GP:CAB11817 GB:Z99104 similar to hypothetical proteins
[Bacillus subtilis]
Identities = 81/179 (45%), Positives = 117/179 (65%), Gaps = 4/179 (2%)

Query:   7  IQEVIVVEGKDDTANLRRFYNVDTYETRGSAIDEDDLERIERLHNLRGVIVFTDPDYNGE   66
            I+E+IVVEG+DDTA ++   + DT ET GSAID+ +++I    RGVI+ TDPD+ GE
Sbjct:   3  IKEIIVVEGRDDTARIKLAVDADTIETNGSAIDDHVIDQIRLAQKTRGVIILTDPDFPGE   62

Query:  67  RIRKIIMNAIPTVRHAFLNRDEAKPGSKTKGRSLGVEHASFEDLQKALSKVTQHFDDEDH  126
            +IRK I  A+P  +HAFL +   AKP +K   R +GVEHAS E ++   L  V +  + +
Sbjct:  63  KIRKTISEAVPGCKHAFLPKHLAKPKNK---RGIGVEHASVESIRACLENVHEEMEAQPS  119

Query: 127  FDITQADLIRWGFITASDSRKRREYLGNQLRIGYSNGKQLLKRLRLFGVTKAEVEECME   185
            DI+  DLI  G I    ++ RRE LG+ L+IGY+NGKQL KRL++F + K++    ++
Sbjct: 120  -DISAEDLIHAGLIGGPAAKCRRERLGDLLKIGYTNGKQLQKRLQMFQIKKSDFMSALD   177
```

A related DNA sequence was identified in *S. pyogenes* <SEQ ID 5719> which encodes the amino acid sequence <SEQ ID 5720>. Analysis of this protein sequence reveals the following:

```
Possible site: 16
>>> Seems to have no N-terminal signal sequence

----- Final Results -----
            bacterial cytoplasm --- Certainty = 0.1474 (Affirmative) <succ>
            bacterial membrane  --- Certainty = 0.0000 (Not Clear)   <succ>
              bacterial outside --- Certainty = 0.0000 (Not Clear)   <succ>
```

An alignment of the GAS and GBS proteins is shown below.

```
Identities = 146/187 (78%), Positives = 165/187 (88%)

Query:    1  MMKKIDIQEVIVVEGKDDTANLRRFYNVDTYETRGSAIDEDDLERIERLHNLRGVIVFTD   60
             + +KI+IQEV+VVEGKDDTANLRRFY VDTYETRGSAI E+DLERI RL++LRGVIV TD
Sbjct:   15  LTEKINIQEVLVVEGKDDTANLRRFYEVDTYETRGSAITEEDLERINRLNDLRGVIVLTD   74

Query:   61  PDYNGERIRKIIMNAIPTVRHAFLNRDEAKPGSKTKGRSLGVEHASFEDLQKALSKVTQH  120
             PDYNGERIRK+IM A+PT RHAFLNR+EA P SK+KGRSLGVEHA+FEDLQKAL+ VTQ
Sbjct:   75  PDYNGERIRKLIMAAVPTARHAFLNRNEAVPSSKSKGRSLGVEHANFEDLQKALAHVTQQ  134

Query:  121  FDDEDHFDITQADLIRWGFITASDSRKRREYLGNQLRIGYSNGKQLLKRLRLFGVTKAEV  180
             +DDE +FDI Q DLIR G + ASDSRKRREYLG +LRIGY+NGKQLLKRL LFG+T AEV
Sbjct:  135  YDDESYFDIRQTDLIRLGLLMASDSRKRREYLGEKLRIGYANGKQLLKRLELFGITLAEV  194

Query:  181  EECMEGY                                                      187
             EE ME Y
Sbjct:  195  EEVMETY                                                      201
```

Based on this analysis, it was predicted that these proteins and their epitopes could be useful antigens for vaccines or diagnostics.

EXAMPLE 1842

A DNA sequence (GBSx1949) was identified in *S. agalactiae* <SEQ ID 5721> which encodes the amino acid sequence <SEQ ID 5722>. Analysis of this protein sequence reveals the following:

```
Possible site: 15
>>> Seems to have no N-terminal signal sequence

----- Final Results -----
            bacterial cytoplasm --- Certainty = 0.4955 (Affirmative) <succ>
            bacterial membrane  --- Certainty = 0.0000 (Not Clear)   <succ>
             bacterial outside  --- Certainty = 0.0000 (Not Clear)   <succ>
```

A related GBS nucleic acid sequence <SEQ ID 10139> which encodes amino acid sequence <SEQ ID 10140> was also identified.

The protein has homology with the following sequences in the GENPEPT database.

```
>GP:CAB11815 GB:Z99104 similar to hypothetical proteins
[Bacillus subtilis]
Identities = 115/254 (45%), Positives = 172/254 (67%)

Query:   28  IFDTHTHLNVENFEGKIDEEINLASELGVTKMNVVGFDQDTISKSLELSSQYAQVYSTIG   87
             +FDTH HLN E ++  ++E I  A    V ++ VVGFD+ TI++++E+   +Y  +Y+ IG
Sbjct:    2  LFDTHAHLNAEQYDTDLEEVIERAKAEKVERIVVVGFDRPTITRAMEHIEEYDFIYAAIG   61

Query:   88  WHPTEAGSYDDNIESMIISHLENPKVIALGEIGLDYYWMEDPKDIQIEVFKRQIELSKEY  147
             WHP +A    +   + I    + KV+A+GE+GLDY+W + PKDIQ EVF+ QI L+KE
Sbjct:   62  WHPVDAIDMTEEDLAWIKELSAHEKVVAIGEMGLDYHWDKSPKDIQKEVFRNQIALAKEV  121

Query:  148  NLPFVVHTRDALEDTYEVIKESGVGPFGGIMHSFSGSLEMAQKFIDLGMMISFSGVVTFK  207
             NLP ++H RDA ED   ++KE G   GGIMH F+GS E+A++ + +    +SF G VTFK
Sbjct:  122  NLPIIIHNRDATEDVVTILKEEGAEAVGGIMHCFTGSAEVARECMKMNFYLSFGGPVTFK  181

Query:  208  KALDVQEAARELPLDKILVETDAPYLAPVPKRGRENKTAYTRYVVEKIAELRGITVEEVA  267
              A   +E  +E+P D++L+ETD P L P P RG+ N+  +Y +YV E+IAEL+ +T EE+A
Sbjct:  182  NAKKPKEVVKEIPNDRLLIETDCPFLTPHPFRGKRNEPSYVKYVAEQIAELKEMTFEEIA  241

Query:  268  EATYQNAVRIFRLD                                               281
              T +NA R+FR++
Sbjct:  242  SITTENAKRLFRIN                                               255
```

A related DNA sequence was identified in *S. pyogenes* <SEQ ID 5723> which encodes the amino acid sequence <SEQ ID 5724>. Analysis of this protein sequence reveals the following:

Possible site: 52
>>> Seems to have no N-terminal signal sequence

----- Final Results -----
            bacterial cytoplasm --- Certainty = 0.2817 (Affirmative) <succ>
            bacterial membrane  --- Certainty = 0.0000 (Not Clear)   <succ>
            bacterial outside   --- Certainty = 0.0000 (Not Clear)   <succ>

An alignment of the GAS and GBS proteins is shown below.

```
Identities = 190/258 (73%), Positives = 227/258 (87%)

Query:   24  DMIKIFDTHTHLNVENFEGKIDEEINLASELGVTKMNVVGFDQDTISKSLELSSQYAQVY   83
             + + IFDTHTHLNV  F+G    EE+ LA E+GV   NVVGFDQ TIS +L L+++YA +Y
Sbjct:   38  EKLTIFDTHTHLNVAEFQGHETEELTLAQEMGVAYHNVVGFDQATISGALTLANKYANIY   97

Query:   84  STIGWHPTEAGSYDDNIESMIISHLENPKVIALGEIGLDYYWMEDPKDIQIEVFKRQIEL  143
             +TIGWHPTEAGSY + +E  I+S L + KVIALGEIGLDYYWMEDPK++QIEVFKRQ++L
Sbjct:   98  ATIGWHPTEAGSYSEAVEEAIVSQLSHSKVIALGEIGLDYYWMEDPKEVQIEVFKRQMQL  157

Query:  144  SKEYNLPFVVHTRDALEDTYEVIKESGVGPFGGIMHSFSGSLEMAQKFIDLGMMISFSGV  203
             +K+++LPFVVHTRDALEDTYEVIK +GVGP GGIMHS+SGSLEMA++FI+LGMMISFSGV
Sbjct:  158  AKDHDLPFVVHTRDALEDTYEVIKAAGVGPRGGIMHSYSGSLEMAERFIELGMMISFSGV  217

Query:  204  VTFKKALDVQEAARELPLDKILVETDAPYLAPVPKRGRENKTAYTRYVVEKIAELRGITV  263
             VTFKKALD+QEAA+ LPLDKILVETDAPYL PVPKRG++N TAYTRYVV+KIAELRG+TV
Sbjct:  218  VTFKKALDIQEAAQHLPLDKILVETDAPYLTPVPKRGKQNHTAYTRYVVDKIAELRGMTV  277

Query:  264  EEVAEATYQNAVRIFRLD                                            281
             EEVA+AT  NA R+F+LD
Sbjct:  278  EEVAKATTANAKRVFKLD                                            295
```

Based on this analysis, it was predicted that these proteins and their epitopes could be useful antigens for vaccines or diagnostics.

EXAMPLE 1843

A DNA sequence (GBSx1950) was identified in *S. agalactiae* <SEQ ID 5725> which encodes the amino acid sequence <SEQ ID 5726>. This protein is predicted to be endosome-associated protein. Analysis of this protein sequence reveals the following:

Possible site: 31
>>> Seems to have no N-terminal signal sequence

----- Final Results -----
            bacterial cytoplasm --- Certainty = 0.5142 (Affirmative) <succ>
            bacterial membrane  --- Certainty = 0.0000 (Not Clear)   <succ>
            bacterial outside   --- Certainty = 0.0000 (Not Clear)   <succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1844

A DNA sequence (GBSx1951) was identified in *S. agalactiae* <SEQ ID 5727> which encodes the amino acid sequence <SEQ ID 5728>. This protein is predicted to be CG17785 gene product. Analysis of this protein sequence reveals the following:

Possible site: 14
>>> Seems to have no N-terminal signal sequence

----- Final Results -----
            bacterial cytoplasm --- Certainty = 0.4730 (Affirmative) < succ>
            bacterial membrane  --- Certainty = 0.0000 (Not Clear)   < succ>
            bacterial outside   --- Certainty = 0.0000 (Not Clear)   < succ>

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1845

A DNA sequence (GBSx1952) was identified in *S. agalactiae* <SEQ ID 5729> which encodes the amino acid sequence <SEQ ID 5730>. Analysis of this protein sequence reveals the following:

```
Possible site: 45
>>> Seems to have no N-terminal signal sequence

----- Final Results -----
            bacterial cytoplasm --- Certainty = 0.4032(Affirmative) < succ>
             bacterial membrane --- Certainty = 0.0000(Not Clear) < succ>
              bacterial outside --- Certainty = 0.0000(Not Clear) < succ>
```

The protein has homology with the following sequences in the GENPEPT database.

```
>GP: BAB01041 GB: AB022220 gene_id: MLN21.14~unknown protein
[Arabidopsis thaliana]
Identities = 49/185 (26%), Positives = 85/185 (45%), Gaps = 46/185 (24%)

Query:   5 LTDLDRVNIAKQEYELGSQLDTLVKIMSQDKVLPIGKVAHVQ------DGGKETGEQIYT   58
           L  +D V+  + + ELGS+    + +M+         K+  V+        D  K+  Q++
Sbjct: 154 LEGIDSVDSGRVRIELGSRGLMDLCVMASKLAYENAKMNLVEFLDCWNDYQKQMSTQVFV  213

Query:  59 ITPNGTLDKPEDVKEVTVLFKGSTAPFGGDDWKTD----WFKNDIPIASKL---LLKKFG  111
             T     DK +D  + + F+G T PF  DDW TD       W+  ++P    KL    L+    G
Sbjct: 214 FT-----DKQKDANLIVISFRG-TEPFDADDWGTDFDYSWY--EVPNVGKLHMGFLEAMG  265

Query: 112 ---------------SQSVSHKQGTKQ-----LEQSAH-----LLKEVMNKYPNAKISVY  146
                          Q+ S ++ +K+     +E+SA+     +LK +++++ NA+    V
Sbjct: 266 LGNRDDTTTFHYNLFEQTSSEEENSKKNLLDMVERSAYYAVRVILKRLLSEHENARFVVT  325

Query: 147 GHSLG                                                         151
           GHSLG
Sbjct: 326 GHSLG                                                         330
```

No corresponding DNA sequence was identified in *S. pyogenes*.

Based on this analysis, it was predicted that this protein and its epitopes, could be useful antigens for vaccines or diagnostics.

EXAMPLE 1846

A DNA sequence (GBSx1953) was identified in *S. agalactiae* <SEQ ID 5731> which encodes the amino acid sequence <SEQ ID 5732>. Analysis of this protein sequence reveals the following:

```
Possible site: 52
>>> Seems to have an uncleavable N-term signal seq
    INTEGRAL     Likelihood = -8.97     Transmembrane     12-28 (5-33)

----- Final Results -----
             bacterial membrane --- Certainty = 0.4588(Affirmative) < succ>
              bacterial outside --- Certainty = 0.0000(Not Clear) < succ>
            bacterial cytoplasm --- Certainty = 0.0000(Not Clear) < succ>
```

A related GBS nucleic acid sequence <SEQ ID 10141> which encodes amino acid sequence <SEQ ID 10142> was also identified.

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

A related GBS gene <SEQ ID 8909> and protein <SEQ ID 8910> were also identified. Analysis of this protein sequence reveals the following:

```
Lipop: Possible site: -1 Crend: 4
McG: Discrim Score: 14.01
GvH: Signal Score (-7.5): -5.55
     Possible site: 46
>>> Seems to have an uncleavable N-term signal seq
ALOM program count: 1 value: -8.97 threshold: 0.0
     INTEGRAL       Likelihood = -8.97      Transmembrane     6-22 (1-27)
     PERIPHERAL     Likelihood =  9.49           84
modified ALOM score: 2.29
*** Reasoning Step: 3

----- Final Results -----
              bacterial membrane  --- Certainty = 0.4588(Affirmative) < succ>
                bacterial outside --- Certainty = 0.0000(Not Clear)   < succ>
              bacterial cytoplasm --- Certainty = 0.0000(Not Clear)   < succ>
```

SEQ ID 8910 (GBS32) was expressed in *E. coli* as a His-fusion product. SDS-PAGE analysis of total cell extract is shown in FIG. 10 (lane 2; MW 15.6 kDa).

GBS32-His was purified as shown in FIG. 191, lane 8.

EXAMPLE 1847

A DNA sequence (GBSx1954) was identified in *S. agalactiae* <SEQ ID 5733> which encodes the amino acid sequence <SEQ ID 5734>. This protein is predicted to be extramembranal protein (dltD). Analysis of this protein sequence reveals the following:

```
Possible site: 31
>>> Seems to have an uncleavable N-term signal seq
     INTEGRAL     Likelihood = -10.24    Transmembrane     12-28 (4-31)

----- Final Results -----
              bacterial membrane  --- Certainty = 0.5097(Affirmative) < succ>
                bacterial outside --- Certainty = 0.0000(Not Clear)   < succ>
              bacterial cytoplasm --- Certainty = 0.0000(Not Clear)   < succ>
```

The protein has homology with the following sequences in the GENPEPT database.

```
>GP: AAC29041 GB: AF050517 unknown [Streptococcus mutans]
Identities = 242/421 (57%), Positives = 309/421 (72%), Gaps = 1/421 (0%)

Query:    1 MLKRLGKVFGPLVCALLLLVGLYFVFPVSQ-PHHLGKEKNSAVALTKAGFKSRVQKVRAF     59
            MLKRL  + GP+ CAL+L+   L  +P       H+  +EKN AVAL+ + FKS  +K+RA
Sbjct:    1 MLKRLWLILGPVFCALVLVFSLIMFYPAKHLSHNYNEEKNDAVALSPSSFKSTNKKMRAL    60

Query:   60 SDPKANFVPFFGSSEWLRFQAMHPSVLAEAYNRSYIPYLLGQKGAASLTQYYGIQQIKGQ    119
            SD   FVPFFGSSEW R D MHPSVLAE YNRSY PYLLGQKG+ SL+ Y+G+QQI   Q
Sbjct:   61 SDKRHLFVPFFGSSEWQRIDNMHPSVLAERYNRSYRPYLLGQKGSTSLSHYFGMQQIGNQ   120

Query:  120 IKNKKAIYVISPQWFVRKGANKGAFQNYFSNDQTIRFLQNQTGTTYDRYAARRLLKLYPE   179
            IKNKKA+YVISPQWFV KG +  AFQ YFS++Q   FL NQTG+T DRYAA+RLL + P
Sbjct:  121 IKNKKAVYVISPQWFVPKGTSPIAFQQYFSSEQLADFLLNQTGSTADRYAAKRLLDIKPS   180

Query:  180 ASMSDLIEKVADGQKLSNKDKQRLKFNDWVFEKTDAIFSYLPLGKTYNQAIMPHVGKLPK   239
             +++   +I+K+A G+ L++  D+   L+          +K DA+F  L      Y +  ++PHV KLPK
Sbjct:  181 SNLQGMIKKIAAGKTLNSFDRASLRLIKSFLKKEDALFGSLTFSDNYERRVLPHVKKLPK   240

Query:  240 AFSYNHLSRIASQDAKVATRSNQFGIQDRFYQTRIKKHLKKLKGSQRHFNYTKSPEFNDL   299
              FSY   LS+IAS+D +   T++NQF I+D FY   RIK   LK+LKG Q+   +Y +SPE+NDL
Sbjct:  241 HFSYGTLSQIASKDGQRLTKTNQFEINDHFYNKRIKGQLKRLKGFQKQLSYLQSPEYNDL   300

Query:  300 QLVLNEFSKQNTDVLFVIPPVNKKWTDYTGLDQKMYQKSVEKIKHQLQSQGFNHIADLSR   359
            QL L + +K   T V+FVIPPVN KW +YTGL Q  MYQK+VEKIK +QLQSQGF++IADLS+
Sbjct:  301 QLALTQLAKSKTKVIFVIPPVNAKWVEYTGLSQDMYQKTVEKIKYQLQSQGFDNIADLSK   360

Query:  360 DGGKPYFMQDTIHLGWNGWLELDKHINPFLTEENSKPNYHINNKFLKKSWAKYTGRPSDYK   420
             +G +PYFMQDTIHLGWNGWL  DK +NPFL+++  +P Y INN FL K WA YTG P  +K
Sbjct:  361 NGDQPYFMQDTIHLGWNGWLAFDKEVNPFLSKKQLQPAYKINNHFLSKKWATYTGNPFQFK   421
```

A related DNA sequence was identified in *S. pyogenes* <SEQ ID 5735> which encodes the amino acid sequence <SEQ ID 5736>. Analysis of this protein sequence reveals the following:

```
Possible site: 41
>>> Seems to have an uncleavable N-term signal seq
     INTEGRAL    Likelihood = -13.06    Transmembrane    7-23 (1-31)

----- Final Results -----
              bacterial membrane --- Certainty = 0.6222(Affirmative) < succ>
               bacterial outside --- Certainty = 0.0000(Not Clear) < succ>
             bacterial cytoplasm --- Certainty = 0.0000(Not Clear) < succ>
```

An alignment of the GAS and GBS proteins is shown below.

```
Identities = 209/410 (50%), Positives = 278/410 (66%)

Query:    1 MLKRLGKVFGPLVCALLLLVGLYFVFPVSQPHHLGKEKNSAVALTKAGFKSRVQKVRAFS   60
            MLKRL  + GPL+ A +L+V   F FP       H + +EK +AVA+T  + FK+ + K +A S
Sbjct:    1 MLKRLWLILGPLLIAFVLVVITIFSFPTQLDHSIAQEKANAVAITDSSFKNGLIKRQALS   60

Query:   61 DPKANFVPFFGSSEWLRFDAMHPSVLAEAYNRSYIPYLLGQKGAASLTQYYGIQQIKGQI  120
            D    FVPFFGSSEW R D+MHPSVLAE Y RSY P+L+G++G+ASL+ YYGIQQI  ++
Sbjct:   61 DETCRFVPFFGSSEWSRMDSMHPSVLAERYKRSYRPFLIGKRGSASLSHYYGIQQITNEM  120

Query:  121 KNKKAIYVISPQWFVRKGANKGAFQNYFSNDQTIRFLQNQTGTTYDRYAARRLLKLYPEA  180
            + KKAI+V+SPQWF   +G N   A Q Y SN   Q I  FL         ++AA+RLL+L  P
Sbjct:  121 QKKKAIFVVSPQWFTAQGINPSAVQMYLSNTQVIEFLLKARTDKESQFAAKRLLELNPGV  180

Query:  181 SMSDLIEKVADGQKLSNKDKQRLKFNDWVFEKTDAIFSYLPLGKTYNQAIMPHVGKLPKA  240
            S  S+L++KV+ G+ LS   D+   LK   V + +++FS+L     Y +  I+P V   LPK
Sbjct:  181 SKSNLLKKVSKGKSLSRLDRAILKCQHQVALREESLFSFLGKSTNYEKRILPRVKGLPKV  240

Query:  241 FSYNHLSRIASQDAKVATRSNQFGIDDRFYQTRIKKHLKKLKGSQRHFNYTKSPEFNDLQ  300
            FSY   L+  +A++   ++AT +N+FGI  + FY+ RI        K  Q +++Y   SPE+ND Q
Sbjct:  241 FSYKQLNALATKRGQLATTNNRFGIKNTFYRKRIAPKYNLYKNFQVNYSYLASPEYNDFQ  300

Query:  301 LVLNEFSKQNTDVLFVIPPVNKKWTDYTGLDQKMYQKSVEKIKHQLQSQGFNHIADLSRD  360
            L+L+EF+K+  TDVLFVI PVNK W DYTGL+Q  YQ +V KIK QL+SQGF+ IAD S+D
Sbjct:  301 LLLSEFAKRKTDVLFVITPVNKAWADYTGLNQDKYQAAVRKIKFQLKSQGFHRIADFSKD  360

Query:  361 GGKPYFMQDTIHLGWNGWLELDKHINPFLTEENSKPNYHINNKFLKKSWA           410
            GG+ YFMQDTIHLGWNGWL  DK + PFL  +    PNY +N  F  K WA
Sbjct:  361 GGESYFMQDTIHLGWNGWLAFDKKVQPFLETKQPVPNYKMNPYFYSKIWA           410
```

A related GBS gene <SEQ ID 8911> and protein <SEQ ID 8912> were also identified. Analysis of this protein sequence reveals the following:

```
Lipop: Possible site: -1 Crend: 6
McG: Discrim Score: 15.50
GvH: Signal Score (-7.5): -4.52
      Possible site: 31
>>> Seems to have an uncleavable N-term signal seq
ALOM program count: 1 value: -10.24 threshold: 0.0
      INTEGRAL        Likelihood = -10.24    Transmembrane    12-28 (4-31)
      PERIPHERAL      Likelihood = 8.33      301
modified ALOM score: 2.55
*** Reasoning Step: 3

----- Final Results -----
              bacterial membrane --- Certainty = 0.5097(Affirmative) < succ>
               bacterial outside --- Certainty = 0.0000(Not Clear) < succ>
             bacterial cytoplasm --- Certainty = 0.0000(Not Clear) < succ>
```

The protein has homology with the following sequences in the databases:

```
57.5/76.3% over 420aa
Streptoccocus mutans
GP|3403204|unknown Insert characterized ORF00336(301-1560 of 1860)
GP|3403204|gb|AAC29041.1||AF050517(1-421 of 421) unknown {Streptoccocus mutans}
% Match = 41.0
% Identity = 57.5    % Similarity = 76.2
Matches = 242   Mismatches = 99   Conservative Sub.s = 79

33          63          93         123         153         183         213         243
         FSGFLDLLWFPQPHNK**GVL*WILNQKY*QLLMTYLWRMFLL*WMKTYLTQEF*TAWVLLN*LLSWKATLILIFRLRNL 273         303         333         363                     420         450         480
         VVMTGTQLIKLLLE*RSSAMLKRLGKVFGPLVCALLLLVGLYFVFPVSQ-PHHLGKEKNSAVALTKAGFKSRVQKVRAFS
                                     ||||| ::||: |||:|:   |    :|  :   :|||  ||||: : |||   :|:||:|
                                     MLKRLWLILGPVFCALVLVFSLIMFYPAKHLSHNYNEEKNDAVALSPSSFKSTNKKMRALS
                                                 10          20          30          40          50          60

510         540         570         600         630         660         690         720
         DPKANFVPFFGSSEWLRFDAMHPSVLAEAYNRSYIPYLLGQKGAASLTQYYGIQQIKGQIKNKKAIYVISPQWFVRKGAN
         | :   ||||||||||| | ||||||||| |||| |||||||:  ||::|:|:|||   ||||||:||||||||| || :
         DKRHLFVPFFGSSEWQRIDNMHPSVLAERYNRSYRPYLLGQKGSTSLSHYFGMQQIGNQIKNKKAVYVISPQWFVPKGTS
                     80          90         100         110         120         130         140

750         780         810         840         870         900         930         960
         KGAFQNYFSNDQTIRFLQNQTGTTYDRYAARRLLKLYPEASMSDLIEKVADGQKLSNKDKQRLKFNDWVFEKTDAIFSYL
         |||  |||::|   ||||||:||| :   | |  : :::   :|::| |:   |::  |: |::  |   ::|:|:|  |
         PIAFQQYFSSEQLADFLLNQTGSTADRYAAKRLLDIKPSSNLQGMIKKIAAGKTLNSFDRASLRLIKSFLKKEDALFGSL
                    160         170         180         190         200         210         220

990        1020        1050        1080        1110        1140        1170        1200
         PLGKTYNQAIMPHVGKLPKAFSYNHLSRIASQDAKVATRSNQFGIDDRFYQTRIKKHLKKLKGSQRHFNYTKSPEFNDLQ
         :   |  : ::||| |||| ||  ||:|||:| :   |::|:|| |:  ||   |||  :|::||  |::::| :|||||
         TFSDNYERRVLPHVKKLPKHFSYGTLSQIASKDGQRLTKTNQFEINDHFYNKRIKGQLKRLKGFQKQLSYLQSPEYNDLQ
                    240         250         260         270         280         290         300

1230        1260        1290        1320        1350        1380        1410        1440
         LVLNEFSKQNTDVLFVIPPVNKKWTDYTGLDQKMYQKSVEKIKHQLQSQGFNHIADLSRDGGKPYFMQDTIHLGWNGWLE
         | |  ::: |   | |:|||||||  : |||| ||||:|||| |:| || ||:|||||:|| :||||||||||||||||
         LALTQLAKSKTKVIFVIPPVNAKWVEYTGLSQDMYQKTVEKIKYQLQSQGFDNIADLSKNGDQPYFMQDTIHLGWNGWLA
                    320         330         340         350         360         370         380

1470        1500        1530        1560        1590        1620        1650        1680
         LDKHINPFLTEENSKPNYHINNKFLKKSWAKYTGRPSDYK*IVESDDL*H*SY*SSFLISLYLVILR*LIHVL*FFIYNE
         :||  :||||:::  :| | |||  | ||| ||||  | |  :|
         FDKEVNPFLSKKQLQPAYKINNHFLSKKWATYTGNPFQFK
                    400         410         420
```

Based on this analysis, it was predicted that these proteins and their epitopes could be useful antigens for vaccines or diagnostics.

EXAMPLE 1848

A DNA sequence (GBSx1955) was identified in *S. agalactiae* <SEQ ID 5737> which encodes the amino acid sequence <SEQ ID 5738>. This protein is predicted to be d-alanyl carrier protein (dltC). Analysis of this protein sequence reveals the following:

```
Possible site: 21
>>> Seems to have no N-terminal signal sequence

----- Final Results -----
         bacterial cytoplasm --- Certainty = 0.1061 (Affirmative) < succ>
         bacterial membrane  --- Certainty = 0.0000 (Not Clear)   < succ>
          bacterial outside  --- Certainty = 0.0000 (Not Clear)   < succ>
```

The protein has homology with the following sequences in the GENPEPT database.

```
>GP: AAC05776 GB: AF051356 D-alanyl carrier protein [Streptococcus mutans]
Identities = 65/79 (82%), Positives = 74/79 (93%)

Query:   1  MDIKSEVLAIIDDLFMEDVSSMMDEDLFDAGVLDSMGTVELIVELESHFNIDIPIAEFGR    60
            MDIKSEVL IID+LFMEDVS MMDEDLFDAGVLDSMGTVELIVELE+HF+I +P++EFGR
```

-continued
```
Sbjct:   1 MDIKSEVLKIIDELFMEDVSDMMDEDLFDAGVLDSMGTVELIVELENHFDITVPVSEFGR    60

Query:  61 NDWNTANKIVAGVTELCNA                                            79
           +DWNTANKI+ G+TEL NA
Sbjct:  61 DDWNTANKIIEGITELRNA                                            79
```

A related DNA sequence was identified in *S. pyogenes* <SEQ ID 5739> which encodes the amino acid sequence <SEQ ID 5740>. Analysis of this protein sequence reveals the following:

```
Possible site: 38
>>> Seems to have no N-terminal signal sequence

----- Final Results -----
            bacterial cytoplasm --- Certainty = 0.3976 (Affirmative) < succ>
             bacterial membrane --- Certainty = 0.0000 (Not Clear)   < succ>
              bacterial outside --- Certainty = 0.0000 (Not Clear)   < succ>
```

An alignment of the GAS and GBS proteins is shown below.

```
Identities = 57/79 (72%), Positives = 65/79 (82%)

Query:   1 MDIKSEVLAIIDDLFMEDVSSMMDEDLFDAGVLDSMGTVELIVELESHFNIDIPIAEFGR    60
           M I+  V+ + D LFMEDVS MMDEDLFDAGVLDS+GTVELIVELES FNI +PI+EFGR
Sbjct:   1 MSIEETVIELFDRLFMEDVSEMMDEDLFDAGVLDSLGTVELIVELESTFNIKVPISEFGR    60

Query:  61 NDWNTANKIVAGVTELCNA                                            79
           +DWNT  KIV GV EL +A
Sbjct:  61 DDWNTVTKIVQGVEELQHA                                            79
```

Based on this analysis, it was predicted that these proteins and their epitopes could be useful antigens for vaccines or diagnostics.

EXAMPLE 1849

A DNA sequence (GBSx1956) was identified in *S. agalactiae* <SEQ ID 5741> which encodes the amino acid sequence <SEQ ID 5742>. Analysis of this protein sequence reveals the following:

```
Possible site: 16
>>> Seems to have an uncleavable N-term signal seq
     INTEGRAL    Likelihood = -8.55    Transmembrane    93-109  (91-117)
     INTEGRAL    Likelihood = -7.64    Transmembrane    21-37   (19-39)
     INTEGRAL    Likelihood = -6.79    Transmembrane   390-406  (387-410)
     INTEGRAL    Likelihood = -5.20    Transmembrane    41-57   (40-59)
     INTEGRAL    Likelihood = -2.07    Transmembrane   203-219  (200-221)
     INTEGRAL    Likelihood = -1.65    Transmembrane    65-81   (65-81)
     INTEGRAL    Likelihood = -0.75    Transmembrane   125-141  (125-141)

----- Final Results -----
             bacterial membrane --- Certainty = 0.4418(Affirmative) < succ>
              bacterial outside --- Certainty = 0.0000(Not Clear)   < succ>
            bacterial cytoplasm --- Certainty = 0.0000(Not Clear)   < succ>
```

A related DNA sequence was identified in *S. pyogenes* <SEQ ID 5743> which encodes the amino acid sequence <SEQ ID 5744>. Analysis of this protein sequence reveals the following:

```
Possible site: 57
>>> Seems to have an uncleavable N-term signal seq
    INTEGRAL     Likelihood = -10.14   Transmembrane   387-403  (382-409)
    INTEGRAL     Likelihood = -9.66    Transmembrane    18-34   (15-37)
    INTEGRAL     Likelihood = -5.95    Transmembrane    64-80   (63-81)
    INTEGRAL     Likelihood = -5.63    Transmembrane    92-108  (89-114)
    INTEGRAL     Likelihood = -1.97    Transmembrane    40-56   (40-56)
```

-continued

```
----- Final Results -----
           bacterial membrane --- Certainty = 0.5055 (Affirmative) < succ>
            bacterial outside --- Certainty = 0.0000 (Not Clear)  < succ>
          bacterial cytoplasm --- Certainty = 0.0000 (Not Clear)  < succ>
```

The protein has homology with the following sequences in the databases:

```
>GP: AAC05775 GB: AF051356 integral membrane protein [Streptococcus mutans]
Identities = 246/413 (59%), Positives = 319/413 (76%)

Query:   1 MMMFFSHIPYMEPYGNPIYFVYLILAFLPVIIGIFKQKRLSTYETLVSLVFILFMFGGDH    60
           M+ FF ++P++E YGNP YF Y+ILA LP+ IG+F +KR    YE  VSL++FI+ M G+
Sbjct:   1 MIDFFKNLPHLEAYGNPQYFFYIILAVLPIFIGLFFKKRFPLYEAFVSLIFIVLMLTGEK    60

Query:  61 YQQLVAFLFYLLWQIISVFAYQKYRENANSAGVFYLAIAMALFPLIWVKVAPLTGPSSQT   120
           Q+ A  FY++WQI V++Y+ YR++ ++  +FYL + M++ PL  VK+ P   + Q+
Sbjct:  61 SHQIFALFFYIIWQIFCVYSYKFYRKSRDNKWIFYLHVFMSILPLSLVKITPAIWTNQQS   120

Query: 121 LFSFLGISYLTFKSIGMIIEMRDGTLQEVRLPDFIRFMIFFPTFSSGPIDRFRHFQEDYH   180
           LF FLGISYLTF+S+GMI+EMRDG L    +FIRFM+F PTFSSGPIDRFR F +DY
Sbjct: 121 LFGFLGISYLTFRSVGMIMEMRDGVLTSFTFWEFIRFMLFMPTFSSGPIDRFRRFNDDYE   180

Query: 181 KLPERDDYFAMLNKAVMYLMLGFLYKHIISYCLGGILLPLLENKALMVGGYFNKETILVM   240
           K+P++D+    ML ++V Y+MLGF YK +++  LG ++LP L+  AL  GG+FN  T+ VM
Sbjct: 181 KIPDKDELLDMLEQSVHYIMLGFFYKFVLAQILGTMILPGLKEMALQKGGWFNWPTLGVM   240

Query: 241 YVYGLNLFFDFAGYSMFAIGISYLLGIRTPENFNMPFLSASLKDFWNRWHMSLSFWFRDY   300
           YVYGL+LFFDFAGYSMFAI IS  +GI++P NFN PF S   LK+FWNRWHMSLSFWFRD+
Sbjct: 241 YVYGLDLFFDFAGYSMFAIAISNFMGIKSPTNFNQPFKSQDLKEFWNRWHMSLSFWFRDF   300

Query: 301 VFMRLVHLLIKHKTFKNRNVTSGVAYLVNMLVMGFWHGLTWYYIAYGLFHGIGLIINDAW   360
           VFMRLV +L+K+K FKNRNVTS VAY+VNML+MGFWHG+TWYYI YGLFHG+GL++NDAW
Sbjct: 301 VFMRLVKVLVKNKVFKNRNVTSSVAYIVNMLIMGFWHGVTWYYITYGLFHGVGLVLNDAW   360

Query: 361 IRKKKEINRHRKKKGLSPLFQSRAFHVLCIVVTFHVVMFSLLLFSGFLNDLWF         413
           +RKKK +N+ RK K LSPL ++     L IV+TF+VVM S L+FSGFLNDLWF
Sbjct: 361 LRKKKRLNKERKAKNLSPLPENGWTRALGIVITFNVVMLSFLIFSGFLNDLWF         413
```

An alignment of the GAS and GBS proteins is shown below.

```
Identities = 240/416 (57%), Positives = 317/416 (75%), Gaps = 5/416 (1%)

Query:   5 FLEKLPHLDVYGNPQYFFYLILAVLPIYIGLFFKKRFALYEIIFSLSFIVMMLTGSTFNQ    64
           F   +P+++ YGNP YF YLILA LP+ IG+F +KR + YE + SL FI+ M  G + Q
Sbjct:   4 FFSHIPYMEPYGNPIYFVYLILAFLPVIIGIFKQKRLSTYETLVSLVFILFMFGGDHYQQ    63

Query:  65 LKSLLAYVVGQSLLVFIYKAYRKRFNHTLVFYVTVCLSIFPLFLVKLIPAISEDGHQSLF   124
           L + L Y++ Q + VF Y+ YR+ N    VFY+ + +++FPL VK+ P ++     Q+LF
Sbjct:  64 LVAFLFYLLWQIISVFAYQKYRENANSAGVFYLAIAMALFPLIWVKVAP-LTGPSSQTLF   122

Query: 125 GFLGISYLTFRAVAMIIEMRDGVLKEFTLWEFLRFLLFFPTFSSGPIDRFKRFNEDYINI   184
            FLGISYLTF+++ MIIEMRDG L+E  L +F+RF++FFPTFSSGPIDRF+ F EDY +
Sbjct: 123 SFLGISYLTFKSIGMIIEMRDGTLQEVRLPDFIRFMIFFPTFSSGPIDRFRHFQEDYNKL   182

Query: 185 PDRNELLDMLGQAIHYLMLGFLYKFILAYIFGSLIMPPLKELALEQGGVFNWPTLGVMYA   244
           P+R++   ML +A+ YLMLGFLYK I++Y  G +++P L+  AL  GG FN  T+ VMY
Sbjct: 183 PERDDYFAMLNKAVMYLMLGFLYKHIISYCLGGILLPLLENKALMVGGYFNKETILVMYV   242

Query: 245 FGFDLFFDFAGYTMFALAISNLMGIKSPINFDKPFKSRDLKEFWNRWHMSLSFWFRDFVF   304
           +G +LFFDFAGY+MFA+ IS L+GI++P NF+ PF S   LK+FWNRWHMSLSFWFRD+VF
Sbjct: 243 YGLNLFFDFAGYSMFAIGISYLLGIRTPENFNMPFLSASLKDFWNRWHMSLSFWFRDYVF   302

Query: 305 MRLVKLLVKNKVFKNRNVTSSVAYIINMLLMGFWHGLTWYYIAYGLFHGIGLVINDAWVR   364
           MRLV LL+K+K FKNRNVTS VAY++NML+MGFWHGLTWYYIAYGLFHGIGL+INDAW+R
Sbjct: 303 MRLVHLLIKHKTFKNRNVTSGVAYLVNMLVMGFWHGLTWYYIAYGLFHGIGLIINDAWIR   362

Query: 365 KKKNINKERRLAKKPLLP--ENKWTYALGVFITFNVVMFSFLIFSGFLDLLWFPQP      418
           KKK IN+ R+  KK L P   +   + L +  +TF+VVMFS L+FSGFL+ LWF +P
Sbjct: 363 KKKEINRHRHK--KKGLSPLFQSRAFHVLCIVVTFHVVMFSLLLFSGFLNDLWFNRP     416
```

A related GBS gene <SEQ ID 8913> and protein <SEQ ID 8914> were also identified. Analysis of this protein sequence reveals the following:

```
Lipop: Possible site: -1 Crend: 10
McG: Discrim Score: 3.22
GvH: Signal Score (-7.5): -4.56
     Possible site: 16
>>> Seems to have an uncleavable N-term signal seq
ALOM program   count: 7 value:  -8.55 threshold: 0.0
    INTEGRAL    Likelihood = -8.55    Transmembrane   93-109 (91-117)
    INTEGRAL    Likelihood = -7.64    Transmembrane   21-37  (19-39)
    INTEGRAL    Likelihood = -6.79    Transmembrane   390-406 (387-410)
    INTEGRAL    Likelihood = -5.20    Transmembrane   41-57  (40-59)
    INTEGRAL    Likelihood = -2.07    Transmembrane   203-219 (200-221)
    INTEGRAL    Likelihood = -1.65    Transmembrane   65-81  (65-81)
    INTEGRAL    Likelihood = -0.75    Transmembrane   125-141 (125-141)
    PERIPHERAL  Likelihood = 1.01            322
modified ALOM score: 2.21

*** Reasoning Step: 3

----- Final Results -----
              bacterial membrane --- Certainty = 0.4418 (Affirmative) < succ>
                bacterial outside --- Certainty = 0.0000 (Not Clear) < succ>
              bacterial cytoplasm --- Certainty = 0.0000 (Not Clear) < succ>
```

The protein has homology with the following sequences in the databases:

```
ORF1206(313-1563 of 1863)
GP|2952530|gb|AAC05775.1||AF051356(4-419 of 420) integral membrane protein
{Streptococcus mutans}
% Match = 50.3
% Identity = 71.0  % Similarity = 86.6
Matches = 296   Mismatches = 55   Consevative Sub.s = 65

273        303        333        363        393        423        453        483
TFDTKWEN*YQRSYERGKQVIQAFLEKLPHLDVYGNPQYFFYLILAVLPIYIGLFFKKRFALYEIIFSLSFIVMMLTGST
               |::  ||||:  ||||||||:|||||||:|||||||||   |||   ||  |||:||||
              MIDFFKNLPHLEAYGNPQYFFYIILAVLPIFIGLFFKKRFPLYEAFVSLIFIVMLTGEK
                     10        20        30        40        50        60

513        543        573        603        633        663        693        723
FNQLKSLLAYVVGQSLLVFIYKAYRKRFNHTLVFYVTVCLSIFPLFLVKLIPAISEDGHQSLFGFLGISYLTFRAVAMII
:|:  :|:  |::   |  :|   ||  |||    ::    :||:   :||:|| |||:  |||  :|||||||||||:|  ||:
SHQIFALFFYIIWQIFCVYSYKFYRKSRDNKWIFYLHVFMSILPLSLVKITPAIWTN-QQSLFGFLGISYLTFRSVGMIM
      70        80        90        100       110       120       130

753        783        813        843        873        903        933        963
EMRDGVLKEFTLWEFLRFLLFFPTFSSGPIDRFKRFNEDYINIPDRNELLDMLGQAIHYLMLGFLYKFILAYIFGSLIMP
||||||| ||:|||:||:||||||||||||||:|||:|| ||| :||||||| |::||:||||:||||||  |:|::|:|
EMRDGVLTSFTFWEFIRFMLFMPTFSSGPIDRFRRFNDDYEKIPDKDELLDMLEQSVHYIMLGFFYKFVLAQILGTMILP
         150       160       170       180       190       200       210

993        1023       1053       1083       1113       1143       1173       1203
PLKELALEQGGVFNWPTLGVMYAFGFDLFFDFAGYTMFALAISNLMGIKSPINFDKPFKSRDLKEFWNRWHMSLSFWFRD
|||:||::||  ||||||||||||||  :|:|||||||||:|||:||||||||  :|||:|:|||||||||||||||||||
GLKEMALQKGGWFNWPTLGVMYVYGLDLFFDFAGYSMFAIAISNFMGIKSPTNFNQPFKSQDLKEFWNRWHMSLSFWFRD
         230       240       250       260       270       280       290

1233       1263       1293       1323       1353       1383       1413       1443
FVFMRLVKLLVKNKVFKNRNVTSSVAYIINMLLMGFWHGLTWYYIAYGLFHGIGLVINDAWVRKKKNINKERRLAKKPLL
||||||||:|||||||||||||||||||:|||:|||||||:||||||:|||||:|||||:|||::|||||| :|||:  |
FVFMRLVKVLVKNKVFKNRNVTSSVAYIVNMLIMGFWHGVTWYYITYGLFHGVGLVLNDAWLRKKKRLNKERKAKNLSPL
         310       320       330       340       350       360       370

1473       1503       1533       1563       1593       1623       1653       1683
PENKWTYALGVFITFNVVMFSFLIFSGFLDLLWFPQPHNK**GVL*WILNQKY*QLLMTYLWRMFLL*WMKTYLTQEF*T
|||  ||  |||: |||||||:||||||||: |||      :|
PENGWTRALGIVITFNVVMLSFLIFSGFLNDLWFADQLSKK
         390       400       410       420
```

Based on this analysis, it was predicted that these proteins and their epitopes could be useful antigens for vaccines or diagnostics.

EXAMPLE 1850

A DNA sequence (GBSx1957) was identified in *S. agalactiae* <SEQ ID 5745> which encodes the amino acid sequence <SEQ ID 5746>. Analysis of this protein sequence reveals the following:

```
Possible site: 45
>>> Seems to have no N-terminal signal sequence

----- Final Results -----
              bacterial cytoplasm --- Certainty = 0.2611 (Affirmative) < succ>
               bacterial membrane --- Certainty = 0.0000 (Not Clear)   < succ>
                bacterial outside --- Certainty = 0.0000 (Not Clear)   < succ>
```

A related GBS nucleic acid sequence <SEQ ID 10143> which encodes amino acid sequence <SEQ ID 10144> was also identified.

The protein has homology with the following sequences in the GENPEPT database.

```
>GP: AAC05774 GB: AF051356 D-alanine-D-alanyl carrier protein ligase
[Streptococcus mutans]
Identities = 404/510 (79%), Positives = 465/510 (90%)

Query:   5 IHDMIKTIEHFAETQADFPVYDILGEVHTYGQLKVDSDSLAAHIDSLGLVEKSPVLVFGG   64
             I DMI TIE+FA+ QA+FPVY+ILGE+HTYG+LK DSDSLAAH+D L L  KSPV+VFGG
Sbjct:   6 IKDMIATIENFAQEQAEFPVYNILGEIHTYGELKADSDSLAAHLDQLDLTAKSPVVVFGG   65

Query:  65 QEYEMLATFVALTKSGHAYIPVDQHSALDRIQAIMTVAQPSLIISIGEFPLEVDNVPILD  124
             QEY MLA+FVALTKSGHAYIP+D HSAL+RI+AI+ VA+PSL+I++ +FP++    VP++
Sbjct:  66 QEYAMLASFVALTKSGHAYIPIDHHSALERIEAILEVAEPSLVIAVDDFPIDNLQVPVIQ  125

Query: 125 VSQVSAIFEEKTPYEVTHSVKGDDNYYIIFTSGTTGLPKGVQISHDNLLSFTNWMISDDE  184
                SQ+  IF++K  Y++ H+VKGDD YYIIFTSGTTG PKGVQISHDNLLSFTNWMI+ +
Sbjct: 126 YSQLEEIFKQKLSYQINHAVKGDDTYYIIFTSGTTGKPKGVQISHDNLLSFTNWMINAEA  185

Query: 185 FSVPERPQMLAQPPYSFDLSVMYWAPTLAMGGTLFALPKTVVNDFKKLFATINELPIQVW  244
             F+ P RPQMLAQPPYSFDLSVMYWAPTLA+GGTLFALPK +  DFK+LF TIN+LPI VW
Sbjct: 186 FATPHRPQMLAQPPYSFDLSVMYWAPTLALGGTLFALPKEITADFKQLFTTINQLPIGVW  245

Query: 245 TSTPSFADMALLSNDFNSETLPQLTHFYFDGEELTVKTAQKLRQRFPKARIVNAYGPTEA  304
             TSTPSF DMA+LS+DFN++ LP LTHFYFDGEELTVKTA+KLRQRFP+ARIVNAYGPTEA
Sbjct: 246 TSTPSFVDMAMLSDDFNAQQLPHLTHFYFDGEELTVKTAKKLRQRFPQARIVNAYGPTEA  305

Query: 305 TVALSAVAITDEMLETCKRLPIGYTKDDSPTYVIDEEGHKLPNGEQGEIIIAGPAVSKGY  364
             TVALSA+A+TD+MLETCKRLPIGYTK DSPT++IDE GHKL NG+QGEII++GPAVSKGY
Sbjct: 306 TVALSALAVTDKMLETCKRLPIGYTKPDSPTFIIDESGHKLANGQQGEIIVSGPAVSKGY  365

Query: 365 LNNPEKTAEAFFQFEGLPAYHTGDLGSMTDEGLLLYGGRMDFQIKFNGYRIELEDVSQNL  424
             LNNPE+TA AFF+FEGLPAYHTGDLGSMTDEGLLLYGGRMDFQIKFNGYRIELE+VSQNL
Sbjct: 366 LNNPERTAAAFFEFEGLPAYHTGDLGSMTDEGLLLYGGRMDFQIKFNGYRIELEEVSQNL  425

Query: 425 NKSQYVKSAVAVPRYNKDHKVQNLLAYIVLKEGVRDDFERDLDLTKAIKEDLKDIMMDYM  484
             NKSQY+ SAVAVPRYNKDHKVQNLLAY+VLK+GV + FER LD+TKAIK DL+D+MMDYM
Sbjct: 426 NKSQYIASAVAVPRYNKDHKVQNLLAYVVLKDGVEEQFERALDITKAIKADLQDVMMDYM  485

Query: 485 MPSKFIYREDLPLTPNGKIDIKGLMSEVNK                               514
             MPSKF+YR+DLPLTPNGKIDIKGLMSEVNK
Sbjct: 486 MPSKFLYRKDLPLTPNGKIDIKGLMSEVNK                               515
```

A related DNA sequence was identified in *S. pyogenes* <SEQ ID 5747> which encodes the amino acid sequence <SEQ ID 5748>. Analysis of this protein sequence reveals the following:

```
Possible site: 60
>>> Seems to have no N-terminal signal sequence
    INTEGRAL    Likelihood = -2.28    Transmembrane    92-108 (91-108)
    INTEGRAL    Likelihood = -0.85    Transmembrane    43-59  (41-59)

----- Final Results -----
              bacterial membrane --- Certainty = 0.1914 (Affirmative) < succ>
               bacterial outside --- Certainty = 0.0000 (Not Clear)   < succ>
             bacterial cytoplasm --- Certainty = 0.0000 (Not Clear)   < succ>
```

The protein has homology with the following sequences in the databases:

```
>GP: AAC05774 GB: AF051356 D-alanine-D-alanyl carrier protein ligase
[Streptococcus mutans]
Identities = 365/511 (71%), Positives = 438/511 (85%)

Query:   2 IKDMIDSIEQFAQTQADFPVYDCLGERRTYGQLKRDSDSIAAFIDSLALLAKSPVLVFGA    61
           IKDMI +IE FAQ QA+FPVY+ LGE  TYG+LK DSDS+AA +D L L AKSPV+VFG
Sbjct:   6 IKDMIATIENFAQEQAEFPVYNILGEIHTYGELKADSDSLAAHLDQLDLTAKSPVVVFGG   65

Query:  62 QTYDMLATFVALTKSGHAYIPVDVHSAPERILAIIEIAKPSLIIAIEEFPLTIEGISLVS   121
           Q Y MLA+FVALTKSGHAYIP+D HSA ERI AI+E+A+PSL+IA+++FP+    + ++
Sbjct:  66 QEYAMLASFVALTKSGHAYIPIDHHSALERIEAILEVAEPSLVIAVDDFPIDNLQVPVIQ  125

Query: 122 LSEIESAKLAEMPYERTHSVKGDDNYYIIFTSGTTGQPKGVQISHDNLLSFTNWMIEDAA   181
              S++E    ++ Y+  H+VKGDD YYIIFTSGTTG+PKGVQISHDNLLSFTNWMI   A
Sbjct: 126 YSQLEEIFKQKLSYQINHAVKGDDTYYIIFTSGTTGKPKGVQISHDNLLSFTNWMINAEA  185

Query: 182 FDVPKQPQMLAQPPYSFDLSVMYWAPTLALGGTLFALPKELVADFKQLFTTIAQLPVGIW   241
           F  P +PQMLAQPPYSFDLSVMYWAPTLALGGTLFALPKE+ ADFKQLFTTI QLP+G+W
Sbjct: 186 FATPHRPQMLAQPPYSFDLSVMYWAPTLALGGTLFALPKEITADFKQLFTTINQLPIGVW  245

Query: 242 TSTPSFADMAMLSDDFCQAKMPALTHFYFDGEELTVSTARKLFERFPSAKIINAYGPTEA   301
           TSTPSF DMAMLSDDF  ++P LTHFYFDGEELTV TA+KL +RFP A+I+NAYGPTEA
Sbjct: 246 TSTPSFVDMAMLSDDFNAQQLPHLTHFYFDGEELTVKTAKKLRQRFPQARIVNAYGPTEA  305

Query: 302 TVALSAIEITREMVDNYTRLPIGYPKPDSPTYIIDEDGKELSSGEQGEIIVTGPAVSKGY   361
           TVALSA+ +T +M++   RLPIGY KPDSPT+IIDE G +L++G+QGEIIV GPAVSKGY
Sbjct: 306 TVALSALAVTDKMLETCKRLPIGYTKPDSPTFIIDESGHKLANGQQGEIIVSGPAVSKGY  365

Query: 362 LNNPEKTAEAFFTFKGQPAYHTGDIGSLTEDNILLYGGRLDFQIKYAGYRIELEDVSQQL   421
           LNNPE+TA AFF F+G PAYHTGD+GS+T++ +LLYGGR+DFQIK+ GYRIELE+VSQ L
Sbjct: 366 LNNPERTAAAFFEFEGLPAYHTGDLGSMTDEGLLLYGGRMDFQIKFNGYRIELEEVSQNL  425

Query: 422 NQSPMVASAVAVPRYNKEHKVQNLLAYIVVKDGVKERFDRELELTKAIKASVKDHMMSYM   481
           N+S+  +ASAVAVPRYNK+HKVQNLLAY+V+KDGV+E+F+R L++TKAIKA ++D MM YM
Sbjct: 426 NKSQYIASAVAVPRYNKDHKVQNLLAYVVLKDGVEEQFERALDITKAIKADLQDVMMDYM  485

Query: 482 MPSKFLYRDSLPLTPNGKIDIKTLINEVNNR                              512
           MPSKFLYR  LPLTPNGKIDIK L++EVN +
Sbjct: 486 MPSKFLYRKDLPLTPNGKIDIKGLMSEVNKK                              516
```

An alignment of the GAS and GBS proteins is shown below.

```
Identities = 374/510 (73%), Positives = 439/510 (85%)

Query:   4 MIHDMIKTIEHFAETQADFPVYDILGEVHTYGQLKVDSDSLAAHIDSLGLVEKSPVLVFG    63
           MI DMI +IE FA+TQADFPVYD LGE  TYGQLK DSDS+AA IDSL L+ KSPVLVFG
Sbjct:   1 MIKDMIDSIEQFAQTQADFPVYDCLGERRTYGQLKRDSDSIAAFIDSLALLAKSPVLVFG    60

Query:  64 GQEYEMLATFVALTKSGHAYIPVDQHSALDRIQAIMTVAQPSLIISIGEFPLEVDNVPIL   123
           Q Y+MLATFVALTKSGHAYIPVD HSA +RI AI+ +A+PSLII+I EFPL ++ + ++
Sbjct:  61 AQTYDMLATFVALTKSGHAYIPVDVHSAPERILAIIEIAKPSLIIAIEEFPLTIEGISLV  120

Query: 124 DVSQVSAIFEEKTPYEVTHSVKGDDNYYIIFTSGTTGLPKGVQISHDNLLSFTNWMISDD   183
           +S++ +    + PYE THSVKGDDNYYIIFTSGTTG PKGVQISHDNLLSFTNWMI D
Sbjct: 121 SLSEIESAKLAEMPYERTHSVKGDDNYYIIFTSGTTGQPKGVQISHDNLLSFTNWMIEDA  180

Query: 184 EFSVPERPQMLAQPPYSFDLSVMYWAPTLAMGGTLFALPKTVVNDFKKLFATINELPIQV   243
           F VP++PQMLAQPPYSFDLSVMYWAPTLA+GGTLFALPK +V DFK+LF TI +LP+ +
Sbjct: 181 AFDVPKQPQMLAQPPYSFDLSVMYWAPTLALGGTLFALPKELVADFKQLFTTIAQLPVGI  240

Query: 244 WTSTPSFADMALLSNDFNSETLPQLTHFYFDGEELTVKTAQKLRQRFPKARIVNAYGPTE   303
           WTSTPSFADMA+LS+DF  +P LTHFYFDGEELTV TA+KL +RFP A+I+NAYGPTE
Sbjct: 241 WTSTPSFADMAMLSDDFCQAKMPALTHFYFDGEELTVSTARKLFERFPSAKIINAYGPTE  300

Query: 304 ATVALSAVAITDEMLETCKRLPIGYTKDDSPTYVIDEEGHKLPNGEQGEIIIAGPAVSKG   363
           ATVALSA+ IT EM++   RLPIGY K DSPTY+IDE+G +L +GEQGEII  GPAVSKG
Sbjct: 301 ATVALSAIEITREMVDNYTRLPIGYPKPDSPTYIIDEDGKELSSGEQGEIIVTGPAVSKG  360
```

```
                              -continued
Query:  364 YLNNPEKTAEAFFQFEGLPAYHTGDLGSMTDEGLLLYGGRMDFQIKFNGYRIELEDVSQN  423
            YLNNPEKTAEAFF F+G PAYHTGD+GS+T++ +LLYGGR+DFQIK+ GYRIELEDVSQ
Sbjct:  361 YLNNPEKTAEAFFTFKGQPAYHTGDIGSLTEDNILLYGGRLDFQIKYAGYRIELEDVSQQ  420

Query:  424 LNKSQYVKSAVAVPRYNKDHKVQNLLAYIVLKEGVRDDFERDLDLTKAIKEDLKDIMMDY  483
            LN+S  V SAVAVPRYNK+HKVQNLLAYIV+K+GV++ F+R+L+LTKAIK  +KD MM Y
Sbjct:  421 LNQSPMVASAVAVPRYNKEHKVQNLLAYIVVKDGVKERFDRELELTKAIKASVKDHMMSY  480

Query:  484 MMPSKFIYREDLPLTPNGKIDIKGLMSEVN                               513
            MMPSKF+YR+ LPLTPNGKIDIK L++EVN
Sbjct:  481 MNPSKFLYRDSLPLTPNGKIDIKTLINEVN                               510
```

Based on this analysis, it was predicted that these proteins and their epitopes could be useful antigens for vaccines or diagnostics.

EXAMPLE 1851

A DNA sequence (GBSx1958) was identified in *S. agalactiae* <SEQ ID 5749> which encodes the amino acid sequence <SEQ ID 5750>. This protein is predicted to be a histidine protein kinase (phoR). Analysis of this protein sequence reveals the following:

```
Possible site: 26
>>> Seems to have an uncleavable N-term signal seq
    INTEGRAL    Likelihood = -13.64   Transmembrane    9-25  (5-32)
    INTEGRAL    Likelihood = -11.62   Transmembrane  136-152 (132-164)

----- Final Results -----
              bacterial membrane --- Certainty = 0.6456 (Affirmative) < succ>
               bacterial outside --- Certainty = 0.0000 (Not Clear)   < succ>
             bacterial cytoplasm --- Certainty = 0.0000 (Not Clear)   < succ>
```

The protein has homology with the following sequences in the GENPEPT database.

```
>GP: CAB54569 GB: AJ006392 histidine kinase [Streptococcus pneumoniae]
Identities = 105/416 (25%), Positives = 197/416 (47%), Gaps = 56/416
(13%)

Query:    7 KKFVFLTMSILIVVVLFLFAVSNRYNQYWDEYDAYRIVKLVAKNDY---LGIPGDEPIAL   63
            + F+F+ + + ++V+ L  + NR +       ++  L+A DY   L + G    I
Sbjct:   12 RDFIFILILLGFILVVTLLLLENRRDNIQLKQVNQKVKDLIA-GDYSKVLDMQGGSEITN   70

Query:   64 VTIDNQKMVKIQSNNTDLTNDVIEKSSLKL------LEQGKKSRKWKSFIYSIKE-----  112
            +T +  + ++        LT + +E+ S +L       +  G   +   + I   I +
Sbjct:   71 ITNNLNDLSEV----IRLTQENLEQESKRLNSILFYMTDGVLATNRRGQIIMINDTAKKQ  126

Query:  113 ---YKDKTYTIAIMDLASYEVPYARRFLILVFT--------IGFCLLAAVSLYLSR---  158
               K+     +I++L   E  Y   R LI           I G  L    V    L R
Sbjct:  127 LGLVKEDVLNRSILELLKIEENYELRDLITQSPELLLDSQDINGEYLNLRVRFALIRRES  186

Query:  159 -FIVGPVE-----TEMTREKQ----FVSDASHELKTPIAAIRANVQVLEQ----QIPGNR  204
             FI  G  V          TE  +E++     FVS+ SHEL+TP+ ++++ ++ L++       +
Sbjct:  187 GFISGLVAVLHDTTEQEKEERERRLFVSNVSHELRTPLTSVKSYLEALDEGALCETVAPD  246

Query:  205 YLDHVVSETKRMEFLIEDLLNLSRLDEKRSKVNFKKLNLSVLCQEVLLTYESLAYEEEKC  264
            ++    + ET RM  ++ DLL+LSR+D     S ++ + +N +       +L   ++ + +E++
Sbjct:  247 FIKVSLDETNRMMRMVTDLLHLSRIDNATSHLDVELINFTAFITFILNRFDKMKGQEKEK  306

Query:  265 LNDTIED----DVWIVGEESQIKQILIILLDNAIRHSLSKSAIQFSLKQARRKAILTISN  320
             + + D     +W+ +  + ++ Q++  +L+NAI++S     I    +K     + IL+IS+
Sbjct:  307 KYELVRDYPINSIWMEIDTDKMTQVVDNILNNAIKYSPDGGKITVRMKTTEDQMILSISD  366

Query:  321 PSAIYSKEVMDNLFERFYQAKDDHADSLS---FGLGLSIAKAIVERHKGRIRAYQE     373
                 K+ +  +F+RFY+    D A S +     GLGLSIAK I+++HKG I A   E
Sbjct:  367 HGLGIPKQDLPRIFDRFYRV--DRARSRAQGGTGLGLSIAKEIIKQHKGFIWAKSE     420
```

A related sequence was also identified in GAS <SEQ ID 9131> which encodes the amino acid sequence <SEQ ID 9132>. Analysis of this protein sequence reveals the following:

```
>>> Seems to have an uncleavable N-term signal seq
   INTEGRAL   Likelihood = -11.30   Transmembrane    9-25 (4-33)
   INTEGRAL   Likelihood = -10.35   Transmembrane  161-177 (154-190)
   PERIPHERAL Likelihood =   4.35                  142

----- Final Results -----
            bacterial membrane  --- Certainty = 0.5522 (Affirmative) < succ>
             bacterial outside  --- Certainty = 0.0000 (Not Clear)   < succ>
           bacterial cytoplasm  --- Certainty = 0.0000 (Not Clear)   < succ>
```

An alignment of the GAS and GBS proteins is shown below.

```
Identities = 94/406 (23%), Positives = 190/406 (46%), Gaps = 31/406 (7%)

Query:   1 MFSDLRKKFVFLTMSILIVVVLFLFAVSNRYNQYWDEYDAYRIVKLVAKNDYLGIPGDEP   60
           MF+ +R +F+ +    + +++ + + N   Y + + RI+ L++ N    +PG
Sbjct:  10 MFNRIRIRFIMIASIAIFIILSSIVGIINTARCYQSQQEINRILHLISSNKGK-LPGTTE   68

Query:  61 IAL-----VTIDNQKMVKIQS-----NNTDLTNDVIEKSSLKLLE-----------QGK   98
           +        ++ D+    + S      N    L+++      S+L    E          + K
Sbjct:  69 SSKRLGTKLSEDSLSQFRYYSVIFNANGHLLSSNTANISALDREEAQYFARLFAKSGEEK  128

Query:  99 KSRKWKSFIYS--IKEYKDKTYTIAIMDLASYEVPYARRFLILVFTIFG-FCLLAAVSLY  155
           S + +  +YS   I +  ++   + I+D   Y         + V   FG F      +
Sbjct: 129 GSYRHQDSVYSYLITQLPNEEKLVVILDTTFYFRSVGDLLAVSVMLAFGGFIFFVVLVSL  188

Query: 156 LSRFIVGPVETEMTREKQFVSDASHELKTPIAAIRANVQVLEQQIPGNRYLDHVVSETKR  215
           S   ++ P    ++++F+++A HELKTP+A I  AN +++E     + +    + KR
Sbjct: 189 FSGMVIKPFVQNYEKQRRFITNAGHELKTPLAIISANNELVELMTGESEWTKSTSDQVKR  248

Query: 216 MEFLIEDLLNLSRLDEKRSKVNFKKLNLSVLCQEVLLTYESLAYEEEKCLNDTIEDDVWI  275
              + LI ++ L+RL+E+   V    ++ S + Q+    ++SL ++ K + TI+ ++ I
Sbjct: 249 LTGLINQMITLARLEEQPDVV-LHMVDFSAIAQDAAEDFKSLVLKDGKRFDLTIQPNIMI  307

Query: 276 VGEESQIKQILIILLDNAIRHSLSKSAIQFSLK---QARRKAILTISNPSAIYSKEVMDN  332
           EE + +++ IL+DNA ++    K  ++ SL    + R++A L +SN
Sbjct: 308 KAEEKSLFELVTILVDNANKYCDPKGLVKVSLTTIGRRRKRAKLEVSNTYLEGKSIDYSR  367

Query: 333 LFERFYQAKDDH-ADSLSFGLGLSIAKAIVERHKGRIRAYQEKDQL               377
             FERFY+  + H +      +G+GLS+A+++V+  KG I    + D +
Sbjct: 368 FFERFYREDESHNSKEKGYGIGLSMAESMVKLFKGTITVNYKNDAI                413
```

A related GBS gene <SEQ ID 8915> and protein <SEQ ID 8916> were also identified. Analysis of this protein sequence reveals the following:

```
Lipop: Possible site: -1  Crend: 7
McG: Discrim Score: 17.50
GvH: Signal Score (-7.5): -2.9
    Possible site: 26
>>> Seems to have an uncleavable N-term signal seq
ALOM program   count: 2  value: -13.64 threshold:  0.0
   INTEGRAL   Likelihood = -13.64   Transmembrane    9-25 (5-32)
   INTEGRAL   Likelihood = -11.62   Transmembrane  136-152 (132-164)
   PERIPHERAL Likelihood =   2.49                  345
modified ALOM score: 3.23

*** Reasoning Step: 3

----- Final Results -----
            bacterial membrane  --- Certainty = 0.6456 (Affirmative) < succ>
             bacterial outside  --- Certainty = 0.0000 (Not Clear)   < succ>
           bacterial cytoplasm  --- Certainty = 0.0000 (Not Clear)   < succ>
```

The protein has homology with the following sequences in the databases:

```
28.3/57.2% over 371aa
Listeria monocytogenes
GP|6117973|LisK Insert characterized ORF00341(631-1452 of 1785)
GP|6117973|gb|AAF03933.1|AF139908_3|AF139908(105-476 of 483) LisK
{Listeria monocytogenes}
% Match = 8.4
% Identity = 28.2   % Similarity = 57.1
Matches = 79    Mismatches = 113    Conservative Sub.s = 81

459         489         519         549         579         609         639         669
VKLVAKNDYLGIPGDEPIALVTIDNQKMVKIQSNNTDLTNDVIEKSSLKLLEQGKKSRKWKSFIYSIKEYKDKTYTIAIM
  :          |  : :||         :    |          :|:    :  |:       |     :   ||  ::   |   :
QGIGQMLLNEEEPEVKELLLATTSTLTNQDLTDNEEIKYLFNNDKTVNRKLQDQVINLYDKDGHFINKYYFSRSQDITSI
          50          60          70          80          90         100         110

699         729                                                      756
DLASYEVPYARRFLILVFTIFG-----------------------------------------FCLLAAVSLYLSRFI--
|::  ||      :|::   || |                                         ||  ||:|::|   :
DFSQYFVSGTDKFIMNKPTIDGQKMMTAQMPIVADDNTTVIGYAQVVNPLTSYNRMMDRLLVTMILLGAVALFISGMLGY
          130         140         150         160         170         180         190

783         813         843         873
---------------------------------------------VGPVETEMTREKQFVSDASHELKTPIAAIRA
                                              :  :||   ::|||   ||||||:||:  :
LLAQNFLNPLTRLARTMNDIRKNGFQKRIETKTNSRDEIGELTVVFNDMMTRIETSFEQQKQFVEDASHELRTPVQIMEG
          210         220         230         240         250         260         270

918         948         978        1008        1038        1068        1098
NVQVLEQ---QIPG--NRYLDHVVSETKRMEFLIEDLLNLSRLDEKRSKVNFKKLNLSVLCQEVLLTYESLAYEEEKCLN
: ::: |   :     |         | :   : |  :||:  |:::: |||  ::       :: :: :   :|    :| : ||
HLKLLTRWGKDDPAVLDESLNASLTELERMKKLVQEMLDLSRAEQISQTKELQITDVNATVEQVRRNFE-VMYENFTFTL
          290         300         310         320         330         340         350

1128        1158        1188        1218        1248        1278        1308        1335
DTIEDDVWIVGEESQIKQILIILLDNAIRHSLSKSAIQFSLKQARRKAILTISNPSAIYSKEVMDNLFERFYQA-KDDHA
  :  |:     :   : :  :::|||||::||||:::|    :  :     :  :::     :  :         |:|    :|   :|   |||:    |
KEDDTDLRALIQHNHLEQILIIIMDNAVKYSGDGTEVDMHVYKEQKQIHIDVRDYGEGISQEEIDKIFNRFYRVDKARSR
          370         380         390         400         410         420         430

1365        1395        1425        1452        1482        1512        1542        1572
DSLSFGLGLSIAKAIVERHKGRIRAYQEKDQ-LRLEVQLPIDGFWTNTMIN*RKNDETIFIFYW*NVIILRYFIVTNLLF
:      ||||:|||  :||  :  |  |  |    ||:    :::  ||         :
EKGGNGLGLAIAKQLVEGYLGTINAVSEPDKGTTIKITLPYIEPKSK
          450         460         470         480
```

SEQ ID 5750 (GBS34) was expressed in *E. coli* as a GST-fusion product. SDS-PAGE analysis of total cell extract is shown in FIG. 15 (lane 9; MW 69 kDa).

GBS34-GST was purified as shown in FIG. 193, lane 9.

Based on this analysis, it was predicted that these proteins and their epitopes could be useful antigens for vaccines or diagnostics.

EXAMPLE 1852

A DNA sequence (GBSx1959) was identified in *S. agalactiae* <SEQ ID 5753> which encodes the amino acid sequence <SEQ ID 5754>. This protein is predicted to be two-component response regulator (regX3). Analysis of this protein sequence reveals the following:

```
Possible site: 30
>>> Seems to have no N-terminal signal sequence

----- Final Results -----
            bacterial cytoplasm --- Certainty = 0.1986 (Affirmative) < succ>
            bacterial membrane  --- Certainty = 0.0000 (Not Clear) < succ>
            bacterial outside   --- Certainty = 0.0000 (Not Clear) < succ>
```

The protein has homology with the following sequences in the GENPEPT database.

```
>GP: BAB04091 GB: AP001508 two-component response regulator
[Bacillus halodurans]
Identities = 98/223 (43%), Positives = 145/223 (64%), Gaps = 5/223 (2%)

Query:    2 RLLVVEDEKSIAEAIQALLADKGYSVDLAFDGDDGLEYILTGLYDLVLLDIMLPKRSGLS   61
            R+L++EDEK IA +Q  L  +GY  D AF G DGLE       +DLVLLD+MLP+ SGL
Sbjct:    3 RILIIEDEKKIARVLQLELEHEGYETDAAFSGSDGLETFQAHAWDLVLLDVMLPELSGLE  62

Query:   62 VLKRVREAGLETPIIFLTAKSQTYDKVNGLDLGADDYITKPFEADELLARIR--LRTRQS  119
            VL+R+R        TPII LTA++   DKV+GLDLGA+DYITKPFE +ELLAR+R  LRT Q+
Sbjct:   63 VLRRIRMTDPVTPIILLTARNSIPDKVSGLDLGANDYITKPFEIEELLARVRACLRTVQT  122

Query:  120 SLIRANQLRLGNIRLNTDSHELESKESSVKLSNKEFLLMEVFMRNAKQIIPKNQLISKVW  179
              + L    + +N  + +++    +++L+ KEF L+   F++N  Q++ +  Q+++ VW
Sbjct:  123 RERVEDTLMFQELTINEKTRDVQRGNETIELTPKEFELLVFFIKNKGQVLSREQILTNVW  182

Query:  180 GPSDNSEYNQLEVFISFLRKKLRFLKADIEIITTKGFGYSLEE                  222
            G      + N ++V++ +LRKKL    +A   + T +G GY L+E
Sbjct:  183 GFDYYGDTNVIDVYVRYLRKKLSLTEA---LQTVRGVGYRLKE                  222
```

Based on this analysis, it was predicted that this protein and its epitopes, could be useful antigens for vaccines or diagnostics.

EXAMPLE 1853

A DNA sequence (GBSx1960) was identified in *S. agalactiae* <SEQ ID 5755> which encodes the amino acid sequence <SEQ ID 5756>. This protein is predicted to be 50S ribosomal protein L34-related protein. Analysis of this protein sequence reveals the following:

```
Possible site: 32
>>> Seems to have no N-terminal signal sequence

----- Final Results -----
           bacterial cytoplasm --- Certainty = 0.5923(Affirmative) < succ>
           bacterial membrane  --- Certainty = 0.0000(Not Clear)  < succ>
            bacterial outside  --- Certainty = 0.0000(Not Clear)  < succ>
```

The protein has homology with the following sequences in the GENPEPT database.

```
>GP: AAC22660 GB: U32781 ribosomal protein L34 (rpL34)
[Haemophilus influenzae Rd]
Identities = 32/44 (72%), Positives = 37/44 (83%)

Query:    1 MKRTYQPSKIRRQRKHGFRHRMSTKNGRRVLASRRRKGRKVLSA   44
            MKRT+QPS ++R R HGFR RM+TKNGR+VLA RR KGRK LSA
Sbjct:    1 MKRTFQPSVLKRSRTHGFRARMATKNGRQVLARRRAKGRKSLSA   44
```

A related DNA sequence was identified in *S. pyogenes* <SEQ ID 5757> which encodes the amino acid sequence <SEQ ID 5758>. Analysis of this protein sequence reveals the following:

```
Possible site: 32
>>> Seems to have no N-terminal signal sequence

----- Final Results -----
           bacterial cytoplasm --- Certainty = 0.5385(Affirmative) < succ>
           bacterial membrane  --- Certainty = 0.0000(Not Clear)  < succ>
            bacterial outside  --- Certainty = 0.0000(Not Clear)  < succ>
```

An alignment of the GAS and GBS proteins is shown below.

```
Identities = 42/44 (95%), Positives = 44/44 (99%)

Query:     1 MKRTYQPSKIRRQRKHGFRHRMSTKNGRRVLASRRRKGRKVLSA   44
             +KRTYQPSKIRRQRKHGFRHRMSTKNGRRVLA+RRRKGRKVLSA
Sbjct:     1 VKRTYQPSKIRRQRKHGFRHRMSTKNGRRVLAARRRKGRKVLSA   44
```

Based on this analysis, it was predicted that these proteins and their epitopes could be useful antigens for vaccines or diagnostics.

EXAMPLE 1854

A DNA sequence (GBSx1961) was identiified in *S. agalactiae* <SEQ ID 5759> which encodes the amino acid sequence <SEQ ID 5760>. Analysis of this protein sequence reveals the following:

```
Possible site: 61
>>> Seems to have an uncleavable N-term signal seq
      INTEGRAL    Likelihood = -5.79     Transmembrane    122-138 (115-141)
      INTEGRAL    Likelihood = -4.35     Transmembrane     19-35  (15-40)

----- Final Results -----
             bacterial membrane --- Certainty = 0.3314(Affirmative) < succ>
              bacterial outside --- Certainty = 0.0000(Not Clear)   < succ>
            bacterial cytoplasm --- Certainty = 0.0000(Not Clear)   < succ>
```

The protein has homology with the following sequences in the GENPEPT database.

```
>GP: AAF95990 GB: AE004350 conserved hypothetical protein [Vibrio cholerae]
Identities = 79/145 (54%), Positives = 117/145 (80%)

Query:     1 MKTFVNNASKTVLSLWFGVMPTIMTVGTIALIISVSTPIFKILGTPFLPFLELLGIPEAD    60
             +++ +     +  + + FGV+P +M +GTIAL+I+   T +F +LG PF+PFLELLG+PEA
Sbjct:   314 VQSVIGEGIRNAVDMVFGVLPVVMGLGTIALVIAEYTSVFSLLGQPFIPFLELLGVPEAT   373

Query:    61 IASQTMIVGFSDMVVPSIMAAEIHSEMTRFIVATVSIVQLIYMSETGAVILGSKIPINIL   120
              AS+T++VGF+DM +P+I+AA I +EMTRF++A +S+ QLIYMSE GA++LGS+IP+NI+
Sbjct:   374 AASKTIVVGFADMFIPAILAASIDNEMTRFVIAAMSVTQLIYMSEVGALLLGSRIPVNIV   433

Query:   121 ELFIIFIERTIISLPIIVLMAHLFF                                     145
             ELF+IFI RT+I+LP+I  +AHL F
Sbjct:   434 ELFVIFILRTLITLPVIAAVAHLLF                                     458
```

No corresponding DNA sequence was identified in *S. pyogenes*.

Based on this analysis, it was predicted that this protein and its epitopes, could be useful antigens for vaccines or diagnostics.

EXAMPLE 1855

A DNA sequence (GBSx1962) was identified in *S. agalactiae* <SEQ ID 5761> which encodes the amino acid sequence <SEQ ID 5762>. This protein is predicted to be D,D-carboxypeptidase (dacA-2). Analysis of this protein sequence reveals the following:

```
Possible site: 23
>>> Seems to have no N-terminal signal sequence

----- Final Results -----
            bacterial cytoplasm --- Certainty = 0.2443(Affirmative) < succ>
             bacterial membrane --- Certainty = 0.0000(Not Clear)   < succ>
              bacterial outside --- Certainty = 0.0000(Not Clear)   < succ>
```

A related GBS nucleic acid sequence <SEQ ID 9485> which encodes amino acid sequence <SEQ ID 9486> was also identified. A further related GBS nucleic acid sequence <SEQ ID 10945> which encodes amino acid sequence <SEQ ID 10946> was also identified.

The protein has homology with the following sequences in the GENPEPT database.

```
>GP: CAA67776 GB: X99400 D,D-carboxypeptidase [Streptococcus pneumoniae]
Identities = 193/383 (50%), Positives = 282/383 (73%), Gaps = 6/383 (1%)

Query:   1 MAVDLDSGKILYEKDANKPAAIASLTKIMTVYMVYKEIDNGNLKWNTKVNISDYPYQLTR   60
           +AV+ ++GKILYEKDA +P   IAS+TK++TVY+VY+ ++NG++   +T V+ISDYPYQLT
Sbjct:  33 IAVEANTGKILYEKDATQPVEIASITKLITVYLVYEALENGSITLSTPVDISDYPYQLTT   92

Query:  61 ESDASNVPLEKRRYTVKQLVDAAMISSANSAAIALAEHISGTESKFVDKMTAQLEKWGIH  120
           S+ASN+P+E R  YTV++L++A  ++SSANSAAIALAE  I+G+E  FVD M A+L +WGI
Sbjct:  93 NSEASNIPMEARNYTVEELLEATLVSSANSAAIALAEKIAGSEKDFVDMMRAKLLEWGIQ  152

Query: 121 DSHLVNASGLNNSMLGNHIYPKSSQNDENKMSARDIAIVAYHLVNEYPSILKITSKSVAK  180
           D+ +VN +GLNN  LG++IYP S +++ENK+SA D+AIVA +L+ +YP +L+IT K  +
Sbjct: 153 DATVVNTTGLNNETLGDNIYPGSKKDEENKLSAYDVAIVARNLIKKYPQVLEITKKPSST  212

Query: 181 FDKDIMHSYNYMLPDMPVFRPGITGLKTGTTELAGQSFIATSTESGMRLLTVIMHADKAD  240
           F    + S NYML  MP +R G  GLKTGTT+ AG+SF+ T+ E GMR++TV+++AD  D
Sbjct: 213 FAGMTITSTNYMLEGMPAYRGGFDGLKTGTTDKAGESFVGTTVEKGMRVITVVLNADHQD  272

Query: 241 KDKYARFTATNSLLNYITNTYEPNLVLAKGAAYKGKEASVRDGKEQSVIAVAKNDLKVVQ  300
              + YARFTAT+SL++YI++T+     ++ +G AY+  +A V+DGKE +VIAVA  D+ +++
Sbjct: 273 NNPYARFTATSSLMDYISSTFTLRKIVQQGDAYQDSKAPVQDGKEDTVIAVAPEDIYLIE  332

Query: 301 KKNITKQNQLKINF---KKELTAPITKKENLGKAYYVDLNKVGKGYLIKE-PSVHLVAKD  356
            +  + Q+   + F   K + AP+      +G  Y D + +G+GY+  E PS  +VA
Sbjct: 333 R--VGNQSSQSVQFTPDSKAIPAPLEAGTVVGHLTYEDKDLIGQGYITTERPSFEMVADK  390

Query: 357 SIERSFFLKVWWNHFVRYVNEKL                                      379
              IE++FFLKVWWN FVR+VNEKL
Sbjct: 391 KIEKAFFLFVWWNQFVRFVNEKL                                      413
```

A related DNA sequence was identified in *S. pyogenes* <SEQ ID 5763> which encodes the amino acid sequence <SEQ ID 5764>. Analysis of this protein sequence reveals the following:

```
Possible site: 21
>>> Seems to have a cleavable N-term signal seq.

----- Final Results -----
              bacterial outside --- Certainty = 0.3000(Affirmative) < succ>
              bacterial membrane --- Certainty = 0.0000(Not Clear)   < succ>
              bacterial cytoplasm --- Certainty = 0.0000(Not Clear)   < succ>
```

An alignment of the GAS and GBS proteins is shown below.

```
Identities = 176/380 (46%), Positives = 257/380 (67%), Gaps = 3/380 (0%)

Query:   1 MAVDLDSGKILYEKDANKPAAIASLTKIMTVYMVYKEIDNGNLKWNTKVNISDYPYQLTR   60
           +AVDL+SGK+LYEKDA +   +AS++K++T Y+VYEE+  G L W++ V IS+YPY+LT
Sbjct:  33 IAVDLESGKVLYEKDAKEVVPVASVSKLLTTYLVYKEVSKGKLNWDSPVTISNYPYELTT   92

Query:  61 ESDASNVPLEKRRYTVKQLVDAAMISSANSAAIALAEHISGTESKFVDKMTAQLEKWGIH  120
           SNVPL+KR+YTVK+L+ A ++++ANS AIALAE I GTE KFVDKM  QL +WGI
Sbjct:  93 NYTISNVPLDKRKYTVKELLSALVVNNANSPAIALAEKIGGTEPKFVDKMKKQLRQWGIS  152

Query: 121 DSHLVNASGLNNSMLGNHIYPKSSQNDENKMSARDIAIVAYHLVNEYPSILKITSKSVAK  180
           D+ +VN++GL N  LG +  YP +  +DEN    A D+AI+A HL+ E+P +LK++SKS
Sbjct: 153 DAKVVNSTGLTNHFLGANTYPNTEPDDENCFCATDLAIIARHLLLEFPEVLKLSSKSSTI  212

Query: 181 FDKDIMHSYNYMLPDMPVFRPGITGLKTGTTELAGQSFIATSTESGMRLLTVIMHADKAD  240
           F    ++SYNYML  MP +R G+ GL   G ++ AG SF+ATS E+ MR++TV+++AD++
Sbjct: 213 FAGQTIYSYNYMLKGMPCYREGVDGLFVGYSKKAGASFVATSVENQMRVITVVLNADQSH  272

Query: 241 KDKYARFTATNSLLNYITNTYEPNLVLAKGAAYKGKEASVRDGKEQSVIAVAKNDLKVVQ  300
           +D  A F  TN LL Y+   ++              K   V D E++V  VA+N L  ++
```

-continued

```
Sbjct:  273 EDDLAIFKTTNQLLQYLLINFQKVQLIENNKPV--KTLYVLDSPEKTVKLVAQNSLFFIK  330

Query:  301 KKNITKQNQLKINFKKE-LTAPITKKENLGKAYYVDLNKVGKGYLIKEPSVHLVAKDSIE  359
             +   +N + I  K    + AP++K + LG+A   D + +G+GYL    PS++L+ + +I
Sbjct:  331 PIHTKTKNTVHITKKSSTMIAPLSKGQVLGRATLQDKHLIGQGYLDTPPSINLILQKNIS  390

Query:  360 RSFFLKVWWNHFVRYVNEKL                                          379
            +SFFLKVWWN FVRYVN  L
Sbjct:  391 KSFFLKVWWNRFVRYVNTSL                                          410
```

Based on this analysis, it was predicted that these proteins and their epitopes could be useful antigens for vaccines or diagnostics.

EXAMPLE 1856

A DNA sequence (GBSx1963) was identified in *S. agalactiae* <SEQ ID 5765> which encodes the amino acid sequence <SEQ ID 5766>. This protein is predicted to be penicillin binding protein 4 (pdp4) (dacA-1). Analysis of this protein sequence reveals the following:

```
Possible site: 23
>>> Seems to have a cleavable N-term signal seq.
     INTEGRAL    Likelihood = -12.58    Transmembrane    368-384 (363-394)

----- Final Results -----
             bacterial membrane --- Certainty = 0.6031(Affirmative) < succ>
               bacterial outside --- Certainty = 0.0000(Not Clear) < succ>
             bacterial cytoplasm --- Certainty = 0.0000(Not Clear) < succ>
```

The protein has homology with the following sequences in the GENPEPT database.

```
>GP: CAA60582 GB: X87104 penicillin binding protein 4 [Staphylococcus
aureus]
Identities = 117/333 (35%), Positives = 188/333 (56%), Gaps = 8/333 (2%)

Query:    5 IVSFLCILLSLTCVNSVQAEEHKDIMQITREAGY-DVKDINKPKASIVIDNKGHILWEDN   63
            I+  LC+ LS+     + A      +Q   + GY  +    +P +++ +     G +L++ N
Sbjct:    7 IIIILCLTLSIMTPYAQAANSDVTPVQAANQYGYAGLSAAYEPTSAVNVSQTGQLLYQYN   66

Query:   64 ADLERDPASMSKMFTLYLLFEDLAKGKTSLNTTVTATETDQAISKIYEISNNNIHAGVAY  123
             D + +PASM+K+  T+YL  E + KG+ SL+ TVT T   +  +S + E+SN  ++ G    +
Sbjct:   67 IDTKWNPASMTKLMTMYLTLEAVNKGQLSLDDTVTMTNKEYIMSTLPELSNTKLYPGQVW  126

Query:  124 PIRELITMTAVPSSNVATIMIANHLSQNNPDAFIKRINETAKKLGMTKTHFYNPSGAVAS  183
              I  +L+ +T   SSN A +++A   +S+N  D F+   +N  AK +GM  THF NP+GA  S
Sbjct:  127 TIADLLQITVSNSSNAAALILAKKVSKNTSD-FVDLMNNKAKAIGMKNTHFVNPTGAENS  185

Query:  184 AFNGLYSPKEYDNNATNVTTARDLSILTYHFLKKYPDILNYTKYPEVKAMVGTPYEETFT  243
                  ++P +Y +       VTTARD +IL  H +K+ P IL++T    K +   T +  T+
Sbjct:  186 RLR-TFAPTKYKDQERTVTTARDYAILDLHVIKETPKILDFT-----KQLAPTTHAVTYY  239

Query:  244 TYNYSTPGAKFGLEGVDGLKTGSSPSAAFNALVTAKRQNTRLITVVLGVGDWSDQDGEYY  303
             T+N+S  GAK  L G DGLKTGSS +A +N   +T KR   R+   V++G GD+ +   GE
Sbjct:  240 TFNFSLEGAKMSLPGTDGLKTGSSDTANYNHTITTKRGKFRINQVIMGAGDYKNLGGEKQ  299

Query:  304 RHPFVNALVEKGFKDAKNISSKTPVLKAVKPKK                             336
            R+    NAL+E+ F   K +     +  + + KK
Sbjct:  300 RNMMGNALMERSFDQYKYVKILSKGEQRINGKK                             332
```

A related DNA sequence was identified in *S. pyogenes* <SEQ ID 5767> which encodes the amino acid sequence <SEQ ID 5768>. Analysis of this protein sequence reveals the following:

```
Possible site: 23
>>> Seems to have a cleavable N-term signal seq.

INTEGRAL   Likelihood = -15.18   Transmembrane   371-387 (364-392)
```

```
----- Final Results -----
bacterial membrane --- Certainty = 0.7071 (Affirmative) <succ>
bacterial outside  --- Certainty = 0.0000 (Not Clear)   <succ>
bacterial cytoplasm --- Certainty = 0.0000 (Not Clear)  <succ>
```

The protein has homology with the following sequences in the databases:

```
>GP: CAA62899 GB: X91786 penicillin-binding protein 4 [Staphylococcus
aureus]
Identities = 119/328 (36%), Positives = 184/328 (55%), Gaps = 19/328 (5%)

Query:    6 ILTIFTFICF--SVMPLVHAEDVMDIT-----RQAGYT-VSEVNRPKSSIVVDANSSDIL   57
            +++I +C   S+M      D+T      Q GY  +S   P S++ V + + +L
Sbjct:    4 LISIIIILCLTLSIMTPYAQATNSDVTPVQAANQYGYAGLSAAYEPTSAVNV-SQTGQLL   62

Query:   58 WQDNIDIPRDPASMSKMFTLYILFEELAKGKITMDTTITATPTDQAIANIYEISNNNIVA  117
            +Q NID   +PASM+K+ T+Y+  E + KG++++D T+T T  +  ++ + E+SN  +
Sbjct:   63 YQYNIDTKWNPASMTKLMTYLTLEAVNKGQLSLDDTVTMTNKEYIMSTLPELSNTKLYP  122

Query:  118 GVAYPIRDLITMTAVPSSNAATVMIANYLSNNDASAFIDRVNATAKQLGMTNTHFSNASG  177
            G  + I DL+ +T   SSNAA +++A  +S N  S F+D +N  AK +GM NTHF N +G
Sbjct:  123 GQVWTIADLLQITVSNSSNAAALILAKKVSKN-TSDFVDLMNNKAKAIGMKNTHFVNPTG  181

Query:  178 AAAQAFQGYYNPTKYDLSASNITTARDLSKLLYAFLKKYPEIISFTNKSVVHTMVGTPYE  237
              A   + + PTKY      +TTARD + L    +K+ P+I+ FT +   T+  T
Sbjct:  182 AENSRLR-TFAPTKYKDQERTVTTARDYAILDLHVIKETPKILDFTKQLAPTTLAVT---  237

Query:  238 EEFHTYNHSLPDNQFGMKGVDGLKTGSSPSAAFNAMITAKRGKTRLITIVMGVGDWSDQN  297
            ++T+N SL   +   G DGLKTGSS +A +N  IT KRGK R+  ++MG GD+ +
Sbjct:  238 --YYTFNFSLEGAKMSLPGTDGLKTGSSDTANYNHTITTKRGKFRINQVIMGAGDYKNLG  295

Query:  298 GEFYRHPFVNALTEKGF---KDSKTLSK                                 322
            GE  R+   NAL E+ F   K  K LSK
Sbjct:  296 GEKQRNMMGNALMERSFDQYKYVKILSK                                 323
```

An alignment of the GAS and GBS proteins is shown below.

```
Identities = 226/382 (59%), Positives = 289/382 (75%), Gaps = 7/382 (1%)

Query:   12 LLSLTCVNSVQAEEHKDIMQITREAGYDVKDINKPKASIVID-NKGHILWEDNADLERDP   70
            + +  C + +     +D+M ITR+AGY V ++N+PK+SIV+D N    ILW+DN D+ RDP
Sbjct:    9 IFTFICFSVMPLVHAEDVMDITRQAGYTVSEVNRPKSSIVVDANSSDILWQDNIDIPRDP   68

Query:   71 ASMSKMFTLYLLFEDLAKGKTSLNTTVTATETDQAISKIYEISNNNIHAGVAYPIRELIT  130
            ASMSKMFTLY+LFE+LAKGK +++TT+TAT TDQAI+ IYEISNNNI AGVAYPIR+LIT
Sbjct:   69 ASMSKMFTLYILFEELAKGKITMDTTITATPTDQAIANIYEISNNNIVAGVAYPIRDLIT  128

Query:  131 MTAVPSSNVATIMIANHLSQNNPDAFIKRINETAKKLGMTKTHFYNPSGAVASAFNGLYS  190
            MTAVPSSN AT+MIAN+LS N+  AFI R+N TAK+LGMT  THF N SGA A AF G Y+
Sbjct:  129 MTAVPSSNAATVMIANYLSNNDASAFIDRVNATAKQLGMTNTHFSNASGAAAQAFQGYYN  188

Query:  191 PKEYDNNATNVTTARDLSILTYHFLKKYPDILNYTKYPEVKAMVGTPYEETFTTYNYSTP  250
            P +YD +A+N+TTARDLS L Y FLKKYP+I+++T   V  MVGTPYEE F TYN+S P
Sbjct:  189 PTKYDLSASNITTARDLSKLLYAFLKKYPEIISFTNKSVVHTMVGTPYEEEFHTYNHSLP  248

Query:  251 GAKFGLEGVDGLKTGSSPSAAFNALVTAKRQNTRLITVVLGVGDWSDQDGEYYRHPFVNA  310
              +FG++GVDGLKTGSSPSAAFNA++TAKR  TRLIT+V+GVGDWSDQ+GE+YRHPFVNA
Sbjct:  249 DNQFGMKGVDGLKTGSSPSAAFNAMITAKRGKTRLITIVMGVGDWSDQNGEFYRHPFVNA  308

Query:  311 LVEKGFKDAKNISSKT-PVLKAVKPKKEVTKTKTKSIQE--QPQTKEQWWTKTDQFIQSH  367
            L EKGFKD+K +S K   L+ + P+   TK +T S Q+     K+ +   + + F+ +
Sbjct:  309 LTEKGFKDSKTLSKKARQKLEKLVPQ---TKKETSSKQQHFKATKKQSYLERVEDFMNHN  365

Query:  368 FVSILIVLGTIAILCLLAGIVL                                       389
            + LI L   I  LL  +V+
Sbjct:  366 HTFLLICLAIFIITILLLSLVV                                       387
```

A related GBS gene <SEQ ID 8917> and protein <SEQ ID 8918> were also identified. Analysis of this protein sequence reveals the following:

```
Lipop: Possible site: -1 Crend: 9
McG: Discrim Score: -14.02
GvH: Signal Score (-7.5): -2.54
Possible site: 60
>>> Seems to have no N-terminal signal sequence
ALOM program count: 1 value: -12.58 threshold: 0.0
INTEGRAL Likelihood = -12.58 Transmembrane 339-355 (334-365)
PERIPHERAL Likelihood = 1.38  99
modified ALOM score: 3.02

*** Reasoning Step: 3

----- Final Results -----
bacterial membrane  --- Certainty = 0.6031 (Affirmative) < succ>
bacterial outside   --- Certainty = 0.0000 (Not Clear)   < succ>
bacterial cytoplasm --- Certainty = 0.0000 (Not Clear)   < succ>
```

The protein has homology with the following sequences in the databases:

```
ORF01254(301-1386 of 1698)
EGAD|40430|42591(32-419 of 431) penicillin binding protein 4 (pdp4)
{Staphylococcus aureus}
GP|1125682|emb|CAA60585.1||X87105 penicillin binding protein 4
{Staphylococcus aureus} GP|1125686|emb|CAA60582.1||X87104 penicillin binding
protein 4 {Staphylococcus aureus}
% Match = 17.3
% Identity = 36.3   % Similarity = 59.6
Matches = 123    Mismatches = 130    Conservative Sub.s = 79

264       294       324       351       381       411       441       471
      FPLHFIIPDLCKLCAS*RHKDIMQITREAGY-DVKDINKPKASIVIDNKGHILWEDNADLERDPASMSKMFTLYLLFEDL
        :|    :  ||    :    :|  :::   |::|::   |   :|||||:  |:|| :| :
      ILCLTLSIMTPYAQAANSDVTPVQAANQYGYAGLSAAYEPTSAVNVSQTGQLLYQYNIDTKWNPASMTKLMTMYLTLEAV
         20        30        40        50        60        70        80

501       531       561       591       621       651       681       711
      AKGKTSLNTTVTATETDQAISKIYEISNNNIHAGVAYPIRELITMTAVPSSNVATIMIANHLSQNNPDAFIKRINETAKK
       ||: ||:  |||  |  :|  :|||   ::|  |   :|  ::| |   :|:|    :|:|       :|  ||
      NKGQLSLDDTVTMTNKEYIMSTLPELSNTKLYPGQVWTIADLLQITVSNSSNAAALILAKKVSKNTSD-FVDLMNNKAKA
         100       110       120       130       140       150       160

741       771       801       831       861       891       921       951
      LGMTKTHFYNPSGAVASAFNGLYSPKEYDNNATNVTTARDLSILTYHFLKKYPDILNYTKYPEVKAMVGTPYEETFTTYN
       :||   |||  ||:||  |     ::|   :|       |||||| |:  |: |  ||::||       |:   |  :||
      IGMKNTHFVNPTGAENSR-LRTFAPTKYKDQERTVTTARDYAILDLHVIKETPKILDFTK-----QLAPTTHAVTYYTFN
         180       190       200       210       220           230       240

981       1011      1041      1071      1101      1131      1161
      YSTPGAKFGLEGVDGLKTGSSPSAAFNALVTAKRQNTRLITVVLGVGDWSDQDGEYYRHPFVNALVEKGFKDAK------
       :|  |||   |  |  ||||||||  :|   :|   :|  |   |::  ||   ||   :|: :|    |
      FSLEGAKMSLPGTDGLKTGSSDTANYNHTITTKRGKFRINQVIMGAGDYKNLGGEKQRNMMGNALMERSFDQYKYVKILS
            260       270       280       290       300       310       320

1179      1209      1239      1266
      ------------------------------------------------NISSKTPVLKAVKPKKEVTKTKTKSI-QEQPQ
                                                       |  :|  ::   :|   :  |  ||: :|:|
      KGEQRINGKKYYVENDLYDVLPSDFSKKDYKLVVEDGKVHADYPREFINKDYRPPTVEVHQPIIQKANTVAKSMWEEHP-
               340       350       360       370       380       390       400

1296      1326      1356      1386      1416      1446      1476      1506
      TKEQWWTKTDQFIQSHFVSILIVLGTIAILCLLAGIVLLIKRSR**LC*YKSPLHQ*HRGFLLSLEIFN*PTEPSIS*EI
                                     ::    |    ||:||:  |::
      ---------------------LFTIIGGACLVAGLALIVHMIINRLFRKRK
                           410       420       430
```

SEQ ID 8918 (GBS379) was expressed in *E. coli* as a His-fusion product. SDS-PAGE analysis of total cell extract is shown in FIG. 68 (lane 5; MW 44 kDa). It was also expressed in *E. coli* as a GST-fusion product. SDS-PAGE analysis of total cell extract is shown in FIG. 72 (lane 3; MW 68.9 kDa).

GBS379-GST was purified as shown in FIG. 212, lane 7.

Based on this analysis, it was predicted that these proteins and their epitopes could be useful antigens for vaccines or diagnostics.

EXAMPLE 1857

A DNA sequence (GBSx1964) was identified in *S. agalactiae* <SEQ ID 5769> which encodes the amino acid sequence <SEQ ID 5770>. Analysis of this protein sequence reveals the following:

```
Possible site: 49
>>> Seems to have no N-terminal signal sequence

----- Final Results -----
bacterial cytoplasm --- Certainty = 0.4039 (Affirmative) < succ>
bacterial membrane  --- Certainty = 0.0000 (Not Clear)   < succ>
bacterial outside   --- Certainty = 0.0000 (Not Clear)   < succ>
```

The protein has homology with the following sequences in the GENPEPT database.

```
>GP: CAB15256 GB: Z99120 similar to hypothetical proteins
[Bacillus subtilis]
Identities = 316/459 (68%), Positives = 386/459 (83%)

Query:  14 DLGEYKFGFHDDVKPIYSTGKGLNEAVIRELSAAKGEPEWMLDFRLKSLETFNKMPMQTW   73
           D+GEYK+GFHD    I+ + +GL + ++ E+S  K  EP+WMLDFRLKSLE F   MPM  W
Sbjct:   7 DIGEYKYGFHDKDVSIFRSERGLTKEIVEEISRMKEEPQWMLDFRLKSLEHFYNMPMPQW   66

Query:  74 GADLSDIDFDDIIYYQKASDKPARDWDDVPEKIKETFERIGIPEAERAYLAGASAQYESE  133
           G DL+ ++FD+I YY K S++   R WD+VPE+IK+TF+++GIPEAE+ YLAG SAQYESE
Sbjct:  67 GGDLNSLNFDEITYYVKPSERSERSWDEVPEEIKQTFDKLGIPEAEQKYLAGVSAQYESE  126

Query: 134 VVYHNMKEEYDKLGIVFTDTDSALKEYPELFKKYFAKLVPPTDNKLAALNSAVWSGGTFI  193
           VVYHNMKE+ +   GIVF DTDSALKE  ++F++++AK++PPTDNK AALNSAVWSGG+FI
Sbjct: 127 VVYHNMKEDLEAQGIVFKDTDSALKENEDIFREHWAKVIPPTDNKFAALNSAVWSGGSFI  186

Query: 194 YVPKGVKVDIPLQTYFRINNENTGQFERTLIIVDEGASVHYVEGCTAPTYSSNSLHAAIV  253
           YVPKGVKV+ PLQ YFRIN+EN GQFERTLIIVDE ASVHYVEGCTAP Y++NSLH+A+V
Sbjct: 187 YVPKGVKVETPLQAYFRINSENMGQFERTLIIVDEEASVHYVEGCTAPVYTTNSLHSAVV  246

Query: 254 EIFALDGAYMRYTTIQNWSDNVYNLVTKRATAKKDATVEWIDGNLGAKTTMKYPSVYLDG  313
           EI     G Y RYTTIQNW++NVYNLVTKR   +++AT+EWIDGN+G+K TMKYP  L G
Sbjct: 247 EIIVKKGGYCRYTTIQNWANNVYNLVTKRTVCEENATMEWIDGNIGSKLTMKYPACILKG  306

Query: 314 EGARGTMLSIAFANKGQHQDTGAKMIHNAPHTSSSIVSKSIAKGGGKVDYRGQVTFNKDS  373
           EGARG  LSIA A KGQHQD GAKMIH AP+TSS+IVSKST+K GGKV YRG V F + +
Sbjct: 307 EGARGMTLSIALAGKGQHQDAGAKMIHLAPNTSSTIVSKSISKQGGKVTYRGIVHFGRKA  366

Query: 374 KKSVSHIECDTILMDDISKSDTIPFNEIHNSQVALEHEAKVSKISEEQLYYLMSRGLSEA  433
           + + S+IECDT++MD+ S SDTIP+NEI N  ++LEHEAKVSK+SEEQL+YLMSRG+SE
Sbjct: 367 EGARSNIECDTLIMDNKSTSDTIPYNEILNDNISLEHEAKVSKVSEEQLFYLMSRGISEE  426

Query: 434 EATEMIVMGFVEPFTKELPMEYAVELNRLISYEMEGSVG                       472
           EATEMIVMGF+EPFTKELPMEYAVE+NRLI +EMEGS+G
Sbjct: 427 EATEMIVMGFIEPFTKELPMEYAVEMNRLIKFEMEGSIG                       465
```

A related DNA sequence was identified in *S. pyogenes* <SEQ ID 5771> which encodes the amino acid sequence <SEQ ID 5772>. Analysis of this protein sequence reveals the following:

```
Possible site: 47
>>> Seems to have no N-terminal signal sequence

----- Final Results -----
bacterial cytoplasm --- Certainty = 0.3780 (Affirmative) < succ>
bacterial membrane  --- Certainty = 0.0000 (Not Clear)   < succ>
bacterial outside   --- Certainty = 0.0000 (Not Clear)   < succ>
```

An alignment of the GAS and GBS proteins is shown below.

```
Identities = 445/472 (94%), Positives = 461/472 (97%)

Query:   1 MSEINEKVEPQPIDLGEYKFGFHDDVKPIYSTGKGLNEAVIRELSAAKGEPEWMLDFRLK   60
           MS+INEKVEP+PIDLG+Y+FGFHDDV+PIYSTGKGL+EAV+RELSAAK EPEWML+FRLK
Sbjct:   1 MSDINEKVEPKPIDLGDYQFGFHDDVEPIYSTGKGLSEAVVRELSAAKNEPEWMLEFRLK   60

Query:  61 SLETFNKMPMQTWGADLSDIDFDDIIYYQKASDKPARDWDDVPEKIKETFERIGIPEAER  120
           SLETFNKMPMQTWGADLSDI+FDDIIYYQKASDKPAR WDDVPEKIKETF+RIGIPEAER
Sbjct:  61 SLETFNKMPMQTWGADLSDINFDDIIYYQKASDKPARSWDDVPEKIKETFDRIGIPEAER  120
```

-continued

```
Query: 121 AYLAGASAQYESEVVYHNMKEEYDKLGIVFTDTDSALKEYPELFKKYFAKLVPPTDNKLA  180
            AYLAGASAQYESEVVYHNMK E++KLGI+FTDTDSALKEYP+LFK+YFAKLVPPTDNKLA
Sbjct: 121 AYLAGASAQYESEVVYHNMKGEFEKLGIIFTDTDSALKEYPDLFKQYFAKLVPPTDNKLA  180

Query: 181 ALNSAVWSGGTFIYVPKGVKVDIPLQTYFRINNENTGQFERTLIIVDEGASVHYVEGCTA  240
            ALNSA WSGGTFIYVPKGVKVDIPLQTYFRINNENTGQFERTLIIVDEGASVHYVEGCTA
Sbjct: 181 ALNSAAWSGGTFIYVPKGVKVDIPLQTYFRINNENTGQFERTLIIVDEGASVHYVEGCTA  240

Query: 241 PTYSSNSLHAAIVEIFALDGAYMRYTTIQNWSDNVYNLVTKRATAKKDATVEWIDGNLGA  300
            PTYSSNSLHAAIVEIFALDGAYMRYTTIQNWSDNVYNLVTKRA A  DATVEWIDGNLGA
Sbjct: 241 PTYSSNSLHAAIVEIFALDGAYMRYTTIQNWSDNVYNLVTKRARALTDATVEWIDGNLGA  300

Query: 301 KTTMKYPSVYLDGEGARGTMLSIAFANKGQHQDTGAKMIHNAPHTSSSIVSKSIAKGGGK  360
            KTTMKYPSVYLDG GARGTMLSIAFAN GQHQDTGAKMIHNAPHTSSSIVSKSIAK GGK
Sbjct: 301 KTTMKYPSVYLDGPGARGTMLSIAFANAGQHQDTGAKMIHNAPHTSSSIVSKSIAKSGGK  360

Query: 361 VDYRGQVTFNKDSKKSVSHIECDTILMDDISKSDTIPFNEIHNSQVALEHEAKVSKISEE  420
            VDYRGQVTFNK SKKSVSHIECDTILMDDISKSDTIPFNEIHNSQVALEHEAKVSKISEE
Sbjct: 361 VDYRGQVTFNKQSKKSVSHIECDTILMDDISKSDTIPFNEIHNSQVALEHEAKVSKISEE  420

Query: 421 QLYYLMSRGLSEAEATEMIVMGFVEPFTKELPMEYAVELNRLISYEMEGSVG          472
            QLYYLMSRGLSE+EATEMIVMGFVEPFTKELPMEYAVELNRLISYEMEGSVG
Sbjct: 421 QLYYLMSRGLSESEATEMIVMGFVEPFTKELPMEYAVELNRLISYEMEGSVG          472
```

Based on this analysis, it was predicted that these proteins and their epitopes could be useful antigens for vaccines or diagnostics.

EXAMPLE 1858

A DNA sequence (GBSx1965) was identified in *S. agalactiae* <SEQ ID 5773> which encodes the amino acid sequence <SEQ ID 5774>. This protein is predicted to be nitrogen fixation protein (nifU). Analysis of this protein sequence reveals the following:

```
Possible site: 61
>>> Seems to have no N-terminal signal sequence

----- Final Results -----
bacterial cytoplasm --- Certainty = 0.1078 (Affirmative) < succ>
bacterial membrane  --- Certainty = 0.0000 (Not Clear)   < succ>
bacterial outside   --- Certainty = 0.0000 (Not Clear)   < succ>
```

The protein has homology with the following sequences in the GENPEPT database.

```
>GP: CAB15257 GB: Z99120 similar to NifU protein homolog [Bacillus subtilis]
Identities = 72/139 (51%), Positives = 92/139 (65%)

Query:   4 SKLDNLYMAVVADHSKHPHHHGFLEGVEQVQLNNPTCGDVISLSVKFDGNIISDIAFAGN   63
           + LD LY  V+ DH K+P + G L     V +NNPTCGD I L++K DG+I+ D  F G
Sbjct:   5 ANLDTLYRQVIMDHYKNPRNKGVLNDSIVVDMNNPTCGDRIRLTMKLDGDIVEDAKFEGE   64

Query:  64 GCTISTASSSMMTDAVIGKTKEEALQLADVFSKMVQGDQNPKQEKLGDAEFLAGVSKFPQ  123
           GC+IS AS+SMMT A+ GK  E AL ++ +FS M+QG +      LGD E L GVSKFP
Sbjct:  65 GCSISMASASMMTQAIKGKDIETALSMSKIFSDMMQGKEYDDSIDLGDIEALQGVSKFPA  124

Query: 124 RIKCATLSWNALRKAIERD                                           142
           RIKCATLSW AL K + ++
Sbjct: 125 RIKCATLSWKALEKGVAKE                                           143
```

A related DNA sequence was identified in *S. pyogenes* <SEQ ID 5775> which encodes the amino acid sequence <SEQ ID 5776>. Analysis of this protein sequence reveals the following:

```
Possible site: 14
>>> Seems to have no N-terminal signal sequence

----- Final Results -----
bacterial cytoplasm --- Certainty = 0.1202 (Affirmative) < succ>
bacterial membrane  --- Certainty = 0.0000 (Not Clear)   < succ>
bacterial outside   --- Certainty = 0.0000 (Not Clear)   < succ>
```

An alignment of the GAS and GBS proteins is shown below.

```
Identities = 114/146 (78%), Positives = 133/146 (91%)

Query:    1 MALSKLDNLYMAVVADHSKHPHHHGFLEGVEQVQLNNPTCGDVISLSVKFDGNIISDIAF   60
            MALSKL++LYMAVVADHSK PHHHG L+GVE VQLNNPTCGDVISL+VKFD + I DIAF
Sbjct:    1 MALSKLNHLYMAVVADHSKRPHHHGQLDGVEAVQLNNPTCGDVISLTVKFDEDKIEDIAF   60

Query:   61 AGNGCTISTASSSMMTDAVIGKTKEEALQLADVFSKMVQGDQNPKQEKLGDAEFLAGVSK  120
            AGNGCTISTASSSMMTDAVIGK+KEEAL LAD+FS+MVQG +NP Q++LG+AE LAGV+K
Sbjct:   61 AGNGCTISTASSSMMTDAVIGKSKEEALALADIFSEMVQGQENPAQKELGEAELLAGVAK  120

Query:  121 FPQRIKCATLSWNALRKAIERDNQAE                                   146
            FPQRIKC+TL+WNAL++AI+R    A+
Sbjct:  121 FPQRIKCSTLAWNALKEAIKRSANAQ                                   146
```

Based on this analysis, it was predicted that these proteins and their epitopes could be useful antigens for vaccines or diagnostics.

EXAMPLE 1859

A DNA sequence (GBSx1966) was identified in *S. agalactiae* <SEQ ID 5777> which encodes the amino acid sequence <SEQ ID 5778>. This protein is predicted to be nitrogen fixation protein (nifS) (b1680). Analysis of this protein sequence reveals the following:

```
Possible site: 43
>>> Seems to have no N-terminal signal sequence

----- Final Results -----
bacterial cytoplasm --- Certainty = 0.2453 (Affirmative) < succ>
bacterial membrane  --- Certainty = 0.0000 (Not Clear)   < succ>
bacterial outside   --- Certainty = 0.0000 (Not Clear)   < succ>
```

The protein has homology with the following sequences in the GENPEPT database.

```
>GP: CAB15258 GB: Z99120 similar to NifS protein homolog [Bacillus subtilis]
Identities = 240/400 (60%), Positives = 306/400 (76%), Gaps = 5/400 (1%)

Query:    9 LKQDFPILNQLVNDEPLIYLDNAATTQKPNQVLEALRDYYQNDNANVHRGVHTLAERATA   68
            +++ FPIL+Q VN   L+YLD+AAT+QKP V+E L  YY   N+NVHRGVHTL  RAT
Sbjct:    6 IREQFPILHQQVNGHDLVYLDSAATSQKPRAVIETLDKYYNQYNSNVHRGVHTLGTRATD   65

Query:   69 QYENAREKARQFLNAKLSKEILFTRGTTTGLNWVA-KFAESILERGDEVLISIMEHHSNI  127
              YE AREK R+F+NAK   EI+FT+GTTT LN VA  +A + L+ GDEV+I+ MEHH+NI
Sbjct:   66 GYEGAREKVRKFINAKSMAEIIFTKGTTTSLNMVALSYARANLKPGDEVVITYMEHHANI  125

Query:  128 IPWQQACERTGAKLVYAYLK-DGSLDLEDFYNKLSSKTKFVSLAHISNVLGCVTPVKAIA  186
            IPWQQA + TGA L Y  L+ DG++ LED    ++S TK V+++H+SNVLG V P+K +A
Sbjct:  126 IPWQQAVKATGATLKYIPLQEDGTISLEDVRETVTSNTKIVAVSHVSNVLGTVNPIKEMA  185

Query:  187 ERVHQVGAYMVVDGAQSAPHMAIDVQDLDCDFFALSGHKMLGPTGIGVLYGKESILDKMF  246
            +  H   GA +VVDGAQS PHW IDVQDLDCDFFALS HKM GPTG+GVLYGK+++L+ M
Sbjct:  186 KIAHDNGAVIVVDGAQSTPHMKIDVQDLDCDFFALSSHKMCGPTGVGVLYGKKALLENME  245

Query:  247 PVEFGGEMIDFVYEQSATWKELPWKFEAGTPNIAGAIAFGEALDYLTDVGMDEIHQYEQS  306
            P EFGGEMIDFV   +TWKELPWKFEAGTP IAGAI  G A+D+L ++G+DEI ++E
Sbjct:  246 PAEFGGEMIDFVGLYESTWKELPWKFEAGTPIIAGAIGLGAAIDFLEEIGLDEISRHEHK  305

Query:  307 LVSYVLPKLQAIDGLTIYGPSDAESHVGVIAFNLEGLHPHDVATAMDYEGVAVRAGHHCA  366
            L +Y L + +  +DG+T+YGP   E     G++ FNL+  +HPHDVAT +D EG+AVRAGHHCA
Sbjct:  306 LAAYALERFRQLDGVTVYGP---EERAGLVTFNLDDVHPHDVATVLDAEGIAVRAGHHCA  362

Query:  367 QPLINHLGIHSAVRASFYFYNTKEDCDKLVDAIQKTKEFF                     406
            QPL+  L + +  RASFY YNT+E+ DKLV+A+QKTKE+F
Sbjct:  363 QPLMKWLDVTATARASFYLYNTEEEIDKLVEALQKTKEYF                     402
```

A related DNA sequence was identified in *S. pyogenes* <SEQ ID 5779> which encodes the amino acid sequence <SEQ ID 5780>. Analysis of this protein sequence reveals the following:

```
Possible site: 41
>>> Seems to have no N-terminal signal sequence

----- Final Results -----
bacterial cytoplasm --- Certainty = 0.3714 (Affirmative) < succ>
bacterial membrane  --- Certainty = 0.0000 (Not Clear)   < succ>
bacterial outside   ---- Certainty = 0.0000 (Not Clear)  < succ>
```

An alignment of the GAS and GBS proteins is shown below.

```
Identities = 293/408 (71%), Positives = 349/408 (84%)

Query:   3 LLDSYKLKQDFPILNQLVNDEPLIYLDNAATTQKPNQVLEALRDYYQNDNANVHRGVHTL  62
           LLD+ +KQDF ILNQ VNDEPL+YLDNAATTQKP  VLEAL+ YYQ DNANVHRGVHTL
Sbjct:   1 LLDAKDIKQDFQILNQQVNDEPLVYLDNAATTQKPALVLEALQSYYQEDNANVHRGVHTL  60

Query:  63 AERATAQYENAREKARQFLNAKLSKEILFTRGTTTGLNWVAKFAESILERGDEVLISIME 122
           AERAT +YE +R++   F++AK SKE+LFTRGTTT LNWVA+FAE +L   DEVLISIME
Sbjct:  61 AERATLKYEASRQQVADFIHAKSSKEVLFTRGTTTSLNWVARFAEQVLTPEDEVLISIME 120

Query: 123 HHSNIIPWQQACERTGAKLVYAYLKDGSLDLEDFYNKLSSKTKFVSLAHISNVLGCVTPV 182
           HH+NIIPWQQAC++TGA+LVY YLKDG LD++D  NKL++KT+FVSL H+SNVLGC+ P+
Sbjct: 121 HHANIIPWQQACQKTGARLVYVYLKDGQLDMDDLANKLTTKTRFVSLVHVSNVLGCINPI 180

Query: 183 KAIAERVHQVGAYMVVDGAQSAPHMAIDVQDLDCDFFALSGHKMLGPTGIGVLYGKESIL 242
            K IA+ H  GAY+VVDGAQS PH+AIDVQDLDCDFFA S HKMLGPTG+GVLYGKE +L
Sbjct: 181 KEIAKLAHAKGAYLVVDGAQSVPHLAIDVQDLDCDFFAFSAHKMLGPTGLGVLYGKEELL 240

Query: 243 DKMPPVEFGGEMIDFVYEQSATWKELPWKFEAGTPNIAGAIAFGEALDYLTDVGMDEIHQ 302
           +++ P+EFGGEMIDFVYEQ ATWKELPWKFEAGTP+IAGAI   A+ YL +GM +IH
Sbjct: 241 NQVEPLEFGGEMIDFVYEQEATWKELPWKFEAGTPHIAGAIGLSAAISYLQRLGMADIHA 300

Query: 303 YEQSLVSYVLPKLQAIDGLTIYGPSDAESHVGVIAFNLEGLHPHDVATAMDYEGVAVRAG 362
           +E  L++YVLPKL+AI+GLTIYGPS   +  G+I+FNL+ LHPHD+ATA+DYEGVAVRAG
Sbjct: 301 HEAELIAYVLPKLEAIEGLTIYGPSQPSARSGLISFNLDDLHPHDLATALDYEGVAVRAG 360

Query: 363 HHCAQPLINHLGIHSAVRASFYFYNTKEDCDKLVDAIQKTKEFFNGTL             410
           HHCAQPL+++LG+ + VRASFY YNTK DCD LV+AI K KEFFNGTL
Sbjct: 361 HHCAQPLLSYLGVPATVRASFYIYNTKADCDRLVEAILKAKEFFNGTL             408
```

Based on this analysis, it was predicted that these proteins and their epitopes could be useful antigens for vaccines or diagnostics.

EXAMPLE 1860

A DNA sequence (GBSx1967) was identified in *S. agalactiae* <SEQ ID 5781> which encodes the amino acid sequence <SEQ ID 5782>. Analysis of this protein sequence reveals the following:

```
Possible site: 14
>>> Seems to have no N-terminal signal sequence

----- Final Results -----
bacterial cytoplasm --- Certainty = 0.1441 (Affirmative) < succ>
bacterial membrane  --- Certainty = 0.0000 (Not Clear)   < succ>
bacterial outside   --- Certainty = 0.0000 (Not Clear)   < succ>
```

The protein has homology with the following sequences in the GENPEPT database.

```
>GP: BAB07189 GB: AP001518 unknown conserved protein [Bacillus halodurans]
Identities = 171/430 (39%), Positives = 267/430 (61%), Gaps = 15/430 (3%)

Query:   1 MSKEAILNFLQAKGEPTWLQELRLKAFEKIEELELPVIERVKFHRWNLG--DGTILENDY  58
           + KE + +F  A+ EP W +++RLK FE +E LELP  ++ K   WN     D   + E
```

-continued

```
Sbjct:    9 IDKEYVQSFSDARNEPQWFKDIRLKGFELVETLELPKPDKTKITSWNFTNFDHKLPEVSP   68

Query:   59 TANVPDFTE---------LGNNPKLVQIGTQTVLEQVPMELIEKGVVFTDFYSALEEIPE  109
             A++  +   +              LVQ    V  ++    L  KGV+FTD +A++E  +
Sbjct:   69 VASIDELRDEVKGLIGEASDTQNLLVQRDATVVYSKLDEALKAKGVIFTDLLTAVKEHGD  128

Query:  110 VIERYFGK-ARPFEEDRLAAYHTAYFNSGAVLYIPDNVEITQPIEGLFYQDSQSKVPFNK  168
             ++E+Y+ K A   +E+RL A H A  N G  +Y+P NVEI  P++ +F+ D++      FN
Sbjct:  129 LVEKYYMKDAVKVDENRLTALHAALVNGGTFIYVPRNVEIEVPLQSVFWFDTEKAGLFN-  187

Query:  169 HILLIVGKNAKVSYLERFESIGDGTERTSANISVEVIAQAGSQIKFASIDRLGENVTTFI  228
             H++++    N+ ++Y+E + S G   +E    ANI VEV A A +++ F ++D L    VTT++
Sbjct:  188 HVIIVAEDNSSITYVENYASFG--SEEAVANIVVEVFAGANAKVSFGAVDNLAAGVTTYV  245

Query:  229 SRRGRHSSDATIDWALGVMNEGNVVADFDSDLIGDGSHANLKVVAASSGRQVQGIDTRVT  288
               RR        D+ ++WALG MN+GN V++   +  L+GD S A+ K  V+     G Q Q    T++
Sbjct:  246 VRRAHVGRDSRVEWALGQMNDGNTVSENTTHLLGDNSWADTKTVSVGRGEQKQNFTTQIF  305

Query:  289 NYGCNSVGHILQHGVILERGTLTFNGIGHIIKGAKGADAQQESRVLMLSDKARSDANPIL  348
             ++G +S G+IL+HGV+ E  T   FNGI  I    GA  +     +Q  RVLMLS+KAR DANPIL
Sbjct:  306 HNGKHSEGYILKHGVMREAATSIFNGISKIEHGATKSHGEQTERVLMLSEKARGDANPIL  365

Query:  349 LIDENDVTAGHAASIGQVDPEDLYYLMSRGLNQKTAEQLVIRGFLGTVIAEIPVKEVRDE  408
             LIDE+DVTAGHAAS+G++DP    ++YLMSRG+++    AE+LVI GFL   V+ ++P++ V++
Sbjct:  366 LIDEDDVTAGHAASVGKIDPIQMFYLMSRGISRAEAERLVIHGFLAPVVGQLPIESVKER  425

Query:  409 MIAVIDTRLE  418
             ++  I+ K++
Sbjct:  426 LVEAIERKVK  435
```

A related DNA sequence was identified in *S. pyogenes* <SEQ ID 5783> which encodes the amino acid sequence <SEQ ID 5784>. Analysis of this protein sequence reveals the following:

```
Possible site: 14
>>> Seems to have no N-terminal signal sequence
INTEGRAL Likelihood = -0.80 Transmembrane 387-403 (387-403)

----- Final Results -----
bacterial membrane --- Certainty = 0.1319 (Affirmative) < succ>
bacterial outside  --- Certainty = 0.0000 (Not Clear)  < succ>
bacterial cytoplasm --- Certainty = 0.0000 (Not Clear)  < succ>
```

The protein has homology with the following sequences in the databases:

```
>GP: CAB15259 GB: Z99120 similar to hypothetical proteins [Bacillus subtilis]
Identities = 177/428 (41%), Positives = 267/428 (62%), Gaps = 15/428 (3%)

Query:    3 KEKLVAFSQAHAEPAWLQERRLAALEAIPNLELPTIERVKFHRWNLGDGT--LTENESLA   60
            +E L +FS+ H EPAWL+  RL ALE    +L +P ++ K   WN +         +NE L+
Sbjct:   11 QEYLKSFSEKHQEPAWLKNLRLQALEQAEDLPMPKPDKTKITNWNFTNFAKHTVDNEPLS   70

Query:   61 SVPDF-------IAIGDNPKLVQVGTQTVLEQLPMA--LIDKGVVFSDFYTALEEIPEVI  111
            S+ D        I I + K + V      L  ++   L  DKGV+F+D  TA  E   +++
Sbjct:   71 SLEDLTDEVKALIDIENEDKTLYVQRDQTPAHLSLSQELKDKGVIFTDILTAAREHSDLV  130

Query:  112 EAHFGQ-ALAFDEDKLAAYHTAYFNSAAVLYVPDHLEITTPIEAIFLQDSDSDVPFNKHV  170
            E  +F  +    DE KL A H A  N  A LYVP ++++ TP++A+++  +S+     FN HV
Sbjct:  131 EKYFMKDGVKVDEHKLTALHAALVNGGAFLYVPKNVQVETPVQAVYVHESNDTALFN-HV  189

Query:  171 LVIAGKESKFTYLERFESIGNATQKISANISVEVIAQAGSQIKFSAIDRLGPSVTTYISR  230
            L++A    S  TY+E + S N     + NI EVI     +  + A+D L    VTTY++R
Sbjct:  190 LIVAEDHSSVTYVENYISTVNPKDAVF-NIISEVITGDNASVTYGAVDNLSSGVTTYVNR  248

Query:  231 RGRLE-KDANIDWALAVMNEGNVIADFDSDLIGQGSQADLKVVAASSGRQVQGIDTRVTN  289
             RG      +D+ I+WAL +MN+G+ I++    ++L G G+   D K V      G Q +      T++ +
Sbjct:  249 RGAARGRDSKIEWALGLMNDGDTISENTTNLYGDGTYGDTKTVVVGRGEQTENFTTQIH  308

Query:  290 YGQRTVGHILQHGVILERGTLTFNGIGHILKDAKGADAQQESRVLMLSDQARADANPILL  349
            +G+    G+IL+HGV+     +   FNGIG I     A +A+QESRVLMLS++AR DANPILL
Sbjct:  309 FGKASEGYILKHGVMKDSASSIFNGIGKIEHGASKANAEQESRVLMLSEKARGDANPILL  368
```

```
-continued
Query: 350 IDENEVTAGHAASIGQVDPEDMYYLMSRGLDQETAERLVIRGFLGAVIAEIPIPSVRQEI 409
            IDE++VTAGHAAS+G+VDP  +YYLMSRG+ +E AERLVI GFL  V+ E+PI  V++++
Sbjct: 369 IDEDDVTAGHAASVGRVDPIQLYYLMSRGIPKEEAERLVIYGFLAPVVNELPIEGVKKQL 428

Query: 410 IKVLDEKL                                                    417
            + V++ K+
Sbjct: 429 VSVIERKV                                                    436
```

An alignment of the GAS and GBS proteins is shown below.

```
Identities = 322/420 (76%), Positives = 368/420 (86%)

Query:    1 MSKEAILNFLQAKGEPTWLQELRLKAFEKIEELELPVIERVKFHRWNLGDGTILENDYTA   60
            M+KE ++ F QA  EP WLQE RL A E I  LELP IERVKFHRWNLGDGT+ EN+  A
Sbjct:    1 MTKEKLVAFSQAHAEPAWLQERRLAALEAIPNLELPTIERVKFHRWNLGDGTLTENESLA   60

Query:   61 NVPDFTELGNNPKLVQIGTQTVLEQVPMELIEKGVVFTDFYSALEEIPEVIERYFGKARP  120
            +VPDF  +G+NPKLVQ+GTQTVLEQ+PM LI+KGVVF+DFY+ALEEIPEVIE +FG+A
Sbjct:   61 SVPDFIAIGDNPKLVQVGTQTVLEQLPMALIDKGVVFSDFYTALEEIPEVIEAHFGQALA  120

Query:  121 FEEDRLAAYHTAYFNSGAVLYIPDNVEITQPIEGLFYQDSQSKVPFNKHILLIVGKNAKV  180
            F+ED+LAAYHTAYFNS AVLY+PD++EIT PIE +F QDS S VPFNKH+L+I GK +K
Sbjct:  121 FDEDKLAAYHTAYFNSAAVLYVPDHLEITTPIEAIFLQDSDSDVPFNKHVLVIAGKESKF  180

Query:  181 SYLERFESIGDGTERTSANISVEVIAQAGSQIKFASIDRLGENVTTFISRRGRHSSDATI  240
            +YLERFESIG+ T++ SANISVEVIAQAGSQIKF++IDRLG +VTT+ISRRGR   DA I
Sbjct:  181 TYLERFESIGNATQKISANISVEVIAQAGSQIKFSAIDRLGPSVTTYISRRGRLEKDANI  240

Query:  241 DWALGVMNEGNVVADFDSDLIGDGSHANLKVVAASSGRQVQGIDTRVTNYGCNSVGHILQ  300
            DWAL VMNEGNV+ADFDSDLIG GS A+LKVVAASSGRQVQGIDTRVTNYG  +VGHILQ
Sbjct:  241 DWALAVMNEGNVIADFDSDLIGQGSQADLKVVAASSGRQVQGIDTRVTNYGQRTVGHILQ  300

Query:  301 HGVILERGTLTFNGIGHIIKGAKGADAQQESRVLMLSDKARSDANPILLIDENDVTAGHA  360
            HGVILERGTLTFNGIGHI+K AKGADAQQESRVLMLSD+AR+DANPILLIDEN+VTAGHA
Sbjct:  301 HGVILERGTLTFNGIGHILKDAKGADAQQESRVLMLSDQARADANPILLIDENEVTAGHA  360

Query:  361 ASIGQVDPEDLYYLMSRGLNQKTAEQLVIRGFLGTVIAEIPVKEVRDEMIAVIDTKLEKR  420
            ASIGQVDPED+YYLMSRGL+Q+TAE+LVIRGFLG VIAEIP+  VR E+I V+D KL  R
Sbjct:  361 ASIGQVDPEDMYYLMSRGLDQETAERLVIRGFLGAVIAEIPIPSVRQEIIKVLDEKLLNR  420
```

Based on this analysis, it was predicted that these proteins and their epitopes could be useful antigens for vaccines or diagnostics.

EXAMPLE 1861

A DNA sequence (GBSx1968) was identified in *S. agalactiae* <SEQ ID 5785> which encodes the amino acid sequence <SEQ ID 5786>. This protein is predicted to be ABC transporter, ATP-binding protein, Ycf16 family. Analysis of this protein sequence reveals the following:

```
Possible site: 59
>>> Seems to have no N-terminal signal sequence

----- Final Results -----
         bacterial cytoplasm --- Certainty = 0.2253(Affirmative) < succ>
          bacterial membrane --- Certainty = 0.0000(Not Clear) < succ>
           bacterial outside --- Certainty = 0.0000(Not Clear) < succ>
```

The protein has homology with the following sequences in the GENPEPT database.

```
>GP: CAB15260 GB: Z99120 similar to ABC transporter (ATP-binding
protein) [Bacillus subtilis]
Identities = 180/250 (72%), Positives = 212/250 (84%)

Query:    2 SVLEIKNLHVSIEDKEILKGLNLTLKTGEIAAIMGPNGTGKSTLSAAIMGNPNYEVTAGE   61
            S L IK+LHV IE KEILKG+NL +K GE  A+MGPNGTGKSTLSAAIMG+P YEVT G
Sbjct:    4 STLTIKDLHVEIEGKEILKGVNLEIKGGEFHAVMGPNGTGKSTLSAAIMGHPKYEVTKGS   63
```

```
-continued
Query:   62 ILFDGEDILELEVDERARLGLFLAMQYPSEVPGITNAEFIRAAMNAGKADDDKISIRQFI   121
            I  DG+D+LE+EVDERA+ GLFLAMQYPSE+ G+TNA+F+R+A+NA + + D+IS+ +FI
Sbjct:   64 ITLDGKDVLEMEVDERAQAGLFLAMQYPSEISGVTNADFLRSAINARREEGDEISLMKFI   123

Query:  122 TKLDEKMELLGMKEEMAERYLNEGFSGGEKKRNEILQLLMLEPKFALLDEIDSGLDIDAL   181
            K+DE ME L M  EMA+RYLNEGFSGGEKKRNEILQL+M+EPK A+LDEIDSGLDIDAL
Sbjct:  124 RKMDENMEFLEMDPEMAQRYLNEGFSGGEKKRNEILQLMMIEPKIAILDEIDSGLDIDAL   183

Query:  182 KVVSKGVNEMRGEGFGAMIITHYQRLLNYITPDKVHVMMDGKVVLSGGPELAVRLEKEGY   241
            KVVSKG+H+MR E FG ++ITHYQRLLNYITPD VHVMM G+VV SGG ELA RLE EGY
Sbjct:  184 KVVSKGINKMRSENFGCLMITHYQRLLNYITPDVVHVMMQGRVVKSGGAELAQRLEAEGY   243

Query:  242 AQIAEELGLE                                                   251
            I  +ELG+E
Sbjct:  244 DWIKQELGIE                                                   253
```

A related DNA sequence was identified in *S. pyogenes* <SEQ ID 5787> which encodes the amino acid sequence <SEQ ID 5788>. Analysis of this protein sequence reveals the following:

```
Possible site: 48
>>> Seems to have no N-terminal signal sequence

----- Final Results -----
          bacterial cytoplasm --- Certainty = 0.2417(Affirmative) < succ>
           bacterial membrane --- Certainty = 0.0000(Not Clear)   < succ>
            bacterial outside --- Certainty = 0.0000(Not Clear)   < succ>
```

An alignment of the GAS and GBS proteins is shown below.

```
Identities = 225/255 (88%), Positives = 241/255 (94%)

Query:    1 MSVLEIKNLHVSIEDKEILKGLNLTLKTGEIAAIMGPNGTGKSTLSAAIMGNPNYEVTAG   60
            MS+LEI NLHVSIE KEILKG+NLTLKTGE+AAIMGPNGTGKSTLSAAIMGNPNYEVT G
Sbjct:    1 MSILEINNLHVSIEGKEILKGVNLTLKTGEVAAIMGPNGTGKSTLSAAIMGNPNYEVTQG   60

Query:   61 EILFDGEDILELEVDERARLGLFLAMQYPSEVPGITNAEFIRAAMNAGKADDDKISIRQF   120
            +IL DG +IL+LEVDERARLGLFLAMQYPSE+PGITNAEF+RAAMNAGKAD+DKIS+R F
Sbjct:   61 QILLDGVNILDLEVDERARLGLFLAMQYPSEIPGITNAEFMRAAMNAGKADEDKISVRDF   120

Query:  121 ITKLDEKMELLGMKEEMAERYLNEGFSGGEKKRNEILQLLMLEPKFALLDEIDSGLDIDA   180
            ITKLDEKM LLGMKEEMAERYLNEGFSGGEKKRNEILQLLMLEPKFALLDEIDSGLDIDA
Sbjct:  121 ITKLDEKMALLGMKEEMAERYLNEGFSGGEKKRNEILQLLMLEPKFALLDEIDSGLDIDA   180

Query:  181 LKVVSKGVNEMRGEGFGAMIITHYQRLLNYITPDKVHVMMDGKVVLSGGPELAVRLEKEG   240
            LKVVSKGVNEMRG+ FGAMIITHYQRLLNYITPD VHVMMDG++VLSG   LA RLEKEG
Sbjct:  181 LKVVSKGVNEMRGKDFGAMIITHYQRLLNYITPDLVHVMMDGRIVLSGDAALATRLEKEG   240

Query:  241 YAQIAEELGLEYKEE                                              255
            YA IA++LG+EYKEE
Sbjct:  241 YAGIAQDLGIEYKEE                                              255
```

Based on this analysis, it was predicted that these proteins and their epitopes could be useful antigens for vaccines or diagnostics.

EXAMPLE 1862

A DNA sequence (GBSx1969) was identified in *S. agalactiae* <SEQ ID 5789> which encodes the amino acid sequence <SEQ ID 5790>. This protein is predicted to be RgpG (rfe). Analysis of this protein sequence reveals the following:

```
Possible site: 40
>>> Seems to have an uncleavable N-term signal seq
    INTEGRAL     Likelihood = -12.10    Transmembrane  312-328 (308-336)
    INTEGRAL     Likelihood = -10.03    Transmembrane   15-31  (6-41)
    INTEGRAL     Likelihood =  -9.82    Transmembrane  205-221 (197-226)
    INTEGRAL     Likelihood =  -8.60    Transmembrane  335-351 (329-358)
    INTEGRAL     Likelihood =  -7.48    Transmembrane  257-273 (255-281)
```

```
                               -continued
    INTEGRAL       Likelihood = -5.52    Transmembrane    60-76   (56-79)
    INTEGRAL       Likelihood = -5.31    Transmembrane   151-167  (148-171)
    INTEGRAL       Likelihood = -4.88    Transmembrane    91-107  (90-108)
    INTEGRAL       Likelihood = -4.78    Transmembrane   184-200  (177-203)
    INTEGRAL       Likelihood = -3.13    Transmembrane   119-135  (119-135)
    INTEGRAL       Likelihood = -2.97    Transmembrane   229-245  (229-250)

----- Final Results -----
              bacterial membrane --- Certainty = 0.5840(Affirmative) < succ>
               bacterial outside --- Certainty = 0.0000(Not Clear)   < succ>
             bacterial cytoplasm --- Certainty = 0.0000(Not Clear)   < succ>
```

A related GBS nucleic acid sequence <SEQ ID 8919> which encodes amino acid sequence <SEQ ID 8920> was also identified. Analysis of this protein sequence reveals the following:

```
Lipop: Possible site: -1 Crend: 10
McG: Discrim Score: 5.18
GvH: Signal Score (-7.5): -6.19
    Possible site: 15
>>> Seems to have an uncleavable N-term signal seq
ALOM program count: 9 value: -12.10 threshold: 0.0
    INTEGRAL       Likelihood = -12.10   Transmembrane   239-255  (235-263)
    INTEGRAL       Likelihood = -9.82    Transmembrane   132-148  (124-153)
    INTEGRAL       Likelihood = -8.60    Transmembrane   262-278  (256-285)
    INTEGRAL       Likelihood = -7.48    Transmembrane   184-200  (182-208)
    INTEGRAL       Likelihood = -5.31    Transmembrane    78-94   (75-98)
    INTEGRAL       Likelihood = -4.88    Transmembrane    18-34   (17-35)
    INTEGRAL       Likelihood = -4.78    Transmembrane   111-127  (104-130)
    INTEGRAL       Likelihood = -3.13    Transmembrane    46-62   (46-62)
    INTEGRAL       Likelihood = -2.97    Transmembrane   156-172  (156-177)
    PERIPHERAL     Likelihood = 12.63    284
modified ALOM score: 2.92
*** Reasoning Step: 3

----- Final Results -----
              bacterial membrane --- Certainty = 0.5840(Affirmative) < succ>
               bacterial outside --- Certainty = 0.0000(Not Clear)   < succ>
             bacterial cytoplasm --- Certainty = 0.0000(Not Clear)   < succ>
```

The protein has homology with the following sequences in the GENPEPT database.

```
>GP: BAA82114 GB: AB022909 RgpG [Streptococcus mutans]
Identities = 266/382 (69%), Positives = 317/382 (82%)

Query:   10 TIEYIFVLIGAFLLSIILTPIIRVISLKVGAVDKPNARRINKVPMPSSGGLAIFLSFVVT    69
            T++++ VLI    L S++LTP++R  +L+VGAVD PNARRINKVPMPS+GGLAI +SFV+
Sbjct:    7 TLKFVLVLIATLLTSLVLTPLVRFFALRVGAVDNPNARRINKVPMPSAGGLAIIISFVIA    66

Query:   70 TLFFMPMAASRHFIEVSYFHYILPVIIGGLVVTTTGFIDDIFELRPRYKMLGIIIAAIII   129
            TL  MPM       SYF YILPV++G LV+   TGFIDD++EL P+ K LGI++ A+II
Sbjct:   67 TLALMPMILKTQIGGKSYFEYILPVVLGALVIALTGFIDDVYELSPKIKFLGILLGAVII   126

Query:  130 WKFTHFRFDSFKIPIGGGPLLEFGPILTFFLTVLWIISITNAINLIDGLDGLVSGVSIISL   189
            W FT FRFDSFKIP GGP+L F P L+FFLT+LW+++ITNA+NLIDGLDGLVSGVS+ISL
Sbjct:  127 WIFTDFRFDSFKIPFGGPMLHFNPFLSFFLTILWVVAITNAVNLIDGLDGLVSGVSMISL   186

Query:  190 ATMAVVSYFFLPKIDFFLTLTIVILIASIVGFFPYNYHPAIIYLGDAGALFIGFMIGVLS   249
                TM +VSYFFL   D FLTLTI +LI +I GFFPYNYHPAIIYLGD GALFIGFMI VLS
Sbjct:  187 TTMGLVSYFFLYDTDIFLTLTIFVLIFAIAGFFPYNYHPAIIYLGDTGALFIGFMISVLS   246

Query:  250 LQGLKNSTAVAVITPVIILGVPILDTAVAIVRRKLSGKKISEADKMHLHHRLLSMGFTHR   309
            LQGLKN+TAVAV+TP+I+LGVPI+DT VAI+RR LSG+K    EAD MHLHHRLL+MGFTHR
Sbjct:  247 LQGLKNATAVAVVTPIIVLGVPIVDTTVAIIRRTLSGQKFYEADNMHLHHRLLAMGFTHR   306

Query:  310 GAVLVVYGIAIIFSLIALLLNVSSRIGGIFLLLALLLAMEIFIEGLNIWGENRTPLFNLL   369
            GAVLVVYGIA+ FSL++LLLNVSSR+GGI L++  + A+EIFIEGL IWG  RTPLF LL
Sbjct:  307 GAVLVVYGIAMFFSLVSLLLLNVSSRLGGILLMIGVAFALEIFIEGLEIWGPKRTPLFRLL   366

Query:  370 KFIGNSDYRQSVIAKYSDKHQK                                         391
            FIGNSDYRQ V+AKY   K +K
Sbjct:  367 AFIGNSDYRQEVVAKYRRKKKK                                         388
```

A related DNA sequence was identified in *S. pyogenes* <SEQ ID 5791> which encodes the amino acid sequence <SEQ ID 5792>. Analysis of this protein sequence reveals the following:

```
Possible site: 32
>>> Seems to have an uncleavable N-term signal seq
      INTEGRAL    Likelihood = -8.28     Transmembrane      9-25   (1-33)
      INTEGRAL    Likelihood = -8.17     Transmembrane    201-217  (198-221)
      INTEGRAL    Likelihood = -7.64     Transmembrane    308-324  (305-329)
      INTEGRAL    Likelihood = -7.17     Transmembrane     55-71   (51-74)
      INTEGRAL    Likelihood = -7.06     Transmembrane    145-161  (138-170)
      INTEGRAL    Likelihood = -6.58     Transmembrane    260-276  (251-278)
      INTEGRAL    Likelihood = -6.21     Transmembrane    180-196  (172-198)
      INTEGRAL    Likelihood = -5.95     Transmembrane    331-347  (330-353)
      INTEGRAL    Likelihood = -5.68     Transmembrane     87-103  (82-104)
      INTEGRAL    Likelihood = -3.93     Transmembrane    113-129  (112-133)
      INTEGRAL    Likelihood = -2.60     Transmembrane    233-249  (232-250)

----- Final Results -----
            bacterial membrane --- Certainty = 0.4312(Affirmative) < succ>
             bacterial outside --- Certainty = 0.0000(Not Clear)   < succ>
           bacterial cytoplasm --- Certainty = 0.0000(Not Clear)   < succ>
```

The protein has homology with the following sequences in the databases:

```
>GP: BAA82114 GB: AB022909 RgpG [Streptococcus mutans]
Identities = 289/381 (75%), Positives = 334/381 (86%), Gaps = 1/381 (0%)

Query:   5 TIDYVLVLIGALLMSLFLTPLVRFLAFRVGAVDNPNARRVNKVPMPTSGGLAIFMSFLVA   64
           T+ +VLVLI  LL SL LTPLVRF A RVGAVDNPNARR+NKVPMP++GGLAI +SF++A
Sbjct:   7 TLKFVLVLIATLLTSLVLTPLVRFFALRVGAVDNPNARRINKVPMPSAGGLAIIISFVIA   66

Query:  65 SLGLIPIASKGAMFFGQTYFSYILPVVIGATVITLTGFLDDLYELSPKLKMFGILIGAVI  124
           +L L+P+ K     G++YF YILPVV+GA VI LTGF+DD+YELSPK+K  GIL+GAVI
Sbjct:  67 TLALMPMILK-TQIGGKSYFEYILPVVLGALVIALTGFIDDVYELSPKIKFLGILLGAVI  125

Query: 125 VWAFTDFKFDSFKIPFGGPLLVFGPFLTLFLTVLWIVSITNAINLIDGLDGLVSGVSIIS  184
           +W FTDF+FDSFKIPFGGP+L F PFL+ FLT+LW+V+ITNA+NLIDGLDGLVSGVS+IS
Sbjct: 126 IWIFTDFRFDSFKIPFGGPMLHFNPFLSFFLTILWVVAITNAVNLIDGLDGLVSGVSMIS  185

Query: 185 LVTMAIVSYFFLPQKDFFLTLTILVLISAIAGFFPYNYHPAMIYLGDTGALFIGFMIGVL  244
           L TM +VSYFFL   D FLTLTI VLI AIAGFFPYNYHPA+IYLGDTGALFIGFMI VL
Sbjct: 186 LTTMGLVSYFFLYDTDIFLTLTIFVLIFAIAGFFPYNYHPAIIYLGDTGALFIGFMISVL  245

Query: 245 SLQGLKNSTAVAVVTPVIILGVPIMDTIVAIIRRSLSGQKFYEPDKMHLHHRLLSMGFTH  304
           SLQGLKN+TAVAVVTP+I+LGVPI+DT VAIIRR+LSGQKFYE D MHLHHRLL+MGFTH
Sbjct: 246 SLQGLKNATAVAVVTPIIVLGVPIVDTTVAIIRRTLSGQKFYEADNMHLHHRLLAMGFTH  305

Query: 305 RGAVLVVYGITMLFSLISLLLNVSSRIGGVLLMLGLLFGLEVFIEGLEIWGEKRTPLFNL  364
           RGAVLVVYGI M FSL+SLLLNVSSR GG+LLM+G+ F LE+FIEGLEIWG KRTPLF L
Sbjct: 306 RGAVLVVYGIAMFFSLVSLLLNVSSRLGGILLMIGVAFALEIFIEGLEIWGPKRTPLFRL  365

Query: 365 LKFIGNSDYRQAMLLKWKEKK                                         385
           L FIGNSDYRQ ++ K++ KK
Sbjct: 366 LAFIGNSDYRQEVVAKYRRKK                                         386
                                                 50
```

An alignment of the GAS and GBS proteins is shown below.

```
Identities = 282/384 (73%), Positives = 334/384 (86%), Gaps = 1/384 (0%)

Query:   6 MIPFTIEYIFVLIGAFLLSIILTPIIRVISLKVGAVDKPNARRINKVPMPSSGGLAIFLS   65
           M   FTI+Y+ VLIGA L+S+ LTP++R ++ +VGAVD PNARR+NKVPMP+SGGLAIF+S
Sbjct:   1 MFSFTIDYVLVLIGALLMSLFLTPLVRFLAFRVGAVDNPNARRVNKVPMPTSGGLAIFMS   60

Query:  66 FVVTTLFFMPMAAS-RHFIEVSYFHYILPVIIGGLVVTTTGFIDDIFELRPRYKMLGIII  124
           F+V +L  +P+A+      F  +YF YILPV+IG  V+T TGF+DD++EL P+ KM GI+I
Sbjct:  61 FLVASLGLIPIASKGAMFFGQTYFSYILPVVIGATVITLTGFLDDLYELSPKLKMFGILI  120
```

```
-continued
Query: 125 AAIIIWKFTHFRFDSFKIPIGGPLLEFGPILTFFLTVLWIISITNAINLIDGLDGLVSGV   184
            A+I+W FT F+FDSFKIP GGPLL FGP LT FLTVLWI+SITNAINLIDGLDGLVSGV
Sbjct: 121 GAVIVWAFTDFKFDSFKIPFGGPLLVFGPFLTLFLTVLWIVSITNAINLIDGLDGLVSGV   180

Query: 185 SIISLATMAVVSYFFLPKIDFFLTLTIVILIASIVGFFPYNYHPAIIYLGDAGALFIGFM   244
            SIISL TMA+VSYFFLP+ DFFLTLTI++LI++I GFFPYNYHPA+IYLGD GALFIGFM
Sbjct: 181 SIISLVTMAIVSYFFLPQKDFFLTLTILVLISAIAGFFPYNYHPAMIYLGDTGALFIGFM   240

Query: 245 IGVLSLQGLKNSTAVAVITPVIILGVPILDTAVAIVRRKLSGKKISEADKMHLHHRLLSM   304
            IGVLSLQGLKNSTAVAV+TPVIILGVPI+DT VAI+RR LSG+K  E DKMHLHHRLLSM
Sbjct: 241 IGVLSLQGLKNSTAVAVVTPVIILGVPIMDTIVAIIRRSLSGQKFYEPDKMHLHHRLLSM   300

Query: 305 GFTHRGAVLVVYGIAIIFSLIALLLNVSSRIGGIFLLLALLLAMEIFIEGLNIWGENRTP   364
            GFTHRGAVLVVYGI ++FSLI+LLLNVSSRIGG+ L+L LL  +E+FIEGL IWGE RTP
Sbjct: 301 GFTHRGAVLVVYGITMLFSLISLLLNVSSRIGGVLLMLGLLFGLEVFIEGLEIWGEKRTP   360

Query: 365 LFNLLKFIGNSDYRQSVIAKYSDK                                       388
            LFNLLKFIGNSDYRQ+++ K+ +K
Sbjct: 361 LFNLLKFIGNSDYRQAMLLKWKEK                                       384
```

Based on this analysis, it was predicted that these proteins and their epitopes could be useful antigens for vaccines or diagnostics.

EXAMPLE 1863

A DNA sequence (GBSx1970) was identified in *S. agalactiae* <SEQ ID 5793> which encodes the amino acid sequence <SEQ ID 5794>. This protein is predicted to be negative regulator of genetic competence. Analysis of this protein sequence reveals the following:

```
Possible site: 16
>>> Seems to have no N-terminal signal sequence

----- Final Results -----
            bacterial cytoplasm --- Certainty = 0.3460(Affirmative) < succ>
            bacterial membrane  --- Certainty = 0.0000(Not Clear)   < succ>
            bacterial outside   --- Certainty = 0.0000(Not Clear)   < succ>
```

A related GBS nucleic acid sequence <SEQ ID 9483> which encodes amino acid sequence <SEQ ID 9484> was also identified.

The protein has homology with the following sequences in the GENPEPT database.

```
>GP: BAA82113 GB: AB022909 negative regulator of genetic competence
[Streptococcus mutans]
Identities = 168/248 (67%), Positives = 205/248 (81%), Gaps = 9/248 (3%)

Query:   1 MEMKQISETTLKITISMEDLEDRGMELKDFLIPQEKTEEFFYSVMDELDLPENFKNSGML    60
           MEMKQISETTLKITISMEDLE+RGMELKDFLIPQEKTEEFFY+VMDELDLPENFK SGML
Sbjct:   1 MEMKQISETTLKITISMEDLEERGMELKDFLIPQEKTEEFFYTVMDELDLPENFKGSGML    60

Query:  61 SFRVTPKKDRIDVFVTKSELSKDLNLEELADLGDISKMSPEDFFKTLEQSMLEKGDTDAH   120
           SFRVTP+ DRIDVFVTKSE++K+LNLE+L+D  DISKMSPEDFF TLE++M EKGD  A
Sbjct:  61 SFRVTPRNDRIDVFVTKSEINKNLNLEDLSDFDDISKMSPEDFFNTLEETMREKGDAAAL   120

Query: 121 AKLAEIENMMDKATQEVVEENVSEEQPEKEVETIGYVHYVFDFDNIEAVVRFSQTIDFPI   180
             KLAEIE   ++ TQ+  E+  ++E+ +       YVH+V DF NI+ V+ F++T+D+ +
Sbjct: 121 DKLAEIEKREEEKTQQ--EKGETKEKRD-------YVHFVLDFPNIQQVISFAKTVDYDV   171

Query: 181 EASELYKNGKGYHMTILLDLENQPSYFANLMYARMLEHANVGTKTRAYLKEHSIQLIHDD   240
           EASEL+K    YHMT+LL+LE++P Y+A+LM+ARMLEHA  GTKTRAYL EH +QLI  D
Sbjct: 172 EASELFKESDAYHMTVLLNLEDKPDYYADLMFARMLEHAGRGTKTRAYLLEHGVQLIKAD   231

Query: 241 AISKLQMI                                                       248
           A+ +LQMI
Sbjct: 232 ALQELQMI                                                       239
```

A related DNA sequence was identified in *S. pyogenes* <SEQ ID 5795> which encodes the amino acid sequence <SEQ ID 5796>. Analysis of this protein sequence reveals the following:

```
Possible site: 18
>>> Seems to have no N-terminal signal sequence

----- Final Results -----
            bacterial cytoplasm --- Certainty = 0.3307(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below.

```
Identities = 171/253 (67%), Positives = 209/253 (82%), Gaps = 2/253 (0%)

Query:    1 MEMKQISETTLKITISMEDLEDRGMELKDFLIPQEKTEEFFYSVMDELDLPENFKNSGML    60
            MEMKQISETTLKITISM+DLE+RGMELKDFLIPQEKTEEFFYSVMDELDLP+NFK+SGML
Sbjct:    3 MEMKQISETTLKITISMDDLEERGMELKDFLIPQEKTEEFFYSVMDELDLPDNFKDSGML    62

Query:   61 SFRVTPKKDRIDVFVTKSELSKDLNLEELADLGDISKMSPEDFFKTLEQSMLEKGDTDAH   120
            SFRVTP+KDR+DVFVTKSE++KD+NLE+LA+ GD+S+M+PEDFFK+LEQSM EKGD  AH
Sbjct:   63 SFRVTPRKDRLDVFVTKSEINKDINLEDLAEFGDMSQMTPEDFFKSLEQSMREKGDVKAH   122

Query:  121 AKLAEIENMMDKATQEVV--EENVSEEQPEKEVETIGYVHYVFDFDNIEAVVRFSQTIDF   178
              KL +IE +M+    +   +    ++     E E + YVHYV DF  I     V F++TIDF
Sbjct:  123 EKLEKIEEIMEDVVEATLANQSEAADPSTNHESEPLDYVHYVLDFSTITEAVAFAKTIDF   182

Query:  179 PIEASELYKNGKGYHMTILLDLENQPSYFANLMYARMLEHANVGTKTRAYLKEHSIQLIH   238
            IEASELYK     YHMTILLD++ QPSYFAN+MYAR++EHAN G+KTRAYL+EH +QL+
Sbjct:  183 SIEASELYKGSNCYHMTILLDVQQQPSYFANVMYARLIEHANPGSKTRAYLQEHGLQLML   242

Query:  239 DDAISKLQMIEMG                                                251
            D A+ +LQ IE+G
Sbjct:  243 DGAVEQLQKIELG                                                255
```

Based on this analysis, it was predicted that these proteins and their epitopes could be useful antigens for vaccines or diagnostics.

EXAMPLE 1864

A DNA sequence (GBSx1971) was identified in *S. agalactiae* <SEQ ID 5797> which encodes the amino acid sequence <SEQ ID 5798>. This protein is predicted to be BacA (bacA). Analysis of this protein sequence reveals the following:

```
Possible site: 17
>>> Seems to have no N-terminal signal sequence
      INTEGRAL    Likelihood = -9.02    Transmembrane  115-131 (111-135)
      INTEGRAL    Likelihood = -8.97    Transmembrane  227-243 (219-247)
      INTEGRAL    Likelihood = -7.86    Transmembrane   48-64  (44-69)
      INTEGRAL    Likelihood = -7.27    Transmembrane  263-279 (260-279)
      INTEGRAL    Likelihood = -7.22    Transmembrane   87-103 (85-107)
      INTEGRAL    Likelihood = -3.50    Transmembrane    2-18  (1-19)

----- Final Results -----
             bacterial membrane --- Certainty = 0.4609(Affirmative) < succ>
              bacterial outside --- Certainty = 0.0000(Not Clear)   < succ>
            bacterial cytoplasm --- Certainty = 0.0000(Not Clear)   < succ>
```

The protein has homology with the following sequences in the GENPEPT database.

```
>GP: AAD50462 GB: AF169967 BacA [Flavobacterium johnsoniae]
Identities = 101/275 (36%), Positives = 165/275 (59%), Gaps = 22/275 (8%)

Query:    7 LKALFLGVVEGVTEWLPVSSTGHLILVQEFMKLNQSKSFVEMFNIVIQLGAIMAVIVIYF    66
            L+A+ L V+EG+TE+LPVSSTGH+I+    F +    + F ++F IVIQLGAI++V++YF
Sbjct:    4 LQAIVLAVIEGITEFLPVSSTGHMIIASSFFGIAH-EDFTKLFTIVIQLGAILSVVVLYF    62

Query:   67 KRLNPFQPGKSAREIRLTWQLWLKVVIACIPSILIALPFDNWFEAHFNFMIPIAIALIFY   126
            KR    FQ           T   + K+++A IP++++ L     ++ +       + +A++L+
Sbjct:   63 KRF--FQ----------TLDFYFKLLVAFIPAVVLGLLLSDFIDGLLENPVTAVSLLIG   110
```

```
                             -continued
Query: 127 GFVFI----WVEKRNAHLKPQVTELASMSYKTAFLIGCFQVLSIVPGTSRSGATILGAII   182
           G ++     W    NA   Q     ++Y A  IG FQ ++++PG SRSGA+I+G +
Sbjct: 111 GLILLKVDEWFNNPNAAETSQ-----KITYLQALKIGLFQCIAMIPGVSRSGASIVGGMS   165

Query: 183 IGTSRSVAADFTFFLAIPTMFGYSGLKAVKYFLDGNVLSLDQSLILLVASLTAFVVSLYV   242
               SR+ AA+F+FFLA+PTM G + K    Y+  G  LS DQ  IL++ ++ AF+V+L
Sbjct: 166 QKLSRTTAAEFSFFLAVPTMLGATVKKCYDYYKAGFELSHDQVNILIIGNVVAFIVALLA   225

Query: 243 IRFLTDYVKRHDFTIFGKYRIVLGSLLILYWLVVH                           277
           I+     ++ ++ F +FG YRI+ G +L+L     +H
Sbjct: 226 IKTFISFLTKNGFKVFGYYRIIAGIILLLIHFFIH                           260
```

A related DNA sequence was identified in *S. pyogenes* <SEQ ID 5799> which encodes the amino acid sequence <SEQ ID 5800>. Analysis of this protein sequence reveals the following:

```
Possible site: 56
>>> Seems to have no N-terminal signal sequence
     INTEGRAL    Likelihood = -11.30   Transmembrane   225-241 (219-247)
     INTEGRAL    Likelihood =  -9.24   Transmembrane   115-131 (109-135)
     INTEGRAL    Likelihood =  -7.64   Transmembrane    48- 64  (44-69)
     INTEGRAL    Likelihood =  -7.43   Transmembrane    87-103  (85-108)
     INTEGRAL    Likelihood =  -5.15   Transmembrane   263-279 (262-279)
     INTEGRAL    Likelihood =  -3.82   Transmembrane     2- 18   (1-19)

----- Final Results -----
           bacterial membrane --- Certainty = 0.5522(Affirmative) < succ>
            bacterial outside --- Certainty = 0.0000(Not Clear)  < succ>
          bacterial cytoplasm --- Certainty = 0.0000(Not Clear)  < succ>
```

The protein has homology with the following sequences in the databases:

```
>GP: AAD50462 GB: AF169967 BacA [Flavobacterium johnsoniae]
Identities = 102/269 (37%), Positives = 169/269 (61%), Gaps = 14/269 (5%)

Query:    7 LKAIFFGIIEGITEWLPVSSTGHLILVQEFIRLNQDKAFIEMFNIVIQLGAIIAVMLIYF    66
            L+AI  +IEGITE+LPVSSTGH+I+    F  +   F ++F IVIQLGAI++V+++YF
Sbjct:    4 LQAIVLAVIEGITEFLPVSSTGHMIIASSFFGIAHED-FTKLFTIVIQLGAILSVVVLYF    62

Query:   67 ERLNPFQPGKTAREVQLTWQLWLKVVIACIPSILIAVPLDNWFEAHFYFMVPIAIALIVY   126
            +R   FQ         T   + K+++A IP++++ + L ++ +         V +A++L++
Sbjct:   63 KRF--FQ----------TLDFYFKLLVAFIPAVVLGLLLSDFIDGLLENPVTVAVSLLIG   110

Query:  127 GIAFIWIEKRNAQQEPAVTELARMSYKTAFFIGCFQVLSIVPGTSRSGATILGAIILGTS   186
            G+ + +++        A T   +++Y A  IG FQ ++++PG SRSGA+I+G +      S
Sbjct:  111 GLILLKVDEWFNNPNAAETS-QKITYLQALKIGLFQCIAMIPGVSRSGASIVGGMSQKLS   169

Query:  187 RTVAADFTFFLAIPTMFGYSGLKAVKFFLDGHHLDFAQVLILLVASLTAFVVSLLAIRFL   246
            RT AA+F+FFLA+PTM G + K    ++  G L     QV IL++ ++ AF+V+LLAI+
Sbjct:  170 RTTAAEFSFFLAVPTMLGATVKKCYDYYKAGFELSHDQVNILIIGNVVAFIVALLAIKTF   229

Query:  247 TDYVKKHDFTIFGKYRIVLGSLLLIYSFF                                 275
            ++ K+ F +FG YRI+ G +LL+  FF
Sbjct:  230 ISFLTKNGFKVFGYYRIIAGIILLLIHFF                                 258
```

An alignment of the GAS and GBS proteins is shown below.

```
Identities = 227/272 (83%), Positives = 253/272 (92%)

Query:    1 MLIIELLKALFLGVVEGVTEWLPVSSTGHLILVQEFMKLNQSKSFVEMFNIVIQLGAIMA    60
            MLIIELLKA+F G++EG+TEWLPVSSTGHLILVQEF++LNQ K+F+EMFNIVIQLGAI+A
Sbjct:    1 MLIIELLKAIFFGIIEGITEWLPVSSTGHLILVQEFIRLNQDKAFIEMFNIVIQLGAIIA    60

Query:   61 VIVIYFKRLNPFQPGKSAREIRLTWQLWLKVVIACIPSILIALPFDNWFEAHFNFMIPIA   120
            V++IYF+RLNPFQPGK+ARE++LTWQLWLKVVIACIPSILIA+P DNWFEAHF FM+PIA
Sbjct:   61 VMLIYFERLNPFQPGKTAREVQLTWQLWLKVVIACIPSILIAVPLDNWFEAHFYFMVPIA   120

Query:  121 IALIFYGFVFIWVEKRNAHLKPQVTELASMSYKTAFLIGCFQVLSIVPGTSRSGATILGA   180
            IALI YG  FIW+EKRNA  +P VTELA MSYKTAF IGCFQVLSIVPGTSRSGATILGA
Sbjct:  121 IALIVYGIAFIWIEKRNAQQEPAVTELARMSYKTAFFIGCFQVLSIVPGTSRSGATILGA   180
```

```
                               -continued
Query: 181 IIIGTSRSVAADFTFFLAIPTMFGYSGLKAVKYFLDGNVLSLDQSLILLVASLTAFVVSL 240
           II+GTSR+VAADFTFFLAIPTMFGYSGLKAVK+FLDG+ L   Q LILLVASLTAFVVSL
Sbjct: 181 IILGTSRTVAADFTFFLAIPTMFGYSGLKAVKFFLDGHHLDFAQVLILLVASLTAFVVSL 240

Query: 241 YVIRFLTDYVKRHDFTIFGKYRIVLGSLLILY                             272
            IRFLTDYVK+HDFTIFGKYRIVLGSLL++Y
Sbjct: 241 LAIRFLTDYVKKHDFTIFGKYRIVLGSLLLIY                             272
```

Based on this analysis, it was predicted that these proteins and their epitopes could be useful antigens for vaccines or diagnostics.

EXAMPLE 1865

A DNA sequence (GBSx1972) was identified in *S. agalactiae* <SEQ ID 5801> which encodes the amino acid sequence <SEQ ID 5802>. Analysis of this protein sequence reveals the following:

```
Possible site: 42
>>> Seems to have no N-terminal signal sequence
      INTEGRAL    Likelihood = -8.65    Transmembrane    494-510 (488-519)
      INTEGRAL    Likelihood = -8.01    Transmembrane    263-279 (256-288)
      INTEGRAL    Likelihood = -5.95    Transmembrane     25-41  (20-43)
      INTEGRAL    Likelihood = -4.94    Transmembrane    475-491 (473-493)

----- Final Results -----
           bacterial membrane --- Certainty = 0.4461(Affirmative) < succ>
            bacterial outside --- Certainty = 0.0000(Not Clear)   < succ>
          bacterial cytoplasm --- Certainty = 0.0000(Not Clear)   < succ>
```

A related GBS nucleic acid sequence <SEQ ID 9481> which encodes amino acid sequence <SEQ ID 9482> was also identified.

The protein has homology with the following sequences in the GENPEPT database.

```
>GP: AAB99606 GB: U67598 M. jannaschii predicted coding region MJ1577
[Methanococcus jannaschii]
Identities = 41/172 (23%), Positives = 78/172 (44%), Gaps = 19/172 (11%)

Query: 479 LISFVVIIYTLFLNYFTYFCIYLLLFGVILLLNKIIFMMTRKISNGYIVTEDGASRVYQW 538
           +IS ++ ++  F+ ++      ++ ++  II  +T    G          ++ +W
Sbjct: 442 VISILLAVFLYFIPKYSQTFNEVFYLSIVFVVQNIILALTPTSLFGRWKANYYKEKL-EW 500

Query: 539 TSFRNMLRDIKSFDRSELESIVLWNRILVYATLFGYADRVEKALR-VNQIDIPERFANID 597
            +F+N L ++      E I +W   L+Y T  G  D+V +A++ +N   +     + I
Sbjct: 501 DAFKNFLSNLAMIKKYSPEDISIWKDWLIYGTALGVGDKVVEAMKSLNLSELVADYVIIH 560

Query: 598 SHQFAISVNQSSNHFSTITEDVSHASNFSVNSGGSSGGFSGGGG--GGGGGA         647
           S+ ++  + S + ST              GS  GGF  GGG   GGGGGA
Sbjct: 561 SNYDSMKTSVDSVYSSTT            GSGGGFGAGGGFGGGGGGA              597
```

A related DNA sequence was identified in *S. pyogenes* <SEQ ID 5803> which encodes the amino acid sequence <SEQ ID 5804>. Analysis of this protein sequence reveals the following:

```
Possible site: 21
>>> Seems to have a cleavable N-term signal seq.
      INTEGRAL    Likelihood = -7.91    Transmembrane    486-502 (483-508)
      INTEGRAL    Likelihood = -5.89    Transmembrane    465-481 (460-483)
      INTEGRAL    Likelihood = -2.18    Transmembrane    244-260 (241-260)

----- Final Results -----
           bacterial membrane --- Certainty = 0.4163(Affirmative) < succ>
            bacterial outside --- Certainty = 0.0000(Not Clear)   < succ>
          bacterial cytoplasm --- Certainty = 0.0000(Not Clear)   < succ>
```

The protein has homology with the following sequences in the databases:

```
>GP: AAB99606 GB: U67598 M. jannaschii predicted coding region MJ1577
[Methanococcus jannaschii]
Identities = 59/263 (22%), Positives = 106/263 (39%), Gaps = 14/263 (5%)

Query: 369 FLDMAFGNKVTLPVDQLFSQYHYDADTIKQLKKTYKGKKLEQEVRQSSEQVIKAMKKASA   428
            ++ +   G K+ +    L +   Y++D +K L K K     + E  +S Q   K+ K
Sbjct: 346 YIKIMNGGKIEILKTDLENLDVYESDVMKFLMKYSKNNVFDPEYIKSLAQKYKSSKDKLK   405

Query: 429 AITNNVLETIKKLNLPDTYRQMTPA--EKRKSNSVQGLGCLLLILNSGLLIYLAIKESGL   486
            + +      E K+  P   ++   A  E R     +  L  ++L    L           ++
Sbjct: 406 KLKD---ELDKIMEYPRYSSKVVNAFLETRGKKIIIALLVISILLAVFLYFIPKYSQTFN   462

Query: 487 ALIYLALMVLTMCLGFYISLKLDQYKKLGIETPEGGVRLHQWQSFKNMIRDIDKFEDVAI   546
             + YL+++ +      I L L         G         +W +FKN + ++    +   +
Sbjct: 463 EVFYLSIVFVVQ----NIILALTPTSLFGRWKANYYKEKLEWDAFKNFLSNLAMIKKYSP   518

Query: 547 EGLVVWNRVLVYATLFGYAKKVERYLKVHRIALPEVYQAVRPGELSMVMYATTPTFVSSL   606
            E + +W     L+Y T  G      KV  +K   ++      + V     +    Y +  T V S+
Sbjct: 519 EDISIWKDWLIYGTALGVGDKVVEAMKSLNLS-----ELVADYVIIHSNYDSMKTSVDSV   573

Query: 607 SSATTSSNFSVSSGGGISGGGGG                                       629
             S+TT S      +GGG GGGGG
Sbjct: 574 YSSTTGSGGGFGAGGGFGGGGGG                                       596
```

An alignment of the GAS and GBS proteins is shown below.

```
Identities = 241/635 (37%), Positives = 372/635 (57%), Gaps = 18/635 (2%)

Query:  22 MKKCFLAICLALSFFMVSVQADEVDYNIPHYEGNLTIHNDNSADFTEKVTYQFDSSYNGQ    81
           MKK  + + L S   + ++A +VDY+I  +YEG L  +N+A F +KVTYQFD+SYNGQ
Sbjct:   1 MKKILMTLVLCFSLLGIRIKAADVDYSITNYEGQLLLSKENTARFEQKVTYQFDTSYNGQ    60

Query:  82 YVTLGTAGKLPDNFDINNKPQVEVSINGKVRKVSYQIEDLEDGYRLKVFNGGEAGDTVKV   141
           Y++LG  G LP  F I+ KP+VEV  NG+   VS +  DL DGYRLK++N G+AGD V V
Sbjct:  61 YISLGRTGHLPAGFAIDQKPKVEVYQNGQQVPVSQEFSDLGDGYRLKLYNAGQAGDKVDV   120

Query: 142 NVQWKLKNVLFMHKDVGELNWIPISDWDKTLEKVDFWISTDKKVALSRLWGHLGYL-KTP   200
             V W+L+ ++L  ++DV ELNW PISDWDKTLEKV  ++T   + S LW H GY  K P
Sbjct: 121 KVIWQLHHLLTAYQDVAELNWTPISDWDKTLEKVSLTVTTPTDIQDSNLWAHRGYYQKKP   180

Query: 201 PKIRQNNNRYHLTAFNVNKRLEFHGYWDRSYF--NLPTNSKNNYKKKIEYQEKMIERHGF   258
            +++  N+RY + A NV+ +LE H YWD+        P +   + K KI  E   I R
Sbjct: 181 QVLKEGNSRYQINAKNVSGQLELHAYWDKKALLGKEPVDVSTSKKNKIVALETKISRRRT   240

Query: 259 ILSFLLRILLPSFFIIVTLFISIRVFLFRKKVNKYGQFPKEHHLYEAPEDLSPLELTQSI   318
            +L  L  ++P    +   L+  1+       +K+ N+Y     H YE PEDLSPL LTQ+I
Sbjct: 241 LLQLLFGKVIPLVEVGFLLWQLIQFTRLKKQFNRYHLANHTDHSYEVPEDLSPLVLTQAI   300

Query: 319 YSMSFKNFQ---DEEKKTHL---ISQEQLIQSILLDLIDRKVL----NYDDNLLSLANLD   368
           Y  SF       E +K +     ++ E L+Q+ LLDLID+KVL       L ++ LD
Sbjct: 301 YGQSFAYLSPTASESQKLLIPKGVTFEALVQATLLDLIDQKVLLLTKEEGKAYLEISQLD   360

Query: 369 RASDAEIDFIEFAFADSTSLKPDQLFSNYQFSYKETLRELKKQHKASDLQTQMRRRGSNA   428
           R +D E  F++ AF +  +L  DQLFS Y +    +T+++LKK +K   L+ ++R+
Sbjct: 361 RVTDEEAAFLDMAFGNKVTLPVDQLFSQYHYD-ADTIKQLKKTYKGKKLEQEVRQSSEQV   419

Query: 429 LSRITRLTRLISKDNINSLRRKGISSPYRKMSSEESKELSRLKRFSYLSPLISFVVIIYT   488
            +  + + +I+ + + +++ +   YR+M+  E ++ + ++     L  +++   ++IY
Sbjct: 420 IKAMKKASAAITNNVLETIKKLNLPDTYRQMTPAEKRKSNSVQGLCLLLILNSGLLIY-   478

Query: 489 LFLNYFTYFCIYLLLFGVILLLNKIIFMMTRKISNGYIVTEDGASRVYQWTSFRNMLRDI   548
           L  +     IYL L  ++ L   I +    I T +G  R++QW SF+NM+RDI
Sbjct: 479 LAIKESGLALIYLALMVLTMCLGFYISLKLDQYKKLGIETPEGGVRLHQWQSFKNMIRDI   538

Query: 549 KSFDRSELESIVLWNRILVYATLFGYADRVEKALRVNQIDIPERFANIDSHQFAISVNQS   608
            F+   +E +V+WNR+LVYATLFGYA +VE+ L+V++I +PE +     + ++ +  +
Sbjct: 539 DKFEDVAIEGLVVWNRVLVYATLFGYAKKVERYLKVHRIALPEVYQAVRPGELSMVMYAT   598

Query: 609 SNHFSTITEDVSHASNFSVNSGGSSGGFSGGGGGG                           643
            +  F +    + +SNFSV+SG   GG SGGGGGG
Sbjct: 599 TPTFVSSLSSATTSSNFSVSSG---GGISGGGGGG                           630
```

Based on this analysis, it was predicted that these proteins and their epitopes could be useful antigens for vaccines or diagnostics.

A related GBS gene <SEQ ID 8921> and protein <SEQ ID 8922> were also identified. Analysis of this protein sequence reveals the following:

```
Lipop: Possible site: -1 Crend: 4
McG: Discrim Score: 10.29
GvH: Signal Score (-7.5): 3.11
Possible site: 23
>>> Seems to have a cleavable N-term signal seq.
ALOM program count: 3 value: -8.65 threshold: 0.0
INTEGRAL Likelihood = -8.65 Transmembrane 475-491 (469-500)
INTEGRAL Likelihood = -8.01 Transmembrane 244-260 (237-269)
INTEGRAL Likelihood = -4.94 Transmembrane 456-472 (454-474)
PERIPHERAL  Likelihood =  2.28  540
modified ALOM score: 2.23

*** Reasoning Step: 3

----- Final Results -----
bacterial membrane --- Certainty = 0.4461 (Affirmative) < succ>
bacterial outside  --- Certainty = 0.0000 (Not Clear)  < succ>
bacterial cytoplasm --- Certainty = 0.0000 (Not Clear)  < succ>
```

The protein has no homology with any sequences in the databases.

EXAMPLE 1866

A DNA sequence (GBSx1973) was identified in *S. agalactiae* <SEQ ID 5805> which encodes the amino acid sequence <SEQ ID 5806>. This protein is predicted to be glutamine-binding periplasmic protein/glutamine transport system perme. Analysis of this protein sequence reveals the following:

```
Possible site: 24
>>> Seems to have a cleavable N-term signal seq.
INTEGRAL Likelihood = -8.86 Transmembrane 301-317 (295-324)
INTEGRAL Likelihood = -6.05 Transmembrane 479-495 (473-496)
INTEGRAL Likelihood = -0.59 Transmembrane 369-385 (369-385)

----- Final Results -----
bacterial membrane --- Certainty = 0.4545 (Affirmative) < succ>
bacterial outside  --- Certainty = 0.0000 (Not Clear)  < succ>
bacterial cytoplasm --- Certainty = 0.0000 (Not Clear)  < succ>
```

The protein has homology with the following sequences in the GENPEPT database.

```
>GP: BAA17584 GB: D90907 glutamine-binding periplasmic protein
[Synechocystis sp.]
Identities = 147/534 (27%), Positives = 256/534 (47%), Gaps = 75/534 (14%)

Query:    4 ILLSLFTALLITFGGMTSIQADEYLRVGMEAAYAPFNWTQNDNTNGAVPIEGTDQYANGY   63
            +LL++   LL  F ++     + + V  E   + PF  T              E T Q    G+
Sbjct:   24 VLLAIAIPLLPAFSQVSR----QTIIVATEPTFPPFEMTD----------EATGQLT-GF   68

Query:   64 DVQVAKKLAKKLNKKVVVVKTKWEGLVPALTSGKLDMIIAGMSPTEERKKEINFSKPYYI  123
            DV + + + +      V +      ++G++PAL S    +    I+ ++ T ER + ++FS  PY+
Sbjct:   69 DVDLIQAIGEAAQVTVDIQGYPFDGIIPALQSNTVGAAISAITITPERAQSVSFSSPYFK  128

Query:  124 SEPTLVVNAEGKYTNAKNISDFKNAKVTAQQGVYLYNLIDQINGVKKEVAMGDFNQLRQA  183
              S    L + +       KN+  D +  ++     G     +  + G K    + +F+ + +  A
Sbjct:  129 S--VLAIAVQDGNDTIKNLKDLEGKRLAVAIGTTGAMVATNVPGAK----VTNFDSITSA  182

Query:  184 VE---SGVVDAYVSERPDATSAQTANPKLKMIELHQGFKTSDADTNISVGMRKGDNRINQ  240
            ++      +G   DA  +++RP     A   +  L+ +++     + D    I++  +           INQ
Sbjct:  183 LQELVNGNADAVINDRPVLLYA-IKDAGLRNVKISADVGSEDY-YGIAMPLAP-PGEINQ  239
```

```
                              -continued
Query:  241 VNQVL-----ESISRDKQIALMDKMIKEQ---------PSV------------KKEKNGK 274
            +VL    + I       A+ +K    E+---------PS+             + + N
Sbjct:  240 TREVLNQGLFQIIENGTYNAIYEKWFGEKNPPFLPLVAPSLVGKVGTAQSLTERSQANPN 299

Query:  275 PNFFEQMATILKNNGSQFLRGTATTLLISMVGTIVGLFIGLLIGVFRTAPKSDNKLKAAL 334
            NF    + T+ +N      +G+  T+L++      GL  G  + +   A   SD
Sbjct:  300 DNF---LITLFRN----LFKGSILTVLLTAFSVFFGLIGGTGVAI---ALISD------- 342

Query:  335 QKLLGWLLNIYIEVFRGTPMIVQSMVIYYGTAQAF-----GVSLDRTLAAIFIVSINTGA 389
              K L  +   IY+E FRGTPM+VQ  +IY+G     F      G+++DR  AAI  +S+N  A
Sbjct:  343 IKPLQLIFRIYVEFFRGTPMLVQLFIIYFGLPALFKEIGLGITIDRFPAAIIALSLNVAA 402

Query:  390 YMSEIVRGGIFSVDKGQFEAATALGFTHGQTMRKIVLPQVVRNILPATGNEFVINIKDTS 449
            Y++EI+RGGI S+D+GQ+EA  +LG +   QTM++++ PQ    R  ILP  GNEF+   IKDTS
Sbjct:  403 YLAEIIRGGIQSIDQGQWEACESLGMSPWQTMKEVIFPQAFRRILPPLGNEFITLIKDTS 462

Query:  450 VLNVISVVELYFSGNTVATQTYQYFQTFTIIAIIYFILTFTVTRILRYIEKRFD       503
              +   VI    EL+   G  +   TY+ F+  +   +A++Y +LT  +  +  +++E  D
Sbjct:  463 LTAVIGFQELFREGQLIVATTYRAFEVYIAVALVYLLLTTISSFVFKWLENYMD       516
```

There is also homology to SEQ ID 1194.

A related GBS gene <SEQ ID 8923> and protein <SEQ ID 8924> were also identified. Analysis of this protein sequence reveals the following:

```
Lipop: Possible Site: -1 Crend: 2
McG: Discrim Score: 6.23
GvH: Signal Score (-7.5): 0.11
Possible site: 24
>>> Seems to have a cleavable N-term signal seq.
ALOM program count: 3 value: -8.86 threshold: 0.0
INTEGRAL Likelihood = -8.86 Transmembrane 301-317 (295-324)
INTEGRAL Likelihood = -6.05 Transmembrane 479-495 (473-496)
PERIPHERAL Likelihood =  1.32    441
modified ALOM score: 2.27

*** Reasoning Step: 3

----- Final Results -----
bacterial membrane --- Certainty = 0.4545 (Affirmative) < succ>
bacterial outside  --- Certainty = 0.0000 (Not Clear) < succ>
bacterial cytoplasm --- Certainty = 0.0000 (Not Clear) < succ>
```

The protein has homology with the following sequences in the databases:

```
34.3/57.3% over 462aa
Synechocystis PCC6803
EGAD|48193|glutamine-binding periplasmic protein/glutamine transport system
permease protein Insert characterized
GP|1652664|dbj|BAA17584.1||D90907 glutamine-binding periplasmic protein
{Synechocystis sp.} Insert characterized
PIR|S77250|S77250 hypothetical protein-Synechocystis sp. (strain PCC 6803) Insert
characterized ORF124 (454-1809 of 2148)
EGAD|48193|s111270(54-516 of 530) glutamine-binding periplasmic protein/glutamine
transport system permease protein {Synechocystis PCC6803}
GP|1652664|dbj|BAA17584.1||D90907 glutamine-binding periplasmic protein
{Synechocystis sp.}PIR|S77250|S77250 hypothetical protein-Synechocystis sp.
(strain PCC 6803)
% Match = 12.3
% Identity = 34.2  % Similarity = 57.2
Matches = 128   Mismatches = 149   Conservative Sub.s = 86

204       234       264       294       324       354       384       414
PSFVCIPF*HKNTINRFQ*DNDIEIDLVFR*NRRK*LIGGC*MKKILLSLFTALLITXGGMTSIQADEYLRVGMEAAYAP
                                          MKGMVKLGHWGKTWRYYLLLALGVLLAIAIPLLPAFSQVS
                                                    10        20        30        40
```

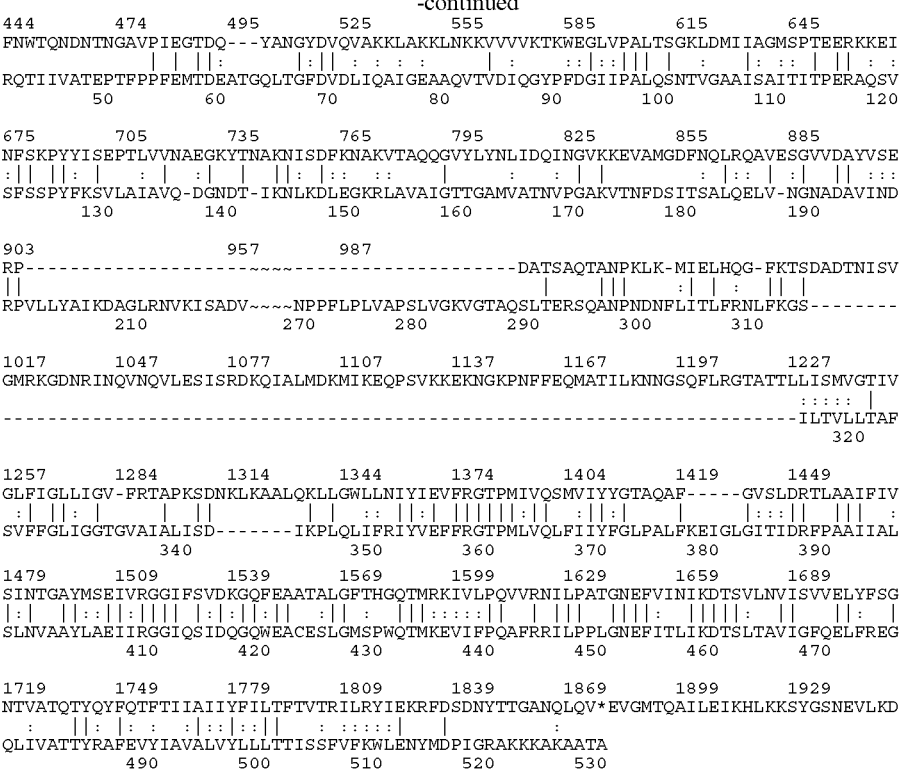

There is also homology to SEQ ID 5804.

Based on this analysis, it was predicted that these proteins and their epitopes could be useful antigens for vaccines or diagnostics.

EXAMPLE 1867

A DNA sequence (GBSx1974) was identified in *S. agalactiae* <SEQ ID 5807> which encodes the amino acid sequence <SEQ ID 5808>. This protein is predicted to be ATP-binding. Analysis of this protein sequence reveals the following:

```
Possible site: 44
>>> Seems to have no N-terminal signal sequence

----- Final Results -----
bacterial cytoplasm --- Certainty = 0.3208 (Affirmative) < succ>
bacterial membrane  --- Certainty = 0.0000 (Not Clear)   < succ>
bacterial outside   --- Certainty = 0.0000 (Not Clear)   < succ>
```

The protein has homology with the following sequences in the GENPEPT database.

```
>GP: CAB73160 GB: AL139076 putative glutamine transport ATP-binding
protein [Campylobacter jejuni]
Identities = 132/241 (54%), Positives = 178/241 (73%), Gaps = 1/241 (0%)

Query:   5 ILEIKHLKKSYGSNEVLKDISLSVNKGEVISIIGSSGSGKSTFLRSINLLEEPSGGEILY    64
           ++E+K+L+K YG  EVLK+I+ +++KG+VI+IIG SG GKSTFLR  IN LE     GEIL
Sbjct:   1 MIEVKNLQKKYGELEVLKNINTTISKGDVIAIIGPSGGGKSTFLRCINRLELADSGEILI    60

Query:  65 HGHNVLEKGYDLNNYREKLGMVFQSFNLFENLNILENAIVAQTTVLKRERQEAEKIAKEN   124
            +  N+L+K  D+N   R+K+ MVFQ FNLF N N++EN +         ++EA K AK
Sbjct:  61 NKQNILDKEIDINKIRQKVSMVFQHFNLFANKNVMENLCLTPIKTGILSQEEAIKKAKLL   120
```

-continued

```
Query: 125 LNAVGMTEQYWKAKPKQLSGGQKQRVAIARALSVNPEAILFDEPTSALDPEMVGEVLKTM  184
            L  VG+ ++       P +LSGGQKQR+AIAR+L +NP+ ILFDEPTSALDPEM+GEVL   M
Sbjct: 121 LAKVGLADKE-NIMPHKLSGGQKQRIAIARSLMMNPDVILFDEPTSALDPEMIGEVLSIM  179

Query: 185 QDLAKSGLTMIIVTHEMEFAKEVSDRVIFMDKGIIAEQGTPKQLFENPTQERTKEFLQRFL  245
            +D+AK GLTM++VTHEM FA+ V++R+ FMDKG IA    +PK++FENP+ ER +EFL + L
Sbjct: 180 KDVAKEGLTMLVVTHEMGFARNVANRIFFMDKGKIAVDASPKEVFENPSNERLREFLNKVL  240
```

A related DNA sequence was identified in *S. pyogenes* <SEQ ID 2157> which encodes the amino acid sequence <SEQ ID 2158>. Analysis of this protein sequence reveals the following:

```
Possible site: 27
>>> Seems to have no N-terminal signal sequence

----- Final Results -----
            bacterial cytoplasm --- Certainty = 0.1170 (Affirmative) < succ>
             bacterial membrane --- Certainty = 0.0000 (Not Clear)   < succ>
              bacterial outside --- Certainty = 0.0000 (Not Clear)   < succ>
```

An alignment of the GAS and GBS proteins is shown below.

```
Identities = 212/246 (86%), Positives = 237/246 (96%)

Query:   1 MTQAILEIKHLKKSYGSNEVLKDISLSVNKGEVISIIGSSGSGKSTFLRSINLLEEPSGG   60
           M+ +I+EIK+LKKSYGSNEVLKDISLSVNKGEVISIIGSSGSGKST LRSINLLEEPS G
Sbjct:  24 MSNSIIEIKNLKKSYGSNEVLKDISLSVNKGEVISIIGSSGSGKSTLLRSINLLEEPSAG   83

Query:  61 EILYHGHNVLEKGYDLNNYREKLGMVFQSFNLFENLNILENAIVAQTTVLKRERQEAEKI  120
           +IL+HG +VL + Y+L +YREKLGMVFQSFNLFENLN+LENAIVAQTTVLKR+R +AE+I
Sbjct:  84 QILFHGEDVLAEHYNLTHYREKLGMVFQSFNLFENLNVLENAIVAQTTVLKRDRAQAEQI  143

Query: 121 AKENLNAVGMTEQYWKAKPKQLSGGQKQRVAIARALSVNPEAILFDEPTSALDPEMVGEV  180
           AKENLNAVGMTEQYW+AKPKQLSGGQKQRVAIARALSVNPEA+LFDEPTSALDPEMVGEV
Sbjct: 144 AKENLNAVGMTEQYWQAKPKQLSGGQKQRVAIARALSVNPEAMLFDEPTSALDPEMVGEV  203

Query: 181 LKTMQDLAKSGLTMIIVTHEMEFAKEVSDRVIFMDKGIIAEQGTPKQLFENPTQERTKEF  240
           LKTMQDLAKSGLTMIIVTHEMEFA++VSDR+IFMDKG+I E+G+P+Q+FENPTQ+RTKEF
Sbjct: 204 LKTMQDLAKSGLTMIIVTHEMEFARDVSDRIIFMDKGLITEEGSPQQIFENPTQDRTKEF  263

Query: 241 LQRFLK                                                       246
           LQRFLK
Sbjct: 264 LQRFLK                                                       269
```

Based on this analysis, it was predicted that these proteins and their epitopes could be useful antigens for vaccines or diagnostics.

EXAMPLE 1868

A DNA sequence (GBSx1976) was identified in *S. agalactiae* <SEQ ID 5809> which encodes the amino acid sequence <SEQ ID 5810>. This protein is predicted to be hypersensitive-induced response protein. Analysis of this protein sequence reveals the following:

```
Possible site: 31
>>> Seems to have an uncleavable N-term signal seq
INTEGRAL Likelihood = -17.94 Transmembrane 4-20 (1-28)

----- Final Results -----
             bacterial membrane --- Certainty = 0.8175 (Affirmative) < succ>
              bacterial outside --- Certainty = 0.0000 (Not Clear)   < succ>
            bacterial cytoplasm --- Certainty = 0.0000 (Not Clear)   < succ>
```

A related GBS nucleic acid sequence <SEQ ID 9479> which encodes amino acid sequence <SEQ ID 9480> was also identified.

The protein has homology with the following sequences in the GENPEPT database.

```
>GP: AAF68390 GB: AF236374 hypersensitive-induced response protein
[Zea mays]
Identities = 127/275 (46%), Positives = 174/275 (63%), Gaps = 1/275 (0%)

Query:  19 ITSLYVVKQQTVAIIERFGKYQKTATSGIHIRVPLGIDKIAARVQLRLLQSEIIVETKTK   78
            I  L  V Q TVAI E FGK+ +    G H       +IA  + LR+ Q ++  ETKTK
Sbjct:   4 ILGLVQVDQSTVAIKENFGKFSEVLEPGCHFLPWCIGQQIAGYLSLRVRQLDVRCETKTK   63

Query:  79 DNVFVTLNIATQYRVNENNVTDAYYKLIKPEAQIKSYIEDALRSSVPKLTLDELFEKKDE  138
           DNVFVT+  + QYR    + +DA+YKL    QI+SY+ D +R++VPKL LD+ FE+K+E
Sbjct:  64 DNVFVTVVASVQYRALADKASDAFYKLSNTREQIQSYVFDVIRATVPKLGLDDAFEQKNE  123

Query: 139 IALEVQHQVAEEMSTYGYIIVKTLITKVEPDAEVKQSMNEINAAQRKRVAAQELANADKI  198
           IA  V+ ++ + MSTYGY IV+TLI  +EPD  VK++MNEINAA R RVAA  E A A+KI
Sbjct: 124 IAKAVEEELEKMNSTYGYQIVQTLIVDIEPDDRVKRAMNEINAAARMRVAASEKAEAEKI  183

Query: 199 KIVTAAEAEAEKDRLHGVGIAQQRKAIVDGLADSIQELKDANVTLTEEQIMSILLTNQYL  258
            +  AE EAE   L GVGIA+QR+AIVDGL DS+       T + IM ++L  QY
Sbjct: 184 LQIKKAEGEAESKYLAGVGIARQRQAIVDGLRDSVLAFSENVPGTTAKDIMDMVLVTQYF  243

Query: 259 DTLNTF-AINGNQTIFLPNNPEGVEDIRTQVLSAL                          292
           DT+     A + + ++F+P+ P  V+D+  Q+    L
Sbjct: 244 DTMREIGASSKSSSVFIPHGPGAVKDVSAQIRDGL                          278
```

A related DNA sequence was identified in *S. pyogenes* <SEQ ID 5811> which encodes the amino acid sequence <SEQ ID 5812>. Analysis of this protein sequence reveals the following:

```
Possible Site: 32
>>> Seems to have an uncleavable N-term signal seq
INTEGRAL Likelihood = -13.06 Transmembrane 5-21 (1-29)

----- Final Results -----
            bacterial membrane  --- Certainty = 0.6222 (Affirmative) < succ>
             bacterial outside  --- Certainty = 0.0000 (Not Clear)   < succ>
            bacterial cytoplasm --- Certainty = 0.0000 (Not Clear)   < succ>
```

The protein has homology with the following sequences in the databases:

```
>GP: AAF68390 GB: AF236374 hypersensitive-induced response protein
[Zea mays]
Identities = 126/273 (46%), Positives = 174/273 (63%), Gaps = 3/273 (1%)

Query:  23 LYVVRQQSVAIVERFGRYQKTATSGIHIRLPFGI-DKIAARVQLRLLQSEIIVETKTKDN   81
           L  V Q +VAI E FG++ +    G H  LP+ I  +IA  + LR+ Q ++  ETKTKDN
Sbjct:   7 LVQVDQSTVAIKENFGKFSEVLEPGCHF-LPWCIGQQIAGYLSLRVRQLDVRCETKTKDN   65

Query:  82 VFVTLNVATQYRVNEQNVTDAYYKLMKPESQIKSYIEDALRSSVPKLTLDELFEKKDEIA  141
           VFVT+  + QYR    +++DA+YKL    QI+SY+ D +R++VPKL LD+ FE+K+EIA
Sbjct:  66 VFVTVVASVQYRALADKASDAFYKLSNTREQIQSYVFDVIRATVPKLGLDDAFEQKNEIA  125

Query: 142 LEVQHQVAEEMSTYGYIIVKTLITKVEPDAEVKQSMNEINAAQRKRVAAQELANADKIKI  201
            V+ ++ + MSTYGY IV+TLI  +EPD  VK++MNEINAA R RVAA  E A A+KI
Sbjct: 126 KAVEEELEKAMSTYGYQIVQTLIVDIEPDDRVKRAMNEINAAARMRVAASEKAEAEKILQ  185

Query: 202 VTAAEAEAEKDRLHGVGIAQQRKAIVDGLAESIQELKEANISLNEEQIMSILLTNQYLDT  261
            +  AE EAE   L GVGIA+QR+AIVDGL +S+    E      + IM ++L  QY DT
Sbjct: 186 IKKAEGEAESKYLAGVGIARQRQAIVDGLRDSVLAFSENVPGTTAKDIMDMVLVTQYFDT  245

Query: 262 LNTFAAKG-NQTLFLPNTPSGVEDIRTQVLSAL                            293
            +    A + + ++F+P+ P  V+D+  Q+    L
Sbjct: 246 MREIGASSKSSSVFIPHGPGAVKDVSAQIRDGL                            278
```

An alignment of the GAS and GBS proteins is shown below.

```
Identities = 254/291 (87%), Positives = 278/291 (95%)

Query:     5 IILTVILVLVIVLLITSLYVVKQQTVAIIERFGKYQKTATSGIHIRVPLGIDKIAARVQL    64
             I +    +++++ ++ ++LYVV+QQ+VAI+ERFG+YQKTATSGIHIR+P GIDKIAARVQL
Sbjct:     6 IFIAFGVIVILAIVASTLYVVRQQSVAIVERFGRYQKTATSGIHIRLPFGIDKIAARVQL    65

Query:    65 RLLQSEIIVETKTKDNVFVTLNIATQYRVNENNVTDAYYKLIKPEAQIKSYIEDALRSSV   124
             RLLQSEIIVETKTKDNVFVTLN+ATQYRVNE NVTDAYYKL+KPE+QIKSYIEDALRSSV
Sbjct:    66 RLLQSEIIVETKTKDNVFVTLNVATQYRVNEQNVTDAYYKLMKPESQIKSYIEDALRSSV   125

Query:   125 PKLTLDELFEKKDEIALEVQHQVAEEMSTYGYIIVKTLITKVEPDAEVKQSMNEINAAQR   184
             PKLTLDELFEKKDEIALEVQHQVAEEMSTYGYIIVKTLITKVEPDAEVKQSMNEINAAQR
Sbjct:   126 PKLTLDELFEKKDEIALEVQHQVAEEMSTYGYIIVKTLITKVEPDAEVKQSMNEINAAQR   185

Query:   185 KRVAAQELANADKIKIVTAAEAEAEKDRLHGVGIAQQRKAIVDGLADSIQELKDANVTLT   244
             KRVAAQELANADKIKIVTAAEAEAEKDRLHGVGIAQQRKAIVDGLA+SIQELK+AN++L
Sbjct:   186 KRVAAQELANADKIKIVTAAEAEAEKDRLHGVGIAQQRKAIVDGLAESIQELKEANISLN   245

Query:   245 EEQIMSILLTNQYLDTLNTFAINGNQTIFLPNNPEGVEDIRTQVLSALKTR           295
             EEQIMSILLTNQYLDTLNTFA  GNQT+FLPN P GVEDIRTQVLSALKT+
Sbjct:   246 EEQIMSILLTNQYLDTLNTFAAKGNQTLFLPNTPSGVEDIRTQVLSALKTK           296
```

SEQ ID 5810 (GBS231) was expressed in *E. coli* as a GST-fusion product. SDS-PAGE analysis of total cell extract is shown in FIG. 55 (lane 7; MW 60.9 kDa).

GBS231d was expressed in *E. coli* as a GST-fusion product. SDS-PAGE analysis of total cell extract is shown in FIG. 155 (lane 5-7; MW 59 kDa) and in FIG. 239 (lane 11; MW 59 kDa). It was also expressed in *E. coli* as a His-fusion product. SDS-PAGE analysis of total cell extract is shown in FIG. 155 (lane 9; MW 34 kDa) and in FIG. 183 (lane 6; MW 34 kDa). Purified GBS231d-GST is shown in FIG. 246, lane 8.

Based on this analysis, it was predicted that these proteins and their epitopes could be useful antigens for vaccines or diagnostics.

EXAMPLE 1869

A DNA sequence (GBSx1977) was identified in *S. agalactiae* <SEQ ID 5813> which encodes the amino acid sequence <SEQ ID 5814>. Analysis of this protein sequence reveals the following:

```
Possible site: 34
>>> Seems to have no N-terminal signal sequence

----- Final Results -----
            bacterial cytoplasm --- Certainty = 0.2305 (Affirmative) < succ>
            bacterial membrane  --- Certainty = 0.0000 (Not Clear)   < succ>
              bacterial outside --- Certainty = 0.0000 (Not Clear)   < succ>
```

A related GBS nucleic acid sequence <SEQ ID 9291> which encodes amino acid sequence <SEQ ID 9292> was also identified.

The protein has homology with the following sequences in the GENPEPT database.

```
>GP: CAB13457 GB: Z99112 similar to hypothetical proteins
[Bacillus subtilis]
Identities = 259/514 (50%), Positives = 350/514 (67%), Gaps = 9/514 (1%)

Query:     1 MGMTMENGAKEVSDKPATTVGEVGQILSKGVLMGARGNSGVITSQLFRGFGQSIKDKEEL    60
             M ++M +GA+EV        +G+VG  LSKG+LMGARGNSGVI SQLFRGF ++I+ K+E+
Sbjct:    46 MNLSMTSGAREVEQMDTDDIGKVGSALSKGLLMGARGNSGVILSQLFRGFSKNIETKKEI   105

Query:    61 TGQDLAHAFQNGVEVAYKAVMKPVEGTILTVSRGAATAALKKAEETDDAVEVMRATLKGA   120
              + A A Q GV++AYKAVMKPVEGTILTV++ AA  A+  AE+  D    +M A  + A
Sbjct:   106 NALEFAAALQAGVDMAYKAVMKPVEGTILTVAKDAAKKAMILAEKETDITALMTAVTEEA   165
```

-continued

```
Query: 121 KRALAKTPDMLPVLKEVGVVDSGGQGLVFIYEGFLSALTGEYIASEDFKATPATMTEMVN 180
            + +L +TP++LPVLKEVGVVDSGG+GL+ +YEGFL++L GE +    KA   ++ +MV+
Sbjct: 166 EASLNRTPELLPVLKEVGVVDSGGKGLLCVYEGFLASLKGETVPQ---KAVLPSLDDMVS 222

Query: 181 AEHHKAVVGHVATEDIKYGYCTEVMVGLKQGPTYVKEFNYEEFQGYLSNLGDSLLVVNDD 240
            AEHHK+    + TEDI++G+CTEVMV L Q      +EF+   F+  LS  GDSLLV+ D+
Sbjct: 223 AEHHKSAQSMMNTEDIEFGFCTEVMVRLDQTK---REFDEGTFRQDLSQFGDSLLVIADE 279

Query: 241 EIVKVHVHTEDPGLVMQEGLKYGSLVKVKVENMRNQHDA---QMQKVEVEETVKETKEYG 297
             + KVH+H E+PG V+       YG L+K+K+ENMR QH +    Q  K    ET    + YG
Sbjct: 280 SLAKVHIHAEEPGNVLNYAQHYGELIKIKIENMREQHTSIISQESKPADNETPPAKQPYG 339

Query: 298 IIAVVAGDGLAEIFKSQGVDYIISGGQTMNPSTEDIVKAIEKVNARNVIILPNNKNIFMA 357
            I+ V  G+G+A++FKS G   +I GGQTMNPSTEDIV A++ VNA  V ILPNN NI MA
Sbjct: 340 IVTVAMGEGIADLFKSIGASVVIEGGQTMNPSTEDIVDAVKSVNADTVFILPNNSNIIMA 399

Query: 358 AQSAADVVDIPAAVVETRTVPQGFTSLLAFDPAKSLETNVADMTNSLSDVISGSVTLAVR 417
            A   AA VVD    V+   +TVPQG ++LLAF+P +   E N A+M +++  V SG VT +VR
Sbjct: 400 ANQAASVVDEQVFVIPAKTVPQGMSALLAFNPDQEAEANEANMLSAIQQVKSGQVTFSVR 459

Query: 418 DTTIDGLEIHENDILGMVDGKILVSTPDMEKALKDTFDKMIDEDSEIVTIYVGEDGKQAL 477
            DT IDG +I + D +G+++G I+ ++ +   A K    +MI ED EIVTI   GED  Q
Sbjct: 460 DTHIDGKDIKKGDFMGILNGTIIGTSENQLSAAKMLLSEMIGEDDEIVTILYGEDASQEE 519

Query: 478 AETLSEYLEETYEDVEVEIHQGDQPVYPYLMSVE                            511
            AE L  +L E YE++EVEIH G QP+Y Y++S E
Sbjct: 520 AEQLEAFLSEKYEEIEVEIHNGKQPLYSYIVSAE                            553
```

A related DNA sequence was identified in *S. pyogenes* <SEQ ID 5635> which encodes the amino acid sequence <SEQ ID 5636>. Analysis of this protein sequence reveals the following:

```
Possible site: 15
>>> Seems to have no N-terminal signal sequence

----- Final Results -----
            bacterial cytoplasm --- Certainty = 0.1816 (Affirmative) < succ>
            bacterial membrane  --- Certainty = 0.0000 (Not Clear)   < succ>
             bacterial outside  --- Certainty = 0.0000 (Not Clear)   < succ>
```

An alignment of the GAS and GBS proteins is shown below.

```
Identities = 434/511 (84%), Positives = 475/511 (92%)
Query:   1 MGMTMENGAKEVSDKPATTVGEVGQILSKGVLMGARGNSGVITSQLFRGFGQSIKDKEEL  60
           M MTM+NGAKEV+DKPA+TVGEVGQ+LSKG+LMGARGNSGVITSQLFRGFGQSIK K+EL
Sbjct:  44 MSMTMDNGAKEVADKPASTVGEVGQMLSKGLLMGARGNSGVITSQLFRGFGQSIKGKDEL 103

Query:  61 TGQDLAHAFQNGVEVAYKAVMKPVEGTILTVSRGAATAALKKAEETDDAVEVMRATLKGA 120
           TG+DLA AFQ GVEVAYKAVMKPVEGTILTVSRGAATAALKKA+ TDDAVEVM+A L GA
Sbjct: 104 TGKDLAQAFQVGVEVAYKAVMKPVEGTILTVSRGAATAALKKADLTDDAVEVMQAALDGA 163

Query: 121 KRALAKTPDMLPVLKEVGVVDSGGQGLVFIYEGFLSALTGEYIASEDFKATPATMTEMVN 180
           K ALAKTPD+LPVLKEVGVVDSGGQGLVFIYEGFLSAL G+Y+ S DFKATPA M+EM+N
Sbjct: 164 KGALAKTPDLLPVLKEVGVVDSGGQGLVFIYEGFLSALNGDYVTSADFKATPANMSEMIN 223

Query: 181 AEHHKAVVGHVATEDIKYGYCTEVMVGLKQGPTYVKEFNYEEFQGYLSNLGDSLLVVNDD 240
           AEHHK+VVGHVATEDI YGYCTE+MV LKQGPTYVKEFNY+EFQGYLS GDSLLVVNDD
Sbjct: 224 AEHHKSVVGHVATEDITYGYCTEIMVALKQGPTYVKEFNYDEFQGYLSGLGDSLLVVNDD 283

Query: 241 EIVKVHVHTEDPGLVMQEGLKYGSLVKVKVENMRNQHDAQMQKVEVEETVKETKEYGIIA 300
           EIVKVHVHTEDPGLVMQEGLKYGSL+K+KV+NMRNQH+AQ+QK +VE+    E K++G+IA
Sbjct: 284 EIVKVHVHTEDPGLVMQEGLKYGSLIKIKVDNMRNQHEAQVQKTDVEKNKAEVKDFGLIA 343

Query: 301 VVAGDGLAEIFKSQGVDYIISGGQTMNPSTEDIVKAIEKVNARNVIILPNNKNIFMAAQS 360
           VVAG+GL+EIFK QGVDY+ISGGQTMNPSTEDIVKAIE VNA+ VIILPNNKNIFMAAQS
Sbjct: 344 VVAGEGLSEIFKAQGVDYVISGGQTMNPSTEDIVKAIEAVNAKQVIILPNNKNIFMAAQA 403

Query: 361 AADVVDIPAAVVETRTVPQGFTSLLAFDPAKSLETNVADMTNSLSDVISGSVTLAVRDTT 420
           AA+VVDIPAAVV TRTVPQGFTSLLAFDP+KSLE NVADM+ SLSDV+SGSVTLAVRDTT
Sbjct: 404 AAEVVDIPAAVVATRTVPQGFTSLLAFDPSKSLEDNVADMSTSLDVVSGSVTLAVRDTT 463

Query: 421 IDGLEIHENDILGMVDGKILVSTPDMEKALKDTFDKMIDEDSEIVTIYVGEDGKQALAET 480
           IDGLEIHEND LGMVDGKI+VS PDME  LK  F+KMIDEDSEIVTI+VGE+G Q LAE
Sbjct: 464 IDGLEIHENDFLGMVDGKIIVSNPDMEATLKAAFEKMIDEDSEIVTIFVGEEGDQDLAEE 523
```

```
                              -continued
Query:  481 LSEYLEETYEDVEVEIHQGDQPVYPLMSVE                            511
            L+ YL ETYEDVEVEIHQGDQPVYPLMSVE
Sbjct:  524 LAGYLGETYEDVEVEIHQGDQPVYPLMSVE                            554
```

Based on this analysis, it was predicted that these proteins and their epitopes could be useful antigens for vaccines or diagnostics.

EXAMPLE 1870

A DNA sequence (GBSx1978) was identified in *S. agalactiae* <SEQ ID 5815> which encodes the amino acid sequence <SEQ ID 5816>. Analysis of this protein sequence reveals the following:

```
Possible site: 46
>>> Seems to have no N-terminal signal sequence

----- Final Results -----
             bacterial cytoplasm --- Certainty = 0.4771(Affirmative) < succ>
             bacterial membrane  --- Certainty = 0.0000(Not Clear)   < succ>
             bacterial outside   --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1871

A DNA sequence (GBSx1979) was identified in *S. agalactiae* <SEQ ID 5817> which encodes the amino acid sequence <SEQ ID 5818>. This protein is predicted to be proliferating-cell nucleolar antigen P120. Analysis of this protein sequence reveals the following:

```
Possible site: 55
>>> Seems to have no N-terminal signal sequence

----- Final Results -----
             bacterial cytoplasm --- Certainty = 0.3774(Affirmative) < succ>
             bacterial membrane  --- Certainty = 0.0000(Not Clear)   < succ>
             bacterial outside   --- Certainty = 0.0000(Not Clear)   < succ>
```

A related GBS nucleic acid sequence <SEQ ID 9345> which encodes amino acid sequence <SEQ ID 9346> was also identified.

The protein has homology with the following sequences in the GENPEPT database.

```
>GP: AAC74905 GB: AE000278 putative nucleolar proteins
[Escherichia coli K12]
 Identities = 87/229 (37%), Positives = 128/229 (54%), Gaps = 8/229 (3%)

Query:   63 GKSIEHTTGLVYSQEPAAQ--IVAQIAEPQEGMKVLDLAAAPGGKTTHLLSYLNNTGLLV 120
            G + EH +GL Y QE ++    + A  A+     +V+D+AAAPG KTT + + +NN G ++
Sbjct:   89 GSTAEHLSGLFYIQEASSMLPVAALFADGNAPQRVMDVAAAPGSKTTQISARMNNEGAIL 148

Query:  121 SNEISNKRSKILVENVERFGARNVIVTNESSQRLAKCFNSFFDLIVFDGPCSGEGMFRKD 180
            +NE S   R K+L  N+ R G  NV +T+             FD I+ D PCSGEG+ RKD
Sbjct:  149 ANEFSASRVKVLHANISRCGISNVALTHFDGRVFGAAVPEMFDAILLDAPCSGEGVVRKD 208

Query:  181 PQAIQYWHKDYPTECAQLQRDILKEAIKMLAHGGILVYSTCTWSPEENEEVVNWLLQEY-  239
            P A++ W +   E A  QR+++  A   L  GG LVYSTCT + EENE V  WL + Y
Sbjct:  209 PDALKNWSPESNQEIAATQRELIDSAFHALRPGGTLVYSTCTLNQEENEAVCLWLKETYP 268
```

```
-continued
Query: 240 ---DYLELVDIPKLNGMVEGINVPQVARMYPHHFQGEGQFVAKLRDTRS      285
            ++L L D+    G + +        ++P  +  EG FVA+LR T++
Sbjct: 269 DAVEFLPLGDL--FPGANKALTEEGFLHVFPQIYDCEGFFVARLRKTQA      315
```

A related DNA sequence was identified in *S. pyogenes* <SEQ ID 5819> which encodes the amino acid sequence <SEQ ID 5820>. Analysis of this protein sequence reveals the following:

```
Possible site: 34
>>> Seems to have no N-terminal signal sequence

----- Final Results -----
              bacterial cytoplasm --- Certainty = 0.2316(Affirmative) < succ>
              bacterial membrane  --- Certaimty = 0.0000(Not Clear)   < succ>
              bacterial outside   --- Certaimty = 0.0000(Not Clear)   < succ>
```

An alignment of the GAS and GBS proteins is shown below.

```
 Identities = 213/311 (68%), Positives = 254/311 (81%), Gaps = 3/311 (0%)

Query:   1 MKLPNEFIEKYQTILKDEAEAFFDSFEQKPISAYRTNPLKEKQLDFPNAIPSTPWGHYGK    60
           M LP EFI  YQ IL  E E F  SF Q+P++A+R NPLK +   F + IP+T WG+YGK
Sbjct:   2 MSLPKEFINTYQAILGKELEDFLASFNQEPVNAFRINPLKNQLKTFEHPIPNTLWGYYGK    61

Query:  61 ISGKSIEHTTGLVYSQEPAAQIVAQIAEPQEGMKVLDLAAAPGGKTTHLLSYLNNTGLLV   120
           +SGKS  EH  GLVYSQEPAAQ +VAQ+A  PQ+G  +VLDLAAAPGGK+THLL+YL+NTGLLV
Sbjct:  62 LSGKSPEHVSGLVYSQEPAAQMVAQVAAPQKGSRVLDLAAAPGGKSTHLLAYLDNTGLLV   121

Query: 121 SNEISNKRSVILVENVERFGARNVIVTNESSQRLAKCFNSFFDLIVFDGPCSGEGMFRKD   180
           SNEIS KRSK+LVEN+ERFGARNV+VTNES+ RLAK F+ +FD IVFDGPCSGEGMFRKD
Sbjct: 122 SNEISKKRSKVLVENIERFGARNVVVTNESADRLAKVFSHYFDTIVFDGPCSGEGMFRKD   181

Query: 181 PQAIQYWHKDYPTECAQLQRDILKEAIKMLAHGGILVYSTCTWSPEENEEVVNWLLQEYD   240
           P AIQYWH  YP ECA+LQ+ IL++A+ ML  GG L+YSTCTW+PEENE+VV WLL+ Y
Sbjct: 182 PDAIQYWHHGYPAECAKLQKSILEDALAMLKPGGELIYSTCTWAPEENEDVVQWLLETYT   241

Query: 241 YLELVDIPKLNGMVEGINVPQVARMYPHHFQGEGQFVAKLRDTRSKEAQKIKPKAQKIN-   299
           +LELVD+PKLNGMV GI +P+ ARMYPH +QGEGQFVAKL+D R +E Q  K KA K N
Sbjct: 242 FLELVDVPKLNGMVSGIGLPETARMYPHRYQGEGQFVAKLKDKR-QEGQSTKLKAPKSNL   300

Query: 300 -KMQLQLWQQF                                                   309
            K QL+LW+ F
Sbjct: 301 IKDQLRLWKMF                                                   311
```

Based on this analysis, it was predicted that these proteins and their epitopes could be useful antigens for vaccines or diagnostics.

EXAMPLE 1872

A DNA sequence (GBSx1980) was identified in *S. agalactiae* <SEQ ID 5821> which encodes the amino acid sequence <SEQ ID 5822>. Analysis of this protein sequence reveals the following:

```
Possible site: 41
>>> Seems to have no N-terminal signal sequence

----- Final Results -----
              bacterial cytoplasm --- Certainty = 0.4111(Affirmative) < succ>
              bacterial membrane  --- Certainty = 0.0000(Not Clear)   < succ>
              bacterial outside   --- Certainty = 0.0000(Not Clear)   < succ>
```

The protein has homology with the following sequences in the GENPEPT database.

```
>GP: AAC24940 GB: AF012285 unknown [Bacillus subtilis]
 Identities = 86/240 (35%), Positives = 133/240 (54%), Gaps = 10/240 (4%)

Query:   6 DFAKQLVYKAGQFIKSEMQNTFDVEEKSRFDDLVTSLDKKTQKLLIQEIIQHYPDDNILA  65
           + AK+ + +AG  I   M  +  +E KS  +DLVT++DK+T+K  I  I + +P    IL
Sbjct:   9 EIAKKWIREAGARITQSMHESLTIETKSNPNDLVTNIDKETEKFFIDRIQETFPGHRILG  68

Query:  66 EE---DBVRSPIAQGNVWVLDPIDGTVNFIVQKDNFAVMLAYYEEGVGQFGIIYDVMADI 122
           EE   D + S   +G VW++DPIDGT+NF+ Q+ NFA+ +   +E G G+ G+IYDV+ D
Sbjct:  69 EEGQGDKIHS--LEGVVWIIDPIDGTMNFVHQQRNFAISIGIFENGEGKIGLIYDVVHDE 126

Query: 123 LYSGGGHFDVYANDKKIVPFQECPLERCLLGVNSAMYAEN----DCGIAHLASETLGVRI 178
           LY        Y N+ K+ P +E  +E  +L +N+     EN        +A L    G R
Sbjct: 127 LYHAFSGRGAYMNETKLAPLKETVIEEAILAINATWVTENRRIDQSVLAPLVKRVRGTRS 186

Query: 179 YGGAGISMAKVMQGKLLAYFSY-IQPWDYAAAKIMGETLGFTLLTLDGEEPNYSTRQKVM 237
           YG A + +A V  G++ AY +  + PWDYAA  ++    +G T  T++GE   +  V+
Sbjct: 187 YGSAALELANVAAGRIDAYITMRLAPWDYAAGCVLLNEVGGTYTTIEGEPFTFLENHSVL 246
```

A related GBS nucleic acid sequence <SEQ ID 10937> which encodes amino acid sequence <SEQ ID 10938> was also identified.

A related DNA sequence was identified in *S. pyogenes* <SEQ ID 5823> which encodes the amino acid sequence <SEQ ID 5824>. Analysis of this protein sequence reveals the following:

```
Possible site: 15
>>> Seems to have no N-terminal signal sequence

----- Final Results -----
            bacterial cytoplasm --- Certainty = 0.1843(Affirmative) < succ>
             bacterial membrane --- Certainty = 0.0000(Not Clear)  < succ>
              bacterial outside --- Certainty = 0.0000(Not Clear)  < succ>
```

An alignment of the GAS and GBS proteins is shown below.

```
Identities = 155/253 (61%), Positives = 205/253 (80%)

Query:   1 MDAKFDFAKQLVYKAGQFIKSEMQNTFDVEEKSRFDDLVTSLDKKTQKLLIQEIIQHYPD  60
           ++ K+ FA+Q++ +AG FIKS M    D++ K++FDDLVT++D++TQ+LL+  I Q YP
Sbjct:   8 LETKYAFARQIIKEAGLFIKSKMSEQLDIQVKTQFDDLVTNVDQETQQLLMDRIHQTYPC  67

Query:  61 DNILAEEDBVRSPIAQGNVWVLDPIDGTVNFIVQKDNFAVMLAYYEEGVGQFGIIYDVMA 120
           D ILAEE++VR PI QGNVWV+DPIDGTVNFIVQ   FAVM+AYYE+G+GQFG+IYDVMA
Sbjct:  68 DAILAEENDVRHPINQGNVWVIDPIDGTVNFIVQGSQFAVMIAYYEQGIGQFGLIYDVMA 127

Query: 121 DILYSGGGHFDVYANDKKIVPFQECPLERCLLGVNSAMYAENDCGIAHLASETLGVRIYG 180
           D L +GGG F+V  N  K+  +QE PLER L+G N+ M+A ND  +AHL ++TLGVR+YG
Sbjct: 128 DQLLAGGGDFEVTLNGDKLPAYQEKPLERSLIGCNAGMFARNDRNLAHLIAKTLGVRVYG 187

Query: 181 GAGISMAKVMQGKLLAYFSYIQPWDYAAAKIMGETLGFTLLTLDGEEPNYSTRQKVMFLP 240
           GAGI M KVM+ +LLAYFS+IQPWDYAAAK++G+ LG+ LLT+DG EP++ TRQK+MF+P
Sbjct: 188 GAGICMVKVMKQELLAYFSFIQPWDYAAAKVLGDKLGYVLLTIDGYEPDFQTRQKIMFVP 247

Query: 241 KSKLNLIQSYLTK                                                253
           K +L   I S+LTK
Sbjct: 248 KCQLTRIASFLTK                                                260
```

Based on this analysis, it was predicted that these proteins and their epitopes could be useful antigens for vaccines or diagnostics.

EXAMPLE 1873

A DNA sequence (GBSx1981) was identified in *S. agalactiae* <SEQ ID 5825> which encodes the amino acid sequence <SEQ ID 5826>. Analysis of this protein sequence reveals the following:

```
Possible site: 16
>>> Seems to have no N-terminal signal sequence

----- Final Results -----
            bacterial cytoplasm --- Certainty = 0.4131(Affirmative) < succ>
            bacterial membrane  --- Certainty = 0.0000(Not Clear)   < succ>
            bacterial outside   --- Certainty = 0.0000(Not Clear)   < succ>
```

The protein has homology with the following sequences in the GENPEPT database.

```
>GP: AAC24938 GB: AF012285 unknown [Bacillus subtilis]
Identities = 33/78 (42%), Positives = 50/78 (63%)

Query: 13 YSYPLDPSWNTEDITKVLRFLNQVEHAYENSIKVDDLLDSYKEFKKVVKSKAQEKQIDRE  72
          Y YP++  W TE+    V+ F  QVE AYE      ++LL +Y+ FK++V  KA+EK++  E
Sbjct:  3 YQYPMNEDWTTEEAVDVIAFFQQVELAYEKGADREELLKAYRRFKEIVPGKAEEKKLCGE  62

Query: 73 FQRTSGYSTYQAVKAAQQ                                             90
          F+   S YS Y+ VK A++
Sbjct: 63 FEEQSTYSPYRTVKQARE                                             80
```

A related DNA sequence was identified in *S. pyogenes* <SEQ ID 5827> which encodes the amino acid sequence <SEQ ID 5828>. Analysis of this protein sequence reveals the following:

```
Possible site: 60
>>> Seems to have no N-terminal signal sequence

----- Final Results -----
            bacterial cytoplasm --- Certainty = 0.4442(Affirmative) < succ>
            bacterial membrane  --- Certainty = 0.0000(Not Clear)   < succ>
            bacterial outside   --- Certainty = 0.0000(Not Clear)   < succ>
```

An alignment of the GAS and GBS proteins is shown below.

```
Identities = 59/91 (64%), Positives = 70/91 (76%)

Query:  9 ISSNYSYPLDPSWNTEDITKVLRFLNQVEHAYENSIKVDDLLDSYKEFKKVVKSKAQEKQ  68
          +S NY YPLD SW+TE+I+ VL FLN+VE AYE  +    LLDSYK +K +VKSKAQEKQ
Sbjct:  5 MSGNYYYPLDLSWSTEEISSVLHFLNKVELAYEKKVDAKQLLDSYKTYKTIVKSKAQEKQ  64

Query: 69 IDREFQRTSGYSTYQAVKAAQQQAKGFISLG                                99
          IDR+FQ+ SGYSTYQ VK A+   KGF SLG
Sbjct: 65 IDRDFQKVSGYSTYQVVKKAKAIEKGFFSLG                                95
```

Based on this analysis, it was predicted that these proteins and their epitopes could be useful antigens for vaccines or diagnostics.

EXAMPLE 1874

A DNA sequence (GBSx1982) was identified in *S. agalactiae* <SEQ ID 5829> which encodes the amino acid sequence <SEQ ID 5830>. Analysis of this protein sequence reveals the following:

```
Possible site: 18
>>> Seems to have no N-terminal signal sequence (or aa 1-18)
```

```
----- Final Results -----
          bacterial cytoplasm --- Certainty = 0.0952(Affirmative) < succ>
          bacterial membrane  --- Certainty = 0.0000(Not Clear)   < succ>
          bacterial outside   --- Certainty = 0.0000(Not Clear)   < succ>
```

The protein has homology with the following sequences in the GENPEPT database.

```
>GP: AAF21893 GB: AF103794 unknown [Listeria monocytogenes]
Identities = 74/126 (58%), Positives = 101/126 (79%)

Query:    1 MITLFLSPSCTSCRKARAWLSKHEVAFEEHNIITSPLNKEELLQILSFTENGTEDIISTR   60
            M+TL+ SPSCTSCRK+RAWL +H++ ++E NI + PL+ +E+ +IL  TE+GT++IISTR
Sbjct:    1 MVTLYTSPSCTSCRKSRAWLEEHDIPYKERNIFSEPLSLDEIKEILRMTEDGTDEIISTR   60

Query:   61 SKVFQKLAIDVDELSTSSLMELISENPSLLRRPIILDKKRMQIGFNEDEIRAFLPRDYRK  120
            SK FQKL +D+D L    L ELI +NP LLRRPII+D+KR+Q+G+NEDEIR  FLPR  R
Sbjct:   61 SKTFQKLNVDLDSLPLQQLFELIQKNPGLLRRPIIIDEKRLQVGYNEDEIRRFLPRRVRT  120

Query:  121 QELKQA                                                       126
            +L++A
Sbjct:  121 YQLREA                                                       126
```

A related DNA sequence was identified in *S. pyogenes* <SEQ ID 5831> which encodes the amino acid sequence <SEQ ID 5832>. Analysis of this protein sequence reveals the following:

```
Possible site: 49
>>> Seems to have no N-terminal signal sequence

----- Final Results -----
          bacterial cytoplasm --- Certainty = 0.0511(Affirmative) < succ>
          bacterial membrane  --- Certainty = 0.0000(Not Clear)   < succ>
          bacterial outside   --- Certainty = 0.0000(Not Clear)   < succ>
```

An alignment of the GAS and GBS proteins is shown below.

```
Identities = 112/134 (83%), Positives = 127/134 (94%)

Query:    1 MITLFLSPSCTSCRKARAWLSKHEVAFEEHNIITSPLNKEELLQILSFTENGTEDIISTR   60
            M+TLFLSPSCTSCRKARAWL KHEV F+EHNIITSPL+++EL+ ILSFTENGTEDIISTR
Sbjct:    1 MVTLFLSPSCTSCRKARAWLVKHEVDFQEHNIITSPLSRDELMSILSFTENGTEDIISTR   60

Query:   61 SKVFQKLAIDVDELSTSSLMELISENPSLLRRPIILDKKRMQIGFNEDEIRAFLPRDYRK  120
            SKVFQKL IDV+ELS S L++LI++NPSLLRRPII+D+KRMQIGFNEDEIRAFL RDYRK
Sbjct:   61 SKVFQKLDIDVEELSISDLIDLIAKNPSLLRRPIIMDQKRMQIGFNEDEIRAFLSRDYRK  120

Query:  121 QELKQATIRAEIEG                                               134
            QEL+QATI+AEIEG
Sbjct:  121 QELRQATIKAEIEG                                               134
```

SEQ ID 5830 (GBS232) was expressed in *E. coli* as a His-fusion product. SDS-PAGE analysis of total cell extract is shown in FIG. 51 (lane 10; MW 16.8 kDa). It was also expressed in *E. coli* as a GST-fusion product. SDS-PAGE analysis of total cell extract is shown in FIG. 56 (lane 2; MW 42 kDa).

GBS232-GST was purified as shown in FIG. 207, lane 7.

Based on this analysis, it was predicted that these proteins and their epitopes could be useful antigens for vaccines or diagnostics.

EXAMPLE 1875

A DNA sequence (GBSx1983) was identified in *S. agalactiae* <SEQ ID 5833> which encodes the amino acid sequence <SEQ ID 5834>. Analysis of this protein sequence reveals the following:

```
Possible site: 39
>>> Seems to have an uncleavable N-term signal seq

----- Final Results -----
          bacterial membrane  --- Certainty = 0.0000(Not Clear) < succ>
          bacterial outside   --- Certainty = 0.0000(Not Clear) < succ>
          bacterial cytoplasm --- Certainty = 0.0000(Not Clear) < succ>
```

A related DNA sequence was identified in *S. pyogenes* <SEQ ID 5835> which encodes the amino acid sequence <SEQ ID 5836>. Analysis of this protein sequence reveals the following:

```
Possible site: 39
>>> Seems to have no N-terminal signal sequence

----- Final Results -----
            bacterial cytoplasm --- Certainty = 0.1768(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below.

```
Identities = 210/308 (68%), Positives = 252/308 (81%)

Query:   1 MKIHYINDYKDIQAKEDCVLVLGYFDGLHLGHKALFDKAKKIATEKNLKIVVLTFNETPR  60
           M+I YI DY+DI  ++D VL+LGYFDGLH GHKALFDKA+++A ++ LK+VV TF E+P+
Sbjct:   1 MEIEYIKDYRDINQEDDTVLILGYFDGLHRGHKALFDKAREVANKEGLKVVVFTFTESPK  60

Query:  61 LTFARFQPELLLHLTSPEKRSEKFQEYGVDELYLMNFTSHFSKVSSDLFIKKYIYGLRAK 120
           L F+RF PELLLH+T P+KR EKF +YGV++LYL++FTS FSKVSSD FI   YI  L+AK
Sbjct:  61 LAFSRFSPELLLHITYPKKRYEKFADYGVNKLYLVDFTSKFSKVSSDHFITHYIKNLKAK 120

Query: 121 AAVVGFDYKFGHNRTSGDYLARNFKGPVYIIDEISEGGEKISSTRIRQLITEGNVEKANQ 180
             VVGFDYKFGHNRT  DYL RNF+G VY I+EI E   KIS+T IR+LI EGNV KAN
Sbjct: 121 HIVVGFDYKFGHNRTDSDYLTRNFEGQVYTIEEIKEDHRKISATWIRKLIQEGNVVKANH 180

Query: 181 LLGYEFSTCGMVVHGDARGRTIGFPTANLAPINRTYLPADGVYISNVLINGKYYRAMTSI 240
           LLGY+ ST G VVHGDARGRTIGFPTANLAPI+ TYLPADGVY++NV++  K YR+MTS+
Sbjct: 181 LLGYDLSTRGRVVHGDARGRTIGFPTANLAPIDNTYLPADGVYVTNVIVANKIYRSMTSL 240

Query: 241 GKNITFGGTELRLEANIFDFDGDIYGETIEIFWLKRIREMVKFNGIDDLVKQLKKDKEIA 300
           GKN+TFGG ELRLE NIFDFD +IYGE IEI WL +IR+M KF GI+DL  +L+ DK  A
Sbjct: 241 GKNVTFGGKELRLEVNIFDFDEEIYGEIIEIVWLDKIRDMEKFEGIEDLTDRLEYDKRTA 300

Query: 301 LNWKKDSQ                                                    308
           LNWKKDS+
Sbjct: 301 LNWKKDSK                                                    308
```

Based on this analysis, it was predicted that these proteins and their epitopes could be useful antigens for vaccines or diagnostics.

EXAMPLE 1876

A DNA sequence (GBSx1984) was identified in *S. agalactiae* <SEQ ID 5837> which encodes the amino acid sequence <SEQ ID 5838>. This protein is predicted to be tRNA pseudouridine 5S synthase (truB). Analysis of this protein sequence reveals the following:

```
Possible site: 56
>>> Seems to have no N-terminal signal sequence

----- Final Results -----
            bacterial cytoplasm --- Certainty = 0.2576(Affirmative) < succ>
             bacterial membrane --- Certainty = 0.0000(Not Clear)   < succ>
              bacterial outside --- Certainty = 0.0000(Not Clear)   < succ>
```

A related GBS nucleic acid sequence <SEQ ID 9817> which encodes amino acid sequence <SEQ ID 9818> was also identified.

The protein has homology with the following sequences in the GENPEPT database.

```
>GP: BAB06129 GB: AP001515 tRNA pseudouridine 5S synthase
        [Bacillus halodurans]
 Identities = 145/283 (51%), Positives 191/283 (67%), Gaps = 12/283 (4%)
```

```
                           -continued
Query:    2 ITGIINLKKEAGMTSHDAVFKLRKILHTKKIGHGGTLDPDVVGVLPIAVGKATRVIEYMT   61
            +TGI+ L K  GMTSHD V KLR++L TKK+GH GTLDPDV GVLP+ +G AT+V +YM+
Sbjct:    3 MTGILPLAKPRGMTSHDCVAKLRRLLKTKKVGHTGTLDPDVYGVLPVCIGHATKVAQYMS   62

Query:   62 ESGKIYEGEITLGYATSTEDSSGEVISRTPLTQSDLSEDVVDHAMKSFTGPITQVPPMYS  121
            +   K YEGE+T+G++T+TED SG+ +   T   Q     E VVD   + F  G I Q+PPMYS
Sbjct:   63 DYPKAYEGEVTVGFSTTTEDRSGDTVE-TKTIQQPFVEAVVDQVLATFVGEIKQIPPMYS  121

Query:  122 AVKVNGKKLYEYARSGEEVERPKRQITISEFRRTSPLYFEKGICRFSFYVSCSKGTYVRT  181
               AVKV GK+LYEYAR+G  VERP+R +TI    R S + +E+G+CRF F VSCSKGTYVRT
Sbjct:  122 AVKVRGKRLYEYARAGITVERPERTVTIFSLERMSDIVYEEGVCRFRFNVSCSKGTYVRT  181

Query:  182 LAVDLGIKLGYASHMSFLKRTSSAGLSITQSLTLEEINEKYKQ-EDFSLLPIEYGVLDL   240
               LAVD+G  LGY +HMS L RT S    S+ +  T    E+ E+ +Q E   S LLPIE   +LD+
Sbjct:  182 LAVDIGKALGYPAHMSDLVRTKSGPFSLEECFTFTELEERLEQGEGSSLLLPIETAILDI  241

Query:  241 PKVNLTEEDKVEISYGR----------RILLENEADTLAAFYE                  273
            P+V +  +E +  +I +G                R   + NE      L  A Y+
Sbjct:  242 PRVQVNKEIEEKIRHGAVLPQKWFNHPRFTVYNEEGALLAIYK                  284
```

A related DNA sequence was identified in *S. pyogenes* <SEQ ID 5839> which encodes the amino acid sequence <SEQ ID 5840>. Analysis of this protein sequence reveals the following:

```
Possible site: 56
>>> Seems to have no N-terminal signal sequence

----- Final Results -----
            bacterial cytoplasm --- Certainty = 0.2698(Affirmative) < succ>
             bacterial membrane --- Certainty = 0.0000(Not Clear)  < succ>
              bacterial outside --- Certainty = 0.0000(Not Clear)  < succ>
```

An alignment of the GAS and GBS proteins is shown below.

```
 Identities = 201/295 (68%), Positives = 246/295 (83%), Gaps = 2/295 (0%)

Query:    1 MITGIINLKKEAGMTSHDAVFKLRKILHTKKIGHGGTLDPDVVGVLPIAVGKATRVIEYM   60
            MI GIINLKKEAGMTSHDAVFKLRK+L  KKIGHGGTLDPDVVGVLPIAVGKATRVIEYM
Sbjct:    1 MINGIINLKKEAGMTSHDAVFKLRKLLQEKKIGHGGTLDPDVVGVLPIAVGKATRVIEYM   60

Query:   61 TESGKIYEGEITLGYATSTEDSSGEVISRTPLTQSDLSEDVVDHAMKSFTGPITQVPPMY  120
            TE+GK+YEG++TLGY+T+TED+SGEV++R+ L   + L+E++VD  M +F G  ITQ PPMY
Sbjct:   61 TEAGKVYEGQVTLGYSTTTEDASGEVVARSSL-PAVLTEELVDQTMTTFLGKITQTPPMY  119

Query:  121 SAVKVNGKKLYEYARSGEEVERPKRQITISEFRRTSPLYF-EKGICRFSFYVSCSKGTYV  179
            SAVKVNG+KLYERAR+GE VERP+R++TIS F RTSPL F  E G+CRFSF V+CSKGTYV
Sbjct:  120 SAVKVNGRKLYERARAGESVERPRREVTISLFERTSPLNFTEDGLCRFSFKVACSKGTYV  179

Query:  180 RTLAVDLGIKLGYASHMSFLKRTSSAGLSITQSLTLEEINEKYKQEDFSFLLPIEYGVLD  239
             RTLAVDLG  LG  SHMSFL+R++SAGL++  + TL EI +    +++ SFLLPIEYGV D
Sbjct:  180 RTLAVDLGRALGVESHMSFLQRSASAGLTLETAYTLGEIADMVSKQEMSFLLPIEYGVAD  239

Query:  240 LPKVNLTEEDKVEISYGRRILLENEADTLAAFYENRVIAILEKRGNEFKPHKVLL       294
            LPK+ + +    + EIS+GRR+ L  ++     LAAF+  +VIAILEKR  E+KP KVL+
Sbjct:  240 LPKMVIDDTELTEISFGRRLSLPSQEPLLAAFHGEKVIAILEKRDQEYKPKKVLI       294
```

Based on this analysis, it was predicted that these proteins and their epitopes could be useful antigens for vaccines or diagnostics.

EXAMPLE 1877

A DNA sequence (GBSx1985) was identified in *S. agalactiae* <SEQ ID 5841> which encodes the amino acid sequence <SEQ ID 5842>. Analysis of this protein sequence reveals the following:

```
Possible site: 50
>>> Seems to have no N-terminal signal sequence
```

```
-continued
----- Final Results -----
            bacterial cytoplasm --- Certainty = 0.2776(Affirmative) < succ>
            bacterial membrane  --- Certainty = 0.0000(Not Clear)   < succ>
             bacterial outside  --- Certainty = 0.0000(Not Clear)   < succ>
```

A related GBS nucleic acid sequence <SEQ ID 9819> which encodes amino acid sequence <SEQ ID 9820> was also identified.

The protein has homology with the following sequences in the GENPEPT database.

```
>GP: CAB12871 GB: Z99109 similar to hypothetical proteins
         [Bacillus subtilis]
 Identities = 39/145 (26%), Positives = 68/145 (46%), Gaps = 7/145 (4%)

Query:    3 MKIRTATLDDSEKLVPLYQELG----YAISLSEIQSILKVILTHSDYGFLIAEDNGKLLA   58
            M IR A   D+ + PL+ +       A L   ++ LK  L + +   LIAE+NG+ +
Sbjct:    1 MNIRQAKTSDAAAIAPLFNQYREFYRQASDLQFAEAFLKARLENHESVILIAEENGEFIG  60

Query    59 FVGYHKLYFFEKSGTYYRILALVVNEKHRRKGIASQLINHVKQLAKTDGSEVLALNSSLK  118
            F   +     Y+  L V    R KG   +L++   K  A  +G++ L L +   +
Sbjct:   61 FTQLYPTFSSVSMKRIYILNDLFVVPHARTKGAGGRLLSAAKDYAGQNGAKCLTLQT--E  118

Query:  119 EYRQEAYHFYENLGFKKVSTGFSYY                                    143
            +  ++A    YE   G+++  TGF +Y
Sbjct:  119 HHNRKARSLYEQNGYEE-DTGFVHY                                    142
```

A related DNA sequence was identified in *S. pyogenes* <SEQ ID 5843> which encodes the amino acid sequence <SEQ ID 5844>. Analysis of this protein sequence reveals the following:

```
Possible site: 49
>>> Seems to have no N-terminal signal sequence

----- Final Results -----
            bacterial cytoplasm --- Certainty = 0.0962(Affirmative) < succ>
            bacterial membrane  --- Certainty = 0.0000(Not Clear)   < succ>
             bacterial outside  --- Certainty = 0.0000(Not Clear)   < succ>
```

An alignment of the GAS and GBS proteins is shown below.

```
 Identities = 37/126 (29%), Positives = 64/126 (50%), Gaps = 16/126 (12%)

Query:   18 PLYQE-----LGYAISLSEIQSILKVILTHSDYGFLIA--EDNGKLLAFVG---YHKLYF   67
            P+ QE     LGY +SL ++   + ++   + FL    +D +LL +V     Y   LY
Sbjct:   11 PMLQEINAKALGYLVSLDLLERQYERLIEDCHHYFLAYADKDTNQLLGYVHAERYETLY-  69

Query:   68 FEKSGTYYRILALVVNEKHRRKGIASQLINHVKQLAKTDGSEVLALNSSLKEYRQEAYHF  127
                  +    +L L V  ++R+GI S L+ ++   A+ +G   + LNS+     +R+EA+  F
Sbjct:   70 ---ASDGLNLLGLAVLPAYQRRGIGSALLRALESQARQEGIAFIRLNSA--SHRKEAHAF  124

Query:  128 YENLGF                                                       133
            Y NL +
Sbjct:  125 YRNLDY                                                       130
```

Based on this analysis, it was predicted that these proteins and their epitopes could be useful antigens for vaccines or diagnostics.

EXAMPLE 1878

A DNA sequence (GBSx1986) was identified in *S. agalactiae* <SEQ ID 5845> which encodes the amino acid sequence <SEQ ID 5846>. Analysis of this protein sequence reveals the following:

```
Possible site: 14
>>> Seems to have no N-terminal signal sequence

----- Final Results -----
              bacterial cytoplasm --- Certainty = 0.1659(Affirmative) < succ>
               bacterial membrane --- Certainty = 0.0000(Not Clear)  < succ>
                 bacterial outside --- Certainty = 0.0000(Not Clear)  < succ>
RGD motif 28-30
```

The protein has homology with the following sequences in the GENPEPT database.

```
>GP: AAF30776 GB: AE002133 conserved hypothetical [Ureaplasma
urealyticum]
Identities = 106/440 (24%), Positives = 206/440 (46%),
Gaps = 65/440 (14%)

Query:  13 FAINESEYHQLLEQIRGDAFDKEVSERLEKERLILGEQAKNQLQEVVVE-KDKEIAKLQY   71
           F   N+ +Y++L++Q    +D     LEK+R  L E+ KN+ + +   KD +  K
Sbjct:  71 FLANDRDYNELVKQ----RYD------LEKQRDELKEKLKNEGNKAIAHFKDSDEYKNLI  120

Query:  72 KVKQFLIEKDNLLKDNEYQLAEQLNQKDMMLRD--------LENQIDRLREHENSLQEA  123
           K ++ +  +  ++ NE   +++   ++ L+         L+N I +  ++ +N+ + A
Sbjct: 121 KAQEKINSLNKTIESNEQSYKKEIENIELKLKSQFDEETKSLKNTIAKQEIKLDNAEKMA  180

Query: 124 LTKVERE-------RDAIQNQLHIQ-------------------EKEKDLALASVKSDY  156
           +   +          +D I   + I+                    E +K + +  ++S
Sbjct: 181 IINFKESNEYQKIIKDKIDLDIEIEKLKFAIQAHEDNMKAAKENWESKKIVEIKELESKK  240

Query: 157 EVQLKAANEQVEFYKNFKAQQSTKAVGESLEHYAETEFNKVRHLAFPNAYFEKDNTLSSR  216
             +  ++     E +E   K+    + K VGE LE + + +F++     + P+  F K N
Sbjct: 241 DKEIHKLTESIEQLKREKSS-NVKLVGEELEQWLKNKFDETYSFSCPDMTFTKINEAID-  298

Query: 217 GSKGDFIY------REKDENDLEFL-SIMFEMKNESDDTIKKHKNEDFFKELDKDRREKS  269
           G K DF+        +E   +D + + S   E K E    D   K   KN +K+LD+DR  +
Sbjct: 299 GKKADFLLEFFDFGKEMSNDDKKLIFSATIEAKTEFFDNQKGTKNSAHYKKLDQDRINQK  358

Query: 270 CEYAVLVTMLEADNDYYNIGIVDVSHKYPKMYVIRPQFFIQLIGILRNAALNTLKYKQEL  329
             EYA+LVT LE ++ +     ++   ++Y  M+ +RPQ+FI L+ ++RN A   TLK  K
Sbjct: 359 SEYAILVTELEPEDHF----VIKKINEYKNMFAVRPQYFIPLVDMIRNFA--TLKAKINS  412

Query: 330 ALMKEQNIDITHFEEDLDIFKNAFAKN-YNSASKNFQKAIDEIDKSIKRMEAV-KAALTT  387
            +++ +  D   EE+LD  K   N  +   +K ID+    IK+ E++ ++A
Sbjct: 413 QIIRYE--DRAKIEENLDELKKDIVDNTLKYINDKTKKIIDDSKAIIKKAESIEESAEDI  470

Query: 388 SENQLRLANNKLDDVSVKKL                                         407
           +L       K+++++++K+
Sbjct: 471 INKKLNTLKKKINELTIRKI                                         490
```

A related DNA sequence was identified in *S. pyogenes* <SEQ ID 5847> which encodes the amino acid sequence <SEQ ID 5848>. Analysis of this protein sequence reveals the following:

```
Possible site: 33
>>> Seems to have no N-terminal signal sequence

----- Final Results -----
              bacterial cytoplasm --- Certainty = 0.3192(Affirmative) < succ>
               bacterial membrane --- Certainty = 0.0000(Not Clear)  < succ>
                 bacterial outside --- Certainty = 0.0000(Not Clear)  < succ>
```

An alignment of the GAS and GBS proteins is shown below.

```
Identities = 310/445 (69%), Positives = 352/445 (78%), Gaps = 22/445 (4%)

Query:   1 MNEIKCPHCGTAFAINESEYHQLLEQIRGDAFDKEVSERLEKERLILGEQAKNQLQEVVV   60
           MNEIKCPHC T F INESEY QLLEQ+RG AFD+E+ +RL  E +L E+AK+QL EVV
Sbjct:   1 MNEIKCPHCHTLFTINESEYSQLLEQVRGQAFDEELKKRLINEIALLEEKAKHQLHEVVA   60
```

```
-continued
Query:  61 EKDKEIAKLQYKVKQF----------LIEKDNLL----------KDNEYQLAEQLNQK     98
           +K+   I   L   +++Q             L  +KD L+              N   +LA QL +K
Sbjct:  61 KKETAITSLTNQLEQIEKEQAYLRQEELAKKDQLIASLEAKLDKLASQNALELANQLAEK   120

Query:  99 DMMLRDLENQIDRLRLEHENSLQEALTKVERERDAIQNQLHIQEKEKDLALASVKSDYEV   158
           D    +   L  NQ+D+L  LE + +  Q     L   +E+ERD  I+NQL  +Q KE  +L+LASV+SDYE
Sbjct: 121 DKEVVSLTNQLDKLALEKDATFQSKLATIEKERDGIKNQLALQAKESELSLASVRSDYEA   180

Query: 159 QLKAANEQVEFYKNFKAQQSTKAVGESLEHYAETEFNKVRHLAFPNAYFEKDNTLSSRGS   218
           QLKAANEQVEFYKNFKAQQSTKA+GESLE YAETEFNKVR  AFPNA F KDN LSSRGS
Sbjct: 181 QLKAANEQVEFYKNFKAQQSTKAIGESLELYAETEFNKVRSYAFPNASFVKDNQLSSRGS   240

Query: 219 KGDFIYREKDENDLEFLSIMFEMKNESDDTIKKHKNEDFFKELDKRREKSCEYAVLVTM    278
           KGD+IYRE D N +E LSIMFEMKNE+D T  KHKN DFFKELDKRREK CEYAVLV+M
Sbjct: 241 KGDYIYREVDANGVEILSIMFEMKNEADTTKTKHKNSDFFKELDKRREKDCEYAVLVSM    300

Query: 279 LEADNDYYNTGIVDVSHKYPKMYVIRPQFFIQLIGILRNAALNTLKYKQELALMKEQNID   338
           LEADNDYYNTGIVDVSH+Y KMYV+RPQ FIQLIGILRNAALN+L YKQELAL+KEQNID
Sbjct: 301 LEADNDYYNTGIVDVSHEYQKMYVVRPQLFIQLIGILRNAALNSLHYKQELALVKEQNID   360

Query: 339 ITHFEEDLDIFKNAFAKNYNSASKNFQKAIDEIDKSIKRMEAVKAALTTSENQLRLANNK   398
           ITHFEEDLD  FKNAFAKNY  SAS  NF+KAIDEIDKSIKRME  VK   LTTSENQLRLANNK
Sbjct: 361 ITHFEEDLDQFKNAFAKNYQSASNNFKKAIDEIDKSIKRMEEVKRFLTTSENQLRLANNK   420

Query: 399 LDDVSVKKLTRKNPTMKAKFDALKD                                     423
           L+DVSVKKLTR+NPTM+KF ALKD
Sbjct: 421 LEDVSVKKLTRQNPTMREKFEALKD                                     445
```

SEQ ID 5846 (GBS304) was expressed in *E. coli* as a His-fusion product. The purified protein is shown in FIG. 206, lane 7.

Based on this analysis, it was predicted that these proteins and their epitopes could be useful antigens for vaccines or diagnostics.

EXAMPLE 1879

A DNA sequence (GBSx1987) was identified in *S. agalactiae* <SEQ ID 5849> which encodes the amino acid sequence <SEQ ID 5850>. This protein is predicted to be unnamed protein product. Analysis of this protein sequence reveals the following:

```
Possible site: 34
>>> Seems to have no N-terminal signal sequence

----- Final Results -----
            bacterial cytoplasm --- Certainty = 0.1845(Affirmative) < succ>
            bacterial membrane  --- Certainty = 0.0000(Not Clear)   < succ>
             bacterial outside  --- Certainty = 0.0000(Not Clear)   < succ>
```

The protein has no significant homology with any sequences in the GENPEPT database.

A related DNA sequence was identified in *S. pyogenes* <SEQ ID 5851> which encodes the amino acid sequence <SEQ ID 5852>. Analysis of this protein sequence reveals the following:

```
Possible site: 51
>>> Seems to have no N-terminal signal sequence

----- Final Results -----
            bacterial cytoplasm --- Certainty = 0.2492(Affirmative) < succ>
            bacterial membrane  --- Certainty = 0.0000(Not Clear)   < succ>
             bacterial outside  --- Certainty = 0.0000(Not Clear)   < succ>
```

An alignment of the GAS and GBS proteins is shown below.

```
Identities = 113/180 (62%), Positives = 141/180 (77%)

Query:   16 LSELVDCFKGKAVPSKAEAGDIRIINLSDMSPLGIDYHNLRTFQDEQRSLLKYLLQEGDV   75
            L  +VDCFKGKAV SK    GD+ +INLSDM  LGI YH LRTFQ ++R LL+YLL++GDV
Sbjct:   18 LGTVVDCFKGKAVSSKVVPGDVGLINLSDMGTLGIQYHQLRTFQMDRRQLLRYLLEDGDV   77

Query:   76 LIASKGTVKKVAIFEEQDYPVVASANITILRPTQHIRGYYLKLFFDSEEGQQALENANKG  135
            LIASKGT+KKV +F +Q+  VVAS+NIT+LRP + +RGYY+K F DS  GQ  L+ A+ G
Sbjct:   78 LIASKGTLKKVCVFHKQNRDVVASSNITVLRPQKLLRGYYIKFFLDSPIGQALLDVADHG  137

Query:  136 KAVMNISTKELLNIAIPSIPLFRQDYLIQRYKQGLNDYKRKIARAEQEWERIQNDIRQQL  195
            K V+N+STKELL+I IP IPL +QDYLI  Y +GL DY RK+ RAEQEWE IQN+I++ L
Sbjct:  138 KDVINLSTKELLDIPIPVIPLVKQDYLINHYLRGLTDYHRKLNRAEQEWEYIQNEIQKGL  197
```

Based on this analysis, it was predicted that these proteins and their epitopes could be useful antigens for vaccines or diagnostics.

EXAMPLE 1880

A DNA sequence (GBSx1988) was identified in *S. agalactiae* <SEQ ID 5853> which encodes the amino acid sequence <SEQ ID 5854>. Analysis of this protein sequence reveals the following:

```
Possible site: 15
>>> Seems to have a cleavable N-term signal seq.
      INTEGRAL    Likelihood = -7.43    Transmembrane    62-78  (55-82)
      INTEGRAL    Likelihood = -2.87    Transmembrane   130-146 (130-150)
      INTEGRAL    Likelihood = -1.28    Transmembrane    37-53  (37-53)

----- Final Results -----
              bacterial membrane  --- Certainty = 0.3972(Affirmative) < succ>
              bacterial outside   --- Certainty = 0.0000(Not Clear)   < succ>
              bacterial cytoplasm --- Certainty = 0.0000(Not Clear)   < succ>
```

A related GBS nucleic acid sequence <SEQ ID 9347> which encodes amino acid sequence <SEQ ID 9348> was also identified.

The protein has homology with the following sequences in the GENPEPT database.

```
>GP: CAA22372 GB: AL034446 putative transmembrane protein
[Streptomyces coelicolor A3(2)]
Identities = 38/139 (27%), Positives = 64/139 (45%), Gaps = 5/139 (3%)

Query:   15 SASVEILCRGWLLPVSATKYSKIVSVSISSIFFGLLHSANNHVSLISIFNLCL-FGLFLS   73
            +A+ E++ RG L +         +++ ++ + FGL+H  N    +L   + G  L+
Sbjct:  143 AATEEVVFRGVLFRIIEEHIGTYLALGLTGLVFGLMHLLNEDATLWGALAIAIEAGFMLA  202

Query:   74 LYVILKGNIWGACGIHGAWNCVQGSVFGIEVSGEPMLSNSLVHVKTYGADWISGGKFGVE  133
                N+W    G+H  WN   G VF   VSG    S  L+     G    ++GG FG E
Sbjct:  203 AAYAATRNLWLTIGVHFGWNFAAGGVFSTVVSGNGD-SEGLLDATMSGPKLLTGGDFGPE  261

Query:  134 GSMIT---SIVLIVACYWL                                          149
            GS+ +   ++L +     WL
Sbjct:  262 GSVYSVGFGVLLTLVFLWL                                          280
```

No corresponding DNA sequence was identified in *S. pyogenes*.

Based on this analysis, it was predicted that these proteins and their epitopes could be useful antigens for vaccines or diagnostics.

EXAMPLE 1881

A DNA sequence (GBSx1989) was identified in *S. agalactiae* <SEQ ID 5855> which encodes the amino acid sequence <SEQ ID 5856>, which is a methylase gene homolog. Analysis of this protein sequence reveals the following:

```
Possible site: 33
>>> Seems to have no N-terminal signal sequence

----- Final Results -----
              bacterial cytoplasm --- Certainty = 0.2192(Affirmative) < succ>
              bacterial membrane  --- Certainty= 0.0000(Not Clear)   < succ>
              bacterial outside   --- Certainty = 0.0000(Not Clear)  < succ>
RGD motif: 264-266
```

A related GBS nucleic acid sequence <SEQ ID 9929> 10
which encodes amino acid sequence <SEQ ID 9930> was
also identified.

The protein has homology with the following sequences in
the GENPEPT database.

```
>GP: BAA87672 GB: AB016260 Hypothetical gene, methylase gene homolog
[Agrobacterium tumefaciens]
Identities = 358/1238 (28%), Positives = 595/1238 (47%),
Gaps = 99/1238 (7%)

Query: 1072 KEVARIKGMVDIRNAYQEVIAIQRYYDYDKETFNHLLGKLNRTYDSFVKHYGYLNSAV--  1129
            K V  I+ ++ IR+A +EV+ Q       + L  +L   + SFV+ +G +N
Sbjct:  497 KHVRIIRKLIPIRDAVREVLKAQEL----DRPWKDLQVRLRVAWSSFVRDFGPINHTTVS  552

Query: 1130 ----------------NRNLFDSDDKYSLLASLEDESL--DPSGKSVIYTKSLAFEKAL  1170
                            N  F D   L+AS+ED  L D +    I+T    E+ +
Sbjct:  553 ITEDPESGETRESHRRPNLQPFADDPDCWLVASIEDYDLENDTAKPGAIFT-----ERVI  607

Query: 1171 VRPEKEVKKVHTALDALNSSLADGRGVDFAYMMSIYQVESQMTLIEELGDLIMPDPEKYL  1230
            P   V + +A DAL    L +   VD ++ +   +    ++ ELG   I   DP
Sbjct:  608 SPPAPPV--ITSAADALAVVLNERGRVDLDHIAELLHRDPD-DVVAELGSAIFRDP----  660

Query: 1231 NGELTYVSRQDFLSGDVVTKLEVVDLFVKQDNQDFNWSHYAGLLEAIKPARITLADIDYR  1290
            + ++      +LSG V  KL+V +   D      ++        L   ++P +  +DI  R
Sbjct:  661 -ADGSWQMADAYLSGPVRDKLKVAEAAAALDPV---YNRNVTALAGVQPVDLRPSDITAR  716

Query: 1291 IGSRWIPLAVYGKFAQETFMGKAYELSDQ-EVATVLEVSPIDGVITYQSKFAYTYSNATD  1349
            +G+ WIP A    F +E  MG  +    E+A+      + G +        A T    TD
Sbjct:  717 LGAPWIPAADVVAFVKE-MMGTDIRIHHMPELASWTVEARQLGYLA-----AGTSEWGTD  770

Query: 1350 RSLGVPASRYDSGRKIFENLLNSNQPTITKQVVEGDKKKNVTDVEKTTVLRAKETHLQEL  1409
            R                ++  + LNS  P I   + +GD ++ V +V T    + K     +++
Sbjct:  771 RR---------HAGELLSDALNSRVPQIFDTIRDGDSERRVLNVVDTEAAKEKLHKIKDA  821

Query: 1410 FQGFVAKYPEVQQMIEDTYNRLYNRTVSKSYDGSHLTIDGLAQNISLRPHQKNAIQRIVE  1469
            FQ ++    P+   +    YN +N     + + G HL  + G +     L  HQK  I  RI+
Sbjct:  822 FQRWIWSDPDRTDRLARVYNDRFNNIAPRKFSGDHLNLPGASGAFVLYGHQKRGIWRIIS  881

Query: 1470 EKRALLAHEVGSGKTLTMLGAGFKLKELGMVHKPLYVVPSSLTAQEGGQEIMKFFPTKKVY  1529
                LAH VG+GKT+TM  + + + LG++ K  VVP    AQ   +E +  +PT ++
Sbjct:  882 SGSTYLAHAVGAGKTMTMAASIMEQRRLGLIAKAMQVVPGHCLAQAAREFLALYPTARIL  941

Query: 1530 VTTKKDFAKAKRKQFVSRIITGDYDAIVIGDSQFEKIPMSREKQVTYINDKLEQLREIKL  1589
            V  +F+K KR +F+SR  T   +DAI+I  S F  I +    I+D+LE   + L
Sbjct:  942 VADETNFSKDKRARFLSRAATATWDAIIITHSAFRFIGVPAAFESQMIHDELELYETLLL  1001

Query: 1590 GSDSDYTV--KEAERSIKGLEHQLEELQKLERDTFIEFENLGIDFLFVDEAHHFKNIRPI  1647
            + +   V   K ER  +GL+ +LE L    +D     +G+D + VDEA  F+ +
Sbjct: 1002 KVEDEDRVSRKRLERLKEGLQERLEALST-RKDDLLTIAEIGVDQIIVDEAQEFRKLSFA  1060

Query: 1648 TGLGNVAGITNTTSKKNVDMEMKVRQVQAEHGDRNVVFATGTPVSNSISELFTMMDYIQP  1707
            T +   G+   S++    D+  +K R ++      R +V A+GTP++N++ E+F++    +
Sbjct: 1061 TNMSTLKGVDPNGSQRAWDLYVKSRFIETINPGRALVLASGTPITNTLGEMFSVQRLMGH  1120

Query: 1708 DVLERYLVSNFDSWVGAFGNIENSMELAPTGDKYQPKKRFKKFVNLPELMRIYKETADI-  1766
                 LE   + FD+W    FG+     +EL P+G KY+P  RF   FVN+PEL+ +++ AD+
Sbjct: 1121 AALEERGLHEFDAWASTFGDTTTELELQPSG-KYKPVSRFASFVNVPELIAMFRSFADVV  1179

Query: 1767 ---QTSDMLDLP-VPEAKIIAVESELTQAQKYYLEELVKRSDAIKSGS--VDPSRDNMLK  1820
               + + +P +     V S+ TQA K++   L +R  AI+     P D +L
Sbjct: 1180 MPADLREYVKVPAISTGRRQIVTSKPTQAFKHHQMVLAERIKAIEERERPPQPGDDILLS  1239

Query: 1821 ITGEARKLAIDMRLIDPTYSLSDNQKILQVVDNVERIYRDGAGDK-------------AT  1867
            + + R AID+RL+D         K+ +V N  RI++  AG                 A
Sbjct: 1240 VITDGRHAAIDLRLVDADNDNEPDNKLNNLVSNAFRIWKATAGSVYLRHDSKPFEVPGAA  1299
```

-continued

```
Query:  1868 QMIFSDIGTPK-SKEEGFDVYNELKDLFVDRGIPKEEIAFVHDANTDEKKNSLSRKVNSG  1926
             QMIFSD+GT    K  GF Y ++D  +  G+P  EIAF+ D    E K    V +G
Sbjct:  1300 QMIFSDLGTISVEKTRGFSAYRWIRDELIRLGVPASEIAFMQDFKKSEAKQRLFGDVRAG  1359

Query:  1927 EVRILMASTEKGGTGLNVQSRMKAVHYLDVPWRPSDIVQRNGRLIRQGNMHQEVDIYHYI  1986
                VR L+ S+E  GTG+NVQ R+KA+H+LDVPW PS I QR GR++RQGN H EVDI+ Y
Sbjct:  1360 RVRFLIGSSETMGTGVNVQLRLKALHHLDVPWLPSQIEQREGRIVRQGNQHDEVDIFAYA  1419

Query:  1987 TKGSFDNYLWQTQENKLKYITQIMTSKDPVRSAEDIDE-QTMTASDFKALATGNPYLKLK  2045
             T+GS D +WQ   E K ++I   ++     +R  EDI E Q     + KA+A+G+  L K
Sbjct:  1420 TEGSLDATMWQNNERKARFIAAALSGDTSIRRLEDIGEGQANQFAMAKAIASGDQRLMQK  1479

Query:  2046 MELENELTVLENQKRAFNRSKDEYRHTISYSEKHLPIMEKRLSQYDKDIAQSLATKSQDE  2105
                LE ++ LE   + A    +   R   + +E+ + +     +R+++  +DI + + T  +DF
Sbjct:  1480 AGLEADIARLERLRAAHIDDQHAVRRQLRDAERDIEVSTRRIAEIGQDITRLVPTTGEDF  1539

Query:  2106 VMRFDNQAMDNRAEAGDYLRK-LITYNRSETKEVRTLASFRGFDLKM-TTRGASEPLPET  2163
                M    +    R EAG   L K ++T +         +AS  GF+L+     R   +   T
Sbjct:  1540 TMTVAGKDYSERKEAGRALMKEILTLVQLSPEGEAVIASIGGFELEYHGQRYGKDGYRYT  1599

Query:  2164 ISLMIVGDNQYTVALDLK-SDVGTIQRISNAIDHIIDDQEKTQELVKDLKDKLRVAKVEV  2222
                 L    G + Y + L +  + +G + R+ +A+D    ++E+ ++ + D + +L     +
Sbjct:  1600 TMLKRTGAD-YEIELPVTVTPLGAVSRLEHALDDFDGERERYRQRLGDARRRLASYQSRG  1658

Query:  2223 DKVFPKEEDYQLVKAKYDVLAPLVEKEAEIEEIDAALA                       2260
             +           +++     L EK  ++ E++ ALA
Sbjct:  1659 E------------GSEFAFAGELAEKHRQLAEVETALA                       1684

Identities = 99/271 (36%), Positives = 153/271 (55%), Gaps = 10/271 (3%)

Query:   607 RDKVETNIVAIRLVKNLEVEHRNASPSEQELLAKYVGWGG--LANEFFD-----DYNPKF   659
             +D+   NI AIRL  +E   R A+ EQE L ++ G+G    LAN F       ++     +
Sbjct:    80 KDRARDNIAAIRLAAEIEASERPATREEQETLIRFTGFGASDLANGVFRRPGELEFRKGW   139

Query:   660 SKEREELKSLVTDKEYSDMKQSSLTAYYTDPSLIRQMWDKLERDGFTGGKILDPSMGTGN   719
             +    +L+  V + +Y+ + +  +   A++T   ++R +W   L+R G+  GG++L+P +GTG
Sbjct:   140 DEIGSDLEDAVGETDYASLARCTQYAHFTPEFIVRAIWSGLQRLGWRGGRVLEPGIGTGL   199

Query:   720 FFAAMPKHLREKSELYGVELDTITGAIAKHLHPNSHIEIKGFETVAFNDNSFDLVISNVP   779
             F A MP+ LR+ S + GVELD +T  I +L P +I         F     SFDL I NP
Sbjct:   200 FPALMPEALRDLSHVTGVELDPVTACIVRLLQPRARILTGDFARTEL-PASFDLAIGNPP   258

Query:   780 FANIRIADNRYDRP--YMIHDYFVKKSLDLLHDGGQVAIISSTGTMDKRTENILQDIRET   837
               F++  +  +R  R       +HDYFV +S+DLL   G    A ++S+GTMDK       Q I   T
Sbjct:   259 FSDRTVRSDRAYRSLGLRLHDYFVARSIDLLKPGAFAAFVTSSGTMDKADSAARQHIATT   318

Query:   838 TEFLGGVRLPDSAFKAIAGTSVTTDMLFFQK                               868
              + +   +RLP+ +F+A AGT V  D+LFF+K
Sbjct:   319 ADLIAAIRLPEGSFRADAGTDVVVDILFFRK                               349
```

SEQ ID 5856 (GBS327N) was expressed in *E. coli* as a GST-fusion product. SDS-PAGE analysis of total cell extract is shown in FIG. 148 (lane 8-10; MW 140 kDa). It was also expressed in *E. coli* as a His-fusion product. SDS-PAGE analysis of total cell extract is shown in FIG. 148 (lane 11-13; MW 115 kDa) and in FIG. 182 (lane 8; MW 115 kDa).

Purified GBS327N-GST is shown in FIG. 243, lane 5; Purified GBS327N-His is shown in FIG. 235, lane 5.

GBS327C was expressed in *E. coli* as a GST-fusion product. SDS-PAGE analysis of total cell extract is shown in FIG. 148 (lane 14; MW 73 kDa).

Based on this analysis, it was predicted that this protein and its epitopes, could be useful antigens for vaccines or diagnostics.

EXAMPLE 1882

A DNA sequence (GBSx1990) was identified in *S. agalactiae* <SEQ ID 5857> which encodes the amino acid sequence <SEQ ID 5858>. Analysis of this protein sequence reveals the following:

```
Possible site: 13

>>> Seems to have no N-terminal signal sequence

----- Final Results -----
            bacterial cytoplasm --- Certainty = 0.3656(Affirmative) < succ>
            bacterial membrane  --- Certainty = 0.0000(Not Clear)  < succ>
            bacterial outside   --- Certainty = 0.0000(Not Clear)  < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1883

A repeated DNA sequence (GBSx1991) was identified in *S. agalactiae* <SEQ ID 5859> which encodes the amino acid sequence <SEQ ID 5860>. This protein is predicted to be giant membrane protein. Analysis of this protein sequence reveals the following:

```
Possible site: 33
>>> Seems to have no N-terminal signal sequence

----- Final Results -----
            bacterial cytoplasm --- Certainty = 0.3698(Affirmative) < succ>
            bacterial membrane  --- Certainty = 0.0000(Not Clear)   < succ>
            bacterial outside   --- Certainty = 0.0000(Not Clear)   < succ>
```

The protein has homology with the following sequences in the GENPEPT database.

```
>GP: AAG19662 GB: AE005054 calcium-binding protein
homology; Cbp [Halobacterium sp. NRC-1]
Identities = 22/43 (51%), Positives = 29/43 (67%),
Gaps = 1/43 (2%)

Query:    9 KDSDQDGLTDAQELAL-GTDPQSVDTDGDGQADLEELQSGHSP      50
            +D+D DGL+D  E+ + GTDP   DTDGDG  D  EL++G  P
Sbjct:  198 RDTDDDGLSDGVEVRVAGTDPTERDTDGDGVDDAAELRAGSLP     240
```

No corresponding DNA sequence was identified in *S. pyogenes*.

Based on this analysis, it was predicted that this protein and its epitopes, could be useful antigens for vaccines or diagnostics.

EXAMPLE 1884

A DNA sequence (GBSx1992) was identified in *S. agalactiae* <SEQ ID 5861> which encodes the amino acid sequence <SEQ ID 5862>. Analysis of this protein sequence reveals the following:

```
Possible site: 52
>>> Seems to have no N-terminal signal sequence
    INTEGRAL    Likelihood = -2.39    Transmembrane   1609-1625 (1609-1625)
    INTEGRAL    Likelihood = -1.81    Transmembrane      30-46  (29-46)

----- Final Results -----
            bacterial membrane  --- Certainty = 0.1956(Affirmative) < succ>
            bacterial outside   --- Certainty = 0.0000(Not Clear)   < succ>
            bacterial cytoplasm --- Certainty = 0.0000(Not Clear)   < succ>
LPXTG motif 1600-1604
```

The protein has homology with the following sequences in the GENPEPT database.

```
!GB: X57841 antigen I/II [Streptococcus sobrinus] (v . . .
>GP: CAA40973 GB: X57841 antigen I/II [Streptococcus sobrinus]
Identities = 419/1436 (29%), Positives = 608/1436 (42%), Gaps = 310/1436 (21%)

Query:   23 KSKKYRTLCSVALGTMVTAVVAWGGTVAHADEVTTSV----DTTIQRTE--NPATNLPEA    76
            K K  RTL   LGT + A  G  A A+E +T+     DT + TE  NPATNLP+
Sbjct:   23 KVKSGRTLSGALLGTAILASGA--GQKALAEETSTTSTSGGDTAVVGTETGNPATNLPDK    80
```

-continued

```
Query:   77 QPNP------------------VSEQTESMASTGQSNGAIAVTVPHDTVT-----QAVE   112
            Q NP                  V  T +  +S      VTV D         + +
Sbjct:   81 QDNPSSQAETSQAQARQKTGAMSVDVSTSELDEAAKSPQEAGVTVSQDATVNKGTVEPSD   140

Query:  113 EAKAEGVSTVEDSPMDLGNTRSAVET---------------NQQIS-------------K   144
            EA +     +D    + +A E               NQ+I+              K
Sbjct:  141 EANQKEPEIKDDYSKQAADIQKATEDYKASVAANQAETDRINQEIAAKKAQYEQDLAANK   200

Query:  145 AD-------------------ADTQKQVETINEVTK----TYKADKATYESNKARIEQEN   181
            A+                   A QK + I   +      Y A K Y+  AR++  N
Sbjct:  201 AEVERSLMRMRKPRPIYEAKLAQNQKDLAAIQQANSDSQAAYAAAKEAYDKEWARVQAAN   260

Query:  182 KELSQAYEGANQTGKETNAWVDTKVNDLKARYADADVTVKEQ-------VVSSGNGTSVL   234
            + AYE        N   +   ++   RA AD      K         +GN  +
Sbjct:  261 AAAKKAYEEALAANTAKNDQIKAEIEAIQQRSAKADYEAKLAQYEKDLAAAQAGNAANEA   320

Query:  235 DY----TNYGKAVETIQSTNEQAVADY----LTKKTKADDIVAKNQAIQKENEA------   280
            DY    Y +  +Q+ N A  Y          K     I A+N+AIQ+    +A
Sbjct:  321 DYQAKKAAYEQELARVQAANAAAKQAYEQALAANSAKNAQITAENEAIQQNAQAKADYEA   380

Query:  281 -------GLANAKADNEAIERRNQAGQAAVDAEN---RAGQAAVDQANQEKQQLVSDRAA   330
                   LA A++ N AE   Q    AA + E    +A  AA QA +++ Q  + A
Sbjct:  381 KLAQYQKDLAAAQSGNAANEADYQEKLAAYEKELARVQAANAAAKQAYEQQVQQANAKNA   440

Query:  331 EIEAITKRNKEKEAAARKENEAIDAYNTKEMERYQRDLAEIS------------------   372
            EI      +  +E+ A A+ + E      +E+ Y++DLAE
Sbjct:  441 EITEANRAIRERNAKAKTDYELKLSKYQEELAQYKKDLAEYPAKLQAYADEQAAIKAALA   500

Query:  373 -----KGEEGYISEALAQALNLNNGEPQAQHGAITRN-----------------------   404
                 K E+G +SE  AQ+L + +  EP AQ    +T
Sbjct:  501 ELEKHKNEDGNLSEPSAQSL-VYDLEPNAQVALVTDGKLLKASALDEAFSHDEKNYNNHL   559

Query:  405 --PDQI----------ISTGDALLGGYSRILDSTGF-----------FVYDMFKTGETLS   441
              PD +          +++  L G +  D G+            F  + K G++ +
Sbjct:  560 LQPDNLNVTYLEQADDVASSVELFGNFG---DKAGWTTTVSNGAEVKFASVLLKRGQSAT   616

Query:  442 FNYQNLQHARFDGKKISRVTYDITNLVSPAG-----TNAVKLVVPNDPTEGFIAYRNDGN   496
            Y NL+++ ++GKKIS+V Y  T  V P          T V L +  DPT G A    G
Sbjct:  617 ATYTNLKNSYYNGKKISKVVYKYT--VDPDSKFQNPTGNVWLFIFTDPTLGVFASAYTGQ   674

Query:  497 GDWRTD---KMEFRVVAKYYLEDGSQVTFSKEKPGVFTHSSLNHDIGLEYVKDSSGKFV   553
                 +   T   K EF     +Y EDG+ + F     + + +SLN    +E  KD SG FV
Sbjct:  675 NEKDTSIFIKNEF----TFYDEDGNPIDFDN---ALLSVASLNREHNSIEMAKDYSGTFV   727

Query:  554 PINGSTVQVTN--------------EGLARSLGSNRASDLNLPEEWDTTSSRYAYKGAIV   599
            I+GS++     N              EG +    RAS+      WD+ +  ++ GA
Sbjct:  728 KISGSSIGEKNGMIYATDTLNFKKGEGGSLHTMYTRASEPG--SGWDSADAPNSWYGAGA   785

Query:  600 STVTSGNTY--------TVTFGQGDMPQNVGL--------SYWFALN-------------   630
            ++  N Y        T      +MPQ  G         + W++LN
Sbjct:  786 VRMSGPNNYITLGATSATNVLSLAEMPQVPGKDNTAGKKPNIWYSLNGKIRAVNVPKVTK   845

Query:  631 --TLPVARTVTPYSPKPHVTVEL-----EPIPEPITVTPDIYTPKTFTPEKPVTFT----   679
              P    P  P V EL        EP EP  TP   P   PEKPV  T
Sbjct:  846 EKPTPPVEPTKPDEPTYEVEKELVDLPVEPKYEP-EPTPPSKNPDQSIPEKPVEPTYEVE   904

Query:  680 ----PKPLDEVVQPSLTLTKVT-------LPVKPIPKELPTPP------------QVPTV   716
                P P++     +  T  + T          PV+P +  LPTPP              VPTV
Sbjct:  905 KELEPAPVEPSYEKEPTPPQSTPDQEEPEKPVEPSYQSLPTPPVEPVYETVPGPVSVPTV   964

Query:  717 HYHAYRLTTTSEIMKEVVNSDQANLHEKTVAKDSTVIYPLTVDALSPNRAQTTSLIFEDY   776
            YH Y+L     + KE+ N D ++ +  VAK STV + L      L   R +TTS + D
Sbjct:  965 RYHYYKLAVQPGVTKEIKNQDDLDIDKTLVAKQSTVKFQLKTADLPAGRPETTSFVLMDP   1024

Query:  777 LPAGYLFDKETTQKENGNYVLSFDETKNFVTLTAKENLLQEVNKDLTQVYQLTAPKLYGS   836
            LP+GY + E T+ + +  S+D+  + VT TA    L +N+DLT+       P + G
Sbjct: 1025 LPSGYQLNLEATKVASPGFEASYDAMTHTVTFTATAETLAALNQDLTKAVATIYPTVVGQ   1084

Query:  837 VQNDGATYSNSYKLLLNKGTTNAYTVTSNVVTVRTPG-----DGETTTLITPDKNNENAD   891
            V  NDGATY+N++  L++N    +AY + SN+V V TPG      D +     ITP K  N+N +
Sbjct: 1085 VLNDGATYTNNFTLMVN----DAYGIKSNIVRVTTPGKPNDPDNPSNNYITPHKVNKNEN   1140

Query:  892 GVLINDTVVALGTTNHYRLTWDLDQYKGDRSAKETIARGFFFVDDYPEEVLDVVENGTAI   951
            GV +I+   V  GTTN+Y LTWDLDQYKGD+SAKE I  +GFF+VDDYPEE LD+ +    +
Sbjct: 1141 GVVIDGKSVLAGTTNYYELTWDLDQYKGDKSAKEIIQKGFFFYDDYPEEALDLRTDLIKL   1200

Query:  952 TTLDGQKVSGITVKNYASLNEAPKDLQDKLARAKITPTGAFQVFMPDDNQAFYDQYVQTG   1011
            T  +G+ V+G++ +G++V +YASL  AP +QD L +A I P GAFQVF  DD QAFYD YV TG
Sbjct: 1201 TDANGKAVTGVSVADYASLEAAPAAVQDMLKKANIIPKGAFQVFTADDPQAFYDAYVVTG   1260
```

```
                              -continued
Query:  1012 TSLALLTKMTVKDSLYGQTKTYTNKAYQVDFGNGYETKEVTNTLVSPEPKKQ-NLNKDKV  1070
             T L ++T MTVK +     +Y N+AYQ+DFGNGYE+  V N +      P+K    L  D
Sbjct:  1261 TDLTIVTPMTVKAEMGKTGGSYENRAYQIDFGNGYESNLVVNNVPKINPEKDVTLTMDPA  1320

Query:  1071 D---INGKPMLVGTQNHYTLSWDLDQYRGIKADNSQIAQGFYFVDDYPE-----EALLPD  1122
             D   ++G+ + +     +Y L   +     I AD+++    + F DDY +
Sbjct:  1321 DSTNVDGQTIALNQVFNYRLIGGI-----IPADHAEELFEYSFSDDYDQTGDQYTGQYKA  1375

Query:  1123 EAAIQFVTSDGKTV-SGITVKSY--SQLLEAPKTLQAAFSKQKIQPKGAFQVFMPE      1175
                A +    DG + +G + SY +Q+ EA     +  F +  ++        F  E
Sbjct:  1376 FAKVDLTLKDGTIIKAGTDLTSYTEAQVDEANGQIVVTFKEDFLRSVSVDSAFQAE     1431

Identities = 209/442 (47%), Positives = 280/442 (63%), Gaps = 27/442 (6%)

Query:  1198 TVLETMLNSGKSY-ENVAYQVDFGQAYETNTVTNFVPK------------VTPHKSNTNQ  1244
             TV+  +LN G +Y  N    V+    ++N V   P             +TPHK N N+
Sbjct:  1080 TVVGQVLNDGATYTNNFTLMVNDAYGIKSNIVRVTTPGKPNDPDNPSNNYITPHKVNKNE  1139

Query:  1245 EGISIDGKTVLPNTVNYYKIVLDYSQYKDMVVTDDVLAKGFYMVDDYPEEALTLNPDGIQ  1304
                G+  IDGK+VL  T NYY++     D  QYK        +++ KGF+ VDDYPEEAL   L   D I+
Sbjct:  1140 NGVVIDGKSVLAGTTNYYELTWDLDQYKGDKSAKEIIQKGFFYVDDYPEEALDLRTDLIK  1199

Query:  1305 VLDKDGNRVSGISVSTYASLSEAPKVVQDAMAKRQFTPKGAIQVLSSDDPKVFYDTYVKT  1364
              + D +G  V+G+SV+ YASL  AP  VQD +  K    PKGA QV ++DDP+ FTD YV  T
Sbjct:  1200 LTDANGKAVTGVSVADYASLEAAPAAVQDMLKKANIIPKGAFQVFTADDPQAFYDAYVVT  1259

Query:  1365 GQTLVVTLPMTVKNELTKTGGQYENTAYQIDFGLAYVTETVVNNVPKLDPQKDVVIDLSH  1424
             G  L +   PMTVK E+ KTGG YEN AYQIDFG  Y +   VVNNVPK++P+KDV + +
Sbjct:  1260 GTDLTIVTPMTVKAEMGKTGGSYENRAYQIDFGNGYESNLVVNNVPKINPEKDVTLTMPP  1319

Query:  1425 KDA-SLDGKEVALHQTFNYRLVGAMIPSNRATDLFEYGFEDNYDEKHDEYNGVYRSYLMT  1483
               D+ ++DG+ +AL+Q FNYRL+G +IP++ A +LFEY F D+YD+   D+Y G Y+++
Sbjct:  1320 ADSTNVDGQTIALNQVFNYRLIGGIIPADHAEELFEYSFSDDYDQTGDQYTGQYKAFAKV  1379

Query:  1484 DVILKDGSVLKEGTEVTKYTLQQVDTENGLVSISFDKSFLETVSDDSAFQADVYLQMKRI  1543
             D+ LKDG+++K GT++T  YT  QVD   NG +  ++F + FL +VS DSAFQA+VYLQMKRI
Sbjct:  1380 DLTLKDGTIIKAGTDLTSYTEAQVDEANGQIVVTFKEDFLRSVSVDSAFQAEVYLQMKRI  1439

Query:  1544 AAGQVENTYLHTVNGYVISSNTVVTHTPQPEEPSPNQP--------TPPQPPIETIEPPV  1595
             A G    NTY++TVNG   SSNTV T TP+P++PSP  P         P Q       PP
Sbjct:  1440 AVGTFANTYVNTVNGITYSSNTVRTSTPEPKQPSPVDPKTTTTVVFQPRQGKAYQPAPPA  1499

Query:  1596 PASILPNTGEQES----LLGLI                                        1613
              A   LP TG+   +     LLGL+
Sbjct:  1500 GAQ-LPATGDSSNAYLPLLGLV                                        1520

Identities = 100/210 (47%), Positives = 137/210 (64%), Gaps = 4/210 (1%)

Query:  1060 PKKQNLNKDKVDINGKPMLVGTQNHYTLSWDLDQYRGIKADNSQIAQGFYFVDDYPEEAL  1119
             P K N N++ V I+GK +L GT N+Y L+WDLDQY+G K+     I +GF++VDDYPEEAL
Sbjct:  1132 PHKVNKNENGVVIDGKSVLAGTTNYYELTWDLDQYKGDKSAKEIIQKGFFYVDDYPEEAL  1191

Query:  1120 LPDEAAIQFVTSDGKTVSGITVKSYSQLLEAPKTLQAAFSKQKIQPKGAFQVFMPEDPQA  1179
              I+   ++GK V+G++V   Y+  L   AP  +Q    K   I PKGAFQVF  +DPQA
Sbjct:  1192 DLRTDLIKLTDANGKAVTGVSVADYASLEAAPAAVQDMLKKANIIPKGAFQVFTADDPQA  1251

Query:  1180 FFESYVTKGENITIVTPMTVLETMLNSGKSYENVAYQVDFGQAYETNTVTNFVPKVTPHK  1239
             F+++YV  G  ++TIVTPMTV    M  +G SYEN AYQ+DFG    YE+N V N VPK+ P K
Sbjct:  1252 FYDAYVVTGTDLTIVTPMTVKAEMGKTGGSYENRAYQIDFGNGYESNLVVNNVPKINPEK  1311

Query:  1240 SNT----NQEGISIDGKTVLPNTVNYYKIV                                 1265
              T        + ++DG+T+ N V Y+++
Sbjct:  1312 DVTLTMDPADSTNVDGQTIALNQVFNYRLI                                 1341
```

There is also homology to SEQ ID 598.

Figure 294:
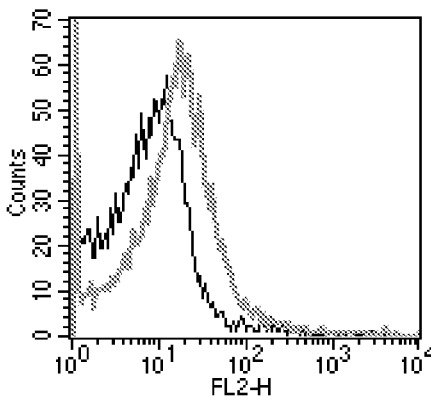

SEQ ID 5862 (GBS76) was expressed in *E. coli* as a His-fusion product. SDS-PAGE analysis of total cell extract is shown in FIG. 17 (lane 2; MW 17.4 kDa). The GBS76-His fusion product was purified (FIG. 196, lane 8) and used to immunise mice. The resulting antiserum was used for FACS (FIG. 294), which confirmed that the protein is immunoaccessible on GBS bacteria.

Based on this analysis, it was predicted that this protein and its epitopes, could be useful antigens for vaccines or diagnostics.

EXAMPLE 1885

A DNA sequence (GBSx1993) was identified in *S. agalactiae* <SEQ ID 5863> which encodes the amino acid sequence <SEQ ID 5864>. This protein is predicted to be abortive infection bacteriophage resistance protein (abiEi). Analysis of this protein sequence reveals the following:

```
Possible site: 31
>>> Seems to have no N-terminal signal sequence

----- Final Results -----
              bacterial cytoplasm --- Certainty = 0.2765(Affirmative) < succ>
               bacterial membrane --- Certainty = 0.0000(Not Clear)   < succ>
                 bacterial outside --- Certainty = 0.0000(Not Clear)   < succ>
```

A related GBS nucleic acid sequence <SEQ ID 9931> which encodes amino acid sequence <SEQ ID 9932> was also identified.

The protein has homology with the following sequences in the GENPEPT database.

```
>GP: AAB52382 GB: U36837 AbiEi [Lactococcus lactis]
Identities = 51/206 (24%), Positives = 90/206 (42%), Gaps = 23/206 (11%)

Query:  17 KNNGIVTNKDCKALGIPTIYLTRLEKEGIIFRVEKGIFLTQNGDYDEYYFFQYRFPKAIF   76
              K  G +  K  +  GI    YL +  +  + V+KG+++  +   D   + FQ ++ KA+
Sbjct:  76 KYKGNIIRKIVRDEGISDYYLRKFVLKYNLTEVDKGVYIFPHKKKDSLFIFQQKYSKAVI  135

Query:  77 SYISALYLQQFTDEIPQYFDVTVPRGYRF--------------------NTPPANLNI   114
              S+ ++LYLQ    D IPQ   ++VP  Y                      N    N+  I
Sbjct: 136 SHETSLYLQDVIDYIPQKIQMSVPEKYNISRIQEPHENRLTSYNYVDINSNNIMDKNIPI  195

Query: 115 HFV-SKEYSELGMTTVPTPMGNNVRVYDFERIICDFVIHREKIDSELFVKTLQSYGNYPK  173
              + V K  S   + TV + +G  +RV      R I D +     K + E+   +  ++ Y
Sbjct: 196 NLVRNKSISPTQIETVNSFLGLPLRVTSIARSIVDVLKPSHKAEEEVKEQAIKYYLERFP  255

Query: 174 KNLAKLYEYATKMNTLEKVKQTLEVL                                   199
              N+ +L    A    N L++++   L +L
Sbjct: 256 DNIVRLKRIAKTQNVLKELEYYLILL                                   281
```

No corresponding DNA sequence was identified in *S. pyogenes*.

Based on this analysis, it was predicted that this protein and its epitopes, could be useful antigens for vaccines or diagnostics.

EXAMPLE 1886

A DNA sequence (GBSx1994) was identified in *S. agalactiae* <SEQ ID 5865> which encodes the amino acid sequence <SEQ ID 5866>. This protein is predicted to be abortive infection bacteriophage resistance protein (abiEii). Analysis of this protein sequence reveals the following:

```
Possible site: 43
>>> Seems to have no N-terminal signal sequence
     INTEGRAL    Likelihood = -1.12    Transmembrane    260-276 (259-277)

----- Final Results -----
               bacterial membrane --- Certainty = 0.1447(Affirmative) < succ>
                 bacterial outside --- Certainty = 0.0000(Not Clear)   < succ>
              bacterial cytoplasm --- Certainty = 0.0000(Not Clear)   < succ>
```

The protein has homology with the following sequences in the GENPEPT database.

```
>GP: AAB52383 GB: U36837 AbiEii [Lactococcus lactis]
Identities = 76/276 (27%), Positives = 135/276 (48%), Gaps = 19/276 (6%)

Query:  14 SKNTGLTFNSVMTYYFLEVILKKLSQSSYSNHYIFKGGFLLSNVIGVESRSTVDIDFLFH   73
              ++N  +  +    Y  E  L  +LS S Y  ++  KGGFL+   +      + R+T D+D
Sbjct:  12 TRNDDIGIENYRIRYATERFLTRLSASQYKEKFVLKGGFLIGVTYNLSQRTTKDLDTALI   71
```

```
-continued
Query:   74 QITLSEETVKQQLKEIL-ADSEEGISFVIQSITTIKESDDYGGYRATISCQLE--NIKQV 130
            +++++ + EI   D E+ + F ++ +T+ ++   Y GYRA +      N +
Sbjct:   72 DFKSDAQSIERVITEICNIDLEDQVLFKLKELTSSQDMRIYPGYRAKLKMMFPDGNTRID 131

Query:  131 IHLDIATGDVVTPQPITYDYKAIFDE-----DNFPIIAYTIETILAEKLQTIYSRNFLNS 185
            LDI  GD +TP+         IF+E      ++AY ETI AEKL+TI +R  +N+
Sbjct:  132 FDLDIGVGDRITPEAKKIKIPLIFNEVKGVEKQIEVLAYPKETIQAEKLETILTRGKVNT 191

Query:  186 RSKDFYDVYIL--SKLKKKDIDFNQLKNACQRTFSYRE-TELDFEKIIE-----LLERFK 237
            R KD+YD ++L    +    I F    A + T+ +R  T+  E++ E     L E  +
Sbjct:  192 RMKDYYDFHLLLTDQENSNSISFYY---AFKNTWEFRNPTQFIDEELFEDWLFILDEILE 248

Query:  238 SDPTQNQQWQNYSKKYSYTKGISLANVLDEMISLIT                         273
            S   + + W NY K  +Y K +++ +++ E+    ++
Sbjct:  249 SKELKEKYWPNYIKDRNYAKHLNMDDIISEIKEFVS                         284
```

No corresponding DNA sequence was identified in *S. pyogenes*.

Based on this analysis, it was predicted that this protein and its epitopes, could be useful antigens for vaccines or diagnostics.

EXAMPLE 1887

A DNA sequence (GBSx1995) was identified in *S. agalactiae* <SEQ ID 5867> which encodes the amino acid sequence <SEQ ID 5868>. Analysis of this protein sequence reveals the following:

```
Possible site: 23
>>> Seems to have no N-terminal signal sequence

----- Final Results -----
        bacterial cytoplasm --- Certainty = 0.1137(Affirmative) < succ>
        bacterial membrane  --- Certainty = 0.0000(Not Clear)   < succ>
        bacterial outside   --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1888

A DNA sequence (GBSx1996) was identified in *S. agalactiae* <SEQ ID 5869> which encodes the amino acid sequence <SEQ ID 5870>. Analysis of this protein sequence reveals the following:

```
Possible site: 44
>>> Seems to have no N-terminal signal sequence

----- Final Results -----
        bacterial cytoplasm --- Certainty = 0.2782(Affirmative) < succ>
        bacterial membrane  --- Certainty = 0.0000(Not Clear)   < succ>
        bacterial outside   --- Certainyl = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1889

A DNA sequence (GBSx1997) was identified in *S. agalactiae* <SEQ ID 5871> which encodes the amino acid sequence <SEQ ID 5872>. Analysis of this protein sequence reveals the following:

```
Possible site: 21
>>> Seems to have no N-terminal signal sequence
    INTEGRAL Likelihood = -10.14 Transmembrane 310-326 (301-334)

----- Final Results -----
              bacterial membrane --- Certainty = 0.5055(Affirmative) < succ>
               bacterial outside --- Certainty = 0.0000(Not Clear)   < succ>
             bacterial cytoplasm --- Certainty = 0.0000(Not Clear)   < succ>
```

The protein has homology with the following sequences in the GENPEPT database.

```
>GP: AAG38044 GB: AF295925 Orf28 [Streptococcus pneumonia]
 Identities = 272/344 (79%), Positives = 307/344 (89%)

Query: 568 VYVNPAFYFPKVIQVQTTILPTIGQFGGDEFERAKAIYDYLKSKGATNQAIAAILGNWSV  627
           +YVNP FYFPKVIQ+QTTILP IGQFGGDEFERAK IY++LKS+GA+ QAIAAILGNWSV
Sbjct:   1 MYVNPQFYFPKVIQLQTTILPAIGQFGGDEFERAKHIYEFLKSQGASPQAIAAILGNWSV   60

Query: 628 ESSINPKRAEGDYLSPPVGATDSSWDDEGWLTLNGPTIYNGRYPNILKRGLGLGQWTDTA  687
           ESSINPKRAEGDYL+PPVG      WDDE WL + GP IY+G YPNIL RGLGLGQWTDTA
Sbjct:  61 ESSINPKRAEGDYLTPPVGVPIPPWDDESWLAIGGPAIYSGAYPNILHRGLGLGQWTDTA  120

Query: 688 DGSRRHTLLLEYAKGKHQKWYDLGLQLDFMLYGDSPYYTNWLKDFFKNSGSPASLAQLFL  747
           DGS RHT LL YA+ +++KWYDL LQLDFML+GDSPYY +WLKDFFKN+GS A+LAQLFL
Sbjct: 121 DGSTRHTALLNYARTQNKKWYDLDLQLDFMLHGDSPYYQSWKKDFFKNTGSAANLAQLFL  180

Query: 748 IYWEGNSGDKLLERQTRASEWYYQIEKGFSQPNGGTAQSDPKALEAVREDLFENSIPGGG  807
           YWEGNSGDKLLERQTRA+EWYYQIEKGFSQ NGG A+SDP++LE VR DL+++S+PGGG
Sbjct: 181 TYWEGNSGDKLLERQTRATEWYYQIEKGFSQTNGGQAKSDPQSLEGVRGDLYDHSVPGGG  240

Query: 808 DGMGYAYGQCTWGVAARINQLGLKLKGKNGEKIPIISTMGNGQDWVRTAASLGGETGTSP  867
           DGM YAYGQCTWGVAAR+NQLGLKLKG+NGEKI II+TMGNGQDWV T++SLGGETG++P
Sbjct: 241 DGMAYAYGQCTWGVAARMNQLGLKLKGRNGEKISIINTMGNGQDWVATSSSLGGETGSTP  300

Query: 868 QEGAILSFAGGGHGTPTEYGHVAFVEKVYPDGSFLISETNYNGN                911
           +GAI+SF GG HGTP  YGHVAFVEKVT DGSFL+SETNY GN
Sbjct: 301 RAGAIVSFVGGTHGTPASYGHVAFVEKVYDDGSFLVSETNYGGN                344
```

SEQ ID 5872 (GBS74d) was expressed in *E. coli* as a GST-fusion product. SDS-PAGE analysis of total cell extract is shown in FIG. 121 (lane 3 & 4; MW 95.5 kDa). It was also expressed in *E. coli* as a His-fusion product. SDS-PAGE analysis of total cell extract is shown in FIG. 121 (lane 5-7; MW 70.5 kDa) and in FIG. 179 (lane 9; MW 70.5 kDa).

GBS74d-His was purified as shown in FIG. 233, lane 7-8.

Based on this analysis, it was predicted that this protein and its epitopes, could be useful antigens for vaccines or diagnostics.

EXAMPLE 1890

A DNA sequence (GBSx1998) was identified in *S. agalactiae* <SEQ ID 5873> which encodes the amino acid sequence <SEQ ID 5874>. This protein is predicted to be TrsE-like protein. Analysis of this protein sequence reveals the following:

```
Possible site: 55
>>> Seems to have no N-terminal signal sequence

----- Final Results -----
             bacterial cytoplasm --- Certainty = 0.5526(Affirmative) < succ>
              bacterial membrane --- Certainty = 0.0000(Not Clear)   < succ>
               bacterial outside --- Certainty = 0.0000(Not Clear)   < succ>
```

The protein has homology with the following sequences in the GENPEPT database.

```
>GP: AAG38042 GB: AF295925 Orf26 [Streptococcus pneumoniae]
 Identities = 618/782 (79%), Positives = 712/782 (91%), Gaps = 1/782 (0%)
```

-continued

```
Query:    1 MKKLKHSMKSK-TSSNDKKQKTKTQKQEISPSTVNTLAYQGLFQNGLMQVSPSYFSQTYL    59
            MK+ +++K + TS++KK++ K +K+E+ PST NTL+YQ L+QNGLMQV YFSQ+YL
Sbjct:    3 MKRKSNTLKKQQTSTTNKKEEVKDKKEEVLPSTANTLSYQALYQNGLMQVKEDYFSQSYL    62

Query:   60 LGDVNYQTVGLDDKGAIVEKYSDLINSLDDKTNFQLTIFNQKVNLEKFRKSILYPLQEDG   119
            LGDVNYQTVGL+DKGAI+EKYSDLI SLDD+TNFQLTIFN+++NLEKFR S+LY +EDG
Sbjct:   63 LGDVNYQTVGLEDKGAIIEKYSDLIKSLDDQTNFQLTIFNKRLNLEKFRSHVLYEEKEDG   122

Query:  120 FDTYRDELNRMMDANLEAGENNFSAVKFLSFGKSDQTPKLAFRSLSQIGEYFKSGFSEID   179
            +D+YR ELNRMM+ NL++GENNFSAVK +SFG+ D PK A+RSLSQIGEYFKSGFSEID
Sbjct:  123 YDSYRKELNRMMNQNLDSGENNFSAVKLISFGRKDSNPKQAYRSLSQIGEYFKSGFSEID   182

Query:  180 VSLGLLGGEERVNVLADMLRGENHLPFSYKDLTLSGQSTKHFIAPTYLSFKHKNHIELDD   239
             L GEERVN+LADMLRGE+HLPFSY+DLT SGQ+T+HFIAP L FK+KN+++++D
Sbjct:  183 ARFESLAGEERVNLLADMLRGEHHLPFSYRDLTRSGQTTRHFIAPNLLDFKNKNYLQIND   242

Query:  240 RLLQIVYVRDYGMELGDKFIRDLMQSDLEVMISLHAKGSTKSETMTKLRTKKTLMESQKI   299
            RLLQIVYVRDYGMELGD+FIRDLMQ DLE+++SLHA+ STKS+ M KLRTKKTLMESQKI
Sbjct:  243 RLLQIVYVRDYGMELGDQFIRDLMQGDLELIVSLHAQSSTKSDAMKKLRTKKTLMESQKI   302

Query:  300 GEQQKMARTGIYLEKVGHVLENNIDEAEALLQTMTQTGDKLFDTVFLIGVLADTEDQLKQ   359
            GEQQK+ARTGIYLEKVGHVLE+NIDEAE LL+TMT+TGDKLF TVFLIGV E++LKQ
Sbjct:  303 GEQQKLARTGIYLEKVGHVLESNIDEAEELLKTMTETGDKLFQTVFLIGVFGQDEEELKQ   362

Query:  360 SLDIIKQVAGSNDMIIDNLTYMQEAAFNSLLPFGKNYLEGVSRSLLTSNIAVNAPWTSVD   419
            +LD ++QVAGSND++ID L YMQEAAFNSLLPFG ++LEGVSRSLLTSNIAVN+PWTSVD
Sbjct:  363 ALDTVQQVAGSNDLMIDKLPYMQEAAFNSLLPFGCDGLEGVSRSLLTSNIAVNSPWTSVD   422

Query:  420 IHDKGGKFYGINQISSNIISIDRGKLNTPSGLILGTSGAGKGMATKHEIISTKLKEADSD   479
            + D+ GK+YGINQISSNII+IDR LNTPSGLILGTSGAGKGMATKHEII+TK+KE+ +
Sbjct:  423 LQDRSGKYYGINQISSNIITIDRSLLNTPSGLILGTSGAGKGMATKHEIITTKIKESGEN   482

Query:  480 TEIIIVDPENEYSIIGQAFGGESIDIAPDSTTFLNVLELSDENMDEDPVKVKSEFLLSWI   539
            TEIIIVDPE EYS+IG+ FGGE IDIAPDS T+LNVL +LS+ENMDEDPVKVKSEFLLS+I
Sbjct:  483 TEIIIVDPEAEYSVIGRTFGGEMIDIAPDSETYLNVLDLSEENMDEDPVKVKSEFLLSFI   542

Query:  543 GKLLDRKMDGREKSLIDRVTRLTYKHFDTPSLVEWVFVLSQQPEQEAKDLALDMELYVEG   599
            GKLLDRKMDGREKS+IDRVTRLTY+ F PSL EWVFVLSQQPE+EA++LALDMELYVEG
Sbjct:  543 GKLLDRKMDGREKSIIDRVTRLTYQSFKEPSLEEWVFVLSQQPEEEAQNLALDMELYVEG   602

Query:  600 SLDIFSHRTNIKTDSHFLIYNVKKLGDELKQIALMVIFDQIWNRVVKNQKLGKKTWIYFD   659
            SLDIFSH+TNI+T S+FLIYNVKKLGDELKQIALMV+FDQIWNRVV+NQKLGKKTWIYFD
Sbjct:  603 SLDIFSHKTNIQTGSNFLIYNVKKLGDELKQIALMVVFDQIWNRVVRNQKLGKKTWIYFD   662

Query:  660 EMQLLLLDKYASDFFFKLWSRVRKYGAIPTGITQNVETLLLDANGRRIIANSEFMILLKQ   719
            E++LLLLDKY SDFFFKLWSRVRKYGA PTGITQNVETLLLD NGRRIIANSEFMILLKQ
Sbjct:  663 EIELLLLDKYPSDFFFKLWSRVRKYGASPTGITQNVETLLLDPNGRRIIANSEFMILLKQ   722

Query:  720 AKSDREELVHMLGLSKELEKYLVNPEKGAGLIKAGSTVVPFKNKIPQHTKLFDIMSTDPE   779
            AK+DREELV +LGLSKELEKYLVNPEKGAGLIKAGS VVPFKNKIPQ ++LFDIM +DP+
Sbjct:  723 AKNDREELVQLLGLSKELEKYLVNPEKGAGLIKAGSVVVPFKNKIPQGSQLFDIMRSDPD   782

Query:  780 KM                                                             781
            KM
Sbjct:  783 KM                                                             784
```

No corresponding DNA sequence was identified in *S. pyogenes*.

Based on this analysis, it was predicted that this protein and its epitopes, could be useful antigens for vaccines or diagnostics.

A related GBS gene <SEQ ID 8925> and protein <SEQ ID 8926> were also identified. Analysis of this protein sequence reveals the following:

```
Lipop: Possible site: -1 Crend: 10
McG: Discrim Score: -26.26
GvH: Signal Score (-7.5): -3.87
     Possible site: 55
>>> Seems to have no N-terminal signal sequence
ALOM program count: 0 value: 6.26 threshold: 0.0
    PERIPHERAL Likelihood = 6.26 335
 modified ALOM score: -1.75
*** Reasoning Step: 3
```

```
----- Final Results -----
         bacterial cytoplasm --- Certainty = 0.5526(Affirmitive) < succ>
         bacterial membrane  --- Certainty = 0.0000(Not Clear)   < succ>
         bacterial outside   --- Certainty = 0.0000(Not Clear)
```

The protein has homology with the following sequences in the databases:

```
33.5/57.2% over 789aa
Enterococcus faecalis
GP|8100663| TrsE-like protein Insert characterized ORF01332(319-2628 of 2949)
GP|8100663|gb|AAF72347.1|AF192329_8|AF192329(2-791 of 799) TrsE-like protein
{Enterococcus faecalis}
% Match = 20.7
% Identity = 33.4 % Similarity = 57.2
Matches = 259 Mismatches = 323 Conservative Sub.s = 184

210       240       270       300       330       360       387
SCYLGSIAPTIYHLKYTSSTVFIMN*RCQTAHLLEEKETNVKKLKHSMKSKTSSNDKKQKTKTQKQEI-----------S
  ||   |            :|: |: |::||
                              MSKKEIPRETEKTKLTRAQRKEIDAVIRKYKGDGR
                                       10        20        30

414       444       474       504       534       564       594       624
PSTVN-TLAYQGLFQNGLMQVSPSYFSQTYLLGDVNYQTVGLDDKGAIVEKYSDLINSLDDKTNFQLTIFNQKVNLEKFR
| |    |  ::  |: ::  :|: :|||  ||:  : |::||      |    || | ||  :|  :  |::||: ::
PHTAQQSIPYEVMYPDGVCRVSPGVFSKCIEFADISYQLAQPDTQTAIFEKLCDLYNYVDASIHIQFSFLNRKVDPVQYA
         50        60        70        80        90       100       110

654       684       714       744       774       804       834       864
KSILYPLQEDGFDTYRDELNRMMDANLEAGENNFSAVKFLSFGKSDQTPKLAFRSLSQIGEYFKSGFSEIDVSLGLLGGE
||   |  |  ||    |     |:|    ::    || ||   |:|     ::   :: :||     | | : |   |
KSFEIAPQGDDFDDIRAEYTGILQKQLANGNNGMVKTKYLTFTIEAESVKAARARLKRIGFDLLGYFKSMGAVAHVMDGW
         130       140       150       160       170       180       190

894       921       951       981      1011      1041      1071      1101
ERVNVLADMLRGENHL-PFSYKDLTLSGQSTKHFIAPTYLSFKHKNHIELDDRLLQIVYVRDYGMELGDKFIRDLMQSDL
||:|   :   :   :      : |:| || || |||:  :  :   :  :  :  : ||   ||  ||:
ERLNLLHGVYHPDGEIFNFDWKWLAPSGLSTKDFIAPSSLCFGNAKTFGMGGKYGAVSFLQILSPELSDDMLADFLNTES
         210       220       230       240       250       260       270

1131      1161      1191      1221      1251      1281      1311      1341
EVMISLHAKGSTKSETMTKLRTKKTLMESQKIGEQQKMARTGIYLEKVGHVLENNIDEAEALLQTMTQTGDKLFDTVFLI
 |:::||  :    :   : :|||  || ||:  :  ::  :    |: :::  |              ||: ||    ||
GVLVNLHVQAIEQTKAIKTIKRKITDLDAMKIAEQKKAVRSGYDMDILPSDLATYGEDAKKLLTKLQTRNERLFQLTFLV
         290       300       310       320       330       340       350

1371      1401      1431      1461      1491      1521      1551
GVLADTEDQLKQSLDIIKQVAGSNDMIIDNLTYMQEAAFNSLLPFGKNYLEGVSRSLLTSNIAVNAPWTSVDIHDKGGK-
 :|||: :|      :       ||  || :| |:|::  ||  |::|     : | |:    ::   : : |
LNVADTKQKLNNDVFQAAGVAQKHNCPLVRLDYQQEQGLASSLPLGVNQI-KIQRSLTTSSVAVFVPFVTQELFQGGAAM
         370       380       390       400       410       420       430

1608      1638      1668      1698      1728      1758      1788      1818
FYGINQISSNIISIDRGKLNTPSGLILGTSGAGKGMATKHEIISTKLKEADSDTEIIIVDPENEYSIIGQAFGGESIDIA
:||||  | :|||  | :|   |||  | |||  |:| :|:   :  || : :  ::|  || | |  :::   ||||
YYGINAKSRNMIMLDRKQARCPNALKLGTPGSGKSMSCKSEIVSVFLTTPD---DIFISDPEAEYYPLVKRLHGQVIRLS
         450       460       470       480       490       500       510

1848      1875      1905      1935      1959      1989      2019
PDSTTFLNVLELS-DENMDEDPVKVKSEFLLSWIGKLLDRK--MDGREKSLIDRVTRLTYKHFDTPSLVEWVFVLS----
| |   | :|::  :|::: : : |:  :|:|| ||         |   |:  |: :  |: ||  | | : |
PTSKDFVNPLDINLNYSEDDNPLALKSDFVLSFCELVMGGKNGLEAIEKTVIDRAVRVIYRPYLADPRPENMPILSDLHK
         530       540       550       560       570       580       590

2058      2088      2118      2148      2178      2208      2238      2268
---QQPEQEAKDLALDMELYVEGSLDIFSHRTNIKTDSHFLIYNVKKLGDELKQIALMVIFDQIWNRVVKNQKLGKKTWI
   | ||   ||: :| ::   :: :  ||  ||| | |: | ::: ||:||::|| |: ||||| :  :|||  ||
ALLDQHVPEADRVAQALDLYVSGSLNVFNHRTNVDIGNRLVSFDIKELGKQLKKLGMLIVQDQIWGRVTANRSQGKATWY
         610       620       630       640       650       660       670

2298      2328      2358      2388      2418      2448      2478      2508
YFDEMQLLLLDKYASDFFFKLWSRVRKYGAIPTGITQNVETLLLDANGRRIIANSEFMILLKQAKSDREELVHMLGLSKE
: ||:|||  :: ::  :: :| |:  ||||||||:||| || ||||::: | ||:|: |||:| | ||| | || ||
FADEFHLLLLKEEQTAAYSAEIWKRFRKWGGIPTGATQNVKDLLSSPEIENILENSDFITLLNQASGDRKILAERLNLSTE
         690       700       710       720       730       740       750

2538      2568      2598      2628      2658      2688      2718      2748
LEKYLVNPEKGAGLIKAGSTVVPFKNKIPQHTKLFDIMSTDPEKMRT*DERG*KASQTG*AKLSKQLKISSYALSERS*D
 :||  | | | |||| |  |  | |::|:|: |   ||:     :
QQKYIDNSEPGEGLLIFENVVLPFTNPIPHNTQLYKIMTTRLNEVAGV
         770       780       790
```

A related GBS gene <SEQ ID 8927> and protein <SEQ ID 8928> were also identified. Analysis of this protein sequence reveals the following:

This protein might be involved in vancomycin research

The protein has homology with the following sequences in the databases:

```
>GP|8100663|gb|AAF72347.1|AF192329_8|AF192329 TrsE-like protein
{Enterococcus faecalis}

Score = 427 bits (1086), Expect = e-118
 Identities = 257/785 (32%), Positives = 431/785 (54%), Gaps = 28/785 (3%)

Query:   9 DKKQKTKTQKQEIS-----------PSTVN-TLAYQGLFQNGLMQVSPSYFSQTYLLGDV   56
           +K + T+ Q++EI+++++++++++++P T    ++ Y+ ++ +G+ +VSP  FS+    D+
Sbjct:  11 EKTKLTRAQRKEIDAVIRKYKGDGRPHTAQQSIPYEVMYPDGVCRVSPGVFSKCIEFADI   70

Query:  57 NYQTVGLDDKGAIVEKYSDLINSLDDKTNFQLTIFNQKVNLEKFRKSILYPLQEDGFDTY  116
           +YQ    D + AI EK  DL N +D    + Q +  N+KV+  ++ KS      Q D FD
Sbjct:  71 SYQLAQPDTQTAIFEKLCDLYNYVDASIHIQFSFLNRKVDPVQYAKSFEIAPQGDDFDDI  130

Query: 117 RDELNRMMDANLEAGENNFSAVKFLSFGKSDQTPKLAFRSLSQIGEYFKSGFSEIDVSLG  176
           R E  ++     L  G N    K+L+F   ++ K A   L +IG       F +
Sbjct: 131 RAEYTGILQKQLANGNNGMVKTKYLTFTIEAESVKAARARLKRIGFDLLGYFKSMGAVAH  190

Query: 177 LLGGEERVNVLADMLRGENHL-PFSYKDLTLSGQSTKHFIAPTYLSFKHKNHIELDDRLL  235
           ++ G  ER+N+L +  +   + F +K L++SG STK FIAP+ L F +      + +
Sbjct: 191 VMDGWERLNLLHGVYHPDGEIFNFDWKWLAPSGLSTKDFIAPSSLCFGNAKTFGMGGKYG  250

Query: 236 QIVYVRDYGMELGDKFIRDLMQSDLEVMISLHAKGSTKSETMTKLRTKKTLMESQKIGEQ  295
             +  +++     EL D  + D + ++  V+++LH +     +++ +  ++ K T +++ KI EQ
Sbjct: 251 AVSFLQILSPELSDMMLADFLNTESGVLVNLHVQAIEQTKAIKTIKRKITDLDAMKIAEQ  310

Query: 296 QKMARTGIYLEKVGHVLENNIDEAEALLQTMTQTGDKLFDTVFLIGVLADTEDQLKQSLD  355
           +K  R+G ++ +    L    ++A+ LL +     ++LF    FL+   +ADT+ +L   +
Sbjct: 311 KKAVRSGYDMDILPSDLATYGEDAKKLLTKLQTRNERLFQLTFLVLNVADTKQKLNNDVF  370

Query: 356 IIKQVAGSNDMIIDNLTYMQEAAFNSLLPFGKNYLEGVSRSLLTSNIAVNAPWTSVDIHD  415
                    VA ++  +   L Y QE    S LP G N ++ + RSL TS++AV P+ + ++
Sbjct: 371 QAAGVAQKHNCPLVRLDYQQEQGLASSLPLGVNQIK-IQRSLTTSSVAVFVPFVTQELFQ  429

Query: 416 KGGK-FYGINQISSNIISIDRGKLNTPSGLILGTSGAGKGMATKHEIISTKLKEADSDTE  474
                G   +YGIN   S N+I +DR +    P+ L LGT G+GK M+ K EI+S   L     D    +
Sbjct: 430 GGAAMYYGINAKSRNMIMLDRKQARCPNALKLGTPGSGKSMSCKSEIVSVFLTTPD---D  486

Query: 475 IIIVDPENEYSIIGQAFGGESIDIAPDSTTFLNVLELS-DENMDEDPVKVKSEFLLSWIG  533
             I I  DPE  EY  ++    G+  I ++P S   F+N L+++ + + D++P+ +KS+F+LS+
Sbjct: 487 IFISDPEAEYYPLVKRLHGQVIRLSPTSKDFVNPLDINLNYSEDDNPLALKSDFVLSFCE  546

Query: 534 KLLDRK--MDGREKSLIDRVTRLTYKHF-------DTPSLVEWVFVLSQQPEQEAKDLAL  584
           ++  K  ++   EK++IDR  R+ Y+ +           + P L +      L  Q  EA  +A
Sbjct: 547 LVMGGKNGLEAIEKTVIDRAVRVIYRPYLADPRPENMPILSDLHKALLDQHVPEADRVAQ  606

Query: 585 DMELYVEGSLDIFSHRTNIKTDSHFLIYNVKKLGDELKQIALMVIFDQIWNRVVKNQKLG  644
             ++LYV GSL++F+HRTN+    +   +++K+LG +LK++ ++++ DQIW RV  N+   G
Sbjct: 607 ALDLYVSGSLNVFNHRTNVDIGNRLVSFDIKELGKQLKKLGMLIVQDQIWGRVTANRSQG  666

Query: 645 KKTWIYFDEMQLLLLDKYASDFFFKLWSRVRKYGAIPTGITQNVETLLLLDANGRRIIANS  704
           K TW + DE++LLL ++  + +   ++W R RK+G  IPTG TQNV+ LL      I+ NS
Sbjct: 667 KATWYFADEFHLLLKEEQTAAYSAEIWKRFRKWGGIPTGATQNVKDLLSSPEIENILENS  726

Query: 705 EFMILLKQAKSDREELVHMLGLSKELEKYLVNPEKGAGLIKAGSTVVPFKNKIPQHTKLF  764
           +F+ LL QA  DR+ L   L LS E +KY+ N E G GL+    + V+PF N IP +T+L+
Sbjct: 727 DFITLLNQASGDRKILAERLNLSTEQQKYIDNSEPGEGLLIFENVVLPFTNPIPHNTQLY  786

Query: 765 DIMST                                                        769
           IM+T
Sbjct: 787 KIMTT                                                        791
```

SEQ ID 8926 (GBS75) was expressed in *E. coli* as a His-fusion product. SDS-PAGE analysis of total cell extract is shown in FIG. 17 (lane 11; MW 89.8 kDa). It was also expressed in *E. coli* as a GST-fusion product. SDS-PAGE analysis of total cell extract is shown in FIG. 20 (lane 6; MW 114.7 kDa).

GBS75-GST was purified as shown in FIG. 197, lane 8.

Figure 174:
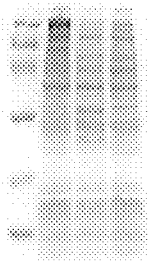

GBS329 was expressed in *E. coli* as a His-fusion product. SDS-PAGE analysis of total cell extract is shown in FIG. 77 (lane 8; MW 89 kDa). It was also expressed in *E. coli* as a GST-fusion product. SDS-PAGE analysis of total cell extract is shown in FIG. 174 (lane 2; MW 114 kDa).

GBS329-GST was purified as shown in FIG. 220, lanes 9 & 10.

EXAMPLE 1891

A DNA sequence (GBSx1999) was identified in *S. agalactiae* <SEQ ID 5875> which encodes the amino acid sequence <SEQ ID 5876>. Analysis of this protein sequence reveals the following:

```
Possible site: 33
>>> Seems to have no N-terminal signal sequence

----- Final Results -----
            bacterial cytoplasm --- Certainty = 0.2442(Affirmative) < succ>
             bacterial membrane --- Certainty = 0.0000(Not Clear)   < succ>
              bacterial outside --- Certainty = 0.0000(Not Clear)   < succ>
```

The protein has no significant homology with any sequences in the GENPEPT database.

No corresponding DNA sequence was identified in S. pyogenes.

Based on this analysis, it was predicted that this protein and its epitopes, could be useful antigens for vaccines or diagnostics.

EXAMPLE 1892

A DNA sequence (GBSx2000) was identified in S. agalactiae <SEQ ID 5877> which encodes the amino acid sequence <SEQ ID 5878>. This protein is predicted to be DNA-directed RNA polymerase ii largest subunit. Analysis of this protein sequence reveals the following:

```
Possible site: 21
>>> Seems to have no N-terminal signal sequence

----- Final Results -----
            bacterial cytoplasm --- Certainty = 0.4393(Affirmative) < succ>
             bacterial membrane --- Certainty = 0.0000(Not Clear)   < succ>
              bacterial outside --- Certainty = 0.0000(Not Clear)   < succ>
```

The protein has no significant homology with any sequences in the GENPEPT database.

No corresponding DNA sequence was identified in S. pyogenes.

Based on this analysis, it was predicted that this protein and its epitopes, could be useful antigens for vaccines or diagnostics.

EXAMPLE 1893

A DNA sequence (GBSx2001) was identified in S. agalactiae <SEQ ID 5879> which encodes the amino acid sequence <SEQ ID 5880>. Analysis of this protein sequence reveals the following:

```
Possible site: 13
>>> Seems to have no N-terminal signal sequence
   INTEGRAL Likelihood = -9.92 Transmembrane 256-272  ( 250-277)
   INTEGRAL Likelihood = -8.28 Transmembrane 216-232  ( 213-244)
   INTEGRAL Likelihood = -8.12 Transmembrane 151-167  ( 148-191)
   INTEGRAL Likelihood = -7.27 Transmembrane  57-73   (  54-80)
   INTEGRAL Likelihood = -6.74 Transmembrane  93-109  (  88-111)
   INTEGRAL Likelihood = -3.50 Transmembrane 172-188  ( 168-191)
   INTEGRAL Likelihood = -2.76 Transmembrane 113-129  ( 110-130)

----- Final Results -----
             bacterial membrane --- Certainty = 0.4970(Affirmative) < succ>
              bacterial outside --- Certainty = 0.0000(Not Clear)   < succ>
            bacterial cytoplasm --- Certainty = 0.0000(Not Clear)   < succ>
```

The protein has homology with the following sequences in the GENPEPT database.

```
>GP: AAG38039 GB: AF295925 Orf23 [Streptococcus pneumoniae]
Identities = 71/86 (82%), Positives = 83/86 (95%)
```

-continued

```
Query:  37 VKSLADFNPTVWSYMTAITKGIMQPLGVAILAVVLVLEFSKMAKKIANSGGAMTFEAIAP   96
           +KSL+ +NPTVW+YM++ITK +MQPLGVAIL+VVL+LEFSKMAKKIANSGGMATFEA+AP
Sbjct:   1 MKSLSSYNPTVWTYMSSITKSVMQPLGVAILSVVLILEFSKMAKKIANSGGMATFEALAP   60

Query:  97 MIVSYIMVAVVITNTTVIVEAIIAIA                                   122
           M++SYIMVAVVITNTTVIVEAII IA
Sbjct:  61 MLISYIMVAVVITNTTVIVEAIIGIA                                    86
```

No corresponding DNA sequence was identified in S. pyogenes.

Based on this analysis, it was predicted that this protein and its epitopes, could be useful antigens for vaccines or diagnostics.

EXAMPLE 1894

A DNA sequence (GBSx2002) was identified in S. agalactiae <SEQ ID 5881> which encodes the amino acid sequence <SEQ ID 5882>. Analysis of this protein sequence reveals the following:

```
Possible site: 25
   >>> Seems to have no N-terminal signal sequence
   INTEGRAL Likelihood = -7.54 Transmembrane 32-48 ( 25-52)
   INTEGRAL Likelihood = -4.09 Transmembrane 63-79 ( 62-80)

----- Final Results -----
           bacterial membrane --- Certainty = 0.4015(Affirmative) < succ>
           bacterial outside  --- Certainty = 0.0000(Not Clear)   < succ>
          bacterial cytoplasm --- Certainty = 0.0000(Not Clear)   < succ>
```

A related GBS nucleic acid sequence <SEQ ID 9933> which encodes amino acid sequence <SEQ ID 9934> was also identified. A related GBS nucleic acid sequence <SEQ ID 10777> which encodes amino acid sequence <SEQ ID 10778> was also identified.

The protein has no significant homology with any sequences in the GENPEPT database.

No corresponding DNA sequence was identified in S. pyogenes.

Based on this analysis, it was predicted that this protein and its epitopes, could be useful antigens for vaccines or diagnostics.

EXAMPLE 1895

A DNA sequence (GBSx2003) was identified in S. agalactiae <SEQ ID 5883> which encodes the amino acid sequence <SEQ ID 5884>. This protein is predicted to be TrsK-like protein (traK). Analysis of this protein sequence reveals the following:

```
Possible site: 34
>>> Seems to have a cleavable N-term signal seq.
   INTEGRAL Likelihood = -7.38 Transmembrane 66-82 ( 62-85)

----- Final Results -----
           bacterial membrane --- Certainty = 0.3951(Affirmative) < succ>
           bacterial outside  --- Certainty = 0.0000(Not Clear)   < succ>
          bacterial cytoplasm --- Certainty = 0.0000(Not Clear)   < succ>
```

The protein has homology with the following sequences in the GENPEPT database.

```
>GP: AAG38037 GB: AF295925 Orf21 [Streptococcus pneumoniae]
  Identities = 343/457 (75%), Positives = 385/457 (84%), Gaps = 24/457 (5%)

Query: 142 LIVIGGSGAGKTFRFVKPNLIQLNCSNIVVDPKDHLAEKTGKLFLENGYQVKVLDLVNMT  201
           + VIGGSG+GKTFRFVKPNLIQ+N SNIVVDPKDHLAEKTGKLFLE+GYQVKVLDLVNM
Sbjct:   1 MAVIGGSGSGKTFRFVKPNLIQMNSSNIVVDPKDHLAEKTGKLFLEHGYQVKVLDLVNMK   60
```

-continued

```
Query: 202 NSDGFNPFRYVETENDLNRMLTVYFNNTKGNGSRSDPFWDEASMTLVRAIASYLVDFYNP 261
            NSDGFNPFRY+ETENDLNRML VYFNNTKG+GSRSDPFWDEASMTLVRA+ASYLVDFYNP
Sbjct:  61 NSDGFNPFRYIETENDLNRMLAVYFNNTKGSGSRSDPFWDEASMTLVRALASYLVDFYNP 120

Query: 121 PGS--------------------SKQEQEARRKRGRYPAFSEIGKLIKLLSKGDNQDKS 300
            P +                    K+E E R+KRGR   F E   +    +   + KS
Sbjct: 121 PKTREQLIEESRLSQKEYQNLLKRQKKEVEERKKGRLSKFCESQNSLNTYPRVKTR-KS 179

Query: 301 ILEVLFEDYAKKYGHENFTMRNWADFQNYKDKTLDSVIAVTTAKFALFNIQSVIDLTQRD 360
            +LE+LFE+YAKKYG ENFTMRNWADFQNYKDKTLDSVIAVTTAKFALFNIQSV+DLT+RD
Sbjct: 180 VLEILFENYAKKYGTENFTMRNWADFQNYKDKTLDSVIAVTTAKFALFNIQSVMDLTKRD 239

Query: 361 TMDLKTWGTQKTMVYLVIPDNDTTFRFLSAL-FFSTVFSTLTRQADV-DFKGQLPIHVRS 418
            T+D+KTWG +K+MVYLVIPDND+TFRFLSAL FF+   F T + +      +LP+HVR
Sbjct: 240 TLDMKTWGQEKSMVYLVIPDNDSTFRFLSALLFFNPYFQTPNKTSQILMLRVRLPLHVRV 299

Query: 419 YLDEFANVGEIPDFAEQTSTVRSRNMSLVPILQNIAQLQGLYKEKEAWKTILGNCDSLLY 478
            YLDEFAN+GEIPDFAEQTSTVRSRNMSLVPILQNIAQLQGLYKEKEAWKTILGNCDSL+Y
Sbjct: 300 YLDEFANIGEIPDFAEQTSTVRSRNMSLVPILQNIAQLQGLYKEKEAWKTILGNCDSLVY 359

Query: 479 LGGNDEETFKFMSGLLGKQTVDVRSTSRSFGQTGSSSTSHQKIARDLMTADEVGTMKRDE 538
            LGGNDE+TFKFMSGLLGKQT+DVR+TSRSFGQTGS S SHQKIARDLMT DEVG MKR E
Sbjct: 360 LGGNDEDTFKFMSGLLGKQTIDVRNTSRSFGQTGSGSLSHQKIARDLMTPDEVGNMKRHE 419

Query: 539 CLVRIAGVPVFRTKKYFPLKHKHWKLLADKETDDRWW                       575
            CLVRIA +PVF++KKY   KH +WK LA++EDT+R W
Sbjct: 420 VLCRIANMPVFKSKKYNSTKHPNWKYLANQETDERRW                       456
```

No corresponding DNA sequence was identified in *S. pyogenes*.

Based on this analysis, it was predicted that this protein and its epitopes, could be useful antigens for vaccines or diagnostics.

A related GBS gene <SEQ ID 8929> and protein <SEQ ID 8930> were also identified. Analysis of this protein sequence reveals the following:

```
Lipop: Possible site: -1 Crend: 5
McG: Discrim Score: 5.53
GvH: Signal Score (-7.5): -0.78
     Possible site: 34
>>> Seems to have a cleavable N-term signal seq.
ALOM program count: 1 value: -7.38 threshold: 0.0
   INTEGRAL Likelihood = -7.38 Transmembrane 66-82 ( 62-85)
   PERIPHERAL Likelihood = 1.75 338
 modified ALOM score: 1.98
*** Reasoning Step: 3

----- Final Results -----
               bacterial membrane --- Certainty = 0.3951(Affirmative) < succ>
                bacterial outside --- Certainty = 0.0000(Not Clear) < succ>
```

The protein has homology with the following sequences in the databases:

33.9/50.9% over 419aa
*Lactococcus lactis*
GP|3582206| trsK protein (traK) Insert characterized
PIR|T43089|T43089 transfer complex protein TrsK-plasmid pMRC01 Insert characterized ORF00383(715-2004 of 2415)
GP|3582206|gb|AAC56002.1||AE001272(23-442 of 530 trsK protein (traK) {*Lactococcus lactis*}PIR|T43089|T43089 transfer complex prote in TrsK - *Lactococcus lactis* plasmid pMRC01
% Match = 10.1
% Identity = 33.8 % Similarity = 50.8
Matches = 141 Mismatches = 193 Conservative Sub.s = 71

-continued

```
519        549        579        609        639        639        669        699        729
SFLAFILGVLMMTLVYLYVSTGQKVYREGEEYGSARFGTSKEKRNFYSKNPFNDTILARDVRLTLLEKKKPQFDRNKNLI
                                                      |  :       |:|::
                                                      MNGTILGVLDNKIIYQDNTTKPNRNVM
                                                            10         20

759        789        816        846        876        906        936        966
VIGGSGAGKTFRFVKPNLIQLNCSNIVV-DPKDHLAEKTGKLFLENGYQVKVLDLVNMTNSDGFNPFRYVETENDLNRML
||||||:  ||   |  ||    ::|||  |||    |||    :  |    ||:|  |:::   ||  :||  |||  |:|  :             :
VIGGSGSYKTQSVVITNLFNETKNSIVVTDPKGELYEKTAGIKLAQGYEVHVVNFANMAHSDRYNPFDYIERDIQAESVA
    40         50         60         70         80         90        100

996       1026       1056       1086       1116       1146       1176       1194
TVYFNNTKGNGSRSDPFWDEASMTLVRAIASYLVDFYNPPGSSKQEQEARRKRGRYPAFSEIGKLIKLLSKGD----NQD
|   :    |    :    |          |::|:   :::                   :  ||       :|  :|    |       |:|
TKIVQSENAEGKK--DVWFSTQRQLLKALILFVM-----------------KERSPEQRNLAGVINVLQTFDSEPINKD
    120        130                                  140        150        160

1221       1251       1281       1311       1341       1371       1401       1431
K-SILEVLFEDYAKKYGHENFTMRNWADFQNYKDKTLDSVIAVTTAKFALFNIQSVIDLTQRDTMDLKTWGTQKTMVYLV
:  | |: ||   | | |     |:  |      |:|:       :   :  ::|       |:      | :| ::|::
ENSDLDNLF--LALKITHPARIAYELG-FKKAKGDMKASIISSLLATISKFTDEEVSNFTSISDFHLQDIGRKKIVLYVI
       180        190        200        210        220        230        240

1461       1491       1521       1551       1581       1611       1641       1671
IPDNDTTFRFLSALFFSTVFSTLTRQADVDFKGQLPIHVRSYLDEFANVGEIPDFAEQTSTVRSRNMSLVPILQNIAQLQ
||    ||:  ||||  :|   :||    :||    ||||  |:|   :     |   |:  |    |      |    |||
IPVMDNTYESFINLFFSQMFDELYKLASSN-GAKLPQEVDFILDEFVNLGKFPKYEEFLATCRGYGIGVTTICQTLTQLQ
        260        270        280        290        300        310        320

1701       1731       1761       1791       1809       1839       1869       1899
GLYKEKEAWKTILGNCDSLLYLGGNDEETFKFMSGLLGKQTVDVR----STSRSFGQTGSSSTSHQKIARDLMTADEVGT
  ||   ||   ::||||       :    ::|  | |:  ||||||  |||    :    :      :|   |||  ||:
SLY-GKEKAESILGNHAVKICLNASNEATAKYFSELLGKSTVKVETGSESTSHSKETSTSKSDSYSYTSRQLMTPDEIIR
       340        350        360        370        380        390        400

1929       1956       1974       2004       2034       2064       2094       2124
MKRDECLVRIAGV-PVFRTK----KYFPLKHKHWKLLADKETDDRWWNYHINPLAKEEELDLSDYQIRDLSTETSLH**K
 |  : |:       |:  ||     | ||    ||     :            :       ::::|
MPDTQSLLIFTNQKPIKATKAFQFKLFPDADSKVKLEQNKYVGITSKSQLEKYNDLSVKWEEKLQSLKNITVTEEEEKDL
       420        430        440        450        460        470        480
```

SEQ ID 5884 (GBS11d) was expressed in E. coli as a His-fusion product. SDS-PAGE analysis of total cell extract is shown in FIG. 151 (lane 6; MW 61 kDa) and in FIG. 182 (lane 10; MW 61 kDa). It was also expressed in E. coli as a GST-fusion product. SDS-PAGE analysis of total cell extract is shown in FIG. 12 (lane 5; MW 91.5 kDa).

EXAMPLE 1896

A DNA sequence (GBSx2004) was identified in *S. agalactiae* <SEQ ID 5885> which encodes the amino acid sequence <SEQ ID 5886>. Analysis of this protein sequence reveals the following:

```
Possible site: 50
>>> Seems to have no N-terminal signal sequence

----- Final Results -----
         bacterial cytoplasm --- Certainty = 0.4192(Affirmative) < succ>
         bacterial membrane  --- Certainty = 0.0000(Not Clear)   < succ>
         bacterial outside   --- Certainty = 0.0000(Not Clear)   < succ>
```

A related GBS nucleic acid sequence <SEQ ID 9935> which encodes amino acid sequence <SEQ ID 9936> was also identified.

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1897

A DNA sequence (GBSx2005) was identified in *S. agalactiae* <SEQ ID 5887> which encodes the amino acid sequence <SEQ ID 5888>. Analysis of this protein sequence reveals the following:

```
Possible site: 16
>>> Seems to have no N-terminal signal sequence
```

```
----- Final Results -----
            bacterial cytoplasm --- Certainty = 0.3391(Affirmative) < succ>
            bacterial membrane  --- Certainty = 0.0000(Not Clear)   < succ>
            bacterial outside   --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1898

A DNA sequence (GBSx2006) was identified in *S. agalactiae* <SEQ ID 5889> which encodes the amino acid sequence <SEQ ID 5890>. Analysis of this protein sequence reveals the following:

```
Possible site: 45
>>> Seems to have an uncleavable N-term signal seq
   INTEGRAL Likelihood = -10.03 Transmembrane  68-84  ( 64-90)
   INTEGRAL Likelihood =  -7.06 Transmembrane  33-49  ( 27-50)
   INTEGRAL Likelihood =  -5.73 Transmembrane 106-122 (105-123)
   INTEGRAL Likelihood =  -4.46 Transmembrane   6-22  (  3-24)
   INTEGRAL Likelihood =  -2.13 Transmembrane 154-170 (154-170)
   INTEGRAL Likelihood =  -0.53 Transmembrane 180-196 (180-196)

----- Final Results -----
            bacterial membrane  --- Certainty = 0.5012(Affirmative) < succ>
            bacterial outside   --- Certainty = 0.0000(Not Clear)   < succ>
            bacterial cytoplasm --- Certainty = 0.0000(Not Clear)   < succ>
```

A related GBS nucleic acid sequence <SEQ ID 9937> which encodes amino acid sequence <SEQ ID 9938> was also identified.

The protein has homology with the following sequences in the GENPEPT database.

```
>GP: BAA11325 GB: D78257 ORF8 [Enterococcus faecalis]
 Identities = 35/102 (34%), Positives = 57/102 (55%), Gaps = 4/102 (3%)
Query:  90 TRNQAVLVQVGKQVPPIIFLLFL-VNASILEEIVYRQLLWEKLTF--PFEQIGVTSFLFV 146
           T N + L+++    V P++ +L L + A I+EEIV+R   +   L      I ++SFLF
Sbjct:   7 TANDSTLIKLFSGVSPVLVVLLLGIAAPIMEEIVFRGGIIGYLVENNALLAILISSFLFG  66

Query: 147 LSHGPNQLGSWLIYSCLGLTLAVVRLKT-DCMTAIALHLLWN                   187
           + HGP     S+ +Y  +G+ L+V   KT D   +I++H L N
Sbjct:  67 IIHGPTNFISFGMYFFMGIILSVSYYKTKDLRVSISIHFLNN                   108
```

No corresponding DNA sequence was identified in *S. pyogenes*.

A related GBS gene <SEQ ID 8931> and protein <SEQ ID 8932> were also identified. Analysis of this protein sequence reveals the following:

```
Lipop: Possible site: -1 Crend: 4
McG: Discrim Score: 9.32
GvH: Signal Score (-7.5): -5.41
     Possible site: 45
>>> Seems to have an uncleavable N-term signal seq
ALOM program count: 6 value: -10.03 threshold: 0.0
   INTEGRAL Likelihood = -10.03 Transmembrane  68-84  ( 64-90)
   INTEGRAL Likelihood =  -7.06 Transmembrane  33-49  ( 27-50)
   INTEGRAL Likelihood =  -5.73 Transmembrane 106-122 (105-123)
   INTEGRAL Likelihood =  -4.46 Transmembrane   6-22  (  3-24)
```

```
    INTEGRAL Likelihood = -2.13 Transmembrane 154-170 ( 154-170)
    INTEGRAL Likelihood = -0.53 Transmembrane 180-196 ( 180-196)
    PERIPHERAL Likelihood =  1.38 131
 modified ALOM score: 2.51
*** Reasoning Step: 3

----- Final Results -----
              bacterial membrane --- Certainty = 0.5012(Affirmative) < succ>
               bacterial outside --- Certainty = 0.0000(Not Clear) < succ>
             bacterial cytoplasm --- Certainty = 0.0000(Not Clear) < succ>
```

The protein has homology with the following sequences in the databases:

```
ORF01326(568-861 of 1188)
EGAD|148261|158156(7-108 of 120) hypothetical protein {Enterococcus faecalis}
GP|1402529|dbj|BAA11325.1||D78257 ORF8 {Enterococcus faecalis}
% Match = 5.9
% Identity = 34.7 % Similarity = 60.4
Matches = 35 Mismatches = 37 Conservative Sub.s = 26

303       333       363       393       423       453       483       513
Y*L*RFI*EVTMIRIVLFYLAIQLNGLLVSLFLKEYLTIEGIVLLQLVLLSVTCLEIARHKTVPLKIVGVQNRLSWLLLG 543       573       603       633       660       690       714       744
FVAMVAFAVFISFLFPVQTRNQAVLVQVGKQVPPIIFLLFL-VNASILEEIVYRQLLWEKLT--FPFEQIGVTSFLFVLS
                  |   :  |:::       | |::  :|: :  |  |:||||:      :      |   ::|||  :
          MQGHTTTANDSTLIKLFSGVSPVLVVLLLGIAAPIMEEIVFRGGIIGYLVENNALLAILISSFLFGII
                10        20        30        40        50        60

774       804       831       861       891       921       951       981
HGPNQLGSWLIYSCLGLTLAVVRLKT-DCMTAIALHLLWNSLAYVVTFL*YQNQECFRIMEAPYV**GIEKRGGHYVI*T
|||   : |:   : |     :|: |: |    ||       :|: :| |
HGPTNFISFGMYFFMGIILSVSYYKTKDLRVSISIHFLNNLFPAIAIAYGLI
       80        90       100       110       120
```

Based on this analysis, it was predicted that these proteins and their epitopes could be useful antigens for vaccines or diagnostics.

EXAMPLE 1899

A DNA sequence (GBSx2007) was identified in *S. agalactiae* <SEQ ID 5891> which encodes the amino acid sequence <SEQ ID 5892>. Analysis of this protein sequence reveals the following:

```
Possible site: 23
>>> Seems to have no N-terminal signal sequence

----- Final Results -----
             bacterial cytoplasm --- Certainty = 0.2490(Affirmative) < succ>
              bacterial membrane --- Certainty = 0.0000(Not Clear) < succ>
               bacterial outside --- Certainty = 0.0000(Not Clear) < succ>
```

A related GBS nucleic acid sequence <SEQ ID 9939> which encodes amino acid sequence <SEQ ID 9940> was also identified.

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1900

A DNA sequence (GBSx2008) was identified in *S. agalactiae* <SEQ ID 5893> which encodes the amino acid sequence <SEQ ID 5894>. Analysis of this protein sequence reveals the following:

```
Possible site: 46
>>> Seems to have no N-terminal signal sequence

----- Final Results -----
             bacterial cytoplasm --- Certainty = 0.5298(Affirmative) < succ>
              bacterial membrane --- Certainty = 0.0000(Not Clear) < succ>
               bacterial outside --- Certainty = 0.0000(Not Clear) < succ>
```

The protein has homology with the following sequences in the GENPEPT database.

```
>GP: AAC98423 GB: L29323 unknown [Streptococcus pneumoniae]
 Identities = 68/126 (53%), Positives = 88/126 (68%)

Query:   1 MNLLHKKSILDCTELEERIHQAETNQLLQKILSLPNFDCDFEVTFEDDYHKEMNDPLFYE   60
           M  L+K+SILDC ELE  +H AE  QL ++I  +PN+ C+FEVTF DDYHK+ N PLFYE
Sbjct:   1 MKALNKESILDCDELETELHDAEIKQLDEQIFLMPNYPCEFEVTFLDDYHKKHNYPLFYE   60

Query:  61 SNLHQISDFMETRDIKNGVDTLLTKDNHLAFRAFGENYSARGKEGILTTLVTVKCFGEGR  120
           S L  I +F+E++DIKNG D +    +L F  +G+ Y A GKEGILTT VTVK F E +
Sbjct:  61 SYLQNIMEFLESQDIKNGADAFVDDHQNLVFVLYGQGYRAEGKEGILTTQVTVKAFDEDK  120

Query: 121 MPIDMS                                                       126
           PI+ +
Sbjct: 121 KPINFA                                                       126
```

No corresponding DNA sequence was identified in *S. pyogenes*.

Based on this analysis, it was predicted that this protein and its epitopes, could be useful antigens for vaccines or diagnostics.

EXAMPLE 1901

A DNA sequence (GBSx2009) was identified in *S. agalactiae* <SEQ ID 5895> which encodes the amino acid sequence <SEQ ID 5896>. This protein is predicted to be methyl transferase. Analysis of this protein sequence reveals the following:

```
Possible site: 46
>>> Seems to have no N-terminal signal sequence
----- Final Results -----
              bacterial cytoplasm --- Certainty = 0.1209(Affirmative) < succ>
              bacterial membrane  --- Certainty = 0.0000(Not Clear)   < succ>
               bacterial outside  --- Certainty = 0.0000(Not Clear)   < succ>
```

The protein has homology with the following sequences in the GENPEPT database.

```
>GP: AAC98421 GB: L29323 methyl transferase [Streptococcus pneumoniae]
 Identities = 323/449 (71%), Positives 389/449 (85%), Gaps = 3/449 (0%)

Query:   1 MKFLDLFAGIGGFRLGMESQGHKCLGFCEIDKFARTSYKAMFNTEGEIEYHDIKEVTDHD   60
           M+F+DLF+GIGGFRLGMES GH+C+GFCEIDKFAR SYK++F TEGEIE+HDI++V+D +
Sbjct:   1 MRFIDLFSGIGGFRLGMESVGHECIGFCEIDKFARESYKSIFQTEGEIEFHDIRDVSDDE   60

Query:  61 FRQFRGQVDIICGGFPCQAFSLAFRRLGFEDTRGTLFFEIARAAKQIQPRFLFLENVKGL  120
           F++ RG+VD+ICGGFPCQAFS+AGRRLGFEDTRGTLFFEIARAAKQIQPRFLFLENVKGL
Sbjct:  61 FKKLRGKVDVICGGFPCQAFSIAGRRLGFEDTRGTLFFEIARAAKQIQPRFLFLENVKGL  120

Query: 121 LNHDEGRTFATILSTLDELGYDVEWQVLNSKDFQVPQNRERVFIIGHSRRYRSRFIFPLR  180
           LNHD+GRTF TIL+TLDELG+DVEWQ+LNSKDF VPQNRERVFIIGHSR+  +R  FP R
Sbjct: 121 LNHDKGRTFTTILTTLDELGFDVEWQMLNSKDFGVPQNRERVFIIGHSRKRGTRLGPFFR  180

Query: 181 RED---SPAHLERLGNINPSKHGLNGEVYLTSGLAPTLTRGKGEGAKIAIPVLTPDRLEK  237
           RE    +P  L+ LGN+NPSK G++G+VY + GLAPTL RGKGEG KIAIP +TPDRL+K
Sbjct: 181 REGQATNPETLKILGNLNPSKSGMSGKVYYSEGLAPTLVRGKGEGFKIAIPCMTPDRLDK  240

Query: 238 RQHGRRFKDNQDPMFTLTSQDKHGVVAGNLPTSFDQTGRVFDISGLSPTLTTMQGGDKV   297
           RQ+GRRFKDNQ+PMFTL +QD+HG+VV G+LPTSF +TGRV+   GLSPTLTTMQGGDK+
Sbjct: 241 RQNGRRFKDNQEPMFTLNTQDRHGIVVVGDLPTSFKETGRVYGSEGLSPTLTTMQGGDKI   300

Query: 298 PKILLREELPFLKIKEATKTGYAKATLGDSVNLAYPDSTKRRGRVGKGISNTLTTSDNMG  357
           PKIL+ E + FLK++EATK GYA+A +GDS+NL  P S  RRGRVGKGI+NTLTTS  MG
Sbjct: 301 PKILIPEPIQFLKVREATKKGYQAQEIGDSINLERPSSQHRRGRVGKGIANTLTTSGQMG  360

Query: 358 VVVAALEYRQDKWYEVTGIVLEGKLYRLRIRRLTPRECFRLQGFPDWAYERAESVSSKSQ  417
           VVVA+ E    Y+V G++++G+ YRLRIRR+TP+ECFRLQGFPDWA+E A  VSS SQ
Sbjct: 361 VVVASYEGEDKQVYQVAGVLIDGQFYRLRIRRITPKECFRLQGFPDWAFEAARKVSSNSQ  420
```

-continued
```
Query: 418 LYKQAGNSVTVTVIEAIAREFRRTEEEEK                              446
            LYKQAGNSVTV VI AIA++ +  EE+++
Sbjct: 421 LYKQAGNSVTVPVIAAIAKKLKEVEEKDE                              449
```

A related DNA sequence was identified in *S. pyogenes* <SEQ ID 2435> which encodes the amino acid sequence <SEQ ID 2436>. Analysis of this protein sequence reveals the following:

```
Possible site: 49
>>> Seems to have no N-terminal signal sequence
----- Final Results -----
            bacterial cytoplasm --- Certainty = 0.1725(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below.

```
 Identities = 60/75 (80%), Positives = 69/75 (92%)
Query:  1 MKFLDLFAGIGGFRLGMESQGHKCLGFCEIDKFARTSYKAMFNTEGEIEYHDIKEVTDHD  60
          MKFLDLFAGIGGFRLG+ +Q H+C+GFCEIDKFAR SYKA++ TEGEIE+HDI++VTD D
Sbjct:  4 MKFLDLFAGIGGFRLGLINQCHECIGFCEIDKFARQSYKAIYETEGEIEFHDIRQVTDQD  63

Query: 61 FRQFRGQVDIICGGF                                              75
          FRQ RGQVDIICGGF
Sbjct: 64 FRQLRGQVDIICGGF                                              78
```

Based on this analysis, it was predicted that these proteins and their epitopes could be useful antigens for vaccines or diagnostics.

EXAMPLE 1902

A DNA sequence (GBSx2010) was identified in *S. agalactiae* <SEQ ID 5897> which encodes the amino acid sequence <SEQ ID 5898>. Analysis of this protein sequence reveals the following:

```
Possible site: 16
>>> Seems to have an uncleavable N-term signal seq
   INTEGRAL Likelihood = -9.71 Transmembrane 8-24 ( 3-30)

----- Final Results -----
             bacterial membrane --- Certainty = 0.4885(Affirmative) < succ>
              bacterial outside --- Certainty = 0.0000(Not Clear)   < succ>
            bacterial cytoplasm --- Certainty = 0.0000(Not Clear)   < succ>
```

A related GBS nucleic acid sequence <SEQ ID 9941> which encodes amino acid sequence <SEQ ID 9942> was also identified.

The protein has no significant homology with any sequences in the GENPEPT database.

A related DNA sequence was identified in *S. pyogenes* <SEQ ID 5899> which encodes the amino acid sequence <SEQ ID 5900>. Analysis of this protein sequence reveals the following:

```
Possible site: 28
>>> Seems to have no N-terminal signal sequence
     INTEGRAL    Likelihood = -1.81    Transmembrane    20-36 (19-36)

----- Final Results -----
             bacterial membrane --- Certainty = 0.1723(Affirmative) < succ>
              bacterial outside --- Certainty = 0.0000(Not Clear)   < succ>
            bacterial cytoplasm --- Certainty = 0.0000(Not Clear)   < succ>
```

An alignment of the GAS and GBS proteins is shown below.

```
Identities = 16/33 (48%), Positives = 26/33 (78%)

Query:   1 MNKMIWWILGGIYLISIIILIVEIIRAPEMDDH  33
           ++KM WW+L G++ +   I LI+E+I APEM+D+
Sbjct:  12 VSKMFWWLLLGVWGLRTIWLIIEVITAPEMEDY  44
```

Based on this analysis, it was predicted that these proteins and their epitopes could be useful antigens for vaccines or diagnostics.

EXAMPLE 1903

A DNA sequence (GBSx2011) was identified in *S. agalactiae* <SEQ ID 5901> which encodes the amino acid sequence <SEQ ID 5902>. This protein is predicted to be ifn-response binding factor 1 (irebf-1). Analysis of this protein sequence reveals the following:

```
Possible site: 53
>>> Seems to have no N-terminal signal sequence

----- Final Results -----
        bacterial cytoplasm --- Certainty = 0.4771(Affirmative) < succ>
        bacterial membrane  --- Certainty = 0.0000(Not Clear)   < succ>
        bacterial outside   --- Certainty = 0.0000(Not Clear)   < succ>
```

The protein has homology with the following sequences in the GENPEPT database.

```
>GP: AAD41248 GB: AF106927 unknown [Streptococcus suis]
Identities = 258/272 (94%), Positives = 266/272 (96%)

Query:   1 MKRITANQYQTSERYYKLPKILFESERYKDMKLEVKVAYAVLKDRLELSLSKGWIDEDGA  60
           MKRITANQYQTSERYYKLPKILFESERYKDMKLEVKVAYAVLKDRLELSLSKGWIDEDGA
Sbjct:   1 MKRITANQYQTSERYYKLPKILFESERYKDMKLEVKVAYAVLKDRLELSLSKGWIDEDGA  60

Query:  61 IYLIYSNSNLMALLGCSKSKLLSIKKTLREYGLIDEVQQSSSERGRMANKIYLGELEHEP 120
           IYLIYSNSNLMALLGCSKSKLLSIKKTLREYGLIDEVQQSSSE+GRMANKIYLGELEHE
Sbjct:  61 IYLIYSNSNLMALLGCSKSKLLSIKKTLREYGLIDEVQQSSSEKGRMANKIYLGELEHET 120

Query: 121 TPVLHTDGASVKKTLGESQRKTGPVLYSAPSETEGSETKYSETEGSDLVMKDEEERQLVD 180
           TPVLHTDGASVKKTLG SQRKTGPVL SAPSETEGSETKYSET+GSD +++DEEERQ VD
Sbjct: 121 TPVLHTDGASVKKTLGGSQRKTGPVLNSAPSETEGSETKYSETKGSDFLIEDEEERQQVD 180

Query: 181 EKKEENFTSKVDGVTKYDRDYIWGLVHDQLRQTGLSQSASDYAMIYFSDRYQYALEQMRF 240
           EK+EENFTSKVDGVT+YDRDYIWGLVHDQLRQTGLSQSASDYAMIYFSDRYQYALE MRF
Sbjct: 181 EKQEENFTSKVDGVTRYDRDYIWGLVHDQLRQTGLSQSASDYAMIYFSDRYQYALEHMRF 240

Query: 241 ARSAEVIAEYVFNGVLSEWTKQLRRQEVKGGE 272
           ARSAEVIAEYVFNGVLSEWTKQLRRQEVKGG+
Sbjct: 241 ARSAEVIAEYVFNGVLSEWTKQLRRQEVKGGD 272
```

A related DNA sequence was identified in *S. pyogenes* <SEQ ID 5903> which encodes the amino acid sequence <SEQ ID 5904>. Analysis of this protein sequence reveals the following:

```
Possible site: 55
>>> Seems to have no N-terminal signal sequence

----- Final Results -----
        bacterial cytoplasm --- Certainty = 0.5248(Affirmative) < succ>
        bacterial membrane  --- Certainty = 0.0000(Not Clear)   < succ>
        bacterial outside   --- Certainty = 0.0000(Not Clear)   < succ>
```

An alignment of the GAS and GBS proteins is shown below.

```
Identities = 84/122 (68%), Positives = 99/122 (80%),
Gaps = 2/122 (1%)

Query: 145 VLYSAPSETEGSETKYSETEGSDLVMKDEEERQLVD--EKKEENFTSKVDGVTKYDRDYI 202
           VL SAPSETE SET+ SET+ S+LV++DEEER+    +K E +FT +VD VTKYD+DYI
Sbjct:   1 VLNSAPSETEKSETEGSETKESNLVIEDEEERKECTSVKKTEGHFTRQVDQVTKYDKDYI  60

Query: 203 WGLVHDQLRQTGLSQSASDYAMIYFSDRYQYALEQMRFARSAEVIAEYVFNGVLSEWTKQ 262
           W LVH QLR+ GLSQ+ASD M YF +RY YALE +RFAR+AE IAEYVFNGVLSEWTKQ
```

```
                            -continued
Sbjct:  61 WSLVHSQLREGGLSQAASDLVMSYFEERYAYALEHIRFARTAEAIAEYVFNGVLSEWTKQ 120

Query: 263 LR                                                        264
           LR
Sbjct: 121 LR                                                        122
```

Based on this analysis, it was predicted that these proteins and their epitopes could be useful antigens for vaccines or diagnostics.

EXAMPLE 1904

A DNA sequence (GBSx2012) was identified in *S. agalactiae* <SEQ ID 5905> which encodes the amino acid sequence <SEQ ID 5906>. Analysis of this protein sequence reveals the following:

```
Possible site: 17
>>> Seems to have no N-terminal signal sequence

----- Final Results -----
            bacterial cytoplasm --- Certainty = 0.4191(Affirmative) < succ>
            bacterial membrane  --- Certainty = 0.0000(Not Clear)   < succ>
             bacterial outside  --- Certainty = 0.0000(Not Clear)   < succ>
```

A related GBS nucleic acid sequence <SEQ ID 9375> which encodes amino acid sequence <SEQ ID 9376> was also identified.

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1905

A DNA sequence (GBSx2013) was identified in *S. agalactiae* <SEQ ID 5907> which encodes the amino acid sequence <SEQ ID 5908>. Analysis of this protein sequence reveals the following:

```
Possible site: 15
>>> Seems to have no N-terminal signal sequence

----- Final Results -----
            bacterial cytoplasm --- Certainty = 0.3723(Affirmative) < succ>
            bacterial membrane  --- Certainty = 0.0000(Not Clear)   < succ>
             bacterial outside  --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1906

A DNA sequence (GBSx2014) was identified in *S. agalactiae* <SEQ ID 5909> which encodes the amino acid sequence <SEQ ID 5910>. Analysis of this protein sequence reveals the following:

```
Possible site: 44
>>> Seems to have no N-terminal signal sequence
```

```
----- Final Results -----
          bacterial cytoplasm --- Certainty = 0.3053(Affirmative) < succ>
          bacterial membrane  --- Certainty = 0.0000(Not Clear)   < succ>
          bacterial outside   --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1907

A DNA sequence (GBSx2015) was identified in *S. agalactiae* <SEQ ID 5911> which encodes the amino acid sequence <SEQ ID 5912>. This protein is predicted to be 50S ribosomal protein L7/112 (rplL). Analysis of this protein sequence reveals the following:

```
Possible site: 56
>>> Seems to have no N-terminal signal sequence

----- Final Results -----
          bacterial cytoplasm --- Certainty = 0.1034(Affirmative) < succ>
          bacterial membrane  --- Certainty = 0.0000(Not Clear)   < succ>
          bacterial outside   --- Certainty = 0.0000(Not Clear)   < succ>
```

A related GBS nucleic acid sequence <SEQ ID 9943> which encodes amino acid sequence <SEQ ID 9944> was also identified.

The protein has homology with the following sequences in the GENPEPT database.

```
>GP: CAB11881 GB: Z99104 ribosomal protein L12 (BL9) [Bacillus subtilis]
Identities = 83/123 (67%), Positives = 95/123 (76%), Gaps = 2/123 (1%)

Query:   6 MALNIENIIAEIKEATILELNDLVKAIEEEFGVTAAAPVAAA--AAGGEAAAAKDSFDVE   63
               MALNIE IIA +KEAT+LELNDLVKAIEEEFGVTAAAPVA A    AA G  AA +   FD+
     Sbjct:   1 MALNIEEIIASVKEATVLELNDLVKAIEEEFGVTAAAPVAVAGGAAAGGAAEEQSEFDLI   60

Query:  64 LTAAGDKKVGVIKVVREITGEGLKEAKAIVDNAPSVIKEGASEAEANEIKEKLEAAGASV  123
                L  AG +K+ VIKVVREITG GLKEAK +VDN P   +KEG ++ EA E+K KLE  GASV
     Sbjct:  61 LAGAGSQKIKVIKVVREITGLGLKEAKELVDNTPRPLKEGIAKEEAEELKAKLEEVGASV  120

Query: 124 TLK                                                          126
                +K
     Sbjct: 121 EVK                                                          123
```

A related DNA sequence was identified in *S. pyogenes* <SEQ ID 5913> which encodes the amino acid sequence <SEQ ID 5914>. Analysis of this protein sequence reveals the following:

```
Possible site: 51
>>> Seems to have no N-terminal signal sequence

----- Final Results -----
          bacterial cytoplasm --- Certainty = 0.1164(Affirmative) < succ>
          bacterial membrane  --- Certainty = 0.0000(Not Clear)   < succ>
          bacterial outside   --- Certainty = 0.0000(Not Clear)   < succ>
```

An alignment of the GAS and GBS proteins is shown below.

```
Identities = 104/126 (82%), Positives = 113/126 (89%)

Query:   1 MEEITMALNIENIIAEIKEATILELNDLVKAIEEEFGVTAAAPVAAAAAGGEAAAAKDSF   60
               +EEITMALNIENIIAEIKEA+ILELNDLVKAIEEEFGVTAAAPVAAAAGG   AAKDSF
     Sbjct:   1 LEEITMALNIENIIAEIKEASILELNDLVKAIEEEFGVTAAAPVAAAAAGGAEEAAKDSF   60

Query:  61 DVELTAAGDKKVGVIKVVREITGEGLKEAKAIVDNAPSVIKEGASEAEANEIKEKLEAAG  120
                DVELT+AGDKKVGVIK VREITG GLKEAK +VD AP+ +KEG + AEA EIK KLE  AG
```

```
                      -continued
Sbjct:   61 DVELTSAGDKKVGVIKAVREITGLGLKEAKGLVDGAPANVKEGVAAAEAEEIKAKLEEAG  120

Query:  121 ASVTLK                                                       126
            A++TLK
Sbjct:  121 ATITLK                                                       126
```

Based on this analysis, it was predicted that these proteins and their epitopes could be useful antigens for vaccines or diagnostics.

EXAMPLE 1908

A DNA sequence (GBSx2017) was identified in S. agalactiae <SEQ ID 5915> which encodes the amino acid sequence <SEQ ID 5916>. This protein is predicted to be ribosomal protein L10 (rplJ). Analysis of this protein sequence reveals the following:

```
Possible site: 37
>>> Seems to have no N-terminal signal sequence

----- Final Results -----
            bacterial cytoplasm --- Certainty = 0.1251(Affirmative) < succ>
            bacterial membrane  --- Certainty = 0.0000(Not Clear)   < succ>
            bacterial outside   --- Certainty = 0.0000(Not Clear)   < succ>
```

The protein has homology with the following sequences in the GENPEPT database.

```
>GP: CAB11880 GB: Z99104 ribosomal protein L10 (BL5) [Bacillus subtilis]
Identities = 96/164 (58%), Positives = 125/164 (75%), Gaps = 1/164 (0%)

Query:   14 MSEAIIAKKAEQVELIAEKMKAAASIVVVDSRGLTVEQDTNLRRSLRESDVEFKVIKNSI   73
            MS AI  KK   VE IA K+K + S ++VD RGL V + T LR+ LRE++VE KV KN++
Sbjct:    1 MSSAIETKKVV-VEEIASKLKESKSTIIVDYRGLNVSEVTELRKQLREANVESKVYKNTM   59

Query:   74 LTRAAEKAGLEDLKELFVGPSAVAESNEDVIAPAKVISDFAKDAEALEIKGGSVDGKFTS  133
               RA E+A L  L +   GP+A+AFS EDV+APAKV++DFAK+ EALEIK G ++GK ++
Sbjct:   60 TRRAVEQAELNGLNDFLTGPNAIAFSTEDVVAPAKVLNDFAKNHEALEIKAGVIEGKVST  119

Query:  134 VEEINALAKLPNKEGMLSMLLSVLQAPVRNVAYAVKAVAEKDEE                  177
            VEE+ ALA+LP +EG+LSMLLSVL+APVRN+A A KAVAE+ EE
Sbjct:  120 VEEVKALAELPPREGLLSMLLSVLKAPVRNLALAAKAVAEQKEE                  163
```

A related DNA sequence was identified in S. pyogenes <SEQ ID 5917> which encodes the amino acid sequence <SEQ ID 5918>. Analysis of this protein sequence reveals the following:

```
Possible site: 56
>>> Seems to have an uncleavable N-term signal seq
    INTEGRAL    Likelihood = -5.47    Transmembrane    7-23 (5-24)

----- Final Results -----
            bacterial membrane  --- Certainty = 0.3187(Affirmative) < succ>
            bacterial outside   --- Certainty = 0.0000(Not Clear)   < succ>
            bacterial cytoplasm --- Certainty = 0.0000(Not Clear)   < succ>
```

An alignment of the GAS and GBS proteins is shown below.

```
Identities = 149/176 (84%), Positives = 162/176 (91%)

Query:    4 SQKIKTEVKLMSEAIIAKKAEQVELIAEKMKAAASIVVVDSRGLTVEQDTNLRRSLRESD   63
            S KIKTEVKLMSEAIIAKKAEQVELIAEKMKAAASIV+VDSRGLTV+QDT LRRSLRES
Sbjct:   23 SPKIKTEVKLMSEAIIAKKAEQVELIAEKMKAAASIVIVDSRGLTVDQDTVLRRSLRESG   82

Query:   64 VEFKVIKNSILTRAAEKAGLEDLKELFVGPSAVAFSNEDVIAPAKVISDFAKDAEALEIK  123
            VEFKVIKNSILTRAAEKAGL++LK++FVGPSAVAFSNEDVIAPAKVI+DF K A+ALEIK
```

```
                            -continued
Sbjct:  83 VEFKVIKNSILTRAAEKAGLDELKDVFVGPSAVAFSNEDVIAPAKVINDFTKTADALEIK 142

Query: 124 GGSVDGKFTSVEEINALAKLPNKEGMLSMLLSVLQAPVRNVAYAVKAVAEKDEEVA      179
           GG+++G  +S EEI ALA LPN+EGMLSMLLSVLQAPVRNVAYAVKAVAE  E  A
Sbjct: 143 GGAIEGAVSSKEEIQALATLPNREGMLSMLLSVLQAPVRNVAYAVKAVAENKEGAA      198
```

Based on this analysis, it was predicted that these proteins and their epitopes could be useful antigens for vaccines or diagnostics.

EXAMPLE 1909

A DNA sequence (GBSx2018) was identified in *S. agalactiae* <SEQ ID 5919> which encodes the amino acid sequence <SEQ ID 5920>. Analysis of this protein sequence reveals the following:

```
Possible site: 40
>>> Seems to have no N-terminal signal sequence
      INTEGRAL      Likelihood = -7.22    Transmembrane    125-141 (106-143)
      INTEGRAL      Likelihood = -1.91    Transmembrane    108-124 (106-124)

----- Final Results -----
              bacterial membrane  --- Certainty = 0.3888(Affirmative) < succ>
              bacterial outside   --- Certainty = 0.0000(Not Clear)   < succ>
              bacterial cytoplasm --- Certainty = 0.0000(Not Clear)   < succ>
```

A related GBS nucleic acid sequence <SEQ ID 10931> which encodes amino acid sequence <SEQ ID 10932> was also identified.

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1910

A DNA sequence (GBSx2019) was identified in *S. agalactiae* <SEQ ID 5921> which encodes the amino acid sequence <SEQ ID 5922>. This protein is predicted to be Clp-like ATP-dependent protease binding subunit (clpC). Analysis of this protein sequence reveals the following:

```
Possible site: 31
>>> Seems to have no N-terminal signal sequence

----- Final Results -----
              bacterial cytoplasm --- Certainty = 0.3483(Affirmative) < succ>
              bacterial membrane  --- Certainty = 0.0000(Not Clear)   < succ>
              bacterial outside   --- Certainty = 0.0000(Not Clear)   < succ>
```

The protein has homology with the following sequences in the GENPEPT database.

```
>GP: AAA68910 GB: L34677 Clp-like ATP-dependent protease binding
subunit [Bos taurus]
Identities = 437/589 (74%), Positives = 514/589 (87%), Gaps = 5/589 (0%)

Query:  10 DPFGN-MDDIFNSLMGNMGGYNSENKRYLINGREVTPEEFSQYRQTGKLPGQELNNQNTP    68
           DPF N MDD+FN LMG M G NSEN+RYLINGREVTPEE++ +RQTGKLPG       Q
Sbjct:   2 DPFNNDMDDLFNQLMGGMNGVNSENRRYLINGREVTPEEYAAFRQTGKLPGVTDPTQ-AK    60

Query:  69 TNQVSADSVLTKLGTNLTDQARQHLLDPVIGRNKEIQETAEILARRTKNNPVLVGDAGVG   128
           T Q   DS+L KLG NLT +A++    LDPVIGRNKEIQETAEIL+RRTKNNPVLVGDAGVG
```

```
                        -continued
Sbjct:  61 TKQPQPDSMLAKLGRNLTQEAKEGKLDPVIGRNKEIQETAEILSRRTKNNPVLVGDAGVG  120

Query: 129 KTAVIEGLAQAIINGDVPAAIKNKEIISIDISSLEAGTQYRGSFEENIQNIIKEVKETGN  188
           KTAV+EGLAQAI+ GDVPAAIKNK+IISIDISSLEAGTQYRGSFEEN+Q +I EVK+ GN
Sbjct: 121 KTAVVEGLAQAIVAGDVPAAIKNKQIISIDISSLEAGTQYRGSFEENMQKLIDEVKKDGN  180

Query: 189 IILFFDEIHQILGAGSTGGDSGSKGLADILKPALSRGELTVIGATTQDEYRNTILKNAAL  248
           +ILFFDEIHQI+GAG+ G  SGSKG+ADILKPALSRGE+T+IGATTQDEYRNTILK+AAL
Sbjct: 181 VILFFDEIHQIIGAGNAGDASGSKGMADILKPALSRGEVTLIGATTQDEYRNTILKDAAL  240

Query: 249 ARRFNEVKVNAPSAQDTFNILMGIRNLYEQHHNVVLPDSVLKAAVDLSIQYIPQRSLPDK  308
           +RRFN+V VNAPS +DTF IL G+R LYE+HHNV LPD VLKAA+D S+QYIPQRSLPDK
Sbjct: 241 SRRFNQVTVNAPSKEDTFKILQGLRKLYEKHHNVSLPDEVLKAAIDYSVQYIPQRSLPDK  300

Query: 309 AIDLIDMTAAHLAAQHPVTDLKSLEKEIAEQRDKQEKAVNTEDFEEALKVKTRIEELQNQ  368
           AIDLID+TAAHLA++HPV D K++E+EI +    KQ++AV  ED++ A + K ++ +LQ+Q
Sbjct: 301 AIDLIDVTAAHLASKHPVKDAKTIEEEIKKTEAKQQEAVEKEDYQAAQEAKDQVAKLQDQ  360

Query: 369 IDNHTEGQKVTATINDIAMSIERLTGVPVSNMGASDIERLKELGNRLKGKVIGQNDAVEA  428
            + +H+E ++V AT +D+A ++ER+TG+PVS MGASDIERLK L  RL+GKVIGQ +AVEA
Sbjct: 361 LKDHSESERVVATPSDVAAAVERMTGIPVSKMGASDIERLKGLATRLEGKVIGQQEAVEA  420

Query: 429 VARAIRRNRAGFDDGNRPIGSFLFVGPTGVGKTELAKQLAFDMFGSKDAIVRLDMSEYND  488
           V+RAIRRNRAGFD+GNRPIGSFLFVGPTGVGKTELAKQLA DMFGS + I+RLDMSEY D
Sbjct: 421 VSRAIRRNRAGFDEGNRPIGSFLFVGPTGVGKTELAKQLALDMFGSTNDIIRLDMSEYTD  480

Query: 489 RTAVSKLIGATAGYVGYDDNSNTLTERIRRNPYSIVLLDEIEKADPQVITLLLQVLDDGR  548
           RTAVSKLIG TAGYVGYDDNSNTLTE++RR+PYSIVLLDEIEKA+PQVITLLLQVLDDGR
Sbjct: 481 RTAVSKLIGTTAGYVGYDDNSNTLTEKVRRHPYSIVLLDEIEKANPQVITLLLQVLDDGR  540

Query: 549 LTDGQGNTINFKNTVIIATSNAGFGNEAFTGDSDKDLKIMERISPYERP             597
           LTDGQGNT++FKNT+IIATSNAGF ++A  G+    D K+M+++ PYFRP
Sbjct: 541 LTDGQGNTVDFKNTIIIATSNAGFSSDAVAGE---DAKLMDKLQPYFRP             586
```

A related DNA sequence was identified in *S. pyogenes* <SEQ ID 5923> which encodes the amino acid sequence <SEQ ID 5924>. Analysis of this protein sequence reveals the following:

```
Possible site: 22
>>> Seems to have no N-terminal signal sequence

----- Final Results -----
            bacterial cytoplasm --- Certainty = 0.2718(Affirmative) < succ>
            bacterial membrane  --- Certainty = 0.0000(Not Clear)   < succ>
             bacterial outside  --- Certainty = 0.0000(Not Clear)   < succ>
```

An alignment of the GAS and GBS proteins is shown below.

```
Identities = 551/697 (79%), Positives = 616/697 (88%), Gaps = 3/697 (0%)

Query:    5 NFYNRDPFGNMDDIFNSLMGNMGGYNSENKRYLINGREVTPEEFSQYRQTGKLPGQELNN   64
            +F +DPF NMDDIFN LM NMGGY SEN RYL+NGRE+TPEEF  YRQTG+LP
Sbjct:    3 HFSGKDPFVNMDDIFNQLMANMGGYRSENPRYLVNGREITPEEFQHYRQTGQLPVATTKA  62

Query:   65 QNTPTNQVSADSVLTKLGTNLTDQARQHLLDPVIGRNKEIQETAEILARRTKNNPVLVGD  124
            N+      ADSVLT+LGTNLT +ARQ   LDPVIGRNKEIQ+TAEILARRTKNNPVLVGD
Sbjct:   63 TNSQMLTPKADSVLTQLGTNLTQEARQGHLDPVIGRNKEIQDTAEILARRTKNNPVLVGD  122

Query:  125 AGVGKTAVIEGLAQAIINGDVPAAIKNKEIISIDISSLEAGTQYRGSFEENIQNIIKEVK  184
            AGVGKTAVIEGLAQAI+NGDVPAAIKNKEI+SIDISSLEAGTQYRGSFEE IQN+I+EVK
Sbjct:  123 AGVGKTAVIEGLAQAIVNGDVPAAIKNKEIVSIDISSLEAGTQYRGSFEETIQNLIQEVK  182

Query:  185 ETGNIILFFDEIHQILGAGSTGGDSGSKGLADILKPALSRGELTVIGATTQDEYRNTILK  244
            E GNIILFFDEIHQI+GAG+T  DSGSKGLADILKPALSRGELT+IGATTQDEYRNTILK
Sbjct:  183 EAGNIILFFDEIHQIVGAGATSSDSGSKGLADILKPALSRGELTLIGATTQDEYRNTILK  242

Query:  245 NAALARRFNEVKVNAPSAQDTFNILMGIRNLYEQHHNVVLPDSVLKAAVDLSIQYIPQRS  304
            NAALARRFNEVKVNAPSA+DTF+ILMGIRNLYEQHH++ LPD+VLKAAVD SIQYIPQRS
Sbjct:  243 NAALARRFNEVKVNAPSAEDTFHILMGIRNLYEQHHHITLPDNVLKAAVDYSIQYIPQRS  302

Query:  305 LPDKAIDLIDMTAAHLAAQHPVTDLKSLEKEIAEQRDKQEKAVNTEDFEEALKVKTRIEE  364
            LPDKAIDL+DMTAAHLAAQHPVTDLK+LE EIA+Q++ QEKAV  EDFE+AL  KTRIE
Sbjct:  303 LPDKAIDLLDMTAAHLAAQHPVTDLKTLETEIAKQKESQEKAVAKEDFEKALAAKTRIET  362
```

```
-continued
Query:   365 LQNQIDNHTEGQKVTATINDIAMSIERLTGVPVSNMGASDIERLKELGNRLKGKVIGQND  424
             LQ QI+ H + Q VTAT+NDIA S+ERLTG+PVSNMG +D+ERLK + +RLK  VIGQ++
Sbjct:   363 LQKQIEQHNQSQNVTATVNDIAESVERLTGIPVSNMGTNDLERLKGISSRLKSHVIGQDE  422

Query:   425 AVEAVARAIRRNRAGFDDGNRPIGSFLFVGPTGVGKTELAKQLAFDMFGSKDAIVRLDMS  484
             AV AVARAIRRNRAGFDDG RPIGSFLFVGPTGVGKTELAKQLA D+FGSKDAI+RLDMS
Sbjct:   423 AVAAVARAIRRNRAGFDDGKRPIGSFLFVGPTGVGKTELAKQLALDLFGSKDAIIRLDMS  482

Query:   485 EYNDRTAVSKLIGATAGYVGYDDNSNTLTERIRRNPYSIVLLDEIEKADPQVITLLLQVL  544
             EYNDRTAVSKLIG TAGYVGYDDN+NTLTER+RRNPY+IVLLDEIEKADPQ+ITLLLQVL
Sbjct:   483 EYNDRTAVSKLIGTTAGYVGYDDNNNTLTERVRRNPYAIVLLDEIEKADPQIITLLLQVL  542

Query:   545 DDGRLTDGQGNTINFKNTVIIATSNAGFGNEAFTGDSDKDLKIMERISPYFRPEFLNRFN  604
             DDGRLTDGQGNTINFKNTVIIATSNAGFG +         +  IM+RI+PYFRPEFLNRFN
Sbjct:   543 DDGRLTDGQGNTINFKNTVIIATSNAGFGQQ---DTETSESNIMDRIAPYFRPEFLNRFN  599

Query:   605 GVIEFSHLSKDDLSEIVDLMLDEVNQTIGKKGIDLVVDENVKSHLIELGYDEAMGVRPLR  664
              +I+F+HL K+ L EIVDLML EVNQT  KKGI L + ++ K+HLI+LGY+ AMG RPLR
Sbjct:   600 SIIKFNHLQKESLEEIVDLMLAEVNQTTAKKGISLTITDDAKAHLIDLGYNHAMGARPLR  659

Query:   665 RVIEQEIRDRITDYYLDHTDVKHLKANLQDGQIVISE                        701
             R+IEQEIRDRITDYYLDH +VK L+A L++GQ+VI +
Sbjct:   660 RIIEQEIRDRITDYYLDHPEVKKLQAILKEGQLVIRQ                        696
```

Based on this analysis, it was predicted that these proteins and their epitopes could be useful antigens for vaccines or diagnostics.

EXAMPLE 1911

A DNA sequence (GBSx2020) was identified in *S. agalactiae* <SEQ ID 5925> which encodes the amino acid sequence <SEQ ID 5926>. Analysis of this protein sequence reveals the following:

```
Possible Site: 20
>>> Seems to have an uncleavable N-term signal seq
      INTEGRAL      Likelihood = -4.78      Transmembrane      8-24 (7-25)

----- Final Results -----
                  bacterial membrane --- Certainty = 0.2911(Affirmative) < succ>
                   bacterial outside --- Certainty = 0.0000(Not Clear)   < succ>
                  bacterial cytoplasm --- Certainty = 0.0000(Not Clear)   < succ>
```

A related GBS nucleic acid sequence <SEQ ID 9945> which encodes amino acid sequence <SEQ ID 9946> was also identified.

The protein has homology with the following sequences in the GENPEPT database.

```
>GP: AAC73364 GB: AE000134 putative enzyme [Escherichia coli K12]
Identities = 142/307 (46%), Positives = 195/307 (63%), Gaps = 6/307 (1%)

Query:    39 KELLESKKTLILHGALGTELESRGCDVSGKLWSAKYLIEDPAAIQTIHEDYIRAGADIVT   98
             + LL+ +  L+L GA+ TELE+RGC+++  LWSAK L+E+P  I+ +H DY RAGA
Sbjct:     8 RALLDKQDILLLDGAMATELEARGCNLADSLWSAKVLVENPELIREVHLDYYRAGAQCAI   67

Query:    99 TSTYQATLQGLAQVGVSESQTEDLIRLTVQLAKAAREQVWKSLTKEEKSERIYPLISGDV  158
             T++YQAT  G A  G+ E+Q++ LI  +V+LA+ ARE       L +  ++   L++G V
Sbjct:    68 TASYQATPAGFAARGLDEAQSKALIGKSVELARKAREAY---LAENPQAGTL--LVAGSV  122

Query:   159 GPYAAFLADGSEYTGLYDIDKQGLKNFHRHRIELLLDEGVDILALETIPNAQEAEALIEL  218
             GPY A+LADGSEY G Y  +  + FHR R+E LLD G D+LA ET+PN  E EAL EL
Sbjct:   123 GPYGAYLADGSEYRGDYHCSVEAFQAFHRPRVEALLDAGADLLACETLPNFSEIEALAEL  182

Query:   219 LAEDFPQVEAYMSFTSQDGKTISDGSAVADLAKAIDVSPQVVALGINCSSPSLVADFLQA  278
             L   +P+  A+ SFT +D + +SDG+ + D+        PQVVALGINC +         LQ
Sbjct:   183 LTA-YPRARAWFSFTLRDSEHLSDGTPLRDVVALLAGYPQVVALGINCIALENTTAALQH  241

Query:   279 IAEQTNKPLVTYPNSGEVYDGASQSWQSSPDHSHTLLENTSDWQKLGAQVVGGCCRTRPA  338
             +    T PLV YPNSGE YD S++W     +H L +    WQ  GA+++GGCCRT PA
Sbjct:   242 LHGLTVLPLVVYPNSGEHYDAVSKTWHHHGEHCAQLADYLPQWQAAGARLIGGCCRTTPA  301
```

```
Query:  339 DIADLSA                                                345
            DIA L A
Sbjct:  302 DIAALKA                                                308
```

No corresponding DNA sequence was identified in *S. pyogenes*.

Based on this analysis, it was predicted that this protein and its epitopes, could be useful antigens for vaccines or diagnostics.

A related GBS gene <SEQ ID 8933> and protein <SEQ ID 8934> were also identified. Analysis of this protein sequence reveals the following:

```
Lipop: Possible site: -1 Crend: 5
McG: Discrim Score: 5.48
GvH: Signal Score (-7.5): -2.64
     Possible site: 20
>>> Seems to have an uncleavable N-term signal seq
ALOM program count: 1 value: -4.78 threshold: 0.0
     INTEGRAL        Likelihood = -4.78     Transmembrane    8-24 (7-25)
     PERIPHERAL      Likelihood = 2.49      259
modified ALOM score: 1.46

*** Reasoning Step: 3

----- Final Results -----
               bacterial membrane --- Certainty = 0.2911(Affirmative) < succ>
               bacterial outside  --- Certainty = 0.0000(Not Clear)   < succ>
               bacterial cytoplasm --- Certainty = 0.0000(Not Clear)  < succ>
```

The protein has homology with the following sequences in the databases:

```
ORF01312(412-1338 of 1644)
OMNI|NT01EC0303(55-357 of 358)conserved hypothetical protein
% Match = 23.8
% Identity = 46.6 % Similarity = 64.3
Matches = 142 Mismatches = 107 Conservative Sub.s = 54
      288       318       348       378       408       438       468       498
LISQSFCS*FRL*GLLGIAHNVLGFTSVFHLLFSAIFITNYVTRNGDLMGRFKELLESKKTLILHGALGTELESRGCDVS
                                 :: ||: :  |:| ||: ||||:|||:::
AWWPVLGWHSIQRRELRCGAGYRLLRCAMVLISLLNPETQNRSQNMSQNNPLRALLDKQDILLLDGAMATELEARGCNLA
          20        30        40        50        60        70        80

528       558       588       618       648       678       708       738
GKLWSAKYLIEDPAAIQTIHEDYIRAGADIVTTSTYQATLQGLAQVGVSESQTEDLIRLTVQLAKAAREQVWKSLTKEEK
|||| |:|:|    |: :|  || ||||     |::|||     |:|    |: |:|::  ||    :|:||: |||          |
DSLWSAKVLVENPELIREVHLDYYRAGAQCAITASYQATPAGFAARGLDEAQSKALIGKSVELARKARE-----AYLAEN
          100       110       120       130       140       150

768       798       828       858       888       918       948       978
SERIYPLISGDVGPYAAFLADGSEYTGLYDIDKQGLKNFHRHRIELLLDEGVDILALETIPNAQEAEALIELLAEDFPQV
 :    |::| ||||  |:||||||||  |    : ::  ||| |:|  ||| |:|| ||:|   |   | |||      :|:
PQAGTLLVAGSVGPYGAYLADGSEYRGDYHCSVEAFQAFHRPRVEALLDAGADLLACETLPNFSEIEALAELLT-AYPRA
          170       180       190       200       210       220       230

1008      1038      1068      1098      1128      1158      1188      1218
EAYMSFTSQDGKTISDGSAVADLAKAIDVSPQVVALGINCSSPSLVADFLQAIAEQTNKPLVTYPNSGEVYDGASQSWQS
|: |||  :| : :|||:  :  :         ||||||||| :       ||:     |   ||| ||||||  |   |::|:
RAWFSFTLRDSEHLSDGTPLRDVVALLAGYPQVVALGINCIALENTTAALQHLHGLTVLPLVVYPNSGEHYDAVSKTWHH
          250       260       270       280       290       300       310

1248      1278      1308      1338      1368      1398      1428      1458
SPDHSHTLLENTSDWQKLGAQVVGGCCRTRPADIADLSAHLK*VKYLEEG*GKFDFLFQSTRKPAWILPNGFCFYLSEMT
  :|    |:    ||   ||:::|||||| ||||| |
HGEHCAQLADYLPQWQAAGARLIGGCCRTTPADIAALKARS
          330       340       350
```

SEQ ID 8934 (GBS381) was expressed in *E. coli* as a His-fusion product. SDS-PAGE analysis of total cell extract is shown in FIG. 68 (lane 6; MW 42 kDa). It was also expressed in *E. coli* as a GST-fusion product. SDS-PAGE analysis of total cell extract is shown in FIG. 72 (lane 4; MW 66.9 kDa).

EXAMPLE 1912

A DNA sequence (GBSx2021) was identified in *S. agalactiae* <SEQ ID 5927> which encodes the amino acid sequence <SEQ ID 5928>. Analysis of this protein sequence reveals the following:

```
Possible site: 51
>>> Seems to have no N-terminal signal sequence

----- Final Results -----
              bacterial cytoplasm --- Certainty = 0.2996(Affirmative) < succ>
               bacterial membrane --- Certainty = 0.0000(Not Clear)   < succ>
                 bacterial outside --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1913

A DNA sequence (GBSx2022) was identified in *S. agalactiae* <SEQ ID 5929> which encodes the amino acid sequence <SEQ ID 5930>. Analysis of this protein sequence reveals the following:

```
Possible site: 59
>>> Seems to have no N-terminal signal sequence
     INTEGRAL       Likelihood = -11.62      Transmembrane    176-192  (168-198)
     INTEGRAL       Likelihood = -11.57      Transmembrane     89-105  (80-111)
     INTEGRAL       Likelihood = -10.03      Transmembrane    337-353  (332-359)
     INTEGRAL       Likelihood =  -9.87      Transmembrane    292-308  (285-316)
     INTEGRAL       Likelihood =  -4.51      Transmembrane     58-74   (52-78)
     INTEGRAL       Likelihood =  -3.88      Transmembrane    267-283  (267-286)
     INTEGRAL       Likelihood =  -3.08      Transmembrane    125-141  (125-142)
     INTEGRAL       Likelihood =  -2.13      Transmembrane    212-228  (212-228)

----- Final Results -----
               bacterial membrane --- Certainty = 0.5649(Affirmative) < succ>
                bacterial outside --- Certainty = 0.0000(Not Clear)   < succ>
              bacterial cytoplasm --- Certainty = 0.0000(Not Clear)   < succ>
```

A related GBS nucleic acid sequence <SEQ ID 9377> which encodes amino acid sequence <SEQ ID 9378> was also identified.

The protein has homology with the following sequences in the GENPEPT database.

```
>GP: CAB12034 GB: Z99105 similar to histidine permease [Bacillus
subtilis]
Identities = 221/384 (57%), Positives = 291/384 (75%), Gaps = 2/384 (0%)

Query:   2 PVTGSFHTYATKFISPGTGFTVAWLYWICWTVALGTEFLGAAMLMQRWFPNVPAWAFASF    61
            PVTG+FHTYA K+I PGTGFTVAWLYW+ WTVALG+EF  A +LMQRWFP+    W +++
Sbjct:  76 PVTGAFHTYAAKYIGPGTGFTVAWLYWLTWTVALGSEFTAAGLLMQRWFPHTSVWMWSAV   135

Query:  62 FALVIFGLNALSVRFFAEAESFFSSIKVIAIIIFIILGLGAMFGLVSFEGQHKAILETHL   121
           FAL IF LNA SV+FFAE+E +FSSIKV+AI++FI+LG  AMFG++  +G    A +++
Sbjct: 136 FALFIFLLNAFSVKFFAESEFWFSSIKVLAIVLFILLGGSAMFGIIPIKGGEAAPMLSNF   195

Query: 122 TANGA-FPNGIVAVVSVMLAVNYAFSGTELIGIAAGETDNPKEAVPRAIKTTIGRLVVFF   180
            TA G   FPNG V ++  ML+VN+AFSGTELIGIAAGE+ +P + +P+AIKTT+ RL +FF
Sbjct: 196 TAEGGLFPNGFVPILMTMLSVNFAFSGTELIGIAAGESVDPDKTIPKAIKTTVWRLSLFF   255

Query: 181 VLTIVVLASLLPMKEAGVSTAPFVDVFDKMGIPFTADIMNFVILTAILSAGNSGLYASSR   240
            V TI VL+ L+P+++AGV  +PFV VFD++G+P+ ADIMNFVILTAILSA NSGLYASSR
Sbjct: 256 VGTIFVLSGLIPIQDAGVIKSPFVAVFDRVGVPYAADIMNFVILTAILSAANSGLYASSR   315

Query: 241 MLWSLANEGMLSKSVVKINKHGVPMRALLLSMAGAVLSLFSSIYAADTVYLALVSIAGFA   300
            MLWSL+ E  L  + K+    G P  AL+ SM G +LSL SS++A DTVY+ LVSI+GFA
Sbjct: 316 MLWSLSKEKTLHPTFAKLTSKGTPFNALVFSMIGGILSLLSSVFAPDTVYVVLVSISGFA   375

Query: 301 VVVVWLAIPVAQINFRKEFLKE-NQLEDLSYKTPFTPVLPYITIILLLISIVGIAWDSSQ   359
            VVVVW+  I  +Q FRK +++  N++ DL Y+TP  P +P    +L L S+VGIA+D +Q
Sbjct: 376 VVVVWMGIAASQFMFRKRYIEAGNKVTDLKYRTPLYPFVPIAAFLLCLASVVGIAFDPNQ   435
```

```
Query: 360 RAGLYFGVPFIIFCYIYHKLRYKK                                      383
            R  LY GVPF+  CY  + ++ +K
Sbjct: 436 RIALYCGVPFMAICYAIYYVKNRK                                      459
```

There is also homology to SEQ ID 4070.

Based on this analysis, it was predicted that this protein and its epitopes, could be useful antigens for vaccines or diagnostics.

EXAMPLE 1914

A DNA sequence (GBSx2023) was identified in *S. agalactiae* <SEQ ID 5931> which encodes the amino acid sequence <SEQ ID 5932>. Analysis of this protein sequence reveals the following:

```
Possible site: 32
>>> Seems to have no N-terminal signal sequence

----- Final Results -----
          bacterial cytoplasm --- Certainty = 0.2378(Affirmative) < succ>
          bacterial membrane  --- Certainty = 0.0000(Not Clear)   < succ>
          bacterial outside   --- Certainty = 0.0000(Not Clear)   < succ>
```

There is also homology to SEQ ID 5642.

Based on this analysis, it was predicted that this protein and its epitopes, could be useful antigens for vaccines or diagnostics.

EXAMPLE 1915

A DNA sequence (GBSx2024) was identified in *S. agalactiae* <SEQ ID 5933> which encodes the amino acid sequence <SEQ ID 5934>. Analysis of this protein sequence reveals the following:

```
Possible site: 25
>>> Seems to have no N-terminal signal sequence

----- Final Results -----
          bacterial cytoplasm --- Certainty = 0.4935(Affirmative) < succ>
          bacterial membrane  --- Certainty = 0.0000(Not Clear)   < succ>
          bacterial outside   --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1916

A DNA sequence (GBSx2025) was identified in *S. agalactiae* <SEQ ID 5935> which encodes the amino acid sequence <SEQ ID 5936>. Analysis of this protein sequence reveals the following:

```
Possible site: 42
>>> Seems to have no N-terminal signal sequence

----- Final Results -----
          bacterial cytoplasm --- Certainty = 0.0530(Affirmative) < succ>
          bacterial membrane  --- Certainty = 0.0000(Not Clear)   < succ>
          bacterial outside   --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1917

A DNA sequence (GBSx2026) was identified in *S. agalactiae* <SEQ ID 5937> which encodes the amino acid sequence <SEQ ID 5938>. Analysis of this protein sequence reveals the following:

```
Possible site: 17
>>> Seems to have no N-terminal signal sequence

----- Final Results -----
            bacterial cytoplasm --- Certainty = 0.0175(Affirmative) < succ>
            bacterial membrane  --- Certainty = 0.0000(Not Clear)   < succ>
             bacterial outside  --- Certainty = 0.0000(Not Clear)   < succ>
```

The protein has homology with the following sequences in the GENPEPT database.

```
>GP:AAF63739 GB:AF236863 hypothetical GTP-binding protein [Lactococcus lactis]
Identities = 142/193 (73%), Positives = 165/193 (84%)

Query:     6 LNTHNASILLSAANKSHYPQDDLPEVALAGRSNVGKSSFINTLLGRKNLARTSSKPGKTQ   65
             +NT+N +I +SAA+K  YP++D PE+ALAGRSNEGKSSFINTLL RKN ARTS +PGKTQ
Sbjct:     3 INTNNLTITISAASKKQYPENDWPEIALAGRSNVGKSSFINTLLNRKNFARTSGQPGKTQ   62

Query:    66 LLNFYNIDDKLRFVDVPGYGYAKVSKTERAKWGKMIEEYLVTRDNLRVVVSLVDFRHDPS  125
             LLNFYNIDD+L FVDVPGYGYA+VSK ER KWGKMIEEYL TR+NL+ VVSLVD RH+PS
Sbjct:    63 LLNFYNIDDQLHFVDVPGYGYARVSKKEREKWGKMIEEYLTTRENLKAVVSLVDIRHEPS  122

Query:   126 ADDIQMYEFLKYYEIPVIIVATKADKIPRGKWNKHESSIKKKLNFDKKDHFIVFSSVDRT  185
              DD+ MYEFLKYY IPVI+VATKADK+PRGKWNKHES IKK + FD  D FI+FSS D+T
Sbjct:   123 EDDLMMYEFLKYYHIPVILVATKADKVPRGKWNKHESIIKKAMKFDSTDDFIIFSSTDKT  182

Query:   186 GLDESWDTILSEL                                                198
             G++E+W  IL  L
Sbjct:   183 GIEEAWTAILKYL                                                195
```

A related DNA sequence was identified in *S. pyogenes* <SEQ ID 5939> which encodes the amino acid sequence <SEQ ID 5940>. Analysis of this protein sequence reveals the following:

```
Possible site: 18
>>> Seems to have no N-terminal signal sequence

----- Final Results -----
            bacterial cytoplasm --- Certainty = 0.0123(Affirmative) < succ>
            bacterial membrane  --- Certainty = 0.0000(Not Clear)   < succ>
             bacterial outside  --- Certainty = 0.0000(Not Clear)   < succ>
```

An alignment of the GAS and GBS proteins is shown below.

```
Identities = 167/196 (85%), Positives = 183/196 (93%)

Query:     3 EEFLNTHNASILLSAANKSHYPQDDLPEVALAGRSNVGKSSFINTLLGRKNLARTSSKPG   62
             E+ LNTHNASILLSAANKSHYPQDDLPE+ALAGRSNVGKSSFINT+LGRKNLARTSSKPG
Sbjct:     4 EQVLNTHNASILLSAANKSHYPQDDLPEIALAGRSNVGKSSFINTILGRKNLARTSSKPG   63

Query:    63 KTQLLNFYNIDDKLRFVDVPGYGYAKVSKTERAKWGKMIEEYLVTRDNLRVVVSLVDFRH  122
             KTQLLNF+NIDDKLRFVDVPGYGYAKVSK+ERAKWGKMIEEYL +RDNLR VVSLVD RH
Sbjct:    64 KTQLLNFFNIDDKLRFVDVPGYGYAKVSKSERAKWGKMIEEYLTSRDNLRAVVSLVDLRH  123

Query:   123 DPSADDIQMYEFLKYYEIPVIIVATKADKIPRGKWNKHESSIKKKLNFDKKDHFIVFSSV  182
              PS +DIQMY+FLKYY+IPVI+VATKADKIPRGKWNKHES +KK LNFDR D FIVFSSV
Sbjct:   124 APSKEDIQMYDFLKYYDIPVIVVATKADKIPRGKWNKHESVVKKALNFDKSDTFIVFSSV  183

Query:   183 DRTGLDESWDTILSEL                                             198
             +R G+D+SWD IL ++
Sbjct:   184 ERIGIDDSWDAILEQV                                             199
```

Based on this analysis, it was predicted that these proteins and their epitopes could be useful antigens for vaccines or diagnostics.

EXAMPLE 1918

A DNA sequence (GBSx2027) was identified in *S. agalactiae* <SEQ ID 5941> which encodes the amino acid sequence <SEQ ID 5942>. This protein is predicted to be protease ClpX (clpX). Analysis of this protein sequence reveals the following:

```
Possible site: 50
>>> Seems to have no N-terminal signal sequence

----- Final Results -----
              bacterial cytoplasm --- Certainty = 0.2389(Affirmative) < succ>
              bacterial membrane  --- Certainty = 0.0000(Not Clear)   < succ>
              bacterial outside   --- Certainty = 0.0000(Not Clear)   < succ>
```

A related GBS nucleic acid sequence <SEQ ID 9947> which encodes amino acid sequence <SEQ ID 9948> was also identified.

The protein has homology with the following sequences in the GENPEPT database.

```
>GP:AAF63738 GB:AF236863 protease ClpX [Lactococcus lactis]
Identities = 305/395 (77%), Positives = 357/395 (90%), Gaps = 1/395 (0%)

Query:   18 NVYCSFCGKSQDEVKKIIAGNGVFICNECVALSQEIIKEELAEEVLADLAEVPKPKELLE    77
            N+ CSFCGKSQD+VKK+IAG+ V+ICNEC+ LS   I++EEL EE  +++ EV  PKE+ +
Sbjct:    8 NIQCSFCGKSQDDVKKMIAGSDVYICNECIELSTRILEEELKEEQDSEMLEVKTPKEMFD    67

Query:   78 ILNQYVVGQDRAKRALAVAVYNHYKRVSYTESS-DDDVDLQKSNILMIGPTGSGKTFLAQ   136
            +LN+YV+GQ++AKRALAVAVYNHYKR+++T S    +D++LQKSNIL+IGPTGSGKTFLAQ
Sbjct:   68 HLNEYVIGQEKAKRALAVAVYNHYKRINFTASKIAEDIELQKSNILLIGPTGSGKTFLAQ   127

Query:  137 TLAKSLNVPFAIADATSLTEAGYVGEDVENILLKLIQAADYNVERAERGIIYVDEIDKIA   196
            TLAKSLNVPFAIADATSLTEAGYVGEDVENILLKL+QA+D+N+ERAERGIIY+DEIDKIA
Sbjct:  128 TLAKSLNVPFAIADATSLTEAGYVGEDVENILLKLLQASDFNIERAERGIIYIDEIDKIA   187

Query:  197 KKGENVSITRDVSGEGVQQALLKIIEGTVASVPPQGGRKHPNQEMIQINTKNILFIVGGA   256
            KK+ENVSITRDVSGEGVQQALLKIIEGTVASVPPQGGRKHPNQEMIQI+TKNILFIVGGA
Sbjct:  188 KKSENVSITRDVSGEGVQQALLKIIEGTVASVPPQGGRKHPNQEMIQIDTKNILFIVGGA   247

Query:  257 FDGIEDLVKQRLGEKVIGFGQTSRKIDDNASYMQEIISEDIQKFGLIPEFIGRLPVVAAL   316
            FDGIE++VKQRLGEK+IGFG  ++K+ D  SYMQEII+EDIQKFGLIPEFIGRLP+VAAL
Sbjct:  248 FDGIEEIVKQRLGEKIIGFGANNKKLSDEDSYMQEIIAEDIQKFGLIPEFIGRLPIVAAL   307

Query:  317 ELLTAEDLVRILTEPRNALVKQYQTLLSYDGVELEFDQDALLAIADKAIERKTGARGLRS   376
            E LT EDL++ILTEP+NAL+KQY+ LL +D VELEF   AL+AIA KAIERKTGARGLRS
Sbjct:  308 ERLTEEDLIQILTEPKNALIKQYKQLLLFDNVELEFKDGALMAIAKKAIERKTGARGLRS   367

Query:  377 IIEETMLDIMFEIPSQEDVTKVRITKAAVEGTDKP                           411
            IIEE M+DIMFE+PS E++TKV IT+A V+G  +P
Sbjct:  368 IIEEVMMDIMFEVPSHEEITKVIITEAVVDGKAEP                           402
```

A related DNA sequence was identified in *S. pyogenes* <SEQ ID 5943> which encodes the amino acid sequence <SEQ ID 5944>. Analysis of this protein sequence reveals the following:

```
Possible site: 42
>>> Seems to have no N-terminal signal sequence

----- Final Results -----
              bacterial cytoplasm --- Certainty = 0.2711(Affirmative) < succ>
              bacterial membrane  --- Certainty = 0.0000(Not Clear)   < succ>
              bacterial outside   --- Certainty = 0.0000(Not Clear)   < succ>
```

An alignment of the GAS and GBS proteins is shown below.

```
Identities = 378/409 (92%), Positives = 393/409 (95%), Gaps = 1/409 (0%)

Query:    9 MAGNRNNDMNVYCSFCGKSQDEVKKIIAGNGVFICNECVALSQEIIKEELAEEVLADLAE   68
            MAG+R ND+ VYCSFCGKSQD+VKKIIAGN VFICNECVALSQEIIKEELAEEVLADL E
Sbjct:    1 MAGSRTNDIKVYCSFCGKSQDDVKKIIAGNNVFICNECVALSQEIIKEELAEEVLADLTE   60

Query:   69 VPKPKELLEILNQYVVGQDRAKRALAVAVYNHYKRVSYTES-SDDDVDLQKSNILMIGPT  127
            VPKPKELL++LNQYVVGQDRAKRAL+VAVYNHYKRVS+TES DDDVDLQKSNILMIGPT
Sbjct:   61 VPKPKELLDVLNQYVVGQDRAKRALSVAVYNHYKRVSFTESRDDDDVDLQKSNILMIGPT  120

Query:  128 GSGKTFLAQTLAKSLNVPFAIADATSLTEAGYVGEDVENILLKLIQAADYNVERAERGII  187
            GSGKTFLAQTLAKSLNVPFAIADATSLTEAGYVGEDVENILLKLIQAADYNVERAERGII
Sbjct:  121 GSGKTFLAQTLAKSLNVPFAIADATSLTEAGYVGEDVENILLKLIQAADYNVERAERGII  180

Query:  188 YVDEIDKIAKKGENVSITRDVSGEGVQQALLKIIEGTVASVPPQGGRKHPNQEMIQINTK  247
            YVDEIDKIAKKGENVSITRDVSGEGVQQALLKIIEGTVASVPPQGGRKHPNQEMIQI+TK
Sbjct:  181 YVDEIDKIAKKGENVSITRDVSGEGVQQALLKIIEGTVASVPPQGGRKHPNQEMIQIDTK  240

Query:  248 NILFIVGGAFDGIEDLVKQRLGEKVIGFGQTSRKIDDNASYMQEIISEDIQKFGLIPEFI  307
            NILFIVGGAFDGIE++VKQRLGEKVIGFGQ SRKIDDNASYMQEIISEDIQKFGLIPEFI
Sbjct:  241 NILFIVGGAFDGIEEIVKQRLGEKVIGFGQNSRKIDDNASYMQEIISEDIQKFGLIPEFI  300

Query:  308 GRLPVVAALELLTAEDLVRILTEPRNALVKQYQTLLSYDGVELEFDQDALLAIADKAIER  367
            GRLPVVAALE L   DL++ILTEPRNALVKQYQ LLSYDGVEL FD++AL AIA+KAIER
Sbjct:  301 GRLPVVAALEQLNTSDLIQILTEPRNALVKQYQALLSYDGVELAFDKEALEAIANKAIER  360

Query:  368 KTGARGLRSIIEETMLDIMFEIPSQEDVTKVRITKAAVEGTDKPVLETA            416
            KTGARGLRSIIEETMLDIMFEIPSQEDVTKVRITKAAVEG  KPVLETA
Sbjct:  361 KTGARGLRSIIEETMLDIMFEIPSQEDVTKVRITKAAVEGKSKPVLETA            409
```

Based on this analysis, it was predicted that these proteins and their epitopes could be useful antigens for vaccines or diagnostics.

EXAMPLE 1919

A DNA sequence (GBSx2028) was identified in *S. agalactiae* <SEQ ID 5945> which encodes the amino acid sequence <SEQ ID 5946>. Analysis of this protein sequence reveals the following:

```
Possible site: 26
>>> Seems to have an uncleavable N-term signal seq

----- Final Results -----
            bacterial membrane --- Certainty = 0.0000(Not Clear) < succ>
             bacterial outside --- Certainty = 0.0000(Not Clear) < succ>
           bacterial cytoplasm --- Certainty = 0.0000(Not Clear) < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1920

A DNA sequence (GBSx2029) was identified in *S. agalactiae* <SEQ ID 5947> which encodes the amino acid sequence <SEQ ID 5948>. Analysis of this protein sequence reveals the following:

```
Possible site: 36
>>> Seems to have no N-terminal signal sequence

----- Final Results -----
           bacterial cytoplasm --- Certainty = 0.4029(Affirmative) < succ>
            bacterial membrane --- Certainty = 0.0000(Not Clear)   < succ>
             bacterial outside --- Certainty = 0.0000(Not Clear)   < succ>
```

A related GBS nucleic acid sequence <SEQ ID 9949> which encodes amino acid sequence <SEQ ID 9950> was also identified.

The protein has homology with the following sequences in the GENPEPT database.

```
>GP:AAC33872 GB:AF055727 dihydrofolate
reductase [Streptococcus pneumoniae]
Identities = 83/162 (51%), Positives = 118/162 (72%),
Gaps = 1/162 (0%)

Query:    25 MTKQIIAIWAEDEDHLIGVNGGLPWRLPKELHHFKETTMGQALLMGRKTFDGMNRRVLPG    84
             MTK+I+AIWA+DE+ LIG   LPW LP EL HFKETT+  A+LMGR TFDGM RR+LP
Sbjct:     1 MTKKIVAIWAQDEEGLIGKENRLPWHLPAELQHFKETTLNHAILMGRVTFDGMGRRLLPK   60

Query:    85 RETIILTKDEQFQADGVTVLNSVEQVIKWFQEHNKTLFIVGGASIYKAFLPYCEAIIKTK  144
             RET+ILT++ + + DGV    V+ V+ W+Q+  K L+I+GG  I++AF PY + +I T
Sbjct:    61 RETLILTRNPEEKIDGVATFQDVQSVLDWYQDQEKNLYIIGGKQIFQAFEPYLDEVIVTH  120

Query:   145 VHGKFKGDTYFP-DVNLSEFKVISRDYFEKDEQNAHAFTVTY                   185
             +H + +GDTYFP +++LS F+ +S   ++ KDE+N + FT+ Y
Sbjct:   121 IHARVEGDTYFPEELDLSLFETVSSKFYAKDEKNPYDFTIQY                  162
```

A related DNA sequence was identified in *S. pyogenes* <SEQ ID 5949> which encodes the amino acid sequence <SEQ ID 5950>. Analysis of this protein sequence reveals the following:

```
Possible site: 51
>>> Seems to have no N-terminal signal sequence

----- Final Results -----
          bacterial cytoplasm --- Certainty = 0.1214(Affirmative) < succ>
          bacterial membrane  --- Certainty = 0.0000(Not Clear)   < succ>
          bacterial outside   --- Certainty = 0.0000(Not Clear)   < succ>
```

An alignment of the GAS and GBS proteins is shown below.

```
Identities = 82/160 (51%), Positives = 119/160 (74%)

Query:    25 MTKQIIAIWAEDEDHLIGVNGGLPWRLPKELHHFKETTMGQALLMGRKTFDGMNRRVLPG   84
             MTK+IIAIWAEDE  LIG+ G LPW LPKEL HFK+TT+ QA+LMGR TF+GMN + LP
Sbjct:     1 MTKEIIAIWAEDEAGLIGIAGKLPWYLPKELEHFKKTTLHQAILMGRVTFEGMNCKRLPQ   60

Query:    85 RETIILTKDEQFQADGVTVLNSVEQVIKWFQEHNKTLFIVGGASIYKAFLPYCEAIIKTK  144
             R+T+++T++  +Q D V  + S+E+V++W+    +KTL+I+GG  + +AF  Y   IIKT
Sbjct:    61 RQTLVMTRNRDYQVDEVLTMTSIEKVLEWYHAQDKTLYIIGGNKVLEAFNGYFDRIIKTV  120

Query:   145 VHGKFKGDTYFPDVNLSEFKVISRDYFEKDEQNAHAFTVT                     184
             +H +FKGDTY P+++ S F   S+ ++ +D +N + FTVT
Sbjct:   121 IHHRFKGDTYRPNLDFSHFTQESQTFYARDAKNPYDFTVT                    160
```

Based on this analysis, it was predicted that these proteins and their epitopes could be useful antigens for vaccines or diagnostics.

EXAMPLE 1921

A DNA sequence (GBSx2030) was identified in *S. agalactiae* <SEQ ID 5951> which encodes the amino acid sequence <SEQ ID 5952>. Analysis of this protein sequence reveals the following:

```
Possible site: 45
>>> Seems to have no N-terminal signal sequence

----- Final Results -----
          bacterial cytoplasm --- Certainty = 0.1577(Affirmative) < succ>
          bacterial membrane  --- Certainty = 0.0000(Not Clear)   < succ>
          bacterial outside   --- Certainty = 0.0000(Not Clear)   < succ>
```

The protein has homology with the following sequences in the GENPEPT database.

```
>GP:AAA25221 GB:M33770 thymidylate synthase (EC 2.1.1.45)
[Lactococcus lactis]
Identities = 215/280 (76%), Positives = 245/280 (86%), Gaps = 2/280 (0%)

Query:     1 MTKADLLFKDNITKIMSEGVFSEQARPRYKNGEMANSKYITGAFAEYDLSKGEFPITTLR    60
             MT AD +FK NI  I+  GVFSE ARP+YK+G+MANSKY+TG+F  YDL KGEFPITTLR
Sbjct:     1 MTYADQVFKQNIQNILDNGVFSENARPKYKDGQMANSKYVTGSFVTYDLQKGEFPITTLR    60

Query:    61 PIPIKSAIKEIFWIYQDQTNDLAVLNDKYGVTYWNDWEVGHTGTIGQRYGAVVKKHNIIS   120
             PIPIKSAIKE+ WIYQDQT++L+VL +KYGV YW +W +G   GTIGQRYGA VKK+NII
Sbjct:    61 PIPIKSAIKELMWIYQDQTSELSVLEEKYGVKYWGEWGIGD-GTIGQRYGATVKKYNIIG   119

Query:   121 KLLKQLEDNPWNRRNVISLWDYEAFEETEGLLPCAFQTMFDVRRV-NGELYLDATLTQRS   179
             KLL+ L  NPWNRRN+I+LW YE FEETEGLLPCAFQTMFDVRR  +G++YLDATL QRS
Sbjct:   120 KLLEGLAKNPWNRRNIINLWQYEDFEETEGLLPCAFQTMFDVRREKDGQIYLDATLIQRS   179

Query:   180 NDMLVAHHINAMQYVALQMMIAKHFGWRVGKFFYFINNLHIYDNQFEQAQELLKRQPSEC   239
             NDMLVAHHINAMQYVALQMMIAKHF W+VGKFFYF+NNLHIYDNQFEQA EL+KR  SE
Sbjct:   180 NDMLVAHHINAMQYVALQMMIAKHFSWKVGKFFYFVNNLHIYDNQFEQANELMKRTASEK   239

Query:   240 NPKLVLNVPDGTDFFDIKPDDFALVDYDPIKPQLRFDLAI                      279
             P+LVLNVPDGT+FFDIKP+DF LVDY+P+KPQL FDLAI
Sbjct:   240 EPRLVLNVPDGTNFFDIKPEDFELVDYEPVKPQLKFDLAI                      279
```

A related DNA sequence was identified in *S. pyogenes* <SEQ ID 5953> which encodes the amino acid sequence <SEQ ID 5954>. Analysis of this protein sequence reveals the following:

```
Possible site: 53
>>> Seems to have no N-terminal signal sequence

----- Final Results -----
               bacterial cytoplasm --- Certainty = 0.3131(Affirmative) < succ>
               bacterial membrane  --- Certainty = 0.0000(Not Clear)   < succ>
                bacterial outside  --- Certainty = 0.0000(Not Clear)   < succ>
```

An alignment of the GAS and GBS proteins is shown below.

```
Identities = 227/279 (81%), Positives = 251/279 (89%)

Query:     1 MTKADLLFKDNITKIMSEGVFSEQARPRYKNGEMANSKYITGAFAEYDLSKGEFPITTLR    60
             MTKAD +FK NI KI++EG  SEQARP+YK+G  A+SKYITGAFAEYDL+KGEFPITTLR
Sbjct:     9 MTKADQIFKANIQKIINEGSLSEQARPKYKDGRTAHSKYITGAFAEYDLAKGEFPITTLR    68

Query:    61 PIPIKSAIKEIFWIYQDQTNDLAVLNDKYGVTYWNDWEVGHTGTIGQRYGAVVKKHNIIS   120
             PIPIKSAIKE+FWIYQDQ+N L VL  KY V YWN+WEV  T TIGQRYGAVVKKH+IIS
Sbjct:    69 PIPIKSAIKELFWIYQDQSNSLDVLEAKYNVHYWNEWEVDQTRTIGQRYGAVVKKHDIIS   128

Query:   121 KLLKQLEDNPWNRRNVISLWDYEAFEETEGLLPCAFQTMFDVRRVNGELYLDATLTQRSN   180
             K+LKQL +NPWNRRNVISLWDYEAFEET+GLLPCAFQ MFDVRRV +LYLDA+LTQRSN
Sbjct:   129 KILKQLAENPWNRRNVISLWDYEAFEETKGLLPCAFQIMFDVRRVGEDLYLDASLTQRSN   188

Query:   181 DMLVAHHINAMQYVALQMMIAKHFGWRVGKFFYFINNLHIYDNQFEQAQELLKRQPSECN   240
             D+LVAHHINAMQYVALQMMIAKHFGW++GKFFYF+NNLHIYDNQF+QAQELLKRQP
Sbjct:   189 DILVAHHINAMQYVALQMMIAKHFGWKIGKFFYFVNNLHIYDNQFDQAQELLKRQPVASQ   248

Query:   241 PKLVLNVPDGTDFFDIKPDDFALVDYDPIKPQLRFDLAI                       279
             PKLVLNVPD T+FFDIKPDDF L +YDP+KPQL FDLAI
Sbjct:   249 PKLVLNVPDRTNFFDIKPDDFELQNYDPVKPQLHFDLAI                       287
```

Based on this analysis, it was predicted that these proteins and their epitopes could be useful antigens for vaccines or diagnostics.

EXAMPLE 1922

A DNA sequence (GBSx2031) was identified in *S. agalactiae* <SEQ ID 5955> which encodes the amino acid sequence <SEQ ID 5956>. This protein is predicted to be HMG-CoA synthase. Analysis of this protein sequence reveals the following:

```
Possible site: 60
>>> Seems to have no N-terminal signal sequence

----- Final Results -----
            bacterial cytoplasm --- Certainty = 0.0816(Affirmative) < succ>
            bacterial membrane  --- Certainty = 0.0000(Not Clear)   < succ>
             bacterial outside  --- Certainty = 0.0000(Not Clear)   < succ>
```

A related DNA sequence was identified in *S. pyogenes* <SEQ ID 5957> which encodes the amino acid sequence <SEQ ID 5958>. Analysis of this protein sequence reveals the following:

```
Possible site: 58
>>> Seems to have no N-terminal signal sequence

----- Final Results -----
            bacterial cytoplasm --- Certainty = 0.1670(Affirmative) < succ>
            bacterial membrane  --- Certainty = 0.0000(Not Clear)   < succ>
             bacterial outside  --- Certainty = 0.0000(Not Clear)   < succ>
```

An alignment of the GAS and GBS proteins is shown below.

```
Identities = 260/385 (67%), Positives = 325/385 (83%)

Query:  36 MKIGIDKIGFATSQYVLEMTDLAIARQVDPEKFSKGLLLDSLSITPVTEDIVTLAASAAN   95
           M IGIDKIGFATSQYVL++ DLA+ARQVDP KFS+GLL++S S+ P+TEDI+TLAASAA+
Sbjct:  14 MTIGIDKIGFATSQYVLKLEDLALARQVDPAKFSQGLLIESFSVAPITEDIITLAASAAD   73

Query:  96 DILSDEDKETIDMVIVATESSIDQSKAASVYVHQLLEIQPFARSFEMKEACYSATAALDY  155
              IL+DED+  IDMVI+ATESS DQSKA+++YVH L+ IQPFARSFE+K+ACYSATAALDY
Sbjct:  74 QILTDEDRAKIDMVILATESSTDQSKASAIYVHHLVGIQPFARSFEVKQACYSATAALDY  133

Query: 156 AKLHVEKHPDSKVLVIASDIAKYGIKSTGESTQGAGSIAMLISQNPSILELKEDHLAQTR  215
           AKLHV   PDS+VLVIASDIA+YG+ S GESTQG+GSIA+L++ NP IL L ED++AQTR
Sbjct: 134 AKLHVASKPDSRVLVIASDIARYGVGSPGESTQGSGSIALLVTANPRILALNEDNVAQTR  193

Query: 216 DIMDFWRPNYSDVPYVNGMFSTKQYLDMLKTTWKVYQKRFNTSLSDYAAFCFHIPFPKLA  275
           DIMDFWRPNYS  PYV+G++STKQYL+ L+TTW+ YQKR N  LSD AA CFHIPFPKLA
Sbjct: 194 DIMDFWRPNYSFTPYVDGIYSTKQYLNCLETTWQAYQKRENLQLSDLAAVCFHIPFPKLA  253

Query: 276 LKGFNKILDNNLDEQKKAELQENFEHSITYSKKIGNCYTGSLYLGLLSLLENSQNLKAGD  335
           LKG N I+DN + + + +L E F+ SI+YSK+IGN YTGSLYLGLLSLLENS+ L++GD
Sbjct: 254 LKGLNNIMDNTVPPEHREKLIEAFQASISYSKQIGNIYTGSLYLGLLSLLENSKVLQSGD  313

Query: 336 QIAFFSYGSGAVAEIFTGQLVDGYQNKLQSDRMDQLNKRQKITVTEYEKLFFEKTILDEN  395
           +I FFSYGSGAV+E ++GQLV GY   L ++R    L++R +++V++YE LF+E+   LD+N
Sbjct: 314 KIGFFSYGSGAVSEFYSGQLVAGYDKMLNTNRQALLDQRTRLSVSKYEDLFYEQVQLDDN  373

Query: 396 GNANFNTYRTGTFSLDSICEHQRIY                                    420
           GNANF+ Y TG F+L +I EH+RIY
Sbjct: 374 GNANFDIYLTGKFALTAIKEHRRIY                                    398
```

Based on this analysis, it was predicted that these proteins and their epitopes could be useful antigens for vaccines or diagnostics.

EXAMPLE 1923

A DNA sequence (GBSx2032) was identified in *S. agalactiae* <SEQ ID 5959> which encodes the amino acid sequence <SEQ ID 5960>. This protein is predicted to be HMG-CoA reductase (mvaA). Analysis of this protein sequence reveals the following:

```
Possible site: 50
>>> Seems to have no N-terminal signal sequence
     INTEGRAL    Likelihood = -1.49    Transmembrane    348-364 (348-364)
     INTEGRAL    Likelihood = -1.33    Transmembrane    53-69 (53-69)

----- Final Results -----
             bacterial membrane --- Certainty = 0.1595(Affirmative) < succ>
             bacterial outside  --- Certainty = 0.0000(Not Clear)   < succ>
             bacterial cytoplasm --- Certainty = 0.0000(Not Clear)  < succ>
```

The protein has homology with the following sequences in the GENPEPT database.

```
>GP:AAG02454 GB:AF290098 HMG-CoA reductase [Streptococcus pneumoniae]
Identities = 266/421 (63%), Positives = 343/421 (81%), Gaps = 3/421 (0%)

Query:    3  KISWTGFSKKSPEERIHYLEEQDFLADSSLEIVTNQDLLSLSLANQMAENVIGRIALPFS    62
             KISW GFSKKS +ER+  L+ Q  L+         +  + +S+++A+Q++ENV+G  +LP+S
Sbjct:    2  KISWNGFSKKSYQERLELLKAQALLSPERQASLEKDEQMSVTVADQLSENVVGTFSLPYS    61

Query:   63  LVPDVLVNGKVYQVPYVTEEPSVVAAASFAAKIIKRSGGFLTTVHNRKMIGQVALYDVQD   122
             LVP+VLVNG+ Y VPYVTEEPSVVAAAS+A+KIIKR+GGF   VH R+MIGQVALY V +
Sbjct:   62  LVPEVLVNGQGYTVPYVTEEPSVVAAASYASKIIKRAGGFTAQVHQRQMIGQVALYQVAN   121

Query:  123  SQHTKESILNQKQQLLEIANAAHPSIVKRGGGACDLTIEI---KEDFLIVYLMVDTKEAM   179
               + +E I ++K +LLE+AN A+PSIVKRGGGA DL +E    + DFL+VY+ VDT+EAM
Sbjct:  122  PKLAQEKIASKKAELLELANQAYPSIVKRGGGARDLHVEQIKGEPDFLVVYIHVDTQEAM   181

Query:  180  GANMVNTMMEALSSPLEDISKGKSLMSILSNYATESLVTATCRVDLRFLSRQKEEAIKLA   239
             GANM+NTM+EAL   LE++S+G+SLM ILSNYAT+SLVTA+CR+  R+LSRQK++  ++A
Sbjct:  182  GANMLNTMLEALKPVLEELSQGQSLMGILSNYATDSLVTASCRIAFRYLSRQKDQGREIA   241

Query:  240  QKMTMASQLAQVDPYRASTHNKGIFNGIDAIVLATGNDWRAIEAGAHTYAVKDGQYRGLS   299
             +K+  ASQ AQ DPYRA+THNKGIFNGIDAI++ATGNDWRAIEAGAH +A +DG+Y+GLS
Sbjct:  242  EKIALASQFAQADPYRAATHNKGIFNGIDAILIATGNDWRAIEAGAHAFASRDGRYQGLS   301

Query:  300  RWSYKVDDNCLEGTLTLPMPVATKGGSIGINPSVHLAHDLLGRPNAKELASIILSIGLAQ   359
                W+ ++   L G +TLPMPVATKGGSIG+NP V L+HDLLG P+A+ELA II+SIGLAQ
Sbjct:  302  CWTLDLEREELVGEMTLPMPVATKGGSIGLNPRVALSHDLLGNPSARELAQIIVSIGLAQ   361

Query:  360  NFAALKALVSTGIQAGHMKLQAKSLALLAGAKEEQISEVVKQLLDSKHMNLETAQKIVNKL   420
             NFAALKALVSTGIQ GHMKLQAKSLALLAGA E +++ +V++L+  K  NLETAQ+ +  L
Sbjct:  362  NFAALKALVSTGIQQGHMKLQAKSLALLAGASESEVAPLVERLISDKTFNLETAQRYLENL   422
```

A related DNA sequence was identified in *S. pyogenes* <SEQ ID 5961> which encodes the amino acid sequence <SEQ ID 5962>. Analysis of this protein sequence reveals the following:

```
Possible site: 31
>>> Seems to have no N-terminal signal sequence

----- Final Results -----
             bacterial cytoplasm --- Certainty = 0.3929(Affirmative) < succ>
             bacterial membrane  --- Certainty = 0.0000(Not Clear)   < succ>
             bacterial outside   --- Certainty = 0.0000(Not Clear)   < succ>
```

An alignment of the GAS and GBS proteins is shown below.

```
Identities = 257/422 (60%), Positives = 330/422 (77%)

Query:    2  TKISWTGFSKKSPEERIHYLEEQDFLADSSLEIVTNQDLLSLSLANQMAENVIGRIALPF    61
             T ++W+GFSKK+ EER+  +E+   L   +L    LL +  ANQM ENV+GR+ALPF
Sbjct:    4  TNLNWSGFSKKTFEERLQLIEKFKLLNAENLNQLKTDVLLPIQTANQMTENVLGRLALPF    63
```

```
-continued
Query:   62 SLVPDVLVNGKVYQVPYVTEEPSVVAAASFAAKIIKRSGGFLTTVHNRKMIGQVALYDVQ 121
            S+ PD LVNG  YQ+P+VTEEPSVVAAASFAAK+IKRSGGF      NR+MIGQ+ LYD+
Sbjct:   64 SIAPDFLVNGSTYQMPFVTEEPSVVAAASFAAKLIKRSGGFKAQTLNRQMIGQIVLYDID 123

Query:  122 DSQHTKESILNQKQQLLEIANAAHPSIVKRGGGACDLTIEIKEDFLIVYLMVDTKEAMGA 181
             + K +IL++ ++L+ +AN A+PSIVKRGGGA  + +E K +FLI YL VDT+EAMGA
Sbjct:  124 QIDNAKAAILHKTKKLIALANKAYPSIVKRGGGARTIHLEEKGEFLIFYLTVDTQEAMGA 183

Query:  182 NMVNTMMEALSSPLEDISKGKSLMSILSNYATESLVTATCRVDLRFLSRQKEEAIKLAQK 241
            NMVNTMMEAL    L  +SKG  LM+ILSNYATESLVT +C + +R L   K ++++LAQK
Sbjct:  184 NMVNTMMEALVPDLTRLSKGHCLMAILSNYATESLVTTSCEIPVRLLDHDKTKSLQLAQK 243

Query:  242 MTMASQLAQVDPYRASTHNKGIFNGIDAIVLATGNDWRAIEAGAHTYAVKDGQYRGLSRW 301
             + +AS+LAQVDPYRA+THNKGIFNGIDA+V+ATGNDWRAIEAGAH YA ++G Y+GLS+W
Sbjct:  244 IELASRLAQVDPYRATTHNKGIFNGIDAVVIATGNDWRAIEAGAHAYASRNGSYQGLSQW 303

Query:  302 SYKVDDNCLEGTLTLPMPVATKGGSIGINPSVHLAHDLLGRPNAKELASIILSIGLAQNF 361
             +  D    L G +TLPMP+A+KGGSIG+NP+V  +AHDLL +P+AK LA +I S+GLAQNF
Sbjct:  304 HFDQDKQVLLGQMTLPMPIASKGGSIGLNPTVSIAHDLLNQPDAKTLAQLIASVGLAQNF 363

Query:  362 AALKALVSTGIQAGHMKLQAKSLALLAGAKEEQISEVVKQLLDSKHMNLETAQKIVNKLT 421
            AALKAL S+GIQAGHMKL AKSLALLAGA +++I+ +V  LL  K +NLE A   +++L
Sbjct:  364 AALKALTSSGIQAGHMKLHAKSLALLAGATQDEIAPLVNALLADKPINLEKAHFYLSQLR 423

Query:  422 KS                                                            423
            +S
Sbjct:  424 QS                                                            425
```

Based on this analysis, it was predicted that these proteins and their epitopes could be useful antigens for vaccines or diagnostics.

EXAMPLE 1924

A DNA sequence (GBSx2033) was identified in *S. agalactiae* <SEQ ID 5963> which encodes the amino acid sequence <SEQ ID 5964>. Analysis of this protein sequence reveals the following:

```
Possible site: 52
>>> Seems to have no N-terminal signal sequence

----- Final Results -----
         bacterial cytoplasm --- Certainty = 0.2355(Affirmative) < succ>
         bacterial membrane  --- Certainty = 0.0000(Not Clear)   < succ>
         bacterial outside   --- Certainty = 0.0000(Not Clear)   < succ>
```

The protein has no significant homology with any sequences in the GENPEPT database.

A related DNA sequence was identified in *S. pyogenes* <SEQ ID 5965> which encodes the amino acid sequence <SEQ ID 5966>. Analysis of this protein sequence reveals the following:

```
Possible site: 53
>>> Seems to have no N-terminal signal sequence

----- Final Results -----
         bacterial cytoplasm --- Certainty = 0.2687(Affirmative) < succ>
         bacterial membrane  --- Certainty = 0.0000(Not Clear)   < succ>
         bacterial outside   --- Certainty = 0.0000(Not Clear)   < succ>
```

An alignment of the GAS and GBS proteins is shown below.

```
Identities = 76/138 (55%), Positives = 100/138 (72%), Gaps = 2/138 (1%)

Query:    7 PKWEELPELDLYLDQVLLYVNQLINPKTITNDKLLTASMINNYVKHNYISKPIKKKYNRR  66
            P W++LP+LDLYLDQVLLYVNQ +    ++++K LTASMINNYVKH Y++KPIKKKY ++
Sbjct:    7 PYWKDLPDLDLYLDQVLLYVNQCTDFSEVSDNKSLTASMINNYVKHGYVTKPIKKKYQKQ  66
```

-continued

```
Query:    67 QVARLIVITAFKQVFAIQEISQTLELLTADNHSEEAYNGFAACMNKEE--VHDLPPVVIS  124
             Q+ARLI I+ FK VF IQ+IS+ LE L A   SE  YN F  C N++      D+PP+V
Sbjct:    67 QLARLIAISLFKTVFPIQDISRVLEELQAQADSESLYNTFVTCWNQKAPIEEDIPPIVQV  126

Query:   125 ACQTLNLYQETQKLVLEL                                            142
             ACQT+  Y +T  L+ E+
Sbjct:   127 ACQTVKDYHKTIYLLQEV                                            144
```

Based on this analysis, it was predicted that these proteins and their epitopes could be useful antigens for vaccines or diagnostics.

EXAMPLE 1925

A DNA sequence (GBSx2034) was identified in *S. agalactiae* <SEQ ID 5967> which encodes the amino acid sequence <SEQ ID 5968>. This protein is predicted to be hemolysin iii. Analysis of this protein sequence reveals the following:

```
Possible site: 43
>>> Seems to have no N-terminal signal sequence
     INTEGRAL    Likelihood = -9.08    Transmembrane   142-158 (140-165)
     INTEGRAL    Likelihood = -6.79    Transmembrane    26-42  (19-44)
     INTEGRAL    Likelihood = -5.63    Transmembrane   200-216 (196-217)
     INTEGRAL    Likelihood = -5.41    Transmembrane   104-120 (102-121)
     INTEGRAL    Likelihood = -3.98    Transmembrane    51-67  (49-69)
     INTEGRAL    Likelihood = -1.86    Transmembrane   172-188 (169-188)

----- Final Results -----
           bacterial membrane --- Certainty = 0.4630(Affirmative) < succ>
            bacterial outside --- Certainty = 0.0000(Not Clear)   < succ>
          bacterial cytoplasm --- Certainty = 0.0000(Not Clear)   < succ>
```

A related GBS nucleic acid sequence <SEQ ID 9951> which encodes amino acid sequence <SEQ ID 9952> was also identified.

The protein has homology with the following sequences in the GENPEPT database.

```
>GP:CAA58877 GB:X84058 novel hemolytic factor [Bacillus cereus]
Identities = 79/204 (38%), Positives = 132/204 (63%), Gaps = 4/204 (1%)

Query:    17 EELANSITHAVGALLMLILLPITAVYSHNHFGLQAALGTSIFVTSLFLMFLSSSIYHSMT   76
             EE+AN+ITH +GA+L +   L I  +++  H       A +  +++  S+FL++L S++ HS+
Sbjct:    14 EEIANAITHGIGAILSIPALIILIIHASKHGTASAVVAFTVYGVSMFLLYLFSTLLHSIH   73

Query:    77 YNSLQKYVLBMIDHSMIYIAIAGSYTPVALSLIGGWLGYLIIFLQWGITLFGILYKIFAP  136
             +  ++K +  ++DHS IY+ IAG+YTP  L   G LG+ ++  + W + +  GI++KIF
Sbjct:    74 HPKVEK-LFTILDHSAIYLLIAGTYTPFLLITLRGPLGWTLLAIIWTLAIGGIIFKIFFV  132

Query:   137 KINDKFSLVLYLIMGWLVIF-IFPAIITKTGPAFWGLLLAGGICYTIGALFYA-RKRPYD  194
             +   K S +  Y+IMGWL+I  I P      TG F  LLLAGGI Y++GA+F+    K P++
Sbjct:   133 RRFIKASTLCYIIMGWLIIVAIKPLYENLTGHGF-SLLLAGGILYSVGAIFFLWSKLPFN  191

Query:   195 HMIWHLFILLASILQYIGIVYFML                                     218
             H IWHLF+L   S + +   +++++L
Sbjct:   192 HAIWHLFVLGGSAMMFFCVLFYVL                                     215
```

A related DNA sequence was identified in *S. pyogenes* <SEQ ID 5969> which encodes the amino acid sequence <SEQ ID 5970>. Analysis of this protein sequence reveals the following:

```
Possible site: 41
>>> Seems to have no N-terminal signal sequence
     INTEGRAL    Likelihood = -10.51   Transmembrane   144-160 (138-163)
     INTEGRAL    Likelihood = -9.87    Transmembrane    49-65  (45-71)
     INTEGRAL    Likelihood = -7.11    Transmembrane   198-214 (193-215)
     INTEGRAL    Likelihood = -6.16    Transmembrane   102-118 (100-120)
     INTEGRAL    Likelihood = -2.97    Transmembrane    20-36  (20-41)
     INTEGRAL    Likelihood = -1.01    Transmembrane   167-183 (167-185)
```

```
----- Final Results -----
              bacterial membrane --- Certainty = 0.5203(Affirmative) < succ>
              bacterial outside  --- Certainty = 0.0000(Not Clear)   < succ>
              bacterial cytoplasm --- Certainty = 0.0000(Not Clear)  < succ>
```

The protein has homology with the following sequences in the databases:

```
>GP:CAA58877 GB:X84058 novel hemolytic factor [Bacillus cereus]
Identities = 82/204 (40%), Positives = 128/204 (62%), Gaps = 4/204 (1%)

Query:   15 EEVANSVTHAIGAFAMLILLPISASYAYQTYDLKAAIGISIFVISLFLMFLSSTIYHSMA    74
            EE+AN++TH IGA   + L I  +A +    A +  +++ +S+FL++L ST+ HS+
Sbjct:   14 EEIANAITHGIGAILSIPALIILIIHASKHGTASAVVAFTVYGVSMFLLYLFSTLLHSIH    73

Query:   75 YGSVHKYILRIIDHSMIYIAIAGSYTPVALSLVSGWLGYIIIVLQWGITLFGILYKIFAK   134
            +  V K +  I+DHS IY+ IAG+YTP  L  + G LG+ ++ + W + + GI++KIF
Sbjct:   74 HPKVEK-LFTILDHSAIYLLIAGTYTPFLLITLRGPLGWTLLAIIWTLAIGGIIFKIFFV   132

Query:  135 RINEKFSLMLYIVMGWL-VVFILPVIIQKTSLAFGLLMLFGGLSYTIGAVFYA-KKRPYF   192
            R    K S + YI+HGWL +V I P+     T   F LL L GG+ Y++GA+F+  +K P+
Sbjct:  133 RRFIKASTLCYIIMGWLIIVAIKPLYENLTGHGFSLL-LAGGILYSVGAIFFLWEKLPFN   191

Query:  193 HHIWHLFILLASALQFIAITFFML                                      216
            H IWHLF+L  SA+ F   + F++L
Sbjct:  192 HAIWHLFVLGGSAMMFFCVLFYVL                                      215
```

An alignment of the GAS and GBS proteins is shown below.

```
Identities = 153/213 (71%), Positives = 181/213 (84%)

Query:    6 SIKLSPQLSFGEELANSITHAVGALLMLILLPITAVYSHNHFGLQAALGTSIFVTSLFLM    65
            + K S  LSF EE+ANS+THA+GA  MLILLPI+A Y++  + L+AA+G SIEV SLFLM
Sbjct:    4 TFKQSLPLSFSEEVANSVTHAIGAFAMLILLPISASYAYQTYDLKAAIGISIFVISLFLM    63

Query:   66 FLSSSIYHSMTYNSLQKYVLRMIDHSMIYIAIAGSYTPVALSLIGGWLGYLIIFLQWGIT   125
            FLSS+IYHSM Y S+ KY+LR+IDHSMIYIAIAGSYTPVALSL+ GWLGY+II LQWGIT
Sbjct:   64 FLSSTIYHSMAYGSVHKYILRIIDHSMIYIAIAGSYTPVALSLVSGWLGYIIIVLQWGIT   123

Query:  126 LFGILYKIFAPKINDKFSLVLYLIMGWLVIFIFPAIITKTGPAFWGLLLAGGICYTIGAL   185
            LFGILYKIFA +IN+KFSL+LY++MGWLV+FI P II KT  AF  L+L GG+ YTIGA+
Sbjct:  124 LFGILYKIFAKRINEKFSLMLYIVMGWLVVFILPVIIQKTSLAFGLLMLFGGLSYTIGAV   183

Query:  186 FYARKRPYDHMIWHLFILLASILQYIGIVYFML                             218
            FYA+KRPY HMIWHLFILLAS LQ+I I +FML
Sbjct:  184 FYAKKRPYFHMIWHLFILLASALQFIAITFFML                             216
```

Based on this analysis, it was predicted that these proteins and their epitopes could be useful antigens for vaccines or diagnostics.

EXAMPLE 1926

A DNA sequence (GBSx2035) was identified in *S. agalactiae* <SEQ ID 5971> which encodes the amino acid sequence <SEQ ID 5972>. Analysis of this protein sequence reveals the following:

```
Possible site: 52
>>> Seems to have no N-terminal signal sequence

----- Final Results -----
              bacterial cytoplasm --- Certainty = 0.3641(Affirmative) < succ>
              bacterial membrane  --- Certainty = 0.0000(Not Clear)   < succ>
              bacterial outside   --- Certainty = 0.0000(Not Clear)   < succ>
```

The protein has homology with the following sequences in the GENPEPT database.

```
>GP:CAB12492 GB:Z99107 similar to hypothetical proteins [Bacillus subtilis]
Identities = 81/302 (26%), Positives = 157/302 (51%), Gaps = 10/302 (3%)

Query:    1 MKSAYIFFNPKSGKDEQALAKEVKSYLIEHDFQDDY-VRIITPSSVEEAVALAKKASEDH    59
            MK A I +NP SG++ + K+  + +++ Q  Y   + +A    AK+A+
Sbjct:    1 MKRARIIYNPTSGRE---IFKKHLAQVLQKFEQAGYETSTHATTCAGDATHAAREAALRE    57

Query:   60 IDLVIPLGGDGTINKICGGVYAGGAYPTIGLVPAGTVNNFSKALNIPQERNL-ALENLLN   118
            DL+I GGDGTIN++ G+ PT+G++P GT N+F++AL IP+E L A + ++N
Sbjct:   58 FDLIIAAGGDGTINEVVNGLAPLDNRPTLGVIPVGTTNDFARALGIPREDILKAADTVIN   117

Query:  119 GHVKSVDICKVNDDYMISSLTLGLLADIAANVTSEMKRKLGPFAFLGDAYRILKRNRSYS   178
            G  + +DI +VN   Y I+ G L ++   +V S++K   LG   A+   +L R
Sbjct:  118 GVARPIDIGQVNGQYFINIAGGGRLTELTYDVPSKLKTMLGQLAYYLKGMEMLPSLRPTE   177

Query:  179 ITLAYDNNVRSLRTRLLLITMTNSIAGMPAFSPEATIDDGLFRVYTMEHIHFFKLLLHLR   238
            + +  YD   + L+T+TNS+ G   +P+++++DG+F +  ++   +  + +
Sbjct:  178 VEIEYDGKLFQGEIMLFLVTLTNSVGGFEKLAPDSSLNDGMFDLMILKKANLAEFIRVAT   237

Query:  239 QFRKGDFSQAKEIKHFHTNNLTISTFKRKKSAIPKVRIDGDPGDQLPVKVEVIPKALKFI   298
            +G+ + I +    N + ++    ++ +  ++ +DG+ G   LP +    + + +  +
Sbjct:  238 MALRGEHINDQHIIYTKANRVKVNVSEKM-----QLNLDGEYGGMLPGEFVNLYRHIHVV   292

Query:  299 IP   300
            +P
Sbjct:  293 MP   294
```

A related DNA sequence was identified in *S. pyogenes* <SEQ ID 5119> which encodes the amino acid sequence <SEQ ID 5120>. Analysis of this protein sequence reveals the following:

```
Possible site: 58
>>> Seems to have no N-terminal signal sequence

----- Final Results -----
            bacterial cytoplasm --- Certainty = 0.4258(Affirmative) < succ>
            bacterial membrane  --- Certainty = 0.0000(Not Clear)   < succ>
             bacterial outside  --- Certainty = 0.0000(Not Clear)   < succ>
```

An alignment of the GAS and GBS proteins is shown below.

```
Identities = 172/300 (57%), Positives = 229/300 (76%)

Query:    1 MKSAYIFFNPKSGKDEQALAKEVKSYLIEHDFQDDYVRIITPSSVEEAVALAKKASEDHI    60
            MK+  IF+NP SGK E  LA++VK Y  +H F +D V++ITP    ++A  LAK+A++D I
Sbjct:    1 MKTVRIFYNPNSGKKESQLARQVKDYFCQHGFSEDSVKVITPKDADQAFQLAKQAAKDKI    60

Query:   61 DLVIPLGGDGTINKICGGVYAGGAYPTIGLVPAGTVNNFSKALNIPQERNLALENLLNGH   120
            DLVIPLGGDGT+NKI GG+Y GGA+    IGLVP+GTVNNF+KA+++IP +    AL+ +L G
Sbjct:   61 DLVIPLGGDGTLNKIIGGIYEGGAHCLIGLVPSGTVNNFAKAMHIPLQITEALDTILTGQ   120

Query:  121 VKSVDICKVNDDYMISSLTLGLLADIAANVTSEMKRKLGPFAFLGDAYRILKRNRSYSIT   180
            +K VDICK N   YMISSLTLGLLADIAA+VT+E KR+ GP AFL D+ RILKRNRSY+I+
Sbjct:  121 IKQVDICKANQQYMISSLTLGLLADIAADVTAEEKRRFGPLAFLKDSIRILKRNRSYAIS   180

Query:  181 LAYDNNVRSLRTRLLLITMTNSIAGMPAFSPEATIDDGLFRVYTMEHIHFFKLLLHLRQF   240
            L   N+   L+T+ LLITMTN+IAG P+FSP A  DDG F+VYTM+ + FFK L H+  F
Sbjct:  181 LISHNHRIHLKTKFLLITMTNTIAGFPSFSPGAQADDGYFQVYTMKKVSFFKFLWHINDF   240

Query:  241 RRGDFSQAKEIKHFHTNNLTISTFKRKKSAIPKVRIDGDPGDQLPVKVEVIPKALKFIIP   300
            ++GDFS+A+EI HF  N L++    +K++ +P+ RIDGD   D LP+++++IPKA+   I+P
Sbjct:  241 KQGDFSKAEEISHFQANTLSLLPQAKKQAILPRTRIDGDKSDYLPIQLDIIPKAVSIIVP   300
```

Based on this analysis, it was predicted that these proteins and their epitopes could be useful antigens for vaccines or diagnostics.

EXAMPLE 1927

A DNA sequence (GBSx2036) was identified in *S. agalactiae* <SEQ ID 5973> which encodes the amino acid sequence <SEQ ID 5974>. Analysis of this protein sequence reveals the following:

```
Possible site: 35
>>> Seems to have no N-terminal signal sequence

----- Final Results -----
              bacterial cytoplasm --- Certainty = 0.3628(Affirmative) < succ>
              bacterial membrane  --- Certainty = 0.0000(Not Clear)   < succ>
               bacterial outside  --- Certainty = 0.0000(Not Clear)   < succ>
```

The protein has homology with the following sequences in the GENPEPT database.

```
>GP:BAB10885 GB:AB010693 gene_id: K21C13.21~pir| |T04769~strong
similarity to unknown protein [Arabidopsis thaliana]
Identities = 85/291 (29%), Positives = 150/291 (51%), Gaps = 28/291 (9%)

Query:   10 DQEWEVPVESGRYHMIVGSFCPYAQRPQIARQLLGLDKHISISFVDDV------------  57
            D + + P ESGRYH+ +    CP+A R      ++ GLD+ I+ S V +
Sbjct:   29 DPDSQFPAESGRYHLYISYACPWACRCLSYLKIKGLDEAITFSSVHAIWGRTKETDDHRG  88

Query:   58 ----PSDIGLIFSQPEQVTGAKSLRDIYHLTDPTYQGPYTIPILIDKTDNRIVCKESADL  113
                SD   L  ++P+ + GAKS+R++Y +   P Y+G YT+P+L DK    +V  ES+++
Sbjct:   89 WVFPDSDTELPGAEPDYLNGAKSVRELYEIASPNYEGKYTVPVLWDKKLKTVVNNESSEI  148

Query:  114 LRLFTTDFSDLHQEDAPVLFSQETASLIDNDIKDINKNFQSLMYKLAFLDKQADYDTYSK  173
            +R+F T+F+ + +  +  L+       +I+      +   + +YK  F  KQ  Y+
Sbjct:  149 IRMFNTEFNGIAKTPSLDLYPSHLRDVINETNGWVFNGINNGVYKCGFARKQEPYNEAVN  208

Query:  174 EFFTFLDQKEHLLGQRPFLLGDNLSEVDIHFFTPLVRWDIAGRDLLLLNQKALEDYPNIF  233
            + +  +D+ E +LG++ ++ G+  +E DI  F  L+R+D         N++ L +YPNIF
Sbjct:  209 QLYEAVDRCEEVLGKQRYICGNTFTEADIRLFVTLIRFDEVYAVHFKCNKRLLREYPNIF  268

Query:  234 SWAKTLYNDFNLKTLTNPQSIKNNYY-----LGKFGRAVRHHTIVPTGPNM          279
            ++ K +Y   + + N + IK +YY       + FG        I+P GPN+
Sbjct:  269 NYIKDIYQIHGMSSTVNMEHIKQHYYGSHPTINPFG-------IIPHGPNI          312
```

No corresponding DNA sequence was identified in *S. pyogenes*.

Based on this analysis, it was predicted that this protein and its epitopes, could be useful antigens for vaccines or diagnostics.

EXAMPLE 1928

A DNA sequence (GBSx2037) was identified in *S. agalactiae* <SEQ ID 5975> which encodes the amino acid sequence <SEQ ID 5976>. Analysis of this protein sequence reveals the following:

```
Possible site: 59
>>> Seems to have no N-terminal signal sequence

----- Final Results -----
              bacterial cytoplasm --- Certainty = 0.2647(Affirmative) < succ>
              bacterial membrane  --- Certainty = 0.0000(Not Clear)   < succ>
               bacterial outside  --- Certainty = 0.0000(Not Clear)   < succ>
```

The protein has homology with the following sequences in the GENPEPT database.

```
>GP:BAB07793 GB:AB037666 hypothetical protein [Streptomyces sp. CL190]
Identities = 127/331 (38%), Positives = 194/331 (58%), Gaps = 9/331 (2%)

Query:     4 RKDDHIKYALKYQSHY---NSFDDIELIHSSLPKYNVNDIDLSTHFAGQSFEFPFYINAM    60
             RKDDH++ A++ + + N FDD+ +H +L + D+ L+T FAG S++ P YINAM
Sbjct:     6 RKDDHVRLAIEQHNAHSGRNQFDDVSFVHHALAGIDRPDVSLATSFAGISWQVPIYINAM   65

Query:    61 TGGSEKGKAVNHKLAQVAQATGIVMVTGSYSAALKNDE--DDSYPTTDLYPDLKLATNIG   118
             TGGSEK +N  LA  A+ TG+ + +GS +A +K+ D D  P+ + NI
Sbjct:    66 TGGSEKTGLINRDLATAARETGVPIASGSMNAYIKDPSCADTFRVLRDENPNGFVIANIN  125

Query:   119 LDKPVPAAESTVKAMNPIFLQVHVNVMQELLMPEGEREFHMWRSHLKEYVDNIQCPLILK   178
                V A+ + + LQ+H+N QE   MPEG+R  F  W +++ +  P+I+K
Sbjct:   126 ATTTVDNAQRAIDLIEANALQIHINTAQETPMPEGDRSFASWVPQIEKIAAAVDIPVIVK  185

Query:   179 EVGFGMDLQSIKDAYDIGITTVDISGRGGTSFAYIENQRGR--DRSYLNTWGQTTAQSLI   236
             EVG G+ Q+I D+G+ D+SGRGGT FA IEN R D ++L+ WGQ+TA L+
Sbjct:   186 EVGNGLSRQTILLLADLGVQAADVSGRGGTDFARIENGRRELGDYAFLHGWGQSTAACLL  245

Query:   237 NAQSMMDKMDILASGGIRHPLDMVKCLVLGAKAVGLSRTVLELVERYPVDDVIAILNSWK   296
             +AQ + + +LASGG+RHPLD+V+ L LGA+AVG S L  + VD +I L +W
Sbjct:   246 DAQDI--SLPVLASGGVRHPLDVVRALALGARAVGSSAGFLRTLMDDGVDALITKLTTWL  303

Query:   297 EDLRMIMCALNCKKITDLRQVNYILYGQLKE                              327
             + L + L + DL + + +L+G+L++
Sbjct:   304 DQLAALQTMLGARTPADLTRCDVLLHGELRD                              334
```

A related DNA sequence was identified in *S. pyogenes* <SEQ ID 5977> which encodes the amino acid sequence <SEQ ID 5978>. Analysis of this protein sequence reveals the following:

```
Possible site: 51
>>> Seems to have no N-terminal signal sequence

----- Final Results -----
            bacterial cytoplasm --- Certainty = 0.2823(Affirmative) < succ>
            bacterial membrane  --- Certainty = 0.0000(Not Clear)  < succ>
             bacterial outside  --- Certainty = 0.0000(Not Clear)  < succ>
```

An alignment of the GAS and GBS proteins is shown below.

```
Identities = 244/329 (74%), Positives = 284/329 (86%)

Query:     1 MTNRKDDHIKYALKYQSHYNSFDDIELIHSSLPKYNVNDIDLSTHFAGQSFEFPFYINAM    60
             MTNRKDDHIKYALKYQS YN+FDDIELIH SLP Y+++DIDLSTHFAGQ F+FPFYINAM
Sbjct:    31 MTNRKDDHIKYALKYQSPYNAFDDIELIHHSLPSYDLSDIDLSTHFAGQDFDFPFYINAM   90

Query:    61 TGGSEKGKAVNHKLAQVAQATGIVMVTGSYSAALKNDEDDSYPTTDLYPDLKLATNIGLD   120
             TGGS+KGKAVN KLA+VA ATGIVMVTGSYSAALKN  DDSY  ++  +LKLATNIGLD
Sbjct:    91 TGGSQKGKAVNEKLAKVAAATGIVMVTGSYSAALKNPNDDSYRLHEVADNLKLATNIGLD  150

Query:   121 KPVPAAESTVKAMNPIFLQVHVNVMQELLMPEGEREFHMWRSHLKEYVDNIQCPLILKEV   180
             KPV   + TV+ M P+FLQVHVNVMQELLMPEGER  FH W+ HL EY    I  P+ILKEV
Sbjct:   151 KPVALGQQTVQEMQPLFLQVHVNVMQELLMPEGERVFHTWKKHLAEYASQIPVPVILKEV  210

Query:   181 GFGMDLQSIKDAYDIGITTVDISGRGGTSFAYIENQRGRDRSYLNTWGQTTAQSLINAQS   240
             GFGMD+ SIK A+D+GI T DISGRGGTSFAYIENQRG DRSYLN WGQTT Q L+NAQ
Sbjct:   211 GFGMDVNSIKLAHDLGIQTFDISGRGGTSFAYIENQRGGDRSYLNDWGQTTVQCLLNAQG  270

Query:   241 MMDKMDILASGGIRHPLDMVKCLVLGAKAVGLSRTVLELVERYPVDDVIAILNSWKEDLR   300
             +MD+++ILASGG+RHPLDM+KC VLGA+AVGLSRTVLELVE+YP  + VIAI+N WKE+L+
Sbjct:   271 LMDQVEILASGGVRHPLDMIKCFVLGARAVGLSRTVLELVEKYPTERVIAIVNGWKEELK  330

Query:   301 MIMCALNCKKITDLRQVNYILYGQLKEAN                                329
             +IMCAL+CK I  +L+ V+Y+LYG+L++ N
Sbjct:   331 IIMCALDCKTIKELKGVDYLLYGRLQQVN                                359
```

Based on this analysis, it was predicted that these proteins and their epitopes could be useful antigens for vaccines or diagnostics.

EXAMPLE 1929

A DNA sequence (GBSx2038) was identified in *S. agalactiae* <SEQ ID 5979> which encodes the amino acid sequence <SEQ ID 5980>. This protein is predicted to be phosphomevalonate kinase. Analysis of this protein sequence reveals the following:

```
Possible site: 41
>>> Seems to have no N-terminal signal sequence

----- Final Results -----
             bacterial cytoplasm --- Certainty = 0.0785(Affirmative) < succ>
              bacterial membrane --- Certainty = 0.0000(Not Clear)   < succ>
               bacterial outside --- Certainty = 0.0000(Not Clear)   < succ>
```

The protein has homology with the following sequences in the GENPEPT database.

```
>GP:AAG02457 GB:AF290099 phosphomevalonate kinase [Streptococcus pneumoniae]
Identities = 170/330 (51%), Positives = 233/330 (70%), Gaps = 1/330 (0%)

Query:    1 MVKVQTGGKLYIAGEYAILYPGQVAILKNVPIYMTALATFADNYSLYSDMFNYTASLQPD    60
            M+ V+T GKLY AGEYAIL PGQ+A++K++PIYM A   F+D+Y +YSDMF++   L+P+
Sbjct:    1 MIAVKTCGKLYWAGEYAILEPGQLALIKDIPIYMRAEIAFSDSYRIYSDMFDFAVDLRPN    60

Query:   61 KQYSLIQETILLMEEWLINFGKNIKPIHLEITGKLERYGLKFGIGSSGSVVVLTIKAMAA   120
               YSLIQETI LM ++L   G+N++P  L+I GK+ER G KFG+GSSGSVVVL +KA+ A
Sbjct:   61 PDYSLIQETIALMGDFLAVRGQNLRPFSLKICGKMEREGKKFGLGSSGSVVVLVVKALLA   120

Query:  121 LYEIEMPSDLLFKLSAYVLLKRGDNGSMGDIACIAYEHLISYSAFDRRAVSKMIETKPLE   180
            LY + +  +LLFKL++ VLLKRGDNGSMGD+ACI   E L+ Y +FDR+   +E + L
Sbjct:  121 LYNLSVDQNLLFKLTSAVLLKRGDNGSMGDLACIVAEDLVLYQSFDRQKAAAWLEEENLA   180

Query:  181 QVLEAEWGYRITKIQALLEMDFLVGWTMQPSISKEMINIVKSTITQRFLDDTKYQVVQLL   240
              VLE +WG+ I++++  LE DFLVGWT + ++S  M+  +K  I Q FL  +K  VV L+
Sbjct:  181 TVLERDWGFFISQVKPTLECDFLVGWTKEVAVSSHMVQQIKQNINQNFLSSSKETVVSLV   240

Query:  241 SAFKEGDKEAIKRCLEEISLLLFNLHPSIYTDKLQKLKEASKGLDIVTKSSGSGGGDCGI   300
             A ++G  E +    +E  S LL  L   IYT L++LKEAS+ L  V KSSG+GGGDCGI
Sbjct:  241 EALEQGKAEKVIEQVEVASKLLEGLSTDIYTPLLRQLKEASQDLQAVAKSSGAGGGDCGI   300

Query:  301 AISFN-KNDNQTLIKRWESAGIELLSKETL                                329
            A+SF+ ++    TL RW   GIELL +E +
Sbjct:  301 ALSFDAQSSRNTLKNRWADLGIELLYQERI                                330
```

A related DNA sequence was identified in *S. pyogenes* <SEQ ID 5981> which encodes the amino acid sequence <SEQ ID 5982>. Analysis of this protein sequence reveals the following:

```
Possible site: 59
>>> Seems to have no N-terminal signal sequence

----- Final Results -----
             bacterial cytoplasm --- Certainty = 0.2669(Affirmative) < succ>
              bacterial membrane --- Certainty = 0.0000(Not Clear)   < succ>
               bacterial outside --- Certainty = 0.0000(Not Clear)   < succ>
```

An alignment of the GAS and GBS proteins is shown below.

```
Identities = 171/325 (52%), Positives = 227/325 (69%), Gaps = 2/325 (0%)

Query:    4 VQTGGKLYIAGEYAILYPGQVAILKNVPIYMTALATFADNYSLYSDMFNYTASLQPDKQY    63
            VQTGGKLY+ GEYAIL PGQ A++  +P+ MTA   + A +  L SDMF++ A + PD  Y
Sbjct:   22 VQTGGKLYLTGEYAILTPGQKALIHFIPLMMTAEISPAAHIQLASDMFSHKAGMTPDASY    81
```

```
                             -continued
Query:   64 SLIQETILLMEEWLINFGKNIKPIHLEITGKLERYGLKFGIGSSGSVVVLTIKAMAALYE  123
            +LIQ T+    ++L      ++P  L ITGK+ER G KFGIGSSGSV +LT+KA++A Y+
Sbjct:   82 ALIQATVKTFADYLGQSIDQLEPFSLIITGKMERDGKKFGIGSSGSVTLLTLKALSAYYQ  141

Query:  124 IEMPSDLLFKLSAYVLLKRGDNGSMGDIACIAYEHLISYSAFDRRAVSKMIETKPLEQVL  183
            I +  +LLFKL+AY LLK+GDNGSMGDIACIAY+ L++Y++FDR  VS   ++T PL+++L
Sbjct:  142 ITLTPELLFKLAAYTLLKQGDNGSMGDIACIAYQTLVAYTSFDREQVSNWLQTMPLKKLL  201

Query:  184 EAEWGYRITKIQALLEMDFLVGWTMQPSISKEMINIVKSTITQRFLDDTKYQVVQ-LLSA  242
             +WGY I  IQ L  DFLVGWT  P+IS++MI   V ++IT  FL  T YQ+ Q  + A
Sbjct:  202 VKDWGYHIQVIQPALPCDFLVGWTKIPAISRQMIQQVTASITPAFL-RTSYQLTQSAMVA  260

Query:  243 FKEGDKEAIKRCLEEISLLLFNLHPSIYTDKLQKLKEASKGLDIVTKSSGSGGGDCGIAI  302
             +EG KE +K+ L    S LL  LHP+IY  KL  L  A +  D V KSSGSGGGDCGIA+
Sbjct:  261 LQEGHKEELKKSLAGASHLLKELHPAIYHPKLVTLVAACQKQDAVAKSSGSGGGDCGIAL  320

Query:  303 SFNKNDNQTLIKRWESAGIELLSKE                                    327
            +FN++    TLI +W+ A I LL +E
Sbjct:  321 AFNQDARDTLISKWQEADIALLYQE                                    345
```

Based on this analysis, it was predicted that these proteins and their epitopes could be useful antigens for vaccines or diagnostics.

EXAMPLE 1930

A DNA sequence (GBSx2039) was identified in *S. agalactiae* <SEQ ID 5983> which encodes the amino acid sequence <SEQ ID 5984>. Analysis of this protein sequence reveals the following:

```
Possible site: 32
>>> Seems to have an uncleavable N-term signal seq
    INTEGRAL     Likelihood = -1.75     Transmembrane    20-36 (18-36)

----- Final Results -----
              bacterial membrane --- Certainty = 0.1720(Affirmative) < succ>
              bacterial outside  --- Certainty = 0.0000(Not Clear)   < succ>
              bacterial cytoplasm --- Certainty = 0.0000(Not Clear)  < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1931

A DNA sequence (GBSx2040) was identified in *S. agalactiae* <SEQ ID 5985> which encodes the amino acid sequence <SEQ ID 5986>. This protein is predicted to be mevalonate diphosphate decarboxylase. Analysis of this protein sequence reveals the following:

```
Possible site: 25
>>> Seems to have no N-terminal signal sequence

----- Final Results -----
              bacterial cytoplasm --- Certainty = 0.1557(Affirmative) < succ>
              bacterial membrane  --- Certainty = 0.0000(Not Clear)   < succ>
              bacterial outside   --- Certainty = 0.0000(Not Clear)   < succ>
```

The protein has homology with the following sequences in the GENPEPT database.

```
>GP:AAG02456 GB:AF290099 mevalonate diphosphate decarboxylase
[Streptococcus pneumoniae]
Identities = 219/312 (70%), Positives = 264/312 (84%)

Query:    1 MDGKSISVKSYANIAIIKYWGKADAEKMIPATSSISLTLENMYTETRLTALGKDAKKDEF   60
            MD + ++V+SYANIAIIKYWGK   ++M+PATSSISLTLENMYTET L+ L  +   DEF
Sbjct:    1 MDREPVTVRSYANIAIIKYWGKKKEKEMVPATSSISLTLENMYTETTLSPLPANVTADEF   60

Query:   61 YISGVLQNDHEHDKMSAILDRFQNRSGFVKIETTNNMPTAAGLSSSSSGLSALVKACND   120
            YI+G LQN+ EH KMS I+DR+R      GFV+I+T NNMPTAAGLSSSSSGLSALVKACN
Sbjct:   61 YINGQLQNEVEHAKMSKIIDRYRPAGEGFVRIDTQNNMPTAAGLSSSSSGLSALVKACNA  120
```

```
-continued
Query:  121 FFGTNLSQSQLAQEAKFASGSSSRSFFGPVAAWDKDSGDIYKVHTNLDLAMIMLVLNDKR  180
            +F   L +SQLAQEAKFASGSSSRSF+GP+ AWDKDSG+IY V T+L LAMIMLVL DK+
Sbjct:  121 YFKLGLDRSQLAQEAKFASGSSSRSFYGPLGAWDKDSGEIYPVETDLKLAMIMLVLEDKK  180

Query:  181 KPISSREGMKICTETSTTFNEWVRQSEQDYQDMLVYLKNNDFQKVGQLTERNALAMHSTT  240
            KPISSR+GMK+C ETSTTF++WVRQSE+DYQDML+YLK NDF K+G+LTE+NALAMH+TT
Sbjct:  181 KPISSRDGMKLCVETSTTFDDWVRQSEKDYQDMLIYLKENDFAKIGELTEKNALAMHATT  240

Query:  241 KTATPAFSYLTEETYKAMDVVKKLREKGHECYYTMDAGPNVKVLCLRQDLEALAAILEKD  300
            KTA+PAFSYLT+ +Y+AM  V++LREKG  CY+TMDAGPNVKV  C  +DLE L+ I  +
Sbjct:  241 KTASPAFSYLTDASYEAMAFVRQLREKGEACYFTMDAGPNVKVFCQEKDLEHLSEIFGQR  300

Query:  301 YRIIVSTTKELA  312
            YR+IVS TK+L+
Sbjct:  301 YRLIVSKTKDLS  312
```

A related DNA sequence was identified in *S. pyogenes* <SEQ ID 5987> which encodes the amino acid sequence <SEQ ID 5988>. Analysis of this protein sequence reveals the following:

```
Possible site: 36
>>> Seems to have no N-terminal signal sequence

----- Final Results -----
           bacterial cytoplasm --- Certainty = 0.1271(Affirmative) < succ>
            bacterial membrane --- Certainty = 0.0000(Not Clear)   < succ>
              bacterial outside --- Certainty = 0.0000(Not Clear)   < succ>
```

An alignment of the GAS and GBS proteins is shown below.

```
Identities = 221/313 (70%), Positives = 258/313 (81%)

Query:    1 MDGKSISVKSYANIAIIKYWGKADAEKMIPATSSISLTLENMYTETRLTALGKDAKKDEF  60
            +D   I+V SYANIAIIKYWGK +  KMIP+TSSISLTLENM+T T ++ L   A  D+F
Sbjct:    1 VDPNVITVTSYANIAIIKYWGKENQAKMIPSTSSISLTLENMFTTTSVSFLPDTATSDQF  60

Query:   61 YISGVLQNDHEHDKMSAILDRFRQNRSGFVKIETTNNMPTAAGLSSSSSGLSALVKACND  120
            YI+G+LQND EH K+SAI+D+FRQ    FVK+ET NNMPTAAGLSSSSSGLSALVKAC+
Sbjct:   61 YINGILQNDEEHTKISAIIDQFRQPGQAFVKMETQNNMPTAAGLSSSSSGLSALVKACDQ  120

Query:  121 FFGTNLSQSQLAQEAKFASGSSSRSFFGPVAAWDKDSGDIYKVHTNLDLAMIMLVLNDKR  180
              F T L Q  LAQ+AKFASGSSSRSFFGPVAAWDKDSG IYKV T+L +AMIMLVLN  +
Sbjct:  121 LFDTQLDQKALAQKAKFASGSSSRSFFGPVAAWDKDSGAIYKVETDLKMAMIMLVLNAAK  180

Query:  181 KPISSREGMKICTETSTTFNEWVRQSEQDYQDMLVYLKNNDFQKVGQLTERNALAMHSTT  240
            KPISSREGMK+C +TSTTF++WV QS  DYQ ML YLK N+F+KVGQLTE NALAMH+TT
Sbjct:  181 KPISSREGMKLCRDTSTTFDQWVEQSAIDYQHMLTYLKTNNFEKVGQLTEANALAMHATT  240

Query:  241 KTATPAFSYLTEETYKAMDVVKKLREKGHECYYTMDAGPNVKVLCLRQDLEALAAILEKD  300
            KTA P FSYLT+E+Y+AM+ VK+LR++G  CY+TMDAGPNVKVLCL +DL  LA  L K+
Sbjct:  241 KTANPPFSYLTKESYQAMEAVKELRQEGFACYFTMDAGPNVKVLCLEKDLAQLAERLGKN  300

Query:  301 YRIIVSTTKELAD  313
            YRIIVS TK+L D
Sbjct:  301 YRIIVSKTKDLPD  313
```

Based on this analysis, it was predicted that these proteins and their epitopes could be useful antigens for vaccines or diagnostics.

EXAMPLE 1932

A DNA sequence (GBSx2041) was identified in *S. agalactiae* <SEQ ID 5989> which encodes the amino acid sequence <SEQ ID 5990>. Analysis of this protein sequence reveals the following:

```
Possible site: 59
>>> Seems to have no N-terminal signal sequence
```

```
-continued
----- Final Results -----
           bacterial cytoplasm --- Certainty = 0.1512(Affirmative) < succ>
            bacterial membrane --- Certainty = 0.0000(Not Clear)  < succ>
             bacterial outside --- Certainty = 0.0000(Not Clear)  < succ>
```

A related DNA sequence was identified in *S. pyogenes* <SEQ ID 5991> which encodes the amino acid sequence <SEQ ID 5992>. Analysis of this protein sequence reveals the following:

```
Possible site: 35
>>> Seems to have no N-terminal signal sequence

----- Final Results -----
           bacterial cytoplasm --- Certainty = 0.1117(Affirmative) < succ>
            bacterial membrane --- Certainty = 0.0000(Not Clear)  < succ>
             bacterial outside --- Certainty = 0.0000(Not Clear)  < succ>
```

An alignment of the GAS and GBS proteins is shown below.

```
Identities = 182/290 (62%), Positives = 223/290 (76%)

Query:    1 MKEKFGIGKAHSKIILMGEHSVVYGYPAIAIPLKNIEVTCLIEEAPQLIALDMTDPLSTA    60
            M E  G GKAHSKIIL+GEH+VVYGYPAIA+PL +IEV C I  A + +  D  D LSTA
Sbjct:    6 MNENIGYGKAHSKIILIGEHAVVYGYPAIALPLTDIEVVCHIFPADKPLVFDFYDTLSTA   65

Query:   61 IFAALDYLGKTSSKIAYHIESQVPERRGMGSSAAVAIAAIRAVFDYFDEDLEADLLECLV  120
            I+A+LDYL +    IAY I SQVP++RGMGSSAAV+IAAIRAVF Y  E L  DLLE LV
Sbjct:   66 IYASLDYLQRLQEPIAYEIVSQVPQKRGMGSSAAVSIAAIRAVFSYCQEPLSDDLLEILV  125

Query:  121 NRAEMIAHSNPSGLDAKTCLSENTIKFIRNIGFSTVPMHLNAYLVIADTGIHGHTKEAVD  180
            N+AE+IAH+NPSGLDAKTCLS++ IKFIRNIGF T+ + LN YL+IADTGIHGHT+EAV+
Sbjct:  126 NKAEIIAHTNPSGLDAKTCLSDHAIKFIRNIGFETIEIALNGYLIIADTGIHGHTREAVN  185

Query:  181 KVKSSGEAVLPFLKELGYLAEASEDAIHKSDSKQLGSLMTKAHQSLKQLGVSSLEADHLV  240
            KV    E  LP+L +LG L +A E AI++ +    +G LMT+AH +LK +GVS  +AD LV
Sbjct:  186 KVAQFEETNLPYLAKLGALTQALERAINQKNKVAIGQLMTQAHSALKAIGVSISKADQLV  245

Query:  241 EVAISCGALGAKMSGGGLGGCIIALVKEKREAERLSQQLEREGAVNTWTE            290
            E A+  GALGAKM+GGGLGGC+IAL   K  AE++S +L+ EGAVNTW +
Sbjct:  246 EAALRAGALGAKMTGGGLGGCMIALADTKDMAEKISHRLKEEGAVNTWIQ           295
```

Based on this analysis, it was predicted that these proteins and their epitopes could be useful antigens for vaccines or diagnostics.

EXAMPLE 1933

A DNA sequence (GBSx2042) was identified in *S. agalactiae* <SEQ ID 5993> which encodes the amino acid sequence <SEQ ID 5994>. This protein is predicted to be a histidine protein kinase. Analysis of this protein sequence reveals the following:

```
Possible site: 26
>>> Seems to have an uncleavable N-term signal seq
   INTEGRAL    Likelihood = -13.43    Transmembrane     12-28   (4-33)
   INTEGRAL    Likelihood =  -9.29    Transmembrane    163-179 (157-191)

----- Final Results -----
            bacterial membrane --- Certainty = 0.6371(Affirmative) < succ>
             bacterial outside --- Certainty = 0.0000(Not Clear)  < succ>
           bacterial cytoplasm --- Certainty = 0.0000(Not Clear)  < succ>
```

The protein has homology with the following sequences in the GENPEPT database.

```
>GP:AAF79919 GB:AF039082 putative histidine protein kinase [Lactococcus lactis]
Identities = 78/315 (24%), Positives = 154/315 (48%), Gaps = 33/315 (10%)
```

-continued

```
Query:   101 SDRQIKNYAKRIVSQNSHSGHITYNFSTYSYLLKKVGKNDYLVVFLDTTNQYLDNQRLLQ   160
             +++QI N + + +N + + Y + T S +          V++   +      Q +
Sbjct:    84 NEKQI-NTIQTVSVKNPYGDNWHYRYLTTSQFIITNSDGTVTPVYVQIFSNVDQIQDAMS   142

Query:   161 LSIWM---SLVSFIVFMVIVSV-LSGRVILPFVANYEKQRRFITNAGHELKTPLAIISAN   216
             ++W+    ++++F + VI+S+ L+   + P +A YEKQ+ F+ NA HEL+TPLAI+
Sbjct:   143 RAMWVIVTTMITFWILSVIISLYLANWTLKPILAAYEKQKEFVENASHELRTPLAILQNR   202

Query:   217 NELV-----EMMSGESEWTKSTNDQIQRLTGLINGMVSLAR------FEEQPDISM----   261
             EL+      + +SE  + +++ + L + +++LAR           E +P  +
Sbjct:   203 LELLFQKPTATIIDQSENISESLSEVRNMRLLTSNLLNLARRDSGIKIEPEPTTATYFEN   262

Query:   262 VDLDFSHITKDAAEDFKGPIIKDGKDFIMSIQPGIHVKAEEKSLFELVTLLVDNANKYCD   321
             +   +   +T++A + F G + +G             V  ++   + +L+T+L DNA KY D
Sbjct:   263 IFNSYEMLTENAGKKFSGNLKLEGT----------VNLDQALIKQLLTILFDNALKYTD   311

Query:   322 PMGTVTVKLSRSSRLRRAKLEVSNTYKNGKDIDYSKFFERFYREDESHNNKKSGYGIGLS   381
                G ++V + ++          V++ +   D D  K F+RF+R D++   +K G G+GLS
Sbjct:   312 SEGEISVDVIKNGGF--LTFAVADNGEGISDEDKKKIFDRFFRVDKARTRQKGGLGLGLS   369

Query:   382 IVTSLVHLFKGSIDV                                                396
             +    +V  + G I V
Sbjct:   370 LAKQIVEAYNGKITV                                                384
```

A related DNA sequence was identified in *S. pyogenes* <SEQ ID 5751> which encodes the amino acid sequence <SEQ ID 5752>. Analysis of this protein sequence reveals the following:

```
Possible site: 24
>>> Seems to have an uncleavable N-term signal seq
    INTEGRAL    Likelihood = -11.30    Transmembrane    18-34 (13-42)
    INTEGRAL    Likelihood = -10.35    Transmembrane    170-186 (163-199)

----- Final Results -----
              bacterial membrane --- Certainty = 0.5522(Affirmative) < succ>
               bacterial outside --- Certainty = 0.0000(Not Clear) < succ>
             bacterial cytoplasm --- Certainty = 0.0000(Not Clear) < succ>
```

An alignment of the GAS and GBS proteins is shown below.

```
Identities = 233/410 (56%), Positives = 303/410 (73%), Gaps = 1/410 (0%)

Query:     1 MFRNLRLRFIGIAAALAILVVLFSVVGVLNSANHYQTKNEIYRVLTILADNNGRIPNKLEF    60
             MF +R+RFI IA++AI ++L S+VG++N+A  YQ++ EI R+L +++ N G++P   E
Sbjct:    10 MFNRIRIRFIMIASIAIFIILSSIVGIINTARCYQSQQEINRILHLISSNKGKLPGTTES    69

Query:    61 SKELGDDLSTDAIFQFRYFSARTDAKGNVTSFDSRNIFEVSDRQIKNYAKRIVSQNSHSG   120
             SK LG  LS D++ QFRY+S   +A G++ S ++ NI  +   + + +A+          G
Sbjct:    70 SKRLGTKLSEDSLSQFRYYSVIFNANGHLLSSNTANISALDREEAQYFARLFAKSGEEKG   129

Query:   121 HITYNFSTYSYLLKKVGKNDYLVVFLDTTNQYLDNQRLLQLSIWMSLVSFIVFMVIVSVL   180
             +    S YSYL+  ++    + LVV LDTT  +      LL +S+ ++    FI F+V+VS+
Sbjct:   130 SYRHQDSVYSYLITQLPNEEKLVVILDTTFYFRSVGDLLAVSVMLAFGGFIFFVVLVSLF   189

Query:   181 SGRVILPFVANYEKQRRFITNAGHELKTPLAIISANNELVEMMSGESEWTKSTNDQIQRL   240
             SG VI  PFV NYEKQRRFITNAGHELKTPLAIISANNELVE+M+GESEWTKST+DQ++RL
Sbjct:   190 SGMVIKPFVQNYEKQRRFITNAGHELKTPLAIISANNELVELMTGESEWTKSTSDQVKRL   249

Query:   241 TGLINGMVSLARFEEQPDISMVDLDFSHITKDAAEDFKGPIIKDGKDFIMSIQPGIHVKA   300
             TGLIN M++LAR EEQPD+ + +DFS I +DAAEDFK ++KDGK F ++IQP I +KA
Sbjct:   250 TGLINQMITLARLEEQPDVVLHMVDFSAIAQDAAEDFKSLVLKDGKRFDLTIQPNIMIKA   309

Query:   301 EEKSLFELVTLLVDNANKYCDPMGTVTVKLSRSSRLR-RAKLEVSNTYKNGKDIDYSKFF   359
             EEKSLFELVT+LVDNANKYCDP G V V L+   R R RAKLEVSNTY  GK IDYS+FF
Sbjct:   310 EEKSLFELVTILVDNANKYCDPKGLVKVSLTTIGRRRKRAKLEVSNTYLEGKSIDYSRFF   369

Query:   360 ERFYREDESHNNKKSGYGIGLSIVTSLVHLFKGSIDVNYKHDTITFVIYI            409
             ERFYREDESHN+K+ GYGIGLS+  S+V LFKG+I VNYK D  I F + I
Sbjct:   370 ERFYREDESHNSKEKGYGIGLSMAESMVKLFKGTITVNYKNDAIVFTVVI            419
```

SEQ ID 5994 (GBS273) was expressed in *E. coli* as a His-fusion product. SDS-PAGE analysis of total cell extract is shown in FIG. 51 (lane 14; MW 46 kDa). It was also expressed in *E. coli* as a GST-fusion product. SDS-PAGE analysis of total cell extract is shown in FIG. 56 (lane 5; MW 71 kDa).

GBS273-GST was purified as shown in FIG. 208, lane 4.

Based on this analysis, it was predicted that these proteins and their epitopes could be useful antigens for vaccines or diagnostics.

EXAMPLE 1934

A DNA sequence (GBSx2043) was identified in *S. agalactiae* <SEQ ID 5995> which encodes the amino acid sequence <SEQ ID 5996>. Analysis of this protein sequence reveals the following:

```
Possible site: 16
>>> Seems to have no N-terminal signal sequence

----- Final Results -----
          bacterial cytoplasm --- Certainty = 0.2181(Affirmative) < succ>
          bacterial membrane  --- Certainty = 0.0000(Not Clear)   < succ>
           bacterial outside  --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1935

A DNA sequence (GBSx2044) was identified in *S. agalactiae* <SEQ ID 5997> which encodes the amino acid sequence <SEQ ID 5998>. This protein is predicted to be two-component response regulator (trcR). Analysis of this protein sequence reveals the following:

```
Possible site: 56
>>> Seems to have no N-terminal signal sequence

----- Final Results -----
          bacterial cytoplasm --- Certainty = 0.2503(Affirmative) < succ>
          bacterial membrane  --- Certainty = 0.0000(Not Clear)   < succ>
           bacterial outside  --- Certainty = 0.0000(Not Clear)   < succ>
```

A related GBS nucleic acid sequence <SEQ ID 9379> which encodes amino acid sequence <SEQ ID 9380> was also identified.

The protein has homology with the following sequences in the GENPEPT database.

```
>GP:BAB04091 GB:AP001508 two-component response regulator
[Bacillus halodurans]
Identities = 71/183 (38%), Positives = 120/183 (64%), Gaps = 3/183 (1%)

Query:   9 RVLIAEDEEQMSRVLSTAISHQGYVVDVAYDGQTAIDLANQNAYDVMVMDVMMPVKTGIE   68
           R+LI EDE++++RVL   + H+GY  D A+ G    ++     +A+D++++DVM+P  +G+E
Sbjct:   3 RILIIEDEKKIARVLQLELEHEGYETDAAFSGSDGLETFQAHAWDLVLLDVMLPELSGLE   62

Query:  69 AVKEIRQSGNKSHIIMLTAMAEIDDRVTGLDAGADDYLTKPFSLKELLARLRSMSRRLE-  127
           ++ IR +   + II+LTA   I D+V+GLD GA+DY+TKPF ++ELLAR+R+  R ++
Sbjct:  63 VLRRIRMTDPVTPIILLTARNSIPDKVSGLDLGANDYITKPFEIEELLARVRACLRTVQT  122

Query: 128 -DFTPNVLSLGRVTLSVGEQELQCEN-TIRLAGKEAKMLAFFMLNHDKELSTQQLFEHVW  185
            +    + L    +T++    +++Q  N TI L  KE ++L FF+ N  + LS +Q+  +VW
Sbjct: 123 RERVEDTLMFQELTINEKTRDVQRGNETIELTPKEFELLVFFIKNGQVLSREQILTNVW  182

Query: 186 GAD                                                          188
           G D
Sbjct: 183 GFD                                                          185
```

A related DNA sequence was identified in *S. pyogenes* <SEQ ID 5999> which encodes the amino acid sequence <SEQ ID 6000>. Analysis of this protein sequence reveals the following:

```
Possible site: 21
>>> Seems to have no N-terminal signal sequence

----- Final Results -----
            bacterial cytoplasm --- Certainty = 0.2391(Affirmative) < succ>
            bacterial membrane  --- Certainty = 0.0000(Not Clear)   < succ>
            bacterial outside   --- Certainty = 0.0000(Not Clear)   < succ>
```

An alignment of the GAS and GBS proteins is shown below.

```
Identities = 125/185 (67%), Positives = 151/185 (81%)

Query:   8 MRVLIAEDEEQMSRVLSTAISHQGYVVDVAYDGQTAIDLANQNAYDVMVMDVMMPVKTGI   67
           M++L+AEDE QMS VL+TA++HQGY VDV ++GQ AID A  NAYD+M++D+MMP+K+GI
Sbjct:   1 MKILLAEDEWQMSNVLTTAMTHQGYDVDVVFNGQEAIDKAKDNAYDIMILDIMMPIKSGI   60

Query:  68 EAVKEIRQSGNKSHIIMLTAMAEIDDRVTGLDAGADDYLTKPFSLKELLARLRSMSRRLE  127
           EA+KEIR SGN SHIIMLTAMAEI+DRVTGLDAGADDYLTKPFSLKELLARLRSM RR+E
Sbjct:  61 EALKEIRASGNCSHIIMLTAMAEINDRVTGLDAGADDYLTKPFSLKELLARLRSMERRVE  120

Query: 128 DFTPNVLSLGRVTLSVGEQELQCENTIRLAGKEAKMLAFFMLNHDKELSTQQLFEHVWGA  187
             FTP VL   VTL++ EQEL  N IRLA KE K++AF MLN  K L T+ L++HVW
Sbjct: 121 SFTPQVLQFAGVTLNINEQELSAGNAIRLASKEGKLMAFLMLNQGKYLDTKTLYQHVWSD  180

Query: 188 DKDQE  192
           +D +
Sbjct: 181 QEDYD  185
```

Based on this analysis, it was predicted that these proteins and their epitopes could be useful antigens for vaccines or diagnostics.

EXAMPLE 1936

A DNA sequence (GBSx2045) was identified in *S. agalactiae* <SEQ ID 6001> which encodes the amino acid sequence <SEQ ID 6002>. Analysis of this protein sequence reveals the following:

```
Possible site: 26
>>> Seems to have no N-terminal signal sequence

----- Final Results -----
            bacterial cytoplasm --- Certainty = 0.2627(Affirmative) < succ>
            bacterial membrane  --- Certainty = 0.0000(Not Clear)   < succ>
            bacterial outside   --- Certainty = 0.0000(Not Clear)   < succ>
```

The protein has homology with the following sequences in the GENPEPT database.

```
>GP:BAB05604 GB:AP001513 unknown conserved protein [Bacillus halodurans]
Identities = 67/182 (36%), Positives = 111/182 (60%), Gaps = 4/182 (2%)

Query:  17 LEDFSQRIQLENDKAKVETGYKLYEHIIGRIKTSDSMIEKCRRKQLPVTVDSALKTIRDS   76
           L++ + +I +   + +     Y   EH+  R+K+ +S++ K +R+    T++S  + +RD
Sbjct:  29 LQELNTKIDILKQEFQYIHDYNPIEHVSSRVKSPESIVNKIQRRGNDFTLESIRENVRDI   88

Query:  77 IGVRIICGFVNDIYQIIERIKAFDDCRIVVEKDYIQHVKPNGYRSYHVILEIDTPYPDCL  136
           G+RI C F +DIY + E++    D  +V  KDYI++ KPNGYRS H+IL I    P  +
Sbjct:  89 AGIRITCSFESDIYTLSEQLMQQHDISVVETKDYIKNPKPNGYRSLHLILSI----PIFM  144

Query: 137 GNSDGKYYIEIQLRTIAQDSWASLEHQMKYKHDIENPERIVRELKRCADEMASVDLTMQT  196
            +      Y+E+Q+RTIA D WASLEH++  YK++   PE +++ELK   A+  A +D  M+
Sbjct: 145 SDRVQDVYVEVQIRTIAMDFWASLEHKIYYKYNKNVPEHLLKELKDAAESAALLDQKMEK  204

Query: 197 IR  198
           I+
Sbjct: 205 IQ  206
```

A related DNA sequence was identified in *S. pyogenes* <SEQ ID 6003> which encodes the amino acid sequence <SEQ ID 6004>. Analysis of this protein sequence reveals the following:

```
Possible Site: 33
>>> Seems to have no N-terminal signal sequence

----- Final Results -----
            bacterial cytoplasm --- Certainty = 0.1057(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below.

```
Identities = 127/206 (61%), Positives = 162/206 (77%)

Query:    3 TNIYGDYGRYLPLILEDFSQRIQLENDKAKVETGYKLYEHIIGRIKTSDSMIEKCRRKQL   62
            ++IY +  YLPL+L+ + I  EN K+K ETG+KLYEH   RIK+  SMIEKC+RKQL
Sbjct:   11 SSIYSGFEVYLPLVLQTITDVIIAENIKSKKETGFKLYEHFTSRIKSEASMIEKCQRKQL   70

Query:   63 PVTVDSALKTIRDSIGVRIICGFVNDIYQIIERIKAFDDCRIVVEKDYIQHVKPNGYRSY  122
            P+T  SALK I+DSIG+RIICGF++DIY++++ +K+    +  EKDYI + KPNGYRSY
Sbjct:   71 PLTSKSALKIIKDSIGIRIICGFIDDIYRMVDLLKSIPGMSVNTEKDYILNAKPNGYRSY  130

Query:  123 HVILEIDTPYPDCLGNSDGKYYIEIQLRTIAQDSWASLEHQMKYKHDIENPERIVRELKR  182
            H+ILE++T +PD LG    G Y+IE+QLRTIAQDSWASLEHQMKYKH + N E I RELKR
Sbjct:  131 HLILELETHFPDILGEKKGCYFIEVQLRTIAQDSWASLEHQMKYKHQVANAEMITRELKR  190

Query:  183 CADEMASVDLTMQTIRQLIESGTKKE                                   208
            CADE+AS D+TMQTIRQLI+  T++E
Sbjct:  191 CADELASCDVTMQTIRQLIQETTEEE                                   216
```

Based on this analysis, it was predicted that these proteins and their epitopes could be useful antigens for vaccines or diagnostics.

EXAMPLE 1937

A DNA sequence (GBSx2046) was identified in *S. agalactiae* <SEQ ID 6005> which encodes the amino acid sequence <SEQ ID 6006>. Analysis of this protein sequence reveals the following:

```
Possible site: 40
>>> Seems to have no N-terminal signal sequence

----- Final Results -----
            bacterial cytoplasm --- Certainty = 0.3250(Affirmative) < succ>
             bacterial membrane --- Certainty = 0.0000(Not Clear)   < succ>
              bacterial outside --- Certainty = 0.0000(Not Clear)   < succ>
```

The protein has homology with the following sequences in the GENPEPT database.

```
>GP:CAA37193 GB:X53013 ORF1 (AA 1-384) [Lactococcus lactis]
Identities = 30/55 (54%), Positives = 37/55 (66%)

Query:    1 MEFYYKTLKRKFINDADTIFIEQSQFEIFIYIETDHNSSSSHVVLDYQSQKEFEK   55
            ME +YKTLKR+ +NDA     ++ EIF YIET +N+  H  LDYQS K+FEK
Sbjct:  327 MESFYKTLKRELINDAHFETRAEATQEIFKYIETYYNTKWMHSGLDYQSPKDFEK  381
```

A related DNA sequence was identified in *S. pyogenes* <SEQ ID 6007> which encodes the amino acid sequence <SEQ ID 6008>. Analysis of this protein sequence reveals the following:

```
Possible site: 36
>>> Seems to have no N-terminal signal sequence
```

```
----- Final Results -----
          bacterial cytoplasm --- Certainty = 0.3065(Affirmative) < succ>
          bacterial membrane  --- Certainty = 0.0000(Not Clear)   < succ>
           bacterial outside  --- Certainty = 0.0000(Not Clear)   < succ>
```

An alignment of the GAS and GBS proteins is shown below.

```
Identities = 31/59 (52%), Positives = 39/59 (65%)

Query:  1 MEFYYKTLKRKFINDADTIFIEQSQFEIFIYIETDHNSSSSHVVLDYQSQKEFEKIITN 59
          ME +YKTLKR+ +NDA     I+Q+Q EIF Y ET +N    H  L Y S  EFEKI+T+
Sbjct: 13 MEAFYKTLKRELVNDAHFATIKQAQLEIFKYSETYYNPKRLHSALGYLSPVEFEKIVTH 71
```

Based on this analysis, it was predicted that these proteins and their epitopes could be useful antigens for vaccines or diagnostics.

EXAMPLE 1938

A DNA sequence (GBSx2047) was identified in *S. agalactiae* <SEQ ID 6009> which encodes the amino acid sequence <SEQ ID 6010>. This protein is predicted to be R5 protein. Analysis of this protein sequence reveals the following:

```
Possible site: 51
>>> Seems to have no N-terminal signal sequence
    INTEGRAL    Likelihood = -3.98    Transmembrane    30-46   (29-51)
    INTEGRAL    Likelihood = -2.76    Transmembrane    967-983 (966-985)

----- Final Results -----
          bacterial membrane  --- Certainty = 0.2593(Affirmative) < succ>
           bacterial outside  --- Certainty = 0.0000(Not Clear)   < succ>
          bacterial cytoplasm --- Certainty = 0.0000(Not Clear)   < succ>
```

A related GBS nucleic acid sequence <SEQ ID 8935> which encodes amino acid sequence <SEQ ID 8936> was also identified. Analysis of this protein sequence reveals the following:

```
Lipop: Possible site: -1 Crend: 8
SRCFLG: 0
McG: Length of UR: 2
     Peak Value of UR: 2.44
     Net Charge of CR: 2
McG: Discrim Score: 0.78
GvH: Signal Score (-7.5): -0.0599995
     Possible site: 39
>>> Seems to have a cleavable N-term signal seq.
Amino Acid Composition: calculated from 40
ALOM program count: 0 value: 7.37 threshold: 0.0
PERIPHERAL Likelihood = 7.37 194
modified ALOM score: -1.97
*** Reasoning Step: 3
Rule gpo1

----- Final Results -----
           bacterial outside  --- Certainty = 0.3000(Affirmative) < succ>
          bacterial membrane  --- Certainty = 0.0000(Not Clear)   < succ>
          bacterial cytoplasm --- Certainty = 0.0000(Not Clear)   < succ>
LPXTG motif: 944-948
```

No corresponding DNA sequence was identified in *S. pyogenes*.

SEQ ID 8936 (GBS200) was expressed in *E. coli* as a His-fusion product. SDS-PAGE analysis of total cell extract is shown in FIG. 29 (lane 3; MW 107.4 kDa), in FIG. 169 (lane 4; MW 122 kDa) and in FIG. 238 (lane 11; MW 122 kDa). It was also expressed in *E. coli* as a GST-fusion product. SDS-PAGE analysis of total cell extract is shown in FIG. 35 (lane 3; MW 132 kDa).

Purified Thio-GBS200-His is shown in FIG. 244, lane 9.

Based on this analysis, it was predicted that this protein and its epitopes, could be useful antigens for vaccines or diagnostics.

EXAMPLE 1939

A DNA sequence (GBSx2048) was identified in *S. agalactiae* <SEQ ID 6011> which encodes the amino acid sequence <SEQ ID 6012>. This protein is predicted to be a 16.1 kDa transcriptional regulator. Analysis of this protein sequence reveals the following:

```
Possible site: 25
>>> Seems to have no N-terminal signal sequence

----- Final Results -----
          bacterial cytoplasm --- Certainty = 0.3919(Affirmative) < succ>
          bacterial membrane  --- Certainty = 0.0000(Not Clear)   < succ>
           bacterial outside  --- Certainty = 0.0000(Not Clear)   < succ>
```

A related GBS nucleic acid sequence <SEQ ID 9953> which encodes amino acid sequence <SEQ ID 9954> was also identified.

The protein has homology with the following sequences in the GENPEPT database.

```
>GP:CAB16108 GB:Z99124 similar to transcriptional regulator (MarR
family) [Bacillus subtilis]
Identities = 30/114 (26%), Positives = 59/114 (51%), Gaps = 3/114 (2%)

Query:  29 DVEHLAGPQGHLVMYLYKHPDKDMSIKAVEEILHISKSVASNLVKRMEKNGFIAIVPSKT   88
           D++     G   +LV  +Y++P   +   + E++ + ++ A+  +K++E  GFI  +P +
Sbjct:  25 DLDLTRGQYLYLVR-IYENPG--IIQEKLAEMIKVDRTTAARAIKKLEMQGFIQKLPDEQ   81

Query:  89 DKRVKYLYLTHLGKKKATQFEIFLEKLHSTMLAGITKEEIRTTKKVIRTLAKNM         142
           +K++K L+ T GKK          E       L+G T EE  T   ++  + KN+
Sbjct:  82 NKKIKKLFPTEKGKKVYPLLRREGEHSTEVALSGFTSEEKETISALLHRVRKNI         135
```

A related DNA sequence was identified in *S. pyogenes* <SEQ ID 6013> which encodes the amino acid sequence <SEQ ID 6014>. Analysis of this protein sequence reveals the following:

```
Possible site: 43
>>> Seems to have no N-terminal signal sequence

----- Final Results -----
          bacterial cytoplasm --- Certainty = 0.4175(Affirmative) < succ>
          bacterial membrane  --- Certainty = 0.0000(Not Clear)   < succ>
           bacterial outside  --- Certainty = 0.0000(Not Clear)   < succ>
```

An alignment of the GAS and GBS proteins is shown below.

```
Identities = 27/64 (42%), Positives = 46/64 (71%)

Query:   3 MENPLQKARILVNQLEKYLDHYAKEYDVEHLAGPQGHLVMYLYKHPDKDMSIKAVEEILH   62
           M  +  R L++Q+E+  D   AK+YDVEHLAGPQG+++++L KH ++++ +K +E+ L
Sbjct:   1 MSQVIGDLRELIHQIEQISDEIAKKYDVEHLAGPQGYVLVFLAKHQNQEIFVKDIEKQLR   60

Query:  63 ISKS                                                          66
           I +S
Sbjct:  61 IFQS                                                          64
```

Based on this analysis, it was predicted that these proteins and their epitopes could be useful antigens for vaccines or diagnostics.

EXAMPLE 1940

A DNA sequence (GBSx2049) was identified in *S. agalactiae* <SEQ ID 6015> which encodes the amino acid sequence <SEQ ID 6016>. This protein is predicted to be 5'-nucleotidase family protein. Analysis of this protein sequence reveals the following:

```
Possible site: 27
>>> Seems to have a cleavable N-term signal seq.
     INTEGRAL    Likelihood = -2.66   Transmembrane   668-684 (665-684)
```

```
----- Final Results -----
           bacterial membrane --- Certainty = 0.2062(Affirmative) < succ>
           bacterial outside --- Certainty = 0.0000(Not Clear) < succ>
           bacterial cytoplasm --- Certainty = 0.0000(Not Clear) < succ>
```

The protein has homology with the following sequences in the GENPEPT database.

```
>GP:CAB12747 GB:Z99108 similar to 5'-nucleotidase [Bacillus subtilis]
Identities = 178/535 (33%), Positives = 270/535 (50%), Gaps = 55/535 (10%)

Query:   28 DQVGVQVIGVNDFHGALDNTGTANMPDGKVANAGTAAQLD---AYMDDAQKDFKQTNPNG    84
            + V ++++ +ND HG +D    ++ DG    GT  ++D   AY+ + + + K
Sbjct:  586 EHVPLRILSMNDLHGKIDQQYELDL-DGNGTVDGTFGRMDYAAAYLKEKKAEKKN-----   639

Query:   85 ESIRVQAGDMVGASPANSGLLQDEPTVKNFNAMNVEYGTLGNHEFDEGLAEYNRIVTGKA   144
            S+ V AGDM+G S    S LLQDEPTV+   +  + GT+GNHEFDEG   E   RI+ G
Sbjct:  640 -SLIVHAGDMIGGSSPVSSLLQDEPTVELMEDIGFDVGTVGNHEFDEGTDELLRILNG-G   697

Query:  145 PAPDSNINNITKSYPHEAAKQEIVVANVIDKVNKQIPYNWKPYAIKNIPVNNKSVNVGFI   204
             P         +++P     +V AN    ++    +P+       +N + V V FI
Sbjct:  698 DHPKGTSGYDGQNFP-------LVCANC------KMKSTGEPFLPAYDIINVEGVPVAFI   744

Query:  205 GIVTKDIPNLVLRKNYEQYEFLDEAETIVKYAKELQAKNVKAIVVLAHVPATSKNDIAEG   264
             G+VT+    +V+ + +  EF DEA  + K A+EL+ K VKAI VLAH+ A      G
Sbjct:  745 GVVTQSAAGMVMPEGIKNIEFTDEATAVNKAAEELKKKGVKAIAVLAHMSAEQNGNAITG   804

Query:  265 EAAEMMKKVNQLFPPENSVDIVFAGHNHQYTNGLVGKTRIVQALSQGKAYADVRGVLDTDT   324
            E+A++   K      ++ +D++FA HNHQ   NG V   IVQA   GKA     V  +D   T
Sbjct:  805 ESADLANKT-----DSEIDVIFAAHNHQVVNGEVNGKLIVQAFEYGKAIGVVDVEIDKTT   859

Query:  325 QDFIETPSAKVIAVAPGKKTGSADIQAIVDQANTIVKQVTEAKIGTAEVSVMITRSVDQD   384
            +D ++  SA+++ V   K        AI+ +  TI + +   +G A V +    S D D
Sbjct:  860 KDIVK-KSAEIVYVDQSKIEPDVSASAILKKYETIAEPIISEVVGEAAVDMEGGYSNDGD   918

Query:  385 NVSPVGSLITEAQLAIARKSWPDIDFAMTNNGGIRADLLIKPDGTITWGAAQAVQPFGNI   444
             +P+G+LI +    A +       DFA+ N GGIR  L      G ITWG   +QPFGN+
Sbjct:  919 --TPLGNLIADGMRAAMK-----TDFALMNGGGIREAL---KKGPITWGDLYNIQPFGNV   968

Query:  445 LQVVEITGRDLYKALNEQYDQKQNFFLQIAGLRYTYTDNKEGGEETPFKVVKAYKSNGEE   504
            L  +EI G+DL + +N Q         I+G  +TYT +KE G+      K+      ++G E
Sbjct:  969 LTKLEIKGKDLREIINAQISPVFGPDYSISG--FTYTWDKETGKAVDMKM-----ADGTE  1021

Query:  505 INPDAKYKLVINDFLFGGGDGFASFRNAKLLGAINP-----DTEVFMAYITDLEK       554
            I  PDA Y L +N+F+       A ++  LLG NP      D E  + Y+    ++
Sbjct: 1022 IQPDATYTLTVNNFMATATG--AKYQPIGLLGK-NPVTGPEDLEATVEYVKSFDE      1073
```

A related DNA sequence was identified in *S. pyogenes* <SEQ ID 1607> which encodes the amino acid sequence <SEQ ID 1608>. Analysis of this protein sequence reveals the following:

```
Possible site: 40
>>> Seems to have no N-terminal signal sequence
     INTEGRAL    Likelihood = -4.67    Transmembrane    662-678 (661-679)
     INTEGRAL    Likelihood = -2.02    Transmembrane     19-35 (18-35)

----- Final Results -----
           bacterial membrane --- Certainty = 0.2869(Affirmative) < succ>
           bacterial outside --- Certainty = 0.0000(Not Clear) < succ>
           bacterial cytoplasm --- Certainty = 0.0000(Not Clear) < succ>
```

An alignment of the GAS and GBS proteins is shown below.

```
Identities = 415/688 (60%), Positives = 517/688 (74%), Gaps = 21/688 (3%)

Query:    1 MKKKIILKSSVLGLVAGTSIMFSSVFADQVGVQVIGVNDFHGALDNTGTANMPDGKVANA    60
            MKK  ILKSSVL ++   +++ + V ADQV VQ +GVNDFHGALDNTGTA  P GK+ NA
Sbjct:   14 MKKYFILKSSVLSILTSFTLLVTDVQADQVDVQFLGVNDFHGALDNTGTAYTPSGKIPNA    73
```

-continued

```
Query:   61 GTAAQLDAYMDDAQKDFKQTNPNGESIRVQAGDMVGASPANSGLLQDEPTVKNFNAMNVE  120
            GTAAQL AYMDDA+ DFKQ N +G SIRVQAGDMVGASPANS LLQDEPTVK FN M  E
Sbjct:   74 GTAAQLGAYMDDAEIDFKQANQDGTSIRVQAGDMVGASPANSALLQDEPTVKVFNKMKFE  133

Query:  121 YGTLGNHEFDEGLAEYNRIVTGKAPAPDSNINNITKSYPHEAAKQEIVVANVIDKVNKQI  180
            YGTLGNHEFDEGL E+NRI+TG+AP P+S IN+ITK Y HEA+ Q IV+ANVIDK  K I
Sbjct:  134 YGTLGNHEFDEGLDEFNRIMTGQAPDPESTINDITKQYEHEASHQTIVIANVIDKKTKDI  193

Query:  181 PYNWKPYAIKNIPVNNKSVNVGFIGIVTKDIPNLVLRKNYEQYEFLDEAETIVKYAKELQ  240
            PY WKPYAIK+I +N+K V +GFIG+VT +IPNLVL++NYE Y+FLD AETI KYAKELQ
Sbjct:  194 PYGWKPYAIKDIAINDKIVKIGFIGVVTTEIPNLVLKQNYEHYQFLDVAETIAKYAKELQ  253

Query:  241 AKNVKAIVVLAHVPATSKNDIAEGEAAEMMKKVNQLFPENSVDIVFAGHNHQYTNGLVGK  300
            ++V AIVVLAHVPATSK+ +  E A +M+KVNQ++PE+S+DI+FAGHNHQYTNG +GK
Sbjct:  254 EQHVHAIVVLAHVPATSKDGVVDHEMATVMEKVNQIYPEHSIDIIFAGHNHQYTNGTIGK  313

Query:  301 TRIVQALSQGKAYADVRGVLDTDTQDFIETPSAKVIAVAPGKKTGSADIQAIVDQANTIV  360
            TRIVQALSQGKAYADVRG LDTDT DFI+TPSA V+AVAPG KT ++DI+AI++ AN IV
Sbjct:  314 TRIVQALSQGKAYADVRGTLDTDTNDFIKTPSANVVAVAPGIKTENSDIKAIINHANDIV  373

Query:  361 KQVTEAKIGTAEVSVMITRSVDQDNVSPVGSLITEAQLAIARKSWPDIDFAMTNNGGIRA  420
            K VTE KIGTA  S  I+++ + D  SPVG+L T AQL IA+K++P +DFAMTNNGGIR+
Sbjct:  374 KTVTERKIGTATNSSTISKTENIDKESPVGNLATTAQLTIAKKTFPTVDFAMTNNGGIRS  433

Query:  421 DLLIKPDGTITWGAAQAVQPFGNILQVVEITGRDLYKALNEQYDQKQNFFLQIAGLRYTY  480
            DL++K D TITWGAAQAVQPFGNILQV+++TG+ +Y  LN+QYD+ Q +FLQ++GL YTY
Sbjct:  434 DLVVKNDRTITWGAAQAVQPFGNILQVIQMTGQHIYDVLNQQYDENQTYFLQMSGLTYTY  493

Query:  481 TDNKEGGEETPPFKVVKAYKSNGEEINPDAKYKLVINDFLFGGGDGFASFRNAKLLGAINP  540
            TDN   +TPFK+VK YK NGEEIN    Y +V+NDFL+GGGDGF++F+ AKL+GAIN
Sbjct:  494 TDNDPKNSDTPFKIVKVYKDNGEEINLTTTYTVVVNDFLYGGGDGFSAFKKAKLIGAINT  553

Query:  541 DTEVFMAYITDLEKAGKKVSVPNNKPKIYVTMKMVNETITQNDGTHSIIKKLYLDRQGNI  600
            DTE F+ YIT+LE +GK V+      K YVT + + T    + G HSII K++ +R GN
Sbjct:  554 DTEAFITYITNLEASGKTVNATIKGVKNYVTSNLESSTKVNSAGKHSIISKVFRNRDGNT  613

Query:  601 VAQEIVSDTLNQTKSKSTKINPVTTIHKKQLHQFTAINPMRNYGKPSNSTTVKSKQLPKT  660
            V+ E++SD L T++ + +  T                +N  T+ S  LP T
Sbjct:  614 VSSEVISDLLTSTENTNNSLGKKET--------------------TTNKNTISSSTLPIT  653

Query:  661 NSEYGQSFLMSVFG-VGLIGIALNTKKK                                 687
               Y  S +M++   + L G+    KK+
Sbjct:  654 GDNYKMSPIMTILALISLGGLNAFIKKR                                 681
```

Figure 268:
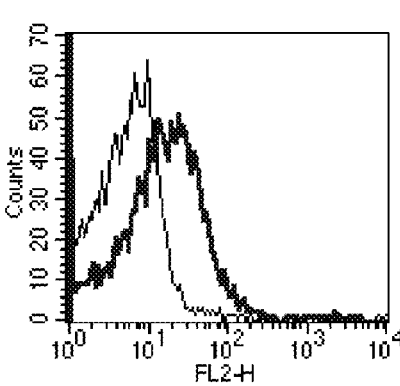

SEQ ID 6016 (GBS328) was expressed in *E. coli* as a His-fusion product. SDS-PAGE analysis of total cell extract is shown in FIG. 69 (lane 4; MW 73 kDa). The GBS328-His fusion product was purified (FIG. 213, lane 9) and used to immunise mice. The resulting antiserum was used for FACS (FIG. 268), which confirmed that the protein is immunoaccessible on GBS bacteria.

Based on this analysis, it was predicted that these proteins and their epitopes could be useful antigens for vaccines or diagnostics.

EXAMPLE 1941

A DNA sequence (GBSx2050) was identified in *S. agalactiae* <SEQ ID 6017> which encodes the amino acid sequence <SEQ ID 6018>. This protein is predicted to be peptide deformylase (def-2). Analysis of this protein sequence reveals the following:

```
Possible site: 21
>>> Seems to have no N-terminal signal sequence
     INTEGRAL    Likelihood = -1.70    Transmembrane    55-71 (55-74)

----- Final Results -----
            bacterial membrane --- Certainty = 0.1680(Affirmative) < succ>
            bacterial outside  --- Certainty = 0.0000(Not Clear)   < succ>
            bacterial cytoplasm --- Certainty = 0.0000(Not Clear)   < succ>
```

The protein has homology with the following sequences in the GENPEPT database.

```
>GP:CAB09662 GB:Z96934 peptide deformylase [Clostridium beijerinckii]
   Identities = 71/136 (52%), Positives = 96/136 (70%)

Query:    1 MIKPIVRDTFFLQQKSQMASRADVSLAKDLQETLHANQNYCVGMAANMIGSLKRVIIINV   60
            MIKPIV+D  FL QKS+ A++ D+ +  DL +TL AN  +CVG+AANMIG KR+++  V
Sbjct:    1 MIKPIVKDILFLGQKSEEATKNDMVVIDDLIDTLRANLEHCVGLAANMIGVKKRILVFTV   60
```

```
Query:   61 GITNLVMFNPVVVAKSDPYETEESCLSLVGCRSTQRYCHITISYRDINWKEQQIKLTDFP 120
            G  + M NPV++ K  PYETEESCLSL+G R T+RY  I ++Y D N+ +++     F
Sbjct:   61 GNLIVPMINPVILKKEKPYETEESCLSLIGFRKTKRYETIEVTYLDRNFNKKKQVFNGFT 120

Query:  121 AQICQHELDHLEGILI 136
            AQI QHE+DH EGI+I
Sbjct:  121 AQIIQHEMDHFEGIII 136
```

A related DNA sequence was identified in *S. pyogenes* <SEQ ID 6019> which encodes the amino acid sequence <SEQ ID 6020>. Analysis of this protein sequence reveals the following:

```
Possible site: 45
>>> Seems to have no N-terminal signal sequence
     INTEGRAL      Likelihood = -3.61       Transmembrane     55-71 (55-73)

----- Final Results -----
              bacterial membrane --- Certainty = 0.2444(Affirmative) < succ>
              bacterial outside  --- Certainty = 0.0000(Not Clear)   < succ>
            bacterial cytoplasm  --- Certainty = 0.0000 (Not Clear)  < succ>
```

An alignment of the GAS and GBS proteins is shown below.

```
Identities = 77/136 (56%), Positives = 103/136 (75%)

Query:    1 MIKPIVRDTFFLQQKSQMASRADVSLAKDLQETLHANQNYCVGMAANMIGSLKRVIIINV  60
            MI+ I+ D F LQQK+Q+A + D+ + +DLQ+TL  +  C+GMAANMIG  KR++I+++
Sbjct:    1 MIREIITDHFLLQQKAQVAKKEDLWIGQDLQDTLAFYRQECLGMAANMIGEQKRIVIVSM  60

Query:   61 GITNLVMFNPVVVAKSDPYETEESCLSLVGCRSTQRYCHITISYRDINWKEQQIKLTDFP 120
            G  +LVMFNPV+V+K    Y+T+ESCLSL G R TQRY  IT+ Y D NW+ +++ LT
Sbjct:   61 GFIDLVMFNPVMVSKKGIYQTKESCLSLSGYRKTQRYDKITVEYLDHNWRPKRLSLTGLT 120

Query:  121 AQICQHELDHLEGILI 136
            AQICQHELDHLEGILI
Sbjct:  121 AQICQHELDHLEGILI 136
```

Based on this analysis, it was predicted that these proteins and their epitopes could be useful antigens for vaccines or diagnostics.

EXAMPLE 1942

A DNA sequence (GBSx2051) was identified in *S. agalactiae* <SEQ ID 6021> which encodes the amino acid sequence <SEQ ID 6022>. Analysis of this protein sequence reveals the following:

```
Possible site: 28
>>> Seems to have no N-terminal signal sequence

----- Final Results -----
            bacterial cytoplasm --- Certainty = 0.2880(Affirmative) < succ>
             bacterial membrane --- Certainty = 0.0000(Not Clear)   < succ>
              bacterial outside --- Certainty = 0.0000(Not Clear)   < succ>
```

The protein has homology with the following sequences in the GENPEPT database.

```
>GP:BAB05820 GB:AP001514 NADP-specific glutamate dehydrogenase
[Bacillus halodurans]
Identities = 298/444 (67%), Positives = 362/444 (81%), Gaps = 2/444 (0%)

Query:    7 YVASVLEKVKKQNEHEEEFLQAVEEVFESLVPVFDKYPQYIEENLLERLVEPERVISFRV  66
            YV   V E VK++N +E EF QAV+EVF+SL+PV  K+PQY+++ +LER+VEPERVISFRV
Sbjct:   16 YVQHVYETVKRRNPNEHEFHQAVKEVFDSLLPVLVKHPQYVKQAILERIVEPERVISFRV  75
```

```
Query:    67 PWVDDKGQVQVNRGYRVQFSSAIGPYKGGLRFHPTVTQSIVKFLGFEQIFKNSLTGLPIG  126
             PWVDD+G VQVNRG+RVQF+SA+GPYKGGLRFHP+V  SI+KFLGFEQIFKN+LTG PIG
Sbjct:    76 PWVDDQGNVQVNRGFRVQFNSALGPYKGGLRFHPSVNASIIKFLGFEQIFKNALTGQPIG  135

Query:   127 GGKGGSNFDPKGKSDNEVMRFTQSFMTELQKYIGPDLDVPAGDIGVGGREIGYLYGQYKR  186
             GGKGGS+FDPKGKSD E+MRF+QSFM+EL   YIGPD+DVPAGDIGVG +EIGY++GQYK+
Sbjct:   136 GGKGGSDFDPKGKSDGEIMRFSQSFMSELSNYIGPDIDVPAGDIGVGAKEIGYMFGQYKK  195

Query:   187 L-NGYQNGVLTGKGLTYGGSLARTEATGYGAVYFAKEMLAARGQDLTGKVALVSGSGNVA  245
             +   G++ GVLTGKG+ YGGSLAR EATGYG VYF +EM+   G       G   +VSGSGNV+
Sbjct:   196 MRGGFEAGVLTGKGIGYGGSLARKEATGYGTVYFVEEMIKDHGFSFAGSTVVVSGSGNVS  255

Query:   246 IYATEKLQELGATVVAVSDSSGYVYDPDGIDLETLKQIKEVERARIVKYTEKHPKANFTP  305
             IYA EK +LGA VVA SDS GYVYD +GIDL+T+K++KEVER RI +Y   +HP A++
Sbjct:   256 IYAMEKAMQLGAKVVACSDSGGYVYDKNGIDLQTVKRLKEVERKRISEYVNEHPHAHYVQ  315

Query:   306 ADQGSIWSIKADLAFPCATQNELDEEDAKLLVENGVLAVTEGANMPSTLGAIKVFQKAGV  365
                 G  IWS+   D+A PCATQNELDE   A +L+  NGV AV EGANMPSTL A+   FQ+ GV
Sbjct:   316 GCSG-IWSVPCDIALPCATQNELDEAAATMLIANGVKAVGEGANMPSTLQAVHTFQEHGV  374

Query:   366 AFGPAKAANAGGVAVSALEMAQNSSRRAWTFEEVDQELQRIMKTIFVNASEAADEFGDSG  425
              F  PAKAANAGGV+VSALEMAQNS+R AWTFEEVD +L  IMK I+  + +AA+ +  SG
Sbjct:   375 LFAPAKAANAGGVSVSALEMAQNSTRLAWTFEEVDAKLYEIMKNIYRESIKAAELYEASG  434

Query:   426 NLVLGANIAGFLKVAQAMSAQGIV                                     449
             NLV+GANIAGF+KVA AM + G+V
Sbjct:   435 NLVVGANIAGFVKVADAMISHGVV                                     458
```

No corresponding DNA sequence was identified in *S. pyogenes*.

Based on this analysis, it was predicted that this protein and its epitopes, could be useful antigens for vaccines or diagnostics.

EXAMPLE 1943

A DNA sequence (GBSx2052) was identified in *S. agalactiae* <SEQ ID 6023> which encodes the amino acid sequence <SEQ ID 6024>. Analysis of this protein sequence reveals the following:

```
Possible site: 58
>>> Seems to have no N-terminal signal sequence
     INTEGRAL    Likelihood = -8.55    Transmembrane    61-77   (55-87)
     INTEGRAL    Likelihood = -7.70    Transmembrane    177-193 (175-202)
     INTEGRAL    Likelihood = -7.06    Transmembrane    99-115  (95-122)
     INTEGRAL    Likelihood = -5.89    Transmembrane    42-58   (40-60)
     INTEGRAL    Likelihood = -3.08    Transmembrane    160-176 (159-176)
     INTEGRAL    Likelihood = -2.44    Transmembrane    124-140 (122-144)

----- Final Results -----
         bacterial membrane  --- Certainty = 0.4418(Affirmative) < succ>
         bacterial outside   --- Certainty = 0.0000(Not Clear)   < succ>
         bacterial cytoplasm --- Certainty = 0.0000(Not Clear)   < succ>
```

A related GBS nucleic acid sequence <SEQ ID 9955> which encodes amino acid sequence <SEQ ID 9956> was also identified.

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1944

A DNA sequence (GBSx2053) was identified in *S. agalactiae* <SEQ ID 6025> which encodes the amino acid sequence <SEQ ID 6026>. This protein is predicted to be ABC transporter, ATP-binding protein (msbA). Analysis of this protein sequence reveals the following:

```
Possible site: 37
>>> Seems to have a cleavable N-term signal seq.
     INTEGRAL    Likelihood = -10.72   Transmembrane    152-168 (147-192)
     INTEGRAL    Likelihood = -5.47    Transmembrane    267-283 (264-288)
     INTEGRAL    Likelihood = -4.30    Transmembrane    171-187 (169-192)
     INTEGRAL    Likelihood = -2.13    Transmembrane    67-83   (67-83)
     INTEGRAL    Likelihood = -0.32    Transmembrane    493-509 (493-509)
```

```
----- Final Results -----
         bacterial membrane --- Certainty = 0.5288(Affirmative) < succ>
         bacterial outside  --- Certainty = 0.0000(Not Clear)   < succ>
         bacterial cytoplasm --- Certainty = 0.0000(Not Clear)  < succ>
```

The protein has homology with the following sequences in the GENPEPT database.

```
>GP:CAB69752 GB:AL137187 putative ABC transporter [Streptomyces coelicolor A3(2)]
Identities = 269/611 (44%), Positives = 392/611 (64%), Gaps = 31/611 (5%)

Query:    9 RLWSYLTRYKATLFLAIFLKVLSSFMSILEPFILGLAITELTANLV--DMAKG-------   59
            RL S   +ATLF +    V+S ++++ P ILG A   + A +V  DM   G
Sbjct:   27 RLVSQFRPERATLFTLLACVVVSVGLNVVGPKILGRATDLVFAGIVGRDMPSGATKEQVL   86

Query:   60 --------------------VSGAELNVPYIAGILIIYFFRGVFYELGSYGSNYFMTTVV   99
                                V G  ++   + +L++         L     +    V
Sbjct:   87 ATMREHGDGNVADMLRSTDFVPGQGIDFGAVGEVLLLALATFAVAGLLMAVATRLVNRAV  146

Query:  100 QKSIRDIRHDLNRKINKVPVSYFDKHQFGDMLGRFTSDVETVSNALQQSFLQIINAFLSI  159
            +++   +R D+   K++++P+SYFDK Q G++L R T+D++ +     LQQS  Q+IN+ L+I
Sbjct:  147 NRTMFRLREDVQTKLSRLPLSYFDKRQRGEVLSRATNDIDNIGQTLQQSMGQLINSLLTI  206

Query:  160 ILVVVMVLYLNVPLAMIIACIPVTYFSAQAILKRSQPYFKEQAKILGELNGFVQEKLTG  219
            I V+  M+ Y++   LA++ +   +P+++   A   + KRSQP F  +Q +   G+LN    ++E   TG
Sbjct:  207 IGVLAMMFYVSWILALVALVTVPLSFVVATRVGKRSQPQFVQQWRSTGQLNAHIEEMYTG  266

Query:  220 FNIIKLYGREEASSQEFRDITDNLRHVGFKASFISGIMMPVLNSISDFIYLIIAFVGGLQ  279
                ++K++GR+E S+++F   +    D L   GFKA F SGIM P++   +S+   Y+++A VGGL+
Sbjct:  267 HALVKVFGRQEESAKQFASQNDALYEAGFKAQFNSGIMQPLMMCVSNLNYVLVAVVGGLR  326

Query:  280 VIAGTLTIGNMQAFVQYVWQISQPVQTITQLAGVLQSAKSSLERIFEVLD-EEEEANQVT  338
            V +G L+IG++QAF+QY  Q S P+  +  +A ++QS   +S  ER+FE+LD EE+ A+ +
Sbjct:  327 VASGQLSIGDVQAFIQYSRQFSMPLTQVASMANLVQSGVASAERVFELLDAEEQSADPIP  386

Query:  339 EKLSHDLTGQVSFHGVDFHYSPDKPLIRDFNLDVEPGQMIAIVGPTGAGKTTLINLLMRF  398
                DL  G+V     V F Y  P+KPLI  D  +L VEPG   +AIVGPTGAGKTTL+NLLMRF
Sbjct:  387 GARPEDLRGRVELEHVSFRYDPEKPLIEDLSLKVEPGHTVAIVGPTGAGKTTLVNLLMRF  446

Query:  399 YDVSEGAITVDGHDIRHLSRQDFRQQFGMVLQDAWLYEGTIKENLRFG-NLEASDEDIVA  457
            Y+VS G  IT+DG DI   +SR + R    GMVLQD WL+ GTI EN+ +G + E +   +I
Sbjct:  447 YEVSGGRITLDGVDIAKMSRDELRAGIGMVLQDTWLFGGTIAENIAYGASREVTRGEIEE  506

Query:  458 AAKAANVDHFIRTLPGGYNMVMNQESSNISLGQKQLLTIARALLADPKILILDEATSSVD  517
            AA+AA+ D F+RTLP GY+ V++ E + +S G+KQL+TIARA L+DP  IL+LDEATSSVD
Sbjct:  507 AARAAHADRFVRTLPDGYDTVIDDEGTGVSAGEKQLITIARAFLSDPVILVLDEATSSVD  566

Query:  518 TRLELLIQKAMKKLMEGRTSFVIAHRLSTIQEADNILVLKDGQIIEQGNHQKLLADKGFY  577
            TR E+LIQKAM KL  GRTSFVIAHRLSTI++AD ILV++DG I+EQG H  +LL    G Y
Sbjct:  567 TRTEVLIQKAMAKLAHGRTSFVIAHRLSTIRDADTILVMEDGAIVEQGAHTELLTADGAY  626

Query:  578 YELYNSQFSNS                                                 588
              LY +QF+ +
Sbjct:  627 ARLYKAQFAEA                                                 637
```

There is also homology to SEQ IDs 160 and 6546.

Based on this analysis, it was predicted that this protein and its epitopes, could be useful antigens for vaccines or diagnostics.

EXAMPLE 1945

A DNA sequence (GBSx2054) was identified in *S. agalactiae* <SEQ ID 6027> which encodes the amino acid sequence <SEQ ID 6028>. Analysis of this protein sequence reveals the following:

```
Possible site: 37
>>> Seems to have a cleavable N-term signal seq.
      INTEGRAL   Likelihood = -10.88    Transmembrane   242-258 (235-263)
      INTEGRAL   Likelihood =  -9.82    Transmembrane   159-175 (129-177)
      INTEGRAL   Likelihood =  -9.71    Transmembrane    52-68  (49-77)
      INTEGRAL   Likelihood =  -8.49    Transmembrane   134-150 (129-158)
      INTEGRAL   Likelihood =  -1.17    Transmembrane   272-288 (272-289)
```

```
----- Final Results -----
            bacterial membrane --- Certainty = 0.5352(Affirmative) < succ>
            bacterial outside  --- Certainty = 0.0000(Not Clear)   < succ>
           bacterial cytoplasm --- Certainty = 0.0000(Not Clear)   < succ>
```

The protein has homology with the following sequences in the GENPEPT database.

```
>GP: CAB69751 GB: AL137187 putative ABC transporter [Streptomyces
coelicolor A3(2)]
Identities = 226/565 (40%), Positives = 342/565 (60%), Gaps = 1/565 (0%)

Query:    6 SYLKRYPNWLWLDLLGAMLFVTVILGMPTALAGMIDNGVTKGDRTGVYLWTFIMFIFVVL    65
            +YL+ Y  + L +    L    L +PT  A +ID GV KGD  +  +  +M     +
Sbjct:    8 TYLRPYKKPIALLVALQFLQTCASLYLPTLNAHIIDEGVVKGDSGYILSYGALMIGISLA   67

Query:   66 GIIGRITMAYASSRLTTTMIRDMRNDMYAKLQEYSHHEYEQIGVSSLVTRMTSDTFVLMQ   125
            ++   I  + +R     + RD+R  ++ ++Q +S  E    G    SL+TR T+D  +
Sbjct:   68 QVVCNIGAVFYGARTAAALGRDVRGAVFDRVQSFSAREVGHFGAPSLITRTTNDVQQVQM  127

Query:  126 FAEMSLRLGLVTPMVMIFSVVMILITSPSLAWLVAVAMPLLVGVILYVAIKTKPLSERQQ   185
             A M+  L + P++ +   +VM L     L+ ++   +P+L  +  +  K +PL  + Q
Sbjct:  128 LALMTFTLMVSAPIMCVGGIVMALGLDVPLSGVLLGVVPLAICVTLIVRKLRPLFRKMQ   187

Query:  186 TMLDKINQYVRENLTGLRVVRAFARENFQSQKFQVANQRYTDTSTGLFKLTGLTEPLFVQ   245
              LD +N+ +RE +TG RV+RAF R+ ++ Q+F+ AN    T+ + G   L   L P+ +
Sbjct:  188 VRLDTVNRVLREQITGNRVIRAFVRDEYEQQRFRKANTELTEVALGTGNLLALMFPVVMT  247

Query:  246 IIIAMIVAIVWFALDPLQRGAIKIGDLVAFIEYSFHALFSFLLFANLFTMYPRMVVSSHR   305
             ++   +A+VWF    + G ++IGDL AF+ Y   + S ++   +F M PR  V + R
Sbjct:  248 VVNLSSIAVWFGAHRIDSGGMQIGDLTAFLAYLMQIVMSVMMATFMFMMVPRAEVCAER  307

Query:  306 IREVMDMPISINPNTEGVTDTKLKGHLEFDNVTFAYPGETESPVLHDISFKAKPGETIAF   365
            I+EV++  S+ P   VT+ +  GHLE     F YPG E PVL  I   A+PGET A
Sbjct:  308 IQEVLETESSVVPPVAPVTELRRHGHLEIREAGFRYPG-AEEPVLRHIDLVARPGETTAV  366

Query:  366 IGSTGSGKSSLVNLIPRFYDVTLGKILVDGVDVRDYNLKSLRQKIGFIPQKALLFTGTIG   425
            IGSTGSGKS+L+ L+PR +D T G++LV+GVDVR  + K+L + +  +PQK  LF GT+
Sbjct:  367 IGSTGSGKSTLLGLVPRLFDATDGEVLVNGVDVRTVDPKTLAKVVSLVPQKPYLFAGTVA  426

Query:  426 ENLKYGKADATIDDLRQAVDISQAKEFIESHQEAFETHLAEGGSNLSGGQKRLSIARAV   485
             NL+YG  DAT ++L  A+ ++QAKEF+  +    +  +A+GG+N+SGGQ+QRL+IAR +
Sbjct:  427 TNLRYGNPDATDEELWHALAVAQAKEFVSELEGGLDAPIAQGGTNVSGGQRQRLAIARTL  486

Query:  486 VKDPDLYIFDDSFSALDYKTDATLRARLKEVTGDSTVLIVAQRVGTIMDADQIIVLDEGE   545
            V+ P++Y+FDDSFSALDY TDA  LRA L + T ++TV+IVAQRV TI DAD+I+VLDEG
Sbjct:  487 VQRPEIYLFDDSFSALDYATDAALRAELAQETAEATVVIVAQRVATIRDADRIVVLDEGR  546

Query:  546 IVGRGTHAQLIENNAIYREIAESQL                                    570
            +VG G H +L+ +N  YREI  SQL
Sbjct:  547 VVGVGRHHELMADNETYREIVLSQL                                    571
```

A related DNA sequence was identified in *S. pyogenes* <SEQ ID 4985> which encodes the amino acid sequence <SEQ ID 4986>. Analysis of this protein sequence reveals the following:

```
Possible site: 22
>>> Seems to have an uncleavable N-term signal seq
    INTEGRAL    Likelihood = -16.24    Transmembrane    155-171 (145-176)
    INTEGRAL    Likelihood =  -7.48    Transmembrane    130-146 (122-150)
    INTEGRAL    Likelihood =  -5.04    Transmembrane     13-29  (12-30)
    INTEGRAL    Likelihood =  -5.04    Transmembrane     56-72  (52-75)
    INTEGRAL    Likelihood =  -4.14    Transmembrane    239-255 (238-259)
    INTEGRAL    Likelihood =  -1.70    Transmembrane    269-285 (269-288)

----- Final Results -----
            bacterial membrane --- Certainty = 0.7496(Affirmative) < succ>
            bacterial outside  --- Certainty = 0.0000(Not Clear)   < succ>
           bacterial cytoplasm --- Certainty = 0.0000(Not Clear)   < succ>
```

An alignment of the GAS and GBS proteins is shown below.

```
Identities = 175/511 (34%), Positives = 296/511 (57%), Gaps = 3/511 (0%)

Query:    59 MFIFVVLGIIGRITMAYASSRLTTTMIRDMRNDMYAKLQEYSHHEYEQIGVSSLVTRMTS  118
             + I +LG++       ++++   +  DMR   + K+Q++S+   E      +LV R+T+
Sbjct:    56 LLIIALLGLMSGAINTVLAAKIAQGVSADMREKTFRKIQDFSYANIEAFNAGNLVVRLTN 115

Query:   119 DTFVLMQFAEMSLRLGLVTPMVMIFSVVMILITSPSLAWLVAVAMPLLVGVILYVAIKTK  178
             D  +     M ++    P++ I + +M + T P L W++ V + L+  ++   V   +
Sbjct:   116 DINQIQSLVMMMFQILFRLPILFIGAFIMAVQTFPQLWWVIVVMVILIALIMGLVMRQMG 175

Query:   179 PLSERQQTMLDKINQYVRENLTGLRVVRAFARENFQSQKFQVANQRYTDTSTGLFKLTGL  238
             P    + Q ++DKIN+   +ENL G+RVV++F +E  Q   KF+   +      + +   L
Sbjct:   176 PRFGKFQRLMDKINRIAKENLRGVRVVKSFVQEQQQYTKFKETSNDLLALNLSIGYGFSL 235

Query:   239 TEPLFVQIIIAMIVAIVWFALDPLQRGAIKIGDLVAFIEYSFHALFSFLLFANLFTMYPR  298
              +P  + +     +    +   ++      IG++ +F+ Y   +FS ++   ++      R
Sbjct:   236 MQPALMLVSYLAVYVSINVVSTMVETDPTVIGNIASFMTYMMQIMFSIIVVGSMGMQVSR 295

Query:   299 MVVSSHRIREVMDMPISINPNTEGVTDTKLKGHLEFDNVTFAYPGETESPVLHDISFKAK  358
                    VS  RIR+++       ++      E  +    + G +  FD+V+F YP + E P L  ISF   +
Sbjct:   296 AFVSMARIRQILSTEPAMTFENE--KEETISGSIVFDDVSFTYPNDDE-PTLKHISFAIE 352

Query:   359 PGETIAFIGSTGSGKSSLVNLIPRFYDVTLGKILVDGVDRDYNLKSLRQKIGFIPQKAL   418
             PG+ +   +G+TGSGKS+L  LIPR +D   G+IL+ G   ++     +LRQ +   + QKA+
Sbjct:   353 PGQMVGIVGATGSGKSTLAQLIPRLFDPQDGQILLGGKPIKTLSQTTLRQSVSIVLQKAI 412

Query:   419 LFTGTIGENLKYGKADATIDDLRQAVDISQAKEFIESHQEAFETHLAEGGSNLSGGQKQR  478
             LF+GTI +NL+  G A A  ID +++A  I+QAKEFI+      +E+ + E GSNLSGGQKQR
Sbjct:   413 LFSGTIADNLRQGSAKADIDAMQKAAQIAQAKEFIDRMDSRYESQVEERGSNLSGGQKQR 472

Query:   479 LSIARAVVKDPDLYIFDDSFSALDYKTDATLRARLKEVTGDSTVLIVAQRVGTIMDADQI  538
             LSIAR V+  P + I DDS SALD K++  ++  L        +T +IVAQ++ +++ AD+I
Sbjct:   473 LSIARGVINHPKILILDDSTSALDAKSEKRVQEALSHKLEGTTTVIVAQKISSVVKADKI 532

Query:   539 IVLDEGEIVGRGTHAQLIENNAIYREIAESQ                              569
             +VLD+G+++G  GTHA+L+  NNAIYREI E+Q
Sbjct:   533 LVLDQGQLIGEGTHAELVANNAIYREIYETQ                              563
```

There is also homology to SEQ IDs 72 and 6552.

Based on this analysis, it was predicted that these proteins and their epitopes could be useful antigens for vaccines or diagnostics.

EXAMPLE 1946

A DNA sequence (GBSx2055) was identified in *S. agalactiae* <SEQ ID 6029> which encodes the amino acid sequence <SEQ ID 6030>. Analysis of this protein sequence reveals the following:

```
Possible site: 24
>>> Seems to have no N-terminal signal sequence

----- Final Results -----
          bacterial cytoplasm --- Certainty = 0.2391(Affirmative) < succ>
           bacterial membrane --- Certainty = 0.0000(Not Clear)   < succ>
            bacterial outside --- Certainty = 0.0000(Not Clear)   < succ>
```

The protein has homology with the following sequences in the GENPEPT database.

```
>GP:CAA51784 GB:X73368 ORF 18.3 [Salmonella typhimurium]
Identities = 58/162 (35%), Positives = 92/162 (55%), Gaps = 8/162 (4%)

Query:    1 MIIRPIIKNDDQAVAQLIRQSLRAYDL--DKPDTAYSDPHLDHLTSYYEKIEKSGFFVIE   58
            + +R I   D+ A+A+++IRQ    Y L  DK T +DP+LD  L  Y +   + ++V+E
Sbjct:    9 LTVRRITTADNAAIARVIRQVSAEYGLTADPNLDELYQVYSQ-PGAAYWVVE           66

Query:   59 ERDEIIGCGGFGPLKNL---IAEMQKVYIAERFRGKGLATDLVKMIEVEARKIGYRQLYL  115
            +  ++G GG  PL      I E+QK+Y     RG+GLA  L  M     AR+ G+++ YL
Sbjct:   67 QNGCVVGGGGVAPLSCSEPDICELQKMYFLPVIRGQGLAKKLALMALDHAREQGFKRCYL 126
```

-continued

```
Query:  116 ETASTLSRATAVYKHMGYCALSQPIANDQGHTAMDIWMIKDL          157
            ET + L   A+Y+ +G+   +S+P+    GH   ++ M+KDL
Sbjct:  127 ETTAFLREAIALYERLGFEHISEPL-GCTGHVDCEVRMLKDL          167
```

No corresponding DNA sequence was identified in *S. pyogenes*.

Based on this analysis, it was predicted that this protein and its epitopes, could be useful antigens for vaccines or diagnostics.

EXAMPLE 1947

A DNA sequence (GBSx2056) was identified in *S. agalactiae* <SEQ ID 6031> which encodes the amino acid sequence <SEQ ID 6032>. This protein is predicted to be ABC transporter. Analysis of this protein sequence reveals the following:

```
Possible site: 25
>>> Seems to have no N-terminal signal sequence

----- Final Results -----
            bacterial cytoplasm --- Certainty = 0.1738(Affirmative) < succ>
            bacterial membrane  --- Certainty = 0.0000(Not Clear)   < succ>
            bacterial outside   --- Certainty = 0.0000(Not Clear)   < succ>
```

The protein has homology with the following sequences in the GENPEPT database.

```
>GP:CAB12566 GB:Z99108 similar to ABC transporter (ATP binding
protein) [Bacillus subtilis]
Identities = 269/625 (43%), Positives = 397/625 (63%), Gaps = 11/625 (1%)

Query:    1 MSDFLVDGLTKSVGDKTVFSNVSFIIHSLDRIGIIGVNGTGKTTLLDVISGELGFDGDRS    60
            MS    + L K+ GDKT+F ++SF I     +RIG+IG NGTGK+TLL VI+G     +
Sbjct:    1 MSILKAENLYKTYGDKTLFDHISFHIEENERIGLIGPNGTGKSTLLKVIAGLESIE--EG   58

Query:   61 PFSSANDYKIAYLKQEPDFDDSQTILDTVLSSDLREMALIKEYELLLNHY-----EESKQ  115
            + +   ++ +L Q+P+     QT+L+ + S +    M  ++EYE  L          E +Q
Sbjct:   59 EITKSGSVQVEFLHQDPELPAGQTVLEHIYSGESAVMKTLREYEKALYELGKDPENEQRQ  118

Query:  116 SRLEKVMAEMDSLDAWSIESEVKTVLSKLGITDLQLSVGELSGGLRRRVQLAQVLLNDAD  175
                 L      A+MD+ +AW  +   KTVLSKLG+ D+     V ELSGG ++RV +A+ L+   AD
Sbjct:  119 KHLLAAQAKMDANNAWDANTLAKTVLSKLGVNDVTKPVNELSGGQKKRVAIAKNLIQPAD  178

Query:  176 LLLLDEPTNHLDIDTIAWLTNFLKNSKKTVLFITHDRYFLDNVATRIFELDKAQITEYQG  235
            LL+LDEPTNHLD  +TI WL  +L       V+  +THDRYFL+ V  RI+EL++  +   Y+G
Sbjct:  179 LLILDEPTNHLDNETIEWLEGYLSQYPGAVMLVTHDRYFLNRVTNRIYELERGSLYTYKG  238

Query:  236 NYQDYVRLRAEQDERDAASLHKKKQLYKQELAWMRTQPQARATKQQARINRFQNLKNDLH  295
            NY+ ++   RAE++  +        K++ L ++ELAW+R   +AR+TKQ+ARI+R + LK
Sbjct:  239 NYEVFLEKRAEREAQAEQKETKRQNLLRRELAWLRRGAKARSTKQKARIDRVETLKEQTG  298

Query:  296 QTSDTSDLEMTFETSRIGKKVINFENVSFSYPDKSILKDFNLLIQNKDRIGIVGDNGVGK  355
                  S  S L+     + R+GK+VI   ENV  +Y   +  ++   FN L+       +RIGI+G NG+GK
Sbjct:  299 PQSSGS-LDFAIGSHRLGKQVIEAENVMIAYDGRMLVDRFNELVIPGERIGIIGPNGIGK  357

Query:  356 STLLNLIVQDLQPDSGNVSIGETIRVGYFSQQLHNMDGSKRVINYLQEVADEVKTSVGTT  415
            +TLLN +     PD G+++IG+T+R+GY++Q      M+G     +VI+Y++E A+   VKT+ G
Sbjct:  358 TTLLNALAGRHTPDGGDITIGQTVRIGYYTQDHSEMNGELKVIDYIKETAEVVKTADGDM  417

Query:  416 SVTE-LLEQFLFPRSTHGTQIAKLSGGEKKRLYLLKILIEKPNVLLLDEPTNDLDIATLT  474
                E +LE+FLFPRS    T I  KLSGGEK+RLYLL++L+++PNVL LDEPTNDLD   TL+
Sbjct:  418 ITAEQMLERFLFPRSMQQTYIRKLSGGEKRRLYLLQVLMQEPNVLFLDEPTNDLDTETLS  477

Query:  475 VLENFLQGFGGPVITVSHDRYFLDKVANKIIAFEDND-IREFFGNYTDYLDEKAFNEQNN  533
            VLE+++  F G  VITVSHDRYFLD+V  +++I FE N   I    F G+Y+DY++E      +
Sbjct:  478 VLEDYIDQFPGVVITVSHDRYFLDRVVDRLIVFEGNGVISRFQGSYSDYMEESKAKKAAP  537

Query:  534 EVISKKESTKTSREKQSRKRMSYFEKQEWATIEDDIMILENTITRIENDMQTCGSDFTRL  593
            +  + ++E T +   K+ RK++SY ++ EW    IED I   LE       ++E D+   GSDF ++
Sbjct:  538 KP-AAEEKTAEAEPKKKRKKLSYKDQLEWDGIEDKIAQLEEKHEQLEADIAAAGSDFGKI  596

Query:  594 SDLQKELDAKNEALLEKYDRYEYLS                                    618
            +L E    E L    DR+ LS
Sbjct:  597 QELMAEQAKTAEELEAAMDRWTELS                                    621
```

A related DNA sequence was identified in *S. pyogenes* <SEQ ID 6033> which encodes the amino acid sequence <SEQ ID 6034>. Analysis of this protein sequence reveals the following:

```
Possible site: 60
>>> Seems to have no N-terminal signal sequence

----- Final Results -----
             bacterial cytoplasm --- Certainty = 0.2591(Affirmative) < succ>
              bacterial membrane --- Certainty = 0.0000(Not Clear)   < succ>
                bacterial outside --- Certainty = 0.0000(Not Clear)   < succ>
```

An alignment of the GAS and GBS proteins is shown below.

```
Identities = 467/624 (74%), Positives = 535/624 (84%), Gaps = 3/624 (0%)

Query:    1 MSDFLVDGLTKSVGDKTVFSNVSFIIHSLDRIGIIGVNGTGKTTLLDVISGELGFDGDRS    60
            MS FLV+ LTK+VGDKTVF ++SFIIH  DRIGIIGVNGTGKTTLLDV+SG LGFDGD S
Sbjct:    1 MSHFLVEKLTKTVGDKTVFQDISFIIHDFDRIGIIGVNGTGKTTLLDVLSGRLGFDGDHS    60

Query:   61 PFSSANDYKIAYLKQEPDFDDSQTILDTVLSSDLREMALIKEYELLLNHYEESKQSRLEK   120
            PFS ANDYKIAYL Q+P+F+D+ ++LDTVLS+D++ + LI++YELL+ +Y E KQ  LE
Sbjct:   61 PFSKANDYKIAYLTQDPEFNDAASVLDTVLSADVKAIQLIRQYELLMANYTEDKQESLES   120

Query:  121 VMAEMDSLDAWSIESEVKTVLSKLGITDLQLSVGELSGGLRRRVQLAQVLLNDADLLLLD   180
            +M+EMD LDAWSIES+VKTVLSKLGITDL+  VG+LSGG+RRRVQLAQVLL  ADLLLLD
Sbjct:  121 LMSEMDRLDAWSIESDVKTVLSKLGITDLEQKVGDLSGGMRRRVQLAQVLLGAADLLLLD   180

Query:  181 EPTNHLDIDTIAWLTNFLKNSKKTVLFITHDRYFLDNVATRIFELDKAQITEYQGNYQDY   240
            EPTNHLDIDTIAWLT +LK +KKTVLFITHDRYFLD+VATRIFELDKA +TEYQGNYQDY
Sbjct:  181 EPTNHLDIDTIAWLTTYLKTAKKTVLFITHDRYFLDHVATRIFELDKAGLTEYQGNYQDY   240

Query:  241 VRLRAEQDERDAASLHKKKQLYKQELAWMRTQPQARATKQQARINRFQNLKNDLHQTSDT   300
            VRL+AEQDERDAA+LHKKKQLYKQELAWMRTQPQARATKQQARINRF +LK ++HQ S
Sbjct:  241 VRLKAEQDERDAANLHKKKQLYKQELAWMRTQPQARATKQQARINRFSDLKKEVHQDSSA   300

Query:  301 SDLEMTFETSRIGKKVINFENVSFSYPDKSILKDFNLLIQNKDRIGIVGDNGVGKSTLLN   360
              LEMTFETSRIGKKVI+FE++SF+Y D+ ++KDFNL+IQNKDRIGIVGDNGVGKSTLLN
Sbjct:  301 DKLEMTFETSRIGKKVIHFEDLSFAYGDRQLIKDFNLIIQNKDRIGIVGDNGVGKSTLLN   360

Query:  361 LIVQDLQPDSGNVSIGETIRVGYFSQQLHNMDGSKRVINYLQEVADEVKTSVGTTSVTEL   420
            +I  DL+P SG + IG+TIRVGYFSQQL +MD +KRVINYLQEVADEVKTSVGTTS++EL
Sbjct:  361 IINGDLKPTSGKLDIGDTIRVGYFSQQLKDMDETKRVINYLQEVADEVKTSVGTTSISEL   420

Query:  421 LEQFLFPRSTHGTQIAKLSGGEKKRLYLLKILIEKPNVLLLDEPTNDLDIATLTVLENFL   480
            LEQFLFPRS+HGT IAKLSGGEKKRLYLLK+LIEKPNVLLLDEPTNDLDIATL VLENFL
Sbjct:  421 LEQFLFPRSSHGTLIAKLSGGEKKRLYLLKLLIEKPNVLLLDEPTNDLDIATLKVLENFL   480

Query:  481 QGFGGPVITVSHDRYFLDKVANKIIAFEDNDIREFFGNYTDYLDEKAFNEQNNEVISKKE   540
             F GPVITVSHDRYFLDKVA KI+AFE+ DIR F+GNY+DYLDEK F ++  E    K
Sbjct:  481 ANFAGPVITVSHDRYFLDKVATKILAFEEGDIRVFYGNYSDYLDEKVFEKETVEADLAKT   540

Query:  541 STKTS---REKQSRKRMSYFEKQEWATIEDDIMILENTITRIENDMQTCGSDFTRLSDLQ   597
            +         +K+ RKRMSY EKQEWA IED I +E  I  IEN M T  SD+ +L+ LQ
Sbjct:  541 TVTEEVPLPQKEERKRMSYLEKQEWAQIEDKIATIEANIEEIENQMLTVVSDYGQLAQLQ   600

Query:  598 KELDAKNEALLEKYDRYEYLSELD                                       621
            KELD +N  LL  Y+R+EYLS LD
Sbjct:  601 KELDQRNNDLLLAYERFEYLSGLD                                       624
```

Based on this analysis, it was predicted that these proteins and their epitopes could be useful antigens for vaccines or diagnostics.

EXAMPLE 1948

A DNA sequence (GBSx2057) was identified in *S. agalactiae* <SEQ ID 6035> which encodes the amino acid sequence <SEQ ID 6036>. This protein is predicted to be poly(a) polymerase (papS). Analysis of this protein sequence reveals the following:

```
Possible site: 14
>>> Seems to have no N-terminal signal sequence
```

-continued

```
----- Final Results -----
            bacterial cytoplasm --- Certainty = 0.2658(Affirmative) < succ>
            bacterial membrane  --- Certainty = 0.0000(Not Clear)   < succ>
             bacterial outside  --- Certainty = 0.0000(Not Clear)   < succ>
```

A related GBS nucleic acid sequence <SEQ ID 9957> which encodes amino acid sequence <SEQ ID 9958> was also identified.

The protein has homology with the following sequences in the GENPEPT database.

```
>GP: AAB38446 GB: L47709 poly(A) polymerase [Bacillus subtilis]
Identities = 157/395 (39%), Positives = 235/395 (58%), Gaps = 14/395 (3%)

Query:  11 FQKALPILKKIKKAGYEAYFVGGSVRDVLLDRPIHDVDIATSSYPEETKQIFKRTVDVGI   70
           F KALP+L+ + +AG++AYFVGG+VRD  + R I DVDIAT + P++ +++F+RTVDVG
Sbjct:   5 FIKALPVLRILIEAGHQAYFVGGAVRDSYMKRTIGDVDIATDAAPDQVERLFQRTVDVGK   64

Query:  71 EHGTVLVLEKGGEYEITTFRTEEVYVDYRRPSQVNFVRSLEEDLKRRDFTVNAFALNEDG  130
           EHGT++VL +   YE+TTFRTE  YVD+RRPS+V F+ SLEEDLKRRD T+NA A+  DG
Sbjct:  65 EHGTIIVLWEDETYEVTTFRTESDYVDFRRPSEVQFISSLEEDLKRRDLTINAMAMTADG  124

Query: 131 EVIDLFHGLDDLDNHLLRAVGLASERFNEDALRIMRGLRFSASLNFDIETTTFEAMKKHA  190
           +V+D F G  D+D  ++R VG   +RF EDALR++R +RF + L F +     T EA+ K
Sbjct: 125 KVLDYFGGKKDIDQKVIRTVGKPEDRFQEDALRMLRAVRFMSQLGFTLSPETEEAIAKEK  184

Query: 191 SLLEKISVERSFIEFDKLLLAPYWRKGMLALIDSHAFNYLPCLKNRELQLSAFLSQLDKD  250
           SLL  +SVER  IEF+KLL       R+ +  LI +  + LP  ++     L   +S   +
Sbjct: 185 SLLSHVSVERKTIEFEKLLQGRASRQALQTLIQTRLYEELPGFYHKRENL---ISTSEFP  241

Query: 251 FLFETS-EQAWASLILSMEV--EHTKTFLKKWKTSTHFQKDVEHIVDVYRIREQMGLTKE  307
           F    TS E+ WA+L++++ +  +    FLK WK      K+  HI D +       L
Sbjct: 242 FFSLTSREELWAALLINLGIVLKDAPLFLKAWKLPGKVIKEAIHIADTF----GQSLDAM  297

Query: 308 HLYRYGKTIIKQAEGIRKAR-GLMVDFEKIEQLD---SELAIHDRHEIVVNGGTLIKKLG  363
           +YR GK + A  I + +D +K++ +      L I   ++ + G  L+
Sbjct: 298 TMYRAGKKALLSAAKISQLRQNEKLDEKKLKDIQYAYQNLPIKSLKDLDITGKDLLALRN  357

Query: 364 IKPGPQMGDIISQIELAIVLGQLINEEEAILHFVK                           398
              G  + + +   IE A+V G+L N+++ I  ++K
Sbjct: 358 RPAGKWVSEELQWIEQAVVTGKLSNQKKHIEEWLK                           392
```

A related DNA sequence was identified in *S. pyogenes* <SEQ ID 6037> which encodes the amino acid sequence <SEQ ID 6038>. Analysis of this protein sequence reveals the following:

```
Possible site: 13
>>> Seems to have no N-terminal signal sequence

----- Final Results -----
            bacterial cytoplasm --- Certainty = 0.2023(Affirmative) < succ>
            bacterial membrane  --- Certainty = 0.0000(Not Clear)   < succ>
             bacterial outside  --- Certainty = 0.0000(Not Clear)   < succ>
```

An alignment of the GAS and GBS proteins is shown below.

```
Identities = 256/400 (64%), Positives = 312/400 (78%)

Query:   2 MRLNYLPSEFQKALPILKKIKKAGYEAYFVGGSVRDVLLDRPIHDVDIATSSYPEETKQI   61
           M+L  +PSEFQKALPIL KIK+AGYEAYFVGGSVRDVLL+RPIHDVDIATSSYPEETK I
Sbjct:   1 MKLMTMPSEFQKALPILTKIKEAGYEAYFVGGSVRDVLLERPIHDVDIATSSYPEETKAI   60

Query:  62 FKRTVDVGIEHGTVLVLEKGGEYEITTFRTEEVYVDYRRPSQVNFVRSLEEDLKRRDFTV  121
           F RTVDVGIEHGTVLVLE GGEYEITTFRTE++YVDYRRPSQV+FVRSLEEDLKRRDFTV
Sbjct:  61 FNRTVDVGIEHGTVLVLENGGEYEITTFRTEDIYVDYRRPSQVSFVRSLEEDLKRRDFTV  120

Query: 122 NAFALNEDGEVIDLFHGLDDLDNHLLRAVGLASERFNEDALRIMRGLRFSASLNFDIETT  181
           NA AL+E+G+VID F GL DL   LRAVG A ERF EDALRIMRG RF+ASL FDIE
Sbjct: 121 NALALDENGQVIDKFRGLIDLKQKRLRAVGKAEERFEEDALRIMRGFRFAASLDFDIEAI  180
```

-continued

```
Query:  182 TFEAMKKHASLLEKISVERSFIEFDKLLLAPYWRKGMLALIDSHAFNYLPCLKNRELQLS  241
            TFEAM+ H+ LLEKISVERSF EFDKLL+AP+WRKG+ A+I   A++YLP LK +E  L+
Sbjct:  181 TFEAMRSHSPLLEKISVERSFTEFDKLLMAPHWRKGISAMIACQAYDYLPGLKQQEAGLN  240

Query:  242 AFLSQLDKDFLFETSEQAWASLILSMEVEHTKTFLKKWKTSTHFQKDVEHIVDVYRIREQ  301
              +  L  +F F    QAWA +++S+ +E  K+FLK WKTS  FQ+ V  ++ +YRIR++
Sbjct:  241 HLIVSLKDNFTFSDYHQAWAYVMISLAIEDPKSFLKAWKTSNDFQRYVTKLIALYRIRQE  300

Query:  302 MGLTKEHLYRYGKTIIKQAEGIRKARGLMVDFEKIEQLDSELAIHDRHEIVVNGGTLIKK  361
              K  +Y+YGK +    E +RKA+ L VD ++I   LD  L IHD+H+IV+NG  LIK
Sbjct:  301 RSFEKLDIYQYGKKMASLVEDLRKAQSLSVDMDRINTLDQALVIHDKHDIVLNGSHLIKD  360

Query:  362 LGIKPGPQMGDIISQIELAIVLGQLINEEEAILHFVKQYL                     401
              G+K GPQ+G ++ ++ELAIV G+L N+    I   FV++ L
Sbjct:  361 FGMKSGPQLGLMLEKVELAIVEGRLDNDFTTIEAFVREEL                     400
```

Based on this analysis, it was predicted that these proteins and their epitopes could be useful antigens for vaccines or diagnostics.

EXAMPLE 1949

A DNA sequence (GBSx2058) was identified in *S. agalactiae* <SEQ ID 6039> which encodes the amino acid sequence <SEQ ID 6040>. Analysis of this protein sequence reveals the following:

```
Possible site: 13
>>> Seems to have no N-terminal signal sequence

----- Final Results -----
           bacterial cytoplasm --- Certainty = 0.2939(Affirmative) < succ>
           bacterial membrane  --- Certainty = 0.0000(Not Clear)   < succ>
            bacterial outside  --- Certainty = 0.0000(Not Clear)   < succ>
```

The protein has homology with the following sequences in the GENPEPT database.

```
>GP: BAB07346 GB: AP001519 unknown conserved protein
[Bacillus halodurans]
Identities = 94/274 (34%), Positives = 153/274 (55%), Gaps = 2/274 (0%)

Query:    2 KLALITDTSAYLPEAIENHEDVYVLDIPIIIDGKTYIEGQNLTLDQYYDKLAASKELPKT   61
            K+A++TD++AYL       V V+ + ++  + Y E   L+  +Y+KL  ++LP T
Sbjct:    3 KIAIVTDSTAYLGPKRAKELGVIVVPLSVVFGEEAYQEEVELSSADFYEKLKHEEKLPTT   62

Query:   62 SQPSLAELDDLLCQLEKEGYTHVLGLFIAAGISGFWQNIQFLIEEHPNLTIAFPDTKITS  121
            SQP++    +L KEG+ V+ + +++ ISG +Q+      +  + D+ I+
Sbjct:   63 SQPAVGLFVETFERLAKEGFEVVISIHLSSKISGTYQSALTAGSMVEGIEVIGYDSGISC  122

Query:  122 APQGNLVRNALMCSREGMDFDVIVNKIQSQIEKIEGFIVVNDLNHLVKGGRLSNGSAIIG  181
             PQ N V  A  +EG D  I++ +    ++   VV+DL+HL +GGRL+    ++G
Sbjct:  123 EPQANFVAEAAKLVKEGADPQTIIDHLDEVKKRTNALFVVHDLSHLHRGGRLNAAQLVVG  182

Query:  182 NLLSIKPVLHFNEEGKIVVYEKVRTEKKALKRLAEI-VKEMTADGEYDIAIIHSRAQDKA  240
            +LL IKP+LHF E+G IV  EKVRTEKKA  R+ E+ +E ++       +IH+   D A
Sbjct:  183 SLLKIKPILHF-EDGSIVPLEKVRTEKKAWARVKELFAEEASSASSVKATVIHANRLDGA  241

Query:  241 EQLYNLLAKAGLKDDLEIVSFGGVIATHLGEGAV                            274
            E+L + +      D+ I  FG VI THLGEG++
Sbjct:  242 EKLADEIRSQFSHVDVSISHFGPVIGTHLGEGSI                            275
```

A related DNA sequence was identified in *S. pyogenes* <SEQ ID 6041> which encodes the amino acid sequence <SEQ ID 6042>. Analysis of this protein sequence reveals the following:

```
Possible site: 14
>>> Seems to have no N-terminal signal sequence

----- Final Results -----
           bacterial cytoplasm --- Certainty = 0.3379(Affirmative) < succ>
           bacterial membrane  --- Certainty = 0.0000(Not Clear)   < succ>
            bacterial outside  --- Certainty = 0.0000(Not Clear)   < succ>
```

An alignment of the GAS and GBS proteins is shown below.

```
Identities = 181/281 (64%), Positives = 233/281 (82%)

Query:    1 MKLALITDTSAYLPEAIENHEDVYVLDIPIIIDGKTYIEGQNLTLDQYYDKLAASKELPK   60
            MKLA+ITD++A LP  ++  + ++ LDIP+IID +TY EG+NL++D +Y K+A S+ LPK
Sbjct:    1 MKLAVITDSTATLPTDLKQDKAIFSLDIPVIIDDETYFEGRNLSIDDFYQKMADSQNLPK   60

Query:   61 TSQPSLAELDDLLCQLEKEGYTHVLGLFIAAGISGFWQNIQFLIEEHPNLTIAFPDTKIT  120
            TSQPSL+ELD+LL  L   +GYTHV+GLF+A GISGFWQNIQFL EEHP + +AFPD+KIT
Sbjct:   61 TSQPSLSELDNLLGLLSSKGYTHVIGLFLAGGISGFWQNIQFLAEEHPEIEMAFPDSKIT  120

Query:  121 SAPQGNLVRNALMCSREGMDFDVIVNKIQSQIEKIEGFIVVNDLNHLVKGGRLSNGSAII  180
            SAP G++V+N L  SR+GM F  I+NK+Q QI+      FI+V+DLNHLVKGGRLSNGSA++
Sbjct:  121 SAPLGSMVKNVLDWSRQGMTFQAILNKLQEQIDGTTAFIMVDDLNHLVKGGRLSNGSALL  180

Query:  181 GNLLSIKPVLHFNEEGKIVVYEKVRTEKKALKRLAEIVKEMTADGEYDIAIIHSRAQDKA  240
            GNLLSIKP+L F+EEGKIVVYEKVRTEKKA+KRL EI+ ++ ADG+Y++ IIHS+AQDKA
Sbjct:  181 GNLLSIKPILRFDEEGKIVVYEKVRTEKKAMKRLVEILNDLIADGQYNVFIIHSKAQDKA  240

Query:  241 EQLYNLLAKAGLKDDLEIVSFGGVIATHLGEGAVAFGITPK                    281
            + L  LL  +G + D+E V FG VIATHLGEGA+AFG+TP+
Sbjct:  241 DYLKRLLQDSGYQYDIEEVHFGAVIATHLGEGAIAFGVTPR                    281
```

Based on this analysis, it was predicted that these proteins and their epitopes could be useful antigens for vaccines or diagnostics.

EXAMPLE 1950

A DNA sequence (GBSx2059) was identified in *S. agalactiae* <SEQ ID 6043> which encodes the amino acid sequence <SEQ ID 6044>. Analysis of this protein sequence reveals the following:

```
Possible site: 46
>>> Seems to have no N-terminal signal sequence
     INTEGRAL     Likelihood = -1.59    Transmembrane     51-67 (50-67)

----- Final Results -----
             bacterial membrane --- Certainty = 0.1638(Affirmative) < succ>
              bacterial outside --- Certainty = 0.0000(Not Clear)   < succ>
            bacterial cytoplasm --- Certainty = 0.0000(Not Clear)   < succ>
```

The protein has no significant homology with any sequences in the GENPEPT database.

A related DNA sequence was identified in *S. pyogenes* <SEQ ID 6045> which encodes the amino acid sequence <SEQ ID 6046>. Analysis of this protein sequence reveals the following:

```
Possible site: 61
>>> Seems to have no N-terminal signal sequence
     INTEGRAL     Likelihood = -3.19    Transmembrane     50-66 (49-67)

----- Final Results -----
             bacterial membrane --- Certainty = 0.2275(Affirmative) < succ>
              bacterial outside --- Certainty = 0.0000(Not Clear)   < succ>
            bacterial cytoplasm --- Certainty = 0.0000(Not Clear)   < succ>
```

The protein has no significant homology with any sequences in the GENPEPT database.

An alignment of the GAS and GBS proteins is shown below.

```
Identities = 94/126 (74%), Positives = 115/126 (90%)

Query:    1 MEVIREQEFVNQYHYDARNLEWEEENGTPKTNFEVTFQLANRDEAAKVTSIVAVLQFVIV   60
            M+++RE+EFVNQYHYDARNLEWE+ENGTP+TNFEVTFQL ++DE  K T IV+VLQFVIV
Sbjct:    1 MQLVREKEFVNQYHYDARNLEWEKENGTPETNFEVTFQLIDKDEQQKETVIVSVLQFVIV   60
```

```
Query: 61 RDEFVISGVISQMAHIQGRLINEPSEFSQDEVENLAAPLLEIVKRLTYEVTEIALDRPGV 120
          ++EFVISGVISQM  I   RL+++PSEF+Q+EVE+LAAPLL++VKRLTYEVTEIALDRPG+
Sbjct: 61 KEEFVISGVISQMVRILDRLVDKPSEFTQEEVESLAAPLLDMVKRLTYEVTEIALDRPGI 120

Query: 121 TLEFNS                                                    126
           LEF +
Sbjct: 121 HLEFKN                                                    126
```

SEQ ID 6044 (GBS416) was expressed in *E. coli* as a His-fusion product. SDS-PAGE analysis of total cell extract is shown in FIG. 79 (lane 4; MW 17.5 kDa).

GBS416-His was purified as shown in FIG. 214, lane 7.

Based on this analysis, it was predicted that these proteins and their epitopes could be useful antigens for vaccines or diagnostics.

EXAMPLE 1951

A DNA sequence (GBSx2060) was identified in *S. agalactiae* <SEQ ID 6047> which encodes the amino acid sequence <SEQ ID 6048>. Analysis of this protein sequence reveals the following:

```
Possible site: 36
>>> Seems to have no N-terminal signal sequence

----- Final Results -----
            bacterial cytoplasm --- Certainty = 0.3875(Affirmative) < succ>
            bacterial membrane  --- Certainty = 0.0000(Not Clear)   < succ>
            bacterial outside   --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1952

A DNA sequence (GBSx2061) was identified in *S. agalactiae* <SEQ ID 6049> which encodes the amino acid sequence <SEQ ID 6050>. Analysis of this protein sequence reveals the following:

```
Possible site: 17
>>> Seems to have an uncleavable N-term signal seq

----- Final Results -----
            bacterial membrane  --- Certainty = 0.0000(Not Clear) < succ>
            bacterial outside   --- Certainty = 0.0000(Not Clear) < succ>
            bacterial cytoplasm --- Certainty = 0.0000(Not Clear) < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1953

A DNA sequence (GBSx2062) was identified in *S. agalactiae* <SEQ ID 6051> which encodes the amino acid sequence <SEQ ID 6052>. This protein is predicted to be PTS system, fructose-specific enzyme II, BC component (fruA-1). Analysis of this protein sequence reveals the following:

```
Possible site: 23
>>> Seems to have no N-terminal signal sequence
      INTEGRAL    Likelihood = -10.56    Transmembrane    630-646 (618-653)
      INTEGRAL    Likelihood =  -7.43    Transmembrane    307-323 (303-331)
```

```
         -continued
INTEGRAL     Likelihood = -7.01     Transmembrane     415-431 (412-435)
INTEGRAL     Likelihood = -7.01     Transmembrane     448-464 (444-474)
INTEGRAL     Likelihood = -3.72     Transmembrane     595-611 (591-612)
INTEGRAL     Likelihood = -3.61     Transmembrane     530-546 (529-553)
INTEGRAL     Likelihood = -2.39     Transmembrane     350-366 (350-371)
INTEGRAL     Likelihood = -1.70     Transmembrane     486-502 (486-506)
INTEGRAL     Likelihood = -1.49     Transmembrane     376-392 (376-392)

----- Final Results -----
              bacterial membrane --- Certainty = 0.5225(Affirmative) < succ>
               bacterial outside --- Certainty = 0.0000(Not Clear)   < succ>
             bacterial cytoplasm --- Certainty = 0.0000(Not Clear)   < succ>
```

A related GBS nucleic acid sequence <SEQ ID 9959> which encodes amino acid sequence <SEQ ID 9960> was also identified.

The protein has homology with the following sequences in the GENPEPT database.

```
>GP: BAB04547 GB: AP001510 PTS system, fructose-specific enzyme II, BC
component [Bacillus halodurans]
Identities = 320/659 (48%), Positives = 438/659 (65%), Gaps = 46/659 (6%)

Query:    1 MKIQDLLKKEVMIMDLKATSKEAAIDEMITKLVDTGVVTNFAIFKDGIMKREAQTSTGLG    60
            +KI LLKK+ M+++L+A SKEA IDE++  L   G + +   FK  I++RE+Q++TG+G
Sbjct:    2 LKISELLKKDTMVLNLRAASKEAVIDELVRTLDKAGRLNDAQAFKRAILERESQSTTGVG    61

Query:   61 DGIAMPHSKNAAVKEATVLFAKSASGVDYEALDGQPTDLFFMIAAPDGANDTHLAALAEL   120
            +GIA+PH+K AAVK+  + F +S +G+DYE+LDGQP+ LFFMIAA +GAN+ HL  L+ L
Sbjct:   62 EGIAIPHAKTAAVKQPAIAFGRSDAGIDYESLDGQPSHLFFMIAASEGANNEHLETLSRL   121

Query:  121 SKYLLKEGFADQLRQAKTPDDIIATFDSNSISQETVAPQTVQSTSKGSDYIVAVTACTTG   180
            S +L+ E F   L +A++ D+I+A  D      +E         +   +G + ++AVT C  TG
Sbjct:  122 STFLMDETFRSTLMKAQSEDEILAAID----KKEAETAGEAEEKQEGYE-LLAVTGCPTG   176

Query:  181 IAHTYMAEEALKKKAAEMGVGIKVETNGASGVGNKLTSSDIARAKGVIIAADKAVEMDRF   240
            IAHTYMA + LK KA E+GV IKVETNG+ GV N+LT  +I+ AK +I+AAD  VEMDRF
Sbjct:  177 IAHTYMAADNLKSKAQELGVSIKVETNGSGGVKNRLTDEEISAAKAIIVAADTKVEMDRF   236

Query:  241 DGKPLVSRPVADGIKKSEDLINIILDNKAQTYHAKNQNDKQSGESDGKSGLGS---AFYK   297
               GKP++  PV DGI++ ++LI+  L  KA  Y  +   Q+    DG +G G      FYK
Sbjct:  237 HGKPVIQVPVTDGIRRPKELIDQALAGKAPVY----EGGAQASGEDGSAGGGRPKLGFYK   292

Query:  298 HLMGGVSQMLPFVIGGGIMIAIAFLFDNILGVPKDQLSNLGSYHEIAALFKNIGGA-AFA   356
            HLM GVS MLPFV+GGGI+IAI+F+F       P D    SYH  A +    IGG  AF
Sbjct:  293 HLMNGVSNMLPFVVGGGILIAISFMFGIKAFDPSDP-----SYHPFAEMLMTIGGGNAFG   347

Query:  357 FMLPVLAGYIAYSIAEKPGLVAGFVAGSIASSGLAFGKVPFAEGGKATLALAGVPSGFLG   416
               M+PVLA +IA SIA++PG  AG + G IAS+G A                    GFLG
Sbjct:  348 LMIPVLAAFIAMSIADRPGFAAGMIGGLIASTGEA--------------------GFLG   386

Query:  417 ALVGGFLAGGVILLLRKLLSGLPKSLEGIKSILLYPLLGVLITGFLMLLVNIPMAAINTA   476
             L+ GFLAG V L ++K+L+ LP++L+GIK+IL YP+  + ITG +ML++  P+AA NT
Sbjct:  387 GLIAGFLAGYVALGVKKVLANLPQTLDGIKTILFYPVFNIFITGMIMLVIVGPLAAFNTG   446

Query:  477 LNTFLQGLSGSSAVLMGLLVGGMMAVDMGGPVNKAAYVFGTGTLAATVANGGSVVMAAVM   536
            L  +L +  ++ V++G+++GGMMAVDMGGP+NKAA+ FG   + A   G    AAVM
Sbjct:  447 LQDWLGSMGTANMVILGVILGGMMAVDMGGPINKAAFTFGIAMIDA----GNFGPHAAVM   502

Query:  537 AGGMVPPLAVFVATLLFKDKFNNEERQSGLTNIVMGLSFITEGAIPFGAADPARAIPSFI   596
            AGGMVPPL + +AT LFK KF  +ER++G TN ++G SFITEGAIPF AADP R IPS I
Sbjct:  503 AGGMVPPLGIALATTLFKKKFTKQEREAGKTNYILGASFITEGAIPFAAADPGRVIPSII   562

Query:  597 VGSALTGALVGLAGIKLMAPHGGIFVI---ALTSNPLLYILFILIGAVVSGVLFGLFRK   652
            VGSA  G L  L + L APHGG FVI    + +NPLLY++ I+ G++V+ +L G ++K
Sbjct:  563 VGSAFAGGLTALFNVTLSAPHGGAFVIFIGNIVNNPLLYLVAIIAGSIVTALLLGFWKK   621
```

A related DNA sequence was identified in *S. pyogenes* <SEQ ID 6053> which encodes the amino acid sequence <SEQ ID 6054>. Analysis of this protein sequence reveals the following:

```
Possible site: 18
>>> Seems to have no N-terminal signal sequence
    INTEGRAL    Likelihood = -10.77   Transmembrane    624-640 (612-646)
    INTEGRAL    Likelihood =  -7.59   Transmembrane    301-317 (297-321)
```

```
                           -continued
INTEGRAL    Likelihood = -6.85      Transmembrane   442-458 (439-468)
INTEGRAL    Likelihood = -5.95      Transmembrane   409-425 (406-426)
INTEGRAL    Likelihood = -3.61      Transmembrane   524-540 (523-547)
INTEGRAL    Likelihood = -2.50      Transmembrane   337-353 (337-353)
INTEGRAL    Likelihood = -2.44      Transmembrane   589-605 (589-605)
INTEGRAL    Likelihood = -1.70      Transmembrane   480-496 (480-500)
INTEGRAL    Likelihood = -1.44      Transmembrane   370-386 (370-386)

----- Final Results -----
              bacterial membrane --- Certainty = 0.5310(Affirmative) < succ>
               bacterial outside --- Certainty = 0.0000(Not Clear)   < succ>
             bacterial cytoplasm --- Certainty = 0.0000(Not Clear)   < succ>
```

The protein has homology with the following sequences in the databases:

```
>GP: BAB04547 GB: AP001510 PTS system, fructose-specific enzyme II, BC
component [Bacillus halodurans]
Identities = 322/659 (48%), Positives = 431/659 (64%), Gaps = 48/659 (7%)

Query:    1 MKIQDLLRKDIMILDLQAISKEVAIDEMITKLVEKDIVHDFDVFKKSIMTREEQTSTGLG    60
            +KI +LL+KD M+L+L+A SKE   IDE++  L +    ++D  FK++I+ RE Q++TG+G
Sbjct:    2 LKISELLKKDTMVLNLRAASKEAVIDELVRTLDKAGRLNDAQAFKRAILERESQSTTGVG    61

Query:   61 DGIAMPHSKNIVVDKPAVLFAKSNKGVDYKALDGQPTDLFFMIAAPQGANDTHLAALAEL  120
            +GIA+PH+K   V +PA+ F +S+ G+DY++LDGQP+ LFFMIAA +GAN+ HL  L+ L
Sbjct:   62 EGIAIPHAKTAAVKQPAIAFGRSDAGIDYESLDGQPSHLFFMIAASEGANNEHLETLSRL  121

Query:  121 SQYLLKDGFADKLRAAATPEAVIAVFD--EASTAKEEVVAPTSGQDFIVAVTACPTGIAH  178
            S +L+ + F   L A + ++A  D   EA TA E        + ++AVT CPTGIAH
Sbjct:  122 STFLMDETFRSTLMKAQSEDEILAAIDKKEAETAGEAEEKQEGYE--LLAVTGCPTGIAH  179

Query:  179 TYMAEEALKKQAAEMGVAIKVETNGASGVANRLTAEDIQRAKGVIVAADKAVEMDRFDGK  238
            TYMA + LK +A E+GV+IKVETNG+ GV NRLT E+I  AK +IVAAD  VEMDRF GK
Sbjct:  180 TYMAADNLKSKAQELGVSIKVETNGSGGVKNRLTDEEISAAKAIIVAADTKVEMDRFHGK  239

Query:  239 QFIARPVADGIKKSQELISLILNNEGNTYHAKNGKSETAVSTEKTSLGG-----AFYKHL  293
              I   PV DGI++ +ELI   L +   Y   +    S E S GG         FYKHL
Sbjct:  240 PVIQVPVTDGIRRPKELIDQALAGKAPVY-----EGGAQASGEDGSAGGGRPKLGFYKHL  294

Query:  294 MGGVSQMLPFVIGGGIMIALAFLLDNMLGVPNDQLGSLGSYHEIAAIFMNIGGA-AFSFM  352
            M GVS MLPFV+GGGI+IA++F+     P+D    SYH  A + M IGG  AF  M
Sbjct:  295 MNGVSNMLPFVVGGGILIAISFMFGIKAFDPSDP-----SYHPFAEMLMTIGGGNAFGLM  349

Query:  353 LPVLAGYIAYSIAEKPGLVAGFVAGAIASNGLAFGKVPFAAGGEVSLGLTGVPSGFLGAL  412
            +PVLA +IA SIA++PG  AG + G  IAS G A                 GFLG L
Sbjct:  350 IPVLAAFIAMSIADRPGFAAGMIGGLIASTGEA--------------------GFLGGL  388

Query:  413 VGGFLAGGVILALRKLLAGLPRSLEGVKSILLYPLLGVLVTGFLMLFVNIPMAAINTALN  472
             + GFLAG V L ++K+LA LP++L+G+K+IL YP+ + +TG +ML   P+AA NT L
Sbjct:  389 IAGFLAGYVALGVKKVLANLPQTLDGIKTILFYPVFNIFITGMIMLVIVGPLAAFNTGLQ  448

Query:  473 DFLQGLSGSSAVLMGLLVGGMMAVDMGGPVNKAAYVFGTGTLAATVANGGSVVMAAVMAG  532
            D+L +  ++ V++G+++GGMMAVDMGGP+NKAA+ FG   + A  G      AAVMAG
Sbjct:  449 DWLGSMGTANMVILGVILGGMMAVDMGGPINKAAFTFGIAMIDA----GNFGPHAAVMAG  504

Query:  533 GMVPPLAVFVATLLFKDKFTKEERESGLTNIVMGLSFITEGAIPFGAADPARAIPSFIAG  592
            GMVPPL + +AT LFK KFTK+ERE+G TN ++G SFITEGAIPF AADP R IPS I G
Sbjct:  505 GMVPPLGIALATTLFKKKFTKQEREAGKTNYILGASFITEGAIPFAAADPGRVIPSIIVG  564

Query:  593 SALTGALVGLAGIKLMAPHGGIFVI---ALTSNPILYLVFVVIGALVSGILFGALRKKA  648
            SA   G L L + L APHGG FVI     +NP+LYLV ++ G++V+ +L G  +K A
Sbjct:  565 SAFAGGLTALFNVTLSAPHGGAFVIFIGNIVNNPLLYLVAIIAGSIVTALLLGFWKKDA  623
```

An alignment of the GAS and GBS proteins is shown below.

```
Identities = 526/652 (80%), Positives = 581/652 (88%), Gaps = 6/652 (0%)

Query:    1 MKIQDLLKKEVMIMDLKATSKEAAIDEMITKLVDTGVVTNFAIFKDGIMKREAQTSTGLG    60
            MKIQDLL+K++MI+DL+A SKE AIDEMITKLV+  +V +F +FK  IM RE QTSTGLG
Sbjct:    1 MKIQDLLRKDIMILDLQAISKEVAIDEMITKLVEKDIVHDFDVFKKSIMTREEQTSTGLG    60

Query:   61 DGIAMPHSKNAAVKEATVLFAKSASGVDYEALDGQPTDLFFMIAAPDGANDTHLAALAEL  120
            DGIAMPHSKN  V +  VLFAKS  GVDY+ALDGQPTDLFFMIAAP GANDTHLAALAEL
Sbjct:   61 DGIAMPHSKNIVVDKPAVLFAKSNKGVDYKALDGQPTDLFFMIAAPQGANDTHLAALAEL  120
```

```
-continued

Query: 121 SKYLLKEGFADQLRQAKTPDDIIATFDSNSISQETVAPQTVQSTSKGSDYIVAVTACTTG  180
            S+YLLK+GFAD+LR A TP+ +IA FD S ++E V   T     G D+IVAVTAC TG
Sbjct: 121 SQYLLKDGFADKLRAAATPEAVIAVFDEASTAKEEVVAPT-----SGQDFIVAVTACPTG  175

Query: 181 IAHTYMAEEALKKKAAEMGVGIKVETNGASGVGNKLTSSDIARAKGVIIAADKAVEMDRF  240
            IAHTYMAEEALKK+AAEMGV IKVETNGASGV N+LT+ DI RAKGVI+AADKAVEMDRF
Sbjct: 176 IAHTYMAEEALKKQAAEMGVAIKVETNGASGVANRLTAEDIQRAKGVIVAADKAVEMDRF  235

Query: 241 DGKPLVSRPVADGIKKSEDLINIILDNKAQTYHAKNQNDKQSGESDGKSGLGSAFYKHLM  300
            DGK  ++RPVADGIKKS++LI++IL+N+  TYHAKN    ++ S  K+ LG AFYKHLM
Sbjct: 236 DGKQFIARPVADGIKKSQELISLILNNEGNTYHAKN-GKSETAVSTEKTSLGGAFYKHLM  294

Query: 301 GGVSQMLPFVIGGGIMIAIAFLFDNILGVPKDQLSNLGSYHEIAALFKNIGGAAFAFMLP  360
            GGVSQMLPFVIGGGIMIA+AFL DN+LGVP DQL +LGSYHEIAA+F NIGGAAF+FMLP
Sbjct: 295 GGVSQMLPFVIGGGIMIALAFLLDNMLGVPNDQLGSLGSYHEIAAIFMNIGGAAFSFMLP  354

Query: 361 VLAGYIAYSIAEKPGLVAGFVAGSIASSGLAFGKVPFAEGGKATLALAGVPSGFLGALVG  420
            VLAGYIAYSIAEKPGLVAGFVAG+IAS+GLAFGKVPFA GG+ +L L GVPSGFLGALVG
Sbjct: 355 VLAGYIAYSIAEKPGLVAGFVAGAIASNGLAFGKVPFAAGGEVSLGLTGVPSGFLGALVG  414

Query: 421 GFLAGGVILLLRKLLSGLPKSLEGIKSILLYPLLGVLITGFLMLLVNIPMAAINTALNTF  480
            GFLAGGVIL LRKLL+GLP+SLEG+KSILLYPLLGVL+TGFLML VNIPMAAINTALN F
Sbjct: 415 GFLAGGVILALRKLLAGLPRSLEGVKSILLYPLLGVLVTGFLMLFVNIPMAAINTALNDF  474

Query: 481 LQGLSGSSAVLMGLLVGGMMAVDMGGPVNKAAYVFGTGTLAATVANGGSVVMAAVMAGGM  540
            LQGLSGSSAVLMGLLVGGMMAVDMGGPVNKAAYVFGTGTLAATVANGGSVVMAAVMAGGM
Sbjct: 475 LQGLSGSSAVLMGLLVGGMMAVDMGGPVNKAAYVFGTGTLAATVANGGSVVMAAVMAGGM  534

Query: 541 VPPLAVFVATLLFKDKFNNEERQSGLTNIVMGLSFITEGAIPFGAADPARAIPSFIVGSA  600
            VPPLAVFVATLLFKDKF  EER+SGLTNIVMGLSFITEGAIPFGAADPARAIPSFI GSA
Sbjct: 535 VPPLAVFVATLLFKDKFTKEERESGLTNIVMGLSFITEGAIPFGAADPARAIPSFIAGSA  594

Query: 601 LTGALVGLAGIKLMAPHGGIFVIALTSNPLLYILFILIGAVVSGVLFGLFRK          652
            LTGALVGLAGIKLMAPHGGIFVIALTSNP+LY++F++IGA+VSG+LFG  RK
Sbjct: 595 LTGALVGLAGIKLMAPHGGIFVIALTSNPILYLVFVVIGALVSGILFGALRK          646
```

Based on this analysis, it was predicted that these proteins and their epitopes could be useful antigens for vaccines or diagnostics.

EXAMPLE 1954

A DNA sequence (GBSx2063) was identified in *S. agalactiae* <SEQ ID 6055> which encodes the amino acid sequence <SEQ ID 6056>. Analysis of this protein sequence reveals the following:

```
Possible site: 29
>>> Seems to have no N-terminal signal sequence

----- Final Results -----
           bacterial cytoplasm --- Certainty = 0.1532(Affirmative) < succ>
           bacterial membrane  --- Certainty = 0.000(Not Clear)    < succ>
           bacterial outside   --- Certainty = 0.0000(Not Clear)   < succ>
```

The protein has homology with the following sequences in the GENPEPT database.

```
>GP: AAC24914 GB: AF012285 fructose-1-phosphate kinase
[Bacillus subtilis]
Identities = 146/303 (48%), Positives = 197/303 (64%)

Query:   1 MIYTVTLNPSIDFIVRLDTLLLGSVNRMTSDDKYVGGKGINVSRILKRLKIDNTATGFIG   60
           MIYTVTLNPS+D+IV ++   +G +NR + D KY GGKGINVSR+LKR  + + A GF+G
Sbjct:   1 MIYTVTLNPSVDYIVHVEDFTVGGLNRSSYDTKYPGGKGINVSRLLKRHHVASKALGFVG   60

Query:  61 GFTGHFVEDGLVLEGIKTDFVSVNEDTRINVKVKAKIETEINGGGPRITNEQLHRLEKLL  120
           GFTG +++  L  E ++T F  V  DTRINVK+K    ETEING  GP I++E      +
Sbjct:  61 GFTGEYIKTFLREENLETAFSEVKGDTRINVKLKTGDETEINGQGPTISDEDFKAFLEQF  120

Query: 121 SRLTPEDTVVFAGSAPASLGNKVYNTLIPIAKKTGAEVVCDFEGQTLLDALAYQPLLVKP  180
                  D VV AGS P+SL +  Y  +    K+   A VV D  G+ LL A    +P L+KP
Sbjct: 121 QSLQEGDIVVLAGSIPSSLPHDTYEKIAEACKQQNARVVLDISGEALLKATEMKPFLMKP  180
```

-continued

```
Query: 181 NNHELADIFGVELEGLPDIEKYAHKILDKGAKNVIVSMAGDGALLVTPEASYFAKPIKGE 240
           N+HEL ++FG  +  + +   Y   K++++GA++VIVSMAGDGALL T EA YFA   KG+
Sbjct: 181 NHHELGEMFGTAITSVEEAVPYGKKLVEQGAEHVIVSMAGDGALLFTNEAVYFANVPKGK 240

Query: 241 VKNSVGAGDSMVAGFTGEFVKSKNPVEALKWGVACGTATTFSDDLATAEFIQDIYNKVEV 300
            + NSVGAGDS+VAGF    K    EA + GV  G+AT FS++L T EF+Q +   +V+V
Sbjct: 241 LVNSVGAGDSVVAGFLAGISKQLPLEEAFRLGVTSGSATAFSEELGTEEFVQQLLPEVKV 300

Query: 301 EKL                                                         303
           +L
Sbjct: 301 TRL                                                         303
```

A related DNA sequence was identified in *S. pyogenes* <SEQ ID 6057> which encodes the amino acid sequence <SEQ ID 6058>. Analysis of this protein sequence reveals the following:

```
Possible site: 57
>>> Seems to have no N-terminal signal sequence

----- Final Results -----
            bacterial cytoplasm --- Certainty = 0.1738(Affirmative) < succ>
            bacterial membrane  --- Certainty = 0.0000(Not Clear)   < succ>
             bacterial outside  --- Certainty = 0.0000(Not Clear)   < succ>
```

An alignment of the GAS and GBS proteins is shown below.

```
Identities = 222/302 (73%), Positives = 261/302 (85%)

Query:   1 MIYTVTLNPSIDFIVRLDTLLLGSVNRMTSDDKYVGGKGINVSRILKRLKIDNTATGFIG  60
           MIYTVTLNPSIDFIVR+D + LGSVNRM SDDK+ GGKGINVSRIL+RL I +TATGF+G
Sbjct:   1 MIYTVTLNPSIDFIVRIDQINLGSVNRMASDDKFAGGKGINVSRILQRLDIASTATGFLG  60

Query:  61 GFTGHFVEDGLVLEGIKTDFVSVNEDTRINVKVKAKIETEINGGGPRITNEQLHRLEKLL 120
           GFTG F+E+ L   EG+KTDFV ++DTRINVK+K++ ETE+NG GP I+ EQL  L+  L
Sbjct:  61 GFTGRFIEESLSAEGVKTDFVKGDQDTRINVKIKSQEETELNGQGPIISQEQLEDLKTKL 120

Query: 121 SRLTPEDTVVFAGSAPASLGNKVYNTLIPIAKKTGAEVVCDFEGQTLLDALAYQPLLVKP 180
           S+LT EDTVVFAGSAPA+LGN VY   L+P+  +++GA+VVCDFEGQTL+DALAY PLLVKP
Sbjct: 121 SQLTAEDTVVFAGSAPANLGNAVYKELLPLVRQSGAQVVCDFEGQTLIDALAYNPLLVKP 180

Query: 181 NNHELADIFGVELEGLPDIEKYAHKILDKGAKNVIVSMAGDGALLVTPEASYFAKPIKGE 240
           NNHEL   IFG  L   L D+E YA ++L+ GA+NVI+SMAGDGALLVT EA+YFAKPIKGE
Sbjct: 181 NNHELEAIFGTILTSLDDVETYARRLLEMGAQNVIISMAGDGALLVTKEATYFAKPIKGE 240

Query: 241 VKNSVGAGDSMVAGFTGEFVKSKNPVEALKWGVACGTATTFSDDLATAEFIQDIYNKVEV 300
           VKNSVGAGDSMVAGFTGEF+KS+NP+EALKWGVACGTAT FSDDLAT  FI++ Y+KVEV
Sbjct: 241 VKNSVGAGDSMVAGFTGEFMKSQNPIEALKWGVACGTATAFSDDLATIAFIKETYHKVEV 300

Query: 301 EK                                                          302
           EK
Sbjct: 301 EK                                                          302
```

Based on this analysis, it was predicted that these proteins and their epitopes could be useful antigens for vaccines or diagnostics.

EXAMPLE 1955

A DNA sequence (GBSx2064) was identified in *S. agalactiae* <SEQ ID 6059> which encodes the amino acid sequence <SEQ ID 6060>. Analysis of this protein sequence reveals the following:

```
Possible site: 26
>>> Seems to have no N-terminal signal sequence

----- Final Results -----
            bacterial cytoplasm --- Certainty = 0.2769(Affirmative) < succ>
            bacterial membrane  --- Certainty = 0.0000(Not Clear)   < succ>
             bacterial outside  --- Certainty = 0.0000(Not Clear)   < succ>
```

A related GBS nucleic acid sequence <SEQ ID 9961> which encodes amino acid sequence <SEQ ID 9962> was also identified.

The protein has homology with the following sequences in the GENPEPT database.

```
>GP: AAC24913 GB: AF012285 FruR [Bacillus subtilis]
Identities = 97/247 (39%), Positives = 148/247 (59%), Gaps = 4/247 (1%)

Query:   23 MLKSKRKEIILSRLEQNKSVTLDELTSILETSESTVRRDLDELESAGFLKRVHGGAELPY   82
            ML  +R ++I+ ++E++  V + EL ++   SEST+RRDL  LE  GFLKRVHGGA
Sbjct:    1 MLTPERHQLIIDQIEKHDVVKIQELINLTNASESTIRRDLSTLEERGFLKRVHGGAAKLS   60

Query:   83 SLGQELSNQEKAIKNVQKKLDIARQTAKLIAKQDVIFIDAGTTTELLIDFLPH-EQLTVV  141
            + E    EK+ KN+  KL IA + A L+ + D I++DAGTTT  +IDF+   + + VV
Sbjct:   61 DIRLEPDMLEKSSKNLHDKLKIAEKAASLLEEGDCIYLDAGTTTLHMIDFMDKTKDIVVV  120

Query:  142 TNSIHHAAKLVDRGIKTIIIGGAVKHSTDASIGQVAINQIRQITVDKAFLGMNGID-EVY  200
            TN + H   L+ + I  ++GG VKH T A IG ++  + Q   DK+FLG NG+  E
Sbjct:  121 TNGVMHIDALIRKEISFYLLGGYVKHRTGAIIGGASLVAMDQYRFDKSFLGTNGVHTEAG  180

Query:  201 LTTPDLEEAAIKEAIINNSQQTFILMDSSKIGQVTFAKVKEINDINLVTNKTDSELMTII  260
              TTPD +EA +K+  I  ++ ++L D SK G+++F+    I D  ++T  TD+E +T
Sbjct:  181 FTTPDPDEALLKQKAIKQAKHAYVLADPSKFGEISFSAFAGIGDATIIT--TDAEELTFD  238

Query:  261 KEKMKVI                                                      267
            + K +
Sbjct:  239 NYQEKTV                                                      245
```

A related DNA sequence was identified in *S. pyogenes* <SEQ ID 6061> which encodes the amino acid sequence <SEQ ID 6062>. Analysis of this protein sequence reveals the following:

```
Possible site: 27
>>> Seems to have no N-terminal signal sequence

----- Final Results -----
              bacterial cytoplasm --- Certainty = 0.2604(Affirmative) < succ>
              bacterial membrane  --- Certainty = 0.0000(Not Clear)   < succ>
              bacterial outside   --- Certainty = 0.0000(Not Clear)   < succ>
```

An alignment of the GAS and GBS proteins is shown below.

```
Identities = 135/237 (56%), Positives = 184/237 (76%)

Query:   33 LSRLEQNKSVTLDELTSILETSESTVRRDLDELESAGFLKRVHGGAELPYSLGQELSNQE   92
            ++++ +    V+L++L  +L +SEST+RRDL ELE  G L RVHGGAEL +SL +ELSNQE
Sbjct:    1 MAKITEENYVSLEDLMQLLNSSESTIRRDLGELEQEGRLHRVHGGAELFHSLQEELSNQE   60

Query:   93 KAIKNVQKKLDIARQTAKLIAKQDVIFIDAGTTTELLIDFLPHEQLTVVTNSIHHAAKLV  152
            K++KN   K  IA++ ++LI   DVIFIDAGTTTE L+ FL  + LTVVTNSIHHAA+LV
Sbjct:   61 KSVKNSHIKKAIAQRASQLIYDNDVIFIDAGTTTEFLLPFLQAKNLTVVTNSIHHAARLV  120

Query:  153 DRGIKTIIIGGAVKHSTDASIGQVAINQIRQITVDKAFLGMNGIDEVYLTTPDLEEAAIK  212
             +  I+TII+GG VK +TDASIG  VA+ QIRQ+  DKAFLGMNG+D+ YLTTPD+EEA IK
Sbjct:  121 ELSIETIIVGGYVKQTTDASIGNVALEQIRQMNFDKAFLGMNGVDDSYLTTPDNEEAVIK  180

Query:  213 EAIINNSQQTFILMDSSKIGQVTFAKVKEINDINLVTNKTDSELMTIIKEKMKVIQV    269
            +A+++N++ +IL+D +KIGQV+F KV  IND+ ++T  + ++    IKEK KVI++
Sbjct:  181 KAVLSNAKLAYILVDGTKIGQVSFVKVAPINDVTIITLGGSASILKQIKEKAKVIEL    237
```

Based on this analysis, it was predicted that these proteins and their epitopes could be useful antigens for vaccines or diagnostics.

EXAMPLE 1956

A DNA sequence (GBSx2065) was identified in *S. agalactiae* <SEQ ID 6063> which encodes the amino acid sequence <SEQ ID 6064>. This protein is predicted to be beta-lactam resistance factor. Analysis of this protein sequence reveals the following:

```
Possible site: 32
>>> Seems to have no N-terminal signal sequence

----- Final Results -----
            bacterial cytoplasm --- Certainty = 0.5777(Affirmative) < succ>
            bacterial membrane  --- Certainty = 0.0000(Not Clear)   < succ>
             bacterial outside  --- Certainty = 0.0000(Not Clear)   < succ>
```

The protein has homology with the following sequences in the GENPEPT database.

```
>GP: CAB89121 GB: AJ277485 beta-lactam resistance factor
[Streptococcus pneumoniae]
Identities = 215/410 (52%), Positives = 283/410 (68%)

Query:    1 MTLRELTIEEFKEHSGNYDSQSFLQTPEMAKLLEKRGYDVRYLGYQVENKLEIISLSYIM   60
            M L  LT EEF+ +S    S+SF+Q+ +M  LLEKRG  + YL  + E ++++ +L Y +
Sbjct:    1 MALTTLTKEEFQTYSDQVSSRSFMQSVQMGDLLEKRGARIVYLALKQEGEIQVAALVYSL   60

Query:   61 PVTGGFQMKIDSGPVHSNSKYLKQFYKALQGYAKSNGVLELIVEPYDDYQLFTSSGVPSN  120
            P+ GG  M+++SGP+++     L  FY  L+ YAK NGVLEL+V+PY+ YQ F S G P +
Sbjct:   61 PMLGGLHMELNSGPIYTQQDALPVFYAELKEYAKQNGVLELLVKPYETYQTFDSQGNPID  120

Query:  121 QGNDNLIEDFTSSGYHHDGLTTGFTGKYLSWHYVKNLEGVTSETLLSSFSKTGRALVKKA  180
              ++I+D T  GY  DGLTTG+ G     W Y K+L  +T ++LL SFSK G+ LVKKA
Sbjct:  121 AEKKSIIQDLTDLGYQFDGLTTGYPGGEPDWLYYKDLTELTEKSLLKSFSKKGKPLVKKA  180

Query:  181 MSFGIKVRVLKRDELHLFKEITTSTSNRRDYMDKSLDYYQDFYDSFEGKAEFVIATLNFR  240
             +FGI+++ LKR+EL +FK IT  TS RR+Y DKSL+YY+ FYD+F  +AEF+IA+LNF
Sbjct:  181 ETFGIRLKKLKREELSIFKNITKETSERREYSDKSLEYYEHFYDTFGEQAEFLIASLNFS  240

Query:  241 EYDHNLQIKAEALENKLKLLDERFRENADSPKYHRQRSEIINQLASFETRRQEVQSFIQK  300
            +3    LQ +   LE  L  L     +N  S K   Q  E  +Q  +FE R+ E +  I+K
Sbjct:  241 DYMSKLQGEQSKLEENLDKLRLDLSKNPHSEKKQNQLREYSSQFETFEVRKAEARDLIEK  300

Query:  301 YDNQDVVLAGSLFVYSLKETVYFFSGSYTEFNKFYAPAVLQEYVMQEALKRGSTFYNLLG  360
            Y  +D+VLAGSLFVY   +ET Y FSGSYTEFNKFYAPA+LQ+YVM E++KRG    YN LG
Sbjct:  301 YGEEDIVLAGSLFVYMPQETTYLFSGSYTEFNKFYAPALLQKYVMLESIKRGIPKYNFLG  360

Query:  361 IQGTFDGSDSILRFKQNFNGCIIRKMGTFNYYPSPFKYKGIQLLKKVLKR           410
            IQG FDGSD +LRFKQNFNG I+RK GTF Y+PSP KYK IQLLKK++ R
Sbjct:  361 IQGIFDGSDGVLRFKQNFNGYIVRKAGTFRYHPSPLKYKAIQLLKKIVGR           410
```

There is also homology to SEQ ID 5460.

Based on this analysis, it was predicted that this protein and its epitopes, could be useful antigens for vaccines or diagnostics.

EXAMPLE 1957

A DNA sequence (GBSx2066) was identified in *S. agalactiae* <SEQ ID 6065> which encodes the amino acid sequence <SEQ ID 6066>. This protein is predicted to be cell wall protein, 40 kDa (sr 5' region). Analysis of this protein sequence reveals the following:

```
Possible site: 42
>>> Seems to have no N-terminal signal sequence
   INTEGRAL    Likelihood = -3.45    Transmembrane    25-41 (23-42)
```

```
----- Final Results -----
             bacterial membrane --- Certainty = 0.2381(Affirmative) < succ>
             bacterial outside  --- Certainty = 0.0000(Not Clear)   < succ>
            bacterial cytoplasm --- Certainty = 0.0000(Not Clear)   < succ>
```

A related GBS nucleic acid sequence <SEQ ID 9963> which encodes amino acid sequence <SEQ ID 9964> was also identified.

The protein has homology with the following sequences in the GENPEPT database.

```
!GB: AF278686 choline binding protein D; CbpD [Strept . . .
!GB: AF278686 choline binding protein D; CbpD [trept . . .
>GP: AAF87768 GB: AF278686 choline binding protein D; CbpD
[Streptococcus pneumoniae]
Identities = 63/230 (27%), Positives = 108/230 (46%), Gaps = 34/230 (14%)

Query: 324 WTEQGGQDDIKWYTAVTTGDG------NYKVAVSFADHKNEKGLYNIHLYYQEASGTLVG 377
           W+  G    + W + V GD-------NY   S+     +     +++++  G  VG
Sbjct: 123 WSTAGTYGHVAWVSNVM-GDQISIEEYNYGYTESYNKRVIKANTMTGFIHFKDLDGGSVG 181

Query: 378 VTGTKVTVAGTNSSQEPIENGLAKTGVYNIIGSTEVKNEAKISSQTQFTLEKGDKINYDQ 437
           + +  +  GT+  +               + +K E    S          G+K++YDQ
Sbjct: 182 NSQSSTSTGGTHYFKT-----------------KSAIKTEPLASGTVIDYYYPGEKVHYDQ 225

Query: 438 VLTADGYQWISYKSYSGVRRYIPVKKLTTSSEKAKDEATKPTSYPNLPKTG-TYTFTKTV 496
           +L  DGY+W+SY +Y+G  RY+ ++  +           P    L  TG T+  F
Sbjct: 226 ILEKDGYKWLSYTAYNGSYRYVQLEAVNKN----------PLGNSVLSSTGGTHYFKTKS 275

Query: 497 DVKSQPKVSSPVEFNFQKGEKIHYDQVLVVDGHQWISYKSYSGIRRYIEI           546
           +K++P VS+ V   + GEK+HYDQ+L  DG++W+SY +Y+G  RRYI++
Sbjct: 276 AIKTEPLVSATVIDYYYPGEKVHYDQILEKDGYKWLSYTAYNGSRRYIQL           325

Identities = 49/161 (30%), Positives = 85/161 (52%), Gaps = 14/161 (8%)

Query: 116 GNYVYSKETEVKNTPSKSAPVAFYAKKGDKVFYDQVFNKDNVKWISYKSFCGVRRYAAIE 175
           G + +  ++ +K  P   S  V  Y    G+KV YDQ+  KD   KW+SY ++ G  RY   +E
Sbjct: 191 GTHYFKTKSAIKTEPLASGTVIDYYYPGEKVHYDQILEKDGYKWLSYTAYNGSYRYVQLE 250

Query: 176 SLDPSGGSETKAPTPVTNSGSNNQEKIATQGNYTFSHKVEVKNEAKVASPTQFTLDKGDR 235
           +++ +              P+ NS +        +T G + F  K  +K E V++     G++
Sbjct: 251 AVNKN---------PLGNSVLS-----STGGTHYFKTKSAIKTEPLVSATVIDYYYPGEK 296

Query: 236 IFYDQILTIEGNQWLSYKSFNGVRRFVLLGKASSVEKTEDK                   276
           + YDQIL  +G +WLSY ++NG RR+  L     +S +    +++
Sbjct: 297 VHYDQILEKDGYKWLSYTAYNGSRRYIQLEGVTSSQNYQNQ                   337

Identities = 52/192 (27%), Positives = 90/192 (46%), Gaps = 3/192 (6%)

Query: 295 ISNETTTGFDILITNIKDDNGIAAVKVPVWTEQGGQDDIKWYTAVTTGDGNYKVAVSFAD 354
              I  T TGF    + KD +G +      T  GG  K  +A+ T           + +
Sbjct: 161 IKANTMTGF----IHFKDLDGGSVGNSQSSTSTGGTHYFKTKSAIKTEPLASGTVIDYY- 215

Query: 355 HKNEKGLYNIHLY---YQEASGTLVGVTGTKVTVAGTNSSQEPIENGLAKT--GVYNIIG 409
            +  EK  Y+ +L    Y+   S T    + V + N +  P+ N +    +    G +
Sbjct: 216 YPGEKVHYDQILEKDGYKWLSYTAYNGSYRYVQLEAVNKN--PLGNSVLSSTGGTHYFKT 273

Query: 410 STEVKNEAKISSQTQFTLEKGDKINYDQVLTADGYQWISYKSYSGVRRYIPVKKLTTSSE 469
            + +K E  +S+           G+K++YDQ+L  DGY+W+SY +Y+G  RRYI ++ + TSS+
Sbjct: 274 KSAIKTEPLVSATVIDYYYPGEKVHYDQILEKDGYKWLSYTAYNGSRRYIQLEGV-TSSQ 332

Query: 470 KAKDEATKPTSY                                               481
           ++++        +SY
Sbjct: 333 NYQNQSGNISSY                                               344

Identities = 33/113 (29%), Positives = 56/113 (49%), Gaps = 2/113 (1%)

Query:  91 NTATKDITTPLVETKPMVEKTLPEQGNYVYSK-ETEVKNTPSKSAPVAFYAKKGDKVFYD 149
           N + +    V  P+      L    G    YK ++ +K  P  SA V  Y       G+KV YD
Sbjct: 241 NGSYRYVQLEAVNKNPLGNSVLSSTGGTHYFKTKSAIKTEPLVSATVIDYYYPGEKVHYD 300

Query: 150 QVFNKDNVKWISYKSFCGVRRYAAIESLDPSGGSETKAPTPVTNSGSNNQEKI        202
           Q+  KD   KW+SY ++ G  RRY  +E  +    S     + +    +++ GS++    +
Sbjct: 301 QILEKDGYKWLSYTAYNGSRRYIQLEGVTSSQNYQNQSGN-ISSYGSHSSSTV        352
```

A related GBS gene <SEQ ID 8937> and protein <SEQ ID 8938> were also identified. Analysis of this protein sequence reveals the following:

```
Lipop: Possible site: -1 Crend: 10
McG: Discrim Score: -6.74
GvH: Signal Score (-7.5): 1.26
     Possible site: 42
>>> Seems to have no N-terminal signal sequence
ALOM program count: 1 value: -3.45 threshold: 0.0
     INTEGRAL         Likelihood = -3.45      Transmembrane    22-39 (23-42)
     PERIPHERAL       Likelihood =  6.26  371
modified ALOM score: 1.19

*** Reasoning Step: 3

----- Final Results -----
                bacterial membrane --- Certainty = 0.2381(Affirmative) < succ>
                bacterial outside  --- Certainty = 0.0000(Not Clear)   < succ>
               bacterial cytoplasm --- Certainty = 0.0000(Not Clear)
```

The protein has homology with the following sequences in the databases:

```
41.2/57.9% over 283aa
Streptococus mutans
EGAD|33594| cell wall protein, 40 kDa (sr 5' region) Insert characterized
PIR|A60328|A60328 40K cell wall protein precursor (sr 5' region) - (strain OMZ
175, serotype f) Insert characterized
ORF02145(301-1803 of 2238)
EGAD|33594|34911(30-313 of 335) cell wall protein, 40 kDa (sr 5' region)
(Strptococcus mutans}PIR|A60328|A60328 40K cell wall protein precursor
(sr 5' region)-Streptococcus mutans (strain OMZ175, sterotype f)
% Match = 8.0
% Identity = 41.1 % Similarity = 57.9
Matches = 81 Mismatches = 79 Conservative Sub.s = 33
156       186       216       246       276       306       336       366
*YA****FCYTKNNKSWVFFSRSIYSIKYYICITNISKIC*HVTKRIL***CK*IRK*VFMMKKGQVNDTKQSYSLRKYK
                                :    :    :  | :||:   :|    |:|:|||
                                MNQKIVVISSFYMLGAHSFSKAVYHNDRSVKLMKRIDINHQAQRFSIRKYA
                                         10        20        30        40        50

396       426       456       486       516       546       576       606
FGLASVILGSFIMVTSPVFADQTTSVQVNNQTGTSVDANNSSNETSASSVITSNNDSVQASDKVVNSQNTATKDITTPLV
|| |||::|    :   :    |     |:    :  ||       |    |     |  ||    ||
FGAASVLIGCVFFLGTQNVSAQEQGTQL---------------PASENAVVNVAENSVAISQAVADKAATQTTLTETPQV
              70                80        90       100       110

654       684       714
ETKPMVEK-------------------------~~~---------------------TLPEQGNYVYSKETEVKNTPSKSAPVAF
| :   |                                       ::| ||||| : | ||| | |:|
EVEEKESKVNAPALNVDDKGAKSKEDVN~~~~AEQNEKAVRENLMCRQAKAVSIPSQGNYVFQETTPVKNAASMSSP---
         130       140       200       210       220       230       240

744       1533      1563      1593      1623      1653      1683
YAKKGDKVFYDQVFNKD~~~~GVYNIIGSTEVKNEAKISSQTQFTLEKGDKINYDQVLTADGYQWISYKSYSGVRRYIPV
                            ||| ::||||: || || ||| :|||| |||||:||| |:
------------------------~~~---------------TQFNFDKGDKVFYDNVLEADGHQWISYVSYSGIRRYAPI
                                           250       260       270

1713      1743      1773      1803      1833      1863      1893      1923
KKLTTSSEKAKDEATKPTSYPNLPKTGTYTFTKTVDVKSQPKVSSPVEFNFQKGEKIHYDQVLVVDGHQWISYKSYSGIR
  :   ::    |    |||  || |||    :|  :              |
------AVTIEELKQKEIVQQNLPAQGTYHFTKQQSLKMKLNCLVRPNSRFTTEITFFMIRF
         290       300       310       320       330
```

A related DNA sequence was identified in S. pyogenes <SEQ ID 6067> which encodes the amino acid sequence <SEQ ID 6068>. Analysis of this protein sequence reveals the following:

```
Possible site: 23
>>> Seems to have a cleavable N-term signal seq.

----- Final Results -----
                 bacterial outside --- Certainty = 0.3000(Affirmative) < succ>
                bacterial membrane --- Certainty = 0.0000(Not Clear)   < succ>
               bacterial cytoplasm --- Certainty = 0.0000(Not Clear)   < succ>
```

The protein has homology with the following sequences in the databases:

```
>GP: AAF87768 GB: AF278686 choline binding protein D; CbpD
[Streptococcus pneumoniae]
Identities = 93/217 (42%), Positives = 136/217 (61%), Gaps = 18/217 (8%)

Query:   42 GDNYPSKWKKGNG-IDSWNMYIRQCTSFAAFRLSSANGFQLPKGYGNACTWGHIAKNQGY 100
            GD+YP+ +K G+  ID W MY RQCTSF AFRLS+ NGF++P  YGNA  WGH A+ +GY
Sbjct:   51 GDDYPAYYKNGSQEIDQWRMYSRQCTSFVAFRLSNVNGFEIPAAYGNANEWGHRARREGY 110

Query:  101 PVNKTPSIGAIAWFDKNAYQSNAAYGHVAWVADIRGDTVTIEEYNYNAGQGPERYHKRQI 160
              V+ TP+IG+I W      + YGHVAWV+++ GD + IEEYNY    E Y+KR I
Sbjct:  111 RVDNTPTIGSITW------STAGTYGHVAWVSNVMGDQIEIEEYNYGY---TESYNKRVI 161

Query:  161 PKSQVSGYIHFKDLSSQTSHSYPRQLKHISQASFDPSGTYHFTTRLPVKGQTSIDSPDLA 220
              + ++G+IHFKDL  +  +          SQ+S    GT++F T+  +K +          +
Sbjct:  162 KANTMTGFIHFRDLDGGSVGN--------SQSSTSTGGTHYFKTKSAIKTEPLASGTVID 213

Query:  221 YYEAGQSVYYDKVVTAGGYTWLSYLSFSGNRRYIPIK                        257
            YY  G+ V+YD+++   GY WLSY +++G+RY+ ++
Sbjct:  214 YYYPGEKVHYDQILEKDGYKWLSYTAYNGSYRYVQLE                        250
```

An alignment of the GAS and GBS proteins is shown below.

```
Identities = 34/94 (36%), Positives = 52/94 (55%)

Query:  453 SGVRRYIPVKKLTTSSEKAKDSATKPTSYPNLPKTGTYTFTKTVDVKSQPKVSSPVEFNF 512
              S V  YI  K L++ + +     K S  +   +GTY FT  + VK Q  + SP    +
Sbjct:  163 SQVSGYIHFKDLSSQTSHSYPRQLKHISQASFDPSGTYHFTTRLPVKGQTSIDSPDLAYY 222

Query:  513 QKGEKIHYDQVLVVDGHQWISYKSYSGIRRYIEI                           546
             + G+ ++YD+V+  G+ W+SY S+SG RRYI I
Sbjct:  223 EAGQSVYYDKVVTAGGYTWLSYLSFSGNRRYIPI                           256

Identities = 30/78 (38%), Positives = 45/78 (57%), Gaps = 2/78 (2%)

Query:  402 TGVYNIIGSTEVKNEAKISSQTQFTLEKGDKINYDQVLTADGYQWISYKSYSGVRRYIPV 461
             +G Y+    VK +  I S     E G  + YD+V+TA GY W+SY S+SG RRYIP+
Sbjct:  197 SGTYHFTTRLPVKGQTSIDSPDLAYYEAGQSVYYDKVVTAGGYTWLSYLSFSGNRRYIPI 256

Query:  462 KKLTTSSEKAKDEATKPT                                           479
            K+  +     +++ TKP+
Sbjct:  257 KS--PAQSVVQNDNTKPS                                           272

Identities = 27/94 (28%), Positives = 47/94 (49%)

Query:  198 NQEKIATQGNYTFSHKVEVKNEAKVASPTQFTLDKGDRIFYDQILTIEGNQWLSYKSFNG 257
             +Q      G Y F+ ++ VK +  + SP      + G  ++YD+++T    G  WLSY SF+G
Sbjct:  190 SQASFDPSGTYHFTTRLPVKGQTSIDSPDLAYYEAGQSVYYDKVVTAGGYTWLSYLSFSG 249

Query:  258 VRRFVLLGKASSVEKTEDKEKVSPQPQARITKTG                           291
              RR++ + + +       D  K S  +   +T G
Sbjct:  250 NRRYIPIKEPAQSVVQNDNTKPSIKVGDTVTFPG                           283

Identities = 23/73 (31%), Positives = 35/73 (47%)

Query:  103 ETKPMVEKTLPEQGNYVYSKETEVKNTPSKSAPVAFYAKKGDKVFYDQVFNKDNVKWISY 162
              + K + + +    G Y ++    VK    S +P    Y + G  V+YD+V     W+SY
Sbjct:  185 QLKHISQASFDPSGTYHFTTRLPVKGQTSIDSPDLAYYEAGQSVYYDKVVTAGGYTWLSY 244

Query:  163 KSFCGVRRYAAIE                                                175
             SF G RRY  I+
Sbjct:  245 LSFSGNRRYIPIK                                                257
```

SEQ ID 8938 (GBS91) was expressed in *E. coli* as a His-fusion product. SDS-PAGE analysis of total cell extract is shown in FIG. 18 (lane 7; MW 63 kDa).

Figure 283:
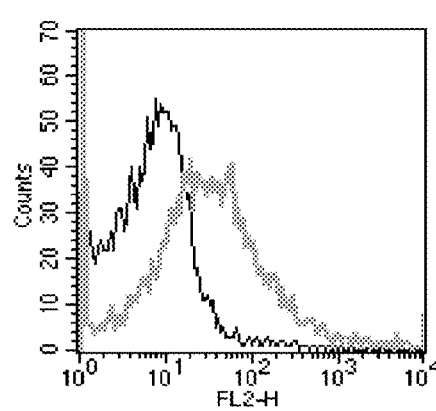

The GBS91-His fusion product was purified (FIG. 195, lane 9) and used to immunise mice. The resulting antiserum was used for FACS (FIG. 283), which confirmed that the protein is immunoaccessible on GBS bacteria.

Based on this analysis, it was predicted that these proteins and their epitopes could be useful antigens for vaccines or diagnostics.

EXAMPLE 1958

A DNA sequence (GBSx2067) was identified in *S. agalactiae* <SEQ ID 6069> which encodes the amino acid sequence <SEQ ID 6070>. This protein is predicted to be thiamine biosynthesis protein. Analysis of this protein sequence reveals the following:

```
Possible site: 40
>>> Seems to have no N-terminal signal sequence

----- Final Results -----
              bacterial cytoplasm --- Certainty = 0.0984(Affirmative) < succ>
               bacterial membrane --- Certainty = 0.0000(Not Clear)   < succ>
                 bacterial outside --- Certainty = 0.0000(Not Clear)   < succ>
```

The protein has homology with the following sequences in the GENPEPT database.

```
>GP: CAB49673 GB: AJ248285 PROBABLE 2-DEHYDROPANTOATE 2-REDUCTASE (EC
1.1.1.169) [Pyrococcus abyssi]
Identities = 85/301 (28%), Positives = 150/301 (49%), Gaps = 7/301 (2%)

Query:   1 MLVYIAGSGAMGCRFGYQISKTNHDVILLDNWADHIMAIKENGLKVTGDTEDLVKLPIMK    60
           M +YI G+GA+G  FG  ++     DV+L+     H+ AI E GLK+G +  VK+
Sbjct:   1 MKIYILGAGAIGSLFGGLLANAGEDVLLIGR-DPHVSAINEKGLKIVGIKDLNVKVEATT   59

Query:  61 PTDATEEADLIILFTKAMQLPNMLQDIKKIIGKKTKVLCLLNGLGHEDVIRQYIPEHNIL   120
            E+ DLI+L TK+     L+  + I+ K + VL + NG+G+ED I  ++        +
Sbjct:  60 RVPE-EKPDLIVLATKSYSTIEALKSARHIV-KGSWVLSIQNGIGNEDKIIEF--GGKAI   115

Query: 121 MGVTVWTAGLKGPGHAHLEGVGSVNLQSIDPNNQEAGHRVTELLNEAKLQATYDENVLPN   180
           G+T   A ++ PG      G G   +       ++    +V ++ N A ++       EN++
Sbjct: 116 GGITTNGAMVEAPGVIKWTGKGVTIIGLYPQGREKFIEKVADVFNSADIETHVSENIISW   175

Query: 181 IWRKACVNGTMNSTCALLDCTIGQLFASEDGVNMVHEIIHEFVTVGKAEGVELDEEEITK   240
           IW  KA VN  +N      LL+    +  ++  ++M E++ E    V     G+E D    +
Sbjct: 176 IWAKAIVNSAINPIGTLLEVKNKVIRENDFLLSMAMEVVKEGCRVALQNGIEFDVPPMDL   235

Query: 241 YVMDTSVKAAHHYPSMHQDLVQNQRLTEIDFLNGAVNKKGENLGIDTPYCRLITQLIHTKE   301
            +  T  +   +Y SM QD+ + ++ TE+D++NG + + +  + ++ P   L+   LI   KE
Sbjct: 236 F-FQTLEQTRENYNSMLQDIWRGKK-TEVDYINGKIVEYAKAVNLEAPMNLLLWGLIKGKE   294
```

A related DNA sequence was identified in *S. pyogenes* <SEQ ID 6071> which encodes the amino acid sequence <SEQ ID 6072>. Analysis of this protein sequence reveals the following:

```
Possible site: 22
>>> Seems to have no N-terminal signal sequence

----- Final Results -----
              bacterial cytoplasm --- Certainty = 0.1392(Affirmative) < succ>
               bacterial membrane --- Certainty = 0.0000(Not Clear)   < succ>
                 bacterial outside --- Certainty = 0.0000(Not Clear)   < succ>
```

An alignment of the GAS and GBS proteins is shown below.

```
Identities = 262/307 (85%), Positives = 288/307 (93%)

Query:   1 MLVYIAGSGAMGCRFGYQISKTNHDVILLDNWADHIMAIKENGLKVTGDTEDLVKLPIMK    60
           MLVYIAGSGAMGCRFGYQISKTN+DVILLDNW DHI AIKENGL VTGD E+ VKLPIMK
Sbjct:   1 MLVYIAGSGAMGCRFGYQISKTNNDVILLDNWEDHINAIKENGLVVTGDVEETVKLPIMK    60

Query:  61 PTDATEEADLIILFTKAMQLPNMLQDIKKIIGKKTKVLCLLNGLGHEDVIRQYIPEHNIL   120
           PT+AT+EADLIILFTKAMQLP MLQDIK IIGK+TKVLCLLNGLGHEDVIRQYIPEHNIL
Sbjct:  61 PTEATQEADLIILFTKAMQLPQMLQDIKGIIGKETKVLCLLNGLGHEDVIRQYIPEHNIL   120

Query: 121 MGVTVWTAGLKGPGHAHLEGVGSVNLQSIDPNNQEAGHRVTELLNEAKLQATYDENVLPN   180
           MGVTVWTAGL+GPG AHL+GVG++NLQS+DP+NQEAGH+V +LLNEA L ATYDENV+PN
Sbjct: 121 MGVTVWTAGLEGPGRAHLQGVGALNLQSMDPSNQEAGHQVADLLNEANLNATYDENVVPN   180

Query: 181 IWRKACVNGTMNSTCALLDCTIGQLFASEDGVNMVHEIIHEFVTVGKAEGVELDEEEITK   240
           IWRKACVNGTMNSTCALLDCTIG+LFASEDG+ MV EIIHEFV VG+AEGVEL+EEEIT+
Sbjct: 181 IWRKACVNGTMNSTCALLDCTIGELFASEDGLKMVKEIIHEFVIVGQAEGVELNEEEITQ   240

Query: 241 YVMDTSVKAAHHYPSMHQDLVQNQRLTEIDFLNGAVNKKGENLGIDTPYCRLITQLIHTK   300
           YVMDTSVKAAHHYPSMHQDLVQN RLTEIDF+NGAVN KGE LGI+TPYCR+IT+L H K
Sbjct: 241 YVMDTSVKAAHHYPSMHQDLVQNHRLTEIDFINGAVNTKGEKLGINTPYCRMITELVHAK   300
```

```
Query: 301 ENVLSIK    307
          E VL+I+
Sbjct: 301 EAVLNIQ    307
```

Based on this analysis, it was predicted that these proteins and their epitopes could be useful antigens for vaccines or diagnostics.

EXAMPLE 1959

A DNA sequence (GBSx2068) was identified in *S. agalactiae* <SEQ ID 6073> which encodes the amino acid sequence <SEQ ID 6074>. Analysis of this protein sequence reveals the following:

```
Possible site: 36
>>> Seems to have no N-terminal signal sequence
    INTEGRAL     Likelihood = -3.03    Transmembrane    61-77 (61-78)
    INTEGRAL     Likelihood = -1.33    Transmembrane    80-96 (79-96)

----- Final Results -----
           bacterial membrane --- Certainty = 0.2211(Affirmative) < succ>
           bacterial outside  --- Certainty = 0.0000(Not Clear)   < succ>
         bacterial cytoplasm  --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1960

A DNA sequence (GBSx2069) was identified in *S. agalactiae* <SEQ ID 6075> which encodes the amino acid sequence <SEQ ID 6076>. This protein is predicted to be regulatory protein (pfoS/R). Analysis of this protein sequence reveals the following:

```
Possible site: 49
>>> Seems to have no N-terminal signal sequence
    INTEGRAL     Likelihood = -9.82    Transmembrane    317-333 (304-335)
    INTEGRAL     Likelihood = -7.64    Transmembrane    187-203 (183-217)
    INTEGRAL     Likelihood = -5.26    Transmembrane     24-40  (18-44)
    INTEGRAL     Likelihood = -5.04    Transmembrane    143-159 (139-161)
    INTEGRAL     Likelihood = -2.34    Transmembrane    116-132 (115-136)
    INTEGRAL     Likelihood = -2.13    Transmembrane     55-71  (55-71)
    INTEGRAL     Likelihood = -0.96    Transmembrane    268-284 (268-284)

----- Final Results -----
           bacterial membrane --- Certainty = 0.4927(Affirmative) < succ>
           bacterial outside  --- Certainty = 0.0000(Not Clear)   < succ>
         bacterial cytoplasm  --- Certainty = 0.0000(Not Clear)   < succ>
```

The protein has homology with the following sequences in the GENPEPT database.

```
>GP: AAC65034 GB: AE001189 regulatory protein (pfoS/R) [Treponema
pallidum]
Identities = 138/358 (38%), Positives = 220/358 (60%), Gaps = 18/358 (5%)

Query:   2 TNTVTPKETAGSFINKVLGGTATAIVVALIPNAILATFLKPFLSYG-LAAEFLHIVQVFQ    60
           T +++P++     F+ K+L G++   IV+ L+P AI        +       L A   H+V    Q
Sbjct:   3 TQSLSPRQ----FMMKILNGSSAGIVIGLVPPAIAGELFRALAPLSPLFAALYHVVLPIQ    58

Query:  61 FFTPIMAGFLIGQQFKFTPMQQLAVGGAAYIGSGAWAYTEVIQKGVATGSFQLRGIGDLI   120
           F  P + G L+G QF + +         + I SG          + G++ + GIGD+I
Sbjct:  59 FSVPALIGTLVGLQFHCSAPEVATLAFVSVIASG--------NVTLQNGAWLITGIGDVI   110

Query: 121 NMMLTAALAVLAVKWFGNKFGSLTIILLPIIIGTGVGYLGWKLLPYVSYVTTLIGQGINS   180
           N+ML +ALA++  V+     K  GSLTII  LP+I+     G  +G       LPYV  +T    +G+ I +
Sbjct: 111 NVMLISALAIILVRALRGKLGSLTIIALPVIVAVVAGGVGSFSLPYVKMITLFVGRVIAT   170

Query: 181 FTTLQPIAMSILIAMAFSMLIVSPISTVAIGLAIGLNGMSASAASMGVASTTAVLVWATM   240
           F   LQP+  MSIL++M+ FS++   I+SP+S+VA+G+A+GL G+++     AA++GV+S         L+      TM
Sbjct: 171 FIALQPLLMSILLSMSFSLIIISPVSSVAVGIAVGLTGLASGAANIGVSSCAMTLIVGTM   230
```

```
                              -continued
Query: 241 KANKSGVPIAIALGAMKMMMPNFLKHPVMAIPMLMTATVSSLTVPLFKLVGTPASSGFGL 300
           + NK GVP+A+  GAMKM+MPN++++P++ IP+L+   V  +   LF L GTPAS+GFG
Sbjct: 231 RVNKIGVPLAMFAGAMKMLMPNWIRYPILNIPLLLNGLVCGVLAWLFNLQGTPASAGFGF 290

Query: 301 VGAVGPIASFE--AGASML---IVILSWLVIPFAVGFVSHKICKDILKLYKDDIFVFE 353
           +G VGPI ++   A  M+   I+ L + V+ F  ++   I D LKLY+ ++F+ E
Sbjct: 291 IGLVGPINAYRLMAYTPMVRAGILFLVYFVLSFLAAYLIDFILVDRLKLYRRELFIPE 348
```

There is also homology to SEQ ID 1280.

A related GBS gene <SEQ ID 8939> and protein <SEQ ID 8940> were also identified. Analysis of this protein sequence reveals the following:

```
Lipop: Possible site: -1 Crend: 8
McG: Discrim Score: -7.24
GvH: Signal Score (-7.5): -2.94
     Possible site: 49
>>> Seems to have no N-terminal signal sequence
ALOM program count: 7 value: -9.82 threshold: 0.0
     INTEGRAL      Likelihood = -9.82    Transmembrane     317-333 (304-335)
     INTEGRAL      Likelihood = -7.64    Transmembrane     187-203 (183-217)
     INTEGRAL      Likelihood = -6.37    Transmembrane     143-159 (136-161)
     INTEGRAL      Likelihood = -5.26    Transmembrane      24-40  (18-44)
     INTEGRAL      Likelihood = -2.34    Transmembrane     116-132 (115-136)
     INTEGRAL      Likelihood = -2.13    Tramsmembrane      55-71  (55-71)
     INTEGRAL      Likelihood = -0.96    Transmembrane     268-284 (268-284)
     PERIPHERAL    Likelihood = 0.69 205
modified ALOM score: 2.46

*** Reasoning Step: 3

----- Final Results -----
            bacterial membrane --- Certainty = 0.4927(Affirmative) < succ>
            bacterial outside  --- Certainty = 0.0000(Not Clear)   < succ>
            bacterial cytoplasm --- Certainty = 0.0000(Not Clear)  < succ>
```

The protein has homology with the following sequences in the databases:

```
ORF02147(337-1359 of 1668)
EGAD|138195|TP0038(10-348 of 350) regulatory protein {Treponema pallidum}
OMNI|TP0038 regulatory protein (pfoS/R) GP|3322295|gb|AAC65034.1||AE001189 regulatory
protein (pfoS/R) {Treponema pallidum} PIR|E|71373|E71373 probable regulatory protein
(pfoS/R) - syphilis spirochete
% Match = 21.6
% Identity = 40.1 % Similarity = 65.6
Matches = 135 Mismatches = 112 Conservative Sub.s = 86
 87         117        147        177        207        237        267        297
LQQDMGKHQSL*TKLSIIFILIEITV*SIQHH**NNYK*N**VYKKGLYILLKK*QSFLFIL*YN*LCRYE*Y*INEARY 327        357        387        417        444        474        504        534
FMTNTVTPKETAGSFINKVLGGTATAIVVALIPNAILATFLKPFLSYG-LAAEFLHIVQVFQFFTPIMAGFLIGQQFKFT
                    |: |:|  |::   ||:  |:|  ||    :::  :  | |: |:|    ||    | | |:| ||   :
           MHTQSLSPRQFMMKILNGSSAGIVIGLVPPAIAGELFRALAPLSPLFAALYHVVLPIQFSVPALIGTLVGLQFHCS
            10         20         30         40         50         60         70

564        594        624        654        684        714        744        774
PMQQLAVGGAAYIGSGAWAYTEVIQKGVATGSFQLRGIGDLINMMLTAALAVLAVKWFGNKFGSLXIILLPIIIGTGVGY
 :    :     : | ||                 :  |:: :   ||||:||:||    :|||::   |:   |:|||::      |
APEVATLAFVSVIASG--------NVTLQNGAWLITGIGDVINVMLISALAIILVRALRGKLGSLTIIALPVIVAVVAGG
            90        100        110        120        130        140

804        834        864        894        924        954        984       1014
LGWKLLPYVSYVTTLIGQGINSFTTLQPIAMSILIAMAFSMLIVSPISTVAIGLAIGLNGMSASAASMGVASTTAVLVWA
  :| ||||   :|  ::|  | |:  |||: ||||::|:|::||:||:||     |:::   ||:::    ||:|:|         |:
VGSFSLPYVKMITLFVGRVIATFIALQPLLMSILLSMSFSLIIISPVSSVAVGIAVGLTGLASGAANIGVSSCAMTLIVG
           160        170        180        190        200        210        220

1044       1074       1104       1134       1164       1194       1224       1248
TMKANKSGVPIAIALGAMKMMMPNFLKHPVMAIPMLMTATVSSLTVPLFKLVGTPASSGFGLVGAVGPIASFE--AGASM
||: ||  |||:|:  |||||:|||:::::|::   ||:|:     |   :  ||| | ||||||:||::: |||| ::   |||  ::     |    |
TMRVNKIGVPLAMFAGAMKMLMPNWIRYPILNIPLLLNGLVCGVLAWLFNLQGTPASAGFGFIGLVGPINAYRLMAYTPM
           240        250        260        270        280        290        300

1269       1299       1329       1359       1389       1419       1449       1479
L---IVILSWLVIPFAVGFVSHKICKDILKLYKDDIFVFEGQN*FGGCMLVYIAGSGAMGCRFGYQISKTNHDVILLDNW
:      |:  |  | ::|:|       |     ::     |    |   ||||  :: :|: |
VRAGILFLVYFVLSFLAAYLIDFILVDRLKLYRRELFIPEQG
           320        330        340        350
```

There is also homology to SEQ ID 1276 Based on this analysis, it was predicted that these proteins and their epitopes could be useful antigens for vaccines or diagnostics.

EXAMPLE 1961

A DNA sequence (GBSx2070) was identified in *S. agalactiae* <SEQ ID 6077> which encodes the amino acid sequence <SEQ ID 6078>. Analysis of this protein sequence reveals the following:

```
Possible site: 20
>>> Seems to have a cleavable N-term signal seq.

----- Final Results -----
            bacterial outside --- Certainty = 0.3000(Affirmative) < succ>
           bacterial membrane --- Certainty = 0.0000(Not Clear)   < succ>
           bacterial cytoplasm --- Certainty = 0.0000(Not Clear)   < succ>
```

The protein has homology with the following sequences in the GENPEPT database.

```
>GP: BAB07127 GB: AP001518 thioredoxin reductase [Bacillus halodurans]
Identities = 163/325 (50%), Positives = 222/325 (68%), Gaps = 3/325 (0%)

Query:   5 IYDITIVGGGPVGLFAAFYAGLRGVSVKIIESLSELGGQPAILYPEKKIYDIPGYPVITG   64
           +YDITI+GGGP GLFAAFY G+R   VKIIES+ +LGGQ A LYPEK IYD+ G+P +
Sbjct:   7 LYDITIIGGGPTGLFAAFYGGMRQAKVKIIESMPQLGGQLAALYPEKYIYDVAGFPKVKA  66

Query:  65 RELIDKHIEQLERFKDSIEICLKEEVLSFEK-VDDVFTIQTDKDQHLSRAIVFACGNGAF  123
           ++L++    Q E+F  +I   L++ V +   K   DD FTI+TDK+ H S+AI+   G GAF
Sbjct:  67 QDLVNDLKRQAEQFNPTI--ALEQSVQNVTKETDDTFTIKTDKETHYSKAIIITAGAGAF  124

Query: 124 APRLLGLENEENYADNNLFYNVTKLEQFAGKHVVICGGGDSAVDWANELDKIAASVAIVH  183
              PR L +E  + Y   NL Y V  L  +AGK+V+I GGGDSAVDWA  L+ +A +V ++H
Sbjct: 125 QPRRLEVEGAKQYEGKNLQYFVNDLNAYAGKNVLISGGGDSAVDWALMLEPVAKNVTLIH  184

Query: 184 RRDAFRAHEHSVDILKASGVRILTPYVPIGLNGDSQRVSSLVVQKVKGDEVIELPLDNLI  243
           RRD FRAHEHSV++L+ S V ILTP+    L+GD +++  + +Q+VKGD V  L +D +I
Sbjct: 185 RRDKFRAHEHSVELLQKSSVNILTPFAISELSGDGEKIHHVTIQEVKGDAVETLDVDEVI  244

Query: 244 VSFGFSTSNKNLRYWNLDYKRSSINVSSLFETTQEGVYAIGDAANYPGKVELIATGYGEA  303
           V+FGF +S   ++ W L+ +++SI V++   ET   G+YA GD   YPGKV+LIATG+GEA
Sbjct: 245 VNFGFVSSLGPIKGWGLEIEKNSIVVNTKMETNIPGIYAAGDICTYPGKVKLIATGFGEA  304

Query: 304 PVAINQAINYIYPDRDNRVVHSTSL                                    328
           P A+N A  +I P        HSTSL
Sbjct: 305 PTAVNNAKAFIDPTARVFPGHSTSL                                    329
```

A related DNA sequence was identified in *S. pyogenes* <SEQ ID 6079> which encodes the amino acid sequence <SEQ ID 6080>. Analysis of this protein sequence reveals the following:

```
Possible site: 20
>>> Seems to have an uncleavable N-term signal seq
     INTEGRAL    Likelihood = -0.37     Transmembrane    8-24 (8-24)

----- Final Results -----
           bacterial membrane --- Certainty = 0.1150(Affirmative) < succ>
            bacterial outside --- Certainty = 0.0000(Not Clear)   < succ>
           bacterial cytoplasm --- Certainty = 0.0000(Not Clear)   < succ>
```

The protein has homology with the following sequences in the databases:

```
>GP: CAB15201 GB: Z99120 similar to thioredoxin reductase
[Bacillus subtilis]
Identities = 173/328 (52%), Positives = 223/328 (67%), Gaps = 4/328 (1%)

Query:   4 KAYDITIIGGGPIGLFAAFYAGLRGVTVKIIESLSELGGQPAILYPEKMIYDIPAYPSLT   63
           K YDITIIGGGP+GLF AFY G+R  +VKIIESL +LGGQ + LYPEK IYD+  +P +
Sbjct:   6 KVYDITIIGGGPVGLFTAFYGGMRQASVKIIESLPQLGGQLSALYPEKYIYDVAGFPKIR  65
```

```
-continued

Query:   64 GVELTENLIKQLSRFEDRTTICLKEEVLTFDKVKGG-FSIRTNKAEHFSKAIIIACGNGA 122
            EL  NL +Q+++F+   TICL++ V + +K   G F +   K    I  GNGA
Sbjct:   66 AQELINNLKEQMAKFDQ--TICLEQAVESVEKQADGVFKLVQMKKPTTLKRSCITAGNGA 123

Query:  123 FAPRTLGLESEENFADHNLFYNVHQLDQFAGQKVVICGGGDSAVDWALALEDIAESVTVV 182
            F PR L LE+ E +    NL Y V  L +FAG++V I GGGDSAVDWAL LE IA+ V+++
Sbjct:  124 FKPRKLELENAEQYEGKNLHYFVDDLQKFAGRRVAILGGGDSAVDWALMLEPIAKEVSII 183

Query:  183 HRRDAFRAHEHSVELLKASTVNLLTPYVPKALKGIGNLAEKLVIQKVKEDEVLELELDSL 242
            HRRD FRAHEHSVE L AS VN+LTP+VP    L G   + E+LV+++VK D    LE+D L
Sbjct:  184 HRRDKFRAHEHSVENLHASKVNVLTPFVPAELIGEDKI-EQLVLEEVKGDRKEILEIDDL 242

Query:  243 IVSFGFSTSNKNLKNWNLDYKRSSITVSPLFQTSQEGIFAIGDAAAYNGKVDLIATGFGE 302
            IV++GF +S   +KNW LD +++SI V    +T+ EG FA GD   Y GKV+LIA+GFGE
Sbjct:  243 IVNYGFVSSLGPIKNWGLDIEKNSIVVKSTMETNIEGFFAAGDICTYEGKVNLIASGFGE 302

Query:  303 APTAVNQAINYIYPDRDNRVVHSTSLID                                 330
            APTAVN A  Y+ P   + +HSTSL +
Sbjct:  303 APTAVNNAKAYMDPKARVQPLHSTSLFE                                 330
```

An alignment of the GAS and GBS proteins is shown below.

```
Identities = 242/324 (74%), Positives = 279/324 (85%)

Query:    6 YDITIVGGGPVGLFAAFYAGLRGVSVKIIESLSELGGQPAILYPEKKIYDIPGYPVITGR 65
            YDITI+GGGP+GLFAAFYAGLRGV+VKIIESLSELGGQPAILYPEK IYDIP YP +TG
Sbjct:    6 YDITIIGGGPIGLFAAFYAGLRGVTVKIIESLSELGGQPAILYPEKMIYDIPAYPSLTGV 65

Query:   66 ELIDKHIEQLERFKDSIEICLKEEVLSFEKVDDVFTIQTDKDQHLSRAIVFACGNGAFAP 125
            EL +   I+QL RF+D   ICLKEEVL+F+KV   F+I+T+K +H S+AI+ ACGNGAFAP
Sbjct:   66 ELTENLIKQLSRFEDRTTICLKEEVLTFDKVKGGFSIRTNKAEHFSKAIIIACGNGAFAP 125

Query:  126 RLLGLENEENYADNNLFYNVTKLEQFAGKHVVICGGGDSAVDWANELDKIAASVAIVHRR 185
            R LGLE+EEN+AD+NLFYNV +L+QFAG+ VVICGGGDSAVDWA  L+ IA SV +VHRR
Sbjct:  126 RTLGLESEENFADHNLFYNVHQLDQFAGQKVVICGGGDSAVDWALALEDIAESVTVVHRR 185

Query:  186 DAFRAHEHSVDILKASGVRILTPYVPIGLNGDSQRVSSLVVQKVKGDEVIELPLDNLIVS 245
            DAFRAHEHSV++LKAS V +LTPYVP  L G      LV+QKVK DEV+EL LD+LIVS
Sbjct:  186 DAFRAHEHSVELLKASTVNLLTPYVPKALKGIGNLAEKLVIQKVKEDEVLELELDSLIVS 245

Query:  246 FGFSTSNKNLRYWNLDYKRSSINVSSLFETTQEGVYAIGDAANYPGKVELIATGYGEAPV 305
            FGFSTSNKNL+ WNLDYKRSSI VS LF+T+QEG++AIGDAA Y GKV+LIATG+GEAP
Sbjct:  246 FGFSTSNKNLKNWNLDYKRSSITVSPLFQTSQEGIFAIGDAAAYNGKVDLIATGFGEAPT 305

Query:  306 AINQAINYIYPDRDNRVVHSTSLI                                    329
            A+NQAINYIYPDRDNRVVHSTSLI
Sbjct:  306 AVNQAINYIYPDRDNRVVHSTSLI                                    329
```

SEQ ID 6078 (GBS178) was expressed in *E. coli* as a His-fusion product. SDS-PAGE analysis of total cell extract is shown in FIG. 38 (lane 5; MW 37.4 kDa). It was also expressed in *E. coli* as a GST-fusion product. SDS-PAGE analysis of total cell extract is shown in FIG. 41 (lane 8; MW 62.4 kDa).

Based on this analysis, it was predicted that this protein and its epitopes, could be useful antigens for vaccines or diagnostics.

EXAMPLE 1962

A DNA sequence (GBSx2071) was identified in *S. agalactiae* <SEQ ID 6081> which encodes the amino acid sequence <SEQ ID 6082>. This protein is predicted to be tRNA methyltransferase (trnD). Analysis of this protein sequence reveals the following:

```
Possible site: 25
>>> Seems to have no N-terminal signal sequence

----- Final Results -----
            bacterial cytoplasm --- Certainty = 0.1496(Affirmative) < succ>
            bacterial membrane  --- Certainty = 0.0000(Not Clear)   < succ>
            bacterial outside   --- Certainty = 0.0000(Not Clear)   < succ>
```

The protein has homology with the following sequences in the GENPEPT database.

```
>GP: BAB06198 GB: AP001515 tRNA methyltransferase [Bacillus halodurans]
Identities = 144/246 (58%), Positives = 186/246 (75%), Gaps = 6/246 (2%)
```

```
Query:    2 MKIDILTLFPEMFAPLEHS-IVGKAKERGLLEINYHNFRENAE-KSRHVDDEPYGGGQGM    59
            MKID LTLFPEMF  + HS I+ +A+ERG +      NFRE +E K + VDD PYGGG GM
Sbjct:    1 MKIDFLTLFPEMFQGVLHSSILKQAQERGAVSFRVVNFREYSENKHKKVDDYPYGGGAGM    60

Query:   60 LLRAQPIFDTIDKIDAQKA---RVILLDPAGRTFDQDFAEELSKEDELIFICGHYEGYDE   116
            +L  QP+FD ++ +  + +   RVIL+ P G TF Q  AEEL++ + LI +CGHYEGYDE
Sbjct:   61 VLSPQPLFDAVEDLTKKSSSTPRVILMCPQGETFTQRKAEELAQAEHLILLCGHYEGYDE   120

Query:  117 RIKS-LVTDEVSLGDFVLTGGELAAMTMVDATVRLIPEVIGKETSHQDDSFSSGLLEYPQ   175
            RI+S LVTDE+S+GD+VLTGGEL AM + D+  RL+P V+G ETS Q DSFS+GLLEYPQ
Sbjct:  121 RIRSYLVTDELSIGDYVLTGGELGAMVIADSVTRLLPAVLGNETSAQTDSFSTGLLEYPQ   180

Query:  176 YTRPYDYLGMTVPDVLMSGHHENIRKWRLEQSLRKTLERRPDLLENYAMTDEERLILEKI   235
            YTRP D+ G  VPDVL+SGHH+NI +WR EQSL++TLERRPDLLE    +T+EE+ +L+ I
Sbjct:  181 YTRPADFRGWKVPDVLLSGHHQNIERWRKEQSLKRTLERRPDLLEGRKLTEEEQELLDSI   240

Query:  236 KTEIER                                                        241
            + + E+
Sbjct:  241 RKQQEK                                                        246
```

A related DNA sequence was identified in *S. pyogenes* <SEQ ID 6083> which encodes the amino acid sequence <SEQ ID 6084>. Analysis of this protein sequence reveals the following:

```
Possible site: 24
>>> Seems to have no N-terminal signal sequence

----- Final Results -----
            bacterial cytoplasm --- Certainty = 0.2705(Affirmative) < succ>
            bacterial membrane  --- Certainty = 0.0000(Not Clear)  < succ>
             bacterial outside  --- Certainty = 0.0000(Not Clear)  < succ>
```

An alignment of the GAS and GBS proteins is shown below.

```
Identities = 195/240 (81%), Positives = 224/240 (93%)

Query:    2 MKIDILTLFPEMFAPLEHSIVGKAKERGLLEINYHNFRENAEKSRHVDDEPYGGGQGMLL    61
            MKIDILTLFPEMFAPLEHSIVGKAKE+GLL+I+YHNFR+ AEK+RHVDDEPYGGGQGMLL
Sbjct:    1 MKIDILTLFPEMFAPLEHSIVGKAKEKGLLDIHYHNFRDYAEKARHVDDEPYGGGQGMLL    60

Query:   62 RAQPIFDTIDKIDAQKARVILLDPAGRTFDQDFAEELSKEDELIFICGHYEGYDERIKSL   121
            RAQPIFDTI++I+A+K R+ILLDPAG+ F Q +AEEL+ E+ELIFICGHYEGYDERIK+L
Sbjct:   61 RAQPIFDTIEQIEAKKPRIILLDPAGKPFTQAYAEELALEEELIFICGHYEGYDERIKTL   120

Query:  122 VTDEVSLGDFVLTGGELAAMTMVDATVRLIPEVIGKETSHQDDSFSSGLLEYPQYTRPYD   181
            VTDE+SLGDFVLTGGELAAMTMVDATVRLIP+V+GKE+SHQDDSFSSGLLEYPQYTRPYD
Sbjct:  121 VTDEISLGDFVLTGGELAAMTMVDATVRLIPQVLGKESSHQDDSFSSGLLEYPQYTRPYD   180

Query:  182 YLGMTVPDVLMSGHHENIRKWRLEQSLRKTLERRPDLLENYAMTDEERLILEKIKTEIER   241
            Y GMTVPDVLMSGHHE IR WRLE+SL+KT  RRPDLLE+Y  ++EER +L+KIK  +++
Sbjct:  181 YRGMTVPDVLMSGHHERIRLWRLEESLKKTYLRRPDLLEHYNFSEEERKLLDKIKEALDQ   240
```

Based on this analysis, it was predicted that these proteins and their epitopes could be useful antigens for vaccines or diagnostics.

EXAMPLE 1963

A DNA sequence (GBSx2072) was identified in *S. agalactiae* <SEQ ID 6085> which encodes the amino acid sequence <SEQ ID 6086>. This protein is predicted to be 16S rRNA processing protein. Analysis of this protein sequence reveals the following:

```
Possible site: 43
>>> Seems to have no N-terminal signal sequence
     INTEGRAL    Likelihood = -2.71    Transmembrane    32-48 (32-52)
```

```
                        -continued
----- Final Results -----
            bacterial membrane --- Certainty = 0.2084(Affirmative) < succ>
            bacterial outside  --- Certainty = 0.0000(Not Clear)   < succ>
            bacterial cytoplasm --- Certainty = 0.0000(Not Clear)  < succ>
```

A related GBS nucleic acid sequence <SEQ ID 9381> which encodes amino acid sequence <SEQ ID 9382> was also identified.

The protein has homology with the following sequences in the GENPEPT database.

```
>GP: CAB13475 GB: Z99112 similar to hypothetical proteins
[Bacillus subtilis]
Identities = 88/174 (50%), Positives = 128/174 (72%), Gaps = 1/174 (0%)

Query:   54 VTMEYFNVGKIVNTQGLQGEMRVLSVTDFVEERFKKGQVLALFDEKNQFVMDIEIASHRK  113
            +T +FNVGKIVNT G++GE+RV+S TDF EER+K G  L LF +    +++ + +HR
Sbjct:    1 MTKRWFNVGKIVNTHGIKGEVRVISKTDFAEERYKPGNTLYLFMDGRNEPVEVTVNTHRL  60

Query:  114 QKNFDIIKFKGMYHINDIEKYKGFTLKVAEDQLSDLKDGEFYYHEIIGLDVYEGE-ELIG  172
            K F +++FK   ++N++E+ K   +KV E++L +L +GEFY+HEIIG +V+  E ELIG
Sbjct:   61 HKQFHLLQFKERQNLNEVEELKNAIIKVPEEELGELNEGEFYFHEIIGCEVFTEEGELIG  120

Query:  173 KIKEILQPGANDVWVVERHGKRDLLLPYIPPVVLEVDLSNQRVQVELMEGLDDE        226
            K+KEIL PGANDVWV+ R GK+D L+PYI  VV  +D+ +++++ELMEGL DE
Sbjct:  121 KVKEILTPGANDVWVIGRKGKKDALIPYIESVVKHIDVREKKIEIELMEGLIDE         174
```

A related DNA sequence was identified in *S. pyogenes* <SEQ ID 6087> which encodes the amino acid sequence <SEQ ID 6088>. Analysis of this protein sequence reveals the following:

```
Possible site: 28
>>> Seems to have no N-terminal signal sequence

----- Final Results -----
            bacterial cytoplasm --- Certainty = 0.2787(Affirmative) < succ>
            bacterial membrane  --- Certainty = 0.0000(Not Clear)   < succ>
            bacterial outside   --- Certainty = 0.0000(Not Clear)   < succ>
```

An alignment of the GAS and GBS proteins is shown below.

```
Identities = 133/172 (77%), Positives = 153/172 (88%)

Query:   56 MEYFNVGKIVNTQGLQGEMRVLSVTDFVEERFKKGQVLALFDEKNQFVMDIEIASHRKQK  115
            MEYFNVGKIVNTQGLQGEMRVLSV+DF EERFKKG  LALFD+K++FV ++ I SHRKQK
Sbjct:    1 MEYFNVGKIVNTQGLQGEMRVLSVSDFAEERFKKGSQLALFDDKDRFVQEVTIVSHRKQK  60

Query:  116 NFDIIKFKGMYHINDIEKYKGFTLKVAEDQLSDLKDGEFYYHEIIGLDVYEGEELIGKIK  175
            +FDIIKFK MYHIN IEKYKG+TLKV++D  DL++GEFYYH+IIG+ VYE + LIG +K
Sbjct:   61 HFDIIKFKDMYHINAIEKYKGYTLKVSKDNQGDLQEGEFYYHQIIGMAVYEKDVLIGHVK  120

Query:  176 EILQPGANDVWVVERHGKRDLLLPYIPPVVLEVDLSNQRVQVELMEGLDDED         227
            EILQPGANDVW+V+R GKRDLLLPYIPPVVL VD+ N+RV VELMEGLDDED
Sbjct:  121 EILQPGANDVWIVKRQGKRDLLLPYIPPVVLNVDVPNKRVDVELMEGLDDED         172
```

Based on this analysis, it was predicted that these proteins and their epitopes could be useful antigens for vaccines or diagnostics.

EXAMPLE 1964

A DNA sequence (GBSx2073) was identified in *S. agalactiae* <SEQ ID 6089> which encodes the amino acid sequence <SEQ ID 6090>. This protein is predicted to be similar to *E. coli* ykfc (11). Analysis of this protein sequence reveals the following:

```
Possible site: 55
>>> Seems to have no N-terminal signal sequence

----- Final Results -----
             bacterial cytoplasm --- Certainty = 0.3488(Affirmative) < succ>
              bacterial membrane --- Certainty = 0.0000(Not Clear)  < succ>
               bacterial outside --- Certainty = 0.0000(Not Clear)  < succ>
```

A related GBS nucleic acid sequence <SEQ ID 9909> which encodes amino acid sequence <SEQ ID 9910> was also identified.

The protein has homology with the following sequences in the GENPEPT database.

```
>GP: AAC38715 GB: AF030367 maturase-related protein
[Streptococcus pneumoniae]
Identities = 366/425 (86%), Positives = 396/425 (93%)

Query:   12 MSELLDKILSRNNMLEAYKQVKSNKGSAGINGVTIEQMDDYLHQNWRETKQLIKERSYKP   71
            MS+LLDKILSR NMLEAY QVKSNKGSAGI+G+TIE+MD+YL QNWR TK+LIK+R YKP
Sbjct:    1 MSKLLDKILSRENMLEAYNQVKSNKGSAGIDGMTIEEMDNYLRQNWRLTKELIKQRKYKP   60

Query:   72 QPVLRVEIPKPNGGVRNLGIPTAMDRMIQQAIVQVLSPLCEKHFSEYSYGFRPNRSCETA  131
            QPVL+VEIPKP+GG+R LGIPT MDRMIQQAIVQV+SP+CE HFS+ SYGFRPNRSCE A
Sbjct:   61 QPVLKVEIPKPDGGIRQLGIPTVMDRMIQQAIVQVMSPICEPHFSDTSYGFRPNRSCEKA  120

Query:  132 IVQLLEYLNDGYEWIVDIDLEKFFDTVPQDRLMSLVHNIIQDGDTESLIRKYLHSGVVIN  191
            I++LLEYLNDGYEWIVDIDLEKFFDTVPQDRLMSLVHNII+DGDTESLIRKYLHSGV+IN
Sbjct:  121 IMKLLEYLNDGYEWIVDIDLEKFFDTVPQDRLMSLVHNIIEDGDTESLIRKYLHSGVIIN  180

Query:  192 GQRHKTLVGTPQGGNLSPLLSNIMLNELDKGLEKRGLRFVRYADDCVITVGSEAAAKRVM  251
            GQR+KTLVGTPQGGNLSPLLSNIMLNELDK LEKRGLRFVRYADDCVITVGSEAAAKRVM
Sbjct:  181 GQRYKTLVGTPQGGNLSPLLSNIMLNELDKELEKRGLRFVRYADDCVITVGSEAAAKRVM  240

Query:  252 HSVSSYIEKRLGLKVNMTKTKIVRPNKLKYLGFGFWKSPKGWKCRPHQDSVQSFKRKLKQ  311
            +SVS +IEKRLGLKVNMTKTKI RP +LKYLGFGFWKS  GWK RPHQDSV+ FK KLK+
Sbjct:  241 YSVSRFIEKRLGLKVNMTKTKITRPRELKYLGFGFWKSSDGWKSRPHQDSVRRFKLKLKK  300

Query:  312 LTMRKWSIDLITRIERLNWVIRGWINYFSLGNMKSIMTQIDERLRTRIRVIIWKQWKKKA  371
            LT RKWSIDL RIE+LN  IRGWINYFSLGNMKSI+  IDERLRTR+R+IIWKQWKKK+
Sbjct:  301 LTQRKWSIDLTRRIEQLNLSIRGWINYFSLGNMKSIVASIDERLRTRLRMIIWKQWKKKS  360

Query:  372 KRLWGLLKLGVARWIADKVSGWGDHYQLVAQKSVLKRAISKPALAKRGLVSCLDYYLERH  431
            +RLWGLLKLGV +WIADKVSGWGDHYQLVAQKSVLKRAISKP L KRGLVSCLDYYLERH
Sbjct:  361 RRLWGLLKLGVPKWIADKVSGWGDHYQLVAQKSVLKRAISKPVLEKRGLVSCLDYYLERH  420

Query:  432 ALKVS                                                         436
            ALKVS
Sbjct:  421 ALKVS                                                         425
```

No corresponding DNA sequence was identified in *S. pyogenes*.

Based on this analysis, it was predicted that this protein and its epitopes, could be useful antigens for vaccines or diagnostics.

EXAMPLE 1965

A DNA sequence (GBSx2074) was identified in *S. agalactiae* <SEQ ID 6091> which encodes the amino acid sequence <SEQ ID 6092>. Analysis of this protein sequence reveals the following:

```
Possible site: 25
>>> Seems to have an uncleavable N-term signal seq
    INTEGRAL      Likelihood = -0.37      Transmembrane     7-23 (7-23)

----- Final Results -----
              bacterial membrane --- Certainty = 0.1150(Affirmative) < succ>
               bacterial outside --- Certainty = 0.0000(Not Clear)  < succ>
             bacterial cytoplasm --- Certainty = 0.0000(Not Clear)  < succ>
```

A related DNA sequence was identified in *S. pyogenes* <SEQ ID 821> which encodes the amino acid sequence <SEQ ID 822>. Analysis of this protein sequence reveals the following:

```
Possible site: 25
>>> Seems to have an uncleavable N-term signal seq
    INTEGRAL    Likelihood = -2.87    Transmembrane    1157-1173 (1157-1174)

----- Final Results -----
                bacterial membrane --- Certainty = 0.2147(Affirmative) < succ>
                bacterial outside  --- Certainty = 0.0000(Not Clear)   < succ>
                bacterial cytoplasm --- Certainty = 0.0000(Not Clear)  < succ>
```

An alignment of the GAS and GBS proteins is shown below.

```
Identities = 1031/1064 (96%), Positives = 1042/1064 (97%)

Query:    1 MRKKQKLPFDKLAIALISTSILLNAQSDIKANTVTEDTPATEQAVEPPQPIAVSEESPSS     60
            +RKKQKLPFDKLAIAL+STSILLNAQSDIKANTVTEDTPATEQAVE PQP AVSEE+PSS
Sbjct:    1 LRKKQKLPFDKLAIALMSTSILLNAQSDIKANTVTEDTPATEQAVETPQPTAVSEEAPSS     60

Query:   61 KETKTSQTPSDVGETVADDANDLAPQAPAKTADTPATSKATIRDLNDPSHVKTLQEKAGK    120
            KETKT QTP D  ET+ADDANDLAPQAPAKTADTPATSKATIRDLNDPS VKTLQEKAGK
Sbjct:   61 KETKTPQTPDDAEETIADDANDLAPQAPAKTADTPATSKATIRDLNDPSQVKTLQEKAGK    120

Query:  121 GVGTVVAVIDAGFDKNHEAWRLTDKTKARYQSKENLEKAKKEHGITYGEWVNDKVAYYHD    180
            G GTVVAVIDAGFDKNHEAWRLTDKTKARYQSKE+LEKAKKEHGITYGEWVNDKVAYYHD
Sbjct:  121 GAGTVVAVIDAGFDKNHEAWRLTDKTKARYQSKEDLEKAKKEHGITYGEWVNDKVAYYHD    180

Query:  181 YSKDGKNAVDQEHGTHVSGILSGNAPSEMKEPYRLEGAMPEAQLLLMRVEIVNGLADYAR    240
            YSKDGK AVDQEHGTHVSGILSGNAPSE KEPYRLEGAMPEAQLLLMRVEIVNGLADYAR
Sbjct:  181 YSKDGKTAVDQEHGTHVSGILSGNAPSETKEPYRLEGAMPEAQLLLMRVEIVNGLADYAR    240

Query:  241 NYAQAIRDAVNLGAKVINMSFGNAALAYANLPDETKKAFDYAKSKGVSIVTSAGNDSSFG    300
            NYAQAI DAVNLGAKVINMSFGNAALAYANLPDETKKAFDYAKSKGVSIVTSAGNDSSFG
Sbjct:  241 NYAQAIIDAVNLGAKVINMSFGNAALAYANLPDETKKAFDYAKSKGVSIVTSAGNDSSFG    300

Query:  301 GKPRLPLADHPDYGVVGTPAAADSTLTVASYSPDKQLTETATVKTDDHQDKEMPVLSTNR    360
            GK RLPLADHPDYGVVGTPAAADSTLTVASYSPDKQLTETATVKT D QDKEMPVLSTNR
Sbjct:  301 GKTRLPLADHPDYGVVGTPAAADSTLTVASYSPDKQLTETATVKTADQQDKEMPVLSTNR    360

Query:  361 FEPNKAYDYAYANRGTKEDDFKDVEGKIALIERGDIDFKDKIANAKKAGAVGVLIYDNQD    420
            FEPNKAYDYAYANRG KEDDFKDV+GKIALIERGDIDFKDKIANAKKAGAVGVLIYDNQD
Sbjct:  361 FEPNKAYDYAYANRGMKEDDFKDVKGKIALIERGDIDFKDKIANAKKAGAVGVLIYDNQD    420

Query:  421 KGFPIELPNVDQMPAAFISRRDGLLLKDNPQKTITFNATPKVLPTASGTKLSRFSSWGLT    480
            KGFPIELPNVDQMPAAFISR+DGLLLK+NPQKTITFNATPKVLPTASGTKLSRFSSWGLT
Sbjct:  421 KGFPIELPNVDQMPAAFISRKDGLLLKENPQKTITFNATPKVLPTASGTKLSRFSSWGLT    480

Query:  481 ADGNIKPDIAAPGQDILSSVANNKYAKLSGTSMSAPLVAGIMGLLQKQYETQYPDMTPSE    540
            ADGNIKPDIAAPGQDILSSVANNKYAKLSGTSMSAPLVAGIMGLLQKQYETQYPDMTPSE
Sbjct:  481 ADGNIKPDIAAPGQDILSSVANNKYAKLSGTSMSAPLVAGIMGLLQKQYETQYPDMTPSE    540

Query:  541 RLDLAKKVLMSSATALYDEDEKAYFSPRQQGAGAVDAKKASAATMYVTDKDNTSSKVHLN    600
            RLDLAKKVLMSSATALYDEDEKAYFSPRQQGAGAVDAKKASAATMYVTDKDNTSSKVHLN
Sbjct:  541 RLDLAKKVLMSSATALYDEDEKAYFSPRQQGAGAVDAKKASAATMYVTDKDNTSSKVHLN    600

Query:  601 NVSDKFEVTVTVHNKSDKPQELYYQVTVQTDKVDGKHFALAPKALYETSWQKITIPANSS    660
            NVSDKFEVTVTVHNKSDKPQELYYQ TVQTDKVDGK FALAPKALYETSWQKITIPANSS
Sbjct:  601 NVSDKFEVTVTVHNKSDKPQELYYQATVQTDKVDGKLFALAPKALYETSWQKITIPANSS    660

Query:  661 KQVTVPIDASRFSKDLLAQMKNGYFLEGFVRFKQDPTKEELMSIPYIGFRGDFGNLSALE    720
            KQVT+PID S+FSKDLLA MKNGYFLEGFVRFKQDPTKEELMSIPYIGFRGDFGNLSALE
Sbjct:  661 KQVTIPIDVSQFSKDLLAPMKNGYFLEGFVRFKQDPTKEELMSIPYIGFRGDFGNLSALE    720

Query:  721 KPIYDSKDGSSYYHEANSDAKDQLDGDGLQFYALKNNFTALTTESNPWTIIKAVKEGVEN    780
            KPIYDSKDGSSYYHEANSDAKDQLDGDGLQFYALKNNFTALTTESNPWTIIKAVKEGVEN
Sbjct:  721 KPIYDSKDGSSYYHEANSDAKDQLDGDGLQFYALKNNFTALTTESNPWTIIKAVKEGVEN    780

Query:  781 IEDIESSEITETIFAGTFAKQDDDSHYYIHRHANGKPYAAISPNGDGNRDYVQFQGTFLR    840
            IEDIESSEITETIFAGTFAKQDDDSHYYIHRHANGKPYAAISPNGDGNRDYVQFQGTFLR
Sbjct:  781 IEDIESSEITETIFAGTFAKQDDDSHYYIHRHANGKPYAAISPNGDGNRDYVQFQGTFLR    840

Query:  841 NAKNLVAEVLDKEGNVVWTSEVTEQVVKNYNNDLASTLGSTRFEKTRWDGKNKDGKVVAN    900
            NAKNLVAEVLDKEGNVVWTSEVTEQVVKNYNNDLASTLGSTRFEKTRWDGK+KDGKVVAN
Sbjct:  841 NAKNLVAEVLDKEGNVVWTSEVTEQVVKNYNNDLASTLGSTRFEKTRWDGKDKDGKVVAN    900
```

```
Query:   901 GTYTYRVRYTPISSGAKEQHTDFDVIVDNTTPEVATSATFSTEDSRLTLASKPKTSQPVY    960
             GTYTYRVRYTPISSGAKEQHTDFDVIVDNTTPEVATSATFSTED RLTLASKPKTSQPVY
Sbjct:   901 GTYTYRVRYTPISSGAKEQHTDFDVIVDNTTPEVATSATFSTEDRRLTLASKPKTSQPVY    960

Query:   961 RERIAYTYMDEDLPTTEYISPNEDGTFTLPEEAETMEGATVPLKMSDFTYVVEDMAGNIT   1020
             RERIAYTYMDEDLPTTEYISPNEDGTFTLPEEAETMEGATVPLKMSDFTYVVEDMAGNIT
Sbjct:   961 RERIAYTYMDEDLPTTEYISPNEDGTFTLPEEAETMEGATVPLKMSDFTYVVEDMAGNIT   1020

Query:  1021 YTPVTKLLEGHSNKPEQDGSDQAPDKKPEAKPEQDGSGQTPDKK                   1064
             YTPVTKLLEGHSNKPEQDGSDQAPDKKPE KPEQDGSGQ PDKK
Sbjct:  1021 YTPVTKLLEGHSNKPEQDGSDQAPDKKPETKPEQDGSGQAPDKK                   1064
```

A related GBS gene <SEQ ID 8941> and protein <SEQ ID 8942> were also identified. Analysis of this protein sequence reveals the following:

```
Lipop Possible site: -1 Crend: 10
McG: Discrim Score: 5.69
GvH: Signal Score (-7.5): -3.33
     Possible site: 25
>>> Seems to have an uncleavable N-term signal seq
ALOM program count: 1 value: -0.37 threshold: 0.0
     INTEGRAL       Likelihood = -0.37     Transmembrane    7-23 (7-23)
     PERIPHERAL     Likelihood = 2.81      508
modified ALOM score: 0.57
*** Reasoning Step: 3

----- Final Results -----
             bacterial membrane --- Certainty = 0.1150(Affirmative) < succ>
             bacterial outside  --- Certainty = 0.0000(Not Clear)   < succ>
             bacterial cytoplasm --- Certainty = 0.0000(Not Clear)  < succ>
```

SEQ ID 8942 (GBS276) was expressed in *E. coli* as a His-fusion product. SDS-PAGE analysis of total cell extract is shown in FIG. 46 (lane 2; MW 123 kDa). It was also expressed in *E. coli* as a GST-fusion product. SDS-PAGE analysis of total cell extract is shown in FIG. 60 (lane 5; MW 46.5 kDa).

Figure 296:
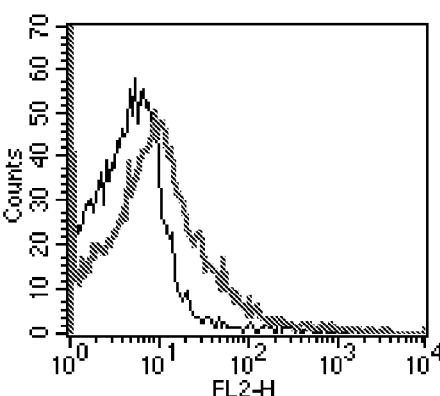

The GBS276-His fusion product was purified (FIG. 206, lane 9) and used to immunise mice. The resulting antiserum was used for FACS (FIG. 296), which confirmed that the protein is immunoaccessible on GBS bacteria.

Based on this analysis, it was predicted that these proteins and their epitopes could be useful antigens for vaccines or diagnostics.

EXAMPLE 1966

A DNA sequence (GBSx2075) was identified in *S. agalactiae* <SEQ ID 6093> which encodes the amino acid sequence <SEQ ID 6094>. Analysis of this protein sequence reveals the following:

```
Possible site: 58
>>> Seems to have no N-terminal signal sequence

----- Final Results -----
             bacterial cytoplasm --- Certainty = 0.4286(Affirmative) < succ>
             bacterial membrane  --- Certainty = 0.0000(Not Clear)   < succ>
             bacterial outside   --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1967

A DNA sequence (GBSx2076) was identified in *S. agalactiae* <SEQ ID 6095> which encodes the amino acid sequence <SEQ ID 6096>. Analysis of this protein sequence reveals the following:

```
Possible site: 30
>>> Seems to have an uncleavable N-term signal seq
     INTEGRAL       Likelihood = -11.15    Transmembrane    19-35 (11-39)
```

```
----- Final Results -----
         bacterial membrane --- Certainty = 0.5458(Affirmative) < succ>
         bacterial outside  --- Certainty = 0.0000(Not Clear)   < succ>
         bacterial cytoplasm --- Certainty = 0.0000(Not Clear)  < succ>
```

A related GBS nucleic acid sequence <SEQ ID 9911> which encodes amino acid sequence <SEQ ID 9912> was also identified.

The protein has no significant homology with any sequences in the GENPEPT database.

No corresponding DNA sequence was identified in *S. pyogenes*.

SEQ ID 6096 (GBS654) was expressed in *E. coli* as a GST-fusion product. SDS-PAGE analysis of total cell extract is shown in FIG. 142 (lane 8 & 10; MW 51.2 kDa+lane 9; MW 27 kDa). Purified GBS654-GST is shown in FIG. 245, lane 11.

Based on this analysis, it was predicted that this protein and its epitopes, could be useful antigens for vaccines or diagnostics.

EXAMPLE 1968

A DNA sequence (GBSx2077) was identified in *S. agalactiae* <SEQ ID 6097> which encodes the amino acid sequence <SEQ ID 6098>. Analysis of this protein sequence reveals the following:

```
Possible site: 14
>>> Seems to have no N-terminal signal sequence

----- Final Results -----
         bacterial cytoplasm --- Certainty = 0.4174(Affirmative) < succ>
         bacterial membrane  --- Certainty = 0.0000(Not Clear)   < succ>
         bacterial outside   --- Certainty = 0.0000(Not Clear)   < succ>
```

A related GBS nucleic acid sequence <SEQ ID 9913> which encodes amino acid sequence <SEQ ID 9914> was also identified.

The protein has homology with the following sequences in the GENPEPT database.

```
>GP: AAF27324 GB: AF178424 unknown [Lactococcus lactis]
Identities = 26/75 (34%), Positives = 45/75 (59%), Gaps = 4/75 (5%)

Query:  11 MAFEPKNSELTKVLKES-LDEEKKEIFSSEMNIRDFERTKQYQFTLQPSVRKKIDRLSKE  69
           MAF+  + ++  VL   S L + K E+       I   E  KY FTL+PSV++ +++L+++
Sbjct:   1 MAFDVDDKKVKTVLSNSSLAKSKVEL---PKKIESEENKKSYSFTLEPSVKEGLEKLAEK  57

Query:  70 KGYRSASSFINDFFK                                              84
           + Y++ S F+ND  K
Sbjct:  58 QNYKNTSQFLNDLIK                                              72
```

No corresponding DNA sequence was identified in *S. pyogenes*.

Based on this analysis, it was predicted that this protein and its epitopes, could be useful antigens for vaccines or diagnostics.

EXAMPLE 1969

A DNA sequence (GBSx2078) was identified in *S. agalactiae* <SEQ ID 6099> which encodes the amino acid sequence <SEQ ID 6100>. This protein is predicted to be ParA. Analysis of this protein sequence reveals the following:

```
Possible site: 45
>>> Seems to have an uncleavable N-term signal seq

----- Final Results -----
         bacterial membrane  --- Certainty = 0.0000(Not Clear) < succ>
         bacterial outside   --- Certainty = 0.0000(Not Clear) < succ>
         bacterial cytoplasm --- Certainty = 0.0000(Not Clear) < succ>
```

The protein has homology with the following sequences in the GENPEPT database.

```
>GP: AAF27325 GB: AF178424 ParA [Lactococcus lactis]
Identities = 49/104 (47%), Positives = 72/104 (69%)

Query:  22 LSERLEEFKTEAFDFKTRASYVTAKLFFLGNMIKHNTNSSKELIRSLKNDKSVLAMIPHK   81
           L ERL+ FK E  D +TR +Y+TA  +F+GN I+HNT SS+E   +  DK  +AMIP K
Sbjct: 157 LIERLQNFKDEVIDARTRETYITAIPYFVGNRIRHNTKSSREFSEKISQDKGTIAMIPEK  216

Query:  82 ELFNRSTLDKKSLSYMMSDKELYSRDSKFFKEIDFTFRKITDKL                 125
           ELFNRSTLD   L  M DK++++ +   F+++++F F +IT+K+
Sbjct: 217 ELFNRSTLDGVPLVEMEKDKDVFNSNKVFYEKLNFAFNEITNKI                 260
```

No corresponding DNA sequence was identified in *S. pyogenes*.

Based on this analysis, it was predicted that this protein and its epitopes, could be useful antigens for vaccines or diagnostics.

EXAMPLE 1970

A DNA sequence (GBSx2079) was identified in *S. agalactiae* <SEQ ID 6101> which encodes the amino acid sequence <SEQ ID 6102>. This protein is predicted to be transposase (orfA). Analysis of this protein sequence reveals the following:

```
Possible site: 42
>>> Seems to have no N-terminal signal sequence

----- Final Results -----
          bacterial cytoplasm --- Certainty = 0.2830(Affirmative) < succ>
          bacterial membrane  --- Certainty = 0.0000(Not Clear)   < succ>
          bacterial outside   --- Certainty = 0.0000(Not Clear)   < succ>
```

Based on this analysis, it was predicted that this protein and its epitopes, could be useful antigens for vaccines or diagnostics.

EXAMPLE 1971

A DNA sequence (GBSx2080) was identified in *S. agalactiae* <SEQ ID 6103> which encodes the amino acid sequence <SEQ ID 6104>. This protein is predicted to be transposase (orfB). Analysis of this protein sequence reveals the following:

```
Possible site: 16
>>> Seems to have no N-terminal signal sequence

----- Final Results -----
          bacterial cytoplasm --- Certainty = 0.2618(Affirmative) < succ>
          bacterial membrane  --- Certainty = 0.0000(Not Clear)   < succ>
          bacterial outside   --- Certainty = 0.0000(Not Clear)   < succ>
```

The protein has homology with the following sequences in the GENPEPT database.

```
>GP: CAB90834 GB: AJ250837 putative transposase [Streptococcus
dysgalactiae]
Identities = 242/259 (93%), Positives = 249/259 (95%)

Query:    1 MCRWLNMPHSSYYYQAVESVSETEFEETIKRIFLDSESRYGSRKIKICLNNEGITLSRRR    60
            MCRWLN+P SSYYY+AVE VSE E EE+IK IFL+S++RYGSRKIKICLNNEGITLSRRR
Sbjct:    1 MCRWLNIPRSSYYYKAVEPVSEAELEESIKAIFLESKARYGSRKIKICLNNEGITLSRRR    60

Query:   61 IRRIMKRLNLVSVYQKATFKPHSRGKNEAPIPNHLDRQFKQERPLQALVTDLTYVRVGNR   120
            IRRIMKRLNLVSVYQKATFKPHSRGKNEAPIPNHLDRQFK ERPLQALVTDLTYVRVGNR
Sbjct:   61 IRRIMKRLNLVSVYQKATFKPHSRGKNEAPIPNHLDRQFKPERPLQALVTDLTYVRVGNR   120

Query:  121 WAYVCLIIDLYNREIIGLSLGWHKTAELVKQAIQSIPYALTKVKMFHSDRXKEFDNQLID   180
            WAYVCLIIDLYNREIIGLSLGWHKTAELVKQAIQSIPY LTKVKMFHSDR KEF+NQLID
Sbjct:  121 WAYVCLIIDLYNREIIGLSLGWHKTAELVKQAIQSIPYPLTKVKMFHSDRGKEFNNQLID   180

Query:  181 EILEAFGITRSLSQAGCPYDNAVAESTYRAFKIEFVYQETFQLLEELALKTKDYVHWWNY   240
            EILEAFGITRSLSQAGCPYDNAVAESTYRAFKIEFVYQETFQ LEELALKTK YVHWWNY
Sbjct:  181 EILEAFGITRSLSQAGCPYDNAVAESTYRAFKIEFVYQETFQSLEELALKTKAYVHWWNY   240
```

```
Query: 241 HRIHGSLNYQTPMTKRLIA 259
            HRIHGSLNYQTPMTKRLIA
Sbjct: 241 HRIHGSLNYQTPMTKRLIA 259
```

There is also homology to SEQ ID 32.

Based on this analysis, it was predicted that this protein and its epitopes, could be useful antigens for vaccines or diagnostics.

EXAMPLE 1972

A DNA sequence (GBSx2081) was identified in *S. agalactiae* <SEQ ID 6105> which encodes the amino acid sequence <SEQ ID 6106>. Analysis of this protein sequence reveals the following:

```
Possible site: 16
>>> Seems to have no N-terminal signal sequence

----- Final Results -----
           bacterial cytoplasm --- Certainty = 0.3325(Affirmative) < succ>
           bacterial membrane  --- Certainty = 0.0000(Not Clear)   < succ>
            bacterial outside  --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1973

A DNA sequence (GBSx2082) was identified in *S. agalactiae* <SEQ ID 6107> which encodes the amino acid sequence <SEQ ID 6108>. Analysis of this protein sequence reveals the following:

```
Possible site: 59
>>> Seems to have no N-terminal signal sequence

----- Final Results -----
           bacterial cytoplasm --- Certainty = 0.4442(Affirmative) < succ>
           bacterial membrane  --- Certainty = 0.0000(Not Clear)   < succ>
            bacterial outside  --- Certainty = 0.0000(Not Clear)   < succ>
```

A related GBS nucleic acid sequence <SEQ ID 9917> which encodes amino acid sequence <SEQ ID 9918> was also identified.

The protein has homology with the following sequences in the GENPEPT database.

```
>GP: AAD44095 GB: AF115103 orf359 gp [Streptococcus thermophilus
bacteriophage Sfi21]
Identities = 92/357 (25%), Positives = 162/357 (44%), Gaps = 33/357 (9%)

Query:  45 RKNQYGKTFETMKEAYDELVRIKYEFANKVSLENYNMTFENYMNKIYLRAYKQK-VQSVT 103
           RK +   F T  EA        ++ +  + V+++  ++T  +Y   K +    YK+  V   +T
Sbjct:  24 RKPKTKGGFRTKSEAIKAAAEMELKLQDNVNVDE-DITLYDYF-KQWCEVYKKPTVSKIT  81

Query: 104 YKTALPHHKLFIQYFGLKPLKAITPRDCEAFRLHIIENYSENYAKNLWSRF----KACMG 159
           YK +    +   +FG K LK+IT + +       ++ +Y++ +A++    RF      KAC+
Sbjct:  82 YKAYINSQRKIELFFGDKKLKSITATEYQ----RVLNSYAKTHAQDTVERFNVHVKACIE 137

Query: 160 YAERLGYISNMPCKALD---NPRGKHPETPFWTYAEFQTFIKSFDLHDYEELQRFTAIWL 216
             A   GYI    CK       +G+  ET F    E++  I  ++    + E   + A+++
Sbjct: 138 MAVHEGYIKRNFCKFAKINAKNKGRDIETKFLEVEEYERLI--YETSKHPEYASYAALYI 195
```

-continued

```
Query: 217 YYMTGVRVSEGLSLCWEDIDFDKKFLKVHTTLEKDENGNWYRKDQTKTPAGERLIELDDI 276
           TG+R +E L L  +DI D    L V+ T +   N  +   TKT +  R I LDD
Sbjct: 196 IAKTGIRFAECLGLTVDDIKRDTGMLSVNKTWDYKNNTGFM---PTKTKSSIREIPLDDE 252

Query: 277 TIEVLQVWRKNQFANQDTDFIISRFGDPFCKSTICRIIKRKAQQVGVPVITGKGLRHSHA 336
           I   +    +Q   D   I+   +     T+ +I+ R+         +   LRH++A
Sbjct: 253 FINFI-----DQLPPTDDGRILPSLSNNAVNKTLRKIVGRE-------VRVHSLRHTYA 299

Query: 337 SYLINVLKKDILYVARRMGHADKSTTLNTYSHWFNALDKTVSEEITQNIKSAGLDSI   393
           SYLI    D++ V++ +GH + + TL   Y+H         E+I Q    G +++
Sbjct: 300 SYLI-AHDIDLISVSQVLGHENLNITLEVYAHQLQEQKSRNDEKIKQMWTECGRNAL   355
```

A related DNA sequence was identified in *S. pyogenes* <SEQ ID 6109> which encodes the amino acid sequence <SEQ ID 6110>. Analysis of this protein sequence reveals the following:

```
Possible site: 61
>>> Seems to have no N-terminal signal sequence

----- Final Results -----
            bacterial cytoplasm --- Certainty = 0.5549(Affirmative) < succ>
            bacterial membrane  --- Certainty = 0.0000(Not Clear)   < succ>
             bacterial outside  --- Certainty = 0.0000(Not Clear)   < succ>
```

An alignment of the GAS and GBS proteins is shown below.

```
Identities = 111/127 (87%), Positives = 119/127 (93%)

Query: 242 LKVHTTLEKDENGNWYRKDQTKTPAGERLIELDDDITIEVLQVWRKNQFANQDTDFIISRF 301
           LKVHTTLEKDENGNWYRKDQTKTPAGERLIELDD+TI VL+ WR+NQ  N DTDFIISRF
Sbjct:   1 LKVHTTLEKDENGNWYRKDQTKTPAGERLIELDDVTIVVLENWRRNQVVNTDTDFIISRF  60

Query: 302 GDPFCKSTICRIIKRKAQQVGVPVITGKGLRHSHASYLINVLKKDILYVARRMGHADKST 361
           G+PFCKSTICR+IK KAQ +GVPVITGKGLRHS+ASYLINVLKKDILYVA+ MGHADKST
Sbjct:  61 GEPFCKSTICRVIKHKAQSIGVPVITGKGLRHSYASYLINVLKKDILYVAKCMGHADKST 120

Query: 362 TLNTYSH 368
           TLNTYSH
Sbjct: 121 TLNTYSH 127
```

Based on this analysis, it was predicted that these proteins and their epitopes could be useful antigens for vaccines or diagnostics.

EXAMPLE 1974

A DNA sequence (GBSx2083) was identified in *S. agalactiae* <SEQ ID 6111> which encodes the amino acid sequence <SEQ ID 6112>. Analysis of this protein sequence reveals the following:

```
Possible site: 20
>>> Seems to have no N-terminal signal sequence

----- Final Results -----
            bacterial cytoplasm --- Certainty = 0.3299(Affirmative) < succ>
            bacterial membrane  --- Certainty = 0.0000(Not Clear)   < succ>
             bacterial outside  --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1975

A DNA sequence (GBSx2084) was identified in *S. agalactiae* <SEQ ID 6113> which encodes the amino acid sequence <SEQ ID 6114>. This protein is predicted to be repressor protein-related protein. Analysis of this protein sequence reveals the following:

```
Possible site: 32
>>> Seems to have no N-terminal signal sequence

----- Final Results -----
              bacterial cytoplasm --- Certainty = 0.2721(Affirmative) < succ>
               bacterial membrane --- Certainty = 0.0000(Not Clear)  < succ>
                 bacterial outside --- Certainty = 0.0000 (Not Clear) < succ>
```

A related GBS nucleic acid sequence <SEQ ID 9919> which encodes amino acid sequence <SEQ ID 9920> was also identified.

The protein has homology with the following sequences in the GENPEPT database.

```
>GP: AAC98432 GB: L29324 repressor protein [Streptococcus pneumoniae]
Identities = 38/65 (58%), Positives = 52/65 (79%), Gaps = 1/65 (1%)

Query:   2 MYRRLRDLREDNDFTQKYVAEK-LSFTHSAYSKIERGERILSADVIIKLSNLYNVSTDYL   60
           M +R+RDLRED+D TQ+YVA+  L+ T SAYSK+E G R++S D +IKL++ YNVS DYL
Sbjct:   1 MLKRIRDLREDDDLTQEYVAKTILNCTRSAYSKMESGTRLISIDDLIKLADFYNVSLDYL   60

Query:  61 LGQTD   65
           +G+ D
Sbjct:  61 VGRVD   65
```

There is also homology to SEQ ID 582.

Based on this analysis, it was predicted that this protein and its epitopes, could be useful antigens for vaccines or diagnostics.

EXAMPLE 1976

A DNA sequence (GBSx2085) was identified in *S. agalactiae* <SEQ ID 6115> which encodes the amino acid sequence <SEQ ID 6116>. This protein is predicted to be relaxase. Analysis of this protein sequence reveals the following:

```
Possible site: 40
>>> Seems to have no N-terminal signal sequence

----- Final Results -----
              bacterial cytoplasm --- Certainty = 0.3160(Affirmative) < succ>
               bacterial membrane --- Certainty = 0.0000(Not Clear)  < succ>
                 bacterial outside --- Certainty = 0.0000(Not Clear)  < succ>
```

The protein has homology with the following sequences in the GENPEPT database.

```
>GP:AAC98434 GB:L29324 relaxase [Streptococcus pneumoniae]
 Identities = 223/417 (53%), Positives = 310/417 (73%), Gaps = 5/417 (1%)

Query:   1 MVITKHYAVHGKKYRRQLIKYILDPKKTRNLSLISDFGMSNYLDFPDYVELVRMYQNNFL    60
           MVITKH+A+HGR YR +LIKYIL+P KT+NL+L+SDFGM NYLDFP Y ELVKMY +NFL
Sbjct:   1 MVITKHFAIHGKNYRSKLIKYILNPSKTKNLTLVSDFGMRNYLDFPSYKELVKMYNDNFL    60

Query:  61 SNDQLYDSRFDRQEKKQQKIHAHHIIQSFSPEDKLSPEEINRIGYETIRELIGGQYKFIV   120
           SND LY+ R DRQE  Q+KIH+HHIIQSFSP+D L+PE+INRIGYE  KEL GG+++FIV
Sbjct:  61 SNDTLYEFRHDRQEVNQRRIHSHHIIQSFSPDDHLTPEQINRIGYEAARELTGGRFRFIV   120

Query: 121 ATHVDQDHCHNHIIINSINSQSQKKLLWDYALERNLQMISDRISKVAGAKIIPPKRYSHR   180
           ATHVD+ H HNHII+NSI+  S KK WDY E NL+M+SDR+SK+AGAKII   RYSHR
Sbjct: 121 ATHVDKGHIHNHIILNSIDQNSDKKFLWDYKAEHNLRMVSDRLSKIAGAKII-ENRYSHR   179

Query: 181 DYEVYRRSNHKYELKQRLFFLMEHSIDFNDFMQKAEQLNVKIDFSRKHSRFFMTDRNMKQ   240
              YEVYR++N+KYE+KQR++FL+E+S +F D  +KA+ L++KIDF  KH  +FMTD NMRQ
Sbjct: 180 QYEVYRKTNYKYEIKQRVYFLIENSKNFEDLKKKAKALHLKIDFRHKHVTYFMTDSNMRQ   239

Query: 241 VIQGDKLNKREPYSKEYFQRYFAKKKIELILEFLLLRSNSFDDLVEKARLLGLELRSKKK   300
           V++  KL++++PY++ YF++ F +++I   ILEFLL +  + ++L+++A + GL++  K+K
Sbjct: 240 VVRDSKLSRKQPYNETYFEKKFVQREIINILEFLLPKMKNMNELIQRAEVFGLKIIPKEK   299
```

```
                          -continued
Query:  301 TIDFVLSDGKSCISIPNKSLRKKNLYDTTYFDSYFKEHDVFEVLHNNEVKIEFEKFETQQ  360
            +F    DG   I +  + L K NLY +YF    YF   +    VL N  +   + + +  +
Sbjct:  300 HVLFEF-DG---IKLAEQELVRSNLYSVSYFQDYFNNKNETFVLDNKNLVELYNEEKIIK  355

Query:  361 LSEILTVEEITEAYETYKTKRDAVHEFEVEITEEQIEKIVLDGLFVKVWMGIGQEGL      417
              E+ +  E + ++Y+ +K  RDAVHEFEVE+    QIE++V  G+++KV  GI ++ L
Sbjct:  356 EKELPSEEMVWKSYQDFKRNRDAVHEFEVELNLNQIEEVVEHGIYIRVQFGIDKKDL      412
```

A related DNA sequence was identified in *S. pyogenes* <SEQ ID 6117> which encodes the amino acid sequence <SEQ ID 6118>. Analysis of this protein sequence reveals the following:

```
Possible site: 20
>>> Seems to have no N-terminal signal sequence

----- Final Results -----
          bacterial cytoplasm --- Certainty = 0.3114(Affirmative) < succ>
          bacterial membrane  --- Certainty = 0.0000(Not Clear)   < succ>
           bacterial outside  --- Certainty = 0.0000(Not Clear)   < succ>
```

An alignment of the GAS and GBS proteins is shown below.

```
Identities = 103/218 (47%), Positives = 170/218 (77%)

Query:  393 EEQIEKIVLDGLFVKVWMGIGQEGLIFIPNHQLNILEQENKKQYQVFIRETSSYFIYHKE  452
            E QIE+++ +  +++KV    + Q GLIFIPN+QL+I ++EN K+Y+V+IRET+ +FIY+KE
Sbjct:    2 EHQIERLIAEDIYIKVSFSVKQSGLIFIPNYQLDIRKEENHKKYKVYIRETAQFFIYNKE   61

Query:  453 DSEMNRFMKGRDLIRQLTFDNKSLPYKRRISLVSLQQKIEEINLLMTLNIQNKSFLELKD  512
            SE+NR+M+G +LI QLT D+KS+P +RR ++ +L++KIEEI+LL+ L+ +NK + ++KD
Sbjct:   62 ASELNRYMRGHELICQLTNDSKSIPKRRRQTIDTLKKKIEEISLLIELDTENKPYQDIKD  121

Query:  513 ELVGDIAQLDIELTNLQDKNTTLNKMAEVVVNLQSDNQDTKQLAKYECSKMNLSQNVTIG  572
            ++V D+AQLD+ +T LQD    LNK+AEV++NL +++ + ++LA+Y+ +KMNL+   + I
Sbjct:  122 DIVKDMAQLDLTITELQDHIAHLNKVAEVLLNLNNNDIENRRLARYDYAKMNLTAAIKIE  181

Query:  573 QIESEIEMIQNQLDNKIEEYENAVRKLDEYVRVLNMDK                        610
            ++E EIE  QN+L+   I+EYE  VR+L+++   +L+  K
Sbjct:  182 EVEKEIETSQNELNISIDEYEYLVRRLEKFGEILSDSK                        219
```

Based on this analysis, it was predicted that these proteins and their epitopes could be useful antigens for vaccines or diagnostics.

EXAMPLE 1977

A DNA sequence (GBSx2086) was identified in *S. agalactiae* <SEQ ID 6119> which encodes the amino acid sequence <SEQ ID 6120>. Analysis of this protein sequence reveals the following:

```
Possible site: 40
>>> Seems to have no N-terminal signal sequence

----- Final Results -----
          bacterial cytoplasm --- Certainty = 0.4006(Affirmative) < succ>
          bacterial membrane  --- Certainty = 0.0000(Not Clear)   < succ>
           bacterial outside  --- Certainty = 0.0000(Not Clear)   < succ>
```

The protein has homology with the following sequences in the GENPEPT database.

```
>GP: AAC98436 GB: L29324 unknown [Streptococcus pneumoniae]
Identities = 53/115 (46%), Positives = 77/115 (66%),
Gaps = 2/115 (1%)

Query:    5 VREIRKEVNFSIEEYQQIQNFMEQEGYEQFSPFARGKLLKIDHQPSQQLEEWIKYLQHQK   64
            +R IRK+  +  E +QI + M ++G + FS F R   LL    D Q  +Q+E+W    + QK
Sbjct:    5 IRSIRKQFRLTETEEKQILDLMREKGDDNFSDFLRKSLLLSDGQ--KQMEKWFNLWKKQK   62
```

```
Query:  65 VEQIYRDVHEILVLAKLSQSVTMEHLEIILTCIKDLMKEIEVTIPLSYSFKDKYM      119
           +EQI RDVHE+ ++AK +  VT EH+ I+LTCI++L+KE+E T PLS  F +KYM
Sbjct:  63 LEQISRDVHEVFIIAKTNHQVTHEHVSILLTCIQELIKEVEKTGPLSEDFCNKYM      117
```

No corresponding DNA sequence was identified in *S. pyogenes*.

Based on this analysis, it was predicted that this protein and its epitopes, could be useful antigens for vaccines or diagnostics.

EXAMPLE 1978

A DNA sequence (GBSx2087) was identified in *S. agalactiae* <SEQ ID 6121> which encodes the amino acid sequence <SEQ ID 6122>. This protein is predicted to be TnpA. Analysis of this protein sequence reveals the following:

```
Possible site: 34
>>> Seems to have no N-terminal signal sequence

----- Final Results -----
            bacterial cytoplasm --- Certainty = 0.2935(Affirmative) < succ>
            bacterial membrane  --- Certainty = 0.0000(Not Clear)   < succ>
             bacterial outside  --- Certainty = 0.0000(Not Clear)   < succ>
```

The protein has homology with the following sequences in the GENPEPT database.

```
>GP: AAC82523 GB: AF027768 TnpA [Serratia marcescens]
Identities = 176/413 (42%), Positives = 243/413 (58%),
Gaps = 18/413 (4%)

Query:  26 MMFKVEAVGPPERCPECGFD-KLYKHSSRNQLIMDLPIRLKRVGLHLNRRRYKCRECGST   84
            M F+V+ V P  C ECG  +     R+    DLPI KRV L + RRRY CR C +T
Sbjct:   1 MHFQVD-VPDPIACEECGVQGEFVRFGKRDVPYRDLPIHGKRVTLWVVRRRYTCRACRTT   59

Query:  85 IS------VDEKRSMTKRLLKSIQEQSMSKTFVEVAESVGVDEKTIRNVFKDYVALKERE  138
           + VD  R MT RL + ++++S +  + VA    G+DEKT+R++F         R
Sbjct:  60 FRPQLPEMVDGFR-MTLRLHEYVEKESFNHPYTFVAAQTGLDEKTVRDIFNARAEFLGRW  118

Query: 139 YQFETPKWLGIDEIHIIRRPRLVLTNIERRTIYDIKPNRNKETVIQRLSEISDRTYIEYV  198
           ++FETP+ LGIDE+++  +R R +LTNIE RT+ D+   R ++ V   L ++ DR +E V
Sbjct: 119 HRFETPRILGIDELYLNKRYRCILTNIEERTLLDLLATRRQDVVTNYLMKLKDRQKVEIV  178

Query: 199 TMDMWKPYKDAVNTILPQAKVVVDKFHVVRMANQALDNVRKSLKAHMSQKERRTLMRERF  258
           +MDMW  PY+  AV   +LPQA++VVDKFHVVRMAN AL+ VRK L+ +   + RTL  +R
Sbjct: 179 SMDMWNPYRAAVKAVLPQARIVVDKFHVVRMANDALERVRKGLRKELKPSQSRTLKGDRK  238

Query: 259 ILLKRKHDLNERESFLLDTWLGNLPALKEAYELKEEFYWIWDTPDPDEGHLRYSQWRHRC  318
           ILLKR H++++RE  +++TW G  P L  AYE KE FY IWD    +    +W
Sbjct: 239 ILLKRAHEVSDRERLIMETWTGAFPQLLAAYEHKERFYGIWDATTRLQAEAALDEW-IAT  297

Query: 319 MSSNSKDAYKDLVRAVDNWHVEIFNYF--DKRLTNAYTESINSIIRQVERMGRGYSFDAL  376
            +    K+ + DLVRAV NW E   YF D +TNAYTESIN + +   R GRGYSF+ +
Sbjct: 298 IPKGQKEVWSDLVRAVGNWREETMTYFETDMPVTNAYTESINRLAKDKNREGRGYSFEVM  357

Query: 377 RAKILFNEKLHKKRKPRFNSSAFNKAMLYDTFNWYEVNDHDITDNLGVDFSTL        429
           RA++L+  K HKK+ P    S F K +    Y + D    N GVD ST+
Sbjct: 358 RARMLYTTK-HKKKAPTAKVSPFYKKTI-----GYGLPDFAEELNYGVDLSTI        404
```

No corresponding DNA sequence was identified in *S. pyogenes*.

Based on this analysis, it was predicted that this protein and its epitopes, could be useful antigens for vaccines or diagnostics.

EXAMPLE 1979

A DNA sequence (GBSx2088) was identified in *S. agalactiae* <SEQ ID 6123> which encodes the amino acid sequence <SEQ ID 6124>. This protein is predicted to be mercuric reductase. Analysis of this protein sequence reveals the following:

>>> Seems to have no N-terminal signal sequence

----- Final Results -----
                bacterial cytoplasm --- Certainty = 0.2115(Affirmative) < succ>
                  bacterial membrane --- Certainty = 0.0000(Not Clear)   < succ>
                   bacterial outside --- Certainty = 0.0000(Not Clear)   < succ>

The protein has homology with the following sequences in the GENPEPT database.

```
>GP: CAA70224 GB: Y09024 mercuric reductase [Bacillus cereus]
Identities = 412/546 (75%), Positives = 484/546 (88%)

Query:    1 MNKFKVNISGMTCTGCEKHVESALEKIGAKNIESSYRRGEAVFELPDDIEVESAIKAIDE   60
            M K++V++ GMTCTGCE+HV  ALE +GA  IE  +RRGEAVFELP+ +  VE+A KAI +
Sbjct:    1 MKKYRVDVQGMTCTGCEEHVAVALENMGATGIEVDFRRGEAVFELPNALGVETAKKAISD   60

Query:   61 ANYQAGEIEEVSSLENVALINEDNYDLLIIGSGAAAFSSAIKAIEYGAKVGMIERGTVGG  120
            A YQ G+ EEV S E V L NE +YD +IIGSG AAFSSAI+A++YGAKV MIERGT+GG
Sbjct:   61 AKYQPGKAEEVQSQEMVQLGNEGDYDYIIIGSGGAAFSSAIEAVKYGAKVAMIERGTIGG  120

Query:  121 TCVNIGCVPSKTLLRAGEINHLSKDNPFIGLQTSAGEVDLASLITQKDKLVSELRNQKYM  180
            TCVNIGCVPSKTLL AGEINHL+K+NPF+GL TSAGEVDLA LI QK++LV+ELRN KY+
Sbjct:  121 TCVNIGCVPSKTLLRAGEINHLAKNNPFVGLHTSAGEVDLAPLIKQKNELVTELRNSKYV  180

Query:  181 DLIDEYNFDLIKGEAKFVDASTVEVNGTKLSAKRFLIATGASPSLPQISGLEKMDYLTST  240
            DLID+Y F+LI+GEAKFVD  TVEVNG  +SAKRFLIATGASP+ P I GL ++DYLTST
Sbjct:  181 DLIDDYGFELIEGEAKFVDEKTVEVNGAPISAKRFLIATGASPAKPNIPGLNEVDYLTST  240

Query:  241 TLLELKKIPKRLTVIGSGYIGMELGQLFHHLGSEITLMQRSERLLKEYDPEISESVEKAL  300
            +LLELKK+PKRL VIGSGYIGMELGQLFH+LGSE+TL+QRSERLLKEYDPEISESVEK+L
Sbjct:  241 SLLELKKVPKRLVVIGSGYIGMELGQLFHNLGSEVTLIQRSERLLKEYDPEISESVEKSL  300

Query:  301 IEQGINLVKGATFERVEQSGEIKRVYVTVNGSREVIESDQLLVATGRKPNTDSLNLSAAG  360
            +EQGINLVKGAT+ER EQ+G+IK+V+V VNG + +IE+DQLLVATGR PNT +LNL AAG
Sbjct:  301 VEQGINLVKGATYERIEQNGDIKKVHVEVNGKKRIIEADQLLVATGRTPNTATLNLRAAG  360

Query:  361 VETGKNNEILINDFGQTSNEKIYAAGDVTLGPQFVYVAAYEGGIITDNAIGGLNKIKDLS  420
            VE G    EI+I+D+ +T+N +IYAAGDVTLGPQFVYVAAY+GG+    NAIGGLNKK++L
Sbjct:  361 VEIGSRGEIIIDDYSRTTNTRIYAAGDVTLGPQFVYVAAYQGGVAAPNAIGGLNKKLNLE  420

Query:  421 VVPAVTFTNPTVATVGLTEEQAKEKGYDVKTSVLPLDAVPRAIVNRETTGVFKLVADAET  480
            VVP VTFT P +ATVGLTE+QAKE GY+VKTSVLPLDAVPRA+VNRETTGVFKLVAD++T
Sbjct:  421 VVPGVTFTAPAIATVGLTEQQAKENGYEVKTSVLPLDAVPRALVNRETTGVFKLVADSKT  480

Query:  481 LKVLGVHIVSENAGDVIYAASLAVKFGLTIEDLTETLAPYLTMAEGLKLVALTFDKDISK  540
            +KVLG H+V+ENAGDVIYAA+LAVKFGLT++D+ ETLAPYLTMAEGLKL ALTFDKDISK
Sbjct:  481 MKVLGAHVVAENAGDVIYAATLAVKFGLTVDDIRETLAPYLTMAEGLKLAALTFDKDISK  540

Query:  541 LSCCAG                                                       546
            LSCCAG
Sbjct:  541 LSCCAG                                                       546
```

There is also homology to SEQ ID 1820.

Based on this analysis, it was predicted that this protein and its epitopes, could be useful antigens for vaccines or diagnostics.

EXAMPLE 1980

A DNA sequence (GBSx2089) was identified in *S. agalactiae* <SEQ ID 6125> which encodes the amino acid sequence <SEQ ID 6126>. This protein is predicted to be regulatory protein. Analysis of this protein sequence reveals the following:

```
Possible site: 36
>>> Seems to have no N-terminal signal sequence

----- Final Results -----
                bacterial cytoplasm --- Certainty = 0.4529(Affirmative) < succ>
                  bacterial membrane --- Certainty = 0.0000(Not Clear)   < succ>
                   bacterial outside --- Certainty = 0.0000(Not Clear)   < succ>
```

The protein has homology with the following sequences in the GENPEPT database.

```
>GP: AAA83973 GB: AF138877 mercury resistance operon negative
regulator MerR1 [Bacillus sp. RC607]
Identities = 83/129 (64%), Positives = 104/129 (80%)

Query:    1 MIYRISEFADKCGVNKETIRYYERKNLLQEPHRTEAGYRIYSYDDVKRVGFIKRIQEFGF   60
            M +RI E ADKCGVNKETIRYYER  L+ EP RTE GYR+YS    V R+ FIKR+QE GF
Sbjct:    1 MKFRIGELADKCGVNKETIRYYERLGLIPEPERTEKGYRMYSQQTVDRLHFIKRMQELGF   60

Query:   61 SLSEIYKLLGVVDKDEVRCQDMFEFVSKKQKEVQKQIEDLKRIETMLDDLKQRCPDEKKL  120
            +L+EI KLLGVVD+DE +C+DM++F    K +++Q++IEDLKRIE ML DLK+RCP+ K +
Sbjct:   61 TLNEIDKLLGVVDRDEAKCRDMYDFTILKIEDIQRKIEDLKRIERMLMDLKERCPENKDI  120

Query:  121 HSCPIIETL                                                    129
            + CPIIETL
Sbjct:  121 YECPIIETL                                                    129
```

There is also homology to SEQ ID 1712.

Based on this analysis, it was predicted that this protein and its epitopes, could be useful antigens for vaccines or diagnostics.

EXAMPLE 1981

A DNA sequence (GBSx2090) was identified in *S. agalactiae* <SEQ ID 6127> which encodes the amino acid sequence <SEQ ID 6128>. Analysis of this protein sequence reveals the following:

```
Possible site: 44
>>> Seems to have no N-terminal signal sequence
     INTEGRAL    Likelihood = -7.86    Transmembrane    80-96 (78-100)

----- Final Results -----
              bacterial membrane --- Certainty = 0.4142(Affirmative) < succ>
              bacterial outside  --- Certainty = 0.0000(Not Clear)   < succ>
              bacterial cytoplasm --- Certainty = 0.0000(Not Clear)  < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

A related GBS gene <SEQ ID 8943> and protein <SEQ ID 8944> were also identified. Analysis of this protein sequence reveals the following:

```
Lipop: Possible site: -1 Crend: 8
McG: Discrim Score: -13.52
GvH: Signal Score (-7.5): -6.14
     Possible site: 44
>>> Seems to have no N-terminal signal sequence
ALOM program count: 1 value: -7.86 threshold: 0.0
     INTEGRAL      Likelihood = -7.86    Transmembrane    80-96 (78-100)
     PERIPHERAL    Likelihood =  1.80 136
modified ALOM score: 2.07

*** Reasoning Step: 3

----- Final Results -----
              bacterial membrane --- Certainty = 0.4142(Affirmative) < succ>
              bacterial outside  --- Certainty = 0.0000(Not Clear)   < succ>
              bacterial cytoplasm --- Certainty = 0.0000(Not Clear)  < succ>
```

The protein has homology with the following sequences in the databases:

```
ORF02021(439-666 of 1080)
GP|451734|gb|AAA18975.1||U05143(9-46 of 46) envelope glycoprotein {Simian
immunodeficiency virus} GP|451744|gb|AAA18980.1||U05148 envelope glycoprotein {Simian
immunodeficiency virus}
% Match = 3.2
% Identity = 38.5 % Similarity = 64.1
Matches = 15 Mismatches = 13 Conservative Sub.s = 10

336       366       396       426       456       486       516       546
RIPVQFKGCDDYYNENVGYPLSRINLEHYLTEGGVLYFVVYSKDVSPTVTYASLTPKVIKNVLPASDKKKRIKKKEDIFL
                                :||  |   : ||:|::||:   |:
                                WGLTGNAGTTPTATTTTTPRVVENVINESN------------
                                                10        20        30

576       606       636       666       696       726       756       786
LFWMAIIAKLLILPYPALQTSYKSRPCLRRSSLRKLTQIPFSIVTKVGNTNMKSITAFLQVKAYILPCLAKGPARIMV*W
                                ||::  :|    |  |  |
------------------------PCIKDNSCAGLEQEP
                               40
```

SEQ ID 8944 (GBS415) was expressed in *E. coli* as a His-fusion product. SDS-PAGE analysis of total cell extract is shown in FIG. 79 (lane 3; MW 21.2 kDa).

EXAMPLE 1982

A DNA sequence (GBSx2092) was identified in *S. agalactiae* <SEQ ID 6129> which encodes the amino acid sequence <SEQ ID 6130>. Analysis of this protein sequence reveals the following:

```
Possible site: 14
>>> Seems to have no N-terminal signal sequence

----- Final Results -----
       bacterial cytoplasm --- Certainty = 0.3402(Affirmative) < succ>
       bacterial membrane  --- Certainty = 0.0000(Not Clear)  < succ>
        bacterial outside  --- Certainty = 0.0000(Not Clear)  < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1983

A DNA sequence (GBSx2093) was identified in *S. agalactiae* <SEQ ID 6131> which encodes the amino acid sequence <SEQ ID 6132>. This protein is predicted to be ATPase. Analysis of this protein sequence reveals the following:

```
Possible site: 27
>>> Seems to have no N-terminal signal sequence
        INTEGRAL     Likelihood = -10.08     Transmembrane    324-340 (317-343)
        INTEGRAL     Likelihood =  -5.73     Transmembrane    662-678 (660-690)
        INTEGRAL     Likelihood =  -5.41     Transmembrane    350-366 (346-378)
        INTEGRAL     Likelihood =  -3.40     Transmembrane     94-110  (93-110)
        INTEGRAL     Likelihood =  -2.87     Transmembrane    681-697 (680-699)
        INTEGRAL     Likelihood =  -1.38     Transmembrane    148-164 (148-164)

----- Final Results -----
         bacterial membrane  --- Certainty = 0.5034(Affirmative) < succ>
          bacterial outside  --- Certainty = 0.0000(Not Clear)  < succ>
        bacterial cytoplasm  --- Certainty = 0.0000(Not Clear)  < succ>
```

The protein has homology with the following sequences in the GENPEPT database.

```
>GP: AAA22858 GB: M90750 cadmium-efflux ATPase [Bacillus firmus]
   Identities = 486/725 (67%), Positives = 584/725 (80%), Gaps = 18/725 (2%)

Query:  1 MSRGKAKQSEKEMKAYRVQGFTCTNCAAIFENNVKELPGVQDAKVNFGASKVYVKGTTTI   60
             MS  KA  SE+EMKAYRVQGFTC NCA  FE NVK+L GV+DAKVNFGASK+ V G  TI
   Sbjct:  1 MSDQKAITSEQEMKAYRVQGFTCANCAGKFEKNVKQLSGVEDAKVNFGASKIAVYGNATI   60
```

-continued

```
Query:  61 EELEKAGAFENLKIRDEKEQRVGGE----------PFWKQKENIKVYISALLLVVSWFL 109
           EELEKAGAFENLK+  EK R  +            PF+K K +  +Y S LL+    +
Sbjct:  61 EELEKAGAFSNLKVTPEKSARQASQEVKEDTKEDKVPFYK-KHSTLLYAS-LLITFGYLS 118

Query: 110 GEQYGEEHVLPTIGYAASILIGGYSLFIKGLKNLRRLNFDMNTLMTIAIIGAAIIGEWGE 169
              GEE+++ T+ + AS+ IGG SLF  GL+NL R  FDM TLMT+A+IG AIIGEW E
Sbjct: 119 SYVNGEENIVTTLLFLASMFIGGLSLFKVGLQNLLRFEFDMKTLMTVAVIGGAIIGEWAE 178

Query: 170 GATVVILFAISEALERYSMDKARQSIESLMDIAPKEALIRRGNEEMMIHVDEIQVGDIMI 229
              A VVILFAISEALER+SMD+ARQSI SLMDIAPKEAL++R +E+MIHVD+I VGDIMI
Sbjct: 179 VAIVVILFAISEALERFSMDRARQSIRSLMDIAPKEALVKRNGQEIMIHVDDIAVGDIMI 238

Query: 230 VKPGQKLAMDGIVVKGTSTLNQAAITGESVPVTKITNDEVFAGTLNEEGLLEVKVTKRVE 289
              VKPGQK+AMDG+VV G S +NQ AITGESVPV K  ++EVFAGTLNEEGLLEV++TK VE
Sbjct: 239 VKPGQKIAMDGVVVSGYSAVNQTAITGESVPVEKTVDNEVFAGTLNEEGLLEVEITKLVE 298

Query: 290 DTTLSKIIHLVEEAQAERAPSQAFVDKFAKYYTPAIVILALLIAVVPPL-FGGDWSQWIY 348
              DTT+SKIIHLVEEAQ ERAPSQAFVDKFAKYYTP I+I+A L+A+VPPL F G W   WIY
Sbjct: 299 DTTISKIIHLVEEAQGERAPSQAFVDKFAKYYTPIIMIIATLVAIVPPLFFDGSWETWIY 358

Query: 349 QGLAVLVVGCPCALVVSTPVAVVTAIGNAAKNGVLIKGGIHLEAAGHLKAIAFDKTGTLT 408
              QGLAVLVVGCPCALV+STP+++V+AIGNAAK GVL+KGG++LE  G LKAIAFDKTGTLT
Sbjct: 359 QGLAVLVVGCPCALVISTPISIVSAIGNAAKKGVLVKGGVYLEEMGALKAIAFDKTGTLT 418

Query: 409 KGIPAVTD--IVTYGRNENELITITSAIEKGSQHPLASAIMRKAEENGLKFNEVTVEDFQ 466
              KG+PAVTD  ++    NE EL++I +A+E  SQHPLASAIM+KAEE  +  +++V VEDF
Sbjct: 419 KGVPAVTDYNVLNKQINEKELLSIITALEYRSQHPLASAIMKKAEEENITYSDVQVEDFS 478

Query: 467 SITGKGVKAKINNEMYYVGSQNLFEE-LHGSISSDKKEKIADMQTGKTVMVLGTEKEIL 525
              SITGKG+K  +N   YY+GS  LF+E L          D ++ +  +Q  GKT M++GTEKEIL
Sbjct: 479 SITGKGIKGIVNGTTYYIGSPKLFKELLTNDFDKDLEQNVTTLQNQGRTAMIIGTEKEIL 538

Query: 526 SFIAVADEMRESSKEVIGKLNNMGI-ETVMLTGDNQRTATAIGKQVGVSDIKADLLPEDK 584
              + IAVADE+RESSKE++ KL+ +GI +T+MLTGDN+ TA AIG QVGVSDI+A+L+P+DK
Sbjct: 539 AVIAVADEVRESSKEILQKLHQLGIKKTIMLTGDNKGTANAIGGQVGVSDIEAELMPQDK 598

Query: 585 LNFIKELREKHQSVGMVGDGVNDAPALAASTVGVAMGGAGTDTALETADIALMSDDLSKL 644
              L+FIK+LR ++ +V MVGDGVNDAPALAASTVG+AMGGAGTDTALETAD+ALM DDL KL
Sbjct: 599 LDFIKQLRSEYGNVAMVGDGVNDAPALAASTVGIAMGGAGTDTALETADVALMGDDLRKL 658

Query: 645 PYTIKLSRKALAIIKQNITFSLAIKLVALLLVMPGWLTLWIAIFADMGATLLVTLNSLRL 704
              P T+KLSRK L IIK NITF++AIK +A LLV+PGWLTLWIAI +DMGATLLV LN LRL
Sbjct: 659 PSTVKLSRKTLNIIKANITFAIAIKFIASLLVIPGWLTLWIAILSDMGATLLVALNGLRL 718

Query: 705 LKIKE 709
           +++KE
Sbjct: 719 MRVKE 723
```

There is also homology to SEQ ID 3506.

Based on this analysis, it was predicted that this protein and its epitopes, could be useful antigens for vaccines or diagnostics.

EXAMPLE 1984

A DNA sequence (GBSx2094) was identified in *S. agalactiae* <SEQ ID 6133> which encodes the amino acid sequence <SEQ ID 6134>. Analysis of this protein sequence reveals the following:

```
Possible site: 19
>>> Seems to have no N-terminal signal sequence

----- Final Results -----
            bacterial cytoplasm --- Certainty = 0.0779(Affirmative) < succ>
            bacterial membrane  --- Certainty = 0.0000(Not Clear)  < succ>
            bacterial outside   --- Certainty = 0.0000(Not Clear)  < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1985

A DNA sequence (GBSx2095) was identified in *S. agalactiae* <SEQ ID 6135> which encodes the amino acid sequence <SEQ ID 6136>. Analysis of this protein sequence reveals the following:

```
Possible site: 58
>>> Seems to have no N-terminal signal sequence
      INTEGRAL        Likelihood = -8.92      Transmembrane     123-139 (115-145)
      INTEGRAL        Likelihood = -6.74      Transmembrane     172-188 (167-190)
      INTEGRAL        Likelihood = -1.81      Transmembrane      80-96 (80-96)

----- Final Results -----
                   bacterial membrane --- Certainty = 0.4567(Affirmative) < succ>
                    bacterial outside --- Certainty = 0.0000(Not Clear)   < succ>
                  bacterial cytoplasm --- Certainty = 0.0000(Not Clear)   < succ>
```

A related GBS nucleic acid sequence <SEQ ID 9923> which encodes amino acid sequence <SEQ ID 9924> was also identified.

The protein has no significant homology with any sequences in the GENPEPT database, but there is homology to SEQ ID 4216.

A related GBS gene <SEQ ID 8945> and protein <SEQ ID 8946> were also identified. Analysis of this protein sequence reveals the following:

```
Lipop: Possible site: -1 Crend: 10
McG: Discrim Score: -6.41
GvH: Signal Score (-7.5): -2.23
     Possible site: 58
>>> Seems to have no N-terminal signal sequence
ALOM program count: 3 value: -8.92 threshold: 0.0
      INTEGRAL        Likelihood = -8.92      Transmembrane     123-139 (115-145)
      INTEGRAL        Likelihood = -6.74      Transmembrane     172-188 (167-190)
      INTEGRAL        Likelihood = -1.81      Transmembrane      80-96 (80-96)
      PERIPHERAL      Likelihood = -2.92  46
modified ALOM score: 2.28

*** Reasoning Step: 3

----- Final Results -----
             bacterial membrane --- Certainty = 0.4567(Affirmative) < succ>
              bacterial outside --- Certainty = 0.0000(Not Clear)   < succ>
            bacterial cytoplasm --- Certainty = 0.0000(Not Clear)   < succ>
```

Based on this analysis, it was predicted that these proteins and their epitopes could be useful antigens for vaccines or diagnostics.

EXAMPLE 1986

A DNA sequence (GBSx2096) was identified in *S. agalactiae* <SEQ ID 6137> which encodes the amino acid sequence <SEQ ID 6138>. This protein is predicted to be histidine rich P type ATPase (HRA-1) (copB). Analysis of this protein sequence reveals the following:

```
Possible site: 54
>>> Seems to have no N-terminal signal sequence
      INTEGRAL        Likelihood = -13.37     Transmembrane     318-334 (307-345)
      INTEGRAL        Likelihood = -5.84      Transmembrane     347-363 (335-364)
      INTEGRAL        Likelihood = -5.15      Transmembrane      88-104 (86-112)
      INTEGRAL        Likelihood = -5.04      Transmembrane     651-667 (649-669)
      INTEGRAL        Likelihood = -4.30      Transmembrane     156-172 (155-173)
      INTEGRAL        Likelihood = -4.30      Transmembrane     669-685 (668-690)
      INTEGRAL        Likelihood = -3.03      Transmembrane      62-78 (60-80)
```

```
----- Final Results -----
           bacterial membrane --- Certainty = 0.6349(Affirmative) < succ>
           bacterial outside  --- Certainty = 0.0000(Not Clear)   < succ>
          bacterial cytoplasm --- Certainty = 0.0000(Not Clear)   < succ>
```

The protein has homology with the following sequences in the GENPEPT database.

```
>GP: AAA62113 GB: U16658 histidine rich P type ATPase [Escherichia
coli]
Identities = 598/731 (81%), Positives = 651/731 (88%), Gaps = 36/731 (4%)

Query:     1 MRNNKKHSSHSHHNHGDIDHSKHDHNEMEHSQMDHS-----------------------  36
             MRNNK+HSSHSHHNHGD++HSKHDHNEMEHSQMDHS
Sbjct:     1 MRNNKQHSSHSHHNHGDMEHSKHDHNEMEHSQMDHSAMGHCAMGGHAHHHHGDMDHSKHD 60

Query:    37 ------------NMDHSEMDHGAMGGHAHHHHGSFKEIFLKSLPLGIAILLITPMMDIQL 84
                         MD+SEMDHGAMGGHAHHHHGSFK+IFLKSLPLGIAILLITP+M IQL
Sbjct:    61 HNEMKHSQMDHSKMDYSEMDHGAMGGHAHHHHGSFKDIFLKSLPLGIAILLITPLMGIQL 120

Query:    85 PFQIIFPYADVVAAVLATILYIFGGKPFYMGAKDEFNSKAPGMMSLITLGITVSYAYSVY 144
             PFQIIFPYADVVAAVLATILYIFGGKPF MGAKDEFNSK PGMMSLITLGITVSYAYSVY
Sbjct:   121 PFQIIFPYADVVAAVLATILYIFGGKPFLMGAKDEFNSKVPGMMSLITLGITVSYAYSVY 180

Query:   145 AVAARYVTGEHVMDFFFEFTTLILIMLLGHWIEMKALGEAGDAQKALAELVPKDAHVVLE 204
             AVAARYVTGE VMDFFFEFTTLILIMLLGHWIEMKALGEAG+AQKALAELVPKDAHVVLE
Sbjct:   181 AVAARYVTGEPVMDFFFEFTTLILIMLLGHWIEMKALGEAGNAQKALAELVPKDAHVVLE 240

Query:   205 DDSIETRPVSELQIGDVIRVQAGENVPADGIIIRGESRVNEALVTGESKPIEKKTGDEVI 264
             DDSIETRPV++LQ+GD+IRVQAGENVPADG I RGESRVNEALVTGESKPIEK  GDEVI
Sbjct:   241 DDSIETRPVADLQVGDLIRVQAGENVPADGTIQRGESRVNEALVTGESKPIEKNPGDEVI 300

Query:   265 GGSTNGGGVLYVEIKQTGDQSFISQVQTLISQAQSQPSRAENVAQKVASWLFYIAVVVAL 324
             GGSTNG GVLYVEIKQTGD+SFISQVQTLISQAQSQPSRAEN+AQKVA WLFYIAV+ AL
Sbjct:   301 GGSTNGDGVLYVEIKQTGOKSFISQVQTLISQAQSQPSRAENLAQKVAGWLFYIAVIAAL 360

Query:   325 IALLIWTIIADLPTAVIFTVTALVIACPHALGLAIPLVVSRSTSLGASRGLLVKNREALE 384
             IAL+IW +IAD+PTAVIFTVT LVIACPHALGLAIPLV +RSTSLGASRGLLVK+R+ALE
Sbjct:   361 IALVIWMVIADVPTAVIFTVTTLVIACPHALGLAIPLVTARSTSLGASRGLLVKDRDALE 420

Query:   385 LTTKADVMVLDKTGTLTTGEFKVLDVTVLSDKYSEEEITGLLAGIEAGSSHPIAQSIVNH 444
             LTT ADVMVLDKTGTLTTGEFKVLDV + +DKY+++EI  LL+GIE GSSHPIAQSI+++
Sbjct:   421 LTTNADVMVLDKTGTLTTGEFKVLDVELFNDKYTKDEIVALLSGIEGGSSHPIAQSIISY 480

Query:   445 AEAKGIKSVSFDSIEIVSGAGIEGEANGHHYQLISQKAYGKALRMDIPKGATLSILVENN 504
             AE +GI+ VSFDSI+++SGAG+EG+ANGH YQLISQKAYG+ L MDIPKGAT+S+LVEN+
Sbjct:   481 AEQQGIRPVSFDSIDVMSGAGVEGQANGHRYQLISQKAYGRNLDMDIPKGATISVLVEND 540

Query:   505 EAIGAVALGDELKETSRNLIEVLKKYGIEPLMATGDNEEAAQGVAEVLGIQYQANQSPED 564
             EAIGAVALGDELK TS++LI+ LKK  I+P+MATGDNE+AAQG AE+LGI Y ANQSP+D
Sbjct:   541 EAIGAVALGDELKPTSKDLIQALKKNKIQPIMATGDNEKAAQGAAEILGIDYLANQSPQD 600

Query:   565 KYKLVESMRNQNKTVIMVGDGVNDAPSLALADVGIAIGAGTQVALDSADIILTQSDPGDI 624
             KY+LVE +K + K VIMVGDGVNDAPSLALADVGIAIGAGTQVALDSADIILTQ  PGDI
Sbjct:   601 KYELVEKLKAEGKKVIMVGDGVNDAPSLALADVGIAIGAGTQVALDSADIILTQYSPGDI 660

Query:   625 ESFIELANKTTRKMKQNLVWGAGYNFIAIPIAAGLLAPIGITLGPAFGAVLMSLSTVIVA 684
               SFIELA KTTRKMK+NLVWGAGYNFIAIPIAAG+LAPIGITL PA  AVLMSLSTVIVA
Sbjct:   661 ASFIELAQKTTRKMKENLVWGAGYNFIAIPIAAGILAPIGITLSPAVAAVLMSLSTVIVA 720

Query:   685 INAMTLKLEPK                                                  695
             INAMTLKLEPK
Sbjct:   721 INAMTLKLEPK                                                  731
```

There is also homology to SEQ ID 3506.

A related GBS gene <SEQ ID 8947> and protein <SEQ ID 8948> were also identified. Analysis of this protein sequence reveals the following:

```
Lipop: Possible site: -1 Crend: 7
McG: Discrim Score: -19.12
GvH: Signal Score (-7.5): -3.71
     Possible site: 27
>>> Seems to have no N-terminal signal sequence
ALOM program count: 7 value: -13.37 threshold: 0.0
     INTEGRAL    Likelihood = 13.37 Transmembrane 291-307 (280-318)
     INTEGRAL    Likelihood = -5.84 Transmembrane 320-336 (308-337)
     INTEGRAL    Likelihood = -5.15 Transmembrane  61-77  (59-85)
     INTEGRAL    Likelihood = -5.04 Transmembrane 624-640 (622-642)
     INTEGRAL    Likelihood = -4.30 Transmembrane 129-145 (128-146)
     INTEGRAL    Likelihood = -4.30 Transmembrane 642-658 (641-663)
     INTEGRAL    Likelihood = -3.03 Transmembrane  35-51  (33-53)
     PERIPHERAL  Likelihood =  0.74 103
modified ALOM score: 3.17

*** Reasoning Step: 3

----- Final Results -----
             bacterial membrane --- Certainty = 0.6349(Affirmative) < succ>
              bacterial outside --- Certainty = 0.0000(Not Clear)   < succ>
            bacterial cytoplasm --- Certainty = 0.0000(Not Clear)   < succ>
```

The protein has homology with the following sequences in the databases:

```
ORF02015(220-2304 of 2604)
EGAD|37454|38974(1-731 of 731) histidine rich P type ATPase (HRA-1) {Escherichia
coli} GP|643613|gb|AAA62113.1||U16658 histidine rich P type ATPase {Escherichia coli}
PIR|JC2464|JC2464 probable copper-transporting  ATPase {EC 3.6.1.-} HRA-1 -
Enterobacteriaceae spp.
% Match = 67.4
% Identity = 85.9 % Similarity = 93.7.
Matches = 598 Mismatches = 43 Conservative Sub.s = 54

162       192       222       252
PFRENYM*C*MRKF*NFKISL*YNKEELKMRNNKKHSSHSHHNHGDI--------------------------------
       |||||:|||||||||||:
                     MRNNKQHSSHSHHNHGDMEHSKHDHNEMEHSQMDHSAMGHCAMGGHAHHHH
                                  10        20        30        40        50

294       324       354       384       414       444       474       504
---DHSKHDHNEMEHSQMDHSNMDHSEMDHGAMGGHAHHHHGSFKEIFLKSLPLGIAILLITPMMDIQLPFQIIFPYADV
   ||||||||||:|||||| ||:|||||||||||||||||||:|  ||||||||||||||||||:| ||||||||||
GDMDHSKHDHNEMKHSQMDHSKMDYSEMDHGAMGGHAHHHHGSFKDIFLKSLPLGIAILLITPLMGIQLPFQIIFPYADV
                70        80        90       100       110       120       130

534       564       594       624       654       684       714       744
VAAVLATILYIFGGKPFYMGAKDEFNSKAPGMMSLITLGITVSYAYSVYAVAARYVTGEHVMDFFFEFTTLILIMLLGHW
||||||||||||||||| ||||||||| |||||||||||||||||||||||||||||| |||||||||||||||||||
VAAVLATILYIFGGKPFLMGAKDEFNSKVPGMMSLITLGITVSYAYSVYAVAARYVTGEPVMDFFFEFTTLILIMLLGHW
               150       160       170       180       190       200       210

774       804       834       864       894       924       954       984
IEMKALGEAGDAQKALAELVPKDAHVVLEDDSIETRPVSELQIGDVIRVQAGENVPADGIIIRGESRVNEALVTGESKPI
||||||||||:|||||||||||||||||||||||||::||:|:|||||||||||||||| | ||||||||||||||||
IEMKALGEAGNAQKALAELVPKDAHVVLEDDSIETRPVADLQVGDLIRVQAGENVPADGTIQRGESRVNEALVTGESKPI
               230       240       250       260       270       280       290

1014      1044      1074      1104      1134      1164      1194      1224
EKKTGDEVIGGSTNGGGVLYVEIKQTGDQSFISQVQTLISQAQSQPSRAENVAQKVASWLFYIAVVVALIALLIWTIIAD
|| |||||||||||| |||||||||||:|||||||||||||||||||||||:|||| |||||| |||||:|| : :|||
EKNPGDEVIGGSTNGDGVLYVEIKQTGDKSFISQVQTLISQAQSQPSRAENLAQKVAGWLFYIAVIAALIALVIWMVIAD
               310       320       330       340       350       360       370
```

```
1254       1284       1314       1344       1374       1404       1434       1464
LPTAVIFTVTALVIACPHALGLAIPLVVSRSTSLGASRGLLVKNREALELTTKADVMVLDKTGTLTTGEFKVLDVTVLSD
:||||||||| |||||||||||||||| :||||||||||||:|:|||||| |||||||||||||||||||||| :::|
VPTAVIFTVTTLVIACPHALGLAIPLVTARSTSLGASRGLLVKDRDALELTTNADVMVLDKTGTLTTGEFKVLDVELFND
           390       400       410       420       430       440       450

1494       1524       1554       1584       1614       1644       1674       1704
KYSEEEITGLLAGIEAGSSHPIAQSIVNHAEAKGIKSVSFDSIEIVSGAGIEGEANGHHYQLISQKAYGKALRMDIPKGA
||:::||  ||:|||| |||||||||||:::|| :||: |||||||:::|||||:||:|||| ||||||||:  ||||||||
KYTKDEIVALLSGIEGGSSHPIAQSIISYAEQQGIRPVSFDSIDVMSGAVGEGQANGHRYQLISQKAYGRNLDMDIPKGA
           470       480       490       500       510       520       530

1734       1764       1794       1824       1854       1884       1914       1944
TLSILVENNEAIGAVALGDELKETSRNLIEVLKKYGIEPLMATGDNEEAAQGVAEVLGIQYQANQSPEDKYKLVESMKNQ
|:|:|||| :||||||||||| ||::||: ||   |:|:||||||:|||| ||:||| | ||||||:|||:||| :|  :
TISVLVENDEAIGAVALGDELKPTSKDLIQALKKNKIQPIMATGDNEKAAQGAAEILGIDYLANQSPQDKYELVEKLKAE
           550       560       570       580       590       600       610

1974       2004       2034       2064       2094       2124       2154       2184
NKTVIMVGDGVNDAPSLALADVGIAIGAGTQVALDSADIILTQSDPGDIESFIELANKTTRKMKQNLVWGAGYNFIAIPI
 | |||||||||||||||||||||||||||||||||||||||| |||| |||||| |||||||:|||||||||||||||
GKKVIMVGDGVNDAPSLALADVGIAIGAGTQVALDSADIILTQYSPGDIASFIELAQKTTRKMKENLVWGAGYNFIAIPI
           630       640       650       660       670       680       690

2214       2244       2274       2304       2334       2364       2394       2424
AAGLLAPIGITLGPAFGAVLMSLSTVIVAINAMTLKLEPK*NEAGTKKHWLV*PPSRIGSDQLVCCIRKIIDR*IFDKNR
|||:|||||||| || |||||||||||||||||||||||
AAGILAPIGITLSPAVAAVLMSLSTVIVAINAMTLKLEPK
           710       720       730
```

Based on this analysis, it was predicted that these proteins and their epitopes could be useful antigens for vaccines or diagnostics.

EXAMPLE 1987

A DNA sequence (GBSx2097) was identified in *S. agalactiae* <SEQ ID 6139> which encodes the amino acid sequence <SEQ ID 6140>. This protein is predicted to be CopA. Analysis of this protein sequence reveals the following:

```
Possible site: 59
>>> Seems to have no N-terminal signal sequence

----- Final Results -----
           bacterial cytoplasm --- Certainty = 0.2197(Affirmative) < succ>
           bacterial membrane --- Certainty = 0.0000(Not Clear)  < succ>
            bacterial outside --- Certainty = 0.0000(Not Clear)  < succ>
```

The protein has homology with the following sequences in the GENPEPT database.

```
>GP: CAA40599 GB: X57326 ORF-1 [Thiobacillus ferrooxidans]
Identities = 26/65 (40%), Positives = 40/65 (61%), Gaps = 2/65 (3%)

Query:   1 MKQEILL--DGVKCAGCANTVQERFSAIEGVESVEVDLATKKAVLESQTEIDTETLNAAL   58
           M Q+I L    G+ CA CA++V++    I G++S +V LAT +A + Q+ I TE L AA+
Sbjct:   1 MSQKIFLRITGMTCAHCAHSVEKALLGIHGIDSAQVSLATNQAEVFLQSSIPTEALLAAV   60

Query:  59 AETNY                                                         63
           + Y
Sbjct:  61 TQAGY                                                         65
```

There is also homology to SEQ ID 3510.

Based on this analysis, it was predicted that this protein and its epitopes, could be useful antigens for vaccines or diagnostics.

EXAMPLE 1988

A DNA sequence (GBSx2098) was identified in *S. agalactiae* <SEQ ID 6141> which encodes the amino acid sequence <SEQ ID 6142>. Analysis of this protein sequence reveals the following:

```
Possible site: 28
>>> Seems to have no N-terminal signal sequence

----- Final Results -----
            bacterial cytoplasm --- Certainty = 0.3220(Affirmative) < succ>
             bacterial membrane --- Certainty = 0.0000(Not Clear)   < succ>
              bacterial outside --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1989

A DNA sequence (GBSx2099) was identified in *S. agalactiae* <SEQ ID 6143> which encodes the amino acid sequence <SEQ ID 6144>. This protein is predicted to be heavy-metal transporting P-type ATPase (b0484). Analysis of this protein sequence reveals the following:

```
Possible site: 27
>>> Seems to have no N-terminal signal sequence
      INTEGRAL       Likelihood = -4.09 Transmembrane 131-147 (130-150)

----- Final Results -----
             bacterial membrane --- Certainty = 0.2635(Affirmative) < succ>
              bacterial outside --- Certainty = 0.0000(Not Clear)   < succ>
            bacterial cytoplasm --- Certainty = 0.0000(Not Clear)   < succ>
```

The protein has homology with the following sequences in the GENPEPT database.

```
>GP: AAB01764 GB: U42410 heavy-metal transporting P-type ATPase
[Proteus mirabilis]
Identities = 98/153 (64%), Positives = 123/153 (80%)

Query:   2 KAVKALRRRGVEVIMITGDNKRTAKAIAKQVGIDSVLSEVLPEDKAEEVKKLQEAGKKVA   61
           +A+KAL    G++V MITGDNK TAKAIAKQ+GID +++EVLP+ K   +K+L + G KVA
Sbjct: 649 EAIKALHALGLKVAMITGDNKATAKAIAKQLGIDEIVAEVLPDGKVAALKQLSQKGDKVA  708

Query:  62 MVGDGINDAPALAQANVGIAVGSGTDVAIESADIVLMRNDLTAVLTTIDLSHATLRNIKQ  121
           +VGDGINDAPALAQA+VG+A+G+GTDVAIE+AD+VLM   DL V+   I LS AT+RNIKQ
Sbjct: 709 FVGDGINDAPALAQADVGLAIGTGTDVAIEAADVVLMSGDLRGVVDAIALSQATIRNIKQ  768

Query: 122 NLFWAFAYNLVGIPVAMGLLYIFGGLLMSPMLA                            154
           NLFW FAYN + IPVA G+LY   G+L+SP+ A
Sbjct: 769 NLFWTFAYNALLIPVAAGMLYPINGMLLSPIFA                            801
```

A related DNA sequence was identified in *S. pyogenes* <SEQ ID 3505> which encodes the amino acid sequence <SEQ ID 3506>. Analysis of this protein sequence reveals the following:

```
Possible site: 36
>>> Seems to have no N-terminal signal sequence
      INTEGRAL Likelihood = -10.83   Transmembrane 328-344 (314-348)
      INTEGRAL Likelihood = -7.01    Transmembrane 354-370 (347-377)
      INTEGRAL Likelihood = -3.24    Transmembrane 101-117 (100-117)
      INTEGRAL Likelihood = -2.97    Transmembrane 165-181 (165-185)
      INTEGRAL Likelihood = -2.34    Transmembrane 665-681 (662-684)
      INTEGRAL Likelihood = -2.18    Transmembrane  67-83  ( 66-83)
      INTEGRAL Likelihood = -0.64    Transmembrane 491-507 (490-508)
      INTEGRAL Likelihood = -0.59    Transmembrane 691-707 (691-707)
      INTEGRAL Likelihood = -0.43    Transmembrane 140-156 (139-156)

----- Final Results -----
             bacterial membrane --- Certainty = 0.5331(Affirmative) < succ>
              bacterial outside --- Certainty = 0.0000(Not Clear)   < succ>
            bacterial cytoplasm --- Certainty = 0.0000(Not Clear)   < succ>
```

An alignment of the GAS and GBS proteins is shown below.

```
Identities = 92/152 (60%), Positives = 123/152 (80%)

Query:   4 VKALRRRGVEVIMITGDNKRTAKAIAKQVGIDSVLSEVLPEDKAEEVKKLQEAGKKVAMV   63
           V+AL + G+ IM+TGD+ TAKAIA QVGI V+S+VLP+ KA  + L+ G+KVAMV
Sbjct: 544 VEALHQLGIHTIMLTGDHDATAKAIASQVGITDVISQVLPDQKAGVIADLRSQGRKVAMV  603
```

```
Query:   64 GDGINDAPALAQANVGIAVGSTDVAIESADIVLMRNDLTAVLTTIDLSHATLRNIKQNL 123
            GDGINDAPALA A++GIA+GSGTD+AIESAD++LM+ D+   ++   + LS   T+R +K+NL
Sbjct:  604 GDGINDAPALAVADIGIAMGSGTDIAIESADVILMKPDMLDVKAMSLSRVTMRIVKENL 663

Query:  124 FWAFAYNLVGIPVAMGLLYIFGGLLMSPMLAG 155
            FWAF YN++ IPVAMGLL++FGG L++PMLAG
Sbjct:  664 FWAFIYNVLMIPVAMGLLHLFGGPLLNPMLAG 695
```

Based on this analysis, it was predicted that these proteins and their epitopes could be useful antigens for vaccines or diagnostics.

EXAMPLE 1990

A DNA sequence (GBSx2100) was identified in *S. agalactiae* <SEQ ID 6145> which encodes the amino acid sequence <SEQ ID 6146>. This protein is predicted to be CopY. Analysis of this protein sequence reveals the following:

```
Possible site: 23
>>> Seems to have no N-terminal signal sequence

----- Final Results -----
            bacterial cytoplasm --- Certainty = 0.2067(Affirmative) < succ>
            bacterial membrane  --- Certainty = 0.0000(Not Clear)   < succ>
             bacterial outside  --- Certainty = 0.0000(Not Clear)   < succ>
```

The protein has homology with the following sequences in the GENPEPT database.

```
>GP: AAG10085 GB: AF296446 CopY [Streptococcus mutans]
Identities = 63/139 (45%), Positives = 96/139 (68%)

Query:    8 TSITDAEWEVMRVVWANDLVTSKTVISVLKEKMDWTESTIKTILGRLVEKGVLNTEQEGR 67
            TSI++AEWEVMRVVWA + +S  +I++L     W+ STIKT++ RL EKG L ++++GR
Sbjct:    2 TSISNAEWEVMRVVWAKQMTSSSEIIAILSRTYCWSASTIKTLITRLSEKGYLTSQRQGR 61

Query:   68 KFIYTANIVEKEAVRDFAEDIFNRICKKKVGNVIGSIIEDHVLSFDDIDRLEKILEIKKS 127
            K+IY++ I E+EA+    ++F+RIC K   +I   ++E+ ++  DI++LE +L   KK+
Sbjct:   62 KYIYSSLISEEEALEQQVSEVFSRICVTKHQALIRHLVEETPMTLSDIEKLEALLLSKKA 121

Query:  128 FAVEEVDCQCTEGQCDCHE 146
             AV EV C C  GQC C+E
Sbjct:  122 NAVPEVKCNCIVGQCSCYE 140
```

There is also homology to SEQ ID 3502.

Based on this analysis, it was predicted that this protein and its epitopes, could be useful antigens for vaccines or diagnostics.

EXAMPLE 1991

A DNA sequence (GBSx2101) was identified in *S. agalactiae* <SEQ ID 6147> which encodes the amino acid sequence <SEQ ID 6148>. Analysis of this protein sequence reveals the following:

```
Possible site: 29
>>> Seems to have no N-terminal signal sequence

----- Final Results -----
            bacterial cytoplasm --- Certainty = 0.2829(Affirmative) < succ>
            bacterial membrane  --- Certainty = 0.0000(Not Clear)   < succ>
             bacterial outside  --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 1992

A DNA sequence (GBSx2102) was identified in *S. agalactiae* <SEQ ID 6149> which encodes the amino acid sequence <SEQ ID 6150>. This protein is predicted to be DS RF protein. Analysis of this protein sequence reveals the following:

```
Possible site: 57
>>> Seems to have a cleavable N-term signal seq.
     INTEGRAL    Likelihood = -13.21    Transmembrane   142-158  (136-169)
     INTEGRAL    Likelihood =  -3.45    Transmembrane    70- 86  ( 66- 88)
     INTEGRAL    Likelihood =  -3.13    Transmembrane   178-194  (176-195)

----- Final Results -----
              bacterial membrane --- Certainty = 0.6286(Affirmative) < succ>
               bacterial outside --- Certainty = 0.0000(Not Clear)  < succ>
             bacterial cytoplasm --- Certainty = 0.0000(Not Clear)  < succ>
```

The protein has homology with the following sequences in the GENPEPT database.

```
>GP: AAA26611 GB: L10909 putative [Staphylococcus aureus]
Identities = 98/204 (48%), Positives = 148/204 (72%), Gaps = 3/204 (1%)

Query:    4 TIISAIGVYISTSIDYLIVLIILFAQLSQNKQKWHIYAGQYLGTGLLVGASLVAAY-VVN   62
            TI++A  VY++T IDYL++LI+LF+Q+ + + K HI+ GQY+GT +++GASL+ A  VVN
Sbjct:   18 TILTATAVYVATGIDYLVLILILLFSQVKKGQVK-HIWIGQYIGTAIVIGASLLVAQGVVN   76

Query:   63 FVPEAWMVGLLGLIPIYLGIRFAIVGEGEEEEEEEIIERLEQSKANQLFWTVTLLTIASG  122
            +P+ W++GLLGL+P+YLG++   I GE E+E+E  I+      K NQLF T+   + +AS
Sbjct:   77 LIPQQWVIGLLGLLPLYLGVKIWIKGE-EDEDESSILSLFSSGKFNQLFLTMIFIVLASS  135

Query:  123 GDNLGIYIPYFASLDWSQTLVVLLVFAIGIIIFCELSWVLSSIPLISETIEKYQRIIVPL  182
            D+  IYIPYF +L  S+   +V +VF I + +  C +S+ L+S   ISETIEKY+R IVP+
Sbjct:  136 ADDFSIYIPYFTTLSMSEIFIVTIVFLIMVGVLCYVSYRLASFDFISETIEKYERWIVPI  195

Query:  183 VFIPLGLYIMYESGTIETFLNFIL                                     206
            VFI LG+YI++E+GT    ++F+L
Sbjct:  196 VFIGLGIYILFENGTSNALISFLL                                     219
```

A related DNA sequence was identified in *S. pyogenes* <SEQ ID 6151> which encodes the amino acid sequence <SEQ ID 6152>. Analysis of this protein sequence reveals the following:

```
Possible site: 34
>>> Seems to have an uncleavable N-term signal seq
     INTEGRAL    Likelihood = -13.16    Transmembrane   143-159  (135-165)
     INTEGRAL    Likelihood =  -9.13    Transmembrane    49- 65  ( 43- 71)
     INTEGRAL    Likelihood =  -7.17    Transmembrane    73- 89  ( 72- 94)
     INTEGRAL    Likelihood =  -6.00    Transmembrane    13- 29  (  9- 33)
     INTEGRAL    Likelihood =  -2.71    Transmembrane   180-196  (179-197)
     INTEGRAL    Likelihood =  -0.59    Transmembrane   112-128  (109-128)

----- Final Results -----
              bacterial membrane --- Certainty = 0.6265(Affirmative) < succ>
               bacterial outside --- Certainty = 0.0000(Not Clear)  < succ>
             bacterial cytoplasm --- Certainty = 0.0000(Not Clear)  < succ>
```

The protein has homology with the following sequences in the databases:

```
>GP: AAF42284 GB: AE002544 cadmium resistance protein [Neisseria
meningitidis MC58]
Identities = 201/208 (96%), Positives = 205/208 (97%)

Query:    1 MRCFMIQNVVTSIILYSGTAVDLLIILMLFFAKRKSRKDIINIYLGQFLGSVSLILLSLL   60
            MRCFMIQNVVTSIILYSGTAVDLLIILMLFFAKRKSRKDIINIYLGQFLGSVSLILLSLL
Sbjct:    1 MRCFMIQNVVTSIILYSGTAVDLLIILMLFFAKRKSRKDIINIYLGQFLGSVSLILLSLL   60

Query:   61 FAFVLDYIPSKEILGLLGLIPIFLGLKVLLLGDSDGEAIAKEGLSKDKNLIFLVAMITF  120
            FAFVLDYIPSKEILGLLGLIPI LG+KVLLLGDSDGEAIAKEGL KDKNLIFLVAMITF
Sbjct:   61 FAFVLDYIPSKEILGLLGLIPILLGIKVLLLGDSDGEAIAKEGLRKDKNLIFLVAMITF  120
```

-continued

```
Query: 121 ASCGADNIGVFVPYFTTLNLANLIVALLTFLVMIYLLVFSAQKLAQVPSVGETLEKYSRW 180
           ASCGADNIGVFVPYFTTLNLANLIVALLTFLVMIYLLVFSAQKLAQVPSVGETLEKYSRW
Sbjct: 121 ASCGADNIGVFVPYFTTLNLANLIVALLTFLVMIYLLVFSAQKLAQVPSVGETLEKYSRW 180

Query: 181 FIAVVYLGLGMYILIENNSFDMLWAVLG                                  208
           F+AVVYLGLG+YIL+ENNSFDMLW VLG
Sbjct: 181 FVAVVYLGLGIYILVENNSFDMLWTVLG                                  208
```

An alignment of the GAS and GBS proteins is shown below.

```
Identities = 71/200 (35%), Positives = 130/200 (64%), Gaps = 4/200 (2%)

Query:   1 MGQTIISAIGVYISTSIDYLIVLIILFAQLSQNKQKWHIYAGQYLGTGLLVGASLVAAYV  60
           M Q ++++I +Y  T++D LI+L++ FA+    K   +IY GQ+LG+  L+  SL+ A+V
Sbjct:   5 MIQNVVTSIILYSGTAVDLLIILMLFFAKRKSRKDIINIYLGQFLGSVSLILLSLLFAFV  64

Query:  61 VNFVPEAWMVGLLGLIPIYLGIRFAIVGEGEEEEEEEIIERLEQSKANQLFWTVTLLTIA 120
           ++++P   ++GLLGLIPI+LG++  ++G+ + E    +   E L +     N +F V ++T A
Sbjct:  65 LDYIPSKEILGLLGLIPIFLGLKVLLLGDSDGEAIAK--EGLSKDNKNLIF-LVAMITFA 121

Query: 121 S-GGDNLGIYIPYFASLDWSQTLVVLLVFAIGIIIFCELSWVLSSIPLISETIEKYQRII 179
           S G DN+G+++PYF +L+ +  +V LL F + I +     L+ +P + ET+EKY R
Sbjct: 122 SCGADNIGVFVPYFTTLNLANLIVALLTFLVMIYLLVFSAQKLAQVPSVGETLEKYSRWF 181

Query: 180 VPLVFIPLGLYIMYESGTIE                                         199
           + +V++ LG+YI+ E+ + +
Sbjct: 182 IAVVYLGLGMYILIENNSFD                                         201
```

SEQ ID 6150 (GBS174) was expressed in and purified from *E. coli*. The purified protein is shown in lane 7 of FIG. 223.

Based on this analysis, it was predicted that this protein and its epitopes, could be useful antigens for vaccines or diagnostics.

EXAMPLE 1993

A DNA sequence (GBSx2103) was identified in *S. agalactiae* <SEQ ID 6153> which encodes the amino acid sequence <SEQ ID 6154>. This protein is predicted to be Pgm. Analysis of this protein sequence reveals the following:

```
Possible site: 53
>>> Seems to have no N-terminal signal sequence

----- Final Results -----
              bacterial cytoplasm --- Certainty = 0.4324(Affirmative) < succ>
              bacterial membrane  --- Certainty = 0.0000(Not Clear)   < succ>
              bacterial outside   --- Certainty = 0.0000(Not Clear)   < succ>
```

The protein has homology with the following sequences in the GENPEPT database.

```
>GP: CAB96418 GB: AJ243290
phosphoglucomutase [Streptococcus thermophilus]
Identities = 65/76 (85%), Positives = 71/76 (92%)

Query:  1 MTYTENLQKWLDFEQLPDYLRQELLSMDEKTKEDAFYTNLEFGTAGMRGYIGAGTNRINI  60
          M+YTEN QKWLDF +LP YLR EL+SMDEKTKEDAFYTNLEFGTAGMRG IGAGTNRINI
Sbjct:  1 MSYTENYQKWLDFAELPAYLRDELVSMDEKTKEDAFYTNLEFGTAGMRGLIGAGTNRINI  60

Query: 61 YVVRQATEGLAKLIET                                              76
          YVVRQATEGLA+LI++
Sbjct: 61 YVVRQATEGLAQLIDS                                              76
```

A related DNA sequence was identified in *S. pyogenes* <SEQ ID 6155> which encodes the amino acid sequence <SEQ ID 6156>. Analysis of this protein sequence reveals the following:

```
Possible site: 53
>>> Seems to have no N-terminal signal sequence

----- Final Results -----
              bacterial Cytoplasm --- Certainty = 0.4324(Affirmative) < succ>
              bacterial membrane  --- Certainty = 0.0000(Not Clear)   < succ>
              bacterial outside   --- Certainty = 0.0000(Not Clear)   < succ>
```

An alignment of the GAS and GBS proteins is shown below.

```
Identities = 75/76 (98%), Positives = 75/76 (98%)

Query:    1 MTYTENLQKWLDFEQLPDYLRQELLSMDEKTKEDAFYTNLEFGTAGMRGYIGAGTNRINI   60
            MTYTEN QKWLDFEQLPDYLRQELLSMDEKTKEDAFYTNLEFGTAGMRGYIGAGTNRINI
Sbjct:    1 MTYTENFQKWLDFEQLPDYLRQELLSMDEKTKEDAFYTNLEFGTAGMRGYIGAGTNRINI   60

Query:   61 YVVRQATEGLAKLIET                                               76
            YVVRQATEGLAKLIET
Sbjct:   61 YVVRQATEGLAKLIET                                               76
```

Based on this analysis, it was predicted that these proteins and their epitopes could be useful antigens for vaccines or diagnostics.

EXAMPLE 1994

A DNA sequence (GBSx2104) was identified in *S. agalactiae* <SEQ ID 6157> which encodes the amino acid sequence <SEQ ID 6158>. This protein is predicted to be a membrane protein. Analysis of this protein sequence reveals the following:

```
Possible site: 53
>>> Seems to have a cleavable N-term signal seq.
INTEGRAL Likelihood = -6.21 Transmembrane  94-110 ( 93-115)
INTEGRAL Likelihood = -4.14 Transmembrane 172-188 (166-188)
INTEGRAL Likelihood = -1.97 Transmembrane 130-146 (129-149)
INTEGRAL Likelihood = -0.16 Transmembrane  62-78  ( 62-79)

----- Final Results -----
           bacterial membrane --- Certainty = 0.3484(Affirmative) < succ>
            bacterial outside --- Certainty = 0.0000(Not Clear)   < succ>
          bacterial cytoplasm --- Certainty = 0.0000(Not Clear)   < succ>
```

The protein has homology with the following sequences in the GENPEPT database.

```
>GP:CAA80247 GB:Z22520 membrane protein [Bacillus acidopullulyticus] Iden-
tities = 47/185 (25%), Positives = 80/185 (42%), Gaps = 23/185 (12%)
Query:    1 MKKKNKSSNIAIIAIFFAIMLVIHFLSSFIFSFWLVPIKPTLMHIPVIIASIAYGPRIGA   60
            MKK      +I I  +  A+ +++              T+MHIP II  I  GP +G
Sbjct:    1 MKKSLTVRDIVIAGVLGAVAILLGVTRLGYIPVPTAAGNATIMHIPAIIGGIMQGPVVGL   60

Query:   61 TLGALMGGISVANSSIVLLPTSYLFSPFVENGNFYSLIIALVPRILIGIIPYFVYKLLHN  120
              +GA+ G  S  N+++ L                 F     +++++PR+ IG++ +VY    +
Sbjct:   61 IVGAIFGISSFLNATVPL---------------FKDPLVSILPRLFIGVVAWLVYIGIRR  105

Query:  121 R---FGLAISGAIGSLTNTVFVLSGIFIFFSSTYNGNIKLMLAGIISSNSLAEMVIAAII  177
            +      + +S  IG+LTNT  VL+     F        +A   +N L E V+  I+
Sbjct:  106 KSEYVAVGLSAFIGTLTNTALVLA--MAVFRHYLTAGVAWTVA---ITNGLPEAVVGTIV  160

Query:  178 VYLTV                                                         182
            V
Sbjct:  161 TLAVV                                                         165
```

A related DNA sequence was identified in *S. pyogenes* <SEQ ID 6159> which encodes the amino acid sequence <SEQ ID 6160>. Analysis of this protein sequence reveals the following:

```
Possible site: 31
>>> Seems to have an uncleavable N-term signal seq
INTEGRAL Likelihood = -8.97 Transmembrane  18-34  ( 10-41)
INTEGRAL Likelihood = -7.43 Transmembrane 170-186 (160-191)
INTEGRAL Likelihood = -5.63 Transmembrane  96-112 ( 94-117)
INTEGRAL Likelihood = -4.67 Transmembrane 140-156 (131-158)
INTEGRAL Likelihood = -3.66 Transmembrane  64-80  ( 63-84)
INTEGRAL Likelihood = -0.22 Transmembrane  39-55  ( 39-55)
```

-continued

----- Final Results -----
            bacterial membrane --- Certainty = 0.4588(Affirmative) < succ>
              bacterial outside --- Certainty = 0.0000(Not Clear)   < succ>
            bacterial cytoplasm --- Certainty = 0.0000(Not Clear)   < succ>

The protein has homology with the following sequences in the databases:

```
>GP:OAA80247 GB:Z22520 membrane protein [Bacillus acidopullulyticus] Iden-
tities = 47/193 (24%), Positives = 86/193 (44%), Gaps = 28/193 (14%)
Query:   8 RKSADISRIAIFFAIMLVIHFVSSLVFNIWPIPI---KPTLVHIPVIIASVLYGPRIGAI    64
           +KS +   I I   + V   +         P+P      T++HIP II ++ GP +G I
Sbjct:   2 KKSLTVRDIVIAGVLGAVAILLGVTRLGYIPVPTAAGNATIMHIPAIIGGIMQGPVVGLI   61

Query:  65 LGGLMGIISVITNTIILLPTNYLFSPFVDHGTFASLIIAIIPRILIGITPYYCYKLIPNQ   124
           +G + GI S + T+ L              F   +++I+PR+ IG+ + Y I +
Sbjct:  62 VGAIFGISSFLNATVPL---------------FKDPLVSILPRLFIGVVAWLVYIGRRK   106

Query: 125 FGLIVSGI---IGSLTNTIFVLS-GIFIFFATVFDGNIKALLTAIISSNAIVEMIISAII   180
             + G+   IG+LTNT VL+ +F + T       +   + +N + E ++  I+
Sbjct: 107 SEYVAVGLSAFIGTLTNTALVLAMAVFRHYLTA------GVAWTVAITNGLPEAVVGTIV   160

Query: 181 TFVLIPTLSRLKR                                                193
           T  ++     ++ R
Sbjct: 161 TLAVVLAWKQIGR                                                173
```

An alignment of the GAS and GBS proteins is shown below.

```
Identities = 121/184 (65%), Positives = 157/184 (84%)

Query:   6 KSSNIAIIAIFFAIMLVIHFLSSFIFSFWLVPIKPTLMHIPVIIASIAYGPRIGATLGAL    65
           KS++I+ IAIFFAIMLVIHF+SS +F+ W +PIKPTL+HIPVIAS+ YGPRIGA LG L
Sbjct:   9 KSADISRIAIFFAIMLVIHFVSSLVFNIWPIPIKPTLVHIPVIIASVLYGPRIGAILGGL   68

Query:  66 MGGISVANSSIVLLPTSYLFSPFVENGNFYSLIIALVPRILIGIIPYFVYKLLHNRFGLA   125
           MG ISV    ++I+LLPT+YLFSPFV++G F SLIIA++PRILIGI PY+ YKL+ N+FGL
Sbjct:  69 MGIISVITNTIILLPTNYLFSPFVDHGTFASLIIAIIPRILIGITPYYCYKLIPNQFGLI   128

Query: 126 ISGAIGSLTNTVFVLSGIFIFFSSTYNGNIKLMLAGIISSNSLAEMVIAAIIVYLTVPRI   185
           +SG IGSLTNT+FVLSGIFIFF++ ++GNIK +L   IISSN++ EM+I+AII ++ +P +
Sbjct: 129 VSGIIGSLTNTIFVLSGIFIFFATVFDGNIKALLTAIISSNAIVEMIISAIITFVLIPTL   188

Query: 186 LNIK                                                         189
             +K
Sbjct: 189 SRLK                                                         192
```

A related GBS gene <SEQ ID 8949> and protein <SEQ ID 8950> were also identified. Analysis of this protein sequence reveals the following:

```
Lipop: Possible site: -1 Crend: 5
McG: Discrim Score: 13.42
GvH: Signal Score (-7.5): -1.93
Possible site: 53
>>> Seems to have a cleavable N-term signal seq.
ALOM program count: 2 value: -6.21 threshold: 0.0
 INTEGRAL   Likelihood = -6.21 Transmembrane 94-110 ( 93-115)
 INTEGRAL   Likelihood = -0.16 Transmembrane 62-78  ( 62-79)
 PERIPHERAL Likelihood =  1.70 123
modified ALOM score: 1.74

*** Reasoning Step: 3

----- Final Results -----
            bacterial membrane --- Certainty = 0.3484(Affirmative) < succ>
              bacterial outside --- Certainty = 0.0000(Not Clear)   < succ>
            bacterial cytoplasm --- Certainty = 0.0000(Not Clear)   < succ>
```

The protein has homology with the following sequences in the databases:

```
ORF01561(301-723 of 1017)
EGAD|38021|39600(1-129 of 183) hypothetical membrane protein {Bacillus
acidopullulyticus} GP|806536|emb|CAA80247.1||Z22520 membrane protein {Bacillus
acidopullulyticus}
% Match = 7.6
% Identity = 29.7 % Similarity = 53.9
Matches = 38 Mismatches = 57 Conservative Sub.s = 31

162       192       222       252       282       312       342       372
KKIGYQEIEPRISLLACGDTGQGALADISTILKCIQEVAN*AVNLYTISSLI*GVIMKKKNKSSNIAIIAIFFAIMLVIH
                                                       |||      :|  |   ::  |:  :::
                                                       MKKSLTVRDIVIAGVLGAVAILLG
                                                                10        20

402       432       462       492       522       552       582       612
FLSSFIFSFWLVPIKPTLMHIPVIIASIAYGPRIGATLGALMGGISVANSSIVLLPTSYLFSPFVENGNFYSLIIALVPR
         |:||||  ||   ||  :|   :||: |    |   |:::  |              |    :::::||
VTRLGYIPVPTAAGNATIMHIPAIIGGIMQGPVVGLIVGAIFGISSFLNATVPL--------------FKDPLVSILPR
            40        50        60        70                            80

642       663       693       723       753       783       813       843
ILIGIIPYFVY---KLLHNRFGLAISGAIGSLTNTVFVXSGIFIFFSSTYNGNIKLMLAGIISXNSLAEMVIAAIIVYLT
::||::::||    :       ::|  ||:||||  :|  :
LFIGVVAWLVYIGIRRKSEYVAVGLSAFIGTLTNTALVLAMAVFRHYLTAGVAWTVAITNGLPEAVVGTIVTLAVVLAWK
           100       110       120       130       140       150       160
```

Based on this analysis, it was predicted that these proteins and their epitopes could be useful antigens for vaccines or diagnostics.

EXAMPLE 1995

A DNA sequence (GBSx2105) was identified in *S. agalactiae* <SEQ ID 6161> which encodes the amino acid sequence <SEQ ID 6162>. Analysis of this protein sequence reveals the following:

```
Possible site: 18
>>> Seems to have no Nterminal signal sequence (or aa 1-18)

----- Final Results -----
          bacterial cytoplasm --- Certainty = 0.0165(Affirmative) < succ>
          bacterial membrane  --- Certainty = 0.0000(Not Clear)   < succ>
          bacterial outside   --- Certainty = 0.0000 (Not Clear)  < succ>
```

The protein has homology with the following sequences in the GENPEPT database.

```
>GP:AAC44502 GB:E148885 DNA/pantothenate metabolism flavoprotein
[i Streptococcus mutans]
Identities = 101/145 (69%), Positives = 122/145 (83%)

Query:   1 MIKRITLAVTGSISAYKAADLTSQLTKIGYDVHIIMTQAATEFITPLTLQVLSKNPIHLD    60
           M K+I LAV+GSI+AYKAADL+ QLTK+GY V++ MT AA +FI PLTLQVLSKNP++ +
Sbjct:   1 MTKKILLAVSGSIAAYKAADLSHQLTKLGYHVNVFMTNAAKQFIPPLTLQVLSKNPVYSN    60

Query:  61 VMDEHNPKIINHIELAKRTDLFIVAPASANTIAHLAYGFADNIVTSVALANPDETPKLIA   120
           VM E +P++INNI LAK+ DLF++ PASANT+AHLA+GFADNIVTSVALA+P E PK  A
Sbjct:  61 VMKEDDPQVINHIALAKQADLFLLPPASANTLAHLAHGFADNIVTSVALALPLEVPKFFA   120

Query: 121 PAMNTKMYHNTITQRNIDILKKIGY                                     145
           PA NTKMY N ITQ NI +LKK GY
Sbjct: 121 PANNTKNYENPITQSNITLLKKWGY                                     145
```

A related DNA sequence was identified in *S. pyogenes* <SEQ ID 6163> which encodes the amino acid sequence <SEQ ID 6164>. Analysis of this protein sequence reveals the following:

```
Possible site: 18
>>> Seems to have no N-terminal signal sequence
```

```
----- Final Results -----
            bacterial cytoplasm --- Certainty = 0.0076(Affirmative) < succ>
            bacterial membrane  --- Certainty = 0.0000(Not Clear)   < succ>
             bacterial outside  --- Certainty = 0.0000(Not Clear)   < succ>
```

An alignment of the GAS and GBS proteins is shown below.

```
Identities = 146/178 (82%), Positives = 155/178 (87%)

Query:   1 MIKRITLAVTGSISAYKAADLTSQLTKIGYDVHIIMTQAATEFITPLTLQVLSKNPIHLD   60
           M K ITLAV+GSISAYKAADLTSQLTKIGYDVHIIMTQAAT+FITPLTLQVLSKN IHLD
Sbjct:   1 MTKHITLAVSGSISAYKAADLTSQLTKIGYDVHIIMTQAATQFITPLTLQVLSKNAIHLD   60

Query:  61 VMDEHNPKIINHIELAKRTDLFIVAPASANTIAHLAYGFADNIVTSVALAMPDETPKLIA  120
           VMDEH+PK+INHIELAKRTDLFIVAPASANTIAHLAYGFADN+VTSVALA+P  TPKLIA
Sbjct:  61 VMDEHDPKVINHIELAKRTDLFIVAPASANTIAHLAYGFADNLVTSVALALPATTPKLIA  120

Query: 121 PAMNTKMYHNTITQRNIDILKKIGYQEIEPRISLLACGDTGQGALADISTILKCIQEV    178
           PAMNTKMY N ITQ NI  L   IG+ EI P+ SLLACGD G GALADI  IL  I +
Sbjct: 121 PAMNTKMYQNPITQENIKRLSTIGFTEIPPKSSLLACGDKGPGALADIDVILATIDTI   178
```

SEQ ID 6162 (GBS236) was expressed in *E. coli* as a His-fusion product. SDS-PAGE analysis of total cell extract is shown in FIG. 52 (lane 5; MW 21.6 kDa).

Purified GBS236-GST is shown in FIG. 208 (lane 6) and in FIG. 225 (lanes 4-5).

Based on this analysis, it was predicted that these proteins and their epitopes could be useful antigens for vaccines or diagnostics.

EXAMPLE 1996

A DNA sequence (GBSx2106) was identified in *S. agalactiae* <SEQ ID 6165> which encodes the amino acid sequence <SEQ ID 6166>. This protein is predicted to be pantothenate metabolism flavoprotein homolog (dfp). Analysis of this protein sequence reveals the following:

```
Possible site: 13
>>> Seems to have no N-terminal signal sequence

----- Final Results -----
            bacterial cytoplasm --- Certainty = 0.2325(Affirmative) < succ>
            bacterial membrane  --- Certainty = 0.0000(Not Clear)   < succ>
             bacterial outside  --- Certainty = 0.0000(Not Clear)   < succ>
```

A related GBS nucleic acid sequence <SEQ ID 9835> which encodes amino acid sequence <SEQ ID 9836> was also identified.

The protein has homology with the following sequences in the GENPEPT database.

```
>GP: AAG39941 GB: AF301375 MTW1216 [Methanothermobacter wolfeii
prophage psiM100]
Identities = 71/229 (31%), Positives = 117/229 (51%), Gaps = 27/229 (11%)

Query:   6 MKILITSGGTTEKIDTVRSITNHATGTLGKIIAEKYLREGHQVTLVTTKNAVKPESATNL    65
            +++L++ GGT E ID VR ITN ++G +G  +A +    +G VTLV    V +  + L
Sbjct: 172 LRVLVSLGGTLEPIDPVRVITNRSSGRMGLAVAREAYIQGADVTLVA--GTVSVDIPSQL   229

Query:  66 STFEIEDVDSLIKTLKPLVKEHDILIHSMAVSDYTPVYMADFEKVKSSDHLDTFLRKDNH   125
            T  E    + + +   L+ EHD+ + + AVSD+ PVY
Sbjct: 230 RTVRAETAHEMAEAVAELIGEHDVFVSAAAVSDFRPVYS--------------------   268

Query: 126 EGKISSESEYQVLFLKKTPKVISLVKKWNPQITLVGFKLLVNVTKENLFKVARHSLIKNK   185
            E KISS+SE  L LK  PK+I + ++ NP+  +VGFK   V++E L    AR +  +
Sbjct: 269 EEKISSDSEI-TLRLKPNPKIIRMARETNPEAFIVGFKAEHGVSEEELIAAARKQIEDSV   327

Query: 186 ATFILANDL-IDITSKHHIAYLLDHDNVYKATT--KEDIAQLIYEKVKK             231
            A ++AND+ ++    +  ++  + V T   KE++A LI  ++ K
Sbjct: 328 ADMVVANDVSVEGFGSENNRAIIVSEGVTELPTMKKEELAGLIIGEIMK             376
```

A related DNA sequence was identified in *S. pyogenes* <SEQ ID 6167> which encodes the amino acid sequence <SEQ ID 6168>. Analysis of this protein sequence reveals the following:

```
Possible site: 54
>>> Seems to have no N-terminal signal sequence

----- Final Results -----
             bacterial cytoplasm --- Certainty = 0.1737(Affirmative) < succ>
              bacterial membrane --- Certainty = 0.0000(Not Clear)  < succ>
               bacterial outside --- Certainty = 0.0000(Not Clear)  < succ>
```

An alignment of the GAS and GBS proteins is shown below.

```
Identities = 142/230 (61%), Positives = 170/230 (73%)

Query:    4 MAMKILITSGGTTEKIDTVRSITNHATGTLGKIIAEKYLREGHQVTLVTTKNAVKPESAT   63
            M MK++ITSGGTTE ID VR ITNH+TG LGK+I E++L+  H VTLVTTK A KP
Sbjct:    1 MTMKLIITSGGTTEPIDAVRGITNHSTGQLGKLITERFLQYHHDVTLVTTKTATKPLPNK   60

Query:   64 NLSTFEIEDVDSLIKTLKPLVKEHDILIHSMAVSDYTPVYMADFEKVKSSDHLDTFLRKD  123
             L   E+E V+ L+  LK V  HDILIHSMAVSDYTPVYM D E+V  +D+L+ FL +
Sbjct:   61 RLRIIEVETVNDLMAALKDQVPHHDILIHSMAVSDYTPVYMTDLEQVSQADNLNCFLCEH  120

Query:  124 NHEGKISSESEYQVLFLKKTPKVISLVKKWNPQITLVGFKLLVNVTKENLFKVARHSLIK  183
            N E KISS S+YQVLFLKKTPKVIS VK+WNP I LVGFKLLVNV +E L KVAR SL K
Sbjct:  121 NSEPKISSASDYQVLFLKKTPKVISYVKQWNPNIKLVGFKLLVNVPQEELIKVARASLAK  180

Query:  184 NKATFILANDLIDITSKHHIAYLLDHDNVYKATTKEDIAQLIYEKVKKYD            233
            N A +ILANDL+DI +   H A L+ ++ V  A TKE IA L+YE++ K+D
Sbjct:  181 NHADYILANDLVDIQTGMHKALLISNNEVASADTKEAIADLLYERMTKHD            230
```

Based on this analysis, it was predicted that these proteins and their epitopes could be useful antigens for vaccines or diagnostics.

EXAMPLE 1997

A DNA sequence (GBSx2107) was identified in *S. agalactiae* <SEQ ID 6169> which encodes the amino acid sequence <SEQ ID 6170>. Analysis of this protein sequence reveals the following:

```
Possible site: 49
>>> Seems to have no N-terminal signal sequence
    INTEGRAL     Likelihood = -0.22    Transmembrane    117-133 (117-133)

----- Final Results -----
              bacterial membrane --- Certainty = 0.1086(Affirmative) < succ>
               bacterial outside --- Certainty = 0.0000(Not Clear)  < succ>
             bacterial cytoplasm --- Certainty = 0.0000(Not Clear)  < succ>
```

A related GBS nucleic acid sequence <SEQ ID 9833> which encodes amino acid sequence <SEQ ID 9834> was also identified.

The protein has homology with the following sequences in the GENPEPT database.

```
>GP: BAB07541 GB: AP001520 unknown conserved protein in B. subtilis
[Bacillus halodurans]
Identities = 94/221 (42%), Positives = 133/221 (59%), Gaps = 2/221 (0%)

Query:   52 AEKPFIWTEVFLREINRSNQEIILHIWPMTKTVILGMLDRELPHLELAKKEIISRGYEPV  111
            A + F + +       I +S    L  W    TV+LG+ D  LP ++   + +   ++ +
Sbjct:   27 ALQSFAYDDTLCTSIGKSQSPPTLRAWVHHNTVVLGIQDSRLPQIKAGIEALKGFQHDVI   86

Query:  112 VRNFGGLAVVADEGILNFSLVIPDVFERKLSISDGYLIMVDFIRSIFSDFYQPIEHFEVE  171
            VRN GGLAVV D GILN SLV+ +    E+  SI DGY +M + I S+F D   + IE E+
Sbjct:   87 VRNSGGLAVVLDSGILNLSLVLKE--EKGFSIDDGYELMYELICSMFQDHREQIEAREIV  144
```

-continued

```
Query: 172 TSYCPGKFDLSINGKKFAGLAQRRIKNGIAVSIYLSVCGDQKGRSQMISDFYKIGLGDTG  231
            SYCPG +DLSI+GKKFAG++QRRI+ G+AV IYL V G     R++MI  FY     +
Sbjct: 145 GSYCPGSYDLSIDGKKFAGISQRRIRGGVAVQIYLCVSGSGAERAKMIRTFYDKAVAGQP  204

Query: 232 SPIAYPNVDPEIMANLSDLLDCPMTVEDVIDRMLISLKQVG                      272
            +    YP + PE MA+LS+LL  P  V DV+ + L++L+Q G
Sbjct: 205 TKFVYPRIKPETMASLSELLGQPHNVSDVLLKALMTLQQHG                      245
```

A related DNA sequence was identified in *S. pyogenes* <SEQ ID 6171> which encodes the amino acid sequence <SEQ ID 6172>. Analysis of this protein sequence reveals the following:

```
Possible site: 61
>>> Seems to have an uncleavable N-term signal seq
     INTEGRAL    Likelihood = -0.22    Transmembrane    95-111 (95-111)

----- Final Results -----
            bacterial membrane --- Certainty = 0.1086(Affirmative) < succ>
             bacterial outside --- Certainty = 0.0000(Not Clear)   < succ>
           bacterial cytoplasm --- Certainty = 0.0000(Not Clear)   < succ>
```

The protein has homology with the following sequences in the databases:

```
>GP: BAB07541 GB: AP001520 unknown conserved protein in B. subtilis
[Bacillus halodurans]
Identities = 97/228 (42%), Positives = 138/228 (59%), Gaps = 2/228 (0%)

Query:  30 ALSPFVWTEVFLKTINQEPNQLILHIWPMTRTVILGMLDRQLPYFELAKTEIGNNGYVPV   89
           AL  F + +    +I + +   L  W    TV+LG+ D +LP +       +    + +
Sbjct:  27 ALQSFAYDDTLCTSIGKSQSPPTLRAWVHHNTVVLGIQDSRLPQIKAGIEALKGFQHDVI   86

Query:  90 TRNIGGLAVVADDGILNFSLVIPDHFSESISISNAYLIMVDVIRESFSDYYQRIEYHEIK  149
           RN GGLAVV D GILN SLV+ +     SI + Y +M ++I   F D+ ++IE  EI
Sbjct:  87 VRNSGGLAVVLDSGILNLSLVLKEE--KGFSIDDGYELMYELICSMFQDHREQIEAREIV  144

Query: 150 NSYCPGNFDLSIAGRKFAGIAQRRIKKGIVVSIYLSVCGDQAARGQLIKDFYEAGTQGEV  209
           SYCPG++DLSI G+KFAGI+QRRI+ G+ V IYL V G   A R ++I+ FY+    G+
Sbjct: 145 GSYCPGSYDLSIDGKKFAGISQRRIRGGVAVQIYLCVSGSGAERAKMIRTFYDKAVAGQP  204

Query: 210 TKVNYPQIDPECMATLSELLETPFTVAEVLERLRLTLRQLGFSLTEKS              257
           TK  YP+I PE MA+LSELL  P  V++VL + +TL+Q G SL  +S
Sbjct: 205 TKFVYPRIKPETMASLSELLGQPHNVSDVLLKALMTLQQHGASLLTES              252
```

An alignment of the GAS and GBS proteins is shown below.

```
Identities = 155/275 (56%), Positives = 199/275 (72%), Gaps = 8/275 (2%)

Query:  32 QDLAQLPVSIFKDYVTDAQDAEKPFIWTEVFLREINRSNQEIILHIWPMTKTVILGMLDR   91
           +DLA LP+ ++ D      A   PF+WTEVFL+ IN+   ++ILHIWPNT+TVILGMLDR
Sbjct:  10 RDLASLPIFVYGDGNKKVPGALSPFVWTEVFLKTINQEPNQLILHIWPMTRTVILGMLDR   69

Query:  92 ELPHLELAKKEIISRGYEPVVRNFGGLAVVADEGILNFSLVIPDVFERKLSISDGYLIMV  151
           +LP+ ELAK EI + GY PV RN GGLAVVAD+GILNFSLVIPD F    +SIS+ YLIMV
Sbjct:  70 QLPYFELAKTEIGNNGYVPVTRNIGGLAVVADDGILNFSLVIPDHFSESISISNAYLIMV  129

Query: 152 DFIRSIFSDFYQPIEHFEVETSYCPGKFDLSINGKKFAGLAQRRIKNGIAVSIYLSVCGD  211
           D IR  FSD+YQ IE+ E++ SYCPG FDLSI G+KFAG+AQRRIK GI VSIYLSVCGD
Sbjct: 130 DVIRESFSDYYQRIEYHEIKNSYCPGNFDLSIAGRKFAGIAQRRIKKGIVVSIYLSVCGD  189

Query: 212 QKGRSQMISDFYKIGLGDTGSPIAYPNVDPEIMANLSDLLDGPMTVEDVIDRMLISLKQV  271
           Q  R Q+I DFY+ G    + + YP +DPE MA LS+LL+ P TV +V++R+ ++L+Q+
Sbjct: 190 QAARGQLIKDFYSAGTQGEVTKVNYPQIDPECMATLSELLETPFTVAEVLERLRLTLRQL  249

Query: 272 GFN------DRLLNIRPDLVAEFNRFQAKSMANKG                           300
           GF+        D+ L+  D V  + Q   + +G
Sbjct: 250 GFSLTEKSPDQALLTNFDAV--YERMQLEVVRKEG                           282
```

A related GBS gene <SEQ ID 8951> and protein <SEQ ID 8952> were also identified. Analysis of this protein sequence reveals the following:

```
Lipop: Possible site: = -1 Crend: 10
McG: Discrim Score: 16.85
GvH: Signal Score (-7.5): -5.07
Possible site: 49
>>> Seems to have no N-terminal signal sequence
ALOM program count: 1 value: -0.22 threshold: 0.0
INTEGRAL    Likelihood = -0.22 Transmembrane 117-133 ( 117-133)
PERIPHERAL Likelihood =  0.47 73
modified ALOM score: 0.54

*** Reasoning Step: 3

----- Final Results -----
            bacterial membrane --- Certainty = 0.1086(Affirmative) < succ>
            bacterial outside  --- Certainty = 0.0000(Not Clear)  < succ>
          bacterial cytoplasm  --- Certainty = 0.0000(Not Clear)  < succ>
```

The protein has homology with the following sequences in the databases:

```
ORF01564(451-1116 of 1518)
EGAD|13388|BS3758(27-249 of 281) hypothetical 31.4 kd protein in pta 3'region
{Bacillus subtilis} OMNI|NTO1BS4391 hypothetical protein SP|P39648|YWFL_BACSU
HYPOTHETICAL 31.4 KDA PROTEIN IN PTA 3'REGION. GP|414014|emb|CAA51646.1||X73124 ipa-
90d {Bacillus subtilis} GP|2636300|emb|CAB15791.1||Z99123 alternate gene name: ipa-
90d{Bacillus subtilis} PIR|S39745|S39745 ywfL protein-Bacillus subtilis
% Match = 15.8
% Identity = 40.8 % Similarity = 61.0
Matches  = 91  Mismatches - 82  Conservative Sub.s = 45
       321       351       381       411       441       471       501       531
*WNLRETYWKISSDCDKINLAEFSRERMSDLLEWQDLAQLPVSIFKDYVTDAQDAEKPFIWTEVFLREINRSNQEIILHI
                                        ||::|   ::   : :
                             MANQPIDLLMQPKWRVIDQSSLGPLFDAKQSFAMDDTLCMSVGKGVSPATARS
                                   10        20        30        40        50

561       591       621       651       681       711       738       768
WPMTKTVILGMLDRELPHLELAKKEIISRGYEPVVRNFGGLAVVADEGILNFSLVIPDVFERK-LSISDGYLIMVDFIRS
|    |::||: |   ||| |:    :  |  || :||| |||||| |::|:|| ||:  |   |:|: :  ||   ||:::|
WVHHDTIVLGIQDTRLPFLQDGISLLESEGYRVIVRNSGGLAVVLDDGVLNISLIFED--EKKGIDIDKGYEAMVELMRR
        70        80        90       100       110       120       130

798       828       858       888       918       972       996
IFSDFYQPIEHFEVETSYCPGKFDLSINGKKFAGLAQRRIKNGIAVSIYLSVCGDQKG--RSQMISDFYKIGLGD--TGS
::   :    || :|:|  |||||   :|||||||||||::|||:: |:||   ||   |  | |: :||:  ||
MLRPYNAKIEAYEIEGSYCPGSYDLSINGKKFAGISQRRVRGGVAVQIYL--CADKSGSERADLIRRFYQAALKDKQNDK
        150       160       170       180       190       200

1026      1056      1086      1116      1146      1176      1206      1236
PIAYPNVDPEIMANLSDLLDCPMTVEDVIDRMLISLKQVGFNDRLLMIRPDLVAEFNRFQAKSMANKGMVSRDE*CPR*F
   || : ||  ||:||:||   ::|:|::   :|  || :
KGVYPEIRPETMASLSELLQKDISVQDLMFALLTELKALSTHLYSAGLSIDEEMEFEKNLVRMAERNAKVFG
        220       230       240       250       260       270       280
```

SEQ ID 8952 (GBS390) was expressed in *E. coli* as a His-fusion product. SDS-PAGE analysis of total cell extract is shown in FIG. 73 (lane 7; MW 37 kDa). It was also expressed in *E. coli* as a GST-fusion product. SDS-PAGE analysis of total cell extract is shown in FIG. 82 (lane 3; MW 62 kDa).

GBS390-GST was purified as shown in FIG. 216, lane 12.

Based on this analysis, it was predicted that these proteins and their epitopes could be useful antigens for vaccines or diagnostics.

EXAMPLE 1998

A DNA sequence (GBSx2108) was identified in *S. agalactiae* <SEQ ID 6173> which encodes the amino acid sequence <SEQ ID 6174>. This protein is predicted to be probable trimethylamine dehydrogenase (nemA). Analysis of this protein sequence reveals the following:

```
Possible site: 36
>>> Seems to have no N-terminal signal sequence

----- Final Results -----
         bacterial cytoplasm ---- Certainty = 0.2218(Affirmative) < succ>
         bacterial membrane  ---- Certainty = 0.0000(Not Clear)  < succ>
         bacterial outside   ---- Certainty = 0.0000(Not Clear)  < succ>
```

The protein has homology with the following sequences in the GENPEPT database.

```
>GP:CAA83700 GB:Z33015 similar to trimethylamine DH [Mycoplasma capricolum]
Identities = 162/311 (52%), Positives = 219/311 (70%), Gaps = 1/311 (0%)

Query:    3 NVQGNLFRPLTLPNGLSLENRFVLSPMVTNSSTSEGFVTDDDIAYAVRRAKSAPLQITGA    62
            N    LF P  L NG  LENRFVLSPM  + +T +G +TD +   Y  RR+ SAPLQITG
Sbjct:    2 NKYEKLFEPFYL-NGWKLENRFVLSPMTLSLATLDGKITDKEADYVKRRSHSAPLQITGG   60

Query:   63 AYITEYGQLFEYGFSVSKDEDIPGLTKLAKANKSKGAKAVLQLTHAGRFSSHTLARHGYV   122
              Y E+GQLFEYG S   D+DIP LT+L + MK+      +LQL HAG+WS   +L ++GY+
Sbjct:   61 VYFDEFGQLFEYGISAKSDDDIPSLTRLYQEMKTDSNCVILQLAHAGKFSKTSLKKYGYL   120

Query:  123 YGPSPMQLQSPYPHQVKELTHKDILRIIDEYVQATRRAIQAGFDGVEISSAQRLLIQTFF   182
              YGPS  +  +P  H+V EL   + I +II +Y  AT R I+AGF+G++EIS AQRLLIQTFF
Sbjct:  121 YGPSYEKNNTPIEHEVLELPKEKIKQIIQDYKDATLRVIKAGFNGIEISMAQRLLIQTFF   180

Query:  183 STFSNQRKOEYGPQTLTNRCRLGLEVFKAVQKVIREEAESDFILGFRATPEETRGSQIGY   242
              S    N+R DEY      NR R   LEV KA+++VI + A   +FI GFRATPEET G   +GY
Sbjct:  181 SQIIMKRTDEYSATNFENRSRFCLEVVKAIREVIDKYAPKNFIFGFRATPEETYGDILGY   240

Query:  243 SIEEFMEFLEKILAIAQVDYLAIASWGHDVFRNTIRSEGVYKGQLVNQVIFEHFGDRVPI   302
              +IE+F++  ++KI+  I  ++  YLAIASWGMD++  N  +RS    YKGQLVN+VI++ +  +++PI
Sbjct:  241 TIEDFIQLVDKIIEIGKISYLAIASWGHDIYLMKVRSMTKYKGQLVNKVIYDIYKNLPI   300

Query:  303 MATGGINSASK                                                   313
               +++GGIN+  +K
Sbjct:  301 ISSGGINTPTK                                                   311
```

A related DNA sequence was identified in *S. pyogenes* <SEQ ID 6175> which encodes the amino acid sequence <SEQ ID 6176>. Analysis of this protein sequence reveals the following:

```
Possible site: 35
>>> Seems to have no N-terminal signal sequence

----- Final Results -----
           bacterial cytoplasm  --- Certainty = 0.3055(Affirmative) < succ>
           bacterial membrane   --- Certainty = 0.0000(Not Clear)   < succ>
            bacterial outside   --- Certainty = 0.0000(Not Clear)   < succ>
```

An alignment of the GAS and GBS proteins is shown below.

```
Identities = 265/390 (67%), Positives = 321/390 (81%)

Query:    8 LFRPLTLPNGLSLENRFVLSPMVTNSSTSEGFVTDDDIAYAVRRAKSAPLQITGAAYITE    67
            L E PLTLPNG L+NRFVLSPMVTNSST +G+VT DD++YA+RRA SAPLQITGAAY+
Sbjct:    8 LFEPLTLPNGSQLDNRFVLSPMVTNSSTKDGYVTQDDVSYALRRAASAPLQITGAAYVDP   67

Query:   68 YGQLFEYGFSVSKDEDIPGLTKLAKAMKSKGAKAVLQLTHAGRESSHTLARHGYVYGPSP   127
            YGQLFEYGFSV+KD DI GL +LA+AMK+KGAKAVLQLTHAGRF+SH L  ++G+VYGPS
Sbjct:   68 YGQLFEYGFSVTKDADISGLKELAQAMKAKGAKAVLQLTHAGRFASHALTKYGFVYGPSY   127

Query:  128 MQLQSPYPHQVKELTHKDILRIIDEYVQATRRAIQAGFDGVEISSAQRLLIQTFFSTFSN   187
            MQL+SP PH+VK LT + I  +I  Y QATRRAIQAGFDGVE+SSAQRLLIQTFFSTFSN
Sbjct:  128 MQLRSPQPHEVKPLTGQQIEELIAAYAQATRRAIQAGFDGVEVSSAQRLLIQTFFSTFSN   187

Query:  188 QRKDEYGPQTLTNRCRLGLEVFKAVQKVIREEAESDFILGFRATPEETRGSQIGYSIEEF   247
            +R D YG QTL  HR +L L V +AVQ+VI++EA   FI GFRATPEETRG+ IGYSI+EF
Sbjct:  188 KRTDSYGCQTLFNRSKLTLAVLQAVQQVIKQEAPDGFIFGFRATPEETRGNDIGYSIDEF   247

Query:  248 MEFLEKILAIAQVDYLAIASWGHDVFRNTIRSEGVYKGQLVNQVIFEHFGDRVPIMATGG   307
              ++ ++ +L +A+++DYLAIASWG  VFRNT+RS G Y G+ VNQV+ ++   +++P+MATGG
Sbjct:  248 LQLMDWVLNVAKLDYLAIASWGRHVFRNTVRSPGPYYGRRVNQVVRDYLRHKLPVMATGG   307

Query:  308 INSASKVFEALQHAHMIGASTPLVVDPEFLQKIKAKCSDQINLRIKVSDLEGLAIPKASF   367
            +N+   K  EAL HA    IG STP VVDPEF  KIK  C +  I+LRI+ +DL+  LAIP+ASF
Sbjct:  308 MNTPDKAIEALAHADFIGVSTPFVVDPEFAHKIKEGCEESIHLRIRPADLKSLAIPQASF   367

Query:  368 KDIVPLMDYGESLPKEAREVFRELRSNYRE                                397
            KDIVPLMDYGESLPKE+R +FR L  NY+E
Sbjct:  368 KDIVPLMDYGESLPKESRTLFRSLTHNYKE                                397
```

Based on this analysis, it was predicted that these proteins and their epitopes could be useful antigens for vaccines or diagnostics.

EXAMPLE 1999

A DNA sequence (GBSx2109) was identified in *S. agalactiae* <SEQ ID 6177> which encodes the amino acid sequence <SEQ ID 6178>. Analysis of this protein sequence reveals the following:

```
Possible site: 53
>>> Seems to have no N-terminal signal sequence

----- Final Results -----
            bacterial cytoplasm --- Certainty = 0.3748(Affirmative) < succ>
            bacterial membrane  --- Certainty = 0.0000(Not Clear)   < succ>
             bacterial outside  --- Certainty = 0.0000(Not Clear)   < succ>
```

The protein has homology with the following sequences in the GENPEPT database.

```
>GP:BAB04594 GB:AP001510 unknown conserved protein [Bacillus halodurans]
Identities = 121/333 (36%), Positives = 192/333 (57%), Gaps = 12/333 (3%)

Query:   1 MKLSVLDYGLIDYGKTASDAIQETILLSQEAERLGYHQFWVAEHHGVKAFSISNPELMIM    60
           MKLSVLD   I YG  A +A+++T  L++   E LGYH+FWV+EHH       +S+PE++I
Sbjct:   1 MKLSVLDQSPIAYGSNAKEALRQTTELAKVTEALGYHRFWVSEHHDASTLAGSSPEVLIA   60

Query:  61 HLANQTKSIKIGSGGINPLHYSSFKLAETLKTLSTCHPNRVSIGLGNSLGTVKVSNALRS  120
           HLA  TK I++GSGG+M  HYS++K+AE  K LE  HP R+ +GLG + G + ++
Sbjct:  61 HLAAHTKKIRLGSGGVMLPHYSAYKVAENFKLLEALHPGRIDVGLGRAPGGMPIAKMALQ  120

Query: 121 LHK---AHDYEEVLEELKSWLIDESSSKEPL----VQPTLSSFPDLYVLGSGQKSAYLAA  173
            K    HY    ++++ +L D+  +           P + + PD+++LGS   SA +AA
Sbjct: 121 EGKEQNIHKYPLQVKDVIGYLQDDLPTDHRFHGLKATPLIDTVPDVWLLGSSGGSANVAA  180

Query: 174 KLGLGFTFGVFPFMDKDPLTEAKKLSSLYYHQFEEYYPNKSPNLMVAAFVVIADTSEEAE  233
           + G GF F     F++ +   +A +    Y  F+      P  VA FV+ ADT E+A+
Sbjct: 181 ENGTGFAFA--HFINGEGGVQAVE---SYRETFQPSALFDRPQTSVAIFVICADTDEQAD  235

Query: 234 NIAKTLDIWMLGNKDFNFATFPTIEEANHYQLTPEQKAKIKSNRDRMIVGDPKQVKESL   293
            IA +LD+ ++  ++        P+IE A  Y  +P ++A+I+  NR RMIVG PK V++ L
Sbjct: 236 QIASSLDLSLIMLENGQLSKGTPSIESALSYPYSPFERARIRENRKRMIVGSPKAVRQQL   295

Query: 294 DALVNASQAEELLLIPLVPGLDQRIKSLKLLSQ                            326
            L  A + EE++++ +     + RI+S +LL +
Sbjct: 296 VELARAYETEEVIVVTITHREEDRIRSYELLGE                            328
```

A related DNA sequence was identified in *S. pyogenes* <SEQ ID 6179> which encodes the amino acid sequence <SEQ ID 6180>. Analysis of this protein sequence reveals the following:

```
Possible site: 51
>>> Seems to have no N-terminal signal sequence
INTEGRAL Likelihood = -2.60 Transmembrane 212-228 ( 210-229)

----- Final Results -----
            bacterial membrane  --- Certainty = 0.2041(Affirmative) < succ>
             bacterial outside  --- Certainty = 0.0000(Not Clear)   < succ>
            bacterial Cytoplasm --- Certainty = 0.0000(Not Clear)   < succ>
```

An alignment of the GAS and GBS proteins is shown below.

```
Identities = 173/329 (52%), Positives = 241/329 (72%), Gaps = 1/329 (0%)

Query:   1 MKLSVLDYGLIDYGKTASDAIQETILLSQEAERLGYHQFWVAEHHGVKAFSISNPELMIM    60
           MK+S+LDYG+ID  KT  +A+ ET  L+Q A++LG+H+FWVAEHH + AF+IS+PEL++M
Sbjct:   1 MKVSILDYGVIDKEKTPQEALLETRCLAQVADKLGFHRFWVAEHHNIYAFAISSPELLMM   60
```

-continued

```
Query:  61 HLANQTKSIKIGSGGIMPLHYSSFKLAETLKTLETCHPNRVSIGLGNSLGTVKVSNALRS  120
           HLA+ TK I+IGSGGIMPLHYSSFK+AE + TLE  HPNR+ +G+GNSLGT  V   AL S
Sbjct:  61 HLADHTKQIRIGSGGIMPLHYSSFKIAEWIMTLEALHPNRIDLGIGNSLGTTLVQRALSS  120

Query: 121 LHKAHDYEEVLEELKSWLIDESSSKEPL-VQPTLSSFPDLYVLGSGQKSAYLAAKLGLGF  179
           +H    Y +V+ EL  +L  +  S  P+ V P  +++P ++ L +  ++A LA +LGLG+
Sbjct: 121 IHCKDSYSQVVTELYQYLNPDHLSPLPIFVNPRGNTYPQIWTLSNSLETAELAGQLGLGY  180

Query: 180 TFGVFPFMDKDPLTEAKKLSSLYYHQFEEYYPNKSPNLMVAAFVVIADTSEEAENIAKTL  239
           TFG+FP++ KDP+TEAK++S+ Y    F       K P L++A F+V++DT E+AE +AK L
Sbjct: 181 TFGIFPYIPKDPITEAKRVSAHYRKAFRPSKLLKIPKLILAVFIVLSDTDEKAEALAKPL  240

Query: 240 DIWMLGNKDFNEFATFPTIEEANHYQLTPEQKAKIKSNRDRMIVGDPKQVKESLDALVNA  299
           DIWMLG +DFNEF T+P +EEA +Y LT +Q+   I +NR RM++G P   VK+ LD L+ A
Sbjct: 241 DIWMLGQQDFNEFKTYPDVEEARNYHLTEKQREAIAANRSRMVIGSPHTVKKQLDRLIEA  300

Query: 300 SQAEELLLIPLVPGLDQRIKSLKLLSQLY                                328
           QA+ELL IPLVP    R ++L+LL+ LY
Sbjct: 301 CQADELLAIPLVPEFANRQRTLELLADLY                                329
```

Based on this analysis, it was predicted that these proteins and their epitopes could be useful antigens for vaccines or diagnostics.

EXAMPLE 2000

A DNA sequence (GBSx2110) was identified in *S. agalactiae* <SEQ ID 6181> which encodes the amino acid sequence <SEQ ID 6182>. Analysis of this protein sequence reveals the following:

```
Possible site: 60
>>> Seems to have no N-terminal signal sequence

----- Final Results -----
          bacterial cytoplasm --- Certainty = 0.2384(Affirmative) < succ>
           bacterial membrane --- Certainty = 0.0000(Not Clear)   < succ>
            bacterial outside --- Certainty = 0.0000(Not Clear)   < succ>
```

The protein has homology with the following sequences in the GENPEPT database.

```
>GP: AAF81345 GB: AC007767 Identical to a glycine cleavage system
H-protein precursor from Arabidopsis thaliana gb|P25855.
It contains a glycine cleavage H-protein domain
PF|01597. ESTs gb|R90208, gb|AI
Identities = 30/91 (32%), Positives = 53/91 (57%), Gaps = 1/91 (1%)

Query:  18 TISLTPELQDDLGTVGYVEFTD-DANLEVDDVILNIEASKTVMAILSPLTGKVVKVNTAA   76
           TI +T   QD LG V +VE +   ++++ +       +E+ K     ILSP++G+V++VNT
Sbjct:  59 TIGITDHAQDHLGEVVFVELPEANSSVSKEKSFGAVESVKATSEILSPISGEVIEVNTKL  118

Query:  77 SQEPTLLNSEKADENWLVVLTEVDYAAFEAL                              107
           ++ P L+NS   ++ W++ +      A  EAL
Sbjct: 119 TESPGLINSSPYEDGWMIKVKPSSPAELEAL                              149
```

A related DNA sequence was identified in *S. pyogenes* <SEQ ID 6183> which encodes the amino acid sequence <SEQ ID 6184>. Analysis of this protein sequence reveals the following:

```
Possible Site: 60
>>> Seems to have no N-terminal signal sequence

----- Final Results -----
          bacterial cytoplasm --- Certainty = 0.3544(Affirmative) < succ>
           bacterial membrane --- Certainty = 0.0000(Not Clear)   < succ>
            bacterial outside --- Certainty = 0.0000(Not Clear)   < succ>
```

An alignment of the GAS and GBS proteins is shown below.

```
Identities = 80/110 (72%), Positives = 98/110 (88%)

Query:    1 MKKIANYLLIEKNEELYTISLTPELQDDLGTVGYVEFTDDANLEVDDVILNIEASKTVMA    60
            MKKIANYLLIEK ++ YTIS+TPELQDD+GT+GY EFTD+ +L VDD+ILN+EASKTVM+
Sbjct:    1 MKKIANYLLIEKTDDRYTISMTPELQDDIGTIGYAEFTDNDHLAVDDIILNLEASKTVMS    60

Query:   61 ILSPLTGKVVKVNTAASQEPTLLNSEKADENWLVVLTEVDYAAFEALENA           110
            +LSPL G VV+ N AA+   PTLLNSEKA+ENW+VVLT+VD AAF+ALE+A
Sbjct:   61 VLSPLAGAVVERNEAATLTPTLLNSEKAEENWIVVLTDVDQAAFDALEDA           110
```

Based on this analysis, it was predicted that these proteins and their epitopes could be useful antigens for vaccines or diagnostics.

EXAMPLE 2001

A DNA sequence (GBSx2111) was identified in *S. agalactiae* <SEQ ID 6185> which encodes the amino acid sequence <SEQ ID 6186>. This protein is predicted to be LRP16 (b1045). Analysis of this protein sequence reveals the following:

```
Possible site: 17
>>> Seems to have no N-terminal signal sequence

----- Final Results -----
              bacterial cytoplasm --- Certainty = 0.0608(Affirmative) < succ>
              bacterial membrane  --- Certainty = 0.0000(Not Clear)   < succ>
              bacterial outside   --- Certainty = 0.0000(Not Clear)   < succ>
```

The protein has homology with the following sequences in the GENPEPT database.

```
>GP: AAF15294 GB: AF202922 LRP16 [Homo sapiens]
Identities = 73/171 (42%), Positives = 98/171 (56%), Gaps = 13/171 (7%)

Query:   88 DICLLQVDAIVNAANSKLLGCFIPNHHCIDNQIHTFAGSRLRLACHQLMTQQGRMEAVGQ   147
            DI  L+VDAIVNAANS LLG      +D IH AG  L   C  L +  +      G+
Sbjct:   78 DITKLEVDAIVNAANSSLLG-----GGGVDGCIHRAAGPLLTDECRTLQSCK-----TGK   127

Query:  148 AKLTESYHLPCKYVIHTVGPYVKVDQKPSRIREDLLKSSYKSCLQLAVRANLKTIVFPCI   207
            AK+T  Y LP KYVIHTVGP      +  S+  E  L+S Y S L L +   L+++ FPCI
Sbjct:  128 AKITGGYRLPAKYVIHTVGPIAYGEPSASQAAE--LRSCYLSSLDLLLEHRLRSVAFPCI   185

Query:  208 STGEFGFPNQRAAELAVQAILEWQRENQHKL-YIIFNTFTPKDQDIYQKLL           257
            STG FG+P + AAE+ +  + EW  +++ K+ +I   F  KD+DIY+  L
Sbjct:  186 STGVFGYPCEAAAEIVLATLREWLEQHKDKVDRLIICVFLEKDEDIYRSRL          236
```

A related DNA sequence was identified in *S. pyogenes* <SEQ ID 6187> which encodes the amino acid sequence <SEQ ID 6188>. Analysis of this protein sequence reveals the following:

```
Possible site: 25
>>> Seems to have no N-terminal signal sequence

----- Final Results -----
              bacterial cytoplasm --- Certainty = 0.1992(Affirmative) < succ>
              bacterial membrane  --- Certainty = 0.0000(Not Clear)   < succ>
              bacterial outside   --- Certainty = 0.0000(Not Clear)   < succ>
```

An alignment of the GAS and GBS proteins is shown below.

```
Identities = 139/266 (52%), Positives = 178/266 (66%), Gaps = 6/266 (2%)

Query:    1 MPNQKQLLLAMIEYLQSEKLTDVDDL----RTTDLQTVWRGLVNQQDPQNISQEYLSLED    56
            MP+    LL  MI  LQ+E+LT          T Q +WR L+NQ+     +S++YL+LED
Sbjct:    1 MPSSFDLLGEMIGLLQTEQLTSSWACPLPNALTKRQDLWRALINQRPALPLSKDYLNLED    60
```

-continued

```
Query:   57 RYLSHWWNTQKVKTIDVCHQTVYSNVFTYHGDICLLQVDAIVNAANSKLLGCFIPNHHCI 116
            YL W  +    ++  C +T Y+++F YHGDI L VDAIVNAANS+LLGCF PNH CI
Sbjct:   61 AYLDDWRASFVPVSVKDCQKTNYTSLFLYHGDIRYLAVDAIVNAANSELLGCFSPNHGCI 120

Query:  117 DNQIHTFAGSRLRLACHQLMTQQGRMEAVGQAKLTESYHLPCKYVIHTVGPYVKVDQKPS 176
            DN IHTFAGSRLRLAC +MT+QGR EA+GQAKLT +YHLP  Y+IHTVGP +        S
Sbjct:  121 DNAIHTFAGSRLRLACQAIMTEQGRKEAIGQAKLTSAYHLPASYIIHTVGPRITKGHHVS 180

Query:  177 RIREDLLKSSYKSCLQLAVRANLKTIVFPCISTGEFGFPNQRAAELAVQAILEWQRENQH 236
            IR DLL   Y+S L LAV+A L ++ F  ISTGEFGFP + AA++A++ +L+WQ E+
Sbjct:  181 PIRADLLARCYRSSLDLAVKAGLTSLAFCSISTGEFGFPKKEAAQIAIKTVLKWQAEHPE 240

Query:  237 K--LYIIFNTFTPKDQDIYQKLLLKE                                  260
               L  IFNTFT +D+ +Y   L KE
Sbjct:  241 SKTLTTIFNTFTSEDKALYDTYLQKE                                  266
```

Based on this analysis, it was predicted that these proteins and their epitopes could be useful antigens for vaccines or diagnostics.

EXAMPLE 2002

A DNA sequence (GBSx2112) was identified in *S. agalactiae* <SEQ ID 6189> which encodes the amino acid sequence <SEQ ID 6190>. Analysis of this protein sequence reveals the following:

```
Possible site: 41
>>> Seems to have no N-terminal signal sequence

----- Final Results -----
            bacterial cytoplasm --- Certainty = 0.2171(Affirmative) < succ>
             bacterial membrane --- Certainty = 0.0000(Not Clear)  < succ>
              bacterial outside --- Certainty = 0.0000(Not Clear)  < succ>
```

The protein has no significant homology with any sequences in the GENPEPT database.

A related DNA sequence was identified in *S. pyogenes* <SEQ ID 6191> which encodes the amino acid sequence <SEQ ID 6192>. Analysis of this protein sequence reveals the following:

```
Possible site: 41
>>> Seems to have no N-terminal signal sequence

----- Final Results -----
            bacterial cytoplasm --- Certainty = 0.2477(Affirmative) < succ>
             bacterial membrane --- Certainty = 0.0000(Not Clear)  < succ>
              bacterial outside --- Certainty = 0.0000(Not Clear)  < succ>
```

An alignment of the GAS and GBS proteins is shown below.

```
Identities = 218/284 (76%), Positives = 250/284 (87%)

Query:    4 WKTLEKTNHSQSEILSQLIEESDAIVVGIGAGMSAADGFTYIGPRFEEAFPDFIAKYQLL  63
            W T  + N +Q+E L+QLI+E+DA+VVGIGAGMSAADGFTYIG RFE AFPDFIAKYQ L
Sbjct:    4 WTTYPQKNLTQAEQLAQLIKEADALVVGIGAGMSAADGFTYIGSRFETAFPDFIAKYQFL  63

Query:   64 DMLQASLYDFEDWEEYWAFQSRFVALNYLDQPVGQAYLDLKDILAKKEYHIITTNADNAF 123
            DMLQASL+DFEDW+EYWAFQSRFVALNYLDQPVGQ+YLDLK+IL   K+YHIITTNADNAF
Sbjct:   64 DMLQASLFDFEDWQEYWAFQSRFVALNYLDQPVGQSYLDLKEILGTKDYHIITTNADNAF 123

Query:  124 AVADYNLEKVFHIQGEYGLWQCSQHCHQQTYRNDQAIRQMIAQQKDMKIPSNLIPKCPKC 183
              VA Y+   +FHIQGEYGLWQCSQHCHQQTY++D  IRQMIA+QK+MK+P  LIP CP+C
Sbjct:  124 WVAGYDPHNIFHIQGEYGLWQCSQHCHQQTYKDDTVIRQMIAEQKNMKVPGGLIPHCPEC 183

Query:  184 DQPFEINKRNEEKGMVEDADFHAQRQRYENFLSQHQNDKVLYLEIGVGHTTPQFIKHPFW 243
              + PFEINKRNEEKGMVEDADFHAQ+ RYE FLS+H+  KVLYLEIGVGHTTPQFIKHPFW
Sbjct:  184 EAPFEINKRNEEKGMVEDADFHAQKARYEAFLSEHKEGKVLYLEIGVGHTTPQFIKHPFW 243
```

```
                                   -continued
Query:  244 RFVSLNENSLFVTLNHKHYRIPQKIRSRSVQLTQHIAELIAEAK       287
            + VS N N+LFVTLNHKHYRIP  IR +S++LT+HIA+LI+  K
Sbjct:  244 KRVSENPNALFVTLNHKHYRIPLSIRRQSLELTEHIAQLISATK       287
```

Based on this analysis, it was predicted that these proteins and their epitopes could be useful antigens for vaccines or diagnostics.

EXAMPLE 2003

A DNA sequence (GBSx2113) was identified in *S. agalactiae* <SEQ ID 6193> which encodes the amino acid sequence <SEQ ID 6194>. Analysis of this protein sequence reveals the following:

```
Possible site: 21
>>> Seems to have no N-terminal signal sequence

----- Final Results -----
            bacterial cytoplasm --- Certainty = 0.1086(Affirmative) < succ>
            bacterial membrane  --- Certainty = 0.0000(Not Clear)   < succ>
            bacterial outside   --- Certainty = 0.0000(Not Clear)   < succ>
```

The protein has homology with the following sequences in the GENPEPT database.

```
>GP: CAB12865 GB: Z99109 similar to lipoate-protein ligase
[Bacillus subtilis]
Identities = 130/331 (39%), Positives = 206/331 (61%), Gaps = 5/331 (1%)

Query:    9 NGKRITDGAIALAMQVYILQNVFLDDDILFPYYCDPKVEIGKFQNAVIETNQEYLKEHDI    68
            + + I D  I LA++ Y ++++  +   L  Y   P + IGK QN + E N +Y++E+ I
Sbjct:    5 DNQNINDPRINLAIEEYCVKHLDPEQQYLLFYVNQPSIIIGKNQNTIEEINTKYVEENGI    64

Query:   69 PVVRRDTGGGAVYVDSGAVNICYLMKDHGQ-FGDFKRAYEPAIKALKTLGASSVEMRERN   127
            VVRR +GGGAVY D G +N  ++ KD G  F +FK+  EP I+AL  LG + E+   RN
Sbjct:   65 IVVRRLSGGGAVYHDLGNLNFSFITKDDGDSFHNFKKFTEPVIQALHQLGVEA-ELSGRN   123

Query:  128 DLVIDGKKVSGAAMTIVNGRIYGGYSLLLDVDVDAMEKVLNPNRKKIESKGIKSVRSRVG   187
            D+V+DG+K+SG A    GRI+  +L+ D  D +   L   + KIESKGIKS+RSRV
Sbjct:  124 DIVVDGRKISGNAQFATKGRIFSHGTLMFDSAIDHVVSALKVKKDKIESKGIKSIRSRVA   183

Query:  188 DIRSHLSEDYRHITTDQFKDLMVCQLLHIDHIDQAKRYHLTEKDWAAIDALADEKYKNWD   247
            +I   L +     +TT++F+  ++  + + +        Y LTEKDW  I  ++ E+Y+NWD
Sbjct:  184 NISEFLDDK---MTTEEFRSHLLRHIFNTNDVGNVPEYKLTEKDWETIHQISKERYQNWD   240

Query:  248 WNYGNSPQYSYHRDARFPSGTYDFHLEIEKGIITNCRIYGDFFSSKDISDIENLLIGCPM   307
            WNYG SP+++ +   R+P G+ D HLE++KG I +C+I+GDFF   D+S+IENLL+G
Sbjct:  241 WNYGRSPRFNLNHSKRYPVGSIDLHLEVKKGKIEDCKIFGDFFGVGDVSEIENLLVGKQY   300

Query:  308 KEELVLEKLSTLSLEDYFGQTSPEEIKAVLF                              338
            +   ++ + L  ++L+  YFG   E+    +++
Sbjct:  301 ERSVIADVLEGVNLKHYFGNITKEDFLDLIY                              331
```

A related DNA sequence was identified in *S. pyogenes* <SEQ ID 6195> which encodes the amino acid sequence <SEQ ID 6196>. Analysis of this protein sequence reveals the following:

```
Possible site: 21
>>> Seems to have no N-terminal signal sequence

----- Final Results -----
            bacterial Cytoplasm --- Certainty = 0.0939(Affirmative) < succ>
            bacterial membrane  --- Certainty = 0.0000(Not Clear)   < succ>
            bacterial outside   --- Certainty = 0.0000(Not Clear)   < succ>
```

An alignment of the GAS and GBS proteins is shown below.

```
Identities = 248/339 (73%), Positives = 283/339 (83%)

Query:    1 MYLIEPIRNGKRITDGAIALAMQVYILQNVFLDDDILFPYYCDPKVEIGKFQNAVIETNQ    60
            MYLIEPIRNGKRITDGA+ALAMQVY+ +N+FLDDDILFPYYCDPKVEIGKFQNAV+ETNQ
Sbjct:    1 MYLIEPIRNGKRITDGAVALAMQVYVQENLFLDDDILFPYYCDPKVEIGKFQNAVVETNQ    60
```

```
Query:   61 EYLKEHDIPVVRRDTGGGAVYVDSGAVNICYLMKDHGQFGDFKRAYEPAIKALKTLGASS  120
            EYLKEH IPVVRRDTGGGAVYVDSGAVNICYL+ D+G FGDFKR Y+PAI+AL  LGA+
Sbjct:   61 EYLKEHHIPVVRRDTGGGAVYVDSGAVNICYLINDNGIFGDFKRTYQPAIEALHHLGATE 120

Query:  121 VEMRERNDLVIDGKKVSGAAMTIVNGRIYGGYSLLLDVDFDAMEKVLNPNRKKIESKGIK  180
            VEM  RNDLVIDGKKVSGAAMTI NGR+YGGYSLLLDVDF+AMEK L PNRKKIESKGI+
Sbjct:  121 VEMSGRNDLVIDGKKVSGAAMTIANGRVYGGYSLLLDVDFEAMEKALKPNRKKIESKGIR 180

Query:  181 SVRSRVGDIRSHLSEDYRHITTDQFKDLMVCQLLHIDHIDQAKRYHLTEKDWAAIDALAD  240
            SVRSRVG+IR HL+  Y+ IT ++FKDLMVCQLL I+ I QAKRY LTEKDW  IDAL +
Sbjct:  181 SVRSRVGNIREHLAPQYQGITIEEFKDLMVCQLLQIETISQAKRYDLTEKDWQQIDALTE 240

Query:  241 EKYKNWDWNYGNSPQYSYHRDARFPSGTYDFHLEIEKGIITNCRIYGDFFSSKDISDIEN  300
            KY NW+WNYGN+PQY YHRD RF  GT D HL+I+KG I  CRIYGDFF   DI+++E
Sbjct:  241 RKYHNWEWNYGNAPQYRYHRDGRFTGGTVDIHLDIKKGYIAACRIYGDFFGKADIAELEG 300

Query:  301 LLIGCPMKEELVLEKLSTLSLEDYFGQTSPEEIKAVLFS                      339
            LIG  M++E VL  L+ + L  Y G  + EE+   ++FS
Sbjct:  301 HLIGTRMEKEDVLATLNAIDLAPYLGAITAEELGDLIFS                      339
```

Based on this analysis, it was predicted that these proteins and their epitopes could be useful antigens for vaccines or diagnostics.

EXAMPLE 2004

A DNA sequence (GBSx2114) was identified in *S. agalactiae* <SEQ ID 6197> which encodes the amino acid sequence <SEQ ID 6198>. Analysis of this protein sequence reveals the following:

```
Possible site: 17
>>> Seems to have no N-terminal signal sequence
     INTEGRAL     Likelihood = -1.49     Transmembrane    196-212 (196-212)

----- Final Results -----
              bacterial membrane --- Certainty = 0.1595(Affirmative) < succ>
              bacterial outside  --- Certainty = 0.0000(Not Clear)  < succ>
              bacterial cytoplasm --- Certainty = 0.0000(Not Clear)  < succ>
```

The protein has homology with the following sequences in the GENPEPT database.

```
>GP: AAB49329 GB: U39612 formyl-tetrahydrofolate synthetase
[Streptococcus mutans]
Identities = 432/556 (77%), Positives = 493/556 (87%)

Query:    1 MKTDIEIAQSVALKPIAEIVEQVGIGFDDIELYGKYKAKLSFDKIEAVKSQKVGKLILVT   60
            MKTDIEIAQSV L+PI  +V+++GI FDD+ELYGKYKAKL+FDKI+AV+   GKL+LVT
Sbjct:    1 MKTDIEIAQSVDLRPITNVVKKLGIDFDDLELYGKYKAKLTFDKIKAVEENAPGKLVLVT   60

Query:   61 AINPTPAGEGKSTMSIGLADALNKIGKKTMIALREPSLGPVMGIKGGAAGGGYAQVLPME  120
            AINPTPAGEGKST++IGLADALNKIGKKTMIA+REPSLGPVMGIKGGAAGGGYAQVLPME
Sbjct:   61 AINPTPAGEGKSTITIGLADALNKIGKKTMIAIREPSLGPVMGIKGGAAGGGYAQVLPME 120

Query:  121 DINLHFTGDMHAITTANNALSALLDNHIHQGNELDIDQRRVIWKRVVDLNDRALRQVIVG  180
            DINLHFTGDMHAITTANNALSAL+DNH+HQGNEL IDQRR+IWKRVVDLNDRALR V VG
Sbjct:  121 DINLHFTGDMHAITTANNALSALIDNHLHQGNELGIDQRRIIWKRVVDLNDRALRHVTVG 180

Query:  181 LGSPVNGIPREDGFDITVASEIMAILCLATDLSDLKKRLSNIVVAYSRNRKPIYVKDLKI  240
            LGSP+NGIPR+DGFDITVASEIMAILCLAT++ DLK+RL+NIV  Y   +R P+YV+DL++
Sbjct:  181 LGSPINGIPREDGFDITVASEIMAILCLATNVEDLKERLANIVIGYRFDRSPVYVRDLEV 240

Query:  241 EGALTLILKDTIKPNLVQTIYGTPALVHGGPFANIAHGCNSVLATSTALRLADYVVTEAG  300
            +GAL LILK+ IKPNLVQTIYGTPA VHGGPFANIAHGCNSVLATSTALRLADY +TEAG
Sbjct:  241 QGALALILKEAIKPNLVQTIYGTPAFVHGGPFANIAHGCNSVLATSTALRLADYTITEAG 300

Query:  301 FGADLGAEKFLDIKTPNLPTSPDAIVIVATLRALKMHGGVSKEDLSQENVEAVKRGFTNL  360
            FGADLGAEKFLDIK PNLPTSPDA+VIVAT+RALK+HGGV+K+ L+QENVEAVK GF NL
Sbjct:  301 FGADLGAEKFLDIKAPNLPTSPDAVVIVATIRALKMNGGVAKDALNQENVEAVKAGFANL 360

Query:  361 ERHVNNMRQYGVPVVVAINQFTADTESEIATLKTLCSNIDVAVELASVWEDGADGGLELA  420
            RHV NMR+YGVPVVVAIN+F  DT  EIA L+  LC+ IDV VELASVW +GADGG++LA
```

-continued

```
Sbjct: 361 ARHVENMRKYGVPVVVAINEFITDTNDEIAVLRNLCAAIDVPVELASVWANGADGGVDLA 420

Query: 421 QTVANVIETQSSNYKRLYNDEDTIEEKIKKIVTKIYGGNKVHFGPKAQIQLKEFSDNGWD 480
            T+ N IE   S+YKRLY++  ++EEK+ +I  +IY  +KV F  KA+ Q+ +   NGWD
Sbjct: 421 NTLINTIENNPSHYKRLYDNNLSVEEKVTEIAKEIYRADKVIFEKKAKTQIAQIVKNGWD 480

Query: 481 KMPICMAKTQYSFSDNPNLLGAPTDFDITVREFVPKTGAGFIVALTGDVLTMPGLPKKPA 540
            +PICMAKTQYSFSD+P LLGAPT FDIT+RE VPK GAGFIVALTGDV+TMPGLPKKPA
Sbjct: 481 NLPICMAKTQYSFSDDPKLLGAPTGFDITIRELVPKLGAGFIVALTGDVMTMPGLPKKPA 540

Query: 541 ALNMDVLEDGTAIGLF                                              556
            ALNMDV  DGTA+GLF
Sbjct: 541 ALNMDVAADGTALGLF                                              556
```

A related DNA sequence was identified in *S. pyogenes* <SEQ ID 6199> which encodes the amino acid sequence <SEQ ID 6200>. Analysis of this protein sequence reveals the following:

```
Possible site: 50
>>> Seems to have no N-terminal signal sequence
     INTEGRAL    Likelihood = -1.49    Transmembrane    196-212 (196-212)

----- Final Results -----
             bacterial membrane --- Certainty = 0.1595(Affirmative) < succ>
              bacterial outside --- Certainty = 0.0000(Not Clear)   < succ>
            bacterial cytoplasm --- Certainty = 0.0000(Not Clear)   < succ>
```

The protein has homology with the following sequences in the databases:

```
>GP: AAB49329 GB: U39612 formyl-tetrahydrofolate synthetase
[Streptococcus mutans]
Identities = 432/556 (77%), Positives = 490/556 (87%)

Query:   1 MKSDIEIAQSVALQPITDIVKKVGIDGDDIELYGKYKAKLSFEKMKAVEANEPGKLILVT  60
           MK+DIEIAQSV L+PIT++VKK+GID DD+ELYGKYKAKL F+K KAVE N PGKL+LVT
Sbjct:   1 MKTDIEIAQSVDLRPITNVVKKLGIDFDDLELYGKYKAKLTFDKIKAVEENAPGKLVLVT  60

Query:  61 AINPTPAGEGKSTMSIGLADALNQMGKKTMLALREPSLGPVMGIKGGAAGGGYAQVLPME 120
           AINPTPAGEGKST++IGLADALN++GKKTM+A+REPSLGPVMGIKGGAAGGGYAQVLPME
Sbjct:  61 AINPTPAGEGKSTITIGLADALNKIGKKTMIAIREPSLGPVMGIKGGAAGGGYAQVLPME 120

Query: 121 DINLHFTGDMHAITTANNALSALIDNHLQQGNDLGIDPRRIIWKRVLDLNDRALRQVIVG 180
           DINLHFTGDMHAITTANNALSALIDNHL QGN+LGID RRIIWKRV+DLNDRALR V VG
Sbjct: 121 DINLHFTGDMHAITTANNALSALIDNHLHQGNELGIDQRRIIWKRVVDLNDRALRHVTVG 180

Query: 181 LGSPVNGVPREDGFDITVASEINAILCLATDLKDLKKRLADIVVAYTYDRKPVYVRDLKV 240
           LGSP+NG+PREDGFDITVASEIMAILCLAT+++DLK+RLA+IV+ Y +DR PVYVRDL+V
Sbjct: 181 LGSPINGIPREDGFDITVASEINAILCLATNVEDLKERLANIVIGYRFDRSPVYVRDLEV 240

Query: 241 EGALTLILKDAIKPNLVQTIYGTPALIHGGPFANIANGCNSVLATSTALRLADYTVTEAG 300
           +GAL LILK+AIKPNLVQTIYGTPA +HGGPFANIAHGCNSVLATSTALRLADYT+TEAG
Sbjct: 241 QGALALILKEAIKPNLVQTIYGTPAFVNGGPFANIAHGCNSVLATSTALRLADYTITEAG 300

Query: 301 FGADLGAEKFLNIKVPNLPKAPDAIVIVATLRALKMHGGVAKSDLAAENCEAVRLGFANL 360
           FGADLGAEKFL+IK PNLP +PDA+VIVAT+RALKM+GGVAK  L  EN EAV+ GFANL
Sbjct: 301 FGADLGAEKFLDIKAPNLPTSPDAVVIVATIRALKMNGGVAKDALNQENVEAVKAGFANL 360

Query: 361 KRHVENMRQFKVPVVVAINEFVADTEAEIATLKALCEEIKVPVELASVWANGAEGGLALA 420
              RHVENMR++  VPVVVAINEF+ DT  EIA L+ LC   I VPVELASVWANGA+GG+ LA
Sbjct: 361 ARHVENMRKYGVPVVVAINEFITDTNDEIAVLRNLCAAIDVPVELASVWANGADGGVDLA 420

Query: 421 KTVVRVIDQEAADYKRLYSDEDTLEEKVINIVTQIYGGKAVQFGPKAKTQLKQFAEFGWD 480
           T++  I+    + YKRLY +  ++EEKV I  +IY     V F  KAKTQ+ Q  + GWD
Sbjct: 421 NTLINTIENNPSHYKRLYDNNLSVEEKVTEIAKEIYRADKVIFEKKAKTQIAQIVKNGWD 480
```

-continued

```
Query:  481 KLPVCMAKTQYSFSDNPSLLGAPTDFDITIREFVPKTGAGFIVGLTGDVMTMPGLPKVPA  540
            LP+CMAKTQYSFSD+P LLGAPT FDITIRE VPK GAGFIV LTGDVMTMPGLPK PA
Sbjct:  481 NLPICMAKTQYSFSDDPKLLGAPTGFDITIRELVPKLGAGFIVALTGDVMTMPGLPKKPA  540

Query:  541 AMAMDVAENGTALGLF  556
            A+ MDVA +GTALGLF
Sbjct:  541 ALNMDVAADGTALGLF  556
```

An alignment of the GAS and GBS proteins is shown below.

```
Identities = 452/556 (81%), Positives = 513/556 (91%)
Query:    1 MKTDIEIAQSVALKPIAEIVEQVGIGFDDIELYGKYKAKLSFDKIEAVKSQKVGKLILVT   60
            MK+DIEIAQSVAL+PI +IV++VGI  DDIELYGKYKAKLSF+K++AV++ + GKLILVT
Sbjct:    1 MKSOIEIAQSVALQPITDIVKKVGIDGDDIELYGKYKAKLSFERNKAVEANEPGKLILVT   60

Query:   61 AINPTPAGEGKSTMSIGLADALNKICKKTMIALREPSLGPVNGIKGGAAGGGYAQVLPME  120
            AINPTPAGEGKSTMSIGLADALN++GKKTM+ALREPSLGPVNGIKGGAAGGGYAQVLPME
Sbjct:   61 AINPTPAGEGKSTMSIGLADALNQMGKKTMLALREPSLGPVNGIKGGAAGGGYAQVLPNE  120

Query:  121 DINLHFTGDMHAITTANNALSALLDNNIHQGNELDIDQRRVIWKRVVDLNDRALRQVIVG  180
            DINLHFTGDMHAITTANNALSAL+DNH+ QGN+L ID RR+IWKRV+DLNDRALRQVIVG
Sbjct:  121 DINLHFTGDMHAITTANNALSALIDNNLQQGNDLGIDPRRIIWKRVLDLNDRALRQVIVG  180

Query:  181 LGSPVNGIPREDGFDITVASEIMAILCLATDLSDLKKRLSNIVVAYSRNRKPIYVKDLKI  240
            LGSPVNG+PREDGFDITVASEIMAILCLATDL DLKKRL++IVVAY+ +RKP+YV+DLK+
Sbjct:  181 LGSPVNGVPREDGFDITVASEINAILCLATDLKDLKKRLADIVVAYTYDRKPVYVRDLKV  240

Query:  241 EGALTLILKDTIKPNLVQTIYGTPALVHGGPFANIAHGCNSVLATSTALRLADYVVTEAG  300
            EGALTLILKD IKPNLVQTIYGTPAL+HGGPFANIA GCNSVLATSTALRLADY VTEAG
Sbjct:  241 EGALTLILKDAIKPNLVQTIYGTPALINGGPFANIAHGCNSVLATSTALRLADYTVTEAG  300

Query:  301 FGADLGAEKFLDIKTPNLPTSFDAIVIVATLRALKMHGGVSKEDLSQENVEAVKRGFTNL  360
            FGADLGAEKFL+IK PNLP +PDAIVIVATLRALKMHGGV+E DL+ EN EAV+ GF NL
Sbjct:  301 FGADLGAEKFLNIKVPNLPKAPOAIVIVATLRALKMHGGVAKSDLAAENCEAVRLGFANL  360

Query:  361 ERHVNNMRQYGVPVVVAINQFTADTESEIATLKTLCSNIDVAVELASVWEDGADGGLELA  420
            +RHV NNRQ+VPVVVAIN+F ADTE+EIATLK LC  I V VELASVW +GA+GGL LA
Sbjct:  361 KRHVENMRQFKVPVVVAINEFVADTEAEIATLKALCEEIKVPVELASVWANGAEGGLALA  420

Query:  421 QTVANVIETQSSNYKRLYNDEDTIEEKIKKIVTKIYGGNKVNFGPKAQIQLKEFSDNGWD  480
            +TV  VI+ ++++YKRLY+DEDT+EEK+  IVT+IYGG  V FGPKA+ QLK+F++ GWD
Sbjct:  421 KTVVRVIDQEAADYKRLYSDEDTLEEKVINIVTQIYGGKAVQFGPKAKTQLRQFAEFGWD  480

Query:  481 KHPICMAKTQYSFSDNPNLLGAPTDFOITVREFVPKTGAGFIVALTGDVLTMPGLPKKPA  540
            K+P+CMAKTQYSFSDNP+LLGAPTDFDIT+REFVPKTGAGFIV LTGDV+TNPGLPK PA
Sbjct:  481 KLPVCMAKTQYSFSDNPSLLGAPTDFDITIREFVPKTGAGFIVGLTGDVMTNPGLPKVPA  540

Query:  541 ALNMDVLEDGTAIGLF  556
            A+ MDV E+GTA+GLF
Sbjct:  541 AMAMDVAENGTALGLF  556
```

A related DNA sequence was identified in *S. pyogenes* <SEQ ID 9057> which encodes amino acid sequence <SEQ ID 9058>. Analysis of this protein sequence reveals the following:

```
Possible site: 13
>>> Seems to have no N-terminal signal sequence
INTEGRAL Likelihood = -1.49 Transmembrane 516-532 ( 516-533)

----- Final Results -----
            bacterial membrane --- Certainty = 0.1595(Affirmative) < succ>
             bacterial outside --- Certainty = 0.0000(Not Clear) < succ>
           bacterial cytoplasm --- Certainty = 0.0000(Not Clear) < succ>
```

An alignment of the GAS and GBS sequences follows:

```
Score = 604 bits (1540), Expect e-174 Identities = 304/555 (54%), Positives
= 389/555 (69%), Gaps = 2/555 (0%)
Query:    4 SDIEIANSVTMEPISKVADQLGIDKEALCLYGKYKAKIDARQLVALKNKPDGKLILVTAI   63
            +DIEIA SV ++PI+++ +Q+GI  + + LYGKYKAK+    ++ A+K++  GKLILVTAI
Sbjct:    3 TDIEIAQSVALKPIAEIVEQVGIGFOOIELYGKYKAKLSFDKIEAVKSQKVGKLILVTAI   62

Query:   64 SPTPAGEGKTTTSVGLVDALSAIGKKAVIALREPSLXXXXXXXXXXXXXXXXXXXXPMEDI  123
            +PTPAGEGK+T S+GL DAL+ IGKK +IALREPSL                    PMEDI
Sbjct:   63 NPTPAGEGKSTNSIGLADALNKIGKKTMIALREPSLGPVNGIKGGAAGGGYAQVLPMEDI  122

Query:  124 NLNFTGDFHAIGVANNLLAALIDNHIHHGNSLGIDSRRITWKRVVDMNDRQLRHIVDGLQ  183
            NLHFTGD HAI  ANN L+AL+DNHIH GN L ID RR+ WKRVVD+NDR LE ++ GL
Sbjct:  123 NLHFTGDNHAITTANNALSALLDNHIHQGNELDIDQRRVIWKRVVDLNDRALRQVIVGLG  182

Query:  184 GKVNGIPREDGYDITVASEIMAILCLSENISDLKARLEKIIIGYNYQGEPVTXXXXXXXX  243
            VNGIPREDG+DITVASEIMAILCL+ ++SDLK RL  I++ Y+    +P+
Sbjct:  183 SPVNGIPREDGFDITVASEIMAILCLATDLSDLKKRLSNIVVAYSRNRKPIYVKDLKIEG  242

Query:  244 XXXXXXXXXIHPNLVQTLEHTPALIHGGPFANIAHGCNSVLATKLALKYGDYAVTEAGFG  303
                     I PNLVQT+  TPAL+HGGPFANIAHGCNSVLAT  AL+  DY VTEAGFG
Sbjct:  243 ALTLILKDTIKPNLVQTIYGTPALVHGGPFANIAHGCNSVLATSTALRLADYVVTEAGFG  302

Query:  304 ADLGAEKFTDIKCRNSGLRPAAVVLVATIRALKNHGGVPKADLATENVQAVVDGLPNLDK  363
            ADLGAEKF+DIK        P A+V+VAT+RALKNHGGV K DL+ ENV+AV  G  NL++
Sbjct:  303 ADLGAEKFLDIKTPNLPTSPDAIVIVATLRALKNHGGVSKEDLSQENVEAVKRGFTNLER  362

Query:  364 HLANIQDVYGLPVVVAINKFPLDTDAELQAVYDACDKRGVDVVISDVWANGGAGGRELAE  423
            H+N++   YG+PVVVAIN+F  DT++E+  +     C     V V ++ VW +G  GG ELA+
Sbjct:  363 HVNNMRQ-YGVPVVVAINQFTADTESEIATLKTLCSNIDVAVELASVWEDGADGGLELAQ  421

Query:  424 KVVTLAE-QDNQFRFVYEEDDSIETKLTKIVTKVYGGKGINLSSAAKRELADLERLGFGN  482
             V  + E Q  + ++ +Y ++D+IE K+ KIVTK+YGG ++    A+  +L +    G+
Sbjct:  422 TVANVIETQSSNYKRLYNDEDTIEEKIKKIVTKIYGGNKVNFGPKAQIQLKEFSDNGWDK  481

Query:  483 YPICMAKTQYSFSDDAKKLGAPTDFTVTISNLKVSAGAGFIVALTGAINTMPGLPKVPAS  542
              PICMAKTQYSFSD+     LGAPTDF +T+        GAGFIVALTG ++TMPGLPK PA+
Sbjct:  482 NPICMAKTQYSFSDNPNLLGAPTDFDITVREFVPKTGAGFIVALTGDVLTMPGLPKKPAA  541

Query:  543 ETIDIDEEGNITGLW                                              557
            +D+ E+G    GLF
Sbjct:  542 LNMDVLEDGTAIGLF                                              556
```

SEQ ID 6198 (GBS131) was expressed in *E. coli* as a His-fusion product. SDS-PAGE analysis of total cell extract is shown in FIG. 29 (lane 6; MW 64.8 kDa). It was also expressed in *E. coli* as a GST-fusion product. SDS-PAGE analysis of total cell extract is shown in FIG. 35 (lane 4; MW 90 kDa).

GBS131-GST was purified as shown in FIG. 201, lane 5.

Based on this analysis, it was predicted that these proteins and their epitopes could be useful antigens for vaccines or diagnostics.

EXAMPLE 2005

A DNA sequence (GBSx2115) was identified in *S. agalactiae* <SEQ ID 6201> which encodes the amino acid sequence <SEQ ID 6202>. Analysis of this protein sequence reveals the following:

```
Possible site: 53
>>> Seems to have no N-terminal signal sequence
INTEGRAL Likelihood = -10.03 Transmembrane  34-50   ( 29-56)
INTEGRAL Likelihood = - 7.70 Transmembrane  90-106  ( 84 - 110)
INTEGRAL Likelihood = - 1.97 Transmembrane  62-78   ( 62 - 78)
INTEGRAL Likelihood = - 0.69 Transmembrane 275-291  ( 275 - 291)

----- Final Results -----
           bacterial membrane --- Certainty = 0.5012(Affirmative) < succ>
             bacterial outside --- Certainty = 0.0000(Not Clear) < succ>
           bacterial cytoplasm --- Certainty = 0.0000(Not Clear) < succ>
```

The protein has homology with the following sequences in the GENPEPT database.

```
>GP:AAA88609 GB:M37842 unknown protein [Streptococcus mutans]
Identities = 243/373 (65%), Positives = 302/373 (80%), Gaps = 1/373 (0%)

Query:  71 IGAVLYLVNSEMDALSRVTWLILVMIAPLLGAMFLMYTKFDWGYRGLKQRLETLI0ESQI  130
           IG+VLYLVNS+MD LS +TWL++++  P+LG +FL+YTK  OWGYR LK ++       +
Sbjct:   2 IGSVLYLVNSQMDTLSIITWLLVILPFPILGTLFLIYTKQDWGYRELKSLIKKSTQAIIP   61

Query: 131 YLEDDPETLNQLKSSTSTTYHLVQYFEKAHGNFPVYRNTOVTFLPTGEAFFEK4KEELLK  190
           Y + D    L +LR S +  TY+L QY   ++ G FPVY+NT VT+ P G++ FE+MK++LLK
Sbjct:  62 YFQYOQRILYKLKESHARTYNLAQYLHRS-GGFPVYKNTKVTYFPNGQSKFEEMKKQLLK  120

Query: 191 AKKYIFLEFFIIDEGIMWGEILSILEQKVEEGVEVRILYDGMIEITKLSFDYTKRLEKIG  250
           A+K+IFLE+FII EG+MWGEILSILEQKV+EGVEVR++YDGM+E++LSFDY KRLEKIG
Sbjct: 121 ASKFIFLEYFIIAEGLMWGEILSILEQKVQEGVEVRVMYDGMLELSTLSFDYAKRLEKIG  180

Query: 251 IKAKAFSPISPFISTYYNYRDHRKIVVIDGVVGMTGGVNLADEYINHIELFGHWKDSGIM  310
           IKAK FSPI+PF+STYYNYROHRKI+VID    V    GG+NLAOEYIN IE FG+WKD+ +M
Sbjct: 181 IKAKVFSPITPFVSTYYNYRDHRKILVIDNKVAFNGGINLADEYINQIERFGYWKDTAVM  240

Query: 311 LKGKAVDSFLLLFLQMWSITEEKMLVAPYLGVHDDLVENEGYVIPYGDSPLDTDKVGENV  370
           L+G+ V SF L+FLQMWS T +    APYL +  +    GYVIPY DSPLD +KVGENV
Sbjct: 241 LEGEGVASFTLMFLQMWSTTNKOYEFAPYLTQNFHEIVANGYVIPYSDSPLDHEKVGENV  300

Query: 371 YIDILNHAREYVYIMTPYLILDSELEHAIQFAAERGVDVRIIMPGIPDKPIPYALAKTYY  430
           YIDILN  AR+YVYIMTPYLILDSE+EHA+QFAAERGVDV+IIMPGIPDK +P+ALAK Y+
Sbjct: 301 YIDILNQARDYVYIMTPYLILOSEMEHALQFAAERGVOVKIIMPGIPDKKVPFALAKRYF  360

Query: 431 QALTKSGVKIYEY                                                443
           AL   +GVKIYE+
Sbjct: 361 PALLDAGVKIYEF                                                373
```

A related DNA sequence was identified in *S. pyogenes* <SEQ ID 6203> which encodes the amino acid sequence <SEQ ID 6204>. Analysis of this protein sequence reveals the following:

```
Possible site: 47
>>> Seems to have no N-terminal signal sequence
INTEGRAL Likelihood = -8.86 Transmembrane 84-100 ( 81-104)
INTEGRAL Likelihood = -8.33 Transmembrane 28-44  ( 23-49)
INTEGRAL Likelihood = -6.74 Transmembrane 56-72  ( 53-74)

----- Final Results -----
           bacterial membrane --- Certainty = 0.4545(Affirmative) < succ>
            bacterial outside --- Certainty = 20.0000(Not Clear)  < succ>
          bacterial cytoplasm --- Certainty = 0.0000(Not Clear)   < succ>
```

The protein has homology with the following sequences in the databases:

```
>GP:AAA23240 GB:J02911 formtyltetrahydrofolate synthetase (FTHFS)
(ttg start codon) (EC 6.3.4.3) [Moorella thermoacetica]
Identities = 350/557 (62%), Positives = 438/557 (77%), Gaps = 2/557 (0%)

Query:   2 VLSDIEIANSVTMEPISKVADQLGIDKEALCLYGKYKAKIDARQLVALKNKPDGELILVT   61
           V  SDIEIA +   M+P+ ++A  LGI ++ + LYGEYKAKI        LK+KPDGKLILVT
Sbjct:   4 VPSDIEIAQAAKMKPVMELARGLGIQEDEVELYGKYKAKISLDVYRRLKDKPDGKLILVT   63

Query:  62 AISPTPAGEGKTTTSVGLVDALSAIGKKAVIALREPSLGPVFGVKGGAAGGGHAQVVPME  121
           AI+PTPAGEGKTTTSVGL DAL+ +GK+ ++ LREPSLGP FG+KGGAAGGG+AQVVPME
Sbjct:  64 AITPTPAGEGKTTTSVGLTDALARLGKRVMVCLREPSLGPSFGIKGGAAGGGYAQVVPME  123

Query: 122 DINLHFTGDFHAIGVANNLLAALIDNHIHHGNSLGIDSRRITWKRVVDMNDRQLRHIVDG  181
           DINLHFTGD HA+  A+NLLAA++DNH+ GM L ID R  ITW+RV+D+NDR LR+IV G
Sbjct: 124 DINLHFTGDIHAVTYAHNLLAAMVDNHLQQGMVLNIDPRTITWRRVIDLNDRALRNIVIG  183

Query: 182 LQGKVNGIPREDGYDITVASEIMAILCLSEMISDLKARLEKIIIGYNYQGEPVTAKDLKA  241
           L GK NG+PRE G+DI+VASE+MA LCL+ ++ DLK R  +I++GY Y G+PVTA DL+A
Sbjct: 184 LGGKANGVPRETGFDISVASEVMACLCLASDLMDLKERFSRIVVGYTYDGKPVTAGDLEA  243

Query: 242 GGALAALLKDAIHPNLVQTLEHTPALIHGGPFANIAHGCNSVLATKLALKYGDYAVTEAG  301
            G++A L+KDAI PNLVQTLE+TPA IHGGPFANIAHGCNS++ATK ALK  DY VTEAG
Sbjct: 244 QGSMALLMKDAIKPNLVQTLEMTPAFIHGGPFANIAHGCNSIIATKTALKLADYVVTEAG  303
```

```
Query: 302 FGADLGAEKFIDIKCRNSGLRPAAVVLVATIRALKMHGGVPKA0LATENVQAVVDGLPNL 361
            FGADLGAEKF D+KCR +G +P A V+VAT+RALKMHGGVPK+DLATEN++A++G  NL
Sbjct: 304 FGADLGAEKFYDVKCRYAGFKPDATVIVATVRALKMNGGVPKSDLATENLEALREGFANL 363

Query: 362 DKHLANIQDVYGLPVVVAINKFPLDTDAELQAVYDACDKRGVOVVISDVWANGGAGGREL 421
            +KH+ NI  +G+P VVAIN FP DT+AEL +Y+ C K G +V +S+VWA GG GG EL
Sbjct: 364 EKHIENI-GKFGVPAVVAINAFPTDTEAELNLLYELCAKAGAEVALSEVWAKGGEGGLEL 422

Query: 422 AEKVV-TLAEQDNQFRFVYEEDOSIETKLTKIVTKVYGGKGINLSSAAKRELADLERLGF 480
             A KV+ TL + + F  +Y D SI+ K+ KI T++YG G+N ++ A + +    E LG+
Sbjct: 423 ARKVLQTLESRPSNFNVLYNLDLSIKDKIAKIATEIYGADGVNYTAEADKAIQRYESLGY 482

Query: 481 GNYPICNAKTQYSFSDDAKKLGAPTDFTVTISNLKVSAGAGFIVALTGAIMTMPGLPKVP 540
            GN P+  MAKTQYSFSDD  KLG P +FT+T+ +++SAG   IV +TGAIMTMPGLPK P
Sbjct: 483 GNLPVVMAKTQYSFSDDNTKLGRPRNFTITVREVRLSAGGRLIVPITGAIMTNPGLPKRP 542

Query: 541 ASETIDIDEEGNITGLF 557
         A+  IDID
            +G
         ITGLF
Sbjct: 543 AACNIDIDADGVITGLF 559

>GB:M37842 unknown protein [Streptococcus mutans] (v . . . 517 e-145
>GP:AAA88609 GB:M37842 unknown protein υStreptococcus mutans]
Identities = 246/370 (66%), Positives = 303/370 (81%), Gaps = 1/370 (0%)

Query:  68 VLYLVNSDMOAISRMTWLILINIAPLLGSLFLIYTKLDWGYRGLKQRINHLVDLSAPYLS 127
            VLYLVNS MD +S +TWL++I+ P+LG+LFLIYTK DWGYR LK  I          PY
Sbjct:   5 VLYLVNSQMOTLSIITWLLVILPFPILGTLFLIYTKQDWGYRELKSLIKKSTQAIKPYFQ  64

Query: 128 DDDAILEVLKDSTSTTYHLVQYLERSRGNFPIYNNTRVTYFPTGETFFDSLKEQLFLAKK 187
             D  IL  LK+S + TY+L QYL RS G FP+Y NT+VTYFP G++ F+ +K+QL  A+K
Sbjct:  65 YDQRILYKLKESHARTYNLAQYLHRS-GGFPVYKNTKVTYFPNGQSKFEEMKKQLLKAEK 123

Query: 188 YIFLEFFIIAEOQMWGSILSILEKKVSEGVEVRVLFDGMNELSTLSSOYAKRLEQIGIKA 247
            +IFLE+FIIAEG MWOEILSILE+KV EGVEVRV++DGM ELSTLS DYAKRLE+IGIKA
Sbjct: 124 FIFLEYFIIAEGLMWGEILSILEQKVQEGVEVRVMYDGMLELSTLSFDYAKRLEKIGIKA 183

Query: 248 KSFLPISPFISTYYNYRDHRKIVVIDGEVSFTGGINLADEYINEVERFGHWKDAGLMLEG 307
             K F PI+PF+STYYNYRDHRKI+VID +V+F GGINLADEYIN++ERFF+WKD +MLEG
Sbjct: 184 KVFSPITPFVSTYYNYRDHRKILVIDNKVAFNGGINLADEYINQIERFGYWKDTAVMLEG 243

Query: 308 EATDSFLILFLQMWSITEKELIIDPYLSDHSLKLPSDGYVIPYGDSPLDTDKIGKNVYID 367
            E    SF ++FLQMWS T K+   PYL+ + ++ ++GYVIPY DSPLD +K+G+NVYID
Sbjct: 244 EGVASFTLMFLQMWSTTNKDYEFAPYLTQNFNEIVANGYVIPYSDSPLDNEKVGENVYID 303

Query: 368 ILNHAKEYVYIMTPYLILDSEMENALRFASERGVDIRIINPGVPDRGVPYALAKTYYKAL 427
            ILN A++YVYIMTPYLILDSEMEHAL+FA ERGVD++IINPG+PDK VP+ALAK Y+ AL
Sbjct: 304 ILNQARDYVYIMTPYLILDSEMEHALQFAAERGVDVKIINPGIPDKKVPFALAKRYFPAL 363

Query: 428 MSSGVKIYEY 437
            +  +GVKIYE+
Sbjct: 364 LDAGVKIYEF 373
```

An alignment of the GAS and GBS proteins is shown below.

```
Identities = 362/524 (69%), Positives = 437/524 (83%)

Query:   8 LISNKVKIVRLLNKSKKSLLRGIFSRTTVIAILLILQLLFLLASYSWLEQYRVWLATVEH  67
            +I  K K+ LL+K K   LRGIFSRTT+I +L+ILQL+FL  SY+W EQYRVW+ +E
Sbjct:   2 IIKKKAKVKYLLHKGKHGFLRGIFSRTTIIVLLIILQLVFLFQSYAWMEQYRVWITILES  61

Query:  68 ILTIGAVLYLVNSEMDALSRVTWLILVMIAPLLGAMFLMYTKFDWGYRGLKQRLETLIDE 127
            +   I  VLYLVNS+MDA+SR+TWLIL+MIAPLLG++FL+YTK DWGYRGLKQR+  L+D
Sbjct:  62 VFAITIVLYLVNSDMDAISRMTWLILIMIAPLLGSLFLIYTKLDWGYRGLKQRINHLVDL 121

Query: 128 SQIYLEDDPETLNQLKSSTSTTYHLVQYFEKANGNFPVYRNTDVTFLPTGEAFFEKMKEE 187
              S  YL DD   L  LK STSTTYHLVQY E++ GNFP+Y NT VT+ PTGE FF+ +KE+
Sbjct: 122 SAPYLSDDDAILEVLKDSTSTTYNLVQYLERSRGNFPIYNNTRVTYFPTGETFFDSLKEQ 181

Query: 188 LLKAKKYIFLEFFIIDEGIMWGEILSILEQKVEEGVEVRILYDGMISITKLSFDYTKRLE 247
            L  AKKYIFLEFFII EG MWGEILSILE+KV EGVEVR+L+DGM ++  LS DY KRLE
Sbjct: 182 LFLAKKYIFLEFFIIAEGQNWGEILSILEKKVSEGVEVRVLFDGMNELSTLSSDYAKRLE 241

Query: 248 KIGIKAKAFSPISPFISTYYNYRDHRKIVVIDGVVGMTGGVNLADEYINHIELFGHWKDS 307
            +IGIKAK+F PISPFISTYYNYRDHRKIVVIDG V  TGG+NLADEYIN +E FGHWKD+
```

```
                            -continued
Sbjct: 242 QIGIKAKSFLPISPFISTYYNYRDHRKIVVIDGEVSFTGGINLADEYINEVERFGHWKDA 301

Query: 308 GIMLKGKAVDSFLLLFLQMWSITEEKMLVAPYLGVHDDLVENEGYVIPYGDSPLDTDKVG 367
           G+ML+G+A DSFL+LFLQMWSITS+++++ PYL  H   + ++GYVIPYGDSPLDTDK+G
Sbjct: 302 GLMLEG-ATDSFLILFLQMWSITEKELIIDPYLSDHSLKLPSDGYVIPYGDSPLDTDKIG 361

Query: 368 ENVYIDILNHAREYVYIMTPYLILDSELEHAIQFAAERGVDVRIIMPGIPDKPIPYALAK 427
           +NVYIDILNHA+EYVYIMTPYLILDSE+EHA++FA+ERGVD+RIIMPG+PDK +PYALAK
Sbjct: 362 KNVYIDILNHAKEYVYIMTPYLILDSEMEHALRFASERGVDIRIIMPGVPDKGVPYALAK 421

Query: 428 TYYQALTKSGVKIYEYTLGFVHSKIFLSDNTRAVVGTINLDYRSLYHHFECAVYLYKVDA 487
           TYY+AL  SGVKIYEY  GFVHSK+F+SDNTKAVVGTINLDYRSLYHHFECA YLY+V
Sbjct: 422 TYYKALMSSGVKIYEYQPGFVHSKVFISDNTKAVVGTINLDYRSLYHHFECATYLYRVSV 481

Query: 488 IQDIYRDYMDTLNKSRLVSLKDINNIPKFQKVIGIVTKTIAPLL                 531
           I DI  D+ +   +S L++    +    P +QK+IG++ + IAPLL
Sbjct: 482 IADIVNDFNEAQKQSLLMTSDHLTQRPWYQKLIGLLVRIIAPLL                 525
                                                                    20
```

A related GBS gene <SEQ ID 8953> and protein <SEQ ID 8954> were also identified. Analysis of this protein sequence reveals the following:

```
Lipop Possible site: -1 Crend: 6
McG: Discrim Score: -8.80
GvH: Signal Score (-7.5): -1.94
Possible site: 53
>>> Seems to have no N-terminal signal sequence
ALOM program count: 4 value: -10.03 threshold: 0.0
INTEGRAL   Likelihood = -10.03 Transmembrane 34-50  ( 29-56)
INTEGRAL   Likelihood =  -7.70 Transmembrane 90-106 ( 84-110)
INTEGRAL   Likelihood =  -1.97 Transmembrane 62-78  ( 62-78)
PERIPHERAL Likelihood =  -1.22 199
modified ALOM score: 2.51

*** Reasoning Step: 3

----- Final Results -----
              bacterial membrane --- Certainty = 0.5012(Affirmative) < succ>
               bacterial outside --- Certainty = 0.0000(Not Clear)   < succ>
              bacterial cytoplasm --- Certainty = 0.0000(Not Clear)   < succ>
```

The protein has homology with the following sequences in the databases:

```
32.5/57.2% over 498aa
Bacillus firmus
SP|O66043|CARDIOLIPIN SYNTHETASE(EC 2.7.8.-) (CARDIOLIPIN SYNTHASE)(CL
SYNTHASE). Insert characterized
GP|2952028|gb|AAC05444.1||U88888 cardiolipin synthase Insert characterized
ORF01572(409-1893 of 2193)
SP|O66043|CLS_BACFI(5-503 of 503) CARDIOLIPIN SYNTHETASE (EC 2.7.8.-)(CARDIOLIPIN
SYNTHASE) (CL SYNTHASE). GP|2952028|gb|AAC05444.1||U88888 cardiolipin synthase
{Bacillus firmus}
% Match = 17.9
% Identity = 32.5 % Similarity = 57.1
Matches = 162 Mismatches = 204 Conservative Sub.s = 123

153       183       213       243       273       303       333       363
NLQLSIWMF*KTVQPLDYFK**RGRACDASLFLLGIRF*LEII*NNRMLFK*QYAIIK*LIWRGEKLISNKVKIVRLLNK 393       423       447       477       507       528       558       588
SKKSLLRGIFSRTTVIAILLILQLLF--LLASYSWLEQYRVWLATVEHILT---IGAVLYLVNSEMDALSRVTWLILVMI
        :|  :  |||   |   :|:  :  |    :|    |:   ||  ::::  |       :|||:::
         MKNRLNVLAFFALLFAALYISRGFLQSWMVGTLSVVFTLSVIFIGIIIFFEN--RHPTKTLTWLLVLAA
              10        20        30        40        50        60

618       648       678       705       735       765       789       819
APLLGAMFLMYTKFDWGYRGLKQRLETLIDESQIYLE-DDPETLNQLKSSTSTTYHLVQYFEKAH--GNFPVYRNTDVTF
 |::|  |:  |   :|  |:   :  |::  : : :      ||:  :      |     ||   |:   :::
FPVVG--FFFYLMFGQNHRKSKRFSKKAIEDERAFQKIEGQRQLNE-EQLKKMGGHQQLLFRLAHKLGKNPISFSSETKV
       80        90       100       110       120       130       140
```

```
849         879         909         939         969         999        1029        1059
LPTGEAFFEKMKEELLKAKKYIFLEFFIIDEGIMWGEILSILEQKVEEGVEVRILYDGMIEITKLSFDYTKRLEKIGIKA
  |   |:  :   : :  |   |: :|  ||::|:    :   :|   ||   |  :|||  || ||||   :    |||    | :  |      |::
LTDGKETYAHILQALKMAEHHIHLEYYIVRHDDLGNQIKDILISKAKEGVHVRFLYDG-VGSWKLSKSYVEELRDAGVEM
          160         170         180         190         200         210         220

1086        1116        1146        1176        1206        1236        1266        1293
KAFSPIS-PFISTYYNYRDHRKIVVIDGVVGMTGGVNLADEYINHIELFGHWKDSGIMLKGKAVDSFLLLFLQMWSI-TE
 :|||:   ||:::    |||:||||:||||||||   ||:|: |||:     ||:|:|:  : ::|:|| ::  :|||| |   |
VSFSPVKLPFLTHTINYRNHRKIIVIDGVVGFVGGLNIGDEYLGKDAYFGYWRDTHLYVRGEAVRTLQLIFLQDWHYQTG
          240         250         260         270         280         290         300

1323        1353        1383        1413        1443        1473        1503        1533
EKMLVAPYLGVHDDLVENEGYVIPYGDSPLDTDKVGENVYIDILNHAREYVYIMTPYLILDSELEHAIQFAAERGVDVRI
  | :|   ||    : : :|    |      :| : ::   ::    |:: ::  :||:|  |  :::   |:  ||     |:||||
ETILNQTYLSPSLSMTKGDGGVQMIASGPDTRWEVNKKLFFSMITSAKKSIWIASPYFIPDDDILSALKIAALSGIDVRI
          320         330         340         350         360         370         380

1563        1593        1623        1653        1683        1713        1743        1773
IMPGIPDKPIPYALAKTYYQALTKSGVKIYEYTLGFVHSKIFLSDNTKAVVGTINLDYRSLYHHFECAVYLYKVDAIQDI
::|    |||  |  :    :::|:     |   :::|||:|||   ||:|||| :  |:       :||  |:  ||::  :||    |||:   ::   :
LVPNRPDKRIVFHASRSYFPELLEAGVKVYEYNRGFMHSKIIIVDHEIASIGTSNMDMRSFHLNFEVNAYLYRTSSVTKL
          400         410         420         430         440         450         460

1803        1833        1863        1893        1923        1953        1983        2013
YRDYMDTLNKSRLVSLKDINNIPKFQKVIGIVTKTIAPLL*K*FIFNLILKVN*RI*LYLKSKGCILTKLC*TTVMR*VD
 ||:  |    |   :::     |  | |:::|   :: ::|||
VSDYVYDLEHSNQINFSLFKNRPFFHRLIESTSRLLSPLL
          480         490         500
```

Figure 150:
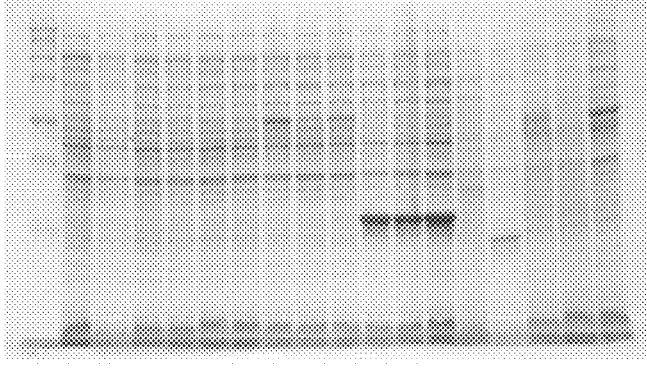

SEQ ID 8954 (GBS277d) was expressed in *E. coli* as a His-fusion product. SDS-PAGE analysis of total cell extract is shown in FIG. 150 (lane 18; MW 51 kDa), in FIG. 151 (lane 17 & 18; MW 51 kDa) and in FIG. 182 (lane 12; MW 51 kDa). It was also expressed in *E. coli* as a GST-fusion product. SDS-PAGE analysis of total cell extract is shown in FIG. 151 (lane 15 & 16; MW 76 kDa) and in FIG. 58 (lane 5; MW 87 kDa).

GBS277d-His was purified as shown in FIG. 235, lane 8.

Based on this analysis, it was predicted that these proteins and their epitopes could be useful antigens for vaccines or diagnostics.

EXAMPLE 2006

A DNA sequence (GBSx2116) was identified in *S. agalactiae* <SEQ ID 6205> which encodes the amino acid sequence <SEQ ID 6206>. This protein is predicted to be aspartate-semialdehyde dehydrogenase. Analysis of this protein sequence reveals the following:

```
Possible site: 42
>>> Seems to have an uncleavable N-term signal seq

----- Final Results -----
          bacterial membrane --- Certainty = 0.0000(Not Clear) < succ>
           bacterial outside --- Certainty = 0.0000(Not Clear) < succ>
          bacterial cytoplasm --- Certainty = 0.000(Not Clear) < succ>
```

A related GBS nucleic acid sequence <SEQ ID 9831> which encodes amino acid sequence <SEQ ID 9832> was also identified.

The protein has homology with the following sequences in the GENPEPT database.

```
>GP: AAA26850 GB: J02667 aspartate beta-semialdehyde dehydrogenase (EC
1.2.1.11) [Streptococcus mutans]
Identities = 261/357 (73%), Positives = 304/357 (85%), Gaps = 1/357 (0%)

Query:  1 MGYTVAIVGATGAVGTQMIRQLEQSNLPIEQVKLLSSSRSAGKILHFKDEAIRVEETTKE   60
          MGYTVAIVGATGAVGT+MI+QLEQS LP+++V+LLSSSRSAGK+L +KD+ + VE TTK+
Sbjct:  1 MGYTVAIVGATGAVGTRMIQQLEQSTLPVDKVRLLSSSRSAGKVLQYKDQDVTVELTTKD   60
```

-continued

```
Query:   61 SFYDVDIALFSAGGSISAKFAPYAVKSGAVVVDNTSYFRQNPDVPLVVPEVNAHAMIGHN 120
            SF  VDIALFSAGGS+SAKFAPYAVK+GAVVVDNTS+FRQNPDVPLVVPEVNA+AM  HN
Sbjct:   61 SFEAVDIALFSAGGSVSAKFAPYAVKAGAVVVDNTSHFRQNPDVPLVVPEVNAYAMDAHN 120

Query:  121 GIIACPNCSTIQMMIALEPIRQKWGIERVIVSTYQAVSGSGARAVEETKEQLRQVLNDNL 180
            GIIACPNCSTIQMM+ALEPIRQKWG+ RVIVSTYQAVSG+G  A+ ET  ++++V+ND +
Sbjct:  121 GIIACPNCSTIQMMVALEPIRQKWGLSRVIVSTYQAVSGAGQSAINETVREIKEVVNDGV 180

Query:  181 SPDQLIATVLPCSSDQKHYPIAFNALPQIDIFTDNDYTYEEMKMTLETKKIMEDATIKVS 240
               P  + A + P    D+KHYPIAFNAL QID+FTDNDYTYEEMKMT ETKKIME+  + VS
Sbjct:  181 DPKAVHADIFPSGGDKKHYPIAFNALAQIDVFTDNDYTYEEMKMTNETKKIMEEPELPVS 240

Query:  241 ATCVRIPVLSGHSESIYIETKELASISEIKKAIANFPGAVLQDLPSQQIYPQAINAVGHR 300
            A  CVR+P+L  HSE++YIETK++A I E+K AIA FPGAVL+D   QIYPQA NAVG R
Sbjct:  241 AHCVRVPILFSHSEAVYIETKDVAPIEEVKAAIAAFPGAVLEDDIKHQIYPQAANAVGSR 300

Query:  301 ETFVGRIRKDLDQENGVHMWVVSDNLLKGAAWNSVQIAETLHKNGLVKPAKELKFEL 357
             TFVGRIRKDLD ENG+HMWVVSDNLLKGAAWNS+  A  LH+ GLV+    ELKFEL
Sbjct:  301 -TFVGRIRKDLDIENGIHMWVVSDNLLKGAAWNSIITANRLHERGLVRSTSELKFEL 356
```

No corresponding DNA sequence was identified in *S. pyogenes*.

Based on this analysis, it was predicted that this protein and its epitopes, could be useful antigens for vaccines or diagnostics.

EXAMPLE 2007

A DNA sequence (GBSx2117) was identified in *S. agalactiae* <SEQ ID 6207> which encodes the amino acid sequence <SEQ ID 6208>. Analysis of this protein sequence reveals the following:

```
Possible site: 22
>>> Seems to have no N-terminal signal sequence
     INTEGRAL     Likelihood = -2.66     Transmembrane      33-49 (33-49)

----- Final Results -----
             bacterial membrane --- Certainty = 0.2062(Affirmative) < succ>
              bacterial outside --- Certainty = 0.0000(Not Clear)   < succ>
            bacterial cytoplasm --- Certainty = 0.0000(Not Clear)   < succ>
```

The protein has no significant homology with any sequences in the GENPEPT database, but there is homology to SEQ ID 500.

Based on this analysis, it was predicted that this protein and its epitopes, could be useful antigens for vaccines or diagnostics.

EXAMPLE 2008

A DNA sequence (GBSx2119) was identified in *S. agalactiae* <SEQ ID 6209> which encodes the amino acid sequence <SEQ ID 6210>. Analysis of this protein sequence reveals the following:

```
Possible site: 24
>>> Seems to have no N-terminal signal sequence

----- Final Results -----
            bacterial cytoplasm --- Certainty = 0.3853(Affirmative) < succ>
             bacterial membrane --- Certainty = 0.0000(Not Clear)   < succ>
              bacterial outside --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 2009

A DNA sequence (GBSx2120) was identified in *S. agalactiae* <SEQ ID 6211> which encodes the amino acid sequence <SEQ ID 6212>. This protein is predicted to be unnamed protein product (clpP). Analysis of this protein sequence reveals the following:

```
Possible site: 45
>>> Seems to have no N-terminal signal sequence

----- Final Results -----
            bacterial cytoplasm --- Certainty = 0.3883(Affirmative) < succ>
             bacterial membrane --- Certainty = 0.0000(Not Clear)   < succ>
               bacterial outside --- Certainty = 0.0000(Not Clear)   < succ>
```

A related GBS nucleic acid sequence <SEQ ID 10061> which encodes amino acid sequence <SEQ ID 10062> was also identified.

A related DNA sequence was identified in *S. pyogenes* <SEQ ID 6213> which encodes the amino acid sequence <SEQ ID 6214>. Analysis of this protein sequence reveals the following:

```
Possible site: 41
>>> Seems to have no N-terminal signal sequence

----- Final Results -----
            bacterial cytoplasm --- Certainty = 0.2682(Affirmative) < succ>
             bacterial membrane --- Certainty = 0.0000(Not Clear)   < succ>
               bacterial outside --- Certainty = 0.0000(Not Clear)   < succ>
```

An alignment of the GAS and GBS proteins is shown below.

```
Identities = 175/196 (89%), Positives = 187/196 (95%)

Query:    5 MIPVVIEQTSRGERSYDIYSRLLKDRIIMLTGQVEDNMANSIIAQLLFLDAQDNTKDIYL   64
            MIPVVIEQTSRGERSYDIYSRLLKDRIIMLTG VEDNMANS+IAQLLFLDAQDNTKDIYL
Sbjct:    1 MIPVVIEQTSRGERSYDIYSRLLKDRIIMLTGPVEDNMANSVIAQLLFLDAQDNTKDIYL   60

Query:   65 YVNTPGGSVSAGLAIVDTMNFIKSDVQTIVMGMAASMGTIIASSGAKGKRFMLPNAEYMI  124
            YVNTPGGSVSAGLAIVDTMNFIK+DVQTIVMGMAASMGT+IASSG KGKRFMLPNAEYMI
Sbjct:   61 YVNTPGGSVSAGLAIVDTMNFIKADVQTIVMGMAASMGTVIASSGTKGKRFMLPNAEYMI  120

Query:  125 HQPMGGTGGGTQQSDMAIAAEHLLKTRHTLEKILADNSGQSIEKVHDDAERDRWMSAQET  184
            HQPMGGTGGGTQQ+DMAIAAEHLLKTRH LEKILA N+G++I+++H DAERD WMSA+ET
Sbjct:  121 HQPMGGTGGGTQQTDMAIAAEHLLKTRHRLEKILAQNAGKTIKQIHKDAERDYWMSAEET  180

Query:  185 LDYGFIDAIMENNNLQ                                             200
            L YGFID IMENN L+
Sbjct:  181 LAYGFIDEIMENNELK                                             196
```

Based on this analysis, it was predicted that these proteins and their epitopes could be useful antigens for vaccines or diagnostics.

EXAMPLE 2010

A DNA sequence (GBSx2121) was identified in *S. agalactiae* <SEQ ID 6215> which encodes the amino acid sequence <SEQ ID 6216>. This protein is predicted to be uracil phosphoribosyltransferase (upp). Analysis of this protein sequence reveals the following:

```
Possible site: 26
>>> Seems to have no N-terminal signal sequence
     INTEGRAL     Likelihood = -0.43      Transmembrane    127-143  (127-144)
     INTEGRAL     Likelihood = -0.06      Transmembrane     72-88   (72-89)
     INTEGRAL     Likelihood = -0.06      Transmembrane    154-170  (154-170)

----- Final Results -----
             bacterial membrane --- Certainty = 0.1171(Affirmative) < succ>
               bacterial outside --- Certainty = 0.0000(Not Clear)   < succ>
            bacterial cytoplasm --- Certainty = 0.0000(Not Clear)   < succ>
```

A related GBS nucleic acid sequence <SEQ ID 10063> which encodes amino acid sequence <SEQ ID 10064> was also identified.

The protein has homology with the following sequences in the GENPEPT database.

```
>GP: AAA26890 GB: L07793 uracil phosphoribosyltransferase
[Streptococcus salivarius]
Identities = 192/209 (91%), Positives 202/209 (95%)

Query:    1 MGKFQVISHPLIQHKLSILRRTTTSTKDFRELVDEIAMLMGYEVSRDLPLEDVEIQTPVA   60
            MGKFQVISHPLIQHKLSILRR  TSTKDFRELV+EIAMLMGYEVSRDLPLE+VEIQTP+
Sbjct:    1 MGKFQVISHPLIQHKLSILRREDTSTKDFRELVNEIAMLMGYEVSRDLPLEEVEIQTPIT   60

Query:   61 TTVQKQLAGKKLAIVPILRAGIGMVDGFLSLVPAAKVGHIGMYRDEETFQPVEYLVKLPE  120
            TVQKQL+GKKLAIVPILRAGIGMVDGFLSLVPAAKVGHIGMYRDEET +PVEYLVKLPE
Sbjct:   61 KTVQKQLSGKKLAIVPILRAGIGMVDGFLSLVPAAKVGHIGMYRDEETLEPVEYLVKLPE  120

Query:  121 DIDQRQIFVVDPMLATGGSAILAVDSLKKRGAASIKFVCLVAAPEGVAALQEAHPDVDIY  180
            DIDQRQIFVVDPMLATGGSAILAVDSLKKRGAA+IKFVCLVAAPEGV  LQ+AHPD+DIY
Sbjct:  121 DIDQRQIFVVDPMLATGGSAILAVDSLKKRGAANIKFVCLVAAPEGVKKLQDAHPDIDIY  180

Query:  181 TAALDEKLNEHGYIVPGLGDAGDRLFGTK                                209
            TA+LDEKLNE+GYIVPGLGDAGDRLFGTK
Sbjct:  181 TASLDEKLNENGYIVPGLGDAGDRLFGTK                                209
```

A related DNA sequence was identified in *S. pyogenes* <SEQ ID 6217> which encodes the amino acid sequence <SEQ ID 6218>. Analysis of this protein sequence reveals the following:

```
Possible site: 26
>>> Seems to have no N-terminal signal sequence
    INTEGRAL    Likelihood = -0.59    Transmembrane    72-88 (72-89)
    INTEGRAL    Likelihood = -0.22    Transmembrane    127-143 (127-144)

----- Final Results -----
            bacterial membrane --- Certainty = 0.1235(Affirmative) < succ>
             bacterial outside --- Certainty = 0.0000(Not Clear) < succ>
           bacterial cytoplasm --- Certainty = 0.0000(Not Clear) < succ>
```

The protein is similar to uracil phosphoribosyltransferase from *S. salivarius*:

```
>GP: AAA26890 GB: L07793 uracil phosphoribosyltransferase
[Streptococcus salivarius]
Identities = 191/209 (91%), Positives = 205/209 (97%)

Query:    1 MGKCQVISHPLIQHKLSILRRQTTSTKDFRELVNEIAMLMGYEVSRDLPLEDVDIQTPVS   60
            MGK QVISHPLIQHKLSILRR+ TSTKDFRELVNEIAMLMGYEVSRDLPLE+V+IQTP++
Sbjct:    1 MGKFQVISHPLIQHKLSILRREDTSTKDFRELVNEIAMLMGYEVSRDLPLEEVEIQTPIT   60

Query:   61 KTVQKQLAGKKLAIVPILRAGIGMVDGLLSLVPAAKVGHIGMYRNEETLEPVEYLVKLPE  120
            KTVQKQL+GKKLAIVPILRAGIGMVDG LSLVPAAKVGHIGMYR+EETLEPVEYLVKLPE
Sbjct:   61 KTVQKQLSGKKLAIVPILRAGIGMVDGFLSLVPAAKVGHIGMYRDEETLEPVEYLVKLPE  120

Query:  121 DINQRQIFLVDPMLATGGSAILAVDSLKKRGAANIKFVCLVAAPEGVKKLQEAHPDIDIF  180
            DI+QRQIF+VDPMLATGGSAILAVDSLKKRGAANIKFVCLVAAPEGVKKLQ+AHPDIDI+
Sbjct:  121 DIDQRQIFVVDPMLATGGSAILAVDSLKKRGAANIKFVCLVAAPEGVKKLQDAHPDIDIY  180

Query:  181 TAALDDHLNEHGYIVPGLGDAGDRLFGTK                                209
            TA+LD+ LNE+GYIVPGLGDAGDRLFGTK
Sbjct:  181 TASLDEKLNENGYIVPGLGDAGDRLFGTK                                209
```

An alignment of the GAS and GBS proteins is shown below.

```
Identities = 190/209 (90%), Positives = 201/209 (95%)

Query:    1 MGKFQVISHPLIQHKLSILRRTTTSTKDFRELVDEIAMLMGYEVSRDLPLEDVEIQTPVA   60
            MGK QVISHPLIQHKLSILRR  TSTKDFRELV+EIAMLMGYEVSRDLPLEDV+IQTPV+
Sbjct:    1 MGKCQVISHPLIQHKLSILRRQTTSTKDFRELVNEIAMLMGYEVSRDLPLEDVDIQTPVS   60
```

-continued

```
Query:   61 TTVQKQLAGKKLAIVPILRAGIGMVDGFLSLVPAAKVGHIGMYRDEETFQPVEYLVKLPE  120
            TVQKQLAGKKLAIVPILRAGIGMVDG LSLVPAAKVGHIGMYR+EET +PVEYLVKLPE
Sbjct:   61 KTVQKQLAGKKLAIVPILRAGIGMVDGLLSLVPAAKVGHIGMYRNEETLEPVEYLVKLPE  120

Query:  121 DIDQRQIFVVDPMLATGGSAILAVDSLKKRGAASIKFVCLVAAPEGVAALQEAHPDVDIY  180
            DI+QRQIF+VDPMLATGGSAILAVDSLKKRGAA+IKFVCLVAAPEGV  LQEAHPD+DI+
Sbjct:  121 DINQRQIFLVDPMLATGGSAILAVDSLKKRGAANIKFVCLVAAPEGVKKLQEAHPDIDIF  180

Query:  181 TAALDEKLNEHGYIVPGLGDAGDRLFGTK                                209
            TAALD+ LNEHGYIVPGLGDAGDRLFGTK
Sbjct:  181 TAALDDHLNEHGYIVPGLGDAGDRLFGTK                                209
```

Based on this analysis, it was predicted that these proteins and their epitopes could be useful antigens for vaccines or diagnostics.

EXAMPLE 2011

A DNA sequence (GBSx2122) was identified in *S. agalactiae* <SEQ ID 6219> which encodes the amino acid sequence <SEQ ID 6220>. This protein is predicted to be hemolysin (patB). Analysis of this protein sequence reveals the following:

```
Possible site: 48
>>> Seems to have no N-terminal signal sequence
    INTEGRAL   Likelihood = -3.29      Transmembrane      88-104 (86-106)

----- Final Results -----
              bacterial membrane --- Certainty = 0.2317(Affirmative) < succ>
               bacterial outside --- Certainty = 0.0000(Not Clear)   < succ>
              bacterial cytoplasm --- Certainty = 0.0000(Not Clear)   < succ>
```

The protein has homology with the following sequences in the GENPEPT database.

```
>GP: CAB15133 GB: Z99120 aminotransferase [Bacillus subtilis]
Identities = 130/381 (34%), Positives = 221/381 (57%), Gaps = 4/381 (1%)

Query:    5 DFTSLPERFSSNTIKWKAVQK---DQEILPLWIADMDFPIFPEMSEAIEDFSHQMVFGYD   61
            +F    ER + ++KW   +      + LP+W+ADNDF    ++EA+++     +FGY
Sbjct:    2 NFDKREERLGTQSVKWDKTGELFGVTDALPMWVADMDFRAPEAITEALKERLDHGIFGYT   61

Query:   62 SPKDSLYQAISNWEVQEHGYQFDKKSLLLIDGVVPAISVAIQAFTKEGDAVLINTPVYPP  121
            +P      A+  W     HG++ + +S+    GVV A+S+A+QAFT+ GD V++ PVY P
Sbjct:   62 TPDQKTKDAVCGWMQNRHGWKVNPESITFSPGVVTALSMAVQAFTEPGDQVVVQPPVYTP  121

Query:  122 FARTIKYNNRHLVSNSLLNNNQYFEIDFKQLEKDIIENNVKLYIFCSPHNPGGRVWTKGE  181
            F    ++ N RH++ N LL +  + IDF+ LE  + + +V L+I C+PHNP GR W++ +
Sbjct:  122 FYHMVEKNGRHILHNPLLEKDGAYAIDFEDLETKLSDPSVTLFILCNPHNPGSRSWSRED  181

Query:  182 IQKIGDICKRYNVILVSDEIHQDLVLFDNVHHSFNTVDSSFKELSVILSSATKTFNIAGT  241
            + K+G++C   + V +VSDEIH DL+L+ + H  F ++   F ++SV ++ +KTFNIAG
Sbjct:  182 LLKLGELCLEHGVTVVSDEIHSDLMLYGHKHTPFASLSDDFADISVTCAAPSKTFNIAGL  241

Query:  242 KNSFAIIENEKLRSDFKKRQIANNQQEISSLGLLATEVAFTKEKQWLKALKMELEGSIEY  301
              + S  II +   R+ F       N   +++ + A E A++K    WL  L   +E ++
Sbjct:  242 QASAIIIPDRLKRAKFSASLQRNGLGGLNAFAVTAIEAAYSKGGPWLDELITYIEKNMNE  301

Query:  302 LYEQL-TQKTNIKVMKPEGTYLVWLDFSAYNLTHLEIQEKLRYDAKLILNDGLTFGKEGK  360
            L  T+     +K+MKP+ +YL+WLDFSAY L+  E+Q+++    K+IL  G  +G  G+
Sbjct:  302 AEAFLSTELPKVKMMKPDASYLIWLDFSAYGLSDAELQQRMLKKGKVILEPGTKYGPGGE  361

Query:  361 KHARINVAAPRSVIEEAVLRL                                        381
              R+N    + +++ + R+
Sbjct:  362 GFMRLNAGCSLATLQDGLRRI                                        382
```

There is also homology to SEQ ID 1006.

SEQ ID 6220 (GBS392) was expressed in *E. coli* as a His-fusion product. SDS-PAGE analysis of total cell extract is shown in FIG. 75 (lane 2; MW 46.4 kDa). It was also expressed in *E. coli* as a GST-fusion product. SDS-PAGE analysis of total cell extract is shown in FIG. 83 (lane 5; MW 71 kDa).

GBS392-GST was purified as shown in FIG. 217, lane 4.

Based on this analysis, it was predicted that this protein and its epitopes, could be useful antigens for vaccines or diagnostics.

EXAMPLE 2012

A DNA sequence (GBSx2123) was identified in *S. agalactiae* <SEQ ID 6221> which encodes the amino acid sequence <SEQ ID 6222>. This protein is predicted to be rRNA methylase, SpoU family (cspR). Analysis of this protein sequence reveals the following:

```
Possible site: 39
>>> Seems to have no N-terminal signal sequence

----- Final Results -----
            bacterial cytoplasm --- Certainty = 0.1436(Affirmative) < succ>
             bacterial membrane --- Certainty = 0.0000(Not Clear)   < succ>
              bacterial outside --- Certainty = 0.0000(Not Clear)   < succ>
```

The protein has homology with the following sequences in the GENPEPT database.

```
>GP: AAB02738 GB: U58864 CspR [Bacillus subtilis]
Identities = 84/155 (54%), Positives = 120/155 (77%), Gaps = 3/155 (1%)

Query:  19 HIVLFEPQIPANTGNIARTCAATNAPLHIIRPMGFPIDDKKMKRAGLDYWDKLDVSFYDG  78
           H+VL++P+IPANTGNIARTCAATN  LH+IRP+GF  DDK +KRAGLDYW+ ++V ++D
Sbjct:   4 HVVLYQPEIPANTGNIARTCAATNTTLHLIRPLGFSTDDKMLKRAGLDYWEFVNVVYHDS  63

Query:  79 LEE-FMLSCRGKVHLISKFADKVYSDENYND-DQDHYFMFGREDKGLPETFMREHAEKAL 136
           LEE F    +GK   I+KF + ++  +Y D D+D++F+FGRE   GLP+  ++ + ++ L
Sbjct:  64 LEELFEAYKKGKFFFITKFGQQPHTSFDYTDLDEDYFFVFGRETSGLPKDLIQNNMDRCL 123

Query: 137 RIPMNDEHVRSLNVSNTVCMIVYEALRQQSFPNLE                          171
           R+PM  EHVRSLN+SNT  ++VYEALRQQ++ +L+
Sbjct: 124 RLPMT-EHVRSLNLSNTAAILVYEALRQQNYRDLK                          157
```

A related DNA sequence was identified in *S. pyogenes* <SEQ ID 6223> which encodes the amino acid sequence <SEQ ID 6224>. Analysis of this protein sequence reveals the following:

```
Possible site: 51
>>> Seems to have no N-terminal signal sequence

----- Final Results -----
            bacterial cytoplasm --- Certainty = 0.2236(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below.

```
Identities = 135/182 (74%), Positives = 150/182 (82%)

Query:   1 MNIETLTQKNHRSDSGRNHIVLFEPQIPANTGNIARTCAATNAPLHIIRPMGFPIDDKKM  60
           M + L  KN +     RNHIVLF+PQIP NTGNIARTCAATNAPLHII+PMGFPIDD+KM
Sbjct:  13 MTTKELINKNDKVKKARNHIVLFQPQIPQNTGNIARTCAATNAPLHIIKPMGFPIDDRKM  72

Query:  61 KRAGLDYWDKLDVSFYDGLEEFMLSCRGKVHLISKFADKVYSDENYNDDQDHYFMFGRED 120
           KRAGLDYWDKL++ FYD LE+F+  C G++HLISKFA   YS   Y D   HYF+FGRED
Sbjct:  73 KRAGLDYWDKLELHFYDHLEQFINQCHGQLHLISKFAVNNYSQATYADGDSHYFLFGRED 132

Query: 121 KGLPETFMREHAEKALRIPMNDEHVRSLNVSNTVCMIVYEALRQQSFPNLELSHTYENDK 180
            GLPE FMREHAEKALRIPMND HVRSLNVSNTVCM++YEALRQQ F  LEL HTYE+DK
Sbjct: 133 TGLPEDFMREHAEKALRIPMNDEHVRSLNVSNTVCMVIYEALRQQGFQGLELKHTYEHDK 192

Query: 181 LK                                                          182
           LK
Sbjct: 193 LK                                                          194
```

Based on this analysis, it was predicted that these proteins and their epitopes could be useful antigens for vaccines or diagnostics.

EXAMPLE 2013

A DNA sequence (GBSx2124) was identified in *S. agalactiae* <SEQ ID 6225> which encodes the amino acid sequence <SEQ ID 6226>. Analysis of this protein sequence reveals the following:

```
Possible site: 60
>>> Seems to have no N-terminal signal sequence
     INTEGRAL    Likelihood = -6.79    Transmembrane     82-98   (69-100)
     INTEGRAL    Likelihood = -6.48    Transmembrane     27-43   (24-47)
     INTEGRAL    Likelihood = -5.52    Transmembrane    132-148  (126-151)
     INTEGRAL    Likelihood = -5.10    Transmembrane    162-178  (161-185)

----- Final Results -----
             bacterial membrane --- Certainty = 0.3718(Affirmative) < succ>
             bacterial outside  --- Certainty = 0.0000(Not Clear)   < succ>
            bacterial cytoplasm --- Certainty = 0.0000(Not Clear)   < succ>
```

A related GBS nucleic acid sequence <SEQ ID 9411> which encodes amino acid sequence <SEQ ID 9412> was also identified.

The protein has homology with the following sequences in the GENPEPT database.

```
>GP: CAB13143 GB: Z99110 similar to amino acid permease
[Bacillus subtilis]
Identities = 46/143 (32%), Positives = 81/143 (56%), Gaps = 1/143 (0%)

Query:    3 FAYDGWTIFVNIAPEVKNPKKNLPLAFVIGPALILLSYLAFFYGLTQILGASFIMTTGND    62
            FAYDGW  +   + E+KNP+K LP A    G  ++    Y+   + L  IL A+ I+T G +
Sbjct:  203 FAYDGWILLAALGGEMKNPEKLLPRAMTGGLLIVTAIYIFINFALLHILSANEIVTLGEN  262

Query:   63 AINYAANIIFGPSVGRLLSFIVILSVLGVANGLLLGTMRLPQAFAERGWIK-SERMANIN   121
            A + AA ++FG    G+L+S  +I+S+ G  NG +L    R+  A  AER  +  +E++++++
Sbjct:  263 ATSTAATMLFGSIGGKLISVGIIVSIFGCLNGKVLSFPRVSFAMAERKQLPFAEKLSHVH  322

Query:  122 LKYQMSLPASLTVTAVAIFWLFV                                        144
            ++     A     A+A+   + +
Sbjct:  323 PSFRTPWIAISFQIALALIMNLI                                        345
```

There is also homology to SEQ ID 3114.

Based on this analysis, it was predicted that this protein and its epitopes, could be useful antigens for vaccines or diagnostics.

EXAMPLE 2014

A DNA sequence (GBSx2125) was identified in *S. agalactiae* <SEQ ID 6227> which encodes the amino acid sequence <SEQ ID 6228>. Analysis of this protein sequence reveals the following:

```
Possible site: 20
>>> Seems to have no N-terminal signal sequence

----- Final Results -----
            bacterial cytoplasm --- Certainty = 0.1849(Affirmative) < succ>
             bacterial membrane --- Certainty = 0.0000(Not Clear)   < succ>
              bacterial outside --- Certainty = 0.0000(Not Clear)   < succ>
```

A related GBS nucleic acid sequence <SEQ ID 9439> which encodes amino acid sequence <SEQ ID 9440> was also identified.

The protein has homology with the following sequences in the GENPEPT database.

```
>GP: AAD23454 GB: AF117741 cochaperonin GroES
[Streptococcus pneumoniae]
Identities = 31/52 (59%), Positives = 42/52 (80%)

Query:    2 GDGIRTLTGELVAPSVAEGDTVLVENGAGLEVKDGNEKVTVVRESDIVAVVK   53
            G G+RTL G+LVAPSV  GD VLVE  AGL+VKDG+EK  +V E++I+A+++
Sbjct:   42 GQGVRTLNGDLVAPSVKTGDRVLVEAHAGLDVKDGDEKYIIVGEANILAIIE   93
```

A related DNA sequence was identified in *S. pyogenes* <SEQ ID 6229> which encodes the amino acid sequence <SEQ ID 6230>. Analysis of this protein sequence reveals the following:

```
Possible site: 50
>>> Seems to have no N-terminal signal sequence

----- Final Results -----
            bacterial cytoplasm --- Certainty = 0.3290(Affirmative) < succ>
             bacterial membrane --- Certainty = 0.0000(Not Clear)  < succ>
              bacterial outside --- Certainty = 0.0000(Not Clear)  < succ>
```

An alignment of the GAS and GBS proteins is shown below.

```
Identities = 29/49 (59%), Positives = 39/49 (79%)

Query:    4 GIRTLTGELVAPSVAEGDTVLVENGAGLEVKDGNEKVTVVRESDIVAVV    52
            G+RT+TG+ V PSV+ G  VLVENG  LEV   +EKV+++RESDI+A+V
Sbjct:   60 GVRTITGDSVLPSVSVGQEVLVENGHDLEVTVDDEKVSIIRESDIIAIV   108
```

Based on this analysis, it was predicted that these proteins and their epitopes could be useful antigens for vaccines or diagnostics.

EXAMPLE 2015

A DNA sequence (GBSx2126) was identified in *S. agalactiae* <SEQ ID 6231> which encodes the amino acid sequence <SEQ ID 6232>. Analysis of this protein sequence reveals the following:

```
Possible site: 13
>>> Seems to have no N-terminal signal sequence

----- Final Results -----
            bacterial cytoplasm --- Certainty = 0.1272(Affirmative) < succ>
             bacterial membrane --- Certainty = 0.0000(Not Clear)  < succ>
              bacterial outside --- Certainty = 0.0000(Not Clear)  < succ>
```

The protein has homology with the following sequences in the GENPEPT database.

```
>GP: AAD23455 GB: AF117741 chaperonin GroEL [Streptococcus pneumoniae]
Identities = 472/539 (87%), Positives = 513/539 (94%), Gaps = 1/539 (0%)

Query:    1 MAKDIKFSADARSAMVRGVDILADTVKVTLGPKGRNVVLEKAFGSPLITNDGVTIAKEIE    60
            M+K+IKFS+DARSAMVRGVDILADTVKVTLGPK RNVVLEK+FGSPLITNDGVTIAKEIE
Sbjct:    1 MSKEIKFSSDARSAMVRGVDILADTVKVTLGPKDRNVVLEKSFGSPLITNDGVTIAKEIE    60

Query:   61 LEDHFENMGAKLVSEVASKTNDIAGDGTTTATVLTQAIVREGLKNVTAGANPIGIRRGIE   120
            LEDHFENMGAKLVSE+ASKTNDIAGDGTTTATVLTQAIVREG+KNVTAGANPIGIRRGIE
Sbjct:   61 LEDHFENMGAKLVSEIASKTNDIAGDGTTTATVLTQAIVREGIKNVTAGANPIGIRRGIE   120

Query:  121 TAVSAAVEELKEIAQPVSGKEAIAQVAAVSSRSEKVGEYISEAMERVGNDGVITIEESRG   180
             TAV+AAVE LK   A PV+ KEAI+QVAAVSSRSEKVGEYISEAME+VG DGVITIEESRG
Sbjct:  121 TAVAAAVEALKNNAIPVANKEAISQVAAVSSRSEKVGEYISEAMEKVGKDGVITIEESRG   180

Query:  181 METELEVVEGMQFDRGYLSQYMVTDNEKNVSELENPYILITDKKISNIQEILPLLEEVLK   240
            METELEVVEGMQFDRGYLSQYMVTD+EKMV++LENPYILITDKKISNIQEILPLLE +L+
```

-continued

```
Sbjct: 181 METELEVVEGMQFDRGYLSQYMVTDSEKMVADLENPYILITDKKISNIQEILPLLESILQ 240

Query: 241 TNRPLLIIADDVDGEALPTLVLNKIRGTFNVVAVKAPGFGDRRKAMLEDIAILTGGTVVT 300
            +NRPLLIIADDVDGEALPTLVLNKIRGTFNVVAVKAPGFGDRRKAMLEDIAILTGGTV+T
Sbjct: 241 SNRPLLIIADDVDGEALPTLVLNKIRGTFNVVAVKAPGFGDRRKAMLEDIAILTGGTVIT 300

Query: 301 EDLGLDLKDATMQVLGQSAKVTVDKDSTVIVEGAGDSSAIANRVAIIKSQMEATTSDFDR 360
            EDLGL+LKDAT++ LGQ+A+VTVDKDSTVIVEGAG+  AI++RVA+IKSQ+E TTS+FDR
Sbjct: 301 EDLGLELKDATIEALGQAARVTVDKDSTVIVEGAGNPEAISHRVAVIKSQIETTTSEFDR 360

Query: 361 EKLQERLAKLAGGVAVIKVGAATETELKEMKLRIEDALNATRAAVEEGIVSGGGTALVNV 420
            EKLQERLAKL+GGVAVIKVGAATETELKEMKLRIEDALNATRAAVEEGIV+GGGTAL NV
Sbjct: 361 EKLQERLAKLSGGVAVIKVGAATETELKEMKLRIEDALNATRAAVEEGIVAGGGTALANV 420

Query: 421 IEKVAALKLNGDEETGRNIVLRALEEPVRQIAYNAGYEGSVIIERLKQSEIGTGFNAANG 480
            I   A L+L GDE TGRNIVLRALEEPVRQIA+NAG+EGS++I+RLK +E+G GFNAA G
Sbjct: 421 IPAEATLELTGDEATGRNIVLRALEEPVRQIAHNAGFEGSIVIDRLKNAELGIGFNAATG 480

Query: 481 EWVDMVTTGIIDPVKVTRSALQNAASVASLILTTEAVVANKPEPEAPTAPAMDPSMMGG 539
            EWV+M+   GIIDPVKV+RSALQNAASVASLILTTEAVVANKPEP AP APAMDPSMMGG
Sbjct: 481 EWVNMIDQGIIDPVKVSRSALQNAASVASLILTTEAVVANKPEPVAP-APAMDPSMMGG 538
```

A related DNA sequence was identified in *S. pyogenes* <SEQ ID 6233> which encodes the amino acid sequence <SEQ ID 6234>. Analysis of this protein sequence reveals the following:

```
Possible site: 15
>>> Seems to have no N-terminal signal sequence

----- Final Results -----
            bacterial cytoplasm --- Certainty = 0.1070(Affirmative) < succ>
            bacterial membrane  --- Certainty = 0.0000(Not Clear)   < succ>
             bacterial outside  --- Certainty = 0.0000(Not Clear)   < succ>
```

An alignment of the GAS and GBS proteins is shown below.

```
Identities = 491/543 (90%), Positives = 515/543 (94%), Gaps = 3/543 (0%)

Query:   1 MAKDIKFSADARSAMVRGVDILADTVKVTLGPKGRNVVLEKAFGSPLITNDGVTIAKEIE   60
           MAKDIKFSADAR+AMVRGVD+LADTVKVTLGPKGRNVVLEKAFGSPLITNDGVTIAKEIE
Sbjct:   3 MAKDIKFSADARAAMVRGVDMLADTVKVTLGPKGRNVVLEKAFGSPLITNDGVTIAKEIE   62

Query:  61 LEDHFENMGAKLVSEVASKTNDIAGDGTTTATVLTQAIVREGLKNVTAGANPIGIRRGIE  120
           LEDHFENMGAKLVSEVASKTNDIAGDGTTTATVLTQAIV EGLKNVTAGANPIGIRRGIE
Sbjct:  63 LEDHFENMGAKLVSEVASKTNDIAGDGTTTATVLTQAIVHEGLKNVTAGANPIGIRRGIE  122

Query: 121 TAVSAAVEELKEIAQPVSGKEAIAQVAAVSSRSEKVGEYISEAMERVGNDGVITIEESRG  180
           TA + AVE LK IAQPVSGKEAIAQVAAVSSRSEKVGEYISEAMERVGNDGVITIEESRG
Sbjct: 123 TATATAVEALKAIAQPVSGKEAIAQVAAVSSRSEKVGEYISEAMERVGNDGVITIEESRG  182

Query: 181 METELEVVEGMQFDRGYLSQYMVTDNEKMVSELENPYILITDKKISNIQEILPLLEEVLK  240
           METELEVVEGMQFDRGYLSQYMVTDNEKMV++LENP+ILITDKK+SNIQ+ILPLLEEVLK
Sbjct: 183 METELEVVEGMQFDRGYLSQYMVTDNEKMVADLENPFILITDKKVSNIQDILPLLEEVLK  242

Query: 241 TNRPLLIIADDVDGEALPTLVLNKIRGTFNVVAVKAPGFGDRRKAMLEDIAILTGGTVVT  300
           TNRPLLIIADDVDGEALPTLVLNKIRGTFNVVAVKAPGFGDRRKAMLEDIAILTGGTV+T
Sbjct: 243 TNRPLLIIADDVDGEALPTLVLNKIRGTFNVVAVKAPGFGDRRKAMLEDIAILTGGTVIT  302

Query: 301 EDLGLDLKDATMQVLGQSAKVTVDKDSTVIVEGAGDSSAIANRVAIIKSQMEATTSDFDR  360
           EDLGL+LKDATM  LGQ+AK+TVDKDSTVIVEG+G S AIANR+A+IKSQ+E TTSDFDR
Sbjct: 303 EDLGLELKDATMTALGQAAKITVDKDSTVIVEGSGSSEAIANRIALIKSQLETTTSDFDR  362

Query: 361 EKLQERLAKLAGGVAVIKVGAATETELKEMKLRIEDALNATRAAVEEGIVSGGGTALVNV  420
           EKLQERLAKLAGGVAVIKVGA TET LKEMKLRIEDALNATRAAVEEGIV+GGGTAL+ V
Sbjct: 363 EKLQERLAKLAGGVAVIKVGAPTETALKEMKLRIEDALNATRAAVEEGIVAGGGTALITV  422

Query: 421 IEKVAALKLNGDEETGRNIVLRALEEPVRQIAYNAGYEGSVIIERLKQSEIGTGFNAANG  480
           IEKVAAL+L GD+ TGRNIVLRALEEPVRQIA NAGYEGSV+I++LK S   GTGFNAA G
Sbjct: 423 IEKVAALELEGDDATGRNIVLRALEEPVRQIALNAGYEGSVVIDKLKNSPAGTGFNAATG  482

Query: 481 EWVDMVTTGIIDPVKVTRSALQNAASVASLILTTEAVVANKPEP--EAPTAPA-MDPSMM  537
           EWVDM+  TGIIDPVKVTRSALQNAASVASLILTTEAVVANKPEP    AP  PA MDP MM
Sbjct: 483 EWVDMIKTGIIDPVKVTRSALQNAASVASLILTTEAVVANKPEPATPAPAMPAGMDPGMM  542
```

```
                              -continued
Query: 538 GGF                                                   540
           GGF
Sbjct: 543 GGF                                                   545
```

Based on this analysis, it was predicted that these proteins and their epitopes could be useful antigens for vaccines or diagnostics.

EXAMPLE 2016

A DNA sequence (GBSx2127) was identified in *S. agalactiae* <SEQ ID 6235> which encodes the amino acid sequence <SEQ ID 6236>. Analysis of this protein sequence reveals the following:

```
Possible site: 40
>>> Seems to have no N-terminal signal sequence

----- Final Results -----
            bacterial cytoplasm --- Certainty = 0.3216(Affirmative) < succ>
             bacterial membrane --- Certainty = 0.0000(Not Clear)   < succ>
              bacterial outside --- Certainty = 0.0000(Not Clear)   < succ>
```

A related GBS nucleic acid sequence <SEQ ID 10247> which encodes amino acid sequence <SEQ ID 10248> was also identified.

The protein has homology with the following sequences in the GENPEPT database.

```
>GP: BAB06113 GB: AP001515 transcriptional regulator (GntR family)
[Bacillus halodurans]
Identities = 50/171 (29%), Positives = 86/171 (50%), Gaps = 17/171 (9%)

Query:  21 HVQVYNKIFNMIQDGTYSPGMQLPSEPELAGQLNVSRATLRKSLALLQEDHLVKNIRGKG    80
           ++QV +K+ + ++ G Y   G +LPSE EL+ QL VSRATLR++L LL+E+ +V     G G
Sbjct:  10 YLQVIDKLKHDMEAGVYEEGEKLPSEFELSKQLGVSRATLREALRLLEEEGVVVRRHGVG   69

Query:  81 NFIRENSSNLSENGYENRQHPIKTCLTSKITEVELE--------FRVEVPAEAITASLKQ   132
           F+ ++ L    G E       +T I  ++E         +++E   +
Sbjct:  70 TFV--HTKPLFSAGIEELY-----SVTDMIRHADMEPGTIFLSSYQIEATDDDKRRFQTD  122

Query: 133 ETPVVVIADRWYHTDDGPLAYTLSFIPIELISDAEISLHDTKQLLNFIEEG           183
           +++ +R    D  P+ Y L  +P ELI   + S+H+    +L+ +E G
Sbjct: 123 NLDQLMMIERVRTADGVPIVYCLDKLPAELI--GQHSVHEINSILDHLESG           171
```

A related DNA sequence was identified in *S. pyogenes* <SEQ ID 6237> which encodes the amino acid sequence <SEQ ID 6238>. Analysis of this protein sequence reveals the following:

```
Possible site: 34
>>> Seems to have no N-terminal signal sequence

----- Final Results -----
            bacterial cytoplasm --- Certainty = 0.2297(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below.

```
Identities = 154/244 (63%), Positives = 189/244 (77%)

Query:   7 MPKNELNNKLNKLKHVQVYNKIFNMIQDGTYSPGMQLPSEPELAGQLNVSRATLRKSLAL    66
           M  N+L   KL KLKHVQVYN IF +IQDGTYSPGMQLPSEPELA QLNVSR TLRKSLAL
Sbjct:   1 MSTNDLTKKLKLKHVQVYNTIFQLIQDGTYSPGMQLPSEPELARQLNVSRMTLRKSLAL    60

Query:  67 LQEDHLVKNIRGKGNFIRENSSNLSENGYENRQHPIKTCLTSKITEVELEFRVEVPAEAI  126
           LQEDHL+KNIRGKGNFI +       G+E  QHPI   L+S IT+VELE+R+EVP  AI
```

-continued
```
Sbjct:   61 LQEDHLIKNIRGKGNFILKTPETKYHQGFEYLQHPIYASLSSDITKVELEYRIEVPTVAI  120

Query:  127 TASLKQETPVVVIADRWYHTDDGPLAYTLSFIPIELISDAEISLHDTKQLLNFIEEGIYQ  186
            TASLKQETPVV+I DRWYH+ +  +AY+LSFIPIE+IS   I+L+  + LL F+EE IY+
Sbjct:  121 TASLKQETPVVIIVDRWYHSQNKAIAYSLSFIPIEVISKYAINLNQEEPLLTFLEEKIYE  180

Query:  187 EGISSHSQSHLGYATSGNFSATKYTLSDHGQFILIQETIFKQEKILMCNKHYVPIEHFEL  246
             G +SHS + +GY  +GN++ATKYTLS++  FILIQET++  + IL+  KHYVP + F+L
Sbjct:  181 SGKASHSCNQIGYTKTGNYTATKYTLSENSAFILIQETLYNGKDILVSTKHYVPADLFDL  240

Query:  247 SITS                                                        250
            + S
Sbjct:  241 KVQS                                                        244
```

Based on this analysis, it was predicted that these proteins and their epitopes could be useful antigens for vaccines or diagnostics.

EXAMPLE 2017

A DNA sequence (GBSx2128) was identified in *S. agalactiae* <SEQ ID 6239> which encodes the amino acid sequence <SEQ ID 6240>. This protein is predicted to be purine nucleoside phosphorylase (udp-1). Analysis of this protein sequence reveals the following:

```
Possible site: 47
>>> Seems to have no N-terminal signal sequence

----- Final Results -----
              bacterial cytoplasm --- Certainty = 0.3910(Affirmative) < succ>
               bacterial membrane --- Certainty = 0.0000(Not Clear)   < succ>
                 bacterial outside --- Certainty = 0.0000(Not Clear)   < succ>
```

The protein has homology with the following sequences in the GENPEPT database.

```
>GP: AAC65977 GB: AE001270 uridine phosphorylase (udp) [Treponema
pallidum]
Identities = 145/246 (58%), Positives = 171/246 (68%)

Query:   11 QYHLQIRPGDVGRYVIMPGDPKRCAKIAEHFDNAVLVADSREYVTYTGTLNGEKVSVTST   70
            +YH+ ++  D+G YVI+PGDP R  KIA+HF +   V  +REYVTYTGTL    VSV ST
Sbjct:   10 EYHIGLKASDIGHYVILPGDPARSEKIAQHFSHPHKVGHNREYVTYTGTLCETPVSVMST   69

Query:   71 GIGGPSASIAMEELKLCGADTFIRVGTCGGIDLDVKGGDIVIATGAIRMEGTSKEYAPIE  130
            GIGGPS +I +EEL   GA TFIRVGT GG+  D+  G +VIATGAIR EGTSKEYAP+E
Sbjct:   70 GIGGPSTAIGVEELIHLGAHTFIRVGTSGGMQPDILAGTVVIATGAIRFEGTSKEYAPVE  129

Query:  131 FPAVADLEVTNALVNAAKKLGYTSHAGVVQCKDAFYGQHEPERMPVSYELLNKWEAWKRL  190
            FPAV D  VT AL +AA+ +     GVVQCKD FYGQH P  MPV  EL  KW AW
Sbjct:  130 FPAVPDFTVTAALKHAAEDVQVRHALGVVQCKDNFYGQHSPHTMPVHAELTQKWHAWIAC  189

Query:  191 GTKASEMESAALFVAASHLGVRCGSDFLVVGNQERNALGMDNPMAHDTEAAIQVAVEALR  250
              T ASEMESAALFV  S   VR G+  LV+GNQ R A G+++   HDTE AI+VAVEA++
Sbjct:  190 NTLASEMESAALFVLGSVRRVRTGAVLLVIGNQTRRAQGLEDIQVHDTENAIRVAVEAVK  249

Query:  251 TLIEND                                                      256
             LI  D
Sbjct:  250 LLITQD                                                      255
```

A related DNA sequence was identified in *S. pyogenes* <SEQ ID 6241> which encodes the amino acid sequence <SEQ ID 6242>. Analysis of this protein sequence reveals the following:

```
Possible site: 47
>>> Seems to have no N-terminal signal sequence

----- Final Results -----
              bacterial cytoplasm --- Certainty = 0.3910(Affirmative) < succ>
```

```
                           -continued
           bacterial membrane --- Certainty = 0.0000(Not Clear) < succ>
           bacterial outside  --- Certainty = 0.0000(Not Clear) < succ>
```

An alignment of the GAS and GBS proteins is shown below.

```
Identities = 259/259 (100%), Positives = 259/259 (100%)
Query:    1 MQNYSGEVGLQYHLQIRPGDVGRYVIMPGDPKRCAKIAEHFDNAVLVADSREYVTYTGTL   60
            MQNYSGEVGLQYHLQIRPGDVGRYVIMPGDPKRCAKIAENFDNAVLVADSREYVTYTGTL
Sbjct:    1 MQNYSGEVGLQYHLQIRPGDVGRYVIMPGDPKRCAKIAENFDNAVLVADSREYVTYTGTL   60

Query:   61 NGEKVSVTSTGIGGPSASIAMEELKLCGADTFIRVGTCGGIDLDVKGGDIVIATGAIRME  120
            NGEKVSVTSTGIGGPSASIAMEELKLCGADTFIRVGTCGGIDLDVKGGDIVIATGAIRME
Sbjct:   61 NGEKVSVTSTGIGGPSASIAMEELKLCGADTFIRVGTCGGIDLDVKGGDIVIATGAIRME  120

Query:  121 GTSKEYAPIEFPAVADLEVTNALVNAAKKLGYTSHAGVVQCRDAFYGQHEPERMPVSYEL  180
            GTSKEYAPIEFPAVADLEVTNALVNAAKKLGYTSHAGVVQCKDAFYGQHEPERMPVSYEL
Sbjct:  121 GTSKEYAPIEFPAVADLEVTNALVNAAKKLGYTSHAGVVQCKDAFYGQHEPERMPVSYEL  180

Query:  181 LNKWEAWKRLGTKASEMESAALFVAASHLGVRCGSDFLVVGNQSRNALGMDNPMAHDTEA  240
            LNKWEAWKRLGTKASEMESAALFVAASHLGVRCGSDFLVVGNQERNALGMDNPMAHDTEA
Sbjct:  181 LNKWEAWKRLGTKASEMESAALFVAASHLGVRCGSDFLVVGNQERNALGMDNPMAHDTEA  240

Query:  241 AIQVAVEALRTLIENDKSQ                                          259
            AIQVAVEALRTLIENDKSQ
Sbjct:  241 AIQVAVEALRTLIENDKSQ                                          259
```

Based on this analysis, it was predicted that these proteins and their epitopes could be useful antigens for vaccines or diagnostics.

EXAMPLE 2018

A DNA sequence (GBSx2129) was identified in *S. agalactiae* <SEQ ID 6243> which encodes the amino acid sequence <SEQ ID 6244>. This protein is predicted to be nucleoside transporter. Analysis of this protein sequence reveals the following:

```
Possible site: 25
>>> Seems to have an uncleavable N-term signal seq
   INTEGRAL Likelihood = -9.45 Transmembrane  35-51    (30-57)
   INTEGRAL Likelihood = -9.29 Transmembrane   8-24     (1-28)
   INTEGRAL Likelihood = -8.07 Transmembrane 388-404  (379-404)
   INTEGRAL Likelihood = -7.27 Transmembrane 104-120  (100-127)
   INTEGRAL Likelihood = -6.58 Transmembrane 259-275  (255-284)
   INTEGRAL Likelihood = -4.35 Transmembrane 172-188  (171-190)
   INTEGRAL Likelihood = -3.50 Transmembrane 200-216  (199-221)
   INTEGRAL Likelihood = -2.18 Tranamembrane 352-368  (352-371)

----- Final Results -----
           bacterial membrane  --- Certainty = 0.4779(Affirmative) < succ>
           bacterial outside   --- Certainty = 0.0000(Not Clear)   < succ>
           bacterial cytoplasm --- Certainty = 0.0000(Not Clear)   < succ>
```

A related GBS nucleic acid sequence <SEQ ID 10245> which encodes amino acid sequence <SEQ ID 10246> was also identified.

The protein has homology with the following sequences in the GENPEPT database.

```
>GP:BAB05165 GB:AP001512 nucleoside transporter [Bacillus halodurans]
Identities = 160/405 (39%), Positives = 256/405 (62%), Gaps = 8/405 (1%)
Query:    5 MQFIYSIIGILLVLGIVYAISFNRKSVSLSLIGKALIVQFIIALILVRIPLGQQVVSVVS   64
            M  ++ ++GI++V  I +A S NR+++     I   L +Q + A+I+++IP GQ ++ ++
Sbjct:    1 MNILWGLLGIVVVFLIAFAFSTNRRAIKPRTILGGLAIQLLFAIIVLKIPAGQALLESLT   60

Query:   65 TGVTKVINCGQAGLNFVFGSLADSGAKTGFIPAIQTLGNIVFLSALVSLLYYVGILGFVV  124
                 V+  I+       G++FVFG    + G+   GF+FAI   L   ++F SAL+S+LYY+GI+  FV+
Sbjct:   61 NVVLNIISYANEGIDFVFGGFFEEGSGVGFVFAINVLSVVIFFSALISILYYLGIMQFVI  120
```

-continued

```
Query:  125 KWIGKGVGKIMKSSEVESFVAVANMFLGQTDSPILVSKYLGRMTDSEIMVVLVSGMGSMS  184
            K IG  +   ++ +S+ ES   A AN+F+GQT++P++V   YL +MT SE+  V+  G+ S++
Sbjct:  121 KIIGGALSWLLGTSKAESMSAAANIFVGQTEAPLVVKPYLPKNTQSELFAVMTGGLASVA  180

Query:  185 VSILGGYIALGIPMEYLLIASTMVPIGSILIAKILLPQTEPVQKI-DDIKMDNKGNNANV  243
                S+L GY  LG+P++YLL AS M       +++AK+++P+TE       DD K+       +N+
Sbjct:  181 GSVLIGYSLLGVPLQYLLAASFMAAPAGLIMAKMIMPETEKTTDAEDDFKLAKDEESTNL  240

Query:  244 IDAIAEGASTGAQMAFSIGASLIAFVGLVSLINMMLSGLG-------IRLEQIFSYVFAP  296
                IDA A GASTG +  +I A L+AFV L++LIN +L  +G         + LE I  YVFAP
Sbjct:  241 IDAAANGASTGLMLVLNIAANLLAFVALIALINGILGWIGGLFGASQLSLELILGYVFAP  300

Query:  297 FGFLMGFDHKNILLEGNLLGSKLILNEFVSFQQLGDLIKSLDYRTALVATISLCGFANLS  356
                 F++G         L   G+ +G KL++NEFV++          I++L   +   +V +  +LCGFAN S
Sbjct:  301 LAFVIGIPWAEALQAGSYIGQKLVVNEFVAYLSFAPEIENLSDKAVMVISFALCGFANFS  360

Query:  357 SLGICVSGIAVLCPEKRGTLARLVFRANIGGIAVSMLSAFIVGIV                401
                SLGI + G+  L P +R  +ARL RA++ G    S+LSA I G++
Sbjct:  361 SLGILLGGLGKLAPSRRPDIARLGLRAILAGTLASLLSASIAGML                405
```

A related DNA sequence was identified in *S. pyogenes* <SEQ ID 6245> which encodes the amino acid sequence <SEQ ID 6246>. Analysis of this protein sequence reveals the following:

```
Possible site: 25
>>> Seems to have an uncleavable N-term signal seq
    INTEGRAL Likelihood = -9.45 Transmembrane  35-51   (30-57)
    INTEGRAL Likelihood = -9.29 Transmembrane   8-24   (1-28)
    INTEGRAL Likelihood = -8.07 Transmembrane 388-404  (379-404)
    INTEGRAL Likelihood = -7.27 Transmembrane 104-120  (100-127)
    INTEGRAL Likelihood = -6.58 Transmembrane 259-275  (255-284)
    INTEGRAL Likelihood = -4.35 Transmembrane 172-188  (171-190)
    INTEGRAL Likelihood = -3.50 Transmembrane 200-216  (199-221)
    INTEGRAL Likelihood = -2.18 Tranamembrane 352-368  (352-371)

----- Final Results -----
           bacterial membrane --- Certainty = 0.4779(Affirmative) < succ>
             bacterial outside --- Certainty = 0.0000(Not Clear) < succ>
          bacterial cytoplasm --- Certainty = 0.0000(Not Clear) < succ>
```

The protein has homology with the following sequences in the databases:

```
>GP:BAB05165 GB:AP001512 nucleoside transporter [Bacillus halodurans]
Identities = 160/405 (39%), Positives = 257/405 (62%), Gaps = 8/405 (1%)
Query:    5 MQFIYSIIGILLVLGIVYAISFNRKSVSLSLIGKALIVQFIIALILVRIPLGQQIVSVVS   64
            M   ++  ++GI++V  I  +A S  NR+++    I      L +Q +  A+I+++IP GQ ++  ++
Sbjct:    1 MNILWGLLGIVVVFLIAFAFSTNRRAIKPRTILGGLAIQLLFAIIVLKIPAGQALLESLT   60

Query:   65 TGVTSVINCGQAGLNFVFGSLADSGAKTGFIFAIQTLGNIVFLSALVSLLYYVGILGFVV  124
                 V ++I+       G++FVFG   + G+  GF+FAI  L   ++F  SAL+S+LYY+GI+  FV+
Sbjct:   61 NVVLNIISYANEGIDFVFGGFFEEGSGVGFVFAINVLSVVIFFSALISILYYLGIMQFVI  120

Query:  125 KWIGKGVGKIMKSSEVESFVAVANHFLGQTDSPILVSKYLGRNTDSEIMVVLVSGMGSMS  184
             K IG  +   +++S+ES  A AN+F+GQT++P++V   YL +MT SE+  V+   G+S++
Sbjct:  121 KIIGGALSWLLGTSKAESMSAAANIFVGQTEAPLVVKPYLPKMTQSELFAVMTGGLASVA  180

Query:  185 VSILGGYIALGIPMEYLLIASTMVPIGSILIAKILLPQTEPVQKI-DDIKMDNKGNNANV  243
                S+L GY  LG+P++YLL AS M       +++AK+++P+TE       DD K+       + N+
Sbjct:  181 GSVLIGYSLLGVPLQYLLAASFMAAPAGLIMAKMIMPETEKTTDAEDDFKLAKDEESTNL  240

Query:  244 IDAIAEGASTGAQMAFSIGASLIAFVGLVSLINMMLSGLG-------IRLEQIFSYVFAP  296
                IDA A GASTG +  +I A L+AFV L++LIN +L  +G         + LE I  YVFAP
Sbjct:  241 IDAAANGASTGLMLVLNIAAMLLAFVALIALINGILGWIGGLFGASQLSLELILGYVFAP  300

Query:  297 EGFLMGFDHKNILLEGNLLGSKLILNEFVSFQQLGHLIKSLDYRTALVATISLCGFANLS  356
                 F++G         L   G+ +G KL++NEFV++          I++L   +   +V +  +LCGFAN S
Sbjct:  301 LAFVIGIPWAEALQAGSYIGQKLVVNEFVAYLSFAPEIENLSOKAVMVISFALCGFANFS  360

Query:  357 SLGICVSGIAVLCPEKRSTLARLVFRAMIGGIAVSMLSAFIVGIV                401
                SLGI + G+  L P +R  +ARL RA++ G    S+LSA I G++
Sbjct:  361 SLGILLGGLGKLAPSRRPDIARLGLRAILAGTLASLLSASIAGML                405
```

An alignment of the GAS and GBS proteins is shown below.

```
Identities = 399/404 (98%), Positives = 401/404 (98%)
Query:    1 MEVIMQFIYSIIGILLVLGIVYAISFNRKSVSLSLIGKALIVQFIIALILVRIPLGQQVV   60
            +EVIMQFIYSIIGILLVLGIVYAISFNRKSVSLSLIGKALIVQFIIALILVRIPLGQQ+V
Sbjct:    1 LEVIMQFIYSIIGILLVLGIVYAISFNRKSVSLSLIGKALIVQFIIALILVRIPLGQQIV   60

Query:   61 SVVSTGVTKVINCGQAGLNFVFGSLADSGAKTGFIFAIQTLGNIVFLSALVSLLYYVGIL  120
            SVVSTGVT VINCGQAGLNFVFGSLADSGAKTGFIFAIQTLGNIVFLSALVSLLYYVGIL
Sbjct:   61 SVVSTGVTSVINCGQAGLNFVFGSLADSGAKTGFIFAIQTLGNIVFLSALVSLLYYVGIL  120

Query:  121 GFVVKWIGKGVGKIMKSSEVESFVAVANMFLGQTDSPILVSKYLGRMTDSEIMVVLVSGN  180
            GFVVKWIGKGVGKIMKSSEVESFVAVANMFLGQTDSPILVS YLGRMTDSEIMVVLVSGM
Sbjct:  121 GFVVKWIGKGVGKIMKSSEVESFVAVANMFLGQTDSPILVSRYLGRMTDSEIMVVLVSGM  180

Query:  181 GSMSVSILGGYIALGIPMEYLLIASTMVPIGSILIAKILLPQTEPVQKIDDIKMDNKGNN  240
            GSMSVSILGGYIALGIPMEYLLIASTMVPIGSILIAKILLPQTEPVQKIDDIKMDNKGNN
Sbjct:  181 GSMSVSILGGYIALGIPMEYLLIASTMVPIGSILIAKILLPQTEPVQKIDDIKMDNKGNN  240

Query:  241 ANVIDAIAEGASTGAQMAFSIGASLIAFVGLVSLINMMLSGLGIRLEQIFSYVFAPFGFL  300
            ANVIDAIAEGASTGAQMAFSIGASLIAFVGLVSLINMMLSGLGIRLEQIFSYVFAPFGFL
Sbjct:  241 ANVIDAIAEGASTGAQMAFSIGASLIAFVGLVSLINMMLSGLGIRLEQIFSYVFAPFGFL  300

Query:  301 MGFDHKNILLEGNLLGSKLILNEFVSFQQLGDLIKSLDYRTALVATISLCGFANLSSLGI  360
            MGFDHKNILLEGNLLGSKLILNEFVSFQQLG LIKSLDYRTALVATISLCGFANLSSLGI
Sbjct:  301 MGFDHKNILLEGNLLGSKLILNEFVSFQQLGHLIKSLDYRTALVATISLCGFANLSSLGI  360

Query:  361 CVSGIAVLCPEKRGTLARLVFRAMIGGIAVSMLSAFIVGIVTLF                 404
            CVSGIAVLCPEKR TLARLVFRAMIGGIAVSMLSAFIVGIVTLF
Sbjct:  361 CVSGIAVLCPEKRSTLARLVFRAMIGGIAVSMLSAFIVGIVTLF                 404
```

A related GBS gene <SEQ ID 8955> and protein <SEQ ID 8956> were also identified. Analysis of this protein sequence reveals the following:

```
Lipop: Possible site: -1 Crend: 1
McG: Discrim Score: 13.83
GvH: Signal Score (-7.5): -2.63
Possible site: 25
>>> Seems to have an uncleavable N-term signal seq
ALOM program count: 8 value: 9.45 threshold: 0.0
   INTEGRAL   Likelihood = -9.45 Transmembrane  35-51   (30-57)
   INTEGRAL   Likelihood = -9.29 Transmembrane   8-24   (1-28)
   INTEGRAL   Likelihood = -8.07 Transmembrane 388-404 (379-404)
   INTEGRAL   Likelihood = -7.27 Transmembrane 104-120 (100-127)
   INTEGRAL   Likelihood = -6.58 Transmembrane 259-275 (255-284)
   INTEGRAL   Likelihood = -4.35 Transmembrane 172-188 (171-190)
   INTEGRAL   Likelihood = -3.50 Transmembrane 200-216 (199-221)
   INTEGRAL   Likelihood = -2.18 Tranamembrane 352-368 (352-371)
   PERIPHERAL Likelihood =  3.82 286
 modified ALON score: 2.39

*** Reasoning Step: 3

----- Final Results -----
             bacterial membrane --- Certainty = 0.4779(Affirmative) < succ>
              bacterial outside --- Certainty = 0.0000(Not Clear)   < succ>
            bacterial cytoplasm --- Certainty = 0.0000(Not Clear)   < succ>
```

The protein has homology with the following sequences in the databases:

```
ORF01622(313-1512 of 1812)
GP|9656920|gb|AAF95495.1||AE004305(1-418 of 418) NuPC family protein {Vibrio
cholerae}
% Match = 24.0
% Identity = 39.5 % Similarity = 65.7
Matches = 160 Mismatches = 134 Conservative Sub.s = 106
```

```
276        306       336       366       396       426       456       486
C*STPHTY*K**ITISEVLEVIMQFIYSIIGILLVLGIVYAISFNRKSVSLSLIGKALIVQFIIALILVRIPLGQQVVSV
                  |  :   |:||: ::|||   :|  |||:::|    :|  |:  :||   ::  :| ||:::
                  MSLFMSLIGMAVLLGIAVLLSSNRKAINLRTVGGAFAIQFSLGAFILYVPWGQELLRG
                          10        20        30        40        50

516       546                 591       621       651       681       711
VSTGVTKVINCGQAGLNFVFGSLADSG-----AKTGFIFAIQTLGNIVFLSALVSLLYYVGILGFVVKWIGKGVGKIMKS
  |  |:  |||    |  :|:||  |              |||||  : |    ::|:|||:|:|||:|::  :|:: :|  |:   |  : :
FSDAVSNVINYGNDGTSFLFGGLVSGKMFEVFGGGGFIFAFRVLPTLIFFSALISVLYYLGVMQWVIRILGGGLQKALGT
         70        80        90       100       110       120       130

741       771       801       831       861       891       921       951
SEVESFVAVANMFLGQTDSPILVSKYLGRMTDSEIMVVLVSGMGSMSVSILGGYIALGIPMEYLLIASTMVPIGSILIAK
|  ||   | ||:|:|||::|::|  :: :||  ||:  |:   |: |:::   :| ||  ::|: :|||: ||| |   :|  ||
SRAESMSAAANIFVGQTEAPLVVRPFVPKMTQSELFAVMCGGLASIAGGVLAGYASMGVKIEYLVAASFMAAPGGLLFAK
         150       160       170       180       190       200       210

981      1011     1038      1068      1098      1128                 1167
ILLPQTEPVQKIDDIKMDNKGNN-ANVIDAIAEGASTGAQMAFSIGASLIAFVGLVSLINMMLSGLG-------IRLEQI
::  :| ||   | :|| :|    :     ||||||  |  |||    |:|:::||   ||||:||::|||  ||  |:|                   ::||  :
LMMPETEKPQDNEDITLDGGDDKPANVIDAAAGGASAGLQLALNVGAMLIAFIGLIALINGMLGGIGGWFGMPELKLEML
         230       240       250       260       270       280       290

1197      1227      1257      1287      1305      1332      1362      1392
FSYVFAPFGFLMGFDHKNILLEGNLLGSKLILNEFVSFQQ----LGDLIKS-LDYRTALVATISLCGFANLSSLGICVSG
:  :::|||:  ||:|              :  |::|  |  :  |||::  |                 |  :|     |   :|   : : :|||||||||:  |  :  |
LGWLFAPLAFLIGVPWNEATVAGEFIGLKTVANEFVAYSQFAPYLTEAAPVVLSEKTKAIISFALCGFANLSSIAILLGG
         310       320       330       340       350       360       370

1422      1452      1482      1512      1542      1572      1602      1632
IAVLCPEKRGTLARLVFRAMIGGIAVSMLSAFIVGIVTLF*KLTKERRIVTWK*KIF*KR*TILC*QQQQHGQKSKQF*M
:   | |::||  :||:   :|:|   |    ::::|  |     |
LGSLAPKRRGDIARMGVKAVIAGTLSNLMAATIAGFFLSF
         390       400       410
```

Based on this analysis, it was predicted that these proteins and their epitopes could be useful antigens for vaccines or diagnostics.

EXAMPLE 2019

A DNA sequence (GBSx2130) was identified in *S. agalactiae* <SEQ ID 6247> which encodes the amino acid sequence <SEQ ID 6248>. This protein is predicted to be deoxyribose-phosphate aldolase (deoC). Analysis of this protein sequence reveals the following:

```
Possible site: 49
>>> Seems to have no N-terminal signal sequence

----- Final Results -----
            bacterial cytoplasm --- Certainty = 0.2196(Affirmative) < succ>
            bacterial membrane  --- Certainty = 0.0000(Not Clear)   < succ>
            bacterial outside   --- Certainty = 0.0000(Not Clear)   < succ>
```

The protein has homology with the following sequences in the GENPEPT database.

```
>GP:CAA81646 GB:Z27121 deoxyribose aldolase [Mycoplasma hominis]
Identities = 99/199 (49%), Positives = 140/199 (69%), Gaps = 1/199 (0%)
Query:   5 DILKTVDHTLLATTATWPEIQTILDDAMAYETASACIPASYVKKAAEYVSGK-LAICTVI    63
           ++ K +DHT L+ +AT  +I  ++ +A+ Y+  S CI   SYVK A E +    + +CTVI
Sbjct:   3 ELNKYIDHTNLSPSATSKDIDKLIQEAIKYDFKSVCIAPSYVKYAKEALKNSDVLVCTVI    62

Query:  64 GFPNGYSTTAAKVFECQDAIKNGADEIDMVINLTDVKNGDFDTVEEEIRQIKAACQDHIL   123
           GFP GY+ T+ KV+E + A+++GADEIDMVIN+   K+G ++ V  EI+ IK AC       L
Sbjct:  63 GFPLGYNATSVKVYETKIAVEHGADEIDMVINVGRFKDGQYEYVLNEIKAIKEACNGKTL   122

Query: 124 KVIVETCQLTKEELIELCGVVTRSGADFIKTSTGFSTAGATFEDVEVMAKYVGEGVKIKA   183
           KVIVET  LTK ELI++   +V +SGADFIKTSTGFS   GA+FED++ M +   G+ + IKA
Sbjct: 123 KVIVETALLTKAELIKITELVMQSGADFIKTSTGFSYRGASFEDIQTMKETCGDKLLIKA   182

Query: 184 AGGISSLSDAEKFIALGAS                                            202
           +GGI   +L DA++ I LGA+
Sbjct: 183 SGGIKNLADAQEMIRLGAN                                            201
```

A related DNA sequence was identified in *S. pyogenes* <SEQ ID 6249> which encodes the amino acid sequence <SEQ ID 6250>. Analysis of this protein sequence reveals the following:

```
Possible site: 49
>>> Seems to have no N-terminal signal sequence

----- Final Results -----
            bacterial cytoplasm --- Certainty = 0.2196(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below.

```
Identities = 211/223 (94%), Positives = 217/223 (96%)
Query:    1 MEVKDILKTVDHTLLATTATWPEIQTILDDAMAYETASACIPASYVKKAAEYVSGKLAIC    60
            +EVKDILKTVDHTLLATTATWPEIQTILDDAMAYETASACIPASYVKKAAEYVSGKLAIC
Sbjct:    1 VEVKDILKTVDHTLLATTATWPEIQTILDDAMAYETASACIPASYVKKAAEYVSGKLAIC    60

Query:   61 TVIGFPNGYSTTAAKVFECQDAIKNGADEIDMVINLTDVKNGDFDTVEEEIRQIKAACQD   120
            TVIGFPNGYSTTAAKVFECQDAI+NGADEIDMVINLTDVKNGDFDTVEEEIRQIKA CQD
Sbjct:   61 TVIGFPNGYSTTAAKVFECQDAIQNGADEIDMVINLTDVKNGDFDTVEEEIRQIKAKCQD   120

Query:  121 HILKVIVETCQLTKEELIELCGVVTRSGADFIKTSTGFSTAGATFEDVEVMAKYVGEGVK   180
            HILKVIVETCQLTKEELIELCGVVTRSGADFIKTSTGFSTAGATFEDVEVMAKYVGEGVK
Sbjct:  121 HILKVIVETCQLTKEELIELCGVVTRSGADFIKTSTGFSTAGATFEDVEVMAKYVGEGVK   180

Query:  181 IKAAGGISSLEDAEKFIALGASRLGTSRIIKIVKNQKVEEGTY                   223
            IKAAGGISSLEDA+ FIALGASRLGTSRIIKIVKN+  +  +Y
Sbjct:  181 IKAAGGISSLEDAKTFIALGASRLGTSRIIKIVKNEATKTDSY                   223
```

Based on this analysis, it was predicted that these proteins and their epitopes could be useful antigens for vaccines or diagnostics.

EXAMPLE 2020

A DNA sequence (GBSx2131) was identified in *S. agalactiae* <SEQ ID 6251> which encodes the amino acid sequence <SEQ ID 6252>. This protein is predicted to be phosphopentomutase (deoB). Analysis of this protein sequence reveals the following:

```
Possible site: 22
>>> Seems to have no N-terminal signal sequence

----- Final Results -----
            bacterial cytoplasm --- Certainty = 0.0546(Affirmative) < succ>
             bacterial membrane --- Certainty = 0.0000(Not Clear)   < succ>
              bacterial outside --- Certainty = 0.0000(Not Clear)   < succ>
```

The protein has homology with the following sequences in the GENPEPT database.

```
>GP:AAC45496 GB:U80410 phosphopentomutase [Lactococcus lactis subsp.
cremoris]
Identities = 275/408 (67%), Positives = 325/408 (79%), Gaps = 7/408 (1%)
Query:    3 QFDRIHLVVLDSVGIGAAPDANDFVNAGVP------DGASDTLGHISKTVGLAVPNMAKI    56
            +F RIHLVV+DSVGIGAAFDA+ F N  V        D  SDT+GHIS+  GL VPN+ K+
Sbjct:    4 KFGRIHLVVMDSVGIGAAPDADKFFNHDVETHEAINDVKSDTIGHISEIRGLDVPNLQKL    63

Query:   57 GLGNIPRPQALKTVPAEENPSGYATKLQEVSLGKDTMTGMWEIMGLNITEPFDTFWNGFP   116
            G GNIPR   LKT+PA + P+ Y TKL+E+S GKDTMTGHWEIMGLNI  PF T+  G+P
Sbjct:   64 GWGNIPRESPLKTIPAAQKPAAYVTKLEEISKGKDTMTGHWEIMGLNIQTPFPTYPEGYP   123

Query:  117 EDIITKIEDFSGRKVIREANKPYSGTAVIDDFGPRQMETGELIIYTSADPVLQIAAHEDI   176
            ED++ KIE+FSGRK+IREANKPYSGTAVI+DFGPRQ ETGELIIYTSADPVLQIAAHED+
Sbjct:  124 EDLLEKIEEFSGRKIIREANKPYSGTAVIEDFGPRQLETGELIIYTSADPVLQIAAHEDV   183
```

```
Query: 177 IPLEELYRICEYARSITMERPALL-GRIIARPYVGEPGNFTRTANRHDYAVSPFEDTVLN 235
            I  EELY+ICEY RSIT+E    ++ GRIIARPYVGE GNF RT  R DYA+SPF +TVL
Sbjct: 184 ISREELYKICEYVRSITLEGSGIMIGRIIARPYVGEAGNFERTDGRRDYALSPFAETVLE 243

Query: 236 KLDQAGIDTYAVGKINDIFNGSGINHDMGHNKSNSHGIDTLIKTMGLSEFEKGFSFTNLV 295
            KL +AGIDTY+VGKI+DIFN  G+ +DMGHN ++  G+D L+K M  +EF +GFSFTNLV
Sbjct: 244 KLYKAGIDTYSVGKISDIFNTVGVKYDMGHNHNDMDGVDRLLKAMTKTEFTEGFSFTNLV 303

Query: 296 DFDALYGHRRDPHGYRDCLHEFDERLPEIISAMRDKDLLLITADHGNDPTYAGTDHTREY 355
            DFDA YGHRRD  GY    + +FD RLPEII AM++ DLL+ITADHGNDP+Y GTDHTREY
Sbjct: 304 DFDAKYGHRRDVEGYGKAIEDFDGRLPEIIDAMKEDDLLMITADHGNDPSYVGTDHTREY 363

Query: 356 IPLLAYSPSFTGNGLIPVGHFADISATVADNFGVDTAMIGESFLQDLV             403
            IPL+ +S SF    ++PVGHFADISAT+A+NF V A  GESFL  LV
Sbjct: 364 IPLVIFSKSFKEPKVLPVGHFADISATIAENFSVKKAQTGESFLDALV             411
```

There is also homology to SEQ ID 2740:

```
Identities = 348/402 (86%), Positives = 374/402 (92%)
Query:   1 MSQFDRIHLVVLDSVGIGAAPDANDFVNAGVPDGASDTLGHISKTVGLAVPNMAKIGLGN  60
           MS+F+RIHLVVLDSVGIGAAPDA+ F NAGV D  SDTLGHIS+  GL+VPNMAKIGLGN
Sbjct:   1 MSKFNRIHLVVLDSVGIGAAPDADKFFNAGVADTDSDTLGHISEAAGLSVPNMAKIGLGN  60

Query:  61 IPRPQALKTVPAEENPSGYATKLQEVSLGKDTMTGHWEIMGLNITEPFDTFWNGFPEDII 120
           I RP  LKTVP E+NP+GY TKL+EVSLGKDTMTGHWEIMGLNITEPFDTFWNGFPE+I+
Sbjct:  61 ISRPIPLKTVPTEDNPTGYVTKLEEVSLGKDTMTGHWEIMGLNITEPFDTFWNGFPEEIL 120

Query: 121 TKIEDFSGRKVIREANKPYSGTAVIDDFGPRQMETGELIIYTSADPVLQIAAHEDIIPLE 180
           TKIE+FSGRK+IREANKPYSGTAVIDDFGPRQMETGELI+YTSADPVLQIAAHEDIIP+E
Sbjct: 121 TKIEEFSGRKIIREANKPYSGTAVIDDFGPRQMETGELIVYTSADPVLQIAAHEDIIPVE 180

Query: 181 ELYRICEYARSITMERPALLGRIIARPYVGEPGNFTRTANRHDYAVSPFEDTVLNKLDQA 240
           ELY+ICEYARSIT+ERPALLGRIIARPYVG+PGNFTRTANRHDYAVSPF+DTVLNKL  A
Sbjct: 181 ELYKICEYARSITLERPALLGRIIARPYVGDPGNFTRTANRHDYAVSPFQDTVLNKLADA 240

Query: 241 GIDTYAVGKINDIFNGSGINHDMGHNKSNSHGIDTLIKTMGLSEFEKGFSFTNLVDFDAL 300
           G+ TYAVGKINDIFNGSGI +DMGHNKSNSHGIDTLIKT+ L EF KGFSFTNLVDFDA
Sbjct: 241 GVPTYAVGKINDIFNGSGITNDMGHNKSNSHGIDTLIKTLQLPEFTKGFSFTNLVDFDAN 300

Query: 301 YGHRRDPHGYRDCLHEFDERLPEIISAMRDKDLLLITADHGNDPTYAGTDHTREYIPLLA 360
           +GHRRDP GYRDCLHEFD RLPEII+ M++ DLLLITADHGNDPTYAGTDHTREYIPLLA
Sbjct: 301 FGHRRDPEGYRDCLHEFDNRLPEIIANMKEDDLLLITADHGNDPTYAGTDHTREYIPLLA 360

Query: 361 YSPSFTGNGLIPVGHFADISATVADNFGVDTAMIGESFLQDL                   402
           YS SFTGNGLIP GHFADISATVA+NFGVDTA+IGESFL  L
Sbjct: 361 YSVSFTGNGLIPQGHFADISATVAENFGVDTAMIGESFLSHL                   402
```

Based on this analysis, it was predicted that this protein and its epitopes, could be useful antigens for vaccines or diagnostics.

EXAMPLE 2021

A DNA sequence (GBSx2132) was identified in *S. agalactiae* <SEQ ID 6253> which encodes the amino acid sequence <SEQ ID 6254>. Analysis of this protein sequence reveals the following:

```
Possible site: 35
>>> Seems to have an uncleavable N-term signal seq
    INTEGRAL    Likelihood = -12.05    Transmembrane    9-25 (4-35)

----- Final Results -----
           bacterial membrane --- Certainty = 0.5819(Affirmative) < succ>
            bacterial outside --- Certainty = 0.0000(Not Clear)   < succ>
          bacterial cytoplasm --- Certainty = 0.0000(Not Clear)   < succ>
```

The protein has no significant homology with any sequences in the GENPEPT database.

A related DNA sequence was identified in *S. pyogenes* <SEQ ID 6255> which encodes the amino acid sequence <SEQ ID 6256>. Analysis of this protein sequence reveals the following:

```
Possible site: 56
>>> Seems to have no N-terminal signal sequence
     INTEGRAL    Likelihood = -5.57    Transmembrane    41-57 (38-60)

----- Final Results -----
               bacterial membrane --- Certainty = 0.3230(Affirmative) < succ>
                bacterial outside --- Certainty = 0.0000(Not Clear) < succ>
              bacterial cytoplasm --- Certainty = 0.0000(Not Clear) < succ>
```

A related sequence was also identified in GAS <SEQ ID 9143> which encodes the amino acid sequence <SEQ ID 9144>. Analysis of this protein sequence reveals the following:

```
Possible cleavage site: 49
>>> Seems to have an uncleavable N-term signal seq
     INTEGRAL    Likelihood = -5.57    Transmembrane    13-29 (10-32)

----- Final Results -----
               bacterial membrane --- Certainty = 0.323(Affirmative) < succ>
                bacterial outside --- Certainty = 0.000(Not Clear) < succ>
              bacterial cytoplasm --- Certainty = 0.000(Not Clear) < succ>
```

An alignment of the GAS and GBS proteins is shown below.

```
Identities = 276/544 (50%), Positives = 368/544 (66%), Gaps = 5/544 (0%)
Query:   5 FKKKVVKVCLVIFGIVLVSLLSLGFFYFSKGQVLSRFVAARSRTSGQAFDNIKEYMVWSD    64
           F  K +K    +I    L    L G FY+SK    ++ ++ ARS   SG  F+NIK Y+VW D
Sbjct:  33 FHHKKLKQITIIAATSLFLFLIGGAFYYSKNHCINAYLKARSAQSGPVFENIKAYLVWDD    92

Query:  65 TGESITNDEANYANFEPLSKSEARKLGQEIKEGNKNDSMYLKRVGSRLGIFPDYRIANKP   124
           T E ITNDEA Y  F    S+ E R+  Q++K  +++ ++ +K VG R  IFPDYRIA KP
Sbjct:  93 TNEQITNDEAMYTKFRRYSQKELRQKKQDLKAASQDSAVQVKSVGRRFWIFPDYRIAIKP   152

Query: 125 MSLTLKTNVPKLDVLLNQKKVATSNSDHFSVTVERLPRTHYTASLEGTSDGKEIKLKKDY   184
           M LT+KTNVP+  DVLLNQKKVA S+S+ FSV ++RLP    YTAS+ G  +G+ IK+ K Y
Sbjct: 153 NDLTIKTNVPQADVLLNQKKVAVSDSEQFSVKLDRLPTAEYTASIRGKHNGRNIKVNKSY   212

Query: 185 DGKNQTIDLSVAFKSFTVTSNLMDGNLYFGDNRIAKLKDGSHSVENYPVTDGSKAYIKKV   244
           DG N  +DLSV+F++ F VTSN   G+LYF DN I  LKDG    VE+YPVT+ ++AY+K
Sbjct: 213 DGDNPVLDLSVSFRTFLVTSNAKQGDLYFDDNHIGTLKDGQLQVEDYPVTENAQAYMKTT   272

Query: 245 FNDGEITSHKQKLISIADNQTIKLDVDGLLNEKEAGQKLITAFNQLILYVSTGQDPQTLG   304
           F DGE+ S K L  + +   T+++ V LL E +AG+ L++AF+QL+ Y+STGQD     L
Sbjct: 273 FPDGELRSQKYALADVEEGATLEILVTDLLEEDKAGELLVSAFDQLMHYLSTGQDSSNLR   332

Query: 305 TVFEKGAENDFYKGLKEGIKAKFVTDNRKASHFTIPNIVLNKMTQVGKESYQVNFAADYD   364
           +VFE G+  N FY+GLKESIKAKF TD RKAS   IP+I+L  MTQVGK +Y ++F A Y+
Sbjct: 333 SVFEAGSSNAFYRGLKESIKAKFQTDTRKASRLNIPSILLTTMTQVGKTTYVLDFTATYE   392

Query: 365 FNYDKSTDPDKKTYGHIIQNLTGNFIMKKSGNSYLISNDGKKDITVAKETNKVKADPVSI   424
           F  YDKSTDP++  T GHI Q+LTG  +KK G  YLIS  G K+ITV KE N++KA   S+
Sbjct: 393 FLYDKSTDPEQHTSGHINQDLTGKVTVKKVGQHYLISQSGSKNITVVKEDNQLKAP--SV   450

Query: 425 FPENLVGSWKESVEDGTVTMTFDKDGKVTQK-KVYKDSKSKESNHSAKVTKLEDKGNGLY   483
           FPE+++G+W G+      ++ M+    DG +T K +   K ++SKE+    +AK++K+EDKGNG Y
Sbjct: 451 FPESILGTWTGQANGLSIHMSLASDGTITTKVEDQKGNRSKET-RTAKISKVEDKGNGFY   509

Query: 484 LYQYESGTDTTTFV-TGGIGGLKVKYAYGIKIEGNKIIPVIWQTSSDGEFDYHKPLLSKP   542
           LY +  G+D +  V  GG+GG  VKYAYG KI G    PV+WQ +    EFDY KPL
Sbjct: 510 LYTPDPGSDISALVPEGGLGGANVKYAYGFKISGKTASPVVWQAALTHSFDYTKPLSGVT   569

Query: 543 LTKQ   546
           L KQ
Sbjct: 570 LQKQ   573
```

A related DNA sequence was identified in *S. pyogenes* <SEQ ID 9065> which encodes amino acid sequence <SEQ ID 9066>. An alignment of the GAS and GBS sequences follows:

```
Score = 47.3 bits (110), Expect = 4e-07
Identities = 65/303 (21%), Positives = 119/303 (38%), Gaps = 18/303 (5%)
Query: 153 FYILGIGTSISIVVALTRFVKEISLNFKEIKKLANKMGIEVLSENENYSQII---EFDDI 209
            +YIL + T I+ +V    + +S  F  +KKL KM       + +QI    EF D+
Sbjct:  37 YYILSV-TIIACIVGGIVNLFLLSSVFTSLKKLKQKMKDISQRCFDTKAQICSPQEFKDL  95

Query: 210 LRTLHIKGDNLKSLIEREILEKQDLSFQIAALSHDIKTPXXXXXXXXXXXXXXXXXXXQE 269
            +        L+S  +      +++ +  IA LSHDIKTP                  +
Sbjct:  96 ETAFNQMSSELESTFKSLNESEREKTMMIAQLSHDIKTPITSIQSTVEGILDGIISEEEV 155

Query: 270 GYIVSMNNSISVFEGYFNSLISYTRML--------SEDRSVKLILVEELLSELHFEVDDL 321
            Y +   N+IS    N L+     +       +E    + I +++LL ++  E   +
Sbjct: 156 NYYL---NTISRQTNRLNHLVEELSFITLETMSDTAEPHKEETIYLDKLLIDILSEFQLV 212

Query: 322 LNINNIEFSICNRLIITSFYGDEENLIRALSNLLVNAIRFMPVLDKKIEVILSESGEQIH 381
                 N + I    ++        + L R L NL+ + NA ++       + +    + + I
Sbjct: 213 FEKENRQVMIDVAPDVSKLSSQYDKLSRILLNLISNAXKYSDP-GSPLTIKAYSNRQDIV 271

Query: 382 FEIWNNGERFSDSTLKKGDKLFYTEDYSRGNK--HYGIGLAFVKGVAIKHGGNLQLNNPA 439
            +I + G     D  L      Y  + SR  K   +G+GL    + +A +  G++ + +
Sbjct: 272 IDIIDQGYGIKDEDLASIFNRLYRVESSRNMKTGGHGLGLYIARQLAHQLNGDILVESQY 331

Query: 440 RGG                                                         442
            + G
Sbjct: 332 QKG                                                         334
```

A related sequence was also identified in GAS <SEQ ID 9135> which encodes the amino acid sequence <SEQ ID 9136>. Analysis of this protein sequence reveals the following:

```
Possible site: 37
>>> Seems to have a cleavable N-term signal seq.
INTEGRAL Likelihood = -3.56 Transmembrane 145-161 (145-164)

----- Final Results -----
          bacterial membrane --- Certainty = 0.2423(Affirmative) < succ>
            bacterial outside --- Certainty = 0.0000(Not Clear) < succ>
          bacterial cytoplasm --- Certainty = 0.0000(Not Clear) < succ>
```

SEQ ID 6254 (GBS280) was expressed in *E. coli* as a His-fusion product. SDS-PAGE analysis of total cell extract is shown in FIG. 52 (lane 8; MW 63.7 kDa). It was also expressed in *E. coli* as a GST-fusion product. SDS-PAGE analysis of total cell extract is shown in FIG. 58 (lane 7; MW 88.7 kDa).

Based on this analysis, it was predicted that these proteins and their epitopes could be useful antigens for vaccines or diagnostics.

EXAMPLE 2022

A DNA sequence (GBSx2133) was identified in *S. agalactiae* <SEQ ID 6257> which encodes the amino acid sequence <SEQ ID 6258>. This protein is predicted to be ribosomal large subunit pseudouridine synthase D (rluC). Analysis of this protein sequence reveals the following:

```
Possible site: 22
>>> Seems to have an uncleavable N-term signal seq
INTEGRAL Likelihood = -4.62 Transmembrane 2-18 (1-19)

----- Final Results -----
          bacterial membrane --- Certainty = 0.2848(Affirmative) < succ>
            bacterial outside --- Certainty = 0.0000(Not Clear) < succ>
          bacterial cytoplasm --- Certainty = 0.0000(Not Clear) < succ>
```

The protein has homology with the following sequences in the GENPEPT database.

```
>GP:CAB12749 GB:Z99108 similar to hypothetical proteins [Bacillus subtilis]
Identities = 97/251 (38%), Positives = 147/251 (57%), Gaps = 15/251 (5%)
Query:  86 KHVLINNEFINWQTVVQENDTITLIFDDEDYFTKKIPLGRAELIDCLYEDEHLIIVNKPE 145
            + + +N+E +    +V++ D + +    + +     G    +D L+ED H++I+NKP
Sbjct:  43 QQIKVNHESVLNNMIVKKGDRVFIDLQESEASSVIPEYGE---LDILFEDNHMLIINKPA  99

Query: 146 GMKTHGNQPHEIALLNHVSAY----SGQTCYV--VHRLDMETSGAVLFAKNPFILPLINQ 199
            G+ TH N+  +  L ++ AY     +G+TC V   VHRLD +TSGA++FAK+     +++Q
Sbjct: 100 GIATHPNEDGQTGTLANLIAYHYQINGETCKVRHVHRLDQDTSGAIVFAKHRLAHAILDQ 159
```

-continued

```
Query: 200 RLERKEIWREYWALVEGKFSPKHQVLRDKIGRNR-HDRRKRIIDSKNGQHAMTIIDVL-- 256
           +LE+K + R Y A+ EGK   K  +   IGR+R H  R+R+  S  GQ A+T    V+
Sbjct: 160 QLEKKTLKRTYTAIAEGKLRTKKGTINPPIGRDRSHPTRRRV--SPGGQTAVTHFKVMAS 217

Query: 257 KYIQNSSLIKCRLETGRTHQIRVHLSHHGHPLIGDPLYNPSSN-NERLMLHAHRLTLSHP 315
             +   SL++   LETGRTHQIRVHL+  GHPL GD LY  S    R  LHA+++   HP
Sbjct: 218 NAKERLSLVELELETGRTHQIRVHLASLGHPLTGDSLYGGGSKLLNRQALHANKVQAVHP 277

Query: 316 LTCETISVEAP                                                  326
           +T  E  I   EAP
Sbjct: 278 ITDELIVAEAP                                                  288
```

A related DNA sequence was identified in *S. pyogenes* <SEQ ID 6259> which encodes the amino acid sequence <SEQ ID 6260>. Analysis of this protein sequence reveals the following:

```
Possible site: 38
>>> Seems to have no N-terminal signal sequence

----- Final Results -----
             bacterial cytoplasm --- Certainty = 0.4198(Affirmative) < succ>
              bacterial membrane --- Certainty = 0.0000(Not Clear)   < succ>
                bacterial outside --- Certainty = 0.0000(Not Clear)   < succ>
```

An alignment of the GAS and GBS proteins is shown below.

```
Identities = 172/278 (61%), Positives = 212/278 (75%), Gaps = 2/278 (0%)
Query:  63 TVKELLEDYFLIPRKIRHFLRVKKHVLINNEFINWQTVVQENDTITLIFDDEDYPTKKIP 122
           TVK LLE+  LIPRKIRNFLR KKHVLIN   +NWQ+ V+  D + L FD EDYP K I
Sbjct:   2 TVKALLEEQLLIPRKIRHFLRTKKHVLINGHSVNWQSCVKYGDQVKLFFDHEDYPSKIIV  61

Query: 123 LGRAELIDCLYEDEHLIIVNKPEGMKTHGNQPNEIALLNHVSAYSGQTCYVVHRLDMETS 182
           +G+AE + CLYEDEH+IIVNKPEGMKTHGN P E+ALLNHVSAY+GQTCYVVHRLD ETS
Sbjct:  62 MGQAEKVTCLYEDEHIIIVNKPEGMKTHGNDPTELALLNHVSAYTGQTCYVVNRLDKETS 121

Query: 183 GAVLFAKNPFILPLINQRLERKEIWREYWALVEGKFSPKNQVLRDKIGRNRHDRRKRIID 242
           GA+LFAK PFILP++N+ LE+++I REY ALV G             IGR+RHDRRKR++D
Sbjct: 122 GAILFAKTPFILPILNRLLEKRDIHREYLALVHGSLDSPRVTYHHPIGRHRHDRRKRVVD 181

Query: 243 SKNGQNANTIIDVLK-YIQNSSLIKCRLETGRTHQIRVHLSHHGHPLIGDPLY-NPSSNN 300
              NG+ A+T + ++K  +  +SL+  C+L+TGRTHQIRVHL+H GH L  GDPLY N   +
Sbjct: 182 PINGKKAITEVTLVKNFHKTASLLTCQLQTGRTHQIRVHLAHQGHVLFGDPLYSNGKKDC 241

Query: 301 ERLMLHANRLTLSHPLTCETISVEAPSSTFEKILNNYK                       338
            RLMLHA++L L HPLT E I V+A S+TF++LN  K
Sbjct: 242 ARLMLHAYQLRLKHPLTQEDICVQAKSATFDAVLNAQK                       279
```

Based on this analysis, it was predicted that these proteins and their epitopes could be useful antigens for vaccines or diagnostics.

EXAMPLE 2023

A DNA sequence (GBSx2134) was identified in *S. agalactiae* <SEQ ID 6261> which encodes the amino acid sequence <SEQ ID 6262>. Analysis of this protein sequence reveals the following:

```
Possible site: 52
>>> Seems to have no N-terminal signal sequence
INTEGRAL Likelihood = -9.02 Transmembrane 98-114 (93-119)

----- Final Results -----
              bacterial membrane --- Certainty = 0.4609(Affirmative) < succ>
                bacterial outside --- Certainty = 0.0000(Not Clear)   < succ>
             bacterial cytoplasm --- Certainty = 0.0000(Not Clear)   < succ>
```

The protein has homology with the following sequences in the GENPEPT database.

```
>GP:AAF04735 GB:AF101780 penicillin-binding protein 2a
[Streptococcus pneumoniae]
Identities = 424/773 (54%), Positives = 555/773 (70%), Gaps = 47/773 (6%)
Query:   2 KLFDKFIDLFRVOEDNDEMTRKNEQETREETSNLDGEEVYDIDDITRPSKSQYQRGIRHQ   61
           KLF+KF+ LF+              +ETS L+  +     I R S+S
Sbjct:   5 KLFEKFLSLFK----------------KETSELEDSD----STILRRSRS---------  34

Query:  62 KENAKSRPEWLQKVDRYLPSPKNPIRRFWRRYRIGKLLFIALMAFILIFGSYLFYLSKTA  121
                         DR   +   PIR+FWRRY +K++ I  ++  L+ G YLF ++K+
Sbjct:  35 --------------DRKKLAQVGPIRKFWRRYHLTKIILILGLSAGLLVGIYLFAVAKST   80

Query: 122 TVSDLQSALKTTTTIYDKNKEYAGKLSGQKGTYVELNAISDHLKNAVIATEDRTFYSNNG  181
              V+DLQ+ALKT  T I+D+ ++ AG LSGQKGTYVEL  IS +L+NAVIATEDR+FY+N+G
Sbjct:  81 NVNDLQNALKTRTLIFDREEKEAGALSGQKGTYVELTDISKNLQNAVIATEORSFYKNDG  140

Query: 182 VNFKRFFLAVATLGKFGGGSTITQQLAKNAYLSQDQTIKRKAREFFLALELTKKYSKAEI  241
              +N+ RFFLA+ T G+ GGGSTITQQLAKNAYLSQDQT++RKA+EFFLALEL+KKYSK +I
Sbjct: 141 INYGRFFLAIVTAGRSGGGSTITQQLAKNAYLSQDQTVERRAKEFFLALELSKKYSKSQI  200

Query: 242 LTMYLNNSYFGNGVWGVEDASRKYFGTSAANLTVDEAATLAGMLKGPEVYNPYYSVENAT  301
              LTMYLNN+ YFGNGVWGVEDAS+KYFG SA+ +++D+AATLAGMLKGPE+YNP  SVE++T
Sbjct: 201 LTMYLNNAYFGNGVWGVEDASKKYFGVSASEVSLDQAATLAGMLKGPELYNPLNSVEDST  260

Query: 302 NRRDTVLAAMVDAGKLTKSQAKEAASIGMKNRLADTYAGKINDYRYPSYFDAVVNSAIDT  361
              NRRDTVL  MV AG + K+Q  EAA + M ++L D Y GKI+DYRYPSYFDAVVNEA+
Sbjct: 261 NRRDTVLQNMVAAGYIDKNQSTSAAEVDMTSQLHDKYEGKISDYRYPSYFDAVVNSAVSK  320

Query: 362 YGISEKDIVNNGYKIYTALDQNYQSGMQKTFDDTSLFPVSDYDGQSAQGASVALDPKTGG  421
              Y ++E++IVNNGY+IYT LDQNYQ+ MQ  +++TSLFP ++ DG  AQ  SVAL+PKTGG
Sbjct: 321 YNLTSEEIVNNGYRIYTELDQNYQANMQIVYENTSLFPRAE-DGTFAQSGSVALEPKTGG  379

Query: 422 VRGLVGRVQSTKDAQFRSFNYATQSKRSPASTIKPLVVYSPAIASGWSIDKELPNKVQDF  481
              VRG+VG+V          FR+FNYATQSKRSP STIKPLVVY+PA+ +GW+++K+L N    +
Sbjct: 380 VRGVVGQVADNDKTGFRNFNYATQSKRSPGSTIKPLVVYTPAVEAGWALNKQLDNHTMQY  439

Query: 482 HGYKPSNYGGIET-ESIPMYQALANSYNIPAVYTLDKLGINKAFTYGRKFGLNMSSANKE  540
                 YK   NY GI+T   +PMYQ+LA S N+PAV T++ LG++KAF  G   KFGLNM ++
Sbjct: 440 DSYKVDNYAGIKTSREVPMYQSLAESLNLPAVATVNDLGVDKAFEAGEKFGLNMEKVDRV  499

Query: 541 LGVALGGSVTTNPLEMAQAYSTFANDGIMHRANLITRIETANGKLVKQFTDKPKRVISRS  600
              LGVALG  V TNPL+MAQAY+ FAN+G+M  AH I+RIE A+G+++    +  KRVI +S
Sbjct: 500 LGVALGSGVETNPLQNAQAYAAFANEGLMPEAHFISRIENASGQVIASHKNSQKRVIDKS  559

Query: 601 VASKMTSMMLGTFSNGTAINANVYGYTMAGKTGTTSTDFNPNLSGDQWVVGYTPDVVISQ  660
                VA KMTSMNLGTF+NGT I+++  Y MAGKTGTTE   FNP  + DQWV+GYTPDVVIS
Sbjct: 560 VADKMTSMMLGTFTNGTGISSSPADYVMAGKTGTTEAVFNPEYTSDQWVIGYTPDVVISH  619

Query: 661 WVGFKNTDKHHYLTDSSAGTASNIFSTQASYILPYTKGSSFTHIENAYFQNGIGSVYNAQ  
                W+GF   TD++HYL S++ A+++F  A+ ILPYT GS+FT +ENAY QNGI       +
Sbjct: 620 WLGFPTTDENNYLAGSTSNGAAHVFRNIANTILPYTPGSTFT-VENAYKQNGIAPANTKR  678

Query: 721 DASNTTNQESRSIINDLKDSASKAAQDISRAVEDSNFQEKVKDAWNSLKDYFR          773
                      N ++    ++D++  A    + SRA+ D+  +EK +   W+S+ +FR
Sbjct: 679 QVQTNDNSQTDDNLSDIRGRAQSLVDEASRAISDAKIKEKAQTIWDSIVNLWR          731
```

A related DNA sequence was identified in *S. pyogenes* <SEQ ID 6263> which encodes the amino acid sequence <SEQ ID 6264>. Analysis of this protein sequence reveals the following:

```
Possible site: 52
>>> Seems to have no N-terminal signal sequence
INTEGRAL Likelihood = -7.96 Transmembrane 104-120 (99-124)

----- Final Results -----
            bacterial membrane --- Certainty = 0.4185(Affirmative) < succ>
             bacterial outside --- Certainty = 0.0000(Not Clear)   < succ>
           bacterial cytoplasm --- Certainty = 0.0000(Not Clear)   < succ>
```

The protein has homology with the following sequences in the databases:

```
>GP:AAF04735 GB:AF101780 penicillin-binding protein 2a [Streptococcus pneumoniae]
Identities = 414/730 (56%), Positives = 539/730 (73%), Gaps = 17/730 (2%)
Query:  50 TKNSEQDPATALQRSRAYEGSPKSRPAWLQKLEAVLPSPQRPIRRFWRRYHIGKLLMILI   109
            T   E   +T L+RSR+          +KL V        PIR+FWRRYH+ K+++IL
```

-continued

```
Sbjct:   18 TSELEDSDSTILRRSRSDR----------KKLAQV-----GPIRKFWRRYHLTKIILILG   62

Query:  110 GTLVLLLGSYLFYLSKTAKVSDLQDALKATTVIYDHKGEYAGSLSGQKGSYVELNAISDD  169
             +  LL+G YLF ++K+ V+DLQ+ALK T+I+D + + AG+LSGQKG+YVEL  IS +
Sbjct:   63 LSAGLLVGIYLFAVAKSTNVNDLQNALKTRTLIFDREEKEAGALSGQKGTYVELTDISKN  122

Query:  170 LENAVIATEDRTFYSNSGINLKRFLLAVVTAGRFGGGSTITQQLAKNAYLSQDQTIKRKA  229
             L+NAVIATEDR+FY N GIN  RF LA+VTAGR GGG STITQQLAKNAYLSQDQT++RKA
Sbjct:  123 LQNAVIATEDRSFYKNDGINYGRFFLAIVTAGRSGGGSTITQQLAKNAYLSQDQTVERKA  182

Query:  230 REFFLALELTKKYSKKDILTMYLNNSYFGNGVWGVEDASQKYFGTTAANLTLDEAATLAG  289
             +EFFLALEL+KKYSK+ ILTMYLNN+YFGNGVWGVEDAS+KYFG +A+ ++LD+AATLAG
Sbjct:  183 KEFFLALELSKKYSKEQILTNYLNNAYFGNGVWGVEDASKKYFGVSASEVSLDQAATLAG  242

Query:  290 MLKGPEIYNPYHSLRNATHRRDTVLGAMVDAKKITQTKAQQARAVGLKNRLADTYVGKTD  349
             MLKGPE+YNP +S++++T+RRDTVL  MV A  I + +   +A V + ++L D Y GK
Sbjct:  243 NLKGPSLYNPLNSVEDSTNRRDTVLQNMVAAGYIDKNQETEAAEVDMTSQLHDKYEGKIS  302

Query:  350 DYKYPSYFDAVISEAIATYGLSEKDIVNNGYKVYTELDQNYQTGMQTTFNNDELFPVSAY  409
             DY+YPSYFDAV++EA++ Y L+E++IVNNGY++YTELDQNYQ  MQ  + N  LFP  A
Sbjct:  303 DYRYPSYFDAVVNEAVSKYNLTEEEIVNNGYRIYTELDQNYQANMQIVYENTSLFP-RAE  361

Query:  410 DGSSAQAASVALDPKTGGVRGLIGRVNSSENPTFRSFNYATQAKRSPASTIKPLVVYAPA  469
             DG+AQ+ SVAL+PKTGGVRG++G+V ++    FR+FNYATQ+KRSP STIKPLVVY PA
Sbjct:  362 DGTFAQSGSVALEPKTGGVRGVVGQVADNDKTGFRNFNYATQSKRSPGSTIKPLVVYTPA  421

Query:  470 VASGWSIEKELPNTVQDFDGYQPHNY-GNYESEDVPMYQALANSYNIPAVSTLNDIGIDK  528
             V +GW++ K+L N   +D Y+ NY G   S +VPMYQ+LA S N+PAV+T+ND+G+DK
Sbjct:  422 VEAGWALNKQLDNHTMQYDSYKVDNYAGIKTSREVPMYQSLAESLNLPAVATVNDLGVDK  481

Query:  529 AFTYGKTFGLDMSSAKKELGVALGGSVTTNPLEMAQAYAAFANNGVIHPAHLINRIENAR  588
             AF  G+ FGL+M   + LGVALG V TNPL+MAQAYAAFAN G++  AH I+RIENA
Sbjct:  482 AFEAGEKFGLNMEKVDRVLGVALGSGVETNPLQMAQAYAAFANEGLMPEAHFISRIENAS  541

Query:  589 GEVLKTFTDKAKRVVSQSVADKMTAMNLGTFSNGTAVNANVYGYTLAGKTGTTETNFNPD  648
             G+V+ + + KRV+ +SVADKT+MMLGTF+NGT ++++   Y +AGKTGTTE  FNP+
Sbjct:  542 GQVIASHKNSQKRVIDKSVADKMTSMMLGTFTNGTGISSSPADYVMAGKTGTTEAVFNPE  601

Query:  649 LAGDQWVIGYTPDVVISQWVGFNQTDENHYLTDSSAGTASAIFSTQASYILPYTKGSQFH  708
                DQWVIGYTPDVVIS W+GF  TDENHYL  S++ A+ +F    A+  ILPYT GS F
Sbjct:  602 YTSDQWVIGYTPDVVISHWLGFPTTDENHYLAGSTSNGAAHVFRNIANTILPYTPGSTFT  661

Query:  709 VDNAYAQNGISAVYGVNETGNQSGVDTQSIIDGLRKSAQEASQSLSKAVDQSGLRDKAQS  768
             V+NAY QNGI+        +    T +  +R AQ      S+A+ +  +++KAQ+
Sbjct:  662 VENAYKQNGIAPANTKRQVQTNDNSQTDDNLSDIRGRAQSLVDEASRAISDAKIKEKAQT  721

Query:  769 IWKEIVDYFR  778
             IW  IV+ FR
Sbjct:  722 IWDSIVNLFR  731
```

An alignment of the GAS and GBS proteins is shown below.

```
Identities = 530/715 (74%), Positives = 623/715 (87%), Gaps = 1/715 (0%)
Query:   59 RHQKENAKSRPEWLQKVDRYLPSPKNPIRRFWRRYRIGKLLFIALMAFILIFGSYLFYLS  118
             R + + KSRP WLQK++  LPSP+ PIRRFWRRY IGKLL I +   +L+ GSYLFYLS
Sbjct:   65 RAYEGSPKSRPAWLQKLEAVLFSPQRPIRRFWRRYHIGKLLMILIGTLVLLLGSYLFYLS  124

Query:  119 KTATVSDLQSALKTTTTIYDKNKEYAGKLSGQKGTYVELNAISDHLKNAVIATEDRTFYE  178
             KTA VSDLQ ALK TT TIYD   EYAG LSGQKG+YVELNAISD L+NAVIATEDRTFY
Sbjct:  125 KTAKVSDLQDALKATTVIYDHKGEYAGSLSGQKGSYVELNAISDDLENAVIATEDRTFYS  184

Query:  179 NNGVNFKRFFLAVATLGKFGGGSTITQQLAKNAYLSQDQTIKRKAREFFLALELTKKYSK  238
             N+G+N KRF LAV T G+FGGGSTITQQLAKNAYLSQDQTIKRKAREFFLAL LTKKYSK
Sbjct:  185 NSGINLKRFLLAVVTAGRFGGGSTITQQLAKNAYLSQDQTIKRKAREFFLALSLTKKYSK  244

Query:  239 AEILTMYLNNSYFGNGVWGVEDASRKYFGTSAANLTVDEAATLAGNLKGPEVYNPYYSVE  298
             +ILTMYLNNSYFGNGVWGVEDAS+KYFGT+AANLT+DEAATLAGNLKGPE+YNPY+S++
Sbjct:  245 KDILTMYLNNSYFGNGVWGVEDASQKYFGTTAANLTLDEAATLAGNLKGPEIYNPYHSLK  304

Query:  299 NATNRRDTVLAAMVDAGKLTKSQAKEAASIGMKNRLADTYAGKINDYRYPSYFDAVVNEA  358
             NAT+RRDTVL AMVDA K+T+++A++ ++GK NRLADTY GK +DY+YFSYFDAV++EA
Sbjct:  305 NATHRRDTVLGANVDAKKITQTKAQQARAVGLKNRLADTYVGKTDDYKYPSYFDAVISEA  364

Query:  359 IDTYGISEKDIVNNGYKIYTALDQNYQSGMQKTFDDTSLFPVSDYDGQSAQGASVALDPK  418
             I TYG+SEKDIVNNGYK+YT LDQNYQ+GMQ TF++  LFPVS YDG SAQ ASVALDPK
Sbjct:  365 IATYGLSSKDIVNNGYKVYTELDQNYQTGMQTTFNNDELFPVSAYDGSSAQAASVALDPK  424
```

-continued

```
Query:  419 TGGVRGLVGRVQSTKDAQFRSFNYATQSKRSPASTIKPLVVYSPAIASGWSIDKELPNKV  478
            TGGVRGL+GRV S+++ERSFNYATQ+KRSPASTIKPLVVY+PA+ASGWSI+KELPN V
Sbjct:  425 TGGVRGLIGRVNSSENPTFRSFNYATQAKRSPASTIKPLVVYAPAVASGWSIEKSLPNTV  484

Query:  479 QDFHGYKPSNYGGIETESIPHYQALANSYNIPAVYTLDKLGINKAFTYGRKFGLNMSSAN  538
            QDF GY+P NYG  E+E +PNYQALANSYNIPAV TL+ +GI+KAFTYG+ FGL+MSSA
Sbjct:  485 QDFDGYQPHNYGNYESEDVPNYQALANSYNIPAVSTLNDIGIDKAFTYGKTFGLDMSSAK  544

Query:  539 KELGVALGGSVTTNPLEMAQAYSTFANDGIMHRAHLITRIETANGKLVKQFTDKFKRVIS  598
            KELGVALGGSVTTNPLEMAQAY+ FAN+G+++H AHLI RIE A G+++K FTDK KRV+S
Sbjct:  545 KELGVALGGSVTTNPLEMAQAYAAFANNGVIHPAHLINRIENARGEVLKTFDKAKRVVS  604

Query:  599 RSVASKMTSMMLGTFSNGTAINANVYGYTNAGKTGTTETDFNPNLSGDQWVVGYTPDVVI  658
            +SVA KMT+MNLGTFSNGTA+NANVYGT+AGKTGTTET+FNP+L+GDQWV+GYTPDVVI
Sbjct:  605 QSVADKMTAMNLGTFSNGTAVNANVYGYTLAGKTGTTETNFNPDLAGDQWVIGYTPDVVI  664

Query:  659 SQWVGFKNTDKHHYLTDSSAGTASNIFSTQASYILPYTKGSSFTHIENAYFQNGIGSVYN  718
            SQWVGF  TD++HYLTDSSAGTAS IFSTQASYILPYTKGS F H++NAY QNGI +VY
Sbjct:  665 SQWVGFNQTDENNYLTDSSAGTASAIFSTQASYILPYTKGSQF-HVDNAYAQNGISAVYG  723

Query:  719 AQDASNTTNQESRSIINDLKDSASKAAQDISRAVEDSNFQEKVKDAWNSLKDYFR       773
              +  N +  +++SII+ L+ SA  +A+Q +S+AV+ S   ++K   W  +DYFR
Sbjct:  724 VNETGNQSGVDTQSIIDGLRKSAQEASQSLSKAVDQSGLRDKAQSIWKEIVDYFR       778
```

SEQ ID 6262 (GBS397d) was expressed in *E. coli* as a His-fusion product. SDS-PAGE analysis of total cell extract is shown in FIG. 153 (lane 13; MW 76 kDa) and in FIG. 184 (lane 9; MW 76 kDa).

Based on this analysis, it was predicted that these proteins and their epitopes could be useful antigens for vaccines or diagnostics.

EXAMPLE 2024

A DNA sequence (GBSx2135) was identified in *S. agalactiae* <SEQ ID 6265> which encodes the amino acid sequence <SEQ ID 6266>. This protein is predicted to be M-like protein. Analysis of this protein sequence reveals the following:

```
Possible site: 27
>>> Seems to have no N-terminal signal sequence
INTEGRAL Likelihood = -10.56 Transmembrane 609-625  (599-628)
INTEGRAL Likelihood =  -0.00 Transmembrane  19-35    (19-35)

----- Final Results -----
            bacterial membrane --- Certainty = 0.5225(Affirmative) < succ>
             bacterial outside --- Certainty = 0.0000(Not Clear)  < succ>
           bacterial cytoplasm --- Certainty = 0.0000(Not Clear)  < succ>
```

The protein has homology with the following sequences in the GENPEPT database.

```
>GP:CAB91647 GB:AJ130830 cell wall protein, putative [Zea mays]
Identities = 106/182 (58%), Positives = 123/182 (67%), Gaps = 8/182 (4%)
Query:  396 KSDKKPDVKPEAKPEAK--PDVKPEAKPDVKPEAKPDVKPEAKPDVKPEAKPDV--KPEA  451
            K + KP+ KPE KPE K P KPE KP+ KPE KP+ KPE KP KPE KP+      KPE
Sbjct:  116 KPEPKPEPKPEPKPKPKIKPKPKPEPKPEPKPSHKPEPKPEPKPKPKPEPKPEPQPKPEP  175

Query:  452 KPDVKPKAKPDVKPEA--KPDVKPDVKPDVKPEA--KPEDKPDVKPDVKPEAKPDVKPEA  507
            KP+ KP+ KP+ KPE    KP+ KP+ KP+ KPE   KPE KP+ KP+ KPE KP+ KPE
Sbjct:  176 KPEPKPEPKPEPKPEPQPKPEPKPEPKPEPKPEPQPKPEPKPEPKPEPKPEPKPEPKPEP  235

Query:  508 KPEAKPEAKPEAKPEAKPEAKPDVKPEAKPDVKPEAKPKAKPEAKSEAKPEAKLEAKPEA  567
            KPE KPE +PE KPE KPE KP   P+ +P  KPE KPE KPE K E KPE K E KPE
Sbjct:  236 KPEPKPEPRPEPKPEPKPEPKPKPDPKPEPQPKPEPKPEPKPEPKPEPKPEPKPEPKPEP  295

Query:  568 KP                                                            569
            KP
Sbjct:  296 KP                                                            297
```

There is also homology to SEQ ID 822.

A related GBS gene <SEQ ID 8957> and protein <SEQ ID 8958> were also identified. Analysis of this protein sequence reveals the following:

```
Lipop: Possible Site: -1 Crend: 8
McG: Discrim Score: -5.20
GvH: Signal Score (-7.5): 3.07
Possible site: 27
```

```
                              -continued
>>> Seems to have no N-terminal signal sequence
ALOM program count: 2 value: -10.56 threshold: 0.0
INTEGRAL    Likelihood = -10.56 Transmembrane 609-625  (599-628)
INTEGRAL    Likelihood = -0.00  Transmembrane  19-35    (19-35)
PERIPHERAL Likelihood =  8.54    139
modified ALOM score: 2.61

*** Reasoning Step: 3

----- Final Results -----
              bacterial membrane --- Certainty = 0.5225(Affirmative) < succ>
                bacterial outside --- Certainty = 0.0000(Not Clear)  < succ>
             bacterial cytoplasm --- Certainty = 0.0000(Not Clear)  < succ>
LPXTG motif: 596-600
```

The protein has homology with the following sequences in the databases:

```
ORF00748(313-2190 of 2490)
GP|2462785|gb|AAB71985.1||U73163(3-374 of 374) M-like protein {Streptococcus equi}
% Match = 9.2
% Identity = 36.0 % Similarity = 55.4
Matches = 126 Mismatches = 147 Conservative Sub.s = 68
   282       312       342       372       402       432       462       666
LS**IRIFN*LYKGANMNNNEKKVKYFLRKTAYGLASMSAAFAVCSGIVHADTSSGISASIPHKKQVNLGAVT~~~~THA
          :|::|::||||:|:||||:|||: |  :   |  ||:
                 MAKKEMKFYLRKSAFGLASVSAALLVGAARVSADS--------------------------~~~~--
                        10        20        30
   696       726       756       786       813       843       870       900
KVSDQELGKQSRRSQDIIKSLGFLSSDQKDILVKSISSSK-DSQLILKFVTQATQLNNAESTKAK-QMAQNDVALIKNIS
         :: |   ::      | |     :::|  ::  |:     |       : ||:    || |:|   :
----------------VESAGPVAVAVTDSLDSEAAATKAEADLVAAKADLAAAEVAITAAKAEFDTAQADLATAEATI
                     40        50        60        70        80        90
   921       951       981      1011      1041      1071      1101      1131
PEV---LEEYKEKIQRASTKSQVDEFVAEAKKVVNSNKETLVNQANGKKQEIAKLENLSNDEMLRYNTAIDNVVKQYNEG
  |:    : | ::|||   |   :   : |:| : ::: |    ::| ||     :: |:|    : |
AELEQKIPELEKKIQEAQEKLNYENRPS-PKRVGSDDEDDTVARKLMSEKEALKAE------LQKTKEALDTAKRAYAGI
          110       120       130       140       150          160       170
   1161      1191      1221      1251      1281      1311      1638      1668
KLNITAAMNALNSIKQAAQEVAQKNLQKQYAKKIERISSKGLALSKKAKEIYEKHKSILPTP~~~~AKPDVKPEAKPDVK
:      |  |::  :|     | :|: |     |        : ||
EERKQVAATKLDAANKAFAGVEEKHAQAMAAFGAAFAAYKGA-------------------------~~~~-----------
                 190       200       210
  1698                                              1740      1770      1800      1830
PKAKPDVKPEAKPDVKPD-----------------------VKPDVKPEAKPEDKPDVKPDVKPEAKPDVKPEAKPE
     ||:|  |     |                      ||:|:||||| |  :  ||:  ||:  ||: |||| |
------VKAELKAAGASDFYTKKIDSADTVDGVKTLREMILDSIAKPEVEPEAKPEPKLEPKPEPKPEPKPEPKPE
           220       230       240       250       260       270       280
   1860      1890      1920      1950      1980      2010      2040      2070
AKPEAKPEAKPEAKPEAKPDVKPEAKPDVKPEAKPEAKPEAKSEAKPEAKLEAKPEAKPATKKSVNTSGNLAAKKAIENK
 ||| |||  ||| |||  ||: ||: :|    |  ||||| ||  :                              |
PKPEPKPEPKPEPKPEPKPQPKPAPAPKPEAKKEEKKAAP--------------------------------K
          300       310       320       330
   2100      2130      2160      2190      2220      2250      2280      2310
KYSKKLPSTGEAASPLLAIVSLIVMLSAGLITIVLKHKKN*IYF*T*TERSILSKS*GKPHQNFAFFI*ILE*FSRYFN*
: : |||||||| :|::    :|  ||  ||:   :  |:|
QDTNKLPSTGEATNPFFTAAALAVMAGAGVAAVSTRRKEN
          350       360       370
```

Figure 261:
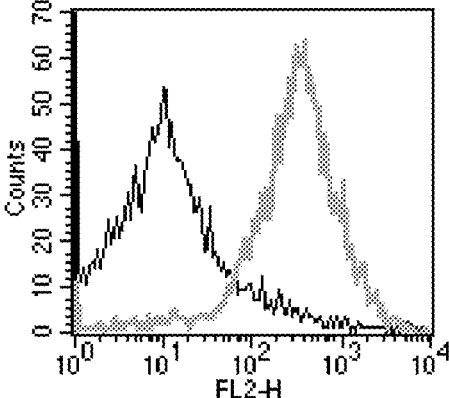

SEQ ID 6266 (GBS3) was expressed in E. coli as a His-fusion product. SDS-PAGE analysis of total cell extract is shown in FIG. 3 (lane 5; MW 65 kDa). The GBS3-His fusion product was purified (FIG. 189, lane 8) and used to immunise mice. The resulting antiserum was used for FACS (FIG. 261), which confirmed that the protein is immunoaccessible on GBS bacteria.

Based on this analysis, it was predicted that these proteins and their epitopes could be useful antigens for vaccines or diagnostics.

EXAMPLE 2025

A DNA sequence (GBSx2136) was identified in S. agalactiae <SEQ ID 6267> which encodes the amino acid sequence <SEQ ID 6268>. This protein is predicted to be transcription antitermination protein nusg (nusG). Analysis of this protein sequence reveals the following:

```
Possible site: 48
>>> Seems to have no N-terminal signal sequence
```

```
----- Final Results -----
            bacterial cytoplasm --- Certainty = 0.3203(Affirmative) < succ>
            bacterial membrane  --- Certainty = 0.0000(Not Clear)   < succ>
            bacterial outside   --- Certainty = 0.0000(Not Clear)   < succ>
```

The protein has homology with the following sequences in the GENPEPT database.

```
>GP:CAA53738 GB:X76134 nusG [Staphylococcus carnosus]
Identities = 90/175 (51%), Positives = 118/175 (67%), Gaps = 2/175 (1%)
Query:   7 KGWFVLQTYSGYENKVKENLLQRAQTYNMLDNILRVEIPTQTVNVEKNGKTKEIEENRFP      66
           K W+ + TYSGYENKVK+NL +R ++ NM + I RV IP +     K+GK K++ +  FP
Sbjct:   8 KRWYAVHTYSGYENKVKKNLEKRVESMNMTEQIFRVVIPEEEETQVKDGKAKKLTKKTFP      67

Query:  67 GYVLVEMVMTDEAWFVVRNTPNVTGFVGSHGNRSKPTPLLEEEIRSILISMGQTVDVFDT     126
           GYVLVE+VMTDE+W+VVRNTP VTGFVGS G  SKP PLL +E+R IL   MG        D
Sbjct:  68 GYVLVELVMTDESWYVVRNTPGVTGFVGSAGAGSKPNPLLPDEVRFILKQMGMKEKTIDV     127

Query: 127 NIKEGDVVQIIDGAFIGQEGRVVEIENNKVKL--MINMFGSETQAELELYQVAEL         179
           ++ G+ V+I   G F   Q G V  EIE +K KL   +++MFG ET   E+E    Q+ +L
Sbjct: 128 EVEVGEQVRIKSGPFANQVGEVQEIEADKFKLTVLVDMFGRETPVEVEFDQIEKL         182
```

A related DNA sequence was identified in *S. pyogenes* <SEQ ID 6269> which encodes the amino acid sequence <SEQ ID 6270>. Analysis of this protein sequence reveals the following:

```
Possible site: 53
>>> Seems to have no N-terminal signal sequence

----- Final Results -----
            bacterial cytoplasm --- Certainty = 0.3874(Affirmative) < succ>
            bacterial membrane  --- Certainty = 0.0000(Not Clear)   < succ>
            bacterial outside   --- Certainty = 0.0000(Not Clear)   < succ>
```

An alignment of the GAS and GBS proteins is shown below.

```
Identities = 170/179 (94%), Positives = 178/179 (98%)
Query:   1 MLDSFDKGWFVLQTYSGYENKVKENLLQPAQTYNMLDNILRVEIPTQTVNVEKNGKTKEI      60
           MLDSFDKGWFVLQTYSGYENKVKENLLQRAQTYNMLDNILRVEIPTQTVNVEKNG+TKEI
Sbjct:   6 MLDSEDRGWFVLQTYSGYENKVKENLLQRAQTYNMLDNILRVEIPTQTVNVEKNGQTKEI      65

Query:  61 EENRFPGYVLVEMVMTDEAWFVVRNTPNVTGFVGSHGNRSKFTPLLEEEIRSILISMGQT     120
           EENRFPGYVLVEMVMTDEAWFVVRNTPNVTGFVGSHGNRSKPTPLLEEEIR+IL+SMGQT
Sbjct:  66 EENRFPGYVLVEMVMTDEAWFVVRNTPNVTGFVGSHGNRSKPTPLLEEEIRAILLSMGQT     125

Query: 121 VDVFDTNIKEGDVVQIIDGAFIGQEGRVVEIENNKVKLMINMFGSETQAELELYQVAEL     179
           +DVFDTNIKEGDVVQIIDGAF+GQEGRVVEIENNKVKLM+NMFGSET AE+ELYQ+AEL
Sbjct: 126 IDVFDTNIKEGDVVQIIDGAFMGQEGRVVEIENNKVKLMLNMFGSETVAEVELYQIAEL     184
```

Based on this analysis, it was predicted that these proteins and their epitopes could be useful antigens for vaccines or diagnostics.

EXAMPLE 2026

A DNA sequence (GBSx2137) was identified in *S. agalactiae* <SEQ ID 6271> which encodes the amino acid sequence <SEQ ID 6272>. This protein is predicted to be a glycosyl transferase. Analysis of this protein sequence reveals the following:

```
Possible site: 16
>>> Seems to have no N-terminal signal sequence

----- Final Results -----
            bacterial cytoplasm --- Certainty = 0.1558(Affirmative) < succ>
            bacterial membrane  --- Certainty = 0.0000(Not Clear)   < succ>
            bacterial outside   --- Certainty = 0.0000(Not Clear)   < succ>
```

The protein has homology with the following sequences in the GENPEPT database.

```
>GP:AAF28363 GB:AF224467 putative glycosyl transferase [Haemophilus ducreyi]
Identities = 98/259 (37%), Positives = 155/259 (59%), Gaps = 10/259 (3%)
Query:   5 VALAVDSNYLDRALVTIKSICVYNRNITFYLFNQDTPVEWVRNINRKLEPLGSKLINVKI    64
           + LA + +Y +  L TIKSI ++N++I FYL N+D P EW   +N KL  L S++I++K+
Sbjct:  10 IVLAANQSYSEYILTTIKSIYLHNKHIRFYLLNRDYPTEWFDILNNKLRKLNSEIIDIKV    69

Query:  65 YNYDIAHLTTFLTVS---TWFRLFLADYIPSSRVLYLDSDIIVNTNLDYLFELDFKGYYL   121
            N  I + T+   +S---T+FR F++D+I   +V+YLD+DI+VN +L  L++ D    Y+L
Sbjct:  70 TNDTIKNFKTYSHISSDTTFFRYFISDFISQDKVIYLDADIVVNGSLTELYQTDISNYFL   129

Query: 122 AAVKDPHKNE----EGGFNAGNLLANLELWREDGLTKTLLKTAEELHRVVKTGDQSILNI   177
           AAVKD    +        FNAGMLL N + WRE   +T+  L  +E+    +  DQSILN+
Sbjct: 130 AAVKDIISEKIYVNNHIFNAGNLLINNKKWREHNITQFCLSLSEKYINSLPDADQSILNL   189

Query: 178 VCHNRWLSLNKTWNF--QTYDVVSRYNHRSYLYLNIENRTPNIIHFLTSDKPWNENSVAR   235
            +  ++WL LN++N+    T  + +Y     YL ++   P IIN+ T KPW      R
Sbjct: 190 IFKDKWLKLNRGYNYLIGTDYLFFKYGKTRYLE-DLGETIPLIIHYNTEAKPWLNIFNTR   248

Query: 236 FRELWWYYFQLDFCQLTGK                                          254
           FR ++W+Y++L++  + K
Sbjct: 249 FRNIYWFYYELNWQDIYAK                                          267
```

No corresponding DNA sequence was identified in *S. pyogenes*.

Based on this analysis, it was predicted that this protein and its epitopes, could be useful antigens for vaccines or diagnostics.

EXAMPLE 2027

A DNA sequence (GBSx2138) was identified in *S. agalactiae* <SEQ ID 6273> which encodes the amino acid sequence <SEQ ID 6274>. Analysis of this protein sequence reveals the following:

```
Possible site: 20
>>> Seems to have no N-terminal signal sequence

----- Final Results -----
            bacterial cytoplasm --- Certainty = 0.0417(Affirmative) < succ>
            bacterial membrane  --- Certainty = 0.0000(Not Clear) < succ>
             bacterial outside  --- Certainty = 0.0000(Not Clear) < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 2028

A DNA sequence (GBSx2139) was identified in *S. agalactiae* <SEQ ID 6275> which encodes the amino acid sequence <SEQ ID 6276>. Analysis of this protein sequence reveals the following:

```
Possible site: 57
>>> Seems to have no N-terminal signal sequence
INTEGRAL Likelihood = -2.60 Transmembrane 306-322 (306-322)

----- Final Results -----
             bacterial membrane  --- Certainty = 0.2041(Affirmative) < succ>
              bacterial outside  --- Certainty = 0.0000(Not Clear) < succ>
            bacterial cytoplasm  --- Certainty = 0.0000(Not Clear) < succ>
```

The protein has homology with the following sequences in the GENPEPT database.

```
>GP:AAF28363 GB:AF224467 putative glycosyl transferase [Haemophilus ducreyi]
Identities = 88/259 (33%), Positives = 156/259 (59%), Gaps = 11/259 (4%)
Query:   7 VVLAGDYSYIRQIETTLKSLCVYHENLSIFIFNQDIPQEWFLAMKDRVGQTGNQIQDVKL    66
           +VLA + SY   I  TT+KS+ ++++++  ++ N+D P EWF  + +++ +  ++I D+K+
Sbjct:  10 IVLAANQSYSEYILTTIKSIYLHNKHIRFYLLNRDYPTEWFDILNNKLRKLNSEIIDIKV    69
```

-continued

```
Query:  67 FHDHLSPKWENKKLNHINY-MTYARYFIPQYISADTVLYLDSDLVVTTNLDNLFQISLDN  125
           +D +       K  +HI+   T+ RYFI  +I  D V+YLD+D+VV  +L  L+Q  + N
Sbjct:  70 TNDTIK---NFKTYSHISSDTTFFRYFISDFIEQDKVIYLDADIVVNGSLTELYQTDISN  126

Query: 126 AYLAAVP-----ALFGLGYGFNAGVNVINNQRWRQENMTIKLIEKNQKEIENANEGDQTI  180
           +LAAV       ++   + FNAG+++INN++WR+ N+T    + ++K I +  + DQ+I
Sbjct: 127 YFLAAVKDIISEKIYVNNHIFNAGMLLINNKKWREHNITQFCLSLSEKYINSLPDADQSI  186

Query: 181 LNRNFENQVIYLDDTYNFQIGFD-MGAAIDGHKFIFDIPITPLPKIIHYISGIKPWQTLS  239
           LN  +F+++ + L+ YN+ IG D +          +++ D+  T +P IIHY +  KPW  +
Sbjct: 187 LNLIFKDKWLKLNRGYNYLIGTDYLFFKYGKTRYLEDLGET-IPLIIHYNTEAKPWLNIF  245

Query: 240 NMRLRSVWWHYNLLEWSSI                                          258
           N R R ++W Y  L W  I
Sbjct: 246 NTRFRNIYWFYYELNWQDI                                          264
```

No corresponding DNA sequence was identified in *S. pyogenes*.

SEQ ID 6276 (GBS395) was expressed in *E. coli* as a His-fusion product. SDS-PAGE analysis of total cell extract is shown in FIG. 75 (lane 5; MW 47.4 kDa). It was also expressed in *E. coli* as a GST-fusion product. SDS-PAGE analysis of total cell extract is shown in FIG. 83 (lane 8; MW 72 kDa) and in FIG. 177 (lane 5; MW 72 kDa).

GBS395-GST was purified as shown in FIG. 217, lane 7.

Based on this analysis, it was predicted that this protein and its epitopes, could be useful antigens for vaccines or diagnostics.

EXAMPLE 2029

A DNA sequence (GBSx2140) was identified in *S. agalactiae* <SEQ ID 6277> which encodes the amino acid sequence <SEQ ID 6278>. Analysis of this protein sequence reveals the following:

```
Possible site: 48
>>> Seems to have no N-terminal signal sequence

----- Final Results -----
          bacterial Cytoplasm --- Certainty = 0.1633(Affirmative) < succ>
          bacterial membrane  --- Certainty = 0.0000(Not Clear)   < succ>
          bacterial outside   --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 2030

A DNA sequence (GBSx2141) was identified in *S. agalactiae* <SEQ ID 6279> which encodes the amino acid sequence <SEQ ID 6280>. Analysis of this protein sequence reveals the following:

```
Possible site: 44
>>> Seems to have no N-terminal signal sequence
    INTEGRAL   Likelihood = -0.16   Transmembrane   36-52   (36-52)

----- Final Results -----
          bacterial membrane  --- Certainty = 0.1065(Affirmative) < succ>
          bacterial outside   --- Certainty = 0.0000(Not Clear)   < succ>
          bacterial cytoplasm --- Certainty = 0.0000(Not Clear)   < succ>
```

A related GBS nucleic acid sequence <SEQ ID 10243> which encodes amino acid sequence <SEQ ID 10244> was also identified.

The protein has homology with the following sequences in the GENPEPT database.

```
>GP:AAC77330 GB:AE000508 orf, hypothetical protein [Escherichia coli K12]
 Identities = 75/260 (28%), Positives = 123/260 (46%), Gaps = 22/260 (8%)
Query:    6 VGLVLEGGGMRGLYTAGVLDAFLDAGIK-IDGIVSVSAGALFGVNFVSRQRERALRYNKK  64
            + LV EGGG RG++TAGVLD F+A       D +  SAGA     F+  Q   A +   +
Sbjct:   25 IALVCEGGGQRGIFTAGVLDEFMRAQFNPFDLYLGTSAGAQNLSAFICNQPGYARKVIMR  84

Query:   65 YLSHPKYMSLRSWFRTGNFVNKDF----TYYEVPMKLD----VFDDEAFKKSSIDFYVVA  116
            Y  +  ++         + R GN ++ D+     T  ++P+++D      +FD    S    FY+ A
Sbjct:   85 YTTKREFFDPLRFVRGGNLIDLDWLVEATASQMPLQMDTAARLFD------SGKSFYMCA  138

Query:  117 TEMTSGKPEYFKIDSVFEQMEILRASSALPVVSKM-VDWQGKKYLDGGLSDSIPVDFARG  175
                   P YF + +    ++++RASSA+P  + V  +G   YLDGG+SD+IPV  A
Sbjct:  139 CRQDDYAPNYF-LPTKQNWLDVIRASSAIPGFYRSGVSLEGINYLDGGISDAIPVKEAAR  197

Query:  176 LGFDKLIVVMTRPLNYQKKPSSGR-----LYKTLYRKYPNFVKTASNRYQQYNNSLEKVM  230
              G    L+V+  T P       P   +        L + +   N V+    Y+      +EK
Sbjct:  198 QGAKTLVVIRTVPSQMYYTPQWFKRMERWLGDSSLQPLVNLVQHHETSYRDIQQFISKPP  257

Query:  231 SLEKTGDLFAIRPSKSLVIG                                        250
             +  +++   +P  S+ +G
Sbjct:  258 GKLRIFEIYPPKPLHSIALG                                        277
```

No corresponding DNA sequence was identified in S. pyogenes.

Based on this analysis, it was predicted that this protein and its epitopes, could be useful antigens for vaccines or diagnostics.

A related GBS gene <SEQ ID 8959> and protein <SEQ ID 8960> were also identified. Analysis of this protein sequence reveals the following:

```
Lipop: Possible site: -1    Crend: 10
McG: Discrim Score: -5.16
GvH: Signal Score (-7.5): -2.17
    Possible site: 44
>>> Seems to have no N-terminal signal sequence
ALOM program   count: 1 value: -0.16  threshold: 0.0
    INTEGRAL        Likelihood = -0.16    Transmembrane     36-52       (36-52)
    PERIPHERAL      Likelihood =  4.14    18
 modified ALOM score: 0.53

*** Reasoning Step: 3

----- Final Results -----
           bacterial membrane --- Certainty = 0.1065(Affirmative) < succ>
           bacterial outside  --- Certainty = 0.0000(Not Clear)   < succ>
           bacterial cytoplasm --- Certainty = 0.0000(Not Clear)  < succ>
```

The protein has homology with the following sequences in the databases:

```
ORF01611(316-1050 of 1449)
OMNI|NT01EC5264(37-289 of 369) hypothetical protein
% Match = 9.2
% Identity = 29.7 % Similarity = 49.8
Matches = 74 Mismatches = 118 Conservative Sub.s = 50

273       303       333       363       393       420       450       480
QKKQLYFAIL*SNINIRK*LPMLSVGLVLEGGGMRGLYTAGVLDAFLDAGIK-IDGIVSVSAGALFGVNFVSRQRERALR
                             : || |||| ||::||||| |:      |    : ||||      |:  |   | :
VGQRIPVTLGNIAPLSLRPFQPGRIALVCEGGGQRGIFTAGVLDEFMRAQFNPFDLYLGTSAGAQNLSAFICNQPGYARK
                    30        40        50        60        70        80        90

510       540            588       618       648       678       708
YNKKYLSHPKYMSLRSWFRTGNFVNKDF----TYYEVPMKLDVFDDEAFKKSSIDFYVVATEMTSGKPEYFKIDSVFEQM
:| :  ::          :  | ||::: |:        | ::|:::|      :   |   ||:  |       ||| : :        :
VIMRYTTKREFFDPLRFVRGGNLIDLDWLVEATASQMPLQMDT--AARLFDSGKSFYMCACRQDDYAPNYF-LPTKQNWL
                    110       120       130       140       150       160

738       765       795       825       855       885       912       930
EILRASSALPVVSKM-VDWQGKKYLDGGLSDSIPVDFARGLGFDKLIVVMTRPLNYQKKPSS-GRLYKTL----YRKYPN
:::|||||:|   :      |    :| |||||:||:|||     |     |:: |    |           |: : |        :       |
DVIRASSAIPGFYRSGVSLEGINYLDGGISDAIPVKEAARQGAKTLVVIRTVPSQMYYTPQWFKRMERWLGDSSLQPLVN
          180       190       200       210       220       230       240

960       990       1020      1050      1080      1110      1140      1170
FVKTASNRYQQYNNSLEKVMSLEKTGDLFAIRPSKSLVIGRLEKNPDKLDSIYQLGMKDAKSVMPELNSYLMK*RKQYFS
:|:        |:       :||       :     ::: |   |: :|
LVQHHETSYRDIQQFIEKPPGKLRIFEIYPPKPLHSIALGSRIPALREDYKLGRLCGRYFLATVGKLLTEKAPLTRHLVP
          260       270       280       290       300       310       320
```

SEQ ID 8960 (GBS394) was expressed in *E. coli* as a His-fusion product. SDS-PAGE analysis of total cell extract is shown in FIG. 75 (lane 4; MW 34.7 kDa). It was also expressed in *E. coli* as a GST-fusion product. SDS-PAGE analysis of total cell extract is shown in FIG. 83 (lane 7; MW 60 kDa).

GBS394-GST was purified as shown in FIG. 217, lane 6.

EXAMPLE 2031

A DNA sequence (GBSx2142) was identified in *S. agalactiae* <SEQ ID 6281> which encodes the amino acid sequence <SEQ ID 6282>. Analysis of this protein sequence reveals the following:

```
Possible site: 21
>>> Seems to have no N-terminal signal sequence

----- Final Results -----
          bacterial cytoplasm --- Certainty = 0.3004(Affirmative) < succ>
          bacterial membrane  --- Certainty = 0.0000(Not Clear)   < succ>
           bacterial outside  --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 2032

A DNA sequence (GBSx2143) was identified in *S. agalactiae* <SEQ ID 6283> which encodes the amino acid sequence <SEQ ID 6284>. This protein is predicted to be transporter protein. Analysis of this protein sequence reveals the following:

```
Possible site: 49
>>> Seems to have a cleavable N-term signal seq.
    INTEGRAL    Likelihood = -6.85    Transmembrane    373-389    (370-395)
    INTEGRAL    Likelihood = -6.74    Transmembrane    168-184    (162-187)
    INTEGRAL    Likelihood = -6.32    Transmembrane    259-275    (257-280)
    INTEGRAL    Likelihood = -4.78    Transmembrane    286-302    (285-306)
    INTEGRAL    Likelihood = -3.19    Transmembrane     55-71      (54-71)
    INTEGRAL    Likelihood = -2.97    Transmembrane     84-100     (79-101)
    INTEGRAL    Likelihood = -2.87    Transmembrane    311-327    (310-328)
    INTEGRAL    Likelihood = -1.44    Transmembrane    355-371    (355-371)
    INTEGRAL    Likelihood = -0.64    Transmembrane    108-124    (108-125)

----- Final Results -----
           bacterial membrane  --- Certainty = 0.3739(Affirmative) < succ>
            bacterial outside  --- Certainty = 0.0000(Not Clear)   < succ>
          bacterial cytoplasm  --- Certainty = 0.0000(Not Clear)   < succ>
```

The protein has homology with the following sequences in the GENPEPT database.

```
>GP:AAC22759 GB:U32790 transporter protein [Haemophilus influenzae Rd]
 Identities = 139/391 (35%), Positives = 221/391 (55%), Gaps = 4/391 (1%)
 Query:    6 INKNNWRALIAAIVASGTDDLNIMFLAFSMSTIITDLHLSAAQAGWIGTITNLGMLVGGL    65
             +N    W+ALI  + V   G D  +++ L F +S I   DL+L+ AQ G + T T +G + GG+
 Sbjct:    5 VNSYGWKALIGSAVGYGMDGFDLLILGFMLSAISADLNLTPAQGGSLVTWTLIGAVFGGI    64

Query:   66 IFGLLADRYNKFKVFKWTILIFSIATGLVFFTTNLSYLYIMRFIAGIGVGGEYGIAIAIM   125
             +FG L+D+Y  +V   WTIL+F++  TGL           L I R  IAGIG+GGE+GI  +A+
 Sbjct:   65 LFGALSDKYGRVRVLTWTILLFAVFTGLCAIAQGYWDLLIYRTIAGIGLGGEFGIGMALA   124

Query:  126 AGIVPTNKMGRISSLNGIAGQVGSISSALLAGWLAPALGWRGLFLFGLLPIVLVLWMQFA   185
              A      P    + +S  +   QVG + +ALL   L P +GWRG+FL G+ P  +   +++
 Sbjct:  125 AEAWPARHRAKAASYVALGWQVGVLGAALLTPLLLPHIGWRGMFLVGIFPAFVAWFLRSH   184

Query:  186 VDDKDILDQYNTDADDEPLDI----SIKALFDTPVLATQSLALMVMTTVQIAGYFGMMNW   241
              + + +I  Q  T +        S  L     SL ++V+T+VQ  GY+G+M W
 Sbjct:  185 LHEPEIFTQKQTALSTQSSFTDKLRSFQLLIKDKATSKISLGIVVLTSVQNFGYYGIMIW   244

Query:  242 LPTIIQTNLNVSVKNSSLWMIATILGMCLGMLVFGQLLDKFGPRLVYGCFLLSSAICVYL   301
             LP +    L   S+  S LW    T+ GM  G+ +FGQL D+ G  +   F L + +
 Sbjct:  245 LPNFLSKQLGFSLTKSGLWTAVTVCGMMAGIWIFGQLADRIGRKPSFLLFQLGAVISIVV   304
```

```
Query:   302 FQFATTMPSMIIGGAVVGFFVNGMFAGYGAMITRLYPHHIRSTANNLILNVGRAIGGFSS  361
             +   T     M++ GA +G FVNGM  GYGA++    YP   R+TA N++ N+GRA+GGF
Sbjct:   305 YSQLTDPDIMLLAGAFLGMFVNGMLGGYGALMAEAYPTEARATAQNVLFNIGRAVGGFGP  364

Query:   362 VIIGMILDVSNVSMVMLFLASLYIVSFLSML                              392
             V++G ++      +    LA +Y++  L+ +
Sbjct:   365 VVVGSVVLAYSFQTAIALLAIIYVIDMLATI                              395
```

A related DNA sequence was identified in *S. pyogenes* <SEQ ID 2377> which encodes the amino acid sequence <SEQ ID 2378>. Analysis of this protein sequence reveals the following:

```
Possible site: 39
>>> Seems to have a cleavable N-term signal seq.
    INTEGRAL    Likelihood = -8.92    Transmembrane   168-184    (162-188)
    INTEGRAL    Likelihood = -5.41    Transmembrane   286-302    (285-306)
    INTEGRAL    Likelihood = -5.15    Transmembrane   372-388    (362-394)
    INTEGRAL    Likelihood = -3.45    Transmembrane   259-275    (257-276)
    INTEGRAL    Likelihood = -2.87    Transmembrane   311-327    (306-328)
    INTEGRAL    Likelihood = -2.81    Transmembrane    55-71      (51-71)
    INTEGRAL    Likelihood = -0.48    Transmembrane   108-124    (108-125)
    INTEGRAL    Likelihood = -0.37    Transmembrane    84-100     (84-100)

----- Final Results -----
            bacterial membrane --- Certainty = 0.4567(Affirmative) < succ>
            bacterial outside  --- Certainty = 0.0000(Not Clear)   < succ>
            bacterial cytoplasm --- Certainty = 0.0000(Not Clear)  < succ>
```

An alignment of the GAS and GBS proteins is shown below.

```
Identities = 306/402 (76%), Positives = 354/402 (87%)
Query:     1 MSPLNINKNNWRALIAAIVASGTDDLNIMFLAFSMSTIITDLHLSAAQAGWIGTITNLGN   60
             MS L+++  N RAL+AAI ASGTDDLN+MFLAFSMS+I+TDL LS  Q GWI TITNLGM
Sbjct:     1 MSTLSLDTTNKRALVAAIAASGTDDLNVMFLAFSMSSIMTDLGLSGTQGGWIATITNLGM   60

Query:    61 LVGGLIFGLLADRYNKFKVFKWTILIFSIATGLVFFTTNLSYLYIMRFIAGIGVGGSYGI  120
             LVGGL+FGLLADR++KFKVFKWTIL+FS+ATGL++FT  +L YLY+MRFIAGIGVGGEYG+
Sbjct:    61 LVGGLLFGLLADRHHKFKVFKWTILLFSVATGLIYFTQSLPYLYLMRFIAGIGVGGEYGV  120

Query:   121 AIAIMAGIVPTNKMGRISSLNGIAGQVGSISSALLAGWLAPALGWRGLFLFGLLPIVLVL  180
             AIAIMAGIVP  KMGR+SSLNGIAGQ+GSISSALLAGWLAP+LGWRGLFLFGLLPI+LV+
Sbjct:   121 AIAIMAGIVPPEKMGRMSSLNGIAGQLGSISSALLAGWLAPSLGWRGLFLFGLLPILLVI  180

Query:   181 WMQFAVDDKDILDQYNTDADDEPLDISIKALFDTPVLATQSLALMVMTTVQIAGYFGMMN  240
             WM  A+DD+ I D Y  + ++    I I  LF T  L  Q+LALMVMTTVQIAGYFGMMN
Sbjct:   181 WMTLAIDDQKIWDHYGQEEEECSQPIKINELFKTKSLTAQTLALMVMTTVQIAGYFGMMN  240

Query:   241 WLPTIIQTNLNVSVKNSSLWMIATILGMCLGMLVFGQLLDKFGPRLVYGCFLLSSAICVY  300
             WLPTIIQT+LN+SVK+SSLWM+ATI+GMCLGML FGQLLD FGPRL+Y   FLL+S+ICVY
Sbjct:   241 WLPTIIQTSLNLSVKSSSLWMVATIVGMCLGMLYFGQLLDCFGPRLIYSLFLLASSICVY  300

Query:   301 LFQFATTMPSMIIGGAVVGFFVNGMFAGYGAMITRLYPHHIRSTANNLILNVGRAIGGFS  360
             LFQFA +M SM+IGGA+VGFFVNGMFAGYGAMITRLYPHHIRSTANN+ILNVGRA+GGFS
Sbjct:   301 LFQFANSMASMVIGGAIVGFFVNGMFAGYGAMITRLYPHHIRSTANNVILNVGRALGGFS  360

Query:   361 SVIIGMILDVSNVSMVMLFLASLYIVSFLSMLSIKQLKRQKY                   402
             SV IG ILD S +SMVM+FLASLY++SF +M SI QLK ++Y
Sbjct:   361 SVAIGSILDASGISMVMIFLASLYVISFGAMWSIGQLKAERY                   402
```

Based on this analysis, it was predicted that these proteins and their epitopes could be useful antigens for vaccines or diagnostics.

EXAMPLE 2033

A DNA sequence (GBSx2144) was identified in *S. agalactiae* <SEQ ID 6285> which encodes the amino acid sequence <SEQ ID 6286>. This protein is predicted to be leucyl-tRNA synthetase (leuS). Analysis of this protein sequence reveals the following:

```
Possible site: 52
>>> Seems to have no N-terminal signal sequence

----- Final Results -----
            bacterial cytoplasm --- Certainty = 0.3481(Affirmative) < succ>
             bacterial membrane --- Certainty = 0.0000(Not Clear)   < succ>
              bacterial outside --- Certainty = 0.0000(Not Clear)   < succ>
```

A related GBS nucleic acid sequence <SEQ ID 10241> which encodes amino acid sequence <SEQ ID 10242> was also identified.

The protein has homology with the following sequences in the GENPEPT database.

```
>GP:AAC00259 GB:AF008220 leucine tRNA synthetase [Bacillus subtilis]
Identities = 569/835 (68%), Positives = 666/835 (79%), Gaps = 42/835 (5%)
Query:   10 YNHKEIEPKWQAFWADNHTFKTGTDASKPKFYALDMFPYPSGAGLHVGHPEGYTATDILS   69
            + HKETE KWQ +W +N TF T  +  K KFYALDMFPYPSGAGLHVGHPEGYTATDILS
Sbjct:    3 FQHKEIEKKWQTYWLENKTFATLDNNEKQKFYALDMFPYPSGAGLHVGHPEGYTATDILS   62

Query:   70 RFKRAQGHNVLHPMGWDAFGLPAEQYAMDTGNDPAEFTAENIANFKRQINALGFSYDWDR  129
            R KR QG++VLHPMGWDAFGLPAEQYA+DTGNDPA FT +NI NF+RQI ALGFSYDWDR
Sbjct:   63 RMKRMQGYDVLHPMGWDAFGLPAEQYALDTGNDPAVFTKQNIDNFRRQIQALGFSYDWDR  122

Query:  130 EVNTTDPNYYKWTQWIFTKLYEKGLAYEAEVPVNWVEELGTAIANEEVLPDGTSERGGYP  189
            E+NTTDP YYKWTQWIF KLYEKGLAY  EVPVNW   LGT +ANEEV+ DG SERGG+P
Sbjct:  123 EINTTDPEYYKWTQWIFLKLYEKGLAYVDEVPVNWCPALGTVLANEEVI-DGKSERGGHP  181

Query:  190 VVRKPMRQWMLKITAYAERLLEDLEEVDWPESIKDMQRNWIGKSTGANVTFKVKDTDKDF  249
            V R+PM+QWMLKITAYA+RLLEDLEE+DWPESIKDMQRNWIG+S GA+V F +   D  F
Sbjct:  182 VERRPMKQWMLKITAYADRLLEDLEELDWPESIKDMQRNWIGRSEGAHVHFAIDGHDDSF  241

Query:  250 TVFTTRPDTLFGATYAVLAPEHALVDAITTADQAEAVAEYKRQASLKSDLARTDLAKEKT  309
            TVFTTRPDTLFGATY VLAPEHALV+ ITTA+Q EAV  Y ++  KSDL RTDLAK KT
Sbjct:  242 TVFTTRPDTLFGATYTVLAPEHALVENITTAEQKEAVEAYIKEIQSKSDLERTDLAKTKT  301

Query:  310 GVWTGAYAINPVNGKEIPVWIADYVLASYGTGAIMAVPAHDERDWEFAKQFNLDIIPVLE  369
            GV+TGAYAINPVNG+++P+WIADYVLASYGTGA+MAVP HDERD+EFAK F L + V++
Sbjct:  302 GVFTGAYAINPVNGEKLPIWIADYVLASYGTGAVMAVPGHDERDFEFAKTFGLPVKEVVK  361

Query:  370 GGNVEEAAFTEDGLHINSDFLDGLDKAAAIAKMVEWLEAEGVGNEKVTYRLRDWLFSRQR  429
            GGNVEEAA+T DG H+NSDFL+GL K  AI K++ WLE   G +KVTYRLRDWLFSRQR
Sbjct:  362 GGNVEEAAYTGDGEHVNSDFLNGLHKQEAIEKVIAWLEETKNGEKKVTYRLRDWLFSRQR  421

Query:  430 YWGEPIPIIHWEDGTSTAVPESELPLVLPVTKDIRPSGTGESPLANLTDWLEVT-REDGV  488
            YWGEPIP+IHWEDGTSTAVPE ELPL+LP T +I+PSGTGESPLAN+ +W+EVT  E G
Sbjct:  422 YWGEPIPVIHWEDGTSTAVPEEELPLILPKTDEIKPSGTGESPLANIKEWVEVTDPETGK  481

Query:  489 KGRRETNTMPQWAGSSWYYLRYIDPHNTEKLADEELLKQWLPVDIYGGAEHAVLHLLYA  548
            KGRRETNTMPQWAGS WY+LRYIDPHN ++LA  E L++WLPVD +Y+GGAEHAVLHLLYA
Sbjct:  482 KGRRETNTMPQWAGSCWYFLRYIDPHNPDQLASPEKLEKWLPVDMYIGGAEHAVLHLLYA  541

Query:  549 RFWHKVLYDLGVVPTKEPFQKLFNQGMILGTSYRDSRGALVATDKVEKRDGSFFHVETGE  608
            RFWHK LYD+GVVPTKEPFQKL+NQGMILG                        E  E
Sbjct:  542 RFWHKFLYDIGVVPTKEPFQKLYNQGMILG-------------------------ENNE  575

Query:  609 ELEQAPAKMSKSLKNVVNPDDVVEQYGADTLRVYEMFMGPLDASIAWSEEGLEGSRKFLD  668
                   KMSKS NVVNPD++V  +GADTLR+YEMFMGPLDASIAWSE GL+G+R+FLD
Sbjct:  576 -------KMSKSKGNVVNPDEIVASHGADTLRLYEMFMGPLDASIAWSESGLDGARRFLD  628

Query:  669 RVYRLI------TTKEITEENSGALDKVYNETVKAVTEQVDQMKFNTAIAQLMVFVNAAN  722
            RV+RL         +I E    L++VY+ETV  VT+ +  ++FNT I+QLMVF+N A
Sbjct:  629 RVWRLFIEDSGELNGKIVEGAGETLERVYHETVMKVTDHYEGLRFNTGISQLMVFINEAY  688

Query:  723 KEDKLFSDYAKGFVQLIAPFAPHLGEELWQVLTASGQSISYVPWPSYDESKLVENEIEIV  782
            K  +L  +Y +GFV+L++P APHL EELW+ L  SG +I+Y WP YDE+KLV++E+EIV
Sbjct:  689 KATELPKEYMEGFVKLLSPVAPHLAEELWEKLGHSG-TIAYEAWPVYDETKLVDDEVEIV  747

Query:  783 VQIKGKVKAKLVVAKDLSREELQDLALANEKVQAEIAGKDIIKVIAVPNKLVNIV       837
            VQ+ GKVKAKL V D ++E+L+ LA A+EKV+ ++ GK I K+IAVP KLVNIV
Sbjct:  748 VQLNGKVKAKLQVPADATKEQLEQLAQADEKVKEQLEGKTIRKIIAVPGKLVNIV       802
```

A related DNA sequence was identified in *S. pyogenes* <SEQ ID 6287> which encodes the amino acid sequence <SEQ ID 6288>. Analysis of this protein sequence reveals the following:

```
Possible site: 46
>>> Seems to have no N-terminal signal sequence

----- Final Results -----
              bacterial cytoplasm --- Certainty = 0.4358(Affirmative) < succ>
               bacterial membrane --- Certainty = 0.0000(Not Clear)  < succ>
                 bacterial outside --- Certainty = 0.0000(Not Clear)  < succ>
```

An alignment of the GAS and GBS proteins is shown below.

```
Identities = 815/833 (97%), Positives = 827/833 (98%)
Query:    7 MTFYNHKEIEPKWQAFWADNHTFKTGTDASKPKFYALDMFPYPSGAGLHVGHPEGYTATD   66
            MTFY+H   IEPKWQAFWADNHTFKTGTDASKPKFYALDMFPYPSGAGLHVGHPEGYTATD
Sbjct:    1 MTFYDHTAIEPKWQAFWADNHTFKTGTDASKPKFYALDMFPYPSGAGLHVGHPEGYTATD   60

Query:   67 ILSRFKRAQGHNVLHPMGWDAFGLPAEQYAMDTGNDPAEFTAENIANFKRQINALGFSYD  126
            ILSRFKRAQGHN+LHPMGWDAFGLPAEQYAMDTGNDPAEFTAENIANFKRQINALGFSYD
Sbjct:   61 ILSRFKRAQGHNILHPMGWDAFGLPAEQYAMDTGNDPAEFTAENIANFKRQINALGFSYD  120

Query:  127 WDREVNTTDPNYYKWTQWIFTKLYEKGLAYEAEVPVNWVEELGTAIANEEVLPDGTSERG  186
            WDREVNTTDPNYYKWTQWIFTKLYEKGLAYEAEVPVNWVEELGTAIANEEVLPDGTSERG
Sbjct:  121 WDREVNTTDPNYYKWTQWIFTKLYEKGLAYEAEVPVNWVEELGTAIANEEVLPDGTSERG  180

Query:  187 GYPVVRKPMRQWMLKITAYAERLLEDLEEVDWPESIKDMQRNWIGKSTGANVTFKVKDTD  246
            GYPVVRKPMRQWMLKITAYAERLLEDLEEVDWPESIKDMQRNWIGKSTGANVTFKVKDTD
Sbjct:  181 GYPVVRKPMRQWMLKITAYAERLLEDLEEVDWPESIKDMQRNWIGKSTGANVTFKVKDTD  240

Query:  247 KDFTVFTTRPDTLFGATYAVLAPEHALVDAITTADQAEAVAEYKRQASLKSDLARTDLAK  306
            KDFTVETTRPDTLFGATYAVLAPEHALVDAITTADQAEAVA+YKRQASLKSDLARTDLAK
Sbjct:  241 KDFTVFTTRPDTLFGATYAVLAPEHALVDAITTADQAEAVAKYKRQASLKSDLARTDLAK  300

Query:  307 EKTGVWTGAYAINPVNGKEIPVWIADYVLASYGTGAIMAVPAHDERDWEFARQFNLDIIP  366
            EKTGVWTGAYAINPVNG E+PVWIADYVLASYGTGAIMAVPAHDERDWEFAKQF LDIIP
Sbjct:  301 EKTGVWTGAYAINPVNGNEMPVWIADYVLASYGTGAIMAVPAHDERDWEFAKQFKLDIIP  360

Query:  367 VLEGGNVEEAAFTEDGLHINSDFLDGLDKAAAIAKMVEWLEAEGVGNEKVTYRLRDWLFS  426
            VLEGGNVEEAAFTEDGLHINS FLDGLDKA+AIAKMVEWLEAEGVGNEKVTYRLRDWLFS
Sbjct:  361 VLEGGNVEEAAFTEDGLHINSGFLDGLDKASAIAKMVEWLEAEGVGNEKVTYRLRDWLFS  420

Query:  427 RQRYWGEPIPIIHWEDGTSTAVPESELPLVLPVTKDIRPSGTGESPLANLTDWLEVTRED  486
            RQRYWGEPIPIIHWEDGTSTAVPESELPLVLPVTKDIRPSGTGESPLAN+TDWLEVTRED
Sbjct:  421 RQRYWGEPIPIIHWEDGTSTAVPESELPLVLPVTKDIRPSGTGESPLANVTDWLEVTRED  480

Query:  487 GVKGRRETNTMPQWAGSSWYYLRYIDPHNTEKLADEELLKQWLPVDIYVGGAEHAVLHLL  546
            GVKGRRETNTMPQWAGSSWYYLRYIDPHNTEKLADEELLKQWLPVDIYVGGAEHAVLHLL
Sbjct:  481 GVKGRRETNTMPQWAGSSWYYLRYIDPHNTEKLADEELLKQWLPVDIYVGGAEHAVLHLL  540

Query:  547 YARFWHKVLYDLGVVPTKEPFQKLFNQGMILGTSYRDSRGALVATDKVEKRDGSFFHVET  606
            YARFWHKVLYDLGVVPTKEPFQKLFNQGMILGTSYRDSRGALVATDKVEKRDGSFFHVET
Sbjct:  541 YARFWHKVLYDLGVVPTKEPFQKLFNQGMILGTSYRDSRGALVATDKVEKRDGSFFHVET  600

Query:  607 GEELEQAPAKMSKSLKNVVNPDDVVEQYGADTLRVYEMFMGPLDASIAWSEEGLEGSRKF  666
            GEELEQAPAKMSKSLKNVVNPDDVVEQYGADTLRVYEMFMGPLDASIAWSEEGLEGSRKF
Sbjct:  601 GEELEQAPAKMSKSLKNVVNPDDVVEQYGADTLRVYEMFMGPLDASIAWSEEGLEGSRKF  660

Query:  667 LDRVYRLITTKEITEENSGALDKVYNETVKAVTEQVDQMKFNTAIAQLMVFVNAANKEDK  726
            LDRVYRLITTKEITEENSGALDKVYNETVKAVTEQVDQMKFNTAIAQLMVFVNAANKEDK
Sbjct:  661 LDRVYRLITTKEITEENSGALDKVYNETVKAVTEQVDQMKFNTAIAQLMVFVNAANKEDK  720

Query:  727 LFSDYAKGFVQLIAPFAPHLGEELWQVLTASGQSISYVPWPSYDESKLVENEIEIVVQIK  786
            LFSDYAKGFVQLIAPFAPHLGEELWQ LTASG+SISYVPWPSYDESKLVEN++EIVVQIK
Sbjct:  721 LFSDYAKGFVQLIAPFAPHLGEELWQALTASGESISYVPWPSYDESKLVENDVEIVVQIK  780

Query:  787 GKVKAKLVVAKDLSREELQDLALANEKVQAEIAGKDIIKVIAVPNKLVNIVVK         839
            GKVKAKLVVAKDLSREELQ++ALANEKVQAEIAGKDIIKVIAVPNKLVNIV+K
Sbjct:  781 GKVKAKLVVAKDLSREELQEVALANEKVQAEIAGKDIIKVIAVPNKLVNIVIK         833
```

Based on this analysis, it was predicted that these proteins and their epitopes could be useful antigens for vaccines or diagnostics.

EXAMPLE 2034

A DNA sequence (GBSx2145) was identified in *S. agalactiae* <SEQ ID 6289> which encodes the amino acid sequence <SEQ ID 6290>. This protein is predicted to be KLAA1074 protein. Analysis of this protein sequence reveals the following:

```
Possible site: 35
>>> Seems to have an uncleavable N-term signal seq

----- Final Results -----
            bacterial membrane --- Certainty = 0.0000(Not Clear) < succ>
             bacterial outside --- Certainty = 0.0000(Not Clear) < succ>
           bacterial cytoplasm --- Certainty = 0.0000(Not Clear) < succ>
```

A related GBS nucleic acid sequence <SEQ ID 8961> which encodes amino acid sequence <SEQ ID 8962> was also identified. Analysis of this protein sequence reveals the following:

```
Lipop: Possible site: -1 Crend: 7
SRCFLG: 0
McG: Length of UR: 19
     Peak Value of UR: 2.86
     Net Charge of CR: 4
McG: Discrim Score: 10.27
GvH: Signal Score (-7.5): -3.61
     Possible site: 31
>>> Seems to have an uncleavable N-term signal seq
Amino Acid Composition: calculated from 1
ALOM program Count: 0 value: 2.12 threshold: 0.0
   PERIPHERAL Likelihood = 2.12 7
modified ALOM score: -0.92
*** Reasoning Step: 3

----- Final Results -----
            bacterial membrane --- Certainty = 0.0000(Not Clear) < succ>
             bacterial outside --- Certainty = 0.0000(Not Clear) < succ>
           bacterial cytoplasm --- Certainty = 0.0000(Not Clear) < succ>
```

The protein has no significant homology with any sequences in the GENPEPT database.

No corresponding DNA sequence was identified in *S. pyogenes*.

SEQ ID 8962 (GBS117) was expressed in *E. coli* as a His-fusion product. SDS-PAGE analysis of total cell extract is shown in FIG. 29 (lane 8; MW 22.5 kDa).

GBS117-His was purified as shown in FIG. 200, lane 7.

Based on this analysis, it was predicted that this protein and its epitopes, could be useful antigens for vaccines or diagnostics.

EXAMPLE 2035

A DNA sequence (GBSx2146) was identified in *S. agalactiae* <SEQ ID 6291> which encodes the amino acid sequence <SEQ ID 6292>. This protein is predicted to be YirC (resE). Analysis of this protein sequence reveals the following:

```
Possible site: 28
>>> Seems to have an uncleavable N-term signal seq
   INTEGRAL    Likelihood = -10.88    Transmembrane    177-193  (173-196)
   INTEGRAL    Likelihood =  -4.09    Transmembrane     10-26     (5-29)

----- Final Results -----
            bacterial membrane --- Certainty = 0.5352(Affirmative) < succ>
             bacterial outside --- Certainty = 0.0000(Not Clear)   < succ>
           bacterial cytoplasm --- Certainty = 0.0000(Not Clear)   < succ>
```

The protein has homology with the following sequences in the GENPEPT database.

```
>GP:CAB15292 GB:Z99120 similar to two-component sensor histidine
kinase [YvqA] [Bacillus subtilis]
Identities = 108/379 (28%), Positives = 193/379 (50%), Gaps = 33/379 (8%)
Query:  92 DNHKKESHDIIRYLTQKRLWQISKEKDGMFVTIKKKTYYVMTKDYSGILVDGSIKKVPKA 151
            +N +   S   + L+   + ++ K  D      KKK Y   + D +G  V    IKK
Sbjct:  86 ENEEASSDKDLSILSSSFIHKVYKLADKQ--EAKKKRY---SADVNGEKVFFVIKKGLSV 140
```

-continued

```
Query:  152 QSQLFHVINFS------DITYTQHLITKINHFLIVILVLTYIPMLFIMRKTFTGIRESIQ  205
            Q    +++++        D+ YT  L  ++    + V+++L++IP +++ +      +    +
Sbjct:  141 NGQSAMMLSYALDSYRDDLAYT--LFKQLLFIIAVVILLSWIPAIWLAKY----LSRPLV   194

Query:  206 SVQTYISSLWKNQGNHQSSQKEIVFSDFDPLLLESQEMANRIYQAEESQRNFFQNASHEL  265
            S + ++  +   ++ +      K   +   L    +EM  ++ Q +E++R   QN SH+L
Sbjct:  195 SFEKHVKRI--SEQDWDDPVKVDRKDEIGKLGHTIEEMRQKLVQKDETERTLLQNISHDL  252

Query:  266 RTPLMSIQGYTEGVQEGII---DAELAHSVILQESKKMKQLVDDIILLSKLD--SNLSDQ  320
            +TP+M I+GYT+ +++GI    D K    VI  E+ K+++ + D++ L+KLD  +    Q
Sbjct:  253 KTPVMVIRGYTQSIKDGIFPKGDLENTVDVIECEALKLEKKIKDLLYLTKLDYLAKQKVQ  312

Query:  321 KDEFSLNELLNSIIAYFKPLANKQKISITYRPDKHEKLLK-GNEELIQRAINNILSNALR  379
              D FS+ E+    +I   K A K+   +++   D  E +L  G+ E    + + NIL N +R
Sbjct:  313 HDMFSIVEVTEEVIERLK-WARKE---LSWEIDVEEDILMPGDPEQWNKLLENILENQIR  368

Query:  380 YAVSHIEISYT----NQKLTISNDGPAISKEDLPYIFDRFYKGHGGQTGIGLAMTKEIIK  435
              YA + IEIS      N  +TI NDGP I  E L  +++ F KG  G+ GIGL++ K I+
Sbjct:  369 YAETKIEISMKQDDRNIVITIKNDGPHIEDEMLSSLYEPFNKGKKGEFGIGLSIVKRILT  428

Query:  436 QHHGNIIAESDSTSTTFTI                                           454
              H  +I  E+D T ++ I
Sbjct:  429 LHKASISIENDKTGVSYRI                                           447
```

There is also homology to SEQ ID 1178.

SEQ ID 6292 (GBS279) was expressed in *E. coli* as a His-fusion product. SDS-PAGE analysis of total cell extract is shown in FIG. 52 (lane 7; MW 54.5 kDa). It was also expressed in *E. coli* as a GST-fusion product. SDS-PAGE analysis of total cell extract is shown in FIG. 58 (lane 6; MW 79.4 kDa).

Based on this analysis, it was predicted that this protein and its epitopes, could be useful antigens for vaccines or diagnostics.

EXAMPLE 2036

A DNA sequence (GBSx2147) was identified in *S. agalactiae* <SEQ ID 6293> which encodes the amino acid sequence <SEQ ID 6294>. This protein is predicted to be two-component response regulator (mtrA). Analysis of this protein sequence reveals the following:

```
Possible site: 37
>>> Seems to have no N-terminal signal sequence

----- Final Results -----
                bacterial cytoplasm --- Certainty = 0.1706(Affirmative) < succ>
                bacterial membrane  --- Certainty = 0.0000(Not Clear)   < succ>
                bacterial outside   --- Certainty = 0.0000(Not Clear)   < succ>
```

A related GBS nucleic acid sequence <SEQ ID 10239> which encodes amino acid sequence <SEQ ID 10240> was also identified.

The protein has homology with the following sequences in the GENPEPT database.

```
>GP:BAB05663 GB:A001513 two-component response regulator
[Bacillus halodurans]
Identities = 87/220 (39%), Positives = 124/220 (55%), Gaps = 4/220 (1%)
Query:   11 IYFADDEKNIRDLVVPFLEHDGFTVRAFETGDLLLEAYKNQKPDLVILDIMMPGTNGLDV   70
             I    DDE ++R+LV  +L  +GF V   ETGD ++   +    DLV+LD+MM    +G
Sbjct:    7 ILIVDDELDLRELVTSYLRKEGFAVYTAETGDEAIKRLEQEPMDLVVLDVMMDEMDGFTA   66

Query:   71 MKSIRQYDNIPIIMLTARDSDVDFITAFNLGTDDYFTKPFSPIKLSLHVKALFKRLDEKA  130
            K IR +  IPIIMLTAR  + D +     +G DDY  KPFSP +L    ++    +R
Sbjct:   67 CKEIRAFSQIPIIMLTARGGEDDKVMGLQIGADDYIVKPFSPRELVARIEVALRRTQGIQ  126

Query:  131 IKNDTQYQFLDLTLDTEKRIALLSNEEMPLTKTEFDFLLVLIEKPETAFSRETLLNRIWG  190
               +DT Y+F +L +    R    ++ +E+  LTK E+D L+ L+E    F+RE L +R+WG
Sbjct:  127 QVDDTGYRFNELRIQPSGRKVFVNGQEISLTKKEYDLLVFLLEHRGRVFTREHLHDRLWG  186

Query:  191 FDDIES--RAVDDTIKRLRKKFKQYHSQVSIKTVWGYGFK                      228
             D  +    R VD   IK LR K K   +    IKTVWG G+K
Sbjct:  187 MDTQQGTLRTVDTHIKTLRLKLKP--ADRFIKTVWGVGYK                      224
```

There is also homology to SEQ ID 3260.

Based on this analysis, it was predicted that this protein and its epitopes, could be useful antigens for vaccines or diagnostics.

EXAMPLE 2037

A DNA sequence (GBSx2148) was identified in *S. agalactiae* <SEQ ID 6295> which encodes the amino acid sequence <SEQ ID 6296>. Analysis of this protein sequence reveals the following:

```
Possible Site: 55
>>> Seems to have a cleavable N-term signal seq.
    INTEGRAL    Likelihood = -2.18    Transmembrane    1568-1584 (1568-1585)
    INTEGRAL    Likelihood = -0.16    Transmembrane    338-354   (338-354)

----- Final Results -----
              bacterial membrane --- Certainty = 0.1871(Affirmative) < succ>
               bacterial outside --- Certainty = 0.0000(Not Clear)  < succ>
             bacterial cytoplasm --- Certainty = 0.0000(Not Clear)  < succ>
```

A related GBS nucleic acid sequence <SEQ ID 10237> which encodes amino acid sequence <SEQ ID 10238> was also identified.

The protein has homology with the following sequences in the GENPEPT database.

```
>GP:AAG09771 GB:AF243528 cell envelope proteinase
[Streptococcus thermophilus]
Identities = 797/1594 (50%), Positives = 1056/1594 (66%), Gaps = 39/1594 (2%)
Query:   21 MNTKQRFSIRKYKLGAVSVLLGTLFFLGGITNVAADSVINKPSDIAVEQQVKDSPTS-IA    79
            M  K+ FS+RKYK+G VSVLLG +F   G  +VAAD + +    + VE  V D+  S  A
Sbjct:    1 MKKKETFSLRKYKIGTVSVLLGAVFLFAGAPSVAADELTSLV-ETKVEATVPDAIVSESA   59

Query:   80 NETPTNN--TSSALASTAQDNLVTKANNSPTETQPVAESHSQATETFSPVANQPVESTQE  137
            +E+P         +++ +T+ D   T          ++ +  S +    ET  P    S ++
Sbjct:   60 SESPVVEELVDTSVEATSTDVTTTDNEEETPGSEALENSANTEVETTQPAVETPAISEKK  119

Query:  138 VSKTPLTKQNLAVKSTPAISKET--PQNIDSNKIITVPKVWNTGYKGEGTVVAIIDSGLD  195
            V +      K ++A ++T   ++E    PQNIDSN IITVPKVW +GYKGEGTVVAIIDSGLD
Sbjct:  120 VEEEE--KLSVADETTAITNQEEAKPQNIDSNTIITVPKVWYSGYKGEGTVVAIIDSGLD  177

Query:  196 INHDALQLNDSTKAKYQNEQQMNAAKAKAGINYGKWYNNKVIFGHNYVDVNTELKEVKST  255
             ++HD  L ++D +  AKY++E+++ AAK   AGI  YG+W+N+KV+FG+NYVDVNT LKE
Sbjct:  178 VDHDVLHISDLSTAKYKSEKEIEAAKEAAGITYGEWFNDKVVFGYNYVDVNTVLKEEDKR  237

Query:  256 SHGMHVTSIATANPSKKDTNELIYGVAPEAQVMFMRVFSDEKRGTGPALYVKAIEDAVKL  315
            SHGMHVTSIAT NP++       +L+YGVAPEAQVMFMRVFSD K  TG ALYVKAIEDAVKL
Sbjct:  238 SHGMHVTSIATGNPTQPVAGQLMYGVAPEAQVMFMRVFSDLKATTGAALYVKAIEDAVKL  297

Query:  316 GADSINLSLGGANGSLVNADDRLIKALEMARLAGVSVVIAAGNDTFGSGASKPSALYPD  375
            GADSINLSLGGANGS+VN ++ +   A+E AR AGVSVVIAAGNDGTFGSG S PSA YPD
Sbjct:  298 GADSINLSLGGANGSVVNMNENVTAAIEAARRAGVSVVIAAGNDGTFGSGHSNPSADYPD  357

Query:  376 YGLVGSPSTAREAISVASYNNTTLVNKVFNIIGLENNRNLNNGLAAYADPKVSDKTFEVG  435
            YGLVG+PSTA +AISVASYNNTT+ +KV NIIGLENN +LN G +++ +P+ S   FE+G
Sbjct:  358 YGLVGAPSTAHDAISVASYNNTTVGSKVINIIGLENNADLNYGKSSFDNPEKSPVPFEIG  417

Query:  436 KQYDYVFVGKGNDNDYKDKTLNGKIALIERGDITFTKKVVNAINHGAVGAIIFNNKAGEA  495
            K+Y+YV+  G G  +D+    L GK+ALI+RG ITF++K+ NA    GAVG +IFN++ GEA
Sbjct:  418 KEYEYVYAGIGQASDFDGLDLTGKLALIKRGTITFSEKIANATAAGAVGVVIFNSRPGEA  477

Query:  496 NLTMSLDPEASAIPAIFTQKEFGDVLAKNNYKIVFNNIKNKQANPNAGVLSDFSSWGLTA  555
            N++M LD  A AIP++F   EFG+ LA N+YKI FNN  +  + NP AG+LSDFSSWGL+A
Sbjct:  478 NVSMQLDDTAIAIPSVFIPLEFGEALAANSYKIAFNNETDIRPNPEAGLLSDFSSWGLSA  537

Query:  556 DGQLKPDLSAPGGSIYAAINDNEYDMMSGTSMASPHVAGATALVKQYLLKEHPELKKGDI  615
            DG+LKPDL+APGG+IYAAINDN+Y M GTSMASPHVAGA  LVKQYLL    +P      +I
Sbjct:  538 DGELKPDLAAPGGAIYAAINDNDYANMQGTSMASPHVAGAAVLVKQYLLATYPTKSPQEI  597

Query:  616 ERTVKYLLMSTAKAHLNKDTGAYTSPRQQGAGIIDVAAAVQTGLYLTGGENNYGSVTLGN  675
            E  VK+LLMSTAKAH+NK+T AYTSPRQQGAGIID AAA+ TGLYLT GE+ YGS+TLGN
Sbjct:  598 EALVKHLLMSTAKAHVNKETTAYTSPRQQGAGIIDTAAAISTGLYLT-GEDGYGSITLGN  656

Query:  676 IKDKISFDVTVHNINKVAKDLHYTTYLNTDQVKDGFVTLAPQQLGTFTGKTIRIEPGQTQ  735
            ++D  SF VT+HNI   K  L+Y+T L TD +      L +    + + ++ +  +
Sbjct:  657 VEDTFSFTVTLHNITNEDKTLNYSTQLTTDTAQKRIDHLGSTSISRDSWRKVTVKANSST  716

Query:  736 TITIDIDVSKYHDMLKKVMPNGYFLEGYVRFTDPVDGGEVLSIPYVGFKGEFQNLEVLEK  795
            T+TI++D S  +   L  +M NGY+LEG+VRFTD  D G+++SIPYVG+GEFQNL VLE+
Sbjct:  717 TVTINVDASSFAEELTGLMKNGYYLEGFVRFTDVADDGDIVSIPYVGFRGEFQNLAVLEE  776
```

-continued

```
Query:   796 SIYKLVANKEKGFYFQP--KQTNEVPGSEDYTALMTTSSEPIYSTDGTSPIQLKALGSYK    853
             IY L+A+ + GFYF+P    Q N V  S  YT L+T S+E IYSTD  S   +K LG++K
Sbjct:   777 PIYNLIADGKGGFYFEPVTAQPNTVDISHHYTGLVTGSTELIYSTDKRSDSAIKTLGTFK    836

Query:   854 SIDGKWILQLDQKGQPHLAISPNDDQNQDAVAVKGVFLRNFNNLRAKVYRADDVNLQKPL    913
             +  G ++L+LD+ G+PHLAISPN D NQD++  KGVFLRN+ +L A VY ADD      PL
Sbjct:   837 NKAGYFVLELDESGKPHLAISPNGDDNQDSLVFKGVFLRNYTDLVASVYAADDTERTNPL    896

Query:   914 WVSAPQAGDKNYYSGNTENPKSTFLYDTEWKGTTTDGIPLEDGKYKYVLTYYSDVPGSKP    973
             W S PQ+GDKN YSGN +NPKS+ +Y TEW GT +DG  L DGKY+YVLTY S VPG+
Sbjct:   897 WESQPQSGDKNIYSGNPKNPKSSIIYPTEWNGTDSDGNALADGKYQYVLTYSSKVPGAAV    956

Query:   974 QQMVFDITLDRQAPTLTTATYDKDRRIFKARPAVEHGESGIFREQVFYLKKDKDGHYNSV   1033
             Q M+FD+ +DR++P +TTATYD+    F  RPA+E GESG++REQVFYL  D G   ++
Sbjct:   957 QTMIFDVIIDRESPVITTATYDETNFTFNPRPAIEKGESGLYREQVFYLVADSG-VTTI   1015

Query:  1034 LRQQGEDGILVEDNKVFIKQEKDGSFILPKEVNDFSHVYYTVEDYAGNLVSAKLEDLINI   1093
                + V DNKVF+ Q  DGSF LP ++ D S  YYTVEDYAGN+   K+E+LI+I
Sbjct:  1016 PSLLKNGDVTVSDNKVFVAQNDDGSFTLPLDLADISKFYYTVEDYAGNISYEKVENLISI   1075

Query:  1094 GNKNGLVNVKVFSPELNSNVDIDFSYSVKDDKGNIIKK-QHHGKDLNLLKLPFGTYTFDL   1152
             GN+ GLV V +   + NS V I FSYSV D+ G I+ +   + D ++LKLPFGTYTFDL
Sbjct:  1076 GNEKGLVTVNILDKDTNSPVPILFSYSVTDETSKIVAELPRYAGDTSVLKLPFGTYTFDL   1135

Query:  1153 FLYDEERANLISPKSVTVTISEKDSLKDVLFKVNLLKKAALLVEFDKLLPKGATVQLVTK   1212
             FLYD E ++L        VTI E +S  +V F V L  KA LL++ D LLP G+T+QLVT
Sbjct:  1136 FLYDTEWSSLAGETKAVVTILEDNSTAEVNFYVTLKDKANLLIDIDALLPSGSTIQLVTA   1195

Query:  1213 TNTVVDLPKATYSPTDYGKNIPVGDYRLNVTLPSGYSTLENLDDLLVSVKEDQVNLTKLT   1272
                 + LP A YS TDYGK +PVG Y +   TLP GY  LE LD    V+V  +Q N+ KLT
Sbjct:  1196 DGQAIQLPNAKYSKTDYGKFVPVGTYTILPTLPEGYEFLEELD---VAVLANQSNVKKLT   1252

Query:  1273 LINKAPLINALAEQTDIITQPVFYNAGTHLKNNYLANLEKAQTLIKNRVEQTSIDNAIAA   1332
             LINK  L  +AE +     +YNA  L+  Y  LE A + N+ Q   +D+A+A+
Sbjct:  1253 LINKVALKELIAELAGLEETARYYNASPELQTAYAKALEDANAVYANKHNQAQVDSALAS   1312

Query:  1333 LRESRQALNGKETDTSLLAKAILAETEIKGNYQFVNASPLSQSTYINQVQLAKNLLQKPN   1392
             L +R+ LNG+ TD   L  +   T  + N+  + NA    Q Y  V+ A+ +L + N
Sbjct:  1313 LVAAREQLNGQATDKEKLIAEVSNYTPTQANFIYYNAENTKQIAYDTAVRSAQLVLNQEN   1372

Query:  1393 VTQSEVDKALENLDIAKNQLNGHETDYSGLHHMIIKANVLKQTSSKYQNASQFAKENYNN   1452
             VTQ+ V++ +L  AK  L+G +TD S L  +  ++VLK T +KY NAS+  K+ Y+
Sbjct:  1373 VTQAVVNQALADLLAAKANLDGQKTDISALRSAVSVSSVLKATDAKYLNASENVKQAYDQ   1432

Query:  1453 LIKKAELLLSNRQATQAQVEELLNQIKATEQELDG----RDRVSSAENYSQSLNDNDSLN   1508
             ++ A+ +L + A+QA V++ L + + + ELDG      +   N +   D ++
Sbjct:  1433 AVEAAKAILVDESASQASVDQALAVLTSAQAELDGVATSTNDAKEPANTATDKKDEGTVT   1492

Query:  1509 TTPIN--------PP-----NQPQALIFKKGMTKESEVAQKRVLGVTSQTDNQKVKTNKL   1555
                PI+        PP     N    I +K   + +     + L   + +NQ+ +   +L
Sbjct:  1493 PPPIDSEIVDVQAPPVKDTGNSEHVPIGQK-PNPQPTLPRPVTLQASLSSPNQEKQVTQL   1551

Query:  1556 PKTGESTPKITYTILLFSLSMLGLATIKLKSIKR                            1589
             P TGE+  K        L      ++GL T+ L SI+R
Sbjct:  1552 PNTCENDTK----YYLVPGVIIGLGTL-LVSIRR                            1580
```

A related GBS gene <SEQ ID 8963> and protein <SEQ ID 8964> were also identified. Analysis of this protein sequence reveals the following:

```
Lipop: Possible site: -1   Crend: 10
SRCFLG: 0
McG: Length of UR: 1
     Peak Value of UR: 2.55
     Net Charge of CR: 4
McG: Discrim Score: 2.60
GvH: Signal Score (-7.5): -0.78
     Possible site: 35
>>> Seems to have a cleavable N-term signal seq.
Amino Acid Composition: calculated from 36
ALOM program    count: 1 value: -0.16 threshold: 0.0
     INTEGRAL      Likelihood = -0.16     Transmembrane   318-334     (318-334)
     PERIPHERAL    Likelihood =  2.54     1161
 modified ALOM score: 0.53
icml HYPID: 7 CFP: 0.106

*** Reasoning Step: 3
```

```
----- Final Results -----
        bacterial membrane --- Certainty = 0.1065(Affirmative) < succ>
          bacterial outside --- Certainty = 0.0000(Not Clear)   < succ>
        bacterial cytoplasm --- Certainty = 0.0000(Not Clear)   < succ>

LPXTG motif: 1535-1539
```

The protein has homology with the following sequences in the databases:

```
50.5/67.5% over 1583aa
Streptococcus thermophilus
GP|99639321| cell envelope proteinase Insert characterized
ORF01603 (361-5070 of 5370)
GP|9963932|gb|AAG09771.1|AF243528_1|AF243528(1-1584 of 1585) cell envelope
proteinase {Streptococcus thermophilus}
% Match = 41.2
% Identity = 50.4 % Similarity = 67.4
Matches = 794 Mismatches = 498 Conservative Sub.s = 267

255       285       315       345       375       405       435       465
KNALGTVLNLPQNNL**KFRKL*KILIFYVLIVFVIIMLQEKEIFMNTKQRFSIRKYKLGAVSVLLGTLFFLGGITNVAA
                                          |  |: ||:||||:| ||||||  :|::  |   :|||
                                          MKKKETFSLRKYKIGTVSVLLGAVFLFAGAPSVAA
                                               10        20        30

495       525       552       576       606       636       666       696
DSVINKPSDIAVEQQVKDSPTS-IANETPT--NNTSSALASTAQDNLVTKANNSPTETQPVAESHSQATETFSPVANQPV
|  :     :  ||    |  |: |   |:|  :::  :|:  |           :: :     |:    ||   |    |
DE-LTSLVETKVEATVPDAIVSESASESPVVEELVDTSVEATSTDVTTTDNEEETPGSEALENSANTEVETTQPAVETPA
              50        60        70        80        90        100       110

726       756       780       810       840       870       900       930
ESTQEVSKTPLTKQNLAVKSTPAISKE--TPQNIDSNKIITVPKVWNTGYKGEGTVVAIIDSGLDINHDALQLNDSTKAK
|  |::|  :     |:::|  ::|    ::|    ||||||| ||||||| :|||||||||||::|| |:::| : ||
ISEKKVEEEE--KLSVADETTAITNQEEAKPQNIDSNTIITVPKVWYSGYKGEGTVVAIIDSGLDVDHDVLHISDLSTAK
              130       140       150       160       170       180       190

960       990       1020      1050      1080      1110      1140      1170
YQNEQQMNAAKAKAGINYGKWYNNKVIFGHNYVDVNTELKEVKSTSHGMHVTSIATANPSKKDTNELIYGVAPEAQVMFM
|::|::: ||| ||| ||::|:|:|||||:|||||||  |||     |||||||||| : :     :|:|||||||||||
YKSEKEIEAAKEAAGITYGEWFNDKVVFGYNYVDVNTVLKEEDKRSHGMHVTSIATGNPTQPVAGQLMYGVAPEAQVMFM
              210       220       230       240       250       260       270

1200      1230      1260      1290      1320      1350      1380      1410
RVFSDEKRGTGPALYVKAIEDAVKLGADSINLSLGGANGSLVNADDRLIKALEMARLAGVSVVIAAGNDGTFGSGASKPS
|||||   ||   ||||||||||||||||||||||||||:|::  :| ||:| |||:||||||||||||||||||:|:||:
RVFSDLKATTGAALYVKAIEDAVKLGADSINLSLGGANGSVVNMNENVTAAIEAARRAGVSVVIAAGNDGTFGSGHSNPS
              290       300       310       320       330       340       350

1440      1470      1500      1530      1560      1590      1620      1650
ALYPDYGLVGSPSTAREAISVASYNNTTLVNKVFNIIGLENNRNLNNGLAAYADPKVSDKTFEVGKQYDYVFVGKGNDND
| ||||||||:|||| :||||||||||: :|| ||||||||||:||| |:: :|: |    |||:|||:||:||  |  :|
ADYPDYGLVGAPSTAHDAISVASYNNTTVGSKVINIIGLENNADLNYGKSSFDNPEKSPVPFEIGKEYEYVYAGIGQASD
              370       380       390       400       410       420       430

1680      1710      1740      1770      1800      1830      1860      1890
YKDKTLNGKIALIERGDITFTKKVVNAINHGAVGAIIFNNKAGEANLTMSLDPEASAIPAIFTQKEFGDVLAKNNYKIVF
:     |  |||:|||:|| ||||::| ||  ||||  ||||  :|||::  ||    ||||:|   ||| ||:||| |
FDGLDLTGKLALIKRGTITFSEKIANATAAGAVGVVIFNSRPGEANVSMQLDDTAIAIPSVFIPLEFGEALAANSYKIAF
              450       460       470       480       490       500       510

1920      1950      1980      2010      2040      2070      2100      2130
NNIKNKQANPNAGVLSDFSSWGLTADGQLKPDLSAPGGSIYAAINDNEYDMMSGTSMASPHVAGATALVKQYLLKEHPEL
||  :   ||  ||||||||||||:|||||||||:||||| |||||||||:  ||||||||||||||  |||||| :|
NNETDIRPNPEAGLLSDFSSWGLSADGELKPDLAAPGGAIYAAINDNDYANMQGTSMASPHVAGAAVLVKQYLLATYPTK
              530       540       550       560       570       580       590

2160      2190      2220      2250      2280      2310      2340      2370
KKGDIERTVKYLLMSTAKAHLNKDTGAYTSPRQQGAGIIDVAAAVQTGLYLTGGENNYGSVTLGNIKDKISFDVTVHNIN
:||   ||:||||||||||| |:|:||||||||||||||| ||::  ||||||:| :|||:|||:|| |  |:  |:|||
SPQEIEALVKHLLMSTAKAHVNKETTAYTSPRQQGAGIIDTAAAISTGLYLTG-EDGYGSITLGNVEDTFSFTVTLHNIT
              610       620       630       640       650       660       670

2400      2430      2460      2490      2520      2550      2580      2610
KVAKDLHYTTYLNTDQVKDGFVTLAPQQLGTFTGKTIRIEPGQTQTITIDIDVSKYHDMLKKVMPNGYFLEGYVRFTDPV
|  |:| |  :  |  |||  |::| | |  |       :  |: :        :::||  ||||||:|||| |||||:|
NEDKTLNYSTQLTTDTAQKRIDHLGSTSISRDSWRKVTVKANSSTTVTINVDASSFAEELTGLMKNGYYLEGFVRFTDVA
              690       700       710       720       730       740       750

2640      2670      2700      2730      2754      2784      2814      2844
DGGEVLSIPYVGFKGEFQNLEVLEKSIYKLVANKEKGFYFQP--KQTNEVPGSEDYTALMTTSSEPIYSTDGTSPIQLKA
|  |:||||||||:||||||| :||| |:|: ||| |||:  :||||:||  :::|| |||:||||| |||||  | |
DDGDIVSIPYVGFRGEFQNLAVLEEPIYNLIADGKGGFYFEPVTAQPNTVDISHHYTGLVTGSTELIYSTDKRSDSAIKT
              770       780       790       800       810       820       830
```

-continued

```
     2874      2904      2934      2964      2994      3024      3054      3084
LGSYKSIDGKWILQLDQKGQPHLAISPNDDQNQDAVAVKGVFLRNFNNLRAKVYRADDVNLQKPLWVSAPQAGDKNYYSG
||::|:    |  ::|:||: |:|||||||| |  |||::  |||||||: :| || |||    ||| || :|||| |||
LGTFKNKAGYFVLELDESGKPHLAISPNGDDNQDSLVFKGVFLRNYTDLVASVYAADDTERTNPLWESQPQSGDKNIYSG
            850       860       870       880       890       900       910

3114      3144      3174      3204      3234      3264      3294      3324
NTENPKSTFLYDTEWKGTTTDGIPLEDGKYKYVLTYYSDVPGSKPQQMVFDITLDRQAPTLTTATYDKDRRIFKARPAVE
| :||||  :|  ||| ||  :||   | ||||:|||| | |||    | |:||: :||::|   :|||||| |   |||:|
NPKNPKSSIIYPTEWNGTDSDGNALADGKYQVLTYSSKVPGAAVQTMIFDVIIDRESPVITTATYDETNFTFNPRPAIE
            930       940       950       960       970       980       990

3354      3384      3414      3444      3474      3504      3534      3564
HGESGIFREQVFYLKKDKDGHYNSVLRQQGEDGILVEDNKVFIKQEKDGSFILPKEVNDFSHVYYTVEDYAGNLVSAKLE
||||::|||||||| | |     ::        :  | ||||| :  ||||  ||  :: | |  ||||||||||:    |:|
KGESGLYREQVFYLVADASG-VTTIPSLLKNGDVTVSDNKVFVAQNDDGSFTLPLDLADISKFYYTVEDYAGNISYEKVE
            1010      1020      1030      1040      1050      1060      1070

3594      3624      3654      3684      3711      3741      3771      3801
DLINIGNKNGLVNVKVFSPELNSNVDIDFSYSVKDDKGNIIKK-QHHGKDLNLLKLPFGTYTFDLFLYDEERANLISPKS
:||:|||:  ||| |   | ::   :  || | |||||  |: |   |:         |  | ::|||||||||||||||   | ::|
NLISIGNEKGLVTVNILDKDTNSPVPILFSYSVTDETGKIVAELPRYAGDTSVLKLPFGTYTFDLFLYDTEWSSLAGETK
            1080      1090      1100      1110      1120      1130      1140      1150

3831      3861      3891      3921      3951      3981      4011      4041
VTVTISEKDSLKDVLFKVNLLKKAALLVEFDKLLPKGATVQLVTKTNTVVDLPKATYSPTDYGKNIPVGDYRLNVTLPSG
     |||   :|    :|      || ||::  |    |||  |:|||||              :   ||  ||  ||||  :||| :    |||  |
AVVTILEDNSTAEVNFYVTLKDKANLLIDIDALLPSGSTIQLVTADGQAIQLPNAKYSKTDYGKFVPVGTYTILPTLPEG
            1160      1170      1180      1190      1200      1210      1220      1230

4071      4101      4131      4161      4191      4221      4251      4281
YSTLENLDDLLVSVKEDQVNLTKLTLINKAPLINALAEQTDIITQPVFYNAGTHLKNNYLANLEKAQTLIKNRVEQTSID
|  ||  ||   |:|   :|  :|  |:   ||||||||    |   :||          : ||  :|:   |          |||
YEFLEELD---VAVLANQSNVKKLTLINKVALKELIAELAGLEETARYYNASPELQTAYAKALEDANAVYANKHNQAQVD
            1240      1250      1260      1270      1280      1290      1300

4311      4341      4371      4401      4431      4461      4491      4521
NAIAALRESRQALNGKETDTSLLAKAILAETEIKGNYQFVNASPLSQSTYINQVQLAKNLLQKPNVTQSEVDKALENLDI
:|:|:|   :|: |||  ||  |     |    |: |:    | :  :    ::   |: | |||    |:  :|||   ||   ||:|
SALASLVAAREQLNGQATDKEKLIAEVSNYTPTQANFIYYNAENTKQIAYDTAVRSAQLVLNQENVTQAVVNQALADLLA
            1320      1330      1340      1350      1360      1370      1380

4551      4581      4611      4641      4671      4701      4731      4761
AKNQLNGHETDYSGLHHMIIKANVLKQTSSKYQNASQFAKENYNNLIKKAELLLSNRQATQAQVEELLNQIKATEQELDG
|| |:|::|| |   :  :::|||    |  |:   | :   ::|    ::  |  :|||:|:|:   :    ||||
AKANLDGQKTDISALRSAVSVSSVLKATDAKYLNASENVKQAYDQAVEAAKAILVDESASQASVDQALAVLTSAQAELDG
            1400      1410      1420      1430      1440      1450      1460

4779      4809      4839      4825      4860      4890      4920      4950
----RDRVSSAENYSQSLNDNDSLNTTPIN--------PP-----NQPQALIFKKGMTKESEVAQKRVLGVTSQTDNQKV
    :   |  |   :: ||:     |:         ||       ::             ||      ||:   |:    :  : :|    |  ||
VATSTNDAKEPANTATDKKDEGTVTPPPIDSEIVDVQAPPVKDTGNSEHVPIGQKPNPQPT-LPRPVTLQASLSSPNQEK
            1480      1490      1500      1510      1520      1530      1540

4980      5010      5040      5070      5100      5130      5160      5190
KTNKLPKTGESTPKITYTILLFSLSMLGLATIKLKSIKRE*NTLKNRARHQLLAINS**LVPF*GA*NDVPKDLFSAVSW
:  :|| |||  |  : :     || |    :   :: ||
QVTQLPNTGENDTK--YYLVPGVIIGLGTLLVSIRRHKEEV
            1560      1570      1580
```

A related GBS nucleic acid sequence <SEQ ID 10965> which encodes amino acid sequence <SEQ ID 10966> was also identified.

A related DNA sequence was identified in *S. pyogenes* <SEQ ID 6297> which encodes the amino acid sequence <SEQ ID 6298>. Analysis of this protein sequence reveals the following:

```
LPXTG motif: 1614-1619

Possible site: 33

>>> Seems to have a cleavable N-term signal seq.
   INTEGRAL    Likelihood = -4.46    Transmembrane 1623-1639   (1621-1641)

----- Final Results -----
            bacterial membrane  --- Certainty = 0.2784(Affirmative) < succ>
            bacterial outside   --- Certainty = 0.0000(Not Clear)   < succ>
            bacterial cytoplasm --- Certainty = 0.0000(Not Clear)   < succ>
```

The protein has homology with the following sequences in the databases:

```
>GP:AAG09771 GB:AF243528 cell envelope proteinase [Streptococcus thermophilus]
 Identities = 465/1125 (41%), Positives = 668/1125 (59%), Gaps = 61/1125 (5%)
Query:     1 VEKKQRFSLRKYKSGTFSVLIGSVFLVM-TTTVAADELSTMSEPTITNHAQQQAQHLTNT      59
             ++KK+ FSLRKYK GT SVL+G+VFL    +VAADEL+++E +              T
Sbjct:     1 MKKKETFSLRKYKIGTVSVLLGAVFLAGAPSVAADELTSLVETKVKA-----------T      49

Query:    60 ELSSAESKSQDTSQITLKTNREKEQSQDLVSEPTTTELADTDAASMANTGSDATQKSASL     119
              +  S+S    S +       E+  D   E T+T++  TD        GS+A + SA
Sbjct:    50 VPDAIVSESASESPVV-------EELVDTSVEATSTDVTTTDNEE-ETPGSEALENSA--      99

Query:   120 PPVNTDVHDWVKTKGAWDKGYKGQGKVVAVIDTGIDPAHQSMRISDVSTAKVKSKEDMLA     179
                  NT+V      T+ A +     + KV         + + ++D +TA      +E
Sbjct:   100 ----NTEVET---TQPAVETPAISEKKV--------EEEEKLSVADETTAITNQEE----     140

Query:   180 RQKAAGINYGSWINDKVVFAHNYVENSDNIKE-NQFEDFDEDWENFEFDAEAEPKAIKKH     238
                K    I+  + I       V+     Y       +    D D D   +  A+ K+ K+
Sbjct:   141 -AKPQNIDSNTIITVPKVWYSGYKGEGTVVAIIDSGLDVDHDVLHISDLSTAKYKSEKEI     199

Query:   239 KIYRPQSTQAPKETVIKTEETDGSHDIDWTQTDDDTKYESHGMHVTGIVAGNSKEAAATG     298
              + +   +    E    +   G +  +D          SHGMHVT I GN  + A G
Sbjct:   200 EAAKEAAGITYGEW-FNDKVVFGYNYVDVNTVLKEEDKRSHGMHVTSIATGNPTQPVA-G     257

Query:   299 ERFLGIAPEAQVMFMRVFANDIMGSAESLFIKAIEDAVALGADVINLSLGTANGAQLSGS     358
              +     G+APEAQVMFMRVF++      +L++KAIEDAV LGAD INLSLG ANG+ ++ +
Sbjct:   258 QLMYGVAPEAQVMFMRVFSDLKATTGAALYVKAIEDAVKLGADSINLSLGGANGSVVNMN     317

Query:   359 KPLMEAIEKAKKAGVSVVVAAGNERVYGSDHDDPLATNPDYGLVGSPSTGRTPTSVAAIN     418
              + +   AIE A++AGVSVV+AAGN+  +GS H +P A  PDYGLVG+PST    SVA+ N
Sbjct:   318 ENVTAAIEAARRAGVSVVIAAGNDGTFGSGHSNFSADYPDYGLVGAPSTAHDAISVASYN     377

Query:   419 SKWVIQRLMTVKELENRADLNHGKAIYSESVDFKDIKDSLGYDKSHQFAYVKESTDAGYN     478
              +  V  +++ +  LEN ADLN+GK+ + ++ +        +G +  + +A +  +++D   ++
Sbjct:   378 NTTVGSKVINIIGLENNADLNYGKSSF-DNPEKSPVPFEIGKEYEYVYAGIGQASD--FD     434

Query:   479 AQDVKGKIALIERDPNKTYDEMIALAKKHGALGVLIFNNKPGQSNRSMRLTANGMGIPSA     538
                 D+ GK+ALI+R-  T+ E IA A   GA+GV+IFN++PG++N SM+L     + IPS
Sbjct:   435 GLDLTGKLALIKRG-TITFSEKIANATAAGAVGVVIFNSRPGEANVSMQLDDTAIAIPSV     493

Query:   539 FISHEFGKAMSQLNGNGTGSLEFDSVVSKAPSQKGNEMNHFSNWGLTSDGYLKPDITAPG     598
              FI  EFG+A++    + + F++    P+  +    ++ FS+WGL++DG LKPD+ APG
Sbjct:   494 FIPLEFGEALAA----NSYKIAFNNETDIRPNPEAGLLSDFSSWGLSADGELKPDLAAPG     549

Query:   599 GDIYSTYNDNHYGSQTGTSMASPQIAGASLLVKQYLEKTQPNLPKEKIADIVKNLLMSNA     658
              G IY+  NDN Y +   GTSMASP +AGA++LVKQYL    T P     ++I   +VK+LLMS A
Sbjct:   550 GAIYAAINDNDYANMQGTSMASPHVAGAAVLVKQYLLATYPTKSPQEIEALVKHLLMSTA     609

Query:   659 QIHVNPETKTTTSPRQQGAGLLNIDGAVTSGLYVTGKDNYGSISLGNITDTMTFDVTVHN     718
              + HVN ET  TSPRQQGAG+++   A+++GLY+TG+D YGSI+LGN+ DT +F VT+HN
Sbjct:   610 KAHVNKETTAYTSPRQQGAGIIDTAAAISTGLYLTGEDGYGSITLGNVEDTFSFTVTLHN     669

Query:   719 LSNKDKTLRYDTELLTDHVDPQKGRFTLTSHSLKTYQGGEVTVPANGKVTVRVTMDVSQF     778
              ++N+DKTL Y T+L TD        TS S +++   +VTV AN    TV +  +D S F
Sbjct:   670 ITNEDKTLNYSTQLTTDTAQKRIDHLGSTSISRDSWR--KVTVKANSSTTVTINVDASSF     727

Query:   779 TKELTKQMPNGYYLEGFVRFRDSQDDQLNRVNIPFVGFKGQFENLAVAEEESIYRLKSQGK     838
                +ELT  M NGYYLEGFVRF D  DD   V+IP+VGF+G+F+NLAV EE IY L + GK
Sbjct:   728 AEELTGLMKNGYYLEGFVRFTDVADDG-DIVSIPYVGFRGEFQNLAVLEEPIYNLIADGK     786

Query:   839 TGFYFDE-SGPKDDIYVGKHFTGLVTLGSETNVSTKTISDNGLHTLGTFKNADGKFILEK     897
                GFYF+ +    + +   H+TGLVT +E   ST     SD+ +  TLGTFKN  G F+LE
Sbjct:   787 GGFYFEPVTAQPNTVDISHHYTGLVTGSTELIYSTDKRSDSAIKTLGTFKNKAGYFVLEL     846

Query:   898 NAQGNPVLAISPNGDNNQDFAAFKGVFLRKYQGLKASVYHASDKEHKNPLWVS-PESFKG     956
                + G P LAISPNGD+NQD    FKGVFLR Y  L ASVY A D E   NPLW S P+S  G
Sbjct:   847 DESGKPHLAISPNGDDNQDSLVFKGVFLRNYTDLVASVYAADDTERTNPLWESQPQS--G     904

Query:   957 DKN-FNSDIRFAKSTTLLGTAFSGKSLTGAELPDGHYHYVVSYYPDVVGAKRQEMTFDMI    1015
              DKN  ++ + +  KS+ ++ T  ++G    L DG Y  YV++Y   V GA  Q M FD+I
Sbjct:   905 DKNIYSGNPKNPKSSIIYPTEWNGTDSDGNALADGKYQYVLTYSSKVPGAAVQTMIFDVI     964

Query:  1016 LDRQKPVLSQATFDPETNRFKPEPLKDRGLAGVRKDSVFYLERKDNKPYTVTINDSYKYV    1075
              +DR+  PV++  AT+D     F  P P  ++G +G+  ++ VFYL      +  T+       V
Sbjct:   965 IDRESPVITTATYDETNFTFNPRPAIEKGESGLYREQVFYLVADASGVTTIPSLLKNGDV    1024

Query:  1076 SVEDNKTFVERQADGSFILPLDKAKLGDFYYMVEDFAGNVAIAKL                1120
              +V DNK FV +  DGSF LPLD A +  FYY VED+AGN++     K+
Sbjct:  1025 TVSDNKVFVAQNDDGSFTLPLDLADISKFYYTVEDYAGNISYEKV                1069
```

An alignment of the GAS and GBS proteins is shown below.

```
Identities = 543/1676 (32%), Positives = 821/1676 (48%), Gaps = 158/1676 (9%)
Query:    24 KQRFSIRKYKLGAVSVLLGTLFFLGGITNVAAD--SVINKPSDIAVEQQVKDSPTSI---    78
             KQRFS+RKYK G  SVL+G++F +  T VAAD  S +++P+     QQ     T+
Sbjct:     4 KQRFSLRKYKSGTFSVLIGSVFLVM-TTTVAADELSTMSEPTITNHAQQQAQHLTNTELS   62

Query:    79 ANETPTNNTSSALASTAQD-----NLVTKANNSPTETQPVAESHSQATETFSPVANQPVE  133
             + E+ + +TS   T ++     +LV++  +       A  + ++     A+ P
Sbjct:    63 SAESKSQDTSQITLKTNREKEQSQDLVSEPTTTELADTDAASMANTGSDATQKSASLPPV  122

Query:   134 STQEVSKTPLTKQ--NLAVKSTPAISKETPQNID-SNKIITVPKVWNTGYKGEGTVVAI-  189
             +T +V    TK   +  K      +      ID +++ + +  V   K + ++A
Sbjct:   123 NT-DVHDVKTKGAWDKGYKGQGKVVAVIDTGIDPAHQSMRISDVSTAKVKSKEDMLARQ   181

Query:   190 ----IDSGLDIN------HDALQLNDSTKAK--------YQNEQQMNAAKAKAGINYGKW  231
                 I+ G IN      H+ ++ +D+ K          ++N +    A+ KA I   K
Sbjct:   182 KAAGINYGSWINDKVVFAHNYVENSDNIKENQFEDFDEDWENFEFDAEAEPKA-IKKHKI  240

Query:   232 YN-------------NKVIFGHNYVDVNTELKEVKSTSHGMHVTSIATANPSKKD-TNEL  277
             Y              +   G + +D    + K SHGMHVT  I  N +   T E
Sbjct:   241 YRPQSTQAPKETVIKTEETDGSHDIDWTQTDDDTKYESHGMHVTGIVAGNSKEAAATGER  300

Query:   278 IYGVAPEAQVMFMRVFSDEKRGTGPALYVKAIEDAVKLGADSINLSLGGANGSLVNADDR  337
                C+APEAQVMFMRVF+++  G+   +L++KAIEDAV LGAD INLSLG ANG+ ++
Sbjct:   301 FLGIAPEAQVMFMRVFANDIMGSAESLFIKAIEDAVALGADVINLSLGTANGAQLSGSKP  360

Query:   338 LIKALEMARLAGVSVVIAAGNDGTFGSGASKPSALYPDYGLVGSPSTAREAISVASYNNT  397
             L++A+E A+ AGVSVV+AAGN+  +GS     P A  PDYGLVGSPST R   SVA+ N+
Sbjct:   361 LMEAIEKAKKAGVSVVVAAGNERVYGSDHDDPLATNPDYGLVGSPSTGRTPTSVAAINSK  420

Query:   398 TLVNKVFNIIGLENNRNLNNGLAAYA---DPKVSDKTFEVGKQYDYVFVGKGNDNDYKDK  454
              ++ ++ +   LEN +LN+G A Y+   D K    +    K + +   +V   D Y +
Sbjct:   421 WVIQRLMTVKELENRADLNHGKAIYSESVDFKDIKDSLGYDKSHQFAYVKESTDAGYNAQ  480

Query:   455 TLNGKIALIERG-DITFTKKVVNAINHGAVGAIIFNNKAGEANLTMSLDPEASAIPAIFT  513
              + GKIALIER  + T+ +   + A HGA+G +IFNNK G++N +M L      IP+ F
Sbjct:   481 DVKGKIALIERDPNKTYDEMIALAKKHGALGVLIFNNKPGQSMRSMRLTANGMGIPSAFI  540

Query:   514 QKEFGDVLAKNNYK----IVFNNIKNKQANPNAGVLSDFSSWGLTADGQLKPDLSAPGGS  569
              EFG +++ N      + F+++ +K     ++ FS+WGLT+DG LKPD++APGG
Sbjct:   541 SHEFGKAMSQLNGNGTGSLEFDSVVSKAPSQKGNEMNHFSNWGLTSDGYLKPDITAPGGD  600

Query:   570 IYAAINDNEYDMMSGTSMASPHVAGATALVKQYLLKEHPELKKGDIERTVKYLLMSTAKA  629
             IY+  NDN Y   +GTSMASP +AGA+ LVKQYL K  P LK   +   VK LLMS A+
Sbjct:   601 IYSTYNDNHYGSQTGTSMASPQIAGASLLVKQYLEKTQPNLPKEKIADIVKNLLMSNAQI  660

Query:   630 HLNKDTGAYTSPRQQGAGIIDVAAAVQTGLYLTGGENNYGSVTLGNIKDKISFDVTVHNI  689
             H+N +T   TSPRQQGAG++++   AV  +GLY+TG ++NYGS++LGNI D ++FDVTVHN+
Sbjct:   661 HVNPETKTTTSPRQQGAGLLNIDGAVTSGLYVTG-KDNYGSISLGNITDTMTFDVTVHNL  719

Query:   690 NKVAKDLHYTTYLNTDQV--KDGFVTLAPQQLGTFTGKTIRIEPGQTQTITIDIDVSKYH  747
              +    KLYT L TD V  +G TL     L T+ G ++      T+ + +DVS++
Sbjct:   720 SNKDKTLRYDTELLTDHVDPQKGRFTLTSHSLKTYQGGEVTVPANGKVTVRVTMDVSQFT  779

Query:   748 DMLKKVMPNGYFLEGYVRFTDPVDGG-EVLSIPYVGFKGEFQNLEVLEKSIYKLVANKEK  806
              L K MPNGY+LEG+VRF D D     ++IP+VGFKG+F+NL V E+SIY+L + +
Sbjct:   780 KELTKQMPNGYYLEGFVRFRDSQDDQLNRVNIPFVGFKGQFENLAVAEEESIYRLKSQGKT  839

Query:   807 GFYFQPK-QTNEVPGSEDYTALMTTSSEPIYSTDGTSPIQLKALGSYKSIDGKWILQLDQ  865
             GEYF      +++  + +T L+T  SE   ST   S    L  LG++K+ DGK+IL+ +
Sbjct:   840 GFYFDESGPKDDIYVGKHFTGLVTLGSETNVSTKTISDNGLHTLGTFKNADGKFILEKNA  899

Query:   866 KGQPHLAISPNDDQNQDAVAVKGVFLRNFNNLRAKVYRADDVNLQKPLWVSAPQ-AGDKN  924
             +G P LAISPN D NQD A  KGVFLR +  L+A VY A D   + PLWVS    GDKN
Sbjct:   900 QGNPVLAISPNGDNNQDFAAFKGVFLRKYQGLKASVYHASDKEHKNPLWVSPESFKGDKN  959

Query:   925 YYSGNTENPKSTFLYDTEWKGTTTDGIPLEDGKYKYVLTYYSDVPGSKPQQMVFDITLDR  984
             + S +   KST L+  T+  G  L DG Y YV++YY DV G+K Q+M FD+ LDR
Sbjct:   960 FNS-DIRFAKSTTLLGTAFSGKSLTGAELPDGHYHYVVSYYPDVVGAKRQEMTFDMILDR 1018

Query:   985 QAPTLTTATYDKRRIFKARPAVEHGESGIFREQVFYLKKDKDGHYNSVLRQQGEDGILVV 1044
             Q  P L+ AT+D +    FK  P  + G + + ++ VFYL++ KD     +V      + V
Sbjct:  1019 QKPVLSQATFDPETNRFKPEPLKDRGLAGVRKDSVFYLER-KDNKPYTVTINDSYKVSV  1077

Query:  1045 EDNKVFIKQEKDGSFILPKEVNDFSHVYYTVEDYAGNLVSAKLEDLINIGNKNGLVNKV  1104
              EDNK F++++ DGSFILP +        YY VED+AGN+  AKL D +      + +K+
Sbjct:  1078 EDNKTFVERQADGSFILPLDKAKLGDFYYMVEDFAGNVAIAKLGDHLPQTLGKTPIKLKL 1137

Query:  1105 FSPELNSNVDIDFSYSVKDDKGNIIKKQ------HHGKDLNLLKLPFGTYTFDLFLYDEE 1158
               +    +  + +   ++  ++  Q    H +   +L   D F+  E
Sbjct:  1138 TDGNYQTKETLKDNLEMTQSDTGLVTNQAQLAVVHRNQPQSQLT----KMNQDFFISFNE 1193
```

```
Query:  1159  RANLISPKSVTVTISEKDSLKDVLFKVNLLKKAALLVEFDKLLP-----KGATVQLVTKT  1213
                  N    K          K+++ +  L VN+ K    +     K P       GA+V +   T
Sbjct:  1194  DGN----KDFVAFKGLKNNVYNDL-TVNVYAKD----DHQKQTPIWSSQAGASVSAIEST  1244

Query:  1214  NTVVDLPKATYSPTDYGKNIPVGDYRLNVTLPSGYSTLENLDDLLVSVKEDQVNLT--KL  1271
                          A Y  T  G   + GDY+ VT    +     E+        +SV + +   +T
Sbjct:  1245  --------AWYGITARGSKVMPGDYQYVVTYRDEHGK-EHQKQYTISVNDKKPMITQGRF  1295

Query:  1272  TLINK----APLINALAEQTDIITQPVFYNAGTHLKNNYLANLEKAQTLIKNRVEQTSID  1327
                  IN        P     + + I+ +  VFY A     KN   ++ + + I        T  D
Sbjct:  1296  DTINGVDHFTPDKTKALDSSGIVREEVFYLA---KKNGRKFDVTEGKDGI------TVSD  1346

Query:  1328  NAIAALRESRQALNGKETDTSLLAKAILAETEIKGNYQFVNASPL----SQSTYIN----  1379
                  N +   +         + D   L+        +   GN F      L         +N
Sbjct:  1347  NKVYIPKNPDGSYTISKRDGVTLSDYYYLVEDRAGNVSFATLRDLKAVGKDKAVVNFGLD  1406

Query:  1380  -QVQLAKNLLQKPNVTQSEVDKALENLDIAKNQLNGHETDYS--GLHHMIIKANVLKQTS  1436
                   V   K ++   + +      K+ ENL+    N   N     Y          +     N K S
Sbjct:  1407  LPVPEDKQIVNFTYLVRDADGKPIENLEYYNNSGNSLILPYGKYTVELLTYDTNAAKLES  1466

Query:  1437  SKYQNASQFAKSNYNNLIKKAELLLSNR----------QATQAQVEELLNQIKATEQEL-  1485
                  K + +  A   N+ +  K  +L +++           + ++  ++    +Q+    EQ L
Sbjct:  1467  DKIVSFTLSADNNFQQVTFKITMLATSQITAHFDHLLPEGSRVSLKTAQDQLIPLEQSLY  1526

Query:  1486  ----------DGRDRVSSAENYSQSLNDNDSLNTTPINPPNQPQALIFKKGMTKES----  1531
                             +G     V +        +  N  +NT P N ++      + K G      +S
Sbjct:  1527  VPKAYGKTVQEGTYEVVVSLPKGYRIEGNTKVNTLP-NEVHELSLRLVKVGDASDSTGDH  1585

Query:  1532  -----EVAQKRVLGVTSQTDNQKVKTNKLPKTGESTPKITYTILLFSLSMLGLATI  1582
                        +Q   T                  LP TGE  K+  +  + L +LGL +
Sbjct:  1586  KVMSKNNSQALTASATPTKSTTSATAKALPSTGE---KMGLKLRIVGLVLLGLTCV  1638
```

SEQ ID 8964 (GBS92) was expressed in *E. coli* as a His-fusion product. SDS-PAGE analysis of total cell extract is shown in FIG. 31 (lane 2; MW 48 kDa).

GBS92-His was purified as shown in FIG. 199, lane 9.

Based on this analysis, it was predicted that these proteins and their epitopes could be useful antigens for vaccines or diagnostics.

EXAMPLE 2038

A DNA sequence (GBSx2149) was identified in *S. agalactiae* <SEQ ID 6299> which encodes the amino acid sequence <SEQ ID 6300>. This protein is predicted to be AzlC family protein. Analysis of this protein sequence reveals the following:

```
Possible site: 33
>>> Seems to have no N-terminal signal sequence
    INTEGRAL   Likelihood = -7.80    Transmembrane   212-228   (196-230)
    INTEGRAL   Likelihood = -7.27    Transmembrane   167-183   (159-185)
    INTEGRAL   Likelihood = -5.68    Transmembrane   189-205   (188-210)
    INTEGRAL   Likelihood = -2.28    Transmembrane    17-33     (13-34)
    INTEGRAL   Likelihood = -1.06    Transmembrane   135-151   (135-151)
    INTEGRAL   Likelihood = -1.01    Transmembrane    61-77     (60-77)

----- Final Results -----
           bacterial membrane  --- Certainty = 0.4121(Affirmative) < succ>
           bacterial outside   --- Certainty = 0.0000(Not Clear)   < succ>
           bacterial cytoplasm --- Certainty = 0.0000(Not Clear)   < succ>
```

A related GBS nucleic acid sequence <SEQ ID 10235> which encodes amino acid sequence <SEQ ID 10236> was also identified.

The protein has homology with the following sequences in the GENPEPT database.

```
>GP:AAF10212 GB:AE001921 AzlC family protein [Deinococcus radiodurans]
 Identities = 72/224 (32%), Positives = 117/224 (52%), Gaps = 8/224 (3%)
 Query:    6  FKEGVKDALPTALGYISIGLAFGIVASASDLSAIEVGLMSALVYGGSAQFAMCALLLAKA   65
             F +G  +  +P  LG +    LA + A+ LS +   LMS   + G++QFA   L   A A
 Sbjct:    7  FWQGFRALVPLWLGTVPFALAYAVTARAAGLSVGDTCLMSLTTFAGASQFAAAGLFGAHA   66

Query:   66  DLMTITMTVFLVNLRNMLSLHATTIFKSAHLMNQLAIGTLITDESYGV-LLGEALHHKV  124
             ++I  +T FL+N R++L  L      +        L ++        +TDE+YGV ++   A
 Sbjct:   67  GGLSIVLTTFLLNARHLLYGLSLARELRLT-LPQRVVAAQFLTDEAYGVAVVSGARLPGG  125

Query:  125  VSPSWMHGNNVMSYLTWVISTIIGTLLGSTIPNPEMFGLDFALVAMFIGLFVFQLFGMLS  184
             ++  +++     G +   YL+W +ST++G L GS +P PE   G+         F+GL V    ++
 Sbjct:  126  LTFAFLLGAELSLYLSWNVSTLLGALAGSVLPPPEQLGVGVVFPLAFLGLLV----PLVV  181
```

```
                            -continued
Query:  185 DGKRLVVYVLASVGLSYFLLATFLSGALSVLLATVVGCSVGVVL          228
            D  RL + V  + GL  + L+   L G L +LLA V G  +G   L
Sbjct:  182 D--RLSLLVALAAGLGGWALSRVLPGGLVILLAGVGGALLGAAL           223
```

No corresponding DNA sequence was identified in *S. pyogenes*.

Based on this analysis, it was predicted that this protein and its epitopes, could be useful antigens for vaccines or diagnostics.

EXAMPLE 2039

A DNA sequence (GBSx2150) was identified in *S. agalactiae* <SEQ ID 6301> which encodes the amino acid sequence <SEQ ID 6302>. Analysis of this protein sequence reveals the following:

```
Possible site: 60
>>> Seems to have no N-terminal signal sequence

----- Final Results -----
          bacterial cytoplasm --- Certainty = 0.3794(Affirmative) < succ>
          bacterial membrane  --- Certainty = 0.0000(Not Clear)   < succ>
          bacterial outside   --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 2040

A DNA sequence (GBSx21151) was identified in *S. agalactiae* <SEQ ID 6303> which encodes the amino acid sequence <SEQ ID 6304>. Analysis of this protein sequence reveals the following:

```
Possible site: 13
>>> Seems to have no N-terminal signal sequence

----- Final Results -----
          bacterial cytoplasm --- Certainty = 0.5087(Affirmative) < succ>
          bacterial membrane  --- Certainty = 0.0000(Not Clear)   < succ>
          bacterial outside   --- Certainty = 0.0000(Not Clear)   < succ>
```

A related GBS nucleic acid sequence <SEQ ID 10233> which encodes amino acid sequence <SEQ ID 10234> was also identified.

The protein has homology with the following sequences in the GENPEPT database.

```
>GP:BAB04157 GB:AP001508 homosystein methyl transferase [Bacillus halodurans]
   Identities = 397/751 (52%), Positives = 519/751 (68%), Gaps = 14/751 (1%)
Query:   10 SNLGYPRLGEQREWKQAIEAFWAGNLEQKDLEKQLKQLRINHLKKQKEAGIDLIPVGDFS    69
            SNLGYPR+GE REWK+A+E+FWA +  ++ L   +K+LR+NHL+ Q+E  +DLIPVGDF+
Sbjct:    4 SNLGYPRIGENREWKKALESFWANDTTEEQLLATMKELRLNHLRVQQEQEVDLIPVGDFT    63

Query:   70 CYDHVLDLSFQFNVIPKRFDEY--ERNLDLYFAIARGDKDNVASSMKKWFNTNYHYIVPE   127
               YDHVLD++  F +IPKRF +      L  YFA+ARG K+  A  M KW+NTNYHYIVPE
Sbjct:   64 LYDHVLDMAVMFGIIPKRFLQQGDTPTLSTYFAMARGSKNAQACEMTKWYNTNYHYIVPE   123

Query:  128 WEVETKPHLQNNYLLDLYLEAREVVGDKAKPVITGPITYVSLSSGIVD--FEATVQRLLP   185
              + P L  N  L+ YLEA+  +G   KPVI GP ++V L+ G  +    + T+Q LLP
Sbjct:  124 LH-DAAPRLTKNAPLEAYLEAKNELGIDGKPVILGPYSFVKLAKGYEEDKLQETIQSLLP   182

Query:  186 LYKQVFQDLIDAGATYIQIDEPIFVTDEGELLVDIAKSVYDFFAREVPQAHFIFQTYFES   245
            LY QV Q+L+DAGA  IQ+DEP  VT      +   +Y+      + A      QTYF++
Sbjct:  183 LYIQVIQELVDAGARSIQVDEPSLVTSISAREMALVTRIYEQINEAIADAPLFLQTYFDA   242

Query:  246 AVCLDKLSKLPVTGFGLDFIHGRAENLAAVKQ-GLFREKELFAGIVNGRNIWAVNLEETL   304
            +++     LPV G GLDF+HG A+NL A++    G   +K L AGI++GRNIW  NL E
Sbjct:  243 VTFYEEVVSLPVKGIGLDFVHGGAKNLEALRTFGFPEDKVLAAGIIDGRNIWISNLRERH   302

Query:  305 ALLEEIGPFVK--RLTLQPSSSLLHVPVTTKYETHLDPVLKNGLSFADEKLKELELLASA   362
              L+ ++     V    RL LQPS  SLLHVPVTTK E  LDP L   L+FA+EKL EL L
```

```
                         -continued
Sbjct:  303  ELVHQLEQHVAKDRLVLQPSCSLLHVPVTTKREEKLDPTLLGVLAFANEKLTELHTLKQL  362

Query:  363  FDGNKTKGYHEALSR----FSALQAADFRHVALESL-AEVKLERSPYKLRQALQAEKLQL  417
                  GN++     EAL    +AL+ + +R  A  S    E K     + R+ LQ EK QL
Sbjct:  363  AAGNEAE-VKEALEANDDALAALEKSGWRSGAATSHNLENKKRPQSFNERRPLQEEKWQL  421

Query:  418  PILPTTTIGSFPQSPEIRKKRLAWKRGNLSDSDYKDFIKTEIRRWIAIQEDLDLDVLVHG  477
             P+LPTTTIGSFPQ+ ++R+ R   W++G LS  +Y+   +K+ I +WI IQE+L LDVLVHG
Sbjct:  422  PLLPTTTIGSFPQTKDVRRTRSLWRKGELSTVEYERTMKSYIEKWINIQEELGLDVLVHG  481

Query:  478  EFERVDMVEFFGQKLAGFTTTKLGWVQSYGSRAVKPPIIYGDVKHIQPLSLEETVYAQSL  537
             EFER DMVEFFG+KL GF  T  GWVQSYGSR VKPPIIYG+V    +P+++ ETVYAQSL
Sbjct:  482  EFERNDMVEFFGEKLDGFAFTANGWVQSYGSRCVKPPIIYGNVSFTEPMTVAETVYAQSL  541

Query:  538  TKKPVKGMLTGPITITNWSFERDDISRSDLFNQIALAIKDEIQLLEQSGIAIIQVDEAAL  597
             T KPVKGMLTGP+TI NWSF RDD+  + + +QIA A+   E+   LE++GI +IQ+DE A+
Sbjct:  542  TDKPVKGMLTGPVTILNWSFVRDDLPLTVIAHQIAEALTHEVTALEEAGIEMIQIDEPAI  601

Query:  598  REGLPLRQQKQQAYLDDAVAAFKIATSSVKDETQIHTHMCYSKFDEIIDSIRALDADVIS  657
             REGLPL+ + QQ YLD AV+AF+ + + VK   TQIHTHMCYS+F E+I++I   LDADVIS
Sbjct:  602  REGLPLKAEDQQEYLDWAVSAFRASCAHVKATTQIHTHMCYSEFHEMIEAIDDLDADVIS  661

Query:  658  IETSRSHGDIIESFETAVYPLGIGLGVYDIHSPRIPTKEEIIVNIQRSLKCLSKEQFWVN  717
             IETSRSHG++I  +FE      Y  GIGLGVYDIHSPR+P++EE++   I+R+L   L      FWVN
Sbjct:  662  IETSRSHGEMISAFEKTTYEKGIGLGVYDIHSPRVPSEEEMLNVIRRALTVLPASLFWVN  721

Query:  718  PDCGLKTRREAETIAALEVLVSATKEVRQQL                              748
             PDCGLKTR  E  ET+AAL+  +V+A  +    R++L
Sbjct:  722  PDCGLKTRAEKETVAALKNMVAAARAAREEL                              752
```

No corresponding DNA sequence was identified in *S. pyogenes*.

Based on this analysis, it was predicted that this protein and its epitopes, could be useful antigens for vaccines or diagnostics.

EXAMPLE 2041

A DNA sequence (GBSx2152) was identified in *S. agalactiae* <SEQ ID 6305> which encodes the amino acid sequence <SEQ ID 6306>. This protein is predicted to be metH. Analysis of this protein sequence reveals the following:

```
Possible site: 20
>>> Seems to have no N-terminal signal sequence

----- Final Results -----
            bacterial cytoplasm --- Certainty = 0.0753(Affirmative) < succ>
            bacterial membrane  --- Certainty = 0.0000(Not Clear)  < succ>
            bacterial outside   --- Certainty = 0.0000(Not Clear)  < succ>
```

The protein has homology with the following sequences in the GENPEPT database.

```
>GP:BAB05348 GB:AP001512 unknown conserved protein [Bacillus halodurans]
 Identities = 301/610 (49%), Positives = 437/610 (71%), Gaps = 9/610 (1%)
Query:    1  MSKFLEKLKTDILVADGAMGTLLYTYGLDTCHESYNVTHPEKVLAIHQAYIEAGADVIQT   60
             M+   +E LKT+ILV DGAMGTLLY  G+D C E   NVT PEK++A H AY+EAGADVIQT
Sbjct:    1  MTNLVEALKTNILVGDGAMGTLLYEQGIDRCFEELNVTDPEKIVAAHVAYVEAGADVIQT   60

Query:   61  NTYGAQRHRLKNYGLEDQVVSINQAAVNIAHQATLGKETFILGTVGGFRSQRQCDLTLDN  120
             NTY A R +L   Y L+DQV+ IN+AAV  +A    +ETF+LGT GG RS +   ++  +
Sbjct:   61  NTYAANRMKLAKYQLDDQVLEINRAAVRLARKAAK-QETFVLGTIGGIRSVQFEEVEIQE  119

Query:  121  IVEETLEQVEALLATGQLDGLLFETYYDIEEITTVLKIVREMTDLPIITNISLHEAGVTS  180
             + +  LEQ++AL++ G +DGLL ET+YD+EE      + R +TDLP+I ++S+ E GV
Sbjct:  120  VQDVFLEQMKALVSEG-VDGLLLSTFYDLEEAKLAVSLARSLTDLPVIAHLSIAEIGVLQ  178

Query:  181  NGKPIVEALSQLVMLGADVIGLNCHLGPYHMIQSLKQVPLFAQSYLSVYPNASQLSLDGE  240
                GK + EA ++L LGAD++G+NC +GPY M++SL+ V L    ++Y S YPNAS      D
Sbjct:  179  GGKLLEEAFAELEGLGADLVGINCRMGPYQMLRSLETVQLLDRAYYSAYPNASLP--DYR  236

Query:  241  NSQYQFSQNSEYFGKSAELLVAEGVRLIGGCCGTTPDHIRAVKRSIRGLKPIERKVVTPI  300
             + +  +    N EYF  +   V +GVRL+GGCCGTTP+H+RA    + ++GLKP+  K V
```

```
                            -continued
Sbjct:  237  DGRLYYHSNPEYFYEMGKRFVQQGVRLLGGCCGTTPEHVRAFAKVVKGLKPVVSKPVR--  294

Query:  301  IPVKDFVRRIRRT---DTLVDKVKKEVTIIAELDPPKHLDIVQFQKAIRAIDQKGIAAIT  357
             + +K+ +     +     + L +KVKK+ +II ELDPPK+L I +F +   A+   G+ A+T
Sbjct:  295  LEIKETLSSTGQKTAREPLAEKVKKQPSIIVELDPPKNLAIDRFVEGAAALKNAGVDAVT  354

Query:  358  LADNSLSNTRICNLSIASLLKDEISTPFLLHIACRDHNLIGLQSRLLGMELLGFNHILAI  417
             +ADNSL++ R+ NL++ ++++ ++    L+H+ CRD NLIGLQS L+G+   LG    +LAI
Sbjct:  355  MADNSLASPRVDNLALGAIIQQQVGARPLVHVTCRDRNLIGLQSHLMGLHALGMTDLLAI  414

Query:  418  TGDPTKLGDFPGATSVYDVTSFKLLSLIKQLNQGLSYSGASLRRPTDFTVAAAFNPNVKN  477
             TGDPTK+GDFPGATSVYDVTSF+L+SLIKQLN+G+S+SG   L +    +F+V AAFNPNV++
Sbjct:  415  TGDFTKVGDFPGATSVYDVTSFQLISLIKQLNEGISFSGKELGQKANFSVGAAFNPNVRH  474

Query:  478  LTRTVKLIEKKVASGADYFMTQPIFDHSVLKELADLTKTVEQPFFIGIMPITSYNNAVFL  537
             L R V+ +EKK+  +GADYFMTQPI++    ++++ + TK +E+P +IGIMP+ +  NA FL
Sbjct:  475  LERAVQRMEKKIEAGADYFMTQPIYNEKQIEDIYEATKHIEKPIYIGIMPLINGRNAEFL  534

Query:  538  HNEVPGIKLSESFLSALEKVKDDKEACLTLALNESKSLIDEALNYFNGIYLITPFLRYDL  597
             HNEVPGIKL++       + +  +D++        L   +KSL+D A +YFNGIYLITPFLRY +
Sbjct:  535  HNEVPGIKLTDQIRERMARAGEDRQKGEREGLAIAKSLLDVATHYFNGIYLITPFLRYGM  594

Query:  598  TLELIDYIQK                                                    607
             T++L  Y+++
Sbjct:  595  TVDLTHYVKE                                                    604
```

No corresponding DNA sequence was identified in *S. pyogenes*.

Based on this analysis, it was predicted that this protein and its epitopes, could be useful antigens for vaccines or diagnostics.

EXAMPLE 2042

A DNA sequence (GBSx2153) was identified in *S. agalactiae* <SEQ ID 6307> which encodes the amino acid sequence <SEQ ID 6308>. Analysis of this protein sequence reveals the following:

```
Possible site: 53
>>> Seems to have no N-terminal signal sequence
    INTEGRAL   Likelihood = -9.55   Transmembrane   127-143   (121-147)
    INTEGRAL   Likelihood = -1.44   Transmembrane   157-173   (155-175)

----- Final Results -----
            bacterial membrane --- Certainty = 0.4821(Affirmative) < succ>
            bacterial outside  --- Certainty = 0.0000(Not Clear)   < succ>
            bacterial cytoplasm --- Certainty = 0.0000(Not Clear)   < succ>
```

A related GBS nucleic acid sequence <SEQ ID 10231> which encodes amino acid sequence <SEQ ID 10232> was also identified.

The protein has homology with the following sequences in the GENPEPT database.

```
>GP:CAC01354 GB:AL390975 putative integral membrane protein
          [Streptomyces coelicolor A3(2)]
 Identities = 38/98 (38%), Positives = 59/98 (59%)
Query:  113  RIADDVARFGGSWTFIIVFVSIMAIWMLVNIMKPFGIQFDPYPFILLNLALSTIAAIQAP  172
             R+++ VARF G+   FI+    ++ +W++ N+   P G++FD YPFI L L LS  A+   AP
Sbjct:   47  RLSERVARFLGTGRFIVWMTVVIILWVVWNVSAPSGLRFDEYPFIFLTLMLSLQASYAAP  106

Query:  173  LIMMSQNRAADYDRLQARNDFNVNKTSELEIRLLHEKI                        210
             LI+++QNR  D DR+   D   N+ S        L  +I
Sbjct:  107  LILLAQNRQDDRDRVNLEQDRKQNERSIADTEYLTREI                        144
```

No corresponding DNA sequence was identified in *S. pyogenes*.

Based on this analysis, it was predicted that this protein and its epitopes, could be useful antigens for vaccines or diagnostics.

A related GBS gene <SEQ ID 8965> and protein <SEQ ID 8966> were also identified. Analysis of this protein sequence reveals the following:

```
Lipop: Possible site: -1  Crend: 7
McG: Discrim Score: -3.84
GvH: Signal Score (-7.5): -5.05
     Possible site: 53
>>> Seems to have no N-terminal signal sequence
ALOM program    count: 2 value: -9.55  threshold: 0.0
     INTEGRAL    Likelihood = -9.55    Transmembrane   127-143    (121-147)
     INTEGRAL    Likelihood = -1.44    Transmembrane   157-173    (155-175)
     PERIPHERAL  Likelihood =  5.46    27
modified ALOM score: 2.41

*** Reasoning Step: 3

----- Final Results -----
              bacterial membrane --- Certainty = 0.4821(Affirmative) < succ>
               bacterial outside --- Certainty = 0.0000(Not Clear)   < succ>
             bacterial cytoplasm --- Certainty = 0.0000(Not Clear)   < succ>
```

The protein has homology with the following sequences in the databases:

```
ORF01598(637-930 of 1341)
GP|9714438|emb|CAC01354.1||AL390975(47-144 of 198)putative integral membrane
protein{Streptomyces coelicolor A3(2)}
% Match = 8.2
% Identity = 38.8  % Similarity = 61.2
Matches = 38   Mismatches = 38   Conservative Sub.s = 22
       600       630       660       690       720       750       780       810
MKEEEKPFNVEERLNKQATIGQRIADDVARFGGSWTFIIVFVSIMAIWMLVNIMKPFGIQFDPYPFILLNLALSTIAAIQ
                |:::  ||||  |:  ||:    :: :|::  |:   |  |::|| ||||:|  ||   |:
RLDQPRPPRRRLLPEWDPESFGRLSERVARFLGTGRFIVWMTVVIILWVVWNVSAPSGLRFDEYPFIFLTLMLSLQASYA
            40        50        60        70        80        90       100
      840       870       900       930       960       990      1020      1050
APLIMMSQNRAADYDRLQARNDFNVNKTSELEIRLLHEKIDHMVQQDQFELLEIQKLQTEMLVSLGNQLAQLKQLQK*SF
||||:::|||    |  ||:       |     |  |:   |    |   :|
APLILLAQNRQDDRDRVNLEQDRKQNERSIADTEYLTREIAALRIGLGEVATRDWIRSELQDLVRDLEERQNGHHPDRGV
           120       130       140       150       160       170       180
```

SEQ ID 8966 (GBS393) was expressed in *E. coli* as a His-fusion product. SDS-PAGE analysis of total cell extract is shown in FIG. 75 (lane 3; MW 30.8 kDa). It was also expressed in *E. coli* as a GST-fusion product. SDS-PAGE analysis of total cell extract is shown in FIG. 177 (lane 4; MW 56 kDa) and in FIG. 83 (lane 6; MW 56 kDa).

GBS393-GST was purified as shown in FIG. 217, lane 5.

EXAMPLE 2043

A DNA sequence (GBSx2154) was identified in *S. agalactiae* <SEQ ID 6309> which encodes the amino acid sequence <SEQ ID 6310>. Analysis of this protein sequence reveals the following:

```
Possible site: 36
>>> Seems to have no N-terminal signal sequence
    INTEGRAL  Likelihood = -3.29    Transmembrane   274-290    (271-291)

----- Final Results ----
              bacterial membrane --- Certainty = 0.2317(Affirmative) < succ>
               bacterial outside --- Certainty = 0.0000(Not Clear)   < succ>
             bacterial cytoplasm --- Certainty = 0.0000(Not Clear)   < succ>
```

The protein has homology with the following sequences in the GENPEPT database.

```
>GP:AAD35508 GB:AE001721 glycerol dehydrogenase [Thermotoga maritima]
 Identities = 94/307 (30%), Positives = 157/307 (50%), Gaps = 21/307 (6%)
 Query:   63 VYGTDSTQSNIDKLVANPQVQAADAILGFGGGKALDTAKMVAKELGKNSFTIPTICSNCS  122
             ++G + +   I++L    + +  D ++G GGGK LDTAK VA +L K      +PTI S  +
 Sbjct:   62 IFGGECSDEEIERLSGLVE-EETDVVVGIGGGKTLDTAKAVAYKLKKPVVIVPTIASTDA  120

Query:  123 AGTAIAVVYNDDHSFLRYGY-PESPLHIFINTRIIAQAPSKYFWAGIGDGISKAPEVERA  181
             +A++V+Y  +  F RY + P +P   + ++T I+A+AP+++  AG+GD ++   E E
 Sbjct:  121 PCSALSVIYTPNGEFKRYLFLPRNPDVVLVDTEIVAKAPARFLVAGMGDALATWFEAESC  180
```

```
Query:  182  TLEAKTNKLPHT-AVLGQAVALSSKEAFYQFGEQGLKDVEANLASRAVEEI--ALDILIS  238
               +   N    ++    A+A     E    ++G     + VE     + A+E+I  A   +L
Sbjct:  181  KQKYAPNMTGRLGSMTAYALARLCYETLLEYGVLAKRSVEEKSVTPALEKIVEANTLLSG  240

Query:  239  TGYASNLVNQPDFYYNSCHAHAFYYGTTAIQRQGEFLHGVVVAFGVLV-LHAYFNELEEL  297
              G+ S              AHA + G T ++    ++LHG  VA GVL  L         + +
Sbjct:  241  LGFESG---------GLAAAHAIHNGLTVLENTHKYLHGEKVAIGVLASLFLTDKPRKMI  291

Query:  298  EKVARFNKSLGLPTTLADVSL---SEKDIPKIVEIAMTTNE---YKNTPFDPKMFAQAIL  351
              E+V  F + +GLPTTLA++ L    S++D+ K+ E A    NE     +  P  K    A+
Sbjct:  292  EEVYSFCEEVGLPTTLAEIGLDGVSDEDLMKVAEKACDKNETIHNEPQPVTSKDVFFALK  351

Query:  352  AADAFGQ                                                      358
              AAD +G+
Sbjct:  352  AADRYGR                                                      358
```

There is also homology to SEQ ID 3078.

SEQ ID 6310 (GBS123) was expressed in *E. coli* as a His-fusion product. SDS-PAGE analysis of total cell extract is shown in FIG. 29 (lane 7; MW 43.3 kDa).

Based on this analysis, it was predicted that this protein and its epitopes, could be useful antigens for vaccines or diagnostics.

EXAMPLE 2044

A DNA sequence (GBSx2155) was identified in *S. agalactiae* <SEQ ID 6311> which encodes the amino acid sequence <SEQ ID 6312>. Analysis of this protein sequence reveals the following:

```
Possible site: 39
>>> Seems to have no N-terminal signal sequence

----- Final Results -----
        bacterial cytoplasm --- Certainty = 0.0974(Affirmative) < succ>
        bacterial membrane  --- Certainty = 0.0000(Not Clear)   < succ>
          bacterial outside --- Certainty = 0.0000(Not Clear)   < succ>
```

A related DNA sequence was identified in *S. pyogenes* <SEQ ID 6313> which encodes the amino acid sequence <SEQ ID 6314>. Analysis of this protein sequence reveals the following:

```
Possible site: 17
>>> Seems to have no N-terminal signal sequence

----- Final Results -----
        bacterial cytoplasm --- Certainty = 0.2368(Affirmative) < succ>
        bacterial membrane  --- Certainty = 0.0000(Not Clear)   < succ>
          bacterial outside --- Certainty = 0.0000(Not Clear)   < succ>
```

An alignment of the GAS and GBS proteins is shown below.

```
Identities = 92/167 (55%), Positives = 121/167 (72%)
Query:    1  MKIAIIGYSGSGKSTLARKLGNYYNCNVLHLDSIHFAPNWEERKYDDMIDDVSNMLEKRT   60
             +KIAIIG+SGSGKSTLAR LG +Y+C V HLD +HF+ NW+ER   DMI D+S  L K+
Sbjct:    1  LKIAIIGHSGSGKSTLARFLGQHYHCEVFHLDQLHFSSNWQERSDHDMIADLSTCLLKQD   60

Query:   61  WIIEGNYKKLLYQERLADADEIIFFDFNRFNCLWRAFKRYCKFRGKTRPDMANGCPEKLD  120
                IIEGNY    LY+ER+++AD II+ +F+RF+C++RAFKRY  +RGKTRPDMA+ C EK D
Sbjct:   61  LIIEGNYANCLYEERMSEADYIIYVNFSRFHCVYRAFKRYLNYRGKTRPDMADNCQEKFD  120

Query:  121  FEFISWILKDGRSDKQKSNYKQVVEDYPQKIKILKHQRDLDQYLKEL              167
               F+ WIL DGRS Q   Y+ VV+ Y K  +L +Q+ L    Y+   +
Sbjct:  121  VAFVKWILLDGRSRNQLKKYQSVVQKYSHKTIVLTNQKQLSHYMNTI              167
```

Based on this analysis, it was predicted that this protein and its epitopes, could be useful antigens for vaccines or diagnostics.

EXAMPLE 2045

A DNA sequence (GBSx2156) was identified in *S. agalactiae* <SEQ ID 6315> which encodes the amino acid sequence <SEQ ID 6316>. Analysis of this protein sequence reveals the following:

```
Possible site: 55
>>> Seems to have no N-terminal signal sequence

----- Final Results -----
            bacterial cytoplasm --- Certainty = 0.3874(Affirmative) < succ>
             bacterial membrane --- Certainty = 0.0000(Not Clear)   < succ>
              bacterial outside --- Certainty = 0.0000(Not Clear)   < succ>
```

The protein has homology with the following sequences in the GENPEPT database.

```
>GP:CAA41941 GB:X59250 initiation factor IF-1 [Lactococcus lactis]
 Identities = 62/72 (86%), Positives = 70/72 (97%)
Query:   1 MAKEDVIEIEGKVVETMPNAMFTVELENGHQILATVSGKIRKNYIRILVGDRVTVEMSPY   60
           MAK+DVIE++GKVV+TMPNAMFTVELENGHQ+LAT+SGKIRKNYIRIL GD+V VE+SPY
Sbjct:   1 MAKDDVIEVDGKVVDTMPNAMFTVELENGHQVLATISGKIRKNYIRILPGDKVQVELSPY   60

Query:  61 DLTRGRITYRFK   72
           DLTRGRITYRFK
Sbjct:  61 DLTRGRITYRFK   72
```

A related DNA sequence was identified in *S. pyogenes* <SEQ ID 6317> which encodes the amino acid sequence <SEQ ID 6318>. Analysis of this protein sequence reveals the following:

```
Possible site: 50
>>> Seems to have no N-terminal signal sequence

----- Final Results -----
            bacterial cytoplasm --- Certainty = 0.3253(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below.

```
 Identities = 67/67 (100%), Positives = 67/67 (100%)
Query:   6 VIEIEGKVVETMPNAMFTVELENGHQILATVSGKIRKNYIRILVGDRVTVEMSPYDLTRG   65
           VIEIEGKVVETMPNAMFTVELENGHQILATVSGKIRKNYIRILVGDRVTVEMSPYDLTRG
Sbjct:   1 VIEIEGKVVETMPNAMFTVELENGHQILATVSGKIRKNYIRILVGDRVTVEMSPYDLTRG   60

Query:  66 RITYRFK   72
           RITYRFK
Sbjct:  61 RITYRFK   67
```

Based on this analysis, it was predicted that this protein and its epitopes, could be useful antigens for vaccines or diagnostics.

EXAMPLE 2046

A DNA sequence (GBSx2157) was identified in *S. agalactiae* <SEQ ID 6319> which encodes the amino acid sequence <SEQ ID 6320>. This protein is predicted to be adenylate kinase (adk). Analysis of this protein sequence reveals the following:

```
Possible site: 17
>>> Seems to have no N-terminal signal sequence

----- Final Results -----
             bacterial membrane --- Certainty = 0.0000(Not Clear)   < succ>
              bacterial outside --- Certainty = 0.0000(Not Clear)   < succ>
            bacterial cytoplasm --- Certainty = 0.0000(Not Clear)   < succ>
```

The protein has homology with the following sequences in the GENPEPT database.

```
>GP:CAA41940 GB:X59250 adenylate kinase [Lactococcus lactis]
 Identities = 146/214 (68%), Positives = 170/214 (79%), Gaps = 6/214 (2%)
  Query:    1 MNLLIMGLPGAGKGTQAAKIVEEFGVAHISTGDMFRAAMANQTEMGRLAKSYIDKGELVP    60
              MNLLIMGLPGAGKGTQA  IV+ +GV HISTGDMFRAAM N+TEMG+LAKS+IDKGELVP
  Sbjct:    1 MNLLIMGLPGAGKGTQAEFIVKNYGVNHISTGDMFRAAMKNETEMGKLAKSFIDKGELVP    60

Query:   61 DEVTNGIVKERLAEDDIAEKGFLLDGYPRTIEQAHALDATLEELGLRLDGVINIKVDPSC   120
              DEVTNGIVKERLA+DDI   GFLLDGYPRTI+QAHALD  LEELG++LD V+NI V+P+
  Sbjct:   61 DEVTNGIVKERLAQDDIKASGFLLDGYPRTIDQAHALDTMLEELGIKLDAVVNIVVNPNI   120

Query:  121 LIERLSGRIINRKTGETFHKVFNPPV------DYKEEDYYQREDDKPETVKRRLDVNIAQ   174
              L++RLSGR I R  G T+HK+FNP             D YQR DD PETVK RLDVNI +
  Sbjct:  121 LVDRLSGRYICRNCGATYHKIFNPTKVEGTCDVCGSHDLYQRADDVPETVKNRLDVNIKE   180

Query:  175 GEPILEHYRKLGLVTDIEGNQEITEVFADVEKAL                            208
              PI+EHY +LGLV +IEG QEI++V  D++K L
  Sbjct:  181 SAPIIEHYTELGLVKNIEGEQEISQVTDDIKKVL                            214
```

A related DNA sequence was identified in *S. pyogenes* <SEQ ID 6321> which encodes the amino acid sequence <SEQ ID 6322>. Analysis of this protein sequence reveals the following:

```
Possible site: 17
>>> Seems to have no N-terminal signal sequence

----- Final Results -----
           bacterial membrane --- Certainty = 0.0000(Not Clear) < succ>
             bacterial outside --- Certainty = 0.0000(Not Clear) < succ>
           bacterial cytoplasm --- Certainty = 0.0000(Not Clear) < succ>
```

An alignment of the GAS and GBS proteins is shown below.

```
 Identities = 208/212 (98%), Positives = 212/212 (99%)
  Query:    1 MNLLIMGLPGAGKGTQAAKIVEEFGVAHISTGDMFRAAMANQTEMGRLAKSYIDKGELVP    60
              MNLLIMGLPGAGKGTQAAKIVEEFG+AHISTGDMFRAAMANQTEMGRLAKSYIDKGELVP
  Sbjct:    1 MNLLIMGLPGAGKGTQAAKIVEEFGIAHISTGDMFRAAMANQTEMGRLAKSYIDKGELVP    60

Query:   61 DEVTNGIVKERLAEDDIAEKGFLLDGYPRTIEQAHALDATLEELGLRLDGVINIKVDPSC   120
              DEVTNGIVKERLAEDDIAEKGFLLDGYPRTIEQAHALDATLEELGLRLDGVINIKVDPSC
  Sbjct:   61 DEVTNGIVKERLAEDDIAEKGFLLDGYPRTIEQAHALDATLEELGLRLDGVINIKVDPSC   120

Query:  121 LIERLSGRIINRKTGETFHKVFNPPVDYKEEDYYQREDDKPETVKRRLDVNIAQGEPILE   180
              L+ERLSGRIINRKTGETFHKVFNPPVDYKEEDYYQREDDKPETVKRRLDVN+AQGEPILE
  Sbjct:  121 LVERLSGRIINRKTGETFHKVFNPPVDYKEEDYYQREDDKPETVKRRLDVNMAQGEPILE   180

Query:  181 HYRKLGLVTDIEGNQEITEVFADVEKALLELK                              212
              HYRKLGLVTDIEGNQEIT+VFADVEKALLELK
  Sbjct:  181 HYRKLGLVTDIEGNQEITDVFADVEKALLELK                              212
```

Based on this analysis, it was predicted that this protein and its epitopes, could be useful antigens for vaccines or diagnostics.

A related GBS gene <SEQ ID 8967> and protein <SEQ ID 8968> were also identified. Analysis of this protein sequence reveals the following:

```
Lipop: Possible site: -1  Crend: 0
McG: Discrim Score: -1.04
GvH: Signal Score (-7.5): -1.08
     Possible site: 17
>>> Seems to have no N-terminal signal sequence
ALOM program  count: 0 value: 6.79  threshold: 0.0
    PERIPHERAL  Likelihood =  6.79      106
 modified ALOM score: -1.86

*** Reasoning Step: 3

----- Final Results -----
                bacterial membrane --- Certainty = 0.0000(Not Clear) < succ>
                  bacterial outside --- Certainty = 0.0000(Not Clear) < succ>
                bacterial cytoplasm --- Certainty = 0.0000(Not Clear) < succ>
```

The protein has homology with the following sequences in the databases:

```
over 213aa
Lactococcus lactis
EGAD|8612| adenylate kinase Insert characterized
SP|P27143|KAD_LACLA ADENYLATE KINASE(EC 2.7.4.3)(ATP-AMP TRANSPHOSPHORYLASE).
Edit characterized
GP|44074|emb|CAA41940.1||X59250 adenylate kinase Insert characterized
PIR|S17987|S17987 adenylate kinase(EC 2.7.4.3)-subsp. lactis Insert
characterized
PIR|B44812|B44812 adenylate kinase EC 2.7.4.3)-Insert characterized ORF01658(301-924 of 1236)
EGAD|8612|8416(1-214 of 215)adenylate kinase{Lactococcus
lactis}SP|P27143|KAD_LACLA ADENYLATE KINASE(EC 2.7.4.3)(ATP-AMP
TRANSPHOSPHORYLASE). GP|44074|emb|CAA41940.1||X59250 adenylate kinase{Lactococcus
lactis}PIR|S17987|S17987 adenylate kinase(EC 2.7.4.3)-Lactococcus lactis subsp.
lactisPIR|B44812|B44812 adenylate kinase(EC 2.7.4.3)-Lactococcus lactis
% Match = 34.8
% Identity = 69.5   % Similarity = 81.0
Matches = 146   Mismatches = 38   Conservative Sub.s = 24

132        162        192        222        252        282        312        342
QAYSF*LQRVLKV*NNSRAIF*RDAMLDS*IQQNRI*VDSVNLLFCFLISPTCCVGFI*KQNKETIMNLLIMGLPGAGKG
                                                                 |||||||||||||||
                                                                 MNLLIMGLPGAGKG
                                                                      10
        372        402        432        462        492        522        552        582
TQAAKIVEEFGVAHISTGDMFRAAMANQTEMGRLAKSYIDKGELVPDEVTNGIVKERLAEDDIAEKGFLLDGYPRTIEQA
||| || :|| |||||||||| :|||| :|||| :||||||||||||||||||:||| ||||||||||||||:||
TQAEFIVKNYGVNHISTGDMFRAAMKNETEMGKLAKSFIDKGELVPDEVTNGIVKERLAQDDIKASGFLLDGYPRTIDQA
         30         40         50         60         70         80         90
        612        642        672        702        732                774        804
HALDATLEELGLRLDGVINIKVDPSCLIERLSXRIINRKTGETFHKVFNPP-----VDY-KEEDYYQREDDKPETVKRRL
||||   |||||::||  |:||  |:|:  |::|||  |  |   |:||:|||       |   | |||| || |||| ||
HALDTMLEELGIKLDAVVNIVVNPNILVDRLSGRYICRNCGATYHKIFNPTKVEGTCDVCGSHDLVQRADDVPETVKNRL
        110        120        130        140        150        160        170
        834        864        894        924        954        984       1014       1044
DVNIAQGEPILEHYRKLGLVTDIEGNQEITEVFADVEKALLELK*IMLIYLHK*ISNDILS*SDL*LLPLYRGHQIEI*G
|||| :  ||:||| :|||| :|||| |||||| ::|   |::| |
DVNIKESAPIIEHYTELGLVKNIEGEQEISQVTDDIKKVLG
            190        200        210
```

SEQ ID 8968 (GBS114) was expressed in *E. coli* as a His-fusion product. SDS-PAGE analysis of total cell extract is shown in FIG. 29 (lane 9; MW 26.9 kDa).

The GBS114-His fusion product was purified (FIG. 108A; see also FIG. 200, lane 8) and used to immunise mice (lane 1+2+3 product; 20 µg/mouse). The resulting antiserum was used for Western blot (FIG. 108B), FACS (FIG. 108C), and in the in vivo passive protection assay (Table III). These tests confirm that the protein is immunoaccessible on GBS bacteria and that it is an effective protective immunogen.

EXAMPLE 2047

A DNA sequence (GBSx2158) was identified in *S. agalactiae* <SEQ ID 6323> which encodes the amino acid sequence <SEQ ID 6324>. This protein is predicted to be preprotein translocase secy subunit (secY). Analysis of this protein sequence reveals the following:

```
Possible site: 35
>>> Seems to have an uncleavable N-term signal seq
    INTEGRAL   Likelihood = -14.01   Transmembrane   217-233   (209-240)
    INTEGRAL   Likelihood =  -8.65   Transmembrane   314-330   (307-334)
    INTEGRAL   Likelihood =  -6.16   Transmembrane   369-385   (363-392)
    INTEGRAL   Likelihood =  -5.36   Transmembrane    19-35     (17-40)
    INTEGRAL   Likelihood =  -3.93   Transmembrane   180-196   (179-199)
    INTEGRAL   Likelihood =  -3.03   Transmembrane   395-411   (392-412)
    INTEGRAL   Likelihood =  -2.55   Transmembrane   151-167   (151-168)
    INTEGRAL   Likelihood =  -2.02   Transmembrane   117-133   (117-133)
    INTEGRAL   Likelihood =  -0.64   Transmembrane   270-286   (269-286)

----- Final Results -----
         bacterial membrane  --- Certainty = 0.6604(Affirmative) < succ>
         bacterial outside   --- Certainty = 0.0000(Not Clear)   < succ>
         bacterial cytoplasm --- Certainty = 0.0000(Not Clear)   < succ>
```

A related GBS nucleic acid sequence <SEQ ID 9467> which encodes amino acid sequence <SEQ ID 9468> was also identified.

The protein has homology with the following sequences in the GENPEPT database.

```
>GP:CAA41939 GB:X59250 SecY protein [Lactococcus lactis]
 Identities = 292/433 (67%), Positives = 361/433 (82%), Gaps = 2/433 (0%)
Query:    1 MFLKLLRDALKVKMVRNKILFTIFILLVFRIGTHITVPGINVKSLEQMGELPFLNMLNLV   60
            MF K L++A KVK VR +ILFTIFIL VFR+G HIT PG+NV++L+Q+ +LPFL+M+NLV
Sbjct:    1 MFFKTLKEAFKVKDVRARILFTIFILFVFRLGAHITAPGVNVQNLQQVADLPFLSMMNLV   60

Query:   61 SGNAMRNFSVFSMGVSPYITASIVVQLLQMDILPKFVEWGKQGEVGRRKLNQATRYISLF  120
            SGNAM+N+S+F+MGVSPYITASI+VQLLQMDILPKFVEW KQGE+GRRKLNQATRYI+L
Sbjct:   61 SGNAMQNYSLFAMGVSPYITASIIVQLLQMDILPKFVEWSKQGEIGRRKLNQATRYITLV  120

Query:  121 LAFVQSIGITAGFNTLSSVALVKTPNVQTYLLIGAILTTGSMVVTWLGEQITDKGFGNGV  180
            LA  QSIGITAGF  +SS+ +V+ PN Q+YL+IG +LTTGSMVVTW+GEQI +KGFG+GV
Sbjct:  121 LAMAQSIGITAGFQAMSSLNIVQNPNWQSYLMIGVLLTTGSMVVTWMGEQINEKGFGSGV  180

Query:  181 SMIIFAGIISSIPSAITTIYEDFFVNVRSSAITNSYIFVGILIVAVLAIVFFTTFIQQAE  240
            S+IIFAGI+S IPSAI ++Y++ F+NVR S I  S+IFV  LI++ + I++ TTF+QQAE
Sbjct:  181 SVIIFAGIVSGIPSAIKSVYDEKFLNVRPSEIPMSWIFVIGLILSAIVIIYVTTFVQQAE  240

Query:  241 YKIPIQYTKLVQGAPTSSYLPLKVNPAGVIPVIFASSITTIPSTIIPFFQ--NGKEIPWL  298
             K+PIQYTKL QGAPTSSYLPL+VNPAGVIPVIFA SITT P+TI+  F Q    +  WL
Sbjct:  241 RKVPIQYTKLTQGAPTSSYLPLRVNPAGVIPVIFAGSITTAPATILQFLQRSQGSNVGWL  300

Query:  299 TKLQELLNYQTPVGMIIYAILIILFSFFYTFVQVNPEKTAENLQKNSSYIPSIRPGRETE  358
            + LQ  L+Y T  GM+ YA+LI+LF+FFY+FVQVNPEK AENLQK  SYIPS+RPG+ TE
Sbjct:  301 STLQNALSYTTWTGMLFYALLIVLFTFFYSFVQVNPEKMAENLQKQGSYIPSVRPGKGTE  360

Query:  359 EYMSSLLKKLATIGSVFLAFISLLPIIAQQALHLSSSIALGGTSLLILIATGIEGMKQLE  418
            +Y+S LL +LAT+GS+FL  IS++PI AQ    L  +ALGGTSLLILI  I+ +KQLE
Sbjct:  361 KYVSRLLMRLATVGSLFLGLISIIPIAAQNVWGLPKIVALGGTSLLILIQVAIQAVKQLE  420

Query:  419 GYLLKRRYVGFMN                                                431
            GYLLKR+Y GFM+
Sbjct:  421 GYLLKRKYAGFMD                                                433
```

A related DNA sequence was identified in *S. pyogenes* <SEQ ID 3987> which encodes the amino acid sequence <SEQ ID 3988>. Analysis of this protein sequence reveals the following:

```
Possible site: 55
>>> Seems to have an uncleavable N-term signal seq
    INTEGRAL    Likelihood = -14.70    Transmembrane    233-249    (226-255)
    INTEGRAL    Likelihood =  -8.12    Transmembrane    330-346    (323-350)
    INTEGRAL    Likelihood =  -6.10    Transmembrane    384-400    (378-403)
    INTEGRAL    Likelihood =  -5.20    Transmembrane     35-51      (33-56)
    INTEGRAL    Likelihood =  -4.09    Transmembrane    199-215    (195-215)
    INTEGRAL    Likelihood =  -3.56    Transmembrane    167-183    (165-184)
    INTEGRAL    Likelihood =  -1.65    Transmembrane    411-427    (411-428)
    INTEGRAL    Likelihood =  -1.49    Transmembrane    133-149    (133-149)
    INTEGRAL    Likelihood =  -0.64    Transmembrane    286-302    (285-302)

----- Final Results -----
            bacterial membrane  --- Certainty = 0.6880(Affirmative) < succ>
             bacterial outside  --- Certainty = 0.0000(Not Clear)   < succ>
           bacterial cytoplasm  --- Certainty = 0.0000(Not Clear)   < succ>
```

An alignment of the GAS and GBS proteins is shown below.

```
 Identities = 377/434 (86%), Positives = 417/434 (95%)
Query:    1 MFLKLLRDALKVKMVRNKILFTIFILLVFRIGTHITVPGINVKSLEQMGELPFLNMLNLV   60
            MFLK+L+DALK+K VRNKI FTIFI+LVFRIGTHITVPG+N KSLEQ+ ELPFLNMLNLV
Sbjct:   17 MFLKILKDALKIKTVRNKIFFTIFIILVFRIGTHITVPGVNAKSLEQLSELPFLNMLNLV   76

Query:   61 SGNAMRNFSVFSMGVSPYITASIVVQLLQMDILPKFVEWGKQGEVGRRKLNQATRYISLF  120
            SGNAMRNFSVFSMGVSPYITASIVVQLLQMDILPKFVEWGKQGEVGRRKLNQATRYISL
Sbjct:   77 SGNAMRNFSVFSMGVSPYITASIVVQLLQMDILPKFVEWGKQGEVGRRKLNQATRYISLV  136

Query:  121 LAFVQSIGITAGFNTLSSVALVKTPNVQTYLLIGAILTTGSMVVTWLGEQITDKGFGNGV  180
            LAF QSIGITAGFNTLS+VALVKTP+++TYLLIGA+LTTGS++VTWLGEQITDKGFGNGV
Sbjct:  137 LAFAQSIGITAGFNTLSNVALVKTPDIKTYLLIGALLTGSVIVTWLGEQITDKGFGNGV  196

Query:  181 SMIIFAGIISSIPSAITTIYEDFFVNVRSSAITNSYIFVGILIVAVLAIVFFTTFIQQAE  240
            SMIIFAGIISSIPSAI TI ED+FVNV++ +  +SY+  VGILI+AVLAIVFFTT++QQAE
Sbjct:  197 SMIIFAGIISSIPSAIATIREDYFVNVKASDLHSSYLIVGILIIAVLAIVFFTTYVQQAE  256
```

```
                         -continued
Query:  241 YKIPIQYTKLVQGAPTSSYLPLKVNPAGVIPVIFASSITTIPSTIIPFFQNGKEIPWLTK  300
            YKIPIQYTKL+QGAPTSSYLPLKVNPAGVIPVIFASSITTIPSTIIPF QNG+++PWL +
Sbjct:  257 YKIPIQYTKLMQGAPTSSYLPLKVNPAGVIPVIFASSITTIPSTIIPFVQNGRDLPWLNR  316

Query:  301 LQELLNYQTPVGMIIYAILIILFSFFYTFVQVNPEKTAENLQKNSSYIPSIRPGRETEEY  360
            LQE+ NYQTPVGMI+YA+LIILFSFFYTFVQVNPEKTAENLQKNSSYIPS+RPGRETE++
Sbjct:  317 LQEIFNYQTPVGMIVYALLIILFSFFYTFVQVNPEKTAENLQKNSSYIPSVRPGRETEQF  376

Query:  361 MSSLLKKLATIGSVFLAFISLLPIIAQQALHLSSSIALGGTSLLILIATGIEGMKQLEGY  420
            MS+LLKKLAT+G++FLAFISL PI AQQAL+LSSSIALGGTSLLILI+TGIEGMKQLEGY
Sbjct:  377 MSALLKKLATVGAIFLAFISLAPIAAQQALNLSSSIALGGTSLLILISTGIEGMKQLEGY  436

Query:  421 LLKRRYVGFMNTTE                                               434
            LLKR+YVGFMNT E
Sbjct:  437 LLKRKYVGFMNTAE                                               450
```

A related GBS gene <SEQ ID 8969> and protein <SEQ ID 8970> were also identified. Analysis of this protein sequence reveals the following:

```
Lipop: Possible site: -1  Crend: 10
McG: Discrim Score: 6.16
GvH: Signal Score (-7.5): -4.32
     Possible site: 35
>>> Seems to have an uncleavable N-term signal seq
ALOM program   count: 9 value: -14.01 threshold: 0.0
     INTEGRAL     Likelihood = -14.01    Transmembrane   217-233   (209-240)
     INTEGRAL     Likelihood =  -9.98    Transmembrane   311-327   (307-334)
     INTEGRAL     Likelihood =  -6.16    Transmembrane   369-385   (363-392)
     INTEGRAL     Likelihood =  -5.36    Transmembrane    19-35     (17-40)
     INTEGRAL     Likelihood =  -3.93    Transmembrane   180-196   (179-199)
     INTEGRAL     Likelihood =  -3.03    Transmembrane   395-411   (392-412)
     INTEGRAL     Likelihood =  -2.55    Transmembrane   151-167   (151-168)
     INTEGRAL     Likelihood =  -2.02    Transmembrane   117-133   (117-133)
     INTEGRAL     Likelihood =  -0.64    Transmembrane   270-286   (269-286)
     PERIPHERAL   Likelihood =   0.95    69
 modified ALOM score: 3.30

*** Reasoning Step: 3

----- Final Results -----
            bacterial membrane --- Certainty = 0.6604(Affirmative) < succ>
              bacterial outside --- Certainty = 0.0000(Not Clear)  < succ>
            bacterial cytoplasm --- Certainty = 0.0000(Not Clear)  < succ>
```

The protein has homology with the following sequences in the databases:

```
ORF01657(301-1596 of 1902)
EGAD|6545|6344(1 - 434 of 439)preprotein translocase secy subunit{Lactococcus
lactis} SP|P27148|SECY_LACLA PREPROTEIN TRANSLOCASE SECY SUBUNIT.
GP|44073|emb|CAA41939.1||X59250 SecY protein{Lactococcus lactis}PIR|S17985|S17985
preprotein translocase secY-Lactococcus lactis subsp. lactis
% Match = 46.6
% Identity = 67.0  % Similarity = 84.1
Matches = 290  Mismatches = 68  Convservative Sub.s = 74

72       102       132       162       192       222       252       282
HQCKRICSCEP*PIKCL*RWY*SNSSCS*RSWNRAC*KIRR*NSW*W*IN*EIVC*SS*IF*IC*SSYHC*RWFNRSHLI 312       342       372       402       432       462       492       522
NER*LIMFLKLLRDALKVKMVRNKILFTIFILLVFRIGTHITVPGINVKSLEQMGELPFLNMLNLVSGNAMRNFSVFSMG
      ||:|  |  |::|:|||  ||| |||:||:|: |||||:||||||||||||:|:|:|||
        MFFKTLKEAFKVKDVRARILFTIFILFVFRLGAHITAPGVNVQNLQQVADLPFLSMMNLVSGNAMQNYSLFAMG
              10        20        30        40        50        60        70

552       582       612       642       672       702       732       762
VSPYITASIVVQLLQMDILPKFVEWGKQGEVGRRKLNQATRYISLFLAFVQSIGITAGFNTLSSVALVKTPNVQTYLLIG
||||||||:||||||||||||||||:|||:||||||||||||:|:||:||||||||||:  |:| ||:||:|||||:||
VSPYITASIIVQLLQMDILPKFVEWSKQGEIGRRKLNQATRYITLVLAMAQSIGITAGFQAMSSLNIVQNPNWQSYLMIG
              90       100       110       120       130       140       150

792       822       852       882       912       942       972      1002
AILTTGSMVVTWLGEQITDKGFGNGVSMIIFAGIISSIPSAITTIYEDFFVNVRSSAITNSYIFVGILIVAVLAIVFFTT
:||||||||||||:|||| :|||:||| ||||||:|||||| |:| ||:| |||| |  ||:|| |||:|::|||:| ||
VLLTTGSMVVTWMGEQINEKGFGSGVSVIIFAGIVSGIPSAIKSVYDEKFLNVRPSEIPMSWIFVIGLILSAIVIIYVTT
             170       180       190       200       210       220       230
```

```
     1032       1062      1092      1122      1152      1176      1206      1236
FIQQAEYKIPIQYTKLVQGAPTSSYLPLKVNPAGVIPVIFASSITTIPSTIIPFFQ--NGKEIPWLTKLQELLNYQTPVG
|:||||  |:||||||| ||||||||||||:|||||||||| |||| |:|||  |:|  :  ||:  ||   |:|   |
FVQQAERKVPIQYTKLTQGAPTSSYLPLRVNPAGVIPVIFAGSITTAPATILQFLQRSQGSNVGWLSTLQNALSYTTWTG
           250       260       270       280       290       300       310
     1266       1296      1326      1356      1386      1416      1446      1476
MIIYAILIILFSFFXTFXQVNPEKTAENLQKNSSYIPSIRPGRETEEYMSSLLKKLATIGSVFLAFISLLPIIAQQALHL
|:  ||:||:||  :  |||||| |||||  :|  |||||:|||:   |||:|||  |||:||||  ||::||   |  |
MLFYALLIVLFTFFYSFVQVNPEKMAENLQKQGSYIPSVRPGKGTEKYVSRLLMRLATVGSLFLGLISIIPIAAQNVWGL
           330       340       350       360       370       380       390
     1506       1536      1566      1596      1626      1656      1686      1716
SSSIALGGTSLLILIATGIEGMKQLEGYLLKRRYVGFMNTTE*NIG*LCQPSILFFNKSDMLCWIYLKTK*GDYNESFNY
   :||||||||||||    |: :||||||||||:|   |||:
PKIVALGGTSLLILIQVAIQAVKQLEGYLLKRKYAGFMDNPLETK
             410       420       430
```

Based on this analysis, it was predicted that these proteins and their epitopes could be useful antigens for vaccines or diagnostics.

EXAMPLE 2048

A DNA sequence (GBSx2159) was identified in *S. agalactiae* <SEQ ID 6325> which encodes the amino acid sequence <SEQ ID 6326>. This protein is predicted to be 50S ribosomal protein L15 (rplO). Analysis of this protein sequence reveals the following:

```
Possible site: 59
>>> Seems to have no N-terminal signal sequence

----- Final Results -----
           bacterial cytoplasm --- Certainty = 0.5259(Affirmative) < succ>
            bacterial membrane --- Certainty = 0.0000(Not Clear)   < succ>
             bacterial outside --- Certainty = 0.0000(Not Clear)   < succ>
```

The protein has homology with the following sequences in the GENPEPT database.

```
>GP:AAB54021 GB:U96620 ribosomal protein L15 [Staphylococcus aureus]
  Identities = 116/146 (79%), Positives = 128/146 (87%)
Query:    1 MKLHELKPAEGSRKVRNRVGRGTSSGNGKTSGRGQKGQKARSGGGVRLGFEGGQTPLFRR     60
            MKLHELKPAEGSRK RNRVGRG ++GNGKTSGRG KGQKARSGGGVR GFEGGQ PLFRR
Sbjct:    1 MKLHELKPAEGSRKERNRVGRGVATGNGKTSGRGHKGQKARSGGGVRPGFEGGQLPLFRR     60

Query:   61 MPKRGFSNINAKEYALVNLDQLNVFEDGTEVTPVVLKEAGIVRAEKSGVKILGNGELTKK    120
            +PKRGF+NIN KEYA+VNLDQLN FEDGTEVTP +L E+G+V+ EKSG+KILGNG L KK
Sbjct:   61 LPKRGFTNINRKEYAIVNLDQLNKFEDGTEVTPALLVESGVVKNEKSGIKILGNGSLDKK    120

Query:  121 LSVKAAKFSKSAEAAITAKGGSIEVI                                    146
            L+VKA KFS SA  AI AKGG+ EVI
Sbjct:  121 LTVKAHKFSASAAEAIDAKGGAHEVI                                    146
```

A related DNA sequence was identified in *S. pyogenes* <SEQ ID 6327> which encodes the amino acid sequence <SEQ ID 6328>. Analysis of this protein sequence reveals the following:

```
Possible site: 59
>>> Seems to have no N-terminal signal sequence

----- Final Results -----
           bacterial cytoplasm --- Certainty = 0.5329(Affirmative) < succ>
            bacterial membrane --- Certainty = 0.0000(Not Clear)   < succ>
             bacterial outside --- Certainty = 0.0000(Not Clear)   < succ>
```

An alignment of the GAS and GBS proteins is shown below.

```
Identities = 135/146 (92%), Positives = 142/146 (96%)
Query:   1 MKLHELKPAEGSRKVRNRVGRGTSSGNGKTSGRGQKGQKARSGGGVRLGFEGGQTPLFRR   60
           MKLHELK AEGSRKVRNRVGRGTSSGNGKTSGRGQKGQKARSGGGVRLGFEGGQTPLFRR
Sbjct:   1 MKLHELKAAEGSRKVRNRVGRGTSSGNGKTSGRGQKGQKARSGGGVRLGFEGGQTPLFRR   60

Query:  61 MPKRGFSNINAKEYALVNLDQLNVFEDGTEVTPVVLKEAGIVRAEKSGVKILGNGELTKK  120
           +PKRGF+NIN KEYALVNLDQLNVF+DGTEVTP +LK+AGIVRAEKSGVK+LGNGELTKK
Sbjct:  61 IPKRGFTNINTKEYALVNLDQLNVFDDGTEVTPAILKDAGIVRAEKSGVKVLGNGELTKK  120

Query: 121 LSVRAAKFSKSAEAAITAKGGSIEVI                                   146
           L+V KAAKFSKSAEAAI AKGGSIEVI
Sbjct: 121 LTVKAAKFSKSAEAAIIAKGGSIEVI                                   146
```

Based on this analysis, it was predicted that this protein and its epitopes, could be useful antigens for vaccines or diagnostics.

EXAMPLE 2049

A DNA sequence (GBSx2160) was identified in *S. agalactiae* <SEQ ID 6329> which encodes the amino acid sequence <SEQ ID 6330>. Analysis of this protein sequence reveals the following:

```
Possible site: 53
>>> Seems to have no N-terminal signal sequence

----- Final Results -----
         bacterial cytoplasm --- Certainty = 0.1162(Affirmative) < succ>
          bacterial membrane --- Certainty = 0.0000(Not Clear)   < succ>
           bacterial outside --- Certainty = 0.0000(Not Clear)   < succ>
```

The protein has homology with the following sequences in the GENPEPT database.

```
>GP:AAB54020 GB:U96620 ribosomal protein L30 [Staphylococcus aureus]
 Identities = 40/58 (68%), Positives = 46/58 (78%)
Query: 1 MAQIKITLTKSPIGRKPEQRKTVVALGLGKLNSSVVKEDNAAIRGMVNAISHLVTVEE    58
         MA+++ITLT+S IGR   QRKTV ALGL K NSSVV EDN AIRG +N + HLVTVEE
Sbjct: 1 MAKLQITLTRSVIGRPETQRKTVEALGLKKTNSSVVVEDNPAIRGQINKVKHLVTVEE   58
```

A related DNA sequence was identified in *S. pyogenes* <SEQ ID 6331> which encodes the amino acid sequence <SEQ ID 6332>. Analysis of this protein sequence reveals the following:

```
Possible site: 53
>>> Seems to have no N-terminal signal sequence

----- Final Results -----
         bacterial cytoplasm --- Certainty = 0.1088(Affirmative) < succ>
          bacterial membrane --- Certainty = 0.0000(Not Clear)   < succ>
           bacterial outside --- Certainty = 0.0000(Not Clear)   < suc>
```

An alignment of the GAS and GBS proteins is shown below.

```
 Identities = 56/58 (96%), Positives = 57/58 (97%)

Query: 1 MAQIKITLTKSPIGRKPEQRKTVVALGLGKLNSSVVKEDNAAIRGMVNAISHLVTVEE   58
         MAQIKITLTKSPIGRKPEQRKTVVALGLGKLNSSVVKEDNAAIRGMV AISHLVTVE+
Sbjct: 1 MAQIKITLTKSPIGRKPEQRKTVVALGLGKLNSSVVKEDNAAIRGMVTAISHLVTVED   58
```

Based on this analysis, it was predicted that this protein and its epitopes, could be useful antigens for vaccines or diagnostics.

EXAMPLE 2050

A DNA sequence (GBSx2161) was identified in *S. agalactiae* <SEQ ID 6333> which encodes the amino acid sequence <SEQ ID 6334>. Analysis of this protein sequence reveals the following:

```
Possible site: 36
>>> Seems to have no N-terminal signal sequence

---- Final Results -----
           bacterial cytoplasm --- Certainty = 0.3226(Affirmative) < succ>
           bacterial membrane  --- Certainty = 0.0000(Not Clear)   < succ>
             bacterial outside --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 2051

A DNA sequence (GBSx2162) was identified in *S. agalactiae* <SEQ ID 6335> which encodes the amino acid sequence <SEQ ID 6336>. This protein is predicted to be 30S ribosomal protein S5 (rpsE). Analysis of this protein sequence reveals the following:

```
Possible site: 26
>>> Seems to have no N-terminal signal sequence

----- Final Results -----
            bacterial cytoplasm --- Certainty = 0.3179(Affirmative) < succ>
            bacterial membrane  --- Certainty = 0.0000(Not Clear)   < succ>
              bacterial outside --- Certainty = 0.0000(Not Clear)   < succ>
```

The protein has homology with the following sequences in the GENPEPT database.

```
>GP:AAA22699 GB:M57621 ribosomal protein S5 [Bacillus stearothermophilus]
 Identities = 119/158 (75%), Positives = 139/158 (87%)

Query:    6 NAVELEERVVAINRVTKVVKGGRRLRFAALVVVGDRNGRVGFGTGKAQEVPEAIRKAVEA   65
            N +ELEERVVA+NRV KVVKGGRRLRF+ALVVVGD+NG VGFGTGKAQEVPEAIRKA+E
Sbjct:    7 NKLELEERVVAVNRVAKVVKGGRRLRFSALVVVGDKNGHVGFGTGKAQEVPEAIRKAIED   66

Query:   66 AKKNMVEVPMVGTTIPHEVRSEFGGAKVLLKPAVEGAGVAAGGAVRAVIELAGVADITSK  125
            AKKN++EVP+VGTTIPHEV   FG  +++LKPA EG GV AGG  RAV+ELAG++DI SK
Sbjct:   67 AKKNLIEVPIVGTTIPHEVIGHFGAGEIILKPASEGTGVIAGGPARAVLELAGISDILSK  126

Query:  126 SLGSNTPINIVRATVEGLKQLKRAEEVAALRGISVSDL                       163
            S+GSNTPIN+VRAT +GLKQLKRAE+VA LRG +V +L
Sbjct:  127 SIGSNTPINMVRATFDGLKQLKRAEDVAKLRGKTVEEL                       164
```

A related DNA sequence was identified in *S. pyogenes* <SEQ ID 6337> which encodes the amino acid sequence <SEQ ID 6338>. Analysis of this protein sequence reveals the following:

```
Possible site: 26
>>> Seems to have no N-terminal siqnal sequence

----- Final Results -----
            bacterial cytoplasm --- Certainty = 0.3179(Affirmative) < succ>
            bacterial membrane  --- Certainty = 0.0000(Not Clear)   < succ>
              bacterial outside --- Certainty = 0.0000(Not Clear)   < succ>
```

An alignment of the GAS and GBS proteins is shown below.

```
Identities = 158/164 (96%), Positives = 161/164 (97%)
Query:    1 MAFKDNAVELEERVVAINRVTKVVKGGRRLRFAALVVVGDRNGRVGFGTGKAQEVPEAIR   60
            MAFKDNAVELEERVVAINRVTKVVKGGRRLRFAALVVVGD NGRVGFGTGKAQEVPEAIR
Sbjct:    1 MAFKDNAVELEERVVAINRVTKVVKGGRRLRFAALVVVGDGNGRVGFGTGKAQEVPEAIR   60
```

```
Query:   61 KAVEAAKKNMVEVPMVGTTIPHEVRSEFGGAKVLLKPAVEGAGVAAGGAVRAVIELAGVA    120
            KAVEAAKKNM+EVPMVGTTIPHEV + FGGAKVLLKPAVEG+GVAAGGAVRAVIELAGVA
Sbjct:   61 KAVEAAKKNMIEVPMVGTTIPHEVYTNFGGAKVLLKPAVEGSGVAAGGAVRAVIELAGVA    120

Query:  121 DITSKSLGSNTPINIVRATVEGLKQLKRAEEVAALRGISVSDLA                   164
            DITSKSLGSNTPINIVRATVEGLKQLKRAEEVAALRGISVSDLA
Sbjct:  121 DITSKSLGSNTPINIVRATVEGLKQLKRAEEVAALRGISVSDLA                   164
```

Based on this analysis, it was predicted that this protein and its epitopes, could be useful antigens for vaccines or diagnostics.

EXAMPLE 2052

A DNA sequence (GBSx2163) was identified in *S. agalactiae* <SEQ ID 6339> which encodes the amino acid sequence <SEQ ID 6340>. This protein is predicted to be 50S ribosomal protein L18 (rplR). Analysis of this protein sequence reveals the following:

```
Possible site: 61
>>> Seems to have no N-terminal signal sequence

----- Final Results -----
            bacterial cytoplasm --- Certainty = 0.4488(Affirmative) < succ>
             bacterial membrane --- Certainty = 0.0000(Not Clear)   < succ>
              bacterial outside --- Certainty = 0.0000(Not Clear)   < succ>
```

A related GBS nucleic acid sequence <SEQ ID 9465> which encodes amino acid sequence <SEQ ID 9466> was also identified.

The protein has homology with the following sequences in the GENPEPT database.

```
>GP:AAB06815 GB:L47971 ribosomal protein L18 [Bacillus subtilis]
 Identities = 86/120 (71%), Positives = 97/120 (80%), Gaps = 2/120 (1%)

Query:    4 VISKPDKNKIRQKRHRRVRGKLSGTADRPRLNIFRSNTGIYAQVIDDVAGVTLASASTLD    63
            +I+K  KN  R KRH RVR KLSGTA+RPRLN+FRSN  IYAQ+IDDV GVTLASASTLD
Sbjct:    1 MITKTSKNAARLKRHARVRAKLSGTAERPRLNVFRSNKHIYAQIIDDVNGVTLASASTLD    60

Query:   64 KE--VSNGTKTEQAVVVGKLVAERAVAKGISEVVFDRGGYLYHGRVKALADSARENGLKF   121
            K+  V +  T A  VG+LVA+RA  KGIS+VVFDRGGYLYHGRVKALAD+ARE GLKF
Sbjct:   61 KDLNVESTGDTSAATKVGELVAKRAAEKGISDVVFDRGGYLYHGRVKALADAAREAGLKF   120
```

A related DNA sequence was identified in *S. pyogenes* <SEQ ID 6341> which encodes the amino acid sequence <SEQ ID 6342>. Analysis of this protein sequence reveals the following:

```
Possible site: 61
>>> Seems to have no N-terminal signal sequence

----- Final Results -----
            bacterial cytoplasm --- Certainty = 0.4488(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below.

```
 Identities = 116/121 (95%), Positives = 120/121 (98%)

Query:    1 MKIVISKPDKNKIRQKRHRRVRGKLSGTADRPRLNIFRSNTGIYAQVIDDVAGVTLASAS    60
            +KIVISKPDKNKIRQKRHRRVRGKLSGTADRPRLN+FRSNTGIYAQVIDDVAGVTLASAS
Sbjct:    1 VKIVISKPDKNKIRQKRHRRVRGKLSGTADRPRLNVFRSNTGIYAQVIDDVAGVTLASAS    60
```

```
                            -continued
Query:  61 TLDKEVSNGTKTEQAVVVGKLVAERAVAKGISEVVFDRGGYLYHGRVKALADSARENGLKF  121
           TLDK+VS GTKTEQAVVVGKLVAERAVAKGISEVVFDRGGYLYHGRVKALAD+ARENGLKF
Sbjct:  61 TLDKDVSKGTKTEQAVVVGKLVAERAVAKGISEVVFDRGGYLYHGRVKALADAARENGLKF  121
```

Based on this analysis, it was predicted that this protein and its epitopes, could be useful antigens for vaccines or diagnostics.

EXAMPLE 2053

A DNA sequence (GBSx2164) was identified in *S. agalactiae* <SEQ ID 6343> which encodes the amino acid sequence <SEQ ID 6344>. Analysis of this protein sequence reveals the following:

```
Possible site: 53
>>> Seems to have no N-terminal signal sequence

----- Final Results -----
            bacterial cytoplasm --- Certainty = 0.1530(Affirmative) < succ>
             bacterial membrane --- Certainty = 0.0000(Not Clear)   < succ>
              bacterial outside --- Certainty = 0.0000(Not Clear)   < succ>
```

The protein has homology with the following sequences in the GENPEPT database.

```
>GP: AAA22700 GB: M57622 ribosomal protein L6 [Bacillus
stearothermophilus]
Identities = 108/178 (60%), Positives = 133/178 (74%)

Query:    1 MSRIGNKVITLPAGVEIINKDNVVTVKGPKGQLTREFNKNIGITVEGTEVTVTRPNDSKE   60
            M R+G K I +PAGV +    N VTVKGPKG+LTR F+ ++ ITVEG  +TVTRP+D K
Sbjct:    1 MXRVGKKPIEIPAGVTVTVNGNTVTVKGPKGELTRTFHPDMTITVEGNVITVTRPSDEKH   60

Query:   61 MKTIHGTTRANLNNMVVGVSEGFKKALEMRGVGYRAQLQGSKLVLSVGKSHQDEVEAPEG  120
            + +HGTTR+ L NMV GVS+G++KALE+ GVGYRA  QG KLVLSVG SH  E+E  EG
Sbjct:   61 HRALHGTTRSLLANMVEGVSKGYEKALELVGVGYRASKQGKKLVLSVGYSHPVEIEPEEG  120

Query:  121 VTFEVPTPTTINVIGINKESVGQTAAYVRSLRSPEPYKGKGIRYVGEFVRRKEGKTGK   178
             +  EVP+ T I V G +K+ VG+ AA +R++R PEPYKGKGIRY GE VR KEGKTGK
Sbjct:  121 LEIEVPSQTKIIVKGADKQRVGELAANIRAVRPPEPYKGKGIRYEGELVRLKEGKTGK   178
```

A related DNA sequence was identified in *S. pyogenes* <SEQ ID 6345> which encodes the amino acid sequence <SEQ ID 6346>. Analysis of this protein sequence reveals the following:

```
Possible site: 17
>>> Seems to have no N-terminal signal sequence

----- Final Results -----
            bacterial cytoplasm --- Certainty = 0.1704(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below.

```
Identities = 153/178 (85%), Positives = 166/178 (92%)

Query:    1 MSRIGNKVITLPAGVEIINKDNVVTVKGPKGQLTREFNKNIGITVEGTEVTVTRPNDSKE   60
            MSRIGNKVIT+PAGVE+ N +NV+TVKGPKG+LTREFNKNI I VEGTE+TV RPNDSKE
Sbjct:    1 MSRIGNKVITMPAGVELTNNNNVITVKGPKGELTREFNKNIEIKVEGTEITVVRPNDSKE   60

Query:   61 MKTIHGTTRANLNNMVVGVSEGFKKALEMRGVGYRAQLQGSKLVLSVGKSHQDEVEAPEG  120
            MKTIHGTTRANLNNMVVGVSEGFKK LEM+GVGYRAQLQG+KLVLSVGKSHQDEVEAPEG
Sbjct:   61 MKTIHGTTRANLNNMVVGVSEGFKKDLEMKGVGYRAQLQGTKLVLSVGKSHQDEVEAPEG  120

Query:  121 VTFEVPTPTTINVIGINKESVGQTAAYVRSLRSPEPYKGKGIRYVGEFVRRKEGKTGK   178
```

```
          +TF V   PT+I+V GINKE VGQTAAY+RSLRSPEPYKGKGIRYVGE+VR KEGKTGK
Sbjct: 121 ITFTVANPTSISVEGINKEVVGQTAAYIRSLRSPEPYKGKGIRYVGEYVRLKEGKTGK    178
```

Based on this analysis, it was predicted that this protein and its epitopes, could be useful antigens for vaccines or diagnostics.

EXAMPLE 2054

A DNA sequence (GBSx2165) was identified in *S. agalactiae* <SEQ ID 6347> which encodes the amino acid sequence <SEQ ID 6348>. This protein is predicted to be 30S ribosomal protein S8 (rpsH). Analysis of this protein sequence reveals the following:

```
Possible site: 19
>>> Seems to have no N-terminal signal sequence

----- Final Results -----
            bacterial cytoplasm --- Certainty = 0.4356(Affirmative) < succ>
             bacterial membrane --- Certainty = 0.0000(Not Clear)   < succ>
              bacterial outside --- Certainty = 0.0000(Not Clear)   < succ>
```

The protein has homology with the following sequences in the GENPEPT database.

```
>GP: AAB06813 GB: L47971 ribosomal protein S8 [Bacillus subtilis]
Identities = 100/132 (75%), Positives = 116/132 (87%)

Query:   1 MVMTDPIADFLTRIRNANQAKHEVLEVPASNIKKGIADILKREGFVKNVEVIEDDKQGII   60
           MVMTDPIAD LTRIRNAN +HE LE+PAS +K+ IA+ILKREGF+++VE +ED KQGII
Sbjct:   1 MVMTDPIADMLTRIRNANMVRHEKLEIPASKLKREIAEILKREGFIRDVEFVEDSKQGII   60

Query:  61 RVFLKYGQNGERVITNLKRISKPGLRVYTKHEDMPKVLNGLGIAIVSTSEGLLTDKEARQ  120
           RVFLKYGQN ERVIT LKRISKPGLRVY K  ++P+VLNGLGIAI+STS +G+LTDKEAR
Sbjct:  61 RVFLKYGQNNERVITGLKRISKPGLRVYAKSNEVPRVLNGLGIAIISTSQGVLTDKEARA  120

Query: 121 KNIGGEVLAYIW                                                 132
           K  GGEVLAY+W
Sbjct: 121 KQAGGEVLAYVW                                                 132
```

A related DNA sequence was identified in *S. pyogenes* <SEQ ID 6349> which encodes the amino acid sequence <SEQ ID 6350>. Analysis of this protein sequence reveals the following:

```
Possible site: 19
>>> Seems to have no N-terminal signal sequence

----- Final Results -----
            bacterial cytoplasm --- Certainty = 0.4327(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below.

```
Identities = 122/132 (92%), Positives = 129/132 (97%)

Query:   1 MVMTDPIADFLTRIRNANQAKHEVLEVPASNIKKGIADILKREGFVKNVEVIEDDKQGII   60
           MVMTDPIADFLTRIRNANQ KHEVLEVPASNIKKGIA+ILKREGFVKNVEVIEDDKQGII
Sbjct:   1 MVMTDPIADFLTRIRNANQVKHEVLEVPASNIKKGIAEILKREGFVKNVEVIEDDKQGII   60

Query:  61 RVFLKYGQNGERVITNLKRISKPGLRVYTKHEDMPKVLNGLGIAIVSTSEGLLTDKEARQ  120
           RVFLKYG+NGERVITNLKRISKPGLRVY K +DMPKVLNGLGIAI+STSEGLLTDKEARQ
Sbjct:  61 RVFLKYGKNGERVITNLKRISKPGLRVYAKRDDMPKVLNGLGIAIISTSEGLLTDKEARQ  120

Query: 121 KNIGGEVLAYIW                                                 132
           KN+GGEV+AY+W
Sbjct: 121 KNVGGEVIAYVW                                                 132
```

Based on this analysis, it was predicted that this protein and its epitopes, could be useful antigens for vaccines or diagnostics.

EXAMPLE 2055

A DNA sequence (GBSx2166) was identified in *S. agalactiae* <SEQ ID 6351> which encodes the amino acid sequence <SEQ ID 6352>. This protein is predicted to be ribosomal protein S14 (rpsN). Analysis of this protein sequence reveals the following:

```
Possible site: 59
>>> Seems to have no N-terminal signal sequence

----- Final Results -----
            bacterial cytoplasm --- Certainty = 0.3833(Affirmative) < succ>
             bacterial membrane --- Certainty = 0.0000(Not Clear)   < succ>
              bacterial outside --- Certainty = 0.0000(Not Clear)   < succ>
```

The protein has homology with the following sequences in the GENPEPT database.

```
>GP: CAB11905 GB: Z99104 ribosomal protein S14 [Bacillus subtilis]
Identities = 47/61 (77%), Positives = 53/61 (86%)

Query:   1 MAKKSMIAKNKRPAKFSTQAYTRCEKCGRPHSVYRKFQLCRVCFRDLAYKGQVPGVTKAS   60
           MAKKSMIAK +R  KF  Q YTRCE+CGRPHSV RKF+LCR+CFR+LAYKGQ+PGV KAS
Sbjct:   1 MAKKSMIAKQQRTPKFKVQEYTRCERCGRPHSVIRKFKLCRICFRELAYKGQIPGVKKAS   60

Query:  61 W                                                              61
           W
Sbjct:  61 W                                                              61
```

A related DNA sequence was identified in *S. pyogenes* <SEQ ID 6353> which encodes the amino acid sequence <SEQ ID 6354>. Analysis of this protein sequence reveals the following:

```
Possible site: 59
>>> Seems to have no N-terminal signal sequence

----- Final Results -----
            bacterial cytoplasm --- Certainty = 0.4747(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below.

```
Identities = 55/61 (90%), Positives = 59/61 (96%)

Query:   1 MAKKSMIAKNKRPAKFSTQAYTRCEKCGRPHSVYRKFQLCRVCFRDLAYKGQVPGVTKAS   60
           +AKKSMIAKNKRPAK STQAYTRCEKCGRPHSVYRKF+LCRVCFR+LAYKGQ+PGV KAS
Sbjct:   1 LAKKSMIAKNKRPAKHSTQAYTRCEKCGRPHSVYRKFKLCRVCFRELAYKGQIPGVVKAS   60

Query:  61 W                                                              61
           W
Sbjct:  61 W                                                              61
```

Based on this analysis, it was predicted that this protein and its epitopes, could be useful antigens for vaccines or diagnostics.

EXAMPLE 2056

A DNA sequence (GBSx2167) was identified in *S. agalactiae* <SEQ ID 6355> which encodes the amino acid sequence <SEQ ID 6356>. This protein is predicted to be 50S ribosomal protein L5 (rplE). Analysis of this protein sequence reveals the following:

```
Possible site: 48
>>> Seems to have no N-terminal signal sequence

----- Final Results -----
            bacterial cytoplasm --- Certainty = 0.1845(Affirmative) < succ>
             bacterial membrane --- Certainty = 0.0000(Not Clear)   < succ>
              bacterial outside --- Certainty = 0.0000(Not Clear)   < succ>
```

The protein has homology with the following sequences in the GENPEPT database.

```
>GP: BAB03865 GB: AP001507 ribosomal protein L5 (BL6)
[Bacillus halodurans]
Identities = 143/178 (80%), Positives = 162/178 (90%)

Query:   3 NRLKEKYTNEVVPALTEKFNYSSVMAVPKVEKIVLNMGVGDAVSNAKNLEKAAAELALIS    62
           NRLKEKY  E+VP+LTERFNYSSVMAVPK+EKIV+NMGVGDAV NAK L+KA  EL  I+
Sbjct:   2 NRLKEKYQKEIVPSLTEKFNYSSVMAVPKLEKIVVNMGVGDAVQNAKALDKAVEELTEIT    61

Query:  63 GQKPLITKAKKSIAGFRLREGVAIGAKVTLRGERMYEFLDKLVSVSLPRVRDFHGVPTKS   122
           GQKP+ITKAKKSIAGF+LREG+ IGAKVTLRGERMYEFLDKL+SVSLPRVRDF G+  K+
Sbjct:  62 GQKPIITKAKKSIAGFKLREGMPIGAKVTLRGERMYEFLDKLISVSLPRVRDFRGISKKA   121

Query: 123 FDGRGNYTLGVKEQLIFPEINFDDVDKVRGLDIVIVTTANTDEESRELLKGLGMPFAK     180
           FDGRGNYTLGVKEQLIFPEI++D VDKVRG+D+VIVTTA+TDEE+RELL  +GMPF K
Sbjct: 122 FDGRGNYTLGVKEQLIFPEIDYDKVDKVRGMDVVIVTTASTDEEARELLSQMGMPFQK    179
```

A related DNA sequence was identified in *S. pyogenes* <SEQ ID 6357> which encodes the amino acid sequence <SEQ ID 6358>. Analysis of this protein sequence reveals the following:

```
Possible site: 48
>>> Seems to have no N-terminal signal sequence

----- Final Results -----
            bacterial cytoplasm --- Certainty = 0.1793(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below.

```
Identities = 177/180 (98%), Positives = 180/180 (99%)

Query:   1 MANRLKEKYTNEVVPALTEKFNYSSVMAVPKVEKIVLNMGVGDAVSNAKNLEKAAAELAL    60
           MANRLKEKYTNEV+PALTEKFNY+SVMAVPKVEKIVLNMGVGDAVSNAKNLEKAAAELAL
Sbjct:   1 MANRLKEKYTNEVIPALTEKFNYTSVMAVPKVEKIVLNMGVGDAVSNAKNLEKAAAELAL    60

Query:  61 ISGQKPLITKAKKSIAGFRLREGVAIGAKVTLRGERMYEFLDKLVSVSLPRVRDFHGVPT   120
           ISGQKPLITKAKKSIAGFRLREGVAIGAKVTLRGERMYEFLDKLVSVSLPRVRDFHGVPT
Sbjct:  61 ISGQKPLITKAKKSIAGFRLREGVAIGAKVTLRGERMYEFLDKLVSVSLPRVRDFHGVPT   120

Query: 121 KSFDGRGNYTLGVKEQLIFPEINFDDVDKVRGLDIVIVTTANTDEESRELLKGLGMPFAK   180
           KSFDGRGNYTLGVKEQLIFPEI+FDDVDKVRGLDIVIVTTANTDEESRELLKGLGMPFAK
Sbjct: 121 KSFDGRGNYTLGVKEQLIFPEISFDDVDKVRGLDIVIVTTANTDEESRELLKGLGMPFAK   180
```

Based on this analysis, it was predicted that this protein and its epitopes, could be useful antigens for vaccines or diagnostics.

EXAMPLE 2057

A DNA sequence (GBSx2169) was identified in *S. agalactiae* <SEQ ID 6359> which encodes the amino acid sequence <SEQ ID 6360>. This protein is predicted to be 50S ribosomal protein L24 (rplX). Analysis of this protein sequence reveals the following:

```
Possible site: 26
>>> Seems to have no N-terminal signal sequence

----- Final Results -----
            bacterial cytoplasm --- Certainty = 0.1850(Affirmative) < succ>
             bacterial membrane --- Certainty = 0.0000(Not Clear)   < succ>
              bacterial outside --- Certainty = 0.0000(Not Clear)   < succ>
```

The protein has homology with the following sequences in the GENPEPT database.

```
>GP: AAD33285 GB: AF126061 RpL24 [Streptococcus pneumoniae]
Identities = 89/101 (88%), Positives = 94/101 (92%)

Query:   1 MFVKKGDKVRVIAGKDKGTEAVVLKALPKVNKVVVEGVALIKKHQKPNNENPQGAIVEKE   60
           MFVKKGDKVRVIAGKDKGTEAVVL ALPKVNKV+VEGV ++KKHQ+P NE PQG I+EKE
Sbjct:   1 MFVKKGDKVRVIAGKDKGTEAVVLTALPKVNKVIVEGVNIVKKHQRPTNELPQGGIIEKE   60

Query:  61 APIHVSNVQVLDKNGVAGRVGYKVVDGKKVRYNKKSGEVLD                     101
           A IHVSNVQVLDKNGVAGRVGYK VDGKKVRYNKKSGEVLD
Sbjct:  61 AAIHVSNVQVLDKNGVAGRVGYKFVDGKKVRYNKKSGEVLD                     101
```

A related DNA sequence was identified in *S. pyogenes* <SEQ ID 6361> which encodes the amino acid sequence <SEQ ID 6362>. Analysis of this protein sequence reveals the following:

```
Possible site: 26
>>> Seems to have no N-terminal signal sequence

----- Final Results -----
            bacterial cytoplasm --- Certainty = 0.1850(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below.

```
Identities = 95/101 (94%), Positives = 99/101 (97%)

Query:   1 MFVKKGDKVRVIAGKDKGTEAVVLKALPKVNKVVVEGVALIKKHQKPNNENPQGAIVEKE   60
           MFVKKGDKVRVIAGKDKGTEAVVLKALFKVNKV+VEGV +IKKHQKPN ENPQGAIVEKE
Sbjct:   1 MFVKKGDKVRVIAGKDKGTEAVVLKALPKVNKVIVEGVGMIKKHQKPNTENPQGAIVEKE   60

Query:  61 APIHVSNVQVLDKNGVAGRVGYKVVDGKKVRYNKKSGEVLD                     101
           APIHVSNVQVLDKNGVAGR+GYKVVDGKKVRY+KKSGEVLD
Sbjct:  61 APIHVSNVQVLDKNGVAGRIGYKVVDGKKVRYSKKSGEVLD                     101
```

Based on this analysis, it was predicted that this protein and its epitopes, could be useful antigens for vaccines or diagnostics.

EXAMPLE 2058

A DNA sequence (GBSx2170) was identified in *S. agalactiae* <SEQ ID 6363> which encodes the amino acid sequence <SEQ ID 6364>. This protein is predicted to be 50S ribosomal protein L14 (rplN). Analysis of this protein sequence reveals the following:

```
Possible site: 16
>>> Seems to have no N-terminal signal sequence

----- Final Results -----
            bacterial cytoplasm --- Certainty = 0.1004(Affirmative) < succ>
             bacterial membrane --- Certainty = 0.0000(Not Clear)   < succ>
              bacterial outside --- Certainty = 0.0000(Not Clear)   < succ>
```

The protein has homology with the following sequences in the GENPEPT database.

```
>GP: AAD33284 GB: AF126061 RpL14 [Streptococcus pneumoniae]
Identities = 116/122 (95%), Positives = 120/122 (98%)

Query:   1 MIQQETRLKVADNSGAREILTIKVLGGSGRKFANIGDVIVASVKQATPGGAVKKGDVVKA    60
           MIQ ETRLKVADNSGAREILTIKVLGGSGRKFANIGDVIVASVKQATPGGAVKKGDVVKA
Sbjct:   1 MIQTETRLKVADNSGAREILTIKVLGGSGRKFANIGDVIVASVKQATPGGAVKKGDVVKA    60

Query:  61 VIVRTKTGARRPDGSYIKFDDNAAVIIRDDKTPRGTRIFGPVARELREGGYMKIVSLAPE   120
           VIVRTK+GARR DGSYIKFD+NAAVIIR+DKTPRGTRIFGPVARELREGG+MKIVSLAPE
Sbjct:  61 VIVRTKSGARRADGSYIKFDENAAVIIREDKTPRGTRIFGPVARELREGGFMKIVSLAPE   120

Query: 121 VL                                                             122
           VL
Sbjct: 121 VL                                                             122
```

A related DNA sequence was identified in *S. pyogenes* <SEQ ID 6365> which encodes the amino acid sequence <SEQ ID 6366>. Analysis of this protein sequence reveals the following:

```
Possible site: 16
>>> Seems to have no N-terminal signal sequence

----- Final Results -----
            bacterial cytoplasm --- Certainty = 0.1004(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below.

```
Identities = 122/122 (100%), Positives = 122/122 (100%)

Query:   1 MIQQETRLKVADNSGAREILTIKVLGGSGRKFANIGDVIVASVKQATPGGAVKKGDVVKA    60
           MIQQETRLKVADNSGAREILTIKVLGGSGRKFANIGDVIVASVKQATPGGAVKKGDVVKA
Sbjct:   1 MIQQETRLKVADNSGAREILTIKVLGGSGRKFANIGDVIVASVKQATPGGAVKKGDVVKA    60

Query:  61 VIVRTKTGARRPDGSYIKFDDNAAVIIRDDKTPRGTRIFGPVARELREGGYMKIVSLAPE   120
           VIVRTKTGARRPDGSYIKFDDNAAVIIRDDKTPRGTRIFGPVARELREGGYMKIVSLAPE
Sbjct:  61 VIVRTKTGARRPDGSYIKFDDNAAVIIRDDKTPRGTRIFGPVARELREGGYMKIVSLAPE   120

Query: 121 VL                                                             122
           VL
Sbjct: 121 VL                                                             122
```

Based on this analysis, it was predicted that this protein and its epitopes, could be useful antigens for vaccines or diagnostics.

EXAMPLE 2059

A DNA sequence (GBSx2171) was identified in *S. agalactiae* <SEQ ID 6367> which encodes the amino acid sequence <SEQ ID 6368>. Analysis of this protein sequence reveals the following:

```
Possible site: 47
>>> Seems to have no N-terminal signal sequence
```

```
----- Final Results -----
         bacterial cytoplasm --- Certainty = 0.3415(Affirmative) < succ>
          bacterial membrane --- Certainty = 0.0000(Not Clear)   < succ>
           bacterial outside --- Certainty = 0.0000(Not Clear)   < succ>
```

The protein has homology with the following sequences in the GENPEPT database.

```
>GP: AAD33283 GB: AF126061 RpS17 [Streptococcus pneumoniae]
Identities = 82/86 (95%), Positives = 83/86 (96%)

Query:  1 MERNQRKTLYGRVVSDKMDKTITVVVETKRNHPVYGKRINYSKKYKAHDENNVAKEGDIV  60
          MERN RK L GRVVSDKMDKTITVVVETKRNHPVYGKRINYSKKYKAHDENNVAKEGDIV
Sbjct:  1 MERNNRKVLVGRVVSDKMDKTITVVVETKRNHPVYGKRINYSKKYKAHDENNVAKEGDIV  60

Query: 61 RIMETRPLSATKRFRLVEVVEKAVII                                    86
          RIMETRPLSATKRFRLVEVVE+AVII
Sbjct: 61 RIMETRPLSATKRFRLVEVVEKAVII                                    86
```

A related DNA sequence was identified in *S. pyogenes* <SEQ ID 6369> which encodes the amino acid sequence <SEQ ID 6370>. Analysis of this protein sequence reveals the following:

```
Possible site: 47
>>> Seems to have no N-terminal signal sequence

----- Final Results -----
         bacterial cytoplasm --- Certainty = 0.3415(Affirmative) < succ>
          bacterial membrane --- Certainty = 0.0000(Not Clear)   < succ>
           bacterial outside --- Certainty = 0.0000(Not Clear)   < succ>
```

An alignment of the GAS and GBS proteins is shown below.

```
Identities = 86/86 (100%), Positives = 86/86 (100%)

Query:  1 MERNQRKTLYGRVVSDKMDKTITVVVETKRNHPVYGKRINYSKKYKAHDENNVAKEGDIV  60
          MERNQRKTLYGRVVSDKMDKTITVVVETKRNHPVYGKRINYSKKYKAHDENNVAKEGDIV
Sbjct:  1 MERNQRKTLYGRVVSDKMDKTITVVVETKRNHPVYGKRINYSKKYKAHDENNVAKEGDIV  60

Query: 61 RIMETRPLSATKRFRLVEVVEKAVII                                    86
          RIMETRPLSATKRFRLVEVVEKAVII
Sbjct: 61 RIMETRPLSATKRFRLVEVVEKAVII                                    86
```

Based on this analysis, it was predicted that this protein and its epitopes, could be useful antigens for vaccines or diagnostics.

EXAMPLE 2060

A DNA sequence (GBSx2172) was identified in *S. agalactiae* <SEQ ID 6371> which encodes the amino acid sequence <SEQ ID 6372>. Analysis of this protein sequence reveals the following:

```
Possible site: 43
>>> Seems to have no N-terminal signal sequence

----- Final Results -----
         bacterial cytoplasm --- Certainty = 0.4329(Affirmative) < succ>
          bacterial membrane --- Certainty = 0.0000(Not Clear)   < succ>
           bacterial outside --- Certainty = 0.0000(Not Clear)   < succ>
```

The protein has homology with the following sequences in the GENPEPT database.

```
>GP: AAD33282 GB: AF126061 RpL29 [Streptococcus pneumoniae]
Identities = 58/68 (85%), Positives = 64/68 (93%)

Query:   1 MKLQEIKDFVKELRGLSQEELAKKENELKKELFDLRFQAAAGQLEKTARLDEVKKQIARV   60
           MKL E+K+FVKELRGLSQEELAK+ENELKKELF+LRFQAA GQLE+TARL EVKKQIAR+
Sbjct:   1 MKLNEVKEFVKELRGLSQEELAKRENELKKELFELRFQAATGQLEQTARLKEVKKQIARI   60

Query:  61 KTVQSEMK   68
           KTVQSE K
Sbjct:  61 KTVQSEAK   68
```

Based on this analysis, it was predicted that this protein and its epitopes, could be useful antigens for vaccines or diagnostics.

EXAMPLE 2061

A DNA sequence (GBSx2174) was identified in *S. agalactiae* <SEQ ID 6373> which encodes the amino acid sequence <SEQ ID 6374>. This protein is predicted to be RpL16 (rplP). Analysis of this protein sequence reveals the following:

```
Possible site: 52
>>> Seems to have no N-terminal signal sequence

----- Final Results -----
            bacterial cytoplasm --- Certainty = 0.4574(Affirmative) < succ>
             bacterial membrane --- Certainty = 0.0000(Not Clear)   < succ>
              bacterial outside --- Certainty = 0.0000(Not Clear)   < succ>
```

The protein has homology with the following sequences in the GENPEPT database.

```
>GP: AAD33263 GB: AF126059 RpL16 [Streptococcus pneumoniae]
Identities = 135/137 (98%), Positives = 137/137 (99%)

Query:   1 MLVPKRVKHRREFRGKMRGEAKGGKEVSFGEYGLQATTSHWITNRQIEAARIANTRYMKR   60
           MLVPKRVKHRREFRGKMRGEAKGGKEV+FGEYGLQATTSHWITNRQIEAARIANTRYMKR
Sbjct:   1 MLVPKRVKHRREFRGKMRGEAKGGKEVAFGEYGLQATTSHWITNRQIEAARIANTRYMKR   60

Query:  61 GGKVWIKIFPHKSYTAKAIGVRMGSGKGAPEGWVAPVKRGKVMFEIAGVSEEVAREALRL  120
           GGKVWIKIFPHKSYTAKAIGVRMGSGKGAPEGWVAPVKRGKVMFEIAGVSEE+AREALRL
Sbjct:  61 GGKVWIKIFPHKSYTAKAIGVRMGSGKGAPEGWVAPVKRGKVMFEIAGVSEEIAREALRL  120

Query: 121 ASHKLPVKCKFVKREAE  137
           ASHKLPVKCKFVKREAE
Sbjct: 121 ASHKLPVKCKFVKREAE  137
```

A related DNA sequence was identified in *S. pyogenes* <SEQ ID 6375> which encodes the amino acid sequence <SEQ ID 6376>. Analysis of this protein sequence reveals the following:

```
Possible site: 52
>>> Seems to have no N-terminal signal sequence

----- Final Results -----
            bacterial cytoplasm --- Certainty = 0.4574(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below.

```
Identities = 136/137 (99%), Positives = 137/137 (99%)

Query:   1 MLVPKRVKHRREFRGKMRGEAKGGKEVSFGEYGLQATTSHWITNRQIEAARIAMTRYMKR   60
           MLVPKRVKHRREFRGKMRGEAKGGKEVSFGEYGLQATTSHWITNRQIEAARIAMTRYMKR
Sbjct:   1 MLVPKRVKHRREFRGRMRGEAKGGKEVSFGEYGLQATTSHWITNRQIEAARIAMTRYMKR   60
```

```
-continued

Query:  61 GGKVWIKIFPHKSYTAKAIGVRMGSGKGAPEGWVAPVKRGKVMFEIAGVSEEVAREALRL  120
           GGKVWIKIFPHKSYTAKAIGVRMGSGKGAPEGWVAPVKRGKVMFEIAGVSEE+AREALRL
Sbjct:  61 GGKVWIKIFPHKSYTAKAIGVRMGSGKGAPEGWVAPVKRGKVMFEIAGVSEEIAREALRL  120

Query: 121 ASHKLPVKCKFVKREAE                                            137
           ASHKLPVKCKFVKREAE
Sbjct: 121 ASHKLPVKCKFVKREAE                                            137
```

Based on this analysis, it was predicted that this protein and its epitopes, could be useful antigens for vaccines or diagnostics.

EXAMPLE 2062

A DNA sequence (GBSx2175) was identified in *S. agalactiae* <SEQ ID 6377> which encodes the amino acid sequence <SEQ ID 6378>. Analysis of this protein sequence reveals the following:

```
Possible site: 53
>>> Seems to have no N-terminal signal sequence

----- Final Results -----
            bacterial cytoplasm --- Certainty = 0.3758(Affirmative) < succ>
            bacterial membrane  --- Certainty = 0.0000(Not Clear)   < succ>
             bacterial outside  --- Certainty = 0.0000(Not Clear)   < succ>
```

The protein has homology with the following sequences in the GENPEPT database.

```
>GP: AAD33280 GB: AF126061 RpS3 [Streptococcus pneumoniae]
Identities = 200/208 (96%), Positives = 203/208 (97%)

Query:  10 MRVGIIRDWDAKWYAEKEYADYLHEDLAIRKFINKELADASVSTIEIERAVNKVIVSLHT   69
           MRVGIIRDWDAKWYAEKEYADYLHEDLAIRKF+ KELADA+VSTIEIERAVNKV VSLHT
Sbjct:   1 MRVGIIRDWDAKWYAEKEYADYLHEDLAIRKFVQKELADAAVSTIEIERAVNKVNVSLHT   60

Query:  70 AKPGMVIGKGGANVDALRGQLNKLTGKQVHINIIEIKQPDLDAHLVGENIARQLEQRVAF  129
           AKPGMVIGKGGANVDALR +LNKLTGKQVHINIIEIKQPDLDAHLVGE IARQLEQRVAF
Sbjct:  61 AKPGMVIGKGGANVDALRAKLNKLTGKQVHINIIEIKQPDLDAHLVGEGIARQLEQRVAF  120

Query: 130 RRAQKQAIQRTMRAGAKGIKTQVSGRLNGADIARAEGYSEGTVPLHTLRADIDYAWEEAD  189
           RRAQKQAIQR MRAGAKGIKTQVSGRLNGADIARAEGYSEGTVPLHTLRADIDYAWEEAD
Sbjct: 121 RRAQKQAIQRAMRAGAKGIKTQVSGRLNGADIARAEGYSEGTVPLHTLRADIDYAWEEAD  180

Query: 190 TTYGKLGVKVWIYRGEVLPARKNTKGGK                                 217
           TTYGKLGVKVWIYRGEVLPARKNTKGGK
Sbjct: 181 TTYGKLGVKVWIYRGEVLPARKNTKGGK                                 208
```

A related DNA sequence was identified in *S. pyogenes* <SEQ ID 6379> which encodes the amino acid sequence <SEQ ID 6380>. Analysis of this protein sequence reveals the following:

```
Possible site: 53
>>> Seems to have no N-terminal signal sequence

----- Final Results -----
            bacterial cytoplasm --- Certainty = 0.3758(Affirmative) < succ>
            bacterial membrane  --- Certainty = 0.0000(Not Clear)   < succ>
             bacterial outside  --- Certainty = 0.0000(Not Clear)   < succ>
```

Based on this analysis, it was predicted that this protein and its epitopes, could be useful antigens for vaccines or diagnostics.

EXAMPLE 2063

A DNA sequence (GBSx2176) was identified in *S. agalactiae* <SEQ ID 6381> which encodes the amino acid sequence <SEQ ID 6382>. This protein is predicted to be 50S ribosomal protein L22 (rplV). Analysis of this protein sequence reveals the following:

```
Possible site: 36
>>> Seems to have no N-terminal signal sequence

----- Final Results -----
           bacterial cytoplasm --- Certainty = 0.2704(Affirmative) < succ>
           bacterial membrane  --- Certainty = 0.0000(Not Clear)   < succ>
           bacterial outside   --- Certainty = 0.0000(Not Clear)   < succ>
```

The protein has homology with the following sequences in the GENPEPT database.

```
>GP: AAD33279 GB: AF126061 RpL22 [Streptococcus pneumoniae]
Identities = 99/114 (86%), Positives = 106/114 (92%)

Query:   1 MAEITSAKAMARTVRVSPRKTRLVLDLIRGKNVADAIAILKFTPNKAARVIEKTLNSAIA   60
           MAEITSAKAMARTVRVSPRK+RLVLD IRGK+VADAIAIL FTPNKAA +I K LNSA+A
Sbjct:   1 MAEITSAKAMARTVRVSPRKSRLVLDNIRGKSVADAIAILTFTPNKAAEIILKVLNSAVA   60

Query:  61 NAENNFGLEKANLVVSETFANEGPTMKRFRPRAKGSASPINKRTTHVTVVVSEK        114
           NAENNFGL+KANLVVSE FANEGPTMKRFRPRAKGSASPINKRT H+TV V+EK
Sbjct:  61 NAENNFGLDKANLVVSEAFANEGPTMKRFRPRAKGSASPINKRTAHITVAVAEK        114
```

A related DNA sequence was identified in *S. pyogenes* <SEQ ID 6383> which encodes the amino acid sequence <SEQ ID 6384>. Analysis of this protein sequence reveals the following:

```
Possible site: 36
>>> Seems to have no N-terminal signal sequence

----- Final Results -----
           bacterial cytoplasm --- Certainty = 0.2794(Affirmative) < succ>
           bacterial membrane  --- Certainty = 0.0000(Not Clear)   < succ>
           bacterial outside   --- Certainty = 0.0000(Not Clear)   < succ>
```

An alignment of the GAS and GBS proteins is shown below.

```
Identities = 113/114 (99%), Positives = 113/114 (99%)

Query:   1 MAEITSAKAMARTVRVSPRKTRLVLDLIRGKNVADAIAILKFTPNKAARVIEKTLNSAIA   60
           MAEITSAKAMARTVRVSPRKTRLVLDLIRGK VADAIAILKFTPNKAARVIEKTLNSAIA
Sbjct:   1 MAEITSAKAMARTVRVSPRKTRLVLDLIRGKKVADAIAILKFTPNKAARVIEKTLNSAIA   60

Query:  61 NAENNFGLEKANLVVSETFANEGPTMKRFRPRAKGSASPINKRTTHVTVVVSEK        114
           NAENNFGLEKANLVVSETFANEGPTMKRFRPRAKGSASPINKRTTHVTVVVSEK
Sbjct:  61 NAENNFGLEKANLVVSETFANEGPTMKRFRPRAKGSASPINKRTTHVTVVVSEK        114
```

Based on this analysis, it was predicted that this protein and its epitopes, could be useful antigens for vaccines or diagnostics.

EXAMPLE 2064

A DNA sequence (GBSx2177) was identified in *S. agalactiae* <SEQ ID 6385> which encodes the amino acid sequence <SEQ ID 6386>. This protein is predicted to be 30S ribosomal protein S19 (rpsS). Analysis of this protein sequence reveals the following:

```
Possible site: 23
>>> Seems to have no N-terminal signal sequence

----- Final Results -----
            bacterial cytoplasm --- Certainty = 0.2991(Affirmative) < succ>
             bacterial membrane --- Certainty = 0.0000(Not Clear)   < succ>
              bacterial outside --- Certainty = 0.0000(Not Clear)   < succ>
```

The protein is similar to ribosomal protein S19 from *S. pneumoniae*.

A related DNA sequence was identified in *S. pyogenes* <SEQ ID 6387> which encodes the amino acid sequence <SEQ ID 6388>. Analysis of this protein sequence reveals the following:

```
Possible site: 41
>>> Seems to have no N-terminal signal sequence

----- Final Results -----
            bacterial cytoplasm --- Certainty = 0.3319(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below.

```
Identities = 92/92 (100%), Positives = 92/92 (100%)

Query:   1 MGRSLKKGPFVDEHLMKKVEAQANDEKKKVIKTWSRRSTIFPSFIGYTIAVYDGRKHVPV    60
           MGRSLKKGPFVDEHLMKKVEAQANDEKKKVIKTWSRRSTIFPSFIGYTIAVYDGRKHVPV
Sbjct:  19 MGRSLKKGPFVDEHLMKKVEAQANDEKKKVIKTWSRRSTIFPSFIGYTIAVYDGRKHVPV    78

Query:  61 YIQEDMVGHKLGEFAPTRTYKGHAADDKKTRR                                92
           YIQEDMVGHKLGEFAPTRTYKGHAADDKKTRR
Sbjct:  79 YIQEDMVGHKLGEFAPTRTYKGHAADDKKTRR                               110
```

Based on this analysis, it was predicted that this protein and its epitopes, could be useful antigens for vaccines or diagnostics.

EXAMPLE 2065

A DNA sequence (GBSx2178) was identified in *S. agalactiae* <SEQ ID 6389> which encodes the amino acid sequence <SEQ ID 6390>. This protein is predicted to be L2 (rplB). Analysis of this protein sequence reveals the following:

```
Possible site: 22
>>> Seems to have no N-terminal signal sequence

----- Final Results -----
            bacterial cytoplasm --- Certainty = 0.3182(Affirmative) < succ>
             bacterial membrane --- Certainty = 0.0000(Not Clear)   < succ>
              bacterial outside --- Certainty = 0.0000(Not Clear)   < succ>
```

The protein has homology with the following sequences in the GENPEPT database.

```
>GP: AAC45959 GB: U43929 L2 [Bacillus subtilis]
Identities = 208/277 (75%), Positives = 239/277 (86%)

Query:   1 MGIKVYKPTTNGRRNMTSLDFAEITTNTPEKSLLVSLKNKAGRNNNGRITVRHQGGHKR    60
           M IK YKP++NGRR MT+ DFAEITT+ PEKSLL  L  K GRNN G++TVRHQGGGHKR
Sbjct:   1 MAIKKYKPSSNGRRGMTTSDFAEITTDKPEKSLLAPLHKKGGRNNQGKLTVRHQGGGHKR    60

Query:  61 HYRLIDFKRNKDGVEAVVKTIEYDPNRTANIALVHYTDGVKAYILAPKGLEVGQRIISGP   120
           YR+IDFKR+KDG   V T+EYDPNR+ANIAL++Y DG K YILAPKG++VG  ++SGP
Sbjct:  61 QYRVIDFKRDKDGIPGRVATVEYDPNRSANIALINYADGEKRYILAPKGIQVGTEVMSGP   120
```

```
                          -continued
Query: 121 EADIKVGNALPLANIPVGTVIHNIELQPGKGAELIRAAGASAQVLGQEGKYVLVRLQSGE 180
           EADIKVGNALPL NIPVGTV+HNIEL+PGKG +L+R+AG SAQVLG+EGKYVLVRL SGE
Sbjct: 121 EADIKVGNALPLINIPVGTVVHNIELKPGKGGQLVRSAGTSAQVLGKEGKYVLVRLNSGE 180

Query: 181 VRMILGTCRATIGTVGNEQQSLVNIGKAGRNRWKGVRPTVRGSVMNPNDHPHGGGEGKAP 240
           VRMIL  CRA+IG VGNEQ  L+NIGKAGR+RWKG+RPTVRGSVMNPNDHPHGGGEG+AP
Sbjct: 181 VRMILSACRASIGQVGNEQHELINIGKAGRSRWKGIRPTVRGSVMNPNDHPHGGGEGRAP 240

Query: 241 VGRKAPSTPWGKPALGLKTRNKKAKSDKLIVRRRNQK                        277
           +GRK+P +PWGKP LG KTR KK KSDK IVRRR  K
Sbjct: 241 IGRKSPMSPWGKPTLGFKTRKKKNKSDKFIVRRRKNK                        277
```

A related DNA sequence was identified in *S. pyogenes* <SEQ ID 6391> which encodes the amino acid sequence <SEQ ID 6392>. Analysis of this protein sequence reveals the following:

```
Possible site: 41
>>> Seems to have no N-terminal signal sequence

----- Final Results -----
          bacterial cytoplasm --- Certainty = 0.2560(Affirmative) < succ>
           bacterial membrane --- Certainty = 0.0000(Not Clear)   < succ>
            bacterial outside --- Certainty = 0.0000(Not Clear)   < succ>
```

An alignment of the GAS and GBS proteins is shown below.

```
Identities = 264/277 (95%), Positives = 276/277 (99%)

Query:   1 MGIKVYKPTTNGRRNMTSLDFAEITTNTPEKSLLVSLKNKAGRNNNGRITVRHQGGGHKR  60
           +GIKVYKPTTNGRRNMTSLDFAEITT+TPEKSLLVSLK+KAGRNNNGRITVRHQGGGHKR
Sbjct:   1 VGIKVYKPTTNGRRNMTSLDFAEITTSTPEKSLLVSLKSKAGRNNNGRITVRHQGGGHKR  60

Query:  61 HYRLIDFKRNKDGVEAVVKTIEYDPNRTANIALVHYTDGVKAYILAPKGLEVGQRIISGP 120
           HYRLIDFKRNKDGVEAVVKTIEYDPNRTANIALVHYTDGVKAYI+APKGLEVGQRI+SGP
Sbjct:  61 HYRLIDFKRNKDGVEAVVKTIEYDPNRTANIALVHYTDGVKAYIIAPKGLEVGQRIVSGP 120

Query: 121 EADIKVGNALPLANIPVGTVIHNIELQPGKGAELIRAAGASAQVLGQEGKYVLVRLQSGE 180
           +ADIKVGNALPLANIPVGTV+HNIEL+PGKG EL+RAAGASAQVLGQEGKYVLVRLQSGE
Sbjct: 121 DADIKVGNALPLANIPVGTVVHNIELKPGKGGELVRAAGASAQVLGQEGKYVLVRLQSGE 180

Query: 181 VRMILGTCRATIGTVGNEQQSLVNIGKAGRNRWKGVRPTVRGSVMNPNDHPHGGGEGKAP 240
           VRMILGTCRATIGTVGNEQQSLVNIGKAGR+RWKG+RPTVRGSVMNPNDHPHGGGEGKAP
Sbjct: 181 VRMILGTCRATIGTVGNEQQSLVNIGKAGRSRWKGIRPTVRGSVMNPNDHPHGGGEGKAP 240

Query: 241 VGRKAPSTPWGKPALGLKTRNKKAKSDKLIVRRRNQK                        277
           VGRKAPSTPWGKPALGLKTRNKKAKSDKLIVRRRN+K
Sbjct: 241 VGRKAPSTPWGKPALGLKTRNKKAKSDKLIVRRRNEK                        277
```

Based on this analysis, it was predicted that this protein and its epitopes, could be useful antigens for vaccines or diagnostics.

EXAMPLE 2066

A DNA sequence (GBSx2180) was identified in *S. agalactiae* <SEQ ID 6393> which encodes the amino acid sequence <SEQ ID 6394>. This protein is predicted to be 50S ribosomal protein L23 (rplW). Analysis of this protein sequence reveals the following:

```
Possible site: 44
>>> Seems to have no N-terminal signal sequence

----- Final Results -----
          bacterial cytoplasm --- Certainty = 0.1669(Affirmative) < succ>
           bacterial membrane --- Certainty = 0.0000(Not Clear)   < succ>
            bacterial outside --- Certainty = 0.0000(Not Clear)   < succ>
```

The protein has homology with the following sequences in the GENPEPT database.

```
>GP: BAB03855 GB: AP001507 ribosomal protein L23
[Bacillus halodurans]
Identities = 56/92 (60%), Positives = 67/92 (71%), Gaps = 1/92 (1%)

Query:    2 NLYDVIKKPVITEKSMVALEAGKYTFEVDTRAHKLLIKQAVEAAFDGVKVASVNTVTVKP   61
            N DVIK+PVITE+S  +    KYTFEVD RA+K  IK A+E  FD VKVA VNT+  K
Sbjct:    3 NARDVIKRPVITERSTEVMGDKKYTFEVDVRANKTQIKDAIEEIFD-VKVAKVNTMNYKG  61

Query:   62 KAKRVGRYTGFTSKTKKAIITLTADSKAIELF                             93
            K KR GRYTGFT++ KKAI+TLT DSK ++ F
Sbjct:   62 KPKRFGRYTGFTARRKKAIVTLTPDSKELDFF                             93
```

A related DNA sequence was identified in *S. pyogenes* <SEQ ID 6395> which encodes the amino acid sequence <SEQ ID 6396>. Analysis of this protein sequence reveals the following:

```
Possible site: 44
>>> Seems to have no N-terminal signal sequence

----- Final Results -----
             bacterial cytoplasm --- Certainty = 0.1617(Affirmative) < succ>
              bacterial membrane --- Certainty = 0.0000(Not Clear)   < succ>
               bacterial outside --- Certainty = 0.0000(Not Clear)   < succ>
```

An alignment of the GAS and GBS proteins is shown below.

```
Identities = 96/98 (97%), Positives = 97/98 (98%)

Query:    1 MNLYDVIKKPVITEKSMVALEAGKYTFEVDTRAHKLLIKQAVEAAFDGVKVASVNTVTVK   60
            MNLYDVIKKPVITEKSM+ALEAGKYTFEVDTRAHKLLIKQAVEAAFDGVKVASVNTV VK
Sbjct:    1 MNLYDVIKKPVITEKSMIALEAGKYTFEVDTRAHKLLIKQAVEAAFDGVKVASVNTVNVK   60

Query:   61 PKAKRVGRYTGFTSKTKKAIITLTADSKAIELFAAEAE                        98
            PKAKRVGRYTGFTSKTKKAIITLTADSKAIELFAAEAE
Sbjct:   61 PKAKRVGRYTGFTSKTKKAIITLTADSKAIELFAAEAE                        98
```

Based on this analysis, it was predicted that this protein and its epitopes, could be useful antigens for vaccines or diagnostics.

EXAMPLE 2067

A DNA sequence (GBSx2181) was identified in *S. agalactiae* <SEQ ID 6397> which encodes the amino acid sequence <SEQ ID 6398>. This protein is predicted to be 50S ribosomal protein L4 (rplD). Analysis of this protein sequence reveals the following:

```
Possible site: 60
>>> Seems to have no N-terminal signal sequence
     INTEGRAL    Likelihood = -1.54    Transmembrane   140-156 (139-156)

----- Final Results -----
              bacterial membrane --- Certainty = 0.1617(Affirmative) < succ>
               bacterial outside --- Certainty = 0.0000(Not Clear)   < succ>
             bacterial cytoplasm --- Certainty = 0.0000(Not Clear)   < succ>
```

The protein has homology with the following sequences in the GENPEPT database.

```
>GP: AAC45957 GB: U43929 L4 [Bacillus subtilis]
Identities = 130/207 (62%), Positives = 160/207 (76%)

Query:    1 MANVKLFDQTGKEVSSVELNEAIFGIEPNESVVFDVVISQRASLRQGTHAVKNRSAVSGG   60
```

-continued

```
             M  V L++Q G     +ELN ++FGIEPNESVVFD ++ QRASLRQGTH VKNRS V GG
Sbjct:    1 MPKVALYNQNGSTAGDIELNASVFGIEPNESVVFDAILMQRASLRQGTHKVKNRSEVRGG    60

Query:   61 GRKPWRQKGTGRARQGSIRSPQWRGGGVVFGPTPRSYGYKLPQKVRRLALKSVYSAKVAE   120
            GRKPWRQKGTGRARQGSIRSPQWRGGGVVFGPTPRSY YKLP+KVRRLA+KSV S+KV +
Sbjct:   61 GRKPWRQKGTGRARQGSIRSPQWRGGGVVFGPTPRSYSYKLPKKVRRLAIKSVLSSKVID   120

Query:  121 DKFVAVENLSFAAPKTAEFASVLSALSIDSKVLVILEEGNEFAALSARNLPNVTVATATT   180
            +  +  +E+L+     KT E A++L  LS++ K L++  + NE  ALSARN+P VTV  A
Sbjct:  121 NNIIVLEDLTLDTAKTKEMAAILKGLSVEKKALIVTADANEAVALSARNIPGVTVVEANG   180

Query:  181 ASVLDIVNADKLLVTKEAISTIEGVLA                                   207
            +VLD+VN +KLL+TK A+  +E VLA
Sbjct:  181 INVLDVVNHEKLLITKAAVEKVEEVLA                                   207
```

A related DNA sequence was identified in *S. pyogenes* <SEQ ID 6399> which encodes the amino acid sequence <SEQ ID 6400>. Analysis of this protein sequence reveals the following:

```
Possible site: 60
>>> Seems to have no N-terminal signal sequence

----- Final Results -----
            bacterial cytoplasm --- Certainty = 0.2544(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below.

```
Identities = 199/207 (96%), Positives = 203/207 (97%)

Query:    1 MANVKLFDQTGKEVSSVELNEAIFGIEPNESVVFDVVISQRASLRQGTHAVKNRSAVSGG    60
            MANVKLFDQTGKEVSSVELN+AIFGIEPNESVVFDVVISQRASLRQGTHAVKNRSAVSGG
Sbjct:    1 MANVKLFDQTGKEVSSVELNDAIFGIEPNESVVFDVVISQRASLRQGTHAVKNRSAVSGG    60

Query:   61 GRKPWRQKGTGRARQGSIRSPQWRGGGVVFGPTPRSYGYKLPQRVRRLALKSVYSAKVAE   120
            GRKPWRQKGTGRARQGSIRSPQWRGGGVVFGPTPRSYGYKLPQKVRRLALKSVYSAKVAE
Sbjct:   61 GRKPWRQKGTGRARQGSIRSPQWRGGGVVFGPTPRSYGYKLPQKVRRLALKSVYSAKVAE   120

Query:  121 DKFVAVENLSFAAPKTAEFASVLSALSIDSKVLVILEEGNEFAALSARNLPNVTVATATT   180
            DKFVAVE LSFAAPKTAEFA VLSALSID+KVLV++EEGNEFAALSARNLPNVTVATA T
Sbjct:  121 DKFVAVEGLSFAAPKTAEFAKVLSALSIDTKVLVLVEEGNEFAALSARNLPNVTVATAAT   180

Query:  181 ASVLDIVNADKLLVTKEAISTIEGVLA                                   207
            ASVLDIVNADKLLVTKEAISTIE VLA
Sbjct:  181 ASVLDIVNADKLLVTKEAISTIEEVLA                                   207
```

Based on this analysis, it was predicted that this protein and its epitopes, could be useful antigens for vaccines or diagnostics.

EXAMPLE 2068

A DNA sequence (GBSx2183) was identified in *S. agalactiae* <SEQ ID 6401> which encodes the amino acid sequence <SEQ ID 6402>. This protein is predicted to be 50S ribosomal protein L3 (rplC). Analysis of this protein sequence reveals the following:

```
Possible site: 40
>>> Seems to have no N-terminal signal sequence

----- Final Results -----
            bacterial cytoplasm --- Certainty = 0.2090(Affirmative) < succ>
             bacterial membrane --- Certainty = 0.0000(Not Clear)   < succ>
              bacterial outside --- Certainty = 0.0000(Not Clear)   < succ>
```

The protein has homology with the following sequences in the GENPEPT database.

```
>GP: AAC45956 GB: U43929 L3 [Bacillus subtilis]
Identities = 157/208 (75%), Positives = 180/208 (86%), Gaps = 2/208 (0%)

Query:    1 MTKGILGKKVGMTQIFTESGEFIPVTVIEATPNVVLQVKTVETDGYEAVQVGFDDKREVL    60
            MTKGILG+K+GMTQ+F E+G+ IPVTVIEA PNVVLQ KT E DGYEA+Q+GFDDKRE L
Sbjct:    1 MTKGILGRKIGMTQVFAENGDLIPVTVIEAAPNVVLQKKTAENDGYEAIQLGFDDKREKL    60

Query:   61 SNKPAKGHVAKANTAPKRFIREFKNIE--GLEVGAELSVEQFEAGDVVDVTGTSKGKGFQ   118
            SNKP KGHVAKA TAPKRF++E + +E    EVG E+ VE F AG++VDVTG SKGKGFQ
Sbjct:   61 SNKPEKGHVAKAETAPKRFVKELRGVEMDAYEVGQEVKVEIFSAGEIVDVTGVSKGKGFQ   120

Query:  119 GVIKRHGQSRGPMAHGSRYHRRPGSMGPVAPNRVFKNKRLAGRMGGNRVTVQNLEIVQVI   178
            G IKRHGQSRGPM+HGSRYHRRPGSMGPV PNRVFK K L GRMGG ++TVQNLEIV+V
Sbjct:  121 GAIKRHGQSRGPMSHGSRYHRRPGSMGPVDPNRVFKGKLLPGPMGGEQITVQNLEIVKVD   180

Query:  179 PEKNVVLIKGNVPGAKKSLITIKSAVKA                                  206
             E+N++LIKGNVPGAKKSLIT+KSAVK+
Sbjct:  181 AERNLLLIKGNVPGAKKSLITVKSAVKS                                  208
```

A related DNA sequence was identified in *S. pyogenes* <SEQ ID 6403> which encodes the amino acid sequence <SEQ ID 6404>. Analysis of this protein sequence reveals the following:

```
Possible site: 40
>>> Seems to have no N-terminal signal sequence

----- Final Results -----
            bacterial cytoplasm --- Certainty = 0.2090(Affirmative) < succ>
             bacterial membrane --- Certainty = 0.0000(Not Clear) < succ>
              bacterial outside --- Certainty = 0.0000(Not Clear) < succ>
```

An alignment of the GAS and GBS proteins is shown below.

```
Identities = 205/208 (98%), Positives = 207/208 (98%)

Query:    1 MTKGILGKKVGMTQIFTESGEFIPVTVIEATPNVVLQVKTVETDGYEAVQVGFDDKREVL    60
            MTKGILGKKVGMTQIFTESGEFIPVTVIEATPNVVLQVKTVETDGYEAVQVGFDDKREVL
Sbjct:    1 MTKGILGKKVGMTQIFTESGEFIPVTVIEATPNVVLQVKTVETDGYEAVQVGFDDKREVL    60

Query:   61 SNKPAKGHVAKANTAPKRFIREFKNIEGLEVGAELSVEQFEAGDVVDVTGTSKGKGFQGV   120
            SNKPAKGHVAKANTAPKRFIREFKNIEGLEVGAELSVEQFEAGDVVDVTG SKGKGFQGV
Sbjct:   61 SNKPAKGHVAKANTAPKRFIREFKNIEGLEVGAELSVEQFEAGDVVDVTGISKGKGFQGV   120

Query:  121 IKRHGQSRGPMAHGSRYHRRPGSMGPVAPNRVFKNKRLAGRMGGNRVTVQNLEIVQVIPE   180
            IKRHGQSRGPMAHGSRYHRRPGSMGPVAPNRVFKNKRLAGRMGGNRVTVQNLEIVQVIPE
Sbjct:  121 IKRHGQSRGPMAHGSRYHRRPGSMGPVAPNRVFKNKRLAGRMGGNRVTVQNLEIVQVIPE   180

Query:  181 KNVVLIKGNVPGAKKSLITIKSAVKAAK                                  208
            KNV+L+KGNVPGAKKSLITIKSAVKAAK
Sbjct:  181 KNVILVKGNVPGAKKSLITIKSAVKAAK                                  208
```

Based on this analysis, it was predicted that this protein and its epitopes, could be useful antigens for vaccines or diagnostics.

EXAMPLE 2069

A DNA sequence (GBSx2184) was identified in *S. agalactiae* <SEQ ID 6405> which encodes the amino acid sequence <SEQ ID 6406>. Analysis of this protein sequence reveals the following:

```
Possible site: 20
>>> Seems to have an uncleavable N-term signal seq
      INTEGRAL       Likelihood = -0.43      Transmembrane     5-21 (5-21)

----- Final Results -----
             bacterial membrane --- Certainty = 0.1171(Affirmative) < succ>
              bacterial outside --- Certainty = 0.0000(Not Clear) < succ>
            bacterial cytoplasm --- Certainty = 0.0000(Not Clear) < succ>
```

4439

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

4440

EXAMPLE 2070

A DNA sequence (GBSx2185) was identified in *S. agalactiae* <SEQ ID 6407> which encodes the amino acid sequence <SEQ ID 6408>. This protein is predicted to be 30S ribosomal protein S10 (rpsJ). Analysis of this protein sequence reveals the following:

```
Possible site: 37
>>> Seems to have no N-terminal signal sequence

----- Final Results -----
            bacterial cytoplasm --- Certainty = 0.3160(Affirmative) < succ>
            bacterial membrane  --- Certainty = 0.0000(Not Clear)   < succ>
             bacterial outside  --- Certainty = 0.0000(Not Clear)   < succ>
```

The protein has homology with the following sequences in the GENPEPT database.

```
>GP: AAB46363 GB: L29637 S10 ribosomal protein [Streptococcus mutans]
Identities = 98/102 (96%), Positives = 102/102 (99%)

Query:  1 MANKKIRIRLKAYEHRTLDTAAEKIVETATRTGATVAGPVPLPTERSLYTIIRATHKYKD   60
          MANKKIRIRLKAYEHRTLDTAAEKIVETATRTGA+VAGPVPLPTERSLYT+IRATHKYKD
Sbjct:  1 MANKKIRIRLKAYEHRTLDTAAEKIVETATRTGASVAGPVPLPTERSLYTVIPATHKYKD   60

Query: 61 SREQFEMRTHKRLVDIINPTQKTVDALMKLDLPSGVNVEIKL                   102
          SREQFEMRTHKRL+DI+NPTQKTVDALMKLDLPSGVNVEIKL
Sbjct: 61 SREQFEMRTHKRLIDIVNPTQKTVDALMKLDLPSGVNVEIKL                   102
```

A related DNA sequence was identified in *S. pyogenes* <SEQ ID 6409> which encodes the amino acid sequence <SEQ ID 6410>. Analysis of this protein sequence reveals the following:

```
Possible site: 37
>>> Seems to have no N-terminal signal sequence

----- Final Results -----
            bacterial cytoplasm --- Certainty = 0.3160(Affirmative) < succ>
            bacterial membrane  --- Certainty = 0.0000(Not Clear)   < succ>
             bacterial outside  --- Certainty = 0.0000(Not Clear)   < succ>
```

An alignment of the GAS and GBS proteins is shown below.

```
Identities = 102/102 (100%), Positives = 102/102 (100%)

Query:  1 MANKKIRIRLKAYEHRTLDTAAEKIVETATRTGATVAGPVPLPTERSLYTIIRATHKYKD   60
          MANKKIRIRLKAYEHRTLDTAAEKIVETATRTGATVAGPVPLPTERSLYTIIRATHKYKD
Sbjct:  1 MANKKIRIRLKAYEHRTLDTAAEKIVETATRTGATVAGPVPLPTERSLYTIIRATHKYKD   60

Query: 61 SREQFEMRTHKRLVDIINPTQKTVDALMKLDLPSGVNVEIKL                   102
          SREQFEMRTHKRLVDIINPTQKTVDALMKLDLPSGVNVEIKL
Sbjct: 61 SREQFEMRTHKRLVDIINPTQKTVDALMKLDLPSGVNVEIKL                   102
```

Based on this analysis, it was predicted that this protein and its epitopes, could be useful antigens for vaccines or diagnostics.

EXAMPLE 2071

A DNA sequence (GBSx2186) was identified in *S. agalactiae* <SEQ ID 6411> which encodes the amino acid sequence <SEQ ID 6412>. Analysis of this protein sequence reveals the following:

```
Possible site: 34
>>> Seems to have no N-terminal signal sequence

----- Final Results -----
           bacterial cytoplasm --- Certainty = 0.2538(Affirmative) < succ>
           bacterial membrane  --- Certainty = 0.0000(Not Clear)   < succ>
             bacterial outside --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 2072

A DNA sequence (GBSx2187) was identified in *S. agalactiae* <SEQ ID 6413> which encodes the amino acid sequence <SEQ ID 6414>. Analysis of this protein sequence reveals the following:

```
Possible site: 46
>>> Seems to have no N-terminal signal sequence
    INTEGRAL    Likelihood = -11.41    Transmembrane    88-104  (79-110)
    INTEGRAL    Likelihood =  -8.39    Transmembrane   304-320  (300-324)
    INTEGRAL    Likelihood =  -6.58    Transmembrane   185-201  (180-206)
    INTEGRAL    Likelihood =  -5.63    Transmembrane   338-354  (331-357)
    INTEGRAL    Likelihood =  -5.52    Transmembrane   240-256  (237-259)
    INTEGRAL    Likelihood =  -4.99    Transmembrane   383-399  (375-407)
    INTEGRAL    Likelihood =  -3.82    Transmembrane    49-65   (48-73)
    INTEGRAL    Likelihood =  -2.87    Transmembrane   127-143  (121-144)
    INTEGRAL    Likelihood =  -2.81    Transmembrane   159-175  (159-177)
    INTEGRAL    Likelihood =  -2.18    Transmembrane    30-46   (30-47)

----- Final Results -----
            bacterial membrane  --- Certainty = 0.5564(Affirmative) < succ>
             bacterial outside  --- Certainty = 0.0000(Not Clear)   < succ>
           bacterial cytoplasm  --- Certainty = 0.0000(Not Clear)   < succ>
```

The protein has homology with the following sequences in the GENPEPT database.

```
>GP: BAB06655 GB: AP001517 unknown conserved protein
[Bacillus halodurans]
Identities = 132/423 (31%), Positives = 210/423 (49%), Gaps = 16/423 (3%)

Query:   7 IIQLAIPAMIENILQMLMGVVDNYLVAQLGVVAVSGVSVANNIITIYQAIF--IALGASI    64
           + L P IE +L MLMG D  +++Q   AV+ V V+N I+ +   +F +A G SI
Sbjct:  11 LFALTWPIFIEILLHMLMGNADTLMLSQYSDDAVAAVGVSNQILAVIIVMFGFVATGTSI   70

Query:  65 ASLLAKSLAGSKKDDAISVCSQAIFLTLLIGAVLGIISIVFGQTFFKLLGTTKSVAQVGG  124
           L+A+ L   ++++A  V  +I   L+  G VLG++ I FG    K +    S+ Q
Sbjct:  71 --LVAQHLGAKERENAGKVAVVSIGANLIFGIVLGLLLIAFGPPILKAMQLDDSLLQEAT  128

Query: 125 LYLAIVGGGVVTLGMLTTLGSFLRVGQPRLPMYVSIFVNFLNAVLSGFAIFEWR----Y  180
           LYL IVGG V  ++ T G+ LR    MYV+I +N LN + +   IF
Sbjct: 129 LYLQIVGGFSVVQSLIMTAGAILRSHSFTKDVMYVTIGMNILNVIGNYLFIFGPFGIPVL  188

Query: 181 GLVGVAVSTLIARLIGICILAKYL--------PIKKIIKRMTWKISAQIWNLALPSAGER  232
           G+ GVA+ST+++R IG+ ++A  L         P  ++KR     +    + +PSAGE+
Sbjct: 189 GVTGVALSTVVSRTIGLFVIAILLYKRIRGELPFAYLLKRFPRVELRNLLKIGIPSAGEQ  248

Query: 233 LMNRAGDVVIVAIVVQLGTNVVAGNAIGETLTQFNYMPGLGIATATIILTAKYVGQKNRE  292
            L   A +VI +  +GT  +      + L F ++  + I   T IL    VG K +
Sbjct: 249 LSYNASQLVITYFIAMMGTEALTTKVYTQNLMMFVFLFAVAIGQGTQILIGHQVGAKQIQ  308

Query: 293 SIEETIQSSYYIGLVLMILISSFMLLAGKPLTQLFTNNPSAIKGSLIVILLSFVGVPATI  352
           +        S +I + + ++       PL +FT+NP +    ++LL+ +  P
Sbjct: 309 AAYVRCFRSLWIAMTVSVSMAVVFFAFSTPLLGIFTDNPDILSLGTTLLLLTIILEPGRA  368

Query: 353 GTLVYTAAWQGLGNAKLPFYTTTIGMWLIRVVLGYLLGIVFELGLLGVWMATIADNIFRW  412
           L +     V   ++ G+ K P Y   + MW I V + YLLG+    LGL+GVW +A IAD   FR
Sbjct: 369 CNLVVISSLRAAGDVKFPVYLAIVSMWGIAVPIAYLLGLPLGLGLIGVWIAFIADEWFRG  428

Query: 413 LFL                                                          415
           L +
Sbjct: 429 LLM                                                          431
```

A related DNA sequence was identified in *S. pyogenes* <SEQ ID 6415> which encodes the amino acid sequence <SEQ ID 6416>. Analysis of this protein sequence reveals the following:

```
Possible site: 48
>>> Seems to have no N-terminal signal sequence
      INTEGRAL      Likelihood = -5.26     Transmembrane     89-105  (85-108)
      INTEGRAL      Likelihood = -4.35     Transmembrane    305-321  (302-322)
      INTEGRAL      Likelihood = -3.82     Transmembrane    161-177  (161-180)
      INTEGRAL      Likelihood = -3.82     Transmembrane    192-208  (189-208)
      INTEGRAL      Likelihood = -3.77     Transmembrane    129-145  (128-151)
      INTEGRAL      Likelihood = -3.24     Transmembrane    242-258  (240-258)
      INTEGRAL      Likelihood = -2.81     Transmembrane    378-394  (377-394)
      INTEGRAL      Likelihood = -2.66     Transmembrane    339-355  (338-358)
      INTEGRAL      Likelihood = -2.60     Transmembrane     58-74   (58-75)
      INTEGRAL      Likelihood = -2.50     Transmembrane     32-48   (32-49)

----- Final Results -----
             bacterial membrane --- Certainty = 0.3102(Affirmative) < succ>
             bacterial outside  --- Certainty = 0.0000(Not Clear)   < succ>
             bacterial cytoplasm --- Certainty = 0.0000(Not Clear)  < succ>
```

The protein has homology with the following sequences in the databases:

```
>GP: BAB06655 GB: AP001517 unknown conserved
protein [Bacillus halodurans]
Identities = 119/435 (27%), Positives = 214/435 (48%),
Gaps = 14/435 (3%)

Query:   9 IFSLALPSMIENILQMLMGMVDNYLVAQIGLVAVSGVSIANNIISIYQSLFIALGAAVSS    68
           +F+L  P  IE +L MLMG  D   +++Q     AV+ V ++N I+++   +F +    S
Sbjct:  11 LFALTWPIFIEILLHMLMGNADTLMLSQYSDDAVAAVGVSNQILAVIIVMFGFVATGTSI   70

Query:  69 LIARSIGENNQNKQLNYMAGVLQVTLLLSVGLGLLSVAGHHQVLEWLGAEASVTLVGGQY   128
           L+A+ +G +             L+  + LGLL +A    +L+ +    + S+        Y
Sbjct:  71 LVAQHLGAKERENAGKVAVVSIGANLIFGIVLGLLLIAFGPPILKAMQLDDSLLQEATLY   130

Query: 129 LSIVGGMIVSLGLLTSLGAIVRAQGYPKIPMQVSLLINVLNAIFSALSIY----VWGFGL   184
           L IVGG V  L+ +  GAI+R+ +  K  M V++ +N+LN I + L  I+      +  G+
Sbjct: 131 LQIVGGFSVVQSLIMTAGAILRSHSFTKDVMYVTIGMNILNVIGNYLFIFGPFGIPVLGV   190

Query: 185 LGVAWATVLSRLVGVFLLCQF--------IPIKQVAKRLMRPLDKIIFDLSLPAAGERLM   236
             GVA +TV+SR +G+F++            +P   + KR R    +  +  +P+AGE+L
Sbjct: 191 TGVALSTVVSRTIGLFVIAILLYKRIRGELPFAYLLKRFPRVELRNLLKIGIPSAGEQLS   250

Query: 237 MRAGDVLIIGIVVRFGTTALAGNAIGETLTQFNYMPGLAMATATIILVARQLGGGKVTEI   296
            A  ++I  +     GT AL    +  L  F ++  +A+  T IL+  Q+G   ++
Sbjct: 251 YNASQLVITYFIAMMGTEALTTKVYTQNLMMFVFLFAVAIGQGTQILIGHQVGAKQIQAA   310

Query: 297 RYIIREAFILSTLMMLVMGALTYLLGPSLLPLFTQNTDAQRSAMIVLLFSLLGAPATAGT   356
                 +   ++  + + M   +    LL +FT N D       +LL +++  P   A
Sbjct: 311 YVRCFRSLWIAMTVSVSMAVVFFAFSTPLLGIFTDNPDILSLGTTLLLLTIILEPGRACN   370

Query: 357 LVYTAVWQGLGKAKLPFYATTIGMWVIRIGLGYVIGVVWQYGLIGVWMATVLDNTSRWFI   416
            LV +  + G  K P Y    + MW I + + Y++G+     GLIGVW+A + D   R +
Sbjct: 371 LVVISSLRAAGDVKFPVYLAIVSMWGIAVPIAYLLGLPLGLGLIGVWIAFIADEWFRGLL   430

Query: 417 LSKHFK--KYQEITF                                               429
             +    ++  K+QE++F
Sbjct: 431 MIWRWRKGKWQEMSF                                               445
```

An alignment of the GAS and GBS proteins is shown below.

```
Identities = 219/418 (52%), Positives = 316/418 (75%)

Query:   5 KEIIQLAIPAMIENILQMLMGVVDNYLVAQLGVVAVSGVSVANNIITIYQAIFIALGASI    64
           ++I  LA+P+MIENILQMLMG+VDNYLVAQ+G+VAVSGVS+ANNII+IYQ++FIALGA++
Sbjct:   7 RKIFSLALPSMIENILQMLMGMVDNYLVAQIGLVAVSGVSIANNIISIYQSLFIALGAAV    66

Query:  65 ASLLAKSLAGSKKDDAISVCSQAIFLTLLIGAVLGIISIVFGQTFFKLLGTTKSVAQVGG   124
           +SL+A+S+   + ++  ++  +   +TLL+  LG++S+      + LG   SV  VGG
Sbjct:  67 SSLIARSIGENNQNKQLNYMAGVLQVTLLLSVGLGLLSVAGHHQVLEWLGAEASVTLVGG   126
```

-continued

```
Query: 125 LYLAIVGGGVVTLGMLTTLGSFLRVQGQPRLPMYVSIFVNFLNAVLSGFAIFEWRYGLVG 184
            YL+IVGG +V+LG+LT+LG+ +R QG P++PM VS+ +N LNA+ S  +I+ W +GL+G
Sbjct: 127 QYLSIVGGMIVSLGLLTSLGAIVRAQGYPKIPMQVSLLINVLNAIFSALSIYVWGFGLLG 186

Query: 185 VAVSTLIARLIGICILAKYLPIKKIIKRMTWKISAQIWNLALPSAGERLMMRAGDVVIVA 244
            VA +T+++RL+G+ +L +++PIK++ KR+    + I++L+LP+AGERLMMRAGDV+I+
Sbjct: 187 VAWATVLSRLVGVFLLCQFIPIKQVAKRLMRPLDKIIFDLSLPAAGERLMMRAGDVLIIG 246

Query: 245 IVVQLGTNVVAGNAIGETLTQFNYMPGLGIATATIILTAKYVGQKNRESIEETIQSSYYI 304
            IVV+ GT  +AGNAIGETLTQFNYMPGL +ATATIIL A+ +G     I  I+ ++ +
Sbjct: 247 IVVRFGTTALAGNAIGETLTQFNYMPGLAMATATIILVARQLGGGKVTEIRYIIREAFIL 306

Query: 305 GLVLMILISSFMLLAGKPLTQLFTNNPSAIKGSLIVILLSFVGVPATIGTLVYTAAWQGL 364
            ++M+++ +   L G  L  LFT N  A + ++IV+L S +G PAT GTLVYTA WQGL
Sbjct: 307 STLMMLVMGALTYLLGPSLLPLFTQNTDAQRSAMIVLLFSLLGAPATAGTLVYTAVWQGL 366

Query: 365 GNAKLPFYTTTIGMWLIRVVLGYLLGIVFELGLLGVWMATIADNIFRWLFLKVHYHRY 422
            G AKLPFY TTIGMW+IR+ LGY++G+V++ GL+GVWMAT+ DN  RW  L  H+ +Y
Sbjct: 367 GKAKLPFYATTIGMWVIRIGLGYVIGVVWQYGLIGVWMATVLDNTSRWFILSKHFKKY 424

Identities = 48/211 (22%), Positives = 89/211 (41%),
Gaps = 29/211 (13%)

Query: 213 MTWKISAQIWNLALPSAGERLMMRAGDVVIVAIVVQLGTNVVAGNAIGETLTQFNYMPGL 272
            M +    +I++LALPS  E ++    +V   +V Q+G   V+G +I +          +
Sbjct:   1 MIYNNRRKIFSLALPSMIENILQMLMGMVDNYLVAQIGLVAVSGVSIANNIISIYQSLFI  60

Query: 273 GIATATIILTAKYVGQKNRESIEETIQSSYYIGLVLMILISSFML--------------L 318
            +  A   L A+ +G+ N+       Q +Y G++ + L+ S  L              L
Sbjct:  61 ALGAAVSSLIARSIGENNQNK-----QLNYMAGVLQVTLLLSVGLGLLSVAGHHQVLEWL 115

Query: 319 AGKPLTQLFTNNPSAIKGSLIVILLSFVGVPATIGTLVYTAAWQGLGNAKLPFYTTTIGM 378
            +    L    +I G +IV L   G+ ++G +V      + G  K+P   + +
Sbjct: 116 GAEASVTLVGGQYLSIVGGMIVSL----GLLTSLGAIV-----RAQGYPKIPMQVSLL-I 165

Query: 379 WLIRVVLGYLLGIVFELGLLGVWMATIADNI                             409
            ++ +   L   V+  GLLGV  AT+  +
Sbjct: 166 NVLNAIFSALSIYVWGFGLLGVAWATVLSRL                              196
```

A related GBS gene <SEQ ID 8971> and protein <SEQ ID 8972> were also identified. Analysis of this protein sequence reveals the following:

```
Lipop: Possible site: -1 Crend: 5
McG: Discrim Score: -0.68
GvH: Signal Score (-7.5): -1.3
     Possible site: 46

>>> Seems to have no N-terminal signal sequence

ALOM program count: 10 value: -11.41 threshold: 0.0
    INTEGRAL     Likelihood = -11.41    Transmembrane   88-104  (79-110)
    INTEGRAL     Likelihood =  -8.39    Transmembrane  304-320 (300-324)
    INTEGRAL     Likelihood =  -6.58    Transmembrane  185-201 (180-206)
    INTEGRAL     Likelihood =  -5.63    Transmembrane  338-354 (331-357)
    INTEGRAL     Likelihood =  -5.52    Transmembrane  240-256 (237-259)
    INTEGRAL     Likelihood =  -4.99    Transmembrane  383-399 (375-407)
    INTEGRAL     Likelihood =  -3.82    Transmembrane   49-65  (48-73)
    INTEGRAL     Likelihood =  -2.87    Transmembrane  127-143 (121-144)
    INTEGRAL     Likelihood =  -2.81    Transmembrane  159-175 (159-177)
    INTEGRAL     Likelihood =  -2.18    Transmembrane   30-46  (30-47)
    PERIPHERAL   Likelihood =   0.32    11
modified ALOM score: 2.78

*** Reasoning Step: 3

----- Final Results -----
          bacterial membrane --- Certainty = 0.5564(Affirmative) < succ>
           bacterial outside --- Certainty = 0.0000(Not Clear)   < succ>
         bacterial cytoplasm --- Certainty = 0.0000(Not Clear)   < succ>
```

The protein has homology with the following sequences in the databases:

```
ORF01629(313-1533 of 1878)
EGAD|165726|TM0815(20-436 of 464)conserved hypothetical protein{Thermotoga
maritima}OMNI|TM0815 conserved hypothetical protein
GP|4981345|gb|AAD35897.1|AE001748_13|AE001748 conserved hypothetical protein
{Thermotoga maritima}PIR|H72331|H72331 conserved hypothetical protein-Thermotoga
maritima(strain MSB8)
% Match = 13.9
% Identity = 29.4  % Similarity = 53.7
Matches = 120  Mismatches = 183  Conservative Sub.s = 99
        48        78       108       138       168       198       228       258
YK*RRDTGFRCYFNLKRFVRCFFT*GGYRSTKGRSNP*NGSTYLKYARNG*RVSRFETIIKIRLF*NI*SEKETF*KFSH M
       288       318       348       378       408       438       468       498
HSLFNDPG**KGDTVRYSKEIIQLAIPAMIENILQMLMGVVDNYLVAQLGVVAVSGVSVANNIITIYQAIFIALGASIAS
             |:|:|||  |||  ||:|||  |:    ::  :    |:|||  ::| :   :    | ::||
RYSLFKNYLPKEEVPEIRKELIKLALPAMGENVLQMLFGMADTAFLGHYSWKAMSGVGLSNQVFWVVQVVLIAASMGATV
                      20        30        40        50        60        70        80
       528       558       588       609       639       669       699       729
LLAKSLAGSKKDDAISVCSQAIFLTLLIGAVL---GIISIVFGQTFFKLLGTTKSVAQVGGLYLAIVGGGVVTLGMLTTL
 :|  ::     :      |:    ::||  ::    : |     :| |:    |    |     || ::    |:   ::    :
TIANAIGAGNRKAVRSLAWNSVFLAIFTGVILTALTPLSDVLINIFPNLEGEIESSA---KEYLKVILSGSMGFSIMAVF
                 100       110       120       130       140       150
       759       789       819       837       867       897       909       939
GSFLRVQGQPRLPMYVSIFVNFLNAVLSGFAIF----EWRYGLVGVAVSTLIARLIGICILA------KYLPIKKIIKRM
  :  ||    |    | ||:::|::  |||    |||       |:  |:::|::|  ||          :  :::| :
SAMLRGAGDTRTPMIVTGLTNFLNIFLDYAMIFGKFGFPEMGVRGAAVATILSRFVGAGILTYVIFKREEFQLRKGLVPP
                 170       180       190       200       210       220       230
       969       999      1029      1059      1089      1119      1149      1179
TWKISAQIWNLALPSAGERLMMRAGDVVIVAIVVQLGTNVVAGNAIGETLTQFNYMPGLGIATATIILTAKYVGQKNRES
  |    :|  :  :|:|  |   ::    |  ::   |::   ||:  ||  :  :::|  :|      |    :|  |  |:|
KWSSQKEILRVGFPTAIENFVFSTGVLMFANILLIAGAEYAGHRAIGINVESLSFMPAFGISVAITTLVGRYNGMGNKEH
                 250       260       270       280       290       300       310
      1209      1239      1269      1299      1329      1359      1383      1413
IEETIQSSYYIGLVLMILISSFMLLAGKPLTQLFTNNPSAIKGSLIVILLSFVGVPATIGTLVYT--AAWQGLGNAKLPF
 :   :  :   |: :  :  ::|       :|| ::||: :|   :       |     |        |  :||     |
VLGVIRQGWILSLLFQVTVGIIIFLFPEPLIRIFTSDPQIIEISKLPV--KIIGLFQFFLAIDSTMNGALRGTGNTLPPM
                 330       340       350       360       370       380       390
      1443      1473      1503      1533      1563      1593      1623      1653
YTTTIGMWLIRVVLGYLLGIVFELGLLGVWMATIADNIFRWLFLKVYHHRYIQKM*PEMVAFFSKIIK*CLRVLFFFDII
  |  |  :|    |:  :  :::       |:|||||   |:    |||   |||
IITFISIWTARLPVAFVMVKYFQLGLLGAWIGMIADIIFRSTLKLLFFLSGKWEKRAVLTRERVKELG
                 410       420       430       440       450
```

Based on this analysis, it was predicted that these proteins and their epitopes could be useful antigens for vaccines or diagnostics.

EXAMPLE 2073

A DNA sequence (GBSx2188) was identified in *S. agalactiae* <SEQ ID 6417> which encodes the amino acid sequence <SEQ ID 6418>. Analysis of this protein sequence reveals the following:

```
Possible site: 20
>>> Seems to have no N-terminal signal sequence

----- Final Results -----
         bacterial cytoplasm --- Certainty = 0.2200(Affirmative) < succ>
          bacterial membrane --- Certainty = 0.0000(Not Clear)   < succ>
            bacterial outside --- Certainty = 0.0000(Not Clear)   < succ>
```

The protein has homology with the following sequences in the GENPEPT database.

```
>GP: AAD05671 GB: AE001448 THREONINE SYNTHASE [Helicobacter pylori
J99]
Identities = 161/479 (33%), Positives = 259/479 (53%),
Gaps = 17/479 (3%)

Query:  14 KVTASQAILKGLADDGGLFTPITFPKVDLDFTKLKDASYQEVAKLVLSAFFDDFTEQELD  73
            K+  +A+L  A  GGL+T  F    L++      SY E+ + V    +  +  L
Sbjct:  13 KIDFIEAVLNPNAPKGGLYTLEHFET--LEWQDCLGMSYSELVEHVFELLNLEIPKNLLA  70
```

-continued

```
Query:  74 YCISQAYDTKFDTTEIAPIVKIGDRYHL-ELFHGPTIAFKDMALSILPYLLTTAAKKQGV 132
           + + Y+  +     API  + +R  + EL+HGP++AFKDMAL  L  L +  A    G
Sbjct:  71 SALKR-YENFDNPKNPAPIFALNERLFVQELYHGPSLAFKDMALQPLASLFSNLAV--GK 127

Query: 133 DNKIVILTATSGDTGKAAMAGFADVPGTEIIVFYPKNGVSYIQELQMITQAGQNTHVVAI 192
           + K ++L +TSGDTG  A + G A +P   ++   YPK+G S +Q+LQM+TQ   N  V  +
Sbjct: 128 NEKYLVLVSTSGDTGPATLEGLAGMPNVFVVCLYPKDGTSLVQKLQMVTQNASNLKVFGV 187

Query: 193 EGNFDDAQTSVKEMFNNSLLRLKLSQQHMQLSSANSMNIGRLVPQIVYYIYAYAQLVKSK 252
             G+FDDAQ ++K +  +       L  +  ++LS ANS+N GR+  QIVY+I+ + +L K
Sbjct: 188 SGDFDDAQNALKNLLKDDDFNEALKARQLKLSVANSVNFGRIAFQIVYHIWGFLELYKKG 247

Query: 253 EISIGQPINFSVPTGNFGNILAAYYASQIGLPVTKLICASNDNNVLTDFFKTQTYD-KNR 311
             I+  + I    ++P+GNFGN L A+YA ++GL +  K+     +N N+VL +F  +T    YD     R
Sbjct: 248 AINSKEKITLAIPSGNFGNALGAFYAKKMGLNIAKIKVVTNSNDVLREFIETGRYDLTKR 307

Query: 312 EFKVTSSPSMDILVSSNLERLIFHLLGDDAETTKKLMEDLVTTGEYALEARQANIL-ESF 370
              K  T  SP+MDIL  SSN+ER +F  L  G    E T  +LM+  L         YAL+  ++   +L E F
Sbjct: 308 SLKQTFSPAMDILKSSNVERALFSLFG--FERTLELMQALEEEKFYALKPKELALLQEHF 365

Query: 371 VAGFATEQFVELDIKHLFDQYQYIEDPHTAVASAVYQAYQTETKDQTPAVIVSTASPYKF 430
                    +++     I+ ++ ++QY+ DPHTA        A        K       ++ +TAS   KF
Sbjct: 366 SCASCSDEDCLKTIQEVYAEHQYLIDPHTAT------ALNASLKTHEKTLVSATASYEKF 419

Query: 431 PCVVTKAIT-NKEEIQDFAAISILNDLSGVSLPKAVTDLQKAEVIHRTVVPTSNMRETV 488
           P     A+   K+    D  AA+  L +            + + DL +   + H+ V+    + ++ ++
Sbjct: 420 PKTTLLALNEQKKNDDDKAALETLKNSYNTPDSQRLDDLFERGIKHQEVLKLNEIKSSI 478
```

No corresponding DNA sequence was identified in *S. pyogenes*.

Based on this analysis, it was predicted that this protein and its epitopes, could be useful antigens for vaccines or diagnostics.

EXAMPLE 2074

A DNA sequence (GBSx2189) was identified in *S. agalactiae* <SEQ ID 6419> which encodes the amino acid sequence <SEQ ID 6420>. Analysis of this protein sequence reveals the following:

```
Possible site: 27
>>> Seems to have no N-terminal signal sequence

----- Final Results -----
            bacterial cytoplasm --- Certainty = 0.3153(Affirmative) < succ>
            bacterial membrane --- Certainty = 0.0000(Not Clear)   < succ>
             bacterial outside --- Certainty = 0.0000(Not Clear)   < succ>
```

A related GBS nucleic acid sequence <SEQ ID 9279> which encodes amino acid sequence <SEQ ID 9280> was also identified.

The protein has homology with the following sequences in the GENPEPT database.

```
>GP: AAF40975 GB: AE002410 alcohol dehydrogenase, propanol-preferring
[Neisseria meningitidis MC58]
Identities = 202/282 (71%), Positives = 228/282 (80%), Gaps = 1/282 (0%)

Query:   1 MGHEGIGIVEEIGEGVTSLRVGDRVSIAWFFEGCGHCEYCTTGRETLCRSVKNAGYSVDG  60
           +GHEGIG+V+E+ +GV +L+VGDRVSIAW F+ CG CEYC TGRETLCRSV NAGY+ DG
Sbjct:  60 LGHEGIGLVKEVADGVKNLKVGDRVSIAWLFQSCGSCEYCNTGRETLCRSVLNAGYTADG 119

Query:  61 GMSEYAIVTADYAVKVPEGLDPAQASSITCAGVTTYKAIKEAGAAPGQWIAVYGAGGLGN 120
           GM+   + IV+ADYAVKVPEGLDPAQASSITCAGVTTYKAIK +G  PGQWIA YGAGGLGN
Sbjct: 120 GMATHCIVSADYAVKVPEGLDPAQASSITCAGVTTYKAIKVSGVRPGQWIAIYGAGGLGN 179

Query: 121 LAVQYAKKVFNAHVVAVDINADKLQLAKEVGADLTVNGKEIKDVAAYIQEKTGGCHGVVV 180
           L VQYAKKVF AHVVA+DIN DKL  AKE GADL VN  + +D A  IQEKTGG H  VV
Sbjct: 180 LGVQYAKKVFGAHVVAIDINDDKLAFAKETGADLVVNAAK-EDAAKVIQEKTGGAHAAVV 238

Query: 181 TAVSKVAFNQAIDSVRAGGTVVAVGLPSEYMELSIVKTVLDGIRVVGSLVGTRKDLEEAF 240
           TAVS   AFN A++ VRAGG VVA+GLP E M+LSI + VLDGI  VVGSLVGTRKDLEEAF
Sbjct: 239 TAVSAAAFNSAVNCVRAGGRVVAIGLPPESMDLSIPRLVLDGIEVVGSLVGTRKDLEEAF 298
```

```
Query: 241 AFGAEGLVVPVVEKVPVDTAPQVFDEMERGLIQGRKVLDFTK         282
            FGAEGLVVP V+   +D AP +F EM  G I GR V+D  K
Sbjct: 299 QFGAEGLVVPKVQLRALDEAPAIFQEMREGKITGRMVIDMKK        340
```

A related DNA sequence was identified in *S. pyogenes* <SEQ ID 6421> which encodes the amino acid sequence <SEQ ID 6422>. Analysis of this protein sequence reveals the following:

```
Possible site: 31
>>> Seems to have no N-terminal signal sequence

----- Final Results -----
          bacterial cytoplasm --- Certainty = 0.2356(Affirmative) < succ>
          bacterial membrane  --- Certainty = 0.0000(Not Clear)   < succ>
           bacterial outside  --- Certainty = 0.0000(Not Clear)   < succ>
```

An alignment of the GAS and GBS proteins is shown below.

```
Identities = 263/280 (93%), Positives = 273/280 (96%)

Query:   1 MGHEGIGIVEEIGEGVTSLRVGDRVSIAWFFEGCGHCEYCTTGRETLCRSVKNAGYSVDG    60
           +GHEGIGIVEEIGEGVTSL+VGDRVSIAWFFEGCGHCEYCTTGRETLCRSVKNAGYSVDG
Sbjct:  76 LGHEGIGIVEEIGEGVTSLKVGDRVSIAWFFEGCGHCEYCTTGRETLCRSVKNAGYSVDG   135

Query:  61 GMSEYAIVTADYAVKVPEGLDPAQASSITCAGVTTYKAIKEAGAAPGQWIAVYGAGGLGN   120
           GMSEYA+VTADYAVKVPEGLDPAQASSITCAGVTTYKAIKEAGAAPGQWI ++GAGGLGN
Sbjct: 136 GMSEYAVVTADYAVKVPEGLDPAQASSITCAGVTTYKAIKEAGAAPGQWIVIFGAGGLGN   195

Query: 121 LAVQYAKKVFNAHVVAVDINADKLQLAKEVGADLTVNGKEIKDVAAYIQEKTGGCHGVVV   180
           LAVQYAKKVFNAHVVAVDIN DKL+LAKEVGAD+ VNGKEI+DV  YIQEKTGG HGVVV
Sbjct: 196 LAVQYAKKVFNAHVVAVDINNDKLELAKEVGADILVNGKEIEDVPGYIQEKTGGAHGVVV   255

Query: 181 TAVSKVAFNQAIDSVRAGGTVVAVGLPSEYMELSIVKTVLDGIRVVGSLVGTRKDLEEAF   240
           TAVSKVAFNQAIDSVRAGGTVVAVGLPSEYMELSIVKTVLDGI+VVGSLVGTRKDLEEAF
Sbjct: 256 TAVSKVAFNQAIDSVRAGGTVVAVGLPSEYMELSIVKTVLDGIKVVGSLVGTRKDLEEAF   315

Query: 241 AFGAEGLVVPVVEKVPVDTAPQVFDEMERGLIQGRKVLDF                     280
           AFGAEGLV PVVEKVPVDTAP+VFDEMERGLIQGRKVLDF
Sbjct: 316 AFGAEGLVAPVVEKVPVDTAPEVFDEMERGLIQGRKVLDF                     355
```

Based on this analysis, it was predicted that this protein and its epitopes, could be useful antigens for vaccines or diagnostics.

EXAMPLE 2075

A DNA sequence (GBSx2190) was identified in *S. agalactiae* <SEQ ID 6423> which encodes the amino acid sequence <SEQ ID 6424>. Analysis of this protein sequence reveals the following:

```
Possible site: 42
>>> Seems to have a cleavable N-term signal seq.
     INTEGRAL      Likelihood = -9.82    Transmembrane    83-99    (76-108)
     INTEGRAL      Likelihood = -7.27    Transmembrane    46-62    (43-65)
     INTEGRAL      Likelihood = -7.22    Transmembrane   187-203   (182-209)
     INTEGRAL      Likelihood = -6.00    Transmembrane   243-259   (229-262)
     INTEGRAL      Likelihood = -4.25    Transmembrane   404-420   (402-422)
     INTEGRAL      Likelihood = -3.98    Transmembrane   120-136   (119-136)
     INTEGRAL      Likelihood = -3.88    Transmembrane   308-324   (307-324)
     INTEGRAL      Likelihood = -2.13    Transmembrane   378-394   (376-394)
     INTEGRAL      Likelihood = -1.38    Transmembrane   152-168   (152-168)
     INTEGRAL      Likelihood = -1.17    Transmembrane   271-287   (271-287)

----- Final Results -----
           bacterial membrane  --- Certainty = 0.4927(Affirmative) < succ>
           bacterial outside   --- Certainty = 0.0000(Not Clear)   < succ>
           bacterial cytoplasm --- Certainty = 0.0000(Not Clear)   < succ>
```

A related GBS nucleic acid sequence <SEQ ID 9371> which encodes amino acid sequence <SEQ ID 9372> was also identified.

The protein has homology with the following sequences in the GENPEPT database.

```
>GP: AAC17857 GB: AF026147 YojI [Bacillus subtilis]
Identities = 183/432 (42%), Positives = 266/432 (61%), Gaps = 1/432 (0%)

Query:    1 MKLFIPVLIYQFANFSATFIDSVMTGQYSQLHLAGVSTASNLWTPFFALLVGMISALVPV   60
            + + IP+ I Q      TF+D+VM+G+ S    LAGV+  S+LWTP + L G++ A+ P+
Sbjct:   15 LHILIPIFITQAGLSLITFLDTVMSGKVSPADLAGVAIGSSLWTPVYTGLAGILMAVTPI   74

Query:   61 VGQHLGRGNKEQIRTEFHQFLYLGLILSLILFLIMQFIAQPVLGSLGLEDEVLAVGRGYL  120
             V Q LG    K++I    Q +Y+  +LS+ + +I       +LG L L+  V  + +L
Sbjct:   75 VAQLLGAEKKQKIPFTVLQAVYVAALLSIAVLVIGYAAVDLILGRLNLDIHVHQIAKHFL  134

Query:  121 NYMLIGIMPLVLFSICRSFFDALGLTRLSMYLMLLILPFNSFFNYNLIYGKFGMPRLGGA  180
               ++ +GI PL ++++ RSF D+LG TR++M + L  LP N   NY+ I+GKFGMP LGG
Sbjct:  135 GFLSLGIFPLFVYTVLRSFIDSLGKTRVTMMITLSSLPINFVLNYVFIFGKFGMPALGGV  194

Query:  181 GAGLGTSLTYWAIFIVIIIVMSLHPQIKTYHIW-TLERIKAPLIIEDIRLGLPIGLQIFA  239
            GAGL ++LTYW I I+   ++ +     Y I+ T+ +        +++GLPIG  +F
Sbjct:  195 GAGLASALTYWCICIISFFIIHKNAPFSEYGIFLTMYKFSWKACKNLLKIGLPIGFAVFF  254

Query:  240 EVAIFAVVGLFMAKFSSIIIAAHQAAMNFSSLMYAFPLSISTALAITISFEVGAERFQDA  299
            E +IFA V L M+ F ++ IA+HQAAMNF+SL+Y  PLS+S AL I + FE GA RF+DA
Sbjct:  255 ETSIFAAVTLLMSHFHTVTIASHQAAMNFASLLYMLPLSVSMALTIVVGFEAGAARFKDA  314

Query:  300 NTYSRIGRLTAVGITSGTLLFLFLFRENVAAMYNSDPHFVAITAQFLTYSLFFQFADAYA  359
              +YS IG + A+G +  T   + LFRE +A MY SDP   +T  FL Y+LFFQ +DA A
Sbjct:  315 RSYSLIGIMMAIGFSLFTAACILLFREQIAGMYTSDPDVLRLTQHFLIYALFFQLSDAVA  374

Query:  360 APVQGILRGYKDTTKPFMIGAGSYWLCALPLAVILEKNSQLGPFAYWIGLITGIFVCGLF  419
            AP+QG LRGYKD        SYW+  LP+ ++   + LG F YWIGLI G+      +
Sbjct:  375 APIQGALRGYKDVNYTLAAAFVSYWVIGLPVGYMVGTFTSLGAFGYWIGLIAGLAAGAVG  434

Query:  420 LNQRLQKIKKLY                                                 431
            L  RL K++K Y
Sbjct:  435 LFFRLAKLQKRY                                                 446
```

Based on this analysis, it was predicted that this protein and its epitopes, could be useful antigens for vaccines or diagnostics.

EXAMPLE 2076

A DNA sequence (GBSx2191) was identified in *S. agalactiae* <SEQ ID 6425> which encodes the amino acid sequence <SEQ ID 6426>. Analysis of this protein sequence reveals the following:

```
Possible site: 20
>>> Seems to have no N-terminal signal sequence
    INTEGRAL     Likelihood = -2.60     Transmembrane     23-39 (23-39)

----- Final Results -----
         bacterial membrane --- Certainty = 0.2041(Affirmative) < succ>
         bacterial outside  --- Certainty = 0.0000(Not Clear)   < succ>
         bacterial cytoplasm --- Certainty = 0.0000(Not Clear)  < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 2077

A DNA sequence (GBSx2192) was identified in *S. agalactiae* <SEQ ID 6427> which encodes the amino acid sequence <SEQ ID 6428>. Analysis of this protein sequence reveals the following:

```
Possible site: 52
>>> Seems to have no N-terminal signal sequence
```

```
----- Final Results -----
           bacterial cytoplasm --- Certainty = 0.3829(Affirmative) < succ>
           bacterial membrane  --- Certainty = 0.0000(Not Clear)   < succ>
            bacterial outside  --- Certainty = 0.0000(Not Clear)   < succ>
```

The protein has homology with the following sequences in the GENPEPT database.

```
>GP: AAC06891 GB: AE000703 hypothetical protein [Aquifex aeolicus]
Identities = 72/213 (33%), Positives = 115/213 (53%), Gaps = 11/213 (5%)

Query:  36 RPKILMHVCCAPCSTYTLEYLSQ---WADVTIYFANSNIHPKDEYYRREYVTQKFVHDFN   92
           + KIL+H+CCAP + Y L+ L +    +++ YF + NIHP +EY  R   T++     +
Sbjct:   3 KSKILVHICCAPDAIYFLKKLREDYPESEIIGYFYDPNIHPYEEYRLRYLETERICKELG   62

Query:  93 KNTGYSVQFLSAPYEPNEFFKIVHGLEEEPEGGDRCKVCYDFRLDKTAEKAVELGFDYFG  152
                N       +    Y+   + + V G E+EPE G RC++C+D+RL+K+AE A ELG D
Sbjct:  63 IN------LIEGEYDLENWLERVKGYEDEPERGKRCQICFDYRLEKSAEVAKELGCDALT  116

Query: 153 SALTISPHKNSQTINTIGIDVQKIYDTQYLPSDLKKNKGYQRSVEMCKDYDIYRQCYCGC  212
             + L +SP K+    +  G +   K     ++L  D +K   G Q    ++ K+ +IY+Q YCGC
Sbjct: 117 TTLLMSPKKSIPQLKKAGEEATKRTGIEFLAPDYRKGGGTQEMFKLSKEREIYQQDYCGC  176

Query: 213 IFGAKDQGINLLQIKKDAKAFVSDKDGKEEFPN                            245
            I+G   Q    +I  D   F+  + G +E  N
Sbjct: 177 IYGLFKQKNG--KIFWDLVGFLGRRPGSKEERN                            207
```

A related DNA sequence was identified in *S. pyogenes* <SEQ ID 6429> which encodes the amino acid sequence <SEQ ID 6430>. Analysis of this protein sequence reveals the following:

```
Possible site: 55
>>> Seems to have no N-terminal signal sequence

----- Final Results -----
           bacterial cytoplasm --- Certainty = 0.3498(Affirmative) < succ>
           bacterial membrane  --- Certainty = 0.0000(Not Clear)   < succ>
            bacterial outside  --- Certainty = 0.0000(Not Clear)   < succ>
RGD motif: 254-256
```

The protein has homology with the following sequences in the databases:

```
>GP: AAC06891 GB: AE000703 hypothetical protein [Aquifex aeolicus]
Identities = 65/182 (35%), Positives = 106/182 (57%), Gaps = 9/182 (4%)

Query:  39 RPSILMHVCCAPCSTYTLEYLTQF---ADITVYFANSNIHPKDEYHRRAYVTQQFVSEFN   95
           +  IL+H+CCAP + Y L+ L +     ++I  YF + NIHP +EY  R   T++     E
Sbjct:   3 KSKILVHICCAPDAIYFLKKLREDYPESEIIGYFYDPNIHPYEEYRLRYLETERICKELG   62

Query:  96 AKTGNTVQFLEADYVPNEYVRQVRGLEEEPEGGDRCRVCFDYRLDKTAQKAVELGFDYFA  155
              +  +E +Y    ++ +V+G E+EPE G RC++CFDYRL+K+A+ A  ELG D
Sbjct:  63 ------INLIEGEYDLENWLERVKGYEDEPERGKRCQICFDYRLEKSAEVAKELGCDALT  116

Query: 156 SALTISPHKNSQTINDVGIDVQKVYTTKYLPSDFKKNNGYRRSVEMCEEYDIYRQCYCGC  215
             + L +SP K+    +  G +   K     ++L  D++K   G +    ++ +E +IY+Q YCGC
Sbjct: 117 TTLLMSPKKSIPQLKKAGEEATKRTGIEFLAPDYRKGGGTQEMFKLSKEREIYQQDYCGC  176

Query: 216 VY                                                           217
           +Y
Sbjct: 177 IY                                                           178
```

An alignment of the GAS and GBS proteins is shown below.

```
Identities = 184/255 (72%), Positives = 219/255 (85%)

Query:   1 MIDVENILEKMKPNQKINYDWVMQQMVKQWQASDIRPKILMHVCCAPCSTYTLEYLSQWA   60
           MID++ IL  M PNQKINYD VMQQM K W+   +RP ILMHVCCAPCSTYTLEYL+Q A
Sbjct:   4 MIDLQEILANMNPNQKINYDRVMQQMAKVWEKESVRPSILMHVCCAPCSTYTLEYLTQFA   63
```

```
Query:   61 DVTIYFANSNIHPKDEYYRREYVTQKFVHDFNKNTGYSVQFLSAPYEPNEFFKIVHGLEE    120
            D+T+YFANSNIHPKDEY+RR YVTQ+FV +FN  TG +VQFL A Y PNE+ + V GLEE
Sbjct:   64 DITVYFANSNIHPKDEYHRRAYVTQQFVSEFNAKTGNTVQFLEADYVPNEYVRQVRGLEE    123

Query:  121 EPEGGDRCKVCYDFRLDKTAEKAVELGFDYFGSALTISPHKNSQTINTIGIDVQKIYDTQ    180
            EPEGGDRC+VC+D+RLDKTA+KAVELGFDYF SALTISPHKNSQTIN +GIDVQK+Y T+
Sbjct:  124 EPEGGDRCRVCFDYRLDKTAQKAVELGFDYFASALTISPHKNSQTINDVGIDVQKVYTTK    183

Query:  181 YLPSDLKKNKGYQRSVEMCKDYDIYRQCYCGCIFGAKDQGINLLQIKKDAKAFVSDKDGK    240
            YLPSD KKN GY+RSVEMC++YDIYRQCYCGC++ AK QGI+L+Q+KKDAKAF++DKD
Sbjct:  184 YLPSDFKKNNGYRRSVEMCEEYDIYRQCYCGCVYAAKMQGIDLVQVKKDAKAFMADKDLD    243

Query:  241 EEFPNIRFTFNGKSM                                              255
            +F +IRF++ G  M
Sbjct:  244 NDFTHIRFSYRGDEM                                              258
```

Based on this analysis, it was predicted that this protein and its epitopes, could be useful antigens for vaccines or diagnostics.

EXAMPLE 2078

A DNA sequence (GBSx2193) was identified in *S. agalactiae* <SEQ ID 6431> which encodes the amino acid sequence <SEQ ID 6432>. Analysis of this protein sequence reveals the following:

```
Possible site: 53
>>> Seems to have no N-terminal signal sequence

----- Final Results -----
           bacterial cytoplasm --- Certainty = 0.4216(Affirmative) < succ>
           bacterial membrane  --- Certainty = 0.0000(Not Clear)   < succ>
            bacterial outside  --- Certainty = 0.0000(Not Clear)   < succ>
```

The protein has homology with the following sequences in the GENPEPT database.

```
>GP: CAB14809 GB: Z99118 excinuclease ABC (subunit C) [Bacillus subtilis]
Identities = 189/333 (56%), Positives = 244/333 (72%)

Query:    1 MNELIKHKLELLPDSPGCYLHKDKNGTIIYVGKAKNLKNRVKSYFHGSHNTKTELLVSEI    60
            MN+ +K KL LLPD PGCYL KD+  T+IYVGKAK LKNRV+SYF GSH+ KT+ LV+EI
Sbjct:    1 MNKQLKEKLALLPDQPGCYLMKDRQQTVIYVGKAKVLKNRVRSYFTGSHDAKTQRLVTEI    60

Query:   61 EDFEYIVTTSNTEALLLEINLIQENMPKYNIRLKDDKSYPYIKITNERYPRLMITRQVKK    120
            EDFEYIVT+SN EAL+LE+NLI+++ PKYN+ LKDDK+YP+IK+T+ER+PRL++TR VKK
Sbjct:   61 EDFEYIVTSSNLEALILEMNLIKKHDPKYNVMLKDDKTYPFIKLTHERHPRLIVTRNVKK    120

Query:  121 SDGTYFGPYPDSGAATEIKRLLDRLFPFKKCTNPANKVCFYYHLGQCNAHTVCQTNKAYW    180
              G YFGPYP+  AA E K+LLDRL+P +KC+   ++VC YYHLGQC A V    ++
Sbjct:  121 DKGRYFGPYPNVQAARETKKLLDRLYPLRKCSKLPDRVCLYYHLGQCLAPCVKDISEETN    180

Query:  181 DSLREDVKQFLNGKDNKIVNGLTEKMKSAAMTMEFERAAEYRDLIEAISLLRTKQRVIHQ    240
              L E + +FL G  N++  L EKM AA  +EFERA E RD I  I    KQ++
Sbjct:  181 RELVESITRFLRGGYNEVKKELEEKMHEAAENLEFERAKELRDQIAHIESTMEKQKMTMN    240

Query:  241 DMKDRDVFGYFVDKGWMCVQVFFVRNGKLIQRDVNMFPYYNEPEEDFLTYIGQFYQDTKH    300
            D+ DRDVF Y  DKGWMCVQVFF+R GKLI+RDV MFP Y E +E+FLT+IGQFY    H
Sbjct:  241 DLVDRDVFAYAYDKGWMCVQVFFIRQGKLIERDVSMFPLYQEADEEFLTFIGQFYSKNNH    300

Query:  301 FLPKEVFIPQDIDAKSVETIVGCKIVKPQRGKR                            333
            FLPKE+ +P  ID  +E ++   + +P++G +
Sbjct:  301 FLPKEILVPDSIDQSMIEQLLETNVHQPKKGPK                            333
```

There is also homology to SEQ ID 2568.

Based on this analysis, it was predicted that this protein and its epitopes, could be useful antigens for vaccines or diagnostics.

EXAMPLE 2079

A DNA sequence (GBSx2194) was identified in *S. agalactiae* <SEQ ID 6433> which encodes the amino acid sequence <SEQ ID 6434>. This protein is predicted to be maltose operon transcriptional repressor (rbsR). Analysis of this protein sequence reveals the following:

```
Possible site: 52
>>> Seems to have no N-terminal signal sequence

----- Final Results -----
            bacterial cytoplasm --- Certainty = 0.3761(Affirmative) < succ>
             bacterial membrane --- Certainty = 0.0000(Not Clear)   < succ>
              bacterial outside --- Certainty = 0.0000(Not Clear)   < succ>
```

A related GBS nucleic acid sequence <SEQ ID 9393> which encodes amino acid sequence <SEQ ID 9394> was also identified.

The protein has homology with the following sequences in the GENPEPT database.

```
>GP: AAD02112 GB: AF039082 putative maltose operon transcriptional
repressor [Lactococcus lactis]
Identities = 64/166 (38%), Positives = 105/166 (62%), Gaps = 13/166 (7%)

Query:   1 MGKSAIDYLYKKGHKSIQFVTDDLNSEVSEERYLGYFKGARKLGLNQKPALLFDRGNPQV   60
            +G+ A+  L +  H++I FVTD   +EV EERY G+   A +LGL+     LLF   N   +
Sbjct: 169 LGREAVRLLAQLNHQNISFVTDTKETEVFEERYQGFKDEAERLGLSHD--LLFMDSNFSL 226

Query:  61 LEEFINRVKEEETTALIVIGDTVSRVMQFLSFYKLKVPDDISIMTFNNSLFSHLIHPYL  120
            E            TAL+V+ D +S++V++ L     L  VP+D+S++T+NNS+F   +IHPYL
Sbjct: 227 RNE---------TALVVMDDVLSLKVVERLRSQGLNVPEDVSLITYNNSIFGAMIHPYL 276

Query: 121 STFDINVNNLGRTSVRRLIDIIKSPDKVFSETIIVPFTLEERESVR              166
           +TFDI++  LG ++++++D+  + + +  +TII PF L  RES +
Sbjct: 277 TTFDIHIEQLGASAIKKILDLRDNKENLPEKTII-PFELIVRESTK                321
```

There is also homology to SEQ ID 5082.

Based on this analysis, it was predicted that this protein and its epitopes, could be useful antigens for vaccines or diagnostics.

EXAMPLE 2080

A DNA sequence (GBSx2195) was identified in *S. agalactiae* <SEQ ID 6435> which encodes the amino acid sequence <SEQ ID 6436>. This protein is predicted to be 4-alpha-glucanotransferase (malQ). Analysis of this protein sequence reveals the following:

```
Possible site: 30
>>> Seems to have no N-terminal signal sequence

----- Final Results -----
            bacterial cytoplasm --- Certainty = 0.2003(Affirmative) < succ>
             bacterial membrane --- Certainty = 0.0000(Not Clear)   < succ>
              bacterial outside --- Certainty = 0.0000(Not Clear)   < succ>
```

The protein has homology with the following sequences in the GENPEPT database.

```
>GP: AAA26923 GB: J01796 amylomaltase [Streptococcus pneumoniae]
Identities = 250/500 (50%), Positives = 329/500 (65%), Gaps = 4/500 (0%)
Query:   1 MKKRASGVLMHITSLPGDLGIGTFGREAYAFVDFLVETDQKFWQILPLTTTSFGDSPYQS   60
            MKKR SGVLMHI+SLPG  GIG+FG+  AY FVDFLV T Q++WQILPL  TS+GDSPYQS
Sbjct:   1 MKKRQSGVLMHISSLPGAYGIGSFGQSAYDFVDFLVRTKQRYWQILPLGATSYGDSPYQS   60

Query:  61 FSAVAGNTHLIDFDLLTLEGFISKDDYQNISFGQDPEVVDYAGLFEKRRPVLEKAVKNFL  120
```

```
            FSA AGNTH ID D+L  +G +    D + + FG D    VDYA ++  RRP+LEKAVK F
Sbjct:   61 FSAFAGNTHFIDLDILVEQGLLEASDLEGVDFGSDASEVDYAKIYYARRPLLEKAVKRFF 120

Query:  121 QEERATRMLSDFLQE-EKWVTDFAEFMAIKEHFGNKALQEWDDKAIIRREEEALAGYRQK  179
             E    +    F Q+ + W+  FAE+MAIKE+F N A  EW D    R+  AL  YR++
Sbjct:  121 -EVGDVKDFEKFAQDNQSWLELFAEYMAIKEYFDNLAWTEWPDADARARKASALESYREQ 179

Query:  180 LSEVIKYHEVTQYFFYKQWFELKEYANDKGIQIIGDMPIYVSADSVEVWTMPELFKLDRD  239
            L++ + YH VTQYFF++QW +LK YAND  I+I+GDMPIYV+ DS ++W  P LFK D +
Sbjct:  180 LADKLVYHRVTQYFFFQQWLKLKAYANDNHIEIVGDMPIYVAEDSSDMWANPHLFKTDVN 239

Query:  240 KQPLAIAGVPADDFSDDGQLWGNPIYNWDYHKESDFDWWIYRIQSGVKMYDYLRIDHFKG  299
              +   IAG P D+FS  GQLWGNPIY+W+     + + WWI R++   K+YD +RIDHF+G
Sbjct:  240 GKATCIAGCPPDEFSVTGQLWGNPIYDWEAMDKDGYKWWIERLRESFKIYDIVRIDHFRG 299

Query:  300 FSDYWEIRGDYQTANDGSWQPAPGPELFATIKEKLGDLPIIAENLGYIDERAERLLAGTG  359
              F    YWEI     TA  G W   PG +LFA +KE+LG+L IIAE+LG++ +    L  TG
Sbjct:  300 FESYWEIPAGSDTAAPGEWVKGPGYKLFAAVKEELGELNIIAEDLGFMTDEVIELRERTG 359

Query:  360 FPGMKIMEFGFYDTTGNSIDIPHNYTENTIAYAGTHDNEVINGWFEN-LTVEQKAYAENY  418
            FPGMKI++F F +     SID PH   N++ Y GTHDN  + GW+ N +    + Y    Y
Sbjct:  360 FPGMKILQFAF-NPEDESIDSPHLAPANSVMYTGTHDNNTVLGWYRNEIDDATREYMARY 418

Query:  419 MRRLPNEPITETVLRTLYATVSQTTITCMQDLLDKPADSRMNMPNTVGGNWQWRMRKEDL  478
               R   E +   +LRT++++VS  I  MQDLL+     +RMN P+T+GGNW WRM ++ L
Sbjct:  419 TNRKEYETVVHAMLRTVFSSVSFMAIATMQDLLELDEAARMNFPSTLGGNWSWRMTEDQL 478

Query:  479 TENRKAFLKEITTIYNRGNK                                          498
            T   +  L ++TTIY R N+
Sbjct:  479 TPAVEEGLLDLTTIYRRINE                                          498
```

A related DNA sequence was identified in *S. pyogenes* <SEQ ID 6437> which encodes the amino acid sequence <SEQ ID 6438>. Analysis of this protein sequence reveals the following:

```
Possible site: 17
>>> Seems to have no N-terminal signal sequence
    INTEGRAL      Likelihood = -0.85    Transmembrane      435-451 (435-451)

----- Final Results -----
                bacterial membrane --- Certainty = 0.1341(Affirmative) < succ>
                 bacterial outside --- Certainty = 0.0000(Not Clear)   < succ>
                bacterial cytoplasm --- Certainty = 0.0000(Not Clear)   < succ>
```

An alignment of the GAS and GBS proteins is shown below.

```
Identities = 313/495 (63%), Positives = 387/495 (77%)
Query:    1 MKKRASGVLMHITSLPGDLGIGTFGREAYAFVDFLVETDQKFWQILPLTTTSFGDSPYQS   60
            M KRASG+LMHI+SLPG  GIGTFG+ A+  FVDFL  ET Q +WQILPLTTTSFGDSPYQS
Sbjct:    1 MNKRASGILMHISSLPGKFGIGTFGKSAFEFVDFLAETKQTYWQILPLTTTSFGDSPYQS   60

Query:   61 FSAVAGNTHLIDFDLLTLEGFISKDDYQNISFGQDPEVVDYAGLFEKRRPVLEKAVKNFL  120
            FSA+AGNTH IDF+LL  +  + D +I+FG +PE VDYA LF+ RRP+LEKAV  F+
Sbjct:   61 FSAIAGNTHFIDFELLVDDELLEAADLCDITFGTNPEAVDYAQLFQVRRPLLEKAVRAFV  120

Query:  121 QEERATRMLSDFLQEEKWVTDFAEFMAIKEHFGNKALQEWDDKAIIRREEEALAGYRQKL  180
             E+     L   F       W+TDFAEFMA+KE+F NKALQ+WDD+ +I+R+E++L  YR+ L
Sbjct:  121 AEQENVCKLEAFETASSWLTDFAEFMALKEYFNNKALQDWDDETVIKRQEDSLNNYRELL  180

Query:  181 SEVIKYHEVTQYFFYKQWFELKEYANDKGIQIIGDMPIYVSADSVEVWTMPELFKLDRDK  240
            ++ I YH+V QYFFY+QW  LK YAN KGI+IIGDMPIYVSADSVEVWTMPELFK+D DK
Sbjct:  181 AKKITYHKVCQYFFYQQWSALKTYANHKGIEIIGDMPIYVSADSVEVWTMPELFKVDSDK  240

Query:  241 QPLAIAGVPADDFSDDGQLWGNPIYNWDYHKESDFDWWIYRIQSGVKMYDYLRIDHFKGF  300
             +PL IAGVPAD FS+DGQLWGNP YNW   H++S+F WWIYRIQ   K+YD LRIDHFKGF
Sbjct:  241 KPLFIAGVPADGFSEDGQLWGNPTYNWSAHEKSNFAWWIYRIQESFKLYDQLRIDHFKGF  300

Query:  301 SDYWEIRGDYQTANDGSWQPAPGPELFATIKEKLGDLPIIAENLGYIDERAERLLAGTGF  360
            SD+WEI    +TA +G W   APG  LF+ ++E LG+LPIIAENLGYIDE+AE+LLA TGF
Sbjct:  301 SDFWEIPAGDKTARNGHWASAPGIALFSAVREALGELPIIAENLGYIDEKAEQLLASTGF  360

Query:  361 PGMKIMEFGFYDTTGNSIDIPHNYTENTIAYAGTHDNEVINGWFENLTVEQKAYAENYMR  420
            PGMKI+EFG +D T  SID+PH Y  N +AY GTHDNEV+NGW++NL+ EQ   NY+
Sbjct:  361 PGMKILEFGLFDITSQSIDLPHYYDRNCVAYTGTHDNEVVNGWYDNLSEEQVHFVNNYLH  420
```

-continued

```
Query: 421 RLPNEPITETVLRTLYATVSQTTITCMQDLLDKPADSRMNMPNTVGGNWQWRMRKEDLTE 480
            +  +E IT+ +LRT++A+V  T I C+QDLLDK   SRMNMPNT+GGNWQWRM   +L +
Sbjct: 421 KHADESITKAMLRTIFASVCDTAILCIQDLLDKDGKSRMNMPNTIGGNWQWRMLDGELNQ 480

Query: 481 NRKAFLKEITTIYNR 495
            +  K  +L   +T +Y R
Sbjct: 481 DHKDYLIYLTDLYGR 495
```

Based on this analysis, it was predicted that this protein and its epitopes, could be useful antigens for vaccines or diagnostics.

EXAMPLE 2081

A DNA sequence (GBSx2196) was identified in *S. agalactiae* <SEQ ID 6439> which encodes the amino acid sequence <SEQ ID 6440>. This protein is predicted to be glycogen phosphorylase (malP). Analysis of this protein sequence reveals the following:

```
Possible site: 40
>>> Seems to have no N-terminal signal sequence

----- Final Results -----
            bacterial cytoplasm --- Certainty = 0.2678(Affirmative) < succ>
            bacterial membrane  --- Certainty = 0.0000(Not Clear)   < succ>
             bacterial outside  --- Certainty = 0.0000(Not Clear)   < succ>
```

The protein has homology with the following sequences in the GENPEPT database.

```
>GP: AAC00218 GB: AF008220 glycogen phosphorylase [Bacillus subtilis]
Identities = 297/776 (38%), Positives = 452/776 (57%), Gaps = 41/776 (5%)
Query:  13 GKVLSELTNEEIYVELLNFVKEEAAA-------KSKNSSQRKVYYISAEFLIGKLLSNNL  65
            GK   +   + Y  L N V+E  +A        KS+++S ++ YY+S EFL+G+LL  NL
Sbjct:  21 GKSFKDSAKLDQYKTLGNMVREYISADWIETNEKSRSNSGKQTYYLSIEFLLGQLLEQNL  80

Query:  66 INLGIYKDVKKELELVGKSIAEIEDVEPEPSLGNGGLGRLASCFIDSISSLGINGEGVGL 125
            +NLG+   V+  L+ +G ++ EI  +E +  LGNGGLGRLA+CF+DS++SL  G  G+G+
Sbjct:  81 MNLGVRDVVEAGLKEIGINLEEILQIENDAGLGNGGLGRLAACFLDSLASLNLPGHGMGI 140

Query: 126 NYHCGLFKQVFRNNQQEAEANYWIEN-NSWLVPT-DISYDVPF--------RDFTLKSRL 175
              Y  GLF+Q  +  Q     W++N N W V   D + DVPF           + L R
Sbjct: 141 RYKHGLFEQKIVDGHQVELPEQWLKNGNVWEVRNADQAVDVPFWGEVHMTEKSGRLHFRH 200

Query: 176 DR----------IDVLGYKKDTKNYLNLFDIDGLDYNLIEKGITFDKTEIKKNLTLFLYP 225
             ++            I ++GY+  T N L L++  +    Y    G       + FLYP
Sbjct: 201 EQATIVTAVPYDIPIIGYETGTVNTLRLWNAE--PYAHYGGNILSYKRETEAVSEFLYP 258

Query: 226 DDSDKNGELLRIYQQYFMVSNAAQLLIDEAIERGSNLHDLAEYAYVQINDTHPSMVIPEL 285
            DD+    G++LR+ QQYF+V  + +++    +   +L +L +  + +INDTHP++ +PEL
Sbjct: 259 DDTHDEGKILRLKQQYFLVCASLKSIVNNYRKTHKSLSGLHKKVSIHINDTHPALAVPEL 318

Query: 286 IRLLTEKHGFEFDEAVSVVRNMVGYTNHTILAEALEKWPLEYLNEVVPHLVTIIKKLDQM 345
            +R+L  ++          ++EA  +   +  YTNHT L+EALEKWP+    ++P  II+++++
Sbjct: 319 MRILLDEENMSWEEAWHITVHTISYTNHTTLSEALEKWPIHLFKPLLPRMYMIIEEINER 378

Query: 346 IRE--------EQTNPEVQIIDEAGRVHMAHMDIHFSTSVNGVAALHTEILKNSELKVFY 397
                        +    E  I   G V MAH+  I   S  SVNGVA  +H++ILK   E++  F+
Sbjct: 379 FCRAVWEKYPGDWKRIENMAITAHGVVKMAHLAIVGSYSVNGVAKIHSDILKEREMRDFH 438

Query: 398 DIYPDKFNNKTNGITFRRWLEFANQDLADYKELIGDSYLTDATQLEKLLTYADSNEVHD 457
            ++P++ FNNKTNGI    RRWL  AN  L+  +  E IGD ++     L  +L   YA     +
Sbjct: 439 LLFPNRFNNKTNGIAHRRWLLKANPGLSAIITEAIGDEWVKQPESLIRLEPYATDPAFIE 498

Query: 458 KLAAIKFKNKLALKRYLKENKGIELDEYSIIDTQIKRFHEYKRQQMNALYVIHKYLEIKR 517
             +     K  K  K L     +  G+ ++  SI D Q+KR H  YKRQ +N L++++ Y  +K
Sbjct: 499 QFQNNKSKKKQELADLIFCTAGVVVNPESIFDVQVKRLHAYKRQLLNVLHIMYLYNRLKE 558

Query: 518 GH-FPSRKLTVIFGGKAAPAYTIAQDIIHLILCLSELINNDPEVNKYLNVHLVENYNVTV 576
                F     T IFG  KA+P+Y  A+  II LI    ++E +N  DP V + +  V  +ENY V++
Sbjct: 559 DSGFSIYPQTFIFGAKASPSYYYAKKIIKLIHSVAEKVNYDPAVKQLIKVVFLENYRVSM 618
```

```
                             -continued
Query:  577 AEKLIPATDISEQISLASKEASGTGNMKFMLNGALTLGTMDGANVEIAELAGKENIYTFG  636
            AE++ PA+D+SEQIS ASKEASGTGNMKFM+NGALT+GT DGAN+EI E  G + IYTFG
Sbjct:  619 AERIFPASDVSEQISTASKEASGTGNMKFMMNGALTIGTHDGANIEILERVGPDCIYTFG  678

Query:  637 KDSDTIINLYETSGYRSKDYYDKDKVIREAVDFIISDDIVSLGNAERLKRLHDELV-GKD  695
            +D +++  E  GYRS++YY  D+ IR+  D +I+        G A+  + + D L+   D
Sbjct:  679 LKADEVLSYQENGGYRSREYYQHDRRIRQVADQLINGFFE--GEADEFESIFDSLLPHND  736

Query:  696 WFMTLIDLKEYIAVKEQVLADYEDYESWNKKVIHNIAKAGFFSSDRTIEQYNQDIW     751
             + L D  Y  +E++ ADY +    W++  I NIA +G+FSSDRTI +Y +DIW
Sbjct:  737 EYFVLKDFSSYADAQERIQADYRERRKWSEHSIVNIAHSGYFSSDRTIREYAKDIW     792
```

A related DNA sequence was identified in *S. pyogenes* <SEQ ID 6441> which encodes the amino acid sequence <SEQ ID 6442>. Analysis of this protein sequence reveals the following:

```
Possible site: 19
>>> Seems to have no N-terminal signal sequence
    INTEGRAL     Likelihood = -2.71     Transmembrane      538-554  (538-554)

----- Final Results -----
              bacterial membrane --- Certainty = 0.2084(Affirmative) < succ>
               bacterial outside --- Certainty = 0.0000(Not Clear)   < succ>
             bacterial cytoplasm --- Certainty = 0.0000(Not Clear)   < succ>
```

An alignment of the GAS and GBS proteins is shown below.

```
Identities = 629/754 (83%), Positives = 696/754 (91%), Gaps = 2/754 (0%)
Query:    1 MTRNFTTYVGQQ-GKVLSELTNEEIYVELLNFVKEEAAAKSKNSSQRKVYYISAEFLIGK   59
            MTR FT YV  + GK L++ +NEEIY+ LLNFVKEEA+ K+KNS++RKVYYISAEFLIGK
Sbjct:    1 MTR-FTEYVETKLGKSLTQASNEEIYLSLLNFVKEEASHKAKNSAKRKVYYISAEFLIGK   59

Query:   60 LLSNNLINLGIYKDVKKELELVGKSIAEIEDVEPEPSLGNGGLGRLASCFIDSISSLGIN  119
            LLSNNLINLGIYKD+K+EL   GKSIAE+EDVE EPSLGNGGLGRLASCFIDSI+SLGIN
Sbjct:   60 LLSNNLINLGIYKDIKEELAAAGKSIAEVEDVELEPSLGNGGLGRLASCFIDSIASLGIN  119

Query:  120 GEGVGLNYHCGLFKQVFRNNQQEAEANYWIENNSWLVPTDISYDVPFRDFTLKSRLDRID  179
            GEGVGLNYHCGLFKQVF++N+QEAE N+WIE++SWLVPTDISYDVPF++FTLKSRLDRID
Sbjct:  120 GEGVGLNYHCGLFKQVFKHNEQEAEPNFWIEDDSWLVPTDISYDVPFKNFTLKSRLDRID  179

Query:  180 VLGYKKDTKNYLNLFDIDGLDYNLIEKGITFDKTEIKKNLTLFLYPDDSDKNGELLRIYQ  239
            VLGYK+DTKNYLNLFDI+G+DY LI+ GI+FDKT+I KNLTLFLYPDDSDKNGELLRIYQ
Sbjct:  180 VLGYKRDTKNYLNLFDIEGVDYGLIKDGISFDKTQIAKNLTLFLYPDDSDKNGELLRIYQ  239

Query:  240 QYFMVSNAAQLLIDEAIERGSNLHDLAEYAYVQINDTHPSMVIPELIRLLTEKHGFEFDE  299
            QYFMVSNAAQL+IDEAIERGSNLHDLA+YAYVQINDTHPSMVIPELIRLLTEKHGF+FDE
Sbjct:  240 QYFMVSNAAQLIIDEAIERGSNLHDLADYAYVQINDTHPSMVIPELIRLLTEKHGFDFDE  299

Query:  300 AVSVVRNMVGYTNHTILAEAEALEKWPLEYLNEVVPHLVTIIKKLDQMIREEQTNPEVQIID  359
            AV+VV+NMVGYTNHTILAEALEKWP  YLNEVVPHLVTII+KLD ++R E ++P VQIID
Sbjct:  300 AVAVVKNMVGYTNHTILAEALEKWPTAYLNEVVPHLVTIIEKLDALVRSEVSDPAVQIID  359

Query:  360 EAGRVHMAHMDIHFSTSVNGVAALHTEILKNSELKVFYDIYPDKFNNKTNGITFRRWLEF  419
            E+GRVHMAHMDIHF+TSVNGVAALHTEILKNSELK FYD+YP+KFNNKTNGITFRRWLEF
Sbjct:  360 ESGRVHMAHMDIHFATSVNGVAALHTEILKNSELKAFYDLYPEKFNNKTNGITFRRWLEF  419

Query:  420 ANQDLADYLKELIGDSYLTDATQLEKLLTYADSNEVHDKLAAIKFKNKLALKRYLKENKG  479
            ANQDLADY+KELIGD YLTDAT+LEKL+ +AD   VH KLA IKF NKLALKRYLK+NK
Sbjct:  420 ANQDLADYIKELIGDEYLTDATKLEKLMAFADDKAVHAKLAEIKFNNKLALKRYLKDNKD  479

Query:  480 IELDEYSIIDTQIKRFHEYKRQQMNALYVIHKYLEIKRGHFPSRKLTVIFGGKAAPAYTI  539
            IELDE+SIIDTQIKRFHEYKRQQMNALYVIHKYLEIK+G+ P RK+TVIFGGKAAPAY I
Sbjct:  480 IELDEHSIIDTQIKRFHEYKRQQMNALYVIHKYLEIKKGNLPKRKITVIFGGKAAPAYII  539

Query:  540 AQDIIHLILCLSELINNDPEVNKYLNVHLVENYNVTVAEKLIPATDISEQISLASKEASG  599
            AQDIIHLILCLSELINNDPEV+ YLNVHLVENYNVTVAE LIPATDISEQISLASKEASG
Sbjct:  540 AQDIIHLILCLSELINNDPEVSPYLNVHLVENYNVTVAEHLIPATDISEQISLASKEASG  599

Query:  600 TGNMKFMLNGALTLGTMDGANVEIAELAGKENIYTFGKDSDTIINLYETSGYRSKDYYDK  659
            TGNMKFMLNGALTLGTMDGANVEIAELAG ENIYTFGKDSDTIINLY T+ Y +KDYY D
Sbjct:  600 TGNMKFMLNGALTLGTMDGANVEIAELAGMENIYTFGKDSDTIINLYATASYVAKDYYDN  659

Query:  660 DKVIREAVDFIISDDIVSLGNAERLKRLHDELVGKDWFMTLIDLKEYIAVKEQVLADYED  719
            +I+ AV+FIIS ++++ GN ERL RL+ EL+ KDWFMTLIDL+EYI VKE++LADYED
```

```
                               -continued
Sbjct:  660 HPAIKAAVNFIISPELLAFGNEERLDRLYKELISKDWFMTLIDLEEYIEVKEKMLADYED  719

Query:  720 YESWNKKVIHNIAKAGFFSSDRTIEQYNQDIWHS                           753
              + W   KV+HNIAKAGFFSSDRTIEQYN+DIWHS
Sbjct:  720 QDLWMTKVVHNIAKAGFFSSDRTIEQYNEDIWHS                           753
```

Based on this analysis, it was predicted that this protein and its epitopes, could be useful antigens for vaccines or diagnostics.

EXAMPLE 2082

A DNA sequence (GBSx2197) was identified in *S. agalactiae* <SEQ ID 6443> which encodes the amino acid sequence <SEQ ID 6444>. This protein is predicted to be glycerol-3-phosphatase transporter (glpT). Analysis of this protein sequence reveals the following:

```
Possible site: 59
>>> Seems to have no N-terminal signal sequence
    INTEGRAL     Likelihood = -10.88    Transmembrane   339-355   (333-359)
    INTEGRAL     Likelihood =  -8.01    Transmembrane   432-448   (426-450)
    INTEGRAL     Likelihood =  -6.74    Transmembrane    92-108    (91-127)
    INTEGRAL     Likelihood =  -6.69    Transmembrane   194-210   (190-214)
    INTEGRAL     Likelihood =  -3.77    Transmembrane   367-383   (364-385)
    INTEGRAL     Likelihood =  -2.81    Transmembrane   111-127   (109-127)
    INTEGRAL     Likelihood =  -2.28    Transmembrane   407-423   (406-424)
    INTEGRAL     Likelihood =  -2.02    Transmembrane   165-181   (165-182)
    INTEGRAL     Likelihood =  -0.64    Transmembrane    29-45     (29-45)

----- Final Results -----
              bacterial membrane  --- Certainty = 0.5352(Affirmative) < succ>
               bacterial outside  --- Certainty = 0.0000(Not Clear)   < succ>
             bacterial cytoplasm  --- Certainty = 0.0000(Not Clear)   < succ>
```

The protein has homology with the following sequences in the GENPEPT database.

```
>GP: AAC44575 GB: U28354 IS629 ORFB fused with
sequences similar to E. coli
GlpT and UhpT proteins, Swiss-Prot Accession Number
P08194 and P09836; Method: conceptual translation
supplied by author [Shig
Identities = 174/321 (54%), Positives = 241/321 (74%), Gaps = 4/321 (1%)
Query:  109 GVIPSVITSIWLFTIMYLINGWLQGMGYPPGARTLVYWYDNKERIKYATIWNLSHNFGGA  168
            GV P V + + +    YL+NGW+QGMGYPPGA+TLV+WY+++ERI +AT+WNLSHN GGA
Sbjct:   12 GVGP-VCSELHIAPSTYLLNGWIQGMGYPPGAKTLVFWYEHRERISWATLWNLSHNVGGA   70

Query:  169 IAPILTGVGLALAGNDSLNQARAAYWFPGVVACLLAVLVYFLQEDTPESIGLPPIEEYHK  228
            +AP+L G       G+ +L+ ARAA+ FPGV+   ++VL+YF+Q D P S+GLPPIEE+
Sbjct:   71 LAPVLIGFSFGFFGDSALDHARAAFIPGVLCMAMSVLIYFIQVDRPVSVGLPPIEEWKG  130

Query:  229 EQYTNVVDSSDILEEPEVLGMGEIIKKYILPNTKLMWASLYSIFVYILRYGIVSWTPKFL  288
             ++          E+   L + +II+K+I+ N KL++  +Y  FVYILRYGIVSW PKFL
Sbjct:  131 NVVSHPAKGR---EQGPRLSIPDIIRKHIIRNNKLIYCCIYGSFVYILRYGIVSWAPKFL  187

Query:  289 ATSVQDGGKGITATAGMGGFSLFEIGGIIGMLTAGYLSAKVFKNSKPLTNVAFLVVAILL  348
             + S+  GGK +    A MGG S+FEIGG+ GML AGYLS ++F+NSKPLTN  FL + +L
Sbjct:  188 SDSLDVGGKDMGKLASMGGGSVFEIGGVAGMLLAGYLSVRLFRNSKPLTNTLFLALTIIL  247

Query:  349 LAAYWFIPAGPQYMALDFIILLGLGASIYGPVMMVGLYAMELVPKAAAGAASGLTGTFSY  408
            L AYW++P+G +Y+ L++ IL+ LG ++YGPVM +GLY+MELVPK AAGAASGL+GTFSY
Sbjct:  248 LIAYWYVPSGNEYLWLNYTILILLGLAVYGPVMFIGLYSMELVPKEAAGAASGLSGTFSY  307

Query:  409 VGGATIATLAIGIIIDHFGWG                                        429
             + G+ +ATL +G+++D+ GWG
Sbjct:  308 IFGSIVATLGMGLVVDYLGWG                                        328
```

A related DNA sequence was identified in *S. pyogenes* <SEQ ID 6445> which encodes the amino acid sequence <SEQ ID 6446>. Analysis of this protein sequence reveals the following:

```
Possible site: 36
>>> Seems to have no N-terminal signal sequence
    INTEGRAL      Likelihood = -12.37    Transmembrane    185-201  (175-208)
    INTEGRAL      Likelihood =  -9.13    Transmembrane    114-130  ( 90-134)
    INTEGRAL      Likelihood =  -7.75    Transmembrane    322-338  (320-345)
    INTEGRAL      Likelihood =  -6.79    Transmembrane    421-437  (419-439)
    INTEGRAL      Likelihood =  -6.37    Transmembrane     91-107  ( 90-113)
    INTEGRAL      Likelihood =  -5.36    Transmembrane    163-179  (161-181)
    INTEGRAL      Likelihood =  -5.20    Transmembrane    350-366  (347-371)
    INTEGRAL      Likelihood =  -4.41    Transmembrane     23-39   ( 22-41)
    INTEGRAL      Likelihood =  -3.77    Transmembrane    257-273  (249-273)
    INTEGRAL      Likelihood =  -1.33    Transmembrane     61-77   ( 61-77)
    INTEGRAL      Likelihood =  -1.28    Transmembrane    383-399  (383-399)
    INTEGRAL      Likelihood =  -0.90    Transmembrane    299-315  (299-315)

----- Final Results -----
            bacterial membrane  --- Certainty = 0.5946(Affirmative) < succ>
            bacterial outside   --- Certainty = 0.0000(Not Clear)   < succ>
            bacterial cytoplasm --- Certainty = 0.0000(Not Clear)   < succ>
```

The protein has homology with the following sequences in the databases:

```
>GP: AAF96050 GB: AE004355 glycerol-3-phosphate transporter
[Vibrio cholerae]
Identities = 128/438 (29%), Positives = 215/438 (48%), Gaps = 17/438 (3%)
Query:   1 LFMEEDYNKREP-EKFTQFLRRQKVVFFVAPF-GYVCAYLVRNNFKLMSNTIMVQNGWDK    58
           LF    +R P +K        R +    F+   F GY     YL R NF L +    +++ G+ +
Sbjct:  21 LFKPAAHTQRLPSDKVDSVYSRLRWQLFIGIFVGYAGYYLGRKNFSL-AMPYLIEQGFSR    79

Query:  59 AQIAILLSCLTVSYGLAKFYMGALGDRVSLRKLFSISLGASALICILIGFF---NSSMVV   115
           + + L  ++++YGL+KF MG + DR + R    S   SAL+      GF       S+
Sbjct:  80 GDLGVALGAVSIAYGLSKFLMGNVSDRSNPRYFLSAGLLLSALVMFCFGFMPWATGSITA   139

Query: 116 LGILLVLCGVVQGALAPASQAMIANYFPNKTRGGAIAGWNISQNMGSALLPLTIALLTSM   175
           + ILL L G  QG    PA     + +++    K RG  ++ WN++ N+G  L      I  +  +
Sbjct: 140 MFILLFLNGWFQGMGWPACGRTMVHWWSRKERGEIVSVWNVAHNVGGGL----IGPIFLL   195

Query: 176 GLVVPANGNILLAFLIPGVLVFLFALCCWKLGGDNPESEGLDSLRTMYGDAGESAVASEE   235
                 GL + N +   AF +P       L A+  W +    D P+S GL +      D +      S E
Sbjct: 196 GLWM-FNDDWRTAFYVPAFFAVLVAVFTWLVMRDTPQSCGLPPIEEYKNDYPDDYKSHE   254

Query: 236 EKHNLSYWQLIWKYVFCNPSLLLVAAVNVALYFVRFGIEDWMPIYLSQVANMSEAHIHFA   295
            +  ++   ++ +KYVF N  L  +A  N   +Y +R+G+ DW P+YL +    + +        +A
Sbjct: 255 NE--MTAKEIFFKYVFNNKLLWSIAIANAFVYLIRYGVLDWAPVYLKEAKHFTVDKSSWA   312

Query: 296 ISMLEWVAIPGSLVFAWLAVR-YPNKMAKVGAIGLFVLAAIVFVYERLTATGAPNYFLLL   354
            + EW   IPG+L+  W++ +  +    + A  G +  + + +        V  VY      G P   +
Sbjct: 313 YFLYEWAGIPGTLLCGWISDKVFKGRRAPAGILFMVLVTLAVLVY-WFNPAGNPAVDMAA   371

Query: 355 VIAGILGSLIYGPQLIVNILTINFVPLNVAGTAIGFVGVTAYLIGNMGANWLMPILADGF   414
            ++A  +G LIYGP +++  +  + +  P     AGTA G+   YL G + AN ++       D F
Sbjct: 372 LVA--IGFLIYGPVMLIGLYALELAPKKAAGTAAGLTGLFGYLGGAVAANAILGYTVDHF   429

Query: 415 GWFWSYIVVAALSAFSAV                                             432
           GW    ++V+ A   S +
Sbjct: 430 GWDGGFMVLVASCVLSVL                                             447
```

An alignment of the GAS and GBS proteins is shown below.

```
Identities = 117/439 (26%), Positives = 203/439 (45%), Gaps = 27/439 (6%)
Query:  23 KYPRYRVQVLISIFVGYMGYYFVRNTTSILSGILNMS----ATEIGIITCASYIAYGLSK    78
           ++ R + V    F GY+   Y VRN ++S + +       +I I+        ++YGL+K
Sbjct:  17 QFLRRQKVVFFVAFFGYVCAYLVRNNFKLMSNTIMVQNGWDKAQIAILLSCLTVSYGLAK    76

Query:  79 FISGLISDESNSKIFLPVGLFLTGLVNVLIGVIPSVITSIWLFTIMYLINGWLQGHGYPP   138
             F   G +  D + +      +  L + L+ +LIG   S  S+ +     I+   +  G +QG    P
Sbjct:  77 FYMGALGDRVSLRKLFSISLGASALICILIGFFNS---SMVVLGILLVLCGVVQGALAPA   133

Query: 139 GARTLVYWYDNKERIKYATIWNLSHNFGGAIAPI----LTGVGLALAGNDSLNQARAAYW   194
            + ++   NK R        WN+S   N G A+ P+      LT +GL + N  +          A+
Sbjct: 134 SQAMIANYFPNKTRGGAIAGWNISQNMGSALLPLTIALLTSMGLVVPANGNI---LLAFL   190

Query: 195 FPGVVACLLAVLVYFLQEDTPESIGLPPIEEYHKEQYTNVVDSSDILEEPEVLGMGEIIK   254
              PGV+    L A+ + L  D PES GL +        + +       + V S         EE  L ++I
```

-continued

```
Sbjct: 191 IPGVLVFLFALCCWKLGGDNPESEGLDSLRTMYGDAGESAVASE---EEKHNLSYWQLIW  247

Query: 255 KYILPNTKLMWASLYSIFVYILRYGIVSWTPKFLATSVQDGGKGITATAGMGGFSLFEIG  314
           KY+  N  L+  +  ++ +Y +R+GI  W P +L+        I          S+ E
Sbjct: 248 KYVFCNPSLLLVAAVNVALYFVRFGIEDWMPIYLSQVANMSEAHIHFA-----ISMLEWV  302

Query: 315 GIIGMLTAGYLSAKVFKNSKPLTNVAFLVVAILLLAAYWFIPAG-PQYMALDFIILLG-L  372
            I G L  +L+ +        +  +  V+A ++          G P Y  L  +++ G L
Sbjct: 303 AIPGSLVFAWLAVRYPNKMAKVGAIGLFVLAAIVFVYERLTATGAPNYFLL--LVIAGIL  360

Query: 373 GASIYGPVMMVGLYAMELVPKAAAGAASGLTGTFSYVGGATIATLAIGIIIDHFGWGVAF  432
           G+ IYGP ++V +  +   VP   AG A G   G  +Y+ G     A     + I+ D FGW  ++
Sbjct: 361 GSLIYGPQLIVNILTINFVPLNVAGTAIGFVGVTAYLIGNMGANWLMPILADGFGWFWSY  420

Query: 433 IIF-GISGFAAIVCTLLSR                                         450
           I+    +S F+A+   +L++
Sbjct: 421 IVVAALSAFSAVGYLILAK                                          439
```

Based on this analysis, it was predicted that this protein and its epitopes, could be useful antigens for vaccines or diagnostics.

EXAMPLE 2083

A DNA sequence (GBSx2198) was identified in *S. agalactiae* <SEQ ID 6447> which encodes the amino acid sequence <SEQ ID 6448>. Analysis of this protein sequence reveals the following:

```
Possible site: 21
>>> Seems to have no N-terminal signal sequence

----- Final Results -----
            bacterial cytoplasm --- Certainty = 0.3202(Affirmative) < succ>
            bacterial membrane  --- Certainty = 0.0000(Not Clear)   < succ>
             bacterial outside  --- Certainty = 0.0000(Not Clear)   < succ>
```

The protein has no significant homology with any sequences in the GENPEPT database.

A related DNA sequence was identified in *S. pyogenes* <SEQ ID 6449> which encodes the amino acid sequence <SEQ ID 6450>. Analysis of this protein sequence reveals the following:

```
Possible site: 19
>>> Seems to have no N-terminal signal sequence

----- Final Results -----
            bacterial cytoplasm --- Certainty = 0.4473(Affirmative) < succ>
            bacterial membrane  --- Certainty = 0.0000(Not Clear)   < succ>
             bacterial outside  --- Certainty = 0.0000(Not Clear)   < succ>
```

An alignment of the GAS and GBS proteins is shown below.

```
Identities = 54/100 (54%), Positives = 67/100 (67%)
Query:   1 MTYELCLEYGTYPLRPVDAWADEINTAPAFITEDKKLLELLEEVNTLFHELFLTIECSFH   60
           MTYELCLEYGTYPL  VDA+  E    P FI ED+ L   LE +N LFH+LF+TIE  FH
Sbjct:   1 MTYELCLEYGTYPLSRVDAYWGEDQNPPTFIQEDRLLCHKLETMNHLFHDLFVTIESQFH   60

Query:  61 YIGHDFPEKRAKITQIYHVIIEHLSIHYPEYDIKIESLLM                     100
           Y+G + PEKRA+I +Y + L   Y +Y IKIE+ L+
Sbjct:  61 YVGFNMPEKRAQIRILYQEVATILKSKYKDYPIKIETFLL                     100
```

Based on this analysis, it was predicted that this protein and its epitopes, could be useful antigens for vaccines or diagnostics.

EXAMPLE 2084

A DNA sequence (GBSx2199) was identified in *S. agalactiae* <SEQ ID 6451> which encodes the amino acid sequence <SEQ ID 6452>. Analysis of this protein sequence reveals the following:

```
Possible site: 19
>>> Seems to have no N-terminal signal sequence

----- Final Results -----
            bacterial cytoplasm --- Certainty = 0.2369(Affirmative) < succ>
             bacterial membrane --- Certainty = 0.0000(Not Clear)   < succ>
              bacterial outside --- Certainty = 0.0000(Not Clear)   < succ>
```

The protein has homology with the following sequences in the GENPEPT database.

```
>GP: AAB81912 GB: U92974 unknown [Lactococcus lactis]
Identities = 213/322 (66%), Positives = 260/322 (80%), Gaps = 5/322 (1%)
Query:    1 MSEKIRVLLYYKYVSIENAEEYAAKHLEFCKSIGLKGRILIADEGINGTVSGDYETTQKY    60
            M++  RVLLYY+YV IE+ E +A KHL  CK +GLKGRIL+ADEGINGTVSG  E T  Y
Sbjct:    1 MTQDYRVLLYYQYVPIEDGETFAQKHLADCKELGLKGRILVADEGINGTVSGTIEQTNAY    60

Query:   61 MDWVHSDERFADLWFKIDEENQQAFRKMFVRYKKEIVHLGLEDNNFDSDINPLETTGEYL   120
            M+ + +D RF+   FKIDE  Q AF+KM VRY+ E+V+L LED     D+NPLE TG YL
Sbjct:   61 MELMKNDPRFSSTIFKIDEAEQNAFKKMHVRYRPELVNLSLED-----DVNPLELTGAYL   115

Query:  121 NPKQFKEALLDEDTVVLDTRNDYEYDLGHFRGAIRPDIRNFRELPQWVRDNKDKFMEKRV   180
            +PK+F+EA+LDE+TVV+D RNDYE+DLGHFRGAIRP+IR+FRELPQW+RDNK++FMEKRV
Sbjct:  116 DPKEFREAMLDENTVVIDARNDYEFDLGHFRGAIRPEIRSFRELPQWIRDNKEQFMEKRV   175

Query:  181 VVYCTGGVRCEKFSGWMVREGFKDVGQLHGGIATYGKDPEVQGELWDGAMYVFDDRISVP   240
             + YCTGG+RCEKFSGW+VREGFKDVGQL GGIATYGKDPEVQG+LWDG MYVFD RI+VP
Sbjct:  176 LTYCTGGIRCEKFSGWLVREGFKDVGQLLGGIATYGKDPEVQGDLWDGQMYVFDSRIAVP   235

Query:  241 INHVNPTVISKDYFDGTPCERYVNCANPFCNKQIFASEENEAKYVRGCSPECRAHERNRY   300
            IN     ++ +D+FDG+PCERY+NC NP CN+Q+ ASEENEAKY+  CS ECR H  NRY
Sbjct:  236 INQKEHVIVGRDWFDGSPCERYINCGNPECNRQMLASEENEAKYLGACSHECRVHPNNRY   295

Query:  301 VQENGLSRQEWAERLEAIGESL                                        322
            ++ + LS QE  ERL + + L
Sbjct:  296 IKAHQLSNQEVQERLALLEKDL                                        317
```

A related DNA sequence was identified in *S. pyogenes* <SEQ ID 6453> which encodes the amino acid sequence <SEQ ID 6454>. Analysis of this protein sequence reveals the following:

```
Possible site: 51
>>> Seems to have no N-terminal signal sequence

----- Final Results -----
            bacterial cytoplasm --- Certainty = 0.2443(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below.

```
Identities = 321/324 (99%), Positives = 323/324 (99%)
Query:    1 MSEKIRVLLYYKYVSIENAEEYAAKHLEFCKSIGLKGRILIADEGINGTVSGDYETTQKY    60
            MSEKIRVLLYYKYVSIENA+EYAAKHLEFCKSIGLKGRILIADEGINGTVSGDYETTQKY
Sbjct:    1 MSEKIRVLLYYKYVSIENAQEYAAKHLEFCKSIGLKGRILIADEGINGTVSGDYETTQKY    60

Query:   61 MDWVHSDERFADLWFKIDEENQQAFRKMFVRYKKEIVHLGLEDNNFDSDINPLETTGEYL   120
            MDWVHSDERFADLWFKIDEENQQAFRKMFVRYKKEIVHLGLEDNNFDSDINPLETTGEYL
Sbjct:   61 MDWVHSDERFADLWFKIDEENQQAFRKMFVRYKKEIVHLGLEDNNFDSDINPLETTGEYL   120

Query:  121 NPKQFKEALLDEDTVVLDTRNDYEYDLGHFRGAIRPDIRNFRELPQWVRDNKDKFMEKRV   180
            NPKQFKEALLDEDTVVLDTRNDYEYDLGHFRGAIRPDIRNFRELPQWVRDNKDKFMEKRV
Sbjct:  121 NPKQFKEALLDEDTVVLDTRNDYEYDLGHFRGAIRPDIRNFRELPQWVRDNKDKFMEKRV   180
```

-continued

```
Query:  181 VVYCTGGVRCEKFSGWMVREGFKDVGQLHGGIATYGKDPEVQGELWDGAMYVFDDRISVP  240
            VVYCTGGVRCEKFSGWMVREGFKDVGQLHGGIATYGKDPEVQGELWDGAMYVFDDRISVP
Sbjct:  181 VVYCTGGVRCEKFSGWMVREGFKDVGQLHGGIATYGKDPEVQGELWDGAMYVFDDRISVP  240

Query:  241 INHVNPTVISKDYFDGTPCERYVNCANPFCNKQIFASEENEAKYVRGCSPECRAHERNRY  300
            INHVNPTVISKDYFDGTPCERYVNCANPFCNKQIFASEENE KYVRGCSPECRAHERNRY
Sbjct:  241 INHVNPTVISKDYFDGTPCERYVNCANPFCNKQIFASEENETKYVRGCSPECRAHERNRY  300

Query:  301 VQENGLSRQEWAERLEAIGESLPQ  324
            VQENGLSRQEWAERLEAIGESLP+
Sbjct:  301 VQENGLSRQEWAERLEAIGESLPE  324
```

Based on this analysis, it was predicted that this protein and its epitopes, could be useful antigens for vaccines or diagnostics.

EXAMPLE 2085

A DNA sequence (GBSx2200) was identified in *S. agalactiae* <SEQ ID 6455> which encodes the amino acid sequence <SEQ ID 6456>. Analysis of this protein sequence reveals the following:

```
Possible site: 57
>>> Seems to have an uncleavable N-term signal seq

----- Final Results -----
            bacterial membrane --- Certainty = 0.0000(Not Clear) < succ>
             bacterial outside --- Certainty = 0.0000(Not Clear) < succ>
           bacterial cytoplasm --- Certainty = 0.0000(Not Clear) < succ>
```

The protein has homology with the following sequences in the GENPEPT database.

```
>GP: AAC83954 GB: L47648 putative [Bacillus subtilis]
Identities = 54/192 (28%), Positives = 89/192 (46%), Gaps = 14/192 (7%)
Query:    5 QTIIIGAGAAGIGFGSAMQRLGLTNFLIIEKGHIGESFLRWPRTTQFITPSFTTNGFGFP   64
            + IIIG G G+     ++++G+ + L+IEKG++  S   +P   F + S
Sbjct:    5 KAIIIGGGPCGLSAAIHLKQIGI-DALVIEKGNVVNSIYNYPTHQTFFSSSEKLE-----  58

Query:   65 DLNAVIPDTSPAFSFEKEHLSGVEYARYLQLVAAHYNLPIQNETSVLSIDK-RDSLFVIK  123
                     I D  AF E     ++  Y + V    N+ +     V  + K +++ FVI+
Sbjct:   59 -----IGDV--AFITENRKPVRIQALSYYREVVKRKNIRVNAFEMVRKVTKTQNNTFVIE  111

Query:  124 TSKGDFSADYLIMATGEFQNPNTIDIKGADLGMHYGQVDNFHIKSDNPFIIIGGNESACD  183
            TSK ++  Y I+ATG + +PN + + G DL +     H  D    ++IGG  S+ D
Sbjct:  112 TSKETYTTPYCIIATGYYDHPNYMGVPGEDLPKVFHYFKEGHPYFDKDVVVIGGKNSSVD  171

Query:  184 ALTHLVYLGNQV  195
            A   LV  G +V
Sbjct:  172 AALELVKSGARV  183
```

No corresponding DNA sequence was identified in *S. pyogenes*.

Based on this analysis, it was predicted that this protein and its epitopes, could be useful antigens for vaccines or diagnostics.

A related GBS gene <SEQ ID 8973> and protein <SEQ ID 8974> were also identified. Analysis of this protein sequence reveals the following:

```
Lipop Possible site: -1 Crend: 2
McG: Discrim Score: 5.05
GvH: Signal Score (-7.5): -3.14
     Possible site: 57
>>> Seems to have an uncleavable N-term signal seq
ALOM program count: 0 value: 0.26 threshold: 0.0
         PERIPHERAL              Likelihood = 0.26           6
modified ALOM score: -0.55
```

```
*** Reasoning Step: 3

----- Final Results -----
            bacterial membrane --- Certainty = 0.0000(Not Clear) < succ>
            bacterial outside  --- Certainty = 0.0000(Not Clear) < succ>
          bacterial cytoplasm  --- Certainty = 0.0000(Not Clear) < succ>
```

The protein has homology with the following sequences in the databases:

```
33.2/56.1% over 281aa
Bacillus subtilis
EGAD|109228|hypothetical protein Insert characterized
GP|2635109|emb|CAB14605.1||Z99117 alternate gene name: yrdP Insert characterized
GP|1934657|gb|AAB80908.1||U93876 hypothetical protein YrdP Insert characterized
PIR|E69725|E69725 potassium uptake trkA-Insert characterized ORF01799(310-1128 of 1725)
EGAD|109228|S2656(2-283 of 345)hypothetical protein{acillus subtilis}
GP|2635109|emb|CA 14605.1||Z99117 alternate gene name: yrdP{acillus subtilis}
GP|1934657|gb|AA 80908.1||U93876 hypothetical protein YrdP{acillus subtilis}
PIR|E69725|E69725 potassium uptake trkA-acillus subtilis
% Match = 6.1
% Identity = 33.2  % Similarity = 56.0
Matches = 77  Mismatches = 88  Conservative Sub.s = 53
     270       300       330       360       390       417       444       474
YYC*LVKYFILHIYFCQGEDMKHYQTIIIGAGAAGIGFGSAMQRLGLTNFLIIEKGH-IGESFL-RWPRTTQFITPSFTT
       ||:||||  |||    |    :::       |:|::|  :|||:  |:       |   :::
                 MYDTIVIGAGQAGISIGYYLKQ-SDQKFIILDKSHEVGESWKDRYDSLVLFTSRMYSS
                        10        20        30        40        50
     480       510       540       570       600       630       660       690
--------NGFGFPDLNAVIPDTSPAFSFEKEHLSGVEYARYLQLVAAHYNLPIQNETSVLSIDKRDSLFVIKTSKGDFS
         |||   ::                  ||:     : :|||    | :|:    :  | :|||:::
LPGMHLEGEKHGFPSKNEIV-------------------AYLKKYVKKFEIPIQLRTEVISVLKIKNYFLIKTNREEYQ
       70                           80        90       100       110
    720       750        822        852        882        912
ADYLIMATGEFQNPNTIDIKGADLG-----MHYGQVDNF-HIKSDNPFIIIGGNESACDALTHLVYLGNQVELYTDTFGR
   |::|||  |:  ||     ||     :|     |    ::     |   :::  |||    |
TKNLVIATGPFHTPNIPSIS-KDLSDNINQLHSSQYKNSKQLAYGNVLVVGGGNSGA----------------------
         130       140       150       160       170
942       969       996      1026
KESNPDPSISLS-PLTKERLKHIQ-DHKKEYYSISEGKKAI--EIKQIG-------------------------------
      ::    |:|||   ::    :|   |: ::   ||::|           ::|
---------QIAVELSKERVTYLACSNKLVYFPLMIGKRSIFWWFDKLGVLHASHTSIVGKFIQKKGDPVFGHELKHAIK
              180       190       200       210       220       230       240
   1068      1098      1128      1158      1188      1218      1248
-------------KQYQVTFDDGSTAESFHKPILSTGFLNTCHLIDGIALFEYDKNQLPIVTEDDESTIVNNCFLIGPSL
              || ::  |  ||   :    |   :|||    |:   :::  :        :        :
QKEIILKKRVIAAKQNEIIFKDSSTLE-VNNIIWATGFRNPLCWINIKGVLDQEGRIIHHRGVSPVEGLYFIGLPWQHKR
              260       270       280       290       300       310       320
```

SEQ ID 8974 (GBS284) was expressed in *E. coli* as a His-fusion product. SDS-PAGE analysis of total cell extract is shown in FIG. 52 (lane 10; MW 42.7 kDa). It was also expressed in *E. coli* as a GST-fusion product. SDS-PAGE analysis of total cell extract is shown in FIG. 58 (lane 9; MW 67.6 kDa).

GBS284-GST was purified as shown in FIG. 225, lane 7.

EXAMPLE 2086

A DNA sequence (GBSx2201) was identified in *S. agalactiae* <SEQ ID 6457> which encodes the amino acid sequence <SEQ ID 6458>. This protein is predicted to be NrgA-like protein. Analysis of this protein sequence reveals the following:

```
Possible site: 24
>>> Seems to have an uncleavable N-term signal seq
    INTEGRAL    Likelihood = -11.73    Transmembrane      7-23    (1-31)
    INTEGRAL    Likelihood =  -6.42    Transmembrane     86-102   (82-108)
    INTEGRAL    Likelihood =  -6.42    Transmembrane    324-340   (318-342)
    INTEGRAL    Likelihood =  -5.26    Transmembrane    210-226   (207-229)
    INTEGRAL    Likelihood =  -5.10    Transmembrane    113-129   (112-133)
    INTEGRAL    Likelihood =  -1.49    Transmembrane    246-262   (246-263)
    INTEGRAL    Likelihood =  -1.17    Transmembrane    183-199   (183-199)
    INTEGRAL    Likelihood =  -0.43    Transmembrane     41-57    (41-57)
    INTEGRAL    Likelihood =  -0.00    Transmembrane    265-281   (265-282)

----- Final Results -----
                bacterial membrane --- Certainty = 0.5692(Affirmative) < succ>
                bacterial outside  --- Certainty = 0.0000(Not Clear)   < succ>
              bacterial cytoplasm  --- Certainty = 0.0000(Not Clear)   < succ>
```

A related GBS nucleic acid sequence <SEQ ID 9997> which encodes amino acid sequence <SEQ ID 9998> was also identified.

The protein has homology with the following sequences in the GENPEPT database.

```
>GP: CAB15668 GB: Z99122 ammonium transporter [Bacillus subtilis]
Identities = 105/378 (27%), Positives = 181/378 (47%), Gaps = 41/378 (10%)
Query:   3 VKKGLFVFLLLCILSMWLMIFGVAFYYFGSLH-QSLTSRIIYQFVLTVLLTTTAWFMGAY    61
           ++ G  VF+  C L +WLM  G+A +Y G +  +++ S  ++ F ++ + +  W + Y
Sbjct:   1 MQMGDTVFMFFCALLVWLMTPGLALFYGGMVKSKNVLSTAMHSFS-SIAIVSIVWVLFGY   59

Query:  62 FLAFEGHFKTVFQFQEADGKQI--------------VNCLFQLCFALYAVVMLIGSIIDR  107
           LAF        +    + A K +              + +FQ+ FA+   ++ G+  +R
Sbjct:  60 TLAFAPGNSIIGGLEWAGLKGVGFDPGDYSDTIPHSLFMMFQMTFAVLTTAIISGAFAER  119

Query: 108 VQTKRLLLAVVSWLFLVYTPLAYLIWNSEGVFAKMGVLDFSGGMIVHLSAGLSSYILAHV  167
           ++      LL   V W   LVYTP+A+ +W    G   ++G LDF+GG +VH+S+G++   +LA V
Sbjct: 120 MRFGAFLLFSVLWASLVYTPVAHWVWGG-GWIGQLGALDFAGGNVVHISSGVAGLVLAIV  178

Query: 168 IGK-----SEHQHNKVKNDSLFLGMILITFGWFGFNMGPVGEWNSQAIMILLNTIFAIIG  222
           +GK       HN +    FLG  LI  FGWFGFN+G      + A+    +NT  A
Sbjct: 179 LGKRKDGTASSPHNLIYT---FLGGALIWFGWFGFNVGSALTLDGVAMYAFINTNTAAAA  235

Query: 223 GGLAWTLAAKWNGEEEKTGSLLNGIIVGLVTSTAGVGYLLTWQLLAVTFFASLFTYFVTD  282
           G     W L     ++       ++G I GLV  T  G++ + + +             ++
Sbjct: 236 GIAGWILVEWIINKKPTMLGAVSGAIAGLVAITPAAGFVTPFASIIIGIIGGAVCFWGVF  295

Query: 283 YVAKAFAIDDVVSSFGMNGIGGLLGSLGVGLFKLSHMP----------------VQLLAL  326
           + K F  DD + +FG++GIGG  G + GLF + +                    Q++A+
Sbjct: 296 SLKKKFGYDDALDAFGLHGIGGTWGGIATGLFATTSVNSAGADGLFYGDASLIWKQIVAI  355

Query: 327 ATTILLSIIMTYIISKAI                                            344
           A T +    I+T++I  K +
Sbjct: 356 AATYVFVFIVTFVIIKIV                                            373
```

No corresponding DNA sequence was identified in *S. pyogenes*.

A related GBS gene <SEQ ID 8975> and protein <SEQ ID 8976> were also identified. Analysis of this protein sequence reveals the following:

```
Lipop: Possible site: -1 Crend: 4
McG: Discrim Score: 17.19
GVH: Signal Score (-7.5): -4.07
     Possible site: 24
>>> Seems to have an uncleavable N-term signal seq
ALOM program count: 9 value: -11.73 threshold: 0.0
     INTEGRAL      Likelihood = -11.73    Transmembrane    7-23     (1-31)
     INTEGRAL      Likelihood =  -6.42    Transmembrane   86-102    (82-108)
     INTEGRAL      Likelihood =  -6.42    Transmembrane  324-340    (318-342)
     INTEGRAL      Likelihood =  -5.26    Transmembrane  210-226    (207-229)
     INTEGRAL      Likelihood =  -5.10    Transmembrane  113-129    (112-133)
     INTEGRAL      Likelihood =  -1.49    Transmembrane  246-262    (246-263)
     INTEGRAL      Likelihood =  -1.17    Transmembrane  183-199    (183-199)
     INTEGRAL      Likelihood =  -0.43    Transmembrane   41-57     (41-57)
     INTEGRAL      Likelihood =  -0.00    Transmembrane  265-281    (265-282)
     PERIPHERAL    Likelihood =   0.26                   152
modified ALOM score: 2.85

*** Reasoning Step: 3

----- Final Results -----
              bacterial membrane --- Certainty = 0.5692(Affirmative) < succ>
              bacterial outside  --- Certainty = 0.0000(Not Clear)  < succ>
              bacterial cytoplasm --- Certainty = 0.0000(Not Clear) < succ>
```

The protein has homology with the following sequences in the databases:

```
ORF01800(307-1332 of 1641)
EGAD|19589|BS3646(1-373 of 404) probable ammonium transporter{Bacillus subtilis}
OMNI|NT01BS4254 ammonium transporter SP|Q07429|NRGA_BACSU PROBABLE AMMONIUM
TRANSPORTER(MEMBRANE PROTEIN NRGA). GP|143264|gb|AAA17399.1||L03216 membrane-
associated protein{Bacillus subtilis}GP|1684645|emb|CAB05374.1||Z82987 unknown
{Bacillus subtilis}GP|2636176|emb|CAB15668.1||Z99122 ammonium transporter{Bacillus
subtilis}PIR|A36865|A36865 ammonium transporter nrgA-Bacillus subtilis
% Match = 13.5
% Identity = 30.0  % Similarity = 54.8
Matches = 104  Mismatches = 149  Conservative Sub.s = 86
         144       174       204       234       264       294       324       354
PFSMIRKFVSPNRCMAEPKPIPAAPAPIIMV**CFMSSP*QK*MCKIKYLTS*Q*YSLTNKRVFVKKGLFVFLLLCILSM
                                                                   ::  |   || :::|  |  :
                                                                   MQMGDTVFMFFCALLV
                                                                                  10
         384       411       441       471       501       531
WLMIFGVAFYYFGSLH-QSLTSRIIYQFVLTVLLTTTAWFMGAYFLAFEGHFKTVFQFQEADGKQI--------------
||| |:|::| | : :  :::  |  :   |     |||   :|||   |   |   :  |   | |   |
WLMTPGLALFYGGMVKSKNVLSTAMHSF-SSIAIVSIVWVLFGYTLAFAPGNSIIGGLEWAGLKGVGFDPGDYSDTIPHS
         30        40        50        60        70        80        90
579       609       639       669       699       729       759       789
VNCLFQLCFALYAVVMLIGSIIDRVQTKRLLLAVVSWLFLVYTPLAYLIWNSEGVFAKMGVLDFSGGMIVHLSAGLSSYI
:  :||: ||:    ::  |: :|:: :||   |  | ||||||:| :|    |  ::|  |||::||| :|||:|:: :
LFMMFQMTFAVLTTAIISGAFAERMRFGAFLLFSVLWASLVTYPVAHWVWGG-GWEGQLGALDFAGGNVVHISSGVAGLV
         110       120       130       140       150       160       170
819       849       873       903       933       963       993       1023
LAHVIGKSEHQHNKVKNDSLF--LGMILITFGWFGFNMGPVGEWNSQAIMILLNTIFAIIGGGLAWTLAAKWNGEEEKTG
|| |:||  :         :: ::   || |||||||||:|  :  |:  :  :|| |   |    | |  :|  :: |
LAIVLGKRKDGTASSPHNLIYTFLGGALIWGFWFGFNVGSALTLDGVAMYAFINTNTAAAAGIAGWIL-VEWIINKKPTM
         190       200       210       220       230       240       250
1050      1080      1110      1140      1170      1200      1230      1260
-SLLNGIIVGLVTSTAGVGYLLTWQLLAVTFFASLFTYFVTDYXAKAFAIDDVVSSFGMNGIGGLLGSLGVGLFKLSHMP
 ::|  |  ||| |:| :  | ::| :   ::   ::|||   |  : |||   |  :  |||   |
LGAVSGAIAGLVAITPAAGFVTPFASIIGIIGGAVCFWGVFSLKKKFGYDDALDAFGLHGIGGTWGGIATGLFATTSVN
         270       280       290       300       310       320       330
1272      1302      1332      1362      1392      1422      1452
V---------------QLLALATTILLSIIMTYIISKAIFRK**IRLRCTSQPYLLF*QGE*LNRIINHFHY*TLSXX*
                |::|:| |  ::  |:|::|    :
SAGADGLFYGDASLIWKQIVAIAATYVFVIVTFVIIKIVSKFLPLRATEEEESLGDTMHGEKAYQDSM
         350       360       370       380       390       400
```

Based on this analysis, it was predicted that these proteins and their epitopes could be useful antigens for vaccines or diagnostics.

EXAMPLE 2087

A DNA sequence (GBSx2202) was identified in *S. agalactiae* <SEQ ID 6459> which encodes the amino acid sequence <SEQ ID 6460>. This protein is predicted to be dUTPase (dut). Analysis of this protein sequence reveals the following:

```
Possible site: 51
>>> Seems to have no N-terminal signal sequence

----- Final Results -----
         bacterial cytoplasm --- Certainty = 0.2731(Affirmative) < succ>
          bacterial membrane --- Certainty = 0.0000(Not Clear) < succ>
           bacterial outside --- Certainty = 0.0000(Not Clear) < succ>
```

A related GBS nucleic acid sequence <SEQ ID 9471> which encodes amino acid sequence <SEQ ID 9472> was also identified.

The protein has homology with the following sequences in the GENPEPT database.

```
>GP: CAA72644 GB: Y11901 dUTPase [Lactococcus lactis]
Identities = 67/144 (46%), Positives = 90/144 (61%), Gaps = 8/144 (5%)
Query:  40 RGFELVSQFSNKELLPKRETAHAAGYDLKVAKKTVIEPGEITLVPTGIKAYMQPGEVLYL   99
           RGF+   +      +P+R T H+AGYD+  ++    I+P EI +V TG+   +   EVL L
Sbjct:   3 RGFK---KLDGNATIPERATKHSAGYDISASETVTIQPDEIKMVSTGLAVQLGDDEVLKL   59

Query: 100 YDRSSNPRKKGIVLINSVGVIDGDYYNNQVNEGHIFAQMQNITDQAVILEEGERIVQAVF  159
           YDRSSNP K+GI LINSVG+ID DYY +          NI+ + V + +G+RI+Q VF
```

```
                            -continued
Sbjct:  60 YDRSSNPVKRGIALINSVGIIDSDYYPQEFK-----GLFMNISKEPVTISKGQRIMQGVF 114

Query: 160 APFLLADDDQATGMRTGGFGSTGK                                     183
           +L  DDD A G RTGGFGSTG+
Sbjct: 115 VKYLTIDDDNANGKRTGGFGSTGE                                     138
```

A related DNA sequence was identified in *S. pyogenes* <SEQ ID 6461> which encodes the amino acid sequence <SEQ ID 6462>. Analysis of this protein sequence reveals the following:

```
Possible site: 37
>>> Seems to have no N-terminal signal sequence

----- Final Results -----
            bacterial cytoplasm --- Certainty = 0.2519(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below.

```
Identities = 115/148 (77%), Positives = 125/148 (83%)
Query:  36 MSKVRGFELVSQFSNKELLPKRETAHAAGYDLKVAKKTVIEPGEITLVPTGIKAYMQPGE   95
           M+K+RGFELVS F+N +LLPKRET HAAGYDL VA+    I PGEI LVPTG+KAYMQ GE
Sbjct:   1 MTKIRGFELVSSFTNPDLLPKRETTHAAGYDLSVAEAVTIAPGEIKLVPTGVKAYMQDGE   60

Query:  96 VLYLYDRSSNPRKKGIVLINSVGVIDGDYYNNQVNEGHIFAQMQNITDQAVILEEGERIV  155
           VLYLYDRSSNPRKKGI+LINSVGVID DYY N+ NEGHIFAQMQNITD  V L  GERIV
Sbjct:  61 VLYLYDRSSNPRKKGIILINSVGVIDADYYGNEANEGHIFAQMQNITDHPVTLAVGERIV  120

Query: 156 QAVFAPFLLADDDQATGMRTGGFGSTGK                                 183
           Q VF PFL+AD DQA G RTGGFGSTG+
Sbjct: 121 QGVFMPFLIADGDQARGERTGGFGSTGQ                                 148
```

Based on this analysis, it was predicted that this protein and its epitopes, could be useful antigens for vaccines or diagnostics.

EXAMPLE 2088

A DNA sequence (GBSx2203) was identified in *S. agalactiae* <SEQ ID 6463> which encodes the amino acid sequence <SEQ ID 6464>. This protein is predicted to be RadA homolog (radA). Analysis of this protein sequence reveals the following:

```
Possible site: 34
>>> Seems to have no N-terminal signal sequence

----- Final Results -----
            bacterial cytoplasm --- Certainty = 0.2628(Affirmative) < succ>
             bacterial membrane --- Certainty = 0.0000(Not Clear)   < succ>
              bacterial outside --- Certainty = 0.0000(Not Clear)   < succ>
```

The protein has homology with the following sequences in the GENPEPT database.

```
>GP: CAB11863 GB: Z99104 DNA repair protein homolog [Bacillus subtilis]
Identities = 285/453 (62%), Positives = 358/453 (78%), Gaps = 4/453 (0%)
Query:   1 MAKKKSVFTCQECGYQSPKYLGRCPNCSAWSSFVEEVEVQEVKNARVSLNGEKSRPTKLK   60
           MAK KS F CQ CGY+SPK++G+CP C AW++ VEE+  +  N R + +        K
Sbjct:   1 MAKTKSKFICQSCGYESPKWMGKCPGCGAWNTMVEEMIKKAPANRRAAFSHSVQTVQKPS   60

Query:  61 DVSSINYS---RTKTDMDEFNRVLGGGVVPGSLVLIGGDPGIGKSTLLLQVSTQLA-NKG  116
           ++SI  S    R KT + EFNRVLGGGVV GSLVLIGGDPGIGKSTLLLQVS QL+ +
Sbjct:  61 PITSIETSEEPRVKTQLGEFNRVLGGGVVKGSLVLIGGDPGIGKSTLLLQVSAQLSGSSN  120

Query: 117 TVLYVSGEESAEQIKLRSERLGDIDNEFYLYAETNMQSIRSEIEKIKPDFLIIDSIQTIM  176
```

-continued
```
              +VLY+SGEES +Q KLR++RLG +    ++ +ET+M+ I S I+++ P F+++DSIQT+
Sbjct:  121 SVLYISGEESVKQTKLRADRLGINNPSLHVLSETDMEYISSAIQEMNPSFVVVDSIQTVY  180

Query:  177 SPEVSSVQGSVSQVREVTAELMQLAKTNNIATFIVGHVTKEGTLAGPRMLEHMVDTVLYF  236
              +++S  GSVSQVRE TAELM++AKT   I  FIVGHVTKEG+++AGPR+LEHMVDTVLYF
Sbjct:  181 QSDITSAPGSVSQVRECTAELMKIAKTKGIPIFIVGHVTKEGSIAGPRLLEHMVDTVLYF  240

Query:  237 EGERHHTFRILRAVKNRFGSTNEIGIFEMQSGGLVEVLNPSQVFLEERLDGATGSAIVVT  296
              EGERHHTFRILRAVKNRFGSTNE+GIFEM+  GL EVLNPS++FLEER  G+ GS+I  +
Sbjct:  241 EGERHHTFRILRAVKNRFGSTNEMGIFEMREEGLTEVLNPSEIFLEERSAGSAGSSITAS  300

Query:  297 MEGTRPILAEVQALVTPTVFGNAKRTTTGLDFNRVSLIMAVLEKRCGLLLQNQDAYLKSA  356
              MEGTRPIL E+QAL++PT FGN +R  TG+D NRVSL+MAVLEKR GLLLQNQDAYLK A
Sbjct:  301 MEGTRPILVEIQALISPTSFGNPRRMATGIDHNRVSLLMAVLEKRVGLLLQNQDAYLKVA  360

Query:  357 GGVKLDEPAIDLAVAVAIASSYKEKPTNPQESFIGEIGLTGEIRRVTRIEQRINEASKLG  416
              GGVKLDEPAIDLA+ ++IASS+++ P NP + FIGE+GLTGE+RRV RIEQR+ EA+KLG
Sbjct:  361 GGVKLDEPAIDLAIVISIASSFRDTPPNPADCFIGEVGLTGEVRRVSRIEQRVKEAAKLG  420

Query:  417 FTKIYAPKNSLAGIEIPKGIDVIGVTTVSQVLK                             449
              F ++   P  +L G    PKGI+VIGV V++ L+
Sbjct:  421 FKRMIIPAANLDGWTKPKGIEVIGVANVAEALR                             453
```

20

A related DNA sequence was identified in *S. pyogenes* <SEQ ID 6465> which encodes the amino acid sequence <SEQ ID 6466>. Analysis of this protein sequence reveals the following:

```
Possible site: 34
>>> Seems to have no N-terminal signal sequence

----- Final Results -----
              bacterial cytoplasm --- Certainty = 0.2191(Affirmative) < succ>
               bacterial membrane --- Certainty = 0.0000(Not Clear)  < succ>
                bacterial outside --- Certainty = 0.0000(Not Clear)  < succ>
```

An alignment of the GAS and GBS proteins is shown below.

```
Identities = 416/453 (91%), Positives = 441/453 (96%)
Query:    1 MAKKKSVFTCQECGYQSPKYLGRCPNCSAWSSFVEEVEVQEVKNARVSLNGEKSRPTKLK   60
              MAKKK+ F CQECGYQSPKYLGRCPNCSAWSSFVEEVEVKEVKNARVSL GEKSRP KLK
Sbjct:    1 MAKKKATFICQECGYQSPKYLGRCPNCSAWSSFVEEVEVKEVKNARVSLAGEKSRPVKLK   60

Query:   61 DVSSINYSRTKTDMDEFNRVLGGGVVPGSLVLIGGDPGIGKSTLLLQVSTQLANKGTVLY  120
              DV +I+Y RT+TDM EFNRVLGGGVVPGSL+LIGGDPGIGKSTLLLQVSTQLANKGTVLY
Sbjct:   61 DVDNISYHRTQTDMSEFNRVLGGGVVPGSLILIGGDPGIGKSTLLLQVSTQLANKGTVLY  120

Query:  121 VSGEESAEQIKLRSERLGDIDNEFYLYAETNMQSIRSEIEKIKPDFLIIDSIQTIMSPEV  180
              VSGEESAEQIKLRSERLGDIDNEFYLYAETNMQ+IR+EIE IKPDFLIIDSIQTIMSP++
Sbjct:  121 VSGEESAEQIKLRSERLGDIDNEFYLYAETNMQAIRTEIENIKPDFLIIDSIQTIMSPDI  180

Query:  181 SSVQGSVSQVREVTAELMQLAKTNNIATFIVGHVTKEGTLAGPRMLEHMVDTVLYFEGER  240
                + VQGSVSQVREVTAELMQLAKTNNIATFIVGHVTKEGTLAGPRMLEHMVDTVLYFEGER
Sbjct:  181 TGVQGSVSQVREVTAELMQLAKTNNIATFIVGHVTKEGTLAGPRMLEHMVDTVLYFEGER  240

Query:  241 HHTFRILRAVKNRFGSTNEIGIFEMQSGGLVEVLNPSQVFLEERLDGATGSAIVVTMEGT  300
              HHTFRILRAVKNRFGSTNEIGIFEMQSGGLVEVLNPSQVFLEERLDGATGSA+VVTMEG+
Sbjct:  241 HHTFRILRAVKNRFGSTNEIGIFEMQSGGLVEVLNPSQVFLEERLDGATGSAVVVTMEGS  300

Query:  301 RPILAEVQALVTPTVFGNAKRTTTGLDFNRVSLIMAVLEKRCGLLLQNQDAYLKSAGGVK  360
              RPILAEVQ+LVTPTVFGNA+RTTTGLDFNRVSLIMAVLEKRCGLLLQNQDAYLKSAGGVK
Sbjct:  301 RPILAEVQSLVTPTVFGNARRTTTGLDFNRVSLIMAVLEKRCGLLLQNQDAYLKSAGGVK  360

Query:  361 LDEPAIDLAVAVAIASSYKEKPTNPQESFIGEIGLTGEIRRVTRIEQRINEASKLGFTKI  420
              LDEPAIDLAVAVAIASSYKEKPT+PQE+F+GEIGLTGEIRRVTRIEQRINEA+KLGFTK+
Sbjct:  361 LDEPAIDLAVAVAIASSYKEKPTSPQEAFLGEIGLTGEIRRVTRIEQRINEAAKLGFTKV  420

Query:  421 YAPKNSLAGIEIPKGIDVIGVTTVSQVLKAVFS                             453
              YAPKN+L GI+IP+GI+V GVTTV QVL AVFS
Sbjct:  421 YAPKNALQGIDIPQGIEVVGVTTVGQVLNAVFS                             453
```

Based on this analysis, it was predicted that this protein and its epitopes, could be useful antigens for vaccines or diagnostics.

EXAMPLE 2089

A DNA sequence (GBSx2204) was identified in *S. agalactiae* <SEQ ID 6467> which encodes the amino acid sequence <SEQ ID 6468>. Analysis of this protein sequence reveals the following:

```
Possible site: 49
>>> Seems to have no N-terminal signal sequence

----- Final Results -----
            bacterial cytoplasm --- Certainty = 0.3488(Affirmative) < succ>
             bacterial membrane --- Certainty = 0.0000(Not Clear)   < succ>
              bacterial outside --- Certainty = 0.0000(Not Clear)   < succ>
```

The protein has homology with the following sequences in the GENPEPT database.

```
>GP: CAA97750 GB: Z73419 hypothetical protein Rv1284 [Mycobacterium
tuberculosis]
Identities = 69/162 (42%), Positives = 100/162 (61%), Gaps = 2/162 (1%)
Query:   3 TYFDNFLKTNQAYADLHGTAHLPIKPKTKVAIVTCMDSRLHVAQALGLALGDAHILRNAG   62
            T  D++L  N  YA      LP+ P   AIV CMD+RL V + LG+   G+AH++RNAG
Sbjct:   2 TVTDDYLANNVDYASGF-KGPLPMPPSKHIAIVACMDARLDVYRMLGIKEGEAHVIRNAG   60

Query:  63 GRVTDDVLRSLVISQQQLGTREIVVLHHTDCGAQTFTNEAFAAQLQRDLGVDMHGHDFLP  122
             VTDDV+RSL ISQ+ LGTREI++LHHTDCG  TFT++  F   +Q + G+
Sbjct:  61 CVVTDDVIRSLAISQRLLGTREIILLHNTDCGMLTFTDDDFKRAIQDETGIRPTWSP-ES  119

Query: 123 FNDIEESVREDVAKLHASPLIPDDVVISGAIYDVDTGRMVEV                   164
            + D  E VR+ + ++ +P +    + G  ++DV TG++ EV
Sbjct: 120 YPDAVEDVRQSLRRIEVNPFVTKHTSLRGFVFDVATGKLNEV                   161
```

There is also homology to SEQ ID 6470:

```
Identities = 126/164 (76%), Positives = 146/164 (88%)
Query:   1 MTTYFDNFLKTNQAYADLHGTAHLPIKPKTKVAIVTCMDSRLHVAQALGLALGDAHILRN   60
            + +YF++F+  NQAY  LHGTAHLP+KPKTKVAIVTCMDSRLHVAQALGLALGDAHILRN
Sbjct:   1 LMSYFEHFMAANQAYVALHGTAHLPLKPKTKVAIVTCMDSRLHVAQALGLALGDAHILRN   60

Query:  61 AGGRVTDDVLRSLVISQQQLGTREIVVLHHTDCGAQTFTNEAFAAQLQRDLGVDMHGHDF  120
            AGGRVT+D++RSLVISQQQ+GTREIVVLHHTDCGAQTFTNE FA +   LGVD G DF
Sbjct:  61 AGGRVTEDMIRSLVISQQQMGTREIVVLHHTDCGAQTFTNEGFAKHIHEHLGVDVSGQDF  120

Query: 121 LPFNDIEESVREDVAKLHASPLIPDDVVISGAIYDVDTGRMVEV                 164
            LPF D+E+SVRED+AK+ AS LI DDVVI+GA+YDVDTG+M +V
Sbjct: 121 LPFQDVSDSVREDMAKIRASSLISDDVVINGAVYDVDTGKMTQV                 164
```

Based on this analysis, it was predicted that this protein and its epitopes, could be useful antigens for vaccines or diagnostics.

EXAMPLE 2090

A DNA sequence (GBSx2205) was identified in *S. agalactiae* <SEQ ID 6471> which encodes the amino acid sequence <SEQ ID 6472>. Analysis of this protein sequence reveals the following:

```
Possible site: 19
>>> Seems to have no N-terminal signal sequence

----- Final Results -----
            bacterial cytoplasm --- Certainty = 0.0536(Affirmative) < succ>
             bacterial membrane --- Certainty = 0.0000(Not Clear)   < succ>
              bacterial outside --- Certainty = 0.0000(Not Clear)   < succ>
```

A related GBS nucleic acid sequence <SEQ ID 9473> which encodes amino acid sequence <SEQ ID 9474> was also identified.

The protein has homology with the following sequences in the GENPEPT database.

```
>GP: AAC73407 GB: AE000137 putative oxidoreductase [Escherichia coli K12]
Identities = 199/438 (45%), Positives = 286/438 (64%)
Query:    1 MKKYDVIVLGFGKAGKTLAAKLATQGKSVAMVEEDDKMYGGTCINIGCIPTKTLLVSASK   60
            M KY +++GFGKAGKTLA  LA  G VA++E+ + MYGGTCINIGCIPTKTL+  A +
Sbjct:   10 MNKYQAVIIGFGKAGKTLAVTLAKAGWRVALIEQSNAMYGGTCINIGCIPTKTLVHDAQQ   69

Query:   61 NHDFQEAMTTRNEVTSRLRAKNFAMLDNKDTVDVYNAKARFISNKVVELTGGADKQELTA  120
            + DF  A+  +NEV + LR KNF  L +    +DV + +A FI+N  + +          E+
Sbjct:   70 HTDFVRAIQRKNEVVNFLRNKNFHNLADMPNIDVIDGQAEFINNHSLRVHRPEGNLEIHG  129

Query:  121 DVIIINTGAKSVQLPIPGLADSQHVYDSTAIQELAHLPKRLGIIGGGNIGLEFATLYSEL  180
            + I INTGA++V  PIPG+ +   VYDST +  L  LP  LGI+GGG IG+EFA++++
Sbjct:  130 EKIFINTGAQTVVPPIPGITTTPGVYDSTGLLNLKELPGHLGILGGGYIGVEFASMFANF  189

Query:  181 GSKVTVIDSQSRIFAREEEELSEMAQDYLEEMGISFKLSADIKSVQNEDEDVVISFEDEK  240
            GSKVT++++ S    RE+ ++++      L + G+    L+A ++ + + + V + E   +
Sbjct:  190 GSKVTILEAASLFLPREDRDIADNIATILRDQGVDIILNAHVERISHHENQVQVHSEHAQ  249

Query:  241 LSFDAVLYATGRKPNTEGLALENTDIKLTERGAIAVDEYCQTSVENIFAVGDVNGGPQFT  300
            L+  DA+L A+GR+P T  L  EN   I + ERGAI VD+    T+ +NI+A+GDV GG QFT
Sbjct:  250 LAVDALLIASGRQPATASLHPENAGIAVNERGAIVVDKRLHTTADNIWAMGDVTGGLQFT  309

Query:  301 YISLDDSRIVLNYLNCDKDYSLKNRGAVPTSTFTNPPLATVGLDEKTAKEKGYQVKSNSL  360
            YISLDD  RIV + L  +     S +R  VP S F  PPL+ VG+ E+  A+E G  ++   +L
Sbjct:  310 YISLDDYRIVRDELLGEGKRSTDDRKNVPYSVFMTPPLSRVGMTEEQARESGADIQVVTL  369

Query:  361 LVSAMPRAHVNNDLRGIFKVVVDTETNLILGARLFGAESHELINIITMAMDNKIPYTYFQ  420
            +V+A+PRA V ND RG+  K +VD +T   +LGA L    +SHE+INI+ M MD   +PY+   +
Sbjct:  370 PVAAIPRARVMNDTRGVLKAIVDNKTQRMLGASLLCVDSHEMINIVKMVMDAGLPYSILR  429

Query:  421 KQIFTHPTMVENFNDLFN                                            438
            QIFTHP+M  E+  NDLF+
Sbjct:  430 DQIFTHPSMSESLNDLFS                                            447
```

There is also homology to SEQ ID 1820.

Based on this analysis, it was predicted that this protein and its epitopes, could be useful antigens for vaccines or diagnostics.

EXAMPLE 2091

A DNA sequence (GBSx2206) was identified in *S. agalactiae* <SEQ ID 6473> which encodes the amino acid sequence <SEQ ID 6474>. This protein is predicted to be glutamyl-tRNA synthetase (gltX). Analysis of this protein sequence reveals the following:

```
Possible site: 43
>>> Seems to have no N-terminal signal sequence

----- Final Results -----
            bacterial cytoplasm --- Certainty = 0.2245(Affirmative) < succ>
             bacterial membrane --- Certainty = 0.0000(Not Clear)   < succ>
              bacterial outside --- Certainty = 0.0000(Not Clear)   < succ>
```

A related GBS nucleic acid sequence <SEQ ID 9475> which encodes amino acid sequence <SEQ ID 9476> was also identified. A further related GBS nucleic acid sequence <SEQ ID 10953> which encodes amino acid sequence <SEQ ID 10954> was also identified.

The protein has homology with the following sequences in the GENPEPT database.

```
>GP: AAC31971 GB: U49789 glutamyl-tRNA synthetase [Bacillus subtilis]
Identities = 273/491 (55%), Positives = 353/491 (71%), Gaps = 19/491 (3%)
Query:   20 LANKIRVRYAPSPTGLLHIGNARTALFNYLYARHHGGDFVIRIEDTDRKRHVEDGERSQL   79
```

```
                 -continued
             + N++RVRYAPSPTG LHIGNARTALFNYL+AR+ GG F+IR+EDTD+KR++E GE+SQL
Sbjct:    1 MGNEVRVRYAPSPTGHLHIGNARTALFNYLFARNQGGKFIIRVEDTDKKRNIEGGEQSQL   60

Query:   80 ENLRWLGMDWDESPET---HENYRQSERLELYQRYIDQLLAEGKAYKSYVTEEELAAERE  136
             L+WLG+DWDES +    +    YRQSER ++Y+ Y ++LL +G AYK Y TEEEL  ERE
Sbjct:   61 NYLKWLGIDWDESVDVGGEYGPYRQSERNDIYKVYYEELLEKGLAYKCYCTEEELEKERE  120

Query:  137 RQELAGETPRYINEFIGMSETEKEAYIAEREAAGIIPTVRLAVNESGIYKWTDMVKGDIE  196
                Q   GE PRY  +  +++ E+E +IAE     G  P++R  V E +  + D+VKG+I
Sbjct:  121 EQIARGEMPRYSGKHRDLTQEEQEKFIAE----GRKPSIRFRVPEGKVIAFNDIVKGEIS  176

Query:  197 FEGSNIGGDWVIQKKDGYPTYNFAVVIDDHDMQISHVIRGDDHIANTPKQLMVYEALGWE  256
            FE    IG D+VI KKDG PTYNFAV IDD+ M+++HV+RG+DHI+NTPKQ+M+Y+A GW+
Sbjct:  177 FESDGIG-DFVIVKKDGTPTYNFAVAIDDYLMKMTHVLRGEDHISNTPKQIMIYQAFGWD  235

Query:  257 APQFGHMTLIINSETGKKLSKRDTNTLQFIEDYRKKGYMSEAVFNFIALLGWNPGGEEEI  316
               PQFGHMTLI+N E+ KKLSKRD + +QFIE Y++ GY+ EA+FNFI LLGW+P GEEE+
Sbjct:  236 IPQFGHMTLIVN-ESRKKLSKRDESIIQFIEQYKELGYLPEALFNFIGLLGWSPVGEEEL  294

Query:  317 FSREQLINLFDENRLSKSPAAFDQKKMDWMSNDYLKNADFESVFALCKPFLEEAGRL---  373
            F++EQ I +FD NRLSKSPA FD   K+ W++N Y+K  D +  V  L  P L++AG++
Sbjct:  295 FTKEQFIEIFDVNRLSKSPALFDMHKLKWVNNQYVKKLDLDQVVELTPLHLQKAGKVGTE  354

Query:  374 -----TDKAEKLVELYQPQLKSADEIVPLTDLFFADFPELTEAEKEVMAAETVPTVLSAF  428
                   + KL+ LY  QL     EIV LTDLFF D  E  + K V+ E VP VLS F
Sbjct:  355 LSAEEQEWVRKLISLYHEQLSYGAEIVELTDLFFTDEIEYNQEAKAVLEEEQVPEVLSTF  414

Query:  429 KEKLVSLSDEEFTRDTIFPQIKAVQKETGIKGKNLFMPIRIAVSGEMHGPELPDTIYLLG  488
              KL  L   EEFT D I    IKAVQKETG KGK LFMPIR+AV+G+ HGPELP +I L+G
Sbjct:  415 AAKLEEL--EEFTPDNIKASIKAVQKETGHKGKKLFMPIRVAVTGQTHGPELPQSIELIG  472

Query:  489 KEKSVQHIDNM                                                  499
             KE  ++Q + N+
Sbjct:  473 KETAIQRLKNI                                                  483
```

<sup>30</sup>
A related DNA sequence was identified in *S. pyogenes* <SEQ ID 6475> which encodes the amino acid sequence <SEQ ID 6476>. Analysis of this protein sequence reveals the following:

```
Possible site: 24
>>> Seems to have no N-terminal signal sequence

----- Final Results -----
        bacterial cytoplasm --- Certainty = 0.1966(Affirmative) < succ>
         bacterial membrane --- Certainty = 0.0000(Not Clear)   < succ>
          bacterial outside --- Certainty = 0.0000(Not Clear)   < succ>
```

An alignment of the GAS and GBS proteins is shown below.

```
Identities = 434/481 (90%), Positives = 459/481 (95%)
Query:   20 LANKIRVRYAPSPTGLLHIGNARTALFNYLYARHHGGDFVIRIEDTDRKRHVEDGERSQL   79
             ++  IRVRYAPSPTGLLHIGNARTALFNYLYAR HGG F+IRIEDTDRKRHVEDGERSQL
Sbjct:    1 MSKPIRVRYAPSPTGLLHIGNARTALFNYLYARRHGGTFIIRIEDTDRKRHVEDGERSQL   60

Query:   80 ENLRWLGMDWDESPETHENYRQSERLELYQRYIDQLLAEGKAYKSYVTEEELAAERERQE  139
            ENL+WLGMDWDESPETHENYRQSERL LYQ+YIDQLLAEGKAYKSYVTEEELAAERERQE
Sbjct:   61 ENLKWLGMDWDESPETHENYRQSERLALYQQYIDQLLAEGKAYKSYVTEEELAAERERQE  120

Query:  140 LAGETPRYINEFIGMSETEKEAYIAEREAAGIIPTVRLAVNESGIYKWTDMVKGDIEFEG  199
               AGETPRYINEFIGMS  EK  YIAEREAAGI+PTVRLAVNESGIYKWTDMVKGDIEFEG
Sbjct:  121 AAGETPRYINEFIGMSADEKAKYIAEREAAGIVPTVRLAVNESGIYKWTDMVKGDIEFEG  180

Query:  200 SNIGGDWVIQKKDGYPTYNFAVVIDDHDMQISHVIRGDDHIANTPKQLMVYEALGWEAPQ  259
             NIGGDWVIQKKDGYPTYNFAVV+DDHDMQISHVIRGDDHIANTPKQLMVYEALGWEAP+
Sbjct:  181 GNIGGDWVIQKKDGYPTYNFAVVVDDHDMQISHVIRGDDHIANTPKQLMVYEALGWEAPE  240

Query:  260 FGHMTLIINSETGKKLSKRDTNTLQFIEDYRKKGYMSEAVFNFIALLGWNPGGEEEIFSR  319
            FGHMTLIINSETGKKLSKRDTNTLQFIEDYRKKGYM EAVFNFIALLGWNPGGEEEIFSR
Sbjct:  241 FGHMTLIINSETGKKLSKRDTNTLQFIEDYRKKGYMPEAVFNFIALLGWNPGGEEEIFSR  300

Query:  320 EQLINLFDENRLSKSPAAFDQKKMDWMSNDYLKNADFESVFALCKPFLEEAGRLTDKAEK  379
            EQLI LFDENRLSKSPAAFDQKKMDWMSN+YLK+ADFE+V+ALCKPFLEEAGRLT+KAEK
Sbjct:  301 EQLIALFDENRLSKSPAAFDQKKMDWMSNEYLKHADFETVYALCKPFLEEAGRLTEKAEK  360
```

-continued
```
Query:  380 LVELYQPQLKSADEIVPLTDLFFADFPELTEAEKEVMAAETVPTVTLSAFKEKLVSLSDEE   439
            LVELY+PQLKSADEI+PLTDLFF+DFPELTEAEKEVMA ETV TVL AFK KL ++SDE+
Sbjct:  361 LVELYKPQLKSADEIIPLTDLFFSDFPELTEAEKEVMAGETVSTVLQAFKAKLEAMSDED   420

Query:  440 FTRDTIFPQIKAVQKETGIKGKNLFMPIRIAVSGEMHGPELPDTIYLLGKEKSVQHIDNML  500
            F   + IFPQIKAVQKETGIKGKNLFMPIRIAVSGEMHGPELP+TIYLLG++KS++HI NML
Sbjct:  421 FKPENIFPQIKAVQKETGIKGKNLFMPIRIAVSGEMHGPELPNTIYLLGRDKSIEHIKNML  481
```

Based on this analysis, it was predicted that this protein and its epitopes, could be useful antigens for vaccines or diagnostics.

EXAMPLE 2092

A DNA sequence (GBSx2207) was identified in *S. agalactiae* <SEQ ID 6477> which encodes the amino acid sequence <SEQ ID 6478>. This protein is predicted to be d-ribose-binding protein precursor, fragment (rbsB). Analysis of this protein sequence reveals the following:

```
Possible site: 24
>>> May be a lipoprotein

----- Final Results -----
            bacterial membrane --- Certainty = 0.0000(Not Clear)  < succ>
            bacterial outside  --- Certainty = 0.0000(Not Clear)  < succ>
            bacterial cytoplasm --- Certainty = 0.0000(Not Clear) < succ>
```

The protein has homology with the following sequences in the GENPEPT database.

```
>GP: CAB15613 GB: Z99122 ribose ABC transporter (ribose-binding
protein) [Bacillus subtilis]
Identities = 143/301 (47%), Positives = 205/301 (67%), Gaps = 1/301 (0%)
Query:   14 MSIVLILGACGKTGLGNSSGNSTKNVTKKSAKDLKLGVSISTTNNPYFVAMKDGIDKYAS    73
            +S++L L    T           K    + K+  +G+S+ST NNP+FV++K GI+K A
Sbjct:    5 VSVILTLSLFLLTACSLEPPQWAKPSNSGNKKEFTIGLSVSTLNNPFFVSLKKGIEKEAK    64

Query:   74 NKKISIKVADAQDDAARQADDVQNFISQNVDAILINPVDSKAIVTAIKSANNANIPVILM   133
            + + + + DAQ+D+++Q  DV++ I Q VDA+LINP DS AI TA++SAN   +PV+ +
Sbjct:   65 KRGMKVIIVDAQNDSSKQTSDVEDLIQQGVDALLINPTDSSAISTAVESANAVGVPVVTI   124

Query:  134 DRGSEGGKVLTTVASDNVAAGKMAADYAVKKLGKKAKAFELSGVPGASATVDRGKGFHSV   193
            DR +E GKV T VASDNV  G+MAA +   KLGK AK  EL GVPGASAT +RG GFH++
Sbjct:  125 DRSAEQGKVETLVASDNVKGGEMAAAFIADKLGKGAKVAELEGVPGASATRERGSGFHNI   184

Query:  194 AKSKLDILSSQSANFDRAKALNTTQNMIQGHKDVQIIFAQNDEMALGAAQAVKSAGLQNV   253
            A   KL +++ QSA+FDR K L   +N++QGH D+Q +FA NDEMALGA +A+ S+G +++
Sbjct:  185 ADQKLQVVTKQSADFDRTKGLTVMENLLQGHPDIQAVFAHNDEMALGALEAINSSG-KDI   243

Query:  254 LIVGIDGQPDAHDAIKKGDISATIAQQPAKMGEIAIQAAIDYYKGKKVEKETISPIYLVTK   314
            L++G DG  DA +IK   +SAT+AQQP  +G++A +AA D   GKKV+K    +P+ L T+
Sbjct:  244 LVIGFDGNKDALASIKDRKLSATVAQQPELIGKLATEAADDILHGKKVQKTISAPLKLETQ   304
```

No corresponding DNA sequence was identified in *S. pyogenes*.

SEQ ID 6478 (GBS203) was expressed in *E. coli* as a His-fusion product. SDS-PAGE analysis of total cell extract is shown in FIG. 52 (lane 12; MW 36.8 kDa).

GBS203-His was purified as shown in FIG. 208, lane 8.

Based on this analysis, it was predicted that this protein and its epitopes, could be useful antigens for vaccines or diagnostics.

EXAMPLE 2093

A DNA sequence (GBSx2208) was identified in *S. agalactiae* <SEQ ID 6479> which encodes the amino acid sequence <SEQ ID 6480>. This protein is predicted to be galactoside ABC transporter, permease protein (rbsC). Analysis of this protein sequence reveals the following:

```
Possible site: 14
>>> Seems to have no N-terminal signal sequence
    INTEGRAL    Likelihood = -11.15    Transmembrane    63-79     (52-85)
    INTEGRAL    Likelihood =  -3.66    Transmembrane   111-127   (110-128)
    INTEGRAL    Likelihood =  -2.71    Transmembrane   168-184   (168-188)
    INTEGRAL    Likelihood =  -2.44    Transmembrane   189-205   (188-205)
```

```
  INTEGRAL    Likelihood = -0.80    Transmembrane    17-33    (17-33)

----- Final Results -----
            bacterial membrane  --- Certainty = 0.5458(Affirmative) < succ>
            bacterial outside   --- Certainty = 0.0000(Not Clear)   < succ>
            bacterial cytoplasm --- Certainty = 0.0000(Not Clear)   < succ>
```

A related GBS nucleic acid sequence <SEQ ID 9287> which encodes amino acid sequence <SEQ ID 9288> was also identified.

The protein has homology with the following sequences in the GENPEPT database.

```
22 GP: CAB15612 GB: Z99122 ribose ABC transporter (permease)
[Bacillus subtilis]
Identities = 144/211 (68%), Positives = 182/211 (86%), Gaps = 1/211 (0%)
Query:   1 MGMLNGLFISYGKLAPFIVTLATMTIFRGATLVYSNGNPITAGLSDSFLFQFLGQGYIVG   60
           +GM+NGL I+ GK+APFI TLATMT+FRG TLVY++GNPIT GL  ++ FQ  G+GY +G
Sbjct: 113 LGMINGLLITKGKMAPFIATLATMTVFRGLTLVYTDGNPIT-GLGTNYGFQMFGRGYFLG  171

Query:  61 IPFPVILMFLTFIILYILLHKTAFGKSVYALGGNEKAAYISGIKLNKVKIIIYTISGIMA  120
           IP P I M L F+IL++LLHKT FG+  YA+GGNEKAA ISGIK+ +VK++IY+++G+++
Sbjct: 172 IPVPAITMVLAFVILWVLLHKTPFGRRTYAIGGNEKAALISGIKVTRVKVMIYSLAGLLS  231

Query: 121 SISGLIITSRLSSAQPTAGASYEMDAIAAVVLGGTSLSGGKGRIIGTLIGALIIGVLNNG  180
           +++G I+TSRL SAQPTAG SYE+DAIAAVVLGGTSLSGG+GRI+GTLIG LIIG LNNG
Sbjct: 232 ALAGAILTSRLHSAQPTAGESYELDAIAAVVLGGTSLSGGRGRIVGTLIGVLIIGTLNNG  291

Query: 181 LNIIGVSAFWQQVVKGIVILMAVLLDRFKVA                              211
           LN++GVS+F+Q VVKGIVIL+AVLLDR K A
Sbjct: 292 LNLLGVSSFYQLVVKGIVILIAVLLDRKKSA                              322
```

A related GBS gene <SEQ ID 8977> and protein <SEQ ID 8978> were also identified.

Based on this analysis, it was predicted that this protein and its epitopes, could be useful antigens for vaccines or diagnostics.

EXAMPLE 2094

A DNA sequence (GBSx2209) was identified in *S. agalactiae* <SEQ ID 6481> which encodes the amino acid sequence <SEQ ID 6482>. Analysis of this protein sequence reveals the following:

```
Possible site: 35
>>> Seems to have no N-terminal signal sequence
    INTEGRAL    Likelihood = -1.12    Transmembrane    75-91   (74-91)
    INTEGRAL    Likelihood = -0.64    Transmembrane    96-112  (96-112)

----- Final Results -----
            bacterial membrane  --- Certainty = 0.1447(Affirmative) < succ>
            bacterial outside   --- Certainty = 0.0000(Not Clear)   < succ>
            bacterial cytoplasm --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 2095

A DNA sequence (GBSx2210) was identified in *S. agalactiae* <SEQ ID 6483> which encodes the amino acid sequence <SEQ ID 6484>. This protein is predicted to be ribose transport ATP-binding protein rbsa (rbsA). Analysis of this protein sequence reveals the following:

```
Possible site: 35
>>> Seems to have no N-terminal signal sequence
    INTEGRAL    Likelihood = -0.00    Transmembrane    401-417  (401-417)

----- Final Results -----
            bacterial membrane  --- Certainty = 0.1001(Affirmative) < succ>
            bacterial outside   --- Certainty = 0.0000(Not Clear)   < succ>
            bacterial cytoplasm --- Certainty = 0.0000(Not Clear)   < succ>
```

The protein has homology with the following sequences in the GENPEPT database.

```
>GP: CAB15611 GB: Z99122 ribose ABC transporter (ATP-binding protein)
[Bacillus subtilis]
Identities = 297/493 (60%), Positives = 375/493 (75%), Gaps = 1/493 (0%)
Query:    1 MKIDMRNISKSFGTNKVLEKIDLELQSGQIHALMGENGAGKSTLMNILTGLFPASTGTIY    60
            M+I+M++I K+FG N+VL  +  +L  G++HALMGENGAGKSTLMNILTGL  A   G I
Sbjct:    1 MQIEMKDIHKTFGKNQVLSGVSFQLMPGEVHALMGENGAGKSTLMNILTGLHKADKGQIS   60

Query:   61 IDGEERTFSNPQEAEEFGISFIHQEMNTWPEMTVLENLFLGREIKTTFGLLNQKLMRQKA   120
            I+G E  FSNP+EAE+ GI+FIHQE+N WPEMTVLENLF+G+EI +   G+L  + M+   A
Sbjct:   61 INGNETYFSNPKEAEQHGIAFIHQELNIWPEMTVLENLFIGKEISSKLGVLQTRKMKALA   120

Query:  121 LETFKRLGVTIPLDIPIGNLSVGQQQMIEIAKSLLNQLSILVMDEPTAALTDRETENLFR   180
               E F +L V++ LD   G  SVGQQQMIEIAK+L+       +++MDEPTAALT+RE    LF
Sbjct:  121 KEQFDKLSVSLSLDQEAGECSVGQQQMIEIAKALMTNAEVIIMDEPTAALTEREISKLFE   180

Query:  181 VIRGLKQEGVGVVYISHRMEEIFKITDFVTVMRDGVIVDTKETSLTNSDELVKKMVGRKL   240
            VI   LK+ GV +VYISHRMEEIF I D +T+MRDG VDT  S T+ DE+VKKMVGR+L
Sbjct:  181 VITALKKNGVSIVYISHRMEEIFAICDRITIMRDGKTVDTTNISETDFDEVVKKMVGREL   240

Query:  241 EDYYPEKHSEIGPVAFEVSNL-CGDNFEDVSFYVRKGEILGFSGLMGAGRTEVMRTIFGI   299
             +   YP++     +G   FEV N    +FEDVSFYVR GEI+G SGLMGAGRTE+MR +FG+
Sbjct:  241 TERYPKRTPSLGDKVFEVKNASVKGSFEDVSFYVRSGEIVGVSGLMGAGRTEMMRALFGV   300

Query:  300 DKKKSGKVKIDDQEITITTPSQAIKQGIGFLTENRKDEGLILDFNIKDNMTLPSTKDFSK   359
            D+   +G++ I ++  I   P +A+K+G+GF+TENRKDEGL+LD +I++N  LP+    FS
Sbjct:  301 DRLDTGEIWIAGKKTAIKNPQEAVKKGLGFITENRKDEGLLLDTSIRENIALPNLSSFSP   360

Query:  360 HGFFDEKTSTTFVQQLINRLYIKSGRPDLEVGNLSGGNQQKVVLAKWIGIAPKVLILDEP   419
               G   D K    FV  LI RL IK+  P+     +LSGGNQQKVV+AKWIGI PKVLILDEP
Sbjct:  361 KGLIDHKREAEFVDLLIKRLTIKTASPETHARHLSGGNQQKVVIAKWIGIGPKVLILDEP   420

Query:  420 TRGVDVGAKREIYQLMNELADRGVPIVMVSSDLPEILGVSDRIMVMHEGRISGELSRKEA   479
            TRGVDVGAKREIY LMNEL +RGV I+MVSS+LPEILG SDRI+V+HEGRISGE+   +EA
Sbjct:  421 TRGVDVGAKREIYTLMNELTERGVAIIMVSSELPEILGMSDRIIVVHEGRISGEIHAREA   480

Query:  480 DQEKVMQLATGGK                                                 492
            +QE++M LATGG+
Sbjct:  481 TQERIMTLATGGR                                                 493
```

There is also homology to SEQ ID 4678.

SEQ ID 6484 (GBS407d) was expressed in *E. coli* as a GST-fusion product. SDS-PAGE analysis of total cell extract is shown in FIG. 147 (lane 24; MW 72 kDa). It was also expressed in *E. coli* as a His-fusion product. SDS-PAGE analysis of total cell extract is shown in FIG. 147 (lane 5 & 6; MW 47 kDa).

GBS407d-His was purified as shown in FIG. 235, lane 9-10.

Based on this analysis, it was predicted that this protein and its epitopes, could be useful antigens for vaccines or diagnostics.

EXAMPLE 2096

A DNA sequence (GBSx2211) was identified in *S. agalactiae* <SEQ ID 6485> which encodes the amino acid sequence <SEQ ID 6486>. This protein is predicted to be high affinity ribose transport protein rbsd (rbsD). Analysis of this protein sequence reveals the following:

```
Possible site: 14
>>> Seems to have no N-terminal signal sequence

----- Final Results -----
          bacterial cytoplasm --- Certainty = 0.2673(Affirmative) < succ>
          bacterial membrane  --- Certainty = 0.0000(Not Clear)   < succ>
          bacterial outside   --- Certainty = 0.0000(Not Clear)   < succ>
```

The protein has homology with the following sequences in the GENPEPT database.

```
>GP: CAB15610 GB: Z99122 ribose ABC transporter (membrane protein)
[Bacillus subtilis]
Identities = 74/131 (56%), Positives = 95/131 (72%), Gaps = 1/131 (0%)
Query:    1 MKKTGILNSHLAKLADDLGHTDRVCIGDLGLPVPNGIPKIDLSLTSGIPSFQEVLDIYLE    60
            MKK GILNSHLAK+  DLGHTD++ I D GLPVP+G+ KIDLSL  G+P+FQ+   + E
Sbjct:    1 MKKHGILNSHLAKILADLGHTDKIVIADAGLPVPDGVLKIDLSLKPGLPAFQDTAAVLAE   60
```

```
                             -continued
Query:  61 NILVEKVILAEEIKEANPDQLSRLLAKLDNSVSIEYVSHNHLKQMTQDVKAVIRTGENTP  120
           + VEKVI A EIK +N +  ++ L  L +    IEY+SH   K +T+D KAVIRTGE TP
Sbjct:  61 EMAVEKVIAAAEIKASNQEN-AKFLENLFSEQEIEYLSHEEFKLLTKDAKAVIRTGEFTP  119

Query: 121 YSNIILQSGVI                                                   131
           Y+N ILQ+GV+
Sbjct: 120 YANCILQAGVL                                                   130
```

No corresponding DNA sequence was identified in S. pyogenes.

Based on this analysis, it was predicted that this protein and its epitopes, could be useful antigens for vaccines or diagnostics.

EXAMPLE 2097

A DNA sequence (GBSx2212) was identified in S. agalactiae <SEQ ID 6487> which encodes the amino acid sequence <SEQ ID 6488>. This protein is predicted to be ribokinase (rbsK). Analysis of this protein sequence reveals the following:

```
Possible site: 47
>>> Seems to have an uncleavable N-term signal seq

----- Final Results -----
             bacterial membrane --- Certainty = 0.0000(Not Clear) < succ>
             bacterial outside  --- Certainty = 0.0000(Not Clear) < succ>
             bacterial cytoplasm --- Certainty = 0.0000(Not Clear) < succ>
```

The protein has homology with the following sequences in the GENPEPT database.

```
>GP: CAB15609 GB: Z99122 ribokinase [Bacillus subtilis]
Identities = 132/293 (45%), Positives = 177/293 (60%), Gaps = 4/293 (1%)
Query:   1 MSNIVIIGSISMDLVMETNRIAKEGETVFGQRFSMVPGGKGANQAVAIGRLSQERDNITI   60
           M NI +IGS SMDLV+ +++  K GETV G  F  VPGGKGANQAVA  RL +   + +
Sbjct:   1 MRNICVIGSCSMDLVVTSDKRPKAGETVLGTSFQTVPGGKGANQAVAAARLGAQ---VFM   57

Query:  61 LGAIGEDSFGPILLDNLNKNHVTTDFVGTIP-SSSGVAQITLYNNDNRIIYCPGANGKVD  119
           +G +G+D +G  +L+NL  N V TD++  +  + SG A I L   DN I+    GAN  +
Sbjct:  58 VGKVGDDHYGTAILNNLKANGVRTDYMEPVTHTESGTAHIVLAEGDNSIVVVKGANDDIT  117

Query: 120 TKKWSQEWSIIKEADLVVLQNEIPHQANMKIANFCKEHSIKLLYNPAPSRETDIEMLDKV  179
                       I++ D+V++Q EIP +   ++  +C  H I ++ NPAP+R    E +D
Sbjct: 118 PAYALNALEQIEKVDMVLIQQEIPEETVDEVCKYCHSHDIPIILNPAPARPLKQETIDHA  177

Query: 180 DYFTPNEHECQELFPNQKLEDILATYPEKLIVTLGTKGAIYSDGKESHLIPALETKAVDT  239
             Y TPNEHE   LFP  + + LA YP KL +T G +G  YS G +  LIP+   + VDT
Sbjct: 178 TYLTPNEHEASILFPELTISEALALYPAKLFITEGKQGVRYSAGSKEVLIPSFPVEPVDT  237

Query: 240 TGAGDTFNGAFGYAISKKFKIAKALRFATLAAHLSVQKFGAQGGMPTIKEMED         292
           TGAGDTFN AF  A+++   I   ALRFA  AA LSV  FGAQGGMPT  E+E+
Sbjct: 238 TGAGDTFNAAFAVALAEGKDIEAALRFANRAASLSVCSFGAQGGMPTRNEVEE         290
```

No corresponding DNA sequence was identified in S. pyogenes.

Based on this analysis, it was predicted that this protein and its epitopes, could be useful antigens for vaccines or diagnostics.

EXAMPLE 2098

A DNA sequence (GBSx2213) was identified in S. agalactiae <SEQ ID 6489> which encodes the amino acid sequence <SEQ ID 6490>. Analysis of this protein sequence reveals the following:

```
Possible site: 31
>>> Seems to have no N-terminal signal sequence
```

-continued

----- Final Results -----
             bacterial cytoplasm --- Certainty = 0.2272(Affirmative) < succ>
              bacterial membrane --- Certainty = 0.0000(Not Clear)  < succ>
               bacterial outside --- Certainty = 0.0000(Not Clear)  < succ>

A related GBS nucleic acid sequence <SEQ ID 9477> which encodes amino acid sequence <SEQ ID 9478> was also identified.

The protein has homology with the following sequences in the GENPEPT database.

```
>GP: CAB15608 GB: Z99122 transcriptional regulator (LacI family)
[Bacillus subtilis]
Identities = 141/327 (43%), Positives = 204/327 (62%), Gaps = 4/327 (1%)
Query:  13 MSTIRQVAEKAGVSTSTVSRYISQNGYVSQKASQKIEQAIRELHYVPNFLAQSLKTKKNQ    72
            M+TI+ VA  AGVS +TVSR ++ NGYV ++    ++  A+ +L+Y PN +A+SL  ++++
Sbjct:   1 MATIKDVAGAAGVSVATVSRNLNDNGYVHEETRTRVIAAMAKLNYYPNEVARSLYKRESR    60

Query:  73 LVGLLLPDISNPFFPRLARGVEEFLKEQGYRVMLGNTNNKSHLEEEYLNVLLQSNAAGII   132
            L+GLLLPDI+NPFFP+LARG E+ L  +GYR++ GN++ +   E EYL   Q++ AGII
Sbjct:  61 LIGLLLPDITNPFFPQLARGAEDELNREGYRLIFGNSDEELKKELEYLQTFKQNHVAGII   120

Query: 133 --TTHDFTKNHPEIDIPVVVVDRVNQETQYGVFSDNKEGGKLAAQAIWTAGATNILLIRG   190
                 T +  + +  ++ PVV +DR   E   V SD   G  KLAAQAI   +  I L+RG
Sbjct: 121 AATNYPDLEEYSGMNYPVVFLDR-TLEGAPSVSSDGYTGVKLAAQAIIHGKSQRITLLRG   179

Query: 191 PLDKADNLNQRFQGSQNYLLNKGACFAIEDSASFDFAEIQIEAKTLLDHHPDIDSIIAPS   250
            P       RF G+   L        F + ++ASF   + Q  AK L    +P  D +IA +
Sbjct: 180 PA-HLPTAQDRFNGALEILKQAEVDFQVIETASFSIKDAQSMAKELFASYPATDGVIASN   238

Query: 251 DIHAIAYLHEILNRGKRIPEDVQIIGYDDILMSQFIYPSLSTIHQSSYIMGQKAAELIFK   310
            DI A A LHE L RGK +PED+QIIGYDDI  S   ++P LSTI Q +Y MG++AA+L+
Sbjct: 239 DIQAAAVLHEALRRGKNVPEDIQIIGYDDIPQSGLLFPPLSTIKPAYDMGKEAAKLLLG   298

Query: 311 ITNQLPITNKRIKLPVHYVERETLRRK                                   337
            I  + P+      I++PV Y+ R+T R++
Sbjct: 299 IIKKQPLAETAIQMPVTYIGRKTTRKE                                   325
```

A related DNA sequence was identified in *S. pyogenes* <SEQ ID 6491> which encodes the amino acid sequence <SEQ ID 6492>. Analysis of this protein sequence reveals the following:

```
Possible site: 35
>>> Seems to have no N-terminal signal sequence

----- Final Results -----
             bacterial cytoplasm --- Certainty = 0.1657(Affirmative) < succ>
              bacterial membrane --- Certainty = 0.0000(Not Clear)  < succ>
               bacterial outside --- Certainty = 0.0000(Not Clear)  < succ>
```

An alignment of the GAS and GBS proteins is shown below.

```
Identities = 232/328 (70%), Positives = 274/328 (82%)
Query:  10 GVSMSTIRQVAEKAGVSTSTVSRYISQNGYVSQKASQKIEQAIRELHYVPNFLAQSLKTK    69
            G +M TI+QVAE+AGVS STVSRYISQ GYVS A  KI+ AI +LHY PN LAQSLKTK
Sbjct:  14 GKAMVTIKQVAEEAGVSRSTVSRYISQKGYVSDDARHKIKAAIAKLHYTPNVLAQSLKTK    73

Query:  70 KNQLVGLLLPDISNPFFPRLARGVEEFLKEQGYRVMLGNTNNKSHLEEEYLNVLLQSNAA   129
            KNQLVGLLLPDISNPFFPRLARG EE+LKE+GYRVMLGN ++    LEEEY++VLLQSNAA
Sbjct:  74 KNQLVGLLLPDISNPFFPRLARGAEEYLKEKGYRVMLGNISDSEALEEEYVHVLLQSNAA   133

Query: 130 GIITTHDFTKNHPEIDIPVVVVDRVNQETQYGVFSDNKEGGKLAAQAIWTAGATNILLIR   189
            GIITTHDFTK +P +  IPVVVVDRV+QETQYGVFSDN+ GG LAAQ +W AGA  +LLIR
Sbjct: 134 GIITTHDFTKRYPTLAIPVVVVDRVDQETQYGVFSDNRAGGLLAAQTVWQAGAKEVLLIR   193

Query: 190 GPLDKADNLNQRFQGSQNYLLNKGACFAIEDSASFDFAEIQIEAKTLLDHHPDIDSIIAP   249
            GPLD A+N+N+RF+ S +YL +       + DS +FDF IQ+EA  L   +P IQSIIAP
Sbjct: 194 GPLDNAENINERFEASFSYLQKQDVTMYVCDSQNFDFESIQLEASYNLKCYPTIDSIIAP   253

Query: 250 SDIHAIAYLHEILNRGKRIPEDVQIIGYDDILMSQFIYPSLSTIHQSSYIMGQKAAELIF   309
```

-continued

```
           SDIHAIAY+HE+  ++GK+IP+DVQIIGYDDILMSQFIYPSLSTIHQSSY+MG+ AAEL++
Sbjct: 254 SDIHAIAYIHELHSQGKKIPQDVQIIGYDDILMSQFIYPSLSTIHQSSYLMGRYAAELVY 313

Query: 310 KITNQLPITNKRIKLPVHYVERETLRRK                                337
           I +QL +   RIKLPVHYVERET+R++
Sbjct: 314 TIASQLTVKANRIKLPVHYVERETIRKR                                341
```

Based on this analysis, it was predicted that this protein and its epitopes, could be useful antigens for vaccines or diagnostics.

EXAMPLE 2099

A DNA sequence (GBSx2214) was identified in *S. agalactiae* <SEQ ID 6493> which encodes the amino acid sequence <SEQ ID 6494>. Analysis of this protein sequence reveals the following:

```
Possible site: 57
>>> Seems to have no N-terminal signal sequence
    INTEGRAL     Likelihood = -13.80    Transmembrane    27-43   (24-51)
    INTEGRAL     Likelihood = -10.61    Transmembrane   337-353 (329-362)
    INTEGRAL     Likelihood = -9.18     Transmembrane   257-273 (249-276)
    INTEGRAL     Likelihood = -8.92     Transmembrane   302-318 (291-326)

----- Final Results -----
          bacterial membrane --- Certainty = 0.6519(Affirmative) < succ>
           bacterial outside --- Certainty = 0.0000(Not Clear)   < succ>
         bacterial cytoplasm --- Certainty = 0.0000(Not Clear)   < succ>
```

A related GBS nucleic acid sequence <SEQ ID 8979> which encodes amino acid sequence <SEQ ID 8980> was also identified. Analysis of this protein sequence reveals the following:

```
Lipop Possible site: -1 Crend: 6
SRCFLG: 0
McG: Length of UR: 4
     Peak Value of UR: 3.20
     Net Charge of CR: 1
McG: Discrim Score: 6.06
GvH: Signal Score (-7.5): 0.0500002
     Possible site: 46
>>> Seems to have a cleavable N-term signal seq.
Amino Acid Composition: calculated from 47
ALOM program count: 3 value: -10.61 threshold: 0.0
    INTEGRAL      Likelihood = -10.61   Transmembrane   326-342 (318-348)
    INTEGRAL      Likelihood = -9.18    Transmembrane   246-262 (238-265)
    INTEGRAL      Likelihood = -8.92    Transmembrane   291-307 (280-315)
    PERIPHERAL    Likelihood = 4.98    152
modified ALOM score: 2.62
icml HYPID: 7 CFP: 0.525
*** Reasoning Step: 3

----- Final Results -----
          bacterial membrane --- Certainty = 0.5246(Affirmative) < succ>
           bacterial outside --- Certainty = 0.0000(Not Clear)   < succ>
         bacterial cytoplasm --- Certainty = 0.0000(Not Clear)   < succ>
```

The protein has homology with the following sequences in the GENPEPT database.

```
>GP: AAF12525 GB: AE001863 hypothetical protein
[Deinococcus radiodurans]
Identities = 103/352 (29%), Positives = 191/352 (54%),
Gaps = 9/352 (2%)
Query:  15 AWKELTFYKKKYLLIELLIIVMMFMVVFLSGLANGLGRAVSAAIENNPAQTYILNEGAEQ   74
           A +EL   K + LLI  ++ ++ FMV  L+GL  GL R  ++ + + PAQ+++  + A+
Sbjct:   4 ALRELQHQKLRSLLIGGIVALIAFMVFMLTGLTRGLSRDSASLLLDTPAQSFVTTKEADG   63

Query:  75 VITSSVLTTKDQTDLNSLNLKDSTTLNIQRSSLTRQGHEKKIDISYFAIDKDSFMAPTLS  134
           V+  S L+ +    +++L   +      ++ ++   +K++      +D   F+AP +S
```

```
                               -continued
Sbjct:  64 VLNRSFLSPEQ---VSALQQDNEDAAAFAQTFVSFSHGDKQLSGVLLGVDPRGFLAPDVS 120

Query: 135 EGKQLTSYKKAIILNDSLKAEGIKLGDKVIDKSSSISLTVVGFVHNSMYGHGPVAFIDKD 194
              EG+ L      A++ ++SL+ +G+K+GD +   K S    L V GF  ++    H P ++
Sbjct: 121 EGQTLRVAGGAVV-DESLREDGVKVGDVLTLKPSGDQLRVSGFTRSARLNHQPGMYVSLA 179

Query: 195 IYTEINKKINPQYQFLPQALVMKNDKSISHLP-TQLEAVSKKDVIQHIPGYSAEQSTLNM 253
              +   +K+NP+       A+ +   + +L      L    ++   +Q +PGY  EQ +L M
Sbjct: 180 RW----QKLNPRMHGTVNAVALPAAPAQVNLGGADLSVTNRAQTLQVLPGYKEEQGSLTM 235

Query: 254 ILWVLVVASAGILGVFFYIITLQKRHEFSVMKAIGTKMSEIALFQLSQVIILALFGIIVG 313
              I   L+ +A +L FFY++TLQK  +F ++KAIG     +A     ++Q++IL L  + +
Sbjct: 236 IQVFLIAVAAFVLATFFYVMTLQKTAQFGLLKAIGASNRTLAGSVVAQMLILTLLAVAIA 295

Query: 314 DGLAVALSYVLPAQMPFVINWQNIILVSFVFLVIAMISSALSIVKVAKIDPV         365
              + + +  +LPA MPF +    NI    S + LV+A ++S LS+  +VAK+DP+
Sbjct: 296 AAVTLGMVQLLPAGMPFHLTAANIASASGLLLVVAALASLLSVRRVAKVDPL          347

A related DNA sequence was identified in S. pyogenes
   <SEQ ID 6495> which encodes the amino acid sequence
   <SEQ ID 6496>. Analysis of this protein sequence reveals the
   following:

Possible site: 58
>>> Seems to have a cleavable N-term signal seq.
    INTEGRAL       Likelihood = -12.31      Transmembrane    246-262 (233-270)
    INTEGRAL       Likelihood = -8.49       Transmembrane    327-343 (321-351)
    INTEGRAL       Likelihood = -1.01       Transmembrane    301-317 (301-317)

----- Final Results -----
                bacterial membrane --- Certainty = 0.5925(Affirmative) < succ>
                bacterial outside  --- Certainty = 0.0000(Not Clear)  < succ>
               bacterial cytoplasm --- Certainty = 0.0000(Not Clear)  < succ>

The protein has homology with the following sequences in
   the databases:

>GP: AAF12525 GB: AE001863 hypothetical protein
[Deinococcus radiodurans]
Identities = 101/360 (28%), Positives = 175/360 (48%),
Gaps = 11/360 (3%)
Query:   1 MFLALNEMKQSKLRYGLIAGLLCLVAYLMFFLSGLAFGLMQENRSAVDLWKADSVLLAKD  60
             M+LAL E++  KLR  LI G++ L+A+++F L+GL  GL +++ S +     A S + K+
Sbjct:   1 MYLALRELQHQKLRSLLIGGIVALIAFMVFMLTGLTRGLSRDSASLLLDTPAQSFVTTKE  60

Query:  61 ADATLTLSQVSRAQENQITADKVAPLAQLNTVAWSVKNPKDADKVKVSLFGIDSNSFIRP 120
              AD  L  S + Q  +  D     A  T          K    V    L G+D  F+  P
Sbjct:  61 ADGVLNRSFLSPEQVSALQQDNEDAAAFAQTFVSFSHGDKQLSGV---LLGVDPRGFLAP 117

Query: 121 NIVKGRLFKTNKEVVLDQSLAKEEEAFAIGKDFYTSSSSQALTIVGYTQNARFSVAPVVYM 180
              ++ +G+ +  +    V+D+SL +E+    +G         S    L + G+T++AR + P +Y+
Sbjct: 118 DVSEGQTLRVAGGAVVDESL-REDGVKVGDVLTLKPSGDQLRVSGFTRSARLNHQPGMYV 176

Query: 181 NLEAFETLKYGEPLPKDKQVVNAFITKGS--LTDYPKKDFQKLDIKTFITKLPGYSAQLL 238
              +L ++ L       P+     VNA    +  +    D       +   + LPGY   +
Sbjct: 177 SLARWQKLN------PRMHGTVNAVALPAAPAQVNLGGADLSVTNRAQTLQVLPGYKEEQG 231

Query: 239 TFGFMISFLVIISAIIIGIPFMYILTIQKAPIFGIMKAQGISNKTITTAVLMQTFFLSFLG 298
               +      FL+ ++A ++   F Y++T+QK    FG++KA G SN+T+   +V+ Q     L + L
Sbjct: 232 SLTMIQVFLIAVAAFVLATFFYVMTLQKTAQFGLLKAIGASNRTLAGSVVAQMLILTLLA  291

Query: 299 SGLGLLGTWLTSLLLPTVVPFQSNWFLYLAIFVSMICFALLGTLFSVFNIIRIDPLKAIG 358
              +       T   LLP +PF          +    ++   A L +L SV   + ++DPL A+G
Sbjct: 292 VAIAAAVTLGMVQLLPAGMPFHLTAANIASASGLLLVVAALASLLSVRRVAKVDPLIALG  351

An alignment of the GAS and GBS proteins is shown
   below.

Identities = 96/356 (26%), Positives = 178/356 (49%),
Gaps = 4/356 (1%)
Query:  15 AWKELTFYKKKYLLIELLIIVMMFMVVFLSGLANGLGRAVSAAIENNPAQTYILNEGAEQ  74
              A  E+   K +Y LI  L+ ++  +++  FLSGLA GL +   +A++      A ++L + A+
Sbjct:   4 ALNEMKQSKLRYGLIAGLLCLVAYLMFFLSGLAFGLMQENRSAVDLWKADSVLLAKDADA   63
```

-continued

```
Query:  75 VITSSVLTTKDQTDLNSLNLKDSTTLNIQRSSLTRQGHEKKIDISYFAIDKDSFMAPTLS  134
           +T S ++    +  + +  +     LN    S+      K+ +S F ID +SF+ P +
Sbjct:  64 TLTLSQVSRAQENQITADKVAPLAQLNTVAWSVKNPKDADKVKVSLFGIDSNSFIRPNIV  123

Query: 135 EGKQLTSYKKAIILNDSLKAEGIKLGDKVIDKSSSISLTVVGFVHNSMYGHGPVAFIDKD  194
           +G+    + K+ ++      K E    +G       SSS +LT+VG+  N+ +     PV +++  +
Sbjct: 124 KGRLFKTNKEVVLDQSLAKEEAFAIGKDFYTSSSSQALTIVGYTQNARFSVAPVVYMNLE  183

Query: 195 IYTEIN-KKINPQYQFLPQALVMKNDKSISHLPTQ-LEAVSKKDVIQHIPGYSAEQSTLN  252
            +  +    +   P+ + +   A + K      S++   P +   + +   K   I   +PGYSA+   T
Sbjct: 184 AFETLKYGEPLPKDKQVVNAFITKG--SLTDYPKKDFQKLDIKTFITKLPGYSAQLLTFG  241

Query: 253 MILWVLVVASAGILGVFFYIITLQKRHEFSVMKAIGTKMSEIALFQLSQVIILALFGIIV  312
            ++   LV+ SA  I+G+F  YI+T+QK    F +MKA G        I      L Q     L+    G   +
Sbjct: 242 FMISFLVIISAIIIGIFMYILTIQKAPIFGIMKAQGISNKTITTAVLMQTFFLSFLGSGL  301

Query: 313 GDGLAVALSYVLPAQMPFVINWQNIILVSFVFLVIAMISSALSIVKVAKIDPVEVI  368
           G        S +LP  +PF  NW   + +      +  A++ +  S+    +  +IDP++  I
Sbjct: 302 GLLGTWLTSLLLPTVVPFQSNWFLYLAIFVSMICFALLGTLFSVFNIIRIDPLKAI  357
```

SEQ ID 8980 (GBS239) was expressed in *E. coli* as a GST-fusion product. SDS-PAGE analysis of total cell extract is shown in FIG. 175 (lane 13; MW 64 kDa).

GBS239-GST was purified as shown in FIG. 227, lane 4.

Based on this analysis, it was predicted that this protein and its epitopes, could be useful antigens for vaccines or diagnostics.

EXAMPLE 2100

A DNA sequence (GBSx2215) was identified in *S. agalactiae* <SEQ ID 6497> which encodes the amino acid sequence <SEQ ID 6498>. This protein is predicted to be heterocyst maturation protein (devA) (b0879). Analysis of this protein sequence reveals the following:

```
Possible site: 33
>>> Seems to have no N-terminal signal sequence

----- Final Results -----
            bacterial cytoplasm --- Certainty = 0.1751(Affirmative) < succ>
            bacterial membrane  --- Certainty = 0.0000(Not Clear)   < succ>
            bacterial outside   --- Certainty = 0.0000(Not Clear)   < succ>
```

The protein has homology with the following sequences in the GENPEPT database.

```
>GP: CAA05977 GB: AJ003195 ATP-binding subunit
[Anabaena variabilis]
Identities = 87/225 (38%), Positives = 146/225 (64%),
Gaps = 1/225 (0%)
Query:   3 AILELKHISKHYPDGDELLSILDNLDLSVSAGEFVAILGPSGSGKSTLLSIAGLLLGADQ   62
           A++ +K ++ +Y  G      IL +++L +   GE V +  GPSGSGK+TLLS+   G L      +
Sbjct:   5 AVIAIKSLNHYYGKGALKRQILFDINLEIYPGEIVIMTGPSGSGKTTLLSLIGGLRSVQE   64

Query:  63 GSLYVNHENVTDLSQRQRTQLRREALGFIFQSHQLLPYLTIQEQLQQEARFAKHYDKKTS  122
           G+L          ++  SQ +   Q+RR ++G+IFQ+H  LL  +LT ++   +Q           +H   ++  +
Sbjct:  65 GNLQFLGVELSGASQNKLVQIRR-SIGYIFQAHNLLGFLTARQNVQMAVELNEHISQEEA  123

Query: 123 LEEINKLLSDLGIEQCAHKYPNQLSGGQKQRAAIARAFINHPKVILADEPTASLDEERGR  182
            + +     +L   +G+E          YP+  LSGGQKQR AIARA +N+P  ++LADEPTA+LD++  GR
Sbjct: 124 IAKAEAMLKAVGLENRVDYYPDNLSGGQKQRVAIARALVNNPPLVLADEPTAALDKQSGR  183

Query: 183 QVTELIRQEVKSHNTAAIMVTHDERVLDLVDTVYRLKDGKLVKEN                227
           V E++++  K     T+ ++VTHD R+LD+ D  +   ++DG L  +++
Sbjct: 184 DVVEIMQRLAKDQGTSILLVTHDNRILDIADRIVEMEDGILARDS                228
```

A related DNA sequence was identified in *S. pyogenes* <SEQ ID 6499> which encodes the amino acid sequence <SEQ ID 6500>. Analysis of this protein sequence reveals the following:

```
Possible site: 13
>>> Seems to have no N-terminal signal sequence

----- Final Results -----
            bacterial cytoplasm --- Certainty = 0.4181(Affirmative) < succ>
            bacterial membrane  --- Certainty = 0.0000(Not Clear)   < succ>
            bacterial outside   --- Certainty = 0.0000(Not Clear)   < succ>
```

An alignment of the GAS and GBS proteins is shown below.

```
Identities = 103/224 (45%), Positives = 149/224 (65%),
Gaps = 4/224 (1%)
Query:    3 AILELKHISKHYPDGDELLSILDNLDLSVSAGEFVAILGPSGSGKSTLLSIAGLLLGADQ   62
            ++L K ++K + DG   ++ L   D S+ AGEFVAI+GPSGSGKST L+IAG L
Sbjct:    3 SVLTFKQVTKTFQDGHHEINALKATDFSIEAGEFVAIIGPSGSGKSTFLTIAGGLQTPSS   62

Query:   63 GSLYVNHENVTDLSQRQRTQLRREALGFIFQSHQLLPYLTIQEQLQQEARFAKHYDKKTS  122
            G L ++  + T LS+++R++LR +++GFI Q+   L+P+ T+Q+QL+          H
Sbjct:   63 GQLIIDGTDYTHLSEKERSRLRFKSVGFILQASNLIPFSTVQQQLE----LVDHLTGSKE  118

Query:  123 LEEINKLLSDLGIEQCAHKYPNQLSGGQKQRAAIARAFINHPKVILADEPTASLDEERGR  182
              + N+L  DLGI     H+ P +LSGG++QRAAIARA  + P +ILADEPTASLD E+
Sbjct:  119 KAKANQLFDDLGITGLKHQLPQELSGGERQRAAIARALYHDPALILADEPTASLDTEKAY  178

Query:  183 QVTELIRQEVKSHNTAAIMVTHDERVLDLVDTVYRLKDGKLVKE                 226
            +V +L+ +E K  N A IMVTHD+R+L   D VYR++DG+L +E
Sbjct:  179 EVVKLLAKESKEKNKAIIMVTHDDRMLKYCDKVYRMQDGELCQE                 222
```

Based on this analysis, it was predicted that this protein and its epitopes, could be useful antigens for vaccines or diagnostics.

EXAMPLE 2101

A DNA sequence (GBSx2216) was identified in *S. agalactiae* <SEQ ID 6501> which encodes the amino acid sequence <SEQ ID 6502>. Analysis of this protein sequence reveals the following:

```
Possible site: 34
>>> Seems to have no N-terminal signal sequence

----- Final Results -----
            bacterial cytoplasm --- Certainty = 0.2645(Affirmative) < succ>
             bacterial membrane --- Certainty = 0.0000(Not Clear)  < succ>
              bacterial outside --- Certainty = 0.0000(Not Clear)  < succ>
```

The protein has homology with the following sequences in the GENPEPT database.

```
>GP: CAB64972 GB: AJ012050 VicR protein
[Enterococcus faecalis]
Identities = 86/229 (37%), Positives = 132/229 (57%), Gaps = 10/229 (4%)
Query:    3 KILVVEDNIVQQKIITTKLTQEGYQFITASNGQEALNCLDTEEVQLIITDIMMPMMDGYQ   62
            KILVV+D    +I+    L +EGY+  TA +G+EAL ++    E  LII D+M+P MDG +
Sbjct:   52 KILVVDDEKPISEIVKYNLVKEGYEVFTAYDGEEALEKVEEVEPDLIILDLMLPKMDGLE  111

Query:   63 LIQELRSAAYNVPIIVMTAKSQMEDMTKGFGLGADDYMVKPVQLQELALRIKALLRR---  119
             + +E+R    +++PII++TAK    D   G LGADDY+ KP   +EL R+KA LRR
Sbjct:  112 VAREVRK-THDMPIIMVTAKDSEIDKVLGLELGADDYVTKPFSNRELVARVKANLRRGAT  170

Query:  120 ----ANIVAQHQLIIGNTCLNEDELSLKYFEQEIIFPQKEFRVLFHLLSYPNRIFTRLEL  175
                A +  Q +L IG+  ++ D     +  ++I   +EF +L++L +  ++ TR  L
Sbjct:  171 NAKEAEVTTQSELTIGDLTIHPDAYMVSKRGEKIELTHREFELLYYLAKHIGQVMTREHL  230

Query:  176 LDSIWGMDTDLDERVVDACINKIRRKVEHLPDFK--IETVRGVGYRAKN            222
            L ++WG D   D R VD  + ++R K+E P     +  T RGVGY  +N
Sbjct:  231 LQTVWGYDYFGDVRTVDVTVRRLREKIEDSPSHPTYLVTRRGVGYYLRN             279
```

There is also homology to SEQ ID 1182.

Based on this analysis, it was predicted that this protein and its epitopes, could be useful antigens for vaccines or diagnostics.

EXAMPLE 2102

A DNA sequence (GBSx2217) was identified in *S. agalactiae* <SEQ ID 6503> which encodes the amino acid sequence <SEQ ID 6504>. This protein is predicted to be sensor protein. Analysis of this protein sequence reveals the following:

```
Possible site: 38
>>> Seems to have a cleavable N-term signal seq.
      INTEGRAL       Likelihood = -8.97     Transmembrane       53-69 (47-77)

----- Final Results -----
                bacterial membrane --- Certainty = 0.4588(Affirmative) < succ>
                  bacterial outside --- Certainty = 0.0000(Not Clear) < succ>
                bacterial cytoplasm --- Certainty = 0.0000(Not Clear) < succ>
```

The protein has homology with the following sequences in the GENPEPT database.

```
>GP: AAC62214 GB: AF049873 sensor protein [Lactococcus lactis]
Identities = 97/307 (31%), Positives = 169/307 (54%), Gaps = 16/307 (5%)
Query:  57 SALAVVFLSLVIASISMWYGSYHLTKPILDISHIVSNVADGDFEGHIYRNSNRRKSYEYY  116
            + LAV+   +L++ + S++Y +   +T+P+L I       +A GD    + N+
Sbjct: 170 AVLAVI--TLIVTAFSIFYITRTVTRPLLKIKLGTDKIAQGDLSIQLNVNTE--------  219

Query: 117 NELDELSESINQMIVSLSHMDHMRKDFITNVSHELKTPIAAVANIVELLQDPELDEETQS  176
            +EL EL++SI +   L  M   R +F+++V+HEL+TP+  +       ++       E ++
Sbjct: 220 DELGELAKSIEDLAEKLDFMKRERNEFLSSVAHELRTPLTFIKGYADIANRSTTSLEDKT  279

Query: 177 ELLGLVKTESLRLTRLCDTMLQMSRVDNQETIGELSSVRVDEQIRQAMISLTERWQAKRI  236
            + L +++ ES  LT+L + ++ +++++       E   V + E I + +   ++  + KRI
Sbjct: 280 QYLRIIREESRHLTQLMEDLMNLAQLEENGFKVEKHQVLIQELINEVVSKVSGVFSEKRI  339

Query: 237 NFQLDSKPYTVYSNSDLLM--QVWINLLDNAIKYSEDIVDLSVRMEETNNHYLRVIISDK  294
            NF  L S       Y+N D +    QV +NLL NA KYS D D+ +           ++ +++ISDK
Sbjct: 340 NF-LISGEGNFYANIDFMRIEQVLVNLLMNAYKYSADESDIKLAFIPEKENF-KIVISDK  397

Query: 295 GRGISQYDVQHIFDKFYQADQSHNQQ--GNGLGLAIVKRIIVLCKGRISVSSQLEIGTEF  352
            G  GI + D+ +IF++FY+ D+S  +     G GLGLAIV+ I+     G+I V S     GT F
Sbjct: 398 GEGIPEQDLPYIFERFYRVDKSRTRTTGGVGLGLAIVQDIVKKHNGKIIVESIQNQGTTF  457

Query: 353 CVELPLS                                                        359
            +ELP S
Sbjct: 458 IIELPYS                                                        464
```

Based on this analysis, it was predicted that this protein and its epitopes, could be useful antigens for vaccines or diagnostics.

A related GBS gene <SEQ ID 8981> and protein <SEQ ID 8982> were also identified. Analysis of this protein sequence reveals the following:

```
Lipop: Possible site: -1 Crend: 10
McG: Discrim Score: 4.84
GvH: Signal Score (-7.5): 0.179999
     Possible site: 35
>>> Seems to have a cleavable N-term signal seq.
ALOM program count: 1 value: -8.97 threshold: 0.0
      INTEGRAL       Likelihood = -8.97     Transmembrane       50-66 (47-77)
      PERIPHERAL     Likelihood =  1.27        324
modified ALOM score: 2.29

*** Reasoning Step: 3

----- Final Results -----
                bacterial membrane --- Certainty = 0.4588(Affirmative) < succ>
                  bacterial outside --- Certainty = 0.0000(Not Clear) < succ>
                bacterial cytoplasm --- Certainty = 0.0000(Not Clear) < succ>
```

The protein has homology with the following sequences in the databases:

```
31.9/57.3% over 293aa
Lactococcus lactis
GP|3687664|sensor protein Insert characterized ORF01881(478-1377 of 1677)
GP|3687664|gb|AAC62214.1||AF049873(171-464 of 464)sensor protein{Lactococcus
lactis}
% Match = 12.9
% Identity = 31.9   % Similarity = 57.3
Matches = 94   Mismatches = 121   Conservative Sub.s = 75
```

-continued
```
       339       369       399       429       459       489       519       549
MTKLRRFRFPLRFYFTLMFVLTMLFSVLASLLLVAAIVFTFFQGVLTTHVLQVSALAVVFLSLVIASISMWYGSYHLTKP
 |  ::  :  : :   |       ::   :  ::        :     :  :::::   |:::   : |:|
EKKNKKESLHFHWLGDKYIVSKSRIQSNGKIVGSVYMFLSTRPIQKMVFNFTGIFAVLAVITLIVTAFSIFYITRTVTRP
        130       140       150       160       170       180       190
       579       609       639       669       699       729       759       789
ILDISHIVSNVADGDFEGHIYRNSNRRKSYEYYNELDELSESINQMIVSLSHMDHMRKDFITNVSHELKTPIAAVANIVE
 :| |    : | ||   ::        :|| ||::|   :   :|||:  ::|||:::|||:||:  :
LLKIKLGTDKIAQGDLSIQLNVNTE--------DELGELAKSIEDLAEKLDFMKRERNEFLSSVAHELRTPLTFIKGYAD
          210       220       230       240       250       260
       819       849       879       909       939       969       999      1029
LLQDPELDEETQSELLGLVKTESLRLTRLCDTMLQMSRVDNQETIGELSSVRVDEQIRQAMISLTERWQAKRINFQLDSK
 :        |  ::: | ::: ||  ||: : ::  :::::       |    |    : | | |   :     ||||| | |
IANRSTTSLEDKTQYLRIIREESRHLTQLMEDLMNLAQLEENGFKVEKHQVLIQELINEVVSKVSGVFSEKRINF-LISG
          280       290       300       310       320       330       340
      1059      1083      1113      1143      1173      1203      1233
PYTVYSNSDLL--MQVWINLLDNAIKYSEDIVDLSVRMEETNNHYLRVIISDKGRGISQYDVQHIFDKFYQADQSHNQQ-
 |:| |:::    ||  :|||  ||  ||      |::          ::   ::::|||||  ||   :|:    ||::||:   |:|    :
EGNFYANIDFMRIEQVLVNLLMNAYKYSADESDIKLAFIPEKENF-KIVISDKGEGIPEQDLPYIFERFYRVDKSRTRTT
        360       370       380       390       400       410       420
      1287      1317      1347      1377      1407      1437      1467      1497
-GNGLGLAIVKRIIVLCKGRISVSSQLEIGTEFCVELPLS*LFKTITANWQLLFYLFRNKYTKNRQKL*KYLTINIASV*
 |  ||||||||::  |:   |:|  |         ||  |  :|||
GGVGLGLAIVQDIVKKHNGKIIVESIQNQGTTFIIELPYS
         440       450       460
```

Figure 123:
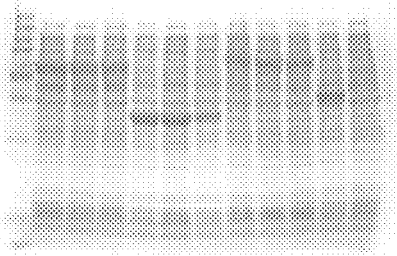
Figure 181:
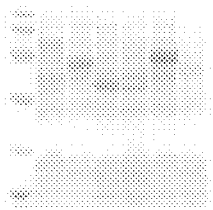

SEQ ID 8982 (GBS170d) was expressed in *E. coli* as a His-fusion product. SDS-PAGE analysis of total cell extract is shown in FIG. 181 (lane 4; MW 35 kDa) and in FIG. 123 (lane 5-7; MW 35 kDa). It was also expressed in *E. coli* as a GST-fusion product. SDS-PAGE analysis of total cell extract is shown in FIG. 123 (lane 24; MW 60 kDa) and in FIG. 184 (lane 3; MW 60 kDa). Purified GBS170d-GST is shown in FIG. 243, lane 7; purified GBS170d-His is shown in FIG. 234, lanes 5-6.

EXAMPLE 2103

A DNA sequence (GBSx2218) was identified in *S. agalactiae* <SEQ ID 6505> which encodes the amino acid sequence <SEQ ID 6506>. Analysis of this protein sequence reveals the following:

```
Possible site: 21
>>> Seems to have no N-terminal signal sequence

----- Final Results -----
           bacterial cytoplasm --- Certainty = 0.0502(Affirmative) < succ>
           bacterial membrane  --- Certainty = 0.0000(Not Clear)   < succ>
           bacterial outside   --- Certainty = 0.0000(Not Clear)   < succ>
```

The protein has homology with the following sequences in the GENPEPT database.

```
>GP: BAB06906 GB: AP001518 argininosuccinate synthase
     [citrulline-aspartate ligase] [Bacillus halodurans]
   Identities = 262/396 (66%), Positives = 321/396 (80%), Gaps = 1/396 (0%)
   Query:   1 MGKEKLILAYSGGLDTSVAIAWLK-KDYDVIAVCMDVGEGKDLDFIHDKALTIGAIESYI    59
             M K+K++LAYSGGLDTSVAI WL  K YDVIAV +DVGEGKDL+F+  +KAL +GAIESY
   Sbjct:   1 MSKKKVVLAYSGGLDTSVAIKWLSDKGYDVIAVGLDVGEGKDLEFVKEKALKVGAIESYT    60

Query:  60 LDVKDEFAEHFVLPALQAHAMYEQKYPLVSALSRPIIAQKLVEMAHQTGATTIAHGCTGK   119
              +D K EFAE FVLPALQAHA+YEQKYPLVSALSRP+I++KLVE+A QTGA  +AHGCTGK
   Sbjct:  61 IDAKKEFAEEFVLPALQAHALYEQKYPLVSALSRPLISKKLVEIAEQTGAQAVAHGCTGK   120

Query: 120 GNDQVRFEVAIAALDPELKVIAPVREWKWHREEEITFAKANGVPIPADLDNPYSIDQNLW   179
              GNDQVRFEV+I AL+P L+V+APVREW W R+EEI +AK N +PIP DLDNPYS+DQNLW
   Sbjct: 121 GNDQVRFEVSIQALNPNLEVLAPVREWAWSRDEEIEYAKKNNIPIPIDLDNPYSVDQNLW   180

Query: 180 GRANECGVLENPWNQAPEEAFGITKSPEEAPDCAEYIDITFQNGKPIAINNQEMTLADLI   239
              GR+NECG+LE+PW   PE A+ +T + E+APD E ++I F+ G P+ +N +    +LI
   Sbjct: 181 GRSNECGILEDPWATPPEGAYELTVAIEDAPDQPEIVEIGFEKGIPVTLNGKSYPVHELI   240

Query: 240 LSLNEIAGKHGIGRIDHVENRLVGIKSREIYECPAAMVLLAAHKEIEDLTLVREVSHFKP   299
              L LN+IAGKHG+GRIDHVENRLVGIKSRE+YECP AM+ AHKE+EDLTL +EV+HFKP
   Sbjct: 241 LELNQIAGKHGVGRIDHVENRLVGIKSREVYECPGAMTLIKAHKELEDLTLTKEVAHFKP   300

Query: 300 ILENELSNLIYNALWFSPATKAIIAYVKETQKVVNGTTKVKLYKGSAQVVARHSSNSLYD   359
              ++E +++ LIY  LWFSP   A+ A++KETQ  V G  +VKL+KG A V R  SLY+
   Sbjct: 301 VVEKKIAELIYEGLWFSPLQPALSAFLKETQSTVTGVVRVKLFKGHAIVEGRKSEYSLYN   360
```

```
-continued
Query:  360 ENLATYTAADSFDQDAAVGFIKLWGLPTQVNAQVNK                     395
            E LATYT  D FD +AAVGFI LWGLPT+V + VNK
Sbjct:  361 EKLATYTPDDEFDHNAAVGFISLWGLPTKVYSMVNK                     396
```

No corresponding DNA sequence was identified in S. pyogenes.

Based on this analysis, it was predicted that this protein and its epitopes, could be useful antigens for vaccines or diagnostics.

EXAMPLE 2104

A DNA sequence (GBSx2219) was identified in S. agalactiae <SEQ ID 6507> which encodes the amino acid sequence <SEQ ID 6508>. This protein is predicted to be argininosuccinate lyase (argH). Analysis of this protein sequence reveals the following:

```
Possible site: 43
>>> Seems to have no N-terminal signal sequence

----- Final Results -----
            bacterial cytoplasm --- Certainty = 0.2131(Affirmative) < succ>
            bacterial membrane  --- Certainty = 0.0000(Not Clear)   < succ>
             bacterial outside  --- Certainty = 0.0000(Not Clear)   < succ>
```

The protein has homology with the following sequences in the GENPEPT database.

```
>GP: BAB06905 GB: AP001518 argininosuccinate lyase [Bacillus halodurans]
Identities = 284/454 (62%), Positives = 350/454 (76%)

6 KLWGGRFESSLEKWVEEFGASISFDQKLAPYDMKASMAHVTMLGKTDIISQEEAGLIKDG    65
Query:
              KLWGGRF  + E WV+EFGASI FDQ+L   D++ S+AHVTML K+ I++ EE   IK G
Sbjct:      3 KLWGGRFTKTAEAWVDEFGASIGFDQQLVEEDIEGSLAHVTMLEKSGILANEEVEQIKKG    62

Query:     66 LKILQDKYRAGQLTFSISNEDIHMNIESLLTAEIGEVAGKLHTARSRNDQVATDMHLYLK   125
              L IL +K + G+L +S++NEDIH+NIE LL   EIG V GKLHT RSRNDQVATDMHLYL+
Sbjct:     63 LHILLEKAKKGELNYSVANEDIHLNIEKLLIDEIGPVGGKLHTGRSRNDQVATDMHLYLR   122

Query:    126 DKLQEMMKKLLHLRTTLVNLAENHIYTVMPGYTHLQHAQPISFGHHLMAYYNMFTRDTER   185
               + +E+++ + +++   LV  A+ H+ T++PGYTHLQ AQPISF HHL+AY+ M  RD  R
Sbjct:    123 KQTKEILQLVKNVQAALVEQAKQHVETLIPGYTHLQRAQPISFAHHLLAYFWMLERDYGR   182

Query:    186 LEFNMKHTNLSPLGAAALAGTTFPIDRHMTTRLLDFEKPYSNSLDAVSDRDFIIEFLSNA   245
                E ++K N+SPLGA ALAGTTFPIDR   T  LL F+  Y NSLDAVSDRDFI+EFLS +
Sbjct:    183 YEDSLKRLNVSPLGAGALAGTTFPIDREYTAELLGFDGIYENSLDAVSDRDFIVEFLSAS   242

Query:    246 SILMMHLSRFCEEIINWCSYEYQFITLSDTFSTGSSIMPQKKNPDMAELIRGKTGRVYGN   305
              S+LM HLSR CEE+I W S E+QF+ + D F+TGSSIMPQKKNPDMAELIRGKTGRVYG+
Sbjct:    243 SLLMTHLSRLCEELILWSSQEFQFVEMDDAFATGSSIMPQKKNPDMAELIRGKTGRVYGS   302

Query:    306 LFSLLTVMKSLPLAYNKDLQEDKEGMFDSVETVSIAIEIMANMLETMTVNEHIMMTSTET   365
              LFSLLTV+K LPLAYNKD+QEDKEGMFD+V+TV  ++ I A M++TM V E  M   +
Sbjct:    303 LFSLLTVLKGLPLAYNKDMQEDKEGMFDAVKTVKGSLAIFAGMIQTMKVKEETMTKAVHQ   362

Query:    366 DFSNATELADYLASKGVPFRKAHEIVGKLVLECSKNGSYLQDIPLKYYQEISELIENDIY   425
              DFSNATELADYLA+KG+PFR+AHE+VGKLVL C + G YL D+PL  Y+   S+L + DIY
Sbjct:    363 DFSNATELADYLATKGMPFREAHEVVGKLVLLCIQKGIYLLDLPLSDYKAASDLFDEDIY   422

Query:    426 EILTAKTAVKRRNSLGGTGFDQVKKQILLARKEL                            459
              ++L  KT V RR S GGTGF +VKK I   A K L
Sbjct:    423 DVLQPKTVVARRTSAGGTGFTEVKKAIAKAEKIL                            456
```

Based on this analysis, it was predicted that this protein and its epitopes, could be useful antigens for vaccines or diagnostics.

EXAMPLE 2105

A DNA sequence (GBSx2220) was identified in *S. agalactiae* <SEQ ID 6509> which encodes the amino acid sequence <SEQ ID 6510>. This protein is predicted to be class-II aldolase (fba). Analysis of this protein sequence reveals the following:

```
Possible site: 42
>>> Seems to have no N-terminal signal sequence

----- Final Results -----
              bacterial cytoplasm --- Certainty = 0.2930(Affirmative) < succ>
               bacterial membrane --- Certainty = 0.0000(Not Clear)   < succ>
                 bacterial outside --- Certainty = 0.0000(Not Clear)   < succ>
```

A related GBS nucleic acid sequence <SEQ ID 9289> which encodes amino acid sequence <SEQ ID 9290> was also identified. Analysis of this sequence reveals:

```
GvH: Signal Score (-7.5): -2.92
     Possible site: 42
>>> Seems to have no N-terminal signal seq.
ALOM program count: 0 value: 0.37 threshold: 0.0
   PERIPHERAL Likelihood = 0.37 66
modified ALOM score: -0.57
*** Reasoning Step: 3

----- Final Results -----
              bacterial cytoplasm --- Certainty = 0.2930(Affirmative) < succ>
               bacterial membrane --- Certainty = 0.0000(Not Clear)   < succ>
                 bacterial outside --- Certainty = 0.0000(Not Clear)   < succ>
```

The protein has homology with the following sequences in the GENPEPT database.

```
>GP:BAB16889 GB:AB050113 class-II aldolase [Streptococcus bovis]
Identities = 221/242 (91%), Positives = 234/242 (96%)
Query:   1 MAIVSAEKFVQAARDNGYAVGGFNTNNLEWTQAILRAAEAKKAPVLIQTSMGAAKYMGGY   60
           MAIVSAEKF++AAR+NGYAVGGFNTNNLEWTQAILRAAEAKKAP+LIQTSMGAAKYMGGY
Sbjct:   1 MAIVSAEKFIKAARENGYAVGGFNTNNLEWTQAILRAAEAKKAPILIQTSMGAAKYMGGY   60

Query:  61 KLCKQLIETLVESMGITVPVAIHLDHGHYDDALECIEVGYTSIMFDGSHLPVEENLEKAR  120
           KLCK LIE LVESMGITVPVAIHLDHGH++DALECIEVGYTS+MFDGSHLPVEENLEKA+
Sbjct:  61 KLCKTLIENLVESNGITVPVAIHLDHGHFEDALECIEVGYTSVMFDGSHLPVEENLEKAK  120

Query: 121 EVVAKAHAKGISVEAEVGTIGGEEDGIVGKGELAPIEDAKAMVETGIDFLAAGIGNIHGP  180
           EVVAKAHAKG+SVEAEVGTIGGEEDGIVG GELAPIEDAKA+V TGIDFLAAGIGNIHGP
Sbjct: 121 EVVAKAHAKGVSVEAEVGTIGGEEDGIVGGGELAPIEDAKAMVATGIDFLAAGIGNIHGP  180

Query: 181 YPANWEGLDLDHLKKLTEAVPGFPIVLHGGSGIPDDQIQEAIKLGVAKVNVNTECQLAFC  240
           YPANW+GL LDHLKKLT AVPGFPIVLHGGSGIPDDQI+ AIKLGVAKVNVNTECQ+AF
Sbjct: 181 YPANWQGLHLDHLKKLTAAVPGFPIVLHGGSGIPDDQIKAAIKLGVAKVNVNTECQIAFA  240

Query: 241 QA                                                           242
           +A
Sbjct: 241 KA                                                           242
```

A related DNA sequence was identified in *S. pyogenes* <SEQ ID 6511> which encodes the amino acid sequence <SEQ ID 6512>. Analysis of this protein sequence reveals the following:

```
Possible site: 42
>>> Seems to have no N-terminal signal sequence

----- Final Results -----
              bacterial cytoplasm --- Certainty = 0.2930(Affirmative) < succ>
               bacterial membrane --- Certainty = 0.0000(Not Clear)   < succ>
                 bacterial outside --- Certainty = 0.0000(Not Clear)   < succ>
```

An alignment of the GAS and GBS proteins is shown below.

```
Identities = 217/242 (89%), Positives = 228/242 (93%)
Query:    1 MAIVSAEKFVQAARDNGYAVGGFNTNNLEWTQAILRAAEAKKAPVLIQTSMGAAKYMGGY    60
            MAIVSAEKFVQAAR+NGYAVGGFNTNNLEWTQAILRAAEAK+APVLIQTSMGAAKYMGGY
Sbjct:    1 MAIVSAEKFVQAARENGYAVGGFNTNNLEWTQAILRAAEAKQAPVLIQTSMGAAKYMGGY    60

Query:   61 KLCKQLIETLVESHGITVPVAIHLDHGHYDDALECIEVGYTSIMFDGSHLPVEENLEKAR   120
            K+C+ LI   LVESMGITVPVAIHLDHGHY+DALECIEVGYTSIMFDGSHLPVEENL K
Sbjct:   61 KVCQSLITNLVESMGITVPVAIHLDHGHYEDALECIEVGYTSIMFDGSHLPVEENLAKTA   120

Query:  121 EVVAKAHAKGISVEAEVGTIGGEEDGIVGKGELAPIEDAKAMVETGIDFLAAGIGNIHGP   180
            EVV  AHAKG+SVEAEVGTIGGEEDGI+GKGELAPIEDAKAMVETGIDFLAAGIGNIHGP
Sbjct:  121 EVVKIAHAKGVSVEAEVGTIGGEEDGIIGKGELAPIEDAKAMVETGIDFLAAGIGNIHGP   180

Query:  181 YPANWEGLDLDHLKKLTEAVPGFPIVLHGGSGIPDDQIQEAIKLGVAKVNVNTECQLAFC   240
            YP NWEGL LDHL+KLT AVPGFPIVLHGGSGIPDDQI+EAI+LGVAKVNVNTE Q+AF
Sbjct:  181 YPENWEGLALDHLEKLTAAVPGFPIVLHGGSGIPDDQIKEAIRLGVAKVNVNTESQIAFS   240

Query:  241 QA                                                            242
            A
Sbjct:  241 NA                                                            242
```

SEQ ID 9290 (GBS683) was expressed in *E. coli* as a GST-fusion product. SDS-PAGE analysis of total cell extract is shown in FIG. 150 (lane 8 & 10; MW 55 kDa). It was also expressed in *E. coli* as a His-fusion product. SDS-PAGE analysis of total cell extract is shown in FIG. 150 (lane 11-13; MW 30 kDa) and in FIG. 184 (lane 11; MW 30 kDa).

Based on this analysis, it was predicted that this protein and its epitopes, could be useful antigens for vaccines or diagnostics.

EXAMPLE 2106

A DNA sequence (GBSx2221) was identified in *S. agalactiae* <SEQ ID 6513> which encodes the amino acid sequence <SEQ ID 6514>. Analysis of this protein sequence reveals the following:

```
Possible site: 22
>>> Seems to have no N-terminal signal sequence

----- Final Results -----
           bacterial cytoplasm --- Certainty = 0.2775(Affirmative) < succ>
           bacterial membrane  --- Certainty = 0.0000(Not Clear)   < succ>
           bacterial outside   --- Certainty = 0.0000(Not Clear)   < succ>
```

The protein has homology with the following sequences in the GENPEPT database.

```
>GP:AAA88585 GB:M18954 unknown protein [Streptococcus mutans]
Identities = 109/229 (47%), Positives = 156/229 (67%), Gaps = 1/229 (0%)
Query:    1 MFSGKRLKKRRITLGYSQSELADKLHINRSSYFNWENEKTKPNQSNLKQLAILLDVPETY    60
            MFS ++LK+RR  LG SQ++ ADKL I+R SYFNWE  KTKPNQ NL +LA LL V   Y
Sbjct:    1 MFSSQKLKERRKKLGLSQAQTADKLGISRPSYFNWEIGKTKPNQKNLDKLAHLLKVDSAY    60

Query:   61 FESEYKIVNTYLQLSLQNQEKVEKYAEELLQTQKVHEKIVPLFAVEVLSEIQLSAGPGEG   120
              F S++ IV  Y +L+  N+ K  KY++ LL+ Q       ++           +LSAG G
Sbjct:   61 FLSQHDIVEIYTRLNESNKTKTLKYSQHLLEQQDKKRNLMKNKRYPYRVYEKLSAGTGYS   120

Query:  121 LYDEFETETVYSEDEYTGFDIATWISGNSMEPVYKDGEVALIRSTGFDHDGAVYALNWNG   180
            + +    +TV+ ++E     D A+WI G+SMEP++  +GEVALI+ TGFD+DGA+YA++W+G
Sbjct:  121 YFGDGNFDTVFYDEEID-HDFASWIFGDSMEPIFLNGEVALIKQTGFDYDGAIYAIDWDG   179

Query:  181 SLYIKKLYREEDGFRMVSINPDVAERFIPFEDEIRIVGKIVGHFMPVIG             229
             YIKK+YREE G R+VS+N  A++F P+++  RI+G IVG+F+P+ G
Sbjct:  180 QTYIKKVYREETGLRLVSLNKKYADKFAPYDENPRIIGLIVGNFIPLEG             228
```

A related DNA sequence was identified in *S. pyogenes* <SEQ ID 6515> which encodes the amino acid sequence <SEQ ID 6516>. Analysis of this protein sequence reveals the following:

```
Possible site: 38
>>> Seems to have no N-terminal signal sequence
```

-continued
```
----- Final Results -----
            bacterial cytoplasm --- Certainty = 0.4340(Affirmative) < succ>
            bacterial membrane  --- Certainty = 0.0000(Not Clear)   < succ>
             bacterial outside  --- Certainty = 0.0000(Not Clear)   < succ>
```

An alignment of the GAS and GBS proteins is shown below.

```
Identities = 84/209 (40%), Positives = 130/209 (62%), Gaps = 9/209 (4%)
Query:  25 LHINRSSYFNWENEKTKPNQSNLKQLAILLDVPETYFESEYKIVNTYLQLSLQNQEKVEK   64
           LH+N+ +  NWE  K PN+ +L  L  L +V    YF+  Y+++   Y QL++ N+EKV
Sbjct:   5 LHVNKMTISNWEKGKNIPNEKHLNALLHLFNVTSDYFDPNYRLLTPYNQLTISNKEKVIG   84

Query:  85 YAEELLQTQ------KVHEKIVPLFAVEVLSEIQLSAGPGEGLYDEFETETVYSEDEYTG  138
           Y+E LL Q        + +K    L+A V     LSAG G   + +   + V+  DE
Sbjct:  65 YSERLLNHQIDKKSKDLIDKPSQLYAYRVYES--LSAGTGYSYFGDGNFDVVFY-DEQLE  121

Query: 139 FDIATWISGNSMEPVYKDGEVALIRSTGFDHDGAVYALNWNGSLYIKKLYREEDGFRMVS  198
           +D A+W+ G+SMEP Y +GEV LI+    FD+DGA+YA+ W+G  YIKK++RE++G R+VS
Sbjct: 122 YDFASWVFGDSMEPTYLNGEVVLIKQNSFDYDGAIYAVEWDGQTYIKKVFREDEGLRLVS  181

Query: 199 INPDVAERFIPFEDEIRIVGKIVGHFMPV                                227
           +N    +++F P+ +E RI+GKI+ +F P+
Sbjct: 182 LNKKYSDKFAPYSEEPRIIGKIIANFRPL                                210
```

Based on this analysis, it was predicted that this protein and its epitopes, could be useful antigens for vaccines or diagnostics.

EXAMPLE 2107

A DNA sequence (GBSx2222) was identified in S. agalactiae <SEQ ID 6517> which encodes the amino acid sequence <SEQ ID 6518>. Analysis of this protein sequence reveals the following:

```
Possible site: 41
>>> Seems to have no N-terminal signal sequence

----- Final Results -----
            bacterial cytoplasm --- Certainty = 0.2387(Affirmative) < succ>
            bacterial membrane  --- Certainty = 0.0000(Not Clear)  <succ>
             bacterial outside  --- Certainty = 0.0000(Not Clear)  <succ>
```

The protein has no significant homology with any sequences in the GENPEPT database.

No corresponding DNA sequence was identified in S. pyogenes.

Based on this analysis, it was predicted that this protein and its epitopes, could be useful antigens for vaccines or diagnostics.

EXAMPLE 2108

A DNA sequence (GBSx2223) was identified in S. agalactiae <SEQ ID 6519> which encodes the amino acid sequence <SEQ ID 6520>. This protein is predicted to be UmuC MucB homolog (uvrX). Analysis of this protein sequence reveals the following:

```
Possible site: 47
>>> Seems to have no N-terminal signal sequence

----- Final Results -----
            bacterial cytoplasm --- Certainty = 0.2195(Affirmative) < succ>
            bacterial membrane  --- Certainty = 0.0000(Not Clear)   < succ>
             bacterial outside  --- Certainty = 0.0000(Not Clear)   < succ>
```

A related GBS nucleic acid sequence <SEQ ID 9925> which encodes amino acid sequence <SEQ ID 9926> was also identified.

The protein has homology with the following sequences in the GENPEPT database.

```
>GP:AAC98439 GB:L29324 UmuC MucB homolog [Streptococcus pneumoniae]
Identities = 303/436 (69%), Positives = 360/436 (82%)
```

```
-continued
Query:   39 LHTSLCVMSRADNSAGLILASSPMFKKVFGKGNVGRAYDLPFDVHTRKFNYYRAKISGLP   98
            L   LCVMSRADNSAGLILASSPMFKKVFGK NVGR+YDLPFDV TRKF+YY AK  GLP
Sbjct:    5 LRLRLCVMSRADNSAGLILASSPMFKKVFGKSNVGRSYDLPFDVKTRKFSYYNAKKQGLP   64

Query:   99 TDAKFVSFIENWAKRTFIVPPRMDLYIQKNLEIQKVFQNYADPTDILPYSIDEGFIDLTS  158
            T   +V +IE WAK T IVP    L I N+EIQK+FQ++A P DI PYSIDEGFIDLTS
Sbjct:   65 TTIDYVRYIEEWAKSTVIVPREWILTIAVNMEIQKIFQDFAAPDDIYPYSIDEGFIDLTS  124

Query:  159 SLNYFVEDKSLSRKDKLDVVSAKIQHDIWEKTGVYSTVGMSNANPLLAKLALDNEAKTTA  218
            SLNYFV DKS+SRKDKLD++SA IQ  IW KTG+YSTVGMSNANPLLAKLALDNEAK T
Sbjct:  125 SLNYFVPDKSISRKDKLDIISAAIQKKIWRKTGIYSTVGMSNANPLLAKLALDNEAKKTP  184

Query:  219 TMRANWSYEDVETKVWNIPKMTDFWGIGSRTEKRLNKLGIYSIKELANCDPTILKKEFGV  278
            TMRANWSYEDVE KVW IPKMTDFWGIG+R EKRL+ LGI+SIKELA  +P ++KKE G+
Sbjct:  185 TMRANWSYEDVEKKVWTIPKMTDFWGIGNRMEKRLHNLGIFSIKELAQANPDLIKKELGI  244

Query:  279 IGVQHWFHANGIDESNVHEPYRPKAVGIGNSQVLHKDYTRQSDIELVLREMAEQVAIRLR  338
            +G++ WFHANGIDESNVH+PY+PK+ GIGNSQVL KDY +Q DIE++LREMAEQVA+RLR
Sbjct:  245 MGLELWFHANGIDESNVHKPYKPKSKGIGNSQVLPKDYIKQRDIEIILREMAEQVAVRLR  304

Query:  339 RRHKKATVVAINVGYSNFENKKSINVQRKINPNNRTLVFQDEVVSLFRSKYDGGAVRSIA  398
            R  KKATVV+I++GYS  E K+SIN Q KI P N+T +   V+ LF +KY  GA+R++A
Sbjct:  305 RSGKKATVVSIHLGYSKVEQKRSINTQMKIEPTNQTALLTNYVLKLFHTKYTSGAIRNVA  364

Query:  399 VRYDGLVDENFAVISLFDDFEESEKEEKLETTIDSIRDRFGFLAVQKASSLLENSRAISR  458
            V Y GLVDE+F +ISLFDD E+ EKEE+L++ ID+IR  FGF ++ K ++L + SR I+R
Sbjct:  365 VNYSGLVDESFGLISLFDDIEKIEKEERLQSAIDAIRTEFGFTSLLKGNALDQASRTIAR  424

Query:  459 SRLVGGHSAGGLEGLK                                             474
            S+L+GGHSAGGL+GLK
Sbjct:  425 SKLIGGHSAGGLDGLK                                             440
```

Based on this analysis, it was predicted that this protein and its epitopes, could be useful antigens for vaccines or diagnostics.

EXAMPLE 2109

A DNA sequence (GBSx2224) was identified in *S. agalactiae* <SEQ ID 6521> which encodes the amino acid sequence <SEQ ID 6522>. Analysis of this protein sequence reveals the following:

```
Possible site: 45
>>> Seems to have no N-terminal signal sequence

----- Final Results -----
          bacterial cytoplasm --- Certainty = 0.4016(Affirmative) < succ>
          bacterial membrane  --- Certainty = 0.0000(Not Clear)   < succ>
          bacterial outside   --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 2110

A DNA sequence (GBSx2225) was identified in *S. agalactiae* <SEQ ID 6523> which encodes the amino acid sequence <SEQ ID 6524>. Analysis of this protein sequence reveals the following:

```
Possible site: 32
>>> Seems to have no N-terminal signal sequence

----- Final Results -----
          bacterial cytoplasm --- Certainty = 0.2088(Affirmative) < succ>
          bacterial membrane  --- Certainty = 0.0000(Not Clear)   < succ>
          bacterial outside   --- Certainty = 0.0000(Not Clear)   < succ>
```

The protein has homology with the following sequences in the GENPEPT database.

```
>GP:AAG13001 GB:AF227520 unknown [Streptococcus pneumoniae]
 Identities = 68/122 (55%), Positives = 89/122 (72%), Gaps = 6/122 (4%)
Query:    1 MIDRSYLPFKVAREYQDRKMAKWMGFFLSEHTAGLDSELNKVDYTSELSISDKLLLLNQL   60
            MIDRSYLPF+ AREYQD KM KWMGFFLSEHT+ L  + NKV Y S+LS+  KLLLL+Q+
Sbjct:    1 MIDRSYLPFQSAREYQDTKMQKWMGFFLSEHTSALTDDANKVTYMSDLSLEKKLLLLSQV   60

Query:   61 YSNQLNGIIAVPGQ----YYSGKVDNLTFNHVSLKTKTGFVSIPIKDILSIDL--EVEYE  114
            Y+ QLN   I V +       Y+G + +LT + + +KT TG +++ +KDI+SI+L  EV YE
Sbjct:   61 YAGQLNTRIHVVKKNNQVSYTGTIPSLTKDFILIKTTTGHINLKLKDIVSIELVEEVLYE  120

Query:  115 SA                                                           116
            SA
Sbjct:  121 SA                                                           122
```

No corresponding DNA sequence was identified in *S. pyogenes*.

Based on this analysis, it was predicted that this protein and its epitopes, could be useful antigens for vaccines or diagnostics.

EXAMPLE 2111

A DNA sequence (GBSx2226) was identified in *S. agalactiae* <SEQ ID 6525> which encodes the amino acid sequence <SEQ ID 6526>. Analysis of this protein sequence reveals the following:

```
Possible site: 48
>>> Seems to have no N-terminal signal sequence

----- Final Results -----
          bacterial cytoplasm --- Certainty = 0.4025(Affirmative) < succ>
          bacterial membrane  --- Certainty = 0.0000(Not Clear)   < succ>
          bacterial outside   --- Certainty = 0.0000(Not Clear)   < succ>
```

A related GBS nucleic acid sequence <SEQ ID 9927> which encodes amino acid sequence <SEQ ID 9928> was also identified.

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 2112

A DNA sequence (GBSx2227) was identified in *S. agalactiae* <SEQ ID 6527> which encodes the amino acid sequence <SEQ ID 6528>. This protein is predicted to be soluble transducer HtrXIII. Analysis of this protein sequence reveals the following:

```
Possible site: 56
>>> Seems to have no N-terminal signal sequence

----- Final Results -----
          bacterial cytoplasm --- Certainty = 0.5246(Affirmative) < succ>
          bacterial membrane  --- Certainty = 0.0000(Not Clear)   < succ>
          bacterial outside   --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 2113

A DNA sequence (GBSx2228) was identified in *S. agalactiae* <SEQ ID 6529> which encodes the amino acid sequence <SEQ ID 6530>. Analysis of this protein sequence reveals the following:

```
Possible site: 60
>>> Seems to have no N-terminal signal sequence

----- Final Results -----
            bacterial cytoplasm --- Certainty = 0.5131(Affirmative) < succ>
            bacterial membrane  --- Certainty = 0.0000(Not Clear)   < succ>
             bacterial outside  --- Certainty = 0.0000(Not Clear)   < succ>
```

The protein has no significant homology with any sequences in the GENPEPT database.

No corresponding DNA sequence was identified in S. pyogenes.

Based on this analysis, it was predicted that this protein and its epitopes, could be useful antigens for vaccines or diagnostics.

EXAMPLE 2114

A DNA sequence (GBSx2229) was identified in S. agalactiae <SEQ ID 6531> which encodes the amino acid sequence <SEQ ID 6532>. This protein is predicted to be pXO2-78. Analysis of this protein sequence reveals the following:

```
Possible site: 43
>>> Seems to have no N-terminal signal sequence

----- Final Results -----
            bacterial cytoplasm --- Certainty = 0.2105(Affirmative) < succ>
            bacterial membrane  --- Certainty = 0.0000(Not Clear)   < succ>
             bacterial outside  --- Certainty = 0.0000(Not Clear)   < succ>
```

The protein has homology with the following sequences in the GENPEPT database.

```
>GP:AAF13682 GB:AF188935 pXO2-78 [Bacillus anthracis]
 Identities = 101/314 (32%), Positives = 147/314 (46%), Gaps = 46/314 (14%)
Query:  27 SGQIYEHPDHDSFRIFADTNTFKWFSRDIQGDVIDFVQLVAGVSFKKALSYLETG--GPE   84
              S + Y  +HDS I    N F W SR + G++I FVQ V    SF A+  L  G   +E
Sbjct:  39 SERYYRLTEHDSLIIDRKKNQFYWNSRGVNGNIIKFVQEVEDASFPGAMQRLLDGEQDYE   98

Query:  85 EAKVIEETYQPFQYYLREEP----FQQARTYLKDIRGLSNQTINSFGRQGLLAQATYQAE  140
              +A  I    +P+ Y  E+     F +AR YL + R +  Q +++    +GL+ Q  Y
Sbjct:  99 KASEITFVSEPYDYEHFEQKEVSRFDRAREYLIEERKIDPQVVDALHNKGLIKQDKYN--  156

Query: 141 SVLVFKSFDHNGTLQAASLQGLVKNEEKYDRGYLKKIMKGSHGHVGISFDIGNPKRLIFC  200
              +VL         G +   S QG+VK++ KY RG   K I K S  + G +    G P+ L F
Sbjct: 157 NVLFLWKDRETGAVMGGSEQGVVKSD-KYKRGAWKSIQKNSTANYGFNVLNGEPRNLKFY  215

Query: 201 ESVIDMMSYYQLHQKQLSDVRLISMEGLKLSVIAYQTLRLAAEEQGKLAFLDTVKPIRLS  260
              ES  ID++SY  LH+  L D  LISMEGLK   VI                        +
Sbjct: 216 ESDIDLLSYATLHKHNLKDTHLISMEGLKPQVI-----------------------FN   250

Query: 261 HYLQAIQETTTFFQTHSNVITMAVDNDEAGREFYQKL-------SDKGFPIFQ-DLPPLQ  312
              +Y++A +         + +++ VDND+AG+ F ++L       +D     F+ + P
Sbjct: 251 YYMKACERIGDV----PDSLSLCVDNDKAGKAFVERLIHFRYEKNDGSIVAFKPEYPQAP  306

Query: 313 RLETKSDWNDIVKR                                               326
              E K DWND  KR
Sbjct: 307 SEEKKWDWNDECKR                                               320
```

No corresponding DNA sequence was identified in S. pyogenes.

Based on this analysis, it was predicted that this protein and its epitopes, could be useful antigens for vaccines or diagnostics.

EXAMPLE 2115

A DNA sequence (GBSx2230) was identified in S. agalactiae <SEQ ID 6533> which encodes the amino acid sequence <SEQ ID 6534>. Analysis of this protein sequence reveals the following:

```
Possible site: 20
>>> Seems to have no N-terminal signal sequence

----- Final Results -----
            bacterial cytoplasm --- Certainty = 0.7013(Affirmative) < succ>
```

```
                   bacterial membrane --- Certainty = 0.0000(Not Clear) < succ>
                   bacterial outside  --- Certainty = 0.0000(Not Clear) < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 2116

A DNA sequence (GBSx2231) was identified in *S. agalactiae* <SEQ ID 6535> which encodes the amino acid sequence <SEQ ID 6536>. Analysis of this protein sequence reveals the following:

```
Possible site: 48
>>> Seems to have no N-terminal signal sequence

----- Final Results -----
              bacterial cytoplasm --- Certainty = 0.1310(Affirmative) < succ>
              bacterial membrane  --- Certainty = 0.0000(Not Clear)   < succ>
              bacterial outside   --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 2117

A DNA sequence (GBSx2232) was identified in *S. agalactiae* <SEQ ID 6537> which encodes the amino acid sequence <SEQ ID 6538>. Analysis of this protein sequence reveals the following:

```
Possible site: 31
>>> Seems to have no N-terminal signal sequence

----- Final Results -----
              bacterial cytoplasm --- Certainty = 0.6726(Affirmative) < succ>
              bacterial membrane  --- Certainty = 0.0000(Not Clear)   < succ>
              bacterial outside   --- Certainty = 0.0000(Not Clear)   < succ>
```

A related GBS nucleic acid sequence <SEQ ID 9373> which encodes amino acid sequence <SEQ ID 9374> was also identified.

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 2118

A DNA sequence (GBSx2233) was identified in *S. agalactiae* <SEQ ID 6539> which encodes the amino acid sequence <SEQ ID 6540>. This protein is predicted to be phosphoglucomutase (manB). Analysis of this protein sequence reveals the following:

```
Possible site: 38
>>> Seems to have no N-terminal signal sequence

----- Final Results -----
              bacterial cytoplasm --- Certainty = 0.2147(Affirmative) < succ>
              bacterial membrane  --- Certainty = 0.0000(Not Clear)   < succ>
              bacterial outside   --- Certainty = 0.0000(Not Clear)   < succ>
```

A related GBS nucleic acid sequence <SEQ ID 9355> which encodes amino-acid sequence <SEQ ID 9356> was also identified.

The protein has homology with the following sequences in the GENPEPT database.

```
>GP: CAB96418 GB: AJ243290 phosphoglucomutase [Streptococcus thermophilus]
Identities = 391/465 (84%), Positives = 424/465 (91%), Gaps = 1/465 (0%)

Query:    1 MAQHGIKSYVFEALRPTPELSFAVRHLNAYAGIMVTASHNPAPFNGYKVYGQDGGQLPPA   60
            +A HGIKSYVFE+LRPTPELSFAVRHL+ +AGIM+TASHNPAPFNGYKVYG+DGGQ+PPA
Sbjct:  107 LAAHGIKSYVFESLRPTPELSFAVRHLHTFAGIMITASHNPAPFNGYKVYGEDGGQMPPA  166

Query:   61 DADALTDFIRAIENPFAVELADLDESKSSGLIQVIGEDVDIEYLREVKDVNINQDLINNF  120
            DADALTD+IRAI+NPF V+LADL++SK+SGLI++IGE+VD EYL+EVKDVNINQDLIN +
Sbjct:  167 DADALTDYIRAIDNPFTVKLADLEDSKASGLIEIIGENVDAEYLKEVKDVNINQDLINEY  226

Query:  121 GKDMKIVYTPLHGTGEMLTRRALAQAGFESVVVVESQAKADPDFSTVKSPNPESQAAFAL  180
            G+DMKIVYT LHGTGEML RRALAQAGF++V VVE+QA   DF TVKSPNPE+Q AFAL
Sbjct:  227 GRDMKIVYTSLHGTGEMLVRRALAQAGFDAVQVVEAQAVPHADFLTVKSPNPENQDAFAL  286

Query:  181 AEELGREVDADVLVATDPDADRLGVEIRQPDGSYKNLSGNQIGAIIAKYILEAHKTAGTL  240
            AEELGR VDADVLVATDPDADRLGVEIRQPDGSY NLSGNQIGAIIAKYILEAHKTAGTL
Sbjct:  287 AEELGRNVDADVLVATDPDADRLGVEIRQPDGSYLNLSGNQIGAIIAKYILEAHKTAGTL  346

Query:  241 PENAALAKSIVSTELVTKIAESYGATMFNVLTGFKFIAEKIQEFEEKHNHTYMFGFEESF  300
            P  NAAL KSIVSTELVTKIAESYGATMFNVLTGFKFI EKI EFE +HN+TYMFGFEESF
Sbjct:  347 PANAALCKSIVSTELVTKIAESYGATMFNVLTGFKFIGEKIHEFETQHNYTYMFGFEESF  406

Query:  301 GYLIKPFVRDKDAIQAVLLVAEIAAYYRSRGLTLADGIDEIYKEYGYFAEKTISVTLSGV  360
            GYLIKPFVRDKDAIQAVL+VAEIAAYYRSRG+TLADGI+EIYK+YGYF+EKTISVTLSGV
Sbjct:  407 GYLIKPFVRDKDAIQAVLIVAEIAAYYRSRGMTLADGIEEIYKQYGYFSEKTISVTLSGV  466

Query:  361 DGAAEIKKIMDKFRENGPKQFNNTDIVLLEDFQKQTATKNDGTISNLTTPPSNVLKYTLA  420
            DGAAEIKKIMDKFR N PKQFNNTDI   EDF +QTAT DG +  LTTPPSNVLKY LA
Sbjct:  467 DGAAEIKKIMDKFRRNAPKQFNNTDIAKTEDFLEQTATTADG-VEKLTTPPSNVLKYILA  525

Query:  421 DDSWIAVRPSGTEPKIKFYIATVGNDLADAETKIANIEKEITTFV                465
            DDSW AVRPSGTEPKIKFYIATVG  ADA+ KIANIE EI   FV
Sbjct:  526 DDSWFAVRPSGTEPKIKFYIATVGETEADAKEKIANIEAEINAFV                570
```

There is also homology to SEQ ID 6156:

```
Query:    1 MAQHGIKSYVFEALRPTPELSFAVRHLNAYAGIMVTASHNPAPFNGYKVYGQDGGQLPPA   60
            +AQHGIKSYVFEALRPTPELSFAVRHLNAYAGIMVTASHNPAPFNGYKVYGQDGGQLPPA
Sbjct:  107 LAQHGIKSYVFEALRPTPELSFAVRHLNAYAGIMVTASHNPAPFNGYKVYGQDGGQLPPA  166

Query:   61 DADALTDFIRAIENPFAVELADLDESKSSGLIQVIGEDVDIEYLREVKDVNINQDLINNF  120
            DADALTDFIRAIENPFAVELADLDE+KSSGLIQVIGEDVD+EYLREVKDVNINQDLINNF
Sbjct:  167 DADALTDFIRAIENPFAVELADLDENKSSGLIQVIGEDVDMEYLREVKDVNINQDLINNF  226

Query:  121 GKDMKIVYTPLHGTGEMLTRRALAQAGFESVVVVESQAKADPDFSTVKSPNPESQAAFAL  180
            GKDMKIVYTPLHGTGEMLTRRALAQAGFESVVVVESQAKADPDFSTVKSPNPESQAAFAL
Sbjct:  227 GKDMKIVYTPLHGTGEMLTRRALAQAGFESVVVVESQAKADPDFSTVKSPNPESQAAFAL  286

Query:  181 AEELGREVDADVLVATDPDADRLGVEIRQPDGSYKNLSGNQIGAIIAKYILEAHKTAGTL  240
            AEELGREV+ADVLVATDPDADRLGVEIRQPDGSYKNLSGNQIGAIIAKYILEAHKTAGTL
Sbjct:  287 AEELGREVEADVLVATDPDADRLGVEIRQPDGSYKNLSGNQIGAIIAKYILEAHKTAGTL  346

Query:  241 PENAALAKSIVSTELVTKIAESYGATMFNVLTGFKFIAEKIQEFEEKHNHTYMFGFEESF  300
            PENAALAKSIVSTELVTKIAESYGATMFNVLTGFKFIAEKIQEFEEKHNHTYMFGFEESF
Sbjct:  347 PENAALAKSIVSTELVTKIAESYGATMFNVLTGFKFIAEKIQEFEEKHNHTYMFGFEESF  406

Query:  301 GYLIKPFVRDKDAIQAVLLVAEIAAYYRSRGLTLADGIDEIYKEYGYFAEKTISVTLSGV  360
            GYLIKPFVRDKDAIQAVLLVAEIAAYYRSRGLTLADGIDEIYKEYGYFAEKTISVTLSGV
Sbjct:  407 GYLIKPFVRDKDAIQAVLLVAEIAAYYRSRGLTLADGIDEIYKEYGYFAEKTISVTLSGV  466

Query:  361 DGAAEIKKIMDKFRENGPKQFNNTDIVLLEDFQKQTATKNDGTISNLTTPPSNVLKYTLA  420
            DGAAEIKKIMDKFRENGPKQFNNTDIVLLEDFQKQTATKNDGTISNLTTPPSNVLKYTLA
Sbjct:  467 DGAAEIKKIMDKFRENGPKQFNNTDIVLLEDFQKQTATKNDGTISNLTTPPSNVLKYTLA  526

Query:  421 DDSWIAVRPSGTEPKIKFYIATVGNDLADAETKIANIEKEITTFV                465
            DDSWIAVRPSGTEPKIKFYIAT+G+ L A+ KIANIE EI  TFV
Sbjct:  527 DDSWIAVRPSGTEPKIKFYIATIGDTLDIAQEKIANIETEINTFV                571
```

EXAMPLE 2119

A DNA sequence (GBSx2235) was identified in *S. agalactiae* <SEQ ID 6541> which encodes the amino acid sequence <SEQ ID 6542>. Analysis of this protein sequence reveals the following:

```
Possible site: 20
>>> Seems to have no N-terminal signal sequence

----- Final Results -----
        bacterial cytoplasm --- Certainty = 0.1564(Affirmative) < succ>
         bacterial membrane --- Certainty = 0.0000(Not Clear)   < succ>
          bacterial outside --- Certainty = 0.0000(Not Clear)   < succ>
```

A related GBS nucleic acid sequence <SEQ ID 9905> which encodes amino acid sequence <SEQ ID 9906> was also identified. There is also homology to SEQ ID 32.

Based on this analysis, it was predicted that this protein and its epitopes, could be useful antigens for vaccines or diagnostics.

EXAMPLE 2120

A DNA sequence (GBSx2236) was identified in *S. agalactiae* <SEQ ID 6543> which encodes the amino acid sequence <SEQ ID 6544>. This protein is predicted to be ABC transporter, ATP-binding protein (msbA). Analysis of this protein sequence reveals the following:

```
Possible site: 48
>>> Seems to have an uncleavable N-term signal seq
    INTEGRAL    Likelihood = -9.92   Transmembrane   162-178 (135-184)
    INTEGRAL    Likelihood = -7.11   Transmembrane    58-74  (56-78)
    INTEGRAL    Likelihood = -6.42   Transmembrane   136-152 (135-161)
    INTEGRAL    Likelihood = -5.20   Transmembrane    23-39  (21-49)
    INTEGRAL    Likelihood = -1.75   Transmembrane   485-501 (485-501)

----- Final Results -----
         bacterial membrane --- Certainty = 0.4970(Affirmative) < succ>
          bacterial outside --- Certainty = 0.0000(Not Clear)   < succ>
        bacterial cytoplasm --- Certainty = 0.0000(Not Clear)   < succ>
```

The protein has homology with the following sequences in the GENPEPT database.

```
>GP: AAD35376 GB: AE001710 ABC transporter, ATP-binding protein
[Thermotoga maritima]
Identities = 216/552 (39%), Positives = 336/552 (60%), Gaps = 3/552 (0%)

Query:  26 MALLGTVVQVCLTVYLPVLIGQAVDVVLSPHSMILLLPIMWKMIAVILANTIIQWINPLL   85
            M  + V   L V P LIG+ +DVV P   LL   M  +   +++ W+   +
Sbjct:  41 MVFVFVTVSSILGVLSPYLIGKTIDVVFVPRRFDLLPRYMLILGTIYALTSLLFWLQGKI  100

Query:  86 YNRLIFHYVASLRKAVMEKLNLLPIAYLDKRGIGDLISRVTTDTEQLSNGLLMVFNQFFV  145
               L V LRK + EKL +P+ + D+   GD+ISRV D + ++N L     QFF
Sbjct: 101 MLTLSQDVVFRLRKELFEKLQRVPVGFFDRTPHGDIISRVINDVDNINNVLGNSIIQFFS  160

Query: 146 GLLTIIVTIFSMAKIDLLMLFLVLFLTPLSLFLARFIAKKSY-HLYQNQTASRGRQTQFI  204
           G++T+    + M ++++++   + L + PL++ + + ++ ++  + Y+NQ    G+    I
Sbjct: 161 GIVTLAGAVIMMFRVNVILSLVTLSIVPLTVLITQIVSSQTRKYFYENQRVL-GQLNGII  219

Query: 205 EEMVSQESLIQAFSAQEESSDHFRTINQEYANFSQSAIFYSSTVNPSTRFINSLIYGFLA  264
           EE +S  ++I+ F+ +E+   + F  +N+        A  +S + P   +N+L +  ++
Sbjct: 220 EEDISGLTVIKLFTREEKEMEKFDRVNESLRKVGTKAQIFSGVLPPLMNMVNNLGFALIS  279

Query: 265 GIGALRIMSGAFSVGQLITFLNYVNQYTKPFNDISSVLSEMQSALACAERLYSILEESSP  324
           G G     +   +VG  TF+ Y  Q+T+P N++S+   +Q ALA  AER++ IL+
Sbjct: 280 GFGGWLALKDIITVGTIATFIGYSRQFTRPLNELSNQFNMIQMALASAERIFEILDLEEE  339

Query: 325 NITGTEKLDSSTVKGQIDFKNVVFGYNKSKLLLNGINLHIPAGAKVAIVGPTGAGKSTLI  384
              + +     V+G+I+FKNV  F Y+K K +L   I    HI  G  KVA+VGPTG+GK+T++
Sbjct: 340 K-DDPDAVELREVRGEIEFKNVWFSYDKKKPVLKDITFHIKPGQKVALVGPTGSGKTTIV  398

Query: 385 NLIMRFYEVDGGNILLDCKPITDYEPSQLRQEIGMVLQETWLKSATIHDNIAYANPKASR  444
           NL+MRFY+VD G IL+D    I   +  S LR   IG+VLQ+T L S  T+ +N+ Y  NP A+
```

-continued
```
Sbjct: 399 NLLMRFYDVDRGQILVDGIDIRKIKRSSLRSSIGIVLQDTILFSTTVKENLKYGNPGATD  458

Query: 445 EEVIEAAKAANADFFIKQLPNGYDTYLEDAGDSLSQGQCQLLTIARIFLKLPRILILDEA  504
           EE+ EAAK  ++D FIK LP GY+T L D G+ LSQGQ QLL I R FL  P+ILILDEA
Sbjct: 459 EEIKEAAKLTHSDHFIKHLPEGYETVLTDNGEDLSQGQRQLLAITRAFLANPKILILDEA  518

Query: 505 TSSIDTRTEVLVQEAFQMLMKGRTSFIIAHRLSTIQTADIILVMVSGEIVEVGNHSELMA  564
           TS++DT+TE  +Q A    LM+G+TS IIAHRL+TI+ AD+I+V+  GEIVE+G H EL+
Sbjct: 519 TSNVDTKTEKSIQAAMWKLMEGKTSIIIAHRLNTIKNADLIIVLRDGEIVEMGKHDELIQ  578

Query: 565 QKGIYYQMQNAQ                                                 576
           ++G YY++  +Q
Sbjct: 579 KRGFYYELFTSQ                                                 590
```

A related DNA sequence was identified in *S. pyogenes* <SEQ ID 6545> which encodes the amino acid sequence <SEQ ID 6546>. Analysis of this protein sequence reveals the following:

```
Possible site: 56
>>> Seems to have an uncleavable N-term signal seq
      INTEGRAL      Likelihood = -8.07    Transmembrane    162-178  (159-182)
      INTEGRAL      Likelihood = -7.17    Transmembrane    143-159  (137-161)
      INTEGRAL      Likelihood = -5.84    Transmembrane     23-39   (19-45)
      INTEGRAL      Likelihood = -5.68    Transmembrane     68-84   (60-86)
      INTEGRAL      Likelihood = -2.55    Transmembrane    261-277  (256-278)

----- Final Results -----
             bacterial membrane --- Certainty = 0.4227(Affirmative) < succ>
             bacterial outside  --- Certainty = 0.0000(Not Clear)   < succ>
            bacterial cytoplasm --- Certainty = 0.0000(Not Clear)   < succ>
```

The protein has homology with the following sequences in the databases:

```
>GP: AAD35376 GB: AE001710 ABC transporter, ATP-binding protein
[Thermotoga maritima]
Identities = 206/572 (36%), Positives = 342/572 (59%), Gaps = 5/572 (0%)

Query:   2 IKTDHHLLKRVLQDLLKKPLPVCILVIASFVQVG--LSVYLPVLIGKAVDMSLSVNSWQT   59
           +K       L+R+L  L  +P    ++++ FV V   L V  P LIGK +D+       +
Sbjct:  18 LKNPTATLRRLLGYL--RPHTFTLIMVFVFVTVSSILGVLSPYLIGKTIDVVFVPRRFDL   75

Query:  60 LKWLLGQMLVIIVVNTLIQWVMPLVYSRLLYQYSQQLKDKLLEKIHRLPFAYLDRQTIGD  119
           L    +  I  +L+ W+    L     +L+ +L EK+ R+P  + DR    GD
Sbjct:  76 LPRYMLILGTIYALTSLLFWLQGKIMLTLSQDVVFRLRKELFEKLQRVPVGFFDRTPHGD  135

Query: 120 LVSRVITDTEQLINGLQMVFNQFILGLLTILCTIIAMAQIDWLMLILVLVLTPSSLFLAR  179
           ++SRVI D + + N L    QF  G++T+    +I M +++ ++ ++ L  P ++  + +
Sbjct: 136 IISRVINDVDNINNVLGNSIIQFFSGIVTLAGAVIMMFRVNVILSLVTLSIVPLTVLITQ  195

Query: 180 FIAQKSFHYAQAQTKSRGNLAQFTEEILRQEGLVQLFNAQEQSICDYHVLNKTYCEASQK  239
            ++ ++  Y      +  G L    EE +    +++LF  +E+ +   +N++    K
Sbjct: 196 IVSSQTRKYFYENQRVLGQLNGIIEEDISGLTVIKLFTREEKEMEKFDRVNESLRKVGTK  255

Query: 240 AIFYASTVNPATRFINSVIYALLAGLGAVRIMAGLFSVGQLTTFLNVVVQYTKPFNDISS  299
           A   ++ + P   +N++ +AL++G G  + + +VG + TF+    Q+T+P N++S+
Sbjct: 256 AQIFSGVLPPLMNMVNNLGFALISGFGGWLALKDIITVGTIATFIGYSRQFTRPLNELSN  315

Query: 300 VLAEIQSSLACAQRLYDLLDIEIKEQEHFLTFKASAVKGQIDFEEVSFSYQKDRPLLKDI  359
            +   IQ +LA A+R+++++LD+E +E++      +     V+G+I+F+ V FSY K +P+LKDI
Sbjct: 316 QFNMIQMALASAERIFEILDLE-EEKDDPDAVELREVRGEIEFKNVWFSYDKKKPVLKDI  374

Query: 360 NFSVPAGSKVAIVGPTGAGKSTLINLLMRFYELDAGSIKLDKVPIKCYAKEELRSITGIV  419
             F +  G KVA+VGPTG+GK+T++NLLMRFY++D G I +D + +    + LRS  GIV
Sbjct: 375 TFHIKPGQKVALVGPTGSGKTTIVNLLMRFYDVDRGQILVDGIDIRKIKRSSLRSSIGIV  434

Query: 420 LQETWLKDATVHELIAYGSEEASRDEVVAAAKAAHAHFFIMQLPKTYDTYLSASDDALSQ  479
           LQ+T L   TV E +  YG+  A+  +E+   AAK  H+    FI   LP+ Y+T L+ + + LSQ
Sbjct: 435 LQDTILFSTTVKENLKYGNPGATDEEIKEAAKLTHSDHFIKHLPEGYETVLTDNGEDLSQ  494

Query: 480 GQLQLLAIARMFLKKPKVLVLDEATSSIDIRTEAVIQEALKELMRGRTSFIIAHRLSTIQ  539
           GQ  QLLAI R FL  PK+L+LDEATS++D  +TE  IQ A+  +LM G+TS IIAHRL+TI+
Sbjct: 495 GQRQLLAITRAFLANFKILILDEATSNVDTKTEKSIQAAMWKLMEGKTSIIIAHRLNTIK  554

Query: 540 SADLILVMDQGRLVEWGTHASLMSKNGCYVRL                             571
```

```
                      -continued
        +ADLI+V+   G +VE G H   L+ K G Y  L
Sbjct: 555 NADLIIVLRDGEIVEMGKHDELIQKRGFYYEL                     586
```

An alignment of the GAS and GBS proteins is shown below.

```
Identities = 340/566 (60%), Positives = 433/566 (76%)

Query:  11 KKLVQDLLSKKSLVGMALLGTVVQVCLTVYLPVLIGQAVDVVLSPHSMILLLPIMWKMIA   70
           K+++QDLL K    V + ++ + VQV L+VYLPVLIG+AVD+ LS +S   L  ++ +M+
Sbjct:  10 KRVLQDLLKKPLPVCILVIASFVQVGLSVYLPVLIGKAVDMSLSVNSWQTLKWLLGQMLV   69

Query:  71 VILANTIIQWINPLLYNRLIFHYVASLRKAVMEKLNLLPIAYLDKRGIGDLISRVTTDTE  130
           +I+ NT+IQW+ PL+Y+RL++ Y    L+  ++EK++ LP AYLD++ IGDL+SRV TDTE
Sbjct:  70 IIVVNTLIQWVMPLVYSRLLYQYSQQLKDKLLEKIHRLPFAYLDRQTIGDLVSRVITDTE  129

Query: 131 QLSNGLLMVFNQFFVGLLTIIVTIFSMAKIDLLMLFLVLFLTPLSLFLARFIAKKSYHLY  190
           QL NGL MVFNQF +GLLTI+ TI +MA+ID LML LVL LTP SLFLARFIA+KS+H
Sbjct: 130 QLINGLQMVFNQFILGLLTILCTIIAMAQIDWLMLILVLVLTPSSLFLARFIAQKSFHYA  189

Query: 191 QNQTASRGRQTQFIEEMVSQESLIQAFSAQEESSDHFRTINQEYANFSQSAIFYSSTVNP  250
           Q  QT SRG   QF EE++ QE L+Q F+AQE+S   +  +N+ Y    SQ AIFY+STVNP
Sbjct: 190 QAQTKSRGNLAQFTEEILRQEGLVQLFNAQEQSICDYHVLNKTYCEASQKAIFYASTVNP  249

Query: 251 STRFINSLIYGFLAGIGALRIMSGAFSVGQLITFLNYVNQYTKPFNDISSVLSEMQSALA  310
           +TRFINS+IY  LAG+GA+RIM+G FSVGQL TFLN V QYTKPFNDISSVL+E+QS+LA
Sbjct: 250 ATRFINSVIYALLAGLGAVRIMAGLFSVGQLTTFLNVVVQYTKPFNDISSVLAEIQSSLA  309

Query: 311 CAERLYSILEESSPNITGTEKLDSSTVKGQIDFKNVVFGYNKSKLLLNGINLHIPAGAKV  370
           CA+RLY +L+ +             +S VKGQIDF+ V  F Y K + LL   IN  +PAG+KV
Sbjct: 310 CAQRLYDLLDIEIKEQEHFLTFKASAVKGQIDFEEVSFSYQKDRPLLKDINFSVPAGSKV  369

Query: 371 AIVGPTGAGKSTLINLIMRFYEVDGGNILLDCKPITDYEPSQLRQEIGMVLQETWLKSAT  430
           AIVGPTGAGKSTLINL+MRFYE+D G+I LD   PI   Y    +LR      G+VLQETWLK AT
Sbjct: 370 AIVGPTGAGKSTLINLLMRFYELDAGSIKLDKVPIKCYAKEELRSITGIVLQETWLKDAT  429

Query: 431 IHDNIAYANPKASREEVIEAAKAANADFFIKQLPNGYDTYLEDAGDSLSQGQCQLLTIAR  490
           +H+ IAY  +ASR+EV+ AAKAA+A FFI QLP  YDTYL  +D+LSQGQ QLL IAR
Sbjct: 430 VHELIAYGSEEASRDEVVAAAKAAHAHFFIMQLPKTYDTYLSASDDALSQGQLQLLAIAR  489

Query: 491 IFLKLPRILILDEATSSIDTRTEVLVQEAFQMLMKGRTSFIIAHRLSTIQTADIILVMVS  550
           +FLK P++L+LDEATSSID RTE ++QEA + LM+GRTSFIIAHRLSTIQ+AD+ILVM
Sbjct: 490 MFLKKPKVLVLDEATSSIDIRTEAVIQEALKELMRGRTSFIIAHRLSTIQSADLILVMDQ  549

Query: 551 GEIVEVGNHSELMAQKGIYYQMQNAQ                                   576
           G +VE G H+ LM++ G Y ++Q +
Sbjct: 550 GRLVEWGTHASLMSKNGCYVRLQKIE                                   575
```

Based on this analysis, it was predicted that this protein and its epitopes, could be useful antigens for vaccines or diagnostics.

EXAMPLE 2121

A DNA sequence (GBSx2237) was identified in *S. agalactiae* <SEQ ID 6547> which encodes the amino acid sequence <SEQ ID 6548>. Analysis of this protein sequence reveals the following:

```
Possible site: 26
>>> Seems to have no N-terminal signal sequence

----- Final Results -----
          bacterial cytoplasm --- Certainty = 0.1099(Affirmative) < succ>
          bacterial membrane  --- Certainty = 0.0000(Not Clear)   < succ>
          bacterial outside   --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 2122

A DNA sequence (GBSx2238) was identified in *S. agalactiae* <SEQ ID 6549> which encodes the amino acid sequence <SEQ ID 6550>. This protein is predicted to be ABC transporter, ATP-binding protein (msbA). Analysis of this protein sequence reveals the following:

```
Possible site: 37
>>> Seems to have no N-terminal signal sequence
    INTEGRAL      Likelihood = -13.69    Transmembrane   157-173 (130-182)
    INTEGRAL      Likelihood = -10.88    Transmembrane    56-72  (49-77)
    INTEGRAL      Likelihood =  -7.75    Transmembrane   239-255 (235-258)
    INTEGRAL      Likelihood =  -6.42    Transmembrane   133-149 (130-156)
    INTEGRAL      Likelihood =  -4.78    Transmembrane   271-287 (270-289)
    INTEGRAL      Likelihood =  -1.91    Transmembrane    20-36  (20-37)

----- Final Results -----
              bacterial membrane  --- Certainty = 0.6477(Affirmative) < succ>
              bacterial outside   --- Certainty = 0.0000(Not Clear)   < succ>
            bacterial cytoplasm   --- Certainty = 0.0000(Not Clear)   < succ>
```

The protein has homology with the following sequences in the GENPEPT database.

```
>GP: AAD35375 GB: AE001710 ABC transporter, ATP-binding protein
[Thermotoga maritima]
Identities = 196/570 (34%), Positives = 327/570 (56%), Gaps = 5/570 (0%)

Query:   1 MKRLTYYFKGYIKETIFGPLFKLLEASFELLVPIVIAKMIDETIPRGDRSGLLLQIGLIF   60
           MK L  Y K Y    + PLF ++E   +L  P ++A+++DE I RGD S L+L+ G++
Sbjct:   1 MKTLARYLKPYWIFAVLAPLFMVVEVICDLSQPTLLARIVDEGIARGDFS-LVLKTGILM   59

Query:  61 FLAA-VGVVVAITAQYYSSKAAVGYTRQLTEDLYQKVMSLGKKDRDELGTASLITRLTAD  119
             + A +G V  I    ++S A+ +     L  DL++KV+S   + +    T+SLITRLT D
Sbjct:  60 LIVALIGAVGGIGCTVFASYASQNFGADLRRDLFRKVLSFSISNVNRFHTSSLITRLTND  119

Query: 120 TFQIQTGLNQFLRLFLRAPIIVFGAIIMAFSISPSLTIWFLVMVVTLFIIVFVMSRLLNP  179
             Q+Q +    LR+ +RAP++  G I+MA SI+  L+    + ++    +++   NP
Sbjct: 120 VTQLQNLVMMLLRIVVRAPLLFVGGIVMAVSINVKLSSVLIFLIPPIVLLFVWLTKKGNP  179

Query: 180 IYLKIRTSTDYLVKLTRQQLQGVRVIRAFNQVDRESEAFNDINYHYTNLQLKAGRLSSLV  239
             ++ KI+ STD + ++ R+ L GVRV+RAF + + E+E F   N       + A  L
Sbjct: 180 LFRKIQESTDEVNRVVRENLLGVRVVRAFRREEYENENFRKANESLRRSIISAFSLIVFA  239

Query: 240 TPLTFLVVNITLVVIIWRGNLNIANHLLSQGMLVALINYLLQILVELLKMTMLVTSLNQS  299
             PL    +VN+ ++ ++W G +   N+  +   G ++A  NYL+QI+ L+ +  ++    + ++
Sbjct: 240 LPLFIFIVNMGMIAVLWFGGVLVRNNQMEIGSIMAYTNYLMQIMFSLMMIGNILNFIVRA  299

Query: 300 YISAKRIIAVF-ERPS-EIIDDKLEPKYSNKALEVQEMAFSYPNSSEKALSDITFSMNVG  357
             SAKR++ V  E+P+ E  D+ L      ++  + +F Y +++ LS + FS+   G
Sbjct: 300 SASAKRVLEVLNEKPAIEEADNALALPNVEGSVSFENVEFRYFENTDPVLSGVNFSVKPG  359

Query: 358 ETLGIIGGTGSGKSTLINLLLHIYKVQEGDIDIYHQGKSPDTISNWRTLVRVVPQNAQLF  417
             + ++G TGSGKSTL+NL+ +   + G +++         + +R  + VPQ   LF
Sbjct: 360 SLVAVLGETGSGKSTLMNLIPRLIDPERGRVEVDELDVRTVKLKDLRGHISAVPQETVLF  419

Query: 418 KGTIRSNLSLGLGKVSEEKLWTALEIAQASDFVKEKDGQLDAPVESFGRNFSGGQRQRLT  477
             GTI+ NL  G     ++++  A +IAQ  DF+        D+ VE  GRNFSGGQ+QRL+
Sbjct: 420 SGTIKENLKWGREDATDDEIVEAAKIAQIHDFIISLPEGYDSRVERGGRNFSGGQKQRLS  479

Query: 478 IARALVQDKIPFLILDDATSALDYLTEARLFKAITKHFNQTNLIIVSQRINSIQNADRIL  537
             IARALV+ K   LILDD TS++D +TE R+   + ++         I++Q+I +   AD+IL
Sbjct: 480 IARALVK-KPKVLILDDCTSSVDPITEKRILDGLKRYTKGCTTFIITQKIPTALLADKIL  538

Query: 538 LLDKGKQVGFDNHQSLLAHNKVYKSIYHSQ                              567
             +L +GK  GF   H+ LL  H K Y+  IY SQ
Sbjct: 539 VLHEGKVAGFGTHKELLEHCKPYREIYESQ                              568
```

A related DNA sequence was identified in *S. pyogenes* <SEQ ID 6551> which encodes the amino acid sequence <SEQ ID 6552>. Analysis of this protein sequence reveals the following:

```
Possible site: 37
>>> Seems to have no N-terminal signal sequence
    INTEGRAL      Likelihood = -12.47    Transmembrane   157-173 (149-185)
    INTEGRAL      Likelihood =  -7.75    Transmembrane    55-71  (51-74)
    INTEGRAL      Likelihood =  -4.25    Transmembrane   239-255 (237-260)
    INTEGRAL      Likelihood =  -3.77    Transmembrane    20-36  (19-37)
    INTEGRAL      Likelihood =  -3.50    Transmembrane   271-287 (270-288)
    INTEGRAL      Likelihood =  -2.55    Transmembrane   133-149 (130-151)
```

```
----- Final Results -----
        bacterial membrane --- Certainty = 0.5989(Affirmative) < succ>
        bacterial outside  --- Certainty = 0.0000(Not Clear)   < succ>
      bacterial cytoplasm  --- Certainty = 0.0000(Not Clear)   < succ>
```

The protein has homology with the following sequences in the databases:

```
!GB: AL137187 putative ABC transporter [Streptomyces . . .  296  6e-79
>GP: CAB69751 GB: AL137187 putative ABC transporter [Streptomyces
coelicolor A3(2)]
Identities = 185/569 (32%), Positives = 306/569 (53%), Gaps = 8/569 (1%)

Query:   1 MKRLRPYVKGYLKESILGPLFKLLEALFELLVPLLIANMIDISISQHNSQGILRVVLTLF  60
           ++ LR Y++ Y K   L   + L+    L +P L A++ID + + +S  IL       +
Sbjct:   3 IRLLRTYLRPYKKPIALLVALQFLQTCASLYLPTLNAHIIDEGVVKGDSGYILSYGALMI 62

Query:  61 GLATIGLLLSVTAQYFSSKAAVGFTRQMTDDLFKKIMFLSKEDQDHLGYASLLSRLTSDS 120
           G++   ++ ++ A ++ ++ A       R +  +F ++  S  +  H G  SL++R T+D
Sbjct:  63 GISLAQVVCNIGAVFYGARTAAALGRDVRGAVFDRVQSFSAREVGHFGAPSLITRTTNDV 122

Query: 121 FQIQTGINQFLRLFLRAPIIVCGAMVMAYWISPSLTLWFVMMVIVLLTLVFVMSHLLGPL 180
           Q+Q        L + API+  G +VMA +    L+   + +V VL   V ++    L PL
Sbjct: 123 QQVQMLALMTFTLMVSAPIMCVGGIVMALGLDVPLSGVLLGVVPVLAICVTLIVRKLRPL 182

Query: 181 YLLIRRETDHLVRLTSQQLQGIRVIKAFNQTQKELQAFKQQNMLLSRHQYQAATLANVLN 240
            +  ++   D + R+   +Q+ G RVI+AF + +  E Q F++ N   L+         L   ++
Sbjct: 183 FRKMQVRLDTVNRVLREQITGNRVIRAFVRDEYEQQRFRKANTELTEVALGTGNLLALMF 242

Query: 241 PMTFLVVNLTLLILIWQGSWQVAHRSLSQGMLVALINYLLQILAELLKMTMLMGTINQSV 300
            P+    VVNL+ +  ++W  G+ ++        G L A + YL+QI+    ++ T  +     + ++
Sbjct: 243 PVVMTVVNLSSIAVVWFGAHRIDSGGMQIGDLTAFLAYLMQIVMSVMMATFMFMMVPRAE 302

Query: 301 TAAKRINQVFVLADEAPLPLLKDGPISTH-LLTIRHLTFTYPGAAEPSLYDIQLSADQGE 359
            A+RI +V          P+     +   H   L  IR    F YPGA  EP L    I L A   GE
Sbjct: 303 VCAERIQEVLETESSVVPPVAPVTELRRHGHLEIREAGFRYPGAEEPVLRHIDLVARPGE 362

Query: 360 WIGIIGGTGAGKTTLIDLICQTYSQYSGEISLNW---QGEVPKTLTEWRNVIALVPQKAQ 416
            +IG TG+GK+TL+ L+ + +    GE+ +N       PKTL +   V++LVPQK
Sbjct: 363 TTAVIGSTGSGKSTLLGLVPRLFDATDGEVLVNGVDVRTVDPKTLAK---VVSLVPQKPY 419

Query: 417 LFKGTIRSNLLLGQSMPISDEELWRALELAQAKEFVAALPEQLEAPVEAFGRHFSGGQRQ 476
           LF GT+ +NL  G +   +DEELW AL +AQAKEFV+ L    L+AP+   G + SGGQRQ
Sbjct: 420 LFAGTVATNLRYG-NPDATDEELWHALAVAQAKEFVSELEGGLDAPIAQGGTNVSGGQRQ 478

Query: 477 RLAIARALLKPKPILILDDASSALDNETRGRLFKALKEELSDVLVILVTQSIKNLQFADK 536
           RLAIAR L++   I + DD+ SALD  T    L   L +E ++ V++V Q +   ++ AD+
Sbjct: 479 RLAIARTLVQRPEIYLFDDSFSALDYATDAALRAELAQETAEATVVIVAQRVATIRDADR 538

Query: 537 ILVLEQGHQLDFASHDQLKVSNALYQEML 565
           I+VL++G    +    H +L    N  Y+E++
Sbjct: 539 IVVLDEGRVVGVGRHHELMADNETYREIV 567
```

An alignment of the GAS and GBS proteins is shown below.

```
Identities = 313/568 (55%), Positives = 428/568 (75%), Gaps = 9/568 (1%)

Query:   1 MKRLTYYFKGYIKETIFGPLFKLLEASFELLVPIVIAKMIDETIPRGDRSGLLLQIGLIF  60
           MKRL Y KGY+KE+I GPLFKLLEA FELLVP+++IA MID +I + +  G+L   + +F
Sbjct:   1 MKRLRPYVKGYLKESILGPLFKLLEALFELLVPLLIANMIDISISQHNSQGILRVVLTLF 60

Query:  61 FLAAVGVVVAITAQYYSSKAAVGYTRQLTEDLYQKVMSLGKKDRELGTASLITRLTADT 120
             LA +G+++++++TAQY+SSKAAVG+TRQ+T+DL++K+M L K+D+D LG ASL++RLT+D+
Sbjct:  61 GLATIGLLLSVTAQYFSSKAAVGFTRQMTDDLFKKIMFLSKEDQDHLGYASLLSRLTSDS 120

Query: 121 FQIQTGLNQFLRLFLRAPIIVFGAIIMAFSISPSLTIWFLVMVVTLFIIVFVMSRLLNPI 180
           FQIQTG+NQFLRLFLRAPIIV GA++MA+ ISPSLT+WF++MV L +VFVMS LL P+
Sbjct: 121 FQIQTGINQFLRLFLRAPIIVCGAMVMAYWISPSLTLWFVMMVIVLLTLVFVMSHLLGPL 180

Query: 181 YLKIRTSTDYLVKLTRQQLQGVRVIRAFNQVDRESEAFNDINYHYTNLQKAGRLSSLVT 240
           YL  IR  TD+LV+LT QQLQG+RVI+AFNQ  +E +AF N +    +  Q +A L++++
Sbjct: 181 YLLIRRETDHLVRLTSQQLQGIRVIKAFNQTQKELQAFKQQNMLLSRHQYQAATLANVLN 240

Query: 241 PLTFLVVNITLVVIIWRGNLNIANHLLSQGMLVALINYLLQILVELLKMTMLVTSLNQSY 300
           P+TFLVVN+TL++ IW+G+   +A+   LSQGMLVALINYLLQIL ELLKMTML+ ++NQS
```

```
                              -continued
Sbjct: 241 PMTFLVVNLTLLILIWQGSWQVAHRSLSQGMLVALINYLLQILAELLKMTMLMGTINQSV  300

Query: 301 ISAKRIIAVF----ERPSEIIDDKLEPKYSNKALEVQEMAFSYPNSSEKALSDITFSMNV  356
           +AKRI  VF    E P  ++ D      S    L ++ + F+YP ++E +L DI   S +
Sbjct: 301 TAAKRINQVFVLADEAPLPLLKD---GPISTHLLTIRHLTFTYPGAAEPSLYDIQLSADQ  357

Query: 357 GETLGIIGGTGSGKSTLINLLLHIYKVQEGDIDIYHQGKSPDTISNWRTLVRVVPQNAQL  416
           GE +GIIGGTG+GK+TLI+L+    Y    G+I +   QG+ P T++ WR ++ +VPQ AQL
Sbjct: 358 GEWIGIIGGTGAGKTTLIDLICQTYSQYSGEISLNWQGEVPKTLTEWRNVIALVPQKAQL  417

Query: 417 FKGTIRSNLSLGLG-KVSEEKLWTALEIAQASDFVKEKDGQLDAPVESFGRNFSGGQRQR  475
           FKGTIRSNL LG   +S+E+LW ALE+AQA +FV     QL+APVE+FGR+FSGGQRQR
Sbjct: 418 FKGTIRSNLLLGQSMPISDEELWRALELAQAKEFVAALPEQLEAPVEAFGRHFSGGQRQR  477

Query: 476 LTIARALVQDKIPFLILDDATSALDYLTEARLFKAITKHFNQTNLIIVSQRINSIQNADR  535
           L IARAL++ K P LILDDA+SALD  T  RLFKA+ +   +I+V+Q I ++Q AD+
Sbjct: 478 LAIARALLKPK-PILILDDASSALDNETRGRLFKALKEELSDVLVILVTQSIKNLQFADK  536

Query: 536 ILLLDKGKQVGFDNHQSLLAHNKVYKSI                                  563
           IL+L++G Q+ F +H  L    N +Y+ +
Sbjct: 537 ILVLEQGHQLDFASHDQLKVSNALYQEM                                  564
```

Based on this analysis, it was predicted that this protein and its epitopes, could be useful antigens for vaccines or diagnostics.

EXAMPLE 2123

A DNA sequence (GBSx2239) was identified in *S. agalactiae* <SEQ ID 6553> which encodes the amino acid sequence <SEQ ID 6554>. Analysis of this protein sequence reveals the following:

```
Possible site: 43
>>> Seems to have an uncleavable N-term signal seq
     INTEGRAL     Likelihood = -12.26     Transmembrane     8-24 (1-28)

----- Final Results -----
              bacterial membrane --- Certainty = 0.5904(Affirmative) < succ>
              bacterial outside  --- Certainty = 0.0000(Not Clear)   < succ>
              bacterial cytoplasm --- Certainty = 0.0000(Not Clear)   < succ>
```

The protein has homology with the following sequences in the GENPEPT database.

```
>GP: AAB84433 GB: AF027868 RAS-related protein [Bacillus subtilis]
Identities = 53/140 (37%), Positives = 78/140 (54%), Gaps = 2/140 (1%)

Query:  28 VKKVLQYHDLVQNTLAENGSEANVHLVLSMIYTETKGDAIDVMQSSESISGTTNSITDSH   87
           ++++   Y  LV+   L   G        L+L M+Y E+KG   D MQSSES+    N ITD
Sbjct:  49 LERLTDYKPLVEEELESQGLSNYTSLILGMMYQESKGKGNDPMQSSESLGLKRNEITDPQ  108

Query:  88 TSIKHGVTLLSQNISQAKKAKVDVWTAVQAYNFGSSYIDVADHGGENSIELAKNYSKNV  147
           +S+K G+      +      K+  VD+ T +Q+YN G+ YID+VA+HGG ++ ELAK YS+
Sbjct: 109 LSVKQGIKQFTLMYKTGKEKGVDLDTIIQSYNMGAGYIDFVAEHGGTHTEELAKQYSEQQ  168

Query: 148 VA--PSLGNYNGDTYFYYHP                                          165
           V    P L   G+   + +P
Sbjct: 169 VKKNPDLYTCGGNAKNFRYP                                          188
```

A related DNA sequence was identified in *S. pyogenes* <SEQ ID 4143> which encodes the amino acid sequence <SEQ ID 4144>. Analysis of this protein sequence reveals the following:

```
Possible site: 42
>>> Seems to have an uncleavable N-term signal seq
     INTEGRAL     Likelihood = -2.66     Transmembrane     8-24 (7-25)

----- Final Results -----
              bacterial membrane --- Certainty = 0.2062(Affirmative) < succ>
              bacterial outside  --- Certainty = 0.0000(Not Clear)   < succ>
              bacterial cytoplasm --- Certainty = 0.0000(Not Clear)   < succ>
```

An alignment of the GAS and GBS proteins is shown below.

```
Identities = 134/200 (67%), Positives = 165/200 (82%), Gaps = 1/200 (0%)

Query:    1 MFKFLKRLIALIIIIFIGYRLVIIHENVKKVLQYHDLVQNTLAENGSEANVHLVLSMIYT   60
            MF+ LKR  + +++ F+ Y+  +IH NV++VL Y  +V+ TLAEN ++ANV LVL+MIYT
Sbjct:    1 MFRLLKRACSFLLL-FVIYQSFVIHHNVQRVLAYKPMVEKTLAENDTKANVDLVLAMIYT   59

Query:   61 ETKGDAIDVMQSSESISGTTNSITDSHTSIKHGVTLLSQNISQAKKAKVDVWTAVQAYNF  120
            ETKG   DVMQSSES SG  NSITDS  SI+HGV LLS N++ A++A VD WTAVQAYNF
Sbjct:   60 ETKGGEADVMQSSESSSGQKNSITDSQASIEHGVNLLSHNLALAEEAGVDSWTAVQAYNF  119

Query:  121 GSSYIDYVADHGGENSIELAKNYSKNVVAPSLGNYNGDTYFYYHPLALISGGKLYKNGGN  180
            G++YIDY+A+HGG+N+++LA  YSK VVAPSLGN +G TYFYYHPLALISGGKLYKNGGN
Sbjct:  120 GTAYIDYIAEHGGQNTVDLATTYSKTVVAPSLGNTSGQTYFYYHPLALISGGKLYKNGGN  179

Query:  181 IYYSREVQFNLYLIKIMELF                                         200
            IYYSREV FNLYLI++M LF
Sbjct:  180 IYYSREVHFNLYLIELMSLF                                         199
```

SEQ ID 6554 (GBS244) was expressed in *E. coli* as a His-fusion product. SDS-PAGE analysis of total cell extract is shown in FIG. 59 (lane 4; MW 23.1 kDa). It was also expressed in *E. coli* as a GST-fusion product. SDS-PAGE analysis of total cell extract is shown in FIG. 67 (lane 2; MW 48 kDa).

Figure 211:
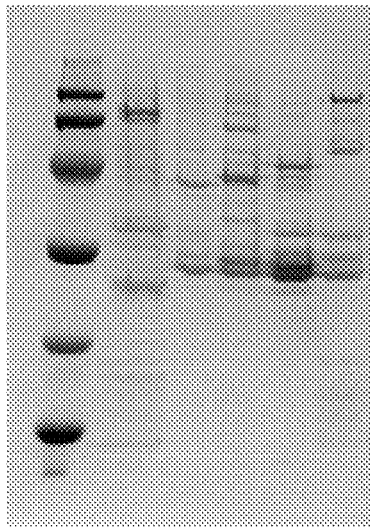

GBS244-GST was purified as shown in FIG. 211, lane 5.

Based on this analysis, it was predicted that this protein and its epitopes, could be useful antigens for vaccines or diagnostics.

EXAMPLE 2124

A DNA sequence (GBSx2240) was identified in *S. agalactiae* <SEQ ID 6555> which encodes the amino acid sequence <SEQ ID 6556>. Analysis of this protein sequence reveals the following:

```
Possible site: 38
>>> Seems to have no N-terminal signal sequence

----- Final Results -----
            bacterial cytoplasm --- Certainty = 0.2401(Affirmative) < succ>
            bacterial membrane  --- Certainty = 0.0000(Not Clear)   < succ>
            bacterial outside   --- Certainty = 0.0000(Not Clear)   < succ>
```

A related GBS nucleic acid sequence <SEQ ID 9837> which encodes amino acid sequence <SEQ ID 9838> was also identified.

The protein has homology with the following sequences in the GENPEPT database.

```
>GP: CAB71302 GB: AJ130879 hypothetical protein [Clostridium
sticklandii]
Identities = 32/95 (33%), Positives = 53/95 (55%), Gaps = 1/95 (1%)

Query:  235 LSPEKLADQLFDDNLTARLTFVDELKDAIPGPVQVSDIDHSRQIKKLENQKLSLSNGIEL  294
            LS EK  + F++    + ++ L A     Q+ ++  +  +K E QK+    +GIE+
Sbjct:    2 LSVEKALETAFEETDEIKAIYKEALSKAGIENEQI-EVSETALKRKFEIQKIITESGIEV   60

Query:  295 IVPNNVYQDAESVEFIQNPDGTYSILIKNIQDIQN                          329
            +P N Y D   +EF+ N DGT S++IKNI +IQ+
Sbjct:   61 KIPVNYYGDPSKLEFVANGDGTVSLVIKNIGNIQS                           95
```

A related DNA sequence was identified in *S. pyogenes* <SEQ ID 6557> which encodes the amino acid sequence <SEQ ID 6558>. Analysis of this protein sequence reveals the following:

```
Possible site: 52
>>> Seems to have no N-terminal signal sequence

----- Final Results -----
            bacterial cytoplasm --- Certainty = 0.3336(Affirmative) < succ>
            bacterial membrane  --- Certainty = 0.0000(Not Clear)   < succ>
            bacterial outside   --- Certainty = 0.0000(Not Clear)   < succ>
```

An alignment of the GAS and GBS proteins is shown below.

```
Identities = 246/325 (75%), Positives = 286/325 (87%)

Query:    6 MMDFYIKQIIIHQFSPNDTELVLSDTPLTLTPRIDDYFRKKLSKVFSDEAKRGYFGEDNV   65
            M+D YIK+I+IHQFSPNDTEL+LSD  +++TPRID+YFRKKL+KVFSDEAKRG F   +N
Sbjct:    1 MLDSYIKRIVIHQFSPNDTELLLSDRLVSITPRIDEYFRKKLAKVFSDEAKRGQFEANNT   60

Query:   66 FMSHLQDDLYVSSCQIAQLWKEEFVISEDQKTNDLVFIQFDKDGMEHFAFLRISLKEQFA  125
            F + + DDL  +S   IAQLWKE FVISEDQKTNDLVF+QFDKDG    FAFLRI+LKEQFA
Sbjct:   61 FFTTIGDDLLETSVTIAQLWKEAFVISEDQKTNDLVFVQFDKDGEPFFAFLRIALKEQFA  120

Query:  126 HVSENQEQPITITQNNLPSAAQTPDEALVVNKSSKQYYLIEKRIKHNGSFANYFSENLLQ  185
            H+S+N E P T+TQNNLPS  QTPDEALV+N  S QYYLIEKR+KHNGSFANYFSE+LL+
Sbjct:  121 HLSDNYEHPFTVTQNNLPSPTQTPDEALVINLKSGQYYLIEKRVKHNGSFANYFSEHLLK  180

Query:  186 VQPEQSVKKSIKMVEQTAQKIAENFNKDDFSFQSKMKSAIYKNLEEEQELSPEKLADQLF  245
            V PEQSVKKSIKM+EQTAQKIAE+FN+DDF+FQSKMKS ++K LE +  LSPEKLADQLF
Sbjct:  181 VTPEQSVKKSIKMIEQTAQKIAEHFNQDDFTFQSKMKSTLFKQLEADDVLSPEKLADQLF  240

Query:  246 DDNLTARLTFVDELKDAIPGPVQVSDIDHSRQIKKLENQKLSLSNGIELIVPNNVYQDAE  305
            DDNLTARLTFVD++KD IP P+++SDI+HSRQIKKLENQKLSLSNGIEL VPN +YQDAE
Sbjct:  241 DDNLTARLTFVDQVKDVIPEPIKISDIEHSRQIKKLENQKLSLSNGIELTVPNAIYQDAE  300

Query:  306 SVEFIQNPDGTYSILIKNIQDIQNK                                    330
            +VEF+ N DGTYSILIKNI+DI+ K
Sbjct:  301 AVEFLLNDDGTYSILIKNIEDIKTK                                    325
```

Based on this analysis, it was predicted that this protein and its epitopes, could be useful antigens for vaccines or diagnostics.

EXAMPLE 2125

A DNA sequence (GBSx2241) was identified in *S. agalactiae* <SEQ ID 6559> which encodes the amino acid sequence <SEQ ID 6560>. This protein is predicted to be Serine hydroxymethyltransferase (glyA-1). Analysis of this protein sequence reveals the following:

```
Possible site: 45
>>> Seems to have no N-terminal signal sequence

----- Final Results -----
          bacterial cytoplasm --- Certainty = 0.3876(Affirmative) < succ>
          bacterial membrane  --- Certainty = 0.0000(Not Clear)   < succ>
           bacterial outside  --- Certainty = 0.0000(Not Clear)   < succ>
```

The protein has homology with the following sequences in the GENPEPT database.

```
>GP: AAD35802 GB: AE001743 serine hydroxymethyltransferase
[Thermotoga maritima]
Identities = 243/416 (58%), Positives = 307/416 (73%), Gaps = 7/416 (1%)

Query:    9 KEFDQELWQAIHDEEIRQQNNIELIASENVVSKAVMAAQGSVLTNKYAEGYPSHRYYGGT   68
            K+ D E+++ + +E  RQ+  +ELIASEN  S AV+   GS+LTNKYAEGYP  RYYGG
Sbjct:    6 KQVDPEIYEVLVNELKRQEYGLELIASENFASLAVIETMGSMLTNKYAEGYPKKRYYGGC   65

Query:   69 DCVDVVESLAIERAKTLFNAEFANVQPHSGSQANAAAYMALIEPGDTVLGMDLAAGGHLT  128
            + VD  E   AIERAK LF A+FANVQPHSGSQAN A Y+AL +PGDT++GM L+ GGHLT
Sbjct:   66 EWVDRAEERAIERAKRLFGAKFANVQPHSGSQANMAVYLALAQPGDTIMGMSLSHGGHLT  125

Query:  129 HGASVSFSGKTYHFVSYSVDPKTEMLDYDNILKIAQETQPKLIVAGASAYSRIIDFEKFR  188
            HGA V+FSGK +  V Y V+ +TE +DYD + ++A E +PK+IVAG SAY+RIIDF++FR
Sbjct:  126 HGAPVNFSGKIFKVVPYGVNLETETIDYDEVRRLALEHKPKIIVAGGSAYARIIDFKRFR  185

Query:  189 QIADAVDAYLMVDMAHIAGLVASGHHPSPIPYAHVTTTTTHKTLRGPRGGLILTNDEAIA  248
            +IAD V  AYLMVDMAH AGLVA+G HP+P+  YAHV T+TTHKTLRGPRGGLILTND  IA
Sbjct:  186 EIADEVGAYLMVDMAHFAGLVAAGIHPNPLEYAHVVTSTTHKTLRGPRGGLILTNDPEIA  245

Query:  249 KKINSAVFPGLQGGPLEHVIAAKAVALKEALDPSFKIYGEDIIKNAQAMAKVFKEDDDFH  308
            K ++  +FPG+QGGPL HVIAAKAV  KEA+    FK Y + ++KNA+ MA+ F++    +
```

```
                              -continued
Sbjct: 246 KAVDKTIFPGIQGGPLMHVIAAKAVCFKEAMTEEFKEYQKQVVKNAKKMAEEFQK-RGYR 304

Query: 309 LISDGTDNHLFLVDVTKVIENGKKAQNVLEEVNITLNKNSIPFERLSPFKTSGIRIGTPA 368
           ++S GTD HLFLVD+T    GK A+  LE   IT+NKN+IP E+ SPF  SGIRIGTPA
Sbjct: 305 IVSGGTDTHLFLVDLTPKDITGKAAEKALESCGITVNKNTIPNEKRSPFVASGIRIGTPA 364

Query: 369 ITSRGMGVEESRRIAELMIKALKN--HENQDVLTEVRQE----IKSLTDAFPLYEN      418
           +T+RGM EE  IAE++  L N   EN V  EVR+E     ++ L + FPLY +
Sbjct: 365 VTTRGMKEEEMEEIAEMIDLVLSNVIDENGTVKPEVREEVSKKVRELCERFPLYRD      420
```

A related DNA sequence was identified in *S. pyogenes* <SEQ ID 6561> which encodes the amino acid sequence <SEQ ID 6562>. Analysis of this protein sequence reveals the following:

```
Possible site: 47
>>> Seems to have no N-terminal signal sequence
      INTEGRAL    Likelihood = -0.00    Transmembrane   196-212 (196-212)

----- Final Results -----
              bacterial membrane --- Certainty = 0.1001(Affirmative) < succ>
               bacterial outside --- Certainty = 0.0000(Not Clear)  < succ>
             bacterial cytoplasm --- Certainty = 0.0000(Not Clear)  < succ>
```

The protein has homology with the following sequences in the databases:

```
>GP: CAB15707 GB: Z99122 serine hydroxymethyltransferase
[Bacillus subtilis]
Identities = 250/407 (61%), Positives = 311/407 (75%), Gaps = 2/407 (0%)

Query:  14 DKELWDAIHAEEERQEHHIELIASENMVSKAVMAAQGSVLTNKYAEGYPGNRYYGGTECV   73
           D+++++AI  E ERQ+  IELIASEN VS+AVM AQGSVLTNKYAEGYPG RYYGG E V
Sbjct:   8 DEQVFNAIKNERERQQTKIELIASENFVSEAVMEAQGSVLTNKYAEGYPGKRYYGGCEHV   67

Query:  74 DIVETLAIERAKKLFGAAFANVQAHSGSQANAAAYMALIEAGDTVLGMDLAAGGHLTHGS  133
           D+VE +A +RAK++FGA   NVQ HSG+QAN A Y  ++E GDTVLGM+L+ GGHLTHGS
Sbjct:  68 DVVEDIARDRAKEIFGAEHVNVQPHSGAQANMAVYFTILEQGDTVLGMNLSHGGHLTHGS  127

Query: 134 PVNFSGKTYHFVGYSVDTDTEMLNYEAILEQAKAVQPKLIVAGASAYSRSIDFEKFRAIA  193
           PVNFSG  Y+FV Y VD +T+ ++Y+ + E+A A +PKLIVAGASAY R+IDF+KFR IA
Sbjct: 128 PVNFSGVQYNFVEYGVDKETQYIDYDDVREKALAHKPKLIVAGASAYPRTIDFKKFREIA  187

Query: 194 DHVGAYLMVDMAHIAGLVAAGVHPSPVPYAHIVTSTTHKTLRGPRGGLILTNDEALAKKI  253
           D VGAY MVDMAHIAGLVAAG+HP+PVPYA   VT+TTHKTLRGPRGG+IL  +E   KKI
Sbjct: 188 DEVGAYFMVDMAHIAGLVAAGLHPNPVPYADFVTTTTHKTLRGPRGGMILCREE-FGKKI  246

Query: 254 NSAVFPGLQGGPLEHVIAAKAVAFKEALDPAFKDYAQAIIDNTAAMAAVFAQDDRFRLIS  313
           + ++FPG+QGGPL HVIAAKAV+F E L   FK YAQ +I N   +A    ++  +L+S
Sbjct: 247 DKSIFPGIQGGPLMHVIAAKAVSFGEVLQDDFKTYAQNVISNAKRLAEALTKEG-IQLVS  305

Query: 314 GGTDNHVFLVDVTKVIANGKLAQNLLDEVNITLNKNAIPFETLSPFKTSGIRIGCAAITS  373
           GGTDNH+ LVD+ +  GK+A+++LDE+ IT NKNAIP++  PF TSGIR+G AA+TS
Sbjct: 306 GGTDNHLILVDLRSLGLTGKVAEHVLDEIGITSNKNAIPYDPEKPFVTSGIRLGTAAVTS  365

Query: 374 RGMGVKESQTIARLIIKALVNHDQETILEEVRQEVRQLTDAFPLYKK              420
           RG     + + +I AL NH+ E  LEE RQ V LTD FPLYK+
Sbjct: 366 RGFDGDALEEVGAIIALALKNHEDEGKLEEARQRVAALTDKFPLYKE              412
```

An alignment of the GAS and GBS proteins is shown below.

```
Identities = 330/417 (79%), Positives = 368/417 (88%)

Query:   1 MIFDKDNFKEFDQELWQAIHDEEIRQQNNIELIASENVVSKAVMAAQGSVLTNKYAEGYP   60
           MIFDK N ++FD+ELW AIH EE RQ+++IELIASEN+VSKAVMAAQGSVLTNKYAEGYP
Sbjct:   3 MIFDKGNVEDFDKELWDAIHAEEERQEHHIELIASENMVSKAVMAAQGSVLTNKYAEGYP   62

Query:  61 SHRYYGGTDCVDVVESLAIERAKTLFNAEFANVQPHSGSQANAAAYMALIEPGDTVLGMD  120
            +RYYGGT+CVD+VE+LAIERAK LF A FANVQ HSGSQANAAAYMALIE GDTVLGMD
Sbjct:  63 GNRYYGGTECVDIVETLAIERAKKLFGAAFANVQAHSGSQANAAAYMALIEAGDTVLGMD  122

Query: 121 LAAGGHLTHGASVSFSGKTYHFVSYSVDPKTEMLDYDNILKIAQETQPKLIVAGASAYSR  180
```

```
                LAAGGHLTHG+ V+FSGKTYHFV YSVD   TEML+Y+ IL+ A+  QPKLIVAGASAYSR
Sbjct:  123 LAAGGHLTHGSPVNFSGKTYHFVGYSVDTDTEMLNYEAILEQAKAVQPKLIVAGASAYSR     182

Query:  181 IIDFEKFRQIADAVDAYLMVDMAHIAGLVASGHHPSPIPYAHVTTTTTHKTLRGPRGGLI     240
                IDFEKFR IAD V AYLMVDMAHIAGLVA+G HPSP+PYAH+ T+TTHKTLRGPRGGLI
Sbjct:  183 SIDFEKFRAIADHVGAYLMVDMAHIAGLVAAGVHPSPVPYAHIVTSTTHKTLRGPRGGLI     242

Query:  241 LTNDEAIAKKINSAVFPGLQGGPLEHVIAAKAVALKEALDPSFKIYGEDIIKNAQAMAKV     300
                LTNDEA+AKKINSAVFPGLQGGPLEHVIAAKAVA KEALDP+FK Y + II N   AMA V
Sbjct:  243 LTNDEALAKKINSAVFPGLQGGPLEHVIAAKAVAFKEALDPAFKDYAQAIIDNTAAMAAV     302

Query:  301 FKEDDDFHLISDGTDNHLFLVDVTKVIENGKKAQNVLEEVNITLNKNSIPFERLSPFKTS     360
                F +DD F LIS GTDNH+FLVDVTKVI NGK AQN+L+EVNITLNKN+IPFE LSPFKTS
Sbjct:  303 FAQDDRFRLISGGTDNHVFLVDVTKVIANGKLAQNLLDEVNITLNKNAIPFETLSPFKTS     362

Query:  361 GIRIGTPAITSRGMGVEESRRIAELMIKALKNHENQDVLTEVRQEIKSLTDAFPLYE        417
                GIRIG   AITSRGMGV+ES+  IA L+IKAL NH+ + +L EVRQE++ LTDAFPLY+
Sbjct:  363 GIRIGCAAITSRGMGVKESQTIARLIIKALVNHDQETILEEVRQEVRQLTDAFPLYK        419
```

Based on this analysis, it was predicted that these proteins and their epitopes could be useful antigens for vaccines or diagnostics.

EXAMPLE 2126

A DNA sequence (GBSx2242) was identified in *S. agalactiae* <SEQ ID 6563> which encodes the amino acid sequence <SEQ ID 6564>. Analysis of this protein sequence reveals the following:

```
Possible site: 30
>>> Seems to have no N-terminal signal sequence

----- Final Results -----
              bacterial cytoplasm --- Certainty = 0.2289(Affirmative) < succ>
              bacterial membrane --- Certainty = 0.0000(Not Clear) < succ>
               bacterial outside --- Certainty = 0.0000(Not Clear) < succ>
```

A related GBS nucleic acid sequence <SEQ ID 9839> which encodes amino acid sequence <SEQ ID 9840> was also identified.

The protein has homology with the following sequences in the GENPEPT database.

```
>GP: AAD35934 GB: AE001752 conserved hypothetical protein
[Thermotoga maritima]
Identities = 71/198 (35%), Positives = 114/198 (56%), Gaps = 4/198 (2%)

Query:    1 MNDLGQILEDHGAVIMPTETVYGIFAKALSEEAVNHVYELKKRPRDKAMNLNICDFETIL      60
              + +  ++L +    +I PTETVYGI A A +EEA    +++LK+RP D  + ++I F+ +
Sbjct:   17 LKEAAELLRNGEVIIFPTETVYGIGADAYNEEACKKIFKLKERPADNPLIVHIHSFKQLE     76

Query:   61 KYSKNQPTYLKQLYDAFLPGPLTIIL-EASQEVPHWINSGLLSVGFRMPKHPVTLDMIAN    119
              + ++    +L  L     F PGPLT+I  + S+++P   + + L +V  RMP HPV L +I
Sbjct:   77 EIAEGYEPHLDFL-KKFWPGPLTVIFRKKSEKIPPVVTADLPTVAVRMPAHPVALKLIEL    135

Query:  120 HG-PLIGPSANISGCDSGRVFSEIQKQFNHQV-LGIEDDKALTGVDSTIIDLSGDRVKIL    177
                G P+  PSANISG  S      + + F +V L I+       G++STI+DL+ ++  +L
Sbjct:  136 FGHPIAAPSANISGRPSATNVKHVIEDFMGKVKLIIDAGDTPFGLESTIVDLTKEKPVLL    195

Query:  178 RQGAITQEVLTATIPELI                                              195
              R G +  E L      PEL+
Sbjct:  196 RPGPVEVERLKELFPELV                                              213
```

A related DNA sequence was identified in *S. pyogenes* <SEQ ID 6565> which encodes the amino acid sequence <SEQ ID 6566>. Analysis of this protein sequence reveals the following:

```
Possible site: 46
>>> Seems to have no N-terminal signal sequence
```

```
----- Final Results -----
         bacterial cytoplasm --- Certainty = 0.0282(Affirmative) < succ>
          bacterial membrane --- Certainty = 0.0000(Not Clear)  < succ>
           bacterial outside --- Certainty = 0.0000(Not Clear)  < succ>
```

An alignment of the GAS and GBS proteins is shown below.

```
Identities = 127/196 (64%), Positives = 154/196 (77%)

Query:   1 MNDLGQILEDHGAVIMPTETVYGIFAKALSEEAVNHVYELKKRPRDKAMNLNICDFETIL  60
           M  L  I+E    A+++PTETVYG+FAKAL E+AVN VY+LK+RPRDKAMNLN+ DF +IL
Sbjct:  11 MEYLASIIESGDALVLPTETVYGLFAKALDEKAVNAVYDLKQRPRDKAMNLNVADFNSIL  70

Query:  61 KYSKNQPTYLKQLYDAFLPGPLTIILEASQEVPHWINSGLLSVGFRMPKHPVTLDMIANH 120
           +SK QP YLK+LY AFLPGPLTIIL+A+ +VP+WINSGL +VGFR+P HP+T  +I
Sbjct:  71 AFSKEQPRYLKKLYQAFLPGPLTIILKANDQVPYWINSGLSTVGFRLPSHPITAALIQKT 130

Query: 121 GPLIGPSANISGCDSGRVFSEIQKQFNHQVLGIEDDKALTGVDSTIIDLSGDRVKILRQG 180
           GPLIGPSAN+SG  SGRVF I + F+ QV G  DD  LTG DSTI+DLSG+R  ILRQG
Sbjct: 131 GPLIGPSANLSGKASGRVFDHIMQDFDFQVFGYADDPFLTGKDSTILDLSGERAVILRQG 190

Query: 181 AITQEVLTATIPELIF                                             196
           AIT+E L A +PEL F
Sbjct: 191 AITKEELLANVPELRF                                             206
```

Based on this analysis, it was predicted that these proteins and their epitopes could be useful antigens for vaccines or diagnostics.

EXAMPLE 2127

A DNA sequence (GBSx2243) was identified in *S. agalactiae* <SEQ ID 6567> which encodes the amino acid sequence <SEQ ID 6568>. This protein is predicted to be protoporphyrinogen oxidase (hemK). Analysis of this protein sequence reveals the following:

```
Possible site: 50
>>> Seems to have no N-terminal signal sequence

----- Final Results -----
         bacterial cytoplasm --- Certainty = 0.3000(Affirmative) < succ>
          bacterial membrane --- Certainty = 0.0000(Not Clear)  < succ>
           bacterial outside --- Certainty = 0.0000(Not Clear)  < succ>
```

The protein has homology with the following sequences in the GENPEPT database.

```
>GP: BAB07493 GB: AP001519 protoporphyrinogen oxidase
[Bacillus halodurans]
Identities = 94/236 (39%), Positives = 132/236 (55%), Gaps = 12/236 (5%)

Query:  49 DTDQQLMENIFQQLKKHRSP---QYITGKAYFRDLIFFVDERVLIPRPETEELVDLILSE 105
           + D +L + + + L  H S   Q++ G  F     F VD+ VLIPRPETEELV  +L E
Sbjct:  46 ELDGELFQRLEEDLAAHASGVPVQHLIGVESFYGRQFQVDQHVLIPRPETEELVLAVLKE 105

Query: 106 -----NKVEDCSVLDIGTGSGAIAISLKKERPSWDVLASDISVSALDLAKENANNCDAEV 160
                K E+ ++LDIGTGSGAIA++L  E    +V A DIS  AL +A +NA    A V
Sbjct: 106 IRRQFKKEEEITILDIGTGSGAIAVTLALEEERTNVTAVDISRDALQVAADNARRLGANV 165

Query: 161 TFIESDV---FSNISGKFDIIVSNPPYISYNDKDEVGKNVLASEPHSALFADEEGLAIYR 217
             I  D+    F     +FD+IVSNPPYI   +KD + +V   EP  ALF   +GL +YR
Sbjct: 166 QLIHGDLGEPFLKTGERFDVIVSNPPYIPTVEKDTLAVHVRDHEPALALFGGVDGLDVYR 225

Query: 218 KIIENSREYL-QPRGKLYFEIGYKQGDDLRSLLKRYFPNNRCRVLKDIFGKDRMVV     272
            +++          + +G +    EIG  QG D+  L++    +P     VL D+ GKDR+V+
Sbjct: 226 RLMSQLPALTKEEKGMVALEIGAGQGMDVEKLMQTAYPKAAVDVLYDLNGKDRIVL     281
```

A related DNA sequence was identified in *S. pyogenes* <SEQ ID 6569> which encodes the amino acid sequence <SEQ ID 6570>. Analysis of this protein sequence reveals the following:

```
Possible site: 48
>>> Seems to have no N-terminal signal sequence

----- Final Results -----
            bacterial cytoplasm --- Certainty = 0.4324(Affirmative) < succ>
            bacterial membrane  --- Certainty = 0.0000(Not Clear)   < succ>
            bacterial outside   --- Certainty = 0.0000(Not Clear)   < succ>
```

An alignment of the GAS and GBS proteins is shown below.

```
Identities = 174/274 (63%), Positives = 207/274 (75%)

Query:    1 MNYAQLIKHYGQLLEACGEEVENFIYVLKDLKQWSTTDYLLNQNSSVSDTDQQLMENIFQ   60
            MNYA LI+ Y   LE   E+ EN  YV +++K+WS+ D L++QN +V+  D  L+E+IF
Sbjct:    1 MNYATLIRTYEDKLEQIDEDRENLAYVFREIKEWSSLDMLIHQNQAVTPEDAVLLEHIFC   60

Query:   61 QLKKHRSPQYITGKAYFRDLIFFVDERVLIPRPETEELVDLILSENKVEDCSVLDIGTGS  120
              L +H SPQYITG AYFRDL   VD+RVLIPRPETEELVD+IL+EN    +VLDIGTGS
Sbjct:   61 SLSQHLSPQYITGNAYFRDLKLAVDKRVLIPRPETEELVDMILAENLDAPLNVLDIGTGS  120

Query:  121 GAIAISLKKERPSWDVLASDISVSALDLAKENANNCDAEVTFIESDVFSNISGKFDIIVS  180
            GAIAISLKKERP+W V ASDIS +ALDLAK NA+    ++TFIESDVFS IS   FDIIVS
Sbjct:  121 GAIAISLKKERPNWQVTASDISRAALDLAKANADAYQLDITFIESDVFSLISETFDIIVS  180

Query:  181 NPPYISYNDKDEVGKNVLASEPHSALFADEEGLAIYRKIIENSREYLQPRGKLYFEIGYK  240
            NPPYISY DK+EV  NVL SEPH ALFA E G AIYRKIIE +  YL   GKLYFEIGYK
Sbjct:  181 NPPYISYEDKEEVSLNVLQSEPHLALFAKENGYAIYRKIIEQADNYLTKEGKLYFEIGYK  240

Query:  241 QGDDLRSLLKRYFPNNRCRVLKDIFGKDRMVVLD                           274
            Q + ++ +L+ YFP   R + DIFGK+RMVV+D
Sbjct:  241 QAEGIKDMLQAYFPQRHIRAVTDIFGKERMVVVD                           274
```

Based on this analysis, it was predicted that these proteins and their epitopes could be useful antigens for vaccines or diagnostics.

EXAMPLE 2128

A DNA sequence (GBSx2244) was identified in *S. agalactiae* <SEQ ID 6571> which encodes the amino acid sequence <SEQ ID 6572>. This protein is predicted to be peptide chain release factor RF-1 (prfA). Analysis of this protein sequence reveals the following:

```
Possible site: 28
>>> Seems to have no N-terminal signal sequence

----- Final Results -----
            bacterial cytoplasm --- Certainty = 0.3446(Affirmative) < succ>
            bacterial membrane  --- Certainty = 0.0000(Not Clear)   < succ>
            bacterial outside   --- Certainty = 0.0000(Not Clear)   < succ>
```

The protein has homology with the following sequences in the GENPEPT database.

```
>GP: CAB15718 GB: Z99122 peptide chain release factor 1
[Bacillus subtilis]
Identities = 211/351 (60%), Positives = 280/351 (79%), Gaps = 1/351 (0%)

Query:    5 DQLQAVEDRYEELGELLSDPDVVSDTKRFMELSREEASTRETVTAYREYKQVIQNISDAE   64
            D+L+++E+RYE+L ELLSDP+VV D K+  E S+E++  +ETV  YR+Y+   + ++DA+
Sbjct:    3 DRLKSIEERYEKLNELLSDPEVVNDPKKLREYSKEQSDIQETVDVYRQYRDASEQLADAK   62

Query:   65 EMIKDASGDAELEEMAKEELKESKAAKEEYEERLKILLLPKDPNDDKNIILEIRGAAGGD  124
            M+++   DAE+ +M KEE+ E +    E  ERLK+LL+PKDPNDDKN+I+EIRGAAGG+
```

```
-continued
Sbjct:  63 AMLEEKL-DAEMRDMVKEEISELQKETETLSERLKVLLIPKDPNDDKNVIMEIRGAAGGE 121

Query: 125 EAALFAGDLLTMYQKYAETQGWRFEVMESSVNGVGGIKEVVAMSGQSVYSKLKYESGAH 184
           EAALFAG+L  MY +YAE QGW+ EVME++V G GG KE++ M++G   YSKLKYE+GAH
Sbjct: 122 EAALFAGNLYRMYSRYAELQGWKTEVMEANVTGTGGYKEIIFMITGSGAYSKLKYENGAH 181

Query: 185 RVQRVPVTESQGRVHTSTATVLVMPEVEEVEYEIDQKDLRVDIYHASGAGGQNVNKVATA 244
           RVQRVP TES GR+HTSTATV  +PE EEVE +I +KD+RVD + +SG GGQ+VN    +A
Sbjct: 182 RVQRVPETESGGRIHTSTATVACLPEAEEVEVDIHEKDIRVDTFASSGPGGQSVNTTMSA 241

Query: 245 VRMVHIPTGIKVEMQEERTQQKNRDKAMKIIRARVADHFAQIAQDEQDAERKSTVGTGDR 304
           VR+ H+PTG+ V  Q+E++Q KN++KAMK++RAR+  D F Q AQ  E D   RKS VG+GDR
Sbjct: 242 VRLTHLPTGVVVSCQDEKSQIKNKEKAMKVLRARIYDKFQQEAQAEYDQTRKSAVGSGDR 301

Query: 305 SERIRTYNFPQNRVTDHRIGLTLQKLDTILSGKMDEVIDALVMYDQTQKLE         355
           SERIRTYNFPQNRVTDHRIGLT+QKLD  IL GK+DEV++AL++  DQ   KL+
Sbjct: 302 SERIRTYNFPQNRVTDHRIGLTIQKLDQILEGKLDEVVEALIVEDQASKLQ         352
```

A related DNA sequence was identified in *S. pyogenes* <SEQ ID 6573> which encodes the amino acid sequence <SEQ ID 6574>. Analysis of this protein sequence reveals the following:

```
Possible site: 28
>>> Seems to have no N-terminal signal sequence

----- Final Results -----
           bacterial cytoplasm --- Certainty = 0.3446(Affirmative) < succ>
           bacterial membrane  --- Certainty = 0.0000(Not Clear)  < succ>
            bacterial outside  --- Certainty = 0.0000(Not Clear)  < succ>
```

An alignment of the GAS and GBS proteins is shown below.

```
Identities = 349/358 (97%), Positives = 354/358 (98%)

Query:   1 MNIYDQLQAVEDRYEELGELLSDPDVVSDTKRFMELSREEASTRETVTAYREYKQVIQNI  60
           MNIYDQLQAVEDRYEELGELLSDPDVVSDTKRFMELSREE +TRETVTAYREYKQVIQ I
Sbjct:   1 MNIYDQLQAVEDRYEELGELLSDPDVVSDTKRFMELSREETNTRETVTAYREYKQVIQTI  60

Query:  61 SDAEEMIKDASGDAELEEMAKEELKESKAAKEEYEERLKILLLPKDPNDDKNIILEIRGA 120
           SDAEEMIKDASGD ELEEMAKEELKESKAAKEEYEE+LKILLLPKDPNDDKNIILEIRGA
Sbjct:  61 SDAEEMIKDASGDPELEEMAKEELKESKAAKEEYEEKLKILLLPKDPNDDKNIILEIRGA 120

Query: 121 AGGDEAALFAGDLLTMYQKYAETQGWRFEVMESSVNGVGGIKEVVAMSGQSVYSKLKYE 180
           AGGDEAALFAGDLLTMYQKYAETQGWRFEVMESSVNGVGGIKEVVAMSGQSVYSKLKYE
Sbjct: 121 AGGDEAALFAGDLLTMYQKYAETQGWRFEVMESSVNGVGGIKEVVAMSGQSVYSKLKYE 180

Query: 181 SGAHRVQRVPVTESQGRVHTSTATVLVMPEVEEVEYEIDQKDLRVDIYHASGAGGQNVNK 240
           SGAHRVQRVPVTESQGRVHTSTATVLVMPEVEEVEY+ID KDLRVDIYHASGAGGQNVNK
Sbjct: 181 SGAHRVQRVPVTESQGRVHTSTATVLVMPEVEEVEYDIDPKDLRVDIYHASGAGGQNVNK 240

Query: 241 VATAVRMVHIPTGIKVEMQEERTQQKNRDKAMKIIRARVADHFAQIAQDEQDAERKSTVG 300
           VATAVRMVHIPTGIKVEMQEERTQQKNRDKAMKIIRARVADHFAQIAQDEQDAERKSTVG
Sbjct: 241 VATAVRMVHIPTGIKVEMQEERTQQKNRDKAMKIIRARVADHFAQIAQDEQDAERKSTVG 300

Query: 301 TGDRSERIRTYNFPQNRVTDHRIGLTLQKLDTILSGKMDEVIDALVMYDQTQKLEALN 358
           TGDRSERIRTYNFPQNRVTDHRIGLTLQKLDTILSGKMDEVIDALVMYDQT KLE+LN
Sbjct: 301 TGDRSERIRTYNFPQNRVTDHRIGLTLQKLDTILSGKMDEVIDALVMYDQTKKLESLN 358
```

Based on this analysis, it was predicted that these proteins and their epitopes could be useful antigens for vaccines or diagnostics.

EXAMPLE 2129

A DNA sequence (GBSx2245) was identified in *S. agalactiae* <SEQ ID 6575> which encodes the amino acid sequence <SEQ ID 6576>. This protein is predicted to be thymidine kinase (tdk). Analysis of this protein sequence reveals the following:

```
Possible site: 39
>>> Seems to have no N-terminal signal sequence

----- Final Results -----
             bacterial cytoplasm --- Certainty = 0.2244(Affirmative) < succ>
              bacterial membrane --- Certainty = 0.0000(Not Clear)   < succ>
                bacterial outside --- Certainty = 0.0000(Not Clear)   < succ>
```

A related GBS nucleic acid sequence <SEQ ID 9841> which encodes amino acid sequence <SEQ ID 9842> was also identified.

The protein has homology with the following sequences in the GENPEPT database.

```
>GP: AAB02289 GB: L40415 thymidine kinase [Streptococcus gordonii]
Identities = 158/189 (83%), Positives = 175/189 (91%)

Query:   1 MAQLYYKYGTMNSGKTIEILKVAHNYEEQGKPVVIMTSALDTRDEFGVVSSRIGMRREAV   60
           MAQLYYKYGTMNSGKTIEILKVAHNYEEQGK VVIMTSA+DTRD  G VSSRIGM+R+A+
Sbjct:   1 MAQLYYKYGTMNSGKTIEILKVAHNYEEQGKGVVIMTSAVDTRDGVGYVSSRIGMKRQAM   60

Query:  61 PISDDMDIFSYIQNLPQKPYCVLIDECQFLSKKNVYDLARVVDDLDVPVMAFGLKNDFQN  120
              I DD DI   YI+NLP+KPYC+LIDE QFL + +VYDLARVVD+LDVPVMAFGLKNDF+N
Sbjct:  61 AIEDDTDILGYIKNLPEKPYCILIDEAQFLKRHHVYDLARVVDELDVPVMAFGLKNDFRN  120

Query: 121 NLFEGSKHLLLLADKIDEIKTICQYCSKKATMVLRTENGKPVYEGDQIQIGGNETYIPVC  180
           LFEGSKHLLLLADKI+EIKTICQYCS+KATMVLRT++GKPVY+G+QIQIGGNETYIPVC
Sbjct: 121 ELFEGSKHLLLLADKIEEIKTICQYCSRKATMVLRTDHGKPVYDGEQIQIGGNETYIPVC  180

Query: 181 RKHYFNPDI                                                    189
           RKHYF PDI
Sbjct: 181 RKHYFKPDI                                                    189
```

A related DNA sequence was identified in *S. pyogenes* <SEQ ID 6577> which encodes the amino acid sequence <SEQ ID 6578>. Analysis of this protein sequence reveals the following:

```
Possible site: 39
>>> Seems to have no N-terminal signal sequence

----- Final Results -----
             bacterial cytoplasm --- Certainty = 0.2244(Affirmative) < succ>
              bacterial membrane --- Certainty = 0.0000(Not Clear)   < succ>
                bacterial outside --- Certainty = 0.0000(Not Clear)   < succ>
```

An alignment of the GAS and GBS proteins is shown below.

```
Identities = 174/189 (92%), Positives = 184/189 (97%)

Query:   1 MAQLYYKYGTMNSGKTIEILKVAHNYEEQGKPVVIMTSALDTRDEFGVVSSRIGMRREAV   60
           +AQLYYKYGTMNSGKTIEILKVAHNYEEQGKPVVIMTSALDTRD FG+VSSRIGMRREA+
Sbjct:   1 LAQLYYKYGTMNSGKTIEILKVAHNYEEQGKPVVIMTSALDTRDGFGIVSSRIGMRREAI   60

Query:  61 PISDDMDIFSYIQNLPQKPYCVLIDECQFLSKKNVYDLARVVDDLDVPVMAFGLKNDFQN  120
           PIS+DMDIF++I  L +KPYCVLIDE QFLSK+NVYDLARVVD+L+VPVMAFGLKNDFQN
Sbjct:  61 PISNDMDIFTFIAQLEEKPYCVLIDESQFLSKQNVYDLARVVDELNVPVMAFGLKNDFQN  120

Query: 121 NLFEGSKHLLLLADKIDEIKTICQYCSKKATMVLRTENGKPVYEGDQIQIGGNETYIPVC  180
           NLFEGSKHLLLLADKIDEIKTICQYCSKKATMVLRTENGKPVYEGDQIQIGGNETYIPVC
Sbjct: 121 NLFEGSKHLLLLADKIDEIKTICQYCSKKATMVLRTENGKPVYEGDQIQIGGNETYIPVC  180

Query: 181 RKHYFNPDI                                                    189
           RKHYFNPDI
Sbjct: 181 RKHYFNPDI                                                    189
```

Based on this analysis, it was predicted that these proteins and their epitopes could be useful antigens for vaccines or diagnostics.

EXAMPLE 2130

A DNA sequence (GBSx2246) was identified in *S. agalactiae* <SEQ ID 6579> which encodes the amino acid sequence <SEQ ID 6580>. Analysis of this protein sequence reveals the following:

```
Possible site: 34
>>> Seems to have no N-terminal signal sequence

----- Final Results -----
            bacterial cytoplasm --- Certainty = 0.3995(Affirmative) < succ>
             bacterial membrane --- Certainty = 0.0000(Not Clear)   < succ>
              bacterial outside --- Certainty = 0.0000(Not Clear)   < succ>
```

The protein has homology with the following sequences in the GENPEPT database.

```
>GP: AAA26046 GB: M95650 4-oxalocrotonate tautomerase [Plasmid pWW0]
Identities = 27/60 (45%), Positives = 36/60 (60%)

Query:  1 MPFVKIDLFEGRSQEQKNELAREVTEVVSRIAKAPKENIHVFINDMPEGTYYPQGELKKK   60
          MP  +I +  EGRS EQK  L REV+E +SR   AP  ++ V I +M +G +   GEL  K
Sbjct:  1 MPIAQIHILEGRSDEQKETLIREVSEAISRSLDAPLTSVRVIITEMAKGHFGIGGELASK   60
```

A related DNA sequence was identified in *S. pyogenes* <SEQ ID 6581> which encodes the amino acid sequence <SEQ ID 6582>. Analysis of this protein sequence reveals the following:

```
Possible site: 34
>>> Seems to have no N-terminal signal sequence

----- Final Results -----
            bacterial cytoplasm --- Certainty = 0.4128(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below.

```
Identities = 56/60 (93%), Positives = 59/60 (98%)

Query:  1 MPFVKIDLFEGRSQEQKNELAREVTEVVSRIAKAPKENIHVFINDMPEGTYYPQGELKKK   60
          MPFV  IDLFEGRSQEQKN+LAREVTEVVSRIAKAPKENIHVFINDMPEGTYYPQGE+K+K
Sbjct:  1 MPFVTIDLFEGRSQEQKNQLAREVTEVVSRIAKAPKENIHVFINDMPEGTYYPQGEMKQK   60
```

Based on this analysis, it was predicted that these proteins and their epitopes could be useful antigens for vaccines or diagnostics.

EXAMPLE 2131

A DNA sequence (GBSx2247) was identified in *S. agalactiae* <SEQ ID 6583> which encodes the amino acid sequence <SEQ ID 6584>. Analysis of this protein sequence reveals the following:

```
Possible site: 57
>>> Seems to have no N-terminal signal sequence

----- Final Results -----
            bacterial cytoplasm --- Certainty = 0.2154(Affirmative) < succ>
             bacterial membrane --- Certainty = 0.0000(Not Clear)   < succ>
              bacterial outside --- Certainty = 0.0000(Not Clear)   < succ>
```

A related GBS nucleic acid sequence <SEQ ID 9843> which encodes amino acid sequence <SEQ ID 9844> was also identified.

The protein has homology with the following sequences in the GENPEPT database.

```
>GP: AAC65759 GB: AE001250 conserved hypothetical protein [Treponema
pallidum]
Identities = 103/317 (32%), Positives = 163/317 (50%), Gaps = 15/317 (4%)

Query:    7 QLSHSLRLMGTTIDIQINSKNAQKQIR----EVIELLELYKNRFSANDFNSELMAINNNA    62
            + S +  ++GT  +++ SK     ++        EV  LL+  +    SAN  +S L A+N  A
Sbjct:   31 EYSRAELVIGTLCRVRVYSKRPAAEVHAALEEVFTLLQQQEMVLSANRDDSALAALNAQA    90

Query:   63 GIKPIQVHPDLFELITIGKEHSLARPSNLNIAIGPLVQTWRIGFSDAKLPSPSEISEAMI   122
             G   P+ V    L+ L+        +       N A+G V+ W IGF  A +P P   + EA+
Sbjct:   91 GSAPVVVDRSLYALLERALFFAEKSGGAFNPALGAXVKLWNIGFDRAAVPDPDALKEALT   150

Query:  123 LSDPTHILLDSN-----KQSVFLNQIGMKIDLGALAKGYIADKIMTYLKNEMIDSAIINL   177
               D    + L +          +V L Q GM++DLGA+AKG++ADKI+  L    +DSA+++L
Sbjct:  151 RCDFRQVHLRAGVSVGAPHTVQLAQAGMQLDLGAIAKGFLADKIVQLLTAHALDSALVDL   210

Query:  178 GGNV----LVHGDNPNRSEGY--WVIGIQHPKKKRGKNIGTVKIKNQSVVTSGTYERRLI   231
            GGN+      L +GD + +       W +GI+ P    K       V +++ SVVTSG  YER
Sbjct:  211 GGNIFALGLKYGDVRSAAAQRLEWNVGIRDPHGTGQKPALVVSVRDCSVVTSGAYERFFE   270

Query:  232 IDDKEYHHIFDRQTGYPIQTEMASISIVSKQSVDCEIWTTRLFGLSIKEALDILNAVSYI   291
               D    YHHI D     TG+P T++  S+SI + +S D +    T  F L  +++  +L      +
Sbjct:  271 RDGVRYHHIIDPVTGFPAHTDVDSVSIFAPRSTDADALATACFVLGYEKSCALLREFPGV   330

Query:  292 EGIIITKDDRIYLSDGL                                             308
            +  +  I   D R+    S G+
Sbjct:  331 DALFIFPDKRVRASAGI                                             347
```

A related DNA sequence was identified in *S. pyogenes* <SEQ ID 6585> which encodes the amino acid sequence <SEQ ID 6586>. Analysis of this protein sequence reveals the following:

```
Possible site: 52
>>> Seems to have no N-terminal signal sequence

----- Final Results -----
            bacterial cytoplasm --- Certainty = 0.1020(Affirmative) < succ>
            bacterial membrane  --- Certainty = 0.0000(Not Clear)   < succ>
            bacterial outside   --- Certainty = 0.0000(Not Clear)   < succ>
```

An alignment of the GAS and GBS proteins is shown below.

```
Identities = 182/310 (58%), Positives = 232/310 (74%)

Query:    8 LSHSLRLMGTTIDIQINSKNAQKQIREVIELLELYKNRFSANDFNSELMAINNNAGIKPI    67
             ++  L+LMGT  IDIQI S   A +Q+   VI+LL  YKNRFSAND NSELMAIN   AG+KP+
Sbjct:    3 VTQQLKLMGTVIDIQIESDKACQQLSRVIDLLYTYKNRFSANDSNSELMAINQAAGVKPV    62

Query:   68 QVHPDLFELITIGKEHSLARPSNLNIAIGPLVQTWRIGFSDAKLPSPSEISEAMILSDPT   127
              VH DLF LI IGK HSL+ PSNLNIAIGPLVQ WRIGF DA++PS + IS+ + L+DP
Sbjct:   63 SVHSDLFNLIQIGKAHSLSTPSNLNIAIGPLVQAWRIGFEDARVPSHNLISQQLALTDPR   122

Query:  128 HILLDSNKQSVFLNQIGMKIDLGALAKGYIADKIMTYLKNEMIDSAIINLGGNVLVHGDN   187
             +L+D   KQ+VFL Q+GM +DLGALAKGYI DKIM YL    +  IDSA+INLGGNV VHG N
Sbjct:  123 QVLIDDKKQTVFLQQVGMALDLGALAKGYITDKIMAYLIEDGIDSALINLGGNVRVHGPN   182

Query:  188 PNRSEGYWVIGIQHPKKKRGKNIGTVKIKNQSVVTSGTYERRLIIDDKEYHHIFDRQTGY   247
              P    +   + IGIQ P   KRG+++G +K+  N SVVTSG  YER+       K+YHHI  DRQTGY
Sbjct:  183 PKSPDKTFRIGIQKPDAKRGQHLGVIKVNNHSVVTSGIYERQFTSKGKQYHHILDRQTGY   242

Query:  248 PIQTEMASISIVSKQSVDCEIWTTRLFGLSIKEALDILNAVSYIEGIIITKDDRIYLSDG   307
             PI+T+M S++I++   S   C+IWTTRLFGL   + +LN    IEG+++T+    +  +S+G
Sbjct:  243 PIETDMLSLTIMAPSSFYCDIWTTRLFGLDSSMIITLLNTFDNIEGLLVTRKHHVLMSNG   302

Query:  308 LKHHFQLFYH                                                    317
              L+H+FQ +YH
Sbjct:  303 LRHYFQPYYH                                                    312
```

Based on this analysis, it was predicted that these proteins and their epitopes could be useful antigens for vaccines or diagnostics.

EXAMPLE 2132

A DNA sequence (GBSx2248) was identified in *S. agalactiae* <SEQ ID 6587> which encodes the amino acid sequence <SEQ ID 6588>. Analysis of this protein sequence reveals the following:

```
Possible site: 31
>>> Seems to have no N-terminal signal sequence

----- Final Results -----
            bacterial cytoplasm --- Certainty = 0.0966(Affirmative) < succ>
            bacterial membrane  --- Certainty = 0.0000(Not Clear)   < succ>
             bacterial outside  --- Certainty = 0.0000(Not Clear)   < succ>
```

The protein has homology with the following sequences in the GENPEPT database.

```
>GP: AAG18632 GB: AY007504 unknown [Streptococcus mitis]
Identities = 92/160 (57%), Positives = 119/160 (73%), Gaps = 1/160 (0%)

Query:    1 MKLIGIVGTNSNKSTNRQLLQYMQQHFADKAEIELIEVKDLPLFNKPADKNVPQVILDIA   60
            MKL+ IVGTNSN+STNR+LL++MQ+HF+DKA+IE++E+K LP FN+P D+   P  +   +
Sbjct:    1 MKLVAIVGTNSNRSTNRKLLKFMQKHFSDKADIEVLEIKQLPAFNEPEDEQAPAEVQAFS   60

Query:   61 AKIEETDGVIIGTPEYDHSIPSALMSVLAWLSYGIYPLLNKPVMITGASYGTLGSSRAQL  120
               KI   DGVII TPEYDH+IP+ L S L W++Y    L+NKP MI GAS G LG+SRAQ
Sbjct:   61 EKILAADGVIISTPEYDHTIPAPLASALEWIAYTSRALINKPTMIVGASLGLLGTSRAQA  120

Query:  121 QLRQILNAPELKASVLP-DEFLLSHSLQAFDKDGNLHDIE                      159
            LRQIL+APELKA V+P  EF L HS Q  D +  +L++  E
Sbjct:  121 HLRQILDAPELKARVMPGTEFFLGHSEQVLDDECHLNNPE                      160
```

A related DNA sequence was identified in *S. pyogenes* <SEQ ID 6589> which encodes the amino acid sequence <SEQ ID 6590>. Analysis of this protein sequence reveals the following:

```
Possible site: 24
>>> Seems to have an uncleavable N-term signal seq

----- Final Results -----
            bacterial membrane  --- Certainty = 0.0000(Not Clear)   < succ>
             bacterial outside  --- Certainty = 0.0000 (Not Clear)  < succ>
            bacterial cytoplasm --- Certainty = 0.0000(Not Clear)   < succ>
```

The protein has homology with the following sequences in the databases:

```
>GP: CAB62679 GB: AL133422 putative secreted protein. [Streptomyces
coelicolor A3(2)]
Identities = 68/192 (35%), Positives = 94/192 (48%), Gaps = 25/192 (13%)

Query:    4 ILFIVGSLREGSFNHQLAAQAQK-ALEHQAVVSYLNWKDVPVLNQDIEANAPLPVVDA--   60
            IL +VGSLR GS N QLA  A + A E   V +    ++P N+DI+    +P   A
Sbjct:    5 ILALVGSLRAGSHNRQLAEAAVRFAPEGAEVQLFEGLAEIPFYNEDIDVEGSVPAAAAKL   64

Query:   61 RQAVQSADAIWIFTPVYNFSIPGSVKNLLDWLSRALDLSDPTGPSAIGGKVVTVSSVANG  120
            R+A Q A A  +F+P YN +IP  +KN +DWLSR      PG A  GK V V   A G
Sbjct:   65 REAAQGAQAFLLFSPEYNGTIPAVLKNAIDWLSR------PYGAGAFTGKPVAVVGTAFG  118

Query:  121 GHDQVFDQFKA----------LLPFIRTSVAGEFTK-ATVNP--DAWGTGRLEISKETKA  167
             +  V+ Q +A          ++  I+ S+ G T+ A +P DA    +L   E  A
Sbjct:  119 QYGGVWAQDEARKAVGIAGGKVIEDIKLSIPGSVTRFAETHPADDAEVAAQL---TEVVA  175

Query:  168 NLLSQAEALLAA                                                 179
              L   A+  +AA
Sbjct:  176 RLHGHADEAIAA                                                 187
```

An alignment of the GAS and GBS proteins is shown below.

```
Identities = 28/90 (31%), Positives = 49/90 (54%)

Query:   3 LIGIVGTNSNKSTNRQLLQYMQQHFADKAEIELIEVKDLPLFNKPADKNVPQVILDIAAK  62
           ++ IVG+    S N QL    Q+   +A +  +  KD+P+ N+  + N P  ++D
Sbjct:   4 ILFIVGSLREGSFNHQLAAQAQKALEHQAVVSYLNWKDVPVLNQDIEANAPLPVVDARQA  63

Query:  63 IEETDGVIIGTPEYDHSIPSALMSVLAWLS                               92
           ++  D + I TP Y+ SIP ++ ++L WLS
Sbjct:  64 VQSADAIWIFTPVYNFSIPGSVKNLLDWLS                               93
```

Based on this analysis, it was predicted that these proteins and their epitopes could be useful antigens for vaccines or diagnostics.

EXAMPLE 2133

A DNA sequence (GBSx2249) was identified in *S. agalactiae* <SEQ ID 6591> which encodes the amino acid sequence <SEQ ID 6592>. Analysis of this protein sequence reveals the following:

```
Possible site: 13
>>> Seems to have no N-terminal signal sequence

----- Final Results -----
           bacterial cytoplasm --- Certainty = 0.1160(Affirmative) < succ>
            bacterial membrane --- Certainty = 0.0000(Not Clear)   < succ>
             bacterial outside --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 2134

A DNA sequence (GBSx2250) was identified in *S. agalactiae* <SEQ ID 6593> which encodes the amino acid sequence <SEQ ID 6594>. Analysis of this protein sequence reveals the following:

```
Possible site: 14
>>> Seems to have no N-terminal signal sequence

----- Final Results -----
           bacterial cytoplasm --- Certainty = 0.2132(Affirmative) < succ>
            bacterial membrane --- Certainty = 0.0000(Not Clear)   < succ>
             bacterial outside --- Certainty = 0.0000(Not Clear)   < succ>
```

The protein has homology with the following sequences in the GENPEPT database.

```
>GP: AAG18632 GB: AY007504 unknown [Streptococcus mitis]
Identities = 80/162 (49%), Positives = 112/162 (68%)

Query:    1 MKFVGIVGSNAEQSYNRMLLEFIRKNFKTKFELEVLEIDDIPMFNQDQNWEESFQLRLLN   60
            MK V IVG+N+ +S NR LL+F++K+F  K  ++EVLEI  +P FN+ ++  +++   +
Sbjct:    1 MKLVAIVGTNSNRSTNRKLLKFMQKHFSDKADIEVLEIKQLPAFNEPEDEQAPAEVQAFS   60

Query:   61 NKITRADGVIIATPEHNHTITAALKSVLEWLSFAVHPLENKPVMIVGASYYDQGTSRAQI  120
              KI  ADGVII+TPE++HTI A L S LEW+++    L NKP MIVGAS    GTSRAQ
Sbjct:   61 EKILAADGVIISTPEYDHTIPAPLASALEWIAYTSRALINKPTMIVGASLGLLGTSRAQA  120

Query:  121 HLRKILDAPGVNAYTLPGNEFLLGKAKEAFDDNGNIINPGTV                   162
            HLR+ILDAP + A  +PG EF LG +++   DD  ++ NP  V
Sbjct:  121 HLRQILDAPELKARVMPGTEFFLGHSEQVLDDECHLNNPEKV                   162
```

There is also homology to SEQ ID 6596.

Based on this analysis, it was predicted that this protein and its epitopes, could be useful antigens for vaccines or diagnostics.

EXAMPLE 2135

A DNA sequence (GBSx2251) was identified in *S. agalactiae* <SEQ ID 6597> which encodes the amino acid sequence <SEQ ID 6598>. Analysis of this protein sequence reveals the following:

```
Possible site: 21
>>> Seems to have no N-terminal signal sequence
     INTEGRAL     Likelihood = -7.32     Transmembrane     13-29 (11-29)

----- Final Results -----
              bacterial membrane --- Certainty = 0.3930(Affirmative) < succ>
              bacterial outside  --- Certainty = 0.0000(Not Clear)   < succ>
            bacterial cytoplasm  --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 2136

A DNA sequence (GBSx2252) was identified in *S. agalactiae* <SEQ ID 6599> which encodes the amino acid sequence <SEQ ID 6600>. This protein is predicted to be potential nitrite transporter. Analysis of this protein sequence reveals the following:

```
Possible site: 42
>>> Seems to have no N-terminal signal sequence
     INTEGRAL     Likelihood = -9.92     Transmembrane      61-77 (54-82)
     INTEGRAL     Likelihood = -5.57     Transmembrane    106-122 (103-126)
     INTEGRAL     Likelihood = -5.15     Transmembrane    160-176 (159-177)
     INTEGRAL     Likelihood = -4.09     Transmembrane    180-196 (179-199)
     INTEGRAL     Likelihood = -1.01     Transmembrane    233-249 (233-249)

----- Final Results -----
              bacterial membrane --- Certainty = 0.4970(Affirmative) < succ>
              bacterial outside  --- Certainty = 0.0000(Not Clear)   < succ>
            bacterial cytoplasm  --- Certainty = 0.0000(Not Clear)   < succ>
```

The protein has homology with the following sequences in the GENPEPT database.

```
>GP: CAB15832 GB: Z99123 alternate gene name: ipa-48r~similar to
nitrite transporter [Bacillus subtilis]
Identities = 82/253 (32%), Positives = 119/253 (46%), Gaps = 10/253 (3%)

Query:    6 EKIAYNCAKKEALYKESLGRYALRSMLAGAYLTMSTAAGIVAADTIGK-ISPALSGFVF-   63
            +K+       KK+ ++  S  RY LRS+LA  ++      GI AA   G     A S F F
Sbjct:    7 QKVEQYALKKQNIFASSKIRYVLRSILASIFIGF----GITAASKTGSYFFMADSPFAFP   62

Query:   64 --AFIFSFGLIYVLIFNGELATSNMLYLTAGAYNKNISWKKAMTILIYCTFFNLVGACIL  121
              A F  ++ +    G+L T N  Y T A K ISW+ + + +      NL+GA +
Sbjct:   63 AAAVTFGAAILMIAYGGGDLFTGNTFYFTYTALRKKISWRDTLYLWMSSYAGNLIGAILF  122

Query:  122 AWLFNQSYSFQHLTNDSFLGHVVAKKLGKPSSGAFLEGIIANMFVNLAILAYMLLKEESA  181
            A L + +  F+ +  SFL H+   K+  P+S   F  G++ N  V LA    M LK E A
Sbjct:  123 AILISATGLFEEPSVHSFLIHLAEHKMEPPASELFFRGMLCNWLVCLAFFIPMSLKGEGA  182

Query:  182 KMTVILSAIFMFVFLSNEHLIANFASFMLAAFSHIEHIKGFTLLNIIRQWTLVFFGNWIG  241
            K+  ++ +F F    EH IAN +F ++   IEH    TL+  +R      V  GN
Sbjct:  183 KLFTMMLFVFCFFISGFEHSIANMCTFAISLL--IEHPDTVTLMGAVRNLIPVTLGNLTA  240

Query:  242 GGVFIGLAYAWLN                                                254
            G V +G  Y  LN
Sbjct:  241 GIVMMGWMYYTLN                                                253
```

A related DNA sequence was identified in *S. pyogenes* <SEQ ID 6601> which encodes the amino acid sequence <SEQ ID 6602>. Analysis of this protein sequence reveals the following:

```
Possible site: 32
>>> Seems to have no N-terminal signal sequence
```

```
                        -continued
INTEGRAL      Likelihood = -9.77    Transmembrane     142-158  (139-171)
INTEGRAL      Likelihood = -9.34    Transmembrane      95-111   (89-119)
INTEGRAL      Likelihood = -2.02    Transmembrane      61-77    (61-79)
INTEGRAL      Likelihood = -1.12    Transmembrane     261-277  (261-279)
INTEGRAL      Likelihood = -0.53    Transmembrane     191-207  (191-207)

----- Final Results -----
            bacterial membrane  --- Certainty = 0.4906(Affirmative) < succ>
            bacterial outside   --- Certainty = 0.0000(Not Clear)   < succ>
            bacterial cytoplasm --- Certainty = 0.0000(Not Clear)   < succ>
```

The protein has homology with the following sequences in the databases:

```
>GP: AAB80864 GB: U93874 formate dehydrogenase
[Bacillus subtilis]
Identities = 133/258 (51%), Positives = 181/258 (69%)

Query:   36 KTPEQILEATIHIGEHKVTKTFLAKSILGFIGGAMISLGYLLYVRIAASGLETFGAFSSI   95
            + P++I EA I  G  K+     +  +LGF+GGA I+LGYLL +R+      + +G+ SS+
Sbjct:    4 RKPDEIAEAAIEAGMKKIKLPLPSLLVLGFLGAFIALGYLLDIRVIGDLPKEWGSLSSL   63

Query:   96 VGACAFPIGLIIILMAGGELITGNMMAVSAALLAKKIKFSELAKNWLIITLFNVIGAVFV  155
            +GA  FP+GLI++++AG ELITGNMM+V+ AL ++KI    ELA NW I+T+ N+IGA+FV
Sbjct:   64 IGAAVFPVGLILVVLAGAELITGNMMSVAMALFSRKISVKELAINWGIVTIMNLIGALFV  123

Query:  156 AFVFGHFLGLTSAGIFKEEVIEVAHAKIAASPLQALVSGIGCNWFVGLALWLCYGANDAA  215
            A+ FGH +GLT  G + E+ I VA  K+  S  + L+S IGCNW V LA+WL +GA DAA
Sbjct:  124 AYFFGHLVGLTETGPYLEKTIAVAQGKLDMSFGKVLISAIGCNWLVCLAVWLSFGAQDAA  183

Query:  216 GKFLGTWFPVMTFVALGFQHSVANAFVIPAAIFEGGATWLDFVTNFIFVYSGNIIGGAIF  275
            GK LG WFP+M FVA+GFQH VAN FVIPAAIF G  TW   F+ N I + GN+IGGA+F
Sbjct:  184 GKILGIWFPIMAFVAIGFQHVVANMFVIPAAIFAGSFTWGQFIGNIIPAFIGNVIGGAVF  243

Query:  276 VSFLYFKVYYHPQKSKTQ                                           293
            V +YF  Y+   +S+ +
Sbjct:  244 VGLIYFIAYHKKDRSRKE                                           261
```

An alignment of the GAS and GBS proteins is shown below.

```
Identities = 69/240 (28%), Positives = 101/240 (41%),
Gaps = 18/240 (7%)

Query:   15 KEALYKESLGRYALRSMLAGAYLTMSTAAGIVAADTIGKISPALSGFVFAFIFSFGLIYV   74
            K  L K  LG    +  G L + AA      +T G    A S  V A F   GLI +
Sbjct:   55 KTFLAKSILGFIGGAMISLGYLLYVRIAAS--GLETFG----AFSSIVGACAFPIGLIII  108

Query:   75 LIFNGELATSNMLYLTAGAYNKNISWKKAMTILIYCTFFNLVGACILAWLFNQSYSFQHL  134
            L+  GEL T NM+ ++A     K I + +      +  T FN++GA  +A++F      F  L
Sbjct:  109 LMAGGELITGNMMAVSAALLAKKIKFSELAKNWLIITLFNVIGAVFVAFVFGH---FLGL  165

Query:  135 TNDSFLGHVVAK----KLGKPSSGAFLEGIIANMFVNLAILAYMLLKEESAKMTVILSAI  190
            T+      V +     K+      A + GI  N FV LA+       + + K          +
Sbjct:  166 TSAGIFKEEVIEVAHAKIAASPLQALVSGIGCNWFVGLALWLCYGANDAAGKFLGTWFPV  225

Query:  191 FMFVFLSNEHLIANFASFMLAAFSHIEHIKGFTLLNIIRQWTLVFFGNWIGGGVFIGLAY  250
              FV L  +H +AN    A F        G T L+ +  + V+ GN IGG +F+   Y
Sbjct:  226 MTFVALGFQHSVANAFVIPAAIFE-----GGATWLDFVTNFIFVYSGNIIGGAIFVSFLY  280
```

Based on this analysis, it was predicted that these proteins and their epitopes could be useful antigens for vaccines or diagnostics.

EXAMPLE 2137

A DNA sequence (GBSx2253) was identified in *S. agalactiae* <SEQ ID 6603> which encodes the amino acid sequence <SEQ ID 6604>. Analysis of this protein sequence reveals the following:

```
Possible site: 56
>>> Seems to have no N-terminal signal sequence

----- Final Results -----
            bacterial cytoplasm --- Certainty = 0.1342(Affirmative) < succ>
             bacterial membrane --- Certainty = 0.0000 (Not Clear) < succ>
              bacterial outside --- Certainty = 0.0000(Not Clear) < succ>
```

The protein has no significant homology with any sequences in the GENPEPT database.

No corresponding DNA sequence was identified in S. pyogenes.

Based on this analysis, it was predicted that this protein and its epitopes, could be useful antigens for vaccines or diagnostics.

EXAMPLE 2138

A DNA sequence (GBSx2254) was identified in S. agalactiae <SEQ ID 6605> which encodes the amino acid sequence <SEQ ID 6606>. Analysis of this protein sequence reveals the following:

```
Possible site: 50
>>> Seems to have no N-terminal signal sequence
    INTEGRAL      Likelihood = -0.22      Transmembrane      44-60 (44-60)

----- Final Results -----
             bacterial membrane --- Certainty = 0.1086(Affirmative) < succ>
              bacterial outside --- Certainty = 0.0000 (Not Clear) < succ>
            bacterial cytoplasm --- Certainty = 0.0000(Not Clear) < succ>
```

The protein has no significant homology with any sequences in the GENPEPT database.

No corresponding DNA sequence was identified in S. pyogenes.

Based on this analysis, it was predicted that this protein and its epitopes, could be useful antigens for vaccines or diagnostics.

EXAMPLE 2139

A DNA sequence (GBSx2255) was identified in S. agalactiae <SEQ ID 6607> which encodes the amino acid sequence <SEQ ID 6608>. This protein is predicted to be xanthine permease (pbuX). Analysis of this protein sequence reveals the following:

```
Possible site: 23
>>> Seems to have no N-terminal signal sequence
    INTEGRAL      Likelihood = -7.91      Transmembrane      160-176 (156-188)
    INTEGRAL      Likelihood = -6.48      Transmembrane      184-200 (179-211)
    INTEGRAL      Likelihood = -6.21      Transmembrane      101-117 (96-121)
    INTEGRAL      Likelihood = -4.04      Transmembrane      309-325 (306-332)
    INTEGRAL      Likelihood = -3.98      Transmembrane      334-350 (331-353)
    INTEGRAL      Likelihood = -3.88      Transmembrane      400-416 (396-420)
    INTEGRAL      Likelihood = -3.45      Transmembrane       19-35 (18-38)
    INTEGRAL      Likelihood = -2.81      Transmembrane      127-143 (127-146)
    INTEGRAL      Likelihood = -2.71      Transmembrane      228-244 (227-249)
    INTEGRAL      Likelihood = -2.02      Transmembrane       47-63 (47-63)
    INTEGRAL      Likelihood = -1.97      Transmembrane       75-91 (73-92)
    INTEGRAL      Likelihood = -0.85      Transmembrane      368-384 (368-384)

----- Final Results -----
             bacterial membrane --- Certainty = 0.4163(Affirmative) < succ>
              bacterial outside --- Certainty = 0.0000(Not Clear) < succ>
            bacterial cytoplasm --- Certainty = 0.0000(Not Clear) < succ>
```

The protein has homology with the following sequences in the GENPEPT database.

```
>GP: CAB14123 GB: Z99115 xanthine permease
[Bacillus subtilis]
Identities = 213/412 (51%), Positives = 292/412 (70%),
Gaps = 5/412 (1%)

Query:   14 LGLQHLLAMYAGSILVPIMIASALGYNAKQLTYLIATDIFMCGIATLLQLRLSKHFGVGL    73
```

-continued

```
              LG+QH+LAMYAG+I+VP+++   A+G     +QLTYL++ DIFMCG+ATLLQ+   ++ FG+GL
Sbjct:     11 LGIQHVLAMYAGAIVVPLIVGKAMGLTVEQLTYLVSIDIFMCGVATLLQVWSNRFFGIGL     70

Query:     74 PVVLGCAFQSVAPLSIIGAQQGSGYMFGALIASGIYVVLVAGIFSKVANFFPPIVTGSVI    133
              PVVLGC F +V+P+   IG++  G    ++G++IASGI V+L++   F K+ +FFPP+VTGSV+
Sbjct:     71 PVVLGCTFTAVSPMIAIGSEYGVSTVYGSIIASGILVILISFFFGKLVSFFPPVVTGSVV    130

Query:    134 TTIGLTLIPVAMGNMGD---NAKEPSLQSLTLSLVTIGVVLLINIFAKGFLKSISILIGL    190
              T  IG+TL+PVAM NM      +A    L +L L+   +  +++L+   F KGF+KS+SILIG+
Sbjct:    131 TIIGITLMPVAMNNMAGGEGSADFGDLSNLALAFTVLSIIVLLYRFTKGFIKSVSILIGI    190

Query:    191 ISGTILAAFMGLVDASVVADAPLVHIPKPFYFGAPRFEFTSILMMCIIATVSMVESTGVY    250
              + GT +A FMG V      V+DA +V + +PFYFGAP F       I+ M I+A VS+VESTGVY
Sbjct:    191 LIGTFIAYFMGKVQFDNVSDAAVVQMIQPFYFGAPSFHAAPIITMSIVAIVSLVESTGVY    250

Query:    251 LALSDITNDKLDSKRLRNGYRSEGLAVLLGGLFNTFPYTGFSQNVGLVQISGIRTRKPIY    310
                   AL D+TN +L     L   GYR+EGLAVLLGG+FN FPYT FSQNVGLVQ++GI+        I
Sbjct:    251 FALGDLTNRRLTEIDLSKGYRAEGLAVLLGGIFNAFPYTAFSQNVGLVQLTGIKKNAVIV    310

Query:    311 FTALFLVILGLLPKFGAMAQMIPSPVLGGAMLVLFGMVALQGMKMLNQVDFEHNEHNFII    370
                    T + L+   GL PK  A    +IPS VLGGAM+ +FGMV    G+KML+++DF     E N +I
Sbjct:    311 VTGVILMAFGLFPKIAAFTTIIPSAVLGGAMVAMFGMVIAYGIKMLSRIDFAKQE-NLLI    369

Query:    371 AAVSIAAGVGFNGT-NLFISLPNTLQMFLTNGIVISTLTAVVLNIILNGLPK           421
                    A S+  G+G      ++F  LP+ L +  TNGIV  + TAVVLNI+ N    K
Sbjct:    370 VACSVGLGLGVTVVPDIFKQLPSALTLLTTNGIVAGSFTAVVLNIVYNVFSK           421
```

A related DNA sequence was identified in *S. pyogenes* <SEQ ID 6609> which encodes the amino acid sequence <SEQ ID 6610>. Analysis of this protein sequence reveals the following:

```
Possible site: 29
>>> Seems to have no N-terminal signal sequence
    INTEGRAL      Likelihood = -7.32    Transmembrane    160-176 (158-181)
    INTEGRAL      Likelihood = -6.37    Transmembrane    103-119 (98-124)
    INTEGRAL      Likelihood = -5.84    Transmembrane    130-146 (126-152)
    INTEGRAL      Likelihood = -5.68    Transmembrane    187-203 (182-207)
    INTEGRAL      Likelihood = -3.98    Transmembrane    337-353 (334-356)
    INTEGRAL      Likelihood = -3.82    Transmembrane    232-248 (225-252)
    INTEGRAL      Likelihood = -3.35    Transmembrane    403-419 (399-421)
    INTEGRAL      Likelihood = -2.50    Transmembrane     22-38  (21-41)
    INTEGRAL      Likelihood = -2.07    Transmembrane    312-328 (312-328)
    INTEGRAL      Likelihood = -1.97    Transmembrane     78-94  (76-95)

----- Final Results -----
         bacterial membrane --- Certainty = 0.3930(Affirmative) < succ>
         bacterial outside  --- Certainty = 0.0000(Not Clear)   < succ>
         bacterial cytoplasm --- Certainty = 0.0000(Not Clear)  < succ>
```

The protein has homology with the following sequences in the databases:

```
>GP: CAB15234 GB: Z99120 similar to purine permease
[Bacillus subtilis]
Identities = 216/421 (51%), Positives = 302/421 (71%),
Gaps = 5/421 (1%)

Query:      6 KQEHSHSQSAVLGLQHVLSMYAGSILVPIMIAGALGYSARELTYLISTDIFMCGVATFLQ     65
              K++H+  Q   +LGLQH+L+MYAGA+ILVP+++   A+G  +A +LTYLI+ D+FMCG AT LQ
Sbjct:      2 KEQHNALQLMMLGLQHMLAMYAGAILVPLIVGAAIGLNAGQLTYLIAIDLFMCGAATLLQ     61

Query:     66 LKLTKHTGVGLPVVLGCAFQSVAPLSIIGAQQGSGAMFGALIASGIYVILVAGIFSKIAR    125
              L     ++  G+GLPVVLGC F +V P+   IG+   G   A++GA+IA+G+ V+L AG F K+ R
Sbjct:     62 LWRNRYFGIGLPVVLGCTFTAVGPMISIGSTYGVPAIYGAIIAAGLIVVLAAGFFGKLVR    121

Query:    126 FFPPIVTGSVITVIGLSLVGVAMGNM--GDNVKE-PTAQSMMLSLLTIVIILLVQKFTKG    182
              FFPP+VTGSV+ +IG+SL+   AM N+   G+   KE +    +++L         ILL+   F KG
Sbjct:    122 FFPPVVTGSVVMIGISLIPTAMNNLAGGEGSKEFGSLDNVLLGFGVTAFILLLFYFFKG    181

Query:    183 FVKSISILIGLVAGTLVSAMMGLVDTTPVVEASWIHVPTPFYFGMPTFEITSIVMMCIIA    242
              F++SI+IL+GL+AGT    +  MG VD    +V+EASW+HVP+ FYFG PTFE+ ++V M ++A
Sbjct:    182 FIRSIAILLGLIAGTAAAYFMGKVDFSEVLEASWLHVPSLFYFGPPTFELPAVVTMLLVA    241

Query:    243 TVSMVESTGVYLALSDLTNDQLDEKRLRNGYRSEGIAVFLGGLFNTFPYTGFSQNVGLVQ    302
              VS+VESTGVY AL+D+TN +L EK L   GYR+EG+A+ LGGLFN FPYT FSQNVG+VQ
```

-continued

```
Sbjct: 242 IVSLVESTGVYFALADITNRRLSEKDLEKGYRAEGLAILLGGLFNAFPYTAFSQNVGIVQ  301

Query: 303 ISGIKTRRPIYYAAGILVVIGLLPKFRAMAQMIPSPVLGGAMLVLFGMVALQGMQMLNRV  362
           +S +K+    I    ILV IGL+PK  A+   +IP+PVLGGAM+V+FGMV    G++ML+ V
Sbjct: 302 LSKMKSVNVIAITGIILVAIGLVPKAAALTTVIPTPVLGGAMIVMFGMVISYGIKMLSSV  361

Query: 363 DFQKNEYNFIIAAVSISAGLGFNGT-NLFASLPETAQMFLTNGIVIATLTSVVLNLVLNGK  422
           D    ++ N +I A S+S GLG        LF+SL   A +   +GIVI +LT++ L+      K
Sbjct: 362 DLD-SQGNLLIIASSVSLGLGATTVPALFSSLSGAASVLAGSGIVIGSLTAIALHAFFQTK  421
```

An alignment of the GAS and GBS proteins is shown below.[10]

```
Identities = 328/416 (78%), Positives = 380/416 (90%)

Query:   7 SNSQAALLGLQHLLAMYAGSILVPIMIASALGYNAKQLTYLIATDIFMCGIATLLQLRLS   66
           S+SQ+A+LGLQH+L+MYAGSILVPIMIA ALGY+A++LTYLI+TDIFMCG+AT LQL+L+
Sbjct:  10 SHSQSAVLGLQHVLSMYAGSILVPIMIAGALGYSARELTYLISTDIFMCGVATFLQLKLT   69

Query:  67 KHFGVGLPVVLGCAFQSVAPLSIIGAQQGSGYMFGALIASGIYVVLVAGIFSKVANFFPP  126
           KH GVGLPVVLGCAFQSVAPLSIIGAQQGSG MFGALIASGIYV+LVAGIFSK+A FFPP
Sbjct:  70 KHTGVGLPVVLGCAFQSVAPLSIIGAQQGSGAMFGALIASGIYVILVAGIFSKIARFFPP  129

Query: 127 IVTGSVITTIGLTLIPVAMGNMGDNAKEPSLQSLTLSLVTIGVVLLINIFAKGFLKSISI  186
           IVTGSVIT IGL+L+ VAMGNMGDN KEP+ QS+ LSL+TI ++LL+  F KGF+KSISI
Sbjct: 130 IVTGSVITVIGLSLVGVAMGNMGDNVKEPTAQSMMLSLLTIVIILLVQKFTKGFVKSISI  189

Query: 187 LIGLISGTILAAFMGLVDASVVADAPLVHIPKPFYFGAPRFEFTSILMMCIIATVSMVES  246
           LIGL++GT+++A MGLVD + V  +A  +H+P PFYFG P FE TSI+MMCIIATVSMVES
Sbjct: 190 LIGLVAGTLVSAMNGLVDTTPVVEASWIHVPTPFYFGMPTFEITSIVMMCIIATVSMVES  249

Query: 247 TGVYLALSDITNDKLDSKRLRNGYRSEGLAVLLGGLFNTFPYTGFSQNVGLVQISGIRTR  306
           TGVYLALSD+TND+LD KRLRNGYRSEG+AV LGGLFNTFPYTGFSQNVGLVQISGI+TR
Sbjct: 250 TGVYLALSDLTNDQLDEKRLRNGYRSEGIAVFLGGLFNTFPYTGFSQNVGLVQISGIKTR  309

Query: 307 KPIYFTALFLVILGLLPKFGAMAQMIPSPVLGGAMLVLFGMVALQGMKMLNQVDFEHNEH  366
           +PIY+  A  LV++GLLPKF AMAQMIPSPVLGGAMLVLFGMVALQGM+MLN+VDF+ NE+
Sbjct: 310 RPIYYAAGILVVIGLLPKFRAMAQMIPSPVLGGAMLVLFGMVALQGMQMLNRVDFQKNEY  369

Query: 367 NFIIAAVSIAAGVGFNGTNLFISLPNTLQMFLTNGIVISTLTAVVLNIILNGLPKK      422
           NFIIAAVSI+AG+GFNGTNLF SLP T QMFLTNGIVI+TLT+VVLN++LNG  K+
Sbjct: 370 NFIIAAVSISAGLGFNGTNLFASLPETAQMFLTNGIVIATLTSVVLNLVLNGKDKQ      425
```

Based on this analysis, it was predicted that these proteins and their epitopes could be useful antigens for vaccines or diagnostics.

EXAMPLE 2140

A DNA sequence (GBSx2256) was identified in *S. agalactiae* <SEQ ID 6611> which encodes the amino acid sequence <SEQ ID 6612>. This protein is predicted to be xanthine phosphoribosyltransferase (xpt). Analysis of this protein sequence reveals the following:

```
Possible site: 43
>>> Seems to have no N-terminal signal sequence

----- Final Results -----
          bacterial cytoplasm --- Certainty = 0.1921(Affirmative) < succ>
           bacterial membrane --- Certainty = 0.0000(Not Clear)   < succ>
            bacterial outside --- Certainty = 0.0000(Not Clear)   < succ>
```

The protein has homology with the following sequences in the GENPEPT database.

```
>GP: CAA13587 GB: AJ233894 xanthine phosphoribosyltransferase
[Streptococcus pneumoniae]
Identities = 133/162 (82%), Positives = 144/162 (88%)

Query: 16 GENILKVDSFLTHQVDFELMQEIGKVFADKYKEAGITKVVTIEASGIAPAVYAAQALGVP   75
          G+NILKVDSFLTHQVDF LM+EIGKVFA+K+  AGITKVVTIEASGIAPA++ A+AL VP
```

```
                                     -continued
Sbjct:    1 GDNILKVDSFLTHQVDFSLMREIGKVFAEKFASAGITKVVTIEASGIAPALFTAEALNVP   60

Query:   76 MIFAKKAKNITMTEGILTAEVYSFTKQVTSQVSIVSRFLSNDDTVLIIDDFLANGQAAKG  135
            MIFAKKAKNITM EGILTAEVYSFTKQVTS VSI  +FLS +D VLIIDDFLANGQAAKG
Sbjct:   61 MIFAKKAKNITMNEGILTAEVYSFTKQVTSTVSIAGKFLSPEDKVLIIDDFLANGQAAKG  120

Query:  136 LLEIIGQAGAKVAGIGIVIEKSFQDGRDLLEKTGVPVTSLAR                   177
            L++II QAGA V  IGIVIEKSFQDGRDLLEK G PV SLAR
Sbjct:  121 LIQIIEQAGATVEAIGIVIEKSFQDGRDLLEKAGYPVLSLAR                   162
```

A related DNA sequence was identified in *S. pyogenes* <SEQ ID 6613> which encodes the amino acid sequence <SEQ ID 6614>. Analysis of this protein sequence reveals the following:

```
Possible site: 43
>>> Seems to have no N-terminal signal sequence

----- Final Results -----
           bacterial cytoplasm --- Certainty = 0.2576(Affirmative) < succ>
           bacterial membrane  --- Certainty = 0.0000(Not Clear)   < succ>
            bacterial outside  --- Certainty = 0.0000(Not Clear)   < succ>
```

An alignment of the GAS and GBS proteins is shown below.

```
Identities = 156/193 (80%), Positives = 172/193 (88%)

Query:    1 MKLLEERILKDGDVLGENILKVDSFLTHQVDFELMQEIGKVFADKYKEAGITKVVTIEAS   60
            M+LLEERIL DG++LGENILKVD+FLTHQVD+ LM+ IGKVFA KY EAGITKVVTIEAS
Sbjct:    1 MQLLEERILTDGNILGENILKVDNFLTHQVDYRLMKAIGKVFAQKYAEAGITKVVTIEAS   60

Query:   61 GIAPAVYAAQALGVPMIFAKKAKNITMTEGILTAEVYSFTKQVTSQVSIVSRFLSNDDTV  120
            GIAPAVYAA+A+ VPMIFAKK KNITMTEGILTAEVYSFTKQVTS VSI  +FLS +D V
Sbjct:   61 GIAPAVYAAEAMDVPMIFAKKHKNITMTEGILTAEVYSFTKQVTSTVSIAGKFLSKEDKV  120

Query:  121 LIIDDFLANGQAAKGLLEIIGQAGAKVAGIGIVIEKSFQDGRDLLEKTGVPVTSLARIKA  180
            LIIDDFLANGQAAKGL+EIIGQAGA+V G+GIVIEKSFQDGR L+E  G+ VTSLARIK
Sbjct:  121 LIIDDFLANGQAAKGLIEIIGQAGAQVVGVGIVIEKSFQDGRRLIEDMGIEVTSLARIKN  180

Query:  181 FENGRVVFAEADA                                                193
            FENG + F EADA
Sbjct:  181 FENGNLNFLEADA                                                193
```

Based on this analysis, it was predicted that these proteins and their epitopes could be useful antigens for vaccines or diagnostics.

EXAMPLE 2141

A DNA sequence (GBSx2257) was identified in *S. agalactiae* <SEQ ID 6615> which encodes the amino acid sequence <SEQ ID 6616>. Analysis of this protein sequence reveals the following:

```
Possible site: 28
>>> Seems to have no N-terminal signal sequence

----- Final Results -----
           bacterial cytoplasm --- Certainty = 0.2546(Affirmative) < succ>
           bacterial membrane  --- Certainty = 0.0000(Not Clear)   < succ>
            bacterial outside  --- Certainty = 0.0000(Not Clear)   < succ>
```

The protein has homology with the following sequences in the GENPEPT database.

```
>GP: CAB15203 GB: Z99120 similar to GMP reductase [Bacillus subtilis]
Identities = 243/321 (75%), Positives = 286/321 (88%), Gaps = 2/321 (0%)
```

-continued

```
Query:   7 VFDYEDIQLIPNKCIISSRSQADTSVKLGNYTFKLPVIPANMQTIIDEEVAETLACEGYF   66
           VFDYEDIQLIP KCI++SRS+ DTSV+LG +TFKLPV+PANMQTIIDE++A +LA  GYF
Sbjct:   4 VFDYEDIQLIPAKCIVNSRSECDTSVRLGGHTFKLPVVPANMQTIIDEKLAISLAENGYF   63

Query:  67 YIMHRFNEEERKPFIKRMHDKGLIASISVGVKDYEYDFVTSLKED--APEFITIDIAHGH  124
           Y+MHRF  E R  FIK M+ +GL +SISVGVKD EY+FV  L E+   PE++TIDIAHGH
Sbjct:  64 YVMHRFEPETRIDFIKDMNARGLFSSISVGVKDEEYEFVRQLAEENLTPEYVTIDIAHGH  123

Query: 125 SNSVIEMIQHIKQELPETFVIAGNVGTPEAVRELENAGADATKVGIGPGKVCITKVKTGF  184
           SN+VIEMIQH+K+ LP++FVIAGNVGTPEAVRELENAGADATKVGIGPGKVCITK+KTGF
Sbjct: 124 SNAVIEMIQHLKKHLPDSFVIAGNVGTPEAVRELENAGADATKVGIGPGKVCITKIKTGF  183

Query: 185 GTGGWQLAALRWCSKAARKPIIADGGIRTHGDIAKSIRFGASMVMIGSLFAGHLESPGKL  244
           GTGGWQLAALRWC+KAA KPIIADGGIRTHGDIAKSIRFGA+MVMIGSLFAGH ESPG+
Sbjct: 184 GTGGWQLAALRWCAKAASKPIIADGGIRTHGDIAKSIRFGATMVMIGSLFAGHEESPGQT  243

Query: 245 VEVEGQQFKEYYGSASEYQKGEHKNVEGKKILLPVKGRLEDTLTEMQQDLQSSISYAGGK  304
           +E +G+ +KEY+GSASE+ KGE KNVEGKK+ +  KG ++DTL EM+QDLQSSISYAGG
Sbjct: 244 IEKDGKLYKEYFGSASEFPKGEKKNVEGKKMHVAHKGSIKDTLIEMEQDLQSSISYAGGT  303

Query: 305 ELDSLRHVDYVIVKNSIWNGD                                        325
           +L+++R+VDYVIVKNSI+NGD
Sbjct: 304 KLNAIRNVDYVIVKNSIFNGD                                        324
```

A related DNA sequence was identified in *S. pyogenes* <SEQ ID 6617> which encodes the amino acid sequence <SEQ ID 6618>. Analysis of this protein sequence reveals the following:

```
Possible site: 35
>>> Seems to have no N-terminal signal sequence

----- Final Results -----
              bacterial cytoplasm --- Certainty = 0.2405(Affirmative) < succ>
               bacterial membrane --- Certainty = 0.0000(Not Clear) < succ>
                bacterial outside --- Certainty = 0.0000(Not Clear) < succ>
```

An alignment of the GAS and GBS proteins is shown below.

```
Identities = 297/327 (90%), Positives = 311/327 (94%)

Query:   1 MFNDIPVFDYEDIQLIPNKCIISSRSQADTSVKLGNYTFKLPVIPANMQTIIDEEVAETL   60
           MFNDIPVFDYEDIQLIPNKCII+SRSQADTSV LG Y FKLPVIPANMQTIIDE +AE L
Sbjct:   8 MFNDIPVFDYEDIQLIPNKCIITSRSQADTSVTLGKYQFKLPVIPANMQTIIDETIAEQL   67

Query:  61 ACEGYFYIMHRFNEEERKPFIKRMHDKGLIASISVGVKDYEYDFVTSLKEDAPEFITIDI  120
           A EGYFYIMHRF+E+ RKPFIKRMH++GLIASISVGVK  EY+FVTSLKEDAPEFITIDI
Sbjct:  68 AKEGYFYIMHRFDEDSRKPFIKRMHEQGLIASISVGVKACEYEFVTSLKEDAPEFITIDI  127

Query: 121 AHGHSNSVIEMIQHIKQELPETFVIAGNVGTPEAVRELENAGADATKVGIGPGKVCITKV  180
           AHGH+NSVI+MI+HIK ELPETFVIAGNVGTPEAVRELENAGADATKVGIGPGKVCITKV
Sbjct: 128 AHGHANSVIDMIKHIKTELPETFVIAGNVGTPEAVRELENAGADATKVGIGPGKVCITKV  187

Query: 181 KTGFGTGGWQLAALRWCSKAARKPIIADGGIRTHGDIAKSIRFGASMVMIGSLFAGHLES  240
           KTGFGTGGWQLAALRWC+KAARKPIIADGGIRTHGDIAKSIRFGASMVMIGSLFAGH ES
Sbjct: 188 KTGFGTGGWQLAALRWCAKAARKPIIADGGIRTHGDIAKSIRFGASMVMIGSLFAGHFES  247

Query: 241 PGKLVEVEGQQFKEYYGSASEYQKGEHKNVEGKKILLPVKGRLEDTLTEMQQDLQSSISY  300
           PGK VEV+G+ FKEYYGSASEYQKGEHKNVEGKKILLP KG L DTLTEMQQDLQSSISY
Sbjct: 248 PGKTVEVDGETFKEYYGSASEYQKGEHKNVEGKKILLPTKGHLSDTLTEMQQDLQSSISY  307

Query: 301 AGGKELDSLRHVDYVIVKNSIWNGDSI                                  327
           AGGK+LDSLRHVDYVIVKNSIWNGDSI
Sbjct: 308 AGGKDLDSLRHVDYVIVKNSIWNGDSI                                  334
```

Based on this analysis, it was predicted that these proteins and their epitopes could be useful antigens for vaccines or diagnostics.

EXAMPLE 2142

A DNA sequence (GBSx2258) was identified in *S. agalactiae* <SEQ ID 6619> which encodes the amino acid sequence <SEQ ID 6620>. Analysis of this protein sequence reveals the following:

```
Possible site: 57
>>> Seems to have an uncleavable N-term signal seq
    INTEGRAL      Likelihood = -16.98     Transmembrane    421-437 (413-443)
    INTEGRAL      Likelihood =  -8.81     Transmembrane    166-182 (159-186)
    INTEGRAL      Likelihood =  -8.55     Transmembrane    220-236 (208-238)
    INTEGRAL      Likelihood =  -6.69     Transmembrane    322-338 (319-353)
    INTEGRAL      Likelihood =  -5.26     Transmembrane    199-215 (196-218)
    INTEGRAL      Likelihood =  -4.35     Transmembrane    343-359 (342-361)
    INTEGRAL      Likelihood =  -4.09     Transmembrane    291-307 (287-308)
    INTEGRAL      Likelihood =  -3.66     Transmembrane      8-24  (8-27)
    INTEGRAL      Likelihood =  -3.66     Transmembrane    133-149 (133-151)
    INTEGRAL      Likelihood =  -3.19     Transmembrane    254-270 (253-278)
    INTEGRAL      Likelihood =  -2.50     Transmembrane     53-69  (53-72)
    INTEGRAL      Likelihood =  -1.81     Transmembrane     77-93  (76-95)
    INTEGRAL      Likelihood =  -1.33     Transmembrane    109-125 (109-125)

----- Final Results -----
              bacterial membrane --- Certainty = 0.7793(Affirmative) < succ>
              bacterial outside  --- Certainty = 0.0000(Not Clear)   < succ>
              bacterial cytoplasm --- Certainty = 0.0000(Not Clear)  < succ>
```

The protein has homology with the following sequences in the GENPEPT database.

```
>GP: CAB61253 GB: AJ250422 ORFC [Oenococcus oeni]
Identities = 157/447 (35%), Positives = 252/447 (56%), Gaps = 13/447 (2%)

Query:  11 AIITTAILGFSGILIETSMNVTFPLLMKEFGVNPAVIQWVTTGNLLAVAVTVPLSAFMIK    70
           AI+   A L F G+LIETSMNVTFP LM++F ++   +QW+TT  LL VA T+ ++AF+ K
Sbjct:  15 AILGLAGLAFCGVLIETSMNVTFPTLMQQFSISLNKVQWLTTAYLLLVAATISIAAFIEK    74

Query:  71 NLSERQIFTLANVLFLSGVLIDSFAPNLAILLVGRVLQGVGTGLALPLLFHIILTQIPME   130
              ++IF  A +LF+ GV+ + APN  ILL+GR++Q + TGLA+PLL    I+ QIP +
Sbjct:  75 RFIFKKIFFWAGLLFIIGVICSALAPNFLILLIGRLIQALSTGLAIPLLITEIMQQIPQK   134

Query: 131 RRGLMMGVAAMVTLLAPAVGPTYGGVISGMLGWKMIFMLLAPILIISTFIGLASIPKRQV   190
              ++G  M +   + L  P++GPTYGGVI+  L W++IF + PI +I+  IGL+ I ++
Sbjct: 135 KQGSYMELVEWLLLWQPSLGPTYGGVITQDLSWRLIFWFVLPIGLIAWLIGLSFIEQKSS   194

Query: 191 RINDKLNFPAFISLGIGLATLLLAIEKMSIF---------YLLVAIVSFVIFYYL--NKQ   239
                 +   FISL +  L ++ +A+     I+          +LL+A++  ++F  L  N +
Sbjct: 195 PSKIPFAWKQFISLILALLSITVAVNNAGIYGWTSIKFYGFLLIAVILLIVFIKLSTNSR   254

Query: 240 LEFLNLNVFKDKDFSILLYGVLAFQMIPLALSFLLPNLLQLVLHQTSTKAGLFMFPGAIA   299
              +++++FK  +F      L     Q I L+L+FLLPN  QL+L +    +G+ +  G++
Sbjct: 255 QALISISIFKKWEFVCPLLIYFLIQFIQLSLTFLLPNYAQLILKKGVMISGIMLLCGSLI   314

Query: 300 VVFLSPFAGYLLDKIGAFKPIMIGISLSLIGLIGTAIFIPAKSVVVLLAFDILTKIGMGI   359
               L P G +LD     P++IG   +  I   IF   SV ++ A  ++   IG
Sbjct: 315 SAILQPLTGRMLDSFSVKIPLVIGAFFLITSTISFTIFQRYLSVFLIAALYVIYMIGFSF   374

Query: 360 GASNMVTTALTKLKPAQSADGNSILNTLQQFAGAFATAVASQIFTIGQVAIPKNGAIIGS   419
              +N +T AL KL     +DGN++  NTLQQ+AG+   T+VAS +   G    K     GS
Sbjct: 375 VFNNSLTYALQKLPLKLISDGNAVFNTLQQYAGSLGTSVASALLANGIGTDGKQSNYTGS   434

Query: 420 Q--FAVLFVIVVVILAIVGLTYLRKRK                                   444
              +  F + F+    +++ ++       +K K
Sbjct: 435 RHIFILNFISCAIVVILIFSIQRKKNK                                   461
```

There is also homology to SEQ ID 46.

Based on this analysis, it was predicted that this protein and its epitopes, could be useful antigens for vaccines or diagnostics.

EXAMPLE 2143

A DNA sequence (GBSx2259) was identified in *S. agalactiae* <SEQ ID 6621> which encodes the amino acid sequence <SEQ ID 6622>. Analysis of this protein sequence reveals the following:

```
Possible site: 52
>>> Seems to have no N-terminal signal sequence

----- Final Results -----
           bacterial cytoplasm --- Certainty = 0.2151(Affirmative) < succ>
            bacterial membrane --- Certainty = 0.0000(Not Clear)   < succ>
             bacterial outside --- Certainty = 0.0000(Not Clear)   < succ>
```

The protein has no significant homology with any sequences in the GENPEPT database.

A related DNA sequence was identified in *S. pyogenes* <SEQ ID 6595> which encodes the amino acid sequence <SEQ ID 6596>. Analysis of this protein sequence reveals the following:

```
Possible site: 32
>>> Seems to have an uncleavable N-term signal seq

----- Final Results -----
            bacterial membrane --- Certainty = 0.0000(Not Clear) < succ>
             bacterial outside --- Certainty = 0.0000(Not Clear) < succ>
           bacterial cytoplasm --- Certainty = 0.0000(Not Clear) < succ>
```

An alignment of the GAS and GBS proteins is shown below.

```
Identities = 74/214 (34%), Positives = 112/214 (51%), Gaps = 5/214 (2%)

Query:  13 NESENNFFITLKTYFNYLFSIQIIT---DISTLNHADFDGSFAFHDIETSIPHLVIDSNY   69
           N+ E  F    L  +F++LF + I+T    +I +    + F G F+FH+ +   +P L    ++
Sbjct:  15 NQLEETFIRELSHHFSHLFEVTILTSKANIQSNQLSTFQGIFSFHEHDIDLPTLYFKTSQ   74

Query:  70 LAISQTNSKIEANDIKTFSELSKTMTEFHYMLNFDLFNHLPYRFRLHNKDGQTIYSNHKP  129
              ++    +        LS+ +T F+   +       +LP + RL + +G   I    NH
Sbjct:  75 HGQGFLVTESVFDQATAVLSLSQYLTGFYQKFDGHFLQYLPLQARLSDANGNIIVDNHAF  134

Query: 130 EDPFDIYPEEEYPIDKWVQNSLIEKKAKELHLLLPSASQDYILVQSYKRLENDSGQLVGY  189
               F   P +  I+ W+    L          LLPS S D+I +Q Y+ L+N   GQLVG
Sbjct: 135 NGSF--LPTTDKEIEDWILAELRLSDNPCKTFLLPSGSLDHIYMQHYQALKNPQGQLVGV  192

Query: 190 IEHVHNIKPLLEGYLKESGQAIVGWSDVTSGASI                           223
           ++ V +IKPLL   YL+E+GQAIVGWSDVTSG SI
Sbjct: 193 LDTVQDIKPLLNQYLEETGQAIVGWSDVTSGPSI                           226
```

Based on this analysis, it was predicted that these proteins and their epitopes could be useful antigens for vaccines or diagnostics.

EXAMPLE 2144

A DNA sequence (GBSx2260) was identified in *S. agalactiae* <SEQ ID 6623> which encodes the amino acid sequence <SEQ ID 6624>. Analysis of this protein sequence reveals the following:

```
Possible site: 18
>>> Seems to have an uncleavable N-term signal seq
    INTEGRAL      Likelihood = -12.10     Transmembrane   431-447 (423-452)
    INTEGRAL      Likelihood =  -8.92     Transmembrane   149-165 (147-174)
    INTEGRAL      Likelihood =  -8.86     Transmembrane   404-420 (402-428)
    INTEGRAL      Likelihood =  -7.91     Transmembrane   299-315 (293-318)
    INTEGRAL      Likelihood =  -6.42     Transmembrane   380-396 (374-398)
    INTEGRAL      Likelihood =  -5.31     Transmembrane   350-366 (347-367)
    INTEGRAL      Likelihood =  -4.57     Transmembrane    56-72  (54-74)
    INTEGRAL      Likelihood =  -3.24     Transmembrane   172-188 (171-198)
    INTEGRAL      Likelihood =  -1.33     Transmembrane   224-240 (224-240)
    INTEGRAL      Likelihood =  -0.59     Transmembrane   101-117 (101-117)
```

-continued

```
----- Final Results -----
            bacterial membrane --- Certainty = 0.5840(Affirmative) < succ>
            bacterial outside --- Certainty = 0.0000(Not Clear) < succ>
          bacterial cytoplasm --- Certainty = 0.0000(Not Clear) < succ>
```

The protein has homology with the following sequences in the GENPEPT database.

```
>GP: AAF84709 GB: AE004010 potassium uptake protein [Xylella
fastidiosa]
Identities = 201/570 (35%), Positives 319/570 (55%), Gaps = 34/570 (5%)

Query:   1 MAEMQHVNHSSFDKASKAGFII--ALGIVYGDIGTSPLYTMQSLVENQGGISSVTESFIL   58
           M+   H    +  ++   G II  A+G+V+GDIGTSPLYT++        G++   ++ +L
Sbjct:   1 MSTSSHSGDCTAVPSNSNGTIILSAIGVVFGDIGTSPLYTLKEAFSPNYGLTPNHDT-VL   59

Query:  59 GSISLIIWTLTLITTIKYVLVALKADNHHEGGIFSLYTLVRKMTPW-------LIVPAVI  111
           G +SLI W + L+ TIKYV V ++ DN  EGGI +L  L ++   P+         + +  +
Sbjct:  60 GILSLIFWAMMLVVTIKYVAVIMRVDNDGEGGIMALTALTQRTMPFGSRSIYIVGILGIF  119

Query: 112 GGATLLSDGALTPAVTVTSAVEGLKVVPSLQHIFQNQSNVIFATLFILLLLFAIQRFGTG  171
           G +    DG +TPA++V SAVEGL+V         F    V+  TL  +L+LLF  QRFGT
Sbjct: 120 GTSLFFGDGVITPAISVLSAVEGLEVAEPHMKAF-----VVPITLAVLILLFLCQRFGTE  174

Query: 172 VIGKLFGPIMFIWFAFLGISGLLNSFAHPEVFKAINPYYGLKLLFSPENHKGIFILGSIF  231
            +GK FGPI  +WF  +G+ G+ N     PEV  AINP +GL    F         +F+LG++
Sbjct: 175 RVGKTFGPITLLWFIAIGVVGVYNIAQAPEVLHAINPSWGLH-FFLEHGWHSMFVLGAVV  233

Query: 232 LATTGAEALYSDLGHVGRGNIHVSWPFVKVAII-LSYCGQGAWILANKNAGNELNPFFAS  290
           LA  TG  EALY+D+ GH G     I  +W +V  +  ++   L+Y GQGA  +L+N  A         NPF+  S
Sbjct: 234 LAVTGGEALYADMGHFGAKAIRHAWMYVVLPMLALNYLGQGALVLSNPTAIG--NPFYQS  291

Query: 291 IPSQFTMHVVILATLAAIIASQALISGSFTLVSEAMRLKIFPQFRSTYPGDN-IGQTYIP  349
           IP        ++  LAT  AA+IASQALI+GS++L  S+AM+L     P+        +  IGQ Y+P
Sbjct: 292 IPDWGLYPMIALATAAAVIASQALITGSYSLSSQAMQLGYIPRMNVRHTSQSTIGQIYVP  351

Query: 350 VINWFLFAITTSIVLLFKTSAHMEAAYGLAITITMLMTTILLSFFL-IQKGVKRGLVLLM  408
            +NW  L   +    V+ F  S   M +AYG+A+T TM++TT+L+   +           V R  ++   +M
Sbjct: 352 TVNWTLLTLVILTVIGFGDSTSMASAYGVAVTGTMMITTVLMIIYARANPRVPRLMLWMM  411

Query: 409 MIFFGILEGIFFLASAVKFMHGGYVVVIIAVAIIFIMTIWYKGSKIVSRYVKL--LDLKD  466
              I F    ++G FF A+   +KFM G +        +++ V I      M       W +G K++      ++L +
Sbjct: 412 AIVFIAVDGAFFYANIIKFMDGAWFPLLLGVVIFTFMRTWLRGRKLLHEEMRKDGINLDN  471

Query: 467 YIGQLDKLRHDHRYPIYHTNVVYLTNRMEEDMIDKSIMYSILDKRPKKAQVYWFVNIKVT  526
              ++    L   L      +  P       V+LT      +   ++    ++M+++    +        F+  +K
Sbjct: 472 FLPGL-MLAPPVKVP---GTAVFLT--ADSTVVPHALMHNLKHNKVLHERNV-FLTVKTL  524

Query: 527 DEPYTA---EYKVDMMGTDFIVKVELYLGF                               553
             PY A       K++  +   F  +V  +  GF
Sbjct: 525 KIPYAANSERLKIEPISNGF-YRVHIRFGF                               553
```

45

A related DNA sequence was identified in *S. pyogenes* <SEQ ID 6625> which encodes the amino acid sequence <SEQ ID 6626>. Analysis of this protein sequence reveals the following:

```
Possible site: 15
>>> Seems to have an uncleavable N-term signal seq
    INTEGRAL    Likelihood = -11.78    Transmembrane    428-444 (421-453)
    INTEGRAL    Likelihood = -8.70     Transmembrane    146-162 (144-171)
    INTEGRAL    Likelihood = -7.64     Transmembrane    404-420 (398-426)
    INTEGRAL    Likelihood = -4.88     Transmembrane    296-312 (294-315)
    INTEGRAL    Likelihood = -4.57     Transmembrane     53-69  (51-71)
    INTEGRAL    Likelihood = -3.93     Transmembrane    347-363 (343-363)
    INTEGRAL    Likelihood = -2.50     Transmembrane    372-388 (371-388)
    INTEGRAL    Likelihood = -1.33     Transmembrane    169-185 (169-185)
    INTEGRAL    Likelihood = -1.33     Transmembrane    221-237 (221-237)

----- Final Results -----
            bacterial membrane --- Certainty = 0.5713(Affirmative) < succ>
            bacterial outside --- Certainty = 0.0000(Not Clear) < succ>
          bacterial cytoplasm --- Certainty = 0.0000(Not Clear) < succ>
```

65

The protein has homology with the following sequences in the databases:

```
>GP: AAF84709 GB: AE004010 potassium uptake protein [Xylella fastidiosa]
Identities = 177/467 (37%), Positives = 270/467 (56%), Gaps = 20/467 (4%)
Query:   7 TAFDKASKAGFII-ALGIVYGDIGTSPLYTIQSLVENQGGVNQVSESFILGSISLIIWTL    65
             TA    S    I+A+G+V+GDIGTSPLYT++          G+    ++ +LG +SLI W +
Sbjct:  11 TAVPSNSNGTIILSAIGVVFGDIGTSPLYTLKEAFSPNYGLTPNHDT-VLGILSLIFWAM    69

Query:  66 TLITTIKYVLIALKADNHHEGGIFSLFTLVRKMSPW-------LIIPAMIGGATLLSDGA   118
             L+ TIKYV + ++ DN EGGI +L L ++ P+       + I  + G +    DG
Sbjct:  70 MLVVTIKYVAVIMRVDNDGEGGIMALTALTQRTMPFGSRSIYIVGILGIFGTSLFFGDGV   129

Query: 119 LTPAVTVTSAIEGLKAVPGLSHIYQNQTNVIITTLVILIVLFGIQRFGTGFIGKIFGPVM   178
             +TPA++V SA+EGL+          +   V+ TL +LI+LF QRFGT  +GK FGP+
Sbjct: 130 ITPAISVLSAVEGLEVAEPHMKAF-----VVPITLAVLILLFLCQRFGTERVGKTFGPIT   184

Query: 179 FIWFSFLGVSGFFNTLGHLEIFKAINPYYALHLLFSPENHRGIFILGSIFLATTGAEALY   238
              +WF  +GV G +N     E+  AINP + LH  F        +F+LG++ LA TG EALY
Sbjct: 185 LLWFIAIGVVGVYNIAQAPEVLHAINPSWGLH-FFLEHGWHSMFVLGAVVLAVTGGEALY   243

Query: 239 SDLGHVGRGNIYVSWPFVKM-CIVLSYCGQAAWILANKHSGIELNPFFASVPSQLRVYLV   297
             +D+GH G   I  +W +V +   + L+Y GQ A +L+N +    NPF+ S+P      ++
Sbjct: 244 ADMGHFGAKAIRHAWMYVVLPMLALNYLGQGALVLSNPTA--IGNPFYQSIPDWGLYPMI   301

Query: 298 SLATLAAIIASQALISGSFTLVSEAMRLKIFPLFRVTYPG-ANLGQLYIPVINWILFAVT   356
              +LAT AA+IASQALI+GS++L S+AM+L    P   V +    +GQ+Y+P +NW L   +
Sbjct: 302 ALATAAAVIASQALITGSYSLSSQAMQLGYIPRMNVRHTSQSTIGQIYVPTVNWTLLTLV   361

Query: 357 SCTVLAFRTSAHMEAAYGLAITITMLMTTILLKYYLIKKGTRPILAHLVMAF-FALVEFI   415
                TV+ F  S  M +AYG+A+T TM++TT+L+  Y         P L  +MA  F  V+
Sbjct: 362 ILTVIGFGDSTSMASAYGVAVTGTMMITTVLMIIYARANPRVPRLMLWMMAIVFIAVDGA   421

Query: 416 FFLASAIKFMHGGYAVVILALAIVFVMFIWHAGTRIVFKYVKSLNLN               462
             FF A+ IKFM G +   ++L + I    M  W  G +++ + ++     +N
Sbjct: 422 FFYANIIKFMDGAWFPLLLGVVIFTFMRTWLRGRKLLHEEMRKDGIN               468
```

An alignment of the GAS and GBS proteins is shown below.

```
Identities = 485/651 (74%), Positives = 575/651 (87%)
Query:  10 SSFDKASKAGFIIALGIVYGDIGTSPLYTMQSLVENQGGISSVTESFILGSISLIIWTLT    69
             ++FDKASKAGFIIALGIVYGDIGTSPLYT+QSLVENQGG++ V+ESFILGSISLIIWTLT
Sbjct:   7 TAFDKASKAGFIIALGIVYGDIGTSPLYTIQSLVENQGGVNQVSESFILGSISLIIWTLT    66

Query:  70 LITTIKYVLVALKADNHHEGGIFSLYTLVRKMTPWLIVPAVIGGATLLSDGALTPAVTVT   129
             LITTIKYVL+ALKADNHHEGGIFSL+TLVRKN+PWLI+PA+IGGATLLSDGALTPAVTVT
Sbjct:  67 LITTIKYVLIALKADNHHEGGIFSLFTLVRKMSPWLIIPAMIGGATLLSDGALTPAVTVT   126

Query: 130 SAVEGLKVVPSLQHIFQNQSNVIFATLFILLLLLFAIQRFGTGVIGKLFGPIMFIWFAFLG   189
             SA+EGLK VP L HI+QNQ+NVI  TL IL++LF IQRFGTG IGK+FGP+MFIWF+FLG
Sbjct: 127 SAIEGLKAVPGLSHIYQNQTNVIITTLVILIVLFGIQRFGTGFIGKIFGPVMFIWFSFLG   186

Query: 190 ISGLLNSFAHPEVFKAINPYYGLKLLFSPENHKGIFILGSIFLATTGAEALYSDLGHVGR   249
              +SG  N+  H E+FKAINPYY L LLFSPENH+GIFILGSIFLATTGAEALYSDLGHVGR
Sbjct: 187 VSGFFNTLGHLEIFKAINPYYALHLLFSPENHRGIFILGSIFLATTGAEALYSDLGHVGR   246

Query: 250 GNIHVSWPFVKVAIILSYCGQGAWILANKNAGNELNPFFASIPSQFTMHVVILATLAAII   309
             GNI+VSWPFVK+ I+LSYCGQ AWILANK++G ELNPFFAS+PSQ   +V LATLAAII
Sbjct: 247 GNIYVSWPFVKMCIVLSYCGQAAWILANKHSGIELNPFFASVPSQLRVYLVSLATLAAII   306

Query: 310 ASQALISGSFTLVSEAMRLKIFPQFRSTYPGDNIGQTYIPVINWFLFAITTSIVLLFKTS   369
             ASQALISGSFTLVSEAMRLKIFP FR TYPG N+GQ YIPVINW LFA+T+  VL F+TS
Sbjct: 307 ASQALISGSFTLVSEAMRLKIFPLFRVTYPGANLGQLYIPVINWILFAVTSCTVLAFRTS   366

Query: 370 AHMEAAYGLAITITMLMTTILLSFFLIQKGVKRGLVLLMMIFFGILEGIFFLASAVKFMH   429
             AHMEAAYGLAITITMLMTTILL ++LI+KG + L  L+M FF ++E IFFLASA+KFMH
Sbjct: 367 AHMEAAYGLAITITMLMTTILLKYYLIKKGTRPILAHLVMAFFALVEFIFFLASAIKFMH   426

Query: 430 GGYVVVIIAVAIIFIMTIWYKGSKIVSRYVKLLDLKDYIGQLDKLRHDHRYPIYRTNVVY   489
             GGY VVI+A+AI+F+M IW+ G++IV +YVK L+L DY Q+ +LR D   +Y TNVVY
Sbjct: 427 GGYAVVILALAIVFVMFIWHAGTRIVFKYVKSLNLNDYKEQIKQLRDDVCFDLYQTNVVY   486

Query: 490 LTNRMEEDMIDKSIMYSILDKRPKKAQVYWFVNIKVTDEPYTAEYKVDMMGTDFIVKVEL   549
             L+NRM++ MID+SI+YSILDKRPK+AQVYWFVN++VTDEPYTA+YKVDMMGTD++V+V L
Sbjct: 487 LSNRMQDHMIDRSILYSILDKRPKRAQVYWFVNVQVTDEPYTAKYKVDMMGTDYMVRVNL   546

Query: 550 YLGFKMRQTVSRYLRTIVEELLESGRLPKQGKTYSVRPDSNVGDFRFIVLDERFSSQNL   609
             YLGF+M QTV RYLRTIV++L ESGRLPKQ + Y++ P +VGDFRF++++ER S+++ L
Sbjct: 547 YLGFRMPQTVPRYLRTIVQDLMESGRLPKQEQEYTITPGRDVGDFRFVLIEERVSNARQL   606
```

```
                              -continued
Query: 610 KPGERFVMLMKSSIKHWTATPIRWFGLQFSEVTTEVVPLIFTANRGLPIKE          660
            ERF+M  K+SIKH TA+P+RWFGLQ+SEVT EVVPLI +    LPIKE
Sbjct: 607 SNFERFIMQTKASIKHVTASPMRWFGLQYSEVTLEVVPLILSDVLKLPIKE          657
```

5

A related GBS gene <SEQ ID 8983> and protein <SEQ ID 8984> were also identified. Analysis of this protein sequence reveals the following:

```
Lipop: Possible site: -1 Crend: 8
McG: Discrim Score: 5.84
GvH: Signal Score (-7.5): -4.59
     Possible site: 18
>>> Seems to have an uncleavable N-term signal seq
ALOM program count: 10 value: -12.10 threshold: 0.0

INTEGRAL        Likelihood = -12.10     Transmembrane    431-447 (423-452)
    INTEGRAL        Likelihood =  -8.92     Transmembrane    149-165 (147-174)
    INTEGRAL        Likelihood =  -8.86     Transmembrane    404-420 (402-428)
    INTEGRAL        Likelihood =  -7.91     Transmembrane    299-315 (293-318)
    INTEGRAL        Likelihood =  -6.42     Transmembrane    380-396 (374-398)
    INTEGRAL        Likelihood =  -5.31     Transmembrane    350-366 (347-367)
    INTEGRAL        Likelihood =  -4.57     Transmembrane     56-72  (54-74)
    INTEGRAL        Likelihood =  -3.24     Transmembrane    172-188 (171-198)
    INTEGRAL        Likelihood =  -1.33     Transmembrane    224-240 (224-240)
    INTEGRAL        Likelihood =  -0.59     Transmembrane    101-117 (101-117)
    PERIPHERAL      Likelihood =  -0.85            20
modified ALOM score: 2.92

*** Reasoning Step: 3

----- Final Results -----
            bacterial membrane  --- Certainty = 0.5840(Affirmative) < succ>
             bacterial outside  --- Certainty = 0.0000(Not Clear)   < succ>
           bacterial cytoplasm  --- Certainty = 0.0000(Not Clear)   < succ>
```

The protein has homology with the following sequences in the databases:

```
ORF02578(367-1680 of 2607)
GP|9106998|gb|AAF84709.1|AE004010_6|AE004010(25-463 of 634)potassium uptake
protein{Xylella fastidiosa}
% Match = 17.8
% Identity = 40.4  % Similarity = 63.7
Matches = 177  Mismatches = 150  Conservative Sub.s = 102

180       210       240       270       300       330       360       390
TSTCLS*LK**RPGNALIISGLFIDKCCFFNLICYNEFSHFFD*YYLIGGLAEMQHVNHSSFDKASKAGFIIALGIVYGD
                                                           |:|:|:||
                                           MSTSSHSGDCTAVPSNSNGTIILSAIGVVFGD
                                                      10        20        30

420       450       480       510       540       570       600       612
IGTSPLYTMQSLVENQGGISSVTESFILGSISLIIWTLTLITTIKYVLVALKADNHHEGGIFSLYTLVRKMTP------W
|||||||::      |::    ::  :|  :|||  | :|: |||||    ::  ||    ||||:|   |::  |    :
IGTSPLYTLKEAFSPNYGLTPNHDT-VLGILSLIFWAMMLVVTIKYVAVIMRVDNDGEGGIMALTALTQRTMPFGSRSIY
         50        60        70        80        90       100       110

639       669       699       729       759       789       819       849
LI-VPAVIGGATLLSDGALTPAVTVTSAVEGLKVVPSLQHIFQNQSNVIFATLFILLLLFAIQRFGTGVIGKLFGPIMFI
::   :   :  |  :  ||:|||::| |||||| :|           :  ::  |:   ||  ||:|:||||    :: 
IVGILGIFGTSLFFGDGVITPAISVLSAVEGLEV----AEPHMKAVFVVPITLAVLILLFLCQRGFTERVGKTFGPITLL
           130       140       150       160       170       180

879       909       939       969       999      1029      1059      1089
WFAFLGISGLLNSFAHPEVFKAINPYYGLKLLFSPENHKGIFILGSIFLATTGAEALYSDLGHVGRGNIHVSWPFVKVAI
||   :|:|:      |||: ||||:|| ::       |   :|:||:  ||  ||||||:|::|    |   :|: ::
WFIAIGVVGVYNIAQAPEVLHAINPSWGLHFFLEHGWHS-MFVLGAVVLAVTGGEALYADMGHFGAKAIRHAWMYVVLPM
     200       210       220       230       240       250       260

1116      1146      1176      1206      1236      1266      1296      1326
I-LSYCGQGAWILANKNAGNELNPFFASIPSQFTMHVVILATLAAIIASQALISGSFTLVSEAMRLKIFPQFRSTYPGDN
: |:|  ||||  :|:|      |||: |||      :: |||:||||||:||:||:  |::|  |:|  |:    :  
LALNYLGQGALVLSNPTA--IGNPFYQSIPDWGLYPMIALATAAAVIASQALITGSYSLSSQAMQLGYIPRMNVRHTSQS
      280       290       300       310       320       330       340
```

```
1353      1383      1413      1443      1473      1500      1530      1560
-IGQTYIPVINWFLFAITTSIVLLFKTSAHMEAAYGLAITITMLMTTILLSFFL-IQKGVKRGLVLLMMIFFGILEGIFF
 ||| |: :||  |: :        |: |   |   | :|||:|: ||::||:|:  :      |  | :: :|   ::| ||
TIGQIYVPTVNWTLLTLVILTVIGFGDSTSMASAYGVAVTGTMMITTVLMIIYARANPRVPRLMLWMMAIVFIAVDGAFF
           360       370       380       390       400       410       420

1590      1620      1650      1680      1710      1740      1770      1800
LASAVKFMHGGYVVVIIAVAIIFIMTIWYKGSKIVSRYVKLLDLKDYIGQLDKLRHDHRYPIYHTNVVYLTNRMEEDMID
 |: :|||  |  :  ::: | |    |   | :| |::     ::
YANIIFKMDGAWFPLLLGVVIFTFMRTWLRGRKLLHEEMRKDGINLDNFLPGLMLAPPVKVPGTAVFLTADSTVVPHALM
           440       450       460       470       480       490       500
```

Based on this analysis, it was predicted that these proteins and their epitopes could be useful antigens for vaccines or diagnostics.

EXAMPLE 2145

A DNA sequence (GBSx2261) was identified in *S. agalactiae* <SEQ ID 6627> which encodes the amino acid sequence <SEQ ID 6628>. This protein is predicted to be serine dehydrogenase. Analysis of this protein sequence reveals the following:

```
Possible site: 26
>>> Seems to have no N-terminal signal sequence

----- Final Results -----
         bacterial cytoplasm --- Certainty = 0.3261(Affirmative) < succ>
         bacterial membrane  --- Certainty = 0.0000(Not Clear)   < succ>
          bacterial outside  --- Certainty = 0.0000(Not Clear)   < succ>
```

The protein has homology with the following sequences in the GENPEPT database.

```
>GP: AAD07424 GB: AE000552 short chain alcohol
dehydrogenase
            [Helicobacter pylori 26695]
Identities = 18/31 (58%), Positives = 25/31 (80%)
Query:   3  WVASQPEHININRIEIMPVSQTYGPQPVYRD   33
```

```
            W+  QP H+NINRIEIMP+SQT+ P P +++
Sbjct: 219  WIYEQPLHVNINRIEIMPISQTFAPLPTHKN   249
```

A related DNA sequence was identified in *S. pyogenes* <SEQ ID 6629> which encodes the amino acid sequence <SEQ ID 6630>. Analysis of this protein sequence reveals the following:

```
Possible site: 21
>>> Seems to have no N-terminal signal sequence

----- Final Results -----
         bacterial cytoplasm --- Certainty = 0.1021(Affirmative) < succ>
         bacterial membrane  --- Certainty = 0.0000(Not Clear)   < succ>
          bacterial outside  --- Certainty = 0.0000(Not Clear)   < succ>
```

An alignment of the GAS and GBS proteins is shown below.

```
Identities = 24/33 (72%), Positives = 29/33 (87%)
Query:   1  MSWVASQPEHININRIEIMPVSQTYGPQPVYRD   33
            +SWV  QP H+N+NRIE+MPVSQ+YGPQPV RD
Sbjct:  20  VSWVIHQPPHVNVNRIELMPVSQSYGPQPVTRD   52
```

Based on this analysis, it was predicted that these proteins and their epitopes could be useful antigens for vaccines or diagnostics.

EXAMPLE 2146

A DNA sequence (GBSx2262) was identified in *S. agalactiae* <SEQ ID 6631> which encodes the amino acid sequence <SEQ ID 6632>. Analysis of this protein sequence reveals the following:

```
Possible site: 21
>>> May be a lipoprotein

----- Final Results -----
           bacterial membrane --- Certainty = 0.0000(Not Clear) < succ>
            bacterial outside --- Certainty = 0.0000(Not Clear) < succ>
          bacterial cytoplasm --- Certainty = 0.0000(Not Clear) < succ>
```

A related GBS nucleic acid sequence <SEQ ID 9337> which encodes amino acid sequence <SEQ ID 9338> was also identified. A further related GBS nucleic acid sequence <SEQ ID 10781> which encodes amino acid sequence <SEQ ID 10782> was also identified. A further related GBS nucleic acid sequence <SEQ ID 10951> which encodes amino acid sequence <SEQ ID 10952> was also identified.

The protein has homology with the following sequences in the GENPEPT database.

```
>GP: CAA32349 GB: X14130 ORF (AA 1 to 299) [Lactococcus lactis subsp.
        cremoris]
Identities = 72/215 (33%), Positives = 110/215 (50%), Gaps = 8/215 (3%)
Query:   4 RSKLAAGFLTLMSVATLAACSGKTSNGTN--VVTMKGDTITVSDFYDQVKTSKAAQQSML   61
             + K+    L  +   L   SG  SN T+  V T G +T S FY ++K S   +  +
Sbjct:   2 KKKMRLKVLLASTATALLLLSGCQSNQTDQTVATYSGGKVTESSFYKELKQSPTTKTMLA   61

Query:  62 TLILSRVFDTQYGDKVSDKKVSEAYNKTAKGYGNSFSSALSQAGLTPEGYKQQIRTTMLV  121
             +++R  +    YG  VS K V++AY+   + YG +F + LSQ G +    +K+ +RT  L
Sbjct:  62 NMLIYRALNHAYGKSVSTKTVNDAYDSYKQQYGENFDAFLSQNGFSRSSFKESLRTNFLS  121

Query: 122 EYAVKEAAKKELTEANYKEAYKNYTPETSVQVIKLDAEDKAKSVLKDVKADGADFAKIAK  181
             E A+K+   K+++E+   K A+K Y P+  +VQ I    ED AK V+ D+ A G DFA +AK
Sbjct: 122 EVALKKL--KKVSESQLKAAWKTYQPKVTVQHILTSDEDTAKQVISDLAA-GKDFAMLAK  178

Query: 182 E---KTTATDKKVEYKFDSAGTTLPKEVMSAAFKL                          213
                  T   D  +  F+  TL      AA+KL
Sbjct: 179 TDSIDTATKDNGGKISFELNNKTLDATFKDAAYKL                          213
```

A related DNA sequence was identified in *S. pyogenes* <SEQ ID 6633> which encodes the amino acid sequence <SEQ ID 6634>. Analysis of this protein sequence reveals the following:

```
Possible site: 21
>>> May be a lipoprotein

----- Final Results -----
           bacterial membrane --- Certainty = 0.0000(Not Clear) < succ>
            bacterial outside --- Certainty = 0.0000(Not Clear) < succ>
          bacterial cytoplasm --- Certainty = 0.0000(Not Clear) < succ>
```

The protein has homology with the following sequences in the databases:

```
>GP: AAA25247 GB: M83946 maturation protein [Lactobacillus paracasei]
Identities = 88/294 (29%), Positives = 146/294 (48%), Gaps = 14/294 (4%)

Query:   7 LIASVVTLASVMALAACQSTNDNTKVISMKGDTISVSDFYNETKNTEVSQKAMLNLVISR   66
             L+AS  T  +++ L+ CQS    + KV +  G   ++ S+FY E K +  ++  + N++I R
Sbjct:  10 LLASTAT--ALLLLSGCQSNQADQKVATYSGGKVTESNFYKELKQSPTTKTMLANMLIYR   67

Query:  67 VFEAQYGDKVSKKEVEKAYHKTAEQYGASFSAALAQSSLTPETFKRQIRSSKLVEYAVKE  126
                YG  VS K V  AY      +QYG +F A L+Q+  +     +FK  +R++ L E A+K+
Sbjct:  68 ALNHAYGKSVSTKTVNDAYDSYKQQYGENFDAFLSQNGFSRSSFKESLRTNFLSEVALKK  127

Query: 127 AAKKELTTQEYKKAYESYTPTMAVEMITLDNEETAKSVLEELKAEGADFTAIAKE---KT  183
             K+++  + K   +++Y P + V+  I   +E+TAK V+ +L A G DF  +AK     T
Sbjct: 128 L--KKVSESQLKAVWKTYQPKVTVQHILTSDEDTAKQVISDL-AAGKDFATLAKTDSIDT  184

Query: 184 TTPEKKVTYKFDSGATNVPTDVVKAASSLNEGGISDVISVLDPTSYQKKFYIVKVTKKAE  243
             T +      F+S   +          AA  L  G +       P        +  ++K+
Sbjct: 185 ATKDNGGKISFESNNKTLDATFKDAAYKLKNGDYTQT-----PVKVTNGYEVIKMINH-P  238

Query: 244 KKSDWQEYKKRLKAIIAEKSKDMNFQNKVIANALDKANVKIKDKAFANILAQY         297
             K    +   KK  L A + A+  S+D +     +VI+    L  +V IKDK A+  L  Y
Sbjct: 239 AKGTFTSSKKALTASVYAKWSRDSSIMQRVISQVLKNQHVTIKDKDLADALDSY         292
```

An alignment of the GAS and GBS proteins is shown below.

```
Identities = 125/213 (58%), Positives = 168/213 (78%), Gaps = 1/213 (0%)

Query:     1 MKTRSKLAAGFLTLMSVATLAACSGKTSNGTNVVTMKGDTITVSDFYDQVKTSKAAQQSM   60
             MK  +KL A  +TL SV  LAAC    T++ T V++MKGDTI+VSDFY++ K ++ +Q++M
Sbjct:     1 MKNSNKLIASVVTLASVMALAACQS-TNDNTKVISMKGDTISVSDFYNETKNTEVSQKAM   59

Query:    61 LTLILSRVFDTQYGDKVSDKKVSEAYNKTAKGYGNSFSSALSQAGLTPEGYKQQIRTTML  120
             L L++SRVF+ QYGDKVS K+V +AY+KTA+ YG SFS+AL+Q+ LTPE +K+QIR++ L
Sbjct:    60 LNLVISRVFEAQYGDKVSKKEVEKAYHKTAEQYGASFSAALAQSSLTPETFKRQIRSSKL  119

Query:   121 VEYAVKEAAKKELTEANYKEAYKNYTPETSVQVIKLDAEDKAKSVLKDVKADGADFAKIA  180
             VEYAVKEAAKKELT   YK+AY++YTP  +V++I LD E+ AKSVL+++KA+GADF  IA
Sbjct:   120 VEYAVKEAAKKELTTQEYKKAYESYTPTMAVEMITLDNEETAKSVLEELKAEGADFTAIA  179

Query:   181 KEKTTATDKKVEYKFDSAGTTLPKEVMSAAFKL                            213
             KEKTT  +KKV YKFDS  T +P +V+ AA  L
Sbjct:   180 KEKTTTPEKKVTYKFDSGATNVPTDVVKAASSL                            212
```

Figure 143:
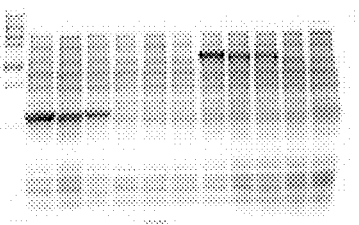
Figure 144:
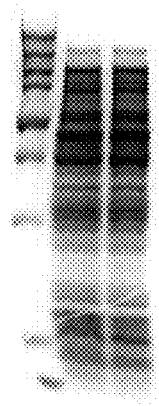

SEQ ID 10782 (GBS657) was expressed in *E. coli* as a GST-fusion product. SDS-PAGE analysis of total cell extract is shown in FIG. 143 (lane 8-10; MW 62.8 kDa) and in FIG. 187 (lane 3; MW 63 kDa).

Purified GBS657-GST is shown in FIG. 245, lanes 2 & 3.

Based on this analysis, it was predicted that these proteins and their epitopes could be useful antigens for vaccines or diagnostics.

EXAMPLE 2147

A DNA sequence (GBSx2263) was identified in *S. agalactiae* <SEQ ID 6635> which encodes the amino acid sequence <SEQ ID 6636>. This protein is predicted to be methyltransferase. Analysis of this protein sequence reveals the following:

```
Possible site: 44
>>> Seems to have no N-terminal signal sequence

----- Final Results -----
              bacterial cytoplasm --- Certainty = 0.2576(Affirmative) < succ>
              bacterial membrane  --- Certainty = 0.0000(Not Clear)   < succ>
              bacterial outside   --- Certainty = 0.0000(Not Clear)   < succ>
```

The protein has homology with the following sequences in the GENPEPT database.

```
>GP: CAA68045 GB: X99710 methyltransferase [Lactococcus lactis]
Identities = 132/227 (58%), Positives = 169/227 (74%)

Query:     1 MVQSYSKNANHNMRRPVVKEEIVQYMRQHQKQNNGCLAELEAFAKQENIPIIPHETATYF   60
             MV++Y    +N M RPVVK E+V++MR  Q Q  G LAE+  FAK+ NIP+IPHET  YF
Sbjct:     1 MVETYKSTSNPMMNRPVVKAELVEWMRSSQTQVTGELAEVLNFAKENNIPVIPHETVLYF   60

Query:    61 RFLMQTLQPKHILEIGTAIGFSALLMAENAPEAKITTIDRNEEMIALAKENFAKYDNHNQ  120
             + L+   L+PK  ILEIGTAIGFSAL+MA+  PEA+I TIDRN EMI LAK+N AKYD+ NQ
Sbjct:    61 QMLLSLLKPKRILEIGTAIGFSALVMAQEVPEAEIVTIDRNPEMIELAKKNLAKYDHRNQ  120

Query:   121 ITLLEGDAVDVLQTLDKSYDFVFMDSAKSKYIVFLPQVLKHLDVGGVVVLDDIFQGGDIA  180
             I L  EGDA DVLQ L   +D VFMDSAKSKY+  FLP+ L+ L     G++++DD+FQ G+I
Sbjct:   121 IQLKEGDAADVLQELKGPFDLVFMDSAKSKYVEFLPKSLELLSENGLILMDDVFQAGEIL  180

Query:   181 KPIDEVRRGQRTIYRGLQRLFDSTLQHPDLTATLVPLGDGLLMIRKN               227
             +PI EV+R QR + RGL++LFD    +P    +++PLGDGLLMI+K+
Sbjct:   181 LPIMEVKRNQRALERGLRKLFDEVFDNPKYMTSVLPLGDGLLMIKKH               227
```

A related DNA sequence was identified in *S. pyogenes* <SEQ ID 6637> which encodes the amino acid sequence <SEQ ID 6638>. Analysis of this protein sequence reveals the following:

```
Possible site: 46
>>> Seems to have no N-terminal signal sequence
    INTEGRAL     Likelihood = -1.38    Transmembrane   153-169 (152-170)
```

```
-continued
----- Final Results -----
             bacterial membrane --- Certainty = 0.1553(Affirmative) < succ>
             bacterial outside --- Certainty = 0.0000(Not Clear) < succ>
           bacterial cytoplasm --- Certainty = 0.0000(Not Clear) < succ>
```

The protein has homology with the following sequences in the databases:

```
>GP: CAA68045 GB: X99710 methyltransferase [Lactococcus lactis]
Identities = 134/227 (59%), Positives = 169/227 (74%)

Query:   1 MVKSYSKTANHNMRRPVVKEELVHYMRTRQKQTTGFLAELEQFARQENIPIIQPEVVAYF  60
           MV++Y  T+N  M RPVVK ELV +MR+ Q Q TG LAE+  FA++ NIP+I  E V YF
Sbjct:   1 MVETYKSTSNPMMNRPVVKAELVEWMRSSQTQVTGELAEVLNFAKENNIPVIPHETVLYF  60

Query:  61 RFLLQSLQPKHILEIGTAIGFSALLMAENAPDATIVTIDRNREMIDFAKANFAKYDSRQQ 120
           + LL  L+PK ILEIGTAIGFSAL+MA+  P+A IVTIDRN EMI+ AK N AKYD R Q
Sbjct:  61 QMLLSLLKPKRILEIGTAIGFSALVMAQEVPEAEIVTIDRNPEMIELAKKNLAKYDHRNQ 120

Query: 121 IRLLEGDAADILSTLEGNFDFVFMDSAKSKYIVFLPEILRLLKVGGVVILDDVFQGGDIT 180
           I+L EGDAAD+L  L+G FD VFMDSAKSKY+ FLP+ L LL   G++++DDVFQ G+I
Sbjct: 121 IQLKEGDAADVLQELKGPFDLVFMDSAKSKYVEFLPKSLELLSENGLILMDDVFQAGEIL 180

Query: 181 KPIEDIRRGQRTIYRGLQSLFDATLTHPNLTTSLVPLSDGLLMIRKN             227
            PI +++R QR + RGL+ LFD    +P   TS++PL DGLLMI+K+
Sbjct: 181 LPIMEVKRNQRALERGLRKLFDEVFDNPKYMTSVLPLGDGLLMIKKH             227
```

An alignment of the GAS and GBS proteins is shown below.

```
Identities = 177/235 (75%), Positives = 199/235 (84%)

Query:   1 MVQSYSKNANHNMRRPVVKEEIVQYMRQHQKQNNGCLAELEAFAKQENIPIIPHETATYF  60
           MV+SYSK ANHNMRRPVVKEE+V YMR  QKQ  G LAELE FA+QENIPII  E   YF
Sbjct:   1 MVKSYSKTANHNMRRPVVKEELVHYMRTRQKQTTGFLAELEQFARQENIPIIQPEVVAYF  60

Query:  61 RFLMQTLQPKHILEIGTAIGFSALLMAENAPEAKITTIDRNEEMIALAKENFAKYDNHNQ 120
           RFL+Q+LQPKHILEIGTAIGFSALLMAENAP+A I TIDRN EMI  AK NFAKYD+  Q
Sbjct:  61 RFLLQSLQPKHILEIGTAIGFSALLMAENAPDATIVTIDRNREMIDFAKANFAKYDSRQQ 120

Query: 121 ITLLEGDAVDVLQTLDKSYDFVFMDSAKSKYIVFLPQVLKHLDVGGVVVLDDIFQGGDIA 180
           I LLEGDA D+L TL+  ++DFVFMDSAKSKYIVFLP++L+ L VGGVV+LDD+FQGGDI
Sbjct: 121 IRLLEGDAADILSTLEGNFDFVFMDSAKSKYIVFLPEILRLLKVGGVVILDDVFQGGDIT 180

Query: 181 KPIDEVRRGQRTIYRGLQRLFDSTLQHPDLTATLVPLGDGLLMIRKNADHIVLED       235
           KPI+++RRGQRTIYRGLQ LFD+TL HP+LT +LVPL DGLLMIRKN   IVL D
Sbjct: 181 KPIEDIRRGQRTIYRGLQSLFDATLTHPNLTTSLVPLSDGLLMIRKNQADIVLPD       235
```

Based on this analysis, it was predicted that these proteins and their epitopes could be useful antigens for vaccines or diagnostics.

EXAMPLE 2148

A DNA sequence (GBSx2264) was identified in *S. agalactiae* <SEQ ID 6639> which encodes the amino acid sequence <SEQ ID 6640>. This protein is predicted to be phosphoglycolate phosphatase. Analysis of this protein sequence reveals the following:

```
Possible site: 50
>>> Seems to have no N-terminal signal sequence

----- Final Results -----
           bacterial cytoplasm --- Certainty = 0.2193(Affirmative) < succ>
             bacterial membrane --- Certainty = 0.0000(Not Clear) < succ>
             bacterial outside --- Certainty = 0.0000(Not Clear) < succ>
```

A related GBS nucleic acid sequence <SEQ ID 8985> which encodes amino acid sequence <SEQ ID 8986> was also identified. This protein appears to be a hydrolase i.e. an exposed protein.

The protein has homology with the following sequences in the GENPEPT database.

```
>GP: CAA91552 GB: Z67740 unidentified [Streptococcus pneumoniae]
Identities = 39/117 (33%), Positives = 67/117 (56%), Gaps = 9/117 (7%)

Query:   98 KEQESRDSKIHLM-PYAKEILEWTKEQDIPNFMYTHKGASTHSVLETLQISHYFDEILTG  156
            KE E+R+ +  ++       ++LE   Q   +F+ +H+       +LE   I+ YF E++T
Sbjct:   25 KENEARELEHPILFEGVSDLLEDILNQGGRHFLVSHRNDQVLEILEKTSIAAYFTEVVTS   84

Query:  157 VSGFERKPHPQGINYLVKRYSLDKSMTYYIGDRPLDLEVAQNAGIKS------INLR    207
            SGF+RKP+P+ + YL ++Y +   +   IGDRP+D+E  Q AG+ +         +NLR
Sbjct:   85 SSGFKRKPNPESMLYLREKYQISSGLV--IGDRPIDIEAGQAAGLDTHLFTSIVNLR    139
```

SEQ ID 8986 (GBS240) was expressed in *E. coli* as a His-fusion product. SDS-PAGE analysis of total cell extract is shown in FIG. 57 (lane 2; MW 26 kDa). It was also expressed in *E. coli* as a GST-fusion product. SDS-PAGE analysis of total cell extract is shown in FIG. 61 (lane 3; MW 51.5 kDa).

GBS240-GST was purified as shown in FIG. 225, lane 12.

Based on this analysis, it was predicted that this protein and its epitopes, could be useful antigens for vaccines or diagnostics.

EXAMPLE 2149

A DNA sequence (GBSx2265) was identified in *S. agalactiae* <SEQ ID 6641> which encodes the amino acid sequence <SEQ ID 6642>. Analysis of this protein sequence reveals the following:

```
Possible site: 36
>>> Seems to have no N-terminal signal sequence

----- Final Results -----
            bacterial cytoplasm --- Certainty = 0.2620(Affirmative) < succ>
            bacterial membrane  --- Certainty = 0.0000(Not Clear)   < succ>
             bacterial outside  --- Certainty = 0.0000(Not Clear)   < succ>
```

A related DNA sequence was identified in *S. pyogenes* <SEQ ID 6643> which encodes the amino acid sequence <SEQ ID 6644>. Analysis of this protein sequence reveals the following:

```
Possible site: 54
>>> Seems to have no N-terminal signal sequence

----- Final Results -----
            bacterial cytoplasm --- Certainty = 0.2967(Affirmative) < succ>
            bacterial membrane  --- Certainty = 0.0000(Not Clear)   < succ>
             bacterial outside  --- Certainty = 0.0000(Not Clear)   < succ>
```

An alignment of the GAS and GBS proteins is shown below.

```
Identities = 463/599 (77%), Positives = 541/599 (90%)

Query:   1 MSDNRSHIEEKYQWDLTTVFATDELWETEVVELTQAIDNAKGFSGHLLDSSQSLLEITEV   60
           M+DNRSH+EEKY WDL+T+FATD+ WE EV +L   ++ +KGF+GHLLDSS +LL++T+
Sbjct:   1 MTDNRSHLEEKYTWDLSTIFATDKDWEAEVSDLATEVEASKGFAGHLLDSSANLLKVTKT   60

Query:  61 ELDLSRRLEKVYVYASMKNDQDTTVAKYQEFQAKATALYAKFSETFSFYEPELLQLSESD  120
           L+L+RR+EKVYVYA MKNDQDTTVAKYQE+QAKA+ LYAKFSE FSFY+PE++ L + D
Sbjct:  61 YLELARRVEKVYVYAHMKNDQDTTVAKYQEYQAKASGLYAKFSEVFSFYDPEVMMLHQED  120
```

-continued

```
Query: 121 YQSFLLEMPDLQKYDHFFEKIFANKPHVLSQNEEELLAGASEIFGAAGETFEILDNADMV 180
            YQ+FL E P+L+ Y+HFF+K+F  + HVLSQ EEELLAGA EIF A ETF ILDNAD+V
Sbjct: 121 YQAFLTETPELKVYNHFFDKLFQAREHVLSQAEEELLAGAQEIFNGAEETFSILDNADIV 180

Query: 181 FPVVKNAKGEEVELTHGNFISLMESSDRTVRKEAYQAMYSTYEQFQHTYAKTLQTNVKSQ 240
            FPVVKN KGE+VELTHGNFISLMES DR+VR+ AY+AMYSTYEQFQHTYAKTLQTNVK Q
Sbjct: 181 FPVVKNDKGEDVELTHGNFISLMESKDRSVRQAAYEAMYSTYEQFQHTYAKTLQTNVKVQ 240

Query: 241 NFKARVHHYQSARQSALSANFIPEEVYETLIKTVNHHLPLLHRYMKLRQKVLGLDDLKMY 300
            N+KARVH Y SARQ+A++ANFIPE VY+TL++TVN HLPLLHRY+KLRQ+VLGLDDLKMY
Sbjct: 241 NYKARVHKYDSARQAAMAANFIPEAVYDTLLETVNKHLPLLHRYLKLRQEVLGLDDLKMY 300

Query: 301 DVYTPLSQMDMSFTYDEALKKSEEVLAIFGEAYSERVHRAFTERWIDVHVNKGKRSGAYS 360
            DVYTPLS+ D++  YDEAL+K+E+VLA+FG+ Y++RVHRAFTERWIDVHVNKGKRSGAYS
Sbjct: 301 DVYTPLSETDLAIGYDEALEKAEKVLAVFGKDYADRVHRAFTERWIDVHVNKGKRSGAYS 360

Query: 361 GGSYDTNAFMLLNWQDTLDNLYTLVHETGHSLHSTFTRENQPYVYGDYSIFLAEIASTTN 420
            GGSYDTNAF+LLNWQDTLDNLYTLVHETGHSLHSTFTRE QPYVYGDYSIFLAEIASTTN
Sbjct: 361 GGSYDTNAFILLNWQDTLDNLYTLVHETGHSLHSTFTRETQPYVYGDYSIFLAEIASTTN 420

Query: 421 ENILTETLLKEVKDDKNRFAILNHYLDGFKGTIFRQTQFAEFEHAIHVADQEGQVLTSEY 480
            ENI+TE LL EV+D+K RFAILNHYLDGF GT+FRQTQFAEFEHAIH ADQ+G+VLTSEY
Sbjct: 421 ENIMTEALLNEVQDEKERFAILNHYLDGFRGTVFRQTQFAEFEHAIHQADQKGEVLTSEY 480

Query: 481 LNNLYAELNEKYYGLTKEDNHFIQYEWARIPHFYYNYYVFQYATGFAAANYLAERIVNGN 540
            LN LYA+LNEKYYGL+K+DNHFIQYEWARIPHFYYNYYV+QYATGFAAA+YLA++IV+G
Sbjct: 481 LNQLYADLNEKYYGLSKKDNHFIQYEWARIPHFYYNYYVYQYATGFAAASYLADKIVHGT 540

Query: 541 PEDKEAYLNYLKAGNSDYPLNVIAKAGVDMTSADYLDAAFRVFEERLVELENLVAKGVH 599
            +D + YL YLK+GNSDYPL VIAKAGVDM   DYL+AAF+VF+ERL ELE LV+KG+H
Sbjct: 541 QDDIDHYLAYLKSGNSDYPLEVIAKAGVDMEKGDYLEAAFKVFDERLTELEVLVSKGIH 599
```

Based on this analysis, it was predicted that these proteins and their epitopes could be useful antigens for vaccines or diagnostics.

EXAMPLE 2150

A DNA sequence (GBSx2266) was identified in *S. agalactiae* <SEQ ID 6645> which encodes the amino acid sequence <SEQ ID 6646>. This protein is predicted to be competence protein. Analysis of this protein sequence reveals the following:

```
Possible site: 22
>>> Seems to have no N-terminal signal sequence

----- Final Results -----
            bacterial cytoplasm --- Certainty = 0.2955(Affirmative) < succ>
             bacterial membrane --- Certainty = 0.0000(Not Clear) < succ>
              bacterial outside --- Certainty = 0.0000(Not Clear) < succ>
```

The protein has homology with the following sequences in the GENPEPT database.

```
>GP: AAC23746 GB: AF052209 competence protein [Streptococcus pneumoniae]
Identities = 127/269 (47%), Positives = 176/269 (65%), Gaps = 8/269 (2%)

Query:   1 MLIAKDKQGNLINLLESHPGKGQYFCPTCCSAVRLKAGRIMRRHFAHISLKNCQFYHENE  60
           M +A+D +G L+N+LE    K Y CP C  + L+ G  +R HFAH SLK+C F+ ENE
Sbjct:   1 MFVARDARGELVNVLEDKLEKQAYTCPACGGQLHLRQGPSVRTHFAHKSLKDCDFFFENE  60

Query:  61 SNEHLQLKAKLYMSLSRENETMLEHHLPEINQIADLFVNETLALE----VQCSRLSEQRL 116
           S EHL  K  LY  L +E +  LE+  L E+ QIAD+FVN  LALE    V C +   + L
Sbjct:  61 SPEHLANKESLYHWLKKETKVQLEYPLSELKQIADVFVNGNLALESSVVVPCLK---KVL 117

Query: 117 RERTKAYLQADFQVRWLLGEKLWLKHRLTNLHKQFLQFSQSIGFHIWELDLRLEVLRLKY 176
           +ER++ Y  +QV WLLG+KLWLK RLT L   FL FSQ++GF++WELD    +VLRLKY
Sbjct: 118 KERSEGYRSQGYQVLWLLGQKLWLKERLTRLQAGFLYFSQNMGFYVWELDKGKQVLRLKY 177

Query: 177 LIYEDLRGHVYYLSKTCPL-SGDVLAFLKWPYQSKNLNFYKVKQDRNIRDYVRQQLRYGN 235
           LIY+DLRG ++Y  K     G +L  L+ PY+ + ++ + V +D++I    Y+RQQL Y N
Sbjct: 178 LIYQDLRGKLHYQIKEFSYGQGSLLEILRLPYKKQKISHFTVSEDKDICRYIRQQLYYQN 237
```

```
                             -continued
Query:  236 QFWLRKQEKAYLSGQNLLTQELMMFFPQI                     264
            FW+++Q +AY  G+N+LT   L  ++PQI
Sbjct:  238 LFWMKEQAEAYQKGENILTYGLKEWYPQI                     266
```

A related DNA sequence was identified in *S. pyogenes* <SEQ ID 6647> which encodes the amino acid sequence <SEQ ID 6648>. Analysis of this protein sequence reveals the following:

```
Possible site: 61
>>> Seems to have no N-terminal signal sequence

----- Final Results -----
            bacterial cytoplasm --- Certainty = 0.1034(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below.

```
Identities = 154/312 (49%), Positives = 204/312 (65%), Gaps = 1/312 (0%)

Query:    1 MLIAKDKQGNLINLL-ESHPGKGQYFCPTCCSAVRLKAGRIMRRHFAHISLKNCQFYHEN   59
            +L A D +  LI+L+ +    K  + CP C S VRL+ G I R HFAH+ L +CQF  EN
Sbjct:    4 ILTALDDKNQLISLVTQPISTKPPFRCPACKSPVRLRQGTIRRPHFAHVQLAHCQFQAEN   63

Query:   60 ESNEHLQLKAKLYMSLSRENETMLEHHLPEINQIADLFVNETLALEVQCSRLSEQRLRER  119
            ES EHL LKAKLY SL R    +E +LPE+ QIADL+VN+ LALE+QCS L  +RL++R
Sbjct:   64 ESEEHLTLKAKLYTSLVRTEAVCIEKYLPELQQIADLWVNDKLALEIQCSPLPVERLKKR  123

Query:  120 TKAYLQADFQVRWLLGEKLWLKHRLTNLHKQFLQFSQSIGFHIWELDLRLEVLRLKYLIY  179
            TKAY + + VRWLLG KLWL   LT L KQFL FS S+GFH+WELD    +LRLKYLI+
Sbjct:  124 TKAYQEKGYPVRWLLGRKLWLNTHLTALQKQFLYFSSSLGFHLWELDAAANLLRLKYLIH  183

Query:  180 EDLRGHVYYLSKTCPLSGDVLAFLKWPYQSKNLNFYKVKQDRNIRDYVRQQLRYGNQFWL  239
            EDL G V YL+KT  L  +++  + PYQ + L Y+ K   N+    +++  L  + WL
Sbjct:  184 EDLFGKVSYLTKTISLDHNIMEMFRLPYQQEILYSYQKKMTVNLSKRIQRALLARHPKWL  243

Query:  240 RKQEKAYLSGQNLLTQELMMFFPQIQPPRVDTDFCQITNSLTSFYQNFTNYYQKNKNNLD  299
            R+QEKAYLSG NLL      F+PQ +P +  + FCQI  +L  +Y++F  YY+K  K+
Sbjct:  244 RRQEKAYLSGYNLLMLTTDAFYPQWRPVQSSSGFCQIKGNLRPYYESFKVYYKKEKDKKV  303

Query:  300 QTLYPPVFYDKI                                                 311
            QTL+  P +Y K+
Sbjct:  304 QTLFSPKYYVKM                                                 315
```

Based on this analysis, it was predicted that these proteins and their epitopes could be useful antigens for vaccines or diagnostics.

EXAMPLE 2151

A DNA sequence (GBSx2267) was identified in *S. agalactiae* <SEQ ID 6649> which encodes the amino acid sequence <SEQ ID 6650>. This protein is predicted to be bicyclomycin resistance protein. Analysis of this protein sequence reveals the following:

```
Possible site: 25
>>> Seems to have a cleavable N-term signal seq.
        INTEGRAL    Likelihood = -8.33    Transmembrane     78-94  (75-96)
        INTEGRAL    Likelihood = -8.33    Transmembrane   269-285  (267-287)
        INTEGRAL    Likelihood = -7.38    Transmembrane   290-306  (287-314)
        INTEGRAL    Likelihood = -7.06    Transmembrane   203-219  (199-225)
        INTEGRAL    Likelihood = -6.69    Transmembrane   157-173  (143-184)
        INTEGRAL    Likelihood = -6.42    Transmembrane    53-69   (44-73)
        INTEGRAL    Likelihood = -6.42    Transmembrane   362-378  (357-381)
        INTEGRAL    Likelihood = -3.72    Transmembrane   242-258  (240-261)
        INTEGRAL    Likelihood = -3.24    Transmembrane   329-345  (328-346)
        INTEGRAL    Likelihood = -1.28    Transmembrane   107-123  (106-123)
```

```
----- Final Results -----
           bacterial membrane --- Certainty = 0.4333(Affirmative) < succ>
           bacterial outside  --- Certainty = 0.0000(Not Clear)  < succ>
           bacterial cytoplasm --- Certainty = 0.0000(Not Clear)  < succ>
```

The protein has homology with the following sequences in the GENPEPT database.

```
>GP: CAA15047 GB: AJ235272 BICYCLOMYCIN RESISTANCE PROTEIN (bcr1)
         [Rickettsia prowazekii]
 Identities = 86/336 (25%), Positives = 159/336 (46%), Gaps = 28/336 (8%)
Query:  73 GKKNTVLLGLCLILMSGFISFFTSNFSLAMASRLLLGIGIGLYNSLSISIITDLYEADER 132
           G++  VLLGL + ++S  IS F+ N  + M +R +   G+ + + +  S+   D Y+  E
Sbjct:  70 GRRPIVLLGLFIYIVSSIISIFSFNIEMLMIARFIQAFGVSVGSVIGQSMARDSYQGAEL 129

Query: 133 ASMIGLRTASLNIGKALTTFIVGLVLA-IGVNYIYLVYLLVIPVFF-FFWKNVPEVENQT 190
           + +  + + L    AL ++I G ++ + +Y+++ + L   +     +++ +PE
Sbjct: 130 SYVYAILSPWLLFIPALGSYIGGYIIEYLSWHYVFIFFSLAGTILLALYYQILPETNYYI 189

Query: 191 HTLKASTTFDT-----KAALLMLITFLVGI---AYIGATVKIPTLLVTKYHYATSFSSNM 242
            ++S  F+     K  +L L   F++G      Y G    ++ P +L+ +     SF   +
Sbjct: 190 AFSQSSKYFEVFNIIIKDKMLWLYAFIIGAFNGIYYGFFIEAPFILIDQMRVLPSFYGKL 249

Query: 243 LTLLAFSGILVGSVFGKLVK---VFQEKTLLIMILAMGIGNVLFALANNQIIFIVAS--I 297
           LL+F+  I   G + G  L+K    V+  +K + I +      G +LFA+ +  + FI+  S
Sbjct: 250 AFLLSFASIFGGFLGGYLIKKRQVYDKKVMSIGFIFSLCGCILFAVDSFILEFILVSNVF 309

Query: 298 LIGASFVGTM-----SSVFFYISKNYAKEHNNFITSLALTAGNI-GVILTPLI--LTKLP 349
            I    F+   M      S+    I+  YA E   +T     TAG+I G   I     +I   +T
Sbjct: 310 AIAMIFMPMMIHMIGHSLLIAITLRYALEDYATVTG---TAGSIFGAIYYVVIASVTYCV 366

Query: 350 SQLHLEPFMTPFLITSGLMVINV--FVYLVLMSKNK                         383
           S++H E      L+    L + +V  F Y+ L+ K K
Sbjct: 367 SKIHGETISNFSLLCLVLSISSVISFYYICLLYKKK                         402
```

A related GBS gene <SEQ ID 8987> and protein <SEQ ID 8988> were also identified. Analysis of this protein sequence reveals the following:

```
Lipop: Possible site: -1 Crend: 7
McG: Discrim Score: 6.28
GvH: Signal Score (-7.5): -2.45
     Possible site: 25
>>> Seems to have a cleavable N-term signal seq.
ALOM program count: 10 value: -8.33 threshold: 0.0
    INTEGRAL      Likelihood = -8.33     Transmembrane   78-94   (75-96)
    INTEGRAL      Likelihood = -8.33     Transmembrane  269-285 (267-287)
    INTEGRAL      Likelihood = -7.38     Transmembrane  290-306 (287-314)
    INTEGRAL      Likelihood = -7.06     Transmembrane  203-219 (199-225)
    INTEGRAL      Likelihood = -6.69     Transmembrane  157-173 (143-184)
    INTEGRAL      Likelihood = -6.42     Transmembrane   53-69   (44-73)
    INTEGRAL      Likelihood = -6.42     Transmembrane  362-378 (357-381)
    INTEGRAL      Likelihood = -3.72     Transmembrane  242-258 (240-261)
    INTEGRAL      Likelihood = -3.24     Transmembrane  329-345 (328-346)
    INTEGRAL      Likelihood = -1.28     Transmembrane  107-123 (106-123)
    PERIPHERAL    Likelihood = -3.71       140
modified ALOM score: 2.17

*** Reasoning Step: 3

----- Final Results -----
           bacterial membrane --- Certainty = 0.4333(Affirmative) < succ>
           bacterial outside  --- Certainty = 0.0000(Not Clear)  < succ>
           bacterial cytoplasm --- Certainty = 0.0000(Not Clear)  < succ>
```

The protein has homology with the following sequences in the databases:

```
ORF01955(517-1449 of 1749)
EGAD|163303|RP603(70-402 of 407)bicyclomycin resistance protein {Rickettsia
prowazekii} OMNI|NT01RP0626 conserved hypothetical protein
GP|3861147|emb|CAA15047.1||AJ235272 BICYCLOMYCIN RESISTANCE PROTEIN(bcrl)
{Rickettsia prowazekii}PIR|E71665|E71665 bicyclomycin resistance protein(bcrl)
RP603-Rickettsia prowazekii
% Match = 5.9
% Identity = 26.5  % Similarity = 52.0
Matches = 85  Mismatches = 141  Conservative Sub.s = 82
474         504         534         564         594         624         654         684
SLVTIPAMMITIFVILSNFVVTKLGKKNTVLLGLCLILMSGFISFFTSNFSLAMASRLLLGIGIGLYNSLSISIITDLYE
           |::    ||||| :  :::   ||| : :  :|::     |: : : :  |:   ||:
MTSTLYFLGFAVGILSLGRLSDIYGRRPIVLLGLFIYIVSSIISIFSFNIEMLMIARFIQAFGVSVGSVIGQSMARDSYQ
           60          70          80          90         100         110         120

714         744         774         801         831         858         886
ADERASMIGLRTASLNIGKALTTFIVGLVLA-IGVNYIYLVYLLVIPVFF-FFWKNVPEVENQTHTLKAST---TFDT--
|  : :  : :    |    || ::|  | ::   : :|:::  |     ::: ::::  :|          ::|         |:
GAELSYVYAILSPWLLFIPALGSYIGGYIIEYLSWHYVFIFFSLAGTILLALYYQILPETNYYIAFSQSSKYFEVFNIII
           140         150         160         170         180         190         200

933         954         984        1014        1044        1074        1095        1125
KAALLMLITFLVG---IAYIGATVKIPTLLVTKYHYATSFSSNMLTLLAFSGILVGSVFGKLVK---VFQEKTLLIMILA
|  :|    ||:|   |::|: |       ||   |:   |: |   :  | ||::   |: | :  |
KDKMLWLYAFIIGAFNGIYYGFFIEAPFILIDQMRVLPSFYGKLAFLLSFASIFGGFLGGYLIKKRQVYDKKVMSIGFIF
           220         230         240         250         260         270         280

1155        1182        1209        1224        1254        1284        1311        1335
MGIGNVLFALANNQIIFI-VASIL-IGAFVGTM------SSVFFYISKNYAKEHNNFITSLALTAGNI-GVILTPLI--L
 |:|||: :  :  || |::::  |  |: |           |::  :  ||| :     |:| | :|         :|
SLCGCILFAVDSFILEFILVSNVFAIAMIFMPMMIHMIGHSLLIAITLRYALEDYATVTGTA---GSIFGAIYYVVIASV
           300         310         320         330         340         350         360

1365        1395        1419        1449        1479        1509        1539        1569
TKLPSQLHLEPFMTPFLITSGLMVINV--FVYLVLMSKNK*KVIRKDNFFRIVKVGEKMLIAKDKQGNLINLLESHPGKG
|    |::|           |:    |  :| | |: |: ||
TYCVSKIHGETISNFSLLCLVLSISSVISFYYICLLYKKKSIIIN
           380         390         400
```

There is also homology to SEQ ID 4001

Based on this analysis, it was predicted that these proteins and their epitopes could be useful antigens for vaccines or diagnostics.

EXAMPLE 2152

A DNA sequence (GBSx2268) was identified in *S. agalactiae* <SEQ ID 6651> which encodes the amino acid sequence <SEQ ID 6652>. This protein is predicted to be 16S pseudouridylate synthase (rsuA). Analysis of this protein sequence reveals the following:

```
Possible site: 52
>>> Seems to have no N-terminal signal sequence

----- Final Results -----
         bacterial cytoplasm --- Certainty = 0.2645(Affirmative) < succ>
         bacterial membrane  --- Certainty = 0.0000(Not Clear)   < succ>
          bacterial outside  --- Certainty = 0.0000(Not Clear)   < succ>
```

The protein has homology with the following sequences in the GENPEPT database.

```
>GP: BAB06992 GB: AP001518 16S pseudouridylate synthase [Bacillus halodurans]
Identities 106/234 (45%), Positives = 141/234 (59%), Gaps = 1/234 (0%)
Query:   1 MRLDKLLGQAGFGSRNQVKKLICSRQVSVDGQIVTKDNVIVDSGLQSIFVGKERVCLKES     60
           MR+DK L   GFGSR  VKKL++   V V GQ +    V+   +SI V  E V   K
Sbjct:   1 MRIDKFLANMGFGSRKDVKKLLKTGAVRVQGQPIKDPSTHVEPESESITVYGEEVEYKPY     60

Query:  61 SYYLLYKPSGVVSAVRDSEHKTVIDLISEKDKVEGLYPIGRLDRDTEGLLIVTNNGPLGY    120
           Y ++ KP GV+ A  D EH+TVIDL+E+++    P+GRLD+DT GLL++TN+G    +
Sbjct:  61 VYLMMNKPKGVICATEDLEHETVIDLLGEEERHYEPSPVGRLDKDTVGLLLITNDGKFNH    120

Query: 121 RMLHPKHHVAKTYYVEVNGFLERDAITFFEEGVVFDDGTKCKPAELTIDTANNDKSTARI    180
              ++ PKHHV KTY   V G + ++  F  GVV DDG   KPA L  A    +S    +
Sbjct: 121 WLMSPKHHVPKTYRALVEGHVTEEDVGAFSHGVVLDDGYVTKPATLHILEA-GARSHIEL    179

Query: 181 TITEGKFHQVKKMFLAYGVKVIYLRRISFGDLRLDMNLKPGQYRRLRDSEAAIL          234
           +TEGKFHQVK+MF A G +V+ L RI   G+L LD     L   G+YR L    E A+L
Sbjct: 180 ILTEGKFHQVKRMFQAVGKRVLELERIKIGNLLLDPELARGEYRELTKEEIALL          233
```

A related DNA sequence was identified in *S. pyogenes* <SEQ ID 6653> which encodes the amino acid sequence <SEQ ID 6654>. Analysis of this protein sequence reveals the following:

```
Possible Site: 56
>>> Seems to have no N-terminal signal sequence

----- Final Results -----
            bacterial cytoplasm --- Certainty = 0.3310(Affirmative) < succ>
            bacterial membrane  --- Certainty = 0.0000(Not Clear)   < succ>
            bacterial outside   --- Certainty = 0.0000(Not Clear)   < succ>
```

An alignment of the GAS and GBS proteins is shown below.

```
Identities = 111/194 (57%), Positives = 138/194 (70%)

Query:    1 MRLDKLLGQAGFGSRNQVKKLICSRQVSVDGQIVTKDNVIVDSGLQSIFVGKERVCLKES   60
            MRLDKLL    GSR+QVKKLI ++ V VD          VD GLQ I V  +RV    +
Sbjct:    1 MRLDKLLEGTKVGSRSQVKKLIKAQGVWVDHMPARNGRQNVDPGLQLIEVTGQRVTHPKH  60

Query:   61 SYYLLYKPSGVVSAVRDSEHKTVIDLISEKDKVEGLYPIGRLDRDTEGLLIVTNNGPLGY  120
            SY +L KPSGVVSA +D+ + TVID ++E+DK   LYP+GRLDRDTEGL+++T+NGPLG+
Sbjct:   61 SYIILNKPSGVVSAKKDTNYLTVIDQLAEEDKSPDLYPVGRLDRDTEGLVLLTDNGPLGF  120

Query:  121 RMLHPKHHVAKTYYVEVNGFLERDAITFFEEGVVFDDGTKCKPAELTIDTANNDKSTARI  180
            RMLHP HHV+KTY V VNG L   DA  FF   G+ F  G +C+PA+LTI  A+ D+S A +
Sbjct:  121 RMLHPSHHVSKTYLVTVNGLLAEDASDFFAAGICFPTGEQCQPAQLTILKADTDQSQASL  180

Query:  181 TITEGKFHQVKKMF                                               194
            TI+EGKFHQVKK F
Sbjct:  181 TISEGKFHQVKKCF                                               194
```

Based on this analysis, it was predicted that these proteins and their epitopes could be useful antigens for vaccines or diagnostics.

EXAMPLE 2153

A DNA sequence (GBSx2269) was identified in *S. agalactiae* <SEQ ID 6655> which encodes the amino acid sequence <SEQ ID 6656>. Analysis of this protein sequence reveals the following:

```
Possible site: 42
>>> Seems to have an uncleavable N-term signal seq

----- Final Results -----
            bacterial membrane  --- Certainty = 0.0000(Not Clear) < succ>
            bacterial outside   --- Certainty = 0.0000(Not Clear) < succ>
            bacterial cytoplasm --- Certainty = 0.0000(Not Clear) < succ>
```

A related GBS nucleic acid sequence <SEQ ID 9745> which encodes amino acid sequence <SEQ ID 9746> was also identified.

The protein has homology with the following sequences in the GENPEPT database.

```
>GP: BAA18872 GB: D90917 hypothetical protein [Synechocystis sp.]
Identities = 197/318 (61%), Positives = 243/318 (75%)

Query:   22 MGLLVDGKWVDQWYDTASTGGKFVRTVTQFRHWVTKDGSAGPSGDAGFKAESGRYHLYVS   81
            MGLLV+G W DQWYDT STGG+FVR +QFRHW+T DGS GP+G   GFKAE+GRYHLYVS
Sbjct:    1 MGLLVNGIWQDQWYDTESTGGRFVRHDSQFRHWITPDGSPGPTGHGGFKAEAGRYHLYVS  60

Query:   82 LACPWASRVLIMRKLKNLESHISISIVNPLMLENGWTFQEYKGVIPDMINQSQYLYQIYQ  141
            LACPWA R LI RKLK LE   I +S+V+ LM ENGWTF    GV+PD +  ++YLYQIY
Sbjct:   61 LACPWAHRTLIFRKLKGLEGMIDVSVVHWLMRENGWTFAPGPGVMPDPLFNAEYLYQIYT  120
```

-continued
```
Query: 142 ASQSDYTGRVTVPVLWDKKFHTIVNNESSEIMRMLNTAFNHITGNTDDYYPDSLQGQIDE 201
           + + Y+GRVTVP+LWDK+  TIVNNESSEI+R+ N+AF+ +  + DYYP +L+ QID
Sbjct: 121 RADAQYSGRVTVPILWDKQKQTIVNNESSEIIRIFNSAFDGLGAKSGDYYPKALRTQIDA 180

Query: 202 MNNFIYPKINNGVYKAGFATSQNVYQKEVETLFTALDQLEKHLSDNHYLVGEQFTEADIR 261
           +N+ IY  INNGVYK GFAT+Q  Y++ +  LF +LD LE  L  + YL G++ TEAD R
Sbjct: 181 LNDRIYHTINNGVYKCGFATTQTAYEEAIAPLFESLDWLEGILQGHQYLTGDEITEADWR 240

Query: 262 LFTTLVRFDTVYYGHFKCNLKALHDYPHLWHYTKRIYNLPGIAETVNFDHIKKHYYGSHK 321
           LFTTL+RFD VY GHFKCNL+ + DYP+LW Y + +Y+ PGIAETVNF HIK HYY SH
Sbjct: 241 LFTTLIRFDVVYVGHFKCNLRRIQDYPNLWRYLRDLYHQPGIAETVNFQHIKGHYYESHL 300

Query: 322 TINPTGIIPAGPNLDWTI                                          339
           INPTGI+P GP LD ++
Sbjct: 301 NINPTGIVPMGPALDLSL                                          318
```

No corresponding DNA sequence was identified in *S. pyogenes*.

SEQ ID 6656 (GBS655) was expressed in *E. coli* as a GST-fusion product. SDS-PAGE analysis of total cell extract is shown in FIG. 143 (lane 24; MW 27 kDa).

Based on this analysis, it was predicted that this protein and its epitopes, could be useful antigens for vaccines or diagnostics.

EXAMPLE 2154

A DNA sequence (GBSx2270) was identified in *S. agalactiae* <SEQ ID 6657> which encodes the amino acid sequence <SEQ ID 6658>. Analysis of this protein sequence reveals the following:

```
Possible site: 43
>>> Seems to have no N-terminal signal sequence

----- Final Results -----
            bacterial cytoplasm --- Certainty = 0.1116(Affirmative) < succ>
            bacterial membrane  --- Certainty = 0.0000(Not Clear)   < succ>
             bacterial outside  --- Certainty = 0.0000(Not Clear)   < succ>
```

The protein has homology with the following sequences in the GENPEPT database.

```
>GP: CAB12030 GB: Z99105 similar to glucosamine-6-phosphate isomerase
[Bacillus subtilis]
Identities = 112/243 (46%), Positives = 163/243 (66%), Gaps = 10/243 (4%)

Query:   1 MRVITVKNDIEGGKIAFTLLEEKMKAGAQT-LGLATGSSPITFYEEIVKS----NLDFSN  55
           M+++  ++  E  K++  +++E+++A    LGLATGS+P+  Y++++      +DFS
Sbjct:   1 MKILIAEHYEELCKLSAAIIKEQIQAKKDAVLGLATGSTPVGLYKQLISDYQAGEIDFSK  60

Query:  56 MVSINLDEYVGIAASNDQSYSYFMHKHLFDAKPFKENNL--PNGLAKDLKEEIKRYDAVI 113
           + +  NLDEY G++ S+ QSY++FMH+HLF     + +++  P G    L+   K Y+ +I
Sbjct:  61 VTTFNLDEYAGLSPSHPQSYNHFMHEHLFQHINMQPDHIHIPQGDNPQLEAACKVYEDLI 120

Query: 114 N-ANPIDFQILGIGRNGHIGFNEPGTPFDITTHVVDLAPSTIEANSRFFNSIDD-VPKQA 171
             A   ID QILGIG NGHIGFNEPG+ F+  T VV L+  STI+AN+RFF     VP+ A
Sbjct: 121 RQAGGIDVQILGIGANGHIGFNEPGSDFEDRTRVVKLSESTIQANARFFGGDPVLVPRLA 180

Query: 172 LSMGIGSIMK-SKTIVLVAYGIEKAEAIASMIKGPITEDMPASILQKHDDVVIIVDEAAA 230
           +SMGI +IM+ SK IVL+A G EKA+AI  M +GP+T D+PASILQKH+ V +I D  AA
Sbjct: 181 ISMGIKTIMEFSKHIVLLASGEEKADAIQKMAEGPVTTDVPASILQKHNHVTVIADYKAA 240

Query: 231 SKL                                                         233
           KL
Sbjct: 241 QKL                                                         243
```

A related DNA sequence was identified in *S. pyogenes* <SEQ ID 6659> which encodes the amino acid sequence <SEQ ID 6660>. Analysis of this protein sequence reveals the following:

```
Possible site: 43
>>> Seems to have no N-terminal signal sequence
     INTEGRAL    Likelihood = -0.59    Transmembrane    174-190 (174-190)

----- Final Results -----
               bacterial membrane --- Certainty = 0.1235(Affirmative) < succ>
                bacterial outside --- Certainty = 0.0000(Not Clear)   < succ>
              bacterial cytoplasm --- Certainty = 0.0000(Not Clear)   < succ>
```

The protein has homology with the following sequences in the databases:

```
>GP: CAB12030 GB: Z99105 similar to glucosamine-6-phosphate isomerase
[Bacillus subtilis]
Identities = 120/244 (49%), Positives = 162/244 (66%), Gaps = 12/244 (4%)

Query:    1 MKIIRVQDQIEGGKIAFTLLKDSL-AKGAKTLGLATGSSPISFYQEMVKS----PLDFSD   55
            MKI+  +  E  K++  ++K+ + AK     LGLATGS+P+  Y++++       +DFS
Sbjct:    1 MKILIAEHYEELCKLSAAIIKEQIQAKKDAVLGLATGSTPVGLYKQLISDYQAGEIDFSK   60

Query:   56 LTSINLDEYVGLSVESDQSYDYFMRQNLF---NAKPFKKNYLPNGLATDVEAEAKRYNQI  112
            +T+ NLDEY GLS   QSY++FM ++LF    N +P   ++P G   +EA  K Y  +
Sbjct:   61 VTTFNLDEYAGLSPSHPQSYNHFMHEHLFQHINMQP-DHIHIPQGDNPQLEAACKVYEDL  119

Query:  113 IAEHP-IDFQVLGIGRNGHIGFNEPGTSFEEETHVVDLQESTIEANSRFFTSIED-VPKQ  170
            I +    ID Q+LGIG NGHIGFNEPG+ FE+ T VV L ESTI+AN+RFF     VP+
Sbjct:  120 IRQAGGIDVQILGIGANGHIGFNEPGSDFEDRTRVVKLSESTIQANARFFGGDPVLVPRL  179

Query:  171 AISMGIASIMK-SEMIVLLAFGQEKADAIKGMVFGPITEHLPASILQKHDHVIVIVDEAA  229
            AISMGI +IM+ S+ IVLLA G+EKADAI+ M  GP+T  +PASILQKH+HV VI D  A
Sbjct:  180 AISMGIKTIMEFSKHIVLLASGEEKADAIQKMAEGPVTTDVPASILQKHNHVTVIADYKA  239

Query:  230 ASQL                                                         233
            A +L
Sbjct:  240 AQKL                                                         243
```

An alignment of the GAS and GBS proteins is shown below.

```
Identities = 163/233 (69%), Positives = 201/233 (85%)

Query:    1 MRVITVKNDIEGGKIAFTLLEEKMKAGAQTLGLATGSSPITFYEEIVKSNLDFSNMVSIN   60
            M++I V++ IEGGKIAFTLL++ +  GA+TLGLATGSSPI+FY+E+VKS LDFS++ SIN
Sbjct:    1 MKIIRVQDQIEGGKIAFTLLKDSLAKGAKTLGLATGSSPISFYQEMVKSPLDFSDLTSIN   60

Query:   61 LDEYVGIAASNDQSYSYFMHKHLFDAKPFKENNLPNGLAKDLKEEIKRYDAVINANPIDF  120
            LDEYVG++ + DQSY YFM ++LF+AKPFK+N LPNGLA D++ E KRY+ +I +PIDF
Sbjct:   61 LDEYVGLSVESDQSYDYFMRQNLFNAKPFKKNYLPNGLATDVEAEAKRYNQIIAEHPIDF  120

Query:  121 QILGIGRNGHIGFNEPGTPFDITTHVVDLAPSTIEANSRFFNSIDDVPKQALSMGIGSIM  180
            Q+LGIGRNGHIGFNEPGT F+  THVVDL  STIEANSRFF SI+DVPKQA SMGI SIM
Sbjct:  121 QVLGIGRNGHIGFNEPGTSFEEETHVVDLQESTIEANSRFFTSIEDVPKQAISMGIASIM  180

Query:  181 KSKTIVLVAYGIEKAEAIASMIKGPITEDMPASILQKHDDVVIIVDEAAASKL         233
            KS+ IVL+A+G EKA+AI+ M+ GPITE +PASILQKHD V++IVDEAAAS+L
Sbjct:  181 KSEMIVLLAFGQEKADAIKGMVFGPITEHLPASILQKHDHVIVIVDEAAASQL         233
```

Based on this analysis, it was predicted that these proteins and their epitopes could be useful antigens for vaccines or diagnostics.

EXAMPLE 2155

A DNA sequence (GBSx2271) was identified in *S. agalactiae* <SEQ ID 6661> which encodes the amino acid sequence <SEQ ID 6662>. Analysis of this protein sequence reveals the following:

```
Possible site: 61
>>> Seems to have no N-terminal signal sequence
     INTEGRAL    Likelihood = -8.12    Transmembrane    169-185 (161-194)
     INTEGRAL    Likelihood = -6.37    Transmembrane    151-167 (145-168)
     INTEGRAL    Likelihood = -5.15    Transmembrane     42-58  (41-62)
```

```
            -continued
INTEGRAL    Likelihood = -1.59    Transmembrane    207-223  (207-224)
INTEGRAL    Likelihood = -1.12    Transmembrane     24-40   (23-40)

----- Final Results -----
              bacterial membrane --- Certainty = 0.4248(Affirmative) < succ>
               bacterial outside --- Certainty = 0.0000(Not Clear)   < succ>
             bacterial cytoplasm --- Certainty = 0.0000(Not Clear)   < succ>
```

The protein has homology with the following sequences in the GENPEPT database.

```
>GP: AAF13747 GB: AF117351 unknown [Zymomonas mobilis]
Identities = 88/216 (40%), Positives = 123/216 (56%)

Query:    9 QQLNILRAGVLGANDGIISVAGVVIGVASATHNLWIIFLSAASAILAGAFSMAGGEYVSV   68
            +Q+  LRA VLGANDGI+S + ++IGVASA  +   I L+  S ++AGA SMA GEYVSV
Sbjct:   17 RQMGWLRASVLGANDGILSTSSLMIGVASAHGSSGNILLAGMSGLIAGALSMAAGEYVSV   76

Query:   69 STQKDTEQAAVAREEKLLENNPELAKKSLVDIYLAKGESHEHAQWLVDKAFSKNAIEHLV  128
            S+Q D EQA VARE    L+ NP  K  L +IY+ +G   E A  + ++   + NA+E  +
Sbjct:   77 SSQHDMEQADVAREHAELKANPHAEKHELAEIYVERGLDRELALQVAEQLMAHNALEAHL  136

Query:  129 EEKYGIEFGEYTSPWHAAISSFIAFAIGSIFPTITILLLPFSVRIVGTVIIVIVSLLSTG  188
             ++  G+        P   AA++S I+F+ G+I P +T L   P   +   +I I+ L    G
Sbjct:  137 RDELGLTDSLIARPVQAALASAISFSGGAIVPFLTALFSPPEIINITISLISILCLAVLG  196

Query:  189 YVSAKLGQAPTVPAMRRNVMIGCLTMLATYVIGQLF                          224
                V A LG A     A R     G L M+ T  IG  F
Sbjct:  197 MVGAHLGGANVPKAALRVTFCGALAMIGTAAIGSFF                          232
```

No corresponding DNA sequence was identified in *S. pyogenes*.

Based on this analysis, it was predicted that this protein and its epitopes, could be useful antigens for vaccines or diagnostics.

EXAMPLE 2156

A DNA sequence (GBSx2272) was identified in *S. agalactiae* <SEQ ID 6663> which encodes the amino acid sequence <SEQ ID 6664>. This protein is predicted to be S-adenosyl-methionine tRNA ribosyltransferase (queA). Analysis of this protein sequence reveals the following:

```
Possible site: 41
>>> Seems to have no N-terminal signal sequence

----- Final Results -----
             bacterial cytoplasm --- Certainty = 0.3438(Affirmative) < succ>
              bacterial membrane --- Certainty = 0.0000(Not Clear)   < succ>
               bacterial outside --- Certainty = 0.0000(Not Clear)   < succ>
```

The protein has homology with the following sequences in the GENPEPT database.

```
>GP: CAB14732 GB: Z99118 S-adenosylmethionine tRNA ribosyltransferase
[Bacillus subtilis]
Identities = 228/341 (66%), Positives = 279/341 (80%)

Query:    1 MNTNDFDFYLPEELIAQTPLEKRDASKLLVIDHKNKTMTDSHFDHILDELKPGDALVMNN   60
            M + FDF LPE LIAQ PLE+RDAS+L+V D    +TDS F HI+    GD LV+NN
Sbjct:    1 MKVDLFDFELPERLIAQVPLEQRDASRLMVLDKHTGELTDSSFKHIISFFNEGDCLVLNN   60

Query:   61 TRVLPARLYGEKQDTHGHVELLLLKNTEGDQWEVLAKPAKRLRVGTKVSFGDGRLIATVT  120
            TRVLPARL+G K+DT    VELLLLK   GD+WE LAKPAKR++ GT V+FGDGRL A  T
Sbjct:   61 TRVLPARLFGTKEDTGAKVELLLLKQETGDKWETLAKPAKRVKKGTVVTFGDGRLKAICT  120
```

```
-continued
Query: 121 KELEHGGRIVEFSYDGIFLEVLESLGEMPLPPYIHEKLEDRDRYQTVYAKENGSAAAPTA 180
            +ELEHGGR +EF YDGIF EVLESLGEMPLPPYI E+L+D++RYQTVY+KE GSAAAPTA
Sbjct: 121 EELEHGGRKMEFQYDGIFYEVLESLGEMPLPPYIKEQLDDKERYQTVYSKEIGSAAAPTA 180

Query: 181 GLHFTKELLEKIETKGVKLVYLTLHVGLGTFRPVSVDNLDEHEMHSEFYQLSKEAADTLN 240
            GLHFT+E+L++++ KGV++ ++TLHVGLGTFRPVS D ++EH MH+EFYQ+S+E A   LN
Sbjct: 181 GLHFTEEILQQLKDKGVQIEFITLHVGLGTFRPVSADEVEEHNMHAEFYQMSEETAAALN 240

Query: 241 AVKESGGRIVAVGTTSIRTLETIGSKFNGELKADSGWTNIFIKPGYQFKVVDAFSTNFHL 300
            V+E+GGRI++VGTTS RTLETI  + +G+ KA SGWT+IFI PGY+FK +D    TNFHL
Sbjct: 241 KVRENGGRIISVGTTSTRTLETIAGEHDGQFKASSGWTSIFIYPGYEFKAIDGMITNFHL 300

Query: 301 PKSTLVMLVSAFAGRDFVLEAYNHAVEERYRFFSFGDAMFV                   341
            PKS+L+MLVSA AGR+ +L AYNHAVEE YRFFSFGDAM +
Sbjct: 301 PKSSLIMLVSALAGRENILRAYNHAVEEEYRFFSFGDAMLI                   341
```

A related DNA sequence was identified in *S. pyogenes* <SEQ ID 6665> which encodes the amino acid sequence <SEQ ID 6666>. Analysis of this protein sequence reveals the following:

```
Possible site: 41
>>> Seems to have no N-terminal signal sequence

----- Final Results -----
            bacterial cytoplasm --- Certainty = 0.3864(Affirmative) < succ>
            bacterial membrane  --- Certainty = 0.0000(Not Clear)  < succ>
             bacterial outside  --- Certainty = 0.0000(Not Clear)  < succ>
```

An alignment of the GAS and GBS proteins is shown below.

```
Identities = 297/341 (87%), Positives = 322/341 (94%)

Query:   1 MNTNDFDFYLPEELIAQTPLEKRDASKLLVIDHKNKTMTDSHFDHILDELKPGDALVMNN   60
           MNTN+FDF LPEELIAQTPLEKRD+SKLL+IDH+ KTM DSHFDHI+D+L PGDALVMNN
Sbjct:   1 MNTNNFDFELPEELIAQTPLEKRDSSKLLIIDHRQKTMVDSHFDHIIDQLNPGDALVMNN   60

Query:  61 TRVLPARLYGEKQDTHGHVELLLLKNTEGDQWEVLAKPAKRLRVGTKVSFGDGRLIATVT  120
           TRVLPARLYGEK DTHGHVELLLLKNT+GDQWEVLAKPAKRL+VG++V+FGDGRL AT+
Sbjct:  61 TRVLPARLYGEKPDTHGHVELLLLKNTQGDQWEVLAKPAKRLKVGSQVNFGDGRLKATII  120

Query: 121 KELEHGGRIVEFSYDGIFLEVLESLGEMPLPPYIHEKLEDRDRYQTVYAKENGSAAAPTA  180
             ELEHGGRIVEFSYDGIFLEVLESLGEMPLPPYIHEKLED +RYQTVYAKENGSAAAPTA
Sbjct: 121 DELEHGGRIVEFSYDGIFLEVLESLGEMPLPPYIHEKLEDAERYQTVYAKENGSAAAPTA  180

Query: 181 GLHFTKELLEKIETKGVKLVYLTLHVGLGTFRPVSVDNLDEHEMHSEFYQLSKEAADTLN  240
           GLHFT +LL+KIE KGV LVYLTLHVGLGTFRPVSVDNLDEH+MHSEFY LS+EAA TL
Sbjct: 181 GLHFTTDLLKKIEAKGVHLVYLTLHVGLGTFRPVSVDNLDEHDMHSEFYSLSEEAAQTLR  240

Query: 241 AVKESGGRIVAVGTTSIRTLETIGSKFNGELKADSGWTNIFIKPGYQFKVVDAFSTNFHL  300
           VK++GGR+VAVGTTSIRTLETIG KF G+++ADSGWTNIFIKPGYQFKVVDAFSTNFHL
Sbjct: 241 DVKQAGGRVVAVGTTSIRTLETIGGKFQGDIQADSGWTNIFIKPGYQFKVVDAFSTNFHL  300

Query: 301 PKSTLVMLVSAFAGRDFVLEAYNHAVEERYRFFSFGDAMFV                   341
           PKSTLVMLVSAFAGRDFVLEAY HAV+E+YRFFSFGDAMFV
Sbjct: 301 PKSTLVMLVSAFAGRDFVLEAYRHAVDEKYRFFSFGDAMFV                   341
```

Based on this analysis, it was predicted that these proteins and their epitopes could be useful antigens for vaccines or diagnostics.

EXAMPLE 2157

A DNA sequence (GBSx2273) was identified in *S. agalactiae* <SEQ ID 6667> which encodes the amino acid sequence <SEQ ID 6668>. Analysis of this protein sequence reveals the following:

```
Possible site: 36
>>> Seems to have an uncleavable N-term signal seq
     INTEGRAL    Likelihood = -14.22    Transmembrane    14-30 (6-34)
```

```
----- Final Results -----
          bacterial membrane --- Certainty = 0.6689(Affirmative) < succ>
          bacterial outside  --- Certainty = 0.0000(Not Clear)   < succ>
         bacterial cytoplasm --- Certainty = 0.0000(Not Clear)   < succ>
```

The protein has no significant homology with any sequences in the GENPEPT database.

A related DNA sequence was identified in *S. pyogenes* <SEQ ID 6669> which encodes the amino acid sequence <SEQ ID 6670>. Analysis of this protein sequence reveals the following:

```
Possible site: 51
>>> Seems to have no N-terminal signal sequence

----- Final Results -----
         bacterial cytoplasm --- Certainty = 0.2655(Affirmative) < succ>
          bacterial membrane --- Certainty = 0.0000(Not Clear)   < succ>
          bacterial outside  --- Certainty = 0.0000(Not Clear)   < succ>
```

An alignment of the GAS and GBS proteins is shown below.

```
Identities = 126/195 (64%), Positives = 155/195 (78%), Gaps = 1/195 (0%)

Query: 160 MEERFDITETDYEYIGEHNNYVAAFSGAMSIDDMQKYSLVYSENTPAYALAERIGGMDSA 219
            M ERFDITETDYEY  EH+ YVA F+GAMSI DMQ+YSLVYSENTPAYALAER+GGM+ A
Sbjct:   1 MTERFDITETDYEYDQEHHAYVAQFNGAMSIPDMQEYSLVYSENTPAYALAERLGGMNKA  60

Query: 220 YSKFGRYGQSKGDIKNIQKNGNKVTTDYYIQVLDYLWKHRKKYDSLITYLEEAFPTDYYR 279
            Y  F RYG+   G I  I +NGNK+TT YY+QVLDYLW+H+ KY  ++ Y+ E+FP   YY+
Sbjct:  61 YQLFDRYGKVSGAITTIDRNGNKITTAYYLQVLDYLWQHQDKYKDILYYIGESFPDLYYK 120

Query: 280 ALIPSDVVVAQKPGYVREALNVGAIVKEEVPYIVAIYTAGLGGSTQEDSEINGVGLYQLE 339
             +P   V V QKPGYVREALNVGAIV EE PY++A+Y++GLGG+TQ    E+NG+G  QL
Sbjct: 121 TYLP-HVKVYQKPGYVREALNVGAIVCEESPYLIALYSSGLGGATQASEEVNGLGYVQLV 179

Query: 340 QLCFVINQWHRVNMN                                              354
            QL +VIN+W+R N+N
Sbjct: 180 QLPYVINEWYRGNLN                                              194
```

SEQ ID 6668 (GBS680) was expressed in *E. coli* as a GST-fusion product. SDS-PAGE analysis of total cell extract is shown in FIG. 164 (lane 10-12; MW 64 kDa) and in FIG. 239 (lane 9; MW 64 kDa). It was also expressed in *E. coli* as a His-fusion product. SDS-PAGE analysis of total cell extract is shown in FIG. 164 (lane 15; MW 40 kDa) and in FIG. 188 (lane 9; MW 40 kDa). Purified GBS680-His is shown in FIG. 242, lane 8. Purified GBS680-GST is shown in FIG. 246, lanes 6 & 7.

Based on this analysis, it was predicted that these proteins and their epitopes could be useful antigens for vaccines or diagnostics.

EXAMPLE 2158

A DNA sequence (GBSx2274) was identified in *S. agalactiae* <SEQ ID 6671> which encodes the amino acid sequence <SEQ ID 6672>. Analysis of this protein sequence reveals the following:

```
Possible site: 17
>>> Seems to have no N-terminal signal sequence
    INTEGRAL    Likelihood = -4.57    Transmembrane     8-24    (4-25)
    INTEGRAL    Likelihood = -2.13    Transmembrane    66-82    (65-84)
    INTEGRAL    Likelihood = -1.65    Transmembrane   107-123   (107-125)
    INTEGRAL    Likelihood = -0.69    Transmembrane    36-52    (36-52)
    INTEGRAL    Likelihood = -0.48    Transmembrane    89-105   (89-105)
```

-continued

```
----- Final Results -----
            bacterial membrane --- Certainty = 0.2826(Affirmative) < succ>
            bacterial outside  --- Certainty = 0.0000(Not Clear)   < succ>
           bacterial cytoplasm --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 2159

A DNA sequence (GBSx2275) was identified in *S. agalactiae* <SEQ ID 6673> which encodes the amino acid sequence <SEQ ID 6674>. Analysis of this protein sequence reveals the following:

```
Possible site: 59
>>> Seems to have an uncleavable N-term signal seq
     INTEGRAL    Likelihood = -9.87   Transmembrane   108-124  (97-133)
     INTEGRAL    Likelihood = -9.08   Transmembrane   181-197  (173-201)
     INTEGRAL    Likelihood = -7.43   Transmembrane   220-236  (216-248)
     INTEGRAL    Likelihood = -6.69   Transmembrane     6-22   (3-28)
     INTEGRAL    Likelihood = -3.72   Transmembrane   401-417  (400-417)
     INTEGRAL    Likelihood = -3.35   Transmembrane   279-295  (278-295)
     INTEGRAL    Likelihood = -2.87   Transmembrane    31-47   (30-50)
     INTEGRAL    Likelihood = -2.87   Transmembrane   244-260  (242-264)
     INTEGRAL    Likelihood = -0.80   Transmembrane    62-78   (62-78)

----- Final Results -----
            bacterial membrane --- Certainty = 0.4949(Affirmative) < succ>
            bacterial outside  --- Certainty = 0.0000(Not Clear)   < succ>
           bacterial cytoplasm --- Certainty = 0.0000(Not Clear)   < succ>
```

The protein has homology with the following sequences in the GENPEPT database.

```
>GP: AAC21770 GB: U32694 H. influenzae predicted coding region HI0092
[Haemophilus influenzae Rd]
Identities = 232/416 (55%), Positives = 314/416 (74%), Gaps = 3/416 (0%)

Query:    4 TFTTTGALIGLALAILLIIKKVHPAYSLILGALVGGLIGGGDLVTIVNTMVLGAQGMMSS    63
            T +  GAL+ L +AI LI+KKV PAY +++GALVGGLIGG DL    V+ M+ GAQG+ ++
Sbjct:    3 TVSAIGALVALIVAIFLILKKVSPAYGMLVGALVGGLIGGADLSQTVSLMIGGAQGITTA   62

Query:   64 ILRILTSGILAGALIKTGSAEKIAESIIKKLGQQRAITALAIATMIICAVGVFIDIAVIT  123
            ++RIL +G+LAG LI++G+A  I E+I   KLG+ RA+ ALA+ATMI+ AVGVF+D+AVIT
Sbjct:   63 VMRILAAGVLAGVLIESGAANSITETITNKLGETRALLALALATMILTAVGVFVDVAVIT  122

Query:  124 VAPIALAIGKKANLSKSSILLAMIGGGKAGNIISPNPNTIAASEAFKVDLTSLMVQNIIP  183
            V+PIALA+ ++++LSK++ILLAMIGGGKAGNI+SPNPN IAA++ F + LTS+M+  IIP
Sbjct:  123 VSPIALALSRRSDLSKAAILLAMIGGGKAGNIMSPNPNAIAAADTFHLPLTSVMMAGIIP  182

Query:  184 AIAALVVTIILAKIVSKKNNDISYDSEEQV--GSDLPAFLPAISGPLVVICLLALRPLFG  241
            A+  L++T  LAK +  K  ++ D E  V   +LP+FL A+  PLV I LLALRPLF
Sbjct:  183 ALFGLILTYFLAKRLINKSKVT-DKEVIVLETQNLPSFLTALVAPLVAILLLALRPLFD  241

Query:  242 ITIDPLIALPLGGLISILATGYLKETVPFVEYGLSKVVGVSILLIGTGTLSGIIKASNLQ  301
            I +DPLIALPLGGLI    G L+  +     GLSK+  V+I+L+GTG L+GII  S L+
Sbjct:  242 IKVDPLIALPLGGLIGAFCMGKLRNINSYAINGLSKMTPVAIMLLGTGALAGIIANSGLK  301

Query:  302 FDMIHLLEFLNMPTFILAPLSGIFMGAATASTTSGTTIASQTFAETLIKSGVPAVSGAAM  361
             +I  LE   +P+++ILAP+SG+ M  ATASTT+GT +AS   F+  TL++  GV +++GAAM
Sbjct:  302 EVLIQGLEHSGLPSYILAPISGVLMSLATASTTAGTAVASNVFSSTLLELGVSSLAGAAM  361

Query:  362 IHAGATVLDSLPHGSFFHATGGAVNMAIKDRMKLISYEALIGLTSTIVAVVYYCFF      417
            IHAGATV D +PHGSFFHATGG+VNM IK+R+KLI YE+ +GL  TIV+ + + F
Sbjct:  362 IHAGATVFDHMPHGSFFHATGGSVNMDIKERLKLIPYESAVGLMMTIVSTLIFGVF      417
```

A related DNA sequence was identified in *S. pyogenes* <SEQ ID 6675> which encodes the amino acid sequence <SEQ ID 6676>. Analysis of this protein sequence reveals the following:

```
Possible site: 51
>>> Seems to have an uncleavable N-term signal seq
    INTEGRAL    Likelihood = -11.15    Transmembrane    240-256  (236-265)
    INTEGRAL    Likelihood = -10.88    Transmembrane      3-19  (1-32)
    INTEGRAL    Likelihood = -10.14    Transmembrane    269-285  (263-289)
    INTEGRAL    Likelihood = -7.27     Transmembrane    107-123  (102-141)
    INTEGRAL    Likelihood = -7.17     Transmembrane    307-323  (303-330)
    INTEGRAL    Likelihood = -6.64     Transmembrane     24-40   (23-43)
    INTEGRAL    Likelihood = -5.63     Transmembrane    422-438  (420-442)
    INTEGRAL    Likelihood = -3.77     Transmembrane    124-140  (124-141)
    INTEGRAL    Likelihood = -3.24     Transmembrane    189-205  (184-207)
    INTEGRAL    Likelihood = -2.60     Transmembrane     65-81   (65-82)
    INTEGRAL    Likelihood = -2.34     Transmembrane    393-409  (393-409)
    INTEGRAL    Likelihood = -0.11     Transmembrane    149-165  (149-166)

----- Final Results -----
           bacterial membrane --- Certainty = 0.5458(Affirmative) < succ>
            bacterial outside --- Certainty = 0.0000(Not Clear) < succ>
          bacterial cytoplasm --- Certainty = 0.0000(Not Clear) < succ>
```

The protein has homology with the following sequences in the databases:

```
>GP: BAB07616 GB: AP001520 unknown conserved protein
[Bacillus halodurans]
Identities = 155/435 (35%), Positives = 248/435 (56%), Gaps = 21/435 (4%)

Query:   7 LGVLVGVIVIIYLYVKEVNIIIAAPLATSLVILFNQMDPTTTLLGKEPNQFMGALSTYIL   66
           LG+++G+++++ L + +II AP+A +V LF +D   LL   + +M   +
Sbjct:   2 LGIVLGLVILMVLAYRGWSIIWVAPIAAGVVALFGGLD----LLPAYTDTYMEGFVNFAK  57

Query:  67 NYFAIFLLGSILAKLMETSGATTSIADYILKKVGHDSPYKVLVAIFLISAILTYGGISLF  126
           +F +F+LG+I KLME +GA  S+A  I K +G    + ++ + L A+LTYGGISLF
Sbjct:  58 QWFPVFMLGAIFGKLMEDTGAARSVASAITKLIGTK---RAILGVMLGCAVLTYGGISLF 114

Query: 127 VVMFAVLPLARSLFKKMDLAWNLIQVPLWLGIATFTMTILPGTPAIQNVIPIQYLDTSLT  186
           VV+FA+ PLA +LF++ +++  LI  + LG TFTMT +PGTP IQN+IP Y  T+
Sbjct: 115 VVVFAMYPLALALFREANISRRLIPGTIALGAFTFTMTAVPGTPQIQNLIPTSYYGTNAM 174

Query: 187 AAAIPSIVGSIGCVAFGLFYMKYCLAKSMARGETYATYAFDNEIQVKTKNLPHFLASILP  246
           AA +  ++ ++   G  Y+ +  K   GE + T  + E + + +P+     S LP
Sbjct: 175 AAPMMGVIAALIMGIGGYTYLVWREKKLKEAGE-FFTEPKNGEKEEEGEKVPNPWLSFLP 233

Query: 247 LLLLIIIALTGSLFGNDFFKKNIIFIALLAVILTASWLFRQFIPNKIAVFNLGASSSIAP  306
           L+ +I+   T +L   D       I +AL++ I+    L   + I   NGA S+
Sbjct: 234 LVSVIV---TLNLLQWD------IVLALISGIVLIMLLNVGKVKGFIQSMNQGAGGSVLA 284

Query: 307 IFATASAVAFGAVVMIVPGFTFFSDLILNIPGNPLISLAVLTSSMSAITGSSSGALGIVM  366
           I  T++AV FG+VV VPGF  ++L+L I G+PLIS AV  + ++  TGS+SG +GI +
Sbjct: 285 IINTSAAVGFGSVVRAVPGFERLTELLLGIQGSPLISQAVAINVLAGATGSASGGMGIAL 344

Query: 367 ----PNFAQYYLDQGLNPEMIHRVATIASNIFTIVPQSGVFLTFLALTGLNHKNAFKETF  422
               + Q ++ G++PE  HRVA+IAS   +P +G  LT LA+TGL+HK ++K+ F
Sbjct: 345 EALGDRYMQLAMETGMSPEAFHRVASIASGGLDTLPHNGAVLTLLAITGLSHKESYKDIF 404

Query: 423 ITVSVSTFIAQVIVI                                              437
           +  V  ++    I
Sbjct: 405 VVGCVIPIVSVAFAI                                              419
```

An alignment of the GAS and GBS proteins is shown below.

```
Identities = 88/395 (22%), Positives = 167/395 (42%), Gaps = 40/395 (10%)

Query:   9 GALIGLALAILLIIKKVHPAYSLILGALVGGLIGGGDLVTIV----NTMVLGAQG--MMS   62
           G L+G+ + I L +K+V+   + L + L    D  T +        +GA    +++
Sbjct:   8 GVLVGVIVIIYLYVKEVNIIIAAPLATSLVILFNQMDPTTTLLGKEPNQFMGALSTYILN  67

Query:  63 SILRILTSGILAGALIKTGSAEKIAESIIKKLGQQ---RAITALAIATMIICAVGVFIDI  119
              L   ILA + +G+  IA+ I+KK+G    + A+ + + I+  G+  + +
Sbjct:  68 YFAIFLLGSILAKLMETSGATTSIADYILKKVGHDSPYKVLVAIFLISAILTYGGISLFV 127
```

-continued

```
Query:  120 AVITVAPIALAIGKKANLSKSSILLAMIGGGKAGNII----SPNPNTIAASEAFKVDLTS  175
            +  V P+A ++ KK +L+ + I + + G         +P    +      LT+
Sbjct:  128 VMFAVLPLARSLFKKMDLAWNLIQVPLWLGIATFTMTILPGTPAIQNVIPIQYLDTSLTA  187

Query:  176 LMVQNIIPAIAALVVTII-----LAKIVSKKNNDISY--DSEEQVGS-DLPAFLPAISGP  227
            + +I+ +I  +  +      LAK +++      +Y  D+E QV + +LP FL +I
Sbjct:  188 AAIPSIVGSIGCVAFGLFYMKYCLAKSMARGETYATYAFDNEIQVKTKNLPHFLASILPL  247

Query:  228 LVVICLLALRPLFG-------ITIDPLIALPLGGLISILATGYLKETVPFVEYGLSKVVG  280
            L++I +     LFG        I   L+A+ L    S L  ++   +     GS  +
Sbjct:  248 LLLIIIALTGSLFGNDFFKKNIIFIALLAVIL--TASWLFRQFIPNKIAVFNLGASSSIA  305

Query:  281 ---VSILLIGTGTLSGIIKASNLQFDMIHLLEFLNMPTFILAPLSGIFMGAATASTTSGT  337
               +    + G+ I+       D+I L     P   LA L+    M A T S++
Sbjct:  306 PIFATASAVAFGAVVMIVPGFTFFSDLI--LNIPGNPLISLAVLTS-SMSAITGSSSGAL  362

Query:  338 TIASQTFAETLIKSGVPAVSGAAMIHAGATVLDSL                          372
              I    FA+ + G+        MIH AT+ ++
Sbjct:  363 GIVMPNFAQYYLDQGL----NPEMIHRVATIASNI                          393
```

Based on this analysis, it was predicted that these proteins and their epitopes could be useful antigens for vaccines or diagnostics.

EXAMPLE 2160

A DNA sequence (GBSx2277) was identified in *S. agalactiae* <SEQ ID 6677> which encodes the amino acid sequence <SEQ ID 6678>. Analysis of this protein sequence reveals the following:

```
Possible site: 21
>>> Seems to have no N-terminal signal sequence
    INTEGRAL    Likelihood = -3.24    Transmembrane    85-101 (84-101)

----- Final Results -----
              bacterial membrane --- Certainty = 0.2296(Affirmative) < succ>
              bacterial outside  --- Certainty = 0.0000(Not Clear)   < succ>
              bacterial cytoplasm --- Certainty = 0.0000(Not Clear)   < succ>
```

The protein has homology with the following sequences in the GENPEPT database.

```
>GP: CAB16041 GB: Z99124 similar to hypothetical proteins
[Bacillus subtilis]
Identities = 176/377 (46%), Positives = 234/377 (61%), Gaps = 2/377 (0%)

Query:    1 MKVVVAIDSLKGSLSSLEAGNAIKESINEVISGADVEVHPLADGGEGTVEALTLGMGGTI    60
            MK+++A DS K SLS+LEA  AI+    V GAD   P+ADGGEGTV++L     G I
Sbjct:    1 MKIIIAPDSFKESLSALEAAEAIERGFKSVFPGADYRKLPVADGGEGTVQSLVDATNGRI    60

Query:   61 ETIPVKGPLGEKVHASYGIIPQRQLAIIEMAAAAGITLIATEERNPLHTTTYGVGEMIKD   120
               V GPLGE V A +G++    + A+IEMAAA+G+ L+   ++RNPL TTT G GE+I
Sbjct:   61 IEQVVTGPLGEPVRAFFGMMGDGRTAVIEMAAASGLHLVPVDKRNPLITTTRGTGELIGA   120

Query:  121 AISKGCRHFIIGIGGSATNDGGAGMLQALGYALLDKDNQEISLGAQGLADLKSISTDKVI   180
            A+  G    IIGIGGSATNDGGAGM+QALG  LLD    EI G   L+ L SI     +
Sbjct:  121 ALDAGAERLIIGIGGSATNDGGAGMIQALGGRLLDNSGSEIGPGGGALSQLASIDVSGLD   180

Query:  181 EELKECDFKIACDVTNPLCGAQGCSSIFGPQKGADEDMITKMDTWLSNYATLATSVSEKA   240
             L+      ++AC+V NPL G +G   +FGPQKGA   DM+   +D  +S++A  +A
Sbjct:  181 SRLRNVKLEVACNVDNPLTGPKGATAVFGPQKGATADMLDVLDQNVSHFADMAEKALGST   240

Query:  241 DATIEGTGAAGGLGFAFLAFTNATLEPGIDIILSEINIEKAISEADLVVTGEGRLDGQTV   300
               EG GAAGGLG++ L +  A L+  GIDI+L  ++ E  + +ADLV+TGEGR+D QTV
Sbjct:  241 FRDTEGAGAAGGLGWSLLTYLQADLKRGIDIVLEAVDFESIVQDADLVITGEGRIDSQTV   300

Query:  301 MGKAPIGVAKLAKKYGKKVVAFSGSVTEDAILCNQHGIDAFFPIVRRLISLDEAMSKEVA   360
               GK PIGVAK AK Y  V+  +GS++ D+        QHGIDA F  IV  + L++A
Sbjct:  301 HGKTPIGVAKAAKSYDVPVIGIAGSISRDSNAVYQHGIDALFSIVPGAVPLEDAFEHAAE   360

Query:  361 YKNMKETATQVFRLINL                                            377
            Y  M+ TA  +  I L
Sbjct:  361 Y--MERTARDIAASIKL                                            375
```

A related DNA sequence was identified in *S. pyogenes* <SEQ ID 6679> which encodes the amino acid sequence <SEQ ID 6680>. Analysis of this protein sequence reveals the following:

```
Possible site: 49
>>> Seems to have no N-terminal signal sequence
     INTEGRAL    Likelihood =  -0.27    Transmembrane   360-376 (360-376)

----- Final Results -----
               bacterial membrane --- Certainty = 0.1107(Affirmative) < succ>
                bacterial outside --- Certainty = 0.0000(Not Clear) < succ>
              bacterial cytoplasm --- Certainty = 0.0000(Not Clear) < succ>
```

The protein has homology with the following sequences in the databases:

```
>GP: AAA57927 GB: U18997 ORF_f408 [Escherichia coli]
Identities = 115/345 (33%), Positives = 182/345 (52%), Gaps = 25/345 (7%)

Query:   24 MKILVAIDSFKGSVTSPELNTSVAQALLSVDKQLVIETRAIADGGEGSLVALSQTVAGRW    83
            MKI++A DS+K S+++ E+  ++ +         +  +ADGGEG++ A+      G
Sbjct:   28 MKIVIAPDSYKESLSASEVAQAIEKGFREIFPDAQYVSVPVADGGEGTVEAMIAATQGAE    87

Query:   84 HQVKTIDLLRRPIKVAY--YRHAKQAFIESASIIGIDKITSNSVTYAQATSYGLGLAVKD   141
                       L   + ++        K AFIE A+  G++ + +           TS G G   +
Sbjct:   88 RHAWVTGPLGEKVNASWGISGDGKTAFIEMAAASGLELVPAEKRDPLVTTSRGTGELILQ   147

Query:  142 AIQKGATQIEIMLGGTGTSDGGKGFLESLNYDFMT--------GRSYLDTLASPVTLLGL   193
            A++ GAT I I +GG+ T+DGG G +++L             G     L+TL + + + GL
Sbjct:  148 ALESGATNIIIGIGGSATNDGGAGMVQALGAKLCDANGNEIGFGGGSLNTL-NDIDISGL   206

Query:  194 T------------DVTNPYHGPQGFAAVFGPQKGGSLSQIEETDQIASNFAKKVFCQTTI   241
                         DVTNP   G  G +  +FGPQKG  S  + I E D    S++A+  +       +
Sbjct:  207 DPRLKDCVIRVACDVTNPLVGDNGASRIFGPQKGASEAMIVELDNNLSHYAEVIKKALHV   266

Query:  242 DLQTIPGSGAAGGLGGAIV-LLGGTLTSGFSRIAELLNLDNSLQSCDLVITGEGCLDTQS   300
            D++ +PG+GAAGG+G A++      LG   L SG      +   LNL+  +    C LVITGEG +D+QS
Sbjct:  267 DVKDVPGAGAAGGMGAALMAFLGAELKSGIEIVTTALNLEEHIHDCTLVITGEGRIDSQS   326

Query:  301 QSGKVPVAIARMAKKYQVPTIALCGSVKIETGLAAEDFL-AVFSI                344
                GKVP+ +A +AKKY  P I + GS+ + G+  + + AVFS+
Sbjct:  327 IHGKVPIGVANVAKKYHKPVIGIAGSLTDDVGVVHQGIDAVFSV                 371
```

An alignment of the GAS and GBS proteins is shown below.

```
Identities = 128/379 (33%), Positives = 194/379 (50%), Gaps = 23/379 (6%)

Query:    1 MKVVVAIDSLKGSLSSLEAGNAIKESINEVISGADVEVHPLADGGEGTVEALTLGMGGTI    60
            MK++VAIDS KGS++S E     ++ +++  V      +E  +ADGGEG++ AL+  + G
Sbjct:   24 MKILVAIDSFKGSVTSPELNTSVAQALLSVDKQLVIETRAIADGGEGSLVALSQTVAGRW    83

Query:   61 ETIPVKGPLGEKVHASYGIIPQRQLAIIEMAAAAGITLIATEERNPLHTTTYGVGEMIKD   120
             +     L   +Y      + A IE A+   GI  I  +         T+YG+G   +KD
Sbjct:   84 HQVKTIDLLRRPIKVAY--YRHAKQAFIESASIIGIDKITSNSVTYAQATSYGLGLAVKD   141

Query:  121 AISKGCRHFIIGIGGSATNDGGAGMLQALGYALLDKDNQEISLGAQGLADLKSISTDKVI   180
            AI KG     I +GG+ T+DGG G L++L  Y  +                G + L ++++  +
Sbjct:  142 AIQKGATQIEIMLGGTGTSDGGKGFLESLNYDFMT-----------GRSYLDTLASPVTL   190

Query:  181 EELKECDFKIACDVTNPLCGAQGCSSIFGPQKGADEDMITKMDTWLSNYATLATSVSEKA   240
             L               DVTNP  G QG +++FGPQKG             I + D    SN+A    +
Sbjct:  191 LGLT--------DVTNPYHGPQGFAAVFGPQKGGSLSQIEETDQIASNFAKKVFCQTTID   242

Query:  241 DATIEGTGAAGGLGFAFLAFTNATLEPGIDIILSEINIEKAISEADLVVTGEGRLDGQTV   300
             TI G+GAAGG+G A +     TL  G  I     +N++  ++    DLV+TGEG LD Q+
Sbjct:  243 LQTIPGSGAAGGLGGA-IVLLGGTLTSGFSRIAELLNLDNSLQSCDLVITGEGCLDTQSQ   301

Query:  301 MGKAPIGVAKLAKKYGKKVVAFSGSVTEDAILCNQHGIDAFFPIVRRLISLDEAMSKEVA   360
             GK P+ +A++AKKY    +A GSV +       L   +  A F I ++ ISL+ A+  K
Sbjct:  302 SGKVPVAIARMAKKYQVPTIALCGSVKIETGLAAEDFL-AVFSIQQQPISLEAAIDKTTT   360

Query:  361 YKNMKETATQVFRLINLYN                                          379
             N+K  A    +  LI  +N
Sbjct:  361 LSNIKILAANLMLLIAQFN                                          379
```

SEQ ID 6678 (GBS409) was expressed in *E. coli* as a His-fusion product. SDS-PAGE analysis of total cell extract is shown in FIG. 76 (lane 7; MW 45.4 kDa).

GBS409-His was purified as shown in FIG. 214, lane 6.

GBS409d was expressed in *E. coli* as a His-fusion product. SDS-PAGE analysis of total cell extract is shown in FIG. 166 (lane 3 & 4; MW 35 kDa) and in FIG. 188 (lane 12; MW 35 kDa). Purified protein is shown in FIG. 240, lanes 9-10.

Based on this analysis, it was predicted that these proteins and their epitopes could be useful antigens for vaccines or diagnostics.

EXAMPLE 2161

A DNA sequence (GBSx2278) was identified in *S. agalactiae* <SEQ ID 6681> which encodes the amino acid sequence <SEQ ID 6682>. Analysis of this protein sequence reveals the following:

```
Possible site: 36
>>> Seems to have no N-terminal signal sequence

----- Final Results -----
            bacterial cytoplasm --- Certainty = 0.1886(Affirmative) < succ>
            bacterial membrane  --- Certainty = 0.0000(Not Clear)   < succ>
             bacterial outside  --- Certainty = 0.0000(Not Clear)   < succ>
```

The protein has homology with the following sequences in the GENPEPT database.

```
>GP: AAC21771 GB: U32695 conserved hypothetical protein
[Haemophilus influenzae Rd]
Identities = 97/383 (25%), Positives = 175/383 (45%), Gaps = 52/383 (13%)

Query:    1 MKLRKQLAQQIVTSIKDVCQQDINFINTKGIIFASTNPKRVGEFHEIGLKVAQTGQMIEV    60
            M+L K  A++IV      +N ++  G+I AS N  R+ + H   +   + +++E+
Sbjct:    1 MQLDKYTAKKIVKRAMKIIHHSVNVMDHDGVIIASGNSTRLNQRHTGAVLALRENRVVEI    60

Query:   61 TD---QESYFGTQAGINIPFYYNCELLATIGISGNPNQVGKYALLAQKMTRLILKEHE-L   116
              Q+   F  Q GIN+P +Y  +    +GISG P QV +YA L +    LI+++    L
Sbjct:   61 DQALAQKWNFEAQPGINLPIHYLGKNIGVVGISGEPTQVKQYAELVKMTAELIVEQQALL   120

Query:  117 DYLDFGRKNEASIVLHHLVEGRELDYYYLNQFLNQYHLSEKTDYRLLTFEINSQKQKLLL   176
              +   + R+ +   +L         L+ LN  + ++    +F++N    +L+
Sbjct:  121 EQESWHRRYKEEFILQ----------LLHCNLNWKEMEQQA--KFFSFDLNKSRVVVLI   167

Query:  177 S------QSEMSLLNFFDK-----------LDTAIYTFNYPNQYWLLLSDHMFDYYYPNI   219
              +    +L+N+ ++              LD +   + N    +LS  M
Sbjct:  168 KLLNPALDNLQNLINYLEQSEFAQDVAILSLDQVVVLKTWQNS--TVLSAQM------KT   219

Query:  220 LSKFECEKGLYKVGIGQKSSLSLLKR---SYETSILALK-ALKGQQK--VNLVDDLDLEL   273
            L   + K  YK+ +G   +L L ++    S++++   L   LK    + + D+  L +
Sbjct:  220 LLPADYSKQDYKIAVGACLNLPLFEQLPLSFQSAQSTLSYGLKHHPRKGIYVFDEHRLPV   279

Query:  274 LLTSIDSNIKQYVLNKALVNL-SENDKIL---LNSYFKHNLSLKECSQELFIHKNTVQYR   329
            LL   + ++    L K L  L SE + IL   L  YF  N L      +++LF+H NT++YR
Sbjct:  280 LLAGLSHSWQGNELIKPLSPLFSEENAILYKTLQQYFLSNCDLYLTAEKLFVHPNTLRYR

339

Query:  330 LNKIYESTQLNPRNFKDATLLYL                                        352
            LNKI + T L    D   LYL
Sbjct:  340 LNKIEQITGLFFNKIDDKLTLYL                                        362
```

No corresponding DNA sequence was identified in *S. pyogenes*.

Based on this analysis, it was predicted that this protein and its epitopes, could be useful antigens for vaccines or diagnostics.

EXAMPLE 2162

A DNA sequence (GBSx2279) was identified in *S. agalactiae* <SEQ ID 6683> which encodes the amino acid sequence <SEQ ID 6684>. Analysis of this protein sequence reveals the following:

```
Possible site: 15
>>> Seems to have no N-terminal signal sequence

----- Final Results -----
            bacterial cytoplasm --- Certainty = 0.0290(Affirmative) < succ>
             bacterial membrane --- Certainty = 0.0000(Not Clear)   < succ>
              bacterial outside --- Certainty = 0.0000(Not Clear)   < succ>
```

The protein has homology with the following sequences in the GENPEPT database.

```
>GP: AAF89979 GB: AF206272 beta-glucosidase [Streptococcus mutans]
Identities = 334/475 (70%), Positives = 392/475 (82%), Gaps = 8/475 (1%)

Query:     4 FPKHFLWGGAVAANQVEGAFRTDGKGLSVQDVLPNGGLGD-------FTAKPTPDNLKLE    56
             FP++FLWGGA AANQ EGA+ DGKGLSVQDV P GG+        T KPT DNLKL
Sbjct:     6 FPENFLWGGATAANQFEGAYNQDGKGLSVQDVTPKGGVAQSGSSSPLITEKPTEDNLKLV   65

Query:    57 AIDFYHNYKNDIKLFAEMGFKVFRTSIAWSRIFPNGDDSAPNEAGLQFYDNLFDELLKYN  116
             IDFY+ YK DI LFAEMGFKVFR SIAW+RIFPNGDD PNEAGL FYD +FDEL KY+
Sbjct:    66 GIDFYNRYKEDIALFAEMGFKVFRLSIAWTRIFPNGDDLEPNEAGLAFYDKVFDELAKYD  125

Query:   117 IEPLVTLSHYETPLHLAKTYNGWADRRLIAFFEKFAQTVMERYKDKVKYWLTFNEVNSIL  176
             IEPLVTLSHYETPLHLA+ YNGWA+R LIAF+E++A+TV  RYKDKVKYWLTFNEVNS+L
Sbjct:   126 IEPLVTLSHYETPLHLARKYNGWANRELIAFYERYARTVFTRYKDKVKYWLTFNEVNSVL  185

Query:   177 HMPFTSGAIMTDKSQLSPQELYQAIHHELVASARVTKLGRSINPNFKIGCMILAMPAYPM  236
             H PF SG I+TD  QLS Q+LYQA+HHELV SA TK+G  INP+FKIGCM+LAMPAYPM
Sbjct:   186 HAPFMSGGIITDPEQLSKQDLYQAVHHELVVSALATKVGHEINPDFKIGCMVLAMPAYPM  245

Query:   237 TSDPRDVLAARQFEQHNLLFSDIHVRGKYPTYIQSYFKNNGIKIKFEEGDEEVLAQNTVD  296
             T+DP D LA R+FE  N LFSD+H RGKYP YI+ YFK+N I IK  EGD+E++ +NTVD
Sbjct:   246 TADPLDQLAVREFENQNYLFSDLHARGKYPNYIKRYFKDNNIDIKMGEGDKELMLENTVD  305

Query:   297 FLSFSYYMSVTQAYDFENYQSGQGNILGGLTNPHLTTSEWGWQIDPIGLRLVLNQYYERY  356
             F+SFSYYMSV A++ E+Y SG+GN+LGGL+NP+L  SEWGWQIDP+GLRLVLN  Y+RY
Sbjct:   306 FISFSYYMSVAAAHNPEDYNSGRGNVLGGLSNPYLQASEWGWQIDPVGLRLVLNDSYDRY  365

Query:   357 QIPLFIVENGLGAKDQLIETLDGDYTVEDDYRIDYMNQHLVQVAKAIEDGVEIMGYTSWG  416
             Q+PLFIVENGLGAKD L++  DG TVEDDYRIDY+ +HL+QV +A++DGV+++GYT+WG
Sbjct:   366 QLPLFIVENGLGAKDVLVQGPDGP-TVEDDYRIDYLQKHLMQVGEALQDGVDLLGYTTWG  424

Query:   417 CIDCVSMSTAQLSKRYGLIYVDRNDDGTSLQRYKKKSFGWYQKVIKTNGQSLFE       471
             ID VS ST +LSKRYG IYV NDDG+GSL RYKKKSF WY+KVI TNG SL+E
Sbjct:   425 PIDLVSESTVELSKRYGFIYVACNDDGSGSLARYKKKSFAWYKKVIETNGASLYE       479
                                       40
```

A related DNA sequence was identified in *S. pyogenes* <SEQ ID 5287> which encodes the amino acid sequence <SEQ ID 5288>. Analysis of this protein sequence reveals the following:

```
Possible site: 15
>>> Seems to have no N-terminal signal sequence

----- Final Results -----
            bacterial cytoplasm --- Certainty = 0.0763(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below.

```
Identities = 390/469 (83%), Positives = 423/469 (90%)

Query:     1 MTVFPKHFLWGGAVAANQVEGAFRTDGKGLSVQDVLPNGGLGDFTAKPTPDNLKLEAIDF   60
             M +FPK FLWGGAVAANQVEGAF D KGLSVQDVLPNGGLG++T  PT DNL LEAIDF
Sbjct:     1 MGIFPKDFLWGGAVAANQVEGAFEADAKGLSVQDVLPNGGLGEWTDSPTSDNLTLEAIDF   60

Query:    61 YHNYKNDIKLFAEMGFKVFRTSIAWSRIFPNGDDSAPNEAGLQFYDNLFDELLKYNIEPL  120
             YH YK DI LFAEMGFKVFRTSIAWSRIFPNGDD  PNEAGLQFYD+LFDELL Y IEPL
Sbjct:    61 YHRYKEDIALFAEMGFKVFRTSIAWSRIFPNGDDDQPNEAGLQFYDDLFDELLNYGIEPL  120
```

-continued

```
Query: 121 VTLSHYETPLHLAKTYNGWADRRLIAFFEKFAQTVMERYKDKVKYWLTFNEVNSILHMPF 180
            VTLSHYETPLHLAK YNGW DRRLI FFE+FAQTVMERYKDKVKYWLTFNEVNSILHMPF
Sbjct: 121 VTLSHYETPLHLAKAYNGWTDRRLIGFFERFAQTVMERYKDKVKYWLTFNEVNSILHMPF 180

Query: 181 TSGAIMTDKSQLSPQELYQAIHHELVASARVTKLGRSINPNFKIGCMILAMPAYPMTSDP 240
            TSG IMT+K +LS Q+LYQAIHHELVASA VTKL    INP+ K+GCMILAMPAYPMTSDP
Sbjct: 181 TSGGIMTEKEKLSLQDLYQAIHHELVASASVTKLAHEINPDVKVGCMILAMPAYPMTSDP 240

Query: 241 RDVLAARQFEQHNLLFSDIHVRGKYPTYIQSYFKNNGIKIKFEEGDEEVLAQNTVDFLSF 300
            RD+LAA  FE  NLLFSDIHVRGKYP+YI+SYFK NGI+I FE+GD+E+LA++TVDFLSF
Sbjct: 241 RDILAAHAFENLNLLFSDIHVRGKYPSYIKSYFKENGIEIVFEDGDKELLAEHTVDFLSF 300

Query: 301 SYYMSVTQAYDFENYQSGQGNILGGLTNPHLTTSEWGWQIDPIGLRLVLNQYYERYQIPL 360
            SYYMSVTQA++ E Y SGQGNILGGL+NP+L +SEWGWQIDPIGLRLVLNQYY+RYQIPL
Sbjct: 301 SYYMSVTQAHNPEAYTSGQGNILGGLSNPYLESSEWGWQIDPIGLRLVLNQYYDRYQIPL 360

Query: 361 FIVENGLGAKDQLIETLDGDYTVEDDYRIDYMNQHLVQVAKAIEDGVEIMGYTSWGCIDC 420
            FIVENGLGAKDQL++T DG  TV DDYRIDYM+QHLVQVAKAIEDGVE+MGYTSWGCIDC
Sbjct: 361 FIVENGLGAKDQLVQTADGSMTVHDDYRIDYMSQHLVQVAKAIEDGVEVMGYTSWGCIDC 420

Query: 421 VSMSTAQLSKRYGLIYVDRNDDGTGSLQRYKKKSFGWYQKVIKTNGQSL          469
            VSMSTAQLSKRYG IYVDRNDDGTG L RYKKKSF WY++VI+TNG+ L
Sbjct: 421 VSMSTAQLSKRYGFIYVDRNDDGTGQLTRYKKKSFDWYRQVIQTNGRYL          469
```

Based on this analysis, it was predicted that these proteins and their epitopes could be useful antigens for vaccines or diagnostics.

EXAMPLE 2163

A DNA sequence (GBSx2280) was identified in *S. agalactiae* <SEQ ID 6685> which encodes the amino acid sequence <SEQ ID 6686>. Analysis of this protein sequence reveals the following:

```
Possible site: 16
>>> Seems to have no N-terminal signal sequence
    INTEGRAL    Likelihood = -10.40    Transmembrane   247-263 (241-273)
    INTEGRAL    Likelihood =  -8.55    Transmembrane   429-445 (424-450)
    INTEGRAL    Likelihood =  -4.88    Transmembrane   285-301 (280-303)
    INTEGRAL    Likelihood =  -3.82    Transmembrane   207-223 (205-225)
    INTEGRAL    Likelihood =  -3.40    Transmembrane   113-129 (112-139)
    INTEGRAL    Likelihood =  -1.97    Transmembrane   309-325 (305-328)
    INTEGRAL    Likelihood =  -1.59    Transmembrane   395-411 (395-411)
    INTEGRAL    Likelihood =  -1.49    Transmembrane   174-190 (173-193)

----- Final Results -----
          bacterial membrane  --- Certainty = 0.5161(Affirmative) < succ>
           bacterial outside  --- Certainty = 0.0000(Not Clear)   < succ>
         bacterial cytoplasm  --- Certainty = 0.0000(Not Clear)   < succ>
```

The protein has homology with the following sequences in the GENPEPT database.

```
>GP: CAA84286 GB: Z34526 beta-glucoside permease [Bacillus subtilis]
Identities = 225/594 (37%), Positives = 351/594 (58%), Gaps = 11/594 (1%)

Query:   4 YQETAKAILAAVGGEKNIQHVTHCVTRLRLVLDNDEIVNDQVIKTIPNVIGVMRKNDQYQ  63
           Y + +K IL  VGGE+N+Q V HC+TRLR L ++    + ++P V+G    +Q+Q
Sbjct:   3 YDKLSKDILQLVGGEENVQRVIHCMTRLRFNLHDNAKADRSQLEQLPGVMGTNISGEQFQ  62

Query:  64 IILGNDVNNYYNAFLALGHFENTTREFSSQKKSSILEKLIETIAGVITPLIPALLGGGML 123
           II+GNDV    Y A +   +       SS +K ++L + + I+GV TP++PA+ G GM+
Sbjct:  63 IIIGNDVPKVYQAIVRHSNLSDEKSAGSSSQKKNVLSAVFDVISGVFTPILPAIAGAGMI 122

Query: 124 KVIGILLPMLGIASSSSQTVAFINFFGDAAYYFMPIMIAYSAASRFKVTPVLAATVGGIL 183
           K + L  G + SQ   GD A+YF+P+++A SAA +F  P +AA +  +
Sbjct: 123 KGLVALAVTFGWMAEKSQVHVILTAVGDGAFYFLPLLLAMSAARKFGSNPYVAAAIAAAI 182

Query: 184 LHPAFVTMVAEGKPLSLFGAPVTLASYGSSVIPILIMVFLMQYIERWINKIVPSVMKSFL 243
           LHP   ++  GKP+S  G PVT A+Y S+VIPIL+ +++   Y+E+WI++   + +K +
Sbjct: 183 LHPDLTALLGAGKPISFIGLPVTAATYSSTVIPILLSIWIASYVEKWIDRFTHASLKLIV 242
```

-continued
```
Query: 244 QPTLIILISGFLALVVVGPLGVIIGKGLSSAMLSIYHVAPWLALSILGAIMPLVVMTGMH 303
            PT +LI    L L+ VGPLG I+G+ LSS +  ++   A  +A+ +L    L++MTGMH
Sbjct: 243 VPTFTLLIVVPLTLITVGPLGAILGEYLSSGVNYLFDHAGLVAMILLAGTFSLIIMTGMH 302

Query: 304 WAFAPIFLAASVATPDVLILPAMLASNLAQGAASLAVAVKAKQKQTRQVAFAAGLSALLA 363
            +AF PI +             +LPAM +N+ Q  AS AV ++++ K+ +  +A    ++AL+
Sbjct: 303 YAFVPIMINNIAQNGHDYLLPAMFLANMGQAGASFAVFLRSRNKKFKSLALTTSITALM- 361

Query: 364 GITEPALYGVTLKFKKPLYAAMISGGLVGAYIGLVNIASYTFVVPSIIGLPQYINPQGGN 423
            GITEPA+YGV ++ KKP  AA+I G   GA+ G+   +ASY +V    GLP  I    G
Sbjct: 362 GITEPAMYGVNMRLKKPFAAALIGGAAGGAFYGMTGVASY--IVGGNAGLPS-IPVFIGP 418

Query: 424 NFSNAVIAAIATIILTFIITWFLGIDEGENEKSSINAQEHTHIRSGLSKKETLYSPMVGN 483
             F   A+I  +         + LG ++   ++ S    Q    H   S      +E ++SP+ G
Sbjct: 419 TFIYAMIGLVIAFAAETAAAYLLGFEDVPSDGSQ---QPAVHEGS----REIIHSPIKGE 471

Query: 484 VLPLSKVPDETFSSKLLGEGLAITPSVGEVYAPFDGEIISLFPTKHAIALKDDKGVEVLI 543
            V   LS+V D   FS+ ++G+G AI P   GEV +P   G +  ++F TKHAI +   D+G E+LI
Sbjct: 472 VKALSEVKDGVFSAGVMGKGFAIEPEEGEVVSPVRGSVTTIFKTKHAIGITSDQGAEILI 531

Query: 544 HIGIDTVELNGEGFEQLVKVGDFVKRGQLLLRMDIDFISSKGYSLISPVVVTNS       597
            HIG+DTV+L G+  F      +K GD V  G L+  D++  I  + GY +I+PV+VTN+
Sbjct: 532 HIGLDTVKLEGQWFTAHIKEGDKVAPGDPLVSFDLEQIKAAGYDVITPVIVTNT        585
```

A related DNA sequence was identified in *S. pyogenes* <SEQ ID 2883> which encodes the amino acid sequence <SEQ ID 2884>. Analysis of this protein sequence reveals the following:

```
Possible site: 20
>>> Seems to have no N-terminal signal sequence
    INTEGRAL    Likelihood = -10.40    Transmembrane    246-262  (240-271)
    INTEGRAL    Likelihood =  -6.26    Transmembrane    284-300  (279-304)
    INTEGRAL    Likelihood =  -4.14    Transmembrane    173-189  (172-194)
    INTEGRAL    Likelihood =  -3.24    Transmembrane    112-128  (111-137)
    INTEGRAL    Likelihood =  -2.39    Transmembrane    428-444  (425-445)
    INTEGRAL    Likelihood =  -2.13    Transmembrane    383-399  (380-401)
    INTEGRAL    Likelihood =  -1.97    Transmembrane    308-324  (304-327)

----- Final Results -----
            bacterial membrane  --- Certainty = 0.5161(Affirmative) < succ>
             bacterial outside  --- Certainty = 0.0000(Not Clear)   < succ>
            bacterial cytoplasm --- Certainty = 0.0000(Not Clear)   < succ>
```

An alignment of the GAS and GBS proteins is shown below.

```
Identities = 508/619 (82%), Positives = 561/619 (90%), Gaps = 1/619 (0%)

Query:    4 YQETAKAILAAVGGEKNIQHVTHCVTRLRLVLDNDEIVNDQVIKTIPNVIGVMRKNDQYQ   63
            YQETAKAILAAVGG+ NIQ VTHCVTRLRLVL NDE V DQ +K  I NVIGVMRKN QYQ
Sbjct:    3 YQETAKAILAAVGGKTNIQRVTHCVTRLRLVLKNDEKVKDQQVKAISNVIGVMRKNGQYQ   62

Query:   64 IILGNDVNNYYNAFLALGHFENTTREFSSQKKSSILEKLIETIAGVITPLIPALLGGGML  123
            IILGNDVNNYY AFL+LGHF+N   + SS+ K SILE+LIETIAGVITPLIPALLGGGML
Sbjct:   63 IILGNDVNNYYQAFLSLGHFDNQDEDHSSKAKGSILERLIETIAGVITPLIPALLGGGML  122

Query:  124 KVIGILLPMLGIASSSSQTVAFINFFGDAAYYFMPIMIAYSAASRFKVTPVLAATVGGIL  183
            KV+GILLPMLG+AS+ SQTVAFINFFGDAAYYFMP+MIAYSAA+RFKVTPVLAAT+ GIL
Sbjct:  123 KVVGILLPMLGLASADSQTVAFINFFGDAAYYFMPVMIAYSAAARFKVTPVLAATIAGIL  182

Query:  184 LHPAFVTMVAEGKPLSLFGAPVTLASYGSSVIPILIMVFLMQYIERWINKIVPSVMKSFL  243
            LHPAFV MVAEGKPL+LFGAPVT ASYGSSVIPIL+MV+LMQYIE+W+N++VPSVMKSFL
Sbjct:  183 LHPAFVAMVAEGKPLTLFGAPVTPASYGSSVIPILMMVYLMQYIEKWVNRLVPSVMKSFL  242

Query:  244 QPTLIILISGFLALVVVGPLGVIIGKGLSSAMLSIYHVAPWLALSILGAIMPLVVMTGMH  303
            QPTLIILISGFLALVVVGPLGVIIG+GLS+ ML+IYHVAPWLAL+ILGAIMPLVVMTGMH
Sbjct:  243 QPTLIILISGFLALVVVGPLGVIIGQGLSNTMLAIYHVAPWLALAILGAIMPLVVMTGMH  302

Query:  304 WAFAPIFLAASVATPDVLILPAMLASNLAQGAASLAVAVKAKQKQTRQVAFAAGLSALLA  363
            WAFAPIFLAASVATPDVLILPAMLASNLAQGAASLAVA K KQKQTRQVA AAG+SALLA
Sbjct:  303 WAFAPIFLAASVATPDVLILPAMLASNLAQGAASLAVAFKTKQKQTRQVALAAGISALLA  362

Query:  364 GITEPALYGVTLKFKKPLYAAMISGGLVGAYIGLVNIASYTFVVPSIIGLPQYINPQGGN  423
            GITEPALYGVTLKFKKPLYAAMISGGLVGA+IG  VNIASYTFVVPSIIGLPQYINP GG
Sbjct:  363 GITEPALYGVTLKFKKPLYAAMISGGLVGAFIGFVNIASYTFVVPSIIGLPQYINPSGGA  422
```

-continued
```
Query:  424 NFSNAVIAAIATIILTFIITWFLGIDEGENEKSSINAQEHTHIRSGLSKKETLYSPMVGN  483
            NF+NA+IA  ATI+L F +TWF+GIDE E+ K    A + + ++SGLS K+TLY+PM G
Sbjct:  423 NFTNALIAGTATIVLAFSLTWFMGIDE-ESPKQVSVAADMSQVKSGLSTKQTLYAPMTGE  481

Query:  484 VLPLSKVPDETFSSKLLGEGLAITPSVGEVYAPFDGEIISLFPTKHAIALKDDKGVEVLI  543
            +L LS+VPDETFSSKLLGEG AI PS GEVYAPFDGE+I+ FPTKHA+ALK+ +GVEVLI
Sbjct:  482 MLFLSEVPDETFSSKLLGEGFAILPSEGEVYAPFDGEVITFFPTKHAVALKNTRGVEVLI  541

Query:  544 HIGIDTVELNGEGFEQLVKVGDFVKRGQLLLRMDIDFISSKGYSLISPVVVTNSIDQLEI  603
            H+GIDTVEL G+GFEQLV VGD VKRGQ LL+MDIDFI+SKGYSLISPVVVTNS +QLEI
Sbjct:  542 HVGIDTVELKGQGFEQLVSVGDVVKRGQALLKMDIDFITSKGYSLISPVVVTNSAEQLEI  601

Query:  604 IVKDAETMVTNEDDLLVIL                                           622
            I++D + MVT ED LLVIL
Sbjct:  602 IIQDDKKMVTKEDALLVIL                                           620
```

Based on this analysis, it was predicted that these proteins and their epitopes could be useful antigens for vaccines or diagnostics.

EXAMPLE 2164

A DNA sequence (GBSx2281) was identified in *S. agalactiae* <SEQ ID 6687> which encodes the amino acid sequence <SEQ ID 6688>. Analysis of this protein sequence reveals the following:

```
Possible site: 18
>>> Seems to have no N-terminal signal sequence

----- Final Results -----
            bacterial cytoplasm --- Certainty = 0.1148(Affirmative) < succ>
             bacterial membrane --- Certainty = 0.0000(Not Cleat)   < succ>
              bacterial outside --- Certainty = 0.0000(Not Clear)   < succ>
```

The protein has homology with the following sequences in the GENPEPT database.

```
>GP: CAB15944 GB: Z99124 transcriptional antiterminator (BglG family)
[Bacillus subtilis]
Identities = 118/275 (42%), Positives = 183/275 (65%)

Query:    1 MIIKRVLNHNAVISVTHQGLDVLLMGKGIAFKKRIGDRINSDAIEKSFVLKNSDNMNRFT   60
            M I +V+N+N +  V  QG ++++MG+G+AF+K+ GD ++    IEK F L N D   +F
Sbjct:    1 MKIAKVINNNVISVVNEQGKELVVMGRGLAFQKKSGDDVDEARIEKVFTLDNKDVSEKFK   60

Query:   61 ELFITVPEEVVACSERIINLGKIKLGKNLDEILYINLTDHIHSAIERHEQGMVIQNPLRL  120
            L    +P E +   SE II+   K++LGK L++ +Y++LTDHI+ AI+R+++G+  I+N L
Sbjct:   61 TLLYDIPIECMEVSEEIIHYAKLQLGKKLNDSIYVSLTDHINFAIQRNQKGLDIKNALLW  120

Query:  121 EIQRYYPDEYSIGMKALELIKDELGICLTIDESAFIAMHFVNAGLDNPFNEAHKITEIVS  180
            E +R Y DE++IG +AL ++K++ G+ L  DE+ FIA+H VNA L+            IT+++
Sbjct:  121 ETKRLYKDEFAIGKEALVMVKNKTGVSLPEDEAGFIALHIVNAELNEEMPNIINITKVMQ  180

Query:  181 YIEQKVKIDFRTELDESSIDYYRFMTHTKLFAQRVLSGMKYEDDDADLLLVVKKKYPREY  240
            I   VK  F+ E +E S+ YYRF+TH K FAQR+ +G   E  D  LL  VK+KY R Y
Sbjct:  181 EILSIVKYHFKIEFNEESLHYYRFVTHLKFFAQRLFNGTHMESQDDFLLDTVKEKYHRAY  240

Query:  241 KCVKEIGNNMAIQYQYQLNSSELLYLTVHVKRLVK                           275
            +C K+I    +  +Y+++L S ELLYLT+H++R+VK
Sbjct:  241 ECTKKIQTYIEREYEHKLTSDELLYLTIHIERVVK                           275
```

A related DNA sequence was identified in *S. pyogenes* <SEQ ID 6689> which encodes the amino acid sequence <SEQ ID 6690>. Analysis of this protein sequence reveals the following:

```
Possible site: 32
>>> Seems to have no N-terminal signal sequence

----- Final Results -----
            bacterial cytoplasm --- Certainty = 0.0680(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below.

```
Identities = 220/279 (78%), Positives = 246/279 (87%)

Query:    1 MIIKRVLNHNAVISVTHQGLDVLLMGKGIAFKKRIGDRINSDAIEKSFVLKNSDNMNRFT   60
            M+IKRVLNHNA IS  HQGLD+LLMGKGI F K++GD I  +AIE SFVLKNSDNMNRFT
Sbjct:    1 MLIKRVLNHNAAISTNHQGLDILLMGKGITFGKKVGDSIELNAIETSFVLKNSDNMNRFT   60

Query:   61 ELFITVPEEVVACSERIINLGKIKLGKNLDEILYINLTDHIHSAIERHEQGMVIQNPLRL  120
            ELFITVP+EVVACSERIINLGKIKLGK LDEILYINLTDHIHSAIERHEQGM+I NPLR
Sbjct:   61 ELFITVPQEVVACSERIINLGKIKLGKTLDEILYINLTDHIHSAIERHEQGMLIHNPLRW  120

Query:  121 EIQRYYPDEYSIGMKALELIKDELGICLTIDESAFIAMHFVNAGLDNPFNEAHKITEIVS  180
            EIQRYYPDEYS+G+KALELI+  LG+ L IDE+AFIAMHFVNA LD PF E H++TEIVS
Sbjct:  121 EIQRYYPDEYSLGVKALELIERNLGVTLAIDEAAFIAMHFVNASLDTPFKEPHRLTEIVS  180

Query:  181 YIEQKVKIDFRTELDESSIDYYRFMTHTKLFAQRVLSGMKYEDDDADLLLVVKKKYPREY  240
            YIEQK+K DF+TELD++SIDYYRFMTH KLFAQRVLS M Y+DDDA+LLLVVK KYP+EY
Sbjct:  181 YIEQKIKTDFKTELDDTSIDYYRFMTHIKLFAQRVLSQMSYDDDDAELLLVVKTKYPKEY  240

Query:  241 KCVKEIGNNMAIQYQYQLNSSELLYLTVHVKRLVKNLKE                      279
            +CV +I   +  +Y Y LNSSELLYLTVHVKRLVK+LKE
Sbjct:  241 RCVLDISEEIKKRYNYHLNSSELLYLTVHVKRLVKHLKE                      279
```

Based on this analysis, it was predicted that these proteins and their epitopes could be useful antigens for vaccines or diagnostics.

EXAMPLE 2165

A DNA sequence (GBSx2282) was identified in *S. agalactiae* <SEQ ID 6691> which encodes the amino acid sequence <SEQ ID 6692>. Analysis of this protein sequence reveals the following:

```
Possible site: 16
>>> Seems to have no N-terminal signal sequence

----- Final Results -----
         bacterial cytoplasm --- Certainty = 0.1104(Affirmative) < succ>
          bacterial membrane --- Certainty = 0.0000(Not Clear)   < succ>
           bacterial outside --- Certainty = 0.0000(Not Clear)   < succ>
```

A related GBS nucleic acid sequence <SEQ ID 9335> which encodes amino acid sequence <SEQ ID 9336> was also identified.

A related DNA sequence was identified in *S. pyogenes* <SEQ ID 6693> which encodes the amino acid sequence <SEQ ID 6694>. Analysis of this protein sequence reveals the following:

```
Possible site: 23
>>> Seems to have no N-terminal signal sequence

----- Final Results -----
         bacterial cytoplasm --- Certainty = 0.3314(Affirmative) < succ>
          bacterial membrane --- Certainty = 0.0000(Not Clear)   < succ>
           bacterial outside --- Certainty = 0.0000(Not Clear)   < succ>
```

An alignment of the GAS and GBS proteins is shown below.

```
Identities = 143/178 (80%), Positives = 161/178 (90%)

Query:    1 MTLHHDKHHATYVANANAALEKHPEIGEDLEALLADVSQIPEDIRQAVINNGGGHLNHAL   60
            MTLHHDKHHATYVAN NAALEKHPEIGE+LE LLADV++IPEDIRQ +INNGGGHLNHAL
Sbjct:   24 MTLHHDKHHATYVANTNAALEKHPEIGENLEELLADVTKIPEDIRQTLINNGGGHLNHAL   83

Query:   61 FWELMSPEETQISQELSEDINATFGSFEDFKAAFTAAATGRFGSGWAWLVVNAEGKLEVL  120
            FWEL+SPE+   ++ ++++ I+  FGSF+ FK  FTAAATGRFGSGWAWLVVN EG+LE+
Sbjct:   84 FWELLSPEKQDVTPDVAQAIDDAFGSFDAFKEQFTAAATGRFGSGWAWLVVNKEGQLEIT  143
```

```
Query:  121 STANQDTPIMEGKKPILGLDVWEHAYYLNYRNVRPNYIKAFFEIINWNKVNELYQAAK    178
            STANQDTPI EGKKPIL LDVWEHAYYLNYRNVRPNYIKAFFEI+NW KV+ELYQAAK
Sbjct:  144 STANQDTPISEGKKPILALDVWEHAYYLNYRNVRPNYIKAFFEIVNWKKVSELYQAAK    201
```

Based on this analysis, it was predicted that these proteins and their epitopes could be useful antigens for vaccines or diagnostics.

EXAMPLE 2166

A DNA sequence (GBSx2283) was identified in *S. agalactiae* <SEQ ID 6695> which encodes the amino acid sequence <SEQ ID 6696>. Analysis of this protein sequence reveals the following:

```
Possible site: 39
>>> Seems to have no N-terminal signal sequence

----- Final Results -----
            bacterial cytoplasm --- Certainty = 0.3331(Affirmative) < succ>
            bacterial membrane  --- Certainty = 0.0000(Not Clear)   < succ>
            bacterial outside   --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 2167

A DNA sequence (GBSx2284) was identified in *S. agalactiae* <SEQ ID 6697> which encodes the amino acid sequence <SEQ ID 6698>. This protein is predicted to be DNA polymerase III delta subunit. Analysis of this protein sequence reveals the following:

```
Possible site: 32
>>> Seems to have no N-terminal signal sequence

----- Final Results -----
            bacterial cytoplasm --- Certainty = 0.0511(Affirmative) < succ>
            bacterial membrane  --- Certainty = 0.0000(Not Clear)   < succ>
            bacterial outside   --- Certainty = 0.0000(Not Clear)   < succ>
```

A related GBS nucleic acid sequence <SEQ ID 9743> which encodes amino acid sequence <SEQ ID 9744> was also identified.

A related DNA sequence was identified in *S. pyogenes* <SEQ ID 6699> which encodes the amino acid sequence <SEQ ID 6700>. Analysis of this protein sequence reveals the following:

```
Possible site: 43
>>> Seems to have no N-terminal signal sequence
    INTEGRAL    Likelihood = -1.22    Transmembrane   250-266 (249-266)

----- Final Results -----
            bacterial membrane  --- Certainty = 0.1489(Affirmative) < succ>
            bacterial outside   --- Certainty = 0.0000(Not Clear)   < succ>
            bacterial cytoplasm --- Certainty = 0.0000(Not Clear)   < succ>
```

An alignment of the GAS and GBS proteins is shown below.

```
Identities = 222/340 (65%), Positives = 282/340 (82%)

Query:     1 MIAIEEIGRITPDNLGLVTVLAGEDLGQYAQMKEKLFQVIGFNKDDLAYSYFDLSEEDYQ    60
             MIAIE+I +++ +NLGL+T++ G+D+GQY+Q+K +L + I F+KDDLAYSYFD+SE  YQ
Sbjct:     1 MIAIEKIEKLSKENLGLITLVTGDDIGQYSQLKSRLMEQIAFDKDDLAYSYFDMSEAAYQ    60

Query:    61 NAELDLESLPFLSDYKVVIFDQFQDITTDKKTYLDEQAMKRFEAYLQNPVDTTRLVICAP   120
             +AE+DL SLPF ++ KVVIFD   DITT+KK++L E+ +K FEAYL+NP++TTRL+I AP
Sbjct:    61 DAEMDLVSLPFFAEQKVVIFDHLLDITTNKKSFLKEKDLKAFEAYLENPLETTRLIIFAP   120

Query:   121 GKLDGKRRLVKLLKRDARVLEANTLKESDLKTYFQKYAHQEGLVFEAGVFDELLIKSNYD   180
             GKLD KRRLVKLLKRDA VLEAN LKE++L+TYFQKY+HQ GL FE+G FD+LL+KSN D
Sbjct:   121 GKLDSKRRLVKLLKRDALVLEANPLKSAELRTYFQKYSHQLGLGFESGAFDQLLLKSNDD   180

Query:   181 FSDTLTNIAFLKSYKTDGHISSNDVREAIPKSLQDNIFDLTQDVLLGRIDLARDLVRDLR   240
             FS + N+AFLK+YK  G+IS  D+ +AIPKSLQDNIFDLT+ VL G+ID ARDL+ DLR
Sbjct:   181 FSQIMKNMAFLKAYKKTGNISLTDIEQAIPKSLQDNIFDLTRLVLGGKIDAARDLIHDLR   240

Query:   241 LQGEDEIKLIAIMLGQFRMFLQVKILASKGKSESQIVSELSHYIGRKINPYQVKFAVRDS   300
             L GED+IKLIAIMLGQFR+FLQ+ ILA   K+E Q+V  LS  +GR++NPYQVK+A++DS
Sbjct:   241 LSGEDDIKLIAIMLGQFRLFLQLTILARDVKNEQQLVISLSDILGRRVNPYQVKYALKDS   300

Query:   301 RNLPLAFLKEAIRILIETDYAIKRGTYDKDYLFDLALLKI                      340
             R L LAFL  A++ LIETDY IK G Y+K YL D+ALLKI
Sbjct:   301 RTLSLAFLTGAVKTLIETDYQIKTGLYEKSYLVDIALLKI                      340
```

Based on this analysis, it was predicted that these proteins and their epitopes could be useful antigens for vaccines or diagnostics.

EXAMPLE 2168

A DNA sequence (GBSx2285) was identified in *S. agalactiae* <SEQ ID 6701> which encodes the amino acid sequence <SEQ ID 6702>. Analysis of this protein sequence reveals the following:

```
Possible site: 37
>>> Seems to have no N-terminal signal sequence

----- Final Results -----
            bacterial cytoplasm --- Certainty = 0.3071(Affirmative) < succ>
            bacterial membrane  --- Certainty = 0.0000(Not Clear) <succ>
             bacterial outside  --- Certainty = 0.0000(Not Clear) < succ>
```

No corresponding DNA sequence was identified in *S. pyogenes*.

Based on this analysis, it was predicted that this protein and its epitopes, could be useful antigens for vaccines or diagnostics.

EXAMPLE 2169

A DNA sequence (GBSx2286) was identified in *S. agalactiae* <SEQ ID 6703> which encodes the amino acid sequence <SEQ ID 6704>. This protein is predicted to be esterase. Analysis of this protein sequence reveals the following:

```
Possible site: 26
>>> Seems to have a cleavable N-term signal seq.
    INTEGRAL     Likelihood = -0.32     Transmembrane     175-191(175-191)

----- Final Results -----
             bacterial membrane  --- Certainty = 0.1128(Affirmative) < succ>
              bacterial outside  --- Certainty = 0.0000(Not Clear) < succ>
            bacterial cytoplasm  --- Certainty = 0.0000(Not Clear) < succ>
```

The protein has homology with the following sequences in the GENPEPT database.

```
>GP: AAB17013 GB: L38252 esterase [Acinetobacter lwoffii]
Identities = 63/218 (28%), Positives = 107/218 (48%),
Gaps = 3/218 (1%)

Query: 105 KVIFYVHGGSYIHQASELQYIFVNKLAKKLDAKVVFPIYPKAPTYNYSDAIPKIKKLYQN 164
           ++IF++HGG++      +       + LA +   +V+   YP AP + Y +AI  I  +YQ
Sbjct:  73 QLIFHIHGGAFFLGSLNTHRALMTDLAARTQMQVIHVDYPLAPEHPYPEAIDAIFDVYQA 132

Query: 165 TLASVTSPKQIILVGESAGGGLALGLADNLVTEHIKQPKEIILISPWLDIATNNPKIEKV 224
             L    PK II+ G+S G LAL L    L +     P +IL+SP+LD+   +    +
Sbjct: 133 LLVQGIKPKDIIISGDSCGANLALALCLRLKQQPELMPSGLILMSPYLDLTLTSESLRFN 192

Query: 225 QKKDPLLKAWQLQQVAPYWANGKKNFKNPQVSPLYSSQFNKMAPISFFIGTHDIFYPDNQ 284
           QK D LL    LQ      ++         +P+VSPL+    + + P     +G+ +I   D++
Sbjct: 193 QKHDALLSIEALQAGIKHYLTDDIQPGDPRVSPLF-DDLDGLPPTLVQVGSKEILLDDSK 251

Query: 285 LLHQKLAKENIKHHYIVGQKMNHVYPVLP--IPEAETA                        320
           +K  + ++K H+ +    M H + +     PEA+ A
Sbjct: 252 RFREKAEQADVKVHFKLYTGMWHNFQMFNAWFPEAKQA                        289
```

There is also homology to SEQ ID 3498.

Based on this analysis, it was predicted that this protein and its epitopes, could be useful antigens for vaccines or diagnostics.

EXAMPLE 2170

A DNA sequence (GBSx2287) was identified in *S. agalactiae* <SEQ ID 6705> which encodes the amino acid sequence <SEQ ID 6706>. This protein is predicted to be purine nucleotide synthesis repressor. Analysis of this protein sequence reveals the following:

```
Possible site: 51
>>> Seems to have no N-terminal signal sequence

----- Final Results -----
            bacterial cytoplasm --- Certainty = 0.2970(Affirmative) < succ>
            bacterial membrane  --- Certainty = 0.0000(Not Clear)   < succ>
            bacterial outside   --- Certainty = 0.0000(Not Clear)   < succ>
```

The protein has homology with the following sequences in the GENPEPT database.

```
>GP: CAB16124 GB: Z99124 similar to transcriptional regulator
(LacI family) [Bacillus subtilis]
Identities = 111/300 (37%), Positives = 175/300 (58%),
Gaps = 4/300 (1%)

Query:   1 MTSISDIAKKAGVAKSTVSRVINHHPHVSDETRQKVMALITELDYIPNQLARDLSRGKTQ  60
           M +I +IA+ A V+ STVSRV+NHHP+VS+E R+ V  ++ ELDY PN+ A DL RGKT
Sbjct:   1 MANIKEIARLANVSVSTVSRVLNHHPYVSEEKRKLVHQVMKELDTPNRTAIDLIRGKTH  60

Query:  61 KIGVVIPHTRHPYFTQLINGLLDAAKTTDYQLVMMPSDYNQELELSYLKQLKMEAIDALI 120
           +GV++P++ HP F +++NG+  AA    +Y   ++P++YN ++E+ YL+ L+ +  ID LI
Sbjct:  61 TVGVILPYSDHPCFDKIVNGITKAAFQHEYATTLLPTNYNPDIEIKYLELLRTKKIDGLI 120

Query: 121 FTSRAISLDIIETYAKYGRIVVCEKLQEYNHLSSAYLDRYSSFLEAFSDMKLRGLEHLVL 180
            TSRA    D I  Y +YG ++ CE   + + +  A+ DR +++ E+F  +K RG E++
Sbjct: 121 ITSRANHWDSILAYQEYGPVIACEDTGDID-VPCAFNDRKTAYAESFRYLKSRGHENIAF 179

Query: 181 LFSRNNESSATYQSALLAYQEVYGQLSSPYMVVGNVHDFNDG-LNLSYQLVKEVSIDGIL 239
              R + S +       AY+ V G+L   +M+ G  +D NDG L     +     I
Sbjct: 180 TCVREADRSPSTADKAAAYKAVCGRLEDRHMLSG-CNDMNDGELAAEHFYMSGRVPTAIY 238

Query: 240 ATSDEVAAGLIKGYEESRKKCPYIIGQECLLVGQLLKLPTIDHKSYYLGKLAFKQALAEK 299
           A SDEVAAG I + +         IIG+  + ++L P++D     LG AF   L ++
Sbjct: 239 ANSDEVAAG-IHLFAKKNNWDVEIIGEGNTSISRVLGFPSLDLNLEQLGIAAFSLFLQDE 297
```

Based on this analysis, it was predicted that this protein and its epitopes, could be useful antigens for vaccines or diagnostics.

EXAMPLE 2171

A DNA sequence (GBSx2288) was identified in *S. agalactiae* <SEQ ID 6707> which encodes the amino acid sequence <SEQ ID 6708>. Analysis of this protein sequence reveals the following:

```
Possible site: 45
>>> Seems to have no N-terminal signal sequence

----- Final Results -----
            bacterial cytoplasm --- Certainty = 0.3451(Affirmative) < succ>
            bacterial membrane  --- Certainty = 0.0000(Not Clear)   < succ>
             bacterial outside  --- Certainty = 0.0000(Not Clear)   < succ>
```

The protein has homology with the following sequences in the GENPEPT database.

```
>GP: AAC21682 GB: U32686 conserved hypothetical protein
[Haemophilus influenzae Rd ]
Identities = 79/264 (29%), Positives = 134/264 (49%),
Gaps = 16/264 (6%)

Query:    1 MTIKRIFCDMDGTLLNSEGQVSKSNATLIREAA---IPVTLVSARAPMEMKDAVDALQLG    57
            M  K +F D +GTLL S+  +S     +I+      IP  +SAR+P+ +       L+
Sbjct:    1 MMYKAVFSDFNGTLLTSQHTISPRTVVVIKRLTANGIPFVPISARSPLGILPYWKQLETN   60

Query:   58 GVQVAFNGGLIYRIGDNNQVLPIHTQIIKKSTVKQLLRGIRFHFPQVSLSYYDLNNWYCD  117
              V VAF+G LI     N + PI++  I+   ++    + H P + ++YY  N+  +
Sbjct:   61 NVLVAFSGALIL----NQNLEPIYSVQIEPKDILEINTVLAEH-PLLGVNYYTNNDCHAR  115

Query:  118 KID-EGIRYEHSLTQQCPTFIHNEDQFLEGHTNTFKIMMITFDEANMLELEKYLQSLELP  176
            ++ +  + YE S+T+    IH  D+    T +   + I +    ++E+E L+  + P
Sbjct:  116 DVENKWVIYERSVTK---IEIHPFDEVA---TRSPHKIQIIGEAEEIIEIEVLLKE-KFP  168

Query:  177 EITIQRSGKAYLEITHLLAKKSKGIAYILQKEQLAREETAAFGDGHNDLPMLEMVGYPIV  236
             ++I RS   +LE+  H   A K  + ++       +     E  AFGD  NDL MLE VG  +
Sbjct:  169 HLSICRSHANFLEVMHKSATKGSAVRFLEDYFGVQTNEVIAFGDNFNDLDMLEHVGLGVA  228

Query:  237 MDNAFDDIKAIAYQLTKSNDEDGV                                    260
            M  NA  ++IK   A   +T +N+EDG+
Sbjct:  229 MGNAPNEIKQAANVVTATNNEDGL                                    252
```

Based on this analysis, it was predicted that this protein and its epitopes, could be useful antigens for vaccines or diagnostics.

EXAMPLE 2172

A DNA sequence (GBSx2289) was identified in *S. agalactiae* <SEQ ID 6709> which encodes the amino acid sequence <SEQ ID 6710>. Analysis of this protein sequence reveals the following:

```
Possible site: 60
>>> Seems to have no N-terminal signal sequence

----- Final Results -----
            bacterial cytoplasm --- Certainty = 0.2854 (Affirmative) < succ>
            bacterial membrane  --- Certainty = 0.0000(Not Clear)    < succ>
             bacterial outside  --- Certainty = 0.0000(Not Clear)    < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 2173

A DNA sequence (GBSx2290) was identified in *S. agalactiae* <SEQ ID 6711> which encodes the amino acid sequence <SEQ ID 6712>. Analysis of this protein sequence reveals the following:

```
Possible site: 40
>>> Seems to have an uncleavable N-term signal seq
      INTEGRAL    Likelihood = -10.51    Transmembrane    392-408  (376-417)
      INTEGRAL    Likelihood =  -9.92    Transmembrane    440-456  (433-461)
      INTEGRAL    Likelihood =  -6.42    Transmembrane     52-68   (51-70)
      INTEGRAL    Likelihood =  -6.32    Transmembrane     29-45   (9-48)
      INTEGRAL    Likelihood =  -6.32    Transmembrane    309-325  (308-328)
      INTEGRAL    Likelihood =  -4.46    Transmembrane     12-28   (9-29)
      INTEGRAL    Likelihood =  -3.29    Transmembrane    463-479  (462-479)
      INTEGRAL    Likelihood =  -2.07    Transmembrane    353-369  (352-369)
      INTEGRAL    Likelihood =  -1.17    Transmembrane    374-390  (374-390)
      INTEGRAL    Likelihood =  -0.85    Transmembrane    247-263  (247-263)
      INTEGRAL    Likelihood =  -0.06    Transmembrane    278-294  (278-294)

----- Final Results -----
           bacterial membrane  --- Certainty = 0.5203(Affirmative) < succ>
           bacterial outside   --- Certainty = 0.0000(Not Clear)   < succ>
           bacterial cytoplasm --- Certainty = 0.0000(Not Clear)   < succ>
```

The protein has homology with the following sequences in the GENPEPT database.

```
>GP: AAC23742 GB: AF052208 competence protein [Streptococcus pneumoniae]
Identities = 325/705 (46%), Positives = 478/705 (67%), Gaps = 3/705 (0%)

Query:    1 MLQLTKYFPLKPIYLALLVFQIYLLVFSWTMLGCAFLLFSFIFLIYQYDRETIFKTIAIV    60
            MLQ  K F +  IYL+ L+  +Y  +FS + L     +F  + L  Q+ ++   K + I
Sbjct:    1 MLQWIKNFSIPLIYLSFLLLWLYYAIFSASYLALLGFVFLLVCLFIQFPWKSAGKVLIIC   60

Query:   61 IFFLFYFLWQNHNMNVQYQRVPNHISQIKVRIDTISINGDVLSFQADASGNTYQAFYTLK   120
              F F+F++QN    Q + + ++++  DT+ +NGD LSF+  A G  +Q +Y L+
Sbjct:   61 GIFGFWFVFQNWQQSQASQNLADSVERVRILPDTVKVNGDSLSFRGKADGRIFQVYYKLQ   120

Query:  121 NKSEKDYFQNLDNNIMIIADIKLEEAEERRHFNGFDYRQYLKRHGIYRIAKVTKIKQIRL   180
             ++ EK+ FQ L +   I + KL E E +R+F GF+Y+ YLK  GIY+   + KI+ ++
Sbjct:  121 SEEEKEAFQALTDLHEIGLEGKLSEPEGQRNFGGFNYQAYLKTQGIYQTLNIKKIQSLQK   180

Query:  181 FQHRSFFALMSKWRRSAIVISQT-FPNPMRHYMSGLLFGYLDKTFDDMSLYSSLGIIHL   239
                   +S   RR A+V   +T  FP+PMR+YM+GLL  G+LD   F++M++LYSSLGIIHL
Sbjct:  181 IGSWDIGENLSSLRRKAVVWIKTHFPDPMRNYMTGLLLGHLDTDFEEMNELYSSLGIIHL   240

Query:  240 FALSGMQVGFFLGIFRYICLRIGLRLDHVWLLQIPFSLIYAGLTGFSISVVRALIQSLLS   299
            FALSGMQVGFF+  F+ +  LR+GL + +   L  PFSLIYAGLTGFS SV+R+L+Q LL+
Sbjct:  241 FALSGMQVGFFMNGFKKLLLRLGLTQEKLKWLTYPFSLIYAGLTGFSASVIRSLLQKLLA   300

Query:  300 HSGVKKDENFALCLLICLISLPHSLLTTGGVLSFAYAFILTMTSFDHFSSIKKVAIESLT   359
               GVK +N AL +L+  I +P+  T GGVLS AYAFILTM S +    +K VA ESL
Sbjct:  301 QHGVKGLDNCALTVLVLFIVMPNFFFTAGGVLSCAYAFILTMPSKEG-EGLKAVASESLV   359

Query:  360 VSVGILPILTYYFSGFQPISIILTALLSFAFDIIFLPLLTVIFVLSPIVKLSCINSLFEI   419
            +S+GILPIL++YF+ FQP SI+LT + SF FD+ FLPLL+++FVLS +  +  +N +FE
Sbjct:  360 ISLGILPILSFYFAEFQPWSILLTFVFSFLFDLTFLPLLSILFVLSFLYPVIQLNFIFEW   419

Query:  420 LEVLLKWTGQLFPRPLIFGKPSLFLLIVMIIILGLLYDYYHSKCFRYCSLLIIFTLFFIT   479
            LE +++    Q+  RPL+FG+P+ +LLI+++I L L+YD +          L+I  LF +T
Sbjct:  420 LEGIIRLVSQVTSRPLVFGQPNTWLLILLLISLALVYDLRKNIKKLTVLCLLITGLFLLT   479

Query:  480 KNPITNEVAILDVGQGDSILVRDWLGKTILIDTGGRVR-FEQPEEWKQKVNQSNAKRTLI   538
            K+P+ NE+  +LDVGQG+SI +RD  GKTILID GG+    +++ ++W++K+  SNA+R+LI
Sbjct:  480 KHPLENEITMLDVGQGESIFLRDVTGKTILIDVGGKAESYKKIKKWQEKMTTSNAQRSLI   539

Query:  539 PYLKSRGISKIDDLVITHTDTDHMGDMEVISKHFKVARLITSSGSLTNSQYVKHLSKIGV   598
            PYLKSRG++KID L++T+TD +H+GD+   ++K F V  ++ S  SL   ++V  L
Sbjct:  540 PYLKSRGVAKIDQLILTNTDKEHVGDLSEMTKAFHVGEILVSKDSLKQKEFVAELQATQT   599
```

```
                              -continued
Query:  599 AVKSIEAGDKLAVMGSYLQVLYPWHKGDGKNNDSIVLYGHLLGKGFLFTGDLEEEGEKQL  658
            V+S+   G+ L + GS L+VL P    GDG ++D++VLYG  L K FLFTG+LEE+GEK L
Sbjct:  600 KVRSMIVGENLPIFGSQLEVLSPRKMGDGGHDDTLVLYGKFLDKQFLFTGNLEEKGEKDL  659

Query:  659 LEAYPNLSVDILKAGHHGSKGSSSLSFLKKLSPSVVLVSAGKNNR                 703
            L+ YP+L V++LKA  HG+K SSS +FL+KL P + L+S GK+NR
Sbjct:  660 LKHYPDLKVNVLKASQHGNKKSSSPAFLEKLKPELTLISVGKSNR                 704
```

A related DNA sequence was identified in *S. pyogenes* <SEQ ID 6713> which encodes the amino acid sequence 10 <SEQ ID 6714>. Analysis of this protein sequence reveals the following:

```
Possible site: 29
>>> Seems to have an uncleavable N-term signal seq
      INTEGRAL    Likelihood = -10.19   Transmembrane   394-410 (380-422)
      INTEGRAL    Likelihood =  -8.28   Transmembrane    54-70  (52-72)
      INTEGRAL    Likelihood =  -6.32   Transmembrane   356-372 (355-377)
      INTEGRAL    Likelihood =  -4.73   Transmembrane     8-24  (7-25)
      INTEGRAL    Likelihood =  -4.30   Transmembrane    30-46  (29-50)
      INTEGRAL    Likelihood =  -3.88   Transmembrane   249-265 (249-267)
      INTEGRAL    Likelihood =  -3.40   Transmembrane   467-483 (465-484)
      INTEGRAL    Likelihood =  -2.39   Transmembrane   325-341 (325-347)
      INTEGRAL    Likelihood =  -0.43   Transmembrane   441-457 (441-458)

----- Final Results -----
            bacterial membrane --- Certainty = 0.5076(Affirmative) < succ>
            bacterial outside  --- Certainty = 0.0000(Not Clear)  < succ>
            bacterial cytoplasm --- Certainty = 0.0000(Not Clear) < succ>
```

The protein has homology with the following sequences in the databases:

```
>GP: AAC23742 GB: AF052208 competence
protein [Streptococcus pneumoniae]
Identities = 311/706 (44%), Positives = 458/706 (64%),
Gaps = 10/706 (1%)

Query:    5 WTKLVPLSKIQFAFLILVFFYQIHSPSWLTFL-LSLSLICLLVKRLSKK--EFLGVFAIL   61
            W K   + I +FL+L +Y I S S+L  L     L+CL ++   K    +L + I
Sbjct:    4 WIKNFSIPLIYLSFLLLWLYYAIFSASYLALLGFVFLLVCLFIQFPWKSAGKVLIICGIF   63

Query:   62 SFCALFLLYQKQQLVQKLEIQPVQITSVALVPDSIRINGDQLAVLGRHGKHSYQLFYRLK  121
            F  +F +Q+ Q  Q L    + V ++PD++++NGD L+  G+      +Q++Y+L+
Sbjct:   64 GFWFVFQNWQQSQASQNLADS---VERVRILPDTVKVNGDSLSFRGKADGRIFQVYYKLQ  120

Query:  122 SQAEAQLFKKEHRWLVMHAKVTLEKAEEVRNFKGFNYQTFLTYQGIYRIGKVEQIEQLEV  181
            S+ E + F+       + +  L + E  RNF GFNYQ +L  QGIY+   +++I+ L+
Sbjct:  121 SEEEKEAFQALTDLHEIGLEGKLSEPEGQRNFGGFNYQAYLKTQGIYQTLNIKKIQSLQK  180

Query:  182 ISPESICDYLSSLRRRAIVHCQQHFPRPMSHYLTGLLFGYLDKSFGEMTDYYSQLGIIHL  241
            I     I + LSSLRR+A+V  + HFP PM +Y+TGLL G+LD   F EM + YS LGIIHL
Sbjct:  181 IGSWDIGENLSSLRRKAVVWIKTHFPDPMRNYMTGLLLGHLDTDFEEMNELYSSLGIIHL  240

Query:  242 FALSGMQVGFFLTCFRRVLLLLAVPLEWIKWIELPFACFYAALTGYSISVIRSLVQSQLR  301
            FALSGMQVGFF+   F+++LL L +  E +KW+   PF+   YA LTG+S SVIRSL+Q  L
Sbjct:  241 FALSGMQVGFFMNGFKKLLLRLGLTQEKLKWLTYPFSLIYAGLTGFSASVIRSLLQKLLA  300

Query:  302 HLGIKGLDNLACTFLLVFLWDAHFLMTVGGVLTFSYAFLLTVVTVEELSGAKRQLVQVLT  361
               G+KGLDN A T L++F+    +F  T GGVL+  +YAF+LT+ + +E   G K    + L
Sbjct:  301 QHGVKGLDNCALTVLVLFIVMPNFFFTAGGVLSCAYAFILTMPS-KEGEGLKAVASESLV  359

Query:  362 ISLGILPFLLFYFSSFNPMSMVLTGLLSYLFDLFILPLLCLVFCLSPLVTVSICNHLFIL  421
            ISLGILP L FYF+ F P S++LT + S+LFDL  LPLL ++F LS L  V    N +F
Sbjct:  360 ISLGILPILSFYFAEFQPWSILLTFVFSFLFDLTFLPLLSILFVLSFLYPVIQLNFIFEW  419

Query:  422 LEKVIQFLGNTFNSSLVFGSPTSWHLLILVISFAIFYDYRQ-VRQRVITCGLVIALTLLS  480
            LE +I+ +      +  LVFG P +W L++L+IS A+ YD R+ +++   + C L+  L LL+
Sbjct:  420 LEGIIRLVSQVTSRPLVFGQPNTWLLILLLISLALVYDLRKNIKKLTVLCLLITGLFLLT  479

Query:  481 VKYPLTNEVTFIDIGQGDSILVREWTGKNLLIDVGGR-PFFSSKEHWRRGHHVANAQKTL  539
            K+PL NE+T +D+GQG+SI +R+ TGK +LIDVGG+       + W+        +NAQ++L
Sbjct:  480 -KHPLENEITMLDVGQGESIFLRDVTGKTILIDVGGKAESYKKIKKWQEKMTTSNAQRSL  538
```

-continued

```
Query: 540 IPYLKSRGIHTIDQLLVTHADTDHMGDIEVVAKAIRIKEILTSQGSLSHPSFVRRLRRLK 599
            IPYLKSRG+  IDQL++T+ D +H+GD+  + KA + EIL S+ SL    FV L+ +
Sbjct: 539 IPYLKSRGVAKIDQLILTNTDKEHVGDLSEMTKAFHVGEILVSKDSLKQKEFVAELQATQ 598

Query: 600 CHVRVLAAGDQLPIMGSVLQVLYPWQLGDGKNNDSLVLYGRLLNRTFLFTGDLEKEGENE 659
            VR +   G+ LPI GS L+VL P ++GDG ++D+LVLYG+ L++  FLFTG +LE++GE +
Sbjct: 599 TKVRSMIVGENLPIFGSQLEVLSPRKMGDGGHDDTLVLYGKFLDKQFLFTGNLEEKGEKD 658

Query: 660 IIKRYPQLRVDYLKAGHHGSNTSSSAAFLDHIQPKVAFISAGKNNR              705
            ++K YP L+V+ LKA  HG+  SSS AFL+ ++P++  IS GK+NR
Sbjct: 659 LLKHYPDLKVNVLKASQHGNKKSSSPAFLEKLKPELTLISVGKSNR              704
```

An alignment of the GAS and GBS proteins is shown below.

```
Identities = 346/743 (46%), Positives = 491/743 (65%), Gaps = 3/743 (0%)

Query:   5 TKYFPLKPIYLALLVFQIYLLVFSWTMLGCAFLLFSFIFLIYQYDRETIFKTIAIVIFFL   64
           TK  PL   I  A L+ + + + S + L    L+ + ++       AI+ F
Sbjct:   6 TKLVPLSKIQFAFLILVFFYQIHSPSWLTFLLSLSLICLLVKRLSKKEFLGVFAILSFCA  65

Query:  65 FYFLWQNHNMNVQYQRVPNHISQIKVRIDTISINGDVLSFQADASGNTYQAFYTLKNKSE  124
             + L+Q + + + +   P  I+ + + D+I INGD L+        ++YQ FY LK+++E
Sbjct:  66 LFLLYQKQQLVQKLEIQPVQITSVALVPDSIRINGDQLAVLGRHGKHSYQLFYRLKSQAE  125

Query: 125 KDYFQNLDNNIMIIADIKLEEAEERRHFNGFDYRQYLKRHGIYRIAKVTKIKQIRLFQHR  184
             F+    +++ A + LE+AEE R+F GF+Y+ +L    GIYRI KV +I+Q+ +
Sbjct: 126 AQLFKKEHRWLVMHAKVTLEKAEEVRNFKGFNYQTFLTYQGIYRIGKVEQIEQLEVISPE  185

Query: 185 SFFALMSKWRRSAIV-ISQTFPNPMRHYMSGLLFGYLDKTFDDMSDLYSSLGIIHLFALS  243
            S    +S RR AIV   Q FP PM HY++GLLFGYLDK+F +M+D YS LGIIHLFALS
Sbjct: 186 SICDYLSSLRRRAIVHCQQHFPRPMSHYLTGLLFGYLDKSFGEMTDYYSQLGIIHLFALS  245

Query: 244 GMQVGFFLGIFRYICLRIGLRLDHVWLLQIPFSLIYAGLTGFSISVVRALIQSLLSHSGV  303
            GMQVGFFL  FR + L + + L+ +   +++PF+  YA LTG+SISV+R+L+QS L H G+
Sbjct: 246 GMQVGFFLTCFRRVLLLLAVPLEWIKWIELPFACFYAALTGYSISVIRSLVQSLRHLGI  305

Query: 304 KKDENFALCLLICLISLPHSLLTTGGVLSFAYAFILTMTSFDHFSSIKKVAIESLTVSVG  363
           K +N A   L+ +    H L+T GGVL+F+YAF+LT+ + +   S K+   ++ LT+S+G
Sbjct: 306 KGLDNLACTFLLVFLWDAHFLMTVGGVLTFSYAFLLTVVTVEELSGAKRQLVQVLTISLG  365

Query: 364 ILPILTYYFSGFQPISIILTALLSFAFDIIFLPLLTVIFVLSPIVKLSCINSLFEILEVL  423
           ILP L +YFS F P+S++LT LLS+ FD+  LPLL ++F LSP+V +S  N LF +LE +
Sbjct: 366 ILPFLLFYFSSFNPMSMVLTGLLSYLFDLFILPLLCLVFCLSPLVTVSICNHLFILLEKV  425

Query: 424 LKWTGQLFPRPLIFGKPSLFLLIVMIIILGLLYDYYHSKC-FRYCSLLIIFTLFFITKNP  482
            +++   G  F   L+FG P+  L++++I    + YDY     +   C L+I  TL  + K P
Sbjct: 426 IQFLGNTFNSSLVFGSPTSWHLLILVISFAIFYDYRQVRQRVITCGLVIALTLLSV-KYP  484

Query: 483 ITNEVAILDVGQGDSILVRDWLGKTILIDTGGRVRFEQPEEWKQKVNQSNAKRTLIPYLK  542
           +TNEV +D+GQGDSILVR+W GK +LID GGR F    E W++ +  + +NA++TLIPYLK
Sbjct: 485 LTNEVTFIDIGQGDSILVREWTGKNLLIDVGGRPFFSSKEHWRRGHHVANAQKTLIPYLK  544

Query: 543 SRGISKIDDLVITHTDTDHMGDMEVISKHFKVARLITSSGSLTNSQYVKHLSKIGVAVKS  602
           SRGI   ID L++TH DTDHMGD+EV++K  ++  ++TS GSL++   +V+ L ++    V+
Sbjct: 545 SRGIHTIDQLLVTHADTDHMGDIEVVAKAIRIKEILTSQGSLSHPSFVRRLRRLKCHVRV  604

Query: 603 IEAGDKLAVMGSYLQVLYPWHKGDGKNNDSIVLYGHLLGKGFLFTGDLEEEGEKQLLEAY  662
            + AGD+L +MGS LQVLYPW  GDGKNNDS+VLYG LL +  FLFTGDLE+EGE +++  Y
Sbjct: 605 LAAGDQLPIMGSVLQVLYPWQLGDGKNNDSLVLYGRLLNRTFLFTGDLEKEGENEIIKRY  664
```

```
                              -continued
Query:  663 PNLSVDILKAGHHGSKGSSSLSFLKKLSPSVVLVSAGKNNRYQHPHQETLQRFQKIKSKI  722
            P L VD LKAGHHGS   SSS +FL + P V  +SAGKNNRYQHPH+ETL R + +
Sbjct:  665 PQLRVDYLKAGHHGSNTSSSAAFLDHIQPKVAFISAGKNNRYQHPHRETLARLEDRQITY  724

Query:  723 FRTDQSGTIRLTGWWKWHIQTVR                                      745
            +RTD  G IRLTG    WH++TVR
Sbjct:  725 YRTDTQGAIRLTGRTSWHLETVR                                      747
```

Based on this analysis, it was predicted that these proteins and their epitopes could be useful antigens for vaccines or diagnostics.

EXAMPLE 2174

A DNA sequence (GBSx2291) was identified in *S. agalactiae* <SEQ ID 6715> which encodes the amino acid sequence <SEQ ID 6716>. This protein is predicted to be competence protein (comEA). Analysis of this protein sequence reveals the following:

```
Possible site: 38
>>> Seems to have an uncleavable N-term signal seq
     INTEGRAL     Likelihood = -3.77     Transmembrane     18-34 (14-36)

----- Final Results -----
              bacterial membrane --- Certainty = 0.2508(Affirmative) < succ>
               bacterial outside --- Certainty = 0.0000(Not Clear)   < succ>
             bacterial cytoplasm --- Certainty = 0.0000(Not Clear)   < succ>
```

The protein has homology with the following sequences in the GENPEPT database.

```
>GP: AAC23741 GB: AF052208 competence protein [Streptococcus pneumoniae]
Identities = 96/217 (44%), Positives = 138/217 (63%), Gaps = 4/217 (1%)

Query:    3 EIVLEKIKSHKWETTGIIVGLLLFGILGLNHFG-THHKEDNLNINLEK-KVSTITEKKVP   60
            E ++EKIK +K        +GLL+ G  L    T  KE NL  +       ++EK+V
Sbjct:    2 EAIIEKIKEYKIIVICTGLGLLVGGFFLLKPAPQTPVKETNLQAEVAAVSKDLVSEKEVN   61

Query:   61 MISHVKDKVSNQVTVDVKGAVNHPGVYSLPSQSRVTDAIKRAGGLSNLADSKSVNLAQKL  120
             +     +  +  +TVDVKGAV  PG+Y LP  SR+ DA+++AGGL+  ADSKS+NLAQK+
Sbjct:   62 KEEKEEPLEQDLITVDVKGAVKSPGIYDLPVGSRINDAVQKAGGLTEQADSKSLNLAQKV  121

Query:  121 QDETVIYVAQKGEKITVVEEEKANNIATQGNSKGKINLNKADLSSLQTISGVGAKRAQDI  180
             DE ++YV  KGE+  V ++         A+ + + K+NLNKA L  L+ + G+G KRAQDI
Sbjct:  122 SDEALVYVPTKGEE--AVSQQTGLGTASSISKEKKVNLNKASLEELKQVKGLGGKRAQDI  179

Query:  181 LDYRDSQGGFKTIDDLKNVSGIGEKTLEKLRQDVTID                        217
            +D+R++  G FK++D+LK VSGIG  KT+EKL+   VT+D
Sbjct:  180 IDHREANGKFKSVDELKKVSGIGGKTIEKLKDYVTVD                        216
```

A related DNA sequence was identified in *S. pyogenes* <SEQ ID 6717> which encodes the amino acid sequence <SEQ ID 6718>. Analysis of this protein sequence reveals the following:

```
Possible site: 36
>>> Seems to have no N-terminal signal sequence
     INTEGRAL     Likelihood = -9.61     Transmembrane     22-38 (16-42)

----- Final Results -----
              bacterial membrane --- Certainty = 0.4843(Affirmative) < succ>
               bacterial outside --- Certainty = 0.0000(Not Clear)   < succ>
             bacterial cytoplasm --- Certainty = 0.0000(Not Clear)   < succ>
```

The protein has homology with the following sequences in the databases:

```
>GP: AAC23741 GB: AF052208 competence protein [Streptococcus pneumoniae]
Identities = 82/179 (45%), Positives = 124/179 (68%), Gaps = 4/179 (2%)
```

```
                                          -continued
Query:  42 NRQSKAAVPALREISPVKQQVSEEKKEIQEDSSILVDLKGAVQKEGVYKLTASSRVRDVI  101
           N Q++ A + +++    K+   EEK+E  E   I VD+KGAV+  G+Y L    SR+ D +
Sbjct:  42 NLQAEVAAVS-KDLVSEKEVNKEEKEEPLEQDLITVDVKGAVKSPGIYDLPVGSRINDAV  100

Query: 102 ELAGGLTSEADKHAINFAEKLTDEQVVYVPKQGEEISVLPRSLVSGKKETASKDQSKVHI  161
           + AGGLT +AD   ++N A+K++DE +VYVP +GEE  +  +      G   + SK++ KV++
Sbjct: 101 QKAGGLTEQADSKSLNLAQKVSDEALVYVPTKGEE--AVSQQTGLGTASSISKEK-KVNL  157

Query: 162 NKASLEELQHIPGIGAKRAQDIIDMRDKLGGFKALEDLRQVSGIGEKTLEKLKDDIFLD  220
           NKASLEEL+ + G+G KRAQDIID R+  G FK++++L++VSGIG KT+EKLKD + +D
Sbjct: 158 NKASLEELKQVKGLGGKRAQDIIDHREANGKFKSVDELKKVSGIGGKTIEKLKDYVTVD  216
```

An alignment of the GAS and GBS proteins is shown below.

```
Identities = 81/166 (48%), Positives = 111/166 (66%), Gaps = 10/166 (6%)
Query:  62 ISHVKDKVSNQ---------VTVDVKGAVNHPGVYSLPSQSRVTDAIKRAGGLSNLADSK  112
           IS VK +VS +            + VD+KGAV   GVY L + SRV D  I+ AGGL++ AD
Sbjct:  55 ISPVKQQVSEEKKEIQEDSSILVDLKGAVQKEGVYKLTASSRVRDVIELAGGLTSEADKH  114

Query: 113 SVNLAQKLQDETVIYVAQKGEKITVVEEEKANNIA-TQGNSKGKINLNKADLSSLQTISG  171
           ++N A+KL DE V+YV ++GE+I+V+      +    T    + K+++NKA L  LQ I G
Sbjct: 115 AINFAEKLTDEQVVYVPKQGEEISVLPRSLVSGKKETASKDQSKVHINKASLEELQHIPG  174

Query: 172 VGAKRAQDILDYRDSQGGFKTIDDLKNVSGIGEKTLEKLRQDVTID              217
           +GAKRAQDI+D RD  GGFK ++DL+ VSGIGEKTLEKL+ D+ +D
Sbjct: 175 IGAKRAQDIIDMRDKLGGFKALEDLRQVSGIGEKTLEKLKDDIFLD              220
```

A related GBS gene <SEQ ID 8989> and protein <SEQ ID 8990> were also identified. Analysis of this protein sequence reveals the following:

```
Lipop: Possible site: -1 Crend: 9
McG: Discrim Score: 5.70
GvH: Signal Score (-7.5): -2.58
     Possible site: 38
>>> Seems to have an uncleavable N-term signal seq
ALOM program count: 1 value: -3.77 threshold: 0.0
      INTEGRAL        Likelihood = -3.77    Transmembrane    18-34 (14-36)
      PERIPHERAL      Likelihood = 10.40         73
modified ALOM score: 1.25

*** Reasoning Step: 3

----- Final Results -----
             bacterial membrane --- Certainty = 0.2508(Affirmative) < succ>
              bacterial outside --- Certainty = 0.0000(Not Clear)  < succ>
            bacterial cytoplasm --- Certainty = 0.0000(Not Clear)  < succ>
```

The protein has homology with the following sequences in the databases:

```
44.3/64.1% over 215aa
Streptococcus pneumoniae
GP|3211753|competence protein Insert characterized ORF01930(304-951 of 1014)
GP|3211753|gb|AAC23741.1||AF052208(1-216 of 216)competence protein{Streptococcus
pneumoniae}
% Match = 25.0
% Identity = 44.2  % Similarity = 64.1
Matches = 96   Mismatches = 75   Conservative Sub.s =43
       90        120       150       180       210       240       270       300
DDGKKLNPLTYIYRLPLAIIAIVLLVLTLIFSYLASFVWDPQKHLK*GLHGNYLLFSK*FFWFLIGKSL*LRISKWRNIF
       330       369       390       417       447       474       504       534
MFEIVLEKIKSHKWETTGIIVGLLLFGILGLNHFG-THHKEDNLINKLEK-KVSTITEKKVPMISHVKDKVSNQVTVDVK
    | ::||||  :|        :|||  :  :  |      | || ||    :     ::||:|    :      : :||||
MEAIIEKIKEYKIIVICTGLGLLVGGGFFLLKPAPQTPVKETNLQAEVAAVSKDLVSEKEVNKEEKEEPLEQDLITVDVK
        10        20        30        40        50        60        70
       564       594       624       654       684       714       744       774
GAVNHPGVYSLPSQSRVTDAIKRAGGLSNLADSKSVNLAQKLQDETVIYVAQKGEKITVVXEEKANNIATQGNSKGKINL
|||  ||:|| ||  ||: :||||   ||||:||:|| ||| ||:|| |||   |   | ::    |:   :  : |:||
GAVKSPGIYDLPVGSRINDAVQKAGGLTEQADSKSLNLAQKVSDEALVYVPTKGEE-AVSQQTGLGTASSISKEKKVNL
        90       100       110       120       130       140       150
```

```
804        834       864       894       924       954       984      1014
NKADLSSLQTISGVGAKRAQDILDYRDSQGGFKTIDDLKNVSGIGEKTLEKLRQDVTID*VFSSKTYLFSIVGLPNLLTS
||| |  |: : |:| |||||:|:|:: |  ||::|:|| |||||  ||:|||  ||:|
NKASLEELKQVKGLGGKRAQDIIDHREANGKFKSVDELKKVSGIGGKTIEKLKDYVTVD
         170       180       190       200       210
```

SEQ ID 8990 (GBS129) was expressed in *E. coli* as a GST-fusion product. SDS-PAGE analysis of total cell extract is shown in FIG. 41 (lane 4; MW 43.8 kDa).

Based on this analysis, it was predicted that these proteins and their epitopes could be useful antigens for vaccines or diagnostics.

EXAMPLE 2175

A DNA sequence (GBSx2292) was identified in *S. agalactiae* <SEQ ID 6719> which encodes the amino acid sequence <SEQ ID 6720>. Analysis of this protein sequence reveals the following:

```
Possible site: 54
>>> Seems to have a cleavable N-term signal seq.
    INTEGRAL    Likelihood = -14.01    Transmembrane    215-231 (208-240)

----- Final Results -----
              bacterial membrane --- Certainty = 0.6604(Affirmative) < succ>
              bacterial outside  --- Certainty = 0.0000(Not Clear)   < succ>
              bacterial cytoplasm --- Certainty = 0.0000(Not Clear)  < succ>
```

The protein has homology with the following sequences in the GENPEPT database.

```
>GP: CAB12793 GB: Z99109 similar to 1-acylglycerol-3-phosphate
          O-acyltransferase [Bacillus subtilis]
Identities = 66/200 (33%), Positives = 111/200 (55%), Gaps = 10/200 (5%)
Query:   3 YTYLRTLVMFLIWVANGNAHYHNEDKMLKDDENYILVAPHRTFWDPVYMAFAARPKQFIF    62
           Y +     + ++ + G   Y+E+  L  D  +++   H  +D + +    PQ +
Sbjct:   2 YKFCANALKVILSLRGGVKVYNKEN--LPADSGFVIACTHSGWVDVITLGVGILPYQIHY   59

Query:  63 MAKKELFTNRLFGWWIKMCGAFPIDREKPGQDAIRYPVKMLKNSNRSLVMFPSGSRHSKD   122
           MAKKELF N+  G  ++K    AFP+DRE PG +I+ P+K+LK      +FPSG+R S+D
Sbjct:  60 MAKKELFQNKWIGSFLKKIHAFPVDRENPGPSSIKTPIKLLK-EGEIVGIFPSGTRTSED  118

Query: 123 V--KGGVAVIAKMAKVRIMPAAYRGPMVFKNLLKGHRVDMNFGNPIDVSDIKRMDA-EGI   179
              V  K G  IA+M K  ++PAAY+GP   K L K +++ G P+  +D   + E +
Sbjct: 119 VPLKRGAVTIAQMGKAPLVPAAYQGPSSGKELFKKGKMKLIIGEPLHQADFAHLPSKERL  178

Query: 180 A----EVSRRIQEEFDRLDR                                          195
           A      +++RI+E  ++LD+
Sbjct: 179 AAMTEALNQRIKELENKLDQ                                          198
```

A related DNA sequence was identified in *S. pyogenes* <SEQ ID 6721> which encodes the amino acid sequence <SEQ ID 6722>. Analysis of this protein sequence reveals the following:

```
    Possible site: 49
>>> Seems to have no N-terminal signal sequence
    INTEGRAL    Likelihood = -11.83    Transmembrane    241-257 (234-266)
    INTEGRAL    Likelihood =  -4.41    Transmembrane     27-43  (26-44)

----- Final Results -----
              bacterial membrane  --- Certainty = 0.5734(Affirmative) < succ>
              bacterial outside   --- Certainty = 0.0000(Not Clear)   < succ>
              bacterial cytoplasm --- Certainty = 0.0000(Not Clear)   < succ>
```

The protein has homology with the following sequences in the databases:

```
>GP: CAB12793 GB: Z99109 similar to 1-acylglycerol-3-phosphate
        O-acyltransferase [Bacillus subtilis]
Identities = 59/198 (29%), Positives = 104/198 (51%), Gaps = 6/198 (3%)
Query:  29 YAYLRGLVVFLLWVVNGNAHYHHEEKMLDASENYILVAPHRTFWDPVYHAFAARPKQFIF   88
           Y +    + +L + G   Y+ E   L A  +++   H +D + +     P Q  +
Sbjct:   2 YKFCANALKVILSLRGGVKVYNKEN--LPADSGFVIACTHSGWVDVITLGVGILPYQIHY   59

Query:  89 MAKKELFANRLFAWWIKMCGAFPIDRDKPSPDAIRYPVNMLKKSNRSLLMFPSGSRHSQE  148
           MAKKELF N+     ++K   AFP+DR+ P P +I+ P+ +LK+    + +FPSG+R S++
Sbjct:  60 MAKKELFQNKWIGSFLKKIHAFPVDRENPGPSSIKTPIKLLKE-GEIVGIFPSGTRTSED  118

Query: 149 V--KGGVAVIAKLAKVKIMPAAYQGPMSVKGLLAGERVDMTFGNPIDVSDIKRM-NDEGI  205
             V  K G   IA++ K  ++PAAYQGP S K L    ++ +  G P+  +D   + + E +
Sbjct: 119 VPLKRGAVTIAQMGKAPLVPAAYQGPSSGKELFKKGKMKLIIGEPLHQADFAHLPSKERL  178

Query: 206 AEVANRIQAEFDRIDDEL                                            223
            A +    +      ++++L
Sbjct: 179 AAMTEALNQRIKELENKL                                            196
```

An alignment of the GAS and GBS proteins is shown below.

```
Identities = 186/244 (76%), Positives = 212/244 (86%)
Query:   1 MFYTYLRTLVMFLIWVANGNAHYHNSDKMLKDDENYILVAPHRTFWDPVYMAFAARPKQF   60
           +FY YLR LV+FL+WV NGNAHYH+E+KML   ENYILVAPHRTFWDPVYMAFAARPKQF
Sbjct:  27 VFYAYLRGLVVFLLWVVNGNAHYHHEEKMLDASENYILVAPHRTFWDPVYMAFAARPKQF   86

Query:  61 IFMAKKELFTNRLFGWWIKMCGAFPIDREKPGQDAIRYPVKMLKNSNRSLVMFPSGSRHS  120
           IFMAKKELF NRLF WWIKMCGAFPIDR+KP  DAIRYPV MLK SNRSL+MFPSGSRHS
Sbjct:  87 IFMAKKELFANRLFAWWIKMCGAFPIDRDKPSPDAIRYPVNMLKKSNRSLLMFPSGSRHS  146

Query: 121 KDVKGGVAVIAKMAKVRIMPAAYRGPMVFKNLLKGHRVDMNFGNPIDVSDIKRMDAEGIA  180
           ++VKGGVAVIAK+AKV+IMPAAY+GPM  K LL G RVDM FGNPIDVSDIKRM+ EGIA
Sbjct: 147 QEVKGGVAVIAKLAKVKIMPAAYQGPMSVKGLLAGERVDMTFGNPIDVSDIKRMNDEGIA  206

Query: 181 EVSRRIQEEFDRLDRENETYDDGKKLNPLTYIYRLPLAIIAIVLLVLTLIFSYLASFVWD  240
           EV+ RIQ EFDR+D E   +  GK  NPLTY+YRLPL ++ +V+L+LT++FSY+ASFVW+
Sbjct: 207 EVANRIQAEFDRIDDELAPFQPGKARNPLTYLYRLPLGLVLVVVLLLTMLFSYIASFVWN  266

Query: 241 PQKH                                                          244
           P KH
Sbjct: 267 PDKH                                                          270
```

SEQ ID 6720 (GBS171) was expressed in *E. coli* as a His-fusion product. SDS-PAGE analysis of total cell extract is shown in FIG. 36 (lane 2; MW 25 kDa). It was also expressed in *E. coli* as a GST-fusion product. SDS-PAGE analysis of total cell extract is shown in FIG. 41 (lane 3; MW 49.8 kDa).

Based on this analysis, it was predicted that these proteins and their epitopes could be useful antigens for vaccines or diagnostics.

EXAMPLE 2176

A DNA sequence (GBSx2293) was identified in *S. agalactiae* <SEQ ID 6723> which encodes the amino acid sequence <SEQ ID 6724>. Analysis of this protein sequence reveals the following:

```
Possible site: 48
>>> Seems to have no N-terminal signal sequence

----- Final Results -----
        bacterial cytoplasm --- Certainty = 0.3268(Affirmative) < succ>
        bacterial membrane  --- Certainty = 0.0000(Not Clear)   < succ>
         bacterial outside  --- Certainty = 0.0000(Not Clear)   < succ>
```

The protein has homology with the following sequences in the GENPEPT database.

```
>GP: CAB11810 GB: Z99104 similar to hypothetical proteins [Bacillus subti-
lis]
Identities = 113/244 (46%), Positives = 173/244 (70%), Gaps = 2/244 (0%)

Query:   6 LKENERIDQLFSTDVKIIQNKEVFSYSIDSVLLSRFPKLP-SRGLIVDLCSGNGAVGLFA   64
           L ++ER+D L + D+KIIQ+  VF++S+D+VLLS+F  +P  +G IVDLC+GNG V L
Sbjct:   4 LHDDERLDYLLAEDMKIIQSPTVFAFSLDAVLLSKFAYVPIQKGKIVDLCTGNGIVPLLL   63

Query:  65 STKTNATIIEIELQESLADMAKRSIKLNKLEKQVTMINDDLKNLLDHVQRSNVDLMLCNP  124
           ST++  A I+ +E+QE L DMA RS++ NKL+ Q+ +I+DDLKN+ + +   + D++ CNP
Sbjct:  64 STRSKADILGVEIQERLHDMAVRSVEYNKLDDQIQIIHDDLKNMPEKLGHNRYDVVTCNP  123

Query: 125 PYFKASETSKKNLSPHYLLARHEITTNLREICQIAQHALKTKGRIAMVHRPDRFLEIIDT  184
           PYFK  + +++N++ H  +ARHEI    L ++  ++    LK  G+ A+VHRP R LEI +
Sbjct: 124 PYFKTPKQTEQNMNEHLRIARHEIHCTLEDVISVSSKLLKQGGKAALVHRPGRLLEIFEL  183

Query: 185 MRQFNLAPKRIQFVYPKLGKDANMLLIEAIKDGSTEGMKILPPLVVHQDNGDYTETIFDI  244
           M+ + +  PKR+QFVYPK GK+AN +L+E IK G  + +KILPPL V+ +   +YT+ I  I
Sbjct: 184 MKAYQIEPKRVQFVYPKQGKEANTILVEGIKGGRPD-LKILPPLFVYDEQNEYTKEIRTI  242

Query: 245 YFGE                                                         248
            +G+
Sbjct: 243 LYGD                                                         246
```

A related DNA sequence was identified in *S. pyogenes* <SEQ ID 6725> which encodes the amino acid sequence <SEQ ID 6726>. Analysis of this protein sequence reveals the following:

```
Possible site: 48
>>> Seems to have no N-terminal signal sequence

----- Final Results -----
           bacterial cytoplasm --- Certainty = 0.2183(Affirmative) < succ>
            bacterial membrane --- Certainty = 0.0000(Not Clear) < succ>
             bacterial outside --- Certainty = 0.0000(Not Clear) < succ>
```

An alignment of the GAS and GBS proteins is shown below.

```
Identities = 200/257 (77%), Positives = 228/257 (87%), Gaps = 3/257 (1%)

Query:   1 MIDTILKENERIDQLFSTDVKIIQNKEVFSYSIDSVLLSRFPKLPSRGLIVDLCSGNGAV   60
           MI   ILKE ERIDQLFS+DV IIQNK+VFSYSIDSVLLSRFPK+PS+GLIVDLCSGNGAV
Sbjct:   1 MIKAILKEGERIDQLFSSDVGIIQNKDVFSYSIDSVLLSRFPKMPSKGLIVDLCSGNGAV   60

Query:  61 GLFASTKTNATIIEIELQESLADMAKRSIKLNKLEKQVTMINDDLKNLLDHVQRSNVDLM  120
           GLFAST+T A I+E+ELQE LADM +RSI+LN+LE QVTMI DDLKNLL+HV RS VDLM
Sbjct:  61 GLFASTRTKAAIVEVELQERLADMGQRSIQLNQLEDQVTMICDDLKNLLNHVPRSGVDLM  120

Query: 121 LCNPPYFKASETSKKNLSPHYLLARHEITTNLREICQIAQHALKTKGRIAMVHRPDRFLE  180
           LCNPPYFK+ E+SKKN+S HYLLARHE+TTNL EICQ+A+HALK+ GR+AMVHRPDRFLE
Sbjct: 121 LCNPPYFKSHESSKKNVSEHYLLARHEVTTNLEEICQVARHALKSNGRLAMVHRPDRFLE  180

Query: 181 IIDTMRQFNLAPKRIQFVYPKLGKDANMLLIEAIKDGSTEGMKILPPLVVHQDNGDYTET  240
           IID++R    LAPKR+QFVYPKLGK ANMLLIEAIKDGS EGM ILPPLVVH++NG+YT+
Sbjct: 181 IIDSLRANGLAPKRVQFVYPKLGKSANMLLIEAIKDGSIEGMTILPPLVVHKENGEYTDH  240

Query: 241 IFDIYFGENGK---SHD                                            254
           IF+IYFG   K   +HD
Sbjct: 241 IFEIYFGAASKGKPNHD                                            257
```

Based on this analysis, it was predicted that these proteins and their epitopes could be useful antigens for vaccines or diagnostics.

EXAMPLE 2177

A DNA sequence (GBSx2294) was identified in *S. agalactiae* <SEQ ID 6727> which encodes the amino acid sequence <SEQ ID 6728>. Analysis of this protein sequence reveals the following:

```
Possible site: 55
>>> Seems to have no N-terminal signal sequence

----- Final Results -----
            bacterial cytoplasm --- Certainty = 0.1512(Affirmative) < succ>
             bacterial membrane --- Certainty = 0.0000(Not Clear)   < succ>
               bacterial outside --- Certainty = 0.0000(Not Clear)  < succ>
```

The protein has homology with the following sequences in the GENPEPT database.

```
>GP: CAB11811 GB: Z99104 similar to hypothetical proteins [Bacillus subti-
lis]
Identities = 40/82 (48%), Positives = 63/82 (76%)

Query:   7 YMYVLECSDGTLYTGYTTDVKRRLNTHNTGKGAKYTRARLPVKLLYSEAFNSKQEAMRAE  66
           + YV++C D + Y GYT D+ +R+ THN GKGAKYT+ R PV+L+++E+F++K+EAM+AE
Sbjct:   7 FFYVVKCKDNSWYAGYTNDLHKRVKTHNDGKGAKYTKVRRPVELIFAESFSTKREAMQAE  66

Query:  67 ALFKQKTRQAKLTYIKQHKNEQ                                       88
           FK+ TR+ K   YI++ +N +
Sbjct:  67 YYFKKLTRKKKELYIEEKRNSK                                       88
```

A related DNA sequence was identified in *S. pyogenes* <SEQ ID 6729> which encodes the amino acid sequence <SEQ ID 6730>. Analysis of this protein sequence reveals the following:

```
Possible site: 61
>>> Seems to have no N-terminal signal sequence

----- Final Results -----
            bacterial cytoplasm --- Certainty = 0.1838(Affirmative) < succ>
             bacterial membrane --- Certainty = 0.0000(Not Clear)   < succ>
               bacterial outside --- Certainty = 0.0000(Not Clear)  < succ>
```

An alignment of the GAS and GBS proteins is shown below.

```
Identities = 60/84 (71%), Positives = 67/84 (79%), Gaps = 1/84 (1%)

Query:   6 AYMYVLECSDGTLYTGYTTDVKRRLNTHNTGKGAKYTRARLPVKLLYSEAFNSKQEAMRA  65
           AYMYVLEC D TLYTGYTTD+K+RL THN GKGAKYTR RLPV LLY E F+SK+ AM A
Sbjct:   6 AYMYVLECVDKTLYTGYTTDLKKRLATHNAGKGAKYTRYRLPVSLLYYEVFDSREAAMSA  65

Query:  66 EALF-KQKTRQAKLTYIKQHKNEQ                                     88
           EALF K+KTR  KL YI   H+ E+
Sbjct:  66 EALFKKRKTRSQKLAYIATHQKEK                                     89
```

Based on this analysis, it was predicted that these proteins and their epitopes could be useful antigens for vaccines or diagnostics.

EXAMPLE 2178

A DNA sequence (GBSx2295) was identified in *S. agalactiae* <SEQ ID 6731> which encodes the amino acid sequence <SEQ ID 6732>. This protein is predicted to be autoaggregation-mediating protein (deaD). Analysis of this protein sequence reveals the following:

```
Possible site: 56
>>> Seems to have no N-terminal signal sequence

----- Final Results -----
            bacterial cytoplasm --- Certainty = 0.2287(Affirmative) < succ>
             bacterial membrane --- Certainty = 0.0000(Not Clear)   < succ>
               bacterial outside --- Certainty = 0.0000(Not Clear)  < succ>
```

The protein has homology with the following sequences in the GENPEPT database.

```
>GP: AAD20136 GB: AF091502 autoaggregation-mediating protein
[Lactobacillus reuteri]
Identities = 289/504 (57%), Positives = 366/504 (72%), Gaps = 18/504 (3%)

Query:   1 MKFTELNLSQDILSAVEKAGFVEPSPIQEMTIPLALEGKDVIGQAQTGTGKTAAFGLPTL    60
           MKF+EL LS  +L A++++G+ E +PIQE TIP+ LEGKDVIGQAQTGTGKTAAFGLP +
Sbjct:   1 MKFSELGLSDSLLKAIKRSGYEEATPIQEQTIPMVLEGKDVIGQAQTGTGKTAAFGLPII    60

Query:  61 NKIHTEDNTIQALIIAPTRELAVQSQEELFRFGRDKGVKVRSVYGGSSIEKQIKALRSGA   120
            + TE+  IQA+II+PTRELA+Q+QEEL+R G+DK V+V+ VYGG+ I +QIK+L+
Sbjct:  61 ENVDTENPNIQAIIISPTRELAIQTQEELYRLGKDKHVRVQVVYGGADIRRQIKSLKQHP   120

Query: 121 HVVVGTPGRLLDLIKRKALKLNHIETLILDEADEMLNMGFLEDIEAIISRVPETRQTLLF   180
             ++VGTPGRL D I R  +KL+HI+TL+LDEADEMLNMGFLEDIE+II    P+ RQTLLF
Sbjct: 121 QILVGTPGRLRDHINRHTVKLDHIKTLVLDEADEMLNMGFLEDIESIIKETPDDRQTLLF   180

Query: 181 SATMPDPIKRIGVKFMKDPEHVKIKATELTNVNVDQYYVRVKENEKFDTMTRLMDVDQPE   240
           SATMP   IKRIGV+FM DPE V+IKA ELT   VDQYYVR ++ EKFD MTRL+DV  P+
Sbjct: 181 SATMPPEIKRIGVQFMSDPETVRIKAKELTTDLVDQYYVRARDYEKFDIMTRLIDVQDPD   240

Query: 241 LSIVFGRTKRRVDELTRGLKLRGFRAEGIHGDLDQNKRLRVIRDFKNDHIDILVATDVAA   300
           L+IVFGRTKRRVDEL++GL  RG+ A GIHGDL Q+KR +++  FKN+ +DILVATDVAA
Sbjct: 241 LTIVFGRTKRRVDELSKGLIARGYNAAGIHGDLTQDKRSKIMWKFKNNELDILVATDVAA   300

Query: 301 RGLDISGVTHVYNYDIPQDPESYVHRIGRTGRAGKSGQSITFVSPNEMGYLTIIENLTKK   360
           RGLDISGVTHVYNYDIP DP+SYVHRIGRTGRAG  G S+TFV+PNEM YL  IE LT+
Sbjct: 301 RGLDISGVTHVYNYDIPSDPDSYVHRIGRTGRAGHHGVSLTFVTPNEMDYLHEIEKLTRV   360

Query: 361 RMTGMKPATASEAFQAKKKVALKRIARDFED-QELVSK--FDKFKADALELATQYTPEEL   417
           RM  +KP TA EAF+         ++A  F D  EL+++  D+++ A +L  +    +L
Sbjct: 361 RMLPLKPPTAEEAFKG-------QVASAFNDIDELIAQDSTDRYEEAAEKLLETHNATDL   413

Query: 418 ALYVLSLTVQDPESLPEVEITREKPLPFKPSGGGFKGKGGRGNGRGGD--RRRNDRGDRR   475
            +L+    ++    S    V+IT E+PLP +           G R N  GG+ RR+N R  +
Sbjct: 414 VAALLNNMTKEAASEVPVKITPERPLPRRNKRN--NRNGNRNNSHGGNHYRRKNFRRHQH   471

Query: 476 GNRDRDDRG----SRCDFKRRDDK                                     495
           G+   D+ G      SR  F  R  K
Sbjct: 472 GSHRNDNHGKSHSSRHSFNIRHRK                                     495
```

A related DNA sequence was identified in *S. pyogenes* <SEQ ID 6733> which encodes the amino acid sequence <SEQ ID 6734>. Analysis of this protein sequence reveals the following:

```
Possible site: 56
>>> Seems to have no N-terminal signal sequence

----- Final Results -----
           bacterial cytoplasm --- Certainty = 0.1108(Affirmative) < succ>
           bacterial membrane  --- Certainty = 0.0000(Not Clear)   < succ>
            bacterial outside  --- Certainty = 0.0000(Not Clear)   < succ>
```

An alignment of the GAS and GBS proteins is shown below.

```
Identities 430/545 (78%), Positives = 463/545 (84%), Gaps = 24/545 (4%)

Query:   1 MKFTELNLSQDILSAVEKAGFVEPSPIQEMTIPLALEGKDVIGQAQTGTGKTAAFGLPTL    60
           +KFTE NLSQDI SAV  AGF + SPIQEMTIPLALEGKDVIGQAQTGTGKTAAFGLPTL
Sbjct:   1 LKFTEFNLSQDIQSAVVTAGFEKASPIQEMTIPLALEGKDVIGQAQTGTGKTAAFGLPTL    60

Query:  61 NKIHTEDNTIQALIIAPTRELAVQSQEELFRFGRDKGVKVRSVYGGSSIEKQIKALRSGA   120
           NKI T +N IQAL+IAPTRELAVQSQEELFRFGR+KGVKVRSVYGGSSIEKQIKAL+SGA
Sbjct:  61 NKIRTNENIIQALVIAPTRELAVQSQEELFRFGREKGVKVRSVYGGSSIEKQIKALKSGA   120

Query: 121 HVVVGTPGRLLDLIKRKALKLNHIETLILDEADEMLNMGFLEDIEAIISRVPETRQTLLF   180
           H+VVG PGRLLDLIKRKAL L+H+ETLILDEADEMLNMGFLEDIEAIISRVP  RQTLLF
Sbjct: 121 HIVVGRPGRLLDLIKRKALILDHVETLILDEADEMLNMGFLEDIEAIISRVPADRQTLLF   180

Query: 181 SATMPDPIKRIGVKFMKDPEHVKIKATELTNVNVDQYYVRVKENEKFDTMTRLMDVDQPE   240
           SATMP PIK+IGVKFMKDPEHV+IK  ELTNVNVDQYYVRVKE EKFDTMTRLMDV+QPE
Sbjct: 181 SATMPAPIKQIGVKFMKDPEHVQIKNKELTNVNVDQYYVRVKEQEKFDTMTRLMDVNQPE   240
```

-continued

```
Query: 241 LSIVFGRTKRRVDELTRGLKLRGFRAEGIHGDLDQNKRLRVIRDFKNDHIDILVATDVAA 300
            LSIVFGRTKRRVDE+TRGLKLRGFRAEGIHGDLDQNKRLRVIRDFKND IDILVATDVAA
Sbjct: 241 LSIVFGRTKRRVDEITRGLKLRGFRAEGIHGDLDQNKRLRVIRDFKNDQIDILVATDVAA 300

Query: 301 RGLDISGVTHVYNYDIPQDPESYVHRIGRTGRAGKSGQSITFVSPNEMGYLTIIENLTKK 360
            RGLDISGVTHVYNYDI QDPESYVHRIGRTGRAGKSG+SITFVSPNEMGYL++IENLTKK
Sbjct: 301 RGLDISGVTHVYNYDITQDPESYVHRIGRTGRAGKSGESITFVSPNEMGYLSMIENLTKK 360

Query: 361 RMTGMKPATASEAFQAKKKVALKRIARDFEDQELVSKFDKFKADALELATQYTPEELALY 420
            +M ++PATA EAFQAKKKVALK+I RDF D+ + S FDKFK DA++LA ++TPEELALY
Sbjct: 361 QMKPLRPATAEEAFQAKKKVALKKIERDFADETIRSNFDKFKGDAVQLAAEFTPEELALY 420

Query: 421 VLSLTVQDPESLPEVEITREKPLPFKPSGGGF---KGKGGRG--NGRGGDRRRNDRGDR- 474
            +LSLTVQDP+SLPEVEI REKPLPFK  GGG       GKGGRG  N    GDRR   RGDR
Sbjct: 421 ILSLTVQDPDSLPEVEIAREKPLPFKYVGGGHGNKNGKGGRGRDNRNRGDRRGGYRGDRN 480

Query: 475 ------------RGNRDRDDRGSRCDFKRRDDKFKKDNRRQENKKPHKNTSSEKQTGFVI 522
                        R  RD  D       DFKR+  +  KD   +E K        SS K TGFVI
Sbjct: 481 RDERDGDRRRQKRDKRDGHDGSGNRDFKRKSKRNSKDFFNKEKK------SSAKNTFFVI 534

Query: 523 RNKGD 527
            R+KG+
Sbjct: 535 RHKGE 539
```

A related GBS gene <SEQ ID 8991> and protein <SEQ ID 8992> were also identified. Analysis of this protein sequence reveals the following:

RGD motif 471-473

The protein has homology with the following sequences in the databases:

```
58.9/74.7% over 494aa
Lactobacillus reuteri
GP|4409804|autoaggregation-mediating protein Insert characterized ORF01926(301-1785 of 2184)
GP|4409804|gb|AAD20136.1||AF091502(1-495 of 497)autoaggregation-mediating protein
{Lactobacillus reuteri}
%Match = 37.3
%Identity = 58.8  %Similarity = 74.6
Matches = 290  Mismatches = 118  Conservative Sub.s = 78
         42         72        102        132        162        192        222        252
IRHYITKEIPSEAAVAF*IDKL*TLLYRWWVFIAFFLFSEATNRTSNL*KRVIY*IDLILYLFTFNCVTLSRLSEKITN
        282        312        342        372        402        432        462        492
KGS*GSFALSFRKEKHLKFTELNLSQDELSAVEKAGFVEPSPIQEMTIPLALEGKDVIGQAQTGTGKTAAFGLPTLNKIH
                     :||:||  ||   :| |:::::|:  |   ||||| |||: |||||||||||||||||||  :  :
                   MKFSELGLSDSLLKAIKRSGYEEATPIQEQTIPMVLEGKDVIGQAQTGTgKTAAFGLPIIENVD
                                10        20        30        40        50        60
        522        552        582        612        642        672        702        732
TEDNTIQALIIAPTRELAVQSQEELFRFGRDKGVKVRSVYGGSSIEKQIKALRSGAHVVGTPGRLLDLIKRKALKLNHI
||:   ||:|||||||||||:|:|||||:|:|    |:|:    |:|:: |||:    :::|||||| |  |   :||:||
TENPNIQAIIISPTRELAIQTQEELYRLGKDKHVRVQVVYGGADIRRQIKSLKQHPQILVGTPGRLRDGINRHTVKLDHI
       80        90        100       110       120       130       140
        762        792        822        852        882        912        942        972
ETLILDEADEMLNMGFLEDIEAIISRVPETRQTLLFSATMPDPIKRIGVKFMKDPEHVKIKATELTNVNVDQYYVRVKEN
:||:|||||||||||||||||||:||    |:  |||||||||||||||:| ||| :|||   |||    ||||||||||||  ::
KTLVLDEADEMLNMGFLEDIESIIKETPDDRQTLLFSATMPPEIKRIGVQFMSDPETVRIKAKELTTDLVDQYYVRARDY
       160       170       180       190       200       210       220
       1002       1032       1062       1092       1122       1152       1182       1212
EKFDTMTRLMDVDQPELSIVFGRTKRRVDELTRGLKLRGFRAEGIHGDLDQNKRLRVIRDFKNDHIDILVATDVAARGLD
||||    ||||:|    |:|:|||||||||||||:||||||||  ||:  :||||  ||| :::   |||: :||||||||||||||
EKFDIMTRLIDVQDPDLTIVFGRTKRRVDELSKGLIARGYNAAGIHGDLTQDKRSKIMWKFKNNELDILVATDVAARGLD
       240       250       260       270       280       290       300
       1242       1272       1302       1332       1362       1392       1422       1452
ISGVTHVYNYDIPQDPESYVHRIGRTGRAGKSGQSITFVSPNEMGYLTIIENLTKKRMTGMKPATASEAFQAKKKVALKR
||||||||||||||   ||:|||||||||||||||| |  |:|||:|  ||   ||  ||:   ||  :|| ||  |||   | :||
ISGVTHVYNYDIPSDPSYVHRIGRTGRAGHHGVSLTFVTPNEMDYLHEIEKLTRVMLPLKPPTAEEAF--KGQVA---
       320       330       340       350       360       370
       1479       1503       1533       1563       1593       1623       1653       1683
IARDFED-QELVSK--FDKFKADALELATQYTPEELALYVLSLTVQDPESLPEVEITREKPLPFKPSGGGFKGKGGRGNG
 |  |||||| :::      |:::     |: |  :|  |   :|:     :|  |::|||:||     |       |
--SAFNDIDELIAQDSTDRYEEAAEKLLETHNATDLVAALLNNMTKEAASEVPKITPERPLPRRNKRNNRGN--RNNS
       390       400       410       420       430       440       450
       1707       1737       1755       1785       1815       1845       1875       1905
RGGD--RRRNDRGDRRGNRDRDDRG----SRCDFKRRDDKFKKDNRRQENKKPHKNTSSEKQTGFVIRNKGDK*EDYEKG
 ||:   ||:|    :    |:    |        ||  |:
HGGNHYRRKNFRRHQYGSHRNDNHGKSHSSRHSFNIRHRKEN
         470       480       490
```

There is also homology to SEQ ID 4454.

SEQ ID 8992 (GBS307) was expressed in *E. coli* as a His-fusion product. SDS-PAGE analysis of total cell extract is shown in FIG. 56 (lane 7; MW 62 kDa). It was also expressed in *E. coli* as a GST-fusion product. SDS-PAGE analysis of total cell extract is shown in FIG. 61 (lane 2; MW 86.7 kDa).

Figure 272:
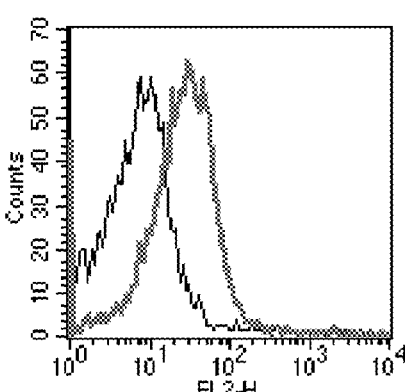

The GBS307-GST fusion product was purified (FIG. 208, lane 9; FIG. 225, lane 10-11) and used to immunise mice. The resulting antiserum was used for FACS (FIG. 272), which confirmed that the protein is immunoaccessible on GBS bacteria.

Based on this analysis, it was predicted that these proteins and their epitopes could be useful antigens for vaccines or diagnostics.

EXAMPLE 2179

A DNA sequence (GBSx2296) was identified in *S. agalactiae* <SEQ ID 6735> which encodes the amino acid sequence <SEQ ID 6736>. This protein is predicted to be outer membrane protein (yaeC). Analysis of this protein sequence reveals the following:

```
Possible site: 19
>>> May be a lipoprotein

----- Final Results -----
              bacterial membrane --- Certainty = 0.0000(Not Clear) < succ>
              bacterial outside  --- Certainty = 0.0000(Not Clear) < succ>
              bacterial cytoplasm --- Certainty = 0.0000(Not Clear) < succ>
```

The protein has homology with the following sequences in the GENPEPT database.

```
>GP: CAB73036 GB: AL139076 putative periplasmic protein
        [Campylobacter jejuni]
  Identities = 89/237 (37%), Positives = 132/237 (55%), Gaps = 3/237 (1%)

Query:  40 ITVATYSKPTSTFLDLVKDNVKEKGYTLKVVMVSDYIQANIALENKEHDANLLQHEFFMS    99
           IT+     P  + L+L+KD+ K KGY LK+V  SDYI  N ALE KE DANL QH+ F+
Sbjct:  23 ITIGATPNPFGSLLELMKDDFKNKGYELKIVEFSDYILPNRALEEKELDANLYQHKPFLE    82

Query: 100 IFNKENDGHLVSITPIYHSLAGFYGQHLKNIAELKDGAKVAIPSDPANMTRALLLLQEKK   159
           +N +   +L++ TP+   + G Y + +KN+  LK+GA+VAIP+D  N +RAL LL++ K
Sbjct:  83 EYNLKKGSNLIATTPVLIAPVGVYSKKIKNLENLKEGARVAIPNDATNESRALELLEKAK  142

Query: 160 LITLKNTSKKTKAIEDIITNPKKLRIEPVALLNLNQAYFEYDLVFNFPGYVTKINLVPKR   219
           LI L  + KT   DI NPKKL+  +    L +A  + D+    +      L P +
Sbjct: 143 LIELNKNTLKTPL--DINKNPKKLKFIELKAAQLPRALDDVDIAIINSNFALGAGLNPSK  200

Query: 220 DRLLYEKKPDIRFAGALVAREDNKNSDKIKVLKEVLTSKEIRHYITKEIPSEAAVAF       276
           D +  E K +   +V R + KNS+K KV+ E+L S + + I +         AF
Sbjct: 201 DTIFREDK-NSPYVNYVVVRSEGKNSEKTKVIDEILRSDKFKAIINEHYKDILIPAF      256
```

SEQ ID 6736 (GBS126) was expressed in *E. coli* as a His-fusion product. SDS-PAGE analysis of total cell extract is shown in FIG. 34 (lane 7; MW 32 kDa).

Based on this analysis, it was predicted that this protein and its epitopes, could be useful antigens for vaccines or diagnostics.

EXAMPLE 2180

A DNA sequence (GBSx2297) was identified in *S. agalactiae* <SEQ ID 6737> which encodes the amino acid sequence <SEQ ID 6738>. This protein is predicted to be probable permease of ABC transporter. Analysis of this protein sequence reveals the following:

```
Possible site: 34
>>> Seems to have no N-terminal signal sequence
   INTEGRAL Likelihood = -11.99 Transmembrane 190-206 ( 187-215)
   INTEGRAL Likelihood =  -8.44 Transmembrane  25-41 (  16-45)
   INTEGRAL Likelihood =  -6.48 Transmembrane  69-85 (  68-90)
   INTEGRAL Likelihood =  -3.77 Transmembrane  90-106 ( 88-109)
   INTEGRAL Likelihood =  -1.44 Transmembrane 145-161 ( 145-161)

----- Final Results -----
              bacterial membrane --- Certainty = 0.5798(Affirmative) < succ>
               bacterial outside --- Certainty = 0.0000(Not Clear)   < succ>
             bacterial cytoplasm --- Certainty = 0.0000(Not Clear)   < succ>
```

The protein has homology with the following sequences in the GENPEPT database.

```
>GP: AAG08889 GB: AE004963 probable permease of ABC transporter
           [Pseudomonas aeruginosa]
 Identities = 80/206 (38%), Positives = 127/206 (60%), Gaps = 4/206 (1%)

Query:  15 SFWETNLMLGLTLILCFLIAFPTGILLFSLRKSYLIKHSLAYQLLNLFLGTLRSVPFLIF   74
           +FW    MLG +L+  ++  P G+LLF      + +   Y LL+L +  LRS+PF+I
Sbjct:  24 TFW----MLGGSLLFTVVLGLPLGVLLFLTGPRQMFEQKAVYTLLSLVVNILRSLPFIIL   79

Query:  75 IFILIPLNRLIFGTSFGTIAAILPLTLVSVSLYARYVEQALLNIPQVVVDRALSLGANKR  134
           +  IPL  LI GTS G   AI PL +  +  +AR VE AL  + + +++   ++GA+ R
Sbjct:  80 LIVMIPLTVLITGTSLGVAGAIPPLVVGATPFFARLVETALREVDKGIIEATQAMGASTR  139

Query: 135 QIIYYFLIPSIKIDLVLSFTATAISILGYSTIMGVIGAGGLGEYAYRFGYQEYDYPVMYL  194
           QII+  L+P  +  ++ + T TAI+++ Y+ + GV+GAGGLG+ A RFGYQ +   VM +
Sbjct: 140 QIIWNALLPEARPGIIAAITVTAITLVSYTAMAGVVGAGGLGDLAIRFGYQRFQTDVMVV  199

Query: 195 IVVLFIIYVFILQSLGYFIANRYSRK                                    220
              VV+ +I V ILQ++G    +SRK
Sbjct: 200 TVVMLLILVQILQTVGDKLVVHFSRK                                    225
```

Based on this analysis, it was predicted that this protein and its epitopes, could be useful antigens for vaccines or diagnostics.

EXAMPLE 2181

A DNA sequence (GBSx2298) was identified in *S. agalactiae* <SEQ ID 6739> which encodes the amino acid sequence <SEQ ID 6740>. This protein is predicted to be ABC transporter, ATP-binding protein (oppF). Analysis of this protein sequence reveals the following:

```
Possible site: 48
>>> Seems to have no N-terminal signal sequence

----- Final Results -----
             bacterial cytoplasm --- Certainty = 0.5454(Affirmative) < succ>
              bacterial membrane --- Certainty = 0.0000(Not Clear)   < succ>
               bacterial outside --- Certainty = 0.0000(Not Clear)   < succ>
```

A related GBS nucleic acid sequence <SEQ ID 9333> which encodes amino acid sequence <SEQ ID 9334> was also identified.

The protein has homology with the following sequences in the GENPEPT database.

```
>GP: AAC22280 GB: U32744 ABC transporter, ATP-binding protein
           [Haemophilus influenzae Rd]
 Identities = 62/174 (35%), Positives = 104/174 (59%), Gaps = 2/174 (1%)

Query:   1 MKMINGLIPYDKGNIYYQGKEVKSFSDNKLRQMRKDIAYIFQNHNLLAGESVYYHLALVY   60
            ++ +N L      G++  G E+   SD +L  R+ I  IFQ+ NLL+   V+  ++AL
Sbjct:  48 IRCVNLLEKPTSGSVIVDGVELTKLSDRELVLARRQIGMIFQHFNLLSSRTVFENVALPL  107
```

```
                               -continued
Query:   61 KLNHQKVN--HDAINDILDFLGLMDLKQVKCHSLSGGQQQKVAIAMAVLQKPKLILCDEI  118
            +L +       + I  +LD +GL + +     +LSGGQ+Q+VAIA A+   PK++LCDE
Sbjct:  108 ELESESKAKIQEKITALLDLVGLSEKRDAYPSNLSGGQKQRVAIARALASDPKVLLCDEA  167

Query:  119 SSALDTNSEKEIFNLLSDLREKYGISILMIAHHLSLLKQYCDRVMILDHQTIVD        172
            +SALD + + I  LL ++     GI+IL+I H + ++KQ CD+V ++D    +V+
Sbjct:  168 TSALDPATTQSILKLLKEINRTLGITILLITHEMEVVKQICDQVAVIDQGRLVE       221
```

There is also homology to SEQ ID 76.

Based on this analysis, it was predicted that this protein and its epitopes, could be useful antigens for vaccines or diagnostics.

EXAMPLE 2182

A DNA sequence (GBSx2299) was identified in *S. agalactiae* <SEQ ID 6741> which encodes the amino acid sequence <SEQ ID 6742>. Analysis of this protein sequence reveals the following:

```
Possible site: 21
>>> Seems to have an uncleavable N-term signal seq

----- Final Results -----
             bacterial membrane --- Certainty = 0.0000(Not Clear) < succ>
             bacterial outside  --- Certainty = 0.0000(Not Clear) < succ>
             bacterial cytoplasm --- Certainty = 0.0000(Not Clear) < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 2183

A DNA sequence (GBSx2300) was identified in *S. agalactiae* <SEQ ID 6743> which encodes the amino acid sequence <SEQ ID 6744>. Analysis of this protein sequence reveals the following:

```
Possible site: 18
>>> Seems to have no N-terminal signal sequence

----- Final Results -----
             bacterial cytoplasm --- Certainty = 0.0904(Affirmative) < succ>
             bacterial membrane  --- Certainty = 0.0000(Not Clear)   < succ>
             bacterial outside   --- Certainty = 0.0000(Not Clear)   < succ>
```

A related GBS nucleic acid sequence <SEQ ID 9741> which encodes amino acid sequence <SEQ ID 9742> was also identified.

The protein has homology with the following sequences in the GENPEPT database.

```
>GP: AAB87515 GB: AF034138 unknown [Bacillus subtilis]
Identities = 74/125 (59%), Positives = 92/125 (73%)

Query:    5 MGIFSGLMGNASQMDTDKVENQLSDILISDEQVDLAYTLIRDLIVFTNYRLILVDKQGVT   64
            MG   GL+GNAS + T   V+ +L+  IL+   E+V+ A+ L+RDLIVFT+  RLILVDKQG+T
Sbjct:    1 MGFIDGLLGNASTLSTAAVQEELAHILLEGEKVEAAFKLVRDLIVFTDKRLILVDKQGIT   60

Query:   65 GKKVSYNSIPYASISRFTVETSGHFDLDAELKIWISSAIEPAEVLQFKNDRNIVSIQKAL  124
            GKK   + SIPY SISRF+VET+G FDLD+ELKIWIS A  PA    QFK D +I  IQK L
Sbjct:   61 GKKTEFQSIPYKSISRFSVETAGRFDLDSELKIWISGAELPAVSKQFKKDESIYDIQKVL  120

Query:  125 ATAVL                                                        129
            A    +
Sbjct:  121 AAVCM                                                        125
```

No corresponding DNA sequence was identified in *S. pyogenes*.

Based on this analysis, it was predicted that this protein and its epitopes, could be useful antigens for vaccines or diagnostics.

EXAMPLE 2184

A DNA sequence (GBSx2301) was identified in *S. agalactiae* <SEQ ID 6745> which encodes the amino acid sequence <SEQ ID 6746>. Analysis of this protein sequence reveals the following:

```
Possible site: 59
>>> Seems to have no N-terminal signal sequence

----- Final Results -----
            bacterial cytoplasm --- Certainty = 0.0921(Affirmative) < succ>
            bacterial membrane  --- Certainty = 0.0000(Not Clear)   < succ>
            bacterial outside   --- Certainty = 0.0000(Not Clear)   < succ>
```

A related GBS nucleic acid sequence <SEQ ID 9331> which encodes amino acid sequence <SEQ ID 9332> was also identified.

The protein has homology with the following sequences in the GENPEPT database.

```
>GP: CAA74739 GB: Y14370 peptide chain release factor 3
[Staphylococcus aureus]
Identities = 274/462 (59%), Positives = 349/462 (75%), Gaps = 9/462 (1%)

Query:    1 MDIEKQRGISVTSSVMQFDYAGKRVNILDTPGHEDFSEDTYRTLMAVDAAVMVVDSAKGI   60
            M +E++RGISVTSSVMQFDY    +NILDTPGHEDFSEDTYRTLMAVD+AVMV+D AKG+
Sbjct:   57 MKVEQERGISVTSSVMQFDYDDYEINILDTPGHEDFSEDTYRTLMAVDSAVMVIDCAKGV  116

Query:   61 EAQTKKLFEVVKHRNIPVFTFINKLDRDGREPLDLLEELEEVLGIASYPMNWPIGMGKSF  120
            E   T  KLF+V  K R  IP+FTFINKLDR  G+EP +LL+E+EE  L  I  +YPMNWPIGMG+SF
Sbjct:  117 EPPTLKLFKVCKMRGIPIFTFINKLDRVGKEPFELLDEIEETLNIETYPMNWPIGMGQSF  176

Query:  121 EGLYDLHNKRLELYKGDERFASIEDG-----DQLFANNPFYEQVKEDIELLQEAGNDFSE  175
             G+ D   +K +E ++  +E        + D        D       N+   +EQ  E++  L++EAG    F
Sbjct:  177 FGIIDRKSKTIEPFRDEENILHLNDDFELEEDHAITNDSDFEQAIEELMLVEEAGEAFDN  236

Query:  176 QAILDGDLTPVFFGSALTNFGVQTFLDTFLEFAPEPHGHKTTEGNVIDPLAKDFSGFVFK  235
             A+L  GDLTPVFFGSAL NFGVQ  FL+  +++FAP P+    +T E    + P     FSGF+FK
Sbjct:  237 DALLSGDLTPVFFGSALANFGVQNFLNAYVDFAPMPNARQTKENVEVSPFDDSFSGFIFK  296

Query:  236 IQANMDPRHRDRIAFVRIVSGEFERGMGVNLTRTGKGAKLSNVTQFMAES-RENVTNAVA  294
            IQANMDP+HRDRIAF+R+VSG FER + + L         +K S+V + +  ++  ++ V  +AVA
Sbjct:  297 IQANMDPKHRDRIAFMRVVSGAFER-VWMLLCNVLIKSKRSHVQRHLWQTIKKLVNHAVA  355

Query:  295 GDIIGVYDTGTYQVGDTLTVGKNKFEFEPLPTFTPELFMKVSAKNVMKQKSFHKGIEQLV  354
            GDIIG+YDTG  YQ+GDTL   GK   + F+ LP FTPE+FMKVSAKNVMKQK FHKGIEQLV
Sbjct:  356 GDIIGLYDTGNYQIGDTLVGGKQTYSFQDLPQFTPEIFMKVSAKNVMKQKHFHKGIEQLV  415

Query:  355 QEGAIQLYKNYQTGEYMLGAVGQLQFEVFKHRMEGEYNAEVVMTPMGKKTVRW--INSDD  412
            QEGAIQ YK   T +  +LGAVGQLQFEVF+HRM+ EYN +VVM P+G+K   RW    N D
Sbjct:  416 QEGAIQYYKTLHTNQIILGAVGQLQFEVFEHRMKNEYNVDVVMEPVGRKIARWDIENEDQ  475

Query:  413 LDERMSSSRNILAKDRFDQPVFLFENDFALRWFADKYPDVKL                   454
            + ++M++SR+IL KDR+D  VFLFEN+FA RWF +K+P++KL
Sbjct:  476 ITDKMNTSRSILVKDRYDDLVFLFENEFATRWFEEKFPEIKL                   517
```

A related DNA sequence was identified in *S. pyogenes* <SEQ ID 6747> which encodes the amino acid sequence <SEQ ID 6748>. Analysis of this protein sequence reveals the following:

```
Possible site: 52
>>> Seems to have no N-terminal signal sequence

----- Final Results -----
            bacterial cytoplasm --- Certainty = 0.2070(Affirmative) < succ>
            bacterial membrane  --- Certainty = 0.0000(Not Clear)   < succ>
            bacterial outside   --- Certainty = 0.0000(Not Clear)   < succ>
```

An alignment of the GAS and GBS proteins is shown below.

```
Identities = 447/458 (97%), Positives = 455/458 (98%)

Query:     1 MDIEKQRGISVTSSVMQFDYAGKRVNILDTPGHEDFSEDTYRTLMAVDAAVMVVDSAKGI   60
             MDIEKQRGISVTSSVMQFDYAGKRVNILDTPGHEDFSEDTYRTLMAVDAAVMVVDSAKGI
Sbjct:    57 MDIEKQRGISVTSSVMQFDYAGKRVNILDTPGHEDFSEDTYRTLMAVDAAVMVVDSAKGI  116

Query:    61 EAQTKKLFEVVKHRNIPVFTFINKLDRDGREPLDLLEELEEVLGIASYPMNWPIGMGKSF  120
             EAQTKKLFEVVKHRNIPVFTFINKLDRDGREPL+LLEELEEVLGIASYPMNWPIGMG++F
Sbjct:   117 EAQTKKLFEVVKHRNIPVFTFINKLDRDGREPLELLEELEEVLGIASYPMNWPIGMGRAF  176

Query:   121 EGLYDLHNKRLELYKGDERFASIEDGDQLFANNPFYEQVKEDIELLQEAGNDFSEQAILD  180
             EGLYDLHNKRLELYKGDERFASIEDGDQLFANNPFYEQVKEDIELLQEAGNDFSEQAILD
Sbjct:   177 EGLYDLHNKRLELYKGDERFASIEDGDQLFANNPFYEQVKEDIELLQEAGNDFSEQAILD  236

Query:   181 GDLTPVFFGSALTNFGVQTFLDTFLEFAPEPHGHKTTEGNVIDPLAKDFSGFVFKIQANM  240
             GDLTPVFFGSALTNFGVQTFLDTFLEFAPEPHGHKTTEGNV+DPLAKDFSGFVFKIQANM
Sbjct:   237 GDLTPVFFGSALTNFGVQTFLDTFLEFAPEPHGHKTTEGNVVDPLAKDFSGFVFKIQANM  296

Query:   241 DPRHRDRIAFVRIVSGEFERGMGVNLTRTGKGAKLSNVTQFMAESRENVTNAVAGDIIGV  300
             DP+HRDRIAFVRIVSGEFERGMGVNLTRTGKGAKLSNVTQFMAESRENVTNAVAGDIIGV
Sbjct:   297 DPKHRDRIAFVRIVSGEFERGMGVNLTRTGKGAKLSNVTQFMAESRENVTNAVAGDIIGV  356

Query:   301 YDTGTYQVGDTLTVGKNKFEFEPLPTFTPELFMKVSAKNVMKQKSFHKGIEQLVQEGAIQ  360
             YDTGTYQVGDTLTVGKNKFEFEPLPTFTPE+FMKVS KNVMKQKSFHKGIEQLVQEGAIQ
Sbjct:   357 YDTGTYQVGDTLTVGKNKFEFEPLPTFTPEIFMKVSPKNVMKQKSFHKGIEQLVQEGAIQ  416

Query:   361 LYKNYQTGEYMLGAVGQLQFEVFKHRMEGEYNAEVVMTPMGKKTVRWINSDDLDERMSSS  420
             LYKNYQTGEYMLGAVGQLQFEVFKHRMEGEYNAEVVMTPMGKKTVRWI+ DDLD+RMSSS
Sbjct:   417 LYKNYQTGEYMLGAVGQLQFEVFKHRMEGEYNAEVVMTPMGKKTVRWISEDDLDQRMSSS  476

Query:   421 RNILAKDRFDQPVFLFENDFALRWFADKYPDVKLEEKM                       458
             RNILAKDRFDQPVFLFENDFALRWFADKYPDV LEEKM
Sbjct:   477 RNILAKDRFDQPVFLFENDFALRWFADKYPDVTLEEKM                       514
```

Based on this analysis, it was predicted that these proteins and their epitopes could be useful antigens for vaccines or diagnostics.

EXAMPLE 2185

A DNA sequence (GBSx2302) was identified in *S. agalactiae* <SEQ ID 6749> which encodes the amino acid sequence <SEQ ID 6750>. Analysis of this protein sequence reveals the following:

```
Possible site: 17
>>> Seems to have no N-terminal signal sequence

----- Final Results -----
         bacterial cytoplasm --- Certainty = 0.3061(Affirmative) < succ>
          bacterial membrane --- Certainty = 0.0000(Not Clear)   < succ>
            bacterial outside --- Certainty = 0.0000(Not Clear)   < succ>
```

The protein has homology with the following sequences in the GENPEPT database.

```
>GP: AAC38046 GB: AF000954 No definition line found
[Streptococcus mutans]
Identities = 122/142 (85%), Positives = 138/142 (96%)

Query:     1 MLEFAAQKTGKENKEMAVTFVTNERSHELNLEYRDTDRPTDVISLEYKPEVDISFDEEDL   60
             +LEFAAQKTGKE+KEMAVTFVTNERSHELNL+YRDT+RPTDVISLEYKPE  +SFDEEDL
Sbjct:    23 ILEFAAQKTGKEDKEMAVTFVTNERSHELNLKYRDTNRPTDVISLEYKPESSLSFDEEDL   82

Query:    61 AENPELAEMLEDFDSYIGELFISIDKAKEQAEEYGHSYEREMGFLAVHGFLHINGYDHYT  120
             A++P+LAE+L +FD+YIGELFIS+DKA+EQA EYGHS+EREMGFLAVHGFLHINGYDHYT
Sbjct:    83 ADDPDLAEVLTEFDAYIGELFISVDKAREQAQEYGHSFEREMGFLAVHGFLHINGYDHYT  142

Query:   121 PEEEKEMFSLQEEILTAYGLKR                                       142
             P+EEKEMFSLQEEIL AYGLKR
Sbjct:   143 PQEEKEMFSLQEEILDAYGLKR                                       164
```

There is also homology to SEQ ID 120.

Based on this analysis, it was predicted that this protein and its epitopes, could be useful antigens for vaccines or diagnostics.

EXAMPLE 2186

A DNA sequence (GBSx2303) was identified in *S. agalactiae* <SEQ ID 6751> which encodes the amino acid sequence <SEQ ID 6752>. Analysis of this protein sequence reveals the following:

```
Possible site: 59
>>> Seems to have no N-terminal signal sequence
    INTEGRAL      Likelihood = -15.39     Transmembrane    108-124 (100-131)
    INTEGRAL      Likelihood = -8.92      Transmembrane     61-77 (52-82)
    INTEGRAL      Likelihood = -5.36      Transmembrane     41-57 (40-60)

----- Final Results -----
              bacterial membrane  --- Certainty = 0.7156(Affirmative) < succ>
              bacterial outside   --- Certainty = 0.0000(Not Clear)   < succ>
              bacterial cytoplasm --- Certainty = 0.0000(Not Clear)   < succ>
```

The protein has homology with the following sequences in the GENPEPT database.

```
>GP: AAC38047 GB: AF000954 diacyglycerol kinase [Streptococcus mutans]
Identities = 107/133 (80%), Positives = 121/133 (90%), Gaps = 2/133 (1%)

Query:    1 MDLNDN--NHKKWKNRTLTSSMEFAVTGIFTAFKEERNMRKHLVSAILVILAGLTFQVSM   58
            MDL DN  + KKWKNRTLTSS+EFA+TGIFTAFKEERNM+KH VSA+L ++AGL F+VS+
Sbjct:    3 MDLRDNKQSQKKWKNRTLTSSLEFALTGIFTAFKEERNMKKHAVSALLAVIAGLVFKVSV  62

Query:   59 VEWLFLLLSIFLVITFEIINSAIENVVDLASNYHFSMLAKNAKDMAAGAVLVVSLFAVLV  118
            +EWLFLLLSIFLVITFEI+NSAIENVVDLAS+YHFSMLAKNAKDMAAGAVLV+S FA L
Sbjct:   63 IEWLFLLLSIFLVITFEIVNSAIENVVDLASDYHFSMLAKNAKDMAAGAVLVISGFAALT 122

Query:  119 GLIIFIPKILALL                                                131
            GLIIF+PKI  LL
Sbjct:  123 GLIIFVPKIWFLL                                                135
```

A related DNA sequence was identified in *S. pyogenes* <SEQ ID 6753> which encodes the amino acid sequence <SEQ ID 6754>. Analysis of this protein sequence reveals the following:

```
Possible site: 34
>>> Seems to have no N-terminal signal sequence
    INTEGRAL      Likelihood = -10.67     Transmembrane     63-79 (41-84)
    INTEGRAL      Likelihood = -7.32      Transmembrane    110-126 (105-129)
    INTEGRAL      Likelihood = -5.41      Transmembrane     43-59 (41-62)

----- Final Results -----
              bacterial membrane  --- Certainty = 0.5267(Affirmative) < succ>
              bacterial outside   --- Certainty = 0.0000(Not Clear)   < succ>
              bacterial cytoplasm --- Certainty = 0.0000(Not Clear)   < succ>
```

The protein has homology with the following sequences in the databases:

```
>GP: AAC38047 GB: AF000954 diacyglycerol kinase [Streptococcus mutans]
Identities = 104/135 (77%), Positives = 119/135 (88%)

Query:    1 MALHDNNTTKRKWKNRTITSSLEFALTGVFTAFKEERNLRSHLLSACLACVAGLFFSISA   60
            M L DN  +++KWKNRT+TSSLEFALTG+FTAFKEERN++ H +SA LA +AGL F +S
Sbjct:    3 MDLRDNKQSQKKWKNRTLTSSLEFALTGIFTAFKEERNMKKHAVSALLAVIAGLVFKVSV  62

Query:   61 IEWLFLLLAIFLVITLEIVNSAIENVVDLASDYHFSMLAKNAKDMAAGAVLMISGYAVLT  120
            IEWLFLLL+IFLVIT EIVNSAIENVVDLASDYHFSMLAKNAKDMAAGAVL+ISG+ LT
Sbjct:   63 IEWLFLLLSIFLVITFEIVNSAIENVVDLASDYHFSMLAKNAKDMAAGAVLVISGFAALT 122

Query:  121 GLIIFIPKIWNIFVH                                              135
            GLIIF+PKIW + H
Sbjct:  123 GLIIFVPKIWFLLFH                                              137
```

An alignment of the GAS and GBS proteins is shown below.

```
Identities = 98/129 (75%), Positives = 115/129 (88%), Gaps = 2/129 (1%)

Query:    1 MDLNDNN--HKKWKNRTLTSSMEFAVTGIFTAFKEERNMRKHLVSAILVILAGLTFQVSM   58
            M L+DNN   +KWKNRT+TSS+EFA+TG+FTAFKEERN+R HL+SA L  +AGL F +S
Sbjct:    1 MALHDNNTTKRKWKNRTITSSLEFALTGVFTAFKEERNLRSHLLSACLACVAGLFFSISA   60

Query:   59 VEWLFLLLSIFLVITFEIINSAIENVVDLASNYHFSMLAKNAKDMAAGAVLVVSLFAVLV  118
            +EWLFLLL+IFLVIT EI+NSAIENVVDLAS+YHFSMLAKNAKDMAAGAVL++S  +AVL
Sbjct:   61 IEWLFLLLAIFLVITLEIVNSAIENVVDLASDYHFSMLAKNAKDMAAGAVLMISGYAVLT  120

Query:  119 GLIIFIPKI                                                    127
            GLIIFIPKI
Sbjct:  121 GLIIFIPKI                                                    129
```

Based on this analysis, it was predicted that these proteins and their epitopes could be useful antigens for vaccines or diagnostics.

EXAMPLE 2187

A DNA sequence (GBSx2304) was identified in *S. agalactiae* <SEQ ID 6755> which encodes the amino acid sequence <SEQ ID 6756>. This protein is predicted to be GTPase Era (era). Analysis of this protein sequence reveals the following:

```
Possible site: 54
>>> Seems to have no N-terminal signal sequence

----- Final Results -----
            bacterial cytoplasm --- Certainty = 0.1871(Affirmative) < succ>
            bacterial membrane  --- Certainty = 0.0000(Not Clear)   < succ>
             bacterial outside  --- Certainty = 0.0000(Not Clear)   < succ>
```

A related GBS nucleic acid sequence <SEQ ID 10017> which encodes amino acid sequence <SEQ ID 10018> was also identified.

The protein has homology with the following sequences in the GENPEPT database.

```
>GP: AAD41632 GB: AF072811 GTPase Era [Streptococcus pneumoniae]
Identities = 273/299 (91%), Positives = 290/299 (96%)

Query:   16 MTFKSGFVAILGRPNVGKSTFLNHVMGQKIAIMSDKAQTTRNKIMGIYTTETEQIVFIDT   75
            MTFKSGFVAILGRPNVGKSTFLNHVMGQKIAIMSDKAQTTRNKIMGIYTT+ EQIVFIDT
Sbjct:    1 MTFKSGFVAILGRPNVGKSTFLNHVMGQKIAIMSDKAQTTRNKIMGIYTTDKEQIVFIDT   60

Query:   76 PGIHKPKTALGDFMVESAYSTLREVETVLFMVPADEKRGKGDDMIIERLKAAKIPVILVI  135
            PGIHKPKTALGDFMVESAYSTLREV+TVLFMVPADE RGKGDDMIIERLKAAK+PVILV+
Sbjct:   61 PGIHKPKTALGDFMVESAYSTLREVDTVLFMVPADEARGKGDDMIIERLKAAKVPVILVV  120

Query:  136 NKIDKVHPDQLLEQIDDFRSQMDFKEVVPISALQGNNVPTLIKLLTDNLEEGFQYFPEDQ  195
            NKIDKVHPDQLL QIDDFR+QMDFKE+VPISALQGNNV  L+ +L++NL+EGFQYFP DQ
Sbjct:  121 NKIDKVHPDQLLSQIDDFRNQMDFKEIVPISALQGNNVSRLVDILSENLDEGFQYFPSDQ  180

Query:  196 ITDHPERFLVSEMVREKVLHLTQQEVPHSVAVVVESMKRDEETDKVHIRATIMVERDSQK  255
            ITDHPERFLVSEMVREKVLHLT++E+PHSVAVVV+SMKRDEETDKVHIRATIMVERDSQK
Sbjct:  181 ITDHPERFLVSEMVREKVLHLTREEIPHSVAVVVDSMKRDEETDKVHIRATIMVERDSQK  240

Query:  256 GIIIGKQGAMLKKIGKMARRDIELMLGDKVYLETWVKVKKNWRDKKLDLADFGYNEKEY  314
            GIIIGK GAMLKKIG MARRDIELMLGDKV+LETWVKVKKNWRDKKLDLADFGYNE+EY
Sbjct:  241 GIIIGKGGAMLKKIGSMARRDIELMLGDKVFLETWVKVKKNWRDKKLDLADFGYNEREY  299
```

A related DNA sequence was identified in *S. pyogenes* <SEQ ID 6757> which encodes the amino acid sequence <SEQ ID 6758>. Analysis of this protein sequence reveals the following:

```
Possible site: 38
>>> Seems to have no N-terminal signal sequence

----- Final Results -----
            bacterial cytoplasm --- Certainty = 0.1088(Affirmative) < succ>
            bacterial membrane  --- Certainty = 0.0000(Not Clear)   < succ>
             bacterial outside  --- Certainty = 0.0000(Not Clear)   < succ>
```

An alignment of the GAS and GBS proteins is shown below.

```
Identities = 295/297 (99%), Positives = 296/297 (99%)

Query:   18 FKSGFVAILGRPNVGKSTFLNHVMGQKIAIMSDKAQTTRNKIMGIYTTETEQIVFIDTPG   77
            FKSGFVAILGRPNVGKSTFLNHVMGQKIAIMSDKAQTTRNKIMGIYTTETEQIVFIDTPG
Sbjct:    2 FKSGFVAILGRPNVGKSTFLNHVMGQKIAIMSDKAQTTRNKIMGIYTTETEQIVFIDTPG   61

Query:   78 IHKPKTALGDFMVESAYSTLREVETVLFMVPADEKRGKGDDMIIERLKAAKIPVILVINK  137
            IHKPKTALGDFMVESAYSTLREVETVLFMVPADEKRGKGDDMIIERLKAAKIPVILVINK
Sbjct:   62 IHKPKTALGDFMVESAYSTLREVETVLFMVPADEKRGKGDDMIIERLKAAKIPVILVINK  121

Query:  138 IDKVHPDQLLEQIDDFRSQMDFKEVVPISALQGNNVPTLIKLLTDNLEEGFQYFPEDQIT  197
            IDKVHPDQLLEQIDDF SQMDFKEVVPISAL+GNNVPTLIKLLTDNLEEGFQYFPEDQIT
Sbjct:  122 IDKVHPDQLLEQIDDFHSQMDFKEVVPISALEGNNVPTLIKLLTDNLEEGFQYFPEDQIT  181

Query:  198 DHPERFLVSEMVREKVLHLTQQEVPHSVAVVVESMKRDEETDKVHIRATIMVERDSQKGI  257
            DHPERFLVSEMVREKVLHLTQQEVPHSVAVVVESMKRDEETDKVHIRATIMVERDSQKGI
Sbjct:  182 DHPERFLVSEMVREKVLHLTQQEVPHSVAVVVESMKRDEETDKVHIRATIMVERDSQKGI  241

Query:  258 IIGKQGAMLKKIGKMARRDIELMLGDKVYLETWVKVKKNWRDKKLDLADFGYNEKEY     314
            IIGKQGAMLKKIGKMARRDIELMLGDKVYLETWVKVKKNWRDKKLDLADFGYNEKEY
Sbjct:  242 IIGKQGAMLKKIGKMARRDIELMLGDKVYLETWVKVKKNWRDKKLDLADFGYNEKEY     298
```

Based on this analysis, it was predicted that these proteins and their epitopes could be useful antigens for vaccines or diagnostics.

EXAMPLE 2188

A DNA sequence (GBSx2305) was identified in *S. agalactiae* <SEQ ID 6759> which encodes the amino acid sequence <SEQ ID 6760>. Analysis of this protein sequence reveals the following:

```
Possible site: 27
>>> Seems to have no N-terminal signal sequence

----- Final Results -----
            bacterial cytoplasm --- Certainty = 0.2679(Affirmative) < succ>
            bacterial membrane  --- Certainty = 0.0000(Not Clear)  < succ>
             bacterial outside  --- Certainty = 0.0000(Not Clear)  < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 2189

A DNA sequence (GBSx2306) was identified in *S. agalactiae* <SEQ ID 6761> which encodes the amino acid sequence <SEQ ID 6762>. Analysis of this protein sequence reveals the following:

```
Possible site: 21
>>> Seems to have a cleavable N-term signal seq.

----- Final Results -----
             bacterial outside  --- Certainty = 0.3000(Affirmative) < succ>
            bacterial membrane  --- Certainty = 0.0000(Not Clear)  < succ>
            bacterial cytoplasm --- Certainty = 0.0000(Not Clear)  < succ>
```

The protein has homology with the following sequences in the GENPEPT database.

```
>GP: BAA16793 GB: D90900 hypothetical protein [Synechocystis sp.]
Identities = 36/119 (30%), Positives = 57/119 (47%), Gaps = 15/119 (12%)
Query: 390 TSDYEKAKVIHDHLVNNYTYATEELATTRETASGISIHAPEALYKDKRGVCQAFAVMFKD   449
            ++D+E+A++ +  +   N  Y   +A TR      I    PE +       +C  ++ +++
Sbjct: 153 SNDWEEARLAYSWITQNIAYDVP-MAETRN----IDDLRPETVLARGETICSGYSNLYQA   207

Query: 450 MAATAGLSVWYVTGQAGGG----------NHAWNIVTINGVKYYVDTTWDNNIKSNKYF   498
            +A   GL V  + G A GG           NHAWN V I+G  Y +DTTW    I S+   F
Sbjct: 208 LAKELGLDVVIIEGFAKGGDVIVGDDPDVNHAWNGVKIDGQWYLLDTTWGAGIVSDGKF   266
```

A related DNA sequence was identified in *S. pyogenes* <SEQ ID 6763> which encodes the amino acid sequence <SEQ ID 6764>. Analysis of this protein sequence reveals the following:

```
Possible site: 23
>>> May be a lipoprotein

----- Final Results -----
            bacterial membrane --- Certainty = 0.0000(Not Clear) < succ>
            bacterial outside  --- Certainty = 0.0000(Not Clear) < succ>
            bacterial cytoplasm --- Certainty = 0.0000(Not Clear) < succ>
```

The protein has no significant homology with any sequences in the GENPEPT database.

An alignment of the GAS and GBS proteins is shown below.

```
Identities = 41/181 (22%), Positives = 79/181 (42%), Gaps = 17/181 (9%)
Query: 355 ITITYTLKGDMVGLHKEYKQFVDSFVKENITNKNITSDYEKAKVIHDHLVNNYTYATE--   412
            + +T+ +  D    ++++  Q + + +  N   +K+     YE+ K   ++ ++ +  Y  +
Sbjct: 124 VFVTFPIPEDAKNIYQDL-QAIGNDIVANTPSKD---RYEQVKYFYEVIIRDTDYNKKAF   179

Query: 413 ELATTRETASGISIHAPEALYKDKRGVCQAFAVMFKDMAATAGLSVWYVTGQAGGGN---   469
            E   +   A  S    ++++ D    VC  +A  F+  +    AG+ V Y+  G
Sbjct: 180 EAYQSGSQAQVASNQDIKSVFIDHLSVCNGYAQAFQFLCQKAGIPVAYIRGTGTSQQPQQ   239

Query: 470 ---HAWNIVTINGVKYYVDTTW-----DNNIKSNKYFLVGKTIMDADHLLDSQYNALAKDI   522
               HAWN V IN   Y VD TW      DN++   K   +  +     L +  +   +KDI
Sbjct: 240 SFAHAWNAVQINNTYYGVDVTWGDPVFDNHLSHQKQGTINYSFLCLPDYLMALSHQPSKDI   300
```

Based on this analysis, it was predicted that this protein and its epitopes, could be useful antigens for vaccines or diagnostics.

EXAMPLE 2190

A DNA sequence (GBSx2307) was identified in *S. agalactiae* <SEQ ID 6765> which encodes the amino acid sequence <SEQ ID 6766>. This protein is predicted to be rgg protein. Analysis of this protein sequence reveals the following:

```
Possible site: 29
>>> Seems to have no N-terminal signal sequence
    INTEGRAL    Likelihood = -0.16    Transmembrane    187-203 (187-203)

----- Final Results -----
            bacterial membrane --- Certainty = 0.1065(Affirmative) < succ>
            bacterial outside  --- Certainty = 0.0000(Not Clear) < succ>
            bacterial cytoplasm --- Certainty = 0.0000(Not Clear) < succ>
```

A related GBS nucleic acid sequence <SEQ ID 10015> which encodes amino acid sequence <SEQ ID 10016> was also identified.

The protein has homology with the following sequences in the GENPEPT database.

```
>GP: AAA26968 GB: M89776 rgg [Streptococcus gordonii]
Identities = 71/273 (26%), Positives = 140/273 (51%), Gaps = 16/273 (5%)
```

```
Query:    8 KELGKTLRRLRKGKKVSISSLADEHLSKSQISRFERGESEITCSRLLNILDKLNITIDEF    67
            K  GK L+ +R+ K +S+  +A    +S +Q+SR+ERG S +T     + L  +++++ EF
Sbjct:    5 KSSGKILKIIRESKNMSLKEVAAGDISVAQLSRYERGISSLTVDSFYSCLRNMSVSLAEF    64

Query:   68 VSI-HSKAHTHFFILLNRVRKYCAEKNVTKLVALL-----------EDHNHKDYEKIMIK   115
            + H+         +L  ++ +   E N+ KL ++L            E   N+K    I+I+
Sbjct:   65 QYVYHNYREADDVVLSQKLSEAQRENNIVKLESILAGSEAMAQEFPEKKNYK-LNTIVIR   123

Query:  116 ALIFSIDQSIEPNQEELARLTDYLFTVEQWGYYEIILLGNCSRLINYNTLFLLTKEMVNS   175
            A + S +   + ++ ++LTDYLF+VE+WG YE+ L  N   L+    TL     EM+N
Sbjct:  124 ATLTSCNPDYQVSKGDIEFLTDYLFSVEEWGRYELWLFTNSVNLLTLETLETFASEMINR   183

Query:  176 FAYSEQNKTNKILVTQLAINCLIISIDHSYFEHSHYLIDKVRSLLQDEVNFYEKTVFLYV   235
              +      N+   + ++ +N +    I++++ + +    ++ + +     E + Y++ +  Y
Sbjct:  184 TQFYNNLPENRRRIIKMLLNVVSACIENNHLQVAMKFLNYIDNTKIPETDLYDRVLIKYH   243

Query:  236 TGYYHLKLGDTSSGKEDMRKALQIFKYLGEDSF                             268
              Y    K+G+  + + D+ + L   F+YL   DSF
Sbjct:  244 KALYSYKVGNPHA-RHDIEQCLSTFEYL--DSF                             273
```

There is also homology to SEQ ID 628.

Based on this analysis, it was predicted that this protein and its epitopes, could be useful antigens for vaccines or diagnostics.

EXAMPLE 2191

A DNA sequence (GBSx2308) was identified in *S. agalactiae* <SEQ ID 6767> which encodes the amino acid sequence <SEQ ID 6768>. Analysis of this protein sequence reveals the following:

```
Possible site: 36
>>> Seems to have no N-terminal signal sequence

----- Final Results -----
             bacterial cytoplasm --- Certainty = 0.3234(Affirmative) < succ>
             bacterial membrane  --- Certainty = 0.0000(Not Clear)   < succ>
              bacterial outside  --- Certainty = 0.0000(Not Clear)   < succ>
```

The protein has homology with the following sequences in the GENPEPT database.

```
>GP: BAA05066 GB: D26071 formamidopyrimidine-DNA glycosylase
[Streptococcus mutans]
Identities = 182/271 (67%), Positives = 217/271 (79%)
Query:    1 MPELPEVETVRKGLERLVVNQEIASITIKVPKMVKTDLNDFMISLPGKTIQQVLRRGKYL    60
            MPELPEVETVR+GLE L+V ++I S+ ++VPKMVKT + DF + + G+T + + RRGKYL
Sbjct:    1 MPELPEVETVRRGLEHLIVGKKIVSVEVRVPKMVKTGVEDFQLDILGQTFESIGRRGKYL    60

Query:   61 LFDFGEMVMVSHLRMEGKYLLFPNKVPDNKHFHLYFKLTNGSTLVYQDVRKFGTFELVRK   120
            L +       ++SHLRMEGKYLLF ++VPDNKHFHL+F L  GSTLVYQDVRKFGTFEL+ K
Sbjct:   61 LLNLNRQTIISHLRMEGKYLLFEDEVPDNKHFHLFFGLDGGSTLVYQDVRKFGTFELLPK   120

Query:  121 SSLKDYFTQKKLGPEPTADTFQFEPFSKGLANSKKPIKPLLLDQRLVAGLGNIYVDEVLW   180
            S ++ YF QKK+GPEP A  F+ +PF +GLA S K IK LLLDQ LVAGLGNIYVDEVLW
Sbjct:  121 SQVEAYFVQKKIGPEPNAKDFKLKPFEEGLAKSHKVIKTLLLDQHLVAGLGNIYVDEVLW   180

Query:  181 AAKIHPQRLANQLTESETSLLHKEIIRILTLGIEKGGSTIRTYKNALGEDGTMQKYLQVY   240
            AAK+ P+RLA+QL  SE   +H E  IRIL L IEKGGSTIR+YKN+LGEDG+MQ  LQVY
Sbjct:  181 AAKVDPERLASQLKTSEIKRIHDETIRILQLAIEKGGSTIRSYKNSLGEDGSMQDCLQVY   240

Query:  241 GKTGQPCPRCGCLIKKIKVGGRGTHYCPRCQ                               271
            GKT QPC RC    I+KIKVGGRGTH+CP CQ
Sbjct:  241 GKTDQPCARCATPIEKIKVGGRGTHFCPSCQ                               271
```

A related DNA sequence was identified in *S. pyogenes* <SEQ ID 6769> which encodes the amino acid sequence <SEQ ID 6770>. Analysis of this protein sequence reveals the following:

```
Possible site: 54
>>> Seems to have no N-terminal signal sequence

----- Final Results -----
            bacterial cytoplasm --- Certainty = 0.2068(Affirmative) < succ>
             bacterial membrane --- Certainty = 0.0000(Not Clear)  < succ>
              bacterial outside --- Certainty = 0.0000(Not Clear)  < succ>
```

An alignment of the GAS and GBS proteins is shown below.

```
Identities = 190/271 (70%), Positives = 229/271 (84%)
Query:    1 MPELPEVETVRKGLERLVVNQEIASITIKVPKMVKTDLNDFMISLPGKTIQQVLRRGKYL   60
            MPELPEVETVR+GLE LV+ QEI ++T+KVPKMVKTDL  F ++LPG+ IQ V RRGKYL
Sbjct:    1 MPELPEVETVRRGLETLVLGQEIVAVTLKVPKMVKTDLETFALTLPGQIIQSVGRRGKYL   60

Query:   61 LFDFGEMVMVSHLRMEGKYLLFPNKVPDNKHFHLYFKLTNGSTLVYQDVRKFGTFELVRK  120
            L D G++V+VSHLRMEGKYLLFP++VPDNKHFH++F+L NGSTLVYQDVRKFGTE+L+ K
Sbjct:   61 LIDLGQLVLVSHLRMEGKYLLFPDEVPDNKHFHVFFELKNGSTLVYQDVRKFGTFDLIAK  120

Query:  121 SSLKDYFTQKKLGPEPTADTFQFEPFSKGLANSKKPIKPLLLDQRLVAGLGNIYVDEVLW  180
              S L  +F ++KLGPEP  +TF+ + F  L  +S+KPIKP LLDQ LVAGLGNIYVDEVLW
Sbjct:  121 SQLSAFFAKRKLGPEFKKETFKLKTFEAALLSSQKPIKPHLLDQTLVAGLGNIYVDEVLW  180

Query:  181 AAKIHPQRLANQLTESETSLLHKEIIRILTLGIEKGGSTIRTYKNALGEDGTMQKYLQVY  240
            AAK+HP+  +++L ++E    LH E IRIL LGIEKGGST+RTY+NALG DGTMQ YLQVY
Sbjct:  181 AAKVHPETASSRLNKAEIKRLHDETIRILALGIEKGGSTVRTYRNALGADGTMQDYLQVY  240

Query:  241 GKTGQPCPRCGCLIKKIKVGGRGTHYCPRCQ                              271
            G+TG+PCPRCG  I K+KVGGRGTH CP+CQ
Sbjct:  241 GQTGKPCPRCGQAIVKLKVGGRGTHICPKCQ                              271
```

Based on this analysis, it was predicted that these proteins and their epitopes could be useful antigens for vaccines or diagnostics.

EXAMPLE 2192

A DNA sequence (GBSx2309) was identified in *S. agalactiae* <SEQ ID 6771> which encodes the amino acid sequence <SEQ ID 6772>. Analysis of this protein sequence reveals the following:

```
Possible site: 26
>>> Seems to have no N-terminal signal sequence

----- Final Results -----
            bacterial cytoplasm --- Certainty = 0.0797(Affirmative) < succ>
             bacterial membrane --- Certainty = 0.0000(Not Clear)  < succ>
              bacterial outside --- Certainty = 0.0000(Not Clear)  < succ>
```

A related GBS nucleic acid sequence <SEQ ID 10013> which encodes amino acid sequence <SEQ ID 10014> was also identified.

The protein has homology with the following sequences in the GENPEPT database.

```
>GP: AAC00353 GB: AF008220 YtaG [Bacillus subtilis]
Identities = 80/189 (42%), Positives = 113/189 (59%), Gaps = 1/189 (0%)
Query:    8 MTKIIGLTGGIASGKSTVTKIIRESGFKVIDADQVVHKLQAKGGKLYQALLEWLGPEILD   67
            MT +IGLTGGIASGKSTV  ++ E G  VIDAD +  +   KG   Y+ +++  G +IL
Sbjct:    1 MTLVIGLTGGIASGKSTVANMLIEKGITVIDADIIAKQAVEKGMPAYRQIIDEFGEDILL   60

Query:   68 ADGELDRPKLSQMIFANPDNMKTSARLQNSIIRQELACQRDQLKQTEEIF-FMDIPLLIE  126
            ++G++DR KL  ++F N          + +  +RQE+  +RD+      E F  +DIPLL E
Sbjct:   61 SNGDIDRKKLGALVFTNEQKRLALNAIVHPAVRQEMLNRRDEAVANREAFVVLDIPLLFE  120

Query:  127 EKYIKWFDEIWLVFVDKEKQLQRLMARNNYSREEAELRLSHQMPLTDKKSFASLIIDNNG  186
                K    D+I +V V KE QL+RLM RN  + EEA  R+  QMPL +K  A  +IDN+G
Sbjct:  121 SKLESLVDKIIVVSVTKELQLERLMKRNQLTEEEAVSRIRSQMPLEEKTARADQVIDNSG  180

Query:  187 DLITLKEQI                                                    195
              L   K Q+
Sbjct:  181 TLEETKRQL                                                    189
```

A related sequence was also identified in GAS <SEQ ID 9111> which encodes the amino acid sequence <SEQ ID 9112>. Analysis of this protein sequence reveals the following:

```
Possible cleavage site: 59
>>> Seems to have no N-terminal signal sequence

----- Final Results -----
            bacterial cytoplasm --- Certainty = 0.101(Affirmative) < succ>
             bacterial membrane --- Certainty = 0.000(Not Clear)   < succ>
              bacterial outside --- Certainty = 0.000(Not Clear)   < succ>
```

An alignment of the GAS and GBS proteins is shown below.

```
Identities = 118/191 (61%), Positives = 153/191 (79%)
Query:    9 TKIIGLTGGIASGKSTVTKIIRESGFKVIDADQVVHKLQAKGGKLYQALLEWLGPEILDA    68
            T IIG+TGGIASGKSTV K+IR++G++VIDADQVVH LQ KGG+LY+AL E  G +IL A
Sbjct:    9 TMIIGITGGIASGKSTVVKVIRKAGYQVIDADQVVHDLQEKGGRLYEALREAFGNQILKA    68

Query:   69 DGELDRPKLSQMIFANPDNMKTSARLQNSIIRQELACQRDQLKQTEEIFFMDIPLLIEEK   128
            DGELDR KLS+M+F+NPDNM TS+ +QN II++ELA +RD L Q++ IFFMDIPLL+E
Sbjct:   69 DGELDRTKLSEMLFSNPDNMATSSAIQNQIIKEELAAKRDHLAQSQAIFFMDIPLLMELG   128

Query:  129 YIKWFDEIWLVFVDKEKQLQRLMARNNYSREEAELRLSHQMPLTDKKSFASLIIDNNGDL   188
            Y  WFD IWLV+VD + QLQRLMARN   + +A  R++ Q+P+ +KK +ASL+IDN+GD+
Sbjct:  129 YQDWFDAIWLVYVDAQTQLQRLMARNRLDKGKARQRIASQLPIEEKKPYASLVIDNSGDI   188

Query:  189 ITLKEQILDAL                                                  199
            + L +Q+  AL
Sbjct:  189 AALIKQVQSAL                                                  199
```

A related GBS gene <SEQ ID 8993> and protein <SEQ ID 8994> were also identified. Analysis of this protein sequence reveals a signal peptide at residues 1-16.

The protein has homology with the following sequences in the databases:

```
42.2/60.6% over 189aa

OMNI|nt01BS3382|Insert characterized

ORF-2237(319-885 of 1206)
OMNI|NT01BS3382(3-192 of 200) ()
% Match = 17.0
% Identity = 42.1  % Similarity = 60.5
Matches = 80  Mismatches = 74  Conservative Sub.s = 35
 78         108        138        168        198        228        258        288
KNSPTAFG*SIDRI*NKLITQGNYSHFNFRHRKRWLHD*NI*ECSWRGRYDAKVFTGLW*NWATVSKVWLFN*EDKSRRE
318        348        378        408        438        468        498        528
RDALLPSVSMLMTKIIGLTGGIASGKSTVTKIIRESGFKVIDADQVVHKLQAKGGKLYQALLEWLGPEILDADGELDRPK
            |:| :||||||||||||  :: |   ||||| :   ||   |: ::: :| :|| ::|::|| |
            VDLLTLVIGLTGGIASGKSTVANMLIEKGITVIDADIIAKQAVEKGMPAYRQIIDEFGEDILLSNGDIDRKK
                   10         20         30         40         50         60         70
558        588        618        648        675        705        735        765
LSQMIFANPDNMKTSARLQNSIIRQELACQRDQLKQTEEIFF-MDIPLLIEEKYIKWFDEIWLVFVDKEKQLQRLMARNN
|   ::|         :   :|||| :||:    |  | :|||| |  |   :|||| |   |:|   |:|||  || ||
LGALVFTNEQKRLALNAIVHPAVRQEMLNRRDEAVANREAFVVLDIPLLFESKLESLVDKIIVVSVTKELQLERLMKRNQ
            90        100        110        120        130        140        150
795        825        855        885        915        945        975        1005
YSREEAELRLSHQMPLTDKKSFASLIIDNNGDLITLKEQILDALQRL*NY*MDNVFIHFLSLLH*F*KTCD*TTVIVQ*Y
:  |||  |:  ||||  :| : | :|||:|  |    | |: : :
LTEEEAVSRIRSQMPLEEKTARADQVIDNSGTLEETKRQLDEIMNSWA
            170        180        190        200
```

A related DNA sequence was identified in *S. pyogenes* <SEQ ID 6773> which encodes amino acid sequence <SEQ ID 6774>. An alignment of the GAS and GBS sequences follows:

```
Score = 218 bits (550), Expect = 4e-59
Identities = 104/175 (59%), Positives = 138/175 (78%)
```

```
-continued
Query:  25 VVKVIRKAGYQVIDADQVVHDLQEKGGRLYEALREAFGNQILKADGELDRTKLSEMLFSN   84
            V K+IR++G++VIDADQVVH LQ KGG+LY+AL E  G +IL ADGELDR KLS+M+F+N
Sbjct:  20 VTKIIRESGFKVIDADQVVHKLQAKGGKLYQALLEWLGPEILDADGELDRPKLSQMIFAN   79

Query:  85 PDNMATSSAIQNQIIKEELAAKRDHLAQSQAIFFMDIPLLMELGYQDWFDAIWLVYVDAQ  144
           PDNM TS+ +QN II++ELA +RD L Q++ IFFMDIPLL+E    Y  WFD IWLV+VD +
Sbjct:  80 PDNMKTSARLQNSIIRQELACQRDQLKQTEEIFFMDIPLLIEEKYIKWFDEIWLVFVDKE  139

Query: 145 TQLQRLMARNRLDKGKARQRIASQLPIEEKKPYASLVIDNSGDIAALIKQVQSAL       199
           QLQRLMARN   + +A  R++ Q+P+ +KK +ASL+IDN+GD+  L +Q+  AL
Sbjct: 140 KQLQRLMARNNYSREEAELRLSHQMPLTDKKSFASLIIDNNGDLITLKEQILDAL      194
```

SEQ ID 8994 (GBS245) was expressed in *E. coli* as a His-fusion product. SDS-PAGE analysis of total cell extract is shown in FIG. 61 (lane 6; MW 23.7 kDa). It was also expressed in *E. coli* as a GST-fusion product, and purified GBS245-GST is shown in FIG. 211, lane 6.

Figure 278:
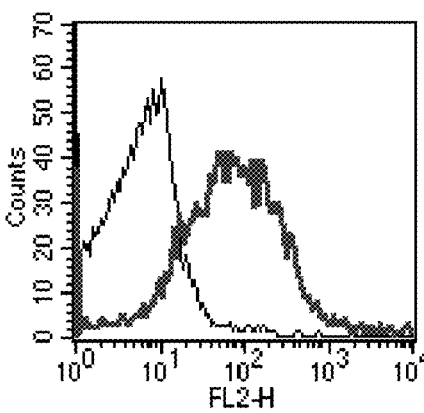

The purified GST fusion product was used to immunise mice ands the resulting antiserum was used for FACS (FIG. 278). This confirmed that the protein is immunoaccessible on GBS bacteria.

Based on this analysis, it was predicted that these proteins and their epitopes could be useful antigens for vaccines or diagnostics.

EXAMPLE 2193

A DNA sequence (GBSx2310) was identified in *S. agalactiae* <SEQ ID 6775> which encodes the amino acid sequence <SEQ ID 6776>. Analysis of this protein sequence reveals the following:

```
Possible site: 35
>>> Seems to have no N-terminal signal sequence

----- Final Results -----
            bacterial cytoplasm --- Certainty = 0.4073(Affirmative) < succ>
            bacterial membrane  --- Certainty - 0.0000(Not Clear)   < succ>
             bacterial outside  --- Certainty = 0.0000(Not Clear)   < succ>
```

The protein has homology with the following sequences in the GENPEPT database.

```
>GP: BAA30330 GB: AP000005 253aa long hypothetical ATP-binding
             transport protein [Pyrococcus horikoshii]
Identities = 78/240 (32%), Positives = 130/240 (53%), Gaps = 13/240 (5%)
Query:   3 LVIRDIRKRFQETEVLRGASYRFYSGKITGVLGRNGAGKTTLFNILYGDLAADNGTICLL   62
           +++ ++RK+F   EVL+G ++    G+I G+LG NG+GK+T   IL G +    G + +
Sbjct:   2 IIVENLRKKFGSKEVLKGINFTVNDGEIYGLLGPNGSGKSTTMRILSGIITDFEGKVMVA   61

Query:  63 -KDNHEYPLTDKDI-GIVYSENYLPEFLTGYEFVKFYMDLH--PSDDL-MTIDDYLDFME  117
             D    P+  K+I G V    L  L  EF  F      P D L   +  + +
Sbjct:  62 GVDVSRDPMKVKEIVGYVPETPALYESLTPAEFFSFIGGVRRIPQDILEERVKRLVDAFG  121

Query: 118 IGQTERHRIIKGYSDGMKSKLSLICLMISKPKVILLDEPLTAVDVVSSIAIKRLLLELSE  177
           IG+    +++I   S G K K+SLI ++  P+V++LDE +   +D  S+   + LL E  E
Sbjct: 122 IGK-YMNQLIGTLSFGTKQKISLISALLHDPQVLILDEAMNGLDPKSARIFRELLFEFKE  180

Query: 178 D-HIIILSTHIMALAEDLCDIVAVLDKGKL---QTLDIDR---KHEQFEERLLQVLKGDE  230
           +   I+ STHI+ALAE +CD + ++ +G++     T+D R   + E+ E+ L++ +   E
Sbjct: 181 EGKSIVFSTHILALAEVMCDRIGIIYEGRIVAEGTIDELREIAREEKLEDIFLKLTQAKE  240
```

There is also homology to SEQ ID 2876.

Based on this analysis, it was predicted that this protein and its epitopes, could be useful antigens for vaccines or diagnostics.

EXAMPLE 2194

A DNA sequence (GBSx2311) was identified in *S. agalactiae* <SEQ ID 6777> which encodes the amino acid sequence <SEQ ID 6778>. Analysis of this protein sequence reveals the following:

```
Possible site: 14
>>> Seems to have no N-terminal signal sequence

----- Final Results -----
             bacterial cytoplasm --- Certainty = 0.6138(Affirmative) < succ>
             bacterial membrane  --- Certainty = 0.0000(Not Clear)   < succ>
             bacterial outside   --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 2195

A DNA sequence (GBSx2312) was identified in *S. agalactiae* <SEQ ID 6779> which encodes the amino acid sequence <SEQ ID 6780>. Analysis of this protein sequence reveals the following:

```
Possible site: 20
>>> Seems to have no N-terminal signal sequence
     INTEGRAL    Likelihood = -15.34    Transmembrane   526-542  (511-546)
     INTEGRAL    Likelihood =  -9.61    Transmembrane   340-356  (335-359)
     INTEGRAL    Likelihood =  -8.17    Transmembrane   455-471  (451-476)
     INTEGRAL    Likelihood =  -8.01    Transmembrane    97-113   (95-121)
     INTEGRAL    Likelihood =  -8.01    Transmembrane   216-232  (207-236)
     INTEGRAL    Likelihood =  -3.40    Transmembrane    50-66    (46-67)
     INTEGRAL    Likelihood =  -1.33    Transmembrane   178-194  (178-194)

----- Final Results -----
             bacterial membrane  --- Certainty = 0.7135(Affirmative) < succ>
             bacterial outside   --- Certainty = 0.0000(Not Clear)   < succ>
             bacterial cytoplasm --- Certainty = 0.0000(Not Clear)   < succ>
```

A related GBS nucleic acid sequence <SEQ ID 10011> which encodes amino acid sequence <SEQ ID 10012> was also identified.

The protein has no significant homology with any sequences in the GENPEPT database, but there is homology to SEQ ID 376.

No corresponding DNA sequence was identified in *S. pyogenes*.

Based on this analysis, it was predicted that this protein and its epitopes, could be useful antigens for vaccines or diagnostics.

EXAMPLE 2196

A DNA sequence (GBSx2314) was identified in *S. agalactiae* <SEQ ID 6781> which encodes the amino acid sequence <SEQ ID 6782>. Analysis of this protein sequence reveals the following:

```
Possible site: 32
>>> Seems to have no N-terminal signal sequence
     INTEGRAL    Likelihood = -8.17    Transmembrane   140-156  (134-160)
     INTEGRAL    Likelihood = -6.64    Transmembrane   255-271  (253-274)
     INTEGRAL    Likelihood = -5.79    Transmembrane   345-361  (343-363)
     INTEGRAL    Likelihood = -3.29    Transmembrane   184-200  (183-202)
     INTEGRAL    Likelihood = -2.34    Transmembrane    66-82    (65-83)
     INTEGRAL    Likelihood = -1.65    Transmembrane   221-237  (221-239)
     INTEGRAL    Likelihood = -0.00    Transmembrane   121-137  (121-137)

----- Final Results -----
             bacterial membrane  --- Certainty = 0.4270(Affirmative) < succ>
             bacterial outside   --- Certainty = 0.0000(Not Clear)   < succ>
             bacterial Cytoplasm --- Certainty = 0.0000(Not Clear)   < succ>
```

A related GBS nucleic acid sequence <SEQ ID 9401> which encodes amino acid sequence <SEQ ID 9402> was also identified.

The protein has homology with the following sequences in the GENPEPT database.

```
>GP: CAA07482 GB: AJ007367 multi-drug resistance efflux pump
[Streptococcus pneumoniae]
Identities = 213/372 (57%), Positives = 295/372 (79%)
Query:   1 MPFMVLYVEQLGAPSNKVEWYAGLSVSLSALSSALVAPLWGRLADKYGRKPMMVRAGLMM   60
           +PFM ++VE LG  S +V +YAGL++S+SA+S+AL +P+WG LADKYGRKPMM+RAGL M
Sbjct:  28 VPFMPIFVENLGVGSQQVAFYAGLAISVSAISAALFSPIWGILADKYGRKPMMIRAGLAM   87

Query:  61 TFTMGGLAFIHSVTGLLILRILNGIFAGYVPNSTALIASQAPQEESGYALGTLATGVTGG  120
           T TMGGLAF+ ++  L+ LR+LNG+FAG+VPN+TALIASQ P+E+SG ALGTL+TGV  G
Sbjct:  88 TITMGGLAFVPNIYWLIFLRLLNGVFAGFVPNATALIASQVPKEKSGSALGTLSTGVVAG  147

Query: 121 MLIGPLLGGLLAEWFGIREVFLLVGTILLISTLMTIFMVKEDFKPISNEETMPTTEVFKS  180
            L GP +GG +AE FGIR VFLLVG+ L ++ ++TI  +KEDF+P++ E+ +PT E+F S
Sbjct: 148 TLTGPFIGGFIAELFGIRTVFLLVGSFLFLAAILTICFIKEDFQPVAKEKAIPTKELFTS  207

Query: 181 VKSLQILIGLFVTSMIIQISAQSIAPILTLYIRHLGQTENLMFVSGLIVSGMGFSSILSS  240
           VK    +L+ LF+TS +IQ SAQSI PIL LY+R LGQTENL+FVSGLIVS MGFSS++S+
Sbjct: 208 VKYPYLLLNLFLTSFVIQFSAQSIGPILALYVRDLGQTENLLFVSGLIVSSMGFSSMMSA  267

Query: 241 PKLGRIGDRIGNHRLLLLALLYSFLMYVLCSLAQTSLQLGVIRFLYGFGTGALMPSINSI  300
             +G++GD++GNHRLL++A   YS ++Y+LC+ A + LQLG+ RFL+G GTGAL+P +N++
Sbjct: 268 GVMGKLGDKVGNHRLLVVAQFYSVIIYLLCANASSPLQLGLYRFLFGLGTGALIPGVNAL  327

Query: 301 LTKIAPRQGLSRIFSYNQMFSNLGQVLGPFVGSAVSIHLGFRWVFFVTSFIVLANFVWCF  360
           L+K+ P+ G+SR+F++NQ+F  LG V+GP  GSAV+   G+  VF+ TS V   + ++
Sbjct: 328 LSKMTPKAGISRVFAFNQVFFYLGGVVGPMAGSAVAGQFGYHAVFYATSLCVAFSCLFNL  387

Query: 361 INFRKYIRVKEI                                                 372
           I FR  ++VKEI
Sbjct: 388 IQFRTLLKVKEI                                                 399
```

A related DNA sequence was identified in *S. pyogenes* <SEQ ID 6783> which encodes the amino acid sequence <SEQ ID 6784>. Analysis of this protein sequence reveals the following:

```
Possible site: 58
>>> Seems to have a cleavable N-term signal seq.
    INTEGRAL    Likelihood = -10.14   Transmembrane   165-181  (150-185)
    INTEGRAL    Likelihood =  -7.43   Transmembrane   371-387  (367-391)
    INTEGRAL    Likelihood =  -3.88   Transmembrane    90-106   (86-109)
    INTEGRAL    Likelihood =  -3.35   Transmembrane   145-161  (143-162)
    INTEGRAL    Likelihood =  -1.70   Transmembrane   279-295  (279-297)
    INTEGRAL    Likelihood =  -0.85   Transmembrane   209-225  (209-226)
    INTEGRAL    Likelihood =  -0.27   Transmembrane   347-363  (347-363)

----- Final Results -----
           bacterial membrane --- Certainty = 0.5055(Affirmative) < succ>
            bacterial outside --- Certainty = 0.0000(Not Clear)  < succ>
          bacterial cytoplasm --- Certainty = 0.0000(Not Clear)  < succ>
```

The protein has homology with the following sequences in the databases:

```
>GP: CAA07482 GB: AJ007367 multi-drug resistance efflux pump
[Streptococcus pneumoniae]
Identities = 236/396 (59%), Positives = 309/396 (77%)
Query:   1 VNWRQNLKVAWLGNFFTGASFSLVMPFMALYVENLGTPTELVEYYAGLAVAVTALASALF   60
           +NW+ NL++AW GNF TGAS SLV+PFM ++VENLG  ++ V +YAGLA++V+A+++ALF
Sbjct:   4 INWKDNLRIAWFGNFLTGASISLVVPFMPIFVENLGVGSQQVAFYAGLAISVSAISAALF   63

Query:  61 APVWGKLADRYGRKPMMLRASFVMTFTMGGLAIIPNVFWLLILRLLTGVSAGYVPNATAL  120
            +P+WG LAD+YGRKPMM+RA   MT TMGGLA +PN++WL+ LRLL GV AG+VPNATAL
Sbjct:  64 SPIWGILADKYGRKPMMIRAGLAMTITMGGLAFVPNIYWLIFLRLLNGVFAGFVPNATAL  123

Query: 121 IASQAPKEESGYALGTLATGVTAGALIGPLLGGILAELLGIRQVFLLVGVILFLCSLMTA  180
           IASQ PKE+SG ALGTL+TGV AG L GP +GG +AEL GIR VFLLVG  LFL +++T
Sbjct: 124 IASQVPKEKSGSALGTLSTGVVAGTLTGPFIGGFIAELFGIRTVFLLVGSFLFLAAILTI  183
```

```
                         -continued
Query: 181 VYVKEEFKPVRRFEMIPTKVILKQVKSPQIMLGLFVTSMIIQISAQSVAPILSLYIRHLG 240
           ++KE+F+PV + + IPTK +   VK P ++L LF+TS +IQ SAQS+ PIL+LY+R LG
Sbjct: 184 CFIKEDFQPVAKEKAIPTKELFTSVKYPYLLLNLFLTSFVIQFSAQSIGPILALYVRDLG 243

Query: 241 QTHNLMFTSGLVVSAMGFSSLFSSSYLGKLGDRFGNHRLLLAALCYSFIMYFSSALAQTS 300
              QT NL+F SGL+VS+MGFSS+ S+  +GKLGD+ GNHRLL+ A  YS I+Y   A A +
Sbjct: 244 QTENLLFVSGLIVSSMGFSSMMSAGVMGKLGDKVGNHRLLVVAQFYSVIIYLLCANASSP 303

Query: 301 FQLGVLRFAYGFGVGALMPSINSLLTKLTPKEGISRVFAYNQMFSNLGQVIGPFIGSNVA 360
              QLG+ RF +G G GAL+P +N+LL+K+TPK GISRVFA+NQ+F  LG V+GP  GS VA
Sbjct: 304 LQLGLYRFLFGLGTGALIPGVNALLSKMTPKAGISRVFAFNQVFFYLGGVVGPMAGSAVA 363

Query: 361 VVLGYRSVFYVTSLIVFVNLIWSLIIFRKYIKVKDI                         396
              GY +VFY TSL V  + +++LI FR  +KVK+I
Sbjct: 364 GQFGYHAVFYATSLCVAFSCLFNLIQFRTLLKVKEI                         399
```

An alignment of the GAS and GBS proteins is shown below.

```
Identities = 262/373 (70%), Positives = 314/373 (83%)
Query:   1 MPFMVLYVEQLGAPSNKVEWYAGLSVSLSALSSALVAPLWGRLADKYGRKPMMVRAGLMM   60
           MPFM LYVE LG P+  VE+YAGL+V+++AL+SAL AP+WG+LAD+YGRKPMM+RA  +M
Sbjct:  25 MPFMALYVENLGTPTELVEYYAGLAVAVTALASALFAPVWGKLADRYGRKPMMLRASFVM   84

Query:  61 TFTMGGLAFIHSVTGLLILRILNGIFAGYVPNSTALIASQAPQEESGYALGTLATGVTGG  120
           TFTMGGLA I +V   LLILR+L G+ AGYVPN+TALIASQAP+EESGYALGTLATGVT G
Sbjct:  85 TFTMGGLAIIPNVFWLLILRLLTGVSAGYVPNATALIASQAPKEESGYALGTLATGVTAG  144

Query: 121 MLIGPLLGGLLAEWFGIREVFLLVGTILLISTLMTIFMVKEDFKPISNEETMPTTEVFKS  180
           LIGPLLGG+LAE  GIR+VFLLVG IL +  +LMT    VKE+FKP+    E  +PT  + K
Sbjct: 145 ALIGPLLGGILAELLGIRQVFLLVGVILFLCSLMTAVYVKEEFKPVRRFEMIPTKVILKQ  204

Query: 181 VKSLQILIGLFVTSMIIQISAQSIAPILTLYIRHLGQTENLMFVSGLIVSGMGFSSILSS  240
           VKS QI++GLFVTSMIIQISAQS+APIL+LYIRHLGQT NLMF SGL+VS MGFSS+ SS
Sbjct: 205 VKSPQIMLGLFVTSMIIQISAQSVAPILSLYIRHLGQTHNLMFTSGLVVSAMGFSSLFSS  264

Query: 241 PKLGRIGDRIGNHRLLLLALLYSFLMYVLCSLAQTSLQLGVIRFLYGFGTGALMPSINSI  300
             LG++GDR GNHRLLL AL YSF+MY    +LAQTS QLGV+RF YGFG GALMPSINS+
Sbjct: 265 SYLGKLGDRFGNHRLLLAALCYSFIMYFSSALAQTSFQLGVLRFAYGFGVGALMPSINSL  324

Query: 301 LTKIAPRQGLSRIFSYNQMFSNLGQVLGPFVGSAVSIHLGFRWVFFVTSFIVLANFVWCF  360
           LTK+ P++G+SR+F+YNQMFSNLGQV+GPF+GS V++ LG+R VF+VTS IV  N +W
Sbjct: 325 LTKLTPKEGISRVFAYNQMFSNLGQVIGPFIGSNVAVVLGYRSVFYVTSLIVFVNLIWSL  384

Query: 361 INFRKYIRVKEIV                                                373
           I FRKYI+VK+IV
Sbjct: 385 IIFRKYIKVKDIV                                                397
```

Based on this analysis, it was predicted that these proteins and their epitopes could be useful antigens for vaccines or diagnostics.

EXAMPLE 2197

A DNA sequence (GBSx2315) was identified in *S. agalactiae* <SEQ ID 6785> which encodes the amino acid sequence <SEQ ID 6786>. Analysis of this protein sequence reveals the following:

```
Possible site: 20
>>> Seems to have no N-terminal signal sequence

----- Final Results -----
            bacterial cytoplasm --- Certainty = 0.2343(Affirmative) < succ>
              bacterial membrane --- Certainty = 0.0000(Not Clear) < succ>
                bacterial outside --- Certainty = 0.0000(Not Clear) < succ>
```

The protein has homology with the following sequences in the GENPEPT database.

```
>GP: AAB69986 GB: U94356 glycerol kinase [Enterococcus faecalis]
Identities = 156/186 (83%), Positives = 167/186 (88%), Gaps = 1/186 (0%)
```

```
                             -continued
Query:     3 SEEKYIMAIDQGTTSSRAIIFNKKGEKIASSQKEFPQIFPQAGWVEHNANQIWNSVQSVI    62
             +EEKYIMAIDQGTTSSRAIIF+KKG KI SSQKEF Q FP AGWVEHNAN+IWNSVQSVI
Sbjct:     2 AEEKYIMAIDQGTTSSRAIIFDKKGNKIGSSQKEFTQYFPNAGWVEHNANEIWNSVQSVI    61

Query:    63 AGAFIESSIKPGQIEAIGITNQRETTVVWDKKTGLPIYNAIVWQSRQTAPIADQLKQEGH   122
             AG+ IES +KP  I  IGITNQRETTVVWDK TGLPIYNAIVWQSRQT PIADQLK++G+
Sbjct:    62 AGSLIESGVRPTDIAGIGITNQRETTVVWDKATGLPIYNAIVWQSRQTTPIADQLKEDGY   121

Query:   123 TNMIHEKTGLVIDAYFSATKVRWILDHVPGAQERAEKGELLFGTIDTWLVWKLTDGLVHV   182
             + MIHEKTGL+IDAYFSATKVRWILDHV GAQERAE GEL+FGTIDTWLVWKLT G  HV
Sbjct:   122 SEMIHEKTGLIIDAYFSATKVRWILDHVEGAQERAENGELMFGTIDTWLVWKLT-GDTHV   180

Query:   183 TDYSNA                                                        188
             TDYSNA
Sbjct:   181 TDYSNA                                                        186
```

There is also high homology to SEQ ID 2844:

```
Identities = 174/186 (93%), Positives = 182/186 (97%)

Query:     3 SEEKYIMAIDQGTTSSRAIIFNKKGEKIASSQKEFPQIFPQAGWVEHNANQIWNSVQSVI    62
             S+EKYIMAIDQGTTSSRAIIFN+KGEK++SSQKEFPQIFP AGWVEHNANQIWNSVQSVI
Sbjct:     2 SQEKYIMAIDQGTTSSRAIIFNQKGEKVSSSQKEFPQIFPHAGWVEHNANQIWNSVQSVI    61

Query:    63 AGAFIESSIKPGQIEAIGITNQRETTVVWDKKTGLPIYNAIVWQSRQTAPIADQLKQEGH   122
             AGAFIESSIKP  QIEAIGITNQRETTVVWDKKTG+PIYNAIVWQSRQTAPIA+QLKQ+GH
Sbjct:    62 AGAFIESSIKPSQIEAIGITNQRETTVVWDKKTGVPIYNAIVWQSRQTAPIAEQLKQDGH   121

Query:   123 TNMIHEKTGLVIDAYFSATKVRWILDHVPGAQERAEKGELLFGTIDTWLVWKLTDGLVHV   182
             T MIHEKTGLVIDAYFSATK+RWILDHVPGAQERAEKGELLFGTIDTWLVWKLTDG VHV
Sbjct:   122 TKMIHEKTGLVIDAYFSATKIRWILDHVPGAQERAEKGELLFGTIDTWLVWKLTDGAVHV   181

Query:   183 TDYSNA                                                        188
             TDYSNA
Sbjct:   182 TDYSNA                                                        187
```

Based on this analysis, it was predicted that these proteins and their epitopes could be useful antigens for vaccines or diagnostics.

EXAMPLE 2198

A DNA sequence (GBSx2317) was identified in *S. agalactiae* <SEQ ID 6787> which encodes the amino acid sequence <SEQ ID 6788>. This protein is predicted to be glycyl-tRNA synthetase beta chain (glyS). Analysis of this protein sequence reveals the following:

```
Possible site: 18
>>> Seems to have no N-terminal signal sequence

----- Final Results -----
           bacterial cytoplasm --- Certainty = 0.2933(Affirmative) < succ>
           bacterial membrane  --- Certainty = 0.0000(Not Clear)   < succ>
            bacterial outside  --- Certainty = 0.0000(Not Clear)   < succ>
```

The protein has homology with the following sequences in the GENPEPT database.

```
>GP: CAB14468 GB: Z99117 glycyl-tRNA synthetase (beta subunit)
[Bacillus subtilis]
Identities = 315/687 (45%), Positives = 447/687 (64%), Gaps = 21/687 (3%)

Query:     3 KDLLLELGLEELPAYVVTPSEKQLGQKMVKFLEDHRLSFETVQIFSTPRRLAVRVKGLAD    62
             +DLLLE+GLEE+PA  +  S  QLG K+  +L++  ++   V++F+TPRRLAV VK +A+
Sbjct:     4 QDLLLEIGLEEMPARFLNESMVQLGDKLTGWLKEKNITHGEVKLFNTPRRLAVFVKDVAE    63

Query:    63 QQTDLTEDFKGPSKKIALDAEGNFSKAAQGFVRGKGLSVDDIEFREVKGEEYVYVTKHET   122
             +Q  D+  E+  KGP+KKIALDA+GN++KAA GF +G+G  +V+D+   +EVKG EYV+V K +
Sbjct:    64 KQDDIKEEAKGPAKKIALDADGNWTKAAIGFSKGQGANVEDLYIKEVKGIEYVFVQKFQA   123
```

```
-continued
Query: 123 GKSAIDVLASVTEVLTELTFPVNMHWANNSFEYIRPVHTLVVLLDDQALELDFLDIHSGR 182
            G+    +L  ++ ++T L FP NM W N    YIRP+ +V L    +    ++ SGR
Sbjct: 124 GQETKSLLPELSGLITSLHFPKNMRWGNEDLRYIRPIKWIVALFGQDVIPFSITNVESGR 183

Query: 183 ISRGHRFLGSDTEISSASSYEDDLRQQFVIADAKERQQMIVNQIHAIEEKKNISVEIDED 242
            ++GHRFLG +  I S S+YE+ L+ Q VIAD   R+QMI +Q+  +  + N S+ +DED
Sbjct: 184 TTQGHRFLGHEVSIESPSAYEEQLKGQHVIADPSVRKQMIQSQLETMAAENNWSIPVDED 243

Query: 243 LLNEVLNLVEYPTAFLGSFDEKYLDVPEEVLVTSMKNHQRYFVVRDRDGKLLPNFISVRN 302
            LL+EV +LVEYPTA  GSF+ ++L +PEEVLVT+MK HQRYF V+D++G LLP+FI+VRN
Sbjct: 244 LLDEVNHLVEYPTALYGSFESEFLSIPEEVLVTTMKEHQRYFPVKDKNGDLLPHFITVRN 303

Query: 303 GNAEHIENVIKGNEKVLVARLEDGEFFWQEDQKLNIADLVEKLKQVTFHEKIGSLYEHMD 362
            GN+  IENV +GNEKVL ARL D  FF++EDQKLNI   V+KL+ + FHE++GSL + +
Sbjct: 304 GNSHAIENVARGNEKVLRARLSDASFFYKEDQKLNIDANVKKLENIVFHEELGSLADKVR 363

Query: 363 RVKVISQYLAEKADLSDEEKLAVLRAASIYKFDLLTGMVDEFPDELQGIMGEKYALLAGEQ 422
            RV   I++ LA +    ++   V RAA I KFDL+T M+ EF ELQGIMGEKYA  GE
Sbjct: 364 RVTSIAEKLAVRLQADEDTLKHVKRAAEISKFDLVTHMIYEFPELQGIMGEKYARMLGED 423

Query: 423 PAVAAAIREHYMPTSADGELPETRVGAILALADKFDTLLSFFSVGLIPSGSNDPYALRRA 482
             AVAAA+ EHYMP SA GE P T  GA++A+ADK DT+ SFFS+G+IP+GS DPY L R
Sbjct: 424 EAVAAAVNEHYMPRSAGGETPSTFTGAVVAMADKLDTIASFFSIGVIPTGSQDPYGLPRQ 483

Query: 483 TQGIVRILEAFGWDIPLDELVTNLYGLSFASLDYANQKEVMAFISARIEKMIGS-KVPKD 541
              GIV IL    W I  +EL+T       F   D  N E++ F + R++ ++ ++   D
Sbjct: 484 ASGIVAILLDRNWGISFEELLT------FVQTDKEN--ELLDFFTQRLKYVLNAEQIRHD 535

Query: 542 IREAVLESDTYIVSLILEASQALVQKSKDAQYKVSVESLSRAFNLAEKVTHSVLVDSSLF 601
            + +AVLES     L  +Q L QK    +K + E+L R ++++K       + LF
Sbjct: 536 VIDAVLESSELEPYSALHKAQVLEQKLGAPGFKETAEALGRVISISKKGVRGD-IQPDLF 594

Query: 602 ENNQEKALYQAILSLELTEDMHDNLDK---------LFALSPIINDFFDNTMVMTDDEKM 652
            EN  E  L+ A + +  E++ +N  K         L AL  I+ +FD+TMV+ D+E +
Sbjct: 595 ENEYEAKLFDAYQTAK--ENLQENFSKKDYEAALASLAALKEPIDAYFDHTMVIADNESL 652

Query: 653 KQNRLAILNSLVAKARTVAAFNLLNTK                                 679
            K NRLA + SL + ++ A  N L  K
Sbjct: 653 KANRLAQMVSLADEIKSFANMNALIVK                                 679
```

A related DNA sequence was identified in *S. pyogenes* <SEQ ID 2835> which encodes the amino acid sequence <SEQ ID 2836>. Analysis of this protein sequence reveals the following:

```
Possible site: 42
>>> Seems to have no N-terminal signal sequence
    INTEGRAL    Likelihood = -0.96    Transmembrane    450-466 (450-466)

----- Final Results -----
              bacterial membrane --- Certainty = 0.1383(Affirmative) < succ>
               bacterial outside --- Certainty = 0.0000(Not Clear) < succ>
             bacterial cytoplasm --- Certainty = 0.0000(Not Clear) < succ>
```

An alignment of the GAS and GBS proteins is shown below.

```
Identities = 505/679 (74%), Positives = 578/679 (84%)

Query:   1 MTKDLLLELGLEELPAYVVTPSEKQLGQKMVKFLEDHRLSFETVQIFSTPRRLAVRVKGL  60
           M+K+LL+ELGLEELPAYVVTPSEKQLG+++  FL ++RLSFE +Q FSTPRRLAVRV GL
Sbjct:   1 MSKNLLIELGLEELPAYVVTPSEKQLGERLATFLTENRLSFEDIQTFSTPRRLAVRVSGL  60

Query:  61 ADQQTDLTEDFKGPSKKIALDAEGNFSKAAQGFVRGKGLSVDDIEFREVKGEEYVYVTKH 120
           ADQQTDLTEDFKGP+KKIALDA+GNFSKAAQGFVRGKGL+ D IEFREVKGEEYVYVTKH
Sbjct:  61 ADQQTDLTEDFKGPAKKIALDADGNFSKAAQGFVRGKGLTTDAIEFREVKGEEYVYVTKH 120

Query: 121 ETGKSAIDVLASVTEVLTELTFPVNMHWANNSFEYIRPVHTLVVLLDDQALELDFLDIHS 180
           E GK A +VL  VTEVL+ +TFPV+MHWANNSFEYIRPVHTL VLL+D+ALELDFLDIHS
Sbjct: 121 EAGKPAKEVLLGVTEVLSAMTFPVSMHWANNSFEYIRPVHTLTVLLNDEALELDFLDIHS 180

Query: 181 GRISRGHRFLGSDTEISSASSYEDDLRQQFVIADAKERQQMIVNQIHAIEEKKNISVEID 240
           GR+SRGHRFLG++T I+SA SYE DLR QFVIADAKERQ+MIV QI  +E ++  V+ID
Sbjct: 181 GRVSRGHRFLGTETTITSADSYEADLRSQFVIADAKERQEMIVEQIKTLEVEQGVQVDID 240
```

-continued

```
Query:  241 EDLLNEVLNLVEYPTAFLGSFDEKYLDVPEEVLVTSMKNHQRYFVVRDRDGKLLPNFISV  300
            EDLLNEVLNLVE+PTAF+GSF+ KYLDVPEEVLVTSMKNHQRYFVVRD+ G L+PNF+SV
Sbjct:  241 EDLLNEVLNLVEFPTAFMGSFEAKYLDVPEEVLVTSMKNHQRYFVVRDQAGHLMPNFVSV  300

Query:  301 RNGNAEHIENVIKGNEKVLVARLEDGEFFWQEDQKLNIADLVEKLKQVTFHEKIGSLYEH  360
            RNGN + IENVIKGNEKVLVARLEDGEFFW+EDQKL IADLV KL  VTFHEKIGSL EH
Sbjct:  301 RNGNDQAIENVIKGNEKVLVARLEDGEFFWREDQKLQIADLVAKLTNVTFHEKIGSLAEH  360

Query:  361 MDRVKVISQYLAEKADLSDEEKLAVLRAASIYKFDLLTGMVDEFDELQGIMGEKYALLAG  420
            MDR +VI+   LA++A+LS EE  AV RAA IYKFDLLTGMV EFDELQGIMGEKYALLAG
Sbjct:  361 MDRTRVIAASLAKEANLSAEEVTAVDRAAQIYKFDLLTGMVGEFDELQGIMGEKYALLAG  420

Query:  421 EQPAVAAAIREHYMPTSADGELPETRVGAILALADKFDTLLSFFSVGLIPSGSNDPYALR  480
            E   AVA  AIREHY+P +A G LPET+VGA+LALA K DTLLSFFSVGLIPSGSNDPYALR
Sbjct:  421 EDAAVATAIREHYLPDAAGGALPETKVGAVLALAAKLDTLLSFFSVGLIPSGSNDPYALR  480

Query:  481 RATQGIVRILEAFGWDIPLDELVTNLYGLSFASLDYANQKEVMAFISARIEKMIGSKVPK  540
            RATQGIVRIL+  FGW IP+D+LV +LY LSF SL YAN+ +VM FI AR++KM+G    PK
Sbjct:  481 RATQGIVRILDHFGWRIPMDKLVDSLYDLSFDSLTYANKADVMNFIRARVDKMMGKAAPK  540

Query:  541 DIREAVLESDTYIVSLILEASQALVQKSKDAQYKVSVESLSRAFNLAEKVTHSVLVDSSL  600
            DIREA+L S T++V  +L A++ALV+ S    YK +VESLSRAFNLAEK   SV VD SL
Sbjct:  541 DIREAILASSTFVVPEMLAAAEALVKASHTENYKPAVESLSRAFNLAEKADASVQVDPSL  600

Query:  601 FENNQEKALYQAILSLELTEDMHDNLDKLFALSPIINDFFDNTMVMTDDEKMKQNRLAIL  660
            FEN  QE   L+ AI  L L      L+++FALSP+INDFFDNTMVM  D+ +K NRLAIL
Sbjct:  601 FENEQENTLFAAIQGLTLAGSAAQQLEQVFALSPVINDFFDNTMVMAGDQALKNNRLAIL  660

Query:  661 NSLVAKARTVAAFNLLNTK                                         679
            + LV+KA+T+ AFN LNTK
Sbjct:  661 SDLVSKAKTIVAFNQLNTK                                         679
```

Based on this analysis, it was predicted that these proteins and their epitopes could be useful antigens for vaccines or diagnostics.

EXAMPLE 2199

A DNA sequence (GBSx2318) was identified in *S. agalactiae* <SEQ ID 6789> which encodes the amino acid sequence <SEQ ID 6790>. Analysis of this protein sequence reveals the following:

```
Possible site: 13
>>> Seems to have no N-terminal signal sequence

----- Final Results -----
          bacterial cytoplasm --- Certainty = 0.2182(Affirmative) < succ>
           bacterial membrane --- Certainty = 0.0000(Not Clear)   < succ>
            bacterial outside --- Certainty = 0.0000(Not Clear)   < succ>
```

The protein has homology with the following sequences in the GENPEPT database.

```
>GP: AAD24436 GB: AF112858 NAD(P)H dehydrogenase [Bacillus
stearothermophilus]
Identities = 64/174 (36%), Positives = 98/174 (55%), Gaps = 6/174 (3%)

Query:    2 NTLIVNSHPDFSNPYSFTTILQEKFIELYNEHFPNHQLSILNLYDCVLPEITKEVLLSIW   61
            N L + +HP   S++  + + FI+ Y + P+H++  L+LY    +PEI  +V  S W
Sbjct:    3 NVLYITAHPH-DDTQSYSMAVGKAFIDTYKQVHPDHEVIHLDLYKEYIPEIDVDVF-SGW   60

Query:   62 SKQRKGL---ELTADEIVQAKISKDLLEQFKSHHRIVFVSPMHNYNVTARAKTYIDNIFI  118
              K R G    EL+ +E +     +L EQF S + +VFV+PM N++      K YID + +
Sbjct:   61 GKLRSGKSFEELSDEEKAKVGRMNELCEQFISADKYVFVTPMWNFSFPPVLKAYIDAVAV  120

Query:  119 AGETFKYTENGSVGLMTDDYRLLMLESAGSIYSKGQYSPYEFPVHYLKAIFKDF        172
            AG+TFKYTE G VGL+TD  + L +++ G  YS+G +   E    YL  I  F
Sbjct:  121 AGKTFKYTEQGPVGLLTDK-KALHIQARGGFYSEGPAAEMEMGHRYLSVIMQFF        173
```

No corresponding DNA sequence was identified in *S. pyogenes*.

Based on this analysis, it was predicted that this protein and its epitopes, could be useful antigens for vaccines or diagnostics.

EXAMPLE 2200

A DNA sequence (GBSx2319) was identified in *S. agalactiae* <SEQ ID 6791> which encodes the amino acid sequence <SEQ ID 6792>. This protein is predicted to be glycyl-tRNA synthetase (glyQ). Analysis of this protein sequence reveals the following:

```
Possible site: 56
>>> Seems to have no N-terminal signal sequence

----- Final Results -----
            bacterial cytoplasm --- Certainty = 0.1364(Affirmative) < succ>
            bacterial membrane  --- Certainty = 0.0000(Not Clear)   < succ>
             bacterial outside  --- Certainty = 0.0000(Not Clear)   < succ>
```

A related GBS nucleic acid sequence <SEQ ID 9521> which encodes amino acid sequence <SEQ ID 9522> was also identified.

The protein has homology with the following sequences in the GENPEPT database.

```
>GP: BAB05089 GB: AP001511 glycyl-tRNA synthetase (alpha subunit)
[Bacillus halodurans]
Identities = 222/287 (77%), Positives = 250/287 (86%)

Query:   6 LTFQEIILTLQQFWNDQGCMLMQAYDNEKGAGTMSPYTFLRAIGPEPWNAAYVEPSRRPA   65
           +  Q +ILTLQ++W+ Q C+L+QAYD EKGAGTMSPYT LR IGPEPWN AYVEPSRRPA
Sbjct:   1 MNVQTMILTLQEYWSKQNCILLQAYDTEKGAGTMSPYTMLRTIGPEPWNVAYVEPSRRPA   60

Query:  66 DGRYGENPNRLYQHHQFQVVMKPSPSNIQELYLKSLELLGINPLEHDIRFVEDNWENPST  125
           DGRYGENPNRLYQHHQFQV+MKPSP+NIQELYL SL  LGINPLEHDIRFVEDNWENPS
Sbjct:  61 DGRYGENPNRLYQHHQFQVIMKPSPTNIQELYLDSLRALGINPLEHDIRFVEDNWENPSL  120

Query: 126 GSAGLGWEVWLDGMEITQFTYFQQVGGLQTGPVTSEVTYGLERLASYIQEVDSVYDIEWA  185
           G AGLGWEVWLDGMEITQFTYFQQVGGL+  PV++E+TYGLERLASYIQ+ ++V+D+EW
Sbjct: 121 GCAGLGWEVWLDGMEITQFTYFQQVGGLEANPVSAEITYGLERLASYIQDKENVFDLEWV  180

Query: 186 PGVKYGEIFTQPEYEHSKYSFEISDQVMLLENFEKFEREAKRALEEGLVHPAYDYVLKCS  245
              G  YG+IFTQPEYEHSKY+FE+SD  ML E F  +E+EA RALEE LV PAYDYVLKCS
Sbjct: 181 EGFTYGDIFTQPEYEHSKYTFEVSDSAMLFELFSTYEKEADRALEENLVFPAYDYVLKCS  240

Query: 246 HTFNLLDARGAVSVTERAGYIARIRNLARVVAKTFVAERKKLGFPLL              292
           HTFNLLDARGA+SVTER GYI R+RNLAR  AK +  ER+KLGFP+L
Sbjct: 241 HTFNLLDARGAISVTERTGYIGRVRNLARKCAKKYYEEREKLGFPML              287
```

A related DNA sequence was identified in *S. pyogenes* <SEQ ID 6793> which encodes the amino acid sequence <SEQ ID 6794>. Analysis of this protein sequence reveals the following:

```
Possible site: 55
>>> Seems to have no N-terminal signal sequence

----- Final Results -----
            bacterial cytoplasm --- Certainty = 0.2081(Affirmative) < succ>
            bacterial membrane  --- Certainty = 0.0000(Not Clear)   < succ>
             bacterial outside  --- Certainty = 0.0000(Not Clear)   < succ>
```

An alignment of the GAS and GBS proteins is shown below.

```
Identities = 290/304 (95%), Positives = 294/304 (96%)

Query:   2 MSKKLTFQEIILTLQQFWNDQGCMLMQAYDNEKGAGTMSPYTFLRAIGPEPWNAAYVEPS   61
           MSKKLTFQEIILTLQQ+WNDQGCMLMQAYDNEKGAGTMSPYTFLRAIGPEPWNAAYVEPS
Sbjct:   1 MSKKLTFQEIILTLQQYWNDQGCMLMQAYDNEKGAGTMSPYTFLRAIGPEPWNAAYVEPS   60
```

```
                      -continued
Query:  62 RRPADGRYGENPNRLYQHHQFQVVMKPSPSNIQELYLKSLELLGINPLEHDIRFVEDNWE 121
           RRPADGRYGENPNRLYQHHQFQVVMKPSPSNIQELYL SLE LGINPLEHDIRFVEDNWE
Sbjct:  61 RRPADGRYGENPNRLYQHHQFQVVMKPSPSNIQELYLASLEKLGINPLEHDIRFVEDNWE 120

Query: 122 NPSTGSAGLGWEVWLDGMEITQFTYFQQVGGLQTGPVTSEVTYGLERLASYIQEVDSVYD 181
           NPSTGSAGLGWEVWLDGMEITQFTYFQQVGGL T PVT+EVTYGLERLASYIQEVDSVYD
Sbjct: 121 NPSTGSAGLGWEVWLDGMEITQFTYFQQVGGLATSPVTAEVTYGLERLASYIQEVDSVYD 180

Query: 182 IEWAPGVKYGEIFTQPEYEHSKYSFEISDQVMLLENFEKFEREAKRALEEGLVHPAYDYV 241
           IEWAPGVKYGEIF QPEYEHSKYSFEISDQ MLLENFEKFE+EA RALEEGLVHPAYDYV
Sbjct: 181 IEWAPGVKYGEIFLQPEYEHSKYSFEISDQDMLLENFEKFEKEASRALEEGLVHPAYDYV 240

Query: 242 LKCSHTFNLLDARGAVSVTERAGYIARIRNLARVVAKTFVAERKKLGFPLLDEETRIKLL 301
           LKCSHTFNLLDARGAVSVTERAGYIARIRNLARVVAKTFVAERKKLGFPLLDE TR  LL
Sbjct: 241 LKCSHTFNLLDARGAVSVTERAGYIARIRNLARVVAKTFVAERKKLGFPLLDEATRAILL 300

Query: 302 AEED                                                         305
           AE+D
Sbjct: 301 AEDD                                                         304
```

Based on this analysis, it was predicted that these proteins and their epitopes could be useful antigens for vaccines or diagnostics.

EXAMPLE 2201

A DNA sequence (GBSx2320) was identified in *S. agalactiae* <SEQ ID 6795> which encodes the amino acid sequence <SEQ ID 6796>. This protein is predicted to be vacB protein (vacB). Analysis of this protein sequence reveals the following:

```
Possible site: 60
>>> Seems to have no N-terminal signal sequence

----- Final Results -----
          bacterial cytoplasm --- Certainty = 0.2966(Affirmative) < succ>
          bacterial membrane --- Certainty = 0.0000(Not Clear)  < succ>
           bacterial outside --- Certainty = 0.0000(Not Clear)  < succ>
```

A related GBS nucleic acid sequence <SEQ ID 9399> which encodes amino acid sequence <SEQ ID 9400> was also identified.

The protein has homology with the following sequences in the GENPEPT database.

```
>GP: CAB15366 GB: Z99121 similar to hypothetical proteins [Bacillus subti-
lis]
Identities = 338/780 (43%), Positives = 485/780 (61%), Gaps = 47/780 (6%)
Query:   4 AKAFPKLIKTISNLESHRQL---RFDDNGSLSLQKKEAKKKEITVRGLFRANKAGFGFL-  59
           A+ F +L+K +  LE   +    R D G        +K   ++G  A+  GF FL
Sbjct:  36 AEEFKELVKALVALEEKGLIVRTRSDRYG--------IPEKMNLIKGKISAHAKGFAFLL  87

Query:  60 SIDQDEDDMFIGKNDIAYAIDGDTVEAVVKKPADRLNGTAAEARVVNIVERSLKTLVGKF 119
           +   D    D+FI  N++  A++GD V  +     +G+  E   V+ I+ER+++ +VG +
Sbjct:  88 PEDTSLSDVFIPPNELNTAMNGDIVMVRLNSQS---SGSRQEGTVIRILERAIQRVVGTY 144

Query: 120 VLDDERPKYAGYIKSKNQKINQKIYIRKEPV--VLDGTEIIKVDIDKYPTRGHDYFVASV 177
                + G++  ++KI  I+I K       +G +++ V + YP   G          V
Sbjct: 145 T----ETRNFGFVIPDDKKITSDIFIPKNGKNGAAEGHKVV-VKLTSYP-EGRMNAEGEV 198

Query: 178 RDIVGHQGDVGIDVLEVLESMDIVSEFPEDVIAEANAIPDAPTEKDLIGRVDLRQEVTFT 237
            I+GH+ D GID+L V+    + EFP D + +A++ PD    EKDL  R  DLR +V  T
Sbjct: 199 ETILGHKNDPGIDILSVIHKHGLPGEFPADAMEQASSTPDTIDEKDLKDRRDLRDQVIVT 258

Query: 238 IDGADAKDLDDAVHIKLLDNGHFELGVHIADVSYYVTEGSALNREALSRGTSVYVTDRVV 297
           IDGADAKDLDDAV +   LD+G ++LGVHIADVS+YVTE S  +++EAL RGTSVY+ DRV+
Sbjct: 259 IDGADAKDLDDAVTVTKLDDGSYKLGVHIADVSHYVTENSPIDKEALERGTSVYLVDRVI 318

Query: 298 PMLPERLSNGICSLNPNLDRLTQSCIMEIDQNGRVVNHQITQSVINTTYRMTYTAVNDII 357
           PM+P RLSNGICSLNP +DRLT SC M I+  G+V  H+I QSVI TT RMTY+ VN I+
Sbjct: 319 PMIPHRLSNGICSLNPKVDRLTLSCEMTINSQGQVTEHEIFQSVIKTTERMTYSDVNKIL 378
```

-continued

```
Query:  358 A-GDEEICSEYESIVSSVQHMVTLHHTLEAMRTRRGALNFDTSEAKIMVNDKGMPVDIVI  416
            DEE+  +YE +V   + M  L    L    R  RGA++FD  EAK++V+D+G    D+VI
Sbjct:  379 VDDDEELKQKYEPLVPMFKDMERLAQILRDKRMDRGAVDFDFKEAKVLVDDEGAVKDVVI  438

Query:  417 RNRGIAERMIESFMLAANETVAEHYARLKLPFIYRIHEEPKAEKLQKFIDYASVFGVQIQ  476
            R R +AE++IE FML ANETVAEH+  +  +PFIYRIHEEP AEKLQKF+++ + FG  ++
Sbjct:  439 RERSVAEKLIEEFMLVANETVAEHFHWMNVPFIYRIHEEPNAEKLQKFLEFVTTFGYVVK  498

Query:  477 GTATKITQSALQDFMKKVQGQPGSEVLSMMLLRSMQQARYSEHNHGHYGLAAEYYTHFTS  536
            GTA  I     ALQ +  V+ +P   V+S ++LRSM+QA+Y   + GH+GL+ E+YTHFTS
Sbjct:  499 GTAGNIHPRALQSILDAVRDRPEETVISTVMLRSMKQAKYDPQSLGHFGLSTEFYTHFTS  558

Query:  537 PIRRYPDLLVHRMIRDY-DDKAMDKA--DHFANLIPEIATQTSSLERRAIDAERIVEAMK  593
            PIRRYPDL+VHR+IR Y  + +D+A   + +A   +P+IA  TSS+ERRA+DAER  +  +K
Sbjct:  559 PIRRYPDLIVHRLIRTYLINGKVDEATQEKWAERLPDIAEHTSSMERRAVDAERETDDLK  618

Query:  594 KAEYMEEYVGEEFEGVVASVVKFGMFVELPNTIEGLIHVTTL-PEYYHFNERTLTLQGEK  652
            KAEYM +  +GEEF+G+++SV  FGMFVELPNTIEGL+HV+  +   +YY F+E+    + GE+
Sbjct:  619 KAEYMLDKIGEEFDGMISSVTNFGMFVELPNTIEGLVHVSFMTDDYYRFDEQHFAMIGER  678

Query:  653 SGKVFRVGQQIKVKLIRSDKETGDIDFDYLPSDFDIVEKVSKSSREGRPNRSSKREHQHR  712
            +G VFR+G +I VK++  +K+  +IDF+ +                 +G P R  + +
Sbjct:  679 TGNVFRIGDEITVKVVDVNKDERNIDFEIV-------------GMKGTPRRPRELD----  721

Query:  713 ISDRDNKNKNTSKKKASRKPKRNSDSKSHHHKDDRTTGSTKKKTKKPFYKGVAKKGQKRK  772
                S  R  K    ++K+           S + S     K+   T   KKK K+ F      +K +K+K
Sbjct:  722 -SSRSRKRGKPARKRVQSTNTPVSPAPS-EEKGEWFTKPKKKKKKRGFQNAPKQKRKKKK  779
```

A related DNA sequence was identified in *S. pyogenes* <SEQ ID 6797> which encodes the amino acid sequence <SEQ ID 6798>. Analysis of this protein sequence reveals the following:

```
Possible site: 30
>>> Seems to have no N-terminal signal sequence

----- Final Results -----
            bacterial cytoplasm --- Certainty = 0.0811(Affirmative) < succ>
            bacterial membrane  --- Certainty = 0.0000(Not Clear)   < succ>
            bacterial outside   --- Certainty = 0.0000(Not Clear)   < succ>
```

An alignment of the GAS and GBS proteins is shown below.

```
Identities = 579/773 (74%), Positives = 664/773 (84%), Gaps = 22/773 (2%)
Query:    1 MAGAKAFPKLIKTISNLESHRQLRFDDNGSLSLQKKEAKKKEITVRGLFRANKAGFGFLS   60
            MAGAK FP LIKTIS +ES   LRF D+GSL+L+K+  KKKE TV+G+FRANKAGFGFL
Sbjct:   27 MAGAKHFPSLIKTISKMESQSLLRFSDDGSLALRKEREKKKEPTVQGVFRANKAGFGFLH   86

Query:   61 IDQDEDDMFIGKNDIAYAIDGDTVEAVVKKPADRLNGTAAEARVVNIVERSLKTLVGKFV  120
            +D++EDDMFIG+ND+ YAIDGDTVE VVKKPADRL GTAAEA+VV IV+RSLKT VG F+
Sbjct:   87 VDENEDDMFIGRNDVGYAIDGDTVEVVVKKPADRLKGTAAEAKVVAIVDRSLKTAVGTFI  146

Query:  121 LDDERPKYAGYIKSKNQKINQKIYIRKEPVVLDGTEIIKVDIDKYPTRGHDYFVASVRDI  180
            LDD++PKYAGYI+SKNQKI QKIYI+KEPVVL GTEIIKVDIDKYP RGHDYFVASVRDI
Sbjct:  147 LDDDKPKYAGYIRSKNQKIQQKIYIKKEPVVLKGTEIIKVDIDKYPIRGHDYFVASVRDI  206

Query:  181 VGHQGDVGIDVLEVLESMDIVSEFPEDVIAEANAIPDAPTEKDLIGRVDLRQEVTFTIDG  240
            VGHQGDVGIDVLEVLESMDIVSEFP +V+AEANAI +APT KDLIGRVDLRQE T TIDG
Sbjct:  207 VGHQGDVGIDVLEVLESMDIVSEFPAEVLAEANAISEAPTAKDLIGRVDLRQETTITIDG  266

Query:  241 ADAKDLDDAVHIKLLDNGHFELGVHIADVSYYVTEGSALNREALSRGTSVYVTDRVVPML  300
            ADAKDLDDA+HIKLLDNG++ELGVHIADVSYYVTEGSAL++EA++RGTSVYVTDRVVPML
Sbjct:  267 ADAKDLDDAIHIKLLDNGNYELGVHIADVSYYVTEGSALDKEAIARGTSVYVTDRVVPML  326

Query:  301 PERLSNGICSLNPNLDRLTQSCIMEIDQNGRVVNHQITQSVINTTYRMTYTAVNDIIAGD  360
            PERLSNGICSLNPN+DRLTQS +MEI+  G VVN+QI QSVI TTYRMTY+ VND+IAGD
Sbjct:  327 PERLSNGICSLNPNIDRLTQSALMEINSQGHVVNYQICQSVIKTTYRMTYSTVNDMIAGD  386

Query:  361 EEICSEYESIVSSVQHMVTLHHTLEAMRTRRGALNFDTSEAKIMVNDKGMPVDIVIRNRG  420
            EE   E+  SI   V   MV LH   LEAMR++RGALNFDT+EAKI+VNDKGMPVD+V+R RG
Sbjct:  387 EEALQEFASIADDVTLMVALHRILEAMRSKRGALNFDTQEAKIIVNDKGMPVDVVLRQRG  446

Query:  421 IAERMIESFMLAANETVAEHYARLKLPFIYRIHEEPKAEKLQKFIDYASVFGVQIQGTAT  480
            IAERMIESFMLAANE VAEH+A+ KLPFIYRIHEEPKAEKLQ+FIDYAS FG+ IQGTA
Sbjct:  447 IAERMIESFMLAANECVAEHFAKAKLPFIYRIHEEPKAEKLQQFIDYASTFGIHIQGTAN  506
```

-continued

```
Query:  481 KITQSALQDFMKKVQGQPGSEVLSMMLLRSMQQARYSEHNHGHYGLAAEYYTHFTSPIRR  540
            KI+Q ALQ FM KV+GQPG+EVL+MMLLRSMQQARYSEHNHGHYGLAAEYYTHFTSPIRR
Sbjct:  507 KISQEALQAFMAKVEGQPGAEVLNMMLLRSMQQARYSEHNHGHYGLAAEYYTHFTSPIRR  566

Query:  541 YPDLLVHRMIRDYDDKAMDKADHFANLIPEIATQTSSLERRAIDAERIVEAMKKAEYMEE  600
            YPDLLVHRM+R+Y+   + +K DHFA +IPE+AT +S LERRAIDAER+VEAMKKAEYM E
Sbjct:  567 YPDLLVHRMVREYNQPSQEKRDHFAQIIPELATSSSQLERRAIDAERVVEAMKKAEYMAE  626

Query:  601 YVGEEFEGVVASVVKFGMFVELPNTIEGLIHVTTLPEYYHFNERTLTLQGEKSGKVFRVG  660
            YVGEEF+G+V+SVVKFG FVELPNTIEGL+H+T+LPEYYHFNERTL+LQGEKSGKVF+VG
Sbjct:  627 YVGEEFDGIVSSVVKFGFFVELPNTIEGLVHITSLPEYYHFNERTLSLQGEKSGKVFKVG  686

Query:  661 QQIKVKLIRSDKETGDIDFDYLPSDFDIVEKVSKSSREGRPNRSSKREHQHRISDRDNKN  720
            Q I+VKL+++DKETGDIDF+YLPSDFD+VEK+   S +  R +R              K+
Sbjct:  687 QPIRVKLVKADKETGDIDFEYLPSDFDVVEKIKMSDKASRRDR--------------RKS  732

Query:  721 KNTSKKKASRKPKRNSDSKSHHHKDDRTTGSTKKKTKKPFYKGVAKKGQKRKS         773
              +SK     ++PK + +K           T G TKK +KKPFYK  AKK   +++S
Sbjct:  733 SKSSKGTKKKEPKEVAKAK--------TKGKTKKGSKKPFYKEQAKKKSRKRS         777
```

Based on this analysis, it was predicted that these proteins and their epitopes could be useful antigens for vaccines or diagnostics.

EXAMPLE 2202

A DNA sequence (GBSx2321) was identified in *S. agalactiae* <SEQ ID 6799> which encodes the amino acid sequence <SEQ ID 6800>. This protein is predicted to be VacB homolog (smpB). Analysis of this protein sequence reveals the following:

```
Possible site: 41
>>> Seems to have no N-terminal signal sequence

----- Final Results -----
            bacterial cytoplasm --- Certainty = 0.2988(Affirmative) < succ>
            bacterial membrane  --- Certainty = 0.0000(Not Clear)   < succ>
             bacterial outside  --- Certainty = 0.0000(Not Clear)   < succ>
```

The protein has homology with the following sequences in the GENPEPT database.

```
>GP: AAC23745 GB: AF052209 VacB homolog [Streptococcus pneumoniae]
Identities = 121/155 (78%), Positives = 139/155 (89%)
Query:    1 MVKGQGNVVAQNKKAHHDYTIVETIEAGIVLTGTEIKSVRAARITLKDGYAQIKNGEAWL   60
            M KG+G VVAQNKKA HDYTIV+T+EAG+VLTGTEIKSVRAARI LKDG+AQ+KNGE WL
Sbjct:    1 MAKGEGKVVAQNKKARHDYTIVDTLEAGMVLTGTEIKSVRAARINLKDGFAQVKNGEVWL   60

Query:   61 INVHITPYDQGNIWNQDPDRTRKLLLKKREIEKISNELKGTGMTLVPLKVYLKDGFAKVL  120
            +NVHI PY++GNIWNQ+P+R RKLLL K++I+K+  E KGTGMTLVPLKVY+KDG+AK+L
Sbjct:   61 SNVHIAPYEEGNIWNQEPERRRKLLLHKKQIQKLEQETKGTGMTLVPLKVYIKDGYAKLL  120

Query:  121 LGLAKGKHDYDKRESIKRREQNRDIARQLKNYNSR                          155
            LGLAKGKHDYDKRESIKRREQNRDIAR +K  N R
Sbjct:  121 LGLAKGKHDYDKRESIKRREQNRDIARVMKAVNQR                          155
```

A related DNA sequence was identified in *S. pyogenes* <SEQ ID 6801> which encodes the amino acid sequence <SEQ ID 6802>. Analysis of this protein sequence reveals the following:

```
Possible site: 41
>>> Seems to have no N-terminal signal sequence

----- Final Results -----
            bacterial cytoplasm --- Certainty = 0.2918(Affirmative) < succ>
            bacterial membrane  --- Certainty = 0.0000(Not Clear)   < succ>
             bacterial outside  --- Certainty = 0.0000(Not Clear)   < succ>
```

An alignment of the GAS and GBS proteins is shown below.

```
Identities = 124/155 (80%), Positives = 145/155 (93%)
Query:    1 MVKGQGNVVAQNKKAHHDYTIVETIEAGIVLTGTEIKSVRAARITLKDGYAQIKNGEAWL   60
            M KG+G+++AQNKKA HDY IVET+EAGIVLTGTEIKSVRAARI LKDG+AQIKNGEAWL
Sbjct:    1 MAKGEGHILAQNKKARHDYHIVETVEAGIVLTGTEIKSVRAARIQLKDGFAQIKNGEAWL   60

Query:   61 INVHITPYDQGNIWNQDPDRTRKLLLKKREIEKISNELKGTGMTLVPLKVYLKDGFAKVL  120
            +NVHI P++QGNIWN DP+RTRKLLLKKREI  ++NELKG+GMTLVPLKVYLKDGFAKVL
Sbjct:   61 VNVHIAPFEQGNIWNADPERTRKLLLKKREITHLANELKGSGMTLVPLKVYLKDGFAKVL  120

Query:  121 LGLAKGKHDYDKRESIKRREQNRDIARQLKNYNSR                          155
            +GLAKGKH+YDKRE+IKRR+Q RDI +Q+K+YN+R
Sbjct:  121 IGLAKGKHEYDKRETIKRRDQERDIKKQMKHYNAR                          155
```

Based on this analysis, it was predicted that these proteins and their epitopes could be useful antigens for vaccines or diagnostics.

EXAMPLE 2203

A DNA sequence (GBSx2322) was identified in *S. agalactiae* <SEQ ID 6803> which encodes the amino acid sequence <SEQ ID 6804>. Analysis of this protein sequence reveals the following:

```
Possible site: 14
>>> Seems to have no N-terminal signal sequence

----- Final Results -----
          bacterial cytoplasm --- Certainty = 0.6876(Affirmative) < succ>
           bacterial membrane --- Certainty = 0.0000(Not Clear)   < succ>
            bacterial outside --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 2204

A DNA sequence (GBSx2323) was identified in *S. agalactiae* <SEQ ID 6805> which encodes the amino acid sequence <SEQ ID 6806>. This protein is predicted to be d-serine/d-alanine/glycine transporter (cycA). Analysis of this protein sequence reveals the following:

```
Possible site: 55
>>> Seems to have a cleavable N-term signal seq.
   INTEGRAL    Likelihood = -9.02    Transmembrane     71-87   (62-90)
   INTEGRAL    Likelihood = -8.92    Transmembrane    320-336  (316-344)
   INTEGRAL    Likelihood = -8.33    Transmembrane    254-270  (251-275)
   INTEGRAL    Likelihood = -6.00    Transmembrane    158-174  (154-175)
   INTEGRAL    Likelihood = -2.76    Transmembrane    197-213  (196-213)
   INTEGRAL    Likelihood = -2.50    Transmembrane    117-133  (116-136)
   INTEGRAL    Likelihood = -1.38    Transmembrane    282-298  (279-298)
   INTEGRAL    Likelihood = -0.32    Transmembrane    342-358  (342-360)

----- Final Results -----
           bacterial membrane --- Certainty = 0.4609(Affirmative) < succ>
            bacterial outside --- Certainty = 0.0000(Not Clear)   < succ>
          bacterial cytoplasm --- Certainty = 0.0000(Not Clear)   < succ>
```

A related GBS nucleic acid sequence <SEQ ID 9397> which encodes amino acid sequence <SEQ ID 9398> was also identified.

The protein has homology with the following sequences in the GENPEPT database.

```
>GP: CAB14651 GB: Z99117 amino acid permease
[Bacillus subtilis]
Identities = 165/361 (45%), Positives = 227/361 (62%), Gaps = 17/361 (4%)

Query:    1 MGIFLT-LSYWISLIFIGMAEITAVGEYVQFWFPEWPSWIIQIVFLAILSSINLIAVKAF   59
            M  F+T  +YW   I + MA++TAVG Y Q+W P+ P W+  ++ L IL  +NL  VK F
Sbjct:   95 MAAFITGWTYWFCWISLAMADLTAVGIYTQYWLPDVPQWLPGLLALIILLIMNLATVKLF  154

Query:   60 GETEFWFPAMIKVIAILGLIATGIFMVLTNFDTGHGYHASISNITNHFEWFPKGKLNFFMA  119
            GE EFWFA+IKVIAIL LI TGI ++    F    G   AS++N+ +H    FP G   F ++
Sbjct:  155 GELEFWFALIKVIAILALIVTGILLIAKGFSAASG-PASLNNLWSHGGMFPNGWHGFILS  213

Query:  120 FQMVFFAYLAIEFVGVTTSETANPRKVLPKAIQEIPMRIILFYAGSLLAIMAIFPWQQLP  179
            FQMV FA++ IE VG+T  ET NP+KV+PKAI +IP+RI+LFY G+L  IM I+PW  L
Sbjct:  214 FQMVVFAFVGIELVGLTAGETENPQKVIPKAINQIPVRILLFYVGALFVIMCIYPWNVLN  273

Query:  180 VNESPFVTVFKLAGIKWAAALINFVVLTSAASALNSTLYSTGRHLFQLANE--SPNALTK  237
             NESPFV VF   GI  AA+LINFVVLTSAASA NS L+ST R ++ LA +  +P   L K
Sbjct:  274 PNESPFVQVFSAVGIVVAASLINFVVLTSAASAANSALFSTSRMVYSLAKDHHAPGLLKK  333

Query:  238 ALKLDQLSRQSVPSRAIIAS--AVIVGASALISVLPGISDAFSLITASSSGVYISIYVLI  295
              L+  +VPS A+  S  A+++G S L  ++P      F+LIT+ S+   +I I+ +
Sbjct:  334 ------LTSSNVPSNALFFSSIAILIGVS-LNYLMP--EQVFTLITSVSTICFIFIWGIT  384

Query:  296 MIAHWKYRKS--PDFMEDGYKMPAYKILSPITLLFFLFVFVSLFLQDSTYIGAIGATIWII  354
            +I H KYRK+   +    + +KMP Y + + +TL F  F+ V L L + T I       +W +
Sbjct:  385 VICHLKYRKTRQHEAKANKFKMPFYPLSNYLTLAFLAFILVILALANDTRIALFVTPVWFV  445
```

There is also homology to SEQ ID 4070:

```
Identities = 286/364 (78%), Positives = 322/364 (87%),
Gaps = 1/364 (0%)

Query:    2 GIFLTLSYWISLIFIGMAEITAVGEYVQFWFPEWPSWIIQIVFLAILSSINLIAVKAFGE   61
            G F  LSYWISLIFIGMAEITAVG YVQFWFP WP+W+IQ+VFL +LSSINLIAV+ FGE
Sbjct:  101 GYFSGLSYWISLIFIGMAEITAVGAYVQFWFPSWPAWLIQLVFLVLLSSINLIAVRVFGE  160

Query:   62 TEFWFAMIKVIAILGLIATGIFMVLTNFDTGHGYHASISNITNHFEWFPKGKLNFFMAFQ  121
            TEFWFAMIK++AIL LIAT IFMVLT F+T H  HAS+SNI +HF  FP GKL FFMAFQ
Sbjct:  161 TEFWFAMIKILAILALIATAIFMVLTGFET-HTGHASLSNIFDHFSMFPNGKLKFFMAFQ  219

Query:  122 MVFFAYLAIEFVGVTTSETANPRKVLPKAIQEIPMRIILFYAGSLLAIMAIFPWQQLPVN  181
            MVFFAY AIEFVG+TTSETANPRKVLPKAIQEIP RI++FY G+L++IMAI PW QLPV+
Sbjct:  220 MVFFAYQAIEFVGITTSETANPRKVLPKAIQEIPTRIVIFYVGALVSIMAIVPWHQLPVD  279

Query:  182 ESPFVTVFKLAGIKWAAALINFVVLTSAASALNSTLYSTGRHLFQLANESPNALTKALKL  241
            ESPFV VFKL GIKWAAALINFVVLTSAASALNSTLYSTGRHL+Q+ANE+PNALT  LK+
Sbjct:  280 ESPFVMVFKLIGIKWAAALINFVVLTSAASALNSTLYSTGRHLYQIANETPNALTNRLKI  339

Query:  242 DQLSRQSVPSRAIIASAVIVGASALISVLPGISDAFSLITASSSGVYISIYVLIMIAHWK  301
            + LSRQ VPSRAIIASAV+VG SALI++LPG++DAFSLITASSSGVYI+IY L MIAHWK
Sbjct:  340 NTLSRQGVPSRAIIASAVVVGISALINILPGVADAFSLITASSSGVYIAIYALTMIAHWK  399

Query:  302 YRKSPDFMEDGYKMPAYKILSPITLLFFLFVFVSLFLQDSTYIGAIGATIWIIGFGLYSH  361
            YR+S DFM DGY MP YK+ +P+TL FF FVF+SLFLQ STYIGAIGATIWII FG+YS+
Sbjct:  400 YRQSKDFMADGYLMPKYKVTTPLTLAFFAFVFISLFLQESTYIGAIGATIWIIIFGIYSN  459

Query:  362 FKHK                                                         365
              K K
Sbjct:  460 VKFK                                                         463
```

Based on this analysis, it was predicted that these proteins and their epitopes could be useful antigens for vaccines or diagnostics.

EXAMPLE 2205

A DNA sequence (GBSx2324) was identified in *S. agalactiae* <SEQ ID 6807> which encodes the amino acid sequence <SEQ ID 6808>. Analysis of this protein sequence reveals the following:

```
Possible site: 38
>>> Seems to have an uncleavable N-term signal seq
    INTEGRAL      Likelihood = -8.33    Transmembrane     194-210 (191-215)
    INTEGRAL      Likelihood = -5.47    Transmembrane      17-33  (14-38)
    INTEGRAL      Likelihood = -5.15    Transmembrane     125-141 (119-144)
    INTEGRAL      Likelihood = -3.88    Transmembrane     155-171 (153-176)
    INTEGRAL      Likelihood = -1.38    Transmembrane      96-112 (94-114)
    INTEGRAL      Likelihood = -0.43    Transmembrane      49-65  (49-65)

----- Final Results -----
              bacterial membrane --- Certainty = 0.4333(Affirmative) < succ>
              bacterial outside  --- Certainty = 0.0000(Not Clear)   < succ>
              bacterial cytoplasm --- Certainty = 0.0000(Not Clear)  < succ>
```

The protein has homology with the following sequences in the GENPEPT database.

```
>GP: AAC95438 GB: AF068901 unknown [Streptococcus pneumoniae]
Identities = 80/214 (37%), Positives = 122/214 (56%),
Gaps = 3/214 (1%)

Query:    4 FFSNIRTEIPQMPLLIHSLILSVLPFLMWLTLVNRDKPLYKTIWSILLGLQLITIYTWFF   63
            FF+   T+ P+  L +   + ++L     +    R+K +Y+  +  IL  +QLI +Y W++
Sbjct:    7 FFTTQATKPPKFDLFWYVSLFTLLALTFYTAHRYREKKVYQRFFQILQTVQLILLYGWYW   66

Query:   64 WAKLPLSESLPLYHCRIGMFVVLLARPGI--LKDYFALLGVVGGVLAMIHPDFYPYQFLH  121
            +PLSESLP YHCR+ MFVVLL  PG    K YFALLG  G + A ++P    Y F H
Sbjct:   67 VNHMPLSESLPFYHCRMAMFVVLLL-PGQSKYKQYFALLGTFGTLAAFVYPVPDAYPFPH  125

Query:  122 VTNIFFFIGHFALFVLSLLHLMTQSNLDKLNPKLIIQLTLLINMSLIFINLLTGGNYGFM  181
            +T + F  GH AL   SL++L+ Q N    L+ K I  +T  +N +   +NL+TGG+YGF+
Sbjct:  126 ITILSFIFGHLALLGNSLVYLLRQYNARLLDVKGIFLMTFALNALIFVVNLVTGGDYGFL  185

Query:  182 MKTPILGITNPFLNLFIVTTLLSFLVLFVKQIFQ                           215
            K P++G     N  +V+ +L   +   K+I +
Sbjct:  186 TKPPLVGDHGLVANYLLVSIVLVATISLTKKILE                           219
```

A related DNA sequence was identified in *S. pyogenes* <SEQ ID 6809> which encodes the amino acid sequence <SEQ ID 6810>. Analysis of this protein sequence reveals the following:

```
Possible site: 35
>>> Seems to have no N-terminal signal sequence
    INTEGRAL      Likelihood = -11.25   Transmembrane      16-32  (11-39)
    INTEGRAL      Likelihood = -3.45    Transmembrane     154-170 (153-173)
    INTEGRAL      Likelihood = -3.08    Transmembrane      96-112 (94-112)
    INTEGRAL      Likelihood = -1.91    Transmembrane     191-207 (191-209)
    INTEGRAL      Likelihood = -1.12    Transmembrane      71-87  (71-87)

----- Final Results -----
              bacterial membrane --- Certainty = 0.5501(Affirmative) < succ>
              bacterial outside  --- Certainty = 0.0000(Not Clear)   < succ>
              bacterial cytoplasm --- Certainty = 0.0000(Not Clear)  < succ>
```

The protein has homology with the following sequences in the databases:

```
>GP: AAC95438 GB: AF068901 unknown [Streptococcus pneumoniae]
Identities = 90/231 (38%), Positives = 128/231 (54%),
Gaps = 7/231 (3%)

Query:    3 FFAIDPIGLPHTSLIFYLSSLLIALLLVFLTFQAYRLKS-HRYFFLFLQLSQVIGLYTWY   61
            FF        P  L +Y+S L    L L F T     YR K  ++ FF  LQ  Q+I LY WY
Sbjct:    7 FFTTQATKPPKFDLFWYVS-LFTLLALTFYTAHRYREKKVYQRFFQILQTVQLILLYGWY   65

Query:   62 VLRGFPLDEALPLYHCRIAMLAIFFLPDRNKFKQLFMVLGIGGTFLALL--SPDLYPFRL  119
            +    PL E+LP YHCR+AM   +  LP ++K+KQ F +LG  GT  A +    PD YPF
Sbjct:   66 WVNHMPLSESLPFYHCRMAMFVVLLLPGQSKYKQYFALLGTFGTLAAFVYPVPDAYPFP-  124

Query:  120 WHVANVSFYFGHYALLVNGLIYLLRFYDASQLRLLSVVRYLATVNFLLLLVSLATKGNYG  179
            H+ +SF FGH ALL N L+YLLR Y+A   L +    +N L+ +V+L T G+YG
Sbjct:  125 -HITILSFIFGHLALLGNSLVYLLRQYNARLLDVKGIFLMTFALNALIFVVNLVTGGDYG  183
```

```
                                 -continued
Query: 180 FVMDIPVIHTRHLLLNFVIVTSGLTFMVKITEYFYLKFGEAQQLALAFSKE        230
           F+   P++    L+ N+++V+  L   + +T+   L+F AQ+       KE
Sbjct: 184 FLTKPPLVGDHGLVANYLLVSIVLVATISLTKKI-LEFFLAQEAEKMIVKE        233
```

An alignment of the GAS and GBS proteins is shown below.

```
Identities = 70/216 (32%), Positives = 117/216 (53%),
Gaps = 1/216 (0%)

Query:   2 IEFFSNIRTEIPQMPLLIHSLILSVLPFLMWLTLVNRDKPLYKTIWSILLGLQLITIYTW    61
           ++FF+     +P  L+ +   L +   L++LT         ++  +  L    Q+I +YTW
Sbjct:   1 MDFFAIDPIGLPHTSLIFYLSSLLIALLLVFLTFQAYRLKSHRYFFLFLQLSQVIGLYTW    60

Query:  62 FFWAKLPLSESLPLYHCRIGMFVVL-LARPGILKDYFALLGVVGGVLAMIHPDFYPYQFL   120
           +      PL E+LPLYHCRI M + L         K  F +LG+  G  LA++ PD YP++
Sbjct:  61 YVLRGFPLDEALPLYHCRIAMLAIFFLPDRNKFKQLFMVLGIGGTFLALLSPDLYPFRLW   120

Query: 121 HVTNIFFFIGHFALFVLSLLHLMTQSNLDKLNPKLIIQLTLLINMSLIFINLLTGGNYGF   180
              HV N+ F+ GH+AL V  L++L+  +  +L  +++   +N  L+ ++L T GNYGF
Sbjct: 121 HVANVSFYFGHYALLVNGLIYLLRFYDASQLRLLSVVRYLATVNFLLLLVSLATKGNYGF   180

Query: 181 MMKTPILGITNPFLNLFIVTTLLSFLVLFVKQIFQK                          216
           +M  P++   +  LN  IVT+ L+F+V   +  K
Sbjct: 181 VMDIPVIHTRHLLLNFVIVTSGLTFMVKITEYFYLK                          216
```

Based on this analysis, it was predicted that these proteins and their epitopes could be useful antigens for vaccines or diagnostics.

EXAMPLE 2206

A DNA sequence (GBSx2325) was identified in *S. agalactiae* <SEQ ID 6811> which encodes the amino acid sequence <SEQ ID 6812>. Analysis of this protein sequence reveals the following:

```
Possible site: 13
>>> Seems to have no N-terminal signal sequence

----- Final Results -----
           bacterial cytoplasm --- Certainty = 0.3297(Affirmative) < succ>
            bacterial membrane --- Certainty = 0.0000(Not Clear)   < succ>
             bacterial outside --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 2207

A DNA sequence (GBSx2326) was identified in *S. agalactiae* <SEQ ID 6813> which encodes the amino acid sequence <SEQ ID 6814>. This protein is predicted to be oxalate: formate antiporter (oxIT-2). Analysis of this protein sequence reveals the following:

```
Possible site: 27
>>> Seems to have a cleavable N-term signal seq.
    INTEGRAL    Likelihood = -7.80    Transmembrane   380-396  (376-399)
    INTEGRAL    Likelihood = -7.43    Transmembrane   291-307  (284-310)
    INTEGRAL    Likelihood = -5.63    Transmembrane   169-185  (163-186)
    INTEGRAL    Likelihood = -4.99    Transmembrane   226-242  (223-245)
    INTEGRAL    Likelihood = -4.19    Transmembrane    46-62    (39-63)
    INTEGRAL    Likelihood = -4.09    Transmembrane   311-327  (308-329)
    INTEGRAL    Likelihood = -1.49    Transmembrane   261-277  (260-278)
```

```
         INTEGRAL     Likelihood = -1.06    Transmembrane    133-149  (133-150)
         INTEGRAL     Likelihood = -0.85    Transmembrane     98-114   (98-114)
         INTEGRAL     Likelihood = -0.06    Transmembrane     77-93    (77-93)

----- Final Results -----
             bacterial membrane --- Certainty = 0.4121(Affirmative) < succ>
             bacterial outside  --- Certainty = 0.0000(Not Clear)   < succ>
           bacterial cytoplasm  --- Certainty = 0.0000(Not Clear)   < succ>
```

The protein has homology with the following sequences in the GENPEPT database.

```
>GP: AAF36228 GB: AF168363 oxalate: formate antiporter [Lactococcus
          lactis]
Identities = 220/398 (55%), Positives = 306/398 (76%), Gaps = 3/398 (0%)
Query:   5 NRYVVAVSGVVLHLMLGSTYAWSVFRNPIISETGWDISSVSFAFSLAIFCLGMSAAFMGH   64
           NRYVVA +GV+ HLM+GS YAWSVF NPI  + GW  SSV+ AFS+AI+ LGMSAAFMG
Sbjct:   4 NRYVVAFAGVMFHLMIGSVYAWSVFTNPIAKQNGWAESSVALAFSIAIYFLGMSAAFMGK   63

Query:  65 LVERFGPRIMGMISAILYGAGNVLTGLAIETQQLWLLYVAYGILGGIGLGSGYITPVSTI  124
           +VE+ GPR+ G I++ LYG G ++TG AI     +WLLY++YG++GG+GLG+GY+TPVSTI
Sbjct:  64 VVEKIGPRLTGTIASFLYGTGTIMTGWAIHQNSIWLLYLSYGVIGGLGLGAGYVTPVSTI  123

Query: 125 IKWFPDRRGLATGFAIMGFGFASLVTSPLAQSLMIRIGVGKTFYILGLVYFFVMMIASQF  184
           IKWFPD+RGLATG AINGFGFA+++T P+AQ LM +G+ +TFY+LG  YF +M++A+QF
Sbjct: 124 IKWFPDKRGLATGLAIMGFGFAAMLTGPVAQQLMASVGLEQTFYLLGTFYFVIMLLAAQF  183

Query: 185 IKQPPQEKITILTHDGKKNAMNSQIITG--LKANAAIKSKTFYIIWLTLFINISCGLGLI  242
           I + P  ++  T +      +++  G   L AN A+K+K+F  +W+  FINI+CG+GL+
Sbjct: 184 IVR-PNLALSSTTENSISQKKGTRLTRGPELTANQALKTKSFTFLWIMFFINITCGIGLV  242

Query: 243 SAASPMAQDLAGYSAESAALLVGVLGIFNGFGRLLWASLSDYIGRPLTFIILFIVNFIMT  302
           SAASPMAQ + G S ++AA++VG++G+FNGFGRL+WA+LSDYIGRP TF  +FI++ +M
Sbjct: 243 SAASPMAQSMTGMSVQTAAIMVGIIGLFNGFGRLIWATLSDYIGRPATFSAIFILDIVML  302

Query: 303 SSLFLSFNAIVFAIAMSILMTCYGAGFSLLPAYLSDIFGTKELATLHGYSLTAWAIAGLF  362
           S++ +    ++F IA+ +LM+CYGAGFS++PAYL D+FGTKEL  +HGY LTAWA AG+
Sbjct: 303 SAILIFKLPLLFVIALCLLMSCYGAGFSVIPAYLGDVFGTKELGAVHGYVLTAWAAAGVV  362

Query: 363 GPLLLSKTYSWGNSYQLTLMVFGFLFLFGLLLSLYLRK                        400
           GPLLLS T+   ++Y LTL  F + L  LL+S ++++
Sbjct: 363 GPLLLSLTHQLFHNYTLTLAAFILIDLLALLISFWIQR                        400
```

A related DNA sequence was identified in *S. pyogenes* <SEQ ID 6815> which encodes the amino acid sequence 40 <SEQ ID 6816>. Analysis of this protein sequence reveals the following:

```
Possible site: 27
>>> Seems to have a cleavable N-term signal seq.
         INTEGRAL     Likelihood = -12.95   Transmembrane    289-305  (282-321)
         INTEGRAL     Likelihood = -11.83   Transmembrane    376-392  (372-397)
         INTEGRAL     Likelihood =  -8.55   Transmembrane    163-179  (160-189)
         INTEGRAL     Likelihood =  -7.75   Transmembrane    227-243  (221-247)
         INTEGRAL     Likelihood =  -5.89   Transmembrane     44-60    (41-67)
         INTEGRAL     Likelihood =  -1.38   Transmembrane    310-326  (309-327)
         INTEGRAL     Likelihood =  -0.90   Transmembrane    353-369  (353-369)
         INTEGRAL     Likelihood =  -0.37   Transmembrane    138-154  (138-154)
         INTEGRAL     Likelihood =  -0.06   Transmembrane     98-114   (98-114)
         INTEGRAL     Likelihood =  -0.00   Transmembrane    259-275  (259-275)

----- Final Results -----
             bacterial membrane --- Certainty = 0.6180(Affirmative) < succ>
             bacterial outside  --- Certainty = 0.0000(Not Clear)   < succ>
           bacterial cytoplasm  --- Certainty = 0.0000(Not Clear)   < succ>
```

The protein has homology with the following sequences in the databases:

```
>GP: AAF36228 GB: AF168363 oxalate: formate antiporter [Lactococcus
          lactis]
Identities = 222/399 (55%), Positives = 305/399 (75%), Gaps = 3/399 (0%)
```

```
                          -continued
Query:   3 KTKRYIIATAGILLHLMLGSTYAWSVYRNPILQETGWDQAPVAFAFSLAIFCLGLSAAFM   62
           KT RY++A AG++ HLM+GS YAWSV+ NPI ++ GW ++ VA AFS+AI+ LG+SAAFM
Sbjct:   2 KTNRYVVAFAGVMFHLMIGSVYAWSVFTNPIAKQNGWAESSVALAFSIAIYFLGMSAAFM   61

Query:  63 GNLVEQYGPRLTGTVSAILYASGNMLTGLAIDRKEIWLLYIGYGVIGGLGLGAGYITPIS  122
           G +VE+ GPRLTGT+++ LY +G ++TG AI +  IWLLY+ YGVIGGLGLGAGY+TP+S
Sbjct:  62 GKVVEKIGPRLTGTIASFLYGTGTIMTGWAIHQNSIWLLYLSYGVIGGLGLGAGYVTPVS  121

Query: 123 TIIKWFPDKRGMATGFAIMGFGFASLLTSPIAQWLIETEGLVATFYLLGLIYLIVMLFAS  182
           TIIKWFPDKRG+ATG AIMGFGFA++LT P+AQ L+ + GL   TFYLLG  Y ++ML A+
Sbjct: 122 TIIKWFPDKRGLATGLAIMGFGFAAMLTGPVAQQLMASVGLEQTFYLLGTFYFVIMLLAA  181

Query: 183 QLIIKPTAAEIAILDKKRLQ-NNSYLIEG--MTAKEALKTKSFYCLWVILFINITCGLGL  239
           Q I++P A + +      Q    + L  G  +TA +ALKTKSF  LW++ FINITCG+GL
Sbjct: 182 QFIVRPNLALSSTTENSISQKKGTRLTRGPELTANQALKTKSFTFLWIMFFINITCGIGL  241

Query: 240 ISVVAPMAQDLTGMSPEMSAIVVGAMGIFNGFGRLVWASLSDYIGRRVTVILLFLVSIIM  299
           +S  +PMAQ +TGMS + +AI+VG +G+FNGFGRL+WA+LSDYIGR  T     F++I+M
Sbjct: 242 VSAASPMAQSMTGMSVQTAAIMVGIIGLFNGFGRLIWATLSDYIGRPATFSAIFILDIVM  301

Query: 300 TISLIFAHSSLIFMISIATLMTCYGAGFSLIPPYLSDLFGAKELATLHGYILTAWAIAAL  359
             +++       L+F+I++  LM+CYGAGFS+IP YL D+FG KEL  +HGY+LTAWA A +
Sbjct: 302 LSAILIFKLPLLFVIALCLLMSCYGAGFSVIPAYLGDVFGTKELGAVHGYVLTAWAAAGV  361

Query: 360 TGPMLLSITVEWTHNYLLTLCVFIVLYILGLMVALRLKK                      398
             GP+LLS+T +  HNY LTL  FI++ +L L+++   +++
Sbjct: 362 VGPLLLSLTHQLFHNYTLTLAAFILIDLLALLISFWIQR                      400
```

An alignment of the GAS and GBS proteins is shown below.

```
Identities = 252/400 (63%), Positives = 329/400 (82%), Gaps = 2/400 (0%)
Query:   1 MKNLNRYVVAVSGVVLHLMLGSTYAWSVFRNPIISETGWDISSVSFAFSLAIFCLGMSAA    60
           M+   RY++A +G++LHLMLGSTYAWSV+RNPI+ ETGWD  V+FAFSLAIFCLG+SAA
Sbjct:   1 MEKTKRYIIATAGILLHLMLGSTYAWSVYRNPILQETGWDQAPVAFAFSLAIFCLGLSAA    60

Query:  61 FMGHLVERFGPRIMGMISAILYGAGNVLTGLAIETQQLWLLYVAYGILGGIGLGSGYITP   120
           FMG+LVE++GPR+ G +SA1LY +GN+LTGLAI+ +++WLLY+ YG++GG+GLG+GYITP
Sbjct:  61 FMGNLVEQYGPRLTGTVSAILYASGNMLTGLAIDRKEIWLLYIGYGVIGGLGLGAGYITP   120

Query: 121 VSTIIKWFPDRRGLATGFAIMGFGFASLVTSPLAQSLMIRIGVGKTFYILGLVYFFVMMI   180
           +STIIKWFPD+RG+ATGFAIMGFGFASL+TSP+AQ L+     G+  TFY+LGL+Y  VM+
Sbjct: 121 ISTIIKWFPDKRGMATGFAIMGFGFASLLTSPIAQWLIETEGLVATFYLLGLIYLIVMLF   180

Query: 181 ASQFIKQPPQEKITILTHDGKKNAMNSQIITGLKANAAIKSKTFYIIWLTLFINISCGLG   240
           ASQ  I +P +  +I IL  D K+   NS +I G+ A A+K+KFY +W+ LFINI+CGLG
Sbjct: 181 ASQLIIKPTAAEIAIL--DKKRLQNNSYLIEGMTAKEALKTKSFYCLWVILFINITCGLG   238

Query: 241 LISAASPMAQDLAGYSAESAALLVGVLGIFNGFGRLLWASLSDYIGRPLTFIILFIVNFI   300
           LIS  +PMAQDL G S E +A++VG +GIFNGFGRL+WASLSDYIGR +T I+LF+V+ I
Sbjct: 239 LISVVAPMAQDLTGMSPEMSAIVVGAMGIFNGFGRLVWASLSDYIGRRVTVILLFLVSII   298

Query: 301 MTSSLFLSFNAIVFAIAMSILMTCYGAGFSLLPAYLSDIFGTKELATLHGYSLTAWAIAG   360
           MT SL + ++++F I+++  LMTCYGAGFSL+P YLSD+FG KELATLHGY LTAWAIA
Sbjct: 299 MTISLIFAHSSLIFMISIATLMTCYGAGFSLIPPYLSDLFGAKELATLHGYILTAWAIAA   358

Query: 361 LFGPLLLSKTYSWGNSYQLTLMVFGFLFLFGLLLSLYLRK                      400
           L GP+LLS T W ++Y LTL VF  L++ GL+++L +K
Sbjct: 359 LTGPMLLSITVEWTHNYLLTLCVFIVLYILGLMVALRLKK                      398
```

A related GBS gene <SEQ ID 8995> and protein <SEQ ID 8996> were also identified. Analysis of this protein sequence reveals the following:

```
Lipop: Possible site: -1 Crend: 5
McG: Discrim Score: 5.06
GvH: Signal Score (-7.5): 4.38
Possible site: 27
>>> Seems to have a cleavable N-term signal seq.
ALOM program count: 10 value: -7.80 threshold: 0.0
    INTEGRAL      Likelihood = -7.80    Transmembrane   380-396  (376-399)
    INTEGRAL      Likelihood = -7.43    Transmembrane   291-307  (284-310)
    INTEGRAL      Likelihood = -5.63    Transmembrane   169-185  (163-186)
    INTEGRAL      Likelihood = -4.99    Transmembrane   226-242  (223-245)
    INTEGRAL      Likelihood = -4.19    Transmembrane    46-62    (39-63)
    INTEGRAL      Likelihood = -4.09    Transmembrane   311-327  (308-329)
```

```
                               -continued
    INTEGRAL       Likelihood = -1.49    Transmembrane     261-277   (260-278)
    INTEGRAL       Likelihood = -1.06    Transmembrane     133-149   (133-150)
    INTEGRAL       Likelihood = -0.85    Transmembrane      98-114    (98-114)
    INTEGRAL       Likelihood = -0.06    Transmembrane      77-93     (77-93)
    PERIPHERAL     Likelihood = -0.42         352
modified ALOM score: 2.06

*** Reasoning Step: 3

----- Final Results -----
             bacterial membrane --- Certainty = 0.4121(Affirmative) < succ>
             bacterial outside  --- Certainty = 0.0000(Not Clear)   < succ>
           bacterial cytoplasm  --- Certainty = 0.0000(Not Clear)   < succ>
```

The protein has homology with the following sequences in the databases:

```
ORF02272(313-1500 of 1818)
GP|7107009|gb|AAF36228.1|AF168363_4|AF168363(4-400 of 421)oxalate:formate
antiporter{Lactococcus lactis}
% Match = 38.5
% Identity = 55.4  % Similarity = 79.1
Matches = 220  Mismatches = 81  Conservative Sub.s = 94
    216       246       276       306       336       366       396       426
GK*IC*AENW*YIQFFDNLFITNYIFKNKT*VRF*EDCLKNLNRYVVAVSGVVLHLMLGSTYAWSVFRNPIISETGWDIS
                                 ||||||  :||::|||:||  ||||||  |||    :  ||   |
                                 MKTNRYVVAFAGVMFHLMIGSVYAWSVFTNPIAKQNGWAES
                                    10        20        30        40
    456       486       516       546       576       606       636       666
SVSFAFSLAIFCLGMSAAFMGHLVERFGPRIMGMISAILYGAGNVLTGLAIETQQLWLLYVAYGILGGIGLGSGYITPVS
||::|||:||: |||||||||  :|:  |||:  |  ||| :||:| ||       :|||||||::||:||||:|:|||
SVALAFSIAIYFLGMSAAFMGKVVEKIGPRLTGTIASFLYGTGTIMTGWAIHQNSIWLLYLSYGVIGGLGLGAGYVTPVS
        60        70        80        90       100       110       120
    696       726       756       786       816       846       876       906
TIIKWFPDRRGLATGFAIMGFGFASLVTSPLAQSLMIRIGVGKTFYILGLVYFEVMMIASQFIKQPPQEKITILTHDGKK
|||||||:||||||:||||||||  |:||  |:||  ||   :|: :|||:||  || :|::::|||  ::    |  :
TIIKWFPDKRGLATGLAIMGFGFAAMLTGPVAQQLMASVGLEQTFYLLGTFYFVIMLLAAQFIVRP-NLALSSTTENSIS
       140       150       160       170       180       190       200
    936       960       990      1020      1050      1080      1110      1140
NAMNSQIITG--LKANAAIKSKTFYIIWLTLFINISCGLGLISAASPMAQDLAGYSAESAALLVGVLGIFNGFGRLLWAS
 :::    |   | ||  |:|:|:|   :|:  |||||:||:||:|||||| :  | |  ::||::||::|||||||::
QKKGTRLTRGPELTANQALKTKSFTFLWIMFFINITCGIGLVSAASPMAQSMTGMSVQTAAIMVGIIGLFNGFGRLIWAT
         210       220       230       240       250       260       270       280
   1170      1200      1230      1260      1290      1320      1350      1380
LSDYIGRPLTFIILFIVNFIMTSSLFLSFNAIVFAIAMSILMTCYGAGFSLLPAYLSDIFGTKELATLHGYSLTAWAIAG
||||||||  |  ||::: ||:: :|| ::  :  ||:|:|||||||||:||||||  ||||||:||:| :|||| | |
LSDYIGRPATFSAIFILDIVMLSAILIFKLPLLFVIALCLLMSCYGAGFSVIPAYLGDVFGTKELGAVHGYVLTAWAAAG
         290       300       310       320       330       340       350       360
   1410      1440      1470      1500      1530      1560      1590      1620
LFGPLLLSKTYSWGNSYQLTLMVFGFLFLGLLLSLYLRKLTTKVV*YISNLKFFGPTKEFFL*KIVLSYSK*FDILSI*
: ||||||  |:     ::||| |    ||| |:  ||:|:::::
VVGPLLLSLTHQLFHNYTLTLAAFILIDLLALLISFWIQRDFIKASKLIKKQIIKNYFKAH
         370       380       390       400       410       420
```

Based on this analysis, it was predicted that these proteins and their epitopes could be useful antigens for vaccines or diagnostics.

EXAMPLE 2208

A DNA sequence (GBSx2327) was identified in *S. agalactiae* <SEQ ID 6817> which encodes the amino acid sequence <SEQ ID 6818>. This protein is predicted to be D-Ala-D-Ala adding enzyme (murF). Analysis of this protein sequence reveals the following:

```
Possible site: 45
>>> Seems to have no N-terminal signal sequence

----- Final Results -----
             bacterial cytoplasm --- Certainty = 0.1311(Affirmative) < succ>
             bacterial membrane  --- Certainty = 0.0000(Not Clear)   < succ>
             bacterial outside   --- Certainty = 0.0000(Not Clear)   < succ>
```

A related GBS nucleic acid sequence <SEQ ID 9739> which encodes amino acid sequence <SEQ ID 9740> was also identified.

The protein has homology with the following sequences in the GENPEPT database.

```
>GP: AAC95436 GB: AF068901 D-Ala-D-Ala adding
enzyme [Streptococcus pneumoniae]
Identities = 313/453 (69%), Positives = 375/453 (82%)

Query:   32 MKLSLHEVAKVVGAKNQVSEFEDVPLGNIEFDSRNISEGDLFLPLKGARDGHEFIEMAFD   91
            MKL++HE+A+VVGAKN +S FED  L   EFDSR I  GDLF+PLKGARDGH+FIE AF+
Sbjct:    1 MKLTIHEIAQVVGAKNDISIFEDTQLEKAEFDSRLIGTGDLFVPLKGARDGHDFIETAFE   60

Query:   92 NGAIATISEKEIEGHPYLLVSDALKAFQVLAQYYIEKMNVDVIAVTGSNGKTTTKDMIAA  151
            NGA  T+SEKE+  HPY+LV D L AFQ LA YY+EK  VDV AVTGSNGKTTTKDM A
Sbjct:   61 NGAAVTLSEKEVSNHPYILVDDVLTAFQSLASYYLEKTTVDVFAVTGSNGKTTTKDMLAH  120

Query:  152 ILSTTYKTYKTQGNYNNEIGLPYTVLHMPEDTEKIILEMGQDHLGDIHVLSEIAKPRIAV  211
            +LST YKTYKTQGNYNNEIGLPYTVLHMPE TEK++LEMGQDHLGDIH+LSE+A+P+ A+
Sbjct:  121 LLSTRYKTYKTQGNYNNEIGLPYTVLHMPEGTEKLVLEMGQDHLGDIHLLSELARPKTAI  180

Query:  212 VTLIGEAHLEFFGSREKIAEGKMQITDGMSSDGILIAPGDPIIDPYLPANQMTIRFGHDQ  271
            VTL+GEAHL FF  R +IA+GKMQI DGM+S  +L+AP DPI++ YLP ++  +RFG  
Sbjct:  181 VTLVGEAHLAFFKDRSEIAKGKMQIADGMASGSLLLAPADPIVEDYLPTDKKVVRFGQGA  240

Query:  272 ELQVTELKEEKHSLTFKTNALEHQLRIPVPGKYNATNAMVAAYVGKLLAVAEEDIVDALE  331
            EL++T+L E K SLTFK N LE  L +PV GKYNATNAM+A+YV    V+EE I  A +
Sbjct:  241 ELEITDLVERKDSLTFKANFLEQVLDLPVTGKYNATNAMIASYVALQEGVSEEQIHQAFQ  300

Query:  332 NLQLTRNRTEWKKSANGADILSDVYNANPTAMRLILETFSAIPNNDGGKKIALLADMKEL  391
            +L+LTRNRTEWKK+ANGADILSDVYNANPTAM+LILETFSAIP N+GGKKIA+LADMKEL
Sbjct:  301 DLELTRNRTEWKKAANGADILSDVYNANPTAMKLILETFSAIPANEGGKKIAVLADMKEL  360

Query:  392 GEQSVDLHNQMIMSIRPDSIDTLICYGQDIEGLAQLASQMFPIGKVYFFKKNQEVDQFDQ  451
            G QSV LHNQMI+S+ PD +DT+I YG+DI  LAQLASQMFPIG VY+FKK ++ DQF+
Sbjct:  361 GNQSVQLHNQMILSLSPDVLDTVIFYGEDIAELAQLASQMFPIGHVYYFKKTEDQDQFED  420

Query:  452 LLAKVKDTLKEKDQILLKGSNSMNLSKIVDILE                            484
            L+ +VK++L  DQILLKGSNSMNL+ +V+ LE
Sbjct:  421 LVKQVKESLSANDQILLKGSNSMNLAMLVESLE                             453
```

A related DNA sequence was identified in *S. pyogenes* <SEQ ID 6819> which encodes the amino acid sequence <SEQ ID 6820>. Analysis of this protein sequence reveals the following:

```
Possible site: 14
>>> Seems to have no N-terminal signal sequence

----- Final Results -----
             bacterial cytoplasm --- Certainty = 0.3299(Affirmative) < succ>
             bacterial membrane  --- Certainty = 0.0000(Not Clear)  < succ>
              bacterial outside  --- Certainty = 0.0000(Not Clear)  < succ>
```

An alignment of the GAS and GBS proteins is shown below.

```
Identities = 323/452 (71%), Positives = 387/452 (85%)

Query:   32 MKLSLHEVAKVVGAKNQVSEFEDVPLGNIEFDSRNISEGDLFLPLKGARDGHEFIEMAFD   91
            MKL+LHEVAK+V A+N VS+ +DVPL +IEFDSR I++GDLFLPLKG RDGHEFI++AF
Sbjct:    1 MKLTLHEVAKIVDAQNNVSDLDDVPLHHIEFDSRKITKGDLFLPLKGQRDGHEFIDLAFQ   60

Query:   92 NGAIATISEKEIEGHPYLLVSDALKAFQVLAQYYIEKMNVDVIAVTGSNGKTTTKDMIAA  151
            NGA+AT SEKE+ G P+LLV D LKAFQ LA YYI+KM VDVIAVTGSNGKT+TKDMI A
Sbjct:   61 NGAVATFSEKELPGKPHLLVEDCLKAFQKLAHYYIDKMRVDVIAVTGSNGKTSTKDMIGA  120

Query:  152 ILSTTYKTYKTQGNYNNEIGLPYTVLHMPEDTEKIILEMGQDHLGDIHVLSEIAKPRIAV  211
            +LSTTYKTYKTQGNYNNEIGLPYTVLHMP+DTEKI+LEMGQDH+GDI +LSEIA+PRIAV
Sbjct:  121 VLSTTYKTYKTQGNYNNEIGLPYTVLHMPDDTEKIVLEMGQDHMGDIRLLSEIARPRIAV  180

Query:  212 VTLIGEAHLEFFGSREKIAEGKMQITDGMSSDGILIAPGDPIIDPYLPANQMTIRFGHDQ  271
            +TL+GEAHLE+FGSR+KIA+GKMQI DGM+SDGILIAPGDPIIDPYLP NQM IRFG+ Q
Sbjct:  181 LTLVGEAHLEYFGSRDKIAQGKMQIVDGMNSDGILIAPGDPIIDPYLPENQMVIRFGNQQ  240
```

-continued

```
Query:  272 ELQVTELKEEKHSLTFKTNALEHQLRIPVPGKYNATNAMVAAYVGKLLAVAEEDIVDALE  331
            E+ VT ++E+K SLTF TN L   + +P+PGKYNATNAMVAAYVGKLLAV +EDI+ AL+
Sbjct:  241 EIDVTGIQEDKDSLTFTTNVLATPVSLPLPGKYNATNAMVAAYVGKLLAVTDEDIIAALQ  300

Query:  332 NLQLTRNRTEWKKSANGADILSDVYNANPTAMRLILETFSAIPNNDGGKKIALLADMKEL  391
              + LT NRTEWKK+ANGADILSDVYNANPTAMRLILETF+ I  N GGKKIA+LADMKEL
Sbjct:  301 TVTLTGNRTEWKKAANGADILSDVYNANPTAMRLILETFANIAKNPGGKKIAVLADMKEL  360

Query:  392 GEQSVDLHNQMIMSIRPDSIDTLICYGQDIEGLAQLASQMFPIGKVYFFKKNQEVDQFDQ  451
             G+ SV LH+Q+I S+   +ID L+ YG  I+ LA+LASQ++P  +V++F K ++ DQF+
Sbjct:  361 GKDSVILHSQLIDSLTSGNIDQLVFYGDHIKELARLASQVYPAEQVHYFLKTEQEDQFEA  420

Query:  452 LLAKVKDTLKEKDQILLKGSNSMNLSKIVDIL                             483
              +   V++ L   DQILLKGS+SM+L K+VD L
Sbjct:  421 MAQYVQNILNPFDQILLKGSHSMSLEKLVDRL                             452
```

Based on this analysis, it was predicted that these proteins and their epitopes could be useful antigens for vaccines or diagnostics.

EXAMPLE 2209

A DNA sequence (GBSx2328) was identified in *S. agalactiae* <SEQ ID 6821> which encodes the amino acid sequence <SEQ ID 6822>. Analysis of this protein sequence reveals the following:

```
Possible site: 17
>>> Seems to have no N-terminal signal sequence

----- Final Results -----
         bacterial cytoplasm --- Certainty = 0.1381(Affirmative) < succ>
          bacterial membrane --- Certainty = 0.0000(Not Clear)   < succ>
           bacterial outside --- Certainty = 0.0000(Not Clear)   < succ>
```

The protein has homology with the following sequences in the GENPEPT database.

```
>GP: AAC95435 GB: AF068901 D-Ala-D-Ala ligase [Streptococcus pneumoniae]
Identities = 243/346 (70%), Positives = 289/346 (83%)

Query:    3 KETLILLYGGRSAEREVSVLSAESVMRAINYDKFFVKTYFITQVGQFIKTQEFDEMPSSD   62
            K+T+ILLYGGRSAEREVSVLSAESVMRA+NYD+F VKT+FI+Q G FIKTQEF    P +
Sbjct:    2 KQTIILLYGGRSAEREVSVLSAESVMRAVNYDRFTVKTFFISQSGDFIKTQEFSHAPGQE   61

Query:   63 EKLMTNQTVDLDKMVRPSDIYDDNAIVFPVLHGPMGEDGSIQGFLEVLRMPYVGTNILSS  122
            ++LMTN+T+D DK V PS IY++ A+VFPVLHGPMGEDGS+QGFLEVL+MPYVG NILSS
Sbjct:   62 DRLMTNETIDWDKKVAPSAIYEEGAVVFPVLHGPMGEDGSVQGFLEVLKMPYVGCNILSS  121

Query:  123 SVAMDKITTKQVLATVGVPQVAYQTYFEGDDLEHAIKLSLETLSFPIFVKPANMGSSVGI  182
            S+AMDKITTK+VL + G+ QV Y    EGDD+   I     E L++P+F KP+NMGSSVGI
Sbjct:  122 SLAMDKITTKRVLESAGIAQVPYVAIVEGDDVTAKIAEVEEKLAYPVFTKPSNMGSSVGI  181

Query:  183 SKATDESSLRSAIDLALKYDSRILIEQGVTAREIEVGILGNNDVKTTFPGEVVKDVDFYD  242
            SK+ ++   LR A+ LA +YDSR+L+EQGV AREIEVG+LGN DVK+T PGEVVKDV FYD
Sbjct:  182 SKSENQEELRQALKLAFRYDSRVLVEQGVNAREIEVGLLGNYDVKSTLPGEVVKDVAFYD  241

Query:  243 YDAKYIDNKITMDIPAKVDEATMEAMRQYASKAFKAIGACGLSRCDFFLTKDGQIFLNEL  302
            YDAKYIDNKITMDIPAK+ +  + MRQ A  AF+AIG  GLSRCDFF T  G+IFLNEL
Sbjct:  242 YDAKYIDNKITMDIPAKISDDVVAVMRQNAETAFRAIGGLGLSRCDFFYTDKGEIFLNEL  301

Query:  303 NTMPGFTQWSMYPLLWENMGLTYSDLIEKLVMLAKEMFEKRESHLI                348
            NTMPGFTQWSMYPLLW+NMG++Y +LIE+LV LAKE F+KRE+HLI
Sbjct:  302 NTMPGFTQWSMYPLLWDNMGISYPELIERLVDLAKESFDKREAHLI                347
```

A related DNA sequence was identified in *S. pyogenes* <SEQ ID 4559> which encodes the amino acid sequence <SEQ ID 4560>. Analysis of this protein sequence reveals the following:

```
Possible site: 23
>>> Seems to have no N-terminal signal sequence

----- Final Results -----
         bacterial cytoplasm --- Certainty = 0.1451(Affirmative) < succ>
          bacterial membrane --- Certainty = 0.0000(Not Clear)   < succ>
           bacterial outside --- Certainty = 0.0000(Not Clear)   < succ>
```

An alignment of the GAS and GBS proteins is shown below.

```
Identities = 261/348 (75%), Positives = 306/348 (87%)

Query:    1 MSKETLILLYGGRSAEREVSVLSAESVMRAINYDKFFVKTYFITQVGQFIKTQEFDEMPS   60
            MSK+TL+LLYGGRSAEREVSVLSAESVMRA+NYDKF VKTYFITQ+GQFIKTQ+F E PS
Sbjct:    1 MSKQTLVLLYGGRSAEREVSVLSAESVMRAVNYDKFLVKTYFITQMGQFIKTQQFSEKPS   60

Query:   61 SDEKLMTNQTVDLDKMVRPSDIYDDNAIVFPVLHGPMGEDGSIQGFLEVLRMPYVGTNIL  120
            E+LMTN+T++L + ++PSDIY++ A+VFPVLHGPMGEDGSIQGFLEVLRMPY+GTN++
Sbjct:   61 ESERLMTNETIELTQKIKPSDIYEEGAVVFPVLHGPMGEDGSIQGFLEVLRMPYIGTNVM  120

Query:  121 SSSVAMDKITTKQVLATVGVPQVAYQTYFEGDDLEHAIKLSLETLSFPIFVKPANMGSSV  180
            SSS+AMDKITTK+VL ++G+PQVAY  Y +G DLE  +   +L  L+FPIFVKPANMGSSV
Sbjct:  121 SSSIAMDKITTKRVLESIGIPQVAYTVYIDGQDLEACLVETLARLTFPIFVKPANMGSSV  180

Query:  181 GISKATDESSLRSAIDLALKYDSRILIEQGVTAREIEVGILGNNDVKTTFPGEVVKDVDF  240
            GISKA  +  LR AI LAL YDSR+LIEQGV AREIEVG+LGN+ VK+T PGEV+KDVDF
Sbjct:  181 GISKAQTKVELRKAIQLALTYDSRVLIEQGVVAREIEVGLLGNDKVKSTLPGEVIKDVDF  240

Query:  241 YDYDAKYIDNKITMDIPAKVDEATMEAMRQYASKAFKAIGACGLSRCDFFLTKDGQIFLN  300
            YDY AKY+DNKITM IPA VD++ +   MR YA  AFKA+G CGLSRCDFFLT+DGQ++LN
Sbjct:  241 YDYQAKYVDNKITMAIPADVDQSIVTEMRSYAEVAFKALGGCGLSRCDFFLTQDGQVYLN  300

Query:  301 ELNTMPGFTQWSMYPLLWENMGLTYSDLIEKLVMLAKEMFEKRESHLI             348
            ELNTMPGFTQWSMYPLLWENMGL Y DLIE+LV LA+EMF++RESHLI
Sbjct:  301 ELNTMPGFTQWSMYPLLWENMGLAYPDLIEELVTLAQEMFDQRESHLI             348
```

Based on this analysis, it was predicted that these proteins and their epitopes could be useful antigens for vaccines or diagnostics.

EXAMPLE 2210

A DNA sequence (GBSx2329) was identified in *S. agalactiae* <SEQ ID 6823> which encodes the amino acid sequence <SEQ ID 6824>. This protein is predicted to be recombination protein (recR). Analysis of this protein sequence reveals the following:

```
Possible site: 36
>>> Seems to have no N-terminal signal sequence

----- Final Results -----
            bacterial cytoplasm --- Certainty = 0.2540(Affirmative) < succ>
            bacterial membrane  --- Certainty = 0.0000(Not Clear)   < succ>
             bacterial outside  --- Certainty = 0.0000(Not Clear)   < succ>
```

The protein has homology with the following sequences in the GENPEPT database.

```
>GP: AAC44615 GB: U58210 RecM [Streptococcus thermophilus]
Identities = 181/198 (91%), Positives = 189/198 (95%)

Query:    1 MLYPTPIAKLIDSFSKLPGIGTKTATRLAFYTIGMSDEDVNEFAKNLLAAKRELTYCSVC   60
            MLYPTPIAKLIDSFSKLPGIG KTATRLAFYTI MSDEDVN+FAKNLLAAKRELTYCSVC
Sbjct:    1 MLYPTPIAKLIDSFSKLPGIGAKTATRLAFYTISMSDEDVNDFAKNLLAAKRELTYCSVC   60

Query:   61 GNLTDDDPCLICTDKTRDQSVILVVEDSKDVSAMEKIQEYNGLYHVLHGLISPMNGISPD  120
            G LTDDDPC+ICTD+TRD++ ILVVEDSKDVSAMEKIQEY GLYHVL GLISPMNG+ PD
Sbjct:   61 GRLTDDDPCIICTDETRDRTKILVVEDSKDVSAMEKIQEYRGLYHVLQGLISPMNGVGPD  120

Query:  121 DINLKSLITRLMDGQVTEVIVATNATADGEATSMYISRVLKPAGIKVTRLARGLAVGSDI  180
            DINLKSLITRLMD +V EVI+ATNATADGEATSMYISRVLKPAGIKVTRLARGLAVGSDI
Sbjct:  121 DINLKSLITRLMDSEVDEVIIATNATADGEATSMYISRVLKPAGIKVTRLARGLAVGSDI  180

Query:  181 EYADEVTLLRAIENRTEL                                           198
            EYADEVTLLRAIENRTEL
Sbjct:  181 EYADEVTLLRAIENRTEL                                           198
```

A related DNA sequence was identified in *S. pyogenes* <SEQ ID 6825> which encodes the amino acid sequence <SEQ ID 6826>. Analysis of this protein sequence reveals the following:

```
Possible site: 36
>>> Seems to have no N-terminal signal sequence

----- Final Results -----
         bacterial cytoplasm --- Certainty = 0.2652(Affirmative) < succ>
         bacterial membrane  --- Certainty = 0.0000(Not Clear)   < succ>
         bacterial outside   --- Certainty = 0.0000(Not Clear)   < succ>
```

An alignment of the GAS and GBS proteins is shown below.

```
Identities = 180/198 (90%), Positives = 192/198 (96%)

Query:   1 MLYPTPIAKLIDSFSKLPGIGTKTATRLAFYTIGMSDEDVNEFAKNLLAAKRELTYCSVC   60
           +LYPTPIAKLIDS+SKLPGIG KTATRLAFYTIGMS+EDVN+FAKNLLAAKRELTYCS+C
Sbjct:   1 VLYPTPIAKLIDSYSKLPGIGIKTATRLAFYTIGMSNEDVNDFAKNLLAAKRELTYCSIC   60

Query:  61 GNLTDDDPCLICTDKTRDQSVILVVEDSKDVSAMEKIQEYNGLYHVLHGLISPMNGISPD  120
           GNLTDDDPC ICTD +RDQ+ ILVVED+KDVSAMEKIQEY+G YHVLHGLISPMNG+ PD
Sbjct:  61 GNLTDDDPCHICTDTSRDQTTILVVEDAKDVSAMEKIQEYHGYYHVLHGLISPMNGVGPD  120

Query: 121 DINLKSLITRLMDGQVTEVIVATNATADGEATSMYISRVLKPAGIKVTRLARGLAVGSDI  180
           DINLKSLITRLMDG+V+EVIVATNATADGEATSMYISRVLKPAGIKVTRLARGLAVGSDI
Sbjct: 121 DINLKSLITRLMDGKVSEVIVATNATADGEATSMYISRVLKPAGIKVTRLARGLAVGSDI  180

Query: 181 EYADEVTLLRAIENRTEL                                           198
           EYADEVTLLRAIENRTEL
Sbjct: 181 EYADEVTLLRAIENRTEL                                           198
```

Based on this analysis, it was predicted that these proteins and their epitopes could be useful antigens for vaccines or diagnostics.

EXAMPLE 2211

A DNA sequence (GBSx2330) was identified in *S. agalactiae* <SEQ ID 6827> which encodes the amino acid sequence <SEQ ID 6828>. Analysis of this protein sequence reveals the following:

```
Possible site: 23
>>> Seems to have no N-terminal signal sequence

----- Final Results -----
         bacterial cytoplasm --- Certainty = 0.3144(Affirmative) < succ>
         bacterial membrane  --- Certainty = 0.0000(Not Clear)   < succ>
         bacterial outside   --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 2212

A DNA sequence (GBSx2331) was identified in *S. agalactiae* <SEQ ID 6829> which encodes the amino acid sequence <SEQ ID 6830>. This protein is predicted to be penicillin-binding protein 2b. Analysis of this protein sequence reveals the following:

```
Possible site: 52
>>> Seems to have no N-terminal signal sequence
        INTEGRAL    Likelihood = -13.69    Transmembrane    23-39 (17-46)

----- Final Results -----
         bacterial membrane  --- Certainty = 0.6477(Affirmative) < succ>
         bacterial outside   --- Certainty = 0.0000(Not Clear)   < succ>
         bacterial cytoplasm --- Certainty = 0.0000(Not Clear)   < succ>
```

The protein has homology with the following sequences in the GENPEPT database.

```
>GP: AAC44614 GB: U58210 penicillin-binding protein 2b [Streptococcus
thermophilus]
 Identities = 341/683 (49%), Positives = 477/683 (68%), Gaps = 12/683 (1%)
Query:    4 RKKRYRLTVKKQNASIPRRLNLLFFIIVLLFTVLILRLEQMQIGQQSFYMKKLTALTSYT    63
            ++K R    ++  +I RR+ LLF ++ +LF +L  RL  MQ+  +SFY KKL   + YT
Sbjct:   18 KRKEKRANKPRKPVNISRRVYLLFGVVFVLFLLLFARLTYMQVYNKSFYTKKLEDNSKYT    77

Query:   64 VKESKARGQIFDAKGVVLVENDERPTVAFSRGNNISSQSIKELANKLSHYITLTEVASSD   123
            V+ +  RGQIFDAKG+ L  N +  + F+R N +SS ++K +A +L+   +TLTE    +D
Sbjct:   78 VRIASERGQIFDAKGIALTTNQSKDVITFTRSNLVSSDTMKSVAERLATLVTLTETKVTD   137

Query:  124 RAKRDYYLADKANYKKVVESLPDSKRYDKFGNHLAESTVYANAVAAVPVSAINYSEDELK   183
            R KR++YLAD ANYK+VV  LP+ K+ DKFGN LAE+T+Y NA+ AVP A++YSEDELK
Sbjct:  138 RQKREFYLADSANYKRVVNDLPNDKKTDKFGNKLAEATIYNNAINAVPDEAVDYSEDELK   197

Query:  184 VVALFNQMNATPTFGSVKLSTGELSDDQIKKLDADKKELLGISVTSNWHRRKKGTSLSDI   243
            +V +++ MNA   F +V L T +L+ DQI  + A +KEL GI V  +W R      +SLS +
Sbjct:  198 IVYIYSHMNAVSNFSTVILKTADLTPDQIAIVAAKQKELNGIRVAKDWERHTSDSSLSPL   257

Query:  244 LGTISTEKAGLPREEVKKYLKKGYSLNDRVGTSYLEKQYEDDLQGIRQIRKVVVNKKGKV   303
            +G  +S+ +AGLP+E+  K YLKKGY+LNDRVGTSYLEK+YE++LQG   +R++ V+K+GKV
Sbjct:  258 IGRVSSSEAGLPQEDAKDYLKKGYALNDRVGTSYLEKEYEEELQGKHTVREITVDKEGKV   317

Query:  304 VSDNITQEGKSGRNLKLTIDLNYQNKVESILKQYYGSELSSGRASFSEGMYAVAIEPSTG   363
             SD I Q+G  G NLKLTIDL++Q  VE IL Q    SE+S  +A++SEGMYAV +    TG
Sbjct:  318 DSDKIIQKGSKGNNLKLTIDLDFQKGVEDILGQQLSSEISGNKATYSEGMYAVVMNADTG   377

Query:  364 KVLAMAGLKNDHG--NLVDDSLGTIAKNFTPGSVVKGATLSSGWENKVLRGNEVLYDQEI   421
             VLAMAG K++ G  +   D+LGTI    FTPGSVVKGATL++GW +   + G++VL DQ I
Sbjct:  378 AVLAMAGQKHEQGAQDFKADALGTITDVFTPGSVVKGATLTAGWRSGAIYGDQVLTDQPI   437

Query:  422 -----ANIRSWFT-RGLTPISAAQALEYSSNTYMVQVALRLMGQDYNTGDALTDRGYQEA   475
                  + I SWFT +G    I+A QALEYSSNTYMVQ+A++  GQ Y  G +L+    ++A
Sbjct:  438 NIASSPPITSWFTDKGSRAITATQALEYSSNTYMVQIAIKRLGQQYVPGMSLSTDNMEKA   497

Query:  476 MAKLRKTYGEYGLGVSTGLDLP-ESEGYVPGKYSLGTTLMESFGQYDAYTPMQLGQYIST   534
            M  LR TY E+G+GVSTGLDLP ESEGY+P  Y++    L E+FGQYD+YT  QL QY+++
Sbjct:  498 MTTLRDTYAEFGMGVSTGLDLPGESEGYIPKNYNVANVLTEAFGQYDSYTTIQLAQYVAS   557

Query:  535 IANNGNRLAPHVVSDIYEGNDSNKFAQLVRSITPKTLNKIAISDQELAIIQEGFYNVVNS   594
            IAN G R+APH+V  IY+       L ++  + LNK+++  ++L IIQ+GF++VVNS
Sbjct:  558 IANGGKRVAPHIVGGIYDAGKNGSLGTLSSTVDTRVLNKLSDSKQLGIIQQGFHDVVNS   617

Query:  595 GSGYATGTSMRGNVTTISGKTGTAETFAKNVNGQTVSTYNLNAIAYDTNR---KIAVAVM   651
            GS  ATG +M  ++   ISGKTGTAET+A +  G +V+T NLNA+AY T +     K+AV +M
Sbjct:  618 GSSLATGKAMASSIIPISGKTGTAETYATDGSGNSVTTVNLNAVAYATAKDGTKLAVGIM   677

Query:  652 YPHVTTDTTKSHQLVARDMIDQY                                       674
            YPH     +K+HQ  + +++ Y
Sbjct:  678 YPHALDWKSKAHQNAVKAIMELY                                       700
```

45

A related GBS gene <SEQ ID 8997> and protein <SEQ ID 8998> were also identified. Analysis of this protein sequence reveals the following:

```
Lipop Possible site: -1 Crend: 8
McG: Discrim Score: -12.38
GvH: Signal Score (-7.5): -5.9
     Possible site: 35
>>> Seems to have no N-terminal signal sequence
ALOM program count: 1 value: -12.42 threshold: 0.0
     INTEGRAL       Likelihood = -12.42    Transmembrane    23-39  (18-46)
     PERIPHERAL     Likelihood =  4.56         355
modified ALOM score: 2.98

*** Reasoning Step: 3

----- Final Results -----
            bacterial membrane --- Certainty = 0.5967(Affirmative) < succ>
            bacterial outside  --- Certainty = 0.0000(Not Clear) < succ>
            bacterial cytoplasm --- Certainty = 0.0000(Not Clear) < succ>
```

The protein has homology with the following sequences in the databases:

```
50.5/71.3% over 683aa
Streptococcus thermophilus
GP|1685112|penicillin-binding protein 2B Insert characterized ORF02276(307-2322 of 2643)
GP|1685112|gb|AAC44614.1||U58210(17-700 of 704)penicillin-binding protein 2b
{Streptococcus thermophilus}
% Match = 38.5
% Identity = 50.4  % Similarity = 71.2
Matches = 342  Mismatches = 189  Conservative Sub.s = 141
       108       138       168       198       228       258       288       318
NHGR*NS*LPTTCFRI**KIKPCFRILLR*II*SLYKKFRPSWLEFFIIYNILSVCKKPFL*YNSSQSFYSKELMLNRKK
                                                                 :   ::    :   ::|
                                                                 MTSFWEKNSQKWKKWRQKRK
                                                                         10        20
       348       378       408       438       468       498       528       558
RYRLTVKKQNASIPRRLNLLFFIIXLLFTVLILRLEQMQIGQQSFYMKKLTALTSYTVKESKARGQIFDAKGVVLVENDE
   |    ::    :|  ||:  |||   ::  :||   :|   ||   ||:    :|||  |||    :   |||:  :  |||||||||:  |    |
EKRANKPRKPVNISRRVYLLFGVVFVFLLLFARLTYMQVYNKSFYTKKALEDNSKYTVRIASERGQIFDAKGIALTTNQS
         30        40        50        60        70        80        90       100
       588       618       648       678       708       738       768       798
RPTVAFSRGNNISSQSIKELANKLSHYITLTEVASSDRAKRDYYLADKANYKKVVESLPDSKRYDKFGNHLAESTVYANA
 :|:|     :||     :|:      ::|     :|:  :||||       :||    ||||||   ||:    ||      :|:|  ||
KDVITFTRSNLVSSDTMKSVAERLATLVTLTETKVTDRQKREFYLADSANYKRVVNDLPNDKKTDKFGNKLAEATIYNNA
        110       120       130       140       150       160       170       180
       828       858       888       918       948       978      1008      1038
VAAVPVSAINYSEDELKVVALFNQMNATPTFGSVKLSTGELSDDQIKKLDADKKELLGISVTSNWHRRKKGTSLSDILGT
:  |||   |::||||||||:|  ::::|||       |  :|   |   :|   :|||     :   |  :|||   ||    :|   :|||   ::|
INAVPDEAVDYSEDELKIVYIYSHMNAVSNFSTVILKTADLTPDQIAIVAAKQKELNGIRVAKDWERHTSDSSLSPLIGR
        190       200       210       220       230       240       250       260
      1068      1098      1128      1158      1188      1218      1248      1278
ISTEKAGLPREEVKKYLKKGYSLNDRVGTSYLEKQYEDDLQGIRQIRKVVVNKKGKVVSDNITQEGKSGRNLKLTIDLNY
:|:  :||||:|:  |      |||||||||||||||||:|::|||    :|  |:|   |:  |:    |  |:|  ||:|      ||
VSSSEAGLPQEDAKDYLKKGYALNDRVGTSYLEKEYEEELQGKHTVREITVDKEGKVDSDKIIQKGSKGNNLKLTIDLDF
        270       280       290       300       310       320       330       340
      1308      1338      1368      1398      1428      1452      1482      1512
QNKVESILKQYYGSELSSGRASFSEGMYAVAIEPSTGKVLAMAGLKNDHG--NLVDDSLGTIAKNFTPGSVVKGATLSSG
|   ||  ||   ||:|    :|::|||||||    ||   |||||||  |::|  ::   :|||||   |||||||||||::|
QKGVEDILGQQLSSEISGNKATYSEGMYAVVMNADTGAVLAMAGGQKHEQGAQDFKADALGTITDVFTPGSVVKGATLTAG
        350       360       370       380       390       400       410       420
      1542      1566      1587      1614      1644      1674      1704      1734
WENKVLRGNEVLYDQ--EIAN---IRSWFT-RGLTPISAAQALEYSSNTYMVQVALRLMGQDYNTGDALTDRGYQEAMAK
|  :   :  |::|| ||    ||:    |   ||||  :|    :|  ||||||||||||||:|:: :||  |     :|:      ::||
WRSGAIYGDQVLTDQPINIASSPPITSWFTDKGSRAITATQALEYSSNTYMVQIAIKRLGQQYVPGMSLSTDNMEKAMTT
        430       440       450       460       470       480       490       500
      1764      1821      1851      1881      1911      1941      1971
LRKTYGEYGLGVSTGLDLP-ESEGYVPGKYSLGTTLMESFGQYDAYTPMQLGQYISTIANNGNRLAPHVVSDIYEGNDSN
|| ||  |:|::||||||| |||||   |::    |:     ||  |||||||  ||::  |||:|    ||      |:  :      |
LRDTYAEFGMGVSTGLDLPGESEGYIPKNYNVANVLTEAFGQYDSYTTIQLAQYVASIANGGKRVAPHIVGGIYDAGKNG
        510       520       530       540       550       560       570       580
      2001      2031      2061      2091      2121      2151      2181      2211
KFAQLVRSITPKTLNKIAISDQELAIIQEGFYNVVNSGSGYATGTSMRGNVTTISKGKTGTAETFANVNGQTVSTYNLNA
 :   |    ::   :    |||:::      ::|   ||||:||::  ||||||   |||   :::   ||||||||||||:|    :|  :|:|    ||||
SLGTLSSTVDTRVLNKLSLDSKQLGIIQQGFHDVVNSGSSLATGKAMASSIIPISGKTGTAETYATDGSGNSVTTVNLNA
        590       600       610       620       630       640       650       660
      2262      2292      2322      2352      2382      2412      2442
IAYDTNR---KIAVAVMYPHVTTDTTKSHQLVARDMIDQYISQFTGQ*ERTFECFTQHQLLN*LTAFQNYRV*VLKQQHV
:|||  :   |:||  :||||        :|:||    :  :::  | |: 
VAYATAKDGTKLAVGIMYPHALDWKSKAHQNAVKAIMELYQNTH
        670       680       690       700
```

SEQ ID 8998 (GBS292) was expressed in *E. coli* as a GST-fusion product. SDS-PAGE analysis of total cell extract is shown in FIG. 68 (lane 9; MW 103 kDa).

GBS292-GST was purified as shown in FIG. 211, lane 7.

Based on this analysis, it was predicted that these proteins and their epitopes could be useful antigens for vaccines or diagnostics.

EXAMPLE 2213

A DNA sequence (GBSx2332) was identified in *S. agalactiae* <SEQ ID 6831> which encodes the amino acid sequence <SEQ ID 6832>. Analysis of this protein sequence reveals the following:

```
Possible site: 47
>>> Seems to have no N-terminal signal sequence

----- Final Results -----
            bacterial cytoplasm --- Certainty = 0.2644(Affirmative) < succ>
            bacterial membrane  --- Certainty = 0.0000(Not Clear)   < succ>
            bacterial outside   --- Certainty = 0.0000(Not Clear)   < succ>
```

The protein has homology with the following sequences in the GENPEPT database.

```
>GP: CAB51328 GB: AJ131985 phosphoglyceromutase [Streptococcus
pneumoniae]
 Identities = 219/230 (95%), Positives = 226/230 (98%)
Query:    1 MVKLVFARHGESEWNKANLFTGWADVDLSEKGTQQAIDAGKLIQAAGIEFDLAFTSVLKR    60
            MVKLVFARHGESEWNKANLFTGWADVDLSEKGTQQAIDAGKLI+ AGI+FD A+TSVLKR
Sbjct:    1 MVKLVFARHGESEWNKANLFTGWADVDLSEKGTQQAIDAGKLIKEAGIKFDQAYTSVLKR    60

Query:   61 AIKTTNLALEAADQLWVPVEKSWRLNERHYGGLTGKNKAEAAEQFGDEQVHIWRRSYDVL   120
            AIKTTNLALEA+DQLWVPVEKSWRLNERHYGGLTGKNKAEAAEQFGDEQVHIWRRSYDVL
Sbjct:   61 AIKTTNLALEASDQLWVPVEKSWRLNERHYGGLTGKNKAEAAEQFGDEQVHIWRRSYDVL   120

Query:  121 PPDMAKDDEHSAHTDRRYASLDDSVIPDAENLKVTLERALPFWEDKIAPALKDGKNVFVG   180
            PP+M +DDEHSAHTDRRYASLDDSVIPDAENLKVTLERALPFWEDKIAPALKDGKNVFVG
Sbjct:  121 PPNMDRDDEHSAHTDRRYASLDDSVIPDAENLKVTLERALPFWEDKIAPALKDGKNVFVG   180

Query:  181 AHGNSIRALVKHIKQLSDDEIMDVEIPNFPPLVFEFDEKLNLVSEYYLGK            230
            AHGNSIRALVKHIK LSDDEIMDVEIPNFPPLVFEFDEKLN+VSEYYLGK
Sbjct:  181 AHGNSIRALVKHIKGLSDDEIMDVEIPNFPPLVFEFDEKLNVVSEYYLGK            230
```

A related DNA sequence was identified in *S. pyogenes* <SEQ ID 6833> which encodes the amino acid sequence <SEQ ID 6834>. Analysis of this protein sequence reveals the following:

```
Possible Site: 61
>>> Seems to have no N-terminal signal sequence

----- Final Results -----
           bacterial cytoplasm --- Certainty = 0.2646(Affirmative) < succ>
           bacterial membrane  --- Certainty = 0.0000(Not Clear)  < succ>
            bacterial outside  --- Certainty = 0.0000(Not Clear)  < succ>
```

An alignment of the GAS and GBS proteins is shown below.

```
 Identities = 206/229 (89%), Positives = 214/229 (92%)
Query:    1 MVKLVFARHGESEWNKANLFTGWADVDLSSKGTQQAIDAGKLIQAAGIEFDLAFTSVLKR    60
            MVKLVFARHGESEWNKANLFTGWADVDLSEKGTQQAIDAGKLI+ AGIEFDLAFTSVL R
Sbjct:    1 MVKLVFARHGESEWNKANLFTGWADVDLSEKGTQQAIDAGKLIKEAGIEFDLAFTSVLTR    60

Query:   61 AIKTTNLALEAADQLWVPVEKSWRLNERHYGGLTGKNKAEAAEQFGDEQVHIWRRSYDVL   120
            AIKTTNLALE A QLWVP EKSWRLNERHYG LTGKNKAEAAEQF DEQVHIWRRSYDVL
Sbjct:   61 AIKTTNLALENAGQLWVPTEKSWRLNERHYGALTGKNKAEAAEQFCDEQVHIWRRSYDVL   120

Query:  121 PPDMAKDDEHSAHTDRRYASLDDSVIPDAENLKVTLERALPFWEDKIAPALKDGKNVFVG   180
            PP MAKDDE+SAH DRRYA LD ++IPDAENLKVTLERA+P+WE+KIAPAL DGKNVFVG
Sbjct:  121 PPAMAKDDEYSAHKDRRYADLDPALIPDAENLKVTLERAMPYWEEKIAPALLDGKNVFVG   180

Query:  181 AHGNSIRALVKHIKQLSDDEIMDVEIPNFPPLVFEFDEKLNLVSEYYLG             229
            AHGNSIRALVKHIK LSDDEIMDVEIPNFPPLVFE DEKLN+V EYYLG
Sbjct:  181 AHGNSIRALVKHIKGLSDDEIMDVEIPNFPPLVFELDEKLNIVKEYYLG             229
```

SEQ ID 6832 (GBS110) was expressed in *E. coli* as a His-fusion product. SDS-PAGE analysis of total cell extract is shown in FIG. 38 (lane 8; MW 28.9 kDa). It was also expressed in *E. coli* as a GST-fusion product. SDS-PAGE analysis of total cell extract is shown in FIG. 41 (lane 10; MW 53.9 kDa).

The GBS110-GST fusion product was purified (FIG. 204, lane 5) and used to immunise mice. The resulting antiserum was used for Western blot (FIG. 252A), FACS (FIG. 252B), and in the in vivo passive protection assay (Table III). These tests confirm that the protein is immunoaccessible on GBS bacteria and that it is an effective protective immunogen.

Based on this analysis, it was predicted that these proteins and their epitopes could be useful antigens for vaccines or diagnostics.

EXAMPLE 2214

A DNA sequence (GBSx2333) was identified in *S. agalactiae* <SEQ ID 6835> which encodes the amino acid sequence <SEQ ID 6836>. This protein is predicted to be triosephosphate isomerase (tpiA). Analysis of this protein sequence reveals the following:

```
Possible site: 54
>>> Seems to have no N-terminal signal sequence
     INTEGRAL     Likelihood = -0.37     Transmembrane     36-52 (36-52)
```

-continued

```
----- Final Results -----
              bacterial membrane --- Certainty = 0.1150(Affirmative) < succ>
              bacterial outside  --- Certainty = 0.0000(Not Clear)   < succ>
              bacterial cytoplasm --- Certainty = 0.0000(Not Clear)  < succ>
```

The protein has homology with the following sequences in the GENPEPT database.

```
>GP: AAC43268 GB: U07640 triosephosphate isomerase [Lactococcus
lactis]
Identities = 164/252 (65%), Positives = 202/252 (80%)
Query:    1 MSRKPFIAGNWKMNKNPEEAKAFIEAVASKLPSSELVEAGIAAPALTLSTVLEAAKGSEL    60
            MSRKP IAGNWKMNK   EA+AF+EAV + LPSS+ VE+ I APAL L+ +    +GSEL
Sbjct:    1 MSRKPIIAGNWKMNKTLSEAQAFVEAVKNNLPSSDNVESVIGAPALFLAPMAYLRQGSEL    60

Query:   61 KIAAQNSYFENSGAFTGENSPKVLAEMGTDYVVIGHSERRDYFHETDQDINKKAKAIFAN   120
            K+AA+NSYFEN+GAFTGENSP  + ++G +Y++IGHSERR+YFHETD+DINKKAKAIFA
Sbjct:   61 KLAAENSYFENAGAFTGENSPAAIVDLGIEYIIIGHSERREYFHETDEDINKKAKAIFAA   120

Query:  121 GLTPIICCGESLETYEAGKAVEFVGAQVSAALAGLSEEQVSSLVIAYEPIWAIGTGKSAT   180
            G TPI+CCGE+LET+EAGK   E+V   Q+ A LAGL+ EQVS+LVIAYEPIWAIGTGK+AT
Sbjct:  121 GATPILCCGETLETFEAGKTAEWVSGQIEAGLAGLTAEQVSNLVIAYEPIWAIGTGKTAT   180

Query:  181 QDDAQNMCKAVRDVVAADFGQAVADKVRVQYGGSVKPENVAEYMACPDVDGALVGGASLE   240
             + A  C  VR V  +G+ V++ VR+QYGGSVKPE +   MA  ++DGALVGGASLE
Sbjct:  181 NEIADETCGVVRSTVEKLYGKEVSEAVRIQYGGSVKPETIEGLMAKENIDGALVGGASLE   240

Query:  241 AESFLALLDFVK                                                  252
            A+SFLALL+  K
Sbjct:  241 ADSFLALLEMYK                                                  252
```

A related DNA sequence was identified in *S. pyogenes* <SEQ ID 6837> which encodes the amino acid sequence <SEQ ID 6838>. Analysis of this protein sequence reveals the following:

```
Possible site: 42
>>> Seems to have no N-terminal signal sequence
    INTEGRAL    Likelihood = -1.81    Transmembrane    36-52 (36-52)

----- Final Results -----
              bacterial membrane --- Certainty = 0.1723(Affirmative) < succ>
              bacterial outside  --- Certainty = 0.0000(Not Clear)   < succ>
              bacterial cytoplasm --- Certainty = 0.0000(Not Clear)  < succ>
```

An alignment of the GAS and GBS proteins is shown below.

```
Identities = 220/251 (87%), Positives = 237/251 (93%)
Query:    1 MSRKPFIAGNWKMNKNPEEAKAFIEAVASKLPSSELVEAGIAAPALTLSTVLEAAKGSEL    60
            MSRKP IAGNWKMNKNP+EAKAF+EAVASKLPS++LV+  +AAPA+ L T +EAAK S L
Sbjct:    1 MSRKPIIAGNWKMNKNPQEAKAFVEAVASKLPSTDLVDVAVAAPAVDLVTTIEAAKDSVL    60

Query:   61 KIAAQNSYFENSGAFTGENSPKVLAEMGTDYVVIGHSERRDYFHETDQDINKKAKAIFAN   120
            K+AAQN YFEN+GAFTGE SPKVLAEMG DYVVIGHSERRDYFHETD+DINKKAKAIFAN
Sbjct:   61 KVAAQNCYFENTGAFTGETSPKVLAEMGADYVVIGHSERRDYFHETDEDINKKAKAIFAN   120

Query:  121 GLTPIICCGESLETYEAGKAVEFVGAQVSAALAGLSEEQVSSLVIAYEPIWAIGTGKSAT   180
            GLTPI+CCGESLETYEAGKAVEFVGAQVSAALAGLS EQV+SLV+AYEPIWAIGTGKSAT
Sbjct:  121 GLTPIVCCGESLETYEAGKAVEFVGAQVSAALAGLSAEQVASLVLAYEPIWAIGTGKSAT   180

Query:  181 QDDAQNMCKAVRDVVAADFGQAVADKVRVQYGGSVKPENVAEYMACPDVDGALVGGASLE   240
            QDDAQNMCKAVRDVVAADFGQ VADKVRVQYGGSVKPENV +YMACPDVDGALVGGASLE
Sbjct:  181 QDDAQNMCKAVRDVVAADFGQEVADKVRVQYGGSVKPENVKDYMACPDVDGALVGGASLE   240

Query:  241 AESFLALLDFV                                                   251
            A+SFLALLDF+
Sbjct:  241 ADSFLALLDFL                                                   251
```

Based on this analysis, it was predicted that these proteins and their epitopes could be useful antigens for vaccines or diagnostics.

EXAMPLE 2215

A DNA sequence (GBSx2334) was identified in *S. agalactiae* <SEQ ID 6839> which encodes the amino acid sequence <SEQ ID 6840>. Analysis of this protein sequence reveals the following:

```
Possible site: 23
>>> Seems to have no N-terminal signal sequence

----- Final Results -----
            bacterial cytoplasm --- Certainty = 0.3050(Affirmative) < succ>
            bacterial membrane  --- Certainty = 0.0000(Not Clear)   < succ>
              bacterial outside --- Certainty = 0.0000(Not Clear)   < succ>
```

The protein has homology with the following sequences in the GENPEPT database.

```
>GP: AAB41198 GB: U75481 elongation factor-Tu [Streptococcus
mutans]
Identities = 44/45 (97%), Positives = 45/45 (99%)
Query:    1 MVMPGDNVTIEVELIHPIAVEQGTTFSIREGGRTVGSGIVSEIEA    45
            MVMPGDNVTI+VELIHPIAVEQGTTFSIREGGRTVGSGIVSEIEA
Sbjct:  117 MVMPGDNVTIDVELIHPIAVEQGTTFSIREGGRTVGSGIVSEIEA   161
```

There is also homology to SEQ ID 1022:

```
Identities = 44/45 (97%), Positives = 44/45 (97%)
Query:    1 MVMPGDNVTIEVELIHPIAVEQGTTFSIREGGRTVGSGIVSEIEA    45
            MVMPGDNVTI VELIHPIAVEQGTTFSIREGGRTVGSGIVSEIEA
Sbjct:  371 MVMPGDNVTINVELIHPIAVEQGTTFSIREGGRTVGSGIVSEIEA   415
```

Based on this analysis, it was predicted that these proteins and their epitopes could be useful antigens for vaccines or diagnostics.

EXAMPLE 2216

A DNA sequence (GBSx2335) was identified in *S. agalactiae* <SEQ ID 6841> which encodes the amino acid sequence <SEQ ID 6842>. Analysis of this protein sequence reveals the following:

```
Possible site: 32
>>> Seems to have no N-terminal signal sequence
      INTEGRAL      Likelihood = -2.66     Transmembrane     81-97 (80-97)
      INTEGRAL      Likelihood = -2.60     Transmembrane     18-34 (17-34)

----- Final Results -----
             bacterial membrane  --- Certainty = 0.2062(Affirmative) < succ>
              bacterial outside  --- Certainty = 0.0000(Not Clear)   < succ>
            bacterial cytoplasm  --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 2217

A DNA sequence (GBSx2336) was identified in *S. agalactiae* <SEQ ID 6843> which encodes the amino acid sequence <SEQ ID 6844>. Analysis of this protein sequence reveals the following:

```
Possible site: 26
>>> Seems to have no N-terminal signal sequence
```

```
----- Final Results -----
          bacterial cytoplasm --- Certainty = 0.0596(Affirmative) < succ>
          bacterial membrane  --- Certainty = 0.0000(Not Clear)   < succ>
          bacterial outside   --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 2218

A DNA sequence (GBSx2337) was identified in *S. agalactiae* <SEQ ID 6845> which encodes the amino acid sequence <SEQ ID 6846>. Analysis of this protein sequence reveals the following:

```
Possible site: 14
>>> Seems to have no N-terminal signal sequence

----- Final Results -----
          bacterial cytoplasm --- Certainty = 0.3559(Affirmative) < succ>
          bacterial membrane  --- Certainty = 0.0000(Not Clear)   < succ>
          bacterial outside   --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 2219

A DNA sequence (GBSx2338) was identified in *S. agalactiae* <SEQ ID 6847> which encodes the amino acid sequence <SEQ ID 6848>. Analysis of this protein sequence reveals the following:

```
Possible site: 33
>>> Seems to have an uncleavable N-term signal seq

----- Final Results -----
          bacterial membrane  --- Certainty = 0.0000(Not Clear)   < succ>
          bacterial outside   --- Certainty = 0.0000(Not Clear)   < succ>
          bacterial cytoplasm --- Certainty = 0.0000(Not Clear)   < succ>
```

The protein has homology with the following sequences in the GENPEPT database.

```
>GP: AAF96286 GB: AE004374 hypothetical protein [Vibrio cholerae]
Identities = 56/167 (33%), Positives = 89/167 (52%), Gaps = 12/167 (7%)
Query:  18 LAIIKSLPLNDCWLCAGTLRNFVWNKLS-GINETLTSDIDVVFFDKNI---SYEETVVLE   73
            L +  L L  C++ AG +RN VW+ L   +  T  +DIDV+FFD +      YE++  LE
Sbjct:  41 LECVYQLELPQCYIAAGFVRNLVWDSLHHNVKLTPLNDIDVIFFDADCLDSDYEKS--LE   98

Query:  74 QQLKDNYPQYDWELKNEFYMNTHSPNTPKYTSSKDAISKFPEKCTAVGARLDDRNQLELY  133
            +L +   PQ +W++KN+  M+  +  +  P Y S+ DA+S +PEK TAV  R  +  ++ E
Sbjct:  99 LKLSEQMPQLNWQVKNQAKMHLQNGDNP-YQSTLDAMSYWPEKETAVAVRKVEHDRYECI  157

Query: 134 LPYGEEEILNFIVSPTPYFEEDLLRYNVYLKRVDKKKWNNIWPRLTI              180
            +G E +    ++ P       Y ++  RV  K W  +WP L I
Sbjct: 158 SAFGFESLFQGFITHNP-----KRAYGIFENRVKSKGWLAMWPNLRI              199
```

No corresponding DNA sequence was identified in *S. pyogenes*.

Based on this analysis, it was predicted that this protein and its epitopes, could be useful antigens for vaccines or diagnostics.

EXAMPLE 2220

A DNA sequence (GBSx2339) was identified in *S. agalactiae* <SEQ ID 6849> which encodes the amino acid sequence <SEQ ID 6850>. Analysis of this protein sequence reveals the following:

```
Possible site: 17
>>> Seems to have no N-terminal signal sequence

----- Final Results -----
            bacterial cytoplasm --- Certainty = 0.2779(Affirmative) < succ>
            bacterial membrane  --- Certainty = 0.0000(Not Clear)   < succ>
            bacterial outside   --- Certainty = 0.0000(Not Clear)   < succ>
```

The protein has homology with the following sequences in the GENPEPT database.

```
>GP: CAB13060 GB: Z99110 yjdF [Bacillus subtilis]
Identities = 47/138 (34%), Positives = 93/138 (67%), Gaps = 2/138 (1%)
Query:   1 MKMTVYFDGNFWLGLIEYDDDGDYKVFRYFFGKEPKDDDVFNFINHKLNDLIKKYEFVKT    60
           MK+T+Y+DG FW+G++E  D+G  + FR+ FGKEP+D +V  F++++L +++ + E   +
Sbjct:  24 MKLTIYYDGQFWVGVVEVVDNGKLRAFRHLFGKEPRDSEVLEFVHNQLLNMMAQAE--QE   81

Query:  61 DISLKRTNEHKKSPKRMQREINREKRKPVVSTKAQLAMKTIHMSIKNERQLSQKCKKNEL  120
            + L+   + K +PKR+QR++++E +    V++KAQ A+K    + K +++   K ++  +
Sbjct:  82 GVRLQGRRQKKINPKRLQRQVSKELKNAGVTSKAQEAIKLELEARKQKKKQIMKEQREHV  141

Query: 121 RKHRYQLKQEKRYQKKKG                                           138
           ++ RY LK++K  +K +G
Sbjct: 142 KEQRYMLKKQKAKKKHRG                                           159
```

No corresponding DNA sequence was identified in *S. pyogenes*.

Based on this analysis, it was predicted that this protein and its epitopes, could be useful antigens for vaccines or diagnostics.

EXAMPLE 2221

A DNA sequence (GBSx2340) was identified in *S. agalactiae* <SEQ ID 6851> which encodes the amino acid sequence <SEQ ID 6852>. This protein is predicted to be ComX1. Analysis of this protein sequence reveals the following:

```
Possible site: 52
>>> Seems to have no N-terminal signal sequence

----- Final Results -----
            bacterial cytoplasm --- Certainty = 0.3143(Affirmative) < succ>
            bacterial membrane  --- Certainty = 0.0000(Not Clear)   < succ>
            bacterial outside   --- Certainty = 0.0000(Not Clear)   < succ>
```

A related GBS nucleic acid sequence <SEQ ID 9469> which encodes amino acid sequence <SEQ ID 9470> was also identified.

The protein has homology with the following sequences in the GENPEPT database.

```
>GP: AAD50429 GB: AF161701 ComX2 [Streptococcus pneumoniae]
 Identities = 61/152 (40%), Positives = 95/152 (62%)
Query:   5 EELFDKVKPIVMKLRRNYFVQLWEYDDWIQEGRIVLFRLLEEEPYLLDNESKLFIYFKTK   64
           +EL+++V+  V K R  Y++ LWE  DW QEG + L+      L+D+  +L YFKTK
Sbjct:   3 KELYEEVQGTVYKCRNEYYLHLWELSDWDQEGMLCLHELISREEGLVDDIPRLRKYFKTK   62
```

```
                              -continued
Query:  65 FSNYLNDVLRHQDCQKRQFNKMPYEEISEVSHYVKSKGLVLDDYIAYRDTLTKVEETLSD   124
           F N + D +R Q+ QKR+++K PYEE+ E+SH +   GL LDDY   + +TL         S
Sbjct:  63 FRNRILDYIRKQESQKRRYDKEPYEEVGEISHRISEGGLWLDDYYLFHETLRDYRNKQSK   122

Query: 125 IDKEKFEKLISGERFAGKKQFIRDIQPFFNAF                              156
              +E+ E+++S ERF G+++ +RD++   F   F
Sbjct: 123 EKQEELERVLSNERFRGRQRVLRDLRIVFKEF                              154
```

A related DNA sequence was identified in *S. pyogenes* <SEQ ID 6853> which encodes the amino acid sequence <SEQ ID 6854>. Analysis of this protein sequence reveals the following:

```
Possible site: 39
>>> Seems to have an uncleavable N-term signal seq
     INTEGRAL    Likelihood = -10.35    Transmembrane    9-25 (7-28)

----- Final Results -----
              bacterial membrane --- Certainty = 0.5140(Affirmative) < succ>
               bacterial outside --- Certainty = 0.0000(Not Clear)   < succ>
             bacterial cytoplasm --- Certainty = 0.0000(Not Clear)   < succ>
```

A related sequence was also identified in GAS <SEQ ID 9163> which encodes the amino acid sequence <SEQ ID 9164>. Analysis of this protein sequence reveals the following:

```
Possible site: 29
>>> Seems to have an uncleavable N-term signal seq
     INTEGRAL    Likelihood = -10.35    Transmembrane    2-18 (1-18)

----- Final Results -----
              bacterial membrane --- Certainty = 0.160(Affirmative) < succ>
               bacterial outside --- Certainty = 0.0000(Not Clear)  < succ>
             bacterial cytoplasm --- Certainty = 0.0000(Not Clear)  < succ>
```

The protein has homology with the following sequences in the databases:

```
>GP: AAD50429 GB: AF161701 ComX2 [Streptococcus pneumoniae]
Identities = 60/149 (40%), Positives = 98/149 (65%)
Query:  41 FEKVKPIILKLKRHYYIQLWDRDDWLQEGHIILLQLLERYPELIEEEERLYRYFKTKFSS   100
           +E+V+  + K +  YY+ LW+  DW QEG + L +L+ R    L+++  RL +YFKTKF +
Sbjct:   6 YEEVQGTVYKCRNEYYLHLWELSDWDQEGMLCLHELISREEGLVDDIPRLRKYFKTKFRN    65

Query: 101 YLKDLLRRQESQKRQFHKLAYEEIGEVAHAIPSRGLWLDDYVAYQEVIASLENQLNSQER   160
           +  D +R+QESQKR++  K  YEE+GE++H I     GLWLDDY   + E +    N+ + +++
Sbjct:  66 RILDYIRKQESQKRRYDKEPYEEVGEISHRISEGGLWLDDYYLFHETLRDYRNKQSKEKQ   125

Query: 161 MQFQALIRGERFKGRRALLRKISPYFKEF                                 189
           +  + ++   ERF+GR+ +LR +    FKEF
Sbjct: 126 EELERVLSNERFRGRQRVLRDLRIVFKEF                                 154
```

An alignment of the GAS and GBS proteins is shown below.

```
Identities = 78/149 (52%), Positives = 116/149 (77%)
Query:   8 FDKVKPIVMKLRRNYFVQLWEYDDWIQEGRIVLFRLLEEHPYLLDNESKLFIYFKTKFSN    67
           F+KVKPI++KL+R+Y++QLW+ DDW+QEG I+L +LLE +P L++ E +L+ YFKTKFS+
Sbjct:  41 FEKVKPIILKLKRHYYIQLWDRDDWLQEGHIILLQLLERYPELIEEEERLYRYFKTKFSS   100

Query:  68 YLNDVLRHQDCQKRQFNKMPYEEISEVSHYVKSKGLVLDDYIAYRDTLTKVEETLSDIDK   127
           YL D+LR Q+ QKRQF+K+ YEEI EV+H + S+GL LDDY+AY++ +   +E  L+  ++
Sbjct: 101 YLKDLLRRQESQKRQFHKLAYEEIGEVAEAIPSRGLWLDDYVAYQEVIASLENQLNSQER   160

Query: 128 EKFEKLISGERFAGKKQFIRDIQPFFNAF                                 156
            +F+ LI GERF G++  +R I P+F   F
Sbjct: 161 MQFQALIRGERFKGRRALLRKISPYFKEF                                 189
```

Based on this analysis, it was predicted that these proteins and their epitopes could be useful antigens for vaccines or diagnostics.

EXAMPLE 2222

A DNA sequence (GBSx2341) was identified in *S. agalactiae* <SEQ ID 6855> which encodes the amino acid sequence <SEQ ID 6856>. Analysis of this protein sequence reveals the following:

```
Possible site: 57
>>> Seems to have no N-terminal signal sequence
    INTEGRAL     Likelihood = -2.23    Transmembrane    166-182 (166-182)

----- Final Results -----
            bacterial membrane --- Certainty = 0.1893(Affirmative) < succ>
             bacterial outside --- Certainty = 0.0000(Not Clear)   < succ>
           bacterial cytoplasm --- Certainty = 0.0000(Not Clear)   < succ>
```

The protein has homology with the following sequences in the GENPEPT database.

```
>GP: CAA99510 GB: Z75191 ORF YOR283w [Saccharomyces cerevisiae]
Identities = 57/226 (25%), Positives = 97/226 (42%), Gaps = 22/226 (9%)
Query:   4 VRLYIARHGKTMFNTIGRAQGWSDTPLTTFGELGIKELGLGLKASNISFKEAFSSDSGRT    63
           +RL+I RHG+T N    QG DT+    GE    +LG L++   I F +  SSD  R
Sbjct:  17 IRLFIIRHGQTEHNVKKILQGHKDTSINPTGEEQATKLGHYLRSRGIHFDKVVSSDLKRC    76

Query:  64 LQTMEIILREVQQENIPYTRDKRIREWCFGSLDGGYDGDLFNGVLPRVSNGDMSHLTHEE   123
           QT  ++L+  +QEN+P +     +RE    G ++G              M     E+
Sbjct:  77 RQTTALVLKHSKQENVPTSYTSGLRERYMGVIEG-----------------MQITEAEK   118

Query: 124 IANLICQVDTAGWAEPWAILSNRILSGFTAIAKKIEDIGGGNAIVVSHGMTIATFL-WL-   181
           A+    + E       R+       +  + +G N  +VSHG  I    L WL
Sbjct: 119 YADKHGSGSFRNFGEKSDDFVARLTGCVEEEVAEASNEGVKNLALVSHGGAIRMILQWLK   178

Query: 182 IDHSTPRSLGLDNGSVSVVDF--EDGTFSIQSIGDMSYREKGREIL                225
           ++      + + N SV++VD+  +   F ++ +G+  +   G ++
Sbjct: 179 YENHQAHKIIVFNTSVTIVDYVKDSKQFIVRRVGNTQHLGDGEFVV                224
```

A related DNA sequence was identified in *S. pyogenes* <SEQ ID 6857> which encodes the amino acid sequence <SEQ ID 6858>. Analysis of this protein sequence reveals the following:

```
Possible site: 57
>>> Seems to have no N-terminal signal sequence
    INTEGRAL     Likelihood = -0.69    Transmembrane    170-186 (170-186)

----- Final Results -----
            bacterial membrane --- Certainty = 0.1277(Affirmative) < succ>
             bacterial outside --- Certainty = 0.0000(Not Clear)   < succ>
           bacterial cytoplasm --- Certainty = 0.0000(Not Clear)   < succ>
```

The protein has homology with the following sequences in the databases:

```
>GP: CAA99510 GB: Z75191 ORF YOR283w [Saccharomyces cerevisiae]
 Identities = 64/231 (27%), Positives = 98/231 (41%), Gaps = 27/231 (11%)
Query:   5 RLYIARHGKTMFNTIGRAQGWSDTPLTKKGEEGIRELGLGLKDATIPFKAAFSSDSGRTM    64
           RL+I RHG+T N    QG DT +   GEE    +LG L+   I F    SSD  R
Sbjct:  18 RLFIIRHGQTEHNVKKILQGHKDTSINPTGEEQATKLGHYLRSRGIHFDKVVSSDLKRCR    77

Query:  65 QTIEIILRESENEFLPYTKDNRIREWCFGSLEGTYDSELFLGVLPRTKAFENRDNLRDVP   124
           QT  ++L+  S+ E +P +       +RE     G +EG      +E
Sbjct:  78 QTTALVLKHSKQENVPTSYTSGLRERYMGVIEGMQITEA--------------------   116

Query: 125 YSELAESIVEVDTANWAEPWEVLRKRIWEGFEAIALSIQNAGGGNALVVSHGMTIGTFL-   183
            + A+   E    N+ E  +      R+    E        NG N  +VSHG  I    L
Sbjct: 117 -EKYADKHGEGSFRNFGEKSDDFVARLTGCVEEEVAEASNEGVKNLALVSHGGAIRMILQ   175
```

```
                        -continued
Query: 184 WL--IDPDRDKQYIDNGSVTVVEF--DDGQFTIKTIGDMSYRYRGREIIEE       230

WL    +   K + N SVT+V++   D  QF ++ +G+  +    G  ++ +

Sbjct: 176 WLKYENHQAHKIIVFNTSVTIVDYVKDSKQFIVRRVGNTQHLGDGEFVVSD          226
```

An alignment of the GAS and GBS proteins is shown below.

```
 Identities = 150/231 (64%), Positives = 182/231 (77%), Gaps = 5/231 (2%)
 Query:    1 MSKVRLYIARHGKTMFNTIGRAQGWSDTPLTTFGELGIKELGLGLKASNISFKEAFSSDS    60

M+K RLYIARHGRTMFNTIGRAQGWSDTPLT  GE GI+ELGLGLK + I FK AFSSDS
 Sbjct:    1 MTKTRLYIARHGKTMFNTIGRAQGWSDTPLTKKGEEGIRELGLGLKDATIPFKAAFSSDS    60

Query:   61 GRTLQTMEIILREVQQENIPYTRDKRIREWCFGSLDGGYDGDLFNGVLPRV----SNGDM   116

GRT+QT+EIILRE + E +PYT+D RIREWCFGSL+G YD +LF GVLPR     +  ++
 Sbjct:   61 GRTMQTIEIILRESENEFLPYTKDNRIREWCFGSLEGTYDSELFLGVLPRTKAFENRDNL   120

Query:  117 SHLTHEEIANLICQVDTAGWAEPWAILSNRILSGFTAIAKKIEDIGGGNAIVVSHGMTIA   176

+ + E+A  I +VDTA WAEPW +L  RI  GF AIA  I++ GGGNA+VVSHGMTI
 Sbjct:  121 RDVPYSELAESIVEVDTANWAEPWEVLRKRIWEGFEAIALSIQNAGGGNALVVSHGMTIG   180

Query:  177 TFLWLIDHSTPRSLGLDNGSVSVVDFEDGTFSIQSIGDMSYREKGREILEK           227
             TFLWLID    +    +DNGSV+VV+F+DG F+I++IGDMSYR +GREI+E+
 Sbjct:  181 TFLWLIDPDRDKQY-IDNGSVTVVEFDDGQFTIKTIGDMSYRYRGREIIEE           230
```

A related GBS gene <SEQ ID 8999> and protein <SEQ ID 9000> were also identified. Analysis of this protein sequence reveals the following:

```
Cytoplasmic predicated but experimentally found on the surface of Streptococci 32.3/52.0% over 184aa
Thermotoga maritima
EGAD|165681|phosphoglycerate mutase Insert characterized
GP|4981935|gb|AAD36444.1|AE001791_6|AE001791 phosphoglycerate mutase Insert
characterized
PIR|G72260|G72260 phophoglycerate mutase-(strain MSB8)Insert characterized ORF01265(268-870 of 1248)
EGAD|165681|TM1374(1-185 of 201)phosphoglycerate mutase {Thermotoga maritima}
GP|4981935|gb|AAD36444.1|AE001791_6|AE001791 phosphoglycerate mutase {Thermotoga
maritima} PIR|G72260|G72260 phosphoglycerate mutase-Thermotoga maritima (Strain
MSB8)
%Match = 6.3
%Identity = 32.2  %Similarity = 52.0
Matches = 57  Mismatches = 78  Conservative Sub.s = 35
105          135          165          195          225          255          285          315
RGRNNSYEIFNPFSMLLKRINRFYFCSR*LQNFFIGKVR*YIPVKAFVFCYNIIKCL*GVSMSKVRLYIARHGKTMFNTI
                                                                   ::||: |||:|::|
                                                                   MKLYLIRHGETIWNEK
                                                                        10
345          375          405          435          465          495          519          549
GRAQGWSDTPLTTFGELGIKELGLGLKASNISFKEAFSSDSXRTLQTMEIILREVQQENI---PYTRDKRIREWCFGSLDG
|  || :| ||    |    ::|    ||           :||   |:|:|    ::|    |:   |   |
GLWQGVTDVPLNERGREQARKLANSLK----RVDAIYSSPLKRSLETAEEIARRFEKEIIVEEDLRECEISLW-------
             30           40            50           60           70           80
579          609          639          669                   699          729          759
GYDGDLFNGVLPRVSNGDMSHLTHEEIANLICQVDTAGWA----------EPWAILSNRILSGFTAIAKKIEDIGGGNAI
                  : || ||    |:   |:           |   : ||::       |  :  :   |  |:
------------------NGLTVEE-AIREYPVEFKKWSSDPNFGMEGLESMRNVQNRVVKAIMKIVSQEKLNGSENVV
                    90          100          110         120          130         140
789          816          840          870          900           930         960         990
VVSHGMTIATFL-WLIDHST--PRSLGLDNGSVSVVDFEDGTFSIQSIGDMSYREKGREILEKTLQ*KKIKLSDVSV*LVF
:|||  :::   |:  |::            |::  |||:| |          :         :|
IVSHSLSLRAFICWILGLPLYLHRNFKLDNASLSVVEIESKPRLVLLNDTCHLKES
             160          170          180           190          200
```

SEQ ID 9000 (GBS44) was expressed in *E. coli* as a His-fusion product. SDS-PAGE analysis of total cell extract is shown in FIG. 238 (lane 7; MW 42 kDa). It was also expressed in *E. coli* as a GST-fusion product. SDS-PAGE analysis of total cell extract is shown in FIG. 12 (lane 8; MW 52.4 kDa).

Purified Thio-GBS44-His is shown in FIG. 244, lanes 7 & 8.

Based on this analysis, it was predicted that these proteins and their epitopes could be useful antigens for vaccines or diagnostics.

EXAMPLE 2223

A DNA sequence (GBSx2342) was identified in *S. agalactiae* <SEQ ID 6859> which encodes the amino acid sequence <SEQ ID 6860>. This protein is predicted to be d-alanyl-d-alanine carboxypeptidase. Analysis of this protein sequence reveals the following:

```
Possible Site: 27
>>> Seems to have a cleavable N-term signal seq.

----- Final Results -----
              bacterial outside  --- Certainty = 0.3000(Affirmative) < succ>
              bacterial membrane --- Certainty = 0.0000(Not Clear)   < succ>
              bacterial cytoplasm --- Certainty = 0.0000(Not Clear)   < succ>
```

The protein has homology with the following sequences in the GENPEPT database.

```
>GP: AAD00280 GB: U78599 putative D,D-carboxypeptidase [Streptococcus mutans]
 Identities = 108/169 (63%), Positives = 139/169 (81%)
Query:  79 ELSPDVVPVENIYLDKRITKQATQFLEAARAIDSREHLISGYRSVAYQEKLFNSYVTQEM    138
            E++PDV  ++ + +D RI +    +FL AA+ IDS EHLISGYRSVAYQE+L+N+Y+ QE
Sbjct:   4 EMNPDVTDIDGVKVDSRIAENTRKFLAAAQEIDSSEHLISGYRSVAYQEELYNNYIAQEK    63

Query: 139 TSNPNLTRGQAEKLVKTYSQPAGASEHQTGLAMDMSTVDSLNESDPRVVSQLKKIAPQYG    198
            +NP+L++ +A+K V+TYSQP G+SEHQTGLA+DMSTVDSLN+SD   VV+++  IAP+YG
Sbjct:  64 ANNPSLSQEEAQKQVQTYSQPPGSSEHQTGLAIDMSTVDSLNQSDANVVAKVAAIAPKYG   123

Query: 199 FVLRFPDGKTAETGVGYEDWHYRYVGVESAKYMAKHHLTLEEYITLLKE    247
            FVLRFP+GK    TG+ YEDWHYRYVGV+SAKYM KH LTLEEY+  LKE
Sbjct: 124 FVLRFPEGKKDATGIDYEDWHYRYVGVKSAKYMTKHDLTLEEYLKKLKE   172
```

A related DNA sequence was identified in *S. pyogenes* <SEQ ID 6861> which encodes the amino acid sequence <SEQ ID 6862>. Analysis of this protein sequence reveals the following:

```
Possible site: 26
>>> Seems to have an uncleavable N-term signal seq
    INTEGRAL    Likelihood = -9.66    Transmembrane    10-26 (3-29)

----- Final Results -----
              bacterial membrane --- Certainty = 0.4864(Affirmative) < succ>
              bacterial outside  --- Certainty = 0.0000(Not Clear)   < succ>
              bacterial cytoplasm --- Certainty = 0.0000(Not Clear)   < succ>
```

The protein has homology with the following sequences in the databases:

```
>GP: AAD00280 GB: U78599 putative D,D-carboxypeptidase [Streptococcus mutans]
 Identities = 118/173 (68%), Positives = 139/173 (80%)
Query:  74 ITKEMSPELADINGISVDKRIEQATSDFLAAAQAIDLQEHLISGYRSVDYQTELYQSYIK    133
            IT EM+P++ DI+G+ VD RI + T  FLAAAQ ID  EHLISGYRSV YQ ELY +YI
Sbjct:   1 ITAEMNPDVTDIDGVKVDSRIAENTRKFLAAAQEIDSSEHLISGYRSVAYQEELYNNYIA    60
```

-continued

```
Query:  134 KEMANDPTLTQEAAEALVQTYSQPPGASEHHTGLAIDMSTVDTLNASDPSVAKAVQKIAP    193
            +E AN+P+L+QE A+  VQTYSQPPG+SEH TGLAIDHSTVD+LN SD +V   V  IAP
Sbjct:   61 QEKANNPSLSQEEAQKQVQTYSQPPGSSEHQTGLAIDMSTVDSLNQSDANVVAKVAAIAP    120

Query:  194 DYGFVLRFPEGKKTSTGVDYEDWHYRYVGKASARYMAQHNLTLEEYIAALKEK          246
            YGFVLRFPEGKK +TG+DYEDWHYRYVG  SA+YM +H+LTLEEY+  LKEK
Sbjct:  121 KYGFVLRFPEGKKDATGIDYEDWHYRYVGVKSAKYMTKHDLTLEEYLKKLKEK          173
```

An alignment of the GAS and GBS proteins is shown below.

```
 Identities = 131/235 (55%), Positives = 172/235 (72%), Gaps = 3/235 (1%)
Query:   15 LLAILCF--SLFALLKPNSQQSSSQKLRNEDIKKISSQKRNKKLQLPAVSSKDWNLILVN    72
            LL ++ F   L+ +KP   + +Q L ++I++   +K ++   LP VS +DW L+LVN
Sbjct:   12 LLIVIVFLGGLYLFIKPEESVTPTQ-LNKKEIQQKDIKKTDRLRALPKVSVEDWELVLVN    70

Query:   73 RDHKHEELSPDVVPVENIYLDKRITKQATQFLEAARAIDSREHLISGYRSVAYQEKLFNS   132
            RDH  +E+SP++   +  I +DKRI +  + FL AA+AID +EHLISGYRSV YQ +L+ S
Sbjct:   71 RDHITKEMSPELADINGISVDKRIEQATSDFLAAAQAIDLQEHLISGYRSVDYQTELYQS   130

Query:  133 YVTQEMTSNPNLTRGQAEKLVKTYSQPAGASEHQTGLAMDMSTVDSLNESDPRVVSQLKK   192
            Y+ +EM ++P LT+  AE LV+TYSQP GASEH TGLA+DMSTVD+LN SDP V   ++K
Sbjct:  131 YIKKEMANDPTLTQEAAEALVQTYSQPPGASEHHTGLAIDMSTVDTLNASDPSVAKAVQK   190

Query:  193 IAPQYGFVLRFPDGKTAETGVGYEDWHYRYVGVESAKYMAKHHLTLEEYITLLKE        247
            IAP YGFVLRFP+GK   TGV YEDWHYRYVG  SA+YMA+H+LTLEEYI  LKE
Sbjct:  191 IAPDYGFVLRFPEGKKTSTGVDYEDWHYRYVGKASARYMAQHNLTLEEYIAALKE        245
```

A related GBS gene <SEQ ID 9001> and protein <SEQ ID 9002> were also identified. Analysis of this protein sequence reveals the following:

```
Lipop: Possible site: -1 Crend: 7
McG: Discrim Score: 14.03
GvH: Signal Score (-7.5): -1.02
      Possible site: 27
>>> Seems to have a cleavable N-term signal seq.
ALOM program count: 0 value: 10.08 threshold: 0.0
           PERIPHERAL           Likelihood = 10.08              56
modified ALOM score: -2.52

*** Reasoning Step: 3

----- Final Results -----
                bacterial outside --- Certainty = 0.3000(Affirmative) < succ>
               bacterial membrane --- Certainty = 0.0000(Not Clear)  < succ>
               bacterial cytoplasm --- Certainty = 0.0000(Not Clear)  < succ>
```

The protein has homology with the following sequences in the databases:

```
33.7/55.1% over 183aa

Enterococcus faecalis
  EGAD|41322| d-alanyl-d-alanine carboxypeptidase Insert characterized
GP|1209528|gb|AAB05624.1||U35369 D,D-carboxypeptidase Insert characterized ORF01266(484-1038 of 1350)
EGAD|41322|43646(85-268 of 268) d-alanyl-d-alanine carboxypeptidase
{Enterococcus faecalis}SP|Q47746|VANY_ENTFA D-ALANYL-D-ALANINE
CARBOXYPEPTIDASE EC 3.4.16.4)DD-PEPTIDASE)
(DD-CARBOXYPEPTIDASE).GP|1209528|gb|AAB05624.1||U35369
D,D-carboxypeptidase {Enterococcus faecalis}
% Match = 10.1
% Identity = 33.7  % Similarity = 55.1
Matches = 63   Mismatches = 79   Conservative Sub.s = 40

234         264         294         324         354         384         414         444
SR*F*RWNIFYSIYWGYVLSRKRKRNFRKNIAMKKNKIIRFSLVGVLLAILCFSLFALLKPNSQQSSSQKLRNEDIKKIS

MEKSNYHSNVNHHKRHMKQSGEKRAFLWAFIISFTVCTLFLGWRLVSVLEATQLPPIPATHTGSGTGVAEN
                  10        20        30        40        50        60        70
```

```
474         504         531         561         588         618         648         678
SQKRNKKLQLPAVSSKDWNLILVNRDHK-HEELSPDVVPVEN-IYLDKRITKQATQFLEAARAIDSREHLISGYRSVAYQ
    :     ::|:||||||  :       ::   :  |   :|  ||:       :::||||       :  ||||:     |
PEENTLATAKEQGDEQEWSLILVNRQNPIPAQYDVELEQLSNGERIDIRISPYLQDLFDAARADGVYPIVASGYRTTEKQ
                90          100         110         120         130         140         150
708         738         768         798         828         858         888         918
EKLFNSYVTQEMTSNPNLTRGQAEKLVKTYSQPAGASEHQTGLAMDMSTVDSLNESDPRVVSQLKKIAPQYGFVLRFPDG
:::  :   |   |   :    |  ||:   :|:    | ||||  |||:|::   | :: :    |    |  : :  ::||: |:|
QEIMDEKV-AEYKAK-GYTSAQAKAEAETWVAVPGTSEHQLGLAVDINA-DGIHSTGNEVYRWLDENSYRFGFIRRYPPD
       160         170         180         190         200         210         220
948         978         1008        1038        1068        1098        1128        1158
KTAETGVGYEDWHYRYVGVESAKYMAKHHLTLEEYITLLKENNQ*GNVFPC*ILLLLLLFSFSLFFFRF*TIREK*MLIL
||  |||   |  ||||||||:|:|   :    :  |  ||||:    |
KTEITGVSNEPWHYRYVGIEAATKIYHQGLCLEEYLNTEK
```

SEQ ID 6860 (GBS18) was expressed in *E. coli* as a His-fusion product. SDS-PAGE analysis of total cell extract is shown in FIG. 4 (lane 3; MW 31 kDa).

The GBS18-His fusion product was purified (FIG. 93A; see also FIG. 189, lane 11) and used to immunise mice (lane 2 product; 20 μg/mouse). The resulting antiserum was used for Western blot (FIG. 93B), FACS (FIG. 93C), and in the in vivo passive protection assay (Table III). These tests confirm that the protein is immunoaccessible on GBS bacteria and that it is an effective protective immunogen.

EXAMPLE 2224

A DNA sequence (GBSx2343) was identified in *S. agalactiae* <SEQ ID 6863> which encodes the amino acid sequence <SEQ ID 6864>. This protein is predicted to be unnamed protein product. Analysis of this protein sequence reveals the following:

```
Possible site: 34
>>> Seems to have an uncleavable N-term signal seq
INTEGRAL Likelihood = -12.58 Transmembrane 10-26 (3-29)

----- Final Results -----
            bacterial membrane --- Certainty = 0.6031(Affirmative) < succ>
             bacterial outside --- Certainty = 0.0000(Not Clear)   < succ>
           bacterial cytoplasm --- Certainty = 0.0000(Not Clear)   < succ>
```

A related DNA sequence was identified in *S. pyogenes* <SEQ ID 6865> which encodes the amino acid sequence <SEQ ID 6866>. Analysis of this protein sequence reveals the following:

```
Possible site: 33
>>> Seems to have an uncleavable N-term signal seq
INTEGRAL Likelihood = -11.83 Transmembrane 10-26 (4-33)

----- Final Result -----
            bacterial membrane --- Certainty = 0.5734(Affirmative) < succ>
             bacterial outside --- Certainty = 0.0000(Not Clear)   < succ>
           bacterial cytoplasm --- Certainty = 0.0000(Not Clear)   < succ>
```

The protein has homology with the following sequences in the databases:

```
>GP:AAD00279 GB:U78599 putative N-acetyl-muramidase [Streptococcus mutans]
Identities = 66/150 (44%), Positives = 97/150 (64%), Gaps = 5/150 (3%)
Query:  18 LLLIVCPLLSSQRIASADKEVRVNYSQKQFITKNGKEVKPLAKYYGIRPSILIAQILLET    77
            LL+I+ P+L+S  +A A+K++    YS K+F+ ++     + L+K YG+R SI+I Q  L++
Sbjct:   3 LLVILLPILASGGLADANKKNPSPYSHKEFVKEIAPTAQKLSKIYGVRSSIIIGQAALDS    62

Query:  78 HDGKTLLASKYHNLFSKKATPGQVAITLKSPKQTN---QNV--RYAIYKDDASAIRDYLR   132
            H G TLLASKYHNLFS +A+PGQ A+ LKS +  N    Q V  RY +Y+     ++ DY+
Sbjct:  63 HFGSTLLASKYHNLFSIEASPGQGAVRLKSHEYKNGRWQEVTNRYLVYESWKESLYDYMA   122
```

```
Query: 133 MLRQGKEVDKRLYRNLATEKGYKAPAKSLQ                              162
            +L   K  DK LY  + T  GYK  A++LQ
Sbjct: 123 ILHGNKIWDKALYTTMMTSSGYKTVARALQ                              152
```

An alignment of the GAS and GBS proteins is shown below.

```
Identities = 67/190 (35%), Positives = 102/190 (53%), Gaps = 1/190 (0%)
Query:    1 MRKRFSLLNFIVVTFIFFFWILFPLLNHKGKVDANSRQSVTYTKEEFIQKIVPDAQDLGK    60
            MRKR    F+ +    F   I+ PLL+ +     A+     V Y++++FI K+  + + L K
Sbjct:    1 MRKRLKFPYFLTLLACFLLLIVCPLLSSQRIASADKEVRVNYSQKQFITKMGKEVKPLAK    60

Query:   61 SYGIRPSFIIAQAALDSDFGEKILANKYHNLFGLLAEPGTPSITLNDSSTGKKQEKQFTH   120
             YGIRPS +IAQ  L++   G+ +LA+KYHNLF    A PG  +ITL  S    Q  ++
Sbjct:   61 YYGIRPSILIAQILLETHDGKTLLASKYHNLFSKKATPGQVAITLK-SPKQTNQNVRYAI   119

Query:  121 YKSWKYSMYDYLAHIKSGATGKKDSYTIMVSVKNPKTLVQKLQDSGFDNDKKYAKKMTEI   180
            YK    ++ DYL  ++G     K  Y  +  + K  K   + LQ        DK YA+++++
Sbjct:  120 YKDDASAIRDYLRMLRQGKEVDKRLYRNLATEKGYKAPAKSLQKYLHYTDKTYARRLIQV   179

Query:  181 IDLYDLTRYD                                                    190
            I+  DLT YD
Sbjct:  180 IESNDLTNYD                                                    189
```

SEQ ID 6864 (GBS246) was expressed in *E. coli* as a His-fusion product. SDS-PAGE analysis of total cell extract is shown in FIG. 61 (lane 7; MW 24.6 kDa).

GBS246d was expressed in *E. coli* as a His-fusion product. SDS-PAGE analysis of total cell extract is shown in FIG. 154 (lane 14 & 15; MW 21 kDa) and in FIG. 183 (lane 4; MW 21 kDa). It was also expressed in *E. coli* as a GST-fusion product. SDS-PAGE analysis of total cell extract is shown in FIG. 187 (lane 12; MW 46 kDa). Purified GBS246d-GST is shown in FIG. 243, lane 12.

Based on this analysis, it was predicted that these proteins and their epitopes could be useful antigens for vaccines or diagnostics.

EXAMPLE 2225

A DNA sequence (GBSx2344) was identified in *S. agalactiae* <SEQ ID 6867> which encodes the amino acid sequence <SEQ ID 6868>. Analysis of this protein sequence reveals the following:

```
Possible site: 44
>>> Seems to have no N-terminal signal sequence

----- Final Results -----
              bacterial cytoplasm --- Certainty = 0.2541(Affirmative) < succ>
               bacterial membrane --- Certainty = 0.0000(Not Clear)   < succ>
                bacterial outside --- Certainty = 0.0000(Not Clear)   < succ>
```

The protein has homology with the following sequences in the GENPEPT database.

```
>GP:AAC45610 GB:U78296 repressor of class I heat shock gene
expression HrcA [Streptococcus mutans]
Identities = 227/345 (65%), Positives = 287/345 (82%), Gaps = 1/345 (0%)
Query:   17 VITQRQNDILNLIVELFTQTHEPVGSKALQRTIDSSSATIRNDMAKLEKLGLLEKAHTSS    76
            +ITQRQ DILNLIVELFT+THEP+GSK LQ +I SS ATIRNDMA LEKLGLLEKA T
Sbjct:    1 MITQRQKDILNLIVELFTKTHEPIGSKTLQNSIASSRATIRNDMAALEKLGLLEKATTPP    60

Query:   77 GRM-PSPAGFKYFVEHSLRLDSIDEQDIYHVIKAFDFEAFKLEDMLQKASHILSEMTGYT   135
             +P     +YFVEHSL   DS+DEQD+Y VIKAFDFEAF+L D+LQ+AS +L+  +TGYT
Sbjct:   61 AVVCPVKKAIRYFVEHSLNPDSLDEQDVYQVIKAFDFEAFRLGDLLQRASDVLANLTGYT   120

Query:  136 SVILDVEPARQRLTGFDVVQLSNHDALAVNTLDESKPVTVQFAIPRNFLTRDLIAFKAIV   195
            ++ILDVEP +QRLT FD+V+LSNHDALAV TLDE+  PVTVQFAIP+NFL   DL+    I
```

-continued
```
Sbjct: 121 ALILDVEPKKQRLTTFDIVKLSNHDALAVLTLDEASPVTVQFAIPKNFLDSDLMTVAKIA 180

Query: 196 EERLLDGSVMDIHYKLRTEIPQIVQKYFVTTDNVLQLFDYVFSELFLETVFVAGKVNSLT 255
            ER L+ +V+DIHY+LRTE PQI+QKYF  TDNVL LFD++F+ +F E VF++GK+ +L
Sbjct: 181 RERFLNQTVLDIHYRLRTEPPQIIQKYFPRTDNVLDLFDHIFNPIFQEEVEISGKIKTLE 240

Query: 256 YSDLSTYQFLDNEQQVAISLRQSLKEGEMASVQVADSQEAALADVSVLTHKFLIPYRGFG 315
            ++ L TYQFL+N Q VA+ +RQSL E E+  VQVADS+E +LAD++V++ KFLIPYRGFG
Sbjct: 241 FAGLDTYQFLENLQSVALEIRQSLPEDELHRVQVADSKEKSLADLTVISQKFLIPYRGFG 300

Query: 316 LLSLIGPIDMDYRRSVSLVNIIGKVLAAKLGDYYRLNSNHYEVH 360
            +L++IGP+D+DY+R++SL+N+I +VLA KLGD+YRLNSNHYEVH
Sbjct: 301 ILTVIGPVDLDYQRTISLINVISRVLAVKLGDFYRLNSNHYEVH 345
```

A related DNA sequence was identified in *S. pyogenes* <SEQ ID 6869> which encodes the amino acid sequence <SEQ ID 6870>. Analysis of this protein sequence reveals the following:

```
Possible site: 28
>>> Seems to have no N-terminal signal sequence

----- Final Results -----
            bacterial cytoplasm --- Certainty = 0.0695(Affirmative) < succ>
            bacterial membrane  --- Certainty = 0.0000(Not Clear)  < succ>
             bacterial outside  --- Certainty = 0.0000(Not Clear)  < succ>
```

An alignment of the GAS and GBS proteins is shown below.

```
Identities = 341/344 (99%), Positives = 343/344 (99%)

Query:  17 VITQRQNDILNLIVELFTQTHEPVGSKALQRTIDSSSATIRNDMAKLEKLGLLEKAHTSS  76
           VITQRQNDILNLIVELFTQTHEPVGSKALQRTIDSSSATIRNDMAKLEKLGLLEKAHTSS
Sbjct:  1 VITQRQNDILNLIVELFTQTHEPVGSKALQRTIDSSSATIRNDMAKLEKLGLLEKAHTSS  60

Query:  77 GRMPSPAGFKYFVEHSLRLDSIDEQDIYHVIKAFDFEAFKLEDMLQKASHILSEMTGYTS 136
           GRMPSPAGFKYFVEHSLRLDSIDEQDIYHVIKAFDFEAFKLEDMLQKASHIL+EMTGYTS
Sbjct:  61 GRMPSPAGFKYFVEHSLRLDSIDEQDIYHVIKAFDFEAFKLEDMLQKASHILAEMTGYTS 120

Query: 137 VILDVEPARQRLTGFDVVQLSNHDALAVMTLDESKPVTVQFAIPRNFLTRDLIAFKAIVE 196
           VILDVEPARQRLTGFDVVQLSNHDALAVMTLDESKPVTVQFAIPRNFLTRDLIAFKAIVE
Sbjct: 121 VILDVEPARQRLTGFDVVQLSNHDALAVMTLDESKPVTVQFAIPRNFLTRDLIAFKAIVE 180

Query: 197 ERLLDGSVMDIHYKLRTEIPQIVQKYFVTTDNVLQLFDYVFSELFLETVFVAGKVNSLTY 256
           ERLLD SV+DIHYKLRTEIPQIVQKYFVTTDNVLQLFDYVFSELFLETVFVAGKVNSLTY
Sbjct: 181 ERLLDNSVIDIHYKLRTEIPQIVQKYFVTTDNVLQLFDYVFSELFLETVFVAGKVNSLTY 240

Query: 257 SDLSTYQFLDNEQQVAISLRQSLKEGEMASVQVADSQEAALADVSVLTHKFLIPYRGFGL 316
           SDLSTYQFLDNEQQVAISLRQSLKEGEMASVQVADSQEAALADVSVLTHKFLIPYRGFGL
Sbjct: 241 SDLSTYQFLDNEQQVAISLRQSLKEGEMASVQVADSQEAALADVSVLTHKFLIPYRGFGL 300

Query: 317 LSLIGPIDMDYRRSVSLVNIIGKVLAAKLGDYYRLNSNHYEVH 360
           LSLIGPIDMDYRRSVSLVNIIGKVLAAKLGDYYRLNSNHYEVH
Sbjct: 301 LSLIGPIDMDYRRSVSLVNIIGKVLAAKLGDYYRLNSNHYEVH 344
```

Based on this analysis, it was predicted that these proteins and their epitopes could be useful antigens for vaccines or diagnostics.

EXAMPLE 2226

A DNA sequence (GBSx2345) was identified in *S. agalactiae* <SEQ ID 6871> which encodes the amino acid sequence <SEQ ID 6872>. This protein is predicted to be grpe protein (grpE). Analysis of this protein sequence reveals the following:

```
Possible site: 15
>>> Seems to have no N-terminal signal sequence
```

-continued

```
----- Final Results -----
            bacterial cytoplasm --- Certainty = 0.5138(Affirmative) < succ>
            bacterial membrane  --- Certainty = 0.0000(Not Clear)   < succ>
            bacterial outside   --- Certainty = 0.0000(Not Clear)   < succ>
```

The protein has homology with the following sequences in the GENPEPT database.

```
>GP: AAC45611 GB: U78296 GrpE [Streptococcus mutans]
Identities = 130/180 (72%), Positives = 151/180 (83%),
Gaps = 3/180 (1%)

Query:   14 VSEEIKKDDLQEEVEATE--TEETVEEVIEEIPEKSELELANERADEFENKYLRAHAEM-  70
            +S++ KK++ +EEVEATE   TEE+VEEV EE  E   EL+ A ERA++FENKYLRAHAEM
Sbjct:    1 MSKKDKKEEYKEEVEATEPTTEESVEEVAEETSENKELQEALERAEDFENKYLRAHAEMP  60

Query:   71 QNIQRRSSEERQQLQRYRSQDLAKAILPSLDNLERALAVEGLTDDVKKGLEMTRDSLIQA 130
            +        +   + QRYRSQDL KAILPSLDNLERALAVEGLTDDVKKGLEM ++SLIQA
Sbjct:   61 KTFSVALMKSDKVCQRYRSQDLRKAILPSLDNLERALAVEGLTDDVKKGLEMVQESLIQA 120

Query:  131 LKEEGVEEVEVDSFDHNFHMAVQTLPADDEHPADSIAEVFQKGYKLHERLLRPAMVVVYN 190
            LKEEGVEEVE+++FD N HMAVQTL ADD+HPADSIA+V QKGY+LHERLLRPAMVVVYN
Sbjct:  121 LKEEGVEEVELENFDANLHMAVQTLDADDDHPADSIAQVHQKGYQLHERLLRPAMVVVYN 180
```

A related DNA sequence was identified in *S. pyogenes* <SEQ ID 6873> which encodes the amino acid sequence <SEQ ID 6874>. Analysis of this protein sequence reveals the following:

```
Possible site: 15
>>> Seems to have no N-terminal signal sequence

----- Final Results -----
            bacterial cytoplasm --- Certainty = 0.5138(Affirmative) < succ>
            bacterial membrane  --- Certainty = 0.0000(Not Clear)   < succ>
            bacterial outside   --- Certainty = 0.0000(Not Clear)   < succ>
```

An alignment of the GAS and GBS proteins is shown below.

```
Identities = 189/190 (99%), Positives = 189/190 (99%)

Query:    1 MAVFNKLFKRRHSVSEEIKKDDLQEEVEATETEETVEEVIEEIPEKSELELANERADEFE  60
            MAVFNKLFKRRHSVSEEIKKDDLQEEVEATETEETVEEVIEE PEKSELELANERADEFE
Sbjct:    1 MAVFNKLFKRRHSVSEEIKKDDLQEEVEATETEETVEEVIEETPEKSELELANERADEFE  60

Query:   61 NKYLRAHAEMQNIQRRSSEERQQLQRYRSQDLAKAILPSLDNLERALAVEGLTDDVKKGL 120
            NKYLRAHAEMQNIQRRSSEERQQLQRYRSQDLAKAILPSLDNLERALAVEGLTDDVKKGL
Sbjct:   61 NKYLRAHAEMQNIQRRSSEERQQLQRYRSQDLAKAILPSLDNLERALAVEGLTDDVKKGL 120

Query:  121 EMTRDSLIQALKEEGVEEVEVDSFDHNFHMAVQTLPADDEHPADSIAEVFQKGYKLHERL 180
            EMTRDSLIQALKEEGVEEVEVDSFDHNFHMAVQTLPADDEHPADSIAEVFQKGYKLHERL
Sbjct:  121 EMTRDSLIQALKEEGVEEVEVDSFDHNFHMAVQTLPADDEHPADSIAEVFQKGYKLHERL 180

Query:  181 LRPAMVVVYN                                                  190
            LRPAMVVVYN
Sbjct:  181 LRPAMVVVYN                                                  190
```

Based on this analysis, it was predicted that these proteins and their epitopes could be useful antigens for vaccines or diagnostics.

EXAMPLE 2227

A DNA sequence (GBSx2346) was identified in *S. agalactiae* <SEQ ID 6875> which encodes the amino acid sequence <SEQ ID 6876>. This protein is predicted to be heat shock protein 70 (dnaK). Analysis of this protein sequence reveals the following:

```
Possible Site: 17
>>> Seems to have no N-terminal signal sequence

----- Final Results -----
            bacterial cytoplasm --- Certainty = 0.0996(Affirmative) < succ>
             bacterial membrane --- Certainty = 0.0000(Not Clear)   < succ>
              bacterial outside --- Certainty = 0.0000(Not Clear)   < succ>
```

A related DNA sequence was identified in *S. pyogenes* <SEQ ID 6877> which encodes the amino acid sequence <SEQ ID 6878>. Analysis of this protein sequence reveals the following:

```
Possible site: 17
>>> Seems to have no N-terminal signal sequence

----- Final Results -----
            bacterial cytoplasm --- Certainty = 0.0996(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below.

```
Identities = 594/609 (97%), Positives = 603/609 (98%),
Gaps = 1/609 (0%)

Query:    1 MSKIIGIDLGTTNSAVAVLEGTESKIIANPEGNRTTPSVVSFKNGEIIVGDAAKRQAVTN   60
            MSKIIGIDLGTTNSAVAVLEGTESKIIANPEGNRTTPSVVSFKNGEIIVGDAAKRQAVTN
Sbjct:    1 MSKIIGIDLGTTNSAVAVLEGTESKIIANPEGNRTTPSVVSFKNGEIIVGDAAKRQAVTN   60

Query:   61 PDTVISIKSKMGTSEKVSANGKEYTPQEISAMILQYLKGYAEDYLGEKVEKAVITVPAYF  120
            P+TVISIKSKMGTSEKVSANGKEYTPQEISAMILQYLKGYAEDYLGEKVEKAVITVPAYF
Sbjct:   61 PETVISIKSKMGTSEKVSANGKEYTPQEISAMILQYLKGYAEDYLGEKVEKAVITVPAYF  120

Query:  121 NDAQRQATKDAGKIAGLEVERIVNEPTAAALAYGMDKTDKDEKILVFDLGGGTFDVSILE  180
            NDAQRQATKDAGKIAGLEVERIVNEPTAAALAYGMDKTDKDEKILVFDLGGGTFDVSILE
Sbjct:  121 NDAQRQATKDAGKIAGLEVERIVNEPTAAALAYGMDKTDKDEKILVFDLGGGTFDVSILE  180

Query:  181 LGDGVFDVLATAGDNKLGGDDFDQKIIDFLVEEFKKENGIDLSQDKMALQRLKDAAEKAK  240
            LGDGVFDVLATAGDNKLGGDDFDQKIIDFLV EFKKENGIDLSQDKMALQRLKDAAEKAK
Sbjct:  181 LGDGVFDVLATAGDNKLGGDDFDQKIIDFLVAEFKKENGIDLSQDKMALQRLKDAAEKAK  240

Query:  241 KDLSGVTQTQISLPFITAGSAGPLHLEMSLSRAKFDDLTRDLVERTKTPVRQALSDAGLS  300
            KDLSGVTQTQISLPFITAGSAGPLHLEMSLSRAKFDDLTRDLVERTKTPVRQALSDAGLS
Sbjct:  241 KDLSGVTQTQISLPFITAGSAGPLHLEMSLSRAKFDDLTRDLVERTKTPVRQALSDAGLS  300

Query:  301 LSEIDEVILVGGSTRIPAVVEAVKAETGKEPNKSVNPDEVVAMGAAIQGGVITGDVKDVV  360
            LSEIDEVILVGGSTRIPAVVEAVKAETGKEPNKSVNPDEVVAMGAAIQGGVITGDVKDVV
Sbjct:  301 LSEIDEVILVGGSTRIPAVVEAVKAETGKEPNKSVNPDEVVAMGAAIQGGVITGDVKDVV  360

Query:  361 LLDVTPLSLGIETMGGVFTKLIDRNTTIPTSKSQVFSTAADNQPAVDIHVLQGERPMAAD  420
            LLDVTPLSLGIETMGGVFTKLIDRNTTIPTSKSQVFSTAADNQPAVDIHVLQGERPMAAD
Sbjct:  361 LLDVTPLSLGIETMGGVFTKLIDRNTTIPTSKSQVFSTAADNQPAVDIHVLQGERPMAAD  420

Query:  421 NKTLGRFQLTDIPAAPRGIPQIEVTFDIDKNGIVSVKAKDLGTQKEQHIVIQSNSGLTDE  480
            NKTLGRFQLTDIPAAPRGIPQIEVTFDIDKNGIVSVKAKDLGTQKEQHIVI+SN GL++E
Sbjct:  421 NKTLGRFQLTDIPAAPRGIPQIEVTFDIDKNGIVSVKAKDLGTQKEQHIVIKSNDGLSEE  480

Query:  481 EIDKMMKDAEANAEADAKRKEEVDLKNEVDQAIFATEKTIKETEGKGFDTERDAAQSALD  540
            EID+MMKDAEANAEADAKRKEEVDLKNEVDQAIFATEKTIKETEGKGFDTERDAAQSALD
```

```
                            -continued
Sbjct: 481 EIDRMMKDAEANAEADAKRKEEVDLKNEVDQAIFATEKTIKETEGKGFDTERDAAQSALD 540

Query: 541 ELKKAQESGNLDDMKAKLEALNEKAQALAVKLYEQAAAAQQAAQGAEGAQSADSSSKGDD 600
           ELK AQESGNLDDMKAKLEALNEKAQALAVK+YEQAAAAQQAAQGAEGAQ+ DS++  DD
Sbjct: 541 ELKAAQESGNLDDMKAKLEALNEKAQALAVKMYEQAAAAQQAAQGAEGAQANDSAN-NDD 599

Query: 601 VVDGEFTEK                                                  609
           VVDGEFTEK
Sbjct: 600 VVDGEFTEK                                                  608
```

Based on this analysis, it was predicted that these proteins and their epitopes could be useful antigens for vaccines or diagnostics.

EXAMPLE 2228

A DNA sequence (GBSx2347) was identified in *S. agalactiae* <SEQ ID 6879> which encodes the amino acid sequence <SEQ ID 6880>. This protein is predicted to be *Streptococcus pneumoniae* DnaJ protein homologue (dnaJ). Analysis of this protein sequence reveals the following:

```
Possible site: 18
>>> Seems to have no N-terminal signal sequence

----- Final Results -----
            bacterial cytoplasm --- Certainty = 0.4180(Affirmative) < succ>
             bacterial membrane --- Certainty = 0.0000(Not Clear)   < succ>
              bacterial outside --- Certainty = 0.0000(Not Clear)   < succ>
```

A related DNA sequence was identified in *S. pyogenes* <SEQ ID 6881> which encodes the amino acid sequence <SEQ ID 6882>. Analysis of this protein sequence reveals the following:

```
Possible site: 16
>>> Seems to have no N-terminal signal sequence

----- Final Results -----
            bacterial cytoplasm --- Certainty = 0.1322(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below.

```
Identities = 330/377 (87%), Positives = 357/377 (94%),
Gaps = 1/377 (0%)

Query:   1 MNNTEFYDRLGVSKDASQDEIKKAYRRMSKKYHPDINKETGAEEKYKEVQEAYETLSDTQ  60
           MNNTE+YDRLGVSKDASQD+IKKAYR+MSKKYHPDINKE GAE+KYK+VQEAYETLSD+Q
Sbjct:  19 MNNTEYYDRLGVSKDASQDDIKKAYRKMSKKYHPDINKEAGAEQKYKDVQEAYETLSDSQ  78

Query:  61 KRAAYDQYGAAGANGGFGGFDGGGFGGFDGGGFGGFEDIFSSFFGGGGMRNPNAPRQGDD 120
           KRAAYDQYGAAGA GGFGG  GGFGGFDGGGFGGFEDIFSSFFGGGG RNPNAPRQGDD
Sbjct:  79 KRAAYDQYGAAGAQGGFGG-GAGGFGGFDGGGFGGFEDIFSSFFGGGGSRNPNAPRQGDD 137

Query: 121 LQYRVNLSFEEAIFGAEKEVSYNRESSCHTCSGSGAKPGTSPVTCQKCHGSGVINVDTQT 180
           LQYRVNLSFEEA+FG EKEVSYNRE++C TC GSGAKPGT+PVTC+KCHGSGV+ +DTQT
Sbjct: 138 LQYRVNLSFEEAVFGVEKEVSYNREATCGTCLGSGAKPGTAPVTCRKCHGSGVMTIDTQT 197

Query: 181 PLGTMRRQVTCDVCQGSGQEIKEKCPTCHGTGHEKKTHKVSVKIPAGVETGQQIRLTGQG 240
           PLG MRRQVTCD+C GSG+EIKE C TCHGTGHEK+ HKVSVKIPAGVETGQQIRL GQG
Sbjct: 198 PLGMMRRQVTCDICHGSGKEIKEPCQTCHGTGHEKQAHKVSVKIPAGVETGQQIRLQGQG 257

Query: 241 EAGFNGGPYGDLFVIINVLPSQQFERNGSTIYYTLNISFVQAALGDTIDIPTVHGAVEMS 300
           EAGFNGGPYGDLFVI+NVLPS+QFERNGSTIYY L+ISF QAALGDT++IPTVHG VEM+
Sbjct: 258 EAGFNGGPYGDLFVILNVLPSKQFERNGSTIYYNLDISFTQAALGDTVEIPTVHGDVEMA 317
```

-continued

```
Query: 301 IPAGTQTGKTFRLRGKGAPKLRGGGQGDQHVTVNIVTPTKLNDAQKEALHAFAEASGDKM 360
            IPAGTQTGKTFRL+GKGAPKLRGGGQGDQHVTVNIVTPTKLNDAQ+EAL AFAEASG+KM
Sbjct: 318 IPAGTQTGKTFRLKGKGAPKLRGGGQGDQHVTVNIVTPTKLNDAQREALQAFAEASGEKM 377

Query: 361 VHPKKKGFFDKVKDALD                                          377
            +HPKKKGFFDKVKDAL+
Sbjct: 378 LHPKKKGFFDKVKDALE                                          394
```

Based on this analysis, it was predicted that these proteins and their epitopes could be useful antigens for vaccines or diagnostics.

EXAMPLE 2229

A DNA sequence (GBSx2348) was identified in *S. agalactiae* <SEQ ID 6883> which encodes the amino acid sequence <SEQ ID 6884>. Analysis of this protein sequence reveals the following:

```
Possible site: 59
>>> Seems to have no N-terminal signal sequence
    INTEGRAL      Likelihood = -0.22    Transmembrane     281-297 (281-297)

----- Final Results -----
              bacterial membrane --- Certainty = 0.1086(Affirmative) < succ>
              bacterial outside  --- Certainty = 0.0000(Not Clear)   < succ>
              bacterial cytoplasm --- Certainty = 0.0000(Not Clear)  < succ>
```

The protein has homology with the following sequences in the GENPEPT database.

```
>GP: AAD24445 GB: AF118389 unknown [Streptococcus suis]
Identities = 182/373 (48%), Positives = 257/373 (68%), Gaps = 5/373 (1%)

Query:   4 KVEEIRSYLIASIQNGKLAPGDRLPSIRQLANQFSCNKDTVQRVLMELRFDNYIYAKPRS   63
           K + I    ++   I+  +    G++LPSIRQL  Q+ C+KDTVQ+ ++EL++ N IYA  +S
Sbjct:   3 KYQVIIQDILTGIEEHRFKRGEKLPSIRQLREQYHCSKDTVQKAMLELKYQNKIYAVEKS   62

Query:  64 GYYVFDSHQEEVEEGVSLPNSEIANIAYDDFRLCLNETLIGREDYLFNYYYRQEGLLDLS  123
           GYY+ +   + +       + ++ I Y+DFR+CL E+LIGRE+YLFNYY++QEGL +L
Sbjct:  63 GYYILEDRDFQ-DHTCRAQSYRLSRITYEDFRICLKESLIGRENYLFNYYHQQEGLAELI  121

Query: 124 KAVAKLMEETGVYVPLDDIVITAGTQQALFILTQVTFPNRKSRVLIEEPTYPRMIELIKT  183
            +V  L+ +   VY   D +VITAG+QQAL+ILTQ+     K+ +LIE PTY RMIELI+
Sbjct: 122 SSVQSLLMDYHVYTKKDQLVITAGSQQALYILTQMETLAGKTEILIENPTYSRMIELIRH  181

Query: 184 QNLPYETISRGTHGIDFQRLEEIFQTQSIKFFYVIPRMHNPLGTSYNPVEMKRLIEMAEK  243
           Q +PY+TI R   GID + LE IFQT  IKFFY IPR+HNPLG++Y+         ++++A++
Sbjct: 182 QGIPYQTIERNLDGIDLEELESIFQTGKIKFFYTIPRLHNPLGSTYDIATKTAIVKLAKQ  241

Query: 244 YDVYIVEDDYMSDFASQS--PLHYYDTHGRVIYLKSFSKAIFPALRLAAICLPQALKSTF  301
           YDVYI+EDDY++DF S      PLHY DT  RVIY+KSF+  +FPALR+ AI LP  L+  F
Sbjct: 242 YDVYIIEDDYLADFDSSHSLPLHYLDTDNRVIYIKSFTPTLFPALRIGAISLPNQLRDIF  301

Query: 302 MAYKKLMDYDTNLILQKALALYIENGLYAKNSQYLKYRYQKDLANSKSILADHP-NLPSY  360
           + +K L+DYDTNLI+QKAL+LYI NG++A+N+Q+L  Y       K  L  +  N+P Y
Sbjct: 302 IKHKSLIDYDTNLIMQKALSLYIDNGMFARNTQHLHHIYHAQWNKIKDCLEKYALNIP-Y  360

Query: 361 SLHHDSVLFDCSK                                               373
            +    SV F  SK
Sbjct: 361 RIPKGSVTFQLSK                                               373
```

A related DNA sequence was identified in *S. pyogenes* <SEQ ID 6885> which encodes the amino acid sequence <SEQ ID 6886>. Analysis of this protein sequence reveals the following:

```
Possible site: 59
>>> Seems to have no N-terminal signal sequence

----- Final Results -----
            bacterial cytoplasm --- Certainty = 0.3043(Affirmative) < succ>
            bacterial membrane  --- Certainty = 0.0000(Not Clear)   < succ>
            bacterial outside   --- Certainty = 0.0000(Not Clear)   < succ>
```

An alignment of the GAS and GBS proteins is shown below.

```
Identities = 176/382 (46%), Positives = 255/382 (66%), Gaps = 7/382 (1%)

Query:   1 MVTKVEEIRSYLIASIQNGKLAPGDRLPSIRQLANQFSCNKDTVQRVLMELRFDNYIYAK   60
           M TK + I S +    IQ +L  GD+LPSIR L+  + C+KDTVQR L+EL++ + IYA
Sbjct:   1 MTTKYQTIISNIEQDIQKQRLKKGDKLPSIRVLSKVYYCSKDTVQRALLELKYRHLIYAV  60

Query:  61 PRSGYYVFDSHQEEVEEGVSLPNSEIANIAYDDFRLCLNETLIGREDYLFNYYYRQEGLL  120
           P+SGYYV  +   + ++L  +  N+AY+DFRLCLNE L  ++ YLF+YY++ EGL
Sbjct:  61 PKSGYYVL-GNVSMPDNVLNLSLEDYNNMAYEDFRLCLNEALSAKDKYLPHYYHKTEGLE  119

Query: 121 DLSKAVAKLMEETGVYVPLDDIVITAGTQQALFILTQVTFPNRKSRVLIEEPTYPRMIEL  180
           +L +A+   + E  VY   D ++IT+GTQQAL+IL+Q+ FPN    +L+E+PTY RM +
Sbjct: 120 ELREALLLYLAENSVYSNKDQLLITSGTQQALYILSQMPFPNTGKTILLEKPTYHRMEAI  179

Query: 181 IKTQNLPYETISRGTHGIDFQRLEEIFQTQSIKFFYVIPRMHNPLGTSYNPVEMKRLIEM  240
           +    LPY+TISR +G+D + LE +FQT  IKFFY I R  +PLG SY+  E + ++ +
Sbjct: 180 VAQLGLPYQTISRHFNGLDLELLESLFQTGDIKFFYTISRFSHPLGLSYSTKEKEAIVRL  239

Query: 241 AEKYDVYIVEDDYMSDFA--SQSPLHYYDTHGRVIYLKSFSKAIFPALRLAAICLPQALK  298
           A++Y VYI+EDDY+ DF    + P+HYYDTH R+IYLKSFS ++FPALR+ A+ LP  LK
Sbjct: 240 AQRYQVYILEDDYLGDFVKLKEPPIHYYDTHHRIIYLKSFSMSVFPALRIGALVLPSGLK  299

Query: 299 STFMAYKKLMDYDTNLILQKALALYIENGLYAKNSQYLKYRYQKDLANSKSILADHPNLP  358
           + F+  K L+D DTNL++QKALALY+ENG++ KN +++K RY K      ++     N P
Sbjct: 300 PHFLTQKSLIDLDTNLLMQKALALYLENGMFQKNLRFIK-RYLKQRERQLALFLKQ-NCP  357

Query: 359 S--YSLHHDSVLFDCSKLDNFK                                       378
              Y L    ++ D +  D+++
Sbjct: 358 DIHYQLTPTHLVIDYTTSDSYR                                       379
```

SEQ ID 6884 (GBS423) was expressed in *E. coli* as a His-fusion product. SDS-PAGE analysis of total cell extract is shown in FIG. 79 (lane 7; MW 49.3 kDa). It was also expressed in *E. coli* as a GST-fusion product. SDS-PAGE analysis of total cell extract is shown in FIG. 172 (lane 2; MW 74 kDa).

GBS423-GST was purified as shown in FIG. 219, lane 2-3.

Based on this analysis, it was predicted that these proteins and their epitopes could be useful antigens for vaccines or diagnostics.

EXAMPLE 2230

A DNA sequence (GBSx2349) was identified in *S. agalactiae* <SEQ ID 6887> which encodes the amino acid sequence <SEQ ID 6888>. This protein is predicted to be pseudouridylate synthase I (truA). Analysis of this protein sequence reveals the following:

```
Possible site: 58
>>> Seems to have no N-terminal signal sequence

----- Final Results -----
            bacterial cytoplasm --- Certainty = 0.3265(Affirmative) < succ>
            bacterial membrane  --- Certainty = 0.0000(Not Clear)   < succ>
            bacterial outside   --- Certainty = 0.0000(Not Clear)   < succ>
```

The protein has homology with the following sequences in the GENPEPT database.

```
>GP: BAB03886 GB: AP001507 tRNA pseudouridine synthase A
(pseudouridylate synthase I) [Bacillus halodurans]
Identities = 105/240 (43%), Positives = 147/240 (60%), Gaps = 2/240 (0%)

Query:    1 MTRYKAQISYDGSAFSGFQRQPNCRTVQEEIERTLKRLNSGNDVIIHGAGRTDVGVHAYG   60
            M R   +++YDG+ F+G+Q QPN RTVQ E+E  LK ++ G  + +  +GRTD GVHA G
Sbjct:    1 MKRIGLKVAYDGTDFAGYQIQPNERTVQGELESVLKNIHKGMSIRVTASGRTDTGVHARG   60

Query:   61 QVIHFDLPQARDVEKLRFGLDTQCPDDIDIVKVEQVSDDFHCRYDKHIKTYEFLVDIGRP  120
            Q++HFD   + V++    L++Q P DI +++   V  DFH RY    K Y + V
Sbjct:   61 QIVHFDTSLSFPVDRWPIALNSQLPADICVLEAADVPADFHARYSAKTKEYRYRVLTSAQ  120

Query:  121 KNPMMRNYATHYPYPVIIELMQEAIKDLVGTHDFTGFTASGTSVENKVRTIFDAKIQFEA  180
              +  RNY H  YP+ +E MQ A   L+GTHDF+ F A+   VE+KVRTI D  +  E
Sbjct:  121 ADVFRRNYTYHVRYPLDVEAMQRAAVQLLGTHDFSSFCAAKAEVEDKVRTIEDVALWREG  180

Query:  181 SKNLLIFTFTGNGFLYKQVRNMVGTLLKIGNGRMPISQIKTILQAKNRDLAGPTAAGNGL  240
             +  LIF+  GNGFLY  VR +VGTLL+IG G+    ++  IL A++R+ AG TA G+GL
Sbjct:  181 DE--LIFSIRGNGFLYNMVRIIVGTLLEIGAGKRSAEEVAKILAARSREAAGKTAPGHGL  238
```

A related DNA sequence was identified in S. pyogenes <SEQ ID 6889> which encodes the amino acid sequence <SEQ ID 6890>. Analysis of this protein sequence reveals the following:

```
Possible site: 58
>>> Seems to have no N-terminal signal sequence

----- Final Results -----
          bacterial cytoplasm --- Certainty = 0.2558(Affirmative) < succ>
          bacterial membrane  --- Certainty = 0.0000(Not Clear)   < succ>
           bacterial outside  --- Certainty = 0.0000(Not Clear)   < succ>
```

An alignment of the GAS and GBS proteins is shown below.

```
Identities = 184/249 (73%), Positives = 214/249 (85%)

Query:    1 MTRYKAQISYDGSAFSGFQRQPNCRTVQEEIERTLKRLNSGNDVIIHGAGRTDVGVHAYG   60
            M RYKA ISYDG+ FSGFQRQ + RTVQEEIE+TL +LN+G  +IIHGAGRTD GVHAYG
Sbjct:    1 MVRYKATISYDGTLFSGFQRQRHLRTVQEEIEKTLYKLNNGTKIIIHGAGRTDAGVHAYG   60

Query:   61 QVIHFDLPQARDVEKLRFGLDTQCPDDIDIVKVEQVSDDFHCRYDKHIKTYEFLVDIGRP  120
            QVIHFDLPQ ++VEKLRF LDTQ P+DID+V +E+V+DDFHCRY KH+KTYEFLVD GRP
Sbjct:   61 QVIHFDLPQEQEVEKLRFALDTQTPEDIDVVNIEKVADDFHCRYQKHLKTYEFLVDNGRP  120

Query:  121 KNPMMRNYATHYPYPVIIELMQEAIKDLVGTHDFTGFTASGTSVENKVRTIFDAKIQFEA  180
            KNPMMR+Y THYPY + I+LMQEAI  LVGTHDFTGFTA+GTSV+NKVRTI  A +  +
Sbjct:  121 KNPMMRHYTTHYPYTLNIKLMQEAINGLVGTHDFTGFTAAGTSVQNKVRTITKATVSRDE  180

Query:  181 SKNLLIFTFTGNGFLYKQVRNMVGTLLKIGNGRMPISQIKTILQAKNRDLAGPTAAGNGL  240
             + L+FTF+GNGFLYKQVRNMVGTLLKIGNG+MP+ Q+K IL +KNR LAGPT +GNGL
Sbjct:  181 KTDFLVFTFSGNGFLYKQVRNMVGTLLKIGNGQMPVEQVKVILSSKNRQLAGPTISGNGL  240

Query:  241 YLKEIIYED                                                    249
            YLKEI YE+
Sbjct:  241 YLKEICYEN                                                    249
```

Based on this analysis, it was predicted that these proteins and their epitopes could be useful antigens for vaccines or diagnostics.

EXAMPLE 2231

A DNA sequence (GBSx2350) was identified in *S. agalactiae* <SEQ ID 6891> which encodes the amino acid sequence <SEQ ID 6892>. This protein is predicted to be phosphomethypyrimidine kinase (thiD). Analysis of this protein sequence reveals the following:

```
Possible site: 45
>>> Seems to have no N-terminal signal sequence

----- Final Results -----
            bacterial cytoplasm --- Certainty = 0.2051(Affirmative) < succ>
             bacterial membrane --- Certainty = 0.0000(Not Clear)   < succ>
              bacterial outside --- Certainty = 0.0000(Not Clear)   < succ>
```

The protein has homology with the following sequences in the GENPEPT database.

```
>GP: CAB15828 GB: Z99123 phosphomethylpyrimidine kinase
[Bacillus subtilis]
Identities = 95/253 (37%), Positives = 150/253 (58%), Gaps = 13/253 (5%)

Query:   1 MKTRNVLAISGNDIFSGGGLHADLATYVVNKLHGFVAVTCLTAMSDKG---FEVIPIEAS    57
           M     L I+G+D   G G+ ADL T+    ++G  A+T + AM        +V PI+
Sbjct:   1 MSMHKALTIAGSDSSGGAGIQADLKTFQEKNVYGMTALTVIVAMDPNNSWNHQVFPIDTD   60

Query:  58 ILKQQLESLKD-VEFGSIKLGLLPNVETAQVVLEFVKSKQECPVVLDPVLVCKENHDL--  114
           ++ QL ++ D +    ++K G+LP V+  ++ + +K KQ    VV+DPV+VCK   +++
Sbjct:  61 TIRAQLATITDGIGVDAMKTGMLPTVDIIELAAKTIKEKQLKNVVIDPVMVCKGANEVLY  120

Query: 115 --EVSQLREQLIAFFPYADVITPNLVEAQLLTGLS-IENLDQMKIAAEKLYDMGAKHVVI  171
             LREQL      P A VITPNL EA  L+G+   ++ +D M   AA+K++ +GA++VVI
Sbjct: 121 PEHAQALREQLA---PLATVITPNLFEASQLSGMDELKTVDDMIEAAKKIHALGAQYVVI  177

Query: 172 KGGNRLNAEEATDLYYDGERFETYVFPVVDANNT-GAGCTFASSIASQLAMGKNVEDAVK  230
           GG +L  E+A D+ YDGE  E      ++D   T  GAGCTF++++ ++LA G  V++A+
Sbjct: 178 TGGGKLKHEKAVDVLYDGETAEVLESEMIDTPYTHGAGCTFSAAVTAELAKGAEVKEAIY  237

Query: 231 MSKGFVYQAIKAS                                                243
           +K F+   AIK S
Sbjct: 238 AAKEFITAAIKES                                                250
```

A related DNA sequence was identified in *S. pyogenes* <SEQ ID 4407> which encodes the amino acid sequence <SEQ ID 4408>. Analysis of this protein sequence reveals the following:

```
Possible site: 36
>>> Seems to have no N-terminal signal sequence

----- Final Results -----
            bacterial cytoplasm --- Certainty = 0.2029(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below.

```
Identities = 135/252 (53%), Positives = 174/252 (68%)

Query:   1 MKTRNVLAISGNDIFSGGGLHADLATYVVNKLHGFVAVTCLTAMSDKGFEVIPIEASILK   60
           MKT  ++ ISGNDI SGGGL+ADLATY+   L   FVAVTCLT S++GF + P+    I +
Sbjct:   1 MKTDYIVTISGNDILSGGGLYADLATYIRYDLQAFVAVTCLTTRSEEGFSLFPVAKEIFR   60

Query:  61 QQLESLKDVEFGSIKLGLLPNVETAQVVLEFVKSKQECPVVLDPVLVCKENHDLEVSQLR  120
           QL  S +      +IK+GLLPN E  ++VL+F+K        PVVLDPVL CKE  D+++  LR
```

-continued

```
Sbjct:  61 DQLNSFTNAPISAIKIGLLPNAEMCEIVLDFIKGHLGIPVVLDPVLACKEIDDVKIVPLR 120

Query: 121 EQLIAFFPYADVITPNLVEAQLLTGLSIENLDQMKIAAEKLYDMGAKHVVIKGGNRLNAE 180
           ++++   PY V+TPNLVEAQLL+   I +L  M+ AA+   Y +GAK VVIKGGNR + +
Sbjct: 121 QEILQLLPYVTVVTPNLVEAQLLSQKEIVSLKDMQEAAKYFYQLGAKQVVIKGGNRFSQK 180

Query: 181 EATDLYYDGERFETYVFPVVDANNTGAGCTFASSIASQLAMGKNVEDAVKMSKGFVYQAI 240
           +A DL+YDG+   T   PV++ NN GAGCTFASSIASQL    K  +AVK SK  VYQAI
Sbjct: 181 KAIDLFYDGKEIVTLECPVLEKNNIGAGCTFASSIASQLVKKKTPLEAVKNSKELVYQAI 240

Query: 241 KASDKYGVVQHF                                                 252
           SD+YGV Q +
Sbjct: 241 LQSDRYGVKQSY                                                 252
```

Based on this analysis, it was predicted that these proteins and their epitopes could be useful antigens for vaccines or diagnostics.

EXAMPLE 2232

A DNA sequence (GBSx2351) was identified in *S. agalactiae* <SEQ ID 6893> which encodes the amino acid sequence <SEQ ID 6894>. Analysis of this protein sequence reveals the following:

```
Possible site: 45
>>> Seems to have a cleavable N-term signal seq.
    INTEGRAL     Likelihood = -6.05    Transmembrane    97-113 (96-119)
    INTEGRAL     Likelihood = -0.22    Transmembrane    54-70  (54-70)

----- Final Results -----
           bacterial membrane  --- Certainty = 0.3421(Affirmative) < succ>
           bacterial outside   --- Certainty = 0.0000(Not Clear)   < succ>
           bacterial cytoplasm --- Certainty = 0.0000(Not Clear)   < succ>
```

The protein has homology with the following sequences in the GENPEPT database.

```
>GP: BAA30952 GB: AP000007 202aa long hypothetical protein [Pyrococcus
horikoshii]
Identities = 48/148 (32%), Positives = 78/148 (52%), Gaps = 9/148 (6%)

Query:  10 VQLAIVTAISIVLGMFISIPTPTGFLTLLDAGIFFAAFYFGKKEGAVVGALAGFLIDLLK  69
           V  A+VTA+++V+    I IP   G+L    D I    +  FG    G   G +   DLL
Sbjct:  49 VMAALVTAMTMVIR--IPIPASQGYLNFGDIMIMLTSVLFGPLVGGFAGGVGSAFADLL- 105

Query:  70 GYPNWMFFSLLIHGTQGYLAGLPGR------RRLLGLISATLVMVLGYAIASGLMYGWGA 123
           GYP+W  F+L+I GT+G  + G        +  LLG +    VMV+GY   + ++YG
Sbjct: 106 GYPSWALFTLVIKGTEGIIVGYFSKGEANYGKILLGTVLGGSVMVIGYVSVAYVLYGPAG 165

Query: 124 VLPDIPGNIMQNMVGMVVGFALNKSLER                                151
           + ++  +I+Q + G+V+G   L   L++
Sbjct: 166 AIGELYNDIVQAVSGIVIGGGLGYILKK                                193
```

A related DNA sequence was identified in *S. pyogenes* <SEQ ID 6895> which encodes the amino acid sequence <SEQ ID 6896>. Analysis of this protein sequence reveals the following:

```
Possible site: 54
>>> Seems to have a cleavable N-term signal seq.
    INTEGRAL     Likelihood = -4.62    Transmembrane    98-114  (97-119)
    INTEGRAL     Likelihood = -0.00    Transmembrane    135-151 (135-151)

----- Final Results -----
           bacterial membrane  --- Certainty = 0.2848(Affirmative) < succ>
           bacterial outside   --- Certainty = 0.0000(Not Clear)   < succ>
           bacterial cytoplasm --- Certainty = 0.0000(Not Clear)   < succ>
```

The protein has homology with the following sequences in the databases:

```
>GP: CAB49310 GB: AJ248284 hypothetical protein [Pyrococcus abyssi]
Identities = 42/145 (28%), Positives = 73/145 (49%), Gaps = 10/145 (6%)

Query:   7 RQMSLTGILTALVVVLGRFVMLPTPT--GFLTLLDAGIYAVSFSFGSAQGAIVGGLSGFL    64
           R ++++ +   ALV  +     + +P P    G+L    D  I  V+   FG   G   GG+  +
Sbjct:  39 RTVAISAVAAALVTAMTMVIRIPIPASQGYLNFGDIMIMLVAVLFGPLVGGFAGGVGSAI    98

Query:  65 IDLVAGYPQWMFHSLIAHSVQGYFAGWRGR------KRWLGVVIGSFIMIFWYFLGSLML   118
           DL+ GYP W   +LI   +G   G+ +          K  +G V+G FIM+  Y   S +L
Sbjct:  99 ADLI-GYPSWALFTLIIKGSEGLVVGYFSKGEPNYSKILIGTVLGGFIMVLGYVSVSYVL   157

Query: 119 GYGLSGSLAGIWGNVMQNTLGLFVG                                     143
            YG +G+++ ++ + +Q    G+ +G
Sbjct: 158 -YGPAGAISELYNDTVQAVSGIVIG                                     181
```

An alignment of the GAS and GBS proteins is shown below.

```
Identities = 77/155 (49%), Positives = 106/155 (67%), Gaps = 1/155 (0%)

Query:   1 MRKEKTSQLVQLAIVTAISIVLGMFISIPTFTGFLTLLDAGIFFAAFYFGKKEGAVVGAL    60
           M+  K  Q+     I+TA+ +VLG F+ +PTPTGFLTLLDAGI+   +F FG   +GA+VG L
Sbjct:   1 MQNSKIRQMSLTGILTALVVVLGRFVMLPTPTGFLTLLDAGIYAVSFSFGSAQGAIVGGL    60

Query:  61 AGFLIDLLKGYPNWMFFSLLIHGTQGYLAGLPGRRLLGLISATLVMVLGYAIASGLM-Y   119
           +GFLIDL+ GYP WMF  SL+ H  QGY AG  GR+R LG++  +  +M+   Y  S ++ Y
Sbjct:  61 SGFLIDLVAGYPQWMFHSLIAHSVQGYFAGWRGRKRWLGVVIGSFIMIFWYFLGSLMGY   120

Query: 120 GWGAVLPDIPGNIMQNMVGMVVGFALNKSLERVKK                           154
           G    L  I GN+MQN +G+ VGF + K++ R KK
Sbjct: 121 GLSGSLAGIWGNVMQNTLGLFVGFIIFKAILRQKK                           155
```

Based on this analysis, it was predicted that these proteins and their epitopes could be useful antigens for vaccines or diagnostics.

EXAMPLE 2233

A DNA sequence (GBSx2352) was identified in *S. agalactiae* <SEQ ID 6897> which encodes the amino acid sequence <SEQ ID 6898>. Analysis of this protein sequence reveals the following:

```
Possible site: 43
>>> Seems to have no N-terminal signal sequence

----- Final Results -----
           bacterial cytoplasm --- Certainty = 0.0881(Affirmative) < succ>
           bacterial membrane  --- Certainty = 0.0000(Not Clear)   < succ>
            bacterial outside  --- Certainty = 0.0000(Not Clear)   < succ>
```

The protein has homology with the following sequences in the GENPEPT database.

```
>GP: CAB15708 GB: Z99122 alternate gene name: ipc-33d [Bacillus subtilis]
Identities = 91/176 (51%), Positives = 115/176 (64%)

Query:   6 NKLKQETKAIVVDIIERSALKKGQIFVLGLSSSEVSGGLIGKNSSSEIGEIIVEVILKEL    65
           N+LKQ   K   ++   +++ LK+ Q+FVLG S+SEV+G    IG + S +I E I    + +
Sbjct:   2 NELKQTWKTMLSEFQDQAELKQDQLFVLGCSTSEVAGSRIGTSGSVDIAESIYSGLAELR    61

Query:  66 HSRGIYLAVQGCEHVNRALVVEAELAERQQLEVVNVVPNLHAGGSGQVAAFKLMTSPVEV   125
               GI+LA Q  CEH+NRALVVEAE A+    +L V+ VP       AGG+     AFK M SPV V
Sbjct:  62 EKTGIHLAFQCCEHLNRALVVEAETAKLFRLPTVSAVPVPKAGGAMASYAFKQMKSPVLV   121

Query: 126 EEIVAHAGIDIGDTSIGMHIKRVQVPLIPISRELGGAHVTALASRPKLIGGARAGY       181
           E I A  AGIDIGDT +IGMH+K V VP+        LG  AHVT   +RPKLIGG RA Y
Sbjct: 122 ETIQADAGIDIGDTFIGMHLKPVAVPVRVSQNSLGSAHVTLARTRPKLIGGVRAVY       177
```

A related DNA sequence was identified in *S. pyogenes* <SEQ ID 6899> which encodes the amino acid sequence <SEQ ID 6900>. Analysis of this protein sequence reveals the following:

```
Possible site: 40
>>> Seems to have no N-terminal signal sequence

----- Final Results -----
            bacterial cytoplasm --- Certainty = 0.2166(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below.

```
Identities = 132/183 (72%), Positives = 161/183 (87%)

Query:    6 NKLKQETKAIVVDIIERSALKKGQIFVLGLSSSEVSGGLIGKNSSSEIGEIIVEVILKEL   65
            N L+++T+ IV+D++ERSA++ G +FVLGLSSSE+ G  IGK SS E+G+I+VEV+L EL
Sbjct:    3 NNLEKQTREIVIDVVERSAIQPGNLFVLGLSSSEILGSRIGKQSSLEVGQIVVEVVLDEL   62

Query:   66 HSRGIYLAVQGCEHVNRALVVEAELAERQQLEVVNVVPNLHAGGSGQVAAFKLMTSPVEV  125
             + RG++LAVQGCEHVNRALVVE  +AE +QLE+VNVVPNLHAGGS Q+AAF+LM+ PVEV
Sbjct:   63 NKRGVHLAVQGCEHVNRALVVERHVAESKQLEIVNVVPNLHAGGSAQMAAFQLMSDPVEV  122

Query:  126 EEIVAHAGIDIGDTSIGMHIKRVQVPLIPISRELGGAHVTALASRPKLIGGARAGYTSDP  185
            EE++AHAG+DIGDT+IGMHIKRVQ+PLIP  RELGGAHVTALASRPKLIGGARA Y  D
Sbjct:  123 EEVIAHAGLDIGDTAIGMHIKRVQIPLIPCQRELGGAHVTALASRPKLIGGARADYNMDI  182

Query:  186 IRK                                                          188
            IRK
Sbjct:  183 IRK                                                          185
```

Based on this analysis, it was predicted that these proteins and their epitopes could be useful antigens for vaccines or diagnostics.

EXAMPLE 2234

A DNA sequence (GBSx2353) was identified in *S. agalactiae* <SEQ ID 6901> which encodes the amino acid sequence <SEQ ID 6902>. Analysis of this protein sequence reveals the following:

```
Possible site: 56
>>> Seems to have no N-terminal signal sequence
      INTEGRAL      Likelihood = -11.25     Transmembrane    21-37  (13-46)
      INTEGRAL      Likelihood =  -4.30     Transmembrane    78-94  (76-113)
      INTEGRAL      Likelihood =  -2.07     Transmembrane    96-112 (95-113)

----- Final Results -----
             bacterial membrane --- Certainty = 0.5501(Affirmative) < succ>
              bacterial outside --- Certainty = 0.0000(Not Clear)   < succ>
            bacterial cytoplasm --- Certainty = 0.0000(Not Clear)   < succ>
```

The protein has homology with the following sequences in the GENPEPT database.

```
>GP: BAB06385 GB: AP001516 unknown conserved protein [Bacillus halodurans]
Identities = 105/261 (40%), Positives = 150/261 (57%), Gaps = 2/261 (0%)

Query:   12 NVEEVLFTFFTKLIS--ILLLIIAFVIVRQVINYLFEKTVNRSLAFSRQKVARQKTLAKL   69
            N+     F  T +I+  +L+ +IAF+IVR +   +  + R    ++ R TL KL
Sbjct:    7 NITSGAFLASTFIIAGKVLVAVIAFLIVRAIGKRIISNSFARMAKNNQLSSGRVVTLEKL   66

Query:   70 SHNVLNYTLYFFLFYWILSILGVPISSLLAGAGIAGVAIGLGAQGFLSDVVNGFFILLEN  129
            S N  +YTL F     +L+I G+  S+L+AGAGI G+AIG GAQG +SD+V GFFILLE
Sbjct:   67 SLNAFSYTLMFIFATTLLTIFGLNPSALIAGAGIVGLAIGFGAQGLVSDIVTGFFILLEK  126

Query:  130 QFDVGDIINVGTVSGTVTNVGIRTTQIHDFDGTLHFIPNRNITIVSNKSRSNMRAQIDIP  189
            Q DVGD +  G V G V  VG+RT  I  FDGTLH+IPNRNI  VSN SR NMRA +DI
```

```
-continued
Sbjct: 127 QIDVGDYVTAGGVDGIVEEVGLRTALIRGFDGTLHYIPNRNIANVSNHSRGNMRALVDIS 186

Query: 190 LFVHTNLDQISDIVTKINEEYVSKHPAIVGEPTVFGPTTNANGQFVYRINIFTQNGAQFD 249
            + + N+D+  ++ K+ ++   +    I+  P V G     +    V RI    T+N  Q+
Sbjct: 187 ISYNDNIDEAISVMQKVCDQLAEQDERIIEGPDVIGVQNLGDSDVVIRIIAKTENMEQWS 246

Query: 250 IYAEFYKLYQKAILEEGIDLP                                         270
            +      K   ++A+      I++P
Sbjct: 247 VERLLRKQLKEALEAHNIEIP                                         267
```

A related DNA sequence was identified in *S. pyogenes* <SEQ ID 6903> which encodes the amino acid sequence <SEQ ID 6904>. Analysis of this protein sequence reveals the following:

```
Possible site: 54
>>> Seems to have no N-terminal signal sequence
    INTEGRAL       Likelihood = -8.49       Transmembrane    24-40  (15-45)
    INTEGRAL       Likelihood = -4.83       Transmembrane    78-94  (73-99)
    INTEGRAL       Likelihood = -2.07       Transmembrane    96-112 (95-113)

----- Final Results -----
         bacterial membrane --- Certainty = 0.4397(Affirmative) < succ>
         bacterial outside  --- Certainty = 0.0000(Not Clear)   < succ>
       bacterial cytoplasm  --- Certainty = 0.0000(Not Clear)   < succ>
```

The protein has homology with the following sequences in the databases:

```
>GP: BAB06385 GB: AP001516 unknown conserved protein
[Bacillus halodurans]
Identities = 104/249 (41%), Positives = 151/249 (59%), Gaps = 4/249 (1%)

Query:  22 KKLVSLIILLLFFAILKRVTNYLFEKTINKSFAYSRQSEARKKTLSKLTHNILNYLLYFL   81
            K LV++I  L+  AI KR+ + F +   +    + S  R  TL KL+ N  +Y L F+
Sbjct:  23 KVLVAVIAFLIVRAIGKRIISNSFARMAKNN----QLSSGRVVTLEKLSLNAFSYTLMFI   78

Query:  82 LIYWILSLFGIPVSSLLAGAGIAGVAIGLGAQGFLSDVVNGFFILFENQFEVGDNVTISD  141
             +L++FG+   S+L+AGAGI G+AIG GAQG +SD+V GFFIL E Q +VGD VT
Sbjct:  79 FATTLLTIFGLNPSALIAGAGIVGLAIGFGAQGLVSDIVTGFFILLEKQIDVGDYVTAGG  138

Query: 142 IEGSVFGVGIRTTQIRGFDGTLHFIPNRSITVVSNKSRGNMRALIEIPLYSTVNLSQVTR  201
            ++G V  VG+RT  IRGFDGTLH+IPNR+I  VSN SRGNMRAL++ +      N+ +
Sbjct: 139 VDGIVEEVGLRTALIRGFDGTLHYIPNRNIANVSNHSRGNMRALVDISISYNDNIDEAIS  198

Query: 202 IIDEVNQKELPNHPQIVGKPNILGPQNNSNGQFTFRIAIFTENGEQFKIYHTFYRLYQEA  261
            ++  +V +      +I+  P+++G QN  +   RI   TEN EQ+ +     +  +EA
Sbjct: 199 VMQKVCDQLAEQDERIIEGPDVIGVQNLGDSDVVIRIIAKTENMEQWSVERLLRKQLKEA  258

Query: 262 LLKEGIQLP                                                     270
            L    I++P
Sbjct: 259 LEAHNIEIP                                                     267
```

An alignment of the GAS and GBS proteins is shown below.

```
Identities = 164/265 (61%), Positives = 215/265 (80%)

Query:   7 FIDHLNVEEVLFTFFTKLISILLLIIAFVIVRQVINYLFEKTVNRSLAFSRQKVARQKTL   66
           +++ ++E +   T F KL+S+++L++ F I+++V NYLFEKT+N+S A+SRQ  AR+KTL
Sbjct:   7 YLEQSHIENIGLTIFKKLVSLIILLLFFAILKRVTNYLFEKTINKSFAYSRQSEARKKTL   66

Query:  67 AKLSHNVLNYTLYFFLFYWILSILGVPISSLLAGAGIAGVAIGLGAQGFLSDVVNGFFIL  126
           +KL+HN+LNY LYF L  YWILS+ G+P+SSLLAGAGIAGVAIGLGAQGFLSDVVNGFFIL
Sbjct:  67 SKLTHNILNYLLYFLLIYWILSLFGIPVSSLLAGAGIAGVAIGLGAQGFLSDVVNGFFIL  126

Query: 127 LENQFDVGDIINVGTVSGTVTNVGIRTTQIHDFDGTLHFIPNRNITIVSNKSRSNMRAQI  186
              ENQF+VGD +  +   +G+V  VGIRTTQI  FDGTLHFIPNR+IT+VSNKSR NMRA I
Sbjct: 127 FENQFEVGDNVTISDIEGSVFGVGIRTTQIRGFDGTLHFIPNRSITVVSNKSRGNMRALI  186

Query: 187 DIPLFVHTNLDQISDIVTKINEEYVSKHPAIVGEPTVFGPTTNANGQFVYRINIFTQNGA  246
            +IPL+    NL Q++  I+  ++N++  +  HP  IVG+P + GP   N+NGQF +RI IFT+NG
```

-continued

```
Sbjct: 187 EIPLYSTVNLSQVTRIIDEVNQKELPNHPQIVGKPNILGPQNNSNGQFTFRIAIFTENGE 246

Query: 247 QFDIYAEFYKLYQKAILEEGIDLPT                                    271
            QF IY  FY+LYQ+A+L+EGI LPT
Sbjct: 247 QFKIYHTFYRLYQEALLKEGIQLPT                                    271
```

Based on this analysis, it was predicted that these proteins and their epitopes could be useful antigens for vaccines or diagnostics.

EXAMPLE 2235

A DNA sequence (GBSx2354) was identified in *S. agalactiae* <SEQ ID 6905> which encodes the amino acid sequence <SEQ ID 6906>. This protein is predicted to be RopA (tig). Analysis of this protein sequence reveals the following:

```
Possible site: 20
>>> Seems to have no N-terminal signal sequence

----- Final Results -----
            bacterial cytoplasm --- Certainty = 0.1785(Affirmative) < succ>
             bacterial membrane --- Certainty = 0.0000(Not Clear)   < succ>
              bacterial outside --- Certainty = 0.0000(Not Clear)   < succ>
```

A related GBS nucleic acid sequence <SEQ ID 9283> which encodes amino acid sequence <SEQ ID 9284> was also identified.

A related DNA sequence was identified in *S. pyogenes* <SEQ ID 6907> which encodes the amino acid sequence <SEQ ID 6908>. Analysis of this protein sequence reveals the following:

```
Possible site: 49
>>> Seems to have no N-terminal signal sequence

----- Final Results -----
            bacterial cytoplasm --- Certainty = 0.0776(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below.

```
Identities = 303/354 (85%), Positives = 337/354 (94%)

Query:   1 MSTSFENKATNRGIITFTISQDEIKPALDQAFNKVKKDLNVPGFRKGHMPRTVFNQKFGE   60
           MSTSFENKATNRG+ITFTISQD+IKPALD+AFNK+KKDLN PGFRKGHMPR VFNQKFGE
Sbjct:  30 MSTSFENKATNRGVITFTISQDKIKPALDKAFNKIKKDLNAPGFRKGHMPRPVFNQKFGE   89

Query:  61 EALYENALNLVLPKAYEAAVAELGLDVVAQPKIDVVSMEKGQDWKLTAEVVTKPEVKLGD  120
           E LYE+ALN+VLP AYEAAV ELGLDVVAQPKIDVVSMEKG++W L+AEVVTKPEVKLGD
Sbjct:  90 EVLYEDALNIVLPEAYEAAVTELGLDVVAQPKIDVVSMEKGKEWTLSAEVVTKPEVKLGD  149

Query: 121 YKDLSVEVDASKEVSDEEVDAKVERERNNLAELTVKDGEAAQGDTVVIDFVGSVDGVEFD  180
           YK+L VEVDASKEVSDE+VDAK+ERER NLAEL +KDGEAAQGDTVVIDFVGSVDGVEFD
Sbjct: 150 YKNLVVEVDASKEVSDEDVDAKIERERQNLAELIIKDGEAAQGDTVVIDFVGSVDGVEFD  209

Query: 181 GGKGDNFSLELGSGQFIPGFEEQLVGSKAGQTVDVNVTFPEDYQAEDLAGKDAKFVTTIH  240
           GGKGDNFSLELGSGQFIPGFE+QLVG+KAG  V+VNVTFPE YQAEDLAGK AKF+TTIH
Sbjct: 210 GGKGDNFSLELGSGQFIPGFEDQLVGAKAGDEVEVNVTFPESYQAEDLAGKAAKFMTTIH  269

Query: 241 EVKTKEVPALDDELAKDIDDEVETLDELKAKYRKELESAKEIAFDDAVEGAAIELAVANA  300
           EVKTKEVP LDDELAKDID++V+TL++LK KYRKELE+A+E A+DDAVEGAAIELAVANA
Sbjct: 270 EVKTKEVPELDDELAKDIDEDVDTLEDLKVKYRKELEAAQETAYDDAVEGAAIELAVANA  329

Query: 301 EIVELPEEMVHDEVHRAMNEFMGNMQRQGISPEMYFQLTGTTEEDLHKQYQADA        354
           EIV+LPEEM+H+EV+R++NEFMGNMQRQGISPEMYFQLTGTT+EDLH QY A+A
Sbjct: 330 EIVDLPEEMIHEEVNRSVNEFMGNMQRQGISPEMYFQLTGTTQEDLHNQYSAEA        383
```

Based on this analysis, it was predicted that these proteins and their epitopes could be useful antigens for vaccines or diagnostics.

EXAMPLE 2236

A DNA sequence (GBSx2355) was identified in *S. agalactiae* <SEQ ID 6909> which encodes the amino acid sequence <SEQ ID 6910>. This protein is predicted to be galactose-6-phosphate isomerase laca subunit (rpiB). Analysis of this protein sequence reveals the following:

```
Possible site: 26
>>> Seems to have no N-terminal signal sequence

----- Final Results -----
            bacterial cytoplasm --- Certainty = 0.3491(Affirmative) < succ>
              bacterial membrane --- Certainty = 0.0000(Not Clear) < succ>
                bacterial outside --- Certainty = 0.0000(Not Clear) < succ>
```

The protein has homology with the following sequences in the GENPEPT database.

```
>GP: AAA25177 GB: M60447 galactose 6-P isomerase [Lactococcus lactis]
Identities = 92/141 (65%), Positives = 115/141 (81%)

Query:    1 MTIIIGADAHGVELKEVIRQHLTSLGKEIIDLTDTSKDFVDNTLAIVAKVNQKEDNLGIM   60
            M I++GAD  G  LK+V++  L   G E+ID+T    +DFVD TLA+ ++VN+ E NLGI+
Sbjct:    1 MAIVVGADLKGTRLKDVVKNFLVEEGFEVIDVTKDGQDFVDVTLAVASEVNKDEQNLGIV   60

Query:   61 VDAYGVGPFMVATKVKGMIAAEVSDERSAYMTRAHNNARMITLGSEIVGPGVAKHIVEGF  120
            +DAYG GPFMVATK+KGM AAEVSDERSAYMTR HNNARMIT+G+EIVG  +AK+I + F
Sbjct:   61 IDAYGAGPFMVATKIKGMVAAEVSDERSAYMTRGHNNARMITVGAEIVGDELAKNIAKAF  120

Query:  121 VDGTYDAGRHQIRVDMLNKMC                                       141
            V+G YD GRHQ+RVDMLNKMC
Sbjct:  121 VNGKYDGGRHQVRVDMLNKMC                                       141
```

A related DNA sequence was identified in *S. pyogenes* <SEQ ID 6911> which encodes the amino acid sequence <SEQ ID 6912>. Analysis of this protein sequence reveals the following:

```
Possible site: 45
>>> Seems to have no N-terminal signal sequence

----- Final Results -----
            bacterial cytoplasm --- Certainty = 0.3224(Affirmative) < succ>
              bacterial membrane --- Certainty = 0.0000(Not Clear) < succ>
                bacterial outside --- Certainty = 0.0000(Not Clear) < succ>
```

An alignment of the GAS and GBS proteins is shown below.

```
Identities = 101/140 (72%), Positives = 117/140 (83%)

Query:    1 MTIIIGADAHGVELKEVIRQHLTSLGKEIIDLTDTSKDFVDNTLAIVAKVNQKEDNLGIM   60
            M II+GADAHG  LKE+I+  L   G +IID+TD + DF+DNTLA+    VN+ E   LGIM
Sbjct:    1 MAIILGADAHGNALKELIKSFLQEEGYDIIDVTDINSDFIDNTLAVAKAVNEAEGRLGIM   60

Query:   61 VDAYGVGPFMVATKVKGMIAAEVSDERSAYMTRAHNNARMITLGSEIVGPGVAKHIVEGF  120
            VDAYG GPFMVATK+KGM+AAEVSDERSAYMTR HNNARMIT+G+EIVGP +AK+IV+GF
Sbjct:   61 VDAYGAGPFMVATKLKGMVAAEVSDERSAYMTRGHNNARMITIGAEIVGPELAKNIVKGF  120

Query:  121 VDGTYDAGRHQIRVDMLNKM                                        140
            V G YD GRHQIRVDMLNKM
Sbjct:  121 VTGPYDGGRHQIRVDMLNKM                                        140
```

Based on this analysis, it was predicted that these proteins and their epitopes could be useful antigens for vaccines or diagnostics.

EXAMPLE 2237

A DNA sequence (GBSx2356) was identified in *S. agalactiae* <SEQ ID 6913> which encodes the amino acid sequence <SEQ ID 6914>. This protein is predicted to be galactose-6-phosphate isomerase lacb subunit (rpiB). Analysis of this protein sequence reveals the following:

```
Possible site: 35
>>> Seems to have no N-terminal signal sequence

----- Final Results -----
            bacterial cytoplasm --- Certainty = 0.2511(Affirmative) < succ>
             bacterial membrane --- Certainty = 0.0000(Not Clear)   < succ>
              bacterial outside --- Certainty = 0.0000(Not Clear)   < succ>
```

A related GBS nucleic acid sequence <SEQ ID 10189> which encodes amino acid sequence <SEQ ID 10190> was also identified.

The protein has homology with the following sequences in the GENPEPT database.

```
>GP: AAA25178 GB: M60447 galactose 6-P isomerase [Lactococcus lactis]
Identities = 138/171 (80%), Positives = 157/171 (91%)

Query:  10 MKIAVGCDHIVTYDKIAVVDYLKTKGYEVIDCGTYDNIRTHYPIYGKKVGEAVASGKADL   69
           M+IA+GCDHIVT  K+AV ++LK+KGYEV+D GTYD++RTHYPIYGKKVGEAV SG+ADL
Sbjct:   1 MRIAIGCDHIVTDVKMAVSEFLKSKGYEVLDFGTYDHVRTHYPIYGKKVGEAVVSGQADL   60

Query:  70 GVCICGTGVGINNAVNKVPGIRSALVRDLTSAIYAKEELNANVIGFGGKITGGLLMTDII  129
           GVCICGTGVGINNAVNKVPG+RSALVRD+TSA+YAKEELNANVIGFGGG ITGGLLM DII
Sbjct:  61 GVCICGTGVGINNAVNKVPGVRSALVRDMTSALYAKEELNANVIGFGGMITGGLLMNDII  120

Query: 130 EAFIRAKYKPTKENKVLIEKIAEVETHNAHQEENDFFTEFLDKWNRGEYHD           180
           EAFI A+YKPT+ENK LI KI  VETHNAHQ + +FFTEFL+KW+RGEYHD
Sbjct: 121 EAFIEAEYKPTEENKKLIAKIEHVETHNAHQADEEFFTEFLEKWDRGEYHD           171
```

A related DNA sequence was identified in *S. pyogenes* <SEQ ID 6915> which encodes the amino acid sequence <SEQ ID 6916>. Analysis of this protein sequence reveals the following:

```
Possible site: 57
>>> Seems to have no N-terminal signal sequence

----- Final Results -----
            bacterial cytoplasm --- Certainty = 0.3048(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below.

```
Identities = 136/171 (79%), Positives = 160/171 (93%)

Query:  10 MKIAVGCDHIVTYDKIAVVDYLKTKGYEVIDCGTYDNIRTHYPIYGKKVGEAVASGKADL   69
           MKIA+GCDHIVT +K+AV D+LK+KGY+VIDCGTYD+ RTHYPI+GKKVGEAV +G+ADL
Sbjct:   2 MKIAIGCDHIVTNEKMAVSDFLKSKGYDVIDCGTYDHTRTHYPIFGKKVGEAVVNGQADL   61

Query:  70 GVCICGTGVGINNAVNKVPGIRSALVRDLTSAIYAKEELNANVIGFGGKITGGLLMTDII  129
           GVCICGTGVGINNAVNKVPGIRSALVRD+T+A+YAKEELNANVIGFGGKITG LLM DII
Sbjct:  62 GVCICGTGVGINNAVNKVPGIRSALVRDMTTALYAKEELNANVIGFGGKITGELLMCDII  121

Query: 130 EAFIRAKYKPTKENKVLIEKIAEVETHNAHQEENDFFTEFLDKWNRGEYHD           180
           +AFI+A+YK T+ENK LI KIA +E+H+A+QE+ DFFTEFL+KW+RGEYHD
Sbjct: 122 DAFIKAEYKETEENKKLIAKIAHLESHHANQEDPDFFTEFLEKWDRGEYHD           172
```

Based on this analysis, it was predicted that these proteins and their epitopes could be useful antigens for vaccines or diagnostics.

EXAMPLE 2238

A DNA sequence (GBSx2357) was identified in *S. agalactiae* <SEQ ID 6917> which encodes the amino acid sequence <SEQ ID 6918>. Analysis of this protein sequence reveals the following:

```
Possible site: 24
>>> Seems to have an uncleavable N-term signal seq

----- Final Results -----
            bacterial membrane --- Certainty = 0.0000(Not Clear) < succ>
            bacterial outside --- Certainty = 0.0000(Not Clear) < succ>
           bacterial cytoplasm --- Certainty = 0.0000(Not Clear) < succ>
```

A related GBS nucleic acid sequence <SEQ ID 10187> which encodes amino acid sequence <SEQ ID 10188> was also identified.

The protein has homology with the following sequences in the GENPEPT database.

```
>GP: AAA25179 GB: M60447 tagatose 6-P kinase [Lactococcus lactis]
Identities = 192/310 (61%), Positives = 236/310 (75%)

Query:   11 MILTVTLNPSIDISYCLENFNMDTVNRVTDVSKTPGGKGLNVTRVLSQLGDNVVATGLLG    70
            MILTVTLNPS+DISY LE   +DTVNRV DVSKT GGKGLNVTRVL + GD V ATG LG
Sbjct:    1 MILTVTLNPSVDISYPLETLKIDTVNRVKDVSKTAGGKGLNVTRVLYESGDKVTATGFLG    60

Query:   71 GDFGDFIRSGLDALEIRHQFLSIGGETRHCIAVLHEGQQTEILEKGPHITKDEADAFLNH   130
            G  G+FI S L+    +   F  I G TR+CIA+LHEG QTEILE+GP I+ +EA+ FL+H
Sbjct:   61 GKIGEFIESELEQSPVSPAFYKISGNTRNCIAILHEGNQTEILEQGPTISHEEAEGFLDH   120

Query:  131 LKLIFDAATIITVSGSLPKGLPSDYYARLISLANHFNKKVVLDCSGEALRSVLKSSAKPT   190
                +  + ++T+SGSLP GLP+DYY +LI LA+     VVLDCSG  L  +VLKSSAKPT
Sbjct:  121 YSNLIKQSEVVTISGSLPSGLPNDYYEKLIQLASDEGVAVVLDCSGAPLETVLKSSAKPT   180

Query:  191 VIKPNLEELTQLIGKPISYSLDELKSTLQQDLFRGIDWVIVSLGARGAFAKHGNHYYQVT   250
             IKPN EEL+QL+GK ++  ++ELK  L++ LF GI+W++VSLG  GAFAKHG+ +Y+V
Sbjct:  181 AIKPNNEELSQLLGKEVTKDIEELKDVLKESLFSGIEWIVVSLGRNGAFAKHGDVFYKVD   240

Query:  251 IPKIEVINPVGSGDATVAGIASALEHQLDDTNLLKRANVLGMLNAQETLTGHINLTYYQE   310
            IP I V+NPVGSGD+TVAGIASAL + D +LLK A  LGMLNAQET+TGH+N+T Y+
Sbjct:  241 IPDIPVVNPVGSGDSTVAGIASALNSKKSDADLLKHAMTLGMLNAQETMTGHVNMTNYET   300

Query:  311 LISQIQVKEV                                                    320
            L SQI VKEV
Sbjct:  301 LNSQIGVKEV                                                    310
```

A related DNA sequence was identified in *S. pyogenes* <SEQ ID 6919> which encodes the amino acid sequence <SEQ ID 6920>. Analysis of this protein sequence reveals the following:

```
Possible site: 14
>>> Seems to have no N-terminal signal sequence

----- Final Results -----
           bacterial cytoplasm --- Certainty = 0.1178(Affirmative) < succ>
            bacterial membrane --- Certainty = 0.0000(Not Clear) < succ>
            bacterial outside --- Certainty = 0.0000(Not Clear) < succ>
```

An alignment of the GAS and GBS proteins is shown below.

```
Identities = 184/310 (59%), Positives = 232/310 (74%), Gaps = 1/310 (0%)

Query:   11 MILTVTLNPSIDISYCLENFNMDTVNRVTDVSKTPGGKGLNVTRVLSQLGDNVVATGLLG   70
            +ILTVTLNP+ID+SY L+    DTVNRV DV+KTPGGKGLNV+RVL++ G+ V ATG +G
Sbjct:    1 VILTVTLNPAIDVSYPLDELKCDTVNRVVDVTKTPGGKGLNVSRVLNEFGETVKATGCVG   60

Query:   71 GDFGDFIRSGLDALEIRHQFLSIGGETRHCIAVLHEGQQTEILEKGPHITKDEADAFLNH  130
            G+ GDFI + L    I  +F  I G+TR CIA+LHEG QTEILEKGP ++ DE D F +H
Sbjct:   61 GESGDFIINHLPD-SILSRFYKISGDTRTCIAILHEGNQTEILEKGPMLSVDEIDGFTHH  119

Query:  131 LKLIFDAATIITVSGSLPKGLPSDYYARLISLANHFNKKVVLDCSGEALRSVLKSSAKPT  190
            K + +   ++T+SGSLP G+P DYY +LI +AN   KK VLDCSG AL +VLK  +KPT
Sbjct:  120 FKYLLNDVDVVTLSGSLPAGMPDDYYQKLIKIANLNGKKTVLDCSGNALEAVLKGDSKPT  179

Query:  191 VIKPNLEELTQLIGKPISYSLDELKSTLQQDLFRGIDWVIVSLGARGAFAKHGNHYYQVT  250
            VIKPNLEEL+QL+GK ++   D LK  LQ +LF GI+W+IVSLGA G FAKH + +Y V
Sbjct:  180 VIKPNLEELSQLLGKEMTKDFDALKEVLQDELFDGIEWIIVSLGADGVFAKHKDTFYNVD  239

Query:  251 IPKIEVINPVGSGDATVAGIASALEHQLDDTNLLKRANVLGMLNAQETLTGHINLTYYQE  310
            IPKI++++ VGSGD+TVAGIAS L +  DD  LL +ANVLGMLNAQE  TGH+N+  Y +
Sbjct:  240 IPKIKIVSAVGSGDSTVAGIASGLANDEDDRALLTKANVLGMLNAQEKTTGHVNMANYDK  299

Query:  311 LISQIQVKEV                                                   320
            L   I+VKEV
Sbjct:  300 LYQSIKVKEV                                                   309
```

Based on this analysis, it was predicted that these proteins and their epitopes could be useful antigens for vaccines or diagnostics.

EXAMPLE 2239

A DNA sequence (GBSx2358) was identified in *S. agalactiae* <SEQ ID 6921> which encodes the amino acid sequence <SEQ ID 6922>. This protein is predicted to be tagatose 1,6-diphosphate aldolase. Analysis of this protein sequence reveals the following:

```
Possible site: 25
>>> Seems to have no N-terminal signal sequence

----- Final Results -----
            bacterial cytoplasm --- Certainty = 0.0369(Affirmative) < succ>
            bacterial membrane  --- Certainty = 0.0000(Not Clear)   < succ>
             bacterial outside  --- Certainty = 0.0000(Not Clear)   < succ>
```

The protein has homology with the following sequences in the GENPEPT database.

```
>GP: AAA25180 GB: M60447 tagatose 1,6-diP aldolase [Lactococcus
lactis]
Identities = 253/325 (77%), Positives = 295/325 (89%)

Query:    1 MGLTEQKQKHMEQLSDKNGIISALAFDQRGALKRLMAKYQSEEPTVSQIEALKVLVAEEL   60
            M LTEQK+K +E+LSDKNG ISALAFDQRGALKRLMA+YQ  EPTV Q E LKVLVA+EL
Sbjct:    1 MVLTEQKRKSLEKLSDKNGFISALAFDQRGALKRLMAQYQDTEPTVAQMEELKVLVADEL   60

Query:   61 TPYASSMLLDPEYGLPATKVLDDNAGLLLAYEKTGYDTSSTKRLPDCLDIWSAKRIKEEG  120
            T YASSMLLDPEYGLPATK LD  AGLLLA+EKTGYDTSSTKRLPDCLD+WSAKRIKE+G
Sbjct:   61 TKYASSMLLDPEYGLPATKALDKEAGLLLAFEKTGYDTSSTKRLPDCLDVWSAKRIKEQG  120

Query:  121 ADAVKFLLYYDVDSSDEVNEEKEAYIERIGSECVAEDIPFFLEILSYDEKITDSSGIEYA  180
            ADAVKFLLYYDVDSSDE+N++K+AYIER+GSECVAEDIPFFLEIL+YDE+I+D+   +EYA
Sbjct:  121 ADAVKFLLYYDVDSSDELNQQKQAYIERVGSECVAEDIPFFLEILAYDEEISDAGSVEYA  180

Query:  181 KIKPRKVIEAMKVFSNPRFNIDVLKVEVPVNMDYVEGFAQGETAYNKATAAAYFREQDQA  240
            K+KPRKVIEAMKVFS+PRFNIDVLKVEVPVN+ YVEGFA GE  Y+KA AA +F+ Q++A
Sbjct:  181 KVKPRKVIEAMKVFSDPRFNIDVLKVEVPVNVKYVEGFADGEVVYSKAEAADFFKAQEEA  240
```

```
-continued
Query: 241 TLLPYIFLSAGVPAQLFQETLVFAKEAGAKFNGVLCGRATWAGSVKEYVEKGEAGARQWL 300
           T LPYI+LSAGV A+LFQETL FA ++GAKFNGVLCGRATWAGSV+ Y+++GE  AR+WL
Sbjct: 241 TNLPYIYLSAGVSAKLFQETLQFAHDSGAKFNGVLCGRATWAGSVEPYIKEGEKAAREWL 300

Query: 301 RTIGFQNIDELNKILQKTATSWKER                                   325
           RT GF+NIDELNK+L KTA+ W ++
Sbjct: 301 RTTGFENIDELNKVLVKTASPWTDK                                   325
```

A related DNA sequence was identified in *S. pyogenes* <SEQ ID 6923> which encodes the amino acid sequence <SEQ ID 6924>. Analysis of this protein sequence reveals the following:

```
Possible site: 26
>>> Seems to have no N-terminal signal sequence

----- Final Results -----
            bacterial cytoplasm --- Certainty = 0.0600(Affirmative) < succ>
            bacterial membrane  --- Certainty = 0.0000(Not Clear)   < succ>
            bacterial outside   --- Certainty = 0.0000(Not Clear)   < succ>
```

An alignment of the GAS and GBS proteins is shown below.

```
Identities = 230/323 (71%), Positives = 276/323 (85%), Gaps = 1/323 (0%)

Query:   3 LTEQKQKHMEQLSDKNGIISALAFDQRGALKRLMAKYQSEEPTVSQIEALKVLVAEELTP  62
           LTE K+K ME+LS  +G+ISALAFDQRGALKR+MA++Q++EPTV QIE LK LV+EELTP
Sbjct:   5 LTENKRKSMEKLS-VDGVISALAFDQRGALKRMMAQHQTKEPTVEQIEELKSLVSEELTP  63

Query:  63 YASSMLLDPEYGLPATKVLDDNAGLLLAYEKTGYDTSSTKRLPDCLDIWSAKRIKEEGAD 122
           +ASS+LLDPEYGLPA++V + AGLLLAYEKTGYD ++T RLPDCLD+WSAKRIKE GA+
Sbjct:  64 FASSILLDPEYGLPASRVRSEEAGLLLAYEKTGYDATTTSRLPDCLDVWSAKRIKEAGAE 123

Query: 123 AVKFLLYYDVDSSDEVNEEKEAYIERIGSECVAEDIPFFLEILSYDEKITDSSGIEYAKI 182
           AVKFLLYYD+D   +VNE+K+AYIERIGSEC AEDIPF+LEIL+YDEKI D++  E+AK+
Sbjct: 124 AVKFLLYYDIDGDQDVNEQKKAYIERIGSECRAEDIPFYLEILTYDEKIADNASPEFAKV 183

Query: 183 KPRKVIEAMKVFSNPRFNIDVLKVEVPVNMDYVEGFAQGETAYNKATAAAYFREQDQATL 242
           K  KV EAMKVFS  RF +DVLKVEVPVNM +VEGFA GE  + K  AA  FR+Q+ +T
Sbjct: 184 KAHKVNEAMKVFSKERFGVDVLKVEVPVNMKFVEGFADGEVLFTKEEAAQAFRDQEASTD 243

Query: 243 LPYIFLSAGVPAQLFQETLVFAKEAGAKFNGVLCGRATWAGSVKEYVEKGEAGARQWLRT 302
           LPYI+LSAGV A+LFQ+TLVFA E+GAKFNGVLCGRATWAGSVK Y+E+G   AR+WLRT
Sbjct: 244 LPYIYLSAGVSAKLFQDTLVFAAESGAKFNGVLCGRATWAGSVKVYIEEGPQAAREWLRT 303

Query: 303 IGFQNIDELNKILQKTATSWKER                                     325
            GF+NIDELNK+L KTA+ W E+
Sbjct: 304 EGFKNIDELNKVLDKTASPWTEK                                     326
```

Based on this analysis, it was predicted that these proteins and their epitopes could be useful antigens for vaccines or diagnostics.

EXAMPLE 2240

A DNA sequence (GBSx2359) was identified in *S. agalactiae* <SEQ ID 6925> which encodes the amino acid sequence <SEQ ID 6926>. This protein is predicted to be lacx protein, chromosomal. Analysis of this protein sequence reveals the following:

```
Possible site: 52
>>> Seems to have no N-terminal signal sequence

----- Final Results -----
            bacterial cytoplasm --- Certainty = 0.0643(Affirmative) < succ>
            bacterial membrane  --- Certainty = 0.0000(Not Clear)   < succ>
            bacterial outside   --- Certainty = 0.0000(Not Clear)   < succ>
```

A related GBS nucleic acid sequence <SEQ ID 10185> which encodes amino acid sequence <SEQ ID 10186> was also identified.

The protein has homology with the following sequences in the GENPEPT database.

```
>GP: AAA25184 GB: M60447 ORF [Lactococcus lactis]
Identities = 173/298 (58%), Positives = 219/298 (73%)

Query:   24 MAITIQNHELQVTLKALGATMTSITDSQGVEYLWQGDATYWGGQAPILFPICGSVRNDCV    83
            M I ++N  L V  K LG +TSI D  G+EYLWQ D  YW GQAPILFPICGS+RND
Sbjct:    1 MTIELKNEYLTVQFKTLGGQLTSIKDKDGLEYLWQADPEYWNGQAPILFPICGSLRNDWA   60

Query:   84 IYRPAQAPHFTGIIPRHGFVRHKTFDYDYISDSSVRFTIKSSKEMLINYPYRFSLEITYT   143
            IYRP + P FTG+I RHGFVR + F  + ++++SV F+IK + EML NY Y+F L + YT
Sbjct:   61 IYRPQERPFFTGLIRRHGFVRKEEFTLEEVNENSVTFSIKPNAEMLDNYLYQFELRVVYT  120

Query:  144 LRNKSIAITYIVKNLESEKNMPYAIGAHPGFNCPLFEKEVFSDYYLEFEQFETCTIPESF   203
            L   KSI   + V NLE+EK MPY IGAHP FNCPL E E + DY LEF + E+C+IP+SF
Sbjct:  121 LNGKSIRTEFQVTNLETEKTMPYFIGAHPAFNCPLVEGEKYEDYSLEFSEVESCSIPKSF  180

Query:  204 PDTGLLDLQARHPFLENQKQLSLNHALFEKDAITLDQLRSKTVYLKSRNHAKGIQLDFDD   263
            P+TGLLDLQ R PFLENQK L L+++LF  DAITLD+L+S++V L+SR   KG+++DFDD
Sbjct:  181 PETGLLDLQDRTPFLENQKSLDLDYSLFSHDAITLDRLKSRSVTLRSRKSGKGLRVDFDD  240

Query:  264 FENLILWTSNNGGPFLALEPWSSLSTSIEESDILEDKQNIVRLNPKQSKQHSIRITIL    321
            F NLILW++ N  PF+ALEPWS LSTS+EE +ILEDK  + ++ P  + + S    ITIL
Sbjct:  241 FPNLILWSTTNKSPFIALEPWSGLSTSLEEGNILEDKPQVTKVLPLDTSKKSYDITIL    298
```

No corresponding DNA sequence was identified in *S. pyogenes*.

Based on this analysis, it was predicted that this protein and its epitopes, could be useful antigens for vaccines or diagnostics.

EXAMPLE 2241

A DNA sequence (GBSx2361) was identified in *S. agalactiae* <SEQ ID 6927> which encodes the amino acid sequence <SEQ ID 6928>. This protein is predicted to be ABC transporter. Analysis of this protein sequence reveals the following:

```
Possible site: 49
>>> Seems to have no N-terminal signal sequence

----- Final Results -----
            bacterial cytoplasm --- Certainty = 0.3272(Affirmative) < succ>
             bacterial membrane --- Certainty = 0.0000(Not Clear)  < succ>
              bacterial outside --- Certainty = 0.0000(Not Clear)  < succ>
```

A related GBS nucleic acid sequence <SEQ ID 10183> which encodes amino acid sequence <SEQ ID 10184> was also identified.

The protein has homology with the following sequences in the GENPEPT database.

```
>GP: CAA51350 GB: X72832 leucine rich protein [Streptococcus
equisimilis]
Identities = 101/278 (36%), Positives = 160/278 (57%), Gaps = 1/278 (0%)

Query:   10 MDFKELFPEVITKQEVKQSEDYIIVEQDGHVLHFPKSSLTKRELYLLQMTPSLEDASSVD    69
            M+ K+ FPE+         ++++ V++    +HFPKS L+++E  LL++         +
Sbjct:    1 MELKDYFPEMQVGPHPLGDKEWVSVKEGDQYVHFPKSCLSEKERLLLEVGLGQYEVLQ-P   59

Query:   70 SQNPWYRYLVEGRGRLPQSHSAVQFIFIEHQFTLSEELKDFLSPLVINVETIMTINQTQS   129
            +PW RYL++ +G   PQ    QFI++HQ  L  +L + L ++   +E I+ I+ TQ+
Sbjct:   60 LGSPWQRYLLDHQGNPPQLFETSQFIYLNHQQVLPADLVELLQQMIAGLEVILPISTTQT  119

Query:  130 VMILNQDNFFNATELLTDILPTIENDFNTRLRCYFGNSWTHLQAVDWKELYEEEYKLFTL   189
            +  Q        L +LPT+E+DF   L +  GN+W  +  A    +E +EEE +L T
Sbjct:  120 AFLCRQATSIKVLRSLEGLLPTLESDFGLALTMFVGNAWYQVAAGTLRECFEEECQLLTA  179
```

```
-continued
Query: 190 FLSHKAEQHYCRFPKMALWALANQSPMPSIKAKCLQHILDTSDTSAIIKALWQEQGNLAK 249
            +L  K+       F ++ LW++ +      P++  +   Q +    SD + ++ ALW E GNL +
Sbjct: 180 YLKQKSGGKLLTFAEVMLWSILSHQSFPALTRQFHQFLNPQSDMADVVHALWSEHGNLVQ 239

Query: 250 TAKALFIHRNSLQYKLDKFTQSSGLNLKILDDLAYAYL                       287
           TA+  L+IHRNSLQYKLDKF Q SGL+LK LDDLA+AYL
Sbjct: 240 TAQRLYIHRNSLQYKLDKFAQQSGLHLKQLDDLAFAYL                       277
```

A related DNA sequence was identified in *S. pyogenes* <SEQ ID 6929> which encodes the amino acid sequence <SEQ ID 6930>. Analysis of this protein sequence reveals the following:

```
Possible site: 14
>>> Seems to have no N-terminal signal sequence

----- Final Results -----
              bacterial cytoplasm --- Certainty = 0.4332(Affirmative) < succ>
               bacterial membrane --- Certainty = 0.0000(Not Clear)   < succ>
                 bacterial outside --- Certainty = 0.0000(Not Clear)   < succ>
```

An alignment of the GAS and GBS proteins is shown below.

```
Identities = 106/287 (36%), Positives = 169/287 (57%), Gaps = 4/287 (1%)

Query:   3 KTVVED-AMDFKELFPEVITKQEVKQSEDYIIVEQDGHVLHFPKSSLTKRELYLLQM-TP   60
           KTV++   AM+ K+ FPE+              +D++ +++      +HFPKS L+++E  LL++
Sbjct:   7 KTVMKGMAMELKDYFPEMQVGPHPLGDKDWMSIKEGDQYVHFPKSCLSEKERLLLEVGLG   66

Query:  61 SLEDASSVDSQNPWYRYLVEGRGRLPQSHSAVQFIFIEHQFTLSEELKDFLSPLVINVET  120
               E    + S  PW RYL++ +G  PQ +    QFI++ HQ  L ++L +  L   ++   +E
Sbjct:  67 QCEVLQPLGS--PWQRYLLDHQGNPPQLYETSQFIYLNHQQALPDDLVELLQQMIAGLEV  124

Query: 121 IMTINQTQSVMILNQDNFFNATELLTDILPTIENDFNTRLRCYFGNSWTHLQAVDWKELY  180
            I+ I+ TQ+  +  Q        L D+LPT+E+DF   L  + GN+W   + A   +E +
Sbjct: 125 ILPISATQTAFLCRQAISIKVLRWLEDLLPTLESDFGLALTMFVGNAWYQVAAGTLRECF  184

Query: 181 EEEYKLFTLFLSHKAEQHYCRFPKMALWALANQSPMPSIKAKCLQHILDTSDTSAIIKAL  240
           EEE +L T +L   ++ +       F + LW+L  +     ++ +  Q +    SD + ++ AL
Sbjct: 185 EEECQLLTAYLRQQSGRKLLTFSGLMLWSLLSHHTFLALTRQFHQFLSPQSDMADVVHAL  244

Query: 241 WQEQGNLAKTAKALFIHRNSLQYKLDKFTQSSGLNLKILDDLAYAYL               287
           W E GNL +TA+  L+IHRNSLQYKLDKF Q SGL+LK LDDLA+A+L
Sbjct: 245 WSEHGNLVQTAQRLYIHRNSLQYKLDKFAQQSGLHLKQLDDLAFAHL               291
```

Based on this analysis, it was predicted that these proteins and their epitopes could be useful antigens for vaccines or diagnostics.

EXAMPLE 2242

A DNA sequence (GBSx2362) was identified in *S. agalactiae* <SEQ ID 6931> which encodes the amino acid sequence <SEQ ID 6932>. This protein is predicted to be multiple sugar-binding transport ATP-binding protein msmk (malK). Analysis of this protein sequence reveals the following:

```
Possible site: 17
>>> Seems to have no N-terminal signal sequence

----- Final Results -----
              bacterial cytoplasm --- Certainty = 0.4392(Affirmative) < succ>
               bacterial membrane --- Certainty = 0.0000(Not Clear)   < succ>
                 bacterial outside --- Certainty = 0.0000(Not Clear)   < succ>
```

The protein has homology with the following sequences in the GENPEPT database.

```
>GP: AAA26938 GB: M77351 ATP-binding protein [Streptococcus mutans]
Identities = 320/377 (84%), Positives = 359/377 (94%)

Query:    1 MVELNLNHIYKKYPSASHYSVEDFDLDIKDKEFIVFVGPSGCGKSTTLRMIAGLEDISEG   60
            MVELNLNHIYKKYP++SHYSVEDFDLDIK+KEFIVFVGPSGCGKSTTLRM+AGLEDI++G
Sbjct:    1 MVELNLNHIYKKYPNSSHYSVEDFDLDIKNKEFIVFVGPSGCGKSTTLRMVAGLEDITKG   60

Query:   61 ELKIDGEVVNDKSPKDRDIAMVFQNYALYPHMTVYDNMAFGLKLRKFSKQEIDKRVREAA  120
            ELKIDGEVVNDK+PKDRDIAMVFQNYALYPHM+VYDNMAFGLKLR +SK+ IDKRV+EAA
Sbjct:   61 ELKIDGEVVNDKAPKDRDIAMVFQNYALYPHMSVYDNMAFGLKLRHYSKEAIDKRVKEAA  120

Query:  121 ANIGLTEFLERKPADLSGGQRQRVAMGRAIVRDAKVFLMDEPLSNLDAKLRVSMRAEIAK  180
               +GLTEFLERKPADLSGGQRQRVAMGRAIVRDAKVFLMDEPLSNLDAKLRVSMRAEIAK
Sbjct:  121 QILGLTEFLERKPADLSGGQRQRVAMGRAIVRDAKVFLMDEPLSNLDAKLRVSMRAEIAK  180

Query:  181 IHQRIGSTTIYVTHDQTEAMTLADRIVIMSATKNPDGDGTIGKIEQVGSPQELYNLPANK  240
            IH+RIG+TTIYVTHDQTEAMTLADRIVIMS+TKN DG GTIG++EQVG+PQELYN PANK
Sbjct:  181 IHRRIGATTIYVTHDQTEAMTLADRIVIMSSTKNEDGSGTIGRVEQVGTPQELYNRPANK  240

Query:  241 FVAGFIGSPSMNFFKVKVENGMIISEDGLRIAIPEGQEKLLESRGYKGKELIFGIRPEDI  300
            FVAGFIGSP+MNFF V +++G ++S+DGL IA+ EGQ K+LES+G+K K LIFGIRPEDI
Sbjct:  241 FVAGFIGSPAMNFFDVTIKDGHLVSKDGLTIAVTEGQLKMLESKGFKNKNLIFGIRPEDI  300

Query:  301 SSNLLVQDTYPNANVEAEVLVSELLGSETMLYVKLGQTEFASRVEARDFHNPGEKVNLTF  360
            SS+LLVQ+TYP+A V+AEV+VSELLGSETMLY+KLGQTEFA+RV+ARDFH PGEKV LTF
Sbjct:  301 SSSLLVQETYPDATVDAEVVVSELLGSETMLYLKLGQTEFAARVDARDFHEPGEKVSLTF  360

Query:  361 NVAKGHFFDADTEQAIR                                             377
            NVAKGHFFDA+TE AIR
Sbjct:  361 NVAKGHFFDAETEAAIR                                             377
```

A related DNA sequence was identified in *S. pyogenes* 30 <SEQ ID 6933> which encodes the amino acid sequence <SEQ ID 6934>. Analysis of this protein sequence reveals the following:

```
Possible site: 48
>>> Seems to have no N-terminal signal sequence

----- Final Results -----
            bacterial cytoplasm --- Certainty = 0.4642(Affirmative) < succ>
            bacterial membrane  --- Certainty = 0.0000(Not Clear)  < succ>
             bacterial outside  --- Certainty = 0.0000(Not Clear)  < succ>
```

An alignment of the GAS and GBS proteins is shown below.

```
Identities = 332/377 (88%), Positives = 359/377 (95%)

Query:    1 MVELNLNHIYKKYPSASHYSVEDFDLDIKDKEFIVFVGPSGCGKSTTLRMIAGLEDISEG   60
            MVELNLNHIYKKYP+ +HY+VEDFDLDIKDKEFIVFVGPSGCGKSTTLRMIAGLEDISEG
Sbjct:    1 MVELNLNHIYKKYPNTTHYAVEDFDLDIKDKEFIVFVGPSGCGKSTTLRMIAGLEDISEG   60

Query:   61 ELKIDGEVVNDKSPKDRDIAMVFQNYALYPHMTVYDNMAFGLKLRKFSKQEIDKRVREAA  120
            ELKI GEVVNDKSPKDRDIAMVFQNYALYPHMTVYDNMAFGLKLRK+ K +ID+RV+EAA
Sbjct:   61 ELKIGGEVVNDKSPKDRDIAMVFQNYALYPHMTVYDNMAFGLKLRKYKKDDIDRRVKEAA  120

Query:  121 ANIGLTEFLERKPADLSGGQRQRVAMGRAIVRDAKVFLMDEPLSNLDAKLRVSMRAEIAK  180
               +GLTEFLERKPADLSGGQRQRVAMGRAIVRDAKVFLMDEPLSNLDAKLRVSMRAEIAK
Sbjct:  121 QILGLTEFLERKPADLSGGQRQRVAMGRAIVRDAKVFLMDEPLSNLDAKLRVSMRAEIAK  180

Query:  181 IHQRIGSTTIYVTHDQTEAMTLADRIVIMSATKNPDGDGTIGKIEQVGSPQELYNLPANK  240
            IH+RIGSTTIYVTHDQTEAMTLADRIVIMSATKNP G+GTIGKIEQVGSPQELYNLPANK
Sbjct:  181 IHRRIGSTTIYVTHDQTEAMTLADRIVIMSATKNPQGNGTIGKIEQVGSPQELYNLPANK  240

Query:  241 FVAGFIGSPSMNFFKVKVENGMIISEDGLRIAIPEGQEKLLESRGYKGKELIFGIRPEDI  300
            FVAGFIGSP+MNFF+V+V++G I+SEDGL IAIPEGQ K+LE+ GYKG+++ FGIRPEDI
Sbjct:  241 FVAGFIGSPAMNFFEVEVKDGRIVSEDGLDIAIPEGQAKMLEAAGYKGEKVTFGIRPEDI  300

Query:  301 SSNLLVQDTYPNANVEAEVLVSELLGSETMLYVKLGQTEFASRVEARDFHNPGEKVNLTF  360
            SS   +V DTYP+A V AEVLVSELLGSETMLYVKLGQTEFASRV+ARDFH+PGE+V+LTF
```

```
                         -continued
Sbjct: 301 SSRQIVHDTYPSATVTAEVLVSELLGSETMLYVKLGQTEFASRVDARDFHSPGEQVSLTF  360

Query: 361 NVAKGHFFDADTEQAIR                                             377
           NVAKGHFFD DTEQAIR
Sbjct: 361 NVAKGHFFDRDTEQAIR                                             377
```

Based on this analysis, it was predicted that these proteins and their epitopes could be useful antigens for vaccines or diagnostics.

EXAMPLE 2243

A DNA sequence (GBSx2363) was identified in *S. agalactiae* <SEQ ID 6935> which encodes the amino acid sequence <SEQ ID 6936>. This protein is predicted to be glucan 1,6-alpha-glucosidase (dexB) (treC). Analysis of this protein sequence reveals the following:

```
Possible site: 56
>>> Seems to have no N-terminal signal sequence

----- Final Results -----
             bacterial cytoplasm --- Certainty = 0.2525(Affirmative) < succ>
             bacterial membrane  --- Certainty = 0.0000(Not Clear)   < succ>
             bacterial outside   --- Certainty = 0.0000(Not Clear)   < succ>
```

The protein has homology with the following sequences in the GENPEPT database.

```
>GP: CAA51348 GB: X72832 glucan 1,6-alpha-glucosidase [Streptococcus
equisimilis]
Identities = 413/535 (77%), Positives = 476/535 (88%), Gaps = 1/535 (0%)

Query:   1 MKKHWWHKATIYQIYPRSFMDSDGDGVGDIKGITSKLDYLEKLGITAIWLSPVYQSPMDD    60
           M+K WWHKATIYQIYPRSF D+ G+G+GD+KGITS+LDYL+KLGITAIWLSPVYQSPMDD
Sbjct:   1 MQKQWWHKATIYQIYPRSFKDTSGNGIGDLKGITSQLDYLQKLGITAIWLSPVYQSPMDD    60

Query:  61 NGYDISDYQAIADIFGDMNDMDQLLQEANQRGIKIIMDLVVNHTSDEHAWFVEARENPNS   120
           NGYDISDY+AIA++FG+M+DMD LL   AN+RGIKIIMDLVVNHTSDEHAWFVEARENPNS
Sbjct:  61 NGYDISDYEAIAEVFGNMDDMDDLLAAANERGIKIIMDLVVNHTSDEHAWFVEARENPNS   120

Query: 121 PERDFYIWRDEPNDLTSIFSGSAWEYDKVSGQYYLHLFSKRQPDLNWENEALRHKIYDMM   180
           PERD+YIWRDEPN+L SIFSGSAWE D+ SGQYYLHLFSK+QPDLNWEN +R KIYDMM
Sbjct: 121 PERDYYIWRDEPNNLMSIFSGSAWELDEASGQYYLHLFSKKQPDLNWENAHVRQKIYDMM   180

Query: 181 NFWIDKGIGGFRMDVIDLIGKIPDKGITGNGPKLHDYLKEMNRASFGKHDLLTVGETWGA   240
           NFWI KGIGGFRMDVIDLIGKIPD  ITGNGP+LHDYLKEMN+A+FG HD++TVGETWGA
Sbjct: 181 NFWIAKGIGGFRMDVIDLIGKIPDSEITGNGPRLHDYLKEMNQATFGNHDVMTVGETWGA   240

Query: 241 TPDIAKQYSNPDNEELSMVFQFEHVGLQHKPDAPKWDYSDGLDVPALKDIFTKWQTQLEL   300
           TP+IA+QYS P+N+ELSMVFQFEHVGLQHKP+APKWDY++ LDVPALK IF+KWQT+L+L
Sbjct: 241 TPEIARQYSRPENKELSMVFQFEHVGLQHKPNAPKWDYAEELDVPALKTIFSKWQTELKL   300

Query: 301 GQGWNSLFWNNHDLPRVLSIWGNDSDNRKQSAKALAILLHLMRGTPYIYQGEEIGMTNYP   360
           G+GWNSLFWNNHDLPRVLSIWGNDS  R++SAKALAILLHLMRGTPYIYQGEEIGMTNYP
Sbjct: 301 GEGWNSLFWNNHDLPRVLSIWGNDSIYREKSAKALAILLHLMRGTPYIYQGEEIGMTNYP   360

Query: 361 FECLADVDDIESLNYAKEAMDNGVSEATILDSIRKVGRDNARTPMQWSQEHQAGFTKG-T   419
           F+ L +VDDIESLNYAKEAM+NGV A ++ SIRKVGRDNARTPMQWS++  AGF++
Sbjct: 361 FKDLTEVDDIESLNYAKEAMENGVPAARVMSSIRKVGRDNARTPMQWSKDTHAGFSEAQE   420

Query: 420 PWLAVNPNYQEINVEAALNDTESIFYTYQKLVALRKEHDWLVDADFKLLETADKVFAYVR   479
            WL VNPNYQEINV AL + +SIFYTYQ+L+ALRK+ DWLV+AD+ LL TADKVFAY R
Sbjct: 421 TWLPVNPNYQEINVADALANQDSIFYTYQQLIALRKDQDWLVEADYHLLPTADKVFAYQR   480

Query: 480 QTDKERYLIVANLSDQNQSFEFPEAVKETIISNTEVQEVLSSNTLKPWDAFCIEL        534
           Q  +E Y+IV N+SDQ Q F   A  E +I+NT+V +VL   L+PWDAFC++L
Sbjct: 481 QFGEETYVIVVNVSDQEQVFAKDLAGAEVVITNTDVDKVLETKHLQPWDAFCVKL        535
```

A related DNA sequence was identified in *S. pyogenes* <SEQ ID 6937> which encodes the amino acid sequence <SEQ ID 6938>. Analysis of this protein sequence reveals the following:

```
Possible site: 56
>>> Seems to have no N-terminal signal sequence

----- Final Results -----
            bacterial cytoplasm --- Certainty = 0.2793(Affirmative) < succ>
             bacterial membrane --- Certainty = 0.0000(Not Clear) < succ>
              bacterial outside --- Certainty = 0.0000(Not Clear) < succ>
```

An alignment of the GAS and GBS proteins is shown below.

```
Identities = 418/535 (78%), Positives = 474/535 (88%), Gaps = 1/535 (0%)

Query:    1 MKKHWWHKATIYQIYPRSFMDSDGDGVGDIKGITSKLDYLEKLGITAIWLSPVYQSPMDD    60
            M  HWWHKATIYQIYPRSF D+ G+G+GD+KGITS+LDYL+KLGITAIWLSPVYQSPMDD
Sbjct:    1 MNNHWWHKATIYQIYPRSFKDTSGNGIGDLKGITSQLDYLQKLGITAIWLSPVYQSPMDD    60

Query:   61 NGYDISDYQAIADIFGDMNDMDQLLQEANQRGIKIIMDLVVNHTSDEHAWFVEARENPNS   120
            NGYDISDY+AIAD+FGDM DMD+LL   AN+RGIKIIMDLVVNHTSDEHAWFVEARENPNS
Sbjct:   61 NGYDISDYEAIADVFGDMADMDELLAAANERGIKIIMDLVVNHTSDEHAWFVEARENPNS   120

Query:  121 PERDFYIWRDEPNDLTSIFSGSAWEYDKVSGQYYLHLFSKRQPDLNWENEALRHKIYDMM   180
            PERD+YIWRDEPN+L SIFSGSAWE D+ SGQYYLHLFSK+QPDLNWEN  LR KIYDMM
Sbjct:  121 PERDYYIWRDEPNNLMSIFSGSAWELDEASGQYYLHLFSKKQPDLNWENAQLRQKIYDMM   180

Query:  181 NFWIDKGIGGFRMDVIDLIGKIPDKGITGNGPKLHDYLKEMNRASFGKHDLLTVGETWGA   240
            NFWI  KGIGGFRMDVIDLIGK+PD   ITGNGP+LHDYLKEMN+A+FG HD++TVGETWGA
Sbjct:  181 NFWIAKGIGGFRMDVIDLIGKVPDLEITGNGPRLHDYLKEMNQATFGNHDVMTVGETWGA   240

Query:  241 TPDIAKQYSNPDNEELSMVFQFEHVGLQHKPDAPKWDYSDGLDVPALKDIFTKWQTQLEL   300
            TP+IA+QYS P+N+ELSMVFQFEHVGLQHKPDAPKWDY+   LDVPALK IF+KWQT+L+L
Sbjct:  241 TPEIARQYSRPENKELSMVFQFEHVGLQHKPDAPKWDYAKELDVPALKAIFSKWQTELKL   300

Query:  301 GQGWNSLFWNNHDLPRVLSIWGNDSDNRKQSAKALAILLHLMRGTPYIYQGEEIGMTNYP   360
            G+GWNSLFWNNHDLPRVLSIWGNDS   R++SAKALAILLHLMRGTPYIYQGEEIGMTNYP
Sbjct:  301 GEGWNSLFWNNHDLPRVLSIWGNDSTYREKSAKALAILLHLMRGTPYIYQGEEIGMTNYP   360

Query:  361 FECLADVDDIESLNYAKEAMDNGVSEATILDSIRKVGRDNARTPMQWSQEHQAGFTKG-T   419
            F+ L +V+DIESLNYAKEAM NGVS A ++DSIRKVGRDNARTPMQWS++  AGF++
Sbjct:  361 FKDLTEVNDIESLNYAKEAMGNGVSAARVMDSIRKVGRDNARTPMQWSKDTHAGFSEAKE   420

Query:  420 PWLAVNPNYQEINVEAALNDTESIFYTYQKLVALRKEHDWLVDADFKLLETADKVFAYVR   479
            WL VNPNYQ+INV  AL D +SIFYTYQKL+ALRKE DWLV+AD+ LL TADKVFAY R
Sbjct:  421 TWLPVNPNYQDINVADALADPDSIFYTYQKLIALRKEQDWLVEADYHLLPTADKVFAYQR   480

Query:  480 QTDKERYLIVANLSDQNQSFEFPEAVKETIISNTEVQEVLSSNTLKPWDAFCIEL         534
            Q  +E Y+IV N+SD+ Q F   A + II+NT+V VL + L+PWDAFC++L
Sbjct:  481 QLGEETYVIVVNVSDEEQVFATDLAGAQVIIANTDVDTVLETKHLQPWDAFCLKL         535
```

Based on this analysis, it was predicted that these proteins and their epitopes could be useful antigens for vaccines or diagnostics.

EXAMPLE 2244

A DNA sequence (GBSx2364) was identified in *S. agalactiae* <SEQ ID 6939> which encodes the amino acid sequence <SEQ ID 6940>. Analysis of this protein sequence reveals the following:

```
Possible site: 44
>>> Seems to have an uncleavable N-term signal seq

----- Final Results -----
             bacterial membrane --- Certainty = 0.0000(Not Clear) < succ>
              bacterial outside --- Certainty = 0.0000(Not Clear) < succ>
            bacterial cytoplasm --- Certainty = 0.0000(Not Clear) < succ>
```

The protein has homology with the following sequences in the GENPEPT database.

```
>GP:AAB49738 GB:U21942 UDP-galactose 4-epimerase [Streptococcus mutans]
Identities = 267/331 (80%), Positives = 306/331 (91%)

Query:    1 MAVLILGGAGYIGSHMVDQLITQGKEKVIVVDNLVTGHRQAVHSDAIFYEGDLSDKTFMR   60
            MA+L+LGGAGYIGSHMVD+LI +G+E+V+VVD+LVTGHR AVH  A FY+GDL+D+ FM
Sbjct:    1 MAILVLGGAGYIGSHMVQRLIEKGEEEVVVVDSLVTGHRAAVHPAAKFYQGDLADREFMS   60

Query:   61 QVFRENPDVDAVIHFAAFSLVAESMENPLKYFDNNTAGMIKLLEVMNECDIKNIVFSSTA  120
             VFRENPDVDAVIHFAA+SLVAESM+ PLKYFDNNTAGMIKLLEVM+E  +K IVFSSTA
Sbjct:   61 MVFRENPDVDAVIHFAAYSLVAESMKKPLKYFDNNTAGMIKLLEVMSEFGVKYIVFSSTA  120

Query:  121 ATYGIPSQVPILETAFQNPINPYGESKLMMETIMKWADQAYGIKFVALRYFNVAGDKPDG  180
            ATYGIP ++PI ET PQ PINPYGESKLMMETIMKW+D+AYGIKFV +RYFNVAG RPDG
Sbjct:  121 ATYGIPNEIPIKETTPQRPINPYGESKLMMETIMKWSORAYGIKFVPVRYFNVAGAKPDG  180

Query:  181 SIGEDHKPETHLLPIILQVAQGVRDKIMIFGDDYNTPDGTNVRDYVHPFDLADAHILAVD  240
            SIGEDH PETHLLPIILQVAQGVR+KIMIFGDDYNTPDGTNVRDYVHPFDLAD H+LA++
Sbjct:  181 SIGEDHSPETHLLPIILQVAQGVREKIMIFGDDYNTPDGTNVRDYVHPFDLADRHLLALN  240

Query:  241 YLRQGNESNVFNLGSSTGFSNLQMLEAARRITGKEIPAQKAARRPGDPDTLIASSERARQ  300
            YLRQGN S  FNLGSSTGFSNLQ+LEAAR++TG++IPA+KAARR GDPDTLIASSEKAR+
Sbjct:  241 YLRQGNPSTAFNLGSSTGFSNLQILEAARRVTGQKIPAEKAARRSGDPDTLIASSEKARE  300

Query:  301 ILGWEPKFDNIDKIISSAWAWHSSHPNGYED                              331
            ++GW+P+FD+I+KII+SAWAWHSSHP GY+D
Sbjct:  301 VVGWKPQFDDIEKIIASAWAWHSSHPKGYDD                              331
```

Based on this analysis, it was predicted that this protein and its epitopes, could be useful antigens for vaccines or diagnostics.

EXAMPLE 2245

A DNA sequence (GBSx2366) was identified in *S. agalactiae* <SEQ ID 6941> which encodes the amino acid sequence <SEQ ID 6942>. This protein is predicted to be two-component response regulator. Analysis of this protein sequence reveals the following:

```
Possible Site: 40
>>> Seems to have no N-terminal signal sequence

----- Final Results -----
          bacterial cytoplasm --- Certainty = 0.3945(Affirmative) < succ>
           bacterial membrane --- Certainty = 0.0000(Not Clear)   < succ>
            bacterial outside --- Certainty = 0.0000(Not Clear)   < succ>
```

The protein has homology with the following sequences in the GENPEPT database.

```
>GP:BAB06470 GB:AP001516 two component response regulator
[Bacillus halodurans]
Identities = 71/223 (31%), Positives = 139/223 (61%), Gaps = 7/223 (3%)

Query:    3 VLIIEDDPMVEFIHRNYLEKLNYFQNIYSTASQTQAIAYLNDIKIQLVLLDIHIKEGNGL   62
            VL+IEDDPMV+ ++R ++EKL+ F  + +TA+  +      +++  L+LLDI + +GL
Sbjct:    9 VLLIEDDPMVQEVNRMFVEKLSGFTIVGTTATGEEGMVKTRELQPDLILLDIFMPKQDGL   68

Query:   63 ELLKLLRNQHQNTEVIVISAANEANTVKEAFHLGIVDYLIKPFTFERFESSIEKFLNHYH  122
            +K +R Q+ + ++I ++AAN+  T+K     G++DYL+KPFTFER ++++ ++   +
Sbjct:   69 SFIKQIREQYIDVDIIAVTAANDTKTIKTLLRYGVMDYLVKPFTFERLKAALTQYEEMFR  128

Query:  123 TFEAD-KIYQDNIOHFQKIDSGWLEGEVKLDE--KGLSEITYQHILDAIQELEQPFTIQE  179
            + + ++ QD++D  K     + +D+  KGL   T Q +++ ++EL++P + +E
Sbjct:  129 KMQKEAELSQDSLDEMIK----QKQAQANMDDLPKGLHAHTLQQVIERLEELDEPKSAEE  184

Query:  180 LAKCSQFSHVSVRKYIAYMEEKGLLTSQQIYTKVGRPYKVYKL                   222
            + +     + V+VR+Y+ Y+E  G +      Y  +GRP + YKL
Sbjct:  185 IGRDVGLARVTVRRYLNYLESVGQVEMDLTYGSIGRPIQTYKL                   227
```

A related DNA sequence was identified in *S. pyogenes* <SEQ ID 6943> which encodes the amino acid sequence <SEQ ID 6944>. Analysis of this protein sequence reveals the following:

```
Possible site: 37
>>> Seems to have no N-terminal signal sequence

----- Final Results -----
            bacterial cytoplasm --- Certainty = 0.4053(Affirmative) < succ>
            bacterial membrane  --- Certainty = 0.0000(Not Clear)   < succ>
            bacterial outside   --- Certainty = 0.0000(Not Clear)   < succ>
```

An alignment of the GAS and GBS proteins is shown below.

```
Identities = 123/220 (55%), Positives = 156/220 (70%)

Query:    1 MDVLIIEDDPMVEFIHRNYLEKLNYFQNIYSTASQTQAIAYLNDIKIQLVLLDIHIKEGN    60
            M+VLIIEDDPMV+FIHRNYLEKLN F  I S+ S      + L D  I L+LLDIHI +GN
Sbjct:    1 MNVLIIEDDPMVDFIHRNYLEKLNLFDRIISSDSMKAVQSILTDYAIDLILLDIHITDGN    60

Query:   61 GLELLKLLRNQHQNTEVIVISAANEAHTVKEAFHLGIVDYLIKPFTFEREESSIEKFLNH   120
            G++ L+  R QH   EVI+ISAAN+ +  +++FHLGI+DYLIKPFTFSRF+ SI++F+ H
Sbjct:   61 GIQFLEKWRTQHIPCEVIIISAANDGNIIRDGFHLGIIDYLIKPFTFERFQESIQQFVTH   120

Query:  121 YHTFEADKIYQDNIDHFQKIDSGWLEGEVKLDEKGLSEITYQHILDAIQELEQPFTIQEL   180
                  ++ Q  ID  + + S         +L EKGLSE T+Q I++ I+  +QPFTIQEL
Sbjct:  121 REHLANQQLEQAQIDQLKCLTSKKDTKNRQLLEKGLSESTFQWIMENIKVFDQPFTIQEL   180

Query:  181 AKCSQFSHVSVRKYIAYMEEKGLLTSQQIYTKVGRPYKVY                      220
            A       SHVSVRKYIAY+EE    L SQQI+TKVGRPY+VY
Sbjct:  181 ASACHLSHVSVRKYIAYLEENKQLNSQQIFTKVGRPYRVY                      220
```

Based on this analysis, it was predicted that these proteins and their epitopes could be useful antigens for vaccines or diagnostics.

EXAMPLE 2246

A DNA sequence (GBSx2367) was identified in *S. agalactiae* <SEQ ID 6945> which encodes the amino acid sequence <SEQ ID 6946>. Analysis of this protein sequence reveals the following:

```
Possible site: 21
>>> Seems to have an uncleavable N-term signal seq
INTEGRAL Likelihood = -8.76 Transmembrane  12-28   ( 6-34)
INTEGRAL Likelihood = -7.43 Transmembrane 178-194 (173-197)

----- Final Results -----
            bacterial membrane  --- Certainty = 0.4503(Affirmative) < succ>
            bacterial outside   --- Certainty = 0.0000(Not Clear)   < succ>
            bacterial cytoplasm --- Certainty = 0.0000(Not Clear)   < succ>
```

A related GBS nucleic acid sequence <SEQ ID 9003> which encodes amino acid sequence <SEQ ID 9004> was also identified. Analysis of this protein sequence reveals the following:

```
Lipop: Possible site: -1 Crend: 3
SRCFLG: 0
McG: Length of UR: 27
Peak Value of CR: 2.99
Net Charge of CR: 3
McG: Discrim Score: 12.92
GvH: Signal Score (-7.5): -2.57
Possible site: 19
>>> Seems to have an uncleavable N-term signal seq
Amino Acid Composition: calculated from 1
ALOM program count: 2 value: -8.76 threshold: 0.0
```

-continued
```
INTEGRAL   Likelihood = -8.76 Transmembrane 10-26    ( 4-32)
INTEGRAL   Likelihood = -7.43 Transmembrane 176-192 ( 171-195)
PERIPHERAL Likelihood =  3.18 149
modified ALOM score: 2.25
icm1 HYPID: 7 CFP: 0.450

*** Reasoning Step: 3

----- Final Results -----
             bacterial membrane --- Certainty = 0.4503(Affirmative) < succ>
               bacterial outside --- Certainty = 0.0000(Not Clear)  < succ>
             bacterial cytoplasm --- Certainty = 0.0000(Not Clear)  < succ>
```

The protein has homology with the following sequences in the GENPEPT database.

```
>GP:CAB15141 GB:Z99120 similar to two-component sensor histidine
kinase [YufM] [Bacillus subtilis]
Identities = 132/461 (28%), Positives = 245/461 (52%), Gaps = 7/461 (1%)

Query:    3 MKKKLSLWAFLSLILVTMTICIFSIFYYVTIHQSYRMVRVQEEKILKNTGYALSRNPQVI   62
            MKKLL L   L++ + + +    I ++    Q+ + +R QE+      T    ++   P
Sbjct:    1 MKKTLKLQTRLTIFVCIVVLIALLITFWTVGAQTTKRIRDQEKATALQTAEMVAEAPMTA   60

Query:   63 QTLKDNHYDQSLQKQNLFLSKKSNLDYIVLINLKGIRFTHPDSTKIGKPFQGGDEQAVEK  122
            L+      + LQ    + K +   +++V++++ GIR THPD +KIGK F+GGDE   V K
Sbjct:   61 AALESGKKQKELQSYTKRVQKITGTEFVVVMDMNGIRKTHPDPSKIGKKFRGGDESEVLK  120

Query:  123 GKAINSTAEGSLGKSLRYLIPVY-DHQKQVGAIAVGLKLTTLGDLSQSSIKEFSKPLLIS  181
            G   +STA G+LGKS R  +PVY ++  KQVGA+AVG+ +   + ++    S++    ++S
Sbjct:  121 GHVHISTASGTLGKSQRAFVPVYAENGKQVGAVAVGITVNEIDEVISHSLRPLYFIICVS  180

Query:  182 ILISLVVTSIISYGLKKQLHNLHPSDIFQHLEERNATLDQIQAAVFVIDQRHIIKRNNPA  241
            I + ++   I++  +K ++L   P +I    LEER+A L+  +  +D+    IK  N
Sbjct:  181 IFVGVIGAVIVARTVKNIMYGLEPYEIATLLEERSAMLESTKEGILAVDEHGKIKLANAE  240

Query:  242 ASLLFKKEGQRDLFSGKLLESLIP--QLKQDHFSKK--TEQVLHFGQDYLLSISPITVK  297
            A   LF  K G      + ++ ++P  +LK+     +KK    ++ +    G + + +  PI +K
Sbjct:  241 AKRLFVKMGINTNPIDQDVDDILPKSRLKKVIETKKPLQDRDVRINGLELVFNEVPIQLK  300

Query:  298 TQNRGYVVFLRNVTETLFTLDQLAHTTAYASALQAQTHQFNNQLHVIYGLADIEYYDELK  357
                 Q  G + R+ TE      +QL+    YA+AL+AQ+H+FNN+LHVI  GL   ++ YD+L
Sbjct:  301 GQTVGAIATFRDKTEVKHLAEQLSGVKNYANALRAQSHEFNNKLHVILGLVQLKEYDDLG  360

Query:  358 IYLKELLEPQNEFLARLSNLVREPRLASFIIGSREKFAEKHINLSTEILVEIPTKSTVED  417
             Y+K++   Q      + +  V+   LA F++G++       E+  NL E      IP  +
Sbjct:  361 DYIKDIAIQQKSETSEIINDVKSSVLAGFLLGKQSFIREQGANLDIECNGVIPNAADPSV  420

Query:  418 VNNYL-LLHRYINTKILTLLN-STTLVSLRLNYQNNLIETD                    456
              ++   + ++    IN   + +  +    +++ + + N++++ +
Sbjct:  421 IHELITIIGNLINNGLDAVADMPKKQITHSMRFHNSILDIE                    461
```

45

A related DNA sequence was identified in *S. pyogenes* <SEQ ID 6947> which encodes the amino acid sequence <SEQ ID 6948>. Analysis of this protein sequence reveals the following:

```
Possible site: 57
>>> Seems to have a cleavable N-term signal seq.
INTEGRAL Likelihood = -10.03 Transmembrane 174-190 ( 170-195)

----- Final Results -----
             bacterial membrane --- Certainty = 0.5012(Affirmative) < succ>
               bacterial outside --- Certainty = 0.0000(Not Clear)  < succ>
             bacterial cytoplasm --- Certainty = 0.0000(Not Clear)  < succ>
```

An alignment of the GAS and GBS proteins is shown below.

```
Identities = 236/488 (48%), Positives = 337/488 (68%), Gaps = 3/488 (0%)

Query:    3 MKKKLSLWAFLSLILVTMTICIFSIFYYVTIHQSYRNVRVQEEKILKNTGYALSRNPQVI   62
            MKK L LWA LSLILV+M +   S+FY +  +H +++ ++ QE  +L  TG  L+ +  +
```

```
                             -continued
Sbjct:    1 MKKPLRLWASLSLILVSMIVVTTSLFYGIMLHDTHQSIKNQETHLLTSTGKNLASHQAIK   60

Query:   63 QTLKDNHYDQSLQKQMLFLSKKSNLDYIVLINLKGIRFTHPDSTKIGKPFQGGDEQAVFK  122
              + L +N +           ++   NLDY+V++N+KGIR THP+   IGKPFQGGDE+AV
Sbjct:   61 ELLLNNQPNAKTTAYTNSIASIYNLDYVVVMNMKGIRLTNPNPKNIGKPFQGGDEEAVLA  120

Query:  123 GKAIMSTAEGSLGKSLRYLIPVYDHQKQVGAIAVGLKLTTLGDLSQSSIKEFSKPLLISI  182
              GK ++STA+G+LGKSLRYL+PV+D  KQ+GAIAVG+KLTTL D++ +S + ++  LL+ +
Sbjct:  121 GKKVISTAKGTLGKSLRYLVPVFDGDKQIGAIAVGIKLTTLNDVALTSKRNYTLSLLLCL  180

Query:  183 LISLVVTSIISYGLKKQLHNLHPSDIFQHLEERNATLDQIQAAVFVIDQRHIIKRNNPAA  242
                  LISL+VTS IS+ LK+QLH L PS+I+Q  EERNA LDQI+AAVFV+D+  I++  N A
Sbjct:  181 LISLLVTSFISFRLKRQLHQLEPSEIYQLFEERNAMLDQIEAAVFVVDKAGILQLCNQAG  240

Query:  243 SLLFKKEGQRDLFSGKLLESLIPQLKQDHFSKKTEQVLHFQGQDYLLSISPITVKTQNRG  302
                     L ++ Q     +G      L P   +    +  EQ+   +  +DYLL+ISPI VK  +RG
Sbjct:  241 QKLIARKCQLGKPTGNSFNYLFPQFPKLSLQEGHEQLFRYGEEDYLLAISPICVKNDHRG  300

Query:  303 YVVFLRNVTETLWTLDQLAHTTAYASALQAQTHQFMNQLHVIYGLADIEYYDELKIYLKE  362
                   +++F+R    + +  TLDQLA+TTAYASALQAQTH+FMNQLHVIYGL DI YYD+LKIYL
Sbjct:  301 HIIFMREAVKAIDTLDQLAYTTAYASALQAQTNKFMNQLHVIYGLVDIAYYDQLKIYLDS  360

Query:  363 LLEPQNEFLARLSNLVREPRLASFIIGEREKFAEKHINLSTEILVEIPTKSTVEDVNNYL  422
                  +LEP+NE L   LS+LV+EP LASF+IGE+EK+ E +++L   ++L EIP  +T     +NN L
Sbjct:  361 ILEPENEILTSLSVLVKEPLLASFLIGEQEKYQELNVHLKIDVLSEIPHSATKNQLNNGL  420

Query:  423 LLHRYINTKILTLLNSTTLVSLRLNYQNNLIETDYQWENEKWL-LNOYHQYFNDAYFQQL  481
                  +++R+I+T +LT L    +LV   + QN+LI  +    + W+ L      F+  YFQQL
Sbjct:  421 MIYRFIHTNLLTTLRPKSLVLSIQHDQNHLI--SHYTLTDNWIDLERVQPIFDLPYFQQL  478

Query:  482 LVDSRATY                                                      489
                  L  D+ + +
Sbjct:  479 LTDTNSQF                                                      486
```

SEQ ID 9004 (GBS130d) was expressed in *E. coli* as a GST-fusion product. SDS-PAGE analysis of total cell extract is shown in FIG. 123 (lane 8-10; MW 63 kDa) and in FIG. 184 (lane 4; MW 63kDa). It was also expressed in *E. coli* as a His-fusion product. SDS-PAGE analysis of total cell extract is shown in FIG. 123 (lane 11; MW 38 kDa) and in FIG. 181 (lane 7; MW 38 kDa).

GBS130d-GST was purified as shown in FIG. 237, lane 11. GBS130d-His was purified as shown in FIG. 233, lane 9-10.

Based on this analysis, it was predicted that these proteins and their epitopes could be useful antigens for vaccines or diagnostics.

EXAMPLE 2247

A DNA sequence (GBSx2368) was identified in *S. agalactiae* <SEQ ID 6949> which encodes the amino acid sequence <SEQ ID 6950>. Analysis of this protein sequence reveals the following:

```
Possible site: 51

>>> Seems to have no N-terminal signal sequence

INTEGRAL Likelihood = -11.52 Transmembrane 364-380  ( 353-386)
INTEGRAL Likelihood =  -9.66 Transmembrane  33-49   ( 26-57)
INTEGRAL Likelihood =  -7.80 Transmembrane  87-103  ( 82-105)
INTEGRAL Likelihood =  -6.85 Transmembrane 153-169  ( 144-174)
INTEGRAL Likelihood =  -4.41 Transmembrane 301-317  ( 300-318)
INTEGRAL Likelihood =  -2.81 Transmembrane 216-232  ( 212-235)
INTEGRAL Likelihood =  -2.39 Transmembrane 120-136  ( 120-136)
INTEGRAL Likelihood =  -1.65 Transmembrane  57-73   ( 56-73)
INTEGRAL Likelihood =  -1.17 Transmembrane 428-444  ( 428-444)
INTEGRAL Likelihood =  -0.32 Transmembrane 276-292  ( 276-292)

----- Final Results -----
           bacterial membrane --- Certainty = 0.5607(Affirmative) < succ>
            bacterial outside --- Certainty = 0.0000(Not Clear)   < succ>
          bacterial cytoplasm --- Certainty = 0.0000(Not Clear)   < succ>
```

The protein has homology with the following sequences in the GENPEPT database.

```
>GP:AAB18291 GB:U35658 L-malate permease [Streptococcus bovis] Identities
= 329/428 (76%), Positives = 375/428 (86%)
Query:  18 DLKAKLFHIKIGSVPLPVYVCLALLILLAGFLQKLPVNMLGGFAVILTMGWFLGTIGASI  77
           D + KL   +IGSV LPVY+  A +IL+   L++LPVNMLGGFAVILTMGW LGTIG +I
Sbjct:  14 DWRNKLTKTRIGSVTLPVYLVTASIILVTALLEQLPVNMLGGFAVILTMGWLLGTIGGNI  73

Query:  78 PGFKNFGGPAILSLLVPSILVFFNLINKNVLESTNMLMKQANFLYFIACLVSGSILGMN  137
           P   K+FGGPAILSLLVPSI+VFFNL+N+NVL+ST++LMKQANFLYFIACLV GSILGMN
Sbjct:  74 PILKHFGGPAILSLLVPSIMVFFNLLNQNVLDSTDILMKQANFLYFIACLVCGSILGMN  133

Query: 138 RKMLIQGLLPMIFPMLLGMVCAMMVGTFVGVILGLEWRHTLFYIVTPVLAGGIGEGILPL  197
           RK+L+QGL+RMI PM LGM+ AM VGT VG +LGL W+H+LEYIVTPVLAGGIGEGILPL
Sbjct: 134 RKILVQGLMRMIVPMALGMILAMGVGTLVGTLLGLGWKHSLFYIVTPVLAGGIGEGILPL  193

Query: 198 SLGYSSITGVASEQLVAQLIPATIIGMFFAILCTALLMRLGSKKPHLSGQGQLVRLMKGE  257
           SLGYS+ITG+SEQLV QLIPATIIGMWFAI+C+ LL+RLGEK+P LSGQGQL+++    +
Sbjct: 194 SLGYSAITGLPSEQLVGQLIPATIIGMFFAIMCSGLLSRLGEKRPELSGQGQLIEITMSD  253

Query: 258 DMSDIIADHSGPIDVKKMGGGVLTACSLFIFGHLLQQLTGFPGPVLMIVAAAILRYINVI  317
           D+SD + +   PIDVE MG GVL AC+LFI G LLQ LTGFPGPVLMIV AA LKY+NV+
Sbjct: 254 DLSDALEEDKAPIDVKLMGAGVLIACTLFITGGLLQHLTGFPGPVLMIVVAAFLKYLNVV  313

Query: 318 PRETQNGAKQLYKFISGNFTFPLMAGLGLLYIPLKDVVATLSIQYFIVVISVVFTVISVG  377
           P+ETQ G+KQLYKFISGNFTFPLM GLG+LYIPLKDVV  LS QYF+VVISVVFTVI+ G
Sbjct: 314 PKETQRGSKQLYKFISGMFTFPLMVGLGMLYIPLKDVVGMLSWQYFVVVISVVFTVIATG  373

Query: 378 FFVSRFLNMNPVEAGIISACQSGMGGTGDVAILSTADRMNLMPFAQVATRLGGAITVITM  437
           FFVSRF+NMMPVEA I+SACQSGMGGTGDVAILSTA+RM LMPFAQVATRLGGAITVITM
Sbjct: 374 FFVSRFMNMNPVEAAIVSACQSGMGGTGDVAILSTANRMTLMPFAQVATRLGGAITVITM  433

Query: 438 TAILRMLF  445
           TAI RMLF
Sbjct: 434 TAIFRMLF  441
```

A related DNA sequence was identified in *S. pyogenes* <SEQ ID 6951> which encodes the amino acid sequence <SEQ ID 6952>. Analysis of this protein sequence reveals the following:

```
Possible site: 48
>>> Seems to have no N-terminal signal sequence
INTEGRAL Likelihood = -11.89 Transmembrane 361-377 ( 350-383)
INTEGRAL Likelihood =  -7.43 Transmembrane  84-100 (  79-102)
INTEGRAL Likelihood =  -6.16 Transmembrane 150-166 ( 137-171)
INTEGRAL Likelihood =  -4.88 Transmembrane  30-46  (  24-48)
INTEGRAL Likelihood =  -4.35 Transmembrane 299-315 ( 297-316)
INTEGRAL Likelihood =  -4.14 Transmembrane 117-133 ( 115-134)
INTEGRAL Likelihood =  -3.19 Transmembrane  54-70  (  51-75)
INTEGRAL Likelihood =  -2.92 Transmembrane 425-441 ( 425-442)
INTEGRAL Likelihood =  -2.81 Transmembrane 213-229 ( 209-232)
INTEGRAL Likelihood =  -2.44 Transmembrane 273-289 ( 271-290)

----- Final Results -----
            bacterial membrane --- Certainty = 0.5755(Affirmative) < succ>
             bacterial outside --- Certainty = 0.0000(Not Clear) < succ>
           bacterial cytoplasm --- Certainty = 0.0000(Not Clear) < succ>
```

The protein has homology with the following sequences in the databases:

```
>GP: AAB18291 GB: U35658 L-malate permease [Streptococcus bovis]
Identities = 344/443 (77%), Positives = 394/443 (88%), Gaps = 6/443 (1%)

Query:   4 ISKKMPQKDLSEHSKAWQNR----RIGSVPLPVYLVLATLILVTGWLQQLPVNMLGGFAV  59
           + KK+P  +E   W+N+    RIGSV LPVYLV A++ILVT L+QLPVNMLGGFAV
Sbjct:   1 MEKKLPATAANETD--WRNKLTKTRIGSVTLPVYLVTASIILVTALLEQLPVNMLGGFAV  58

Query:  60 ILTLGWLLGTIGATIPGLKHFGGPAILSLLVPSILVFFNLLNPNVLEATNVLMKQANFLY  119
           ILT+GWLLGTIG  IP LKHFGGPAILSLLVPSI+VFFNLLN NVL++T++LMKQANFLY
Sbjct:  59 ILTMGWLLGTIGGNIPILKHFGGPAILSLLVPSIMVFFNLLNQNVLDSTDILMKQANFLY  118

Query: 120 FYIACLVCGSILGMNRKILIQGLFRMIIPMLLGMVCAMGVGTLVGVILGLDWQHTLFYVV  179
           FYIACLVCGSILGMNRKIL+QGL RMI+PM LGM+ AMGVGTLVG +LGL W+H+LFY+V
```

```
                              -continued
Sbjct:  119 FYIACLVCGSILGMNRKILVQGLMRMIVPMALGMILAMGVGTLVGTLLGLGWKHSLFYIV  178

Query:  180 TPVLAGGIGEGILPLSLGYSAITGVGSEQLVAQLIPATIIGNFFAILCTALLNRFGEKHP  239
            TPVLAGGIGEGILPLSLGYSAITG+ SEQLV QLIPATIIGNFFAI+C+ LL+R GEK P
Sbjct:  179 TPVLAGGIGEGILPLSLGYSAITGLPSEQLVGQLIPATIIGNFFAIMCSGLLSRLGEKRP  238

Query:  240 SYSGQGQLVKIGHSEDMSDALKDNSGALDVKLMGAGVLTACSLFIAGGLLQHLTDFPGPV  299
            S SGQGQL+KI +S+D+SDAL+++    +DVKLMGAGVL AC+LFI GGLLQHLT FPGPV
Sbjct:  239 ELSGQGQLIKITNSDDLSDALEEDKAPIDVKLMGAGVLIACTLFITGGLLQHLTGFPGPV  298

Query:  300 LMIILAAFLKYLNVIPQETQNGAKQLYKFISSNFTFPLMAGLGLLYIPLKEVVATLSWQY  359
            LMI++AAFLKYLNV+P+ETQ G+KQLYKFIS NFTFPLM GLG+LYIPLK+VV  LSWQY
Sbjct:  299 LMIVVAAFLKYLNVVPKETQRGSKQLYKFISGNFTFPLMVGLGMLYIPLKDVVGMLSWQY  358

Query:  360 FIVVISVVLTVVSVGFFVSRFLNMSPVEAAIISACQSGMGGTGDVAILSTADRMNLMPFA  419
            F+VVISVV TV++ GFFVSRF+NM+PVEAAI+SACQSGMGGTGDVAILSTA+RM LMPFA
Sbjct:  359 FVVVISVVFTVIATGFFVSRFMNMNPVEAAIVSACQSGMGGTGDVAILSTANRMTLMPFA  418

Query:  420 QVATRLGGAITVITMTAILRIIF                                      442
            QVATRLGGAITVITMTAI R++F
Sbjct:  419 QVATRLGGAITVITMTAIFRMLF                                      441
```

An alignment of the GAS and GBS proteins is shown below.

```
Identities = 356/419 (84%), Positives = 385/419 (90%)

Query:   27 KIGSVPLPVYVCLALLILLAGFLQKLPVNMLGGFAVILTMGWFLGTIGASIPGFKNFGGP   86
            +IGSVPLPVY+ LA LIL+ G+LQ+LPVNMLGGFAVILT+GW LGTIGA+IPG K+FGGP
Sbjct:   24 RIGSVPLPVYLVLATLILVTGWLQQLPVNMLGGFAVILTLGWLLGTIGATIPGLKHFGGP   83

Query:   87 AILSLLVPSILVFFNLINKNVLESTNMLMKQANFLYFYIACLVSGSILGMNRKMLIQGLL  146
            AILSLLVPSILVFFNL+N NVLE+TN+LMKQANFLYFYIACLV GSILGMNRK+LIQGL
Sbjct:   84 AILSLLVPSILVFFNLLNPNVLEATNVLMKQANFLYFYIACLVCGSILGMNRKILIQGLF  143

Query:  147 RMIFPMLLGMVCAMMVGTFVGVILGLEWRHTLFYIVTPVLAGGIGEGILPLSLGYSSITG  206
            RMI PMLLGMVCAM VGT VGVILGL+W+HTLFY+VTPVLAGGIGEGILPLSLGYS+ITG
Sbjct:  144 RMIIPMLLGMVCAMGVGTLVGVILGLDWQHTLFYVVTPVLAGGIGEGILPLSLGYSAITG  203

Query:  207 VASEQLVAQLIPATIIGNFFAILCTALLNRLGEKKPHLSGQGQLVRLNKGEDMSDIIADH  266
            V SEQLVAQLIPATIIGNFFAILCTALLNR GEK P  SGQGQLV++    EDMSD + D+
Sbjct:  204 VGSEQLVAQLIPATIIGNFFAILCTALLNRFGEKHPSYSGQGQLVKIGHSEDMSDALKDN  263

Query:  267 SGPIDVKKMGGGVLTACSLFIFGHLLQQLTGFPGPVLMIVAAAILKYINVIPRETQNGAK  326
            SG +DVK MG GVLTACSLFI G LLQ LT FPGPVLMI+ AA LKY+NVIP+ETQNGAK
Sbjct:  264 SGALDVKLMGAGVLTACSLFIAGGLLQHLTDFPGPVLMIILAAFLKYLNVIPQETQNGAK  323

Query:  327 QLYKFISGNFTFPLMAGLGLLYIPLKDVVATLSIQYFIVVISVVFTVISVGFFVSRFLNM  386
            QLYKFIS NFTFPLMAGLGLLYIPLK+VVATLS QYFIVVISVV TV+SVGFFVSRFLNM
Sbjct:  324 QLYKFISSNFTFPLMAGLGLLYIPLKEVVATLSWQYFIVVISVVLTVVSVGFFVSRFLNM  383

Query:  387 NPVEAGIISACQSGMGGTGDVAILSTADRMNLMPFAQVATRLGGAITVITMTAILRMLF   445
            +PVEA IISACQSGMGGTGDVAILSTADRMNLMPFAQVATRLGGAITVITMTAILR++F
Sbjct:  384 SPVEAAIISACQSGMGGTGDVAILSTADRMNLMPFAQVATRLGGAITVITMTAILRIIF   442
```

Based on this analysis, it was predicted that these proteins and their epitopes could be useful antigens for vaccines or diagnostics.

EXAMPLE 2248

A DNA sequence (GBSx2369) was identified in *S. agalactiae* <SEQ ID 6953> which encodes the amino acid sequence <SEQ ID 6954>. This protein is predicted to be malic enzyme (mae). Analysis of this protein sequence reveals the following:

```
Possible site: 48
>>> Seems to have no N-terminal signal sequence
     INTEGRAL    Likelihood = -2.28    Transmembrane   164-180 (164-181)

----- Final Results -----
            bacterial membrane --- Certainty = 0.1914(Affirmative) < succ>
             bacterial outside --- Certainty = 0.0000(Not Clear)   < succ>
           bacterial cytoplasm --- Certainty = 0.0000(Not Clear)   < succ>
```

The protein has homology with the following sequences in the GENPEPT database.

```
>GP: AAB07709 GB: U35659 malic enzyme [Streptococcus bovis]
Identities = 285/386 (73%), Positives = 332/386 (85%), Gaps = 1/386 (0%)

Query:    2 SENLGQLAINQARENGGKLEVISKVKVEDKRDLSIAYTPGVASVSSAIAEDVELAYELTT    61
            ++++ +LAI QA++ GGKLEV  KV +E K DL IAYTPGVA+VSSAI E   E AYELTT
Sbjct:    3 TKDVKELAIEQAKKFGGKLEVCPKVPIETKADLGIAYTPGVAAVSSAIYEKKERAYELTT    62

Query:   62 KKNTVAVVSDGSAVLGLGDIGPEAAMPVMEGKAALFKRFANVDAVPIVLKTNDTEEIISI   121
            KKNTVAV+SDGSAVLGLG+IGPEAAMPVMEGKAALFKRFA VD++P+VL T DTEEII
Sbjct:   63 KKNTVAVISDGSAVLGLGNIGPEAAMPVMEGKAALFKRFAGVDSIPLVLDTQDTEEIIQT   122

Query:  122 VKAISPTFGGINLEDISAPRCFEIEQRLIEECDIPVFHDDQHGTAIVVLAALFNSLKLVK   181
            VK ++PTFGGINLEDISAPRCFEIEQRLI+E DIPVFHDDQHGTAIVVLAAL+NSLKL+
Sbjct:  123 VKFLAPTFGGINLEDISAPRCFEIEQRLIDELDIPVFHDDQHGTAIVVLAALYNSLKLIN   182

Query:  182 KDIEDIRVVVNGGGSAGLSITRKLLSAGAKHVTVVDRFGIINDKDRESLAPHHKAIAKLT   241
            K IEDI VV+NGGGSAGLSITRK L+AG KH+ +VDR GI+++ D  +L PHH  IAKLT
Sbjct:  183 KKIEDIHVVINGGGSAGLSITRKFLAAGVKHIIIVDRTGILSETD-TALPPHHAEIAKLT   241

Query:  242 NREFQSGSLEDALENADVFIGVSAPEALHAEWISKMADKPIVFAMANPIPEIYPDQALKA   301
            NRE ++G L  ALE ADVF+GVSAP  L  EWI +M ++P++FAMANP+PEI+PD+AL A
Sbjct:  242 NREHRTGDLATALEGADVFVGVSAPGVLKPEWIQQMNEQPVIFAMANPVPEIFPDEALAA   301

Query:  302 GAYIVGTGRSDFPNQINNVLAFPGIFRGALDARAKTITVEMQIAAARGIASLIPEEELST   361
            GAYIVGTGRSDFPNQINNVLAFPGIFRGALDARAK IT+EMQIAAA+GIA LIP+ EL+
Sbjct:  302 GAYIVGTGRSDFPNQINNVLAFPGIFRGALDARAKKITIEMQIAAAKGIAKLIPDNELTP   361

Query:  362 THIIPNAFQNDVADVVAKSVSNAVQK                                    387
            T+IIP+ FQ   VA VVA+SV NAV++
Sbjct:  362 TNIIPDPFQEGVAKVVAESVRNAVKE                                    387
```

A related DNA sequence was identified in *S. pyogenes* <SEQ ID 6955> which encodes the amino acid sequence <SEQ ID 6956>. Analysis of this protein sequence reveals the following:

```
Possible site: 48
>>> Seems to have no N-terminal signal sequence
     INTEGRAL    Likelihood = -2.44    Transmembrane   164-180 (164-181)
     INTEGRAL    Likelihood = -1.75    Transmembrane    94-110  (94-110)

----- Final Results -----
            bacterial membrane --- Certainty = 0.1977(Affirmative) < succ>
             bacterial outside --- Certainty = 0.0000(Not Clear)  < succ>
           bacterial cytoplasm --- Certainty = 0.0000(Not Clear)  < succ>
```

The protein has homology with the following sequences in the databases:

```
>GP: AAB07709 GB: U35659 malic enzyme [Streptococcus bovis]
Identities = 289/379 (76%), Positives = 334/379 (87%), Gaps = 1/379 (0%)

Query:    7 QLALEQAKTFGGKLEVQPKVDIKTKHDLSIAYTPGVASVSSAIAKDKTLAYDLTTKKNTV    66
            +LA+EQAK FGGKLEV PKV I+TK DL IAYTPGVA+VSSAI + K  AY+LTTKKNTV
Sbjct:    8 ELAIEQAKKFGGKLEVCPKVPIETKADLGIAYTPGVAAVSSAIYEKKERAYELTTKKNTV    67

Query:   67 AVISDGTAVLGLGDIGPEAAMPVMEGKAALFKAFAGVDAIPIVLDTKDTEEIISIVKALA   126
            AVISDG+AVLGLG+IGPEAAMPVMEGKAALFK FAGVD+IP+VLDT DTEEII  VK LA
Sbjct:   68 AVISDGSAVLGLGNIGPEAAMPVMEGKAALFKRFAGVDSIPLVLDTQDTEEIIQTVKFLA   127

Query:  127 PTFGGINLEDISAPRCFEIEQRLIKECHIPVFHDDQHGTAIVVLAAIFNSLKLLKKSLDE   186
            PTFGGINLEDISAPRCFEIEQRLI E  IPVFHDDQHGTAIVVLAA++NSLKL+ K +++
Sbjct:  128 PTFGGINLEDISAPRCFEIEQRLIDELDIPVFHDDQHGTAIVVLAALYNSLKLINKKIED   187

Query:  187 VSIVVNGGGSAGLSITRKLLAAGATKVTVVDKFGIINEQEAAQLAPHHLDIAKVTNREFK   246
            + +V+NGGGSAGLSITRK LAAG   +VD+ GI++E + A L PHH +IAK+TNRE +
Sbjct:  188 IHVVINGGGSAGLSITRKFLAAGVKHIIIVDRTGILSETDTA-LPPHHAEIAKLTNREHR   246

Query:  247 SGTLEDALEGADIFIGVSAPGVLKAEWISKMAARPVIFAMANPIPEIYPDEALEAGAYIV   306
            +G L  ALEGAD+F+GVSAPGVLK EWI +M  +PVIFAMANP+PEI+PDEAL AGAYIV
Sbjct:  247 TGDLATALEGADVFVGVSAPGVLKPEWIQQMNEQPVIFAMANPVPEIFPDEALAAGAYIV   306
```

-continued

```
Query:  307 GTGRSDFPNQINNVLAFPGIFRGALDARAKTITVEMQIAAAKGIASLVPDDALSTTNIIP  366
            GTGRSDFPNQINNVLAFPGIFRGALDARAK IT+EMQIAAAKGIA L+PD+ L+ TNIIP
Sbjct:  307 GTGRSDFPNQINNVLAFPGIFRGALDARAKKITIEMQIAAAKGIAKLIPDNELTPTNIIP  366

Query:  367 DAFKEGVAEIVAKSVRSVV                                          385
            D F+EGVA++VA+SVR+ V
Sbjct:  367 DPFQEGVAKVVAESVRNAV                                          385
```

An alignment of the GAS and GBS proteins is shown below.

```
Identities = 306/387 (79%), Positives = 349/387 (90%)

Query:    1 MSENLGQLAINQARENGGKLEVISKVKVEDKRDLSIAYTPGVASVSSAIAEDVELAYELT   60
            M   LGQLA+ QA+  GGKLEV  KV ++ K DLSIAYTPGVASVSSAIA+D  LAY+LT
Sbjct:    1 MKNQLGQLALEQAKTFGGKLEVQPKVDIKTKHDLSIAYTPGVASVSSAIAKDKTLAYDLT   60

Query:   61 TKKNTVAVVSDGSAVLGLGDIGPEAAMPVMEGKAALFKRFANVDAVPIVLKTNDTEEIIS  120
            TKKNTVAV+SDG+AVLGLGDIGPEAAMPVMEGKAALFK FA VDA+PIVL T DTEEIIS
Sbjct:   61 TKKNTVAVISDGTAVLGLGDIGPEAAMPVMEGKAALFKAFAGVDAIPIVLDTKDTEEIIS  120

Query:  121 IVKAISPTFGGINLEDISAPRCFEIEQRLIEECDIPVFHDDQHGTAIVVLAALFNSLKLV  180
            IVKA++PTFGGINLEDISAPRCFEIEQRLI+EC IPVFHDDQHGTAIVVLAA+FNSLKL+
Sbjct:  121 IVKALAPTFGGINLEDISAPRCFEIEQRLIKECHIPVFHDDQHGTAIVVLAAIFNSLKLL  180

Query:  181 KKDIEDIRVVVNGGGSAGLSITRKLLSAGAKHVTVVDRFGIINDKDRESLAPHHKAIAKL  240
            KK ++++ +VVNGGGSAGLSITRKLL+AGA  VTVVD+FGIIN+++   LAPHH  IAK+
Sbjct:  181 KKSLDEVSIVVNGGGSAGLSITRKLLAAGATKVTVVDKFGIINEQEAAQLAPHHLDIAKV  240

Query:  241 TNREFQSGSLEDALENADVFIGVSAPEALHAEWISKMADKPIVFAMANPIPEIYPDQALK  300
            TNREF+SG+LEDALE AD+FIGVSAP  L AEWISKMA +P++FAMANPIPEIYPD+AL+
Sbjct:  241 TNREFKSGTLEDALEGADIFIGVSAPGVLKAEWISKMAARPVIFAMANPIPEIYPDEALE  300

Query:  301 AGAYIVGTGRSDFPNQINNVLAFPGIFRGALDARAKTITVEMQIAAARGIASLIPEEELS  360
            AGAYIVGTGRSDFPNQINNVLAFPGIFRGALDARAKTITVEMQIAAA+GIASL+P++ LS
Sbjct:  301 AGAYIVGTGRSDFPNQINNVLAFPGIFRGALDARAKTITVEMQIAAAKGIASLVPDDALS  360

Query:  361 TTHIIPNAFQNDVADVVAKSVSNAVQK                                  387
            TT+IIP+AF+  VA++VAKSV + V K
Sbjct:  361 TTNIIPDAFKEGVAEIVAKSVRSVVLK                                  387
```

Based on this analysis, it was predicted that these proteins and their epitopes could be useful antigens for vaccines or diagnostics.

EXAMPLE 2249

A DNA sequence (GBSx2370) was identified in *S. agalactiae* <SEQ ID 6957> which encodes the amino acid sequence <SEQ ID 6958>. This protein is predicted to be Bta. Analysis of this protein sequence reveals the following:

```
Possible site: 19
>>> Seems to have no N-terminal signal sequence
     INTEGRAL    Likelihood = -2.02     Transmembrane     29-45 (29-45)

----- Final Results -----
            bacterial membrane --- Certainty = 0.1808(Affirmative) < succ>
            bacterial outside  --- Certainty = 0.0000(Not Clear)   < succ>
            bacterial cytoplasm --- Certainty = 0.0000(Not Clear)   < succ>
```

The protein has homology with the following sequences in the GENPEPT database.

```
>GP: AAD56628 GB: AF165218 Bta [Streptococcus pneumoniae]
Identities = 35/112 (31%), Positives = 63/112 (56%)

Query:    1 MYSFEELLATMTLITAAEIEDKIDSNQDFVLFIGRISCPFCHLFVPKIVEVADEDEFELF   60
            M  F + + +T   ++ +D +     FIGR +CP+C  F   + V E +  ++
Sbjct:    1 MEQFLDNIKDLEVTTVVRAQEALDKKETATFFIGRKTCPYCRKFAGTLSGVVAETKAHIY   60
```

-continued

```
Query:  61 HLDSEDFDHWTANKEFRNKYDIPTVPGLMVVKNGTIKVKCDSKMTKEEIREF      112
           ++SE+         + FR++Y IPTVPG + + +G I V+CDS M+ +EI++F
Sbjct:  61 FINSEEASQLNDLQAFRSRYGIPTVPGFVHITDGQINVRCDSSMSAQEIKDF      112
```

A related DNA sequence was identified in *S. pyogenes* <SEQ ID 6959> which encodes the amino acid sequence <SEQ ID 6960>. Analysis of this protein sequence reveals the following:

```
Possible site: 25
>>> Seems to have no N-terminal signal sequence

----- Final Results -----
            bacterial cytoplasm --- Certainty = 0.0900(Affirmative) < succ>
            bacterial membrane  --- Certainty = 0.0000(Not Clear)   < succ>
             bacterial outside  --- Certainty = 0.0000(Not Clear)   < succ>
```

An alignment of the GAS and GBS proteins is shown below.

```
Identities = 39/111 (35%), Positives = 66/111 (59%)

Query:   3 SFEELLATMTLITAAEIEDKIDSNQDFVLFIGRISCPFCHLFVPKIVEVADEDEFELFHL   62
           +FEE++A    + AE+   I S +D ++F+GR SCP+C  F PK+ +VA +++ E++ +
Sbjct:  11 TFEEIVANFIPSSVAEVTSAIASGKDMIVFLGRSSCPYCRRFAPKLAQVATDNQKEVYFV   70

Query:  63 DSEDFDHWTANKEFRNKYDIPTVPGLMVVKNGTIKVKCDSKMTKEEIREFI           113
           DSE+           FR  Y + TVP L+V  +   + CDS +T ++I  F+
Sbjct:  71 DSENAADAAELAAFRENYQLVTVPALLVSYDQHQRAVCDSSLTPDDILAFL           121
```

SEQ ID 6958 (GBS427) was expressed in *E. coli* as a His-fusion product. SDS-PAGE analysis of total cell extract is shown in FIG. 80 (lane 5; MW 16.2kDa).

GBS427-His was purified as shown in FIG. 214, lane 8.

Based on this analysis, it was predicted that this protein and its epitopes, could be useful antigens for vaccines or diagnostics.

EXAMPLE 2250

A DNA sequence (GBSx2371) was identified in *S. agalactiae* <SEQ ID 6961> which encodes the amino acid sequence <SEQ ID 6962>. Analysis of this protein sequence reveals the following:

```
Possible site: 26
>>> Seems to have an uncleavable N-term signal seq
     INTEGRAL      Likelihood = -7.75     Transmembrane    2-18 (1-21)

----- Final Results -----
            bacterial membrane  --- Certainty = 0.4100(Affirmative) < succ>
             bacterial outside  --- Certainty = 0.0000(Not Clear)   < succ>
            bacterial cytoplasm --- Certainty = 0.0000(Not Clear)   < succ>
```

A related GBS nucleic acid sequence <SEQ ID 9437> which encodes amino acid sequence <SEQ ID 9438> was also identified.

The protein has homology with the following sequences in the GENPEPT database.

```
>GP: BAA11328 GB: D78257 ORF11 [Enterococcus faecalis]
Identities = 36/80 (45%), Positives = 58/80 (72%)

Query:  1 MSLPIIMLVVMVGMMFFMQRQQKKQAQERQKQLNAVQKGDEIVTIGGLFGVVDEVNTEAQ  60
          M L +IML+V+V M F++ R QKKQ +ERQ  LN +Q GD +VTIGGL GV+ E++++ +
Sbjct:  1 MKLMLIMLLVIVAMYFYLFRTQKKQQKERQDFLNNLQPGDAVVTIGGLHGVISEISSDKK  60

Query: 61 RMVLDVDGVYLTFELAAIKS                                         80
          ++ LD +G +  F+  +I++
Sbjct: 61 KVTLDCEGAFFDFDQQSIRT                                         80
```

A related DNA sequence was identified in *S. pyogenes* <SEQ ID 6963> which encodes the amino acid sequence <SEQ ID 6964>. Analysis of this protein sequence reveals the following:

```
Possible site: 60
>>> Seems to have an uncleavable N-term signal seq
      INTEGRAL     Likelihood = -6.10     Transmembrane    3-19  (1-22)
      INTEGRAL     Likelihood = -3.03     Transmembrane   63-79  (63-79)

----- Final Results -----
              bacterial membrane --- Certainty = 0.3442(Affirmative) < succ>
              bacterial outside  --- Certainty = 0.0000(Not Clear)   < succ>
              bacterial cytoplasm --- Certainty = 0.0000(Not Clear)  < succ>
```

The protein has homology with the following sequences in the databases:

```
>GP: BAA11328 GB: D78257 ORF11 [Enterococcus faecalis]
Identities = 29/75 (38%), Positives = 52/75 (68%)

Query:  6 ILMFVVMLGLIWFMQRQQKKQAQERQNQLNAIEKGDEVVTIGGMFAIVDEVDTTAKKIVL  65
          ++M +V++ + +++ R QKKQ +ERQ+ LN ++ GD VVTIGG+  ++ E+ +  KK+ L
Sbjct:  5 LIMLLVIVAMYFYLFRTQKKQQKERQDFLNNLQPGDAVVTIGGLHGVISEISSDKKKVTL  64

Query: 66 DVDGVFLTFELLAIK                                              80
          D +G F  F+   +I+
Sbjct: 65 DCEGAFFDFDQQSIR                                              79
```

An alignment of the GAS and GBS proteins is shown below.

```
Identities = 63/90 (70%), Positives = 80/90 (88%)

Query:  4 PIIMLVVMVGMMFFMQRQQKKQAQERQKQLNAVQKGDEIVTIGGLFGVVDEVNTEAQRMV  63
          PI+M VVM+G+++ FMQRQQKKQAQERQ QLNA++KGDE+VTIGG+F +VDEV+T A+++V
Sbjct:  5 PILMFVVMLGLIWFMQRQQKKQAQERQNQLNAIEKGDEVVTIGGMFAIVDEVDTTAKKIV  64

Query: 64 LDVDGVYLTFELAAIKSVVSKAATPTEPVE                               93
          LDVDGV+LTFEL AIK +V+KA T T   VE
Sbjct: 65 LDVDGVFLTFELLAIKRIVTKATTETTLVE                               94
```

Based on this analysis, it was predicted that these proteins and their epitopes could be useful antigens for vaccines or diagnostics.

EXAMPLE 2251

A DNA sequence (GBSx2372) was identified in *S. agalactiae* <SEQ ID 6965> which encodes the amino acid sequence <SEQ ID 6966>. Analysis of this protein sequence reveals the following:

```
Possible site: 21
>>> Seems to have an uncleavable N-term signal seq

----- Final Results -----
              bacterial membrane --- Certainty = 0.0000(Not Clear) < succ>
               bacterial outside --- Certainty = 0.0000(Not Clear) < succ>
             bacterial cytoplasm --- Certainty = 0.0000(Not Clear) < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 2252

A DNA sequence (GBSx2373) was identified in *S. agalactiae* <SEQ ID 6967> which encodes the amino acid sequence <SEQ ID 6968>. Analysis of this protein sequence reveals the following:

```
Possible site: 16
>>> Seems to have no N-terminal signal sequence
    INTEGRAL    Likelihood = -1.38    Transmembrane    164-180 (164-180)

----- Final Results -----
              bacterial membrane --- Certainty = 0.1553(Affirmative) < succ>
               bacterial outside --- Certainty = 0.0000(Not Clear)   < succ>
             bacterial cytoplasm --- Certainty = 0.0000(Not Clear)   < succ>
```

The protein has homology with the following sequences in the GENPEPT database.

```
>GP: CAB61731 GB: AL133220 putative oxidoreductase.
[Streptomyces coelicolor A3(2)]

Identities = 72/216 (33%), Positives = 120/216 (55%),
Gaps = 1/216 (0%)

Query:   14 AQALEARGQKLYSVANRTYDKGLEFATKYGIQKVYDHIDQVFEDPEVDIIYISTPHNTHI   73
            A  ++      ++ +VA+RT       FA ++GI + Y   + +  D +VD++Y++TPH+ H
Sbjct:   25 ADLVDLPDAEVVAVASRTEASAKTFAERFGIPRAYGGWETLARDEDVDVVYVATPHSAHR   84

Query:   74 SFLRKALANGKHVLCEKSITLNSTELKEAIDLAETNHVVLAEAMTIFHMPIYRQLKTLVD  133
             +      L  G++VLCEK   TLN+ E   E + LA   N V L EAM ++   P+ R+LK LV
Sbjct:   85 TAAGLCLEAGRNVLCEKPFTLNAREAAELVALARENGVFLMEAMWMYCNPLVRRLKELVA  144

Query:  134 SGKLGPLKMIQMNFGSYKEYDMTNRFFSRDLAGGALLDIGVYALSCIRWFMSEAPHNITS  193
              G +G ++ +Q +FG    +   +R        GGALLD+GVY +S  +  E P ++  +
Sbjct:  145 DGAIGEVRSLQADFGLAGPFPAAHRLRDPAQGGGALLDLGVYPVSFAQLLLGE-PTDVAA  203

Query:  194 QVTFAPTGVDEQVGILLTNPANEMATVSLSLHAKQP                         229
             +     +  GVD Q G LL+   + +A++  S+      P
Sbjct:  204 RAVLSEEGVDLQTGALLSYGNDALASIHCSITGGTP                         239
```

Based on this analysis, it was predicted that this protein and its epitopes, could be useful antigens for vaccines or diagnostics.

EXAMPLE 2253

A DNA sequence (GBSx2374) was identified in *S. agalactiae* <SEQ ID 6969> which encodes the amino acid sequence <SEQ ID 6970>. This protein is predicted to be surface protein Rib. Analysis of this protein sequence reveals the following:

```
Possible site: 45
>>> Seems to have no N-terminal signal sequence

----- Final Results -----
            bacterial cytoplasm --- Certainty = 0.4957(Affirmative) < succ>
             bacterial membrane --- Certainty = 0.0000(Not Clear)   < succ>
              bacterial outside --- Certainty = 0.0000(Not Clear)   < succ>
```

No corresponding DNA sequence was identified in *S. pyogenes*.

Based on this analysis, it was predicted that this protein and its epitopes, could be useful antigens for vaccines or diagnostics.

EXAMPLE 2254

A DNA sequence (GBSx2375) was identified in *S. agalactiae* <SEQ ID 6971> which encodes the amino acid sequence <SEQ ID 6972>. This protein is predicted to be surface protein Rib. Analysis of this protein sequence reveals the following:

```
Possible site: 24
>>> Seems to have no N-terminal signal sequence

----- Final Results -----
            bacterial cytoplasm --- Certainty = 0.1892(Affirmative) < succ>
             bacterial membrane --- Certainty = 0.0000(Not Clear)   < succ>
              bacterial outside --- Certainty = 0.0000(Not Clear)   < succ>
```

No corresponding DNA sequence was identified in *S. pyogenes*.

Based on this analysis, it was predicted that this protein and its epitopes, could be useful antigens for vaccines or diagnostics.

EXAMPLE 2255

A DNA sequence (GBSx2376) was identified in *S. agalactiae* <SEQ ID 6973> which encodes the amino acid sequence <SEQ ID 6974>. This protein is predicted to be a host cell surface-exposed lipoprotein. Analysis of this protein sequence reveals the following:

```
Possible site: 38
>>> Seems to have an uncleavable N-term signal seq
    INTEGRAL     Likelihood = -7.75     Transmembrane      9-25 (5-28)

----- Final Results -----
             bacterial membrane --- Certainty = 0.4100(Affirmative) < succ>
              bacterial outside --- Certainty = 0.0000(Not Clear)   < succ>
            bacterial cytoplasm --- Certainty = 0.0000(Not Clear)   < succ>
```

A related GBS nucleic acid sequence <SEQ ID 9005> which encodes amino acid sequence <SEQ ID 9006> was also identified. Analysis of this protein sequence reveals the following:

```
Lipop: Possible site: -1 Crend: 3
SRCFLG: 0
McG: Length of UR: 24
     Peak Value of UR: 2.84
     Net Charge of CR: 2
McG: Discrim Score: 10.29
GvH: Signal Score (-7.5): -4.34
     Possible site: 34
>>> Seems to have an uncleavable N-term signal seq
Amino Acid Composition: calculated from 1
ALOM program count: 1 value: -7.75 threshold: 0.0
     INTEGRAL        Likelihood = -7.75      Transmembrane    5-21 (1-24)
     PERIPHERAL      Likelihood = 13.31         86
modified ALOM score: 2.05
icml HYPID: 7 CFP: 0.410
*** Reasoning Step: 3

----- Final Results -----
              bacterial membrane --- Certainty = 0.4100(Affirmative) < succ>
              bacterial outside  --- Certainty = 0.0000(Not Clear)   < succ>
              bacterial cytoplasm --- Certainty = 0.0000(Not Clear)  < succ>
```

The protein has homology with the following sequences in the GENPEPT database.

```
>GP: AAC03455 GB: AF020798 putative host cell surface-exposed
lipoprotein [Streptococcus thermophilus bacteriophage TP-J34]
Identities = 40/102 (39%), Positives = 63/102 (61%), Gaps = 10/102 (9%)

Query: 101 KNALISAKIYSKTMNLSKQSIFEQLYSESPDKATHSDKFTKEESQYAIDHLKVDFKENAL  160
           + A+  AK Y+ T+++SK+ +  QL S          DK++++ S YA+++  +D+ + AL
Sbjct:  51 RTAVSKAKQYASTVHMSKEELRSQLVS--------FDKYSQDASDYAVENSGIDYNKQAL  102

Query: 161 ETAKSYQSSSSLSKEEIYKQLTSTLGDKFTNDEAQYAVDHLK  202
           E AK YQ + S+S + I  QL S   DKFT +EA YAV +LK
Sbjct: 103 EKAKQYQDTLSMSPDAIRDQLVSF--DKFTQEEADYAVANLK  142

Identities = 40/112 (35%), Positives = 64/112 (56%), Gaps = 9/112 (8%)

Query:  41 KKAKIKFNKTQKKIVKKAREYAKSGHMSKDSIIEKLKKDSKKYRQEDINFVINNLKVDYK  100
           + ++ K  K + V KA++YA + HMSK+ +  +L    K Y Q+ ++ + N  +DY
Sbjct:  40 QSSESKVPKEYRTAVSKAKQYASTVHMSKEELRSQLVSFDK-YSQDASDYAVENSGIDYN  98

Query: 101 KNALISAKIYSKTMNLSKQSIFEQLYSESPDKATHSDKFTKEESQYAIDHLK  152
           K AL  AK Y  T+++S  +I +QL S        DKFT+EE+ YA+ +LK
Sbjct:  99 KQALEKAKQYQDTLSMSPDAIRDQLVS--------FDKFTQEEADYAVANLK  142
```

No corresponding DNA sequence was identified in S. pyogenes.

SEQ ID 9006 (GBS122) was expressed in E. coli as a His-fusion product. SDS-PAGE analysis of total cell extract is shown in FIG. 38 (lane 6; MW 21.9 kDa).

GBS122-His was purified as shown in FIG. 202, lane 8.

Based on this analysis, it was predicted that this protein and its epitopes, could be useful antigens for vaccines or diagnostics.

EXAMPLE 2256

A DNA sequence (GBSx2377) was identified in S. agalactiae <SEQ ID 6975> which encodes the amino acid sequence <SEQ ID 6976>. This protein is predicted to be transposase (orfA). Analysis of this protein sequence reveals the following:

```
Possible site: 42

>>> Seems to have no N-terminal signal sequence

----- Final Results -----
              bacterial cytoplasm --- Certainty = 0.2830(Affirmative) < succ>
              bacterial membrane  --- Certainty = 0.0000(Not Clear)   < succ>
              bacterial outside   --- Certainty = 0.0000(Not Clear)   < succ>
```

The protein has homology with the following sequences in the GENPEPT database.

```
>GP: CAB90833 GB: AJ250837 hypothetical
protein [Streptococcus dysgalactiae]
Identities = 91/96 (94%), Positives = 93/96 (96%)

Query:   1 MSRKVRRHFTDDFKQQIVDLYNVGRKRSSLIKVYELTPSTFDKWVRQAKTTGSFKSIDNL   60
           MSRK+RRHFTDDFKQQIVDLYN GRKRSSLIK YELTPSTFDKWVRQAKTTGSFKS+DNL
Sbjct:   1 MSRKIRRHFTDDFKQQIVDLYNAGRKRSSLIKEYELTPSTFDKWVRQAKTTGSFKSVDNL   60

Query:  61 TDEQRELIELRKHNKELEMQLDILKQAAVIMAQKGK                          96
           TDEQRELIELRK NKELEMQLDILKQAAVIMAQKGK
Sbjct:  61 TDEQRELIELRKRNKELEMQLDILKQAAVIMAQKGK                          96
```

Based on this analysis, it was predicted that this protein and its epitopes, could be useful antigens for vaccines or diagnostics.

EXAMPLE 2257

A DNA sequence (GBSx2378) was identified in *S. agalactiae* <SEQ ID 6977> which encodes the amino acid sequence <SEQ ID 6978>. This protein is predicted to be transposase (orfB). Analysis of this protein sequence reveals the following:

```
Possible site: 16
>>> Seems to have no N-terminal signal sequence

----- Final Results -----
            bacterial cytoplasm --- Certainty = 0.2618(Affirmative) < succ>
             bacterial membrane --- Certainty = 0.0000(Not Clear) < succ>
              bacterial outside --- Certainty = 0.0000(Not Clear) < succ>
```

A related GBS nucleic acid sequence <SEQ ID 9915> which encodes amino acid sequence <SEQ ID 9916> was also identified.

A related GBS nucleic acid sequence <SEQ ID 9903> which encodes amino acid sequence <SEQ ID 9904> was also identified.

The protein has homology with the following sequences in the GENPEPT database.

```
>GP: CAB90834 GB: AJ250837 putative transposase
[Streptococcus dysgalactiae]
Identities = 243/259 (93%), Positives = 250/259 (95%)

Query:    1 MCRWLNMPHSSYYYQAVESVSETEFEETIKRIFLDSESRYGSRKIKICLNNEGITLSRRR    60
            MCRWLN+P SSYYY+AVE VSE E EE+IK IFL+S++RYGSRKIKICLNNEGITLSRRR
Sbjct:    1 MCRWLNIPRSSYYYKAVEPVSEAELEESIKAIFLESKARYGSRKIKICLNNEGITLSRRR    60

Query:   61 IRRIMKRLNLVSVYQKATFKPHSRGKNEAPIPNHLDRQFKQERPLQALVTDLTYVRVGNR   120
            IRRIMKRLNLVSVYQKATFKPHSRGKNEAPIPNHLDRQFK ERPLQALVTDLTYVRVGNR
Sbjct:   61 IRRIMKRLNLVSVYQKATFKPHSRGKNEAPIPNHLDRQFKPERPLQALVTDLTYVRVGNR   120

Query:  121 WAYVCLIIDLYNREIIGLSLGWHKTAELVKQAIQSIPYALTKVKMFHSDRGKEFDNQLID   180
            WAYVCLIIDLYNREIIGLSLGWHKTAELVKQAIQSIPY LTKVKMFHSDRGKEF+NQLID
Sbjct:  121 WAYVCLIIDLYNREIIGLSLGWHKTAELVKQAIQSIPYPLTKVKMFHSDRGKEFNNQLID   180

Query:  181 EILEAFGITRSLSQAGCPYDNAVAESTYRAFKIEFVYQETFQLLEELALKTKDYVHWWNY   240
            EILEAFGITRSLSQAGCPYDNAVAESTYRAFKIEFVYQETFQ LEELALKTK YVHWWNY
Sbjct:  181 EILEAFGITRSLSQAGCPYDNAVAESTYRAFKIEFVYQETFQSLEELALKTKAYVHWWNY   240

Query:  241 HRIHGSLNYQTPMTKRLIA                                          259
            HRIHGSLNYQTPMTKRLIA
Sbjct:  241 HRIHGSLNYQTPMTKRLIA                                          259
```

There is also homology to SEQ ID 32.

Based on this analysis, it was predicted that this protein and its epitopes, could be useful antigens for vaccines or diagnostics.

EXAMPLE 2258

A DNA sequence (GBSx2379) was identified in *S. agalactiae* <SEQ ID 6979> which encodes the amino acid sequence <SEQ ID 6980>. This protein is predicted to be pXO1-128. Analysis of this protein sequence reveals the following:

```
Possible site: 20

>>> Seems to have no N-terminal signal sequence

----- Final Results -----
              bacterial cytoplasm --- Certainty = 0.3684(Affirmative) < succ>
               bacterial membrane --- Certainty = 0.0000(Not Clear) < succ>
                bacterial outside --- Certainty = 0.0000(Not Clear) < succ>
```

The protein has homology with the following sequences in the GENPEPT database.

```
>GP: AAD32432 GB: AF065404 pXO1-128 [Bacillus anthracis]
Identities = 45/69 (65%), Positives = 52/69 (75%)

Query:  17 MKKAGKSNRVIMETLGIKNNSQIYTWMKWYENEELYRFHQGVGKQYTYGKGLEHLSEVEQ   76
           MKK   SNR IME LGIKN SQI TWMKWY  ++ YRF Q VGKQY+YGKG + LSE+EQ
Sbjct:   1 MKKESYSNRTIMEKLGIKNVSQIKTWMKWYRTDQTYRFQQPVGKQYSYGKGPKELSELEQ   60

Query:  77 LQLQVDLLK                                                    85
           L+L+   LK
Sbjct:  61 LRLENKHLK                                                    69
```

No corresponding DNA sequence was identified in *S. pyogenes*.

Based on this analysis, it was predicted that this protein and its epitopes, could be useful antigens for vaccines or diagnostics.

EXAMPLE 2259

A DNA sequence (GBSx2380) was identified in *S. agalactiae* <SEQ ID 6981> which encodes the amino acid sequence <SEQ ID 6982>. This protein is predicted to be transposase. Analysis of this protein sequence reveals the following:

```
Possible site: 25

>>> Seems to have an uncleavable N-term signal seq

----- Final Results -----
               bacterial membrane --- Certainty = 0.0000(Not Clear) < succ>
                bacterial outside --- Certainty = 0.0000(Not Clear) < succ>
              bacterial cytoplasm --- Certainty = 0.0000(Not Clear) < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 2260

A DNA sequence (GBSx2382) was identified in *S. agalactiae* <SEQ ID 6985> which encodes the amino acid sequence <SEQ ID 6986>. This protein is predicted to be Lmb. Analysis of this protein sequence reveals the following:

```
Possible site: 18
>>> May be a lipoprotein

----- Final Results -----
            bacterial membrane  --- Certainty = 0.0000(Not Clear) < succ>
            bacterial outside   --- Certainty = 0.0000(Not Clear) < succ>
            bacterial cytoplasm --- Certainty = 0.0000(Not Clear) < succ>
```

A related DNA sequence was identified in *S. pyogenes* <SEQ ID 1595> which encodes the amino acid sequence <SEQ ID 1596>. Analysis of this protein sequence reveals the following:

```
Possible site: 18
>>> May be a lipoprotein

----- Final Results -----
            bacterial membrane  --- Certainty = 0.0000(Not Clear) < succ>
            bacterial outside   --- Certainty = 0.0000(Not Clear) < succ>
            bacterial cytoplasm --- Certainty = 0.0000(Not Clear) < succ>
```

An alignment of the GAS and GBS proteins is shown below.

```
Identities = 302/306 (98%), Positives = 303/306 (98%)

Query:   1 MKKVFFLMAMVVSLVMIAGCDKSANPKQPTQGMSVVTSFYPMYAMTKEVSGDLNDVRMIQ   60
           MKK FFLMAMVVSLVMIAGCDKSANPKQPTQGMSVVTSFYPMYAMTKEVSGDLNDVRMIQ
Sbjct:   1 MKKGFFLMAMVVSLVMIAGCDKSANPKQPTQGMSVVTSFYPMYAMTKEVSGDLNDVRMIQ   60

Query:  61 SGAGIHSFEPSVNDVAAIYDADLFVYHSHTLEAWARDLDPNLKKSKVNVFEASKPLTLDR  120
           SGAGIHSFEPSVNDVAAIYDADLFVYHSHTLEAWARDLDPNLKKSKV+VFEASKPLTLDR
Sbjct:  61 SGAGIHSFEPSVNDVAAIYDADLFVYHSHTLEAWARDLDPNLKKSKVDVFEASKPLTLDR  120

Query: 121 VKGLEDMEVTQGIDPATLYDPHTWTDPVLAGEEAVNIAKELGHLDPKHKDSYTKKAKAFK  180
           VKGLEDMEVTQGIDPATLYDPHTWTDPVLAGEEAVNIAKELG LDPKHKDSYTK AKAFK
Sbjct: 121 VKGLEDMEVTQGIDPATLYDPHTWTDPVLAGEEAVNIAKELGRLDPKHKDSYTKNAKAFK  180

Query: 181 KEAEQLTEEYTQKFKKVRSKTFVTQHTAFSYLAKRFGLKQLGISGISPEQEPSPRQLKEI  240
           KEAEQLTEEYTQKFKKVRSKTFVTQHTAFSYLAKRFGLKQLGISGISPEQEPSPRQLKEI
Sbjct: 181 KEAEQLTEEYTQKFKKVRSKTFVTQHTAFSYLAKRFGLKQLGISGISPEQEPSPRQLKEI  240

Query: 241 QDFVKEYNVKTIFAEDNVNPKIAHAIAKSTGAKVKTLSPLEAAPSGNKTYLENLRANLEV  300
           QDFVKEYNVKTIFAEDNVNPKIAHAIAKSTGAKVKTLSPLEAAPSGNKTYLENLRANLEV
Sbjct: 241 QDFVKEYNVKTIFAEDNVNPKIAHAIAKSTGAKVKTLSPLEAAPSGNKTYLENLRANLEV  300

Query: 301 LYQQLK                                                        306
           LYQQLK
Sbjct: 301 LYQQLK                                                        306
```

There is also homology to SEQ ID 4.

SEQ ID 6986 (GBS189) was expressed in *E. coli* as a His-fusion product. SDS-PAGE analysis of total cell extract is shown in FIG. 38 (lane 2; MW 35.2 kDa).

The GBS189-His fusion product was purified (FIG. 204, lane 7) and used to immunise mice. The resulting antiserum was used for Western blot (FIG. 248A), FACS (FIG. 248B), and in the in vivo passive protection assay (Table III). These tests confirm that the protein is immunoaccessible on GBS bacteria and that it is an effective protective immunogen.

Based on this analysis, it was predicted that these proteins and their epitopes could be useful antigens for vaccines or diagnostics.

EXAMPLE 2261

A DNA sequence (GBSx2383) was identified in *S. agalactiae* <SEQ ID 6987> which encodes the amino acid sequence <SEQ ID 6988>. Analysis of this protein sequence reveals the following:

```
Possible site: 46
>>> Seems to have no N-terminal signal sequence

----- Final Results -----
            bacterial cytoplasm --- Certainty = 0.4656(Affirmative) < succ>
             bacterial membrane --- Certainty = 0.0000(Not Clear)   < succ>
              bacterial outside --- Certainty = 0.0000(Not Clear)   < succ>
```

The protein has homology with the following sequences in the GENPEPT database.

```
>GP: AAB41455 GB: U34956 phosphoribosylformylglycinamidine synthase
[Mycobacterium tuberculosis]
Identities = 73/237 (30%), Positives = 112/237 (46%), Gaps = 25/237 (10%)

Query:  43 GAGGVCVAIGELAD----GLEIDLDKVPLKYQGLNGTEIAISESQERMSVVVGPSDVDAF   98
           G  G+  A  ELA      G+ I LD VPL+ + +    E+   SESQERM  VV P +VDAF
Sbjct: 282 GGAGLSCATSELASAGDGGMTIQLDSVPLRAKEMTPAEVLCSESQERMCAVVSPKNVDAF  341

Query:  99 IAACNKENIDAVVVATVTEKPNLVMTWNGETIVDLERCFLDTNG------VRVVVDAKVV  152
           +A C K   + A V+   VT+    L +TW+GET+VD+       +     G    V       +
Sbjct: 342 LAVCRKWEVLATVIGEVTDGDRLQITWHGETVVDVPPRTVAHEGPVYQRPVARPDTQDAL  401

Query: 153 DKDLTVPEARTTSAETLEADMLKVLSDLNHASQKGLQTIFDSSVGRSTV--NHPIGGRYQ  210
           + D +    +R  + + L A +L +L      + S+   +    +D   V   +TV     H   GG  +
Sbjct: 402 NADRSAKLSRPVTGDELRATLLALLGSPHLCSRAFITEQYDRYVRGNTVLAEHADGGMLR  461

Query: 211 ITPTESSVQKLPVQYGVTTTASVMAQGYNPYIAEWSPYHGAAYAVIEATARLVATGA     267
           I    ES+ + + V        +   +++                PY GA  A+ EA    +  TGA
Sbjct: 462 I--DESTGRGIAVSTDASGRYTLL-----------DPYAGAQLALAEAYRNVAVTGA     505
```

There is also homology to SEQ ID 982.

Based on this analysis, it was predicted that this protein and its epitopes, could be useful antigens for vaccines or diagnostics.

EXAMPLE 2262

A DNA sequence (GBSx2384) was identified in *S. agalactiae* <SEQ ID 6989> which encodes the amino acid sequence <SEQ ID 6990>. This protein is predicted to be 30S ribosomal protein S11 (rpsK). Analysis of this protein sequence reveals the following:

```
Possible site: 37
>>> Seems to have no N-terminal signal sequence

----- Final Results -----
            bacterial cytoplasm --- Certainty = 0.0598(Affirmative) < succ>
             bacterial membrane --- Certainty = 0.0000(Not Clear)   < succ>
              bacterial outside --- Certainty = 0.0000(Not Clear)   < succ>
```

A related GBS nucleic acid sequence <SEQ ID 9281> which encodes amino acid sequence <SEQ ID 9282> was also identified. A further related GBS nucleic acid sequence <SEQ ID 10919> which encodes amino acid sequence <SEQ ID 10920> was also identified.

The protein has homology with the following sequences in the GENPEPT database.

```
>GP: CAB11918 GB: Z99104 ribosomal protein S11 (BS11) [Bacillus subtilis]
Identities = 81/92 (88%), Positives = 87/92 (94%)

Query:  2 HGNALAWSSAGALGFKGSRKSTPFAAQMAAEAAAKSAQEHGLKTVEVTVKGPGSGRESAI   61
          HGNA++WSSAGALGF+GSRKSTPFAAQMAAE AAK + EHGLKT+EVTVKGPGSGRE+AI
```

```
                              -continued
Sbjct:  40 HGNAISWSSAGALGFRGSRKSTPFAAQMAAETAAKGSIEHGLKTLEVTVKGPGSGREAAI   99

Query:  62 RALAAAGLEVTAIRDVTPVPHNGARPPKRRRV                                 93
           RAL AAGLEVTAIRDVTPVPHNG RPPKRRRV
Sbjct: 100 RALQAAGLEVTAIRDVTPVPHNGCRPPKRRRV                                131
```

A related DNA sequence was identified in *S. pyogenes* <SEQ ID 6991> which encodes the amino acid sequence <SEQ ID 6992>. Analysis of this protein sequence reveals the following:

```
Possible site: 47
>>> Seems to have no N-terminal signal sequence

----- Final Results -----
              bacterial cytoplasm --- Certainty = 0.0945(Affirmative) < succ>
                bacterial membrane --- Certainty = 0.0000(Not Clear)  < succ>
                 bacterial outside --- Certainty = 0.0000(Not Clear)  < succ>
```

An alignment of the GAS and GBS proteins is shown below.

```
Identities = 92/93 (98%), Positives = 93/93 (99%)

Query:   1 MHGNALAWSSAGALGFKGSRKSTPFAAQMAAEAAAKSAQEHGLKTVEVTVKGPGSGRESA   60
           +HGNALAWSSAGALGFKGSRKSTPFAAQMAAEAAAKSAQEHGLKTVEVTVKGPGSGRESA
Sbjct:  35 VHGNALAWSSAGALGFKGSRKSTPFAAQMAAEAAAKSAQEHGLKTVEVTVKGPGSGRESA   94

Query:  61 IRALAAAGLEVTAIRDVTPVPHNGARPPKRRRV                              93
           IRALAAAGLEVTAIRDVTPVPHNGARPPKRRRV
Sbjct:  95 IRALAAAGLEVTAIRDVTPVPHNGARPPKRRRV                             127
```

Based on this analysis, it was predicted that these proteins and their epitopes could be useful antigens for vaccines or diagnostics.

EXAMPLE 2263

A DNA sequence (GBSx2385) was identified in *S. agalactiae* <SEQ ID 6993> which encodes the amino acid sequence <SEQ ID 6994>. Analysis of this protein sequence reveals the following:

```
Possible site: 53
>>> Seems to have no N-terminal signal sequence

----- Final Results -----
              bacterial cytoplasm --- Certainty = 0.2551(Affirmative) < succ>
                bacterial membrane --- Certainty = 0.0000(Not Clear)  < succ>
                 bacterial outside --- Certainty = 0.0000(Not Clear)  < succ>
```

The protein has homology with the following sequences in the GENPEPT database.

```
>GP:BAB03881 GB:AP001507 DNAdirected RHA polymerase alpha subunit
[Bacillus halodurans]
Identities = 190/314 (60%), Positives = 249/314 (78%), Gaps 2/314 (0%)

Query:   1 MIEFEKPIITKIDENKD--YGRFVIEPLERGYGTTLGNSLRRVLLSSLPGAAVTSIKIDG   58
           MIE EKP+I  I+ ++D   YG+FV+EPLERGYGTTLGNSLRR+LLSSLPGAAVTS++IDG
Sbjct:   1 MIEIEKPVIETIEISEDAKYGKFVVEPLERGYGTTLGNSLRRILLSSLPGAAVTSVQIDG   60

Query:  59 VLHEFDTIPGVREDVMQIILNVKGLAVRSYVEDERIIELDVEGPAEITAGDILTDSDIEI  118
           VLHEF TI GV EDV  I+LN+K LA+K Y +++K +E+D +G   +TAGD+ DSD+++
Sbjct:  61 VLHEFSTIEGVVEDVTTIVLNLKQLALKIYSDEDKTLEIDTQGEGVVTAGDLTHDSDVDV  120

Query: 119 VNPDHYLFTIAEGHSLKATMTVAKNRGYVPAEGNKKDDAPVGTLAVDSIYTPVKKVNYQV  178
           +NPD ++ T+ G  L+  +T + RGYVPAEGNK D+ +G + +DSIYTPV +VNYQV
```

```
                              -continued
Sbjct: 121 LNPDLHIATLTTGAHLRNRITAKRGRGYVPAEGNKSDELAIGVIPIDSIYTPVSRVNYQV 180

Query: 179 EPARVGSNDGFDKLTIEIMTNGTIIPEDALGLSARVLIEHLNLFTDLTEVAKATEVMKET 238
           E RVG     +DKLT+++ T+G+I PE+A+L A++L EHLN+F   LT+ A+  E+M E
Sbjct: 181 ENTRVGQVTNYDKLTLDVWTDGSIRPEEAVSLGAKILTEHLNIFVGLTDQAQNAEIMVEK 240

Query: 239 EKVNDEKVLDRTIEELDLSVRSYNCLKRAGINTVFDLTEETEPEMMKVRNLGRKSLEEVK 298
           E+    EKVL+ TIEELDLSVRSYNCLKRAGINTV +LT+ETE +MMKVRNLGRKSLEEV+
Sbjct: 241 EEDQKEKVLEMTIEELDLSVRSYNCLKRAGINTVQELTQRTEEDMMKVRNLGRKSLEEVQ 300

Query: 299 IKLADLGLGLENDK                                               312
           KL +LGLGL+ ++
Sbjct: 301 EKLGELGLGLRKEE                                               314
```

A related DNA sequence was identified in *S. pyogenes* <SEQ ID 6995> which encodes the amino acid sequence <SEQ ID 6996>. Analysis of this protein sequence reveals the following:

```
Possible site: 53
>>> Seems to have no N-terminal signal sequence

----- Final Results -----
            bacterial cytoplasm --- Certainty = 0.2551(Affirmative) < succ>
            bacterial membrane  --- Certainty = 0.0000(Not Clear)   < succ>
             bacterial outside  --- Certainty = 0.0000(Not Clear)   < succ>
```

An alignment of the GAS and GBS proteins is shown below.

```
Identities = 305/312 (97%), Positives = 311/312 (98%)

Query:   1 MIEFEKPIITKIDENKDYGRFVIEPLERGYGTTLGNSLRRVLLSSLPGAAVTSIKIDGVL   60
           MIEFEKPIITKIDENKDYGRFVIEPLERGYGTTLGNSLRRVLLSSLPGAAVTSIKIDGVL
Sbjct:   1 MIEFEKPIITKIDENKDYGRFVIEPLERGYGTTLGNSLRRVLLSSLPGAAVTSIKIDGVL   60

Query:  61 HEFDTIPGVREDVMQIILNVKGLAVKSYVEDEKIIELDVEGPAEITAGDILTDSDIEIVN  120
           HEFDTIPGVREDVMQIILNVKGLAV SYVEDEKIIEL+VEGPAE+TAGDILTDSDIE+VN
Sbjct:  61 HEFDTIPGVREDVMQIILNVKGLAVISYVEDEKIIELEVEGPAEVTAGDILTDSDIELVN  120

Query: 121 PDHYLFTIAEGHSLKATMTVAKNRGYVPAEGNKKDDAPVGTLAVDSIYTPVKKVNYQVEP  180
           PDHYLFTIAEGHSL+ATMTVAK RGYVPAEGNEKDDAPVGTLAVDSIYTPVEKVNYQVEP
Sbjct: 121 PDHYLFTIAEGHSLRATMTVAKKRGYVPAEGNKKODAPVGTLAVDSIYTPVKKVNYQVEP  180

Query: 181 ARVGSNDGFDKLTIEIMTNGTIIPEDALGLSARVLIEHLNLFTDLTEVAKATEVMKETEK  240
           ARVGSNDGFDKLTIEIMTNGTIIPEDALGLSARVLIEHLNLFTDLTEVAKATEVMKETEK
Sbjct: 181 ARVGSNDGFDKLTIEIMTNGTIIPEDALGLSARVLIEHLNLFTDLTEVAKATEVMKETEK  240

Query: 241 VNDEKVLDRTIEELDLSVRSYNCLKRAGINTVFDLTEKTEPEMMKVRNLGRKSLEEVKIK  300
           VNDEKVLDRTIEELDLSVRSYNCLKRAGINTVFDLTEK+EPEMMKVRNLGRKSLEEVK+K
Sbjct: 241 VNDEKVLDRTIEELDLSVRSYNCLKRAGINTVFDLTEKSEPEMMKVRNLGRKSLEEVKVK  300

Query: 301 LADLGLGLKNDK                                                 312
           LADLGLGLKNDK
Sbjct: 301 LADLGLGLKNDK                                                 312
```

Based on this analysis, it was predicted that these proteins and their epitopes could be useful antigens for vaccines or diagnostics.

EXAMPLE 2264

A DNA sequence (GBSx2386) was identified in *S. agalactiae* <SEQ ID 6997> which encodes the amino acid sequence <SEQ ID 6998>. This protein is predicted to be 50S ribosomal protein L17 (rplQ). Analysis of this protein sequence reveals the following:

```
Possible site: 37
>>> Seems to have no N-terminal signal sequence

----- Final Results -----
             bacterial cytoplasm --- Certainty = 0.1609(Affirmative) < succ>
              bacterial membrane --- Certainty = 0.0000(Not Clear)   < succ>
               bacterial outside --- Certainty = 0.0000(Not Clear)   < succ>
```

The protein has homology with the following sequences in the GENPEPT database.

```
>GP:CAB11920 GB:Z99104 ribosomal protein L17 (BL15) [Bacillus subtilis]
Identities = 95/128 (74%), Positives = 105/128 (81%), Gaps = 8/128 (6%)
Query:   1 MAYRKLGRTSSQRKANLRDLTTDLLINESIVTTEARAKEIRKTVEKMITLGKRGDLHARR    60
           M+YRKLGRTS+QRKANLRDLTTDL+INE I TTE RAKE+R  VEKMITLGKRGDLHARR
Sbjct:   1 MSYRKLGRTSAQRKAMLRDLTTDLIINERIETTETRAKELRSVVEKMITLGKRGDLHARR    60

Query:  61 QAAAYVRNEIASENYDEASDKYTSTTALQRLFDDIAPRYASRNGGYTRILKTEPRRGDAA   120
           QAAAY+RNE+A+E  ++         ALQKLF DIA RY ER GGYTRI+K  PRRGD A
Sbjct:  61 QAAAYIRNEVANEENNQ--------DALQKLFSDIATRYEERQGGYTRIMKLGPRRGDA   112

Query: 121 PMAIIELV                                                      128
           PMAIIELV
Sbjct: 113 PMAIIELV                                                      120
```

A related DNA sequence was identified in *S. pyogenes* <SEQ ID 6999> which encodes the amino acid sequence <SEQ ID 7000>. Analysis of this protein sequence reveals the following:

```
Possible site: 37
>>> Seems to have no N-terminal signal sequence

----- Final Results -----
             bacterial cytoplasm --- Certainty = 0.1609(Affirmative) < succ>
              bacterial membrane --- Certainty = 0.0000(Not Clear)   < succ>
               bacterial outside --- Certainty = 0.0000(Not Clear)   < succ>
```

An alignment of the GAS and GBS proteins is shown below.

```
Identities = 125/128 (97%), Positives = 127/128 (98%)

Query:   1 MAYRKLGRTSSQRKAMLRDLTTDLLINESIVTTEARAKEIRKTVEKNITLGKRGDLHARR    60
           M+YRKLGRTSSQRKAMLRDLTTDLLINESIVTTEARAKEIRKTVEKMITLGKRGDLHARR
Sbjct:   1 MAYRKLGRTSSQRKANLRDLTTDLLINESIVTTEARAKEIRKTVERNITLGKRGDLHARR    60

Query:  61 QAAAYVRNEIASENYDEASDKYTSTTALQKLFDDIAPRYAERNGGYTRILKTEPRRGDAA   120
           QAAAYVRNEIASENYDEA+DKYTSTTALQKLF +IAPRYAERNGGYTRILKTEPRRGDAA
Sbjct:  61 QAAAYVRNEUASENYDEATDKYTSTTALQKLFSEIAPRYAERNGGYTRILKTEPRRGDAA   120

Query: 121 PMAIIELV                                                      128
           PMAIIELV
Sbjct: 121 PMAIIELV                                                      128
```

Based on this analysis, it was predicted that these proteins and their epitopes could be useful antigens for vaccines or diagnostics.

EXAMPLE 2265

A DNA sequence (GBSx2396) was identified in *S. agalactiae* <SEQ ID 7001> which encodes the amino acid sequence <SEQ ID 7002>. This protein is predicted to be mercuric reductase. Analysis of this protein sequence reveals the following:

```
Possible site: 35
>>> Seems to have no N-terminal signal sequence

----- Final Results -----
            bacterial cytoplasm --- Certainty = 0.2384(Affirmative) < succ>
            bacterial membrane  --- Certainty = 0.0000(Not Clear)   < succ>
            bacterial outside   --- Certainty = 0.0000(Not Clear)   < succ>
```

The protein has homology with the following sequences in the GENPEPT database.

```
>GP:AAA83977 GB:AF138877 mercuric reductase MerA
[Bacillus sp. RCE07]
Identities = 29/33 (87%), Positives = 32/33 (96%)

Query:    4 VGLTEEQAKEKGYDVKTSVLPLXAVPRAIVNRE    36
            VGLTE+QAKEKGY+VKTSVLPL AVPRA+VNRE
Sbjct:  520 VGLTEQQAKEKGYEVKTSVLPLDAVPRALVNRE   552
```

No corresponding DNA sequence was identified in *S. pyogenes*.

Based on this analysis, it was predicted that this protein and its epitopes, could be useful antigens for vaccines or diagnostics.

EXAMPLE 2266

A DNA sequence (GBSx2397) was identified in *S. agalactiae* <SEQ ID 7003> which encodes the amino acid sequence <SEQ ID 7004>. This protein is predicted to be mercuric reductase. Analysis of this protein sequence reveals the following:

```
Possible site: 49
>>> Seems to have no N-terminal signal sequence

----- Final Results -----
            bacterial cytoplasm --- Certainty = 0.3016(Affirmative) < succ>
            bacterial membrane  --- Certainty = 0.0000(Not Clear)   < succ>
            bacterial outside   --- Certainty = 0.0000(Not Clear)   < succ>
```

The protein has homology with the following sequences in the GENPEPT database.

```
>GP: CAA70224 GB: Y09024 mercuric reductase [Bacillus cereus]
Identities = 146/194 (75%), Positives = 175/194 (89%)

Query:    2 PQISGLEKMDYLTSTTLLELKKIPKRLTVIGSGYIGMELGQLFHHLGSEITLMQRSERLL    61
            P I GL ++DYLTST+LLELKK+PKRL VIGSGYIGMELGQLFH+LGSE+TL+QRSERLL
Sbjct:  226 PNIPGLNEVDYLTSTSLLELKKVPKRLVVIGSGYIGMELGQLFHNLGSEVTLIQRSERLL   285

Query:   62 KEYDPEISESVEKALIEQGINLVKGATFERVEQSGEIKRVYVTVNGSREVIESDQLLVAT   121
            KEYDPEISESVEK+L+EQGINLVKGAT+ER+EQ+G+IK+V+V VNG + +IE+DQLLVAT
Sbjct:  286 KEYDPEISESVEKSLVEQGINLVKGATYERIEQNGDIKKVHVEVNGKKRIIEADQLLVAT   345

Query:  122 GRKPNTDSLNLSAAGVETGKNNEILINDFGQTSNEKIYAAGDVTLGPQFVYVAAYEGGII   181
            GR PNT +LNL AAGVE G   EI+I+D+ +T+N +IYAAGDVTLGPQFVYVAAY+GG+
Sbjct:  346 GRTPNTATLNLRAAGVEIGSRGEIIIDDYSRTTNTRIYAAGDVTLGPQFVYVAAYQGGVA   405

Query:  182 TDNAIGGLNKKIDL                                                195
            NAIGGLNKK++L
Sbjct:  406 APNAIGGLNKKLNL                                                419
```

There is also homology to SEQ ID 1820.

Based on this analysis, it was predicted that this protein and its epitopes, could be useful antigens for vaccines or diagnostics.

EXAMPLE 2267

A DNA sequence (GBSx2398) was identified in *S. agalactiae* <SEQ ID 7005> which encodes the amino acid sequence <SEQ ID 7006>. This protein is predicted to be triacylglycerol acylhydrolase. Analysis of this protein sequence reveals the following:

```
Possible site: 46
>>> Seems to have no N-terminal signal sequence

----- Final Results -----
            bacterial cytoplasm --- Certainty = 0.3180(Affirmative) < succ>
            bacterial membrane  --- Certainty = 0.0000(Not Clear)   < succ>
             bacterial outside  --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 2268

A DNA sequence (GBSx2399) was identified in *S. agalactiae* <SEQ ID 7007> which encodes the amino acid sequence <SEQ ID 7008>. Analysis of this protein sequence reveals the following:

```
Possible site: 42
>>> Seems to have no N-terminal signal sequence

----- Final Results -----
            bacterial cytoplasm --- Certainty = 0.0544(Affirmative) < succ>
            bacterial membrane  --- Certainty = 0.0000(Not Clear)   < succ>
             bacterial outside  --- Certainty = 0.0000(Not Clear)   < succ>
```

The protein has homology with the following sequences in the GENPEPT database.

```
>GP: AAC74453 GB: AE000234 orf, hypothetical protein [Escherichia
coli K12]
Identities = 45/58 (77%), Positives = 51/58 (87%)

Query:   1 MPWQNLLHAGQENLFSGLTALTAEFTVGEGKLMTHDEPCSMAPDDKHDLISGTCSHLP   58
            +PWQNLLHAG+ENLFSGLTAL+AEFT+GEG+LM HD P    APD+  DLISGTCSHLP
Sbjct:  34 LPWQNLLHAGEENLFSGLTALSAEFTIGEGELMAHDVPLGCAPDEYDDLISGTCSHLP   91
```

No corresponding DNA sequence was identified in *S. pyogenes*.

Based on this analysis, it was predicted that this protein and its epitopes, could be useful antigens for vaccines or diagnostics.

EXAMPLE 2269

A DNA sequence (GBSx2400) was identified in *S. agalactiae* <SEQ ID 7009> which encodes the amino acid sequence <SEQ ID 7010>. This protein is predicted to be transposase for insertion sequence element is 5. Analysis of this protein sequence reveals the following:

```
Possible site: 48
>>> Seems to have no N-terminal signal sequence

----- Final Results -----
            bacterial cytoplasm --- Certainty = 0.2058(Affirmative) < succ>
             bacterial membrane --- Certainty = 0.0000(Not Clear)   < succ>
              bacterial outside --- Certainty = 0.0000(Not Clear)   < succ>
```

The protein has homology with the following sequences in the GENPEPT database.

```
>GP: BAB15497 GB: AK026530 unnamed protein product [Homo sapiens]
Identities = 297/299 (99%), Positives = 297/299 (99%)

Query:   1 MEQILPWQNMVEVIEPFYPKAGNGRRPYPLETMLRIHCMQHWYNLSDGAMEDALYEIASM   60
           MEQILPWQNMVEVIEPFYPKAGNGRRPYPLETMLRIHCMQHWYNLSDGAMEDALYEIASM
Sbjct:  40 MEQILPWQNMVEVIEPFYPKAGNGRRPYPLETMLRIHCMQHWYNLSDGAMEDALYEIASM   99

Query:  61 RLFARLSLDSALPDRTTIMNFRHLLEQHQLARQLFKTINRWLAEAGVMMTQGTLVDATII  120
           RLFARLSLDSALPDRTTIMNFRHLLEQHQLARQLFKTINRWLAEAGVMMTQGTLVDATII
Sbjct: 100 RLFARLSLDSALPDRTTIMNFRHLLEQHQLARQLFKTINRWLAEAGVMMTQGTLVDATII  159

Query: 121 EAPSSTKNKEQQRDPEMHQTKKGNQWHFGMKAHIGVDAKSGLTHSLVTTAANEHDLNQLX  180
           EAPSSTKNKEQQRDPEMHQTKKGNQWHFGMKAHIGVDAKSGLTHSLVTTAANEHDLNQL
Sbjct: 160 EAPSSTKNKEQQRDPEMHQTKKGNQWHFGMKAHIGVDAKSGLTHSLVTTAANEHDLNQLG  219

Query: 181 NLLHGEEQFVSADAXYQGAPQREELAEVDVDWLIAERPGKVRTLKQHPRKNKTAINIEYM  240
           NLLHGEEQFVSADA YQGAPQREELAEVDVDWLIAERPGKVRTLKQHPRKNKTAINIEYM
Sbjct: 220 NLLHGEEQFVSADAGYQGAPQREELAEVDVDWLIAERPGKVRTLKQHPRKNKTAINIEYM  279

Query: 241 KASIRARVEHPFRIIKRQFGFVKARYKGLLKNDNQLAMLFTLANLFRADQMIRQWERSH   299
           KASIRARVEHPFRIIKRQFGFVKARYKGLLKNDNQLAMLFTLANLFRADQMIRQWERSH
Sbjct: 280 KASIRARVEHPFRIIKRQFGFVKARYKGLLKNDNQLAMLFTLANLFRADQMIRQWERSH   338
```

No corresponding DNA sequence was identified in *S. pyogenes*.

Based on this analysis, it was predicted that this protein and its epitopes, could be useful antigens for vaccines or diagnostics.

EXAMPLE 2270

A DNA sequence (GBSx2401) was identified in *S. agalactiae* <SEQ ID 7011> which encodes the amino acid sequence <SEQ ID 7012>. Analysis of this protein sequence reveals the following:

```
Possible site: 16
>>> Seems to have a cleavable N-term signal seq.

----- Final Results -----
              bacterial outside --- Certainty = 0.3000(Affirmative) < succ>
             bacterial membrane --- Certainty = 0.0000(Not Clear)   < succ>
            bacterial cytoplasm --- Certainty = 0.0000(Not Clear)   < succ>
```

The protein has homology with the following sequences in the GENPEPT database.

```
>GP: CAB51958 GB: AL109661 putative eukaryotic-type serine/threonine
protein kinase [Streptomyces coelicolor A3(2)]
Identities = 49/169 (28%), Positives = 90/169 (52%), Gaps = 6/169 (3%)

Query:  23 PTTIRVPDVSNKTVAQAKMTLENSGLKVGAIRNIESDSVSEGLVVKTDPAAGRSRREGAK   82
           P T+++PDV+   + +A+  LE+ GL+ G +     SD V+ G V+ T P +G + R G+
Sbjct: 469 PDTVKLPDVTGYKLDKARTLLEDEGLEPGMVTRAFSDEVARGFVISTKPGSGTTVRAGSA  528

Query:  83 VNLYIATPNKSFTLGNYKEHNYKDILKDLQGKGVKKSLIKVKRKINNDYTTGTILAQSLP  142
              V L + +         + +     + +   +L+G G+K +      ++N++Y +G + A+    P
```

-continued

```
Sbjct: 529 VAL-VVSKGSPVDVPDVTGDDLDEARAELEGAGLK--VKTADERVNSEYDSGRV-ARQTP  584

Query: 143 EGTSFNPDGNKKLTLTVAVNDPMI-MPDVTGMTVGEVIETLTDLGLDAD             190
           E      +G+  +TLTV+     MI +PDV G +V +    + L D G + D
Sbjct: 585 EPGGRAAEGD-TVTLTVSKGPRMIEVPDVVGDSVDDAKQKLEDAGFEVD              632

Identities = 45/161 (27%), Positives = 80/161 (48%), Gaps = 4/161 (2%)

Query:  27 RVPDVSNKTVAQAKMTLENSGLKVGAIRNIESDSVSEGLVVKTDPAAGRSRREGAKVNLY   86
           +VP + +KT AQA+  L+++GL VG +R+   SD+V  G V+ TDP   G     R+    V+L
Sbjct: 405 KVPPLLSKTEAQARDRLDDAGLDVGKVRHAYSDTVERGKVISTDPGVGDRIRKNDSVSLT  464

Query:  87 IATPNKSFTLGNYKEHNYKDILKDLQGKGVKKSLIKVKRKINNDYTTGTILAQSLPEGTS  146
           ++     + L +  +        L+ +G++ +     V R  +++    G  +++    GT+
Sbjct: 465 VSDGPDTVKLPDVTGYKLDKARTLLEDEGLEPGM--VTRAFSDEVARGFVISTKPGSGTT  522

Query: 147 FNPDGNKKLTLTVAVNDPMIMPDVTGMTVGEVIETLTDLGL                     187
               + L V+     P+ +PDVTG  + E      L     GL
Sbjct: 523 VR--AGSAVALVVSKGSPVDVPDVTGDDLDEARAELEGAGL                     561
```

There is also homology to SEQ ID 3026.

Based on this analysis, it was predicted that this protein and its epitopes, could be useful antigens for vaccines or diagnostics.

EXAMPLE 2271

A DNA sequence (GBSx2402) was identified in *S. agalactiae* <SEQ ID 7013> which encodes the amino acid sequence <SEQ ID 7014>. Analysis of this protein sequence reveals the following:

```
Possible site: 38
>>> Seems to have an uncleavable N-term signal seq

----- Final Results -----
            bacterial membrane --- Certainty = 0.0000(Not Clear) < succ>
            bacterial outside  --- Certainty = 0.0000(Not Clear) < succ>
            bacterial cytoplasm --- Certainty = 0.0000(Not Clear) < succ>
```

A related GBS nucleic acid sequence <SEQ ID 9311> which encodes amino acid sequence <SEQ ID 9312> was also identified.

The protein has homology with the following sequences in the GENPEPT database.

```
>GP: AAB90561 GB: AE001058 glutamine ABC transporter, ATP-binding
protein (glnQ) [Archaeoglobus fulgidus]
Identities = 142/219 (64%), Positives = 178/219 (80%)

Query:   1 MDIHQGEVVVIIGPSGSGKSTFLRTMNLLEVPTKGTVTFEGIDITDKKNDIFKMREKMGM   60
           M + +GEVVVIIGPSGSGKST LR +N LE PT G +  +G+DIT+ K DI K+R+++G+
Sbjct:  24 MKVEKGEVVVIIGPSGSGKSTLLRCINRLEEPTSGKILLDGVDITNSKIDINKVRQRIGI   83

Query:  61 VFQQFNLFPNMTVLENITLSPIKTKGLSNLDAQTKAYELLEKVGLKEKANTYPASLSGGQ  120
           VFQQFNLFP++T L+N+TL+PIK K +S  +A+      LLEKVGL++KA+ YPA LSGGQ
Sbjct:  84 VFQQFNLFPHLTALQNVTLAPIKIKKMSKREAEELGMRLLEKVGLEDKADYYPAQLSGGQ  143

Query: 121 QQRIAIARGLAMNPDVLLFDEPTSALDPEMVGEVLTVMQDLAKSGMTMVIVTHEMGFARE  180
           QQR+AIAR LAMNP+V+LFDE TSALDPE+V EVL VM+ LA+ GMTMV+VTHEMGFARE
Sbjct: 144 QQRVAIARALAMNPEVMLFDEVTSALDPELVKEVLDVMKQLARDGMTMVVVTHEMGFARE  203

Query: 181 VADRVIFMDAGIIVEQGAPKEVFEQTKEIRTRDFLSKVL                       219
           V DRVIFMD G+IVE+G P+++F   K  RTR FLS +L
Sbjct: 204 VGDRVIFMDGGVIVEEGKPEQIFSNPKHERTRKFLSMIL                       242
```

There is also homology to SEQ ID 1186.

Based on this analysis, it was predicted that this protein and its epitopes, could be useful antigens for vaccines or diagnostics.

EXAMPLE 2272

A DNA sequence (GBSx2403) was identified in *S. agalactiae* <SEQ ID 7015> which encodes the amino acid sequence <SEQ ID 7016>. This protein is predicted to be 4-hydroxy-2-oxoglutarate aldolase (kdgA). Analysis of this protein sequence reveals the following:

```
Possible site: 43
>>> Seems to have no N-terminal signal sequence

----- Final Results -----
            bacterial cytoplasm --- Certainty = 0.1479(Affirmative) < succ>
            bacterial membrane  --- Certainty = 0.0000(Not Clear)   < succ>
            bacterial outside   --- Certainty = 0.0000(Not Clear)   < succ>
```

The protein has homology with the following sequences in the GENPEPT database.

```
>GP: CAB14127 GB: Z99115 deoxyphosphogluconate
aldolase [Bacillus subtilis]
Identities = 21/62 (33%), Positives = 38/62 (60%), Gaps = 4/62 (6%)

Query:   3 QLMQGKIVAVIRGNSQEEAFQAAQACIKGGISAIEIAYTNSKASQVIEQLVTQYTNQEQV  62
           +L + K++AVIR   ++EA Q  ++ +  GI A+E+ YT    AS +IE    + N+E +
Sbjct:   9 RLKEAKLIAVIRSKDKQEACQQIESLLDKGIRAVEVTYTTPGASDIIE----SFRNREDI  64

Query:  63 VV                                                           64
           ++
Sbjct:  65 LI                                                           66
```

Based on this analysis, it was predicted that this protein and its epitopes, could be useful antigens for vaccines or diagnostics.

EXAMPLE 2273

A DNA sequence (GBSx2405) was identified in *S. agalactiae* <SEQ ID 7017> which encodes the amino acid sequence <SEQ ID 7018>. This protein is predicted to be H repeat-associated protein (rfbQRS) (b1458). Analysis of this protein sequence reveals the following:

```
Possible site: 27
>>> Seems to have no N-terminal signal sequence

----- Final Results -----
            bacterial cytoplasm --- Certainty = 0.0207(Affirmative) < succ>
            bacterial membrane  --- Certainty = 0.0000(Not Clear)   < succ>
            bacterial outside   --- Certainty = 0.0000(Not Clear)   < succ>
```

There is homology to SEQ ID 504.

Based on this analysis, it was predicted that this protein and its epitopes, could be useful antigens for vaccines or diagnostics.

EXAMPLE 2274

A DNA sequence (GBSx2406) was identified in *S. agalactiae* <SEQ ID 7019> which encodes the amino acid sequence <SEQ ID 7020>. Analysis of this protein sequence reveals the following:

```
Possible site: 14
>>> Seems to have an uncleavable N-term signal seq
     INTEGRAL    Likelihood = -6.74    Transmembrane    2-18  (1-21)
     INTEGRAL    Likelihood = -3.03    Transmembrane    73-89 (73-92)

----- Final Results -----
              bacterial membrane --- Certainty = 0.3697(Affirmative) < succ>
              bacterial outside  --- Certainty = 0.0000(Not Clear)   < succ>
             bacterial cytoplasm --- Certainty = 0.0000(Not Clear)   < succ>
```

The protein has no significant homology with any sequences in the GENPEPT database.

There is also homology to SEQ ID 3376.

Based on this analysis, it was predicted that this protein and its epitopes, could be useful antigens for vaccines or diagnostics.

EXAMPLE 2275

A DNA sequence (GBSx2407) was identified in *S. agalactiae* <SEQ ID 7021> which encodes the amino acid sequence <SEQ ID 7022>. This protein is predicted to be insertion element IS1 protein InsB (insB_5). Analysis of this protein sequence reveals the following:

```
Possible site: 52
>>> Seems to have no N-terminal signal sequence

----- Final Results -----
             bacterial cytoplasm --- Certainty = 0.4280(Affirmative) < succ>
              bacterial membrane --- Certainty = 0.0000(Not Clear)   < succ>
              bacterial outside  --- Certainty = 0.0000(Not Clear)   < succ>
```

No corresponding DNA sequence was identified in *S. pyogenes*.

Based on this analysis, it was predicted that this protein and its epitopes, could be useful antigens for vaccines or diagnostics.

EXAMPLE 2276

A DNA sequence (GBSx2409) was identified in *S. agalactiae* <SEQ ID 7023> which encodes the amino acid sequence <SEQ ID 7024>. Analysis of this protein sequence reveals the following:

```
Possible site: 13
>>> Seems to have no N-terminal signal sequence

----- Final Results -----
             bacterial cytoplasm --- Certainty = 0.3937(Affirmative) < succ>
              bacterial membrane --- Certainty = 0.0000(Not Clear)   < succ>
              bacterial outside  --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 2277

A DNA sequence (GBSx2410) was identified in *S. agalactiae* <SEQ ID 7025> which encodes the amino acid sequence <SEQ ID 7026>. This protein is predicted to be triosephosphate isomerase (tpi). Analysis of this protein sequence reveals the following:

```
Possible site: 53
>>> Seems to have no N-terminal signal sequence
     INTEGRAL    Likelihood = -0.37    Transmembrane    35-51 (35-51)

----- Final Results -----
              bacterial membrane --- Certainty = 0.1150(Affirmative) < succ>
               bacterial outside --- Certainty = 0.0000(Not Clear)   < succ>
             bacterial cytoplasm --- Certainty = 0.0000(Not Clear)   < succ>
```

The protein has homology with the following sequences in the GENPEPT database.

```
>GP: AAC43268 GB: U07640 triosephosphate isomerase [Lactococcus
lactis]
Identities = 50/75 (66%), Positives = 61/75 (80%)

Query:    6 IAGNWKMNKNPEEAKAFIEAVASKLPSSELVEAGIAAPALTLSTVLEAAKGSELKIAAQN   65
            IAGNWKMNK   EA+AF+EAV + LPSS+ VE+ I APAL L+ +    +GSELK+AA+N
Sbjct:    7 IAGNWKMNKTLSEAQAFVEAVKNNLPSSDNVESVIGAPALFLAPMAYLRQGSELKLAAEN  66

Query:   66 SYFENSGAFTGENSP                                               80
            SYFEN+GAFTGENSP
Sbjct:   67 SYFENAGAFTGENSP                                               81
```

There is also homology to SEQ ID 6838:

```
Identities = 58/77 (75%), Positives = 68/77 (87%)

Query:    6 IAGNWKMNKNPEEAKAFIEAVASKLPSSELVEAGIAAPALTLSTVLEAAKGSELKIAAQN   65
            IAGNWKMNKNP+EAKAF+EAVASKLPS++LV+   +AAPA+ L T +EAAK S LK+AAQN
Sbjct:    7 IAGNWKMNKNPQEAKAFVEAVASKLPSTDLVDVAVAAPAVDLVTTIEAAKDSVLKVAAQN  66

Query:   66 SYFENSGAFTGENSPKV                                             82
            YFEN-GAFTGE SPKV
Sbjct:   67 CYFENTGAFTGETSPKV                                             83
```

Based on this analysis, it was predicted that this protein and its epitopes, could be useful antigens for vaccines or diagnostics.

EXAMPLE 2278

A DNA sequence (GBSx2412) was identified in *S. agalactiae* <SEQ ID 7027> which encodes the amino acid sequence <SEQ ID 7028>. Analysis of this protein sequence reveals the following:

```
Possible site: 20
>>> Seems to have no N-terminal signal sequence
     INTEGRAL    Likelihood = -2.39    Transmembrane    96-112 (96-112)

----- Final Results -----
              bacterial membrane --- Certainty = 0.1956(Affirmative) < succ>
               bacterial outside --- Certainty = 0.0000(Not Clear)   < succ>
             bacterial cytoplasm --- Certainty = 0.0000(Not Clear)   < succ>
```

The protein has homology with the following sequences in the GENPEPT database.

```
>GP: BAA14368 GB: D90354 surface protein antigen precursor
[Streptococcus sobrinus]
Identities = 60/129 (46%), Positives = 76/129 (58%), Gaps = 18/129 (13%)

Query:    3 ISFDNSFLETVSDDSAFQADVYLQMKRIAAGQVENTYLHTVNGYVISSNTVVTHTPQPEE    62
            ++F   FL +VS DSAFQA+VYLQMKRIA G   NTY++TVNG   SSNTV T TP+P++
Sbjct: 1442 VTFKEDFLRSVSVDSAFQAEVYLQMKRIAVGTFANTYVNTVNGITYSSNTVRTSTPEPKQ  1501

Query:   63 PSPNQP--------TPPQPPIETIEPPVPASILPNTGEQES----LLGLIG--AGILLGT   108
            PSP  P         P Q    PP  A  LP TG+ +     LLGL+   AG  L
```

```
                            -continued
Sbjct:  1502 PSPVDPKTTTTVVFQPRQGKAYQPAPPAGAQ-LPATGDSSNAYLPLLGLVSLTAGFSL--  1558

Query:   109 AYGLKKKEE                                                    117
             GL++K++
Sbjct:  1559 -LGLRRKQD                                                    1566
```

No corresponding DNA sequence was identified in *S. pyogenes*.

Based on this analysis, it was predicted that this protein and its epitopes, could be useful antigens for vaccines or diagnostics.

EXAMPLE 2279

A DNA sequence (GBSx2413) was identified in *S. agalactiae* <SEQ ID 7029> which encodes the amino acid sequence <SEQ ID 7030>. Analysis of this protein sequence reveals the following:

```
Possible site: 23
>>> Seems to have no N-terminal signal sequence

----- Final Results -----
             bacterial cytoplasm --- Certainty = 0.3691(Affirmative) < succ>
              bacterial membrane --- Certainty = 0.0000(Not Clear)   < succ>
               bacterial outside --- Certainty = 0.0000(Not Clear)   < succ>
```

A related GBS nucleic acid sequence <SEQ ID 9359> which encodes amino acid sequence <SEQ ID 9360> was also identified.

The protein has homology with the following sequences in the GENPEPT database.

```
>GP: CAB15793 GB: Z99123 phosphotransacetylase [Bacillus subtilis]
Identities = 131/221 (59%), Positives = 169/221 (76%), Gaps = 2/221 (0%)

Query:    6 LVDPVILGKADEVHDSLARLGFVDQDYSIIDPEQYEKFEEMKEAFVEIRKGKATMEDADR   65
            +++P+++G  +E+     L         I DP  YE  E++ +AFVE RKGKAT E A +
Sbjct:   41 VLNPIVIGNENEIQAKAKELNLTLGGVKIYDPHTYEGMEDLVQAFVERRKGKATEEQARK  100

Query:   66 LLKDVNYFGVMLVKLGLADGMVSGAIHSTADTVRPALQIIKTKPGISRTSGVFLMNRENT  125
            L D NYFG MLV  GLADG+VSGA HSTADTVRPALQIIKTK G+ +TSGVF+M R
Sbjct:  101 ALLDENYFGTMLVYKGLADGLVSGAAHSTADTVRPALQIIKTKEGVKKTSGVFIMARG--  158

Query:  126 QERYIFADCAINIDPNAQELAEIAVNTADTAKIFDIDPKIAMLSFSTKGSAKAPQAEKVQ  185
            +E+Y+FADCAINI P++Q+LAEIA+  +A+TAK+FDI+P++AMLSFSTKGSAK+ +  EKV
Sbjct:  159 EEQYVFADCAINIAPDSQDLAEIAIESANTAKMFDIEPRVAMLSFSTKGSAKSDETEKVA  218

Query:  186 EAAKIAKDLSPELAVDGELQFDAAFVPETAEIKAPNSDVAG                    226
            +A KIAK+ +PEL +DGE QFDAAFVP  AE KAP+S++ G
Sbjct:  219 DAVKIAKEKAPELTLDGEFQFDAAFVPSVAEKKAPDSEIKG                    259
```

A related DNA sequence was identified in *S. pyogenes* <SEQ ID 7031> which encodes the amino acid sequence <SEQ ID 7032>. Analysis of this protein sequence reveals the following:

```
Possible site: 34
>>> Seems to have no N-terminal signal sequence

----- Final Results -----
             bacterial cytoplasm --- Certainty = 0.3182(Affirmative) < succ>
              bacterial membrane --- Certainty = 0.0000(Not Clear)   < succ>
               bacterial outside --- Certainty = 0.0000(Not Clear)   < succ>
```

An alignment of the GAS and GBS proteins is shown below.

```
Identities = 181/227 (79%), Positives = 211/227 (92%)

Query:    1 MKFEGLVDPVILGKADEVHDSLARLGFVDQDYSIIDPEQYEKFEEMKEAFVEIRKGKATM   60
            +KFEGL++P+ILG+++EV + L +LGF DQDY+II+P +Y  F++MKEAFVE+RKGKAT+
Sbjct:   38 LKFEGLLEPIILGQSEEVRNLLTKLGFADQDYTIINPNEYADFDKMKEAFVEVRKGKATL   97

Query:   61 EDADRLLKDVNYFGVMLVKLGLADGMVSGAIHSTADTVRPALQIIKTKPGISRTSGVFLM  120
            EDAD++L+DVNYFGVMLVK+GLADGMVSGAIHSTADTVRPALQIIKTKPGISRTSGVFLM
Sbjct:   98 EDADKMLRDVNYFGVMLVKMGLADGMVSGAIHSTADTVRPALQIIKTKPGISRTSGVFLM  157

Query:  121 NRENTQERYIFADCAINIDPNAQELAEIAVNTADTAKIFDIDPKIAMLSFSTKGSAKAPQ  180
            NRENT ERY+FADCAINIDP AQELAEIAVNTA+TAKIFDIDPKIAMLSFSTKGS KAPQ
Sbjct:  158 NRENTSERYVFADCAINIDPTAQELAEIAVNTAETAKIFDIDPKIAMLSFSTKGSGKAPQ  217

Query:  181 AEKVQEAAKIAKDLSPELAVDGELQFDAAFVPETAEIKAPNSDVAGK              227
            +KV+EA +IA  L+P+LA+DGELQFDAAFVPETA IKAP+S VAG+
Sbjct:  218 VDKVREATEIATGLNPDLALDGELQFDAAFVPETAAIKAPDSAVAGQ              264
```

Based on this analysis, it was predicted that these proteins and their epitopes could be useful antigens for vaccines or diagnostics.

EXAMPLE 2280

A DNA sequence (GBSx2414) was identified in *S. agalactiae* <SEQ ID 7033> which encodes the amino acid sequence <SEQ ID 7034>. This protein is predicted to be lipopolysaccharide biosynthesis protein-related protein. Analysis of this protein sequence reveals the following:

```
Possible site: 61
>>> Seems to have no N-terminal signal sequence

----- Final Results -----
              bacterial cytoplasm --- Certainty = 0.4076(Affirmative) < succ>
              bacterial membrane  --- Certainty = 0.0000(Not Clear)   < succ>
              bacterial outside   --- Certainty = 0.0000(Not Clear)   < succ>
```

The protein has homology with the following sequences in the GENPEPT database.

```
>GP: AAG19110 GB: AE005009 Vng0600c [Halobacterium sp. NRC-1]
Identities = 57/176 (32%), Positives = 86/176 (48%), Gaps = 20/176 (11%)

Query:    1 MKVLLYLEAEEYLKKSGIGRAIKHQEKALQIAGIDYTTNPT-------------------   41
            M+ L YLEA E L+  G+   A    Q  AL+   ++      P
Sbjct:    2 MRALNYLEAAEALR-GGMVTATNQQRAALETTDVEVVETPWRAGDPVRSIGSLAAGGSCF   60

Query:   42 DDFDLVHMNTYGIRSWLLMSKAKKTGKKVIMHGHSTEEDFRNSFIGSNLVSPLFKWYLCR  101
            FD+ H N  G  S  +    A++T   +++H H T EDF   SF GS+ ++P  + YL
Sbjct:   61 TAFDVAHCNLVGPGSVAVARHARRTDTPLVLHAHLTREDFAQSFRGSSTIAPALEPYLRW  120

Query:  102 FYQKADAIITPTDYSKQLIKAYGIKKPIFVLSNGIDLSRYQXSEKKESAFRHYFHL     157
            FY +AD ++ P++Y+K +++AY + PI  LSNG+DL    Q  E   + R  F L
Sbjct:  121 FYSQADLVLCPSEYTKDVLRAYPVDAPIRQLSNGVDLESMQGYESFRADTRARFDL     176
```

There is also homology to SEQ ID 1220.

Based on this analysis, it was predicted that this protein and its epitopes, could be useful antigens for vaccines or diagnostics.

EXAMPLE 2281

A DNA sequence (GBSx2415) was identified in *S. agalactiae* <SEQ ID 7035> which encodes the amino acid sequence <SEQ ID 7036>. Analysis of this protein sequence reveals the following:

```
Possible site: 41
>>> Seems to have no N-terminal signal sequence

----- Final Results -----
              bacterial cytoplasm --- Certainty = 0.2625(Affirmative) < succ>
               bacterial membrane --- Certainty = 0.0000(Not Clear)   < succ>
                bacterial outside --- Certainty = 0.0000(Not Clear)   < succ>
```

The protein has homology with the following sequences in the GENPEPT database.

```
>GP: AAC35010 GB: AF055987 intracellular a-amylase
[Streptococcus mutans]
Identities = 27/46 (58%), Positives = 33/46 (71%)

Query:    1 MEVGEIYAGKTFVDYLGNCEQEVVIGDDGWGDFLVESASISAWVPK    46
            M +GE    K FVDYL NC +EV++ D GWGDF V+ AS+SAWV K
Sbjct:  438 MNMGEFNRNKVFVDYLNNCTEEVILDDQGWGDFPVQEASLSAWVNK   483
```

No corresponding DNA sequence was identified in *S. pyogenes*.

Based on this analysis, it was predicted that this protein and its epitopes, could be useful antigens for vaccines or diagnostics.

EXAMPLE 2282

A DNA sequence (GBSx2416) was identified in *S. agalactiae* <SEQ ID 7037> which encodes the amino acid sequence <SEQ ID 7038>. This protein is predicted to be RopA. Analysis of this protein sequence reveals the following:

```
Possible site: 24
>>> Seems to have no N-terminal signal sequence

----- Final Results -----
              bacterial cytoplasm --- Certainty = 0.2082(Affirmative) < succ>
               bacterial membrane --- Certainty = 0.0000(Not Clear)   < succ>
                bacterial outside --- Certainty = 0.0000(Not Clear)   < succ>
```

There is also homology to SEQ ID 6908:

```
Identities = 30/35 (85%), Positives = 33/35 (93%)

Query:    1 MEADQVRGLLSADMLKHDIAMKKAVDVITSSATVK    35
            M ADQVR LLSADMLKHDIAMKKAV+VITS+A+VK
Sbjct:  422 MPADQVRSLLSADMLKHDIAMKKAVEVITSTASVK   456
```

Based on this analysis, it was predicted that these proteins and their epitopes could be useful antigens for vaccines or diagnostics.

EXAMPLE 2283

A DNA sequence (GBSx2417) was identified in *S. agalactiae* <SEQ ID 7039> which encodes the amino acid sequence <SEQ ID 7040>. This protein is predicted to be DNA-directed RNA polymerase, subunit delta. Analysis of this protein sequence reveals the following:

```
Possible site: 54
>>> Seems to have no N-terminal signal sequence

----- Final Results -----
              bacterial cytoplasm --- Certainty = 0.2407(Affirmative) < succ>
               bacterial membrane --- Certainty = 0.0000(Not Clear)   < succ>
                bacterial outside --- Certainty = 0.0000(Not Clear)   < succ>
```

The protein has homology with the following sequences in the GENPEPT database.

```
>GP: CAB15744 GB: Z99123 RNA polymerase (delta subunit)
[Bacillus subtilis]
Identities = 62/186 (33%), Positives = 102/186 (54%), Gaps = 15/186 (8%)

Query:    1 MELEVFAGQEKSELSMIEVARAILEQRGRDNEMYFSDLVNDIQTYLGKSDSAIRESLPFF   60
            M ++ ++ +E  E++++E+A  + E+  +   + F +L+N+I + LG    + + + F
Sbjct:    1 MGIKQYSQEELKEMALVEIAHELFEEHKKP--VPFQELLNEIASLLGVKKEELGDRIAQF   58

Query:   61 YSDLNTDGSFIPLGENKWGLRSWYAIDEIDEEIITLEEDEDGAPKRKKKRVNAFMDGDED  120
            Y+DLN DG F+ L +  WGLRSWY D++DEE        K KKK+    ++ D D
Sbjct:   59 YTDLNIDGRFLALSDQTWGLRSWYPYDQLDEE-------TQPTVKAKKKKAKKAVEEDLD  111

Query:  121 AIDYNDDDPEDEDFTEETPSLEYDEENPDDEKSEVESYDSEINEIIPDEDLDEDVEINEE  180
             ++ + D +D D  E    L+ + ++ D+E + +  D EI E I DED DED
Sbjct:  112 LDEFEEIDEDDLDLDEVEEELDLEADDFDEEDLDEDDDDLEIEEDIIDED-DEDY-----  165

Query:  181 DDEEEE                                                       186
            DDEEEE
Sbjct:  166 DDEEEE                                                       171
```

A related DNA sequence was identified in *S. pyogenes* <SEQ ID 7041> which encodes the amino acid sequence <SEQ ID 7042>. Analysis of this protein sequence reveals the following:

```
Possible site: 33
>>> Seems to have no N-terminal signal sequence

----- Final Results -----
            bacterial cytoplasm --- Certainty = 0.2263(Affirmative) < succ>
            bacterial membrane  --- Certainty = 0.0000(Not Clear)   < succ>
            bacterial outside   --- Certainty = 0.0000(Not Clear)   < succ>
```

An alignment of the GAS and GBS proteins is shown below.

```
Identities = 162/191 (84%), Positives = 181/191 (93%), Gaps = 1/191 (0%)

Query:    1 MELEVFAGQEKSELSMIEVARAILEQRGRDNEMYFSDLVNDIQTYLGKSDSAIRESLPFF   60
            ++L+VFAGQEKSELSMIEVARAILE+RGRDNEMYFSDLVN+IQ YLGKSD+ IR +LPFF
Sbjct:   12 LKLDVFAGQEKSELSMIEVARAILEERGRDNEMYFSDLVNEIQNYLGKSDAGIRHALPFF   71

Query:   61 YSDLNTDGSFIPLGENKWGLRSWYAIDEIDEEIITLEEDEDGAPKRKKKRVNAFMDGDED  120
            Y+DLNTDGSFIPLGENKWGLRSWYAIDEIDEEIITLEEDEDGA KRKKKRVNAFMDGDED
Sbjct:   72 YTDLNTDGSFIPLGENKWGLRSWYAIDEIDEEIITLEEDEDGAQKRKKKRVNAFMDGDED  131

Query:  121 AIDYNDDDPEDEDFTEETPSLEYDEENPDDEKSEVESYDSEINEIIPDEDLDEDVEINEE  180
            AIDY DDDPEDEDFTEE+  +EYDEE+PDDEKSEVESYDSE+NEIIP++D  E+V+INEE
Sbjct:  132 AIDYRDDDPEDEDFTEESAEVEYDEEDPDDEKSEVESYDSELNEIIPEDDF-EEVDINEE  190

Query:  181 DDEEEEEEEV                                                   191
            D+E+EE+EE V
Sbjct:  191 DEEDEEDEEPV                                                  201
```

Based on this analysis, it was predicted that these proteins and their epitopes could be useful antigens for vaccines or diagnostics.
m

EXAMPLE 2284

A DNA sequence (GBSx2418) was identified in *S. agalactiae* <SEQ ID 7043> which encodes the amino acid sequence <SEQ ID 7044>. This protein is predicted to be CTP synthetase (pyrG). Analysis of this protein sequence reveals the following:

```
Possible site: 23
>>> Seems to have an uncleavable N-term signal seq
     INTEGRAL      Likelihood = -0.11      Transmembrane      5-21 (5-21)

----- Final Results -----
              bacterial membrane --- Certainty = 0.1044(Affirmative) < succ>
               bacterial outside --- Certainty = 0.0000(Not Clear)   < succ>
             bacterial cytoplasm --- Certainty = 0.0000(Not Clear)   < succ>
```

The protein has homology with the following sequences in the GENPEPT database.

```
>GP: CAA09021 GB: AJ010153 CTP synthetase [Lactococcus lactis subsp.
cremoris] (ver 2)
Identities = 421/533 (78%), Positives = 481/533 (89%)

Query:    2 TKYIFVTGGVVSSIGKGIVAASLGRLLKNRGLKVTIQKFDPYINIDPGTMSPYQHGEVYV   61
            TKYIFVTGG  SS+GKGIVAASLGRLLKNRGLKVT+QKFDPY+NIDPGTMSPYQHGEV+V
Sbjct:    3 TKYIFVTGGGTSSMGKGIVAASLGRLLKNRGLKVTVQKFDPYLNIDPGTMSPYQHGEVFV   62

Query:   62 TDDGAETDLDLGHYERFIDINLNKYSNVTTGKIYSEVLKKERRGEYLGATVQVIPHVTDA  121
            TDDGAETDLDLGHYERFIDINLNKYSNVT+GK+YSE+L+KER+GEYLGATVQ++PHVT+
Sbjct:   63 TDDGAETDLDLGHYERFIDINLNKYSNVTSGKVYSEILRKERKGEYLGATVQMVPHVTNM  122

Query:  122 LKEKIKRAATTTDSDVIITEVGGTVGDIESLPFLEALRQMKADVGSDNVMYIHTTLLPYL  181
            LKEKIKRAATTTD+D+IITEVGGTVGD+ESLPF+EALRQMKA+VG+DNVMYIHT  + +L
Sbjct:  123 LKEKIKRAATTTDADIIITEVGGTVGDMESLPFIEALRQMKAEVGADNVMYIHTVPILHL  182

Query:  182 KAAGEMKTKPTQHSVKELRGLGIQPNMLVIRTEQPAGQSIKNKLAQFCDVAPEAVIESLD  241
            +AAGE+KTK  Q++ K LR  GIQ NMLV+R+E P       +++K+A FCDVAPEAVI+SLD
Sbjct:  183 RAAGELKTKIAQNATKTLREYGIQANMLVLRSEVPITTEMRDKIAMFCDVAPEAVIQSLD  242

Query:  242 VDHIYQIPLNMQAQNMDQIVCDHLKLETPAADMTEWSAMVDKVMNLEKKVKIALVGKYVE  301
            V+H+YQIPLN+QAQNMDQIVCDHLKL+ P ADM EWSAMVD VMNL+KKVKIALVGKYVE
Sbjct:  243 VEHLYQIPLNLQAQNMDQIVCDHLKLDAPKADMAEWSAMVDHVMNLKKKVKIALVGKYVE  302

Query:  302 LPDAYLSVVEALKHSGYVNDVAIDLKWVNAAEVTEDNIKELVGDADGIIVPGGFGQRGSE  361
            LPDAY+SV EALKH+GY +D  +D+ WVNA +VT++N+ ELVGDA GIIVPGGFGQRG+E
Sbjct:  303 LPDAYISVTEALKHAGYASDAEVDINWVNANDVTDENVAELVGDAAGIIVPGGFGQRGTE  362

Query:  362 GKIEAIRYARENDVPMLGVCLGMQLTCVEFARNVLNLHGANSAELDPKTPFPIIDIMRDQ  421
            GKI AI+YARENDVPMLG+CLGMQLT VEFARNVL  L  GA+S ELDP+T +P+IDIMRDQ
Sbjct:  363 GKIAAIKYARENDVPMLGICLGMQLTAVEFARNVLGLEGAHSFELDPETKYPVIDIMRDQ  422

Query:  422 IDIEDMGGTLRLGLYPCKLKSGSRAAAAYNNQEVVQRRHRHRYEFNTKFREQFEAAGFVF  481
            +D+EDMGGTLRLGLYP KLK+GSRA AAYN+ EVVQRRHRHRYEFN K+RE FE AGFVF
Sbjct:  423 VDVEDMGGTLRLGLYPAKLKNGSRAKAAYNDAEVVQRRHRHRYEFNNKYREDFEKAGFVF  482

Query:  482 SGVSPDNRLMEVVELPEKKFFVAAQYHPELQSRPNHAEELYTAFVTAAVENMK         534
            SGVSPDNRL+E+VEL  KKFFVA QYHPELQSRPN  EELYT F+  AVEN K
Sbjct:  483 SGVSPDNRLVEIVELSGKKFFVACQYHPELQSRPNRPEELYTEFIRVAVENSK         535
```

A related DNA sequence was identified in *S. pyogenes* <SEQ ID 7045> which encodes the amino acid sequence <SEQ ID 7046>. Analysis of this protein sequence reveals the following:

```
Possible site: 23
>>> Seems to have an uncleavable N-term signal seq
     INTEGRAL      Likelihood = -0.11      Transmembrane      5-21 (5-21)

----- Final Results -----
              bacterial membrane --- Certainty = 0.1044(Affirmative) < succ>
               bacterial outside --- Certainty = 0.0000(Not Clear)   < succ>
             bacterial cytoplasm --- Certainty = 0.0000(Not Clear)   < succ>
```

The protein has homology with the following sequences in the databases:

```
>GP: CAA09021 GB: AJ010153 CTP synthetase [Lactococcus lactis subsp.
cremoris] (ver 2)
Identities = 423/532 (79%), Positives = 483/532 (90%)
```

-continued

```
Query:    2 TKYIFVTGGVVSSIGKGIVAASLGRLLKNRGLKVTIQKFDPYINIDPGTMSPYQHGEVYV   61
            TKYIFVTGG  SS+GKGIVAASLGRLLKNRGLKVT+QKFDPY+NIDPGTMSPYQHGEV V
Sbjct:    3 TKYIFVTGGGTSSMGKGIVAASLGRLLKNRGLKVTVQKFDPYLNIDPGTMSPYQHGEVFV   62

Query:   62 TDDGAETDLDLGHYERFIDINLNKYSNVTTGKIYSEVLRKERKGEYLGATVQVIPHITDA  121
            TDDGAETDLDLGHYERFIDINLNKYSNVT+GK+YSE+LRKERKGEYLGATVQ++PH+T+
Sbjct:   63 TDDGAETDLDLGHYERFIDINLNKYSNVTSGKVYSEILRKERKGEYLGATVQMVPHVTNM  122

Query:  122 LKEKIKRAASTTDSDVIITEVGGTVGDIESLPFLEALRQMKADVGSENVMYIHTTLLPYL  181
            LKEKIKRAA+TTD+D+IITEVGGTVGD+ESLPF+EALRQMKA+VG++NVMYIHT  + +L
Sbjct:  123 LKEKIKRAATTTDADIIITEVGGTVGDMESLPFIEALRQMKAEVGADNVMYIHTVPILHL  182

Query:  182 KAAGEMKTKPTQHSVKELRGLGIQPNMLVIRTEEPVEQGIKNKLAQFCDVNSEAVIESRD  241
            +AAGE+KTK  Q++ K LR  GIQ NMLV+R+E P+    +++K+A FCDV  EAVI+S D
Sbjct:  183 RAAGELKTKIAQNATKTLREYGIQANMLVLRSEVPITTEMRDKIAMFCDVAPEAVIQSLD  242

Query:  242 VEHLYQIPLNLQAQSMDQIVCDHLKLNAPQADMTEWSAMVDKVMNLRKTTKIALVGKYVE  301
            VEHLYQIPLNLQAQ+MDQIVCDHLKL+AP+ADM EWSAMVD VMNL+K  KIALVGKYVE
Sbjct:  243 VEHLYQIPLNLQAQNMDQIVCDHLKLDAPKADMAEWSAMVDHVMNLKKKVKIALVGKYVE  302

Query:  302 LPDAYLSVVEALKHSGYANDTAIDLKWVNANDVTVDNAADLLGDADGIIVPGGFGQRGTE  361
            LPDAY+SV EALKH+GYA+D   +D+ WVNANDVT +N A+L+GDA GIIVPGGFGQRGTE
Sbjct:  303 LPDAYISVTEALKHAGYASDAEVDINWVNANDVTDENVAELVGDAAGIIVPGGFGQRGTE  362

Query:  362 GKIQAIRYARENDVPMLGICLGMQLTCVEFARHVLNMEGANSFELEPSTKYPIIDIMRDQ  421
            GKI AI+YARENDVPMLGICLGMQLT VEFAR+VL +EGA+SFEL+P TKYP+IDIMRDQ
Sbjct:  363 GKIAAIKYARENDVPMLGICLGMQLTAVEFARNVLGLEGAHSFELDPETKYPVIDIMRDQ  422

Query:  422 IDIEDMGGTLRLGLYPCKLKPGSKAAMAYNNQEVVQRRHRHRYEFNNKFRPEFEAAGFVF  481
            +D+EDMGGTLRLGLYP KLK GS+A  AYN+ EVVQRRHRHRYEFNNK+R +FE AGFVF
Sbjct:  423 VDVEDMGGTLRLGLYPAKLKNGSRAKAAYNDAEVVQRRHRHRYEFNNKYREDFEKAGFVF  482

Query:  482 SGVSPDNRLVEIVELKEKKFFVAAQYHPELQSRPNRPEELYTAFVTAAIKNS          533
            SGVSPDNRLVEIVEL  KKFFVA QYHPELQSRPNRPEELYT F+  A++NS
Sbjct:  483 SGVSPDNRLVEIVELSGKKFFVACQYHPELQSRPNRPEELYTEFIRVAVENS          534
```

An alignment of the GAS and GBS proteins is shown below.

```
Identities = 477/532 (89%), Positives = 503/532 (93%)

Query:    1 MTKYIFVTGGVVSSIGKGIVAASLGRLLKNRGLKVTIQKFDPYINIDPGTMSPYQHGEVY   60
            MTKYIFVTGGVVSSIGKGIVAASLGRLLKNRGLKVTIQKFDPYINIDPGTMSPYQHGEVY
Sbjct:    1 MTKYIFVTGGVVSSIGKGIVAASLGRLLKNRGLKVTIQKFDPYINIDPGTMSPYQHGEVY   60

Query:   61 VTDDGAETDLDLGHYERFIDINLNKYSNVTTGKIYSEVLKKERRGEYLGATVQVIPHVTD  120
            VTDDGAETDLDLGHYERFIDINLNKYSNVTTGKIYSEVL+KER+GEYLGATVQVIPH+TD
Sbjct:   61 VTDDGAETDLDLGHYERFIDINLNKYSNVTTGKIYSEVLRKERKGEYLGATVQVIPHITD  120

Query:  121 ALKEKIKRAATTTDSDVIITEVGGTVGDIESLPFLEALRQMKADVGSDNVMYIHTTLLPY  180
            ALKEKIKRAA+TTDSDVIITEVGGTVGDIESLPFLEALRQMKADVGS+NVMYIHTTLLPY
Sbjct:  121 ALKEKIKRAASTTDSDVIITEVGGTVGDIESLPFLEALRQMKADVGSENVMYIHTTLLPY  180

Query:  181 LKAAGEMKTKPTQHSVKELRGLGIQPNMLVIRTEQPAGQSIKNKLAQFCDVAPEAVIESL  240
            LKAAGEMKTKPTQHSVKELRGLGIQPNMLVIRTE+P  Q IKNKLAQFCDV  EAVIES
Sbjct:  181 LKAAGEMKTKPTQHSVKELRGLGIQPNMLVIRTEEPVEQGIKNKLAQFCDVNSEAVIESR  240

Query:  241 DVDHIYQIPLNMQAQNMDQIVCDHLKLETPAADMTEWSAMVDKVMNLEKKVKIALVGKYV  300
            DV+H+YQIPLN+QAQ+MDQIVCDHLKL  P ADMTEWSAMVDKVMNL K  KIALVGKYV
Sbjct:  241 DVEHLYQIPLNLQAQSMDQIVCDHLKLNAPQADMTEWSAMVDKVMNLRKTTKIALVGKYV  300

Query:  301 ELPDAYLSVVEALKHSGYVNDVAIDLKWVNAAEVTEDNIKELVGDADGIIVPGGFGQRGS  360
            ELPDAYLSVVEALKHSGY ND AIDLKWVNA +VT DN +L+GDADGIIVPGGFGQRG+
Sbjct:  301 ELPDAYLSVVEALKHSGYANDTAIDLKWVNANDVTVDNAADLLGDADGIIVPGGFGQRGT  360

Query:  361 EGKIEAIRYARENDVPMLGVCLGMQLTCVEFARNVLNLHGANSAELDPKTPFPIIDIMRD  420
            EGKI+AIRYARENDVPMLG+CLGMQLTCVEFAR+VLN+ GANS EL+P T +PIIDIMRD
Sbjct:  361 EGKIQAIRYARENDVPMLGICLGMQLTCVEFARHVLNMEGANSFELEPSTKYPIIDIMRD  420

Query:  421 QIDIEDMGGTLRLGLYPCKLKSGSRAAAAYNNQEVVQRRHRHRYEFNTKFREQFEAAGFV  480
            QIDIEDMGGTLRLGLYPCKLK GS+AA AYNNQEVVQRRHRHRYEFN KFR +FEAAGFV
Sbjct:  421 QIDIEDMGGTLRLGLYPCKLKPGSKAAMAYNNQEVVQRRHRNRYEFNNKFRPEFEAAGFV  480

Query:  481 FSGVSPDNRLMEVVELPEKKFFVAAQYHPELQSRPNHAEELYTAFVTAAVEN          532
            FSGVSPDNRL+E+VEL EKKFFVAAQYHPELQSRPN  EELYTAFVTAA++N
Sbjct:  481 FSGVSPDNRLVEIVELKEKKFFVAAQYHPELQSRPNRPEELYTAFVTAAIKN          532
```

Based on this analysis, it was predicted that these proteins and their epitopes could be useful antigens for vaccines or diagnostics.

EXAMPLE 2285

A DNA sequence (GBSx2419) was identified in *S. agalactiae* <SEQ ID 7047> which encodes the amino acid sequence <SEQ ID 7048>. Analysis of this protein sequence reveals the following:

```
Possible site: 34
>>> Seems to have an uncleavable N-term signal seq
INTEGRAL Likelihood = -9.92 Transmembrane 13-29 ( 3-34)

----- Final Results -----
            bacterial membrane --- Certainty = 0.4970(Affirmative) < succ>
             bacterial outside --- Certainty = 0.0000(Not Clear) < succ>
           bacterial cytoplasm --- Certainty = 0.0000(Not Clear) < succ>
```

A related GBS nucleic acid sequence <SEQ ID 9285> which encodes amino acid sequence <SEQ ID 9286> was also identified.

The protein has homology with the following sequences in the GENPEPT database.

```
>GP:CAB14296 GB:Z99116 yqkD [Bacillus subtilis]
Identities = 79/289 (27%), Positives = 139/289 (47%), Gaps = 8/289 (2%)

Query:    1 MKKIRLSKFIKMIVVILFLISVAASFYFFHVAQVRDDKSFISNGQRKPGNSLYAYDKSFD   60
            MKKI L+  I  +V  + I+ S    + + D+ I    + G+ ++   +SF+
Sbjct:    1 MKKILLA--IGALVTAVIAIGIVFSHMILFIKKKTDED--IIKRETDNGHDVF---ESFE   53

Query:   61 KLLKQKIEMTNQNIKQVAWYVPAVKKTHKTAVVVHGFANSKENMKAYGWLFHKLGYNVLM  120
            ++ K   + +      + Y A   T  T++ HG   +  N   Y  LF  LG+NVL+
Sbjct:   54 QMEKTAFVIPSAYGYDIKGYHVAPHDTPNTIIICHGVTMNVLNSLKYMHLFLDLGWNVLI  113

Query:  121 PDNIAHGESHGQLIGYGWNDRENIIKWTEMIVDK-NPSSQITLFGVSMGGATVNMASGEK  179
               D+  HG+S G+   YG+ +++++ K   ++ +K N    I + G SMG  T ++ +G
Sbjct:  114 YDHRRHGQSGGKTTSYGFYEKDDLNKVVSLLKNKTNHRGLIGIHGESMGAVTALLYAGAH  173

Query:  180 LPSQVVNIIEDCGYSSVWDELKFQAKEMYGLPAFPLLYEVSTISKIRAGFSYGQASSVEQ  239
                      I DC ++   ++L ++ +   Y LP++PLL         K+R G+   + S +
Sbjct:  174 CSDGADFYIADCPFACFDEQLAYRLRAEYRLPSWPLLPIADFFLKLRGGYRAREVSPLAV  233

Query:  240 LKKNNLPALFIHGDKDNFVFTSMVYDNYKATAGKKELYIVKGAKHAKSF             288
            + K   P LFIH  D+++P S    Y+   G K LYI +  +HA S+
Sbjct:  234 IDKIEKPVLFIHSKDDDYIPVSSTERLYEKKRGPKALYIAENGEHAMSY             282
```

A related DNA sequence was identified in *S. pyogenes* <SEQ ID 7049> which encodes the amino acid sequence <SEQ ID 7050>. Analysis of this protein sequence reveals the following:

```
Possible site: 24
>>> Seems to have an uncleavable N-term signal seq
INTEGRAL Likelihood = -7.48 Transmembrane 10-26 ( 3-32)

----- Final Results -----
            bacterial membrane --- Certainty = 0.3994(Affirmative) < succ>
             bacterial outside --- Certainty = 0.0000(Not Clear) < succ>
           bacterial cytoplasm --- Certainty = 0.0000(Not Clear) < succ>
```

The protein has homology with the following sequences in the databases:

```
>GP:CAB14296 GB:Z99116 yqkD [Bacillus subtilis]
Identities = 88/295 (29%), Positives = 145/295 (48%), Gaps = 4/295 (1%)

Query:   10 LGILFLLITLISVGASFYFFHVAQIREEKSFINNKKRSTNNPLYPAEQSFDALPYEKRQL   69
              L I  L+  +I++G    F  H+    ++K+   +  KR T+N   +  +SF+ +            +
```

```
                            -continued
Sbjct:    6 LAIGALVTAVIAIG--IVFSHMILFIKKKTDEDIIKRETDNG-HDVFESFEQMEKTAFVI   62

Query:   70 TNRGLKQVGWYLPAAQKTKKTAIVVHGFTNDKEDMKPYAMLFHDLGYNVLMPDNEAHGES  129
            +      +  Y  A   T  T I+ HG T  +  +   Y  LF DLG+NVL+D+    HG+S
Sbjct:   63 PSAYGYDIKGYHVAPHDTPNTIIICHGVTMNVLNSLKYMHLFLDLGWNVLIYDHRRHGQS  122

Query:  130 EGNLIGYGWNDRLNVMAWTDQLI-KENPESQITLFGLSMGAATVMMASGERLPAQVTSLI  188
              G     YG+  ++ ++      L  K N    I +  G SMGAT ++ +G          I
Sbjct:  123 GGKTTSYGFYEKDDLNKVVSLLKNETNHRGLIGIHGESMGAVTALLYAGANCSDGADFYI  182

Query:  189 EDCGYASVWDELKFQAKANYNLPAFPLLYEVSALSKIRAGFSYGEASSVKQLAKNKRPTL  248
              DC +A     ++L  ++ +A Y LP++PLL           K+R G+     E S +    + K ++P L
Sbjct:  183 ADCPFACFDEQLAYRLRAEYRLPSWPLLPIADFFLKLRGGYRAREVSPLAVIDKIEKPVL  242

Query:  249 FIHGDRDDFVPTRMVYDNYKATKGPKEILIVRGAKHAKSFETNPEQYQKKIAAFL       303
              FIN   DD++P         Y+  +GPK +  I  +  +HA S+   N     Y+K +   FL
Sbjct:  243 FIHSKDDDYIPVSSTERLYEKKKGPKALYIAENGEHAMSYTKNRHTYRKTVQEFL       297
```

An alignment of the GAS and GBS proteins is shown below.

```
Identities = 203/294 (69%), Positives = 246/294 (83%)

Query:    1 MKKIRLSKFIKMIVVILFLISVAASFYFFHVAQVRDDKSFISNGQRKPGNSLYAYDKSFD   60
            MK IR++K++ ++ +++ LISV ASFYFFHVAQ+R++KSFI+N +R    N LY  ++SFD
Sbjct:    1 MKTIRIAKYLGILFLLITLISVGASFYFFHVAQIREEKSFINNKKRSTNNPLYPAEQSFD   60

Query:   61 KLLKQKIEMTNQNIKQVAWYVPAVKKTHKTAVVVHGFANSKENMKAYGWLFNKLGYNVLN  120
            L   +K ++TN+ +KQV WY+PA +KT KTA+VVHGF N KE+NK Y   LFH LGYNVLN
Sbjct:   61 ALPYEKRQLTNRGLKQVGWYLPAAQKTRKTAIVVHGFTNDKEDNKPYANLFHDLGYNVLN  120

Query:  121 PDNIAHGESNGQLIGYGWNDRENIIKWTEDMVDKNPSSQITLFGVSMGGATVMMASGEKL  180
            PDN  ANGES G LIGYGWNDR N++WT+ ++  +NP SQITLFG+SMG ATVMMASGE+L
Sbjct:  121 PDNEAHGESEGNLIGYGWNDRLNVMAWTDQLIKENPESQITLFGLSMGAATVMNASGERL  180

Query:  181 PSQVVNIIEOCGYSSVWDELKFQAKENYGLPAFPLLYEVSTISKIRAGFSYGQASSVEQL  240
            P+QV  ++IEDCGY+SVWDELKFQAK  MY LPAFPLLYEVS  +SKIRAGFSYG+ASSV+QL
Sbjct:  181 PAQVTSLIEDCGYASVWDELKFQAKANYNLPAFPLLYEVSALSKIRAGFSYGEASSVKQL  240

Query:  241 KKNNLPALFIHGDKDNFVPTSMVYDNYKATAGKKELYIVKGAKHAKSFETEPEK       294
                KN   P  LFIHGDKD+FVPT MVYDNYKAT G  KE+  IVKGAKHAKSWET PE+
Sbjct:  241 AKNKRPTLFIHGDKDDFVPTKMVYDNYKATKGPKEILIVKGAKHAKSFETNPEQ       294
```

SEQ ID 9286 (GBS662) was expressed in *E. coli* as a GST-fusion product. SDS-PAGE analysis of total cell extract is shown in FIG. 136 (lane 8-10; MW 63 kDa) and in FIG. 187 (lane 4; MW 63 kDa).

GBS662-GST was purified as shown in FIG. 237, lane 7.

Based on this analysis, it was predicted that these proteins and their epitopes could be useful antigens for vaccines or diagnostics.

EXAMPLE 2286

A DNA sequence (GBSx2420) was identified in *S. agalactiae* <SEQ ID 7051> which encodes the amino acid sequence <SEQ ID 7052>. This protein is predicted to be aspartate—ammonia ligase (asnA). Analysis of this protein sequence reveals the following:

```
Possible site: 60
>>> Seems to have no N-terminal signal sequence

----- Final Results -----
            bacterial cytoplasm --- Certainty = 0.2898(Affirmative) < succ>
            bacterial membrane  --- Certainty = 0.0000(Not Clear)   < succ>
            bacterial outside   --- Certainty = 0.0000(Not Clear)   < succ>
```

A related GBS nucleic acid sequence <SEQ ID 9309> which encodes amino acid sequence <SEQ ID 9310> was also identified.

The protein has homology with the following sequences in the GENPEPT database.

```
>GP:AAC22222 GB:U32738 aspartate--ammonia ligase (asnA)
[Haemophilus influenzae Rd]
Identities = 246/300 (82%), Positives = 268/300 (89%)

Query:    1 MIDKLEIVEVQGPILSQVGDGMQDNLSGIEHPVSVKVLNIPEAEFEVVHSLAKWKRHTLA   60
            +I++L I+EVQGPILSQVG+GMQDNLSGIE  V V  IP A FEVVHSLAKWKRHTLA
Sbjct:   23 LIEQLGIIEVQGPILSQVGNGMQDNLSGIEKAVQVNVKCIPNAVFEVVHSLAKWKRHTLA   82

Query:   61 RFGFNEGEGLFVHMKALRPDEDSLDPTHSVYVDQWDWEKVIPDGRRNLDYLKETVEKIYK  120
            RF F E EGLFVHMKALRPDEDSLDPTHSVYVDQWDWEKVIP+GRRN  YLKETV  IY+
Sbjct:   83 RFNFKEDEGLFVHMKALRPDEDSLDPTHSVYVDQWDWEKVIPEGRRNFAYLKETVNSIYR  142

Query:  121 AIRLTELAVEARFDIESILPKRITFIHTEELVEKYPDLSPKERENAIAKEYGAVFLIGIG  180
            AIRLTELAVEARFDI SILPK+ITF+H+E+LV++YPDLS KERENAI KEYGAVFLIGIG
Sbjct:  143 AIRLTELAVEARFDIPSILPKQITFVHSEDLVKRYPDLSSKERENAICKEYGAVFLIGIG  202

Query:  181 GELADGKPHDGRAPDYDDWTTPSENGFKGLNGDILVWNEQLGTAFELSSMGIRVDEDALK  240
            G+L+DGKPNDGRAPDYDDWTT SENG+KGLNGDILVWN+QLG AFELSSMGIRVDE AL+
Sbjct:  203 GKLSDGKPHDGRAPDYDDWTTESENGYKGLNGDILVWNDQLGKAFELSSMGIRVDESALR  262

Query:  241 RQVVLTGDEDRLEFEWHKTLLRGFFPLTIGGGIGQSRLAMFLLRKXHIGEVQSSVWPKEV  300
             QV LTGDED L+ +WH+ LL G  PLTIGGGIGQSRLAM LLRK HIGEVQSSVWPKE+
Sbjct:  263 LQVGLTGDEDHLKMDWHQDLLNGKLPLTIGGGIGQSRLAMLLLRKKHIGEVQSSVWPKEM  322
```

A related DNA sequence was identified in *S. pyogenes* <SEQ ID 7053> which encodes the amino acid sequence <SEQ ID 7054>. Analysis of this protein sequence reveals the following:

```
Possible site: 34
>>> Seems to have no N-terminal signal sequence
INTEGRAL Likelihood = -0.16 Transmembrane 189-205 ( 189-205)

----- Final Results -----
           bacterial membrane --- Certainty = 0.1065(Affirmative) < succ>
            bacterial outside --- Certainty = 0.0000(Not Clear) < succ>
          bacterial cytoplasm --- Certainty = 0.0000(Not Clear) < succ>
```

The protein has homology with the following sequences in the databases:

```
>GP:AAC22222 GB:U32738 aspartate--aimnonia ligase (asnA)
[Haemophilus influen ae Rd]
Identities = 255/330 (77%), Positives = 289/330 (87%)

Query:    1 MKKSFIHQQEEISFVKNTFTQYLIAKLDVVEVQGPILSRVGDGMQDNLSGTENPVSVNVL   60
            MKK+FI QQ+EISFVKNTFTQ LI +L ++EVQGPILS+VG+GMQDNLSG E   V VNV
Sbjct:    1 MKKTFILQQQEISFVKNTFTQNLIEQLGIIEVQGPILSQVGNGMQDNLSGIEKAVQVNVK   60

Query:   61 KIPNATFEVVNSLAKWKRHTLARFGFNEGEGLVVNMKALRPDEDSLDQTHSVYVDQWDWE  120
            +IPNA FEVVHSLAKWKRHTLARF F E EGL V+MKALRPDEDSLD THSVYVDQWDWE
Sbjct:   61 CIPNAVFEVVHSLAKWKRHTLARFNFKEDEGLFVHMKALRPDEDSLDPTHSVYVDQWDWE  120

Query:  121 KVIPDGKRNLAYLKETVETIYKVIRLTELAVEARYDIEAVLPKKITFIHTEELVAKYPDL  180
            KVIP+G+RN AYLKETV +IY+ IRLTELAVEAR+DI ++LPK+ITF+H+E+LV +YPDL
Sbjct:  121 KVIPEGRRNFAYLKETVNSIYRAIRLTELAVEARFDIPSILPKQITFVHSEDLVKRYPDL  180

Query:  181 TPKERENAITKEFGAVFLIGIGGVLPDGKPHDGRAPDYDDWTTETENGYHGLNGDILVWN  240
            + KERENAI KE+GAVFLIGIGG L DGKPHDGRAPDYDDWTTE+ENGY GLNGDILVWN
Sbjct:  181 SSKERENAICKEYGAVFLIGIGGKLSDGKPHDGRAPDYDDWTTESENGYKGLNGDILVWN  240

Query:  241 DQLGSAFELSSNGIRVDEEALKRQVEMTGDQDRLGFDWHESLLNGLFPLTIGGGIGQSRM  300
            DQLG AFELSSNGIRVDE AL+ QV +TGD+D L  DWH+ LLNG  PLTIGGGIGQSR+
Sbjct:  241 DQLGKAFELSSNGIRVDESALRLQVGLTGDEDHLKNDWHQDLLNGKLPLTIGGGIGQSRL  300

Query:  301 VMFLLREQHIGEVQTSVWPQEVRDSYDNIL                               330
            +M LLRK+HIGEVQ+SVWP+E+ + + NIL
Sbjct:  301 ANLLLRKKHIGEVQSSVWPKEMLEEFSNIL                               330
```

An alignment of the GAS and GBS proteins is shown below.

```
Identities = 254/303 (83%), Positives = 280/303 (91%)

Query:    1 MIDKLEIVEVQGPILSQVGDGMQDNLSGIEHPVSVKVLNIPEAEFEVVHSLAKWKRHTLA   60
            +I KL++VEVQGPILS+VGDGMQDNLSG E+PVSV VL IF A FEVVHSLAKWKRHTLA
Sbjct:   23 LIAKLDVVEVQGPILSRVGDGMQDNLSGTENPVSVNVLKIPNATFEVVHSLAKWKRHTLA   82

Query:   61 RFGFNEGEGLFVHMKALRPDEDSLDPTHSVYVDQWDWEKVIPDGRRNLDYLKETVEKIYK  120
            RFGFNEGEGL V+MKALRPDEDSLD THSVYVDQWDWEKVIPDG+RNL YLKETVE IYK
Sbjct:   83 RFGFNEGEGLVVNMKALRPDEDSLDQTHSVYVDQWDWEKVIPDGKRNLAYLKETVETIYK  142

Query:  121 AIRLTELAVEARFDIESILPKRITFIHTEELVEKYPDLSPKERENAIAKEYGAVFLIGIG  180
            IRLTELAVEAR+DIE++LPK+ITFIHTESLV KYPDL+PKERENAI KE+GAVFLIGIG
Sbjct:  143 VIRLTELAVEARYDIEAVLPKKITFIHTEELVAKYPDLTPKERENAITKEFGAVFLIGIG  202

Query:  181 GELADGKPHDGRAPDYDDWTTPSENGFKGLNGDILVWNEQLGTAFELSSMGIRVDEDALK  240
            G L DGKPHDGRAPDYDDWTT +ENG+ GLNGDILVWN+QLG+AFELSSMGIRVDE+ALK
Sbjct:  203 GVLPDGKPHDGRAPDYDQWTTETENGYHGLNGDILVWNDQLGSAFELSSMGIRVDEEALK  262

Query:  241 RQVVLTGDEDRLEFEWHKTLLRGFFPLTIGGGIGQSRLANFLLRKXHIGEVQSSVWPKEV  300
            RQV +TGD+DRL F+WHR+LL G FPLTIGGGIGQSR+ MFLLRK HIGEVQ+SVWP+EV
Sbjct:  263 RQVEMTGDQDRLGFDWHKSLLNGLFFLTIGGGIGQSRNVMFLLRKQHIGEVQTSVWPQEV  322

Query:  301 RDT                                                           303
            RD+
Sbjct:  323 RDS                                                           325
```

Based on this analysis, it was predicted that these proteins and their epitopes could be useful antigens for vaccines or diagnostics.

EXAMPLE 2287

A DNA sequence (GBSx2421) was identified in *S. agalactiae* <SEQ ID 7055> which encodes the amino acid sequence <SEQ ID 7056>. Analysis of this protein sequence reveals the following:

```
Possible site: 27
>>> Seems to have no N-terminal signal sequence

----- Final Results -----
            bacterial cytoplasm --- Certainty = 0.3163(Affirmative) < succ>
             bacterial membrane --- Certainty = 0.0000(Not Clear)   < succ>
              bacterial outside --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 2288

A DNA sequence (GBSx2422) was identified in *S. agalactiae* <SEQ ID 7057> which encodes the amino acid sequence <SEQ ID 7058>. Analysis of this protein sequence reveals the following:

```
Possible site: 25
>>> Seems to have a cleavable N-term signal seq.

----- Final Results -----
              bacterial outside --- Certainty = 0.3000(Affirmative) < succ>
             bacterial membrane --- Certainty = 0.0000(Not Clear)   < succ>
            bacterial cytoplasm --- Certainty = 0.0000(Not Clear)   < succ>
```

A related GBS nucleic acid sequence <SEQ ID 9007> which encodes amino acid sequence <SEQ ID 9008> was also identified.

The protein has homology with the following sequences in the GENPEPT database.

```
>GP:AAD56628 GB:AF165218 Bta [Streptococcus pneumoniae]
Identities = 30/97 (30%), Positives = 50/97 (50%), Gaps = 3/97 (3%)

Query:   50 KALVSKSQQSEATIFIGRPTCQYCRAFLPKLLKSQATLHSKIYYLDSQKYKG-KRLKSFF  108
            +A +  ++ AT FIGR TC YCR F   L   A    + IY+++S++     L++F
Sbjct:   18 RAQEALDKKETATFFIGRKTCPYCRKFAGTLSGVVAETKAHIYFINSEEASQLNDLQAFR  77

Query:  109 KKHHITTVPNLAHYQQGKMTKYLVQGSQATPQQIQTW                        145
              ++ I TVP    H    G++     +    S  + Q+I+ F
Sbjct:   78 SRYGIPTVPGFVHITDGQIN--VRCDSSMSAQEIKDF                        112
```

SEQ ID 9008 (GBS134) was expressed in *E. coli* as a His-fusion product. SDS-PAGE analysis of total cell extract is shown in FIG. 40 (lane 2; MW 17 kDa). It was also expressed in *E. coli* as a GST-fusion product. SDS-PAGE analysis of total cell extract is shown in FIG. 46 (lane 4; MW 42 kDa).

GBS134-GST was purified as shown in FIG. 204, lane 10.

Based on this analysis, it was predicted that this protein and its epitopes, could be useful antigens for vaccines or diagnostics.

EXAMPLE 2289

A DNA sequence (GBSx2423) was identified in *S. agalactiae* <SEQ ID 7059> which encodes the amino acid sequence <SEQ ID 7060>. Analysis of this protein sequence reveals the following:

```
Possible site: 58
>>> Seems to have no N-terminal signal sequence

----- Final Results -----
            bacterial cytoplasm --- Certainty = 0.0735(Affirmative) < succ>
            bacterial membrane  --- Certainty = 0.0000(Not Clear)  < succ>
             bacterial outside  --- Certainty = 0.0000(Not Clear)  < succ>
```

A related GBS nucleic acid sequence <SEQ ID 9603> which encodes amino acid sequence <SEQ ID 9604> was also identified.

The protein has homology with the following sequences in the GENPEPT database.

```
>GP: BAB06309 GB: AP001516 unknown conserved protein
[Bacillus halodurans]
Identities = 78/178 (43%), Positives = 115/178 (63%), Gaps = 3/178 (1%)

Query:    3 MRVVAGTFGGRPLKTLDGKTTRPTTDKVKGAIFNMIGPFFEGGRVLDLFSGSGSLAIEAI   62
            MRV+AG   G  LK + G  TRPTTDKVK AIFNMIGPFF+GG  LDL+ GSG L IEA+
Sbjct:    1 MRVIAGEQKGLTLKAVPGHKTRPTTDKVKEAIFNMIGPFFDGGIGLDLYGGSGGLGIEAL   60

Query:   63 SRGMDQAVLVEKDRRAQVVIQENIAMTKSPEQFQLLKMEANRALEQLTGQ---FDLVLLD  119
            SRG+++ + V++ +RA    I++N++     + ++ + +A RAL+ LT +    F   V LD
Sbjct:   61 SRGVERMIFVDQQKRAIETIKQNLSHCGLEGRAEVYRNDAKRALQVLTKRGIVFAYVFLD  120

Query:  120 PPYAKEEIVKQIQIMDSKGLLGDDIMIACETDKSVDLPEEIASFGIWKQKIYGISKVT   177
            PPYAK+ I   + I+ + GLL +  ++ CE D+   LP++I       K++ YG + +T
Sbjct:  121 PPYAKQTIKNDLAILANHGLLEEGGVVVCEHDRDTMLPDQIEYAVKHKEETYGDTMIT   178
```

There is also homology to SEQ ID 132.

Based on this analysis, it was predicted that this protein and its epitopes, could be useful antigens for vaccines or diagnostics.

EXAMPLE 2290

A DNA sequence (GBSx2424) was identified in *S. agalactiae* <SEQ ID 7061> which encodes the amino acid sequence <SEQ ID 7062>. Analysis of this protein sequence reveals the following:

```
Possible site: 14
>>> Seems to have no N-terminal signal sequence

----- Final Results -----
           bacterial cytoplasm --- Certainty = 0.4984(Affirmative) < succ>
            bacterial membrane --- Certainty = 0.0000(Not Clear)   < succ>
             bacterial outside --- Certainty = 0.0000(Not Clear)   < succ>
```

The protein has homology with the following sequences in the GENPEPT database.

```
>GP: CAB96619 GB: AJ400630 hypothetical protein
[Streptococcus pneumoniae bacteriophage MM1]
Identities = 175/254 (68%), Positives = 219/254 (85%)

Query:   2 LRRHIYSMLEEHXHLQPEIKYHQKTNLRKNRVYTVFIEEKVDVILADLKLADAFFGIETG   61
           L RH+Y         ++ EI++HQ++NLRKNRVYTVF EKV  L+DL LAD+FFG+ETG
Sbjct:  50 LARHLYESFLHFYEIKSEIRHHQRSNLRKNRVYTVFTDEKVQDLLSDLHLADSFFGLETG  109

Query:  62 IEHSILDNDENGRAYLRGAFLSTGTVREPDSGKYQLEIFSVYLDHAQDLANLMKKFMLDA  121
           I+ +IL ++E GRAYL GAFL+ G++R+P+SGKYQLEI SVYLDHAQ +A+L+++F+LDA
Sbjct: 110 IDEAILSDEEAGRAYLCGAFLANGSIRDPESGKYQLEISSVYLDHAQGIASLLQQFLLDA  169

Query: 122 KVIEHKHGAVTYLQKAEDIMDFLIVIDAMEARDAFEEIKMIRETRNDINRANNVETANIA  181
           KV+E K GAVTYLQ+AEDIMDFLIVI AM+ARD FE +K++RETRND+NRANN ETANIA
Sbjct: 170 KVLERKKGAVTYLQRAEDIMDFLIVIGAMQARDDFERVKILRETRNDLNRANNAETANIA  229

Query: 182 RTITASMKTINNIIKIMDTIGFDALPSDLRQVAQVRVAHPDYSIQQIADSLETPLSKSGV  241
           RT++ASMKTINNI KI D +G + LP DL++VAQ R+ HPDYSIQQ+ADSL TPL+KSGV
Sbjct: 230 RTVSASMKTINNISKIKDIMGLENLPVDLQEVAQLRIQHPDYSIQQLADSLSTPLTKSGV  289

Query: 242 NHRLRKINKIADEL                                                255
           NHRLRKINKIADEL
Sbjct: 290 NHRLRKINKIADEL                                                303
```

There is also homology to SEQ ID 5540:

```
Identities = 186/254 (73%), Positives = 227/254 (89%)

Query:   2 LRRHIYSMLEEHXHLQPEIKYHQKTNLRKNRVYTVFIEEKVDVILADLKLADAFFGIETG   61
           + R+IYS++E+    + PEI+YHQKTNLRKNRVYTV++E+ V+ ILADLKLAD+FFG ETG
Sbjct:  50 IARYIYSLIEDAYVIVPEIRYHQKTNLRKNRVYTVYVEQGVETILADLKLADSFFGLETG  109

Query:  62 IEHSILDNDENGRAYLRGAFLSTGTVREPDSGKYQLEIFSVYLDHAQDLANLMKKFMLDA  121
           IE  +L +D  GR+YL+GAFL+ G++R+P+SGKYQLEI+SVYLDHAQDLA LM+KFMLDA
Sbjct: 110 IEPQVLSDDNAGRSYLKGAFLAAGSIRDPESGKYQLEIYSVYLDHAQDLAQLMQKFMLDA  169

Query: 122 KVIEHKHGAVTYLQKAEDIMDFLIVIDAMEARDAFEEIKMIRETRNDINRANNVETANIA  181
           K IEHK GAVTYLQKAEDIMDFLI+I AM  ++ FE IK++RE RNDINRANN ETANIA
Sbjct: 170 KTIEHKSGAVTYLQKAEDIMDFLIIIGAMSCKEDFEAIKLLREARNDINRANNAETANIA  229

Query: 182 RTITASMKTINNIIKIMDTIGFDALPSDLRQVAQVRVAHPDYSIQQIADSLETPLSKSGV  241
           +TI+ASMKTINNIIKIMDTIG ++LP +L+QVAQ+RV HPDYSIQQ+AD+LE P++KSGV
Sbjct: 230 KTISASMKTINNIIKIMDTIGLESLPIELQQVAQLRVKHPDYSIQQVADALEFPITKSGV  289

Query: 242 NHRLRKINKIADEL                                                255
           NHRLRKINKIAD+L
Sbjct: 290 NHRLRKINKIADDL                                                303
```

Based on this analysis, it was predicted that these proteins and their epitopes could be useful antigens for vaccines or diagnostics.

EXAMPLE 2291

A DNA sequence (GBSx2425) was identified in *S. agalactiae* <SEQ ID 7063> which encodes the amino acid sequence <SEQ ID 7064>. Analysis of this protein sequence reveals the following:

```
Possible site: 14
>>> Seems to have no N-terminal signal sequence

----- Final Results -----
            bacterial cytoplasm --- Certainty = 0.0297(Affirmative) < succ>
            bacterial membrane  --- Certainty = 0.0000(Not Clear)   < succ>
             bacterial outside  --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 2292

A DNA sequence (GBSx2428) was identified in *S. agalactiae* <SEQ ID 7065> which encodes the amino acid sequence <SEQ ID 7066>. Analysis of this protein sequence reveals the following:

```
Possible site: 31
>>> Seems to have no N-terminal signal sequence

----- Final Results -----
            bacterial cytoplasm --- Certainty = 0.2706(Affirmative) < succ>
            bacterial membrane  --- Certainty = 0.0000(Not Clear)   < succ>
             bacterial outside  --- Certainty = 0.0000(Not Clear)   < succ>
```

The protein has homology with the following sequences in the GENPEPT database.

```
>GP: CAB54571 GB: AJ006393 response regulator [Streptococcus pneumoniae]
Identities = 139/190 (73%), Positives = 166/190 (87%)

Query:   8 IKIVLVDDHEMVRLGLKSFLNLQADVEVIGEASNGLEGIKKALELRPDVVVMDLVMPEMD    67
           +KI+LVDDHEMVRLGLKS+ +LQ DVEV+GEASNG +GI  ALELRPDV+VMD+VMPEM+
Sbjct:   1 MKILLVDDHEMVRLGLKSYFDLQDDVEVVGEASNGSQGIDLALELRPDVIVMDIVMPEMN    60

Query:  68 GVEATLALLKDWPEAAILVLTSYLDNEKIYPVIEAGAKGYMLKTSSAAEILNAIRKVSRG   127
           G++ATLA+LK+WPEA IL++TSYLDNEKI PV++AGAKGYMLKTSSA E+L+A+ KV+ G
Sbjct:  61 GIDATLAILKEWPEAKILIVTSYLDNEKIMPVLDAGAKGYMLKTSSADELLHAVSKVAAG   120

Query: 128 EQAIENEVDKKIKAHDKCPALHEGLTARERDILNLLAKGYDNQRIADELFISLKTVKTHV   187
           E AIE EV KK++ H    LHE LTARERD+L L+AKGY+NQRIAD+LFISLKTVKTHV
Sbjct: 121 ELAIEQEVSKKVEYHRNHMELHEELTARERDVLQLIAKGYENQRIADDLFISLKTVKTHV   180

Query: 188 SNILGKLNGS                                                   197
           SNIL KL  S
Sbjct: 181 SNILAKLEVS                                                   190
```

There is also high homology to SEQ ID 2996:

```
Identities = 158/198 (79%), Positives = 176/198 (88%), Gaps = 1/198 (0%)

Query:   5 MDKIKIVLVDDHEMVRLGLKSFLNLQADVEVIGEASNGLEGIKKALELRPDVVVMDLVMP    64
           M KIK++LVDDHEMVR+GLKSFLNLQAD++V+GEASNG EG+  AL L+PDV+VMDLVMP
Sbjct:   3 MSKIKVILVDDHEMVRMGLKSFLNLQADIDVVGEASNGREGVDLALALKPDVLVMDLVMP    62
```

-continued

```
Query:  65 EMDGVEATLALLKDWPEAAILVLTSYLDNEKIYPVIEAGAKGYMLKTSSAAEILNAIRKV  124
           E+ GVEATL +LK W EA +LVLTSYLDNEKIYPVI+AGAKGYMLKTSSAAEILNAIRKV
Sbjct:  63 ELGGVEATLEVLKKWKEAKVLVLTSYLDNEKIYPVIDAGAKGYMLKTSSAAEILNAIRKV  122

Query: 125 SRGEQAIENEVDKKIKAHDKCPALHEGLTARERDILNLLAKGYDNQRIADELFISLKTVK  184
           S+GE AIE EVDKKIKAHD+ P LHE LTARE DIL+LLAKGYDNQ IADELFISLKTVK
Sbjct: 123 SKGELAIETEVDKKIKAHDQHPDLHEELTAREYDILHLLAKGYDNQTIADELFISLKTVK  182

Query: 185 THVSNILGKLN-GSRSNS                                            201
           THVSNIL KL  G R+ +
Sbjct: 183 THVSNILAKLEVGDRTQA                                            200
```

Based on this analysis, it was predicted that these proteins and their epitopes could be useful antigens for vaccines or diagnostics.

EXAMPLE 2293

A DNA sequence (GBSx2429) was identified in *S. agalactiae* <SEQ ID 7067> which encodes the amino acid sequence <SEQ ID 7068>. This protein is predicted to be histidine kinase (narQ). Analysis of this protein sequence reveals the following:

```
Possible site: 56
>>> Seems to have no N-terminal signal sequence

----- Final Results -----
            bacterial cytoplasm --- Certainty = 0.3944(Affirmative) < succ>
            bacterial membrane  --- Certainty = 0.0000(Not Clear)   < succ>
             bacterial outside  --- Certainty = 0.0000(Not Clear)   < succ>
```

The protein has homology with the following sequences in the GENPEPT database.

```
>GP: CAB54570 GB: AJ006393 histidine kinase [Streptococcus pneumoniae]
Identities = 32/55 (58%), Positives = 49/55 (88%)

Query:    1 MIDNGIGFDMDSVYDLSYGLKNIEDRVEDLAGNLQLLSQPGKGVAMDIRLPLVNQ       55
            ++DNGIGF + S+ DLSYGL+NI++RVED+AG +QLL+ P +G+A+DIR+PL+++
Sbjct:  276 VVDNGIGFQLGSLDDLSYGLRNIKERVEDMAGTVQLLTAPKQGLAVDIRIPLLDK      330
```

There is also homology to SEQ ID 2992:

```
Identities = 44/59 (74%), Positives = 51/59 (85%)

Query:    1 MIDNGIGFDMDSVYDLSYGLKNIEDRVEDLAGNLQLLSQPGKGVAMDIRLPLVNQSEDK   59
            MID+G+GFDMD V DLSYGLKNIEDRV DLAGNL L+SQ GKGV+MDIRLP+V   +D+
Sbjct:  276 MIDDGVGFDMDQVRDLSYGLKNIEDRVNDLAGNLHLISQKGKGVSMDIRLPIVKGDDDE  334
```

Based on this analysis, it was predicted that these proteins and their epitopes could be useful antigens for vaccines or diagnostics.

EXAMPLE 2294

A DNA sequence (GBSx2430) was identified in *S. agalactiae* <SEQ ID 7069> which encodes the amino acid sequence <SEQ ID 7070>. This protein is predicted to be RfbQRSO155-1. Analysis of this protein sequence reveals the following:

```
Possible site: 41
>>> Seems to have no N-terminal signal sequence

----- Final Results -----
            bacterial cytoplasm --- Certainty = 0.1120(Affirmative) < succ>
            bacterial membrane  --- Certainty = 0.0000(Not Clear)   < succ>
             bacterial outside  --- Certainty = 0.0000(Not Clear)   < succ>
```

There is also homology to SEQ ID 7072:

```
Identities = 171/172 (99%), Positives = 172/172 (99%)

Query:    1 MGQVAVEEKSNEIVAIPQLLRTIDIRKSIVTIDAMGTQTAIVDTIIKGKADYCLAVKGNQ    60
            +GQVAVEEKSNEIVAIPQLLRTIDIRKSIVTIDAMGTQTAIVDTIIKGKADYCLAVKGNQ
Sbjct:  143 LGQVAVEEKSNEIVAIPQLLRTIDIRKSIVTIDAMGTQTAIVDTIIKGKADYCLAVKGNQ   202

Query:   61 ETLYDDIALYFSDVNLLEELQENAQYYQTVEKSRGQIEVREYWVSSDIKWLCQNHPKWHK   120
            ETLYDDIALYFSDVNLLEELQENAQYYQTVEKSRGQIEVREYWVSSDIKWLCQNHPKWHK
Sbjct:  203 ETLYDDIALYFSDVNLLEELQENAQYYQTVEKSRGQIEVREYWVSSDIKWLCQNHPKWHK   262

Query:  121 LRGIGMTRNTIDKDGQLSQENRYFIFSFKPDVLTFANCVRGHWQIESMHWLL           172
            LRGIGMTRNTIDKDGQLSQENRYFIFSFKPDVLTFANCVRGHWQIESMHWLL
Sbjct:  263 LRGIGMTRNTIDKDGQLSQENRYFIFSFKPDVLTFANCVRGHWQIESMHWLL           314
```

Based on this analysis, it was predicted that these proteins and their epitopes could be useful antigens for vaccines or diagnostics.

EXAMPLE 2295

A DNA sequence (GBSx2431) was identified in *S. agalactiae* <SEQ ID 7073> which encodes the amino acid sequence <SEQ ID 7074>. This protein is predicted to be translation initiation factor if-3 homolog dsg (infC). Analysis of this protein sequence reveals the following:

```
Possible site: 42
>>> Seems to have no N-terminal signal sequence

----- Final Results -----
            bacterial cytoplasm --- Certainty = 0.1787(Affirmative) < succ>
             bacterial membrane --- Certainty = 0.0000(Not Clear)   < succ>
              bacterial outside --- Certainty = 0.0000(Not Clear)   < succ>
```

The protein has homology with the following sequences in the GENPEPT database.

```
>GP: CAA68920 GB: Y07640 translation initiation factor, IF3
[Listeria monocytogenes]
Identities = 112/169 (66%), Positives = 134/169 (79%)

Query:    7 KDLFINDEIRVREVRLVGLEGEQLGIKPLSEAQAIADDANVDLVLIQPQATPPVAKIMDY    66
            KD+ +ND IR REVRL+  +GEQLG+K   +A   IA+ AN+DLVL+ P A PPVA+IMDY
Sbjct:    3 KDMLVNDGIRAREVRLIDQDGEQLGVKSKIDALQIAEKANLDLVLVAPTAKPPVARIMDY    62

Query:   67 GKFKFEYQKKQKEQRKKQSVVTVKEVRLSPVIDKGDFETKLRNGRKFLEKGNKVKVSIRF   126
            GKF+FE QKK KE RK Q V+ +KEVRLSP ID+ DF+TKLRN RKFLEKG+KVK SIRF
Sbjct:   63 GKFRFEQQKKDKEARKNQKVIVMKEVRLSPTIDEHDFDTKLRNARKFLEKGDKVKCSIRF   122

Query:  127 KGRMITHKEIGAKVLAEFAEATQDIAIIEQRAKMDGRQMFMQLAPIPDK              175
            KGR ITHKEIG KVL  FA+A +D+   IEQR KMDGR MF+ LAP+ +K
Sbjct:  123 KGRAITHKEIGQKVLDRFAKACEDLCTIEQRPKMDGRSMFLVLAPLHEK              171
```

A related DNA sequence was identified in *S. pyogenes* <SEQ ID 7075> which encodes the amino acid sequence <SEQ ID 7076>. Analysis of this protein sequence reveals the following:

```
Possible site: 42
>>> Seems to have no N-terminal signal sequence

----- Final Results -----
            bacterial cytoplasm --- Certainty = 0.2247(Affirmative) < succ>
             bacterial membrane --- Certainty = 0.0000(Not Clear)   < succ>
              bacterial outside --- Certainty = 0.0000(Not Clear)   < succ>
```

An alignment of the GAS and GBS proteins is shown below.

```
Identities = 167/176 (94%), Positives = 173/176 (97%)

Query:   1 MKIIAKKDLFINDEIRVREVRLVGLEGEQLGIKPLSEAQAIADDANVDLVLIQPQATPPV   60
           +KIIAKKDLFINDEIRVREVRLVGLEGEQLGIKPLSEAQ++AD +NVDLVLIQPQA PPV
Sbjct:   1 VKIIAKKDLFINDEIRVREVRLVGLEGEQLGIKPLSEAQSLADASNVDLVLIQPQAVPPV   60

Query:  61 AKIMDYGKFKFEYQKKQKEQRKKQSVVTVKEVRLSPVIDKGDFETKLRNGRKFLEKGNKV  120
           AK+MDYGKFKFEYQKKQKEQRKKQSVVTVKEVRLSPVIDKGDFETKLRNGRKFLEKGNKV
Sbjct:  61 AKLMDYGKFKFEYQKKQKEQRKKQSVVTVKEVRLSPVIDKGDFETKLRNGRKFLEKGNKV  120

Query: 121 KVSIRFKGRMITHKEIGAKVLAEFAEATQDIAIIEQRAKMDGRQMFMQLAPIPDKK      176
           KVSIRFKGRMITHKEIGAKVLA+FAEATQDIAIIEQRAKNDGRQMFMQLAPI DKK
Sbjct: 121 KVSIRFKGRMITHKEIGAKVLADFAEATQDIAIIEQRAKMDGRQMFMQLAPISDKK      176
```

Based on this analysis, it was predicted that these proteins and their epitopes could be useful antigens for vaccines or diagnostics.

EXAMPLE 2296

A DNA sequence (GBSx2432) was identified in *S. agalactiae* <SEQ ID 7077> which encodes the amino acid sequence <SEQ ID 7078>. Analysis of this protein sequence reveals the following:

```
Possible site: 57
>>> Seems to have no N-terminal signal sequence

----- Final Results -----
           bacterial cytoplasm --- Certainty = 0.1807(Affirmative) < succ>
           bacterial membrane  --- Certainty = 0.0000(Not Clear)   < succ>
            bacterial outside  --- Certainty = 0.0000(Not Clear)   < succ>
```

The protein has homology with the following sequences in the GENPEPT database.

```
>GP: AAC45308 GB: U81957 RNA polymerase beta' subunit [Streptococcus gordonii]
Identities = 262/286 (91%), Positives = 276/286 (95%)

Query:   1 MAAKVVKAGVEEVXIRSVFTCNTRHGVCRHCYGINLATGDAVEVGEAVGTIAAQSIGEPG   60
           MA +VV AGV EV IRSV TCNTRHGVCRHCYGINLATGDAVEVGEAVGTIAAQSIGEPG
Sbjct: 122 MARQVVNAGVTEVTIRSVLTCNTRHGVCRHCYGINLATGDAVEVGEAVGTIAAQSIGEPG  181

Query:  61 TQLTMRTFHTGGVASNTDITQGLPRIQEIFEARNPKGEAVITEVKGEVVAIEEDSSTRTK  120
           TQLTMRTFHTGGVAS++DITQGLFR+QEIFEARNPKGEAVITEVKGEV AIEED+STRTK
Sbjct: 182 TQLTMRTFHTGGVASSSDITQGLPRVQEIFEARNPKGEAVITEVKGEVTAIEEDASTRTK  241

Query: 121 KVFVKGQTGEGEYVVPFTARMKVEVGDEVARGAALTEGSIQPKRLLEVRDTLSVETYLLA  180
           KVFVKGQTGEGEYVVPFTARMKVEVGD+V+RGAALTEGSIQPK LL VRD LSVETYLLA
Sbjct: 242 KVFVKGQTGEGEYVVPFTARMKVEVGDQVSRGAALTEGSIQPKHLLAVRDVLSVETYLLA  301

Query: 181 EVQKVYRSQGVEIGDKHVEVMVRQMLRKVRVMDPGDTDLLPGTLMDISDFTDANKDIVIS  240
           EVQKVYRSQGVEIGDKH+EVMVRQM+RKVRVMDPGDTDLL GTLMDI+DFTDAN+D+VIS
Sbjct: 302 EVQKVYRSQGVEIGDKHIEVMVRQMIRKVRVMDPGDTDLLMGTLMDITDFTDANRDVVIS  361

Query: 241 GGIPATSRPVLMGITKASLETNSFLSAASFQETTRVLTDAAIRGKK                286
           GG+PAT+RPVLMGITKASLETNSFLSAASFQETTRVLTDAAIRGKK
Sbjct: 362 GGVPATARPVLMGITKASLETNSFLSAASFQETTRVLTDAAIRGKK                407
```

There is also homology to SEQ ID 384.

Based on this analysis, it was predicted that this protein and its epitopes, could be useful antigens for vaccines or diagnostics.

EXAMPLE 2297

A DNA sequence (GBSx2434) was identified in *S. agalactiae* <SEQ ID 7079> which encodes the amino acid sequence <SEQ ID 7080>. Analysis of this protein sequence reveals the following:

```
Possible site: 24
>>> Seems to have no N-terminal signal sequence

----- Final Results -----
            bacterial cytoplasm --- Certainty = 0.0352(Affirmative) < succ>
            bacterial membrane  --- Certainty = 0.0000(Not Clear)   < succ>
             bacterial outside  --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 2298

A DNA sequence (GBSx2435) was identified in *S. agalactiae* <SEQ ID 7081> which encodes the amino acid sequence <SEQ ID 7082>. This protein is predicted to be acetoin dehydrogenase (TPP-dependent) beta chain (pdhB). Analysis of this protein sequence reveals the following:

```
Possible site: 47
>>> Seems to have no N-terminal signal sequence

----- Final Results -----
            bacterial cytoplasm --- Certainty = 0.0266(Affirmative) < succ>
            bacterial membrane  --- Certainty = 0.0000(Not Clear)   < succ>
             bacterial outside  --- Certainty = 0.0000(Not Clear)   < succ>
```

The protein has homology with the following sequences in the GENPEPT database.

```
>GP: BAB04496 GB: AP001509 acetoin dehydrogenase (TPP-dependent) beta
chain [Bacillus halodurans]
Identities = 37/57 (64%), Positives = 50/57 (86%)

Query:   1 MLEEFGAKRVRDTPISEAAIAGSAIGAAQTGLRPIVDLTFMDFVTIAMDAIVDDCIR    57
           M+EEFG++RVR+TPISEAAI+G+AIGAA TG+RPI++L F DF+TIAMD +V+   +
Sbjct:  44 MIEEFGSERVRNTPISEAAISGTAIGAALTGMRPILELQFSDFITIAMDNMVNQAAK   100
```

There is also homology to SEQ ID 4272.

Based on this analysis, it was predicted that this protein and its epitopes, could be useful antigens for vaccines or diagnostics.

EXAMPLE 2299

A DNA sequence (GBSx2436) was identified in *S. agalactiae* <SEQ ID 7083> which encodes the amino acid sequence <SEQ ID 7084>. This protein is predicted to be Structural protein. Analysis of this protein sequence reveals the following:

```
Possible site: 30
>>> Seems to have no N-terminal signal sequence

----- Final Results -----
            bacterial cytoplasm --- Certainty = 0.3015(Affirmative) < succ>
            bacterial membrane  --- Certainty = 0.0000(Not Clear)   < succ>
             bacterial outside  --- Certainty = 0.0000(Not Clear)   < succ>
```

The protein has homology with the following sequences in the GENPEPT database.

```
>GP: AAB18706 GB: U38906 Structural protein [Bacteriophage rlt]
Identities = 57/127 (44%), Positives = 83/127 (64%)

Query:   5 IKAGTLFKPELVTEIMSKVKGHSTLAKLSGQTPIPFNGVEQFVFNLDGNAQIVGEGEQKL   64
           + GTLF P LVT+++SKV G S++A+LS Q PIPFNG + F F +D    +V E +K
Sbjct:   3 LNKGTLFDPTLVTDLISKVAGKSSIARLSAQKPIPFNGEKVFTFTMDSEIDVVAESGKKT   62
```

```
Query:   65 GNTAKVTSKIIKPLKFVYQARMTDEFKYASEEKRLNFLKHYADGFAKKMAEAFDIAAIHG 124
            +  + + P+K  Y AR++DEF YAS+E+++N L+ + DGFAKK+A    D+ A HG
Sbjct:   63 HGGVTLAPQTMVPIKVEYGARISDEFMYASDEEKINILQEFNDGFAKKVARGIDLMAFHG 122

Query:  125 LEPRTMT 131
            + PR  T
Sbjct:  123 VNPRLGT 129
```

Based on this analysis, it was predicted that this protein and its epitopes, could be useful antigens for vaccines or diagnostics.

EXAMPLE 2300

A DNA sequence (GBSx2439) was identified in *S. agalactiae* <SEQ ID 7085> which encodes the amino acid sequence <SEQ ID 7086>. This protein is predicted to be surface protein Rib. Analysis of this protein sequence reveals the following:

```
Possible site: 24
>>> Seems to have no N-terminal signal sequence

----- Final Results -----
            bacterial cytoplasm --- Certainty = 0.1892(Affirmative) < succ>
            bacterial membrane  --- Certainty = 0.0000(Not Clear)   < succ>
            bacterial outside   --- Certainty = 0.0000(Not Clear)   < succ>
```

No corresponding DNA sequence was identified in *S. pyogenes*.

Based on this analysis, it was predicted that this protein and its epitopes, could be useful antigens for vaccines or diagnostics.

EXAMPLE 2301

A DNA sequence (GBSx2440) was identified in *S. agalactiae* <SEQ ID 7087> which encodes the amino acid sequence <SEQ ID 7088>. Analysis of this protein sequence reveals the following:

```
Possible site: 39
>>> Seems to have no N-terminal signal sequence

----- Final Results -----
            bacterial cytoplasm --- Certainty = 0.2227(Affirmative) < succ>
            bacterial membrane  --- Certainty = 0.0000(Not Clear)   < succ>
            bacterial outside   --- Certainty = 0.0000(Not Clear)   < succ>
```

Based on this analysis, it was predicted that this protein and its epitopes, could be useful antigens for vaccines or diagnostics.

EXAMPLE 2302

A DNA sequence (GBSx2441) was identified in *S. agalactiae* <SEQ ID 7089> which encodes the amino acid sequence <SEQ ID 7090>. This protein is predicted to be integrase. Analysis of this protein sequence reveals the following:

```
Possible site: 37
>>> Seems to have no N-terminal signal sequence

----- Final Results -----
            bacterial cytoplasm --- Certainty = 0.2948(Affirmative) < succ>
            bacterial membrane  --- Certainty = 0.0000(Not Clear)   < succ>
            bacterial outside   --- Certainty = 0.0000(Not Clear)   < succ>
```

A related GBS nucleic acid sequence <SEQ ID 9319> which encodes amino acid sequence <SEQ ID 9320> was also identified.

The protein has homology with the following sequences in the GENPEPT database.

```
>GP: CAB96616 GB: AJ400629 integrase [Streptococcus pneumoniae
bacteriophage MM1]
Identities = 84/238 (35%), Positives = 137/238 (57%),
Gaps = 8/238 (3%)

Query:    1 MTLDKNSSQAQKKAGLILQEKIEDRLAIRNHSEMTYGELKKEYLKQWIPTVKDSTKRGYL    60
            +T+++K + QA+ +A ++LQEKI  +L+ +     +T+ E+   + K W  TVK+STK
Sbjct:   30 VTMEKKTPQARNQAAILLQEKINKKLSTKQVESITFEEIYNLFYKSWAQTVKESTKHNCK   89

Query:   61 VSDSHIATVLPDDTIINKLTKRDIRLIIDKLLKHNSYHVTHKCRKRLHAIFSYAIQMDYM  120
            D  +  V+P DTI+   L +R ++  I+K+++ N Y    K R RL  IF+YA+Q  Y+
Sbjct:   90 SVDKKMKEVIPSDTILANLDRRFLQEAIEKIIESNGYITAKKVRHRLRGIFNYAVQYSYI  149

Query:  121 TSNPTENVLVP-KPK--DDYKPEKVLYLTSNEV---YDLCNRMIDNDEQTLADIVLFMFL  174
            +N  +    +P KPK  ++ + ++   +LT  E+    D+ NR     Q   AD+VL + L
Sbjct:  150 ENNEVDYTTIPQKPKTLEELEKKRNNFLTMQEIKALVDVLNRR--EYHQKYADMVLVLTL  207

Query:  175 TGVRYGELSCLTYDKIDFENKEILINATYDFNTRXITTTKTKKSTRKISVSDNILDIV    232
              TG+RYGEL+ L    IDFEN +I I   +D   +  T   KT   S  R I VS+++++ +
Sbjct:  208 TGMRYGELTALQLKNIDFENNKIEITGNFDSVNKIKTLPKTTNSIRTIKVSESVIEAI    265
```

There is also homology to SEQ ID 578.

Based on this analysis, it was predicted that this protein and its epitopes, could be useful antigens for vaccines or diagnostics.

EXAMPLE 2303

A DNA sequence (GBSx2444) was identified in *S. agalactiae* <SEQ ID 7091> which encodes the amino acid sequence <SEQ ID 7092>. Analysis of this protein sequence reveals the following:

```
Possible site: 50
>>> Seems to have no N-terminal signal sequence

----- Final Results -----
           bacterial cytoplasm --- Certainty = 0.2518(Affirmative) < succ>
           bacterial membrane  --- Certainty = 0.0000 (Not Clear) < succ>
            bacterial outside  --- Certainty = 0.0000 (Not Clear) < succ>
```

The protein has no significant homology with any sequences in the GENPEPT database.

There is also homology to SEQ ID 4212:

```
Identities = 92/144 (63%), Positives = 118/144 (81%), Gaps = 1/144 (0%)

Query:    1 MPKYSLFELENGRRRLLASAGELQKGNELALPTQFMKFLYLASRYNESKGKPEEIEKKQE    60
            +PKYSLFELENGR+R+LASAGELQKGNELALP++++ FLYLAS Y + KG PE+ E+KQ
Sbjct: 1198 LPKYSLFELENGRKRMLASAGELQKGNELALPSKYVNFLYLASHYEKLKGSPEDNEQKQL 1257

Query:   61 FVNQHVSYFDDILQLINDFSKRVILADANLEKINKLYQDNKENISVDELANNIINLFTFT  120
            FV QH  Y D+I++  I++FSKRVILADANL+K+   Y    +++   + E A NII+LFT T
Sbjct: 1258 FVEQHKHYLDEIIEQISEFSKRVILADANLDKVLSAYNKHRDK-PIREQAENIIHLFTLT 1316

Query:  121 SLGAPAAFKFFDKIVDRKRYTSTQ                                     144
            +LGAPAAFK+FD   +DRKRYTST+
Sbjct: 1317 NLGAPAAFKYFDTTIDRKRYTSTK                                    1340
```

Based on this analysis, it was predicted that this protein and its epitopes, could be useful antigens for vaccines or diagnostics.

EXAMPLE 2304

A DNA sequence (GBSx2445) was identified in *S. agalactiae* <SEQ ID 7093> which encodes the amino acid sequence <SEQ ID 7094>. This protein is predicted to be 0. Analysis of this protein sequence reveals the following:

```
Possible site: 48
>>> Seems to have no N-terminal signal sequence
    INTEGRAL    Likelihood = -4.57    Transmembrane    239-255 (236-256)

----- Final Results -----
            bacterial membrane --- Certainty = 0.2826(Affirmative) < succ>
            bacterial outside  --- Certainty = 0.0000(Not Clear)   < succ>
            bacterial cytoplasm --- Certainty = 0.0000(Not Clear)  < succ>
```

The protein has homology with the following sequences in the GENPEPT database.

```
>GP: CAB15253 GB: Z99120 similar to opine catabolism [Bacillus subtilis]
Identities = 88/257 (34%), Positives = 129/257 (49%), Gaps = 11/257 (4%)

Query:    1 MARLGADFYSKLVTDLQKDGFETKFYQQTGVFLLKKDESQLESLFALADKRRLESPLIGD    60
            +A+ GA +Y  L+   L+KDG      Y++ G   +  D S+L+ +   A KRR ++P IGD
Sbjct:   61 LAKGGARYYKDLIHQLEKDGESDTGYKRVGAISIHTDASKLDKMEERAYKRREDAPEIGD   120

Query:   61 LQILNKSEANTHFPEL-DGYEQLLYASGGARVEGADLTRILLEAS---GVNVIKDEVHF-  115
            + L+ SE    FP L DGYE  ++ SG ARV G  L R LL A+    G  VIK
Sbjct:  121 ITRLSASETKKLFPILADGYES-VHISGAARVNGRALCRSLLSAAEKRGATVIKGNASLL  179

Query:  116 ----TITDNGFRVQGIDFDKLVLASGAWLAKILDEHNYQVDVRPQKGQLRDYYFSNINTG  171
                T+T    +  D +++ +GAW  +IL           V  QK Q+  +  ++ +TG
Sbjct:  180 FENGTVTGVQTDTKQFAADAVIVTAGAWANEILKPLGIHFQVSFQKAQIMHFEMTDADTG  239

Query:  172 KYPVVMPEGELDIIPFDNGKVSVGASHENDMAF-DLNIDFKVLDKFEEQAIGYFPQLKKQ  230
            +PVVMP   +  I+ FDNG++  GA+HEND     DL +    +A+    P L
Sbjct:  240 SWPVVMPPSDQYILSFDNGRIVAGATHENDAGLDDLRVTAGGQHEVLSKALAVAPGLADA  299

Query:  231 IRLLKRVEFVPIQVIFL                                            247
             +  RV F P    FL
Sbjct:  300 AAVETRVGFRPFTPGFL                                            316
```

There is also homology to SEQ ID 2656.

Based on this analysis, it was predicted that this protein and its epitopes, could be useful antigens for vaccines or diagnostics.

EXAMPLE 2305

A DNA sequence (GBSx2446) was identified in *S. agalactiae* <SEQ ID 7095> which encodes the amino acid sequence <SEQ ID 7096>. Analysis of this protein sequence reveals the following:

```
Possible site: 60
>>> Seems to have no N-terminal signal sequence

----- Final Results -----
            bacterial cytoplasm --- Certainty = 0.2572(Affirmative) < succ>
            bacterial membrane  --- Certainty = 0.0000(Not Clear)   < succ>
            bacterial outside   --- Certainty = 0.0000(Not Clear)   < succ>
```

A related GBS nucleic acid sequence <SEQ ID 9315> which encodes amino acid sequence <SEQ ID 9316> was also identified.

The protein has homology with the following sequences in the GENPEPT database.

```
>GP: AAC00337 GB: AF008220 YtqI [Bacillus subtilis]
Identities = 119/256 (46%), Positives = 174/256 (67%), Gaps = 3/256 (1%)

Query:    6 QILDKIKEYDTIIIHRHMRPDPDALGSQIGLRDIIRHNFPKKKVLATGFDEPTLAWIAKM   65
            +++  I  YDTII+HRH+RPDPDA GSQ GL +I+R  +P+K + A G  EP+L+++  +
Sbjct:    4 ELIRTISLYDTIILHRHVRPDPDAYGSQCGLTEILRETYPEKNIFAVGTPEPSLSFLYSL   63

Query:   66 DQVTDQDYQGALVVVTDTANTPRIDDERYKKGDFLIKIDHHPNDEVYGDLSYVDTNASSA  125
            D+V ++  Y+GALV+V DTAN  RIDD+RY  G  L+KIDHHPN++ YGDL +VDT+ASS
Sbjct:   64 DEVDNETYEGALVIVCDTANQERIDDQRYPSGAKLMKIDHHPNEDPYGDLLWVDTSASSV  123
```

```
-continued
Query:  126 SEIVTDFAL---SCDLLLSTSAARVLYNGIVGDTGRFLYPATTSKTLKIASKLREFDFDF  182
             SE++ +  L         L+T AA ++Y GIVGDTGRFL+P TT KTLK A +L ++ F
Sbjct:  124 SEMIYELYLEGKEHGWKLNTKAAELIYAGIVGDTGRFLFPNTTEKTLKYAGELIQYPFSS  183

Query:  183 SAMARQMDSFPFKIAKLQGFIFEQLKIDKNGAACVTLTQEDLKRFDVTDAETAAIVGVPG  242
             S +  Q+      + KL GFIF+ + + +NGAA V + ++ L++F  T +E + +VG  G
Sbjct:  184 SELFNQLYETKLNVVKLNGFIFQNVSLSENGAASVFIKKDTLEKFGTTASEASQLVGTLG  243

Query:  243 KIDIVESWAIFVKQSD                                             258
              I  + +W   FV++ D
Sbjct:  244 NISGIRAWVFFVEEDD                                             259
```

A related DNA sequence was identified in *S. pyogenes* <SEQ ID 7097> which encodes the amino acid sequence <SEQ ID 7098>. Analysis of this protein sequence reveals the following:

```
Possible site: 61
>>> Seems to have no N-terminal signal sequence

----- Final Results -----
              bacterial cytoplasm --- Certainty = 0.2584(Affirmative) < succ>
               bacterial membrane --- Certainty = 0.0000(Not Clear)   < succ>
                bacterial outside --- Certainty = 0.0000(Not Clear)   < succ>
```

An alignment of the GAS and GBS proteins is shown below.

```
Identities = 180/256 (70%), Positives = 215/256 (83%)

Query:    4 FQQILDKIKEYDTIIIHRHMRPDPDALGSQIGLRDIIRHNFPKKKVLATGFDEPTLAWIA   63
            F+ ILDKIK + TIIIHRH  PDPDALGSQ GL++II  NFP KKVL TGFDEP+LAWI+
Sbjct:    5 FETILDKIKAHQTIIIHRHQNPDPDALGSQAGLKEIIAQNFPDKKVLMTGFDEPSLAWIS   64

Query:   64 KMDQVTDQDYQGALVVVTDTANTPRIDDERYKKGDFLIKIDHHPNDEVYGDLSYVDTNAS  123
            +MDQVTD+DY+ ALV++TDTAN PRIDDERY  G   LIKIDHHPND+VYGD  YVDT+AS
Sbjct:   65 QMDQVTDKDYKEALVIITDTANRPRIDDERYTLGKCLIKIDHHPNDDVYGDFYYVDTSAS  124

Query:  124 SASEIVTDFALSCDLLLSTSAARVLYNGIVGDTGRFLYPATTSKTLKIASKLREFDFDFS  183
            SASEI+ DFA S +L LS   AA++LY GIVGDTGRFLY +TTSKTL IAS+LR F+FDF+
Sbjct:  125 SASEIIADFAFSQNLTLSDKAAKLLYTGIVGDTGRFLYASTTSKTLSIASQLRHFEFDFA  184

Query:  184 AMARQMDSFPFKIAKLQGFIFEQLKIDKNGAACVTLTQEDLKRFDVTDAETAAIVGVPGK  243
            A++RQMDSFP KIAELQ ++FE L ID++GAA V ++QE LK FDVT AE++AIV  PGK
Sbjct:  185 AISRQMDSFPLKIAKLQSYVFEHLTIDESGAAYVLVSQETLKHFDVTLAESSAIVCAPGK  244

Query:  244 IDIVESWAIFVKQSDG                                             259
            ID V++WAIFV+ +DG
Sbjct:  245 IDNVQAWAIFVELTDG                                             260
```

Based on this analysis, it was predicted that these proteins and their epitopes could be useful antigens for vaccines or diagnostics.

EXAMPLE 2306

A DNA sequence (GBSx2447) was identified in *S. agalactiae* <SEQ ID 7099> which encodes the amino acid sequence <SEQ ID 7100>. Analysis of this protein sequence reveals the following:

```
Possible site: 26
>>> Seems to have no N-terminal signal sequence

----- Final Results -----
              bacterial cytoplasm --- Certainty = 0.1846(Affirmative) < succ>
               bacterial membrane --- Certainty = 0.0000(Not Clear)   < succ>
                bacterial outside --- Certainty = 0.0000(Not Clear)   < succ>
```

The protein has homology with the following sequences in the GENPEPT database.

```
>GP: CAB42949 GB: AL049863 putative adenosine deaminase [Streptomyces
coelicolor A3(2)]
Identities = 123/343 (35%), Positives = 175/343 (50%),
Gaps = 26/343 (7%)

Query:     6 LKELAKAELHCHLDGSLSLPAIRKLANMADIILPSSDK-ELRKYVIAPAQTESLVDYLKT   64
             L+ L KA LH HLDG L   + +LA       LP++D EL +    A + LV Y+ T
Sbjct:    11 LRRLPKAVLHDHLDGGLRPATVVELARSVGHTLPTTDPDELAAWYYEAANSGDLVRYIAT   70

Query:    65 FEFIRPLLQTKEALRFAAYDVARQAALENVIYIEIRFAPELSMDKGLTASDTVLAVLEGL  124
             FE  ++Q +E L  AA +     A + V+Y E+R+APEL+   GL+  + V  V EGL
Sbjct:    71 FEHTLAVMQNREGLLRAAEEYVLDLAADGVVYGEVRYAPELNTRGGLSMREVVETVQEGL  130

Query:   125 ADAQKEFNIVAR-----ALVCGMRQSSHKTTKDIIKHIVDLA----PKGLVGFDFAGDEF  175
             A   +              L+CGMR        D ++   DLA     G+VGFD AG E
Sbjct:   131 ATGMAKAAAAGTPVRVGTLLCGMRMF------DRVREAADLAVAFRDAGVVGFDIAGAED  184

Query:   176 SYPTDSLVDLIQEVKRSGYPMTLHAGECGCAKHIADSLNL-GIKRMGHVTALT-------  227
             +P  +D + ++R    P T+HAGE       I  +L + G +R+GH    +T
Sbjct:   185 GFPPADHLDAFEHLRRENVPFTIHAGEAHGLPSIHQALQVCGAQRIGHGVRITDDIPDLA  244

Query:   228 -GQRDLIKRFVEEDAVA-EMCLTSNLQTKAASSIQSFPYQELYDAGGKITINTDNRTVSD  285
              G+   +  +V +   +A EMC TSNLQT AA+SI    P   L D G ++T+NTDNR VS
Sbjct:   245 AGKLGRLAAWVRDRRIALEMCPTSNLQTGAATSIAEHPITALKDLGFRVTLNTDNRLVSG  304

Query:   286 TNLTKEYSLFVTYFGTKIEDFLVFNQNAVKASFTSDSEKDTLL                  328
             T +T+E SL V   G   +ED          NA+K++F   E+  L+
Sbjct:   305 TTMTREMSLLVEQAGWSVEDLRTVTVNALKSAFVPFDERTALI                  347
```

No corresponding DNA sequence was identified in *S. pyogenes*.

Based on this analysis, it was predicted that this protein and its epitopes, could be useful antigens for vaccines or diagnostics.

EXAMPLE 2307

A DNA sequence (GBSx2448) was identified in *S. agalactiae* <SEQ ID 7101> which encodes the amino acid sequence <SEQ ID 7102>. Analysis of this protein sequence reveals the following:

```
Possible site: 18
>>> Seems to have no N-terminal signal sequence

----- Final Results -----
           bacterial cytoplasm --- Certainty = 0.2042(Affirmative) < succ>
           bacterial membrane  --- Certainty = 0.0000(Not Clear)   < succ>
            bacterial outside  --- Certainty = 0.0000(Not Clear)   < succ>
```

A related GBS nucleic acid sequence <SEQ ID 9639> which encodes amino acid sequence <SEQ ID 9640> was also identified.

The protein has homology with the following sequences in the GENPEPT database.

```
>GP: CAB13290 GB: Z99111 similar to
sulfite reductase [Bacillus subtilis]
Identities = 63/146 (43%), Positives = 87/146 (59%),
Gaps = 1/146 (0%)

Query:     5 MALAKIVYASMTGNTEEIADIVADKLRDLGLDVEVEECTMVDAAD-FEDADIAIVATYTY   63
             MA   +VYA+M+GNTE +AD++    L++   +V+ E  +D A  F D D  I+ TYT+
Sbjct:     1 MAKILLVYATMSGNTEAMADLIEKGLQEALAEVDRFEAMDIDDAQLFTDYDHVIMGTYTW   60

Query:    64 GDGDLPDEIVDFYEDLAEVDLSGKVYGVVGSGDTFYDYFCKSVDEFEAQFALTGAQKGAD  123
             GDGDLPDE +D  ED+ E+D SGK   V GSGDT Y++FC  +VD EA+       G
Sbjct:    61 GDGDLPDEFLDLVEDMEEIDFSGKTCAVFGSGDTAYEFFCGAVDTLEAKIKERGGDIVLP  120

Query:   124 CVKVDLAAEDEDIENLEAFAEEIASK                                   149
             VK++    E E+ E L  F  + A K
Sbjct:   121 SVKIENNPEGEEEEELINFGRQFAKK                                   146
```

A related DNA sequence was identified in *S. pyogenes* <SEQ ID 7103> which encodes the amino acid sequence <SEQ ID 7104>. Analysis of this protein sequence reveals the following:

```
Possible site: 14
>>> Seems to have no N-terminal signal sequence

----- Final Results -----
            bacterial cytoplasm --- Certainty = 0.1641(Affirmative) < succ>
            bacterial membrane  --- Certainty = 0.0000(Not Clear)   < succ>
             bacterial outside  --- Certainty = 0.0000(Not Clear)   < succ>
```

An alignment of the GAS and GBS proteins is shown below.

```
Identities = 116/147 (78%), Positives = 136/147 (91%)

Query:    5 MALAKIVYASMTGNTEEIADIVADKLRDLGLDVEVEECTMVDAADFEDADIAIVATYTYG   64
            MALAKIVYASMTGNTEEIADIVA+KL++LG DV+++ECT VDA++FE+ADIA+VATYTYG
Sbjct:    1 MALAKIVYASMTGNTEEIADIVANKLQELGHDVDIDECTTVDASEFENADIAVVATYTYG   60

Query:   65 DGDLPDEIVDFYEDLAEVDLSGKVYGVVGSGDTFYDYFCKSVDEFEAQFALTGAQKGADC  124
            DGDLPDEIVDFYEDL ++DL GK+YGVVGSGDTFYDYFCKSVD+F  QFALTGA KGA+
Sbjct:   61 DGDLPDEIVDFYEDLQDLDLEGKIYGVVGSGDTFYDYFCKSVDDFSEQFALTGAIKGAEP  120

Query:  125 VKVDLAAEDEDIENLEAFAEEIASKLN                                  151
            VKVDLAAEDEDI+ LEAFAE+++  +N
Sbjct:  121 VKVDLAAEDEDIDRLEAFAEQLSQAVN                                  147
```

Based on this analysis, it was predicted that these proteins and their epitopes could be useful antigens for vaccines or diagnostics.

EXAMPLE 2308

A DNA sequence (GBSx2449) was identified in *S. agalactiae* <SEQ ID 7105> which encodes the amino acid sequence <SEQ ID 7106>. Analysis of this protein sequence reveals the following:

```
Possible site: 33
>>> Seems to have no N-terminal signal sequence

----- Final Results -----
            bacterial cytoplasm --- Certainty = 0.3568(Affirmative) < succ>
            bacterial membrane  --- Certainty = 0.0000(Not Clear)   < succ>
             bacterial outside  --- Certainty = 0.0000(Not Clear)   < succ>
```

The protein has homology with the following sequences in the GENPEPT database.

```
>GP:AAB98234 GB:U67480 chorismate mutase/prephenate dehydratase
(pheA) [Methanococcus jannaschii]
Identities = 26/85 (30%), Positives = 46/85 (53%), Gaps = 1/85 (1%)

Query:    2 ELEEIRQEIDEIDQQLVSLLETRMGLILEVIAFKKKHRLPVLDMNRENEVLNNVLKKVQN   61
            +L EIR++IDEID +++L+  R  L  +V    K +  +P+ D   RE  + + K  +
Sbjct:    4 KLAEIRKKIDEIDNKILKLIAERNSLAKDVAEIKNQLGIPINDPEREKYIYDRIRKLCKE   63

Query:   62 HQFDDVIRATFKDIMTE-SRVYQKE                                     85
            H  D+ I    I+ E ++  QK+
Sbjct:   64 HNVDENIGIKIFQILIEHNRALQKQ                                     88
```

There is also homology to SEQ ID 1568.

Based on this analysis, it was predicted that this protein and its epitopes, could be useful antigens for vaccines or diagnostics.

EXAMPLE 2309

A DNA sequence (GBSx2450) was identified in *S. agalactiae* <SEQ ID 7107> which encodes the amino acid sequence <SEQ ID 7108>. This protein is predicted to be a minor structural protein. Analysis of this protein sequence reveals the following:

```
Possible site: 23
>>> Seems to have no N-terminal signal sequence

----- Final Results -----
            bacterial cytoplasm --- Certainty = 0.1828(Affirmative) < succ>
             bacterial membrane --- Certainty = 0.0000(Not Clear)   < succ>
              bacterial outside --- Certainty = 0.0000(Not Clear)   < succ>
```

The protein has homology with the following sequences in the GENPEPT database.

```
>GP:AAC34413 GB:AF158600 putative minor structural protein
[Streptococcus thermophilus bacteriophage Sfi11]
Identities = 39/65 (60%), Positives = 54/65 (83%)

Query:   1 MEVETDSQEVLMSTGLKDLKAHAYPAITYEVDGYVDLELGDVVRIQDDGYEPPLILTARV    60
           ME++TDS++VL+ST L++L+    YPAITYEVDG++DL++GD V+IQD G+ P L+L ARV
Sbjct: 707 MEIDTDSEDVLISTALRNLRKFCYPAITYEVDGFLDLDIGDTVKIQDTGFSPMLMLEARV   766

Query:  61 VEQDI                                                         65
           EQ I
Sbjct: 767 SEQQI                                                        771
```

No corresponding DNA sequence was identified in *S. pyogenes*.

Based on this analysis, it was predicted that this protein and its epitopes, could be useful antigens for vaccines or diagnostics.

EXAMPLE 2310

A DNA sequence (GBSx2451) was identified in *S. agalactiae* <SEQ ID 7109> which encodes the amino acid sequence <SEQ ID 7110>. This protein is predicted to be phosphomethylpyrimidine kinase (thiD). Analysis of this protein sequence reveals the following:

```
Possible site: 45
>>> Seems to have no N-terminal signal sequence

----- Final Results -----
            bacterial cytoplasm --- Certainty = 0.2051(Affirmative) < succ>
             bacterial membrane --- Certainty = 0.0000(Not Clear)   < succ>
              bacterial outside --- Certainty = 0.0000(Not Clear)   < succ>
```

The protein has homology with the following sequences in the GENPEPT database.

```
>GP:AAC22074 GB:U32725 phosphomethylpyrimidine kinase (thiD)
[Haemophiius influenzae Rd]
Identities = 29/78 (37%), Positives = 48/78 (61%), Gaps = 2/78 (2%)

Query:   4 RNVLAISGNDIFSGGGLHADLATYVVNKLHGFVAVTCLTANSDKG-FEVIPIEASILKQQ   62
           + VL I+G+D  G G+ ADL T+ +  + G  A+T +TA +  G F++ PI     ++ Q
Sbjct:   5 KQVLTIAGSDSGGGAGIQADLKTFQMRGVFGTSAITAVTAQNTLGVFDIHPIPLKTIQAQ   64

Query:  63 LESLK-DVEFGSIKLGLL                                            79
           LE++K D +  S K+G+L
Sbjct:  65 LEAVKNDFQIASCKIGML                                            82
```

There is also homology to SEQ ID 4408.

Based on this analysis, it was predicted that this protein and its epitopes, could be useful antigens for vaccines or diagnostics.

EXAMPLE 2311

A DNA sequence (GBSx2452) was identified in *S. agalactiae* <SEQ ID 7111> which encodes the amino acid sequence <SEQ ID 7112>. Analysis of this protein sequence reveals the following:

```
Possible site: 57
>>> Seems to have no N-terminal signal sequence
INTEGRAL Likelihood = -7.43 Transmembrane 109-125 ( 102-129)
INTEGRAL Likelihood = -1.28 Transmembrane  84-100 ( 84-100)

----- Final Results -----
            bacterial membrane --- Certainty = 0.3972(Affirmative) < succ>
              bacterial outside --- Certainty = 0.0000(Not Clear)   < succ>
            bacterial cytoplasm --- Certainty = 0.0000(Not Clear)   < succ>
```

The protein has homology with the following sequences in the GENPEPT database.

```
>GP:CAA22372 GB:AL034446 putative transmembrane protein
[Streptomyces coelicolor A3(2)]
Identities = 25/93 (26%), Positives = 43/93 (45%), Gaps = 1/93 (1%)

Query:   62 SASVEILCRGWLLPVSATKYSKIVSVSISSIFFGLLHSANNNVSLISIFNLCL-FGLFLS   120
            +A+ E++ RG L +       +++ ++ + FGL+H N   +L      + + G  L+
Sbjct:  143 AATEEVVFRGVLFRIIEENIGTYLALGLTGLVFGLMHLLNEDATLWGALAIAIEAGFMLA   202

Query:  121 LYVILKGNIWACGIHGAWNCVQGSVFGIEVSG                              153
                N+W    G+H   WN    G VF   VSG
Sbjct:  203 AAYAATRNLWLTIGVHFGWNFAAGGVFSTVVSG                              235
```

No corresponding DNA sequence was identified in *S. pyogenes*.

Based on this analysis, it was predicted that this protein and its epitopes, could be useful antigens for vaccines or diagnostics.

EXAMPLE 2312

A DNA sequence (GBSx2453) was identified in *S. agalactiae* <SEQ ID 7113> which encodes the amino acid sequence <SEQ ID 7114>. This protein is predicted to be pppL protein. Analysis of this protein sequence reveals the following:

```
Possible site: 45
>>> Seems to have no N-terminal signal sequence

----- Final Results -----
            bacterial cytoplasm --- Certainty = 0.5796(Affirmative) < succ>
             bacterial membrane --- Certainty = 0.0000(Not Clear)   < succ>
              bacterial outside --- Certainty = 0.0000(Not Clear)   < succ>
```

The protein has homology with the following sequences in the GENPEPT database.

```
>GP:CAA10712 GB:AJ132604 pppL protein [Lactococcus lactis]
Identities = 38/64 (59%), Positives = 51/64 (79%)

Query:    1 MEISLLTDIGQRRSNNQDFINQFENKAGVPLIILADGMGGHRAGNIASEMTVTDLGSDWA    60
            ME S+L+DIG +RS NQD++  + N+AG  L +LADGMGGH+AGN+AS++TV DLG  W+
Sbjct:    1 MEYSILSDIGSKRSTNQDYVGTYVNRAGYQLFLLADGMGGHKAGNVASKLTVEDLGKLWS    60

Query:   61 ETDF                                                          64
            ET F
Sbjct:   61 ETFF                                                          64
```

There is also homology to SEQ ID 3022:

```
Identities = 58/74 (78%), Positives = 69/74 (92%)

Query:    1 MEISLLTDIGQRRSNNQDFINQFENKAGVPLIILADGMGGHRAGNIASEMTVTDLGSDWA    60
            M+ISL TDIGQ+RSNNQDFIN+F+NK G+ L+ILADGMGGHRAGNIASEMTVTDLG +W
Sbjct:    1 MKISLKTDIGQKRSNNQDFINKFDNKKGITLVILADGMGGHRAGNIASEMTVTDLGREWV    60

Query:   61 ETDFSELSEIRDWM                                                74
            +TDF+ELS+IRDW+
Sbjct:   61 KTDFTELSQIRDWL                                                74
```

Based on this analysis, it was predicted that this protein and its epitopes, could be useful antigens for vaccines or diagnostics.

EXAMPLE 2313

A DNA sequence (GBSx2454) was identified in *S. agalactiae* <SEQ ID 7115> which encodes the amino acid sequence <SEQ ID 7116>. This protein is predicted to be sunL protein. Analysis of this protein sequence reveals the following:

```
Possible site: 25
>>> Seems to have no N-terminal signal sequence

----- Final Results -----
            bacterial cytoplasm --- Certainty = 0.1631(Affirmative) < succ>
             bacterial membrane --- Certainty = 0.0000(Not Clear) < succ>
              bacterial outside --- Certainty = 0.0000(Not Clear) < succ>
```

The protein has homology with the following sequences in the GENPEPT database.

```
>GP: CAA10711 GB: AJ132604 sunL protein [Lactococcus lactis]
Identities = 48/81 (59%), Positives = 67/81 (82%)

Query:   1 MSILSSVCQTLRKGGIITYSTCTIFEEENFQVIEKFLENHPNFEQVELSHTQEDIVKRGC   60
           + IL+S  ++L+K GI+ YSTCTIF+EENF V+ +FLENHPNFEQVE+S+ + +++K GC
Sbjct: 342 LEILNSASKSLKKSGIMVYSTCTIFDEENFDVVHEFLENHPNFEQVEISNEKPEVIKEGC  401

Query:  61 ISISPEQYHTDGFFIGQVKRI   81
           + I+PE YHTDGFFI + K+I
Sbjct: 402 LFITPEMYHTDGFFIAKFKKI  422
```

There is also homology to SEQ ID 3018:

```
Identities = 64/82 (78%), Positives = 74/82 (90%)

Query:   1 MSILSSVCQTLRKGGIITYSTCTIFEEENFQVIEKFLENHPNFEQVELSHTQEDIVKRGC   60
           + ILSSVCQTLRKGGIITYSTCTIF+EEN QVIE FL++HPNFEQV+L+HTQ DIVK G
Sbjct: 359 LEILSSVCQTLRKGGIITYSTCTIFDEENRQVIEAFLQSHPNFEQVKLNHTQADIVKDGY  418

Query:  61 ISISPEQYHTDGFFIGQVKRIL   82
           + I+PEQY TDGFFIGQV+R+L
Sbjct: 419 LIITPEQYQTDGFFIGQVRRVL  440
```

Based on this analysis, it was predicted that this protein and its epitopes, could be useful antigens for vaccines or diagnostics.

EXAMPLE 2314

A DNA sequence (GBSx2455) was identified in *S. agalactiae* <SEQ ID 7117> which encodes the amino acid sequence <SEQ ID 7118>. This protein is predicted to be PTS permease for mannose subunit IIPMan. Analysis of this protein sequence reveals the following:

```
Possible site: 53
>>> Seems to have no N-terminal signal sequence
     INTEGRAL     Likelihood = -9.18    Transmembrane     32-48 (30-58)
     INTEGRAL     Likelihood = -8.07    Transmembrane   127-143 (122-146)
     INTEGRAL     Likelihood = -2.07    Transmembrane     56-72 (56-72)
     INTEGRAL     Likelihood = -1.44    Transmembrane    87-103 (86-103)
     INTEGRAL     Likelihood = -0.53    Transmembrane   105-121 (105-121)

----- Final Results -----
             bacterial membrane --- Certainty = 0.4673(Affirmative) < succ>
              bacterial outside --- Certainty = 0.0000(Not Clear) < succ>
            bacterial cytoplasm --- Certainty = 0.0000(Not Clear) < succ>
```

The protein has homology with the following sequences in the GENPEPT database.

```
>GP: AAF81084 GB: AF228498 AgaW [Escherichia coli]
Identities = 38/122 (31%), Positives = 68/122 (55%), Gaps = 7/122 (5%)

Query:   25 KVPETKSIIRLTALAFLVCSILVVELVSMRELISSISFIGILVGSGPVNSFVHHIPQNLM   84
            ++P T  + L A +L         L+++      +F+ I  G+     + + +PQ L+
Sbjct:  126 RMPRTPILAALNACNYLA-------LLALGNFYFLCAFLPIYFGAEHAKTIIDVLPQRLI  178

Query:   85 NGLSAAGGLLPAVGFAMLMKLLWTNKLAVFYLLGFVLTAYLKLPAVAVAALGAVICVISS  144
            +GL  AGG++PA+GFA+L+K++  N   +++LGFV  A+LKLP +A+A       + +I
Sbjct:  179 DGLGVAGGIMPAIGFAVLLKIMMKNVYIPYFILGFVAAAWLKLPVLAIACPALAMALIDL  238

Query:  145 QR  146
            R
Sbjct:  239 LR  240
```

There is also homology to SEQ ID 1636:

```
Identities = 104/109 (95%), Positives = 108/109 (98%)

Query:   56 LISSISFIGILVGSGPVNSFVHHIPQNLMNGLSAAGGLLPAVGFAMLMKLLWTNKLAVFY  115
            +I+SISFIGILVGSGPVN+FV HIPQNLMNGLSAAGGLLPAVGFAMLMKLLWTNKLAVFY
Sbjct:  149 IIASISFIGILVGSGPVNAFVEHIPQNLMNGLSAAGGLLPAVGFAMLMKLLWTNKLAVFY  208

Query:  116 LLGFVLTAYLKLPAVAVAALGAVICVISSQRDIELDAITRGAISKQTTF  164
            LLGFVLTAYLKLPAVAVAALGAVICVISSQRD+ELDAITRGAISKQTTF
Sbjct:  209 LLGFVLTAYLKLPAVAVAALGAVICVISSQRDLELDAITRGAISKQTTF  257
```

Based on this analysis, it was predicted that this protein and its epitopes, could be useful antigens for vaccines or diagnostics.

EXAMPLE 2315

A DNA sequence (GBSx2456) was identified in *S. agalactiae* <SEQ ID 7119> which encodes the amino acid sequence <SEQ ID 7120>. Analysis of this protein sequence reveals the following:

```
Possible site: 50
>>> Seems to have a cleavable N-term signal seq.
    INTEGRAL    Likelihood = -8.12    Transmembrane   121-137 (118-144)
    INTEGRAL    Likelihood = -5.52    Transmembrane    91-107 (89-111)
    INTEGRAL    Likelihood = -5.20    Transmembrane   166-182 (162-192)

----- Final Results -----
          bacterial membrane --- Certainty = 0.4248(Affirmative) < succ>
           bacterial outside --- Certainty = 0.0000(Not Clear)   < succ>
         bacterial cytoplasm --- Certainty = 0.0000(Not Clear)   < succ>
```

The protein has homology with the following sequences in the GENPEPT database.

```
>GP: CAB15963 GB: Z99124 phosphotransferase system (PTS)
beta-glucoside-specific enzyme IIABC component [Bacillus subtilis]
Identities = 76/201 (37%), Positives = 122/201 (59%), Gaps = 3/201 (1%)

Query:    1 MIKALLALLLVFKILTPSSQTYILLNLFADGVFYFLPILIAITAAQKLKANPILALGTVV   60
            MIK L+AL + F  +    SQ +++L    DG FYFLP+L+A++AA+K  +NP +A
Sbjct:  121 MIKGLVALAVTFGWMAEKSQVHVILTAVGDGAFYFLPLLLAMSAARKFGSNPYVAAAIAA  180

Query:   61 MLLHPNWANLVASGKPVSLFHTIPFTLTNYASSVIPIILIICVQAYIEKYLKQIIPKSLR  120
            +LHP+    L+  +GKP+S F   +P T   Y+S+VIPI+L I  +Y+EK++  +    SL+
Sbjct:  181 AILHPDLTALLGAGKPIS-FIGLPVTAATYSSTVIPILLSIWIASYVEKWIDRFTHASLK  239

Query:  121 LVLVPMLIFLSMGILSFSILGPMGTIAGQYLAVIFTFLSKYASW-APAFLVGAFAPILIM  179
            L++VP    L +  L+   +   +GP+G I G+YL+    +L  +A   A  FL G F+ ++IM
Sbjct:  240 LIVVPTFTLLIVVPLTLITVGPLGAILGEYLSSGVNYLFDHAGLVAMIFLAGTFS-LIIM  298
```

```
Query:  180 FGVHSGIAALGITQLAKLGVD                                          200
            G+H     + I  +A+ G D
Sbjct:  299 TGMHYAFVPIMINNIAQNGHD                                          319
```

There is also homology to SEQ ID 2884.

Based on this analysis, it was predicted that this protein and its epitopes, could be useful antigens for vaccines or diagnostics.

EXAMPLE 2316

A DNA sequence (GBSx2457) was identified in *S. agalactiae* <SEQ ID 7121> which encodes the amino acid sequence <SEQ ID 7122>. This protein is predicted to be glucose kinase. Analysis of this protein sequence reveals the following:

```
Possible site: 54
>>> Seems to have no N-terminal signal sequence

----- Final Results -----
            bacterial cytoplasm --- Certainty = 0.1180(Affirmative) < succ>
             bacterial membrane --- Certainty = 0.0000(Not Clear)   < succ>
               bacterial outside --- Certainty = 0.0000(Not Clear)   < succ>
```

The protein has homology with the following sequences in the GENPEPT database.

```
>GP: CAB14416 GB: Z99116 glucose kinase [Bacillus subtilis]
Identities = 32/57 (56%), Positives = 41/57 (71%)

Query:    1 MVIGGGVSAAGEFLRSRVEKYFVTFAFPQVKKSTKIKIAELGNDAGIIGAASLANQQ   57
            +V+GGGVS AGE LRS+VEK F   AFP+  ++   I IA LGNDAG+IG A +A  +
Sbjct:  258 IVLGGGVSRAGELLRSKVEKTFRKCAFPRAAQAADISIAALGNDAGVIGGAWIAKNE  314
```

There is also homology to SEQ ID 198. An alignment of the GAS and GBS proteins is shown below:

```
Identities = 50/56 (89%), Positives = 53/56 (94%)

Query:    1 MVIGGGVSAAGEFLRSRVEKYFVTFAFPQVKKSTKIKIAELGNDAGIIGAASLANQ    56
            +VIGGGVSAAGEFLRSR+EKYFVTF FPQV+ STKIKIAELGNDAGIIGAASLA Q
Sbjct:  264 VVIGGGVSAAGEFLRSRIEKYFVTFTFPQVRYSTKIKIAELGNDAGIIGAASLARQ  319
```

Based on this analysis, it was predicted that these proteins and their epitopes could be useful antigens for vaccines or diagnostics.

EXAMPLE 2317

A DNA sequence (GBSx2458) was identified in *S. agalactiae* <SEQ ID 7123> which encodes the amino acid sequence <SEQ ID 7124>. Analysis of this protein sequence reveals the following:

```
Possible site: 19
>>> Seems to have a cleavable N-term signal seq.

----- Final Results -----
              bacterial outside --- Certainty = 0.3000(Affirmative) < succ>
             bacterial membrane --- Certainty = 0.0000(Not Clear)   < succ>
            bacterial cytoplasm --- Certainty = 0.0000(Not Clear)   < succ>
```

The protein has homology with the following sequences in the GENPEPT database.

```
>GP: CAB14385 GB: Z99116 similar to hypothetical proteins [Bacillus subti-
lis]
Identities = 37/86 (43%), Positives = 51/86 (59%)

Query:   3 MSVILIIVILLAFVAWASWNYWRVRRAAKFLDNESFQKEMSRGQLIDIREAGAFHRKHIL   62
           MS +++++I AF+ +    +Y  +R  K L  E F+    + QLID+RE   F    HIL
Sbjct:   1 MSNMIVLIIFPAFIIYMIASYVYQQRIMKTLTEEEFRAGYRKAQLIDVREPNEFEGGHIL   60

Query:  63 GARNIPASQFKVALSALRKDKPVLLY                                    88
           GARNIP SQ K    + +R DKPV LY
Sbjct:  61 GARNIPLSQLKQRKNEIRTDKPVYLY                                    86
```

There is also homology to SEQ ID 202. An alignment of the GAS and GBS proteins is shown below:

```
Identities = 51/108 (47%), Positives = 70/108 (64%)

Query:   1 MDMSVILIIVILLAFVAWASWNYWRVRRAAKFLDNESFQKEMSRGQLIDIREAGAFHRKH   60
           M   +++ ++L+ V + +WNY+  R+ AK +DNE+F+  M +GQLID+RE   AF   KH
Sbjct:   1 MSPITLILWLLLVGIVGYYTWNYFSFRKMAKQVDNETFKDVMRQGQLIDLREPAAFRTKH   60

Query:  61 ILGARNIPASQFKVALSALRKDKPVLLYDASRGQSIPRIVLLLRKERF             108
           ILGARN PA QF A+   LRKDKPVL+Y+  R Q    V L+K  F
Sbjct:  61 ILGARNFPAQQFDAAIKGLRKDKPVLIYENMRPQYRVPAVKKLKKAGF             108
```

Based on this analysis, it was predicted that these proteins and their epitopes could be useful antigens for vaccines or diagnostics.

EXAMPLE 2318

A DNA sequence (GBSx2459) was identified in *S. agalactiae* <SEQ ID 7125> which encodes the amino acid sequence <SEQ ID 7126>. This protein is predicted to be surface protein Rib. Analysis of this protein sequence reveals the following:

```
Possible site: 24
<<< Seems to have no N-terminal signal sequence

----- Final Results -----
            bacterial cytoplasm --- Certainty = 0.1892(Affirmative) < succ>
            bacterial membrane  --- Certainty = 0.0000(Not Clear)   < succ>
             bacterial outside  --- Certainty = 0.0000(Not Clear)   < succ>
```

No corresponding DNA sequence was identified in *S. pyogenes*.

Based on this analysis, it was predicted that this protein and its epitopes, could be useful antigens for vaccines or diagnostics.

EXAMPLE 2319

A DNA sequence (GBSx2460) was identified in *S. agalactiae* <SEQ ID 7127> which encodes the amino acid sequence <SEQ ID 7128>. Analysis of this protein sequence reveals the following:

```
Possible site: 18
>>> Seems to have no N-terminal signal sequence

----- Final Results -----
            bacterial cytoplasm --- Certainty = 0.3522(Affirmative) < succ>
            bacterial membrane  --- Certainty = 0.0000(Not Clear)   < succ>
             bacterial outside  --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 2320

A DNA sequence (GBSx2461) was identified in *S. agalactiae* <SEQ ID 7129> which encodes the amino acid sequence <SEQ ID 7130>. Analysis of this protein sequence reveals the following:

```
Possible site: 25
>>> Seems to have no N-terminal signal sequence

----- Final Results -----
            bacterial cytoplasm --- Certainty = 0.2770(Affirmative) < succ>
             bacterial membrane --- Certainty = 0.0000(Not Clear)   < succ>
              bacterial outside --- Certainty = 0.0000(Not Clear)   < succ>
```

The protein has homology with the following sequences in the GENPEPT database.

```
>GP: AAB18708 GB: U38906 ORF33 [Bacteriophage r1t]
Identities = 56/85 (65%), Positives = 66/85 (76%), Gaps = 1/85 (1%)

Query:  1 MTNFATTDDVILLWRQLSVDEIKRAEALLETVSDTLRLEASKVGKNLDEMILETP-YFAT  59
          M  FAT DD+ +LWR L  DE +RAE LLE VSD+LR EA KVG++L  MI E P YFA+
Sbjct:  1 MNPFATVDDLTMLWRPLKGDEKERAEKLLEIVSDSLREEADKVGRDLYAMIAEKPSYFAS  60

Query: 60 VLKSVTVDIVARTLMTATQGEPMSQ  84
          V+KSVTVDIVARTLMT+T  EPM+Q
Sbjct: 61 VVKSVTVDIVARTLMTSTDQEPMTQ  85
```

There is also homology to SEQ ID 1432.

Based on this analysis, it was predicted that this protein and its epitopes, could be useful antigens for vaccines or diagnostics.

EXAMPLE 2321

A DNA sequence (GBSx2462) was identified in *S. agalactiae* <SEQ ID 7131> which encodes the amino acid sequence <SEQ ID 7132>. This protein is predicted to be regulatory protein TypA (typA). Analysis of this protein sequence reveals the following:

```
Possible site: 41
>>> Seems to have no N-terminal signal sequence

----- Final Results -----
            bacterial cytoplasm --- Certainty = 0.2238(Affirmative) < succ>
             bacterial membrane --- Certainty = 0.0000(Not Clear)   < succ>
              bacterial outside --- Certainty = 0.0000(Not Clear)   < succ>
```

The protein has homology with the following sequences in the GENPEPT database.

```
>GP: BAB06351 GB: AP001516 GTP-binding protein TypA/BipA (tyrosine
phosphorylated protein A) [Bacillus halodurans]
Identities = 175/237 (73%), Positives = 204/237 (85%), Gaps = 1/237 (0%)

Query:   1 MEDIFVGETVTPTDAIEPLPVLRIDEPTLQMTFLVNNSPFAGREGKWITSRKVEERLLAE   60
           ME+I VGETV P D  +PLP+LRIDEPTLQMTFLVNNSPFAGREGK +TSRK+EERL AE
Sbjct: 281 MEEINVGETVCPVDHQDPLPILRIDEPTLQMTFLVNNSPFAGREGKHVTSRKLEERLRAE  340

Query:  61 LQTDVSLRVDPTDSPDKWTVSGRGELHLSILIETMRREGYELQVSRPEVIIKEIDGVQCE  120
           L+TDVSLRV+ TDSPD W VSGRGELHLSILIE MRREGYELQVS+PEVII+EIDGVQCE
Sbjct: 341 LETDVSLRVENTDSPDMWVVSGRGELHLSILIENMRREGYELQVSKPEVIIREIDGVQCE  400

Query: 121 PFERVQIDTPEEYQGAIIQSLSERKGDMLDMQMVGNGQTRLIFLIPARGLIGYSTEFLSM  180
           P ERVQID PEEY GA+++SL ERKG ML+M   G+GQ RL F++PARGLIGY+TEFLS
Sbjct: 401 PVERVQIDVPEEYTGAVMESLGERKGEMLNMTNTGSGQVRLEFMVPARGLIGYTTEFLSQ  460

Query: 181 TRGYGIMNHTFDQYLPVVQGEIGGRHRGALVSIENGKATTYSIMRIEERGNLSFVNP     237
           TRGYGI+NH+FD Y PV  G++GGR +G LVS+E GKAT Y I+++E+RG + FV P
Sbjct: 461 TRGYGIINHSFDSYQPVTPGQVGGRRQGVLVSMETGKATQYGIIQVEDRGTI-FVEP     516
```

There is also homology to SEQ ID 206. An alignment of the GAS and GBS proteins is shown below:

```
Identities = 228/237 (96%), Positives = 233/237 (98%), Gaps = 1/237 (0%)

Query:  1 MEDIFVGETVTPTDAIEPLPVLRIDEPTLQMTFLVNNSPFAGREGKWITSRKVEERLLAE  60
          MEDIFVGET+TPTD +E LP+LRIDEPTLQMTFLVNNSPFAGREGKWITSRKVEERLLAE
```

-continued

```
Sbjct: 284 MEDIFVGETITPTDCVEALPILRIDEPTLQMTFLVNNSPFAGREGKWITSRKVEERLLAE  343

Query:  61 LQTDVSLRVDPTDSPDKWTVSGRGELHLSILIETMRREGYELQVSRPEVIIKEIDGVQCE   120
            LQTDVSLRVDPTDSPDKWTVSGRGELHLSILIETMRREGYELQVSRPEVIIKEIDGV+CE
Sbjct: 344 LQTDVSLRVDPTDSPDKWTVSGRGELHLSILIETMRREGYELQVSRPEVIIKEIDGVKCE   403

Query: 121 PFERVQIDTPEEYQGAIIQSLSERKGDMLDMQMVGNGQTRLIFLIPARGLIGYSTEFLSM   180
            PFERVQIDTPEEYQGAIIQSLSERKGDMLDMQMVGNGQTRLIFLIPARGLIGYSTEFLSM
Sbjct: 404 PFERVQIDTPEEYQGAIIQSLSERKGDMLDMQMVGNGQTRLIFLIPARGLIGYSTEFLSM   463

Query: 181 TRGYGIMNHTFDQYLPVVQGEIGGRHRGALVSIENGKATTYSIMRIEERGNLSFVNP       237
            TRGYGIMNHTFDQYLPVVQGEIGGRHRGALVSIENGKATTYSIMRIEERG + FVNP
Sbjct: 464 TRGYGIMNHTFDQYLPVVQGEIGGRHRGALVSIENGKATTYSIMRIEERGTI-FVNP      519
```

Based on this analysis, it was predicted that these proteins and their epitopes could be useful antigens for vaccines or diagnostics.

EXAMPLE 2322

A DNA sequence (GBSx2464) was identified in *S. agalactiae* <SEQ ID 7133> which encodes the amino acid sequence <SEQ ID 7134>. This protein is predicted to be pseudouridine synthase family 1 protein (rluB). Analysis of this protein sequence reveals the following:

```
Possible site: 34
>>> Seems to have no N-terminal signal sequence

----- Final Results -----
              bacterial cytoplasm --- Certainty = 0.1950(Affirmative) < succ>
              bacterial membrane  --- Certainty = 0.0000(Not Clear)   < succ>
               bacterial outside  --- Certainty = 0.0000(Not Clear)   < succ>
```

The protein has homology with the following sequences in the GENPEPT database.

```
>GP: CAB14248 GB: Z99116 similar to hypothetical proteins [Bacillus subti-
lis]
Identities = 59/105 (56%), Positives = 85/105 (80%)

Query:   5 VKERIYPVGRLDWDTTGLLILTNDGDFTDKMIHPRNEIDKVYLARVKGIATKENLRPLTR   64
           + +RIYP+GRLD+DT+GLL+LTNDG+F +K++HP+ EIDK Y+A+VKGI   KE LR L R
Sbjct:  91 IPQRIYPIGRLDYDTSGLLLLTNDGEFANKLMHPKYEIDKTYVAKVKGIPPKELLRKLER  150

Query:  65 GVVIDGKKTKPARYTIIKVDHEKNRSVVELTIHEGRNHQVKKMFE                109
           G+ ++  KT PA+  ++ +D +K  S+++LTIHEGRN QV++MFE
Sbjct: 151 GIRLEEGKTAPAKAKLLSLDKKKQTSIIQLTIHEGRNRQVRRMFE                195
```

There is also homology to SEQ ID 4728:

```
Identities = 96/109 (88%), Positives = 106/109 (97%)

Query:   1 MLPQVKERIYPVGRLDWDTTGLLILTNDGDFTDKMIHPRNEIDKVYLARVKGIATKENLR   60
           +LPQVKERIYPVGRLDWDT+G+LILTNDGDFTD MIHPRNEIDKVYLARVKGIATKENLR
Sbjct:  94 LLPQVKERIYPVGRLDWDTSGVLILTNDGDFTDTMIHPRNEIDKVYLARVKGIATKENLR  153

Query:  61 PLTRGVVIDGKKTKPARYTIIKVDHEKNRSVVELTIHEGRNHQVKKMFE            109
           PLTRG+VIDGKKTKPARY I++V+ +K+RS+VELTIHEGRNHQVKKMFE
Sbjct: 154 PLTRGIVIDGKKTKPARYNIVRVEADKSRSIVELTIHEGRNHQVKKMFE            202
```

Based on this analysis, it was predicted that these proteins and their epitopes could be useful antigens for vaccines or diagnostics.

EXAMPLE 2323

A DNA sequence (GBSx2466) was identified in *S. agalactiae* <SEQ ID 7135> which encodes the amino acid sequence <SEQ ID 7136>. This protein is predicted to be L-ribulose 5-phosphate 4-epimerase. Analysis of this protein sequence reveals the following:

```
Possible site: 19
>>> Seems to have no N-terminal signal sequence

----- Final Results -----
              bacterial cytoplasm --- Certainty = 0.2827(Affirmative) < succ>
               bacterial membrane --- Certainty = 0.0000(Not Clear)  < succ>
                bacterial outside --- Certainty = 0.0000(Not Clear)  < succ>
```

The protein has homology with the following sequences in the GENPEPT database.

```
>GP: AAD45716 GB: AF160811 L-ribulose 5-phosphate 4-epimerase
[Bacillus stearothermophilus]
Identities = 68/103 (66%), Positives = 82/103 (79%)

Query:   2 QEMRERVCEANKSLPVHSLVKFTWGNVSEVDREAGLIVIKPSGVDYDQLTPENMVVTDLE    61
           +E+++ V EAN  LP + LV FTWGNVS +DRE GL+VIKPSGV YD+LT ++MVV DL
Sbjct:   3 EELKQAVLEANLQLPQYRLVTFTWGNVSGIDRERGLVVIKPSGVAYDKLTIDDMVVVDLT    62

Query:  62 GNIVEGDLNPSSDLPTHVQLYKAWPEVGGIVHTHSTEAVGWAQ                   104
           GN+VEGDL PSSD PTH+ LYK +P +GGIVHTHST A  WAQ
Sbjct:  63 GNVVEGDLKPSSDTPTHLWLYKQFPGIGGIVHTHSTWATVWAQ                   105
```

There is also homology to SEQ ID 4600:

```
Identities = 93/103 (90%), Positives = 96/103 (92%)

Query:   2 QEMRERVCEANKSLPVHSLVKFTWGNVSEVDREAGLIVIKPSGVDYDQLTPENMVVTDLE    61
           QEMRERVC ANKSLP H LVKFTWGNVSEV RE G IVIKPSGVDYD LTPENMVVTDL+
Sbjct:   6 QEMRERVCAANKSLPQHGLVKFTWGNVSEVCRELGRIVIKPSGVDYDLLTPENMVVTDLD    65

Query:  62 GNIVEGDLNPSSDLPTHVQLYKAWPEVGGIVHTHSTEAVGWAQ                   104
           GN+VEGDLNPSSDLPTHV+LYKAWPEVGGIVHTHSTEAVGWAQ
Sbjct:  66 GNVVEGDLNPSSDLPTHVELYKAWPEVGGIVHTHSTEAVGWAQ                   108
```

Based on this analysis, it was predicted that these proteins and their epitopes could be useful antigens for vaccines or diagnostics.

EXAMPLE 2324

A DNA sequence (GBSx2467) was identified in *S. agalactiae* <SEQ ID 7137> which encodes the amino acid sequence <SEQ ID 7138>. Analysis of this protein sequence reveals the following:

```
Possible site: 20
>>> Seems to have no N-terminal signal sequence

----- Final Results -----
              bacterial cytoplasm --- Certainty = 0.3452(Affirmative) < succ>
               bacterial membrane --- Certainty = 0.0000(Not Clear)  < succ>
                bacterial outside --- Certainty = 0.0000(Not Clear)  < succ>
```

The protein has homology with the following sequences in the GENPEPT database.

```
>GP: AAG05712 GB: AE004658 hypothetical protein [Pseudomonas aeruginosa]
Identities = 141/200 (70%), Positives = 162/200 (80%), Gaps = 1/200 (0%)

Query:  10 LSLGTDYETLANRFRPIFREISAGNVEREKARALPYEPIEWLKKAGFGAVRVPSEYGGAG    69
           LS G DYE LA RFRPIF  I+ G VERE+ R LP+E I WLK+AGFGAVRVP E+GGAG
Sbjct:  14 LSEGADYELLAQRFRPIFARIAEGAVERERQRELPHEAIAWLKQAGFGAVRVPREHGGAG    73

Query:  70 ASIGQLFQLLIELAEADSNIPQALRAHFAFVEDRLNAPPGVDRDTWFARFVAGDLVGNGW   129
           AS+ QL QLLIELAEADSNI QALR HFAFVEDRLNA PG  RD W  RFV GDLVG  W
Sbjct:  74 ASLPQLVQLLIELAEADSNITQALRGHFAFVEDRLNAEPGPGRDRWLRRFVEGDLVGCAW   133

Query: 130 TEVGTVKIGDVITKVSAQGDG-FVLNGTKFYSTGSIFADWIDVYAQRADNGADVIAVVNA   188
           TEVG+V++G+V+T+VS + DG +V+NG+K+YSTGS+F+DWID+YAQR D GADVIA +
Sbjct: 134 TEVGSVRLGEVLTRVSRKDDGRWVVNGSKYYSTGSLFSDWIDLYAQRDDTGADVIAAIRT   193
```

```
Query:  189 RHAGVRHSDDWDGFGQRTTG                              208
            GVR SDDWDGFGQRTTG
Sbjct:  194 DQPGVRQSDDWDGFGQRTTG                             213
```

No corresponding DNA sequence was identified in *S. pyogenes*.

Based on this analysis, it was predicted that this protein and its epitopes, could be useful antigens for vaccines or diagnostics.

EXAMPLE 2325

A DNA sequence (GBSx2468) was identified in *S. agalactiae* <SEQ ID 7139> which encodes the amino acid sequence <SEQ ID 7140>. Analysis of this protein sequence reveals the following:

```
Possible site: 15
>>> Seems to have no N-terminal signal sequence

----- Final Results -----
            bacterial cytoplasm --- Certainty = 0.1919(Affirmative) < succ>
            bacterial membrane  --- Certainty = 0.0000(Not Clear)   < succ>
            bacterial outside   --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 2326

A DNA sequence (GBSx2474) was identified in *S. agalactiae* <SEQ ID 7141> which encodes the amino acid sequence <SEQ ID 7142>. Analysis of this protein sequence reveals the following:

```
Possible site: 39
>>> Seems to have no N-terminal signal sequence

----- Final Results -----
            bacterial cytoplasm --- Certainty = 0.2978(Affirmative) < succ>
            bacterial membrane  --- Certainty = 0.0000(Not Clear)   < succ>
            bacterial outside   --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 2327

A DNA sequence (GBSx2476) was identified in *S. agalactiae* <SEQ ID 7143> which encodes the amino acid sequence <SEQ ID 7144>. Analysis of this protein sequence reveals the following:

```
Possible site: 61
>>> Seems to have no N-terminal signal sequence

----- Final Results -----
            bacterial cytoplasm --- Certainty = 0.5402(Affirmative) < succ>
            bacterial membrane  --- Certainty = 0.0000(Not Clear)   < succ>
            bacterial outside   --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 2328

A DNA sequence (GBSx2477) was identified in *S. agalactiae* <SEQ ID 7145> which encodes the amino acid sequence <SEQ ID 7146>. This protein is predicted to be mercuric reductase. Analysis of this protein sequence reveals the following:

```
Possible site: 49
>>> Seems to have no N-terminal signal sequence

----- Final Results -----
            bacterial cytoplasm --- Certainty = 0.2755(Affirmative) < succ>
            bacterial membrane  --- Certainty = 0.0000(Not Clear)   < succ>
             bacterial outside  --- Certainty = 0.0000(Not Clear)   < succ>
```

The protein has homology with the following sequences in the GENPEPT database.

```
>GP: CAA70224 GB: Y09024 mercuric reductase [Bacillus cereus]
Identities = 190/247 (76%), Positives = 225/247 (90%)

Query:   1 MELGQLFHHLGSEITLMQRSERLLKEYDPEISESVEKALIEQGINLVKGATFERVEQSGE  60
           MELGQLFH+LGSE+TL+QRSERLLKEYDPEISESVEK+L+EQGINLVKGAT+ER+EQ+G+
Sbjct: 262 MELGQLFHNLGSEVTLIQRSERLLKEYDPEISESVEKSLVEQGINLVKGATYERIEQNGD 321

Query:  61 IKRVYVTVNGSREVIESDQLLVATGRKPNTDSLNLSAAGVETGKNNEILINDFGQTSNEK 120
           IK+V+V VNG + +IE+DQLLVATGR PNT +LNL AAGVE G    EI+I+D+ +T+N +
Sbjct: 322 IKKVHVEVNGKKRIIEADQLLVATGRTPNTATLNLRAAGVEIGSRGEIIIDDYSRTTNTR 381

Query: 121 IYAAGDVTLGPQFVYVAAYEGGIITDNAIGGLNKKIDLSVVPAVTFTNPTVATVGLTEEQ 180
           IYAAGDVTLGPQFVYVAAY+GG+    NAIGGLNKK++L VVP VTFT P +ATVGLTE+Q
Sbjct: 382 IYAAGDVTLGPQFVYVAAYQGGVAAPNAIGGLNKKLNLEVVPGVTFTAPAIATVGLTEQQ 441

Query: 181 AKEKGYDVKTSVLPLGAVPRAIVNRETTGVFKLVADAETLKVLGVHIVSENAGDVIYAAS 240
           AKE GY+VKTSVLPL AVPRA+VNRETTGVFKLVAD++T+KVLG H+V+ENAGDVIYAA+
Sbjct: 442 AKENGYEVKTSVLPLDAVPRALVNRETTGVFKLVADSKTMKVLGAHVVAENAGDVIYAAT 501

Query: 241 LAVKFGL                                                      247
           LAVKFGL
Sbjct: 502 LAVKFGL                                                      508
```

There is also homology to SEQ ID 1820.

Based on this analysis, it was predicted that this protein and its epitopes, could be useful antigens for vaccines or diagnostics.

EXAMPLE 2329

A DNA sequence (GBSx2478) was identified in *S. agalactiae* <SEQ ID 7147> which encodes the amino acid sequence <SEQ ID 7148>. Analysis of this protein sequence reveals the following:

```
Possible site: 30
>>> Seems to have no N-terminal signal sequence

----- Final Results -----
            bacterial cytoplasm --- Certainty = 0.3642(Affirmative) < succ>
            bacterial membrane  --- Certainty = 0.0000(Not Clear)   < succ>
             bacterial outside  --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 2330

A DNA sequence (GBSx2479) was identified in *S. agalactiae* <SEQ ID 7149> which encodes the amino acid sequence <SEQ ID 7150>. This protein is predicted to be surface protein Rib. Analysis of this protein sequence reveals the following:

```
Possible site: 61
>>> Seems to have no N-terminal signal sequence

----- Final Results -----
            bacterial cytoplasm --- Certainty = 0.1936(Affirmative) < succ>
            bacterial membrane  --- Certainty = 0.0000(Not Clear)   < succ>
             bacterial outside  --- Certainty = 0.0000(Not Clear)   < succ>
```

No corresponding DNA sequence was identified in *S. pyogenes*.

Based on this analysis, it was predicted that this protein and its epitopes, could be useful antigens for vaccines or diagnostics.

EXAMPLE 2331

A DNA sequence (GBSx2480) was identified in *S. agalactiae* <SEQ ID 7151> which encodes the amino acid sequence <SEQ ID 7152>. This protein is predicted to be Nra. Analysis of this protein sequence reveals the following:

```
Possible site: 36
>>> Seems to have no N-terminal signal sequence

----- Final Results -----
            bacterial cytoplasm --- Certainty = 0.1510(Affirmative) < succ>
            bacterial membrane  --- Certainty = 0.0000(Not Clear)   < succ>
             bacterial outside  --- Certainty = 0.0000(Not Clear)   < succ>
```

A related GBS nucleic acid sequence <SEQ ID 9383> which encodes amino acid sequence <SEQ ID 9384> was also identified.

The protein has no significant homology with any sequences in the GENPEPT database.

A related DNA sequence was identified in *S. pyogenes* <SEQ ID 7153> which encodes the amino acid sequence <SEQ ID 7154>. Analysis of this protein sequence reveals the following:

```
Possible site: 16
>>> Seems to have no N-terminal signal sequence
     INTEGRAL      Likelihood = -0.64      Transmembrane      22-38 (22-38)

----- Final Results -----
            bacterial membrane  --- Certainty = 0.1256(Affirmative) < succ>
             bacterial outside  --- Certainty = 0.0000(Not Clear)   < succ>
            bacterial cytoplasm --- Certainty = 0.0000(Not Clear)   < succ>
```

An alignment of the GAS and GBS proteins is shown below.

```
Identities = 42/157 (26%), Positives = 78/157 (48%), Gaps = 2/157 (1%)

Query:  71 LLGREFIDSQHFKDINAYFLRHFICYCYYFIPDFYFLNTSRLSY--SKDLYHLLDKGLAD  128
           LLG   ++S  FK I   F R FI    +PD +   R   +K Y+ L   + +
Sbjct:   8 LLGNNILNSLPFKRILVSFSRLFISNLQVLLPDIHLFHYLRRQQKRNKSFYNTLKTIVEE   67
```

```
Query:  129 IFNLKGGNLTFSKHETVLLTMQLSNLIETFLAPLSVYVISSSNIRLQTYQVMLNQYFTSK  188
             + +G         +  +L T+QL  L++T+L P+ VY+++++    L      L+ YF
Sbjct:   68 WMSAEGIVGKLPSYHLLLFTIQLEELLKTYLPPIPVYLLTNNTAALDLMTNALSIYFPPA  127

Query:  189 IAEFFFVNYQTTQIDEKLLKKADIIIAERRYISSLKN                        225
             IA    VN +      + + +K  +IIA+R+Y++ +++
Sbjct:  128 IATVMPVNVEIIPFKDIVKEKQSVIIADRQYLNLIQH                        164
```

Based on this analysis, it was predicted that these proteins and their epitopes could be useful antigens for vaccines or diagnostics.

EXAMPLE 2332

A DNA sequence (GBSx2481) was identified in *S. agalactiae* <SEQ ID 7155> which encodes the amino acid sequence <SEQ ID 7156>. Analysis of this protein sequence reveals the following:

```
Possible site: 20
>>> Seems to have no N-terminal signal sequence

----- Final Results -----
          bacterial cytoplasm --- Certainty = 0.1383(Affirmative) < succ>
           bacterial membrane --- Certainty = 0.0000(Not Clear)   < succ>
            bacterial outside --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 2333

A DNA sequence (GBSx2482) was identified in *S. agalactiae* <SEQ ID 7157> which encodes the amino acid sequence <SEQ ID 7158>. Analysis of this protein sequence reveals the following:

```
Possible site: 60
>>> Seems to have no N-terminal signal sequence

----- Final Results -----
          bacterial cytoplasm --- Certainty = 0.4145(Affirmative) < succ>
           bacterial membrane --- Certainty = 0.0000(Not Clear)   < succ>
            bacterial outside --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 2334

A DNA sequence (GBSx2484) was identified in *S. agalactiae* <SEQ ID 7159> which encodes the amino acid sequence <SEQ ID 7160>. Analysis of this protein sequence reveals the following:

```
Possible site: 57
>>> Seems to have no N-terminal signal sequence
    INTEGRAL    Likelihood = -2.02    Transmembrane    34-50 (34-50)

----- Final Results -----
            bacterial membrane --- Certainty = 0.1808(Affirmative) < succ>
            bacterial outside  --- Certainty = 0.0000(Not Clear)   < succ>
            bacterial cytoplasm --- Certainty = 0.0000(Not Clear)  < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 2335

A DNA sequence (GBSx2485) was identified in *S. agalactiae* <SEQ ID 7161> which encodes the amino acid sequence <SEQ ID 7162>. Analysis of this protein sequence reveals the following:

```
Possible site: 49
>>> Seems to have no N-terminal signal sequence

----- Final Results -----
            bacterial cytoplasm --- Certainty = 0.3488(Affirmative) < succ>
            bacterial membrane  --- Certainty = 0.0000(Not Clear)   < succ>
            bacterial outside   --- Certainty = 0.0000(Not Clear)   < succ>
```

The protein has homology with the following sequences in the GENPEPT database.

```
>GP: CAB52002 GB: AL109663 hypothetical protein [Streptomyces
coelicolor A3(2)]
Identities = 61/141 (43%), Positives = 86/141 (60%), Gaps = 2/141 (1%)

Query:    3 TYFDNFLKTNQAYADLHGTAHLPIKPKTKVAIVTCMDSRLHVAQALGLALGDAHILRNAG   62
            T  D  ++ N+ YA     +  +P  +VA+V CMD+RL +   ALGL LGD H +RNAG
Sbjct:    5 TVTDRLVEANERYAAAFADPGMDARPVQRVAVVACMDARLDLHAALGLKLGDCHTIRNAG   64

Query:   63 GRVTDDVLRSLVISQQQLGTREIVVLHHTDCGAQTFTNEAFAAQLQRDLGVDMHGHDFLP  122
            G VTDDV+RSL ISQ+ LGTR + ++HHT CG +T T E F    L+ ++G
Sbjct:   65 GVVTDDVIRSLTISQRALGTRSVALIHHTGCGMETITEE-FRHDLELEVG-QRPAWAVEA  122

Query:  123 FNDIEESVREDVAKLHASPFL                                        143
            F D ++ VR+ +  ++   SPFL
Sbjct:  123 FRDADQDVRQSIERVRTSPFL                                        143
```

A related DNA sequence was identified in *S. pyogenes* <SEQ ID 6469> which encodes the amino acid sequence <SEQ ID 6470>. Analysis of this protein sequence reveals the following:

```
Possible site: 20
>>> Seems to have no N-terminal signal sequence

----- Final Results -----
            bacterial cytoplasm --- Certainty = 0.2295(Affirmative) < succ>
            bacterial membrane  --- Certainty = 0.0000(Not Clear)   < succ>
            bacterial outside   --- Certainty = 0.0000(Not Clear)   < succ>
```

An alignment of the GAS and GBS proteins is shown below.

```
Identities = 109/146 (74%), Positives = 128/146 (87%)

Query:    1 MTTYFDNFLKTNQAYADLHGTAHLPIKPKTKVAIVTCMDSRLHVAQALGLALGDAHILRN   60
            + +YF++F+  NQAY   LHGTAHLP+KPKTKVAIVTCMDSRLHVAQALGLALGDAHILRN
Sbjct:    1 LMSYFEHFMAANQAYVALHGTAHLPLKPKTKVAIVTCMDSRLHVAQALGLALGDAHILRN   60

Query:   61 AGGRVTDDVLRSLVISQQQLGTREIVVLHHTDCGAQTFTNEAFAAQLQRDLGVDMHGHDF  120
            AGGRVT+D++RSLVISQQQ+GTREIVVLHHTDCGAQTFTNE FA +   LGVD+ G DF
Sbjct:   61 AGGRVTEDMIRSLVISQQQMGTREIVVLHHTDCGAQTFTNEGFAKHIHEHLGVDVSGQDF  120
```

```
Query:  121 LPFNDIEESVREDVAKLHASPFLREE       146
            LPF D+E+SVRED+AK+ AS  + ++
Sbjct:  121 LPFQDVEDSVREDMAKIRASSLISDD       146
```

Based on this analysis, it was predicted that these proteins and their epitopes could be useful antigens for vaccines or diagnostics.

EXAMPLE 2336

A DNA sequence (GBSx2486) was identified in *S. agalactiae* <SEQ ID 7163> which encodes the amino acid sequence <SEQ ID 7164>. Analysis of this protein sequence reveals the following:

```
Possible site: 26
>>> Seems to have no N-terminal signal sequence

----- Final Results -----
           bacterial cytoplasm --- Certainty = 0.0932(Affirmative) < succ>
           bacterial membrane  --- Certainty = 0.0000(Not Clear)   < succ>
            bacterial outside  --- Certainty = 0.0000(Not Clear)   < succ>
```

The protein has homology with the following sequences in the GENPEPT database.

>GP: AAG08811 GB: AE004955
phosphoribosylaminoimidazole carboxylase, catalytic subunit [*Pseudomonas aeruginosa*]
Identities = 20/27 (74%), Positives = 26/27 (96%)

```
Query:   1 MFKHAEEARGRGIKIIAGAGGAAHLP       27
           +F++AEEA GRG+++IIAGAGGAAHLP
Sbjct:  46 LFQYAEEAEGRGLEVIIAGAGGAAHLP       72
```

There is also homology to SEQ ID 910:

Identities = 27/27 (100%), Positives = 27/27 (100%)

```
Query:   1 MFKHAEEARGRGIKIIAGAGGAAHLP       27
           MFKHAEEARGRGIKIIAGAGGAAHLP
Sbjct:  87 MFKHAEEARGRGIKIIAGAGGAAHLP       113
```

Based on this analysis, it was predicted that these proteins and their epitopes could be useful antigens for vaccines or diagnostics.

EXAMPLE 2337

A DNA sequence (GBSx2488) was identified in *S. agalactiae* <SEQ ID 7165> which encodes the amino acid sequence <SEQ ID 7166>. Analysis of this protein sequence reveals the following:

```
Possible site: 43
>>> Seems to have an uncleavable N-term signal seq
    INTEGRAL    Likelihood = -6.85    Transmembrane    58-74  (53-80)
    INTEGRAL    Likelihood = -5.79    Transmembrane    103-119 (101-122)

----- Final Results -----
           bacterial membrane  --- Certainty = 0.3739(Affirmative) < succ>
            bacterial outside  --- Certainty = 0.0000(Not Clear)   < succ>
           bacterial cytoplasm --- Certainty = 0.0000(Not Clear)   < succ>
```

There is also homology to SEQ IDs 880 and 9278.

Based on this analysis, it was predicted that this protein and its epitopes, could be useful antigens for vaccines or diagnostics.

EXAMPLE 2338

A DNA sequence (GBSx2489) was identified in *S. agalactiae* <SEQ ID 7167> which encodes the amino acid sequence <SEQ ID 7168>. This protein is predicted to be short chain alcohol dehydrogenase. Analysis of this protein sequence reveals the following:

```
Possible site: 16
>>> Seems to have no N-terminal signal sequence

----- Final Results -----
           bacterial cytoplasm --- Certainty = 0.1742(Affirmative) < succ>
           bacterial membrane  --- Certainty = 0.0000(Not Clear)   < succ>
            bacterial outside  --- Certainty = 0.0000(Not Clear)   < succ>
```

A related GBS nucleic acid sequence <SEQ ID 9357> which encodes amino acid sequence <SEQ ID 9358> was also identified.

The protein has homology with the following sequences in the GENPEPT database.

```
>GP: AAD06605 GB: AE001530 putative oxidoreductase [Helicobacter
pylori J99]
Identities = 68/94 (72%), Positives = 79/94 (83%)

Query:    4 IDLLVNNAGLALGLDKSYEADFGDWMTMINTNVVGLIYLTRCILPKMVEVNRGLIINLGS   63
            ID L+NNAGLALGL+K+YE +  DW  MI+TN+ GL++LTR ILP M+E ++G IINLGS
Sbjct:   76 IDALINNAGLALGLNKAYECELDDWEVMIDTNIKGLLHLTRLILPSMIEHDQGTIINLGS  135

Query:   64 XAGTIPYPGANVYGASKAFVKQFSLNLRADLAGT                            97
              AGT   YPG NVYGASKAFVKQFSLNLRADLAGT
Sbjct:  136 IAGTYAYPGGNVYGASKAFVKQFSLNLRADLAGT                           169
```

A related DNA sequence was identified in *S. pyogenes* <SEQ ID 7169> which encodes the amino acid sequence <SEQ ID 7170>. Analysis of this protein sequence reveals the following:

```
Possible site: 18
>>> Seems to have an uncleavable N-term signal seq

----- Final Results -----
          bacterial membrane --- Certainty = 0.0000(Not Clear) < succ>
           bacterial outside --- Certainty = 0.0000(Not Clear) < succ>
         bacterial cytoplasm --- Certainty = 0.0000(Not Clear) < succ>
```

A related sequence was also identified in GAS <SEQ ID 9121> which encodes the amino acid sequence <SEQ ID 9122>. Analysis of this protein sequence reveals the following:

```
Possible site: 12
>>> Seems to have an uncleavable N-term signal seq

----- Final Results -----
          bacterial membrane --- Certainty = 0.0000(Not Clear) < succ>
           bacterial outside --- Certainty = 0.0000(Not Clear) < succ>
         bacterial cytoplasm --- Certainty = 0.0000(Not Clear) < succ>
```

An alignment of the GAS and GBS proteins is shown below.

```
Identities = 78/96 (81%), Positives = 87/96 (90%)

Query:    2 QSIDLLVNNAGLALGLDKSYEADFGDWMTMINTNVVGLIYLTRCILPKMVEVNRGLIINL   61
            Q I +LVNNAGLALGLDK+YEADF +WMTMINTN+VGLIYLTR +LP MV  + G+IINL
Sbjct:   82 QDITILVNNAGLALGLDKAYEADFENWMTMINTNIVGLIYLTRQLLPHMVSKDDGIIINL  141

Query:   62 GSXAGTIPYPGANVYGASKAFVKQFSLNLRADLAGT                          97
            GS AGTIPYPGAN+YGASKAFVKQFSLNLRADLAG+
Sbjct:  142 GSTAGTIPYPGANIYGASKAFVKQFSLNLRADLAGS                         177
```

Based on this analysis, it was predicted that these proteins and their epitopes could be useful antigens for vaccines or diagnostics.

EXAMPLE 2339

A DNA sequence (GBSx2492) was identified in *S. agalactiae* <SEQ ID 7171> which encodes the amino acid sequence <SEQ ID 7172>. This protein is predicted to be mercuric reductase. Analysis of this protein sequence reveals the following:

```
Possible site: 53
>>> Seems to have no N-terminal signal sequence

----- Final Results -----
            bacterial cytoplasm --- Certainty = 0.2115(Affirmative) < succ>
             bacterial membrane --- Certainty = 0.0000(Not Clear)   < succ>
              bacterial outside --- Certainty = 0.0000(Not Clear)   < succ>
```

The protein has homology with the following sequences in the GENPEPT database.

```
>GP: CAC14663 GB: Y10855 mercuric reductase [Bacillus licheniformis]
Identities = 68/104 (65%), Positives = 82/104 (78%)

Query:   1 MNKFKVNISGMTCTGCEKHVESALEKIGAKNIESSYRRGEAVFELPDDIEVESAIKAIDE   60
           M K++VN+ GMTCTGCE+HV  ALE +GAK IE  YRRGEAVFELP+ +EVE+A KAI E
Sbjct:   1 MKKYRVNVQGMTCTGCEEHVAVALENMGAKRIEVDYRRGEAVFELPNGLEVETAKKAIAE   60

Query:  61 ANYQAGEIEEVSSLENVALINEDNYDLLIIGSGAAAFSSAIKAI                 104
           A YQ GE EEV S E + L +E +YD +IIGSG AAFSSAI+A+
Sbjct:  61 AKYQPGEAEEVQSQELIQLGDEGDYDYIIIGSGGAAFSSAIEAV                 104
```

No corresponding DNA sequence was identified in *S. pyogenes*.

Based on this analysis, it was predicted that this protein and its epitopes, could be useful antigens for vaccines or diagnostics.

EXAMPLE 2340

A DNA sequence (GBSx2494) was identified in *S. agalactiae* <SEQ ID 7173> which encodes the amino acid sequence <SEQ ID 7174>. Analysis of this protein sequence reveals the following:

```
Possible site: 58
>>> Seems to have no N-terminal signal sequence

----- Final Results -----
            bacterial cytoplasm --- Certainty = 0.3341(Affirmative) < succ>
             bacterial membrane --- Certainty = 0.0000(Not Clear)   < succ>
              bacterial outside --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 2341

A DNA sequence (GBSx2495) was identified in *S. agalactiae* <SEQ ID 7175> which encodes the amino acid sequence <SEQ ID 7176>. Analysis of this protein sequence reveals the following:

```
Possible site: 31
>>> Seems to have no N-terminal signal sequence

----- Final Results -----
            bacterial cytoplasm --- Certainty = 0.4989(Affirmative) < succ>
             bacterial membrane --- Certainty = 0.0000(Not Clear)   < succ>
              bacterial outside --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 2342

A DNA sequence (GBSx2496) was identified in *S. agalactiae* <SEQ ID 7177> which encodes the amino acid sequence <SEQ ID 7178>. Analysis of this protein sequence reveals the following:

```
Possible site: 30
>>> Seems to have no N-terminal signal sequence

----- Final Results -----
          bacterial cytoplasm --- Certainty = 0.2569(Affirmative) < succ>
          bacterial membrane  --- Certainty = 0.0000(Not Clear)   < succ>
          bacterial outside   --- Certainty = 0.0000(Not Clear)   < succ>
```

Based on this analysis, it was predicted that this protein and its epitopes, could be useful antigens for vaccines or diagnostics.

EXAMPLE 2343

A DNA sequence (GBSx2497) was identified in *S. agalactiae* <SEQ ID 7179> which encodes the amino acid sequence <SEQ ID 7180>. This protein is predicted to be DNA polymerase III alpha subunit (dnaE). Analysis of this protein sequence reveals the following:

```
Possible site: 60
>>> Seems to have no N-terminal signal sequence

----- Final Results -----
          bacterial cytoplasm --- Certainty = 0.3124(Affirmative) < succ>
          bacterial membrane  --- Certainty = 0.0000(Not Clear)   < succ>
          bacterial outside   --- Certainty = 0.0000(Not Clear)   < succ>
```

A related DNA sequence was identified in *S. pyogenes* <SEQ ID 4095> which encodes the amino acid sequence <SEQ ID 4096>. Analysis of this protein sequence reveals the following:

```
Possible site: 36
>>> Seems to have no N-terminal signal sequence

----- Final Results -----
          bacterial cytoplasm --- Certainty = 0.2600(Affirmative) < succ>
          bacterial membrane  --- Certainty = 0.0000(Not Clear)   < succ>
          bacterial outside   --- Certainty = 0.0000(Not Clear)   < succ>
```

An alignment of the GAS and GBS proteins is shown below.

```
Identities = 186/237 (78%), Positives = 214/237 (89%)

Query:   10 DPVKHNLIFERFLNEERYSMPDIDIDLPDIYRGEFLRYVRNRYGSMHSAQIVTFSTFGAK   69
            DPV+H+L+FERFLN+ERYSMPDIDIDLPDIYR EFLRYVRNRYGS HSAQIVTFSTFG K
Sbjct:  321 DPVQHDLLFERFLNKERYSMPDIDIDLPDIYRSEFLRYVRNRYGSDHSAQIVTFSTFGPK  380

Query:   70 QAIRDVFKRFGASEYELTNITKKIHFRDNLTSVYNRNLAFRQIIDSKIEYQKAYDIAKRI  129
            QAIRDVFKRFG EYELTN+TKKI F+D+L +VY ++++FRQ+I+S+ E+QKA+ IAKRI
Sbjct:  381 QAIRDVFKRFGVPEYELTNLTKKIGFKDSLATVYEKSISFRQVINSRTEFQKAFAIAKRI  440

Query:  130 EGNPRQTSIHAAGVVMSDDLLTDHIPLKNGEDMMITQYDASSVEDNGLLKMDFLGLRNLT  189
            EGNPRQTSIHAAG+VMSDD LT+HIPLK+G+DMMITQYDA +VE NGLLKMDFLGLRNLT
Sbjct:  441 EGNPRQTSIHAAGIVMSDDALTNHIPLKSGDDMMITQYDAHAVEANGLLKMDFLGLRNLT  500

Query:  190 FVQKMKEKVDKDYGISIQLETIDLEDKETLKLFAAGQTKGIFQFEQSGAINLLRRIR     246
            FVQKM+EKV KDYG  I +   IDLED +TL LFA G TKGIFQFEQ+GAINLL+RI+
Sbjct:  501 FVQKMQEKVAKDYGCQIDITAIDLEDPQTLALFAKGDTKGIFQFEQNGAINLLKRIK     557
```

Based on this analysis, it was predicted that these proteins and their epitopes could be useful antigens for vaccines or diagnostics.

EXAMPLE 2344

A DNA sequence (GBSx2498) was identified in *S. agalactiae* <SEQ ID 7181> which encodes the amino acid sequence <SEQ ID 7182>. This protein is predicted to be a methylase. Analysis of this protein sequence reveals the following:

```
Possible site: 60
>>> Seems to have no N-terminal signal sequence

----- Final Results -----
            bacterial cytoplasm --- Certainty = 0.2121(Affirmative) < succ>
             bacterial membrane --- Certainty = 0.0000(Not Clear)   < succ>
              bacterial outside --- Certainty = 0.0000(Not Clear)   < succ>
```

The protein has homology with the following sequences in the GENPEPT database.

```
>GP: AAG21729 GB: AF116907 putative methylase [Corynebacterium hoagii]
Identities = 48/160 (30%), Positives = 85/160 (53%), Gaps = 6/160 (3%)

Query:    97 EPDDSENGHNDTDLEETDNQIPEEEVVETIPEIPVTDFYFPEDLTDFYPKTARDKVETNI   156
             EP+            + E + + ++E          +P TDF    D+     P  A+ +V  NI
Sbjct:  1236 EPEAPTQPEAASAAETAEPAVEQQEPRAGPQSVPATDFALGTDV--HVPSGAKARVRANI  1293

Query:   157 VAIRLVKNLEVEHRNASPSEQELLAKYVGWGGLANEFFDD---YNPKFSKEREELKSLVT   213
                A RLV  L+ + R A+   EQ +LA++ GWG +   E FD+      +   +++ ER   L   L+
Sbjct:  1294 AAARLVLELDEQQRPATAEEQAVLAQWSGWGAVP-EVFDNRSKFLSEWADERAALLDLLG  1352

Query:   214 DKEYSDMKQSSLTAYYTDPSLIRQMWGIVERDGFTGWQIL                      253
             +K +S  ++++L A+YTDP+++ ++W   V+R G        +L
Sbjct:  1353 EKGFSQARETTLNAHYTDPAIVGELWRAVQRAGLPDGALL              1392
```

No corresponding DNA sequence was identified in *S. pyogenes*.

Based on this analysis, it was predicted that this protein and its epitopes, could be useful antigens for vaccines or diagnostics.

EXAMPLE 2345

A DNA sequence (GBSx2499) was identified in *S. agalactiae* <SEQ ID 7183> which encodes the amino acid sequence <SEQ ID 7184>. Analysis of this protein sequence reveals the following:

```
Possible site: 34
>>> Seems to have no N-terminal signal sequence

----- Final Results -----
            bacterial cytoplasm --- Certainty = 0.1111(Affirmative) < succ>
             bacterial membrane --- Certainty = 0.0000(Not Clear)   < succ>
              bacterial outside --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 2346

A DNA sequence (GBSx2501) was identified in *S. agalactiae* <SEQ ID 7185> which encodes the amino acid sequence <SEQ ID 7186>. Analysis of this protein sequence reveals the following:

```
Possible site: 39
>>> Seems to have no N-terminal signal sequence
```

-continued

```
----- Final Results -----
            bacterial cytoplasm --- Certainty = 0.4752(Affirmative) < succ>
            bacterial membrane  --- Certainty = 0.0000(Not Clear)   < succ>
             bacterial outside  --- Certainty = 0.0000(Not Clear)   < succ>
```

The protein has homology with the following sequences in the GENPEPT database.

```
>GP: CAA61516 GB: X89232 DNA-directed RNA polymerase [Pediococcus
acidilactici]
Identities = 48/53 (90%), Positives = 52/53 (97%)

Query:   5 KKPETINYRTLKPEREGLFDEVIFGPTKDWECACGKYKRIRYKGIICDRCGVE   57
           KKPETINYRTLKPE++GLFDE IFGPTKD+ECACGKYKRIRYKGI+CDRCGVE
Sbjct:  29 KKPETINYRTLKPEKDGLFDERIFGPTKDYECACGKYKRIRYKGIVCDRCGVE   81
```

There is also homology to SEQ ID 384.

Based on this analysis, it was predicted that these proteins and their epitopes could be useful antigens for vaccines or diagnostics.

EXAMPLE 2347

A DNA sequence (GBSx2502) was identified in *S. agalactiae* <SEQ ID 7187> which encodes the amino acid sequence <SEQ ID 7188>. Analysis of this protein sequence reveals the following:

```
Possible site: 22
>>> Seems to have no N-terminal signal sequence

----- Final Results -----
            bacterial cytoplasm --- Certainty = 0.3080(Affirmative) < succ>
            bacterial membrane  --- Certainty = 0.0000(Not Clear)   < succ>
             bacterial outside  --- Certainty = 0.0000(Not Clear)   < succ>
```

The protein has homology with the following sequences in the GENPEPT database.

```
>GP: AAC00282 GB: AF008220 Ytlr [Bacillus subtilis]
Identities = 61/216 (28%), Positives = 98/216 (45%), Gaps = 28/216 (12%)

Query:    8 IPCTYYPVGSGNDFARALKIPNL---------KETLTAIQTERLKEINCFIYDKGLIL--    56
            I  ++ P G+ NDF+R    I  +         K  LT  +T  L  +N F+ DK  IL
Sbjct:   86 IELSFVPAGAYNDFSRGFSIKKIDLIQEIKKVKRPLT--RTFHLGSVN-FLQDKSQILYF  142

Query:   57 -NSLDLGFAAYVVWKASNSKIKNILNRYRLGKITYIVIAIKSLLHSSK------VQVLVE  109
             N + +GF AYV   KA    ++ +   RL   + Y +    S LH+S        +  E
Sbjct:  143 MNHIGIGFDAYVNKKAMEFPLRRVFLFLRLRFLVYPL----SHLHASATFKPFTLACTTE  198

Query:  110 GETGQQIKLNDLYFFALANNTYFGGGITIWPKASALTAELDMVYAKGHTFLKRLSILLSL  169
            ET +      +D++F  ++N+ ++GGG+    P A+      D+V +   FLK+   +L  +
Sbjct:  199 DETRE---FHDVWFAVVSNHPFYGGGMKAAPLANPREKTFDIVIVENQPFLKKYWLLCLM  255

Query:  170 VFKRHTTSKSIKHQTFKAMTVYFPKNSLIEIDGEIV                         205
            F  +HT     +  K +T Y           DGEI+
Sbjct:  256 AFGKHTKMDGVTMFKAKDITFYTKDKIPFHADGEIM                         291
```

No corresponding DNA sequence was identified in *S. pyogenes*.

Based on this analysis, it was predicted that this protein and its epitopes, could be useful antigens for vaccines or diagnostics.

EXAMPLE 2348

A DNA sequence (GBSx2503) was identified in *S. agalactiae* <SEQ ID 7189> which encodes the amino acid sequence <SEQ ID 7190>. This protein is predicted to be protease subunit HflC (hflC). Analysis of this protein sequence reveals the following:

Possible site: 18
>>> Seems to have no N-terminal signal sequence

----- Final Results -----
             bacterial cytoplasm --- Certainty = 0.1809(Affirmative) < succ>
              bacterial membrane --- Certainty = 0.0000(Not Clear)   < succ>
               bacterial outside --- Certainty = 0.0000(Not Clear)   < succ>

The protein has homology with the following sequences in the GENPEPT database.

```
>GP: AAG08326 GB: AE004907 protease subunit HflC [Pseudomonas aeruginosa]
Identities = 182/202 (90%), Positives = 194/202 (95%)

Query:    1 MSQTERAVLLQFGKVVQTDVKPGLHVKVPYVNQVRKFDGRLLTLDAPTQRFLTLEKKAVM   60
            + QTERAV+L+FG+VV++DVKPGLH K+PYVNQVRKFD RLLTLDAPTQRFLTLEKKAVM
Sbjct:   26 VQQTERAVMLRFGRVVESDVKPGLHFKIPYVNQVRKFDARLLTLDAPTQRFLTLEKKAVM   85

Query:   61 VDAYAKWRVKDAERFYTATSGLKQIADERLSRRLESGLRDQFGKRTLHEVVSGERDALMA  120
            VDAYAKWRV DAERFYTATSGLKQIADERLSRRLE+GLRDQFGKRTLHEVVSGERDALM
Sbjct:   86 VDAYAKWRVADAERFYTATSGLKQIADERLSRRLEAGLRDQFGKRTLHEVVSGERDALMG  145

Query:  121 DITGSLNRMAEKELGIEVLDVRVKAIDLPKEVNRSVFERMSTEREREAREHRAKGNELGE  180
            DIT SLNRMA+KELGIEV+DVRVKAIDLPKEVNRSVFERMSTEREREAREHRAKG EL E
Sbjct:  146 DITASLNRMAQKELGIEVIDVRVKAIDLPKEVNRSVFERMSTEREREAREHRAKGRELAE  205

Query:  181 GIRADADRQRRVLLAEAYRESE                                       202
            GIRADADRQRRV++AEAYRESE
Sbjct:  206 GIRADADRQRRVIVAEAYRESE                                       227
```

No corresponding DNA sequence was identified in *S. pyogenes*.

Based on this analysis, it was predicted that this protein and its epitopes, could be useful antigens for vaccines or diagnostics.

EXAMPLE 2349

A DNA sequence (GBSx2504) was identified in *S. agalactiae* <SEQ ID 7191> which encodes the amino acid sequence <SEQ ID 7192>. Analysis of this protein sequence reveals the following:

```
Possible site: 24
>>> Seems to have an uncleavable N-term signal seq

----- Final Results -----
              bacterial membrane --- Certainty = 0.0000(Not Clear) < succ>
               bacterial outside --- Certainty = 0.0000(Not Clear) < succ>
             bacterial cytoplasm --- Certainty = 0.0000(Not Clear) < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 2350

A DNA sequence (GBSx2505) was identified in *S. agalactiae* <SEQ ID 7193> which encodes the amino acid sequence. <SEQ ID 7194>. This protein is predicted to be ABC transporter (ATP-binding; daunorubicin resistance). Analysis of this protein sequence reveals the following:

```
Possible site: 56
>>> Seems to have no N-terminal signal sequence

----- Final Results -----
             bacterial cytoplasm --- Certainty = 0.1846(Affirmative) < succ>
              bacterial membrane --- Certainty = 0.0000(Not Clear)   < succ>
               bacterial outside --- Certainty = 0.0000(Not Clear)   < succ>
```

The protein has homology with the following sequences in the GENPEPT database.

```
>GP: CAB15892 GB: Z99123 similar to ABC transporter
(ATP-binding protein) [Bacillus subtilis]
Identities = 88/231 (38%), Positives = 132/231 (57%),
Gaps = 13/231 (5%)

Query:   10 QVIGYLPDVPKFYDYMTAQEYLQLC---AGLAQNKTSLPIADLLEQVGLADN-QQRISTY   65
            ++IGYLP  P FY +MTA E+L      +GL++ K    I ++LE VGL +    +RI   Y
Sbjct:   69 RLIGYLPQYPAFYSWMTANEFLTFAGRLSGLSKRKCQEKIGEMLEFVGLHEAAHKRIGGY  128

Query:   66 SRGMKQRLGLAQALIHXXKILICDEPTSALDPQGRQEILSIISQLRGQKTVIFSTHILSD  125
            S GMKQRLGLAQAL+H  K LI DEP SALDP GR E+L ++ +L+     V+FSTH+L D
Sbjct:  129 SGGMKQRLGLAQALLHKPKFLILDEPVSALDPTGRFEVLDMMRELKKHMAVLFSTHVLHD  188

Query:  126 VEKVCDQVLILTKSGIH---NLEDLRDKASASVNQLNLLIKVSDNEAQKLALRFPLNQKD  182
            E+VCDQV+I+   I     L++L+ +   +V  L++ K+       +K +   + +
Sbjct:  189 AEQVCDQVVIMKNGEISWKGELQELKQQQQTNVFTLSVKEKLEGWLEEKPYVSAIVYKNP  248

Query:  183 QYYKVHLELSEANNREQALASFYRYLVEQEITPYFIELLEDSLEDFYLEVI           233
              +   EL + +       L+       + + +T    E    +SLED YL+V+
Sbjct:  249 S--QAVFELPDIHAGRSLLSD----CIRKGLTVTRFEQKTESLEDVYLKVV          293
```

There is also homology to SEQ ID 686.

Based on this analysis, it was predicted that this protein and its epitopes, could be useful antigens for vaccines or diagnostics.

EXAMPLE 2351

A DNA sequence (GBSx2506) was identified in *S. agalactiae* <SEQ ID 7195> which encodes the amino acid sequence <SEQ ID 7196>. Analysis of this protein sequence reveals the following:

```
Possible site: 52
>>> Seems to have no N-terminal signal sequence

----- Final Results -----
         bacterial cytoplasm --- Certainty = 0.0679(Affirmative) < succ>
         bacterial membrane  --- Certainty = 0.0000(Not Clear)   < succ>
         bacterial outside   --- Certainty = 0.0000(Not Clear)   < succ>
```

The protein has homology with glycine-rich cell wall proteins (e.g. GB:AL161589—the glycine-rich cell wall protein from *Arabidopsis thaliania*) and to SEQ ID 6882.

Based on this analysis, it was predicted that this protein and its epitopes, could be useful antigens for vaccines or diagnostics.

EXAMPLE 2352

A DNA sequence (GBSx2507) was identified in *S. agalactiae* <SEQ ID 7197> which encodes the amino acid sequence <SEQ ID 7198>. Analysis of this protein sequence reveals the following:

```
Possible site: 35
>>> Seems to have no N-terminal signal sequence

----- Final Results -----
         bacterial cytoplasm --- Certainty = 0.2890(Affirmative) < succ>
         bacterial membrane  --- Certainty = 0.0000(Not Clear)   < succ>
         bacterial outside   --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 2353

A DNA sequence (GBSx2508) was identified in *S. agalactiae* <SEQ ID 7199> which encodes the amino acid sequence <SEQ ID 7200>. Analysis of this protein sequence reveals the following:

```
Possible site: 60
>>> Seems to have no N-terminal signal sequence

----- Final Results -----
            bacterial cytoplasm --- Certainty = 0.2410(Affirmative) < succ>
            bacterial membrane  --- Certainty = 0.0000(Not Clear)   < succ>
             bacterial outside  --- Certainty = 0.0000(Not Clear)   < succ>
```

A related GBS nucleic acid sequence <SEQ ID 9329> which encodes amino acid sequence <SEQ ID 9330> was also identified.

The protein has no significant homology with any sequences in the GENPEPT database.

No corresponding DNA sequence was identified in *S. pyogenes*.

Figure 163:
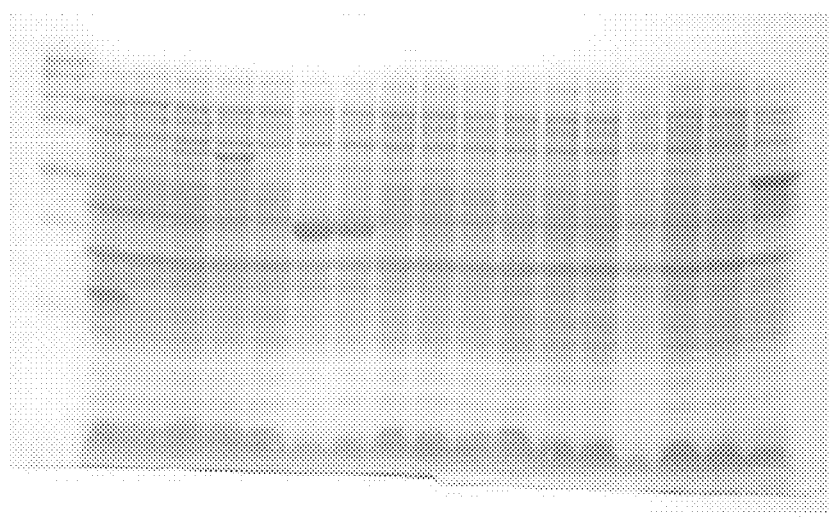

SEQ ID 9330 (GBS678) was expressed in *E. coli* as a His-fusion product. SDS-PAGE analysis of total cell extract is shown in FIG. 163 (lane 18; MW 53 kDa), FIG. 164 (lane 2 & 3; MW 53 kDa) and FIG. 188 (lane 7; MW 53 kDa). Purified protein is shown in FIG. 242, lanes 6 & 7.

Based on this analysis, it was predicted that this protein and its epitopes, could be useful antigens for vaccines or diagnostics.

EXAMPLE 2354

A DNA sequence (GBSx2509) was identified in *S. agalactiae* <SEQ ID 7201> which encodes the amino acid sequence <SEQ ID 7202>. This protein is predicted to be surface protein Rib. Analysis of this protein sequence reveals the following:

```
Possible site: 24
>>> Seems to have no N-terminal signal sequence

----- Final Results -----
            bacterial cytoplasm --- Certainty = 0.2025(Affirmative) < succ>
            bacterial membrane  --- Certainty = 0.0000(Not Clear)   < succ>
             bacterial outside  --- Certainty = 0.0000(Not Clear)   < succ>
```

No corresponding DNA sequence was identified in *S. pyogenes*.

Based on this analysis, it was predicted that this protein and its epitopes, could be useful antigens for vaccines or diagnostics.

EXAMPLE 2355

A DNA sequence (GBSx2510) was identified in *S. agalactiae* <SEQ ID 7203> which encodes the amino acid sequence <SEQ ID 7204>. This protein is predicted to be surface protein Rib. Analysis of this protein sequence reveals the following:

```
Possible site: 24
>>> Seems to have no N-terminal signal sequence

----- Final Results -----
            bacterial cytoplasm --- Certainty = 0.1892(Affirmative) < succ>
            bacterial membrane  --- Certainty = 0.0000(Not Clear)   < succ>
             bacterial outside  --- Certainty = 0.0000(Not Clear)   < succ>
```

No corresponding DNA sequence was identified in *S. pyogenes*.

Based on this analysis, it was predicted that this protein and its epitopes, could be useful antigens for vaccines or diagnostics.

EXAMPLE 2356

A DNA sequence (GBSx2511) was identified in *S. agalactiae* <SEQ ID 7205> which encodes the amino acid sequence <SEQ ID 7206>. This protein is predicted to be surface protein Rib. Analysis of this protein sequence reveals the following:

```
Possible site: 24
>>> Seems to have no N-terminal signal sequence

----- Final Results -----
          bacterial cytoplasm --- Certainty = 0.1892(Affirmative) < succ>
          bacterial membrane  --- Certainty = 0.0000(Not Clear)   < succ>
          bacterial outside   --- Certainty = 0.0000(Not Clear)   < succ>
```

No corresponding DNA sequence was identified in *S. pyogenes*.

Based on this analysis, it was predicted that this protein and its epitopes, could be useful antigens for vaccines or diagnostics.

EXAMPLE 2357

A DNA sequence (GBSx2512) was identified in *S. agalactiae* <SEQ ID 7207> which encodes the amino acid sequence <SEQ ID 7208>. Analysis of this protein sequence reveals the following:

```
Possible site: 28
>>> Seems to have no N-terminal signal sequence

----- Final Results -----
          bacterial cytoplasm --- Certainty = 0.0999(Affirmative) < succ>
          bacterial membrane  --- Certainty = 0.0000(Not Clear)   < succ>
          bacterial outside   --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 2358

A DNA sequence (GBSx2514) was identified in *S. agalactiae* <SEQ ID 7209> which encodes the amino acid sequence <SEQ ID 7210>. This protein is predicted to be surface protein Rib. Analysis of this protein sequence reveals the following:

```
Possible site: 24
>>> Seems to have no N-terminal signal sequence

----- Final Results -----
          bacterial cytoplasm --- Certainty = 0.1892(Affirmative) < succ>
          bacterial membrane  --- Certainty = 0.0000(Not Clear)   < succ>
          bacterial outside   --- Certainty = 0.0000(Not Clear)   < succ>
```

No corresponding DNA sequence was identified in *S. pyogenes*.

Based on this analysis, it was predicted that this protein and its epitopes, could be useful antigens for vaccines or diagnostics.

EXAMPLE 2359

A DNA sequence (GBSx2515) was identified in *S. agalactiae* <SEQ ID 7211> which encodes the amino acid sequence <SEQ ID 7212>. Analysis of this protein sequence reveals the following:

```
Possible site: 19
>>> Seems to have no N-terminal signal sequence

----- Final Results -----
          bacterial cytoplasm --- Certainty = 0.2041(Affirmative) < succ>
          bacterial membrane  --- Certainty = 0.0000(Not Clear)   < succ>
          bacterial outside   --- Certainty = 0.0000(Not Clear)   < succ>
```

The protein has no significant homology with any sequences in the GENPEPT database.

No corresponding DNA sequence was identified in *S. pyogenes*.

Based on this analysis, it was predicted that this protein and its epitopes, could be useful antigens for vaccines or diagnostics.

EXAMPLE 2360

A DNA sequence (GBSx2516) was identified in *S. agalactiae* <SEQ ID 7213> which encodes the amino acid sequence <SEQ ID 7214>. This protein is predicted to be 30S ribosomal protein S6 (rpsF). Analysis of this protein sequence reveals the following:

```
Possible site: 51
>>> Seems to have no N-terminal signal sequence

----- Final Results -----
          bacterial cytoplasm --- Certainty = 0.3607(Affirmative) < succ>
          bacterial membrane  --- Certainty = 0.0000(Not Clear)   < succ>
          bacterial outside   --- Certainty = 0.0000(Not Clear)   < succ>
```

A related GBS nucleic acid sequence <SEQ ID 9423> which encodes amino acid sequence <SEQ ID 9424> was also identified.

The protein has homology with the following sequences in the GENPEPT database.

```
>GP: CAB16128 GB: Z99124 ribosomal protein S6 (BS9) [Bacillus subtilis]
Identities = 41/72 (56%), Positives = 58/72 (79%), Gaps = 1/72 (1%)

Query:   1 MVARFDSILSDNGATVVESKDWEKRRLAYEIQDFTEGLYHIVNVEAEDAVALNEFDRLSK   60
           ++ RF+++L+ NGA +  +KDW KRRLAYEI DF +G Y IVNV++ DA A+ EFDRL+K
Sbjct:  22 VIERFNNVLTSNGAEITGTKDWGKRRLAYEINDFRDGFYQIVNVQS-DAAAVQEFDRLAK   80

Query:  61 INGDILRHMIVK                                                 72
           I+ DI+RH++VK
Sbjct:  81 ISDDIIRHIVVK                                                 92
```

A related DNA sequence was identified in *S. pyogenes* <SEQ ID 7215> which encodes the amino acid sequence <SEQ ID 7216>. Analysis of this protein sequence reveals the following:

```
Possible site: 40
>>> Seems to have no N-terminal signal sequence

----- Final Results -----
          bacterial cytoplasm --- Certainty = 0.2720(Affirmative) < succ>
          bacterial membrane  --- Certainty = 0.0000(Not Clear)   < succ>
          bacterial outside   --- Certainty = 0.0000(Not Clear)   < succ>
```

An alignment of the GAS and GBS proteins is shown below.

```
Identities = 66/74 (89%), Positives = 70/74 (94%)

Query:    1 MVARFDSILSDNGATVVESKDWEKRRLAYEIQDFTEGLYHIVNVEAEDAVALNEFDRLSK   60
            +VARFDSIL+DNGATVVESKDWEKRRLAYEI DF EGLYHIVN+EA DA ALNEFDRLSK
Sbjct:   22 LVARFDSILTDNGATVVESKDWEKRRLAYEINDFREGLYHIVNLEATDAAALNEFDRLSK   81

Query:   61 INGDILRHMIVKVD                                                74
            INGDILRHMIVK+D
Sbjct:   82 INGDILRHMIVKLD                                                95
```

Based on this analysis, it was predicted that these proteins and their epitopes could be useful antigens for vaccines or diagnostics.

EXAMPLE 2361

A DNA sequence (GBSx2518) was identified in *S. agalactiae* <SEQ ID 7219> which encodes the amino acid sequence <SEQ ID 7220>. This protein is predicted to be surface protein Rib. Analysis of this protein sequence reveals the following:

```
Possible site: 49
>>> Seems to have no N-terminal signal sequence

----- Final Results -----
          bacterial cytoplasm --- Certainty = 0.5289(Affirmative) < succ>
          bacterial membrane  --- Certainty = 0.0000(Not Clear)   < succ>
           bacterial outside  --- Certainty = 0.0000(Not Clear)   < succ>
```

No corresponding DNA sequence was identified in *S. pyogenes*.

Based on this analysis, it was predicted that this protein and its epitopes, could be useful antigens for vaccines or diagnostics.

EXAMPLE 2362

A DNA sequence (GASx1R) was identified in *S. pyogenes* <SEQ ID 7221> which encodes the amino acid sequence <SEQ ID 7222>. Analysis of this protein sequence reveals the following:

```
Possible site: 33
>>> Seems to have an uncleavable N-term signal seq

----- Final Results -----
           bacterial membrane  --- Certainty = 0.0000(Not Clear) < succ>
            bacterial outside  --- Certainty = 0.0000(Not Clear) < succ>
          bacterial cytoplasm  --- Certainty = 0.0000(Not Clear) < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2363

A DNA sequence (GASx5R) was identified in *S. pyogenes* <SEQ ID 7223> which encodes the amino acid sequence <SEQ ID 7224>. Analysis of this protein sequence reveals the following:

```
Possible site: 20
>>> Seems to have an uncleavable N-term signal seq

----- Final Results -----
           bacterial membrane  --- Certainty = 0.0000(Not Clear) < succ>
            bacterial outside  --- Certainty = 0.0000(Not Clear) < succ>
          bacterial cytoplasm  --- Certainty = 0.0000(Not Clear) < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2364

A DNA sequence (GASx11) was identified in *S. pyogenes* <SEQ ID 7225> which encodes the amino acid sequence <SEQ ID 7226>. Analysis of this protein sequence reveals the following:

```
Possible site: 22
>>> Seems to have no N-terminal signal sequence

----- Final Results -----
            bacterial cytoplasm --- Certainty = 0.2614(Affirmative) < succ>
            bacterial membrane  --- Certainty = 0.0000(Not Clear)   < succ>
            bacterial outside   --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2365

A DNA sequence (GASx17) was identified in *S. pyogenes* <SEQ ID 7227> which encodes the amino acid sequence <SEQ ID 7228>. Analysis of this protein sequence reveals the following:

```
Possible site: 30
>>> Seems to have no N-terminal signal sequence

----- Final Results -----
            bacterial cytoplasm --- Certainty = 0.2849(Affirmative) < succ>
            bacterial membrane  --- Certainty = 0.0000(Not Clear)   < succ>
            bacterial outside   --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2366

A DNA sequence (GASx18) was identified in *S. pyogenes* <SEQ ID 7229> which encodes the amino acid sequence <SEQ ID 7230>. Analysis of this protein sequence reveals the following:

```
Possible site: 30
>>> Seems to have no N-terminal signal sequence

----- Final Results -----
            bacterial cytoplasm --- Certainty = 0.2099(Affirmative) < succ>
            bacterial membrane  --- Certainty = 0.0000(Not Clear)   < succ>
            bacterial outside   --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2367

A DNA sequence (GASx34) was identified in *S. pyogenes* <SEQ ID 7231> which encodes the amino acid sequence <SEQ ID 7232>. Analysis of this protein sequence reveals the following:

```
Possible site: 54
>>> Seems to have no N-terminal signal sequence

----- Final Results -----
            bacterial cytoplasm --- Certainty = 0.0801(Affirmative) < succ>
            bacterial membrane  --- Certainty = 0.0000(Not Clear)   < succ>
              bacterial outside --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2368

A DNA sequence (GASx38) was identified in *S. pyogenes* <SEQ ID 7233> which encodes the amino acid sequence <SEQ ID 7234>. Analysis of this protein sequence reveals the following:

```
Possible site: 18
>>> Seems to have an uncleavable N-term signal seq

----- Final Results -----
             bacterial membrane --- Certainty = 0.0000(Not Clear) < succ>
              bacterial outside --- Certainty = 0.0000(Not Clear) < succ>
            bacterial cytoplasm --- Certainty = 0.0000(Not Clear) < succ>
```

No corresponding DNA sequence was identified in *S. agalactiae*.

The protein has homology with the following sequences in the GENPEPT database:

```
>GP: CAB12617 GB: Z99108 similar to protein-tyrosine phosphatase
[Bacillus subtilis]
Identities = 57/155 (36%), Positives = 88/155 (56%), Gaps = 12/155 (7%)

Query:    1 MKKVCFVCLGNICRSPMAEFVMKSIVS----SDVMMIESRATSDWEHGNPIHSGTQSILK   56
            M   V FVCLGNICRSPMAE + + +         + +S      W   GNP H GTQ IL+
Sbjct:    1 MISVLFVCLGNICRSPMAEAIFRDLAAKKGLEGKIKADSAGIGGWHIGNPPHEGTQEILR   60

Query:   57 TYQINYDITKCSKQITITDFNTFDYIIGMDSDNVKNLKEMSQHQWDSKIYLFRE------  110
            I++D    ++Q++    D + FDYII MD++N+ +L+ M+   +   S I      +
Sbjct:   61 REGISFD-GMLARQVSEQDLDDFDYIIAMDAENIGSLRSMAGFKNTSHIKRLLDYVEDSD  119

Query:  111 -GGVPDPWYTNDFEETYQLVRKGCQDWLSRLMSKE                          144
              VPDP+YT +FEE   QL++ GC+  L+ +    ++
Sbjct:  120 LADVPDPYYTGNFEEVCQLIKTGCEQLLASIQKEK                          154
```

Based on this analysis, it was predicted that this GAS-specific protein and its epitopes, could be useful antigens for vaccines or diagnostics.

EXAMPLE 2369

A DNA sequence (GASx42R) was identified in *S. pyogenes* <SEQ ID 7235> which encodes the amino acid sequence <SEQ ID 7236>. Analysis of this protein sequence reveals the following:

```
Possible site: 14
>>> Seems to have no N-terminal signal sequence

----- Final Results -----
           bacterial cytoplasm --- Certainty = 0.4753(Affirmative) < succ>
           bacterial membrane  --- Certainty = 0.0000(Not Clear)   < succ>
           bacterial outside   --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2370

A DNA sequence (GASx47R) was identified in *S. pyogenes* <SEQ ID 7237> which encodes the amino acid sequence <SEQ ID 7238>. Analysis of this protein sequence reveals the following:

```
Possible site: 58
>>> Seems to have no N-terminal signal sequence

----- Final Results -----
           bacterial cytoplasm --- Certainty = 0.2014(Affirmative) < succ>
           bacterial membrane  --- Certainty = 0.0000(Not Clear)   < succ>
           bacterial outside   --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2371

A DNA sequence (GASx53R) was identified in *S. pyogenes* <SEQ ID 7239> which encodes the amino acid sequence <SEQ ID 7240>. Analysis of this protein sequence reveals the following:

```
Possible site: 45
>>> Seems to have no N-terminal signal sequence
      INTEGRAL     Likelihood = -0.11    Transmembrane     56-72 (56-72)

----- Final Results -----
           bacterial membrane  --- Certainty = 0.1044(Affirmative) < succ>
           bacterial outside   --- Certainty = 0.0000(Not Clear)   < succ>
           bacterial cytoplasm --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2372

A DNA sequence (GASx67R) was identified in *S. pyogenes* <SEQ ID 7241> which encodes the amino acid sequence <SEQ ID 7242>. Analysis of this protein sequence reveals the following:

```
Possible site: 39
>>> Seems to have no N-terminal signal sequence

----- Final Results -----
          bacterial cytoplasm --- Certainty = 0.1610(Affirmative) < succ>
          bacterial membrane  --- Certainty = 0.0000(Not Clear)   < succ>
          bacterial outside   --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2373

A DNA sequence (GASx75) was identified in *S. pyogenes* <SEQ ID 7243> which encodes the amino acid sequence <SEQ ID 7244>. Analysis of this protein sequence reveals the following:

```
Possible site: 31
>>> Seems to have no N-terminal signal sequence

----- Final Results -----
          bacterial cytoplasm --- Certainty = 0.2803(Affirmative) < succ>
          bacterial membrane  --- Certainty = 0.0000(Not Clear)   < succ>
          bacterial outside   --- Certainty = 0.0000(Not Clear)   < succ>
```

No corresponding DNA sequence was identified in *S. agalactiae*.

The protein has homology with the following sequences in the GENPEPT database:

```
>GP: CAA41942 GB: X59250 ribosomal
protein B [Lactococcus lactis]
Identities = 37/38 (97%), Positives = 37/38 (97%)

Query: 1 MKVRPSVKPICEYCKVIRRNGRVMVICPTNPKHKQRQG 38
         MKVRPSVKPICEYCKVIRRNGRVMVICP NPKHKQRQG
Sbjct: 1 MKVRPSVKPICEYCKVIRRNGRVMVICPANPKHKQRQG 38
```

Based on this analysis, it was predicted that this GAS-specific protein and its epitopes, could be useful antigens for vaccines or diagnostics.

EXAMPLE 2374

A DNA sequence (GASx76) was identified in *S. pyogenes* <SEQ ID 7245> which encodes the amino acid sequence <SEQ ID 7246>. Analysis of this protein sequence reveals the following:

```
Possible site: 35
>>> Seems to have no N-terminal signal sequence

----- Final Results -----
          bacterial cytoplasm --- Certainty = 0.0824(Affirmative) < succ>
          bacterial membrane  --- Certainty = 0.0000(Not Clear)   < succ>
          bacterial outside   --- Certainty = 0.0000(Not Clear)   < succ>
```

No corresponding DNA sequence was identified in *S. aga-lactiae*.

The protein has homology with the following sequences in the GENPEPT database:

```
>GP: AAB06824 GB: L47971 ribosomal protein S13 [Bacillus subtilis]
Identities = 86/121 (71%), Positives = 103/121 (85%)

Query:   1 MARIAGVDIPNDKRVVISLTYVYGIGLATSKKILAAAGISEDIRVKDLTSDQEDAIRREV    60
           MARIAGVDIP DKRVVISLTY++GIG  T++++L  AG+SED RV+DLT ++   IR +
Sbjct:   1 MARIAGVDIPRDKRVVISLTYIFGIGRTTAQQVLKEAGVSEDTRVRDLTEEELGKIRDII   60

Query:  61 DAIKVEGDLRREVNMNIKRLMEIGSYRGIRHRRGLPVRGQNTKNNARTRKGKAVAIAGKKK  121
           D +KVEGDLRREV++NIKRL+EIGSYRGIRHRRGLPVRGQN+KNNARTRKG    +A KKK
Sbjct:  61 DKLKVEGDLRREVSLNIKRLIEIGSYRGIRHRRGLPVRGQNSKNNARTRKGPRRTVANKKK  121
```

Based on this analysis, it was predicted that this GAS-specific protein and its epitopes, could be useful antigens for vaccines or diagnostics.

EXAMPLE 2375

A DNA sequence (GASx81R) was identified in *S. pyogenes* <SEQ ID 7247> which encodes the amino acid sequence <SEQ ID 7248>. Analysis of this protein sequence reveals the following:

```
Possible site: 21
>>> Seems to have no N-terminal signal sequence

----- Final Results -----
          bacterial cytoplasm --- Certainty = 0.1842(Affirmative) < succ>
           bacterial membrane --- Certainty = 0.0000(Not Clear)  < succ>
            bacterial outside --- Certainty = 0.0000(Not Clear)  < succ>
```

No corresponding DNA sequence was identified in *S. aga-lactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2376

A DNA sequence (GASx82) was identified in *S. pyogenes* <SEQ ID 7249> which encodes the amino acid sequence <SEQ ID 7250>. Analysis of this protein sequence reveals the following:

```
Possible site: 59
>>> Seems to have no N-terminal signal sequence

----- Final Results -----
          bacterial cytoplasm --- Certainty = 0.3613(Affirmative) < succ>
           bacterial membrane --- Certainty = 0.0000(Not Clear)  < succ>
            bacterial outside --- Certainty = 0.0000(Not Clear)  < succ>
```

No corresponding DNA sequence was identified in *S. aga-lactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2377

A DNA sequence (GASx83) was identified in *S. pyogenes* <SEQ ID 7251> which encodes the amino acid sequence <SEQ ID 7252>. Analysis of this protein sequence reveals the following:

```
Possible site: 51
>>> Seems to have no N-terminal signal sequence
```

```
----- Final Results -----
          bacterial cytoplasm --- Certainty = 0.1141(Affirmative) < succ>
          bacterial membrane  --- Certainty = 0.0000(Not Clear)   < succ>
          bacterial outside   --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2378

A DNA sequence (GASx85) was identified in *S. pyogenes* <SEQ ID 7253> which encodes the amino acid sequence <SEQ ID 7254>. Analysis of this protein sequence reveals the following:

```
Possible site: 16
>>> Seems to have no N-terminal signal sequence

----- Final Results -----
          bacterial cytoplasm --- Certainty = 0.2280(Affirmative) < succ>
          bacterial membrane  --- Certainty = 0.0000(Not Clear)   < succ>
          bacterial outside   --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2379

A DNA sequence (GASx89R) was identified in *S. pyogenes* <SEQ ID 7255> which encodes the amino acid sequence <SEQ ID 7256>. Analysis of this protein sequence reveals the following:

```
Possible site: 44
>>> Seems to have no N-terminal signal sequence

----- Final Results -----
          bacterial cytoplasm --- Certainty = 0.3040(Affirmative) < succ>
          bacterial membrane  --- Certainty = 0.0000(Not Clear)   < succ>
          bacterial outside   --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2380

A DNA sequence (GASx102) was identified in *S. pyogenes* <SEQ ID 7257> which encodes the amino acid sequence <SEQ ID 7258>. Analysis of this protein sequence reveals the following:

```
Possible site: 33
>>> Seems to have an uncleavable N-term signal seq
      INTEGRAL    Likelihood = -13.75    Transmembrane    21-37 (12-41)

----- Final Results -----
          bacterial membrane  --- Certainty = 0.6498(Affirmative) < succ>
          bacterial outside   --- Certainty = 0.0000(Not Clear)   < succ>
          bacterial cytoplasm --- Certainty = 0.0000(Not Clear)   < succ>
```

No corresponding DNA sequence was identified in *S. agalactiae*.

The protein has homology with the following sequences in the GENPEPT database:

```
>GP: AAC45312 GB: U81957 ComYC [Streptococcus gordonii]
Identities = 59/104 (56%), Positives = 85/104 (81%), Gaps = 1/104 (0%)

Query:     6 NNLRHKKLKGFTLLEMLLVILVISVLMLLFVPNLSKQKDRVTETGNAAVVKLVENQAELY    65
             N L+   ++K FTL+EML+V+L+ISVLMLLFVPNL+KQK+ V++TGNAAVVK+VE+QAELY
Sbjct:     2 NKLKKLRVKAFTLVEMLVVLLIISVLMLLFVPNLTKQKEAVSDTGNAAVVKVVESQAELY    61

Query:    66 EL-SQGSKPSLSQLKADGSITEKQEKAYQDYYDKHKNEKARLSN                 108
             EL + G + +LS+L A G+I++KQ  +Y+ YY K+ +E    ++N
Sbjct:    62 ELKNTGDQATLSKLVAAGNISQKQADSYKAYYGKNNSETQAVAN                 105
```

Based on this analysis, it was predicted that this GAS-specific protein and its epitopes, could be useful antigens for vaccines or diagnostics.

EXAMPLE 2381

A DNA sequence (GASx103) was identified in *S. pyogenes* <SEQ ID 7259> which encodes the amino acid sequence <SEQ ID 7260>. Analysis of this protein sequence reveals the following:

```
Possible site: 24
>>> Seems to have a cleavable N-term signal seq.

----- Final Results -----
             bacterial outside --- Certainty = 0.3000(Affirmative) < succ>
            bacterial membrane --- Certainty = 0.0000(Not Clear)   < succ>
            bacterial cytoplasm --- Certainty = 0.0000(Not Clear)  < succ>
```

No corresponding DNA sequence was identified in *S. agalactiae*.

The protein has homology with the following sequences in the GENPEPT database:

```
>GP: AAC23740 GB: AF052207 competence protein [Streptococcus pneumoniae]
Identities = 52/131 (39%), Positives = 76/131 (57%)

Query:     8 IKAFTLLETLLSLSVMSFIILGLSVPVTKSYQKVEEHLFFSHFEHLYRHQQKLAILQQKQ    67
             IKAFT+LE+LL L ++S + LGLS  V  ++  VEE +FF  FE LYR  QK ++  Q++
Sbjct:     2 IKAFTMLESLLVLGLVSILALGLSGSVQSTFSAVEEQIFFMEFEELYRETQKRSVASQQK    61

Query:    68 RVLDISSTKIVTEGNSLTVPKSITVNHPYRLVIDQMGGNHSLAKIIFDMTDRRFKYQFYL   127
             L++    I     LTVPK I      + D+ GGN SLAK+ F +    +YQ YL
Sbjct:    62 TSLNLDGQMISNGSQKLTVPKGIQAPSGQSITFDRAGGNSSLAKVEFQTSKGAIRYQLYL   121

Query:   128 GSGNYQKTSQS                                                  138
             G+G  ++  ++
Sbjct:   122 GNGKIKRIKET                                                  132
```

Based on this analysis, it was predicted that this GAS-specific protein and its epitopes, could be useful antigens for vaccines or diagnostics.

EXAMPLE 2382

A DNA sequence (GASx104) was identified in *S. pyogenes* <SEQ ID 7261> which encodes the amino acid sequence <SEQ ID 7262>. Analysis of this protein sequence reveals the following:

```
Possible site: 23
>>> Seems to have a cleavable N-term signal seq.
```

```
----- Final Results -----
         bacterial outside --- Certainty = 0.3000(Affirmative) < succ>
         bacterial membrane --- Certainty = 0.0000(Not Clear)   < succ>
         bacterial cytoplasm --- Certainty = 0.0000(Not Clear)  < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2383

A DNA sequence (GASx109) was identified in *S. pyogenes* <SEQ ID 7265> which encodes the amino acid sequence <SEQ ID 7266>. Analysis of this protein sequence reveals the following:

```
Possible site: 45
>>> Seems to have no N-terminal signal sequence
     INTEGRAL    Likelihood = -10.51    Transmembrane    37-53 (28-58)
     INTEGRAL    Likelihood =  -3.56    Transmembrane    61-77 (60-77)

----- Final Results -----
         bacterial membrane  --- Certainty = 0.5203(Affirmative) < succ>
         bacterial outside   --- Certainty = 0.0000(Not Clear)   < succ>
         bacterial cytoplasm --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2384

A DNA sequence (GASx115R) was identified in *S. pyogenes* <SEQ ID 7267> which encodes the amino acid sequence <SEQ ID 7268>. Analysis of this protein sequence reveals the following:

```
Possible site: 18
>>> Seems to have an uncleavable N-term signal seq
     INTEGRAL    Likelihood = -11.09    Transmembrane    20-36 (13-40)

----- Final Results -----
         bacterial membrane  --- Certainty = 0.5437(Affirmative) < succ>
         bacterial outside   --- Certainty = 0.0000(Not Clear)   < succ>
         bacterial cytoplasm --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2385

A DNA sequence (GASx124) was identified in *S. pyogenes* <SEQ ID 7269> which encodes the amino acid sequence <SEQ ID 7270>. Analysis of this protein sequence reveals the following:

```
Possible site: 52
>>> Seems to have no N-terminal signal sequence
     INTEGRAL    Likelihood = -8.17    Transmembrane     31-47 (29-59)
     INTEGRAL    Likelihood = -5.63    Transmembrane    737-753 (734-756)
```

-continued
```
----- Final Results -----
            bacterial membrane --- Certainty = 0.4270(Affirmative) < succ>
            bacterial outside  --- Certainty = 0.0000(Not Clear)   < succ>
           bacterial cytoplasm --- Certainty = 0.0000(Not Clear)   < succ>
```

No corresponding DNA sequence was identified in *S. agalactiae*.

The protein has homology with the following sequences in the GENPEPT database:

```
>GP: AAC97148 GB: U49397 Cpa [Streptococcus pyogenes]
Identities = 401/737 (54%), Positives = 517/737 (69%), Gaps = 25/737 (3%)

Query:  25 SKNSKR--FTVTLVGVFLMIFALVTSMVGAKTVFGLVESSTPNAINPDSSSEYRWYGYES    82
           S N+KR   T+ L+ VFL   AL+  +  +   FG  E S PN      S  +Y WYGY+S
Sbjct:  11 SANNKRRQTTIGLLKVFLTFVALIGIVGFSIRAFGAEEQSVPN--RQSSIQDYPWYGYDS    68

Query:  83 YVRGHPYYKQFRVAHDLRVNLEGSRSYQVYCFNLKKAFPLGSDSSVKKWYKKHDGISTKF   142
           Y +G+P Y   +  H+L+VNLEGS+ YQ YCFNL K FP  SDS   +WYKK +G +  F
Sbjct:  69 YPKGYPDYSPLKTYHNLKVNLEGSKDYQAYCFNLTKHFPSKSDSVRSQWYKKLEGTNENF   128

Query: 143 EDYAMSPRITGDELNQKLRAVMYNGHPQNANGIMEGLEPLNAIRVTQEAVWYYSDNAPIS   202
              A  PRI  +L Q +   ++YNG+P N NGIM+G++PLNAI VTQ A+W Y+D+A I
Sbjct: 129 IKLADKPRIEDGQLQQNILRILYNGYPNNRNGIMKGIDPLNAILVTQNAIW-YTDSAQI-   186

Query: 203 NPDESFKRESESNLVSTSQLSLMRQALKQLIDPNLATKMPKQVPDDFQLSIFESEDKGDK   262
           NPDESFK E+ SN ++  QL LMR+ALK+LIDPNL +K   + P  ++L++FES D
Sbjct: 187 NPDESFKTEARSNGINDQQLGLMRKALKELIDPNLGSKYSNKTPSGYRLNVFESHD----   242

Query: 263 YNKGYQNLLSGGLVPTKPPTPGDPPMPPNQPQTTSVLIRKYAIGDYSKLLEGATLQLTGD   322
              K +QNLLS    VP  PP PG+   PP + + TSV+IRKYA GD SKLLEGATL+L+
Sbjct: 243 --KPFQNLLSAEYVPDTPPKPGEE--PPAKTEKTSVIIRKYAEGD-SKLLEGATLKLSQI   297

Query: 323 NVNSFQARVFSSNDIGERIELSDGTYTLTELNSPAGYSIAEPITFKVEAGKVYTI-IDGK   381
            + FQ + F SN +GE +EL +GTYTLTE +SP GY IAEPI F+VE  KV+ +  DG
Sbjct: 298 EGSGFQEKDFQSNSLGETVELPNGTYTLTETSSPDGYKIAEPIKFRVENKKVFIVQKDGS   357

Query: 382 QIENPNKEIVEPYSVEAYNDFEEFSVLT-TQNYAKFYYAKNKNGSSQVVYCFNADLKSPP   440
           Q+ENPNKE+ EPYSVEAYNDF +  VL+    Y KFYYA NK+ SSQVVYCFNADL SPP
Sbjct: 358 QVENPNKEVAEPYSVEAYNDFMDEEVLSGFTPYGKFYYATNKDKSSQVVYCFNADLHSPP   417

Query: 441 DSEDGGKTMTPDFTT-GEVKYTHIAGRDLFKYTVKPRDTDPDTFLKHIKKVIEKGYREKG   499
           DS D G+T+ PD +T  EVKYTH AG DLFKY ++PRDT+P+ FLKHIKKVIEKGY++KG
Sbjct: 418 DSYDSGETINPDTSTMKEVKYTHTAGSDLFKYALRPRDTNPEDFLKHIKKVIEKGYKKKG   477

Query: 500 QAIEYSGLTETQLRAATQLAIYYFTDSAELDKDKL----KDYHGFGDMNDSTLAVAKILV   555
            + Y+GLTETQ RAATQLAIYYFTDSA+L  K       K YHGF  M++ TLAV K L+
Sbjct: 478 DS--YNGLTETQFRAATQLAIYYFTDSADLKTLKTYNNGKGYHGFESMDEKTLAVTKELI   535

Query: 556 EYAQDSNPPQLTDLDFFIPNNNKYQSLIGTQWHPEDLVDIIRMEDKK-EVIPVTHNLTLR   614
             YAQ+   PQLT+LDFF+PNN+K QSLIGT+ HP+DLVD+IRMEDKK EVIPVTH+LT++
Sbjct: 536 TYAQNGSAPQLTNLDFFVPNNSKDQSLIGTECHPDDLVDVIRMEDKKQEVIPVTHSLTVK   595

Query: 615 KTVTGLAGDRTKDFHFEIELKNNKQELLSQTVKTDKTNLEFKDGKATINLKHGESLTLQG   674
           KTV G  GD+TK F FE+ELK+  +  +  T+KT+ +L  KDGK + NLKHG+++  ++G
Sbjct: 596 KTVVGELGDKTKGFQFELELKDKTGQPIVNTLKTNNQDLVAKDGKYSFNLKHGDTIRIEG   655

Query: 675 LPEGYSYLVKETDSEGYKVKVNSQEVANATVSKTGITSDETLAFENNKEPVVPTGVDQKI   734
           LP GYSY +KE +++ Y V V+++   A      IT D+ + FEN K+ V PTG+
Sbjct: 656 LPTGYSYTLKEAEAKDYIVTVDNKVSQEAQSVGKDITEDKKVTFENRKDLVPPTGLTTDG   715

Query: 735 NGYLALIVIAGISLGIW                                             751
             YL L+++   L +W
Sbjct: 716 AIYLWLLLLVPLGLLVW                                             732
```

Based on this analysis, it was predicted that this GAS-specific protein and its epitopes, could be useful antigens for vaccines or diagnostics.

EXAMPLE 2386

A DNA sequence (GASx125R) was identified in *S. pyogenes* <SEQ ID 7271> which encodes the amino acid sequence <SEQ ID 7272>. Analysis of this protein sequence reveals the following:

```
Possible site: 40
>>> Seems to have no N-terminal signal sequence

----- Final Results -----
            bacterial cytoplasm --- Certainty = 0.2604(Affirmative) < succ>
            bacterial membrane  --- Certainty = 0.0000(Not Clear)   < succ>
             bacterial outside  --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2387

A DNA sequence (GASx126) was identified in *S. pyogenes* <SEQ ID 7273> which encodes the amino acid sequence <SEQ ID 7274>. Analysis of this protein sequence reveals the following:

```
Possible site: 14
>>> Seems to have no N-terminal signal sequence

----- Final Results -----
            bacterial cytoplasm --- Certainty = 0.1537(Affirmative) < succ>
            bacterial membrane  --- Certainty = 0.0000(Not Clear)   < succ>
             bacterial outside  --- Certainty = 0.0000(Not Clear)   < succ>
```

No corresponding DNA sequence was identified in *S. agalactiae*.

The protein has homology with the following sequences in the GENPEPT database:

```
>GP: AAC97149 GB: U49397 LepA [Streptococcus pyogenes]
Identities = 59/132 (44%), Positives = 84/132 (62%), Gaps = 5/132 (3%)

Query:   1 MIIKRNDMAPSVKAGDAILFYRLSQTYKVEEAVVYEDSKTSITKVGRIIAQAGDEVDLTE    60
           MII NDM+P++ AGD +L+YRL+   + + VVYE   T   KVGRI AQAGDEV+ T+
Sbjct:  42 MIINTNDMSPALSAGDGVLYYRLADRSHINDVVVYEVDNT--LKVGRIAAQAGDEVNFTQ    99

Query:  61 QGELKINGHIQNEG---LTFIKSREANYPYRIADNSYLILNDYYSQESENYLQDAIAKDA   117
           +G L INGH   +     LT+ S  N+PY++   +Y ILNDY + ++     A+ +
Sbjct: 100 EGGLLINGHPPEKEVPYLTYPHSSGPNFPYKVPTGTYFILNDYREERLDSRYYGALPINQ   159

Query: 118 IKGTINTLIRLR                                                  129
           IKG I+TL+R+R
Sbjct: 160 IKGKISTLLRVR                                                  171
```

Based on this analysis, it was predicted that this GAS-specific protein and its epitopes, could be useful antigens for vaccines or diagnostics.

EXAMPLE 2388

A DNA sequence (GASx127) was identified in *S. pyogenes* <SEQ ID 7275> which encodes the amino acid sequence <SEQ ID 7276>. Analysis of this protein sequence reveals the following:

```
Possible site: 17
>>> Seems to have a cleavable N-term signal seq.
      INTEGRAL    Likelihood = -3.93      Transmembrane   312-328 (311-337)

----- Final Results -----
            bacterial membrane  --- Certainty = 0.2572(Affirmative) < succ>
             bacterial outside  --- Certainty = 0.0000(Not Clear)   < succ>
            bacterial cytoplasm --- Certainty = 0.0000(Not Clear)   < succ>
```

No corresponding DNA sequence was identified in *S. agalactiae*.

The protein has homology with the following sequences in the GENPEPT database:

```
>GP: AAC97152 GB: U49397 unknown [Streptococcus pyogenes]
Identities = 125/355 (35%), Positives = 191/355 (53%), Gaps = 26/355 (7%)

Query:   1 MKLRHLLLTGAALTSFA-----ATTVHGET--VVNGAKLTVTKNL-DLVNSNALIPNTDF    52
           MK  LLL  A L +       + + ET V++G+ L V K     + N L+P D+
Sbjct:   1 MKKNKLLLATAILATALGMASMSQNIKAETAGVIDGSTLVVKKTFPSYTDDNVLMPKADY    60
```

```
Query:   53 TFKIEPDTTVN---EDGNKFK-GVALNTPMTK-VTYTNSDKGGSNTKTAEFDFSEVTFEK  107
            +FK+E D       +DG  K GV        TK + Y+NSDK  +  K+  F+F+ V F
Sbjct:   61 SFKVEADDNAKGKTKDGLDIKPGVIDGLENTKTIRYSNSDKITAKEKSVNFEFANVKFPG  120

Query:  108 PGVYYYKVTEEKIDKVPGVSYDTTSYTVQVHVLWNEEQQKPVATYIVGYKEGS--KVPIQ  165
               GVY Y V E   +K  G++YD+   +TV V+V+ N+E       YIV   + G     K P+
Sbjct:  121 VGVYRYTVAEVNGNKA-GITYDSQQWTVDVYVV-NKEGGGFEVKYIVSTEVGQSEKKPVL  178

Query:  166 FKNSLDSTTLTVKKKVSGTGGDRSKDFNFGLTLKANQYYKASEKVMIEKTTKGGQAPVQT  225
               FKNS D+T+L ++K+V+G  G+   + F+F L L   N+ +       EK   +   +GG+
Sbjct:  179 FKNSFDTTSLKIEKQVTGNTGEHQRLFSFTLLLTPNECF---EKGQVVNILQGGETK---  232

Query:  226 EASIDQLYHFTLKDGESIKVTNLPVGVDYVVTEDDYKSEKYTTNVEVSPQDGAVKNIAGN  285
                + I + Y FTLKD   S+ ++ LPVG++Y +TE+D    + Y T+  +      + +        G
Sbjct:  233 KVVIGEEYSFTLKDKGSVTLSQLPVGIEYKLTEEDVTKDGYKTSATLKDGEQSSTYELGK  292

Query:  286 STEQETSTDKDMTITFTNKKDFEVPTGVAMTVAPYIALGIVAVGGALYFVKKKNA       340
               + + S D+    I    TNK+D +VPTGV   T+AP+   L IVA+GG +Y   K+K A
Sbjct:  293 DHKTDKSADE---IVVTNKRDTQVPTGVVGTLAPFAVLSIVAIGGVIYITKRKKA       344
```

Based on this analysis, it was predicted that this GAS-specific protein and its epitopes, could be useful antigens for vaccines or diagnostics.

EXAMPLE 2389

A DNA sequence (GASx128) was identified in *S. pyogenes* <SEQ ID 7277> which encodes the amino acid sequence <SEQ ID 7278>. Analysis of this protein sequence reveals the following:

```
Possible site: 44
>>> Seems to have a cleavable N-term signal seq.

----- Final Results -----
              bacterial outside  --- Certainty = 0.3000(Affirmative) < succ>
              bacterial membrane --- Certainty = 0.0000(Not Clear)   < succ>
              bacterial cytoplasm --- Certainty = 0.0000(Not Clear)  < succ>
```

No corresponding DNA sequence was identified in *S. agalactiae*.

The protein has homology with the following sequences in the GENPEPT database:

```
>GP: AAC97152 GB: U49397 unknown [Streptococcus pyogenes]
Identities = 115/240 (47%), Positives = 178/240 (73%), Gaps = 3/240 (1%)

Query:    1 MIVRLIKLLDKLINVIVLCFFFLCLLIAALGIYDALTVYQGANATNYQQYKKKGVQ--FD   58
              M++ ++++++K I+ ++L F  + L +A  G++D+   +YQ A+A+N++++K     Q   F+
Sbjct:  351 MMMTIVQVINKAIDTLILIFCLVVLFLAGFGLWDSYHLYQQADASNFKKFKTAQQQPKFE  410

Query:   59 DLLAINSDVMAWLTVKGTHIDYPIVQGENNLEYINKSVEGEYSLSGSVFLDYRNKVTFED  118
              DLLA+N DV+ WL +  GTHIDYP+VQG+ NLEYINK+V+G  ++SGS+FLD RN     F D
Sbjct:  411 DLLALNEDVIGWLNIPGTHIDYPLVQGKTNLEYINKAVDGSVAMSGSLFLDTRNHNDFTD  470

Query:  119 KYSLIYAHHMAGNVMFGELPNFRKKSFFNKHKEFSIETKTKQKLKINIFACIQTDAFDSL  178
                YSLIY HHMAGN MFGE+P F KK+FFNKH  +  IETK  ++KL  +  IFAC++TDAFD L
Sbjct:  471 DYSLIYGHHMAGNAMFGEIPKFLKKNFFNKHNKAIIETKERKKLTVTIFACLKTDAFDQL  530

Query:  179 LFNPIDV-DISSKNEFLNHIKQKSVQYREILTTNESRFVALSTCEDMTTDGRIIVIGQIE  237
              +FNP + +   + + +++I ++S Q++ +    + ++FVA STCE+ +TD R+IV+G I+
Sbjct:  531 VFNPNAITNQDQQRQLVDYISKRSKQFKPVKLKHHTKFVAFSTCENFSTDNRVIVVGTIQ  590
```

Based on this analysis, it was predicted that this GAS-specific protein and its epitopes, could be useful antigens for vaccines or diagnostics.

EXAMPLE 2390

A DNA sequence (GASx129) was identified in *S. pyogenes* <SEQ ID 7279> which encodes the amino acid sequence <SEQ ID 7280>. Analysis of this protein sequence reveals the following:

```
Possible site: 26
>>> Seems to have an uncleavable N-term signal seq
     INTEGRAL   Likelihood = -6.05    Transmembrane    5-21  (4-22)
     INTEGRAL   Likelihood = -5.04    Transmembrane  191-207 (186-209)

----- Final Results -----
             bacterial membrane --- Certainty = 0.3421(Affirmative) < succ>
              bacterial outside --- Certainty = 0.0000(Not Clear)   < succ>
           bacterial --- cytoplasm Certainty = 0.0000(Not Clear)   < succ>
LPXTG motif: 181-186
```

No corresponding DNA sequence was identified in *S. agalactiae*.

```
>GP: AAC97151 GB: U49397 unknown [Streptococcus pyogenes]
Identities = 64/213 (30%), Positives = 106/213 (49%), Gaps = 20/213 (9%)

Query:   1 MKKSILRILAIGYLLMSFCLLDSVEAENLTASINIEVINQVDVATNKQSSDIDETFMFVI   60
           M+K    + ++ +L       +V A++ T   +I V N ++ A +       F   +
Sbjct:   1 MRKYWKMLFSVVMMLTMLAFNQTVLAKDSTVQTSISVENVLERAGDSTP------FSIAL  54

Query:  61 EALDKESPLPNSVTTSVKGNGKTSFEQLTFSEVGQYHYKIHQLLGKNSQYHYDETVYEVV  120
           E++D   +        ++ G+GK SF  L F+ VGQY Y+++Q    +N  Y  D TV++V+
Sbjct:  55 ESIDAMKTIEE---ITIAGSGKASFSPLNFTTVGQYTYRVYQKPSQNKDYQADTTVFDVL  111

Query: 121 IYVLYNEQSGALETNLVSNKLGETEKSELIFKQEYSEKTPEPHQPDTTEKEKPQKKRNGI  180
           +YV Y+E  G  L    ++S + G+ EKS + FK +    K   P QPD   +
Sbjct: 112 VYVTYDE-DGTLVAKVISRRAGDEEKSAITFKPKRLVKPIPPRQPDIPKTP---------  161

Query: 181 LPSTGEMVSYVSALGIVLVATITLYSIYKKLKT                            213
           LP  GE+ S +  L IVL+  + L  + KKLK+
Sbjct: 162 LPLAGEVKSLLGILSIVLLGLLVLLYV-KKLKS                            193
```

Based on this analysis, it was predicted that this GAS-specific protein and its epitopes, could be useful antigens for vaccines or diagnostics.

EXAMPLE 2391

A DNA sequence (GASx130R) was identified in *S. pyogenes* <SEQ ID 7281> which encodes the amino acid sequence <SEQ ID 7282>. Analysis of this protein sequence reveals the following:

```
Possible site: 57
>>> Seems to have no N-terminal signal sequence

----- Final Results -----
             bacterial cytoplasm --- Certainty = 0.1614(Affirmative) < succ>
              bacterial membrane --- Certainty = 0.0000(Not Clear)   < succ>
               bacterial outside --- Certainty = 0.0000(Not Clear)   < succ>
```

No corresponding DNA sequence was identified in *S. agalactiae*.

The protein has homology with the following sequences in the GENPEPT database:

```
>GP: CAB54046 GB: AJ245436 hypothetical protein, 57.8 kD [Pseudomonas
putida]
Identities = 128/388 (32%), Positives = 204/388 (51%), Gaps = 21/388 (5%)

Query:   4 IGSVVQRQELVFIPAQLKRINHVQHAYKCQTCSDNSLSDKIIKAPVPKAPLAHSLGSASI   63
           IG  V  Q L +P Q++ I HV+  Y C+ C     ++      A P   + S+ S S+
Sbjct: 126 IGEEVSEQ-LEIVPMQIRVIKHVRKVYGCRDCESAPVT-----ADKPAQMIEKSMASPSV  179

Query:  64 IAHTVHQKFTLKVPNYRQEEDWNKLGLSISRKEIANWHIKSSQYYFEPLYDLLRDILLSQ  123
           +A  + K+   +P +R E+    + G+ I R+ +A W I+ S++ F+PL +L+R+ LL+
Sbjct: 180 LAMLLTTKYVDGLPLHRFEKVLGRHGIDIPRQTLARWVIQCSEH-FQPLLNLMRESLLNS  238

Query: 124 EVIHADETSYRVLESD----TQLTYYWTFLSGKHEKKGITLYHHDKRRSGLVTQEVLGDY  179
           +IH DET +VL+       + ++ W   G  +  + L+ +   R+ V    +L   Y
Sbjct: 239 RIIHCDETRVQVLKEPGREPSSQSWMWVQTGGPPDRP-VILFDYATSRAQEVPVRLLDGY  297
```

-continued

```
Query: 180 SGYVHCDMHGAYRQL---EHAKLVGCWAHVRRKFFEATPKQAD-KTSLGRKGLVYCDKLF  235
           GYV  D +  Y  L    +  + +GCWAH RRKF EA   Q   KT       L   +KL+
Sbjct: 298 RGYVMTDDYAGYNALAAQDGLERLGCWAHARRKFVEAQKVQPKGKTGRADIALNLINKLY  357

Query: 236 ALEAEWCELPPQERLVKRKEILTPLMTTFFDWCR--EQVVLSGSKLGLAIAYSLKHERTF  293
            +E +   +   ++R V R E   PL+T   +W    +  V + + LG AI Y    +
Sbjct: 358 GVERDLKDSDDEDRKVARMERSLPLLTQLKNWVEKTQPQVTTQNALGKAIGYLASNWSKL  417

Query: 294 RTVLEDGHIVLSNNMAERAIKSLVMGRKNWLFSQSFEGAKAAAIIMSLLETAKRHGLNSE  353
              +E G++ + NN AERAI+  V+GRKNWLFS + +GA A+A + SL+ETAK +G
Sbjct: 418 ERYVEHGYLPMDNNAAERAIRPFVIGRKNWLFSDTPKGATASAQLYSLVETAKANGQEPY  477

Query: 354 KYISYLLDRLPNEETLAKREVLEAYLPW                                  381
           ++ + L+RLP   ++    E  EA LPW
Sbjct: 478 AWLRHALERLPQACSV---EDYEALLPW                                  502
```

Based on this analysis, it was predicted that this GAS-specific protein and its epitopes, could be useful antigens for vaccines or diagnostics.

EXAMPLE 2392

A DNA sequence (GASx131R) was identified in *S. pyogenes* <SEQ ID 7283> which encodes the amino acid sequence <SEQ ID 7284>. Analysis of this protein sequence reveals the following:

```
Possible site: 37
>>> Seems to have no N-terminal signal sequence

----- Final Results -----
              bacterial cytoplasm --- Certainty = 0.4465(Affirmative) < succ>
               bacterial membrane --- Certainty = 0.0000(Not Clear) < succ>
                bacterial outside --- Certainty = 0.0000(Not Clear) < succ>
```

No corresponding DNA sequence was identified in *S. agalactiae.*

The protein has no significant homology with any sequences in the GENPEPT database.

Based on this analysis, it was predicted that this GAS-specific protein and its epitopes, could be useful antigens for vaccines or diagnostics.

EXAMPLE 2393

A DNA sequence (GASx132R) was identified in *S. pyogenes* <SEQ ID 7285> which encodes the amino acid sequence <SEQ ID 7286>. Analysis of this protein sequence reveals the following:

```
Possible site: 46
>>> Seems to have no N-terminal signal sequence

----- Final Results -----
              bacterial cytoplasm --- Certainty = 0.1529(Affirmative) < succ>
               bacterial membrane --- Certainty = 0.0000(Not Clear) < succ>
                bacterial outside --- Certainty = 0.0000(Not Clear) < succ>
```

No corresponding DNA sequence was identified in *S. agalactiae.*

The protein has homology with the following sequences in the GENPEPT database:

```
>GP: BAA84885 GB: AB024946 orf50 [Escherichia coli]
Identities = 37/91 (40%), Positives = 53/91 (57%)

Query:  10 QVYLVCGKTDMRQGIDSLAYLVKSQHELDLFSGAVYLFCGGRRDRFKALYWDGQGFWLLY  69
           +++LV G TDMR G + LA  V++  + D FSG +++F G R D+ K L+ D  G  L
Sbjct:   9 RIWLVAGITDMRNGFNGLASKVQNVLKDDPFSGHLFIFRGRRGDQIKVLWADSDGLCLFT  68
```

```
Query:  70 KRFENGKLAWPRNRDEVKCLTAVQVDWLMKG                              100
           KR E G+  WP  RD    LT Q+ L++G
Sbjct:  69 KRLERGRFVWPVTRDGKVHLTPAQLSMLLEG                               99
```

Based on this analysis, it was predicted that this GAS-specific protein and its epitopes, could be useful antigens for vaccines or diagnostics.

EXAMPLE 2394

A DNA sequence (GASx133R) was identified in S. pyogenes <SEQ ID 7287> which encodes the amino acid sequence <SEQ ID 7288>. Analysis of this protein sequence reveals the following:

```
Possible site: 18
>>> Seems to have no N-terminal signal sequence

----- Final Results -----
           bacterial cytoplasm --- Certainty = 0.1979(Affirmative) < succ>
           bacterial membrane  --- Certainty = 0.0000(Not Clear)   < succ>
           bacterial outside   --- Certainty = 0.0000(Not Clear)   < succ>
```

No corresponding DNA sequence was identified in S. agalactiae.

The protein has no significant homology with any sequences in the GENPEPT database.

Based on this analysis, it was predicted that this GAS-specific protein and its epitopes, could be useful antigens for vaccines or diagnostics.

EXAMPLE 2395

A DNA sequence (GASx135R) was identified in S. pyogenes <SEQ ID 7289> which encodes the amino acid sequence <SEQ ID 7290>. Analysis of this protein sequence reveals the following:

```
Possible site: 20
>>> Seems to have a cleavable N-term signal seq.

----- Final Results -----
           bacterial outside   --- Certainty = 0.3000(Affirmative) < succ>
           bacterial membrane  --- Certainty = 0.0000(Not Clear)   < succ>
           bacterial cytoplasm --- Certainty = 0.0000(Not Clear)   < succ>
```

No corresponding DNA sequence was identified in S. agalactiae.

The protein has no significant homology with any sequences in the GENPEPT database.

Based on this analysis, it was predicted that this GAS-specific protein and its epitopes, could be useful antigens for vaccines or diagnostics.

EXAMPLE 2396

A DNA sequence (GASx136) was identified in S. pyogenes <SEQ ID 7291> which encodes the amino acid sequence <SEQ ID 7292>. Analysis of this protein sequence reveals the following:

```
Possible site: 54
>>> Seems to have no N-terminal signal sequence
    INTEGRAL    Likelihood = -11.73    Transmembrane    222-238  (212-242)
    INTEGRAL    Likelihood = -10.88    Transmembrane     37-53   (32-57)
    INTEGRAL    Likelihood =  -9.87    Transmembrane    462-478  (456-478)
    INTEGRAL    Likelihood =  -4.25    Transmembrane    119-135  (117-137)
    INTEGRAL    Likelihood =  -2.60    Transmembrane    308-324  (306-324)
    INTEGRAL    Likelihood =  -1.28    Transmembrane    164-180  (164-180)
    INTEGRAL    Likelihood =  -0.06    Transmembrane    137-153  (137-153)
    INTEGRAL    Likelihood =  -0.06    Transmembrane    343-359  (343-359)

----- Final Results -----
           bacterial membrane  --- Certainty = 0.5692(Affirmative) < succ>
           bacterial outside   --- Certainty = 0.0000(Not Clear)   < succ>
           bacterial cytoplasm --- Certainty = 0.0000(Not Clear)   < succ>
```

No corresponding DNA sequence was identified in *S. agalactiae*.

The protein has homology with the following sequences in the GENPEPT database:

```
>GP: BAB04077 GB: AP001508 short-chain fatty acids transporter
[Bacillus halodurans]
Identities = 158/465 (33%), Positives = 248/465 (52%), Gaps = 41/465 (8%)

Query:   15 IKTKKRFMDRYIDGFMKWMPESLFICFILTFLVVTMSVLMTDSPFIGTEKTGGIIYGWVN   74
             I   R M RY+     P+      +LTFLV +S++ T+S    T   T  I+ W
Sbjct:    5 ISLSNRLMQRYL------PDPFLFVVLLTFLVFALSLIFTES----TPLT--IVQYWGE   51

Query:   75 GFWGLLSFAMQMTILLATGNAVASSPPAHKMFKSLAKLPQTRTQIFIFSIVVGSIFGFLH  134
             GFWGLLSF+MQM ++L TG+ +ASSP   K  +LA LP +  Q  +  VV  + F++
Sbjct:   52 GFWGLLSFSMQMVLVLVTGHVLASSPLFKKGLGALAGLPASPGQAILLVTVVSLVASFIN  111

Query:  135 WGLGMMVAIVFGKELLVQARQKGIKVHTPLFVATLFFTFLPATSGLSGAAVLYSATPDYL  194
             WG G+++  +F KEL      +K   V   L +A+ +  F+     GLSG+   L  ATPD+
Sbjct:  112 WGFGLVIGALFAKELA----KKVDNVDYRLLIASAYSGFMIWHGGLSGSVPLTIATPDHF  167

Query:  195 RNSVADAYKQVVPESVPLTESVL---NLPFISLLVVCMLVPLCFALLAHPKDETKIME--  249
                +          +P +E++    NL  +  L  +  +PL   L+    K +T  ++
Sbjct:  168 AQDMIGV--------IPTSETIFAPYNLAIVFALFIA--IPLANRLMMPGKSDTVTVDRS  217

Query:  250 -LDDEIYHHSLDTASHVVIARNTPAEKMNASRLVMYLVGGAIVSYSLYHFSVVGLSGLDL  308
              LDD        L  AS + +     TP++++    SR++   LVG    + +  Y+F+   G    L+L
Sbjct:  218 LLDDG---RDLQAAS-LELEAMTPSDRLENSRMISLLVGVLGLVFLGYYFATNGFE-LNL  272

Query:  309 NCFNFLFLGLGLLLCGQQGPEYYGSLFKDGVMSSWGLVLQFPFYAGIFGIIQSTGLGLEI  368
              +  N LFL LG+L   G       P+ +         V  + G+++QFPFYAG+  GI+ S+GL    +
Sbjct:  273 DIVNSLFLFLGILFHGT--PKLFLKAVTSAVKGASGIIIQPFYAGLMGIMVSSGLATVM  330

Query:  369 SHFFVAISNGTTWPVFAYLYSALLNIAVPSGGSKFVIEAPYIVPATIEVGNDLGKILQAY  428
              S   FV+ SN   T+P+F  +L +  ++N+   VPSGG   ++ ++AP ++  A    +G    K    A
Sbjct:  331 SEAFVSFSNEVTFPLFVFLSAGIVNVFVPSGGGQWAVQAPVVLEAAQSLGVPAAKAAMAV  390

Query:  429 QLGDATTNLIVPFWALSYLSNFKLKFNQIVAYTIPCVLVVTGIAI                473
              GDA TN+I PFWAL  L+     LK   I+ +  +   +LVV+G+  I
Sbjct:  391 AWGDAWTNMIQPFWALPALAIAGLKAKDIMGFCV-MILVVSGVVI                434
```

Based on this analysis, it was predicted that this GAS-specific protein and its epitopes, could be useful antigens for vaccines or diagnostics.

EXAMPLE 2397

A DNA sequence (GASx137R) was identified in *S. pyogenes* <SEQ ID 7293> which encodes the amino acid sequence <SEQ ID 7294>. Analysis of this protein sequence reveals the following:

```
Possible site: 58
>>> Seems to have no N-terminal signal sequence

----- Final Results -----
            bacterial cytoplasm --- Certainty = 0.2591(Affirmative) < succ>
             bacterial membrane --- Certainty = 0.0000(Not Clear)   < succ>
              bacterial outside --- Certainty = 0.0000(Not Clear)   < succ>
```

No corresponding DNA sequence was identified in *S. agalactiae*.

The protein has homology with the following sequences in the GENPEPT database:

```
>GP: AAC22434 GB: U32761 transcriptional regulator
[Haemophilus influenzae Rd]
Identities = 37/107 (34%), Positives = 56/107 (51%), Gaps = 1/107 (0%)

Query:   21 LHRQNLVTFDKTFMINHQLTTLFEEANSLPVVKCYSASWDFLLNCTRYS-SYLTILPRPI   79
             LH+Q  + FD+TFMI+H L   FE  N P +    S+ WDFLL+  + +    LTILP P+
Sbjct:  205 LHQQKMAIFDQTFMIHHHLKEAFERNNCYPDIVLDSSCWDFLLSAVKTNKELLTILPLPM  264
```

```
Query:  80 THFAHMDGLVEVQLTEHPKWEVVLASLKHNKTSHLKHYIKHTILDYF            126
           H   +  ++    W+V L   +    +HL+ YI    +L+ F
Sbjct: 265 AELYHSKEFLCRKIESPVPWKVTLCRQRKTVYTHLEEYIFDKLLEAF            311
```

Based on this analysis, it was predicted that this GAS-specific protein and its epitopes, could be useful antigens for vaccines or diagnostics.

EXAMPLE 2398

A DNA sequence (GASx140) was identified in *S. pyogenes* <SEQ ID 7295> which encodes the amino acid sequence <SEQ ID 7296>. Analysis of this protein sequence reveals the following:

```
Possible site: 50
>>> Seems to have no N-terminal signal sequence

----- Final Results -----
            bacterial cytoplasm --- Certainty = 0.3351(Affirmative) < succ>
             bacterial membrane --- Certainty = 0.0000(Not Clear)   < succ>
              bacterial outside --- Certainty = 0.0000(Not Clear)   < succ>
```

No corresponding DNA sequence was identified in *S. agalactiae*.

The protein has homology with the following sequences in the GENPEPT database:

```
!GB: U32761 acetate CoA-transferase, alpha subunit [H . . . 215 4e-55
Identities = 105/213 (49%), Positives = 146/213 (68%)

Query:  22 ENKRIAIAEAISHIKDGDTIMVGGFMANGTPEALIDALVDKGTKDLTLICNDAGFVDRGV    81
            + K + + +A   +DG TIMVGGFM  GTP L++AL++ G +DLTLI ND   FVD G+
Sbjct:   2 KTKLMTLQDATGFFRDGMTIMVGGFMGIGTPSRLVEALLESGVRDLTLIANDTAFVDTGI    61

Query:  82 GKMVANHQFKTIYATHIGLNKEAGRQMTAGETTIELIPQGTFAEKIRIGAYGIGGFYTPT   141
           G ++ N + + A+HIG N E GR+M +GE  + L+PQGT  E+IR G  G+GGF TPT
Sbjct:  62 GPLIVNGRVRKVIASHIGTNPETGRRMISGEMDVVLVPQGTLIEQIRCGGAGLGGFLTPT   121

Query: 142 GVGTLVAEGKETKTIKGKTYLLEYPFEADVALIFANQADEMGNLQYSGSENNFNQLMAAC   201
           GVGT+V EGK+T T+ GKT+LLE P  AD+ALI A++ D +GNL Y  S  NFN L+A
Sbjct: 122 GVGTVVEEGKQTLTLDGKTWLLERPLRADLALIRAHRCDTLGNLTYQLSARNFNPLIALA   181

Query: 202 AKTTIVQAREIVPVGTIQPECVHTPHIFVDYIV                             234
           A  T+V+  E+V  G +QP+ + TP    +D+I+
Sbjct: 182 ADITLVEPDELVETGELQPDHIVTPGAVIDHII                             214 subunit (EC 2.8.3.-). [Escherichia coli]
```

Based on this analysis, it was predicted that this GAS-specific protein and its epitopes, could be useful antigens for vaccines or diagnostics.

EXAMPLE 2399

A DNA sequence (GASx141) was identified in *S. pyogenes* <SEQ ID 7297> which encodes the amino acid sequence <SEQ ID 7298>. Analysis of this protein sequence reveals the following:

```
Possible site: 41
>>> Seems to have no N-terminal signal sequence

----- Final Results -----
            bacterial cytoplasm --- Certainty = 0.4941(Affirmative) < succ>
             bacterial membrane --- Certainty = 0.0000(Not Clear)   < succ>
              bacterial outside --- Certainty = 0.0000(Not Clear)   < succ>
```

No corresponding DNA sequence was identified in *S. agalactiae*.

The protein has homology with the following sequences in the GENPEPT database:

```
>GP:AAF12248 GB:AE001862 CoA transferase, subunit B [Deinococcus radiodurans]
Identities = 114/203 (56%), Positives = 158/203 (77%), Gaps = 3/203 (1%)
Query:   11 QNRIAKRVAKELEDGTLVNLGIGLPTKVANFVPEEMTVYFQSENGFIGLGP--KSDDPNS    68
            ++ +A R A+EL+DG  VNLGIGLPT VAN +P  M+V+ QSENG +G+GP    D+ +
Sbjct:    5 RDEMAARAAQELQDGYYVNLGIGLPTLVANHIPAGMSVWLQSENGLLGIGPFPTEDEVDP    64

Query:   69 TIVNAGGQPVTVYPGAAFENSADSFGIIRGGHVDLTVLGALEIAENGDIANYLIPGKMVP   128
            ++NAG Q VT   PGA+FF+SADSF +IRGGHV+L +LGA++++E GD+AN++IPGKMV
Sbjct:   65 DLINAGKQTVTALPGASFFSSADSFAMIRGGHVNLAILGAMQVSETGDLANWMIPGKMVK   124

Query:  129 GMGGANDLLVGAKKVIVANEHTNKG-KHKLLKECTLPLTAKGVVDLIITEMGVFKVTPDG   187
            GMGGANDL+ G ++V+V MEH  KG  HK+L+ECTLPLT +GVVD IIT++GV  VTP G
Sbjct:  125 GMGGANDLVAGVQRVVVLMEHVAKGDAHKILRECTLPLTGQGVVDRIITDLGVLDVTPQG   184

Query:  188 IQVIEISEGFTFDEVQAATGVPL                                       210
            ++++E++ G T DE++   TG +
Sbjct:  185 LKLVELAPGVTLDELRQKTGADI                                       207
```

Based on this analysis, it was predicted that this GAS-specific protein and its epitopes, could be useful antigens for vaccines or diagnostics.

EXAMPLE 2400

A DNA sequence (GASx144) was identified in *S. pyogenes* <SEQ ID 7299> which encodes the amino acid sequence <SEQ ID 7300>. Analysis of this protein sequence reveals the following:

```
Possible site: 39
>>> Seems to have no N-terminal signal sequence

----- Final Result -----
           bacterial cytoplasm --- Certainty = 0.3227(Affirmative) < succ>
           bacterial membrane  --- Certainty = 0.0000(Not Clear)  < succ>
             bacterial outside --- Certainty = 0.0000(Not Clear)  < succ>
```

No corresponding DNA sequence was identified in *S. agalactiae*.

The protein has homology with the following sequences in the GENPEPT database:

```
>GP:BAA29948 GB:AP000003 137aa long hypothetical protein
[Pyrococcus horikoshii]
Identities = 49/113 (43%), Positives = 71/113 (62%), Gaps = 1/113 (0%)

Query:    5 PEPMGPYSTYTIEGHFLYTAGQLPLNPVTGQLSDG-FEAQCRQVFVNLQSILAEQKLDLN    63
            P+P+GPYS      G+FL+ AGQ+P++P TG++    G  + Q RQV N+++IL     LN
Sbjct:   22 PKPIGPYSQAIKAGNFLFIAGQIPIDPKTGEIVKGDIKDQTRQVLENIKAILEAAGYSLN    81

Query:   64 HIYKLNVYLTDVTNVEILNHVMTDLFEEPYPVRTAVQVSALPLQALIEVEAVA          116
            + K+ VYL D+ +   +N V   + F E   P R  AV+VS LP    LIE+EA+A
Sbjct:   82 DVIKVTVYLKDMNDFAKMNEVYAEYFGESKPARVAVEVSRLPKDVLIEIEAIA          134
```

Based on this analysis, it was predicted that this GAS-specific protein and its epitopes, could be useful antigens for vaccines or diagnostics.

EXAMPLE 2401

A DNA sequence (GASx146) was identified in *S. pyogenes* <SEQ ID 7301> which encodes the amino acid sequence <SEQ ID 7302>. Analysis of this protein sequence reveals the following:

```
Possible site: 16
>>> Seems to have no N-terminal signal sequence

----- Final Results -----
            bacterial cytoplasm --- Certainty = 0.1238(Affirmative) < succ>
            bacterial membrane  --- Certainty = 0.0000(Not Clear)   < succ>
             bacterial outside  --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2402

A DNA sequence (GASx147) was identified in *S. pyogenes* <SEQ ID 7303> which encodes the amino acid sequence <SEQ ID 7304>. Analysis of this protein sequence reveals the following:

```
Possible site: 30
>>> Seems to have no N-terminal signal sequence
INTEGRAL Likelihood = -11.46 Transmembrane 456-472 ( 452-481)
INTEGRAL Likelihood =  -8.17 Transmembrane 603-619 ( 595-623)
INTEGRAL Likelihood =  -6.85 Transmembrane 495-511 ( 491-518)
INTEGRAL Likelihood =  -5.31 Transmembrane 420-436 ( 418-443)
INTEGRAL Likelihood =  -4.99 Transmembrane 396-412 ( 392-413)
INTEGRAL Likelihood =  -1.59 Transmembrane 522-538 ( 522-538)
INTEGRAL Likelihood =  -0.64 Transmembrane 577-593 ( 577-593)
INTEGRAL Likelihood =  -0.43 Transmembrane 377-393 ( 377-393)

----- Final Results -----
              bacterial membrane  --- Certainty = 0.5585(Affirmative) < succ>
              bacterial outside   --- Certainty = 0.0000CNot Clear)   < succ>
              bacterial cytoplasm --- Certainty = 0.0000(Not Clear)   < succ>
```

No corresponding DNA sequence was identified in *S. agalactiae*.

The protein has homology with the following sequences in the GENPEPT database:

```
>GP:BAA04270 GB:D17462 Na+ -ATPase subunit I [Enterococcus hirae]
Identities = 232/681 (34%), Positives = 370/681 (54%), Gaps = 40/681 (5%)

Query:   1 MAISQMKKLANVFEKDYLDLVLKTLQQSQLVEVRDMKQLKH---WQDAFNKGNVKLPQIV   57
           MA+++M+K+ ++ +K   +++L+ +Q    VE+RD+ Q      W + F     P+++
Sbjct:   1 MAVTKMEKVTLISDKKNREILLQAVQGLHAVEIRDLFQESENNQWVETF----FPEPEMI  56

Query:  58 QYDLTHQKPLLDDEALQYLLQSQQELENGLASLSAFLPPIGKLTALRQ--KTPSLSFKQF  115
              D  K      L Y L       + +  F+   G+ +  +Q   K    LS
Sbjct:  57 DKDKELAK-------LSYKLTD-------IRTAIQFIEHHGEKSQKKQHLKRRELSLDTL  102

Query: 116 EERHRQQAAQTALKNMSQKIERLEQLQSKIDQLTEYCQELEKWRSLTVLPQDLAQFHFLS  175
           E+ + ++A     L+ +     E+ EQL   QL +    L  W++L + P+
Sbjct: 103 EKNYSEEAFSKKLEEVLLLKEQWEQLVOERQQLEDQENWLLNWQNLDLAPKAFDS-QMTK  161

Query: 176 ARVGTIPSTANNHFYHQLKQHKGLFIEEVYH----TEFEYGLVLFWQAQOTIHLQKYQFK  231
           +GT+ +      F  ++ +     ++EE+     T F Y ++     +++       +Y F
Sbjct: 162 LVIGTVNAKNAESFKAEVAEINEAYLEEINSSPTTTYFAYIVLRADESRMEEIASRYGFV  221

Query: 232 PLLYKEQLLPSEQLRINKELLTNWLAEKDSLLKELRQSQKILAQLQVEIDYVLSQYQRQQ  291
             Y   P +QL    K+  L     ++  L      +   +  +  +   +  L++ +R+
Sbjct: 222 KEDYLYEGTPQQQLVAAKQSLQEIKDQQKKLSSAIGACSGYIKDFEWTEEIFLARSEREA  281

Query: 292 TKKQLLGTRHLIALEGWIEADSVNQLKGLMTKTLGDMFYLDSYDVTPDDW--EDVPIKLR  349
           K +++ T +LI ++GW++ +    +L ++       L  ++D   D+    E+VP KL+
Sbjct: 282 IKDRIIHTPYLILIQGWVDHEEKQELIHMLQNILASEEVYLTFDEPTDNEIAEEVPTKLK  341

Query: 350 NHRYIAPFELVTEMYALPKYQEKDPTPFLAPLYLTFFGMMVADLGYGLLLYAVTLAALVF  409
           NH   +APFE+++TEMY+LPKY+E DPTP++ P YL FFGMMVAD+GYGLL++
Sbjct: 342 NHPIVAPFEHLTEMYSLPKYEEVDPTPWMNPFYLVFFGMMVADIGYGLLMFLGAFLLQKL  401

Query: 410 FNLQKTSKRLVTFFNILAISVAIWGLIYGSFFG---------FDLPVALLSTKTDVITIL  460
                L +  +R  FF ILAI    IWG IY SFFG           LP  +LST DV  TIL
Sbjct: 402 VVLPRGMQRFAKFFEILAIPSIIWGFIYSSFFGAALPKEIFGIHLPFPILSTTDDVNTIL  461
```

-continued

```
Query: 461 VVSLLFGFVTLIEGLLLGAWQQVHMKAYATAYTSSLAWTFILLGLLLFILGKNVSGLAYL 520
            ++S++FG + ++ GL + A + ++ KAY A    AW +ILLG++L +LG
Sbjct: 462 ILSVIFGLIQILVGLFIAAKEHIKRKAYVDAVNDGFAWQWILLGIILILLGTNTLKNNAF 521

Query: 521 SVIGKWLALGNAFGILVVSLLKSKSLL-GLGSGLYNLYGISSYLSDLVSFTRLMALGLSG 579
            +G  LA+ +A  IL++ + +S S   G+  G YNLYG++ Y+ DLVS+TRLMALG+SG
Sbjct: 522 VYLGGALAVLSAVCILIIPVFQSSSKAKGIAKGAYNLYGLTGYIGDLVSYTRLMALGISG 581

Query: 580 ASIGAAFNMIVGIFPPVTRFTVGIFIFILLHAINIFLSMLSGYVHGARLIFVEFFGKFYE 639
            SI AAFNM+V   PP  RF+VGI + I+L A+N+FL++LS YVHGARL +VEFFGKFY
Sbjct: 582 GSIAAAFNMLVAFMPPAARFSVGILLIIVLQALNHFLTLLSAYVHGARLQYVEFFGKFYT 641

Query: 640 GGGKAFNPLKLADNYVNVNEE                                        660
            GGG++F PLK   + YVN+N +
Sbjct: 642 GGGRSFKPLKTVEKYVNINHK                                        662
```

Based on this analysis, it was predicted that this GAS-specific protein and its epitopes, could be useful antigens for vaccines or diagnostics.

EXAMPLE 2403

A DNA sequence (GASx148) was identified in *S. pyogenes* <SEQ ID 7305> which encodes the amino acid sequence <SEQ ID 7306>. Analysis of this protein sequence reveals the following:

```
Possible site: 40
>>> Seems to have no N-terminal signal sequence
INTEGRAL Likelihood = -7.80 Transmembrane  28-44  ( 21-51)
INTEGRAL Likelihood = -6.85 Transmembrane 148-164 ( 146-170)
INTEGRAL Likelihood = -2.81 Transmembrane 105-121 ( 105-123)

----- Final Results -----
          bacterial membrane --- Certainty = 0.4121(Affirmative) < succ>
            bacterial outside --- Certainty = 0.0000(Not Clear) < succ>
          bacterial cytoplasm --- Certainty = 0.0000(Not Clear) < succ>
```

No corresponding DNA sequence was identified in *S. agalactiae*.

The protein has homology with the following sequences in the GENPEPT database:

```
>GP:BAA03841 GB:D16334 Na+-ATPase K subunit [Enterococcus hirae]
Identities = 85/150 (56%), Positives = 107/150 (70%)

Query:  20 HYFTAHGGVFFAALGIVLAVALSGMGSAYGVGKGGQAAAALLKEEPEKFTSALILQLLPG   79
           +  T +GG+ FA L +  A    SG+GSA GVG  G+AAAAL  +PEKF  ALILQLLPG
Sbjct:   4 YLITQNGGMVFAVLAMATATIFSGIGSAKGVGMTGEAAAALTTSQPEKFGQALILQLLPG   63

Query:  80 SQGIYGFAIGILIWMKLTPELSVNQGLAYFLVSLPIAIVGYFSAKHQGNVSVAGMQILAK  139
           +QG+YGF I  LI++ L  ++SV QGL +   SLPIA  G FS   QG V+ AG+QILAK
Sbjct:  64 TQGLYGFVIAFLIFINLGSDMSVVQGLNFLGASLPIAFTGLFSGIAQGKVAAAGIQILAK  123

Query: 140 RPKDFNKGVILAAMVETYAILAFVVSFILL                               169
           +P+   KG+I AAMVETYAIL FV+SF+L+
Sbjct: 124 KPEHATKGIIFAAMVETYAILGFVISFLLV                               153
```

Based on this analysis, it was predicted that this GAS-specific protein and its epitopes, could be useful antigens for vaccines or diagnostics.

EXAMPLE 2404

A DNA sequence (GASx149) was identified in *S. pyogenes* <SEQ ID 7307> which encodes the amino acid sequence <SEQ ID 7308>. Analysis of this protein sequence reveals the following:

```
Possible site: 55
>>> Seems to have no N-terminal signal sequence

----- Final Results-----
            bacterial cytoplasm --- Certainty = 0.4510(Affirmative) < succ>
             bacterial membrane --- Certainty = 0.0000(Not Clear)  < succ>
              bacterial outside --- Certainty = 0.0000(Not Clear)  < succ>
```

No corresponding DNA sequence was identified in *S. agalactiae*.

The protein has homology with the following sequences in the GENPEPT database:

```
>GP:BAA04272 GB:017462 Na+ -ATPase subunit E [Enterococcus hirae]
Identities = 43/193 (22%), Positives = 95/193 (48%), Gaps = 2/193 (1%)

Query:     1 VNDITQLRQNVLEIAHQEGQQCLKIATDSLDTDFEERQQQGLHDLKAERQKELKALEQQF   60
             V+ I ++   + E A  E       ++    +D  F+ ++ Q    D + ++   +L+ +E+  +
Sbjct:     3 VDAIDKIITQINETAQLERASFEEMKRKEIDQKFEVKKWQIEADFQKEKASKLEEIERSY   62

Query:    61 QVAQQQLKNQERQALLALKQDSIKELFEASLEKMTNFSKEEELAFLKQVLSEYP-EQPLQ  119
             +  + + + K Q +Q +L   KQ+ ++ LF  +   ++ N   KEE+LA +KQ++      P       +
Sbjct:    63 RQLRNKQKMQVKQEILNAKQEVLQRLFTEATLQLENEPKEEQLALMKQMIQTLPINGTAR  122

Query:   120 VTFGEKTGQKFSSYDCAELRLAFPQLSYNQELIPQ-EAGFLVSLDQVDDNYLYRYLLESV  178
              +   GEK+   +       AE        P        ++     + +AG ++      +    N+L+  +L++ +
Sbjct:   123 LIPGEKSADILTPAVIAEWNEELPFELIREDFTSRAQAGLIIDDAGIQYNFLFSHLIEEI  182

Query:   179 LKEESSRIIDMLF                                                191
              +    S+ I    LF
Sbjct:   183 QETMSAEIAKELF                                                195
```

Based on this analysis, it was predicted that this GAS-specific protein and its epitopes, could be useful antigens for vaccines or diagnostics.

EXAMPLE 2405

A DNA sequence (GASx150) was identified in *S. pyogenes* <SEQ ID 7309> which encodes the amino acid sequence <SEQ ID 7310>. Analysis of this protein sequence reveals the following:

```
Possible site: 30
>>> Seems to have no N-terminal signal sequence

----- Final Results -----
            bacterial cytoplasm --- Certainty = 0.3095(Affirmative) < succ>
             bacterial membrane --- Certainty = 0.0000(Not Clear)  < succ>
              bacterial outside --- Certainty = 0.0000(Not Clear)  < succ>
```

No corresponding DNA sequence was identified in *S. agalactiae*.

The protein has homology with the following sequences in the GENPEPT database:

```
>GP: BAA04273 GB: D17462 Na+ -ATPase subunit C [Enterococcus hirae]
Identities = 94/326 (28%), Positives = 167/326 (50%), Gaps = 5/326 (1%)

Query:     6 ELNTTISVKEKELLTKEQFDKLLQAPNTTTLARLLHQSVYHLTVDDLNDLDRLESILMAE   65
             ELN    I   +E EL++K+  F++++Q   +   +L   +L   ++Y    + D  DD   E+ L   E
Sbjct:     5 ELNPLIRGRELELISKDTFEQMIQTDSIDSLGEILQSTIYQPYIYDGFDKD-FEANLSQE   63

Query:    66 LTKTYRWAFAETPQPDIVQLFTLRYTYHNVKVLLKAKASQADLSHLLLPIGDKPLVALEH  125
              +K  ++W          P+P+IV ++T+RYT+HN+KVL KA+ +    +L HL +      G      L   L+
Sbjct:    64 RSKLFQWLKESAPEPEIVWIYTMRYTFHNLKVLTKAEITGQNLDHLYIHDGFYSLEVLKD  123

Query:   126 LIRTMTSDEFPKEVVTEIQSIWAEYQDYQDIRVLEIGTDLAYFKALKQIAQRLEDPVFQQ  185
                 I T   S E P   ++   I+ +       ++     ++ +++   D  +      +++ ++L  P          +
Sbjct:   124 AIHTQVSVELPDSLMDYIREVHEYCEESTILQGIDVIYDRCFLTEQRRLGEQLGYPELLE  183
```

-continued

```
Query: 186 AVLIVIDLYNLITVRRAKSQNKPISFMMQLLSDEASRPSKTFITLEDDKDLMTWFENVTP 245
           ++  IDL N+ T R    Q++   FM  ++S   S P  T ++      ++ ++ + +
Sbjct: 184 EIIAFIDLTNITTTARGILQHRSAGFMTTVISSSGSIPKDTLLSFVRG-EMASFTQFLLT 242

Query: 246 DSYMTALKPYSEKLRQGTLQTTELEYLVDECLYHLFAKAKYQVDGPYVLARFLLAKSFEV 305
            Y    LK   + + +      LE L D+ L    +  A+ Q  GP  L   FL AK  E
Sbjct: 243 TDYSELLK---QVIHEEQIDLVSLEQLKDDYLSSFYQVAQTQAFGPLPLLAFLNAKEVES 299

Query: 306 KNLRLLAAALANDLPKERVIERMRPI                                   331
           KNLRLL     N       E++ ERMR +
Sbjct: 300 KNLRLLIIGKRNHFSLEQLKERMRQV                                   325
```

Based on this analysis, it was predicted that this GAS-specific protein and its epitopes, could be useful antigens for vaccines or diagnostics.

EXAMPLE 2406

A DNA sequence (GASx151) was identified in *S. pyogenes* <SEQ ID 7311> which encodes the amino acid sequence <SEQ ID 7312>. Analysis of this protein sequence reveals the following:

```
Possible Site: 29
>>> Seems to have no N-terminal signal sequence

----- Final Results -----
            bacterial cytoplasm --- Certainty = 0.0484(Affirmative) < succ>
             bacterial membrane --- Certainty = 0.0000(Not Clear)   < succ>
              bacterial outside --- Certainty = 0.0000(Not Clear)   < succ>
```

No corresponding DNA sequence was identified in *S. agalactiae*.

The protein has homology with the following sequences in the GENPEPT database:

```
>GP: BAA04274 GB: D17462 Na+ -ATPase subunit G [Enterococcus hirae]
Identities = 45/101 (44%), Positives = 65/101 (63%)

Query:   6 YKVGVIGNRDVILPFQMIGFQTFPVIKPQDAINQLRQLAMEDFGIIYITEDIAAAIPEAL  65
           YK+GV+G++D + PF++ GF          +   + ++A ++G+IYITE  A  +PE +
Sbjct:   3 YKIGVVGDKDSVSPFRLFGFDVQHGTTKTEIRKTIDEMAKNEYGVIYITEQCANLVPETI  62

Query:  66 THYDNQVLPAVIPLPTHQGAQGIGLSRIQAMVEKAVGQNIL                    106
            Y   Q+ PA+I +P+HQG  GIGL  IQ   VEKAVGQNIL
Sbjct:  63 ERYKGQLTPAIILIPSHQGTLGIGLEEIQNSVEKAVGQNIL                    103
```

Based on this analysis, it was predicted that this GAS-specific protein and its epitopes, could be useful antigens for vaccines or diagnostics.

EXAMPLE 2407

A DNA sequence (GASx152R) was identified in *S. pyogenes* <SEQ ID 7313> which encodes the amino acid sequence <SEQ ID 7314>. Analysis of this protein sequence reveals the following:

```
Possible site: 21
>>> Seems to have no N-terminal signal sequence

----- Final Results -----
            bacterial cytoplasm --- Certainty = 0.1048(Affirmative) < succ>
             bacterial membrane --- Certainty = 0.0000(Not Clear)   < succ>
              bacterial outside --- Certainty = 0.0000(Not Clear)   < succ>
```

No corresponding DNA sequence was identified in *S. aga-lactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2408

A DNA sequence (GASx156) was identified in *S. pyogenes* <SEQ ID 7315> which encodes the amino acid sequence <SEQ ID 7316>:

EYSIIPQLKETIHYIELKLEEAERASLVRIMKITS

Analysis of this protein sequence reveals the following:

```
Possible site: 16
>>> Seems to have no N-terminal signal sequence

----- Final Results -----
            bacterial cytoplasm --- Certainty = 0.5026(Affirmative) < succ>
            bacterial membrane  --- Certainty = 0.0000(Not Clear)   < succ>
            bacterial outside   --- Certainty = 0.0000(Not Clear)   < succ>
```

No corresponding DNA sequence was identified in *S. agalactiae*.

The protein has homology with the following sequences in the GENPEPT database:

```
>GP: BAA04277 GB: D17462 Na+ -ATPase subunit D [Enterococcus hirae]
Identities = 119/201 (59%), Positives = 151/201 (74%), Gaps = 2/201 (0%)

Query:   10 RLNVKPTRMELSNLKNRLKTATRGHKLLKDKRDELMRRFVDLIRENNELRQTIEKELAAN   69
            RLNV PTRMEL+ LK +L TATRGHKLLKDK+DELMR+F+ LIR+NNELRQ IEKE
Sbjct:    2 RLNVNPTRMELTRLKKQLTTATRGHKLLKDKQDELMRQFILLIRKNNELRQAIEKETQTA   61

Query:   70 MKEFVLAKASENSLMVEELFAVPVHEVTLWIDIENIMSVNVPKFHVQSNTAREQEQGEFA  129
            MK+FVLAK++       ++EL A+P   V++ +  +NIMSV VP  + Q +      E
Sbjct:   62 MKDFVLAKSTVEEAFIDELLALPAENVSISVVEKNIMSVKVPLMNFQYDETLNETPLE--  119

Query:  130 YSYLSSNSEMDNTIQKTKELLEKLLRLAEVEKTCQLMADDIEKTRRRVNGLEYSIIPQLK  189
            Y  YL SN+E+D +I     +LL KLL+LAEVEKTCQLMA++IEKTRRRVN LEY  IPQL+
Sbjct:  120 YGYLHSNAELDRSIDGFTQLLPKLLKLAEVEKTCQLMAEEIEKTRRRVNALEYMTIPQLE  179

Query:  190 ETIHYIELKLEEAERASLVRI                                         210
            ETI+YI++KLEE ERA + R+
Sbjct:  180 ETIYYIKMKLEENERAEVTRL                                         200
```

Based on this analysis, it was predicted that this GAS-specific protein and its epitopes, could be useful antigens for vaccines or diagnostics.

EXAMPLE 2409

A DNA sequence (GASx161R) was identified in *S. pyogenes* <SEQ ID 7317> which encodes the amino acid sequence <SEQ ID 7318>. Analysis of this protein sequence reveals the following:

```
Possible site: 27
>>> Seems to have an uncleavable N-term signal seq

----- Final Results -----
            bacterial membrane  --- Certainty = 0.0000(Not Clear) < succ>
            bacterial outside   --- Certainty = 0.0000(Not Clear) < succ>
            bacterial cytoplasm --- Certainty = 0.0000(Not Clear) < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2410

A DNA sequence (GASx164) was identified in *S. pyogenes* <SEQ ID 7319> which encodes the amino acid sequence <SEQ ID 7320>. Analysis of this protein sequence reveals the following:

```
Possible site: 36
>>> Seems to have no N-terminal signal sequence
    INTEGRAL    Likelihood = -1.06    Transmembrane    9-25 (9-25)

----- Final Results -----
            bacterial membrane --- Certainty = 0.1426(Affirmative) < succ>
              bacterial outside --- Certainty = 0.0000(Not Clear)   < succ>
           bacterial cytoplasm --- Certainty = 0.0000(Not Clear)   < succ>
```

A related sequence was also identified <SEQ ID 9091> which encodes the amino acid sequence <SEQ ID 9092>. Analysis of this protein sequence reveals the following:

```
Possible cleavage site: 33
>>> Seems to have a cleavable N-term signal seq.

----- Final Results -----
              bacterial outside --- Certainty = 0.300(Affirmative) < succ>
            bacterial membrane --- Certainty = 0.000(Not Clear)   < succ>
           bacterial cytoplasm --- Certainty = 0.000(Not Clear)   < succ>
```

No corresponding DNA sequence was identified in *S. agalactiae*.

Based on this analysis, it was predicted that this GAS-specific protein and its epitopes, could be useful antigens for vaccines or diagnostics.

EXAMPLE 2411

A DNA sequence (GASx165) was identified in *S. pyogenes* <SEQ ID 7321> which encodes the amino acid sequence <SEQ ID 7322>. Analysis of this protein sequence reveals the following:

```
Possible site: 59
>>> Seems to have no N-terminal signal sequence

----- Final Results -----
           bacterial cytoplasm --- Certainty = 0.2251(Affirmative) < succ>
            bacterial membrane --- Certainty = 0.0000(Not Clear)   < succ>
              bacterial outside --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2412

A DNA sequence (GASx166) was identified in *S. pyogenes* <SEQ ID 7323> which encodes the amino acid sequence <SEQ ID 7324>. Analysis of this protein sequence reveals the following:

```
Possible site: 34
>>> Seems to have a cleavable N-term signal seq.

----- Final Results -----
              bacterial outside --- Certainty = 0.3000(Affirmative) < succ>
            bacterial membrane --- Certainty = 0.0000(Not Clear)   < succ>
           bacterial cytoplasm --- Certainty = 0.0000(Not Clear)   < succ>
```

No corresponding DNA sequence was identified in *S. agalactiae*.

Based on this analysis, it was predicted that this GAS-specific protein and its epitopes, could be useful antigens for vaccines or diagnostics.

EXAMPLE 2413

A DNA sequence (GASx167) was identified in *S. pyogenes* <SEQ ID 7325> which encodes the amino acid sequence <SEQ ID 7326>. Analysis of this protein sequence reveals the following:

```
Possible site: 31
>>> Seems to have a cleavable N-term signal seq.

----- Final Results -----
          bacterial outside --- Certainty = 0.3000(Affirmative) < succ>
         bacterial membrane --- Certainty = 0.0000(Not Clear)   < succ>
        bacterial cytoplasm --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2414

A DNA sequence (GASx168R) was identified in *S. pyogenes* <SEQ ID 7327> which encodes the amino acid sequence <SEQ ID 7328>. Analysis of this protein sequence reveals the following:

```
Possible site: 22
>>> Seems to have a cleavable N-term signal seq.

----- Final Results -----
          bacterial outside --- Certainty = 0.3000(Affirmative) < succ>
         bacterial membrane --- Certainty = 0.0000(Not Clear)   < succ>
        bacterial cytoplasm --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2415

A DNA sequence (GASx169R) was identified in *S. pyogenes* <SEQ ID 7329> which encodes the amino acid sequence <SEQ ID 7330>. Analysis of this protein sequence reveals the following:

```
Possible site: 31
>>> Seems to have a cleavable N-term signal seq.

----- Final Results -----
          bacterial outside --- Certainty = 0.3000(Affirmative) < succ>
         bacterial membrane --- Certainty = 0.0000(Not Clear)   < succ>
        bacterial cytoplasm --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2416

A DNA sequence (GASx170) was identified in *S. pyogenes* <SEQ ID 7331> which encodes the amino acid sequence <SEQ ID 7332>. Analysis of this protein sequence reveals the following:

```
Possible site: 61
>>> Seems to have no N-terminal signal sequence
    INTEGRAL      Likelihood = -2.34    Transmembrane    154-170 (153-170)
    INTEGRAL      Likelihood = -1.12    Transmembrane    20-36 (19-36)
    INTEGRAL      Likelihood = -0.69    Transmembrane    52-68 (52-68)
    INTEGRAL      Likelihood = -0.53    Transmembrane    399-415 (399-415)

----- Final Results -----
              bacterial membrane --- Certainty = 0.1935(Affirmative) < succ>
              bacterial outside  --- Certainty = 0.0000(Not Clear)   < succ>
              bacterial cytoplasm --- Certainty = 0.0000(Not Clear)  < succ>
```

No corresponding DNA sequence was identified in *S. agalactiae*.

The protein has homology with the following sequences in the GENPEPT database:

```
>GP: BAB05347 GB: AP001512 cystathionine beta-lyase
[Bacillus halodurans]
Identities = 200/384 (52%), Positives = 262/384 (68%),
Gaps = 3/384 (0%)

Query:   79 IAEVYEMRENTTLLHGYTVIDEFTGAASVPIYQTSTFHNSELYCPSQKHLYTRFSNPTTE   138
            ++E Y ++  T LLH    +D+ TGA SVPI   STFH + +    + Y+R  NPT +
Sbjct:    1 MSEQYSLQ--TKLLHNEHKVDQATGAVSVPIQHASTFHQFD-FDTFGTYDYSRSGNPTRD    57

Query:  139 ALEDGLACLEKATYAVAYASGMAAISTVLMLLKAGDHVIFPLEVYGGTCQFATAILPNYQ   198
            ALE +A LE  +  A+ASGMAAIST  MLL  GDHV+   +VYGGT +   T +L
Sbjct:   58 ALEAAIAELEGGNHGFAFASGMAAISTAFMLLSKGDHVVLTKDVYGGTFRLVTEVLTRLG   117

Query:  199 IETSFVDMADLATVKASIRPNTRMIYLETPSNPLLKICDISELVQLAKAYGVLTVADNTF   258
            IE +FVDM +LA V A+IRPNTR++Y+ETPSNP L I DI  +V LAK +  LT  DNTF
Sbjct:  118 IEHTFVDMTNLAEVAAAIRPNTRVLYMETPSNPTLNITDIRGVVSLAKEHECLTFLDNTF   177

Query:  259 MTSLYQEPLAMGVDIVVESVTKFINGHSDVVAGLAATNNEAIYNQLKLFQKNFGAIVGVE   318
            +T    Q PL +GVD+V+ S TKFI GHSDVVAGLA T NE +   +L    Q +FGAI+GV+
Sbjct:  178 LTPALQRPLELGVDVVLHSATKFIGGHSDVVAGLAVTKNEELGKKLAFLQNSFGAILGVQ   237

Query:  319 DAWLILRGMKTMGIRMEQAVKNAQQLANYLAKHPKVLKVHYPGLDSHPNHDTHLQQAKNG   378
            D  WL+LRG+KT+ +RME    K AQQ+A +L   P+V +V+YPGL  HP HE L +QA+
Sbjct:  238 DVWLVLRGLKTLHVRMEHGEKGAQQIAEWLQGVPEVKRVYYPGLKDHPGHELQKRQAEGF   297

Query:  379 GAVLSFELASKEELMTFTHRIQLPILAVSLGGVESILSHPATMSHACLSPQARLEQGVVD   438
            GAVLSFEL ++E + F  ++LP+ AVSLG VESILS+PA MSHA  + R  +G+ D
Sbjct:  298 GAVLSFELENEEAVRRFVEHVKLPVFAVSLGAVESILSYPAKMSHAAMPKEEREARGIRD   357

Query:  439 GLLRLSCGVENIEDLLADFEQALA                                      462
            GLLRLS G+E  E+L+ADF+ A A
Sbjct:  358 GLLRLSVGLEKPEELMADFKAAFA                                      381
```

Based on this analysis, it was predicted that this GAS-specific protein and its epitopes, could be useful antigens for vaccines or diagnostics.

EXAMPLE 2417

A DNA sequence (GASx178) was identified in *S. pyogenes* <SEQ ID 7333> which encodes the amino acid sequence <SEQ ID 7334>. Analysis of this protein sequence reveals the following:

```
Possible site: 21
>>> Seems to have no N-terminal signal sequence
```

-continued

```
----- Final Results -----
            bacterial cytoplasm --- Certainty = 0.1492(Affirmative) < succ>
            bacterial membrane  --- Certainty = 0.0000(Not Clear)   < succ>
             bacterial outside  --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2418

A DNA sequence (GASx182) was identified in *S. pyogenes* <SEQ ID 7335> which encodes the amino acid sequence <SEQ ID 7336>. Analysis of this protein sequence reveals the following:

```
Possible site: 22
>>> Seems to have no N-terminal signal sequence

----- Final Results -----
            bacterial cytoplasm --- Certainty = 0.2584(Affirmative) < succ>
            bacterial membrane  --- Certainty = 0.0000(Not Clear)   < succ>
             bacterial outside  --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2419

A DNA sequence (GASx187) was identified in *S. pyogenes* <SEQ ID 7337> which encodes the amino acid sequence <SEQ ID 7338>. Analysis of this protein sequence reveals the following:

```
Possible site: 61
>>> Seems to have no N-terminal signal sequence

----- Final Results -----
            bacterial cytoplasm --- Certainty = 0.2084(Affirmative) < succ>
            bacterial membrane  --- Certainty = 0.0000(Not Clear)   < succ>
             bacterial outside  --- Certainty = 0.0000(Not Clear)   < succ>
```

No corresponding DNA sequence was identified in *S. agalactiae*.

Based on this analysis, it was predicted that this GAS-specific protein and its epitopes, could be useful antigens for vaccines or diagnostics.

EXAMPLE 2420

A DNA sequence (GASx188) was identified in *S. pyogenes* <SEQ ID 7339> which encodes the amino acid sequence <SEQ ID 7340>. Analysis of this protein sequence reveals the following:

```
Possible site: 34
>>> Seems to have no N-terminal signal sequence
```

```
----- Final Results -----
          bacterial cytoplasm --- Certainty = 0.2060(Affirmative) < succ>
           bacterial membrane --- Certainty = 0.0000(Not Clear)   < succ>
            bacterial outside --- Certainty = 0.0000(Not Clear)   < succ>
```

No corresponding DNA sequence was identified in *S. agalactiae*.

The protein has homology with the following sequences in the GENPEPT database:

```
>GP: AAG05515 GB: AE004640 conserved hypothetical protein
[Pseudomonas aeruginosa]
Identities = 140/442 (31%), Positives = 208/442 (46%),
Gaps = 73/442 (16%)

Query:    2 KKYLNQNVYDALIERLHFLFNDFPIVYISFSGGKDSGLLLNILLDFRDKYYPDREIG---   58
            K Y + +V+ A + RL  +F +F  V ++FSGGKDS + L + LD       RE+G
Sbjct:    4 KHYQDADVHAATLSRLRLVFRNFERVCVAFSGGKDSSVTLQLALDVA------RELGRSP  57

Query:   59 --VFHQDFEAQYSLTTKYVQETFTSLEGRKKVSLYWVCLPMATRTALSSYEMFWYPWDDK  116
              V   D EQY T +V E     GR V +WVCLP+  R A S  E +W  W+
Sbjct:   58 VDVLFIDLEGQYQATIDHVSEML----GRPDVRPWWVCLPLNLRNASSLEEPYWCCWEPG 113

Query:  117 TEDIWVRPMPSQDYVINLENNSITTYRYKMNQEDLAKQFGRWYKQIHGNQKTVCILGNRA  176
            E  WVRP+P Q  VI+ +      YRY+M  E+    F  W +    + T ++G R+
Sbjct:  114 AEADWVRPLPKQRGVIS-DPAFFPFYRYRMEFEEFVAGFNAWLAR---EEPTAFLVGIRS  169

Query:  177 SESLHRYSGFINKKYGYQKEC------------WITKQFKDVWTAS--PLYDWSVEDIWH  222
            ESL+RY       K+     K+C          W  +    S  P+YDW  ED+W
Sbjct:  170 DESLNRYLAV--KRRSRAKQCAWTPPGGSAPLAWSARDRANPQAVSFFPIYDWRFEDLWR  227

Query:  223 AYYKFSYSYNELYDLFYKAGLKPSQMRVASPFQDYAVDSLNLYRIIDQETWVKLLGRVQG  282
             Y+YN LYD   Y+AG+   SQMR+   P+ D       L+L+  I+   TW K++ RV G
Sbjct:  228 CVADHGYAYNRLYDQMYRAGVPFSQMRICQPYGDDQRKGLDLFHRIEPRTWFKVVRRVAG  287

Query:  283 VNFSNIYGRTKAMGYK-SIALPKGH-SWKSYTQFLLSTLPVRLRNNYVRKFNKSIDFWHK  340
              N+     Y R + +GY+  + LP    +W+ Y+QFLL ++P  LR   Y R+   + I +W +
Sbjct:  288 ANYGARYCRQRFLGYRGGLGLPPSFGTWREYSQFLLRSMPPPLRGIYQRRIERFILWWKQ  347

Query:  341 TGGGLAEETINELIEKGYRIARNGISNYTSFKHSRVIFLDQ-IPDDTDDIVTTKDIPSWK  399
                LA                             I+ D  IP   +   +   PSW+
Sbjct:  348 HDYPLA-----------------------------IWPDAGIP----ALENRRKQPSWR  373

Query:  400 RMCFCILKNDHICRTMGFGLTR                                       421
            R+   +LK D + R++ FG ++
Sbjct:  374 RIALSLLKQD-MARSLSFGFSQ                                       394
```

Based on this analysis, it was predicted that this GAS-specific protein and its epitopes, could be useful antigens for vaccines or diagnostics.

EXAMPLE 2421

A DNA sequence (GASx189) was identified in *S. pyogenes* <SEQ ID 7341> which encodes the amino acid sequence <SEQ ID 7342>. Analysis of this protein sequence reveals the following:

```
Possible site: 45
>>> Seems to have no N-terminal signal sequence

----- Final Results -----
          bacterial cytoplasm --- Certainty = 0.4121(Affirmative) < succ>
           bacterial membrane --- Certainty = 0.0000(Not Clear)   < succ>
            bacterial outside --- Certainty = 0.0000(Not Clear)   < succ>
```

No corresponding DNA sequence was identified in *S. agalactiae*.

The protein has homology with the following sequences in the GENPEPT database:

```
>GP: AAC73702 GB: AE000165 orf, hypothetical protein
[Escherichia coli]
Identities = 79/162 (48%), Positives = 110/162 (67%), Gaps = 1/162 (0%)

Query:     7 PVYEIKSIPIEKISPNDYNPNSVAPPEMKLLYDSIKSDGYTMPIVCYYDKEEDRYSIVDG    66
             PV  +    ++ PNDYNPN+VAPPE KLL  SI+ DG+T PIV   +  +++    IVDG
Sbjct:    46 PVDCVLWVKNSQLMPNDYNPNNVAPPEKKLLQKSIEIDGFTQPIVVTHT-DKNAMEIVDG   104

Query:    67 FHRYRIMLDYSDIYERESGRLPVSVIDKSLDYRMASTIRHNRARGSHDVDLMSQIVKDLH   126
             FHR+ I    S  +   R  G LPV+ ++ + + R+A+TIRHNRARG H  +  MS+IV++L
Sbjct:   105 FHRHEIGKGSSSLKLRLKGYLPVTCLEGTRNQRIAATIRHNRARGRHQITAMSEIVRELS   164

Query:   127 ECGRSDNWIAKHLGMDKDEILRLKQITGLASLFKDHEFNQSW                    168
             + G   DN I K LGMD DE+LRLKQI GL   LF D +++++W
Sbjct:   165 QLGWDDNKIGKELGMDSDEVLRLKQINGLQELFADRQYSRAW                    206
```

Based on this analysis, it was predicted that this GAS-specific protein and its epitopes, could be useful antigens for vaccines or diagnostics.

EXAMPLE 2422

A repeated DNA sequence (GASx192R) was identified in *S. pyogenes* <SEQ ID 7343> which encodes the amino acid sequence <SEQ ID 7344>. Analysis of this protein sequence reveals the following:

```
Possible site: 13
>>> Seems to have no N-terminal signal sequence

----- Final Results -----
              bacterial cytoplasm --- Certainty = 0.4301(Affirmative) < succ>
               bacterial membrane --- Certainty = 0.0000(Not Clear) < succ>
                bacterial outside --- Certainty = 0.0000(Not Clear) < succ>
```

No corresponding DNA sequence was identified in *S. agalactiae.*

The protein has homology with the following sequences in the GENPEPT database:

```
>GP: CAA63509 GB: X92946 transposase
[Lactococcus lactis]
Identities = 23/36 (63%), Positives = 28/36 (76%)

Query:    1 MQDKLVTEAFNQAYNREKPKEGVIVHTDQGSQYTGA  36
            MQDKLV + F QA  +E P+ G+IVHTDQGSQYT +
Sbjct:  134 MQDKLVRDCFLQACGKEHPQPGLIVHTDQGSQYTSS 169
```

Based on this analysis, it was predicted that this GAS-specific protein and its epitopes, could be useful antigens for vaccines or diagnostics.

EXAMPLE 2423

A DNA sequence (GASx194R) was identified in *S. pyogenes* <SEQ ID 7345> which encodes the amino acid sequence <SEQ ID 7346>. Analysis of this protein sequence reveals the following:

```
Possible site: 26
>>> Seems to have an uncleavable N-term signal seq

----- Final Results -----
               bacterial membrane --- Certainty = 0.0000(Not Clear) < succ>
                bacterial outside --- Certainty = 0.0000(Not Clear) < succ>
              bacterial cytoplasm --- Certainty = 0.0000(Not Clear) < succ>
```

No corresponding DNA sequence was identified in *S. agalactiae.*

The protein has homology with the following sequences in the GENPEPT database:

```
>GP: CAA63508 GB: X92946 hypothetical protein
[Lactococcus lactis]
Identities = 64/96 (66%), Positives = 78/96 (80%)

Query:  1 MPRKTFDKAFKLSAVKLILEEEQSVKMVSSTLEIHPNSLYQWIQEYEKYGESAFPGHGSA   60
          M R+ FDK FK SAVKLILEE  SVK VS   LE+H NSLY+W+QE E+YGESAFPG+G+A
Sbjct:  1 MARRKFDKQFKNSAVKLILEEGYSVKEVSQELEVHANSLYRWVQEVEEYGESAFPGNGTA   60
```

-continued

```
Query: 61 LRHAQFETKKLEKEHKLLQEELALLKKFQVFLKPNR          96
          L +AQ + K LEKE++ LQEEL LLKKF+VFLK ++
Sbjct: 61 LANAQHKIKLLEKENRYLQEELELLKKFRVFLKRSK          96
```

Based on this analysis, it was predicted that this GAS-specific protein and its epitopes, could be useful antigens for vaccines or diagnostics.

EXAMPLE 2424

A DNA sequence (GASx195R) was identified in *S. pyogenes* <SEQ ID 7347> which encodes the amino acid sequence <SEQ ID 7348>. Analysis of this protein sequence reveals the following:

```
Possible site: 13
>>> Seems to have a cleavable N-term signal seq.
   INTEGRAL     Likelihood = -11.30    Transmembrane    179-195 (173-201)
   INTEGRAL     Likelihood = -8.86     Transmembrane    229-245 (224-254)
   INTEGRAL     Likelihood = -8.39     Transmembrane    289-305 (280-307)
   INTEGRAL     Likelihood = -8.23     Transmembrane    417-433 (410-435)
   INTEGRAL     Likelihood = -5.89     Transmembrane    324-340 (323-349)
   INTEGRAL     Likelihood = -4.73     Transmembrane    260-276 (256-278)
   INTEGRAL     Likelihood = -4.51     Transmembrane     96-112 (91-113)
   INTEGRAL     Likelihood = -4.25     Transmembrane      24-40 (20-43)
   INTEGRAL     Likelihood = -2.44     Transmembrane    344-360 (342-360)

----- Final Results -----
               bacterial membrane --- Certainty = 0.5522(Affirmative) < succ>
                bacterial outside --- Certainty = 0.0000(Not Clear) < succ>
              bacterial cytoplasm --- Certainty = 0.0000(Not Clear) < succ>
```

No corresponding DNA sequence was identified in *S. agalactiae*.

The protein has homology with the following sequences in the GENPEPT database:

```
>GP: CAB75191 GB: AL139075 putative integral membrane protein
[Campylobacter jejuni]
Identities = 177/430 (41%), Positives = 274/430 (63%),
Gaps = 8/430 (1%)

Query:   5 IIISAIALAIGIGYRTKINIGLLAIAFSYLIATTLMGLSPKELLHFWPTSLFFTIFSVSL   64
           +IIS+I +AI +GY T+ N+G+ A+ F+Y+I    M L+PK+++ FWP S+FF IF+VSL
Sbjct:   6 LIISSIIVAIILGYITRHNVGIFAMIFAYIIGAFFMDLAPKKIIAFWPISIFFVIFAVSL   65

Query:  65 FYNVATTNGTLDVLAQHILYRTRTHPNALYMILYLIATLLSALGAGFFTTMAVCCPLAIT  124
           FYN AT NGTL+ LA H++YR    HP  L  ++++++ +++ALGAGF+T +A   PL
Sbjct:  66 FYNFATVNGTLEKLAGHLMYRFANHPYLLPFVIFVVSAIIAALGAGFYTVLAFMAPLTFL  125

Query: 125 LCQKADKHPLIGAQAVNWGASGGANLITSGSGIVFQGLFKQMGWE-EQAFSLGNHIFIVS  183
           LC K      + GA A+N+GA GGAN ITS SGI+F+GL +  G E  +AF+  + IF  +
Sbjct: 126 LCDKIGLSKIAGAMAINYGALGGANFITSQSGIIFRGLMENSGIEANEAFANSSIIFAFT  185

Query: 184 IIYPLIVLLLLSCYIRYSKGRTNSSLT-IDQPPVLSKVQRQTTLLMISSMVLVWLFPLLL  242
           II P++VL      +  ++  + N  ++ I +P       Q+ T +LM    +V+V +FP+L
Sbjct: 186 IILPIVVL----SFFVFNAFKNNIKISVISKPDPFDYKQKTTLILMFMMIVVVLIFPVLN  241

Query: 243 LIFPNIAWIATYRQTFDIGFVSILMVCLALRLKLGKQEAILAKVPWAIIIMLCGMSLLMS  302
           +IFP+    I+ + +  DI  ++++ V +AL LKL  ++ ++A +PW  +IM+CG+ +L+S
Sbjct: 242 IIFPHNETISYFNKKIDIAMIAMIFVAIALFLKLADEKQVVALIPWGTLIMICGVGMLIS  301

Query: 303 LAVKSGLVTLIGHLITTTIPHFWLPLFFCVIAGVMSLFSSTLSVVAPTLFPIIATISAQS  362
           +AV++G + L    L+    I    ++PL   C IA  MSLFSSTL VV P LFPI+ +I+A S
Sbjct: 302 IAVEAGAIKLFSDLVENEINVIFIPLIMCAIAAFMSLFSSTLGVVTPALFPIVPSIAASS  361

Query: 363 PHIDIRLLTTATIIGALSTNISPFSSAGSLIQLSLPHIEERSLAFKKQILLGVPISLSLA  422
              +   LL +  ++GA ++ ISPFSS GSLI   S P    +  L FK  ++  VPI     A
Sbjct: 362 -GLSEALLFSCIVVGAQASAISPFSSGGSLILGSCPDKYKEKL-FKDLLIKAVPIGFIAA  419

Query: 423 LLTIWILMLL                                                  432
           +L   I+  +
Sbjct: 420 ILATIIMSFI                                                  429
```

Based on this analysis, it was predicted that this GAS-specific protein and its epitopes, could be useful antigens for vaccines or diagnostics.

EXAMPLE 2425

A DNA sequence (GASx196) was identified in *S. pyogenes* <SEQ ID 7349> which encodes the amino acid sequence <SEQ ID 7350>. Analysis of this protein sequence reveals the following:

```
Possible site: 57
>>> Seems to have no N-terminal signal sequence

----- Final Results -----
            bacterial cytoplasm --- Certainty = 0.0563(Affirmative) < succ>
            bacterial membrane  --- Certainty = 0.0000(Not Clear)   < succ>
            bacterial outside   --- Certainty = 0.0000(Not Clear)   < succ>
```

No corresponding DNA sequence was identified in *S. agalactiae*.

The protein has homology with the following sequences in the GENPEPT database:

```
>GP: AAC45128 GB: U65510 nicotinate-nucleotide pyrophosphorylase
[Rhodospirillum rubrum]
Identities = 116/277 (41%), Positives = 170/277 (60%),
Gaps = 4/277 (1%)

Query:  17 LTPFQIDDTLKAALREDV-HSEDYSTNAIFDHHGQAKVSLFAKEAGVLAGLTVFQRVFTL   75
           L+PF ID+ ++ AL ED+  + D ++ A       +A     A++ G+LAGL   +  F L
Sbjct:  10 LSPFAIDEAVRRALAEDLGRAGDITSTATIPAATRAHARFVARQPGILAGLGCARSAFAL   69

Query:  76 FDTEVTFQNPHQFKDGDRLTSGDLVLEIIGSVRSLLTCERVALNFLQHLSGIASMTAAYV  135
              D   VTF  P    +DG   + +G   V E+ G+ R++L   ER ALNFL HLSGIA+  T    +
Sbjct:  70 LDDTVTFTTP--LEDGAEIAAGQTVAEVAGAARTILAAERTALNFLGHLSGIATRTRRFG  127

Query: 136 EALGDDRIKVFDTRKTTPNLRLFEKYAVRVGGGYNHRFNLSDAIMLKDNHIAAVGSVQKA  195
              +A+    R ++  TRKTTP LR   EKYAVR GGG NHRF L DA+++KDNHIA  G V  A
Sbjct: 128 DAIAHTRARLTCTRKTTPGLRGLEKYAVRCGGGSNHRFGLDDAVLIKDNHIAVAGGVSAA  187

Query: 196 IAQARAYAPFVKMVEVEVESL-AAAEEAAAAGVDIIMLDNMSLEQIEQAITLIAGRSRIE  254
              +++ARA   +   +E+EV++L   AE   A  G ++++LDNM   + +A+ ++AGR    E
Sbjct: 188 LSRARAGVGHMVRIEIEVDTLEQLAEVLAVGGAEVVLLDNMDAPTLTRAVDMVAGRLVTE  247

Query: 255 CSGNIDMTTISRFRGLAIDYVSSGSLTHSAKSLDFSM                        291
              SG + +  TI+         +DY+S  G+LTHS   +LD +
Sbjct: 248 ASGGVSLDTIAALAESGVDYISVGALTHSVTTLDIGL                        284
```

Based on this analysis, it was predicted that this GAS-specific protein and its epitopes, could be useful antigens for vaccines or diagnostics.

EXAMPLE 2426

A DNA sequence (GASx199) was identified in *S. pyogenes* <SEQ ID 7351> which encodes the amino acid sequence <SEQ ID 7352>. Analysis of this protein sequence reveals the following:

```
Possible site: 25
>>> Seems to have no N-terminal signal sequence

----- Final Results -----
            bacterial cytoplasm --- Certainty = 0.1649(Affirmative) < succ>
            bacterial membrane  --- Certainty = 0.0000(Not Clear)   < succ>
            bacterial outside   --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2427

A DNA sequence (GASx201) was identified in *S. pyogenes* <SEQ ID 7353> which encodes the amino acid sequence <SEQ ID 7354>. Analysis of this protein sequence reveals the following:

```
Possible site: 19
>>> Seems to have an uncleavable N-term signal seq

----- Final Results -----
          bacterial membrane --- Certainty = 0.0000(Not Clear) < succ>
          bacterial outside  --- Certainty = 0.0000(Not Clear) < succ>
          bacterial cytoplasm --- Certainty = 0.0000(Not Clear) < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2428

A DNA sequence (GASx203) was identified in *S. pyogenes* <SEQ ID 7355> which encodes the amino acid sequence <SEQ ID 7356>. Analysis of this protein sequence reveals the following:

```
Possible site: 37
>>> Seems to have a cleavable N-term signal seq.

----- Final Results -----
          bacterial outside  --- Certainty = 0.3000(Affirmative) < succ>
          bacterial membrane --- Certainty = 0.0000(Not Clear)   < succ>
          bacterial cytoplasm --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2429

A DNA sequence (GASx210) was identified in *S. pyogenes* <SEQ ID 7357> which encodes the amino acid sequence <SEQ ID 7358>. Analysis of this protein sequence reveals the following:

```
Possible site: 29
>>> Seems to have an uncleavable N-term signal seq

----- Final Results -----
          bacterial membrane --- Certainty = 0.0000(Not Clear) < succ>
          bacterial outside  --- Certainty = 0.0000(Not Clear) < succ>
          bacterial cytoplasm --- Certainty = 0.0000(Not Clear) < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2430

A DNA sequence (GASx211) was identified in *S. pyogenes* <SEQ ID 7359> which encodes the amino acid sequence <SEQ ID 7360>. Analysis of this protein sequence reveals the following:

```
Possible site: 24
>>> Seems to have a cleavable N-term signal seq.

----- Final Results -----
            bacterial outside --- Certainty = 0.3000(Affirmative) < succ>
           bacterial membrane --- Certainty = 0.0000(Not Clear)   < succ>
          bacterial cytoplasm --- Certainty = 0.0000(Not Clear)   < succ>
```

No corresponding DNA sequence was identified in *S. agalactiae*.

Based on this analysis, it was predicted that this GAS-specific protein and its epitopes, could be useful antigens for vaccines or diagnostics.

EXAMPLE 2431

A DNA sequence (GASx213) was identified in *S. pyogenes* <SEQ ID 7361> which encodes the amino acid sequence <SEQ ID 7362>. Analysis of this protein sequence reveals the following:

```
Possible site: 14
>>> Seems to have no N-terminal signal sequence

----- Final Results -----
          bacterial cytoplasm --- Certainty = 0.4430(Affirmative) < succ>
           bacterial membrane --- Certainty = 0.0000(Not Clear)   < succ>
            bacterial outside --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2432

A DNA sequence (GASx219) was identified in *S. pyogenes* <SEQ ID 7363> which encodes the amino acid sequence <SEQ ID 7364>. Analysis of this protein sequence reveals the following:

```
Possible site: 15
>>> Seems to have an uncleavable N-term signal seq

----- Final Results -----
           bacterial membrane --- Certainty = 0.0000(Not Clear)   < succ>
            bacterial outside --- Certainty = 0.0000(Not Clear)   < succ>
          bacterial cytoplasm --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2433

A DNA sequence (GASx220) was identified in *S. pyogenes* <SEQ ID 7365> which encodes the amino acid sequence <SEQ ID 7366>. Analysis of this protein sequence reveals the following:

```
Possible site: 24
>>> Seems to have no N-terminal signal sequence

----- Final Results -----
          bacterial cytoplasm --- Certainty = 0.0530(Affirmative) < succ>
           bacterial membrane --- Certainty = 0.0000(Not Clear)   < succ>
            bacterial outside --- Certainty = 0.0000(Not Clear)   < succ>
```

No corresponding DNA sequence was identified in S. aga-lactiae.

The protein has no significant homology with any sequences in the GENPEPT database.

Based on this analysis, it was predicted that this GAS-specific protein and its epitopes, could be useful antigens for vaccines or diagnostics.

EXAMPLE 2434

A DNA sequence (GASx231R) was identified in S. pyogenes <SEQ ID 7367> which encodes the amino acid sequence <SEQ ID 7368>. Analysis of this protein sequence reveals the following:

```
Possible site: 30
>>> Seems to have an uncleavable N-term signal seq

----- Final Results -----
            bacterial membrane --- Certainty = 0.0000(Not Clear) < succ>
            bacterial outside  --- Certainty = 0.0000(Not Clear) < succ>
            bacterial cytoplasm --- Certainty = 0.0000(Not Clear) < succ>
```

No corresponding DNA sequence was identified in S. agalactiae.

The protein has no significant homology with any sequences in the GENPEPT database.

Based on this analysis, it was predicted that this GAS-specific protein and its epitopes, could be useful antigens for vaccines or diagnostics.

EXAMPLE 2435

A DNA sequence (GASx237) was identified in S. pyogenes <SEQ ID 7369> which encodes the amino acid sequence <SEQ ID 7370>. Analysis of this protein sequence reveals the following:

```
Possible site: 52
>>> Seems to have no N-terminal signal sequence

----- Final Results -----
            bacterial cytoplasm --- Certainty = 0.4961(Affirmative) < succ>
            bacterial membrane  --- Certainty = 0.00000(Not Clear) < succ>
            bacterial outside   --- Certainty = 0.0000(Not Clear) < succ>
```

No corresponding DNA sequence was identified in S. agalactiae.

The protein has homology with the following sequences in the GENPEPT database:

```
>GP: CAB49143 GB: AJ248283 hypothetical protein
[Pyrococcus abyssi]
Identities = 79/229 (34%), Positives = 131/229 (56%),
Gaps = 11/229 (4%)

Query:   18 MRFTIDQNMQFPLVEIDLEHGGSVYLQQGSMVYHTENVTLNTKLNGKGSGLGKLVGAIGR   77
            M + I+      F L+E++L  G +V  + G+MVY    V++ TK  G       L+GA+ R
Sbjct:    1 MEYRIEHRPSFSLLEVNLREGEAVQAEAGAMVYMDPTVSIETKARGG------LLGALKR   54

Query:   78 SMVSGESMFITQAMSNGDGKLALAPNTPGQIVALELGEKQYRLNDGAFLALDGSAQYKME  137
            S++ GES F+  +  G G++   AP  PG I++LEL    Y    GAFL         ++
Sbjct:   55 SVLGGESFFMN--VFRGPGRVGFAPGYPGDIISLELNGTLYA-QSGAFLVASEGIDIDVK  111

Query:  138 RQNIGKALFGGQGGLFVMTTEGLGTLLANSFGSIKKITLDGGTMTIDNAHVVAWSRELDY  197
               GK +FG +G +F++   +G G +   +S+G+I+KITL G ++ +D   H+VA++    +D+
Sbjct:  112 FGG-GKTIFGREG-VFLLELKGKGIVFLSSYGAIEKITLRGESVIVDTGHMVAFTEGIDF  169

Query:  198 DIHLENGFMQSIGTGEGVVNTFRGHGEIYIQSLNLEQFAGTLKRYLPTS             246
              I    G   ++ +GEG+V  F  GHG++YIQ+ +L+ F   +   +LP S
Sbjct:  170 RIRKIGGLKATLFSGEGLVFEFSGHGDVYIQTRSLDGFLSWILPHLPKS            218
```

Based on this analysis, it was predicted that this GAS-specific protein and its epitopes, could be useful antigens for vaccines or diagnostics.

EXAMPLE 2436

A DNA sequence (GASx240R) was identified in *S. pyogenes* <SEQ ID 7371> which encodes the amino acid sequence <SEQ ID 7372>. Analysis of this protein sequence reveals the following:

```
Possible site: 35
>>> Seems to have no N-terminal signal sequence

----- Final Results -----
          bacterial cytoplasm --- Certainty = 0.2745(Affirmative) < succ>
          bacterial membrane  --- Certainty = 0.0000(Not Clear)   < succ>
           bacterial outside  --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2437

A DNA sequence (GASx241) was identified in *S. pyogenes* <SEQ ID 7373> which encodes the amino acid sequence <SEQ ID 7374>. Analysis of this protein sequence reveals the following:

```
Possible site: 21
>>> Seems to have an uncleavable N-term signal seq
    INTEGRAL      Likelihood = -10.14     Transmembrane   196-212 (187-215)
    INTEGRAL      Likelihood =  -8.01     Transmembrane   160-176 (156-179)
    INTEGRAL      Likelihood =  -5.89     Transmembrane   116-132 (110-134)
    INTEGRAL      Likelihood =  -4.57     Transmembrane    74-90  (73-97)
    INTEGRAL      Likelihood =  -2.66     Transmembrane    51-67  (50-68)
    INTEGRAL      Likelihood =  -2.60     Transmembrane     8-24  (7-27)
    INTEGRAL      Likelihood =  -1.28     Transmembrane   344-360 (344-360)
    INTEGRAL      Likelihood =  -0.22     Transmembrane    30-46  (30-46)

----- Final Results -----
           bacterial membrane  --- Certainty = 0.5055(Affirmative) < succ>
            bacterial outside  --- Certainty = 0.0000(Not Clear)   < succ>
          bacterial cytoplasm  --- Certainty = 0.0000(Not Clear)   < succ>
```

No corresponding DNA sequence was identified in *S. agalactiae*.

The protein has homology with the following sequences in the GENPEPT database:

```
>GP: CAC10175 GB: AJ278302 histidine kinase
[Streptococcus pneumoniae]
Identities = 136/449 (30%), Positives = 234/449 (51%),
Gaps = 26/449 (5%)

Query:     8 FLLLSIIVYYMTKIYIFSFLSDITLP---VWKQLTI-LALALFFNQFPYLS-----PLLI   58
             ++LL  +V +  KI IF +  I+L     ++K   + LA+ F     Y+          +
Sbjct:     5 WILLYTLVTHGLKIVIFFKVDGISLTFERIFKAFLFKILLAVVFGMLGYMVGNVYLSYFM   64

Query:    59 DPL----LFLVVLRQETKQLFSLKALFLAVAPSVLVDLLSRFMGTIVIPYLFLSSGIYLG  114
             +PL     L   ++LR+  K+L     LF + P +LV+L  R +     V+P  FL   G
Sbjct:    65 EPLYGIGLSFLLLRELPKKLL----LFYGLFPMILVNLFYRGVSYFVLP--FLGQGQVYD  118

Query:   115 HIIFDLLAYLLIFPSFAIINYMIGKDYKMIC-QSGYSKRSHNFYQTLLMFVLVYYVDIFV  173
                F  L  ++IF  F + ++    DY    + G +         T + +++  Y   +
Sbjct:   119 DYSFIWLC-IIIFNFFISLAFLKWLDYDFTSLRKGILDKDFQKSLTQINWIMGAYYLVIQ  177

Query:   174 ILGFTDPFLHFHHSLFVPTPYKLLFLMFILLLVYLLSYFNHSSKEYLKNELRREQQAYMT  233
                 L + +     +    T   L+ + ++L  + ++   +    K+ L    L +EQ
Sbjct:   178 NLSYFE----YEQGIQSTTVRHLILVFYLLFFMGIIKKLDTYLKDKLHERLNQEQDLRYR  233

Query:   234 NLEIYGKHLEKLYRDVRAFQSDYLSRIERLGQAIKSESITQIQDIYAQTVHEANDYWDDK  293
             +E Y +H+E+LY++VR+F+  DY + +  L    I+ E + QI++IY    ++++  D
Sbjct:   234 EMERYSRHIEELYKEVRSFRHDYTNLLTSLRLGIEEEDMEQIKEIYDSVLKDSSEKLQDN  293
```

```
Query: 294 HYNISKLRKINISSIKSLLSAKIISAEKSGIDLNVEVPDNIKETYIPELDLLLLMSIFCD 353
            Y++ +L +   ++KSLL+ K I A    I   NVEVP+ I+  +  LD L ++SI CD
Sbjct: 294 KYDLGRLVNVRDRALKSLLAGKFIKARDKNIVFNVEVPEEIQVEGVSLLDFLTVVSILCD 353

Query: 354 NAIEAALEAQQPHMSIAYFLLGDYQMFVVTNTTKKK-VDINKIFEEGYSSKGSERGIGLS 412
            NAIEA++EA QPH+SIA+F  G  + F++ N+ K++ +DI++IF  G SSKG ERG+GL
Sbjct: 354 NAIEASVEACQPHVSIAFFKNGAQETFIIENSIKEEGIDISEIFSFGASSKGEERGVGLY 413

Query: 413 NAQRILKKYPYLSLRTKSFDKEFSQTLTM 441
            +I++ +P  SL T   D  F Q LT+
Sbjct: 414 TVMKIVESHPNTSLNTTCQDHVFRQVLTV 442
```

Based on this analysis, it was predicted that this GAS-specific protein and its epitopes, could be useful antigens for vaccines or diagnostics.

EXAMPLE 2438

A DNA sequence (GASx242R) was identified in *S. pyogenes* <SEQ ID 7375> which encodes the amino acid sequence <SEQ ID 7376>. Analysis of this protein sequence reveals the following:

```
Possible site: 26
>>> Seems to have no N-terminal signal sequence

----- Final Results -----
              bacterial cytoplasm --- Certainty = 0.4165(Affirmative) < succ>
               bacterial membrane --- Certainty = 0.0000(Not Clear) < succ>
                bacterial outside --- Certainty = 0.0000(Not Clear) < succ>
```

No corresponding DNA sequence was identified in *S. agalactiae.*

The protein has no significant homology with any sequences in the GENPEPT database.

Based on this analysis, it was predicted that this GAS-specific protein and its epitopes, could be useful antigens for vaccines or diagnostics.

EXAMPLE 2439

A DNA sequence (GASx243) was identified in *S. pyogenes* <SEQ ID 7377> which encodes the amino acid sequence <SEQ ID 7378>. Analysis of this protein sequence reveals the following:

```
Possible site: 26
>>> Seems to have an uncleavable N-term signal seq
     INTEGRAL    Likelihood = -11.09     Transmembrane    188-204 (182-208)
     INTEGRAL    Likelihood = -7.17      Transmembrane      52-68 (47-69)
     INTEGRAL    Likelihood = -4.73      Transmembrane    119-135 (114-142)
     INTEGRAL    Likelihood = -4.62      Transmembrane      83-99 (77-107)
     INTEGRAL    Likelihood = -1.86      Transmembrane    328-344 (328-345)
     INTEGRAL    Likelihood = -1.65      Transmembrane       7-23 (6-23)
     INTEGRAL    Likelihood = -0.22      Transmembrane      35-51 (35-51)

----- Final Results -----
               bacterial membrane --- Certainty = 0.5437(Affirmative) < succ>
                bacterial outside --- Certainty = 0.0000(Not Clear) < succ>
              bacterial cytoplasm --- Certainty = 0.0000(Not Clear) < succ>
```

No corresponding DNA sequence was identified in *S. agalactiae.*

The protein has homology with the following sequences in the GENPEPT database:

```
>GP: CAC10175 GB: AJ278302 histidine kinase [Streptococcus pneumoniae]
Identities = 123/438 (28%), Positives = 229/438 (52%), Gaps = 49/438 (11%)

Query:  20 VIFAKVSAIKLSWKRVS-------IIGISFVIANMIFDKVIL---IDQLFFIIVSLL---   66
           VIF KV  I L+++R+        ++ + F +   +  V L   ++ L+ I +S L
Sbjct:  19 VIFFKVDGISLTFERIFKAFLFKILLAVVFGMLGYMVGNVYLSYFMEPLYGIGLSFLLLR   78

Query:  67 SAPKKKLFEHMFNGFFTILIVELLFRVIGSFFLPAVLGFSIGQINNNLKLLELCYLFVLP  126
             PKK L   +F G F +++V L +R +  F LP +     GQ+ ++   + LC + +
Sbjct:  79 ELPKKLL---LFYGLFPMILVNLFYRGVSYFVLPFL---GQGQVYDDYSFIWLC-IIIFN  131
```

```
-continued
Query: 127 IFYLFSYIFSIDL---SLIRFISEDKMKKWVFWMNTAMFSYYFFAHFLVTVQSGFLALYF 183
            F    +++  +D    SL + I +    +K +  +N  M +YY     L          YF
Sbjct: 132 FFISLAFLKWLDYDFTSLRKGILDKDFQKSLTQINWIMGAYYLVIQNLS---------YF 182

Query: 184 QY---------RSILVFIYLAIFIWVIVKLDRFAKDQLSQKLTQAQNERIAYLENYNQSI 234
            +Y          R +++   YL  F+ +I KLD + KD+L ++L Q Q+ R    +E Y++ I
Sbjct: 183 EYEQGIQSTTVRHLILVFYLLFFMGIIKKLDTYLKDKLHERLNQEQDLRYREMERYSRHI 242

Query: 235 EQLYREIRTVKHDSENILISLKDSIDSGDIDLITRVYDTVIQQSATSMMRTNYEISSLDN 294
            E+LY+E+R+ +HD  N+L SL+   I+   D++ I   +YD+V++ S+  +     Y++  L  N
Sbjct: 243 EELYKEVRSFRHDYTNLLTSLRLGIEEEDMEQIKEIYDSVLKDSSEKLQDNKYDLGRLVN 302

Query: 295 IKEAVIRSIMNSKLLEAQYLGIELYIEIPDVIDHLPIKLIDLIVLFTGLVDNAIETAKGS 354
            +++   ++S++   K  ++A+     I     +E+P+ I       + L+D + + + L DNAIE +  +
Sbjct: 303 VRDRALKSLLAGKFIKARDKNIVFNVEVPEEIQVEGVSLLDFLTVVSILCDNAIEASVEA 362

Query: 355 RRPFLSIAYFKQDNKQLFIIENSTKTNRVDIAKRFDAQQQNSAH--------FLTVLDSY 406
              +P  +SIA+FK   ++ FIIENS K   +DI++ F    +            + +++S+
Sbjct: 363 CQPHVSIAFFKNGAQETFIIENSIKEEGIDISEIFSFGASSKGEERGVGLYTVMKIVESH 422

Query: 407 PQITLSTKSDHYRLRQLL                                          424
            P   +L+T    +  RQ+L
Sbjct: 423 PNTSLNTTCQDHVFRQVL                                          440
```

Based on this analysis, it was predicted that this GAS-specific protein and its epitopes, could be useful antigens for vaccines or diagnostics.

EXAMPLE 2440

A DNA sequence (GASx248) was identified in *S. pyogenes* <SEQ ID 7379> which encodes the amino acid sequence <SEQ ID 7380>. Analysis of this protein sequence reveals the following:

```
Possible site: 32
>>> Seems to have no N-terminal signal sequence

----- Final Results -----
         bacterial cytoplasm --- Certainty = 0.5665(Affirmative) < succ>
          bacterial membrane --- Certainty = 0.0000(Not Clear)   < succ>
           bacterial outside --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2441

A DNA sequence (GASx255) was identified in *S. pyogenes* <SEQ ID 7381> which encodes the amino acid sequence <SEQ ID 7382>. Analysis of this protein sequence reveals the following:

```
Possible site: 19
>>> Seems to have no N-terminal signal sequence

----- Final Results -----
         bacterial cytoplasm --- Certainty = 0.1437(Affirmative) < succ>
          bacterial membrane --- Certainty = 0.000(Not Clear)    < succ>
           bacterial outside --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2442

A DNA sequence (GASx270R) was identified in *S. pyogenes* <SEQ ID 7383> which encodes the amino acid sequence <SEQ ID 7384>. Analysis of this protein sequence reveals the following:

```
Possible site: 21
>>> Seems to have no N-terminal signal sequence
     INTEGRAL     Likelihood = -5.89     Transmembrane     20-36 (17-36)

----- Final Results -----
               bacterial membrane --- Certainty = 0.3357(Affirmative) < succ>
                bacterial outside --- Certainty = 0.0000(Not Clear)   < succ>
              bacterial cytoplasm --- Certainty = 0.0000(Not Clear)   < succ>
```

No corresponding DNA sequence was identified in *S. aga-lactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2443

A DNA sequence (GASx272) was identified in *S. pyogenes* <SEQ ID 7385> which encodes the amino acid sequence <SEQ ID 7386>. Analysis of this protein sequence reveals the following:

```
Possible site: 58
>>> Seems to have no N-terminal signal sequence

----- Final Results -----
              bacterial cytoplasm --- Certainty = 0.2488(Affirmative) < succ>
               bacterial membrane --- Certainty = 0.0000(Not Clear)   < succ>
                bacterial outside --- Certainty = 0.0000(Not Clear)   < succ>
```

No corresponding DNA sequence was identified in *S. aga-lactiae*.

The protein has homology with the following sequences in the GENPEPT database:

```
>GP: CAB11887 GB: Z99104 ribosomal protein S7 (BS7) [Bacillus subtilis]
Identities = 117/156 (75%), Positives = 139/156 (89%)

Query:    1 MSRKNQAPKREVLPDPLYNSKIVTRLINRVMLDGKRGTAATIVYDAFNAIKEATGNDALE   60
            M RK   KR+VLPDP+YNSK+V+RLIN++M+DGK+G   TI+Y +F+ IKE TGNDA+E
Sbjct:    1 MPRKGPVAKRDVLPDPIYNSKLVSRLINKMMIDGKKGKPQTILYKSFDIIKERTGNDAME   60

Query:   61 VFETAMDNIMPVLEVRARRVGGSNYQVPVEVRPERRTTLGLRWLVNASRARGEHTMKDRL  120
            VFE A+ NIMPVLEV+ARRVGG+NYQVPVEVRPERRTTLGLRWLVN +R RGE TM++RL
Sbjct:   61 VFEQALKNIMPVLEVKARRVGGANYQVPVEVRPERRTTLGLRWLVNYARLRGEKTMEERL  120

Query:  121 AKEIMDAANNTGASVKKREDTHKMAEANRAFAHFRW                         156
            A EI+DAANNTGA+VKKREDTHKMAEAN+AFAH+RW
Sbjct:  121 ANEILDAANNTGAAVKKREDTHKMAEANKAFAHYRW                         156
```

Based on this analysis, it was predicted that this GAS-specific protein and its epitopes, could be useful antigens for vaccines or diagnostics.

EXAMPLE 2444

A DNA sequence (GASx274) was identified in *S. pyogenes* <SEQ ID 7387> which encodes the amino acid sequence <SEQ ID 7388>. Analysis of this protein sequence reveals the following:

```
Possible site: 61
>>> Seems to have an uncleavable N-term signal seq

----- Final Results -----
               bacterial membrane --- Certainty = 0.0000(Not Clear) < succ>
                bacterial outside --- Certainty = 0.0000(Not Clear) < succ>
              bacterial cytoplasm --- Certainty = 0.0000(Not Clear) < succ>
```

A related sequence was also identified in GAS <SEQ ID 9095> which encodes the amino acid sequence <SEQ ID 9096>. Analysis of this protein sequence reveals the following:

```
Possible cleavage site: 52
>>> Seems to have no N-terminal signal sequence

----- Final Results -----
          bacterial cytoplasm --- Certainty = 0.291(Affirmative) < succ>
          bacterial membrane  --- Certainty = 0.000(Not Clear)   < succ>
          bacterial outside   --- Certainty = 0.000(Not Clear)   < succ>
```

No corresponding DNA sequence was identified in *S. agalactiae*.

Based on this analysis, it was predicted that this GAS-specific protein and its epitopes, could be useful antigens for vaccines or diagnostics.

EXAMPLE 2445

A DNA sequence (GASx275R) was identified in *S. pyogenes* <SEQ ID 7389> which encodes the amino acid sequence <SEQ ID 7390>. Analysis of this protein sequence reveals the following:

```
Possible site: 16
>>> Seems to have no N-terminal signal sequence

----- Final Results -----
          bacterial cytoplasm --- Certainty = 0.5664(Affirmative) < succ>
          bacterial membrane  --- Certainty = 0.0000(Not Clear)   < succ>
          bacterial outside   --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2446

A DNA sequence (GASx283) was identified in *S. pyogenes* <SEQ ID 7391> which encodes the amino acid sequence <SEQ ID 7392>. Analysis of this protein sequence reveals the following:

```
Possible site: 18
>>> Seems to have no N-terminal signal sequence

----- Final Results -----
          bacterial cytoplasm --- Certainty = 0.0724(Affirmative) < succ>
          bacterial membrane  --- Certainty = 0.0000(Not Clear)   < succ>
          bacterial outside   --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2447

A DNA sequence (GASx298) was identified in *S. pyogenes* <SEQ ID 7393> which encodes the amino acid sequence <SEQ ID 7394>. Analysis of this protein sequence reveals the following:

```
Possible site: 25
>>> Seems to have no N-terminal signal sequence
```

```
----- Final Results -----
          bacterial cytoplasm --- Certainty = 0.2840(Affirmative) < succ>
          bacterial membrane  --- Certainty = 0.0000(Not Clear)   < succ>
           bacterial outside  --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2448

A DNA sequence (GASx300) was identified in *S. pyogenes* <SEQ ID 7395> which encodes the amino acid sequence <SEQ ID 7396>. Analysis of this protein sequence reveals the following:

```
Possible site: 18
>>> Seems to have an uncleavable N-term signal seq
     INTEGRAL    Likelihood = -1.91    Transmembrane    4-20 (4-20)

----- Final Results -----
          bacterial membrane  --- Certainty = 0.1765(Affirmative) < succ>
           bacterial outside  --- Certainty = 0.0000(Not Clear)   < succ>
          bacterial cytoplasm --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2449

A DNA sequence (GASx301) was identified in *S. pyogenes* <SEQ ID 7397> which encodes the amino acid sequence <SEQ ID 7398>. Analysis of this protein sequence reveals the following:

```
Possible site: 33
>>> Seems to have no N-terminal signal sequence

----- Final Results -----
          bacterial cytoplasm --- Certainty = 0.4884(Affirmative) < succ>
          bacterial membrane  --- Certainty = 0.0000(Not Clear)   < succ>
           bacterial outside  --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2450

A repeated DNA sequence (GASx302) was identified in *S. pyogenes* <SEQ ID 7399> which encodes the amino acid sequence <SEQ ID 7400>. Analysis of this protein sequence reveals the following:

```
Possible site: 22
>>> Seems to have no N-terminal signal sequence

----- Final Results -----
          bacterial cytoplasm --- Certainty = 0.2581(Affirmative) < succ>
          bacterial membrane  --- Certainty = 0.0000(Not Clear)   < succ>
           bacterial outside  --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2451

A DNA sequence (GASx316) was identified in *S. pyogenes* <SEQ ID 7401> which encodes the amino acid sequence <SEQ ID 7402>. Analysis of this protein sequence reveals the following:

```
Possible site: 18
>>> Seems to have no N-terminal signal sequence
    INTEGRAL    Likelihood = -0.80    Transmembrane    23-39 (22-39)

----- Final Results -----
            bacterial membrane --- Certainty = 0.1319(Affirmative) < succ>
            bacterial outside  --- Certainty = 0.0000(Not Clear)   < succ>
            bacterial cytoplasm --- Certainty = 0.0000(Not Clear)  < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2452

A DNA sequence (GASx323R) was identified in *S. pyogenes* <SEQ ID 7403> which encodes the amino acid sequence <SEQ ID 7404>. Analysis of this protein sequence reveals the following:

```
Possible site: 28
>>> Seems to have no N-terminal signal sequence

----- Final Results -----
            bacterial cytoplasm --- Certainty = 0.0005(Affirmative) < succ>
            bacterial membrane  --- Certainty = 0.0000(Not Clear)   < succ>
            bacterial outside   --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2453

A DNA sequence (GASx334) was identified in *S. pyogenes* <SEQ ID 7405> which encodes the amino acid sequence <SEQ ID 7406>. Analysis of this protein sequence reveals the following:

```
Possible site: 17
>>> Seems to have a cleavable N-term signal seq.

----- Final Results -----
            bacterial outside   --- Certainty = 0.3000(Affirmative) < succ>
            bacterial membrane  --- Certainty = 0.0000(Not Clear)   < succ>
            bacterial cytoplasm --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2454

A DNA sequence (GASx336) was identified in *S. pyogenes* <SEQ ID 7407> which encodes the amino acid sequence <SEQ ID 7408>. Analysis of this protein sequence reveals the following:

```
Possible site: 31
>>> Seems to have no N-terminal signal sequence

----- Final Results -----
            bacterial cytoplasm --- Certainty = 0.3379(Affirmative) < succ>
            bacterial membrane  --- Certainty = 0.0000(Not Clear)   < succ>
            bacterial outside   --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2455

A DNA sequence (GASx361R) was identified in *S. pyogenes* <SEQ ID 7409> which encodes the amino acid sequence <SEQ ID 7410>. Analysis of this protein sequence reveals the following:

```
Possible site: 22
>>> Seems to have no N-terminal signal sequence

----- Final Results -----
            bacterial cytoplasm --- Certainty = 0.2807(Affirmative) < succ>
            bacterial membrane  --- Certainty = 0.0000(Not Clear)   < succ>
            bacterial outside   --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2456

A DNA sequence (GASx387) was identified in *S. pyogenes* <SEQ ID 7411> which encodes the amino acid sequence <SEQ ID 7412>. Analysis of this protein sequence reveals the following:

```
Possible site: 16
>>> Seems to have no N-terminal signal sequence

----- Final Results -----
            bacterial cytoplasm --- Certainty = 0.2740(Affirmative) < succ>
            bacterial membrane  --- Certainty = 0.0000(Not Clear)   < succ>
            bacterial outside   --- Certainty = 0.0000(Not Clear)   < succ>
```

No corresponding DNA sequence was identified in *S. aga-lactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2457

A DNA sequence (GASx389) was identified in *S. pyogenes* <SEQ ID 7413> which encodes the amino acid sequence <SEQ ID 7414>. Analysis of this protein sequence reveals the following:

```
Possible site: 21
>>> Seems to have no N-terminal signal sequence

----- Final Results -----
            bacterial cytoplasm --- Certainty = 0.0744(Affirmative) < succ>
            bacterial membrane  --- Certainty = 0.0000(Not Clear)   < succ>
             bacterial outside  --- Certainty = 0.0000(Not Clear)   < succ>
```

No corresponding DNA sequence was identified in *S. aga-lactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2458

A DNA sequence (GASx392) was identified in *S. pyogenes* <SEQ ID 7415> which encodes the amino acid sequence <SEQ ID 7416>. Analysis of this protein sequence reveals the following:

```
Possible site: 29
>>> Seems to have no N-terminal signal sequence

----- Final Results -----
            bacterial cytoplasm --- Certainty = 0.2162(Affirmative) < succ>
            bacterial membrane  --- Certainty = 0.0000(Not Clear)   < succ>
             bacterial outside  --- Certainty = 0.0000(Not Clear)   < succ>
```

No corresponding DNA sequence was identified in *S. aga-lactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2459

A DNA sequence (GASx393R) was identified in *S. pyo-genes* <SEQ ID 7417> which encodes the amino acid sequence <SEQ ID 7418>. Analysis of this protein sequence reveals the following:

```
Possible site: 18
>>> Seems to have no N-terminal signal sequence

----- Final Results -----
            bacterial cytoplasm --- Certainty = 0.2520(Affirmative) < succ>
            bacterial membrane  --- Certainty = 0.0000(Not Clear)   < succ>
             bacterial outside  --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2460

A DNA sequence (GASx395) was identified in *S. pyogenes* <SEQ ID 7419> which encodes the amino acid sequence <SEQ ID 7420>. Analysis of this protein sequence reveals the following:

```
Possible site: 16
>>> Seems to have no N-terminal signal sequence

----- Final Results -----
            bacterial cytoplasm --- Certainty = 0.2590(Affirmative) < succ>
            bacterial membrane  --- Certainty = 0.0000(Not Clear)   < succ>
            bacterial outside   --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2461

A DNA sequence (GASx396) was identified in *S. pyogenes* <SEQ ID 7421> which encodes the amino acid sequence <SEQ ID 7422>. Analysis of this protein sequence reveals the following:

```
Possible site: 41
>>> Seems to have an uncleavable N-term signal seq

----- Final Results -----
            bacterial membrane  --- Certainty = 0.0000(Not Clear) < succ>
            bacterial outside   --- Certainty = 0.0000(Not Clear) < succ>
            bacterial cytoplasm --- Certainty = 0.0000(Not Clear) < succ>
```

No corresponding DNA sequence was identified in *S. agalactiae*.

The protein has homology with the following sequences in the GENPEPT database:

```
>GP: CAB13373 GB: Z99111 similar to hypothetical proteins [Bacillus subti-
lis]
Identities = 23/88 (26%), Positives = 52/88 (58%)

Query:   4 KQERIGLVVYLYYNRDARKLSKFGDLYYHSKRSRYLIIYINKNDLDTKLEEMRRLKCVKD   63
           +   R G+VVYL+   + ++  L  KFG+++Y  SKR  +Y+++Y + + ++   ++++        VK
Sbjct:   2 ENRRQGMVVYLHSLKQSKMLRKFGNVHYVSKRLKYVVLYCDMDQIEKTMDKIASYSFVKK   61

Query:  64 IRPSAFDDIDRQFVGNLHRDETNNHQKG                                  91
           + PS    +  +F   L + +  +++ G
Sbjct:  62 VEPSYKPFLKLEFESKLDKAKEYDYKIG                                  89
```

Based on this analysis, it was predicted that this GAS-specific protein and its epitopes, could be useful antigens for vaccines or diagnostics.

EXAMPLE 2462

A DNA sequence (GASx400) was identified in *S. pyogenes* <SEQ ID 7423> which encodes the amino acid sequence <SEQ ID 7424>. Analysis of this protein sequence reveals the following:

```
Possible site: 13
>>> Seems to have no N-terminal signal sequence

----- Final Results -----
            bacterial cytoplasm --- Certainty = 0.2010(Affirmative) < succ>
             bacterial membrane --- Certainty = 0.0000(Not Clear)   < succ>
              bacterial outside --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2463

A DNA sequence (GASx401) was identified in *S. pyogenes* <SEQ ID 7425> which encodes the amino acid sequence <SEQ ID 7426>. Analysis of this protein sequence reveals the following:

```
Possible site: 17
>>> Seems to have no N-terminal signal sequence

----- Final Results -----
            bacterial cytoplasm --- Certainty = 0.1176(Affirmative) < succ>
             bacterial membrane --- Certainty = 0.0000(Not Clear)   < succ>
              bacterial outside --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2464

A DNA sequence (GASx402) was identified in *S. pyogenes* <SEQ ID 7427> which encodes the amino acid sequence <SEQ ID 7428>. Analysis of this protein sequence reveals the following:

```
Possible site: 16
>>> Seems to have no N-terminal signal sequence

----- Final Results -----
            bacterial cytoplasm --- Certainty = 0.2938(Affirmative) < succ>
             bacterial membrane --- Certainty = 0.0000(Not Clear)   < succ>
              bacterial outside --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2465

A DNA sequence (GASx403R) was identified in *S. pyogenes* <SEQ ID 7429> which encodes the amino acid sequence <SEQ ID 7430>. Analysis of this protein sequence reveals the following:

```
Possible site: 21
>>> Seems to have a cleavable N-term signal seq.

----- Final Results -----
              bacterial outside --- Certainty = 0.3000(Affirmative) < succ>
             bacterial membrane --- Certainty = 0.0000(Not Clear)   < succ>
            bacterial cytoplasm --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2466

A DNA sequence (GASx406) was identified in *S. pyogenes* <SEQ ID 7431> which encodes the amino acid sequence <SEQ ID 7432>. Analysis of this protein sequence reveals the following:

```
Possible site: 31
>>> Seems to have an uncleavable N-term signal seq
      INTEGRAL    Likelihood = -12.26    Transmembrane    15-31 (4-36)
      INTEGRAL    Likelihood =  -6.64    Transmembrane    96-112 (94-115)

----- Final Results -----
              bacterial membrane --- Certainty = 0.5904(Affirmative) < succ>
               bacterial outside --- Certainty = 0.0000(Not Clear)   < succ>
             bacterial cytoplasm --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2467

A DNA sequence (GASx408R) was identified in *S. pyogenes* <SEQ ID 7433> which encodes the amino acid sequence <SEQ ID 7434>. Analysis of this protein sequence reveals the following:

```
Possible site: 19
>>> Seems to have no N-terminal signal sequence
      INTEGRAL    Likelihood = -2.23    Transmembrane    17-33 (15-34)
      INTEGRAL    Likelihood = -0.85    Transmembrane    38-54 (38-54)

----- Final Results -----
              bacterial membrane --- Certainty = 0.1893(Affirmative) < succ>
               bacterial outside --- Certainty = 0.0000(Not Clear)   < succ>
             bacterial cytoplasm --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2468

A DNA sequence (GASx412) was identified in *S. pyogenes* <SEQ ID 7435> which encodes the amino acid sequence <SEQ ID 7436>. Analysis of this protein sequence reveals the following:

```
Possible site: 13
>>> Seems to have an uncleavable N-term signal seq
      INTEGRAL    Likelihood = -6.53    Transmembrane    5-21 (4-23)

----- Final Results -----
              bacterial membrane --- Certainty = 0.3612(Affirmative) < succ>
               bacterial outside --- Certainty = 0.0000(Not Clear)   < succ>
             bacterial cytoplasm --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2469

A DNA sequence (GASx413) was identified in *S. pyogenes* <SEQ ID 7437> which encodes the amino acid sequence <SEQ ID 7438>. Analysis of this protein sequence reveals the following:

```
Possible site: 56
>>> Seems to have no N-terminal signal sequence

----- Final Results -----
            bacterial cytoplasm --- Certainty = 0.3422(Affirmative) < succ>
            bacterial membrane  --- Certainty = 0.0000(Not Clear)   < succ>
            bacterial outside   --- Certainty = 0.0000(Not Clear)   < succ>
```

No corresponding DNA sequence was identified in *S. agalactiae*.

The protein has homology with the following sequences in the GENPEPT database:

```
>GP: CAA68903 GB: Y07622 lactate oxidase [Streptococcus iniae]
Identities = 328/392 (83%), Positives = 359/392 (90%), Gaps = 4/392 (1%)

Query:   3 MAQKTVITEETTDFVMDFKTSSAEGNVDFINVFDLEKMAQQVIPKGAFGYIASGAGDTFT   62
           M  K+ +    TT   ++FKTSSAEG+VDF+NVFDLEKMAQ+VIPKGAFGYIASGAGDTFT
Sbjct:   1 MENKSEMINATT---IEFKTSSAEGSVDFVNVFDLEKMAQKVIPKGAFGYIASGAGDTFT   57

Query:  63 LHENIRSFNHKLIVPHSLKGVENPSTEITFDGDYLTSPLILAPVAAHKLANEQGEVASAK  122
           LHENIRSFNHKLI PH LKGVENPSTEITF GD L SP+ILAPVAAHKLANEQGE+ASAK
Sbjct:  58 LHENIRSFNHKLI-PHGLKGVENPSTEITFIGDKLASPIILAPVAAHKLANEQGEIASAK  116

Query: 123 GLKEFGSIYTTSSYSTTDLPEISAALGGTPHWFQFYYSKDDGINRNIMDRVKAQGCKAIV  182
           G+KEFG+IYTTSSYSTTDLPEIS  LG +PHWFQFYYSKDDGINR+IMDR+KA+G K+IV
Sbjct: 117 GVKEFGTIYTTSSYSTTDLPEISQTLGDSPHWFQFYYSKDDGINRHIMDRLKAEGVKSIV  176

Query: 183 LTADATVGGNREVDRRNGFVFPVGMPIVQEYLPDGAGKTMDYVYKSAKQALTSKDIEYIA  242
           LT DATVGGNREVD+RNGFVFPVGMPIVQEYLP+GAGKTMDYVYK+ KQAL+ KD+EYIA
Sbjct: 177 LTVDATVGGNREVDKRNGFVFPVGMPIVQEYLPNGAGKTMDYVYKATKQALSPKDVEYIA  236

Query: 243 TYSGLPVYVKGPQCAEDTLRALDAGASGIWVTNHGGRQLDGGPAAFDSLQEVAEAVDQKV  302
            YSGLPVYVKGPQCAED  RAL+AGASGIWVTNHGGRQLDGGPAAFDSLQEVAE+VD++V
Sbjct: 237 QYSGLPVYVKGPQCAEDAFRALEAGASGIWVTNHGGRQLDGGPAAFDSLQEVAESVDRRV  296

Query: 303 PIVFDSGIRRGQHIFKALASGADLVALGRPAIYGLAMGGSIGTRQVFEKLNDELKMVMQL  362
           PIVFDSG+RRGQH+FKALASGADLVALGRP IYGLAMGGS+GTRQVFEK+NDELKMVMQL
Sbjct: 297 PIVFDSGVRRGQHVFKALASGADLVALGRPVIYGLAMGGSVGTRQVFEKINDELKMVMQL  356

Query: 363 AGTQTIQDVKAFNLRHNPYDSSIPFDQNALRL                             394
           AGTQTI DVK F LRHNPYDSSIPF      ++
Sbjct: 357 AGTQTIDDVKHFKLRHNPYDSSIPFSPKCFKI                             388
```

Based on this analysis, it was predicted that this GAS-specific protein and its epitopes, could be useful antigens for vaccines or diagnostics.

EXAMPLE 2470

A DNA sequence (GASx414) was identified in *S. pyogenes* <SEQ ID 7439> which encodes the amino acid sequence <SEQ ID 7440>. Analysis of this protein sequence reveals the following:

```
Possible site: 32
>>> Seems to have no N-terminal signal sequence

----- Final Results -----
            bacterial cytoplasm --- Certainty = 0.0682(Affirmative) < succ>
            bacterial membrane  --- Certainty = 0.0000(Not Clear)   < succ>
            bacterial outside   --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2471

A DNA sequence (GASx417R) was identified in *S. pyogenes* <SEQ ID 7441> which encodes the amino acid sequence <SEQ ID 7442>. Analysis of this protein sequence reveals the following:

```
Possible site: 34
>>> Seems to have no N-terminal signal sequence

----- Final Results -----
            bacterial cytoplasm --- Certainty = 0.1765(Affirmative) < succ>
            bacterial membrane  --- Certainty = 0.0000(Not Clear)   < succ>
             bacterial outside  --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2472

A DNA sequence (GASx418) was identified in *S. pyogenes* <SEQ ID 7443> which encodes the amino acid sequence <SEQ ID 7444>. Analysis of this protein sequence reveals the following:

```
Possible site: 32
>>> Seems to have no N-terminal signal sequence

----- Final Results -----
            bacterial cytoplasm --- Certainty = 0.2532(Affirmative) < succ>
            bacterial membrane  --- Certainty = 0.0000(Not Clear)   < succ>
             bacterial outside  --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2473

A DNA sequence (GASx419) was identified in *S. pyogenes* <SEQ ID 7445> which encodes the amino acid sequence <SEQ ID 7446>. Analysis of this protein sequence reveals the following:

```
Possible site: 28
>>> Seems to have no N-terminal signal sequence

----- Final Results -----
            bacterial cytoplasm --- Certainty = 0.3082(Affirmative) < succ>
            bacterial membrane  --- Certainty = 0.0000(Not Clear)   < succ>
             bacterial outside  --- Certainty = 0.0000(Not Clear)   < succ>
```

No corresponding DNA sequence was identified in S. agalactiae.

The protein has no significant homology with any sequences in the GENPEPT database.

Based on this analysis, it was predicted that this GAS-specific protein and its epitopes, could be useful antigens for vaccines or diagnostics.

EXAMPLE 2474

A DNA sequence (GASx423) was identified in S. pyogenes <SEQ ID 7447> which encodes the amino acid sequence <SEQ ID 7448>. Analysis of this protein sequence reveals the following:

```
Possible site: 52
>>> Seems to have an uncleavable N-term signal seq
      INTEGRAL    Likelihood = -2.18    Transmembrane    14-30 (13-31)

----- Final Results -----
            bacterial membrane --- Certainty = 0.1871(Affirmative) < succ>
            bacterial outside  --- Certainty = 0.0000 (Not Clear)  < succ>
            bacterial cytoplasm --- Certainty = 0.0000 (Not Clear) < succ>
```

No corresponding DNA sequence was identified in S. agalactiae.

The protein has no significant homology with any sequences in the GENPEPT database.

Based on this analysis, it was predicted that this GAS-specific protein and its epitopes, could be useful antigens for vaccines or diagnostics.

EXAMPLE 2475

A DNA sequence (GASx427R) was identified in S-pyogenes <SEQ ID 7449> which encodes the amino acid sequence <SEQ ID 7450>. Analysis of this protein sequence reveals the following:

```
Possible site: 25
>>> Seems to have an uncleavable N-term signal seq
      INTEGRAL    Likelihood = -1.17    Transmembrane    13-29 (10-29)

----- Final Results -----
            bacterial membrane --- Certainty = 0.1468(Affirmative) < succ>
            bacterial outside  --- Certainty = 0.0000(Not Clear)  < succ>
            bacterial cytoplasm --- Certainty = 0.0000(Not Clear) < succ>
```

A related sequence was also identified in GAS <SEQ ID 9105> which encodes the amino acid sequence <SEQ ID 9106>. Analysis of this protein sequence reveals the following:

```
Possible site: 20
>>> Seems to have an uncleavable N-term signal seq
      INTEGRAL    Likelihood = -1.17    Transmembrane    8-24

----- Final Results -----
            bacterial membrane --- Certainty = 0.1470(Affirmative) < succ>
            bacterial outside  --- Certainty = 0.0000(Not Clear)  < succ>
            bacterial cytoplasm --- Certainty = 0.0000(Not Clear) < succ>
```

No corresponding DNA sequence was identified in S. agalactiae.

The protein has homology with the following sequences in the GENPEPT database:

```
>GP: AAA26616 GB: M63917 epidermal cell differentiation inhibitor
[Staphylococcus aureus]
Identities = 58/195 (29%), Positives = 106/195 (53%), Gaps = 13/195 (6%)

Query:  67 RWGKGLI----YPRAEQEAMAAYTCQQAGPINTSLDKAKGELSQLTPELRDQVAQLDAAT 122
            +WG  LI    Y   ++ A+  YT + +  IN  L A G++++L     +D+V +LD++
Sbjct:  49 KWGNKLIKQAKYSSDDKIALYEYT-KDSSKINGPLRLAGGDINKLDSTTQDKVRRLDSSI 107
```

```
-continued
Query: 123 HRLVIPWNIVVYRYVYETFLRDI-GVSHADLTSYYR--NHQFDPHILCKIK--LGTR-YT  176
            +   P ++ VYR +   +L  I G ++ DL     +   N Q+D +++ K+   + +R Y
Sbjct: 108 SKSTTPESVYVYRLLNLDYLTSIVGFTNEDLYKLQQTNNGQYDENLVRKLNNVMNSRIYR  167

Query: 177 KHSFMSTTALKNGAMTHRPVEVRICVKKGAKAAFV--EPYSAVPSEVELLFPRGCQLEVV  234
            +  + ST  +    A+  RP+E+R+ + KG KAA++    +A    + E+L PRG + V
Sbjct: 168 EDGYSSTQLVSGAAVGGRPIELRLELPKGTKAAYLNSKDLTAYYGQQEVLLPRGTEYAVG  227

Query: 235 GAYVSQDQKKLHIEA                                              249
            +S D+KK+ I A
Sbjct: 228 SVELSNDKKKIIITA                                              242
```

Based on this analysis, it was predicted that this GAS-specific protein and its epitopes, could be useful antigens for vaccines or diagnostics.

EXAMPLE 2476

A DNA sequence (GASx428) was identified in *S. pyogenes* <SEQ ID 7451> which encodes the amino acid sequence <SEQ ID 7452>. Analysis of this protein sequence reveals the following:

```
Possible site: 14
>>> Seems to have no N-terminal signal sequence

----- Final Results -----
          bacterial cytoplasm --- Certainty = 0.3817(Affirmative) < succ>
          bacterial membrane  --- Certainty = 0.0000(Not Clear)   < succ>
          bacterial outside   --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2477

A DNA sequence (GASx429) was identified in *S. pyogenes* <SEQ ID 7453> which encodes the amino acid sequence <SEQ ID 7454>. Analysis of this protein sequence reveals the following:

```
Possible site: 32
>>> Seems to have a cleavable N-term signal seq.

----- Final Results -----
          bacterial outside   --- Certainty = 0.3000(Affirmative) < succ>
          bacterial membrane  --- Certainty = 0.0000(Not Clear)   < succ>
          bacterial cytoplasm --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2478

A DNA sequence (GASx431) was identified in *S. pyogenes* <SEQ ID 7455> which encodes the amino acid sequence <SEQ ID 7456>. Analysis of this protein sequence reveals the following:

```
Possible site: 43
>>> Seems to have an uncleavable N-term signal seq
          INTEGRAL    Likelihood = -8.60    Transmembrane   68-84 (66-90)
          INTEGRAL    Likelihood = -6.85    Transmembrane   22-38 (16-42)
          INTEGRAL    Likelihood = -3.29    Transmembrane   44-60 (43-61)
```

```
----- Final Results -----
          bacterial membrane --- Certainty = 0.4439(Affirmative) < succ>
          bacterial outside  --- Certainty = 0.0000(Not Clear)   < succ>
         bacterial cytoplasm --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2479

A DNA sequence (GASx432R) was identified in *S. pyogenes* <SEQ ID 7457> which encodes the amino acid sequence <SEQ ID 7458>. Analysis of this protein sequence reveals the following:

```
Possible site: 22
>>> Seems to have a cleavable N-term signal seq.

----- Final Results -----
          bacterial outside  --- Certainty = 0.3000(Affirmative) < succ>
          bacterial membrane --- Certainty = 0.0000(Not Clear)   < succ>
         bacterial cytoplasm --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2480

A DNA sequence (GASx434) was identified in *S. pyogenes* <SEQ ID 7459> which encodes the amino acid sequence <SEQ ID 7460>. Analysis of this protein sequence reveals the following:

```
Possible site: 24
>>> Seems to have a cleavable N-term signal seq.

----- Final Results -----
          bacterial outside  --- Certainty = 0.3000(Affirmative) < succ>
          bacterial membrane --- Certainty = 0.0000(Not Clear)   < succ>
         bacterial cytoplasm --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2481

A DNA sequence (GASx435R) was identified in *S. pyogenes* <SEQ ID 7461> which encodes the amino acid sequence <SEQ ID 7462>. Analysis of this protein sequence reveals the following:

```
Possible site: 25
>>> Seems to have an uncleavable N-term signal seq
     INTEGRAL    Likelihood = -2.50    Transmembrane    4-20 (3-21)

----- Final Results -----
          bacterial membrane --- Certainty = 0.1999(Affirmative) < succ>
          bacterial outside  --- Certainty = 0.0000(Not Clear)   < succ>
         bacterial cytoplasm --- Certainty = 0.0000(Not Clear)   < succ>
```

No corresponding DNA sequence was identified in *S. agalactiae*.

The protein has homology with the following sequences in the GENPEPT database:

```
>GP: AAB59092 GB: M97157 pyrogenic exotoxin C [Streptococcus pyogenes]
Identities = 110/229 (48%), Positives = 150/229 (65%), Gaps = 4/229 (1%)

Query:    4 IIKTIILVIIIFHGYGS--VKSDSE-NIKDVKLQLNYAYEIIPVDYTNCNIDYLTTHDFY   60
            IIK + ++ +I     S  +KSDS+ +I +VK  L YAY I P DY +C +++ TTH
Sbjct:    6 IIKIVFIITVILISTISPIIKSDSKKDISNVKSDLLYAYTITPYDYKDCRVNFSTTHTLN  65

Query:   61 IDISSYKKKNFSVDSEVESYITTKFTKNQKVNIFGLPYIFTRYDVYYIYGGVTPSVNSNS  120
            ID   Y+ K++ + SE+    + KF ++ V++FGL YI   +  YIYGG+TP+ N N
Sbjct:   66 IDTQKYRGKDYYISSEMSYEASQKFKRDDHVDVFGLFYILNSHTGEYIYGGITPAQN-NK  124

Query:  121 ENSKIVGNLLIDGVQQKTLINPIKIDKPIFTIQEFDFKIRQYLMQTYKIYDPNSPYIKGQ  180
             N K++GNL  I G  Q+ L N I ++K I T QE DFKIR YLM  YKIYD  SPY  G+
Sbjct:  125 VNHKLLGNLFISGESQQNLNNKIILEKDIVTFQEIDFKIRKYLMDNYKIYDATSPYVSGR  184

Query:  181 LEIAINGNKHESFNLYDATSSSTRSDIFKKYKDNKTINMKDFSHFDIYL            229
            +EI      KHE +L+D+ +  TRSDIF KYKDN+ INMK+FSHFDIYL
Sbjct:  185 IEIGTKDGKHEQIDLFDSPNEGTRSDIFAKYKDNRIINMKNFSHFDIYL            233
```

Based on this analysis, it was predicted that this GAS-specific protein and its epitopes, could be useful antigens for vaccines or diagnostics.

EXAMPLE 2482

A DNA sequence (GASx436R) was identified in *S. pyogenes* <SEQ ID 7463> which encodes the amino acid sequence <SEQ ID 7464>. Analysis of this protein sequence reveals the following:

```
Possible site: 22
>>> Seems to have a cleavable N-term signal seq.

----- Final Results -----
            bacterial outside  --- Certainty = 0.3000(Affirmative) < succ>
            bacterial membrane --- Certainty = 0.0000(Not Clear)   < succ>
            bacterial cytoplasm --- Certainty = 0.0000(Not Clear)  < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2483

A DNA sequence (GASx446) was identified in *S. pyogenes* <SEQ ID 7465> which encodes the amino acid sequence <SEQ ID 7466>. Analysis of this protein sequence reveals the following:

```
Possible site: 20

>>> Seems to have a cleavable N-term signal seq.

----- Final Results -----
            bacterial outside  --- Certainty = 0.3000(Affirmative) < succ>
            bacterial membrane --- Certainty = 0.0000(Not Clear)   < succ>
            bacterial cytoplasm --- Certainty = 0.0000(Not Clear)  < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2484

A DNA sequence (GASx449) was identified in *S. pyogenes* <SEQ ID 7467> which encodes the amino acid sequence <SEQ ID 7468>. Analysis of this protein sequence reveals the following:

```
Possible site: 15

>>> Seems to have an uncleavable N-term signal seq
    INTEGRAL    Likelihood = -3.82    Transmembrane 3 - 19   (1 - 20)

----- Final Results -----
                bacterial membrane --- Certainty = 0.2529(Affirmative) < succ>
                bacterial outside  --- Certainty = 0.0000(Not Clear)  < succ>
                bacterial cytoplasm --- Certainty = 0.0000(Not Clear)  < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2485

A DNA sequence (GASx450R) was identified in *S. pyogenes* <SEQ ID 7469> which encodes the amino acid sequence <SEQ ID 7470>. Analysis of this protein sequence reveals the following:

```
Possible site: 30

>>> Seems to have an uncleavable N-term signal seq
    INTEGRAL    Likelihood = -1.44    Transmembrane 21 - 37 (19 - 37)

----- Final Results -----
                bacterial membrane --- Certainty = 0.1574(Affirmative) < succ>
                bacterial outside  --- Certainty = 0.0000(Not Clear)  < succ>
                bacterial cytoplasm --- Certainty = 0.0000(Not Clear)  < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2486

A DNA sequence (GASx457R) was identified in *S. pyogenes* <SEQ ID 7471> which encodes the amino acid sequence <SEQ ID 7472>. Analysis of this protein sequence reveals the following:

```
Possible site: 19

>>> Seems to have a cleavable N-term signal seq.
    INTEGRAL    Likelihood = -15.34    Transmembrane   64 - 80    (57 - 86)
    INTEGRAL    Likelihood = -13.43    Transmembrane   97 - 113   (91 - 116)
    INTEGRAL    Likelihood =  -5.57    Transmembrane   38 - 54    (32 - 56)

----- Final Results -----
                bacterial membrane --- Certainty = 0.7135(Affirmative) < succ>
                bacterial outside  --- Certainty = 0.0000(Not Clear)  < succ>
                bacterial cytoplasm --- Certainty = 0.0000(Not Clear)  < succ>
```

No corresponding DNA sequence was identified in *S. aga-lactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2487

A DNA sequence (GASx476R) was identified in *S. pyogenes* <SEQ ID 7473> which encodes the amino acid sequence <SEQ ID 7474>. Analysis of this protein sequence reveals the following:

```
Possible site: 31

>>> Seems to have no N-terminal signal sequence

----- Final Results -----
           bacterial cytoplasm --- Certainty = 0.3013(Affirmative) < succ>
           bacterial membrane  --- Certainty = 0.0000(Not Clear)   < succ>
            bacterial outside  --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2488

A DNA sequence (GASx477) was identified in *S. pyogenes* <SEQ ID 7475> which encodes the amino acid sequence <SEQ ID 7476>. Analysis of this protein sequence reveals the following:

```
Possible site: 57

>>> Seems to have no N-terminal signal sequence

----- Final Results -----
           bacterial cytoplasm --- Certainty = 0.1022(Affirmative) < succ>
           bacterial membrane  --- Certainty = 0.0000(Not Clear)   < succ>
            bacterial outside  --- Certainty = 0.0000(Not Clear)   < succ>
```

No corresponding DNA sequence was identified in *S. agalactiae*.

The protein has homology with the following sequences in the GENPEPT database:

```
>GP:CAC03521 GB:AJ276410 BlpJ protein [Streptococcus pneumoniae]
  Identities = 47/77 (61%), Positives = 59/77 (76%)

Query:  1 MIKFAEEIQKEELFHIIGGYSATDCKNHLIGGITSGAIAGGVGAGMATLGVGGVAGAFAG  60
          M+   E +  E L  + GGYS+TDC+N LI G+T+G I GG GAG+ATLGV G+AGAF G
Sbjct:  5 MLSQLEVMDTEMLAKVEGGYSSTDCQNALITGVTTGIITGGTGAGLATLGVAGLAGAFVG  64

Query: 61 AHVGAIAGGLTCVGGML                                             77
          AH+GAI GGLTC+GGM+
Sbjct: 65 AHIGAIGGGLTCLGGMV                                             81
```

Based on this analysis, it was predicted that this GAS-specific protein and its epitopes, could be useful antigens for vaccines or diagnostics.

EXAMPLE 2489

A DNA sequence (GASx478) was identified in *S. pyogenes* <SEQ ID 7477> which encodes the amino acid sequence <SEQ ID 7478>. Analysis of this protein sequence reveals the following:

```
Possible site: 45

>>> Seems to have no N-terminal signal sequence
    INTEGRAL    Likelihood = -2.07    Transmembrane   42 - 58    (41 - 58)
    INTEGRAL    Likelihood = -1.59    Transmembrane   22 - 38    (22 - 38)

----- Final Results -----
             bacterial membrane --- Certainty = 0.1829(Affirmative) < succ>
              bacterial outside --- Certainty = 0.0000(Not Clear)   < succ>
            bacterial cytoplasm --- Certainty = 0.0000(Not Clear)   < succ>
```

No corresponding DNA sequence was identified in *S. agalactiae*.

The protein has homology with the following sequences in the GENPEPT database:

```
>GP:CAC03520 GB:AJ276410 BlpI protein [Streptococcus pneumoniae]
 Identities = 35/56 (62%), Positives = 44/56 (78%)

Query: 1 MDNFLELQFEELVNISGGKGNIGSAIGGCLGGMLIAAAGGPITGGAAAFVCVASGI    56
         M+ F  +  EEL +SGG+GN+GSAIGGC+G +L+AAA GPITGGAA  +CV SGI
Sbjct: 6 MEQFSVMDNEELEIVSGGRGNLGSAIGGCIGAVLLAAATGPITGGAATLICVGSGI   61
```

Based on this analysis, it was predicted that this GAS-specific protein and its epitopes, could be useful antigens for vaccines or diagnostics.

EXAMPLE 2490

A DNA sequence (GASx482) was identified in *S. pyogenes* <SEQ ID 7479> which encodes the amino acid sequence <SEQ ID 7480>. Analysis of this protein sequence reveals the following:

```
Possible site: 14

>>> Seems to have an uncleavable N-term signal seq
    INTEGRAL    Likelihood = -0.43    Transmembrane   61 - 77    (61 - 79)

----- Final Results -----
             bacterial membrane --- Certainty = 0.1171(Affirmative) < succ>
              bacterial outside --- Certainty = 0.0000(Not Clear)   < succ>
            bacterial cytoplasm --- Certainty = 0.0000(Not Clear)   < succ>
```

No corresponding DNA sequence was identified in *S. agalactiae*.

The protein has homology with the following sequences in the GENPEPT database:

```
>GP:CAC03524 GB:AJ276410 BlpM protein [Streptococcus pneumoniae]
 Identities = 22/52 (42%), Positives = 30/52 (57%)

Query: 29 MEIKKLETFHQMTIEKLAKVEGGKNNWQANVSGVIAAGSAGAAIGFPVCGVA     80
          M+ K +E FH+M I  L+ +EGGKNNWQ NV     A   G +G +C  +
Sbjct:  1 MDTKIMEQFHEMDITMLSSIEGGKNNWQTNVLEGGGAAFGGWGLGTAICAAS     52
```

Based on this analysis, it was predicted that this GAS-specific protein and its epitopes, could be useful antigens for vaccines or diagnostics.

EXAMPLE 2491

A DNA sequence (GASx483) was identified in *S. pyogenes* <SEQ ID 7481> which encodes the amino acid sequence <SEQ ID 7482>. Analysis of this protein sequence reveals the following:

```
Possible site: 58

>>> Seems to have no N-terminal signal sequence

----- Final Results -----
            bacterial cytoplasm --- Certainty = 0.1832(Affirmative) < succ>
             bacterial membrane --- Certainty = 0.0000(Not Clear)   < succ>
              bacterial outside --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2492

A DNA sequence (GASx484) was identified in *S. pyogenes* <SEQ ID 7483> which encodes the amino acid sequence <SEQ ID 7484>. Analysis of this protein sequence reveals the following:

```
Possible site: 21

>>> Seems to have a cleavable N-term signal seq.

----- Final Results -----
          bacterial outside --- Certainty = 0.3000(Affirmative) < succ>
          bacterial membrane --- Certainty = 0.0000(Not Clear) < succ>
          bacterial cytoplasm --- Certainty = 0.0000(Not Clear) < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2493

A DNA sequence (GASx485) was identified in *S. pyogenes* <SEQ ID 7485> which encodes the amino acid sequence <SEQ ID 7486>. Analysis of this protein sequence reveals the following:

```
Possible site: 32

>>> Seems to have no N-terminal signal sequence

----- Final Results -----
          bacterial cytoplasm --- Certainty = 0.1037(Affirmative) < succ>
          bacterial membrane --- Certainty = 0.0000(Not Clear) < succ>
           bacterial outside --- Certainty = 0.0000(Not Clear) < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2494

A DNA sequence (GASx487) was identified in *S. pyogenes* <SEQ ID 7487> which encodes the amino acid sequence <SEQ ID 7488>. Analysis of this protein sequence reveals the following:

```
Possible site: 50

>>> Seems to have no N-terminal signal sequence

----- Final Results -----
          bacterial cytoplasm --- Certainty = 0.1086(Affirmative) < succ>
          bacterial membrane --- Certainty = 0.0000(Not Clear) < succ>
           bacterial outside --- Certainty = 0.0000(Not Clear) < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2495

A DNA sequence (GASx488) was identified in *S. pyogenes* <SEQ ID 7489> which encodes the amino acid sequence <SEQ ID 7490>. Analysis of this protein sequence reveals the following:

```
Possible site: 22

>>> Seems to have no N-terminal signal sequence

----- Final Results -----
          bacterial cytoplasm --- Certainty = 0.2176(Affirmative) < succ>
          bacterial membrane  --- Certainty = 0.0000(Not Clear)   < succ>
          bacterial outside   --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2496

A DNA sequence (GASx489R) was identified in *S. pyogenes* <SEQ ID 7491> which encodes the amino acid sequence <SEQ ID 7492>. Analysis of this protein sequence reveals the following:

```
Possible site: 22

>>> Seems to have an uncleavable N-term signal seq

----- Final Results -----
          bacterial membrane  --- Certainty = 0.0000(Not Clear) < succ>
          bacterial outside   --- Certainty = 0.0000(Not Clear) < succ>
          bacterial cytoplasm --- Certainty = 0.0000(Not Clear) < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2497

A DNA sequence (GASx490) was identified in *S. pyogenes* <SEQ ID 7493> which encodes the amino acid sequence <SEQ ID 7494>. Analysis of this protein sequence reveals the following:

```
Possible site: 24

>>> Seems to have no N-terminal signal sequence

----- Final Results -----
          bacterial cytoplasm --- Certainty = 0.2547(Affirmative) < succ>
          bacterial membrane  --- Certainty = 0.0000(Not Clear)   < succ>
          bacterial outside   --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2498

A DNA sequence (GASx491R) was identified in *S. pyogenes* <SEQ ID 7495> which encodes the amino acid sequence <SEQ ID 7496>. Analysis of this protein sequence reveals the following:

```
Possible site: 22

>>> Seems to have an uncleavable N-term signal seq
    INTEGRAL     Likelihood = -10.24   Transmembrane   6 - 22   (3 - 28)

----- Final Results -----
            bacterial membrane  --- Certainty = 0.5097(Affirmative) < succ>
            bacterial outside   --- Certainty = 0.0000(Not Clear)   < succ>
            bacterial cytoplasm --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2499

A DNA sequence (GASx492) was identified in *S. pyogenes* <SEQ ID 7497> which encodes the amino acid sequence <SEQ ID 7498>. Analysis of this protein sequence reveals the following:

```
Possible site: 27

>>> Seems to have an uncleavable N-term signal seq

----- Final Results -----
            bacterial membrane  --- Certainty = 0.0000(Not Clear) < succ>
            bacterial outside   --- Certainty = 0.0000(Not Clear) < succ>
            bacterial cytoplasm --- Certainty = 0.0000(Not Clear) < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2500

A DNA sequence (GASx493) was identified in *S. pyogenes* <SEQ ID 7499> which encodes the amino acid sequence <SEQ ID 7500>. Analysis of this protein sequence reveals the following:

```
Possible site: 19

>>> Seems to have no N-terminal signal sequence
    INTEGRAL     Likelihood = -0.69    Transmembrane  21 - 37   (21 - 37)

----- Final Results -----
            bacterial membrane  --- Certainty = 0.1277(Affirmative) < succ>
            bacterial outside   --- Certainty = 0.0000(Not Clear)   < succ>
            bacterial cytoplasm --- Certainty = 0.0000(Not Clear)   < succ>
```

No corresponding DNA sequence was identified in S. agalactiae.

The protein has no significant homology with any sequences in the GENPEPT database.

Based on this analysis, it was predicted that this GAS-specific protein and its epitopes, could be useful antigens for vaccines or diagnostics.

EXAMPLE 2501

A DNA sequence (GASx495R) was identified in S. pyogenes <SEQ ID 7501> which encodes the amino acid sequence <SEQ ID 7502>. Analysis of this protein sequence reveals the following:

```
Possible site: 28

>>> Seems to have no N-terminal signal sequence

----- Final Results -----
            bacterial cytoplasm --- Certainty = 0.2891(Affirmative) < succ>
             bacterial membrane --- Certainty = 0.0000(Not Clear)   < succ>
              bacterial outside --- Certainty = 0.0000(Not Clear)   < succ>
```

No corresponding DNA sequence was identified in S. agalactiae.

The protein has no significant homology with any sequences in the GENPEPT database.

Based on this analysis, it was predicted that this GAS-specific protein and its epitopes, could be useful antigens for vaccines or diagnostics.

EXAMPLE 2502

A DNA sequence (GASx499R) was identified in S. pyogenes <SEQ ID 7503> which encodes the amino acid sequence <SEQ ID 7504>. Analysis of this protein sequence reveals the following:

```
Possible site: 15

>>> Seems to have an uncleavable N-term signal seq
    INTEGRAL    Likelihood = -2.50    Transmembrane   3 - 19   (1 - 20)

----- Final Results -----
             bacterial membrane --- Certainty = 0.1999(Affirmative) < succ>
              bacterial outside --- Certainty = 0.0000(Not Clear)   < succ>
            bacterial cytoplasm --- Certainty = 0.0000(Not Clear)   < succ>
```

No corresponding DNA sequence was identified in S. agalactiae.

The protein has no significant homology with any sequences in the GENPEPT database.

Based on this analysis, it was predicted that this GAS-specific protein and its epitopes, could be useful antigens for vaccines or diagnostics.

EXAMPLE 2503

A DNA sequence (GASx500) was identified in S. pyogenes <SEQ ID 7505> which encodes the amino acid sequence <SEQ ID 7506>. Analysis of this protein sequence reveals the following:

```
Possible site: 54

>>> Seems to have an uncleavable N-term signal seq
```

----- Final Results -----
```
         bacterial membrane --- Certainty = 0.0000(Not Clear) < succ>
          bacterial outside --- Certainty = 0.0000(Not Clear) < succ>
        bacterial cytoplasm --- Certainty = 0.0000(Not Clear) < succ>
```

No corresponding DNA sequence was identified in *S. agalactiae*.

The protein has homology with the following sequences in the GENPEPT database:

```
>GP: AAC77220 GB: AE000497 orf, hypothetical protein [Escherichia
coli]
Identities = 262/480 (54%), Positives = 338/480 (69%), Gaps = 5/480 (1%)

Query:  18 GMLNRHGLIAGATGTGKTVTLKVLAEQLSLAGVPVFLADIKGDLSNLTKAGEVTDKLAAR   77
           GM NRHGLI GATGTGKTVTL+ LAE LS  GVPVF+AD+KGDL+ + +AG V++KL AR
Sbjct:  20 GMANRHGLITGATGTGKTVTLQKLAESLSEIGVPVFMADVKGDLTGVAQAGTVSEKLLAR   79

Query:  78 LATIGVSDYQPQAFPVRMWDVFGQNGQPLRTTISELGPMMLSRLLNLNDTQTGVLNIVFK  137
           L   IGV+D+QP A PV +WD+FG+ G P+R T+S+LGP++L+RLLNLND Q+GVLNI+F+
Sbjct:  80 LKNIGVNDWQPHANPVVVWDIFGEKGHPVRATVSDLGPLLLARLLNLNDVQSGVLNIIFR  139

Query: 138 IADEKGWLLIDLKDLQAILKEVGDHASDYSSHYGNIAKQSIGAIQRSLLTLEQEGAHQFF  197
           IAD++G LL+D KDL+AI + +GD+A  + + YGNI+  S+GAIQR LL+LEQ+GA  FF
Sbjct: 140 IADDQGLLLLDFKDLRAITQYIGDNAKSFQNQYGNISSASVGAIQRGLLSLEQQGAAHFF  199

Query: 198 GEPALDVADLMQLDVASGYGAINILSATKLFQSPTLYTTFLLWLLSELYKLLPEVGDLDK  257
           GEP LD+ D M+ D A+G G INILSA KL+Q P LY   LLW+LSELY+ LPE GDL+K
Sbjct: 200 GEPMLDIKDWMRTD-ANGKGVINILSAEKLYQMPKLYAASLLWMLSELYEQLPEAGDLEK  258

Query: 258 PKMVFFFDEAHLLFKDAPKVFLEKVEQIVRLIRSKGVGIFFVTQNPLDLPETVLAQLGNR  317
           PK+VFFFDEAHLLF DAP+V L+K+EQ++RLIRSKGVG++FV+QNP D+P+ VL QLGNR
Sbjct: 259 PKLVFFFDEAHLLFNDAPQVLLDKIEQVIRLIRSKGVGVWFVSQNPSDIPDNVLGQLGNR  318

Query: 318 IQHAFRAYTPKEQKAVRVAADTFRQNPDLDVARVITELEVGEALISVLNDKGQPSIVERA  377
           +QHA RA+TPK+QKAV+ AA T R NP  D + I EL  GEALIS L+ KG PS+VERA
Sbjct: 319 VQHALRAFTPKDQKAVKAAAQTMRANPAFDTEKAIQELGTGEALISFLDAKGSPSVVERA  378

Query: 378 YIMPPKSSFAVLSEIESQQLVQSSPFASKYSQSIDRESAYEKLAAKVLEDNRLAQEAIAT  437
           ++  P S    ++E E   L+  SP    KY  +DRESAYE L  K + +   Q
Sbjct: 379 MVIAPCSRMGPVTEDERNGLINHSPVYGKYEDEVDRESAYEML-QKGFQASTEQQNNPPA  437

Query: 438 AQREKEAKEAIKAQAATKKANRRSVGRSHKTVVEKATDAFISTTVRTIGRELVRGLLGSL  497
           +E   + I              K +         + R +  ++VRG+LGSL
Sbjct: 438 KGKEVAVDDGILGGLKDILFGTTGPRGGKK---DGVVQTMAKSAARQVTNQIVRGMLGSL  494
```

Based on this analysis, it was predicted that this GAS-specific protein and its epitopes, could be useful antigens for vaccines or diagnostics.

EXAMPLE 2504

A DNA sequence (GASx502) was identified in *S. pyogenes* <SEQ ID 7507> which encodes the amino acid sequence <SEQ ID 7508>. Analysis of this protein sequence reveals the following:

```
Possible site: 49
>>> Seems to have an uncleavable N-term signal seq
    INTEGRAL      Likelihood = -13.59      Transmembrane      59-75 (52-77)
    INTEGRAL      Likelihood =  -9.34      Transmembrane       4-20  (1-24)

----- Final Results -----
         bacterial membrane --- Certainty = 0.6434(Affirmative) < succ>
          bacterial outside --- Certainty = 0.0000(Not Clear)   < succ>
        bacterial cytoplasm --- Certainty = 0.0000(Not Clear)   < succ>
```

No corresponding DNA sequence was identified in *S. agalactiae*.

The protein has homology with the following sequences in the GENPEPT database:

```
>GP: CAB15368 GB: Z99121 yvaL [Bacillus subtilis]
Identities = 28/72 (38%), Positives = 44/72 (60%), Gaps = 2/72 (2%)

Query:   1 MYNLLLTILLVLSGLLEIAIFMQPQKNPSSNVFDSSGSEALFERTKARGFEAFMQRFTAV  60
           M+ +L+T+L+++S   L I + +Q  K+   +   S G+E LF + KARG +  + R T V
Sbjct:   1 MHAVLITLLVIVSIALIIVVLLQSSKSAGLSGAISGGAEQLFGKQKARGLDLILHRITVV  60

Query:  61 L--VFFWLAIAL                                                 70
           L  +FF L IAL
Sbjct:  61 LAVLFFVLTIAL                                                 72
```

Based on this analysis, it was predicted that this GAS-specific protein and its epitopes, could be useful antigens for vaccines or diagnostics.

EXAMPLE 2505

A DNA sequence (GASx505) was identified in S. pyogenes <SEQ ID 7509> which encodes the amino acid sequence <SEQ ID 7510>. Analysis of this protein sequence reveals the following:

```
Possible site: 45
>>> Seems to have no N-terminal signal sequence
    INTEGRAL    Likelihood = -1.44    Transmembrane     140-156 (138-156)

----- Final Results -----
              bacterial membrane --- Certainty = 0.1574(Affirmative) < succ>
               bacterial outside --- Certainty = 0.0000(Not Clear)   < succ>
             bacterial cytoplasm --- Certainty = 0.0000(Not Clear)   < succ>
```

No corresponding DNA sequence was identified in S. agalactiae.

The protein has homology with the following sequences in the GENPEPT database:

```
>GP: AAF09704 GB: AE001874 glutamine cyclotransferase
[Deinococcus radiodurans]
Identities = 81/229 (35%), Positives = 128/229 (55%), Gaps = 10/229 (4%)

Query:  16 YSYDSNLYTQGLEQLNNNHILLSAGRYGFSKVGVYDL--TQEIFSEKIAFP-DTVFAEGL   72
           Y +D    +TQGL+ L    H L S G+ G S + V +L    + ++S  +A      F EG
Sbjct:  54 YPHDRAAFTQGLQYLGGGHYLESTGQVGESDLRVSELRGAKVLWSTPLAQALPQAFGEGS  113

Query:  73 TVVEDYFWLLTYKEGVAYKFDKATCNCLGAYPFEGDGWGLAYDKENQCLWMTSGNAFLQK  132
           T +    + LT+++GVA  +D  T     G + ++G+GWGL  D ++  L M++G + L
Sbjct: 114 TQLGSTVYQLTWQDGVALTYDARTFKETGRHRYQGEGWGLTSDGKS--LIMSNGTSTLVW  171

Query: 133 RDPKDFALLDTVLVAIESVPISMLNELEYVDGYLYANIWQTNTIVKLQPDSGKVVATYDI  192
           RDPK FA   +V V +   P+   LNELEYV G +YAN+W T+  I ++   P +GKV+     D+
Sbjct: 172 RDPKTFAAQRSVQVTDQGQPVRNLNELEYVQGSVYANVWLTDRIARIHPQTGKVLTWIDV  231

Query: 193 SPLLKALNLDKSHYPDL----NVLNGIAHLDQQ-RFLITGKLYPLMLEV            236
           S L + ++   +         +V NGIA + ++    L+TGK +P + EV
Sbjct: 232 SDLTREVSAAATKQGQALTFDDVPNGIAFIPERGTLLLTGKRWPTLFEV            280
```

Based on this analysis, it was predicted that this GAS-specific protein and its epitopes, could be useful antigens for vaccines or diagnostics.

EXAMPLE 2506

A DNA sequence (GASx506R) was identified in S. pyogenes <SEQ ID 7511> which encodes the amino acid sequence <SEQ ID 7512>. Analysis of this protein sequence reveals the following:

```
Possible site: 33
>>> Seems to have no N-terminal signal sequence
```

```
----- Final Results -----
          bacterial cytoplasm --- Certainty = 0.2800(Affirmative) < succ>
          bacterial membrane  --- Certainty = 0.0000(Not Clear)   < succ>
          bacterial outside   --- Certainty = 0.0000(Not Clear)   < succ>
```

No corresponding DNA sequence was identified in *S. agalactiae*.

Based on this analysis, it was predicted that this GAS-specific protein and its epitopes, could be useful antigens for vaccines or diagnostics.

EXAMPLE 2507

A DNA sequence (GASx507R) was identified in *S. pyogenes* <SEQ ID 7513> which encodes the amino acid sequence <SEQ ID 7514>. Analysis of this protein sequence reveals the following:

```
Possible site: 53
>>> Seems to have a cleavable N-term signal seq.
    INTEGRAL   Likelihood = -10.51   Transmembrane   103-119  (97-124)
    INTEGRAL   Likelihood =  -9.13   Transmembrane   126-142  (122-145)
    INTEGRAL   Likelihood =  -8.65   Transmembrane   290-306  (286-307)
    INTEGRAL   Likelihood =  -7.17   Transmembrane   200-216  (198-228)
    INTEGRAL   Likelihood =  -7.06   Transmembrane    58-74   (54-82)
    INTEGRAL   Likelihood =  -3.19   Transmembrane   223-239  (220-242)
    INTEGRAL   Likelihood =  -2.81   Transmembrane   244-260  (244-261)
    INTEGRAL   Likelihood =  -2.71   Transmembrane   174-190  (169-191)

----- Final Results -----
          bacterial membrane  --- Certainty = 0.5203(Affirmative) < succ>
          bacterial outside   --- Certainty = 0.0000(Not Clear)   < succ>
          bacterial cytoplasm --- Certainty = 0.0000(Not Clear)   < succ>
```

No corresponding DNA sequence was identified in *S. agalactiae*.

The protein has homology with the following sequences in the GENPEPT database:

```
>GP: CAB56669 GB: AL121596 putative membrane protein [Streptomyces
coelicolor A3(2)]
Identities = 119/322 (36%), Positives = 182/322 (55%), Gaps = 24/322 (7%)

Query:    9 LETIYILIGLQLFHTAYCTFKDKTNPVYFGTALFWGLLGVTFV------------GGAFL   56
            +E +Y LIGL     A     D++NP  + +A FWGLLG+TF            GG  L
Sbjct:    4 VEWLYWLIGLVFVVMAVQMAMDRSNPKRWTSAAFWGLLGLTFPYGTGVANATAGNGGWTL   63

Query:   57 PNKVIGFIVIVLALLTLFKQVRIGTLPAFNEQKAEESAHRIGNWIFLPVMLMAMISLLLA  116
            P + +G V+ L +L  F  + G         ++ E +A R+GN IF+P + + +++++ A
Sbjct:   64 PAEPLGVAVLALIVLAGFNFLGKGVPVTTTGEQREAAAARLGNKIFVPALTIPLVAIVCA  123

Query:  117 LILPDFSKSAIGIAGILA---------TIAILIITKQKPSALLAENNRMNQQVSTSGILP  167
             +L +      G A +L          + +L+ ++K S +      M + + ++ +LP
Sbjct:  124 SVLDESGLFETGKATLLGLGLGCVAALVVGMLVTGEKKLSVPIHSGRSMLEAMGSALLLP  183

Query:  168 QLLGALGAIFAAAGVGDVIASLIREIVPADSRFFGVLAYVLGMVIFTMIMGNAFAAFTVI  227
            QLL  LG+IFAAAGVGD +  ++ +++P DS++F VLAY +GM +FT+IMGNAFAAF V+
Sbjct:  184 QLLAVLGSIFAAAGVGDQVGDIMNKVLPDDSKYFAVLAYCVGMFLFTVIMGNAFAAFPVM  243

Query:  228 TTGIGVPFVFAL--GADPIIAGALAMTAGFCGTLLTPMAANFNALPVALMEIKDRNAVIK  285
            T   IG P +       G +P +   A+ M AGF GTL TPMAANFN +P  L+E+KD+    IK
Sbjct:  244 TAAIGWPVLIQQMHGNEPAVL-AIGMLAGFAGTLCTPMAANFNIVPATLLELKDQYGPIK  302

Query:  286 KQAPIALVLIISHIALMYLLAY                                       307
             Q P  + L+      +M L A+
Sbjct:  303 AQLPTGIALLGCCTVIMALFAF                                       324
```

Based on this analysis, it was predicted that this GAS-specific protein and its epitopes, could be useful antigens for vaccines or diagnostics.

EXAMPLE 2508

A DNA sequence (GASx508R) was identified in *S. pyogenes* <SEQ ID 7515> which encodes the amino acid sequence <SEQ ID 7516>. Analysis of this protein sequence reveals the following:

```
Possible site: 61
>>> Seems to have an uncleavable N-term signal seq
    INTEGRAL    Likelihood = -12.15     Transmembrane    212-228  (208-235)
    INTEGRAL    Likelihood = -8.81      Transmembrane     23-39   (17-64)
    INTEGRAL    Likelihood = -7.43      Transmembrane     45-61   (40-64)
    INTEGRAL    Likelihood = -1.49      Transmembrane    114-130  (114-130)
    INTEGRAL    Likelihood = -1.49      Transmembrane      3-19   (3-20)
    INTEGRAL    Likelihood = -1.49      Transmembrane     76-92   (76-92)

----- Final Results -----
            bacterial membrane  --- Certainty = 0.5861(Affirmative) < succ>
             bacterial outside  --- Certainty = 0.0000(Not Clear)   < succ>
           bacterial cytoplasm  --- Certainty = 0.0000(Not Clear)   < succ>
```

No corresponding DNA sequence was identified in *S. agalactiae*.

```
>GP: CAB56670 GB: AL121596 possible integral membrane protein
[Streptomyces coelicolor A3(2)]
Identities = 77/220 (35%), Positives = 138/220 (62%), Gaps = 2/220 (0%)

Query:  23 IKLIGIVIIVLGFILKCDAIATVVVAGLVTALVSGISFIDFLDILGKEFTNQRLLTIFFI    82
           I L+G+V+++LGF+ + + +  V VAG+VT L+  ++ ++ L    G+ F + R +T++ I
Sbjct:   2 IVLLGVVVVILGFVTRRNPVLVVGVAGIVTGLLGKMNPLEVLAAFGRSFADSRSVTVYAI    61

Query:  83 TLPLIGLSETYGLKHRATQLIQRVQALTVGRLLTLYLIIRELAGLFSIR-LGGHPQFVRP   141
           LP+IGL E YGL+ +A  LI R+   L+ GR LT+YL++R++    F +  +GG Q VRP
Sbjct:  62 VLPVIGLLERYGLREQARHLIGRLGKLSAGRFLTVYLLVRQVTAAFGLNSIGGPAQTVRP   121

Query: 142 LIQPMGEAAAKANIGEELTDAEKDDIKAMAAANENFGNFFAQNTFVGAGGVLLIAGTLEQ   201
           L+ PM EAAA+ + G +L D  ++ +++ +A+ +   G FF ++ F+    G +LLI G +
Sbjct: 122 LVAPMAEAAAERSTGAKLPDKLREKVRSYSASADTVGVFFGEDCFIAIGSILLITGFVNS   181

Query: 202 LGY-DGNQAKIAFSSILIAIISIIIVAIYNYLFEKKMERQ                      240
            + D    ++A  +I  +A+ + +I       L +K++ER+
Sbjct: 182 TYHQDIEPTQLALWAIPLAVCAFLIHGARLLLMDKQLERE                      221
```

Based on this analysis, it was predicted that this GAS-specific protein and its epitopes, could be useful antigens for vaccines or diagnostics.

EXAMPLE 2509

A DNA sequence (GASx520) was identified in *S. pyogenes* <SEQ ID 7517> which encodes the amino acid sequence <SEQ ID 7518>. Analysis of this protein sequence reveals the following:

```
Possible site: 13
>>> Seems to have no N-terminal signal sequence

----- Final Results -----
           bacterial cytoplasm  --- Certainty = 0.2652(Affirmative) < succ>
            bacterial membrane  --- Certainty = 0.0000(Not Clear)   < succ>
             bacterial outside  --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2510

A DNA sequence (GASx522R) was identified in *S. pyogenes* <SEQ ID 7519> which encodes the amino acid sequence <SEQ ID 7520>. Analysis of this protein sequence reveals the following:

```
Possible site: 21
>>> Seems to have an uncleavable N-term signal seq

----- Final Results -----
            bacterial membrane  --- Certainty = 0.0000(Not Clear) < succ>
             bacterial outside  --- Certainty = 0.0000(Not Clear) < succ>
           bacterial cytoplasm  --- Certainty = 0.0000(Not Clear) < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2511

A DNA sequence (GASx523) was identified in *S. pyogenes* <SEQ ID 7521> which encodes the amino acid sequence <SEQ ID 7522>. Analysis of this protein sequence reveals the following:

```
Possible site: 22
>>> Seems to have no N-terminal signal sequence

----- Final Results -----
           bacterial cytoplasm  --- Certainty = 0.2133(Affirmative) < succ>
            bacterial membrane  --- Certainty = 0.0000(Not Clear)   < succ>
             bacterial outside  --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2512

A DNA sequence (GASx525) was identified in *S. pyogenes* <SEQ ID 7523> which encodes the amino acid sequence <SEQ ID 7524>. Analysis of this protein sequence reveals the following:

```
Possible site: 14
>>> Seems to have no N-terminal signal sequence

----- Final Results -----
           bacterial cytoplasm  --- Certainty = 0.2364(Affirmative) < succ>
            bacterial membrane  --- Certainty = 0.0000(Not Clear)   < succ>
             bacterial outside  --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2513

A DNA sequence (GASx535) was identified in *S. pyogenes* <SEQ ID 7525> which encodes the amino acid sequence <SEQ ID 7526>. Analysis of this protein sequence reveals the following:

```
Possible site: 47
>>> Seems to have no N-terminal signal sequence

----- Final Results -----
           bacterial cytoplasm  --- Certainty = 0.4223(Affirmative) < succ>
```

-continued
```
              bacterial membrane --- Certainty = 0.0000(Not Clear) < succ>
              bacterial outside  --- Certainty = 0.0000(Not Clear) < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2514

A DNA sequence (GASx536) was identified in *S. pyogenes* <SEQ ID 7527> which encodes the amino acid sequence <SEQ ID 7528>. Analysis of this protein sequence reveals the following:

```
Possible site: 59
>>> Seems to have no N-terminal signal sequence

----- Final Results -----
              bacterial cytoplasm --- Certainty = 0.1102(Affirmative) < succ>
              bacterial membrane  --- Certainty = 0.0000(Not Clear)   < succ>
              bacterial outside   --- Certainty = 0.0000(Not Clear)   < succ>
```

No corresponding DNA sequence was identified in *S. agalactiae*.

The protein has homology with the following sequences in the GENPEPT database:

```
>GP: AAB85515 GB: AE000874 conserved protein [Methanobacterium
thermoautotrophicum]
Identities = 82/236 (34%), Positives = 132/236 (55%), Gaps = 11/236 (4%)

Query:    9 MNLSIFGLKNIPYLKEGDSIEKLIEESIKTSEFFIEDNDVLCIASKVVSIAEGQVMSLNE   68
            M +S+ G++ +P +  GD I  LI  ++       + D D++ IA  +VS AEG ++SL E
Sbjct:    1 MGISLIGVEGMPLVGAGDDIAYLIISALNEGGEDLLDGDIIVIAETIVSKAEGNIISLEE   60

Query:   69 IQVSDVAKEIHRNIPRKDPRIIEIMLNLVNRDLSRLDIKKNYIGCRLENGLKLTSGGIDR  128
            I+ S  A +I     KDP ++E +L          + +  ++I     +G     + GID
Sbjct:   61 IKPSPEALDIAERTG-KDPSLVEAILG---ESSEIIRVGHDFIVSETRHGFVCANAGIDE  116

Query:  129 KSVDEVFL--LPNNPDASAKRISEYLKKSLGKNVAVVITDSDGREDKRGATQVAIGIYGI  186
             +VD+      LP +PD SA++I    L+++ G+ +AV+I+D+ GR   + GA   VA+G+ G+
Sbjct:  117 SNVDDGLATPLPRDPDGSAEKILRTLQEATGRELAVIISDTQGRPFREGAVGVAVGVAGL  176

Query:  187 HPL--RKTEVIDSQGETIKFQEETLCDMIAACAGLVMGQRGTGIPAVLIRGLDYKW       240
             P+   RK E   D   G +++        + D +AA A  LVMGQ    G+PAV+IRG   Y W
Sbjct:  177 SPIWDRKGE-RDLYGRSLETTRVAVADELAAAASLVMGQADEGVPAVIIRG--YPW       229
```

Based on this analysis, it was predicted that this GAS-specific protein and its epitopes, could be useful antigens for vaccines or diagnostics.

EXAMPLE 2515

A DNA sequence (GASx537) was identified in *S. pyogenes* <SEQ ID 7529> which encodes the amino acid sequence <SEQ ID 7530>. Analysis of this protein sequence reveals the following:

```
Possible site: 50
>>> Seems to have no N-terminal signal sequence
     INTEGRAL    Likelihood = -1.12    Transmembrane   174-190 (174-190)
```

```
-continued
----- Final Results -----
        bacterial membrane  --- Certainty = 0.1447(Affirmative) < succ>
        bacterial outside   --- Certainty = 0.0000(Not Clear)   < succ>
        bacterial cytoplasm --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2516

A DNA sequence (GASx538) was identified in *S. pyogenes* <SEQ ID 7531> which encodes the amino acid sequence <SEQ ID 7532>. Analysis of this protein sequence reveals the following:

```
Possible site: 32
>>> Seems to have no N-terminal signal sequence

----- Final Results -----
        bacterial cytoplasm --- Certainty = 0.3852(Affirmative) < succ>
        bacterial membrane  --- Certainty = 0.0000(Not Clear)   < succ>
        bacterial outside   --- Certainty = 0.0000(Not Clear)   < succ>
```

No corresponding DNA sequence was identified in *S. agalactiae*.

The protein has homology with the following sequences in the GENPEPT database:

```
>GP: AAB99212 GB: U67562 conserved hypothetical protein [Methanococcus
jannaschii]
Identities = 129/387 (33%), Positives = 208/387 (53%),
Gaps = 44/387 (11%)

Query:  18 EVVERKGLGHPDTLADGIAEQIEIDYSLYCLDKFGVIPHHNFDKIIIRGGHSVQDFGGSD    77
            E+VERKGLGHPD++ DGIAE +        ++KFG I HHN D++ + GGH+    FGG
Sbjct:  20 EIVERKGLGHPDSICDGIAESVSRALCKMYMEKFGTILHHNTDQVELVGGHAYPKFGGGV    79

Query:  78 FIEPIKIIFLGRASKKCFNS------SIPLFKIQKKAATKYLNRILPNLDVENYVEFETL   131
            + PI I+ GRA+ + +       +P+      KAA +YL ++L N+DV+ V  +
Sbjct:  80 MVSPIYILLSGRATMEILDKEKNEVIKLPVGTTAVKAAKEYLKKVLRNVDVDKDVIID--   137

Query: 132 TSDFTTKTNWFSPEAIEDLP-EYLDVPKANDTATMISYWPLTISEELALMIEGYFYKLD-   189
            +       S + ++    +  +VP ANDT+ + Y PL+ +E L L  E +      +
Sbjct: 138 -----CRIGQGSMDLVDVFERQKNEVPLANDTSFGVGYAPLSTTERLVLETERFLNSDEL   192

Query: 190 KNELPTPRFTKMGGDIKVMVVRNDLEYSIRINFPLISKFFNNDIESQLYVDKHVEKIKKY   249
            KNE+P     +G DIKVM +R  + ++   ++ ++  N IE     V   +EK++K
Sbjct: 193 KNEIPA-----VGEDIKVMGLREGKKITLTIAMAVVDRYVKN-IEEYKEV---IEKVRKK   243

Query: 250 IEQKYKNIS--FSIDYH-----------YYLTTTGSCIDFGEEGAVGRGNKTHGIISSFR   296
            +E   K I+ + ++ H            YLT TG+  + G++G+VGRGN+ +G+I+ FR
Sbjct: 244 VEDLAKKIADGYEVEIHINTADDYERESVYLTVTGTSAEMGDDGSVGRGNRVNGLITPFR   303

Query: 297 PNTMEAPAGKNCTYFVGKVWGFLSDTIAKEIYEAFNT-PCQIIMQLNIGSKLYRPTHLFI   355
            P +MEA +GKN      VGK++  L++  IA +I +       C + +     IG   +    P     L I
Sbjct: 304 PMSMEAASGKNPVNHVGKIYNILANLIANDIAKLEGVKECYVRILSQIGKPINEPKALDI   363

Query: 356 Q--TEESVD----QERVLEIVNRHLNN                                   376
             +  TE+S D     + + EI N+ L+N
Sbjct: 364 EIITEDSYDIKDIEPKAKEIANKWLDN                                   390
```

Based on this analysis, it was predicted that this GAS-specific protein and its epitopes, could be useful antigens for vaccines or diagnostics.

EXAMPLE 2517

A DNA sequence (GASx539) was identified in *S. pyogenes* <SEQ ID 7533> which encodes the amino acid sequence <SEQ ID 7534>. Analysis of this protein sequence reveals the following:

```
Possible site: 17
>>> Seems to have no N-terminal signal sequence

----- Final Results -----
            bacterial cytoplasm --- Certainty = 0.1436(Affirmative) < succ>
            bacterial membrane  --- Certainty = 0.0000(Not Clear)   < succ>
            bacterial outside   --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2518

A DNA sequence (GASx540) was identified in *S. pyogenes* <SEQ ID 7535> which encodes the amino acid sequence <SEQ ID 7536>. Analysis of this protein sequence reveals the following:

```
Possible site: 45
>>> Seems to have no N-terminal signal sequence

----- Final Results -----
            bacterial cytoplasm --- Certainty = 0.3956(Affirmative) < succ>
            bacterial membrane  --- Certainty = 0.0000(Not Clear)   < succ>
            bacterial outside   --- Certainty = 0.0000(Not Clear)   < succ>
```

No corresponding DNA sequence was identified in *S. agalactiae*.

The protein has homology with the following sequences in the GENPEPT database:

```
>GP: AAD36304 GB: AE001779 conserved hypothetical protein
[Thermotoga maritima]
Identities = 105/353 (29%), Positives = 173/353 (48%),
Gaps = 46/353 (13%)

Query:    3 VIGIPTLNEADNISRLVKQIDEYAVNL-GKEIIIINSDSKSTDGTPQIFLETKTYNT-KV    60
            V+GIP+ N A+ IS + +    + V+     + +I+NSD  S DGT + F+ET T+   K
Sbjct:  106 VVGIPSYNNAETISHVARTAAQGIVDFFDGDGMIVNSDGGSADGTRERFMETDTFGLPKE  165

Query:   61 SIVSEA-KGKGYNVRNIFEYAINHVPNFSGLILIDGDVVSMKKMWLEKMFIAIESGN-DL  118
            S V E   GKG +R I E+A+     +   ++ +D D+ S+K  W+E++    +  G  D
Sbjct:  166 SFVYEGLPGKGSAMRAIMEFALKQ--DAEAVVFLDADLRSVKPWWVERLAGPVLKGEADY  223

Query:  119 IIPNYARKSFEGNATNHFIYPMLVKIFKRDMPYQCISGDFGFSRGLIKDLTLKCN--WHK  176
             + P Y R  F+G  TN+  +PM  ++ + +   Q I GDFG  R L++     K   W+
Sbjct:  224 VTPFYLRHRFDGTITNNVCFPMTAVLYGKKVR-QPIGGDFGVGRKLLEIYLGKPKEIWNT  282

Query:  177 YTLGYGIDIFLTLTAILKSYKIKEIDLQSKIH--KKSFEKIEKIFLEVSQSFFETINDNS  234
                +GIDI++T TAI +S ++ +   L +K+H  K    + ++ +FL+V  + FE +
Sbjct:  283 DVARFGIDIWMTTTAINESGRVVQAALGTKVHDVKDPGKHLKGMFLQVVGTLFELV----  338

Query:  235 LNQDKLRLNINFESHSRQFIKSSDI-----------LSSNDIENLKLRALFLLQEEKQY  282
                   I  +E+  ++  K   D+              S DI NLK A   L+E +
Sbjct:  339 ---------ITYENVWKEIWKIEDVPIYGETPQEEVPSMSIDIGNLKKLARETLEEVEYI  389

Query:  283 LHG-LSEVEWDGI--LSNTINNIYRYSSEEHSL-------YLLPLYLLRVYNY         325
              G LSEV+ G    LS+ ++ +YR + +              LLP Y  R    +
Sbjct:  390 DRGILSEVKESGTLSLSSWVDTLYRSAVQYRKTRDKKVVENLLPFYFARTARF         442
```

Based on this analysis, it was predicted that this GAS-specific protein and its epitopes, could be useful antigens for vaccines or diagnostics.

EXAMPLE 2519

A DNA sequence (GASx542) was identified in *S. pyogenes* <SEQ ID 7537> which encodes the amino acid sequence <SEQ ID 7538>. Analysis of this protein sequence reveals the following:

```
Possible site: 20
>>> Seems to have an uncleavable N-term signal seq
      INTEGRAL      Likelihood = -5.31      Transmembrane      3-19 (1-21)

----- Final Results -----
                bacterial membrane --- Certainty = 0.3123(Affirmative) < succ>
                bacterial outside  --- Certainty = 0.0000(Not Clear)   < succ>
                bacterial cytoplasm --- Certainty = 0.0000(Not Clear)  < succ>
```

No corresponding DNA sequence was identified in *S. agalactiae*.

```
>GP: BAB07427 GB: AP001519 nucleotide sugar dehydrogenase
[Bacillus halodurans]
Identities = 184/388 (47%), Positives = 274/388 (70%), Gaps = 3/388 (0%)

Query:    1 MKITVVGIGYVGLSIGLLLAKEHDVTFFDIDNKKIDLINKRQSPLKEAAINKLLC-KAKN   59
            M IT+ G GYVGLS  +LLA+ +DV  +DI  +K+D+IN R+SP+ +   I + L  K  N
Sbjct:    1 MNITIAGTGYVGLSNAVLLAQHNDVIAYDIVQEKVDMINNRKSPIVDREIEEFLATKELN   60

Query:   60 INATSSEELAYKDATFIILSLPTNL--KFNKLDTSIIEISVSNILKINKKATIVIKSTVP  117
            + AT+ +E A+KDA F+++S PTN     + N  DTS +E  +S++L IN  A +VIKST+P
Sbjct:   61 LTATTDKEKAFKDAQFVVISTPTNYDPEKNYFDTSSVEAVISDVLSINPNAVMVIKSTIP  120

Query:  118 IGFTEYLRNRFHYNDIIFSPEFLREGSTIHDQLYPSRTIVGNESRNSQLFLDILTDISVE  177
            +G+T  +  RF+  +IIFSPEFLREGS ++D L+PSR +VG  ++  +++F  +L    +++
Sbjct:  121 VGYTREVNERFNTKNIIFSPEFLREGSALYDNLHPSRIVVGERTQRAKIFAALLVQGAIK  180

Query:  178 KDSPSLLVGSSEAEAIKLFSNAYLAQKIAFFNELDTFAEMQNLDSKKIIEAMGYDQRIGN  237
            ++   L    S+EAEAIKLF+N YLA ++AFFNELD++AE++ LD+K+II+ +G D RIG
Sbjct:  181 ENIDVLFTDSTEAEAIKLFANTYLAMRVAFFNELDSYAELKGLDAKQIIDGVGLDPRIGT  240

Query:  238 SHNNPSFGFGGYCLPKDIKQLEYHFKEIPAPIITSISESNLLRKIHIAKMILNSSAKTIG  297
            +NNPSFG+GGYCLPKD KQL  +F+++P  II +I ++N  RK H+A MIL    K +G
Sbjct:  241 HYNNPSFGYGGYCLPKDTKQLLANFEDVPNNIIGAIVDANDTRKDHVANMILKREPKVVG  300

Query:  298 IYRINSKKDSDNCRESSTIDVAKLLKSSGKDVIIFEPLINQKKFLGCPLSNDFNEFIKYS  357
            IYR+  K   SDN R+S+ +DV    L ++G +V+++EP ++   +F  G   +  DF EF  K S
Sbjct:  301 IYRLTMKTGSDNFRQSAILDVMTRLNNAGAEVVVYEPALDATEFDGSKVIEDFAEFKKMS  360

Query:  358 DIIVANRIDDALRKCNSKVFTRDIFQYD                                  385
            D+IVANR+ D L++   KV+TRD++   D
Sbjct:  361 DVIVANRLSDDLKEVAEKVYTRDLYTRD                                  388
```

Based on this analysis, it was predicted that this GAS-specific protein and its epitopes, could be useful antigens for vaccines or diagnostics.

EXAMPLE 2520

A DNA sequence (GASx544R) was identified in *S. pyogenes* <SEQ ID 7539> which encodes the amino acid sequence <SEQ ID 7540>. Analysis of this protein sequence reveals the following:

```
Possible site: 34
>>> Seems to have no N-terminal signal sequence
      INTEGRAL      Likelihood = -0.06      Transmembrane      46-62 (46-62)

----- Final Results -----
                bacterial membrane --- Certainty = 0.1022(Affirmative) < succ>
                bacterial outside  --- Certainty = 0.0000(Not Clear)   < succ>
                bacterial cytoplasm --- Certainty = 0.0000(Not Clear)  < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2521

A DNA sequence (GASx545R) was identified in *S. pyogenes* <SEQ ID 7541> which encodes the amino acid sequence <SEQ ID 7542>. Analysis of this protein sequence reveals the following:

```
Possible site: 58
>>> Seems to have no N-terminal signal sequence
    INTEGRAL      Likelihood = -1.49    Transmembrane      186-202 (186-203)

----- Final Results -----
              bacterial membrane --- Certainty = 0.1595(Affirmative) < succ>
               bacterial outside --- Certainty = 0.0000(Not Clear)   < succ>
             bacterial cytoplasm --- Certainty = 0.0000(Not Clear)   < succ>
```

No corresponding DNA sequence was identified in S. agalactiae.

The protein has no significant homology with any sequences in the GENPEPT database.

Based on this analysis, it was predicted that this GAS-specific protein and its epitopes, could be useful antigens for vaccines or diagnostics.

EXAMPLE 2522

A DNA sequence (GASx546R) was identified in S. pyogenes <SEQ ID 7543> which encodes the amino acid sequence <SEQ ID 7544>. Analysis of this protein sequence reveals the following:

```
Possible site: 47
>>> Seems to have no N-terminal signal sequence

----- Final Results -----
             bacterial cytoplasm --- Certainty = 0.2422(Affirmative) < succ>
              bacterial membrane --- Certainty = 0.0000(Not Clear)   < succ>
               bacterial outside --- Certainty = 0.0000(Not Clear)   < succ>
```

No corresponding DNA sequence was identified in S. agalactiae.

The protein has no significant homology with any sequences in the GENPEPT database.

Based on this analysis, it was predicted that this GAS-specific protein and its epitopes, could be useful antigens for vaccines or diagnostics.

EXAMPLE 2523

A DNA sequence (GASx547R) was identified in S. pyogenes <SEQ ID 7545> which encodes the amino acid sequence <SEQ ID 7546>. Analysis of this protein sequence reveals the following:

```
Possible site: 60
>>> Seems to have no N-terminal signal sequence

----- Final Results -----
             bacterial cytoplasm --- Certainty = 0.1612(Affirmative) < succ>
              bacterial membrane --- Certainty = 0.0000(Not Clear)   < succ>
               bacterial outside --- Certainty = 0.0000(Not Clear)   < succ>
```

No corresponding DNA sequence was identified in S. agalactiae.

The protein has no significant homology with any sequences in the GENPEPT database.

Based on this analysis, it was predicted that this GAS-specific protein and its epitopes, could be useful antigens for vaccines or diagnostics.

EXAMPLE 2524

A DNA sequence (GASx548) was identified in S. pyogenes <SEQ ID 7547> which encodes the amino acid sequence <SEQ ID 7548>. Analysis of this protein sequence reveals the following:

```
Possible site: 44
>>> Seems to have no N-terminal signal sequence
```

```
-continued
----- Final Results -----
            bacterial cytoplasm --- Certainty = 0.5156(Affirmative) < succ>
            bacterial membrane  --- Certainty = 0.0000(Not Clear)   < succ>
             bacterial outside  --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2525

A DNA sequence (GASx549R) was identified in *S. pyogenes* <SEQ ID 7549> which encodes the amino acid sequence <SEQ ID 7550>. Analysis of this protein sequence reveals the following:

```
Possible site: 21
>>> Seems to have a cleavable N-term signal seq.

----- Final Results -----
             bacterial outside  --- Certainty = 0.3000(Affirmative) < succ>
            bacterial membrane  --- Certainty = 0.0000(Not Clear)   < succ>
            bacterial cytoplasm --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2526

A DNA sequence (GASx552) was identified in *S. pyogenes* <SEQ ID 7551> which encodes the amino acid sequence <SEQ ID 7552>. Analysis of this protein sequence reveals the following:

```
Possible site: 15
>>> Seems to have no N-terminal signal sequence
    INTEGRAL    Likelihood = -0.59    Transmembrane    83-99 (83-99)

----- Final Results -----
            bacterial membrane  --- Certainty = 0.1235(Affirmative) < succ>
             bacterial outside  --- Certainty = 0.0000(Not Clear)   < succ>
            bacterial cytoplasm --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2527

A DNA sequence (GASx553) was identified in *S. pyogenes* <SEQ ID 7553> which encodes the amino acid sequence <SEQ ID 7554>. Analysis of this protein sequence reveals the following:

```
Possible site: 49
>>> Seems to have no N-terminal signal sequence

----- Final Results -----
            bacterial cytoplasm --- Certainty = 0.2781(Affirmative) < succ>
             bacterial membrane --- Certainty = 0.0000(Not Clear)   < succ>
              bacterial outside --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2528

A DNA sequence (GASx554) was identified in *S. pyogenes* <SEQ ID 7555> which encodes the amino acid sequence <SEQ ID 7556>. Analysis of this protein sequence reveals the following:

```
Possible site: 18
>>> Seems to have no N-terminal signal sequence

----- Final Results -----
            bacterial cytoplasm --- Certainty = 0.2792(Affirmative) < succ>
             bacterial membrane --- Certainty = 0.0000(Not Clear)   < succ>
              bacterial outside --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2529

A DNA sequence (GASx555) was identified in *S. pyogenes* <SEQ ID 7557> which encodes the amino acid sequence <SEQ ID 7558>. Analysis of this protein sequence reveals the following:

```
Possible site: 35
>>> Seems to have no N-terminal signal sequence
     INTEGRAL     Likelihood = -0.00     Transmembrane     49-65 (49-65)

----- Final Results -----
             bacterial membrane --- Certainty = 0.1001(Affirmative) < succ>
              bacterial outside --- Certainty = 0.0000(Not Clear)   < succ>
            bacterial cytoplasm --- Certainty = 0.0000(Not Clear)   < succ>
```

No corresponding DNA sequence was identified in *S. agalactiae*.

The protein has homology with the following sequences in the GENPEPT database:

```
>GP: BAA36631 GB: AB016282 ORF25 [bacteriophage phi-105]
Identities = 43/118 (36%), Positives = 69/118 (58%),
Gaps = 2/118 (1%)

Query:  3 LLDLIGRKRARDKPQNSYEGQDFSYLFG--RTTSGENVDEFKTMQTTAVYACVRVLAEAV   60
          LL+ +  KR+               +FG  +T SGE V E  ++    ++ACV VL++ +
Sbjct:  2 LLERMFEKRSGSSDHEDGFNNILLNMFGGRKTASGERVSESNSLVQPDIFACVNVLSDDI   61
```

```
Query:  61 ASLPIHIYERTENGKEKKLDHPLYFLLHDEPNPEMSSFIFRETIMSHLLIWGNAYVQI   118
           A LPIH Y+RT+ G E+K +H      ++  PNP M++F +++ +M+H+L WGNAY   I
Sbjct:  62 AKLPIHTYKRTDGGIERKPEHKSAHAVYARPNPYMTAFTWKKLMMTHVLTWGNAYSYI   119
```

Based on this analysis, it was predicted that this GAS-specific protein and its epitopes, could be useful antigens for vaccines or diagnostics.

EXAMPLE 2530

A DNA sequence (GASx556) was identified in *S. pyogenes* <SEQ ID 7559> which encodes the amino acid sequence <SEQ ID 7560>. Analysis of this protein sequence reveals the following:

```
Possible site: 43
>>> Seems to have no N-terminal signal sequence

----- Final Results -----
           bacterial Cytoplasm --- Certainty = 0.2055(Affirmative) < succ>
           bacterial membrane --- Certainty = 0.0000(Not Clear)   < succ>
             bacterial outside --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2531

A DNA sequence (GASx557) was identified in *S. pyogenes* <SEQ ID 7561> which encodes the amino acid sequence <SEQ ID 7562>. Analysis of this protein sequence reveals the following:

```
Possible site: 50
>>> Seems to have no N-terminal signal sequence

----- Final Results -----
           bacterial cytoplasm --- Certainty = 0.1696(Affirmative) < succ>
           bacterial membrane --- Certainty = 0.0000(Not Clear)   < succ>
             bacterial outside --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2532

A DNA sequence (GASx559) was identified in *S. pyogenes* <SEQ ID 7563> which encodes the amino acid sequence <SEQ ID 7564>. Analysis of this protein sequence reveals the following:

```
Possible site: 51
>>> Seems to have no N-terminal signal sequence

----- Final Results -----
           bacterial cytoplasm --- Certainty = 0.1556(Affirmative) < succ>
```

```
            bacterial membrane --- Certainty = 0.0000(Not Clear) < succ>
            bacterial outside  --- Certainty = 0.0000(Not Clear) < succ>
```

No corresponding DNA sequence was identified in *S. agalactiae*.

The protein has homology with the following sequences in the GENPEPT database:

```
>GP: CAB15798 GB: Z99123 alternate gene name: ipa-83d [Bacillus subtilis]
Identities = 70/263 (26%), Positives = 121/263 (45%), Gaps = 25/263 (9%)

Query:  68 KTIEQIKELK--YSIDAVACWDEALTHIADDISKELGLNPISSLDSQSFRFKDRMRMVCE 125
           + +EQI ++   +  DA+  +E         + LGL         +++ R K++MR
Sbjct:  87 EVVEQIVKVAEMFGADAITTNNELFIAPMAKACERLGLRGAGVQAAENARDKNKMRDAFN 146

Query: 126 AGGLKMPKYKIINQFSDTNKIINW-KYPLIVKPTSFLASIGVKKVYNFSELQQAVSQMLN 184
           G+K  K K +   D   +      PLI+KPT  +SIGV + +     + +++ +
Sbjct: 147 KAGVKSIKNKRVTTLEDFRAALEEIGTPLILKPTYLASSIGVTLITDTETAEDEFNRVND 206

Query: 185 VKFPVYIASGVYELGELYNLEPRVLVEEFIDGE----------EY-SLESVVRNGIYTP 232
           + +    V       E   + EEF+ GE              +Y S+E ++ +G Y P
Sbjct: 207 YLKSINVPKAV-------TFEAPFIAEEFLQGEYGDWYQTEGYSDYISIEGIMADGEYFP 259

Query: 233 LGITKKIVDEKLFMDEIGHIFPSNLNKEEKSRVYSWAEKLHQILQLNHITTHTEFRIGRN 292
           + I K    ++   E  HI PS L++E K ++    A+K ++ L L +  THTE ++ +N
Sbjct: 260 IAIHDKT--PQIGFTETSHITPSILDEEAKKKIVEAAKKANEGLGLQNCATHTEIKLMKN 317

Query: 293 GDIILIEIGARIGG-DCIPNLMK                                      314
           +   LIE AR G + IPN+ K
Sbjct: 318 REPGLIESAARFAGWNMIPNIKK                                      340
```

Based on this analysis, it was predicted that this GAS-specific protein and its epitopes, could be useful antigens for vaccines or diagnostics.

EXAMPLE 2533

A DNA sequence (GASx561) was identified in *S. pyogenes* <SEQ ID 7565> which encodes the amino acid sequence <SEQ ID 7566>. Analysis of this protein sequence reveals the following:

```
Possible site: 55
>>> Seems to have no N-terminal signal sequence

----- Final Results -----
            bacterial cytoplasm --- Certainty = 0.2602(Affirmative) < succ>
            bacterial membrane  --- Certainty = 0.0000(Not Clear)   < succ>
            bacterial outside   --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2534

A DNA sequence (GASx562) was identified in *S. pyogenes* <SEQ ID 7567> which encodes the amino acid sequence <SEQ ID 7568>. Analysis of this protein sequence reveals the following:

```
Possible site: 34
>>> Seems to have no N-terminal signal sequence

----- Final Results -----
            bacterial membrane  --- Certainty = 0.0000(Not Clear) < succ>
            bacterial outside   --- Certainty = 0.0000(Not Clear) < succ>
            bacterial cytoplasm --- Certainty = 0.0000(Not Clear) < succ>
```

No corresponding DNA sequence was identified in *S. agalactiae*.

The protein has homology with the following sequences in the GENPEPT database:

```
>GP: AAD06696 GB: AE001539 HISTIDYL-TRNA SYNTHETASE [Helicobacter
pylori J99]
Identities = 75/309 (24%), Positives = 129/309 (41%), Gaps = 35/309 (11%)

Query:  11 KGYRRQFNQILLGAWGIESAYVDAEIIVATWRGLQRFKGIKVE--FIQLSNKNIFDVLEK   68
           KG R+F Q    G ES  DAEII      L  K + +E  + ++++ I + + +
Sbjct: 115 KGRYREFTQCDFDFIGSESLVCDAEIIQVIIASL---KALDLEDFCVSINHRKILNGICE  171

Query:  69 DLSKKLRFEDISIEAILGKYLCNNDIEIIKCLYEKDKINMELLISLISKISNKLVKQEFI  128
              E + L K  N   E +K   + D    ++ L+ ++     N L   EF
Sbjct: 172 YFGIAQVNEVLRIVDKLEKIGLNGVEEELKKECDLDSNTIKDLLEMVQIKQNDLSHAEFF  231

Query: 129 -KVLVLYEYVKNFLP----VDCIYFSLS------NLY--------GTGHYSSMNYKIFIR  169
            K+  L +Y +N       ++ +Y  L        NLY         G  G+Y+ + Y+  +
Sbjct: 232 EKIAYLKDYNENLKKGIQDLERLYQLLGDLQISQNLYKIDFSIARGLGYYTGIVYETTLN  291

Query: 170 TKSGDIFDIADGGRIDDMVSKFNKVNVLGVCMGIGTTVLSQEI-------EYEIEDRIMI  222
             +  +   GGR D +    F+K N+ GV   IG   L    +       E    + +++I
Sbjct: 292 DMKS-LGSVCSGGRYDHLTKNFSKENLQGVGASIGIDRLIVALSEMQLLDERSTQAKVLI  350

Query: 223 LVEKIDVKIYKNCLELANKLSGYHCSVFEFPYKKIKKFFKHELYSRHHYIIVRLDGSMEY  282
            +     Y N L  + + SG    V+     +KIKK F +  + H ++ V    G  E+
Sbjct: 351 ACMHEEYFSYANRLAESLRQSGIFSEVYP-EAQKIKKPFSYANHKGHEFVAV--IGEEEF  407

Query: 283 RFSSVALKN                                                    291
            +  +++LKN
Sbjct: 408 KSETLSLKN                                                    416
```

Based on this analysis, it was predicted that this GAS-specific protein and its epitopes, could be useful antigens for vaccines or diagnostics.

EXAMPLE 2535

A DNA sequence (GASx564) was identified in *S. pyogenes* <SEQ ID 7569> which encodes the amino acid sequence <SEQ ID 7570>. Analysis of this protein sequence reveals the following:

```
Possible site: 56
>>> Seems to have no N-terminal signal sequence

----- Final Results -----
           bacterial cytoplasm --- Certainty = 0.1264(Affirmative) < succ>
           bacterial membrane  --- Certainty = 0.0000(Not Clear)   < succ>
            bacterial outside  --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2536

A DNA sequence (GASx576) was identified in *S. pyogenes* <SEQ ID 7571> which encodes the amino acid sequence <SEQ ID 7572>. Analysis of this protein sequence reveals the following:

```
Possible site: 60
>>> Seems to have a cleavable N-term signal seq.

----- Final Results -----
             bacterial outside  --- Certainty = 0.3000(Affirmative) < succ>
             bacterial membrane --- Certainty = 0.0000(Not Clear)   < succ>
            bacterial cytoplasm --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2537

A DNA sequence (GASx577R) was identified in *S. pyogenes* <SEQ ID 7573> which encodes the amino acid sequence <SEQ ID 7574>. Analysis of this protein sequence reveals the following:

```
Possible site: 17
>>> Seems to have no N-terminal signal sequence
     INTEGRAL    Likelihood = -2.60    Transmembrane    2-18 (1-18)

----- Final Results -----
            bacterial membrane --- Certainty = 0.2041(Affirmative) < succ>
            bacterial outside  --- Certainty = 0.0000(Not Clear)   < succ>
            bacterial cytoplasm --- Certainty = 0.0000(Not Clear)  < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2538

A DNA sequence (GASx579) was identified in *S. pyogenes* <SEQ ID 7575> which encodes the amino acid sequence <SEQ ID 7576>. Analysis of this protein sequence reveals the following:

```
Possible site: 13
>>> Seems to have no N-terminal signal sequence

----- Final Results -----
            bacterial cytoplasm --- Certainty = 0.3161(Affirmative) < succ>
            bacterial membrane  --- Certainty = 0.0000(Not Clear)   < succ>
            bacterial outside   --- Certainty = 0.0000(Not Clear)   < succ>
```

No corresponding DNA sequence was identified in *S. agalactiae*.

The protein has homology with the following sequences in the GENPEPT database:

```
>GP: CAB12286 GB: Z99106 similar to hypothetical proteins
[Bacillus subtilis]
Identities = 62/140 (44%), Positives = 88/140 (62%), Gaps = 3/140 (2%)

Query:    3 LTNYVQEVSLADFGKPLHHKAYWNKRLKTTGGRFFPKDGHLDFNPRMLEEHGELIFRKIV   62
            L    +++S    F KP  H+A +N RLKTTGGR+     +++ N + L EHG      I+
Sbjct:    6 LQKLTEDISETYFKKPFRHQALFNDRLKTTGGRYLLTSHNIELNRKYLIEHGREELIGII  65

Query:   63 RHELCHYHLYFEGRGYHHKDRDFKDLLAQVNGLRY---VPTSSKSKTNHHYSCQTCGQVY  119
            +HELCHYHL+ EG+GY H+DRDF+ LL QVN  R+    +   +++K  + Y C TCGQ Y
Sbjct:   66 KHELCHYHLHLEGKGYKHRDRDFRMLLQQVNAPRFCTPLKKKAENKKTYMYICTTCGQQY  125

Query:  120 QRKRRINLAKYVCGNCHGKL                                          139
            +KR +N  +Y CG C GK+
Sbjct:  126 IKKRAMNPDRYRCGKCRGKI                                          145
```

Based on this analysis, it was predicted that this GAS-specific protein and its epitopes, could be useful antigens for vaccines or diagnostics.

EXAMPLE 2539

A DNA sequence (GASx587R) was identified in *S. pyogenes* <SEQ ID 7577> which encodes the amino acid sequence <SEQ ID 7578>. Analysis of this protein sequence reveals the following:

```
Possible site: 53
>>> Seems to have no N-terminal signal sequence
    INTEGRAL     Likelihood = -10.40     Transmembrane    46-62 (39-89)
    INTEGRAL     Likelihood =  -5.36     Transmembrane    65-81 (63-89)

----- Final Results -----
           bacterial membrane --- Certainty = 0.5161(Affirmative) < succ>
            bacterial outside --- Certainty = 0.0000(Not Clear)   < succ>
          bacterial cytoplasm --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2540

A DNA sequence (GASx590R) was identified in *S. pyogenes* <SEQ ID 7579> which encodes the amino acid sequence <SEQ ID 7580>. Analysis of this protein sequence reveals the following:

```
Possible site: 35
>>> Seems to have no N-terminal signal sequence

----- Final Results -----
          bacterial cytoplasm --- Certainty = 0.2036(Affirmative) < succ>
           bacterial membrane --- Certainty = 0.0000(Not Clear)   < succ>
            bacterial outside --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2541

A DNA sequence (GASx592R) was identified in *S. pyogenes* <SEQ ID 7581> which encodes the amino acid sequence <SEQ ID 7582>. Analysis of this protein sequence reveals the following:

```
Possible site: 23
>>> Seems to have a cleavable N-term signal seq.
    INTEGRAL     Likelihood =  -4.62     Transmembrane    25-41 (24-43)

----- Final Results -----
           bacterial membrane --- Certainty = 0.2848(Affirmative) < succ>
            bacterial outside --- Certainty = 0.0000(Not Clear)   < succ>
          bacterial cytoplasm --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2542

A DNA sequence (GASx600) was identified in *S. pyogenes* <SEQ ID 7583> which encodes the amino acid sequence <SEQ ID 7584>. Analysis of this protein sequence reveals the following:

```
Possible site: 24
>>> Seems to have an uncleavable N-term signal seq
      INTEGRAL      Likelihood = -2.18     Transmembrane     3-19(2-19)

----- Final Results -----
            bacterial membrane --- Certainty = 0.1871(Affirmative) < succ>
              bacterial outside --- Certainty = 0.0000(Not Clear)  < succ>
            bacterial cytoplasm --- Certainty = 0.0000(Not Clear)  < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2543

A DNA sequence (GASx603R) was identified in *S. pyogenes* <SEQ ID 7585> which encodes the amino acid sequence <SEQ ID 7586>. Analysis of this protein sequence reveals the following:

```
Possible site: 48
>>> Seems to have no N-terminal signal sequence

----- Final Results -----
            bacterial cytoplasm --- Certainty = 0.3027(Affirmative) < succ>
             bacterial membrane --- Certainty = 0.0000(Not Clear)  < succ>
              bacterial outside --- Certainty = 0.0000(Not Clear)  < succ>
```

No corresponding DNA sequence was identified in *S. agalactiae*.

The protein has homology with the following sequences in the GENPEPT database:

```
>GP: CAA03927 GB: AJ000109 gluthatione peroxidase [Lactococcus lactis]
Identities = 79/133 (59%), Positives = 103/133 (77%)
Query:    1 VVLVVNTATKCGLTPQYQALQALYDTYHDKGFEVLDFPCNQFLNQAPGDAEEINHFCSLT    60
            VV+VVNTA+KCG TPQ++ L+ LY+TY D+G E+L FPCNQF NQ  G+  EIN FC L
Sbjct:   25 VVIVVNTASKCGFTPQFEGLEKLYETYKDQGLEILGFPCNQFANQDAGENTEINEFCQLN   84

Query:   61 YHTTFPRFAKIKVNGKDADPLFTWLKEEKSGPLGKRIEWNFTKFLIDQNGQVIKRYSSKT  120
            Y  TF  F KIKVNGK+A PL+ +LK+E  G L    I+WNFTKFLID++GQVI+R++ KT
Sbjct:   85 YGVTFTMFQKIKVNGKEAHPLYQFLKKEAKGALSGTIKWNFTKFLIDRDGQVIERFAPKT  144

Query:  121 DPKLIEEDLKALL                                                133
            +P+  +EE++K LL
Sbjct:  145 EPEEMEEEIKKLL                                                157
```

Based on this analysis, it was predicted that this GAS-specific protein and its epitopes, could be useful antigens for vaccines or diagnostics.

EXAMPLE 2544

A DNA sequence (GASx605) was identified in *S. pyogenes* <SEQ ID 7587> which encodes the amino acid sequence <SEQ ID 7588>. Analysis of this protein sequence reveals the following:

```
Possible site: 26
>>> Seems to have no N-terminal signal sequence

----- Final Results -----
            bacterial cytoplasm --- Certainty = 0.3687(Affirmative) < succ>
             bacterial membrane --- Certainty = 0.0000(Not Clear)  < succ>
              bacterial outside --- Certainty = 0.0000(Not Clear)  < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2545

A DNA sequence (GASx608R) was identified in *S. pyogenes* <SEQ ID 7589> which encodes the amino acid sequence <SEQ ID 7590>. Analysis of this protein sequence reveals the following:

```
Possible site: 17
>>> Seems to have no N-terminal signal sequence

----- Final Results -----
          bacterial cytoplasm --- Certainty = 0.1327(Affirmative) < succ>
          bacterial membrane  --- Certainty = 0.0000(Not Clear)   < succ>
          bacterial outside   --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2546

A DNA sequence (GASx616) was identified in *S. pyogenes* <SEQ ID 7591> which encodes the amino acid sequence <SEQ ID 7592>. Analysis of this protein sequence reveals the following:

```
Possible site: 21
>>> Seems to have no N-terminal signal sequence

----- Final Results -----
          bacterial membrane  --- Certainty = 0.0000(Not Clear) < succ>
          bacterial outside   --- Certainty = 0.0000(Not Clear) < succ>
          bacterial cytoplasm --- Certainty = 0.0000(Not Clear) < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2547

A DNA sequence (GASx617R) was identified in *S. pyogenes* <SEQ ID 7593> which encodes the amino acid sequence <SEQ ID 7594>. Analysis of this protein sequence reveals the following:

```
Possible site: 36
>>> Seems to have no N-terminal signal sequence

----- Final Results -----
          bacterial cytoplasm --- Certainty = 0.0677(Affirmative) < succ>
          bacterial membrane  --- Certainty = 0.0000(Not Clear)   < succ>
          bacterial outside   --- Certainty = 0.0000(Not Clear)   < succ>
```

No corresponding DNA sequence was identified in *S. aga-lactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2548

A DNA sequence (GASx622R) was identified in *S. pyogenes* <SEQ ID 7595> which encodes the amino acid sequence <SEQ ID 7596>. Analysis of this protein sequence reveals the following:

```
Possible site: 16
>>> Seems to have an uncleavable N-term signal seq
     INTEGRAL    Likelihood = -7.32    Transmembrane    4-20 (1-26)

----- Final Results -----
             bacterial membrane --- Certainty = 0.3930(Affirmative) < succ>
             bacterial outside  --- Certainty = 0.0000(Not Clear)   < succ>
             bacterial cytoplasm --- Certainty = 0.0000(Not Clear)   < succ>
```

No corresponding DNA sequence was identified in *S. aga-lactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2549

A DNA sequence (GASx632) was identified in *S. pyogenes* <SEQ ID 7597> which encodes the amino acid sequence <SEQ ID 7598>. Analysis of this protein sequence reveals the following:

```
Possible site: 31
>>> Seems to have no N-terminal signal sequence
     INTEGRAL    Likelihood = -3.40    Transmembrane     83-99  (82-102)
     INTEGRAL    Likelihood = -1.28    Transmembrane    108-124 (108-124)

----- Final Results -----
             bacterial membrane --- Certainty = 0.2359(Affirmative) < succ>
             bacterial outside  --- Certainty = 0.0000(Not Clear)   < succ>
             bacterial cytoplasm --- Certainty = 0.0000(Not Clear)   < succ>
```

No corresponding DNA sequence was identified in *S. aga-lactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2550

A DNA sequence (GASx638) was identified in *S. pyogenes* <SEQ ID 7599> which encodes the amino acid sequence <SEQ ID 7600>. Analysis of this protein sequence reveals the following:

```
Possible site: 25

>>> Seems to have an uncleavable N-term signal seq
     INTEGRAL    Likelihood = -0.64    Transmembrane 12 - 28   (12 - 28)

----- Final Results -----
             bacterial membrane --- Certainty = 0.1256(Affirmative) < succ>
             bacterial outside  --- Certainty = 0.0000(Not Clear)   < succ>
             bacterial cytoplasm --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2551

A DNA sequence (GASx652R) was identified in *S. pyogenes* <SEQ ID 7601> which encodes the amino acid sequence <SEQ ID 7602>. Analysis of this protein sequence reveals the following:

```
Possible site: 16

>>> Seems to have no N-terminal signal sequence

----- Final Results -----
              bacterial cytoplasm --- Certainty = 0.2622(Affirmative) < succ>
               bacterial membrane --- Certainty = 0.0000(Not Clear)   < succ>
                bacterial outside --- Certainty = 0.0000(Not Clear)   < succ>
```

No corresponding DNA sequence was identified in *S. agalactiae*.

The protein has homology with the following sequences in the GENPEPT database:

```
>GP:CAA74610 GB:Y14232 hypothetical protein [Bacteriophage TP901-1]
 Identities = 225/485 (46%), Positives = 308/485 (63%), Gaps = 20/485 (4%)

Query:    2 RKVAIYSRVSTINQAEEGYSIQGQIEALTKYCEAMEWKIYKNYSDAGFSGGKLERPAITE    61
            +KVAIY+RVST NQAEEG+SI  QI+ LTKY EAM W++    Y+DAGFSG KLERPA+
Sbjct:    3 KKVAIYTRVSTTNQAEEGFSIDEQIDRLTKYAEAMGWQVSDTYTDAGFSGAKLERPAMQR   62

Query:   62 LIEDGKNNKFDTILVYKLDRLSRNVKDTLYLVKDVFTANNIHFVSLKENIDTSSAMGNLF   121
            LI D +N  FDT+LVYKLDRLSR+V+DTLYLVKDVFT N I F+SL E+IDTSSAMG+LF
Sbjct:   63 LINDIENKAFDTVLVYKLDRLSRSVRDTLYLVKDVFTKNKIDFISLNESIDTSSAMGSLF   122

Query:  122 LTLLSAIAEFEREQIKERMQFGVMNRAKSGKTTAWKTPPYGYRYNKDEKTLSVNELEAAN   181
            LT+LSAI EFERE IKERM  G + RAKSGK+   W    +GY +N+    L +  L+A
Sbjct:  123 LTILSAINEFERENIKERMTMGRLGRAKSGKSMMWTKTAFGYYHNRKTGILEIVPLQATI   182

Query:  182 VRQMFDMIISGCSIMSITNYARDN-FVGN--TWTHVKVKRILENETYKGLVKYREQTFSG   238
            V Q+F  +SG S+  + +    ++  +G      W++    +++ L+N  Y G +K+++   F G
Sbjct:  183 VEQIFTDYLSGISLTKLRDKLNESGHIGKDIPWSYRTLRQTLDNPVYCGYIKFKDSLFEG   242

Query:  239 DHQAIIDEKTYNKAQIALAHRT----DTKTNTRPFQGKYMLSHIAKCGYCGAPLKVCTGR   294
             H+ II  +TY K Q  L  R       +  N RPFQ KYMLS +A+CGYCGAPLK+  G
Sbjct:  243 MHKPIIPYETYLKVQKELEERQQQTYERNNNPRPFQAKYMLSGMARCGYCGAPLKIVLGH   302

Query:  295 AKNDGTRRQTYVCVNKTESLARRSVNNYNNQKICNTGRYEKKHIEKYVIDVLYKLQHDKE   354
            + DG+R  Y C N+       + +  YN+ K C++G Y+   ++E  VID L  Q + +
Sbjct:  303 KRKDGSRTMKYHCANRFPR-KTKGITVYNDNKKCDSGTYDLSNLENTVIDNLIGFQENND   361

Query:  355 YLKKIKKDDN--IIDITPLKKEIEIIDKKINRLNDLYINDLIDLPKLKKDIEELNHLKDD   412
              L KI  +N  I+D +   KK+I   IDKKI + +DLY+ND I + +LK    + L       K
Sbjct:  362 SLLKIINGNNQPILDTSSFKKQISQIDKKIQKNSDLYLNDFITMDELKDRTDSLQAEK--   419

Query:  413 YNKAIKLNYLDKKNEDSLGML------MDNLDIRKSSYDVQSRIVKQLIDRVEVTNDNID   466
              K +K    +K   DS +         + ++ I + SYD + +IV  L+ +V+VT DN+D
Sbjct:  420 --KLLKAKISENKFNDSTDVFELVKTQLGSIPINELSYDNKKKIVNNLVSKVDVTADNVD   477

Query:  467 IIFKF   471
            IIFKF
Sbjct:  478 IIFKF   482
```

Based on this analysis, it was predicted that this GAS-specific protein and its epitopes, could be useful antigens for vaccines or diagnostics.

EXAMPLE 2552

A DNA sequence (GASx653R) was identified in *S. pyogenes* <SEQ ID 7603> which encodes the amino acid sequence <SEQ ID 7604>. Analysis of this protein sequence reveals the following:

```
Possible site: 48

>>> Seems to have no N-terminal signal sequence
   INTEGRAL    Likelihood = -1.22    Transmembrane 86 - 102   (86 - 102)

----- Final Results -----
              bacterial membrane --- Certainty = 0.1489(Affirmative) < succ>
                bacterial outside --- Certainty = 0.0000(Not Clear) < succ>
             bacterial cytoplasm --- Certainty = 0.0000(Not Clear) < succ>
```

No corresponding DNA sequence was identified in *S. agalactiae*.

The protein has homology with the following sequences in the GENPEPT database:

```
>GP:AAF12707 GB:AF066865 unknown [bacteriophage TPW22]
 Identities = 45/67 (67%), Positives = 53/67 (78%), Gaps = 2/67 (2%)

Query:   57 EKEAVRCPKCKSTNVGFMQQGKKTFSVKKAVAGTLLIG--GTVMGFLGEKGKKQWHCNEC  114
            +K A++CPKCKST+V FMQQGKK FSV KAV G +L G   GT+ GF G+KGKKQWHCN C
Sbjct:  138 DKHAIKCPKCKSTDVVFMQQGKKGFSVGKAVGGAVLTGGIGTLAGFAGKKGKKQWHCNNC  197

Query:  115 SCIFETK                                                      121
            +FETK
Sbjct:  198 GRVFETK                                                      204
```

Based on this analysis, it was predicted that this GAS-specific protein and its epitopes, could be useful antigens for vaccines or diagnostics.

EXAMPLE 2553

A DNA sequence (GASx655) was identified in *S. pyogenes* <SEQ ID 7605> which encodes the amino acid sequence <SEQ ID 7606>. Analysis of this protein sequence reveals the following:

```
Possible site: 50

>>> Seems to have no N-terminal signal sequence

----- Final Results -----
             bacterial cytoplasm --- Certainty = 0.3956(Affirmative) < succ>
              bacterial membrane --- Certainty = 0.0000(Not Clear) < succ>
                bacterial outside --- Certainty = 0.0000(Not Clear) < succ>
```

No corresponding DNA sequence was identified in *S. agalactiae*.

The protein has homology with the following sequences in the GENPEPT database:

```
>GP:CAB63661 GB:AJ251789 Cro protein [Lactobacilius casei
          bacteriophage A2]
 Identities = 43/76 (56%), Positives = 55/76 (71%)

Query:   26 MTINLKRLKAERIASGMTQCEVAQSMGWKTRTPYAKRENGIVSIGADELAKITLIFGLPI  85
            MT+NLKRL+AERIA GM Q E+A++MGW TR+ YAKRENGI +I A EL K+   I G
Sbjct:    1 MTLNLKRLRAERIAKGMNQDEMAKAMGWHTRSSYAKRENGITTISATELVKMASILGYGT  60

Query:   86 EKIAIFFDKDVPVMER                                             101
            ++ +FF  +VP  ER
Sbjct:   61 NQLDLFFTNNVPDRER                                             76
```

Based on this analysis, it was predicted that this GAS-specific protein and its epitopes, could be useful antigens for vaccines or diagnostics.

EXAMPLE 2554

A DNA sequence (GASx656) was identified in *S. pyogenes* <SEQ ID 7607> which encodes the amino acid sequence <SEQ ID 7608>. Analysis of this protein sequence reveals the following:

```
Possible site: 34
>>> Seems to have no N-terminal signal sequence

----- Final Results -----
           bacterial cytoplasm --- Certainty = 0.4505(Affirmative) < succ>
            bacterial membrane --- Certainty = 0.0000(Not Clear)   < succ>
             bacterial outside --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2555

A DNA sequence (GASx657) was identified in *S. pyogenes* <SEQ ID 7609> which encodes the amino acid sequence <SEQ ID 7610>. Analysis of this protein sequence reveals the following:

```
Possible site: 35
>>> Seems to have no N-terminal signal sequence

----- Final Results -----
           bacterial cytoplasm --- Certainty = 0.6593(Affirmative) < succ>
            bacterial membrane --- Certainty = 0.0000(Not Clear)   < succ>
             bacterial outside --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2556

A DNA sequence (GASx658) was identified in *S. pyogenes* <SEQ ID 7611> which encodes the amino acid sequence <SEQ ID 7612>. Analysis of this protein sequence reveals the following:

```
Possible site: 32
>>> Seems to have no N-terminal signal sequence

----- Final Results -----
           bacterial cytoplasm --- Certainty = 0.5244(Affirmative) < succ>
            bacterial membrane --- Certainty = 0.0000(Not Clear)   < succ>
             bacterial outside --- Certainty = 0.0000 (Not Clear)  < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2557

A DNA sequence (GASx660) was identified in *S. pyogenes* <SEQ ID 7613> which encodes the amino acid sequence <SEQ ID 7614>. Analysis of this protein sequence reveals the following:

```
Possible site: 58
>>> Seems to have no N-terminal signal sequence

----- Final Results -----
            bacterial cytoplasm --- Certainty = 0.1133(Affirmative) < succ>
            bacterial membrane  --- Certainty = 0.0000 (Not Clear)  < succ>
             bacterial outside  --- Certainty = 0.0000 (Not Clear)  < succ>
```

No corresponding DNA sequence was identified in *S. agalactiae*.

The protein has homology with the following sequences in the GENPEPT database:

```
>GP: AAB99331 GB: U67572 purine NTPase [Methanococcus jannaschii]
Identities = 71/346 (20%), Positives = 154/346 (43%), Gaps = 52/346 (15%)

Query:   8 MSITINKLEIENVK-----RIKAVKIEPSATGLTIIGGNNNQGKTSVLDAIAWAL--GGN   60
           MS+ + ++ + N K     RIK K      G+   I G N  GK+S+ +A+ +AL   G+
Sbjct:   1 MSMILKEIRMNNFKSHVNSRIKFEK------GIVAIIGENGSGKSSIFEAVFFALFGAGS   54

Query:  61 KYKPSQAMREGSQ---VPPTLKITMSNGLIVERKGKNASLKVIDPNGQ----------KG  107
             +    + +G +     V    ++ +N I+        + NG+            K
Sbjct:  55 NFNYDTIITKGKKSVYVELDFEVNGNNYKIIREYDSGRGGAKLYKNGKPYATTISAVNKA  114

Query: 108 GQQLL----DSFVEELAI---NLPKFMDSTPKEKADVLLEIIGVGDQLAELELKEKEIYN  160
            ++L    + F+  + I    + KF+   P EK + +++G+ D+    K  EI
Sbjct: 115 VNEILGVDRNMFLNSIYIKQGEIAKFLSLKPSEKLETVAKLLGI-DEFEKCYQKMGEIVK  173

Query: 161 QRHAIGVIADQKEKFAKEMTYYPDAPKQLVS-ISELIQQHQAILAKNGE-NAQKR--QNV  216
              +          + E+    E+  Y  +   K+L + +S+L ++++ ++   N + N   K+   +++
Sbjct: 174 E------YEKRLERIEGELNYKENYEKELKNKMSQLEEKNKKLMEINDKLNKIKKEFEDI  227

Query: 217 ERIRYDYNQSILEVDRLRKLLADAEAKTNKLSEDLKIANTD------AMDLHDESTAEIE  270
             E++  ++   L ++    L + +              +++LKI   D      A +  +     E E
Sbjct: 228 EKLFNEWENKKLLYEKFINKLEERKRALELKNQELKILEYDLNTVVEARETLNRHKDEYE  287

Query: 271 ANIADIDEVNRKVRANFDKDKAE-EDAKQQREQYNILTNDIESIRQ                315
              + +DE+ RK+ +   + K+  ED + +Q I+  DIE +++
Sbjct: 288 KYKSLVDEI-RKIESRLRELKSHYEDYLKLTKQLEIIKGDIEKLKE                332
```

Based on this analysis, it was predicted that this GAS-specific protein and its epitopes, could be useful antigens for vaccines or diagnostics.

EXAMPLE 2558

A DNA sequence (GASx661) was identified in *S. pyogenes* <SEQ ID 7615> which encodes the amino acid sequence <SEQ ID 7616>. Analysis of this protein sequence reveals the following:

```
Possible site: 28
>>> Seems to have no N-terminal signal sequence

----- Final Results -----
            bacterial cytoplasm --- Certainty = 0.1559(Affirmative) < succ>
            bacterial membrane  --- Certainty = 0.0000(Not Clear)   < succ>
             bacterial outside  --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2559

A DNA sequence (GASx662) was identified in *S. pyogenes* <SEQ ID 7617> which encodes the amino acid sequence <SEQ ID 7618>. Analysis of this protein sequence reveals the following:

```
Possible site: 52
>>> Seems to have no N-terminal signal sequence

----- Final Results -----
            bacterial cytoplasm --- Certainty = 0.3292(Affirmative) < succ>
            bacterial membrane  --- Certainty = 0.0000(Not Clear)   < succ>
            bacterial outside   --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2560

A DNA sequence (GASx663) was identified in *S. pyogenes* <SEQ ID 7619> which encodes the amino acid sequence <SEQ ID 7620>. Analysis of this protein sequence reveals the following:

```
Possible site: 15
>>> Seems to have no N-terminal signal sequence

----- Final Results -----
            bacterial cytoplasm --- Certainty = 0.4867(Affirmative) < succ>
            bacterial membrane  --- Certainty = 0.0000(Not Clear)   < succ>
            bacterial outside   --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2561

A DNA sequence (GASx664) was identified in *S. pyogenes* <SEQ ID 7621> which encodes the amino acid sequence <SEQ ID 7622>. Analysis of this protein sequence reveals the following:

```
Possible site: 46
>>> Seems to have no N-terminal signal sequence

----- Final Results -----
            bacterial cytoplasm --- Certainty = 0.2141(Affirmative) < succ>
            bacterial membrane  --- Certainty = 0.0000(Not Clear)   < succ>
            bacterial outside   --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2562

A DNA sequence (GASx667) was identified in *S. pyogenes* <SEQ ID 7623> which encodes the amino acid sequence <SEQ ID 7624>. Analysis of this protein sequence reveals the following:

```
Possible site: 59
>>> Seems to have no N-terminal signal sequence

----- Final Results -----
          bacterial cytoplasm --- Certainty = 0.2614(Affirmative) < succ>
          bacterial membrane  --- Certainty = 0.0000(Not Clear)   < succ>
          bacterial outside   --- Certainty = 0.0000(Not Clear)   < succ>
```

No corresponding DNA sequence was identified in *S. agalactiae*.

The protein has homology with the following sequences in the GENPEPT database:

```
>GP: AAF80834 GB: AF165214 Orf78 [Pseudomonas phage D3]
Identities = 68/200 (34%), Positives = 109/200 (54%), Gaps = 10/200 (5%)

Query:  12 GLRFGSLTVINRNRNNSKGGNARWNCLCDCGNKTVVI-GSKLRSGYTKSCGCARKNDNAK    70
           GLR G + V       ++  G  + W C CDCGN+ ++   G+ +R+  T SCGC+R +
Sbjct:   8 GLRVGKVVV--EAFSHCAGKASHWVCRCDCGNRVIMRRGNLMRNRTTTSCGCSRFSH---   62

Query:  71 GYSSTRLYRIWKGMMNRCYNHKNDNYKYYGGKGISICDEWLTFINFRTWSLSNGYKESLT   130
           G + T Y   W  M++RC N   N  Y  Y G+GI++C+ W+TF NF       G +  T
Sbjct:  63 GMTGTPTYSSWSNMIDRCTNPSNKRYVDYQGRGITVCERWMTFANFLA---DMGERPDAT   119

Query: 131 -IDRINPKGNYTPLNCRWVSMKMQQNNKTNNRYLSYLGQEYTIAEFSEKLNVTYWTVINQ   189
            +DRI+   Y      NCRW +    Q NN   N ++ YLG+  T+++++ +L +   T+ ++
Sbjct: 120 SLDRIDNDAGYFKENCRWATALEQMNNTRRNTFVEYLGRRQTVSQWAGQLGIPECTLRSR   179

Query: 190 LKLGWSVERIVEEARMKNDR                                          209
           L  GWS+E +++    K  R
Sbjct: 180 LNRGWSIEDAMQKPISKQRR                                          199
```

Based on this analysis, it was predicted that this GAS-specific protein and its epitopes, could be useful antigens for vaccines or diagnostics.

EXAMPLE 2563

A DNA sequence (GASx668) was identified in *S. pyogenes* <SEQ ID 7625> which encodes the amino acid sequence <SEQ ID 7626>. Analysis of this protein sequence reveals the following:

```
Possible site: 41
>>> Seems to have no N-terminal signal sequence

----- Final Results -----
          bacterial cytoplasm --- Certainty = 0.1476(Affirmative) < succ>
          bacterial membrane  --- Certainty = 0.0000(Not Clear)   < succ>
          bacterial outside   --- Certainty = 0.0000(Not Clear)   < succ>
```

No corresponding DNA sequence was identified in *S. agalactiae*.

The protein has homology with the following sequences in the GENPEPT database:

```
>GP: CAB75598 GB: AJ271879 putative DNA helicase [uncultured
eubacterium]
Identities = 42/168 (25%), Positives = 75/168 (44%), Gaps = 7/168 (4%)

Query: 374 IAGPSKAGKSFALIELSIALAEGQKWLG-WQCEQGKVLYVNLELDRPSALHRFKDVYDAM   432
```

```
                + P  AGKS   ++L+  +A G     LG  +    G V+Y+   E D P+A+H       A
Sbjct:  35 LVSPGGAGKSMLALQLAAQIAGGPDLLGVGELPTGPVIYLPAE-DPPTAIHHRLHALGAH    93

Query: 433 GLPPANVANIDIWNLRGKTVPMDKLAPKLIRRSLKKNYQA---VIIDPIYKVLTGDENSA   489
              A   D   ++    +  +        +LK+   +   +I+D + +    +EN++
Sbjct:  94 LSAEERQAVADGLLIQPLIGSLPNIMASNWFEALKRAAEGRRLMILDTLRRFHIEEENAS   153

Query: 490 DQMAHFTNQFDKVATELGCSVIYCHHHSKGS--QGGKKSMDRASGSGV               535
              MA   +  + +A + GCS+++ HH SKG+   G          + GS V
Sbjct: 154 GPMAQVIGRMEAIAADTGCSIVFLHHASKGATMMGAGDQQQASRGSSV               201
```

Based on this analysis, it was predicted that this GAS-specific protein and its epitopes, could be useful antigens for vaccines or diagnostics.

EXAMPLE 2564

A DNA sequence (GASx669) was identified in *S. pyogenes* <SEQ ID 7627> which encodes the amino acid sequence <SEQ ID 7628>. Analysis of this protein sequence reveals the following:

```
Possible site: 56
>>> Seems to have no N-terminal signal sequence

----- Final Results -----
            bacterial cytoplasm --- Certainty = 0.2555(Affirmative) < succ>
            bacterial membrane  --- Certainty = 0.0000(Not Clear)   < succ>
             bacterial outside  --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2565

A DNA sequence (GASx670) was identified in *S. pyogenes* <SEQ ID 7629> which encodes the amino acid sequence <SEQ ID 7630>. Analysis of this protein sequence reveals the following:

```
Possible Site: 54
>>> Seems to have no N-terminal signal sequence

----- Final Results -----
            bacterial cytoplasm --- Certainty = 0.2921(Affirmative) < succ>
            bacterial membrane  --- Certainty = 0.0000(Not Clear)   < succ>
             bacterial outside  --- Certainty = 0.0000(Not Clear)   < succ>
```

No corresponding DNA sequence was identified in *S. agalactiae*.

The protein has homology with the following sequences in the GENPEPT database:

```
>GP: AAF74082 GB: AF212845 ORF129 [Lactococcus lactis bacteriophage
u136]
Identities = 36/108 (33%), Positives = 63/108 (58%), Gaps = 1/108 (0%)

Query:   8 IEFFLPMDKIPTTTHQQKKVTVINGKPHFYEPESLKNARDKFTSLLAQHVPPSKLDGPIR    67
           ++F   +DK+PTT QQK +  GK  FY+    KN    K      +  + + P++
Sbjct:   1 MKFEFELDKMPTT-QQQKGIKKVKGKLQFYDRRGTKNYSLKAQLMKNKPKECWEKNVPLK    59

Query:  68 LTVKWLFPKIKGSTNGQYKTTKPDTDNLQKLLKDCMTELGFWNDDAQV               115
           L+V + +    +      Q+KT++PD DNL K L+D MT+L +++DD+Q+
Sbjct:  60 LSVTFFFYAIKQKKRWWQWKTSRPDLDNLMKNLQDYMTKLRYYSDDSQI              107
```

Based on this analysis, it was predicted that this GAS-specific protein and its epitopes, could be useful antigens for vaccines or diagnostics.

EXAMPLE 2566

A DNA sequence (GASx671) was identified in *S. pyogenes* <SEQ ID 7631> which encodes the amino acid sequence <SEQ ID 7632>. Analysis of this protein sequence reveals the following:

```
Possible site: 33
>>> Seems to have no N-terminal signal sequence

----- Final Results -----
            bacterial cytoplasm --- Certainty = 0.4294(Affirmative) < succ>
            bacterial membrane  --- Certainty = 0.0000(Not Clear)   < succ>
             bacterial outside  --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2567

A DNA sequence (GASx672R) was identified in *S. pyogenes* <SEQ ID 7633> which encodes the amino acid sequence <SEQ ID 7634>. Analysis of this protein sequence reveals the following:

```
Possible site: 15
>>> Seems to have a cleavable N-term signal seq.
    INTEGRAL    Likelihood = -6.37    Transmembrane    106-122 (104-125)

----- Final Results -----
             bacterial membrane  --- Certainty = 0.3548(Affirmative) < succ>
              bacterial outside  --- Certainty = 0.0000(Not Clear)   < succ>
            bacterial cytoplasm  --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2568

A DNA sequence (GASx673) was identified in *S. pyogenes* <SEQ ID 7635> which encodes the amino acid sequence <SEQ ID 7636>. Analysis of this protein sequence reveals the following:

```
Possible site: 56
>>> Seems to have no N-terminal signal sequence

----- Final Results -----
            bacterial cytoplasm --- Certainty = 0.4781(Affirmative) < succ>
            bacterial membrane  --- Certainty = 0.0000(Not Clear)   < succ>
             bacterial outside  --- Certainty = 0.0000(Not Clear)   < succ>
```

No corresponding DNA sequence was identified in *S. agalactiae*.

The protein has homology with the following sequences in the GENPEPT database:

```
>GP: AAB18697 GB: U38906 ORF22 [Bacteriophage rlt]
    Identities = 78/207 (37%), Positives = 123/207 (58%), Gaps = 2/207 (0%)
```

```
                            -continued
Query:   28 EIHRILGIDEVYKAPKRLTDILFDKDSREDIFRQFLKYETDVSYDWFMQYFEEEQADRKN   87
            + + +L +DE     R+ +++FDK RE+ + + L    D+   D+F  YF    A
Sbjct:    7 QFYDMLNVDEHMNFTNRIQELVFDKKGREEFYSKILNIHHDMGVDFFRDYFMAHSAVSA-   65

Query:   88 KKQDFTPKSVSTLLSKIISGNQYYEVA-VGTGGILIQAWQEQRLNDSPFTYRPSKYWYHV  146
            K Q +TP  +  L + ++ G+   ++    GTG ++IQ WQ+ R+N   F Y PS YWY
Sbjct:   66 KGGQHYTPDELGKLTALLVGGSGGADLTGAGTGTLIIQKWQDDRMNTDFFNYLPSNYWYQA 125

Query:  147 EELSDKAVPFLLFNMSIRGINGVVVHGDSLTRQVKNIYFLQNTKDDMLSFSDINVMPRTQ  206
               ELSD+A+ FL+    +IRG+NGVV+HGD+L    VK +YF+QN+ ++ + FS+INV+P ++
Sbjct:  126 LELSDEAISFLIHAFAIRGMNGVVIHGDALEMAVKQVYFIQNSANNPIGFSEINVIPHSK 185

Query:  207 DIEREFNVKEWIGDGIEHIENPLIEWI                                  233
            D    + EW    IEHIE+   +WI
Sbjct:  186 DAMEFLGIHEWTEQAIEHIESKFPDWI                                  212
```

Based on this analysis, it was predicted that this GAS-specific protein and its epitopes, could be useful antigens for vaccines or diagnostics.

EXAMPLE 2569

A DNA sequence (GASx674) was identified in *S. pyogenes* <SEQ ID 7637> which encodes the amino acid sequence <SEQ ID 7638>. Analysis of this protein sequence reveals the following:

```
Possible site: 51
>>> Seems to have no N-terminal signal sequence
     INTEGRAL     Likelihood = -0.00    Transmembrane    122-138 (122-138)

----- Final Results -----
               bacterial membrane --- Certainty = 0.1001(Affirmative) < succ>
                bacterial outside --- Certainty = 0.0000(Not Clear) < succ>
              bacterial cytoplasm --- Certainty = 0.0000(Not Clear) < succ>
```

No corresponding DNA sequence was identified in *S. agalactiae*.

The protein has homology with the following sequences in the GENPEPT database:

```
>GP: AAF63071 GB: AF158600 gp137 [Streptococcus thermophilus
bacteriophage Sfi11]
Identities = 66/135 (48%), Positives = 89/135 (65%), Gaps = 2/135 (1%)

Query:   5 PEIDIQKTKSNAKRKLREYPRWRRIANDVDTQKVTATYSFEPRQSHGVPSKPVERLALNR   64
           PEID + T     KRKLREYPRWR IA+D    QK+T  ++F PR    G  +KPVE +A+ R
Sbjct:   4 PEIDEKATLKRCKRKLREYPRWREIAHDSAEQKITQEFTFMPRG--GGVNKPVENIAVRR   61

Query:  65 VSAEQELDAIEQAVSMILEPERRRILYDKYLAPYKKADKVIYTELCMSESFYYDTLDIAL  124
           V A  EL+AIEQAV+ +   P+ RRIL +KYLA    K +  I   +    + + + L+ ++
Sbjct:  62 VDALNELEAIEQAVNGLYRPDYRRILIEKYLAYPPKPNWQIAQSIGFERTAFQELLNNSI  121

Query: 125 LAFAELYREGVLLVE                                              139
           LAFAELYR+G L+VE
Sbjct: 122 LAFAELYRDGRLIVE                                              136
```

Based on this analysis, it was predicted that this GAS-specific protein and its epitopes, could be useful antigens for vaccines or diagnostics.

EXAMPLE 2570

A DNA sequence (GASx675) was identified in *S. pyogenes* <SEQ ID 7639> which encodes the amino acid sequence <SEQ ID 7640>. Analysis of this protein sequence reveals the following:

```
Possible site: 41
>>> Seems to have no N-terminal signal sequence
```

```
----- Final Results -----
         bacterial cytoplasm --- Certainty = 0.1865(Affirmative) < succ>
         bacterial membrane  --- Certainty = 0.0000(Not Clear)   < succ>
         bacterial outside   --- Certainty = 0.0000(Not Clear)   < succ>
```

No corresponding DNA sequence was identified in S. agalactiae.

The protein has no significant homology with any sequences in the GENPEPT database.

Based on this analysis, it was predicted that this GAS-specific protein and its epitopes, could be useful antigens for vaccines or diagnostics.

EXAMPLE 2571

A DNA sequence (GASx676) was identified in S. pyogenes <SEQ ID 7641> which encodes the amino acid sequence <SEQ ID 7642>. Analysis of this protein sequence reveals the following:

```
Possible site: 31

>>> Seems to have no N-terminal signal sequence

----- Final Results -----
         bacterial cytoplasm --- Certainty = 0.4870(Affirmative) < succ>
         bacterial membrane  --- Certainty = 0.0000(Not Clear)   < succ>
         bacterial outside   --- Certainty = 0.0000(Not Clear)   < succ>
```

No corresponding DNA sequence was identified in S. agalactiae.

The protein has homology with the following sequences in the GENPEPT database:

```
>GP:BAB07254 GB:AP001519 unknown [Bacillus halodurans]
 Identities = 194/451 (43%), Positives = 262/451 (58%), Gaps = 69/451 (15%)

Query:   1 MEFVDKKLSEITPYKNNPRNNDEAVGPVAE----SIKEFGFKVPIVV-DKNGEIVNGHTR   55
           +   V+KK+ ++ P + NPR + +    P E      SI+EFG   PIV  ++ G +V GH R
Sbjct:   3 IRIVNKKIDDLVPAEYNPRLDLQPGDPEYEKLKRSIEEFGLVEPIVFNERTGRVVGGHQR   62

Query:  56 YKAAQKLGLETVPVIVADDLSEEQIKAFRLADNKV-GEIAVWDLDLLNEELNDILDLDMS   114
           K  ++LG E VPV V D L +    KA  +A NK+ G+    + L  L EEL+  L+D++
Sbjct:  63 LKILRELGWEEVPVSVVD-LDDHHEKALNVALNKIEGDWDNFKLKELLEELDSGL-IDVT   120

Query: 115 AFGFDVLDNLDDL-----IEDEKDL--DDF----TGTVPDEPKSKLGDIYQLGSHKLMCG   163
             GFD  + ++DL      +EDE ++  DDF         +EP +K GD++ LG H L+ G
Sbjct: 121 LTGFDE-EEIEDLMTQFFVEDENEIKEDDFDPDEVAEEIEEPITKPGDLWHLGRHFLLVG   179

Query: 164 DSTNGADVKKLMNGELADLLLTDPPYNVAYEGKTKDSLTIKNDSMDNDSFRQFLVNAFSS   223
           DST    DVK+LM  E AD++ TDPPYNV YEG T   + IKND+M++   F QFL +AF +
Sbjct: 180 DSTKIEDVKRLMGNEKADMIFTDPPYNVDYEGAT--GMKIKNDNMEDSEFYQFLFDAFVA   237

Query: 224 ANEVMKPGAVFYIWHADSEGYNFRGACFDIGWTVRQCLIWNKNSMVLGRQDYHWKHEPCL   283
            +V K G    Y+ HADSEG  FR A   D G+  ++QCLIW KNS+VLGRQDYHW+HEP L
Sbjct: 238 MYQVTKEGGPIYVCHADSEGLTFRKAFQDSGFLLKQCLIWVKNSLVLGRQDYHWRHEPIL   297

Query: 284 YGWKDGAGHLWASDRKQTSVID-------------------------------------   305
           YGWK  GA H W   RKQ++VI+
Sbjct: 298 YGWKPGAAHKWYGGRKQSTVIEDPVDLAITPKVDHVLLTFNNGISSTVVKVPSYEIIHDG   357

Query: 306 ---------YEKPQRNGVHPTMKPVGLFDYQIKNNTKGSDIVLDLFGGSGTTLIACESNG   356
                    E+P+RN  HPTMKP+ L    I+N++K  + VLD FGGSG+TLIACE  G
Sbjct: 358 SDEGMTTWRIERPKRNADHPTMKPIALCARAIQNSSKPGERVLDPFGGSGSTLIACEQTG   417

Query: 357 RHARLMEYDPKYVDVIIKRWEELTGESVIQL                              387
           R    +MEYDP Y +VII+ RWEE TG++ ++L
Sbjct: 418 RICHMMEYDPVYAEVIIRRWEEWTGQNAVKL                              448
```

Based on this analysis, it was predicted that this GAS-specific protein and its epitopes, could be useful antigens for vaccines or diagnostics.

EXAMPLE 2572

A DNA sequence (GASx677) was identified in S. pyogenes <SEQ ID 7643> which encodes the amino acid sequence <SEQ ID 7644>. Analysis of this protein sequence reveals the following:

```
Possible site: 54

>>> Seems to have no N-terminal signal sequence

----- Final Results -----
            bacterial cytoplasm --- Certainty = 0.4744(Affirmative) < succ>
            bacterial membrane  --- Certainty = 0.0000(Not Clear)   < succ>
             bacterial outside  --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2573

A DNA sequence (GASx678) was identified in *S. pyogenes* <SEQ ID 7645> which encodes the amino acid sequence <SEQ ID 7646>. Analysis of this protein sequence reveals the following:

```
Possible site: 31

>>> Seems to have no N-terminal signal sequence
    INTEGRAL   Likelihood = -0.27   Transmembrane 90 - 106  (90 - 106)

----- Final Results -----
            bacterial membrane  --- Certainty = 0.1107(Affirmative) < succ>
             bacterial outside  --- Certainty = 0.0000(Not Clear)   < succ>
            bacterial cytoplasm --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2574

A DNA sequence (GASx679) was identified in *S. pyogenes* <SEQ ID 7647> which encodes the amino acid sequence <SEQ ID 7648>. Analysis of this protein sequence reveals the following:

```
Possible site: 19

>>> Seems to have no N-terminal signal sequence

----- Final Results -----
            bacterial cytoplasm --- Certainty = 0.3408(Affirmative) < succ>
            bacterial membrane  --- Certainty = 0.0000(Not Clear)   < succ>
             bacterial outside  --- Certainty = 0.0000(Not Clear)   < succ>
```

No corresponding DNA sequence was identified in *S. agalactiae*.

The protein has homology with the following sequences in the GENPEPT database:

```
>GP:CAA66734 GB:X98106 minor capsid protein [Bacteriophage phigle]
  Identities = 213/494 (43%), Positives = 323/494 (65%), Gaps = 19/494 (3%)

Query:    1 MGVIQKIKNLVTRSKYVM-TTQSLTNITDHPKIAISKLEYDRITTNLKYYKSDWDSVLYL    59
                MG+IQ+IK+L +         T SL+ ITD P+I+I    EY RI T+L YY      + Y
    Sbjct:    1 MGLIQRIKDLFWKGAAATGVTGSLSKITDDPRISIDPDEYVRIQTDLDYYSDKLQYIHYQ    60

Query:   60 NTDGETKKRDLNHLPIARTAAKKIASLVFNEQAEIKV-DDDAANEFISETLKNDRFNKNF   118
                 +DG  KKR  N + +A+TAA++IAS+VFNE+AEI V D++ A++F++ L+++ F    F
    Sbjct:   61 ASDGIKKKRLKNTINMAKTAARRIASVVFNEKAEIHVKDNNEADKFLNDVLEDNDFKNKF   120

Query:  119 ERYLESCLALGGLAMRPYVDGDKVRVAFVQAPVFLPLQSNTQDVSSAAVVIKSVKTINGK   178
                E   LE  +ALGG AMRPY+DG+ +++A+V+A  F  PLQSNT D+S AA+  ++ +T + +
```

-continued

```
Sbjct:  121  EEALEKGVALGGFAMRPYIDGNHIKIAWVRADQFYPLQSNTNDISEAAIASRTQRTESNQ  180

Query:  179  EVYYTLIEFHEWQSSDDYVISNELYRSDDKAKVGSRVPLS--EVYKDLKDEAKVTDVTRP  236
             YYTL+EFH+WQ +  Y I+NELY+SD    VG++VPLS   VYK+L +  ++ + RP
Sbjct:  181  TKYYTLLEFHQWQDNGSYQITNELYKSDSPDIVGNQVPLSTLPVYKELAPQVTISGLQRP  240

Query:  237  IFTYLKTPGMNNKDINSPLGLSIFDNAKTTIDFINTTYDEFMWEVKMGQRRVAVPESLTA  296
             +F Y KTPG NN +I SPLGL + DNAK  +D IN T+D+F+WE+++GQ+ +AV   +
Sbjct:  241  LFAYFKTPGANNINIESPLGLGVVDNAKHVLDDINDTHDQFIWEIRLGQKHIAVQPGMLR  300

Query:  297  LTVRTADGDVVPRPRFESDQNVYIRMGGRDLDSSAIQDLTTPIRADDYIKAINEGLSLFE  356
                         D   +P F+++QNVY+ +    D +   ++D+TTPIR   Y  AI+  +  FE
Sbjt:   301  F-------DDEHKPTFDTEQNVYVGVLSDDNNGLGVKDMTTPIRTVQYKDAIDHFIKEFE  353

Query:  357  MQIGVSAGLFSFDGKSMKTATEIVSENSDTYQMRNSIVTLVEQSLKELVISIFEIAKAYD  416
             +QIG+S G FS+    +KTATE+VS NS TYQ R+S +T+VE+++ EL  SIFE+A  A
Sbjct:  354  VQIGLSTGTFSYNDGVKTATEVVSNNSMTYQTRSSYLTMVEKAIDELCQSIFELANAGA  413

Query:  417  LYQSEVP--SMDNISISL------DDGVFTDRDAELDYWIKVVNAGFGTREMAIQKVLNV  468
             L+    P  ++D+ S  L         DDGVF ++D +L+    KV+  G  +++  +Q+     +
Sbjct:  414  LFDDGKPLFTLDSASQPLDIECHFDDGVFVNKDKQLEEDAKVLAIGALSKQTFLQRNYGM  473

Query:  469  TEEKAQEIAAEINT  482
             T+E+A  E   A+I +
Sbjct:  474  TDEQAAEELAKIQS  487
```

Based on this analysis, it was predicted that this GAS-specific protein and its epitopes, could be useful antigens for vaccines or diagnostics.

EXAMPLE 2575

A DNA sequence (GASx680) was identified in *S. pyogenes* <SEQ ID 7649> which encodes the amino acid sequence <SEQ ID 7650>. Analysis of this protein sequence reveals the following:

```
Possible site: 48

>>> Seems to have no N-terminal signal sequence

----- Final Results -----
              bacterial cytoplasm --- Certainty = 0.1840(Affirmative) < succ>
               bacterial membrane --- Certainty = 0.0000(Not Clear) < succ>
                bacterial outside --- Certainty = 0.0000(Not Clear) < succ>
```

No corresponding DNA sequence was identified in *S. agalactiae.*

The protein has homology with the following sequences in the GENPEPT database:

```
>GP:CAB53790 GB:AJ242593 gp4 [Bacteriophage A118]
 Identities = 114/385 (29%), Positives = 187/385 (47%), Gaps = 23/385 (5%)

Query:   8 LNDEQLLLEASQLSDMYHQLTLDLFDQVIERIKARGSASLADNPYLWQANKLHDVGLLNA  67
           L   QL L     + D+Y  L  +LF  ++ R+K + + S AND   WQ  KL+ V  L+
Sbjct:   3 LTPRQLDLFVQPIVDVYTGLENELFTLIVRRLKTKKNIS-ADNVLAWQIEKLNQVHALDQ  61

Query:  68 DNIKLIAKYSGIAEAQLRYIIKNEGFKIYKNTSEQLEEALGRESGV-------NSTIQDD 120
             I+ I+K SG++  +L  ++K+ G+   K        +    E+G          TI D
Sbjct:  62 QMIERISKASGVSAKKLFSVVKDAGYSDLKQVDNYFSKLA--EAGAVLPLVSDGQTIVDK 119

Query: 121 LSNYARQAIDDVHNLTNTTLPFSVIGAYQGIIQDAVAGVVTGLKTPDQAINQTVIKWFKK 180
           +     +  +  +   N T+         Y  II +     V+ GLKT  QA+ +TV K+ +
Sbjct: 120 VMRSYFKLAESNYKRINQTMLSQARQIYSDIIHETTQSVLAGLKTHRQALAETVTKFAEN 179

Query: 181 GFYGFTDKAGRKWRADSYARTVINTTTWRVFNEAKEAPAREFGIDTFYYSKKATAREMCA 240
           G      DKA ++W   ++Y RTV   TT    V+N  ++     E+G+D     S+    AR  C+
Sbjct: 180 GVPALVDKANKRWTPEAYVRTVTRTTVNSVYNSVEDERMNEYGVDLVRISQHVGARPTCS 239

Query: 241 PLQHQIV---TTGEAREEGGIKILALSD----YGHGEPDGCLGINCKHTKTPFVVGVNSK 293
            +Q +++    +  E R + G K +++       YG+G  DG  G NC+H +  F+ G+N
Sbjct: 240 IVQGKVICLLSVEETRSKYGNKYMSIYSPELRYGYG--DGIFGCNCRHHRFAFIEGINIA 297
```

```
                             -continued
Query:  294 PELPEHLKNITPAQAKANANAQAKQRAIERSIRKSKELLHVAKQLGDKELIRQYQSDVRS  353
                P+  E     I    + K        +QR +ER IR +K  L  A++LGD+  +++ +  VR+
Sbjct:  298 PDESE---LIDEEENKRVYALSQQQRLMERDIRAAKRKLSAAEELGDELAVKKAKQAVRT  354

Query:  354 KQDALNYLINNNAFLHRNQAREKRY                                    378
                KQ  L   +  +  L R  +REK Y
Sbjct:  355 KQSKLRAFVKTHN-LTRQYSREKVY                                    378
```

Based on this analysis, it was predicted that this GAS-specific protein and its epitopes, could be useful antigens for vaccines or diagnostics.

EXAMPLE 2576

A DNA sequence (GASx681) was identified in *S. pyogenes* <SEQ ID 7651> which encodes the amino acid sequence <SEQ ID 7652>. Analysis of this protein sequence reveals the following:

```
Possible site: 31

>>> Seems to have no N-terminal signal sequence

----- Final Results -----
            bacterial cytoplasm --- Certainty = 0.2756(Affirmative) < succ>
            bacterial membrane  --- Certainty = 0.0000(Not Clear)   < succ>
             bacterial outside  --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2577

A DNA sequence (GASx682) was identified in *S. pyogenes* <SEQ ID 7653> which encodes the amino acid sequence <SEQ ID 7654>:

```
            TLDNQSVIKAIGDTVDYIKKNYKRKWGK
```

Analysis of this protein sequence reveals the following:

```
Possible site: 25

>>> Seems to have a cleavable N-term signal seq.

----- Final Results -----
             bacterial outside  --- Certainty = 0.3000(Affirmative) < succ>
            bacterial membrane  --- Certainty = 0.0000(Not Clear)   < succ>
            bacterial cytoplasm --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2578

A DNA sequence (GASx683) was identified in *S. pyogenes* <SEQ ID 7655> which encodes the amino acid sequence <SEQ ID 7656>. Analysis of this protein sequence reveals the following:

```
Possible site: 60

>>> Seems to have no N-terminal signal sequence

----- Final Results -----
            bacterial cytoplasm --- Certainty = 0.5288(Affirmative) < succ>
            bacterial membrane  --- Certainty = 0.0000(Not Clear)   < succ>
             bacterial outside  --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2579

A DNA sequence (GASx685) was identified in *S. pyogenes* <SEQ ID 7657> which encodes the amino acid sequence <SEQ ID 7658>:

```
GATEVGANRVVSGVYGEVLGVQIVRSRKCPKGTAYMVRKGALRIMLKRNT

MVETDRDITKAINQIVANKHYGVYLYKAEKAVKITLRDAAKK
```

Analysis of this protein sequence reveals the following:

```
Possible site: 18

>>> Seems to have no N-terminal signal sequence

----- Final Results -----
            bacterial cytoplasm --- Certainty = 0.1750(Affirmative) < succ>
            bacterial membrane  --- Certainty = 0.0000(Not Clear)   < succ>
             bacterial outside  --- Certainty = 0.0000(Not Clear)   < succ>
```

No corresponding DNA sequence was identified in *S. agalactiae*.

The protein has homology with the following sequences in the GENPEPT database:

```
>GP:CAA59185 GB:X84706 major head protein [Bacteriophage B1]
 Identities = 138/270 (51%), Positives = 186/270 (68%), Gaps = 6/270 (2%)

Query:   1 MAVGTTKMAQMLDPEVLADMIDAEVGKAIRFAPLAEVDTTLEGQPGTTLTVPK-WDYIGD    59
                   M+    T +A +++PEVLA ++   E+ KA+RFAPLA+VDTTL+GQPG TL  P  + YIGD
        Sbjct:   1 MSKQKTTLADLVNPEVLATIVSYELNKALRFAPLAQVDTTLQGQPGNTLKFPDPFTYIGD    60

Query:  60 AEDVAEGEAIPMTQLGFKKTTMTIKKAGKGVEITDEAILSGYGDPVGQAAKQIVEAIDHK   119
                   A DVAEG  I + ++G    ++TIKKA KG EITDEA LSGYGDP+G++ KQ+  ++ +K
        Sbjct:  61 AADVAEGGEISLDKIGTTTKSVTIKKAAKGTEITDEAALSGYGDPIGESNKQLGLSLANK   120

Query: 120 VDADVLDALSKSTQTVEATATVDGVSKALDIFNDEDDAETVIVMNPADASTLRLDAAKEW   179
                   VD D+L A   ++QTV   A VDGV  ALDIFNDED    V+++NP DA+ +R DA  +
        Sbjct: 121 VDDDLLSAAKTTSQTVSTKANVDGVQAALDIFNDEDAQAYVLIVNPKDAAKIRKDANAKN   180

Query: 180 LGATEVGANRVVSGVYGEVLGVQIVRSRKCPKGTAYMVR----KGALRIMLKRNTMVETD   235
                   +G +EVGAN +++G Y +VLG QIVRS+K  +G+A M +      AL+++LKR   VETD
        Sbjct: 181 IG-SEVGANALINGTYADVLGAQIVRSKKLAEGSALMFKIVSNSPALKLVLKRGVQVETD   239

Query: 236 RDITKAINQIVANKHYGVYLYKAEKAVKIT                               265
                   RDI    I A++HY  YLY  K V IT
        Sbjct: 240 RDIVTKTTVITADEHYAAYLYDLTKVVNIT                               269
```

Based on this analysis, it was predicted that this GAS-specific protein and its epitopes, could be useful antigens for vaccines or diagnostics.

EXAMPLE 2580

A DNA sequence (GASx686) was identified in *S. pyogenes* <SEQ ID 7659> which encodes the amino acid sequence <SEQ ID 7660>. Analysis of this protein sequence reveals the following:

```
Possible site: 35

>>> Seems to have an uncleavable N-term signal seq

----- Final Results -----
          bacterial membrane --- Certainty = 0.0000(Not Clear) < succ>
           bacterial outside --- Certainty = 0.0000(Not Clear) < succ>
         bacterial cytoplasm --- Certainty = 0.0000(Not Clear) < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2581

A DNA sequence (GASx687) was identified in *S. pyogenes* <SEQ ID 7661> which encodes the amino acid sequence <SEQ ID 7662>. Analysis of this protein sequence reveals the following:

```
Possible site: 54

>>> Seems to have no N-terminal signal sequence

----- Final Results -----
         bacterial cytoplasm --- Certainty = 0.2942(Affirmative) < succ>
          bacterial membrane --- Certainty = 0.0000(Not Clear) < succ>
           bacterial outside --- Certainty = 0.0000(Not Clear) < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2582

A DNA sequence (GASx688) was identified in *S. pyogenes* <SEQ ID 7663> which encodes the amino acid sequence <SEQ ID 7664>. Analysis of this protein sequence reveals the following:

```
Possible site: 21

>>> Seems to have no N-terminal signal sequence

----- Final Results -----
         bacterial cytoplasm --- Certainty = 0.2844(Affirmative) < succ>
          bacterial membrane --- Certainty = 0.0000(Not Clear) < succ>
           bacterial outside --- Certainty = 0.0000(Not Clear) < succ>
```

No corresponding DNA sequence was identified in *S. agalactiae*.

The protein has homology with the following sequences in the GENPEPT database:

```
>GP:AAC00538 GB:L02496 unknown protein [Bacteriophage LL-H]
 Identities = 35/86 (40%), Positives = 48/86 (55%), Gaps = 6/86 (6%)

Query: 24 KLIMNNQVMMSMNPYVPYRDGALRGSSRANSVGVTWSGPHARAQFYGGAYNKYKSFKFKK   83
          +L + NQ+    M  YVP R G LR  S  N   G+ ++  +ARAQFYG           + +
```

-continued
```
Sbjct:  20 RLQVLNQMHQDMEQYVPKRAGFLRSQSFVNDTGIHYTAKYARAQFYGFV----NGHRVRN    75

Query:  84 YTTPGTGKRWDKRALANATIVKDWEK                                    109
           Y+TPGTG+RWD +  A A    DW+K
Sbjct:  76 YSTPGTGRRWDLK--AKAVYKADWQK                                     99
```

Based on this analysis, it was predicted that this GAS-specific protein and its epitopes, could be useful antigens for vaccines or diagnostics.

EXAMPLE 2583

A DNA sequence (GASx689) was identified in *S. pyogenes* <SEQ ID 7665> which encodes the amino acid sequence <SEQ ID 7666>. Analysis of this protein sequence reveals the following:

```
Possible site: 45

>>> Seems to have no N-terminal signal sequence

----- Final Results -----
            bacterial cytoplasm --- Certainty = 0.2892(Affirmative) < succ>
             bacterial membrane --- Certainty = 0.0000(Not Clear)   < succ>
              bacterial outside --- Certainty = 0.0000(Not Clear)   < succ>
```

No corresponding DNA sequence was identified in *S. agalactiae*.

The protein has homology with the following sequences in the GENPEPT database:

```
>GP:CAA66741 GB:X98106 minor capsid protein [Bacteriophage phigle]
 Identities = 36/109 (33%), Positives = 64/109 (58%), Gaps = 2/109 (1%)

Query:  17 DLGIKPRLDYLTRQEDLAIYPMPGGKVNNEYMDGTREISLPFEIAIKTKNQELASTVMWT    76
           +L +K  L YLT  + L++YP+PG +V +E    G ++  + +E+ ++TKNQ+ A+T +W
Sbjct:  16 NLPMKCTLGYLTAADSLSLYPLPGSRVLDEDYAGNQQWQMNYEVGMRTKNQQQANTTLWL    75

Query:  77 INSALSNFDL-KLPSLNHSYTFISLDVE-KPFLNDLSDQGFYIYVLDIT            123
           ++ AL      L S N S+ F SL +  +P +++   QG+   Y L  +
Sbjct:  76 VSQALDVLTADDLVSSNGSFEFESLTINGQPSISEQDTQGYSTYQLSFS            124
```

Based on this analysis, it was predicted that this GAS-specific protein and its epitopes, could be useful antigens for vaccines or diagnostics.

EXAMPLE 2584

A DNA sequence (GASx690) was identified in *S. pyogenes* <SEQ ID 7667> which encodes the amino acid sequence <SEQ ID 7668>. Analysis of this protein sequence reveals the following:

```
Possible site: 18

>>> Seems to have no N-terminal signal sequence

----- Final Results -----
            bacterial cytoplasm --- Certainty = 0.1626(Affirmative) < succ>
             bacterial membrane --- Certainty = 0.0000(Not Clear)   < succ>
              bacterial outside --- Certainty = 0.0000(Not Clear)   < succ>
```

No corresponding DNA sequence was identified in *S. agalactiae*.

The protein has homology with the following sequences in the GENPEPT database:

```
>GP:CAB53798 GB:AJ242593 major tail shaft protein [Bacteriophage A118]
 Identities = 54/133 (40%), Positives = 77/133 (57%), Gaps = 9/133 (6%)

Query:     1 MRQKNALRGHFIAPYVKGEEKTEVTKEKLLELARWIKDISDDTDEKTEDEAYYDGDGTEE    60
             MR KNA  + +A  V G + +  +     L++WI ++SDD  + TE++  YDGDG E+
Sbjct:     1 MRIKNAKTKYSVAEIVAGAGEPDWKR-----LSKWITNVSDDGSDNTEEQGDYDGDGNEK    55

Query:    61 TTVVGVKGAYTFEGTYDPEDKAQAHIASLKYKLGDERKVWHLIVSADGKTQWLGVATVTE   120
             T V+G   AYTFEGT+D ED+AQ  I + K +  +R +   I   D +T  +G ATV+E
Sbjct:    56 TVVLGYSEAYTFEGTHDREDEAQNLIVA-KRRTPENRSIMFKIEIPDTETA-IGKATVSE   113

Query:   121 I--IAGSGAAARF                                                131
             I   AG G A F
Sbjct:   114 IKGSAGGGDATEF                                                126
```

Based on this analysis, it was predicted that this GAS-specific protein and its epitopes, could be useful antigens for vaccines or diagnostics.

EXAMPLE 2585

A DNA sequence (GASx691) was identified in *S. pyogenes* <SEQ ID 7669> which encodes the amino acid sequence <SEQ ID 7670>. Analysis of this protein sequence reveals the following:

```
Possible site: 17

>>> Seems to have no N-terminal signal sequence

----- Final Results -----
            bacterial cytoplasm --- Certainty = 0.3521(Affirmative) < succ>
            bacterial membrane  --- Certainty = 0.0000(Not Clear)   < succ>
             bacterial outside  --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2586

A DNA sequence (GASx692) was identified in *S. pyogenes* <SEQ ID 7671> which encodes the amino acid sequence <SEQ ID 7672>. Analysis of this protein sequence reveals the following:

```
Possible site: 61

>>> Seems to have no N-terminal signal sequence

----- Final Results -----
            bacterial cytoplasm --- Certainty = 0.3438(Affirmative) < succ>
            bacterial membrane  --- Certainty = 0.0000(Not Clear)   < succ>
             bacterial outside  --- Certainty = 0.0000(Not Clear)   < succ>
```

No corresponding DNA sequence was identified in *S. agalactiae*.

The protein has homology with the following sequences in the GENPEPT database:

```
>GP:CAB53801 GB:AJ242593 gp15 [Bacteriophage A118]
 Identities = 67/191 (35%), Positives = 110/191 (57%), Gaps = 17/191 (8%)

Query:    11 FEFRGEIYPIDLSFNKVLDVFDVIDDDFLNEAEKCFLCLDILLDRTDLPFTYAVD-----    65
             +E+ G+ Y +DL+F+ VL V D+ +D+ L++   +   L +D+L    D+P+ + +
Sbjct:    12 YEYEGKEYKLDLAFDNVLRVIDLTEDNSLSDVFRANLAIDVLF-ADDMPWPRSNEEDEYA    70

Query:    66 -------LWVYIKTNFIDAERPEKPQLDIKGNPMPVVKEKEDNKKVI---DLSLDAEFIY   115
                    + + I TN+I  E +    DI GN MP        D+ + I    L+ DA++IY
Sbjct:    71 NIEEKSLVLIDIFTNYIVKENDDGLLYDIDGNKMPSATNNNDDAEEIASYSLTQDADYIY   130

Query:   116 ASFRQAYQINLLKEQNRLSWIEFKALLNALPDDTVMQRIIAIRQWE-DDGEGSKKYRDNM   174
             ASF Q Y I+LL  + ++ W +F+ALL +L DDT ++ II IRQ E   G+G++K R+ +
```

```
                          -continued
Sbjct:   131 ASFLQDYNIDLLDSRGKMHWYKFRALLESLRDDTTIKTIIGIRQAELPSGKGTEKERNEL   190

Query:   175 RKLKAKYSLDE                                                    185
             KLK +Y L +
Sbjct:   191 IKLKNRYKLKD                                                    201
```

Based on this analysis, it was predicted that this GAS-specific protein and its epitopes, could be useful antigens for vaccines or diagnostics.

EXAMPLE 2587

A DNA sequence (GASx694) was identified in *S. pyogenes* <SEQ ID 7673> which encodes the amino acid sequence <SEQ ID 7674>. Analysis of this protein sequence reveals the following:

```
Possible site: 29

>>> Seems to have no N-terminal signal sequence

----- Final Results -----
            bacterial cytoplasm --- Certainty = 0.4143(Affirmative) < succ>
            bacterial membrane  --- Certainty = 0.0000(Not Clear)   < succ>
             bacterial outside  --- Certainty = 0.0000(Not Clear)   < succ>
```

No corresponding DNA sequence was identified in *S. agalactiae*.

The protein has homology with the following sequences in the GENPEPT database:

```
>GP:AAG18639 GB:AY007505 unknown [Streptococcus mitis]
 Identities = 48/157 (30%), Positives = 85/157 (53%), Gaps = 10/157 (6%)

Query:    86 DLELSWEPDYIYKATHITPFSIKEVLRNFGRLKINFLIHPIKYLKTGKQEVPLVNG-GTL   144
             +LE S+ P+ ++ A H    S K   +  +LKI   + P +Y KT    E     NG GT+
Sbjct:    81 ELEFSYHPESVFYA-HFLTASYKPFGNHAWQLKIKLNMQPFRYQKTVNPES--YNGPGTI   137

Query:   145 QNPGNVQAKPILKIKGTGNGILTINDFETGLENVQSELVIDMERHLVYKDVLSAWDNIVR   204
              NPG + ++PI++++G G+   +TI    ET     NV+++   ID   +    +++ +A    +
Sbjct:   138 NNPGTIYSEPIIEVQGDGDVSITIGR-ETMYLNVKTKATIDCRQG--RQNIYNATGAVQN   194

Query:   205 TERHRMPLFDV--GQNKISWTGS-FTITAVPNWGVKV                         238
               T R R     F++   G++ I++TG+    +    PNW  K+
Sbjct:   195 TLRKRGGFFEIPTGRSGITFTGNVLRLIIRPNWRYKI                         231
```

Based on this analysis, it was predicted that this GAS-specific protein and its epitopes, could be useful antigens for vaccines or diagnostics.

EXAMPLE 2588

A DNA sequence (GASx695R) was identified in *S. pyogenes* <SEQ ID 7675> which encodes the amino acid sequence <SEQ ID 7676>. Analysis of this protein sequence reveals the following:

```
Possible site: 15

>>> Seems to have no N-terminal signal sequence
    INTEGRAL    Likelihood = -2.60   Transmembrane 15 - 31   (15 - 31)

----- Final Results -----
            bacterial membrane  --- Certainty = 0.2041(Affirmative) < succ>
             bacterial outside  --- Certainty = 0.0000(Not Clear)   < succ>
            bacterial cytoplasm --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2589

A DNA sequence (GASx697) was identified in *S. pyogenes* <SEQ ID 7677> which encodes the amino acid sequence <SEQ ID 7678>. Analysis of this protein sequence reveals the following:

```
Possible site: 22

>>> Seems to have no N-terminal signal sequence
----- Final Results -----
            bacterial cytoplasm --- Certainty = 0.3348(Affirmative) < succ>
            bacterial membrane  --- Certainty = 0.0000(Not Clear)   < succ>
             bacterial outside  --- Certainty = 0.0000(Not Clear)   < succ>
```

No corresponding DNA sequence was identified in *S. agalactiae*.

The protein has homology with the following sequences in the GENPEPT database:

```
>GP:AAA86895 GB:U28144 hyaluronidase [Streptococcus pyogenes]
 Identities = 326/337 (96%), Positives = 329/337 (96%)

Query:    1 MSENIPLRVQFKRMKAAEWARSDVILLESEIGFETDTGFARAGDGHNRFSDLGYISPLDY    60
            MSENIPLRVQFKRMKAAEWARSDVILLESEIGFETDTGFARAGDGHNRFSDLGYISPLDY
Sbjct:    1 MSENIPLRVQFKRMKAAEWARSDVILLESEIGFETDTGFARAGDGHNRFSDLGYISPLDY    60

Query:   61 NLLTNKPNIDGLATKVETAQKLQQKADKETVYTKAESKQELDKKLNLKGGVMTGQLKFKP   120
            NLLTNKPNIDGLATKVETAQKLQQKADKETVYTKAESKQELDKKLNLKGGVMTGQLKFKP
Sbjct:   61 NLLTNKPNIDGLATKVETAQKLQQKADKETVYTKAESKQELDKKLNLKGGVMTGQLKFKP   120

Query:  121 AATVAYSSSTGGAVNIDLSSTRGAGVVVYSDNDTSDGPLMSLRTGKETFNQSALFVDYKG   180
            AATVAYSSSTGGAVNIDLSSTRGAGVVVYSDNDTSDGPLMSLRTGKETFNQSALFVDYKG
Sbjct:  121 AATVAYSSSTGGAVNIDLSSTRGAGVVVYSDNDTSDGPLMSLRTGKETFNQSALFVDYKG   180

Query:  181 TTNAVNIAMRQPTTPNFSSALNITSGNENGSAMQLRGSEKALGTLKITHENPSIGADYDK   240
            TTNAVNIAMR  TTPNFSSALNITSGNENGSAMQLRGSEKALGTLKITHENPSIGADYDK
Sbjct:  181 TTNAVNIAMRHATTPNFSSALNITSGNENGSAMQLRGSEKALGTLKITHENPSIGADYDK   240

Query:  241 NAAALSIDIVKKTNGAGTAAQGIYINSTSGTTGKLLRIRNLSDDKFYVKSDGGFYAKETS   300
            NAA    + + K+ NGAGTAAQGIYINSTSGTTGKLLRIRNLSDDKFYVKSDGGFYAKETS
Sbjct:  241 NAARYPLILSKRQNGAGTAAQGIYINSTSGTTGKLLRIRNLSDDKFYVKSDGGFYAKETS   300

Query:  301 QIDGNLKLKDPTANDHAATKAYVDKAISELKKLILKK                         337
            QIDGNLKLKDPTANDHAATKAYVDKAISELKKLILKK
Sbjct:  301 QIDGNLKLKDPTANDHAATKAYVDKAISELKKLILKK                         337
```

Based on this analysis, it was predicted that this GAS-specific protein and its epitopes, could be useful antigens for vaccines or diagnostics.

EXAMPLE 2590

A DNA sequence (GASx698) was identified in *S. pyogenes* <SEQ ID 7679> which encodes the amino acid sequence <SEQ ID 7680>. Analysis of this protein sequence reveals the following:

```
Possible site: 17

>>> Seems to have no N-terminal signal sequence

----- Final Results -----
            bacterial cytoplasm --- Certainty = 0.4208(Affirmative) < succ>
            bacterial membrane  --- Certainty = 0.0000(Not Clear)   < succ>
             bacterial outside  --- Certainty = 0.0000(Not Clear)   < succ>

RGD motif 54-56
```

No corresponding DNA sequence was identified in *S. agalactiae*.

The protein has homology with the following sequences in the GENPEPT database:

```
>GP: AAA98102 GB: M19348 ORF [Streptococcus pyogenes phage H4489A]
Identities = 250/648 (38%), Positives = 351/648 (53%), Gaps = 75/648 (11%)

Query:    1 MSRDPTLILDESNLVIGKDGRVHYTFTTEDDNPKVRLASKCLGTAHFNQLMIERGDQATS   60
            MSRDPT  ++E +L    DGR + TF  +  +  VRL S CLG     +L +E   +
Sbjct:    1 MSRDPTYTINEHDLSFA-DGRFYVTFKADKSSETVRLNSSCLGNTIIKKLQVEDDNTMHD  59

Query:   61 YVAPVVVEGTGNPTGLFKDLKEISLELTDTANSQLWSKIKLTNRGMLQEYYDGKIKTEIV  120
            +V P V   T    GL + +KE+ L+L D   S LW KIK  N+ ML EY +  ++ + I
Sbjct:   60 FVKPKVT--TQQAFGLAQQVKELDLQLKDP-KSDLWGKIKFNNKAMLVEYANKEMSSAIA  116

Query:  121 NSARGVATRISEDTDKKLALINDTIDGIRREYRDADRKLSASYQAGIEGLKATMANDKIG  180
             SA  +  ++     D++  +     T++GI++  +
Sbjct:  117 QSAEQILLQVKSIDDERYSKFEQTLNGIKQTVKSES------------------------  152

Query:  181 LQAEIKASAQGLSQKYDDELRKLSAKITTTSSGTTEAYESKLAGLRAEFTRSNQGTRTEL  240
                ++++  L+  +D   + L  K+    S  T  ++  S+L            G   + L
Sbjct:  153 ----VESARTQLASMFDSRISGLDGKYSRLSQ-TIDSLSSRLD--------DGVGNYSTL  199

Query:  241 ESQISGLRAVQQSTASQISQEIRDREGAVSRVQQSLESYQRRMQDAEENYSSLTHTVRGL  300
              ++SG           I   + +      VSR+ Q+ +   Q ++ +A +NYSSL+ TV+GL
Sbjct:  200 SQKVSG-----------IDLRVSNAANDVSRLSQTAQGLQSQITNANQNYSSLSQTVQGL  248

Query:  301 QSDVGSPTGKIQSRLTQLAGQIEQRVTRDGVMSIISGAGDSIKLAIQKAGGINAKMSGNE  360
            Q+ V        SR+ QL+  I   +VT+  V + I++ + D I   AI+      + KM+G+E
Sbjct:  249 QTTVRDNQSNATSRINQLSDLISTKVTKGDVETTIAQSYDKIAFAIRDKLPAS-KMTGSE  307

Query:  361 IIASINLNSYGVTIAGKHAILDGNTTVNGTFTTKIAEAIKIRADQIIAGTIDAARIRVIN  420
            IISAINL+   GV I GK+I LDGN+ ++       K A    + A +I  G ++A+RI
Sbjct:  308 IISAINLDRSGVKITGKNITLDGNSYISNA-VIKDAHIANMDAGKINTGYLNASRIAAEA  366

Query:  421 LNASSIVGLDANFIK--AKIGY---------------AIT---DLLEGKVIKARNGAMLI  460
              +    I    A F K   A  GY                    A+T     +  G V+  A NGA
Sbjct:  367 ITGDKIKMDYAFFNKLTANEGYFRTLFAKNIFTTSVQAVTTSASKITGGVLSATNGASRW  426

Query:  461 DLNTAKMDFNSDATINFNSKNNALVRKDGTHTAFVHFSNATPKGYTGSALYASIGITSSG  520
            DLN+A +DFN DATINFNSKNNALVRK GT+TAFVHFSNATPKGY GSALYASIGITSSG
Sbjct:  427 DLNSANIDFNRDATINFNSKNNALVRKSGTNTAFVHFSNATPKGYRGSALYASIGITSSG  486

Query:  521 DGVNSASSGRFAGLRSFRYATGYNHTAAVDQTEIYGDNVLVVDDFNITRGFKFRPDKMQK  580
            DG++SASSGRF G+R FRYA G  HTA VDQ EIYGD+++ DDFNI RGFK RP  M K
Sbjct:  487 DGIDSASSGRFCGVRFFRYAEGLQHTAKVDQAEIYGDDIVFSDDFNIDRGFKMRPSLMPK  546

Query:  581 MLDMNDLYAAVVALGRCWGHLANVGWNTAHSNFTSAVNRELNNYITKI              628
            M+D+N +Y A++ALGRCW H N  W+ + + SA+  E N +I +
Sbjct:  547 MVDLNKMYQAILALGRCWLHANNTAWSW-NFDTRSAIIAEYNAHINNL              593
```

Based on this analysis, it was predicted that this GAS-specific protein and its epitopes, could be useful antigens for vaccines or diagnostics.

EXAMPLE 2591

A DNA sequence (GASx699) was identified in *S. pyogenes* <SEQ ID 7681> which encodes the amino acid sequence <SEQ ID 7682>. Analysis of this protein sequence reveals the following:

```
Possible site: 36
>>> Seems to have no N-terminal signal sequence

----- Final Results -----
          bacterial cytoplasm --- Certainty = 0.3323(Affirmative) < succ>
          bacterial membrane  --- Certainty = 0.0000(Not Clear)  < succ>
           bacterial outside  --- Certainty = 0.0000(Not Clear)  < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2592

A DNA sequence (GASx701) was identified in *S. pyogenes* <SEQ ID 7683> which encodes the amino acid sequence <SEQ ID 7684>. Analysis of this protein sequence reveals the following:

```
Possible site: 20
>>> Seems to have no N-terminal signal sequence

----- Final Results -----
            bacterial cytoplasm --- Certainty = 0.1017(Affirmative) < succ>
            bacterial membrane  --- Certainty = 0.0000(Not Clear)   < succ>
             bacterial outside  --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2593

A DNA sequence (GASx702) was identified in *S. pyogenes* <SEQ ID 7685> which encodes the amino acid sequence <SEQ ID 7686>. Analysis of this protein sequence reveals the following:

```
Possible site: 27
>>> Seems to have an uncleavable N-term signal seq
    INTEGRAL Likelihood = -3.03 Transmembrane 2-18 ( 1-23)

----- Final Results -----
            bacterial membrane  --- Certainty = 0.2211(Affirmative) < succ>
             bacterial outside  --- Certainty = 0.0000(Not Clear)   < succ>
            bacterial cytoplasm --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2594

A DNA sequence (GASx703) was identified in *S. pyogenes* <SEQ ID 7687> which encodes the amino acid sequence <SEQ ID 7688>. Analysis of this protein sequence reveals the following:

```
Possible site: 25
>>> Seems to have a cleavable N-term signal seq.
    INTEGRAL Likelihood = -3.45 Transmembrane 36-52 ( 36-55)

----- Final Results -----
            bacterial membrane  --- Certainty = 0.2381(Affirmative) < succ>
             bacterial outside  --- Certainty = 0.0000(Not Clear)   < succ>
            bacterial cytoplasm --- Certainty = 0.0000(Not Clear)   < succ>
```

No corresponding DNA sequence was identified in *S. agalactiae*.

The protein has homology with the following sequences in the GENPEPT database:

```
>GP: AAC39287 GB: AF115103 orf87 gp [Streptococcus thermophilus
bacteriophage Sfi21]
```

```
                                -continued
Identities = 43/73 (58%), Positives = 61/73 (82%)

Query:  1  MINLKLRLQNKVTLMAILGAIFLLAQQLGIKLPSNIADIANTAVTLLVLLGVVTDPTTKG  60
           MIN KLRLQNK TL+A++ A+FL+ QQ G+ +P+NI +   NT V +LV+LG++TDPTTKG
Sbjct:  8  MINFKLRLQNKATLVALISAVFLMLQQFGLHVPNNIQEGINTLVGILVILGIITDPTTKG  67

Query: 61  LSDSEQALTYHEP                                                73
           ++DSE+AL+Y +P
Sbjct: 68  IADSERALSYIQP                                                80
```

Based on this analysis, it was predicted that this GAS-specific protein and its epitopes, could be useful antigens for vaccines or diagnostics.

EXAMPLE 2595

A DNA sequence (GASx707R) was identified in *S. pyogenes* <SEQ ID 7689> which encodes the amino acid sequence <SEQ ID 7690>. Analysis of this protein sequence reveals the following:

```
Possible site: 22
>>> Seems to have an uncleavable N-term signal seq
    INTEGRAL Likelihood = -10.35 Transmembrane 9-25 ( 1-27)

----- Final Results -----
           bacterial membrane --- Certainty = 0.5140(Affirmative) < succ>
            bacterial outside --- Certainty = 0.0000(Not Clear)   < succ>
           bacterial cytoplasm --- Certainty = 0.0000(Not Clear)   < succ>
```

No corresponding DNA sequence was identified in *S. agalactiae*.

Based on this analysis, it was predicted that this GAS-specific protein and its epitopes, could be useful antigens for vaccines or diagnostics.

EXAMPLE 2596

A DNA sequence (GASx714R) was identified in *S. pyogenes* <SEQ ID 7691> which encodes the amino acid sequence <SEQ ID 7692>. Analysis of this protein sequence reveals the following:

```
Possible site: 26
>>> Seems to have no N-terminal signal sequence

----- Final Results -----
           bacterial cytoplasm --- Certainty = 0.1401(Affirmative) < succ>
            bacterial membrane --- Certainty = 0.0000(Not Clear)   < succ>
             bacterial outside --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2597

A DNA sequence (GASx715) was identified in *S. pyogenes* <SEQ ID 7693> which encodes the amino acid sequence <SEQ ID 7694>. Analysis of this protein sequence reveals the following:

```
Possible site: 20
>>> Seems to have no N-terminal signal sequence

----- Final Results -----
           bacterial cytoplasm --- Certainty = 0.0417(Affirmative) < succ>
            bacterial membrane --- Certainty = 0.0000(Not Clear)   < succ>
             bacterial outside --- Certainty = 0.0000(Not Clear)   < succ>
```

No corresponding DNA sequence was identified in S. agalactiae.

The protein has no significant homology with any sequences in the GENPEPT database.

Based on this analysis, it was predicted that this GAS-specific protein and its epitopes, could be useful antigens for vaccines or diagnostics.

EXAMPLE 2598

A DNA sequence (GASx726) was identified in S. pyogenes <SEQ ID 7695> which encodes the amino acid sequence <SEQ ID 7696>. Analysis of this protein sequence reveals the following:

```
Possible site: 33
>>> Seems to have no N-terminal signal sequence
   INTEGRAL Likelihood = -1.17 Transmembrane 18-34 ( 18-35)

----- Final Results -----
             bacterial membrane --- Certainty = 0.1468(Affirmative) < succ>
             bacterial outside  --- Certainty = 0.0000(Not Clear)   < succ>
             bacterial cytoplasm --- Certainty = 0.0000(Not Clear)   < succ>
```

No corresponding DNA sequence was identified in S. agalactiae.

The protein has no significant homology with any sequences in the GENPEPT database.

Based on this analysis, it was predicted that this GAS-specific protein and its epitopes, could be useful antigens for vaccines or diagnostics.

EXAMPLE 2599

A DNA sequence (GASx728R) was identified in S. pyogenes <SEQ ID 7697> which encodes the amino acid sequence <SEQ ID 7698>. Analysis of this protein sequence reveals the following:

```
Possible site: 29
>>> Seems to have no N-terminal signal sequence

----- Final Results -----
             bacterial cytoplasm --- Certainty = 0.1795(Affirmative) < succ>
             bacterial membrane  --- Certainty = 0.0000(Not Clear)   < succ>
             bacterial outside   --- Certainty = 0.0000(Not Clear)   < succ>
```

No corresponding DNA sequence was identified in S. agalactiae.

The protein has homology with the following sequences in the GENPEPT database:

```
>GP: AAF61314 GB: U96166 unknown [Streptococcus cristatus]
Identities = 149/194 (76%), Positives = 162/194 (82%)

Query:    1 LSAIIRQSTSKRISDKRGIYLVEKLVSLAKQSYFTVTKTSPMIEEVRYYAKELLRLSERR    60
            L  IIRQSTSKRIS+KR  YL +KL+ LAKQS+  V KTSPM+EEVRYYA+ELLRLSERR
Sbjct:   56 LYEIIRQSTSKRISEKRIAYLTDKLIKLAKQSFCAVKKTSPMLEEVRYYAQELLRLSERR   115

Query:   61 QAIFDKMVASAQPLPEDKILRSIPSIVETTATSIIGELGAIRRFQSANQINAFIGIDFRH   120
            Q + + MVA AQPLPE  ILRSIP I ETTATSIIGELG I RFQS NQ NAFIGID RH
Sbjct:  116 QVVLNDMVALAQPLPEYDILRSIPGIAETTATSIIGELGDIHRFQSTNQFNAFIGIDLRH   175

Query:  121 YESGNYLAQEHITKRGNPYAPKILFKCIDHIAFASHTNPCHIADFYEKRKRQSQTASTKP   180
            YES N+LA+EHITKRGNPYA KILFKCIH+IA ASHTNPCHIADFYEKRKRQS  ASTKP
Sbjct:  176 YESRNFLAKEHITKRGNPYARKILFKCIHNIASASHTNPCHIADFYEKRKRQSTIASTKP   235

Query:  181 HTIASRHCLVRQCF                                                 194
            TIAS H L+R +
Sbjct:  236 LTIASIHRLIRTMY                                                 249
```

Based on this analysis, it was predicted that this GAS-specific protein and its epitopes, could be useful antigens for vaccines or diagnostics.

EXAMPLE 2600

A DNA sequence (GASx729R) was identified in *S. pyogenes* <SEQ ID 7699> which encodes the amino acid sequence <SEQ ID 7700>. Analysis of this protein sequence reveals the following:

```
Possible site: 28
>>> Seems to have no N-terminal signal sequence

----- Final Results -----
          bacterial cytoplasm --- Certainty = 0.2363(Affirmative) < succ>
          bacterial membrane  --- Certainty = 0.0000(Not Clear)   < succ>
          bacterial outside   --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2601

A DNA sequence (GASx730R) was identified in *S. pyogenes* <SEQ ID 7701> which encodes the amino acid sequence <SEQ ID 7702>. Analysis of this protein sequence reveals the following:

```
Possible site: 25
>>> Seems to have an uncleavable N-term signal seq

----- Final Results -----
          bacterial membrane  --- Certainty = 0.0000(Not Clear) < succ>
          bacterial outside   --- Certainty = 0.0000(Not Clear) < succ>
          bacterial cytoplasm --- Certainty = 0.0000(Not Clear) < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2602

A DNA sequence (GASx734) was identified in *S. pyogenes* <SEQ ID 7703> which encodes the amino acid sequence <SEQ ID 7704>. Analysis of this protein sequence reveals the following:

```
Possible site: 52
>>> Seems to have no N-terminal signal sequence

----- Final Results -----
          bacterial cytoplasm --- Certainty = 0.4001(Affirmative) < succ>
          bacterial membrane  --- Certainty = 0.0000(Not Clear)   < succ>
          bacterial outside   --- Certainty = 0.0000(Not Clear)   < succ>
```

No corresponding DNA sequence was identified in *S. agalactiae*.

Based on this analysis, it was predicted that this GAS-specific protein and its epitopes, could be useful antigens for vaccines or diagnostics.

EXAMPLE 2603

A DNA sequence (GASx735) was identified in *S. pyogenes* <SEQ ID 7705> which encodes the amino acid sequence <SEQ ID 7706>. Analysis of this protein sequence reveals the following:

```
Possible site: 55
>>> Seems to have no N-terminal signal sequence
   INTEGRAL Likelihood = -3.66 Transmembrane 276-292 ( 274-292)
----- Final Results -----
              bacterial membrane --- Certainty = 0.2466(Affirmative) < succ>
               bacterial outside --- Certainty = 0.0000(Not Clear)   < succ>
             bacterial cytoplasm --- Certainty = 0.0000(Not Clear)   < succ>
```

No corresponding DNA sequence was identified in *S. agalactiae*.

Based on this analysis, it was predicted that this GAS-specific protein and its epitopes, could be useful antigens for vaccines or diagnostics.

EXAMPLE 2604

A DNA sequence (GASx736) was identified in *S. pyogenes* <SEQ ID 7707> which encodes the amino acid sequence <SEQ ID 7708>. Analysis of this protein sequence reveals the following:

```
Possible site: 33
>>> Seems to have no N-terminal signal sequence

---- Final Results ----
             bacterial cytoplasm --- Certainty = 0.3998(Affirmative) < succ>
              bacterial membrane --- Certainty = 0.0000(Not Clear)   < succ>
               bacterial outside --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2605

A DNA sequence (GASx737) was identified in *S. pyogenes* <SEQ ID 7709> which encodes the amino acid sequence <SEQ ID 7710>. Analysis of this protein sequence reveals the following:

```
Possible site: 60
>>> Seems to have a cleavable N-term signal seq.
   INTEGRAL Likelihood = -12.74 Transmembrane  77-93  ( 69-99)
   INTEGRAL Likelihood =  -4.14 Transmembrane 152-168 ( 151-170)
   INTEGRAL Likelihood =  -1.17 Transmembrane 196-212 ( 194-212)

----- Final Results -----
              bacterial membrane --- Certainty = 0.6095(Affirmative) < succ>
               bacterial outside --- Certainty = 0.0000(Not Clear)   < succ>
             bacterial cytoplasm --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2606

A DNA sequence (GASx738) was identified in *S. pyogenes* <SEQ ID 7711> which encodes the amino acid sequence <SEQ ID 7712>. Analysis of this protein sequence reveals the following:

```
Possible site: 37
>>> Seems to have a cleavable N-term signal seq.
   INTEGRAL Likelihood = -13.16 Transmembrane  44-60  ( 39-71)
   INTEGRAL Likelihood = -10.24 Transmembrane  94-110 ( 81-114)
   INTEGRAL Likelihood =  -7.64 Transmembrane 185-201 ( 179-207)
```

```
                                  -continued
INTEGRAL Likelihood =  -7.48 Transmembrane 132-148  ( 130-158)
INTEGRAL Likelihood =  -2.76 Transmenibrane 208-224  ( 204-225)
INTEGRAL Likelihood =  -0.06 Transmernbrane 153-169  ( 152-169)

----- Final Results -----
                bacterial membrane --- Certainty = 0.6265(Affirmative) < succ>
                bacterial outside  --- Certainty = 0.0000(Not Clear)  < succ>
              bacterial cytoplasm  --- Certainty = 0.0000(Not Clear)  < succ>
```

No corresponding DNA sequence was identified in S. agalactiae.

The protein has no significant homology with any sequences in the GENPEPT database.

Based on this analysis, it was predicted that this GAS-specific protein and its epitopes, could be useful antigens for vaccines or diagnostics.

EXAMPLE 2607

A DNA sequence (GASx742) was identified in S. pyogenes <SEQ ID 7713> which encodes the amino acid sequence <SEQ ID 7714>. Analysis of this protein sequence reveals the following:

```
Possible site: 22
>>> Seems to have an uncleavable N-term signal seq
    INTEGRAL Likelihood =  -7.80 Transmembrane 887-903  ( 882-906)
    INTEGRAL Likelihood =  -4.88 Transmembrane   6-22  (   5-23)

----- Final Results -----
                bacterial membrane --- Certainty = 0.4121(Affirmative) < succ>
                bacterial outside  --- Certainty = 0.0000(Not Clear)  < succ>
              bacterial cytoplasm  --- Certainty = 0.0000(Not Clear)  < succ>

LPXTG motif: 877-881
```

No corresponding DNA sequence was identified in S. agalactiae.

The protein has homology with the following sequences in the GENPEPT database:

```
>GP: CAB46409 GB: AL096743 putative large secreted protein
[Streptomyces coelicolor A3(2)]
  Identities = 231/599 (38%), Positives = 329/599 (54%), Gaps = 43/599 (7%)
Query: 278 TSSNSDASSRNIVKIGEIQGASHTSPLLKKAVTVEQVVVTYL---DDSTHFYVQDLNGDG  334
           T +++ +++    V+I ++QG++   SP   + VT    +VT +       S  F++QD  D
Sbjct:  28 TPAHAASAAAGPVRIHDVQGSTRLSPYAGEQVTDVAGIVTGVRGYGSSKGFWMQDPLPDA   87

Query: 335 DLATSDGIRVFAKNA-KVQVGDVLTISGEVEEFFGRGYEERKQTDLTITQIVAKAVTK-T  392
           D ATS+G+ VF  A  +V VGD +T+SG V E+    G   Q+     +T+I    VT  +
Sbjct:  88 DPATSEGVFVFTSRAPEVAVGDAVTVSGTVSEYVPGGTSSGNQS---LTEITRPTVTVVS  144

Query: 393 GTAQVPSPLVLGKDRIAPANIIDNDGLR-------VFDPEEDAIDYWESMEGMLVAVDDA  445
           G    +P+    +    A   + DG           P       A+DY+ES+EGM V V DA
Sbjct: 145 GGNAIPAATTVSARSVPRAYAPEGDGAANGSVNALPLRPGTYALDYYESLEGMNVRVADA  204

Query: 446 KILGPMKN-KEIYVLPGSSTRPLNNSGGVLLPANSYNTDVIPVLFKKGKQI----IKAGD  500
           +++G      E++V     P       G V   + NT + +     GK          GD
Sbjct: 205 RVVGASDPYTELWVTVKPWENPNRRGGTVYGSYDDQNTGRLQIQ-SLGKPADFPAADVGD  263

Query: 501 SYKGRLAGPVSYS-YGNYKVFVDDSKNMPSLMDGHLKPEKTNLQKDLSKLSIASYNIENF  559
           +    G AGP Y+  YG Y +    +    ++L  G  + E T   Q     +L+++A+YN+EN
Sbjct: 264 TLAGTTAGPLDYNQYGGYTLVASE---IGALESGGTERESTRRQS-ARELAVATYNVENL  319

Query: 560 SANPSSTKDEKVKRIAESFIHDLNAPDIIGLIEVQDNNGPTDDGTTDATQSAQRLIDAIK  619
           + +PS   D+        AE+ +H L +PDI+ L E+QDNNG TDDGT  A    RLIDAI
Sbjct: 320 --DPS---DDTFTAHAETIVHRLKSPDIVSLEEIQDNNGATDDGTVAADATVGRLIDAIV  374

Query: 620 KLGGPTYRYVDIAPENNVDGGQPGGNIRTGFLYQPERVSLSDKPKGGARDA--LTWVNGE  434
            +GGP Y +  I P + DGGQPGGNIR  FL+ PERVS +D+  G A  A     V G+
Sbjct: 375 AAGGPRYDWRGIDPVDKADGGQPGGNIRQAFLFNPERVSFTDRAGGDATTATGVRKVRGK  434

Query: 678 --LNLSVGRIDPTNAAWKDVRKSLAAEFIFQGRKVVVVANHLNSKRGDNALYGCVQPVTF  735
             L   S GR+DP N AW+D RK LA EF+F+GR V VVANH NSK GD  L      QP +
Sbjct: 435 AALTHSPGRVDPANEAWEDSRKPLAGEFVFRGRTVFVVANHFNSKGGDQGLTAQYQPPSR  494

Query: 736 KSEQQRHVLANMLAQFAKE--QAKHQANIVMLGDFNDFEFTKTIQLIE-EGDMVNLVSRH  792
            SE +RH A ++ F KE   A+  A++V LGD NDFEF++T +++E +G + + V
Sbjct: 495 GSETQRHAQAKVVNTFVKEILAAQKNADVVALGDINDFEFSRTARILEGDGALWSAVKSL  554

Query: 793 DISDRYSYFHQGNNQTLDNILVSRHLL--DHYEFDMVHVNSPFMEAHGRASDHDPLLLQ   849
```

```
                S+RYSY +QGN+Q LD ILVS  +     H  +D VHVN+ F    H + SDHDP +L+
Sbjct: 555 PRSERYSYVYQGNSQVLDQILVSPSVRRGGHLSYDSVHVNAEF---HDQISDHDPQVLR     610
```

Based on this analysis, it was predicted that this GAS-specific protein and its epitopes, could be useful antigens for vaccines or diagnostics.

EXAMPLE 2608

A DNA sequence (GASx743) was identified in *S. pyogenes* <SEQ ID 7715> which encodes the amino acid sequence <SEQ ID 7716>. Analysis of this protein sequence reveals the following:

```
Possible site: 22
>>> Seems to have no N-terminal signal sequence

----- Final Results -----
           bacterial cytoplasm --- Certainty = 0.2437(Affirmative) < succ>
           bacterial membrane  --- Certainty = 0.0000(Not Clear)   < succ>
           bacterial outside   --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2609

A DNA sequence (GASx756) was identified in *S. pyogenes* <SEQ ID 7717> which encodes the amino acid sequence <SEQ ID 7718>. Analysis of this protein sequence reveals the following:

```
Possible site: 18
>>> Seems to have no N-terminal signal sequence
    INTEGRAL Likelihood = -4.30 Transmembrane 10-26 ( 8-27)
    INTEGRAL Likelihood = -3.08 Transmembrane 51-67 ( 50-67)

----- Final Results -----
           bacterial membrane  --- Certainty = 0.2720(Affirmative) < succ>
           bacterial outside   --- Certainty = 0.0000(Not Clear)   < succ>
           bacterial cytoplasm --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2610

A repeated DNA sequence (GASx758) was identified in *S. pyogenes* <SEQ ID 7719> which encodes the amino acid sequence <SEQ ID 7720>. Analysis of this protein sequence reveals the following:

```
Possible site: 22
>>> Seems to have a cleavable N-term signal seq.

----- Final Results -----
              bacterial outside   --- Certainty = 0.3000(Affirmative) < succ>
              bacterial membrane  --- Certainty = 0.0000(Not Clear)   < succ>
              bacterial cytoplasm --- Certainty = 0.0000(Not Clear)   < succ>
```

No corresponding DNA sequence was identified in *S. agalactiae*.

The protein has homology with the following sequences in the GENPEPT database:

```
>GP: CAA38133 GB: X54225 7 kDa protein [Streptococcus pneumoniae]
 Identities = 31/61 (50%), Positives = 41/61 (66%)
Query:   1 MTNGLKYVLEQMLLLFIIAALACLFLAIGLMIGYSFMGDGQSPWHILSMDKWAELVNKFT 60
           M      YV++++LL+I+  L  L L IGLM+GY  +G GQ PW ILS  KW EL++KFT
Sbjct:   3 MNKKSSYVVKRLLLVIIVLILGTLALGIGLMVGYGILGKGQDPWAILSPAKWQELIHKFT 62

Query: 61 G                                                            61
          G
Sbjct: 63 G                                                            63
```

Based on this analysis, it was predicted that this GAS-specific protein and its epitopes, could be useful antigens for vaccines or diagnostics.

EXAMPLE 2611

A DNA sequence (GASx764) was identified in *S. pyogenes* <SEQ ID 7721> which encodes the amino acid sequence <SEQ ID 7722>. Analysis of this protein sequence reveals the following:

```
Possible site: 58
>>> Seems to have no N-terminal signal sequence
   INTEGRAL Likelihood = -3.98 Transmembrane 47-63 ( 46-67)

----- Final Results -----
            bacterial membrane --- Certainty = 0.2593(Affirmative) < succ>
            bacterial outside  --- Certainty = 0.0000(Not Clear) < succ>
          bacterial cytoplasm  --- Certainty = 0.0000(Not Clear) < succ>
```

A related sequence was also identified in GAS <SEQ ID 9149> which encodes the amino acid sequence <SEQ ID 9150>. Analysis of this protein sequence reveals the following:

```
Possible site: 53
    >>> Seems to have no N-terminal signal sequence
INTEGRAL Likelihood = -3.98 Transmembrane 35-51 ( 34-55)

----- Final Results -----
            bacterial membrane --- Certainty = 0.2593(Affirmative) < succ>
            bacterial outside  --- Certainty = 0.0000(Not Clear) < succ>
          bacterial cytoplasm  --- Certainty = 0.0000(Not Clear) < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2612

A DNA sequence (GASx783) was identified in *S. pyogenes* <SEQ ID 7723> which encodes the amino acid sequence <SEQ ID 7724>. Analysis of this protein sequence reveals the following:

```
Possible site: 43
>>> Seems to have no N-terminal signal sequence
   INTEGRAL Likelihood = -13.16 Transmembrane 142-158 ( 132-167)
   INTEGRAL Likelihood = -12.26 Transmembrane 113-129 ( 101-140)
   INTEGRAL Likelihood = -10.24 Transmembrane 238-254 ( 233-260)
   INTEGRAL Likelihood =  -2.76 Tramsmembrane  34-50 (  34-51)

----- Final Results -----
            bacterial membrane --- Certainty = 0.6265(Affirmative) < succ>
            bacterial outside  --- Certainty = 0.0000(Not Clear) < succ>
          bacterial cytoplasm  --- Certainty = 0.0000(Not Clear) < succ>
```

No corresponding DNA sequence was identified in *S. agalactiae*.

The protein has homology with the following sequences in the GENPEPT database:

```
>GP: BAA32091 GB: AB010970 ABC-transporter [Streptococcus mutans]
 Identities = 173/269 (64%), Positives = 214/269 (79%), Gaps = 2/269 (0%)
Query:   1 MNFLTKKNRILLREMVKTDFKLRYQGSAIGYLWSILKPLMMFTIMYLVFIRFLRLGGNVP   60
           M+F ++KNRILL+E++KTDFKLRYQGSAIGYLWSILKPLM+F IMY+VF+RFL LGG+VP
Sbjct:   1 MDFFSRKNRILLKELIKTDFKLRYQGSAIGYLWSILKPLMLFAIMYIVFVRFLPLGGDVP   60

Query:  61 HFPVALLLANVIWSFFSEATSMGMVSIVSRGDLLRKLNFSKHIIVFSAVLGALINFLINL  120
           H+PVALLL LVIW+FF E T MGMVS+V+RGDLLRKLNFSK  IVFSAV GA INF IN+
Sbjct:  61 HWPVALLLGNVIWTFFQETTMMGMVSVVTRGDLLRKNLFSKQTIVFSAVSGAAINFGINV  120

Query: 121 VVVLIFALINGVTIS--GYAYLSLFLFIELVVLVLGIALLLSNVFVYYRDLAQVWEVLLQ  178
           +VVLIFAL+NGFT +     +L + LF+EL++   GIA +LS ++V YRD+  VWEV+LQ
Sbjct: 121 IVVLIFALLNGVTFTFRWNLFLLIPLFLELLLGSTGIAFILSTLYVRYRDIGPVWEVILQ  180

Query: 179 AGMYATPIIYPITFVLDSHPLAAKLLMLNPVAQMIQDFRYLLIDRANVTIWQMSTNWFYI  238
            G Y TPIIY +T++     + AKLL+L+P+AQ+IQD R++LID ANVTIWQM  +
Sbjct: 181 GGFYGTPIIYSLTYIARRSVVGAKLLLLSPIAQIIQDMRHILIDPANVTIWQMINHKSIA  240

Query: 239 VIPYLVPFVILFIGIFVFKKNADRFAEII                                267
           VIPYLVP  +  IG++VF++NA +FAEII
Sbjct: 241 VIPYLVPIFVFIIGFLVFNYNAKKFAEII                                269
```

Based on this analysis, it was predicted that this GAS-specific protein and its epitopes, could be useful antigens for vaccines or diagnostics.

EXAMPLE 2613

A DNA sequence (GASx786) was identified in *S. pyogenes* <SEQ ID 7725> which encodes the amino acid sequence <SEQ ID 7726>. Analysis of this protein sequence reveals the following:

```
Possible site: 32
>>> Seems to have no N-terminal signal sequence

----- Final Results -----
              bacterial cytoplasm --- Certainty = 0.3828(Affirmative) < succ>
               bacterial membrane --- Certainty = 0.0000(Not Clear) < succ>
                bacterial outside --- Certainty = 0.0000(Not Clear) < succ>
```

No corresponding DNA sequence was identified in *S. agalactiae.*

The protein has homology with the following sequences in the GENPEPT database:

```
>GP: BAA32094 GB: AB010970 rgpFc [Streptococcus mutans]
Identities = 381/582 (65%), Positives = 475/582 (81%), Gaps = 1/582 (0%)

Query:   1 MNRILLYVHFNKYNKISAHVYYQLEQMRSLFSKIVFISNSKVSHEDLKRLKNHCLIDEFL   60
           M R+LLYVHFNKYN++S+HV YQL QMRSLFSK++FISNS+V+  D+K L+   LID+F+
Sbjct:   1 MKRLLLYVHFNKYNRVSSHVVYQLTQMRSLFSKVIFISNSQVADADVKMLREKHLIDDFI   60

Query:  61 QRKNKGFDFSAWHDGLIIMGFDKLEEFDSLTIMNDTCFGPIWEMAPYFENFEEKETVDFW  120
           QR+N GFDF+AW DG++ +GFD+L  +DS+T MNDTCFGP+WEM   ++ FE K TVDFW
Sbjct:  61 QRQNSGFDFAAWRDGMVFVGFDELVTYDSVTTMNDTCFGPLWEMYSIYQEFETKTTVDFW  120

Query: 121 GITNNRGTKAFKEHVQSYFMTFKNQVIQNKVFQQFWQSIIEYENVQEVIQHYETQLTSIL  180
           G+TNNR TK+F+EH+QSYF++FK  V+++  F+ FW++I EY++VQ+VI  YET++T+ L
Sbjct: 121 GLTNNRATKSFREHIQSYFISFKASVLRSTAFRDFWENIKEYQDVQKVIDQYETKVTTTL  180

Query: 181 LNEGFSYQTVFDTRKAESSFMPHPDFSYYNPTAILKHHVPFIKVKAIDANQHIAPYLLNL  240
           L+ GF Y  VFDT K ++S M H DFSYYNPTAIL H VPFIKVKAID NQHI PYLLN
Sbjct: 181 LDAGFQYDVVFDTTKEDASHMLHADFSYYNPTAILNHRVPFIKVKAIDNNQHITPYLLND  240

Query: 241 IRETTNYPIDLIVSHMSQISLPDTKYLLSQKYLNCQRLAKQTCQKVAVHLHVFYVDLLDE  300
           I++ + YPIDLIVSHMS+I+ PD  YLL  KY+  +       QKVAVHLHVFYVDLL+E
Sbjct: 241 IQKNSTYPIDLIVSHMSEINYPDFSYLLGHKYVKKRERVDLKNQKVAVHLHVFYVDLLEE  300

Query: 301 FLTAFENWNFHYDLFITTDSDIKRKEIKEILQRKGKTADIRVTGNRGRDIYPMLLLKDKL  360
           FLTAF+ ++F YDLFITTDSD K+ EI+EIL   G+ A + VTGN GRD+ PML LK+ L
Sbjct: 301 FLTAFKQFHFSYDLFITTDSDDKKAEIEEILSANGQEAQVFVTGNIGRDVLPMLKLKNYL  360

Query: 361 SQYDYIGHFHTKKSKEADFWAGESWRKELIDMLVKPADSILSAFETD-DIGIIIADIPSF  419
           S YD++GHFHTKKSKEADFWAG+SWR+ELIDMLVKPAD+IL+  +  IG++IAD+P+F
Sbjct: 361 SAYDFVGHFHTKKSKEADFWAGQSWREELIDMLVKPADNILAQLQQNPKIGLVIADMPTF  420
```

```
Query:  420 FRFNKIVNAWNEHLIAQEMMSLWRKMDVKKQIDFQAMDTFVMSYGTFVWFKYDALKSLFD  479
             FR+NKIV+AWNEHLIA EM +LW+KM + K+IDF A  TFVMSYGTFVWFKYDALK LFD
Sbjct:  421 FRYNKIVDAWNEHLIAPEMNTLWQKMGMTKKIDFNAFHTFVMSYGTFVWFKYDALKPLFD  480

Query:  480 LELTQNDIPSEPLPQNSILHAIERLLVYIAWGDSYDFRIVKNPYELTPFIDNKLLNLRED  539
             L LT +D+P EPLPQNSILHAIERLL+YIAW + YDFRI KNP +LTPFIDNKLLN R +
Sbjct:  481 LNLTDDDVPEEPLPQNSILHAIERLLIYIAWNEHYDFRISKNPVDLTPFIDNKLLNERGN  540

Query:  540 EGAHTYVNFNQMGGIKGALKYIIVGPAKAMKYIFLRLMEKLK                   581
             +T+V+FN MGGIKGA KYI +GPA+A+KYI  R ++K+K
Sbjct:  541 SAPNTFVDFNYMGGIKGAFKYIFIGPARAVKYILKRSLQKIK                   582
```

Based on this analysis, it was predicted that this GAS-specific protein and its epitopes, could be useful antigens for vaccines or diagnostics.

EXAMPLE 2614

A DNA sequence (GASx787) was identified in *S. pyogenes* <SEQ ID 7727> which encodes the amino acid sequence <SEQ ID 7728>. Analysis of this protein sequence reveals the following:

```
Possible site: 33
>>> Seems to have a cleavable N-term signal seq.
INTEGRAL Likelihood = -15.66  Transmembrane 202-218  (191-224)
INTEGRAL Likelihood = -10.03  Transmembrane 340-356  (335-365)
INTEGRAL Likelihood =  -9.08  Transmembrane 270-286  (263-289)
INTEGRAL Likelihood =  -8.60  Transmembrane 124-140  (118-145)
INTEGRAL Likelihood =  -4.94  Transmembrane 377-393  (375-395)
INTEGRAL Likelihood =  -3.29  Transmembrane 291-307  (290-311)
INTEGRAL Likelihood =  -2.87  Transmembrane 160-176  (159-180)
INTEGRAL Likelihood =  -2.66  Transmembrane  50-66   (48-66)
INTEGRAL Likelihood =  -1.28  Transmembrane  77-93   (76-93)
INTEGRAL Likelihood =  -0.69  Transmembrane 229-245  (229-245)

----- Final Results -----
bacterial membrane  --- Certainty = 0.7262 (Affirmative) < succ>
bacterial outside   --- Certainty = 0.0000 (Not Clear)  < succ>
bacterial cytoplasm --- Certainty = 0.0000 (Not Clear)  < succ>
```

No corresponding DNA sequence was identified in *S. agalactiae*.

The protein has homology with the following sequences in the GENPEPT database:

```
>GP: BAA32095 GB: AB010970 ORF7 [Streptococcus mutans]
Identities = 374/775 (48%), Positives = 525/775 (67%), Gaps = 7/775 (0%)

Query:   53 VSFVGYIISLIGLSYYLSRQVSRQLFLKTSFIVISYLIVSYWVQITQHLNDKRFDIWSLT  112
             V  V  Y++S++GLS+YLS+ + +  F++        Y+++SY++ +T+ LN++ F IW L
Sbjct:   30 VCLVIYVLSILGLSFYLSKNLKKTFFIELLLGYGLYIVISYFLAVTRELNNESFKIWDLA   89

Query:  113 KNQFYQFQALPSLLIILV----MATLIKILAAYFAIEKDRFGLL-GYQGNTFSVALILAV  167
             KN F+Q  LP+L++I+    + LI++       + +   LL  +   F + ++
Sbjct:   90 KNHFFQPYFLPTLVLIIACTFALNYLIRVKMKRSHLSRKMTLLLENFSETEFLLTGLIVS  149

Query:  168 VPINDIHLLKLISSRFSELVTAGNSQIALLKISGLLIVLLVIFATIIYVVLNALKHLKSN  227
             ++D  +KL+  +  LL  L++F+ I+    NA + +K N
Sbjct:  150 FILSDTLYVKLLQESLRAYYHKPLAYESLLFLYTLLT--LILFSVIVEACFNAYRSIKLN  207
Query:  228 KPSFSVAATTSLFLALVFNYTFQYGVKGDEALLGYYVFPGATLFQIVAITLVALLAYVIT  287
             +P+ S+A +SL A +FNY FQYG+K D  LLG Y+ PGAT +QI+ +T   Y+I
Sbjct:  208 RPNLSLAFVSSLLFATIFNYAFQYGLKNDADLLGKYIVPGATAYQILVLTAAGFFLYLII  267

Query:  288 NRYWPTTFFLLILGTIISVVNDLKESMRSEPLLVTDFVWLQELGLVTSFVKKSVIVEMVV  347
             NRY   TF ++ILG+II+VVN LK   MR+EPLLVTDF W+  + L+   V   ++I    ++
Sbjct:  268 NRYLLVTFLIVILGSIITVVNVLKVGMRNEPLLVTDFAWVTNIRLLARSVNANIIFSTLL  327

Query:  348 GLAICIVVAWYLHGRVLAGKLFMSPVKRASAVLGLFIVSCSMLIPFSYEKEGKILSGLPI  407
              LA  I++ +L  R+L GK+ +    +    + ++   S+ I F   EK  KI++G+P+
Sbjct:  328 ILAALILLYLFLRKRLLQGKITENYRLKVGLISSICLLGFSIFIIFRNEKGSKIVNGIPV  387

Query:  408 ISALNNDNDINWLGFSTNARYKSLAYVWTRQVTKKIMEKPTNYSQETIASIAQKYQKLAE  467
             IS +NN  DI + GF +NA YKSL YVWT+QVTK IM+KP++YS+E I  +A+KY  +A
Sbjct:  388 ISQVNNWVDIGYQGFYSNASYKSLMYVWTKQVTKSIMDKPSDYSKERILKLAKKYNNVAN  447
```

-continued

```
Query: 468 DINKDRKNNIADQTVIYLLSESLSDPDRVSNVTVSHDVLPNIKAIKNSTTAGLMQSDSYG 527
           INK R  NI++QTVIY+LSES SDPDRV  V +S DV+PNIK IK  TT+GLM SD YG
Sbjct: 448 KINKVRTENISNQTVIYILSESFSDPDRVQGVNLSRDVIPNIKQIKEKTTSGLMHSDGYG 507

Query: 528 GGTANMEFQTLTSLPFYNFSSSVSVLYSEVFPKMAKPHTISEFYQGKNRIAMHPASANNF 587
           GGTANMEFQ+LT LP+YNF+SSVS LY+EV P M+   +IS   ++ KNR+ +HP+SA+N+
Sbjct: 508 GGTANMEFQSLTGLPYYNFNSSVSTLYTEVVPDMSVFPSISNQFKSKNRVVIHPSSASNY 567

Query: 588 NRKTVYSNLGFSKFLALSGSKDKFKNIENVGLLTSDKTVYNNILSLINPSESQFFSVITM 647
           +RK VY   L F  F+A SG+ DK  +  E VGL  SDKT Y NIL  INPS+SQFFSV+TM
Sbjct: 568 SRKYVYDKLKFPTFVASSGTSDKITHSEKVGLNVSDKTTYQNILDKINPSQSQFFSVMTM 627

Query: 648 QNHIPWSSDYPEEIVAEGKNFTEEENHNLTSYARLLSFTDKETRAFLEKLTQINKPITVV 707
           QNH+PW+SD P ++VA GK +T++EN +L+SYARLL++TDKET+ FL +L+Q+    +TVV
Sbjct: 628 QNHVPWASDEPSDVVATGKGYTKDENGSLSSYARLLTYTDKETKDFLAQLSQLKHKVTVV 687

Query: 708 FYGDHLPGLYPDSAFNKHIENKYLTDYFIWSNGTNEKKNHPLINSSDFTAALFEHTDSKV 767
           FYGDHLPGLYP+SAF K  +++Y TDYFIWSN  +   NH  +NSSDFTA L EHT+SKV
Sbjct: 688 FYGDHLPGLYPESAFKKDPDSQYQTDYFIWSNYNTKTLNHSYVNSSDFTAELLEHTNSKV 747

Query: 768 SPYYALLTEVLNKASVDKSPDSPEVKAIQNDLKNIQYDVTIGKGYLLKHKTFFKI      822
           SPYYALLTEVL+  +V    +  E K I NDLK IQYD+T+GKGY+   +K FF I
Sbjct: 748 SPYYALLTEVLDNTTVGHGKLTKEQKEIANDLKLIQYDITVGKGYIRNYKGFFDI      802
```

Based on this analysis, it was predicted that this GAS-specific protein and its epitopes, could be useful antigens for vaccines or diagnostics.

EXAMPLE 2615

A DNA sequence (GASx789R) was identified in *S. pyogenes* <SEQ ID 7729> which encodes the amino acid sequence <SEQ ID 7730>. Analysis of this protein sequence reveals the following:

```
Possible site: 13
>>> Seems to have no N-terminal signal sequence
INTEGRAL Likelihood = -1.06 Transmembrane 42-58 (42-58)

----- Final Results -----
bacterial membrane --- Certainty = 0.1426 (Affirmative) < succ>
bacterial outside  --- Certainty = 0.0000 (Not Clear)   < succ>
bacterial cytoplasm --- Certainty = 0.0000 (Not Clear)  < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2616

A DNA sequence (GASx790) was identified in *S. pyogenes* <SEQ ID 7731> which encodes the amino acid sequence <SEQ ID 7732>. Analysis of this protein sequence reveals the following:

```
Possible site: 24
>>> Seems to have a cleavable N-term signal seq.

----- Final Results -----
bacterial outside   --- Certainty = 0.3000 (Affirmative) < succ>
bacterial membrane  --- Certainty = 0.0000 (Not Clear)   < succ>
bacterial cytoplasm --- Certainty = 0.0000 (Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2617

A DNA sequence (GASx791) was identified in *S. pyogenes* <SEQ ID 7733> which encodes the amino acid sequence <SEQ ID 7734>. Analysis of this protein sequence reveals the following:

```
Possible site: 48
>>> Seems to have a cleavable N-term signal seq.
INTEGRAL Likelihood = -12.42  Transmembrane 166-182  (157-188)
INTEGRAL Likelihood =  -7.32  Transmembrane  85-101  ( 79-104)
INTEGRAL Likelihood =  -6.90  Transmembrane 397-413  (386-417)
INTEGRAL Likelihood =  -6.05  Transmembrane 253-269  (252-273)
INTEGRAL Likelihood =  -5.26  Transmembrane 301-317  (293-325)
INTEGRAL Likelihood =  -3.35  Transmembrane 363-379  (362-379)
INTEGRAL Likelihood =  -3.24  Transmembrane 335-351  (335-351)

----- Final Results -----
bacterial membrane  --- Certainty = 0.5967 (Affirmative) < succ>
bacterial outside   --- Certainty = 0.0000 (Not Clear)  < succ>
bacterial cytoplasm --- Certainty = 0.0000 (Not Clear)  < succ>
```

No corresponding DNA sequence was identified in *S. agalactiae*.

The protein has homology with the following sequences in the GENPEPT database:

```
>GP: AAA64645 GB: U10927 CapF [Staphylococcus aureus]
Identities = 97/419 (23%), Positives = 186/419 (44%), Gaps = 40/419 (9%)

Query:  12 FLWNMLGSLSTAVISVILLMVVTRLLTSADSDIYAFAYSFANMMVVVGLFQVRNYQATDI   71
            F + + ++ +A+   ++L+V+ RL T   D    Y +A       + +    ++R+   T
Sbjct:   5 FNYMFVANILSALCKFLILLVIVRLGTPEDVGRYNYALVITAPIFLFISLKIRSVIVT--   62

Query:  72 NEKYSFSQYLVARLMTCLLMLAITVIYLTLTKTDSYKSTIVFLVCFYRSTDAFSDLYQGM  131
              N+KYS ++Y+ A L   ++ L     I++ +      T + +v    +    ++  G+
Sbjct:  63 NDKYSPNEYISAILSLNIITLIFVAIFVYVLGNGDL--TTILIVSLIKLFENIKEVPYGI  120

Query: 132 FQQHERLDIAGKSLAYRNTLIFMVYTAIILYSKNLTLALVAVCIVSLVFIMYYDIGHSKK  191
            +Q++E L + G S+      N L +++  I  +S NL +AL+ + I +       D + K
Sbjct: 121 YQKNESLKLLGISMGIYNILSLILFYIIYSFSHNLNMALLFLVISCIFSFAIIDRWYLSK  180

Query: 192 FQKLMFSELLSNISFQNSLKLLKESF----PLFLNGFLIIYIYTQPKYAIELMTTLGEVA  247
            + +            + + N++     KE F       PL    + L       P+    +E +    G+
Sbjct: 181 YYNI-------KLHYNNNIAKFKEIFILTIPLAFSSALGSLNTGIPRIVLENL--FGKYT  231

Query: 248 LGS-QTIFNILFMPAFVMNLLILFFRPHITQMAIALIRGQIK-EFNKIQVQLFAYLGVF-  304
              LG   TI  +L +       N +     F P + +       L + + KEF K+  ++   ++G+F
Sbjct: 232 LGIFSTIAYVLVIGGLFANSISQVFLPKLRK----LYKDEKKIEFEKLTRKM-VFIGIFI  286

Query: 305 SLIALVGSGLFGIPFLSILYG-----TNLTDYWVDF-MLIMLGGSIGSFATVIDNILTAM  358
             + +++ S   G   LS+L+G       N+     + F +L +L G             +
Sbjct: 287 GMCSVILSLFLGEALLSLLFGKEYGENNIILIILSFGLLFILSGIFLGTTIIATGKYNVN  346

Query: 359 RKQQLLLIPYTGGFLISLLITNLFVMKYHILGAALSFLITMLVWLGLSIMIYLFIMNRF   417
              K   L+L+      F I L+ + L + KY +LGAAL+   I+    V  L    I  Y F       F
Sbjct: 347 YKISLILL-----FCI-LIFSFLLIPKYSLLGAALTITISQFVAL---ISYYYFYKRIF   396
```

Based on this analysis, it was predicted that this GAS-specific protein and its epitopes, could be useful antigens for vaccines or diagnostics.

EXAMPLE 2618

A DNA sequence (GASx792) was identified in *S. pyogenes* <SEQ ID 7735> which encodes the amino acid sequence <SEQ ID 7736>. Analysis of this protein sequence reveals the following:

```
Possible site: 36
>>> Seems to have no N-terminal signal sequence
INTEGRAL Likelihood = -10.03  Transmembrane  64-80  (60-84)
INTEGRAL Likelihood =  -9.66  Transmembrane  43-59  (37-63)
INTEGRAL Likelihood =  -8.70  Transmembrane 232-248 (229-251)
INTEGRAL Likelihood =  -8.28  Transmembrane 410-426 (402-432)
INTEGRAL Likelihood =  -6.21  Transmembrane 298-314 (296-322)
INTEGRAL Likelihood =  -6.21  Transmembrane 478-494 (471-496)
INTEGRAL Likelihood =  -5.04  Transmembrane 265-281 (256-288)
INTEGRAL Likelihood =  -3.29  Transmembrane 380-396 (378-397)
INTEGRAL Likelihood =  -2.92  Transmembrane 210-226 (209-227)
INTEGRAL Likelihood =  -2.60  Transmembrane 187-203 (187-204)
INTEGRAL Likelihood =  -2.50  Transmembrane 442-458 (439-458)
INTEGRAL Likelihood =  -1.65  Transmembrane  18-34  (18-35)
INTEGRAL Likelihood =  -1.38  Transmembrane 165-181 (165-181)

----- Final Results -----
bacterial membrane --- Certainty = 0.5012 (Affirmative) < succ>
bacterial outside  --- Certainty = 0.0000 (Not Clear)   < succ>
bacterial cytoplasm --- Certainty = 0.0000 (Not Clear)   < succ>
```

No corresponding DNA sequence was identified in *S. agalactiae*.

The protein has homology with the following sequences in the GENPEPT database:

```
>GP: BAA19642 GB: AB002668 unnamed protein product [Actinobacillus
actinomycetemcomitans]
Identities = 116/459 (25%), Positives = 207/459 (44%), Gaps = 60/459
(13%)

Query:  69 FILVFGTISAIISPINDIPDEYVHYSRTVYISEGDINLTNNNKKLRISKDVDKLI-----  123
           FIL F  I  II+P   PDE+ H+ R   IS G I  ++  K   + K + K++
Sbjct:  16 FILTF-IIGVIITPPYQSPDEFYHFQRGYAISNGQIIPSSTEK---LDKAMMKMLSIYEG   71

Query: 124 ----KQSGKTFITSNLKATKHSTREYSYPYIKGTNAYYSFSYIPQALGILVGNALDLPIL  179
               ++  T    N     +EY        TN Y+    Y+PQALG  +G+ LDL +
Sbjct:  72 IPYRSENKVTHFLENEAQNVAWEKEYILDESANTNVYFPLIYLPQALGSFLGSTDLSLY  131

Query: 180 LTYYFGRLCN-LISYAMLAFIAIKLSGSFKQVIAVVTLLPMNIYLAASFNQDGFAIGLVL  238
              YY   ++   L+S A+L F +++   S    + ++ LPM ++    S N D          ++
Sbjct: 132 NMYYLAKIFTLLVSIAILYFASVQYRLSIP--VLLILSLPMTMFQMGSTNPDS-----II  184

Query: 239 VTIGLFI-NLLSSKDKSNYNTKFFLYLVLCGLL------VLSKFTYFLLVCLPLFIPNEK  291
           ++ +FI +LL+    SNYN   F +    C LL------V  KF   +L+ LP FI   +
Sbjct: 185 FSLSVFIGSLLARGLDSNYN---FTHKDFCKLLFSIFLCVTVKFNMLVLLLLPFFISKRR  241

Query: 292 FGKNTKLVILKKLGGLLLIFLFAAMWFRLYGQVKTPYVADFLKEV----NVSQQVKNMLE  347
           ++  +  +  +  +L   + A        K   +F    +      ++ + KN L
Sbjct: 242 EIRHGSMYSIFIIILSILWIVLAMKLTEAQSHFKEGALHNFSYYIFHMDDLFEIFKNTLN  301

Query: 348 SPIVYSSIIIRHMVINLINMNNIFQFGA-LSYGITNLFPLYVCFFFFVYISNASKITINI  406
            + Y   ++R   +  L  ++    F       L +G T+L            + F++I N K+      I
Sbjct: 302 --LTYKSLLRMFLGVLGWVDTKFTINEYLFFGSTSLLA-----YIFLFIHNLYKLKYVI  354

Query: 407 VEKM--GIIFVISAIIGATVLAMYLTWTPVGSSTVLGVQSRYLIGIIPLVLLLFSS----  460
           V  + G++F+ +  I      + +T+   +G++ ++GVQ RY       IP++L++FSS
Sbjct: 355 VSVLLVGVVFLFTHFI------LLITYNEIGTTQIVGVQGRY---FIPIMLIIFSSFILK  405

Query: 461 QQQKFKQIEDILSDKLAIHVSLLFILAMLM--STIFRYY                         497
           + +K   + I  +  +        LFI + +   + + RYY
Sbjct: 406 KSEKTSNNKTISKYFIIVPFLFLFISSFITINTLVSRYY                         444
```

Based on this analysis, it was predicted that this GAS-specific protein and its epitopes, could be useful antigens for vaccines or diagnostics.

EXAMPLE 2619

A DNA sequence (GASx797) was identified in *S. pyogenes* <SEQ ID 7737> which encodes the amino acid sequence <SEQ ID 7738>. Analysis of this protein sequence reveals the following:

```
Possible site: 49
>>> Seems to have no N-terminal signal sequence
```

```
----- Final Results -----
bacterial cytoplasm --- Certainty = 0.1491 (Affirmative) < succ>
bacterial membrane  --- Certainty = 0.0000 (Not Clear)  < succ>
bacterial outside   --- Certainty = 0.0000 (Not Clear)  < succ>
```

No corresponding DNA sequence was identified in *S. agalactiae*.

The protein has homology with the following sequences in the GENPEPT database:

```
>GP: AAC83961 GB: L47648 cytidine monophosphate kinase
[Bacillus subtilis]
Identities = 116/220 (52%), Positives = 156/220 (70%), Gaps = 1/220 (0%)

Query:    2 KAIKIAIDGPASSGKSTVAKIIAKNLGYTYLDTGAMYRSATYIALTHGYTGKEVALILEE   61
            K + IAIDGPA++GKSTVAKI+A+   Y Y+DTGAMYR+ TY AL      +  + E
Sbjct:    3 KKLSIAIDGPAAAGKSTVAKIVAEKKSYIYIDTGAMYRAITYAALQENVDLTDEEKLAEL   62

Query:   62 LEKNPIFFKKAKDGSQLVFLGDEDVTLAIRQNDVTNNVSWISALPEIREELVHQQRRIAQ  121
            L++  I    KDG Q VF+   DVT AIR ++++N VS  +    +REE+V +Q+++ +
Sbjct:   63 LKRTDIELITTKDG-QKVFVNGTDVTEAIRTDEISNQVSIAAKHRSVREEMVKRQQQLGE  121

Query:  122 AGGIIMDGRDIGTVVLPDAELKIFLVASVEERAERRYKENLEKGIESDFETLKEEIAARD  181
             GG++MDGRDIGT VLP+AE+KIFL+ASVEERA+RRY+EN++KG + ++ETL EEIA RD
Sbjct:  122 KGGVVMDGRDIGTHVLPNAEVKIFLLASVEERAKRRYEENVKKGFDVNYETLIEEIARRD  181

Query:  182 YKDSHRKVSPLKAAEDALIFDTTGVSIDGVVQFIQEKAEK                      221
             DS R+VSPL+ AEDAL  DTT +SI  V   I E  E+
Sbjct:  182 KLDSEREVSPLRKAEDALEIDTTSLSIQEVADKILEAVEQ                      221
```

Based on this analysis, it was predicted that this GAS-specific protein and its epitopes, could be useful antigens for vaccines or diagnostics.

EXAMPLE 2620

A DNA sequence (GASx799) was identified in *S. pyogenes* <SEQ ID 7739> which encodes the amino acid sequence <SEQ ID 7740>. Analysis of this protein sequence reveals the following:

```
Possible site: 29
>>> Seems to have no N-terminal signal sequence

----- Final Results -----
bacterial cytoplasm --- Certainty = 0.4324 (Affirmative) < succ>
bacterial membrane  --- Certainty = 0.0000 (Not Clear)  < succ>
bacterial outside   --- Certainty = 0.0000 (Not Clear)  < succ>
```

No corresponding DNA sequence was identified in *S. agalactiae*.

The protein has homology with the following sequences in the GENPEPT database:

```
>GP: CAA34313 GB: X16188 ribosomal protein L35 (AA 1-66) [Bacillus
stearothermophilus]
Identities = 46/65 (70%), Positives = 51/65 (77%)

Query:    1 MPKQKTHRASAKRFKRTGSGGLKRFRAFTSHRFHGKTKKQRRHLRKAGLVSSGDFKRIKA   60
            MPK KTHR SAKRFK+T SG LKR  A+TSH F  KTKKQ+RHLRKA LVS GDFKRI+
Sbjct:    1 MPKMKTHRGSAKRFKKTASGKLKRGHAYTSHLFANKTKKQKRHLRKATLVSPGDFKRIRQ   60

Query:   61 MVTGL                                                         65
            M+  L
Sbjct:   61 MLDNL                                                         65
```

Based on this analysis, it was predicted that this GAS-specific protein and its epitopes, could be useful antigens for vaccines or diagnostics.

EXAMPLE 2621

A DNA sequence (GASx806R) was identified in *S. pyogenes* <SEQ ID 7741> which encodes the amino acid sequence <SEQ ID 7742>. Analysis of this protein sequence reveals the following:

```
Possible site: 16
>>> Seems to have no N-terminal signal sequence

----- Final Results -----
bacterial cytoplasm --- Certainty = 0.5361 (Affirmative) < succ>
bacterial membrane  --- Certainty = 0.0000 (Not Clear)   < succ>
bacterial outside   --- Certainty = 0.0000 (Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2622

A DNA sequence (GASx809R) was identified in *S. pyogenes* <SEQ ID 7743> which encodes the amino acid sequence <SEQ ID 7744>. Analysis of this protein sequence reveals the following:

```
Possible site: 52
>>> Seems to have no N-terminal signal sequence
INTEGRAL Likelihood = -8.81 Transmembrane 33-49 (28-53)

----- Final Results -----
bacterial membrane  --- Certainty = 0.4524 (Affirmative) < succ>
bacterial outside   --- Certainty = 0.0000 (Not Clear)   < succ>
bacterial cytoplasm --- Certainty = 0.0000 (Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2623

A DNA sequence (GASx814R) was identified in *S. pyogenes* <SEQ ID 7745> which encodes the amino acid sequence <SEQ ID 7746>. Analysis of this protein sequence reveals the following:

```
Possible site: 33
>>> Seems to have no N-terminal signal sequence

----- Final Results -----
bacterial cytoplasm --- Certainty = 0.0206 (Affirmative) < succ>
bacterial membrane  --- Certainty = 0.0000 (Not Clear)   < succ>
bacterial outside   --- Certainty = 0.0000 (Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2624

A DNA sequence (GASx817) was identified in *S. pyogenes* <SEQ ID 7747> which encodes the amino acid sequence <SEQ ID 7748>. Analysis of this protein sequence reveals the following:

```
Possible site: 13
>>> Seems to have an uncleavable N-term signal seq
INTEGRAL Likelihood = -1.49 Transmembrane 16-32 (15-32)

----- Final Results -----
bacterial membrane --- Certainty = 0.1595 (Affirmative) < succ>
bacterial outside  --- Certainty = 0.0000 (Not Clear)   < succ>
bacterial cytoplasm --- Certainty = 0.0000 (Not Clear)  < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2625

A DNA sequence (GASx820) was identified in *S. pyogenes* <SEQ ID 7749> which encodes the amino acid sequence <SEQ ID 7750>. Analysis of this protein sequence reveals the following:

```
Possible site: 31
>>> Seems to have an uncleavable N-term signal seq
INTEGRAL Likelihood =  -7.11 Transmembrane  62-78 (59-81)
INTEGRAL Likelihood =  -6.00 Transmembrane 128-144 (123-147)
INTEGRAL Likelihood =  -2.50 Transmembrane   5-21 (3-26)

----- Final Results -----
bacterial membrane --- Certainty = 0.3845 (Affirmative) < succ>
bacterial outside  --- Certainty = 0.0000 (Not Clear)   < succ>
bacterial cytoplasm --- Certainty = 0.0000 (Not Clear)  < succ>
```

No corresponding DNA sequence was identified in *S. agalactiae*.

The protein has homology with the following sequences in the GENPEPT database:

```
>GP: AAA26653 GB: M83994 prolipoprotein signal peptidase
[Staphylococcus aureus]
Identities = 57/153 (37%), Positives = 96/153 (62%), Gaps = 6/153 (3%)

Query:    1 MKKRLFVLSLILL----VALDQLSKFWIVSHIALGEVKPFIPGIVSLTYLQNNGAAFSIL   56
            M K+ F+ + IL+     V  DQ++K+ I + + +G+    IP  +++T +NNGAA+ IL
Sbjct:    1 MHKKYFIGTSILIAVFVVIFDQVTKYIIATTMKIGDSFEVIPHFLNITSHRNNGAAWGIL   60

Query:   57 QDQQWFFVVITVLVIGYAIYYLATHPHLNIWKQLALLLIISGGIGNFIDRLRLAYVIDMI  116
             +  FF +IT++++    +Y+          N++ Q+A+ L+ +G +GNFIDR+    V+D I
Sbjct:   61 SGKMTFFFIITIIILIALVYFFIKDAQYNLFMQVAISLLFAGALGNFIDRILTGEVVDFI  120

Query:  117 HLDF--VDFAIFNVADSYLTVGVILLLICLWKE                            147
            +    DF IFN+ADS LT+GVIL++I L K+
Sbjct:  121 DTNIFGYDFPIFNIADSSLTIGVILIIIALLKD                            153
```

Based on this analysis, it was predicted that this GAS-specific protein and its epitopes, could be useful antigens for vaccines or diagnostics.

EXAMPLE 2626

A DNA sequence (GASx822R) was identified in *S. pyogenes* <SEQ ID 7751> which encodes the amino acid sequence <SEQ ID 7752>. Analysis of this protein sequence reveals the following:

```
Possible site: 33
>>> Seems to have no N-terminal signal sequence

----- Final Results -----
bacterial cytoplasm --- Certainty = 0.2638 (Affirmative) < succ>
bacterial membrane  --- Certainty = 0.0000 (Not Clear)   < succ>
bacterial outside   --- Certainty = 0.0000 (Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2627

A DNA sequence (GASx823R) was identified in *S. pyogenes* <SEQ ID 7753> which encodes the amino acid sequence <SEQ ID 7754>. Analysis of this protein sequence reveals the following:

```
Possible site: 45
>>> Seems to have no N-terminal signal sequence

----- Final Results -----
bacterial cytoplasm --- Certainty = 0.3452 (Affirmative) < succ>
bacterial membrane  --- Certainty = 0.0000 (Not Clear)   < succ>
bacterial outside   --- Certainty = 0.0000 (Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2628

A DNA sequence (GASx828) was identified in *S. pyogenes* <SEQ ID 7755> which encodes the amino acid sequence <SEQ ID 7756>. Analysis of this protein sequence reveals the following:

```
Possible site: 21
>>> Seems to have an uncleavable N-term signal seq

----- Final Results -----
bacterial membrane  --- Certainty = 0.0000 (Not Clear) < succ>
bacterial outside   --- Certainty = 0.0000 (Not Clear) < succ>
bacterial cytoplasm --- Certainty = 0.0000 (Not Clear) < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2629

A DNA sequence (GASx836) was identified in *S. pyogenes* <SEQ ID 7757> which encodes the amino acid sequence <SEQ ID 7758>. Analysis of this protein sequence reveals the following:

```
Possible site: 18
>>> Seems to have no N-terminal signal sequence

----- Final Results -----
bacterial cytoplasm --- Certainty = 0.4333 (Affirmative) < succ>
```

```
                          -continued
bacterial membrane --- Certainty = 0.0000 (Not Clear) < succ>
bacterial outside  --- Certainty = 0.0000 (Not Clear) < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2630

A DNA sequence (GASx853R) was identified in *S. pyogenes* <SEQ ID 7759> which encodes the amino acid sequence <SEQ ID 7760>. Analysis of this protein sequence reveals the following:

```
Possible site: 14
>>> Seems to have no N-terminal signal sequence

----- Final Results -----
bacterial cytoplasm --- Certainty = 0.4906 (Affirmative) < succ>
bacterial membrane  --- Certainty = 0.0000 (Not Clear)   < succ>
bacterial outside   --- Certainty = 0.0000 (Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2631

A DNA sequence (GASx854R) was identified in *S. pyogenes* <SEQ ID 7761> which encodes the amino acid sequence <SEQ ID 7762>. Analysis of this protein sequence reveals the following:

```
Possible site: 43
>>> Seems to have no N-terminal signal sequence

----- Final Results -----
bacterial cytoplasm --- Certainty = 0.3989 (Affirmative) < succ>
bacterial membrane  --- Certainty = 0.0000 (Not Clear)   < succ>
bacterial outside   --- Certainty = 0.0000 (Not Clear)   < succ>
```

A related sequence was also identified in GAS <SEQ ID 9147> which encodes the amino acid sequence <SEQ ID 9148>. Analysis of this protein sequence reveals the following:

```
Possible site: 42
>>> Seems to have no N-terminal signal sequence

----- Final Results -----
bacterial cytoplasm --- Certainty = 0.399 (Affirmative) < succ>
bacterial membrane  --- Certainty = 0.000 (Not Clear)   < succ>
bacterial outside   --- Certainty = 0.000 (Not Clear)   < succ>
```

No corresponding DNA sequence was identified in *S. agalactiae*.

The protein has homology with the following sequences in the GENPEPT database:

```
>GP: AAB59092 GB: M97157 pyrogenic exotoxin C [Streptococcus pyogenes]
Identities = 39/67 (58%), Positives = 53/67 (78%)

Query:    1 LMESKEIYLTKSPYIRGSLEIHSKNRKHEKINLYDAKPNSTRSDVFKKYKDNKTINMKDF   60
            LM++ +IY   SPY+ G +EI +K+ KHE+I+L+D+    TRSD+F KYKDN+ INMK+F
Sbjct:  167 LMDNYKIYDATSPYVSGRIEIGTKDGKHEQIDLFDSPNEGTRSDIFAKYKDNRIINMKNF  226

Query:   61 SHFDIYL                                                       67
            SHFDIYL
Sbjct:  227 SHFDIYL                                                      233
```

Based on this analysis, it was predicted that this GAS-specific protein and its epitopes, could be useful antigens for vaccines or diagnostics.

EXAMPLE 2632

A DNA sequence (GASx855R) was identified in *S. pyogenes* <SEQ ID 7763> which encodes the amino acid sequence <SEQ ID 7764>. Analysis of this protein sequence reveals the following:

```
Possible site: 33
>>> Seems to have a cleavable N-term signal seq.

----- Final Results -----
bacterial outside  --- Certainty = 0.3000 (Affirmative) < succ>
bacterial membrane --- Certainty = 0.0000 (Not Clear)  < succ>
bacterial cytoplasm --- Certainty = 0.0000 (Not Clear) < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2633

A DNA sequence (GASx856) was identified in *S. pyogenes* <SEQ ID 7765> which encodes the amino acid sequence <SEQ ID 7766>. Analysis of this protein sequence reveals the following:

```
Possible site: 26
>>> Seems to have no N-terminal signal sequence

----- Final Results -----
bacterial cytoplasm --- Certainty = 0.4145 (Affirmative) < succ>
bacterial membrane  --- Certainty = 0.0000 (Not Clear)  < succ>
bacterial outside   --- Certainty = 0.0000 (Not Clear)  < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2634

A DNA sequence (GASx862) was identified in *S. pyogenes* <SEQ ID 7767> which encodes the amino acid sequence <SEQ ID 7768>. Analysis of this protein sequence reveals the following:

```
Possible site: 19
>>> Seems to have no N-terminal signal sequence

----- Final Results -----
bacterial cytoplasm --- Certainty = 0.6285 (Affirmative) < succ>
bacterial membrane  --- Certainty = 0.0000 (Not Clear)  < succ>
bacterial outside   --- Certainty = 0.0000 (Not Clear)  < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2635

A DNA sequence (GASx863) was identified in *S. pyogenes* <SEQ ID 7769> which encodes the amino acid sequence <SEQ ID 7770>. Analysis of this protein sequence reveals the following:

```
Possible site: 51
>>> Seems to have no N-terminal signal sequence

----- Final Results -----
bacterial membrane --- Certainty = 0.0000 (Not Clear) < succ>
bacterial outside --- Certainty = 0.0000 (Not Clear) < succ>
bacterial cytoplasm --- Certainty = 0.0000 (Not Clear) < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2636

A DNA sequence (GASx878) was identified in *S. pyogenes* <SEQ ID 7771> which encodes the amino acid sequence <SEQ ID 7772>. Analysis of this protein sequence reveals the following:

```
Possible site: 21
>>> Seems to have a cleavable N-term signal seq.

----- Final Results -----
bacterial outside --- Certainty = 0.3000 (Affirmative) < succ>
bacterial membrane --- Certainty = 0.0000 (Not Clear) < succ>
bacterial cytoplasm --- Certainty = 0.0000 (Not Clear) < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2637

A DNA sequence (GASx887R) was identified in *S. pyogenes* <SEQ ID 7773> which encodes the amino acid sequence <SEQ ID 7774>. Analysis of this protein sequence reveals the following:

```
Possible site: 20
>>> Seems to have no N-terminal signal sequence

----- Final Results -----
bacterial cytoplasm --- Certainty = 0.1911 (Affirmative) < succ>
bacterial membrane --- Certainty = 0.0000 (Not Clear) < succ>
bacterial outside --- Certainty = 0.0000 (Not Clear) < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2638

A DNA sequence (GASx910) was identified in *S. pyogenes* <SEQ ID 7775> which encodes the amino acid sequence <SEQ ID 7776>. Analysis of this protein sequence reveals the following:

```
Possible site: 20
>>> Seems to have no N-terminal signal sequence

----- Final Results -----
bacterial cytoplasm --- Certainty = 0.4511 (Affirmative) < succ>
bacterial membrane  --- Certainty = 0.0000 (Not Clear)   < succ>
bacterial outside   --- Certainty = 0.0000 (Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2639

A DNA sequence (GASx911) was identified in *S. pyogenes* <SEQ ID 7777> which encodes the amino acid sequence <SEQ ID 7778>. Analysis of this protein sequence reveals the following:

```
Possible site: 52
>>> Seems to have no N-terminal signal sequence

----- Final Results -----
bacterial cytoplasm --- Certainty = 0.2993 (Affirmative) < succ>
bacterial membrane  --- Certainty = 0.0000 (Not Clear)   < succ>
bacterial outside   --- Certainty = 0.0000 (Not Clear)   < succ>
```

No corresponding DNA sequence was identified in *S. agalactiae*.

The protein has homology with the following sequences in the GENPEPT database:

```
>GP: AAC74707 GB: AE000259 glutathionine S-transferase [Escherichia
coli]
Identities = 29/137 (21%), Positives = 61/137 (44%), Gaps = 9/137 (6%)

Query:    1 LPFIAKQTLKSQLIPQDNLLAESRFNEIMDFLTGDFPLVFRPMINPHRYTISQDNQALEK    60
            + ++A       QL+    N ++  +  E ++++   +    F  P+  P           E+
Sbjct:   70 MQYLADSVPDRQLLAPVNSISRYKTIEWLNYIATELHKGFTPLFRP--------DTPEE   120

Query:   61 VKQASYKRMDIAMTHLDSLIGESGHVYRDQQTIADAYAYAMALWSQKTPKSYENYPHLAA   120
            K      +++  + +++  + +    +  + TIADAY + +  W+      + E   H+AA
Sbjct:  121 YKPTVRAQLEKKLQYVNEALKDEHWICGQRFTIADAYLFTVLRWAYAVKLNLEGLEHIAA   180

Query:  121 FMAKMVEDSAVQQVLNA                                            137
            FM +M E   VQ  L+A
Sbjct:  181 FMQRMAERPEVQDALSA                                            197
```

Based on this analysis, it was predicted that this GAS-specific protein and its epitopes, could be useful antigens for vaccines or diagnostics.

EXAMPLE 2640

A DNA sequence (GASx932R) was identified in *S. pyogenes* <SEQ ID 7779> which encodes the amino acid sequence <SEQ ID 7780>. Analysis of this protein sequence reveals the following:

```
Possible site: 14
>>> Seems to have no N-terminal signal sequence

----- Final Results -----
bacterial cytoplasm --- Certainty = 0.4081 (Affirmative) < succ>
bacterial membrane  --- Certainty = 0.0000 (Not Clear)   < succ>
bacterial outside   --- Certainty = 0.0000 (Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2641

A DNA sequence (GASx935) was identified in *S. pyogenes* <SEQ ID 7781> which encodes the amino acid sequence <SEQ ID 7782>. Analysis of this protein sequence reveals the following:

```
Possible site: 45
>>> Seems to have no N-terminal signal sequence

----- Final Results -----
bacterial cytoplasm --- Certainty = 0.6304 (Affirmative) < succ>
bacterial membrane  --- Certainty = 0.0000 (Not Clear)   < succ>
bacterial outside   --- Certainty = 0.0000 (Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2642

A DNA sequence (GASx937) was identified in *S. pyogenes* <SEQ ID 7783> which encodes the amino acid sequence <SEQ ID 7784>. Analysis of this protein sequence reveals the following:

```
Possible site: 34
>>> Seems to have no N-terminal signal sequence

----- Final Results -----
bacterial cytoplasm --- Certainty = 0.3503 (Affirmative) < succ>
bacterial membrane  --- Certainty = 0.0000 (Not Clear)   < succ>
bacterial outside   --- Certainty = 0.0000 (Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2643

A DNA sequence (GASx938R) was identified in *S. pyogenes* <SEQ ID 7785> which encodes the amino acid sequence <SEQ ID 7786>. Analysis of this protein sequence reveals the following:

```
Possible site: 27
>>> Seems to have no N-terminal signal sequence

----- Final Results -----
bacterial cytoplasm --- Certainty = 0.2884 (Affirmative) < succ>
```

```
-continued
bacterial membrane --- Certainty = 0.0000 (Not Clear) < succ>
bacterial outside  --- Certainty = 0.0000 (Not Clear) < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2644

A DNA sequence (GASx939) was identified in *S. pyogenes* <SEQ ID 7787> which encodes the amino acid sequence <SEQ ID 7788>. Analysis of this protein sequence reveals the following:

```
Possible site: 50
>>> Seems to have no N-terminal signal sequence

----- Final Results -----
bacterial cytoplasm --- Certainty = 0.2771 (Affirmative) < succ>
bacterial membrane  --- Certainty = 0.0000 (Not Clear)   < succ>
bacterial outside   --- Certainty = 0.0000 (Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2645

A DNA sequence (GASx941) was identified in *S. pyogenes* <SEQ ID 7789> which encodes the amino acid sequence <SEQ ID 7790>. Analysis of this protein sequence reveals the following:

```
Possible site: 29
>>> Seems to have no N-terminal signal sequence

----- Final Results -----
bacterial cytoplasm --- Certainty = 0.2257 (Affirmative) < succ>
bacterial membrane  --- Certainty = 0.0000 (Not Clear)   < succ>
bacterial outside   --- Certainty = 0.0000 (Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2646

A DNA sequence (GASx942R) was identified in *S. pyogenes* <SEQ ID 7791> which encodes the amino acid sequence <SEQ ID 7792>. Analysis of this protein sequence reveals the following:

```
Possible site: 23
>>> Seems to have no N-terminal signal sequence

----- Final Results -----
bacterial cytoplasm --- Certainty = 0.3255 (Affirmative) < succ>
bacterial membrane  --- Certainty = 0.0000 (Not Clear)   < succ>
bacterial outside   --- Certainty = 0.0000 (Not Clear)   < succ>
```

No corresponding DNA sequence was identified in *S. agalactiae*.

The protein has homology with the following sequences in the GENPEPT database:

```
>GP: AAB91582 GB: AF242881 ymh [Agrobacterium tumefaciens] (ver 2)
Identities = 75/223 (33%), Positives = 116/223 (51%), Gaps = 2/223 (0%)

Query:  38 DQNSGFNKHKRVHNLVSDILNRTQNTDNIKLVIEYVCNPLRYINEVSIFEQLRTAINIPL    97
           D +    K R++N +   N +   +I  I     P R+  +   FE +R  +N  L
Sbjct:  39 DTDPQMTKRHRLYNAFASDQNSRKQRTHIIAFIRKAMKPERFARDSERFEPMRLNLNRAL    98

Query:  98 SLKGLIVSDSGQIVTTTTSKTLSEAKKRFETLDSRLKELKVHPHVLKFCTQELLQENYFH   157
            +  GL V  SG++        ++TLS+A +R    L + L      VHP VL+FC  +ELL +NYFH
Sbjct:  99 AFAGLAVKASGELAAVDAAETLSQATRRALELRADLTSRGVHPDVLRFCREELLVDNYFH   158

Query: 158 AVFEASKGVFHRIRLLTGSAMDSASLIDQCFKPGEPIVIINGNKLQTLDEQSEYKGLKNL   217
             AV EA K V  +IR  TG    D A L+D+ F     P++ I  N+LQ+   E+ E +G  NL
Sbjct: 159 AVLEAVKSVADKIRQRTGLTDDGAVLVDRAFSGDAPMLAI--NELQSESEKGEQRGFSNL   216

Query: 218 LLAIAHLYRNSKAHKLKYYNPDNLNDALTALTLMSLAHNLLDS                   260
            +    ++RN+ AH + +    + DA     ++ SL H  +D+
Sbjct: 217 VKGTFSMFRNTTAHAPRIHWQMSKEDAEDLFSMFSLMHRRIDA                   259
```

Based on this analysis, it was predicted that this GAS-specific protein and its epitopes, could be useful antigens for vaccines or diagnostics.

EXAMPLE 2647

A DNA sequence (GASx943R) was identified in *S. pyogenes* <SEQ ID 7793> which encodes the amino acid sequence <SEQ ID 7794>. Analysis of this protein sequence reveals the following:

```
Possible site: 30
>>> Seems to have no N-terminal signal sequence

----- Final Results -----
bacterial cytoplasm --- Certainty = 0.1526 (Affirmative) < succ>
bacterial membrane  --- Certainty = 0.0000 (Not Clear)  < succ>
bacterial outside   --- Certainty = 0.0000 (Not Clear)  < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2648

A DNA sequence (GASx944) was identified in *S. pyogenes* <SEQ ID 7795> which encodes the amino acid sequence <SEQ ID 7796>. Analysis of this protein sequence reveals the following:

```
Possible site: 19
>>> Seems to have no N-terminal signal sequence

----- Final Results -----
bacterial cytoplasm --- Certainty = 0.1427 (Affirmative) < succ>
bacterial membrane  --- Certainty = 0.0000 (Not Clear)  < succ>
bacterial outside   --- Certainty = 0.0000 (Not Clear)  < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2649

A DNA sequence (GASx945) was identified in *S. pyogenes* <SEQ ID 7797> which encodes the amino acid sequence <SEQ ID 7798>. Analysis of this protein sequence reveals the following:

```
Possible site: 13
>>> Seems to have no N-terminal signal sequence

----- Final Results -----
bacterial cytoplasm --- Certainty = 0.2578 (Affirmative) < succ>
bacterial membrane  --- Certainty = 0.0000 (Not Clear)  < succ>
bacterial outside   --- Certainty = 0.0000 (Not Clear)  < succ>
```

No corresponding DNA sequence was identified in *S. agalactiae*.

The protein has homology with the following sequences in the GENPEPT database:

```
>GP: AAC98430 GB: L29324 excisionase [Streptococcus pneumoniae]
Identities = 23/54 (42%), Positives = 40/54 (73%)

Query:   1 LIQQWEGLTVATAKQWATEMRDHPDFKQFVLNPTHRIVFIDYEGFKLFVQWKSR  54
           ++++W+GL   T  +W   EMR++  F  +V+NPTH++VFI+ EGF+ F++WK +
Sbjct:  21 ILKRWDGLNKYTLNRWIKEMRENRTFSMYVINPTHKLVFINLEGFESFLRWKQK  74
```

Based on this analysis, it was predicted that this GAS-specific protein and its epitopes, could be useful antigens for vaccines or diagnostics.

EXAMPLE 2650

A DNA sequence (GASx946) was identified in *S. pyogenes* <SEQ ID 7799> which encodes the amino acid sequence <SEQ ID 7800>. Analysis of this protein sequence reveals the following:

```
Possible site: 16
>>> Seems to have an uncleavable N-term signal seq
INTEGRAL Likelihood = -4.99 Transmembrane 3-19 (1-23)

----- Final Results -----
bacterial membrane  --- Certainty = 0.2996 (Affirmative) < succ>
bacterial outside   --- Certainty = 0.0000 (Not Clear)  < succ>
bacterial cytoplasm --- Certainty = 0.0000 (Not Clear)  < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2651

A DNA sequence (GASx950) was identified in *S. pyogenes* <SEQ ID 7801> which encodes the amino acid sequence <SEQ ID 7802>. Analysis of this protein sequence reveals the following:

```
Possible site: 51
>>> Seems to have no N-terminal signal sequence

----- Final Results -----
bacterial cytoplasm --- Certainty = 0.2211 (Affirmative) < succ>
bacterial membrane  --- Certainty = 0.0000 (Not Clear)  < succ>
bacterial outside   --- Certainty = 0.0000 (Not Clear)  < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2652

A DNA sequence (GASx951) was identified in *S. pyogenes* <SEQ ID 7803> which encodes the amino acid sequence <SEQ ID 7804>. Analysis of this protein sequence reveals the following:

```
Possible site: 30
>>> Seems to have no N-terminal signal sequence

----- Final Results -----
bacterial cytoplasm --- Certainty = 0.4258 (Affirmative) < succ>
bacterial membrane  --- Certainty = 0.0000 (Not Clear)   < succ>
bacterial outside   --- Certainty = 0.0000 (Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2653

A DNA sequence (GASx952) was identified in *S. pyogenes* <SEQ ID 7805> which encodes the amino acid sequence <SEQ ID 7806>. Analysis of this protein sequence reveals the following:

```
Possible site: 46
>>> Seems to have no N-terminal signal sequence

----- Final Results -----
bacterial cytoplasm --- Certainty = 0.2476 (Affirmative) < succ>
bacterial membrane  --- Certainty = 0.0000 (Not Clear)   < succ>
bacterial outside   --- Certainty = 0.0000 (Not Clear)   < succ>
```

No corresponding DNA sequence was identified in *S. agalactiae*.

The protein has homology with the following sequences in the GENPEPT database:

```
>GP: AAF74110 GB: AF212847 ORF245 [Lactococcus lactis bacteriophage
ul36.2]
Identities = 82/265 (30%), Positives = 128/265 (47%), Gaps = 27/265 (10%)

Query:    1 MANQLSTQQVKRDITTDPTLLTGADIKKYFDPQNLLSEKQVGQALALCKGRNLNPFANEV   60
            MAN+L     V         L   IK+Y D     S+ ++   + LCK  N+NPF  EV
Sbjct:    1 MANELGIFSVDN--------LNMTTIKQYLDGGGKASDAELVLLINLCKQNNMNPFMKEV   52

Query:   61 YIVAYKNNSGTDFSLIVSKEAFMKRAERCEGYDGFEAGITVM-RNGEMVEIEGSLKLPDD  119
            Y + Y N       ++VS++ + KRA +    + G E G+ V+ ++G +    EG+ K  +
Sbjct:   53 YFIKYGNQPA---QIVVSRDFYRKRAFQNPNFVGIEVGVIVLNKDGVLEHNEGTFKTHEQ  109

Query:  120 VLIGGWAIVYRKDRSHRYKVTVDFNEYVKLDKYGNPRSTWKSMPGTMIRKTALVQTLREA  179
            L+G  WA V+ K+        V V ++EYV++ K G+P   W + P TM+ K A  Q LR A
Sbjct:  110 ELVGAWARVHLKNTEIPVYVAVSYDEYVQM-KDGHPNKMWTNKPCTMLGKVAESQALRMA  168

Query:  180 FPDELGNMYTDIDGGDTFDAIKDVTPQETQEEVRARK---MAQIEQYKQEQ--TQKQTQK  234
            FP E   Y + +       P++    EV   K       AQIE + +E     +K  +
Sbjct:  169 FPAEFSGTYGEEEYPE--------PEKEPREVNGVKEPDRAQIESFDKEDYAAKKIEEL  219

Query:  235 ADTSYPVDEVSEHTDDPVQGELLDG                                    259
            + + P   EV  T + +   E L+G
Sbjct:  220 KEKAQPQKEVVEETGEVIDEEPLEG                                    244
```

Based on this analysis, it was predicted that this GAS-specific protein and its epitopes, could be useful antigens for vaccines or diagnostics.

EXAMPLE 2654

A DNA sequence (GASx953) was identified in *S. pyogenes* <SEQ ID 7807> which encodes the amino acid sequence <SEQ ID 7808>. Analysis of this protein sequence reveals the following:

```
Possible site: 13
>>> Seems to have no N-terminal signal sequence

----- Final Results -----
bacterial cytoplasm --- Certainty = 0.3413 (Affirmative) < succ>
bacterial membrane  --- Certainty = 0.0000 (Not Clear)   < succ>
bacterial outside   --- Certainty = 0.0000 (Not Clear)   < succ>
```

No corresponding DNA sequence was identified in *S. agalactiae*.

The protein has homology with the following sequences in the GENPEPT database:

```
>GP: AAF74111 GB: AF212847 ORF364 [Lactococcus lactis bacteriophage
ul36.2]
Identities = 67/222 (30%), Positives = 120/222 (53%), Gaps = 3/222 (1%)

Query:    1 MQELQLKVTQAQVEIIDREKFEQNINEVVAKYQNYAVTAGTIKDDKQVLADLRKLKKQLS   60
            ++++++      A + I++ EKF+ +IN+VVA+Y  +   +   D++  A L KL  ++
Sbjct:   19 VKDIEIDFKPAIINILEEEKFKASINQVVAEYTGHVPSVENLTVDRKTRASLNKLITKIE   78

Query:   61 DERIKVKKELSKPADDIDGYIKQASKPLDDTIDKIATDVKEFEDHQKALRLDTVKSYLSN  120
            R ++KK ++ P  + +G+ K+A  P++  I+ I   +K+ E  QK   R    V     L
Sbjct:   79 TRRKEIKKSINVPYAEFEGWYKKAIAPMEKVIETIDAGIKKIEAEQKESRKKVVHELLVE  138

Query:  121 KASEYMLDPRIFDEKAMEYTKAGNFMADGVTLKKVTMKSLEDLVTFEYQKEQEVEKAKAT  180
            ++  +D RIF+     ++ K+ NF + +  KK  S+  ++  E QK   E + AK +
Sbjct:  139 LTTDTEVDSRIFENFVDDWAKSSNF--NDIKPKKQLIDSITYVIDGEKQKIAEYKSAKQS  196

Query:  181 ISGQCAEYGMTDQPYIRMLKE-MTLVEVLGQIKADYLAEKQK                   221
            IS  C   +T  PYIRML    T+ E++  I  D L EKQ+
Sbjct:  197 ISDFCFGNNITSTPYIRMLDSGKTVSEIMAVITEDVLFEKQR                   238
```

Based on this analysis, it was predicted that this GAS-specific protein and its epitopes, could be useful antigens for vaccines or diagnostics.

EXAMPLE 2655

A DNA sequence (GASx954) was identified in *S. pyogenes* <SEQ ID 7809> which encodes the amino acid sequence <SEQ ID 7810>. Analysis of this protein sequence reveals the following:

```
Possible site: 56
>>> Seems to have no N-terminal signal sequence

----- Final Results -----
bacterial cytoplasm --- Certainty = 0.3884 (Affirmative) < succ>
bacterial membrane  --- Certainty = 0.0000 (Not Clear)   < succ>
bacterial outside   --- Certainty = 0.0000 (Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2656

A DNA sequence (GASx955) was identified in *S. pyogenes* <SEQ ID 7811> which encodes the amino acid sequence <SEQ ID 7812>. Analysis of this protein sequence reveals the following:

```
Possible site: 34
>>> Seems to have no N-terminal signal sequence
```

```
----- Final Results -----
bacterial cytoplasm --- Certainty = 0.1777 (Affirmative) < succ>
bacterial membrane  --- Certainty = 0.0000 (Not Clear)   < succ>
bacterial outside   --- Certainty = 0.0000 (Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2657

A DNA sequence (GASx956) was identified in *S. pyogenes* <SEQ ID 7813> which encodes the amino acid sequence <SEQ ID 7814>. Analysis of this protein sequence reveals the following:

```
Possible site: 16
>>> Seems to have no N-terminal signal sequence
INTEGRAL Likelihood = -2.44 Transmembrane 82-98 (81-98)

----- Final Results -----
bacterial membrane  --- Certainty = 0.1977 (Affirmative) < succ>
bacterial outside   --- Certainty = 0.0000 (Not Clear)   < succ>
bacterial cytoplasm --- Certainty = 0.0000 (Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2658

A DNA sequence (GASx958) was identified in *S. pyogenes* <SEQ ID 7815> which encodes the amino acid sequence <SEQ ID 7816>. Analysis of this protein sequence reveals the following:

```
Possible site: 34
>>> Seems to have no N-terminal signal sequence

----- Final Results -----
bacterial cytoplasm --- Certainty = 0.3673 (Affirmative) < succ>
bacterial membrane  --- Certainty = 0.0000 (Not Clear)   < succ>
bacterial outside   --- Certainty = 0.0000 (Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2659

A DNA sequence (GASx960) was identified in *S. pyogenes* <SEQ ID 7817> which encodes the amino acid sequence <SEQ ID 7818>. Analysis of this protein sequence reveals the following:

```
Possible site: 36
>>> Seems to have no N-terminal signal sequence
```

```
----- Final Results -----
bacterial cytoplasm --- Certainty = 0.1852 (Affirmative) < succ>
bacterial membrane  --- Certainty = 0.0000 (Not Clear)   < succ>
bacterial outside   --- Certainty = 0.0000 (Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2660

A DNA sequence (GASx961) was identified in S-pyogenes <SEQ ID 7819> which encodes the amino acid sequence <SEQ ID 7820>. Analysis of this protein sequence reveals the following:

```
Possible site: 45
>>> Seems to have no N-terminal signal sequence

----- Final Results -----
bacterial cytoplasm --- Certainty = 0.7380(Affirmative) < succ>
bacterial membrane  --- Certainty = 0.0000(Not Clear)   < succ>
bacterial outside   --- Certainty = 0.0000(Not Clear)   < succ>
```

No corresponding DNA sequence was identified in *S. agalactiae*.

The protein has homology with the following sequences in the GENPEPT database:

```
>GP: AAFE3071 GB: AF158600 gp137 [Streptococcus thermophilus
bacteriophage Sfill]
Identities = 67/136 (49%), Positives = 97/136 (71%), Gaps = 2/136 (1%)

Query:    5 PEIDIQKTKSNAKRKLREYPRWRRIANDVDTQKVTATYSFEPRQPHGTPSKPVERLALNR   64
            PEID + T    KRKLREYPRWR IA+D    QK+T  ++F PR   G  +KPVE +A+ R
Sbjct:    4 PEIDEKATLKRCKRKLREYPRWREIAHDSAEQKITQEFTFMPRG--GGVNKPVENIAVRR   61

Query:   65 VSAEQELDTIERAVNGIFDPEYRLILIDKYLLTYPKTDCDIYTKLGYEKSQYYNMLDNAL  124
            V A  EL+ IE+AVNG++ P+YR ILI+KYL   PK + I   +G+E++ +   +L+N++
Sbjct:   62 VDALNELEAIEQAVNGLYRPDYRRILIEKYLAYPPKPNWQIAQSIGFERTAFQELLNNSI  121

Query:  125 LSFSELYKEGMLLVEK                                              140
            L+F+ELY++G L+VE+
Sbjct:  122 LAFAELYRDGRLIVER                                              137
```

Based on this analysis, it was predicted that this GAS-specific protein and its epitopes, could be useful antigens for vaccines or diagnostics.

EXAMPLE 2661

A DNA sequence (GASx962) was identified in *S. pyogenes* <SEQ ID 7821> which encodes the amino acid sequence <SEQ ID 7822>. Analysis of this protein sequence reveals the following:

```
Possible site: 16
>>> Seems to have no N-terminal signal sequence

----- Final Results -----
bacterial cytoplasm --- Certainty = 0.3375 (Affirmative) < succ>
bacterial membrane  --- Certainty = 0.0000 (Not Clear)   < succ>
bacterial outside   --- Certainty = 0.0000 (Not Clear)   < succ>
```

No corresponding DNA sequence was identified in *S. aga-lactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2662

A DNA sequence (GASx963R) was identified in *S. pyogenes* <SEQ ID 7823> which encodes the amino acid sequence <SEQ ID 7824>. Analysis of this protein sequence reveals the following:

```
Possible site: 48
>>> Seems to have an uncleavable N-term signal seq

----- Final Results -----
bacterial membrane --- Certainty = 0.0000 (Not Clear) < succ>
bacterial outside  --- Certainty = 0.0000 (Not Clear) < succ>
bacterial cytoplasm --- Certainty = 0.0000 (Not Clear) < succ>
```

No corresponding DNA sequence was identified in *S. aga-lactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2663

A DNA sequence (GASx964) was identified in *S. pyogenes* <SEQ ID 7825> which encodes the amino acid sequence <SEQ ID 7826>. Analysis of this protein sequence reveals the following:

```
Possible site: 51
>>> Seems to have a cleavable N-term signal seq.
INTEGRAL Likelihood = -6.16 Transmembrane   90-106 (89-111)
INTEGRAL Likelihood = -5.52 Transmembrane  131-147 (129-150)
INTEGRAL Likelihood = -0.43 Transmembrane   53-69  (52-69)

----- Final Results -----
bacterial membrane --- Certainty = 0.3463 (Affirmative) < succ>
bacterial outside  --- Certainty = 0.0000 (Not Clear)  < succ>
bacterial cytoplasm --- Certainty = 0.0000 (Not Clear)  < succ>
```

No corresponding DNA sequence was identified in *S. aga-lactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2664

A DNA sequence (GASx965) was identified in *S. pyogenes* <SEQ ID 7827> which encodes the amino acid sequence <SEQ ID 7828>. Analysis of this protein sequence reveals the following:

```
Possible site: 15
>>> Seems to have no N-terminal signal sequence

----- Final Results -----
bacterial cytoplasm --- Certainty = 0.3944 (Affirmative) < succ>
bacterial membrane  --- Certainty = 0.0000 (Not Clear)  < succ>
bacterial outside   --- Certainty = 0.0000 (Not Clear)  < succ>
```

No corresponding DNA sequence was identified in *S. agalactiae*.

The protein has homology with the following sequences in the GENPEPT database:

```
>GP: CAA66779 GB: X98106 Rorf172 [Bacteriophage phigle]
Identities = 36/82 (43%), Positives = 52/82 (62%), Gaps = 3/82 (3%)

Query:  18 ELTEKQQRFVDKYITTFNATESAKQAGYSEKSAYSQGQRLLKNVEIQKAMKERFLEAKDT   77
           +LT KQQ+F D+YI + NA ++A++AGYS++SA S GQ  L   +I++ + ER     +
Sbjct:   4 KLTPKQQKFADEYIKSGNAADAARKAGYSKRSARSVGQENLTKPDIKQYIDERM---DEI   60

Query:  78 KGDRIQDVAETLEQDTSIARGE   99
              RI D  E +E  T IARGE
Sbjct:  61 ASKRIMDATEAVELLTRIARGE   82
```

Based on this analysis, it was predicted that this GAS-specific protein and its epitopes, could be useful antigens for vaccines or diagnostics.

EXAMPLE 2665

A DNA sequence (GASx966) was identified in *S. pyogenes* <SEQ ID 7829> which encodes the amino acid sequence <SEQ ID 7830>. Analysis of this protein sequence reveals the following:

```
Possible site: 36
>>> Seems to have no N-terminal signal sequence

----- Final Results -----
bacterial cytoplasm --- Certainty = 0.2389 (Affirmative) < succ>
bacterial membrane  --- Certainty = 0.0000 (Not Clear)   < succ>
bacterial outside   --- Certainty = 0.0000 (Not Clear)   < succ>
```

No corresponding DNA sequence was identified in *S. agalactiae*.

The protein has homology with the following sequences in the GENPEPT database:

```
>GP: CAB13115 GB: Z99110 PBSX defective prophage terminase (large
subunit) [Bacillus subtilis]
Identities = 117/417 (28%), Positives = 195/417 (46%), Gaps = 33/417 (7%)

Query:  31 YRVVKGSRGSKKSKTTALNFIVRLLKYPWANLLVIRRYSNTNKQSTYTDFKWACNQLKVT    90
           Y+ + G   GS KS  TAL   +++LLK        LVIR   +T++ ST+  F+    +L +T
Sbjct:  21 YQFLVGGYGSSKSYHTALKIVLKLLKEK-RTALVIREVFDTHRDSTFALFQEVIEELGLT    79

Query:  91 HLFKFNESLPEITVKATGQKILFRGLDDELKITSITVDVGALCWAWFEEAYQIETEDKFS   150
               S   ++       G +I+F+G+D+   K+ S     V  +   W EE  +++ E
Sbjct:  80 KAVASLSSPLQLRFH-NGSRIMFKGMDNPAKLKS----VHNISLIWIEECSEVKYEG---  131

Query: 151 TVVESIRGSLDAPDFFKQITVTFNPWSERHWLKRVFFDEETKR                  193
            + + G L  P+   +  T NP   +W  R FF +E K+
Sbjct: 132 --FKELIGRLRHPELKLHMICTTNPVGTSNWTYRHFFRDERKKRFVLDDSELYEKRTIVK  189

Query: 194 ADTFSGTTTFRVNEWLDDVDKRRYEDLYKTNPRRARIVCDGEWGVAEGLVFDNFEVVDFD  253
              DT+   +T   N +L +   ++ + L + +P   RI   G +GV     V    FEV+  D
Sbjct: 190 GDTYYHHSTANDNLFLPESYVKQLDGLKEYDPDLYRIARKGRFGVNGIRVLPQFEVLPHD  249

Query: 254 -VEKTIQRVKET--SAGMDFGFTQDPTTLICVAVDLANKELWLYNEHYQKAMLTDHIVKM  310
            V+K I  + +    GMDFGF +     ++ +AVD   K L++Y E+YQ  M  D   +
Sbjct: 250 QVKKCIAAISKPIFRTGMDFGFEESYNAVVRLAVDPEKKYLYIYWEYYQNKMTDDRTAEE  309

Query: 311 IRDKNLHRSYIAGDSAEKRLIAEIKSKGVSGIVPSIKGKGSIMQGIQFMQGF-KIYIHPS  369
            +R+   +   I DSAE + I   +G   +V + K   GS +Q  + ++ F KI+
Sbjct: 310 LREFIETQELIKADSAEPKSIQYFRQQGFR-MVGARKFPGSRLQYTKKVKRFKKIFCSDR  368

Query: 370 CEHTIEEFNTYTFKQDKEGNWLNEPIDKNNHVIDAIRYALEKYHIRSNESNQFEVLR    426
           CE+ I E  T T+ +DK G  + +        + H +AI YAL+ Y +     + +R
Sbjct: 369 CENVIYELETLTYAKDKNGALIEDEFTIDPHTLSAIWYALDDYEVADMKETAHKRMR    425
```

Based on this analysis, it was predicted that this GAS-specific protein and its epitopes, could be useful antigens for vaccines or diagnostics.

EXAMPLE 2666

A DNA sequence (GASx967) was identified in *S. pyogenes* <SEQ ID 7831> which encodes the amino acid sequence <SEQ ID 7832>. Analysis of this protein sequence reveals the following:

```
Possible site: 32
>>> Seems to have no N-terminal signal sequence

----- Final Results -----
bacterial cytoplasm --- Certainty = 0.4899 (Affirmative) < succ>
bacterial membrane  --- Certainty = 0.0000 (Not Clear)  < succ>
bacterial outside   --- Certainty = 0.0000 (Not Clear)  < succ>
```

No corresponding DNA sequence was identified in *S. agalactiae*.

The protein has homology with the following sequences in the GENPEPT database:

```
>GP: AAC34397 GB: AF158600 gp502 [Streptococcus thermophilus
bacteriophage Sfi11]
Identities = 67/114 (58%), Positives = 83/114 (72%)

Query:    6 FRDSTGKTKTLEFRFHREARMRYQAESLESLLTEKYKLLREMIEHHDKVQKPRIQELLDY    65
            F DSTG+    L  RFHRE+R+RY+A++LE L+    ++LL+  I HH   Q PRIQELLDY
Sbjct:    7 FTDSTGQDLVLNLRFHRESRIRYRADNLEELMVNNWELLKNFINHHKLRQAPRIQELLDY   66

Query:   66 AEGNNHTISEIGRRKDDDMADVRAVHNYGKYISTLKQGYLVGNPIRVEYIDGTE        119
            A G NH + +  GRRKD++MAD RAVHNYG+ IS  K GYL GNPIRVEY D  +
Sbjct:   67 ARGENHDVLKSGRRKDNEMADKRAVHNYGRMISKFKTGYLAGNPIRVEYDDNED        120
```

Based on this analysis, it was predicted that this GAS-specific protein and its epitopes, could be useful antigens for vaccines or diagnostics.

EXAMPLE 2667

A DNA sequence (GASx968) was identified in *S. pyogenes* <SEQ ID 7833> which encodes the amino acid sequence <SEQ ID 7834>. Analysis of this protein sequence reveals the following:

```
Possible site: 34
>>> Seems to have no N-terminal signal sequence

----- Final Results -----
bacterial cytoplasm --- Certainty = 0.4007 (Affirmative) < succ>
bacterial membrane  --- Certainty = 0.0000 (Not Clear)  < succ>
bacterial outside   --- Certainty = 0.0000 (Not Clear)  < succ>
```

No corresponding DNA sequence was identified in *S. agalactiae*.

The protein has homology with the following sequences in the GENPEPT database:

```
>GP: AAC34397 GB: AF158600 gp502 [Streptococcus thermophilus
bacteriophage Sfi11]
Identities = 172/319 (53%), Positives = 227/319 (70%), Gaps = 9/319 (2%)

Query:    1 LIYRSMDDKTEVVRLDPREVFVIYQNNLEQSSLAGVRYYNKNQLDGTTKIVELYTDNKIL    60
            +IYRS  D+T + RL P E FVIY N+LE +S+A VRYYN+  L     +VE+YT+ I
Sbjct:  157 VIYRSEYDETRIKRLSPLETFVIYDNSLEDNSIAAVRYYNRGTLQNAKDVVEIYTNQHIY  216

Query:   61 KFEYDGDLTPIGETSSHAFGSVPITEYLNTDDGMGDYETELSLIDLYDAAQSDTANYMQD   120
            +         I T  HAFG+VPITE+LN  DG+GDYETEL LIDLYD+A+SDTAN+M D
Sbjct:  217 TLDASDSFNEISVTP-HAFGTVPITEFLNNADGIGDYETELYLIDLYDSAESDTANHMSD  275

Query:  121 LSDAILAIIGRVSFPGYVDTAEKAIEYLRKMRKARLLNLEPPVDQDGREGSVDAKYLYKQ   180
            ++DAILAI G ++ P  +   ++     M++ RL+ L+PP   DG+EG+V A+YL K
Sbjct:  276 MADAILAIYGDLALPQGMQASD--------MKRTRLMQLKPPKSADGKEGTVKAEYLTKS  327

Query:  181 YDVQGTEAYKNRIVSDIHKFTNTPDMTDSKFAGQQSGEALKWKVFGLDQERVDMQALFEQ   240
```

-continued

```
                  YDV G EAYK R+   DIH FTNTPDM+D+ F+G  SGEALK+K+FGLDQ+RVD Q+F Q
Sbjct: 328 YDVSGAEAYKTRLNKDIHVFTNTPDMSDNHFSGNASGEALKYKLFGLDQDRVDTQSQFTQ 387

Query: 241 SLKRRYKLIARVSQLLKEIDDFDISKLKITFTPNLPKSLQEKIEAFKALGGELSQETAMA 300
           LKRRY+L AR+  L+ E  DFD S+LKITFTPNLPKSL E++     LGG++SQETA++
Sbjct: 388 GLKRRYRLAARIGSLVNEFKDFDESRLKITFTPNLPKSLYEQVSILNDLGGQVSQETALS 447

Query: 301 ITDIVEDAKKEISLINSES                                         319
           ++ +VE+  +E+  IN ES
Sbjct: 448 LSGLVENPTEELDKINEES                                         466
```

Based on this analysis, it was predicted that this GAS-specific protein and its epitopes, could be useful antigens for vaccines or diagnostics.

EXAMPLE 2668

A DNA sequence (GASx969) was identified in *S. pyogenes* <SEQ ID 7835> which encodes the amino acid sequence <SEQ ID 7836>. Analysis of this protein sequence reveals the following:

```
Possible site: 21
>>> Seems to have no N-terminal signal sequence

----- Final Results -----
bacterial cytoplasm --- Certainty = 0.5307 (Affirmative) < succ>
bacterial membrane  --- Certainty = 0.0000 (Not Clear)   < succ>
bacterial outside   --- Certainty = 0.0000 (Not Clear)   < succ>
```

No corresponding DNA sequence was identified in *S. agalactiae*.

The protein has homology with the following sequences in the GENPEPT database:

```
>GP: AAC79543 GB: U88974 ORF28 [Streptococcus thermophilus temperate
bacteriophage O1205]
Identities = 118/309 (38%), Positives = 183/309 (59%), Gaps = 18/309 (5%)

Query:   8 YWRDRIKKEMDAK-EADDISLEQSMKQLHDYHFRNIEKEIESFYQRYADKEKIDLSEARK  66
           YW  R  +E +A  +   ++ ++ L++      + KE++++ Q+YA+K  + +S+A++
Sbjct:   3 YWSKRTLREREASIKKGEAEFKKELEALYNLQSQLRKELDAYIQKYANKNGLSVSDAKR  62

Query:  67 RASELDISAYQKKAKELVAKAEKLRREGKIVTRDDFTHQENADMSIYNLAMKTNALELLR 126
           +A   D+ A++ KAK  VA              DF+ + N ++  YN +M     ELL
Sbjct:  63 KADSFDVKAFETKAKRYVADK-------------DFSPKANRELQDYNFSMSVGRQELLI 109

Query: 127 LNIDLEMQELANGEHKLTKKFLDEGYRKETEFQAGLLGLSVASQASVKSLADAVINANFK 186
           ++LE+  L+  E +LT  +L  GY+ E   +   LL  +V S  ++   A +NANF+
Sbjct: 110 QELELELLALSESERQLTNDYLTNGYKSEV-VRESLLDQTVPSGKTLEKYMKAAVNANFE 168

Query: 187 GAKWSDNIWDRQDKLRSIISQSVQSAILKGKNGLTIARDIRREFDVSASYAKRLAITEHA 246
           GA+WS+ IW RQ++LR I+   V  A+++G+NGLTIAR IR+  D S + A+RLAITEHA
Sbjct: 169 GAEWSERIWKRQEQLRKIVKTEVTRALIRGENGLTIARRIRKHMDASRTEAERLAITEHA 228

Query: 247 RVQMEVGRLSMAENGFAMFDILPEPKACDVCKDIAKH---GPYHLDKWRIGENSPPFHPY 303
           RVQ      M ENGF  F ++PE +ACD+CKDI K       P +     IG N+PP HPY
Sbjct: 229 RVQTLAQESIMKENGFEHFKLMPESRACDICKDIGKETEKNPVKIADMEIGTNAPPIHPY 288

Query: 304 CRCAIVGVD                                                   312
           CRCA+V V+
Sbjct: 289 CRCAVVEVE                                                   297
```

Based on this analysis, it was predicted that this GAS-specific protein and its epitopes, could be useful antigens for vaccines or diagnostics.

EXAMPLE 2669

A DNA sequence (GASx970) was identified in *S. pyogenes* <SEQ ID 7837> which encodes the amino acid sequence <SEQ ID 7838>. Analysis of this protein sequence reveals the following:

```
Possible site: 15
>>> Seems to have no N-terminal signal sequence

----- Final Results -----
bacterial cytoplasm --- Certainty = 0.2091 (Affirmative) < succ>
bacterial membrane  --- Certainty = 0.0000 (Not Clear)   < succ>
bacterial outside   --- Certainty = 0.0000 (Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2670

A DNA sequence (GASx971) was identified in *S. pyogenes* <SEQ ID 7839> which encodes the amino acid sequence <SEQ ID 7840>. Analysis of this protein sequence reveals the following:

```
Possible site: 28
>>> Seems to have a cleavable N-term signal seq.

----- Final Results -----
bacterial outside   --- Certainty = 0.3000 (Affirmative) < succ>
bacterial membrane  --- Certainty = 0.0000 (Not Clear)   < succ>
bacterial cytoplasm --- Certainty = 0.0000 (Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2671

A DNA sequence (GASx972) was identified in *S. pyogenes* <SEQ ID 7841> which encodes the amino acid sequence <SEQ ID 7842>. Analysis of this protein sequence reveals the following:

```
Possible site: 46
>>> Seems to have no N-terminal signal sequence

----- Final Results -----
bacterial cytoplasm --- Certainty = 0.3226 (Affirmative) < succ>
bacterial membrane  --- Certainty = 0.0000 (Not Clear)   < succ>
bacterial outside   --- Certainty = 0.0000 (Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2672

A DNA sequence (GASx973) was identified in *S. pyogenes* <SEQ ID 7843> which encodes the amino acid sequence <SEQ ID 7844>. Analysis of this protein sequence reveals the following:

```
Possible site: 29
>>> Seems to have no N-terminal signal sequence

----- Final Results -----
bacterial cytoplasm --- Certainty = 0.1830 (Affirmative) < succ>
```

```
bacterial membrane --- Certainty = 0.0000 (Not Clear) < succ>
bacterial outside  --- Certainty = 0.0000 (Not Clear) < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2673

A DNA sequence (GASx975) was identified in *S. pyogenes* <SEQ ID 7845> which encodes the amino acid sequence <SEQ ID 7846>. Analysis of this protein sequence reveals the following:

```
Possible site: 45
>>> Seems to have no N-terminal signal sequence

----- Final Results -----
bacterial cytoplasm --- Certainty = 0.4757 (Affirmative) < succ>
bacterial membrane  --- Certainty = 0.0000 (Not Clear)   < succ>
bacterial outside   --- Certainty = 0.0000 (Not Clear)   < succ>
```

No corresponding DNA sequence was identified in *S. agalactiae*.

The protein has homology with the following sequences in the GENPEPT database:

```
>GP: BAB07248 GB: AP001519 unknown [Bacillus halodurans]
Identities = 46/134 (34%), Positives = 73/134 (54%)

Query:   23 KQPQDEKKYTDADVDAIIDKKFAKWKSEQEAEKSEAKKMAKMNEKEKADYEKQKLLDELQ    82
            K  + E+ +T  +V+ I+  + A+    ++E      EA+K+AKMN ++K +YE +KL  E +
Sbjct:   66 KPNKTERLFTQEEVNRIVKDRLARALKDKEEAIKEAEKLAKMNAEQKREYELEKLRRENE   125

Query:   83 ELKNDKTRNELTAVARQMFAESEINVNDDVLGLVVTLDAEQTKANVTTLANAFAKVIADD   142
            +LK  + R EL   A +M  E+  I  +DDVL  VV   DAEQT+  V T   +    K+
Sbjct:  126 QLKKAQMRYELGREATKMLGEAGIMADDDVLSFVVRDDAEQTQEAVKTFISLVDKLADMR   185

Query:  143 RKALVRQTTPSTGG                                                156
            +K  ++      P    G
Sbjct:  186 MKEKLKGRPPKKDG                                                199
```

Based on this analysis, it was predicted that this GAS-specific protein and its epitopes, could be useful antigens for vaccines or diagnostics.

EXAMPLE 2674

A DNA sequence (GASx976) was identified in *S. pyogenes* <SEQ ID 7847> which encodes the amino acid sequence <SEQ ID 7848>. Analysis of this protein sequence reveals the following:

```
Possible site: 24
>>> Seems to have no N-terminal signal sequence

----- Final Results -----
bacterial cytoplasm --- Certainty = 0.2478 (Affirmative) < succ>
bacterial membrane  --- Certainty = 0.0000 (Not Clear)   < succ>
bacterial outside   --- Certainty = 0.0000 (Not Clear)   < succ>
```

No corresponding DNA sequence was identified in *S. agalactiae*.

The protein has homology with the following sequences in the GENPEPT database:

```
>GP: AAC79545 GB: U88974 ORF30 [Streptococcus thermophilus temperate
bacteriophage O1205]
Identities = 43/119 (36%), Positives = 66/119 (55%), Gaps = 16/119 (13%)
```

```
                          -continued
Query:    9 SKEILHNLDYEAISVTLDSNKIG-----KKVVPAGTILAGKDKSIFEDRKQKVETVTNEE   63
            +  I+ +L Y+A+S T+DS+  G      KK + AGT++AG   SIF+DR + V
Sbjct:    9 TSNIVRSLPYKAVSATVDSSYPGVLVDGKKYIKAGTLVAGNGGSIFDDRTKSV-------   61

Query:   64 VSTKEYVDGILLTDVDLTNGDAVGSCVYRGTINADKLADSSVAENYDDLEEVLPHIVFI  122
            V  K   +GI+L DVDLT  + V S +Y G +  DK+     +   D +++ LP + FI
Sbjct:   62 VENKTEPEGIVLYDVDLTIDNTV-SVLYAGEVYKDKVNGGDIT---DTVKKALPLVKFI  116
```

Based on this analysis, it was predicted that this GAS-specific protein and its epitopes, could be useful antigens for vaccines or diagnostics.

EXAMPLE 2675

A DNA sequence (GASx978) was identified in *S. pyogenes* <SEQ ID 7849> which encodes the amino acid sequence <SEQ ID 7850>. Analysis of this protein sequence reveals the following:

```
Possible site: 60
>>> Seems to have no N-terminal signal sequence

----- Final Results -----
bacterial cytoplasm --- Certainty = 0.4138 (Affirmative) < succ>
bacterial membrane  --- Certainty = 0.0000 (Not Clear)   < succ>
bacterial outside   --- Certainty = 0.0000 (Not Clear)   < succ>
```

No corresponding DNA sequence was identified in *S. agalactiae*.

The protein has homology with the following sequences in the GENPEPT database:

```
>GP: AAC79546 GB: U88974 ORF31 [Streptococcus thermophilus temperate
bacteriophage 01205]
Identities = 195/343 (56%), Positives = 256/343 (73%), Gaps = 1/343 (0%)

Query:    1 MALIHEIITSENIKGFYNAKNENVENTLGEKAFPPKQQLGLKLSFIKGAAGKPVTLKAAA   60
            M LI++ +T+ NI G++NA  ENV +TLGE  FP ++QLG KLS+IKGA+G+ V LKAAA
Sbjct:    1 MGLIYDKVTASNIAGYFNALQENVSSTLGESIFPARKQLGTKLSYIKGASGQSVALKAAA   60

Query:   61 FDTKVPLRDRMAVELIDEEMPFFKEAMLVKEADRQQLNMLAQTKNNELIDTILASIYNDQ  120
            FDT V +RDR++  E+ DE+MPFFKEAMLVKE DRQQLN++   + N   L++TI+A I+ND
Sbjct:   61 FDTNVTIRDRVSAEMHDEQMPFFKEAMLVKENDRQQLNLVKDSGNAVLVNTIVAGIFNDN  120

Query:  121 ATLIAGAKARLEAMRMEVLSKGKIHIQSNGVMKDIDYGLAEDQTTKPDAKWDSAGTATPL  180
              TL+ GA+ARLEAMRM+VL+ GKI    S+GV KDIDYG+  D  +   W   G ATPL
Sbjct:  121 LTLVNGARARLEAMRMQVLATGKIAFTSDGVNKDIDYGVKPDHKKQVSKSWAEPG-ATPL  179

Query:  181 KDIEKAIEKMAERGFVPEAIIMNSKTFSLIKNAESTLDVVKPMAPNGAAVTKRDLNTYLE  240
              D+E AIE   E G   PE  +MN+KTF LI+ A ST+ V+KP+A +G+AVTK +L  Y+
Sbjct:  180 ADLEDAIETARELGLNPERAVMNAKTFGLIRKAASTVKVIKPLAGDGSAVTKAELENYIA  239

Query:  241 DELQIKVILKDGMFVGDDGESRKYFPDGFATLVPNGNLGYTVFGTTPEQSDLLGGEATDA  300
            D     + ++L++G   +  D GE  K++PDG  TL+PNG LG TVFGTTPE+SDL       +A
Sbjct:  240 DNFGVSIVLENGTYRNDKGEVSKFYPDGHLTLIPNGPLGNTVFGTTPEESDLFADNTVNA  299

Query:  301 NVSIVETGIAITTTKTTDPVNVQTKVSMIALPSFERLEEVHII                  343
              V IV+ GIA+TTTKTTDPVNVQTKVSM+ALPSFERL++V+++
Sbjct:  300 EVEIVDNGIAVTTTKTTDPVNVQTKVSMVALPSFERLDDVYML                  342
```

Based on this analysis, it was predicted that this GAS-specific protein and its epitopes, could be useful antigens for vaccines or diagnostics.

EXAMPLE 2676

A DNA sequence (GASx979) was identified in *S. pyogenes* <SEQ ID 7851> which encodes the amino acid sequence <SEQ ID 7852>. Analysis of this protein sequence reveals the following:

```
Possible site: 46
>>> Seems to have no N-terminal signal sequence
```

```
----- Final Results -----
bacterial cytoplasm --- Certainty = 0.3319 (Affirmative) < succ>
bacterial membrane  --- Certainty = 0.0000 (Not Clear)  < succ>
bacterial outside   --- Certainty = 0.0000 (Not Clear)  < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2677

A DNA sequence (GASx980) was identified in *S. pyogenes* <SEQ ID 7853> which encodes the amino acid sequence <SEQ ID 7854>. Analysis of this protein sequence reveals the following:

```
Possible site: 55
>>> Seems to have no N-terminal signal sequence

----- Final Results -----
bacterial cytoplasm --- Certainty = 0.2385 (Affirmative) < succ>
bacterial membrane  --- Certainty = 0.0000 (Not Clear)  < succ>
bacterial outside   --- Certainty = 0.0000 (Not Clear)  < succ>
```

No corresponding DNA sequence was identified in *S. agalactiae*.

The protein has homology with the following sequences in the GENPEPT database:

```
>GP: AAC34404 GB: AF158600 gp113 [Streptococcus thermophilus
bacteriophage Sfi11]
Identities = 53/109 (48%), Positives = 79/109 (71%), Gaps = 4/109 (3%)

Query:  11 IVKNVKLDLGIEDDNQDQLLEMLLNRITDHFKANYGVLEIDNAFSFVLEDCLIARFNRRG    70
            +++NV +DL I DDN   LL +LL RI +HFKA YGV E+D+   +F+ EDCL+ RFNRRG
Sbjct:   9 VIQNVSVDLNINDDN---LLGILLERIVNHFKAEYGVDEVDDNLAFIFEDCLVKRFNRRG    65

Query:  71 SERAKTEEVEGHKTTYYDHLNEFEPYDAMIMAKLNLIKDKSRKGGLYFL               119
            +E A++E ++GH  +YYD+ NEF+PYD M+  +L      ++++G + FL
Sbjct:  66 AEGARSESIDGHSMSYYDNENEFDPYDNMLQ-RLYGTSGQAKEGEVLFL               113
```

Based on this analysis, it was predicted that this GAS-specific protein and its epitopes, could be useful antigens for vaccines or diagnostics.

EXAMPLE 2678

A DNA sequence (GASx981) was identified in *S. pyogenes* <SEQ ID 7855> which encodes the amino acid sequence <SEQ ID 7856>. Analysis of this protein sequence reveals the following:

```
Possible site: 49
>>> Seems to have no N-terminal signal sequence

----- Final Results -----
bacterial cytoplasm --- Certainty = 0.5714 (Affirmative) < succ>
bacterial membrane  --- Certainty = 0.0000 (Not Clear)  < succ>
bacterial outside   --- Certainty = 0.0000 (Not Clear)  < succ>
```

No corresponding DNA sequence was identified in *S. agalactiae*.

The protein has homology with the following sequences in the GENPEPT database:

```
>GP: CAA59188 GB: X84706 b3 [Bacteriophage B1]
Identities = 28/82 (34%), Positives = 49/82 (59%), Gaps = 2/82 (2%)

Query:   1 MRYADRVTFVKTT-DEQYNPDLGEYTHTEVISITKPCFVMDMGMEKSVQIFGDYQKDRKV   59
```

```
                +RY D VTF+K  + D   Y+PDLGE+     E          + D+G ++SV++FGD +K   KV
Sbjct:    1 LRYLDEVTFIKESPDSHYDPDLGEWVEKEPTRTVFSANITDIGTDRSVEVFGDIKKGAKV    60

Query:   60 IYLKQPYT-KAFDYCEYEGRRY                                           80
              + +    +    +DY E++ +++
Sbjct:   61 MRMMPLFNMPKYDYIEFDNKKW                                           82
```

Based on this analysis, it was predicted that this GAS-specific protein and its epitopes, could be useful antigens for vaccines or diagnostics.

EXAMPLE 2679

A DNA sequence (GASx982) was identified in *S. pyogenes* <SEQ ID 7857> which encodes the amino acid sequence <SEQ ID 7858>. Analysis of this protein sequence reveals the following:

```
Possible site: 14
>>> Seems to have no N-terminal signal sequence

----- Final Results -----
bacterial cytoplasm --- Certainty = 0.2509 (Affirmative) < succ>
bacterial membrane  --- Certainty = 0.0000 (Not Clear)   < succ>
bacterial outside   --- Certainty = 0.0000 (Not Clear)   < succ>
```

No corresponding DNA sequence was identified in *S. agalactiae*.

The protein has homology with the following sequences in the GENPEPT database:

```
>GP: AAC34406 GB: AF158600 gp114 [Streptococcus thermophilus
bacteriophage Sfi11]
Identities = 44/103 (42%), Positives = 65/103 (62%), Gaps = 5/103 (4%)

Query:   17 GLKKKLELIIKKDAVKK---IVRDNGTQLQRKMINKAVFTKGYSTGATRRSITMQIGDGG    73
            GL  +  + ++K  + +K    ++R  G++L+    +N+A F KGYSTGATRRSIT+Q+
Sbjct:    8 GLDEMAQSLLKNASPEKRSKVLRKYGSKLKEAAVNRAQFNKGYSTGATRRSITLQVESDK    67

Query:   74 LSVKVKPGTHYAGYLERGTRLMSKQPFVLPALKEQKVKFRKDL                     116
              +V+    T Y+GYLE GTR M  QPF+ PAL E     K  ++L
Sbjct:   68 ATVEAL--TSYSGYLEVGTRKMEAQPFMKPALDEVAPKMVEEL                     108
```

Based on this analysis, it was predicted that this GAS-specific protein and its epitopes, could be useful antigens for vaccines or diagnostics.

EXAMPLE 2680

A DNA sequence (GASx983) was identified in *S. pyogenes* <SEQ ID 7859> which encodes the amino acid sequence <SEQ ID 7860>. Analysis of this protein sequence reveals the following:

```
Possible site: 45
>>> Seems to have no N-terminal signal sequence

----- Final Results -----
bacterial cytoplasm --- Certainty = 0.3098 (Affirmative) < succ>
bacterial membrane  --- Certainty = 0.0000 (Not Clear)   < succ>
bacterial outside   --- Certainty = 0.0000 (Not Clear)   < succ>
```

No corresponding DNA sequence was identified in *S. agalactiae*.

The protein has homology with the following sequences in the GENPEPT database:

```
>GP: AAA32612 GB: L31366 putative [Bacteriophage Tuc2009]
Identities = 88/129 (68%), Positives = 108/129 (83%)

Query:    1 MIKTRDQSIFDEMFKRIQSLGFKVYDYKPMTEVPYPFVEMESTDAEYIPNKDDIKGSVEL    60
            MIKTRDQSIFDE+FKRIQ+LG+ VYDYKPM EV YPFVE+E+T   +  NK DIKG+V L
```

-continued

```
Sbjct:    1 MIKTRDQSIFDELFKRIQALGYTVYDYKPMNEVGYPFVELENTQTIHEANKTDIKGTVSL    60

Query:   61 MLSVWGVQKKRKQVSDMASAIFSQALTVESSDVFRWSLNTRQSSIQMLDDTTTVTPLKRA   120
             L SVWG+QKKRK+VSDMAS IF+QAL + ++D + W+LN++ S+IQMLDDTTT TPLKRA
Sbjct:   61 SLSVWGLQKKRKEVSDMASNIFNQALNISATDGYSWALNSQASTIQMLDDTTTHTPLKRA   120

Query:  121 IVTLRFNLR                                                     129
             ++ L F LR
Sbjct:  121 LINLEFRLR                                                     129
```

Based on this analysis, it was predicted that this GAS-specific protein and its epitopes, could be useful antigens for vaccines or diagnostics.

EXAMPLE 2681

A DNA sequence (GASx984R) was identified in *S. pyogenes* <SEQ ID 7861> which encodes the amino acid sequence <SEQ ID 7862>. Analysis of this protein sequence reveals the following:

```
Possible site: 36
>>> Seems to have no N-terminal signal sequence

----- Final Results -----
bacterial cytoplasm --- Certainty = 0.1736 (Affirmative) < succ>
bacterial membrane  --- Certainty = 0.0000 (Not Clear)   < succ>
bacterial outside   --- Certainty = 0.0000 (Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2682

A DNA sequence (GASx985) was identified in *S. pyogenes* <SEQ ID 7863> which encodes the amino acid sequence <SEQ ID 7864>. Analysis of this protein sequence reveals the following:

```
Possible site: 27
>>> Seems to have no N-terminal signal sequence

----- Final Results -----
bacterial membrane  --- Certainty = 0.0000 (Not Clear) < succ>
bacterial outside   --- Certainty = 0.0000 (Not Clear) < succ>
bacterial cytoplasm --- Certainty = 0.0000 (Not Clear) < succ>
```

No corresponding DNA sequence was identified in *S. agalactiae*.

The protein has homology with the following sequences in the GENPEPT database:

```
>GP: AAA32613 GB: L31366 structural protein [Bacteriophage Tuc2009]
Identities = 81/185 (43%), Positives = 111/185 (59%), Gaps = 22/185 (11%)

Query:    4 QLEAKQGIHSILLFRLLKEASSEAATKLAFQTEHEVGKSRDVDGQKTKDGIIQSVGALEY    63
            +L AKQG   ILL+RLL +A+ EAA KLAFQTEH   K+RD +   TKDG I S+ A+EY
Sbjct:    3 ELTAKQGKDIILLYRLLSKATKEAAWKLAFQTEHSNEKTRDYNTTATKDGTIGSLAAIEY    62

Query:   64 DFKATSILAKGDVLAAKLEKAMENGELVEIWDIDLEETSKNGDSDNKLANVWGIDKNGTN   123
               ATSI A GD     +++KA ++GE++++W+ID  E
Sbjct:   63 SLSATSIAANGDPHLDEMDKAFDDGEIIDVWEIDKAEKG---------------------  101

Query:  124 RGNGKYLATYYQGYISSFSAKKNAEENIEIEMEFAINGVGQKGFATLTDAQKAAVQYAFK   183
             +GKY A Y + Y++SFS + N+E+ +E+ +EF + G  QKG ATLT+ Q   VQY FK
Sbjct:  102 -SDGKYKAKYLRAYLTSFSYEPNSEDALELSLEFGVFGKPQKGQATLTEEQANVVQYVFK   160

Query:  184 DTTKG                                                         188
            DT  G
Sbjct:  161 DTVAG                                                         165
```

Based on this analysis, it was predicted that this GAS-specific protein and its epitopes, could be useful antigens for vaccines or diagnostics.

EXAMPLE 2683

A DNA sequence (GASx986) was identified in *S. pyogenes* <SEQ ID 7865> which encodes the amino acid sequence <SEQ ID 7866>. Analysis of this protein sequence reveals the following:

```
Possible site: 55
>>> Seems to have no N-terminal signal sequence

----- Final Results -----
bacterial cytoplasm --- Certainty = 0.2273 (Affirmative) < succ>
bacterial membrane --- Certainty = 0.0000 (Not Clear) < succ>
bacterial outside --- Certainty = 0.0000 (Not Clear) < succ>
```

No corresponding DNA sequence was identified in *S. agalactiae.*

The protein has homology with the following sequences in the GENPEPT database:

```
>GP: CAA59192 GB: X84706 a2 [Bacteriophage B1]
Identities = 54/111 (48%), Positives = 72/111 (64%), Gaps = 1/111 (0%)

Query:   1 MQLEIKGKTHNVKFGTRFVAEMDKNHIAERQGFKFGAGLQSSV-PFLIDHSVVTLAEVIY   59
           M+L IKGK  + KFG +FV E+DKN + E+ G  FG  L    + P L   ++ TL+ V++
Sbjct:   1 MELTIKGKQVHFKFGVKFVRELDKNLVIEQNGVSFGLALAVKIIPELEMANIATLSNVLF   60

Query:  60 TGTITEPPRPSLNDIYDYIDEVEDIEKLFDDVLDELRQSNASKLFMAQVEK           110
             G  TE P+ S  DI D+IDE EDIEKLFDDVL E+ +SN  KL  A++ K
Sbjct:  61 LGNRTETPKLSQGDIDDFIDECEDIEKLFDDVLKEITESNTGKLIKAKMTK           111
```

Based on this analysis, it was predicted that this GAS-specific protein and its epitopes, could be useful antigens for vaccines or diagnostics.

EXAMPLE 2684

A DNA sequence (GASx987) was identified in *S. pyogenes* <SEQ ID 7867> which encodes the amino acid sequence <SEQ ID 7868>. Analysis of this protein sequence reveals the following:

```
Possible site: 36
>>> Seems to have no N-terminal signal sequence

----- Final Results -----
bacterial cytoplasm --- Certainty = 0.2735 (Affirmative) < succ>
bacterial membrane --- Certainty = 0.0000 (Not Clear) < succ>
bacterial outside --- Certainty = 0.0000 (Not Clear) < succ>
```

No corresponding DNA sequence was identified in *S. agalactiae.*

The protein has homology with the following sequences in the GENPEPT database:

```
>GP: CAA59193 GB: X84706 c2 [Bacteriophage B1]
Identities = 40/111 (36%), Positives = 57/111 (51%), Gaps = 10/111 (9%)

Query:   2 IVLNCIRYLGMTDINEIGRLTLYEYDLLMTGKALAAVDESHKAHKQAWINHQVTATKLVG   61
            +++  +R  G+ D++   R+T+ EY +       L  +DE    ++QAW N QV ATK  G
Sbjct:  15 MMIRFLRCFGIQDLSVFERMTIREYSIRSIAFQLRTLDEEEFIYEQAWANWQVQATKQQG   74

Query:  62 GKKNKKEVPVYKKFKDFFD---YEEEIRKI-TQEIDEGYDKKGMDLLLKAN           108
           K       P+Y  FK FFD     E EI  I + E     D K +DL+ KAN
Sbjct:  75 KK------PLYPTFKKFFDKKKLENEILGIESPENKFKKDNKLIDLMKKAN           119
```

Based on this analysis, it was predicted that this GAS-specific protein and its epitopes, could be useful antigens for vaccines or diagnostics.

EXAMPLE 2685

A DNA sequence (GASx989) was identified in *S. pyogenes* <SEQ ID 7869> which encodes the amino acid sequence <SEQ ID 7870>. Analysis of this protein sequence reveals the following:

```
Possible site: 60
>>> Seems to have no N-terminal signal sequence

----- Final Results -----
bacterial cytoplasm --- Certainty = 0.2869 (Affirmative) < succ>
bacterial membrane  --- Certainty = 0.0000 (Not Clear)   < succ>
bacterial outside   --- Certainty = 0.0000 (Not Clear)   < succ>
```

No corresponding DNA sequence was identified in *S. agalactiae*.

The protein has homology with the following sequences in the GENPEPT database:

```
>GP: CAA66560 GB: X97918 gene 19.1 [Bacteriophage SPP1]
Identities = 66/232 (28%), Positives = 106/232 (45%), Gaps = 12/232 (5%)

Query:   38 FRTLTVSGRDVVDLEHQTTSVLGRNGEYFHNATVEVRKLEIKAKISGKDNKS-MRLQYEK   96
            F   V GR V  +E    ++ G +G       ++ R+LE+ A + G   ++ +R + E
Sbjct:   24 FLVQEVRGRSVYSIEMGKRTIAGVDGGVITTESLPARELEVDAIVFGDGTETDLRRRIEY   83

Query:   97 LNKLIVSHNQVFLSFSDEPDRNYLGIFKSKDVPEEVSNEQIIGLTFICYNPFK-----MS   151
            LN L+    V ++FSDEP R Y G ++     +E      + L F C +P K     +
Sbjct:   84 LNFLLHRDTDVPITFSDEPSRTYYGRYEFATEGDEKGGFHKVTLNFYCQDPLKYGPEVTT   143

Query:  152 DVKTKKGTSIQNGGLFQTKPIITLNLSSPTKEIKLLHVESQKYIRLT----GTYTTDEIK   207
            DV T   T ++N GL  T P I    S+   E ++  ++       ++      G  T D +
Sbjct:  144 DV-TTASTPVKNTGLAVTNPTIRCVFSTSATEYEMQLLDGSTVVKFLKVKYGFNTGDTLV   202

Query:  208 IDMATGKITQNGRNILGDLDMINSRYFELLPGNNTLQCANAAITAEFREVYL          259
            ID    +T NG++I+   L  +I S + +L P  NT    A     T   F E +L
Sbjct:  203 IDCHERSVTLNGQDIMPAL-LIQSDWIQLKPQVNTYLKATQPSTIVFTEKFL          253
```

Based on this analysis, it was predicted that this GAS-specific protein and its epitopes, could be useful antigens for vaccines or diagnostics.

EXAMPLE 2686

A DNA sequence (GASx990) was identified in *S. pyogenes* <SEQ ID 7871> which encodes the amino acid sequence <SEQ ID 7872>. Analysis of this protein sequence reveals the following:

```
Possible site: 22
>>> Seems to have no N-terminal signal sequence

----- Final Results -----
bacterial cytoplasm --- Certainty = 0.2861 (Affirmative) < succ>
bacterial membrane  --- Certainty = 0.0000 (Not Clear)   < succ>
bacterial outside   --- Certainty = 0.0000 (Not Clear)   < succ>
```

No corresponding DNA sequence was identified in *S. agalactiae*.

The protein has homology with the following sequences in the GENPEPT database:

```
>GP: BAB04681 GB: AP001510 unknown conserved protein in others
[Bacillus halodurans]
Identities = 116/449 (25%), Positives = 198/449 (43%), Gaps = 79/449 (17%)

Query:    2 IYLFDKLERLVATVG-TDDLLSWHFKVKNNDWDQASFEVPVDYDVEPFVYFGFFNYDPHQ    60
            ++++FD+ ++L+ T+  +   L+     F+ + N       F  ++   E  +      + HQ
Sbjct:    4 LFIFDREDQLLTTLTESTGLVRALFREELNRVPNQPFAFTIEASSEEAKHV----IEEHQ    59

Query:   61 -----KEDVFKLFKVIDYNLEDSKFYKG------LDKAESDLDTIAIIKDKRFRQSSADA   109
                 KE  +LF + +      LED      G       + A +L   I++      Q  +A
Sbjct:   60 VVFRDKEGDLRLFVIKE--LEDVDGLDGPQTTAICEPAFMELAEHMIVEQSVVNQPAHEA   117
```

-continued

```
Query: 110 CIDGALEGTGYQVGKVEGITNVRTLSYYYISPRAALIKIVEAFNCEFNVRYTF-INNKIT 168
            ++ AL+GT +  G VE      T  + Y+S   A+  I+  +  +F    TF   N+IT
Sbjct: 118 -LNVALQGTRW-TGSVEVNLGNATEHFSYVSAIEAVWNILVTWGGDFKDVVTFNAENRIT 175

Query: 169 SRYIDLKKRFGKPTGKQFEHGNNLLKVVYEESTDDIVTCLIGRGKGEEIQHEEAEPKDVE 228
           S  I + +R G   GK+FE  +N+ + +        VT L GRG    +Q E  E    +
Sbjct: 176 SHQIKIVQRRGVDRGKRFEIDHNI-EQIERTILSYPVTALYGRGAS--LQGENGE----D 228

Query: 229 GHLPQEERRQGYGRRIEFTDVVWSVEKGDPIDKPAGQNFVALDSAREEYGLSQNGELKHR 288
           G L             +F +V W    G P+DKP GQ +V    A ++YG   NG+L HR
Sbjct: 229 GSL-------------DFGEVEWRKSAGAPVDKPKGQLWVGDPEALQKYGRKHNGQLLHR 275

Query: 289 WGVFVNEEIEDKTELLKATWEELQRLSIPIRIYKAEILDIGPETWKGDSVAIIYDEVKIA 348
            G+F N  IED  ELL+ TWE+LQ+ S P   Y+ +                +++ +
Sbjct: 276 EGIFQNTNIEDPEELLEKTWEQLQKSSKPEVHYRLSVR              LFEHIS-- 319

Query: 349 FETRVDEIDIDKLNFNRSVVTLGDYSVVQNR------ESRSRKEAVQ-NMIDESLETITD 401
                         +     +LGD ++  +R      E +SR  A++ +++D     + +
Sbjct: 320 -------------GYEHEQASLGDTAIAIDRQFSRPIEIQSRIIAIEYDLVDIDGTGMVE 366

Query: 402 LGMTFQEFLQGIEKRIETGKKEMEDNWRK 430
           +G      L G+++R+E   +E+E N  K
Sbjct: 367 MGQFLS--LNGMDERLERIIEEIEKNQGK 393
```

Based on this analysis, it was predicted that this GAS-specific protein and its epitopes, could be useful antigens for vaccines or diagnostics.

EXAMPLE 2687

A DNA sequence (GASx991) was identified in *S. pyogenes* <SEQ ID 7873> which encodes the amino acid sequence <SEQ ID 7874>. Analysis of this protein sequence reveals the following:

```
Possible site: 50
>>> Seems to have no N-terminal signal sequence

----- Final Results -----
bacterial cytoplasm --- Certainty = 0.2584 (Affirmative) < succ>
bacterial membrane --- Certainty = 0.0000 (Not Clear) < succ>
bacterial outside --- Certainty = 0.0000 (Not Clear) < succ>
```

No corresponding DNA sequence was identified in *S. agalactiae*.

The protein has homology with the following sequences in the GENPEPT database:

```
>GP: AAA98101 GB: M19348 hyaluronidase [Streptococcus pyogenes phage
H4489A]
Identities = 314/371 (84%), Positives = 338/371 (90%), Gaps = 1/371 (0%)

Query:   1 MAENIPLRVQFKRMKAAEWASSDVVLLEGEIGFETDTGFAKFGDGQNTFSKLKYLTGPKG  60
           M ENIPLRVQFKRM A EWA SDV+LLEGEIGFETDTGFAKFGDGQNTFSKLKYLTGPKG
Sbjct:   1 MTENIPLRVQFKRMSADEWARSDVILLEGEIGFETDTGFAKFGDGQNTFSKLKYLTGPKG  60

Query:  61 PKGDTGLQGKTGGTGSRGPAGKPGTTDYDQLQNKPDLGAFAQKEETNSKITKLESSKADK  120
           PKGDTGLQGKTGGTG RGPAGKPGTTDYDQLQNKPDLGAFAQKEETNSKITKLESSKADK
Sbjct:  61 PKGDTGLQGKTGGTGPRGPAGKPGTTDYDQLQNKPDLGAFAQKEETNSKITKLESSKADK  120

Query: 121 NAVYLKAESNAKLDEKLNLKGGVMTGQLQFKPN-SGIKPSSSVGGAINIDMSKSEGAAMV  179
           +AVY KAES  +LD+KL+L GG++TGQLQFFCPN SGIKPSSSVGGAINIDMSKSEGAAMV
Sbjct: 121 SAVYSKAESKIELDKKLSLTGGIVTGQLQFKPNKSGIKPSSSVGGAINIDMSKSEGAAMV  180

Query: 180 MYTNKDTTDGPLMILRSNKDTFDQSVQFVDYKGTTNAVNIVMRQPTTPNFSSALNITSAN  239
           MYTNKDTTDGPLMILRS+KDTFDQS QFVDY G TNAVNIVMRQP+ PNFSSALNITSAN
Sbjct: 181 MYTNKDTTDGPLMILRSDKDTFDQSAQFVDYSGKTNAVNIVMRQPSAPNFSSALNITSAN  240

Query: 240 EGGSAMQIRGVEKALGTLKITHENPSVDKEYDKNAAALSIDIVKKQKGGKGTAAQGIYIN  299
           EGGSAMQIRGVEKALGTLKITHENP+V+ +YD+NAAALSIDIVKKQKGGKGTAAQGIYIN
Sbjct: 241 EGGSAMQIRGVEKALGTLKITHENPNVEAKYDENAAALSIDIVKKQKGGKGTAAQGIYIN  300

Query: 300 STSGTTGKLLRIRNLNDDKFYVKPDGGFYAKETSQIDGNLKLKDPIANDHAATKAYVDGE  359
           STSGT GK+LRIRN N+DKFYV PDGGF++   S + GNL +KDP +  HAATK YVD +
Sbjct: 301 STSGTAGKMLRIRNKNEDKFYVGPDGGFHSGANSTVAGNLTVKDPTSGKHAATKDYVDEK  360
```

```
Query: 360 VEKLKALLAAK                                         370
           + +LK L+  K
Sbjct: 361 IAELKKLILKK                                         371
```

Based on this analysis, it was predicted that this GAS-specific protein and its epitopes, could be useful antigens for vaccines or diagnostics.

EXAMPLE 2688

A DNA sequence (GASx993) was identified in *S. pyogenes* <SEQ ID 7875> which encodes the amino acid sequence <SEQ ID 7876>. Analysis of this protein sequence reveals the following:

```
Possible site: 29
>>> Seems to have no N-terminal signal sequence

----- Final Results -----
bacterial cytoplasm --- Certainty = 0.1358 (Affirmative) < succ>
bacterial membrane  --- Certainty = 0.0000 (Not Clear)   < succ>
bacterial outside   --- Certainty = 0.0000 (Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2689

A DNA sequence (GASx995) was identified in *S. pyogenes* <SEQ ID 7877> which encodes the amino acid sequence <SEQ ID 7878>. Analysis of this protein sequence reveals the following:

```
Possible site: 22
>>> Seems to have no N-terminal signal sequence

----- Final Results -----
bacterial cytoplasm --- Certainty = 0.0855 (Affirmative) < succ>
bacterial membrane  --- Certainty = 0.0000 (Not Clear)   < succ>
bacterial outside   --- Certainty = 0.0000 (Not Clear)   < succ>
```

No corresponding DNA sequence was identified in *S. agalactiae*.

The protein has homology with the following sequences in the GENPEPT database:

```
>GP: AAC34418 GB: AF158600 gp149 [Streptococcus thermophilus
bacteriophage Sfi11]
Identities = 27/95 (28%), Positives = 50/95 (52%), Gaps = 2/95 (2%)

Query:  9 KYPQLDGTGAVASTHIIAAEDGAVIPQLIKQDLTSTNDTEIIKAALEEFKKSEYVEIAM   68
          K  + D +GA  +T +I+   DGA +P  +    ++TE++K ALE   +  + A
Sbjct: 26 KSKEYDASGAAYATKVILKNRDGAYVPVFLPVEKIDLSNTELLKEALEVIYQENFPQRAE  85

Query: 69 GEAVQKVDDLEKISQETAKTAKTAQTAAGLAKVSA                          103
          E    ++D  EKI +  A + K  +T A + + S+
Sbjct: 86 NEKFNELD--EKIKEYEALSKKATETIAKMEEASS                          118
```

Based on this analysis, it was predicted that this GAS-specific protein and its epitopes, could be useful antigens for vaccines or diagnostics.

EXAMPLE 2690

A DNA sequence (GASx996) was identified in *S. pyogenes* <SEQ ID 7879> which encodes the amino acid sequence <SEQ ID 7880>. Analysis of this protein sequence reveals the following:

```
Possible site: 22
>>> Seems to have an uncleavable N-term signal seq
INTEGRAL Likelihood = -4.62 Transmembrane 9-25 (7-26)

----- Final Results -----
bacterial membrane --- Certainty = 0.2848 (Affirmative) < succ>
bacterial outside --- Certainty = 0.0000 (Not Clear) < succ>
bacterial cytoplasm --- Certainty = 0.0000 (Not Clear) < succ>
```

No corresponding DNA sequence was identified in S. agalactiae.

The protein has no significant homology with any sequences in the GENPEPT database.

Based on this analysis, it was predicted that this GAS-specific protein and its epitopes, could be useful antigens for vaccines or diagnostics.

EXAMPLE 2691

A DNA sequence (GASx997) was identified in S. pyogenes <SEQ ID 7881> which encodes the amino acid sequence <SEQ ID 7882>. Analysis of this protein sequence reveals the following:

```
Possible site: 41
>>> Seems to have no N-terminal signal sequence
INTEGRAL Likelihood = -3.66 Transmembrane 38-54 (35-55)

----- Final Results -----
bacterial membrane --- Certainty = 0.2466 (Affirmative) < succ>
bacterial outside --- Certainty = 0.0000 (Not Clear) < succ>
bacterial cytoplasm --- Certainty = 0.0000 (Not Clear) < succ>
```

No corresponding DNA sequence was identified in S. agalactiae.

The protein has no significant homology with any sequences in the GENPEPT database.

Based on this analysis, it was predicted that this GAS-specific protein and its epitopes, could be useful antigens for vaccines or diagnostics.

EXAMPLE 2692

A DNA sequence (GASx998R) was identified in S. pyogenes <SEQ ID 7883> which encodes the amino acid sequence <SEQ ID 7884>. Analysis of this protein sequence reveals the following:

```
Possible site: 27
>>> Seems to have no N-terminal signal sequence
INTEGRAL Likelihood = -9.87 Transmembrane 47-63 (41-72)

----- Final Results -----
bacterial membrane --- Certainty = 0.4949 (Affirmative) < succ>
bacterial outside --- Certainty = 0.0000 (Not Clear) < succ>
bacterial cytoplasm --- Certainty = 0.0000 (Not Clear) < succ>
```

No corresponding DNA sequence was identified in S. agalactiae.

The protein has no significant homology with any sequences in the GENPEPT database.

Based on this analysis, it was predicted that this GAS-specific protein and its epitopes, could be useful antigens for vaccines or diagnostics.

EXAMPLE 2693

A DNA sequence (GASx999) was identified in S. pyogenes <SEQ ID 7885> which encodes the amino acid sequence <SEQ ID 7886>. Analysis of this protein sequence reveals the following:

```
Possible site: 24
>>> Seems to have a cleavable N-term signal seq.

----- Final Results -----
bacterial outside --- Certainty = 0.3000 (Affirmative) < succ>
bacterial membrane --- Certainty = 0.0000 (Not Clear) < succ>
bacterial cytoplasm --- Certainty = 0.0000 (Not Clear) < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2694

A DNA sequence (GASx1001) was identified in *S. pyogenes* <SEQ ID 7887> which encodes the amino acid sequence <SEQ ID 7888>. Analysis of this protein sequence reveals the following:

```
Possible site: 22
>>> Seems to have an uncleavable N-term signal seq
INTEGRAL Likelihood = -10.51 Transmembrane 18-34 (16-34)

----- Final Results -----
bacterial membrane --- Certainty = 0.5203 (Affirmative) < succ>
bacterial outside --- Certainty = 0.0000 (Not Clear) < succ>
bacterial cytoplasm --- Certainty = 0.0000 (Not Clear) < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2695

A DNA sequence (GASx1002) was identified in *S. pyogenes* <SEQ ID 7889> which encodes the amino acid sequence <SEQ ID 7890>. Analysis of this protein sequence reveals the following:

```
Possible site: 32
>>> Seems to have an uncleavable N-term signal seq
INTEGRAL Likelihood = -3.61 Transmembrane 12-28 (11-33)

----- Final Results -----
bacterial membrane --- Certainty = 0.2444 (Affirmative) < succ>
bacterial outside --- Certainty = 0.0000 (Not Clear) < succ>
bacterial cytoplasm --- Certainty = 0.0000 (Not Clear) < succ>
```

No corresponding DNA sequence was identified in *S. agalactiae*.

The protein is similar to AF186180 from *S. equi*.

Based on this analysis, it was predicted that this GAS-specific protein and its epitopes, could be useful antigens for vaccines or diagnostics.

EXAMPLE 2696

A DNA sequence (GASx1003) was identified in *S. pyogenes* <SEQ ID 7891> which encodes the amino acid sequence <SEQ ID 7892>. Analysis of this protein sequence reveals the following:

```
Possible site: 32
>>> Seems to have a cleavable N-term signal seq.
```

-continued
```
----- Final Results -----
bacterial outside --- Certainty = 0.3000 (Affirmative) < succ>
bacterial membrane --- Certainty = 0.0000 (Not Clear) < succ>
bacterial cytoplasm --- Certainty = 0.0000 (Not Clear) < succ>
```

No corresponding DNA sequence was identified in *S. agalactiae*.

The protein is similar to See H from *S. equi*:

```
>GP: AAF72809 GB: AF186180 SeeH [Streptococcus equi] Length = 236
Identities = 233/236 (98%), Positives = 234/236 (98%)

Query:    1 MRYNCRYSHIDKKIYSMIICLSFLLYSNVVQANSYNTTNRHNLESLYKHDSNLIEADSIK   60
            MRYNCRYSHIDKKIYSMIICLSFLLYSNVVQANSYNTTNRHNLESLYKHDSNLIEADSIK
Sbjct:    1 MRYNCRYSHIDKKIYSMIICLSFLLYSNVVQANSYNTTNRHNLESLYKHDSNLIEADSIK   60

Query:   61 NSPDIVTSHMLKYSVKDKNLSVFFEKDWISQEFKDKEVDIYALSAQEVCECPGKRYEAFG  120
            NSPDIVTSHMLKYSVKDKNLSVFFEKDWISQEFKDKEVDIYALSAQE CECPGKRYEAFG
Sbjct:   61 NSPDIVTSHMLKYSVKDKNLSVFFEKDWISQEFKDKEVDIYALSAQEACECPGKRYEAFG  120

Query:  121 GITLTNSEKKEIKVPVNVWDKSKQQPPMFITVNKPKVTAQEVDIKVRKLLIKKYDIYNNR  180
            GITLTNSEKKEIKVP+NVWDKSKQ  PPMFITVNKPKVTAQEVDIKVRKLLIKKYDIYNNR
Sbjct:  121 GITLTNSEKKEIKVPINVWDKSKQHPPMFITVNKPKVTAQEVDIKVRKLLIKKYDIYNNR  180

Query:  181 EQKYSKGTVTLDLNSGKDIVFDLYYFGNGDFNSMLKIYSNNERIDSTQFHVDVSIS      236
            EQKYSKGTVTLDLNSGKDIVFDLYYFGNGDFNSMLKIYSNNERIDSTQFHVDVSIS
Sbjct:  181 EQKYSKGTVTLDLNSGKDIVFDLYYFGNGDFNSMLKIYSNNERIDSTQFHVDVSIS      236
```

There is also homology to a *S. aureus* enterotoxin:

```
>GP: AAA19777 GB: U11702 enterotoxin H [Staphylococcus aureus]
Identities = 70/215 (32%), positives = 108/215 (49%), Gaps = 19/215 (8%)

Query:   27 SNVVQANSYNTTNRHNLESLYKHDSNLIEADSI-KNSPDIVTSHMLKYSVKDKNLSVFFE   85
            +++  AN+Y N   ++   K D    E D I +N  D    +K++  D
Sbjct:   34 TDLALANAYGQYNHPFIKENIKSDEISGEKDLIFRNQGDSGNDLRVKFATAD--------   85

Query:   86 KDWISQEFKDKEVDIYALSAQEVCECPGKRYEA--FGGITLTNSEK--KEIKVPVNVWDK  141
              ++Q+FK+K VDIY   S    CE  +       +GG TL NSEK +E +  NVW
Sbjct:   86 ---LAQFKNKNVDIYGASFYYKCEKISENISECLYGGTTL-NSEKLAQERVIGANVWVD  141

Query:  142 SKQQPPMFITVNKPKVTAQEVDIKVRKLLIKKYDIYNNREQKYSKGTVTLDLNSGKDIVF  201
                Q+   I  NK  VT QE+DIK+RK+L  KY IY  ++ + SKG + D+ + +D F
Sbjct:  142 GIQKETELIRTNKKNVTLQELDIKIRKILSDKYKIY-YKDSEISKGLIEFDMKTPRDYSF  200

Query:  202 DLYYFGNGDFNSMLKIYSNNERIDSTQF-HVDVSI                          235
            D+Y   +  + KIY +N+ +  S    H+DV++
Sbjct:  201 DIYDLKGENDYEIDKIYEDNKTLKSDDISHIDVNL                          235

>GP: AAC26661 GB: AF064774 extracellular enterotoxin type I precursor
[Staphylococcus aureus]
Identities = 68/214 (31%), Positives = 109/214 (50%), Gaps = 27/214 (12%)

Query:   42 NLESLY-KHDSNLIEADSIKNSPDIVTSHMLKYSVKDKNLSVFFEKDWIS-QEFKDKEVD   99
            NL + Y KHD  ++ + KN P   ++ L++S  +L  +   +W   +FK K++D
Sbjct:   32 NLRNFYTKHDYIDLKGVTDKNLP---IANQLEFSTGTNDL-ISESNNWDEISKFKGKKLD   87

Query:  100 IYALSAQEVCECPGKRYEAFGGITLTNSEKKEI-KVPVNVWDKSKQQPPMF--ITVNKPK  156
            I+ +      C    K      +GG TL+        K+P+N+W  K   +     I NK
Sbjct:   88 IFGIDYNGPC----KSKYMYGGATLSGQYLNSARKIPINLWVNGKHKTISTDKIATNKKL  143

Query:  157 VTAQEVDIKVRKLLIKKYDIYNNRE--------------QKYSKGTVTLDLNSGKDIVFD  202
            VTAQE+D+K+R+ L ++Y+IY +                    ++ G V   LN+ K  +D
Sbjct:  144 VTAQEIDVKLRRYLQEEYNIYGHNNTGKGKEYGYKSKFYSGFNNGKVLFHLNNEKSFSYD  203

Query:  203 LYYFGNGDFNSMLKIYSNNERIDSTQFHVDVSIS                           236
            L+Y G+G    S LKIY +N+ I+S +FH+DV IS
Sbjct:  204 LFYTGDGLPVSFLKIYEDNKIIESEKFHLDVEIS                           237

>GP: AAC28968 GB: U93688 enterotoxin [Staphylococcus aureus]
Identities = 70/244 (28%), Positives = 127/244 (51%), Gaps = 27/244 (11%)

Query:   12 KKIYSMIICLSFLLYSNVVQANSYNTTNRHNLESLYKHDSNLIEADSIKNSPDIVTSHML   71
            KK+ S+++ ++ ++       A++     NL + Y  + ++  +K++ D   ++ L
Sbjct:    2 KKLISILL-INIIILGVSNNASAQGDIGIDNLRNFYTK-KDFVDLKDVKDN-DTPIANQL   58
```

```
-continued
Query:   72 KYSVKDKNLSVFFEKDWIS-QEFKDKEVDIYALSAQEVCECPGKRYEAFGGITLTNSE-K  129
            ++S +  +L +    KD+      FK K++D++ +S     C      +Y +GG+T TN
Sbjct:   59 QFSNESYDL-ISESKDFNKFSNFKGKKLDVFGISYNGQCNT---KY-IYGGVTATNEYLD  113

Query:  130 KEIKVPVNVW--DKSKQQPPMFITVNKPKVTAQEVDIKVRKLLIKKYDIYNNREQK----  183
            K   +P+N+W    K        ++ NK  VTAQE+D+K+RK L ++Y+IY +     K
Sbjct:  114 KSRNIPINIWINGNHKTISTNKVSTNKKLVTAQEIDVKLRKYLQEEYNIYGHNGTKKGEE  173

Query:  184 ----------YSKGTVTLDLNSGKDIVFDLYYFG-NGDFNSMLKIYSNNERIDSTQFHVD  232
                      ++ G VT LN+     +DL+Y G +G   S LKIY +N+ ++S +FH+D
Sbjct:  174 YGHKSKFYSGFNIGKVTFHLNNNDTFSYDLFYTGDDGLPKSFLKIYEDNKTVESEKFHLD  233

Query:  233 VSIS                                                         236
            V IS
Sbjct:  234 VDIS                                                         237
```

Based on this analysis, it was predicted that this GAS-specific protein and its epitopes, could be useful antigens for vaccines or diagnostics.

EXAMPLE 2697

A DNA sequence (GASx1004R) was identified in *S. pyogenes* <SEQ ID 7893> which encodes the amino acid sequence <SEQ ID 7894>. Analysis of this protein sequence reveals the following:

```
Possible site: 29
>>> Seems to have an uncleavable N-term signal seq
    INTEGRAL    Likelihood = -2.18    Transmembrane    12-28 (12-28)

----- Final Results -----
            bacterial membrane --- Certainty = 0.1871(Affirmative) < succ>
            bacterial outside  --- Certainty = 0.0000(Not Clear)   < succ>
            bacterial cytoplasm --- Certainty = 0.0000(Not Clear)  < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2698

A DNA sequence (GASx1009) was identified in *S. pyogenes* <SEQ ID 7895> which encodes the amino acid sequence <SEQ ID 7896>. Analysis of this protein sequence reveals the following:

```
Possible site: 34
>>> Seems to have no N-terminal signal sequence

----- Final Results -----
            bacterial cytoplasm --- Certainty = 0.6391(Affirmative) < succ>
            bacterial membrane  --- Certainty = 0.0000(Not Clear)   < succ>
            bacterial outside   --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2699

A DNA sequence (GASx1010) was identified in *S. pyogenes* <SEQ ID 7897> which encodes the amino acid sequence <SEQ ID 7898>. Analysis of this protein sequence reveals the following:

```
Possible site: 50
>>> Seems to have no N-terminal signal sequence

----- Final Results -----
            bacterial cytoplasm --- Certainty = 0.4528(Affirmative) < succ>
             bacterial membrane --- Certainty = 0.0000(Not Clear)   < succ>
              bacterial outside --- Certainty = 0.0000(Not Clear)   < succ>
```

No corresponding DNA sequence was identified in S. agalactiae.

The protein has no significant homology with any sequences in the GENPEPT database.

Based on this analysis, it was predicted that this GAS-specific protein and its epitopes, could be useful antigens for vaccines or diagnostics.

EXAMPLE 2700

A DNA sequence (GASx1024) was identified in S. pyogenes <SEQ ID 7899> which encodes the amino acid sequence <SEQ ID 7900>. Analysis of this protein sequence reveals the following:

```
Possible site: 22
>>> Seems to have an uncleavable N-term signal seq

----- Final Results -----
             bacterial membrane --- Certainty = 0.0000(Not Clear) < succ>
              bacterial outside --- Certainty = 0.0000(Not Clear) < succ>
            bacterial cytoplasm --- Certainty = 0.0000(Not Clear) < succ>
```

No corresponding DNA sequence was identified in S. agalactiae.

The protein has no significant homology with any sequences in the GENPEPT database.

Based on this analysis, it was predicted that this GAS-specific protein and its epitopes, could be useful antigens for vaccines or diagnostics.

EXAMPLE 2701

A DNA sequence (GASx1033) was identified in S. pyogenes <SEQ ID 7901> which encodes the amino acid sequence <SEQ ID 7902>. Analysis of this protein sequence reveals the following:

```
Possible site: 20
>>> Seems to have no N-terminal signal sequence

----- Final Results -----
            bacterial cytoplasm --- Certainty = 0.1652(Affirmative) < succ>
             bacterial membrane --- Certainty = 0.0000(Not Clear)   < succ>
              bacterial outside --- Certainty = 0.0000(Not Clear)   < succ>
```

No corresponding DNA sequence was identified in S. agalactiae.

The protein has no significant homology with any sequences in the GENPEPT database.

Based on this analysis, it was predicted that this GAS-specific protein and its epitopes, could be useful antigens for vaccines or diagnostics.

EXAMPLE 2702

A DNA sequence (GASx1039) was identified in S. pyogenes <SEQ ID 7903> which encodes the amino acid sequence <SEQ ID 7904>. Analysis of this protein sequence reveals the following:

```
Possible site: 22
>>> Seems to have no N-terminal signal sequence
      INTEGRAL    Likelihood = -1.06    Transmembrane    15-31 (15-31)
```

```
----- Final Results -----
            bacterial membrane --- Certainty = 0.1426(Affirmative) < succ>
            bacterial outside  --- Certainty = 0.0000(Not Clear)   < succ>
          bacterial cytoplasm  --- Certainty = 0.0000(Not Clear)   < succ>
```

No corresponding DNA sequence was identified in S. agalactiae.

The protein has no significant homology with any sequences in the GENPEPT database.

Based on this analysis, it was predicted that this GAS-specific protein and its epitopes, could be useful antigens for vaccines or diagnostics.

EXAMPLE 2703

A DNA sequence (GASx1058) was identified in S. pyogenes <SEQ ID 7905> which encodes the amino acid sequence <SEQ ID 7906>. Analysis of this protein sequence reveals the following:

```
Possible site: 60
>>> Seems to have no N-terminal signal sequence

----- Final Results -----
          bacterial cytoplasm  --- Certainty = 0.5484(Affirmative) < succ>
            bacterial membrane --- Certainty = 0.0000(Not Clear)   < succ>
            bacterial outside  --- Certainty = 0.0000(Not Clear)   < succ>
```

No corresponding DNA sequence was identified in S. agalactiae.

The protein has no significant homology with any sequences in the GENPEPT database.

Based on this analysis, it was predicted that this GAS-specific protein and its epitopes, could be useful antigens for vaccines or diagnostics.

EXAMPLE 2704

A DNA sequence (GASx1077) was identified in S. pyogenes <SEQ ID 7907> which encodes the amino acid sequence <SEQ ID 7908>. Analysis of this protein sequence reveals the following:

```
Possible site: 31
>>> Seems to have no N-terminal signal sequence

----- Final Results -----
          bacterial cytoplasm  --- Certainty = 0.4848(Affirmative) < succ>
            bacterial membrane --- Certainty = 0.0000(Not Clear)   < succ>
            bacterial outside  --- Certainty = 0.0000(Not Clear)   < succ>
```

No corresponding DNA sequence was identified in S. agalactiae.

Based on this analysis, it was predicted that this GAS-specific protein and its epitopes, could be useful antigens for vaccines or diagnostics.

EXAMPLE 2705

A DNA sequence (GASx1080) was identified in S. pyogenes <SEQ ID 7909> which encodes the amino acid sequence <SEQ ID 7910>. Analysis of this protein sequence reveals the following:

```
Possible site: 40
>>> Seems to have an uncleavable N-term signal seq
       INTEGRAL    Likelihood = -12.42    Transmembrane   107-123  (93-133)
       INTEGRAL    Likelihood = -11.20    Transmembrane    20-36   (14-44)
       INTEGRAL    Likelihood =  -8.39    Transmembrane   226-242  (218-246)
       INTEGRAL    Likelihood =  -5.52    Transmembrane   129-145  (126-148)
       INTEGRAL    Likelihood =  -4.46    Transmembrane   160-176  (159-183)
       INTEGRAL    Likelihood =  -1.44    Transmembrane    55-71   (55-72)
```

```
----- Final Results -----
         bacterial membrane --- Certainty = 0.5967(Affirmative) < succ>
         bacterial outside  --- Certainty = 0.0000(Not Clear)   < succ>
         bacterial cytoplasm --- Certainty = 0.0000(Not Clear)  < succ>
```

No corresponding DNA sequence was identified in S. agalactiae.

Based on this analysis, it was predicted that this GAS-specific protein and its epitopes, could be useful antigens for vaccines or diagnostics.

EXAMPLE 2706

A DNA sequence (GASx1081) was identified in S. pyogenes <SEQ ID 7911> which encodes the amino acid sequence <SEQ ID 7912>. Analysis of this protein sequence reveals the following:

```
Possible site: 34
>>> Seems to have a cleavable N-term signal seq.
     INTEGRAL    Likelihood = -13.00    Transmembrane   103-119  (91-129)
     INTEGRAL    Likelihood = -11.46    Transmembrane   208-224  (203-230)
     INTEGRAL    Likelihood = -8.28     Transmembrane    54-70   (46-71)
     INTEGRAL    Likelihood = -5.79     Transmembrane   160-176  (155-181)
     INTEGRAL    Likelihood = -4.25     Transmembrane   127-143  (125-149)

----- Final Results -----
         bacterial membrane --- Certainty = 0.6201(Affirmative) < succ>
         bacterial outside  --- Certainty = 0.0000(Not Clear)   < succ>
         bacterial cytoplasm --- Certainty = 0.0000(Not Clear)  < succ>
```

No corresponding DNA sequence was identified in S. agalactiae.

Based on this analysis, it was predicted that this GAS-specific protein and its epitopes, could be useful antigens for vaccines or diagnostics.

EXAMPLE 2707

A DNA sequence (GASx1089) was identified in S. pyogenes <SEQ ID 7913> which encodes the amino acid sequence <SEQ ID 7914>. Analysis of this protein sequence reveals the following:

```
Possible site: 37
>>> Seems to have no N-terminal signal sequence

----- Final Results -----
         bacterial cytoplasm --- Certainty = 0.2999(Affirmative) < succ>
         bacterial membrane  --- Certainty = 0.0000(Not Clear)   < succ>
         bacterial outside   --- Certainty = 0.0000(Not Clear)   < succ>
```

No corresponding DNA sequence was identified in S. agalactiae.

The protein has no significant homology with any sequences in the GENPEPT database.

Based on this analysis, it was predicted that this GAS-specific protein and its epitopes, could be useful antigens for vaccines or diagnostics.

EXAMPLE 2708

A DNA sequence (GASx1109) was identified in S. pyogenes <SEQ ID 7915> which encodes the amino acid sequence <SEQ ID 7916>. Analysis of this protein sequence reveals the following:

```
Possible site: 27
>>> Seems to have no N-terminal signal sequence

----- Final Results -----
         bacterial cytoplasm --- Certainty = 0.1270 (Affirmative) < succ>
         bacterial membrane  --- Certainty = 0.0000 (Not Clear)   < succ>
         bacterial outside   --- Certainty = 0.0000 (Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2709

A DNA sequence (GASx1114R) was identified in *S. pyogenes* <SEQ ID 7917> which encodes the amino acid sequence <SEQ ID 7918>. Analysis of this protein sequence reveals the following:

```
Possible site: 19
>>> Seems to have no N-terminal signal sequence

----- Final Results -----
            bacterial cytoplasm --- Certainty = 0.4021 (Affirmative) < succ>
            bacterial membrane  --- Certainty = 0.0000 (Not Clear)   < succ>
            bacterial outside   --- Certainty = 0.0000 (Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2710

A DNA sequence (GASx1149) was identified in *S. pyogenes* <SEQ ID 7919> which encodes the amino acid sequence <SEQ ID 7920>. Analysis of this protein sequence reveals the following:

```
Possible site: 28
>>> Seems to have an uncleavable N-term signal seq
INTEGRAL    Likelihood = -1.70        Transmembrane      12-28 (12-29)

----- Final Results -----
            bacterial membrane  --- Certainty = 0.1680 (Affirmative) < succ>
            bacterial outside   --- Certainty = 0.0000 (Not Clear)   < succ>
            bacterial cytoplasm --- Certainty = 0.0000 (Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2711

A DNA sequence (GASx1150) was identified in *S. pyogenes* <SEQ ID 7921> which encodes the amino acid sequence <SEQ ID 7922>. Analysis of this protein sequence reveals the following:

```
Possible site: 22
>>> Seems to have a cleavable N-term signal seq.

----- Final Results -----
            bacterial outside   --- Certainty = 0.3000 (Affirmative) < succ>
            bacterial membrane  --- Certainty = 0.0000 (Not Clear)   < succ>
            bacterial cytoplasm --- Certainty = 0.0000 (Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2712

A DNA sequence (GASx1160) was identified in *S. pyogenes* <SEQ ID 7923> which encodes the amino acid sequence <SEQ ID 7924>. Analysis of this protein sequence reveals the following:

```
Possible site: 17
>>> Seems to have no N-terminal signal sequence
INTEGRAL    Likelihood = -3.19        Transmembrane     15-31 (15-31)

----- Final Results -----
            bacterial membrane --- Certainty = 0.2275 (Affirmative) < succ>
             bacterial outside --- Certainty = 0.0000 (Not Clear)  < succ>
           bacterial cytoplasm --- Certainty = 0.0000 (Not Clear)  < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2713

A DNA sequence (GASx1167) was identified in *S. pyogenes* <SEQ ID 7925> which encodes the amino acid sequence <SEQ ID 7926>. Analysis of this protein sequence reveals the following:

```
Possible site: 16
>>> Seems to have no N-terminal signal sequence

----- Final Results -----
           bacterial cytoplasm --- Certainty = 0.1404 (Affirmative) < succ>
            bacterial membrane --- Certainty = 0.0000 (Not Clear)  < succ>
             bacterial outside --- Certainty = 0.0000 (Not Clear)  < succ>
```

No corresponding DNA sequence was identified in *S. agalactiae*.

The protein has homology with the following sequences in the GENPEPT database:

```
>GP: AAB99233 GB: U67563 oxaloacetate decarboxylase alpha chain (oadA)
[Methanococcus jannaschii]
Identities = 250/453 (55%), Positives = 325/453 (71%), Gaps = 7/453 (1%)

Query:  13 VAITETVLRDGHQSLMATRLSIEDMLPVLTILDKIGYYSLECWGGATFDACIRFLNEDPW   72
            V I +T  RD QSL+ATR+  EDMLP+   +D++G+YS+E WGGATFDACIR+LNEDPW
Sbjct:   2 VKIVDTTFRDAQQSLIATRMRTEDMLPIAEKMDEVGFYSMEVWGGATFDACIRYLNEDPW   61

Query:  73 ERLRTLKKGLPNTRLQMLLRGQNLLGYRHYADDIVDKFISLSAQNGIDVFRIFDALNDPR  132
            ERLR LKK + NT LQMLLRGQNL+GYRHY DDIV+KF+  + +NGID+FRIFDALND R
Sbjct:  62 ERLRALKKRIQNTPLQMLLRGQNLVGYRHYPDDIVEKFVIKAHENGIDIFRIFDALNDVR  121

Query: 133 NIQQALRAVKKTGKEAQLCIAYTTSPVHTLNYYLSLVKELVEMGADSICIKDMAGILTPK  192
            N++ A++  KK G E Q   I YT SPVHT++ Y+ L K+L EMG DSICIKDMAG+LTP
Sbjct: 122 NMETAIKTAKKVGAEVQGAICYTISPVHTIDQYVELAKKLEEMGCDSICIKDMAGLLTPY  181

Query: 193 AAKELVSGIKAMTNLPLIVHTHATSGISQMTYLAAVEAGADRIDTALSPFSEGTSQPATE  252
              ELV +K   +LP+ VH+H TSG+ MTYL  +EAGAD +D A+SPF+ GTSQP TE
Sbjct: 182 EGYELVKRLKEEISLPIDVHSHCTSGLAPMTYLKVIEAGADMVDCAISPFAMGTSQPPTE  241

Query: 253 SMYLALKEASYDITLDETLLEQAANHLRQARQKYLADGILDPSLLFPDPRTLQYQVPGGM  312
            S+ +ALK   YD LD LL +  ++  + R+KY    + P    D R L YQVPGGM
Sbjct: 242 SIVVALKGTKYDTGLDLKLLNEIRDYFMKVREKYKM--LFSPISQIVDARVLVYQVPGGM  299

Query: 313 LSNMLSQLKQANAESKLEEVLAEVPRVRKDLGYPPLVTPLSQMVGTQAAMNVILGKPYQM  372
            LSN++SQLK+  A  K EEVL E+PRVRKDLGYPPLVTP SQ+VGTQA +NV+   + Y++
Sbjct: 300 LSNLVSQLKEQGALDKFEEVLQEIPRVRKDLGYPPLVTPTSQIVGTQAVLNVLTEERYKI  359

Query: 373 VSKEIKQYLAGDYGKTPAPVNEDLKRSQI--GSAPVTTNRPADQLSPEFEVLK--AEVAD  428
            ++ E+  Y+ G YGK PAP+N +L +    G  P+T  RPAD L PE+E +K   AE
```

```
-continued
Sbjct: 360 ITNEVVNYVKGFYGKPPAPINPELLKRVLDEGEKPITC-RPADLLPPEWEKVKKEAEEKG  418

Query: 429 LAQTDEDVLTYALFPSVAKPFLTTKYQTDDVIK  461
           + + +ED+LTYAL+P +A  FL  + + + + K
Sbjct: 419 IVKKEEDILTYALYPQIAVKFLRGELKAEPIPK  451
```

Based on this analysis, it was predicted that this GAS-specific protein and its epitopes, could be useful antigens for vaccines or diagnostics.

EXAMPLE 2714

A DNA sequence (GASx1168) was identified in *S. pyogenes* <SEQ ID 7927> which encodes the amino acid sequence <SEQ ID 7928>. Analysis of this protein sequence reveals the following:

```
Possible site: 38
>>> Seems to have an uncleavable N-term signal seq
INTEGRAL      Likelihood = -7.11       Transmembrane     16-32 (2-34)

----- Final Results -----
            bacterial membrane --- Certainty = 0.3845 (Affirmative) < succ>
              bacterial outside --- Certainty = 0.0000 (Not Clear)  < succ>
            bacterial cytoplasm --- Certainty = 0.0000 (Not Clear)  < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2715

A DNA sequence (GASx1170) was identified in *S. pyogenes* <SEQ ID 7929> which encodes the amino acid sequence <SEQ ID 7930>. Analysis of this protein sequence reveals the following:

```
Possible site: 51
>>> Seems to have no N-terminal signal sequence
INTEGRAL      Likelihood = -7.06    Transmembrane    211-227 (208-238)
INTEGRAL      Likelihood = -5.84    Transmembrane    117-133 (110-136)
INTEGRAL      Likelihood = -5.36    Transmembrane    256-272 (253-274)
INTEGRAL      Likelihood = -4.67    Transmembrane     44-60  (41-64)
INTEGRAL      Likelihood = -4.19    Transmembrane    287-303 (287-306)
INTEGRAL      Likelihood = -3.77    Transmembrane    358-374 (357-375)
INTEGRAL      Likelihood = -2.18    Transmembrane     20-36  (16-38)
INTEGRAL      Likelihood = -0.85    Transmembrane     90-106 (90-106)
INTEGRAL      Likelihood = -0.53    Transmembrane    165-181 (164-181)

----- Final Results -----
            bacterial membrane --- Certainty = 0.3824 (Affirmative) < succ>
              bacterial outside --- Certainty = 0.0000 (Not Clear)  < succ>
            bacterial cytoplasm --- Certainty = 0.0000 (Not Clear)  < succ>
```

No corresponding DNA sequence was identified in *S. agalactiae*.

The protein has homology with the following sequences in the GENPEPT database:

```
>GP: CAA05140 GB: AJ002015 methylmalonyl-CoA decarboxylase,
beta-subunit [Propionigenium modestum]
Identities = 231/395 (58%), Positives = 293/395 (73%), Gaps = 19/395 (4%)

Query:   1 MLDVLNQMVQSSGLAHLTVNNLIMICLASFFLYLGIKKEYEPYLMVPIAFGILLVNLPMA    60
           ML +     S+G   L + ++IM+  +A   FLYL I KE+EP L+VPI+FGILL NLP A
Sbjct:   1 MLQAILDFYHSTGFYGLNMGSIIMMLVACVFLYLAIAKEFEPLLLVPISFGILLTNLPFA    60

Query:  61 GLMDHP---------ANG---------NPGGLLYYLYKGTSLGIYPPLIFLCLGASTDFG   102
           G+M  P         A+G          PGGLLYYL++G  LGI+PPLIFL +GA TDFG
Sbjct:  61 GMMAEPLLEVHEKLSASGAHLYTAHTAEPGGLLYYLFQGDHLGIFPPLIFLGVGAMTDFG   120

Query: 103 PLIANPKTILLGGAAQVGIFLAFFLAIMLGM-TPQEAASVGIIGGADGPTAIYVTTKLAP   161
           PLI+NPK++LLG AAQ GIF+ FF AI   G+ T QEAAS+GIIGGADGPTAI++++KLAP
```

-continued

```
Sbjct: 121 PLISNPKSLLLGAAAQFGIFVTFFGAIASGLFTAQEAASIGIIGGADGPTAIFLSSKLAP  180

Query: 162 DLLSTIALAAYSYMALVPIIQPPIIKLLTTKAERQVKMTQARTVSQKEKIIFPIMVTIFV  221
            L+  IA+AAYSYMALVPIIQPPI+  LT++ ER++KM+Q R VS++EKIIFPI+VTI V
Sbjct: 181 HLMGPIAVAAYSYMALVPIIQPPIMTALTSETERKIKMSQLRLVSKREKIIFPIVVTILV  240

Query: 222 SLLVPSATTLVGCLMLGNLVREIKIVPKIVENLQQVVMFCITIILGLTVGAKANGDLFLS  281
            SL+VP A TLVG LMLGN RE  +V ++ +  +  ++  ITI LG+TVGA A  + FL
Sbjct: 241 SLIVPPAATLVGMLMLGNLFRECGVVGRLEDTAKNALINIITIFLGVTVGATATAEAFLK  300

Query: 282 ATTLKIIALGLIAFAAGTAGGVLMGKVMYYLSGNKVNPMIGAAGVSAVPMAARVVQKIGQ  341
             TL I+ LG++AF  GT  GVL+ K M  LS    +NP++G+AGVSAVPMAARV Q +GQ
Sbjct: 301 VETLAILGLGIVAFGIGTGSGVLLAKFMNKLSKEPINPLLGSAGVSAVPMAARVSQVVGQ  360

Query: 342 EEDPSNFLLMHANGPNVAGVIGSAIASGALLAFFG                          376
            + DP+NFLLMHAMGPNVAGVIGSA+++G  LL+ FG
Sbjct: 361 KADPTNFLLMHAMGPNVAGVIGSAVSAGVLLSLFG                          395
```

Based on this analysis, it was predicted that this GAS-specific protein and its epitopes, could be useful antigens for vaccines or diagnostics.

EXAMPLE 2716

A DNA sequence (GASx1171R) was identified in *S. pyogenes* <SEQ ID 7931> which encodes the amino acid sequence <SEQ ID 7932>. Analysis of this protein sequence reveals the following:

```
Possible site: 16
>>> Seems to have no N-terminal signal sequence

----- Final Results -----
           bacterial cytoplasm --- Certainty = 0.0851 (Affirmative) < succ>
           bacterial membrane  --- Certainty = 0.0000 (Not Clear)  < succ>
           bacterial outside   --- Certainty = 0.0000 (Not Clear)  < succ>
```

No corresponding DNA sequence was identified in *S. agalactiae*.

The protein has homology with the following sequences in the GENPEPT database:

```
>GP: AAF93965 GB: AE004165 citG protein [Vibrio cholerae]
Identities = 100/287 (34%), Positives = 154/287 (52%), Gaps = 12/287 (4%)

Query:   9 ISQLALKALLYEVSLSPKPGLVDRFDNGAHDDMSFITFIDSMIALSPFFQAYIETGFAYA   68
            +  LA  A++ EV L+PKPGLVD  +NGAH DM   TFI S  A++P+  +++  G+  A
Sbjct:  32 VGHLAYHAMMLEVHLTPKPGLVDTANNGAHRDMDLNTFIASAEAIAPYLHSFVSAGWESA   91

Query:  69 KEEPLLLFNRLRQLGQKAEETMFCATQGINTHKGLNFSMALLLGATGAYLARTPHLMTDL  128
            L + LR +G +AE+ MF  ATQG+NTHKG+  F + L+ G+ G   A
Sbjct:  92 GNPAAQLLSALRPIGIEAEQAMFAATQGVNTHKGMIFILGLICGSVGWLKANQ-------  144

Query: 129 GRFSKEDTLAICRLVKPMTAHLIQTDLGHLNTKKEFTYGEQLFVTYGIKGPRGEASEGFT  188
               K D   I  ++    L+  +L    + T GE+++  YG+ G RGEA+ G
Sbjct: 145 ---LKIDAQHTGETIRQACQFLVIDELKAKRDCEPETAGERIYRQYGLTGARGEAASGLA  201

Query: 189 TLTDHALPYFRQMISQN-DPETSQLRLLVYLMSIVEDGNLIHRGGIEAWKGVKAD-MRLL  246
            + HALP ++  +++    E +   L+ LM+  D NL+ RGG+    V+    +LL
Sbjct: 202 MVMIQHALPAYQACLTKGASTEQALWHTLLVLMANNNDSNLVSRGGLAGLHFVQEQAQQLL  261

Query: 247 LQQDLSTTDLRLALSSYNQCLINQHLSPGGAADLLALTFYFAFLEKL              293
             +        ++ AL++ +  LI +HLSPGG+ADLLA T+    L +L
Sbjct: 262 AKGGFLYQEIEQALTALDSVLIEKHLSPGGSADLLAATWLIYELVQL              308
```

Based on this analysis, it was predicted that this GAS-specific protein and its epitopes, could be useful antigens for vaccines or diagnostics.

EXAMPLE 2717

A DNA sequence (GASx1172R) was identified in *S. pyogenes* <SEQ ID 7933> which encodes the amino acid sequence <SEQ ID 7934>. Analysis of this protein sequence reveals the following:

```
Possible site: 23
>>> Seems to have no N-terminal signal sequence

----- Final Results -----
          bacterial cytoplasm --- Certainty = 0.2501 (Affirmative) < succ>
          bacterial membrane  --- Certainty = 0.0000 (Not Clear)  < succ>
           bacterial outside  --- Certainty = 0.0000 (Not Clear)  < succ>
```

No corresponding DNA sequence was identified in *S. agalactiae*.

The protein has homology with the following sequences in the GENPEPT database:

```
>GP: CAB12389 GB: Z99107 similar to transcriptional regulator (GntR
family) [Bacillus subtilis]
Identities = 60/205 (29%), Positives = 99/205 (48%), Gaps = 3/205 (1%)

Query:  19 PLKIAFYNALKKTIILRQIPVGSRINEKEFSIALNISRTPIRYALGLLSEEHLVEHIPKK   78
            P + FYN LKK I       G RINE + + + +SR+PIR A+ LL ++ L++    +
Sbjct:  11 PYYLQFYNQLKKMIFNGTFKPGERINETQLAKSFGVSRSPIREAMRLLEKDGLLKADDRN   70

Query:  79 GIIVKGVSIKDACEIFEIRKALETLATVQAMHLMTEEDFKVMHNLLEDCETFI--AEDDT  136
            G + ++ KD  EI++IR  LE LA    +    EE+ ++   LE+ E  I    +DT
Sbjct:  71 GFSITSLTAKDVDEIYKIRIPLEQLAVELVIDEADEEELTILEKQLEETEKAIHNGTEDT  130

Query: 137 NRILDNFNAFNNLIYSYSQMVRLKEIVTELQAYLVYFRKISISSVERRKRALSEHWMIYR  196
              I N   F+ L+ +S    LK ++ +    + + R ++ +    R +  L EH  I+
Sbjct: 131 EIIRLN-QKFHELLVDFSHNRHLKNLLEHVNDLIHFCRILNYTGDHRAETILREHRRIFE  189

Query: 197 GMKNKDHEQITLITHEHLNSSLEFI                                    221
           +K K+ E          H N   E +
Sbjct: 190 EVKKKNKEAAKQHVLAHFNHDCEHL                                    214
```

Based on this analysis, it was predicted that this GAS-specific protein and its epitopes, could be useful antigens for vaccines or diagnostics.

EXAMPLE 2718

A DNA sequence (GASx1173R) was identified in *S. pyogenes* <SEQ ID 7935> which encodes the amino acid sequence <SEQ ID 7936>. Analysis of this protein sequence reveals the following:

```
Possible site: 16
>>> Seems to have a cleavable N-term signal seq.
INTEGRAL    Likelihood = -10.99    Transmembrane     450-466 (445-473)
INTEGRAL    Likelihood =  -9.61    Transmembrane      33-49  (30-55)
INTEGRAL    Likelihood =  -8.55    Transmembrane     326-342 (321-346)
INTEGRAL    Likelihood =  -7.01    Transmembrane     288-304 (286-311)
INTEGRAL    Likelihood =  -6.79    Transmembrane      95-111 (88-114)
INTEGRAL    Likelihood =  -4.99    Transmembrane     265-281 (264-285)
INTEGRAL    Likelihood =  -4.62    Transmembrane     208-224 (204-228)
INTEGRAL    Likelihood =  -3.13    Transmembrane     126-142 (126-145)
INTEGRAL    Likelihood =  -2.81    Transmembrane     366-382 (365-383)
INTEGRAL    Likelihood =  -2.34    Transmembrane     419-435 (417-438)

----- Final Results -----
            bacterial membrane  --- Certainty = 0.5394 (Affirmative) < succ>
             bacterial outside  --- Certainty = 0.0000 (Not Clear)  < succ>
           bacterial cytoplasm  --- Certainty = 0.0000 (Not Clear)  < succ>
```

A related sequence was also identified in GAS <SEQ ID 9169> which encodes the amino acid sequence <SEQ ID 9170>. Analysis of this protein sequence reveals the following:

```
Possible cleavage site: 39
>>> Seems to have a cleavable N-term signal seq.
INTEGRAL    Likelihood = -10.99    Transmembrane     443-459 (438-466)
INTEGRAL    Likelihood =  -8.55    Transmembrane     319-335 (314-339)
INTEGRAL    Likelihood =  -7.01    Transmembrane     281-297 (279-304)
INTEGRAL    Likelihood =  -6.79    Transmembrane      88-104 (81-107)
```

```
INTEGRAL    Likelihood = -4.99      Transmembrane      258-274 (257-278)
INTEGRAL    Likelihood = -4.62      Transmembrane      201-217 (197-221)
INTEGRAL    Likelihood = -3.13      Transmembrane      119-135 (119-138)
INTEGRAL    Likelihood = -2.81      Transmembrane      359-375 (358-376)
INTEGRAL    Likelihood = -2.34      Transmembrane      412-428 (410-431)

----- Final Results -----
           bacterial membrane --- Certainty = 0.539 (Affirmative) < succ>
             bacterial outside --- Certainty = 0.0000 (Not Clear) < succ>
           bacterial cytoplasm --- Certainty = 0.0000 (Not Clear) < succ>
```

No corresponding DNA sequence was identified in *S. agalactiae*.

The protein has homology with the following sequences in the GENPEPT database:

```
>GP: AAG08853 GB: AE004959 probable citrate transporter
[Pseudomonas aeruginosa]
Identities = 199/468 (42%), Positives = 296/468 (62%), Gaps = 41/468 (8%)

Query:    9 LLTMLAYAMIIVFMYVVMKKKMTPFTALVMIPLIMTIAVILTGSADFNADAKFVAFVGDG   68
            +LT+LA+AM+  FM+++M K+++    AL+++P                    +AF   G
Sbjct:    1 MLTLLAFAMVATFMFLIMTKRLSALIALILVP--------------------IAFALIG   39

Query:   69 GIAKDLTAIGPMVMYGINNTAKTGIMLLFAILFFSVMLDAGLFDPITEKMIRFAKGDPMK  128
               G  A  L    GPM++ GI   A TG+ML+FAIL+F++M+D+GLFDP    K++R   KGDP+K
Sbjct:   40 GFAAGL---GPMMLDGIRTLAPTGVMLMFAILYFAIMIDSGLFDPAVRKILRLVKGDPLK   96

Query:  129 VLIATAVVAAAVSLNGDGTTTTLICCSAFLPIYKKLDMKIMNLGVLIILQNTIMNLLPWG  188
            V + TA +A   VSL+GDG+TT  +IC +A LP+Y +L M  +  LI+L +  ++N+ PWG
Sbjct:   97 VSLGTAALAMIVSLDGDGSTTYMICVAAVLPLYSRLGMSPLVMACLIMLSSGVLNMTPWG  156

Query:  189 GPTARAMSVLGVGP-EILGYLAPGMILSLL--YVICWVAPSMGRKERARLGVIDL--SEE  243
            GPTARA  S L V P +I    + P MI  LL    + I W+    G++ERARLG + L     E
Sbjct:  157 GPTARAASALHVDPADIFVPMIPAMIAGLLAIFAIAWI---YGKRERARLGELHLPTDHE  213

Query:  244 DMRQLTDITDPDTLFIRRPKNFVFNAILTIGLITWLVAGSFNKSIAMAPLLLFAVGTCIA  303
            D+ +++      P+     RRPK   FNAILT+ L+    L+AG        + M   L  +A G   IA
Sbjct:  214 DLAEISVSQYPEA---RRPKLLWFNAILTVVLMATLIAGL----LPMPVLFMIAFG--IA  264

Query:  304 LMVNYPVLKDQSKRIGDNAGDAVQVVILVFAAGIFMGLFQGSGMASALAQSFATIIPKQL  363
            ++VNYP +++Q KRIG +A + + VV L+FAAG+F G+   G+GM  A+++S    +IP  L
Sbjct:  265 MIVNYPCIQEQKKRIGAHAENILAVVSLIFAAGVFTGILSGTGMVDAMSKSLLAVIPPAL  324

Query:  364 AGFWGLVIALVSAPGTFFISNDGFYYGILPVLAEAGAEYGFSNMAMALASLMGQAFHLLS  423
             +    + ALVS P TFF+SND FYYG+LP+L +A AEYG + + MA AS++GQ   HLLS
Sbjct:  325 GPYLATITALVSMPFTFFMSNDAFYYGVLPILTQAAAEYGITPVEMARASIVGQPVHLLS  384

Query:  424 PLVAFIYLLLRLTGLDMGEWQKEAAKYALIIFVIFVVTIIAMGQMPLY             471
            PLV    YLL+ L  +D G+ Q+    K+A+++  +   +   +G  PL+
Sbjct:  385 PLVPSTYLLVGLAKIDFGDHQRFTLKWAVLVCLAILAMLLLGLFPLF              432
```

Based on this analysis, it was predicted that this GAS-specific protein and its epitopes, could be useful antigens for vaccines or diagnostics.

EXAMPLE 2719

A DNA sequence (GASx1174) was identified in *S. pyogenes* <SEQ ID 7937> which encodes the amino acid sequence <SEQ ID 7938>. Analysis of this protein sequence reveals the following:

```
Possible site: 57
>>> Seems to have no N-terminal signal sequence

----- Final Results -----
           bacterial cytoplasm --- Certainty = 0.3948 (Affirmative) < succ>
            bacterial membrane --- Certainty = 0.0000 (Not Clear) < succ>
             bacterial outside --- Certainty = 0.0000 (Not Clear) < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2720

A DNA sequence (GASx1175) was identified in *S. pyogenes* <SEQ ID 7939> which encodes the amino acid sequence <SEQ ID 7940>. Analysis of this protein sequence reveals the following:

```
Possible site: 39
>>> Seems to have no N-terminal signal sequence

----- Final Results -----
          bacterial cytoplasm --- Certainty = 0.3519 (Affirmative) < succ>
          bacterial membrane  --- Certainty = 0.0000 (Not Clear)   < succ>
           bacterial outside  --- Certainty = 0.0000 (Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2721

A DNA sequence (GASx1177) was identified in *S. pyogenes* <SEQ ID 7941> which encodes the amino acid sequence <SEQ ID 7942>. Analysis of this protein sequence reveals the following:

```
Possible site: 60
>>> Seems to have an uncleavable N-term signal seq
INTEGRAL     Likelihood = -9.24     Transmembrane     115-131 (105-137)
INTEGRAL     Likelihood = -8.92     Transmembrane     208-224 (204-238)
INTEGRAL     Likelihood = -7.80     Transmembrane     282-298 (273-303)
INTEGRAL     Likelihood = -4.94     Transmembrane      85-101  (75-102)
INTEGRAL     Likelihood = -4.04     Transmembrane      10-26   (3-32)
INTEGRAL     Likelihood = -3.61     Transmembrane     255-271 (253-271)

----- Final Results -----
          bacterial membrane  --- Certainty = 0.4694 (Affirmative) < succ>
           bacterial outside  --- Certainty = 0.0000 (Not Clear)   < succ>
          bacterial cytoplasm --- Certainty = 0.0000 (Not Clear)   < succ>
```

No corresponding DNA sequence was identified in *S. agalactiae*.

The protein has homology with the following sequences in the GENPEPT database:

```
>GP: AAB89172 GB: AE000960 oxaloacetate decarboxylase, sodium ion pump
subunit (oadB) [Archaeoglobus fulgidus]
Identities = 190/354 (53%), Positives = 255/354 (71%), Gaps = 8/354 (2%)

Query:   16 IVMMVIGALLMYLGIKKEYEPTLLVPMGLGTILVNFPGSGVLTQVVNGVEQEGVFEALFN   75
             +VM+ +G LL+YLGI K+ EP LLVP+G+G ILVN PG G+           E+  +F+
Sbjct:    5 LVMIGVGLLLVYLGIVKKMEPLLLVPIGIGAILVNIPGGGL-------AEEGSIFDLFLK   57

Query:   76 FGIGTELFPLLIFIGIGAMIDFGPLLQNPFMLLFGDAAQFGIFFVVVVAVLAGFDIKEAA  135
             + I TE+ PLLIF+G+GA+ DF PLL NP    L G AAQ GIF  ++ A+  GF +EAA
Sbjct:   58 YLIHTEIVPLLIFLGLGALTDFSPLLANPKTFLLGAAAQIGIFAALIAALFLGFTPQEAA  117

Query:  136 SIGIIGAADGPTSIFVANQLAKDLLGPITVAAYSYMALVPIIQPFAIKLVTTKKERRIRM  195
             SIGIIG ADGPT+I+      LA  LL    VAAYSYM+LVPIIQP  IK +T+ +ER+I+M
Sbjct:  118 SIGIIGGADGPTTIYTTTILAPHLLAATAVAAYSYMSLVPIIQPPIIKALTSSRERKIKM  177

Query:  196 TYKAENVSQMTKILFPIIITLVAGFIAPISLPLVGFLMFGNLLRECGVLDRLSQTAQNEL  255
              +    VS+  KILFPI    +++GF+AP +LPLVG LM GNL RE GV DRL++ A   EL
Sbjct:  178 R-QLRIVSKKEKILFPIATIIISGFLAPKALPLVGMLMTGNLFRESGVTDRLAKGASEEL  236

Query:  256 VNIISILLGLTISIKMQADLFLNVQTLLIIVFGLLAFIMDSIGGVMFAKFLNLFRKEKIN  315
              +NI++I+LGL+     M+A+ FL  +TLL++   G++AF    + GGV+ AK +NLF KEKIN
Sbjct:  237 MNIMTIILGLSVGSTMRAESFLTQKTLLVLALGVVAFAAATAGGVLLAKVMNLFLKEKIN  296

Query:  316 PMIGAAGISAFPMSSRVIQKMATDEDPQNFILMYAVGANVSGQIASVIAGGLLL        369
             PMIGAAG+SA PMS+RV+Q++A +EDP N ILM+A+G NV+G I S +A G+L+
Sbjct:  297 PMIGAAGVSAVPMSARVVQRLAIEEDPHNHILMHAMGPNVAGVIGSAVAAGVLI        350
```

Based on this analysis, it was predicted that this GAS-specific protein and its epitopes, could be useful antigens for vaccines or diagnostics.

EXAMPLE 2722

A DNA sequence (GASx1178) was identified in *S. pyogenes* <SEQ ID 7943> which encodes the amino acid sequence <SEQ ID 7944>. Analysis of this protein sequence reveals the following:

```
Possible site: 16
>>> Seems to have no N-terminal signal sequence
INTEGRAL     Likelihood = -9.50        Transmembrane      21-37 (8-43)

----- Final Results -----
            bacterial membrane --- Certainty = 0.4800 (Affirmative) < succ>
              bacterial outside --- Certainty = 0.0000 (Not Clear)  < succ>
            bacterial cytoplasm --- Certainty = 0.0000 (Not Clear)  < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2723

A DNA sequence (GASx1179) was identified in *S. pyogenes* <SEQ ID 7945> which encodes the amino acid sequence <SEQ ID 7946>. Analysis of this protein sequence reveals the following:

```
Possible site: 60
>>> Seems to have no N-terminal signal sequence

----- Final Results -----
            bacterial cytoplasm --- Certainty = 0.1906 (Affirmative) < succ>
             bacterial membrane --- Certainty = 0.0000 (Not Clear)   < succ>
              bacterial outside --- Certainty = 0.0000 (Not Clear)   < succ>
```

No corresponding DNA sequence was identified in *S. agalactiae*.

The protein has homology with the following sequences in the GENPEPT database:

```
>GP: AAF93961 GB: AE004165 citrate lyase, gamma subunit [Vibrio cholerae]
Identities = 46/97 (47%), Positives = 64/97 (65%)

Query:   1 MDIKQTAVAGSLESSDLMITVSPNDEQTITITLDSSVEKQFGNHIRQLIHQTLVNLKVTA  60
           M I   A AG+LESSDL + + PN++  I + LDS+VE+QFG+ IRQ++   TL  ++V
Sbjct:   1 MKIAHPAFAGTLESSDLQVRIEPNNDGGIELVLDSTVEQQFGHAIRQVVLHTLDAMQVRD  60

Query:  61 AKVEAVDKGALDCTIQARTIAAVHRAAGIDQYDWKEI                        97
            A V   DKGALDC I+AR   AAV RA  +   +W ++
Sbjct:  61 ALVTIEDKGALDCVIRARVQAAVMRACDVQNIEWSQL                        97
```

Based on this analysis, it was predicted that this GAS-specific protein and its epitopes, could be useful antigens for vaccines or diagnostics.

EXAMPLE 2724

A DNA sequence (GASx1181) was identified in *S. pyogenes* <SEQ ID 7947> which encodes the amino acid sequence <SEQ ID 7948>. Analysis of this protein sequence reveals the following:

```
Possible site: 16
>>> Seems to have no N-terminal signal sequence
INTEGRAL Likelihood = -1.65 Transmembrane 74-90 (74-90)
```

-continued

```
----- Final Results -----
bacterial membrane --- Certainty = 0.1659 (Affirmative) < succ>
bacterial outside  --- Certainty = 0.0000 (Not Clear)   < succ>
bacterial cytoplasm --- Certainty = 0.0000 (Not Clear)   < succ>
```

No corresponding DNA sequence was identified in *S. agalactiae*.

The protein has homology with the following sequences in the GENPEPT database:

```
>GP: CAA71632 GB: Y10621 CILB, citryl-CoA lyase beta subunit
[Leuconostoc mesenteroides]
Identities = 187/293 (63%), Positives = 237/293 (80%), Gaps = 1/293 (0%)

Query:    2 ERLRRTMMFVPGANAAMLRDAPLFGADSIMFDLEDSVSLKEKDTSRALVHFALKTFDYSS    61
            ERLRRTMNFVPG N AM++DA +FGADSIMFDLED+VSL EKD++R LV+ AL+T DY S
Sbjct:    4 ERLRRTMMFVPGNNPAMVKDAGIFGADSIMFDLEDAVSLAEKDSARYLVYEALQTVDYGS   63

Query:   62 VETVVRVNGLDS-CGALDIEAVVLAGVNVIRLPKTETAQDIIDVEAVIERVERENSIEVG  120
            E VVR+NGLD+      DI+A+V AG++VIRLPK ETA + ++E++I   E+E   VG
Sbjct:   64 SELVVRINGLDTPFYKNDIKAMVKAGIDVIRLPKVETAAMMHELESLITDAEKEFGRPVG  123

Query:  121 RTRMMAAIESAEGVLNAREIAKASKRLIGIALGAEDYVTNMKTRRYPDGQELFFARSMIL  180
            T MMAAIESA GV+NA EIA AS R+IGIAL AEDY T+MKT RYPDGQEL +AR++IL
Sbjct:  124 TTHMMAAIESALGVVNAVEIANASDRMIGIALSAEDYTTDMKTHRYPDGQELLYARNVIL  183

Query:  181 HAARAAGIAAIDTVYSDVNNTEGFQNEVRMIKQLGFDGKSVINPRQIPLVNEIYTPTKKE  240
            HAARAAGIAA DTV++++N+ EGF  E ++I QLGFDGKS+INPRQI +VN++Y PT+KE
Sbjct:  184 HAARAAGIAAFDTVFTNLNDEEGFYRETQLIHQLGFDGKSLINPRQIEMVNKVYAPTEKE  243

Query:  241 IDHAKQVIWAIREAESKGSGVISLNGKMVDKPIVERAERVIALATAAGVLSEE         293
            I++A+ VI AI EA+ KGSGVIS+NG+MVD+P+V RA+RV+ LA A  ++  E
Sbjct:  244 INNAQNVIAAIEEAKQKGSGVISMNGQMVDRPVVLRAQRVMKLANANHLVDSE         296
```

Based on this analysis, it was predicted that this GAS-specific protein and its epitopes, could be useful antigens for vaccines or diagnostics.

EXAMPLE 2725

A DNA sequence (GASx1182) was identified in *S. pyogenes* <SEQ ID 7949> which encodes the amino acid sequence <SEQ ID 7950>. Analysis of this protein sequence reveals the following:

```
Possible site: 55
>>> Seems to have no N-terminal signal sequence

----- Final Results -----
bacterial cytoplasm --- Certainty = 0.3554 (Affirmative) < succ>
bacterial membrane  --- Certainty = 0.0000 (Not Clear)   < succ>
bacterial outside   --- Certainty = 0.0000 (Not Clear)   < succ>
```

No corresponding DNA sequence was identified in *S. agalactiae*.

The protein has homology with the following sequences in the GENPEPT database:

```
>GP: CAA71633 GB: Y10621 CILA, citrate CoA-transferase alpha subunit
[Leuconostoc mesenteroides]
Identities = 294/511 (57%), Positives = 378/511 (73%), Gaps = 7/511 (1%)

Query:    4 NKLGRDIPQPYADQY--GVFEGELANIKQYDESSRRIKPVKPGDSKLLGSVREAIEKTGL   61
            NK+  D+P   +Q   VFE    +    +++     G+SK+ S+ + +   T L
Sbjct:    3 NRVNIDVPDAILEQLDDSVFESTNYGNPEIQRVGPKVRATT-GESKVQSSIDDVLSNT-L   60

Query:   62 TDGMTISFHHHFREGDFIMNMVLEEIAKMGIKNLSIAPSSIANV-HEPLIDHIKNGVVTN  120
            DGMTISFHHHFREGDF+ N V+ +I  MG +NL++APSS+ NV ++ +I+   IK GVVTN
Sbjct:   61 KDGMTISFHHHFREGDFVFNKVMRKIIDMGYQNLTLAPSSLTNVMNDIVIEAIKKGVVTN  120

Query:  121 ITSSGLRDKVGAAISEGLMENPVVIRSHGGRARAIASGDIHIDVAFLGAPSSDAYGNVNG  180
            ITSSG+R  +G A+S G+++NPV+ RSHG RARAI SG+I IDVAFLG P+SD  GN NG
Sbjct:  121 ITSSGMRGTLGDAVSHGILKNPVIFRSHGARARAIESGEIKIDVAFLGVPNSDEMGNANG  180
```

```
                                  -continued
Query: 181 TKGKATCGSLGYAMIDAKYADQVVILTDNLVPYPNTPISIPQTDVDYVVTVDAIGDPQGI 240
           G A  GSLGYA+IDA+YAD++V++TD ++PYPNTP SI QT VDYVV VD +GDP  I
Sbjct: 181 MNGDAAFGSLGYALIDAQYADKLVLITDTIMPYPNTPASIKQTQVDYVVKVDKVGDPDKI 240

Query: 241 AKGATRFTKNPKELLIAEYAAKVITNSPYFKEGFSFQTGTGGASLAVTRFMREAMIKENI 300
           GATRFTK+PKEL IA+    VI NS YFK  FSFQTG+GGA+LAVTRF+REAM+ +NI
Sbjct: 241 GSGATRFTKDPKELKIAKTVNDVIVNSKYFKNDFSFQTGSGGAALAVTRFLREAMMAQNI 300

Query: 301 KASFALGGITNAMVELLEEELVEKILDVQDFDHPSAVSLGKHAEHYEIDANMYASPLSKG 360
           ASFALGGIT   V+LL E LV +++DVQDFD  +A S+         EIDA+ YA P +KG
Sbjct: 301 MASFALGGITKPTVDLLNEGLVNRVMDVQDFDKGAASSMKLSPNQQEIDASWYADPANKG 360

Query: 361 AVINQLDTCILSALEVDTNFNVNVMTGSDGVIRGASGGHCDTAFAAKMSLVISPLIRGRI 420
           A++++LD   ILSALEVDTNFNVNVM+GSDGVIRGA GGH D A  AK++++  PL+RGRI
Sbjct: 361 AMVDKLDVAILSALEVDTNFNVNVMSGSDGVIRGAIGGHQDAA-TAKLTIISVPLVRGRI 419

Query: 421 PTFVDEVNTVITPGTSVDVIVTEVGIAINPNRQDLVDHFKSL-NVPQFSIEELKEKAYAI 479
           T V +VNTVITPG S+DV+VTEVGIAINP R DLV+  K +  +P +SIEEL++KA   I
Sbjct: 420 ATIVPKVNTVITPGDSIDVVVTEVGIAINPKRTDLVEQLKQVPGLPIYSIEELQQKAEKI 479

Query: 480 VGTPERIQYGDKVVALIEYRDGSLMDVVYNV                              510
           VG P  +++ D+VVA+ EYRDGS++D++  V
Sbjct: 480 VGQPAPLKFTDRVVAVAEYRDGSVIDIIKEV                              510
```

Based on this analysis, it was predicted that this GAS-specific protein and its epitopes, could be useful antigens for vaccines or diagnostics.

EXAMPLE 2726

A DNA sequence (GASx1183) was identified in *S. pyogenes* <SEQ ID 7951> which encodes the amino acid sequence <SEQ ID 7952>. Analysis of this protein sequence reveals the following:

```
Possible site: 13
>>> Seems to have a cleavable N-term signal seq.

----- Final Results -----
bacterial outside  --- Certainty = 0.3000 (Affirmative) < succ>
bacterial membrane --- Certainty = 0.0000 (Not Clear)  < succ>
bacterial cytoplasm --- Certainty = 0.0000 (Not Clear) < succ>
```

No corresponding DNA sequence was identified in *S. agalactiae*.

The protein has homology with the following sequences in the GENPEPT database:

```
>GP: CAA71634 GB: Y10621 CILG, hypothetical protein [Leuconostoc
mesenteroides]
Identities = 65/176 (36%), Positives = 97/176 (54%), Gaps = 3/176 (1%)

Query:  21 DTYFSGEAIQLSDMLRAREERALRQLHLLKEYPEGSLLSVTMNIPGPIKTSPKLLEAFDI  80
           D +  GE + L  +L RE R   Q L+  +P    + SV +N+PGPIKTSPKL   F I
Sbjct:   2 DYFEGGERLNLMQVLDNREWREKYQKQLMASFPTAVITSVKLNLPGPIKTSPKLQSVFQI  61

Query:  81 VIKAIQTALADDKICYQLRLL-PTTGYEYYLITSLPSRDLKLKMIALETELPIGRLMDLD 139
           +I +     D +I +  +   TG + + +TS  + +K MI E     +GRL+DLD
Sbjct:  62 IINDLNPVFKDLQIIKEASFVDQITGPDIFFVTSGCLKLVKQIMITFEESHLLGRLLDLD 121

Query: 140 VLVLQNDLPHSISRTVLGGSPRQCFICSKEAKVCGRLRKHSVEEMQTAISKLLHSF     195
           V+    D   +SR  LG +PR+C +C K+AK C +    HS+ E   I+K+LH+F
Sbjct: 122 VMCQNAD--KQLSREELGFAPRKCLLCGKDAKTCIKEGNHSLAEGYSQINKMLHNF     175
```

Based on this analysis, it was predicted that this GAS-specific protein and its epitopes, could be useful antigens for vaccines or diagnostics.

EXAMPLE 2727

A DNA sequence (GASx1184) was identified in *S. pyogenes* <SEQ ID 7953> which encodes the amino acid sequence <SEQ ID 7954>. Analysis of this protein sequence reveals the following:

Possible site: 58
>>> Seems to have no N-terminal signal sequence

----- Final Results -----
bacterial cytoplasm --- Certainty = 0.3730 (Affirmative) < succ>
bacterial membrane  --- Certainty = 0.0000 (Not Clear)  < succ>
bacterial outside   --- Certainty = 0.0000 (Not Clear)  < succ>

No corresponding DNA sequence was identified in S. agalactiae.

The protein has homology with the following sequences in the GENPEPT database:

```
>GP: AAB99233 GB: U67563 oxaloacetate decarboxylase alpha chain (oadA)
[Methanococcus jannaschii]
Identities = 245/441 (55%), Positives = 336/441 (75%), Gaps = 5/441 (1%)

Query:   10 IRITETVLRDGQQSQIATRMTTKEMIPILETLDNAGYHALEMWGGATFDSCLRFLNEDPW   69
            ++I +T  RD QQS IATRM T++M+PI E +D   G++++E+WGGATFD+C+R+LNEDPW
Sbjct:    2 VKIVDTTFRDAQQSLIATRMRTEDMLPIAEKMDEVGFYSMEVWGGATFDACIRYLNEDPW   61

Query:   70 ERLRAIRKAVKKTKLQMLLRGQNLLGYRNYADDVVRSFIQKSIENGIDIVRIFDALNDPR  129
            ERLRA++K ++ T LQMLLRGQNL+GYR+Y DD+V  F+ K+ ENGIDI RIFDALND R
Sbjct:   62 ERLRALKKRIQNTPLQMLLRGQNLVGYRHYPDDIVEKFVIKAHENGIDIFRIFDALNDVR  121

Query:  130 NLQTAVSATKKFGGHAQVAISYTTSPVHTIDYFVELAKAYQAIGADSICIKDMAGVLTPE  189
            N++TA+   KK G   Q AI YT SPVHTID +VELAK  +G DSICIKDMAG+LTP
Sbjct:  122 NMETAIKTAKKVGAEVQGAICYTISPVHTIDQYVELAKKLEEMGCDSICIKDMAGLLTPY  181

Query:  190 IGYQLVKCIKENTTIPLEVHTHATSGISEMTYLKVAEAGADIIDTAISSFSGGTSQPATE  249
               GY+LVK +KE  ++P++VH+H TSG++ MTYLKV EAGAD++D AIS F+ GTSQP TE
Sbjct:  182 EGYELVKRLKEEISLPIDVHSHCTSGLAPMTYLKVIEAGADMVDCAISPFAMGTSQPPTE  241

Query:  250 SMAIALTDLGFDTGLDMQEVAKVAEYFNTIRDHYREIGILNPKVKDTEPKTLIYQVPGGM  309
            S+ +AL    +DTGLD++ + ++ +YF  +R+ Y+     + +P  +   + + L+YQVPGGM
Sbjct:  242 SIVVALKGTKYDTGLDLKLLNEIRDYFMKVREKYKM--LFSPISQIVDARVLVYQVPGGM  299

Query:  310 LSNLLSQLTEQGLTDKYEEVLAEVPKVRADLGYPPLVTPLSQMVGTQALMNIISGERYKV  369
            LSNL+SQL EQG  DK+EEVL E+P+VR DLGYPPLVTP SQ+VGTQA++N+++ ERYK+
Sbjct:  300 LSNLVSQLKEQGALDKFEEVLQEIPRVRKDLGYPPLVTPTSQIVGTQAVLNVLTEERYKI  359

Query:  370 VPNEIKDYVRGLYGQSPAPLAEGIKEKIIGD-EAVITCRPADLIEPQMIYLRDEIAP--Y  426
             + NE+ +YV+G YG+ PAP+  + ++++ + E  ITCRPADL+ P+   ++ E
Sbjct:  360 ITNEVVNYVKGFYGKPPAPINPELLKRVLDEGEKPITCRPADLLPPEWEKVKKEAEEKGI  419

Query:  427 AHSEEDVLSYASFPQQARDFL                                        447
                EED+L+YA +PQ A  FL
Sbjct:  420 VKKEEDILTYALYPQIAVKFL                                        440
```

Based on this analysis, it was predicted that this GAS-specific protein and its epitopes, could be useful antigens for vaccines or diagnostics.

EXAMPLE 2728

A DNA sequence (GASx1185R) was identified in S. pyogenes <SEQ ID 7955> which encodes the amino acid sequence <SEQ ID 7956>. Analysis of this protein sequence reveals the following:

```
Possible site: 40
>>> Seems to have no N-terminal signal sequence

----- Final Results -----
bacterial cytoplasm --- Certainty = 0.2497 (Affirmative) < succ>
bacterial membrane  --- Certainty = 0.0000 (Not Clear)  < succ>
bacterial outside   --- Certainty = 0.0000 (Not Clear)  < succ>
```

No corresponding DNA sequence was identified in S. agalactiae.

The protein has homology with the following sequences in the GENPEPT database:

```
>GP: AAF93960 GB: AE004165 citrate (pro-3S)-lyase ligase
[Vibrio cholerae]
Identities = 118/336 (35%), Positives = 183/336 (54%), Gaps = 5/336 (1%)

Query:   4 YTISKVFPSDKTTMASVKNLLHQEGIRLDAHLDYTCAIMNAQNDVIATGSYFGNSLRCLC   63
           YT S+V    ++T +   +K  L Q  + +D  +++    +    N +IA G    G+ L+ +
Sbjct:  10 YTFSRVSTKNRTKLLQIKEFLCQHQLTVDDDVEHF-VVAYGTNQIIACGGIAGHVLKSIA   68

Query:  64 VSSAYQGEGLLNRIVSHLIDEEYALGNYHLFVYTKTSSAAFFKDLGFTEIVHIDNHISFL  123
           VS A QG G    ++++ L +   Y +G + LF++TK ++    F+  GF  +  ++ HI+ L
Sbjct:  69 VSPALQGTGFALKLMTELTNFAYEMGRFSLFLFTKPANIDLFRQCGFFLVDKVEPHIALL  128

Query: 124 ENKKTGFQDYLMTLNKPEQTPGKVAAIVINANPFTLGHQFLVEKAARENDWVHLFMVSED  183
           EN        Y    L     + +  K+ +IV+NANPFTLGHQ+L+E+A   + DWVHLF+V  +
Sbjct: 129 ENSPNRLSVYCKQLQLLKMSGRKIGSIVMNANPFTLGHQYLIEQACEQCDWVHLFVVKAE  188

Query: 184 RSLIPFSVRKRLIQEGLAHLDNVIYHETGPYLISQATFPAYFQKEDNDVIKSQALLDTAI  243
                ++ R  +I+ G  HL N+  H     Y+IS+ATFP+YF K+    V +S    LD +I
Sbjct: 189 NKDFSYADRMAMIKAGSKHLLNLTIHSGSDYIISRATFPSYFIKDQQVVNQSHTALDLSI  248

Query: 244 FL-KIAQTLQITKRYVGEEPTSRVTAIYNEIM---AEQLQQAGILLDILPRKAINQQQDP  299
           F    IA  L IT R+VG EP    VT  YN+ M     E+   A   + ++  +    Q   P
Sbjct: 249 FRHSIAPALGITHRFVGSEPICTVTRHYNQAMRRWLEEAHDASAPIQVVEIERSQQASQP  308

Query: 300 ISASTARQALKDNDWDLLAKLLPKTSLDYFCSLKAQ                          335
           ISAS  R  LK   +  +A L+PKT+  Y C   A+
Sbjct: 309 ISASRVRYLLKQFGFAAIADLVPKTTYSYLCQHYAE                          344
```

Based on this analysis, it was predicted that this GAS-specific protein and its epitopes, could be useful antigens for vaccines or diagnostics.

EXAMPLE 2729

A DNA sequence (GASx1187) was identified in *S. pyogenes* <SEQ ID 7957> which encodes the amino acid sequence <SEQ ID 7958>. Analysis of this protein sequence reveals the following:

```
Possible site: 30
>>> Seems to have no N-terminal signal sequence

----- Final Results -----
              bacterial cytoplasm --- Certainty = 0.4790(Affirmative) < succ>
               bacterial membrane --- Certainty = 0.0000(Not Clear) < succ>
                bacterial outside --- Certainty = 0.0000(Not Clear) < succ>
```

No corresponding DNA sequence was identified in *S. agalactiae.*

The protein has no significant homology with any sequences in the GENPEPT database.

Based on this analysis, it was predicted that this GAS-specific protein and its epitopes, could be useful antigens for vaccines or diagnostics.

EXAMPLE 2730

A DNA sequence (GASx1188R) was identified in *S. pyogenes* <SEQ ID 7959> which encodes the amino acid sequence <SEQ ID 7960>. Analysis of this protein sequence reveals the following:

```
Possible site: 21
>>> Seems to have no N-terminal signal sequence

----- Final Results -----
              bacterial cytoplasm --- Certainty = 0.3956(Affirmative) < succ>
               bacterial membrane --- Certainty = 0.0000(Not Clear) < succ>
                bacterial outside --- Certainty = 0.0000(Not Clear) < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2731

A DNA sequence (GASx1190) was identified in *S. pyogenes* <SEQ ID 7961> which encodes the amino acid sequence <SEQ ID 7962>. Analysis of this protein sequence reveals the following:

```
Possible site: 14
>>> Seems to have no N-terminal signal sequence

----- Final Results -----
            bacterial cytoplasm --- Certainty = 0.1274(Affirmative) < succ>
            bacterial membrane  --- Certainty = 0.0000(Not Clear)   < succ>
             bacterial outside  --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2732

A DNA sequence (GASx1196R) was identified in *S. pyogenes* <SEQ ID 7963> which encodes the amino acid sequence <SEQ ID 7964>. Analysis of this protein sequence reveals the following:

```
Possible site: 33
>>> Seems to have a cleavable N-term signal seq.

----- Final Results -----
             bacterial outside  --- Certainty = 0.3000(Affirmative) < succ>
            bacterial membrane  --- Certainty = 0.0000(Not Clear)   < succ>
            bacterial cytoplasm --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2733

A DNA sequence (GASx1211) was identified in *S. pyogenes* <SEQ ID 7965> which encodes the amino acid sequence <SEQ ID 7966>. Analysis of this protein sequence reveals the following:

```
Possible site: 15
>>> Seems to have no N-terminal signal sequence

----- Final Results -----
            bacterial cytoplasm --- Certainty = 0.1850(Affirmative) < succ>
```

```
            bacterial membrane --- Certainty = 0.0000(Not Clear) < succ>
            bacterial outside  --- Certainty = 0.0000(Not Clear) < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2734

A DNA sequence (GASx1219R) was identified in *S. pyogenes* <SEQ ID 7967> which encodes the amino acid sequence <SEQ ID 7968>. Analysis of this protein sequence reveals the following:

```
Possible site: 15
>>> Seems to have no N-terminal signal sequence

----- Final Results -----
            bacterial cytoplasm --- Certainty = 0.2284(Affirmative) < succ>
            bacterial membrane  --- Certainty = 0.0000(Not Clear)   < succ>
            bacterial outside   --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2735

A DNA sequence (GASx1225) was identified in *S. pyogenes* <SEQ ID 7969> which encodes the amino acid sequence <SEQ ID 7970>. Analysis of this protein sequence reveals the following:

```
Possible site: 27
>>> Seems to have no N-terminal signal sequence

----- Final Results -----
            bacterial cytoplasm --- Certainty = 0.2062(Affirmative) < succ>
            bacterial membrane  --- Certainty = 0.0000(Not Clear)   < succ>
            bacterial outside   --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2736

A DNA sequence (GASx1229) was identified in *S. pyogenes* <SEQ ID 7971> which encodes the amino acid sequence <SEQ ID 7972>. Analysis of this protein sequence reveals the following:

```
Possible site: 15
>>> Seems to have no N-terminal signal sequence

----- Final Results -----
             bacterial cytoplasm --- Certainty = 0.2755(Affirmative) < succ>
              bacterial membrane --- Certainty = 0.0000(Not Clear)   < succ>
                bacterial outside --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2737

A DNA sequence (GASx1247R) was identified in *S. pyogenes* <SEQ ID 7973> which encodes the amino acid sequence <SEQ ID 7974>. Analysis of this protein sequence reveals the following:

```
Possible site: 31
>>> Seems to have a cleavable N-term signal seq.
     INTEGRAL      Likelihood = -6.32     Transmembrane     55-71  (53-81)
     INTEGRAL      Likelihood = -6.00     Transmembrane     74-90  (72-95)
     INTEGRAL      Likelihood = -2.18     Transmembrane     95-111 (95-111)
     INTEGRAL      Likelihood = -1.54     Transmembrane    124-140 (123-141)

----- Final Results -----
              bacterial membrane --- Certainty = 0.3527(Affirmative) < succ>
               bacterial outside --- Certainty = 0.0000(Not Clear)   < succ>
             bacterial cytoplasm --- Certainty = 0.0000(Not Clear)   < succ>
```

No corresponding DNA sequence was identified in *S. agalactiae*.

The protein has homology with the following sequences in the GENPEPT database:

```
>GP: CAB14326 GB: Z99116 yqjA [Bacillus subtilis]
Identities = 97/306 (31%), Positives = 154/306 (49%)

Query:    6 RTLKMTLATIVAILIAYQLHLDYAMSAGIIALLSVLDTRKSSLVVARNRLLSFFLAFGIA    65
            RT+K  L T +AI I+   LHL    SAGII +L +  T+K SL  +  R  +  LA   +
Sbjct:    7 RTIKTALGTALAIYISQLLHLQNFASAGIITILCIQITQKRSLQASWARFWACCLAIAFS   66

Query:   66 MMCFSLFGFTTVGFMCYLLIIIPLLYHFQIEAGLVPITVLVTHLIAKKSIALPILSNEFM   125
            +  F L G+          LLI IP+   +I  G+V  +V++ HL     I    + NE
Sbjct:   67 YLFFELIGYHPFVIGALLLIFIPITVLLKINEGIVTSSVIILHLYMSGGITPTFIWNEVQ   126

Query:  126 LFFVGTSVALLFNAYMGPQDQQIRYYHQKVESDLKGILYRFESFLLEGKGQNEGLLIKNL   185
            L   VG  VALL N YM    D+++  Y +K+E +    I    E +LL G+      G   I
Sbjct:  127 LITVGIGVALLMNLYMPSLDRKLIAYRKKIEDNFAVIFAEIERYLLTGEQDWSGKEIPET   186

Query:  186 DKILDEALKLVYRERHNQLFQQTNYQVHYFEMRRQQNRLLGQMAINVNTLMRQSKESILL   245
              +++ EA  L YR+  N + +  N     HYF+MR +Q  ++  ++    V ++       +  ++
Sbjct:  187 HQLITEAKNLAYRDVQNHILRYENLHYHYFKMREKQFEIIERLLPKVTSISITVDQGKMI   246

Query:  246 SHLFHETACQLSEQNPALTLIDDIEQLLETFRHGDLPQTREEFERRAVLFQLLQDLERFI   305
              +  H+    +   N A  +   +  + +  F     LP  TREEFE  RA  LF  LL  ++E+++
Sbjct:  247 AEFIHDLREAIHPGNTAYKFLKRLADMRKEFEEMPLPATREEFEARAALFHLLGEMEQYL   306

Query:  306 LLKVEF                                                         311
            ++K  F
Sbjct:  307 VIKSYF                                                         312
```

Based on this analysis, it was predicted that this GAS-specific protein and its epitopes, could be useful antigens for vaccines or diagnostics.

EXAMPLE 2738

A DNA sequence (GASx1261) was identified in *S. pyogenes* <SEQ ID 7975> which encodes the amino acid sequence <SEQ ID 7976>. Analysis of this protein sequence reveals the following:

```
Possible site: 15
>>> Seems to have no N-terminal signal sequence

----- Final Results -----
            bacterial cytoplasm --- Certainty = 0.6082(Affirmative) < succ>
            bacterial membrane  --- Certainty = 0.0000(Not Clear)   < succ>
            bacterial outside   --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2739

A DNA sequence (GASx1262R) was identified in *S. pyogenes* <SEQ ID 7977> which encodes the amino acid sequence <SEQ ID 7978>. Analysis of this protein sequence reveals the following:

```
Possible site: 51
>>> Seems to have no N-terminal signal sequence
     INTEGRAL    Likelihood = -7.06    Transmembrane    38-54 (37-55)

----- Final Results -----
            bacterial membrane  --- Certainty = 0.3824(Affirmative) < succ>
            bacterial outside   --- Certainty = 0.0000(Not Clear)   < succ>
            bacterial cytoplasm --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2740

A DNA sequence (GASx1265R) was identified in *S. pyogenes* <SEQ ID 7979> which encodes the amino acid sequence <SEQ ID 7980>. Analysis of this protein sequence reveals the following:

```
Possible site: 25
>>> Seems to have a cleavable N-term signal seq.

----- Final Results -----
            bacterial outside   --- Certainty = 0.3000(Affirmative) < succ>
            bacterial membrane  --- Certainty = 0.0000(Not Clear)   < succ>
            bacterial cytoplasm --- Certainty = 0.0000(Not Clear)   < succ>
```

No corresponding DNA sequence was identified in *S. agalactiae*.

Based on this analysis, it was predicted that this GAS-specific protein and its epitopes, could be useful antigens for vaccines or diagnostics.

EXAMPLE 2741

A DNA sequence (GASx1270) was identified in *S. pyogenes* <SEQ ID 7981> which encodes the amino acid sequence <SEQ ID 7982>. Analysis of this protein sequence reveals the following:

```
Possible site: 36
>>> Seems to have no N-terminal signal sequence

----- Final Results -----
            bacterial cytoplasm --- Certainty = 0.4063(Affirmative) < succ>
            bacterial membrane  --- Certainty = 0.0000(Not Clear)   < succ>
            bacterial outside   --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2742

A DNA sequence (GASx1290R) was identified in *S. pyogenes* <SEQ ID 7983> which encodes the amino acid sequence <SEQ ID 7984>. Analysis of this protein sequence reveals the following:

```
Possible site: 26
>>> Seems to have no N-terminal signal sequence
    INTEGRAL    Likelihood = -12.37    Transmembrane   180-196 (172-207)
    INTEGRAL    Likelihood = -10.19    Transmembrane    34-50  (30-53)
    INTEGRAL    Likelihood =  -4.09    Transmembrane   233-249 (232-250)

----- Final Results -----
            bacterial membrane  --- Certainty = 0.5946(Affirmative) < succ>
            bacterial outside   --- Certainty = 0.0000(Not Clear)   < succ>
            bacterial cytoplasm --- Certainty = 0.0000(Not Clear)   < succ>
```

No corresponding DNA sequence was identified in *S. agalactiae*.

The protein has homology with the following sequences in the GENPEPT database:

```
>GP: AAB88010 GB: L21856 MalA [Streptococcus pneumoniae]
Identities = 66/237 (27%), Positives = 105/237 (43%), Gaps = 28/237 (11%)

Query:   45 MIPVTLHYANMTTYPLERIVTKSLSPITDKTYQALTQGKIEKD---TFQGQSLIRRD---   98
            M+P+ +  ++ TYPLE +      P+TDK Q L++     D    T+ G +
Sbjct:    1 MVPIAIQNSSQETYPLETFIDNVYEPLTDKVVQDLSEHATIVDGTLTYTGTASQAPSVVI   60

Query:   99 GELVLAVLPTKVDLEQLASESTRQIIVTKKEWRFVTPDGKEL-RAHVRGQQQSLADLTTV  157
            G   + LP +L      T +++++K       + KEL R   R Q        T
Sbjct:   61 GPSQIKELPKDLQLHF----DTNELVISK--------ESKELTRISYRAIQ------TEG  102

Query:  158 KAVKDFVNQQWY---DSNKASVLGFLLLTFVLMVCVGTLIVIGLGAFFLTLTKKRSRLFMI  214
            K  KD + Q +     +N+  +  FL+L   +   +   IV        L +TK+SRLF
Sbjct:  103 FKSKDSLTQAFIRLVPTNRVYISLFLVLGASFLFGLNFFIVSLGACLLLYITKKSRLFSF  162

Query:  215 RNFSEGLGLMVNCLAWPSLLAIALSFFIQDPVLIMNCQVFGTLLMLTWVFYKTQFRD      271
              R F E     ++NCL  P+L+ + L  F Q+   ++    Q    +L L  +FYKT FRD
Sbjct:  163 RTFKECYHFILNCLGLPTLITLILGLFGQNMTLITVQNILFVLYLVTIFYKTHFRD      219
```

Based on this analysis, it was predicted that this GAS-specific protein and its epitopes, could be useful antigens for vaccines or diagnostics.

EXAMPLE 2743

A DNA sequence (GASx1294) was identified in *S. pyogenes* <SEQ ID 7985> which encodes the amino acid sequence <SEQ ID 7986>. Analysis of this protein sequence reveals the following:

```
Possible site: 18
>>> Seems to have no N-terminal signal sequence

----- Final Results -----
            bacterial cytoplasm --- Certainty = 0.2104(Affirmative) < succ>
            bacterial membrane  --- Certainty = 0.0000(Not Clear)   < succ>
            bacterial outside   --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2744

A DNA sequence (GASx1303R) was identified in *S. pyogenes* <SEQ ID 7987> which encodes the amino acid sequence <SEQ ID 7988>. Analysis of this protein sequence reveals the following:

```
Possible site: 38
>>> Seems to have an uncleavable N-term signal seq
    INTEGRAL    Likelihood = -8.07    Transmembrane    13-29 (8-38)

----- Final Results -----
            bacterial membrane  --- Certainty = 0.4227(Affirmative) < succ>
            bacterial outside   --- Certainty = 0.0000(Not Clear)   < succ>
            bacterial cytoplasm --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2745

A DNA sequence (GASx1307R) was identified in *S. pyogenes* <SEQ ID 7989> which encodes the amino acid sequence <SEQ ID 7990>. Analysis of this protein sequence reveals the following:

```
Possible site: 19
>>> Seems to have a cleavable N-term signal seq.

----- Final Results -----
            bacterial outside   --- Certainty = 0.3000(Affirmative) < succ>
            bacterial membrane  --- Certainty = 0.0000(Not Clear)   < succ>
            bacterial cytoplasm --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2746

A DNA sequence (GASx1312R) was identified in *S. pyogenes* <SEQ ID 7991> which encodes the amino acid sequence <SEQ ID 7992>. Analysis of this protein sequence reveals the following:

```
Possible site: 21
>>> Seems to have no N-terminal signal sequence

----- Final Results -----
            bacterial cytoplasm --- Certainty = 0.1996(Affirmative) < succ>
            bacterial membrane  --- Certainty = 0.0000(Not Clear)   < succ>
             bacterial outside  --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2747

A DNA sequence (GASx1316R) was identified in *S. pyogenes* <SEQ ID 7993> which encodes the amino acid sequence <SEQ ID 7994>. Analysis of this protein sequence reveals the following:

```
Possible site: 58
>>> Seems to have no N-terminal signal sequence

----- Final Results -----
            bacterial cytoplasm --- Certainty = 0.3504(Affirmative) < succ>
            bacterial membrane  --- Certainty = 0.0000(Not Clear)   < succ>
             bacterial outside  --- Certainty = 0.0000(Not Clear)   < succ>
RGD motif: 271-273
```

No corresponding DNA sequence was identified in *S. agalactiae*.

The protein has homology with the following sequences in the GENPEPT database:

```
>GP: AAC66321 GB: AE000792 outer surface protein, putative
[Borrelia burgdorferi]
Identities = 127/365 (34%), Positives = 195/365 (52%), Gaps = 14/365 (3%)

Query:   1 MVDLGFSLYPERYDVTKSKAYIDLCHSYGAKRLFMSLLQLAPADHQMFHCYAELIAYANQ   60
           M ++G S+YP      K   Y++    +G  ++F SLL +   +   F  + EL++ AN+
Sbjct:   1 MKEIGISIYPNVSPKNKIIKYLEKSAHFGFTQVFTSLLYI---NGNEFDIFKELLSIANK  57

Query:  61 LGIRVIADVSPSFISQAGWSDQLIERA------HAFGLAGLRLDEALPLAEIVTLTRNPF  114
           G++ I DVSP   + G     +          G   +RLD      E    +T N
Sbjct:  58 NGMKPIIDVSPEIFKELGIDLSNLRNCPKLDYFKKLGAWAIRLDNTFTGIEESLMTFNDS  117

Query: 115 GLKIELNMSTDKQLLMSLLATDAERSNIIGCHNFYPHEFTGLSWQHFKDMSRFYHEHDIE  174
           LKI+LN+S   +  +++       N++GCHNFYPH++TGLS    FK+ ++ +   + I
Sbjct: 118 DLKIQLNISNINKHIDTIMYFKPNIKNLLGCHNFYPHKYTGLSRNFFKETTKIFKHYSIP  177

Query: 175 TAAFITAQSASE-GPWLLAEGLPTVEDHRHLPIGLQVELMKAIGTIDNILISNQFISEEE  233
           TAAFI++ +A E    EG+PT+E HR    I  Q + +    G ID +LISN F SE E
```

-continued

```
Sbjct: 178 TAAFISSNNAEECARGKEKEGVPTLESHRSKDIETQAKDLFKEG-IDTVLISNCFPSETE 236

Query: 234 LAACTQALARPVTTIKVRPIIDLTEVEEQII-GYPHCYRGDVSDYVIRSTMPRLVYAQES 292
           L   ++ + R +  +K     D    VE++II     H   RGD++ Y IRSTMPR+ Y   +
Sbjct: 237 LKKVSK-VNRNILELKADLNPDANSVEKEIILENLHFNRGDINSYRIRSTMPRVYYNNKK 295

Query: 293 IAPRDQSKEVKRGSIIIDNDRYHRYKGELQIALKNFTVSSKANVVAEVREDYLSLLDDLR 352
               P    E+K+G I+ID+  Y  Y GELQIALK+   +    NVV ++   D + LL+ +
Sbjct: 296 F-PVHSPNEIKKGDILIDSSEYLGYTGELQIALKDTPNNGLVNVVGKIINDEIYLLEKIE 354

Query: 353 PWQEF 357
           PW++F
Sbjct: 355 PWEKF 359
```

Based on this analysis, it was predicted that this GAS-specific protein and its epitopes, could be useful antigens for vaccines or diagnostics.

EXAMPLE 2748

A DNA sequence (GASx1319) was identified in *S. pyogenes* <SEQ ID 7995> which encodes the amino acid sequence <SEQ ID 7996>. Analysis of this protein sequence reveals the following:

```
Possible Site: 34
>>> Seems to have no N-terminal signal sequence
INTEGRAL    Likelihood = -9.50       Transmembrane        127-143 (125-151)
INTEGRAL    Likelihood = -7.43       Transmembrane          17-33 (15-36)
INTEGRAL    Likelihood = -5.68       Transmembrane          39-55 (36-57)
INTEGRAL    Likelihood = -1.86       Transmembrane          60-76 (59-77)
INTEGRAL    Likelihood = -0.59       Transmembrane         85-101 (85-101)

----- Final Results -----
              bacterial membrane --- Certainty = 0.4800 (Affirmative) < succ>
               bacterial outside --- Certainty = 0.0000 (Not Clear) < succ>
             bacterial cytoplasm --- Certainty = 0.0000 (Not Clear) < succ>
```

No corresponding DNA sequence was identified in *S. agalactiae.*

The protein has no significant homology with any sequences in the GENPEPT database.

Based on this analysis, it was predicted that this GAS-specific protein and its epitopes, could be useful antigens for vaccines or diagnostics.

EXAMPLE 2749

A DNA sequence (GASx1320) was identified in *S. pyogenes* <SEQ ID 7997> which encodes the amino acid sequence <SEQ ID 7998>. Analysis of this protein sequence reveals the following:

```
Possible site: 45
>>> Seems to have no N-terminal signal sequence
INTEGRAL    Likelihood = -1.81         Transmembrane       35-51 (35-51)

----- Final Results -----
              bacterial membrane --- Certainty = 0.1723 (Affirmative) < succ>
               bacterial outside --- Certainty = 0.0000 (Not Clear) < succ>
             bacterial cytoplasm --- Certainty = 0.0000 (Not Clear) < succ>
```

No corresponding DNA sequence was identified in S. agalactiae.

The protein has no significant homology with any sequences in the GENPEPT database.

Based on this analysis, it was predicted that this GAS-specific protein and its epitopes, could be useful antigens for vaccines or diagnostics.

EXAMPLE 2750

A DNA sequence (GASx1321) was identified in S. pyogenes <SEQ ID 7999> which encodes the amino acid sequence <SEQ ID 8000>. Analysis of this protein sequence reveals the following:

```
Possible site: 29
>>> Seems to have an uncleavable N-term signal seq

----- Final Results -----
            bacterial membrane --- Certainty = 0.0000 (Not Clear) < succ>
              bacterial outside --- Certainty = 0.0000 (Not Clear) < succ>
            bacterial cytoplasm --- Certainty = 0.0000 (Not Clear) < succ>
```

No corresponding DNA sequence was identified in S. agalactiae.

The protein has no significant homology with any sequences in the GENPEPT database.

Based on this analysis, it was predicted that this GAS-specific protein and its epitopes, could be useful antigens for vaccines or diagnostics.

EXAMPLE 2751

A DNA sequence (GASx1329) was identified in S. pyogenes <SEQ ID 8001> which encodes the amino acid sequence <SEQ ID 8002>. Analysis of this protein sequence reveals the following:

```
Possible site: 44
>>> Seems to have no N-terminal signal sequence
INTEGRAL Likelihood = -1.28 Transmembrane 64-80 (64-80)

----- Final Results -----
bacterial membrane --- Certainty = 0.1510 (Affirmative) < succ>
bacterial outside --- Certainty = 0.0000 (Not Clear) < succ>
bacterial cytoplasm --- Certainty = 0.0000 (Not Clear) < succ>
```

No corresponding DNA sequence was identified in S. agalactiae.

The protein has no significant homology with any sequences in the GENPEPT database.

Based on this analysis, it was predicted that this GAS-specific protein and its epitopes, could be useful antigens for vaccines or diagnostics.

EXAMPLE 2752

A DNA sequence (GASx1332R) was identified in S. pyogenes <SEQ ID 8003> which encodes the amino acid sequence <SEQ ID 8004>. Analysis of this protein sequence reveals the following:

```
Possible site: 37
>>> Seems to have an uncleavable N-term signal seq

----- Final Results -----
            bacterial membrane --- Certainty = 0.0000 (Not Clear) < succ>
             bacterial outside --- Certainty = 0.0000 (Not Clear) < succ>
            bacterial cytoplasm --- Certainty = 0.0000 (Not Clear) < succ>
```

No corresponding DNA sequence was identified in S. agalactiae.

The protein has no significant homology with any sequences in the GENPEPT database.

Based on this analysis, it was predicted that this GAS-specific protein and its epitopes, could be useful antigens for vaccines or diagnostics.

EXAMPLE 2753

A DNA sequence (GASx1333) was identified in S. pyogenes <SEQ ID 8005> which encodes the amino acid sequence <SEQ ID 8006>. Analysis of this protein sequence reveals the following:

```
Possible site: 29
>>> Seems to have an uncleavable N-term signal seq

----- Final Results -----
            bacterial membrane --- Certainty = 0.0000 (Not Clear) < succ>
              bacterial outside --- Certainty = 0.0000 (Not Clear) < succ>
           bacterial cytoplasm --- Certainty = 0.0000 (Not Clear) < succ>
```

No corresponding DNA sequence was identified in S. agalactiae.

The protein has no significant homology with any sequences in the GENPEPT database.

Based on this analysis, it was predicted that this GAS-specific protein and its epitopes, could be useful antigens for vaccines or diagnostics.

EXAMPLE 2754

A DNA sequence (GASx1335R) was identified in S. pyogenes <SEQ ID 8007> which encodes the amino acid sequence <SEQ ID 8008>. Analysis of this protein sequence reveals the following:

```
Possible site: 37
>>> Seems to have an uncleavable N-term signal seq

----- Final Results -----
            bacterial membrane --- Certainty = 0.0000 (Not Clear) < succ>
              bacterial outside --- Certainty = 0.0000 (Not Clear) < succ>
           bacterial cytoplasm --- Certainty = 0.0000 (Not Clear) < succ>
```

No corresponding DNA sequence was identified in S. agalactiae.

The protein has homology with the following sequences in the GENPEPT database:

```
>GP: AAF96047 GB: AE004354 uridine phosphorylase [Vibrio cholerae]
Identities = 46/167 (27%), Positives = 72/167 (42%), Gaps = 12/167 (7%)
```

-continued

```
Query:   8 GVKEMISTGTCGVLVP-IAENRFLVPVKALRDEGTSYHYVAPSRYIDIDPKMLRLIEKTL    66
           G K ++  G+ G +    I     ++   A+RDEG S  Y+ +       +++ +++ L
Sbjct:  79 GAKAIVRVGSAGAMQSEIGLGELILVEGAVRDEGGSKAYIGAAYPAYSSFELVVEMQRFL  138

Query:  67 LAQGLAYQEVITWSTDGFYR-ETKEKVAHRQEEGCSVVEMECSALAAVAQLRG-----IL  120
             Q +     I  S D FY  E   E   +   +G   +ME SAL  V +LRG      +L
Sbjct: 139 AEQSVPIHRGIVRSHDSFYTDEEAELCRYWHRKGILAADMETSALLTVGRLRGLQVASVL  198

Query: 121 WGQLLFTADTLADVEVY---DQRNWGADSFSFALHLCLEVLNTLEKD             164
            +L+   D  A V  Y    DQR    +  + A     L  LN L+ D
Sbjct: 199 NNVVLYEQDVQAGVNQYVNADQRMMQGE--TLAARAALHALNALKFD             243
```

Based on this analysis, it was predicted that this GAS-specific protein and its epitopes, could be useful antigens for vaccines or diagnostics.

EXAMPLE 2755

A DNA sequence (GASx1353) was identified in *S. pyogenes* <SEQ ID 8009> which encodes the amino acid sequence <SEQ ID 8010>. Analysis of this protein sequence reveals the following:

```
Possible site: 42
>>> Seems to have a cleavable N-term signal seq.
INTEGRAL    Likelihood = -5.79       Transmembrane         241-257 (234-260)
INTEGRAL    Likelihood = -5.15       Transmembrane           44-60 (43-65)
INTEGRAL    Likelihood = -4.78       Transmembrane           74-90 (72-92)

----- Final Results -----
               bacterial membrane --- Certainty = 0.3314 (Affirmative) < succ>
                bacterial outside --- Certainty = 0.0000 (Not Clear) < succ>
              bacterial cytoplasm --- Certainty = 0.0000 (Not Clear) < succ>
```

No corresponding DNA sequence was identified in *S. agalactiae.*

The protein has no significant homology with any sequences in the GENPEPT database.

Based on this analysis, it was predicted that this GAS-specific protein and its epitopes, could be useful antigens for vaccines or diagnostics.

EXAMPLE 2756

A DNA sequence (GASx1354R) was identified in *S. pyogenes* <SEQ ID 8011> which encodes the amino acid sequence <SEQ ID 8012>. Analysis of this protein sequence reveals the following:

```
Possible site: 55
>>> Seems to have a cleavable N-term signal seq.
INTEGRAL    Likelihood = -3.45         Transmembrane       68-84 (65-86)

----- Final Results -----
               bacterial membrane --- Certainty = 0.2381 (Affirmative) < succ>
                bacterial outside --- Certainty = 0.0000 (Not Clear) < succ>
              bacterial cytoplasm --- Certainty = 0.0000 (Not Clear) < succ>
```

No corresponding DNA sequence was identified in *S. agalactiae.*

The protein has homology with the following sequences in the GENPEPT database:

>GP: CAB83831 GB: AL162753 putative integral membrane protein

[*Neisseria meningitidis*]

Identities = 31/72 (43%), Positives = 46/72 (63%), Gaps = 6/72 (8%)

-continued

```
Query:  17 FVIYAFDKRKAIKKKRRISERKLLVITVLFGGF-GALLAAKKYHHKTRKWYFVI----TC  71
           F +Y  DKR+A++ KRRI E +LL +   LFGG+ GA L ++ + HKT K   FV+     T
Sbjct:  38 FALYGIDKRRAVRGKRRIPEHRLL-LPALFGGWAGAYLGSRIFRHKTAKKRFVVLFRLTV  96

Query:  72 YTSILLTLLVTY  83
           ++L TL++ Y
Sbjct:  97 SGNVLATLILIY  108
```

Based on this analysis, it was predicted that this GAS-specific protein and its epitopes, could be useful antigens for vaccines or diagnostics.

EXAMPLE 2757

A DNA sequence (GASx1363R) was identified in *S. pyogenes* <SEQ ID 8013> which encodes the amino acid sequence <SEQ ID 8014>. Analysis of this protein sequence reveals the following:

```
Possible Site: 21
>>> Seems to have an uncleavable N-term signal seq

----- Final Results -----
           bacterial membrane --- Certainty = 0.0000 (Not Clear) < succ>
            bacterial outside --- Certainty = 0.0000 (Not Clear) < succ>
          bacterial cytoplasm --- Certainty = 0.0000 (Not Clear) < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2758

A DNA sequence (GASx1367) was identified in *S. pyogenes* <SEQ ID 8015> which encodes the amino acid sequence <SEQ ID 8016>. Analysis of this protein sequence reveals the following:

```
Possible site: 31
>>> Seems to have an uncleavable N-term signal seq

----- Final Results -----
           bacterial membrane --- Certainty = 0.0000 (Not Clear) < succ>
            bacterial outside --- Certainty = 0.0000 (Not Clear) < succ>
          bacterial cytoplasm --- Certainty = 0.0000 (Not Clear) < succ>
```

No corresponding DNA sequence was identified in *S. agalactiae*.

The protein has homology with the following sequences in the GENPEPT database:

```
>GP: CAA63508 GB: X92946 hypothetical protein [Lactococcus lactis]
Identities = 64/96 (66%), Positives = 77/96 (79%)

Query:  1 MPRKTFDKAFKLSAVKLILEEEQPVKMVSSTLEIHPNSLYQWIQEYEKYGESAFPGHGSA  60
          M R+ FDK FK SAVKLILEE   VK VS   LE+H NSLY+W+QE E+YGESAFPG+G+A
Sbjct:  1 MARRKEDKQFKNSAVKLILEEGYSVKEVSQELEVHANSLYRWVQEVEEYGESAFPGNGTA  60
```

```
-continued
Query:  61 LRHAQFKTKKLEKEHKLLQEELALLKKFQVFLKPNR                        96
           L +AQ K K LEKE++ LQEEL LLKKF+VFLK ++
Sbjct:  61 LANAQHKIKLLEKENRYLQEELELLKKFRVFLKRSK                        96
```

Based on this analysis, it was predicted that this GAS-specific protein and its epitopes, could be useful antigens for vaccines or diagnostics.

EXAMPLE 2759

A DNA sequence (GASx1374R) was identified in *S. pyogenes* <SEQ ID 8017> which encodes the amino acid sequence <SEQ ID 8018>. Analysis of this protein sequence reveals the following:

```
Possible site: 39
>>> Seems to have no N-terminal signal sequence

----- Final Results -----
              bacterial cytoplasm --- Certainty = 0.2585 (Affirmative) < succ>
              bacterial membrane  --- Certainty = 0.0000 (Not Clear)   < succ>
                bacterial outside --- Certainty = 0.0000 (Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2760

A DNA sequence (GASx1382R) was identified in *S. pyogenes* <SEQ ID 8019> which encodes the amino acid sequence <SEQ ID 8020>. Analysis of this protein sequence reveals the following:

```
Possible site: 14
>>> Seems to have an uncleavable N-term signal seq
INTEGRAL     Likelihood = -2.39         Transmembrane       3-19 (3-19)

----- Final Results -----
              bacterial membrane  --- Certainty = 0.1956 (Affirmative) < succ>
                bacterial outside --- Certainty = 0.0000 (Not Clear)   < succ>
              bacterial cytoplasm --- Certainty = 0.0000 (Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2761

A DNA sequence (GASx1391R) was identified in *S. pyogenes* <SEQ ID 8021> which encodes the amino acid sequence <SEQ ID 8022>. Analysis of this protein sequence reveals the following:

```
Possible site: 22
>>> May be a lipoprotein
```

```
----- Final Results -----
           bacterial membrane  --- Certainty = 0.0000 (Not Clear) < succ>
           bacterial outside   --- Certainty = 0.0000 (Not Clear) < succ>
         bacterial cytoplasm   --- Certainty = 0.0000 (Not Clear) < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2762

A DNA sequence (GASx1404) was identified in *S. pyogenes* <SEQ ID 8023> which encodes the amino acid sequence <SEQ ID 8024>. Analysis of this protein sequence reveals the following:

```
Possible site: 32
>>> Seems to have no N-terminal signal sequence

----- Final Results -----
         bacterial cytoplasm  --- Certainty = 0.3046 (Affirmative) < succ>
          bacterial membrane  --- Certainty = 0.0000 (Not Clear)   < succ>
           bacterial outside  --- Certainty = 0.0000 (Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2763

A DNA sequence (GASx1412R) was identified in *S. pyogenes* <SEQ ID 8025> which encodes the amino acid sequence <SEQ ID 8026>. Analysis of this protein sequence reveals the following:

```
Possible site: 20
>>> Seems to have no N-terminal signal sequence

----- Final Results -----
         bacterial cytoplasm  --- Certainty = 0.1590 (Affirmative) < succ>
          bacterial membrane  --- Certainty = 0.0000 (Not Clear)   < succ>
           bacterial outside  --- Certainty = 0.0000 (Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2764

A DNA sequence (GASx1414R) was identified in *S. pyogenes* <SEQ ID 8027> which encodes the amino acid sequence <SEQ ID 8028>. Analysis of this protein sequence reveals the following:

```
Possible site: 24
>>> Seems to have no N-terminal signal sequence

----- Final Results -----
            bacterial cytoplasm --- Certainty = 0.2816 (Affirmative) < succ>
            bacterial membrane  --- Certainty = 0.0000 (Not Clear)   < succ>
              bacterial outside --- Certainty = 0.0000 (Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2765

A DNA sequence (GASx1416) was identified in *S. pyogenes* <SEQ ID 8029> which encodes the amino acid sequence <SEQ ID 8030>. Analysis of this protein sequence reveals the following:

```
Possible site: 34
>>> Seems to have no N-terminal signal sequence

----- Final Results -----
            bacterial cytoplasm --- Certainty = 0.1744 (Affirmative) < succ>
            bacterial membrane  --- Certainty = 0.0000 (Not Clear)   < succ>
              bacterial outside --- Certainty = 0.0000 (Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2766

A DNA sequence (GASx1417) was identified in *S. pyogenes* <SEQ ID 8031> which encodes the amino acid sequence <SEQ ID 8032>. Analysis of this protein sequence reveals the following:

```
Possible site: 13
>>> Seems to have no N-terminal signal sequence

----- Final Results -----
            bacterial cytoplasm --- Certainty = 0.3771 (Affirmative) < succ>
```

```
                bacterial membrane --- Certainty = 0.0000 (Not Clear) < succ>
                 bacterial outside --- Certainty = 0.0000 (Not Clear) < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2767

A DNA sequence (GASx1419R) was identified in *S. pyogenes* <SEQ ID 8033> which encodes the amino acid sequence <SEQ ID 8034>. Analysis of this protein sequence reveals the following:

```
Possible site: 13
>>> Seems to have an uncleavable N-term signal seq
INTEGRAL    Likelihood = -10.93        Transmembrane     4-20 (1-25)

----- Final Results -----
                bacterial membrane --- Certainty = 0.5373 (Affirmative) < succ>
                 bacterial outside --- Certainty = 0.0000 (Not Clear)   < succ>
                bacterial cytoplasm --- Certainty = 0.0000 (Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2768

A DNA sequence (GASx1423) was identified in *S. pyogenes* <SEQ ID 8035> which encodes the amino acid sequence <SEQ ID 8036>. Analysis of this protein sequence reveals the following:

```
Possible site: 39
>>> Seems to have no N-terminal signal sequence
INTEGRAL    Likelihood = -8.97         Transmembrane     30-46 (25-49)
INTEGRAL    Likelihood = -7.80         Transmembrane     52-68 (50-72)
INTEGRAL    Likelihood = -6.95         Transmembrane     129-145 (125-146)

----- Final Results -----
                bacterial membrane --- Certainty = 0.4588 (Affirmative) < succ>
                 bacterial outside --- Certainty = 0.0000 (Not Clear)   < succ>
                bacterial cytoplasm --- Certainty = 0.0000 (Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2769

A DNA sequence (GASx1426R) was identified in *S. pyogenes* <SEQ ID 8037> which encodes the amino acid sequence <SEQ ID 8038>. Analysis of this protein sequence reveals the following:

```
Possible site: 25
>>> Seems to have a cleavable N-term signal seq.
INTEGRAL    Likelihood = -3.45         Transmembrane       36-52 (36-55)

----- Final Results -----
              bacterial membrane --- Certainty = 0.2381 (Affirmative) < succ>
                bacterial outside --- Certainty = 0.0000 (Not Clear)  < succ>
             bacterial cytoplasm --- Certainty = 0.0000 (Not Clear)  < succ>
```

No corresponding DNA sequence was identified in *S. agalactiae*.

The protein has homology with the following sequences in the GENPEPT database:

```
>GP: AAC39287 GB: AF115103 orf87 gp [Streptococcus thermophilus
bacteriophage Sfi21]
Identities = 43/73 (58%), Positives = 61/73 (82%)

Query:   1 MINLKLRLQNKVTLMAILGAIFLLAQQLGIKLPSNIADIANTAVTLLVLLGVVTDPTTKG   60
           MIN KLRLQNK TL+A++ A+FL+ QQ G+ +P+NI +  NT V +LV+LG++TDPTTKG
Sbjct:   8 MINFKLRLQNKATLVALISAVFLMLQQFGLHVPNNIQEGINTLVGILVILGIITDPTTKG   67

Query:  61 LSDSEQALTYHEP                                                 73
           ++DSE+AL+Y +P
Sbjct:  68 IADSERALSYIQP                                                 80
```

Based on this analysis, it was predicted that this GAS-specific protein and its epitopes, could be useful antigens for vaccines or diagnostics.

EXAMPLE 2770

A DNA sequence (GASx1427R) was identified in *S. pyogenes* <SEQ ID 8039> which encodes the amino acid sequence <SEQ ID 8040>. Analysis of this protein sequence reveals the following:

```
Possible site: 27
>>> Seems to have an uncleavable N-term signal seq
INTEGRAL    Likelihood = -3.03         Transmembrane       2-18 (1-23)

----- Final Results -----
              bacterial membrane --- Certainty = 0.2211 (Affirmative) < succ>
                bacterial outside --- Certainty = 0.0000 (Not Clear)  < succ>
             bacterial cytoplasm --- Certainty = 0.0000 (Not Clear)  < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2771

A DNA sequence (GASx1428R) was identified in *S. pyogenes* <SEQ ID 8041> which encodes the amino acid sequence <SEQ ID 8042>. Analysis of this protein sequence reveals the following:

```
Possible site: 20
>>> Seems to have no N-terminal signal sequence

----- Final Results -----
            bacterial cytoplasm --- Certainty = 0.1017 (Affirmative) < succ>
            bacterial membrane  --- Certainty = 0.0000 (Not Clear)   < succ>
             bacterial outside  --- Certainty = 0.0000 (Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2772

A DNA sequence (GASx1429R) was identified in *S. pyogenes* <SEQ ID 8043> which encodes the amino acid sequence <SEQ ID 8044>. Analysis of this protein sequence reveals the following:

```
Possible site: 46
>>> Seems to have no N-terminal signal sequence

----- Final Results -----
            bacterial cytoplasm --- Certainty = 0.3097 (Affirmative) < succ>
            bacterial membrane  --- Certainty = 0.0000 (Not Clear)   < succ>
             bacterial outside  --- Certainty = 0.0000 (Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2773

A DNA sequence (GASx1431R) was identified in *S. pyogenes* <SEQ ID 8045> which encodes the amino acid sequence <SEQ ID 8046>. Analysis of this protein sequence reveals the following:

```
Possible site: 50
>>> Seems to have no N-terminal signal sequence

----- Final Results -----
            bacterial cytoplasm --- Certainty = 0.2584 (Affirmative) < succ>
            bacterial membrane  --- Certainty = 0.0000 (Not Clear)   < succ>
             bacterial outside  --- Certainty = 0.0000 (Not Clear)   < succ>
```

No corresponding DNA sequence was identified in *S. agalactiae*.

The protein has homology with the following sequences in the GENPEPT database:

```
>GP: AAA98101 GB: M19348 hyaluronidase [Streptococcus pyogenes phage
H4489A]
Identities = 337/371 (90%), Positives = 351/371 (93%), Gaps = 1/371 (0%)

Query:    1 MAENIPLRVQFKRMKAAEWASSDVVLLEGEIGFETDTGFAKFGDGQNTFSKLKYLTGPKG    60
            M ENIPLRVQFKRM A EWA SDV+LLEGEIGFETDTGFAKFGDGQNTFSKLKYLTGPKG
Sbjct:    1 MTENIPLRVQFKRMSADEWARSDVILLEGEIGFETDTGFAKFGDGQNTFSKLKYLTGPKG    60

Query:   61 PKGDTGLQGKTGGTGSRGPAGKPGTTDYDQLQNKPDLGAFAQKEETNSKITKLESSKADK   120
            PKGDTGLQGKTGGTG RGPAGKPGTTDYDQLQNKPDLGAFAQKEETNSKITKLESSKADK
Sbjct:   61 PKGDTGLQGKTGGTGPRGPAGKPGTTDYDQLQNKPDLGAFAQKEETNSKITKLESSKADK   120

Query:  121 NAVYLKAESNAKLDEKLNLKGGVMTGQLQFKPN-SGIKPSSSVGGAINIDMSKSEGAAMV   179
            +AVY KAES  +LD+KL+L GG++TGQLQFKPN SGIKPSSSVGGAINIDMSKSEGAAMV
Sbjct:  121 SAVYSKAESKIELDKKLSLTGGIVTGQLQFKPNKSGIKPSSSVGGAINIDMSKSEGAAMV   180

Query:  180 MYTNKDTTDGPLMILRSNKDTFDQSVQFVDYKGTTNAVNIVMRQPTTPNFSSALNITSAN   239
            MYTNKDTTDGPLMILRS+KDTFDQS QFVDY G TNAVNIVMRQP+ PNFSSALNITSAN
Sbjct:  181 MYTNKDTTDGPLMILRSDKDTFDQSAQFVDYSGKTNAVNIVMRQPSAPNFSSALNITSAN   240

Query:  240 EGGSAMQIRGVEKALGTLKITHENPSVDKEYDENAAALSIDIVKKQKGGKGTAAQGIYIN   299
            EGGSAMQIRGVEKALGTLKITHENP+V+ +YDENAAALSIDIVKKQKGGKGTAAQGIYIN
Sbjct:  241 EGGSAMQIRGVEKALGTLKITHENPNVEAKYDENAAALSIDIVKKQKGGKGTAAQGIYIN   300

Query:  300 STSGTAGKMLRIRNKNKDKFYVGPDGDFWSCASSIVDGNLTVKDPTSGKHAATKDYVDEK   359
            STSGTAGKMLRIRNKN+DKFYVGPDG F S A+S V GNLTVKDPTSGKHAATKDYVDEK
Sbjct:  301 STSGTAGKMLRIRNKNEDKFYVGPDGGFHSGANSTVAGNLTVKDPTSGKHAATKDYVDEK   360

Query:  360 IAELKKLILKK                                                   370
            IAELKKLILKK
Sbjct:  361 IAELKKLILKK                                                   371
```

Based on this analysis, it was predicted that this GAS-specific protein and its epitopes, could be useful antigens for vaccines or diagnostics.

EXAMPLE 2774

A DNA sequence (GASx1438R) was identified in *S. pyogenes* <SEQ ID 8047> which encodes the amino acid sequence <SEQ ID 8048>. Analysis of this protein sequence reveals the following:

```
Possible site: 55
>>> Seems to have no N-terminal signal sequence

----- Final Results -----
            bacterial cytoplasm --- Certainty = 0.1892 (Affirmative) < succ>
             bacterial membrane --- Certainty = 0.0000 (Not Clear)  < succ>
              bacterial outside --- Certainty = 0.0000 (Not Clear)  < succ>
```

A related DNA sequence <SEQ ID 10439> was identified in GBS which encodes amino acid sequence <SEQ ID 10440>.

No corresponding DNA sequence was identified in *S. agalactiae*.

The protein has homology with the following sequences in the GENPEPT database:

```
>GP: AAB18711 GB: U38906 ORF36 [Bacteriophage rlt]
Identities = 70/111 (63%), Positives = 88/111 (79%)

Query:    1 LIEVIIKKYLDEHLDVPSFFEHQKDEPARFIILEKTSGAKQNHLLSSTFAFQSYAESLYE    60
            +IE+IIK +LD HL V SF E + + P  +I+ EKT  +K NHLLSSTFAFQSYA S+YE
Sbjct:    1 MIEIIIKNFLDTHLSVSSFLEKKGEMPLSYILFEKTGSSKSNHLLSSTFAFQSYAPSMYE    60
```

-continued

```
Query:  61 AALLNDKVKQVIEQLDVLPQVSGVHLNADYNFTDTATKRYRYQAVFDINHY          111
           AA LN+++K+V+E+L  L ++S V LN+DYNFTDT TK YRYQAVFDINHY
Sbjct:  61 AAKLNEQLKEVVERLIELNEISNVSLNSDYNFTDTETKEYRYQAVFDINHY          111
```

Based on this analysis, it was predicted that this GAS-specific protein and its epitopes, could be useful antigens for vaccines or diagnostics.

EXAMPLE 2775

A DNA sequence (GASx1442R) was identified in *S. pyogenes* <SEQ ID 8049> which encodes the amino acid sequence <SEQ ID 8050>. Analysis of this protein sequence reveals the following:

```
Possible site: 55
>>> Seems to have no N-terminal signal sequence

----- Final Results -----
              bacterial cytoplasm --- Certainty = 0.1241(Affirmative) < succ>
               bacterial membrane --- Certainty = 0.0000(Not Clear) < succ>
                bacterial outside --- Certainty = 0.0000(Not Clear) < succ>
```

No corresponding DNA sequence was identified in *S. agalactiae.*

The protein has no significant homology with any sequences in the GENPEPT database.

Based on this analysis, it was predicted that this GAS-specific protein and its epitopes, could be useful antigens for vaccines or diagnostics.

EXAMPLE 2776

A DNA sequence (GASx1444R) was identified in *S. pyogenes* <SEQ ID 8051> which encodes the amino acid sequence <SEQ ID 8052>. Analysis of this protein sequence reveals the following:

```
Possible site: 42
>>> Seems to have no N-terminal signal sequence

----- Final Results -----
              bacterial cytoplasm --- Certainty = 0.4547(Affirmative) < succ>
               bacterial membrane --- Certainty = 0.0000(Not Clear) < succ>
                bacterial outside --- Certainty = 0.0000(Not Clear) < succ>
```

No corresponding DNA sequence was identified in *S. agalactiae.*

The protein has no significant homology with any sequences in the GENPEPT database.

Based on this analysis, it was predicted that this GAS-specific protein and its epitopes, could be useful antigens for vaccines or diagnostics.

EXAMPLE 2777

A DNA sequence (GASx1447R) was identified in *S. pyogenes* <SEQ ID 8053> which encodes the amino acid sequence <SEQ ID 8054>. Analysis of this protein sequence reveals the following:

```
Possible site: 25
>>> Seems to have a cleavable N-term signal seq.

----- Final Results -----
                bacterial outside --- Certainty = 0.3000(Affirmative) < succ>
```

```
            bacterial membrane --- Certainty = 0.0000(Not Clear) < succ>
            bacterial cytoplasm --- Certainty = 0.0000(Not Clear) < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2778

A DNA sequence (GASx1448R) was identified in *S. pyogenes* <SEQ ID 8055> which encodes the amino acid sequence <SEQ ID 8056>. Analysis of this protein sequence reveals the following:

```
Possible site: 20
>>> Seems to have no N-terminal signal sequence

----- Final Results -----
            bacterial cytoplasm --- Certainty = 0.3221(Affirmative) < succ>
            bacterial membrane  --- Certainty = 0.0000(Not Clear)   < succ>
            bacterial outside   --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2779

A DNA sequence (GASx1449R) was identified in *S. pyogenes* <SEQ ID 8057> which encodes the amino acid sequence <SEQ ID 8058>. Analysis of this protein sequence reveals the following:

```
Possible site: 19
>>> Seems to have no N-terminal signal sequence

----- Final Results -----
            bacterial cytoplasm --- Certainty = 0.6356(Affirmative) < succ>
            bacterial membrane  --- Certainty = 0.0000(Not Clear)   < succ>
            bacterial outside   --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2780

A DNA sequence (GASx1453R) was identified in *S. pyogenes* <SEQ ID 8059> which encodes the amino acid sequence <SEQ ID 8060>. Analysis of this protein sequence reveals the following:

```
Possible site: 13
>>> Seems to have no N-terminal signal sequence

----- Final Results -----
            bacterial cytoplasm --- Certainty = 0.2869(Affirmative) < succ>
             bacterial membrane --- Certainty = 0.0000(Not Clear)   < succ>
              bacterial outside --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2781

A DNA sequence (GASx1455R) was identified in *S. pyogenes* <SEQ ID 8061> which encodes the amino acid sequence <SEQ ID 8062>. Analysis of this protein sequence reveals the following:

```
Possible site: 40
>>> Seems to have no N-terminal signal sequence

----- Final Results -----
            bacterial cytoplasm --- Certainty = 0.1787(Affirmative) < succ>
             bacterial membrane --- Certainty = 0.0000(Not Clear)   < succ>
              bacterial outside --- Certainty = 0.0000(Not Clear)   < succ>
```

No corresponding DNA sequence was identified in *S. agalactiae*.

The protein has homology with the following sequences in the GENPEPT database:

```
>GP: AAF43512 GB: AF145054 ORF19 [Streptococcus thermophilus
bacteriophage 7201]
Identities = 47/126 (37%), Positives = 86/126 (67%), Gaps = 2/126 (1%)

Query:   8 LKDLRNLDLYIASLIRRRDKIEASLL--SSPKWSSDKVNGGIKRKQDDVYVELIATAKDI    65
           ++ ++ LD YI S I +  ++E+  L   +S    +D V GG ++ +DD+YVELI   +++
Sbjct:   7 IQQIKALDRYIESQIEQIKRLESQALKVTSGSMHTDMVQGGKRKGKDDIYVELITAREEV   66

Query:  66 EKKTAEAIRKQRELQNLIDSLENTDSQTILSMVYIDKMTRWQVIDELNCSESTYFRLLRV   125
           E+  TAEAI+++ E +   I ++E+ D++++L MVYID+++ WQ+ D++   S++TY+   LR
Sbjct:  67 ERFTAEAIKQKLEFRRQIANIEDIDARSLLQMVYIDQLSIWQICDKMGISKATYYVKLRQ   126

Query: 126 ATKELN                                                        131
           A K L+
Sbjct: 127 AEKYLD                                                        132
```

Based on this analysis, it was predicted that this GAS-specific protein and its epitopes, could be useful antigens for vaccines or diagnostics.

EXAMPLE 2782

A DNA sequence (GASx1456R) was identified in *S. pyogenes* <SEQ ID 8063> which encodes the amino acid sequence <SEQ ID 8064>. Analysis of this protein sequence reveals the following:

```
Possible site: 34
>>> Seems to have no N-terminal signal sequence

----- Final Results -----
            bacterial cytoplasm --- Certainty = 0.2883(Affirmative) < succ>
```

```
             bacterial membrane --- Certainty = 0.0000(Not Clear) < succ>
             bacterial outside  --- Certainty = 0.0000(Not Clear) < succ>
```

No corresponding DNA sequence was identified in *S. agalactiae*.

The protein has homology with the following sequences in the GENPEPT database:

```
>GP: AAB18697 GB: U38906 ORF22 [Bacteriophage rlt]
Identities = 78/207 (37%), Positives = 123/207 (58%), Gaps = 2/207 (0%)

Query:    6 EIHRILGIDEVYKAPKRLTDILFDKDSREDIFRQFLKYETDVSYDWFMQYFEEEQADRKN   65
            + + +L +DE      R+ +++FDK  RE+ + + L     D+   D+F  YF       A
Sbjct:    7 QFYDMLNVDEHMNFTNRIQELVFDKKGREEFYSKILNIHHDMGVDFFRDYFMAHSAVSA-   65

Query:   66 KKQDFTPKSVSTLLSKIISGNQYYEVA-VGTGGILIQAWQEQRLNDSPFTYRPSKYWYHV  124
             K Q +TP  +  L +  ++ G+    ++    GTG ++IQ WQ+ R+N    F Y PS YWY
Sbjct:   66 KGQHYTPDELGKLTALLVGGSGGADLTGAGTGTLIIQKWQDDRMNTDFFNYLPSNYWYQA  125

Query:  125 EELSDKAVPFLLFNMSIRGINGVVVHGDSLTRQVKNIYFLQNTKDDMLSFSDINVMPRTQ  184
              ELSD+A+  FL+    +IRG+NGVV+HGD+L    VK +YF+QN+ ++ +  FS+INV+P ++
Sbjct:  126 LELSDEAISFLIHAFAIRGMNGVVIHGDALEMAVKQVYFIQNSANNPIGFSEINVIPHSK  185

Query:  185 DIEREFNVKEWIGDGIEHIENPLIEWI                                  211
              D     + EW    IEHIE+    +WI
Sbjct:  186 DAMEFLGIHEWTEQAIEHIESKFPDWI                                  212
```

Based on this analysis, it was predicted that this GAS-specific protein and its epitopes, could be useful antigens for vaccines or diagnostics.

EXAMPLE 2783

A DNA sequence (GASx1459R) was identified in *S. pyogenes* <SEQ ID 8065> which encodes the amino acid sequence <SEQ ID 8066>. Analysis of this protein sequence reveals the following:

```
Possible site: 16
>>> Seems to have no N-terminal signal sequence
     INTEGRAL     Likelihood = -2.44    Transmembrane    82-98 (81-98)

----- Final Results -----
             bacterial membrane  --- Certainty = 0.1977(Affirmative) < succ>
             bacterial outside   --- Certainty = 0.0000(Not Clear)   < succ>
             bacterial cytoplasm --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2784

A DNA sequence (GASx1460R) was identified in *S. pyogenes* <SEQ ID 8067> which encodes the amino acid sequence <SEQ ID 8068>. Analysis of this protein sequence reveals the following:

```
Possible site: 55
>>> Seems to have no N-terminal signal sequence

----- Final Results -----
             bacterial cytoplasm --- Certainty = 0.3368(Affirmative) < succ>
             bacterial membrane  --- Certainty = 0.0000(Not Clear)   < succ>
             bacterial outside   --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2785

A DNA sequence (GASx1461R) was identified in *S. pyogenes* <SEQ ID 8069> which encodes the amino acid sequence <SEQ ID 8070>. Analysis of this protein sequence reveals the following:

```
Possible site: 61
>>> Seems to have no N-terminal signal sequence

----- Final Results -----
          bacterial cytoplasm --- Certainty = 0.2834(Affirmative) < succ>
          bacterial membrane  --- Certainty = 0.0000(Not Clear)   < succ>
          bacterial outside   --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2786

A DNA sequence (GASx1462R) was identified in *S. pyogenes* <SEQ ID 8071> which encodes the amino acid sequence <SEQ ID 8072>. Analysis of this protein sequence reveals the following:

```
Possible site: 27
>>> Seems to have no N-terminal signal sequence

----- Final Results -----
          bacterial cytoplasm --- Certainty = 0.3531(Affirmative) < succ>
          bacterial membrane  --- Certainty = 0.0000(Not Clear)   < succ>
          bacterial outside   --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2787

A DNA sequence (GASx1463R) was identified in *S. pyogenes* <SEQ ID 8073> which encodes the amino acid sequence <SEQ ID 8074>. Analysis of this protein sequence reveals the following:

```
Possible site: 58
>>> Seems to have no N-terminal signal sequence

----- Final Results -----
          bacterial cytoplasm --- Certainty = 0.2483(Affirmative) < succ>
```

```
                bacterial membrane --- Certainty = 0.0000(Not Clear) < succ>
                bacterial outside  --- Certainty = 0.0000(Not Clear) < succ>
```

No corresponding DNA sequence was identified in *S. agalactiae*.

The protein has homology with the following sequences in the GENPEPT database:

```
>GP: CAB14569 GB: Z99117 similar to phage-related protein [Bacillus
subtilis]
Identities = 98/252 (38%), Positives = 152/252 (59%); Gaps = 29/252 (11%)

Query:   16 SPAVKNRIEQVVGARAEQFTTSLLSIISNNNLLAKATSESIMGAAMKAAVLNLPIEPSLG    75
            SP+V  R E+V+G RA QFT S+LS+ ++   +L K     S++ +AM AA L+LPI+ +LG
Sbjct:   33 SPSVIKRFEEVLGKRATQFTASILSLYNSEQMLQKTDPMSVISSAMVAATLDLPIDKNLG    92

Query:   76 FAYVVPYNRNYKDGNRWITVNEAQFQIGYRGLIQLAQRSGQVRNIEHGIIYEEEFLGYDK   135
            +A++VPY              +AQFQ+GY+G IQLA R+GQ ++I    I+E E   ++
Sbjct:   93 YAWIVPYG------------GKAQFQLGYKGYIQLALRTGQYKSINCIPIHEGELQKWNP   140

Query:  136 IRGQLKLTGDYVDSGVVKGYFASLELISGFYKMIFWPKEKVYEHAKKYSKTFDKKTGDFK   195
            +  ++++  +  +S  V GY A  ELI+GF K ++W K +V +H KK+SK+       DF
Sbjct:  141 LTEEIEIDFEKRESDAVIGYAAYFELINGFRKTVYWTKAQVEKHKKKFSKS------DF-   193

Query:  196 PGTPWATEFDPMAIKTLLKELLSKYAPLSVEMQDA-LEADNADSTIVIPKDVTPQETNSL   254
                W  ++D MA+KT+LK +LSK+  LSVEMQ A +E D    I    D+T +  +S
Sbjct:  194 ---GWKNDWDAMALKTVLKAVLSKWGILSVEMQKAVIEEDETRERI----DITNEADSS-   245

Query:  255 DDLIGTQNEKKD                                                 266
            ++I ++    KD
Sbjct:  246 -EIIDSEPSNKD                                                 256
```

Based on this analysis, it was predicted that this GAS-specific protein and its epitopes, could be useful antigens for vaccines or diagnostics.

EXAMPLE 2788

A DNA sequence (GASx1464R) was identified in *S. pyogenes* <SEQ ID 8075> which encodes the amino acid sequence <SEQ ID 8076>. Analysis of this protein sequence reveals the following:

```
Possible site: 30
>>> Seems to have no N-terminal signal sequence

----- Final Results -----
                bacterial cytoplasm --- Certainty = 0.4258(Affirmative) < succ>
                bacterial membrane  --- Certainty = 0.0000(Not Clear)   < succ>
                bacterial outside   --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2789

A DNA sequence (GASx1465R) was identified in *S. pyogenes* <SEQ ID 8077> which encodes the amino acid sequence <SEQ ID 8078>. Analysis of this protein sequence reveals the following:

```
Possible site: 51
>>> Seems to have no N-terminal signal sequence
```

```
-continued
----- Final Results -----
            bacterial cytoplasm --- Certainty = 0.2045(Affirmative) < succ>
            bacterial membrane  --- Certainty = 0.0000(Not Clear)   < succ>
             bacterial outside  --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2790

A DNA sequence (GASx1469R) was identified in *S. pyogenes* <SEQ ID 8079> which encodes the amino acid sequence <SEQ ID 8080>. Analysis of this protein sequence reveals the following:

```
Possible site: 19
>>> Seems to have a cleavable N-term signal seq.

----- Final Results -----
             bacterial outside  --- Certainty = 0.3000(Affirmative) < succ>
             bacterial membrane --- Certainty = 0.0000(Not Clear)   < succ>
           bacterial cytoplasm  --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2791

A DNA sequence (GASx1470R) was identified in *S. pyogenes* <SEQ ID 8081> which encodes the amino acid sequence <SEQ ID 8082>. Analysis of this protein sequence reveals the following:

```
Possible site: 37
>>> Seems to have no N-terminal signal sequence

----- Final Results -----
bacterial cytoplasm --- Certainty = 0.3577 (Affirmative) < succ>
bacterial membrane  --- Certainty = 0.0000 (Not Clear)   < succ>
bacterial outside   --- Certainty = 0.0000 (Not Clear)   < succ>
```

No corresponding DNA sequence was identified in *S. agalactiae*.

The protein has homology with the following sequences in the GENPEPT database:

```
>GP: AAC98430 GB: L29324 excisionase [Streptococcus pneumoniae]
Identities = 23/56 (41%), Positives = 41/56 (73%)

Query:  23 KHLIQQWEGLTVATAKQWATEMRDHPDFKQFVLNPTHRIVFIDYKGFKLFVQWKSR   78
           K ++++W+GL    T  +W  EMR++  F  +V+NPTH++VFI+ +GF+ F++WK +
Sbjct:  19 KGILKRWDGLNKYTLNRWIKEMRENRTFSMYVINPTHKLVFINLEGFESFLRWKQK   74
```

Based on this analysis, it was predicted that this GAS-specific protein and its epitopes, could be useful antigens for vaccines or diagnostics.

EXAMPLE 2792

A DNA sequence (GASx1473) was identified in *S. pyogenes* <SEQ ID 8083> which encodes the amino acid sequence <SEQ ID 8084>. Analysis of this protein sequence reveals the following:

```
Possible site: 27
>>> Seems to have no N-terminal signal sequence

----- Final Results -----
bacterial cytoplasm --- Certainty = 0.2725 (Affirmative) < succ>
bacterial membrane  --- Certainty = 0.0000 (Not Clear)  < succ>
bacterial outside   --- Certainty = 0.0000 (Not Clear)  < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2793

A DNA sequence (GASx1476) was identified in *S. pyogenes* <SEQ ID 8085> which encodes the amino acid sequence <SEQ ID 8086>. Analysis of this protein sequence reveals the following:

```
Possible site: 23
>>> Seems to have no N-terminal signal sequence

----- Final Results -----
bacterial cytoplasm --- Certainty = 0.1422 (Affirmative) < succ>
bacterial membrane  --- Certainty = 0.0000 (Not Clear)  < succ>
bacterial outside   --- Certainty = 0.0000 (Not Clear)  < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2794

A DNA sequence (GASx1480R) was identified in *S. pyogenes* <SEQ ID 8087> which encodes the amino acid sequence <SEQ ID 8088>. Analysis of this protein sequence reveals the following:

```
Possible site: 25
>>> Seems to have a cleavable N-term signal seq.
INTEGRAL Likelihood = -4.04 Transmembrane 291-307 (290-309)

----- Final Results -----
bacterial membrane  --- Certainty = 0.2614 (Affirmative) < succ>
bacterial outside   --- Certainty = 0.0000 (Not Clear)  < succ>
bacterial cytoplasm --- Certainty = 0.0000 (Not Clear)  < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2795

A DNA sequence (GASx1489R) was identified in *S. pyogenes* <SEQ ID 8089> which encodes the amino acid sequence <SEQ ID 8090>. Analysis of this protein sequence reveals the following:

```
Possible site: 23
>>> Seems to have no N-terminal signal sequence

----- Final Results -----
bacterial cytoplasm --- Certainty = 0.2278 (Affirmative) < succ>
bacterial membrane  --- Certainty = 0.0000 (Not Clear)   < succ>
bacterial outside   --- Certainty = 0.0000 (Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2796

A DNA sequence (GASx1490R) was identified in *S. pyogenes* <SEQ ID 8091> which encodes the amino acid sequence <SEQ ID 8092>:

```
SFITSVLAFRKLLKCEGIDLYLMYGDLMTCFEQLLTQLKDWTDVYFNYDE
SGYGRLRDQKAAQFFKKNGIAVHTYQDHYLHGSQEIINQSGQPYKVFTPY
```

```
-continued

YRIWQNYPKETPIKVELSQGRWLNLETPDDVLRTVESFKDEKYQDVATFD

EASKQLNRFIQDQLAAYHANRDFPAQLGTSRLSPFLRIGAIGIRTVYHAV

RQAPNSLGQATFLKELAWRDFYNMVYVAYPDQKTQPIQKAFSQIEWVNNP

DWFQLWKEGKTGYPIVDAAMLQLQKTGWMHNRLRMIVASFLTKDLLCDWR

LGEQYFQQQLIDYDAASNIGGWQWAASTGTDAVPYFRIFNPVTQGKRFDP

KGEFIKAYLPQLEHVPEKYLHEPWKMPKNLQESVSCIIGTDYPQPIVDHA

KQREQAIAKYEWAKEKAKIE
```

Analysis of this protein sequence reveals the following:

```
Possible site: 33
>>> Seems to have an uncleavable N-term signal seq

----- Final Results -----
bacterial membrane  --- Certainty = 0.0000 (Not Clear) < succ>
bacterial outside   --- Certainty = 0.0000 (Not Clear) < succ>
bacterial cytoplasm --- Certainty = 0.0000 (Not Clear) < succ>
```

No corresponding DNA sequence was identified in *S. agalactiae*.

The protein has homology with the following sequences in the GENPEPT database:

```
>GP: AAA22361 GB: M94110 DNA photolyase [Bacillus firmus]
Identities = 175/338 (51%), Positives = 228/338 (66%), Gaps = 6/338 (1%)

Query: 145 EIINQSGQPYKVFTPYYRIWQNYPKETP--IKVELSQGRWLNLETPDDVLRTVES--FKD  200
               +++ + G PYKVFTPYY+ W    K TP  IK ++  G          PD     T+ +    K
Sbjct:   2 QVLKKDGTPYKVFTPYYKAWAKERKRTPAVIKRDVLLGSVHKGTAPDREAETLFNNLIKK   61

Query: 201 EKYQDVATFDE-ASKQLNRFIQDQLAAYHANRDFPAQLGTSRLSPFLRIGAIGIRTVY-H  258
               Y   A  +E A K+L  F + +L+ Y ANRDFP+  GTSRLSP+++ GA+  R++Y H
Sbjct:  62 CSYDWSAIGEEHAIKRLQMFTKKRLSGYKANRDFPSITGTSRLSPYIKTGAVSSRSIYYH  121

Query: 259 AVRQAPNSLGQATFLKELAWRDFYNMVYVAYPDQKTQPIQKAFSQIEWVNNPDWFQLWKE  318
               +    +S       TFLKELAWRDFY MV+     PD K + I + + ++ W ++ D     WK
Sbjct: 122 ILNAEADSYSAETFLKELAWRDFYRMVHFYEPDCKDREIMEGYRELNWSHDQDDLTSWKR  181
```

-continued

```
Query: 319 GKTGYPIVDAAMLQLQKTGWMHNRLRMIVASFLTKDLLCDWRLGEQYFQQQLIDYDAASN 378
            G+TG+PIVDA M QL   GWMHNRLRMI ASFLTKDLL DWRLGE+YF++ LIDYD +SN
Sbjct: 182 GETGFPIVDAGMRQLLNEGWMHNRLRMITASFLTKDLLIDWRLGERYFERMLIDYDPSSN 241

Query: 379 IGGWQWAASTGTDAVPYFRIFNPVTQGKRFDPKGEFIKAYLPQLEHVPEKYLHEPWKMPK 438
            IGGWQWAAS GTDAVPYFRIFNPVTQ KRFD  G +I+ Y+P+L HVP+ Y+HEPWKM +
Sbjct: 242 IGGWQWAASVGTDAVPYFRIFNPVTQSKRFDENGTYIRTYIPELNHVPDHYIHEPWKMSE 301

Query: 439 NLQESVSCIIGTDYPQPIVDHAKQREQAIAKYEWAKEK                      476
            Q     C +  DYP PIVDH+KQR++A++ ++    E+
Sbjct: 302 EEQVKYKCRLDEDYPLPIVDHSKQRKKALSFFKGDDEE                      339
```

Based on this analysis, it was predicted that this GAS-specific protein and its epitopes, could be useful antigens for vaccines or diagnostics.

EXAMPLE 2797

A DNA sequence (GASx1493R) was identified in *S. pyogenes* <SEQ ID 8093> which encodes the amino acid sequence <SEQ ID 8094>. Analysis of this protein sequence reveals the following:

```
Possible site: 39
>>> Seems to have no N-terminal signal sequence

----- Final Results -----
              bacterial cytoplasm --- Certainty = 0.2748 (Affirmative) < succ>
               bacterial membrane --- Certainty = 0.0000 (Not Clear) < succ>
                bacterial outside --- Certainty = 0.0000 (Not Clear) < succ>
```

No corresponding DNA sequence was identified in *S. agalactiae.*

The protein has no significant homology with any sequences in the GENPEPT database.

Based on this analysis, it was predicted that this GAS-specific protein and its epitopes, could be useful antigens for vaccines or diagnostics.

EXAMPLE 2798

A DNA sequence (GASx1501R) was identified in *S. pyogenes* <SEQ ID 8095> which encodes the amino acid sequence <SEQ ID 8096>. Analysis of this protein sequence reveals the following:

```
Possible site: 31
>>> Seems to have a cleavable N-term signal seq.
INTEGRAL Likelihood = -7.27 Transmembrane 64-80 (53-83)

----- Final Results -----
             bacterial membrane --- Certainty = 0.3909 (Affirmative) < succ>
               bacterial outside --- Certainty = 0.0000 (Not Clear) < succ>
                bacterial cytoplasm --- Certainty = 0.0000 (Not Clear) < succ>
```

No corresponding DNA sequence was identified in *S. agalactiae.*

The protein has homology with the following sequences in the GENPEPT database:

```
>GP: AAC95443 GB: AF068901 YlmG [Streptococcus pneumoniae]
Identities = 35/81 (43%), Positives = 58/81 (71%)

Query:  1 MILILSILLRLIKVYTYLLIAYALMSWFPGAYDSKIGRLISGIVEPILKPFRAFNLQFAG  60
          MI ++ ++    + +Y+ +L+A+A+MSWFPGAY+S +GR I  +V+P+L P +   LQ AG
Sbjct:  1 MIFLIRMIYNAVDIYSLILVAFAVMSWFPGAYESSLGRWIVALVKPVLAPLQRLPLQIAG  60
```

```
Query:  61 LDFTIFVVIISLNFLAQVLVR                                     81
           LD +++V I+ + FL + LVR
Sbjct:  61 LDLSVWVAIVLVRFLGENLVR                                     81
```

Based on this analysis, it was predicted that this GAS-specific protein and its epitopes, could be useful antigens for vaccines or diagnostics.

EXAMPLE 2799

A DNA sequence (GASx1502) was identified in *S. pyogenes* <SEQ ID 8097> which encodes the amino acid sequence <SEQ ID 8098>. Analysis of this protein sequence reveals the following:

```
Possible site: 25
>>> Seems to have no N-terminal signal sequence
INTEGRAL    Likelihood = -2.39      Transmembrane      17-33 (17-33)

----- Final Results -----
            bacterial membrane  --- Certainty = 0.1956 (Affirmative) < succ>
            bacterial outside   --- Certainty = 0.0000 (Not Clear)   < succ>
            bacterial cytoplasm --- Certainty = 0.0000 (Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2800

A DNA sequence (GASx1507) was identified in *S. pyogenes* <SEQ ID 8099> which encodes the amino acid sequence <SEQ ID 8100>. Analysis of this protein sequence reveals the following:

```
Possible site: 23
>>> Seems to have no N-terminal signal sequence

----- Final Results -----
            bacterial cytoplasm --- Certainty = 0.0865 (Affirmative) < succ>
            bacterial membrane  --- Certainty = 0.0000 (Not Clear)   < succ>
            bacterial outside   --- Certainty = 0.0000 (Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2801

A DNA sequence (GASx1511R) was identified in *S. pyogenes* <SEQ ID 8101> which encodes the amino acid sequence <SEQ ID 8102>. Analysis of this protein sequence reveals the following:

```
Possible site: 47
>>> Seems to have an uncleavable N-term signal seq
```

```
   INTEGRAL    Likelihood = -11.83     Transmembrane     31-47 (22-53)
   INTEGRAL    Likelihood =  -0.96     Transmembrane      2-18 (1-18)

----- Final Results -----
            bacterial membrane --- Certainty = 0.5734 (Affirmative) < succ>
            bacterial outside  --- Certainty = 0.0000 (Not Clear)   < succ>
          bacterial cytoplasm  --- Certainty = 0.0000 (Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2802

A DNA sequence (GASx1516R) was identified in *S. pyogenes* <SEQ ID 8103> which encodes the amino acid sequence <SEQ ID 8104>. Analysis of this protein sequence reveals the following:

```
Possible site: 42
>>> Seems to have no N-terminal signal sequence

----- Final Results -----
          bacterial cytoplasm --- Certainty = 0.2729 (Affirmative) < succ>
            bacterial membrane --- Certainty = 0.0000 (Not Clear)   < succ>
             bacterial outside --- Certainty = 0.0000 (Not Clear)   < succ>
```

No corresponding DNA sequence was identified in *S. agalactiae*.

The protein has homology with the following sequences in the GENPEPT database:

```
>GP: BAA96472 GB: AB036428 Dpr [Streptococcus mutans]
Identities = 132/175 (75%), Positives = 153/175 (87%)

Query:    1 MTNTLVENIYASVTHNISKKEASKNEKTKAVLNQAVADLSVAASIVHQVHWYMRGPGFLY    60
            MTNT+ ENIYAS+ H + KKE S NEKTKAVLNQAVADLS AASIVHQVHWYMRG GFLY
Sbjct:    1 MTNTITENIYASIIHQVEKKENSGNEKTKAVLNQAVADLSKAASIVHQVHWYMRGSGFLY    60

Query:   61 LHPKMDELLDSLNANLDEMSERLITIGGAPYSTLAEFSKHSKLDEAKGTYDKTVAQHLAR   120
            LHPKMDEL+D+LN +LDE+SERLITIGGAP+STL EF ++S+L+E  GT+DK++  HL R
Sbjct:   61 LHPKMDELMDALNGHLDEISERLITIGGAPFSTLKEFDENSRLEETVGTWDKSITDHLKR   120

Query:  121 LVEVYLYLSSLYQVGLDITDEEGDAGTNDLFTAAKTEAEKTIWMLQAERGQPAL        175
            LV+VY YLSSLYQVGLD+TDEE DA +ND+FTAA+TEA+KTIWMLQAE GQ P L
Sbjct:  121 LVQVYDYLSSLYQVGLDVTDEEDDAVSNDIFTAAQTEAQKTIWMLQAELGQAPGL        175
```

Based on this analysis, it was predicted that this GAS-specific protein and its epitopes, could be useful antigens for vaccines or diagnostics.

EXAMPLE 2803

A DNA sequence (GASx1517) was identified in *S. pyogenes* <SEQ ID 8105> which encodes the amino acid sequence <SEQ ID 8106>. Analysis of this protein sequence reveals the following:

```
Possible site: 46
>>> Seems to have an uncleavable N-term signal seq
   INTEGRAL    Likelihood = -6.32     Transmembrane    109-125 (106-126)
   INTEGRAL    Likelihood = -5.26     Transmembrane     63-79  (61-81)
   INTEGRAL    Likelihood = -5.20     Transmembrane    154-170 (151-176)
   INTEGRAL    Likelihood = -4.14     Transmembrane    189-205 (189-205)
```

```
INTEGRAL    Likelihood = -3.50    Transmembrane    130-146  (127-147)
INTEGRAL    Likelihood = -2.92    Transmembrane      6-22  (1-24)
INTEGRAL    Likelihood = -2.23    Transmembrane     83-99  (83-101)

----- Final Results -----
         bacterial membrane --- Certainty = 0.3527 (Affirmative) < succ>
          bacterial outside --- Certainty = 0.0000 (Not Clear)  < succ>
        bacterial cytoplasm --- Certainty = 0.0000 (Not Clear)  < succ>
```

No corresponding DNA sequence was identified in *S. agalactiae*.

The protein has homology with the following sequences in the GENPEPT database:

```
>GP: BAA96471 GB: AB036428 type IV prepilin peptidase homologue
[Streptococcus mutans]
Identities = 55/127 (43%), Positives = 78/127 (61%), Gaps = 3/127 (2%)

Query:   83 VSASYCYLLLFSLLFSLFDWRSQEYPFILWLFSFVSLLLFYSINYLSLILLLLGLLAHLR  142
            ++ S   LL   +L SL+D + Q YP   LW+      L+  Y +N +SLIL L G+ A L+
Sbjct:   91 LTTSQVCLLFMGVLLSLYDLQDQSYPLTLWIGFTFLLMFIYPLNLISLILFLFGIFAALK  150

Query:  143 PFSIGAGDFFYLASLALVLDLTSLIWLIQLASLAGITACLLLGIKRIP--FIPYLSFGLF  200
            +IG+GDFFYLA+LAL L+L  +IW+IQ+ASL GI    LL    + P   F+P+L  G
Sbjct:  151 NINIGSGDFFYLATLALSLNLQQIIWIIQIASLLGILYSLLFQKHKEPFAFVPFLFLG-H  209

Query:  201 WIVLLEH                                                       207
            I++  H
Sbjct:  210 LIIIFSH                                                       216
```

Based on this analysis, it was predicted that this GAS-specific protein and its epitopes, could be useful antigens for vaccines or diagnostics.

EXAMPLE 2804

A DNA sequence (GASx1538R) was identified in *S. pyogenes* <SEQ ID 8107> which encodes the amino acid sequence <SEQ ID 8108>. Analysis of this protein sequence reveals the following:

```
Possible site: 15
>>> Seems to have no N-terminal signal sequence

----- Final Results -----
        bacterial cytoplasm --- Certainty = 0.1186 (Affirmative) < succ>
         bacterial membrane --- Certainty = 0.0000 (Not Clear)  < succ>
          bacterial outside --- Certainty = 0.0000 (Not Clear)  < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2805

A DNA sequence (GASx1539R) was identified in *S. pyogenes* <SEQ ID 8109> which encodes the amino acid sequence <SEQ ID 8110>. Analysis of this protein sequence reveals the following:

```
Possible site: 34
>>> Seems to have an uncleavable N-term signal seq
    INTEGRAL    Likelihood = -11.73    Transmembrane      6-22  (3-32)
```

-continued

```
----- Final Results -----
           bacterial membrane --- Certainty = 0.5692 (Affirmative) < succ>
             bacterial outside --- Certainty = 0.0000 (Not Clear)   < succ>
           bacterial cytoplasm --- Certainty = 0.0000 (Not Clear)   < succ>
```

No corresponding DNA sequence was identified in *S. agalactiae*.

The protein has homology with the following sequences in the GENPEPT database:

```
>GP: AAF31453 GB: AF221126 putative histidine kinase
[Streptococcus pneumoniae]
Identities = 141/301 (46%), Positives = 210/301 (68%), Gaps = 7/301 (2%)

Query:    1 MKRYPLLVQLISYVFVIVIALITTLGLLYYQTSSRNIRQLIERDTRQSIRQSSQFIDAYI    60
            MKR LLV+++  +F++ + L+   +G  YYQ+SS  I    IE +++ +I Q+S FI +YI
Sbjct:    1 MKRSSLLVRMVISIFLVFLILLALVGTFYYQSSSSAIEATIEGNSQTTISQTSHFIQSYI    60

Query:   61 KPLKETTSVLAKNTEIQAFASQIHQENDKQVLQLMKMVLATNSDLQAAVLVTKDGRTVST   120
            K L+ T++ L + T++ A+A    Q+ + +  L  +L ++ DL+   VLVTK G+ +ST
Sbjct:   61 KKLETTSTGLTQQTDVLAYAENPSQDKVEGIRDLFLTILKSDKDLKTVVLVTKSGQVIST   120

Query:  121 NSQLTMKTSSDMMAEPWYKAAIDRQAMPILTPARQLSLSSKKEWVVSVTQEVVDRAGHNL   180
             + + MKTSSDMMAE WY+ AI + AMP+LTPAR+      S +WV+SVTQE+VD  G NL
Sbjct:  121 DDSVQMKTSSDMMAEDWYQKAIHQGAMPVLTPARK----SDSQWVISVTQELVDAKGANL   176

Query:  181 GVLRLDIAYPTIKASLDQLQLGRQGFAFIVNDKHEFVYHPKKSVYSSSKEMAAMKPYLAI   240
            GVLRLDI+Y T++A L+QLQLG+QGFAFI+N+  HEFVYHP+ +VYSSS +M AMKPY+
Sbjct:  177 GVLRLDISYETLEAYLNQLQLGQQGFAFIINENHEFVYHPQHTVYSSSSKMEAMKPYIDT   236

Query:  241 QNGYTKDKTSFVYQKLIPNSQWTLVGVASLDQLHRVQRQIFWSFSWNRASTLSDLWLCNCL   301
              GYT    S+V Q+ I  + WT++GV+SL++L +V+ Q+ W+       ++++ L +C CL
Sbjct:  237 GQGYTPGHKSYVSQEKIAGTDWTVLGVSSLEKLDQVRSQLLWTL---LGASVTSLLVCLCL   294
```

Based on this analysis, it was predicted that this GAS-specific protein and its epitopes, could be useful antigens for vaccines or diagnostics.

EXAMPLE 2806

A DNA sequence (GASx1542R) was identified in *S. pyogenes* <SEQ ID 8111> which encodes the amino acid sequence <SEQ ID 8112>. Analysis of this protein sequence reveals the following:

```
Possible site: 39
>>> May be a lipoprotein

----- Final Results -----
           bacterial membrane --- Certainty = 0.0000 (Not Clear) < succ>
             bacterial outside --- Certainty = 0.0000 (Not Clear) < succ>
           bacterial cytoplasm --- Certainty = 0.0000 (Not Clear) < succ>
```

No corresponding DNA sequence was identified in *S. agalactiae*.

The protein has homology with the following sequences in the GENPEPT database:

```
>GP: AAC23101 GB: U32823 conserved hypothetical protein
[Haemophilus influenzae Rd]
Identities = 56/128 (43%), Positives = 87/128 (67%)

Query:   73 DFELKGIDGKTYRLSEFKGKKVYLKFWASWCSICLSTLADTEDLAKMSDKDYVVLTVVSP   132
            D +LK ++ +   LS++KGK VY+K WASWC  ICL+ LA+ +DL+   D+++ V+T+VSP
Sbjct:   24 DVQLKDLNNQPVTLSQYKGKPVYVKMWASWCPICLAGLAEIDDLSAEKDRNFEVITIVSP    83

Query:  133 GHQGEKSEADFKKWFQGTDYKDLPVLLDPDGKLLEAYGVRSYPTEVFIGSDGVLAKKHIG   192
            H+GEK  ADF +W++G +YK++ VLLD  G++++    VR YP +F+ SD  L K   G
```

```
                                  -continued
Sbjct:  84 DHKGEKDTADFIEWYKGLEYKNITVLLDEKGEIIDKARVRGYPFNLFLDSDLNLKKTVPG 143

Query: 193 YAKKSDIK                                                    200
              +    I+
Sbjct: 144 HLGAEQIR                                                    151
```

Based on this analysis, it was predicted that this GAS-specific protein and its epitopes, could be useful antigens for vaccines or diagnostics.

EXAMPLE 2807

A DNA sequence (GASx1543R) was identified in *S. pyogenes* <SEQ ID 8113> which encodes the amino acid sequence <SEQ ID 8114>. Analysis of this protein sequence reveals the following:

```
Possible site: 13
>>> Seems to have a cleavable N-term signal seq.
INTEGRAL Likelihood = -7.75 Transmembrane 171-187 (169-191)
INTEGRAL Likelihood = -6.26 Transmembrane 205-221 (203-232)
INTEGRAL Likelihood = -5.73 Transmembrane  56-72  (54-81)
INTEGRAL Likelihood = -5.36 Transmembrane  92-108 (91-113)
INTEGRAL Likelihood = -3.45 Transmembrane  20-36  (14-39)
INTEGRAL Likelihood = -1.17 Transmembrane 147-163 (144-163)

----- Final Results -----
            bacterial membrane --- Certainty = 0.4100 (Affirmative) < succ>
             bacterial outside --- Certainty = 0.0000 (Not Clear)  < succ>
            bacterial cytoplasm --- Certainty = 0.0000 (Not Clear)  < succ>
```

No corresponding DNA sequence was identified in *S. agalactiae*.

The protein has homology with the following sequences in the GENPEPT database:

```
>GP: AAC23102 GB: U32823 cytochrome C-type biogenesis protein
[Haemophilus influenzae Rd]
Identities = 106/224 (47%), Positives = 138/224 (61%), Gaps = 16/224 (7%)

Query:   6 VLMVSVFGAGLLSFFSPCIFPVLPVYLGILLDADDSKTITIFGKKLYWYGIVKTLAFIFG   65
           +L+ +VF AGL SF SPCIFP++P+Y GIL         GKK    ++ T  FI G
Sbjct:   6 LLIGTVFLAGLASFLSPCIFPIIPIYFGILSKG---------GKK-----VLNTFLFILG   51

Query:  66 LSTIFVILGYGAGFLGNILYAVWFRYLLGALVIILGIHQMGLITIKSLQFQKSLTFHNNK  125
           LS  FV LG+  GFLGNIL++    R + G +VIILGIHQ+G+  I  L+  K +    +
Sbjct:  52 LSLTFVSLGFSFGFLGNILFSNTTRIIAGVIVIILGIHQLGIFKIGLLERTKLVEIKTSG  111

Query: 126 NRNGLFNAFILGLTFSFGWTPCVGPVLSSVLALVASGGNGAWQGGVLMIIYTLGLGIPFL  185
              L  AF+LGLTFS GWTPC+GP+L++VLAL    G+ A  G   +M +Y LGL  PF+
Sbjct: 112 KSTAL-EAFVLGLTFSLGWTPCIGPILASVLALSGDEGS-ALYGASMMFVYVLGLATPFV  169

Query: 186 LISFASGIVLKQFNKLKPHILLLKKVGGVLIIVMGILLMTGTLN                 229
           L SF S +LK+   L  H+   K  GG+LIIVMGILL+T  +
Sbjct: 170 LFSFFSDSLLKRAKGLNKHLDKFKIGGGILIIVMGILLITNNFS                 213
```

Based on this analysis, it was predicted that this GAS-specific protein and its epitopes, could be useful antigens for vaccines or diagnostics.

EXAMPLE 2808

A DNA sequence (GASx1544) was identified in *S. pyogenes* <SEQ ID 8115> which encodes the amino acid sequence <SEQ ID 8116>. Analysis of this protein sequence reveals the following:

```
Possible site: 25
>>> Seems to have no N-terminal signal sequence
```

```
----- Final Results -----
          bacterial cytoplasm --- Certainty = 0.1493 (Affirmative) < succ>
          bacterial membrane  --- Certainty = 0.0000 (Not Clear)   < succ>
          bacterial outside   --- Certainty = 0.0000 (Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2809

A DNA sequence (GASx1546R) was identified in *S. pyogenes* <SEQ ID 8117> which encodes the amino acid sequence <SEQ ID 8118>. Analysis of this protein sequence reveals the following:

```
Possible site: 46
>>> Seems to have no N-terminal signal sequence

----- Final Results -----
          bacterial cytoplasm --- Certainty = 0.4658 (Affirmative) < succ>
          bacterial membrane  --- Certainty = 0.0000 (Not Clear)   < succ>
          bacterial outside   --- Certainty = 0.0000 (Not Clear)   < succ>
```

No corresponding DNA sequence was identified in *S. agalactiae*.

The protein has homology with the following sequences in the GENPEPT database:

```
>GP: BAB04061 GB: AP001508 unknown conserved protein in others
[Bacillus halodurans]
Identities = 48/89 (53%), Positives = 61/89 (67%)

Query:   1 MMVLVTYDVNTETPAGRKRLRHVAKLCVDYGQRVQNSVFECSVTPAEFVDIKHRLTQIID  60
           M+VL+TYDV T +  G KRLR VAK C +YGQRVQNSVFEC V  +   +K  LT +ID
Sbjct:   1 MLVLITYDVQTSSMGGTKRLRKVAKACQNYGQRVQNSVFECIVDSTQLTSLKLELTSLID  60

Query:  61 EKTDSIRFYLLGKNWQRRVETLGKSDSYD                                89
           E+ DS+R Y LG N++ +VE +G   S D
Sbjct:  61 EEKDSLRIYRLGNNYKTKVEHIGARPSID                                89
```

Based on this analysis, it was predicted that this GAS-specific protein and its epitopes, could be useful antigens for vaccines or diagnostics.

EXAMPLE 2810

A DNA sequence (GASx1547R) was identified in *S. pyogenes* <SEQ ID 8119> which encodes the amino acid sequence <SEQ ID 8120>. Analysis of this protein sequence reveals the following:

```
Possible site: 57
>>> Seems to have no N-terminal signal sequence
INTEGRAL Likelihood = -1.70 Transmembrane 44-60 (43-60)

----- Final Results -----
          bacterial membrane  --- Certainty = 0.1680 (Affirmative) < succ>
          bacterial outside   --- Certainty = 0.0000 (Not Clear)   < succ>
          bacterial cytoplasm --- Certainty = 0.0000 (Not Clear)   < succ>
RGD motif: 330-332
```

No corresponding DNA sequence was identified in *S. aga-lactiae*.

The protein has homology with the following sequences in the GENPEPT database:

```
>GP: BAB04060 GB: AP001508 unknown conserved protein in others
[Bacillus halodurans]
Identities = 162/341 (47%), Positives = 231/341 (67%), Gaps = 1/341 (0%)

Query:    1 MKKLLNTLYLTQEDFYVTKEGDNIVIKQEGKVLKRFPFRIIDGIVCFSYLGVSSALVKLC      60
            MKKLLNTLY+TQ D Y++ +GDN+V+ +E + L R P   ++ IV F Y G S AL+  C
Sbjct:    1 MKKLLNTLYVTQPDTYLSLDGNVVLLKEQEKLGRLPLHNLEAIVGFGYT>FEATURESALMGYC     60

Query:   61 TENQINLSFHTPQGRFCGRYIGSTNGNVLLRREHYRLSDRE-ESLEYAKRFILAKISNSR     119
            E  I+++F T  GRF  R +G + GNV+LR+  YR+S+ + ES + A+ FI   K+ NS+
Sbjct:   61 AERNISITFLTKNGRFLARVVGESRGNVVLRKTQYRISENDQESTKIARNFITGKVYNSK     120

Query:  120 KYLLRFKRDHRQQIDTKLFEAVNDELIWALEMVQAADNKDSLRGIEGQAANQYFRIFNDL     179
              L R  R+H +++ + F+A + L    ++ ++  D+ +SLRG EGQAA  Y ++F+ +
Sbjct:  121 WMLERMTREHPLRVNVEQFKATSQLLSVMNQEIRNCDSLESLRGWEGQAAINYNKVFDQM     180

Query:  180 VLTDKKTFYFQGRSKRPPLDCVNALLSFGYSLLTFECQSALEAVGLDSYVGFFHTDRPGR     239
             +L   K+ F F GRS+RPP D  VNA+LSF Y+LL  +   +ALE VGLD+YVGF H DRPGR
Sbjct:  181 ILQQKEEFAFHGRSRRPPKDNVNAMLSFAYTLLANDVAAALETVGLDAYVGFMHQDRPGR     240

Query:  240 ASLALDLVEEFRSYIVDRFVFSLINKGQLQKKHFEVKENGSILLTENGRAIFIDLWQKRK     299
            ASLALDL+EE R    DRFV SLIN+ ++      F  KENG++L+T+  R  F+  WQ +K
Sbjct:  241 ASLALDLMEELRGLYADRFVLSLINRKEMTADGFYKKENGAVLMTDEARKTFLKAWQTKK     300

Query:  300 HTEVEHPFTKEKVKLMLLPYVQAQLLAKAIRGDLESYPPFM                       340
            ++ HP+  EK+    L+PYVQA LLA+ +RGDL+ YPPF+
Sbjct:  301 QEKITHPYLGEKMSWGLVPYVQALLLARFLRGDLDEYPPFL                       341
```

Based on this analysis, it was predicted that this GAS-specific protein and its epitopes, could be useful antigens for vaccines or diagnostics.

EXAMPLE 2811

A DNA sequence (GASx1548R) was identified in *S. pyogenes* <SEQ ID 8121> which encodes the amino acid sequence <SEQ ID 8122>. Analysis of this protein sequence reveals the following:

```
Possible site: 49
>>> Seems to have no N-terminal signal sequence

----- Final Results -----
          bacterial cytoplasm --- Certainty = 0.2247 (Affirmative) < succ>
          bacterial membrane  --- Certainty = 0.0000 (Not Clear)  < succ>
           bacterial outside  --- Certainty = 0.0000 (Not Clear)  < succ>
```

No corresponding DNA sequence was identified in *S. aga-lactiae*.

The protein has homology with the following sequences in the GENPEPT database:

```
>GP: BAB04059 GB: AP001508 unknown [Bacillus halodurans]
Identities = 90/169 (53%), Positives = 111/169 (65%), Gaps = 1/169 (0%)

Query:   45 LHTKADNPYIKEKRKELLVSRAMPISSAELGLSGIMDVVEFYKDDQGVSLRGKRGKWLPK     104
            +H KAD P++KEKR   L  RAMPI S  L +SGI DVVEF +D +G+ L G  G +
Sbjct:    1 MHKKADQPFMKEKRGSKLTVRAMPIQSKNLQISGICDVVEFVQDSEGIELSGVSGSYKAF      60

Query:  105 VVEYKRGKPKKDTRDIVQLVAQTMCLEETLDCDINEGCLYYHSVNQRVIVPMTSALRQEV     164
            V EYKRGKPKK   DIVQLVAQ MCLEE L C I++G L+Y+ +   RV VP+T ALR +V
Sbjct:   61 PVEYKRGKPKKGDEDIVQLVAQAMCLEEMLVCRIDKGYLFYNEIKHRVEVPITDALRDKV     120

Query:  165 KELAAEMHEVYQSQMLPKAAYFKNCQLCSLVDICKPRLSKKTRSVSRYI               213
            ++A EMH  Y+++  PK       C  CSL  IC P+L  K RSV RYI
Sbjct:  121 VQMAKEMHHYYENRHTPKVKTGPFCNNCSLQSICLPKLMNK-RSVKRYI               168
```

Based on this analysis, it was predicted that this GAS-specific protein and its epitopes, could be useful antigens for vaccines or diagnostics.

EXAMPLE 2812

A DNA sequence (GASx1549R) was identified in *S. pyogenes* <SEQ ID 8123> which encodes the amino acid sequence <SEQ ID 8124>. Analysis of this protein sequence reveals the following:

```
Possible site: 26
>>> Seems to have no N-terminal signal sequence

----- Final Results -----
              bacterial cytoplasm --- Certainty = 0.1399 (Affirmative) < succ>
              bacterial membrane  --- Certainty = 0.0000 (Not Clear)   < succ>
              bacterial outside   --- Certainty = 0.0000 (Not Clear)   < succ>
```

No corresponding DNA sequence was identified in *S. agalactiae*.

The protein has homology with the following sequences in the GENPEPT database:

```
>GP: BAB04058 GB: AP001508 unknown conserved protein in others
[Bacillus halodurans]
Identities = 148/290 (51%), Positives = 190/290 (65%), Gaps = 19/290 (6%)

Query:    6 MLEHKIDFMVTLEVKEANANGDPLNGNMPRTDAKGYGVMSDVSIKRKIRNRLQDMGKSIF   65
            +L+HKIDF V L V +AN NGDPLNGN PR + G+G +SDV+IKRKIRNRL DM + IF
Sbjct:    3 ILDHKIDFAVILSVTKANPNGDPLNGNRPRQNYDGHGEISDVAIKRKIRNRLLDMEEPIF   62

Query:   66 VQANERIEDDFRSLEKRFSQH----FTAKTPDKEIEEKANAL---WFDVRAFGQVFTYLK  118
            VQ+++R D F+SL R +      K + ++E A     W DVR+FGQVF +
Sbjct:   63 VQSDDRKADSFKSLRDRADSNPELAKMLKAKNASVDEFAKIACQEWMDVRSFGQVFAFKG  122

Query:  119 K--SIGVRGPVSISMAKSLEPIVISSLQITRSTNGMEAKNNSGRSSDTMGTKHFVDYGVY  176
               S+GVRGPVSI  A S++PI I S QIT+S N +       RSSDTMG KH VD+GVY
Sbjct:  123 SNLSVGVRGPVSIHTATSIDPIDIVSTQITKSVNSVTGDK---RSSDTMGMKHRVDFGVY  179

Query:  177 VLKGSINAYFAEKTGFSQEDAEAIKEVLVSLFENDASSARPEGSMRVCEVFWFTHSSKLG  236
              V KGSIN  AEKTGF+ EDAE IK L++LFEND+SSARP+GSM V +V+W+ HSSKLG
Sbjct:  180 VFKGSINTQLAEKTGFTNEDAEKIKRALITLFENDSSSARPDGSMEVHKVYWWEHSSKLG  239

Query:  237 NVSSARVFDLLEYHQSIEEKSTYDAYQIHLNQEKLAKYEAKGLTLEILEG            286
             SSA+V  L+    +  ++D Y + L    YE   GL +E+++G
Sbjct:  240 QYSSAKVHRSLKIESKTDTPKSFDDYAVEL-------YELDGLGVEVIDG            282
```

Based on this analysis, it was predicted that this GAS-specific protein and its epitopes, could be useful antigens for vaccines or diagnostics.

EXAMPLE 2813

A DNA sequence (GASx1550R) was identified in *S. pyogenes* <SEQ ID 8125> which encodes the amino acid sequence <SEQ ID 8126>. Analysis of this protein sequence reveals the following:

```
Possible site: 43
>>> Seems to have no N-terminal signal sequence

----- Final Results -----
              bacterial cytoplasm --- Certainty = 0.2882 (Affirmative) < succ>
              bacterial membrane  --- Certainty = 0.0000 (Not Clear)   < succ>
              bacterial outside   --- Certainty = 0.0000 (Not Clear)   < succ>
```

No corresponding DNA sequence was identified in *S. agalactiae*.

The protein has homology with the following sequences in the GENPEPT database:

```
>GP: BAB04057 GB: AP001508 unknown [Bacillus halodurans]
Identities = 176/671 (26%), Positives = 311/671 (46%),
Gaps = 87/671 (12%)

Query:    1 MDFFTSLLKTYEKAELADLVDHQKR--NNEPVLLPIYHTSLKSNGKNIISVKLDKDGQFH   58
            M +    L +TYE A L  +    K+  + E  LLPI HT+  ++     I V LD+DG F
Sbjct:    1 MSWLLHLYETYE-ANLDQVGKTVKKGEDREYTLLPISHTTQNAH----IEVTLDEDGDFL   55

Query:   59 KAEFMADKQMIIFPVTADSVARSGSHPAPHPLVDKFAYYSAEM----GQIQ------YDS  108
            +A+ +   K+  + P T ++ +RSGS  AP+PL DK +Y + +       G+I+       +D+
Sbjct:   56 RAKALT-KESTLIPCTEEAASRSGSKVAPYPLHDKLSYVAGDFVKYGGKIKNQDDAPFDT  114

Query:  109 FHKQLNNWID--YCEEGDVKKFLTFVQQFILKPEFLTLILDSLIGPDYQHNQLKVTFCDA  166
            + K L  W +   Y E  VK    T++++  L  + +    + L        NQ +   +
Sbjct:  115 YIKNLGEWANSPYATE-KVKCIYTYLKKGRLIEDLVDAGVLKL-----DENQQLIEKWEK  168

Query:  167 TGKEKLIDLSACFLEFSIDQ------FQGFKNESVSTF---KALHQSYISFVEANRENLG  217
            + E L  + A F    + DQ            F  F    ES+      K +   S+ISF
Sbjct:  169 RYEELLGEKPAIFSSGATDQASAFVRFNVFHPESIDDVWKDKEMFDSFISFYNDKLGEED  228

Query:  218 ICNISGREEQLTDKH----RGLMGNAKIISVS-NKREAYKGRFREREDVFSVGYETSEKI  272
            IC ++G       T++H      R       AK+IS + N     ++GRF+   +    + YE S+K
Sbjct:  229 ICFVTGNRLPSTERHANKIRHAADKAKLISANDNSGFTFRGRFKTSREAVGISYEVSQKA  288

Query:  273 HLMLKYLLENKNTSTWLGSSQYLINWFSDD-LTNDSRLDIVSPIFDDGLEEDDDDTPPV  331
            H   LK+L+  ++ S        + + W +D+ L  +       D V  +       E + D DT    +
Sbjct:  289 HNALKWLIHRQSKSI---DDRVFLVWSNDNSLVPNPDEDAVDIMKHANRELERDPDTGQI  345

Query:  332 ITLATEDNKRIGKSFIKGQKLFANDATY----YVAILNKTSNGRIALKYFRQLQASQLLT  387
                A E  K IG         + +D  Y      ++ +L+   + GR+A+ Y+R L         L
Sbjct:  346 F--AGEVKKAIGG--------YRSDLNYQPEVHILVLDSATTGRMAVLYYRSLNKELYLN  395

Query:  388 NLNKWQETYSWESRSKFGKSRLRT----PTFHDILNVSYGVDRDRFLELDNDNFKSDQIQ  443
             L  W ++ +WE R +   +       +       P     DI    +YG             ++       D ++
Sbjct:  396 RLEAWHDSCAWEHRYRRDEKEFISFYGAPATKDIAFAAYGPRA-------SEKVIKDLME  448

Query:  444 KLVASLIDGKPMPQSIVKKL---GNNVKERHRYRKHWYQVEQVCLAILHK---QNGEEFS  497
                +++   ++DG+  +P+ IV+              +N                  R+      W +      + A++ K     + EE+
Sbjct:  449 RMLPCIVDGRRVPKDIVRSAFQRASNPVSMERWE--WEKTLSITCALIRKMHIEQKEEWG  506

Query:  498 PMLDHTNQNRSYLFGRLLAIFELIETLRYGLDGNNNDRITNAERYWTAYTGQPTKLMMLL  557
                      LD ++ +RSYLFGRLLA+ +++E      G   G +  R TNA RY  +Y+   P +        +
Sbjct:  507 VPLDKSSTDRSYLFGRLLAVADVLER---GALGKDETRATNAIRYMNSYSKNPGRTWKTI  563

Query:  558 ENKIKPYEEPLKLNRRGSWMKLEKEKEEILELLNPLLETETMEKPLDYRFIFGYYAEKNY  617
             +    ++PY+    KL    +  ++  L K  +EI +     P    +    PL +++ G+Y+++
Sbjct:  564 QESLQPYQ--AKLGTKATY--LSKLVDEIGDQFEP---GDFNNNPLTEQYLLGFYSQRRE  616

Query:  618 YYTKQNTEVTE                                                  628
            Y  K+  E +
Sbjct:  617 LYKKKEEETNQ                                                  627
```

Based on this analysis, it was predicted that this GAS-specific protein and its epitopes, could be useful antigens for vaccines or diagnostics.

EXAMPLE 2814

A DNA sequence (GASx1551R) was identified in *S. pyogenes* <SEQ ID 8127> which encodes the amino acid sequence <SEQ ID 8128>. Analysis of this protein sequence reveals the following:

```
Possible site: 33
>>> Seems to have no N-terminal signal sequence

----- Final Results -----
         bacterial cytoplasm --- Certainty = 0.3035 (Affirmative) < succ>
         bacterial membrane  --- Certainty = 0.0000 (Not Clear)   < succ>
          bacterial outside  --- Certainty = 0.0000 (Not Clear)   < succ>
```

No corresponding DNA sequence was identified in *S. agalactiae*.

The protein has homology with the following sequences in the GENPEPT database:

```
>GP: BAB04056 GB: AP001508 unknown [Bacillus halodurans]
Identities = 90/218 (41%), Positives = 127/218 (57%), Gaps = 7/218 (3%)

Query:  13 GQRALFTNPATKGGSERSSYSVPTRQALNGIVDAIYYKPTFTNIVTEVKVINQIQTELQG   72
           G  ALFT+P TK G E+ SYSVPT QAL GI ++IY+KPT   ++ E++V+  IQ E +G
Sbjct:  11 GDYALFTDPLTKIGGEKLSYSVPTYQALKGIAESIYWKPTIVFVIDELRVMKPIQMESKG   70

Query:  73 VRALLHDYSADLSYVSYLSDVVYLIKFHFVWNEDRKDLNSDRLPAKHEAIMERSIRKGGR   132
           VR + +     L++ +YL DV Y +K HF +N  R DL  DR    KH +I++RS++ GGR
Sbjct:  71 VRPIEYGGGNTLAHYTYLKDVHYQVKAHFEFNLHRPDLAFDRNEGKHYSILQRSLKAGGR   130

Query: 133 RDVFLGTRECLGLVDDISQEEYETTVSYYNGV-NIDLGIMFHSFAYPKDK-KTPLKSYFT   190
           RD+FLG REC G V   +  E+ +   +Y+G     LG M H F YP +  +  L
Sbjct: 131 RDIFLGARECQGYV---APCEFGSGDGFYDGQGKYHLGTMVHGFNYPDETGQHQLDVRLW   187

Query: 191 KTVMKNGVITFKAQSECDIVNTLSSYAFKA--PEEIKS                       226
             VM+NG I F    +C IV  +     K   P+ ++S
Sbjct: 188 SAVMENGYIQFPRPEDCPIVRPVKEMEPKIFNPDNVQS                       225
```

Based on this analysis, it was predicted that this GAS-specific protein and its epitopes, could be useful antigens for vaccines or diagnostics.

EXAMPLE 2815

A DNA sequence (GASx1552R) was identified in *S. pyogenes* <SEQ ID 8129> which encodes the amino acid sequence <SEQ ID 8130>. Analysis of this protein sequence reveals the following:

```
Possible site: 53
>>> Seems to have no N-terminal signal sequence

----- Final Results -----
               bacterial cytoplasm --- Certainty = 0.2770 (Affirmative) < succ>
                bacterial membrane --- Certainty = 0.0000 (Not Clear) < succ>
                 bacterial outside --- Certainty = 0.0000 (Not Clear) < succ>
```

No corresponding DNA sequence was identified in *S. agalactiae.*

The protein has homology with the following sequences in the GENPEPT database:

```
>GP: BAB04055 GB: AP001508 unknown conserved protein in others
[Bacillus halodurans]
Identities = 252/836 (30%), Positives = 404/836 (48%),
Gaps = 90/836 (10%)

Query:   3 MILAHYDCKKDKKQSLDEHLWHVACSSRQEASIIGQGDVLFLIGLYHDLGKADRTFQD--   60
           M +AH         Q+L EHL  V C +    + +    V  L GL HDLGK     F+D
Sbjct:   1 MYIAHIREVDKVIQTLKEHLCGVQCLAETFGAKLRLQHVAGLAGLLHDLGKYTNEFKDYI   60

Query:  61 -------KLLNNPNRHVDHSYAGAKYLCSIIGPHLKNRGVDKNERMTFNEMVGYVISAHH  113
                  +L        VDHS AG + L  +    L +R     +E++    E+VG  I +HH
Sbjct:  61 YKAVFEPELAEKKRGQVDHSTAGGRLLYQM----LHDRENSFHEKL-LAEVVGNAIISHH  115

Query: 114 GMYDLCYYFDDAEYYGFNKFKNRINRDLDGYHYHEDIKGYALKLEKKLCDYGYK-DLREL  172
                   +Y       N + R L+      +++  Y    +E+    +    + +L
Sbjct: 116 SNLQ--------DYISPTIESNFLTRVLE-----KELPEYESAVERFFQEVMTEAELARY  162

Query: 173 IDKAFDNYQQAMSSLNWQDKSEWDYYQSCMVRLYLSLLKNADILDTVNAYGLKISPMDKT  232
           + KA D  +Q   +   Q         Y  SC++          +AD  +T   +  +    + T
Sbjct: 163 VAKAVDEIKQFTDNSPTQSFFLTKYIFSCLI--------DADRTNT-RMFDEQAREEEPT  213

Query: 233 ERSFLKHSYLAAIEQKYASFGQPNNQ---LNTIRTEIAERVKERGKRDSKGIYRLDLPTG  289
           +    L   Y   +   AS  + ++     +N +R+ ++E+ +   R S GIY L +PTG
Sbjct: 214 QPQQLFEHYHQQLLNHLASLKESDSAQKPINVLRSAMSEQCESFAMRPS-GIYTLSIPTG  272

Query: 290 AGKTNLSMRYAFHQLVHHDKSRFFYITPFLSVLEQNASEIRKVTGD-LGVLEHHSNVVKQ  348
            GKT  S+RYA       ++K R  YI PF +++EQNA E+R + GD    +LEHHSNVV+
Sbjct: 273 GGKTLASLRYALKHAQEYNKQRIIYIVPFTTIIEQNAQEVRNILGDDENILEHHSNVVED  332
```

-continued

```
Query: 349 ANEDDDDKDSLLSA-----YLSDSWDSQVVLTSMVQFFQTLFKTKSANLRRFSSLINSVV  403
           +   D+ +D +++        D+WD  ++ T++VQF    +    + N RR  +L +SV+
Sbjct: 333 SENGDEQEDGVITKKERLRLARDNWDRPIIFTTLVQFLNVFYAKGNRNTRRLHNLSHSVL  392

Query: 404 ILDEVQSLPIEVTTLFNLTMNFLNKVMDTTIVLCTATQPAYDSSEIDHRICYGGNLGELA  463
           I DEVQ +P +  +LFN  +NFL +    +I+LCTATQP  ++  + H +    +
Sbjct: 393 IFDEVQKVPTKCVSLFNEALNFLKEFAHCSILLCTATQPTLEN--VKHSLLKDRD----G  446

Query: 464 EIVELTIEEKQIFSRTELRKFDDSDQKVHLTDVINLILGEE---NSVLAIFNTKKTVHNC  520
           EIV+   E  + F R E+  D +DQ +    +   +  E    S L I NTKK V +
Sbjct: 447 EIVQNLTEVSEAFKRVEI--LDKTDQPMTNERLAEWVRDEAPSWGSTLIILNTKKVVKDL  504

Query: 521 YTMLKDMTDRPVYQLSTNMCAQHRLDLIAKIKTELQNNIPIICISTQLIEAGVDVDFHRV  580
           Y  L+     PV+ LST+MCA HR D + +I+  L+   P IC++TQLIEAGVDV F  V
Sbjct: 505 YEKLEG-GPLPVFHLSTSMCAAHRKDQLDEIRALLKEGTPFICVTTQLIEAGVDVSFKCV  563

Query: 581 IRSYSGIDSIVQAAGRCNREGKRDKGQVTLVNLTNEEENISRLTEIKTKKEATESILHKI  640
           IRS +G+DSI QAAGRCNR G+      V +++  + EE +S+L EI+  +E   ++L +
Sbjct: 564 IRSLAGLDSIAQAAGRCNRHGEEQLQYVYVID--HAEETLSKLKEIEVGQEIAGNVLARF  621

Query: 641 GSPIDISTLN-------RDFFEYYYANNQGLMDYPLED-----NLSIYDYLSLNIYQTAN  688
               +    N        R++F YYY+      ++Y +++           +  +   N Y T
Sbjct: 622 KKKAEKYEGNLLSQAAMREYFRYYYSKMDANLNYFVKEVDKDMTKLLMSHAVENSYVTYY  681

Query: 689 KKFKGK-----LKQAFKTAGAKMNLINNDMIGILVPYGEAEKKLAYLEELGVSHFLSAKD  743
           +K  G      L  ++KTA     +I+ +    +VPYGE +  +A L          S +
Sbjct: 682 QKNTGTHFPLLLNGSYKTAADHFRVIDQNTTSAIVPYGEGQDIIAQLN--------SGEW  733

Query: 744 YQTIKSLLKELQPFTVNV--RENDPLFE--TTKSYLNGQILVLTSEYYDTERGVKY      795
              +  +LK+ Q +TVN+  +E D L +      +L+G +  L   +Y  + GV +
Sbjct: 734 VDDLSKVLKKAQQYTVNLYSQEIDQLKKEGAIVMHLDGMVYELKESWYSHQYGVDF      789
```

Based on this analysis, it was predicted that this GAS-specific protein and its epitopes, could be useful antigens for vaccines or diagnostics.

EXAMPLE 2816

A DNA sequence (GASx1558) was identified in *S. pyogenes* <SEQ ID 8131> which encodes the amino acid sequence <SEQ ID 8132>. Analysis of this protein sequence reveals the following:

```
Possible site: 16
>>> Seems to have no N-terminal signal sequence

----- Final Results -----
               bacterial cytoplasm --- Certainty = 0.1050 (Affirmative) < succ>
                bacterial membrane --- Certainty = 0.0000 (Not Clear) < succ>
                 bacterial outside --- Certainty = 0.0000 (Not Clear) < succ>
```

No corresponding DNA sequence was identified in *S. agalactiae.*

The protein has no significant homology with any sequences in the GENPEPT database.

Based on this analysis, it was predicted that this GAS-specific protein and its epitopes, could be useful antigens for vaccines or diagnostics.

EXAMPLE 2817

A DNA sequence (GASx1563) was identified in *S. pyogenes* <SEQ ID 8133> which encodes the amino acid sequence <SEQ ID 8134>. Analysis of this protein sequence reveals the following:

```
Possible site: 27
>>> Seems to have no N-terminal signal sequence

----- Final Results -----
               bacterial cytoplasm --- Certainty = 0.1872 (Affirmative) < succ>
```

```
            bacterial membrane --- Certainty = 0.0000 (Not Clear) < succ>
            bacterial outside  --- Certainty = 0.0000 (Not Clear) < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2818

A DNA sequence (GASx1564R) was identified in *S. pyogenes* <SEQ ID 8135> which encodes the amino acid sequence <SEQ ID 8136>. Analysis of this protein sequence reveals the following:

```
Possible site: 32
>>> Seems to have no N-terminal signal sequence

----- Final Results -----
            bacterial cytoplasm --- Certainty = 0.2173 (Affirmative) < succ>
            bacterial membrane  --- Certainty = 0.0000 (Not Clear)   < succ>
            bacterial outside   --- Certainty = 0.0000 (Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2819

A DNA sequence (GASx1566R) was identified in *S. pyogenes* <SEQ ID 8137> which encodes the amino acid sequence <SEQ ID 8138>. Analysis of this protein sequence reveals the following:

```
Possible site: 43
>>> Seems to have no N-terminal signal sequence

----- Final Results -----
            bacterial cytoplasm --- Certainty = 0.3486 (Affirmative) < succ>
            bacterial membrane  --- Certainty = 0.0000 (Not Clear)   < succ>
            bacterial outside   --- Certainty = 0.0000 (Not Clear)   < succ>
```

Based on this analysis, it was predicted that this GAS-specific protein and its epitopes, could be useful antigens for vaccines or diagnostics.

EXAMPLE 2820

A DNA sequence (GASx1568) was identified in *S. pyogenes* <SEQ ID 8139> which encodes the amino acid sequence <SEQ ID 8140>. Analysis of this protein sequence reveals the following:

```
Possible site: 26
>>> Seems to have no N-terminal signal sequence
```

```
-continued
----- Final Results -----
        bacterial cytoplasm --- Certainty = 0.2711 (Affirmative) < succ>
         bacterial membrane --- Certainty = 0.0000 (Not Clear)   < succ>
          bacterial outside --- Certainty = 0.0000 (Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2821

A DNA sequence (GASx1569) was identified in *S. pyogenes* <SEQ ID 8141> which encodes the amino acid sequence <SEQ ID 8142>. Analysis of this protein sequence reveals the following:

```
Possible site: 27
>>> Seems to have an uncleavable N-term signal seq

----- Final Results -----
         bacterial membrane --- Certainty = 0.0000 (Not Clear) < succ>
          bacterial outside --- Certainty = 0.0000 (Not Clear) < succ>
        bacterial cytoplasm --- Certainty = 0.0000 (Not Clear) < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2822

A DNA sequence (GASx1576R) was identified in *S. pyogenes* <SEQ ID 8143> which encodes the amino acid sequence <SEQ ID 8144>. Analysis of this protein sequence reveals the following:

```
Possible site: 28
>>> Seems to have no N-terminal signal sequence

----- Final Results -----
        bacterial cytoplasm --- Certainty = 0.4042 (Affirmative) < succ>
         bacterial membrane --- Certainty = 0.0000 (Not Clear)   < succ>
          bacterial outside --- Certainty = 0.0000 (Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2823

A DNA sequence (GASx1577R) was identified in *S. pyogenes* <SEQ ID 8145> which encodes the amino acid sequence <SEQ ID 8146>. Analysis of this protein sequence reveals the following:

```
Possible site: 21
>>> Seems to have no N-terminal signal sequence

----- Final Results -----
            bacterial cytoplasm --- Certainty = 0.3342 (Affirmative) < succ>
             bacterial membrane --- Certainty = 0.0000 (Not Clear)  < succ>
              bacterial outside --- Certainty = 0.0000 (Not Clear)  < succ>
```

No corresponding DNA sequence was identified in *S. agalactiae*.

The protein has homology with the following sequences in the GENPEPT database:

```
>GP: BAB04515 GB: AP001509 unknown [Bacillus halodurans]
Identities = 36/104 (34%), Positives = 55/104 (52%)

Query:   2 HMGAWNTGNNKILYTQESVTDDMIAKRDQSIKDAKESPILGFTVDTKVIKTELSNISNVM   61
           +M ++  GN  IL    E   D      +   + A  SP LGF D+  ++TE++ ISNV
Sbjct: 392 NMPSFAIGNQLILKLYEDDPQDKWEAFEAFNESAIPSPALGFYFDSNPVRTEIAAISNVT  451

Query:  62 NRYKASINTGTVDPDEALPKLLADLKGAGWDKVQKEVQKQLDDF                  105
           + +  ++  G VDP+E LP       L   AG  KV  E+Q+Q D++
Sbjct: 452 SEFSPALLKGAVDPEEYLPLFNDKLNEAGLQKVIDEMQRQFDEW                  495
```

Based on this analysis, it was predicted that this GAS-specific protein and its epitopes, could be useful antigens for vaccines or diagnostics.

EXAMPLE 2824

A DNA sequence (GASx1578R) was identified in *S. pyogenes* <SEQ ID 8147> which encodes the amino acid sequence <SEQ ID 8148>. Analysis of this protein sequence reveals the following:

```
Possible site: 27
>>> May be a lipoprotein

----- Final Results -----
             bacterial membrane --- Certainty = 0.0000 (Not Clear)  < succ>
              bacterial outside --- Certainty = 0.0000 (Not Clear)  < succ>
            bacterial cytoplasm --- Certainty = 0.0000 (Not Clear)  < succ>
```

No corresponding DNA sequence was identified in *S. agalactiae*.

The protein has homology with the following sequences in the GENPEPT database:

```
>GP: BAB04515 GB: AP001509 unknown [Bacillus halodurans]
Identities = 134/346 (38%), Positives = 206/346 (58%), Gaps = 10/346 (2%)

Query:  21 AACESKSASKDSDVKLLMYQVGDKPDNFDELMTIANKRIKEKTGATVDLQYIGWGDWDDK   80
           +A E+++    D V L Y +G    + +M   N   +EK   ATVDL+ + WG++D++
Sbjct:  42 SANETEATDLDH-VTLTWYMIGTPQPDLELVMEEVNAYTEEKINATVDLRMLDWGEYDER  100

Query:  81 MSTIIASGENYDIAF----ANNYVVNAQKGAFADLTTLMPKYAKKTYKNLDPAYIKGNTI  136
           M  I  SGE YDIAF    ANNY +NA++GAF +L  L+ ++ ++   + +DPA+++G +
Sbjct: 101 MQVITTSGEAYDIAFTSSWANNYALNARRGAFLELNDLLDEHGQEMKELIDPAFLEGAQV  160
```

-continued

```
Query: 137 DGKLYAFPVDANVYAQQMLSFNKELVDKYGLDISNIKSYADAENVLKQFHEKEPNTAAFA 196
           DGKLYA P + V  Q +LSFN ELV+K+ LD+S++ S AD E +L    E+E +   A
Sbjct: 161 DGKLYAVPTNKEVGQQAVLSFNNELVEKHNLDLSSVHSLADLEPLLAVIKEEESDVTPIA 220

Query: 197 IGQVFSMSGDYDYPLTKTQPFAVKIDEGKPTIINQYEDESFKNNLRLMHKWYKEGLIPTD 256
               F    +D  L +  PFA +++      +IN+YE++      L+  MH +YK+G I   D
Sbjct: 221 ---TFDAYLPFDSILQEEMPFAFRLEGNTNEVINKYEEDITMETLKTMHDYYKKGYIRPD 277

Query: 257 AATNTEGYPLEGNTWFMREETQGPMDYGDTILTNAAGKDIVSRPLTKPLKTTSQAQMANF 316
           AAT+T+ +PLE   WF+R+E   P  Y + I T  AG +I +RPL +P    +     +
Sbjct: 278 AATSTDSWPLETPNWFVRKELYQP--YAELIWTRTAGYEIATRPLHEPYIFNNSVTGSNQ 335

Query: 317 VVSSVSKNKEKAVEVLSLLNSDPELLNGLVYGVEGKAWEKIGDKKI               362
            +S+ SKN E+A+  L+LLNSDP L N L  G+EG  +E++ D  I
Sbjct: 336 AISATSKNPERAMMFLNLLNSDPYLRNLLDKGIEGVHYEELEDGTI               381
```

Based on this analysis, it was predicted that this GAS-specific protein and its epitopes, could be useful antigens for vaccines or diagnostics.

EXAMPLE 2825

A DNA sequence (GASx1582) was identified in *S. pyogenes* <SEQ ID 8149> which encodes the amino acid sequence <SEQ ID 8150>. Analysis of this protein sequence reveals the following:

```
Possible site: 34
>>> Seems to have no N-terminal signal sequence

----- Final Results -----
            bacterial cytoplasm --- Certainty = 0.0454 (Affirmative) < succ>
            bacterial membrane  --- Certainty = 0.0000 (Not Clear)  < succ>
             bacterial outside  --- Certainty = 0.0000 (Not Clear)  < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2826

A DNA sequence (GASx1584R) was identified in *S. pyogenes* <SEQ ID 8151> which encodes the amino acid sequence <SEQ ID 8152>. Analysis of this protein sequence reveals the following:

```
Possible site: 41
>>> Seems to have no N-terminal signal sequence

----- Final Results -----
            bacterial cytoplasm --- Certainty = 0.3105 (Affirmative) < succ>
            bacterial membrane  --- Certainty = 0.0000 (Not Clear)  < succ>
             bacterial outside  --- Certainty = 0.0000 (Not Clear)  < succ>

RGD motif: 3-5
```

No corresponding DNA sequence was identified in *S. agalactiae*.

The protein has homology with the following sequences in the GENPEPT database:

>GP: AAG21428 GB: AF307332 meningioma-expressed antigen 5s splice
variant [Homo sapiens]
Identities = 94/271 (34%), Positives = 148/271 (53%), Gaps = 14/271 (5%)

```
Query: 120 GIIEGFYGTPWTREERLDCLRFIGNKRMNTYMYAPKDDDYQRKLWRDLYPEDWVTYFKEL 179
            G++EGFYG PW  E+R + R +    +NTY+YAPKDD    R  WR++Y +      L
Sbjct:  63 GVVEGFYGRPWVMEQRKELFRRLQKWELNTYLYAPKDDYKHRMFWREMYSVEEAEQLMTL 122

Query: 180 LAVAKEEGLDFWYMISPGLDFDYTKEADYQLLYQKLQQLLALGVCHFGLLLDDIDYQIVD 239
             ++ A+E  ++F Y ISPGLD  ++   + L +KL Q+    G   F LL DDID+ +
Sbjct: 123 ISAAREYEIEFIYAISPGLDITFSNPKEVSTLKRKLDQVSQFGCRSFALLFDDIDHNMCA Query: 240 AVERRFKKTAYAQAHLATEVHHFLNQQHAAPELVICPTE------YDNHHDSIYLQELSE 293
            A +  F   A+AQ +  E++ +L +        + CPTE        Y N   S YL+ + E
Sbjct: 183 ADKEVFSSFAHAQVSITNEIYQYLGEPET---FLFCPTEYCGTFCYPNVSQSPYLRTVGE 239

Query: 294 RIPKEVAFFWTGPSTLASQISQADIETMAAVYQRPIIIWDNIPVNDYQKDPERLFLTPFA 353
            ++    +   WTGP  ++ +I      IE ++ +  +R  +IWDNI  NDY  D +RLFL  P+
Sbjct: 240 KLLPGIEVLWTGPKVVSKEIPVESIEEVSKIIKRAPVIWDNIHANDY--DQKRLFLGPYK 297

Query: 354 NRSPFLCQPDYQVKGIVSNPMISWELSKLTL                             384
             RS  L       ++KG+++NP  +E + + +
Sbjct: 298 GRSTELIP---RLKGVLTNPNCEFEANYVAI                             325
```

Based on this analysis, it was predicted that this GAS-specific protein and its epitopes, could be useful antigens for vaccines or diagnostics.

EXAMPLE 2827

A DNA sequence (GASx1585R) was identified in *S. pyogenes* <SEQ ID 8153> which encodes the amino acid sequence <SEQ ID 8154>. Analysis of this protein sequence reveals the following:

```
Possible site: 24
>>> Seems to have no N-terminal signal sequence

----- Final Results -----
           bacterial cytoplasm --- Certainty = 0.4469 (Affirmative) < succ>
           bacterial membrane  --- Certainty = 0.0000 (Not Clear)   < succ>
            bacterial outside  --- Certainty = 0.0000 (Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2828

A DNA sequence (GASx1587) was identified in *S. pyogenes* <SEQ ID 8155> which encodes the amino acid sequence <SEQ ID 8156>. Analysis of this protein sequence reveals the following:

```
Possible site: 47
>>> Seems to have no N-terminal signal sequence

----- Final Results -----
           bacterial cytoplasm --- Certainty = 0.3082(Affirmative) < succ>
           bacterial membrane  --- Certainty = 0.0000(Not Clear)   < succ>
            bacterial outside  --- Certainty = 0.0000(Not Clear)   < succ>
```

No corresponding DNA sequence was identified in *S. agalactiae*.

The protein has homology with the following sequences in the GENPEPT database:

```
>GP: BAB04509 GB: AP001509 unknown conserved protein in others
[Bacillus halodurans]
Identities = 221/425 (52%), Positives = 296/425 (69%), Gaps = 4/425 (0%)

Query:   12 RPIPTSVSQFMAKVESLCGDQHPDWALNFKTSFTNTLETTLKTYEDGTSFLLTGDIPAMW   71
            + IP S+  +A+V++    D     L F+  F NT  TT++  E GT F++TGDIPAMW
Sbjct:    4 KKIPRSLQAIIAQVKAHYADDQELQTL-FEQCFLNTYLTTIQEDEQGT-FVVTGDIPAMW   61

Query:   72 LRDSTAQMKPYLFLAKEDEEIRKIIAGLVKRQFRYICIDPYANAFNEEANEKGHQTDHTQ  131
            LRDS+AQ++PYL + KED ++ ++I G+++RQ+RYI DPYANAFN+ AN++GHQ D T+
Sbjct:   62 LRDSSAQVRPYLTVVKEDADMARMIKGVIERQWRYILHDPYANAFNQTANKQGHQQDRTE  121

Query:  132 MNPWIWERKYEIDCLCYPIQLAYLLYRETGSTDQFNDDFHRGVELILDLWTVEQDH-AQS  190
            M+P +WERKYE+D LCYPIQLAYL ++ TG         + +E I  +W +EQDH A+S
Sbjct:  122 MSPLVWERKYELDSLCYPIQLAYLYWKATGDDSVLQPTLKQVLETIYRIWKIEQDHEAKS  181

Query:  191 PYLFERDTWRKEDTLTHAGKGSPVAPTGMTWSGFRPSDDACQYGYLIPSNMFAVVVLSYL  250
                Y FERD  R  DTL   GKG   PTGMTWSGFRPSDDAC YGYLIP+NMFAVVV +Y
Sbjct:  182 SYSFERDDCRVSDTLLRKGKGYSVPTGMTWSGFRPSDDACLYGYLIPANMFAVVVSNYA  241

Query:  251 EDLYNNLFHNEPVATRAKQLKEAIQSGIADHALVQNSKGETIYAYEVDGLGQFSIMDDAN  310
            +L  +    +A  ++L+  I+ GI  +  + +       IY YE DG G+  ++MDDAN
Sbjct:  242 VELLTAM-EEIKLAEEFRELEADIRQGIGQYGKMDHPVYGEIYVYETDGNGRVNLMDDAN  300

Query:  311 IPSLLAAPYLGFCTKDDPIYLATRRTILSQENPYYYQGNAAAGIGSSHTPENYIWHIALA  370
            +PSLLA PYLG+ T DDP+Y  TRR ILS++NPYYY+G+ A G+GS HTP++Y+WHI+LA
Sbjct:  301 VPSLLAIPYLGYTTADDPVYQNTRRFILSRDNPYYYEGSYAKGVGSPHTPDHYVWHISLA  360

Query:  371 LQGLTALDQDSKKEMLDLLVATDAGTHLMHEGFDVNDPYQYTREWFSWANMMFCELLLDY  430
            +QG+TA+D   KK+++ +   T A T+ MHEGFDV+ P QYTR WF+WAN MF E LL
Sbjct:  361 IQGMTAIDSKEKKQIVAMFKQTHADTYFMHEGFDVDRPEQYTRSWFAWANSMFSEFLLSE  420

Query:  431 LGFSI                                                         435
                G +
Sbjct:  421 AGIYV                                                         425
```

Based on this analysis, it was predicted that this GAS-specific protein and its epitopes, could be useful antigens for vaccines or diagnostics.

EXAMPLE 2829

A DNA sequence (GASx1588) was identified in *S. pyogenes* <SEQ ID 8157> which encodes the amino acid sequence <SEQ ID 8158>. Analysis of this protein sequence reveals the following:

```
Possible site: 21
>>> Seems to have no N-terminal signal sequence

----- Final Results -----
              bacterial cytoplasm --- Certainty = 0.5250(Affirmative) < succ>
               bacterial membrane --- Certainty = 0.0000(Not Clear) < succ>
                bacterial outside --- Certainty = 0.0000(Not Clear) < succ>
```

No corresponding DNA sequence was identified in *S. agalactiae.*

The protein has homology with the following sequences in the GENPEPT database:

```
>GP: BAB04508 GB: AP001509 unknown conserved protein in others
(divided) [Bacillus halodurans]
Identities = 312/737 (42%), Positives = 426/737 (57%), Gaps = 21/737 (2%)

Query: 123 FPDTFGNMGQTPQLMLKAGLQAAAFGRGIRPTGFNNQVDTSEKYSSQFSEISWQGPDNSR  182
           FPDTFG  GQ PQL+ +AG++AA FGRG+ PTGFNNQV   + YSS FSE+ W+ PD S+
Sbjct:   4 FPDTFGIYGQAPQLLAQAGIRAAVFGRGVTPTGFNNQVQHDD-YSSPFSELIWEAPDGSQ   62

Query: 183 ILGLLFANWYSNGNEIPTTEAEARLFWDKKLADAERFASTKHLLMMNGCDHQPVQLDVTK  242
           ++G+L ANWYSNGNEIPT E EA+ FW KKL DAERFAST  LL MNGCDHQPVQ DVT+
Sbjct:  63 VIGILLANWYSNGNEIPTDEDEAQTFWVKKLRDAERFASTSQLLFMNGCDHQPVQKDVTQ  122
```

-continued

```
Query: 243 AIALANQLYPDYEFVHSCFEDYLADLADDLPENLSTVQGEITSQETDGWYTLANTASARI 302
            AI +A  L+PD   F HS F DYL  + ++LP+ L  + GE+ +Q+TDGW TL NTASARI
Sbjct: 123 AIKVAETLFPDVAFKHSNFHDYLTQIKEELPKELQKITGELRNQKTDGWSTLVNTASARI 182

Query: 303 YLKQANTRVSRQLENITEPLAAMAYEVTSTYPHDQLRYAWKTLMQNHPHDSICGCSVDSV 362
            YLKQAN R    L N+ EP+  +        + D   Y WK LM+NHPHDSICGCS+D+V
Sbjct: 183 YLKQANDRCQTLLTNVLEPMCLLV--ENKSLHRDFSEYYWKLLMENHPHDSICGCSIDAV 240

Query: 363 HREMMTRFEKAYEVGHYLAKEAAKQIADAIDTRDFPMDSQPFVLFNTSGHSKTSVAELSL 422
            HREM TRFEK         E  K+IA I+T      ++ P V+  T+G S   V   +
Sbjct: 241 HREMKTRFEKVEAGATTFIAEQGKEIAAQINTLHDSEEAIPLVVLKTNGTSGKRVVRHKV 300

Query: 423 TWKKYHFGQRFPKEVYQEAQEYLARLSQSFQIIDTSGQVRPEAEILGTSIAFDYDLPKRS 482
               KK +F +       ++   + L  +      ++  +     E+    + F YDLP+
Sbjct: 301 AMKKIYFDEM----DFRHIPDRLKEIVMPTYRLEFPNKGSVPIEVQDAGVRFGYDLPRDG 356

Query: 483 FREPYFAIKVRLRLPITLPAMSWKTLALKLG------NETTPSETVSLYDDSNQCLENGF 536
            FR  PY+A         L +T    S     L  + G        + T +     + D S   LEN
Sbjct: 357 FRRPYYA----RELEVTFSYDSDLYLGYECGFLVPVEEKQTEARKELIGDPSMNTLENEA 412

Query: 537 LKVMIQTDGRLTITDKQSGLIYQDLLRFEDCGDIGNEYISRQPNHDQPFYADQGTIKLNI 596
            +KVMI    +G  +I DK +G  Y+ L   +ED GDIGNEY+ +    +    + +      + I
Sbjct: 413 MKVMIHRNGSYSILDKTTGFEYRHLGIYEDVGDIGNEYMFKASSDGVRYTTEACEASIRI 472

Query: 597 ISNTAQVAELEIQQTFAIPISADKLLQAEMEAVIDITERQARRSQEKAELTLTTLIRMEK 656
             I N +  A +EI QT ++P +AD+ L+ E E ++    +R+A RS+E+ ++TL T + +E+
Sbjct: 473 IENNSLCATVEICQTLSVPAAADERLKEEQERLVWHPDRKAGRSKERTDITLRTELTLEQ 532

Query: 657 NNPRLQFTTRFDNQMTNHRLRVLFPTHLKTDHHLADSIFETVKRPNHPDATFWKNPSNPQ 716
                L+      DN    +HR+R LFP         +H ADSI+E V+RPN PD    W+NP+
Sbjct: 533 GAKGLKVNVNIDNTAKDHRMRALFPVERARGNHYADSIYEIVERPNTPDPK-WQNPAFDH 591

Query: 717 HQECFVSLFDGENGVTIGNYGLNEYEILPDTNTIAITLLRSVGEMGDWGYFPTPEAQCLG 776
            H +  VSL +GE G+TI    GL+EYEI+  D   +IA+TLLRSVGE+GDWG F TPEAQC G
Sbjct: 592 HMQRLVSLDNGEYGLTIATKGLHEYEIVSD--SIAVTLLRSVGELGDWGLFETPEAQCFG 649

Query: 777 KHSLSYSFESITKQTQFAS-YWRAQEGQVPVITTQTNQHEGTLAAEYSYLTGTNDQVALT 835
            ++   +        A+ Y A +   V       QT Q  G L    + + + LT
Sbjct: 650 QNEAQFVLLPHKGDVLSANVYVAAYDDPVEPTVIQTEQSMGPLPHATNLFQWSGEGLVLT 709

Query: 836 AFKRRLADNALITRSYN                                            852
            A K  +     +I R +N
Sbjct: 710 ACKPTMDGRGMILRWFN                                            726
```

Based on this analysis, it was predicted that this GAS-specific protein and its epitopes, could be useful antigens for vaccines or diagnostics.

EXAMPLE 2830

A DNA sequence (GASx1589R) was identified in *S. pyogenes* <SEQ ID 8159> which encodes the amino acid sequence <SEQ ID 8160>. Analysis of this protein sequence reveals the following:

```
Possible site: 31
>>> Seems to have a cleavable N-term signal seq.
   INTEGRAL     Likelihood = -11.30     Transmembrane    203-219 (195-221)
   INTEGRAL     Likelihood = -8.17      Transmembrane      61-77 (59-82)
   INTEGRAL     Likelihood = -3.98      Transmembrane    107-123 (107-124)
   INTEGRAL     Likelihood = -3.40      Transmembrane      39-55 (38-58)
   INTEGRAL     Likelihood = -2.34      Transmembrane    129-145 (126-145)
   INTEGRAL     Likelihood = -2.07      Transmembrane     89-105 (87-105)

----- Final Results -----
               bacterial membrane --- Certainty = 0.5522(Affirmative) < succ>
                bacterial outside --- Certainty = 0.0000(Not Clear) < succ>
              bacterial cytoplasm --- Certainty = 0.0000(Not Clear) < succ>
```

No corresponding DNA sequence was identified in *S. agalactiae.*

The protein has homology with the following sequences in the GENPEPT database:

```
>GP: CAC10175 GB: AJ278302 histidine kinase [Streptococcus pneumoniae]
Identities = 114/432 (26%), Positives = 219/432 (50%), Gaps = 10/432 (2%)

Query:   21 LTLKLFSFVSAIPLRLKNIFYLSLSMVLFQVVFWAFFPDHFILDVVMLAQF---LFFALI   77
            L  +F   V  I L  + IF    L  +L  VVF        +++  V L+ F    L+   +
Sbjct:   16 LKIVIFFKVDGISLTFERIFKAFLFKILLAVVFGML---GYMVGNVYLSYFMEPLYGIGL   72

Query:   78 ALYYGKSIKAKFLMFYAFFPLVSISLVKRFIVFFVMPLFGMPYSVVKHNTLLIYSITCFS  137
            +    + +   K L+FY  FP++  ++L  R +  +FV+P    G      V      + +    I   F+
Sbjct:   73 SFLLLRELPKKLLLFYGLFPMILVNLFYRGVSYFVLPFLGQG-QVYDDYSFIWLCIIIFN  131

Query:  138 IFLIYRCIQVFHFDFSTWRQYFQSHRASKLLVFTNSSMALYYLCVQGIDVMSPSLSGLAT  197
             F+      ++    +DF++ R+           K L   N  M  YYL +Q +          G+    +
Sbjct:  132 FFISLAFLKWLDYDFTSLRKGILDKDFQKSLTQINWIMGAYYLVIQNLSYFEYQ-QGIQS  190

Query:  198 TTARSIIVLFYFILFLTLLIHLERYVKQNSIEAIVQQKE--YRELINYSQHLGLLYQDIQ  255
            TT  R  +I++FY + F+ ++    L+ Y+K      E +  Q+++  YRE+   YS+H+   LY++++
Sbjct:  191 TTVRHLILVFYLLFFMGIIKKLDTYLKDKLHERLNQEQDLRYREMERYSRHIEELYKEVR  250

Query:  256 ELRRLLTTVSSRLKIGIEQNDISIVRLTYEGILNAEKNNAKDDRLDLTCLDKLQVEAIRH  315
                 R     T + +  L++GIE+  D+   ++   Y+   +L          +D++  DL    L   ++   A++
Sbjct:  251 SFRHDYTNLLTSLRLGIEEEDMEQIKEIYDSVLKDSSEKLQDNKYDLGRLVNVRDRALKS  310

Query:  316 IVLAKLIEAKNKKLKVEVSIPNCIATFFLEVVDFTKLLSFLLDNAIEMSLETKQPCLSIA  375
                ++   K I+A++K  +      V +P    I       +  ++DF   ++S  L  DNAIE   S+E     QP  +SIA
Sbjct:  311 LLAGKFIKARDKNIVFNVEVPEEIQVEGVSLLDFLTVVSILCDNAIEASVEACQPHVSIA  370

Query:  376 FLDQNHKLVIVIQSSTKQGQDDSQSVFAIPALKKRDDWQFDLRNVTTILNRYDYLTISSQ  435
             F      +    +I++S K+     D    +F+   A   K ++        L  V  I+    +     ++++
Sbjct:  371 FFKNGAQETFIIENSIKEEGIDISEIFSFGASSKGEERGVGLYTVMKIVESHPNTSLNTT  430

Query:  436 IHDGILTQLIEI                                                  447
             D +    Q++ +
Sbjct:  431 CQDHVFRQVLTV                                                  442
```

Based on this analysis, it was predicted that this GAS-specific protein and its epitopes, could be useful antigens for vaccines or diagnostics.

EXAMPLE 2831

A DNA sequence (GASx1593R) was identified in *S. pyogenes* <SEQ ID 8161> which encodes the amino acid sequence <SEQ ID 8162>. Analysis of this protein sequence reveals the following:

```
Possible site: 25
>>> Seems to have an uncleavable N-term signal seq
     INTEGRAL       Likelihood = -1.28       Transmembrane    2-18 (1-18)

----- Final Results -----
              bacterial membrane --- Certainty = 0.1510(Affirmative) < succ>
              bacterial outside  --- Certainty = 0.0000(Not Clear)   < succ>
              bacterial cytoplasm --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2832

A DNA sequence (GASx1594) was identified in *S. pyogenes* <SEQ ID 8163> which encodes the amino acid sequence <SEQ ID 8164>. Analysis of this protein sequence reveals the following:

```
Possible site: 61
>>> Seems to have no N-terminal signal sequence
     INTEGRAL      Likelihood = -3.93      Transmembrane      76-92 (76-92)

----- Final Results -----
               bacterial membrane --- Certainty = 0.2572(Affirmative) < succ>
               bacterial outside  --- Certainty = 0.0000(Not Clear)   < succ>
              bacterial cytoplasm --- Certainty = 0.0000(Not Clear)   < succ>
```

No corresponding DNA sequence was identified in *S. agalactiae*.

The protein has homology with the following sequences in the GENPEPT database:

```
>GP: AAF61313 GB: U96166 unknown [Streptococcus cristatus]
Identities = 31/66 (46%), Positives = 40/66 (59%), Gaps = 2/66 (3%)

Query: 14 LLGRILSKYVGRLTSCIENETTKIRNHSRQNDTIGLNHLLGNLKTVHNPEIILKTINVYS   73
          + G  +SK    +   + E  K+  ++  ND IG N LLG+LKTVHNPEII +   VYS
Sbjct: 30 VFGMDVSKTSSEVAILVNGE--KVHGYTILNDAIGFNRLLGDLKTVHNPEIIFEATGVYS   87

Query: 74 RRLQVF                                                         79
          RRLQ F
Sbjct: 88 RRLQAF                                                         93
```

Based on this analysis, it was predicted that this GAS-specific protein and its epitopes, could be useful antigens for vaccines or diagnostics.

EXAMPLE 2833

A DNA sequence (GASx1598) was identified in *S. pyogenes* <SEQ ID 8165> which encodes the amino acid sequence <SEQ ID 8166>. Analysis of this protein sequence reveals the following:

```
Possible site: 14
>>> Seems to have no N-terminal signal sequence

----- Final Results -----
              bacterial cytoplasm --- Certainty = 0.2117(Affirmative) < succ>
               bacterial membrane --- Certainty = 0.0000(Not Clear)   < succ>
               bacterial outside  --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2834

A DNA sequence (GASx1608) was identified in *S. pyogenes* <SEQ ID 8167> which encodes the amino acid sequence <SEQ ID 8168>. Analysis of this protein sequence reveals the following:

```
Possible site: 16
>>> Seems to have an uncleavable N-term signal seq

----- Final Results -----
               bacterial membrane --- Certainty = 0.0000(Not Clear) < succ>
               bacterial outside  --- Certainty = 0.0000(Not Clear) < succ>
              bacterial cytoplasm --- Certainty = 0.000(Not Clear)  < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2835

A DNA sequence (GASx1619) was identified in *S. pyogenes* <SEQ ID 8169> which encodes the amino acid sequence <SEQ ID 8170>. Analysis of this protein sequence reveals the following:

```
Possible site: 36
>>> Seems to have no N-terminal signal sequence

----- Final Results -----
          bacterial cytoplasm --- Certainty = 0.2916(Affirmative) < succ>
          bacterial membrane  --- Certainty = 0.0000(Not Clear)   < succ>
           bacterial outside  --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2836

A DNA sequence (GASx1621) was identified in *S. pyogenes* <SEQ ID 8171> which encodes the amino acid sequence <SEQ ID 8172>. Analysis of this protein sequence reveals the following:

```
Possible site: 33
>>> Seems to have no N-terminal signal sequence

----- Final Results -----
          bacterial cytoplasm --- Certainty = 0.1899(Affirmative) < succ>
          bacterial membrane  --- Certainty = 0.0000(Not Clear)   < succ>
           bacterial outside  --- Certainty = 0.0000(Not Clear)   < succ>
```

No corresponding DNA sequence was identified in *S. agalactiae*.

The protein has homology with the following sequences in the GENPEPT database:

```
alpha subunit [Escherichia coli]
Identities = 110/211 (52%), Positives = 153/211 (72%)

Query:   7 KEITIKEAVAHVKDGDTIMVGGFMTNGTPEKLIDALVEKGVKDLTLICNDAGFPDKGVGK   66
           K +T+++A    +DG TIMVGGFM  GTP +L++AL+E GV+DLTLI ND   F D G+G
Sbjct:   4 KLMTLQDATGFFRDGMTIMVGGFMGIGTPSRLVEALLESGVRDLTLIANDTAFVDTGIGP  63

Query:  67 MVANKQFSTIIASHIGLNREAGRQMTEGETVIDLVPQGTLAERIRSGGFGLGGFLTPTGI  126
           ++ N +   +IASHIG N E GR+M  GE   LVPQGTL E+IR GG GLGGFLTPTG+
Sbjct:  64 LIVNGRVRKVIASHIGTNPETGRRMISGEMDVVLVPQGTLIEQIRCGGAGLGGFLTPTGV 123

Query: 127 GTEVAKGKEVITIDGKDYLLEKPLKADVALIFANKADKNGNLQYAGSENNFNHVMAANAK 186
           GT V +GK+ +T+DGK +LLE+PL+AD+ALI A++ D  GNL Y  S   NFN ++A  A
Sbjct: 124 GTVVEEGKQTLTLDGKTWLLERPLRADLALIRAHRCDTLGNLTYQLSARNFNPLIALAAD 183

Query: 187 TTIVEAREIVDVGQMDPNFVHTPGIFVNYLV                              217
           T+VE  E+V+ G++ P+ +  TPG  +++++
Sbjct: 184 ITLVEPDELVETGELQPDHIVTPGAVIDHII                              214
```

Based on this analysis, it was predicted that this GAS-specific protein and its epitopes, could be useful antigens for vaccines or diagnostics.

EXAMPLE 2837

A DNA sequence (GASx1622) was identified in *S. pyogenes* <SEQ ID 8173> which encodes the amino acid sequence <SEQ ID 8174>. Analysis of this protein sequence reveals the following:

```
Possible site: 44
>>> Seems to have no N-terminal signal sequence

----- Final Results -----
            bacterial cytoplasm --- Certainty = 0.4668(Affirmative) < succ>
             bacterial membrane --- Certainty = 0.0000(Not Clear)   < succ>
              bacterial outside --- Certainty = 0.0000(Not Clear)   < succ>
```

No corresponding DNA sequence was identified in *S. agalactiae*.

The protein has homology with the following sequences in the GENPEPT database:

```
>GP: AAD54948 GB: AF157306 acetoacetate:butyrate/acetate coenzyme A
transferase [Clostridium beijerinckii]
Identities = 121/214 (56%), Positives = 161/214 (74%), Gaps = 5/214 (2%)

Query:   7 VLSKEEIQTRIAKRVAQELEHNTLVNLGIGLPTKVANYIPEGVTITLQSENGFVGLTGLT   66
           VL+KE I    AKRVA+EL+   LVNLGIGLPT VANY+P+ + IT +SENG VG+  +
Sbjct:   6 VLAKEII----AKRVAKELKKGQLVNLGIGLPTLVANYVPKEMNITFESENGMVGMAQMA   61

Query:  67 DD-HYDPTIVNAGGQPVSIAPGGAFFDSSTSFGIIRGGHVAATVLGALQVDKEASIANYL  125
              DP I+NAGG+ V++ P GAFFDSSTSF +IRGGHV    VLGAL+VD+E ++AN++
Sbjct:  62 SSGENDPDIINAGGEYVTLLPQGAFFDSSTSFALIRGGHVDVAVLGALEVDEEGNLANWI  121

Query: 126 IPGKMVPGMGGAMDLLVGAKKVIVAMEHTNKGKAKILDKCTLPLTAQNVVNLIITEMGVF  185
           +P K+VPGMGGAMDL +GAKK+IVAM+HT KGK KI+ KCTLPLTA+   V+LI+TE+ V
Sbjct: 122 VPNKIVPGMGGAMDLAIGAKKIIVAMQHTGKGKPKIVKKCTLPLTAKAQVDLIVTELCVI  181

Query: 186 EYQDEGLCALEINPDYTFEDVQNVTEVTLIDKTN                           219
           +  ++GL   EI+ D T ++++ +T+  LI   N
Sbjct: 182 DVTNDGLLFREIHKDTTIDEIKFLTDADLIIPDN                           215
```

Based on this analysis, it was predicted that this GAS-specific protein and its epitopes, could be useful antigens for vaccines or diagnostics.

EXAMPLE 2838

A DNA sequence (GASx1628R) was identified in *S. pyogenes* <SEQ ID 8175> which encodes the amino acid sequence <SEQ ID 8176>. Analysis of this protein sequence reveals the following:

```
Possible site: 17
>>> Seems to have no N-terminal signal sequence

----- Final Results -----
            bacterial cytoplasm --- Certainty = 0.1243(Affirmative) < succ>
             bacterial membrane --- Certainty = 0.0000(Not Clear)   < succ>
              bacterial outside --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2839

A DNA sequence (GASx1639R) was identified in *S. pyogenes* <SEQ ID 8177> which encodes the amino acid sequence <SEQ ID 8178>. Analysis of this protein sequence reveals the following:

```
Possible site: 34
>>> Seems to have an uncleavable N-term signal seq
     INTEGRAL    Likelihood = -8.65    Transmembrane    55-71 (44-73)
     INTEGRAL    Likelihood = -7.64    Transmembrane    13-29 (5-31)

----- Final Results -----
              bacterial membrane --- Certainty = 0.4461(Affirmative) < succ>
              bacterial outside  --- Certainty = 0.0000(Not Clear)   < succ>
              bacterial cytoplasm --- Certainty = 0.0000(Not Clear)  < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2840

A DNA sequence (GASx1643) was identified in *S. pyogenes* <SEQ ID 8179> which encodes the amino acid sequence <SEQ ID 8180>. Analysis of this protein sequence reveals the following:

```
Possible site: 35
>>> Seems to have no N-terminal signal sequence

----- Final Results -----
              bacterial cytoplasm --- Certainty = 0.0766 (Affirmative) < succ>
              bacterial membrane  --- Certainty = 0.0000 (Not Clear)   < succ>
              bacterial outside   --- Certainty = 0.0000 (Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2841

A DNA sequence (GASx1645R) was identified in *S. pyogenes* <SEQ ID 8181> which encodes the amino acid sequence <SEQ ID 8182>. Analysis of this protein sequence reveals the following:

```
Possible site: 18
>>> Seems to have a cleavable N-term signal seq.

----- Final Results -----
              bacterial outside   --- Certainty = 0.3000 (Affirmative) < succ>
              bacterial membrane  --- Certainty = 0.0000 (Not Clear)   < succ>
              bacterial cytoplasm --- Certainty = 0.0000 (Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2842

A DNA sequence (GASx1649R) was identified in *S. pyogenes* <SEQ ID 8183> which encodes the amino acid sequence <SEQ ID 8184>. Analysis of this protein sequence reveals the following:

```
Possible site: 24
>>> Seems to have no N-terminal signal sequence

----- Final Results -----
            bacterial cytoplasm --- Certainty = 0.0931 (Affirmative) < succ>
            bacterial membrane  --- Certainty = 0.0000 (Not Clear)   < succ>
            bacterial outside   --- Certainty = 0.0000 (Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2843

A DNA sequence (GASx1650) was identified in *S. pyogenes* <SEQ ID 8185> which encodes the amino acid sequence <SEQ ID 8186>. Analysis of this protein sequence reveals the following:

```
Possible site: 14
>>> Seems to have no N-terminal signal sequence

----- Final Results -----
            bacterial cytoplasm --- Certainty = 0.5678 (Affirmative) < succ>
            bacterial membrane  --- Certainty = 0.0000 (Not Clear)   < succ>
            bacterial outside   --- Certainty = 0.0000 (Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2844

A DNA sequence (GASx1651R) was identified in *S. pyogenes* <SEQ ID 8187> which encodes the amino acid sequence <SEQ ID 8188>. Analysis of this protein sequence reveals the following:

```
Possible site: 40
>>> Seems to have no N-terminal signal sequence

----- Final Results -----
            bacterial cytoplasm --- Certainty = 0.2761 (Affirmative) < succ>
            bacterial membrane  --- Certainty = 0.0000 (Not Clear)  < succ>
            bacterial outside   --- Certainty = 0.0000 (Not Clear)  < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2845

A DNA sequence (GASx1667R) was identified in *S. pyogenes* <SEQ ID 8189> which encodes the amino acid sequence <SEQ ID 8190>. Analysis of this protein sequence reveals the following:

```
Possible site: 33
>>> Seems to have no N-terminal signal sequence

----- Final Results -----
            bacterial cytoplasm --- Certainty = 0.2967 (Affirmative) < succ>
            bacterial membrane  --- Certainty = 0.0000 (Not Clear)  < succ>
            bacterial outside   --- Certainty = 0.0000 (Not Clear)  < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2846

A DNA sequence (GASx1672) was identified in *S. pyogenes* <SEQ ID 8191> which encodes the amino acid sequence <SEQ ID 8192>. Analysis of this protein sequence reveals the following:

```
Possible site: 24
>>> Seems to have an uncleavable N-term signal seq
INTEGRAL Likelihood = -3.82 Transmembrane 3-19 (1-20)

----- Final Results -----
            bacterial membrane  --- Certainty = 0.2529 (Affirmative) < succ>
            bacterial outside   --- Certainty = 0.0000 (Not Clear)  < succ>
            bacterial cytoplasm --- Certainty = 0.0000 (Not Clear)  < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2847

A DNA sequence (GASx1673R) was identified in *S. pyogenes* <SEQ ID 8193> which encodes the amino acid sequence <SEQ ID 8194>. Analysis of this protein sequence reveals the following:

```
Possible site: 38
>>> Seems to have no N-terminal signal sequence
INTEGRAL Likelihood = -8.86 Transmembrane   51-67 (47-75)
INTEGRAL Likelihood = -5.20 Transmembrane   27-43 (24-45)
INTEGRAL Likelihood = -3.66 Transmembrane 112-128 (112-131)

----- Final Results -----
              bacterial membrane --- Certainty = 0.4545 (Affirmative) < succ>
               bacterial outside --- Certainty = 0.0000 (Not Clear) < succ>
                bacterial cytoplasm --- Certainty = 0.0000 (Not Clear) < succ>
```

No corresponding DNA sequence was identified in *S. agalactiae*.

The protein has homology with the following sequences in the GENPEPT database:

```
>GP: AAF41294 GB: AE002440 conserved hypothetical protein [Neisseria
meningitidis MC58]
Identities = 61/148 (41%), Positives = 96/148 (64%)

Query:   1 LKKSITNEKAILAQGGQEFGAQNTKFLTLLHIMIYVFAVIEALLKQIKFDGISFLGLLLM   60
           L  SI +EKA++A+G +++G  N+  L  +H + Y+   +    L    F+GIS +G L +
Sbjct:  19 LAVSIKHEKALIAKGAKQYGKTNSTLLAAVHTLYYLACFVWVWLSDTAFNGISLIGTLTV   78

Query:  61 LLSVAVLYEVTRILGDIWTVKLMLAKDHKYVDHWLFKTIKHPNYFLNIAPELVGIALLCH  120
           + S  +L  + + LG+IWTVK+ +  +H+    WLFKT +HPNYFLNI PEL+GIALLC
Sbjct:  79 MASFVILSLIIKQLGEIWTVKIYILPNHQINRSWLFKTFRHPNYFLNIIPELIGIALLCQ  138

Query: 121 AKITAMLLFPCYIVVIYLRIREENKLLA                                 148
           A    ++  P Y++V++ RIR+E + +A
Sbjct: 139 AWYVLLIGLPIYLLVLFKRIRQEEQAMA                                 166
```

A related GBS gene <SEQ ID 9009> and protein <SEQ ID 9010> were also identified. Analysis of this protein sequence reveals the following:

```
Lipop: Possible site: -1 Crend: 0
McG: Discrim Score: 5.86
GvH: Signal Score (-7.5): 0.14
Possible site: 60
>>> Seems to have a cleavable N-term signal seq.
ALOM program count: 2 value: -8.23 threshold: 0.0
INTEGRAL Likelihood = -8.23 Transmembrane   69-85 (64-89)
INTEGRAL Likelihood = -3.29 Transmembrane 142-158 (140-159)
PERIPHERAL  Likelihood = 1.70  123
modified ALOM score: 2.15

*** Reasoning Step: 3

----- Final Results -----
               bacterial membrane --- Certainty = 0.4291 (Affirmative) < succ>
                bacterial outside --- Certainty = 0.0000 (Not Clear) < succ>
              bacterial cytoplasm --- Certainty = 0.0000 (Not Clear) < succ>
```

The protein has homology with the following sequences in the databases:

```
42.1/64.0% over 168aa                                              imported

EGAD|177248| conserved hypothetical protein {Neisseria meningitidis} Insert
characterized
  GP|7379797|emb|CAB84365.1||AL162755 putative integral membrane protein {Neisseria
meningitidis} Insert characterized
  GP|7226121|gb|AAF41294.1||AE002440 conserved hypothetical protein {Neisseria
meningitidis MC58} Insert characterized
  PIR|F81147|F81147 probable integral membrane protein NMA1102 - Neisseria
meningitidis (group B strain MD58, group A strain Z2491) Insert
 characterized ORF00432(301-807 of 1140)
EGAD|177248|NMB0883(1-169 of 169) conserved hypothetical protein {Neisseria
meningitidis}GP|7379797|emb|CAB84365.1||AL162755 putative integral membrane protein
{Neisseria meningitidis}GP|7226121|gb|AAF41294.1||AE002440 conserved hypothetical
protein {Neisseria meningitidis MC58}PIR|F81147|F81147 probable integral membrane
protein NMA1102 [imported] - Neisseria meningitidis (group B strain MD58, group A
strain Z2491)
% Match = 19.0
% Identity = 42.0  % Similarity = 63.9
Matches = 71  Mismatches = 61  Conservative Sub.s = 37
   237       267       297       327       357       387       417       447
SSGEYHLLTSDHSLV*IGKAXX*LIXXXEFTMSIIIGLMAAMFIIRLAYLKLSIANEKALRKNGAKEYGVGVSKAITVLH
                                  |::|: ::: |||||:|:||:||||   |||:||   |  :  :|
                              MTMILSILSLFFIIRLLFLAVSIKHEKALIAKGAKQYGKTNSTLLAAVH
                                        10        20        30        40
   477       507       537       567       597       627       657       687
IIIYFSSVTEAILTKASFNFVSVIGLSLMIFSVFMLHTVTRLLGRIWTVKLMVDKNHQFVDHWLFRVVKHPNYFLNIAPE
  :|::       |:  :|| :|:||   ::   |   :|    :  : ||  |||||:  :  |||    |||:  :||||||||| ||
TLYYLACFVWVWLSDTAFNGISLIGTLTVMASFVILSLIIKQLGEIWTVKIYILPNHQINRSWLFKTFRHPNYFLNIIPE
         60        70        80        90       100       110       120
   717       747       777       807       837       867       897       927
LLGVTLLCHAKYTALFVLPIYAFVIYLRIREENLLLKTIIIPNGIKKSRVY*E*DK**T*KSFFVILSQ*EEVFISCFFS
|:|: |||:|| | | |  ||||  :|::  |||:|    :  |:
LIGIALLCQAWYVLLIGLPIYLLVLFKRIRQEEQAMATLF
        140       150       160
```

Based on this analysis, it was predicted that these proteins and their epitopes could be useful antigens for vaccines or diagnostics.

EXAMPLE 2848

A DNA sequence (GASx1674R) was identified in *S. pyogenes* <SEQ ID 8195> which encodes the amino acid sequence <SEQ ID 8196>. Analysis of this protein sequence reveals the following:

```
Possible site: 23
>>> Seems to have no N-terminal signal sequence

----- Final Results -----
           bacterial cytoplasm --- Certainty = 0.3098(Affirmative) < succ>
           bacterial membrane  --- Certainty = 0.0000(Not Clear)   < succ>
            bacterial outside  --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2849

A DNA sequence (GASx1677R) was identified in *S. pyogenes* <SEQ ID 8197> which encodes the amino acid sequence <SEQ ID 8198>. Analysis of this protein sequence reveals the following:

```
Possible site: 33
>>> Seems to have no N-terminal signal sequence
     INTEGRAL    Likelihood = -8.86    Transmembrane    254-270 (248-280)
     INTEGRAL    Likelihood = -7.01    Transmembrane    303-319 (296-322)
     INTEGRAL    Likelihood = -2.39    Transmembrane     74-90  (74-91)
     INTEGRAL    Likelihood = -1.91    Transmembrane    201-217 (199-217)
     INTEGRAL    Likelihood = -1.91    Transmembrane    223-239 (220-240)
     INTEGRAL    Likelihood = -1.65    Transmembrane    118-134 (115-135)
     INTEGRAL    Likelihood = -1.49    Transmembrane     56-72  (55-72)
     INTEGRAL    Likelihood = -0.32    Transmembrane     13-29  (13-30)

----- Final Results -----
              bacterial membrane  --- Certainty = 0.4545(Affirmative) < succ>
              bacterial outside   --- Certainty = 0.0000(Not Clear)   < succ>
              bacterial cytoplasm --- Certainty = 0.0000(Not Clear)   < succ>
```

No corresponding DNA sequence was identified in *S. agalactiae*.

The protein has homology with the following sequences in the GENPEPT database:

```
>GP: BAB05126 GB: AP001511 unknown conserved protein
[Bacillus halodurans]
Identities = 249/534 (46%), Positives = 380/534 (70%)

Query:    12 QDIAFHFFGGLGLFLFSIKYMGDGLQQAAGDKLRYYIDKYTSNPFFGILVGIAMSALIQS    71
             Q + F FFGGLG+FLF IKYMGDGLQ+ AG++LR   +DK+T+NP  G+L GI ++ L+Q+
Sbjct:     6 QTLLFMFFGGLGIFLFGIKYMGDGLQKVAGERLRDLLDKFTTNPLMGVLAGIVVTVLLQT    65

Query:    72 SSGVTVITVGLVSAGLLNLRQAIGIVMGANIGTTITSFLIGFKLGDYALPMIFIGAACLF   131
             S+G TV+T+GLV+AG + L+QAIG++MGANIGTT+T+F+IG K+  YALP+I +GAA +F
Sbjct:    66 STGTTVLTIGLVNAGFMTLKQAIGVIMGANIGTTVTAFIIGIKISEYALPIIAVGAALIF   125

Query:   132 FTSNKKLNNFGRIIFGVGGIFFSLNLMGDAMDPLKSVSAFQNYLATLGDKPFQGVFIGTA   191
             F   NKK+NN G++IFG G +F+ LN MG+ ++PL+  + AF     ++ + P  GV IGT
Sbjct:   126 FIKNKKVNNIGQVIFGFGTLFYGLNTMGEGLNPLRELQAFADLTVSMSENPLLGVLIGTI   185

Query:   192 LTMLIQSSAAIIGILQGLFSGGLLTLQGAIPILLGSNIGTCITAVLAAIGSNIAAKRVAA   251
             +T  +QSS+A IG+LQ L+  G + A+P+L G NIGT ITAVLAAIG+++AAKR A
Sbjct:   186 FTAAVQSSSASIGLLQQLYDQGAMDLFAALPVLFGDNIGTTITAVLAAIGASVAAKRAAL   245

Query:   252 AHVLFNLIGTIIFMIILVPFTSLMLWLQSKLSLTPEMTIAFSHGSFNITNTILLIPFISL   311
              HV+FNLIGTII +II++PFT + +L     +L    MTIAF+HG FN++NTI+ PFI +
Sbjct:   246 THVIFNLIGTIIVLIIIPFTHFIAYLAEVFALNRPMTIAFAHGIFNVSNTIIQFPPIGI   305

Query:   312 LAMIVTRLIPGEDEVVKYEALYLDRLLITQAPSIALGNAHKELVHLASYAIQAFEASYSY   371
             LA+IVT+L+PG+D  ++Y+A +LD    + +P+IALG A +E++ +A ++ +        Y
Sbjct:   306 LAIIVTKLVPGDDFYIEYKAKHLDPRFVGSSPAIALGQAKQEVLRMAEFSEKGLLEVSKY   365

Query:   372 IMTADGKFGEKVKRYERAVDTIDEELTTYLVDISNEALSPSENEVLAGILDSSRDLERIG   431
             +     K  E    ++E A++ +D ++T YL+ IS+ +LS  ++++    ++D+ RD+ERIG
Sbjct:   366 MENGQKKHAEMAVQFEDAINNLDRKITEYLISISSRSLSAQDSKMHGMLMDTVRDIERIG   425

Query:   432 DHSESLGILIEGIISKQIGFSISARQELTEMYQLTHCLTLDAIRAIVDSDTDLAQTIVTR   491
             DH E++  L +   + ++ S  A  +L EM+ LTH    +AI ++    D + A++++ +
Sbjct:   426 DHIENIVELKDYQKANKVKISEKALHDLQEMFDLTHSTLTEAIMSLETGDLEAARSVIEK   485

Query:   492 HKEIEEKERRLRKTHIKRLNCGECTAQAGINFIDIISHYTRITDHALNLAEKVL         545
                + I++  ER+LRK HI R+N G CT    AGI F+DI+S+  RI DH++N+AE V+
Sbjct:   486 EEHIDQMERKLRKQHIIRVNEGNCTGAAGIVFVDIVSNLERIGDHSVNIAEAVI         539
```

Based on this analysis, it was predicted that this GAS-specific protein and its epitopes, could be useful antigens for vaccines or diagnostics.

EXAMPLE 2850

A DNA sequence (GASx1678R) was identified in *S. pyogenes* <SEQ ID 8199> which encodes the amino acid sequence <SEQ ID 8200>. Analysis of this protein sequence reveals the following:

```
Possible site: 48
>>> Seems to have no N-terminal signal sequence
```

```
----- Final Results -----
            bacterial cytoplasm --- Certainty = 0.2940(Affirmative) < succ>
            bacterial membrane  --- Certainty = 0.0000(Not Clear)   < succ>
             bacterial outside  --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2851

A DNA sequence (GASx1685R) was identified in *S. pyogenes* <SEQ ID 8201> which encodes the amino acid sequence <SEQ ID 8202>. Analysis of this protein sequence reveals the following:

```
Possible site: 22
>>> Seems to have an uncleavable N-term signal seq
    INTEGRAL     Likelihood = -7.11     Transmembrane     13-29 (9-31)

----- Final Results -----
            bacterial membrane  --- Certainty = 0.3845(Affirmative) < succ>
             bacterial outside  --- Certainty = 0.0000(Not Clear)   < succ>
            bacterial cytoplasm --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2852

A DNA sequence (GASx1695R) was identified in *S. pyogenes* <SEQ ID 8203> which encodes the amino acid sequence <SEQ ID 8204>. Analysis of this protein sequence reveals the following:

```
Possible site: 15
>>> Seems to have no N-terminal signal sequence

----- Final Results -----
            bacterial cytoplasm --- Certainty = 0.1357(Affirmative) < succ>
            bacterial membrane  --- Certainty = 0.0000(Not Clear)   < succ>
             bacterial outside  --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2853

A DNA sequence (GASx1698) was identified in *S. pyogenes* <SEQ ID 8205> which encodes the amino acid sequence <SEQ ID 8206>. Analysis of this protein sequence reveals the following:

```
Possible site: 33
>>> Seems to have no N-terminal signal sequence

----- Final Results -----
            bacterial cytoplasm --- Certainty = 0.1970(Affirmative) < succ>
             bacterial membrane --- Certainty = 0.0000(Not Clear) < succ>
              bacterial outside --- Certainty = 0.0000(Not Clear) < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2854

A DNA sequence (GASx1713) was identified in *S. pyogenes* <SEQ ID 8207> which encodes the amino acid sequence <SEQ ID 8208>. Analysis of this protein sequence reveals the following:

```
Possible site: 44
>>> Seems to have no N-terminal signal sequence

----- Final Results -----
            bacterial cytoplasm --- Certainty = 0.3092(Affirmative) < succ>
             bacterial membrane --- Certainty = 0.0000(Not Clear) < succ>
              bacterial outside --- Certainty = 0.0000(Not Clear) < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2855

A DNA sequence (GASx1737) was identified in *S. pyogenes* <SEQ ID 8209> which encodes the amino acid sequence <SEQ ID 8210>. Analysis of this protein sequence reveals the following:

```
Possible site: 13
>>> Seems to have no N-terminal signal sequence

----- Final Results -----
            bacterial cytoplasm --- Certainty = 0.1878(Affirmative) < succ>
             bacterial membrane --- Certainty = 0.0000(Not Clear) < succ>
              bacterial outside --- Certainty = 0.0000(Not Clear) < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2856

A DNA sequence (GASx1748R) was identified in *S. pyogenes* <SEQ ID 8211> which encodes the amino acid sequence <SEQ ID 8212>. Analysis of this protein sequence reveals the following:

```
Possible site: 23
>>> Seems to have no N-terminal signal sequence

----- Final Results -----
              bacterial cytoplasm --- Certainty = 0.2841(Affirmative) < succ>
               bacterial membrane --- Certainty = 0.0000(Not Clear)   < succ>
                bacterial outside --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2857

A DNA sequence (GASx1750R) was identified in *S. pyogenes* <SEQ ID 8213> which encodes the amino acid sequence <SEQ ID 8214>. Analysis of this protein sequence reveals the following:

```
Possible site: 59
>>> Seems to have no N-terminal signal sequence
    INTEGRAL    Likelihood = -1.22    Transmembrane    18-34  (18-34)

----- Final Results -----
              bacterial membrane --- Certainty = 0.1489(Affirmative) < succ>
               bacterial outside --- Certainty = 0.0000(Not Clear)   < succ>
             bacterial cytoplasm --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2858

A DNA sequence (GASx1754) was identified in *S. pyogenes* <SEQ ID 8215> which encodes the amino acid sequence <SEQ ID 8216>. Analysis of this protein sequence reveals the following:

```
Possible site: 44
>>> Seems to have an uncleavable N-term signal seq

----- Final Results -----
               bacterial membrane --- Certainty = 0.0000(Not Clear) < succ>
                bacterial outside --- Certainty = 0.0000(Not Clear) < succ>
              bacterial cytoplasm --- Certainty = 0.0000(Not Clear) < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2859

A DNA sequence (GASx1759) was identified in *S. pyogenes* <SEQ ID 8217> which encodes the amino acid sequence <SEQ ID 8218>. Analysis of this protein sequence reveals the following:

```
Possible site: 36
>>> Seems to have no N-terminal signal sequence

----- Final Results -----
          bacterial cytoplasm --- Certainty = 0.1534(Affirmative) < succ>
          bacterial membrane  --- Certainty = 0.0000(Not Clear)   < succ>
          bacterial outside   --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2860

A DNA sequence (GASx1764R) was identified in *S. pyogenes* <SEQ ID 8219> which encodes the amino acid sequence <SEQ ID 8220>. Analysis of this protein sequence reveals the following:

```
Possible site: 29
>>> Seems to have a cleavable N-term signal seq.
     INTEGRAL    Likelihood = -6.74    Transmembrane    90-106 (87-121)
     INTEGRAL    Likelihood = -4.57    Transmembrane   210-226 (205-229)
     INTEGRAL    Likelihood = -4.19    Transmembrane    43-59 (42-62)
     INTEGRAL    Likelihood = -3.77    Transmembrane   137-153 (137-155)

----- Final Results -----
          bacterial membrane  --- Certainty = 0.3697(Affirmative) < succ>
          bacterial outside   --- Certainty = 0.0000(Not Clear)   < succ>
          bacterial cytoplasm --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2861

A DNA sequence (GASx1768R) was identified in *S. pyogenes* <SEQ ID 8221> which encodes the amino acid sequence <SEQ ID 8222>. Analysis of this protein sequence reveals the following:

```
Possible site: 17
>>> Seems to have an uncleavable N-term signal seq
```

```
        INTEGRAL    Likelihood = -12.37      Transmembrane      26-42   (17-47)
        INTEGRAL    Likelihood = -7.54       Transmembrane      53-69   (46-73)
        INTEGRAL    Likelihood = -3.29       Transmembrane     209-225 (209-225)
        INTEGRAL    Likelihood = -2.13       Transmembrane      82-98   (82-98)
        INTEGRAL    Likelihood = -1.65       Transmembrane       9-25    (9-25)
        INTEGRAL    Likelihood = -0.85       Transmembrane     117-133 (117-134)

----- Final Results -----
              bacterial membrane --- Certainty = 0.5946(Affirmative) < succ>
              bacterial outside  --- Certainty = 0.0000(Not Clear)   < succ>
              bacterial cytoplasm --- Certainty = 0.0000(Not Clear)   < succ>
```

No corresponding DNA sequence was identified in *S. agalactiae*.

The protein has homology with the following sequences in the GENPEPT database:

```
>GP: AAB84959 GB: AE000829 conserved protein [Methanobacterium
thermoautotrophicum]
Identities = 54/192 (28%), Positives = 90/192 (46%), Gaps = 6/192 (3%)

Query:    7 TKLLLLVLANACFFFRVDGFLEFIIVIFLLLLLSALNKKKLA--FKLAVVYLLMIGLSVI    64
            +KL  ++V A      F  D  L  I+ +      L++     + A  F    ++    ++ L++I
Sbjct:   32 SKLTVVVSATLLSTFISDLTLLIIMGVIFTALIAHSGSLRFAAPFLSFIILFWLVSLAII    91

Query:   65 PLSIFPSYLDHLLSFVSIAGRLVFPSLLAGLITIKTTTIYELVHGLRKWRFPEVWLLTLA   124
                +  S    H + F+S+        F     AGL      TT    +L    LR    R P     + TL
Sbjct:   92 MVL---SGNPHTMGFLSLFFARFFIISAAGLSFAFTTEPQKLAESLRSVRIPGEIVFTLT   148

Query:  125 VMCRFIPMIRQECCVIHRSLKIRGIILTKWSILIRPKQYLEYLMVPLLLSLIRSSQELTI   184
              V   R+IP +   E      I    SLK+R     L+   SI+  RP          L++P+++    ++ S E+  I
Sbjct:  149 VALRYIPALAVEASSIWDSLKLR-TSLSGSSIIRRPSLLYRGLIIPMIIRTVKISDEVAI   207

Query:  185 ASLTKGLAVNKG                                                  196
            A+   T+G    +G
Sbjct:  208 AAETRGFNPREG                                                  219
```

Based on this analysis, it was predicted that this GAS-specific protein and its epitopes, could be useful antigens for vaccines or diagnostics.

EXAMPLE 2862

A DNA sequence (GASx1769R) was identified in *S. pyogenes* <SEQ ID 8223> which encodes the amino acid sequence <SEQ ID 8224>. Analysis of this protein sequence reveals the following:

```
Possible site: 16
>>> Seems to have a cleavable N-term signal seq.
        INTEGRAL    Likelihood = -7.32       Transmembrane     164-180 (158-186)
        INTEGRAL    Likelihood = -4.67       Transmembrane      85-101  (84-105)
        INTEGRAL    Likelihood = -3.03       Transmembrane      42-58   (42-61)
        INTEGRAL    Likelihood = -2.76       Transmembrane     118-134 (117-134)
        INTEGRAL    Likelihood = -2.07       Transmembrane      64-80   (64-82)
        INTEGRAL    Likelihood = -1.22       Transmembrane      18-34   (17-34)

----- Final Results -----
              bacterial membrane --- Certainty = 0.3930(Affirmative) < succ>
              bacterial outside  --- Certainty = 0.0000(Not Clear)   < succ>
              bacterial cytoplasm --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2863

A DNA sequence (GASx1776R) was identified in *S. pyogenes* <SEQ ID 8225> which encodes the amino acid sequence <SEQ ID 8226>. Analysis of this protein sequence reveals the following:

```
Possible site: 21
>>> Seems to have an uncleavable N-term signal seq
    INTEGRAL    Likelihood = -6.37    Transmembrane    4-20 (1-22)
    INTEGRAL    Likelihood = -0.43    Transmembrane    261-277 (261-278)

----- Final Results -----
             bacterial membrane --- Certainty = 0.3548(Affirmative) < succ>
              bacterial outside --- Certainty = 0.0000(Not Clear)   < succ>
            bacterial cytoplasm --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2864

A DNA sequence (GASx1777R) was identified in *S. pyogenes* <SEQ ID 8227> which encodes the amino acid sequence <SEQ ID 8228>. Analysis of this protein sequence reveals the following:

```
Possible site: 24
>>> Seems to have no N-terminal signal sequence
    INTEGRAL    Likelihood = -8.17    Transmembrane    1217-1233 (1215-1235)

----- Final Results -----
             bacterial membrane --- Certainty = 0.4270(Affirmative) < succ>
              bacterial outside --- Certainty = 0.0000(Not Clear)   < succ>
            bacterial cytoplasm --- Certainty = 0.0000(Not Clear)   < succ>
```

No corresponding DNA sequence was identified in *S. agalactiae*.

The protein has homology with the following sequences in the GENPEPT database:

```
>GP: AAF53254 GB: AE003639 CG16974 gene product
[Drosophila melanogaster]
Identities = 84/238 (35%), Positives = 133/238 (55%),
Gaps = 10/238 (4%)

Query: 516 LRLDHYELTDISLL--KHAKNITELHLDGNQITEIPKELFSQMKQLRFLNLRSNHLTYLD  573
           L +     L++ SLL  ++ K + ELHLD +++T +P+    ++ +LR LNL  N LT L
Sbjct: 232 LEMSGNRLSNCSLLNLQYMKQLQELHLDRSELTYLPQRFLGELSELRMLNLSQNLLTELP  291

Query: 574 KDTFKSNAQLRELYLSSNFIHSLEGGLFQSLHHLEQLDLSKNRIGRLCDNPFEGLSRLTS  633
           +D F    +L  LYLS N +  L    LFQ+    L+ LDLS NR+     DN F   +L
Sbjct: 292 RDIFVGALKLERLYLSGNRLSVLPFMLFQTAADLQVLDLSDNRLLSFPDNFFARNGQLRQ  351

Query: 634 LGFAENSLEEIPEKALEPLTSLNFIDLSQNNLALLP-KTIEKLRALSTIVASRNHITRID  692
           L    N L+ I + +L  L   +DLSQN+L+++    K   EL    L  +   S N++T +
Sbjct: 352 LHLQRNQLKSIGKHSLYSLRELRQLDLSQNSLSVIDRKAFESLDHLLALNVSGNNLTLLS  411

Query: 693 NISFKNLPKLSVLDLSTNEISNLPNGIFKQNNQL-------TKLDFFNNLLTQVEESV    743
           +I F++L   L  LDLS N+    LP+G+F++     L         T ++ F+N +++ +ES+
Sbjct: 412 SIIFQSLHALRQLDLSRNQFKQLPSGLFQRQRSLVLLRIDETPIEQFSNWISRYDESL    469
```

Based on this analysis, it was predicted that this GAS-specific protein and its epitopes, could be useful antigens for vaccines or diagnostics.

EXAMPLE 2865

A DNA sequence (GASx1778R) was identified in *S. pyogenes* <SEQ ID 8229> which encodes the amino acid sequence <SEQ ID 8230>. Analysis of this protein sequence reveals the following:

```
Possible site: 39
>>> Seems to have no N-terminal signal sequence

----- Final Results -----
            bacterial cytoplasm --- Certainty = 0.1067(Affirmative) < succ>
             bacterial membrane --- Certainty = 0.0000(Not Clear)   < succ>
              bacterial outside --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2866

A DNA sequence (GASx1779) was identified in *S. pyogenes* <SEQ ID 8231> which encodes the amino acid sequence <SEQ ID 8232>. Analysis of this protein sequence reveals the following:

```
Possible site: 17
>>> Seems to have no N-terminal signal sequence

----- Final Results -----
            bacterial cytoplasm --- Certainty = 0.1885(Affirmative) < succ>
             bacterial membrane --- Certainty = 0.0000(Not Clear)   < succ>
              bacterial outside --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2867

A DNA sequence (GASx1786R) was identified in *S. pyogenes* <SEQ ID 8233> which encodes the amino acid sequence <SEQ ID 8234>. Analysis of this protein sequence reveals the following:

```
Possible site: 19
>>> Seems to have no N-terminal signal sequence

----- Final Results -----
            bacterial cytoplasm --- Certainty = 0.0612(Affirmative) < succ>
             bacterial membrane --- Certainty = 0.0000(Not Clear)   < succ>
              bacterial outside --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2868

A DNA sequence (GASx1790) was identified in *S. pyogenes* <SEQ ID 8235> which encodes the amino acid sequence <SEQ ID 8236>. Analysis of this protein sequence reveals the following:

```
Possible site: 13
>>> Seems to have a cleavable N-term signal seq.

----- Final Results -----
            bacterial outside  --- Certainty = 0.3000(Affirmative) < succ>
            bacterial membrane --- Certainty = 0.0000(Not Clear)   < succ>
            bacterial cytoplasm --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2869

A DNA sequence (GASx1791R) was identified in *S. pyogenes* <SEQ ID 8237> which encodes the amino acid sequence <SEQ ID 8238>. Analysis of this protein sequence reveals the following:

```
Possible site: 43
>>> Seems to have no N-terminal signal sequence
     INTEGRAL    Likelihood = -0.90    Transmembrane    28-44 (28-44)

----- Final Results -----
            bacterial membrane  --- Certainty = 0.1362(Affirmative) < succ>
            bacterial outside   --- Certainty = 0.0000(Not Clear)   < succ>
            bacterial cytoplasm --- Certainty = 0.0000(Not Clear)   < succ>
```

A related sequence was also identified in GAS <SEQ ID 9155> which encodes the amino acid sequence <SEQ ID 9156>. Analysis of this protein sequence reveals the following:

```
Possible site: 25
>>> Seems to have a cleavable N-term signal seq.

----- Final Results -----
            bacterial outside  --- Certainty = 0.300 (Affirmative) < succ>
            bacterial membrane --- Certainty = 0.000 (Not Clear)   < succ>
            bacterial cytoplasm --- Certainty = 0.000 (Not Clear)   < succ>
```

No corresponding DNA sequence was identified in *S. agalactiae*.

The protein has homology with the following sequences in the GENPEPT database:

```
>GP: AAA24923 GB: L06331 endoglycosidase [Chryseobacterium meningosepticum]
Identities = 105/322 (32%), Positives = 153/322 (46%),
Gaps = 53/322 (16%)

Query:  106 ADKQAQELAKMKIPEKIPMKPLHGSLYGGYFRTWHDKTSDPTEKDKVNSMGELPKEVDLA  165
            A K    ++ + +    I K      + GY+RTW D     T    + SM  LP  +D+
Sbjct:   37 AQKSGVTVSAVNLSNLIAYKNSDHQISAGYYRTWRDSA---TASGNLPSMRWLPDSLDMV  93
```

```
-continued
Query: 166 FIFHDWTKDYSLFWKELATKHVPKLNKQGTRVIRTIPWRFLAGGDNSGIAEDTSKYPNTP 225
          +F D+T   + +W  L T +VP L+K+GT+VI T+       G  NS     T+
Sbjct:  94 MVFPDYTPPENAYWNTLKTNYVPYLHKRGTKVIITL------GDLNSA----TTTGGQDS 143

Query: 226 EGNKALAKAIVDEYVYKYNLDGLDVDVEHDSIPKVDKKEDTAGVERSIQVFEEIGKLIGP 285
           G  + AK I D++V +YNLDG+D+D+E          A + + +  + + K  GP
Sbjct: 144 IGYSSWAKGIYDKWVGEYNLDGIDIDIE--------SSPSGATLTKFVAATKALSKYFGP 195

Query: 286 KGVDKSRLFIMDSTYMADKNP--LIERGAPYINLLLVQVYGSQGEKGGWEPVSNRPEKTM 343
           K     + F+ D+    ++NP     + AP  N + +Q YG              R  +
Sbjct: 196 KS-GTGKTFVYDT----NQNPTNFFIQTAPRYNYVFLQAYG-------------RSTTNL 237

Query: 344 EERWQGYSKYIRPEQYMIGFSFYEENAQEGNLWYDINSRKDEDKANGINTDITGTRAERY 403
               Y+ YI  +Q++ GFSFYEEN    GN W D+  +      NG     TG RA  Y
Sbjct: 238 TTVSGLYAPYISMKQFLPGFSFYEENGYPGNYWNDVRYPQ-----NG-----TG-RAYDY 286

Query: 404 ARWQPKTGGVKGGIFSYAIDRD                                      425
           ARWQP  T G  KGG+FSYAI+RD
Sbjct: 287 ARWQPAT-GKKGGVFSYAIERD                                      307
```

Based on this analysis, it was predicted that this GAS-specific protein and its epitopes, could be useful antigens for vaccines or diagnostics.

EXAMPLE 2870

A DNA sequence (GASx1803) was identified in *S. pyogenes* <SEQ ID 8239> which encodes the amino acid sequence <SEQ ID 8240>. Analysis of this protein sequence reveals the following:

```
Possible Site: 20
>>> Seems to have no N-terminal signal sequence

----- Final Results -----
          bacterial cytoplasm --- Certainty = 0.2099 (Affirmative) < succ>
          bacterial membrane  --- Certainty = 0.0000 (Not Clear)   < succ>
          bacterial outside   --- Certainty = 0.0000 (Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2871

A DNA sequence (GASx1806R) was identified in *S. pyogenes* <SEQ ID 8241> which encodes the amino acid sequence <SEQ ID 8242>. Analysis of this protein sequence reveals the following:

```
Possible site: 54
>>> Seems to have no N-terminal signal sequence

----- Final Results -----
          bacterial cytoplasm --- Certainty = 0.2706 (Affirmative) < succ>
          bacterial membrane  --- Certainty = 0.0000 (Not Clear)   < succ>
          bacterial outside   --- Certainty = 0.0000 (Not Clear)   < succ>
```

No corresponding DNA sequence was identified in *S. agalactiae*.

The protein has homology with the following sequences in the GENPEPT database:

```
>GP: CAB16126 GB: Z99124 ribosomal protein S18 [Bacillus subtilis]
Identities = 51/77 (66%), Positives = 63/77 (81%)

Query:   1 MAQQRRGGFKRRKKVDFIAANKIEYVDYKDTELLSRFVSERGKILPRRVTGTSAKNQRKV   60
           MA  RRGG +R+KV +  +N I ++DYKD +LL +FVSERGKILPRRVTGT+AK QRK+
Sbjct:   3 MAGGRRGGRAKRRKVCYFTSNGITHIDYKDVDLLKKFVSERGKILPRRVTGTNAKYQRKL  62

Query:  61 TTAIKRARVMALMPYVN                                             77
           T AIKRAR MAL+PYV+
Sbjct:  63 TAAIKRARQMALLPYVS                                             79
```

Based on this analysis, it was predicted that this GAS-specific protein and its epitopes, could be useful antigens for vaccines or diagnostics.

EXAMPLE 2872

A DNA sequence (GASx1809R) was identified in *S. pyogenes* <SEQ ID 8243> which encodes the amino acid sequence <SEQ ID 8244>. Analysis of this protein sequence reveals the following:

```
Possible site: 60
>>> Seems to have an uncleavable N-term signal seq
INTEGRAL Likelihood = -7.59 Transmembrane 70-86 (66-92)
INTEGRAL Likelihood = -6.42 Transmembrane 13-29 (8-33)
INTEGRAL Likelihood = -5.68 Transmembrane 48-64 (43-69)

----- Final Results -----
         bacterial membrane --- Certainty = 0.4036 (Affirmative) < succ>
          bacterial outside --- Certainty = 0.0000 (Not Clear) < succ>
        bacterial cytoplasm --- Certainty = 0.0000 (Not Clear) < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2873

A DNA sequence (GASx1813R) was identified in *S. pyogenes* <SEQ ID 8245> which encodes the amino acid sequence <SEQ ID 8246>. Analysis of this protein sequence reveals the following:

```
Possible site: 56
>>> Seems to have a cleavable N-term signal seq.
INTEGRAL Likelihood = -10.51 Transmembrane 127-143 (113-147)
INTEGRAL Likelihood = -10.46 Transmembrane 151-167 (149-167)
INTEGRAL Likelihood = -4.41  Transmembrane  59-75 (57-77)

----- Final Results -----
         bacterial membrane --- Certainty = 0.5203(Affirmative) < succ>
          bacterial outside --- Certainty = 0.0000(Not Clear) < succ>
        bacterial cytoplasm --- Certainty = 0.0000(Not Clear) < succ>
```

No corresponding DNA sequence was identified in *S. agalactiae*.

The protein has homology with the following sequences in the GENPEPT database:

```
>GP: AAB98363 GB: U67490 lipoprotein B (lppB) [Methanococcus
jannaschii]
Identities = 43/143 (30%), Positives = 68/143 (47%), Gaps = 7/143 (4%)

Query:   25 LLNVLLKIITGVMY--ILYPSFLIFTLWQGMTFQLWLRLLIIPAVGFIALSYIRKRFDFP    82
            + + ++ II+    Y I   S +IF   +   +L   L +   + F +L Y+         P
Sbjct:  181 IFDAIMPIISKTAYPLIAITSLIIFIKNRKFGMKLIFALFLAFMIAF-SLKYLVNE---P   236

Query:   83 RPYEKWNIKPLIDKDTKGRSMPSRHVFSATMISMCLLRYYVYFGIVCLILSALLAICRVI   142
            RPY     +   L+   +     S PS H    A  ++  LL Y     GI+ L  + ++A   RV
Sbjct:  237 RPYLVLDNVHLLCNEGNEPSFPSGHTTLAFTLATSLLFYSKKLGILFLSWAIIVAYSRVY   296

Query:  143 AGIHYPKDVIVGYLIGLMLGLCL                                        165
            G+HYP DV+ G +IG+   G CL
Sbjct:  297 VGVHYPLDVLAGMIIGIFCG-CL                                        318
```

A related GBS gene <SEQ ID 9011> and protein <SEQ ID 9012> were also identified. Analysis of this protein sequence reveals the following:

```
Lipop: Possible site: -1 Crend: 9
McG: Discrim Score: 3.19
GvH: Signal Score (-7.5): -2.18
Possible site: 55
>>> Seems to have a cleavable N-term signal seq.
ALOM program Count: 3 value: -11.78 threshold: 0.0
INTEGRAL Likelihood = -11.78 Transmembrane 126-142 (112-147)
INTEGRAL Likelihood = -11.30 Transmembrane 150-166 (147-166)
INTEGRAL Likelihood =  -4.41 Transmembrane  58-74  (56-76)
PERIPHERAL   Likelihood        107
                         = 3.29
modified ALOM score: 2.86

*** Reasoning Step: 3

----- Final Results -----
              bacterial membrane --- Certainty = 0.5713 (Affirmative) < succ>
                bacterial outside --- Certainty = 0.0000 (Not Clear) < succ>
              bacterial cytoplasm --- Certainty = 0.0000 (Not Clear) < succ>
```

The protein has homology with the following sequences in the databases:

```
ORF01020(472-792 of 1098)
EGAD|44548|MJ0374(213-318 of 330) conserved hypothetical protein {Methanococcus
jannaschii} OMNI|MJ0374 conserved hypothetical protein SP|Q57819|Y374_METJA
HYPOTHETICAL PROTEIN MJ0374. GP|1591081|gb|AAB98363.1||U67490 lipoprotein B (lppB)
{Methanococcus jannaschii} PIR|F64346|F64346 hypothetical protein MJ0374 -
Methanococcus jannaschii
% Match = 6.8
% Identity = 30.8   % Similarity = 53.3
Matches = 33   Mismatches = 49   Conservative Sub.s = 24
    222      252      282      312      342      372      402      432
EGVTKYLRRNKHVKHFAYAPQNAGGSGATIVTLG*IMESYEQFYAKLSQPFRKSPQLIILLNFLLKIVTGMMYILYPSFL VIAWLSGIFEMHKLLFTVGTIIGRLPRFLAVAYFGDVLGNINRLSDINIYLFYLINSHYNYIFDAIMPIISKTAYPLIAI
        130      140      150      160      170      180      190
    462      492      522      552      582      612      642      672
IFTLWQGMTFQLWLRLLIIPAVGFIALSYIRKRLDFPRPYEKWNIKPLIYKDTEGRSMPSRHVFSATMISMCLLRYYVYF
          :: |:       : |:      ::     ::  ||||      :  |:   :     |||  |   ::  ||  |     :
TSLIIFIKNRKFGMKLIFALFLAFMIAFSLKYLVNEPRPYLVLDNVHLLCNEGNEPSFPSGHTTLAFTLATSLLFYSKKL
        210      220      230      240      250      260      270
    702      732      762      792      822      852      882      912
GIVCLILSVLLAICRVIAGIHYPKDVIVGYLIGLILGLCLFI*RVRSK*FQKQLDSCTIGLSLR*NGEKRWH*K*QMLHL
 || :  |   :::: |   ||    |:|||  ||:   :||:   | ||
GILFLSWAIIVAYSRVYVGVHYPLDVLAGMIIGIFCG-CLTRIDIYKLIDNI
        290      300      310      320      330
```

Based on this analysis, it was predicted that these proteins and their epitopes could be useful antigens for vaccines or diagnostics.

EXAMPLE 2874

A DNA sequence (GASx1815R) was identified in *S. pyogenes* <SEQ ID 8247> which encodes the amino acid sequence <SEQ ID 8248>. Analysis of this protein sequence reveals the following:

```
Possible site: 15
>>> Seems to have no N-terminal signal sequence

----- Final Results -----
            bacterial cytoplasm --- Certainty = 0.0888(Affirmative) < succ>
            bacterial membrane  --- Certainty = 0.0000(Not Clear)   < succ>
            bacterial outside   --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2875

A DNA sequence (GASx1825R) was identified in *S. pyogenes* <SEQ ID 8249> which encodes the amino acid sequence <SEQ ID 8250>. Analysis of this protein sequence reveals the following:

```
Possible site: 30
>>> Seems to have no N-terminal signal sequence
    INTEGRAL     Likelihood = -0.16     Transmembrane    7-23  (7-23)

----- Final Results -----
            bacterial membrane  --- Certainty = 0.1065(Affirmative) < succ>
            bacterial outside   --- Certainty = 0.0000(Not Clear)   < succ>
            bacterial cytoplasm --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2876

A DNA sequence (GASx1832) was identified in *S. pyogenes* <SEQ ID 8251> which encodes the amino acid sequence <SEQ ID 8252>. Analysis of this protein sequence reveals the following:

```
Possible site: 26
>>> Seems to have no N-terminal signal sequence

----- Final Results -----
            bacterial cytoplasm --- Certainty = 0.0918(Affirmative) < succ>
            bacterial membrane  --- Certainty = 0.0000(Not Clear)   < succ>
            bacterial outside   --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2877

A DNA sequence (GASx1836R) was identified in *S. pyogenes* <SEQ ID 8253> which encodes the amino acid sequence <SEQ ID 8254>. Analysis of this protein sequence reveals the following:

```
Possible site: 22
>>> Seems to have no N-terminal signal sequence

----- Final Results -----
            bacterial cytoplasm --- Certainty = 0.4084(Affirmative) < succ>
             bacterial membrane --- Certainty = 0.0000(Not Clear)   < succ>
              bacterial outside --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2878

A DNA sequence (GASx1864R) was identified in *S. pyogenes* <SEQ ID 8255> which encodes the amino acid sequence <SEQ ID 8256>. Analysis of this protein sequence reveals the following:

```
Possible site: 21
>>> Seems to have no N-terminal signal sequence

----- Final Results -----
            bacterial cytoplasm --- Certainty = 0.5280(Affirmative) < succ>
             bacterial membrane --- Certainty = 0.0000(Not Clear)   < succ>
              bacterial outside --- Certainty = 0.0000(Not Clear)   < succ>
```

No corresponding DNA sequence was identified in *S. agalactiae*.

The protein has homology with the following sequences in the GENPEPT database:

```
>GP: AAC36810 GB: L12244 ribosomal protein L28 [Bacillus subtilis]
Identities = 45/62 (72%), Positives = 52/62 (83%)

Query:   1 MAKVCYFTGRKTVSGNNRSHAMNQTKRTVKPNLQKVTILVDGKPKKVWASARALKSGKVE   60
           MA+ C  TG+KT +GNNRSHAMN +KRT   NLQKV ILV+GKPKK+ SARALKSGKVE
Sbjct:   1 MARKCVITGKKTTAGNNRSHAMNASKRTWGANLQKVRILVNGKPKKVYVSARALKSGKVE   60

Query:  61 RI   62
           R+
Sbjct:  61 RV   62
```

Based on this analysis, it was predicted that this GAS-specific protein and its epitopes, could be useful antigens for vaccines or diagnostics.

EXAMPLE 2879

A DNA sequence (GASx1869) was identified in *S. pyogenes* <SEQ ID 8257> which encodes the amino acid sequence <SEQ ID 8258>. Analysis of this protein sequence reveals the following:

```
Possible site: 19
>>> Seems to have no N-terminal signal sequence
```

```
----- Final Results -----
           bacterial cytoplasm --- Certainty = 0.1858(Affirmative) < succ>
           bacterial membrane --- Certainty = 0.0000(Not Clear) < succ>
            bacterial outside --- Certainty = 0.0000(Not Clear) < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2880

A DNA sequence (GASx1881) was identified in *S. pyogenes* <SEQ ID 8259> which encodes the amino acid sequence <SEQ ID 8260>. Analysis of this protein sequence reveals the following:

```
Possible site: 29
>>> Seems to have no N-terminal signal sequence

----- Final Results -----
           bacterial cytoplasm --- Certainty = 0.2752(Affirmative) < succ>
           bacterial membrane --- Certainty = 0.0000(Not Clear) < succ>
            bacterial outside --- Certainty = 0.0000(Not Clear) < succ>
RGD motif 136-138
```

No corresponding DNA sequence was identified in *S. agalactiae*.

The protein has homology with the following sequences in the GENPEPT database:

```
>GP: AAF04356 GB: AF177167 type IC restriction subunit
[Streptococcus thermophilus]
Identities = 358/1047 (34%), Positives = 571/1047 (54%),
Gaps = 91/1047 (8%)

Query:    7 TELELEKELIHLLETGESQWTYRKELKTEDALWDNFFKILAQNNTQYLNEEPLTASEKEQ    66
            +E  +E + I +L    E+QWTYR +LK+E+ALW NF    L + N    L E+PLT  E +Q
Sbjct:    4 SEQMIENQFIQILSEKENQWTYRPDLKSEEALWQNFRSHLNRINLAVLGEQPLTDKEFKQ    63

Query:   67 IKNQLNFVNY--YEAAKWLAGENGIAKVQVQREDAKLGTIRLEVVKADNVAGGTSVYEIA   124
            +K + + +      + A++WL GENG+A++ ++RED K   + LE +  +++GGTS YE+
Sbjct:   64 VKVEFSRLTGTPFLASQWLRGENGVAQILLEREDGK--RVTLEAFRNKDISGGTSSYEVV   121

Query:  125 NQVAFSGSRDRRGDVTLLINGLPMIQIELKSQNHQ--CIEAFNQVKKYDKEGQFRGIFST   182
            +QV    SR  RGDV+LLINGLP+I IELK ++ +    ++A+ Q+++Y ++G F+GI++T
Sbjct:  122 HQVVPDSSRVDRGDVSLLINGLPIIHIELKKESAKDGFMQAYYQIQRYAEDGFFKGIYAT   181

Query:  183 LQMFVVSNKTDTRYIAAAKENKLNP-----NFLTQWVDQNNKPQKDLFAFAKEVLSIPRA   237
             Q+ V+SNK DTRY A    E+         FL  W ++N+   DLF F + VL IP A
Sbjct:  182 TQIMVISNKVDTRYFARPSEDTAEAYARMKKFLFNWRTEDNQTVSDLFDFTRTVLRIPDA   241

Query:  238 HQMVMTYSVIDDDKKA---LILLRPYQIHAIEAVAEASRHRKSGYIWHTTGSGKTLTSYK   294
            H+++   Y+++ DD+K    L+ LRPYQIHAI + +    + G+IWH TGSGKT+TS+
Sbjct:  242 HELISQYTILVDDQKNQKFLMALRPYQIHAIRKIRQKAAQHEGGFIWHATGSGKTITSFV   301

Query:  295 VARNILQIP-AVEKSIFVIDRKDLDNQTASAFQSYA---------QNDIFD--VDETEDT   342
             + + Q    V++++ V+DR DLD QT    F  +A            +N + +  +  ++
Sbjct:  302 ATKLLAQNAIGVDRTVMVVDRTDLDAQTQDEFTKFASEYHTGQTTENSVANTLIVGIKNQ   361

Query:  343 RQLIKNLESS--DRRVVVTTIQKLNAMISQMESYDTPKFKKLKERLAHLNVVFVVDECHR   400
            +QL +NL SS + ++VTTIQKL+A +    +   K     E+L    ++VF+VDE HR
Sbjct:  362 KQLAQNLLSSKNNNTILVTTIQKLSAAMRSAQQESEEKGSNQFEKLRQEHIVFIVDEAHR   421

Query:  401 AVTPERQRYLTNTFRNSRWYGFTGTPIFVENKRAQLGDLAQTTEQQYGKCLHQYTVKEAI   460
            AV+  E + +      NS W+G TGTPIF ENK+ + G  A+TT QQYG  LH  YT+K A+
Sbjct:  422 AVSDEEMKRIKKILPNSTWFGLTGTPIFEENKKQENGTFARTTSQQYGPLLHSYTIKNAM   481
```

-continued

```
Query: 461 HDKAVLGFQVEYKTTIPD-------------MPEDS------IPEEAYDHEEHMLAVLD   500
           D AVLGFQVEY + I +              +P+D+      +P E Y+ +EH+  +L
Sbjct: 482 DDGAVLGFQVEYHSLISEEDQEVIVTQLNKGKLPDDALQQEKLLPTELYETDEHIRTMLQ   541

Query: 501 SIINQSR--KKLGFNNGIGQTFEGLLTVKSIARAQAYYDLMKKVKAGETDLVISKKVKEK   558
            I N+     KK     NG    T    +LT   SIA+A+   Y ++K++K    T L+  ++   E+
Sbjct: 542 KIFNRRSVVKKFKVKNGF-PTMSAILTTHSIAQAKHIYRILKEMKDNGT-LLNGRQFDER   599

Query: 559 L----PDFPKVAITYSITENDNASISRQDKMTKNLEDYNHLFGTNFTIDNLQGYNRDLND   614
               DFP+VAIT+S    +      + D++ + +++Y    F  +    D  + YN+++N
Sbjct: 600 HQLIDKDFPRVAITFSTNPDQLEKNEQDDELVEIMKEYEKQFDASPYQDE-KLYNQNINK   658

Query: 615 RLARKKDKFKDRHEQLDLVIVVDRLLTGFDAPCLSTIFIDRQPMKPQHIIQAFSRTNRIF   674
           RLARK+ +++    + LD VIVVDRLLTGFD+P + T++IDR+ M  Q ++QAFSRTNRI+
Sbjct: 659 RLARKEKQYQSDGQWLDFVIVVDRLLTGFDSPTIQTLYIDRE-MNYQKLLQAFSRTNRIY   717

Query: 675 ESRKHYGQVVTFQTPLRFKEAVDKALSLYSNGGEN-DVLAP-SWEEEKARFFEKVTVLKN   732
            + K  G +V+F+ P   +E V     L+SN  +N D L P  +EE K  F E  T+ K
Sbjct: 718 -TGKDSGLIVSFRKPFTMRENVRNTFRLFSNEKQNFDQLIPKEYEEVKKEFIECSTLYKQ   776

Query: 733 IVPDPDAFPTIESAQTAFLKQYAKAFQAFDKLFASVQVYSDFNETLLSEVGLSDEVIDTY   792
              D    P        A +  Y K  +++  L +  Q   DF E    SEV    E +  Y
Sbjct: 777 SEADLSDNPNDLKTMIAQVSAYQKLEKSYKALRSYDQYEEDFEE--FSEV---VEQLPQY   831

Query: 793 KGTYQNVIAEIRKRRED--------DEAIPEINIDYELESVQMDDINYHYILTLIQAFVD   844
           +G  +N+  +I++  ED         ++ + EI    +L +   D ++  YI  L++A
Sbjct: 832 QGKTENIKTKIKEMIEDEGHPEEDFEKLLQEIAFSSQLNATHKDVVDSFYINQLLKAIQL   891

Query: 845 QEQEALQERLNDNPMDQYIQDLAKSNPAMADSLAELWQDIQKEPKAYEGKSIVYELDNLI   904
            E  A+++   +  + Q    + K   + D L    ++I           +    + I
Sbjct: 892 NEAGAVEK--FEKEIQQKDPQIQKMYHTLKDQLVNTTEEI----------DVAQLKETSI   939

Query: 905 GDKIQRAIKHFADQWKADPDKLAFVATNYHSANSTKQVGMSTLKE-SLDYQAYKEKQGDS   963
            ++IQR ++  A+++    D L      Y S   T       L   +L  + ++ K G+
Sbjct: 940 QNEIQRQLQKEAEEFGLSFDFLQSAMNEYQSDKKTIPYLTHLLDSMTLSKEEFEAKTGE-   998

Query: 964 AMNKLKYKSQFERELVQFIRDQIQPLK                                  990
              K + +++   E +Q   +Q+Q  K
Sbjct: 999 ---KYRRRTKVLEERLQQNFEQLQKWK                                 1022
```

Based on this analysis, it was predicted that this GAS-specific protein and its epitopes, could be useful antigens for vaccines or diagnostics.

EXAMPLE 2881

A DNA sequence (GASx1882) was identified in *S. pyogenes* <SEQ ID 8261> which encodes the amino acid sequence <SEQ ID 8262>. Analysis of this protein sequence reveals the following:

```
Possible site: 39
>>> Seems to have no N-terminal signal sequence

----- Final Results -----
              bacterial cytoplasm --- Certainty = 0.3653(Affirmative) < succ>
               bacterial membrane --- Certainty = 0.0000(Not Clear) < succ>
                bacterial outside --- Certainty = 0.0000(Not Clear) < succ>
```

No corresponding DNA sequence was identified in *S. agalactiae*.

The protein has homology with the following sequences in the GENPEPT database:

```
>GP: AAB53491 GB: U35629 unknown [Lactococcus lactis subsp. lactis]
Identities = 141/241 (58%), Positives = 178/241 (73%)

Query:   3 KSKQPQYRFDGFEGEWEEKELGDIVQITMGQSPSSQNYTTNPSDYILVQGNADIKNGYVF    62
           K K P+ RF GF  EWE ++LGD V+I MGQSP+S+NYT +P+DYILVQGNAD+KNG V
Sbjct:  13 KKKVPELRFKGFTDEWELRKLGDEVRIVMGQSPNSENYTDDPNDYILVQGNADMKNGRVL    72

Query:  63 PRVWTTQITKQADKGDIILSVRAPVGDVGKTNYHVIIGRGVAAIKGNEFIFQILKYLKEI   122
           PRVWTTQ+TKQA+K D+ILSVRAPVGD+GKT Y V+IGRGVAAIKGNEFIFQ L  +K
```

```
-continued
Sbjct:   73 PRVWTTQVTKQAEKDDLILSVRAPVGDIGKTAYDVVIGRGVAAIKGNEFIFQNLGKMKSD    132

Query:  123 GYWKRISTGSTFDSISSSDIKYAKIQIPSLPEQEAIGELFQMVDQLIQLQDQKLATLKEQ    182
            GYW R STGSTF+SI+S+DIK A I +P++ EQ+ IG  F+ +D   I L  +KL  LKEQ
Sbjct:  133 GYWTRYSTGSTFESINSTDIKEAIISVPAIEEQDKIGSFFKQLDNTIALHQRKLDLLKEQ    192

Query:  183 KQTFLRKMFPAQGQKVPEIRLQGFKGEWEEKKLREVSTHRSGTAIEKYFDSEGEFKVISIG   243
            K+ FL+KMFP  G KVPE+R GF  +WEE+KL +++    +G            G++   + G
Sbjct:  193 KKGFLQKMFPKNGAKVPELRFAGFADDWEERKLGDITKISTGKLDANAMVENGKYDFYTSG   253
```

Based on this analysis, it was predicted that this GAS-specific protein and its epitopes, could be useful antigens for vaccines or diagnostics.

EXAMPLE 2882

A DNA sequence (GASx1883) was identified in *S. pyogenes* <SEQ ID 8263> which encodes the amino acid sequence <SEQ ID 8264>. Analysis of this protein sequence reveals the following:

```
Possible site: 61
>>> Seems to have no N-terminal signal sequence

----- Final Results -----
            bacterial cytoplasm --- Certainty = 0.4318(Affirmative) < succ>
             bacterial membrane --- Certainty = 0.0000(Not Clear)   < succ>
              bacterial outside --- Certainty = 0.0000(Not Clear)   < succ>
```

No corresponding DNA sequence was identified in *S. agalactiae*.

The protein has homology with the following sequences in the GENPEPT database:

```
>GP: AAF04357 GB: AF177167 type IC modification
subunit [Streptococcus thermophilus]
Identities = 293/523 (56%), Positives = 377/523 (72%),
Gaps = 6/523 (1%)

Query:    6 TSLRQALWHSADQLRGQMDANDYKNYLLGLIFYKHLSDKLLLAVCDNLEKHFNTFTEAQK    65
            TSL Q LW SAD LRG+MDA++YKNYLLGLIFYK+LSDK L   V +       +TF  E
Sbjct:    3 TSLNQQLWASADILRGKMDASEYKNYLLGLIFYKYLSDKQLREVYEQENGKTDTFPERST    62

Query:   66 I---FEDAYQDEGLKDDLISVVTGDLGYFIEPTLTFEKLIQDVYHNTFQLESLAQGFRDI   122
              +    F + Y+++  KDDLI +    GYFI+P   F      +  F L  L GF ++
Sbjct:   63 LYAGFMEWYEED--KDDLIENIQPRQGYFIQPDRLFYHYRIKADNYEFNLTDLQAGFNEL   120

Query:  123 EQSGEDFENLFEDIDLYSKKLGSTPQKQNQTISNVMKTLNEIDFEAVDGDTLGDAYEYLI   182
            E+ GE+F  LF DIDL S KLGS  Q++N TI+ V++ L+EID    +GD +GDAYEYLI
Sbjct:  121 ERQGEEFSGLFSDIDLNSTKLGSNAQQRNVTITEVLRALDEIDLFEHNGDVIGDAYEYLI   180

Query:  183 GEFASESGKKAGEFYTPQAVSHLMTQIVFLGREDQKGMTLYDPAMGSGSLLLNAKKYSNQ   242
            G FA+ +GKKAGEFYTPQAVS +M++I  +G+E +      +YDPAMGSGSL+LN ++Y
Sbjct:  181 GMFAAGAGKKAGEFYTPQAVSRIMSEITSIGQESRVPFHIYDPAMGSGSLMLNIRRYLIH   240

Query:  243 SDTVSYYGQEINTSTYNLARMNMMLHGVAIENQHLSNADTLDADWPTDEPINFDGVLMNP   302
              + V  Y+GQE+NT+T+NLARMN++LHGV  E   +L+N DTLDADWP++EP  FD V+MNP
Sbjct:  241 PNQVHYHGQELNTTTFNLARMNLILHGVDKERMNLNNGDTLDADWPSEEPYQFDSVVMNP   300

Query:  303 PYSLKWSATAGFLTDPRFSSYGVLAPKSKADFAFLLHGFYHLKNTGTMAIVLPHGVLFRG   362
            PYS KWSA   FL+DPRF +G LAPKSKADFAFLLHGFYHLK +GTM IVLPHGVLFRG
Sbjct:  301 PYSAKWSAADKFLSDPRFERFGKLAPKSKADFAFLLHGFYHLKESGTMGIVLPHGVLFRG   360

Query:  363 AAEGKIRQKLLEQGAIDTIIGLPSNIFYNTSIPTTIIILKKNRTNKDVFFIDASKEFDKG   422
            A EG IRQ LLE GAID +IGLP+NIF+ TSIPTT+IILKKNR+ +DV FIDAS++F+K
Sbjct:  361 GAEGTIRQALLEMGAIDAVIGLPANIFFGTSIPTTVIILKKNRSRRDVLFIDASQDFEKQ   420

Query:  423 KNQNTMTDNHIKKILDAYKSRDNSDKFSYLASFDEIIENDYNLNIPRYVDTFEEVPVKPL   482
            KNQN  +  D HI KI+   YK R++    ++++++ASFDEI +END+NLNIPRYVDTFEE       L
Sbjct:  421 KNQNVLLDEHIDKIVSTYKKREDIERYAHVASFDEIQENDFNLNIPRYVDTFEEEEPVDL   480

Query:  483 PELAKQLSDIDQEIAKTNAKLDQLMKQLVGTTKEAQDELDTFR                   525
                 E+   L   I++E+  +      L  L+       ++E Q   +++ R
Sbjct:  481 VEVNTNLLKINEELVQQEQTLLSLINDF-SESEENQAMIESMR                   522
```

Based on this analysis, it was predicted that this GAS-specific protein and its epitopes, could be useful antigens for vaccines or diagnostics.

EXAMPLE 2883

A DNA sequence (GASx1886R) was identified in *S. pyogenes* <SEQ ID 8265> which encodes the amino acid sequence <SEQ ID 8266>. Analysis of this protein sequence reveals the following:

```
Possible site: 59
>>> Seems to have an uncleavable N-term signal seq
      INTEGRAL    Likelihood = -8.17    Transmembrane    155-171 (147-173)
      INTEGRAL    Likelihood = -7.22    Transmembrane     14-30  (11-33)
      INTEGRAL    Likelihood = -7.17    Transmembrane    182-198 (179-205)
      INTEGRAL    Likelihood = -5.68    Transmembrane    132-148 (128-152)
      INTEGRAL    Likelihood = -4.14    Transmembrane     46-62  (43-62)
      INTEGRAL    Likelihood = -3.50    Transmembrane     73-89  (73-90)
      INTEGRAL    Likelihood = -0.96    Transmembrane     95-111 (95-111)

----- Final Results -----
            bacterial membrane --- Certainty = 0.4270(Affirmative) < succ>
             bacterial outside --- Certainty = 0.0000(Not Clear)   < succ>
           bacterial cytoplasm --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2884

A DNA sequence (GASx1890R) was identified in *S. pyogenes* <SEQ ID 8267> which encodes the amino acid sequence <SEQ ID 8268>. Analysis of this protein sequence reveals the following:

```
Possible site: 58
>>> Seems to have no N-terminal signal sequence

----- Final Results -----
           bacterial cytoplasm --- Certainty = 0.4757(Affirmative) < succ>
             bacterial membrane --- Certainty = 0.0000(Not Clear)   < succ>
              bacterial outside --- Certainty = 0.0000(Not Clear)   < succ>
RGD motif 339-341
```

No corresponding DNA sequence was identified in *S. agalactiae*.

The protein has homology with the following sequences in the GENPEPT database:

```
>GP: AAA62650 GB: L37110 clyM [Plasmid pAD1]
Identities = 127/492 (25%), Positives = 230/492 (45%),
Gaps = 30/492 (6%)

Query:  46 KLFYSEFENQLFETIMFLSMKTLVLDINHFSKEIENK----SEAYEQYIQQ-IREENGIN 100
           K F       L + ++ L+ KTLVLD++ F K    K    S+ + Y+++   + I
Sbjct: 135 KEFIINLLENLTQELIHLTSKTLVLDLHTFKKNEPLKGNDSSKRFIYYLKKRFNSKKDII 194

Query: 101 HFFDRYPYLLKQINKEVGLIEESYSLLFDRFLEDLSEIKSCFNI-SEPLSNVAFSLGDSH 159
           F+  YP L++    +    ++  + + R  EDL I++CFNI S  L++++ S GDSH
Sbjct: 195 AFYTCYPELMRITVVRMRYFLDNTKQMLIRVTEDLPSIQNCFNIQSSELNSISESQGDSH 254

Query: 160 SKKQTVVKIAFKE-KSVYYKPKSYHSHSILLELTSLLKSSNIPSFSLPKSLVKADYCWQL 218
           S+ +TV + F + K  YKPK +S + L +      L      + K + + Y ++
Sbjct: 255 SRGKTVSTLTFSDGKKIVYKPK-INSENKLRDFFEFLNKELEADIYIVKKVTRNTYFYEE 313
```

-continued

```
Query: 219 GVAYTSSNK-DEVAKIYFKYGVLAAFSEIFSITDLHMENVIVSGGDLYLIDVETFFQRKL  277
             +     N  +EV K Y +YG L    + +F++TDLH EN+I   G     +ID ETFFQ+ +
Sbjct: 314 YIDNIEINNIEEVKKYYERYGKLIGIAFLFNVTDLHYENIIAHGEYPVIIDNETFFQQNI  373

Query: 278 NVQNQNFEGITVDTYQRIYETSLSNGLFP---VQFEKNSAPNVSGISRKGGKRQKGKYEL  334
             ++  N     TVD    +  ++ +  GL P    ++ + +S       +S     K Q    +++
Sbjct: 374 PIEFGN--SATVDAKYKYLDSIMVTGLVPYLAMKDKSDSKDEGVNLSALNFKEQSVPFKI  431

Query: 335 I---NKNRGDLKLVKVDYFQEDRFNIPTLNGKVVEPLDYANEIISGFRECYIFLLSQRSK  391
            +    N     +++      +  +    N P +N + +   + Y    I++G +    +      + K
Sbjct: 432 LKIKNTFTDEMRFEYQTHIMDTAKNTPIMNNEKISFISYEKYIVTGMKSILMKAKDSKKK  491

Query: 392 IKEIV-EGFPELKSRVPFRNTSDYGKFLQASTNPKYLFS----EKKRKNLFSILYETKHI  446
            I    +         L   R    R T   Y     L+ S +P      +      EK     N+++    Y+ K +
Sbjct: 492 ILAYINNNLQNLIVRNVIRPTQRYADMLEFSYHPNCFSNAIEREKVLHNMWAYPYKNKKV  551

Query: 447 EHFIVDNEIKDLMNGDIP-YFSMDTRGNVYNSVGTLIGNLGDTTSL---FDSITILNDER  502
             H+     E   DL++GDIP +++   ++ ++   S G L+ +    ++L     + I   L DE
Sbjct: 552 VHY----EFSDLIDGDIPIFYNNISKTSLIASDGCLVEDFYQESALNRCLNKINDLCDED  607

Query: 503 LKFTCELLEIVL                                                 514
            +        LEI L
Sbjct: 608 ISIQTVWLEIAL                                                 619
```

Based on this analysis, it was predicted that this GAS-specific protein and its epitopes, could be useful antigens for vaccines or diagnostics.

EXAMPLE 2885

A DNA sequence (GASx1891R) was identified in *S. pyogenes* <SEQ ID 8269> which encodes the amino acid sequence <SEQ ID 8270>. Analysis of this protein sequence reveals the following:

```
Possible site: 40
>>> Seems to have no N-terminal signal sequence

----- Final Results -----
              bacterial cytoplasm --- Certainty = 0.3487(Affirmative) < succ>
               bacterial membrane --- Certainty = 0.0000(Not Clear) < succ>
                bacterial outside --- Certainty = 0.0000(Not Clear) < succ>
```

No corresponding DNA sequence was identified in *S. agalactiae.*

The protein has homology with the following sequences in the GENPEPT database:

```
>GP: AAA02867 GB: L07740 salivaricin
A [Streptococcus salivarius]
Identities = 46/51 (90%), Positives = 48/51 (93%)

Query: 1 MSFMKNSKDILTNAIEEVSEKELMEVAGGKKGSGWFATITDDCPNSVFVCC   51
          M+ MKNSKDIL NAIEEVSEKELMEVAGGK+GSGW ATITDDCPNSVFVCC
Sbjct: 1 MNAMKNSKDILNNAIEEVSEKELMEVAGGKRGSGWIATITDDCPNSVFVCC   51
```

Based on this analysis, it was predicted that this GAS-specific protein and its epitopes, could be useful antigens for vaccines or diagnostics.

EXAMPLE 2886

A DNA sequence (GASx1901R) was identified in *S. pyogenes* <SEQ ID 8271> which encodes the amino acid sequence <SEQ ID 8272>. Analysis of this protein sequence reveals the following:

```
Possible site: 13
>>> Seems to have no N-terminal signal sequence
     INTEGRAL     Likelihood = -1.59     Transmembrane     3-19 (1-20)
```

```
----- Final Results -----
            bacterial membrane --- Certainty = 0.1638(Affirmative) < succ>
            bacterial outside  --- Certainty = 0.0000(Not Clear)   < succ>
            bacterial cytoplasm --- Certainty = 0.0000(Not Clear)  < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2887

A DNA sequence (GASx1905R) was identified in *S. pyogenes* <SEQ ID 8273> which encodes the amino acid sequence <SEQ ID 8274>. Analysis of this protein sequence reveals the following:

```
Possible site: 25
>>> Seems to have an uncleavable N-term signal seq
     INTEGRAL    Likelihood = -0.48    Transmembrane    38-54 (37-54)

----- Final Results -----
            bacterial membrane --- Certainty = 0.1192(Affirmative) < succ>
            bacterial outside  --- Certainty = 0.0000(Not Clear)   < succ>
            bacterial cytoplasm --- Certainty = 0.0000(Not Clear)  < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2888

A DNA sequence (GASx1911R) was identified in *S. pyogenes* <SEQ ID 8275> which encodes the amino acid sequence <SEQ ID 8276>. Analysis of this protein sequence reveals the following:

```
Possible site: 30
>>> Seems to have no N-terminal signal sequence
     INTEGRAL    Likelihood = -10.40   Transmembrane     27-43 (22-48)
     INTEGRAL    Likelihood =  -9.82   Transmembrane     52-68 (50-74)
     INTEGRAL    Likelihood =  -7.27   Transmembrane    113-129 (111-134)
     INTEGRAL    Likelihood =  -1.97   Transmembrane    137-153 (135-153)

----- Final Results -----
            bacterial membrane --- Certainty = 0.5161(Affirmative) < succ>
            bacterial outside  --- Certainty = 0.0000(Not Clear)   < succ>
            bacterial cytoplasm --- Certainty = 0.0000(Not Clear)  < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2889

A DNA sequence (GASx1915R) was identified in *S. pyogenes* <SEQ ID 8277> which encodes the amino acid sequence <SEQ ID 8278>. Analysis of this protein sequence reveals the following:

```
Possible site: 31
>>> Seems to have a cleavable N-term signal seq.
    INTEGRAL    Likelihood = -10.77    Transmembrane    242-258 (238-262)

----- Final Results -----
            bacterial membrane --- Certainty = 0.5310(Affirmative) < succ>
            bacterial outside  --- Certainty = 0.0000(Not Clear)   < succ>
          bacterial cytoplasm  --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2890

A DNA sequence (GASx1918R) was identified in *S. pyogenes* <SEQ ID 8279> which encodes the amino acid sequence <SEQ ID 8280>. Analysis of this protein sequence reveals the following:

```
Possible site: 38
>>> Seems to have a cleavable N-term signal seq.
    INTEGRAL    Likelihood = -7.32    Transmembrane    40-56 (39-60)

----- Final Results -----
            bacterial membrane --- Certainty = 0.3930(Affirmative) < succ>
            bacterial outside  --- Certainty = 0.0000(Not Clear)   < succ>
          bacterial cytoplasm  --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2891

A DNA sequence (GASx1923R) was identified in *S. pyogenes* <SEQ ID 8281> which encodes the amino acid sequence <SEQ ID 8282>. Analysis of this protein sequence reveals the following:

```
Possible site: 42
>>> Seems to have an uncleavable N-term signal seq
    INTEGRAL    Likelihood = -12.26    Transmembrane    20-36 (13-42)

----- Final Results -----
             bacterial membrane --- Certainty = 0.5904(Affirmative) < succ>
             bacterial outside  --- Certainty = 0.0000(Not Clear)   < succ>
           bacterial cytoplasm  --- Certainty = 0.0000(Not Clear)   < succ>
```

No corresponding DNA sequence was identified in *S. aga-lactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2892

A DNA sequence (GASx1926) was identified in *S. pyogenes* <SEQ ID 8283> which encodes the amino acid sequence <SEQ ID 8284>. Analysis of this protein sequence reveals the following:

```
Possible site: 24
>>> Seems to have no N-terminal signal sequence

----- Final Results -----
            bacterial cytoplasm --- Certainty = 0.2322(Affirmative) < succ>
             bacterial membrane --- Certainty = 0.0000(Not Clear)   < succ>
              bacterial outside --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2893

A DNA sequence (GASx1928R) was identified in *S. pyogenes* <SEQ ID 8285> which encodes the amino acid sequence <SEQ ID 8286>. Analysis of this protein sequence reveals the following:

```
Possible site: 13
>>> Seems to have no N-terminal signal sequence

----- Final Results -----
            bacterial cytoplasm --- Certainty = 0.3395(Affirmative) < succ>
             bacterial membrane --- Certainty = 0.0000(Not Clear)   < succ>
              bacterial outside --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2894

A DNA sequence (GASx1929R) was identified in *S. pyogenes* <SEQ ID 8287> which encodes the amino acid sequence <SEQ ID 8288>. Analysis of this protein sequence reveals the following:

```
Possible site: 16
>>> Seems to have an uncleavable N-term signal seq
      INTEGRAL    Likelihood = -1.86    Transmembrane    17-33 (15-33)

----- Final Results -----
             bacterial membrane --- Certainty = 0.1744(Affirmative) < succ>
```

```
                    -continued
    bacterial outside --- Certainty = 0.0000(Not Clear) < succ>
    bacterial cytoplasm --- Certainty = 0.0000(Not Clear) < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2895

A DNA sequence (GASx1931R) was identified in *S. pyogenes* <SEQ ID 8289> which encodes the amino acid sequence <SEQ ID 8290>. Analysis of this protein sequence reveals the following:

```
Possible site: 31
>>> Seems to have no N-terminal signal sequence

----- Final Results -----
        bacterial cytoplasm --- Certainty = 0.0551(Affirmative) < succ>
         bacterial membrane --- Certainty = 0.0000(Not Clear) < succ>
          bacterial outside --- Certainty = 0.0000(Not Clear) < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2896

A DNA sequence (GASx1941R) was identified in *S. pyogenes* <SEQ ID 8291> which encodes the amino acid sequence <SEQ ID 8292>. Analysis of this protein sequence reveals the following:

```
Possible site: 16
>>> Seems to have no N-terminal signal sequence

----- Final Results -----
        bacterial cytoplasm --- Certainty = 0.2377(Affirmative) < succ>
         bacterial membrane --- Certainty = 0.0000(Not Clear) < succ>
          bacterial outside --- Certainty = 0.0000(Not Clear) < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2897

A DNA sequence (GASx1949) was identified in *S. pyogenes* <SEQ ID 8293> which encodes the amino acid sequence <SEQ ID 8294>. Analysis of this protein sequence reveals the following:

```
Possible site: 29
>>> Seems to have no N-terminal signal sequence

----- Final Results -----
            bacterial cytoplasm --- Certainty = 0.0262(Affirmative) < succ>
              bacterial membrane --- Certainty = 0.0000(Not Clear)  < succ>
               bacterial outside --- Certainty = 0.0000(Not Clear)  < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2898

A DNA sequence (GASx1951R) was identified in *S. pyogenes* <SEQ ID 8295> which encodes the amino acid sequence <SEQ ID 8296>. Analysis of this protein sequence reveals the following:

```
Possible site: 45
>>> Seems to have no N-terminal signal sequence

----- Final Results -----
            bacterial cytoplasm --- Certainty = 0.1330(Affirmative) < succ>
              bacterial membrane --- Certainty = 0.0000(Not Clear)  < succ>
               bacterial outside --- Certainty = 0.0000(Not Clear)  < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2899

A DNA sequence (GASx1953) was identified in *S. pyogenes* <SEQ ID 8297> which encodes the amino acid sequence <SEQ ID 8298>. Analysis of this protein sequence reveals the following:

```
Possible site: 15
>>> Seems to have a cleavable N-term signal seq.

----- Final Results -----
               bacterial outside --- Certainty = 0.3000(Affirmative) < succ>
              bacterial membrane --- Certainty = 0.0000(Not Clear)  < succ>
            bacterial cytoplasm --- Certainty = 0.0000(Not Clear)  < succ>
```

No corresponding DNA sequence was identified in *S. agalactiae*.

Based on this analysis, it was predicted that this GAS-specific protein and its epitopes, could be useful antigens for vaccines or diagnostics.

EXAMPLE 2900

A DNA sequence (GASx1957) was identified in *S. pyogenes* <SEQ ID 8299> which encodes the amino acid sequence <SEQ ID 8300>. Analysis of this protein sequence reveals the following:

```
Possible site: 26
>>> Seems to have no N-terminal signal sequence

----- Final Results -----
            bacterial cytoplasm --- Certainty = 0.2409(Affirmative) < succ>
             bacterial membrane --- Certainty = 0.0000(Not Clear)   < succ>
              bacterial outside --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2901

A DNA sequence (GASx1969) was identified in *S. pyogenes* <SEQ ID 8301> which encodes the amino acid sequence <SEQ ID 8302>. Analysis of this protein sequence reveals the following:

```
Possible site: 14
>>> Seems to have an uncleavable N-term signal seq
      INTEGRAL    Likelihood = -2.28     Transmembrane    7-23  (7-23)

----- Final Results -----
             bacterial membrane --- Certainty = 0.1914(Affirmative) < succ>
              bacterial outside --- Certainty = 0.0000(Not Clear)   < succ>
            bacterial cytoplasm --- Certainty = 0.0000(Not Clear)   < succ>
```

No corresponding DNA sequence was identified in *S. agalactiae*.

Based on this analysis, it was predicted that this GAS-specific protein and its epitopes, could be useful antigens for vaccines or diagnostics.

EXAMPLE 2902

A DNA sequence (GASx1971R) was identified in *S. pyogenes* <SEQ ID 8303> which encodes the amino acid sequence <SEQ ID 8304>. Analysis of this protein sequence reveals the following:

```
Possible site: 21
>>> Seems to have no N-terminal signal sequence

----- Final Results -----
            bacterial cytoplasm --- Certainty = 0.1545(Affirmative) < succ>
             bacterial membrane --- Certainty = 0.0000(Not Clear)   < succ>
              bacterial outside --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2903

A DNA sequence (GASx1973) was identified in *S. pyogenes* <SEQ ID 8305> which encodes the amino acid sequence <SEQ ID 8306>. Analysis of this protein sequence reveals the following:

```
Possible site: 49
>>> Seems to have no N-terminal signal sequence
     INTEGRAL    Likelihood = -2.44    Transmembrane    31-47 (31-48)

----- Final Results -----
              bacterial membrane --- Certainty = 0.1977(Affirmative) < succ>
               bacterial outside --- Certainty = 0.0000(Not Clear)   < succ>
             bacterial cytoplasm --- Certainty = 0.0000(Not Clear)   < succ>
```

No corresponding DNA sequence was identified in *S. agalactiae*.

The protein has homology with the following sequences in the GENPEPT database:

```
>GP: CAB51744 GB: AJ245405 speX [Streptococcus pyogenes]
Identities = 236/256 (92%), Positives = 243/256 (94%)

Query:   3 MIISFESVILKHNKIITPEKRLFMKKTKLIFSFTSIFIAIISRPVFGLEVDNNSLLRNIY   62
           MIISFESVILKHNKIITPEKRLFMKKTKLIFSFTSIFIAIISRPVFGLEVDNNSLLRNIY
Sbjct:   1 MIISFESVILKHNKIITPEKRLFMKKTKLIFSFTSIFIAIISRPVFGLEVDNNSLLRNIY   60

Query:  63 STIVYEYSDTVIDFKTSHNLVTKKLDVRDARDFFINSEMDEYAANDFKDGDKIAMFSVPF  122
           STIVYEYSD VIDFKTSHNLVTKKLDVRDARDFFINSEMDEYAANDFK GDKIA+FSVPF
Sbjct:  61 STIVYEYSDIVIDFKTSHNLVTKKLDVRDARDFFINSEMDEYAANDFKTGDKIAVFSVPF  120

Query: 123 DWNYLSEGKVIAYTYGGMTPYQEEPMSKNIPVNLWINRKQIPVPYNQISTNKTTVTAQEI  182
           DWNYLS+GKV AYTYGG+TPYQ+    K   VNLWIN KQI VPYN+ISTNKTTVTAQEI
Sbjct: 121 DWNYLSKGKVTAYTYGGITPYQKLQYLKISLVNLWINGKQISVPYNEISTNKTTVTAQEI  180

Query: 183 DLKVRKFLISQHQLYSSGSSYKSGKLVFHTNDNSDKYSLDLFYVGYRDKESIFKVYKDNK  242
           DLKVRKFLI+QHQLYSSGSSYKSG+LVFHTNDNSDKYS DLFYVGYRDKESIFKVYKDNK
Sbjct: 181 DLKVRKFLIAQHQLYSSGSSYKSGRLVFHTNDNSDKYSFDLFYVGYRDKESIFKVYKDNK  240

Query: 243 SFNIDKIGHLDIEIDS                                              258
           SFNIDKIGHLDIEIDS
Sbjct: 241 SFNIDKIGHLDIEIDS                                              256
```

Based on this analysis, it was predicted that this GAS-specific protein and its epitopes, could be useful antigens for vaccines or diagnostics.

EXAMPLE 2904

A DNA sequence (GASx1974R) was identified in *S. pyogenes* <SEQ ID 8307> which encodes the amino acid sequence <SEQ ID 8308>. Analysis of this protein sequence reveals the following:

```
Possible site: 53
>>> Seems to have no N-terminal signal sequence

----- Final Results -----
             bacterial cytoplasm --- Certainty = 0.2022(Affirmative) < succ>
              bacterial membrane --- Certainty = 0.0000(Not Clear)   < succ>
               bacterial outside --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2905

A DNA sequence (GASx1983) was identified in *S. pyogenes* <SEQ ID 8309> which encodes the amino acid sequence <SEQ ID 8310>. Analysis of this protein sequence reveals the following:

```
Possible site: 14
>>> Seems to have no N-terminal signal sequence

----- Final Results -----
            bacterial cytoplasm --- Certainty = 0.0989(Affirmative) < succ>
             bacterial membrane --- Certainty = 0.0000(Not Clear)   < succ>
              bacterial outside --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2906

A DNA sequence (GASx1987) was identified in S-pyogenes <SEQ ID 8311> which encodes the amino acid sequence <SEQ ID 8312>. Analysis of this protein sequence reveals the following:

```
Possible site: 34
>>> Seems to have no N-terminal signal sequence

----- Final Results -----
            bacterial cytoplasm --- Certainty = 0.2389(Affirmative) < succ>
             bacterial membrane --- Certainty = 0.0000(Not Clear)   < succ>
              bacterial outside --- Certainty = 0.0000(Not Clear)   < succ>
```

No corresponding DNA sequence was identified in *S. agalactiae*.

Based on this analysis, it was predicted that this GAS-specific protein and its epitopes, could be useful antigens for vaccines or diagnostics.

EXAMPLE 2907

A DNA sequence (GASx1988) was identified in *S. pyogenes* <SEQ ID 8313> which encodes the amino acid sequence <SEQ ID 8314>. Analysis of this protein sequence reveals the following:

```
Possible site: 48
>>> Seems to have no N-terminal signal sequence

----- Final Results -----
            bacterial cytoplasm --- Certainty = 0.5904(Affirmative) < succ>
             bacterial membrane --- Certainty = 0.0000(Not Clear)   < succ>
              bacterial outside --- Certainty = 0.0000(Not Clear)   < succ>
```

No corresponding DNA sequence was identified in *S. agalactiae*.

The protein has homology with the following sequences in the GENPEPT database:

```
>GP: BAB16031 GB: AB030747 transposase
[Streptococcus pyogenes]
Identities = 22/24 (91%), Positives = 23/24 (95%)

Query:    1  LERLFGTAKEYHNLCYTREKGKSK    24
                 +ERLFGTAKEYHNL YTREKGKSK
    Sbjct:  399  IERLFGTAKEYHNLRYTREKGKSK   422
```

Based on this analysis, it was predicted that this GAS-specific protein and its epitopes, could be useful antigens for vaccines or diagnostics.

EXAMPLE 2908

A DNA sequence (GASx1990R) was identified in *S. pyogenes* <SEQ ID 8315> which encodes the amino acid sequence <SEQ ID 8316>. Analysis of this protein sequence reveals the following:

```
Possible site: 32
>>> Seems to have a cleavable N-term signal seq.

----- Final Results -----
             bacterial outside --- Certainty = 0.3000(Affirmative) < succ>
             bacterial membrane --- Certainty = 0.0000(Not Clear) < succ>
             bacterial cytoplasm --- Certainty = 0.0000(Not Clear) < succ>
```

No corresponding DNA sequence was identified in *S. agalactiae*.

Based on this analysis, it was predicted that this GAS-specific protein and its epitopes, could be useful antigens for vaccines or diagnostics.

EXAMPLE 2909

A DNA sequence (GASx1991) was identified in *S. pyogenes* <SEQ ID 8317> which encodes the amino acid sequence <SEQ ID 8318>. Analysis of this protein sequence reveals the following:

```
Possible site: 53
>>> Seems to have an uncleavable N-term signal seq
     INTEGRAL    Likelihood = -0.16    Transmembrane    2-18 (1-18)

----- Final Results -----
             bacterial membrane --- Certainty = 0.1065(Affirmative) < succ>
             bacterial outside --- Certainty = 0.0000(Not Clear) < succ>
             bacterial cytoplasm --- Certainty = 0.0000(Not Clear) < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2910

A DNA sequence (GASx1994) was identified in *S. pyogenes* <SEQ ID 8319> which encodes the amino acid sequence <SEQ ID 8320>. Analysis of this protein sequence reveals the following:

```
Possible site: 40
>>> Seems to have no N-terminal signal sequence
     INTEGRAL    Likelihood = -1.44    Transmembrane    28-44 (28-44)

----- Final Results -----
             bacterial membrane --- Certainty = 0.1574(Affirmative) < succ>
             bacterial outside --- Certainty = 0.0000(Not Clear) < succ>
             bacterial cytoplasm --- Certainty = 0.0000(Not Clear) < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2911

A DNA sequence (GASx1996) was identified in *S. pyogenes* <SEQ ID 8321> which encodes the amino acid sequence <SEQ ID 8322>. Analysis of this protein sequence reveals the following:

```
Possible site: 13
>>> Seems to have no N-terminal signal sequence

----- Final Results -----
            bacterial cytoplasm --- Certainty = 0.1076(Affirmative) < succ>
            bacterial membrane  --- Certainty = 0.0000(Not Clear)   < succ>
             bacterial outside  --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2912

A DNA sequence (GASx1997R) was identified in *S. pyogenes* <SEQ ID 8323> which encodes the amino acid sequence <SEQ ID 8324>. Analysis of this protein sequence reveals the following:

```
Possible site: 61
>>> Seems to have no N-terminal signal sequence
    INTEGRAL    Likelihood = -7.96     Transmembrane    53-69 (49-75)
    INTEGRAL    Likelihood = -2.34     Transmembrane    24-40 (24-43)

----- Final Results -----
             bacterial membrane  --- Certainty = 0.4185(Affirmative) < succ>
              bacterial outside  --- Certainty = 0.0000(Not Clear)   < succ>
            bacterial cytoplasm  --- Certainty = 0.0000(Not Clear)   < succ>
```

No corresponding DNA sequence was identified in *S. agalactiae*.

Based on this analysis, it was predicted that this GAS-specific protein and its epitopes, could be useful antigens for vaccines or diagnostics.

EXAMPLE 2913

A DNA sequence (GASx2007R) was identified in *S. pyogenes* <SEQ ID 8325> which encodes the amino acid sequence <SEQ ID 8326>. Analysis of this protein sequence reveals the following:

```
Possible site: 55
>>> Seems to have no N-terminal signal sequence
     INTEGRAL     Likelihood = -6.64      Transmembrane    46-62 (43-65)

----- Final Results -----
             bacterial membrane  --- Certainty = 0.3654(Affirmative) < succ>
              bacterial outside  --- Certainty = 0.0000(Not Clear)   < succ>
            bacterial cytoplasm  --- Certainty = 0.0000(Not Clear)   < succ>
```

No corresponding DNA sequence was identified in *S. agalactiae*.

The protein has homology with the following sequences in the GENPEPT database:

```
>GP: AAB97959 GB: U96166 ATP-binding cassette lipoprotein
[Streptococcus cristatus]
Identities = 37/60 (61%), Positives = 42/60 (69%), Gaps = 1/60 (1%)

Query: 59 FLTACGTKKDSKKEEVKEIKMSDIKDDAVSKKTKVVDGEEVTEYTTKDGNVIQIPAGNEE 118
          FL ACG+K    KE + + K  D K DAV +KTK VDG+EVTEYT  DGNVIQIPA  EE
Sbjct: 12 FLAACGSKNADNKE-ISDGKKVDFKKDAVDQKTKTVDGKEVTEYTMPDGNVIQIPADGEE 70
```

Based on this analysis, it was predicted that this GAS-specific protein and its epitopes, could be useful antigens for vaccines or diagnostics.

EXAMPLE 2914

A DNA sequence (GASx2009) was identified in *S. pyogenes* <SEQ ID 8327> which encodes the amino acid sequence <SEQ ID 8328>. Analysis of this protein sequence reveals the following:

```
Possible site: 41
>>> Seems to have no N-terminal signal sequence

----- Final Results -----
          bacterial cytoplasm --- Certainty = 0.1246(Affirmative) < succ>
          bacterial membrane  --- Certainty = 0.0000(Not Clear)   < succ>
          bacterial outside   --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2915

A DNA sequence (GASx2010) was identified in *S. pyogenes* <SEQ ID 8329> which encodes the amino acid sequence <SEQ ID 8330>. Analysis of this protein sequence reveals the following:

```
Possible site: 17
>>> Seems to have no N-terminal signal sequence

----- Final Results -----
          bacterial cytoplasm --- Certainty = 0.2549(Affirmative) < succ>
          bacterial membrane  --- Certainty = 0.0000(Not Clear)   < succ>
          bacterial outside   --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2916

A DNA sequence (GASx2012R) was identified in *S. pyogenes* <SEQ ID 8331> which encodes the amino acid sequence <SEQ ID 8332>. Analysis of this protein sequence reveals the following:

```
Possible site: 28
>>> Seems to have no N-terminal signal sequence

----- Final Results -----
            bacterial cytoplasm --- Certainty = 0.3307(Affirmative) < succ>
             bacterial membrane --- Certainty = 0.0000(Not Clear)   < succ>
              bacterial outside --- Certainty = 0.0000(Not Clear)   < succ>
```

No corresponding DNA sequence was identified in *S. agalactiae*.

The protein has homology with the following sequences in the GENPEPT database:

```
>GP: AAA27007 GB: L26141 pyrogenic exotoxin B [Streptococcus pyogenes]
Identities = 40/102 (39%), Positives = 57/102 (55%), Gaps = 7/102 (6%)

Query:   2 EMHFVRTEPEARRIAETFCAENTQTKTPMRVQQLSYPSDTDHSGGEL-----YIYALSPA     56
           + +F R E EA+  A TF ++    K   R  +      D  + GGEL     YIY +S
Sbjct:  28 DQNFARNEKEAKDSAITFIQKSAAIKAGARSAE-DIKLDKVNLGGELSGSNMYIYNISTG    86

Query:  57 GFIIVSGDTRAHTILGYSFDNNLDLN-HDNVRSMIEAYQKQI                     97
           GF+IVSGD R+   ILGYS   + D+N  +N+ S +E+Y +QI
Sbjct:  87 GFVIVSGDKRSPEILGYSTSGSFDVNGKENIASFMESYVEQI                    128
```

Based on this analysis, it was predicted that this GAS-specific protein and its epitopes, could be useful antigens for vaccines or diagnostics.

EXAMPLE 2917

A DNA sequence (GASx2013R) was identified in *S. pyogenes* <SEQ ID 8333> which encodes the amino acid sequence <SEQ ID 8334>. Analysis of this protein sequence reveals the following:

```
Possible site: 22
>>> Seems to have a cleavable N-term signal seq.

----- Final Results -----
              bacterial outside --- Certainty = 0.3000(Affirmative) < succ>
             bacterial membrane --- Certainty = 0.0000(Not Clear)   < succ>
            bacterial cytoplasm --- Certainty = 0.0000(Not Clear)   < succ>
```

No corresponding DNA sequence was identified in *S. agalactiae*.

Based on this analysis, it was predicted that this GAS-specific protein and its epitopes, could be useful antigens for vaccines or diagnostics.

EXAMPLE 2918

A DNA sequence (GASx2014R) was identified in *S. pyogenes* <SEQ ID 8335> which encodes the amino acid sequence <SEQ ID 8336>. Analysis of this protein sequence reveals the following:

```
Possible site: 44
>>> Seems to have no N-terminal signal sequence

----- Final Results -----
            bacterial cytoplasm --- Certainty = 0.1392(Affirmative) < succ>
             bacterial membrane --- Certainty = 0.0000(Not Clear)   < succ>
              bacterial outside --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2919

A DNA sequence (GASx2015) was identified in *S. pyogenes* <SEQ ID 8337> which encodes the amino acid sequence <SEQ ID 8338>. Analysis of this protein sequence reveals the following:

```
Possible site: 35
>>> Seems to have an uncleavable N-term signal seq
    INTEGRAL    Likelihood = -1.75    Transmembrane    18-34 (17-37)

----- Final Results -----
            bacterial membrane --- Certainty = 0.1702(Affirmative) < succ>
            bacterial outside  --- Certainty = 0.0000(Not Clear)   < succ>
            bacterial cytoplasm --- Certainty = 0.0000(Not Clear)  < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2920

A DNA sequence (GASx2018) was identified in *S. pyogenes* <SEQ ID 8339> which encodes the amino acid sequence <SEQ ID 8340>. Analysis of this protein sequence reveals the following:

```
Possible site: 29
>>> Seems to have no N-terminal signal sequence
    INTEGRAL    Likelihood = -5.84    Transmembrane    23-39 (22-40)

----- Final Results -----
            bacterial membrane --- Certainty = 0.3336(Affirmative) < succ>
            bacterial outside  --- Certainty = 0.0000(Not Clear)   < succ>
            bacterial cytoplasm --- Certainty = 0.0000(Not Clear)  < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2921

A DNA sequence (GASx2019) was identified in *S. pyogenes* <SEQ ID 8341> which encodes the amino acid sequence <SEQ ID 8342>. Analysis of this protein sequence reveals the following:

```
Possible site: 26
>>> Seems to have no N-terminal signal sequence

----- Final Results -----
            bacterial cytoplasm --- Certainty = 0.0669(Affirmative) < succ>
            bacterial membrane  --- Certainty = 0.0000(Not Clear)   < succ>
            bacterial outside   --- Certainty = 0.0000(Not Clear)   < succ>
```

No corresponding DNA sequence was identified in *S. agalactiae*.

The protein has homology with the following sequences in the GENPEPT database:

```
>GP: AAC98898 GB: AW023179 low temperature requirement C protein
[Listeria monocytogenes]
Identities = 95/144 (65%), Positives = 117/144 (80%)

Query:   15 LAERGVSLEAIAELVLFLQNDYIPNLTMAECLESVEAVLAKREVQNAIITGVELDKLAEA   74
            L ERGV ++ IAELVLFLQ  Y P L +  C ++VE VL KREVQNA++TG++LD +AE
Sbjct:   16 LIERGVEIDDIAELVLFLQQKYHPGLELDICRQNVEHVLRKREVQNAVLTGIQLDVMAEK  75

Query:   75 NQLSEPLLSILKTDQGLYGIDEILALSIVNLYGSIGFTNYGYLDKTKPGIVDKLNHKDGY  134
            +L +PL +I+  D+GLYG+DEILALSIVN+YGSIGFTNYGY+DK KPGI+ KLN  DG
Sbjct:   76 GELVQPLQNIISADEGLYGVDEILALSIVNVYGSIGFTNYGYIDKVKPGILAKLNEHDGI 135

Query:  135 SCHTFLDDIVSAIAAAAASRIAHN                                     158
            + HTFLDDIV AIAAAAASR+AH+
Sbjct:  136 AVHTFLDDIVGAIAAAAASRLAHS                                     159
```

Based on this analysis, it was predicted that this GAS-specific protein and its epitopes, could be useful antigens for vaccines or diagnostics.

EXAMPLE 2922

A DNA sequence (GASx2030) was identified in *S. pyogenes* <SEQ ID 8343> which encodes the amino acid sequence <SEQ ID 8344>. Analysis of this protein sequence reveals the following:

```
Possible site: 18
>>> Seems to have no N-terminal signal sequence

----- Final Results -----
           bacterial cytoplasm --- Certainty = 0.0320(Affirmative) < succ>
           bacterial membrane  --- Certainty = 0.0000(Not Clear)  < succ>
            bacterial outside  --- Certainty = 0.0000(Not Clear)  < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2923

A DNA sequence (GASx2031) was identified in *S. pyogenes* <SEQ ID 8345> which encodes the amino acid sequence <SEQ ID 8346>. Analysis of this protein sequence reveals the following:

```
Possible site: 24
>>> Seems to have no N-terminal signal sequence

----- Final Results -----
           bacterial cytoplasm --- Certainty = 0.0583(Affirmative) < succ>
           bacterial membrane  --- Certainty = 0.0000(Not Clear)  < succ>
            bacterial outside  --- Certainty = 0.0000(Not Clear)  < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2924

A DNA sequence (GASx2032R) was identified in *S. pyogenes* <SEQ ID 8347> which encodes the amino acid sequence <SEQ ID 8348>. Analysis of this protein sequence reveals the following:

```
Possible site: 53
>>> Seems to have no N-terminal signal sequence
     INTEGRAL     Likelihood = -2.76     Transmembrane     27-43 (26-43)

----- Final Results -----
                bacterial membrane --- Certainty = 0.2105(Affirmative) < succ>
                 bacterial outside --- Certainty = 0.0000(Not Clear)  < succ>
               bacterial cytoplasm --- Certainty = 0.0000(Not Clear)  < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

A related GBS gene <SEQ ID 8467> and protein <SEQ ID 8468> were also identified. Analysis of this protein sequence reveals the following:

```
Lipop: Possible site: -1 Crend: 10
McG: Discrim Score: -11.19
GvH: Signal Score (-7.5): -4.94
     Possible site: 49
>>> Seems to have no N-terminal signal sequence
ALOM program count: 1 value: -4.19 threshold: 0.0
    INTE- Likelihood = -4.19 Transmembrane 25-41 (25-42)
GRAL
    PERIPH-  Likelihood = 13.26 41
ERAL
 modified ALOM score: 1.34

*** Reasoning Step: 3

----- Final Results -----
                bacterial membrane --- Certainty = 0.2678 (Affirmative) < succ>
                 bacterial outside --- Certainty = 0.0000 (Not Clear)   < succ>
               bacterial cytoplasm --- Certainty = 0.0000 (Not Clear)   < succ>
```

The protein has homology with the following sequences in the databases:

```
ORF01616(304-429 of 771)
SP|O06442|SECE_STAAU(7-48 of 60) PREPROTEIN TRANSLOCASE SECE SUBUNIT.
GP|20787376|gb|AAB54017.1||U96619 SecE {Staphylococcus aureus}
% Match = 5.4
% Identity = 26.2  % Similarity = 57.1
Matches = 11   Mismatches = 18   Conservative Sub.s = 13
 99        129       159       189       219       249       279       309
RIIQIMLK*HLWRRYGTKESKPSVYRMRKPKLLNRSK*HPQANTTRSK*IL*IL*EVYNTQRNALI*RNKLQKGELIMFV
                                                                              |
                                                                        MAKKESFF
339       369       399       429       459       489       519       549
KGIFQVLRDTTWPNRKQRWKDFISILEYTVFFTIVIYIFDKLLAAGVMDLINRF***IILDRNNPNP*ILLRVFCVENNI
||:   :  |:||  ::: :|   :  ::     :||  :   |  :|
KGVKSEMEKTSWPTKEELFKYTVIVVSTVIFFLVFFYALDLGITALKNLLFG
          20        30        40        50        60
```

SEQ ID 8468 (GBS396) was expressed in *E. coli* as a GST-fusion product. SDS-PAGE analysis of total cell extract is shown in FIG. 83 (lane 9; MW 35 kDa).

GBS396-GST was purified as shown in FIG. 217, lane 8.

EXAMPLE 2925

A DNA sequence (GASx2034R) was identified in *S. pyogenes* <SEQ ID 8349> which encodes the amino acid sequence <SEQ ID 8350>. Analysis of the protein sequence reveals the following:

```
Possible site: 21
>>> Seems to have no N-terminal signal sequence
INTEGRAL Likelihood = -0.59 Transmembrane 53-69 (53-70)

----- Final Results -----
            bacterial membrane --- Certainty = 0.1235 (Affirmative) < succ>
             bacterial outside --- Certainty = 0.0000 (Not Clear)   < succ>
           bacterial cytoplasm --- Certainty = 0.0000 (Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2926

A DNA sequence (GASx2035) was identified in *S. pyogenes* <SEQ ID 8351> which encodes the amino acid sequence <SEQ ID 8352>. Analysis of this protein sequence reveals the following:

```
Possible site: 39
>>> Seems to have no N-terminal signal sequence

----- Final Results -----
           bacterial cytoplasm --- Certainty = 0.2928 (Affirmative) < succ>
            bacterial membrane --- Certainty = 0.0000 (Not Clear)   < succ>
             bacterial outside --- Certainty = 0.0000 (Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2927

A DNA sequence (GASx2042R) was identified in *S. pyogenes* <SEQ ID 8353> which encodes the amino acid sequence <SEQ ID 8354>. Analysis of this protein sequence reveals the following:

```
Possible site: 44
>>> Seems to have no N-terminal signal sequence

----- Final Results -----
           bacterial cytoplasm --- Certainty = 0.2547 (Affirmative) < succ>
            bacterial membrane --- Certainty = 0.0000 (Not Clear)   < succ>
             bacterial outside --- Certainty = 0.0000 (Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2928

A DNA sequence (GASx2043) was identified in *S. pyogenes* <SEQ ID 8355> which encodes the amino acid sequence <SEQ ID 8356>. Analysis of this protein sequence reveals the following:

```
Possible site: 26
>>> Seems to have no N-terminal signal sequence

----- Final Results -----
          bacterial cytoplasm --- Certainty = 0.3289 (Affirmative) < succ>
          bacterial membrane  --- Certainty = 0.0000 (Not Clear)   < succ>
          bacterial outside   --- Certainty = 0.0000 (Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2929

A DNA sequence (GASx2049) was identified in *S. pyogenes* <SEQ ID 8357> which encodes the amino acid sequence <SEQ ID 8358>. Analysis of this protein sequence reveals the following:

```
Possible site: 13
>>> Seems to have no N-terminal signal sequence

----- Final Results -----
          bacterial cytoplasm --- Certainty = 0.4014 (Affirmative) < succ>
          bacterial membrane  --- Certainty = 0.0000 (Not Clear)   < succ>
          bacterial outside   --- Certainty = 0.0000 (Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2930

A DNA sequence (GASx2052) was identified in *S. pyogenes* <SEQ ID 8359> which encodes the amino acid sequence <SEQ ID 8360>. Analysis of this protein sequence reveals the following:

```
Possible site: 40
>>> Seems to have a cleavable N-term signal seq.

----- Final Results -----
              bacterial outside --- Certainty = 0.3000 (Affirmative) < succ>
             bacterial membrane --- Certainty = 0.0000 (Not Clear)  < succ>
             bacterial cytoplasm --- Certainty = 0.0000 (Not Clear) < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2931

A DNA sequence (GASx2055R) was identified in *S. pyogenes* <SEQ ID 8361> which encodes the amino acid sequence <SEQ ID 8362>. Analysis of this protein sequence reveals the following:

```
Possible site: 32
>>> Seems to have no N-terminal signal sequence

----- Final Results -----
             bacterial cytoplasm --- Certainty = 0.3048 (Affirmative) < succ>
             bacterial membrane --- Certainty = 0.0000 (Not Clear)  < succ>
             bacterial outside --- Certainty = 0.0000 (Not Clear)   < succ>
```

No corresponding DNA sequence was identified in *S. agalactiae*.

The protein has homology with the following sequences in the GENPEPT database:

```
>GP: BAB05703 GB: AP001513 imidazolonepropionase
(imidazolone-5-propionate hydrolase) [Bacillus halodurans]
Identities = 203/416 (48%), Positives = 278/416 (66%), Gaps = 4/416 (0%)

Query:   11 DVLLTHFNQLFCLNDPGHPLTGQEMKKATIVEDGYIAIKDGLIVALGSGEPDAELVGTQT   70
             D LL +  QL  +  G P G+EM +  ++E  + I+DG +   +G+         Q
Sbjct:    6 DTLLVNIGQLLPMESKG-PKRGKEMSELQLLEHAALGIRDGKVAFIGTMVEADTFTANQM  64

Query:   71 IMRSYKGKIATPGIIDCHTHLVYGGSREHEFAKKLAGVSYLDILAQGGGILSTVRATRSA  130
             I    +GK+ TPG++D HTHL++GGSREHE A K  GV YL+IL  GGGIL+TV ATR+A
Sbjct:   65 I--DCQGKLVTPGLVDPHTHLIFGGSREHEMALKQQGVPYLEILKNGGGILATVEATRAA  122

Query:  131 SFDNLYQKSKRLLDYMLLHGVTTVEAKSGYGLDWETEKRQLDVVAALEKDHPIDLVSTFM  190
             S + L  K+   L+ ML +GVTT+EAKSGYGLD ETE +QL    A+ +  HPID+VSTF+
Sbjct:  123 SEEELITKAICHLNRMLSYGVTTIEAKSGYGLDRETEWKQLRAAKAVGEQHPIDIVSTFL  182

Query:  191 AAHAIPEEYKGNPKAYLDVIIKDMLPVVKEENLAEFCDIFCEKNVFTADESRYLLSKAKE  250
             A HAIP  ++ +P  +LD +  DML   +KE+NLAEF DIF E   VFT ++SR  L KAKE
Sbjct:  183 GAHAIPTSHRNDPDRFLDEMA-DMLGEIKEQNLAEFVDIFTETGVFTVEQSRTFLQKAKE  241

Query:  251 MGFKLRIHADEIASIGGVDVAAELSAVSAEHLMMITDDGIAKLIGAGVIGNLLPATTFSL  310
                GF L++HADEI  +GG ++A EL A+SA+HL+   +D GI K+    AG I   LLP TTF L
Sbjct:  242 RGFGLKLHADEIDPLGGAELAGELGAISADHLVGASDQGIQKMAAAGTIACLLPGTTFYL  301

Query:  311 MEDTYAPARKMIDAGMAITLSTDSNPGSCPTANMQFVMQLGCFMLRLTPIEVLNAVTINA  370
                 +DTYA AR MID G+A+T+STD NPGS PT N+Q +M +     L++TP E+ +AVT+N
Sbjct:  302 GKDTYARARDMIDQGLAVTISTDFNPGSSPTENLQLIMSIAALRLKMTPEEIWHAVTVNG  361

Query:  371 AYSVNRQERVGSLTVGKEADIAIFDAPNIDYPFYFFATNLIHQVYKKGQLTVDRGR      426
             A+++  R +   G L VG+ AD+ ++DA N  Y  Y +  N +H V+KKG++    +R R
Sbjct:  362 AHAIGRGDTAGQLAVGRAADVVVWDAKNYYYVPYHYGVNHVHSVWKKGEVVYERRR      417
```

Based on this analysis, it was predicted that this GAS-specific protein and its epitopes, could be useful antigens for vaccines or diagnostics.

EXAMPLE 2932

A DNA sequence (GASx2056) was identified in *S. pyogenes* <SEQ ID 8363> which encodes the amino acid sequence <SEQ ID 8364>. Analysis of this protein sequence reveals the following:

```
Possible site: 14
>>> Seems to have no N-terminal signal sequence

----- Final Results -----
            bacterial cytoplasm --- Certainty = 0.1847(Affirmative) < succ>
            bacterial membrane  --- Certainty = 0.0000(Not Clear)   < succ>
            bacterial outside   --- Certainty = 0.0000(Not Clear)   < succ>
```

No corresponding DNA sequence was identified in *S. agalactiae*.

The protein has homology with the following sequences in the GENPEPT database:

```
>GP: CAB61139 GB: AL132952 predicted using Genefinder~cDNA EST
yk155e6.3 comes from this gene~cDNA EST yk155e6.5 comes
from this gene~cDNA EST yk156d6.5 comes from this
gene~cDNA EST yk259b10.3 comes fr
Identities = 302/649 (46%), Positives = 419/649 (64%), Gaps = 17/649 (2%)

Query:   29 EGIRRAPDRGFRLTQAQTEIALKNALRYVPTKFHEEVIPEFLEELKTRGRIYGYRFRPKD   88
            + +  AP R    LTQ +  +A++NALRY+P + H  +  EF EEL T G IYGYRF P
Sbjct:   85 KNVAHAPKRPCNLTQTEKMLAVRNALRYIPKEHHVLLATEFAEELNTYGHIYGYRFMPNF  144

Query:   89 RIYGKPIDEYKGNCTAAKAMQVMIDNNLSFEIALYPYELVTYGETGSVCANWMQYCLIKK  148
            ++  P+ E   +C   A A+ +MI NNL   +A +P ELVTYG  G V +NW+Q+ L+ +
Sbjct:  145 DLFAPPVSEIGAHCEQASAIILMILNNLDKRVAQFPQELVTYGGNGQVFSNWIQFRLVLR  204

Query:  149 YLEVMTDEQTLVVESGHPVGLFKSKPEAPRVIITNGLLVGEYDNMKDWEIAEEMGVTNYG  208
            YL  MTD QTLV+ SGHP+GLF S P++PR+ +TNG+++  Y    + +    +GVT YG
Sbjct:  205 YLYTMTDHQTLVLYSGHPLGLFPSTPDSPRMTVTNGMMIPSYSTKELYDKYFALGVTQYG  264

Query:  209 QMTAGGWMYIGPQGIVHGTFNTLLNAGRLKLGVADDGDLTGKLFISSGLGGMSGAQGKAA  268
            QMTAG + YIGPQGIVHGT  T+LNAGR ++G+       L GK+F+++GLGGMSGAQ KAA
Sbjct:  265 QMTAGSFCYIGPQGIVHGTTITVLNAGR-RMGL---DSLAGKVFVTAGLGGMSGAQPKAA  320

Query:  269 EIAKAVAIIAEVDQSRIKTRHSQGWISQIAESPEEALQLAQKAIDAKESTSIAYHGNIVD  328
            +IA + +IAE+ + +  RH QGW+    ++ EE +    ++ +  KE+ SI Y GN+VD
Sbjct:  321 KIAGCIGVIAEISDTALLKRHQQGWLDVYSKDLEEIVNWIKEYREKKEAISIGYLGNVVD  380

Query:  329 LLE-YVNDKQIHVDLLSDQTSCHNVYDGGYCPVGISFDERTRLLAEDKDTFHQMVDDTLA  387
            L E   + + V+L SDQTS HN + GG+ P G++F++  +++  D   F ++V ++L
Sbjct:  381 LWERLAEEPECLVELGSDQTSLHNPFLGGFYPAGLTFEQSNQMMTSDPVKFKKLVQNSLI  440

Query:  388 RHFEAIKTLTENGTYFFDYGNAFMKSVYDSGITEISKNGRNDKDGFIWPSYVEDIMGPML  447
            R   AI +    G YF+DYGNAF+    +G   + ++ ++DK F +PSY++DIMG  +
Sbjct:  441 RQIAAIDKIAAKGMYFWDYGNAFLLECQRAGANLLREDAQDDK-SFRYPSYMQDIMGD-I  498

Query:  448 FDYGYGPFRWVCLSGNHDDLVATDKAAMEAIDPDR--------RYQDRDNYNWIRDAEKN  499
            F  G+GPFRWVC SG +DL  TD+ A + ID +            + Q  DN   WI +AEKN
Sbjct:  499 FSMGFGPFRWVCTSGKPEDLRLTDQTACKIIDELKDTDVPEYVKQQYLDNKKWIEEAEKN  558

Query:  500 QLVVGTQARILYQDCIGRVTIALKFNELVRKGKI-GPVMIGRDHHDVSGTDSPFRETSNI  558
            +LVVG+QARILY D  GRV +A  FNELV+ GK+    ++I RDHHDVSGTDSPFRETSN+
Sbjct:  559 KLVVGSQARILYSDRAGRVALASAFNELVKSGKVSAAIVISRDHHDVSGTDSPFRETSNV  618

Query:  559 KDGSNVTCDMAVQCYAGNAARGMSLVALHNGGGTGIGKAINGGFGLVLDGSERIDEIIKS  618
             DGS  T DMAVQ   G++ RG + VALHNGGG G G   INGGFG+VLDGS      +
Sbjct:  619 YDGSAFTADMAVQNCIGDSFRGATWVALHNGGGVGWGDVINGGFGIVLDGSSDAARRAEG  678

Query:  619 AIAWDTMGGVARRNWARNEHAIETAIEYNRLHAGTDHITIPYLADDDLV             667
             +   WD   GV RR+W+ N  A E AI+          +T+P  AD++L+
Sbjct:  679 MLNWDVPNGVTRRSWSGNAKAQE-AIQRAEKQVDGLRVTLPVEADEELL             726
```

Based on this analysis, it was predicted that this GAS-specific protein and its epitopes, could be useful antigens for vaccines or diagnostics.

EXAMPLE 2933

A DNA sequence (GASx2057) was identified in *S. pyogenes* <SEQ ID 8365> which encodes the amino acid sequence <SEQ ID 8366>. Analysis of this protein sequence reveals the following:

```
Possible site: 44
>>> Seems to have no N-terminal signal sequence

----- Final Results -----
            bacterial cytoplasm --- Certainty = 0.1887(Affirmative) < succ>
            bacterial membrane  --- Certainty = 0.0000(Not Clear)   < succ>
            bacterial outside   --- Certainty = 0.0000(Not Clear)   < succ>
```

No corresponding DNA sequence was identified in *S. agalactiae*.

The protein has homology with the following sequences in the GENPEPT database:

```
>GP: AAD35925 GB: AE001751
formiminotransferase-
cyclodeaminase/formiminotetrahydrofolate cyclodeaminase,
putative [Thermotoga maritima]
Identities = 160/296 (54%), Positives = 214/296 (72%), Gaps = 2/296 (0%)

Query:   3 KIVECIPNFSEGQNQAVIDGLVATAKSIPGVTLLDYSSDASHNRSVFTLVGDDQSIQEAA    62
           K++E +PNFSEG+ + V++ +VA AK     V +LD+S DA HNRSV TLVG+ +++  A
Sbjct:   2 KLIESVPNFSEGRRKEVVEKIVAEAKKYDRVWVLDWSMDADHNRSVITLVGEPENLINAL   61

Query:  63 FQLVKYASENIDMTKHHGEHPRMGATDVCPFVPIKDITTQECVEISKQVAERINRELGIP  122
           F + K A+E ID+  H G+HPRMGA DV P VP+ + T +ECVE SK +  RI  ELGIP
Sbjct:  62 FDMTKKAAELIDLRNHTGQHPRMGAADVIPLVPLYNTTMEECVEYSKILGRRIGEELGIP  121

Query: 123 IFLYEDSATRPERQNLAKVRKGQFEGMPEKLLEEDWAPDYGDRKIHPTAGVTAVGARMPL  182
           ++LYE SATRPERQNLA +RKG+FEG  EK+ +  W PD+G  ++HPTAGVTAVGAR  L
Sbjct: 122 VYLYEKSATRPERQNLADIRKGEFEGFFEKIKDPLWKPDFGPDRVHPTAGVTAVGAREFL  181

Query: 183 VAFNVNLDTDNIDIAHKIAKIIRGSGGGYKYCKAIGVMLEDRHIAQVSMNMVNFEKCSLY  242
           +AFNVNL T ++ IA KIA+ IR S GG +Y KAIGV L+ R + QVS+N+ N +K  LY
Sbjct: 182 IAFNVNLGTRDVKIAEKIARAIRFSSGGLRYVKAIGVDLKGRGVVQVSINITNHKKTPLY  241

Query: 243 RTFETIKFEARRYGVNVIGSEVIGLAPAKALIDVAEYYLQVEDFDYHKQILENHLL      298
           R FE IK  EA RYGV V+GSE++GL P ++L++    YYL+ +      K+++E++LL
Sbjct: 242 RVFELIKMEAERYGVPVLGSEIVGLFPLESLLKTVSYYLRTD--LNAKKVIESNLL      295
```

Based on this analysis, it was predicted that this GAS-specific protein and its epitopes, could be useful antigens for vaccines or diagnostics.

EXAMPLE 2934

A DNA sequence (GASx2058) was identified in *S. pyogenes* <SEQ ID 8367> which encodes the amino acid sequence <SEQ ID 8368>. Analysis of this protein sequence reveals the following:

```
Possible site: 31
>>> Seems to have no N-terminal signal sequence

----- Final Results -----
            bacterial cytoplasm --- Certainty = 0.2776(Affirmative) < succ>
            bacterial membrane  --- Certainty = 0.0000(Not Clear)   < succ>
            bacterial outside   --- Certainty = 0.0000(Not Clear)   < succ>
```

No corresponding DNA sequence was identified in S. agalactiae.

The protein has homology with the following sequences in the GENPEPT database:

```
>GP: AAA62653 GB: L33465 methenyl tetrahydrofolate cyclohydrolase
[Methylobacterium extorquens]
Identities = 79/198 (39%), Positives = 112/198 (55%)

Query:     7 SLTDFAKVLGSDAPAPGGGSAAALSGANGISLTKMVCELTLGKKKYADYQDIITEIHAKS    66
             ++  F    L S AP PGGG AAA+SGA G +L  MVC LT+GKKKY + +  + ++  KS
Sbjct:     6 TIETFLDGLASSAPTPGGGGAAAISGAMGAALVSMVCNLTIGKKKYVEVEADLMQVLEKS    65

Query:    67 TALQASLLAAIDKDTEAFNLVSAVFDMPKETDEDKAARRTAMQKALKTAAQSPFEMMTLM   126
               L+ +L    I   D EAF+ V   + +PK TDE+KAAR    +Q+ALKTA    P     +
Sbjct:    66 EGLRRTLTGMIADDVEAFDAVMGAYGLPKNTDEEKAARAAKIQEALKTATDVPLACCRVC   125

Query:   127 VEALEITATAVGKSNTNAASDLGVAALNLKAGLQGAWLNVLINLSGIKDEDFVTDYRQKG   186
               E +++       K N N  SD GVA L+   AGL+ A LNV +N  G+ D  F   +  ++
Sbjct:   126 REVIDLAEIVAEKGNLNVISDAGVAVLSAYAGLRSAALNVYVNAKGLDDRAFAEERLKEL   185

Query:   187 QALLDKGCHLADDIYTKI                                            204
               + LL +    L + IY +
Sbjct:   186 EGLLAEAGALNERIYETV                                            203
```

Based on this analysis, it was predicted that this GAS-specific protein and its epitopes, could be useful antigens for vaccines or diagnostics.

EXAMPLE 2935

A DNA sequence (GASx2061) was identified in S. pyogenes <SEQ ID 8369> which encodes the amino acid sequence <SEQ ID 8370>. Analysis of this protein sequence reveals the following:

```
Possible site: 22
>>> Seems to have no N-terminal signal sequence

----- Final Results -----
            bacterial cytoplasm --- Certainty = 0.3924(Affirmative) < succ>
            bacterial membrane  --- Certainty = 0.0000(Not Clear)   < succ>
            bacterial outside   --- Certainty = 0.0000(Not Clear)   < succ>
```

No corresponding DNA sequence was identified in S. agalactiae.

The protein has no significant homology with any sequences in the GENPEPT database.

Based on this analysis, it was predicted that this GAS-specific protein and its epitopes, could be useful antigens for vaccines or diagnostics.

EXAMPLE 2936

A DNA sequence (GASx2063) was identified in S. pyogenes <SEQ ID 8371> which encodes the amino acid sequence <SEQ ID 8372>. Analysis of this protein sequence reveals the following:

```
Possible site: 57
>>> Seems to have an uncleavable N-term signal seq
    INTEGRAL    Likelihood = -1.06    Transmembrane    231-247 (231-247)
    INTEGRAL    Likelihood = -0.53    Transmembrane    2-18   (1-18)

----- Final Results -----
            bacterial membrane  --- Certainty = 0.1426(Affirmative) < succ>
            bacterial outside   --- Certainty = 0.0000(Not Clear)   < succ>
            bacterial cytoplasm --- Certainty = 0.0000(Not Clear)   < succ>
```

No corresponding DNA sequence was identified in *S. agalactiae*.

The protein has homology with the following sequences in the GENPEPT database:

```
>GP: CAB15971 GB: Z99124 histidase [Bacillus subtilis]
Identities = 236/477 (49%), Positives = 321/477 (66%), Gaps = 2/477 (0%)

Query:   42 VINLDGESLTIEDVIAIARQGVACHIDDSAIEAVNASRKIVDDIVSEKRVVYGVTTGFGS 101
            ++ LDG SLT  DV +        + ++E V  SR  V+ IV +++ +YG+ TGFG
Sbjct:    1 MVTLDGSSLTTADVARVLFDFEEAAASEESMERVKKSRAAVERIVRDEKTIYGINTGFGK  60

Query:  102 LCNVSISPEDTVQLQENLIRTHASGFGDPLPEDAVRAIMLIRINSLVKGYSGIRLSTIEK 161
            +V I  ED+  LQ NLI +HA G GDP PE   RA++L+R N+L+KG+SG+R   IE+
Sbjct:   61 FSDVLIQKEDSAALQLNLILSHACGVGDPFPECVSRAMLLLRANALLKGFSGVRAELIEQ 120

Query:  162 LLELLNKGVHPYIPEKGSLGASGDLAPLAHMVLPMLGLGKAYYKGELLSGQEALDKAGID 221
            LL  LNK VHP IP++GSLGASGDLAPL+H+ L ++G G+ +++GE +     L KAGI
Sbjct:  121 LLAFLNKRVHPVIPQQGSLGASGDLAPLSHLALALIGQGEVFFEGERMPAMTGLKKAGIQ 180

Query:  222 KISLAAKEGLALINGTTVLTAVGALATYDAIQLLKLSDLAGALSLEVHNGITSPFEENLH 281
            ++L +KEGLALINGT +TA+G +A  +A +L  ++   +L++E    GI    F+E++H
Sbjct:  181 PVTLTSKEGLALINGTQAMTAMGVVAYIEAEKLAYQTERIASLTIEGLQGIIDAFDEDIH 240

Query:  282 TIRPQSGQLATARNIRNLLEGSQNTTVATQSRVQDPYTLRCMPQIHGASKDSIAYVKSKV 341
            R    Q+  A  IR  L  S  TT    + RVQD Y+LRC+PQ+HGA+  ++ YVK K+
Sbjct:  241 LARGYQEQIDVAERIRFYLSDSGLTTSQGELRVQDAYSLRCIPQVHGATWQTLGYVKEKL 300

Query:  342 DIEINSVTDNPIICKDG-HVISGGNFHGEPMAQPFDFLGIAISEIGNVSERRVERLVNSQ 400
            +IE+N+ TDNP+I  DG  VISGGNFHG+P+A   DFL IAISE  N++ERR+ERLVN Q
Sbjct:  301 EIEMNAATDNPLIFNDGDKVISGGNFHGQPIAFAMDFLKIAISELANIAERRIERLVNPQ 360

Query:  401 LSKLPSFLVKYPGLNSGFMITQYACASLASENKVLAHPASVDSIPSCENQEDFVSMGTTA 460
            L+  LP FL  +PGL SG MI QYA ASL SENK LAHPASVDSIPS  NQED VSMGT A
Sbjct:  361 LNDLPPFLSPHPGLQSGAMIMQYAAASLVSENKTLAHPASVDSIPSSANQEDHVSMGTIA 420

Query:  461 ARKAFEILKNSRRIVATEIMAACQALDLKPENHELGKGTKVAYDLFRKEVNFIEHDK    517
            AR A++++ N+RR++A E + A QA++ +    H     TK  +   RK V  I+ D+
Sbjct:  421 ARHAYQVIANTRRVIAIEAICALQAVEYRGIEH-AASYTKQLFQEMRKVVPSIQQDR    476
```

Based on this analysis, it was predicted that this GAS-specific protein and its epitopes, could be useful antigens for vaccines or diagnostics.

EXAMPLE 2937

A DNA sequence (GASx2064) was identified in *S. pyogenes* <SEQ ID 8373> which encodes the amino acid sequence <SEQ ID 8374>. Analysis of this protein sequence reveals the following:

```
Possible site: 44
>>> Seems to have no N-terminal signal sequence

----- Final Results -----
         bacterial cytoplasm --- Certainty = 0.4483(Affirmative) < succ>
         bacterial membrane  --- Certainty = 0.0000(Not Clear)   < succ>
          bacterial outside  --- Certainty = 0.0000(Not Clear)   < succ>
```

No corresponding DNA sequence was identified in *S. agalactiae*.

The protein has homology with the following sequences in the GENPEPT database:

```
>GP: AAG06563 GB: AE004741 probable arginase family protein
[Pseudomonas aeruginosa]
Identities = 99/275 (36%), Positives = 147/275 (53%), Gaps = 9/275 (3%)

Query:  53 LIGFKSDKGVYINNGRVGAVESPAAIRTQLAKFPWHLGNQVMVYDVGNIDGPNRSLEQLQ 112
           L+GF SD+GV  N GR GA    P A+R  LA   WH G Q +YD G+I    +  LE Q
Sbjct:  42 LLGFASDEGVRRNQGRQGARHGPPALRRALANLAWH-GEQA-IYDAGDIVAGD-DLEAAQ  98
```

-continued

```
Query: 113 NSLSKAIKRMCDLNLKPIVLGGGHETAYGHYLGLRQSLSPSDDL---AVINMDAHFDLRP 169
            ++ +  +       + + LGGGHE AY  + GL + LS  + L      ++N DAHFDLR
Sbjct:  99 ECYAQRVADLLACGHRVVGLGGGHEIAYASFAGLARHLSRHERLPRIGILNFDAHFDLRH 158

Query: 170 YDQTGPNSGTGFRQMFDDAVADKRLFKYFVLGIQEHNNNLFLFDFVAKSKGIQFLTGQDI 229
            ++   +SGT FRQ+ +   A     F Y  LGI  +N    LFD  A+   G+++L  + +
Sbjct: 159 AERA--SSGTPFRQIAELCQASDWPFAYCCLGISRLSNTAALFD-QAQRLGVRYLLDRQL 215

Query: 230 YQMGHQKVCRAIDRFLEGQERVYLTIDMDCFSVGAAPGVSAIQSLGVDPNLAVLVLQHIA 289
             ++      +D FL+  +  +YLT+ +D       APGVSA  + GV+  +    +++
Sbjct: 216 QPWNLERSEAFLDGFLQSVDHLYLTVCLDVLPAAQAPGVSAPSAHGVEMPVVEHLVRRAK 275

Query: 290 ASGKLVGFDVVEVSPPHDIDNHTANLAATFIFYLV                          324
            ASGKL    D+ E++P   D D   TA +AA  +  LV
Sbjct: 276 ASGKLRLADIAELNPQLDSDQRTARIAARLVDSLV                          310
```

Based on this analysis, it was predicted that this GAS-specific protein and its epitopes, could be useful antigens for vaccines or diagnostics.

EXAMPLE 2938

A DNA sequence (GASx2065R) was identified in *S. pyogenes* <SEQ ID 8375> which encodes the amino acid sequence <SEQ ID 8376>. Analysis of this protein sequence reveals the following:

```
Possible site: 27
>>> Seems to have no N-terminal signal sequence
     INTEGRAL      Likelihood = -0.37    Transmembrane    375-391 (375-392)

----- Final Results -----
               bacterial membrane --- Certainty = 0.1150(Affirmative) < succ>
                bacterial outside --- Certainty = 0.0000(Not Clear) < succ>
              bacterial cytoplasm --- Certainty = 0.0000(Not Clear) < succ>
```

No corresponding DNA sequence was identified in *S. agalactiae.*

The protein has homology with the following sequences in the GENPEPT database:

```
>GP: CAB37582 GB: AL035569 putative regulatory protein [Streptomyces
coelicolor A3(2)]
Identities = 95/437 (21%), Positives = 177/437 (39%), Gaps = 28/437 (6%)

Query: 271 EVGALLLIGDTGIGKRTLARQVLANQTQTFQIVTAKCFREEAMDSL--LPWRNILDGLGD  328
           E  ALLL G+ G+GK   L  +  A    +   +V       E   D L    P+    L  L
Sbjct:  95 EPQALLLGGEAGVGKTRLVEEFAAAADRRGAVVALGGCVEIGADGLPFAPFSTALRALRR  154

Query: 329 LVIQNRLLTTKAWKAALKRCFP-VATIFQEDNNQPFIKDHTSLLVSFIVDILQHLAEIKA  387
             + +          +  L R   P +A              ++   + L        +L+ +A
Sbjct: 155 HLPEELAAAAAGQEEELARLLPELAEGTPVTGGGRHDEESMARLFELTARLLERVAARHT  214

Query: 388 LVILIEDCHWMDEDSLTLLQRVMNQLVHYPIAFVLT-------KHLGTTPELGLCLNALM  440
           +V+++ED HW  D   +  L+  ++   L        +  + T          +      P L    L+ L
Sbjct: 215 VVLVLEDLHWADASTRHLIAYLLRTLRTGRLVVLATYRSDDIHRRHPLRPLLAE-LDRLR  273

Query: 441 SQGRLESICLEPFNRQESLVYINSQLGSQPVTAEEMEHLYQASQGNPFFLSEYTQALLRH  500
             +  RLE     L  F R E      I    L  +P     +++ +++ S GN FF+ E    A  R
Sbjct: 274 TVRRLE---LGRFTRDEVGRQIAGILAHEP-DQLQVDEIFERSDGNAFFVEELAVA-ARV  328

Query: 501 EKFVPLTPAIKAKLGLKLANLSSRDDALLNYLSCCRRPIPLNTLAQLMLLPLEEVIEMVD  560
                  LT +++   L +++   L           +     ++         +      LA +   L   +++IE +
Sbjct: 329 GSCTGLTDSLRDLLLVRVEALPESAQRVARIVAEGGSTVEYRLLAAVARLAEDDLIEALR  388

Query: 561 NLGHYYILVEESVGEEVLISFRQRIIQLYSYDRLSLSKRRLLHGQIAKRLEDLLPILTPS  620
           +  +  IL+     G+      FR  +++      D L    +R   L+ + A+ L D   P L P+
Sbjct: 389 SAVNANILLPAPDGDG--YRFRHSLVREAVGDDLLPGERSRLNRRYAEAL-DADPTLVPA  445

Query: 621 PHLLDDIAYHYQESRQVIKALEYNLNYLDATLPFQHELFPIYSKSIGSLEKSDRDHQRLM  680
               +   +A ++   +      KAL         LDA++   +          YS+ +   LE++         L
Sbjct: 446 AERVMRLASYWYHAHAPAKALP---AVLDASVEARRR--HAYSEQLRLLERA----MELW  496
```

```
                       -continued
Query:  681 EEQFDKIRQSIADLELT                                      697
             +   D +R ++  ++ T
Sbjct:  497 DSAPDDVRATLRPVDCT                                      513
```

Based on this analysis, it was predicted that this GAS-specific protein and its epitopes, could be useful antigens for vaccines or diagnostics.

EXAMPLE 2939

A DNA sequence (GASx2072) was identified in *S. pyogenes* <SEQ ID 8377> which encodes the amino acid sequence <SEQ ID 8378>. Analysis of this protein sequence reveals the following:

```
Possible site: 14
>>> Seems to have no N-terminal signal sequence

----- Final Results -----
            bacterial cytoplasm --- Certainty = 0.3702(Affirmative) < succ>
            bacterial membrane  --- Certainty = 0.0000(Not Clear)   < succ>
            bacterial outside   --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2940

A DNA sequence (GASx2074R) was identified in *S. pyogenes* <SEQ ID 8379> which encodes the amino acid sequence <SEQ ID 8380>. Analysis of this protein sequence reveals the following:

```
Possible site: 37
>>> Seems to have no N-terminal signal sequence
    INTEGRAL     Likelihood = -0.90     Transmembrane    21-37 (21-38)

----- Final Results -----
            bacterial membrane  --- Certainty = 0.1362(Affirmative) < succ>
            bacterial outside   --- Certainty = 0.0000(Not Clear)   < succ>
            bacterial cytoplasm --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2941

A DNA sequence (GASx2075R) was identified in *S. pyogenes* <SEQ ID 8381> which encodes the amino acid sequence <SEQ ID 8382>. Analysis of this protein sequence reveals the following:

```
Possible site: 25
>>> Seems to have no N-terminal signal sequence

----- Final Results -----
            bacterial cytoplasm --- Certainty = 0.3545(Affirmative) < succ>
```

```
            bacterial membrane --- Certainty = 0.0000(Not Clear) < succ>
            bacterial outside  --- Certainty = 0.0000(Not Clear) < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2942

A DNA sequence (GASx2076R) was identified in *S. pyogenes* <SEQ ID 8383> which encodes the amino acid sequence <SEQ ID 8384>. Analysis of this protein sequence reveals the following:

```
Possible site: 34
>>> Seems to have no N-terminal signal sequence

----- Final Results -----
            bacterial cytoplasm --- Certainty = 0.2340(Affirmative) < succ>
            bacterial membrane  --- Certainty = 0.0000(Not Clear)   < succ>
            bacterial outside   --- Certainty = 0.0000(Not Clear)   < succ>
```

No corresponding DNA sequence was identified in *S. agalactiae*.

The protein has homology with the following sequences in the GENPEPT database:

```
>GP: AAC44494 GB: U44893 orf108; unknown function [Butyrivibrio
fibrisolvens]
Identities = 42/75 (56%), Positives = 55/75 (73%)

Query:  1 LLKGTLRFGQLKSSIGSVSQKVLTAQLRAMEADGLVHREVYAEVPPRVEYSLTETGLSLA    60
          LL    RF +LK+++  +SQKVLT  LR+ME DG++ R VY EVPPRVEYSL+E G S+
Sbjct: 31 LLVRPWRFNELKNNLEGISQKVLTDSLRSMEEDGIITRTVYPEVPPRVEYSLSELGESMR   90

Query: 61 PVIEAMSDWGQTYQE    75
          P+I+AM  WG  Y+E
Sbjct: 91 PIIKAMEQWGTEYKE   105
```

Based on this analysis, it was predicted that this GAS-specific protein and its epitopes, could be useful antigens for vaccines or diagnostics.

EXAMPLE 2943

A DNA sequence (GASx2097) was identified in *S. pyogenes* <SEQ ID 8385> which encodes the amino acid sequence <SEQ ID 8386>. Analysis of this protein sequence reveals the following:

```
Possible site: 40
>>> Seems to have no N-terminal signal sequence
     INTEGRAL    Likelihood = -3.40    Transmembrane    26-42 (23-44)

----- Final Results -----
            bacterial membrane  --- Certainty = 0.2359(Affirmative) < succ>
            bacterial outside   --- Certainty = 0.0000(Not Clear)   < succ>
            bacterial cytoplasm --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2944

A DNA sequence (GASx2098) was identified in *S. pyogenes* <SEQ ID 8387> which encodes the amino acid sequence <SEQ ID 8388>. Analysis of this protein sequence reveals the following:

```
Possible site: 20
>>> Seems to have no N-terminal signal sequence

----- Final Results -----
           bacterial cytoplasm --- Certainty = 0.1385(Affirmative) < succ>
           bacterial membrane  --- Certainty = 0.0000(Not Clear)   < succ>
            bacterial outside  --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2945

A DNA sequence (GASx2100) was identified in *S. pyogenes* <SEQ ID 8389> which encodes the amino acid sequence <SEQ ID 8390>. Analysis of this protein sequence reveals the following:

```
Possible site: 23
>>> Seems to have no N-terminal signal sequence

----- Final Results -----
           bacterial cytoplasm --- Certainty = 0.2138(Affirmative) < succ>
           bacterial membrane  --- Certainty = 0.0000(Not Clear)   < succ>
            bacterial outside  --- Certainty = 0.0000(Not Clear)   < succ>
```

No corresponding DNA sequence was identified in *S. agalactiae*.

The protein has homology with the following sequences in the GENPEPT database:

```
>GP: AAA98589 GB: L44593 ORF79; putative [Lactococcus lactis phage
BK5-T]
Identities = 34/62 (54%), Positives = 44/62 (70%)

Query:   3 QITLKAARINAGYTLKQVAGAVGKNPQTISKYEKDSSDISLGLLQKLSSLYGVTIDNLFL   62
           +I LKAAR NA ++ K+VA  VGKN QTI  YEKDS++I + L  KL+ +Y   ID +FL
Sbjct:   8 KIKLKAARTNADFSAKEVAEIVGKNYQTILSYEKDSTEIPMSLAIKLAEIYDYPIDFIFL   67

Query:  63 GK                                                             64
           GK
Sbjct:  68 GK                                                             69
```

Based on this analysis, it was predicted that this GAS-specific protein and its epitopes, could be useful antigens for vaccines or diagnostics.

EXAMPLE 2946

A DNA sequence (GASx2103) was identified in *S. pyogenes* <SEQ ID 8391> which encodes the amino acid sequence <SEQ ID 8392>. Analysis of this protein sequence reveals the following:

```
Possible site: 39
>>> Seems to have no N-terminal signal sequence

----- Final Results -----
            bacterial cytoplasm --- Certainty = 0.3316(Affirmative) < succ>
            bacterial membrane  --- Certainty = 0.0000(Not Clear)   < succ>
            bacterial outside   --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2947

A DNA sequence (GASx2104) was identified in *S. pyogenes* <SEQ ID 8393> which encodes the amino acid sequence <SEQ ID 8394>. Analysis of this protein sequence reveals the following:

```
Possible site: 55
>>> Seems to have no N-terminal signal sequence

----- Final Results -----
            bacterial cytoplasm --- Certainty = 0.4371(Affirmative) < succ>
            bacterial membrane  --- Certainty = 0.0000(Not Clear)   < succ>
            bacterial outside   --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2948

A DNA sequence (GASx2105) was identified in *S. pyogenes* <SEQ ID 8395> which encodes the amino acid sequence <SEQ ID 8396>. Analysis of this protein sequence reveals the following:

```
Possible site: 40
>>> Seems to have no N-terminal signal sequence

----- Final Results -----
            bacterial cytoplasm --- Certainty = 0.2263(Affirmative) < succ>
            bacterial membrane  --- Certainty = 0.0000(Not Clear)   < succ>
            bacterial outside   --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2949

A DNA sequence (GASx2106) was identified in *S. pyogenes* <SEQ ID 8397> which encodes the amino acid sequence <SEQ ID 8398>. Analysis of this protein sequence reveals the following:

```
Possible site: 32
>>> Seems to have an uncleavable N-term signal seq
     INTEGRAL      Likelihood = -6.42      Transmembrane      9-25 (6-29)

----- Final Results -----
             bacterial membrane --- Certainty = 0.3569(Affirmative) < succ>
              bacterial outside --- Certainty = 0.0000(Not Clear)   < succ>
            bacterial cytoplasm --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2950

A DNA sequence (GASx2107) was identified in *S. pyogenes* <SEQ ID 8399> which encodes the amino acid sequence <SEQ ID 8400>. Analysis of this protein sequence reveals the following:

```
Possible site: 25
>>> Seems to have no N-terminal signal sequence

----- Final Results -----
            bacterial cytoplasm --- Certainty = 0.1355(Affirmative) < succ>
             bacterial membrane --- Certainty = 0.0000(Not Clear)   < succ>
              bacterial outside --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2951

A DNA sequence (GASx2108) was identified in *S. pyogenes* <SEQ ID 8401> which encodes the amino acid sequence <SEQ ID 8402>. Analysis of this protein sequence reveals the following:

```
Possible site: 26
>>> Seems to have no N-terminal signal sequence

----- Final Results -----
            bacterial cytoplasm --- Certainty = 0.3050(Affirmative) < succ>
```

```
            bacterial membrane --- Certainty = 0.0000(Not Clear) < succ>
            bacterial outside  --- Certainty = 0.0000(Not Clear) < succ>
```

No corresponding DNA sequence was identified in *S. aga-lactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2952

A DNA sequence (GASx2109) was identified in *S. pyogenes* <SEQ ID 8403> which encodes the amino acid sequence <SEQ ID 8404>. Analysis of this protein sequence reveals the following:

```
Possible site: 13
>>> Seems to have no N-terminal signal sequence

----- Final Results -----
            bacterial cytoplasm --- Certainty = 0.3628(Affirmative) < succ>
            bacterial membrane  --- Certainty = 0.0000(Not Clear)   < succ>
            bacterial outside   --- Certainty = 0.0000(Not Clear)   < succ>
```

No corresponding DNA sequence was identified in *S. agalactiae*.

The protein has homology with the following sequences in the GENPEPT database:

```
>GP: CAB46557 GB: AJ242479 putative replication protein
[Streptococcus thermophilus]
Identities = 143/242 (59%), Positives = 180/242 (74%),
Gaps = 2/242 (0%)

Query:   1 MAIYEARGFSSYLY--PYKGPLEPFDYIAQFRPLKPPEDIDIEEYKRTQAPYCLSGKVTA   58
           MAIYE+RGF + L+       +PF ++A FRP+K P+  DI ++KR  APYC+SG+V
Sbjct:   1 MAIYESRGFGNILHLNNSNASKDPFKFVATFRPMKVPQGEDIADFKRYHAPYCISGEVKQ   60

Query:  59 EKNGSYKRNNASLVYRDLIFLDYDEIETGVNLPKIVSQTLWEYSYIIYPTIKHTPEKPRY  118
           +++G+YKRNNASL+YRDLIFLDYD++E   + P+ VS  L  YSY+IYPTIKHT EKPRY
Sbjct:  61 DEDGNYKRNNASLLYRDLIFLDYDKLEASTDFPRAVSNALNGYSYVIYPTIKHTAEKPRY  120

Query: 119 RLVMKPSDVMTEATYKQVVKEIADKIGLPFDLASLTWSQLQGLPVTTGDPEDYQRYVNHG  178
           RLV+KP+D M E TYK   +EIADKIGLPFD +SLTWSQLQGLPVTTGDPE Y+R VN G
Sbjct: 121 RLVVKPTDKMDEQTYKATAQEIADKIGLPFDDSSLTWSQLQGLPVTTGDPEKYERIVNRG  180

Query: 179 LDYPVPKNGSTPNRQVVTTYTPRPRSQRSITMRVIDTLFNGFGNEGGRNVALTKFVGLLF  238
            YPV   +        +TPR    +S+TMRV+DTL NGFG+EGGRN+ +T+FVGLL
Sbjct: 181 RCYPVANPNTVKANHSPNYHTPRQSGDKSLTMRVVDTLLNGFGDEGGRNIEVTRFVGLLL  240

Query: 239 NK                                                            240
           +K
Sbjct: 241 SK                                                            242
```

Based on this analysis, it was predicted that this GAS-specific protein and its epitopes, could be useful antigens for vaccines or diagnostics.

EXAMPLE 2953

A DNA sequence (GASx2110) was identified in *S. pyogenes* <SEQ ID 8405> which encodes the amino acid sequence <SEQ ID 8406>. Analysis of this protein sequence reveals the following:

```
Possible site: 28
>>> Seems to have no N-terminal signal sequence
```

-continued

```
----- Final Results -----
            bacterial cytoplasm --- Certainty = 0.5215(Affirmative) < succ>
            bacterial membrane  --- Certainty = 0.0000(Not Clear)   < succ>
            bacterial outside   --- Certainty = 0.0000(Not Clear)   < succ>
```

No corresponding DNA sequence was identified in *S. agalactiae*.

The protein has homology with the following sequences in the GENPEPT database:

```
>GP: CAB46558 GB: AJ242479 putative DNA primase
[Streptococcus thermophilus]
Identities = 274/548 (50%), Positives = 363/548 (66%), Gaps = 17/548 (3%)

Query:  17 DLKNLENEITEARE------NEDKYFSTFKGVRGQLIKECQEMKDEAFKIAYDGVMADSK  70
           DL  LE E  E+++      +ED Y TFK +R Q I   ++ K+ A++  YD  M + K
Sbjct:   8 DLTKLEEEYNESKKEASTLFDEDGYLKTFKDIRKQFINILEQKKEIAYQKGYDLYMNNPK  67

Query:  71 HLENVKAGRLTEVQHE-------ELAKEKGQEASEKALPKTPLGVAIMLKHYLRFIRVKP  123
           L  +    E   E         E AK++G++A + A PKTPL  A   LK Y+RFIR++P
Sbjct:  68 VLLKLAKAEKDEENGELIRKTVIEDAKKEGEKAKKNATPKTPLECAEFLKKYIRFIRIRP  127

Query: 124 EAQGQKAPLYFFHPDHGVWLEDNEFLQDLISVIFPNATEKQAFDTLYKIARQSQLKEIQR  183
           + +G++    F    G++LED+EFL DL+  I PN TE+   D LYKIA    LK+  Q
Sbjct: 128 KGKGRERLYTFTRQILGIYLEDDEFLHDLMVTIHPNNTERLGNDALYKIAHSVPLKDKQE  187

Query: 184 EYTVIGNQLYNYKTGQFEELTPDITVTRKIKTGYNKKAKEPTIKGWKPTAWLLELFDGDA  243
            Y V+G +LYN +TG+F +   P I VTRK++ GYN  A EP I GWKPT WL  LF+GD
Sbjct: 188 NYVVVGGELYNNETGEFTQFDPRIIVTRKVRMGYNPDATEPIIDGWKPTVWLKGLFNGDR  247

Query: 244 ELYNLAIQIIKASITGQSLQKIFWLFGEGGTGKGTFQQLLINLVGMDNVASLKITELAKS  303
           + Y+LAIQII+A+ITG++L+  IFWL+GEGGTGKGTFQ LL NLVG +NVAS  EI + A
Sbjct: 248 DSYDLAIQIIRATITGKTLENIFWLYGEGGTGKGTFQTLLENLVGSENVASFKI-DGASG  306

Query: 304 RFTTSILLGKSIVIGDDIQKDAVIKDTSDIFSLATGDIMTIEDKGKRPYSIRLNMTVVQS  363
           +F TSIL+GK++VIGDDIQKD VIKDTS +FSLATGD +  IEDKGKRPY+ R  MTVVQS
Sbjct: 307 KFDTSILIGKTVVIGDDIQKDVVIKDTSVVFSLATGDPIRIEDKGKRPYTTRKRMTVVQS  366

Query: 364 SNGLPRMNGDKSAIDRRFRILPFTKVFKGKPNKAIRNDYINRKEVLEYLLKLAIETPITD  423
           SNG PRMN D+ AI+RRFR+L F+++ KGK +K I+NDY+ RKEVLEY +KLAIETP  D
Sbjct: 367 SNGFPRMNADQKAINRRFRVLTFSEL-KGKADKRIKNDYVGRKEVLEYFVKLAIETPFRD  425

Query: 424 INPKASIEILEEHHKEMNPVIDFVSKFFTDE-LTSEFIPNSFVYHVWKGFLEYYDIKQ-I  481
           +NP+ SIE L+E +KEMNPV DFV +FF DE +   ++PN +V+  +K + E       +
Sbjct: 426 VNPQKSIEFLDEAYKEMNPVADFVDRFFNDEVIKCNYVPNGYVFECFKAYCEKNQNRNYF  485

Query: 482 KSERGLHKEIKSNLPEGFEAGQKVIPVGRQLHTGFYPKEDLPLFASASYANGRASPEKRK  541
           + R LHK+IK  LP+ F  + + I G++ + F P        +Y NGR   E ++
Sbjct: 486 LNSRTLHKQIKKILPKTFRPKEVTIKKGQKFYEEFNPHLVSNPWHFDAYDNGRNKKEDQQ  545

Query: 542 KPKNERGY  549
           K  ERGY
Sbjct: 546 DAKKERGY  553
```

Based on this analysis, it was predicted that this GAS-specific protein and its epitopes, could be useful antigens for vaccines or diagnostics.

EXAMPLE 2954

A DNA sequence (GASx2111) was identified in *S. pyogenes* <SEQ ID 8407> which encodes the amino acid sequence <SEQ ID 8408>. Analysis of this protein sequence reveals the following:

```
Possible site: 41
>>> Seems to have no N-terminal signal sequence

----- Final Results -----
            bacterial cytoplasm --- Certainty = 0.0994(Affirmative) < succ>
            bacterial membrane  --- Certainty = 0.0000(Not Clear)   < succ>
            bacterial outside   --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2955

A DNA sequence (GASx2112) was identified in *S. pyogenes* <SEQ ID 8409> which encodes the amino acid sequence <SEQ ID 8410>. Analysis of this protein sequence reveals the following:

```
Possible site: 54
>>> Seems to have no N-terminal signal sequence

----- Final Results -----
            bacterial cytoplasm --- Certainty = 0.3058(Affirmative) < succ>
            bacterial membrane  --- Certainty = 0.0000(Not Clear)   < succ>
             bacterial outside  --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2956

A DNA sequence (GASx2114) was identified in *S. pyogenes* <SEQ ID 8411> which encodes the amino acid sequence <SEQ ID 8412>. Analysis of this protein sequence reveals the following:

```
Possible site: 37
>>> Seems to have no N-terminal signal sequence

----- Final Results -----
            bacterial cytoplasm --- Certainty = 0.2815(Affirmative) < succ>
            bacterial membrane  --- Certainty = 0.0000(Not Clear)   < succ>
             bacterial outside  --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2957

A DNA sequence (GASx2115R) was identified in *S. pyogenes* <SEQ ID 8413> which encodes the amino acid sequence <SEQ ID 8414>. Analysis of this protein sequence reveals the following:

```
Possible site: 27
>>> Seems to have an uncleavable N-term signal seq

----- Final Results -----
            bacterial membrane  --- Certainty = 0.0000(Not Clear)   < succ>
```

```
                bacterial outside --- Certainty = 0.0000(Not Clear) < succ>
                bacterial cytoplasm --- Certainty = 0.0000(Not Clear) < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2958

A DNA sequence (GASx2116) was identified in *S. pyogenes* <SEQ ID 8415> which encodes the amino acid sequence <SEQ ID 8416>. Analysis of this protein sequence reveals the following:

```
Possible site: 56
>>> Seems to have no N-terminal signal sequence

----- Final Results -----
                bacterial cytoplasm --- Certainty = 0.4213(Affirmative) < succ>
                bacterial membrane  --- Certainty = 0.0000(Not Clear)   < succ>
                bacterial outside   --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2959

A DNA sequence (GASx2117) was identified in *S. pyogenes* <SEQ ID 8417> which encodes the amino acid sequence <SEQ ID 8418>. Analysis of this protein sequence reveals the following:

```
Possible site: 20
>>> Seems to have no N-terminal signal sequence

----- Final Results -----
                bacterial cytoplasm --- Certainty = 0.3091(Affirmative) < succ>
                bacterial membrane  --- Certainty = 0.0000(Not Clear)   < succ>
                bacterial outside   --- Certainty = 0.0000(Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2960

A DNA sequence (GASx2118) was identified in *S. pyogenes* <SEQ ID 8419> which encodes the amino acid sequence <SEQ ID 8420>. Analysis of this protein sequence reveals the following:

```
Possible site: 41
>>> Seems to have an uncleavable N-term signal seq

----- Final Results -----
            bacterial membrane --- Certainty = 0.0000(Not Clear) < succ>
             bacterial outside --- Certainty = 0.0000(Not Clear) < succ>
           bacterial cytoplasm --- Certainty = 0.0000(Not Clear) < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2961

A DNA sequence (GASx2119) was identified in *S. pyogenes* <SEQ ID 8421> which encodes the amino acid sequence <SEQ ID 8422>. Analysis of this protein sequence reveals the following:

```
Possible site: 22
>>> Seems to have no N-terminal signal sequence

----- Final Results -----
           bacterial cytoplasm --- Certainty = 0.2531(Affirmative) < succ>
            bacterial membrane --- Certainty = 0.0000(Not Clear) < succ>
             bacterial outside --- Certainty = 0.0000(Not Clear) < succ>
```

No corresponding DNA sequence was identified in *S. agalactiae*.

The protein has homology with the following sequences in the GENPEPT database:

```
>GP: AAF63071 GB: AF158600 gp137 [Streptococcus thermophilus
bacteriophage Sfi11]
Identities = 41/121 (33%), Positives = 65/121 (52%), Gaps = 3/121 (2%)

Query:   4 KNAIRKLKEFHRWQRIAN-SLDLTYTELYQFDIEYHPTRR--KHLEISRECALEELDAIR    60
           K    RKL+E+ RW+ IA+ S +   T+ + F        +  +++ + R  AL EL+AI
Sbjct:  13 KRCKRKLREYPRWREIAHDSAEQKITQEFTFMPRGGGVNKPVENIAVRRVDALNELEAIE    72

Query:  61 YAINQLSKVEYRQILIECYLISEEKTQQDIMEELNGSQSWYYESKKRALLEFVEFYRDGAL   121
           A+N L + +YR+ILIE YL    K    I + +   ++ + E     ++L F E YRDG L
Sbjct:  73 QAVNGLYRPDYRRILIEKYLAYPPKPNWQIAQSIGFERTAFQELLNNSILAFAELYRDGRL   133
```

Based on this analysis, it was predicted that this GAS-specific protein and its epitopes, could be useful antigens for vaccines or diagnostics.

EXAMPLE 2962

A DNA sequence (GASx2120) was identified in *S. pyogenes* <SEQ ID 8423> which encodes the amino acid sequence <SEQ ID 8424>. Analysis of this protein sequence reveals the following:

```
Possible site: 24
>>> Seems to have no N-terminal signal sequence

----- Final Results -----
           bacterial cytoplasm --- Certainty = 0.2666 (Affirmative) < succ>
            bacterial membrane --- Certainty = 0.0000 (Not Clear) < succ>
             bacterial outside --- Certainty = 0.0000 (Not Clear) < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2963

A DNA sequence (GASx21121) was identified in *S. pyogenes* <SEQ ID 8425> which encodes the amino acid sequence <SEQ ID 8426>. Analysis of this protein sequence reveals the following:

```
Possible site: 30
>>> Seems to have a cleavable N-term signal seq.

----- Final Results -----
           bacterial outside --- Certainty = 0.3000 (Affirmative) < succ>
          bacterial membrane --- Certainty = 0.0000 (Not Clear)   < succ>
         bacterial cytoplasm --- Certainty = 0.0000 (Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2964

A DNA sequence (GASx2123R) was identified in *S. pyogenes* <SEQ ID 8427> which encodes the amino acid sequence <SEQ ID 8428>. Analysis of this protein sequence reveals the following:

```
Possible site: 21
>>> Seems to have no N-terminal signal sequence

----- Final Results -----
         bacterial cytoplasm --- Certainty = 0.3441 (Affirmative) < succ>
          bacterial membrane --- Certainty = 0.0000 (Not Clear)   < succ>
           bacterial outside --- Certainty = 0.0000 (Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2965

A DNA sequence (GASx2132) was identified in *S. pyogenes* <SEQ ID 8429> which encodes the amino acid sequence <SEQ ID 8430>. Analysis of this protein sequence reveals the following:

```
Possible site: 31
>>> Seems to have an uncleavable N-term signal seq

----- Final Results -----
          bacterial membrane --- Certainty = 0.0000 (Not Clear) < succ>
          bacterial outside  --- Certainty = 0.0000 (Not Clear) < succ>
          bacterial cytoplasm --- Certainty = 0.0000 (Not Clear) < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2966

A DNA sequence (GASx2136) was identified in *S. pyogenes* <SEQ ID 8431> which encodes the amino acid sequence <SEQ ID 8432>. Analysis of this protein sequence reveals the following:

```
Possible site: 30
>>> Seems to have no N-terminal signal sequence
    INTEGRAL    Likelihood = -3.19 Transmembrane 57-73 (54-78)

----- Final Results -----
          bacterial membrane --- Certainty = 0.2275 (Affirmative) < succ>
          bacterial outside  --- Certainty = 0.0000 (Not Clear)   < succ>
          bacterial cytoplasm --- Certainty = 0.0000 (Not Clear)   < succ>
```

No corresponding DNA sequence was identified in *S. agalactiae*.

The protein has homology with the following sequences in the GENPEPT database:

```
>GP: AAB18271 GB: U74623 CadX [Staphylococcus lugdunensis]
Identities = 50/110 (45%), Positives = 76/110 (68%)

Query:  11 MKKDSICQVGVINQQNVTTATNYLEKEKVQKSLRILSKFTDNKQINIIFYLLAVEELCVC    70
           M  ++ C V  +++  V  A ++LE +K +K L  IL K  D K++ II  L+   +ELCVC
Sbjct:   1 MSYENACDVICVHEDKVNNALSFLEDDKSKKLLNILEKICDEKKLKIILSLIKEDELCVC    60

Query:  71 DIACLLNLSMASASHHLRKLANQNILDTRREGKIIYYFIKDEEIRDFFNQ           120
           DI+ +L +S+AS SHHLR L    ++LD   ++GK+ YYFIKD+EIR+FF++
Sbjct:  61 DISLILKMSVASTSHHLRLLYKNDVLDFYKKGKMAYYFIKDDEIREFFSK            110
```

Based on this analysis, it was predicted that this GAS-specific protein and its epitopes, could be useful antigens for vaccines or diagnostics.

EXAMPLE 2967

A DNA sequence (GASx2137) was identified in *S. pyogenes* <SEQ ID 8433> which encodes the amino acid sequence <SEQ ID 8434>. Analysis of this protein sequence reveals the following:

```
Possible site: 49
>>> Seems to have no N-terminal signal sequence

----- Final Results -----
          bacterial cytoplasm --- Certainty = 0.4582 (Affirmative) < succ>
```

```
                bacterial membrane --- Certainty = 0.0000 (Not Clear) < succ>
                bacterial outside  --- Certainty = 0.0000 (Not Clear) < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2968

A DNA sequence (GASx2139) was identified in *S. pyogenes* <SEQ ID 8435> which encodes the amino acid sequence <SEQ ID 8436>. Analysis of this protein sequence reveals the following:

```
Possible site: 28
>>> Seems to have a cleavable N-term signal seq.
    INTEGRAL    Likelihood = -5.89 Transmembrane 63-79 (54-80)

----- Final Results -----
                bacterial membrane  --- Certainty = 0.3357 (Affirmative) < succ>
                bacterial outside   --- Certainty = 0.0000 (Not Clear)   < succ>
                bacterial cytoplasm --- Certainty = 0.0000 (Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2969

A DNA sequence (GASx2141R) was identified in *S. pyogenes* <SEQ ID 8437> which encodes the amino acid sequence <SEQ ID 8438>. Analysis of this protein sequence reveals the following:

```
Possible site: 19
>>> Seems to have no N-terminal signal sequence

----- Final Results -----
                bacterial cytoplasm --- Certainty = 0.4663 (Affirmative) < succ>
                bacterial membrane  --- Certainty = 0.0000 (Not Clear)   < succ>
                bacterial outside   --- Certainty = 0.0000 (Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2970

A DNA sequence (GASx2142) was identified in *S. pyogenes* <SEQ ID 8439> which encodes the amino acid sequence <SEQ ID 8440>. Analysis of this protein sequence reveals the following:

```
Possible site: 29
>>> Seems to have a cleavable N-term signal seq.
    INTEGRAL      Likelihood          Transmembrane 143-159 (135-
                  = -10.08            165)
    INTEGRAL      Likelihood = -7.64  Transmembrane  53-69 (49-79)
    INTEGRAL      Likelihood = -7.17  Transmembrane 252-268 (248-
                                      275)
    INTEGRAL      Likelihood = -6.74  Transmembrane 186-202 (183-
                                      208)
    INTEGRAL      Likelihood = -5.63  Transmembrane 220-236 (218-
                                      240)
    INTEGRAL      Likelihood = -5.26  Transmembrane 116-132 (115-
                                      136)
    INTEGRAL      Likelihood = -2.02  Transmembrane  85-101 (85-101)
    INTEGRAL      Likelihood = -0.64  Transmembrane 165-181 (165-
                                      181)

----- Final Results -----
               bacterial membrane --- Certainty = 0.5034 (Affirmative) < succ>
                bacterial outside --- Certainty = 0.0000 (Not Clear) < succ>
              bacterial cytoplasm --- Certainty = 0.0000 (Not Clear) < succ>
```

No corresponding DNA sequence was identified in *S. agalactiae*.

The protein has homology with the following sequences in the GENPEPT database:

```
>GP: AAD35257 GB: AE001701 conserved hypothetical protein
[Thermotoga maritima]
Identities = 81/275 (29%), Positives = 137/275 (49%), Gaps = 29/275 (10%)

Query:    9 FKGMIIALGFILPGVSGGVLAAILGIYERMISFLAHMRDNFIENVLFFLPVGIG---GIL    65
            F G+++ +  ++PGVSGG +A ++G+YE++I  +          ++   +PVG G   G+
Sbjct:    7 FSGVLMGIANVVPGVSGGTIAVLMGVYEKLIESVNSFFHGNSRSLKVLIPVGAGVLVGVF   66

Query:   66 GIALFSFPVEFLLKHYQVSVLWGFAGAIVGTIPSLIKESTKQSQRDKADWLWLVLTFVIS  125
            GIA F  +E  L  Y V   + F G I    I S +K  TK+    K    + + FV+
Sbjct:   67 GIARF---LEIFLSKYPVPTHFFFLGLI---IVSFVK--TKEYFSIKP----VNIFFVLL  114

Query:  126 GLGLYFLNDLIG--TLPANFLTFILAGALIALGVLVPGLSPSNLLLILGLYGPMLIGFKS  183
            G+ L F+   G  T  +     +L G + A  ++VPG+S S +LLI G+Y   +L
Sbjct:  115 GMFLIFMLHFSGETTAKESMFLLVLGGFVAATAMVVPGISGSLILLIFGVYDHVLYLVSH  174

Query:  184 LDLLGTFLPIAIGGVLAILAFSKSMDYALQHHHSKVYHFIIGIVLSSTLLILIPNSSSPE  243
            L ++G  L  +IG V  IL    K M++ L+    + Y FI G++L+S L   ++P   +
Sbjct:  175 L-IIGELLIFSIGVVAGILVSVKIMNFLLKRFREETYSFIGGMILAS-LYEVLPKKMNTN  232

Query:  244 SISYSHAGILTWLMAFVLFALGIWLGLWMSQLEEK                          278
            +             L + +   L + LG ++   +E+K
Sbjct:  233 VV----------LPSVLSLVLSLTLGFFLLYIEKK                          257
```

Based on this analysis, it was predicted that this GAS-specific protein and its epitopes, could be useful antigens for vaccines or diagnostics.

EXAMPLE 2971

A DNA sequence (GASx2143R) was identified in *S. pyogenes* <SEQ ID 8441> which encodes the amino acid sequence <SEQ ID 8442>. Analysis of this protein sequence reveals the following:

```
Possible site: 20
>>> Seems to have no N-terminal signal sequence

----- Final Results -----
            bacterial cytoplasm --- Certainty = 0.3964 (Affirmative) < succ>
            bacterial membrane  --- Certainty = 0.0000 (Not Clear)   < succ>
            bacterial outside   --- Certainty = 0.0000 (Not Clear)   < succ>
```

No corresponding DNA sequence was identified in *S. agalactiae*.

The protein has homology with the following sequences in the GENPEPT database:

```
>GP: BAB05000 GB: AP001511 unknown conserved protein in others
[Bacillus halodurans]
Identities = 28/78 (35%), Positives = 37/78 (46%)

Query:   44 EVDKVFIVPLRQLLFTDPVYYRLEVTPIETTDFPFDRIRNGKYYQFSQEYRSIPFYENLE  103
            EVD VF VP+   +    P  YR+ V       FP +RI N   YQ S   +   FY
Sbjct:  127 EVDHVFTVPIDHFISHPPEQYRINVHFEPGAGFPIERIANQSAYQKSTRQITESFYYYQS  186

Query:  104 ETIWGMTAQFTKCLTDIL  121
            +TIWG+TA+ + +   IL
Sbjct:  187 YVIWGLTAKILRHVITIL  204
```

Based on this analysis, it was predicted that this GAS-specific protein and its epitopes, could be useful antigens for vaccines or diagnostics.

EXAMPLE 2972

A DNA sequence (GASx2144R) was identified in *S. pyogenes* <SEQ ID 8443> which encodes the amino acid sequence <SEQ ID 8444>. Analysis of this protein sequence reveals the following:

```
Possible site: 17
>>> Seems to have no N-terminal signal sequence

----- Final Results -----
            bacterial cytoplasm --- Certainty = 0.4761 (Affirmative) < succ>
            bacterial membrane  --- Certainty = 0.0000 (Not Clear)   < succ>
            bacterial outside   --- Certainty = 0.0000 (Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2973

A DNA sequence (GASx2145) was identified in *S. pyogenes* <SEQ ID 8445> which encodes the amino acid sequence <SEQ ID 8446>. Analysis of this protein sequence reveals the following:

```
Possible site: 25
>>> Seems to have an uncleavable N-term signal seq
   INTEGRAL     Likelihood = -4.09 Transmembrane 2-18 (1-19)

----- Final Results -----
              bacterial membrane --- Certainty = 0.2635 (Affirmative) < succ>
               bacterial outside --- Certainty = 0.0000 (Not Clear) < succ>
             bacterial cytoplasm --- Certainty = 0.0000 (Not Clear) < succ>
```

No corresponding DNA sequence was identified in *S. agalactiae.*

The protein has homology with the following sequences in the GENPEPT database:

```
>GP: CAA49519 GB: X69895 X [Bacillus sphaericus]
Identities = 40/97 (41%), Positives = 57/97 (58%), Gaps = 5/97 (5%)

Query:  10 IEFLILAIVEKNDSYGYDISQTIKLVAN----IKESTLYPILKKLEKAGFLTTYSQE-HQ   64
           ++ +IL ++ + D YGY+ISQ I    N    IKE+TLY + ++LEK    +  Y  +
Sbjct:  11 LDSIILRLILEKDRYGYEISQEISNRTNNSFQIKEATLYAVFQRLEKKEVIEAYYGDVSD   70

Query:  65 GRKRKYYAVTSSGRAQLIFLKKEWQSYKFALDGIIEG                        101
           G KRKYY +TS G+A L  L KEW   K  +D  +EG
Sbjct:  71 GGKRKYYRITSLGKAYLSELVKEWAEVKEIIDLFMEG                        107
```

Based on this analysis, it was predicted that this GAS-specific protein and its epitopes, could be useful antigens for vaccines or diagnostics.

EXAMPLE 2974

A DNA sequence (GASx2146) was identified in *S. pyogenes* <SEQ ID 8447> which encodes the amino acid sequence <SEQ ID 8448>. Analysis of this protein sequence reveals the following:

```
Possible site: 56
>>> Seems to have no N-terminal signal sequence
   INTEGRAL     Likelihood         Transmembrane  97-113 (77-
                = -14.75           143)
   INTEGRAL     Likelihood = -6.85 Transmembrane 116-132
                                   (114-143)
   INTEGRAL     Likelihood = -5.68 Transmembrane 156-172
                                   (149-175)
   INTEGRAL     Likelihood = -5.47 Transmembrane   79-95 (77-
                                   96)

----- Final Results -----
               bacterial membrane --- Certainty = 0.6901 (Affirmative) < succ>
                bacterial outside --- Certainty = 0.0000 (Not Clear) < succ>
              bacterial cytoplasm --- Certainty = 0.0000 (Not Clear) < succ>
```

No corresponding DNA sequence was identified in *S. agalactiae.*

The protein has no significant homology with any sequences in the GENPEPT database.

Based on this analysis, it was predicted that this GAS-specific protein and its epitopes, could be useful antigens for vaccines or diagnostics.

EXAMPLE 2975

A DNA sequence (GASx2147) was identified in *S. pyogenes* <SEQ ID 8449> which encodes the amino acid sequence <SEQ ID 8450>. Analysis of this protein sequence reveals the following:

```
Possible site: 31
>>> Seems to have an uncleavable N-term signal seq
    INTEGRAL     Likelihood = -7.11 Transmembrane 8-24 (6-30)

----- Final Results -----
                bacterial membrane --- Certainty = 0.3845 (Affirmative) < succ>
                 bacterial outside --- Certainty = 0.0000 (Not Clear)   < succ>
               bacterial cytoplasm --- Certainty = 0.0000 (Not Clear)   < succ>
```

No corresponding DNA sequence was identified in *S. agalactiae*.

The protein has homology with the following sequences in the GENPEPT database:

```
>GP: AAF04457 GB: AF078161 lacunin [Manduca sexta]
Identities = 68/310 (21%), Positives = 117/310 (36%), Gaps = 12/310 (3%)

Query:     55 DIDSSASTITVETGPVQRPTVTYYTHPKLIDPIVTTVTGKTLSLSQTPKDVVITGGIEIL    114
              DI+ + ++ + E+      T++  T   +   TT T  T +S T +   I      +
Sbjct:   1004 DIEGTTASGSTESTFTDETTMSKVTEESSVAEEETTKTTITEEVSGTSESASINSDKTTM   1063

Query:    115 GFTLNNSRQEKNYRSIT--ITVPEKTSLNEVKASNVPHTTLSNLT--VQDMQFDGNLTLL    170
                       ++ +         IT  +TV E+TS            TT+S ++ +          T
Sbjct:   1064 TTLSEDTGKTSVSEEITTEMTVTEETSETSPTEGTSDKTTMSTVSEETESSSVTEETTTE   1123

Query:    171 HTKVKKATITGMLEATKSQLTNLELKADYSFSNLTDSSVE-NGTISLGNGQLTTKDTTLK    229
                 T V+ AT     E T S   T +   ++ S      +++ E    T  +     T    T+ K
Sbjct:   1124 TTVVENATDISSTEVTASDKTTMTTMSEESEKTTEEATTEITVTKEVTESSSTETATSDK   1183

Query:    230 AVNIQSLHPGGIE-AERTTLENVTFTVSKSKEEEENDYYDNDAIFTAHALTLKGTNTITG    288
                  ++   S     G         AE +T E VT T    +   EE              T+  +T+K T T
Sbjct:   1184 TISTLSEETGKTSVAEESTTEKVTETTVTTMPEETGK------TITSEEITIKTTVTEEP   1237

Query:    289 GDIDVDITLTKAKAIAYRARTENGKVSLGSQLTPAKIGKESTSDVISYVAENKAATGNLT    348
                     D+      +T  K        A  E GK S+  +  T             E++++   S  A         T         T
Sbjct:   1238 TDVGSSEAITSDKTTVSTASEETGKYSVSEEETVKTTVAEASTEPSSTEAITSDKTKMST   1297

Query:    349 VNLNKGDITI                                                    358
                 ++    G   ++
Sbjct:   1298 ISEETGKTSV                                                   1307
```

Based on this analysis, it was predicted that this GAS-specific protein and its epitopes, could be useful antigens for vaccines or diagnostics.

EXAMPLE 2976

A DNA sequence (GASx2148R) was identified in *S. pyogenes* <SEQ ID 8451> which encodes the amino acid sequence <SEQ ID 8452>. Analysis of this protein sequence reveals the following:

```
Possible Site: 28
>>> Seems to have an uncleavable N-term signal seq

----- Final Results -----
                bacterial membrane --- Certainty = 0.0000 (Not Clear) < succ>
                 bacterial outside --- Certainty = 0.0000 (Not Clear) < succ>
               bacterial cytoplasm --- Certainty = 0.0000 (Not Clear) < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2977

A DNA sequence (GASx2160) was identified in *S. pyogenes* <SEQ ID 8453> which encodes the amino acid sequence <SEQ ID 8454>. Analysis of this protein sequence reveals the following:

```
Possible site: 29
>>> Seems to have no N-terminal signal sequence

----- Final Results -----
            bacterial cytoplasm --- Certainty = 0.1630 (Affirmative) < succ>
            bacterial membrane  --- Certainty = 0.0000 (Not Clear)   < succ>
            bacterial outside   --- Certainty = 0.0000 (Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2978

A DNA sequence (GASx2170R) was identified in *S. pyogenes* <SEQ ID 8455> which encodes the amino acid sequence <SEQ ID 8456>. Analysis of this protein sequence reveals the following:

```
Possible site: 37
>>> Seems to have no N-terminal signal sequence
INTEGRAL    Likelihood = -13.32    Transmembrane    181-197 (175-203)

----- Final Results -----
            bacterial membrane  --- Certainty = 0.6328 (Affirmative) < succ>
            bacterial outside   --- Certainty = 0.0000 (Not Clear)   < succ>
            bacterial cytoplasm --- Certainty = 0.0000 (Not Clear)   < succ>
```

No corresponding DNA sequence was identified in *S. agalactiae*.

Based on this analysis, it was predicted that this GAS-specific protein and its epitopes, could be useful antigens for vaccines or diagnostics.

EXAMPLE 2979

A DNA sequence (GASx2174) was identified in *S. pyogenes* <SEQ ID 8457> which encodes the amino acid sequence <SEQ ID 8458>. Analysis of this protein sequence reveals the following:

```
Possible site: 28
>>> Seems to have an uncleavable N-term signal seq
    INTEGRAL         Likelihood = -2.39    Transmembrane    3-19 (3-19)

----- Final Results -----
            bacterial membrane  --- Certainty = 0.1956 (Affirmative) < succ>
            bacterial outside   --- Certainty = 0.0000 (Not Clear)   < succ>
            bacterial cytoplasm --- Certainty = 0.0000 (Not Clear)   < succ>
```

No corresponding DNA sequence was identified in *S. agalactiae*.

Based on this analysis, it was predicted that this GAS-specific protein and its epitopes, could be useful antigens for vaccines or diagnostics.

EXAMPLE 2980

A DNA sequence (GASx2181R) was identified in *S. pyogenes* <SEQ ID 8459> which encodes the amino acid sequence <SEQ ID 8460>. Analysis of this protein sequence reveals the following:

```
Possible site: 24
>>> Seems to have no N-terminal signal sequence

----- Final Results -----
            bacterial cytoplasm --- Certainty = 0.3751 (Affirmative) < succ>
            bacterial membrane  --- Certainty = 0.0000 (Not Clear)   < succ>
            bacterial outside   --- Certainty = 0.0000 (Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2981

A DNA sequence (GASx2185R) was identified in *S. pyogenes* <SEQ ID 8461> which encodes the amino acid sequence <SEQ ID 8462>. Analysis of this protein sequence reveals the following:

```
Possible site: 26
>>> Seems to have no N-terminal signal sequence
   INTEGRAL    Likelihood = -0.90      Transmembrane    18-34 (18-34)

----- Final Results -----
            bacterial membrane  --- Certainty = 0.1362 (Affirmative) < succ>
            bacterial outside   --- Certainty = 0.0000 (Not Clear)   < succ>
            bacterial cytoplasm --- Certainty = 0.0000 (Not Clear)   < succ>
```

No corresponding DNA sequence was identified in *S. agalactiae*.

The protein has no significant homology with any sequences in the GENPEPT database.

Based on this analysis, it was predicted that this GAS-specific protein and its epitopes, could be useful antigens for vaccines or diagnostics.

EXAMPLE 2982

A DNA sequence (GASx2186R) was identified in *S. pyogenes* <SEQ ID 8463> which encodes the amino acid sequence <SEQ ID 8464>. Analysis of this protein sequence reveals the following:

```
Possible site: 61
>>> Seems to have no N-terminal signal sequence

----- Final Results -----
            bacterial cytoplasm --- Certainty = 0.4803 (Affirmative) < succ>
            bacterial membrane  --- Certainty = 0.0000 (Not Clear)   < succ>
            bacterial outside   --- Certainty = 0.0000 (Not Clear)   < succ>
```

No corresponding DNA sequence was identified in *S. agalactiae*.

The protein has homology with the following sequences in the GENPEPT database:

```
>GP: CAA78948 GB: Z17279 transposase [Streptococcus salivarius]
Identities = 48/77 (62%), Positives = 55/77 (71%), Gaps = 1/77 (1%)

Query:    1 VSMKPIDLSKMVSIRKRSKKVMKTNKKTLGKSIEERPEYINDRSEFGHWEIDLALGKKTK   60
            + +K IDL + V IRK+   K   T KK LGKSIEERPE IN+RS FG WEID  LG KT
Sbjct:  150 LEIKVIDLPRAVRIRKKFTKRPST-KKHLGKSIEERPEEINNRSRFGDWEIDSVLGGKTI  208

Query:   61 SEAVMLTLVERQTRYAL                                             77
            E  +LTLVERQTRYA+
Sbjct:  209 GEPSILTLVERQTRYAV                                            225
```

Based on this analysis, it was predicted that this GAS-specific protein and its epitopes, could be useful antigens for vaccines or diagnostics.

EXAMPLE 2983

A DNA sequence (GASx2187R) was identified in *S. pyogenes* <SEQ ID 8465> which encodes the amino acid sequence <SEQ ID 8466>. Analysis of this protein sequence reveals the following:

```
Possible site: 50
>>> Seems to have no N-terminal signal sequence

----- Final Results -----
            bacterial cytoplasm --- Certainty = 0.3287 (Affirmative) < succ>
             bacterial membrane --- Certainty = 0.0000 (Not Clear)   < succ>
              bacterial outside --- Certainty = 0.0000 (Not Clear)   < succ>
```

No corresponding DNA sequence was identified in *S. agalactiae*.

The protein has homology with the following sequences in the GENPEPT database:

```
>GP: CAA78948 GB: Z17279 transposase [Streptococcus salivarius]
Identities = 48/87 (55%), Positives = 57/87 (65%)

Query:    1 MNMSNINSTRKSSYSHLSATERGEIAAYLKMGKKPVEIARLLGSHRSTICREIKRGSVDQ   60
            MNMS    ST   SY HLS  ERGEI AYL +G KP EIAR LG +RSTI REI RGS+ Q
Sbjct:    1 MNMSTNYSTTNQSYKHLSEAERGEIEAYLSVGLKPAEIARRLGRNRSTITREINRGSITQ   60

Query:   61 VKDKNGKQTFFNAYFADSRQRVYETNR                                   87
            VK  NG++ ++  Y+AD+    Y   R
Sbjct:   61 VKKVNGQKVYYQHYYADAAHNRYRHAR                                   87
```

Based on this analysis, it was predicted that this GAS-specific protein and its epitopes, could be useful antigens for vaccines or diagnostics.

EXAMPLE 2984

A DNA sequence <SEQ ID 9013> was identified in *S. agalactiae* which encodes amino acid sequence <SEQ ID 9014>. Analysis of the amino acid sequence reveals the following:

```
Lipop: Possible site: -1 Crend: 3
McG: Discrim Score: 10.50
GvH: Signal Score (-7.5): -5.2
      Possible site: 40
>>> Seems to have an uncleavable N-term signal seq
ALOM program         count: 4       value: -12.26           threshold: 0.0
    INTEGRAL         Likelihood = -12.26    Transmembrane   98-114  (94-116)
    INTEGRAL         Likelihood =  -8.17    Transmembrane    5-21   (1-27)
    INTEGRAL         Likelihood =  -6.95    Transmembrane   62-78   (57-80)
```

```
   INTEGRAL        Likelihood = -5.84    Transmembrane    37-53 (30-55)
   PERIPHERAL      Likelihood = 17.35                     81
modified ALOM score: 2.95

*** Reasoning Step: 3

----- Final Results -----
              bacterial membrane --- Certainty = 0.5904 (Affirmative) < succ>
                bacterial outside --- Certainty = 0.0000 (Not Clear)  < succ>
              bacterial cytoplasm --- Certainty = 0.0000 (Not Clear)  < succ>
```

The protein has homology with the following sequences in the databases:

```
ORF01345(292-636 of 951)
PIR|G64646|G64646(56-168 of 205) hypothetical protein HP1015 - Helicobacter pylori
(strain 26695)
% Match = 4.4
% Identity = 30.6  % Similarity = 54.1
Matches = 34  Mismatches = 46  Conservative Sub.s = 26
   87        117       147       177       207       237       267       297
LSGMGATFVPQTLIHRYLDKECNVYHFHKNKLFSEYIMIYKKDVELSGIALLLYKAFLTK*FR*FY*KSVYFLPKSV*NR
                                                                              |
                        RYFLQNIIHIHQNKELQFIKKCLLGYFFAPLCGAILLVLFIVSSGAKSFQISNLFNN
                             10        20        30        40        50
   327       357       381       411       441       471       501
PMIYKIIASLFLVLIPIFSQVL--VKIFKLKKFNIMFPDVAFPIFVFLIPLISSSLLKQNLLPYYLILISLLAIGITI--
 :|::||||   :    :   ::|::    |:||    :  :::   |||:     |    :||:  |::|
QLAYIVLLSLFLCALGFIAGAIGFYRLSKITRHLSFFENFAFSFLAVILCAILSYLV-----PNASNALSLIGNGVSIFY
             70        80        90       100       110             120       130
   549       579       606       636       666       696       726       756
--KLLRTKTLFSYKRFLKLFWRSGF-ILTFLFYLGLLVIIFIKVQ*KELDKLNCTPKVRQKI*RLGCFSDEIKL*R*TRN
  ||  |  :|:: :||    : |||:|  |  |  ||  |:
LHKLYRELSLYTQERF----FLSGFRLLLFSFMLALLGILVQALVIIFLTTAVVLMCVALGFLARAFLNFSQVFLKA
                      150       160       170       180       190       200
```

Based on this analysis, it is predicted that this protein from *S. agalactiae*, and its epitopes, could be useful antigens for vaccines and/or diagnostics.

EXAMPLE 2985

A DNA sequence <SEQ ID 9015> was identified in *S. agalactiae* which encodes amino acid sequence <SEQ ID 9016>. Analysis of the amino acid sequence reveals the following:

```
Lipop: Possible site: -1 Crend: 10
McG: Discrim Score: 13.20
GvH: Signal Score (-7.5): -2.08
     Possible site: 34
>>> Seems to have a cleavable N-term signal seq.
ALOM program           count: 0       value: 10.45     threshold: 0.0
   PERIPHERAL          Likelihood = 10.45     36
modified ALOM score: -2.59

*** Reasoning Step: 3

----- Final Results -----
                bacterial outside --- Certainty = 0.3000 (Affirmative) < succ>
               bacterial membrane --- Certainty = 0.0000 (Not Clear) < succ>
              bacterial cytoplasm --- Certainty = 0.0000 (Not Clear) < succ>
```

The protein has homology with the following sequences in the databases:

```
43.9/72.0% over 56aa

Streptococcus pneumoniae
  EGAD|7626| epua protein Insert characterized
  SP|Q03159|EPUA_STRPN EPUA PROTEIN.  Insert characterized
  GP|47373|emb|CAA38133.1||X54225 7 kDa protein Insert characterized
  PIR|S10640|S10640 epuA protein - Insert characterized ORF01809(331-501 of 801)
EGAD|7626|7426(8-64 of 64) epua protein {Streptococcus
pneumoniae}SP|Q03159|EPUA_STRPN EPUA PROTEIN.GP|47373|emb|CAA38133.1||X54225 7 kDa
protein {Streptococcus pneumoniae}PIR|S10640|S10640 epuA protein - Streptococcus
pneumoniae
% Match = 10.0
% Identity = 43.9  % Similarity = 71.9
Matches = 25  Mismatches = 16  Conservative Sub.s = 16
  171        201        231        261        291        321        351        381
RSCLLTYELVQL*SWQEWLRKGKQ*LAN*PI*TVVIINSMKN*RLLVLILNV*VRRNMASSGWKYVLKQIGLIVLVILLA
                                                         :   ||:|:: |:::|::|
                                                        MKMNKKSSYVVKRLLLVIIVLILG
                                                                     10        20
  411        441        471        501        531        561        591        621
LLFLAVGLMLGYSVFGDGEHAYSILSLDKWQNIIGKFLGK*KEPL*VI*CL*WFPLRVNFSSRIIQ*QKNKNK*QLRL*L
 |  | :|||:||  ::|  |:   ::|||   |||  :| || |
TLALGIGLMVGYGILGKGQDPWAILSPAKWQELIHKFTGN
              40        50        60
```

A related DNA sequence <SEQ ID 10507> was identified in GBS which encodes amino acid sequence <SEQ ID 10508>.

SEQ ID 9016 (GBS168) was expressed in *E. coli* as a His-fusion product. SDS-PAGE analysis of total cell extract is shown in FIG. 33 (lane 9; MW 7.6 kDa) and in FIG. 34 (lane 5; MW 7.6 kDa). It was also expressed in *E. coli* as a GST-fusion product. SDS-PAGE analysis of total cell extract is shown in FIG. 42 (lane 2; MW 32.6 kDa).

Based on this analysis, it is predicted that this protein from *S. agalactiae*, and its epitopes, could be useful antigens for vacc

EXAMPLE 2986

A DNA sequence <SEQ ID 9017> was identified in *S. agalactiae* which encodes amino acid sequence <SEQ ID 9018>. Analysis of the amino acid sequence reveals the following:

```
Lipop: Possible site: -1 Crend: 8

McG: Discrim Score: -2.85

GvH: Signal Score (-7.5): -5.7
     Possible site: 21
>>> Seems to have no N-terminal signal sequence
ALOM program   count: 0 value: 5.25 threshold: 0.0
   PERIPHERAL  Likelihood = 5.25   103
  modified ALOM score: -1.55

*** Reasoning Step: 3

----- Final Results -----
              bacterial cytoplasm --- Certainty = 0.1210 (Affirmative) < succ>
                bacterial membrane --- Certainty = 0.0000 (Not Clear) < succ>
                 bacterial outside --- Certainty = 0.0000 (Not Clear) < succ>
```

The protein has homology with the following sequences in the databases:

```
56.1/72.0% over 131aa

Escherichia coli
 EGAD|40237| arsenate reductase Insert characterized
 SP|P52147|ARC2_ECOLI ARSENATE REDUCTASE (ARSENICAL PUMP MODIFIER). Edit
characterized
 GP|1061418|gb|AAB09628.1||U38947 ArsC {Plasmid R46} Insert characterized ORF00095(304-699 of 1008)
EGAD|40237|42398(1-132 of 141) arsenate reductase {Escherichia coli}
SP|P52147|ARC2_ECOLI ARSENATE REDUCTASE (ARSENICAL PUMP MODIFIER).
GP|1061418|gb|AAB09628.1||U38947 ArsC {Plasmid R46}
% Match = 22.0
% Identity = 56.1  % Similarity = 72.0
Matches = 74   Mismatches = 37   Conservative Sub.s = 21
129         159         189         219         249         279         309         339
RIHSSLSL*PIFHRKRPYPSRAFRRYFSNSCG*LWC*YCDDWRELLAGLGINFYFLKTLVALKIERKMMEKIRIYHNPNC
                                                                    |  |  |||||:|
                                                                    MSNITIYHNPHC
                                                                             10
369         399         429         459         489         519         549         579
GTSRNVLAIIRHCGIEPEIIYYLKTPPSRMELVELLLEMKLSARELLRTDVPAYEKFNLESSSVTDEEMIDAMIQDPILI
|||||  |  :||:  ||||  :|  ||:|||||  ||::|:  :|  :|  |||  :|   ||::  |    ||:::||  |:|  ||||
GTSRNTLEMIRNSGIEPTVILYLETPPSRDELLKLIADMGISVRALLRKNVEPYEELGLAEDKFTDDQLIDFMLQHPILI
            30          40          50          60          70          80          90
609         639         669         699         729         759         789         819
NRPIVVTSKGAKLCRPCEAILTILPVKMEKDFVKEDGQIIQSL*HIV**IMV*EVSK*HY*KKLMRLETFCKQKASQHQN
||||||||   |  ||||||  |  :|  |||     :     |  ||||:  :
NRPIVVTPLGTKLCRPSEVVLDILPDAQKAAFTKEDGEKVVDDSGKRLK
              110         120         130         140
```

SEQ ID 9018 (GBS45) was expressed in *E. coli* as a His-fusion product. SDS-PAGE analysis of total cell extract is shown in FIG. 8 (lane 4; MW 18.6 kDa).

The GBS45-His fusion product was purified (FIG. 97A; see also FIG. 191, lane 5) and used to immunise mice (lane 1 product; 20 μg/mouse). The resulting antiserum was used for Western blot (FIG. 97B), FACS (FIG. 97C), and in the in vivo passive protection assay (Table III). These tests confirm that the protein is immunoaccessible on GBS bacteria and that it is an effective protective immunogen.

Based on this analysis, it is predicted that this protein from *S. agalactiae*, and its epitopes, could be useful antigens for vaccines and/or diagnostics.

EXAMPLE 2987

A DNA sequence <SEQ ID 9019> was identified in *S. agalactiae* which encodes amino acid sequence <SEQ ID 9020>. Analysis of the amino acid sequence reveals the following:

```
Lipop: Possible site: -1 Crend: 3
McG: Discrim Score: 6.84
GvH: Signal Score (-7.5): 2.98
     Possible site: 25
>>> Seems to have a cleavable N-term signal seq.
ALOM program    count: 0 value: 13.69 threshold: 0.0
    PERIPHERAL  Likelihood = 13.69      77
  modified ALOM score: -3.24

*** Reasoning Step: 3

----- Final Results -----
              bacterial outside --- Certainty = 0.3000 (Affirmative) < succ>
              bacterial membrane --- Certainty = 0.0000 (Not Clear) < succ>
              bacterial cytoplasm --- Certainty = 0.0000 (Not Clear)
```

A DNA sequence <SEQ ID 10337> was identified in GBS which encodes amino acid sequence <SEQ ID 10338>. This protein and its epitopes could be useful antigens for vaccines and/or diagnostics.

SEQ ID 9020 (GBS55) was expressed in *E. coli* as a His-fusion product. SDS-PAGE analysis of total cell extract is shown in FIG. 17 (lane 7; MW 11.3 kDa). It was also expressed in *E. coli* as a GST-fusion product. SDS-PAGE analysis of total cell extract is shown in FIG. 33 (lane 5; MW 36.3 kDa).

GBS55-GST was purified as shown in FIG. 197, lane 5.

Figure 161:
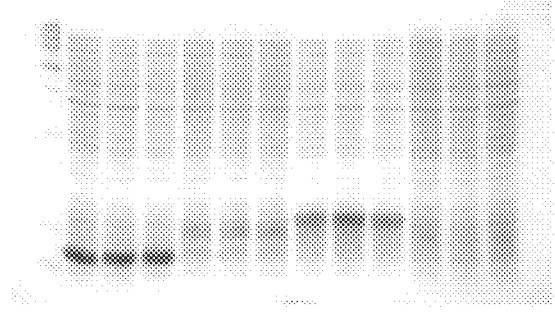

GBS671 was expressed in *E. coli* as a His-fusion product. SDS-PAGE analysis of total cell extract is shown in FIG. 161 (lane 24; MW 12 kDa) and in FIG. 188 (lane 2; MW 12 kDa). Purified protein is shown in FIG. 242, lane 3.

Based on this analysis, it is predicted that this protein from *S. agalactiae*, and its epitopes, could be useful antigens for vaccines and/or diagnostics.

EXAMPLE 2988

A DNA sequence <SEQ ID 9021> was identified in *S. agalactiae* which encodes amino acid sequence <SEQ ID 9022>. Analysis of the amino acid sequence reveals the following:

```
Lipop Possible site: -1 Crend: 3
McG: Discrim Score: -14.35
GvH: Signal Score (-7.5): -2.12
    Possible site: 44
>>> Seems to have no N-terminal signal sequence
ALOM program    count: 4 value: -13.90 threshold: 0.0
   INTEGRAL    Likelihood = -13.90    Transmembrane 101-117
                                      (92-126)
   INTEGRAL    Likelihood = -7.64     Transmembrane 130-146
                                      (125-148)
   INTEGRAL    Likelihood = -6.64     Transmembrane   24-40
                                      (20-45)
   INTEGRAL    Likelihood = -2.44     Transmembrane   55-71
                                      (55-75)
   PERIPHERAL  Likelihood = 17.40            2
 modified ALOM score: 3.28

*** Reasoning Step: 3

----- Final Results -----
              bacterial membrane --- Certainty = 0.6562 (Affirmative) < succ>
              bacterial outside  --- Certainty = 0.0000 (Not Clear)   < succ>
              bacterial cytoplasm --- Certainty = 0.0000 (Not Clear)  < succ>
```

SEQ ID 9022 (GBS215) was expressed in *E. coli* as a GST-fusion product. SDS-PAGE analysis of total cell extract is shown in FIG. 175 (lane 10; MW 45 kDa).

Based on this analysis, it is predicted that this protein from *S. agalactiae*, and its epitopes, could be useful antigens for vaccines and/or diagnostics.

EXAMPLE 2989

A DNA sequence <SEQ ID 9023> was identified in *S. agalactiae* which encodes amino acid sequence <SEQ ID 9024>. Analysis of the amino acid sequence reveals the following:

```
Lipop Possible site: -1 Crend: 0
McG: Discrim Score: 11.66
GvH: Signal Score (-7.5): -5.3
    Possible site: 61
```

-continued
```
>>> Seems to have an uncleavable N-term signal seq
ALOM program    count: 2 value: -14.12 threshold: 0.0
    INTEGRAL    Likelihood = -14.12   Transmembrane 13-29 (5-35)
    INTEGRAL    Likelihood = -8.17    Transmembrane 44-60 (39-65)
    PERIPHERAL  Likelihood = 39.00          29
  modified ALOM score: 3.32

*** Reasoning Step: 3

----- Final Results -----
              bacterial membrane --- Certainty = 0.6647 (Affirmative) < succ>
                bacterial outside --- Certainty = 0.0000 (Not Clear)  < succ>
              bacterial cytoplasm --- Certainty = 0.0000 (Not Clear)  < succ>
```

Figure 156:
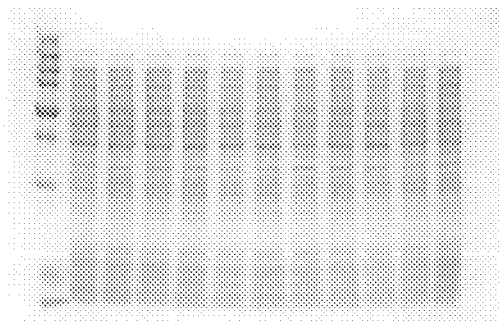

SEQ ID 9024 (GBS217) was expressed in *E. coli* as a GST-fusion product. SDS-PAGE analysis of total cell extract is shown in FIG. 85 (lane 2; MW 36.1 kDa) and in FIG. 156 (lane 1 & 3; MW 36 kDa).

GBS217-GST was purified as shown in FIG. 224, lane 5-6.

Based on this analysis, it is predicted that this protein from *S. agalactiae*, and its epitopes, could be useful antigens for vaccines and/or diagnostics.

EXAMPLE 2990

A DNA sequence <SEQ ID 9025> was identified in *S. agalactiae* which encodes amino acid sequence <SEQ ID 9026>. Analysis of the amino acid sequence reveals the following:

```
Lipop Possible site: -1 Crend: 10
McG: Discrim Score: 8.20
GvH: Signal Score (-7.5): -3.7
     Possible site: 33
>>> Seems to have an uncleavable N-term signal seq
ALOM program    count: 4 value: -9.98 threshold: 0.0
    INTEGRAL    Likelihood = -9.98    Transmembrane   22-38
                                      (12-43)
    INTEGRAL    Likelihood = -7.80    Transmembrane   61-77
                                      (56-85)
    INTEGRAL    Likelihood = -5.20    Transmembrane 121-137
                                      (117-148)
    INTEGRAL    Likelihood = -2.97    Transmembrane  99-115
                                      (98-119)
    PERIPHERAL  Likelihood = 10.77          5
  modified ALOM score: 2.50

*** Reasoning Step: 3

----- Final Results -----
              bacterial membrane --- Certainty = 0.4991 (Affirmative) < succ>
                bacterial outside --- Certainty = 0.0000 (Not Clear)  < succ>
              bacterial cytoplasm --- Certainty = 0.0000 (Not Clear)  < succ>
```

A related DNA sequence <SEQ ID 10701> was identified in GBS which encodes amino acid sequence <SEQ ID 10702>.

Based on this analysis, it is predicted that this protein from *S. agalactiae*, and its epitopes, could be useful antigens for vaccines and/or diagnostics.

EXAMPLE 2991

A DNA sequence <SEQ ID 9027> was identified in *S. agalactiae* which encodes amino acid sequence <SEQ ID 9028>. Analysis of the amino acid sequence reveals the following:

```
Lipop Possible site: -1 Crend: 7
McG: Discrim Score: 10.61
GvH: Signal Score (-7.5): -4.21
     Possible site: 51
>>> Seems to have an uncleavable N-term signal seq
ALOM program   count: 3 value: -10.99 threshold: 0.0
    INTEGRAL    Likelihood = -10.99    Transmembrane 38-54 (33-61)
    INTEGRAL    Likelihood = -8.01     Transmembrane  5-21 (1-26)
    INTEGRAL    Likelihood = -7.01     Transmembrane 65-81 (60-87)
    PERIPHERAL  Likelihood = 13.85           99
  modified ALOM score: 2.70

*** Reasoning Step: 3

----- Final Results -----
             bacterial membrane --- Certainty = 0.5394 (Affirmative) < succ>
              bacterial outside --- Certainty = 0.0000 (Not Clear)  < succ>
            bacterial cytoplasm --- Certainty = 0.0000 (Not Clear)  < succ>
```

Based on this analysis, it is predicted that this protein from *S. agalactiae*, and its epitopes, could be useful antigens for vaccines and/or diagnostics.

EXAMPLE 2992

A DNA sequence <SEQ ID 9029> was identified in *S. agalactiae* which encodes amino acid sequence <SEQ ID 9030>. Analysis of the amino acid sequence reveals the following:

```
Lipop Possible site: -1 Crend: 10
McG: Discrim Score: -21.39
GvH: Signal Score (-7.5): -1.85
     Possible site: 57
>>> Seems to have no N-terminal signal sequence
ALOM program   count: 1 value: -8.44  threshold: 0.0
    INTEGRAL    Likelihood = -8.44     Transmembrane 38-54 (36-59)
    PERIPHERAL  Likelihood = 19.10           18
  modified ALOM score: 2.19

*** Reasoning Step: 3

----- Final Results -----
             bacterial membrane --- Certainty = 0.4376 (Affirmative) < succ>
              bacterial outside --- Certainty = 0.0000 (Not Clear)  < succ>
            bacterial cytoplasm --- Certainty = 0.0000 (Not Clear)  < succ>
```

Based on this analysis, it is predicted that this protein from *S. agalactiae*, and its epitopes, could be useful antigens for vaccines and/or diagnostics.

EXAMPLE 2993

A DNA sequence <SEQ ID 9031> was identified in *S. agalactiae* which encodes amino acid sequence <SEQ ID 9032>. Analysis of the amino acid sequence reveals the following:

```
Lipop Possible site: -1 Crend: 5
McG: Discrim Score: 12.87
GvH: Signal Score (-7.5): -3.57
     Possible site: 41
>>> Seems to have an uncleavable N-term signal seq
ALOM program   count: 4                value: -10.30   threshold: 0.0
    INTEGRAL    Likelihood = -10.30    Transmembrane   69-85 (63-98)
    INTEGRAL    Likelihood = -8.65     Transmembrane    4-20 (1-29)
    INTEGRAL    Likelihood = -2.07     Transmembrane   96-112 (95-118)
    PERIPHERAL  Likelihood = 9.71           113
```

-continued

```
modified ALOM score: 2.56

*** Reasoning Step: 3

----- Final Results -----
            bacterial membrane --- Certainty = 0.5118 (Affirmative) < succ>
             bacterial outside --- Certainty = 0.0000 (Not Clear)   < succ>
           bacterial cytoplasm --- Certainty = 0.0000 (Not Clear)   < succ>
```

The protein has homology with the following sequences in the databases:

```
20.1/50.5% over 114aa

Streptococcus pneumoniae
  GP|9798572| BlpX protein Insert characterized

ORF02100(316 - 660 of 999)
GP|9798572|emb|CAC03527.1||AJ276410(9 - 123 of 132) BlpX protein {Streptococcus
pneumoniae}
% Match = 5.0
% Identity = 20.0  % Similarity = 50.4
Matches = 23  Mismatches = 57  Conservative Sub.s = 35
        90        120       150       180       210       240       270       300
LMSLF*DPQVSGEELDKFTVRLDSHRKSNSRG*NQLVIILRLYSQIN*REPNMLVGPFLNKGEHMTQDYICYL*SRGGED MEV
      330       360       390       420       450       480       510       540
MHNILRFLGIVIISAVILFSIGSFYDLTLMKNILLICWSFLFDLLVFVFKQRQTTEVLTWYQVVKQFWLFIKCTILIPIL
    :   |:: :: :|:|:    :|:|  ::::     |: :| ||:  ||::  :     :    : :|:    |:    ||
FNMKYRLFFVIFLSSVLDILLGTFLQISIVSIGWLVLYSGLFEAGVFLLANKGVAVKIKEVDIRNRFKFIFGKTLWFQIL
           20        30        40        50        60        70        80
      570       600       630       660       690       720       750       780
VAFIIMKGCLTSISDILIYFYLHLVVVYYTIGMILSLGRIISPEHSMFNKLRK*NELYLKFVFNRADLTICCLPCLS*FF
    :   :: :          || ||  |: :|:  :   :||   ::    :: :  :
LLIFLIIKLYLGLDARLILFYGHIFIVFNALMYLLSSSQVSLKKNKLSS
           100       110       120       130
```

Based on this analysis, it is predicted that this protein from *S. agalactiae*, and its epitopes, could be useful antigens for vaccines and/or diagnostics.

EXAMPLE 2994

A DNA sequence <SEQ ID 9033> was identified in *S. agalactiae* which encodes amino acid sequence <SEQ ID 9034>. Analysis of the amino acid sequence reveals the following:

```
Lipop Possible site: -1 Crend: 9
McG: Discrim Score: 3.25
GvH: Signal Score (-7.5): -3.39
     Possible site: 59
>>> Seems to have an uncleavable N-term signal seq
ALOM program       count: 4               value: -6.64        threshold: 0.0
   INTEGRAL        Likelihood = -6.64     Transmembrane       46-62 (43-64)
   INTEGRAL        Likelihood = -5.15     Transmembrane       17-33 (15-34)
   PERIPHERAL      Likelihood = 11.03     100
modified ALOM score: 1.83

*** Reasoning Step: 3

----- Final Results -----
            bacterial membrane --- Certainty = 0.3654 (Affirmative) < succ>
             bacterial outside --- Certainty = 0.0000 (Not Clear)   < succ>
           bacterial cytoplasm --- Certainty = 0.0000 (Not Clear)   < succ>
```

The protein has homology with the following sequences in the databases:

```
35.5/63.8% over 127aa

OMNI|NT01BS4455| wall teichoic acid glycosylation protein GtcA Insert characterized ORF01715(343-750 of 1053)
OMNI|NT01BS4455(58-185 of 187) wall teichoic acid glycosylation protein GtcA
% Match = 8.0
% Identity = 35.5  % Similarity = 63.7
Matches = 44  Mismatches = 39  Conservative Sub.s = 35
210        240        270        300        330        360        390        411
GN*ASRVV*NNLLSISQTKSKAKLMGDFLITLKHP*YNKNMVKLKSLLKKSIQNEVSLYLLFGLLTSLLYLV---IRQGI
   : :       :            : :| |       :          ::          |: :|:: |::|::: :     |   |
PRRNHQTIICIGPASHLPQLFRRTLGIFYFRQRAREAKNFEKFFRKRGTSVKYREIIMYIIMGVFTTIVNIASFYILVEI
              20         30         40         50         60         70         80
441        471        501        531        549        579        609        639
FNFSQDAPFSAIVANIIAILFAFFTNDRFVFKQTKIEQLQRL----QTFVIARLGTLGLDLILAVIFVDQFPSIIGQFVQ
  |     |   : : |  |:::|||: ||  :||:| |       || |         |     |: :||:|| : :|:| ||
MNVDYKA--ATVAAWILSVLFAYITNKLYVFQQ-KTHDLQSLLKELTAFFSVRVLSLGIDLGMMIILVGQF---------
               100        110        120        130        140        150
669        690        720        750        780        810        840        870
HNLNKINTIESL---VSQILIILLNYILSKFVIFKDKKRQL*QELSFLIFLLWIFG*ET*YLHALIQFFLSQFLERWHSV
   ||  |:|      :     :|:::||: ||:::||   | :
------NTNETLAKILDNAVIVVVNYVASKWLVFKKTKEEGV
              160        170        180
```

Figure 63:
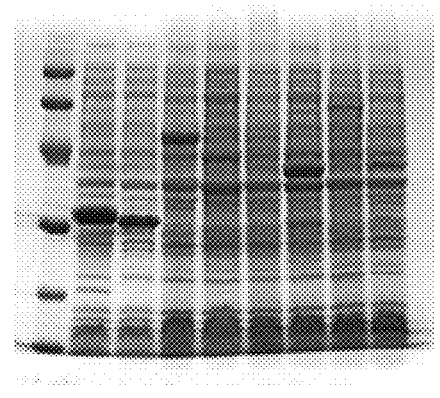

SEQ ID 9034 (GBS283) was expressed in *E. coli* as a GST-fusion product. SDS-PAGE analysis of total cell extract is shown in FIG. 63 (lane 8; MW 67.6 kDa).

Based on this analysis, it is predicted that this protein from *S. agalactiae*, and its epitopes, could be useful antigens for vaccines and/or diagnostics.

EXAMPLE 2995

A DNA sequence <SEQ ID 9035> was identified in *S. agalactiae* which encodes amino acid sequence <SEQ ID 9036>. Analysis of the amino acid sequence reveals the following:

```
Lipop Possible Site: -1 Crend: 2
SRCFLG: 0
McG: Length of UR: 22
     Peak Value of UR: 3.86
     Net Charge of CR: 2
McG: Discrim Score: 16.84
GvH: Signal Score (-7.5): -4.38
     Possible site: 21
>>> Seems to have an uncleavable N-term signal seq
Amino Acid Composition: calculated from 1
ALOM program     count: 1              value: -12.37    threshold: 0.0
   INTEGRAL      Likelihood = -12.37    Transmembrane   7-23 (1-26)
   PERIPHERAL    Likelihood = 12.84          64
modified ALOM score: 2.97
icm1 HYPID: 7 CFP: 0.595

*** Reasoning Step: 3

----- Final Results -----
               bacterial membrane --- Certainty = 0.5946 (Affirmative) < succ>
               bacterial outside  --- Certainty = 0.0000 (Not Clear)   < succ>
               bacterial cytoplasm --- Certainty = 0.0000 (Not Clear)   < succ>
```

SEQ ID 9036 (GBS286) was expressed in *E. coli* as a His-fusion product. SDS-PAGE analysis of total cell extract is shown in FIG. 52 (lane 11; MW 16.4 kDa). It was also expressed in *E. coli* as a GST-fusion product. SDS-PAGE analysis of total cell extract is shown in FIG. 59 (lane 2; MW 41.3 kDa) and in FIG. 63 (lane 9; MW 41.4 kDa).

Figure 274:
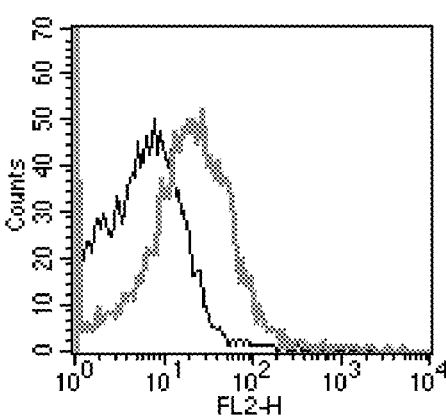

The GBS286-GST fusion product was purified (FIG. 210, lane 9; FIG. 225, lane 9) and used to immunise mice. The resulting antiserum was used for FACS (FIG. 274), which confirmed that the protein is immunoaccessible on GBS bacteria.

Figure 139:
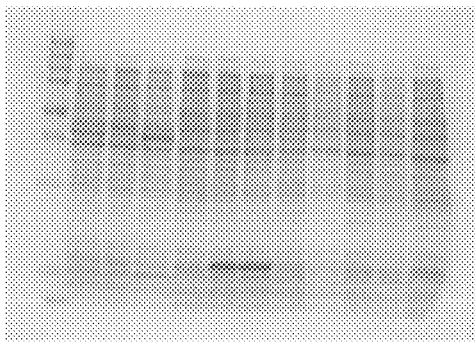

GBS668 was expressed in *E. coli* as a GST-fusion product. SDS-PAGE analysis of total cell extract is shown in FIG. 139 (lane 2-4; MW 43.5 kDa) and in FIG. 187 (lane 6; MW 43 kDa). It was also expressed in *E. coli* as a His-fusion product. SDS-PAGE analysis of total cell extract is shown in FIG. 139 (lane 6 & 7; MW 18.6 kDa) and in FIG. 179 (lane 12; MW 19 kDa).

GBS668-GST was purified as shown in FIG. 237 (lane 10). GBS668-His was purified as shown in FIG. 231 (lanes 5 & 6).

Figure 162:
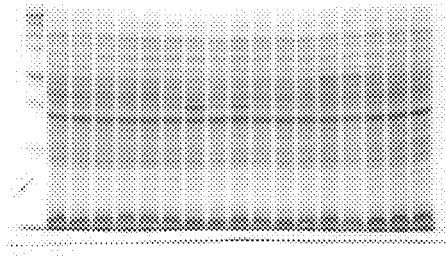

GBS673 was expressed in *E. coli* as a His-fusion product. SDS-PAGE analysis of total cell extract is shown in FIG. 161 (lane 8-10; MW 17 kDa) and in FIG. 188 (lane 4; MW 17 kDa). It was also expressed in *E. coli* as a GST-fusion product. SDS-PAGE analysis of total cell extract is shown in FIG. 162 (lane 8; MW 41.5 kDa) and in FIG. 239 (lane 7; MW 41 kDa). Purified GBS673-His is shown in FIG. 242, lane 5. Purified GBS673-GST is shown in FIG. 246, lane 2.

Based on this analysis, it is predicted that this protein from *S. agalactiae*, and its epitopes, could be useful antigens for vaccines and/or diagnostics.

EXAMPLE 2996

A DNA sequence <SEQ ID 9037> was identified in *S. agalactiae* which encodes amino acid sequence <SEQ ID 9038>. Analysis of the amino acid sequence reveals the following:

```
Lipop: Possible site: -1 Crend: 6
McG: Discrim Score: -18.42
GvH: Signal Score (-7.5): -6.16
     Possible site: 57
>>> Seems to have no N-terminal signal sequence
ALOM program      count: 2              value: -8.49       threshold: 0.0
    INTEGRAL      Likelihood = -8.49    Transmembrane      51-67 (44-95)
    INTEGRAL      Likelihood = -3.08    Transmembrane      70-86 (68-95)
    PERIPHERAL    Likelihood = 12.89        32
modified ALOM score: 2.20

*** Reasoning Step: 3

----- Final Results -----
              bacterial membrane --- Certainty = 0.4397 (Affirmative) < succ>
               bacterial outside --- Certainty = 0.0000 (Not Clear)   < succ>
             bacterial cytoplasm --- Certainty = 0.0000 (Not Clear)   < succ>
```

SEQ ID 9038 (GBS386) was expressed in *E. coli* as a His-fusion product. SDS-PAGE analysis of total cell extract is shown in FIG. 70 (lane 2; MW 14 kDa). It was also expressed in *E. coli* as a GST-fusion product. SDS-PAGE analysis of total cell extract is shown in FIG. 72 (lane 8; MW 39.5 kDa).

GBS386-GST was purified as shown in FIG. 213, lane 8.

Based on this analysis, it is predicted that this protein from *S. agalactiae*, and its epitopes, could be useful antigens for vaccines and/or diagnostics.

EXAMPLE 2997

A DNA sequence <SEQ ID 9039> was identified in *S. agalactiae* which encodes amino acid sequence <SEQ ID 9040>. Analysis of the amino acid sequence reveals the following:

```
Lipop: Possible site: -1 Crend: 8
McG: Discrim Score: -15.47
GvH: Signal Score (-7.5): -6.21
     Possible site: 14
>>> Seems to have no N-terminal signal sequence
ALOM program     count: 2              value: -3.61       threshold: 0.0
   INTEGRAL      Likelihood = -3.61    Transmembrane      94-110 (94-111)
   INTEGRAL      Likelihood = -1.70    Transmembrane      75-91 (75-91)
   PERIPHERAL    Likelihood = 5.94     139
modified ALOM score: 1.22

*** Reasoning Step: 3

----- Final Results -----
              bacterial membrane --- Certainty = 0.2444 (Affirmative) < succ>
                bacterial outside --- Certainty = 0.0000 (Not Clear)  < succ>
              bacterial cytoplasm --- Certainty = 0.0000 (Not Clear)  < succ>
```

The protein has homology with the following sequences in the databases:

```
ORF01481(394-720 of 1065)
GP|9657521|gb|AAF96047.1||AE004354(16-121 of 243) uridine phosphorylase {Vibrio
cholerae}
% Match = 5.3
% Identity = 28.0  % Similarity = 48.6
Matches = 30  Mismatches = 54  Conservative Sub.s = 22
150       180       210       240       270       300       330       360
V*KHMV*AI*YGNLP*KW*IVPLSIFIFANLTLPFKFH*VKIEKIFLTR**NIVN*GLKEMLMIINSFDNSRKAIINPED MSIQ
390       420       450       480       510       540       570       600
INSPIKGFPKTVITCFARETFNRILEELPHREIARTSVANLEIPIYELEFKGQKIGFFNAYVGASACVAILEDIIVFGME
          |:  |     |||     |  : |      |  | : : :| |   :  :|| :  :  :|::      |  :
PHIHVAQVAPRVVVCGEPNRANRIASLLNNAE---LVAENREYRLFSGEFEEQPITVCSTGIGAPSMIIAVEELARSGAK
            20        30        40        50        60        70        80
630       660       690       720       750       780       810       840
SLIVFGTCGVLDSSIEETSIIIPRSAIRDEGTSFHYSEASSEIAVNTNSIFLLCG*FRCRSMGSKIFRK*RGFRKER*NC
:::   |:  |  :  |  |     :|:   |:||||  |    |  |:
AIVRVGSAGAMQSEIGLGELILVEGAVRDEGGSKAYIGAAYPAYSSFELVVEMQRFLAEQSVPIHRGIVRSHDSFYTDEE
             100       110       120       130       140       150       160
```

SEQ ID 9040 (GBS388) was expressed in *E. coli* as a His-fusion product. SDS-PAGE analysis of total cell extract is shown in FIG. 70 (lane 3; MW 21 kDa). It was also expressed in *E. coli* as a GST-fusion product. SDS-PAGE analysis of total cell extract is shown in FIG. 72 (lane 9; MW 45.6 kDa).

Figure 311:
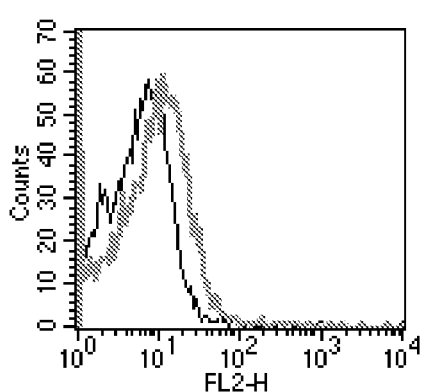

The GBS388-GST fusion product was purified (FIG. 213, lane 10) and used to immunise mice. The resulting antiserum was used for FACS (FIG. 311), which confirmed that the protein is immunoaccessible on GBS bacteria.

Based on this analysis, it is predicted that this protein from *S. agalactiae*, and its epitopes, could be useful antigens for vaccines and/or diagnostics.

EXAMPLE 2998

A DNA sequence <SEQ ID 9041> was identified in *S. agalactiae* which encodes amino acid sequence <SEQ ID 9042>. Analysis of the amino acid sequence reveals the following:

```
Lipop: Possible site: -1 Crend: 9
McG: Discrim Score: -11.81
GvH: Signal Score (-7.5): -7.49
     Possible site: 25
>>> Seems to have no N-terminal signal sequence
```

```
ALOM program      count: 1              value: -5.68         threshold: 0.0
  INTEGRAL        Likelihood = -5.68    Transmembrane        78-94 (77-95)
  PERIPHERAL      Likelihood = 4.61     134
modified ALOM score: 1.64

*** Reasoning Step: 3

----- Final Results -----
              bacterial membrane --- Certainty = 0.3272 (Affirmative) < succ>
              bacterial outside  --- Certainty = 0.0000 (Not Clear)   < succ>
              bacterial cytoplasm --- Certainty = 0.0000 (Not Clear)  < succ>
```

The protein has homology with the following sequences in the databases:

```
ORF01912(307-720 of 1056)
GP|3845252|gb|AAC71927.1||AE001412(81-242 of 244) hypothetical protein {Plasmodium
falciparum} PIR|D71608|D71608 hypothetical protein PFB0690w - malaria parasite
(Plasmodium falciparum)
% Match = 4.0
% Identity = 31.2  % Similarity = 53.5
Matches = 45  Mismatches = 58  Conservative Sub.s = 32
   231         261         291              348         378         405
KKGRFLIDLYCNVMNFKNSKIA*NQCFDV**RVVNHLLN-LSKENIAKIDFDFLNEALNA-NIRLKELVDELKISK----
                        ||  :  |  :: :  |:  |     |     :    :||   |   ||  |
KYNELQSLLSKEEEKYDFVKNELGDLQKQKDLLKWHLCNNIKKLSMKRSDYKFKTETKSKLESKLKSLKDMNKIHKFEHD
            60          70          80          90          100         110         120
    450         480         501         531         558         588         618
----------ELDSKGWSKKDSRTIKILYDGLINK---HIVSLDRADYNII-QVIPFANVHVLLFLIPERENSKNYRIY
          ||::|  :  |    |:  :::   |||     ::   :       :       |    |:||  ::||:|||  |
TLEELVHKMEQELETKMYIKND---IENIFNECINKKDEYLKDITQERISVFKERKKRQNQLQKLLLIMKQENNKNYNIN
            140         150         160         170         180         190         200
    648         672         693         720         750         780         810         840
NYSDYEMELINE--DRQQFSKYET---VDL-DQLILVDIFNIDDYISSYLTI*DIENLDLGLLKLINYADNKSDRHILQT
    ||   |:||         :    :||    :||   |    |  |::
YLKKYESNLMNEINSYKNYKDFETKIAMDLIDDHSLNDLYVT
              220         230         240
```

A related DNA sequence <SEQ ID 10589> was identified in GBS which encodes amino acid sequence <SEQ ID 10590>.

SEQ ID 9042 (GBS408) was expressed in *E. coli* as a His-fusion product. SDS-PAGE analysis of total cell extract is shown in FIG. 76 (lane 6; MW 20.4 kDa). It was also expressed in *E. coli* as a GST-fusion product. SDS-PAGE analysis of total cell extract is shown in FIG. 171 (lane 5; MW 45.3 kDa).

GBS408-GST was purified as shown in FIG. 218, lane 9.

Based on this analysis, it is predicted that this protein from *S. agalactiae*, and its epitopes, could be useful antigens for vaccines and/or diagnostics.

EXAMPLE 2999

A DNA sequence <SEQ ID 9043> was identified in *S. agalactiae* which encodes amino acid sequence <SEQ ID 9044>. Analysis of the amino acid sequence reveals the following:

```
Lipop: Possible site: -1 Crend: 9
McG: Discrim Score: -9.62
GvH: Signal Score (-7.5): -4.84
     Possible site: 61
>>> Seems to have no N-terminal signal sequence
ALOM program      count: 2              value: -11.09        threshold: 0.0
  INTEGRAL        Likelihood = -11.09   Transmembrane        45-61 (37-72)
  INTEGRAL        Likelihood = -8.60    Transmembrane        76-92 (70-97)
  PERIPHERAL      Likelihood = 11.62    95
modified ALOM score: 2.72
```

```
*** Reasoning Step: 3

----- Final Results -----
         bacterial membrane --- Certainty = 0.5437 (Affirmative) < succ>
         bacterial outside  --- Certainty = 0.0000 (Not Clear)  < succ>
        bacterial cytoplasm --- Certainty = 0.0000 (Not Clear)  < succ>
```

The protein has homology with the following sequences in the databases:

```
ORF01977(442-627 of 948)
EGAD|88220|96064(204-583 of 751) hypothetical 848 kDa protein f23f125 in chromosome
iii {Caenorhabditis elegans} SP|P46501|YLX5_CAEEL HYPOTHETICAL 84.8 KDA PROTEIN
F23F12.5 IN CHROMOSOME III. GP|529214|gb|AAA20607.1||U12965 F23F12.5 gene product
{Caenorhabditis elegans}
% Match = 4.6
% Identity = 35.9  % Similarity = 59.4
Matches = 23  Mismatches = 24  Conservative Sub.s = 15
192         222         252         282         312         342         372         402
DFVSSFFIS*SQTNYNRISFLLKLAKHQLECLNNVAQGLSV**YSSMKDYINRILHFIKEHMTYHVNFIDDFLDIKWEKV VTLSAYFPFTITVERYYAMNKSEKYEKMPIILGPLFVLFIVKLELKIKDKVTLFQVIVNFGVIFQIYKNETFSHGDVAFS
        120         130         140         150         160         170         180         190
432         462         492         522         552
SNIHLRFWTTIIAYLVIFILSISTVILNLVLLFQGFLTQNPIIYLLFFITLVCAFY----------------------~~~~
            |:|:|::::  |::||||| ||  |  :| ||:    |:
LYPPGTAEKVFTFYVVLFLINLLDVMFNLVLLQMSFLNTNRFHWLCFFLWQFALFFCCQQIFSIFYNFSPGLSCDD~~~~
        200         210         220         230         240         250         260
600     627         657         687         717         747
-------------------FAYKFITYTPTIVKNAL-QYIKKLKNV*NNKVICTLTLYQLCFRVFFHTKITKKDSYLTI
                   |  :  :  || |:   :  |  ||
AGNFYLSQFVSGAVTAFAKIFVFLLDTYVPSFDRRRLHQYPQIAMILCYCVIMVLMILPESDCGSQGSRDLAIIIINIIG
              560         570         580         590         600         610         620
```

SEQ ID 9044 (GBS411) was expressed in *E. coli* as a His-fusion product. SDS-PAGE analysis of total cell extract is shown in FIG. 78 (lane 2; MW 16 kDa).

Based on this analysis, it is predicted that this protein from *S. agalactiae*, and its epitopes, could be useful antigens for vaccines and/or diagnostics.

EXAMPLE 3000

A DNA sequence <SEQ ID 9045> was identified in *S. agalactiae* which encodes amino acid sequence <SEQ ID 9046>. Analysis of the amino acid sequence reveals the following:

```
Lipop: Possible site: -1 Crend: 6
McG: Discrim Score: -17.94
GvH: Signal Score (-7.5): -4.63
     Possible site: 45
>>> Seems to have no N-terminal signal sequence
ALOM program   count: 1 value: -6.10 threshold: 0.0
    INTEGRAL    Likelihood = -6.10   Transmembrane 31-47 (26-49)
    PERIPHERAL  Likelihood = 15.33          3
  modified ALOM score: 1.72

*** Reasoning Step: 3

----- Final Results -----
         bacterial membrane --- Certainty = 0.3442 (Affirmative) < succ>
         bacterial outside  --- Certainty = 0.0000 (Not Clear)  < succ>
        bacterial cytoplasm --- Certainty = 0.0000 (Not Clear)  < succ>
```

The protein has homology with the following sequences in the databases:

```
ORF01982(313-501 of 801)
GP|2444082|gb|AAC79518.1||U88974(93-156 of 156) ORF2 {Streptococcus thermophilus
temperate bacteriophage O1205} PIR|T13290|T13290 hypothetical protein 2 -
Streptococcus phage phi-O1205
% Match = 11.5
% Identity = 48.4  % Similarity = 59.4
Matches = 31  Mismatches = 25  Conservative Sub.s = 7
174         204         234         264         294         324         354         384
DVDQNIESHKLFKRHFV*RAILPQSKRK*EN**LCVISEPR*KLKSKLGELKMGFFAQRCPYCQSTKVQFMNQDRKGFNG
                                                   | :||||:|| |:|| | || |:
LLMFVGVALLFARLFWEIKHPMTKEQKEQLKIERAKAKEEFRKSRNEFKKAMAEARAVKCPYCKSTDVEFMVQQRKSFSI
          50          60          70          80          90         100         110
414         441         471         501         531         561         591         621
CVGCIGFLIAWPF-LLLGLVGKKGKNNWHCTNCGRTFKTK*KSPTLKFCPRRA*GKF*YSKNLLFGRGFYHTYFNRK*GI
    | ::      | |: |||||  ||| |||  | ||
GKAAAGTIMTGGVGALAGFAGKKGKKEWHCKNCGAVFTTK
           130         140         150
```

SEQ ID 9046 (GBS412) was expressed in *E. coli* as a GST-fusion product. SDS-PAGE analysis of total cell extract is shown in FIG. 171 (lane 6; MW 36 kDa). Purified GBS412-GST is shown in FIG. 218, lane 10-11.

Based on this analysis, it is predicted that this protein from *S. agalactiae*, and its epitopes, could be useful antigens for vaccines and/or diagnostics.

EXAMPLE 3001

A DNA sequence <SEQ ID 9047> was identified in *S. agalactiae* which encodes amino acid sequence <SEQ ID 9048>. Analysis of the amino acid sequence reveals the following:

```
Lipop: Possible site: -1 Crend: 0
McG: Discrim Score: 3.67
GvH: Signal Score (-7.5): -3.62
     Possible site: 41
>>> Seems to have an uncleavable N-term signal seq
ALOM program   count: 5 value: -7.27  threshold: 0.0
    INTEGRAL    Likelihood = -7.27    Transmembrane   48-64 (32-
                                      68)
    INTEGRAL    Likelihood = -6.26    Transmembrane   87-103 (85-
                                      105)
    INTEGRAL    Likelihood = -6.21    Transmembrane   29-45 (26-
                                      46)
    INTEGRAL    Likelihood = -3.29    Transmembrane 110-126 (109-
                                      130)
    INTEGRAL    Likelihood = -2.87    Transmembrane    2-18 (1-18)
    PERIPHERAL  Likelihood = 4.24        66
 modified ALOM score: 1.95

*** Reasoning Step: 3

----- Final Results -----
            bacterial membrane --- Certainty = 0.3909 (Affirmative) < succ>
            bacterial outside  --- Certainty = 0.0000 (Not Clear)   < succ>
            bacterial cytoplasm --- Certainty = 0.0000 (Not Clear)  < succ>
```

The protein has homology with the following sequences in the databases:

```
ORF01286(304-672 of 993)
GP|8272442|dbj|BAA96471.1||AB036428(90-212 of 218) type IV prepilin peptidase
homologue {Streptococcus mutans}
% Match = 16.8
% Identity = 46.3  % Similarity = 72.4
Matches = 57  Mismatches = 34  Conservative Sub.s = 32
102         132         162         192         222         252         282         312
*RRLPI*T*IPNFFKRFCTSNKTFIYEF*QKTIQFSRKSATAC*LSL*R*TDYL**KS*SLFYHFSNININYKKDFMIMS
                                                                                  :::
LGSFFGLVVDRYPQKSIIFPRSHCNKCYNCLTMRDLIPIFSRIINKNSCRFCGYPIPLRYSLVELLCGLISTGFALDLLT
          30          40          50          60          70          80          90
342         372         402         432         462         492         522         552
TIYFISLCMSFILSYYDIKYQEYPIFLWILFTISTIILTPITKVSIVLCLFGILAEVVDINIGSGDFLYLATIGLSLPLH
|    |  |  :|| ||::  | ||: ||| ||   : : |:   :|::| ||||:| : :||||||||:||||: ||| |:
TSQVCLLFMGVLLSLYDLQDQSYPLTLWIGFTFLLMFIYPLNLISLILFLFGIFAALKNINIGSGDFFYLATLALSLNLQ
          110         120         130         140         150         160         170
582         612         642         672         702         732         762         792
QMLFIIQIGAWLGIIYCLVMRKMKKTIAFLPFLSIAYIIVTSYSLLF*SL*IIRKVIKLWVLVAFWIFRMTNCTTKINHG
|:::||||  :  |||:|  |: :|  |:    ||:|||  :  ::|:
QIIWIIQIASLLGILYSLLFQKHKEPFAFVPFLFLGHLIIIFSHLI
          190         200         210
```

Based on this analysis, it is predicted that this protein from *S. agalactiae*, and its epitopes, could be useful antigens for vaccines and/or diagnostics.

EXAMPLE 3002

A DNA sequence <SEQ ID 9049> was identified in *S. agalactiae* which encodes amino acid sequence <SEQ ID 9050>. Analysis of the amino acid sequence reveals the following:

```
Lipop: Possible site: -1 Crend: 2
McG: Discrim Score: 10.43
GvH: Signal Score (-7.5): -4.39
     Possible site: 54
>>> Seems to have an uncleavable N-term signal seq
ALOM program   count: 4 value: -10.30 threshold: 0.0
   INTEGRAL    Likelihood = -10.30   Transmembrane   62-78 (59-
                                     84)
   INTEGRAL    Likelihood = -6.10    Transmembrane    4-20 (1-22)
   INTEGRAL    Likelihood = -4.25    Transmembrane 128-144 (123-
                                     145)
   INTEGRAL    Likelihood = -3.13    Transmembrane  88-104 (87-
                                     104)
   PERIPHERAL  Likelihood = 2.01         109
 modified ALOM score: 2.56

*** Reasoning Step: 3

----- Final Results -----
               bacterial membrane --- Certainty = 0.5118 (Affirmative) < succ>
                bacterial outside --- Certainty = 0.0000 (Not Clear) < succ>
              bacterial cytoplasm --- Certainty = 0.0000 (Not Clear) < succ>
```

The protein has homology with the following sequences in the databases:

```
SP|Q48729|LSPA_LACLC(1-149 of 150) LIPOPROTEIN SIGNAL PEPTIDASE (EC 3.4.23.36)
(PROLIPOPROTEIN SIGNAL PEPTIDASE) (SIGNAL PEPTIDASE II) (SPASE II).
% Match = 16.3
% Identity = 40.7  % Similarity = 66.0
Matches = 61  Mismatches = 50  Conservative Sub.s = 38
```

-continued

```
180         210         240         270         300         330         360         390
EWYHCYSIRRSSR*PNDLYQTKRS*FISDGFKICCCYGRVF*GI*FIGEVMRKIIIPIITILLIALDQLSKLWIVKHIEL
                                                   |:|::   :|  ::  |   ||:  |  |:|  :|:|
                                                   MKKLLSLVIIVVGIIADQVFKNWVVANIQL
                                                        10          20          30
420         450         480         510         540         570         600         630
NQIKEFIPNIVSLTYLRNYGAAFSILQNQQWLFTLITIFVVGVAIIYLMKHINGSYWLLISLTLIISGGLGNFIDRLRLG
   |:   |:::|||::|  |||:|  :    |||:|  ::|   |:  ||: :|   |    |  :   |||||:|  |||::  |:|  |
GDTKKIWPDVLSLTYIKNDGAAWSSFSGQQWFFLVLTPIVLIVALWFLWKK-MGQNWYFAGLTLIIAGALGNLLTRVRQG
         40          50          60          70          80          90          100
660         690         720         750         780         810         840         870
YVVDMVHLDFINFAIFNVADSYLTIGIICLMIALWKEESNGNHN*NSRS*AR*SFSG*F*TVA*SS**RN*KRDCVSKWT
:||||        :|  |||:||  |::|  :  |  ||:    ::
FVVDMFXNRIYDFPIFNIADILLSVGFVVLFIAILTDKETK
         120         130         140         150
```

There is also homology to SEQ ID 7750.

Based on this analysis, it is predicted that this protein from *S. agalactiae*, and its epitopes, could be useful antigens for vacc

EXAMPLE 3003

A DNA sequence <SEQ ID 9051> was identified in *S. agalactiae* which encodes amino acid sequence <SEQ ID 9052>. Analysis of the amino acid sequence reveals the following:

```
Lipop: Possible site: -1 Crend: 7
McG: Discrim Score: 13.24
GvH: Signal Score (-7.5): -2.18
      Possible site: 19
>>> Seems to have a cleavable N-term signal seq.
ALOM program    count: 0 value: 2.01 threshold: 0.0
    PERIPHERAL  Likelihood = 2.01      21
  modified ALOM score: -0.90

*** Reasoning Step: 3

----- Final Results -----
              bacterial outside --- Certainty = 0.3000 (Affirmative) < succ>
              bacterial membrane --- Certainty = 0.0000 (Not Clear)  < succ>
              bacterial cytoplasm --- Certainty = 0.0000 (Not Clear) < succ>
```

The protein has no homology with any sequences in the databases.

SEQ ID 9052 (GBS138) was expressed in *E. coli* as a His-fusion product. SDS-PAGE analysis of total cell extract is shown in FIG. 19 (lane 2; MW 15 kDa)

GBS672 was expressed in *E. coli* as a His-fusion product. SDS-PAGE analysis of total cell extract is shown in FIG. 161 (lane 5-7; MW 15 kDa) and in FIG. 188 (lane 3; MW 15 kDa). Purified protein is shown in FIG. 242, lane 4.

Based on this analysis, it is predicted that this protein from *S. agalactiae*, and its epitopes, could be useful antigens for vaccines and/or diagnostics.

EXAMPLE 3004

A DNA sequence <SEQ ID 9053> was identified in *S. agalactiae* which encodes amino acid sequence <SEQ ID 9054>. Analysis of the amino acid sequence reveals the following:

```
Lipop: Possible site: -1 Crend: 8
McG: Discrim Score: 18.01
GvH: Signal Score (-7.5): -2.35
    Possible site: 26
>>> Seems to have a cleavable N-term signal seq.
ALOM program count: 0 value: 14.80 threshold: 0.0
   PERIPHERAL Likelihood = 14.80     51
modified ALOM score: -3.46
*** Reasoning Step: 3

----- Final Results -----
            bacterial outside --- Certainty = 0.3000(Affirmative) < succ>
            bacterial membrane --- Certainty = 0.0000(Not Clear) < succ>
            bacterial cytoplasm --- Certainty = 0.0000(Not Clear) < succ>
```

SEQ ID 9054 (GBS143) was expressed in *E. coli* as a GST-fusion product. SDS-PAGE analysis of total cell extract is shown in FIG. 23 (lane 2; MW 33.5 kDa).

Based on this analysis, it is predicted that this protein from *S. agalactiae*, and its epitopes, could be useful antigens for vaccines and/or diagnostics.

EXAMPLE 3005

A DNA sequence <SEQ ID 9055> was identified in *S. agalactiae* which encodes amino acid sequence <SEQ ID 9056>. Analysis of the amino acid sequence reveals the following:

```
Lipop Possible site: -1 Crend: 0
McG: Discrim Score: 7.43
GvH: Signal Score (-7.5): -6.25
    Possible site: 41
>>> Seems to have an uncleavable N-term signal seq
ALOM program count: 1 value: -10.77 threshold: 0.0
    INTEGRAL     Likelihood = -10.77    Transmembrane    2-18 (1-20)
    PERIPHERAL   Likelihood = 5.14      29
modified ALOM score: 2.65
*** Reasoning Step: 3

----- Final Results -----
            bacterial membrane --- Certainty = 0.5310(Affirmative) < succ>
            bacterial outside --- Certainty = 0.0000(Not Clear) < succ>
            bacterial cytoplasm --- Certainty = 0.0000(Not Clear) < succ>
```

SEQ ID 9056 (GBS229) was expressed in *E. coli* as a GST-fusion product. SDS-PAGE analysis of total cell extract is shown in FIG. 55 (lane 3; MW 35.9 kDa).

GBS229-GST was purified as shown in FIG. 206, lane 5.

Based on this analysis, it is predicted that this protein from *S. agalactiae*, and its epitopes, could be useful antigens for vaccines and/or diagnostics.

EXAMPLE 3006

A DNA sequence <SEQ ID 9183> was identified in GAS which encodes amino acid sequence <SEQ ID 9184>. Analysis of the amino acid sequence reveals the following:

```
Possible site: 29
>>> Seems to have a cleavable N-term signal seq.

----- Final Results -----
            bacterial outside --- Certainty = 0.3000(Affirmative) < succ>
            bacterial membrane --- Certainty = 0.0000(Not Clear) < succ>
            bacterial cytoplasm --- Certainty = 0.0000(Not Clear) < succ>
```

Based on this analysis, it is predicted that this GAS protein, and its epitopes, could be useful antigens for vaccines and/or diagnostics.

EXAMPLE 3007

A DNA sequence <SEQ ID 9185> was identified in GAS which encodes amino acid sequence <SEQ ID 9186>. Analysis of the amino acid sequence reveals the following:

```
Possible site: 28
>>> Seems to have a cleavable N-term signal seq.

----- Final Results -----
              bacterial outside --- Certainty = 0.3000(Affirmative) < succ>
             bacterial membrane --- Certainty = 0.0000(Not Clear)   < succ>
            bacterial cytoplasm --- Certainty = 0.0000(Not Clear)   < succ>
```

Based on this analysis, it is predicted that this GAS protein, and its epitopes, could be useful antigens for vaccines and/or diagnostics.

EXAMPLE 3008

A DNA sequence <SEQ ID 9187> was identified in GAS which encodes amino acid sequence <SEQ ID 9188>. Analysis of the amino acid sequence reveals the following:

```
Possible site: 36
>>> Seems to have no N-terminal signal sequence
     INTEGRAL    Likelihood = -1.70   Transmembrane    850-866 (850-866)
     INTEGRAL    Likelihood = -1.22   Transmembrane     15-31  (15-31)

----- Final Results -----
             bacterial membrane --- Certainty = 0.1680(Affirmative) < succ>
              bacterial outside --- Certainty = 0.0000(Not Clear)   < succ>
            bacterial cytoplasm --- Certainty = 0.0000(Not Clear)   < succ>
```

Based on this analysis, it is predicted that this GAS protein, and its epitopes, could be useful antigens for vaccines and/or diagnostics.

EXAMPLE 3009

A DNA sequence <SEQ ID 9189> was identified in GAS which encodes amino acid sequence <SEQ ID 9190>. Analysis of the amino acid sequence reveals the following:

```
LPXTG motif: 259-263
Possible site: 13
>>> Seems to have no N-terminal signal sequence
     INTEGRAL    Likelihood = -3.93   Transmembrane    270-286 (268-288)

----- Final Results -----
             bacterial membrane --- Certainty = 0.2572(Affirmative) < succ>
              bacterial outside --- Certainty = 0.0000(Not Clear)   < succ>
            bacterial cytoplasm --- Certainty = 0.0000(Not Clear)   < succ>
```

Based on this analysis, it is predicted that this GAS protein, and its epitopes, could be useful antigens for vaccines and/or diagnostics.

EXAMPLE 3010

A DNA sequence <SEQ ID 9191> was identified in GAS which encodes amino acid sequence <SEQ ID 9192>. Analysis of the amino acid sequence reveals the following:

```
Possible site: 21
>>> May be a lipoprotein

----- Final Results -----
             bacterial membrane --- Certainty = 0.0000(Not Clear)   < succ>
```

```
                 bacterial outside --- Certainty = 0.0000(Not Clear) < succ>
                 bacterial cytoplasm --- Certainty = 0.0000(Not Clear) < succ>
```

Based on this analysis, it is predicted that this GAS protein, and its epitopes, could be useful antigens for vaccines and/or diagnostics.

EXAMPLE 3011

A DNA sequence <SEQ ID 9193> was identified in GAS which encodes amino acid sequence <SEQ ID 9194>. Analysis of the amino acid sequence reveals the following:

```
Possible site: 29
>>> May be a lipoprotein

----- Final Results -----
                 bacterial membrane --- Certainty = 0.0000(Not Clear) < succ>
                 bacterial outside --- Certainty = 0.0000(Not Clear) < succ>
                 bacterial cytoplasm --- Certainty = 0.0000(Not Clear) < succ>
```

Based on this analysis, it is predicted that this GAS protein, and its epitopes, could be useful antigens for vaccines and/or diagnostics.

EXAMPLE 3012

A DNA sequence <SEQ ID 9195> was identified in GAS which encodes amino acid sequence <SEQ ID 9196>. Analysis of the amino acid sequence reveals the following:

```
Possible site: 34
>>> Seems to have a cleavable N-term signal seq.

----- Final Results -----
                 bacterial outside --- Certainty = 0.3000(Affirmative) < succ>
                 bacterial membrane --- Certainty = 0.0000(Not Clear) < succ>
                 bacterial cytoplasm --- Certainty = 0.0000(Not Clear) < succ>
```

Based on this analysis, it is predicted that this GAS protein, and its epitopes, could be useful antigens for vaccines and/or diagnostics.

EXAMPLE 3013

A DNA sequence <SEQ ID 9197> was identified in GAS which encodes amino acid sequence <SEQ ID 9198>. Analysis of the amino acid sequence reveals the following:

```
Possible site: 13
>>> Seems to have no N-terminal signal sequence
     INTEGRAL     Likelihood = -3.50    Transmembrane   346-362 (343-366)
     INTEGRAL     Likelihood = -2.97    Transmembrane   177-193 (176-195)

----- Final Results -----
                 bacterial membrane --- Certainty = 0.2402(Affirmative) < succ>
                 bacterial outside --- Certainty = 0.0000(Not Clear) < succ>
                 bacterial cytoplasm --- Certainty = 0.0000(Not Clear) < succ>
```

Based on this analysis, it is predicted that this GAS protein, and its epitopes, could be useful antigens for vaccines and/or diagnostics.

EXAMPLE 3014

A DNA sequence <SEQ ID 9199> was identified in GAS which encodes amino acid sequence <SEQ ID 9200>. Analysis of the amino acid sequence reveals the following:

```
Possible site: 19
>>> Seems to have no N-terminal signal sequence
     INTEGRAL    Likelihood = -1.33    Transmembrane    24-40 (24-40)

----- Final Results -----
              bacterial membrane --- Certainty = 0.1532(Affirmative) < succ>
               bacterial outside --- Certainty = 0.0000(Not Clear)   < succ>
             bacterial cytoplasm --- Certainty = 0.0000(Not Clear)   < succ>
```

Based on this analysis, it is predicted that this GAS protein, and its epitopes, could be useful antigens for vaccines and/or diagnostics.

EXAMPLE 3015

A DNA sequence <SEQ ID 9201> was identified in GAS which encodes amino acid sequence <SEQ ID 9202>. Analysis of the amino acid sequence reveals the following:

```
Possible site: 33
>>> Seems to have a cleavable N-term signal seq.
     INTEGRAL    Likelihood = -6.00    Transmembrane    194-210 (192-214)

----- Final Results -----
              bacterial membrane --- Certainty = 0.3399(Affirmative) < succ>
               bacterial outside --- Certainty = 0.0000(Not Clear)   < succ>
             bacterial cytoplasm --- Certainty = 0.0000(Not Clear)   < succ>
LPXTG motif: 183-187
```

Based on this analysis, it is predicted that this GAS protein, and its epitopes, could be useful antigens for vaccines and/or diagnostics.

EXAMPLE 3016

A DNA sequence <SEQ ID 9203> was identified in GAS which encodes amino acid sequence <SEQ ID 9204>. Analysis of the amino acid sequence reveals the following:

```
Possible site: 32
>>> Seems to have an uncleavable N-term signal seq
     INTEGRAL    Likelihood = -11.25    Transmembrane    9-25 (4-28)

----- Final Results -----
              bacterial membrane --- Certainty = 0.5501(Affirmative) < succ>
               bacterial outside --- Certainty = 0.0000(Not Clear)   < succ>
             bacterial cytoplasm --- Certainty = 0.0000(Not Clear)   < succ>
```

Based on this analysis, it is predicted that this GAS protein, and its epitopes, could be useful antigens for vaccines and/or diagnostics.

EXAMPLE 3017

A DNA sequence <SEQ ID 9205> was identified in GAS which encodes amino acid sequence <SEQ ID 9206>. Analysis of the amino acid sequence reveals the following:

```
Possible site: 37
>>> Seems to have no N-terminal signal sequence
     INTEGRAL    Likelihood = -3.03    Transmembrane    462-478 (460-479)
     INTEGRAL    Likelihood = -0.90    Transmembrane    18-34 (18-34)

----- Final Results -----
              bacterial membrane --- Certainty = 0.2211(Affirmative) < succ>
               bacterial outside --- Certainty = 0.0000(Not Clear)   < succ>
             bacterial cytoplasm --- Certainty = 0.0000(Not Clear)   < succ>
LPXTG motif: 450-454
```

Based on this analysis, it is predicted that this GAS protein, and its epitopes, could be useful antigens for vaccines and/or diagnostics.

EXAMPLE 3018

A DNA sequence <SEQ ID 9207> was identified in GAS which encodes amino acid sequence <SEQ ID 9208>. Analysis of the amino acid sequence reveals the following:

```
Possible site: 26
>>> Seems to have an uncleavable N-term signal seq
     INTEGRAL    Likelihood = -2.60    Transmembrane    15-31 (12-32)

----- Final Results -----
           bacterial membrane --- Certainty = 0.2041(Affirmative) < succ>
            bacterial outside --- Certainty = 0.0000(Not Clear)   < succ>
          bacterial cytoplasm --- Certainty = 0.0000(Not Clear)   < succ>
```

Based on this analysis, it is predicted that this GAS protein, and its epitopes, could be useful antigens for vaccines and/or diagnostics.

EXAMPLE 3019

A DNA sequence <SEQ ID 9209> was identified in GAS which encodes amino acid sequence <SEQ ID 9210>. Analysis of the amino acid sequence reveals the following:

```
Possible site: 28
>>> Seems to have no N-terminal signal sequence
     INTEGRAL    Likelihood = -1.38    Transmembrane    16-32 (16-32)

----- Final Results -----
           bacterial membrane --- Certainty = 0.1553(Affirmative) < succ>
            bacterial outside --- Certainty = 0.0000(Not Clear)   < succ>
          bacterial cytoplasm --- Certainty = 0.0000(Not Clear)   < succ>
```

Based on this analysis, it is predicted that this GAS protein, and its epitopes, could be useful antigens for vaccines and/or diagnostics.

EXAMPLE 3020

A DNA sequence <SEQ ID 9211> was identified in GAS which encodes amino acid sequence <SEQ ID 9212>. Analysis of the amino acid sequence reveals the following:

```
Possible cleavage site: 24
>>> Seems to have a cleavable N-term signal seq.

----- Final Results -----
            bacterial outside --- Certainty = 0.300(Affirmative) < succ>
           bacterial membrane --- Certainty = 0.000(Not Clear)   < succ>
          bacterial cytoplasm --- Certainty = 0.000(Not Clear)   < succ>
```

Based on this analysis, it is predicted that this GAS protein, and its epitopes, could be useful antigens for vaccines and/or diagnostics.

EXAMPLE 3021

A DNA sequence <SEQ ID 9213> was identified in GAS which encodes amino acid sequence <SEQ ID 9214>. Analysis of the amino acid sequence reveals the following:

```
Possible cleavage site: 23
>>> May be a lipoprotein
```

```
----- Final Results -----
           bacterial membrane --- Certainty = 0.000(Not Clear) < succ>
           bacterial outside  --- Certainty = 0.000(Not Clear) < succ>
           bacterial cytoplasm --- Certainty = 0.000(Not Clear) < succ>
```

Based on this analysis, it is predicted that this GAS protein, and its epitopes, could be useful antigens for vaccines and/or diagnostics.

EXAMPLE 3022

A DNA sequence <SEQ ID 9215> was identified in GAS which encodes amino acid sequence <SEQ ID 9216>. Analysis of the amino acid sequence reveals the following:

```
Possible site: 19
>>> Seems to have an uncleavable N-term signal seq
    INTEGRAL    Likelihood = -2.76    Transmembrane    3-19 (2-20)

----- Final Results -----
           bacterial membrane --- Certainty = 0.2105(Affirmative) < succ>
           bacterial outside  --- Certainty = 0.0000(Not Clear)   < succ>
           bacterial cytoplasm --- Certainty = 0.0000(Not Clear)   < succ>
RGD motif: 396-398
```

Based on this analysis, it is predicted that this GAS protein, and its epitopes, could be useful antigens for vaccines and/or diagnostics.

EXAMPLE 3023

A DNA sequence <SEQ ID 9217> was identified in GAS which encodes amino acid sequence <SEQ ID 9218>. Analysis of the amino acid sequence reveals the following:

```
Possible site: 18
>>> Seems to have no N-terminal signal sequence
    INTEGRAL    Likelihood = -0.80    Transmembrane    251-267 (251-267)
    INTEGRAL    Likelihood = -0.75    Transmembrane    179-195 (179-195)

----- Final Results -----
           bacterial membrane --- Certainty = 0.1319(Affirmative) < succ>
           bacterial outside  --- Certainty = 0.0000(Not Clear)   < succ>
           bacterial cytoplasm --- Certainty = 0.0000(Not Clear)   < succ>
```

Based on this analysis, it is predicted that this GAS protein, and its epitopes, could be useful antigens for vaccines and/or diagnostics.

EXAMPLE 3024

A DNA sequence <SEQ ID 9219> was identified in GAS which encodes amino acid sequence <SEQ ID 9220>. Analysis of the amino acid sequence reveals the following:

```
Possible site: 39
>>> Seems to have no N-terminal signal sequence
    INTEGRAL    Likelihood = -1.22    Transmembrane    52-68 (51-68)

----- Final Results -----
           bacterial membrane --- Certainty = 0.1489(Affirmative) < succ>
           bacterial outside  --- Certainty = 0.0000(Not Clear)   < succ>
           bacterial cytoplasm --- Certainty = 0.0000(Not Clear)   < succ>
```

Based on this analysis, it is predicted that this GAS protein, and its epitopes, could be useful antigens for vaccines and/or diagnostics.

EXAMPLE 3025

A DNA sequence <SEQ ID 9221> was identified in GAS which encodes amino acid sequence <SEQ ID 9222>. Analysis of the amino acid sequence reveals the following:

```
Possible site: 52
>>> Seems to have an uncleavable N-term signal seq
    INTEGRAL    Likelihood = -12.58    Transmembrane    39-55 (32-86)
    INTEGRAL    Likelihood = -9.55     Transmembrane    60-76 (56-86)

----- Final Results -----
            bacterial membrane --- Certainty = 0.6031(Affirmative) < succ>
             bacterial outside --- Certainty = 0.0000(Not Clear)   < succ>
           bacterial cytoplasm --- Certainty = 0.0000(Not Clear)   < succ>
```

Based on this analysis, it is predicted that this GAS protein, and its epitopes, could be useful antigens for vaccines and/or diagnostics.

EXAMPLE 3026

A DNA sequence <SEQ ID 9223> was identified in GAS which encodes amino acid sequence <SEQ ID 9224>. Analysis of the amino acid sequence reveals the following:

```
Possible site: 18
>>> Seems to have an uncleavable N-term signal seq

----- Final Results -----
            bacterial membrane --- Certainty = 0.0000(Not Clear) < succ>
             bacterial outside --- Certainty = 0.0000(Not Clear) < succ>
           bacterial cytoplasm --- Certainty = 0.0000(Not Clear) < succ>
```

Based on this analysis, it is predicted that this GAS protein, and its epitopes, could be useful antigens for vaccines and/or diagnostics.

EXAMPLE 3027

A DNA sequence <SEQ ID 9225> was identified in GAS which encodes amino acid sequence <SEQ ID 9226>. Analysis of the amino acid sequence reveals the following:

```
Possible site: 26
>>> Seems to have an uncleavable N-term signal seq

----- Final Results -----
            bacterial membrane --- Certainty = 0.0000(Not Clear) < succ>
             bacterial outside --- Certainty = 0.0000(Not Clear) < succ>
           bacterial cytoplasm --- Certainty = 0.0000(Not Clear) < succ>
```

Based on this analysis, it is predicted that this GAS protein, and its epitopes, could be useful antigens for vaccines and/or diagnostics.

EXAMPLE 3028

A DNA sequence <SEQ ID 9227> was identified in GAS which encodes amino acid sequence <SEQ ID 9228>. Analysis of the amino acid sequence reveals the following:

```
Possible site: 33
>>> Seems to have an uncleavable N-term signal seq
    INTEGRAL    Likelihood = -8.44    Transmembrane    18-34 (13-40)
    INTEGRAL    Likelihood = -7.86    Transmembrane    59-75 (54-79)

----- Final Results -----
            bacterial membrane --- Certainty = 0.4376(Affirmative) < succ>
```

```
                 -continued
      bacterial outside --- Certainty = 0.0000(Not Clear) < succ>
      bacterial cytoplasm --- Certainty = 0.0000(Not Clear) < succ>
```

Based on this analysis, it is predicted that this GAS protein, and its epitopes, could be useful antigens for vaccines and/or diagnostics.

EXAMPLE 3029

A DNA sequence <SEQ ID 9229> was identified in GAS which encodes amino acid sequence <SEQ ID 9230>. Analysis of the amino acid sequence reveals the following:

```
Possible site: 27
>>> Seems to have a cleavable N-term signal seq.

----- Final Results -----
      bacterial outside --- Certainty = 0.3000(Affirmative) < succ>
      bacterial membrane --- Certainty = 0.0000(Not Clear) < succ>
      bacterial cytoplasm --- Certainty = 0.0000(Not Clear) < succ>
```

Based on this analysis, it is predicted that this GAS protein, and its epitopes, could be useful antigens for vaccines and/or diagnostics.

EXAMPLE 3030

A DNA sequence <SEQ ID 9231> was identified in GAS which encodes amino acid sequence <SEQ ID 9232>. Analysis of the amino acid sequence reveals the following:

```
Possible site: 24
>>> Seems to have an uncleavable N-term signal seq

----- Final Results -----
      bacterial membrane --- Certainty = 0.0000(Not Clear) < succ>
      bacterial outside --- Certainty = 0.0000(Not Clear) < succ>
      bacterial cytoplasm --- Certainty = 0.0000(Not Clear) < succ>
```

Based on this analysis, it is predicted that this GAS protein, and its epitopes, could be useful antigens for vaccines and/or diagnostics.

EXAMPLE 3031

A DNA sequence <SEQ ID 9233> was identified in GAS which encodes amino acid sequence <SEQ ID 9234>. Analysis of the amino acid sequence reveals the following:

```
Possible site: 49
>>> Seems to have a cleavable N-term signal seq.
    INTEGRAL     Likelihood = -9.87     Transmembrane     58-74 (53-81)

----- Final Results -----
      bacterial membrane --- Certainty = 0.4949(Affirmative) < succ>
      bacterial outside --- Certainty = 0.0000(Not Clear) < succ>
      bacterial cytoplasm --- Certainty = 0.0000(Not Clear) < succ>
```

Based on this analysis, it is predicted that this GAS protein, and its epitopes, could be useful antigens for vaccines and/or diagnostics.

EXAMPLE 3032

A DNA sequence <SEQ ID 9235> was identified in GAS which encodes amino acid sequence <SEQ ID 9236>. Analysis of the amino acid sequence reveals the following:

```
Possible site: 16
>>> Seems to have no N-terminal signal sequence
    INTEGRAL    Likelihood = -0.06    Transmembrane    92-108 (92-108)

----- Final Results -----
            bacterial membrane --- Certainty = 0.1022(Affirmative) < succ>
             bacterial outside --- Certainty = 0.0000(Not Clear)   < succ>
           bacterial cytoplasm --- Certainty = 0.0000(Not Clear)   < succ>
```

Based on this analysis, it is predicted that this GAS protein, and its epitopes, could be useful antigens for vaccines and/or diagnostics.

EXAMPLE 3033

A DNA sequence <SEQ ID 9237> was identified in GAS which encodes amino acid sequence <SEQ ID 9238>. Analysis of the amino acid sequence reveals the following:

```
Possible site: 40
>>> Seems to have no N-terminal signal sequence
    INTEGRAL    Likelihood = -1.38    Transmembrane    18-34 (18-34)

----- Final Results -----
            bacterial membrane --- Certainty = 0.1553(Affirmative) < succ>
             bacterial outside --- Certainty = 0.0000(Not Clear)   < succ>
           bacterial cytoplasm --- Certainty = 0.0000(Not Clear)   < succ>
```

Based on this analysis, it is predicted that this GAS protein, and its epitopes, could be useful antigens for vaccines and/or diagnostics.

EXAMPLE 3034

A DNA sequence <SEQ ID 9239> was identified in GAS which encodes amino acid sequence <SEQ ID 9240>. Analysis of the amino acid sequence reveals the following:

```
Possible site: 19
>>> Seems to have an uncleavable N-term signal seq

----- Final Results -----
            bacterial membrane --- Certainty = 0.0000(Not Clear) < succ>
             bacterial outside --- Certainty = 0.0000(Not Clear) < succ>
           bacterial cytoplasm --- Certainty = 0.0000(Not Clear) < succ>
```

Based on this analysis, it is predicted that this GAS protein, and its epitopes, could be useful antigens for vaccines and/or diagnostics.

EXAMPLE 3035

A DNA sequence <SEQ ID 9241> was identified in GAS which encodes amino acid sequence <SEQ ID 9242>. Analysis of the amino acid sequence reveals the following:

```
Possible site: 57
>>> Seems to have no N-terminal signal sequence
    INTEGRAL    Likelihood = -1.01    Transmembrane    155-171 (154-171)

----- Final Results -----
            bacterial membrane --- Certainty = 0.1404(Affirmative) < succ>
             bacterial outside --- Certainty = 0.0000(Not Clear)   < succ>
           bacterial cytoplasm --- Certainty = 0.0000(Not Clear)   < succ>
```

Based on this analysis, it is predicted that this GAS protein, and its epitopes, could be useful antigens for vaccines and/or diagnostics.

EXAMPLE 3036

A DNA sequence <SEQ ID 9243> was identified in GAS which encodes amino acid sequence <SEQ ID 9244>. Analysis of the amino acid sequence reveals the following:

```
Possible site: 28
>>> Seems to have a cleavable N-term signal seq.
    INTEGRAL    Likelihood = -4.25    Transmembrane    113-129 (111-131)

----- Final Results -----
              bacterial membrane --- Certainty = 0.2699(Affirmative) < succ>
               bacterial outside --- Certainty = 0.0000(Not Clear)   < succ>
             bacterial cytoplasm --- Certainty = 0.0000(Not Clear)   < succ>
```

Based on this analysis, it is predicted that this GAS protein, and its epitopes, could be useful antigens for vaccines and/or diagnostics.

EXAMPLE 3037

A DNA sequence <SEQ ID 9245> was identified in GAS which encodes amino acid sequence <SEQ ID 9246>. Analysis of the amino acid sequence reveals the following:

```
Possible site: 56
>>> Seems to have no N-terminal signal sequence
    INTEGRAL    Likelihood = -0.69    Transmembrane    110-126 (110-126)

----- Final Results -----
              bacterial membrane --- Certainty = 0.1277(Affirmative) < succ>
               bacterial outside --- Certainty = 0.0000(Not Clear)   < succ>
             bacterial cytoplasm --- Certainty = 0.0000(Not Clear)   < succ>
```

Based on this analysis, it is predicted that this GAS protein, and its epitopes, could be useful antigens for vaccines and/or diagnostics.

EXAMPLE 3038

A DNA sequence <SEQ ID 9247> was identified in GAS which encodes amino acid sequence <SEQ ID 9248>. Analysis of the amino acid sequence reveals the following:

```
Possible site: 58
>>> Seems to have no N-terminal signal sequence
    INTEGRAL    Likelihood = -1.28    Transmembrane    130-146 (128-146)

----- Final Results -----
              bacterial membrane --- Certainty = 0.1510(Affirmative) < succ>
               bacterial outside --- Certainty = 0.0000(Not Clear)   < succ>
             bacterial cytoplasm --- Certainty = 0.0000(Not Clear)   < succ>
```

Based on this analysis, it is predicted that this GAS protein, and its epitopes, could be useful antigens for vaccines and/or diagnostics.

EXAMPLE 3039

A DNA sequence <SEQ ID 9249> was identified in GAS which encodes amino acid sequence <SEQ ID 9250>. Analysis of the amino acid sequence reveals the following:

```
Possible site: 39
>>> Seems to have no N-terminal signal sequence
    INTEGRAL    Likelihood = -4.57    Transmembrane     74-90  (72-92)
    INTEGRAL    Likelihood = -3.13    Transmembrane    169-185 (166-185)
    INTEGRAL    Likelihood = -3.13    Transmembrane     28-44  (27-44)
```

```
----- Final Results -----
            bacterial membrane --- Certainty = 0.2826(Affirmative) < succ>
             bacterial outside --- Certainty = 0.0000(Not Clear)   < succ>
           bacterial cytoplasm --- Certainty = 0.0000(Not Clear)   < succ>
```

Based on this analysis, it is predicted that this GAS protein, and its epitopes, could be useful antigens for vaccines and/or diagnostics.

EXAMPLE 3040

A DNA sequence <SEQ ID 9251> was identified in GAS which encodes amino acid sequence <SEQ ID 9252>. Analysis of the amino acid sequence reveals the following:

```
Possible cleavage site: 56
>>> Seems to have a cleavable N-term signal seq.
    INTEGRAL    Likelihood = -12.21    Transmembrane    93-109   (87-114)
    INTEGRAL    Likelihood =  -8.65    Transmembrane   227-243  (226-243)

----- Final Results -----
            bacterial membrane --- Certainty = 0.588(Affirmative) < succ>
             bacterial outside --- Certainty = 0.0000(Not Clear)  < succ>
           bacterial cytoplasm --- Certainty = 0.0000(Not Clear)  < succ>
```

Based on this analysis, it is predicted that this GAS protein, and its epitopes, could be useful antigens for vaccines and/or diagnostics.

EXAMPLE 3041

A DNA sequence <SEQ ID 9253> was identified in GAS which encodes amino acid sequence <SEQ ID 9254>. Analysis of the amino acid sequence reveals the following:

```
Possible site: 45
>>> Seems to have an uncleavable N-term signal seq
    INTEGRAL    Likelihood = -6.53    Transmembrane     73-89   (70-94)
    INTEGRAL    Likelihood = -4.41    Transmembrane     32-48   (30-51)
    INTEGRAL    Likelihood = -2.55    Transmembrane     10-26   (10-26)
    INTEGRAL    Likelihood = -2.39    Transmembrane   106-122  (104-123)
    INTEGRAL    Likelihood = -1.75    Transmembrane   153-169  (152-169)

----- Final Results -----
            bacterial membrane --- Certainty = 0.3612(Affirmative) < succ>
             bacterial outside --- Certainty = 0.0000(Not Clear)   < succ>
           bacterial cytoplasm --- Certainty = 0.0000(Not Clear)   < succ>
```

Based on this analysis, it is predicted that this GAS protein, and its epitopes, could be useful antigens for vaccines and/or diagnostics.

EXAMPLE 3042

A DNA sequence <SEQ ID 9255> was identified in GAS which encodes amino acid sequence <SEQ ID 9256>. Analysis of the amino acid sequence reveals the following:

```
Possible site: 44
>>> Seems to have no N-terminal signal sequence
    INTEGRAL    Likelihood = -11.68    Transmembrane     25-41   (15-46)
    INTEGRAL    Likelihood =  -9.24    Transmembrane   255-271  (248-276)
    INTEGRAL    Likelihood =  -7.59    Transmembrane     82-98   (79-100)
    INTEGRAL    Likelihood =  -4.30    Transmembrane   115-131  (113-135)
    INTEGRAL    Likelihood =  -0.11    Transmembrane   148-164  (148-164)

----- Final Results -----
            bacterial membrane --- Certainty = 0.5670(Affirmative) < succ>
             bacterial outside --- Certainty = 0.0000(Not Clear)   < succ>
           bacterial cytoplasm --- Certainty = 0.0000(Not Clear)   < succ>
```

Based on this analysis, it is predicted that this GAS protein, and its epitopes, could be useful antigens for vaccines and/or diagnostics.

EXAMPLE 3043

A DNA sequence <SEQ ID 9257> was identified in GAS which encodes amino acid sequence <SEQ ID 9258>. Analysis of the amino acid sequence reveals the following:

```
Possible site: 51
>>> Seems to have no N-terminal signal sequence
    INTEGRAL    Likelihood = -11.04    Transmembrane    137-153 (126-160)
    INTEGRAL    Likelihood = -10.56    Transmembrane     36-52  (29-58)
    INTEGRAL    Likelihood = -10.08    Transmembrane    407-423 (399-426)
    INTEGRAL    Likelihood =  -4.94    Transmembrane    230-246 (228-250)
    INTEGRAL    Likelihood =  -4.83    Transmembrane     79-95  (77-98)
    INTEGRAL    Likelihood =  -4.35    Transmembrane    202-218 (201-220)
    INTEGRAL    Likelihood =  -1.12    Transmembrane    293-309 (293-309)

----- Final Results -----
             bacterial membrane --- Certainty = 0.5416(Affirmative) < succ>
             bacterial outside  --- Certainty = 0.0000(Not Clear)   < succ>
           bacterial cytoplasm  --- Certainty = 0.0000(Not Clear)   < succ>
```

Based on this analysis, it is predicted that this GAS protein, and its epitopes, could be useful antigens for vaccines and/or diagnostics.

EXAMPLE 3044

A DNA sequence <SEQ ID 9259> was identified in GAS which encodes amino acid sequence <SEQ ID 9260>. Analysis of the amino acid sequence reveals the following:

```
Possible site: 31
>>> Seems to have no N-terminal signal sequence
    INTEGRAL    Likelihood = -2.76    Transmembrane    137-153 (137-154)

----- Final Results -----
             bacterial membrane --- Certainty = 0.2105(Affirmative) < succ>
             bacterial outside  --- Certainty = 0.0000(Not Clear)   < succ>
           bacterial cytoplasm  --- Certainty = 0.0000(Not Clear)   < succ>
```

Based on this analysis, it is predicted that this GAS protein, and its epitopes, could be useful antigens for vaccines and/or diagnostics.

EXAMPLE 3045

A DNA sequence <SEQ ID 9261> was identified in GAS which encodes amino acid sequence <SEQ ID 9262>. Analysis of the amino acid sequence reveals the following:

```
Possible site: 36
>>> Seems to have no N-terminal signal sequence
    INTEGRAL    Likelihood = -7.91    Transmembrane    238-254 (236-264)
    INTEGRAL    Likelihood = -6.16    Transmembrane     69-85  (65-89)
    INTEGRAL    Likelihood = -6.00    Transmembrane    136-152 (134-155)
    INTEGRAL    Likelihood = -4.73    Transmembrane     29-45  (21-48)
    INTEGRAL    Likelihood = -2.97    Transmembrane    194-210 (193-220)

----- Final Results -----
             bacterial membrane --- Certainty = 0.4163(Affirmative) < succ>
             bacterial outside  --- Certainty = 0.0000(Not Clear)   < succ>
           bacterial cytoplasm  --- Certainty = 0.0000(Not Clear)   < succ>
```

Based on this analysis, it is predicted that this GAS protein, and its epitopes, could be useful antigens for vaccines and/or diagnostics.

EXAMPLE 3046

A DNA sequence <SEQ ID 9263> was identified in GAS which encodes amino acid sequence <SEQ ID 9264>. Analysis of the amino acid sequence reveals the following:

```
Possible site: 39
>>> Seems to have a cleavable N-term signal seq.
     INTEGRAL    Likelihood = -9.87    Transmembrane    574-590  (568-601)
     INTEGRAL    Likelihood = -9.18    Transmembrane    243-259  (238-262)
     INTEGRAL    Likelihood = -7.11    Transmembrane     66-82   (65-87)
     INTEGRAL    Likelihood = -1.28    Transmembrane    270-286  (270-287)

----- Final Results -----
              bacterial membrane --- Certainty = 0.4949(Affirmative) < succ>
               bacterial outside --- Certainty = 0.0000(Not Clear)   < succ>
             bacterial cytoplasm --- Certainty = 0.0000(Not Clear)   < succ>
```

Based on this analysis, it is predicted that this GAS protein, and its epitopes, could be useful antigens for vaccines and/or diagnostics.

EXAMPLE 3047

A DNA sequence <SEQ ID 9265> was identified in GAS which encodes amino acid sequence <SEQ ID 9266>. Analysis of the amino acid sequence reveals the following:

```
Possible site: 33
>>> Seems to have no N-terminal signal sequence
     INTEGRAL    Likelihood = -7.91    Transmembrane     98-114  (92-124)
     INTEGRAL    Likelihood = -6.21    Transmembrane     19-35   (14-37)
     INTEGRAL    Likelihood = -5.36    Transmembrane    170-186  (169-189)
     INTEGRAL    Likelihood = -5.15    Transmembrane    147-163  (136-167)
     INTEGRAL    Likelihood = -1.12    Transmembrane     77-93   (77-93)

----- Final Results -----
              bacterial membrane --- Certainty = 0.4163(Affirmative) < succ>
               bacterial outside --- Certainty = 0.0000(Not Clear)   < succ>
             bacterial cytoplasm --- Certainty = 0.0000(Not Clear)   < succ>
```

Based on this analysis, it is predicted that this GAS protein, and its epitopes, could be useful antigens for vaccines and/or diagnostics.

EXAMPLE 3048

A DNA sequence <SEQ ID 9267> was identified in GAS which encodes amino acid sequence <SEQ ID 9268>. Analysis of the amino acid sequence reveals the following:

```
Possible site: 47
>>> Seems to have no N-terminal signal sequence
     INTEGRAL    Likelihood = -11.94   Transmembrane     27-43   (19-51)
     INTEGRAL    Likelihood = -4.83    Transmembrane    152-168  (151-171)
     INTEGRAL    Likelihood = -4.09    Transmembrane    277-293  (276-294)
     INTEGRAL    Likelihood = -3.82    Transmembrane    195-211  (193-217)
     INTEGRAL    Likelihood = -2.50    Transmembrane    120-136  (120-137)
     INTEGRAL    Likelihood = -0.64    Transmembrane     81-97   (81-98)

----- Final Results -----
              bacterial membrane --- Certainty = 0.5776(Affirmative) < succ>
               bacterial outside --- Certainty = 0.0000(Not Clear)   < succ>
             bacterial cytoplasm --- Certainty = 0.0000(Not Clear)   < succ>
```

Based on this analysis, it is predicted that this GAS protein, and its epitopes, could be useful antigens for vaccines and/or diagnostics.

EXAMPLE 3049

A DNA sequence <SEQ ID 9269> was identified in GAS which encodes amino acid sequence <SEQ ID 9270>. Analysis of the amino acid sequence reveals the following:

```
Possible site: 36
>>> Seems to have no N-terminal signal sequence
     INTEGRAL     Likelihood = -8.49     Transmembrane     27-43  (14-50)
     INTEGRAL     Likelihood = -8.17     Transmembrane     58-74  (52-79)
     INTEGRAL     Likelihood = -7.38     Transmembrane    165-181 (161-193)
     INTEGRAL     Likelihood = -3.66     Transmembrane    247-263 (246-270)
     INTEGRAL     Likelihood = -1.54     Transmembrane    134-150 (134-150)

----- Final Results -----
              bacterial membrane --- Certainty = 0.440(Affirmative) < succ>
              bacterial outside  --- Certainty = 0.0000(Not Clear)  < succ>
             bacterial cytoplasm --- Certainty = 0.0000(Not Clear)  < succ>
```

Based on this analysis, it is predicted that this GAS protein, and its epitopes, could be useful antigens for vaccines and/or diagnostics.

EXAMPLE 3050

A DNA sequence <SEQ ID 9271> was identified in GAS which encodes amino acid sequence <SEQ ID 9272>. Analysis of the amino acid sequence reveals the following:

```
Possible site: 55
>>> Seems to have no N-terminal signal sequence
     INTEGRAL     Likelihood = -14.75    Transmembrane    389-405 (377-413)
     INTEGRAL     Likelihood = -8.44     Transmembrane     31-47  (29-54)
     INTEGRAL     Likelihood = -7.17     Transmembrane    181-197 (179-205)
     INTEGRAL     Likelihood = -7.01     Transmembrane    339-355 (326-360)
     INTEGRAL     Likelihood = -6.58     Transmembrane    105-121 (102-124)
     INTEGRAL     Likelihood = -5.36     Transmembrane    225-241 (222-244)
     INTEGRAL     Likelihood = -0.43     Transmembrane    139-155 (139-155)
     INTEGRAL     Likelihood = -0.16     Transmembrane    283-299 (282-300)

----- Final Results -----
              bacterial membrane --- Certainty = 0.6901(Affirmative) < succ>
              bacterial outside  --- Certainty = 0.0000(Not Clear)   < succ>
             bacterial cytoplasm --- Certainty = 0.0000(Not Clear)   < succ>
```

Based on this analysis, it is predicted that this GAS protein, and its epitopes, could be useful antigens for vaccines and/or diagnostics.

EXAMPLE 3051

A DNA sequence <SEQ ID 9273> was identified in GAS which encodes amino acid sequence <SEQ ID 9274>. Analysis of the amino acid sequence reveals the following:

```
Possible cleavage site: 25
>>> Seems to have a cleavable N-term signal seq.
     INTEGRAL     Likelihood = -5.31     Transmembrane    155-171 (154-174)
     INTEGRAL     Likelihood = -3.50     Transmembrane    111-127 (110-128)
     INTEGRAL     Likelihood = -2.07     Transmembrane     80-96  (78-96)
     INTEGRAL     Likelihood = -0.90     Transmembrane     57-73  (57-74)

----- Final Results -----
              bacterial membrane --- Certainty = 0.312(Affirmative) < succ>
              bacterial outside  --- Certainty = 0.0000(Not Clear)  < succ>
             bacterial cytoplasm --- Certainty = 0.0000(Not Clear)  < succ>
```

Based on this analysis, it is predicted that this GAS protein, and its epitopes, could be useful antigens for vaccines and/or diagnostics.

EXAMPLE 3052

A DNA sequence <SEQ ID 9275> was identified in GAS which encodes amino acid sequence <SEQ ID 9276>. Analysis of the amino acid sequence reveals the following:

```
Possible site: 27
>>> Seems to have an uncleavable N-term signal seq
    INTEGRAL    Likelihood = -3.93    Transmembrane    463-479 (461-480)

----- Final Results -----
            bacterial membrane  --- Certainty = 0.2572(Affirmative) < succ>
            bacterial outside   --- Certainty = 0.0000(Not Clear)   < succ>
            bacterial cytoplasm --- Certainty = 0.0000(Not Clear)   < succ>
```

Based on this analysis, it is predicted that this GAS protein, and its epitopes, could be useful antigens for vaccines and/or diagnostics.

EXAMPLE 3053

A DNA sequence <SEQ ID 8741> was identified in GBS which encodes amino acid sequence <SEQ ID 8742>. This protein and its epitopes could be useful antigens for vaccines and/or diagnostics.

EXAMPLE 3054

A DNA sequence <SEQ ID 8685> was identified in GBS which encodes amino acid sequence <SEQ ID 8686>. This protein and its epitopes could be useful antigens for vaccines and/or diagnostics.

EXAMPLE 3055

A DNA sequence <SEQ ID 10303> was identified in GBS which encodes amino acid sequence <SEQ ID 10304>. This protein and its epitopes could be useful antigens for vaccines and/or diagnostics.

EXAMPLE 3056

A DNA sequence <SEQ ID 10305> was identified in GBS which encodes amino acid sequence <SEQ ID 10306>. This protein and its epitopes could be useful antigens for vaccines and/or diagnostics.

EXAMPLE 3057

A DNA sequence <SEQ ID 10307> was identified in GBS which encodes amino acid sequence <SEQ ID 10308>. This protein and its epitopes could be useful antigens for vaccines and/or diagnostics.

EXAMPLE 3058

A DNA sequence <SEQ ID 10309> was identified in GBS which encodes amino acid sequence <SEQ ID 10310>. This protein and its epitopes could be useful antigens for vaccines and/or diagnostics.

EXAMPLE 3059

A DNA sequence <SEQ ID 10311> was identified in GBS which encodes amino acid sequence <SEQ ID 10312>. This protein and its epitopes could be useful antigens for vaccines and/or diagnostics.

EXAMPLE 3060

A DNA sequence <SEQ ID 10313> was identified in GBS which encodes amino acid sequence <SEQ ID 10314>. This protein and its epitopes could be useful antigens for vaccines and/or diagnostics.

EXAMPLE 3061

A DNA sequence <SEQ ID 10315> was identified in GBS which encodes amino acid sequence <SEQ ID 10316>. This protein and its epitopes could be useful antigens for vaccines and/or diagnostics.

EXAMPLE 3062

A DNA sequence <SEQ ID 10317> was identified in GBS which encodes amino acid sequence <SEQ ID 10318>. This protein and its epitopes could be useful antigens for vaccines and/or diagnostics.

EXAMPLE 3063

A repeated DNA sequence <SEQ ID 10319> was identified in GBS which encodes amino acid sequence <SEQ ID 10320>. This protein and its epitopes could be useful antigens for vaccines and/or diagnostics.

EXAMPLE 3064

A DNA sequence <SEQ ID 10321> was identified in GBS which encodes amino acid sequence <SEQ ID 10322>. This protein and its epitopes could be useful antigens for vaccines and/or diagnostics.

EXAMPLE 3065

A DNA sequence <SEQ ID 10323> was identified in GBS which encodes amino acid sequence <SEQ ID 10324>. This protein and its epitopes could be useful antigens for vaccines and/or diagnostics.

EXAMPLE 3066

A DNA sequence <SEQ ID 10325> was identified in GBS which encodes amino acid sequence <SEQ ID 10326>. This protein and its epitopes could be useful antigens for vaccines and/or diagnostics.

EXAMPLE 3067

A DNA sequence <SEQ ID 10327> was identified in GBS which encodes amino acid sequence <SEQ ID 10328>. This protein and its epitopes could be useful antigens for vaccines and/or diagnostics.

EXAMPLE 3068

A DNA sequence <SEQ ID 10329> was identified in GBS which encodes amino acid sequence <SEQ ID 10330>. This protein and its epitopes could be useful antigens for vaccines and/or diagnostics.

EXAMPLE 3069

A DNA sequence <SEQ ID 10331> was identified in GBS which encodes amino acid sequence <SEQ ID 10332>. This protein and its epitopes could be useful antigens for vaccines and/or diagnostics.

EXAMPLE 3070

A DNA sequence <SEQ ID 10333> was identified in GBS which encodes amino acid sequence <SEQ ID 10334>. This protein and its epitopes could be useful antigens for vaccines and/or diagnostics.

EXAMPLE 3071

A DNA sequence <SEQ ID 10335> was identified in GBS which encodes amino acid sequence <SEQ ID 10336>. This protein and its epitopes could be useful antigens for vaccines and/or diagnostics.

EXAMPLE 3072

A DNA sequence <SEQ ID 10339> was identified in GBS which encodes amino acid sequence <SEQ ID 10340>. This protein and its epitopes could be useful antigens for vaccines and/or diagnostics.

EXAMPLE 3073

A DNA sequence <SEQ ID 10341> was identified in GBS which encodes amino acid sequence <SEQ ID 10342>. This protein and its epitopes could be useful antigens for vaccines and/or diagnostics.

EXAMPLE 3074

A DNA sequence <SEQ ID 10343> was identified in GBS which encodes amino acid sequence <SEQ ID 10344>. This protein and its epitopes could be useful antigens for vaccines and/or diagnostics.

EXAMPLE 3075

A DNA sequence <SEQ ID 10345> was identified in GBS which encodes amino acid sequence <SEQ ID 10346>. This protein and its epitopes could be useful antigens for vaccines and/or diagnostics.

EXAMPLE 3076

A DNA sequence <SEQ ID 10347> was identified in GBS which encodes amino acid sequence <SEQ ID 10348>. This protein and its epitopes could be useful antigens for vaccines and/or diagnostics.

EXAMPLE 3077

A DNA sequence <SEQ ID 10349> was identified in GBS which encodes amino acid sequence <SEQ ID 10350>. This protein and its epitopes could be useful antigens for vaccines and/or diagnostics.

EXAMPLE 3078

A DNA sequence <SEQ ID 10351> was identified in GBS which encodes amino acid sequence <SEQ ID 10352>. This protein and its epitopes could be useful antigens for vaccines and/or diagnostics.

EXAMPLE 3079

A DNA sequence <SEQ ID 10353> was identified in GBS which encodes amino acid sequence <SEQ ID 10354>. This protein and its epitopes could be useful antigens for vaccines and/or diagnostics.

EXAMPLE 3080

A DNA sequence <SEQ ID 10355> was identified in GBS which encodes amino acid sequence <SEQ ID 10356>. This protein and its epitopes could be useful antigens for vaccines and/or diagnostics.

EXAMPLE 3081

A DNA sequence <SEQ ID 10357> was identified in GBS which encodes amino acid sequence <SEQ ID 10358>. This protein and its epitopes could be useful antigens for vaccines and/or diagnostics.

EXAMPLE 3082

A DNA sequence <SEQ ID 10359> was identified in GBS which encodes amino acid sequence <SEQ ID 10360>. This protein and its epitopes could be useful antigens for vaccines and/or diagnostics.

EXAMPLE 3083

A DNA sequence <SEQ ID 10361> was identified in GBS which encodes amino acid sequence <SEQ ID 10362>. This protein and its epitopes could be useful antigens for vaccines and/or diagnostics.

EXAMPLE 3084

A DNA sequence <SEQ ID 10363> was identified in GBS which encodes amino acid sequence <SEQ ID 10364>. This protein and its epitopes could be useful antigens for vaccines and/or diagnostics.

EXAMPLE 3085

A DNA sequence <SEQ ID 10365> was identified in GBS which encodes amino acid sequence <SEQ ID 10366>. This protein and its epitopes could be useful antigens for vaccines and/or diagnostics.

EXAMPLE 3086

A DNA sequence <SEQ ID 10367> was identified in GBS which encodes amino acid sequence <SEQ ID 10368>. This protein and its epitopes could be useful antigens for vaccines and/or diagnostics.

EXAMPLE 3087

A DNA sequence <SEQ ID 10369> was identified in GBS which encodes amino acid sequence <SEQ ID 10370>. This protein and its epitopes could be useful antigens for vaccines and/or diagnostics.

EXAMPLE 3088

A DNA sequence <SEQ ID 10371> was identified in GBS which encodes amino acid sequence <SEQ ID 10372>. This protein and its epitopes could be useful antigens for vaccines and/or diagnostics.

EXAMPLE 3089

A DNA sequence <SEQ ID 10373> was identified in GBS which encodes amino acid sequence <SEQ ID 10374>. This protein and its epitopes could be useful antigens for vaccines and/or diagnostics.

EXAMPLE 3090

A DNA sequence <SEQ ID 10375> was identified in GBS which encodes amino acid sequence <SEQ ID 10376>. This protein and its epitopes could be useful antigens for vaccines and/or diagnostics.

EXAMPLE 3091

A DNA sequence <SEQ ID 10377> was identified in GBS which encodes amino acid sequence <SEQ ID 10378>. This protein and its epitopes could be useful antigens for vaccines and/or diagnostics.

EXAMPLE 3092

A DNA sequence <SEQ ID 10379> was identified in GBS which encodes amino acid sequence <SEQ ID 10380>. This protein and its epitopes could be useful antigens for vaccines and/or diagnostics.

EXAMPLE 3093

A DNA sequence <SEQ ID 10381> was identified in GBS which encodes amino acid sequence <SEQ ID 10382>. This protein and its epitopes could be useful antigens for vaccines and/or diagnostics.

EXAMPLE 3094

A DNA sequence <SEQ ID 10383> was identified in GBS which encodes amino acid sequence <SEQ ID 10384>. This protein and its epitopes could be useful antigens for vaccines and/or diagnostics.

EXAMPLE 3095

A DNA sequence <SEQ ID 10385> was identified in GBS which encodes amino acid sequence <SEQ ID 10386>. This protein and its epitopes could be useful antigens for vaccines and/or diagnostics.

EXAMPLE 3096

A DNA sequence <SEQ ID 10387> was identified in GBS which encodes amino acid sequence <SEQ ID 10388>. This protein and its epitopes could be useful antigens for vaccines and/or diagnostics.

EXAMPLE 3097

A DNA sequence <SEQ ID 10389> was identified in GBS which encodes amino acid sequence <SEQ ID 10390>. This protein and its epitopes could be useful antigens for vaccines and/or diagnostics.

EXAMPLE 3098

A DNA sequence <SEQ ID 10391> was identified in GBS which encodes amino acid sequence <SEQ ID 10392>. This protein and its epitopes could be useful antigens for vaccines and/or diagnostics.

EXAMPLE 3099

A DNA sequence <SEQ ID 10393> was identified in GBS which encodes amino acid sequence <SEQ ID 10394>. This protein and its epitopes could be useful antigens for vaccines and/or diagnostics.

EXAMPLE 3100

A DNA sequence <SEQ ID 10395> was identified in GBS which encodes amino acid sequence <SEQ ID 10396>. This protein and its epitopes could be useful antigens for vaccines and/or diagnostics.

EXAMPLE 3101

A DNA sequence <SEQ ID 10397> was identified in GBS which encodes amino acid sequence <SEQ ID 10398>. This protein and its epitopes could be useful antigens for vaccines and/or diagnostics.

EXAMPLE 3102

A DNA sequence <SEQ ID 10399> was identified in GBS which encodes amino acid sequence <SEQ ID 10400>. This protein and its epitopes could be useful antigens for vaccines and/or diagnostics.

EXAMPLE 3103

A DNA sequence <SEQ ID 10401> was identified in GBS which encodes amino acid sequence <SEQ ID 10402>. This protein and its epitopes could be useful antigens for vaccines and/or diagnostics.

EXAMPLE 3104

A DNA sequence <SEQ ID 10403> was identified in GBS which encodes amino acid sequence <SEQ ID 10404>. This protein and its epitopes could be useful antigens for vaccines and/or diagnostics.

EXAMPLE 3105

A DNA sequence <SEQ ID 10405> was identified in GBS which encodes amino acid sequence <SEQ ID 10406>. This protein and its epitopes could be useful antigens for vaccines and/or diagnostics.

EXAMPLE 3106

A DNA sequence <SEQ ID 10407> was identified in GBS which encodes amino acid sequence <SEQ ID 10408>. This protein and its epitopes could be useful antigens for vaccines and/or diagnostics.

EXAMPLE 3107

A DNA sequence <SEQ ID 10409> was identified in GBS which encodes amino acid sequence <SEQ ID 10410>. This protein and its epitopes could be useful antigens for vaccines and/or diagnostics.

EXAMPLE 3108

A DNA sequence <SEQ ID 10411> was identified in GBS which encodes amino acid sequence <SEQ ID 10412>. This protein and its epitopes could be useful antigens for vaccines and/or diagnostics.

EXAMPLE 3109

A DNA sequence <SEQ ID 10413> was identified in GBS which encodes amino acid sequence <SEQ ID 10414>. This protein and its epitopes could be useful antigens for vaccines and/or diagnostics.

EXAMPLE 3110

A DNA sequence <SEQ ID 10415> was identified in GBS which encodes amino acid sequence <SEQ ID 10416>. This protein and its epitopes could be useful antigens for vaccines and/or diagnostics.

EXAMPLE 3111

A DNA sequence <SEQ ID 10417> was identified in GBS which encodes amino acid sequence <SEQ ID 10418>. This protein and its epitopes could be useful antigens for vaccines and/or diagnostics.

EXAMPLE 3112

A DNA sequence <SEQ ID 10419> was identified in GBS which encodes amino acid sequence <SEQ ID 10420>. This protein and its epitopes could be useful antigens for vaccines and/or diagnostics.

EXAMPLE 3113

A DNA sequence <SEQ ID 10421> was identified in GBS which encodes amino acid sequence <SEQ ID 10422>. This protein and its epitopes could be useful antigens for vaccines and/or diagnostics.

EXAMPLE 3114

A DNA sequence <SEQ ID 10423> was identified in GBS which encodes amino acid sequence <SEQ ID 10424>. This protein and its epitopes could be useful antigens for vaccines and/or diagnostics.

EXAMPLE 3115

A DNA sequence <SEQ ID 10425> was identified in GBS which encodes amino acid sequence <SEQ ID 10426>. This protein and its epitopes could be useful antigens for vaccines and/or diagnostics.

EXAMPLE 3116

A DNA sequence <SEQ ID 10427> was identified in GBS which encodes amino acid sequence <SEQ ID 10428>. This protein and its epitopes could be useful antigens for vaccines and/or diagnostics.

EXAMPLE 3117

A DNA sequence <SEQ ID 10429> was identified in GBS which encodes amino acid sequence <SEQ ID 10430>. This protein and its epitopes could be useful antigens for vaccines and/or diagnostics.

EXAMPLE 3118

A DNA sequence <SEQ ID 10431> was identified in GBS which encodes amino acid sequence <SEQ ID 10432>. This protein and its epitopes could be useful antigens for vaccines and/or diagnostics.

EXAMPLE 3119

A DNA sequence <SEQ ID 10433> was identified in GBS which encodes amino acid sequence <SEQ ID 10434>. This protein and its epitopes could be useful antigens for vaccines and/or diagnostics.

EXAMPLE 3120

A DNA sequence <SEQ ID 10435> was identified in GBS which encodes amino acid sequence <SEQ ID 10436>. This protein and its epitopes could be useful antigens for vaccines and/or diagnostics.

EXAMPLE 3121

A DNA sequence <SEQ ID 10437> was identified in GBS which encodes amino acid sequence <SEQ ID 10438>. This protein and its epitopes could be useful antigens for vaccines and/or diagnostics.

EXAMPLE 3122

A DNA sequence <SEQ ID 10441> was identified in GBS which encodes amino acid sequence <SEQ ID 10442>. This protein and its epitopes could be useful antigens for vaccines and/or diagnostics.

EXAMPLE 3123

A DNA sequence <SEQ ID 10443> was identified in GBS which encodes amino acid sequence <SEQ ID 10444>. This protein and its epitopes could be useful antigens for vaccines and/or diagnostics.

EXAMPLE 3124

A DNA sequence <SEQ ID 10445> was identified in GBS which encodes amino acid sequence <SEQ ID 10446>. This protein and its epitopes could be useful antigens for vaccines and/or diagnostics.

EXAMPLE 3125

A DNA sequence <SEQ ID 10447> was identified in GBS which encodes amino acid sequence <SEQ ID 10448>. This protein and its epitopes could be useful antigens for vaccines and/or diagnostics.

EXAMPLE 3126

A DNA sequence <SEQ ID 10449> was identified in GBS which encodes amino acid sequence <SEQ ID 10450>. This protein and its epitopes could be useful antigens for vaccines and/or diagnostics.

EXAMPLE 3127

A DNA sequence <SEQ ID 10451> was identified in GBS which encodes amino acid sequence <SEQ ID 10452>. This protein and its epitopes could be useful antigens for vaccines and/or diagnostics.

EXAMPLE 3128

A DNA sequence <SEQ ID 10453> was identified in GBS which encodes amino acid sequence <SEQ ID 10454>. This protein and its epitopes could be useful antigens for vaccines and/or diagnostics.

EXAMPLE 3129

A DNA sequence <SEQ ID 10455> was identified in GBS which encodes amino acid sequence <SEQ ID 10456>. This protein and its epitopes could be useful antigens for vaccines and/or diagnostics.

EXAMPLE 3130

A DNA sequence <SEQ ID 10457> was identified in GBS which encodes amino acid sequence <SEQ ID 10458>. This protein and its epitopes could be useful antigens for vaccines and/or diagnostics. A related GBS nucleic acid sequence <SEQ ID 10907> which encodes amino acid sequence <SEQ ID 10908> was also identified.

EXAMPLE 3131

A DNA sequence <SEQ ID 10459> was identified in GBS which encodes amino acid sequence <SEQ ID 10460>. This protein and its epitopes could be useful antigens for vaccines and/or diagnostics.

EXAMPLE 3132

A DNA sequence <SEQ ID 10461> was identified in GBS which encodes amino acid sequence <SEQ ID 10462>. This protein and its epitopes could be useful antigens for vaccines and/or diagnostics.

EXAMPLE 3133

A DNA sequence <SEQ ID 10463> was identified in GBS which encodes amino acid sequence <SEQ ID 10464>. This protein and its epitopes could be useful antigens for vaccines and/or diagnostics.

EXAMPLE 3134

A DNA sequence <SEQ ID 10465> was identified in GBS which encodes amino acid sequence <SEQ ID 10466>. This protein and its epitopes could be useful antigens for vaccines and/or diagnostics.

EXAMPLE 3135

A DNA sequence <SEQ ID 10467> was identified in GBS which encodes amino acid sequence <SEQ ID 10468>. This protein and its epitopes could be useful antigens for vaccines and/or diagnostics.

EXAMPLE 3136

A DNA sequence <SEQ ID 10469> was identified in GBS which encodes amino acid sequence <SEQ ID 10470>. This protein and its epitopes could be useful antigens for vaccines and/or diagnostics.

EXAMPLE 3137

A DNA sequence <SEQ ID 10471> was identified in GBS which encodes amino acid sequence <SEQ ID 10472>. This protein and its epitopes could be useful antigens for vaccines and/or diagnostics.

EXAMPLE 3138

A DNA sequence <SEQ ID 10473> was identified in GBS which encodes amino acid sequence <SEQ ID 10474>. This protein and its epitopes could be useful antigens for vaccines and/or diagnostics.

EXAMPLE 3139

A DNA sequence <SEQ ID 10475> was identified in GBS which encodes amino acid sequence <SEQ ID 10476>. This protein and its epitopes could be useful antigens for vaccines and/or diagnostics.

EXAMPLE 3140

A DNA sequence <SEQ ID 10477> was identified in GBS which encodes amino acid sequence <SEQ ID 10478>. This protein and its epitopes could be useful antigens for vaccines and/or diagnostics.

EXAMPLE 3141

A DNA sequence <SEQ ID 10479> was identified in GBS which encodes amino acid sequence <SEQ ID 10480>. This protein and its epitopes could be useful antigens for vaccines and/or diagnostics.

EXAMPLE 3142

A DNA sequence <SEQ ID 10481> was identified in GBS which encodes amino acid sequence <SEQ ID 10482>. This protein and its epitopes could be useful antigens for vaccines and/or diagnostics.

EXAMPLE 3143

A DNA sequence <SEQ ID 10483> was identified in GBS which encodes amino acid sequence <SEQ ID 10484>. This protein and its epitopes could be useful antigens for vaccines and/or diagnostics.

EXAMPLE 3144

A DNA sequence <SEQ ID 10485> was identified in GBS which encodes amino acid sequence <SEQ ID 10486>. This protein and its epitopes could be useful antigens for vaccines and/or diagnostics.

EXAMPLE 3145

A DNA sequence <SEQ ID 10487> was identified in GBS which encodes amino acid sequence <SEQ ID 10488>. This protein and its epitopes could be useful antigens for vaccines and/or diagnostics.

EXAMPLE 3146

A DNA sequence <SEQ ID 10489> was identified in GBS which encodes amino acid sequence <SEQ ID 10490>. This protein and its epitopes could be useful antigens for vaccines and/or diagnostics.

EXAMPLE 3147

A DNA sequence <SEQ ID 10491> was identified in GBS which encodes amino acid sequence <SEQ ID 10492>. This protein and its epitopes could be useful antigens for vaccines and/or diagnostics.

EXAMPLE 3148

A DNA sequence <SEQ ID 10493> was identified in GBS which encodes amino acid sequence <SEQ ID 10494>. This protein and its epitopes could be useful antigens for vaccines and/or diagnostics.

EXAMPLE 3149

A DNA sequence <SEQ ID 10495> was identified in GBS which encodes amino acid sequence <SEQ ID 10496>. This protein and its epitopes could be useful antigens for vaccines and/or diagnostics.

EXAMPLE 3150

A DNA sequence <SEQ ID 10497> was identified in GBS which encodes amino acid sequence <SEQ ID 10498>. This protein and its epitopes could be useful antigens for vaccines and/or diagnostics.

EXAMPLE 3151

A DNA sequence <SEQ ID 10499> was identified in GBS which encodes amino acid sequence <SEQ ID 10500>. This protein and its epitopes could be useful antigens for vaccines and/or diagnostics.

EXAMPLE 3152

A DNA sequence <SEQ ID 10501> was identified in GBS which encodes amino acid sequence <SEQ ID 10502>. This protein and its epitopes could be useful antigens for vaccines and/or diagnostics.

EXAMPLE 3153

A DNA sequence <SEQ ID 10503> was identified in GBS which encodes amino acid sequence <SEQ ID 10504>. This protein and its epitopes could be useful antigens for vaccines and/or diagnostics.

EXAMPLE 3154

A DNA sequence <SEQ ID 10505> was identified in GBS which encodes amino acid sequence <SEQ ID 10506>. This protein and its epitopes could be useful antigens for vaccines and/or diagnostics.

EXAMPLE 3155

A DNA sequence <SEQ ID 10509> was identified in GBS which encodes amino acid sequence <SEQ ID 10510>. This protein and its epitopes could be useful antigens for vaccines and/or diagnostics.

EXAMPLE 3156

A DNA sequence <SEQ ID 10511> was identified in GBS which encodes amino acid sequence <SEQ ID 10512>. This protein and its epitopes could be useful antigens for vaccines and/or diagnostics.

EXAMPLE 3157

A DNA sequence <SEQ ID 10513> was identified in GBS which encodes amino acid sequence <SEQ ID 10514>. This protein and its epitopes could be useful antigens for vaccines and/or diagnostics.

EXAMPLE 3158

A DNA sequence <SEQ ID 10515> was identified in GBS which encodes amino acid sequence <SEQ ID 10516>. This protein and its epitopes could be useful antigens for vaccines and/or diagnostics.

EXAMPLE 3159

A DNA sequence <SEQ ID 10517> was identified in GBS which encodes amino acid sequence <SEQ ID 10518>. This protein and its epitopes could be useful antigens for vaccines and/or diagnostics.

EXAMPLE 3160

A DNA sequence <SEQ ID 10519> was identified in GBS which encodes amino acid sequence <SEQ ID 10520>. This protein and its epitopes could be useful antigens for vaccines and/or diagnostics.

EXAMPLE 3161

A DNA sequence <SEQ ID 10521> was identified in GBS which encodes amino acid sequence <SEQ ID 10522>. This protein and its epitopes could be useful antigens for vaccines and/or diagnostics.

EXAMPLE 3162

A DNA sequence <SEQ ID 10523> was identified in GBS which encodes amino acid sequence <SEQ ID 10524>. This protein and its epitopes could be useful antigens for vaccines and/or diagnostics.

EXAMPLE 3163

A DNA sequence <SEQ ID 10525> was identified in GBS which encodes amino acid sequence <SEQ ID 10526>. This protein and its epitopes could be useful antigens for vaccines and/or diagnostics.

EXAMPLE 3164

A DNA sequence <SEQ ID 10527> was identified in GBS which encodes amino acid sequence <SEQ ID 10528>. This protein and its epitopes could be useful antigens for vaccines and/or diagnostics.

EXAMPLE 3165

A DNA sequence <SEQ ID 10529> was identified in GBS which encodes amino acid sequence <SEQ ID 10530>. This protein and its epitopes could be useful antigens for vaccines and/or diagnostics.

EXAMPLE 3166

A DNA sequence <SEQ ID 10531> was identified in GBS which encodes amino acid sequence <SEQ ID 10532>. This protein and its epitopes could be useful antigens for vaccines and/or diagnostics.

EXAMPLE 3167

A DNA sequence <SEQ ID 10533> was identified in GBS which encodes amino acid sequence <SEQ ID 10534>. This protein and its epitopes could be useful antigens for vaccines and/or diagnostics.

EXAMPLE 3168

A DNA sequence <SEQ ID 10535> was identified in GBS which encodes amino acid sequence <SEQ ID 10536>. This protein and its epitopes could be useful antigens for vaccines and/or diagnostics.

EXAMPLE 3169

A DNA sequence <SEQ ID 10537> was identified in GBS which encodes amino acid sequence <SEQ ID 10538>. This protein and its epitopes could be useful antigens for vaccines and/or diagnostics.

EXAMPLE 3170

A DNA sequence <SEQ ID 10539> was identified in GBS which encodes amino acid sequence <SEQ ID 10540>. This protein and its epitopes could be useful antigens for vaccines and/or diagnostics.

EXAMPLE 3171

A DNA sequence <SEQ ID 10541> was identified in GBS which encodes amino acid sequence <SEQ ID 10542>. This protein and its epitopes could be useful antigens for vaccines and/or diagnostics.

EXAMPLE 3172

A DNA sequence <SEQ ID 10543> was identified in GBS which encodes amino acid sequence <SEQ ID 10544>. This protein and its epitopes could be useful antigens for vaccines and/or diagnostics.

EXAMPLE 3173

A DNA sequence <SEQ ID 10545> was identified in GBS which encodes amino acid sequence <SEQ ID 10546>. This protein and its epitopes could be useful antigens for vaccines and/or diagnostics.

SEQ ID 10546 (GBS665) was expressed in *E. coli* as a GST-fusion product. SDS-PAGE analysis of total cell extract is shown in FIG. 137 (lane 8-10; MW 41 kDa) and in FIG. 187 (lane 5; MW 41 kDa). It was also was expressed in *E. coli* as a His-fusion product. SDS-PAGE analysis of total cell extract is shown in FIG. 137 (lane 11 & 12; MW 16.1 kDa), in FIG. 141 (lane 4; MW 16 kDa) and in FIG. 179 (lane 6; MW 16 kDa). Purified GBS665-GST is shown in FIG. 243, lane 4.

Figure 230:
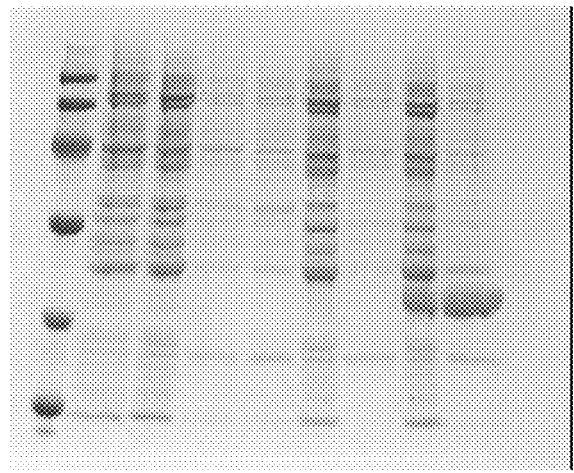

GBS665-His was purified as shown in FIG. 230, lane 7-8.

EXAMPLE 3174

A DNA sequence <SEQ ID 10547> was identified in GBS which encodes amino acid sequence <SEQ ID 10548>. This protein and its epitopes could be useful antigens for vaccines and/or diagnostics. A related GBS nucleic acid sequence <SEQ ID 10909> which encodes amino acid sequence <SEQ ID 10910> was also identified.

EXAMPLE 3175

A DNA sequence <SEQ ID 10549> was identified in GBS which encodes amino acid sequence <SEQ ID 10550>. This protein and its epitopes could be useful antigens for vaccines and/or diagnostics.

EXAMPLE 3176

A DNA sequence <SEQ ID 10551> was identified in GBS which encodes amino acid sequence <SEQ ID 10552>. This protein and its epitopes could be useful antigens for vaccines and/or diagnostics.

EXAMPLE 3177

A DNA sequence <SEQ ID 10553> was identified in GBS which encodes amino acid sequence <SEQ ID 10554>. This protein and its epitopes could be useful antigens for vaccines and/or diagnostics.

EXAMPLE 3178

A DNA sequence <SEQ ID 10555> was identified in GBS which encodes amino acid sequence <SEQ ID 10556>. This protein and its epitopes could be useful antigens for vaccines and/or diagnostics.

EXAMPLE 3179

A DNA sequence <SEQ ID 10557> was identified in GBS which encodes amino acid sequence <SEQ ID 10558>. This protein and its epitopes could be useful antigens for vaccines and/or diagnostics.

EXAMPLE 3180

A DNA sequence <SEQ ID 10559> was identified in GBS which encodes amino acid sequence <SEQ ID 10560>. This protein and its epitopes could be useful antigens for vaccines and/or diagnostics.

EXAMPLE 3181

A DNA sequence <SEQ ID 10561> was identified in GBS which encodes amino acid sequence <SEQ ID 10562>. This protein and its epitopes could be useful antigens for vaccines and/or diagnostics.

EXAMPLE 3182

A DNA sequence <SEQ ID 10563> was identified in GBS which encodes amino acid sequence <SEQ ID 10564>. This protein and its epitopes could be useful antigens for vaccines and/or diagnostics.

EXAMPLE 3183

A DNA sequence <SEQ ID 10565> was identified in GBS which encodes amino acid sequence <SEQ ID 10566>. This protein and its epitopes could be useful antigens for vaccines and/or diagnostics.

EXAMPLE 3184

A DNA sequence <SEQ ID 10567> was identified in GBS which encodes amino acid sequence <SEQ ID 10568>. This protein and its epitopes could be useful antigens for vaccines and/or diagnostics.

EXAMPLE 3185

A DNA sequence <SEQ ID 10569> was identified in GBS which encodes amino acid sequence <SEQ ID 10570>. This protein and its epitopes could be useful antigens for vaccines and/or diagnostics.

EXAMPLE 3186

A DNA sequence <SEQ ID 10571> was identified in GBS which encodes amino acid sequence <SEQ ID 10572>. This protein and its epitopes could be useful antigens for vaccines and/or diagnostics.

EXAMPLE 3187

A DNA sequence <SEQ ID 10573> was identified in GBS which encodes amino acid sequence <SEQ ID 10574>. This protein and its epitopes could be useful antigens for vaccines and/or diagnostics.

EXAMPLE 3188

A DNA sequence <SEQ ID 10575> was identified in GBS which encodes amino acid sequence <SEQ ID 10576>. This protein and its epitopes could be useful antigens for vaccines and/or diagnostics.

EXAMPLE 3189

A DNA sequence <SEQ ID 10577> was identified in GBS which encodes amino acid sequence <SEQ ID 10578>. This protein and its epitopes could be useful antigens for vaccines and/or diagnostics.

EXAMPLE 3190

A DNA sequence <SEQ ID 10579> was identified in GBS which encodes amino acid sequence <SEQ ID 10580>. This protein and its epitopes could be useful antigens for vaccines and/or diagnostics.

EXAMPLE 3191

A DNA sequence <SEQ ID 10581> was identified in GBS which encodes amino acid sequence <SEQ ID 10582>. This protein and its epitopes could be useful antigens for vaccines and/or diagnostics.

EXAMPLE 3192

A DNA sequence <SEQ ID 10583> was identified in GBS which encodes amino acid sequence <SEQ ID 10584>. This protein and its epitopes could be useful antigens for vaccines and/or diagnostics.

EXAMPLE 3193

A DNA sequence <SEQ ID 10585> was identified in GBS which encodes amino acid sequence <SEQ ID 10586>. This protein and its epitopes could be useful antigens for vaccines and/or diagnostics.

EXAMPLE 3194

A DNA sequence <SEQ ID 10587> was identified in GBS which encodes amino acid sequence <SEQ ID 10588>. This protein and its epitopes could be useful antigens for vaccines and/or diagnostics.

EXAMPLE 3195

A DNA sequence <SEQ ID 10591> was identified in GBS which encodes amino acid sequence <SEQ ID 10592>. This protein and its epitopes could be useful antigens for vaccines and/or diagnostics.

EXAMPLE 3196

A DNA sequence <SEQ ID 10593> was identified in GBS which encodes amino acid sequence <SEQ ID 10594>. This protein and its epitopes could be useful antigens for vaccines and/or diagnostics.

EXAMPLE 3197

A DNA sequence <SEQ ID 10595> was identified in GBS which encodes amino acid sequence <SEQ ID 10596>. This protein and its epitopes could be useful antigens for vaccines and/or diagnostics.

EXAMPLE 3198

A DNA sequence <SEQ ID 10597> was identified in GBS which encodes amino acid sequence <SEQ ID 10598>. This protein and its epitopes could be useful antigens for vaccines and/or diagnostics. A related GBS nucleic acid sequence <SEQ ID 10797> which encodes amino acid sequence <SEQ ID 10798> was also identified.

EXAMPLE 3199

A DNA sequence <SEQ ID 10599> was identified in GBS which encodes amino acid sequence <SEQ ID 10600>. This protein and its epitopes could be useful antigens for vaccines and/or diagnostics.

EXAMPLE 3200

A DNA sequence <SEQ ID 10601> was identified in GBS which encodes amino acid sequence <SEQ ID 10602>. This protein and its epitopes could be useful antigens for vaccines and/or diagnostics.

EXAMPLE 3201

A DNA sequence <SEQ ID 10603> was identified in GBS which encodes amino acid sequence <SEQ ID 10604>. This protein and its epitopes could be useful antigens for vaccines and/or diagnostics.

EXAMPLE 3202

A DNA sequence <SEQ ID 10605> was identified in GBS which encodes amino acid sequence <SEQ ID 10606>. This protein and its epitopes could be useful antigens for vaccines and/or diagnostics.

EXAMPLE 3203

A DNA sequence <SEQ ID 10607> was identified in GBS which encodes amino acid sequence <SEQ ID 10608>. This protein and its epitopes could be useful antigens for vaccines and/or diagnostics.

EXAMPLE 3204

A DNA sequence <SEQ ID 10609> was identified in GBS which encodes amino acid sequence <SEQ ID 10610>. This protein and its epitopes could be useful antigens for vaccines and/or diagnostics.

EXAMPLE 3205

A DNA sequence <SEQ ID 10611> was identified in GBS which encodes amino acid sequence <SEQ ID 10612>. This protein and its epitopes could be useful antigens for vaccines and/or diagnostics.

EXAMPLE 3206

A DNA sequence <SEQ ID 10613> was identified in GBS which encodes amino acid sequence <SEQ ID 10614>. This protein and its epitopes could be useful antigens for vaccines and/or diagnostics.

EXAMPLE 3207

A DNA sequence <SEQ ID 10615> was identified in GBS which encodes amino acid sequence <SEQ ID 10616>. This protein and its epitopes could be useful antigens for vaccines and/or diagnostics.

EXAMPLE 3208

A DNA sequence <SEQ ID 10617> was identified in GBS which encodes amino acid sequence <SEQ ID 10618>. This protein and its epitopes could be useful antigens for vaccines and/or diagnostics.

EXAMPLE 3209

A DNA sequence <SEQ ID 10619> was identified in GBS which encodes amino acid sequence <SEQ ID 10620>. This protein and its epitopes could be useful antigens for vaccines and/or diagnostics.

EXAMPLE 3210

A DNA sequence <SEQ ID 10621> was identified in GBS which encodes amino acid sequence <SEQ ID 10622>. This protein and its epitopes could be useful antigens for vaccines and/or diagnostics.

EXAMPLE 3211

A DNA sequence <SEQ ID 10623> was identified in GBS which encodes amino acid sequence <SEQ ID 10624>. This protein and its epitopes could be useful antigens for vaccines and/or diagnostics.

EXAMPLE 3212

A DNA sequence <SEQ ID 10625> was identified in GBS which encodes amino acid sequence <SEQ ID 10626>. This protein and its epitopes could be useful antigens for vaccines and/or diagnostics.

EXAMPLE 3213

A DNA sequence <SEQ ID 10627> was identified in GBS which encodes amino acid sequence <SEQ ID 10628>. This protein and its epitopes could be useful antigens for vaccines and/or diagnostics.

EXAMPLE 3214

A DNA sequence <SEQ ID 10629> was identified in GBS which encodes amino acid sequence <SEQ ID 10630>. This protein and its epitopes could be useful antigens for vaccines and/or diagnostics.

EXAMPLE 3215

A DNA sequence <SEQ ID 10631> was identified in GBS which encodes amino acid sequence <SEQ ID 10632>. This protein and its epitopes could be useful antigens for vaccines and/or diagnostics.

EXAMPLE 3216

A DNA sequence <SEQ ID 10633> was identified in GBS which encodes amino acid sequence <SEQ ID 10634>. This protein and its epitopes could be useful antigens for vaccines and/or diagnostics. A related GBS nucleic acid sequence <SEQ ID 10939> which encodes amino acid sequence <SEQ ID 10940> was also identified.

SEQ ID 10634 (GBS675) was expressed in *E. coli* as a GST-fusion product. SDS-PAGE analysis of total cell extract is shown in FIG. 162 (lane 14 & 15; MW 56 kDa). It was also expressed in *E. coli* as a His-fusion product. SDS-PAGE analysis of total cell extract is shown in FIG. 163 (lane 2; MW 31 kDa) and in FIG. 188 (lane 5; MW 31 kDa).

Purified GBS675-His is shown in FIG. 240, lane 7-8.

EXAMPLE 3217

A DNA sequence <SEQ ID 10635> was identified in GBS which encodes amino acid sequence <SEQ ID 10636>. This protein and its epitopes could be useful antigens for vaccines and/or diagnostics.

EXAMPLE 3218

A DNA sequence <SEQ ID 10637> was identified in GBS which encodes amino acid sequence <SEQ ID 10638>. This protein and its epitopes could be useful antigens for vaccines and/or diagnostics.

EXAMPLE 3219

A DNA sequence <SEQ ID 10639> was identified in GBS which encodes amino acid sequence <SEQ ID 10640>. This protein and its epitopes could be useful antigens for vaccines and/or diagnostics.

EXAMPLE 3220

A DNA sequence <SEQ ID 10641> was identified in GBS which encodes amino acid sequence <SEQ ID 10642>. This protein and its epitopes could be useful antigens for vaccines and/or diagnostics.

EXAMPLE 3221

A DNA sequence <SEQ ID 10643> was identified in GBS which encodes amino acid sequence <SEQ ID 10644>. This protein and its epitopes could be useful antigens for vaccines and/or diagnostics.

EXAMPLE 3222

A DNA sequence <SEQ ID 10645> was identified in GBS which encodes amino acid sequence <SEQ ID 10646>. This protein and its epitopes could be useful antigens for vaccines and/or diagnostics.

EXAMPLE 3223

A DNA sequence <SEQ ID 10647> was identified in GBS which encodes amino acid sequence <SEQ ID 10648>. This protein and its epitopes could be useful antigens for vaccines and/or diagnostics.

EXAMPLE 3224

A DNA sequence <SEQ ID 10649> was identified in GBS which encodes amino acid sequence <SEQ ID 10650>. This protein and its epitopes could be useful antigens for vaccines and/or diagnostics.

EXAMPLE 3225

A DNA sequence <SEQ ID 10651> was identified in GBS which encodes amino acid sequence <SEQ ID 10652>. This protein and its epitopes could be useful antigens for vaccines and/or diagnostics.

EXAMPLE 3226

A DNA sequence <SEQ ID 10653> was identified in GBS which encodes amino acid sequence <SEQ ID 10654>. This protein and its epitopes could be useful antigens for vaccines and/or diagnostics.

EXAMPLE 3227

A DNA sequence <SEQ ID 10655> was identified in GBS which encodes amino acid sequence <SEQ ID 10656>. This protein and its epitopes could be useful antigens for vaccines and/or diagnostics.

EXAMPLE 3228

A DNA sequence <SEQ ID 10657> was identified in GBS which encodes amino acid sequence <SEQ ID 10658>. This protein and its epitopes could be useful antigens for vaccines and/or diagnostics.

EXAMPLE 3229

A DNA sequence <SEQ ID 10659> was identified in GBS which encodes amino acid sequence <SEQ ID 10660>. This protein and its epitopes could be useful antigens for vaccines and/or diagnostics.

EXAMPLE 3230

A DNA sequence <SEQ ID 10661> was identified in GBS which encodes amino acid sequence <SEQ ID 10662>. This protein and its epitopes could be useful antigens for vaccines and/or diagnostics.

EXAMPLE 3231

A DNA sequence <SEQ ID 10663> was identified in GBS which encodes amino acid sequence <SEQ ID 10664>. This protein and its epitopes could be useful antigens for vaccines and/or diagnostics.

EXAMPLE 3232

A DNA sequence <SEQ ID 10665> was identified in GBS which encodes amino acid sequence <SEQ ID 10666>. This protein and its epitopes could be useful antigens for vaccines and/or diagnostics. A related GBS nucleic acid sequence <SEQ ID 10917> which encodes amino acid sequence <SEQ ID 10918> was also identified.

A DNA sequence <SEQ ID 10667> was identified in GBS which encodes amino acid sequence <SEQ ID 10668>. This protein and its epitopes could be useful antigens for vaccines and/or diagnostics.

EXAMPLE 3233

A DNA sequence <SEQ ID 10669> was identified in GBS which encodes amino acid sequence <SEQ ID 10670>. This protein and its epitopes could be useful antigens for vaccines and/or diagnostics.

EXAMPLE 3234

A DNA sequence <SEQ ID 10671> was identified in GBS which encodes amino acid sequence <SEQ ID 10672>. This protein and its epitopes could be useful antigens for vaccines and/or diagnostics.

EXAMPLE 3235

A DNA sequence <SEQ ID 10673> was identified in GBS which encodes amino acid sequence <SEQ ID 10674>. This protein and its epitopes could be useful antigens for vaccines and/or diagnostics.

EXAMPLE 3236

A DNA sequence <SEQ ID 10675> was identified in GBS which encodes amino acid sequence <SEQ ID 10676>. This protein and its epitopes could be useful antigens for vaccines and/or diagnostics.

EXAMPLE 3237

A DNA sequence <SEQ ID 10677> was identified in GBS which encodes amino acid sequence <SEQ ID 10678>. This protein and its epitopes could be useful antigens for vaccines and/or diagnostics.

EXAMPLE 3238

A DNA sequence <SEQ ID 10679> was identified in GBS which encodes amino acid sequence <SEQ ID 10680>. This protein and its epitopes could be useful antigens for vaccines and/or diagnostics.

EXAMPLE 3239

A DNA sequence <SEQ ID 10681> was identified in GBS which encodes amino acid sequence <SEQ ID 10682>. This protein and its epitopes could be useful antigens for vaccines and/or diagnostics.

EXAMPLE 3240

A DNA sequence <SEQ ID 10683> was identified in GBS which encodes amino acid sequence <SEQ ID 10684>. This protein and its epitopes could be useful antigens for vaccines and/or diagnostics.

EXAMPLE 3241

A DNA sequence <SEQ ID 10685> was identified in GBS which encodes amino acid sequence <SEQ ID 10686>. This protein and its epitopes could be useful antigens for vaccines and/or diagnostics.

EXAMPLE 3242

A DNA sequence <SEQ ID 10687> was identified in GBS which encodes amino acid sequence <SEQ ID 10688>. This protein and its epitopes could be useful antigens for vaccines and/or diagnostics.

EXAMPLE 3243

A DNA sequence <SEQ ID 10689> was identified in GBS which encodes amino acid sequence <SEQ ID 10690>. This protein and its epitopes could be useful antigens for vaccines and/or diagnostics.

EXAMPLE 3244

A DNA sequence <SEQ ID 10691> was identified in GBS which encodes amino acid sequence <SEQ ID 10692>. This protein and its epitopes could be useful antigens for vaccines and/or diagnostics.

SEQ ID 10692 (GBS676) was expressed in *E. coli* as a GST-fusion product. SDS-PAGE analysis of total cell extract is shown in FIG. 163 (lane 3-5; MW 66 kDa) and in FIG. 239 (lane 8; MW 66 kDa). It was also expressed in *E. coli* as a His-fusion product. SDS-PAGE analysis of total cell extract is shown in FIG. 163 (lane 7 & 8; MW 41 kDa) and in FIG. 188 (lane 6; MW 41 kDa). Purified GBS676-His is shown in FIG. 240, lane 4-5. Purified GBS676-GST is shown in FIG. 246, lanes 10 & 11.

EXAMPLE 3245

A DNA sequence <SEQ ID 10693> was identified in GBS which encodes amino acid sequence <SEQ ID 10694>. This protein and its epitopes could be useful antigens for vaccines and/or diagnostics.

EXAMPLE 3246

A DNA sequence <SEQ ID 10695> was identified in GBS which encodes amino acid sequence <SEQ ID 10696>. This protein and its epitopes could be useful antigens for vaccines and/or diagnostics.

EXAMPLE 3247

A DNA sequence <SEQ ID 10697> was identified in GBS which encodes amino acid sequence <SEQ ID 10698>. This protein and its epitopes could be useful antigens for vaccines and/or diagnostics.

EXAMPLE 3248

A DNA sequence <SEQ ID 10699> was identified in GBS which encodes amino acid sequence <SEQ ID 10700>. This protein and its epitopes could be useful antigens for vaccines and/or diagnostics.

EXAMPLE 3249

A DNA sequence <SEQ ID 10703> was identified in GBS which encodes amino acid sequence <SEQ ID 10704>. This protein and its epitopes could be useful antigens for vaccines and/or diagnostics.

EXAMPLE 3250

A DNA sequence <SEQ ID 10705> was identified in GBS which encodes amino acid sequence <SEQ ID 10706>. This protein and its epitopes could be useful antigens for vaccines and/or diagnostics.

EXAMPLE 3251

A DNA sequence <SEQ ID 10707> was identified in GBS which encodes amino acid sequence <SEQ ID 10708>. This protein and its epitopes could be useful antigens for vaccines and/or diagnostics.

EXAMPLE 3252

A DNA sequence <SEQ ID 10709> was identified in GBS which encodes amino acid sequence <SEQ ID 10710>. This protein and its epitopes could be useful antigens for vaccines and/or diagnostics. A related GBS nucleic acid sequence <SEQ ID 10803> which encodes amino acid sequence <SEQ ID 10804> was also identified.

EXAMPLE 3253

A DNA sequence <SEQ ID 10711> was identified in GBS which encodes amino acid sequence <SEQ ID 10712>. This protein and its epitopes could be useful antigens for vaccines and/or diagnostics. A related GBS nucleic acid sequence <SEQ ID 10913> which encodes amino acid sequence <SEQ ID 10914> was also identified.

EXAMPLE 3254

A DNA sequence <SEQ ID 10713> was identified in GBS which encodes amino acid sequence <SEQ ID 10714>. This protein and its epitopes could be useful antigens for vaccines and/or diagnostics.

EXAMPLE 3255

A DNA sequence <SEQ ID 10715> was identified in GBS which encodes amino acid sequence <SEQ ID 10716>. This protein and its epitopes could be useful antigens for vaccines and/or diagnostics.

EXAMPLE 3256

A DNA sequence <SEQ ID 10717> was identified in GBS which encodes amino acid sequence <SEQ ID 10718>. This protein and its epitopes could be useful antigens for vaccines and/or diagnostics.

EXAMPLE 3257

A DNA sequence <SEQ ID 10719> was identified in GBS which encodes amino acid sequence <SEQ ID 10720>. This protein and its epitopes could be useful antigens for vaccines and/or diagnostics.

EXAMPLE 3258

A DNA sequence <SEQ ID 10721> was identified in GBS which encodes amino acid sequence <SEQ ID 10722>. This protein and its epitopes could be useful antigens for vaccines and/or diagnostics.

EXAMPLE 3259

A DNA sequence <SEQ ID 10723> was identified in GBS which encodes amino acid sequence <SEQ ID 10724>. This protein and its epitopes could be useful antigens for vaccines and/or diagnostics.

EXAMPLE 3260

A DNA sequence <SEQ ID 10725> was identified in GBS which encodes amino acid sequence <SEQ ID 10726>. This protein and its epitopes could be useful antigens for vaccines and/or diagnostics.

EXAMPLE 3261

A DNA sequence <SEQ ID 10727> was identified in GBS which encodes amino acid sequence <SEQ ID 10728>. This protein and its epitopes could be useful antigens for vaccines and/or diagnostics.

EXAMPLE 3262

A DNA sequence <SEQ ID 10729> was identified in GBS which encodes amino acid sequence <SEQ ID 10730>. This protein and its epitopes could be useful antigens for vaccines and/or diagnostics.

Figure 140:
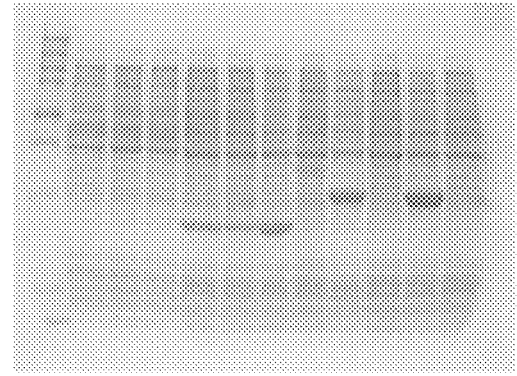

SEQ ID 10730 (GBS670) was expressed in *E. coli* as a GST-fusion product. SDS-PAGE analysis of total cell extract is shown in FIG. 140 (lane 24; MW 45.3 kDa). It was also expressed in *E. coli* as a His-fusion product. SDS-PAGE analysis of total cell extract is shown in FIG. 140 (lane 5-7; MW 20.4 kDa) and in FIG. 179 (lane 10; MW 20 kDa).

GBS670-His was purified as shown in FIG. 230, lane 9-10.

EXAMPLE 3263

A DNA sequence <SEQ ID 10731> was identified in GBS which encodes amino acid sequence <SEQ ID 10732>. This protein and its epitopes could be useful antigens for vaccines and/or diagnostics.

EXAMPLE 3264

A DNA sequence <SEQ ID 10733> was identified in GBS which encodes amino acid sequence <SEQ ID 10734>. This protein and its epitopes could be useful antigens for vaccines and/or diagnostics.

EXAMPLE 3265

A DNA sequence <SEQ ID 10735> was identified in GBS which encodes amino acid sequence <SEQ ID 10736>. This protein and its epitopes could be useful antigens for vaccines and/or diagnostics.

EXAMPLE 3266

A DNA sequence <SEQ ID 10737> was identified in GBS which encodes amino acid sequence <SEQ ID 10738>. This protein and its epitopes could be useful antigens for vaccines and/or diagnostics.

EXAMPLE 3267

A DNA sequence <SEQ ID 10739> was identified in GBS which encodes amino acid sequence <SEQ ID 10740>. This protein and its epitopes could be useful antigens for vaccines and/or diagnostics.

EXAMPLE 3268

A DNA sequence <SEQ ID 10741> was identified in GBS which encodes amino acid sequence <SEQ ID 10742>. This protein and its epitopes could be useful antigens for vaccines and/or diagnostics.

EXAMPLE 3269

A DNA sequence <SEQ ID 10743> was identified in GBS which encodes amino acid sequence <SEQ ID 10744>. This protein and its epitopes could be useful antigens for vaccines and/or diagnostics.

EXAMPLE 3270

A DNA sequence <SEQ ID 10745> was identified in GBS which encodes amino acid sequence <SEQ ID 10746>. This protein and its epitopes could be useful antigens for vaccines and/or diagnostics.

EXAMPLE 3271

A DNA sequence <SEQ ID 10747> was identified in GBS which encodes amino acid sequence <SEQ ID 10748>. This protein and its epitopes could be useful antigens for vaccines and/or diagnostics.

EXAMPLE 3272

A DNA sequence <SEQ ID 10749> was identified in GBS which encodes amino acid sequence <SEQ ID 10750>. This protein and its epitopes could be useful antigens for vaccines and/or diagnostics.

EXAMPLE 3273

A DNA sequence <SEQ ID 10751> was identified in GBS which encodes amino acid sequence <SEQ ID 10752>. This protein and its epitopes could be useful antigens for vaccines and/or diagnostics.

EXAMPLE 3274

A DNA sequence <SEQ ID 10753> was identified in GBS which encodes amino acid sequence <SEQ ID 10754>. This protein and its epitopes could be useful antigens for vaccines and/or diagnostics.

EXAMPLE 3275

A DNA sequence <SEQ ID 10755> was identified in GBS which encodes amino acid sequence <SEQ ID 10756>. This protein and its epitopes could be useful antigens for vaccines and/or diagnostics.

EXAMPLE 3276

A DNA sequence <SEQ ID 10757> was identified in GBS which encodes amino acid sequence <SEQ ID 10758>. This protein and its epitopes could be useful antigens for vaccines and/or diagnostics.

EXAMPLE 3277

A DNA sequence <SEQ ID 10759> was identified in GBS which encodes amino acid sequence <SEQ ID 10760>. This protein and its epitopes could be useful antigens for vaccines and/or diagnostics.

EXAMPLE 3278

A DNA sequence <SEQ ID 10761> was identified in GBS which encodes amino acid sequence <SEQ ID 10762>. This protein and its epitopes could be useful antigens for vaccines and/or diagnostics.

EXAMPLE 3279

A DNA sequence <SEQ ID 10763> was identified in GBS which encodes amino acid sequence <SEQ ID 10764>. This protein and its epitopes could be useful antigens for vaccines and/or diagnostics.

EXAMPLE 3280

A DNA sequence <SEQ ID 10765> was identified in GBS which encodes amino acid sequence <SEQ ID 10766>. This protein and its epitopes could be useful antigens for vaccines and/or diagnostics.

EXAMPLE 3281

A DNA sequence <SEQ ID 10767> was identified in GBS which encodes amino acid sequence <SEQ ID 10768>. This protein and its epitopes could be useful antigens for vaccines and/or diagnostics.

EXAMPLE 3282

A DNA sequence <SEQ ID 10769> was identified in GBS which encodes amino acid sequence <SEQ ID 10770>. This protein and its epitopes could be useful antigens for vaccines and/or diagnostics.

EXAMPLE 3283

A DNA sequence <SEQ ID 10771> was identified in GBS which encodes amino acid sequence <SEQ ID 10772>. This protein and its epitopes could be useful antigens for vaccines and/or diagnostics.

EXAMPLE 3284

A repeated DNA sequence <SEQ ID 10791> was identified in GBS which encodes amino acid sequence <SEQ ID 10792>. This protein and its epitopes could be useful antigens for vaccines and/or diagnostics.

EXAMPLE 3285

A DNA sequence <SEQ ID 10805> was identified in GBS which encodes amino acid sequence <SEQ ID 10806>. This protein and its epitopes could be useful antigens for vaccines and/or diagnostics.

EXAMPLE 3286

A DNA sequence <SEQ ID 10807> was identified in GBS which encodes amino acid sequence <SEQ ID 10808>. This protein and its epitopes could be useful antigens for vaccines and/or diagnostics.

EXAMPLE 3287

A DNA sequence <SEQ ID 10809> was identified in GBS which encodes amino acid sequence <SEQ ID 10810>. This protein and its epitopes could be useful antigens for vaccines and/or diagnostics.

EXAMPLE 3288

A DNA sequence <SEQ ID 10811> was identified in GBS which encodes amino acid sequence <SEQ ID 10812>. This protein and its epitopes could be useful antigens for vaccines and/or diagnostics.

EXAMPLE 3289

A DNA sequence <SEQ ID 10813> was identified in GBS which encodes amino acid sequence <SEQ ID 10814>. This protein and its epitopes could be useful antigens for vaccines and/or diagnostics.

EXAMPLE 3290

A DNA sequence <SEQ ID 10815> was identified in GBS which encodes amino acid sequence <SEQ ID 10816>. This protein and its epitopes could be useful antigens for vaccines and/or diagnostics.

EXAMPLE 3291

A DNA sequence <SEQ ID 10817> was identified in GBS which encodes amino acid sequence <SEQ ID 10818>. This protein and its epitopes could be useful antigens for vaccines and/or diagnostics.

EXAMPLE 3292

A DNA sequence <SEQ ID 10819> was identified in GBS which encodes amino acid sequence <SEQ ID 10820>. This protein and its epitopes could be useful antigens for vaccines and/or diagnostics.

EXAMPLE 3293

A DNA sequence <SEQ ID 10821> was identified in GBS which encodes amino acid sequence <SEQ ID 10822>. This protein and its epitopes could be useful antigens for vaccines and/or diagnostics.

EXAMPLE 3294

A DNA sequence <SEQ ID 10823> was identified in GBS which encodes amino acid sequence <SEQ ID 10824>. This protein and its epitopes could be useful antigens for vaccines and/or diagnostics.

EXAMPLE 3295

A DNA sequence <SEQ ID 10825> was identified in GBS which encodes amino acid sequence <SEQ ID 10826>. This protein and its epitopes could be useful antigens for vaccines and/or diagnostics.

EXAMPLE 3296

A DNA sequence <SEQ ID 10827> was identified in GBS which encodes amino acid sequence <SEQ ID 10828>. This protein and its epitopes could be useful antigens for vaccines and/or diagnostics.

EXAMPLE 3297

A DNA sequence <SEQ ID 10829> was identified in GBS which encodes amino acid sequence <SEQ ID 10830>. This protein and its epitopes could be useful antigens for vaccines and/or diagnostics.

EXAMPLE 3298

A DNA sequence <SEQ ID 10831> was identified in GBS which encodes amino acid sequence <SEQ ID 10832>. This protein and its epitopes could be useful antigens for vaccines and/or diagnostics.

EXAMPLE 3299

A DNA sequence <SEQ ID 10833> was identified in GBS which encodes amino acid sequence <SEQ ID 10834>. This protein and its epitopes could be useful antigens for vaccines and/or diagnostics.

EXAMPLE 3300

A DNA sequence <SEQ ID 10835> was identified in GBS which encodes amino acid sequence <SEQ ID 10836>. This protein and its epitopes could be useful antigens for vaccines and/or diagnostics.

EXAMPLE 3301

A DNA sequence <SEQ ID 10837> was identified in GBS which encodes amino acid sequence <SEQ ID 10838>. This protein and its epitopes could be useful antigens for vaccines and/or diagnostics.

EXAMPLE 3302

A DNA sequence <SEQ ID 10839> was identified in GBS which encodes amino acid sequence <SEQ ID 10840>. This protein and its epitopes could be useful antigens for vaccines and/or diagnostics.

EXAMPLE 3303

A DNA sequence <SEQ ID 10841> was identified in GBS which encodes amino acid sequence <SEQ ID 10842>. This protein and its epitopes could be useful antigens for vaccines and/or diagnostics.

EXAMPLE 3304

A DNA sequence <SEQ ID 10843> was identified in GBS which encodes amino acid sequence <SEQ ID 10844>. This protein and its epitopes could be useful antigens for vaccines and/or diagnostics.

EXAMPLE 3305

A DNA sequence <SEQ ID 10845> was identified in GBS which encodes amino acid sequence <SEQ ID 10846>. This protein and its epitopes could be useful antigens for vaccines and/or diagnostics.

EXAMPLE 3306

A DNA sequence <SEQ ID 10847> was identified in GBS which encodes amino acid sequence <SEQ ID 10848>. This protein and its epitopes could be useful antigens for vaccines and/or diagnostics.

EXAMPLE 3307

A DNA sequence <SEQ ID 10849> was identified in GBS which encodes amino acid sequence <SEQ ID 10850>. This protein and its epitopes could be useful antigens for vaccines and/or diagnostics.

EXAMPLE 3308

A DNA sequence <SEQ ID 10851> was identified in GBS which encodes amino acid sequence <SEQ ID 10852>. This protein and its epitopes could be useful antigens for vaccines and/or diagnostics.

EXAMPLE 3309

A DNA sequence <SEQ ID 10853> was identified in GBS which encodes amino acid sequence <SEQ ID 10854>. Related sequences are <SEQ ID 10855>, <SEQ ID 10856>, <SEQ ID 10857>, <SEQ ID 10858>, <SEQ ID 10859>, <SEQ ID 10860>, <SEQ ID 10861>, <SEQ ID 10862>, <SEQ ID 10863>, <SEQ ID 10864>, <SEQ ID 10865> and <SEQ ID 10866>. These proteins and their epitopes could be useful antigens for vaccines and/or diagnostics.

EXAMPLE 3310

A DNA sequence <SEQ ID 10867> was identified in GBS which encodes amino acid sequence <SEQ ID 10868>. This protein and its epitopes could be useful antigens for vaccines and/or diagnostics.

EXAMPLE 3311

A DNA sequence <SEQ ID 10869> was identified in GBS which encodes amino acid sequence <SEQ ID 10870>. This protein and its epitopes could be useful antigens for vaccines and/or diagnostics.

EXAMPLE 3312

A DNA sequence <SEQ ID 10871> was identified in GBS which encodes amino acid sequence <SEQ ID 10872>. This protein and its epitopes could be useful antigens for vaccines and/or diagnostics.

EXAMPLE 3313

A DNA sequence <SEQ ID 10873> was identified in GBS which encodes amino acid sequence <SEQ ID 10874>. This protein and its epitopes could be useful antigens for vaccines and/or diagnostics.

EXAMPLE 3314

A DNA sequence <SEQ ID 10875> was identified in GBS which encodes amino acid sequence <SEQ ID 10876>. This protein and its epitopes could be useful antigens for vaccines and/or diagnostics.

EXAMPLE 3315

A DNA sequence <SEQ ID 10877> was identified in GBS which encodes amino acid sequence <SEQ ID 10878>. This protein and its epitopes could be useful antigens for vaccines and/or diagnostics.

EXAMPLE 3316

A DNA sequence <SEQ ID 10879> was identified in GBS which encodes amino acid sequence <SEQ ID 10880>. This protein and its epitopes could be useful antigens for vaccines and/or diagnostics.

EXAMPLE 3317

A DNA sequence <SEQ ID 10881> was identified in GBS which encodes amino acid sequence <SEQ ID 10882>. This protein and its epitopes could be useful antigens for vaccines and/or diagnostics.

EXAMPLE 3318

A DNA sequence <SEQ ID 10883> was identified in GBS which encodes amino acid sequence <SEQ ID 10884>. This protein and its epitopes could be useful antigens for vaccines and/or diagnostics.

EXAMPLE 3319

A DNA sequence <SEQ ID 10885> was identified in GBS which encodes amino acid sequence <SEQ ID 10886>. This protein and its epitopes could be useful antigens for vaccines and/or diagnostics.

EXAMPLE 3320

A DNA sequence <SEQ ID 10887> was identified in GBS which encodes amino acid sequence <SEQ ID 10888>. This protein and its epitopes could be useful antigens for vaccines and/or diagnostics.

EXAMPLE 3321

A DNA sequence <SEQ ID 10889> was identified in GBS which encodes amino acid sequence <SEQ ID 10890>. This protein and its epitopes could be useful antigens for vaccines and/or diagnostics.

EXAMPLE 3322

A DNA sequence <SEQ ID 10891> was identified in GBS which encodes amino acid sequence <SEQ ID 10892>. This protein and its epitopes could be useful antigens for vaccines and/or diagnostics.

EXAMPLE 3323

A DNA sequence <SEQ ID 10893> was identified in GBS which encodes amino acid sequence <SEQ ID 10894>. This protein and its epitopes could be useful antigens for vaccines and/or diagnostics.

EXAMPLE 3324

A DNA sequence <SEQ ID 10895> was identified in GBS which encodes amino acid sequence <SEQ ID 10896>. This protein and its epitopes could be useful antigens for vaccines and/or diagnostics.

EXAMPLE 3325

A DNA sequence <SEQ ID 10897> was identified in GBS which encodes amino acid sequence <SEQ ID 10898>. This protein and its epitopes could be useful antigens for vaccines and/or diagnostics.

EXAMPLE 3326

A DNA sequence <SEQ ID 10899> was identified in GBS which encodes amino acid sequence <SEQ ID 10900>. This protein and its epitopes could be useful antigens for vaccines and/or diagnostics.

EXAMPLE 3327

A DNA sequence <SEQ ID 10901> was identified in GBS which encodes amino acid sequence <SEQ ID 10902>. This protein and its epitopes could be useful antigens for vaccines and/or diagnostics.

EXAMPLE 3328

A DNA sequence <SEQ ID 10903> was identified in GBS which encodes amino acid sequence <SEQ ID 10904>. This protein and its epitopes could be useful antigens for vaccines and/or diagnostics.

EXAMPLE 3329

Seven rRNA genes were identified in *S. agalactiae*. These are SEQ IDs 12018 to 12024. These rRNA genes are particularly useful for diagnostic purposes and for phlyogenetic studies. An alignment of the rRNA sequences is shown below:

```
12023       ----------------------------------TTTCGAGTCAAAGTCATCAGCGTT
12024       ---------------------------------------------------------
12019       -----TCCAATCATACTTAATTTCACTAATATCTGGATTTTGACATATTCAGTTAATTCT
12021  . . . ATCGAATTGAACGGACTCAATTTGGTTGTTATGTAATTTT--ACATAATCTATGATTTCT
```

-continued

```
12020    ----------------------------------------------------------
12018    ----------------------------------------------------------
12022    --------------------------CTTCTTTGTTTTCTTTAGAGATATTAACTGTA

12023    TACTGTTACGGCAGCAGTTCCAAGAGTTACTCCACTCACAAGGACTGCTGATAATATTCT
12024    ----------------------------------------------------------
12019    TTTTCATGCTTTTTGAGATAAGCTACTTGTTCTTTTTTTATTACTTTTTTACCTTTCTTT
12021    TGCTCATGCTCTTTGAGATAGGCTAATTGTTCTTTTTTTGTCATTTTTTTATCTTTCTTC
12020    ----------------------------------------------------------
12018    ----------------------------------------------------------
12022    CCCACTTTGGGCGTTAAAATACCTAAAGTAGCCTTTATTAAAGTTGATTTAGCAGCCCCA

12023    TTTTTTCATTTTTATTAAACTACTCCTTTAC--GATAAGACATTAAATATTTTACCAAAA
12024    ----------------------------------------------------------
12019    ACTGCTGACTGTTTGCTATTTTTTACTTCGTTTGACTGACTTTTAGATTCACTATTCATT
12021    ACTTCTGATTGCTTGCTATTTTTTACTTCGTTTGACTGAATTTTATGTTCACTATTCATT
12020    ----------------------------------------------------------
12018    --------------------------CTTT-GATACAATATTATCAAATTATATTAA
12022    TTTTCACCTGTTAAGGTAACAAACTCCCCACT-GTCTAAATGGTAATTAACCCCTTCCAG

12023    AATTCACGAAATTATATTACGTCATTGTTACATTTATATTTGAAATCAACTATTTCTAAA
12024    ----------------------------------------------------------
12019    TGACAGCCTGCTAGTAACATCCCAATAATAGATATGGGAATTAACCATTTTACATATTTT
12021    TGACAGCCTCCAAGTATCATCCCAAAAATTGATATGGGAATTAACCATTTTATATATTTT
12020    ----------------------------------------------------------
12018    CGGTAAAGATATTGTTAAAGACCAAACTTGGATTATCAATCGT----TATCAAGAAATTA
12022    CA-CAGGATCGCTATCGTACTGAAAAGTAAGACCACTAACTGTAATATATCGCATGATTA

12023    TGAACCATAATCAAATCTAGAAAACGATAACCTTCTTCTATTCACTCT---ATCAATATA
12024    ----------------------------------------------------------
12019    TTCAACATGCTCTCTTTTCTTAGAAAATAAACTTCCCATGTCAAGTATCTAATAAAAATA
12021    CTCATCATGTTCTCTTTTCTTAGAATATAAATTTTATATATCAAGTATATAATGAAATTA
12020    ----------------------------------------------------------
12018    TTAGTG---ATTTGTCTTTAGGAAGCACTA--------TTGCAGAAGA---AATTACTCG
12022    CCCTTCT--AATTCTCTAGAGAAAAGATCAAGAAAACGTTCTAAAACG---ACCTTTTCG

12023    ATTACTCCATAGTGAAACTAAAAGAGAAATAAAAAAAGAGTATAATTACTCTTAAAATTA
12024    ----------------------------------------------------------
12019    ATTATTATTTACCAGTATGTTAAAACTAATATTAGTATAACAAA-TTTTCACGAGTTTAA
12021    ACTATTATTCACCAACATTATAAAATTAATTTTAGTATAACAAAATTTTCACGTATTTTT
12020    ---------ATCAAAAAACATGACCAGTATGAATTAAAGCAACGTATAATCAATGCCT
12018    CTCTAT--AGAGCAGCTAGCTTCACTTCCCATAGAAAATAATCAGTTTTTAT-ATGAT--
12022    TCCTTTGAAAAATGATTTACTAATCTTCCGTAAACCCCTAACGTATTGTCATGATGATGT

12023    TAATATTTACGGAGAATAAGGGATTCGAACCCTTGCGCCAGTTACCCGACCTAACGATTT
12024    ----------------------------------------------------------
12019    TT--TTTTAGTCGTAACATATACACTGAAAAATCTTATTATTTTATACTACCTATCTATC
12021    ATAGTTTTAGTCTTAACATGTAAACAGAAA------A--------------------TC
12020    TAATGCGTAAAGGATACCAGTACGAAGATA--------------------------TC
12018    ---TGTTTTTTAGCAGCCGGTGAAGATA-------------------ACAACGCAAAGTT
12022    GTGTGTTCATCTGCAATGGGTTTAGCAAGT----TCA---------GATAACTCAAAATA

12023    AGCAAACCGTCCTCTTCAGCCTCTTGAG--TAATTCTCCAAATTAATATTAATGGGCACG
12024    ----------------------------------------------------------
12019    ATTCACAAACACTTTTATTACTTCAGAACCTATGACATTTAGGAGTCCTCTTTGAATTTC
12021    ATTTGTATA-----T----------------------TTTAAATGCCCTAATTAAATT--
12020    AAAAGTGC------T----------------------TTAAGAGAATATTTATAAGAT--
12018    AGTTGCA-ACGTTTTTTAATCAAAATGA--CATTCCTGCAAGATATGTTCATCCAAACGA
12022    AGTAATACGAGCATCTTTAGAATCTTTA--TTCGCTTTCAACATATCCTGAGA-AATTAA

12023    AGTGGACTCGAACCACCGACCTCACGCTTATCAGGCGTGCGCTCTAACCACCTGAGCTAC
12024    ----------------------------------------------------------
12019    ATTTAAATGTTGAGTCTCCACTAACTCTTGAAAAATTTCCTTATTATTTCTGCTTGTTTT
12021    -----------------------------AATAATT-----AATATTTATTATTATATA
12020    -----------------------------AATAACTCTCAGACGATGTATT-TTACAGA
12018    AGCAGGAATTATTGTAACTAAAGAACCATG--TAATGCACGAATTATT--CCAG----GA
12022    ACTTTTTACTGCTTTAGTTACAGCTGCCTGACTAATATTTAACTTCTTAGCTAAATCAGA

12023    GCGCCCAAGCAAATGCTTGGTTTTACTTTTATGTAAAGTAAGCGGGTGACGAGAATCGA-
12024    ----------------------------------------------------------
12019    AAACCTTCTATAACGATTGCAATAATGAAAAACAAATATAAGTAATTTTCAGTAACTTTT
12021    AATTCTTCTACAATGA----------AAAAAATAAATATAT--A-TTACAAGTAACATT-
12020    AAAT----TATGATAA------A----CTATAACAGACGTAT--AAATTGTAGAAAGTTG-
12018    AGTTATGATAAGATTGA------GAACTTATGTCTATACAATGAGGTTCTTGTTATCCCT
12022    ATTTGTCAACTGCTCTT------GTGATAAAAGCATCAGAATGTGTTCTTGCGTATTAGT

12023    -ACTCGCGACAACAGCTTGGAAGGCTGTAGTTTTACCACTAAACTACACCCGCTAAAAAC
12024    ----------------------------------------------------------
12019    TCTCAAAATTACCAGCACAATACAAAAAAGACAAGGCTTCTAAACCTTGTCTTTATAAAT
12021    --TCACAATAAATTATCTAGTAGAAAAAAGACAAGGTTTAGAAACCTTGTCTTTATAAGT
12020    ----GTAGGCTATGAGATTACCTAAAGAAGGCGACTTTATTACAATTCAAAGTTACAAAC
```

```
12018    GGATTT---------TTTGG--AGTCACAGAAGATAAC-CAAATTTGTACCTTTTCAAGA
12022    CAATTTAA-CATCACTTTGACAAGTACCAAACAATAATTCATGTTGATTTTCTGCTTTAA

12023    TTATATAATAAATGGCGCGAGACGGAATCGAACCGCCGACACATGGAGCTTCAATCCATT
12024    ------------------------------------------------------------
12019    ATACCGGCGGCCGGGGTCGAACCGGCACGTCCGTGAGGACACTGGATTTTGAGTCCAGCG
12021    ATACCGGCGGCCGGGGTCGAACCGGCACGTCCGTGAGGACACTGGATTTTGAGTCCAGCG
12020    ATGATGGTAGTTTACACCGAACTTG-----GCGTGACACCA-TGGTATTAAAACAACCG
12018    GGGGGATCTGACATTACTGGATC--------CCTAATTGC--------AGCAGGCATAAA
12022    GCAAGATTTGAC-TCACTAAATGG-------TCTAATTTTTGTTCTAAAACTGTCATATA

12023    GCTCTACCAACTGAGCTACCGAGCCTATTGCGGGAGCAGGATTTGAACCTACGACCTTCG
12024    ------------------------------------------------------------
12019    CGTCTGCCAATTCCGCCACGCCGGCTATCTTAAAACTGGGGTAGCTGGATTCGA--ACCA
12021    CGTCTGCCAATTCCGCCACGCCGGCTATCTTAAAACTGGGGTAGCTGGATTCGA--ACCA
12020    AAAATGCC--CTCATTGGTGTTAATGATCAT---ACTTTAGTAACAGAAAATGATGGTCG
12018    AGCAGACCT-TTATGAGAACTTCACAGATGT----TGATGGTATATTTGCAGCACATCCA
12022    TACCT-CTT-TTTTGTTAACCAGTAAATTATATCACGAAGATATAGAAGAATCAATCATA

12023    GGTTA-TGAGCCCGACGAGCTACCTAGCTGCTCCA-------TCCCGCGATATCTTTAAA
12024    ------------------------------------------------------------
12019    ACGCA-TGAGGGAGTCAAAGTCCCTTGCCTTACCG-------CTTGGCTATACCCCATGA
12021    ACGCA-TGAGGGAGTCAAAGTCCCTTGCCTTACCG-------CTTGGCTATACCCCATGA
12020    ACGC--TGGGTGACACGAGAGCC--TGCAATA---------------GTATACTTTCATA
12018    GGT-------GTAGTTAAGAACCCTCACGCTA----------TCCCTGAGCTTACTTATA
12022    GATAGGTGAAGAAGATAAAACCTTTTATCTCAACAACCTAACTTTATAAACTTCTTTGCA

12023    GGA---------GGATGTGGGATTCGAACCCACGCACGCTTTTACAC--GCCTGACGGTT
12024    ------------------------------------------------------------
12019    AAAGGCG-----AGTGATGGGAATCGAACCCACGAATGTCAGAGCCACAATCTGATGTGT
12021    AAAGGCG-----AGTGATGGGAATCGAACCCACGAATGTCAGAGCCACAATCTGATGTGT
12020    AAA---------AATACTGG---T------TT--AACATTATCGCTA-----TGATACGT
12018    AAGA--------AATGCGTGAATTAGCCTATGCGGGTTTTTCGGTTT-TACATGATGAA-
12022    AAAACCTTTCATACTATTAAAAACACGATCAGCTTTTTTCTCTGTAG-AACACATTGAAA

12023    TTCAAGACCGTTCCCTTCAGCCGGACTTGGGTAATCCTCCATATAACAAAAAATATGGAC
12024    ------------------------------------------------------------
12019    TAACCACTTCACCACACCCGCCATATTAGAAAAAACACGGGCAGTAGGAATCGAACCCAC
12021    TAACCACTTCACCACACCCGCCATATTAGAAAAAACACGGGCAGTAGGAATCGAACCCAC
12020    GAAACTGGTGTCTCCTACTATTGTAATCTAGCAAGT-----CCGTATATCTTGGACCC--
12018    ---------GCTTTACTTCCTGCCTATCGTGGCAGAATCCCTCTTGTTATTAAAAATAC--
12022    AAACAGTTGGTCCACTTCCTGTC-ATTAATGCAACATCGGCTCCAGAATTTAACATAC--

12023    CTTGTAGGACTCGAACCTACGACCGCTCGGTTATGAGCCGAGTGCTCTAACCAGTTGAGC
12024    ------------------------------------------------------------
12019    ACTGAAGGTTTTGGAGACCTTAGTTCTACCTTTAAACTATGCCCGTTTACTATGGAGAGA
12021    ACTGAAGGTTTTGGAGACCTTAGTTCTACCTTTAAACTATGCCCGTTTACTATGGAGAGA
12020    --TGAAGCACTCAAGTATATTGACTATGACCTTGATGTCAAAGTATTTGCAGATGGTGAA
12018    ----AAA----TAATCCCCAACAGCCTGGTACAAAAATAGTTTTAAAGCATACTCGTAG-
12022    ----GTTCTTTTATTGTACTTATAACTGGATTTTTAGTAATTGTAATATCCTCGAGTGAA

12023    TAAAGGTCCAAAGTCTCAATAAAATAAATAGCGGCGGAGGGGATCGAACCCCCGACCTCC
12024    ------------------------------------------------------------
12019    GAGGGATTCGAACCCCCGAACCCGAAGGAGCGGATTTACAGTCCGCCGCGTTTAGCCTCT
12021    GAGGGATTCGAACCCCCGAACCCGAAGGAGCGGATTTACAGTCCGCCGCGTTTAGCCTCT
12020    AAAAGACTACTAGATGTGGACGAATATGAACAGCATAAAGYTCAGATGAACT--ATCCTA
12018    --TAACATAGCAGTAACTGG-GATCGCT--TCTGATAGCCGTTTTGCTAGCATAAACGTA
12022    TTTCCCATAGATTTGACCATTAACTGATAATCTGATGACAAAATAGCAGACTTTAATAAA

12023    CGGGTATG-AACCGGACGCTCTAGCCAGCT--GAGCTACACCGCCATAAAAATATATCCA
12024    ------------------------------------------------------------
12019    TCGCTATC-TCTCCTAAGGTATAAATGGCGCGAGACGGAATCGAACCGCCGACACATGGA
12021    TCGCTATC-TCTCCTAAGGTATAAATGGCGCGAGACGGAATCGAACCGCCGACACATGGA
12020    CCGATATT-GATTATATATTAAAGGAAAATGTAAAAATATTGGTAGAATGGATAAATGAG
12018    TCTAAAT--ACTTAATGAATAGA---GAAGTAGGGTTTCGGCCGAAAAG----TACTACAA
12022    TCAATATCAACTCTACTTATAGACTTACAATCAATATCTCTAAAAATGGATTTAGTTGAA

12023    TCGGGAAGACAGGATTCGAACCTGCGACACCTTGGTCCCAAACCAAGTACTCTACCAAGC
12024    ------------------------------------------------------------
12019    GCTTCAATCCATTGCTCTACCAACTGAGCTACCGAGCCTATTGCGGGAGCAGGATTTGAA
12021    GCTTCAATCCATTGCTCTACCAACTGAGCTACCGAGCCTATTGCGGGAGCAGGATTTGAA
12020    AATAAAGGCCCCTTTTC-ATCATC--ATATATCAA-TATCTGGTATAAACGGTA------
12018    ATTTTAGAG---GATTTAAATATT---AGTTTTGAACATATGCCAACTGGCATAGATGAT
12022    ATACCAAAATCCGGCTTAACCAGA---ACTATCCAACATGGTCTCAATGTCGGTAAGGGT

12023    TGAGCTACTTCCCGAAAAATATGCAC--CCTAGAGGAGTCGAACCTCTAACCGCCTGATT
12024    ------------------------------------------------------------
12019    CCTACGACCTTCGGGTTATGAGCCCG--ACGAGCTACCTAGCTGCTCCATCCCGCGATAT
12021    CCTACGACCTTCGGGTTATGAGCCCG--ACGAGCTACCTAGCTGCTCCATCCCGCGATAT
12020    --------CCTTGAATTGAAA-------AAGCGCTAACTAAC-ACACTAAATAGTG-TGT
12018    CTATCCATTGT---CTTACGTGAAA---AAGAATTGACACCAATCAAAGAACAAGAAATC
```

-continued
```
12022    TTAACAATTTCACCTTTACCTAATACTAACGAACATCCCCCACCAAGACAATAAGGAACA 12023    CGTAGTCAG---GTACTCTATCCAGTTGAGCTAAGGGTGCTAAATATTATA-----TGCC
12024    ------------------------------------------------------------
12019    CTTTAAAGGAGGATGTGGGATTCGAACCCACGCACGCTTTTACACGCCTGACG--GTTTT
12021    CTTTAAAGGAGGATGTGGGATTCGAACCCACGCACGCTTTTACACGCCTGACG--GTTTT
12020    TTTTATTA----ATATCAAATTTAATTACA---ATACTATTGCAAAAATAT----ATACT
12018    TTAAATTACCTAACTCGTAAACTAGAAGTAG--ATTACGTTGACATCCAA----------
12022    TC--ACTACC-AATTTAAAACCAATAGCAACCATTTCGTCATAGTCCATTTGAAGATTC 12023    GAGGACCGGAATC----GAACCGGTACGATGTTTACCATCGCAGGATTTTAAGTCCTGTG
12024    ------------------------------------------------------------
12019    CAAGACCGTTCCCTTCAGCCGGACTTGGGTAATCCTCCATATAACAAAAAATAGTCCGTA
12021    CAAGACCGTTCCCTTCAGCCGGACTTGGGTAATCCTCCATATAACAAAAAATAGTCCGTA
12020    TAAAATAAA-------AAAAGTAGAAAGATCACTTTCTACTTTTTTAAGAATAGTCCGTA
12018    CACAATCTATC-------TACAATCGTAATTGTAGGTGAAA-ATATGAAAGTCAGATTG
12022    CATAATCGATT-------AAGAGCTCTTATTGTAGCAGCAGCATCAGTAGAACCACCCCC 12023    CGTCTGCCAGTTCCGCCACCCCGGCCTCTAACAAGCGAACGACGGGGTTCGAACCCGCGA
12024    ------------------------------------------------------------
12019    CGGGATTCGAACCCGTGTTACCGCCGTGAAAAGGCGGTGTCTTAACCCCTTGACCAACGG
12021    CGGGATTCGAACCCGTGTTACCGCCGTGAAAAGGCGGTGTCTTAACCCCTTGACCAACGG
12020    CGGGATTCGAACCCGTGTTACCGCCGTGAAAAGGCGGTGTCTTAACCCCTTGACCAACGG
12018    GAGTCACTGCAACAGCGACACAAGCCTTATC------AAGAGAAAAA-----ATCAATAT
12022    CAGTC-CTGCACAGACAGGAATGGATTTTTCTAATCTAATATGAACACCTTTATTAATAC 12023    -CCCTCACCTT-----GGCAAGGTGATGTTCTACCACTGAACTACGTTCGCACTAAAGAC
12024    ------------------------------------------------------------
12019    -ACCATATTCTTGATGGGCACGAGTGGACTCGAACCACCGACCTCACGCTTATCAGGCGT
12021    -ACCATATTCTTGATGGGCACGAGTGGACTCGAACCACCGACCTCACGCTTATCAGGCGT
12020    -ACCATATTCTTGATGGGCACGAGTGGACTCGAACCACCGACCTCACGCTTATCAGGCGT
12018    CACCATGAT-----ATCACA-----AGGTTCAAGCGAA--GTCTCCATTATGT-------
12022    CATATTGATTTTTGATTATATCTGCAGCTTTAAACACATCATTATCATTATTTAAAGGCA 12023    ACTATTTATCCTATAAAATTGTAATGCCGGC-----------------------------
12024    ------TATCCTATAAAATTGTAATGCCGGC-----------------------------
12019    GCGCTCTAACCACCTGAGCTACGCGCCCAAAATAACTTCTAAAATTATAAAGTTAATGCC
12021    GCGCTCTAACCACCTGAGCTACGCGCCCAAG-------CTA-------------------
12020    GCGCTCTAACCACCTGAGCTACGCGCCCAAG-------CTA-------------------
12018    --TCGTTATAAACAGTAAGGATGAAAAAAGAG------------------------CTAT
12022    TTTTGCTACTATCAGAATCGATAACAATACAAT-----CTT---------------CCTT
             **        *

12023    ---TACATGACTTGAACACGCGACCCTCTGATTACAAATCAGATGCTCTACCAACTGAGC
12024    ---TACATGACTTGAACACGCGACCCTCTGATTACAAATCAGATGCTCTACCAACTGAGC
12019    GGCTACATGACTTGAACACGCGACCCTCTGATTACAAATCAGATGCTCTACCAACTGAGC
12021    --TTGCTTGGTTT-----T--TACTTTCTTATA-------A-------------------
12020    --TTGCTTGGTTT-----T--TACTTTCTTATA------------------A-------
12018    TAAAGCACTATATGAA-ACAT--TCTTCCAAA--AATAGTACCTATTACACTACTTACAC
12022    TAGCTCAGAAATGGTA-ACGTAGTCATTAAGATCAATACTAACCATAATCATAGCTAATT
              *              *

12023    TAAGCCGGCAATCTACTAATGCGGGTGAAGGGACTTGAACCCCCACGCCGTTAAGCGCCA
12024    TAAGCCGGCAATCTACTAATGCGGGTGAAGGGACTTGAACCCCCACGCCGTTAAGCGCCA
12019    TAAGCCGGCAATCTACTAATGCGGGTGAAGGGACTTGAACCCCCACGCCGTTAAGCGCCA
12021    ---------AG-----TAAAGCGGGTGACGAGAATCGAACTC------------------
12020    ---------AG-----TAAAGCGGGTGACGAGAATCGAACTC------------------
12018    TATTAGATAGATAA--CAAATCGTCCT-----AAGTAAGCTTA-------CTTAGGACGA
12022    CATGATAACCATCGT-CACATCGTCCTTTAATATCTAATCCTAAATTAAGTTTGGCAGGA
             *  **         *   * *

12023    GATCCTAAATCTGGTGCGTCTGCCAATTCCGCCACACCCGCATTTCTAAATGACCCGTAC
12024    GATCCTAAATCTGGTGCGTCTGCCAATTCCGCCACACCCGCATTTCTAAATGACCCGTAC
12019    GATCCTAAATCTGGTGCGTCTGCCAATTCCGCCACACCCGCATTTCTAAATGACCCGTAC
12021    ------------------------------GCGACAACAGC-------------------
12020    ------------------------------GCGACAACAGC-------------------
12018    TTTT----ATTTAGAACATAGGATAGTTTTTCCACTTTTAATCGTAA-------CCACTT
12022    GCTT----TCTCAAAAATTTTCATAAAACCTCCCTAATAAAATATAGAA-T-ATCCATAT
                                           *

12023    TGGGCTCGAACCAGTGACCCATTGATTAAAGTCAATTGCTCTACCAACTGAGCTAACGA
12024    TGGGCTCGAACCAGTGACCCATTGATTAAAGTCAATTGCTCTACCAACTGAGCTAACGA
12019    TGGGCTCGAACCAGTGACCCATTGATTAAAGTCAATTGCTCTACCAACTGAGCTAACGA
12021    --------------T-----------TGGAAGGCTGTAGTTTTACCA-CTAAACTA----
12020    ------------------------TTGGAAGGCTGTAGTTTTACCA-CTAAACTA----
12018    GGTATCA------GTGACA----AATTCGGA--CAATTAAGATGCTAGCCAATCTTAAGG
12022    TATAACATAACAAATGACA----AATTCGGA--CAATTAAGATGCTAGCCAATCTTAAGG
                              *   *   *       *   *  *   **

12023    GTCTACGGTCCCGACGGGAATCGAACCCGCGATCTTCGCCGTGACAGGGCGACGTGATAA
12024    GTCTACGGTCCCGACGGGAATCGAACCCGCGATCTTCGCCGTGACAGGGCGACGTGATAA
```

-continued

```
12019  GTCTACGGTCCCGACGGGAATCGAACCCGCGATCTTCGCCGTGACAGGGCGACGTGATAA
12021  --------------------------------------------CACC------------
12020  --------------------------------------------CACC------------
12018  ATA-ATAATTCCAATAAAAA--------------------AAGGCTAACCAAAGTTAGTC
12022  ATA-ATAATTCCAATAAAAA--------------------AAGGCTAACCAAAGTTAGTC
                                                *

12023  CCGCTACACTACGGGACCTATGGGAGTTAACGGGATCGAACCGCTGACCCTCTGCTTGTA
12024  CCGCTACACTACGGGACCTATGGGAGTTAACGGGATCGAACCGCTGACCCTCTGCTTGTA
12019  CCGCTACACTACGGGACCTATGGGAGTTAACGGGATCGAACCGCTGACCCTCTGCTTGTA
12021  -CGCT-----------TCTATGGGAGTTAACGGGATCGAACCGCTGACCCTCTGCTTGTA
12020  -CGCT-----------TCTATGGGAGTTAACGGGATCGAACCGCTGACCCTCTGCTTGTA
12018  TCCCTTTA--------TCTACTCCGCCAGTAGGACTCGAACCTACGACATCATGATTAAC
12022  TCCCTTTA--------TCTACTCCGCCAGTAGGACTCGAACCTACGACATCATGATTAAC
        * **            ***           ** *******    ***      ** **

12023  AGGCAGATGCT-CTCCCAGCTGAGCTAAACTCCCTTT--GCTAAGCGACTACCTTATCTC
12024  AGGCAGATGCT-CTCCCAGCTGAGCTAAACTCCCTTT--GCTAAGCGACTACCTTATCTC
12019  AGGCAGATGCT-CTCCCAGCTGAGCTAAACTCCCTTT--GCTAAGCGACTACCTTATCTC
12021  AGGCAGATGCT-CTCCCAGCTGAGCTAAACTCCCTTT--GCTAAGCGACTACCTTATCTC
12020  AGGCAGATGCT-CTCCCAGCTGAGCTAAACTCCCTTT--GCTAAGCGACTACCTTATCTC
12018  AGTCATGCGCTACTACCAACTGAGCTATGGCGGATTATAGCTAAGCGACTACCTTATCTC
12022  AGTCATGCGCTACTACCAACTGAGCTATGGCGGATTATAGCTAAGCGACTACCTTATCTC
       ** **   *** ** *** *******            **   ********************

12023  ACAGGGGGCAACCCCCAACTACTTCCGGCGTTCTAGGGCTTAACTTCTGTGTTCGGCATG
12024  ACAGGGGGCAACCCCCAACTACTTCCGGCGTTCTAGGGCTTAACTTCTGTGTTCGGCATG
12019  ACAGGGGGCAACCCCCAACTACTTCCGGCGTTCTAGGGCTTAACTTCTGTGTTCGGCATG
12021  ACAGGGGGCAACCCCCAACTACTTCCGGCGTTCTAGGGCTTAACTTCTGTGTTCGGCATG
12020  ACAGGGGGCAACCCCCAACTACTTCCGGCGTTCTAGGGCTTAACTTCTGTGTTCGGCATG
12018  ACAGGGGGCAACCCCCAACTACTTCCGGCGTTCTAGGGCTTAACTTCTGTGTTCGGCATG
12022  ACAGGGGGCAACCCCCAACTACTTCCGGCGTTCTAGGGCTTAACTTCTGTGTTCGGCATG
       ************************************************************

12023  AGAACAGGTGTATCTCCTAGGCAATTATCACTTAACTATTGAGCCTTATTCACTCAAAAT
12024  AGAACAGGTGTATCTCCTAGGCAATTATCACTTAACTATTGAGCCTTATTCACTCAAAAT
12019  AGAACAGGTGTATCTCCTAGGCAATTATCACTTAACTATTGAGCCTTATTCACTCAAAAT
12021  AGAACAGGTGTATCTCCTAGGCAATTATCACTTAACTATTGAGCCTTATTCACTCAAAAT
12020  AGAACAGGTGTATCTCCTAGGCAATTATCACTTAACTATTGAGCCTTATTCACTCAAAAT
12018  AGAACAGGTGTATCTCCTAGGCAATTATCACTTAACTATTGAGCCTTATTCACTCAAAAT
12022  AGAACAGGTGTATCTCCTAGGCAATTATCACTTAACTATTGAGCCTTATTCACTCAAAAT
       ************************************************************

12023  TGAATATCTATAGTCTAACAAGAAACCGTAACGTTGTCAATATCTCTTTTTGGATAAGTC
12024  TGAATATCTATAGTCTAACAAGAAACCGTAACGTTGTCAATATCTCTTTTTGGATAAGTC
12019  TGAATATCTATAGTCTAACAAGAAACCGTAACGTTGTCAATATCTCTTTTTGGATAAGTC
12021  TGAATATCTATAGTCTAACAAGAAACCGTAACGTTGTCAATATCTCTTTTTGGATAAGTC
12020  TGAATATCTATAGTCTAACAAGAAACCGTAACGTTGTCAATATCTCTTTTTGGATAAGTC
12018  TGAATATCTATAGTCTAACAAGAAACCGTAACGTTGTCAATATCTCTTTTTGGATAAGTC
12022  TGAATATCTATAGTCTAACAAGAAACCGTAACGTTGTCAATATCTCTTTTTGGATAAGTC
       ************************************************************

12023  CTCGAGCTATTAGTATTAGTCCGCTAAATGTGTCACCACAATTACACTCCTAACCTATCT
12024  CTCGAGCTATTAGTATTAGTCCGCTAAATGTGTCACCACAATTACACTCCTAACCTATCT
12019  CTCGAGCTATTAGTATTAGTCCGCTAAATGTGTCACCACAATTACACTCCTAACCTATCT
12021  CTCGAGCTATTAGTATTAGTCCGCTAAATGTGTCACCACAATTACACTCCTAACCTATCT
12020  CTCGAGCTATTAGTATTAGTCCGCTAAATGTGTCACCACAATTACACTCCTAACCTATCT
12018  CTCGAGCTATTAGTATTAGTCCGCTAAATGTGTCACCACAATTACACTCCTAACCTATCT
12022  CTCGAGCTATTAGTATTAGTCCGCTAAATGTGTCACCACAATTACACTCCTAACCTATCT
       ************************************************************

12023  ACCTGATCATCTCTCAGGGCTCTTACTGATATAAAATCATGGGAAATCTCATCTTGAGGT
12024  ACCTGATCATCTCTCAGGGCTCTTACTGATATAAAATCATGGGAAATCTCATCTTGAGGT
12019  ACCTGATCATCTCTCAGGGCTCTTACTGATATAAAATCATGGGAAATCTCATCTTGAGGT
12021  ACCTGATCATCTCTCAGGGCTCTTACTGATATAAAATCATGGGAAATCTCATCTTGAGGT
12020  ACCTGATCATCTCTCAGGGCTCTTACTGATATAAAATCATGGGAAATCTCATCTTGAGGT
12018  ACCTGATCATCTCTCAGGGCTCTTACTGATATAAAATCATGGGAAATCTCATCTTGAGGT
12022  ACCTGATCATCTCTCAGGGCTCTTACTGATATAAAATCATGGGAAATCTCATCTTGAGGT
       ************************************************************

12023  GGGCTTCGCACTTAGATGCTTTCAGCGCTTATCCCTTCCCTACATAGCTACCCAGCGATG
12024  GGGCTTCGCACTTAGATGCTTTCAGCGCTTATCCCTTCCCTACATAGCTACCCAGCGATG
12019  GGGCTTCGCACTTAGATGCTTTCAGCGCTTATCCCTTCCCTACATAGCTACCCAGCGATG
12021  GGGCTTCGCACTTAGATGCTTTCAGCGCTTATCCCTTCCCTACATAGCTACCCAGCGATG
12020  GGGCTTCGCACTTAGATGCTTTCAGCGCTTATCCCTTCCCTACATAGCTACCCAGCGATG
12018  GGGCTTCGCACTTAGATGCTTTCAGCGCTTATCCCTTCCCTACATAGCTACCCAGCGATG
12022  GGGCTTCGCACTTAGATGCTTTCAGCGCTTATCCCTTCCCTACATAGCTACCCAGCGATG
       ************************************************************

12023  CCTTTGGCAAGACAACTGGTACACCAGCGGTAAGTCCACTCTGGTCCTCTCGTACTAGGA
12024  CCTTTGGCAAGACAACTGGTACACCAGCGGTAAGTCCACTCTGGTCCTCTCGTACTAGGA
```

```
                                  -continued
12019   CCTTTGGCAAGACAACTGGTACACCAGCGGTAAGTCCACTCTGGTCCTCTCGTACTAGGA
12021   CCTTTGGCAAGACAACTGGTACACCAGCGGTAAGTCCACTCTGGTCCTCTCGTACTAGGA
12020   CCTTTGGCAAGACAACTGGTACACCAGCGGTAAGTCCACTCTGGTCCTCTCGTACTAGGA
12018   CCTTTGGCAAGACAACTGGTACACCAGCGGTAAGTCCACTCTGGTCCTCTCGTACTAGGA
12022   CCTTTGGCAAGACAACTGGTACACCAGCGGTAAGTCCACTCTGGTCCTCTCGTACTAGGA
        ************************************************************

12023   GCAGATCCTCTCAAATTTCCTACGCCCGCGACGGATAGGGACCGAACTGTCTCACGACGT
12024   GCAGATCCTCTCAAATTTCCTACGCCCGCGACGGATAGGGACCGAACTGTCTCACGACGT
12019   GCAGATCCTCTCAAATTTCCTACGCCCGCGACGGATAGGGACCGAACTGTCTCACGACGT
12021   GCAGATCCTCTCAAATTTCCTACGCCCGCGACGGATAGGGACCGAACTGTCTCACGACGT
12020   GCAGATCCTCTCAAATTTCCTACGCCCGCGACGGATAGGGACCGAACTGTCTCACGACGT
12018   GCAGATCCTCTCAAATTTCCTACGCCCGCGACGGATAGGGACCGAACTGTCTCACGACGT
12022   GCAGATCCTCTCAAATTTCCTACGCCCGCGACGGATAGGGACCGAACTGTCTCACGACGT
        ************************************************************

12023   TCTGAACCCAGCTCGCGTGCCGCTTTAATGGGCGAACAGCCCAACCCTTGGGACCGACTA
12024   TCTGAACCCAGCTCGCGTGCCGCTTTAATGGGCGAACAGCCCAACCCTTGGGACCGACTA
12019   TCTGAACCCAGCTCGCGTGCCGCTTTAATGGGCGAACAGCCCAACCCTTGGGACCGACTA
12021   TCTGAACCCAGCTCGCGTGCCGCTTTAATGGGCGAACAGCCCAACCCTTGGGACCGACTA
12020   TCTGAACCCAGCTCGCGTGCCGCTTTAATGGGCGAACAGCCCAACCCTTGGGACCGACTA
12018   TCTGAACCCAGCTCGCGTGCCGCTTTAATGGGCGAACAGCCCAACCCTTGGGACCGACTA
12022   TCTGAACCCAGCTCGCGTGCCGCTTTAATGGGCGAACAGCCCAACCCTTGGGACCGACTA
        ************************************************************
12023   CAGCCCCAGGATGCGACGAGCCGACATCGAGGTGCCAAACCTCCCCGTCGATGTGAACTC
12024   CAGCCCCAGGATGCGACGAGCCGACATCGAGGTGCCAAACCTCCCCGTCGATGTGAACTC
12019   CAGCCCCAGGATGCGACGAGCCGACATCGAGGTGCCAAACCTCCCCGTCGATGTGAACTC
12021   CAGCCCCAGGATGCGACGAGCCGACATCGAGGTGCCAAACCTCCCCGTCGATGTGAACTC
12020   CAGCCCCAGGATGCGACGAGCCGACATCGAGGTGCCAAACCTCCCCGTCGATGTGAACTC
12018   CAGCCCCAGGATGCGACGAGCCGACATCGAGGTGCCAAACCTCCCCGTCGATGTGAACTC
12022   CAGCCCCAGGATGCGACGAGCCGACATCGAGGTGCCAAACCTCCCCGTCGATGTGAACTC
        ************************************************************

12023   TTGGGGGAGATAAGCCTGTTATCCCCAGGGTAGCTTTTATCCGTTGAGCGATGGCCCTTC
12024   TTGGGGGAGATAAGCCTGTTATCCCCAGGGTAGCTTTTATCCGTTGAGCGATGGCCCTTC
12019   TTGGGGGAGATAAGCCTGTTATCCCCAGGGTAGCTTTTATCCGTTGAGCGATGGCCCTTC
12021   TTGGGGGAGATAAGCCTGTTATCCCCAGGGTAGCTTTTATCCGTTGAGCGATGGCCCTTC
12020   TTGGGGGAGATAAGCCTGTTATCCCCAGGGTAGCTTTTATCCGTTGAGCGATGGCCCTTC
12018   TTGGGGGAGATAAGCCTGTTATCCCCAGGGTAGCTTTTATCCGTTGAGCGATGGCCCTTC
12022   TTGGGGGAGATAAGCCTGTTATCCCCAGGGTAGCTTTTATCCGTTGAGCGATGGCCCTTC
        ************************************************************

12023   CATACGGAACCACCGGATCACTAAGCCCGACTTTCGTCCCTGCTCGAGTTGTAGCTCTCG
12024   CATACGGAACCACCGGATCACTAAGCCCGACTTTCGTCCCTGCTCGAGTTGTAGCTCTCG
12019   CATACGGAACCACCGGATCACTAAGCCCGACTTTCGTCCCTGCTCGAGTTGTAGCTCTCG
12021   CATACGGAACCACCGGATCACTAAGCCCGACTTTCGTCCCTGCTCGAGTTGTAGCTCTCG
12020   CATACGGAACCACCGGATCACTAAGCCCGACTTTCGTCCCTGCTCGAGTTGTAGCTCTCG
12018   CATACGGAACCACCGGATCACTAAGCCCGACTTTCGTCCCTGCTCGAGTTGTAGCTCTCG
12022   CATACGGAACCACCGGATCACTAAGCCCGACTTTCGTCCCTGCTCGAGTTGTAGCTCTCG
        ************************************************************

12023   CAGTCAAGCTCCCTTATACCTTTACACTCTACGACTGATTTCCAACCAGTCTGAGGGAAC
12024   CAGTCAAGCTCCCTTATACCTTTACACTCTACGACTGATTTCCAACCAGTCTGAGGGAAC
12019   CAGTCAAGCTCCCTTATACCTTTACACTCTACGACTGATTTCCAACCAGTCTGAGGGAAC
12021   CAGTCAAGCTCCCTTATACCTTTACACTCTACGACTGATTTCCAACCAGTCTGAGGGAAC
12020   CAGTCAAGCTCCCTTATACCTTTACACTCTACGACTGATTTCCAACCAGTCTGAGGGAAC
12018   CAGTCAAGCTCCCTTATACCTTTACACTCTACGACTGATTTCCAACCAGTCTGAGGGAAC
12022   CAGTCAAGCTCCCTTATACCTTTACACTCTACGACTGATTTCCAACCAGTCTGAGGGAAC
        ************************************************************

12023   CTTTGGGCGCCTCCGTTACCTTTTAGGAGGCGACCGCCCCAGTCAAACTGCCCGTCAGAC
12024   CTTTGGGCGCCTCCGTTACCTTTTAGGAGGCGACCGCCCCAGTCAAACTGCCCGTCAGAC
12019   CTTTGGGCGCCTCCGTTACCTTTTAGGAGGCGACCGCCCCAGTCAAACTGCCCGTCAGAC
12021   CTTTGGGCGCCTCCGTTACCTTTTAGGAGGCGACCGCCCCAGTCAAACTGCCCGTCAGAC
12020   CTTTGGGCGCCTCCGTTACCTTTTAGGAGGCGACCGCCCCAGTCAAACTGCCCGTCAGAC
12018   CTTTGGGCGCCTCCGTTACCTTTTAGGAGGCGACCGCCCCAGTCAAACTGCCCGTCAGAC
12022   CTTTGGGCGCCTCCGTTACCTTTTAGGAGGCGACCGCCCCAGTCAAACTGCCCGTCAGAC
        ************************************************************

12023   ACTGTCTCCGATAGGGATTGCCTATCTGGGTTAGAGTAGCCATAACACAAGGGTAGTATC
12024   ACTGTCTCCGATAGGGATTGCCTATCTGGGTTAGAGTAGCCATAACACAAGGGTAGTATC
12019   ACTGTCTCCGATAGGGATTGCCTATCTGGGTTAGAGTAGCCATAACACAAGGGTAGTATC
12021   ACTGTCTCCGATAGGGATTGCCTATCTGGGTTAGAGTAGCCATAACACAAGGGTAGTATC
12020   ACTGTCTCCGATAGGGATTGCCTATCTGGGTTAGAGTAGCCATAACACAAGGGTAGTATC
12018   ACTGTCTCCGATAGGGATTGCCTATCTGGGTTAGAGTAGCCATAACACAAGGGTAGTATC
12022   ACTGTCTCCGATAGGGATTGCCTATCTGGGTTAGAGTAGCCATAACACAAGGGTAGTATC
        ************************************************************

12023   CCAACAACGCCTCAAACGAAACTGGCGTCCCGTTATCATAGGCTCCTACCTATCCTGTAC
12024   CCAACAACGCCTCAAACGAAACTGGCGTCCCGTTATCATAGGCTCCTACCTATCCTGTAC
12019   CCAACAACGCCTCAAACGAAACTGGCGTCCCGTTATCATAGGCTCCTACCTATCCTGTAC
```

-continued

```
12021  CCAACAACGCCTCAAACGAAACTGGCGTCCCGTTATCATAGGCTCCTACCTATCCTGTAC
12020  CCAACAACGCCTCAAACGAAACTGGCGTCCCGTTATCATAGGCTCCTACCTATCCTGTAC
12018  CCAACAACGCCTCAAACGAAACTGGCGTCCCGTTATCATAGGCTCCTACCTATCCTGTAC
12022  CCAACAACGCCTCAAACGAAACTGGCGTCCCGTTATCATAGGCTCCTACCTATCCTGTAC
       ************************************************************

12023  ATGTGGTACAGATACTCAATATCAAACTGCAGTAAAGCTCCATGGGGTCTTTCCGTCCTG
12024  ATGTGGTACAGATACTCAATATCAAACTGCAGTAAAGCTCCATGGGGTCTTTCCGTCCTG
12019  ATGTGGTACAGATACTCAATATCAAACTGCAGTAAAGCTCCATGGGGTCTTTCCGTCCTG
12021  ATGTGGTACAGATACTCAATATCAAACTGCAGTAAAGCTCCATGGGGTCTTTCCGTCCTG
12020  ATGTGGTACAGATACTCAATATCAAACTGCAGTAAAGCTCCATGGGGTCTTTCCGTCCTG
12018  ATGTGGTACAGATACTCAATATCAAACTGCAGTAAAGCTCCATGGGGTCTTTCCGTCCTG
12022  ATGTGGTACAGATACTCAATATCAAACTGCAGTAAAGCTCCATGGGGTCTTTCCGTCCTG
       ************************************************************

12023  TCGCGGGTAACCTGCATCTTCACAGGTACTAAAATTTCACCGAGTCTCTCGTTGAGACAG
12024  TCGCGGGTAACCTGCATCTTCACAGGTACTAAAATTTCACCGAGTCTCTCGTTGAGACAG
12019  TCGCGGGTAACCTGCATCTTCACAGGTACTAAAATTTCACCGAGTCTCTCGTTGAGACAG
12021  TCGCGGGTAACCTGCATCTTCACAGGTACTAAAATTTCACCGAGTCTCTCGTTGAGACAG
12020  TCGCGGGTAACCTGCATCTTCACAGGTACTAAAATTTCACCGAGTCTCTCGTTGAGACAG
12018  TCGCGGGTAACCTGCATCTTCACAGGTACTAAAATTTCACCGAGTCTCTCGTTGAGACAG
12022  TCGCGGGTAACCTGCATCTTCACAGGTACTAAAATTTCACCGAGTCTCTCGTTGAGACAG
       ************************************************************

12023  TGCCCAAATCATTACGCCTTTCGTGCGGGTCGGAACTTACCCGACAAGGAATTTCGCTAC
12024  TGCCCAAATCATTACGCCTTTCGTGCGGGTCGGAACTTACCCGACAAGGAATTTCGCTAC
12019  TGCCCAAATCATTACGCCTTTCGTGCGGGTCGGAACTTACCCGACAAGGAATTTCGCTAC
12021  TGCCCAAATCATTACGCCTTTCGTGCGGGTCGGAACTTACCCGACAAGGAATTTCGCTAC
12020  TGCCCAAATCATTACGCCTTTCGTGCGGGTCGGAACTTACCCGACAAGGAATTTCGCTAC
12018  TGCCCAAATCATTACGCCTTTCGTGCGGGTCGGAACTTACCCGACAAGGAATTTCGCTAC
12022  TGCCCAAATCATTACGCCTTTCGTGCGGGTCGGAACTTACCCGACAAGGAATTTCGCTAC
       ************************************************************

12023  CTTAGGACCGTTATAGTTACGGCCGCCGTTTACTGGGGCTTCAATTCATACCTTCGCTTA
12024  CTTAGGACCGTTATAGTTACGGCCGCCGTTTACTGGGGCTTCAATTCATACCTTCGCTTA
12019  CTTAGGACCGTTATAGTTACGGCCGCCGTTTACTGGGGCTTCAATTCATACCTTCGCTTA
12021  CTTAGGACCGTTATAGTTACGGCCGCCGTTTACTGGGGCTTCAATTCATACCTTCGCTTA
12020  CTTAGGACCGTTATAGTTACGGCCGCCGTTTACTGGGGCTTCAATTCATACCTTCGCTTA
12018  CTTAGGACCGTTATAGTTACGGCCGCCGTTTACTGGGGCTTCAATTCATACCTTCGCTTA
12022  CTTAGGACCGTTATAGTTACGGCCGCCGTTTACTGGGGCTTCAATTCATACCTTCGCTTA
       ************************************************************

12023  CGCTAAGCACTCCTCTTAACCTTCCAGCACCGGGCAGGCGTCACCCCCTATACATCATCT
12024  CGCTAAGCACTCCTCTTAACCTTCCAGCACCGGGCAGGCGTCACCCCCTATACATCATCT
12019  CGCTAAGCACTCCTCTTAACCTTCCAGCACCGGGCAGGCGTCACCCCCTATACATCATCT
12021  CGCTAAGCACTCCTCTTAACCTTCCAGCACCGGGCAGGCGTCACCCCCTATACATCATCT
12020  CGCTAAGCACTCCTCTTAACCTTCCAGCACCGGGCAGGCGTCACCCCCTATACATCATCT
12018  CGCTAAGCACTCCTCTTAACCTTCCAGCACCGGGCAGGCGTCACCCCCTATACATCATCT
12022  CGCTAAGCACTCCTCTTAACCTTCCAGCACCGGGCAGGCGTCACCCCCTATACATCATCT
       ************************************************************

12023  TACGATTTAGCAGAGAGCTGTGTTTTTGATAAACAGTTGCTTGGGCCTATTCACTGCGGC
12024  TACGATTTAGCAGAGAGCTGTGTTTTTGATAAACAGTTGCTTGGGCCTATTCACTGCGGC
12019  TACGATTTAGCAGAGAGCTGTGTTTTTGATAAACAGTTGCTTGGGCCTATTCACTGCGGC
12021  TACGATTTAGCAGAGAGCTGTGTTTTTGATAAACAGTTGCTTGGGCCTATTCACTGCGGC
12020  TACGATTTAGCAGAGAGCTGTGTTTTTGATAAACAGTTGCTTGGGCCTATTCACTGCGGC
12018  TACGATTTAGCAGAGAGCTGTGTTTTTGATAAACAGTTGCTTGGGCCTATTCACTGCGGC
12022  TACGATTTAGCAGAGAGCTGTGTTTTTGATAAACAGTTGCTTGGGCCTATTCACTGCGGC
       ************************************************************

12023  TGATCTAAAATCAGCGCCCCTTCTCCCGAAGTTACGGGGCCATTTTGCCGAGTTCCTTAA
12024  TGATCTAAAATCAGCGCCCCTTCTCCCGAAGTTACGGGGCCATTTTGCCGAGTTCCTTAA
12019  TGATCTAAAATCAGCGCCCCTTCTCCCGAAGTTACGGGGCCATTTTGCCGAGTTCCTTAA
12021  TGATCTAAAATCAGCGCCCCTTCTCCCGAAGTTACGGGGCCATTTTGCCGAGTTCCTTAA
12020  TGATCTAAAATCAGCGCCCCTTCTCCCGAAGTTACGGGGCCATTTTGCCGAGTTCCTTAA
12018  TGATCTAAAATCAGCGCCCCTTCTCCCGAAGTTACGGGGCCATTTTGCCGAGTTCCTTAA
12022  TGATCTAAAATCAGCGCCCCTTCTCCCGAAGTTACGGGGCCATTTTGCCGAGTTCCTTAA
       ************************************************************

12023  CGAGAGTTCTCTCGCTCACCTGAGGCTACTCGCCTCGACTACCTGTGTCGGTTTGCGGTA
12024  CGAGAGTTCTCTCGCTCACCTGAGGCTACTCGCCTCGACTACCTGTGTCGGTTTGCGGTA
12019  CGAGAGTTCTCTCGCTCACCTGAGGCTACTCGCCTCGACTACCTGTGTCGGTTTGCGGTA
12021  CGAGAGTTCTCTCGCTCACCTGAGGCTACTCGCCTCGACTACCTGTGTCGGTTTGCGGTA
12020  CGAGAGTTCTCTCGCTCACMTGAGGCTACTCGCCTCGACTACCTGTGTCGGTTTGCGGTA
12018  CGAGAGTTCTCTCGCTCACCTGAGGCTACTCGCCTCGACTACCTGTGTCGGTTTGCGGTA
12022  CGAGAGTTCTCTCGCTCACCTGAGGCTACTCGCCTCGACTACCTGTGTCGGTTTGCGGTA
       ******************* ****************************************

12023  CGGGTAGAGTATATGTATCGCTAGAAGCTTTTCTTGGCAGTGTGACATCACTAACTTCGC
12024  CGGGTAGAGTATATGTATCGCTAGAAGCTTTTCTTGGCAGTGTGACATCACTAACTTCGC
12019  CGGGTAGAGTATATGTATCGCTAGAAGCTTTTCTTGGCAGTGTGACATCACTAACTTCGC
```

-continued

```
12021  CGGGTAGAGTATATGTATCGCTAGAAGCTTTTCTTGGCAGTGTGACATCACTAACTTCGC
12020  CGGGTAGAGTATATGTATCGCTAGAAGCTTTTCTTGGCAGTGTGACATCACTAACTTCGC
12018  CGGGTAGAGTATATGTATCGCTAGAAGCTTTTCTTGGCAGTGTGACATCACTAACTTCGC
12022  CGGGTAGAGTATATGTATCGCTAGAAGCTTTTCTTGGCAGTGTGACATCACTAACTTCGC
       ************************************************************

12023  TACTAAACTTCGCTCCTCGTCACAGCTCAATGTTAAAGATATAAGCATTTGACTCATATC
12024  TACTAAACTTCGCTCCTCGTCACAGCTCAATGTTAAAGATATAAGCATTTGACTCATATC
12019  TACTAAACTTCGCTCCTCGTCACAGCTCAATGTTAAAGATATAAGCATTTGACTCATATC
12021  TACTAAACTTCGCTCCTCGTCACAGCTCAATGTTAAAGATATAAGCATTTGACTCATATC
12020  TACTAAACTTCGCTCCTCGTCACAGCTCAATGTTAAAGATATAAGCATTTGACTCATATC
12018  TACTAAACTTCGCTCCTCGTCACAGCTCAATGTTAAAGATATAAGCATTTGACTCATATC
12022  TACTAAACTTCGCTCCTCGTCACAGCTCAATGTTAAAGATATAAGCATTTGACTCATATC
       ************************************************************

12023  ACACCTCACTGTTTGACCAGACACTTCCAATCGTCTGGTTTAGTTAGCCTACTGCGTCCC
12024  ACACCTCACTGTTTGACCAGACACTTCCAATCGTCTGGTTTAGTTAGCCTACTGCGTCCC
12019  ACACCTCACTGTTTGACCAGACACTTCCAATCGTCTGGTTTAGTTAGCCTACTGCGTCCC
12021  ACACCTCACTGTTTGACCAGACACTTCCAATCGTCTGGTTTAGTTAGCCTACTGCGTCCC
12020  ACACCTCACTGTTTGACCAGACACTTCCAATCGTCTGGTTTAGTTAGCCTACTGCGTCCC
12018  ACACCTCACTGTTTGACCAGACACTTCCAATCGTCTGGTTTAGTTAGCCTACTGCGTCCC
12022  ACACCTCACTGTTTGACCAGACACTTCCAATCGTCTGGTTTAGTTAGCCTACTGCGTCCC
       ************************************************************

12023  TCCATCACTATATACTCTAGTACAGGAATATCAACCTGTTGTCCATCGGATACACCTTTC
12024  TCCATCACTATATACTCTAGTACAGGAATATCAACCTGTTGTCCATCGGATACACCTTTC
12019  TCCATCACTATATACTCTAGTACAGGAATATCAACCTGTTGTCCATCGGATACACCTTTC
12021  TCCATCACTATATACTCTAGTACAGGAATATCAACCTGTTGTCCATCGGATACACCTTTC
12020  TCCATCACTATATACTCTAGTACAGGAATATCAACCTGTTGTCCATCGGATACACCTTTC
12018  TCCATCACTATATACTCTAGTACAGGAATATCAACCTGTTGTCCATCGGATACACCTTTC
12022  TCCATCACTATATACTCTAGTACAGGAATATCAACCTGTTGTCCATCGGATACACCTTTC
       ************************************************************

12023  GGTCTCTCCTTAGGTCCCGACTAACCCAGGGCGGACGAGCCTTCCCCTGGAAACCTTAGT
12024  GGTCTCTCCTTAGGTCCCGACTAACCCAGGGCGGACGAGCCTTCCCCTGGAAACCTTAGT
12019  GGTCTCTCCTTAGGTCCCGACTAACCCAGGGCGGACGAGCCTTCCCCTGGAAACCTTAGT
12021  GGTCTCTCCTTAGGTCCCGACTAACCCAGGGCGGACGAGCCTTCCCCTGGAAACCTTAGT
12020  GGTCTCTCCTTAGGTCCCGACTAACCCAGGGCGGACGAGCCTTCCCCTGGAAACCTTAGT
12018  GGTCTCTCCTTAGGTCCCGACTAACCCAGGGCGGACGAGCCTTCCCCTGGAAACCTTAGT
12022  GGTCTCTCCTTAGGTCCCGACTAACCCAGGGCGGACGAGCCTTCCCCTGGAAACCTTAGT
       ************************************************************

12023  CTTACGGTGGACAGGATTCTCACCTGTCTTGCGCTACTCATACCGGCATTCTCACTTCTA
12024  CTTACGGTGGACAGGATTCTCACCTGTCTTGCGCTACTCATACCGGCATTCTCACTTCTA
12019  CTTACGGTGGACAGGATTCTCACCTGTCTTGCGCTACTCATACCGGCATTCTCACTTCTA
12021  CTTACGGTGGACAGGATTCTCACCTGTCTTGCGCTACTCATACCGGCATTCTCACTTCTA
12020  CTTACGGTGGACAGGATTCTCACCTGTCTTGCGCTACTCATACCGGCATTCTCACTTCTA
12018  CTTACGGTGGACAGGATTCTCACCTGTCTTGCGCTACTCATACCGGCATTCTCACTTCTA
12022  CTTACGGTGGACAGGATTCTCACCTGTCTTGCGCTACTCATACCGGCATTCTCACTTCTA
       ************************************************************

12023  TGCGTTCCAGCGCTCCTCACGGTACACCTTCTTCACACATAGAACGCTCTCCTACCATGA
12024  TGCGTTCCAGCGCTCCTCACGGTACACCTTCTTCACACATAGAACGCTCTCCTACCATGA
12019  TGCGTTCCAGCGCTCCTCACGGTACACCTTCTTCACACATAGAACGCTCTCCTACCATGA
12021  TGCGTTCCAGCGCTCCTCACGGTACACCTTCTTCACACATAGAACGCTCTCCTACCATGA
12020  TGCGTTCCAGCGCTCCTCACGGTACACCTTCTTCACACATAGAACGCTCTCCTACCATGA
12018  TGCGTTCCAGCGCTCCTCACGGTACACCTTCTTCACACATAGAACGCTCTCCTACCATGA
12022  TGCGTTCCAGCGCTCCTCACGGTACACCTTCTTCACACATAGAACGCTCTCCTACCATGA
       ************************************************************

12023  CACTTTTGTGTCATCCACAGCTTCGGTAATATGTTTTAGCCCCGGTACATTTTCGGCGCA
12024  CACTTTTGTGTCATCCACAGCTTCGGTAATATGTTTTAGCCCCGGTACATTTTCGGCGCA
12019  CACTTTTGTGTCATCCACAGCTTCGGTAATATGTTTTAGCCCCGGTACATTTTCGGCGCA
12021  CACTTTTGTGTCATCCACAGCTTCGGTAATATGTTTTAGCCCCGGTACATTTTCGGCGCA
12020  CACTTTTGTGTCATCCACAGCTTCGGTAATATGTTTTAGCCCCGGTACATTTTCGGCGCA
12018  CACTTTTGTGTCATCCACAGCTTCGGTAATATGTTTTAGCCCCGGTACATTTTCGGCGCA
12022  CACTTTTGTGTCATCCACAGCTTCGGTAATATGTTTTAGCCCCGGTACATTTTCGGCGCA
       ************************************************************

12023  GGGTCACTCGACTAGTGAGCTATTACGCACTCTTTGAATGAATAGCTGCTTCTAAGCTAA
12024  GGGTCACTCGACTAGTGAGCTATTACGCACTCTTTGAATGAATAGCTGCTTCTAAGCTAA
12019  GGGTCACTCGACTAGTGAGCTATTACGCACTCTTTGAATGAATAGCTGCTTCTAAGCTAA
12021  GGGTCACTCGACTAGTGAGCTATTACGCACTCTTTGAATGAATAGCTGCTTCTAAGCTAA
12020  GGGTCACTCGACTAGTGAGCTATTACGCACTCTTTGAATGAATAGCTGCTTCTAAGCTAA
12018  GGGTCACTCGACTAGTGAGCTATTACGCACTCTTTGAATGAATAGCTGCTTCTAAGCTAA
12022  GGGTCACTCGACTAGTGAGCTATTACGCACTCTTTGAATGAATAGCTGCTTCTAAGCTAA
       ************************************************************

12023  CATCCTAGTTGTCTGTGCAACCCCACATCCTTTTCCACTTAACATATATTTTGGGACCTT
12024  CATCCTAGTTGTCTGTGCAACCCCACATCCTTTTCCACTTAACATATATTTTGGGACCTT
12019  CATCCTAGTTGTCTGTGCAACCCCACATCCTTTTCCACTTAACATATATTTTGGGACCTT
```

-continued

```
12021   CATCCTAGTTGTCTGTGCAACCCCACATCCTTTTCCACTTAACATATATTTTGGGACCTT
12020   CATCCTAGTTGTCTGTGCAACCCCACATCCTTTTCCACTTAACATATATTTTGGGACCTT
12018   CATCCTAGTTGTCTGTGCAACCCCACATCCTTTTCCACTTAACATATATTTTGGGACCTT
12022   CATCCTAGTTGTCTGTGCAACCCCACATCCTTTTCCACTTAACATATATTTTGGGACCTT
        ************************************************************

12023   AGCTGGTGGTCTGGGCTGTTTCCCTTTCGACTACGGATCTTAGCACTCGCAGTCTGACTG
12024   AGCTGGTGGTCTGGGCTGTTTCCCTTTCGACTACGGATCTTAGCACTCGCAGTCTGACTG
12019   AGCTGGTGGTCTGGGCTGTTTCCCTTTCGACTACGGATCTTAGCACTCGCAGTCTGACTG
12021   AGCTGGTGGTCTGGGCTGTTTCCCTTTCGACTACGGATCTTAGCACTCGCAGTCTGACTG
12020   AGCTGGTGGTCTGGGCTGTTTCCCTTTCGACTACGGATCTTAGCACTCGCAGTCTGACTG
12018   AGCTGGTGGTCTGGGCTGTTTCCCTTTCGACTACGGATCTTAGCACTCGCAGTCTGACTG
12022   AGCTGGTGGTCTGGGCTGTTTCCCTTTCGACTACGGATCTTAGCACTCGCAGTCTGACTG
        ************************************************************

12023   CCGATTATATCTCGTTGGCATTCGGAGTTTATCTGAGATTGGTAATCCGGGATGGACCCC
12024   CCGATTATATCTCGTTGGCATTCGGAGTTTATCTGAGATTGGTAATCCGGGATGGACCCC
12019   CCGATTATATCTCGTTGGCATTCGGAGTTTATCTGAGATTGGTAATCCGGGATGGACCCC
12021   CCGATTATATCTCGTTGGCATTCGGAGTTTATCTGAGATTGGTAATCCGGGATGGACCCC
12020   CCGATTATATCTCGTTGGCATTCGGAGTTTATCTGAGATTGGTAATCCGGGATGGACCCC
12018   CCGATTATATCTCGTTGGCATTCGGAGTTTATCTGAGATTGGTAATCCGGGATGGACCCC
12022   CCGATTATATCTCGTTGGCATTCGGAGTTTATCTGAGATTGGTAATCCGGGATGGACCCC
        ************************************************************

12023   TCACCCAAACAGTGCTCTACCTCCAAGAGACTTAACATCGACGCTAGCCCTAAAGCTATT
12024   TCACCCAAACAGTGCTCTACCTCCAAGAGACTTAACATCGACGCTAGCCCTAAAGCTATT
12019   TCACCCAAACAGTGCTCTACCTCCAAGAGACTTAACATCGACGCTAGCCCTAAAGCTATT
12021   TCACCCAAACAGTGCTCTACCTCCAAGAGACTTAACATCGACGCTAGCCCTAAAGCTATT
12020   TCACCCAAACAGTGCTCTACCTCCAAGAGACTTAACATCGACGCTAGCCCTAAAGCTATT
12018   TCACCCAAACAGTGCTCTACCTCCAAGAGACTTAACATCGACGCTAGCCCTAAAGCTATT
12022   TCACCCAAACAGTGCTCTACCTCCAAGAGACTTAACATCGACGCTAGCCCTAAAGCTATT
        ************************************************************

12023   TCGGAGAGAACCAGCTATCTCCAAGTTCGTTTGGAATTTCTCCGCTACCCACAAGTCATC
12024   TCGGAGAGAACCAGCTATCTCCAAGTTCGTTTGGAATTTCTCCGCTACCCACAAGTCATC
12019   TCGGAGAGAACCAGCTATCTCCAAGTTCGTTTGGAATTTCTCCGCTACCCACAAGTCATC
12021   TCGGAGAGAACCAGCTATCTCCAAGTTCGTTTGGAATTTCTCCGCTACCCACAAGTCATC
12020   TCGGAGAGAACCAGCTATCTCCAAGTTCGTTTGGAATTTCTCCGCTACCCACAAGTCATC
12018   TCGGAGAGAACCAGCTATCTCCAAGTTCGTTTGGAATTTCTCCGCTACCCACAAGTCATC
12022   TCGGAGAGAACCAGCTATCTCCAAGTTCGTTTGGAATTTCTCCGCTACCCACAAGTCATC
        ************************************************************

12023   CAAGCACTTTTCAACGTGCCCTGGTTCGGTCCTCCAGTGAGTTTTACCTCACCTTCAACC
12024   CAAGCACTTTTCAACGTGCCCTGGTTCGGTCCTCCAGTGAGTTTTACCTCACCTTCAACC
12019   CAAGCACTTTTCAACGTGCCCTGGTTCGGTCCTCCAGTGAGTTTTACCTCACCTTCAACC
12021   CAAGCACTTTTCAACGTGCCCTGGTTCGGTCCTCCAGTGAGTTTTACCTCACCTTCAACC
12020   CAAGCACTTTTCAACGTGCCCTGGTTCGGTCCTCCAGTGAGTTTTACCTCACCTTCAACC
12018   CAAGCACTTTTCAACGTGCCCTGGTTCGGTCCTCCAGTGAGTTTTACCTCACCTTCAACC
12022   CAAGCACTTTTCAACGTGCCCTGGTTCGGTCCTCCAGTGAGTTTTACCTCACCTTCAACC
        ************************************************************

12023   TGCTCATGGGTAGGTCACATGGTTTCGGGTCTACAACATGATACTATGACGCCCTATTAA
12024   TGCTCATGGGTAGGTCACATGGTTTCGGGTCTACAACATGATACTATGACGCCCTATTAA
12019   TGCTCATGGGTAGGTCACATGGTTTCGGGTCTACAACATGATACTATGACGCCCTATTAA
12021   TGCTCATGGGTAGGTCACATGGTTTCGGGTCTACAACATGATACTATGACGCCCTATTAA
12020   TGCTCATGGGTAGGTCACATGGTTTCGGGTCTACAACATGATACTATGACGCCCTATTAA
12018   TGCTCATGGGTAGGTCACATGGTTTCGGGTCTACAACATGATACTATGACGCCCTATTAA
12022   TGCTCATGGGTAGGTCACATGGTTTCGGGTCTACAACATGATACTATGACGCCCTATTAA
        ************************************************************

12023   GACTCGGTTTCCCTACGGCTCCGTCTCTTCAACTTAACCTCGCATCATATCGTAACTCGC
12024   GACTCGGTTTCCCTACGGCTCCGTCTCTTCAACTTAACCTCGCATCATATCGTAACTCGC
12019   GACTCGGTTTCCCTACGGCTCCGTCTCTTCAACTTAACCTCGCATCATATCGTAACTCGC
12021   GACTCGGTTTCCCTACGGCTCCGTCTCTTCAACTTAACCTCGCATCATATCGTAACTCGC
12020   GACTCGGTTTCCCTACGGCTCCGTCTCTTCAACTTAACCTCGCATCATATCGTAACTCGC
12018   GACTCGGTTTCCCTACGGCTCCGTCTCTTCAACTTAACCTCGCATCATATCGTAACTCGC
12022   GACTCGGTTTCCCTACGGCTCCGTCTCTTCAACTTAACCTCGCATCATATCGTAACTCGC
        ************************************************************

12023   CGGTTCATTCTACAAAAGGCACGCTCTCACCCATTAACGGGCTCGAACTTGTTGTAGGCA
12024   CGGTTCATTCTACAAAAGGCACGCTCTCACCCATTAACGGGCTCGAACTTGTTGTAGGCA
12019   CGGTTCATTCTACAAAAGGCACGCTCTCACCCATTAACGGGCTCGAACTTGTTGTAGGCA
12021   CGGTTCATTCTACAAAAGGCACGCTCTCACCCATTAACGGGCTCGAACTTGTTGTAGGCA
12020   CGGTTCATTCTACAAAAGGCACGCTCTCACCCATTAACGGGCTCGAACTTGTTGTAGGCA
12018   CGGTTCATTCTACAAAAGGCACGCTCTCACCCATTAACGGGCTCGAACTTGTTGTAGGCA
12022   CGGTTCATTCTACAAAAGGCACGCTCTCACCCATTAACGGGCTCGAACTTGTTGTAGGCA
        ************************************************************

12023   CACGGTTTCAGGTTCTATTTCACTCCCCTCCCGGGGTGCTTTTCACCTTTCCCTCACGGT
12024   CACGGTTTCAGGTTCTATTTCACTCCCCTCCCGGGGTGCTTTTCACCTTTCCCTCACGGT
12019   CACGGTTTCAGGTTCTATTTCACTCCCCTCCCGGGGTGCTTTTCACCTTTCCCTCACGGT
```

-continued

```
12021  CACGGTTTCAGGTTCTATTTCACTCCCCTCCCGGGGTGCTTTTCACCTTTCCCTCACGGT
12020  CACGGTTTCAGGTTCTATTTCACTCCCCTCCCGGGGTGCTTTTCACCTTTCCCTCACGGT
12018  CACGGTTTCAGGTTCTATTTCACTCCCCTCCCGGGGTGCTTTTCACCTTTCCCTCACGGT
12022  CACGGTTTCAGGTTCTATTTCACTCCCCTCCCGGGGTGCTTTTCACCTTTCCCTCACGGT
       ************************************************************

12023  ACTGGTTCACTATCGGTCACTAGAGAGTATTTAGGGTTGGGAGATGGTCCTCCCAGATTC
12024  ACTGGTTCACTATCGGTCACTAGAGAGTATTTAGGGTTGGGAGATGGTCCTCCCAGATTC
12019  ACTGGTTCACTATCGGTCACTAGAGAGTATTTAGGGTTGGGAGATGGTCCTCCCAGATTC
12021  ACTGGTTCACTATCGGTCACTAGAGAGTATTTAGGGTTGGGAGATGGTCCTCCCAGATTC
12020  ACTGGTTCACTATCGGTCACTAGAGAGTATTTAGGGTTGGGAGATGGTCCTCCCAGATTC
12018  ACTGGTTCACTATCGGTCACTAGAGAGTATTTAGGGTTGGGAGATGGTCCTCCCAGATTC
12022  ACTGGTTCACTATCGGTCACTAGAGAGTATTTAGGGTTGGGAGATGGTCCTCCCAGATTC
       ************************************************************

12023  CGACGAGATTTCGCGTGTCTCGCCGTACTCAGGATACTGCTAAGGTTAATCTATCATTTT
12024  CGACGAGATTTCGCGTGTCTCGCCGTACTCAGGATACTGCTAAGGTTAATCTATCATTTT
12019  CGACGAGATTTCGCGTGTCTCGCCGTACTCAGGATACTGCTAAGGTTAATCTATCATTTT
12021  CGACGAGATTTCGCGTGTCTCGCCGTACTCAGGATACTGCTAAGGTTAATCTATCATTTT
12020  CGACGAGATTTCGCGTGTCTCGCCGTACTCAGGATACTGCTAAGGTTAATCTATCATTTT
12018  CGACGAGATTTCGCGTGTCTCGCCGTACTCAGGATACTGCTAAGGTTAATCTATCATTTT
12022  CGACGAGATTTCGCGTGTCTCGCCGTACTCAGGATACTGCTAAGGTTAATCTATCATTTT
       ************************************************************

12023  AAATACGAGGCTGTTACTCTCTTTGGCTTACCTTCCCAGGTAATTCTTCTATAATGATTA
12024  AAATACGAGGCTGTTACTCTCTTTGGCTTACCTTCCCAGGTAATTCTTCTATAATGATTA
12019  AAATACGAGGCTGTTACTCTCTTTGGCTTACCTTCCCAGGTAATTCTTCTATAATGATTA
12021  AAATACGAGGCTGTTACTCTCTTTGGCTTACCTTCCCAGGTAATTCTTCTATAATGATTA
12020  AAATACGAGGCTGTTACTCTCTTTGGCTTACCTTCCCAGGTAATTCTTCTATAATGATTA
12018  AAATACGAGGCTGTTACTCTCTTTGGCTTACCTTCCCAGGTAATTCTTCTATAATGATTA
12022  AAATACGAGGCTGTTACTCTCTTTGGCTTACCTTCCCAGGTAATTCTTCTATAATGATTA
       ************************************************************

12023  ATCCTATATCGCAGTCCTACAACCCCGAAGTGTAAACACTTCGGTTTGCCCTCCTGCCGT
12024  ATCCTATATCGCAGTCCTACAACCCCGAAGTGTAAACACTTCGGTTTGCCCTCCTGCCGT
12019  ATCCTATATCGCAGTCCTACAACCCCGAAGTGTAAACACTTCGGTTTGCCCTCCTGCCGT
12021  ATCCTATATCGCAGTCCTACAACCCCGAAGTGTAAACACTTCGGTTTGCCCTCCTGCCGT
12020  ATCCTATATCGCAGTCCTACAACCCCGAAGTGTAAACACTTCGGTTTGCCCTCCTGCCGT
12018  ATCCTATATCGCAGTCCTACAACCCCGAAGTGTAAACACTTCGGTTTGCCCTCCTGCCGT
12022  ATCCTATATCGCAGTCCTACAACCCCGAAGTGTAAACACTTCGGTTTGCCCTCCTGCCGT
       ************************************************************

12023  TTCGCTCGCCGCTACTAAGGCAATCGCTTTTGCTTTCTCTTCCTGCAGCTACTTAGATGT
12024  TTCGCTCGCCGCTACTAAGGCAATCGCTTTTGCTTTCTCTTCCTGCAGCTACTTAGATGT
12019  TTCGCTCGCCGCTACTAAGGCAATCGCTTTTGCTTTCTCTTCCTGCAGCTACTTAGATGT
12021  TTCGCTCGCCGCTACTAAGGCAATCGCTTTTGCTTTCTCTTCCTGCAGCTACTTAGATGT
12020  TTCGCTCGCCGCTACTAAGGCAATCGCTTTTGCTTTCTCTTCCTGCAGCTACTTAGATGT
12018  TTCGCTCGCCGCTACTAAGGCAATCGCTTTTGCTTTCTCTTCCTGCAGCTACTTAGATGT
12022  TTCGCTCGCCGCTACTAAGGCAATCGCTTTTGCTTTCTCTTCCTGCAGCTACTTAGATGT
       ************************************************************

12023  TTCAGTTCACTGCGTCTTCCTTCTCATATCCTTAACAGATATGGATACTAGTCATTAACT
12024  TTCAGTTCACTGCGTCTTCCTTCTCATATCCTTAACAGATATGGATACTAGTCATTAACT
12019  TTCAGTTCACTGCGTCTTCCTTCTCATATCCTTAACAGATATGGATACTAGTCATTAACT
12021  TTCAGTTCACTGCGTCTTCCTTCTCATATCCTTAACAGATATGGATACTAGTCATTAACT
12020  TTCAGTTCACTGCGTCTTCCTTCTCATATCCTTAACAGATATGGATACTAGTCATTAACT
12018  TTCAGTTCACTGCGTCTTCCTTCTCATATCCTTAACAGATATGGATACTAGTCATTAACT
12022  TTCAGTTCACTGCGTCTTCCTTCTCATATCCTTAACAGATATGGATACTAGTCATTAACT
       ************************************************************

12023  AGTGGGTTCCCCCATTCGGACATCTCTGGATCAGCGCTTACTTACAGCTCCCCAAAGCAT
12024  AGTGGGTTCCCCCATTCGGACATCTCTGGATCAGCGCTTACTTACAGCTCCCCAAAGCAT
12019  AGTGGGTTCCCCCATTCGGACATCTCTGGATCAGCGCTTACTTACAGCTCCCCAAAGCAT
12021  AGTGGGTTCCCCCATTCGGACATCTCTGGATCAGCGCTTACTTACAGCTCCCCAAAGCAT
12020  AGTGGGTTCCCCCATTCGGACATCTCTGGATCAGCGCTTACTTACAGCTCCCCAAAGCAT
12018  AGTGGGTTCCCCCATTCGGACATCTCTGGATCAGCGCTTACTTACAGCTCCCCAAAGCAT
12022  AGTGGGTTCCCCCATTCGGACATCTCTGGATCAGCGCTTACTTACAGCTCCCCAAAGCAT
       ************************************************************

12023  TTCGTCGTTAGTCACGTCCTTCTTCGGCTTCTAGTGCCAAGGCATCCACCGTGCGCCCTT
12024  TTCGTCGTTAGTCACGTCCTTCTTCGGCTTCTAGTGCCAAGGCATCCACCGTGCGCCCTT
12019  TTCGTCGTTAGTCACGTCCTTCTTCGGCTTCTAGTGCCAAGGCATCCACCGTGCGCCCTT
12021  TTCGTCGTTAGTCACGTCCTTCTTCGGCTTCTAGTGCCAAGGCATCCACCGTGCGCCCTT
12020  TTCGTCGTTAGTCACGTCCTTCTTCGGCTTCTAGTGCCAAGGCATCCACCGTGCGCCCTT
12018  TTCGTCGTTAGTCACGTCCTTCTTCGGCTTCTAGTGCCAAGGCATCCACCGTGCGCCCTT
12022  TTCGTCGTTAGTCACGTCCTTCTTCGGCTTCTAGTGCCAAGGCATCCACCGTGCGCCCTT
       ************************************************************

12023  ATTAACTTAACCTTATTAACCTAGTTTCTTTAAAACTAGAAAACTCATTAAATATTCACA
12024  ATTAACTTAACCTTATTAACCTAGTTTCTTTAAAACTAGAAAACTCATTAAATATTCACA
12019  ATTAACTTAACCTTATTAACCTAGTTTCTTTAAAACTAGAAAACTCATTAAATATTCACA
```

-continued

```
12021   ATTAACTTAACCTTATTAACCTAGTTTCTTTAAAACTAGAAAACTCATTAAATATTCACA
12020   ATTAACTTAACCTTATTAACCTAGTTTCTTTAAAACTAGAAAACTCATTAAATATTCACA
12018   ATTAACTTAACCTTATTAACCTAGTTTCTTTAAAACTAGAAAACTCATTAAATATTCACA
12022   ATTAACTTAACCTTATTAACCTAGTTTCTTTAAAACTAGAAAACTCATTAAATATTCACA
        ************************************************************

12023   GCGTTTTCGGTTTATTTTCTTGTTACTTTCTACAATCTATTTCTAGATCGTGGAATTTGA
12024   GCGTTTTCGGTTTATTTTCTTGTTACTTTCTACAATCTATTTCTAGATCGTGGAATTTGA
12019   GCGTTTTCGGTTTATTTTCTTGTTACTTTCTACAATCTATTTCTAGATCGTGGAATTTGA
12021   GCGTTTTCGGTTTATTTTCTTGTTACTTTCTACAATCTATTTCTAGATCGTGGAATTTGA
12020   GCGTTTTCGGTTTATTTTCTTGTTACTTTCTACAATCTATTTCTAGATCGTGGAATTTGA
12018   GCGTTTTCGGTTTATTTTCTTGTTACTTTCTACAATCTATTTCTAGATCGTGGAATTTGA
12022   GCGTTTTCGGTTTATTTTCTTGTTACTTTCTACAATCTATTTCTAGATCGTGGAATTTGA
        ************************************************************

12023   TATAGATATTCAATTTTCAATGAACAATTTGAACCTTTCGATTCAATGGAGCCTAGCGGG
12024   TATAGATATTCAATTTTCAATGAACAATTTGAACCTTTCGATTCAATGGAGCCTAGCGGG
12019   TATAGATATTCAATTTTCAATGAACAATTTGAACCTTTCGATTCAATGGAGCCTAGCGGG
12021   TATAGATATTCAATTTTCAATGAACAATTTGAACCTTTCGATTCAATGGAGCCTAGCGGG
12020   TATAGATATTCAATTTTCAATGAACAATTTGAACCTTTCGATTCAATGGAGCCTAGCGGG
12018   TATAGATATTCAATTTTCAATGAACAATTTGAACCTTTCGATTCAATGGAGCCTAGCGGG
12022   TATAGATATTCAATTTTCAATGAACAATTTGAACCTTTCGATTCAATGGAGCCTAGCGGG
        ************************************************************

12023   ATCGAACCGCTGACCTCCTGCGTGCAAAGCAGGCGCTCTCCCAGCTGAGCTAAGGCCCCA
12024   ATCGAACCGCTGACCTCCTGCGTGCAAAGCAGGCGCTCTCCCAGCTGAGCTAAGGCCCCA
12019   ATCGAACCGCTGACCTCCTGCGTGCAAAGCAGGCGCTCTCCCAGCTGAGCTAAGGCCCCA
12021   ATCGAACCGCTGACCTCCTGCGTGCAAAGCAGGCGCTCTCCCAGCTGAGCTAAGGCCCCA
12020   ATCGAACCGCTGACCTCCTGCGTGCAAAGCAGGCGCTCTCCCAGCTGAGCTAAGGCCCCA
12018   ATCGAACCGCTGACCTCCTGCGTGCAAAGCAGGCGCTCTCCCAGCTGAGCTAAGGCCCCA
12022   ATCGAACCGCTGACCTCCTGCGTGCAAAGCAGGCGCTCTCCCAGCTGAGCTAAGGCCCCA
        ************************************************************

12023   CAAGACCTCTCAAAACTAAACAAGACGCAAATGGCAGGTTTCCTTATCCTTAGAAAGGAG
12024   CAAGACCTCTCAAAACTAAACAAGACGCAAATGGCAGGTTTCCTTATCCTTAGAAAGGAG
12019   CAAGACCTCTCAAAACTAAACAAGACGCAAATGGCAGGTTTCCTTATCCTTAGAAAGGAG
12021   CAAGACCTCTCAAAACTAAACAAGACGCAAATGGCAGGTTTCCTTATCCTTAGAAAGGAG
12020   CAAGACCTCTCAAAACTAAACAAGACGCAAATGGCAGGTTTCCTTATCCTTAGAAAGGAG
12018   CAAGACCTCTCAAAACTAAACAAGACGCAAATGGCAGGTTTCCTTATCCTTAGAAAGGAG
12022   CAAGACCTCTCAAAACTAAACAAGACGCAAATGGCAGGTTTCCTTATCCTTAGAAAGGAG
        ************************************************************

12023   GTGATCCAGCCGCACCTTCCGATACGGCTACCTTGTTACGACTTCACCCCAATCATCTAT
12024   GTGATCCAGCCGCACCTTCCGATACGGCTACCTTGTTACGACTTCACCCCAATCATCTAT
12019   GTGATCCAGCCGCACCTTCCGATACGGCTACCTTGTTACGACTTCACCCCAATCATCTAT
12021   GTGATCCAGCCGCACCTTCCGATACGGCTACCTTGTTACGACTTCACCCCAATCATCTAT
12020   GTGATCCAGCCGCACCTTCCGATACGGCTACCTTGTTACGACTTCACCCCAATCATCTAT
12018   GTGATCCAGCCGCACCTTCCGATACGGCTACCTTGTTACGACTTCACCCCAATCATCTAT
12022   GTGATCCAGCCGCACCTTCCGATACGGCTACCTTGTTACGACTTCACCCCAATCATCTAT
        ************************************************************

12023   CCCACCTTAGGCGGCTGGCTCCTAAAAGGTTACCTCACCGACTTCGGGTGTTACAAACTC
12024   CCCACCTTAGGCGGCTGGCTCCTAAAAGGTTACCTCACCGACTTCGGGTGTTACAAACTC
12019   CCCACCTTAGGCGGCTGGCTCCTAAAAGGTTACCTCACCGACTTCGGGTGTTACAAACTC
12021   CCCACCTTAGGCGGCTGGCTCCTAAAAGGTTACCTCACCGACTTCGGGTGTTACAAACTC
12020   CCCACCTTAGGCGGCTGGCTCCTAAAAGGTTACCTCACCGACTTCGGGTGTTACAAACTC
12018   CCCACCTTAGGCGGCTGGCTCCTAAAAGGTTACCTCACCGACTTCGGGTGTTACAAACTC
12022   CCCACCTTAGGCGGCTGGCTCCTAAAAGGTTACCTCACCGACTTCGGGTGTTACAAACTC
        ************************************************************

12023   TCGTGGTGTGACGGGCGGTGTGTACAAGGCCCGGGAACGTATTCACCGCGGCGTGCTGAT
12024   TCGTGGTGTGACGGGCGGTGTGTACAAGGCCCGGGAACGTATTCACCGCGGCGTGCTGAT
12019   TCGTGGTGTGACGGGCGGTGTGTACAAGGCCCGGGAACGTATTCACCGCGGCGTGCTGAT
12021   TCGTGGTGTGACGGGCGGTGTGTACAAGGCCCGGGAACGTATTCACCGCGGCGTGCTGAT
12020   TCGTGGTGTGACGGGCGGTGTGTACAAGGCCCGGGAACGTATTCACCGCGGCGTGCTGAT
12018   TCGTGGTGTGACGGGCGGTGTGTACAAGGCCCGGGAACGTATTCACCGCGGCGTGCTGAT
12022   TCGTGGTGTGACGGGCGGTGTGTACAAGGCCCGGGAACGTATTCACCGCGGCGTGCTGAT
        ************************************************************

12023   CCGCGATTACTAGCGATTCCGACTTCATGTAGGCGAGTTGCAGCCTACAATCCGAACTGA
12024   CCGCGATTACTAGCGATTCCGACTTCATGTAGGCGAGTTGCAGCCTACAATCCGAACTGA
12019   CCGCGATTACTAGCGATTCCGACTTCATGTAGGCGAGTTGCAGCCTACAATCCGAACTGA
12021   CCGCGATTACTAGCGATTCCGACTTCATGTAGGCGAGTTGCAGCCTACAATCCGAACTGA
12020   CCGCGATTACTAGCGATTCCGACTTCATGTAGGCGAGTTGCAGCCTACAATCCGAACTGA
12018   CCGCGATTACTAGCGATTCCGACTTCATGTAGGCGAGTTGCAGCCTACAATCCGAACTGA
12022   CCGCGATTACTAGCGATTCCGACTTCATGTAGGCGAGTTGCAGCCTACAATCCGAACTGA
        ************************************************************

12023   GATTGGCTTTAAGAGATTAGCTTGCCGTCACCGGCTTGCGACTCGTTGTACCAACCATTG
12024   GATTGGCTTTAAGAGATTAGCTTGCCGTCACCGGCTTGCGACTCGTTGTACCAACCATTG
12019   GATTGGCTTTAAGAGATTAGCTTGCCGTCACCGGCTTGCGACTCGTTGTACCAACCATTG
```

-continued

```
12021  GATTGGCTTTAAGAGATTAGCTTGCCGTCACCGGCTTGCGACTCGTTGTACCAACCATTG
12020  GATTGGCTTTAAGAGATTAGCTTGCCGTCACCGGCTTGCGACTCGTTGTACCAACCATTG
12018  GATTGGCTTTAAGAGATTAGCTTGCCGTCACCGGCTTGCGACTCGTTGTACCAACCATTG
12022  GATTGGCTTTAAGAGATTAGCTTGCCGTCACCGGCTTGCGACTCGTTGTACCAACCATTG
       ************************************************************

12023  TAGCACGTGTGTAGCCCAGGTCATAAGGGGCATGATGATTTGACGTCATCCCCACCTTCC
12024  TAGCACGTGTGTAGCCCAGGTCATAAGGGGCATGATGATTTGACGTCATCCCCACCTTCC
12019  TAGCACGTGTGTAGCCCAGGTCATAAGGGGCATGATGATTTGACGTCATCCCCACCTTCC
12021  TAGCACGTGTGTAGCCCAGGTCATAAGGGGCATGATGATTTGACGTCATCCCCACCTTCC
12020  TAGCACGTGTGTAGCCCAGGTCATAAGGGGCATGATGATTTGACGTCATCCCCACCTTCC
12018  TAGCACGTGTGTAGCCCAGGTCATAAGGGGCATGATGATTTGACGTCATCCCCACCTTCC
12022  TAGCACGTGTGTAGCCCAGGTCATAAGGGGCATGATGATTTGACGTCATCCCCACCTTCC
       ************************************************************

12023  TCCGGTTTATTACCGGCAGTCTCGCTAGAGTGCCCAACTTAATGATGGCAACTAACAATA
12024  TCCGGTTTATTACCGGCAGTCTCGCTAGAGTGCCCAACTTAATGATGGCAACTAACAATA
12019  TCCGGTTTATTACCGGCAGTCTCGCTAGAGTGCCCAACTTAATGATGGCAACTAACAATA
12021  TCCGGTTTATTACCGGCAGTCTCGCTAGAGTGCCCAACTTAATGATGGCAACTAACAATA
12020  TCCGGTTTATTACCGGCAGTCTCGCTAGAGTGCCCAACTTAATGATGGCAACTAACAATA
12018  TCCGGTTTATTACCGGCAGTCTCGCTAGAGTGCCCAACTTAATGATGGCAACTAACAATA
12022  TCCGGTTTATTACCGGCAGTCTCGCTAGAGTGCCCAACTTAATGATGGCAACTAACAATA
       ************************************************************

12023  GGGGTTGCGCTCGTTGCGGGACTTAACCCAACATCTCACGACACGAGCTGACGACAACCA
12024  GGGGTTGCGCTCGTTGCGGGACTTAACCCAACATCTCACGACACGAGCTGACGACAACCA
12019  GGGGTTGCGCTCGTTGCGGGACTTAACCCAACATCTCACGACACGAGCTGACGACAACCA
12021  GGGGTTGCGCTCGTTGCGGGACTTAACCCAACATCTCACGACACGAGCTGACGACAACCA
12020  GGGGTTGCGCTCGTTGCGGGACTTAACCCAACATCTCACGACACGAGCTGACGACAACCA
12018  GGGGTTGCGCTCGTTGCGGGACTTAACCCAACATCTCACGACACGAGCTGACGACAACCA
12022  GGGGTTGCGCTCGTTGCGGGACTTAACCCAACATCTCACGACACGAGCTGACGACAACCA
       ************************************************************

12023  TGCACCACCTGTCACTTCTGCTCCGAAGAGAAAGCCTATCTCTAGGCCGGTCAGAAGGAT
12024  TGCACCACCTGTCACTTCTGCTCCGAAGAGAAAGCCTATCTCTAGGCCGGTCAGAAGGAT
12019  TGCACCACCTGTCACTTCTGCTCCGAAGAGAAAGCCTATCTCTAGGCCGGTCAGAAGGAT
12021  TGCACCACCTGTCACTTCTGCTCCGAAGAGAAAGCCTATCTCTAGGCCGGTCAGAAGGAT
12020  TGCACCACCTGTCACTTCTGCTCCGAAGAGAAAGCCTATCTCTAGGCCGGTCAGAAGGAT
12018  TGCACCACCTGTCACTTCTGCTCCGAAGAGAAAGCCTATCTCTAGGCCGGTCAGAAGGAT
12022  TGCACCACCTGTCACTTCTGCTCCGAAGAGAAAGCCTATCTCTAGGCCGGTCAGAAGGAT
       ************************************************************

12023  GTCAAGACCTGGTAAGGTTCTTCGCGTTGCTTCGAATTAAACCACATGCTCCACCGCTTG
12024  GTCAAGACCTGGTAAGGTTCTTCGCGTTGCTTCGAATTAAACCACATGCTCCACCGCTTG
12019  GTCAAGACCTGGTAAGGTTCTTCGCGTTGCTTCGAATTAAACCACATGCTCCACCGCTTG
12021  GTCAAGACCTGGTAAGGTTCTTCGCGTTGCTTCGAATTAAACCACATGCTCCACCGCTTG
12020  GTCAAGACCTGGTAAGGTTCTTCGCGTTGCTTCGAATTAAACCACATGCTCCACCGCTTG
12018  GTCAAGACCTGGTAAGGTTCTTCGCGTTGCTTCGAATTAAACCACATGCTCCACCGCTTG
12022  GTCAAGACCTGGTAAGGTTCTTCGCGTTGCTTCGAATTAAACCACATGCTCCACCGCTTG
       ************************************************************

12023  TGCGGGCCCCCGTCAATTCCTTTGAGTTTCAACCTTGCGGTCGTACTCCCCAGGCGGAGT
12024  TGCGGGCCCCCGTCAATTCCTTTGAGTTTCAACCTTGCGGTCGTACTCCCCAGGCGGAGT
12019  TGCGGGCCCCCGTCAATTCCTTTGAGTTTCAACCTTGCGGTCGTACTCCCCAGGCGGAGT
12021  TGCGGGCCCCCGTCAATTCCTTTGAGTTTCAACCTTGCGGTCGTACTCCCCAGGCGGAGT
12020  TGCGGGCCCCCGTCAATTCCTTTGAGTTTCAACCTTGCGGTCGTACTCCCCAGGCGGAGT
12018  TGCGGGCCCCCGTCAATTCCTTTGAGTTTCAACCTTGCGGTCGTACTCCCCAGGCGGAGT
12022  TGCGGGCCCCCGTCAATTCCTTTGAGTTTCAACCTTGCGGTCGTACTCCCCAGGCGGAGT
       ************************************************************

12023  GCTTAATGCGTTAGCTGCGGCACTAAGCCCCGGAAAGGGCCTAACACCTAGCACTCATCG
12024  GCTTAATGCGTTAGCTGCGGCACTAAGCCCCGGAAAGGGCCTAACACCTAGCACTCATCG
12019  GCTTAATGCGTTAGCTGCGGCACTAAGCCCCGGAAAGGGCCTAACACCTAGCACTCATCG
12021  GCTTAATGCGTTAGCTGCGGCACTAAGCCCCGGAAAGGGCCTAACACCTAGCACTCATCG
12020  GCTTAATGCGTTAGCTGCGGCACTAAGCCCCGGAAAGGGCCTAACACCTAGCACTCATCG
12018  GCTTAATGCGTTAGCTGCGGCACTAAGCCCCGGAAAGGGCCTAACACCTAGCACTCATCG
12022  GCTTAATGCGTTAGCTGCGGCACTAAGCCCCGGAAAGGGCCTAACACCTAGCACTCATCG
       ************************************************************

12023  TTTACGGCGTGGACTACCAGGGTATCTAATCCTGTTTGCTCCCCACGCTTTCGAGCCTCA
12024  TTTACGGCGTGGACTACCAGGGTATCTAATCCTGTTTGCTCCCCACGCTTTCGAGCCTCA
12019  TTTACGGCGTGGACTACCAGGGTATCTAATCCTGTTTGCTCCCCACGCTTTCGAGCCTCA
12021  TTTACGGCGTGGACTACCAGGGTATCTAATCCTGTTTGCTCCCCACGCTTTCGAGCCTCA
12020  TTTACGGCGTGGACTACCAGGGTATCTAATCCTGTTTGCTCCCCACGCTTTCGAGCCTCA
12018  TTTACGGCGTGGACTACCAGGGTATCTAATCCTGTTTGCTCCCCACGCTTTCGAGCCTCA
12022  TTTACGGCGTGGACTACCAGGGTATCTAATCCTGTTTGCTCCCCACGCTTTCGAGCCTCA
       ************************************************************

12023  GCGTCAGTTACAGACCAGAGAGCCGCTTTCGCCACCGGTGTTCCTCCATATATCTACGCA
12024  GCGTCAGTTACAGACCAGAGAGCCGCTTTCGCCACCGGTGTTCCTCCATATATCTACGCA
12019  GCGTCAGTTACAGACCAGAGAGCCGCTTTCGCCACCGGTGTTCCTCCATATATCTACGCA
```

-continued

| | |
|---|---|
| 12021 | GCGTCAGTTACAGACCAGAGAGCCGCTTTCGCCACCGGTGTTCCTCCATATATCTACGCA |
| 12020 | GCGTCAGTTACAGACCAGAGAGCCGCTTTCGCCACCGGTGTTCCTCCATATATCTACGCA |
| 12018 | GCGTCAGTTACAGACCAGAGAGCCGCTTTCGCCACCGGTGTTCCTCCATATATCTACGCA |
| 12022 | GCGTCAGTTACAGACCAGAGAGCCGCTTTCGCCACCGGTGTTCCTCCATATATCTACGCA |
| | ************************************************************ |
| | |
| 12023 | TTTCACCGCTACACATGGAATTCCACTCTCCCCTTCTGCACTCAAGTCCTCCAGTTTCCA |
| 12024 | TTTCACCGCTACACATGGAATTCCACTCTCCCCTTCTGCACTCAAGTCCTCCAGTTTCCA |
| 12019 | TTTCACCGCTACACATGGAATTCCACTCTCCCCTTCTGCACTCAAGTCCTCCAGTTTCCA |
| 12021 | TTTCACCGCTACACATGGAATTCCACTCTCCCCTTCTGCACTCAAGTCCTCCAGTTTCCA |
| 12020 | TTTCACCGCTACACATGGAATTCCACTCTCCCCTTCTGCACTCAAGTCCTCCAGTTTCCA |
| 12018 | TTTCACCGCTACACATGGAATTCCACTCTCCCCTTCTGCACTCAAGTCCTCCAGTTTCCA |
| 12022 | TTTCACCGCTACACATGGAATTCCACTCTCCCCTTCTGCACTCAAGTCCTCCAGTTTCCA |
| | ************************************************************ |
| | |
| 12023 | AAGCGTACAATGGTTAAGCCACTGCCTTTAACTTCAGACTTAAAGAACCGCCTGCGCTCG |
| 12024 | AAGCGTACAATGGTTAAGCCACTGCCTTTAACTTCAGACTTAAAGAACCGCCTGCGCTCG |
| 12019 | AAGCGTACAATGGTTAAGCCACTGCCTTTAACTTCAGACTTAAAGAACCGCCTGCGCTCG |
| 12021 | AAGCGTACAATGGTTAAGCCACTGCCTTTAACTTCAGACTTAAAGAACCGCCTGCGCTCG |
| 12020 | AAGCGTACAATGGTTAAGCCACTGCCTTTAACTTCAGACTTAAAGAACCGCCTGCGCTCG |
| 12018 | AAGCGTACAATGGTTAAGCCACTGCCTTTAACTTCAGACTTAAAGAACCGCCTGCGCTCG |
| 12022 | AAGCGTACAATGGTTAAGCCACTGCCTTTAACTTCAGACTTAAAGAACCGCCTGCGCTCG |
| | ************************************************************ |
| | |
| 12023 | CTTTACGCCCAATAAATCCGGACAACGCTCGGGACCTACGTATTACCGCGGCTGCTGGCA |
| 12024 | CTTTACGCCCAATAAATCCGGACAACGCTCGGGACCTACGTATTACCGCGGCTGCTGGCA |
| 12019 | CTTTACGCCCAATAAATCCGGACAACGCTCGGGACCTACGTATTACCGCGGCTGCTGGCA |
| 12021 | CTTTACGCCCAATAAATCCGGACAACGCTCGGGACCTACGTATTACCGCGGCTGCTGGCA |
| 12020 | CTTTACGCCCAATAAATCCGGACAACGCTCGGGACCTACGTATTACCGCGGCTGCTGGCA |
| 12018 | CTTTACGCCCAATAAATCCGGACAACGCTCGGGACCTACGTATTACCGCGGCTGCTGGCA |
| 12022 | CTTTACGCCCAATAAATCCGGACAACGCTCGGGACCTACGTATTACCGCGGCTGCTGGCA |
| | ************************************************************ |
| | |
| 12023 | CGTAGTTAGCCGTCCCTTTCTGGTTAGTTACCGTCACTTGGTAGATTTTCCACTCCTACC |
| 12024 | CGTAGTTAGCCGTCCCTTTCTGGTTAGTTACCGTCACTTGGTAGATTTTCCACTCCTACC |
| 12019 | CGTAGTTAGCCGTCCCTTTCTGGTTAGTTACCGTCACTTGGTAGATTTTCCACTCCTACC |
| 12021 | CGTAGTTAGCCGTCCCTTTCTGGTTAGTTACCGTCACTTGGTAGATTTTCCACTCCTACC |
| 12020 | CGTAGTTAGCCGTCCCTTTCTGGTTAGTTACCGTCACTTGGTAGATTTTCCACTCCTACC |
| 12018 | CGTAGTTAGCCGTCCCTTTCTGGTTAGTTACCGTCACTTGGTAGATTTTCCACTCCTACC |
| 12022 | CGTAGTTAGCCGTCCCTTTCTGGTTAGTTACCGTCACTTGGTAGATTTTCCACTCCTACC |
| | ************************************************************ |
| | |
| 12023 | AACGTTCTTCTCTAACAACAGAGCTTTACGATCCGAAAACCTTCTTCACTCACGCGGCGT |
| 12024 | AACGTTCTTCTCTAACAACAGAGCTTTACGATCCGAAAACCTTCTTCACTCACGCGGCGT |
| 12019 | AACGTTCTTCTCTAACAACAGAGCTTTACGATCCGAAAACCTTCTTCACTCACGCGGCGT |
| 12021 | AACGTTCTTCTCTAACAACAGAGCTTTACGATCCGAAAACCTTCTTCACTCACGCGGCGT |
| 12020 | AACGTTCTTCTCTAACAACAGAGCTTTACGATCCGAAAACCTTCTTCACTCACGCGGCGT |
| 12018 | AACGTTCTTCTCTAACAACAGAGCTTTACGATCCGAAAACCTTCTTCACTCACGCGGCGT |
| 12022 | AACGTTCTTCTCTAACAACAGAGCTTTACGATCCGAAAACCTTCTTCACTCACGCGGCGT |
| | ************************************************************ |
| | |
| 12023 | TGCTCGGTCAGACTTCCGTCCATTGCCGAAGATTCCCTACTGCTGCCTCCCGTAGGAGTC |
| 12024 | TGCTCGGTCAGACTTCCGTCCATTGCCGAAGATTCCCTACTGCTGCCTCCCGTAGGAGTC |
| 12019 | TGCTCGGTCAGACTTCCGTCCATTGCCGAAGATTCCCTACTGCTGCCTCCCGTAGGAGTC |
| 12021 | TGCTCGGTCAGACTTCCGTCCATTGCCGAAGATTCCCTACTGCTGCCTCCCGTAGGAGTC |
| 12020 | TGCTCGGTCAGACTTCCGTCCATTGCCGAAGATTCCCTACTGCTGCCTCCCGTAGGAGTC |
| 12018 | TGCTCGGTCAGACTTCCGTCCATTGCCGAAGATTCCCTACTGCTGCCTCCCGTAGGAGTC |
| 12022 | TGCTCGGTCAGACTTCCGTCCATTGCCGAAGATTCCCTACTGCTGCCTCCCGTAGGAGTC |
| | ************************************************************ |
| | |
| 12023 | TGGGCCGTGTCTCAGTCCCAGTGTGGCCGATCACCCTCTCAGGTCGGCTATGTATCGTCG |
| 12024 | TGGGCCGTGTCTCAGTCCCAGTGTGGCCGATCACCCTCTCAGGTCGGCTATGTATCGTCG |
| 12019 | TGGGCCGTGTCTCAGTCCCAGTGTGGCCGATCACCCTCTCAGGTCGGCTATGTATCGTCG |
| 12021 | TGGGCCGTGTCTCAGTCCCAGTGTGGCCGATCACCCTCTCAGGTCGGCTATGTATCGTCG |
| 12020 | TGGGCCGTGTCTCAGTCCCAGTGTGGCCGATCACCCTCTCAGGTCGGCTATGTATCGTCG |
| 12018 | TGGGCCGTGTCTCAGTCCCAGTGTGGCCGATCACCCTCTCAGGTCGGCTATGTATCGTCG |
| 12022 | TGGGCCGTGTCTCAGTCCCAGTGTGGCCGATCACCCTCTCAGGTCGGCTATGTATCGTCG |
| | ************************************************************ |
| | |
| 12023 | CCTTGGTGAGCCTTTACCTCACCAACTAGCTAATACAACGCAGGTCCATCTCACAGTGAA |
| 12024 | CCTTGGTGAGCCTTTACCTCACCAACTAGCTAATACAACGCAGGTCCATCTCACAGTGAA |
| 12019 | CCTTGGTGAGCCTTTACCTCACCAACTAGCTAATACAACGCAGGTCCATCTCACAGTGAA |
| 12021 | CCTTGGTGAGCCTTTACCTCACCAACTAGCTAATACAACGCAGGTCCATCTCACAGTGAA |
| 12020 | CCTTGGTGAGCCTTTACCTCACCAACTAGCTAATACAACGCAGGTCCATCTCACAGTGAA |
| 12018 | CCTTGGTGAGCCTTTACCTCACCAACTAGCTAATACAACGCAGGTCCATCTCACAGTGAA |
| 12022 | CCTTGGTGAGCCTTTACCTCACCAACTAGCTAATACAACGCAGGTCCATCTCACAGTGAA |
| | ************************************************************ |
| | |
| 12023 | GCAATTGCTCCTTTTAAATAACTAACATGTGTTAATTACTCTTATGCGGTATTAGCTATC |
| 12024 | GCAATTGCTCCTTTTAAATAACTAACATGTGTTAATTACTCTTATGCGGTATTAGCTATC |
| 12019 | GCAATTGCTCCTTTTAAATAACTAACATGTGTTAATTACTCTTATGCGGTATTAGCTATC |

-continued

```
12021  GCAATTGCTCCTTTTAAATAACTAACATGTGTTAATTACTCTTATGCGGTATTAGCTATC
12020  GCAATTGCTCCTTTTAAATAACTAACATGTGTTAATTACTCTTATGCGGTATTAGCTATC
12018  GCAATTGCTCCTTTTAAATAACTAACATGTGTTAATTACTCTTATGCGGTATTAGCTATC
12022  GCAATTGCTCCTTTTAAATAACTAACATGTGTTAATTACTCTTATGCGGTATTAGCTATC
       ************************************************************

12023  GTTTCCAATAGTTATCCCCCGCTATGAGGCAGGTTACCTACGCGTTACTCACCCGTTCGC
12024  GTTTCCAATAGTTATCCCCCGCTATGAGGCAGGTTACCTACGCGTTACTCACCCGTTCGC
12019  GTTTCCAATAGTTATCCCCCGCTATGAGGCAGGTTACCTACGCGTTACTCACCCGTTCGC
12021  GTTTCCAATAGTTATCCCCCGCTATGAGGCAGGTTACCTACGCGTTACTCACCCGTTCGC
12020  GTTTCCAATAGTTATCCCCCGCTATGAGGCAGGTTACCTACGCGTTACTCACCCGTTCGC
12018  GTTTCCAATAGTTATCCCCCGCTATGAGGCAGGTTACCTACGCGTTACTCACCCGTTCGC
12022  GTTTCCAATAGTTATCCCCCGCTATGAGGCAGGTTACCTACGCGTTACTCACCCGTTCGC
       ************************************************************

12023  AACTCATCAGTCTAGTGTAAACACCAAACCTCAGCGTTCTACTTGCATGTATTAGGCACG
12024  AACTCATCAGTCTAGTGTAAACACCAAACCTCAGCGTTCTACTTGCATGTATTAGGCACG
12019  AACTCATCAGTCTAGTGTAAACACCAAACCTCAGCGTTCTACTTGCATGTATTAGGCACG
12021  AACTCATCAGTCTAGTGTAAACACCAAACCTCAGCGTTCTACTTGCATGTATTAGGCACG
12020  AACTCATCAGTCTAGTGTAAACACCAAACCTCAGCGTTCTACTTGCATGTATTAGGCACG
12018  AACTCATCAGTCTAGTGTAAACACCAAACCTCAGCGTTCTACTTGCATGTATTAGGCACG
12022  AACTCATCAGTCTAGTGTAAACACCAAACCTCAGCGTTCTACTTGCATGTATTAGGCACG
       ************************************************************

12023  CCGCCAGCGTTCGTCCTGAGCCAGGATCAAACTCTCATTAAAAGTTTGAGCTTTGCTCTT
12024  CCGCCAGCGTTCGTCCTGAGCCAGGATCAAACTCTCATTAAAAGTTTGAGCTTTGCTCTT
12019  CCGCCAGCGTTCGTCCTGAGCCAGGATCAAACTCTCATTAAAAGTTTGAGCTTTGCTCTT
12021  CCGCCAGCGTTCGTCCTGAGCCAGGATCAAACTCTCATTAAAAGTTTGAGCTTTGCTCTT
12020  CCGCCAGCGTTCGTCCTGAGCCAGGATCAAACTCTCATTAAAAGTTTGAGCTTTGCTCTT
12018  CCGCCAGCGTTCGTCCTGAGCCAGGATCAAACTCTCATTAAAAGTTTGAGCTTTGCTCTT
12022  CCGCCAGCGTTCGTCCTGAGCCAGGATCAAACTCTCATTAAAAGTTTGAGCTTTGCTCTT
       ************************************************************

12023  TTCTGTCTCGCTGACAGATTTATTGTTTTTT-GTCATTGACGGATTTACAATGTAAATCC
12024  TTCTGTCTCGCTGACAGATTTATTGTTTTTTTGTCATTGACGGATTTACAATGTAAATCC
12019  TTCTGTCTCGCTGACAGATTTATTGTTTTTT-GTCATTGACGGATTTACAATGTAAATCC
12021  TTCTGTCTCGCTGACAGATTTATTGTTTTTTTGTCATTGACGGATTTACAATGTAAATCC
12020  TTCTGTCTCGCTGACAGATTTATTGTTTTTTTGTCATTGACGGATTTACAATGTAAATCC
12018  TTCTGTCTCGCTGACAGATTTATTGTTTTTT-GTCATTGACGGATTTACAATGTAAATCC
12022  TTCTGTCTCGCTGACAGATTTATTGTTTTTT-GTCATTGACGGATTTACAATGTAAATCC
       ******************************* ****************************

12023  ACCCTGCACATTCGTTCGTCTTGTTCAGTTTTCAAAGGTCTAATGATATATCATAAAAAT
12024  ACCCTGCACATTCGTTCGTCTTGTTCAGTTTTCAAAGGTCTTTGCCTCTCTTGAGACAAC
12019  ACCCTGCACATTCGTTCGTCTTGTTCAGTTTTCAAAGGTCTTTGCCTCTCTTGAGACAAC
12021  ACCCTGCACATTCGTTCGTCTTGTTCAGTTTTCAAAGGTCTTTGCCTCTCTTGAGACAAC
12020  ACCCTGCACATTCGTTCGTCTTGTTCAGTTTTCAAAGGTCTTTGCCTCTCTTGAGACAAC
12018  ACCCTGCACATTCGTTCATCTTGTTCAGTTTTCAAAGGTCTTTGCCTCTCTTGAGACAAC
12022  ACCCTGCACATTCGTTCGTCTTGTTCAGTTTTCAAAGGTCTTTGCCTCTCTTGAGACAAC
       *****************  *********************   *  *    *  *  **

12023  ATATCCATCGGGAAGACAGGATTCGAACCTG-CGACACCTTGGTCCCAAACCAAGTACTC
12024  TTCTATATTCTAGCAAACTTATTCTGCTTTGTCAACTACTTTTTTTTAAGTTGTTAACTA
12019  TTCTATATTCTAGCAAACTTATTCTGCTTTGTCAACTACTTT-TTTTAAGTTGTTAACTA
12021  TTCTATATTCTAGCAAACTTATTCTGCTTTGTCAACTACTTT-TTTTAAGTTGTTAACTA
12020  TTCTATATTCTAGCAAACTTATTCTGCTTTGTCAACTACTTT-TTTTAAGTTGTTAACTA
12018  TTCTATATTCTAGCAAACTTATTCTGCTTTGTCAACTACTTT-TTTTAAGTTGTTTATAA
12022  TTCTATATTCTAGCAAACTTATTCTGCTTTGTCAACTACTTT-TTTTAAGTTGTTAACTA
         *  *  **       *    ****     **  * **   ***   *   **    *

12023  TACCAAGCTG--A-GCTACT-TCCCGAAAAA---TATGCACC---CTAGAGGAGTCGAAC
12024  CGCGTTACTAGAA-GCTGCTCTCTCGAGACAACTTATTCATTATACTAAATATTTCTACT
12019  CGCGCTAATAGAA-ACTGCTCTCTCGAGACAACTTATTCATTATACTAAATATTTCTACT
12021  CGCGCTAATAGAA-ACTGCTCTCTCGAGACAACTTATTTAGTTTACTACATCATCTCTTA
12020  CGCGCTAATAGAA-ACTGCTCTCTCGAGACAACTTATTTAGTTTACTACATCATCTCTTA
12018  AATGATAATACAATATTAGGTTCGCTTAAGAACTCATTTAGTATACTATAATTTTTTATT
12022  CGCGCTAATAGAA-ACTGCTCTCTCGAGACAACTTATTTAGTTTACTACATCATCTCTTA
                   *    *     **  *   *    **  *          ***  *

12023  CTCTAACCGCCTGATTCGTA-GTCAGGTACTCTATCC-------AGTTGA----GCTAAG
12024  TCCTGTCAATACTATTTTTGCATTTTTCTTTTATTTTTAAA-AAGTTAATATTATTTAT
12019  TCCTGTCAATACTATTTTTGTA---TTTTATAAATTTAGTAT-AGACATAATTATTCCTC
12021  CTTTGTCAACTCTTTTTTTCATACT-TTTTCTACATTTTCTGA-AAATGTAGATCAGGCTC
12020  CTTTGTCAACTCTTTTTTTCATACT-TTTTCTACATTTTCTGA-AAATGTAGATAGAGCGC
12018  TGTTGTCAATAGGTTTTAAAAA----------AATCTCAGAGAAACCCTGAGATTTTT
12022  CTTTGTCAACTCTTTTTTTCATACT-TTTTCTACATTTTCTGAAAAAAGTTTCCTGTTGGC
          *  *        **            *

12023  GGTGCTAAAT--------ATTATATGCCGA-------GGACCGGAATC-------G---A
12024  AGTAACTAAC--------CTTCTATACTTGTTGA-ATGGATAGCATTT-------T---T
12019  TATATTCAATTAAGAGAAATTATATAACCACTATTGAGAAATGTAGTC-------T---A
```

```
                             -continued
12021    AA-GCTTAAC---GATTCTTTTAAAATCATTA-----AATTTTAAAA-------C---A
12020    AAGAAAAAAGAGGTCTCACCTCTTTTTATTTCTTAGTAACTACTACA-------A---A
12018    TAAATT--ATGTTACAAAGTT--AATTTCCTT-----TAGCTTCAATT---------AAA
12022    TAACACCAATAACATAGAGTTTAAAATTCCATAC--CTAAATTTATTTTATTAGTAAAAA
                        *

12023    ACCGGTACGATGTTTACC-A--TCGCAGGATTTTAAGTCCTGTGCGTCTGC--CAGTTCC
12024    ACCGTTGTCATGTTCAT--A--TTTCATCTTCTTAATTCACAAATTTAAACTTCATCTTC
12019    GCGATTAAATTCTTTGCTCA--TCGAA-AATATCCAATAAATATAATAATGCATAAAACG
12021    AATTTCAGACATGTTGC------CAAA-GTTTTGATATTATTACTATAAT--ATAGTTTG
12020    TCTATTAGGATCGTTACCTT--CAGAATAACTTTCAACACCCTCTATAGT-TGCAATTGT
12018    CCTAGTTCGCCATCTTCACG-CTTGTAAAGGACATTTGTCGTATTATCTTCTGCATCT--
12022    AATAAAAGATGGGCTAGCCATCTTTTATAATATTTGTTTTTTATATTCTTCAGCTTCTTG
                          *                    *

12023    G-CCA--------CCCCGGCCTCTAACAAGCGAACGACGGGGTTCGAA-CCCGCGACCCT
12024    A-TAAAAAATACCCTTCAAATTTTATCTAAATTTGAAGGGTATTTGAAATTTATAAAGTT
12019    C-CTGCTTACGAAATATAAACAAA-ATTGTTTGCAT--TTCGTAAACAAGCGTTACCTAT
12021    T-AGAGGAGAATAATATGGGCCAA-GAACCTATCAT--CGAATATCAAAATAT----CAA
12020    T-TTATGAACAGTTTTTCGCTCACTGTTACTCATAGGATCCATATGGTAAGGTTCATTAG
12018    --GTATAGATAAAGAAATCATGACCTAAAAGTTCCATTTGCAACAATGCTTCCTCAACAT
12022    GGGTGTAGATAAAACAAA-ATGACCAGGGGTAATCTCGTGCATTTGACGTTCTTGTCCGT

12023    CAC--CTTGGCAAGGTGATGTTCTACCACTGAACTACGT-TCGCACTAAAGACACTATT-
12024    CTT--TAAAAATATATGATGACTTATTTTTTATCTTCTTCTTGCATTTTTTCTTTGATTT
12019    TTA--ACAATATATGATGAGTGTTCCCGCTGAGAATAATTCTCAGCGGTAGACCAGAGCT
12021    TAA--AGTGTATGGGGAAAATGTTGCGGTTGAAGACA----TTAACCTTAAAATTTACCC
12020    TCT--CTAAAACACGCCTAGCTATTTTTTAGAAAAA----TCAATTAAAGTTTCTGTAC
12018    CCA--TTGGTTTTAGATTAACATTCTTAGTACGTACAAT--T-CTTTGGCTTACTGCTTC
12022    CTTGCTCAATAGCTGGATTATACGGCTGGTGAACACGTT--GACGTTCACTCTCCGGATC
                          *

12023    ------------------------------------------------------------
12024    CATCGTATGATAACGCTCTTGCTTTATCTTCA---TCATTTTCTGTCTCAGGCATTTTAC
12019    AGACTAAGAATCGATTGATTCCATCATCATAACACTCAACAAAATTGATAAAAATTATAC
12021    TGGT---GATTTTGTTTGTTTCATCGGTA-------CGAGTGGATCAGGTAAAACAACAT
12020    GATGCTCAACGTAGTCATGGACATTAATGGA----TACTGAAAAACTCTTAGAAAAGCGG
12018    TTCATCTGGCTCAGCC-----TCAAATTCTGTTGTGAAAAC---TTGACTTGCTGGAATC
12022    TGGTTCTGGAATAGCTGATAATAGACTCTTCGTATAAGGGTGGATTGGATTGTTATAAAC

12023    ------------------------------------------------------------
12024    CTGTCTCAAAAATCGATTTAATCTGAGCAGCATCAA-----GAGTCTCATATTTTAAGAG
12019    TAATTCA-ATAATTGCCATTGGGGCAGCATCGCCAC--GGCGTGGTTCTGT-TTTAAGAA
12021    TAATGCGTATGGTTAACCATATGTTAAAACCAACAA--ATGGTACTCTATTATTTAAGGG
12020    TCATGAAGATAATT----TTGTGCTAACAACTGCAACGATTTTAATACTTT-TCCATGAT
12018    TTTTCACGATATT--------TTTTCGCAATTTTA--------GTTTTATT-TTTACGA-
12022    ATCATCAGATGTTC---CAACTTCTAACAGTTTCCCCCAATGCATAACACC-GATACGAT

12023    ------------------------------------------------------------
12024    GGCTTCTGCAATTAATTTATGAGTATCACGGTTTTCGTTGATAATATCAGCTGCC--TTA
12019    TACGAGTGTATCCTCCG--TTACGTTCAGCATAACGAGGTGCGATGTCGTC-AAA--AAG
12021    AAAAGATATTTCTACTA--TTAACCCCATTGAATTAAGACGCAGAATTG---GAT--ATG
12020    AACCAATGATGCGCCCAGCTTCTGGCGTTTCTATTTGGAGATTTATTTGTC-GCT--TAC
12018    ---------ATTTGAC------GCTCAATTTT-----ATCAACAACTAAGTCAAT-----
12022    CTGAAATGTATTTTACC--ATAGACAAATCATGTGCGATAAACAAATAAGTCAATCCTTG

12023    ------------------------------------------------------------
12024    TTACGTGCTTCATTAAGAAGGTGACGAACTTCATCATCAATAAGTTGTGCAGTTTGAGCA
12019    TTTTTGAAGAGCTGTTGTTGATGTAT-ATTT-ATCAGAAGCTTCATCATAGTTTTCTGAT
12021    TTATCCAAAACATTGGTTTAATGCCTCATATGACCATTTACGAAAATATAGTTCT-TGTA
12020    TTGTCGTAG--TTTCTATTGTTGCAT-CTAAATCCATCTCATAGATGATATTTC----A
12018    TGACCCATACATATCTTGTGAAACATCTTCTGCTCGTAAAGTAATAGAATCTATTAAG--
12022    TTCTCTTTGCAATTTTTGCATTAAATTAACAACTTGTGCTTGGATTGAAACATCTAAGGC

12023    ------------------------------------------------------------
12024    GAATATGATTTTTCAGGTGACATTTGACCA--GCCATCATTGCGTGGTTGCCTTCGTATT
12019    GCAATTTCATTACGTACATAAGCAGCAGCT--TGACGACGAGCATGTAAATCACCACGTT
12021    CCAAAATTATTGAAATGGTCAGAAGAAGCT--AAAAGA-GCTAAAGCAAGGGAACTTATT
12020    ACGTATTTAGTCACCTGAGCAGCTGCTACT--TCAATATTAGGAAGTAGGTCAATTTTTT
12018    ----ATTGTTACTTCAACTTTTGCGGTCTT---CTCTCTGTATACTTTGAGGTTGACTCT
12022    AGATATTGGTTCATCAGCAATGATAAATTTAGGCTCTACTGCTAAAGCACGTGCAATCCC

12023    ------------------------------------------------------------
12024    GAACTGGTCCAAGTTTCTCGCTCATACCATATTCAGTTACCATAGCGCGGGCCATAGCAG
12019    TACCTAGAGTAATCATTTTTTCAACTGTTTTACGGATTTCTTTAGCACGTGCTTCAGTAG
12021    AAATTAGTTGAATTACCCGAAGAA-TATTTGGATCGCTACCCTAGTGAGTTGTCTGGCGG
12020    CAATAGCTTCACTTGTAGTTACAACGTTTTTATCATCAATTTTTGGAAGT--TCTGGTTG
12018    AGTATCTAATTCTTGTGCTTC-----ATTAAAGTATTTTCAACTTTAGAGAGTTTGGTC
12022    GATACGTTGTCGTTGTCCACCTGAAAATTCATGCGGATAACGTGTTAAATGATCTTTATT
```

-continued

```
12023   ------------------------------------------------------------
12024   TGGCTTGTTCGAAGTCATTTGAGGCACCTGTTGTCTGAGCGTTGAAAATAATTTCTTCCG
12019   TTACAATTGATTCGTTGATAAGAAGATCGGTTGTCAAATCA--CGAAGCATTGCCTTACG
12021   TCAGCAACAACGTATCGGTGTCATTCGCGCTCTTGCAGCAGACCAAGATATTATTTTAAT
12020   T----GATACGTCTTCTTTTTCAAGCGT-TTCATCAACCTCCTCTATATATTCTTCCACC
12018   TCAACATACTCA--CGAATAGCTTCTG----TTACTTCGATGTTTTCACCACGAAT-ACT
12022   TAACCCTACAAGATCTAATAGGGCCTGAACTTTACTATCACGATCTGATTTTGATTTAGC

12023   ------------------------------------------------------------
12024   CTACACGTCCTCCCATAAGACCTGCTAATTGCTCTTTCATATCATCTTTTGAAAGAAGCA
12019   TTGTGAGCTAGT-------GCGTCCTAGTTTACGGTAAGCCATTATGTCCTCCTATTTTA
12021   GGATGAGCCTTTT-----GGAGCTCTGGATCCTATTACTAGAGAAGGTATTCAAGACTTA
12020   ACATCTACGCTA-------GACGGTACATTCTTAATATTTTTTAACG--CTACCGATTCA
12018   GTATTTAATCAT----ATGAGTACCTCTTTCTTGCGTTGTTAACGCTTTCTATACTCTTA
12022   TAATTTATGTAT----ATCTAAACCT-TCTGCTACGATATCACGAATCTTCATACGGCCG

12023   ------------------------------------------------------------
12024   TTTGATCTTCTTTAGGT----AAAGCAATCATATATCCACCTGCACGACCACGTGGTACG
12019   TTTATCGTTTTTTAATC----CAAGACCTAGATCGGCAAGTTTGATTTTAACTTCTTCAA
12021   GTCAAGTCTCTTCAGG------AAGAAATGGG--GAAAACTATCATCTTAGTTACT-CAT
12020   TTAATATCAGTTACTT---------CGTCGGT-GATACCTTCTATTTCAACTTTTGCTG
12018   TTATAACC-GCTT-----TCATGAAAA---------------------------------
12022   TTTAAGCTAGCCTGAGGATCCTGAAAAATCATCTGAGCGTCTTTACGAAAACTATGTAAT

12023   ------------------------------------------------------------
12024   ATAGTAACTTTATGAACAACTCGCGCATTTGAAAGAATCAAACCGACAATTGTGTGCCCA
12019   GACTCTTACGTCCTAAGTTTCGGACTTTCATCATTTCAGGCTCAGTTTTTTCTG-TTAAA
12021   GA---T-ATGGATGAAGCCCTCAAGTT--AGCAACAAAAATT--ATTGTTATGG-ACAAT
12020   GC---TTTTTACCAAAGCCCAAAAAACCTTTTTTCTCACGTGATACAACTTTTATATGTG
12018   ------------------------------------------------------------
12022   GCTTTACCTTTCAGATGTGAGATCACTTCTCCATTAAAGGTAATTTCTCCATCAGAAATA

12023   ------------------------------------------------------------
12024   GCTTCATGGTAAGCAACCATAGCTCTTTCTCTTTCAGAAATAGTACGATCTTTTTTAGAA
12019   TCAAATACTGTATTAATTCCAGCACGTTTTAAACAGTTATATGAGCGCACTGACAAATCA
12021   GGTAAAATGGTCCAAGAAGGGACACCCAATGATCTCTTACATCATCCTGCTA--------
12020   CCCTCAATCGTGAAATGTTTAACTCTTGTAGTCCTTTTTCAATAGCTTCTTCTACAGTCG
12018   ------------------------------------------------------------
12022   TCATAAAGTTTTAAAATTGAACGTCCAACGGTTGTCTTTCCTGATCCAGATTCCCCAACT

12023   ------------------------------------------------------------
12024   GGACCAGCAATTACACGGTCTTCTGCTTCATCAATATCTGAAGCATCAATAACTTTTTTA
12019   AGTTCCTCAATTGTCCGGTCAAGCACTTTCTCATCGTTCACTTTCTCTGTTTCCTTCATT
12021   ------------------------------------------------------------
12020   CTCCTGTAAATAATACC-------------------------------------------
12018   ------------------------------------------------------------
12022   AATCCAAACACTTCACCTTCATAAATGTCAAAACTAACATTATCAATTGCTCTCACTTCA

12023   ------------------------------------------------------------
12024   TTTCGTCGCGCAGCAACTAAAGCAGCTTCATTGAGAACATTCTCCAAATCAGCACCAACA
12019   ACTTCAGTTGCTTTAGCAACCTCTGTTAAATCAGTAAACAAGTTTAAGTGTTCAATTAAG
12021   ------------------------------------------------------------
12020   ------------------------------------------------------------
12018   ------------------------------------------------------------
12022   TTAGCTTTTCCTTTATTGAAGGTCAAAGAAACATTTTTGACTTCAACTAATTTTTTTCGA

12023   ------------------------------------------------------------
12024   AATCCTGGGGTTTGTTGAGCTACTACTTTTAAGTCAACATTATCTGCTAATGGTTTATTT . . .
12019   ACGCGAGCTGAAAGACCAAGAGCATCCTCAGGAATGA-----------------------
12021   ------------------------------------------------------------
12020   ------------------------------------------------------------
12018   ------------------------------------------------------------
12022   TTTTCAGTCATTAGGCT-------------------------------------------
```

It will be understood that the invention has been described by way of example only and modifications may be made whilst remaining within the scope and spirit of the invention.

TABLE I

THEROETICAL MOLECULAR WEIGHTS FOR GBS PROTEINS

| GBS # | exp ct d mol. weight (dalton) | | |
|---|---|---|---|
| | GST-fusion | His-fusion | Native |
| 1 | 78425 | 53460 | 49720 |
| 2 | 40035 | 15070 | 11330 |

TABLE I-continued

THEROETICAL MOLECULAR WEIGHTS FOR GBS PROTEINS

| GBS # | exp ct d mol. weight (dalton) | | |
|---|---|---|---|
| | GST-fusion | His-fusion | Native |
| 3 | 90305 | 65340 | 61600 |
| 4 | 43115 | 18150 | 14410 |
| 5 | 158835 | 133870 | 130130 |
| 6 | 39265 | 14300 | 10560 |
| 7 | 44985 | 20020 | 16280 |
| 8 | 56315 | 31350 | 27610 |

TABLE I-continued

THEROETICAL MOLECULAR WEIGHTS FOR GBS PROTEINS

| GBS # | GST-fusion | His-fusion | Native |
|---|---|---|---|
| 9 | 50265 | 25300 | 21560 |
| 10 | 96465 | 71500 | 67760 |
| 11 | 91515 | 66550 | 62810 |
| 11d | 85905 | 60940 | 57200 |
| 12 | 64455 | 39490 | 35750 |
| 13 | 40475 | 15510 | 11770 |
| 14 | 33325 | 8360 | 4620 |
| 15 | 44765 | 19800 | 16060 |
| 16 | 73475 | 48510 | 44770 |
| 17 | 46745 | 21780 | 18040 |
| 18 | 54335 | 29370 | 25630 |
| 19 | 46085 | 21120 | 17380 |
| 20 | 47625 | 22660 | 18920 |
| 21 | 56535 | 31570 | 27830 |
| 21 long | 66435 | 41470 | 37730 |
| 22 | 60055 | 35090 | 31350 |
| 23 | 60165 | 35200 | 31460 |
| 24 | 58405 | 33440 | 29700 |
| 25 | 50265 | 25300 | 21560 |
| 26 | 118245 | 93280 | 89540 |
| 28 | 63795 | 38830 | 35090 |
| 29 | 50595 | 25630 | 21890 |
| 30 | 44215 | 19250 | 15510 |
| 31 | 63795 | 38830 | 35090 |
| 31d | 58735 | 33770 | 30030 |
| 32 | 40585 | 15620 | 11880 |
| 33 | 71495 | 46530 | 42790 |
| 34 | 69295 | 44330 | 40590 |
| 35 | 56535 | 31570 | 27830 |
| 36 | 59065 | 34100 | 30360 |
| 37 | 46965 | 22000 | 18260 |
| 38 | 61815 | 36850 | 33110 |
| 39 | 65225 | 40260 | 36520 |
| 41 | 75235 | 50270 | 46530 |
| 42 | 46745 | 21780 | 18040 |
| 43 | 58955 | 33990 | 30250 |
| 44 | 52355 | 27390 | 23650 |
| 45 | 43555 | 18590 | 14850 |
| 46 | 59835 | 34870 | 31130 |
| 47 | 84255 | 59290 | 55550 |
| 48 | 86455 | 61490 | 57750 |
| 48d | 106695 | 81730 | 77990 |
| 49 | 59615 | 34650 | 30910 |
| 50 | 94155 | 69190 | 65450 |
| 51 | 47075 | 22110 | 18370 |
| 52 | 55435 | 30470 | 26730 |
| 53 | 110215 | 85250 | 81510 |
| 54 | 73365 | 48400 | 44660 |
| 55 | 36295 | 11330 | 7590 |
| 56 | 34865 | 9900 | 6160 |
| 57 | 51145 | 26180 | 22440 |
| 58 | 128805 | 103840 | 100100 |
| 59 | 99215 | 74250 | 70510 |
| 60 | 63575 | 38610 | 34870 |
| 61 | 68085 | 43120 | 39380 |
| 62 | 105485 | 80520 | 76780 |
| 63 | 64125 | 39160 | 35420 |
| 64 | 112745 | 87780 | 84040 |
| 65 | 72485 | 47520 | 43780 |
| 66 | 49715 | 24750 | 21010 |
| 67 | 120335 | 95370 | 91630 |
| 68 | 131225 | 106260 | 102520 |
| 68d | 103065 | 78100 | 74360 |
| 69 | 53895 | 28930 | 25190 |
| 70 | 74465 | 49500 | 45760 |
| 70d | 59725 | 34760 | 31020 |
| 71 | 56755 | 31790 | 28050 |
| 72 | 75565 | 50600 | 46860 |
| 73 | 72815 | 47850 | 44110 |
| 74 | 131225 | 106260 | 102520 |
| 74d | 95475 | 70510 | 66770 |
| 75 | 114725 | 89760 | 86020 |
| 76 | 198875 | 173910 | 170170 |
| 77 | 78535 | 53570 | 49830 |
| 78 | 48835 | 23870 | 20130 |
| 79 | 58185 | 33220 | 29480 |
| 79d | 50815 | 25850 | 22110 |
| 80 | 81835 | 56870 | 53130 |
| 81 | 89205 | 64240 | 60500 |
| 82 | 40475 | 15510 | 11770 |
| 83 | 62585 | 37620 | 33880 |
| 84 | 122645 | 97680 | 93940 |
| 85 | 70175 | 45210 | 41470 |
| 86 | 84035 | 59070 | 55330 |
| 87 | 44435 | 19470 | 15730 |
| 88 | 73365 | 48400 | 44660 |
| 89 | 143325 | 118360 | 114620 |
| 90 | 93495 | 68530 | 64790 |
| 91 | 88325 | 63360 | 59620 |
| 92 | 193595 | 168630 | 164890 |
| 93 | 95585 | 70620 | 66880 |
| 94 | 77435 | 52470 | 48730 |
| 95 | 60605 | 35640 | 31900 |
| 96 | 57195 | 32230 | 28490 |
| 97 | 138375 | 113410 | 109670 |
| 98 | 82055 | 57090 | 53350 |
| 99 | 60715 | 35750 | 32010 |
| 100 | 53015 | 28050 | 24310 |
| 101 | 59395 | 34430 | 30690 |
| 102 | 40695 | 15730 | 11990 |
| 103 | 56975 | 32010 | 28270 |
| 104 | 120005 | 95040 | 91300 |
| 105 | 179735 | 154770 | 151030 |
| 105dNterm | 127265 | 102300 | 98560 |
| 105dCterm | 81285 | 56320 | 52580 |
| 106 | 85795 | 60830 | 57090 |
| 107 | 89535 | 64570 | 60830 |
| 108 | 64565 | 39600 | 35860 |
| 109 | 75125 | 50160 | 46420 |
| 109d | 70725 | 45760 | 42020 |
| 110 | 53895 | 28930 | 25190 |
| 111/190 | 60165 | 35200 | 31460 |
| 112 | 63905 | 38940 | 35200 |
| 113 | 59175 | 34210 | 30470 |
| 114 | 51915 | 26950 | 23210 |
| 115 | 98225 | 73260 | 69520 |
| 116 | 73475 | 48510 | 44770 |
| 117 | 47515 | 22550 | 18810 |
| 118 | 42235 | 17270 | 13530 |
| 119 | 109225 | 84260 | 80520 |
| 120 | 71385 | 46420 | 42680 |
| 121 | 65115 | 40150 | 36410 |
| 122 | 46855 | 21890 | 18150 |
| 123 | 68305 | 43340 | 39600 |
| 124 | 54115 | 29150 | 25410 |
| 125 | 57305 | 32340 | 28600 |
| 126 | 56865 | 31900 | 28160 |
| 127 | 80845 | 55880 | 52140 |
| 128 | 39925 | 14960 | 11220 |
| 129 | 43775 | 18810 | 15070 |
| 130 | 82275 | 57310 | 53570 |
| 130d | 63245 | 38280 | 34540 |
| 131 | 89755 | 64790 | 61050 |
| 132 | 49055 | 24090 | 20350 |
| 133 | 54445 | 29480 | 25740 |
| 134 | 42015 | 17050 | 13310 |
| 135 | 65225 | 40260 | 36520 |
| 136 | 54885 | 29920 | 26180 |
| 137 | 63465 | 38500 | 34760 |
| 138 | 40145 | 15180 | 11440 |
| 139 | 38165 | 13200 | 9460 |
| 140 | 43445 | 18480 | 14740 |
| 141 | 49935 | 24970 | 21230 |
| 142 | 79745 | 54780 | 51040 |
| 143 | 33545 | 8580 | 4840 |
| 144 | 49165 | 24200 | 20460 |
| 145 | 63025 | 38060 | 34320 |
| 146 | 107025 | 82060 | 78320 |

TABLE I-continued

THEROETICAL MOLECULAR WEIGHTS FOR GBS PROTEINS

| GBS # | GST-fusion | His-fusion | Native |
|---|---|---|---|
| 147 | 156965 | 132000 | 128260 |
| 148 | 41905 | 16940 | 13200 |
| 149 | 62365 | 37400 | 33660 |
| 150 | 54665 | 29700 | 25960 |
| 151 | 50412 | 25447 | 21707 |
| 151L | 50045 | 25080 | 21340 |
| 152 | 45535 | 20570 | 16830 |
| 153 | 46965 | 22000 | 18260 |
| 154 | 101525 | 76560 | 72820 |
| 155 | 62585 | 37620 | 33880 |
| 156 | 61265 | 36300 | 32560 |
| 157 | 74025 | 49060 | 45320 |
| 158 | 52025 | 27060 | 23320 |
| 159 | 41025 | 16060 | 12320 |
| 160 | 82825 | 57860 | 54120 |
| 161 | 95365 | 70400 | 66660 |
| 162 | 42015 | 17050 | 13310 |
| 163 | 69405 | 44440 | 40700 |
| 164 | 42345 | 17380 | 13640 |
| 165 | 43555 | 18590 | 14850 |
| 166 | 38055 | 13090 | 9350 |
| 167 | 50375 | 25410 | 21670 |
| 168 | 32555 | 7590 | 3850 |
| 169 | 43445 | 18480 | 14740 |
| 170 | 64015 | 39050 | 35310 |
| 170d | 59945 | 34980 | 31240 |
| 171 | 49825 | 24860 | 21120 |
| 172 | 62365 | 37400 | 33660 |
| 173 | 96795 | 71830 | 68090 |
| 174 | 45095 | 20130 | 16390 |
| 175 | 59175 | 34210 | 30470 |
| 176 | 55435 | 30470 | 26730 |
| 177 | 66215 | 41250 | 37510 |
| 178 | 62365 | 37400 | 33660 |
| 179 | 58515 | 33550 | 29810 |
| 180 | 37615 | 12650 | 8910 |
| 181 | 63685 | 38720 | 34980 |
| 182 | 90085 | 65120 | 61380 |
| 182d | 87225 | 62260 | 58520 |
| 183 | 57855 | 32890 | 29150 |
| 184 | 46415 | 21450 | 17710 |
| 185 | 40695 | 15730 | 11990 |
| 186 | 85685 | 60720 | 56980 |
| 187 | 56205 | 31240 | 27500 |
| 188 | 61595 | 36630 | 32890 |
| 189 | 60165 | 35200 | 31460 |
| 191 | 116705 | 91740 | 88000 |
| 192 | 69625 | 44660 | 40920 |
| 193 | 98005 | 73040 | 69300 |
| 194 | 49385 | 24420 | 20680 |
| 195 | 81065 | 56100 | 52360 |
| 195L | 147615 | 122650 | 118910 |
| 195L N-term | 91405 | 66440 | 62700 |
| 196 | 69515 | 44550 | 40810 |
| 197 | 99325 | 74360 | 70620 |
| 198 | 73805 | 48840 | 45100 |
| 199 | 158285 | 133320 | 129580 |
| 200 | 132325 | 107360 | 103620 |
| 201 | 74538 | 49573 | 45833 |
| 202 | 157295 | 132330 | 128590 |
| 203 | 61705 | 36740 | 33000 |
| 204 | 39705 | 14740 | 11000 |
| 205 | 55985 | 31020 | 27280 |
| 206 | 56645 | 31680 | 27940 |
| 207 | 44765 | 19800 | 16060 |
| 208 | 59725 | 34760 | 31020 |
| 209 | 62145 | 37180 | 33440 |
| 209d | 56425 | 31460 | 27720 |
| 210 | 60935 | 35970 | 32230 |
| 210d | 53675 | 28710 | 24970 |
| 211 | 64895 | 39930 | 36190 |
| 212 | 60825 | 35860 | 32120 |
| 213 | 45205 | 20240 | 16500 |
| 214 | 38935 | 13970 | 10230 |
| 215 | 45205 | 20240 | 16500 |
| 216 | 91515 | 66550 | 62810 |
| 217 | 36075 | 11110 | 7370 |
| 218 | 81065 | 56100 | 52360 |
| 219 | 56535 | 31570 | 27830 |
| 220 | 54555 | 29590 | 25850 |
| 220 | 50155 | 25190 | 21450 |
| 221 | 41465 | 16500 | 12760 |
| 222 | 47405 | 22440 | 18700 |
| 223 | 42895 | 17930 | 14190 |
| 224 | 45865 | 20900 | 17160 |
| 225 | 56645 | 31680 | 27940 |
| 226 | 44875 | 19910 | 16170 |
| 227 | 46195 | 21230 | 17490 |
| 228 | 46525 | 21560 | 17820 |
| 229 | 35855 | 10890 | 7150 |
| 230 | 51915 | 26950 | 23210 |
| 231 | 60935 | 35970 | 32230 |
| 231d | 58735 | 33770 | 30030 |
| 232 | 41795 | 16830 | 13090 |
| 233 | 35635 | 10670 | 6930 |
| 234 | 43115 | 18150 | 14410 |
| 235 | 58295 | 33330 | 29590 |
| 235d | 48395 | 23430 | 19690 |
| 236 | 46525 | 21560 | 17820 |
| 237 | 44215 | 19250 | 15510 |
| 238 | 59725 | 34760 | 31020 |
| 239 | 63905 | 38940 | 35200 |
| 240 | 51475 | 26510 | 22770 |
| 241 | 45095 | 20130 | 16390 |
| 242 | 43225 | 18260 | 14520 |
| 243 | 119455 | 94490 | 90750 |
| 244 | 48065 | 23100 | 19360 |
| 245 | 48615 | 23650 | 19910 |
| 246 | 49605 | 24640 | 20900 |
| 246d | 45975 | 21010 | 17270 |
| 247 | 58955 | 33990 | 30250 |
| 248 | 92505 | 67540 | 63800 |
| 248d | 70835 | 45870 | 42130 |
| 249 | 103835 | 78870 | 75130 |
| 250 | 136505 | 111540 | 107800 |
| 251 | 52135 | 27170 | 23430 |
| 252 | 51695 | 26730 | 22990 |
| 253 | 74245 | 49280 | 45540 |
| 254 | 59615 | 34650 | 30910 |
| 255 | 69075 | 44110 | 40370 |
| 256 | 47845 | 22880 | 19140 |
| 257 | 60495 | 35530 | 31790 |
| 258 | 67975 | 43010 | 39270 |
| 259 | 79415 | 54450 | 50710 |
| 260 | 48175 | 23210 | 19470 |
| 261 | 55765 | 30800 | 27060 |
| 262 | 75345 | 50380 | 46640 |
| 263 | 63465 | 38500 | 34760 |
| 264 | 47185 | 22220 | 18480 |
| 265 | 56315 | 31350 | 27610 |
| 266 | 51365 | 26400 | 22660 |
| 267 | 88655 | 63690 | 59950 |
| 268 | 50265 | 25300 | 21560 |
| 269 | 60495 | 35530 | 31790 |
| 270 | 59285 | 34320 | 30580 |
| 271 | 56315 | 31350 | 27610 |
| 272 | 118355 | 93390 | 89650 |
| 272d | 98885 | 73920 | 70180 |
| 273 | 70945 | 45980 | 42240 |
| 274 | 56205 | 31240 | 27500 |
| 275 | 47515 | 22550 | 18810 |
| 276 | 147945 | 122980 | 119240 |
| 277 | 87005 | 62040 | 58300 |
| 277d | 75675 | 50710 | 46970 |
| 278 | 52245 | 27280 | 23540 |
| 279 | 79415 | 54450 | 50710 |
| 280 | 88655 | 63690 | 59950 |
| 281 | 74465 | 49500 | 45760 |

TABLE I-continued

THEROETICAL MOLECULAR WEIGHTS FOR GBS PROTEINS

| GBS # | GST-fusion | His-fusion | Native |
|---|---|---|---|
| 281d | 71495 | 46530 | 42790 |
| 282 | 44765 | 19800 | 16060 |
| 283 | 20240 | 16500 | |
| 284 | 67645 | 42680 | 38940 |
| 285 | 57525 | 32560 | 28820 |
| 286 | 41355 | 16390 | 12650 |
| 287 | 61045 | 36080 | 32340 |
| 287d | 57085 | 32120 | 28380 |
| 288 | 53675 | 28710 | 24970 |
| 288d | 51035 | 26070 | 22330 |
| 289 | 65005 | 40040 | 36300 |
| 289 long | 71825 | 46860 | 43120 |
| 290 | 47405 | 22440 | 18700 |
| 291 | 63795 | 38830 | 35090 |
| 292 | 103505 | 78540 | 74800 |
| 293 | 115935 | 90970 | 87230 |
| 293d N-term | 73805 | 48840 | 45100 |
| 293d C-term | 70835 | 45870 | 42130 |
| 294 | 75785 | 50820 | 47080 |
| 295 | 89425 | 64460 | 60720 |
| 296 | 60385 | 35420 | 31680 |
| 297 | 100205 | 75240 | 71500 |
| 298 | 54335 | 29370 | 25630 |
| 299 | 62255 | 37290 | 33550 |
| 300 | 130895 | 105930 | 102190 |
| 301 | 54885 | 29920 | 26180 |
| 302 | 80075 | 55110 | 51370 |
| 303 | 53235 | 28270 | 24530 |
| 304 | 75125 | 50160 | 46420 |
| 305 | 78645 | 53680 | 49940 |
| 306 | 67975 | 43010 | 39270 |
| 307 | 86675 | 61710 | 57970 |
| 308 | 59285 | 34320 | 30580 |
| 309 | 62695 | 37730 | 33990 |
| 310 | 58845 | 33880 | 30140 |
| 311 | 76445 | 51480 | 47740 |
| 312 | 64785 | 39820 | 36080 |
| 313 | 65995 | 41030 | 37290 |
| 314 | 52135 | 27170 | 23430 |
| 315 | 51695 | 26730 | 22990 |
| 316 | 41795 | 16830 | 13090 |
| 317 | 179295 | 154330 | 150590 |
| 317d N-term | 115935 | 90970 | 87230 |
| 317d C-term | 92160 | 67402 | 63360 |
| 318 | 70065 | 45100 | 41360 |
| 319 | 61925 | 36960 | 33220 |
| 320 | 57965 | 33000 | 29260 |
| 321 | 83705 | 58740 | 55000 |
| 322 | 76628 | 51663 | 47923 |
| 323 | 86345 | 61380 | 57640 |
| 324 | 86345 | 61380 | 57640 |
| 325 | 82605 | 57640 | 53900 |
| 326 | 91515 | 66550 | 62810 |
| 326L | 172695 | 147730 | 143990 |
| 326L N-term | 113955 | 88990 | 85250 |
| 327 | 279175 | 254210 | 250470 |
| 327d N-term | 139915 | 114950 | 111210 |
| 327d C-term | 167965 | 143000 | 139260 |
| 328 | 97602 | 72637 | 68897 |
| 329 | 113955 | 88990 | 85250 |
| 330 | 83595 | 58630 | 54890 |
| 331 | 60825 | 35860 | 32120 |
| 332 | 75675 | 50710 | 46970 |
| 333 | 63465 | 38500 | 34760 |
| 333d | 57965 | 33000 | 29260 |
| 334 | 38275 | 13310 | 9570 |
| 335 | 43555 | 18590 | 14850 |
| 336 | 67645 | 42680 | 38940 |
| 337 | 75235 | 50270 | 46530 |
| 338 | 54995 | 30030 | 26290 |
| 339 | 76665 | 51700 | 47960 |
| 339d | 72925 | 47960 | 44220 |
| 340 | 86565 | 61600 | 57860 |
| 341 | 38385 | 13420 | 9680 |
| 342 | 61595 | 36630 | 32890 |
| 343 | 60385 | 35420 | 31680 |
| 344 | 55875 | 30910 | 27170 |
| 345 | 40585 | 15620 | 11880 |
| 346 | 53895 | 28930 | 25190 |
| 347 | 55325 | 30360 | 26620 |
| 348 | 58405 | 33440 | 29700 |
| 349 | 98335 | 73370 | 69630 |
| 350 | 53895 | 28930 | 25190 |
| 351 | 82165 | 57200 | 53460 |
| 352 | 111315 | 86350 | 82610 |
| 352d | 105485 | 80520 | 76780 |
| 353 | 55325 | 30360 | 26620 |
| 354 | 42345 | 17380 | 13640 |
| 355 | 52135 | 27170 | 23430 |
| 356 | 59065 | 34100 | 30360 |
| 357 | 40255 | 15290 | 11550 |
| 358 | 60495 | 35530 | 31790 |
| 359 | 78865 | 53900 | 50160 |
| 360 | 73695 | 48730 | 44990 |
| 361 | 109005 | 84040 | 80300 |
| 362 | 125945 | 100980 | 97240 |
| 362d N-tem | 63355 | 38390 | 34650 |
| 362d C-term | 91295 | 66330 | 62590 |
| 363 | 53125 | 28160 | 24420 |
| 364 | 75015 | 50050 | 46310 |
| 365 | 102075 | 77110 | 73370 |
| 366 | 68415 | 43450 | 39710 |
| 367 | 76885 | 51920 | 48180 |
| 368 | 44765 | 19800 | 16060 |
| 369 | 142115 | 117150 | 113410 |
| 370 | 94595 | 69630 | 65890 |
| 371 | 65555 | 40590 | 36850 |
| 372 | 55105 | 30140 | 26400 |
| 373 | 50265 | 25300 | 21560 |
| 374 | 57525 | 32560 | 28820 |
| 375 | 66875 | 41910 | 38170 |
| 376 | 48065 | 23100 | 19360 |
| 377 | 73805 | 48840 | 45100 |
| 378 | 58955 | 33990 | 30250 |
| 379 | 68855 | 43890 | 40150 |
| 380 | 47405 | 22440 | 18700 |
| 381 | 66875 | 41910 | 38170 |
| 382 | 50815 | 25850 | 22110 |
| 383 | 57085 | 32120 | 28380 |
| 384 | 77985 | 53020 | 49280 |
| 385 | 75675 | 50710 | 46970 |
| 386 | 39485 | 14520 | 10780 |
| 387 | 54555 | 29590 | 25850 |
| 388 | 45645 | 20680 | 16940 |
| 389 | 43005 | 18040 | 14300 |
| 390 | 62255 | 37290 | 33550 |
| 391 | 54775 | 29810 | 26070 |
| 392 | 71385 | 46420 | 42680 |
| 393 | 55765 | 30800 | 27060 |
| 394 | 59725 | 34760 | 31020 |
| 395 | 72375 | 47410 | 43670 |
| 396 | 34865 | 9900 | 6160 |
| 397 | 113625 | 88660 | 84920 |
| 397d | 100865 | 3740 | 72160 |
| 398 | 56755 | 31790 | 28050 |
| 399 | 55435 | 30470 | 26730 |
| 400 | 74135 | 49170 | 45430 |
| 401 | 59395 | 34430 | 30690 |
| 402 | 78095 | 53130 | 49390 |
| 403 | 64455 | 39490 | 35750 |
| 404 | 61595 | 36630 | 32890 |
| 405 | 45975 | 21010 | 17270 |
| 406 | 36955 | 11990 | 8250 |
| 407 | 82715 | 57750 | 54010 |
| 407d | 71715 | 46750 | 43010 |
| 408 | 45315 | 20350 | 16610 |
| 409 | 70395 | 45430 | 41690 |
| 409d | 59600 | 34842 | 30800 |

TABLE I-continued

THEROETICAL MOLECULAR WEIGHTS FOR GBS PROTEINS

| GBS # | GST-fusion | His-fusion | Native |
|---|---|---|---|
| 410 | 62475 | 37510 | 33770 |
| 411 | 41355 | 16390 | 12650 |
| 412 | 35965 | 11000 | 7260 |
| 413 | 59175 | 34210 | 30470 |
| 414 | 50375 | 25410 | 21670 |
| 415 | 46195 | 21230 | 17490 |
| 416 | 42455 | 17490 | 13750 |
| 417 | 77985 | 53020 | 49280 |
| 418 | 42125 | 17160 | 13420 |
| 419 | 47515 | 22550 | 18810 |
| 420 | 67755 | 42790 | 39050 |
| 421 | 62915 | 37950 | 34210 |
| 422 | 60165 | 35200 | 31460 |
| 423 | 74245 | 49280 | 45540 |
| 424 | 89975 | 65010 | 61270 |
| 424 | 77325 | 52360 | 48620 |
| 425 | 116045 | 91080 | 87340 |
| 426 | 83815 | 58850 | 55110 |
| 427 | 41135 | 16170 | 12430 |
| 428 | 55325 | 30360 | 26620 |
| 429 | 59175 | 34210 | 30470 |
| 430 | 53785 | 28820 | 25080 |
| 431 | 54005 | 29040 | 25300 |
| 432 | 65665 | 40700 | 36960 |
| 433 | 40915 | 15950 | 12210 |
| 434 | 44545 | 19580 | 15840 |
| 642 | 91845 | 66880 | 63140 |
| 643 | 78975 | 54010 | 50270 |
| 644 | 49605 | 24640 | 20900 |
| 645 | 59725 | 34760 | 31020 |
| 646 | 61595 | 36630 | 32890 |
| 647 | 55875 | 30910 | 27170 |
| 648 | 59835 | 34870 | 31130 |
| 649 | 76115 | 51150 | 47410 |
| 650 | 51475 | 26510 | 22770 |
| 651 | 53345 | 28380 | 24640 |
| 652 | 49715 | 24750 | 21010 |
| 653 | 44655 | 19690 | 15950 |
| 654 | 51255 | 26290 | 22550 |
| 655 | 65995 | 41030 | 37290 |
| 656 | 57525 | 32560 | 28820 |
| 657 | 62805 | 37840 | 34100 |
| 658 | 60165 | 35200 | 31460 |
| 659 | 60275 | 35310 | 31570 |
| 660 | 71495 | 46530 | 42790 |
| 661 | 60605 | 35640 | 31900 |
| 662 | 62695 | 37730 | 33990 |
| 663 | 89535 | 64570 | 60830 |
| 664 | 45315 | 20350 | 16610 |
| 665 | 41135 | 16170 | 12430 |
| 666 | 47075 | 22110 | 18370 |
| 667 | 53162 | 28197 | 24457 |
| 668 | 43555 | 18590 | 14850 |
| 669 | 48505 | 23540 | 19800 |
| 670 | 45315 | 20350 | 16610 |
| 671 | 36940 | 12182 | 8140 |
| 672 | 40130 | 15372 | 11330 |
| 673 | 41450 | 16692 | 12650 |
| 674 | 45300 | 20542 | 16500 |
| 675 | 55970 | 31212 | 27170 |
| 676 | 65650 | 40892 | 36850 |
| 677 | 54320 | 29562 | 25520 |
| 678 | 77750 | 52992 | 48950 |
| 679 | 60480 | 35722 | 31680 |
| 680 | 64440 | 39682 | 35640 |
| 681 | 93040 | 68282 | 64240 |
| 682 | 84790 | 60032 | 55990 |
| 683 | 15950 | 44655 | 19690 |
| 684 | 11880 | 40585 | 15620 |
| 685 | 16280 | 44985 | 20020 |
| 686 | 21340 | 50045 | 25080 |
| 687 | 9350 | 38055 | 13090 |
| 689 | 55105 | 3740 | 26400 |

TABLE II

PRIMERS USED TO AMPLIFY GBSnnn PROTEINS
Forward primers begin 5'-GGGGACAAGTTTGTACAAAAAAGCAGGC-3' and
continue with the sequences indicated in the table below;
reverse primers begin
5'-GGGGACCACTTTGTACAAGAAAGCTGGGTT-3' and
continue with the sequences indicated in the table.
The primers for GBS1 are thus:
Fwd: GGGGACAAGTTTGTACAAAAAAGCAGGCTCTCAATCTCATATTGTTTCAG
Rev: GGGGACCACTTTTGTACAAGAAAGCTGGGTTTATTTTTAGACATCATAGACA
The full forward primer sequences are given in the
sequence listing as SEQ IDs 10968-11492. The reverse
primer sequences are SEQ IDs 11493-12017.

| GBS | Forward | Reverse |
|---|---|---|
| 1 | TCTCAATCTCATATTGTTTCAG | ATTTTTAGACATCATAGACA |
| 2 | TCTAATTACATTATTACATTTTTG | GGGAATGCCTACAAA |
| 3 | TCTGATACTAGTTCAGGAATATC | TTTTTTACTATACTTTTTGT |
| 4 | TCTGATACAAGTGATAAGAATACT | TTCCTTTTTAGGCTTACT |
| 5 | TCTATTTTTCTTCATAGTCCAC | ATTAGCTTCATTTGTCAG |
| 6 | TCTGAATGGGTGTTATTAACTC | AGTTTCTTCTTTAAAATCAT |
| 7 | TCTACAAATTCTTATTTTAGCAA | CTCTGAAGCTGTAAAACC |
| 8 | TCTGTATCAGTTCAGGCGT | TTTATCAATGTTTGAAACG |
| 9 | TCTGCTGCTCTAGGACAAC | TAGTAAATCAAGTTTTTGCA |
| 10 | TCTTTTGTTGTTGCCTTATT | ATCCCTTCTATTTTCGA |
| 11 | TCTCCACCTATGGAACGT | ATGTAGTGACGTTTCTGTG |
| 11d | TCTCAGAAAGTCTATCGGG | ATGTAGTGACGTTTCTGTG |
| 12 | TCTAGTGAGAAGAAAGCAAAT | ATTGGGTGTAAGCATT |
| 13 | TCTTCTTGGAATTATTGGAG | CTTAACTCTACCCGTCC |
| 14 | TCTGCAATGATTGTAACCAT | TTTTCTCTTATTAAAGAATT |
| 15 | TCTGCATCTTATACCGTGAA | ATACCAGCCGTTACTATT |
| 16 | TCTGCCGAGAAGGATAAA | TTTAGCTGCTTTTTTAATG |

TABLE II-continued

PRIMERS USED TO AMPLIFY GBSnnn PROTEINS
Forward primers begin 5'-GGGGACAAGTTTGTACAAAAAAGCAGGC-3' and
continue with the sequences indicated in the table below;
reverse primers begin
5'-GGGGACCACTTTGTACAAGAAAGCTGGGTT-3' and
continue with the sequences indicated in the table.
The primers for GBS1 are thus:
Fwd: GGGGACAAGTTTGTACAAAAAAGCAGGCTCTCAATCTCATATTGTTTCAG
Rev: GGGGACCACTTTGTACAAGAAAGCTGGGTTATTTTTAGACATCATAGACA
The full forward primer sequences are given in the
sequence listing as SEQ IDs 10968-11492. The reverse
primer sequences are SEQ IDs 11493-12017.

| GBS | Forward | Reverse |
|---|---|---|
| 17 | TCTGTTTATAAAGTTATTCAAAA | AAATACTACATTTACAGGTG |
| 18 | TCTAAGCCTAACAGTCAACA | TTGGTTATTCTCCTTTAAT |
| 19 | TCTGATGATAACTTTGAAATGC | ATTATATTTTTGGATATTTC |
| 20 | TCTGCAGTGATTGCAAGTC | GGGCTTTTTCTTAAAAA |
| 21 | TGTGCTGCATCAAAC | GTTGGCATCCCTTTT |
| 21 Long + A527 | TGTGCTGCATCAAAC | CTTTTGATGGGATTGG |
| 22 | TGTACTAAACAAAGCCAG | TTGATTTAACGATTTGA |
| 23 | TGTCAATAACCGATAC | TTTATCTCCTCTAAAATAATG |
| 24 | TGCTCAAATGATTCAT | CTTTGATAAGTCAGACCA |
| 25 | TCTAAAAGTTCACAAGTTACTACT | GTAACCCCAAGCTGAT |
| 26 | TCTAGTCATTATTCCATAAAATT | TGATTTTGCAATATCAA |
| 28 | TCTAATCATATGCTGATTGAG | TTTTTGTAATTTAAGTACTAA |
| 29 | TCAGTTTGGATGTTAAC | TTCTTTTATATTAAGAGCTT |
| 30 | TCAACAAATGCAGATG | ATTCGGATAAATGTAGC |
| 31 | TGTTTTGTCATTATTGATAG | TCCATTTTTATCCTCAC |
| 31d | TCTCTAACTTGGTTTTTATTAGA | TCCATTTTTATCCTCAC |
| 32 | TCTGGTTTAAAAGTGACTGAA | ATGACCTCTACTTTCCA |
| 33 | TCTCATCATTTAGGTAAGGAA | CTTGTAATCACTTGGAC |
| 34 | TCTGTTAGTAATCGCTACAATC | ATTAATCATGGTATTGGT |
| 35 | TCTAATCAAGAAGTTTCAGC | CCATTGTGGAATATCA |
| 36 | TCTCGAGTTTTAGCGGATA | TTTGTAAAGCAGTTCTT |
| 37 | TCTGTATTATTTTACCAATCACA | ATCATTCATATGATCTCTAGA |
| 38 | TTAGGAGTGGTAGTTCAT | ATTTTGATTGATTCTACTC |
| 39 | TTTTTATTGTTAGTATTAGC | TTTTGTTTTTTTCAAATA |
| 41 | TCTGTTTATCTAGCGGTTAGA | ATCTTCAACGTCCTCC |
| 42 | TATAACAGTTTAGTTAGAAGTC | AAAGTCAAAGGAAACTT |
| 43 | TTTAAAGGGTTTACATATT | TTCTTTATCTAATTTATAATAG |
| 44 | TTTAATACAATTGGTCG | TTGCAATGTTTTTTCT |
| 45 | TCTATGGAAAAAATTAGGATT | TAAACTTTGGATAATCTGT |
| 46 | TCTAGAGATGAGCAAGAAATA | GTTGAAATTTTGATATGA |
| 47 | TCTCAACAGATAGGTCTTTATAA | CTCCTTTACTATATAGCTAACT |
| 48 | TTTCTCTATAATTACTTCAAT | TTGTTTGTGAAGTAAAAC |
| 49 | TCTAATAAGGCATTATTAGAGG | TGATAATATCTCCATATTTT |
| 50 | TCTACACATTTAGTTGACTTAAC | GCATTGGCGCCATA |
| 51 | TCTAGTAAACAACACATTTATCTA | TTCTACACGACTTTTATTC |
| 52 | TCTCAAGAAACTCATCAGTTG | AAGACCTCCTCGAGAT |
| 53 | TCTGCAGAAGACATTGTTACA | TGTTTTTTCTTTCTGTTG |
| 54 | TATAATTTTTCGACTAATGA | TGGATTAGTTTGACCTG |
| 55 | TCTGACACAGTGTCTTATCCT | TTTATCGTAAGCACTTAGG |
| 56 | TCTGTGGAGCAAGTGGCCA | CTCCTTCCAGGCATCG |
| 57 | TCTCAAGAACTAAGTAACTTTGA | GTAAAAGTATCTTAAATAGTCA |
| 58 | TCTACTGAAACGTTTGAAGG | TGCCATTCCTCCTCT |
| 59 | TCTGATGAAGCAACAACTAA | TGTTACCTTTTTATTTTCT |
| 60 | TCTAATAAAGATAATCAAAAAACT | TTTTTCATGCGATTGA |
| 61 | TGTTTCTTTTTTATTCCA | GAGACGTTTCTTATACCTT |
| 62 | TATTACTTTGATGGTAGTTT | TGTACCATATGTTCTCTCT |
| 63 | TCTGTTCAATCATTAGCAAA | AAAAGTTGGACTACTTTC |
| 64 | TTTAAAGGTAATAAGAAGTTG | TCGTTTTCCACCC |
| 64d | TCTAGTCAAGTTGACTCTGTTA | TCGTTTTCCACCC |
| 65 | TCTCAAAACCAGGTGACTG | ATTTGGGTAAATATAGTAAA |
| 66 | TTAAGATTTTATAACAACGA | TTTACGACTAACCTCAAC |
| 67 | TCTAATGTTTTAGGGGAAA | AATTCCTTTTGGTGG |
| 68 | TCCCAAAAGACTTTTG | GGCAGAATACACCTTC |
| 68d | TCCCAAAAGACTTTTG | GGCTGACGTCGACGCA |
| 69 | TCTAAAGTTTTAGCCTTTGA | AACTCTCTTAATATATTCTTCT |
| 70 | TCTGAAATGGCTTTAG | GTCTTTTTCAATATTCTGT |
| 70d | TCTACTAACTTATTGAGTAGAATCA | GTCTTTTTCAATATTCTGT |
| 71 | TGTAGCTCAAAATCTCAT | CTTCTCCTTAGGAGTAACG |
| 72 | TCTAGTTTATCTATTAAAGATGCC | ATTATTATCAATTAATAACTCTT |
| 73 | TCTATCAAAGAGGCGGTAA | GTCAAACATACTTCCAAA |
| 74 | TCTAAAGAGGATAAAAAGCTAG | TTTCGTCGTATAAGCA |
| 74d | TCTAGTGTTTCAGGTAGTAGTG | TTTCGTCGTATAAGCA |
| 75 | TCTAAAAAATTAAAACACTCAA | TGTCCTCATTTTTTCAG |
| 76 | TCTGATGAAGTTACAACTTCAG | AATACTTGCTGGAACAG |
| 77 | TTATTCCAAAGTAAAATAAA | GTCTTTCTTCAATTTTGG |

TABLE II-continued

PRIMERS USED TO AMPLIFY GBSnnn PROTEINS
Forward primers begin 5'-GGGGACAAGTTTGTACAAAAAAGCAGGC-3' and
continue with the sequences indicated in the table below;
reverse primers begin
5'-GGGGACCACTTTGTACAAGAAAGCTGGGTT-3' and
continue with the sequences indicated in the table.
The primers for GBS1 are thus:
Fwd: GGGGACAAGTTTGTACAAAAAAGCAGGCTCTCAATCTCATATTGTTTCAG
Rev: GGGGACCACTTTGTACAAGAAAGCTGGGTTATTTTTAGACATCATAGACA
The full forward primer sequences are given in the
sequence listing as SEQ IDs 10968-11492. The reverse
primer sequences are SEQ IDs 11493-12017.

| GBS | Forward | Reverse |
|---|---|---|
| 78 | TCTCATAACCATCACTCAGAACACATGT | GTCGTGATTTTTATGAGT |
| 79 | TCTCCCAAGAATAGGATAAA | CCCAAACTGGCATAAC |
| 79d | TCTAGTCAGTATGAGTCACAGA | CCCAAACTGGCATAAC |
| 80 | TCTGCAGAAGTGTCACAAGA | TGAAGGACGTTTGTTG |
| 81 | TCTTTTGATGGATTTTT | TTTTTTTAGTTTAAGGCTA |
| 82 | TCTACAAATGAAAAACGAAC | GTCCACCTTCCGAT |
| 83 | TCTGAAATTAAACTCAAAAATATT | AACATTGTTTTTCCTTTC |
| 84 | TCTCATACTCAAGAACACAAAA | ATGGTGATGATGACCT |
| 85 | TCTCCTAAGAAGAAATCAGATAC | ATTAACATTTTGAGGGT |
| 86 | TCTGCAGAACTAACTCTTTTAA | TTTTGCAAAATCAACA |
| 87 | TCTGCGGATACATATAATAACTA | GAATAAATAACTGTATTTTTT |
| 88 | TCTTACCAAAAAATGACG | ATTTTCATTAATTTCCTCT |
| 89 | TCTGAAGAGCTTACCAAAAC | GATAGCTAATTGGTCTGT |
| 90 | TCTAGATATACAAATGGAAATTT | TAAAAGATGAGCTTCTG |
| 91 | TCTAAAAAAGGACAAGTAAATG | AATTTCAATATAGCGACG |
| 92 | TCTGATTCTGTCATAAATAAGC | CTTGTTTGTCTTTACCTT |
| 93 | TCTGAATTTTCACGAGAAA | ATTATCCTTCAAAGCTG |
| 94 | TACCAATTAGGTAGCTATAA | TGTGTCATATAATGTAACCA |
| 95 | TCTGTTAATACAAAAACACTTCT | TGATCTTAATTTTCGAG |
| 96 | TCTGGTCAGTCTAAAAATGAAG | CCAAACAGGTTGATCT |
| 97 | TCTAGCCAGGAGGTATATG | ATTTACATCAGACTGTGAC |
| 98 | TCTGAAACTATTAATCCAGAAA | TTTATGGCCAATAACA |
| 99 | TCTACAAGTATGAACCATCAA | TTTTTTAGTAGTTGTCAATT |
| 100 | TCTAAGGGGCCAAAAGTAG | GTAAGCTGAATTTTCGA |
| 101 | TCTATTACTTTAGAAAAATTTATAGA | ACGAGAGTGGTTATTGG |
| 102 | TCTGCCTTTTACTTTGGCA | TTTCTTCACTCTTTCTAGAG |
| 103 | TCTATTTTTTCCTTGATCAT | CGGCCAGTTTTTTCTT |
| 104 | TCTGGTGAAACCCAAGATA | AACACCTGGTGGGCGT |
| 105 | TTAACAATTCATGGACC | ACTATTTCTAATTGCTCTG |
| 105d | TTAACAATTCATGGACC | TGGTCCCGGTGCGCCA |
| 105d | TCTCAAGGACCTCCCGGTG | ACTATTTCTAATTGCTCTG |
| 106 | TCTCAAAATCAAAATTCACA | CTTAGCAGATTCATCCC |
| 107 | TCTCTGGAGCCTTTTATTT | TTTACTATTTGAAAATTGG |
| 108 | TCTGGTAATCGTTCAGATAAG | TTTCATAGGAACTTGTATT |
| 109 | TCTATCCAGCAGATCAACT | GTCCACACCTGCGACT |
| 109d | TCTAAACGGGTTCGCTATG | GTCCACACCTGCGACT |
| 110 | TCTGTAAAATTAGTATTCGCAC | TTTACCTAAGTAATATTCTGA |
| 111.19 | TCTGTTAGCGTTGATAAGGC | TCCCCGTCTTTTTTGT |
| 112 | TCTACAATTAAAAATCTCACTG | GTCGTAATCATAAAAGCC |
| 113 | TCTAGTAAAATCAAAATTGTAACG | TTCATAACGAACCATAAC |
| 114 | TCTAATCTTTTAATTATGGGTT | TTTGAGTTCTAGCAACG |
| 115 | TTTCAATACTATTTAAAAGG | TTTTTTATCTTCTTCTTGC |
| 116 | TCTACCGAGGAGCCATTAA | TTTTAAAACCTGGTAAAC |
| 117 | TCTGAACAATCACAAAAAACA | TCAGCTCGTACTGTTT |
| 118 | TCTATGGTGACGGTGCTGG | GTCCTCCTCAATTGGT |
| 119 | TCTAGTCAGCCGGTAGGGG | CTCTTTTATACGCGATG |
| 120 | TCTGGTGGAGCATTTGCTA | GTTATTTGCTCGTTGTT |
| 121 | TCTAATAAAGATAATCAAAAAACT | TTTCTCAAATGTTTTCAT |
| 122 | TCTGCTGCCACCAAGAAAG | TTTCAAATGATCTACAGC |
| 123 | TCTACAACAAATGTAATGGC | GGCTAGTGTCTGTCCG |
| 124 | TCAATGAATTTTTCATTT | ACCATCTATTTTTACCCC |
| 125 | TCTACAAAATATCAGCGAATG | AGAACCCGCACTCTCA |
| 126 | TCTACTAAGCAAGCAATGTC | GAACGCAACGGCTGCT |
| 127 | TCTACAAAAGAATATCAAAATTAT | TTTCATATCAAAAACTATCG |
| 128 | TCGACTAATTCGTTAAA | TTCTTTATCTCTTAATGCTT |
| 129 | TTTGAAATAGTATTGGAAA | CACAACAGTTATTTTTCA |
| 130 | TCTATATTTTCTATTTTTATTATGT | AGGCCCTTCTGAGTAG |
| 130d | TCTAAAAAACAACTTCACAAC | AGGCCCTTCTGAGTAG |
| 131 | TCTAAAACAGATATTGAAATAGC | AAATAATCCAATGGCTG |
| 132 | TCTATTAAATATTATCATTTGCA | CTTTTCAAGCTTTTTCG |
| 133 | TCTGCTTTACGGAACCTTG | AAAATGATCAGTTTGAGG |
| 134 | TCTACTATTTCTCAACAACAATAC | TTTTTGGCTTAAGAAAG |
| 135 | TCTGAAAAAAAGAGTAGTTCAAC | CTTACGATACATTTTAAATTG |
| 136 | TCTAATCAATTATCAGAAATCA | TTCTTTTTTTACTTTAGCG |
| 137 | TCTCAAGAGTATAAAACAAAAGAG | CCATTGCAATCCAGCA |

TABLE II-continued

PRIMERS USED TO AMPLIFY GBSnnn PROTEINS
Forward primers begin 5'-GGGGACAAGTTTGTACAAAAAAGCAGGC-3' and
continue with the sequences indicated in the table below;
reverse primers begin
5'-GGGGACCACTTTGTACAAGAAAGCTGGGTT-3' and
continue with the sequences indicated in the table.
The primers for GBS1 are thus:
Fwd: GGGGACAAGTTTGTACAAAAAAGCAGGCTCTCAATCTCATATTGTTTCAG
Rev: GGGGACCACTTTGTACAAGAAAGCTGGGTTTATTTTTAGACATCATAGACA
The full forward primer sequences are given in the
sequence listing as SEQ IDs 10968-11492. The reverse
primer sequences are SEQ IDs 11493-12017.

| GBS | Forward | Reverse |
|---|---|---|
| 138 | TCTGCTGTATTTACACTCGTC | ATGTTTATGGCTTGCT |
| 139 | TCTGGCGGCAAGATAAAAT | TTTTTGATAAATCCCC |
| 140 | TCTGATGGGTTAAAGAATAATG | ATATGTGTATTCATCCTTT |
| 141 | TCTGATGTTGTAATTAGTGGAG | TACTTCTATTTTTCCATCTG |
| 142 | TTCGAATTAAGAGAAAGA | GTAATGCAATAAATCAAAA |
| 143 | TCTAGCTTTTTAGTGATTTCA | GGATTTTAGTTTCGCA |
| 144 | TATACGCATAGTGGAAC | CCCATTGATTTCGTCG |
| 145 | TCTGTTATTATCAGGGGCG | TACCTCTTTCAATACCAC |
| 146 | TCTGTTAGTCGTTCTCCGA | ATTACCGTTAGGTACTGTA |
| 147 | TCTGAGGAGCAAGAATTAAA | GGTATGGTTAACAGAATC |
| 148 | TCTATTCTAACAAAAGCAAGT | ATATACCCTAGACTTTTTGA |
| 149 | TCTAGTGGGCGTTCATGGA | AGGAGTTTTATTGATGATAT |
| 150 | TCTGATACCCCTAATCAACTA | AAATGATTGTGGAAAAA |
| 151 | TGCAGGAGCTGTCCGC | ATCAAAGAAGTTGACATTG |
| 151 Long | TCTGTCCGCATTGGTAAAG | ATCAAAGAAGTTGACATTG |
| 152 | TCTAACTGCTTAGAAAATGAA | GTTAGATAAATTAACCAGTG |
| 153 | TCTAACAACTCCAGCA | CCCTTTGCTTCGTTGT |
| 154 | TCTGGAAAGGTCAGTGCAG | TTCCACAAGTCCGATT |
| 155 | TCTATTTTATTTTCAGATGAAC | TTGTTTGATTCGTCCT |
| 156 | TCTGCATCAGATGTTCAGA | ACTACCAAACTGCTGG |
| 157 | TCTAGTGACGTTGACAAATA | TTGTGTATTTTTAGTTAGGT |
| 158 | TCTATGACCATTTACTTCAATA | GTGGATAAAATTCGAAA |
| 159 | TCTCAAACTATTTTGACGC | CAGACTGACTAGGAGCT |
| 160 | TCTGATGAATATCTACGTGTCG | GACTTGTAATTGATTCGC |
| 161 | TCTGATGAGGTGGACTATAACA | GAAGGCACCACCACCT |
| 162 | TCTATTTTCTTGCTCTTAGTTG | GTTGTATAGATGAGTTAATCTG |
| 163 | TCTGAAACTGTCATTCAACTTG | ACGGTTTTAAAGAATG |
| 164 | TATTTTTTAACAACAAAAAA | TTTTTCTTTATCTTCTGTG |
| 165 | TCTCCAATTTTTATTGGTTT | CGATTTTGTAAGAGCTT |
| 166 | TCTGCATCTTATACCGTGAA | CGACGAAGCTATTTCT |
| 167 | TCTACAATTTATATTGCTTGG | TAAGGCTTGCATTTTG |
| 168 | TCTGTTGGATTGATGTTGG | TTTTCCTAAAAATTTTCC |
| 169 | TGGAAACAAATCACAG | GGCATCTCCTAGCTTT |
| 170 | TCTGCAATAGTTTTTACTTTTTT | TGATAAAGGTAGTTCTACAC |
| 170d | TCTGGTTCTTATCATTTAACAA | TGATAAAGGTAGTTCTACAC |
| 171 | TCTGCTAGACCCAAACAGT | TTTTAGATGTTTTTGTGG |
| 172 | TACACTCATATTGTTGAAAA | ATGATTGATAATTTTAAGC |
| 173 | TCTAATAGTACTGAGACAAGTGC | TGCTTTTTGATATGCC |
| 174 | TCTGCTTATGTCGTCAATTT | TAAAATAAAGTTCAGAAAAG |
| 175 | TCTGAATTACCTTCGTTTATC | TTTCTCCCTTGACTTTC |
| 176 | TCTAAACATCCGATACTTAATG | CTTTTTCTCAGATGCTT |
| 177 | TCTAATTATCCTTTTGCGA | GACATTGAAACGGAAT |
| 178 | TCTGGACTACGCGGAGTAT | TTTTATCAATGATGTTGA |
| 179 | TCTGCTATTGGAGCAGCTG | CATATGACGCAAACGC |
| 180 | TCTGATAAAGAAGGGATAGAGG | AGCCTCTTTTCTTGTT |
| 181 | TCTAAAGAAAATCACAAACTG | ACGATTATCAACAAAGTT |
| 182 | TCTCAAAATAATAAAAAAGTAAAA | CATTCTTTTAAATACAAATC |
| 182d | TCTCAAAATAATAAAAAAGTAAAA | GGGTTTGAAGTTTTC |
| 183 | TCAAATGGTCAATCTAGC | TTTAACTTTAATTACTGGAAT |
| 184 | TCTAAGGATTCAAAAATCCC | TTTTTTTAATAAGCTTCGA |
| 185 | TCTGGGCAACCATCTACAT | TTTTTTGTAAACTTCCTG |
| 186 | TCTCATTCACAGGATAGCA | CTTAGATACATTGTTTTTTC |
| 187 | TCTGGACGAGGAGAAGTATC | CTTTCTTTTCTTACTTGC |
| 188 | TCACAATCTTCTCAAAA | TTTATTATTTTTAATACTTGAA |
| 189 | TCTGATAAGTCAGCAAACCC | CTTCAACTGTTGATAGAGC |
| 191 | TCTATCACGACATTACAGACT | TCCTTTAGCAGGAGCT |
| 192 | TCTAGATATTTAACTGCTGGT | GTTATACATGTTGTCTGAAG |
| 193 | TCTATAAAATATCAAGATGATTTT | CCAAATAATAACACGTTT |
| 194 | TTAGAAGTCAGAGAGCAG | GCTATCCCTTTCCAAT |
| 195 | TCTATTATGGAGACGGGTA | TGTATTTTAATTTGTTTTC |
| 195L | TCTTTGAATAATAAAGGTGTCG | TGTATTTTTAATTTGTTTTC |
| 195LN | TCTTTGAATAATAAAGGTGTCG | CAAACTTTTAACATTTAATG |
| 196 | TCTATTTCCTCAAATTTTTACG | ATAGTGTAAGCTACCAGC |
| 197 | TCTAATTTTTATAAGCTCTTG | GTCATCATATTCCTGAAA |
| 198 | TCTGCGCTTAAAGAATTAA | TGTTCGGCGTAAGATT |

TABLE II-continued

PRIMERS USED TO AMPLIFY GBSnnn PROTEINS
Forward primers begin 5'-GGGGACAAGTTTGTACAAAAAAGCAGGC-3' and
continue with the sequences indicated in the table below;
reverse primers begin
5'-GGGGACCACTTTGTACAAGAAAGCTGGGTT-3' and
continue with the sequences indicated in the table.
The primers for GBS1 are thus:
Fwd: GGGGACAAGTTTGTACAAAAAAGCAGGCTCTCAATCTCATATTGTTTCAG
Rev: GGGGACCACTTTGTACAAGAAAGCTGGGTTATTTTTAGACATCATAGACA
The full forward primer sequences are given in the
sequence listing as SEQ IDs 10968-11492. The reverse
primer sequences are SEQ IDs 11493-12017.

| GBS | Forward | Reverse |
|---|---|---|
| 199 | TTTTTAAAAGAAATTGAAA | ATTGGTCATTTCTTGAG |
| 200 | TTTCGTAAATATAATTTTGA | AACAGATTTATTGGTTGG |
| 201 | TCTAGCGATACCTTTAATTTT | AGACTCATCAACTTTTTCT |
| 202 | TCTATGCTGATTAAGTCGC | GAACCCTGAAGGGTAG |
| 203 | TGTGGTAAAACTGGACT | CCAATTGTATTTTTCAAC |
| 204 | TCTAAGACAGGAGCACCCGT | ATTTATACTACCTGTTGAATC |
| 205 | TGCGAGTCAATTGAGC | TTTAAATTTGTAGTCTTTAATA |
| 206 | TCTACAAATACTTTGAAAAAGA | CTCTTTTACTTTTCCAAAA |
| 207 | TCTAATTTATTTAAACGTTCCT | CCCTCCCTTAAGAGAA |
| 208 | TCTAAAAAGCGGCTAGTCA | TTGACGATGTTGCATC |
| 209 | TCTGGACAAAAATCAAAAATA | TTTCGAATTATTGTGACT |
| 209d | TCTGGACAAAAATCAAAAATA | GTATTGTTGTTGCCTG |
| 210 | TCTGGAGGAAAATTTCAGAA | TTTTTGATTTCCCTTTC |
| 210d | TCTACCTCATATCCTTTTATTT | TTTATAGTGTGTTTGCAA |
| 211 | TGTGGACATCGTGGTG | TTTGCTAGGAACTTTGA |
| 212 | TCTAAGACTAAAAAAATCATCA | TGATTCAATTCCTTTTC |
| 213 | TCTAAACACACCAGTAAAGAA | TTTTTCCTCTACTTTCTTA |
| 214 | TCTAAAAATAAAAAAATCTTATTT | TTTGCTCACCTCCACA |
| 215 | TTAATAAAAGGATTATTGTCA | CAATAACTTCTGTAAAATAAA |
| 216 | TCTGCTCGTTTAATACCACA | TTCACCCTTAAAATAATT |
| 217 | TCTAACACTAACATCCCTAGC | TGCATTTTTCCCTTCT |
| 218 | TCTAGAGGGAAGGTTATTTAC | CTCCAGTAAAGTATTAGTATTT |
| 219 | TCTATCAATAAAGTAACAGCTCA | GTGAGGTTTTGGTAATT |
| 220 | TCTAGAACACTATTTAGAATGATAT | TGCATATAAGTTTTTTAGC |
| 220d | TACTATGCGAATCACAG | TGCATATAAGTTTTTTAGC |
| 221 | TCTAGTTTAGCATTGCAAAT | CTCATCTAAAGTGCTATCC |
| 222 | TCTACATTTTATAAAAAGACGG | CTCGTATTTAGGCAACT |
| 223 | TCTAAGAAAATACGAAGCTATAC | ATTGGATATGCCATAAA |
| 224 | TCTGGAGGAAATGAAATATTA | GACTTTTTGATGTTTACTTT |
| 225 | TCTGGTATGTCTAATAAGGAAAT | TTCTTTACTATAAACATCTTCA |
| 226 | TCTAACAAACTTATTACAGAAAA | AGCATTTAAAGTGAATGT |
| 227 | TCTGTTTCATATGAAAAAGTCC | GTTAGTCTCTTCAAGATCA |
| 228 | TCTAGTAGAGGTATTTTTTTACAA | AAGACCTACCGCCCAA |
| 229 | TCTGAACGTCGGGTAAGTC | TACTTCTTTCTCTTTCAATT |
| 230 | TTTTTAATCGATTTTATTT | CTTAGTGTTCCGATATGA |
| 231 | TCATTAATATTCTTACGGT | TCTTGTTTTAAGAGCAGA |
| 231d | TCTTTATACGTTGTTAAACA | TCTTGTTTTAAGAGCAGA |
| 232 | TGGCTAAGTAAGCATGAG | ATCATGTTTTCCCTCAA |
| 233 | TTCCCAGCTAGCTGTC | ATCTGATATATCCGTTTTAT |
| 234 | TCTATAGAAATTGCTGTATTAATT | TTTTTTGTCTCCTTTTTTA |
| 235 | TCTATTCGATTTCTTATTCTTG | AAAGACACGATAAACATAAG |
| 235d | TCTGACTCAACCACAGTCTC | AAAGACACGATAAACATAAG |
| 236 | TCTGCAGACCTTACAAGTCA | ATTTGCAACTTCTTGTATA |
| 237 | TCTATTGTATTTGCTATTGCA | TTTAAAAGTATCCTTAAATAAG |
| 238 | TCTGATATTTTTTCAGCTATTGA | CTTCCTCCTCAATAGTTG |
| 239 | TCTGTTAGTGCTGCTATTGAA | TTCTCCTCCCCCATTA |
| 240 | TCTAAGAAGCTTACTTTTATTTG | ATCCAAACGAGTGAAAT |
| 241 | TCAAAAGGATATTCAAGA | AGGTGTTGTTGTATTTTC |
| 242 | TCTCATAATATATTAAGATTTTTAGG | CTTTCTAAGTTTATTAAACATA |
| 243 | TCTATTCTTGGTCAAGATGT | GGCATCTGTTACCTTG |
| 244 | TCTCATGAAAATGTTAAAAAAG | AAACAACTCCATTATTTTT |
| 245 | TCTAAGTCAACGGTAACAAA | TAAACGTTGAAGAGCAT |
| 246 | AGGAAACGTTTTTCCT | CTTATCATATCTTGTTAAATCA |
| 246d | TCTAACCATAAGGGAAAAGTA | CTTATCATATCTTGTTAAATCA |
| 247 | TCTGCTAAACAATTAATTGGT | TTGCCATGGGTTATAG |
| 248 | TCTTTGATGGTGTTGTTATTC | AGAATTAAAATTTTCATGC |
| 248d | TCTAAAACTTATTTGTCAAATG | AGAATTAAAATTTTCATGC |
| 249 | TGGGCTTACCATACTG | TTTTTTAGATGTTTTATGTG |
| 250 | TCTGGCCTTAATCTTAAGC | CTCTTTTACTTTAGCTTCA |
| 251 | TCTCAATATTTTTTGAAACAAG | TTTCAAACTCCAGCCA |
| 252 | TTTATTTCAGGTTATATCAA | GGAGTGCCTTTCTACT |
| 253 | TCTGAAAATTGGAAGTTTGC | TTCATATCGTAAAGCATC |
| 254 | TCTATTGAAAAGGGAGTTG | ATCGTCAACCTTAACG |
| 255 | TCTATTGTTGGTAGAGAAATCA | TTTTACTTGACGTCTCAC |
| 256 | TATCATGTAAAAATGATCA | GTCTTCCATTAATATTCCC |

TABLE II-continued

PRIMERS USED TO AMPLIFY GBSnnn PROTEINS
Forward primers begin 5'-GGGGACAAGTTTGTACAAAAAAGCAGGC-3' and
continue with the sequences indicated in the table below;
reverse primers begin
5'-GGGGACCACTTTGTACAAGAAAGCTGGGTT-3' and
continue with the sequences indicated in the table.
The primers for GBS1 are thus:
Fwd: GGGGACAAGTTTGTACAAAAAAGCAGGCTCTCAATCTCATATTGTTTCAG
Rev: GGGGACCACTTTGTACAAGAAAGCTGGGTTATTTTTAGACATCATAGACA
The full forward primer sequences are given in the
sequence listing as SEQ IDs 10968-11492. The reverse
primer sequences are SEQ IDs 11493-12017.

| GBS | Forward | Reverse |
|---|---|---|
| 257 | TCTGATTTTTTATACAAAGGAGG | CCAATTATTTTGAAAGTTC |
| 258 | TCTGAACGTTATACAGATAAAATG | ATTTTTTTGAATAATATAATCC |
| 259 | TCTCTTTCTCGTAAAAAAGAG | TTTATTATCAGAAAAGGC |
| 260 | TCTACTCTTGTCTTAGTTGTTTAT | ATTCAAAAAATTTTTCAA |
| 261 | TCTATAAAGAAAGCTGAAAATC | CGAAACGTCAGGTAAA |
| 262 | TCTATAAAAAATGCTATAGCATA | ACTTATTTTTGATAATATTTCTT |
| 263 | TCTCAGCCTTCTAAACTACTTC | ATCAGCATTTCTACGAA |
| 264 | TCTGATTTGTTTAGCATGTTG | ATGTAGACTCCTAATGATTT |
| 265 | TCTCTTGCTTCCCTGATTT | TTTACTGTTCCTTTCGC |
| 266 | TCTCATCAATCAAATCATTATC | GAGATTAATTTGATTATATTTT |
| 267 | TCTATCTTTATTATCGGACAA | AACATCATTTCCTCCC |
| 268 | TCTAAAGAATTTATTAAAGAATGG | GTTGATAGTTCCAAAACG |
| 269 | TCTGCAGATGATGGTGGTT | TAAATGTGTTCCTACTAAATT |
| 270 | TTAAATGATGCAATAACAA | CATCAATAGCCGAGCTG |
| 271 | TTGCTGGATTATCCTC | TTTATTTTCCAAATGACA |
| 272 | TCTGTATTTATGGCAAATAAGA | TTCACTCGGAGTTGGAG |
| 272d | TCTATGAGTTCTCTGGAAGTT | TTCACTCGGAGTTGGAG |
| 273 | TCTGGTGTCCTCAACTCTG | AATGTAAATGACAAAGGTA |
| 274 | TCTGTTCATGATTTTGGTGA | GTTTTTTAATGGTTTGC |
| 275 | TCTGGGGTTTGGTTTTATA | TTTATCATAAGCATCTAGAC |
| 276 | TCTCAATCAGACATTAAAGCA | CTGATCTCTTGTTGATGC |
| 277 | TCTATTTGGAGGGGGGAAA | AAGCAGGGGAGCAATA |
| 277d | TCTACCAAATTTGACTGGG | AAGCAGGGGAGCAATA |
| 278 | TCTGTTACGTTTTTCTTAT | CTGAGCAACACCTGTC |
| 279 | TCTAAAAAGAAAAGTTTAATTAGC | GGCAATTTTGTGGCAA |
| 280 | TTTGATTTTTTAAGAAAA | TTGCTTAGTTAATGGCT |
| 281 | TCTAAGAAATTAATTATAGGTATTT | AGGCGTTGAATATAATTC |
| 281d | TCTGGTTTTTCGTTTTTGA | AGGCGTTGAATATAATC |
| 282 | TCTCTATTCTCAGATGAAACAA | CTTTTCAACTCCAAACA |
| 283 | TCTGTTAAATTAAAATCGTACTG | GAGTTGTCTTTTTTTGTC |
| 284 | TCTATGCAACGATTAGGAC | GCAATCACAATTGACAT |
| 285 | TTAGGTGAAAGCAAATC | CTTTGTCTGCTTCACTT |
| 286 | TCTGGAGGATTTTATATGAAAG | TTGTATCTTCTCCTGACC |
| 287 | TCTGCACACACACCTACTAGT | TTGGTTAATCGTCTTG |
| 287d | TCTAACAATCGTTCAAAGC | TTGGTTAATCGTCTTG |
| 288 | TCTAAAAAGTTTTTAAAAGTTTT | TTTAGTTACTTTCATAAATGG |
| 288d | TGGAATAATCATCAGTCA | TTTAGTTACTTTCATAAATGG |
| 289 | TCTCAATCTAAAGGGCAAA | ATATAATTCCTCTAAAACTAGC |
| 289L | TCTCAATCTAAAGGGCAAA | CCACTTCAAATTAACTAAC |
| 290 | TATTACTTATCAAAAGAAAAGG | ATTCCTTGAACACGAA |
| 291 | TCTCAAGTATTAAATGACAATGG | GTGCCATTCATTCTCT |
| 292 | TTGAATCGTAAAAAAAGG | TTGTCCTGTGAACTGTG |
| 293 | TCTATGGGTCTAGCAACAA | AGGGTTTATTTGTTGAAG |
| 293d N-term | TCTATGGGTCTAGCAACAA | TCCTGATTTATCCACTG |
| 293d C-term | TCTGTTACAGCTAAACACGG | AGGGTTTATTTGTTGAAG |
| 294 | TCTGGTCATTTTAGTGAAAAA | CAAAATACCTAAGCTAGC |
| 295 | TCTAGCGACATAAAAATCAT | ACGAACTTCCATAACC |
| 296 | TCTAAAGGTATTATTTTAGCG | GGCTTCTCCAATCAAA |
| 297 | TCTATTCAGATTGGCAAATT | TTGAGTTAATGGATTGTT |
| 298 | TCTACTAAATTTATTGTTGATTCA | TAGCGTTATTTCACTGTG |
| 299 | TTTGAAATACTTAAACCTG | TTTCTCCGCCCAGTCA |
| 300 | TCTGCTTCTACAAATAATGTTTC | CCGTTTATTCTTTCTACTG |
| 301 | TCTGTAATTAATATTGAGCAAGC | CATATCTGTTGCATCAAT |
| 302 | TCTGAAATCAACACTGAAATAG | AACTGGCTTTTTAGTCAG |
| 303 | TCTACAAGGCATATAAAAATTTC | TTTATTATTTAATTCTTCAATA |
| 304 | TCTAACGAAATCAAATGCCC | GTCTTTTAGAGCATCGA |
| 305 | TCTGGACGAGTAATGAAAACA | CTCTCCTCTAAGACTTTCG |
| 306 | TCTGGGAAAAAAATTGTTTT | TCCTTTTGTTACTTTTGC |
| 307 | TCTAAATTTACAGAACTTAACTTAT | TTTATCGCCTTTGTTG |
| 308 | ATGACACAGATGAATTTTA | ATGTTCAGGTTCTCCG |
| 309 | TTGCAACTTGGAATTG | TTCCATTATCTTCAAGTTA |
| 310 | TCTGCTAAAGAGAGGGTAGAT | CTCTTCTTCATTTTTCTA |
| 311 | TCAATTATTACTGATGTTTAC | TTTTTTTAAGTTGTAGAATG |
| 312 | TCTACTGCAACTAAACAACAT | GTTTTTTGATGCTTCTTG |
| 313 | TCTAAACGTATTGCTGTTTTA | TTTACTACTTTGGTTGGC |

TABLE II-continued

PRIMERS USED TO AMPLIFY GBSnnn PROTEINS
Forward primers begin 5'-GGGGACAAGTTTGTACAAAAAAGCAGGC-3' and
continue with the sequences indicated in the table below;
reverse primers begin
5'-GGGGACCACTTTGTACAAGAAAGCTGGGTT-3' and
continue with the sequences indicated in the table.
The primers for GBS1 are thus:
Fwd: GGGGACAAGTTTGTACAAAAAAGCAGGCTCTCAATCTCATATTGTTTCAG
Rev: GGGGACCACTTTGTACAAGAAAGCTGGGTTTATTTTAGACATCATAGACA
The full forward primer sequences are given in the
sequence listing as SEQ IDs 10968-11492. The reverse
primer sequences are SEQ IDs 11493-12017.

| GBS | Forward | Reverse |
|---|---|---|
| 314 | TCTAAATTTTATCTTGTTAGACAC | GTGTGTCATTTTGACCT |
| 315 | TCTATAGGGGATTATTCAGTAA | TCCTTCAAGATCATTTAA |
| 316 | TCTACTGAACGAACATTCGA | ACCTCCTTTTCTTTCATT |
| 317 | TCTAATAAGCCATATTCAATAG | ATCTTCTCCTAACTTACCC |
| 317d N-term | TCTAATAAGCCATATTCAATAG | ACTAGCTAGATTCTTAACGC |
| 317d C-term | TCTGACTTGAATGGCAATAT | ATCTTCTCCTAACTTACCC |
| 318 | TCTATTGATTTTATTTCTATTG | GCCTCTTTCTCCAAAT |
| 319 | TTAAAACATTTTGGTAGTAA | ATGTCCTGTTATATCTTCTT |
| 320 | TCTACTATTTATGACCAAATTG | GCGTTGAATAATGGTT |
| 321 | TCTAAAAATAAAAAGATCAGTT | TATTTCTTTAGTTTCTTCAA |
| 322 | TCTCAAGAAACAGATACGACG | TAATAAAAATTATATAAGAACCT |
| 323 | TCTGGTAATGAGTCAAAGAAC | TTCTGTCTTATAAGCATAAG |
| 324 | TCTGGAAGTAAATCAGCTTC | TTTTTTATAAGCATGTGTA |
| 325 | TCTGCTTGGCAACTTGTTC | ATGAGACATAAGGTCTTG |
| 326 | TCTGGCATCTCAGACTTACC | GTTGGAGCTCCTACTG |
| 326L | TCTAAATTCAAATCTGGGG | GTTGGAGCTCCTACTG |
| 326L N-term | TCTAAATTCAAATCTGGGG | CATTTCTTTGGTTAAAGC |
| 327 | TCTGGAGGGAAAATGAATC | TATCTCGAGTGCTATTTG |
| 327d N-term | TCTGGAGGGAAAATGAATC | CTCTTCATCGACATAGTAA |
| 327d C-term | TCTGGCAACTTCAAAGCAT | TATCTCGAGTGCTATTTG |
| 328 | TCTGACCAAGTCGGTGTCC | ATTTTACAGTAGTGGAGTTT |
| 329 | TCTAAATCAAAGACCTCTTCTA | TGTCCTCATTTTTTCA |
| 330 | TCTAATAAACGCGTAAAAATC | TTTAACAGTACGAACACG |
| 331 | TCTACCAGAACAGTAGCAAT | CCCCCTGTTTTTAAAAT |
| 332 | TCTACAAAAACCTGTTATTAA | ACCCTCATATGATTCC |
| 333 | TCTATTGATATACAAAAATAAAA | TTTAAAATAATGATACATCTC |
| 333d | TCTGGATCATTGAGGGCAA | TTTAAAATAATGATACATCTC |
| 334 | TCTAATTTAGTAAAAGTGAATAGTG | TAACCCCGTCTCAACA |
| 335 | TCTGAAGAAGAAAAATATTTTGA | TATTTTCGTTTTCTCAAA |
| 336 | TCTCAGGTTGAAGTTGACTTA | TTTCTCCAAATAATCTCTC |
| 337 | TCTGAAACAGATTCGTTTGTA | CCTATTTTAGTTTTAGAAGA |
| 338 | TCTGCTATAATAGACAAAAAG | GAAATCATAGCTTCCC |
| 339 | TCGAAACCGATTAAGAT | ACCTTTTACTTTTGGTAGT |
| 339d | TCTCAAGTCATGCGCTATG | ACCTTTTACTTTTGGTAGT |
| 340 | TCTGGATTTCTCTATAATTACTTC | TTGTTTGTGAAGTAAAACG |
| 341 | TCTGGAAAACCATTGTTAAC | TAATTTAAAAATTGCATAAA |
| 342 | TCTCAGAAAATTGAAGGTATT | TTTCGTTACCATATCTAGA |
| 343 | TCTGAAATGCAAGTTCAAA | TAAATCATGGAAACTAGC |
| 344 | TCTGCACAACGCAGAATGT | AAAGCCCAACCTTCCG |
| 345 | TCTAAAAACCTGAATTGGG | GTTTCCACGTCCTTTC |
| 346 | TCTAATAAAATAGCTAATACAGAAG | AAGTTTATTCAAATCTGG |
| 347 | TCTATTGATATTCATTCTCATATC | AATGTAATGGTTTTTAATA |
| 348 | TCTACTGGATCTAAAAAATTAGC | AGCTAAAATACCTAACCAG |
| 349 | TCTAAAGATCGCTTATATAATAAA | ATTTTTTAAACGACTCAT |
| 350 | TCTGCAAAAGATATAATTAAGGTT | AGCGGAACGGTGAATA |
| 351 | TCAGAAGATCAAAAACA | ATAATCTAAACTATCAGCTCT |
| 352 | TCTACTTTTTTAAAAAGCTAAA | ATCTCCTATTGTAATTTTGA |
| 352d | TCTGGTACAGATAGTAAATTTGG | ATCTCCTATTGTAATTTTGA |
| 353 | TCTACAATGTTAAAAATTGAAA | CACCTCTTTTGTCAGA |
| 354 | TCTATTAAAGAACTAAAAGAATTT | TTTGTTAGCGAGTAAGTC |
| 355 | TCTCGCTCACTACCTT | TTTATCATCCTCCTTAATAA |
| 356 | TCTAAATTCTATATTATTGATGATG | AAACGTTTTACTCTGTAAAA |
| 357 | TTGGAACATTTTTATATTAT | AAATAAGAATGTTAAAAGAGC |
| 358 | TTTTATACAATTGAAGAGC | TTCCCCAAAAATTTCT |
| 359 | TCAAGAAATAATTACGGT | ACGCAGTCCCATTTTC |
| 360 | TCTATAATGAAGGCGGTCT | CTGGCATGAGGTCTCA |
| 361 | TCTAGCGTATATGTTAGTGGA | CCTTTTTTCAATAATAGC |
| 362 | TCTACTAAACCACAGGGGG | ATCTTTAATCTTACCATCC |
| 362d N-term | TCTACTAAACCACAGGGGG | TGCTGCTACTGCAATG |
| 362 C-term | TCTGGTAATGAAGGAAATATCAC | ATCTTTAATCTTACCATCC |
| 363 | TCTCTCGAATTAAAAAATATTG | TAAATTCCTTTGTTGTAATA |
| 364 | TCTAACTATATGGGTATGGGC | ACCATCAGTTGTCACC |
| 365 | TCTGGAACTGCTACATATAGTAGG | TATTGACCAGTGCACG |
| 366 | TGGCTTGACATTATTTT | TTTTTTTGAATTTGTAAAAG |
| 367 | TCTAAGAAATTAAAAATATTCCC | AGAGATTATTTTTATTTAAAT |

TABLE II-continued

PRIMERS USED TO AMPLIFY GBSnnn PROTEINS
Forward primers begin 5'-GGGGACAAGTTTGTACAAAAAAGCAGGC-3' and
continue with the sequences indicated in the table below;
reverse primers begin
5'-GGGGACCACTTTGTACAAGAAAGCTGGGTT-3' and
continue with the sequences indicated in the table.
The primers for GBS1 are thus:
Fwd: GGGGACAAGTTTGTACAAAAAAGCAGGCTCTCAATCTCATATTGTTTCAG
Rev: GGGGACCACTTTGTACAAGAAAGCTGGGTTATTTTTAGACATCATAGACA
The full forward primer sequences are given in the
sequence listing as SEQ IDs 10968-11492. The reverse
primer sequences are SEQ IDs 11493-12017.

| GBS | Forward | Reverse |
|---|---|---|
| 368 | TCTAAAATCATTATTCAACGT | TTTATTTTTAGTATCTAAAACG |
| 369 | TCTAGTAGAATGATTCCAGG | TTTAGAAACTCCAAGTATCTC |
| 370 | TCTACCGAATTTAATGACG | GTTAATTTGACTATTGATATATT |
| 371 | TCTAAAGATAGATATATTTTAGCAG | TAAACTCTCAAAAGCTAAAC |
| 372 | TCAGAAAAATATTCCACT | ACGTTCTTCTCTGGCT |
| 373 | TCTGAAATTGGTCAGCAAA | ACTTAAATGGAACAACC |
| 374 | TCTAAGTTCGAAAATATAATATATG | TTTGCCTAAAAAATTAGG |
| 375 | TCTGAAAAAGAAACTATTTTAAGT | GGCTTTCCTCCCTTCA |
| 376 | TCTAAAGAAAAGAAAAATTTGG | TTCATCTTTTTCAATATCA |
| 377 | TCTGGTAATAAACTGATGTATCA | GTGAGAGTGTCTTTGTTT |
| 378 | TCTGAAGATCAACTCACTATATTT | CAGATTTTTAGCTACTTGTC |
| 379 | TCTCAAATTACCCGAGAAG | TCTAGAGCGCTTTATAAG |
| 380 | TCTCTTAAAAGATTACTTACTGAAG | TTTTCTAATAGTTAGAAGCC |
| 381 | TCTCTTGGGATAGCTCACA | TTTTAAATGTGCAGAGA |
| 382 | TCTATAAAGTTTAAATTATTTTTTAA | ATTTATAATTTCCTTGGG |
| 383 | TCTATTTTACAGACGAATATACTAT | TCTATAATATCTCTCTAAAGTGA |
| 384 | TCTAGAATAATTGTTGTCGG | CCTCGCTAACATATCAC |
| 385 | TCTAATGTAAAAAAACGC | AGCTCTTACAGTCTTGC |
| 386 | TCTCTAGTATCAAAGGAGAAAGC | TTGTCTGAGTGACCAA |
| 387 | TCTGGTATGTTGTTAGCA | ATAATATGAAATATGTTGTTCA |
| 388 | TCTCTTATGATAATAAATTCATTCG | TCCGCAGAGTAAAAAA |
| 389 | TCTATGAATAGTGAACATAAAATT | TTCATAAATGTGCCAA |
| 390 | TCTAGGGAAACTTACTGGA | TTCATCTCTGCTCACC |
| 391 | TCTAAAAAAGTCATCGATTTAA | TTCTCCTTCAGCTTTTA |
| 392 | TCTATTACATATGATTTCACAAG | GTCATTTTTTCTAAAGTTTG |
| 393 | TCTAATAAATCTTGGTTGAGAA | TTTTTGTAGTTGTTTCAAT |
| 394 | TCTCCTATGTTGTCTGTTGG | TTTCATTAGATAACTATTCAGC |
| 395 | TCTACTTATCAAAAAACAGTTG | TATAGACTGAAGATAATTAATTAA |
| 396 | TTTGTCAAAGGGATTT | AAATCGATTAATCAAGTC |
| 397 | TCTAAATTATTTGATAAGTTTATAGA | TCTAAAGTAGTCCTTTAGACTA |
| 397d | TCTAAAACTGCTACAGTTAG | TCTAAAGTAGTCCTTTAGACTA |
| 398 | TATTTAGAACAATTAAAAGAGG | TTTGTCCATAATCATTTC |
| 399 | TCTAAAGTTTTAGTAGTTGATGAT | GGTAGATATGCCTAACATT |
| 400 | TCTAAAATAGTTGAAGGCG | GTTTCCTTCCAAAAAA |
| 401 | TCTGGAATTGAATTTAAAAATG | TCCATGCTTAATAGCC |
| 402 | TCTGGAAAATATTTTGGTACAG | ATCTAAACCAATTTCTGTAC |
| 403 | TCTGAGGTTAGAATGGTAACTC | GTCCACAAAAACGTCT |
| 404 | TCTAAAATAGATGACCTAAGAAA | TAGATGTTCTACGGAGAA |
| 405 | TTGAAAATTCAGTATTATCA | AAAGATGGCAAGCCAT |
| 406 | TCTGATAAAAATAATTTAGAAGACT | TCTCTCTCCACACCATA |
| 407 | TCTAAAATTGACATGAGGAA | CTTACCTCCTGTGGCT |
| 407d | TCTAAAATTGACATGAGGAA | CTTTTGTTGGTTACCTC |
| 408 | TCTAACCACTTACTTAACCTCA | TATTGTTAAATATGATGAAATG |
| 409 | TCTAAGGTAGTAGTAGCTATTGAT | ATGATTATACAAATTGATTAAT |
| 409d | TCTACTGAAGAGAGAAATCCT | ATGATTATACAAATTGATTAAT |
| 410 | TCTGCTTTATTATCAGTTATTGTC | TCCCTCTTCCTTGACA |
| 411 | TCTAAAGACTATATTAACAGAATATT | AACGTTTTTGAGCTTT |
| 412 | TCTGGATTTTTTGCACAGC | TTTTGTCTTAAACGTTCT |
| 413 | TCTATTGTTGGTGAACAAGA | TTTAGATAGTCTAGCCATTT |
| 414 | TTAAATCAATATTTTCTGC | ACGGCTTGGGGCAGAG |
| 415 | TCTGAGCGAATTCCTGTTC | TACCATTATCCGTGCT |
| 416 | TCTGAAGTCATTCGTGAACA | ACTATTAAACTCCAATGTTA |
| 417 | TCAAAACAATATGATTATATC | GCGCATTGTAACAAAT |
| 418 | TCTAGCAAGCCTAATGTTG | TTTTGGTAAAAGGTCTG |
| 419 | TCTGATTTAAATAATTACATCGC | TCCTGGAAAGTTCATC |
| 420 | TCTAAACGTGAATTACTACTCG | TAGTTTATCTAAAGCGTTC |
| 421 | TCTATACGCCAGTTTTTAAG | TTTATGTATAGAAACAGCAG |
| 422 | TTTTCGAGCGATTTTG | AATGTACATAACAATAGAGAGC |
| 423 | TCTGTAACCAAAGTTGAAGAG | CAACGATCCCAAGAAC |
| 424 | TCTATGAAAGATTTTATTGAATG | GCCATTCTTACCTCCT |
| 424d | TCTATGAAAGATTTTATTGAATG | ACGTTTTTTCTGACCG |
| 425 | TCTATAGCCTTTAATAGTTTATTT | TATAAAATAAATTTGAAGATCT |
| 426 | TCTD440ACAGTTTATAATATAAACCATG | ATCATCTTGTACCAACTC |
| 427 | TATTCTTTTGAAGAACTTTT | GCCAATAAATTCACGG |
| 428 | TCTATAAAAATTTTGATCCC | AGTCTGTTTTTTAACAAAAG |

TABLE II-continued

PRIMERS USED TO AMPLIFY GBSnnn PROTEINS
Forward primers begin 5'-GGGGACAAGTTTGTACAAAAAAGCAGGC-3' and
continue with the sequences indicated in the table below;
reverse primers begin
5'-GGGGACCACTTTGTACAAGAAAGCTGGGTT-3' and
continue with the sequences indicated in the table.
The primers for GBS1 are thus:
Fwd: GGGGACAAGTTTGTACAAAAAAGCAGGCTCTCAATCTCATATTGTTTCAG
Rev: GGGGACCACTTTGTACAAGAAAGCTGGGTTATTTTTAGACATCATAGACA
The full forward primer sequences are given in the
sequence listing as SEQ IDs 10968-11492. The reverse
primer sequences are SEQ IDs 11493-12017.

| GBS | Forward | Reverse |
|---|---|---|
| 429 | TCTAATCATTCCATTGAATC | TGGTTTTAGAACAACTTTA |
| 430 | TTACAAAAAAATATCGG | AATTAAGCTGAAAATGAC |
| 431 | TCTGCGGCTCAATTAGCTG | ATTATATTCTTTTAATTTGTCA |
| 432 | TCTCGTACCTTCAAACCAG | CTTACGACGTCCTGGA |
| 433 | TCTATTAAAGCAACTTTTACTC | GTGTGTCATGACTACTGTAC |
| 434 | TCAATTTTTCAGACAACA | TGAGTAGAGCACAAGC |
| 642 | TCTAGAAAACGTAATGATACATT | GAAACGAATACGTTCTT |
| 643 | TCTGATTGTCAAATTACACCA | ACTACCTACCGTTTTCAC |
| 644 | TCTATTTTTCGTGGTGATAA | TTTGATGGTAACAGTCG |
| 645 | TTTTTTAATATTGAATATCAC | AGAAAGGCGCTCTTCT |
| 646 | TCTAAGGGAGTCCAATATATG | TATCTTTAATAAAGCCCTA |
| 647 | TCTCGTCGCATGAATACCA | CATCCCATAAATTTGTT |
| 648 | TCTATAGAATTTTCAGGGC | CAAGACATTTCTTAAAGC |
| 649 | TCTGCTACTCACTCTAACTCAG | TTTTGTTTTAGCGATG |
| 650 | TGCTCTTCTTCAAATACT | TTTTAAACCATGCTGT |
| 651 | TCTCTAACACCATTTACAAAG | TTTGTAAAGACCTTCTTT |
| 652 | TCTCAACAAGGTATTATGGATA | TTCCTCGTTTATTAATTT |
| 653 | TCTAAAATTTTAGGTACACCA | AAAGAAAAGATGTGCC |
| 654 | TCTGGAAAAATGGTTAAGAA | CTGTGCAGGCTCAAAT |
| 655 | TCTAAATTCGTCCGAACCGT | AATTGTCCAGTCTAAGTTA |
| 656 | TCTGGTCTTCCAACGCAGC | ATTTAGTGTTATTTCTCCTG |
| 657 | TGCTCAGGTAAAACAT | TTTTTTAAGTGATGATGAA |
| 658 | TCTGAAAGCAAATCTTTGC | CTTTGTCTGCTTCACTT |
| 659 | TGTGCTAATTGGATTG | TTTTGGGGTTACTTTAC |
| 660 | TGTGGAAATGTCGGAG | TTTTGCTGAAATAATGTT |
| 661 | TGTCAGTCAAACCACA | ATCATACGAATGCAAC |
| 662 | TCTGCTAGTTTTTATTTTTCC | TTTTTCATATTTTTTCAAA |
| 663 | TGTGGAAGTAAATCAGC | ATTATTTTTATAAGCATGTG |
| 664 | TCTGTTAAATTAAAATCGTTACTG | GAGTTGTCTTTTTTTGTC |
| 665 | TCTATTGCTGGTCCTAGTG | GATAAGCACTTTCCTTAA |
| 666 | TTATTTTTTGGAAATTGG | GCCTAAAAACCAATCA |
| 667 | TCTGCTGTATTTACACTCGTC | ATGTTTATGGCTTGCT |
| 668 | TTTTATATGAAAGAACAACA | TTGTATCTTCTCCTGACC |
| 669 | TCAATTATTATTGGGTTAA | ATATACCCTAGACTTTTGA |
| 670 | TCTCCTAAATTAACCCTAGTCT | GGCTTTAAAGTTCGATA |
| 671 | TCTAGTCTTGCGAAGGCAG | TTTATCGTAAGCACTTAGG |
| 672 | TCTGTATTTACACTCGTCTTACA | ATGTTTATGGCTTGCTT |
| 673 | TCTGGAGGATTTTATATGAAAG | TTGTATCTTCTCCTGACC |
| 674 | TCTGTTAAATTAAAATCGTTACTG | GAGTTGTCTTTTTTTGTCT |
| 675 | TCTGGTTCATCAGACAAACA | TTCAACTTGATTGCCA |
| 676 | TCTGTAGTTAAAGTTGGTATTAACG | TTTTGCAATTTTTGC |
| 677 | TCTGTATTAGAAGTACATGCTGA | TTTTAATGCTGTTTGAA |
| 678 | TCTGAGACACCAGTAATGGC | TTTTTTAGCTAAGGCTG |
| 679 | TCTGCTAACAAGCAGGATC | TTTTGCTAAACCTTCTG |
| 680 | TCTAATAAGTCCAGTAACTCTAAG | ATTCATATTAACACGATGC |
| 681 | TCTGCTTTTGATGTAATTATGC | TTTGCGTTTTGGAGGG |
| 682 | TCTATTAACTATGAGGTTAAAGC | TGCACCTTGATGGCGA |
| 683 | TCTGTAATTGTTGAACTTAGTTTG | CCATAATATTTGATGCTG |
| 684 | TCTCTTAGGAAGTATAAGCAAA | TTCTAATCCTACAGCATG |
| 685 | TCTAAAATTTGTCTGGTTGG | AAAAATTCCTCCTAAATTAA |
| 686 | TCTGACTTTTATGATATCAATCTT | AAAGTTTTGACTATTACTGATAG |
| 687 | TATGCTATTATGCAAAAAG | TGGGGGAGATAGTTATG |
| 688 | TCTGCAATCGTTTCAGCAG | TTGACAGAAAGCTAATTG |

TABLE III

RESULTS FOR in vivo GBS CHALLENGE

| GBS # | % survival Pre-immune | % survival Post-immune |
|---|---|---|
| 1 | 18.7 | 22.2 |
| 4gst | 19.4 | 37.2 |
| 4his | 25.0 | 75.0 |
| 8 | 14.3 | 42.1 |
| 10 | 29.1 | 36.0 |
| 15 | 30.0 | 60.9 |
| 16 | 33.3 | 53.8 |
| 18 | 29.4 | 50.0 |
| 21 | 5.9 | 10.0 |
| 22 | 36.8 | 63.1 |
| 24 | 38.5 | 41.4 |
| 25 | 28.6 | 85.7 |
| 32 | 20.0 | 25.0 |
| 35 | 0.0 | 17.6 |
| 45 | 26.7 | 37.5 |
| 48 | 20.0 | 25.0 |
| 52 | 14.2 | 17.3 |
| 53 | 23.8 | 29.2 |
| 54 | 22.7 | 44.0 |
| 55 | 50.0 | 52.9 |
| 57 | 33.3 | 55.6 |
| 58 | 6.7 | 11.8 |
| 62 | 15.8 | 36.4 |
| 63 | 21.4 | 42.9 |
| 65 | 3.7 | 23.3 |
| 67 | 23.5 | 27.8 |
| 71 | 13.3 | 26.7 |
| 73 | 28.6 | 39.1 |
| 80 | 38.8 | 56.5 |
| 84 | 33.3 | 37.5 |
| 85 | 30.8 | 62.5 |
| 90 | 14.3 | 22.7 |
| 94 | 25.0 | 30.0 |
| 95 | 16.7 | 23.1 |
| 98 | 5.9 | 11.1 |
| 100 | 26.9 | 42.9 |
| 103 | 16.7 | 52.9 |
| 106 | 10.0 | 18.2 |
| 110 | 11.1 | 30.0 |
| 113 | 17.6 | 29.4 |
| 114 | 40.0 | 52.2 |
| 117 | 27.8 | 36.8 |
| 119 | 36.4 | 52.2 |
| 139 | 23.1 | 26.7 |
| 150 | 21.6 | 44.4 |
| 153 | 25.0 | 30.0 |
| 155 | 22.6 | 36.8 |
| 157 | 14.3 | 31.8 |
| 158 | 22.6 | 40.0 |
| 163 | 29.6 | 37.9 |
| 164 | 25.0 | 43.8 |
| 173 | 17.9 | 38.7 |
| 176 | 20.0 | 38.9 |
| 177 | 21.7 | 33.3 |
| 181 | 5.0 | 21.7 |
| 186 | 41.2 | 52.6 |
| 188 | 11.8 | 23.5 |
| 189 | 21.4 | 31.6 |
| 195 | 32.1 | 64.7 |
| 206 | 33.3 | 50.0 |
| 211 | 30.8 | 33.3 |
| 232 | 50.0 | 57.1 |
| 233 | 34.8 | 55.2 |
| 236 | 57.1 | 70.6 |
| 243 | 46.7 | 52.9 |
| 263 | 15.4 | 35.7 |
| 273 | 61.5 | 75.0 |
| 276 | 23.8 | 44.4 |
| 296 | 25.0 | 28.6 |
| 297 | 13.3 | 23.5 |
| 298 | 20.0 | 22.2 |
| 302 | 30.0 | 52.2 |
| 304 | 33.3 | 40.9 |
| 305 | 42.1 | 70.0 |

TABLE III-continued

RESULTS FOR in vivo GBS CHALLENGE

| GBS # | % survival Pre-immune | % survival Post-immune |
|---|---|---|
| 316 | 38.5 | 42.9 |
| 318 | 7.1 | 15.8 |

TABLE IV

COMPARISON OF GBSnnn NUMBERING AND SEQ ID NUMBER

| GBS numbering | Sequence listing |
|---|---|
| GBS1 | SEQ ID 3532 & 8736 |
| GBS2 | SEQ ID 4530 & 8818 |
| GBS3 | SEQ ID 6266 & 8958 |
| GBS4 | SEQ ID 2 & 8786 |
| GBS5 | SEQ ID 2598 & 8674 |
| GBS6 | SEQ ID 398 & 8496 |
| GBS7 | SEQ ID 8790 & 9798 |
| GBS8 | SEQ ID 8694 |
| GBS9 | SEQ ID 4540 & 8822 |
| GBS10 | SEQ ID 8718 |
| GBS11 | SEQ ID 5884 & 8930 |
| GBS12 | SEQ ID 8764 & 9692 |
| GBS13 | SEQ ID 8484 |
| GBS14 | SEQ ID 5406 & 8892 |
| GBS15 | SEQ ID 4 & 8710 |
| GBS16 | SEQ ID 944 & 8538 |
| GBS17 | SEQ ID 1770 & 8602 |
| GBS18 | SEQ ID 6860 & 9002 |
| GBS19 | SEQ ID 4422 & 8812 |
| GBS20 | SEQ ID 308 & 8488 |
| GBS21 | SEQ ID 8762 |
| GBS22 | SEQ ID 8584 |
| GBS23 | SEQ ID 8512 |
| GBS24 | SEQ ID 1694 & 8598 |
| GBS25 | SEQ ID 3180 & 8714 |
| GBS26 | SEQ ID 8820 |
| GBS27 | SEQ ID 8774 |
| GBS28 | SEQ ID 8738 |
| GBS29 | SEQ ID 8744 |
| GBS30 | SEQ ID 8860 |
| GBS31 | SEQ ID 8702 |
| GBS32 | SEQ ID 8910 & 10142 |
| GBS33 | SEQ ID 5734 & 8912 |
| GBS34 | SEQ ID 5750 & 8916 |
| GBS35 | SEQ ID 8908 |
| GBS36 | SEQ ID 8542 |
| GBS37 | SEQ ID 8564 |
| GBS38 | SEQ ID 2122 & 8642 |
| GBS39 | SEQ ID 8480 |
| GBS40 | SEQ ID 8654 |
| GBS41 | SEQ ID 1176 & 8562 |
| GBS42 | SEQ ID 4856 & 8850 |
| GBS43 | SEQ ID 672 & 8520 |
| GBS44 | SEQ ID 9000 |
| GBS45 | SEQ ID 9018 |
| GBS46 | SEQ ID 1834 & 8608 |
| GBS47 | SEQ ID 8588 |
| GBS48 | SEQ ID 8594 & 8596 |
| GBS49 | SEQ ID 8494 & 9490 |
| GBS50 | SEQ ID 1236 & 8566 |
| GBS51 | SEQ ID 5410 |
| GBS52 | SEQ ID 3920 |
| GBS53 | SEQ ID 8586 |
| GBS54 | SEQ ID 3442 |
| GBS55 | SEQ ID 9020 & 10338 |
| GBS56 | SEQ ID 2510 & 8668 |
| GBS57 | SEQ ID 8854 |
| GBS58 | SEQ ID 8664 |
| GBS59 | SEQ ID 3744 |
| GBS60 | SEQ ID 8760 |
| GBS61 | SEQ ID 8776 |
| GBS62 | SEQ ID 2244 |

TABLE IV-continued

COMPARISON OF GBSnnn NUMBERING AND SEQ ID NUMBER

| GBS numbering | Sequence listing |
|---|---|
| GBS63 | SEQ ID 390 |
| GBS64 | SEQ ID 374 |
| GBS65 | SEQ ID 8544 |
| GBS66 | SEQ ID 3028 |
| GBS67 | SEQ ID 3746 |
| GBS68 | SEQ ID 4012 |
| GBS69 | SEQ ID 4916 |
| GBS70 | SEQ ID 3718 |
| GBS71 | SEQ ID 8906 |
| GBS72 | SEQ ID 1348 |
| GBS73 | SEQ ID 220 |
| GBS74 | SEQ ID 5872 |
| GBS75 | SEQ ID 8926 |
| GBS76 | SEQ ID 5862 |
| GBS77 | SEQ ID 3256 |
| GBS78 | SEQ ID 3262 |
| GBS79 | SEQ ID 3264 |
| GBS80 | SEQ ID 8780 |
| GBS81 | SEQ ID 2706 |
| GBS82 | SEQ ID 2898 |
| GBS83 | SEQ ID 8772 |
| GBS84 | SEQ ID 4182 |
| GBS85 | SEQ ID 216 |
| GBS86 | SEQ ID 2978 |
| GBS87 | SEQ ID 3452 |
| GBS88 | SEQ ID 5694 |
| GBS89 | SEQ ID 2682 |
| GBS90 | SEQ ID 8476 |
| GBS91 | SEQ ID 8938 |
| GBS92 | SEQ ID 8964 & 10238 |
| GBS93 | SEQ ID 2848 |
| GBS94 | SEQ ID 1592 |
| GBS95 | SEQ ID 2224 |
| GBS96 | SEQ ID 2130 |
| GBS97 | SEQ ID 800 |
| GBS98 | SEQ ID 8746 |
| GBS99 | SEQ ID 4240 |
| GBS100 | SEQ ID 8782 |
| GBS101 | SEQ ID 6902 |
| GBS102 | SEQ ID 6894 |
| GBS103 | SEQ ID 6 |
| GBS104 | SEQ ID 8778 |
| GBS105 | SEQ ID 1400 |
| GBS106 | SEQ ID 8502 |
| GBS107 | SEQ ID 6026 |
| GBS108 | SEQ ID 8532 |
| GBS109 | SEQ ID 4116 |
| GBS110 | SEQ ID 6832 |
| GBS111 | SEQ ID 8842 |
| GBS112 | SEQ ID 8904 |
| GBS113 | SEQ ID 300 |
| GBS114 | SEQ ID 8968 |
| GBS115 | SEQ ID 5164 |
| GBS116 | SEQ ID 5152 |
| GBS117 | SEQ ID 8962 |
| GBS118 | SEQ ID 2508 |
| GBS119 | SEQ ID 8814 |
| GBS120 | SEQ ID 8874 |
| GBS121 | SEQ ID 3826 |
| GBS122 | SEQ ID 9006 |
| GBS123 | SEQ ID 6310 |
| GBS124 | SEQ ID 260 |
| GBS125 | SEQ ID 3872 |
| GBS126 | SEQ ID 6736 |
| GBS127 | SEQ ID 8816 |
| GBS128 | SEQ ID 752 |
| GBS129 | SEQ ID 8990 |
| GBS130 | SEQ ID 9004 |
| GBS131 | SEQ ID 6198 |
| GBS132 | SEQ ID 8730 |
| GBS133 | SEQ ID 474 |
| GBS134 | SEQ ID 9008 |
| GBS135 | SEQ ID 8882 |
| GBS136 | SEQ ID 1188 |
| GBS137 | SEQ ID 3960 |
| GBS138 | SEQ ID 9052 |
| GBS139 | SEQ ID 884 |
| GBS140 | SEQ ID 8632 |
| GBS141 | SEQ ID 1768 |
| GBS142 | SEQ ID 8600 |
| GBS143 | SEQ ID 9054 |
| GBS144 | SEQ ID 2238 |
| GBS145 | SEQ ID 8700 |
| GBS146 | SEQ ID 8696 |
| GBS147 | SEQ ID 8526 |
| GBS148 | SEQ ID 9010 |
| GBS149 | SEQ ID 8732 |
| GBS150 | SEQ ID 3736 |
| GBS151 | SEQ ID 3188 |
| GBS152 | SEQ ID 3952 |
| GBS153 | SEQ ID 3904 |
| GBS154 | SEQ ID 4024 |
| GBS155 | SEQ ID 8796 |
| GBS156 | SEQ ID 4646 |
| GBS157 | SEQ ID 4812 |
| GBS158 | SEQ ID 5504 |
| GBS159 | SEQ ID 8628 |
| GBS160 | SEQ ID 8924 |
| GBS161 | SEQ ID 8922 |
| GBS162 | SEQ ID 168 |
| GBS163 | SEQ ID 224 |
| GBS164 | SEQ ID 1102 |
| GBS165 | SEQ ID 3672 |
| GBS166 | SEQ ID 8712 |
| GBS167 | SEQ ID 4214 |
| GBS168 | SEQ ID 9016 |
| GBS169 | SEQ ID 4346 |
| GBS170 | SEQ ID 8982 |
| GBS171 | SEQ ID 6720 |
| GBS172 | SEQ ID 6704 |
| GBS173 | SEQ ID 8788 |
| GBS174 | SEQ ID 6150 |
| GBS175 | SEQ ID 62 |
| GBS176 | SEQ ID 8478 |
| GBS177 | SEQ ID 8876 |
| GBS178 | SEQ ID 6078 |
| GBS179 | SEQ ID 8848 |
| GBS180 | SEQ ID 3062 |
| GBS181 | SEQ ID 1924 |
| GBS182 | SEQ ID 3774 |
| GBS183 | SEQ ID 4796 |
| GBS184 | SEQ ID 1978 |
| GBS185 | SEQ ID 1046 |
| GBS186 | SEQ ID 8470 |
| GBS187 | SEQ ID 844 |
| GBS188 | SEQ ID 3410 |
| GBS189 | SEQ ID 6986 |
| GBS190 | SEQ ID 8842 |
| GBS191 | SEQ ID 1814 |
| GBS192 | SEQ ID 8618 |
| GBS193 | SEQ ID 2382 |
| GBS194 | SEQ ID 3912 |
| GBS195 | SEQ ID 8 |
| GBS196 | SEQ ID 4944 |
| GBS197 | SEQ ID 5486 |
| GBS198 | SEQ ID 8896 |
| GBS199 | SEQ ID 1162 |
| GBS200 | SEQ ID 8936 |
| GBS201 | SEQ ID 4550 |
| GBS202 | SEQ ID 8666 |
| GBS203 | SEQ ID 6478 |
| GBS204 | SEQ ID 1996 |
| GBS205 | SEQ ID 18 |
| GBS206 | SEQ ID 8552 |
| GBS207 | SEQ ID 3822 |
| GBS208 | SEQ ID 3916 |
| GBS209 | SEQ ID 3918 |
| GBS210 | SEQ ID 3738 |
| GBS211 | SEQ ID 4680 |
| GBS212 | SEQ ID 8750 |
| GBS213 | SEQ ID 8500 |
| GBS214 | SEQ ID 8498 |

TABLE IV-continued
COMPARISON OF GBSnnn NUMBERING AND SEQ ID NUMBER

| GBS numbering | Sequence listing |
|---|---|
| GBS215 | SEQ ID 9022 |
| GBS216 | SEQ ID 8606 |
| GBS217 | SEQ ID 9024 |
| GBS218 | SEQ ID 8652 |
| GBS219 | SEQ ID 8646 |
| GBS220 | SEQ ID 2730 |
| GBS221 | SEQ ID 9028 |
| GBS222 | SEQ ID 3842 |
| GBS223 | SEQ ID 8794 |
| GBS224 | SEQ ID 9026 |
| GBS225 | SEQ ID 8834 |
| GBS226 | SEQ ID 4966 |
| GBS227 | SEQ ID 5030 |
| GBS228 | SEQ ID 5050 |
| GBS229 | SEQ ID 9056 |
| GBS230 | SEQ ID 1296 |
| GBS231 | SEQ ID 5810 |
| GBS232 | SEQ ID 5830 |
| GBS233 | SEQ ID 4722 |
| GBS234 | SEQ ID 1106 |
| GBS235 | SEQ ID 8560 |
| GBS236 | SEQ ID 6162 |
| GBS237 | SEQ ID 8706 |
| GBS238 | SEQ ID 4246 |
| GBS239 | SEQ ID 8980 |
| GBS240 | SEQ ID 8986 |
| GBS241 | SEQ ID 9030 |
| GBS242 | SEQ ID 9032 |
| GBS243 | SEQ ID 8678 |
| GBS244 | SEQ ID 6554 |
| GBS245 | SEQ ID 8994 |
| GBS246 | SEQ ID 6864 |
| GBS247 | SEQ ID 8856 |
| GBS248 | SEQ ID 454 |
| GBS249 | SEQ ID 8620 |
| GBS250 | SEQ ID 8634 |
| GBS251 | SEQ ID 2258 |
| GBS252 | SEQ ID 8648 |
| GBS253 | SEQ ID 2526 |
| GBS254 | SEQ ID 2710 |
| GBS255 | SEQ ID 2966 |
| GBS256 | SEQ ID 3424 |
| GBS257 | SEQ ID 3550 |
| GBS258 | SEQ ID 3752 |
| GBS259 | SEQ ID 8756 |
| GBS260 | SEQ ID 4162 |
| GBS261 | SEQ ID 1530 |
| GBS262 | SEQ ID 8572 |
| GBS263 | SEQ ID 1616 |
| GBS264 | SEQ ID 8824 |
| GBS265 | SEQ ID 4554 |
| GBS266 | SEQ ID 4652 |
| GBS267 | SEQ ID 4980 |
| GBS268 | SEQ ID 5038 |
| GBS269 | SEQ ID 5534 |
| GBS270 | SEQ ID 1998 |
| GBS271 | SEQ ID 8570 |
| GBS272 | SEQ ID 22 |
| GBS273 | SEQ ID 5994 |
| GBS274 | SEQ ID 774 |
| GBS275 | SEQ ID 2308 |
| GBS276 | SEQ ID 8942 |
| GBS277 | SEQ ID 8954 |
| GBS278 | SEQ ID 8524 |
| GBS279 | SEQ ID 6292 |
| GBS280 | SEQ ID 6254 |
| GBS281 | SEQ ID 4458 |
| GBS282 | SEQ ID 4444 |
| GBS283 | SEQ ID 9034 |
| GBS284 | SEQ ID 6456 & 8974 |
| GBS285 | SEQ ID 8802 |
| GBS286 | SEQ ID 9036 |
| GBS287 | SEQ ID 5354 |
| GBS288 | SEQ ID 5374 |
| GBS289 | SEQ ID 8616 |
| GBS290 | SEQ ID 8680 |
| GBS291 | SEQ ID 8530 |
| GBS292 | SEQ ID 8998 |
| GBS293 | SEQ ID 8582 |
| GBS294 | SEQ ID 8604 |
| GBS295 | SEQ ID 2722 |
| GBS296 | SEQ ID 2658 |
| GBS297 | SEQ ID 3024 |
| GBS298 | SEQ ID 8704 |
| GBS299 | SEQ ID 3268 |
| GBS300 | SEQ ID 4170 |
| GBS301 | SEQ ID 8576 |
| GBS302 | SEQ ID 8670 |
| GBS303 | SEQ ID 8554 |
| GBS304 | SEQ ID 5846 |
| GBS305 | SEQ ID 208 |
| GBS306 | SEQ ID 212 |
| GBS307 | SEQ ID 8992 |
| GBS308 | SEQ ID 8880 |
| GBS309 | SEQ ID 3386 |
| GBS310 | SEQ ID 286 |
| GBS311 | SEQ ID 3964 |
| GBS312 | SEQ ID 4660 |
| GBS313 | SEQ ID 4090 |
| GBS314 | SEQ ID 8556 |
| GBS315 | SEQ ID 1766 |
| GBS316 | SEQ ID 2000 |
| GBS317 | SEQ ID 4210 |
| GBS318 | SEQ ID 8548 |
| GBS319 | SEQ ID 892 |
| GBS320 | SEQ ID 916 |
| GBS321 | SEQ ID 8846 |
| GBS322 | SEQ ID 8540 |
| GBS323 | SEQ ID 2102 |
| GBS324 | SEQ ID 8490 |
| GBS325 | SEQ ID 8900 |
| GBS326 | SEQ ID 8630 |
| GBS327 | SEQ ID 5856 |
| GBS328 | SEQ ID 6016 |
| GBS329 | SEQ ID 8928 |
| GBS330 | SEQ ID 8792 |
| GBS331 | SEQ ID 922 |
| GBS332 | SEQ ID 1004 |
| GBS333 | SEQ ID 1786 |
| GBS334 | SEQ ID 1784 |
| GBS335 | SEQ ID 1782 |
| GBS336 | SEQ ID 1886 |
| GBS337 | SEQ ID 2010 |
| GBS338 | SEQ ID 8638 |
| GBS339 | SEQ ID 2080 |
| GBS340 | SEQ ID 8594 & 8596 |
| GBS341 | SEQ ID 2280 |
| GBS342 | SEQ ID 2266 |
| GBS343 | SEQ ID 8644 |
| GBS344 | SEQ ID 8662 |
| GBS345 | SEQ ID 2442 |
| GBS346 | SEQ ID 2768 |
| GBS347 | SEQ ID 2766 |
| GBS348 | SEQ ID 8658 |
| GBS349 | SEQ ID 2360 |
| GBS350 | SEQ ID 8698 |
| GBS351 | SEQ ID 2970 |
| GBS352 | SEQ ID 8692 |
| GBS353 | SEQ ID 3454 |
| GBS354 | SEQ ID 8754 |
| GBS355 | SEQ ID 8752 |
| GBS356 | SEQ ID 8724 |
| GBS357 | SEQ ID 8720 |
| GBS358 | SEQ ID 3184 |
| GBS359 | SEQ ID 3948 |
| GBS360 | SEQ ID 3926 |
| GBS361 | SEQ ID 8770 |
| GBS362 | SEQ ID 8768 |
| GBS363 | SEQ ID 3816 |
| GBS364 | SEQ ID 1452 |
| GBS365 | SEQ ID 1398 |
| GBS366 | SEQ ID 8574 |

TABLE IV-continued
COMPARISON OF GBSnnn NUMBERING AND SEQ ID NUMBER

| GBS numbering | Sequence listing |
|---|---|
| GBS367 | SEQ ID 1340 |
| GBS368 | SEQ ID 1598 |
| GBS369 | SEQ ID 4822 |
| GBS370 | SEQ ID 8844 |
| GBS371 | SEQ ID 4926 |
| GBS372 | SEQ ID 4956 |
| GBS373 | SEQ ID 5062 |
| GBS374 | SEQ ID 8878 |
| GBS375 | SEQ ID 326 |
| GBS376 | SEQ ID 5380 |
| GBS377 | SEQ ID 5468 |
| GBS378 | SEQ ID 5570 |
| GBS379 | SEQ ID 8918 |
| GBS380 | SEQ ID 156 |
| GBS381 | SEQ ID 8934 |
| GBS382 | SEQ ID 8610 |
| GBS383 | SEQ ID 4738 |
| GBS384 | SEQ ID 8836 |
| GBS385 | SEQ ID 1094 |
| GBS386 | SEQ ID 9038 |
| GBS387 | SEQ ID 8558 |
| GBS388 | SEQ ID 9040 |
| GBS389 | SEQ ID 8516 |
| GBS390 | SEQ ID 8952 |
| GBS391 | SEQ ID 8522 |
| GBS392 | SEQ ID 6220 |
| GBS393 | SEQ ID 8966 |
| GBS394 | SEQ ID 8960 |
| GBS395 | SEQ ID 6276 |
| GBS396 | SEQ ID 8468 |
| GBS397 | SEQ ID 6262 |
| GBS398 | SEQ ID 8806 |
| GBS399 | SEQ ID 1960 |
| GBS400 | SEQ ID 3154 |
| GBS401 | SEQ ID 3170 |
| GBS402 | SEQ ID 4236 |
| GBS403 | SEQ ID 8798 |
| GBS404 | SEQ ID 8800 |
| GBS405 | SEQ ID 8508 |
| GBS406 | SEQ ID 8506 |
| GBS407 | SEQ ID 6484 |
| GBS408 | SEQ ID 9042 |
| GBS409 | SEQ ID 6678 |
| GBS410 | SEQ ID 4064 |
| GBS411 | SEQ ID 9044 |
| GBS412 | SEQ ID 9046 |
| GBS413 | SEQ ID 272 |
| GBS414 | SEQ ID 8946 |
| GBS415 | SEQ ID 8944 |
| GBS416 | SEQ ID 6044 |
| GBS417 | SEQ ID 1874 |
| GBS418 | SEQ ID 5146 |
| GBS419 | SEQ ID 2638 |
| GBS420 | SEQ ID 2104 |
| GBS421 | SEQ ID 2108 |
| GBS422 | SEQ ID 714 |
| GBS423 | SEQ ID 6884 |
| GBS424 | SEQ ID 4874 |
| GBS425 | SEQ ID 3978 |
| GBS426 | SEQ ID 3976 |
| GBS427 | SEQ ID 6958 |
| GBS428 | SEQ ID 3398 |
| GBS429 | SEQ ID 3402 |
| GBS430 | SEQ ID 8840 |
| GBS431 | SEQ ID 8902 |
| GBS432 | SEQ ID 8534 |
| GBS433 | SEQ ID 2558 |
| GBS434 | SEQ ID 8590 |
| GBS435 | SEQ ID 484 |
| GBS436 | SEQ ID 8472 |
| GBS437 | SEQ ID 466 |
| GBS438 | SEQ ID 362 |
| GBS439 | SEQ ID 900 |
| GBS440 | SEQ ID 8536 |
| GBS441 | SEQ ID 936 |
| GBS442 | SEQ ID 940 |
| GBS443 | SEQ ID 998 |
| GBS444 | SEQ ID 1776 |
| GBS445 | SEQ ID 8634 |
| GBS446 | SEQ ID 2048 |
| GBS447 | SEQ ID 1654 |
| GBS448 | SEQ ID 8592 |
| GBS449 | SEQ ID 1634 |
| GBS450 | SEQ ID 1630 |
| GBS451 | SEQ ID 2098 |
| GBS452 | SEQ ID 2062 |
| GBS453 | SEQ ID 8636 |
| GBS454 | SEQ ID 1734 |
| GBS455 | SEQ ID 1690 |
| GBS456 | SEQ ID 1684 |
| GBS457 | SEQ ID 8656 |
| GBS458 | SEQ ID 8650 |
| GBS459 | SEQ ID 2152 |
| GBS460 | SEQ ID 2148 |
| GBS461 | SEQ ID 2394 |
| GBS462 | SEQ ID 2778 |
| GBS463 | SEQ ID 8688 |
| GBS464 | SEQ ID 8684 |
| GBS465 | SEQ ID 8682 |
| GBS466 | SEQ ID 2694 |
| GBS467 | SEQ ID 2350 |
| GBS468 | SEQ ID 8660 |
| GBS469 | SEQ ID 2998 |
| GBS470 | SEQ ID 2988 |
| GBS471 | SEQ ID 2924 |
| GBS472 | SEQ ID 2910 |
| GBS473 | SEQ ID 2882 |
| GBS474 | SEQ ID 2878 |
| GBS475 | SEQ ID 2856 |
| GBS476 | SEQ ID 8690 |
| GBS477 | SEQ ID 3112 |
| GBS478 | SEQ ID 3432 |
| GBS479 | SEQ ID 3460 |
| GBS480 | SEQ ID 3504 |
| GBS481 | SEQ ID 8734 |
| GBS482 | SEQ ID 8740 |
| GBS483 | SEQ ID 3606 |
| GBS484 | SEQ ID 3562 |
| GBS485 | SEQ ID 3552 |
| GBS486 | SEQ ID 3762 |
| GBS487 | SEQ ID 3756 |
| GBS488 | SEQ ID 3732 |
| GBS489 | SEQ ID 3730 |
| GBS490 | SEQ ID 3704 |
| GBS491 | SEQ ID 3698 |
| GBS492 | SEQ ID 3252 |
| GBS493 | SEQ ID 3244 |
| GBS494 | SEQ ID 3238 |
| GBS495 | SEQ ID 8722 |
| GBS496 | SEQ ID 8716 |
| GBS497 | SEQ ID 3876 |
| GBS498 | SEQ ID 3858 |
| GBS499 | SEQ ID 8758 |
| GBS500 | SEQ ID 4022 |
| GBS501 | SEQ ID 4106 |
| GBS502 | SEQ ID 1406 |
| GBS503 | SEQ ID 8580 |
| GBS504 | SEQ ID 4578 |
| GBS505 | SEQ ID 4566 |
| GBS506 | SEQ ID 8832 |
| GBS507 | SEQ ID 8830 |
| GBS508 | SEQ ID 4644 |
| GBS509 | SEQ ID 8828 |
| GBS510 | SEQ ID 8826 |
| GBS511 | SEQ ID 4892 |
| GBS512 | SEQ ID 4970 |
| GBS513 | SEQ ID 4974 |
| GBS514 | SEQ ID 8862 |
| GBS515 | SEQ ID 8864 |
| GBS516 | SEQ ID 8866 |
| GBS517 | SEQ ID 8868 |
| GBS518 | SEQ ID 9012 |

TABLE IV-continued

COMPARISON OF GBSnnn NUMBERING AND SEQ ID NUMBER

| GBS numbering | Sequence listing |
|---|---|
| GBS519 | SEQ ID 5068 |
| GBS520 | SEQ ID 8870 |
| GBS521 | SEQ ID 5228 |
| GBS522 | SEQ ID 322 |
| GBS523 | SEQ ID 8492 |
| GBS524 | SEQ ID 8894 |
| GBS525 | SEQ ID 5430 |
| GBS526 | SEQ ID 5414 |
| GBS527 | SEQ ID 5524 |
| GBS528 | SEQ ID 8898 |
| GBS529 | SEQ ID 5670 |
| GBS530 | SEQ ID 5630 |
| GBS531 | SEQ ID 5588 |
| GBS532 | SEQ ID 1324 |
| GBS533 | SEQ ID 8914 |
| GBS534 | SEQ ID 8550 |
| GBS535 | SEQ ID 8568 |
| GBS536 | SEQ ID 1288 |
| GBS537 | SEQ ID 5798 |
| GBS538 | SEQ ID 8920 |
| GBS539 | SEQ ID 158 |
| GBS540 | SEQ ID 8482 |
| GBS541 | SEQ ID 184 |
| GBS542 | SEQ ID 9048 |
| GBS543 | SEQ ID 8932 |
| GBS544 | SEQ ID 5880 |
| GBS545 | SEQ ID 44 |
| GBS546 | SEQ ID 9014 |
| GBS547 | SEQ ID 12 |
| GBS548 | SEQ ID 8614 |
| GBS549 | SEQ ID 8612 |
| GBS550 | SEQ ID 4720 |
| GBS551 | SEQ ID 4710 |
| GBS552 | SEQ ID 1086 |
| GBS553 | SEQ ID 1088 |
| GBS554 | SEQ ID 1138 |
| GBS555 | SEQ ID 8748 |
| GBS556 | SEQ ID 5968 |
| GBS557 | SEQ ID 774 |
| GBS558 | SEQ ID 1192 |
| GBS559 | SEQ ID 1196 |
| GBS560 | SEQ ID 1268 |
| GBS561 | SEQ ID 8518 |
| GBS562 | SEQ ID 8676 |
| GBS563 | SEQ ID 2296 |
| GBS564 | SEQ ID 2300 |
| GBS565 | SEQ ID 8950 |
| GBS566 | SEQ ID 694 |
| GBS567 | SEQ ID 680 |
| GBS568 | SEQ ID 6300 |
| GBS569 | SEQ ID 8956 |
| GBS570 | SEQ ID 8972 |
| GBS571 | SEQ ID 8970 |
| GBS572 | SEQ ID 3300 |
| GBS573 | SEQ ID 3304 |
| GBS574 | SEQ ID 8726 |
| GBS575 | SEQ ID 8810 |
| GBS576 | SEQ ID 4418 |
| GBS577 | SEQ ID 8808 |
| GBS578 | SEQ ID 4382 |
| GBS579 | SEQ ID 4378 |
| GBS580 | SEQ ID 1932 |
| GBS581 | SEQ ID 8622 |
| GBS582 | SEQ ID 8624 |
| GBS583 | SEQ ID 1962 |
| GBS584 | SEQ ID 8708 |
| GBS585 | SEQ ID 8672 |
| GBS586 | SEQ ID 6444 |
| GBS587 | SEQ ID 8976 |
| GBS588 | SEQ ID 8804 |
| GBS589 | SEQ ID 8514 |
| GBS590 | SEQ ID 8510 |
| GBS591 | SEQ ID 630 |
| GBS592 | SEQ ID 8504 |
| GBS593 | SEQ ID 514 |
| GBS594 | SEQ ID 8978 |
| GBS595 | SEQ ID 6738 |
| GBS596 | SEQ ID 6712 |
| GBS597 | SEQ ID 6686 |
| GBS598 | SEQ ID 6674 |
| GBS599 | SEQ ID 6662 |
| GBS600 | SEQ ID 8988 |
| GBS601 | SEQ ID 8578 |
| GBS602 | SEQ ID 8948 |
| GBS603 | SEQ ID 6132 |
| GBS604 | SEQ ID 5282 |
| GBS605 | SEQ ID 5302 |
| GBS606 | SEQ ID 8884 |
| GBS607 | SEQ ID 5314 |
| GBS608 | SEQ ID 8886 |
| GBS609 | SEQ ID 8888 |
| GBS610 | SEQ ID 8890 |
| GBS611 | SEQ ID 6028 |
| GBS612 | SEQ ID 8474 |
| GBS613 | SEQ ID 5092 |
| GBS614 | SEQ ID 8872 |
| GBS615 | SEQ ID 6052 |
| GBS616 | SEQ ID 8940 |
| GBS617 | SEQ ID 1824 |
| GBS618 | SEQ ID 6600 |
| GBS619 | SEQ ID 6608 |
| GBS620 | SEQ ID 6620 |
| GBS621 | SEQ ID 864 |
| GBS622 | SEQ ID 8640 |
| GBS623 | SEQ ID 8996 |
| GBS624 | SEQ ID 9050 |
| GBS625 | SEQ ID 2812 |
| GBS626 | SEQ ID 8858 |
| GBS627 | SEQ ID 8852 |
| GBS628 | SEQ ID 8784 |
| GBS629 | SEQ ID 6950 |
| GBS630 | SEQ ID 4502 |
| GBS631 | SEQ ID 4492 |
| GBS632 | SEQ ID 4488 |
| GBS633 | SEQ ID 8728 |
| GBS634 | SEQ ID 3066 |
| GBS635 | SEQ ID 8838 |
| GBS636 | SEQ ID 4772 |
| GBS637 | SEQ ID 8626 |
| GBS638 | SEQ ID 8984 |
| GBS639 | SEQ ID 8546 |
| GBS640 | SEQ ID 6780 |
| GBS641 | SEQ ID 900 |
| GBS642 | 1312 |
| GBS643 | 1772 |
| GBS644 | 1956 |
| GBS645 | 2726 |
| GBS646 | 3348 |
| GBS647 | 3770 |
| GBS648 | 4934 |
| GBS649 | 5076 |
| GBS650 | 5446 |
| GBS651 | 5602 |
| GBS652 | 5610 |
| GBS653 | 5760 |
| GBS654 | 6096 |
| GBS655 | 6656 |
| GBS656 | 9324 |
| GBS657 | 10782 |
| GBS658 | 8802 |
| GBS659 | 9344 |
| GBS660 | 9410 |
| GBS661 | 9428 |
| GBS662 | 9286 |
| GBS663 | 9294 |
| GBS664 | 9034 |
| GBS665 | 10546 |
| GBS666 | 10610 |
| GBS667 | 9052 |
| GBS668 | 9036 |
| GBS669 | 9010 |
| GBS670 | 10730 |

TABLE IV-continued

COMPARISON OF GBSnnn NUMBERING AND SEQ ID NUMBER

| GBS numbering | Sequence listing |
| --- | --- |
| GBS671 | 9020 |
| GBS672 | 9052 |
| GBS673 | 9036 |
| GBS674 | 9034 |
| GBS675 | 10634 |
| GBS676 | 10692 |
| GBS677 | 10746 |
| GBS678 | 9330 |
| GBS679 | 9404 |
| GBS680 | 6668 |
| GBS681 | 4264 |
| GBS682 | 6762 |
| GBS683 | 9290 |
| GBS684 | 9614 |
| GBS685 | 10454 |
| GBS686 | 2774 |
| GBS687 | 4620 |
| GBS688 | 10224 |

TABLE V

NUCLEOTIDES DELETED IN EXPRESSION OF GBSnnn PROTEINS

| GBS | Deleted nucleotides |
| --- | --- |
| 11d | 1-153 |
| 31d | 1-129 |
| 64d | 1-165 |
| 68d | 2029-2796 |
| 70d | 1-402 |
| 74d | 1-975 |
| 79d | 1-201 |
| 105dN | 2689-4119 |
| 105dC | 1-2688 |
| 105d | 1-2688 |
| 109d | 1-120 |
| 130d | 1-518 |
| 170d | 1-111 |
| 182d | 1596-1674 |
| 195C | 1-1710 |
| 195N | 1711-3243 |
| 209d | 757-912 |
| 210d | 1-99 & 777-879 |
| 220d | 1-120 |
| 231d | 1-54 |
| 235d | 1-270 |
| 246d | 1-75 |
| 248d | 1-591 |
| 272d | 1-531 |
| 277d | 1-318 |
| 281d | 1-54 |
| 287d | 1-108 |
| 288d | 1-72 |
| 293C | 1-1229 |
| 293N | 1230-2379 |
| 317N | 1729-4107 |
| 317C | 1-2379 |
| 326N | 1707-2652 |
| 326dN | 2326-3927 |
| 327N | 3034-6831 |
| 327C | 1-3033 |
| 333d | 1-150 |
| 339d | 1-111 |
| 352d | 1-158 |
| 362N | 1707-2652 |
| 362C | 1-1706 |
| 397d | 1-348 |
| 399d | 1-111 |
| 407d | 1174-1473 |
| 409d | 1-297 |
| 424d | 1327-1671 |

TABLE VI

PREDICTED FUNCTIONS FOR CERTAIN SEQ IDs

| SEQ ID | Function |
| --- | --- |
| 6 | manganese ABC transporter, ATP-binding protein (psaB) |
| 12 | iron (chelated) ABC transporter, permease protein (psaC) |
| 18 | peptidyl-prolyl cis-trans isomerase, cyclophilin-type |
| 26 | chorismate binding enzyme (pabB) |
| 30 | probable transposase (insertion sequence IS861) |
| 42 | peptidase, M20/M25/M40 family |
| 44 | drug transporter |
| 50 | ribosomal protein L11 (rplK) |
| 54 | ribosomal protein L1 (rplA) |
| 62 | peptide ABC transporter, permease protein |
| 66 | peptide ABC transporter, permease protein |
| 78 | uridylate kinase (pyrH) |
| 84 | ribosome recycling factor (frr) |
| 104 | PhoH family protein (phoH) |
| 110 | MutT/nudix family protein superfamily |
| 116 | tetracenomycin polyketide synthesis O-methyltransferase TcmP |
| 134 | phosphopantetheine adenylyltransferase (coaD) |
| 140 | PDZ domain protein |
| 144 | 5-nucleotidase family protein |
| 156 | VanZF-related protein |
| 158 | ABC transporter, ATP-binding/permease protein |
| 162 | ABC transporter, ATP-binding/permease protein |
| 168 | BioY family protein |
| 180 | acetyl-CoA acetyltransferase |
| 188 | endonuclease III (nth) |
| 196 | glucokinase (gki) |
| 200 | rhodanese family protein |
| 204 | elongation factor Tu family protein (typA) |
| 212 | UDP-N-acetylglucosamine-N-acetylmuramyl-(pentapeptide) pyrophosphoryl- |
| 216 | cell division protein DivIB |

TABLE VI-continued

PREDICTED FUNCTIONS FOR CERTAIN SEQ IDs

| SEQ ID | Function |
|---|---|
| 220 | cell division protein FtsA (ftsA) |
| 224 | cell division protein FtsZ (ftsZ) |
| 236 | ylmH protein (ylmH) |
| 240 | cell division protein DivIVA (divIVA) |
| 244 | isoleucyl-tRNA synthetase (ileS) |
| 252 | MutT/nudix family protein |
| 256 | ATP-dependent Clp protease, ATP-binding subunit ClpE (clpE) |
| 268 | methylenetetrahydrofolate dehydrogenase/methenyltetrahydrofolate cycloh |
| 274 | exodeoxyribonuclease VII, large subunit (xseA) |
| 278 | exodeoxyribonuclease VII, small subunit (xseB) |
| 282 | geranyltranstransferase (ispA) |
| 286 | hemolysin A |
| 290 | transcriptional repressor |
| 296 | DNA repair protein RecN (recN) |
| 300 | degV family protein (degV) |
| 322 | peptide ABC transporter, permease protein (oppC) |
| 326 | peptide ABC transporter, ATP-binding protein (oppD) |
| 328 | peptide ABC transporter, ATP-binding protein (oppF) |
| 348 | 4-diphosphocytidyl-2C-methyl-D-erythritol kinase (ispE) |
| 352 | adc operon repressor AdcR (adcR) |
| 356 | zinc ABC transporter, ATP-binding protein (adcC) |
| 370 | tyrosyl-tRNA synthetase (tyrS) |
| 374 | penicillin-binding protein 1B (pbp1B) |
| 378 | DNA-directed RNA polymerase, beta subunit (rpoB) |
| 382 | dna-directed ma polymerase beta' chain |
| 390 | competence protein CglA (cglA) |
| 406 | acetate kinase (ackA) |
| 410 | transcriptional regulator |
| 418 | pyrroline-5-carboxylate reductase (proC) |
| 422 | glutamyl-aminopeptidase (pepA) |
| 432 | thioredoxin family protein |
| 436 | tRNA binding domain protein (pheT) |
| 440 | methyltransferase |
| 442 | single-strand DNA-binding protein, authentic point mutation (ssbB) |
| 454 | GAF domain protein (lytS) |
| 466 | lrgB protein (lrgB) |
| 474 | oligopeptide ABC transporter, permease protein |
| 476 | peptide ABC transporter, ATP-binding protein |
| 480 | peptide ABC transporter, ATP-binding protein (oppF) |
| 484 | PTS system, IIABC components (treB) |
| 488 | alpha amylase family protein (treC) |
| 494 | transcriptional regulator, BglG family |
| 506 | transcriptional regulator, BglG family |
| 508 | PTS system, IIB component |
| 514 | PTS system, IIC component |
| 518 | transketolase, N-terminal subunit (tktA) |
| 528 | ribosomal protein S15 (rpsO) |
| 546 | cysteinyl-tRNA synthetase (cysS) |
| 554 | RNA methyltransferase, TrmH family, group 3 |
| 562 | DegV family protein (degV) |
| 572 | ribosomal protein S9 (rpsI) |
| 576 | integrase, phage family |
| 580 | transcriptional regulator |
| 596 | recombination protein |
| 626 | transcriptional regulator MutR |
| 630 | transporter |
| 640 | amino acid ABC transporter, permease protein (opuBB) |
| 642 | glycine betaine/L-proline transport ATP binding subunit (proV) |
| 654 | lectin, alpha subunit precursor |
| 662 | transcriptional regulator |
| 664 | acetyltransferase, GNAT family |
| 666 | acetyltransferase, GNAT family (rimJ) |
| 670 | acetyltransferase, GNAT family |
| 676 | transcriptional regulator, tetR family domain protein |
| 680 | ABC transporter efflux protein, DrrB family |
| 690 | IS1381, transposase OrfA/OrfB, truncation |
| 714 | magnesium transporter, CorA family |
| 718 | oxidoreductase, Gfo/Idh/MocA family |
| 722 | valyl-tRNA synthetase (valS) |
| 730 | acetyltransferase, GNAT family |
| 746 | methyltransferase |
| 750 | bacteriophage L54a, integrase |
| 754 | DNA-damage-inducible protein J |
| 774 | cation efflux system protein |
| 778 | oxidoreductase, aldo/keto reductase family |
| 784 | alcohol dehydrogenase, zinc-containing |

TABLE VI-continued

PREDICTED FUNCTIONS FOR CERTAIN SEQ IDs

| SEQ ID | Function |
|---|---|
| 790 | 3-oxoadipate enol-lactone hydrolase/4-carboxymuconolactone decarboxylas |
| 804 | ribonucleoside-diphosphate reductase, alpha subunit (nrdE) |
| 808 | nrdI protein (nrdI) |
| 812 | Ribonucleotide reductases |
| 824 | elaA protein (elaA) |
| 828 | RNA methyltransferase, TrmA family |
| 832 | RecX family protein |
| 840 | -identity (jag) |
| 844 | membrane protein, 60 kDa (yidC) |
| 856 | UTP-glucose-1-phosphate uridylyltransferase (galU) |
| 864 | rhomboid family protein |
| 884 | MORN motif family |
| 892 | transcriptional regulator |
| 896 | adenylosuccinate lyase (purB) |
| 908 | phosphoribosylaminoimidazole carboxylase, catalytic subunit (purE) |
| 912 | phosphoribosylamine--glycine ligase (purD) |
| 916 | phosphosugar-binding transcriptional regulator |
| 920 | acetyl xylan esterase |
| 922 | ROK family protein (gki) |
| 926 | N-acetylneuraminate lyase (nanA) |
| 936 | sugar ABC transporter, permease protein |
| 940 | sugar ABC transporter, permease protein (msmF) |
| 952 | LysM domain protein, authentic frameshift |
| 956 | zoocin A endopeptidase |
| 958 | phosphoribosylaminoimidazolecarboxamide formyltransferase/IMP cyclohydr |
| 962 | acetyltransferase, GNAT family family |
| 964 | phosphoribosylglycinamide formyltransferase (purN) |
| 968 | phosphoribosylformylglycinamidine cyclo-ligase (purM) |
| 972 | amidophosphoribosyltransferase (purF) |
| 980 | phosphoribosylformylglycinamidine synthase |
| 984 | phosphoribosylaminoimidazole-succinocarboxamide synthase (purC) |
| 1042 | oligoendopeptidase F (pepF) |
| 1060 | ebsC protein |
| 1068 | hydrolase, haloacid dehalogenase-like family |
| 1076 | riboflavin synthase, beta subunit (ribH) |
| 1082 | riboflavin biosynthesis protein RibD (ribD) |
| 1086 | Mn2+/Fe2+ transporter, NRAMP family |
| 1094 | peptidase, U32 family |
| 1116 | HPr(Ser) kinase/phosphatase (hprK) |
| 1130 | oxidoreductase |
| 1148 | signal recognition particle-docking protein FtsY (ftsY) |
| 1152 | Cof family protein |
| 1156 | Cof family protein |
| 1172 | vicX protein (vicX) |
| 1176 | sensory box sensor histidine kinase (vicK) |
| 1180 | DNA-binding response regulator (vicR) |
| 1184 | amino acid ABC transporter, ATP-binding protein |
| 1188 | amino acid ABC transporter, amino acid-binding protein (fliY) |
| 1192 | amino acid ABC transporter, permease protein |
| 1196 | amino acid ABC transporter, permease protein |
| 1208 | DNA-binding response regulator (vicR) |
| 1210 | threonyl-tRNA synthetase (thrS) |
| 1214 | glycosyl transferase, group 1 |
| 1218 | glycosyl transferase, group 1 (cpoA) |
| 1222 | alpha-amylase (amy) |
| 1230 | proline dipeptidase (pepQ) |
| 1238 | haloacid dehalogenase-like hydrolase superfamily |
| 1244 | mannonate dehydratase (uxuA) |
| 1248 | glucuronate isomerase |
| 1254 | transcriptional regulator, GntR family |
| 1268 | sodiumgalactoside symporter family protein |
| 1270 | D-isomer specific 2-hydroxyacid dehydrogenase family protein |
| 1282 | transcriptional regulator, LysR family |
| 1290 | ABC transporter, ATP-binding protein (potA) |
| 1296 | DedA family protein |
| 1308 | MutT/nudix family protein family |
| 1310 | phosphoserine phosphatase SerB (serB) |
| 1312 | septation ring formation regulator EzrA |
| 1320 | hydrolase, haloacid dehalogenase-like family (gph) |
| 1340 | sensor histidine kinase (vncS) |
| 1348 | transmembrane protein Vexp3 (vex3) |
| 1352 | ABC transporter, ATP-binding protein (vex2) |
| 1358 | transmembrane protein Vexp1 (vex1) |
| 1366 | transposase |
| 1374 | integrase, phage family |
| 1390 | holin 2 |

TABLE VI-continued

PREDICTED FUNCTIONS FOR CERTAIN SEQ IDs

| SEQ ID | Function |
|---|---|
| 1398 | minor structural protein |
| 1400 | host specificity protein |
| 1404 | minor structural protein |
| 1406 | PblA |
| 1486 | homeobox protein drg11 |
| 1488 | reverse transcriptase |
| 1496 | p22 erf-like protein |
| 1498 | gp157 |
| 1500 | tropomyosin 2 |
| 1512 | gp49 homologous |
| 1526 | transcriptional regulator-related protein |
| 1566 | chorismate mutase |
| 1572 | PTS system component |
| 1576 | PTS system, IIB component |
| 1580 | PTS system IIA component |
| 1584 | lactose phosphotransferase system repressor (lacR) |
| 1594 | adhesion lipoprotein (lmb) |
| 1602 | GTP pyrophosphokinase (relA) |
| 1606 | 2',3'-cyclic-nucleotide 2'-phosphodiesterase (cpdB) |
| 1616 | iron ABC transporter, iron-binding protein |
| 1620 | DNA-binding response regulator |
| 1630 | PTS system component |
| 1634 | PTS system component (manM) |
| 1638 | PTS system component (manL) |
| 1642 | PTS system component |
| 1658 | response regulator BlpR (blpR) |
| 1676 | phosphate transport system regulatory protein PhoU |
| 1680 | phosphate ABC transporter, ATP-binding protein (pstB) |
| 1684 | phosphate ABC transporter, permease protein (pstA) |
| 1690 | phosphate ABC transporter, permease protein (pstC) |
| 1694 | probable hemolysin precursor |
| 1704 | ribosomal protein L11 methyltransferase (prmA) |
| 1710 | transcriptional regulator, MerR family (skgA) |
| 1714 | acetyltransferase, GNAT family |
| 1716 | MutT/nudix family protein |
| 1722 | spermidine N1-acetyltransferase |
| 1726 | ATPase, AAA family |
| 1736 | ABC transporter domain protein |
| 1738 | Helix-turn-helix domain protein |
| 1748 | integrase, phage family |
| 1756 | Helix-turn-helix domain protein |
| 1762 | bacteriophage L54a, integrase |
| 1768 | LPXTG-motif cell wall anchor domain protein |
| 1776 | membrane protein |
| 1778 | conjugal transfer protein |
| 1780 | IS1381, transposase OrfA/OrfB, truncation |
| 1802 | transcriptional regulator (rstR-1) |
| 1806 | transcriptional regulator |
| 1808 | FtsK/SpoIIIE family protein |
| 1814 | aggregation substance |
| 1818 | mercuric reductase |
| 1822 | transcriptional regulator, MerR family |
| 1824 | Mn2+/Fe2+ transporter, NRAMP family |
| 1830 | ABC transporter, ATP-binding protein (epiF) |
| 1848 | Helix-turn-helix domain protein |
| 1850 | type 2 phosphatidic acid phosphatase(PAP2), family |
| 1858 | Abortive infection protein family |
| 1868 | aminotransferase, class-V |
| 1874 | glutathione reductase (gor) |
| 1882 | chorismate synthase (aroC) |
| 1886 | 3-dehydroquinate synthase (aroB) |
| 1900 | sulfatase family protein |
| 1914 | ABC transporter, ATP-binding protein |
| 1920 | smf protein (Smffamily) |
| 1924 | transferrin receptor |
| 1928 | iron compound ABC transporter, ATP-binding protein |
| 1932 | iron compound ABC transporter, permease protein |
| 1942 | acetyltransferase, CysE/LacA/LpxA/NodL family |
| 1952 | GTP-binding protein |
| 1958 | carbon starvation protein A |
| 1960 | response regulator (lytR) |
| 1962 | GAF domain protein (lytS) |
| 2000 | extracellular protein |
| 2004 | diarrheal toxin (yukA) |
| 2024 | carbamoyl-phosphate synthase, large subunit (carB) |
| 2028 | carbamoyl-phosphate synthase, small subunit (carA) |

TABLE VI-continued

PREDICTED FUNCTIONS FOR CERTAIN SEQ IDs

| SEQ ID | Function |
|---|---|
| 2032 | aspartate carbamoyltransferase (pyrB) |
| 2036 | dihydroorotase, multifunctional complex type (pyrC) |
| 2040 | orotate phosphoribosyltransferase (pyrE) |
| 2048 | membrane protein |
| 2062 | phosphate ABC transporter, permease protein (pstA-2) |
| 2064 | phosphate ABC transporter, ATP-binding protein (pstB) |
| 2070 | phosphate transport system regulatory protein PhoU |
| 2072 | aminopeptidase N (pepN) |
| 2076 | DNA-binding response regulator (arlR) |
| 2080 | sensor histidine kinase (arlS) |
| 2088 | signal recognition particle protein (ffh) |
| 2102 | peptide ABC transporter, peptide-binding protein |
| 2104 | integrase/recombinase, phage integrase family |
| 2108 | sensor histidine kinase |
| 2112 | DNA-binding response regulator (vicR) |
| 2118 | ABC transporter, ATP-binding protein |
| 2122 | nisin-resistance protein |
| 2130 | lipoprotein |
| 2136 | gid protein (gid) |
| 2140 | transcriptional regulator, GntR family |
| 2142 | GMP synthase (guaA) |
| 2152 | branched-chain amino acid ABC transporter, permease protein (livM) |
| 2154 | branched-chain amino acid ABC transporter, ATP-binding protein (livG) |
| 2156 | branched-chain amino acid ABC transporter, ATP-binding protein (livF) |
| 2160 | acetoin utilization protein AcuB |
| 2174 | DNA polymerase III, delta prime subunit (holB) |
| 2186 | copper homeostasis protein (cutC) |
| 2190 | phosphoserine aminotransferase (serC) |
| 2202 | methylated-DNA--protein-cysteine S-methyltransferase (ogt) |
| 2208 | exodeoxyribonuclease III (xth) |
| 2214 | PTS system, IIC component |
| 2224 | tellurite resistance protein TehB (tehB) |
| 2246 | icaA protein |
| 2250 | acetyltransferase, GNAT family |
| 2258 | oxidoreductase, short chain dehydrogenase/reductase family (fabG) |
| 2266 | oxidoreductase, Gfo/Idh/MocA family family |
| 2268 | glyoxalase family protein |
| 2272 | UDP-N-acetylglucosamine pyrophosphorylase (glmU) |
| 2276 | MutT/nudix family protein |
| 2284 | 5-methylthioadenosine/S-adenosylhomocysteine nucleosidase (mtf) |
| 2296 | phosphatidate cytidylyltransferase (cdsA) |
| 2300 | membrane-associated zinc metalloprotease |
| 2308 | autolysin (flgJ) |
| 2312 | DNA polymerase III, alpha subunit, Gram-positive type |
| 2320 | nitroreductase family protein superfamily |
| 2326 | 4-hydroxy-2-oxoglutarate aldolase/2-deydro-3-deoxyphosphogluconate aldo |
| 2328 | carbohydrate kinase, PfkB family |
| 2336 | oxidoreductase, short chain dehydrogenase/reductase family (fabG) |
| 2338 | PTS system, IIA component (manL) |
| 2342 | glucuronyl hydrolase |
| 2346 | PTS system, IIB component (manL) |
| 2350 | PTS system, IIC component (manM) |
| 2364 | sugar binding transcriptional regulator RegR (regR) |
| 2368 | polypeptide deformylase (def) |
| 2380 | oxidoreductase, Gfo/Idh/MocA family |
| 2382 | endopeptidase O (pepO) |
| 2394 | Na+/H+ antiporter |
| 2404 | transcriptional regulator |
| 2410 | replication initiation protein RepRC |
| 2412 | bacteriophage L54a, antirepressor |
| 2416 | e11 |
| 2422 | replicative DNA helicase (dnaB) |
| 2432 | GTP-binding protein |
| 2440 | arpR protein |
| 2444 | gene 17 protein |
| 2458 | integrase/recombinase, phage integrase family |
| 2468 | bacteriophage L54a, phage D3 terminase |
| 2472 | protease |
| 2500 | PblB |
| 2504 | sensor histidine kinase |
| 2514 | N-acetylmuramoyl-L-alanine amidase |
| 2518 | KH domain protein |
| 2522 | ribosomal protein S16 (rpsP) |
| 2526 | permease |
| 2528 | ABC transporter, ATP-binding protein |
| 2538 | carbamoyl-phosphate synthase, large subunit |

TABLE VI-continued

PREDICTED FUNCTIONS FOR CERTAIN SEQ IDs

| SEQ ID | Function |
|---|---|
| 2540 | carbamoyl-phosphate synthase, small subunit (carA) |
| 2550 | transcriptional regulator, LysR family |
| 2554 | ribosomal protein L27 (rpmA) |
| 2562 | ribosomal protein L21 (rplU) |
| 2572 | glycerophosphoryl diester phosphodiesterase |
| 2582 | nitroreductase family protein |
| 2586 | dipeptidase (pepV) |
| 2614 | GTP-binding protein HflX (hflX) |
| 2618 | galactose-1-phosphate uridylyltransferase (galT) |
| 2626 | oxidoreductase, short chain dehydrogenase/reductase family |
| 2630 | single-stranded-DNA-specific exonuclease RecJ (recJ) |
| 2638 | adenine phosphoribosyltransferase (apt) |
| 2646 | Bcl-2 family protein |
| 2654 | oxidoreductase, DadA family protein |
| 2658 | glucose-1-phosphate thymidylyltransferase (rfbA) |
| 2664 | dTDP-4-dehydrorhamnose 3,5-epimerase (rfbC) |
| 2682 | hyaluronidase |
| 2686 | mutator MutT protein (mutX) |
| 2690 | MutT/nudix family protein |
| 2694 | membrane protein |
| 2702 | acetolactate synthase (ilvK) |
| 2706 | adherence and virulence protein A (pavA) |
| 2714 | ABC transporter, permease protein (rbsC) |
| 2722 | metallo-beta-lactamase superfamily protein |
| 2734 | ribose 5-phosphate isomerase (rpiA) |
| 2738 | phosphopentomutase (deoB) |
| 2742 | purine nucleoside phosphorylase, family 2 (deoD) |
| 2750 | purine nucleoside phosphorylase (deoD) |
| 2762 | capsular polysaccharide biosynthesis protein Cps4A (cps4A) |
| 2768 | cpsb protein |
| 2770 | cpsc protein |
| 2772 | CpsE |
| 2774 | CpsF |
| 2776 | CpsVG |
| 2778 | CpsVH |
| 2780 | CpsVM |
| 2782 | CpsVN |
| 2784 | glycosyl transferase domain protein |
| 2786 | glycosyl transferase, family 2/glycosyl transferase family 8 |
| 2790 | CpsVK |
| 2794 | CpsL |
| 2796 | neuB protein |
| 2798 | UDP-N-acetylglucosamine 2-epimerase |
| 2800 | hexapeptide transferase family protein |
| 2802 | NeuA |
| 2808 | uracil-DNA glycosylase (ung) |
| 2818 | DNA topoisomerase IV, B subunit (parE) |
| 2822 | DNA topoisomerase IV, A subunit (parC) |
| 2826 | branched-chain amino acid aminotransferase (ilvE) |
| 2842 | glycerol kinase (glpK) |
| 2848 | aerobic glycerol-3-phosphate dehydrogenase (glpD) |
| 2874 | ABC transporter, ATP-binding protein |
| 2882 | PTS system component (bglP) |
| 2886 | glutamate 5-kinase (proB) |
| 2890 | gamma-glutamyl phosphate reductase (proA) |
| 2898 | cell division protein FtsL (ftsL) |
| 2904 | penicillin-binding protein 2X (pbpX) |
| 2910 | phospho-N-acetylmuramoyl-pentapeptide-transferase (mraY) |
| 2914 | ATP-dependent RNA helicase, DEAD/DEAH box family (deaD) |
| 2918 | ABC transporter, substrate-binding protein |
| 2924 | amino acid ABC transporter, permease protein |
| 2928 | amino acid ABC transporter, ATP-binding protein |
| 2932 | thioredoxin reductase (trxB) |
| 2940 | NAD+ synthetase (nadE) |
| 2944 | aminopeptidase C (pepC) |
| 2952 | recombination protein U (recU) |
| 2966 | Uncharacterized protein family UPF0020 family |
| 2974 | autoinducer-2 production protein LuxS (luxS) |
| 2978 | KH domain protein |
| 2986 | ABC transporter, ATP-binding protein |
| 2994 | DNA-binding response regulator (vraR) |
| 3000 | guanylate kinase (gmk) |
| 3004 | DNA-directed RNA polymerase, omega subunit |
| 3008 | primosomal protein N (priA) |
| 3012 | methionyl-tRNA formyltransferase (fmt) |
| 3016 | Sun protein (sun) |

TABLE VI-continued

PREDICTED FUNCTIONS FOR CERTAIN SEQ IDs

| SEQ ID | Function |
|---|---|
| 3020 | protein phosphatase 2C |
| 3032 | sensor histidine kinase |
| 3034 | DNA-binding response regulator (vraR) |
| 3036 | cof family protein/peptidyl-prolyl cis-trans isomerase, cyclophilin typ |
| 3040 | S1 RNA binding domain protein (rpsA) |
| 3044 | pyruvate formate-lyase-activating enzyme |
| 3062 | PTS system, IIB component (celA) |
| 3066 | PTS system, cellobiose-specific IIC component (celB) |
| 3068 | formate acetyltransferase (pfl) |
| 3072 | transaldolase |
| 3080 | cysteine synthase A (cysK) |
| 3088 | comF operon protein 1 (comFA) |
| 3092 | competence protein ComF |
| 3096 | ribosomal subunit interface protein (yfiA) |
| 3104 | tryptophanyl-tRNA synthetase (trpS) |
| 3108 | carbamate kinase (arcC) |
| 3116 | ornithine carbamoyltransferase (argF) |
| 3124 | arginine deiminase (arcA) |
| 3134 | transcriptional regulator, Crp/Fnr family |
| 3138 | inosine-5'-monophosphate dehydrogenase (guaB) |
| 3140 | MutR |
| 3142 | transporter |
| 3146 | recF protein (recF) |
| 3158 | peptidase, M16 family |
| 3166 | ABC transporter, ATP-binding protein |
| 3170 | ABC transporter, ATP-binding protein |
| 3178 | LysM domain protein (lytN) |
| 3180 | immunodominant antigen A (isaA) |
| 3184 | L-serine dehydratase, iron-sulfur-dependent, alpha subunit (sdhA) |
| 3188 | L-serine dehydratase, iron-sulfur-dependent, beta subunit (sdhB) |
| 3202 | DHH subfamily 1 protein |
| 3206 | ribosomal protein L9 (rplI) |
| 3210 | replicative DNA helicase (dnaB) |
| 3216 | ribosomal protein S4 (rpsD) |
| 3224 | transcriptional regulator, TetR family |
| 3236 | membrane protein |
| 3238 | choline transporter (proWX) |
| 3240 | glycine betaine/L-proline transport ATP binding subunit (proV) |
| 3242 | DNA-binding response regulator |
| 3244 | Histidine kinase-, DNA gyrase B-, phytochrome-like ATPase family |
| 3246 | ornithine carbamoyltransferase (argF) |
| 3248 | carbamate kinase (arcC) |
| 3252 | membrane protein |
| 3256 | sensory box histidine kinase VicK |
| 3258 | DNA-binding response regulator |
| 3268 | Helix-turn-helix domain protein |
| 3278 | integrase |
| 3284 | ribosomal protein L33 (rpmG) |
| 3288 | ribosomal protein L32 (rpmF) |
| 3300 | YitT family protein |
| 3304 | YitT family protein |
| 3320 | DNA mismatch repair protein MutS (mutS) |
| 3324 | cold-shock domain family protein-related protein |
| 3336 | drug transporter |
| 3340 | Holliday junction DNA helicase RuvA (ruvA) |
| 3352 | recA protein (recA) |
| 3386 | oxidoreductase, Gfo/Idh/MocA family |
| 3390 | acetyltransferase, GNAT family |
| 3394 | anaerobic ribonucleoside-triphosphate reductase activating protein (nrd |
| 3412 | ABC transporter, permease protein (rbsC) |
| 3414 | ABC transporter, ATP-binding protein (nrtC) |
| 3416 | PTS system, mannose-specific IIAB components (manL) |
| 3420 | Cof family protein |
| 3432 | xanthine/uracil permease family protein |
| 3440 | acetyltransferase, GNAT family |
| 3442 | transcriptional regulator (cps4A) |
| 3448 | HIT family protein (hit) |
| 3460 | ABC transporter, permease protein |
| 3472 | Uncharacterized BCR, YhbC family COG0779 superfamily |
| 3484 | ribosomal protein L7A family |
| 3496 | esterase |
| 3500 | transcriptional repressor, CopY (copY) |
| 3504 | cation-transporting ATPase, E1-E2 family |
| 3508 | cation-binding protein-related protein |
| 3520 | DNA polymerase I (polA) |
| 3534 | DNA-binding response regulator (saeR) |

TABLE VI-continued

PREDICTED FUNCTIONS FOR CERTAIN SEQ IDs

| SEQ ID | Function |
|---|---|
| 3536 | sensor histidine kinase (saeS) |
| 3562 | drug resistance transporter, EmrB/QacA subfamily |
| 3566 | peptidase M24 family protein |
| 3570 | peptidase M24 family protein (pepQ) |
| 3572 | cytidine/deoxycytidylate deaminase family protein |
| 3584 | translation elongation factor P (efp) |
| 3592 | N utilization substance protein B (nusB) |
| 3596 | sugar-binding transcriptional regulator, LacI family (scrR) |
| 3600 | sucrose-6-phosphate dehydrogenase (scrB) |
| 3606 | PTS system IIABC components (scrA) |
| 3610 | fructokinase (scrK) |
| 3614 | mannose-6-phosphate isomerase, class I (manA) |
| 3622 | phospho-2-dehydro-3-deoxyheptonate aldolase (aroH) |
| 3626 | holo-(acyl-carrier-protein) synthase (acpS) |
| 3630 | alanine racemase (alr) |
| 3634 | autolysin (usp45) |
| 3636 | ATP-dependent DNA helicase RecG (recG) |
| 3642 | shikimate 5-dehydrogenase (aroE) |
| 3652 | Cof family protein |
| 3668 | ferredoxin-related protein |
| 3676 | peptidase t (pepT) |
| 3684 | UDP-N-acetylmuramoylalanyl-D-glutamate-2,6-diaminopimelate ligase (mur |
| 3692 | iron compound ABC transporter, substrate-binding protein |
| 3698 | FecCD transport family protein (sirB) |
| 3704 | iron compound ABC transporter, permease protein (sirB) |
| 3710 | inorganic pyrophosphatase, manganese-dependent (ppaC) |
| 3714 | pyruvate formate-lyase-activating enzyme (pflA) |
| 3718 | CBS domain protein |
| 3730 | acid phosphatase |
| 3736 | LPXTG-motif cell wall anchor domain protein |
| 3738 | LPXTG-site transpeptidase family protein |
| 3742 | LPXTG-site transpeptidase family protein |
| 3744 | cell wall surface anchor family protein |
| 3746 | cell wall surface anchor family protein |
| 3752 | glycosyl transferase, group 1 family protein domain protein |
| 3754 | EpsQ protein |
| 3756 | polysaccharide extrusion protein |
| 3768 | dTDP-glucose 4-6-dehydratase |
| 3782 | glycosyl transferas domain protein |
| 3788 | dTDP-4-dehydrorhamnose reductase (rfbD) |
| 3796 | RNA polymerase sigma-70 factor (rpoD) |
| 3802 | DNA primase (dnaG) |
| 3816 | ABC transporter, ATP-binding protein Vexp2 (vex2) |
| 3818 | permease |
| 3820 | transmembrane protein Vexp3 |
| 3822 | transmembrane protein Vexp3 |
| 3832 | endopeptidase O (pepO) |
| 3834 | endopeptidase O (pepO) |
| 3840 | serine protease, subtilase family |
| 3842 | exotoxin 2 |
| 3844 | CylK |
| 3854 | glycine cleavage system T protein |
| 3856 | CylE |
| 3858 | ABC transporter homolog CylB |
| 3862 | acyl carrier protein homolog AcpC (acpP) |
| 3864 | 3-oxoacyl-(acyl-carrier-protein) reductase (fabG) |
| 3868 | CylD |
| 3876 | membrane protein |
| 3912 | LPXTG-site transpeptidase family protein |
| 3916 | LPXTG-site transpeptidase family protein |
| 3918 | LPXTG-site transpeptidase family protein |
| 3920 | LPXTG-motif cell wall anchor domain protein |
| 3928 | chaperonin, 33 kDa (hslO) |
| 3932 | Tn5252, Orf 10 protein |
| 3934 | transposase OrfAB, subunit B |
| 3948 | psr protein |
| 3952 | shikimate kinase (aroK) |
| 3964 | enolase (eno) |
| 3972 | MutT/nudix family protein |
| 3976 | glycosyl transferase, group 1 |
| 3978 | preprotein translocase, SecA subunit (secA) |
| 3986 | preprotein translocase SecY family protein |
| 3990 | glycosyl transferase, family 8 |
| 3992 | glycosyl transferase, family 2 |
| 3998 | glycosyl transferase, family 8 |
| 4000 | glycosyl transferase, family 2/glycosyl transferase family 8 |

TABLE VI-continued

PREDICTED FUNCTIONS FOR CERTAIN SEQ IDs

| SEQ ID | Function |
|---|---|
| 4002 | glycosyl transferase, family 8 |
| 4012 | LPXTG-motif cell wall anchor domain protein (clfB) |
| 4016 | transcriptional regulator |
| 4018 | excinuclease ABC, B subunit (uvrB) |
| 4022 | Abortive infection protein family |
| 4024 | amino acid ABC transporter, amino acid-binding protein/permease protein |
| 4026 | amino acid ABC transporter, ATP-binding protein |
| 4034 | GTP-binding protein, GTP1/Obg family (obg) |
| 4042 | aminopeptidase PepS (pepS) |
| 4050 | ribosomal small subunit pseudouridine synthase A (rsuA) |
| 4060 | lactoylglutathione lyase (gloA) |
| 4064 | glycosyl transferase family protein |
| 4072 | alkylphosphonate utilization operon protein PhnA (phnA) |
| 4078 | glucosamine--fructose-6-phosphate aminotransferase (isomerizing) (glmS) |
| 4090 | Phosphofructokinase |
| 4094 | DNA polymerase III, alpha subunit (dnaE) |
| 4098 | transcriptional regulator, GntR family |
| 4102 | ABC transporter, ATP-binding protein |
| 4106 | ABC transporter, ATP-binding protein |
| 4116 | FtsK/SpoIIIE family protein |
| 4122 | Helix-turn-helix domain protein |
| 4152 | Helix-turn-helix domain protein |
| 4158 | excisionase |
| 4160 | transposase |
| 4166 | chloramphenicol acetyltransferase (cat) |
| 4174 | PilB-related protein |
| 4178 | acetyltransferase |
| 4182 | Leucine Rich Repeat domain protein |
| 4190 | nucleoside diphosphate kinase (ndk) |
| 4206 | Protein of unknown function superfamily |
| 4218 | hydrolase, haloacid dehalogenase-like family (pho2) |
| 4226 | oxygen-independent coproporphyrinogen III oxidase |
| 4236 | phosphoglucomutase/phosphomannomutase family protein (femD) |
| 4240 | Gram-positive signal peptide, YSIRK family domain protein |
| 4256 | cobyric acid synthase (cobQ) |
| 4260 | lipoate-protein ligase A (lplA) |
| 4264 | branched-chain alpha-keto acid dehydrogenase E3 component, lipoamide de |
| 4266 | pyruvate dehydrogenase complex, E2 component, dihydrolipoamide acetyltr |
| 4270 | pyruvate dehydrogenase complex, E1 component, pyruvate dehydrogenase be |
| 4286 | magnesium transporter, CorA family |
| 4294 | exonuclease RexB (rexB) |
| 4302 | phenylalanyl-tRNA synthetase, beta subunit (pheT) |
| 4324 | ATP synthase F1, epsilon subunit (atpC) |
| 4328 | ATP synthase F1, beta subunit (atpD) |
| 4332 | ATP synthase F1, gamma subunit (atpG) |
| 4338 | ATP synthase F1, alpha subunit (atpA) |
| 4342 | ATP synthase F1, delta subunit (atpH) |
| 4346 | ATP synthase F0, B subunit (atpF) |
| 4350 | ATP synthase, F0 subunit A (atpB) |
| 4354 | proton-translocating ATPase, c subunit-related protein |
| 4360 | glycogen synthase (glgA) |
| 4362 | glycogen biosynthesis protein GlgD (glgD) |
| 4366 | 1,4-alpha-glucan branching enzyme (glgB) |
| 4368 | pullulanase |
| 4382 | ribonuclease BN |
| 4396 | acetyltransferase, GNAT family |
| 4398 | UDP-N-acetylglucosamine 1-carboxyvinyltransferase (murA) |
| 4402 | thiamine-phosphate pyrophosphorylase (thiE) |
| 4406 | phosphomethylpyrimidine kinase (thiD) |
| 4410 | transcriptional regulator, Deg family (tenA) |
| 4414 | ABC transporter, ATP-binding protein |
| 4426 | S-adenosylmethionine synthetase (metK) |
| 4440 | DNA polymerase III, gamma and tau subunits (dnaX) |
| 4444 | GAF domain protein |
| 4448 | uridine kinase (udk) |
| 4452 | ATP-dependent RNA helicase, DEAD/DEAH box family |
| 4458 | peptidoglycan GlcNAc deacetylase (pgdA) |
| 4462 | glyceraldehyde-3-phosphate dehydrogenase, NADP-dependent (gapN) |
| 4466 | phosphoenolpyruvate-protein phosphotransferase (ptsI) |
| 4470 | phosphocarrier protein hpr |
| 4474 | NrdH-redoxin-related protein |
| 4478 | ribonucleoside-diphosphate reductase 2, alpha subunit (nrdE) |
| 4498 | glycosyl transferase, family 8 |
| 4504 | alanyl-tRNA synthetase (alaS) |
| 4512 | alkyl hydroperoxide reductase, subunit F (ahpF) |
| 4516 | alkyl hydroperoxide reductase, subunit C (ahpC) |

TABLE VI-continued

PREDICTED FUNCTIONS FOR CERTAIN SEQ IDs

| SEQ ID | Function |
|---|---|
| 4520 | ribosomal protein S2 (rpsB) |
| 4524 | translation elongation factor Ts (tsf) |
| 4532 | transcriptional regulator CtsR (ctsR) |
| 4536 | ATP-dependent Clp protease, ATP-binding subunit (clpC) |
| 4540 | deoxynucleoside kinase |
| 4544 | NifR3/Smm1 family protein |
| 4548 | chaperonin, 33 kDa (hslO) |
| 4558 | glutamate--cysteine ligase (gshA) |
| 4562 | Helix-turn-helix domain, fis-type protein |
| 4566 | perfringolysin O regulator protein (pfoR) |
| 4570 | adenylosuccinate synthetase (purA) |
| 4578 | SgaT protein (sgaT) |
| 4582 | PTS system, IIB component (sgaT) |
| 4586 | PTS system, IIA component (mtlA) |
| 4590 | hexulose-6-phosphate synthase |
| 4594 | hexulose-6-phosphate isomerase |
| 4598 | L-ribulose-5-phosphate 4-epimerase (araD) |
| 4606 | sugar binding transcriptional regulator RegR |
| 4610 | D-isomer specific 2-hydroxyacid dehydrogenase family protein (serA) |
| 4622 | transcriptional regulator, BglG family |
| 4632 | glycine betaine/L-proline transport ATP binding subunit (proV) |
| 4636 | amino acid ABC transporter, permease protein |
| 4644 | Na+/H+ exchanger family protein (kefB) |
| 4648 | glyoxylase family protein |
| 4652 | LPXTG-site transpeptidase family protein |
| 4656 | DNA gyrase, A subunit (gyrA) |
| 4660 | L-lactate dehydrogenase (ldh) |
| 4664 | NADH oxidase (nox) |
| 4680 | lipoprotein (bmpD) |
| 4690 | pantothenate kinase (coaA) |
| 4694 | ribosomal protein S20 (rpsT) |
| 4698 | amino acid ABC transporter, amino acid-binding protein (aatB) |
| 4702 | amino acid ABC transporter, ATP-binding protein |
| 4726 | ribosomal large subunit pseudouridine synthase B (rluB) |
| 4734 | Uncharacterized ACR, COG1354 |
| 4738 | integrase/recombinase, phage integrase family (xerD) |
| 4742 | CBS domain protein |
| 4746 | phosphoesterase |
| 4750 | HAM1 protein |
| 4768 | transcriptional regulator, biotin repressor family |
| 4792 | amino acid ABC transproter, permease protein |
| 4796 | amino acid ABC transporter, substrate-binding protein |
| 4798 | 6-aminohexanoate-cyclic-dimer hydrolase |
| 4800 | transcription elongation factor GreA (greA) |
| 4804 | Uncharacterized BCR, YceG family COG1559 |
| 4812 | UDP-N-acetylmuramate--alanine ligase (murC) |
| 4822 | Snf2 family protein |
| 4828 | GTP-binding protein (b2511) |
| 4832 | primosomal protein DnaI (dnaI) |
| 4844 | sensor histidine kinase (arlS) |
| 4846 | DNA-binding response regulator (arlR) |
| 4852 | heat shock protein HtpX (htpX) |
| 4870 | potassium uptake protein, Trk family |
| 4874 | ABC transporter, ATP-binding protein |
| 4888 | phosphoglycerate kinase (pgk) |
| 4896 | transcriptional regulator, MerR family |
| 4900 | glutamine synthetase, type I (glnA) |
| 4904 | secreted 45 kd protein (usp45) |
| 4908 | metallo-beta-lactamase superfamily protein |
| 4916 | glycoprotease family protein |
| 4926 | glycoprotease family protein (gcp) |
| 4938 | ribosomal protein S14p/S29e (rpsN) |
| 4952 | exonuclease (dnaQ) |
| 4956 | transcriptional regulator, merR family |
| 4958 | cyclopropane-fatty-acyl-phospholipid synthase (cfa) |
| 4970 | 1,4-dihydroxy-2-naphthoate octaprenyltransferase (menA) |
| 4972 | pyridine nucleotide-disulphide oxidoreductase (ndh) |
| 4974 | cytochrome d oxidase, subunit I (cydA) |
| 4976 | cytochrome d ubiquinol oxidase, subunit II (cydB) |
| 4980 | transport ATP-binding protein CydD |
| 4988 | polyprenyl synthetase (ispB) |
| 4990 | X-pro dipeptidyl-peptidase (pepX) |
| 4998 | drug transporter |
| 5002 | universal stress protein family |
| 5004 | glycerol uptake facilitator protein (glpF) |
| 5012 | cppA protein (cppA) |

TABLE VI-continued

PREDICTED FUNCTIONS FOR CERTAIN SEQ IDs

| SEQ ID | Function |
|---|---|
| 5034 | exodeoxyribonuclease V, alpha subunit (recD) |
| 5038 | Signal peptidase I |
| 5042 | ribonuclease HIII (rnhC) |
| 5062 | transcriptional regulator |
| 5068 | maltose ABC transporter, permease protein (malD) |
| 5072 | maltose ABC transporter, permease protein (malC) |
| 5088 | ABC transporter, ATP-binding protein |
| 5092 | ABC transporter, permease protein |
| 5106 | spspoJ protein (spo0J) |
| 5114 | DNA polymerase III, beta subunit (dnaN) |
| 5118 | Diacylglycerol kinase catalytic domain (presumed) protein |
| 5138 | transcription-repair coupling factor (mfd) |
| 5142 | S4 domain protein |
| 5156 | MesJ/Ycf62 family protein |
| 5160 | hypoxanthine phosphoribosyltransferase (hpt) |
| 5164 | cell division protein FtsH (ftsH) |
| 5172 | hydrolase, haloacid dehalogenase-like family (b2690) |
| 5178 | transcriptional regulator, MarR family |
| 5182 | 3-oxoacyl-(acyl-carrier-protein) synthase III (fabH) |
| 5190 | enoyl-(acyl-carrier-protein) reductase (fabK) |
| 5194 | malonyl CoA-acyl carrier protein transacylase (fabD) |
| 5198 | 3-oxoacyl-[acyl-carrier protein] reductase (fabG) |
| 5200 | 3-oxoacyl-(acyl-carrier-protein) synthase II (fabF) |
| 5202 | acetyl-CoA carboxylase, biotin carboxyl carrier protein (accB) |
| 5206 | (3R)-hydroxymyristoyl-(acyl-carrier-protein) dehydratase (fabZ) |
| 5210 | acetyl-CoA carboxylase, biotin carboxylase (accC) |
| 5214 | acetyl-CoA carboxylase, carboxyl transferase, beta subunit (accD) |
| 5218 | acetyl-CoA carboxylase, carboxyl transferase, alpha subunit (accA) |
| 5224 | seryl-tRNA synthetase (serS) |
| 5234 | PTS system, mannose-specific IID component |
| 5246 | ribosomal large subunit pseudouridine synthase, RluD subfamily (rluD) |
| 5254 | GTP pyrophosphokinase (relA) |
| 5266 | ribose-phosphate pyrophosphokinase (prsA) |
| 5270 | aminotransferase, class-V |
| 5274 | DNA-binding protein |
| 5282 | Domain of unknown function |
| 5290 | platelet activating factor |
| 5296 | transcriptional regulator, AraC family |
| 5302 | voltage-gated chloride channel family protein |
| 5318 | spermidine/putrescine ABC transporter, ATP-binding protein (potA) |
| 5320 | UDP-N-acetylenolpyruvoylglucosamine reductase (murB) |
| 5324 | bifunctional folate synthesis protein (folK) |
| 5328 | dihydroneopterin aldolase (folB) |
| 5332 | dihydropteroate synthase (folP) |
| 5336 | GTP cyclohydrolase I (folE) |
| 5344 | rarD protein (rarD) |
| 5348 | homoserine kinase (thrB) |
| 5354 | Polysaccharide deacetylase family (icaB) |
| 5362 | osmoprotectant transporter, BCCT family (opuD) |
| 5384 | thiol peroxidase (psaD) |
| 5388 | hydrolase |
| 5390 | transcriptional regulator, GntR family |
| 5402 | gls24 protein |
| 5424 | uncharacterized domain 1 |
| 5440 | cation efflux family protein |
| 5454 | dihydroorotate dehydrogenase A (pyrDa) |
| 5458 | beta-lactam resistance factor (fibB) |
| 5462 | beta-lactam resistance factor (fibA) |
| 5474 | HD domain protein |
| 5482 | cation-transporting ATPase, E1-E2 family |
| 5486 | fructose-1,6-bisphosphatase (fbp) |
| 5488 | iron-sulfur cluster-binding protein |
| 5492 | peptide chain release factor 2 (prfB) |
| 5496 | cell division ABC transporter, ATP-binding protein FtsE (ftsE) |
| 5504 | carboxymethylenebutenolidase-related protein |
| 5506 | metallo-beta-lactamase superfamily protein |
| 5514 | DNA polymerase III, epsilon subunit/ATP-dependent helicase DinG |
| 5520 | asparaginyl-tRNA synthetase (asnS) |
| 5526 | inosine-uridine preferring nucleoside hydrolase (iunH) |
| 5528 | general stress protein 170 |
| 5534 | Uncharacterised protein family superfamily |
| 5538 | Uncharacterized BCR, COG1481 |
| 5546 | zinc ABC transporter, zinc-binding adhesion liprotein (adcA) |
| 5560 | isochorismatase family protein (entB) |
| 5566 | 3-hydroxybutyryl-CoA dehydrogenase |
| 5572 | pyruvate phosphate dikinase (ppdK) |

TABLE VI-continued

PREDICTED FUNCTIONS FOR CERTAIN SEQ IDs

| SEQ ID | Function |
|---|---|
| 5574 | glutamyl-tRNA(Gln) amidotransferase, C subunit (gatC) |
| 5580 | glutamyl-tRNA(Gln) amidotransferase, A subunit (gatA) |
| 5594 | GTP-binding protein |
| 5612 | iojap-related protein |
| 5626 | transcriptional regulator SkgA (skgA) |
| 5630 | glycerol uptake facilitator protein (glpF) |
| 5634 | dihydroxyacetone kinase family protein |
| 5638 | dihydroxyacetone kinase family protein |
| 5640 | transcriptional regulator, tetR family |
| 5646 | dihydroxyacetone kinase family protein |
| 5654 | glutamine amidotransferase, class I |
| 5666 | peptidase, M20/M25/M40 family |
| 5668 | ABC transporter, ATP-binding protein |
| 5686 | pur operon repressor (purR) |
| 5690 | cmp-binding-factor 1 (cbf1) |
| 5694 | competence-induced protein Ccs50 (ccs50) |
| 5702 | ribulose-phosphate 3-epimerase (rpe) |
| 5710 | rRNA (guanine-N1-)-methyltransferase (rrmA) |
| 5712 | dimethyladenosine transferase (ksgA) |
| 5718 | primase-related protein |
| 5726 | endosome-associated protein |
| 5728 | CG17785 gene product |
| 5734 | dltD protein (dltD) |
| 5738 | D-alanyl carrier protein-related protein |
| 5742 | dltB protein (dltB) |
| 5754 | DNA-binding response regulator (arlR) |
| 5756 | ribosomal protein L34 (rpmH) |
| 5766 | penicillin-binding protein 4 (pbp4) |
| 5770 | intein-containing protein |
| 5774 | NifU family protein |
| 5778 | aminotransferase, class-V |
| 5782 | Uncharacterized protein family (UPF0051) family |
| 5786 | ABC transporter, ATP-binding protein |
| 5790 | glycosyl transferase domain protein (llm) |
| 5794 | transcriptional regulator MecA (mecA) |
| 5798 | undecaprenol kinase |
| 5806 | amino acid ABC transporter, amino acid-binding protein/permease protein |
| 5808 | amino acid ABC transporter, ATP-binding protein |
| 5834 | riboflavin biosynthesis protein RibF (ribF) |
| 5850 | type I restriction-modification system, S subunit |
| 5860 | lipoprotein |
| 5862 | aggregation substance |
| 5866 | ID479 |
| 5896 | type II DNA modification methyltransferase Spn5252IP (spn5252IMP) |
| 5916 | ribosomal protein L10 (rplJ) |
| 5922 | ATP-dependent Clp protease, ATP-binding subunit ClpC (clpC) |
| 5926 | homocysteine S-methyltransferase (mmuM) |
| 5932 | transcriptional regulator, TetR family |
| 5938 | GTP-binding protein (cgpA) |
| 5952 | thymidylate synthase (thyA) |
| 5956 | condensing enzyme, FabH-related |
| 5960 | hydroxymethylglutaryl-CoA reductase, degradative |
| 5974 | gene__idK21C13.21~pir\|T04769~strong similarity to unknown protein, put |
| 5976 | FMN-dependent dehydrogenase family protein |
| 5980 | phosphomevalonate kinase |
| 5986 | diphosphomevalonate decarboxylase (mvaD) |
| 5990 | mevalonate kinase (mvk) |
| 5994 | Histidine kinase-, DNA gyrase B-, phytochrome-like ATPase family (PhoR1 |
| 6002 | GTP pyrophosphokinase (relA) |
| 6006 | transposase for insertion sequence element is904 |
| 6016 | 5'-nucleotidase family |
| 6018 | polypeptide deformylase (def) |
| 6022 | NADP-specific glutamate dehydrogenase (gdhA) |
| 6026 | ABC transporter, ATP-binding/permease protein |
| 6028 | ABC transporter, ATP-binding/permease protein |
| 6030 | acetyltransferase, GNAT family family |
| 6032 | ABC transporter, ATP-binding protein |
| 6040 | degV family protein (degV) |
| 6056 | carbohydrate kinase, PfkB family (fruB) |
| 6064 | beta-lactam resistance factor (fibB) |
| 6070 | 2-dehydropantoate 2-reductase |
| 6076 | PTS system component |
| 6078 | pyridine nucleotide-disulphide oxidoreductase family protein (trxB) |
| 6082 | tRNA (guanine-N1-)-methyltransferase (trmD) |
| 6092 | c5a peptidase precursor |
| 6100 | ParA |

TABLE VI-continued

PREDICTED FUNCTIONS FOR CERTAIN SEQ IDs

| SEQ ID | Function |
|---|---|
| 6102 | transposase family protein (orfA) |
| 6116 | Tn5252, relaxase |
| 6120 | Tn5252, Orf 10 protein |
| 6124 | mercuric reductase |
| 6126 | transcriptional regulator, MerR family |
| 6132 | cation transport ATPase, E1-E2 family |
| 6138 | cation-transporting ATPase, E1-E2 family |
| 6140 | cation-transporting ATPase, E1-E2 family |
| 6144 | cation-transporting ATPase, E1-E2 family |
| 6146 | transcriptional repressor, CopY (copY) |
| 6150 | cadmium resistance transporter |
| 6158 | membrane protein |
| 6162 | flavoprotein (dfp) |
| 6170 | lipoate-protein ligase A |
| 6174 | FMN oxidoreductase (nemA) |
| 6178 | Bacterial luciferase superfamily |
| 6182 | glycine cleavage system H protein (gcvH) |
| 6186 | Domain of unknown function |
| 6194 | lipoate-protein ligase A (lplA) |
| 6198 | formate-tetrahydrofolate ligase (fhs) |
| 6202 | cardiolipin synthetase (cls) |
| 6220 | aminotransferase, class II (aspB) |
| 6222 | RNA methyltransferase, TrmH family, group 2 |
| 6232 | 60 kda chaperonin |
| 6242 | purine nucleoside phosphorylase (deoD) |
| 6248 | deoxyribose-phosphate aldolase (deoC) |
| 6254 | Lyme disease proteins of unknown function |
| 6258 | ribosomal large subunit pseudouridine synthase, RluD subfamily (rluD) |
| 6262 | penicillin-binding protein 2A (pbp2A) |
| 6266 | pathenogenicity protein |
| 6268 | transcription antitermination protein NusG (nusG) |
| 6272 | glycosyl transferase, family 8 |
| 6276 | glycosyl transferase, family 8 |
| 6284 | sugar transporter family protein |
| 6292 | sensory box histidine kinase |
| 6306 | homocysteine S-methyltransferase (metH) |
| 6310 | glycerol dehydrogenase |
| 6312 | DNA topology modulation protein FlaR |
| 6316 | translation initiation factor IF-1 (infA) |
| 6320 | adenylate kinase (adk) |
| 6326 | ribosomal protein L15 (rplO) |
| 6330 | ribosomal protein L30 (rpmD) |
| 6336 | ribosomal protein S5 (rpsE) |
| 6344 | ribosomal protein L6 (rplF) |
| 6348 | ribosomal protein S8 (rpsH) |
| 6352 | ribosomal protein S14 (rpsN) |
| 6356 | ribosomal protein L5 (rplE) |
| 6360 | ribosomal protein L24 (rplX) |
| 6366 | ribosomal protein L14 (rplN) |
| 6368 | ribosomal protein S17 (rpsQ) |
| 6372 | ribosomal protein L29 (rpmC) |
| 6374 | ribosomal protein L16 (rplP) |
| 6378 | ribosomal protein S3 (rpsC) |
| 6382 | ribosomal protein L22 (rplV) |
| 6386 | ribosomal protein S19 (rpsS) |
| 6390 | ribosomal protein L2 (rplB) |
| 6394 | ribosomal protein L23 (rplW) |
| 6398 | ribosomal protein L4/L1 family (rplD) |
| 6402 | ribosomal protein L3 (rplC) |
| 6408 | ribosomal protein S10 (rpsJ) |
| 6414 | MATE efflux family protein |
| 6418 | threonine synthase (thrC) |
| 6428 | Uncharacterized BCR, COG1636 superfamily |
| 6436 | 4-alpha-glucanotransferase (malQ) |
| 6440 | glycogen phosphorylase family protein (malP) |
| 6444 | glycerol-3-phosphate transporter (glpT) |
| 6452 | rhodanese family protein |
| 6458 | ammonium transporter |
| 6464 | DNA repair protein RadA (radA) |
| 6472 | oxidoreductase, pyridine nucleotide-disulfide, class I |
| 6478 | ribose ABC transporter, periplasmic D-ribose-binding protein (rbsB) |
| 6484 | ribose ABC transporter, ATP-binding protein (rbsA) |
| 6486 | ribose ABC transporter protein (rbsD) |
| 6488 | ribokinase (rbsK) |
| 6498 | ABC transporter, ATP-binding protein |
| 6502 | DNA-binding response regulator (vicR) |

TABLE VI-continued

PREDICTED FUNCTIONS FOR CERTAIN SEQ IDs

| SEQ ID | Function |
|---|---|
| 6506 | argininosuccinate synthase (argG) |
| 6508 | argininosuccinate lyase (argH) |
| 6514 | bacteriophage L54a, repressor protein |
| 6528 | soluble transducer HtrXIII |
| 6542 | probable transposase (insertion sequence IS861) |
| 6544 | ABC transporter, ATP-binding/permease protein |
| 6550 | ABC transporter, ATP-binding/permease protein |
| 6560 | Serine hydroxymethyltransferase |
| 6568 | HemK protein (hemK) |
| 6572 | peptide chain release factor 1 (prfA) |
| 6576 | thymidine kinases |
| 6580 | 4-oxalocrotonate tautomerase (dmpI) |
| 6588 | oxidoreductase |
| 6594 | oxidoreductase |
| 6600 | formate/nitrite transporter family protein |
| 6608 | xanthine permease (pbuX) |
| 6612 | xanthine phosphoribosyltransferase (xpt) |
| 6616 | guanosine monophosphate reductase (guaC) |
| 6620 | drug resistance transporter, EmrB/QacA subfamily |
| 6622 | oxidoreductase |
| 6624 | Kup system potassium uptake protein (kup) |
| 6636 | O-methyltransferase |
| 6642 | oligoendopeptidase F (pepF) |
| 6646 | competence protein CoiA (coiA) |
| 6650 | major facilitator superfamily protein superfamily |
| 6652 | ribosomal small subunit pseudouridine synthase A (rsuA) |
| 6658 | glucosamine-6-phosphate isomerase (nagB) |
| 6662 | nodulin-related protein, truncation |
| 6664 | S-adenosylmethioninetRNA ribosyltransferase-isomerase (queA) |
| 6674 | permease, GntP family |
| 6684 | 6-phospho-beta-glucosidase (bglA) |
| 6686 | PTS system, beta-glucosides-specific IIABC components |
| 6688 | transcription antiterminator LicT (licT) |
| 6704 | esterase |
| 6706 | sugar-binding transcriptional repressor, LacI family |
| 6708 | hydrolase, haloacid dehalogenase-like family |
| 6712 | DNA internalization-related competence protein CamEC/Rec2 |
| 6716 | competence protein CelA (celA) |
| 6720 | acyltransferase family protein |
| 6732 | ATP-dependent RNA helicase DeaD (deaD) |
| 6736 | lipoprotein, YaeC family |
| 6738 | ABC transporter, permease protein |
| 6752 | diacylglycerol kinase (dgkA) |
| 6768 | formamidopyrimidine-DNA glycosylase (mutM) |
| 6776 | epidermin immunity protein F |
| 6788 | glycyl-tRNA synthetase, beta subunit (glyS) |
| 6790 | acyl carrier protein phosphodiesterase |
| 6800 | SsrA-binding protein (smpB) |
| 6822 | D-alanine--D-alanine ligase |
| 6824 | recombination protein RecR (recR) |
| 6830 | penicillin-binding protein 2b |
| 6832 | phosphoglycerate mutase (gpmA) |
| 6836 | triosephosphate isomerase (tpiA) |
| 6856 | phosphoglycerate mutase family protein |
| 6860 | D-alanyl-D-alanine carboxypeptidase family |
| 6864 | autolysin |
| 6868 | heat-inducible transcription repressor HrcA (hrcA) |
| 6872 | heat shock protein GrpE (grpE) |
| 6876 | chaperone protein dnak |
| 6880 | dnaJ protein (dnaJ) |
| 6884 | transcriptional regulator, gntR family domain protein |
| 6888 | tRNA pseudouridine synthase A (truA) |
| 6892 | phosphomethylpyrimidine kinase (thiD) |
| 6910 | galactose-6-phosphate isomerase, LacA subunit (lacA) |
| 6922 | tagatose 1,6-diphosphate aldolase (lacD) |
| 6932 | sugar ABC transporter, ATP-binding protein (msmK) |
| 6936 | glucan 1,6-alpha-glucosidase (dexB) |
| 6940 | UDP-glucose 4-epimerase (galE) |
| 6942 | response regulator (citB) |
| 6950 | citrate carrier protein (citS) |
| 6954 | malate oxidoreductase (tme) |
| 6958 | bacterocin transport accessory protein |
| 6976 | transposase family protein (orfA) |
| 6980 | pXO1-128 |
| 6986 | adhesion lipoprotein (lmb) |
| 6994 | DNA-directed RNA polymerase, alpha subunit (rpoA) |

TABLE VI-continued

PREDICTED FUNCTIONS FOR CERTAIN SEQ IDs

| SEQ ID | Function |
|---|---|
| 6998 | ribosomal protein L17 (rplQ) |
| 7040 | probable dna-directed rna polymerase delta subunit |
| 7044 | CTP synthase (pyrG) |
| 7058 | bacteriocin transport accessory protein |
| 7074 | translation initiation factor IF-3 (infC) |
| 7100 | adenosine deaminase |
| 8468 | preprotein translocase, SecE subunit |
| 8476 | antigen, 67 kDa |
| 8486 | Lipase/Acylhydrolase |
| 8492 | peptide ABC transporter, permease protein (oppB) |
| 8494 | competence protein CglB (cglB) |
| 8502 | peptide ABC transporter, peptide-binding protein |
| 8504 | oxidoreductase |
| 8510 | amino acid ABC transporter, permease protein (opuBB) |
| 8522 | abc transporter atp-binding protein ybhf |
| 8530 | glycerol-3-phosphate dehydrogenase (NAD(P)+) (gpsA) |
| 8538 | sugar ABC transporter, sugar-binding protein |
| 8544 | secreted 45 kd protein (usp45) |
| 8556 | phosphoglycerate mutase family protein |
| 8566 | glycosyl hydrolase, family 3 |
| 8576 | N-acetylmuramoyl-L-alanine amidase |
| 8596 | sensory box histidine kinase (withHAMPandPASd) |
| 8608 | aminoglycoside 6-adenylyltransferase |
| 8622 | iron compound ABC transporter, permease protein (sirB) |
| 8636 | phosphate ABC transporter, permease protein (pstC-2) |
| 8650 | branched-chain amino acid transport system II carrier protein (brnQ) |
| 8658 | PTS system, IID component |
| 8662 | replisome organiser-related protein |
| 8674 | alkaline amylopullulanase |
| 8676 | exfoliative toxin A |
| 8690 | glycerol uptake facilitator protein (glpF) |
| 8698 | ABC transporter, ATP-binding protein |
| 8706 | CDP-diacylglycerol--glycerol-3-phosphate 3-phosphatidyltransferase (pgs |
| 8708 | cobalt transport protein |
| 8730 | integral membrane protein |
| 8734 | yadS protein |
| 8736 | cell wall surface anchor family protein |
| 8748 | polysaccharide biosynthesis protein |
| 8752 | glycosyl transferase domain protein |
| 8764 | endopeptidase O |
| 8770 | beta-ketoacyl-acyl carrier protein synthase II |
| 8772 | ABC transporter, ATP-binding protein |
| 8776 | penicillin-binding protein |
| 8778 | cell wall surface anchor family protein |
| 8780 | cell wall surface anchor family protein |
| 8786 | LPXTG-motif cell wall anchor domain protein |
| 8788 | 6-aminohexanoate-cyclic-dimer hydrolase |
| 8796 | NLP/P60 family protein |
| 8802 | DNA/RNA non-specific endonuclease |
| 8806 | hydroxyethylthiazole kinase (thiM) |
| 8826 | PTS system component |
| 8832 | sugar ABC transporter, permease protein |
| 8836 | potassium uptake protein, Trk family (trkA) |
| 8850 | lemA protein (lemA) |
| 8856 | cobalt transport protein |
| 8882 | spermidine/putrescine ABC transporter, spermidine/putrescine-binding pr |
| 8884 | spermidine/putrescine ABC transporter, permease protein (potC) |
| 8906 | ABC transporter, substrate-binding protein |
| 8908 | lipoprotein |
| 8916 | sensor histidine kinase |
| 8930 | TrsK-like protein (traK) |
| 8936 | R5 protein |
| 8962 | chromosome assembly protein homolog |
| 8978 | ribose ABC transporter, permease protein (rbsC) |
| 8980 | permease |
| 8982 | sensor histidine kinase (arlS) |
| 8986 | hydrolase, haloacid dehalogenase-like family (gph) |
| 8994 | dephospho-CoA kinase |
| 8996 | oxalate/formate antiporter |
| 9004 | sensory box protein |
| 9006 | host cell surface-exposed lipoprotein |
| 9012 | PAP2 family protein |
| 9034 | GtrA family protein |
| 9050 | lipoprotein signal peptidase (lspA) |
| 9280 | alcohol dehydrogenase, zinc-containing (adh) |
| 9284 | trigger factor (tig) |

TABLE VI-continued

PREDICTED FUNCTIONS FOR CERTAIN SEQ IDs

| SEQ ID | Function |
|---|---|
| 9290 | fructose-bisphosphate aldolase (fba) |
| 9292 | DAK2 domain protein |
| 9296 | oligopeptide ABC transporter, permease protein |
| 9298 | N-acetylglucosamine-6-phosphate deacetylase (nagA) |
| 9300 | transcriptional regulator, DeoR family (lacR) |
| 9302 | PTS system, mannose-specific IIC component (manM) |
| 9306 | Phosphoglucose isomerase |
| 9310 | aspartate--ammonia ligase (asnA) |
| 9312 | amino acid ABC transporter, ATP-binding protein |
| 9314 | DNA-binding protein HU (hup) |
| 9316 | DHH subfamily 1 protein |
| 9318 | chloride channel |
| 9320 | integrase (int) |
| 9324 | DNA/RNA non-specific endonuclease |
| 9326 | PTS system component |
| 9328 | cell division protein, FtsW/RodA/SpoVE family (ftsW) |
| 9330 | LPXTG-motif cell wall anchor domain protein |
| 9332 | peptide chain release factor 3 (prfC) |
| 9334 | ABC transporter, ATP-binding protein |
| 9336 | superoxide dismutase [mn-fe] |
| 9340 | phenylalanyl-tRNA synthetase, alpha subunit (pheS) |
| 9342 | amino acid ABC transporter, permease protein |
| 9344 | phosphate ABC transporter, phosphate-binding protein (pstS) |
| 9346 | NOL1/NOP2/sun family protein (sun) |
| 9348 | Abortive infection protein family |
| 9350 | permease |
| 9352 | N-acetylmuramoyl-L-alanine amidase domain protein (usp45) |
| 9354 | ABC transporter, ATP-binding protein |
| 9356 | phosphoglucomutase (pgm) |
| 9358 | oxidoreductase, short chain dehydrogenase/reductase family |
| 9360 | phosphate acetyltransferase |
| 9362 | gls24 protein |
| 9364 | ribosomal protein S1 (rpsA) |
| 9368 | dTDP-glucose 4,6-dehydratase (rfbB) |
| 9370 | excinuclease ABC, C subunit (uvrC) |
| 9372 | MATE efflux family protein |
| 9378 | amino acid permease (rocE) |
| 9380 | DNA-binding response regulator TrcR (trcR) |
| 9382 | 16S rRNA processing protein RimM (rimM) |
| 9384 | transcriptional regulator |
| 9388 | ribosomal protein L20 (rplT) |
| 9394 | sugar-binding transcriptional repressor, LacI family (malR) |
| 9396 | proton/peptide symporter family protein |
| 9398 | amino acid permease |
| 9400 | exoribonuclease, VacB/Rnb family (vacB) |
| 9402 | multi-drug resistance efflux pump (pmrA) |
| 9404 | adhesion lipoprotein (psaA) |
| 9406 | iron-dependent transcriptional regulator (sirR) |
| 9410 | branched-chain amino acid ABC transporter, amino acid-binding protein ( |
| 9412 | amino acid permease |
| 9414 | SpoU rRNA Methylase family protein |
| 9416 | sodium/dicarboxylate symporter (gltP-2) |
| 9418 | branched-chain amino acid transport system II carrier protein (brnQ) |
| 9420 | alcohol dehydrogenase, zinc-containing |
| 9422 | aminotransferase, class I (aspB) |
| 9424 | ribosomal protein S6 (rpsF) |
| 9426 | A/G-specific adenine glycosylase (mutY) |
| 9428 | acid phosphatase (olpA) |
| 9430 | ribosomal protein S12 (rpsL) |
| 9434 | microcin immunity protein MccF (mccF-1) |
| 9436 | undecaprenyl diphosphate synthase (uppS) |
| 9438 | preprotein translocase, YajC subunit (yajC) |
| 9440 | chaperonin, 10 kDa (groES) |
| 9444 | YitT family protein |
| 9446 | seine protease (htrA) |
| 9448 | ribose-phosphate pyrophosphokinase (prsA) |
| 9450 | aromatic amino acid aminotransferase (araT) |
| 9452 | Recombination protein O (recO) |
| 9454 | Abortive infection protein family |
| 9456 | fatty acid/phospholipid synthesis protein PlsX (plsX) |
| 9458 | acyl carrier protein (acpP) |
| 9462 | phosphoribosylaminoimidazole carboxylase, ATPase subunit (purK) |
| 9464 | alcohol dehydrogenase, iron-containing |
| 9466 | ribosomal protein L18 (rplR) |
| 9468 | preprotein translocase, SecY subunit |
| 9470 | transcriptional regulator ComX1 (comX1) |

TABLE VI-continued

PREDICTED FUNCTIONS FOR CERTAIN SEQ IDs

| SEQ ID | Function |
|---|---|
| 9472 | deoxyuridine 5'-triphosphate nucleotidohydrolase (dut) |
| 9478 | sugar-binding transcriptional regulator, LacI family (rbsR) |
| 9480 | SPFH domain/Band 7 family |
| 9488 | zinc ABC transporter, permease protein (adcB) |
| 9492 | abortive infection protein |
| 9494 | hydrolase, haloacid dehalogenase-like family |
| 9496 | response regulator (lytT) |
| 9500 | transketolase, C-terminal subunit |
| 9502 | polyribonucleotide nucleotidyltransferase (pnp) |
| 9504 | serine O-acetyltransferase (cysE) |
| 9508 | ribosomal protein L13 (rplM) |
| 9510 | replication initiation protein |
| 9518 | amino acid ABC transporter, amino acid-binding protein |
| 9522 | glycyl-tRNA synthetase, alpha subunit (glyQ) |
| 9524 | NADH oxidase |
| 9528 | transketolase (tkt) |
| 9534 | penicillin-binding protein 1A (pbp1A) |
| 9536 | cell division protein DivIVA (divIVA) |
| 9538 | sensor histidine kinase |
| 9540 | serine/threonine protein kinase (pknB) |
| 9542 | transcriptional regulator |
| 9544 | PTS system, IIA component (lacF) |
| 9546 | glycerol dehydrogenase (gldA) |
| 9548 | aspartate kinase (thrA) |
| 9550 | enoyl-CoA hydratase/isomerase family protein |
| 9552 | acyl carrier protein (acpP) |
| 9564 | ABC transporter, ATP-binding protein |
| 9566 | N utilization substance protein A (nusA) |
| 9568 | ribosome-binding factor A (rbfA) |
| 9570 | Cof family protein |
| 9572 | CoA binding domain protein (b0965) |
| 9574 | transcriptional regulator, Fur family |
| 9578 | queuine tRNA-ribosyltransferase (tgt) |
| 9580 | ribonuclease P protein component (rnpA) |
| 9582 | serine protease, subtilase family |
| 9584 | glycosyl transferase domain protein |
| 9586 | transcriptional activator, AraC family |
| 9588 | transcriptional regulator, TetR family |
| 9590 | transcriptional regulator, AraC family |
| 9594 | surface protein Rib |
| 9596 | transposase, mutator family |
| 9600 | acetyltransferase, GNAT family |
| 9602 | Transposase, Mutator family |
| 9606 | UDP-sugar hydrolase |
| 9610 | anthranilate synthase component II (trpG) |
| 9612 | biotin synthetase (bioB) |
| 9616 | UDP-N-acetylmuramoylalanine--D-glutamate ligase (murD) |
| 9618 | ylmF protein (ylmF) |
| 9620 | amino acid ABC transporter, permease protein |
| 9622 | phosphoglucomutase (pgm) |
| 9624 | YjeF-related protein, C-terminus |
| 9626 | FemAB family protein (fibA) |
| 9628 | Cof family protein |
| 9630 | cell division ABC transporter, permease protein FtsX (ftsX) |
| 9632 | oxidoreductase, short-chain dehydrogenase/reductase family (fabG) |
| 9634 | aspartate aminotransferase (aspC) |
| 9638 | ribosomal protein L31 (rpmE) |
| 9640 | nrdI protein (nrdI) |
| 9642 | ribosomal protein L19 (rplS) |
| 9644 | bacteriophage L54a, repressor protein |
| 9646 | bacteriophage L54a, antirepressor |
| 9652 | single-strand binding protein (ssb) |
| 9660 | pneumococcal surface protein A |
| 9666 | DNA-binding response regulator (vncR) |
| 9668 | transposase OrfAB, subunit B |
| 9670 | cell division protein, FtsW/RodA/SpoVE family (rodA) |
| 9672 | DNA gyrase, B subunit (gyrB) |
| 9674 | 3-phosphoshikimate 1-carboxyvinyltransferase (aroA) |
| 9676 | RNA methyltransferase, TrmA family |
| 9680 | transcriptional regulator, AraC family |
| 9682 | ABC transporter, ATP-binding protein |
| 9690 | CylJ |
| 9696 | permease |
| 9698 | regulatory protein |
| 9700 | carbohydrate kinase, pfkB family |
| 9702 | beta-glucuronidase |

TABLE VI-continued

PREDICTED FUNCTIONS FOR CERTAIN SEQ IDs

| SEQ ID | Function |
|---|---|
| 9704 | 2-deydro-3-deoxyphosphogluconate aldolase/4-hydroxy-2-oxoglutarate aldo |
| 9706 | 3-oxoacyl-(acyl-carrier-protein) reductase |
| 9708 | catabolite control protein A (ccpA) |
| 9712 | ribonuclease III (rnc) |
| 9714 | SMC family, C-terminal domain family |
| 9718 | S1 RNA binding domain protein |
| 9722 | prolipoprotein diacylglyceryl transferase (lgt) |
| 9724 | riboflavin synthase, alpha subunit (ribE) |
| 9726 | 3,4-dihydroxy-2-butanone 4-phosphate synthase/GTP cyclohydrolase II (ri |
| 9728 | lysyl-tRNA synthetase (lysS) |
| 9734 | Transposase subfamily |
| 9738 | translation elongation factor Tu (tuf) |
| 9740 | UDP-N-acetylmuramoylalanyl-D-glutamyl-2,6-diaminopimelate--D-alanyl-D-a |
| 9746 | Glutathione S-transferases domain protein |
| 9754 | Ribonucleotide reductases |
| 9756 | biotin--acetyl-CoA-carboxylase ligase |
| 9760 | Uncharacterized protein family SNZ family |
| 9762 | methionine aminopeptidase, type I (map) |
| 9764 | DNA ligase, NAD-dependent (ligA) |
| 9766 | glucose-1-phosphate adenylyltransferase (glgC) |
| 9768 | UDP-N-acetylglucosamine 1-carboxyvinyltransferase (murA) |
| 9770 | acetyltransferase, GNAT family |
| 9772 | exonuclease RexA (rexA) |
| 9774 | tRNA modification GTPase TrmE (trmE) |
| 9776 | ABC transporter, ATP-binding protein |
| 9778 | pyruvate dehydrogenase complex, E1 component, pyruvate dehydrogenase al |
| 9782 | Mur ligase family protein |
| 9786 | HD domain protein |
| 9788 | translation elongation factor G (fusA) |
| 9796 | pyruvate kinase (pyk) |
| 9798 | Signal peptidase I |
| 9802 | cytidine deaminase (cdd) |
| 9804 | sugar ABC transporter, ATP-binding protein |
| 9806 | sugar ABC transporter, permease protein |
| 9808 | acetyltransferase, GNAT family |
| 9810 | ABC transporter, permease protein |
| 9812 | SatD |
| 9814 | Helix-turn-helix domain, fis-type protein |
| 9816 | phosphate ABC transporter, ATP-binding protein (pstB-1) |
| 9818 | tRNA pseudouridine synthase B (truB) |
| 9820 | Acetyltransferase (GNAT) family |
| 9822 | DNA topoisomerase I (topA) |
| 9824 | ribonuclease HII (rnhB) |
| 9830 | orotidine 5'-phosphate decarboxylase (pyrF) |
| 9832 | aspartate-semialdehyde dehydrogenase (asd) |
| 9836 | pantothenate metabolism flavoprotein (dfp) |
| 9840 | Sua5/YciO/YrdC/YwlC family protein |
| 9844 | thiamine biosynthesis protein ApbE |
| 9846 | Domain of unknown function |
| 9848 | DNA repair protein RadC (radC) |
| 9850 | glycosyl hydrolase, family 1 (bglA) |
| 9852 | Cof family protein (b0844) |
| 9854 | spermidine/putrescine ABC transporter, permease protein (potH) |
| 9856 | folylpolyglutamate synthase (folC) |
| 9858 | homoserine dehydrogenase (hom) |
| 9860 | succinate-semialdehyde dehydrogenase (gabD-1) |
| 9862 | membrane protein |
| 9864 | ATP-dependent DNA helicase PcrA (pcrA) |
| 9866 | uracil permease (uraA) |
| 9868 | sodiumalanine symporter family protein |
| 9878 | capsular polysaccharide biosynthesis protein Cps4B (cps4B) |
| 9880 | transcriptional regulator, LysR family |
| 9882 | CpslaS |
| 9884 | chloride channel protein |
| 9886 | tributyrin esterase (estA) |
| 9888 | ABC transporter, ATP-binding protein (potA) |
| 9890 | alpha-acetolactate decarboxylase (budA) |
| 9892 | TPR domain protein |
| 9896 | metallo-beta-lactamase superfamily protein |
| 9898 | tRNA delta(2)-isopentenylpyrophosphate transferase (miaA) |
| 9902 | glycerophosphoryl diester phosphodiesterase |
| 9904 | transposase OrfAB, subunit B |
| 9906 | IS3-Spn1, transposase |
| 9908 | transposase OrfAB, subunit B (orfB) |
| 9910 | reverse transcriptase |
| 9916 | transposase OrfAB, subunit B |

TABLE VI-continued

PREDICTED FUNCTIONS FOR CERTAIN SEQ IDs

| SEQ ID | Function |
|---|---|
| 9918 | integrase, phage family (int) |
| 9920 | transcription regulator |
| 9922 | TnpA |
| 9926 | structural gene for ultraviolet resistance (uvra) |
| 9930 | Helicases conserved C-terminal domain protein |
| 9932 | abortive infection bacteriophage resistance protein (abiEi) |
| 9944 | ribosomal protein L7/L12 (rplL) |
| 9948 | ATP-dependent Clp protease, ATP-binding subunit ClpX (clpX) |
| 9950 | dihydrofolate reductase (folA) |
| 9952 | hemolysin |
| 9954 | transcriptional regulator, MarR family |
| 9958 | polyA polymerase family protein |
| 9960 | PTS system, fructose specific IIABC components (fruA-1) |
| 9962 | lactose phosphotransferase system repressor (lacR) |
| 9964 | choline binding protein D (cbpD) |
| 9968 | pyrimidine operon regulatory protein (pyrR) |
| 9970 | ribosomal large subunit pseudouridine synthase D (rluD) |
| 9972 | thiamine biosynthesis protein ThiI (thiI) |
| 9974 | 3-dehydroquinate dehydratase, type I (aroD) |
| 9976 | iron compound ABC transporter, ATP-binding protein (fepC) |
| 9980 | transcriptional regulator |
| 9982 | glycosyl transferase domain protein |
| 9984 | Cps9H |
| 9988 | 4-diphosphocytidyl-2C-methyl-D-erythritol synthase (ispD) |
| 9990 | licD1 protein (licD1) |
| 9996 | large conductance mechanosensitive channel protein (mscL) |
| 10000 | maltose ABC transporter, maltose-binding protein |
| 10004 | nucleotide sugar synthetase-like protein |
| 10006 | transcriptional regulator |
| 10008 | oxidoreductase, aldo/keto reductase family |
| 10010 | NAD(P)H-flavin oxidoreductase |
| 10016 | transcriptional regulator MutR |
| 10018 | GTP-binding protein Era (era) |
| 10022 | peptide methionine sulfoxide reductase (msrA) |
| 10026 | peptide ABC transporter, ATP-binding protein |
| 10028 | peptide ABC transporter, ATP-binding protein (amiE) |
| 10030 | peptide ABC transporter, peptide-binding protein |
| 10032 | transposase, IS30 family |
| 10034 | transcriptional regulator, LysR family |
| 10036 | spoE family protein (ftsK) |
| 10044 | methionyl-tRNA synthetase (metG) |
| 10046 | D-isomer specific 2-hydroxyacid dehydrogenase family protein (serA) |
| 10048 | acetyltransferase, GNAT family |
| 10050 | phosphoserine aminotransferase (serC) |
| 10054 | thymidylate kinase (tmk) |
| 10060 | branched-chain amino acid ABC transporter, permease protein (livH) |
| 10062 | ATP-dependent Clp protease, proteolytic subunit ClpP (clpP) |
| 10064 | uracil phosphoribosyltransferase (upp) |
| 10066 | potassium uptake protein, Trk family (trkH) |
| 10068 | glutamate racemase (murI) |
| 10070 | membrane protein |
| 10072 | HD domain protein |
| 10074 | Acylphosphatase |
| 10076 | spoIIIJ family protein |
| 10078 | acetyltransferase, GNAT family |
| 10080 | glucose-inhibited division protein B (gidB) |
| 10082 | potassium uptake protein, Trk family |
| 10084 | ABC transporter, permease protein |
| 10088 | isochorismatase family protein |
| 10092 | haloacid dehalogenase-like hydrolase superfamily |
| 10094 | membrane protein |
| 10096 | glutamyl-tRNA(Gln) amidotransferase, B subunit (gatB) |
| 10098 | CBS domain protein protein |
| 10100 | transcriptional regulator (codY) |
| 10102 | universal stress protein family |
| 10104 | L-asparaginase (ansA) |
| 10106 | oxidoreductase, aldo/keto reductase 2 family |
| 10108 | preprotein translocase, SecA subunit (secA) |
| 10112 | excinuclease ABC, A subunit (uvrA) |
| 10114 | magnesium transporter, CorA family (corA) |
| 10116 | thioredoxin (trx) |
| 10118 | MutS2 family protein (mutS2) |
| 10122 | DNA-damage inducible protein P (dinP) |
| 10124 | formate acetyltransferase (pfl) |
| 10126 | transcriptional regulator, Crp family |
| 10128 | transport ATP-binding protein CydC |

TABLE VI-continued

PREDICTED FUNCTIONS FOR CERTAIN SEQ IDs

| SEQ ID | Function |
|---|---|
| 10138 | ribosomal-protein-alanine acetyltransferase (rimI) |
| 10140 | hydrolase |
| 10144 | D-alanine-activating enzyme (dltA) |
| 10148 | carbohydrate kinase, FGGY family |
| 10150 | transaldolase |
| 10160 | Helix-turn-helix domain protein |
| 10164 | single-strand binding protein (ssb) |
| 10166 | type II DNA modification methyltransferase Spn5252IP (spn5252IMP) |
| 10174 | integrase, phage family |
| 10178 | Cyclic nucleotide-binding domain protein |
| 10180 | transcriptional regulator, MarR family |
| 10182 | prolyl-tRNA synthetase (proS) |
| 10184 | leucine-rich protein |
| 10186 | lacX protein, truncation (lacX) |
| 10188 | tagatose-6-phosphate kinase (lacC) |
| 10190 | galactose-6-phosphate isomerase, LacB subunit (lacB) |
| 10192 | neuraminidase |
| 10198 | Histidine kinase-, DNA gyrase B-, phytochrome-like ATPase domain protei |
| 10200 | ABC transporter, ATP-binding protein |
| 10202 | PTS system, IIABC components (ptsG) |
| 10204 | phosphate regulon response regulator PhoB (phoB) |
| 10212 | Uncharacterized ACR, COG2161 subfamily |
| 10216 | abortive phage resistance protein |
| 10222 | TnpA |
| 10226 | acetyltransferase, GNAT family |
| 10230 | ABC transporter domain protein |
| 10234 | 5-methyltetrahydropteroyltriglutamate--homocysteine methyltransferase ( |
| 10236 | branched-chain amino acid transport protein AzlC (azlC) |
| 10240 | DNA-binding response regulator (srrA) |
| 10242 | leucyl-tRNA synthetase (leuS) |
| 10246 | NupC family protein |
| 10248 | transcriptional regulator, GntR family |
| 10252 | glyoxalase family protein |
| 10254 | anaerobic ribonucleoside-triphosphate reductase (nrdD) |
| 10256 | competence-induced protein Ccs4 |
| 10262 | competence/damage-inducible protein CinA (cinA) |
| 10264 | DNA-3-methyladenine glycosylase I (tag) |
| 10268 | DNA mismatch repair protein HexB (hexB) |
| 10270 | arginine repressor (argR) |
| 10272 | arginyl-tRNA synthetase (argS) |
| 10274 | aspartyl-tRNA synthetase (aspS) |
| 10276 | histidyl-tRNA synthetase (hisS) |
| 10280 | AGR_pAT_51p |
| 10286 | hydrolase, alpha/beta hydrolase fold family |
| 10288 | phage infection protein |
| 10290 | Glucose inhibited division protein A (gidA) |
| 10292 | tRNA (5-methylaminomethyl-2-thiouridylate)-methyltransferase (trmU) |
| 10296 | arginine/ornithine antiporter (arcD) |
| 10298 | chromosomal replication initiator protein DnaA (dnaA) |
| 10302 | peptidyl-tRNA hydrolase (pth) |
| 10310 | phosphotyrosine protein phosphatase |
| 10316 | ribosomal protein L36 (rpmJ) |
| 10318 | ribosomal protein S13/S18 (rpsM) |
| 10328 | L-lactate dehydrogenase (ldh) |
| 10330 | ribosomal protein L28 (rpmB) |
| 10362 | RNA polymerase sigma-70 factor, ECF subfamily |
| 10384 | BioY family protein |
| 10386 | AtsA/ElaC family protein |
| 10388 | cytidine/deoxycytidylate deaminase family protein |
| 10394 | phosphorylase, Pnp/Udp family |
| 10396 | transcriptional regulator, MerR family |
| 10402 | methyltransferase (ubiE) |
| 10412 | type IV prepilin peptidase |
| 10416 | ylmG protein (ylmG) |
| 10444 | transposase OrfAB, subunit B |
| 10446 | IS150-like transposase |
| 10452 | Bacterial regulatory proteins, tetR family domain protein |
| 10454 | cell wall surface anchor family protein, authentic frameshift (clfB) |
| 10456 | transposase OrfAB, subunit A (orfA) |
| 10460 | chaperonin, 33 kDa (hslO) |
| 10472 | (3R)-hydroxymyristoyl-(acyl-carrier-protein) dehydratase (fabZ) |
| 10482 | sprT protein |
| 10490 | transcriptional regulator, MarR family |
| 10498 | transcriptional regulator |
| 10504 | glycogen biosynthesis protein GlgD (glgD) |
| 10536 | ribonucleoside-diphosphate reductase, alpha subunit, truncation (nrdD) |

TABLE VI-continued

PREDICTED FUNCTIONS FOR CERTAIN SEQ IDs

| SEQ ID | Function |
| --- | --- |
| 10538 | LPXTG-motif cell wall anchor domain |
| 10550 | membrane protein |
| 10554 | arsenate reductase (arsC) |
| 10564 | transposase, authentic frameshift |
| 10570 | transposase OrfAB, subunit A (orfA) |
| 10574 | Tn5252, Orf 9 protein |
| 10580 | IS3-Spn1, transposase |
| 10584 | transcriptional regulator, ArsR family |
| 10628 | ribosomal protein L35 (rpml) |
| 10630 | cytidylate kinase (cmk) |
| 10636 | MutT/nudix family protein |
| 10644 | preprotein translocase, SecG subunit |
| 10680 | ribosomal protein S18 (rpsR) |
| 10682 | single-strand binding protein (ssb) |
| 10692 | glyceraldehyde 3-phosphate dehydrogenase (gap) |
| 10694 | translation elongation factor G (fusA) |
| 10696 | ribosomal protein S7 (rpsG) |
| 10704 | phosphinothricin N-acetyltransferase (pat) |
| 10730 | nrdI protein (nrdI) |
| 10732 | accessory gene regulator protein C (blpH) |
| 10744 | rhodanese family protein (pspE) |
| 10746 | cAMP factor |
| 10758 | competence/damage-inducible protein CinA (cinA) |
| 10770 | transcriptional regulator, ArgR family (argR) |
| 10772 | FliP family family |
| 10794 | peptide ABC transporter, peptide-binding protein |
| 10800 | ribosomal protein S21 (rpsU) |
| 10802 | transposase, IS30 family |
| 10816 | mucin 2 precursor, intestinal |
| 10854 | SV40-transformed marker protein pG1-related protein |
| 10856 | SV40-transformed marker protein pG1-related protein |
| 10858 | SV40-transformed marker protein pG1-related protein |
| 10860 | SV40-transformed marker protein pG1-related protein |
| 10862 | SV40-transformed marker protein pG1-related protein |
| 10864 | SV40-transformed marker protein pG1-related protein |
| 10866 | SV40-transformed marker protein pG1-related protein |
| 10910 | transcriptional regulator |
| 10920 | ribosomal protein S11 (rpsK) |
| 10922 | elaA protein |
| 10926 | 5-formyltetrahydrofolate cyclo-ligase family protein |
| 10938 | inositol monophosphatase family protein |
| 10940 | amino acid ABC transporter, amino acid-binding protein (artI) |
| 10944 | Holliday junction DNA helicase RuvB (ruvB) |
| 10946 | D-alanyl-D-alanine carboxypeptidase (dacA) |
| 10948 | lipoprotein (bmpD) |
| 10950 | peptidase, U32 family family |
| 10952 | protease maturation protein |
| 10954 | glutamyl-tRNA synthetase (gltX) |
| 10956 | GTP-binding protein LepA (lepA) |
| 10960 | translation initiation factor if-2 |
| 10962 | phosphoenolpyruvate carboxylase (ppc) |
| 10964 | calcium E1-E2-type ATPase |
| 10966 | serine protease, subtilase family |

SEQUENCE LISTING (12029 sequences)

SEQ ID NO: 1 - DNA, 576 bp, Streptococcus agalactiae
atgaaagtgaaaaataagattttaacgatggtagcacttactgtcttaacatgtgctacttattcatcaatcggttatgctgatacaagtgataagaatactgacacgagtgtcgtgactacgaccttatctgaggagaaaagatcagatgaactagaccagtctagtactggttcttcttctgaaaatgaatcgagttcatcaagtgaaccagaaacaaatccgtcaactaatccacctacaacagaaccatcgcaaccctcacctagtgaagagaacaagcctgatggtagaacgaagacagaaattggcaataataaggatatttctagtggaacaaaagtattaatttcagaagatagtattaagaattttagtaaagcaagtagtgatcaagaagaagtggatcgcgatgaatcatcatcttcaaaagcaaatgatgggaaaaaaggccacagtaagcctaaaaaggaacttcctaaaacaggagatagccactcagatactgtaatagcatctacgggagggattattctgttatcattaagtttttacaataagaaaatgaaactttat

SEQ ID NO: 2 - protein, 192 aa, Streptococcus agalactiae
MKVKNKILTMVALTVLTCATYSSIGYADTSDKNTDTSVVTTTLSEEKRSDELDQSSTGSSSENESSSSSEPETNPSTNPPTTEPSQPSPSEENKPDGRTKTEIGNNKDISSGTKVLISEDSIKNFSKASSDQEEVDRDESSSSKANDGKKGHSKPKKELPKTGDSHSDTVIASTGGIILLSLSFYNKKMKLY

SEQ ID NO: 3 - DNA, 537 bp, Streptococcus agalactiae
atgtcaataacctcggttaaaaaatcaaaaccatttaaattaggagtggcaggtcttttagtgggtgcttcattagctttaccactttcagtaagcgcagcatcttataccgtgaaatcaggtgataccttatcagctattgctaaaaatcataaaactacggtacaagagttagtgtctctcaatagtatcagtaacgctgatgtcatcagtataggtgatgttttaaaattggataattctacagctagtcaagcagaagcaaaatctcaaccaacaattgaaaattcaatgaattcttcatcaaatttgagttcaagtgattcagccgcaaaagaagaaatagctcgtcgtgaatcaaatggtagttatactgcacagaatggacaatattatggaagatatcaactgtctcaatcttacctaaatggcgacttatctcctgaaaatcaagaaaaagtagcggacaattatgtggtttctcgttacggatcttggtcggcagcgctatcattttggaatagtaacggctggtat

SEQ ID NO: 4 - protein, 179 aa, Streptococcus agalactiae
MSITSVKKSKPFKLGVAGLLVGASLALPLSVSAASYTVKSGDTLSAIAKNHKTTVQELVSLNSISNADVISIGDVLKLDNSTASQAEAKSQPTIENSMNSSSNLSSSDSAAKEEIARRESNGSYTAQNGQYYGRYQLSQSYLNGDLSPENQEKVADNYVVSRYGSWSAALSFWNSNGWY

SEQ ID NO: 5 - DNA, 837 bp, Streptococcus agalactiae
atgaataagaaaaaaatacttaccggactttctttttttctggtaagtcttcttttatcttttgggattttttccttgatcattccaaaatcaaatcctaaattaacaaaaaaagacttcctaacaaagaaagttatcccacttaactatgttgctcttggagattctctgaccgaaggtgtgggcgatacaacctctcaaggtggttttgttccactgctatcagaatcactccataatcgatactcttaccaagtgacttctgttaattatggtgtgtctgggaatactagtcaacaaattttaaaacgtatgacgacagatcctcaaatcgaaaaagatttagagaaagctgatttattgacgctaactgttggtggtaatgatgtcttggctgttattcgtaaagagctcagtcatttatcactaaattcctttgagaaaccagcagaagcatataaggaacgtttgaaagaaatccttgcaaaagcaagacaagataatcctaaattgcctatttatgttttaggcatttataatcctttttacctaaactttccacaattaactaaaatgcaaaccgttattgataattggaataaagctacaaaagaagtagttgatgcttcagaaaatgtttattttgtcccaattaatgaccgcctttataagggaataaatggtaaagagggtattacagagtcatcaaatagtcaggcaagtatcactaatgatgctctctttactggagaccattttcatcccaataatattggctatcaaatcatgtctaacgccgttatggagaaaataaatgaaacaagaaaaaactggccg

SEQ ID NO: 6 - protein, 279 aa, Streptococcus agalactiae
MNKKKILTGLSFFLVSLLLSFGIFSLIIPKSNPKLTKKDFLTKKVIPLNYVALGDSLTEGVGDTTSQGGFVPLLSESLHNRYSYQVTSVNYGVSGNTSQQILKRMTTDPQIEKDLEKADLLTLTVGGNDVLAVIRKELSHLSLNSFEKPAEAYKERLKEILAKARQDNPKLPIYVLGIYNPFYLNFPQLTKMQTVIDNWNKATKEVVDASENVYFVPINDRLYKGINGKEGITESSNSQASITNDALFTGDHFHPNNIGYQIMSNAVMEKINETRKNWP

SEQ ID NO: 7 - DNA, 1536 bp, Streptococcus agalactiae
ttgattatggagacgggtagtgtaagtaagaaagttcaacaacttcctttaagtcctagattatctaaaaataagcatatgagggatatgctacttactatgcaaaaagattcagcgtattacgaaacaagtgacagtctagtccttcgaattaatctcactgcagatactaaacttaattttaatgctgttaaaggagcgagtgctcttactgaaaatatgatgatgagacagtttgcagttgctggaccacaagatgatcctgttagtgaacataaatacccatcagtatttctcttaactcctgccttattggaaactgctagtgaggcaactctaaatggtaaggaaatcacagcatctggtattatcggtcacatcaaggatggtgataaaagcaagcatgttgaagtcaaaatggtgaatgaaaatggagacatgctaggaacccctgttattattcaaggtaaagacttgactaatcgaacaaaaccattaatgagtggacgtagagtactttatgccggtaaacaatatgagttccgggctaaattaccacttagtcgttttaacacttggattagggttgaagtggtaacagaagcaggagagaaagcaagtattgttcgtcgcatgttctttgaccaatcagttccagagcttaacacagcagttgctaaacgtgatttgacttctgatactgctcttatccacatcgttgccaaagatgactctctaaaactaaaattatatcaagatgattcattacttgaatctgttgataaaaccggtctttatagttttagaaatggtgtagaaatcactaaagatatgacagtaccactagaatttggagataatattattaagttatctgctgttgacttatcaaattatcgtcgtaatgagacccttcatatctatagaaaccgttttgatgttaaagcaagccaaatgacagctgacaaaggagctaaagtaactgtggatatgttgatgaagcacttagttgttccagaaatggcaggagcttatacattaacaatcgacgaagctccaaacacaaatgaatcaggaatgttaacaaacgctaaagtatcgattcattatgtaaatggtggtgttgataaagttgatgttccgattaaagtagttgacttagaagctattcgtaaagctgaagaagcacgtaaagctgaagaagcacgtaaagctgaagaagcacgtaaagctgaagagggacataaaacccaagaagcacctatagttgaagaaggctacaaggttaataacgttcatcaaactgatactacagttaaagcgtctgatttaccaaagactaagacagtttccgcagttcatatggctagaacagacaataaacagataacttcacatcagacacatgttgaaaaacaaattaaaaatacattgccatccactggtgacagcaaacgtggttattatatcactggaatggctatcgttatgctgagtgtattatttagtttagctaaaaagtttaaaagcaaatat

SEQ ID NO: 8 - protein, 512 aa, Streptococcus agalactiae
LIMETGSVSKKVQQLPLSPRLSKNKHMRDMLLTMQKDSAYYETSDSLVLRINLTADTKLNFNAVKGASALTENMMMRQFAVAGPQDDPVSEHKYPSVFLLTPALLETASEATLNGKEITASGIIGHIKDGDKSKHVEVKMVNENGDMLGTPVIIQGKDLTNRTKPLMSGRRVLYAGKQYEFRAKLPLSRFNTWIRVEVVTEAGEKASIVRRMFFDQSVPELNTAVAKRDLTSDTALIHIVAKDDSLKLKLYQDDSLLESVDKTGLYSFRNGVEITKDMTVPLEFGDNIIKLSAVDLSNYRRNETLHIYRNRFDVKASQMTADKGAKVTVDMLMKHLVVPEMAGAYTLTIDEAPNTNESGMLTNAKVSIHYVNGGVDKVDVPIKVVDLEAIRKAEEARKAEEARKAEEARKAEEGHKTQEAPIVEEGYKVNNVHQTDTTVKASDLPKTKTVSAVHMARTDNKQITSHQTHVEKQIKNTLPSTGDSKRGYYITGMAIVMLSVLFSLAKKFKSKY

SEQ ID NO: 9 - DNA, 96 bp, Streptococcus agalactiae
atgttaacaaaatcatcaataaataatgataaaaagaaactctcattcccattgattttgctaaaacaggatcaaaagaagtcaataataattctt

SEQ ID NO: 10 - protein, 32 aa, Streptococcus agalactiae
MLTKSSINNDKKKLSFPLILLKQDQKKSIIIL

SEQ ID NO: 11 - DNA, 831 bp, Streptococcus agalactiae
atgtttacgaaattttttgaaggcttattgacttatcattttttgcaaaatgcttttataactgcaattgtgattggtattgtagcgggtgcagtaggctgttttattatcttgcgctcaatgtctttgatgggtgatgctatttctcacgctgttctaccaggtgttgctatatcttttattttagggattaacttttttataggtgctattgtctttggtttgttgtcttcgattatcattacttatattaaagaaaatagtgtcataaaaggagatactgctattggaattactttttcgtcctttttagccttaggtatcattttaattggacttgctaatagtacaactgacctctttcatattctttttgggaatattttggcagtacaagatagtgataaatatatgactattattgtgggattaattgtactgactctgattactatcttctttaaagaattattattgacttcttttgatcctgttttagcaaaatcaatgggaatgagagtttctttttatcattatttattgatgattttgttaacattagttgcagtaacagctatgcagagtgtgggaacaatattgatcgtagcacttttaattacaccagctgcaacagcatatctttatgttaaaagtctcagaacaatgttgtttttatcatctgcattaggagcagtagcatctgttctggggttatatatcggttatacatttaatattgccgcaggatcaagtattgttttaacatctacttttatgtttttacttgctttcctattttctcctaaacaaagtttgtttaaaaagaaacaa

SEQ ID NO: 12 - protein, 277 aa, Streptococcus agalactiae
MFTKFFEGLLTYHFLQNAFITAIVIGIVAGAVGCFIILRSMSLMGDAISHAVLPGVAISFILGINFFIGAIVFGLLSSIIITYIKENSVIKGDTAIGITFSSFLALGIILIGLANSTTDLFHILFGNILAVQDSDKYMTIIVGLIVLTLITIFFKELLLTSFDPVLAKSMGMRVSFYHYLLMILLTLVAVTAMQSVGTILIVALLITPAATAYLYVKSLRTMLFLSSALGAVASVLGLYIGYTFNIAAGSSIVLTSTFMFLLAFLFSPKQSLFKKKQ

SEQ ID NO: 13 - DNA, 852 bp, Streptococcus pyogenes
atgtctatgaaattttttgagggcttgatgtcataccactttttacaaaatgcactgataacggctgtagtcattggtatcgtctcaggtgctgtagggtgttttattatccttaggtcaatgtctcttatgggtgatgccatctcacacgctgttttaccaggggttgctttgtcatttattttaggagtcaatttttttattggagcgattatttttgggttattagcttctgttattattacttatatcaaggaaaactctgtcattaaaggagatacggctattggtatcacctttagctcttttttggcactgggagtcatcttgataggggtagccaatagttcgacggacttatttcatattttgtttgggaatattttagctgtgcaagatagcgataagtggattactattggtgtttcgatttttgttttagtggttattagtctctttttcaaagaactattattaacatcatttgatcctatcttagccaaatcaatgggtgtgaaggtcaatgcgtatcattatttgttgatggtcctattaactttagtggctgttacggcgatgcaaagcgtgggtactatcttgattgttgccttattgattacgccagcagcgacagcttatttatatgctaatagcttaaaagtaatgttagtgatgtcatctttactaggcgctttagcatcggttttagggctttatttgggctatacctttaatgttgccgcagggtcaagtatcgtactgacttctgcgatgatgtttttgatcagtttctttgtttcacccaagcaaggctaccttaaaagatggatgcaaaaaaaagaaaaaacacct

SEQ ID NO: 14 - protein, 284 aa, Streptococcus pyogenes
MSMKFFEGLMSYHFLQNALITAVVIGIVSGAVGCFIILRSMSLMGDAISHAVLPGVALSFILGVNFFIGAIIFGLLASVIITYIKENSVIKGDTAIGITFSSFLALGVILIGVANSSTDLFHILFGNILAVQDSDKWITIGVSIFVLVVISLFFKELLLTSFDPILAKSMGVKVNAYHYLLMVLLTLVAVTAMQSVGTILIVALLITPAATAYLYANSLKVMLVMSSLLGALASVLGLYLGYTFNVAAGSSIVLTSAMMFLISFFVSPKQGYLKRWMQKKEKTP

SEQ ID NO: 15 - DNA, 123 bp, Streptococcus agalactiae
gtgaccctaatggagacgggaccggtggaaaatctatatggaatagcaaagataaaaagaaagattctggaaatggttttgttaatgaaatatccccttacctctacaatatcaggggaagtt

SEQ ID NO: 16 - protein, 41 aa, Streptococcus agalactiae
MTLMETGPVENLYGIAKIKRKILEMVLLMKYPLTSTISGEV

SEQ ID NO: 17 - DNA, 801 bp, Streptococcus agalactiae
atgaaaaaaattatttatcttggtttagcctgtgtcagtatattaactttaagtggttgcgagtcaattgagcgttctctaaaaggagaccgttatgttgaccaaaaactagctgaaaactcttcaaaggaagctactgaacaactaaacaaaaaaactaagcaagccttaaaagctgataaaaaagcttttcctcaattggacaaggctgttgccaaaaacgaggcacaagtgcttataaaaacctctaaaggtgatataaatatcaagttatttccaaaatatgctcctttagctgttgaaaattttctaacacatgcaaaagaaggatactataatgggttaagtttccacagagttatcaaagattttatgatacaatctggtgaccctaatggagacgggaccggtggaaaatctatatggaatagcaaagataaaaagaaagattctggaaatggttttgttaatgaaatatccccttacctctacaatatcaggggaagtttagcaatggcaaatgctggagctgatactaatggcagccaattctttatcaatcaaagccagcaagatcattccaaacaactgtcagataaaaaagttcctaaggtgattattaaagcctattcagagggaggaaatccaagtttagatggtggttataccgtctttggacaagtaatctctggcatggaaactgtggataaaattgcttcggtagaagttacaaaatcagatcaaccaaaagaaaaaattactattacaagtatcaaagttattaaagactacaaatttaaa

SEQ ID NO: 18 - protein, 267 aa, Streptococcus agalactiae
MKKIIYLGLACVSILTLSGCESIERSLKGDRYVDQKLAENSSKEATEQLNKKTKQALKADKKAFPQLDKAVAKNEAQVLIKTSKGDINIKLFPKYAPLAVENFLTHAKEGYYNGLSFHRVIKDFMIQSGDPNGDGTGGKSIWNSKDKKKDSGNGFVNEISPYLYNIRGSLAMANAGADTNGSQFFINQSQQDHSKQLSDKKVPKVIIKAYSEGGNPSLDGGYTVFGQVISGMETVDKIASVEVTKSDQPKEKITITSIKVIKDYKFK

SEQ ID NO: 19 - DNA, 804 bp, Streptococcus pyogenes
atgaaaaaattattatctctcagtttagtagccattagtttacttaatttgagtgcttgtgaatctgttgaccgcgctataaaaggcgataaatacattgatgaaaaaactgccaaagaagaaagcgaagcagcttctaaagcctatgaagaaagcattcaaaaagctctcaaagctgatgctagccaatttccacaactaaccaaagaagtcggcaaagaagaagctaaggtcgtaatgaggacaagtcaaggggacattacccttaagttattcccaaaatatgctcccttagctgttgagaacttcctcacccatgctaaaaaaggctactatgataaccttaccttccatcgtgtgatcaacgactttatgattcaatcaggtgaccccaaaggagatggcacaggtggtgaatcgatttggaaaggcaaggatcctaaaaaagatgctggcaatggctttgtcaacgaaatctctccatttttatatcatattcgcggtgctcttgccatggcaaatgctggtgctaatactaacggtagccaattttatatcaaccaaaacaagaaaaatcaaagcaagggattatcaagtaccaactacccaaaacctatcatctctgcctatgagcatggcggcaatccaagcttagatggcggttatactgtatttggtcaagtcattgatggtatggatgttgtcgataaaattgccgctacttctatcaaccaaaatgataaaccagaacaagacattacgattacctcaattgacattgtcaaagattatcgctttaaaaac

SEQ ID NO: 20 - protein, 268 aa, Streptococcus pyogenes
MKKLLSLSLVAISLLNLSACESVDRAIKGDKYIDEKTAKEESEAASKAYEESIQKALKADASQFPQLTKEVGKEEAKVVMRTSQGDITLKLFPKYAPLAVENFLTHAKKGYYDNLTFHRVINDFMIQSGDPKGDGTGGESIWKGKDPKKDAGNGFVNEISPFLYHIRGALAMANAGANTNGSQFYINQNKKNQSKGLSSTNYPKPIISAYEHGGNPSLDGGYTVFGQVIDGMDVVDKIAATSINQNDKPEQDITITSIDIVKDYRFKN

SEQ ID NO: 21 - DNA, 2448 bp, Streptococcus agalactiae
atggtatttatggcaaataagaaaaaaacaaaaggaaagaaaaccagaagacctactaaggcagaaatagagcgtcaaagagctattcaaaggatgattactgctcttgttttaacaattattctcttctttggtattatcagattaggtatttttggtattacagtctataacgtcatccgttttatggtaggtagcttggcttacttatttattgcggcaactttaatctacctttatttctttaaatggttgcgaaagaaagatagcttagtagcaggttttttgatagcttctttaggattattgattgagtggcatgcttaccttttctcaatgcctattttgaaagataaagaaattttgcgttcaactgctcgattaattgtgtctgatttaatgcaatttaaaatcactgtttttgccggtggaggtatgttgggtgctttgatttacaagccaattgcttttctcttttctaatattggtgcctatatgattggtgttctcttcatcattttgggtctctttttaatgagttctctggaagtttatgacatcgtcgaatttattagagcttttaaaaataaagtggcagagaagcacgagcaaaataaaaaggagcgttttgctaagcgagagatgaaaaaagcaatcgctgaacaagagcgcatagagcgtcaaaaagctgaagaagaagcttatttagcttcggttaatgtagaccctgaaacgggtgagattctagaggatcaagctgaggacaatttggatgatgcgctaccacctgaggtaagtgaaacatcaactccggtatttgagccagagatccttgcttatgagacatcgcctcaaaatgatcctttaccagtagagccgacaatttatttagaagactatgattcgccgattcctaatatgagagaaaatgatgaggaaatggtttatgatttagatgatgatgtagatgatagtgatatagaaaatgtcgactttacacctaaaacgacactggtttataaattaccaacgatagatttatttgcaccagataagcctaaaaatcaatccaaagaaaaggatttagtccgaaagaatatcagagttttagaagaaacatttagaagttttggtatcgatgtaaaagtagaacgtgctgaaattggaccatcagttactaaatatgaaattaaaccagcagttggagttcgtgtgaatcgtatttcaaatctatctgacgacctagctcttgctcttgcagcaaaagatgtgcgtatagaaacaccaattcctggaaaatcattaataggtattgaagttcctaactcagaaattgcaacggtttctttccgcgaactttgggaacaatctgatgccaatcctgaaaaccttttagaagtaccactaggaaaagctgttaacggcaatgctcgcagttttaacttagctagaatgccgcatcttttggtagctggttcaactggttcaggtaaatctgtggcagttaatggaattatttcaagtattttgatgaaggcacgtccagatcaagttaagtttatgatgattgatcccaaaatggttgaattatctgtttataatgatattccacatttattaatccctgttgtaaccaatccgcgtaaagcaagtaaggcactccaaaaagttgttgatgaaatggaaaatcgatacgagttatttagcaaaattggtgtgcgtaatatagcaggttataatacaaaggttgaagagtttaatgcttcctctgagcaaaaacaaatacctttgcctttaatcgttgtcattgtagatgaattggctgacttgatgatggttgctagtaaagaagttgaagatgctattattcgtttggggcaaaaagcacgtgctgcaggtatccatatgattcttgcaactcaacgtccatccgtagatgttatttctggtttgattaaagcaaatgttccgtcgcgtattgcatttgctgtttcaagtggtactgatagccgtacgatccttgatgaaaatggtgctgaaaagctcttgggacggggtgacatgctctttaagcctattgatgagaatcatccagtacgactacaaggttcctttatttcagatgatgatgttgaaaggatcgttggttttatcaaagaccaagccgaggctgactatgatgatgcctttgatcctggagaagtatctgaaacagataacggctctggtggtggcggcggagtacctgaaagtgatcctctttttgaagaagccaagggactcgttttagagacgcaaaaagcaagtgcctcaatgattcaacgccgattgtctgttggtttcaatagagcaacaagactaatggaagaattagaagcagcgggggttattggtccagcagaaggaaccaagccacgaaaagttttaatgactccaactccgagtgaa

SEQ ID NO: 22 - protein, 816 aa, Streptococcus agalactiae
MVFMANKKKTKGKKTRRPTKAEIERQRAIQRMITALVLTIILFFGIIRLGIFGITVYNVIRFMVGSLAYLFIAATLIYLYFFKWLRKKDSLVAGFLIASLGLLIEWHAYLFSMPILKDKEILRSTARLIVSDLMQFKITVFAGGGMLGALIYKPIAFLFSNIGAYMIGVLFIILGLFLMSSLEVYDIVEFIRAFKNKVAEKHEQNKKERFAKREMKKAIAEQERIERQKAEEEAYLASVNVDPETGEILEDQAEDNLDDALPPEVSETSTPVFEPEILAYETSPQNDPLPVEPTIYLEDYDSPIPNMRENDEEMVYDLDDDVDDSDIENVDFTPKTTLVYKLPTIDLFAPDKPKNQSKEKDLVRKNIRVLEETFRSFGIDVKVERAEIGPSVTKYEIKPAVGVRVNRISNLSDDLALALAAKDVRIETPIPGKSLIGIEVPNSEIATVSFRELWEQSDANPENLLEVPLGKAVNGNARSFNLARMPHLLVAGSTGSGKSVAVNGIISSILMKARPDQVKFMMIDPKMVELSVYNDIPHLLIPVVTNPRKASKALQKVVDEMENRYELFSKIGVRNIAGYNTKVEEFNASSEQKQIPLPLIVVIVDELADLMMVASKEVEDAIIRLGQKARAAGIHMILATQRPSVDVISGLIKANVPSRIAFAVSSGTDSRTILDENGAEKLLGRGDMLFKPIDENHPVRLQGSFISDDDVERIVGFIKDQAEADYDDAFDPGEVSETDNGSGGGGGVPESDPLFEEAKGLVLETQKASASMIQRRLSVGFNRATRLMEELEAAGVIGPAEGTKPRKVLMTPTPSE

SEQ ID NO: 23 - DNA, 2403 bp, Streptococcus agalactiae
atggttaaaagaaatcaaagaaaaaaaagtgcgcctaagaagcgtttaacaaaagcagaagtggaaaagcaacgtgccattaagaggatgattttatctgttttaatggctttgttgcttatttttgcgatgcttcgcttgggcgtctttggtgtgacaacttataatatgattcgttttttggtgggtagtttagcctatccgtttatgtttgcctggttaatttacttattttgttttaaatggttacggcaaaaagatggaatgattgcgggagttgttattgcctttttgggattgctagttgagtggcacgccttcttatttgcgatgcctaggatgcttgatcaagatatttttctaggcactgctcggctaattacaagagatttactagccctgcgcgtgactgaatttgttggtggaggaatgcttggtgcattactttataaacccatagcctttttattttcgaatatcggctcttactttattggttttttgtttatcttattaggattatttctaatgacgccttgggatatctatgatgtgagtcactttgtgaaagaggctgttgataaactagcagtggcttatcaggaaaataaagaaaagcggttcatcaaacgagaagagcaccgcttacaagctgaaaaagaggctttagagaaacaagcacaagaggaagaaaaacgtctagcagaattgacggttgatcctgagacgggagagattgttgaggatagtcagtctcaagtcagctatgatttggctgaggatatgacaaaagaaccagagattcttgcttatgatagtcacctcaaagacgatgagacaagcttatttgatcaagaagacttggcttacgctcatgaggaaattggggcttatgactctttatctgctttagcatcttctgaagatgagatggatatggatgaacctgttgaagttgatttcacaccaaaaacccatcttctttataaacttccaacgatagatttatttgcaccagataagcccaaaaaccagtccaaagagaaaaacttagtccgcaaaaatatcaaggtgcttgaagataccttccaaagttttgggattgatgtcaaggtagagcgagcagaaatcgggccttccgtcaccaaatatgaaatcaagccagctgtcggggtccgagttaatcgtatttcaaatcttgctgatgatttggcacttgctctggctgctaaagatgttcgtattgaagcaccaattcctggaaaatccttaataggtattgaagttcctaactcagaaattgcaacggtttctttccgcgaactttgggaacaatctgatgccaatcctgaaaaccttttagaagtaccactaggtaaagctgttaatggcaatgcgcgcagttttaacttagctagaatgccgcatcttttggtagctggttcaactggttcaggtaaatctgtggcagttaatggcattatttcaagtattttgatgaaggcacgtccagatcaagttaagtttatgatgattgaccccaaaatggttgaattatctgtttataatgatattccacatttattaatcccagttgtaaccaatccgcgtaaagccagtaaggcactccaaaaagtggttgatgagatggaaaaccgctacgagttatttagtaaaattggtgtgcgtaatatagcaggttataatacaaaggttgaagagtttaatgcttcttctgagcaaaaacaaataccgttgcctttaatcgttgtcattgtagatgaattggctgacttgatgatggtggctagtaaagaagttgaagatgctattattcgtttgggacaaaaagcacgtgctgcaggtatccatatgattcttgcaactcaacgtccctctgtagatgttatttctggtttgattaaagcaaatgttccgtcgcgtatggcatttgctgtttcaagtggtactgatagccgtacgatccttgatgaaaatggtgctgaaaagctcttgggacggggtgatatgctctttaagccgattgatgaaaatcaccctgttcgcttgcaagggtctttcatctcagatgatgatgtggagcgtattgtcaactttatcaaagaccaaactgaagcggattatgatgacgcctttgatcctggtgaagttagcgacaatgatcctggtttttctggaaatggcggagctgctgaaggtgatcctctttttgaagaagcaaaagccttggtcttagaaacacaaaaagctagtgcctcaatgattcaaaggcgtttgtcggttggatttaatcgtgccacgcgcttgatggatgaattggaagaagcaggtgttatcggtccagcagaaggaaccaagcctcgtaaggtattgcagacaaac

SEQ ID NO: 24 - protein, 801 aa, Streptococcus agalactiae
MVKRNQRKKSAPKKRLTKAEVEKQRAIKRMILSVLMALLLIFAMLRLGVFGVTTYNMIRFLVGSLAYPFMFAWLIYLFCFKWLRQKDGMIAGVVIAFLGLLVEWHAFLFAMPRMLDQDIFLGTARLITRDLLALRVTEFVGGGMLGALLYKPIAFLFSNIGSYFIGFLFILLGLFLMTPWDIYDVSHFVKEAVDKLAVAYQENKEKRFIKREEHRLQAEKEALEKQAQEEEKRLAELTVDPETGEIVEDSQSQVSYDLAEDMTKEPEILAYDSHLKDDETSLFDQEDLAYAHEEIGAYDSLSALASSEDEMDMDEPVEVDFTPKTHLLYKLPTIDLFAPDKPKNQSKEKNLVRKNIKVLEDTFQSFGIDVKVERAEIGPSVTKYEIKPAVGVRVNRISNLADDLALALAAKDVRIEAPIPGKSLIGIEVPNSEIATVSFRELWEQSDANPENLLEVPLGKAVNGNARSFNLARMPHLLVAGSTGSGKSVAVNGIISSILMKARPDQVKFMMIDPKMVELSVYNDIPHLLIPVVTNPRKASKALQKVVDEMENRYELFSKIGVRNIAGYNTKVEEFNASSEQKQIPLPLIVVIVDELADLMMVASKEVEDAIIRLGQKARAAGIHMILATQRPSVDVISGLIKANVPSRMAFAVSSGTDSRTILDENGAEKLLGRGDMLFKPIDENHPVRLQGSFISDDDVERIVNFIKDQTEADYDDAFDPGEVSDNDPGFSGNGGAAEGDPLFEEAKALVLETQKASASMIQRRLSVGFNRATRLMDELEEAGVIGPAEGTKPRKVLQTN

SEQ ID NO: 25 - DNA, 1713 bp, Streptococcus agalactiae
atgcatattgagactgttattgatttcaaagaattaggaaaaagatatcgttttaaaaatcctacaaaagaattaatagctgatactttagaacaagtcttagaagtgataaaagaagttgattattatcaatctcaaaattattatgttgttggttatttatcttatgaagcatctgctgcttttgattcacattttaaagtttctcaacagaagttggctggagaacatctagcttattttacagtacataaagattgtgagaacgaagcttttcctttaagttatgaaaatgttagattagcagataattggactgctaatgtttctgagcaagaatatcaagaggcaattgctaatattaaaggacaaattagacaaggaaatacttatcaagtaaattatacactagagcttagccaacaattatgctcggatccctttagtgtttatgaacgcctaatggtagaacaaggagcaggatataatgcttatattgcctacgacgataaaaggattttatctgtaagcccggaattgttctttaagaagaaggatgaagtcttaacaactagaccaatgaagggaacaagcgctagaaagcctacttatcaagaagatgtggcggagcgagattggttggcaaatgatcctaaaaatcgttctgaaaatatgatgattgttgatttattaagaaacgatatgggccgtatctgtgatgttggaacagttaaggtaaaaaaactatgtcaagtggagcagtatgcaactgtgtggcaaatgacatcaactattgaaggagttttatcgccagaagtgacacttatgtctatttttcaagctctatatccttgtggatctatcactggagctcctaagatatcaacaatggctattattaatgagttggaaaaacggccaagaggtatttattgtgggacgataggactttgcatgccagacggacaagctatttttaacgttcctattcgcacagtacaaatgaaaggtcaacaagcctattacggcgttggtggaggtattacgtgggagagccagacagattctgaatatgaagaaacccgtcaaaaatcagctgttttaacacgtgtcaatccaaaatttcaattaataactacaggaagagtgactgaaaataaacttcttttctctcaacaacatgtcgagagattagttgaatcagcgtcttattttgcttattcttttgataaaagtaaattcgaaagggaactgaaaaaataccttcatcagctagatgagaaggattaccgcttgaaaataatgcttgataaaactggtaaggtaacgtttgaggtaaaacaactagtgaatttatcaaaaaagtttttaacggcagaggtggtcgtacaagactaccctattaaattatccccgtttacttattttaaaacttcttatcgcccacatattattgaaggtcagaatgaaaagatatttgtatctcctgaggggttgctattggaaacaagtattgggaatattgttttagaaaaaaatggaaggtttttaaccccagatttatcagaaggagggttgaatgggatttatcgtcgtcatctccttaaaaaccaaaaagtaattgaagcaccactaactttaaaagatttagaatcagccgatgctatatacgcctgtaatgctgttagagggctttatcctctaaacctaaag

SEQ ID NO: 26 - protein, 571 aa, Streptococcus agalactiae
MHIETVIDFKELGKRYRFKNPTKELIADTLEQVLEVIKEVDYYQSQNYYVVGYLSYEASAAFDSHFKVSQQKLAGEHLAYFTVHKDCENEAFPLSYENVRLADNWTANVSEQEYQEAIANIKGQIRQGNTYQVNYTLELSQQLCSDPFSVYERLMVEQGAGYNAYIAYDDKRILSVSPELFFKKKDEVLTTRPMKGTSARKPTYQEDVAERDWLANDPKNRSENMMIVDLLRNDMGRICDVGTVKVKKLCQVEQYATVWQMTSTIEGVLSPEVTLMSIFQALYPCGSITGAPKISTMAIINELEKRPRGIYCGTIGLCMPDGQAIFNVPIRTVQMKGQQAYYGVGGGITWESQTDSEYEETRQKSAVLTRVNPKFQLITTGRVTENKLLFSQQHVERLVESASYFAYSFDKSKFERELKKYLHQLDEKDYRLKIMLDKTGKVTFEVKQLVNLSKKFLTAEVVVQDYPIKLSPFTYFKTSYRPHIIEGQNEKIFVSPEGLLLETSIGNIVLEKNGRFLTPDLSEGGLNGIYRRHLLKNQKVIEAPLTLKDLESADAIYACNAVRGLYPLNLK

SEQ ID NO: 27 - DNA, 1761 bp, Streptococcus pyogenes
ttgggtatgcatagaaaaactattattgatttcaaagagctcgggcaacgctatctttttgatgagccattagtagaattggtagccaagtccttagatcaggtcggtccagtcattgaaaaagtacaacactaccaacagctgggctattacgtggtgggctatctcagttatgaagcagctgctttttttgacaatgccctacaaacccataatgacagactaggcaacgagtaccttgcctattttacagtgcacaaaacctgtcaaaaaaaagacctacctcttgattatgacagcattactatccctaaccaatgggtcagcgcaactcaaaaagaagcctatcaaaaagccattgaaaccattcaccgtgagatgcaacagggcaatacttatcaggttaactacacccttcaattaactcaggaactcaatgcagctgatagtttagccatttacaataaactcgtcgttgaacaggctgctggctacaatgcctacatcgcccatgatgagtttgccgttatttcagctagtcctgaattgttctttaaacaagagggcaacaggttaactactaggcctatgaaaggcaccaccaaacgaggggttaatagctggctggatcaacaagaacatgactggctccaagctgacgggaaaaaccgttctgaaaacatgatgattgtggatttgctccgcaatgacatggggaaaatttgccaaacaggcagtgttcgtgttgataggctctgtgaggtcgagcgatactctaccgtctggcaaatgacctcaactattgttggtgacctcaaagcggactgtgacctgatagacattctcaaagctctctttccttgtggctctatcacaggggcaccaaaagtctccaccatggcaattatcacatctctggagccaaaaccaagggggatttattgtggaagtattggcatttgcctacctgatggtcgccgtttcttcaatgttcccattagaaccatccagctcagtcataatcaagctacttatggtgtcggaggcggcatcacttggcaaagcaagtgggaagacgaatacgaggaagtccatcaaaaaacagcttttctctatcggcacaaacaaatctttgacctcaaaacaaccgccaaggtggaacacaaaaaaatagccttccttgagcaacacctcaatcgccttaaagaagcagccacttattttgcttacccttataatgaaaaagctttgcagaaacaactgtcaacctatttggaaaataagaataatgctgcctaccgtttgatgattcgtttatccaaagatggaaagattagcctctctgatcaacccttggaacctttgtcagccgattttctgacagctcaactctctttacagaaaaaggacgtgacagcttcgccttttacctactttaagaccagctaccggcctcatattgagcaaaaatcttatgaacagctattctataaccaagcggggcaattattggaaacgtccattggcaatctctttgttcagctgggtcagaccctctacacaccaccagtggctgtggggattttaccaggactttttcgccaagaactgctagctactggtcaagctcaggaaaaagaggtgacactagctgatttaaaagaggctagcgctatttttggaggaaatgctgtccgtggcctttatcctctcaaccttgagcttactcaccttgatgccctcttagctaagagtcaagcc

SEQ ID NO: 28 - protein, 587 aa, Streptococcus pyogenes
LGMHRKTIIDFKELGQRYLFDEPLVELVAKSLDQVGPVIEKVQHYQQLGYYVVGYLSYEAAAFFDNALQTHNDRLGNEYLAYFTVHKTCQKKDLPLDYDSITIPNQWVSATQKEAYQKAIETIHREMQQGNTYQVNYTLQLTQELNAADSLAIYNKLVVEQAAGYNAYIAHDEFAVISASPELFFKQEGNRLTTRPMKGTTKRGVNSWLDQQEHDWLQADGKNRSENMMIVDLLRNDMGKICQTGSVRVDRLCEVERYSTVWQMTSTIVGDLKADCDLIDILKALFPCGSITGAPKVSTMAIITSLEPKPRGIYCGSIGICLPDGRRFFNVPIRTIQLSHNQATYGVGGGITWQSKWEDEYEEVHQKTAFLYRHKQIFDLKTTAKVEHKKIAFLEQHLNRLKEAATYFAYPYNEKALQKQLSTYLENKNNAAYRLMIRLSKDGKISLSDQPLEPLSADFLTAQLSLQKKDVTASPFTYFKTSYRPHIEQKSYEQLFYNQAGQLLETSIGNLFVQLGQTLYTPPVAVGILPGLFRQELLATGQAQEKEVTLADLKEASAIFGGNAVRGLYPLNLELTHLDALLAKSQA

SEQ ID NO: 29 - DNA, 831 bp, Streptococcus agalactiae
atggtcacaggaggattccgactagacctcttacttgagataactaagatagctcgtgcaacttactattatcaactaaagaaactgaataaaccaaataaagacaaagcaatcaaatctgacattcaatccatttatgatgaacatagaggaaactatggctatcgtcggatttatttagaactgcgaaatcgtggctttgtcatcaaccacaaaagggtgcaaggcttgatgaaaagtatgggcttgactgctcgtattcgtcgtaagcgcaagtatgcctcttacaaaggtgaggttggtaagaaggctgataacctgattcaacgccagtttgaggggtcgaagccctatgagaagtgctataccgatgtgacggagtttgctttacctgaagggaaactttatctatcgcctgttcttgatggctataacagtgagataattgattttaccctgtctcggtctcctgacttgaaacaggttcaaaccatgcttgagagggcttttcctgcggcttcatacagcgaaaccattctccacagcgaccaaggctggcagtaccagcacaagtcctaccatcaatttctggaggacaaaggcattcgtccttctatgtcacggaaggggaacagtcctgacaacggtatgatggaatctttctttgggattctaaaatctgagatgttctatggcttggagaagtcttacaaatcacttgatgaccttgagcaagctatcacagattacattttttactacaacaacaagcgaatcaaagcaaaactaaaaggacttagtcctgtgcaatacagaactaaatccttcact

SEQ ID NO: 30 - protein, 277 aa, Streptococcus agalactiae
MVTGGFRLDLLLEITKIARATYYYQLKKLNKPNKDKAIKSDIQSIYDEHRGNYGYRRIYLELRNRGFVINHKRVQGLMKSMGLTARIRRKRKYASYKGEVGKKADNLIQRQFEGSKPYEKCYTDVTEFALPEGKLYLSPVLDGYNSEIIDFTLSRSPDLKQVQTMLERAFPAASYSETILHSDQGWQYQHKSYHQFLEDKGIRPSMSRKGNSPDNGMMESFFGILKSEMFYGLEKSYKSLDDLEQAITDYIFYYNNKRIKAKLKGLSPVQYRTKSFT

SEQ ID NO: 31 - DNA, 804 bp, Streptococcus pyogenes
atgctacttgaaatccttgatttatcacgctccacctattactatcaagtgaagcgactagctcaaggagataaggatatagaactaaagcatgtgattcgagagatttatgatgagcataaaggtaattacggttatcgtcggattcatatggagttgcgtaaccgaggatttgtggtcaatcataagaaagttcaacgtctcatgaaagtcatgggcttagcagcccgcattcgtcggaagcgcaagtattcttcttacaaaggagaggttggtaagaaggctgataatctgattaaacgtcacttcgaaggctctaaaccttacgaaaaatgttacactgatgtgacggagttggccttacctgaaggaaaactctacttatcacctgttcttgatggctataacagtgagattattgatttcactctatctcggtctcctaacttgaaacaggttcaaaccatgcttgagaagacttttccagcagattcatacagcggaactattcttcatagtgaccaggggtggcaataccaacaccagtcctaccatgattttttagagtctaaaggtattctggcatccatgtcccgcaaagggaatagtccggataacggcatgatggaatccttctttggcattctcaaatctgaaatgttttatggactcgagacaacttatcaatcacttgacaagcttgaagaagctattacagattacattttttactacaacaacaaacgaattaaagcaaaactaaaaggatttagtcctgtccaatacagaactaaatcctttcaa

SEQ ID NO: 32 - protein, 268 aa, Streptococcus pyogenes
MLLEILDLSRSTYYYQVKRLAQGDKDIELKHVIREIYDEHKGNYGYRRIHMELRNRGFVVNHKKVQRLMKVMGLAARIRRKRKYSSYKGEVGKKADNLIKRHFEGSKPYEKCYTDVTELALPEGKLYLSPVLDGYNSEIIDFTLSRSPNLKQVQTMLEKTFPADSYSGTILHSDQGWQYQHQSYHDFLESKGILASMSRKGNSPDNGMMESFFGILKSEMFYGLETTYQSLDKLEEAITDYIFYYNNKRIKAKLKGFSPVQYRTKSFQ

SEQ ID NO: 33 - DNA, 534 bp, Streptococcus agalactiae
atgaaattaagttatgaagataaactagaaatatacgagttaagaaagatcgggatgtcctggtctcagattagtcaacgatatgatgttcgtatctcgaatcttaaatacatgataaaactcatggatcggtatggtgtagaaatcgtcgaaaaaggtagaaatgagtattatccacctgaattaaagcaggaaatgatagataaagtcttgattcatggttgttctcaactctctgtttctcttgattatgctctctctaattgttctatactcacaaattggctttcccaatttaagaaaaatggttatactattgttgagaaaacaagagggagaccgagtaaaatgggacgtaagcgtaagaaaacttgggaagaaatgacagagctcgagcgacttcaggaagaaaatgagcgcttgagaacggagaatgcctttctaaaaaagttgagggatttgcgcttgagggacgaagccttacagagcgaacggcagaaacaattagagaaatggtcacaggaggattccgac

SEQ ID NO: 34 - protein, 178 aa, Streptococcus agalactiae
MKLSYEDKLEIYELRKIGMSWSQISQRYDVRISNLKYMIKLMDRYGVEIVEKGRNEYYPPELKQEMIDKVLIHGCSQLSVSLDYALSNCSILTNWLSQFKKNGYTIVEKTRGRPSKMGRKRKKTWEEMTELERLQEENERLRTENAFLKKLRDLRLRDEALQSERQKQLEKWSQEDSD

SEQ ID NO: 35 - DNA, 513 bp, Streptococcus pyogenes
atgaaatttaatcaagaaacgaaagttaagatttatgagttacggcaaatgggagagtccattaaatccatatcaaaaaagtttgatatggcagaatccgatctcaaatatatgattcgcttgattgataggtatggggtaaccattgttcaaaaatgtaagaatcattattattctccagaactgaagcaagagataataaataaagtcctgattgacggccaatctcagaaacaaacatccttagattatgctttaccaacttctagtatgctctcaaggtggatagcgcaatacaagaaaaacggttatactattcttgaaaaaccaagagggagaccgagtaagatggggcgtaaacgtaagaaaaatttggaagagatgacagaggttgaacgtcttcagaaggaattagaataccctagagcggagaatgctgtgctaaaaaagctgagagaataccgcttgagggacgaagcaaaactcaaagagcaacagaaatcattcaagcat

SEQ ID NO: 36 - protein, 171 aa, Streptococcus pyogenes
MKFNQETKVKIYELRQMGESIKSISKKFDMAESDLKYMIRLIDRYGVTIVQKCKNHYYSPELKQEIINKVLIDGQSQKQTSLDYALPTSSMLSRWIAQYKKNGYTILEKPRGRPSKMGRKRKKNLEEMTEVERLQKELEYPRAENAVLKKLREYRLRDEAKLKEQQKSFKH

SEQ ID NO: 37 - DNA, 903 bp, Streptococcus agalactiae
ttgaaaaatcaacaaaaattaatgtatctagagagtatcgagctatactcaaacatcactaaagccgctgcacacctttttatttctcaaccttacctaagcaaagtgatcaagcaattagaaaatgagttagaaataaaactcatccagagccaaggacaccaaacctttttaacttatgctggacagagatatctattctacctaaaagaaattgatatgattgagcgtcaaatggccaaagaactatatctcatccgttctgataaaaaaggagaaatcacacttgggattaactctggcttagcaagttctattctggcaaatgtacttcccaaatttaacttggagcacccagaaatttctgtcaaattactcgaaaacaatcaaaatatttctgaacaattggtagcgagtggtgatattgacctagctgttgggatggctcctatcctttataaagatggaattgcatcaaccactatttaccgcgacgaattgtttttaatgatacctaccaccagccaactctacaacgctgaaaaacgtggacagattattccttttgaatatcctatttcagttctagacaatgaacctcttatcctaacaccattagagtacggaattggcaaaacaattgcacaattctatgagcttcatcacatgtcattaaatcagatgattacaactagtaccgttcctacagcagctagcctatctttgtcagggatgggagcaacatttgttccacaaactctcattcatcgctatttggataaagagtgcaatgtctaccattttcataagaataagttattttcagagtacattatgatttataaaaaagatgttgaattatctggaattgctctcctactttataaagcttttttaaccaag

SEQ ID NO: 38 - protein, 301 aa, Streptococcus agalactiae
MKNQQKLMYLESIELYSNITKAAAHLFISQPYLSKVIKQLENELEIKLIQSQGHQTFLTYAGQRYLFYLKEIDMIERQMAKELYLIRSDKKGEITLGINSGLASSILANVLPKFNLEHPEISVKLLENNQNISEQLVASGDIDLAVGMAPILYKDGIASTTIYRDELFLMIPTTSQLYNAEKRGQIIPFEYPISVLDNEPLILTPLEYGIGKTIAQFYELHHMSLNQMITTSTVPTAASLSLSGMGATFVPQTLIHRYLDKECNVYHFHKNKLFSEYIMIYKKDVELSGIALLLYKAFLTK

SEQ ID NO: 39 - DNA, 918 bp, Streptococcus pyogenes
ttgataagacaaggagaatcctatttggatattaaacaaattcgttattttatcgcaatcgttgaaaatcattttaacttgagccaggcggcggaactgttgtatgtgtcgcagccgacacttagcatgatgatcaatgattttgaaaaaagagaaaatgttaagctcttcaaacgaaaaagaggtcgtattattgggttaacctatcttggtgataattattataaggacgctcaaaaggttctcagtctctatgatgacatgtttttgaaattgcatgatcacagtaaagggttaaagggaagtatcaatattggtattcctcctcttattttatcagttgttttctcagaagtaatgccaaaactgattttagaaaatccggggattcaattcaatgttaaggagattggtgcttaccaactaaaaaatgaactactcgtgggaaatgttgacgtcgcagtcttgttatccccaacaggcatcgctgataatttggttgagacttatgaaatccagagatcagaattatctgtatgcctgtctccacgccatcgtttagcttccaaaaaagttattcagtgggaagatttaacagatgaacaacttgccctatttgatcctagtttcatggttcaccatttagtgcttgaagcttgcgagcgtcaccaagtcagacctaatattattttgacgtcctcttcctgggattttatgcttaattctaccaagattaatcacaacgtcttaactatttgtcccaaacctattacagaattataccaattaaaggacattaagtgtattccaatggaacgtcccatttcttggcgtgttgtcttaacacgcctccggaaaaaaagttattctgaaatagaagcctacatcatggacgacttgctacagtctttttttaag

SEQ ID NO: 40 - protein, 306 aa, Streptococcus pyogenes
LIRQGESYLDIKQIRYFIAIVENHFNLSQAAELLYVSQPTLSMMINDFEKRENVKLFKRKRGRIIGLTYLGDNYYKDAQKVLSLYDDMFLKLHDHSKGLKGSINIGIPPLILSVVFSEVMPKLILENPGIQFNVKEIGAYQLKNELLVGNVDVAVLLSPTGIADNLVETYEIQRSELSVCLSPRHRLASKKVIQWEDLTDEQLALFDPSFMVHHLVLEACERHQVRPNIILTSSSWDFMLNSTKINHNVLTICPKPITELYQLKDIKCIPMERPISWRVVLTRLRKKSYSEIEAYIMDDLLQSFFK

SEQ ID NO: 41 - DNA, 1212 bp, Streptococcus agalactiae
atggccaatgcatctttgcgacatcaattatttgaaaaacttgaccaaaaatgtgatcaaatggttgctattcgtcgctatttacatgaaaatcccgaattatcatttaaagagacaaaaacagcagcttatatttcagatttttataaaggtaaggactgtcatgttcagacacaatttggtggtatgaatggcgtcgtagttgatatctatggtgataaagcgacagataagcccatcaaacacattgctttgagagccgactttgatgctcttccaattcaggaagagacagggctttcttttgcttcaaaaacagcgggcgtcatgcatgcttgtggacatgatgcccatacagcttatttattgattttggctgagagcttgattgaattaaaatcagaattttcaggtcatatccgtatcttacatcaaccggctgaagaggtgccaccaggcggagcaaaagcaatgattgaagcaggatgtttagatggcattgatgctgtccttggtatccatgttatgtcaacgatggaagagggaacggtacaatatcacgcaggtcccattcaaacagggcgtgccacttttaaagttattttgcaaggtaagggtggacatggttccatgccacatcgtgcaaatgatacaattgttgcagcttctagttttgttatggcagcgcaaacgattgtcagtcgtcgagttaatccatttgacacagcagtagttactatcggatcttttgatggtaaaggttctgctaatgtgatcaaagatagtgtaaccttagaaggtgatgtgcgcgtgatgtctgaagagacacgaggtgttgttgaggaggaatttaagcgtattctagatggaatagcacaaacttatggtgttagttatcagttagactatcagaatgattatcctgttttagttaataacagtgaagtgacacagaaagttgcaaatagtttaaaatctgttgctataaaagaaattttagatgtcattgattgcgaccctcaaacgccgtctgaagattttgcctattatgctcaaacaatcccagcttgcttcttctatgttggagcacatgaagaggggcaaccatattacccacatcatcatccaaaattccaaattgcagaatcatcattgatggtatctgctaaatcaatggcaacagcagcgcttgctatgcttgtagaaggagaa

SEQ ID NO: 42 - protein, 404 aa, Streptococcus agalactiae
MANASLRHQLFEKLDQKCDQMVAIRRYLHENPELSFKETKTAAYISDFYKGKDCHVQTQFGGMNGVVVDIYGDKATDKPIKHIALRADFDALPIQEETGLSFASKTAGVMHACGHDAHTAYLLILAESLIELKSEFSGHIRILHQPAEEVPPGGAKAMIEAGCLDGIDAVLGIHVMSTMEEGTVQYHAGPIQTGRATFKVILQGKGGHGSMPHRANDTIVAASSFVMAAQTIVSRRVNPFDTAVVTIGSFDGKGSANVIKDSVTLEGDVRVMSEETRGVVEEEFKRILDGIAQTYGVSYQLDYQNDYPVLVNNSEVTQKVANSLKSVAIKEILDVIDCDPQTPSEDFAYYAQTIPACFFYVGAHEEGQPYYPHHHPKFQIAESSLMVSAKSMATAALAMLVEGE

SEQ ID NO: 43 - DNA, 1380 bp, Streptococcus agalactiae
atgttaacgacaaaggaaaatttcaaaggaaataacaaattattggtgggaattgtactcgctgtactatcattttggttatttgcacagtctattttaaacatgggaccagatgttcagtcatcattaggtatttcatctggtgcaatggatattggtgtctcaagtacggcattgttttcaggtttatttattgttgtaactggtggtttagcagataaacttggtcgagttaaatttacttttattggtctttgcttaaatattattggttctctactaattgttttagctaatggagcagtgctatttattatgggacgtatttttcaaggattggcagcagcttttattatgccatcaacaatggccttggttaaaacgtactatgatggtaaagatagacaacgtgcagttagtttctggtcaatcggatcgtggggtggctcaggtctatgttcttattttggtggagcggtggcaagtactctaggttggcgttatgtctttatcttttcaatcatcgcatcagtagttagttttctattaattttaggaaccccagaaagtaaaaatgttggacaaaaaactcactttgattaccttggtttaattatttttattatttcaatgttatcgttaaatattgggatatctatggctcaggaacatggattgatgaacgttattccattgagtctttttacagtgatgcttattggatttgttctgttttattatgttgaaacacgtaaatctaatagttttattgactttcatctgtttgaaaatcgattttacttaggtgcgacaatatcaaatttcttactgaatgcagttgcaggaactctgattgttattaatacttacatgcaacaaggtcgccagctaacaccaaaggttgcaggtgaaatgtctttaggctatttggtttgtgtactaattgctatccgagttggtgagaaaattttacaacgttttggtgcccgtaagccaatgcttttgggagctatgagtacatttgttgggatatttttaatgactttggtcaatattcaaggacctttgtatcttgtgttagtctttgttggttatgctttatttggaacaggcttggggatctatgcgacaccatcaacagatacagctatttctagtattcctaatgaaaaagtaggttctgcatctggaatttacaaaatggcaagttcactaggtggtgcaattggtgtagcaacttcaattgcgatttatcatgctttttctggtaatgcagattttcacaaagcagctttgtgtggattaattttaaacctagttttttgtagtctatcgatcttatcaattctttttgttatccctaagaaaattgaggataaa

SEQ ID NO: 44 - protein, 460 aa, Streptococcus agalactiae
MLTTKENFKGNNKLLVGIVLAVLSFWLFAQSILNMGPDVQSSLGISSGAMDIGVSSTALFSGLFIVVTGGLADKLGRVKFTFIGLCLNIIGSLLIVLANGAVLFIMGRIFQGLAAAFIMPSTMALVKTYYDGKDRQRAVSFWSIGSWGGSGLCSYFGGAVASTLGWRYVFIFSIIASVVSFLLILGTPESKNVGQKTHFDYLGLIIFIISMLSLNIGISMAQEHGLMNVIPLSLFTVMLIGFVLFYYVETRKSNSFIDFHLFENRFYLGATISNFLLNAVAGTLIVINTYMQQGRQLTPKVAGEMSLGYLVCVLIAIRVGEKILQRFGARKPMLLGAMSTFVGIFLMTLVNIQGPLYLVLVFVGYALFGTGLGIYATPSTDTAISSIPNEKVGSASGIYKMASSLGGAIGVATSIAIYHAFSGNADFHKAALCGLILNLVFCSLSILSILFVIPKKIEDK

SEQ ID NO: 45 - DNA, 1365 bp, Streptococcus pyogenes
atgtcacatcatcaacaaaccgtttcaaaacaaacaattatggcgattatcgccatagcactcattggtttttcaggaattttgtctgaaaccagtatgaatgtcaccttcccgacactgatgtcagtctatcagttacccttaaatagcttgcaatggatgacgaccatttatttactagcagtggcgattatgatgaccacttcggctacactgaaaaaaaatgtgcgggaaagacccctcttttttatggccacaggtctttttacatttggcaccatcttggccgttctgacccagtcctttgcgatcatgttgctagcccgcatttttcaaggcattggtactggtctggtaatgcctcagatgtttaatattattttagagcgtgtcccaatgcataaggtaggtctatttatgggatttgctggtcttattattagcttagcacctgcttttgggcctacttatgggggctttatgattagccattttagttggcaatggatttttatctgtatactccctgtaccactgattgcaggtattctagcttattattacctcgaagattctccagtaagcgaaaaagtaccctttgactggttggcatttattgcactatcgattagcttaacttctgccttattagctattactagtctagaaaacggcagtgttaatttgtattacttagggctttttattctcagctttatcctcttcctctacaagaatctcacagctaagcaaccctttcttgatattcgcattctcaaaattccctctctaacctttggcctgattcccttttttgtcttccagctgattaatttaggcataaattttctaacgccaaactttattgtcatggaaaagattgctaatagttctcaagctggtatggtgttactacctggtaccttactcggagctctactagcacctgcttttggtaaactttatgatcaaaaaggagcaagactttcgctttatttaggaaatgccttatttagtttatcattgattattatgacacttcaaacaagacattttatgcttttaccattcactcttttatatattttattcacgtttgggcgtaacatgggctttaataatagcttagccacggctattcgagaattgcctgccgagaaaaatgccgatgccacggccatttttcagatgatgcagcaatttgctggcgctctaggaactgctatggcatcactgatagcaaatagtcaagcagaattcacaagcggtgtccagtctgtctaccttctctttactatttttgctctacttgattttatctttttctttgctatgttttaccatttagggaaaaaaggattagcc

SEQ ID NO: 46 - protein, 455 aa, Streptococcus pyogenes
MSHHQQTVSKQTIMAIIAIALIGFSGILSETSMNVTFPTLMSVYQLPLNSLQWMTTIYLLAVAIMMTTSATLKKNVRERPLFFMATGLFTFGTILAVLTQSFAIMLLARIFQGIGTGLVMPQMFNIILERVPMHKVGLFMGFAGLIISLAPAFGPTYGGFMISHFSWQWIFICILPVPLIAGILAYYYLEDSPVSEKVPFDWLAFIALSISLTSALLAITSLENGSVNLYYLGLFILSFILFLYKNLTAKQPFLDIRILKIPSLTFGLIPFFVFQLINLGINFLTPNFIVMEKIANSSQAGMVLLPGTLLGALLAPAFGKLYDQKGARLSLYLGNALFSLSLIIMTLQTRHFMLLPFTLLYILFTFGRNMGFNNSLATAIRELPAEKNADATAIFQMMQQFAGALGTAMASLIANSQAEFTSGVQSVYLLFTIFALLDFIFFFAMFYHLGKKGLA

SEQ ID NO: 47 - DNA, 615 bp, Streptococcus agalactiae
  misc_feature (1)..(615): n = a, c, g, or t
atgagtttatccatcatgacaaaacacaaacacctaactctcttagaccgtaatgacatccaatctggtttggatagaggagaaacctttaaagccatcgggcttaatctactgaaacaccctactactatcgcaaaagaagtcaaacgaaataagcaactaagagaatcaaccaaagactgcctagactgtccgctactaagaaaagctccctatgtttgtaatgggtgtccaaagaggaggatcaactgtggttacaagaagaccttctatcttgctaagcaagctcaaagaaactatgaaaaacttttagttgaatctagagaaggaatccctttgaacaaagagaccttctggaaaatagatagagtgctttctaatggggtcaagaagggccaacgtatctatcatatcctcaaaaccaacgatctagaagtgagttcttcaaccgtttatcgacacatcaagaaaggctacctatccatcacaccaatcgacctacccagagctgtgaagttcaaaaaaaggcgaaagagcacactccctcctattccaaaagcgattaaagaagggcgacggtacgaggattttatagaacacataacnnnnnttaat

SEQ ID NO: 48 - protein, 205 aa, Streptococcus agalactiae
  MISC_FEATURE (1)..(205): Xaa = Any Amino Acid
MSLSIMTKHKHLTLLDRNDIQSGLDRGETFKAIGLNLLKHPTTIAKEVKRNKQLRESTKDCLDCPLLRKAPYVCNGCPKRRINCGYKKTFYLAKQAQRNYEKLLVESREGIPLNKETFWKIDRVLSNGVKKGQRIYHILKTNDLEVSSSTVYRHIKKGYLSITPIDLPRAVKFKKRRKSTLPPIPKAIKEGRRYEDFIEHITXXN

SEQ ID NO: 49 - DNA, 423 bp, Streptococcus agalactiae
atggctaaaaaagttgaaaaacttgtaaaacttcaaattcctgctggtaaagcaactccagctccaccagttggaccagcacttggtcaagcaggaatcaacatcatgggattcactaaagagtttaacgctcgtacagctgatcaagctggtatgattattccagttgttatctcagtatatgaagacaaatcatttgatttcatcactaaaacaccaccagctgctgttcttttgaaaaaagctgcaggtgttgaaaaaggatcaggtgaacctaacaaaactaaagttgcaacaattactcgtgcgcaagtacaagaaattgctgaaactaaaatgccagatttaaacgctgcaaaccttgagtctgcaatgcgtatgatcgaaggtactgctcgttctatgggattcactgttactgac

SEQ ID NO: 50 - protein, 141 aa, Streptococcus agalactiae
MAKKVEKLVKLQIPAGKATPAPPVGPALGQAGINIMGFTKEFNARTADQAGMIIPVVISVYEDKSFDFITKTPPAAVLLKKAAGVEKGSGEPNKTKVATITRAQVQEIAETKMPDLNAANLESAMRMIEGTARSMGFTVTD

SEQ ID NO: 51 - DNA, 495 bp, Streptococcus pyogenes
atgcaatattgcatatctgtgggaggtaaaaatctcaattaccgccaaaaccacaacaggaggatttttaaaatggctaaaaaagtcgaaaaacttgtaaaacttcaaatccctgctggtaaagctacaccagctccaccagttggaccagctcttggtcaagcaggtatcaacatcatgggcttcactaaagaatttaacgctcgtacagctgatcaagctggtatgatcatcccagttgttatctcagtttatgaagacaaatcatttgatttcatcactaaaacaccaccagctgctgttcttttgaaaaaagctgcaggtgttgaaaaaggatcaggtacacctaacactactaaggttgcgacagttactcgtgcacaagtacaagaaattgctgaaactaagatgccagatttgaacgctgcaaacattgaagctgcaatgcgtatgatcgaaggtactgctcgttctatgggattcactgttactgac

SEQ ID NO: 52 - protein, 165 aa, Streptococcus pyogenes
MQYCISVGGKNLNYRQNHNRRIFKMAKKVEKLVKLQIPAGKATPAPPVGPALGQAGINIMGFTKEFNARTADQAGMIIPVVISVYEDKSFDFITKTPPAAVLLKKAAGVEKGSGTPNTTKVATVTRAQVQEIAETKMPDLNAANIEAAMRMIEGTARSMGFTVTD

SEQ ID NO: 53 - DNA, 687 bp, Streptococcus agalactiae
atggctaaaaaaagtaaaaacttacgtgctgctcttgagaaaattgatagcactaaagcatacagcgtagaagaagctgtagctcttgcaaaagaaactaactttgctaaatttgatgcaactgttgaagtttcttataaccttaacattgacgttaaaaaagctgaccaacaaatccgtggtgctatggttttaccagcaggtactggtaaaacttcacgtgttcttgtttttgctcgtggtgctaaagctgaagaagctaaagcagcaggtgcagactttgtcggtgaagatgacttagttgctaaaatccaaggtggatggcttgactttgatgttgttatcgcaacaccagatatgatggcacttgttggacgtcttggacgtgtccttggacctcgtaacttgatgccaaaccctaaaactggtacagtaactatggacgttgctaaagcagttgaagagtctaaaggtggtaaaattacttaccgtgctgataaagcaggtaacgtccaagcccttattggtaaagtttcatttgatgatgctaaattagttgataacttcaaagcatttaatgatgttattgttaaagctaaaccagctactgcaaaaggaacttacatcacaaacctttcaattacaacaacacaaggtgttggtatcaaagttgatcctaactcactt

SEQ ID NO: 54 - protein, 229 aa, Streptococcus agalactiae
MAKKSKNLRAALEKIDSTKAYSVEEAVALAKETNFAKFDATVEVSYNLNIDVKKADQQIRGAMVLPAGTGKTSRVLVFARGAKAEEAKAAGADFVGEDDLVAKIQGGWLDFDVVIATPDMMALVGRLGRVLGPRNLMPNPKTGTVTMDVAKAVEESKGGKITYRADKAGNVQALIGKVSFDDAKLVDNFKAFNDVIVKAKPATAKGTYITNLSITTTQGVGIKVDPNSL

SEQ ID NO: 55 - DNA, 687 bp, Streptococcus pyogenes
atggctaaaaaaagcaaacaaatgcgtgctgcacttgaaaaagtagatagcacaaaagcgtacagtgtagaagaagctgtagcattagtaaaagaaacgaacttcgcaaaatttgatgcgtctgttgaagttgcttacaacttgaacattgacgttcgtaaagcagaccaacaaatccgtggcgcaatggtattgccaaacggaactggtaaaacacaacgtgttcttgtttttgcacgtggtgcaaaagctgaagaagcaaaagcagctggtgcagacttcgtaggtgaagacgaccttgttgcaaaaatcaatggtggatggcttgactttgacgttgttatcgcaacgccagacatgatggctatcgtaggtcgtcttggacgtgtccttggacctcgtaacttgatgccaaaccctaaaactggtacagtaacgatggatgttgctaaagccgttgaagagtctaaaggtggtaaaatcacttaccgtgctgacaaagcaggtaatgttcaagctcttattggtaaagtttcatttgatgctgacaaattggttgaaaacttcaaagccttccacgatgtaatggctaaagctaaacctgcaacagctaaaggaacttacatggcaaacgtctcaatcacatcaacacaaggtgttggtatcaaggttgatcctaactcactt

SEQ ID NO: 56 - protein, 229 aa, Streptococcus pyogenes
MAKKSKQMRAALEKVDSTKAYSVEEAVALVKETNFAKFDASVEVAYNLNIDVRKADQQIRGAMVLPNGTGKTQRVLVFARGAKAEEAKAAGADFVGEDDLVAKINGGWLDFDVVIATPDMMAIVGRLGRVLGPRNLMPNPKTGTVTMDVAKAVEESKGGKITYRADKAGNVQALIGKVSFDADKLVENFKAFHDVMAKAKPATAKGTYMANVSITSTQGVGIKVDPNSL

SEQ ID NO: 57 - DNA, 1623 bp, Streptococcus agalactiae
ttggtaaaaatgagacgtaacatattattgagcattacttgtttattgatggtgactctgactgcatgccattcacaggatagcaaaagtcataaactaaacagtgataaactcacgcttgcttggggagaagactttggtgatgttaatccgcatcgctataaccctgatcagtttgttatccaggatatggtttatgaggggttggtacgatatggtgacaatgggaaaattgaaccagctttagcgaaaagctggagcattagtcaagatggaaaaacctacacttttaaattgagaaatgctaaatattctgatggcagtaactttaatgctgcgaatgtcaaacgtaattttgatagtattttttcgaagtctaatagaggtaatcataattggtttaatttaacgaatcaattggaaaattatcgtgccttgaatcaaagtacttttgaaattaaactgaaacaagcttatagtgctactttatatgatctctctatgattcgaccaattcgctttttatctgatagcgctttccctaaaggtgatgatacaactaagaagaatgtaaaaaaaccaattggaacgggtcaatgggttgtgaaaagtaaaaagcaaaatgaatatattaccttcaaacgtaatgagaattactggggaaagaaaccaaaattaaaagaagtaaccgtaaaagttatacccgatgctcagacgcgtgctttagcattcgaatcaggtgacgttgatttgatctatgggaatggcattattggtttagacacttttgcccaatatacgaaggacaagaaatatgtcacagctatttctcaacctatgtcaacaagacttttgttgctaaatgctaaggaaagtattttccaagataaaaaagttcgtcaggcaatgaatcatgctattgacaaggtttctattgctaagaacacctttagaggaacagaaaagccagcagacactattttttcaaaatcaacatctcactcagatgctaagttaaatccttatagctataatgttgataaagcaaatcagctattggatcaagctggttggaagatgggaaaagataaggttcgtgaaaaagatggtaaaactctaaccttacgtcttccttatatcgccactaaggcaactgataaagacctggtaacttatttccaaggagaatggcgtaaaatcggtattaatgtttctcttattgctatggaagaagatgattattgggctaatgctaaaaagggtaattttgatatgatgttaacctattcttggggagcaccatgggaccctcatgcttggatgtcggcattaactgccaaggcagatcatggacatccagaaaatatagctttagaaaatctagcaactaaaactgaaatggatagacttattaagtcagctctagtagatcctaaggaagaaaatgttgatagagactataagaaggttcttgaattattgcatgatgaggctgtatatatcccattaacttatcaatcggtgatttctgtttataggaaaggtgattttaaaaccatgcgttttgcgccagaagaaaattcattcccattacgctatatagaaaaaaacaatgtatctaag

SEQ ID NO: 58 - protein, 541 aa, Streptococcus agalactiae
MVKMRRNILLSITCLLMVTLTACHSQDSKSHKLNSDKLTLAWGEDFGDVNPHRYNPDQFVIQDMVYEGLVRYGDNGKIEPALAKSWSISQDGKTYTFKLRNAKYSDGSNFNAANVKRNFDSIFSKSNRGNHNWFNLTNQLENYRALNQSTFEIKLKQAYSATLYDLSMIRPIRFLSDSAFPKGDDTTKKNVKKPIGTGQWVVKSKKQNEYITFKRNENYWGKKPKLKEVTVKVIPDAQTRALAFESGDVDLIYGNGIIGLDTFAQYTKDKKYVTAISQPMSTRLLLLNAKESIFQDKKVRQAMNHAIDKVSIAKNTFRGTEKPADTIFSKSTSHSDAKLNPYSYNVDKANQLLDQAGWKMGKDKVREKDGKTLTLRLPYIATKATDKDLVTYFQGEWRKIGINVSLIAMEEDDYWANAKKGNFDMMLTYSWGAPWDPHAWMSALTAKADHGHPENIALENLATKTEMDRLIKSALVDPKEENVDRDYKKVLELLHDEAVYIPLTYQSVISVYRKGDFKTMRFAPEENSFPLRYIEKNNVSK

SEQ ID NO: 59 - DNA, 1632 bp, Streptococcus pyogenes
ttgattgtgtcaaaatacctaaaatacttctctattatcacgttatttttgactgggcttattttagttgcatgtcaacaacaaaagcctcaaacaaaagaacgtcagcgcaaacaacgtccaaaagacgaacttgtcgtttctatgggggcaaagctccctcatgaattcgatccaaaggaccgttatggagtccacaatgaagggaatatcactcatagcactctattgaaacgttctcctgaactagatataaaaggagagcttgctaaaacataccatctctctgaagatgggctgacttggtcgtttgacttgcatgatgattttaaattctcaaatggtgagcctgttactgctgatgatgttaagtttacttatgatatgttgaaagcagatggaaaggcttgggatctaaccttcattaagaacgttgaagtagttgggaaaaatcaggtcaatatccatttgactgaggcgcattcgacatttacagcacagttgactgaaatcccaatcgtccctaaaaaacattacaatgataagtataagagcaatcctatcggttcaggaccttacatggtaaaagaatataaggctggagaacaagctatttttgttcgtaacccttattggcatgggaaaaaaccatactttaaaaaatggacttgggtcttacttgatgaaaacacagcactagcagctttagaatctggtgatgttgatatgatctacgcaacgccagaacttgctgataaaaaagtcaaaggcacccgcctccttgatattccatcaaatgatgtgcgcggcttatcattaccttatgtgaaaaagggcgtcatcactgattctcctgatggttatcctgtaggaaatgatgtcactagtgatccagcaatccgaaaagccttgactattggtttaaataggcaaaaagttctcgatacggttttaaatggttatggtaaaccagcttattcaattattgataaaacaccattttggaatccaaaaacagccattaaagataataaagtagctaaagctaagcaattattgacaaaagcgggatggaaagaacaagcagacggtagccgtaaaaaaggtgaccttgatgcagcgtttgatctgtactaccctactaatgatcaattgcgagcgaacttagccgttgaagtagcagagcaagccaaggccctagggattactattaaactcaaagctagtaactgggatgaaatggcaacgaagtcacatgactcagccttactttatgccggaggacgtcatcacgcgcagcaattttatgaatcgcatcatccaagcctagcagggaaaggttggaccaatattacgttttataacaatcctaccgtgactaagtaccttgacaaagcaatgacatcttctgaccttgataaagctaacgaatattggaagttagcgcagtgggatggcaaaacaggtgcttctactcttggagatttgccaaatgtatggttggtgagccttaaccatacttatattggtgataaacgtatcaatgtaggtaaacaaggcgtccacagtcatggtcatgattggtcattattgactaacattgccgagtggacttgggatgaatcaactaag

SEQ ID NO: 60 - protein, 544 aa, Streptococcus pyogenes
LIVSKYLKYFSIITLFLTGLILVACQQQKPQTKERQRKQRPKDELVVSMGAKLPHEFDPKDRYGVHNEGNITHSTLLKRSPELDIKGELAKTYHLSEDGLTWSFDLHDDFKFSNGEPVTADDVKFTYDMLKADGKAWDLTFIKNVEVVGKNQVNIHLTEAHSTFTAQLTEIPIVPKKHYNDKYKSNPIGSGPYMVKEYKAGEQAIFVRNPYWHGKKPYFKKWTWVLLDENTALAALESGDVDMIYATPELADKKVKGTRLLDIPSNDVRGLSLPYVKKGVITDSPDGYPVGNDVTSDPAIRKALTIGLNRQKVLDTVLNGYGKPAYSIIDKTPFWNPKTAIKDNKVAKAKQLLTKAGWKEQADGSRKKGDLDAAFDLYYPTNDQLRANLAVEVAEQAKALGITIKLKASNWDEMATKSHDSALLYAGGRHHAQQFYESHHPSLAGKGWTNITFYNNPTVTKYLDKAMTSSDLDKANEYWKLAQWDGKTGASTLGDLPNVWLVSLNHTYIGDKRINVGKQGVHSHGHDWSLLTNIAEWTWDESTK

SEQ ID NO: 61 - DNA, 942 bp, Streptococcus agalactiae
atgtatctaagtagttcgatcatcaaaaaaatattgtcagcttttttggcattgtttttcatatcacttctaacatttattcttatcaaactatcaacagttaattcagcagaaaattaccttcgtttatcaaaaataagtgttagtccagaagcgctaaaagaagcagagcactatttaggtttagataagccattatggaagcagtactggctgtggttccaaaaagcattaacaggagattttggatattcttatgtgctcaggttgccagtattagatttggttttacaacggtttttggctactttatttttaggcacgagtgccttcttgctaattgttaccatttctaccccgttaggtgtgtgggctggcttacatgaatctgctcggagtgatcacttgattcgatttttgagtttttctagtgtgtctatgccaaatttttgggttgcttacttgttgatgctgctattttcggcaaaattaaatcttctgcctgtttcaggaggtaacgatttacaaagtttaattttgccaagtattaccttaagtttttctaccgtaggtcaatacatagcccttattcgaaaagctattagtcaagaaaatagaagtttaaatgtggaaaatgcccgattaagaggagtaaaagaacgttatattgtcacacatcacctccttagaaatgccttacctgcgataatgacagcacttagcttgacttgggtttacttattaacaggatcaattattgttgaagaaattttttcatggaatggaataggacgtttatttgtgaccagtctaagaacttcagatcttccagtaatacaagcttgtatgctaatttttggaaccttatttttagctaataattttatgacacagtgttttatgaattgggttgatcctcggttacgaaagtcaagggagaaa

SEQ ID NO: 62 - protein, 314 aa, Streptococcus agalactiae
MYLSSSIIKKILSAFLALFFISLLTFILIKLSTVNSAENYLRLSKISVSPEALKEAEHYLGLDKPLWKQYWLWFQKALTGDFGYSYVLRLPVLDLVLQRFLATLFLGTSAFLLIVTISTPLGVWAGLHESARSDHLIRFLSFSSVSMPNFWVAYLLMLLFSAKLNLLPVSGGNDLQSLILPSITLSFSTVGQYIALIRKAISQENRSLNVENARLRGVKERYIVTHHLLRNALPAIMTALSLTWVYLLTGSIIVEEIFSWNGIGRLFVTSLRTSDLPVIQACMLIFGTLFLANNFMTQCFMNWVDPRLRKSREK

SEQ ID NO: 63 - DNA, 975 bp, Streptococcus pyogenes
gtgaaacgtactaccattattatcatctggaaaatcatcagatgtgtcacgcttatttttggggtatctgttttgaccttcgttttgttaaaacaatctccagtagatccagtcatggcaagtgtcaattatgacacatcactaacccctgctcagtacaaagcgattgctcaccactatggcttggataagccagctctagtccaatattttatttggttgaaaaatgtgatacagggagatttagggacctcgctcgtttatcggcaacctgttagtgatattattagatcacgggcaggtgcttctttcatacttatgggactctcttggatcttatcgggtcttattggatttatcttaggaacgttatccgctttccatcaagggaaattacttgaccgagttgtcaggtggttttcataccttcagatatcagtaccaacgttttggattggactcatttttttattaatcttttctgtccagctggggtggttcccgattggtatttcttccccgataggcactttgagtcaagatattacgttagctgatcgagttaagcaccttatgttacctgttttcacgctaagtattctaggcattgccaatgtcacccttcatacgagaactaaaatgatgtcggtgctttctagtgaatatgtcttatttgccagagcgcgtggggaaacacagtggcaaatttttaaacatcattgccttagaaatgctatcgtaccagctattacactgcatttttcctattttggagaattgtttggaggatctgttcttgctgagcaagttttctcatatcctggcttagggtctaccctcactgaagcaggacttaaaagtgatacaccgctccttctagctattgtgatgatagggacattatttgtttttgcgggcaatcttattgcggatattttaaatagcatcatcaatccacagttaaggagaaaagta

SEQ ID NO: 64 - protein, 325 aa, Streptococcus pyogenes
VKRTTIIIIWKIIRCVTLIFGVSVLTFVLLKQSPVDPVMASVNYDTSLTPAQYKAIAHHYGLDKPALVQYFIWLKNVIQGDLGTSLVYRQPVSDIIRSRAGASFILMGLSWILSGLIGFILGTLSAFHQGKLLDRVVRWFSYLQISVPTFWIGLIFLLIFSVQLGWFPIGISSPIGTLSQDITLADRVKHLMLPVFTLSILGIANVTLHTRTKMMSVLSSEYVLFARARGETQWQIFKHHCLRNAIVPAITLHFSYFGELFGGSVLAEQVFSYPGLGSTLTEAGLKSDTPLLLAIVMIGTLFVFAGNLIADILNSIINPQLRRKV

SEQ ID NO: 65 - DNA, 765 bp, Streptococcus agalactiae
ttgttagtgattagtgccatttttgcccctattctatctagctttgatccacaatacgtagatttatcacaaaaattattggctcccaataatgttcatttgttagggactgaccaattgggtagagatgtattatctcgcttgctttatggtgctagatattcactgtttttagctattattattagcttattggaattaacgattggtatgtttgtgggtcttattgttggttggtatcaaggaaagttagaaaacctctttttatggatagctaatattattttagcttttccgagctttttgctctctcttgcaaccgtgggaatcttaggtcatggtctagggaatttaatttttgcaattgtctttgtggaatgggtttactatgctaaattaatgaccaatttagttaagagtgcaaaaaaagagccttatgtgataaatgcgcaaattatgggactttcagtctggcatattttaagaaaacatatttttccttttgtgtatcagccaatcctcgttatggtccttatgaatataggaaatattattttaatgatttctggcttttctttcttagggattggtgtgcaacctaatgtcacagaatggggaatgatgttgcacgatgctagaggatattttaggacagctacttggatgatgttatctcctggaattgcgatttttttaacagtattttcctttaatactttaggcgatgccatagataaaaaagattggaaacgacaatggaacagt

SEQ ID NO: 66 - protein, 255 aa, Streptococcus agalactiae
MLVISAIFAPILSSFDPQYVDLSQKLLAPNNVHLLGTDQLGRDVLSRLLYGARYSLFLAIIISLLELTIGMFVGLIVGWYQGKLENLFLWIANIILAFPSFLLSLATVGILGHGLGNLIFAIVFVEWVYYAKLMTNLVKSAKKEPYVINAQIMGLSVWHILRKHIFPFVYQPILVMVLMNIGNIILMISGFSFLGIGVQPNVTEWGMMLHDARGYFRTATWMMLSPGIAIFLTVFSFNTLGDAIDKKDWKRQWNS

SEQ ID NO: 67 - DNA, 819 bp, Streptococcus pyogenes
atgatattgaaacgtcgaacgatggttttatggcaactgggtatcgccatttctctcattcttagtattctagccttaaacctttatttctataggacgcctttggaaaccaatgcagctttacgcaacctcgctccttccttaaaccatctttttgggacagatggtttaggtagggatatgtttgtcagaacgattaaagggctttatttctctttacaagtcggcttattaggcgcccttatgggagtctttcttgcgaccgtttttggagtgcttgcaggtctaggaaatagccttattgataaaataatagcctggttggttgatttgtttattggtatgcctcatttgatttttatgattctcatttcttttgttgttgggaaaggggctcaaggggttatcattgcaacagctgttacccattggccctctctagcaaggcttatccgcaatgaagtctatgatctaaagaataaagcctttgtccagctctctaaaagcatgggaaaaacgccttattatattgtgaggcatcatatcctgcctttgattgcttctcaaattttcattgggtttatcctcttatttccgcacgtcatcttgcatgaagcatccatgactttcttaggatttggcctttctgccgaacaaccttcggttggtatcattttgtcagaggcagctaagcatatctctcttggcaattggtggttggtgatttttccaggcctttatcttattttggttgtcaatgcctttgatactatcggagaatctttaaagaaactcttttaccctcaaacggatcatttt

SEQ ID NO: 68 - protein, 273 aa, Streptococcus pyogenes
MILKRRTMVLWQLGIAISLILSILALNLYFYRTPLETNAALRNLAPSLNHLFGTDGLGRDMFVRTIKGLYFSLQVGLLGALMGVFLATVFGVLAGLGNSLIDKIIAWLVDLFIGMPHLIFMILISFVVGKGAQGVIIATAVTHWPSLARLIRNEVYDLKNKAFVQLSKSMGKTPYYIVRHHILPLIASQIFIGFILLFPHVILHEASMTFLGFGLSAEQPSVGIILSEAAKHISLGNWWLVIFPGLYLILVVNAFDTIGESLKKLFYPQTDHF

SEQ ID NO: 69 - DNA, 798 bp, Streptococcus agalactiae
ttggaaacgacaatggaacagttagaaataagaaaattgtcattacagataggagaggtccctgtactaagagattttagttgtaaaatagatatgggagaatcgctaactattattggtgagagtggttcagggaaaaccctcttggcaaaattattggttggtcacattccacaaggtatgacagttagaggaaacatattttttaagggagttgatttaggtaaactaactgtaaagcagtggcagaaattaaggggacgagatattgcctatttagtgcaaaatcccatgtctatgtttaatccttttcaaaaaattgaagcgcatattttggaaacaatccttagtcatgagaaatgttcaaagagagtagccttatctaaagcgttagaatggatgaaacgtttaaatttagatgatgcgatatccctgttaaaaaaatacccttttgagcttagtggaggaatgctacaaagaattatgttagccactatattatctcttgatcctcaggtaatcatattagatgagccgacctcagcggttgattgtcataattgttctactatatcagctattttgcaggaattgcaaaataatggaaaaaccttgattactgtaacgcatgattatcagttagctagagacctggggggacaattattagttataagtgagggagaagttgttgaacagggacaaacccaagctattttaagcaatcctcaacataactatacgaaagcactgacagtgcaaatggagtatgaaggagatattcttaatgttggtttg

SEQ ID NO: 70 - protein, 266 aa, Streptococcus agalactiae
METTMEQLEIRKLSLQIGEVPVLRDFSCKIDMGESLTIIGESGSGKTLLAKLLVGHIPQGMTVRGNIFFKGVDLGKLTVKQWQKLRGRDIAYLVQNPMSMFNPFQKIEAHILETILSHEKCSKRVALSKALEWMKRLNLDDAISLLKKYPFELSGGMLQRIMLATILSLDPQVIILDEPTSAVDCHNCSTISAILQELQNNGKTLITVTHDYQLARDLGGQLLVISEGEVVEQGQTQAILSNPQHNYTKALTVQMEYEGDILNVGL

SEQ ID NO: 71 - DNA, 1068 bp, Streptococcus pyogenes
atgacaaaagaaaataatgtaatcttaactgccaaagatgtggtggtagaatttgatgtgcgtgatcgtgttttaacagctatccgtaacgtctcactggaacttgttgaaggagaagtccttgcttttgtaggggaatcaggctcaggtaaatctgttttaacaaagacctttacagggatgttggagtctaatggacgcattgctaatggttcaattgtctatcgtgggcaagaattgacagatttaaaaacaaataaagagtgggcaaagattcgcggctcaaaaatcgcaacgattttccaagacccaatgaccagtcttagtcccattaaaactatcggtagccaaatcacagaagtgattattaagcaccaaaaagtaagtcatgccaaagctaaagaaatggcccttgattacatgaataaagtgggtatcccaaatgccaaaaaacgctttgaagattacccatttgagtattcaggaggaatgcgtcaacgtattgttatcgctattgctttagcttgtcgcccagatattcttatctgtgatgagccaacaacagcccttgatgtgactattcaagctcaaatcgttgagttattgaagtcgcttcaacgagaatatcatttcaccattatctttattacgcacgatttaggtgttgtggcaagcattgcagataaagtggctgtcatgtatgcaggagaaattgttgaatttggaacagtcgaagagattttctatgatccaagacacccctatacatggagtttgctgtctagcttaccgcagttggcagatgaatctggtgaactttacgctattccaggaacgcctccatcactttattcaccaattatcggagatgcctttgcacttcgctcagaatatgctatggttttagactttgaaaaagcacctccggcgattaacgtatctgagactcattgggccaaaacatggcttttacacccagaggctccaaaagttcaaaaaccagaagtcattcaagatttgcatcaaaaaatcttaagaaaaatgtcacaacaggaggaaggaaatgtc

SEQ ID NO: 72 - protein, 356 aa, Streptococcus pyogenes
MTKENNVILTAKDVVVEFDVRDRVLTAIRNVSLELVEGEVLAFVGESGSGKSVLTKTFTGMLESNGRIANGSIVYRGQELTDLKTNKEWAKIRGSKIATIFQDPMTSLSPIKTIGSQITEVIIKHQKVSHAKAKEMALDYMNKVGIPNAKKRFEDYPFEYSGGMRQRIVIAIALACRPDILICDEPTTALDVTIQAQIVELLKSLQREYHFTIIFITHDLGVVASIADKVAVMYAGEIVEFGTVEEIFYDPRHPYTWSLLSSLPQLADESGELYAIPGTPPSLYSPIIGDAFALRSEYAMVLDFEKAPPAINVSETHWAKTWLLHPEAPKVQKPEVIQDLHQKILRKMSQQEEGNV

SEQ ID NO: 73 - DNA, 696 bp, Streptococcus agalactiae
atgaaggagatattcttaatgttggtttgtaatcatgtcggaaaaacatttggacgacaagaggttttaaaggactgtcattttcatcttaaaagaggagaaataattggtataatgggtaaaagtggcagtggtaaaagtagccttgcccgactcattataggactagatagtcctacttgtggttcgatatattttcaaggaaaaatttacacacctaaagatggtaaggcgcagattatccttgtttttcaagatgcgcttagttcggtcaatccatattttagtattgaggaaattttgaatgaagctttttatggaaaaaaaacaacttttgaattatgtcaaatattagaagcggtgggtttagatggaacttatctaaaatataaagctagacaacttagtggtggtcagctacagagagtttgtatcgctagagctttactcttaaagcctaaaattattatttttgatgaatccttaagtggattagacccagtaactcaaattaaaatgctacgtttattacaaaaaataaaacgccgttatgaattaagttttataatgatttctcatgaccctaaaatttgtcaagctatctgtaaccgggtctttctgataaaaaatggttatttagtagaagataatgaattcttgaagagagcgtgttctactaactgtttgaccaatctc

SEQ ID NO: 74 - protein, 232 aa, Streptococcus agalactiae
MKEIFLMLVCNHVGKTFGRQEVLKDCHFHLKRGEIIGIMGKSGSGKSSLARLIIGLDSPTCGSIYFQGKIYTPKDGKAQIILVFQDALSSVNPYFSIEEILNEAFYGKKTTFELCQILEAVGLDGTYLKYKARQLSGGQLQRVCIARALLLKPKIIIFDESLSGLDPVTQIKMLRLLQKIKRRYELSFIMISHDPKICQAICNRVFLIKNGYLVEDNEFLKRACSTNCLTNL

SEQ ID NO: 75 - DNA, 1062 bp, Streptococcus pyogenes
atgaatgaagcaataattcaattagatcatattgatattaccttccgtcaaaaaaaacgggttatcgaagctgttaaagatgtcacggttcatatcaatcaaggagatatttatggcattgttgggtattcaggtgccgggaaatcaactcttgtgcgtgtgattaacctgctacaggcaccaacaaacgggaaaatcactgttgatggggatgtgacttttgaccaggggaaaattcaattgtcagctgatgcccttcgccaaaaacgacgtgatattggtatgatcttccaacatttcaatttgatggcccaaaaaacagccaaagaaaatgtagcatttgcgctccgtcattcgtcgttaagtaagactgagaaagaacacaaagttatcgaactgctagaacttgtaggtttatcagagcgagcagataactaccctgcccagttatcgggtgggcaaaaacaaagggtggctattgcgcgtgctctagctaacgatccaaaaattttgatttcagatgaggccacatcagcactagatccaaaaaccactaaacaaattttggcgctcttgcaagaattaaaccgcaaacttggccttaccattgttatgattactcatgaaatgcaaattgttaaggatatttgtaatcgtgttgctgttatgcaaaatggtgttttgattgaagaaggttctgtccttgatatcttttcaaatccaaaagaagccttgacacaggaatttatcacaacagctacagggattgatgaggctttagaaaaaattaaccaacaagacattgttaaacatttgcctgcaaatgcccttctagctcagttgaaatatgcaggaacttctacggatgagcctctacttaatagcatttaccgtcagtttgaagtgacagctaatattttgtatggcaatattgagattttagatcatattccagttggtgacatgattgttgtcttggaagggcaagctgaaaatattcttgcggctgagaaagccttgcatgaagctggtgttgatgttagtattttaaagagaggagcc

SEQ ID NO: 76 - protein, 354 aa, Streptococcus pyogenes
MNEAIIQLDHIDITFRQKKRVIEAVKDVTVHINQGDIYGIVGYSGAGKSTLVRVINLLQAPTNGKITVDGDVTFDQGKIQLSADALRQKRRDIGMIFQHFNLMAQKTAKENVAFALRHSSLSKTEKEHKVIELLELVGLSERADNYPAQLSGGQKQRVAIARALANDPKILISDEATSALDPKTTKQILALLQELNRKLGLTIVMITHEMQIVKDICNRVAVMQNGVLIEEGSVLDIFSNPKEALTQEFITTATGIDEALEKINQQDIVKHLPANALLAQLKYAGTSTDEPLLNSIYRQFEVTANILYGNIEILDHIPVGDMIVVLEGQAENILAAEKALHEAGVDVSILKRGA

SEQ ID NO: 77 - DNA, 726 bp, Streptococcus agalactiae
gtggaacctaaatatcaacgtatattaattaagttatctggtgaagcattggcgggagataagggtgtcggtattgacattcctaccgttcaatctattgcaaaagaaattgccgaagtacacaattcaggtgttcaaatagcgcttgtcattggtggaggtaatctttggcgtggagaacctgcagcagaagcagggatggatcgtgttcaagctgattatacagggatgttagggacagtaatgaatgctcttgtaatggctgatagccttcaacaatatggggtagatactagagttcaaacagctattccaatgcaaactgttgctgagccttacgtacgtggtcgtgctttacgtcatctagagaagaatcgtattgttgtctttggagcgggtattggttcgccttatttctcaactgatacaacagcagcgcttcgtgctgctgagattgaggcagaagcaattttaatggctaaaaatggagtagatggtgtttataatgctgatccaaagaaagatgccaatgctgtcaaatttgatgaattaactcacgttgaagtaataaaacgagggttaaaaatcatggatgcaaccgcatcaactatttcaatggataatgatattgaccttgttgttttcaatatgaatgagactggtaatattaagcgtgttgttcttggagaacaaatcggaacaactgtttcaaacaaagcatctgaa

SEQ ID NO: 78 - protein, 242 aa, Streptococcus agalactiae
MEPKYQRILIKLSGEALAGDKGVGIDIPTVQSIAKEIAEVHNSGVQIALVIGGGNLWRGEPAAEAGMDRVQADYTGMLGTVMNALVMADSLQQYGVDTRVQTAIPMQTVAEPYVRGRALRHLEKNRIVVFGAGIGSPYFSTDTTAALRAAEIEAEAILMAKNGVDGVYNADPKKDANAVKFDELTHVEVIKRGLKIMDATASTISMDNDIDLVVFNMNETGNIKRVVLGEQIGTTVSNKASE

SEQ ID NO: 79 - DNA, 726 bp, Streptococcus pyogenes
gtggaacctaaatatcaacgtatattaattaagttatctggtgaagcattagcaggtgaaaaaggagttggcattgacattccaactgttcaggctattgcaaaagaaattgccgaagttcatgtgtcgggagtacagatcgctcttgttattggtggaggcaatctctggcgtggagagcctgcagcagacgctggaatggaccgtgttcaggctgattacactggcatgcttggaacggtgatgaatgccctagtcatggctgatagtcttcaacattatggtgttgatacccgtgtgcaaacagctattcctatgcaaaatgtagcagaaccttatattcgcggacgtgccttgcgccatctagaaaaaaatcggattgttgtttttggagctggtattggctcgccttatttttcaacagacaccaccgcggcactgcgtgctgctgagattgaagcagatgctattttaatggcaaaaaatggtgtggatggggtctataatgctgatcctaaaaaagatgctaatgcggttaaatttgatgaattaacacatggtgaagtgatcaaacgtggtctcaaaatcatggatgcaacggcatcgaccttatcgatggataacgatattgatttggtggttttcaatatgaatgaagctggcaatattcaacgtgttgtctttggagaacatattggaactactgtatcaaataaagtttgtgac

SEQ ID NO: 80 - protein, 242 aa, Streptococcus pyogenes
VEPKYQRILIKLSGEALAGEKGVGIDIPTVQAIAKEIAEVHVSGVQIALVIGGGNLWRGEPAADAGMDRVQADYTGMLGTVMNALVMADSLQHYGVDTRVQTAIPMQNVAEPYIRGRALRHLEKNRIVVFGAGIGSPYFSTDTTAALRAAEIEADAILMAKNGVDGVYNADPKKDANAVKFDELTHGEVIKRGLKIMDATASTLSMDNDIDLVVFNMNEAGNIQRVVFGEHIGTTVSNKVCD

SEQ ID NO: 81 - DNA, 93 bp, Streptococcus agalactiae
ttgattgatgatttatcaaatggtgaaattaaaagaacacgagcttcaggtacagtaatagaagctaattggttaaggggggttggcgctcca

SEQ ID NO: 82 - protein, 31 aa, Streptococcus agalactiae
MIDDLSNGEIKRTRASGTVIEANWLRGVGAP

SEQ ID NO: 83 - DNA, 555 bp, Streptococcus agalactiae
atgactaaggaaatcgttacaaaagctcaagagcgttttgagcaatcacaccaaagtttatcaagagaatttgcagggattcgtgcaggacgtgctaatgctagcttgcttgatcgtattcaagttgagtattatggagcgccaaccccccttaaccaattagcttctattactgtacctgaagctcgtgttcttttaatttcaccatttgataaatcatcaatcaaagatattgagcgtgctattaacgaatcagatttaggtattaatcctgcaaatgatggttcagttattcgtcttgttattccagctttgacagaagaaacacgtcgtgatttagctaaagaagtgaaaaaagtcggagaaaatgctaagattgctatccgtaatattcgccgtgatgctatggatgaagctaagaagcaagaaaagaataaagaaattacagaagatgacttgaaatctcttgaaaaagatattcaaaaggctactgatgatgctgtaaaacatattgatgagatgactgctaataaagaaaaagaattgttggaagtt

SEQ ID NO: 84 - protein, 185 aa, Streptococcus agalactiae
MTKEIVTKAQERFEQSHQSLSREFAGIRAGRANASLLDRIQVEYYGAPTPLNQLASITVPEARVLLISPFDKSSIKDIERAINESDLGINPANDGSVIRLVIPALTEETRRDLAKEVKKVGENAKIAIRNIRRDAMDEAKKQEKNKEITEDDLKSLEKDIQKATDDAVKHIDEMTANKEKELLEV

SEQ ID NO: 85 - DNA, 555 bp, Streptococcus pyogenes
atggcaaatgcaattattgaaactgcaaaagaacgttttgcacaatcccatcagtctttatcacgtgaatatgccagcattcgtgcgggtcgtgccaacgctagtcttttagaccgtatccaagttgattattacggggcaccgacaccattaaatcaattggcttcaatcactgtaccagaagcgcgtgtcttattgatctcgccttttgataaatcttctatcaaagatatcgagcgcgctcttaacgcatcagatttaggcattacacctgctaacgatggctctgtcattcgtttggttattccagctttgaccgaagaaacacgtaaagaattagccaaagaagtgaaaaaagttggtgaaaatgctaaaattgcaatccgtaatatccgccgcgatgctatggatgatgctaaaaagcaagaaaaagcaaaagaaatcactgaagatgagttaaaaacacttgagaaagatatccaaaaagcaaccgatgatgctatcaaagaaattgaccgcatgacggctgaaaaagaaaaagaattgctctcagtg

SEQ ID NO: 86 - protein, 185 aa, Streptococcus pyogenes
MANAIIETAKERFAQSHQSLSREYASIRAGRANASLLDRIQVDYYGAPTPLNQLASITVPEARVLLISPFDKSSIKDIERALNASDLGITPANDGSVIRLVIPALTEETRKELAKEVKKVGENAKIAIRNIRRDAMDDAKKQEKAKEITEDELKTLEKDIQKATDDAIKEIDRMTAEKEKELLSV

SEQ ID NO: 87 - DNA, 942 bp, Streptococcus agalactiae
ttggcaagtaataaaatgattatggaggtaactgatagaatcaaaaccagatggatttggtttgtcggttacctttttaaaaggagaaaaatgaatacattattagcgacagtcataacaggcttagtaactgatgaaaacaaagatttttactttatccaaaaagatggctttacctttgcattatcaaagtcagaaggagagcatcacattggtgaaatggttaaaggattcgcctatacagatatgcaacaaaaagcacgtcttacaactaaagaaacatttgcgactcgagatcattatggttgggggacagttactgaggtacgtaaagacttgggagtatttcttgatactggtcttccagataagcaagtggttgtttctttggatgttcttcctgaattgaaagaactttggcctaaaaaaggtgatcgcctctacgtttgcttagatgttgataaaaaagatcgtctctgggctctccctgcagatcctgaagtgtttcaacgaatggcaacccctgcatataacaatatgcaaaatcaaaattggccagcaatcgtttatcgcttaaaattgtcaggaacttttgtttatctaccagaaaataatatgctcggctttattcaccctagtgaacgttacagtgaacctcgtttagggcaagtgctggatgcacgagttattggcttcagagaagttgatagaaccttaaatttatcattaaagcctcgttcttttgaaatgttagaaaatgacgcacaaatgattttaacgtatttagaaagtaacggaggattcatgactttaaatgataaatcttctccagaggaaattaaagctacttttggaatttccaaaggtcagtttaaaaaagcacttggaggactcatgaaagctaaaaagatcaaacaagatcagctaggtacagaattatta

SEQ ID NO: 88 - protein, 314 aa, Streptococcus agalactiae
MASNKMIMEVTDRIKTRWIWFVGYLFKRRKMNTLLATVITGLVTDENKDFYFIQKDGFTFALSKSEGEHHIGEMVKGFAYTDMQQKARLTTKETFATRDHYGWGTVTEVRKDLGVFLDTGLPDKQVVVSLDVLPELKELWPKKGDRLYVCLDVDKKDRLWALPADPEVFQRMATPAYNNMQNQNWPAIVYRLKLSGTFVYLPENNMLGFIHPSERYSEPRLGQVLDARVIGFREVDRTLNLSLKPRSFEMLENDAQMILTYLESNGGFMTLNDKSSPEEIKATFGISKGQFKKALGGLMKAKKIKQDQLGTELL

SEQ ID NO: 89 - DNA, 855 bp, Streptococcus pyogenes
atgaatgatttactagcaacagtcattactgggcttattaaagaagaaaacgctaatgactattttatccacaaagaagggtttacctttaccttgtctaaagcagaaggagaacgccagattggtgatatggtcacaggctttgcctatacagacatagagcaaaaggcacgtctcacaaccaaagagatccgttcaacacggacaagttatggctggggggaagtgacagaggttcgtcgtgacctaggcgtttttgtcgatacaggaattccaaataaagaaattgtggtttctttggacgtgttgcctgagatgaaagaactatggcctaaaaaaggggataaactttacattcgtttggatgtggataaaaaagaccgtatttggggacttccagcagagcctgaggtctttcaaaagatggctagccctgcttacaataacatgcaaaatcaacattggccagcaattgtttaccgcctaaaattaacaggaacgtttgtttacctgcctgaaaacaacatgttgggctttattcactcaagtgaacgctacgcagaaccgcgcttaggtcaggttttagatgcccgtgtgattgggtttagagaggtcgatcgtaccttgaatttatcgttgaaaccacgttcttttgagatgttggagaatgacgctcagatgattgttacttatctggaagccaatggtggtttcatgactttaaatgacaaatcaagtccagaagagattaaagcaagctttggtatttcaaaaggccagtttaaaaaagccttgggtggattgatgaaagctaaacgtatcaaacaagacgccacaggaactgaattaatagga

SEQ ID NO: 90 - protein, 285 aa, Streptococcus pyogenes
MNDLLATVITGLIKEENANDYFIHKEGFTFTLSKAEGERQIGDMVTGFAYTDIEQKARLTTKEIRSTRTSYGWGEVTEVRRDLGVFVDTGIPNKEIVVSLDVLPEMKELWPKKGDKLYIRLDVDKKDRIWGLPAEPEVFQKMASPAYNNMQNQHWPAIVYRLKLTGTFVYLPENNMLGFIHSSERYAEPRLGQVLDARVIGFREVDRTLNLSLKPRSFEMLENDAQMIVTYLEANGGFMTLNDKSSPEEIKASFGISKGQFKKALGGLMKAKRIKQDATGTELIG

SEQ ID NO: 91 - DNA, 555 bp, Streptococcus agalactiae
ttggctttttttgttataatgtatctattaaaaagaatggagaacgatatggaacgtgcgatttttgctggaggttgtttttggtgtatggtacaaccatttgaagaattagatggtattgaatctgttttatctggatacactggaggacatgttgagaatccaacttataaagaagtttgtagtaaaactactggacatacagaagctgttgaaattatttttaatcctgaaaaaatctcttatgcagatttagttgagttatattgggcacaaacagatccaacagacgcttttggtcagtttgaagatcgtggggataattatcgtcctgtcatcttttatgagaatgaagagcaacgtcagattgctcaaaaatcaaaagataagctacaagcttcgggtagatttgatagaccaattgtaaccagcattgagcctgctgatactttttacccagcagaagactatcatcaagcattctatcggactaaccctgctcgttacgccttgagtagtgccagaagacatgcatttctagaggagaactggcat

SEQ ID NO: 92 - protein, 185 aa, Streptococcus agalactiae
MAFFVIMYLLKRMENDMERAIFAGGCFWCMVQPFEELDGIESVLSGYTGGHVENPTYKEVCSKTTGHTEAVEIIFNPEKISYADLVELYWAQTDPTDAFGQFEDRGDNYRPVIFYENEEQRQIAQKSKDKLQASGRFDRPIVTSIEPADTFYPAEDYHQAFYRTNPARYALSSARRHAFLEENWH

SEQ ID NO: 93 - DNA, 507 bp, Streptococcus pyogenes
atggaaagagccatttttgcaggaggttgtttctggtgtatggtgcaaccttttgaggagcaagcaggtattttgtcagtcagaagtggctacacaggtgggcatctcccaaatcctagctatgaacaagtttgtgccaaaacaacaggacatacagaagctgttgaaattatttttgaccctaagcaaatcgcttataaagatttggtagagctctattggacgcagacggatccaacagacgcctttgggcaatttgaagatcgtggggacaactaccgtcctgtcatttactacacaacggaaagacaaaaagaaattgcagagcaatcaaaagcaaacttgcaagcttcaggacgttttgaccaacccattgtcaccactattgaaccagcagagccattttatctcgcagaggattatcaccaaggattttataaaaagaatcccaagcggtatgcacaaagcagtgctattcgtcatcagtttttagaggagaattggtca

SEQ ID NO: 94 - protein, 169 aa, Streptococcus pyogenes
MERAIFAGGCFWCMVQPFEEQAGILSVRSGYTGGHLPNPSYEQVCAKTTGHTEAVEIIFDPKQIAYKDLVELYWTQTDPTDAFGQFEDRGDNYRPVIYYTTERQKEIAEQSKANLQASGRFDQPIVTTIEPAEPFYLAEDYHQGFYKKNPKRYAQSSAIRHQFLEENWS

SEQ ID NO: 95 - DNA, 213 bp, Streptococcus agalactiae
ttgagaaaatcattttacagttggttgatgacacaaagaaatccaaaatcaaatgaaccagtagcaatcctagcagattacgcttttgatgaaaccacttttccaaaacatagttcggattttgaaacagttagtcgctatttagaagatgaggccagtttttcctttaatttaacagattttgatgatatttgggaagattatctcaatcat

SEQ ID NO: 96 - protein, 71 aa, Streptococcus agalactiae
MRKSFYSWLMTQRNPKSNEPVAILADYAFDETTFPKHSSDFETVSRYLEDEASFSFNLTDFDDIWEDYLNH

SEQ ID NO: 97 - DNA, 219 bp, Streptococcus pyogenes
ttggtcatgagaaaatcattttacagctggctgatgacacaacgtaaccctaaatcaaatgaacctgtggcgattttagcagatttggtgtttgatgacaccacttttccaaagcataccaatgattttgaactcattagtcggtatctagaagatcaagctagtttttcctttaatttaggtcaatttgatgaaatctgggaagattatctagcacat

SEQ ID NO: 98 - protein, 73 aa, Streptococcus pyogenes
LVMRKSFYSWLMTQRNPKSNEPVAILADLVFDDTTFPKHTNDFELISRYLEDQASFSFNLGQFDEIWEDYLAH

SEQ ID NO: 99 - DNA, 1776 bp, Streptococcus agalactiae
ttgtttatgagatatacaaatggaaattttgaagcctttgcaagacctcgaaaacctgaaggtgtggataaaaaatccgcttatattgttggttctggtttagcaggattagctgccgctgtctttttaatacgtgacggtcaaatggatggtcaacgtattcatatttttgaagaactacctctttctggaggatcacttgacggtgtcaaacgacctgatatcggttttgtaacgcgtggtggtcgtgaaatggaaaatcacttcgaatgtatgtgggatatgtaccgttccatcccctctctcgaagttccagatgcttcttatctagatgaattttattggcttgacaaggatgatcccaattcatctaactgtcgcctcattcataaacaggggaatcgcttagaatctgatggtgattttacactcggaacacattccaaagagttagttaagctagtcatggagactgaagagtctttaggtgctaagacgattgaagaagttttttcaaaagaattttttgaaagtaatttttggacttattggggtactatgtttgcctttgagaaatggcattcagcgattgaaatgcgtcgatatgctatgcgctttatccatcatattggtggtctgcctgatttcacttcattaaaatttaataaatataatcaatatgattctatggtgaaaccaatcatcagttatttagagtctcataatgtagatgttcaatttgatagcaaggtaactaatatctccgtagactttaagaacggtcagaagcttgcaaaagctattcatctcacagttggtggtgaagcaaaaacaattgatcttactccaaatgattttgtttttgtaacgaatggttctatcactgaaagtacgaactatggtagtcatgatactgtagctaaacctaataccgatttgggaggttcttggaatctttgggaaaacttagctgctcaatctgatgaatttggacatcctaaagtcttctacaaagatattccaaaagagtcatggtttgtttctgctactgcaacaataaaagatccagctattgaaccttatatagagcgtttaacacatcgtgacctccatgatggtaaagtaaataccggaggcattgttacagttacagattctaattggatgatgagttttgctatccatcgccaaccgcatttcaaagagcaaaaggaaaatgaaacaattgtttggatttatggactctattcaaatgtggaaggtaattatattaaaaaaccaattgaagaatgtactggtcgagaaatcacagaagagtggttatatcacttaggtgttcctgaaatgaagattcatgatttatctgataaacaatatgtaagtacagttcctgtttatatgccttacattactagttatttcatgcctcgagttaaaggtgaccgaccagatgttatcccacaaggatctgttaacctagccttcattggtaattttgcagaatctccatccagagatacagtatttacaacggaatattctattagaactgctatggaagctgtttatactttcttaaatattgaacgtggtgttccagaagtctttaattcagcatttgatattcgtgtcttgttgcaatctttatactatctcaatgataagaaatctgttgaagatatggatttaccaatacctgccttaatgcgtaaagtaggcatgaaaaaaattagaggaacttatttagaagaattacttcgagaagctcatctttta

SEQ ID NO: 100 - protein, 592 aa, Streptococcus agalactiae
MFMRYTNGNFEAFARPRKPEGVDKKSAYIVGSGLAGLAAAVFLIRDGQMDGQRIHIFEELPLSGGSLDGVKRPDIGFVTRGGREMENHFECMWDMYRSIPSLEVPDASYLDEFYWLDKDDPNSSNCRLIHKQGNRLESDGDFTLGTHSKELVKLVMETEESLGAKTIEEVFSKEFFESNFWTYWGTMFAFEKWHSAIEMRRYAMRFIHHIGGLPDFTSLKFNKYNQYDSMVKPIISYLESHNVDVQFDSKVTNISVDFKNGQKLAKAIHLTVGGEAKTIDLTPNDFVFVTNGSITESTNYGSHDTVAKPNTDLGGSWNLWENLAAQSDEFGHPKVFYKDIPKESWFVSATATIKDPAIEPYIERLTHRDLHDGKVNTGGIVTVTDSNWMMSFAIHRQPHFKEQKENETIVWIYGLYSNVEGNYIKKPIEECTGREITEEWLYHLGVPEMKIHDLSDKQYVSTVPVYMPYITSYFMPRVKGDRPDVIPQGSVNLAFIGNFAESPSRDTVFTTEYSIRTAMEAVYTFLNIERGVPEVFNSAFDIRVLLQSLYYLNDKKSVEDMDLPIPALMRKVGMKKIRGTYLEELLREAHLL

SEQ ID NO: 101 - DNA, 1812 bp, Streptococcus pyogenes
gtgatgatatcactttgcttgactattcaaggaggtcttgaaatgtattatactagtggtaattacgaagcttttgcaacacctcgaaaacccgaaggggtagatcagaaatcagcttatattgttggtactggtttagctggtttagcagcagctgttttccttattcgcgatgggcatatggctggggaacgcattcatctgtttgaggaattgcctttagcaggtggttctttagatggtattgaaaagcctcatcttggttttgtgacccgtggtggtcgtgagatggaaaatcattttgagtgtatgtgggacatgtatcggtctattccctcactggaaattcccggtgcgtcttatttagatgaattttattggttggataaggatgatcctaactcatccaactgtcgtttgattcacaagagaggaaatcgtgtggatgatgacggccagtatacgctcggtaaacagtcaaaagaattaatccatttaatcatgaagacagaagaatctctaggagaccaaaccattgaagagttcttctcagaagatttctttaagagtaatttttgggtgtattgggcaaccatgtttgcttttgaaaaatggcattctgctgtagaaatgcgacgctatgcgatgaggtttatccaccatattgatggtttgccagatttcacctccctcaagttcaacaaatataaccaatatgactctatggtcaaaccgattattgcttacctagaatcacacgacgttgacatccaatttgacacaaaagtcactgatattcaggtggagcaaacagctggtaaaaaggtagcaaaaaccatccatatgacggtgtctggggaggctaaggcgattgagctaacacctgatgatttggtttttgtgaccaatggttctattactgaaagcagcacatacggtagtcatcacgaagtggctaagccaaccaaagcgttaggtggttcttggaatttatgggaaaatctagctgctcaatcagatgattttggtcatcctaaagtgttttaccaggacttgcctgctgaaagctggtttgtgtctgctacagcaaccataaaacacccagctatcgagccttatatagaacgtttgacccaccgtgacttgcacgatggcaaagtgaacactggcggcatcatcactattacagattctaactggatgatgagctttgccattcaccgtcaacctcattttaaagaacaaaaagaaaatgagaccactgtctggatttacggtctttattccaatagtgagggcaattacgtccacaagaaaattgaggagtgtacaggtcaagaaatcacagaagaatggttgtaccaccttggggtacctgttgataaaatcaaggacttagcgagtcaggactatatcaatacagttcctgtttacatgccttatattacgagttactttatgccacgcgtcaaaggagaccgtccgaaagttatcccagatggttcagtcaacttggcctttattggtaactttgcggaatctccatctcgagatacggtctttacgactgagtattctattcgtactgccatggaagcagtgtatagcttcttgaatgtggaacgaggcatcccagaagtctttaattcagcctatgatattcgtgaattgctcaaagccttttattaccttaatgataaaaaggcaatcaaggatatggatttgccaattcctgcactgattgagaaaatcggacataaaaaaatcaaggatacctttatcgaagaattgctcaaagatgctaatcttatg

SEQ ID NO: 102 - protein, 604 aa, Streptococcus pyogenes
VMISLCLTIQGGLEMYYTSGNYEAFATPRKPEGVDQKSAYIVGTGLAGLAAAVFLIRDGHMAGERIHLFEELPLAGGSLDGIEKPHLGFVTRGGREMENHFECMWDMYRSIPSLEIPGASYLDEFYWLDKDDPNSSNCRLIHKRGNRVDDDGQYTLGKQSKELIHLIMKTEESLGDQTIEEFFSEDFFKSNFWVYWATMFAFEKWHSAVEMRRYAMRFIHHIDGLPDFTSLKFNKYNQYDSMVKPIIAYLESHDVDIQFDTKVTDIQVEQTAGKKVAKTIHMTVSGEAKAIELTPDDLVFVTNGSITESSTYGSHHEVAKPTKALGGSWNLWENLAAQSDDFGHPKVFYQDLPAESWFVSATATIKHPAIEPYIERLTHRDLHDGKVNTGGIITITDSNWMMSFAIHRQPHFKEQKENETTVWIYGLYSNSEGNYVHKKIEECTGQEITEEWLYHLGVPVDKIKDLASQDYINTVPVYMPYITSYFMPRVKGDRPKVIPDGSVNLAFIGNFAESPSRDTVFTTEYSIRTAMEAVYSFLNVERGIPEVFNSAYDIRELLKAFYYLNDKKAIKDMDLPIPALIEKIGHKKIKDTFIEELLKDANLM

SEQ ID NO: 103 - DNA, 1035 bp, Streptococcus agalactiae
atgaaattttgttataatgtagtcacttactgtacgaaaaggaagaataatttgcaagaatactctatcgaaattactttacaacatccagatgatatgatgtcactctttggcagcaatgagcgccatttaaaattaatcgaagaaaatttagatgttatcattcatgctagaactgaacgtgttcaggtattaggtgactctgaagaagcagtagaaaccgctcggttaaccattgaagcattattagtgcttgttaaccgcgggatgactgtgaatacttcagatgttgtaacagccttatccatggcacaaaatggttcaattgataaattcgttgccctttatgaggaagaaattattaaggatagctatggtaagcctatccgtgttaagactttagggcaaaaaatatacgttgatagcgttaaaaatcatgatgttgtttttggtattgggcctgctggaacgggaaaaacttttttagcagtcactctagcagtaacggcactaaagcgtggtcaagttaaacgaataatcttaacgagaccagcggttgaagctggtgaaagccttggtttcttgcctggagatctcaaagagaaagttgatccttatttgagaccagtttatgatgccctatatcaaattttaggtaaagagcaaacaagtcgcttaatggagcgtgaaatcatcgaaattgctccattggcttacatgcgtggtcgtactttagatgatgcatttgtcatattagatgaagcgcaaaacaccactataatgcaaatgaaaatgttcctaacacgtcttggcttcaattctaaaatgattgtaaatggcgatgttagccaaattgacttaccaaagaatgttaaatctggtttgattgatgctgttgagaaattacgaaatatcaaaaagattgactttattcatttatcagcaaaggatgttgtaagacaccctgtcgttgctgaaataataaatgcttattcagattcagaaagtagtcacaagctacaatctgataaggac

SEQ ID NO: 104 - protein, 345 aa, Streptococcus agalactiae
MKFCYNVVTYCTKRKNNLQEYSIEITLQHPDDMMSLFGSNERHLKLIEENLDVIIHARTERVQVLGDSEEAVETARLTIEALLVLVNRGMTVNTSDVVTALSMAQNGSIDKFVALYEEEIIKDSYGKPIRVKTLGQKIYVDSVKNHDVVFGIGPAGTGKTFLAVTLAVTALKRGQVKRIILTRPAVEAGESLGFLPGDLKEKVDPYLRPVYDALYQILGKEQTSRLMEREIIEIAPLAYMRGRTLDDAFVILDEAQNTTIMQMKMFLTRLGFNSKMIVNGDVSQIDLPKNVKSGLIDAVEKLRNIKKIDFIHLSAKDVVRHPVVAEIINAYSDSESSHKLQSDKD

SEQ ID NO: 105 - DNA, 1050 bp, Streptococcus pyogenes
ttgcaagagtattctattgacattaccttaacccatcctgatgatgttttagctctttttggtagcaacgagcgtcatttgaagctaatagaagctcatttaggagttattgttcacgcaagaaccgagcgagtccaagtgattggtgatgatgaagaagctgtggaattggctcgattgaccatcaaagccctactggttctagtgggtcgtggcatggtggtcaacacatcagatgtggtgacagctttatctatggcagaatctcatcagattgaccaatttatggcgctttatgaagaagaaatcattaaagataactatggtaaggcaatacgagtcaaaacattaggtcaaaaaacctatgttgatagtgtcaaacgtcatgatgtggtttttggtgtaggacctgcagggacaggtaaaaccttcttagctgttacgcttgcagtcactgctctgaaaagaggacaggtaaagcgtattattttgacgcgtcctgcggtagaagctggcgaaagcctaggttttttaccaggcgatttgaaagaaaaggtggatccttacctcagacctgtttacgatgccctttatcacattttaggcaaggaacaaaccacacgcctgatggaacgagatgtgattgagattgctccgttagcttatatgcgaggtcgtactctggatgacgcttttgttatcttagatgaggctcaaaacacgaccatcatgcaaatgaagatgtttttgacccgtcttggttttaattctaaaatgattgtcaatggagatacgagtcagattgacctccctcgaaatgtcaagtctggtttgattgatgctactcagaaattacaaggcattaaacagattgattttgtctatttctctgctaaggatgttgtccgacatcctgttgtggctgatattatcaaggcttatgaaacgtcctcagaggagatgaaggacttactaaaacctaaggctagtgacgttgaagctgattaccagccaggcttgacaaaataccctgtgatcggtcaagagcac

SEQ ID NO: 106 - protein, 350 aa, Streptococcus pyogenes
LQEYSIDITLTHPDDVLALFGSNERHLKLIEAHLGVIVHARTERVQVIGDDEEAVELARLTIKALLVLVGRGMVVNTSDVVTALSMAESHQIDQFMALYEEEIIKDNYGKAIRVKTLGQKTYVDSVKRHDVVFGVGPAGTGKTFLAVTLAVTALKRGQVKRIILTRPAVEAGESLGFLPGDLKEKVDPYLRPVYDALYHILGKEQTTRLMERDVIEIAPLAYMRGRTLDDAFVILDEAQNTTIMQMKMFLTRLGFNSKMIVNGDTSQIDLPRNVKSGLIDATQKLQGIKQIDFVYFSAKDVVRHPVVADIIKAYETSSEEMKDLLKPKASDVEADYQPGLTKYPVIGQEH

SEQ ID NO: 107 - DNA, 801 bp, Streptococcus agalactiae
atggaccatttcacaaaactctggcaagatttctctaaacttccaaatgttgttgctatagcactcggaggctcacgctctggtgacagttttgaccaatcttccgattatgatttgtatgtttattgtgcagcaactcctgatatcactagtcgtaaacgtatccttaacaagcactgtcattacattgaacttaacaatcattactgggagcttgaagataatggtactttaaacgacggaactgatattgatattctctatcgtaacatagataactttttatcagacttagaagatgtcgttgaacaccacaattctcgaattggatacactacttgtttttggcataacctcatcaattgccaaatactctatgatcctgaaaatcaattacaatcactcaaagagagattcgaagtttcttatcccagtcagttacaaaaacaaattatcattcaaaatcgtaacttattaactggcaagcttccctcttacgataaacaaattataaaagcccttaaacgccaagactttgttagtactcaccatagaactactgctttcttagattcctactttgatattatttttgcacttaataagttgacacatcctggcgaaaaaagaatgatttcctatgctaagaagaatgctacattgcttcctaaacatttcgaagaaaatatcattaaactatgtcatcacaactccaacgaacacactgttaaagaaacattaaacgatataataatgcatctcgacgtcatgcttaaagaaaattttcaacactttataggt

SEQ ID NO: 108 - protein, 267 aa, Streptococcus agalactiae
MDHFTKLWQDFSKLPNVVAIALGGSRSGDSFDQSSDYDLYVYCAATPDITSRKRILNKHCHYIELNNHYWELEDNGTLNDGTDIDILYRNIDNFLSDLEDVVEHHNSRIGYTTCFWHNLINCQILYDPENQLQSLKERFEVSYPSQLQKQIIIQNRNLLTGKLPSYDKQIIKALKRQDFVSTHHRTTAFLDSYFDIIFALNKLTHPGEKRMISYAKKNATLLPKHFEENIIKLCHHNSNEHTVKETLNDIIMHLDVMLKENFQHFIG

SEQ ID NO: 109 - DNA, 474 bp, Streptococcus agalactiae
atgaaacaagattatatttcctacattaggtcaaaagttggacatgagactatctttttaacatattctggtggtattttgacagatggtaagggacgtgtcttactccaattaagagctgataagaattcttggggaattattggtggatgtatggagttaggtgagtcatcagtagatacattgaaaagagaatttttcgaagaaactggattgagagtggaaccaatcagactgttaaatgtttatactaactttcaagactcttatcccaatggcgataaagcacaaaccgtcggttttatttatgaagtaagctgtccaaaaccagttaatatagaaggttttcataatgaggaaacattgcaattggactatttttctaaagaagacgtcaaaaatattacgatcgtaaatgaacaacaccaattaattttagatgaatatttttcacaaacattccaaatggggcgt

SEQ ID NO: 110 - protein, 158 aa, Streptococcus agalactiae
MKQDYISYIRSKVGHETIFLTYSGGILTDGKGRVLLQLRADKNSWGIIGGCMELGESSVDTLKREFFEETGLRVEPIRLLNVYTNFQDSYPNGDKAQTVGFIYEVSCPKPVNIEGFHNEETLQLDYFSKEDVKNITIVNEQHQLILDEYFSQTFQMGR

SEQ ID NO: 111 - DNA, 519 bp, Streptococcus pyogenes
ttggctataatgagaaagaatactaacatagtaaagcgagatcatatgccacaagactacatttcttatatccgctccaaagttgggcatgataagattattcttaactttgctggtgggattttgaccaatgatgacggcaaggtgctgatgcagctgcgtggtgataagaaaacctggactattcctggtggcactatggaactgggtgagagctctttagagacttgcaaacgtgagttcttagaggaaaccggaattgaggttgaagctgttcgcttactgaatgtttacactcattttgaggaagtttatcccaacggtgatgctgttcagactattgtctttatctatgaactaacggctgtttctgatatggctattgataactttcataatgaggaaacgctcaagttacaatttttctctcatgaggagatagcagagttagagagtgtctcagccaaacatcgcctgatgttagaggaatattttagtgatagctttgctatggggcat

SEQ ID NO: 112 - protein, 173 aa, Streptococcus pyogenes
LAIMRKNTNIVKRDHMPQDYISYIRSKVGHDKIILNFAGGILTNDDGKVLMQLRGDKKTWTIPGGTMELGESSLETCKREFLEETGIEVEAVRLLNVYTHFEEVYPNGDAVQTIVFIYELTAVSDMAIDNFHNEETLKLQFFSHEEIAELESVSAKHRLMLEEYFSDSFAMGH

SEQ ID NO: 113 - DNA, 117 bp, Streptococcus agalactiae
gtgactgtttttttagaaagcataagaagtacagaaaaagaaaattatggaatatttgatggtggggatatgctttacttacggtattggaatgatatacttaaagaaatccagttt

SEQ ID NO: 114 - protein, 39 aa, Streptococcus agalactiae
MTVFLESIRSTEKENYGIFDGGDMLYLRYWNDILKEIQF

SEQ ID NO: 115 - DNA, 804 bp, Streptococcus agalactiae
atgaagataacattacacggcgttgctgaaacgttattaatcaccttatatattagggctaaagatgcgatggctaaacatccgatacttaatgatcaaaaatccttagcaattgttgaacagatagaatatgattttgataaattcgataattcagaagcttctttttatgcaacattagctagaattcgcgttatggatagagaaatcaaaaaatttattagagaaaatccaaatagtcaaatcctttcaattggttgtggacttgatacaaggtttgaaagagtcgataatggacaaattaggtggtataaccttgatttgccagaggttatggagataagaaaattattttttgaagagcatgaaagagttactaatatagcaaaatcagccctagatgaaacttggacacgggaggtaaatccccaaaatgccccttttctaatcgtgtcagaaggtgttttaatgtttctaaaagaagatgacgtagagacttttcttcatatcctgacaaattcatttagccaatttatggcacaatttgatttgtgtcataaggaaatgattaataaaggaaagcaacatgatacagtaaagtatatggatacagaatttcagtttggtatcacagatggtcatgagattgtggatttagaccctaaattaaagcaaataaatctgattaactttacagatgagatgagcaaatttgagttaggcacacttcgctctttacttccaacaattcgtaaatttaataattgtttaggtgtgtacgaatataaagcatctgagaaaaag

SEQ ID NO: 116 - protein, 268 aa, Streptococcus agalactiae
MKITLHGVAETLLITLYIRAKDAMAKHPILNDQKSLAIVEQIEYDFDKFDNSEASFYATLARIRVMDREIKKFIRENPNSQILSIGCGLDTRFERVDNGQIRWYNLDLPEVMEIRKLFFEEHERVTNIAKSALDETWTREVNPQNAPFLIVSEGVLMFLKEDDVETFLHILTNSFSQFMAQFDLCHKEMINKGKQHDTVKYMDTEFQFGITDGHEIVDLDPKLKQINLINFTDEMSKFELGTLRSLLPTIRKFNNCLGVYEYKASEKK

SEQ ID NO: 117 - DNA, 495 bp, Streptococcus agalactiae
atgtacgttgaaatgattgatgaaactggacaagtttcagaagatatcaaaaagcaaactcttgatttgttagagtttgcagcacaaaaaacaggtaaagagaataaagaaatggctgtaacgtttgtcactaatgaacgtagccatgaattgaatttagagtatcgagataccgatcgtccgactgatgttatcagtttagaatataagcctgaggttgatatttcttttgatgaagaagatctggctgaaaatcctgaacttgctgagatgctagaagattttgattcttatattggtgaactttttatttctattgataaagctaaagaacaagcagaagagtacggtcactcttatgaacgtgaaatgggttttttagctgtacatggttttttgcatattaacggttatgatcattatacacccgaagaagaaaaagagatgttcagcttacaggaagaaattttaactgcttatggacttaaacgacaa

SEQ ID NO: 118 - protein, 165 aa, Streptococcus agalactiae
MYVEMIDETGQVSEDIKKQTLDLLEFAAQKTGKENKEMAVTFVTNERSHELNLEYRDTDRPTDVISLEYKPEVDISFDEEDLAENPELAEMLEDFDSYIGELFISIDKAKEQAEEYGHSYEREMGFLAVHGFLHINGYDHYTPEEEKEMFSLQEEILTAYGLKRQ

SEQ ID NO: 119 - DNA, 546 bp, Streptococcus pyogenes
gtgcccaacataccaaatgaggtgggcagcccttccctaacaattaaccttatgtatatcgagatgattgacgaaacgggacaagtttcgcaagagattatggagcaaacacttgatttgctcaattttgctgctcaaaagacgggcaaagaagaaaaagaaatgtctgtgacctttgtgaccaatgaaagaagtcatgaactcaacttagaataccgagatactgatcgtccaacagatgtgatttctctagaatataagccagaaacgcctattttatttagtcaagaggatttggctgctgatcctagtttggcagagatgatggcagagtttgatgcttatattggcgaattgtttatttctattgacaaggcgcgtgagcagtcccaagaatatgggcactcttttgagcgtgaaatgggatttttggctgttcatggattcttacatattaatgggtatgatcactacacccttgaagaagaaaaagagatgtttaccttacaggaagagattttgactgcttatggccttacacgacaa

SEQ ID NO: 120 - protein, 182 aa, Streptococcus pyogenes
VPNIPNEVGSPSLTINLMYIEMIDETGQVSQEIMEQTLDLLNFAAQKTGKEEKEMSVTFVTNERSHELNLEYRDTDRPTDVISLEYKPETPILFSQEDLAADPSLAEMMAEFDAYIGELFISIDKAREQSQEYGHSFEREMGFLAVHGFLHINGYDHYTLEEEKEMFTLQEEILTAYGLTRQ

SEQ ID NO: 121 - DNA, 708 bp, Streptococcus agalactiae
atgtcagaaaatcctgatgcctatattattcgtagtcaaaatttgcataatcaggatttcccaagtaacctcaaagctattgctagggcgggtgcaggaacaaataatattcctattgaagaggcaagtgcacagggaatagtcgtgtttaataccccaggtgcaaatgctaatgctgtaaaagaagcggtcattgctgccttattactttcagctcgtgattatttaggagctaaccgatgggttaatactctaactggaacagatattcccaaacaaattgaagcaggaaagaaagcttttgctggtaatgaaattgcaggaaaaaaattgggagttatcggccttggtgccattggagctagaattgcgaatgatgctagacgcttaggaatgacagttcttggttatgatccctatgtttcaattgaaacagcttggaatatttcaagccatgttcaaagggttaaagagattaaggatatttttgaaacttgtgactatatcacaattcatgttcccttaacaaatgaaactaagcatacttttgatgcgaaagctttttcaatcatgaaaaaaggaactacgattatcaactttgctcgtgcagaattagtcaataaccaagagctatttgaagcgatagaaactggtgttgtcaagcgctatattactgattttggagacaaagaattattaaaccaaaag

SEQ ID NO: 122 - protein, 236 aa, Streptococcus agalactiae
MSENPDAYIIRSQNLHNQDFPSNLKAIARAGAGTNNIPIEEASAQGIVVFNTPGANANAVKEAVIAALLLSARDYLGANRWVNTLTGTDIPKQIEAGKKAFAGNEIAGKKLGVIGLGAIGARIANDARRLGMTVLGYDPYVSIETAWNISSHVQRVKEIKDIFETCDYITIHVPLTNETKHTFDAKAFSIMKKGTTIINFARAELVNNQELFEAIETGVVKRYITDFGDKELLNQK

SEQ ID NO: 123 - DNA, 993 bp, Streptococcus pyogenes
ttgatgaaattaaaattatataatgttagaggcgaagaagcagtcttagcaaaaaaatgggctgatgacaatgggattgagatttccttgacggagtctcccttaactcctgaaacggttaaagaagctgaaggctttgacgggattgccaatgcccaaattggtcctttagatgatgcgatttatcctctcttaaaggaaatggggattaaacaaatcgctcagcacagtgctagtgtcgatatgtataaccttgatttggccaccgaaaatgacattattatcacaaatgttcctagctattctccagaatccattgcagaatttacggttactattgtccttaatttaattcgtcatgtggagttgattcgtgaaaatgttaaaaaacaaaatttcacttggggactccctatccgcggccgtgttttaggtgatatgacagttgcgattatcggaactggacgtattggtctagctactgctaaaatctttaaaggttttggctgcaaggtcgttggatatgatatttaccaaagcgatgctgccaaagctgtcttggactataaggaatctgtagaagaagcgattaaagatgctgatcttgtttccttacacatgccaccaactgcagagaacacacaccttttcaattctgatttatttaaatcattcaaaaaaggggctattttgatgaatatggcgcgtggtgccgtcattgagacgcaagatttactggatgctttggatgcaggcttactgagcggagctggtattgacacttacgaatttgaaggaccttatatacctaagaattttgaaggtcaagaaattacagattcactatttaaagctttgattaaccatcctaaggttatttatacacctcatgcagcttattatactgatgaagccgttaaaaacctagttgaaggtgcccttaatgctacagtagagattatcaaaactgggacaacgacaactcgtgttaac

SEQ ID NO: 124 - protein, 331 aa, Streptococcus pyogenes
LMKLKLYNVRGEEAVLAKKWADDNGIEISLTESPLTPETVKEAEGFDGIANAQIGPLDDAIYPLLKEMGIKQIAQHSASVDMYNLDLATENDIIITNVPSYSPESIAEFTVTIVLNLIRHVELIRENVKKQNFTWGLPIRGRVLGDMTVAIIGTGRIGLATAKIFKGFGCKVVGYDIYQSDAAKAVLDYKESVEEAIKDADLVSLHMPPTAENTHLFNSDLFKSFKKGAILMNMARGAVIETQDLLDALDAGLLSGAGIDTYEFEGPYIPKNFEGQEITDSLFKALINHPKVIYTPHAAYYTDEAVKNLVEGALNATVEIIKTGTTTTRVN

SEQ ID NO: 125 - DNA, 159 bp, Streptococcus agalactiae
  misc_feature (1)..(159): n = a, c, g, or t
atgcttttcatgagagataatttagattctttgattcagcctgttattgatgagatggctaaacattatcaatggtctgatcaagacaaaactttctatgaagaagaattacatgagactctaaaagacaatgacttggcagctttgaannnnnttaat

SEQ ID NO: 126 - protein, 53 aa, Streptococcus agalactiae
  MISC_FEATURE (1)..(53): Xaa = Any Amino Acid
MLFMRDNLDSLIQPVIDEMAKHYQWSDQDKTFYEEELHETLKDNDLAALXXXN

SEQ ID NO: 127 - DNA, 1836 bp, Streptococcus pyogenes
atggaattttcaagagaaacaagacgcttagctctccaaaaaatgcaagaaagagatttagacctactgattattgggggaggtattacgggtgctggtgtggcacttcaggcggcagctagtggcctagatacgggtctgattgagatgcaagattttgctcaaggaacctctagccgttcaaccaaattggttcacggggggcttcgttacttgaaacaatttgatgtggaggtggtttcagatacggtgtcagagcgggctgtggtgcaacaaattgcaccccacattccaaaaccagaccctatgttattacctgtttatgacgaacctggcagtacctttagcatgttccgtttgaaggtcgctatggatttgtatgatcttttagcaggcgtgtccaatacgccagcggccaacaaggtgttaaccaaagaagaagtcttaaaacgagaaccagacttaaaacaagaaggcttgcttggtggtggggtttaccttgatttccgcaataatgacgcaaggcttgttattgaaaatatcaaacgagctaatcgtgatggggctcttattgctagtcatgtgaaagcagaagatttcttgctagatgacaatggtaagattattggtgtgaaggcgcgtgatctgctgtcagatcaagaaatcattatcaaggctaaattagtcatcaacaccacaggtccatggagtgatgagattcgtcaattctctcataagggacaaccgattcatcaaatgcgccctacaaaaggggtgcatctggtagtggaccgtcaaaaattaccagtgtctcaacctgtctatgttgacacagggttaaatgatggtcgtatggtctttgtcttgccacgtgaggaaaaaacttattttggaacaacggacacggactacactggagacttggagcacccacaagttactcaagaagatgtggattatttgttaggcgttgtcaataaccgctttccaaatgccaacgtgaccattgatgatattgaaagcagttgggctggtcttcgccccttgttatcaggtaatagtgcttctgactacaatggtggcaacagcggtaaagtcagtgatgatagttttgatcacttggttgatactgtcaaagcctatattaaccacgaagatagccgagaagctgttgaaaaagctattaagcaggttgaaaccagcacatctgaaaaagaattggatccgtctgcagtgtcacgaggttcaagttttgagcgtgatgagaatggactctttaccttggcaggtggtaagattaccgactatcgcaaaatggctgaaggagcattgacagggattattcaaatcctcaaagaagagtttggcaaatccttcaagcttatcaattcaaaaacctatcctgtttcaggaggtgaaatcaatccagccaatgtagattcggaaatagaagcctatgctcaattaggaactcttagtggtctttcgatggatgatgctaggtatttggcaaacctttatggttctaatgcgccaaaagtctttgccttaactcgtcaattaacagcagctgaagggttaagtttagctgaaaccttgtccttacattatgcgatggattatgaaatggctcttaaaccgacagattatttcttgagaagaacaaatcacctcttatttatgcgagatagcctagatgctttgattgacccagtgattaatgaaatggctaaacattttgaatggtctgatcaggaaagagtggcacaagaagacgatcttcgtcgcgtgattgcagacaatgatttgagtgccttaaaaggccatcaggagggt

SEQ ID NO: 128 - protein, 612 aa, Streptococcus pyogenes
MEFSRETRRLALQKMQERDLDLLIIGGGITGAGVALQAAASGLDTGLIEMQDFAQGTSSRSTKLVHGGLRYLKQFDVEVVSDTVSERAVVQQIAPHIPKPDPMLLPVYDEPGSTFSMFRLKVAMDLYDLLAGVSNTPAANKVLTKEEVLKREPDLKQEGLLGGGVYLDFRNNDARLVIENIKRANRDGALIASHVKAEDFLLDDNGKIIGVKARDLLSDQEIIIKAKLVINTTGPWSDEIRQFSHKGQPIHQMRPTKGVHLVVDRQKLPVSQPVYVDTGLNDGRMVFVLPREEKTYFGTTDTDYTGDLEHPQVTQEDVDYLLGVVNNRFPNANVTIDDIESSWAGLRPLLSGNSASDYNGGNSGKVSDDSFDHLVDTVKAYINHEDSREAVEKAIKQVETSTSEKELDPSAVSRGSSFERDENGLFTLAGGKITDYRKMAEGALTGIIQILKEEFGKSFKLINSKTYPVSGGEINPANVDSEIEAYAQLGTLSGLSMDDARYLANLYGSNAPKVFALTRQLTAAEGLSLAETLSLHYAMDYEMALKPTDYFLRRTNHLLFMRDSLDALIDPVINEMAKHFEWSDQERVAQEDDLRRVIADNDLSALKGHQEG

SEQ ID NO: 129 - DNA, 489 bp, Streptococcus agalactiae
atggttcgtacaactcgtccaacaactgataaggttaaaggcgctatttttaatatgattggtcctttttttgaaggtggtcgtgttttagaccttttttctggcagtggtagcttagctattgaggcgatctcaaggggaatggaccaagctgtcctagttgaaaaagataggcgtgcgcaggtcgttattcaagaaaatattgcaatgactaagagtccggagcaatttcaattattaaaaatggaagccaaccgtgctttagaacaattaacgggacaatttgatttggtcttgttggacccgccatatgctaaggaagaaattgtaaagcaaatccaaatcatggatagcaagggtttattaggcgatgatatcatgattgcttgtgaaacggacaaatcagttgatttacctgaagaaattgcttcttttgggatatggaaacagaaaatttatggcatttctaaagtaacggtctacgttcgt

SEQ ID NO: 130 - protein, 163 aa, Streptococcus agalactiae
MVRTTRPTTDKVKGAIFNMIGPFFEGGRVLDLFSGSGSLAIEAISRGMDQAVLVEKDRRAQVVIQENIAMTKSPEQFQLLKMEANRALEQLTGQFDLVLLDPPYAKEEIVKQIQIMDSKGLLGDDIMIACETDKSVDLPEEIASFGIWKQKIYGISKVTVYVR

SEQ ID NO: 131 - DNA, 537 bp, Streptococcus pyogenes
atgagagttgtatcaggtgaatttggtgggcgtcctttaaagacgctcgatggaaagataacacgccctacttcagacaaagttagaggtgcgatttttaatatgataggaccttactttaatggtggtcgtgttttagatttgtttgcaggttcaggtggattagccattgaggctgtttctcgtgggatgtctgctgcagttttggttgagaagaatcgtaaagcgcaagctattattcaagacaatattataatgactaaagctgagaatcggtttaccttgttaaaaatggaagctgagcgagctattgattgcttgactggtcgatttgacttagtctttttagaccctccttatgccaaagaaacaattgtggcaactattgaagctttagcagctaaaaacttattgagtgaacaggttatggttgtctgtgagacagataaaacagtcttgttgccaaaagagattgcaacgttaggtatttggaaagaaaaaatttatggaattagtaaggtaacagtttatgttaac

SEQ ID NO: 132 - protein, 179 aa, Streptococcus pyogenes
MRVVSGEFGGRPLKTLDGKITRPTSDKVRGAIFNMIGPYFNGGRVLDLFAGSGGLAIEAVSRGMSAAVLVEKNRKAQAIIQDNIIMTKAENRFTLLKMEAERAIDCLTGRFDLVFLDPPYAKETIVATIEALAAKNLLSEQVMVVCETDKTVLLPKEIATLGIWKEKIYGISKVTVYVN

SEQ ID NO: 133 - DNA, 483 bp, Streptococcus agalactiae
atgacaaagaaagctttatttacaggttcatttgatcctgttactaatggacatttagatattattgagcgcgccagctatctatttgatcatgtttacattgggttattttataaccttgagaagcaaggttacttttcgattgagtgccgtaaaaaaatgttagaagaagctatccgtcagtttaagaatgtttcagttttagtggcgcaagatagactggctgttgacttagcaagggaagtgggagcaaaatattttgttcgaggtctgcgtaatagccaggattttgattatgaagccaatttggagttttttaataaacagttggcagatgatattgagacagtttatttatcaacgtcgccatctttgagtccgatatcatctagtcgcatccgtgaattgatacattttaaggcttctgtgaagccttttgttccaaagagtgttgttagagaagtggagaaaatgagtgaagaa

SEQ ID NO: 134 - protein, 161 aa, Streptococcus agalactiae
MTKKALFTGSFDPVTNGHLDIIERASYLFDHVYIGLFYNLEKQGYFSIECRKKMLEEAIRQFKNVSVLVAQDRLAVDLAREVGAKYFVRGLRNSQDFDYEANLEFFNKQLADDIETVYLSTSPSLSPISSSRIRELIHFKASVKPFVPKSVVREVEKMSEE

SEQ ID NO: 135 - DNA, 489 bp, Streptococcus pyogenes
atgttaactaaaataggactttatacagggtcatttgatcctgttacaaacggtcatctcgatattgttaaacgggcaagtggcctatttgatcaaatatatgttgggatttttgataatcctaccaaaaaaagctattttaaactagaagttcgtaaagcaatgcttactcaagctctggctgattttacaaatgtaattgtagtaacttcgcacgaacgtttagctattgatgtagctaaagaattacgagtaactcacttgattagaggcttgcgaaatgcaactgactttgagtatgaagaaaatttggaatattttaatcaccttttagctccaaatattgaaaccgtctatttgatatcaagaaataaatggcaggcccttagctctagtcgtgtgagagagctaattcattttcagtcttccttagaaggtttggttcctcagtcggttattgctcaagtggagaaaatgaatgaaaagact

SEQ ID NO: 136 - protein, 163 aa, Streptococcus pyogenes
MLTKIGLYTGSFDPVTNGHLDIVKRASGLFDQIYVGIFDNPTKKSYFKLEVRKAMLTQALADFTNVIVVTSHERLAIDVAKELRVTHLIRGLRNATDFEYEENLEYFNHLLAPNIETVYLISRNKWQALSSSRVRELIHFQSSLEGLVPQSVIAQVEKMNEKT

SEQ ID NO: 137 - DNA, 141 bp, Streptococcus agalactiae
ttggatctctattcttcactcattttctccacttctctaacaacactctttggaacaaaaggcttcacagaagccttaaaatgtatcaattcacggatgcgactagatgatatcggactcaaagatggcgacgttgataaa

SEQ ID NO: 138 - protein, 47 aa, Streptococcus agalactiae
MDLYSSLIFSTSLTTLFGTKGFTEALKCINSRMRLDDIGLKDGDVDK

SEQ ID NO: 139 - DNA, 1071 bp, Streptococcus agalactiae
gtgaagaatagagatccaaaaagaaaacataaaagtttactaggtctgcttaaatggtggattataggttttgcttttttattgttagtattagcaagccttgtagtgagactaccttattatttggaaatgccaggtggagcttatgatatccgttcggtattgaaagtgaataaaaaggctgataaagctaagggttcgtacaattttgtagcggtatctgtcagtcaagcaacgccagctcaggttctttatgcttggttaactccttttacagaattatctagtaaagaggagacaacaggtggctttagtaatgacgattatctcagaattaatcaattctacatggagacttctcaaaatgagtccatctatcaagctttaaagttagctaataagcaagtatctcttacttataaaggagtttatgtgcttaacttagctaaaaattcgacatttaaagatagattacatttagctgatacagtcacaggagttaatggcaaaagtttcaaaaattcttctcaacttatcaaatatgttgcagctcttcatctaggtgataaagtaaaggtacaatacacaagtcaaggtaaaaagaaagaatcagttggtaaagttattaaactatcaaacggtaaaaatggtattggtatcggtttgacagaccatacagaagtattatctgatgttcctgtggactttaatactgaaggtgttggaggaccaagtgcaggtttaatgtttactttagcgatttacgaccaattggttaaagaagatttacgtaaaggacgtaagattgcaggtactggtactattgagcaaaatgggcatgttggcgatattggtggagcaggtttgaaagttgtttcagcggctaaaaaaggaatggatattttctttgttcctaataatccgatcgataaaaatgctaaaaaaggcaaaacaaaggttcagacgaattatcaagaggcaaaagcagcagctaagcgattaggtacgaagatgaaaattgtaccagttcaaaatgttcagcaagctattgattatttgaaaaaaacaaaa

SEQ ID NO: 140 - protein, 357 aa, Streptococcus agalactiae
MKNRDPKRKHKSLLGLLKWWIIGFAFLLLVLASLVVRLPYYLEMPGGAYDIRSVLKVNKKADKAKGSYNFVAVSVSQATPAQVLYAWLTPFTELSSKEETTGGFSNDDYLRINQFYMETSQNESIYQALKLANKQVSLTYKGVYVLNLAKNSTFKDRLHLADTVTGVNGKSFKNSSQLIKYVAALHLGDKVKVQYTSQGKKKESVGKVIKLSNGKNGIGIGLTDHTEVLSDVPVDFNTEGVGGPSAGLMFTLAIYDQLVKEDLRKGRKIAGTGTIEQNGHVGDIGGAGLKVVSAAKKGMDIFFVPNNPIDKNAKKGKTKVQTNYQEAKAAAKRLGTKMKIVPVQNVQQAIDYLKKTK

SEQ ID NO: 141 - DNA, 1035 bp, Streptococcus pyogenes
atgaaaagacttaaaaaaatcaaatggtggttagtgggtctgctagctttaatctctttgttgctagcgttattttttccgctaccttattatattgaaatgcctggaggcgcttacgatattcggactgtcttacaagtcaatggcaaagaagacaaacgaaaaggagcttaccagtttgttgcagtgggcattagtcgtgccagcctcgctcagctattatatgcttggctgacaccgtttactgaaattagtacagcagaagatacaacaggcggatacagcgatgctgatttccttcgaattaatcaattttacatggaaacatcacaaaatgcagctatttatcaagctttatccttagctggaaaaccagttacattagattataaaggcgtatatgttttagacgtaaacaacgaatctacttttaaaggaacgctacacttagcagatactgtaacaggtgtaaatggtaaacagtttactagttcagcagaacttattgactatgtttctcacctaaaactaggggatgaagttacggttcagtttacgagtgataataagcctaaaaaaggagttggccgtattatcaaactgaaaaatgggaaaaatgggattggcattgccttgactgatcatacaagtgtcaattcagaagacacagtgatctttagtactaaaggagtaggaggacctagtgctggtctaatgtttactcttgatatatatgatcaaataactaaagaagatttacgcaagggccgtacaattgcaggtacaggaactattggcaaggatggcgaagtaggagatattggtggtgcaggtcttaaagtagttgcagcagctgaagctggtgcagatatattttttgttccgaataatcctgttgataaggaaattaaaaaagttaatccaaatgctataagtaattacgaagaagccaaacgggcagccaaacgactaaagaccaaaatgaagattgttcctgttacgactgttcaagaggcactggtttatcttcgcaaa

SEQ ID NO: 142 - protein, 345 aa, Streptococcus pyogenes
MKRLKKIKWWLVGLLALISLLLALFFPLPYYIEMPGGAYDIRTVLQVNGKEDKRKGAYQFVAVGISRASLAQLLYAWLTPFTEISTAEDTTGGYSDADFLRINQFYMETSQNAAIYQALSLAGKPVTLDYKGVYVLDVNNESTFKGTLHLADTVTGVNGKQFTSSAELIDYVSHLKLGDEVTVQFTSDNKPKKGVGRIIKLKNGKNGIGIALTDHTSVNSEDTVIFSTKGVGGPSAGLMFTLDIYDQITKEDLRKGRTIAGTGTIGKDGEVGDIGGAGLKVVAAAEAGADIFFVPNNPVDKEIKKVNPNAISNYEEAKRAAKRLKTKMKIVPVTTVQEALVYLRK

SEQ ID NO: 143 - DNA, 822 bp, Streptococcus agalactiae
atgacagagcttataagaatactacatttaaatgatctgcactctcattttgagaattttcctaaggtaaaacgattttttcatgacaatcaagcgcagccaatagagacgatttcacttgacttgggggataatattgataaaagccatcctttgacagaagcaagctcgggaaaggctaatgtccaattgatgaatgaactgggtattgagcttgctactattggtaataatgaaggagttggtttatccaaaaaagacttggaccaagtctacaaagattcagattttacggttattgttggcaatctaaaagataacataatcgaaccgagttgggcaaaaccttacattatttatgagacgcagcaaggaactaagcttgcctttttagcttatacttttccttattataaaacctatgaacctaatgggtggacgatagaagatccaattgactgtcttaaatgccatttacaaataaatgagataaaagaggcaaattgtcgcattttgatgagtcatttaggtattcgttttgatacaaggattgctcaagaattttcagaaattgaccttattataggtgcacatacacaccatttatttgaggaaggggagctaattaacggtacatatcttgcagcagctggtaaatatggtcgctttgttgggagtattgatataacttttgataatcatacactaaaagatattttaatctcaacatgtgatacaaaacaactaactggttatccttcggacagtgactggctaagaagattgagtcagaaggtaaagaacagcttagaaaagaaagtt

SEQ ID NO: 144 - protein, 274 aa, Streptococcus agalactiae
MTELIRILHLNDLHSHFENFPKVKRFFHDNQAQPIETISLDLGDNIDKSHPLTEASSGKANVQLMNELGIELATIGNNEGVGLSKKDLDQVYKDSDFTVIVGNLKDNIIEPSWAKPYIIYETQQGTKLAFLAYTFPYYKTYEPNGWTIEDPIDCLKCHLQINEIKEANCRILMSHLGIRFDTRIAQEFSEIDLIIGAHTHHLFEEGELINGTYLAAAGKYGRFVGSIDITFDNHTLKDILISTCDTKQLTGYPSDSDWLRRLSQKVKNSLEKKV

SEQ ID NO: 145 - DNA, 441 bp, Streptococcus agalactiae
atggatgcgatgctgttttacgcaggtgcagatgttgctattatcaattctggcttaattgttcagccatttgaaaaagacttttcgaggaaaaatctccacgaatcattacctcatcaaatgcgcctcgctaaattgacagtgagtagtcaagaacttttagagatttatgaaactatttatcaacaaggtcaatttttagcgcaacaaaagattcatggtatgggctttcgtggcaagtgctttggagaagttttacattcgggatttgattacaaaaatggaaaaatagtgtataatgagaaagatattgatgccaaagaagaagtgattcttgtaatcgttgatcagtattattttgcatcgtattttgagtgtttaaaaacgaaaaaagtagacttgcttttcctgaattactcagagatgtggcagcagattatt

SEQ ID NO: 146 - protein, 147 aa, Streptococcus agalactiae
MDAMLFYAGADVAIINSGLIVQPFEKDFSRKNLHESLPHQMRLAKLTVSSQELLEIYETIYQQGQFLAQQKIHGMGFRGKCFGEVLHSGFDYKNGKIVYNEKDIDAKEEVILVIVDQYYFASYFECLKTKKVDLLFLNYSEMWQQII

SEQ ID NO: 147 - DNA, 576 bp, Streptococcus agalactiae
atgcgaaaagaagtgacaccagagatgcttaactataataagtatcctggcccacagttcattcactttgaaaatatcgttaaaagtgatgatattgaatttcaacttgttattaatgaaaaatcagcttttgatgtgactgtctttggacaacgtttttctgagattttattaaaatatgattttatcgttggcgattggggtaacgagcagttgaggctaagaggcttttacaaagatgctagtacaattagaaaaaatagccggatttcacgtttagaagattatattaaagagtattgtaactttggttgtgcttattttgtgttggagaatccaaatcctagagatattaaatttgatgatgaaagacctcataagcgtcgtaagtcaagatccaaatcacaatcatcaaagtcacaaactagaaataatcgttcccagtcaaatgccaatgctcattttacaagtaaaaagcgtaaagacacaaaacgccgtcaagaacgtcatattaaagaagagcaagataaggaaatgacctctgcaaagcagcattttgttattcgtaagaaaaaa

SEQ ID NO: 148 - protein, 192 aa, Streptococcus agalactiae
MRKEVTPEMLNYNKYPGPQFIHFENIVKSDDIEFQLVINEKSAFDVTVFGQRFSEILLKYDFIVGDWGNEQLRLRGFYKDASTIRKNSRISRLEDYIKEYCNFGCAYFVLENPNPRDIKFDDERPHKRRKSRSKSQSSKSQTRNNRSQSNANAHFTSKKRKDTKRRQERHIKEEQDKEMTSAKQHFVIRKKK

SEQ ID NO: 149 - DNA, 642 bp, Streptococcus pyogenes
atggatttttcagaaaggtgtcaaatgaaaaaagaaatttcgccagaaatgtacaactataataaatttccaggtcccaaatttattcattttgaagagcaagttaaggctgaaggcattgatttgttactcttagaagatgttaagaacgcttttgatacgactagctttggtcaacgttatacagaagttctcctaaagtatgactatattgttggcgattggggaaatgaacagcttcgtcttaaagggttttataaggatagtgacgatatcaagaaaacgaatcgcatctcacgtttagaagattatattaaagaattttgcaattttggttgtgcttattttgttttagaaaatcttcatccacaagatattaaatttgaagaggagcgccaaccaagacgaaagaaatcacctaaatcaaaatcaaatcgtcgcaagccaaactattcaaatcagcagcccgcaacacctaagagcaaatcgaagcgggcatcaaaagaaaagcaacctgaaaaccaagcgtttaccagtcaaaaacgtcgaagtaatactaagcataaagaaaagtcaaaacgtaatcagactagtcaacttaataccaaaattagtcattttatcatcagaaagaaagataaa

SEQ ID NO: 150 - protein, 214 aa, Streptococcus pyogenes
MDFSERCQMKKEISPEMYNYNKFPGPKFIHFEEQVKAEGIDLLLLEDVKNAFDTTSFGQRYTEVLLKYDYIVGDWGNEQLRLKGFYKDSDDIKKTNRISRLEDYIKEFCNFGCAYFVLENLHPQDIKFEEERQPRRKKSPKSKSNRRKPNYSNQQPATPKSKSKRASKEKQPENQAFTSQKRRSNTKHKEKSKRNQTSQLNTKISHFIIRKKDK

SEQ ID NO: 151 - DNA, 1122 bp, Streptococcus agalactiae
atgaagaaagaaaatattatgcctaaaaaaactgatacacccgcctataaaccctctatttatagcttaactcgcgatgaactaatagcttgggctattgaacatggagaaaagaaattccgtgcttcacaaatctgggactggctctataaaaagcgtgtgcaaagcttcgatgaaatgactaacatttccaaagattttattgcacttttgaacgagaattttgttgttaatcctctaaaacaacgtattgttcaagaatctgctgatggaactgttaaatacctttttgaattacctgatggcatgctgattgagacggttttgatgcgtcaacattatggtttatcagtatgtgtaacgactcaagttggttgtaacattggttgcactttctgtgcaagtggtttaataaagaaacaacgtgatcttaacaatggcgaaatcactgctcaaattatgcttgttcaaaaatattttgatgaacgtggacaaggtgagcgcgttagtcacattgtggtcatgggaataggtgaaccctttgataactataccaatgtattaaaattcttgcgtacagttaatgatgataatggattagctattggtgcacgtcacattacagtgtctacttcaggtttagcacataaaattcgtgaatttgcaaatgaaggtgtacaagttaacttagcagtatctcttcatgctccaaataacgatttacgatcaagtatcatgcgtattaatcgttctttccctcttgaaaagttgtttgcggctattgaatattatattgagacgactaaccgtcgtgtaacatttgagtatattatgttaaatggtgtcaacgataccccagaaaatgctcaagagttagcagatttaacgaaaaagattcgcaaattatcttatgtcaatttaattccttacaatcctgtctcagaacatgaccagtatagtcgtagtcctaaagagcgtgtagaagctttctatgacgttttgaagaaaaatggagttaactgtgttgttcgtcaagaacatggtacggacattgatgcagcttgcgggcaattacgttcaaacacaatgaaacgcgatcgtcaaaaagcgaaggtagggcag

SEQ ID NO: 152 - protein, 374 aa, Streptococcus agalactiae
MKKENIMPKKTDTPAYKPSIYSLTRDELIAWAIEHGEKKFRASQIWDWLYKKRVQSFDEMTNISKDFIALLNENFVVNPLKQRIVQESADGTVKYLFELPDGMLIETVLMRQHYGLSVCVTTQVGCNIGCTFCASGLIKKQRDLNNGEITAQIMLVQKYFDERGQGERVSHIVVMGIGEPFDNYTNVLKFLRTVNDDNGLAIGARHITVSTSGLAHKIREFANEGVQVNLAVSLHAPNNDLRSSIMRINRSFPLEKLFAAIEYYIETTNRRVTFEYIMLNGVNDTPENAQELADLTKKIRKLSYVNLIPYNPVSEHDQYSRSPKERVEAFYDVLKKNGVNCVVRQEHGTDIDAACGQLRSNTMKRDRQKAKVGQ

SEQ ID NO: 153 - DNA, 1077 bp, Streptococcus pyogenes
atgaaaccatcgatttatagcttaacacgcgatgaactgatcgcgtgggcagttgaacgcggccaaaaacagtttagagctactcaaatttgggattggctctataaaaaaagagttcaatcttttgaggagatgacgaatatttctaaagattttgtttctattttaaatgatagtttctgtgtcaatcctttaaaacagcgagttgtacaagagtcagctgatggtacagtaaaatatttatttgaactgcccgatggtatgttaattgaaacagttttaatgcgtcaacattatggtcattctgtttgtgtgacgactcaagttggctgtaacattggctgtactttttgtgctagtggattgatcaaaaagcaacgtgatctaaacagtggggaaattacagctcaaatcatgttagtccaaaaatattttgacgatagaaagcaaggtgagcgggttagccatgttgtcgtaatgggcattggtgaaccttttgataattacaaaaatgtcatgtgctttcttcgcgtcatcaacgatgataatggcttagcaattggtgcccgtcatattacagtctctacctcagggttagctcacaagattcgggattttgcaaacgagggagtacaggttaacttagcagtctcgttgcatgcaccaaataatgatttacgttcaagtattatgcgagtaaatcgctcttttccgcttgaaaagctcttttcagctatagaatactatattgaaaaaacgaatcgtcgtgtcacttttgaatacattatgctaaatgaagttaacgatagcattaagcaagctcaagaattagcagacttaactaaaactattcgtaagttatcttatgttaacttgattccgtataatcctgtttcagaacatgatcagtatagtagaagtcctaaagagcgagttctagcgttttatgatgtgctaaagaaaaatggagttaactgtgtggtgcgtcaagagcacggaacagatattgatgcagcctgtggccagttacgttctaaaacgatgaaaaaagatcgcgaaaaggttacagcgacaaaa

SEQ ID NO: 154 - protein, 359 aa, Streptococcus pyogenes
MKPSIYSLTRDELIAWAVERGQKQFRATQIWDWLYKKRVQSFEEMTNISKDFVSILNDSFCVNPLKQRVVQESADGTVKYLFELPDGMLIETVLMRQHYGHSVCVTTQVGCNIGCTFCASGLIKKQRDLNSGEITAQIMLVQKYFDDRKQGERVSHVVVMGIGEPFDNYKNVMCFLRVINDDNGLAIGARHITVSTSGLAHKIRDFANEGVQVNLAVSLHAPNNDLRSSIMRVNRSFPLEKLFSAIEYYIEKTNRRVTFEYIMLNEVNDSIKQAQELADLTKTIRKLSYVNLIPYNPVSEHDQYSRSPKERVLAFYDVLKKNGVNCVVRQEHGTDIDAACGQLRSKTMKKDREKVTATK

SEQ ID NO: 155 - DNA, 513 bp, Streptococcus agalactiae
atgcttaaaagattacttactgaagatggggaattgacaaagattagtcgtcgtttcgtttggatgttagtgattatctattgtcttattattgtcaggatgtgttttgggcctcaaattatgattgagggggtatcaactccgaatgttcagcgcttcggaagaattgtagctcttttagtaccatttaattcttttcgtagtttagatcagctaactagctttaaagagattttttgggttattggtcaaaatgtagtgaatattttactgctgtttcctctcattatagggttactatccctaaagccaagtttacggaaatataaaagcgttatattacttgctttcttgatgtctattttcatagagtgtactcaagttgttttagatattttaatagatgctaatcgggtttttgaaatcgacgatctatggacaaataccttaggcggtcctttcgccctatggacttatcgaaacataaaaggttggcttctaactattagaaaa

SEQ ID NO: 156 - protein, 171 aa, Streptococcus agalactiae
MLKRLLTEDGELTKISRRFVWMLVIIYCLIIVRMCFGPQIMIEGVSTPNVQRFGRIVALLVPFNSFRSLDQLTSFKEIFWVIGQNVVNILLLFPLIIGLLSLKPSLRKYKSVILLAFLMSIFIECTQVVLDILIDANRVFEIDDLWTNTLGGPFALWTYRNIKGWLLTIRK

SEQ ID NO: 157 - DNA, 1743 bp, Streptococcus agalactiae
atgtctattataaaaaatttgtggtggttttttaaggaagaaaagaagcgctatcttattggaattttgtcattaagtttggttgcggtgttaaatcttatccctcctaaaatcatgggatcagttattgatgctattacaactggaaaattaacaagaccacaattgctctggaatttattaggtttggttttgtcagctttagctatgtatgggctgcgttatatttggcgtatgtatattttagggacttcttacaaattgggtcaagttgtcagataccgtttatttgaacattttacaaaaatgtctccttctttttatcagaaatatcgtacaggtgatttaatggcgcacgcgaccaacgacatcaattctctaacacgtcttgcaggaggaggagttatgtcagcagtggatgcctctatcacagcattagtaacgcttatcaccatgttctttactatttcgtggcaaatgacattaattgcggttatccctttgcccttaatggccttagcaactagtaaattggggcgaaaaacccatgaaaccttcaaagaatctcaggcagccttttcagaattaaataataaagtgcaagaaagtgtctctggcgtcaaagtgactaaatcatttggttatcaagaacaagaaattgcttcttttcaagaggttaatcagatgactttcgtgaagaacatgcggaccatgacttatgatgtcatgtttgatcctttagttcttctttttataggtgcctcctacgtattaacattggctatgggagcttttatgatttcaaaaggtcaagttactgttggtgacttggtaacatttgtgacgtatttagatatgttggtatggcccttgatggcgattggtttcttgttcaatatggtacagcgtggtagtgtttcttataaccgtattaatagcctacttgagcaagaatcggatataactgaccctttaaatcctatcagacctgttgtcaatggaacattaagatatgatattgatttctttagatacgacaatgaagaaaccttagccgatattcatttcaccttagaaaaaggtcaaaccttaggtttggtaggtcaaacgggatcagggaagacaagtcttattaagttattgctacgtgaacatgatgtgactcagggaaaaattactttaaataaacatgatatacgtgattatcgattgtctgagttacgtcaactaatcggttatgttcctcaagatcagtttttatttgctaccagtattttagaaaatgttcgctttggaaatccaactctatctatcaatgctgttaaaaaagcaactaaattggctcatgtttacgatgacattaaacagatgccagcaggatttgagactctaattggagaaaaaggagtctcattatctggtggacaaaaacaaaggattgcgatgagtcgtgccatgattttagatccagatattcttattttggatgattctctatcagcagtggacgctaaaacggaacatgccattattgaaaatcttaaaacgaatcgtcaagggaaatcgactattatttcagcacatcgattatcagctgttgtgcacgcagaccttatcttagttatgcaagacggcagagtcatcgagcgaggtcagcatcaagagttgctaaataaaggtggttggtatgctgaaacgtatgcctcacagcaattagaaatggaggaagcatttgatgaagtc

SEQ ID NO: 158 - protein, 581 aa, Streptococcus agalactiae
MSIIKNLWWFFKEEKKRYLIGILSLSLVAVLNLIPPKIMGSVIDAITTGKLTRPQLLWNLLGLVLSALAMYGLRYIWRMYILGTSYKLGQVVRYRLFEHFTKMSPSFYQKYRTGDLMAHATNDINSLTRLAGGGVMSAVDASITALVTLITMFFTISWQMTLIAVIPLPLMALATSKLGRKTHETFKESQAAFSELNNKVQESVSGVKVTKSFGYQEQEIASFQEVNQMTFVKNMRTMTYDVMFDPLVLLFIGASYVLTLAMGAFMISKGQVTVGDLVTFVTYLDMLVWPLMAIGFLFNMVQRGSVSYNRINSLLEQESDITDPLNPIRPVVNGTLRYDIDFFRYDNEETLADIHFTLEKGQTLGLVGQTGSGKTSLIKLLLREHDVTQGKITLNKHDIRDYRLSELRQLIGYVPQDQFLFATSILENVRFGNPTLSINAVKKATKLAHVYDDIKQMPAGFETLIGEKGVSLSGGQKQRIAMSRAMILDPDILILDDSLSAVDAKTEHAIIENLKTNRQGKSTIISAHRLSAVVHADLILVMQDGRVIERGQHQELLNKGGWYAETYASQQLEMEEAFDEV

SEQ ID NO: 159 - DNA, 1785 bp, Streptococcus pyogenes
gtgatgaaaacagcacgttttttctggttttattttaaacgctatcgtttctcatttactgtcattgctgttgccgttatcttagcaacttatttacaagtaaaagctcctgtcttcttaggagagtccttgactgagttgggaaaaatcggtcaggcttattacgttgctaagatgagtggccagacacattttagccctgatttatcagcttttaatgccgtgatgtttaagcttttgatgacttatttctttactgttttagctaatctaatatatagtttcttacttacacgtgttgtctcacattcgactaaccgcatgcgcaagggcttatttggtaaattagaacgtttaaccgtcgccttttttgaccgccataaagatggggagattctttctcgtttcacgagtgatttggataatattcaaaactcgctgaaccaatccttgattcaagtggtgactaatattgccctttacatcggcctggtctggatgatgtttaggcaagatagccgtttagctttgttaaccatcgcatcaaccccagttgctctcatttttttagtgattaacatccgtttggcaagaaaatacaccaatatccaacagcaagaagtcagtgctttaaatgcttttatggatgaaaccatttcaggacaaaaggctattattgtacaaggtgtccaagaagatacgatgacagcctttttaaagcataatgaaagggttcgacaagccaccttcaaacgccgtctgttctcaggacaattatttccagtcatgaatggaatgagccttattaacacggctatcgtgatttttgtcggttcaacaattgtcctcagtgacaaatctatgccagcagcggcagcgcttggtttagtggttacttttgtacaatattcccagcaatattaccaacccatgatgcaaatcgcgtctagttggggagaattgcagctggcctttaccggtgctcaccgtattcaagaaatgtttgatgaaaccgaagaagttcgtccacaaaatgcaccagcgttcaccagcttaaaagaagcagtggcgattaaccacgtcgattttgggtatcttcctgggcaaaaagttttatcagatgtgtcaatcgttgcacccaagggcaaaatgattgccgtggttggaccgacaggttctggaaagaccactattatgaacttgattaaccgtttctacgatgtggatgcaggttcgattacctttgatggccgtgatattcgtgactacgatttggatagtcttcgtcaaaaggtagggattgtgttgcaagagtcagttcttttttcaggaaccattacggataatattcgttttggtgatcagaccattagtcaagacatggttgaaactgctgcgcgtgcgacccatattcatgactttatcatgtccttaccaaaagggtacaatacctatgtctcagatgatgacaatgtcttttcaacaggtcaaaagcagttgatttctattgctaggacgctactgactgaccctgaagtgttgattttggatgaggccacttcaaatgttgatacggttaccgaaagtaaaattcaacgggccatggaagctatcgtggcaggtcgaactagctttgtcattgctcaccgcctcaaaaccattttaaatgccgatcacattattgtgttgaaagatggcaaggtcattgagcaaggaaatcatcatgagctattgcatcaaaaaggcttttatgccgaattgtatcacaatcaatttgtctttgaa

SEQ ID NO: 160 - protein, 595 aa, Streptococcus pyogenes
VMKTARFFWFYFKRYRFSFTVIAVAVILATYLQVKAPVFLGESLTELGKIGQAYYVAKMSGQTHFSPDLSAFNAVMFKLLMTYFFTVLANLIYSFLLTRVVSHSTNRMRKGLFGKLERLTVAFFDRHKDGEILSRFTSDLDNIQNSLNQSLIQVVTNIALYIGLVWMMFRQDSRLALLTIASTPVALIFLVINIRLARKYTNIQQQEVSALNAFMDETISGQKAIIVQGVQEDTMTAFLKHNERVRQATFKRRLFSGQLFPVMNGMSLINTAIVIFVGSTIVLSDKSMPAAAALGLVVTFVQYSQQYYQPMMQIASSWGELQLAFTGAHRIQEMFDETEEVRPQNAPAFTSLKEAVAINHVDFGYLPGQKVLSDVSIVAPKGKMIAVVGPTGSGKTTIMNLINRFYDVDAGSITFDGRDIRDYDLDSLRQKVGIVLQESVLFSGTITDNIRFGDQTISQDMVETAARATHIHDFIMSLPKGYNTYVSDDDNVFSTGQKQLISIARTLLTDPEVLILDEATSNVDTVTESKIQRAMEAIVAGRTSFVIAHRLKTILNADHIIVLKDGKVIEQGNHHELLHQKGFYAELYHNQFVFE

SEQ ID NO: 161 - DNA, 1740 bp, Streptococcus agalactiae
ttgatgaagtctaatcaatggcaagtctttaagagattaatctcctatttacgcccttataaatggtttacagtattagctctatctctcttattgttgacgactgttgttaaaaatattattcctttaattgcttcacattttattgatcactatctgacaaatgttaatcaaacagcagttcttattttagtgggatattattcaatgtatgtcttgcagaccttaattcaatattttgggaatctcttttttgcgcgtgtttcttatagtattgttagagatattcgtagagatgcttttgctaatatggaaaggcttggcatgtcttattttgataggacaccggcaggatctatagtgtcacgtattactaatgatactgaagcaatatctgatatgttttcgggtattttatcgagttttatctcggcgatatttatttttacagttactctgtacactatgttgatgctagacattaaactaacaggacttgtcgctcttttattacctgttatctttatattagtgaatgtctatcggaaaaaatcagtcactgtcattgctaaaacgagaagtttacttagtgatatcaacagtaaattatcagaaagtattgaaggaattcgcattgtacaggcttttggtcaagaagagcgcttgaagactgaatttgaggaaattaacaaagagcatgttgtgtatgccaatcgttctatggctcttgatagtctcttcttaagaccggcgatgtctcttttaaaactcctagcatatgctgttcttatggcttattttggatttacaggagttaaaggaggtcttacggcaggattgatgtatgcttttattcagtacgttaatcgtctctttgaccctttaattgaagtaacgcaaaatttttcaaccttacaaacatcaatggtatcagcagggcgtgtgtttgatttgattgatgaaacaggttttgaaccaagccaaaaaaatacagaagcttttgtgagagaaggaaatatcgaatttaaaaatgtatcattctcatatgatggaaaaaaacaaatccttgataatgtttcttttagtgttaaaaaaggtgaaacgattgcttttgtaggagcgacaggttctggaaaatcatctattattaatgtctttatgaggttttacgaatttcaatctggacaagttttattagatgggaaggatattagggattactcacaagaacaattgcgaaagaatattggactcgtcttacaagacccctttttatatcatggcactattaaatctaatatcaaaatgtaccaagacatcaccgatcaagaggtacaggacgcagcagagtttgttgatgctgatcaatttattcagaagttgccagataagtacgatgcagctgtttcagaacgtgggtcaagtttttcgactggacaacgccaactattggcgtttgccagaactgtggctagtaaacctaaaattttaatcttagatgaagcgacagcaaatattgattcggaaacagagcagattgtacaagattcgttagcaaaaatgcgtcaaggtcgaacaacaattgccattgctcaccgcttatcaaccattcaagatgctaattgtatctatgttcttgatagaggaaagataattgaaagtgggaatcacgagtctttattagacctaaaagggacttattatcgtatgtaccaattacaagctggcatgatggaggtc

SEQ ID NO: 162 - protein, 580 aa, Streptococcus agalactiae
MMKSNQWQVFKRLISYLRPYKWFTVLALSLLLLTTVVKNIIPLIASHFIDHYLTNVNQTAVLILVGYYSMYVLQTLIQYFGNLFFARVSYSIVRDIRRDAFANMERLGMSYFDRTPAGSIVSRITNDTEAISDMFSGILSSFISAIFIFTVTLYTMLMLDIKLTGLVALLLPVIFILVNVYRKKSVTVIAKTRSLLSDINSKLSESIEGIRIVQAFGQEERLKTEFEEINKEHVVYANRSMALDSLFLRPAMSLLKLLAYAVLMAYFGFTGVKGGLTAGLMYAFIQYVNRLFDPLIEVTQNFSTLQTSMVSAGRVFDLIDETGFEPSQKNTEAFVREGNIEFKNVSFSYDGKKQILDNVSFSVKKGETIAFVGATGSGKSSIINVFMRFYEFQSGQVLLDGKDIRDYSQEQLRKNIGLVLQDPFLYHGTIKSNIKMYQDITDQEVQDAAEFVDADQFIQKLPDKYDAAVSERGSSFSTGQRQLLAFARTVASKPKILILDEATANIDSETEQIVQDSLAKMRQGRTTIAIAHRLSTIQDANCIYVLDRGKIIESGNHESLLDLKGTYYRMYQLQAGMMEV

SEQ ID NO: 163 - DNA, 603 bp, Streptococcus agalactiae
gtgtataatgaggtcaaagtgcaaggaaaggtctataaaatgttactattggtagataattacgattcttttacctataatttaaagcaatatttaagtgtctataaagaggtattcgtcataaaaaatgatgttcctaacctttttttattagctgagagcgcagaagccatcgtcttatcacctggaccaggacacccaaaggatgctgggaaaatggtagaattaatcaatcagtttataggaaagaaacctattctaggtatctgtttggggcatcaagcgcttgccgagtgcttgggtgggcgattaaatttagcaaatcacgttatgcatggtaaacaaagttgggtaacaataaacgaccatactagtttgtttaagggaattgatagtccaacccaagttatgcgttatcattcattggtagtgactgatttaccagagaatattgctgttattgcacgatcaaatgaggataatgaaatcatggcattccattgccccagcttaaaggtatatgcgatgcagtttcatcctgagtcaatcgggagtattgatggaatgaaaatgattgaaaactttttgacgttaattaatgac

SEQ ID NO: 164 - protein, 201 aa, Streptococcus agalactiae
MYNEVKVQGKVYKMLLLVDNYDSFTYNLKQYLSVYKEVFVIKNDVPNLFLLAESAEAIVLSPGPGHPKDAGKMVELINQFIGKKPILGICLGHQALAECLGGRLNLANHVMHGKQSWVTINDHTSLFKGIDSPTQVMRYHSLVVTDLPENIAVIARSNEDNEIMAFHCPSLKVYAMQFHPESIGSIDGMKMIENFLTLIND

SEQ ID NO: 165 - DNA, 564 bp, Streptococcus pyogenes
atgatactcttaattgataattacgattcatttacctacaacctcgcccaatatttaagtgaatttgacgagacgattgtcttgtataaccaagacccaaacttatatgacatggccaaaaaagctaacgctctagtcctctcacctggtcctggttggcccaaggaagccaaccaaatgccaaaactcattcaagacttttaccaaacaaaacctatcttaggagtgtgtctgggacaccaagctatcgctgaaactttagggggaaccttacgcttggccaaacgcgtcatgcatgggagacaaagcaccattgaaacgcaaggccctgctagtctttttcgctccctgccacaagagatcaccgtcatgcgctaccattccatcgttgtggatcagttaccaaaaggttttagcgtaaccgctagagactgtgacgatcaagaaatcatggcatttgaacaccacaccctgccactttttgggctacaatttcacccagaaagcatcggaactcctgatggcatgaccatgattgccaacttcatcgcagccattccccgt

SEQ ID NO: 166 - protein, 188 aa, Streptococcus pyogenes
MILLIDNYDSFTYNLAQYLSEFDETIVLYNQDPNLYDMAKKANALVLSPGPGWPKEANQMPKLIQDFYQTKPILGVCLGHQAIAETLGGTLRLAKRVMHGRQSTIETQGPASLFRSLPQEITVMRYHSIVVDQLPKGFSVTARDCDDQEIMAFEHHTLPLFGLQFHPESIGTPDGMTMIANFIAAIPR

SEQ ID NO: 167 - DNA, 537 bp, Streptococcus agalactiae
atgaaaacaagaacaactacctatattgcactcatggttgcactacttattgttttaggttttatcccagggatcccattaggtttcattccagtcccaattgttttacaaaatcttggtgttatgctggcaggtgctctgcttggtagtaggaagggtttcctagctgtggctattttcttgctcttagttgctattggtgcaccatttttaccaggaggacggtcaggtctcgtaacgctgtttgggccaacagcaggctatctgctgacttatccatttgcagctttttttatcggcctagggcttgagaaagtgaaaacaacaaaactctgggttcaattccttattatttggatatttggcgtactattgattgatatttgtggtagcatcgttctttcctttcaaacttctctacccttaactaaatcactattttctaaccttatttttattcctggggataccttaaaagcatccatttgcttgattatttatcgtaaatttgcaaacagattaactcatctatacaac

SEQ ID NO: 168 - protein, 179 aa, Streptococcus agalactiae
MKTRTTTYIALMVALLIVLGFIPGIPLGFIPVPIVLQNLGVMLAGALLGSRKGFLAVAIFLLLVAIGAPFLPGGRSGLVTLFGPTAGYLLTYPFAAFFIGLGLEKVKTTKLWVQFLIIWIFGVLLIDICGSIVLSFQTSLPLTKSLFSNLIFIPGDTLKASICLIIYRKFANRLTHLYN

SEQ ID NO: 169 - DNA, 537 bp, Streptococcus pyogenes
atgtttacaaccaaagaacttgttaaggtggctatgatgaccactttgattattattttaggctttattcctgctatcccgctaggctttatcccagtccctattgttttacaaaacttaggtgtcatgttggctggattgatgctgggtggtaaaaagggaaccttatctgttttcttatttttagtgattggccttttcttacctgttttctcaggctcaagaacaaccattccagtattgatggggccatctgctggctatgttattgcctaccttcttgtgcctattgtcttttcattactttaccgcaattggttctcaaaaagcacgccattagcattcctagctcttttaatctcaggagttgtactggttgatgttctgggtgctatctggttgtcagcctacactggcatgtctcttgtgacatcgcttttatcaaacttggtctttattccaggagataccatcaaagcaatcattgcgaccattatcgctgttaaatacaaagatagttttttgaatacaaaacag

SEQ ID NO: 170 - protein, 179 aa, Streptococcus pyogenes
MFTTKELVKVAMMTTLIIILGFIPAIPLGFIPVPIVLQNLGVMLAGLMLGGKKGTLSVFLFLVIGLFLPVFSGSRTTIPVLMGPSAGYVIAYLLVPIVFSLLYRNWFSKSTPLAFLALLISGVVLVDVLGAIWLSAYTGMSLVTSLLSNLVFIPGDTIKAIIATIIAVKYKDSFLNTKQ

SEQ ID NO: 171 - DNA, 120 bp, Streptococcus agalactiae
gtgactaatgattcaaaattctcaaaatggacctctcgtccagcgcttaatcttaattccttgaaaggaaaaacaaaacgcaacatggccataatttttaagcatttaatgggagtcaaa

SEQ ID NO: 172 - protein, 40 aa, Streptococcus agalactiae
MTNDSKFSKWTSRPALNLNSLKGKTKRNMAIIFKHLMGVK

SEQ ID NO: 173 - DNA, 1023 bp, Streptococcus agalactiae
atgctattattaatttcgttaaaggaggctatcatgtcatttcaaacaaattatatccatttggctgacgaaatattatctggaaagactagcatttcttatgaacaagcgctggaaattctaaatagcgatgagaactggtgggaaatctacgctgctgccttataccttaaaaatcaagttagccgaaataatattcgccttaacgttttattaagtgctaagcaaggactttgtgcagaaaattgtggttactgttctcaatctaaagaaagcactgctgacattgataaatttggtctgcttcctcaaaatgtcattctaaaacaggctattgtcgctcatcaaaatggtgctagcgtcttttgtattgcgatgagtggaactaagcctagcaagagagaaattgagcagttatgtcaagtcatccctgaaatcaaaaaaagcctccctctagaaatatgccttaccgctggttttttggatagagaacaacttcatcagctaaaacaagcaggaattgaccgtatcaatcataatctcaacacccccgaagaaaactaccccaacattgcaacgacgcatagcttcaaagatcgttgtgatactttagaaagaattcacaatgaagacattgatgtttgttctggattcatttgtggtatgggagagagcgatgaggggctcatcacattagctttcagactaaaagagctggacccctattctatccctgtcaattttttacttgctgttgaaggaacacctcttggaaaatataactatttgactcccattaaatgcttaaaaattatggccatgttgcgttttgtttttcctttcaaggaattaagattaagcgctggacgagaggtccattttgagaattttgaatcattagtcaccttacttgttgactcaacttttttgggaaattacctaacagagggcggtcgcaatcaacataccgatattgaattcttggaaaaattacaactaaatcatactaaaaaggaattaatt

SEQ ID NO: 174 - protein, 341 aa, Streptococcus agalactiae
MLLLISLKEAIMSFQTNYIHLADEILSGKTSISYEQALEILNSDENWWEIYAAALYLKNQVSRNNIRLNVLLSAKQGLCAENCGYCSQSKESTADIDKFGLLPQNVILKQAIVAHQNGASVFCIAMSGTKPSKREIEQLCQVIPEIKKSLPLEICLTAGFLDREQLHQLKQAGIDRINHNLNTPEENYPNIATTHSFKDRCDTLERIHNEDIDVCSGFICGMGESDEGLITLAFRLKELDPYSIPVNFLLAVEGTPLGKYNYLTPIKCLKIMAMLRFVFPFKELRLSAGREVHFENFESLVTLLVDSTFLGNYLTEGGRNQHTDIEFLEKLQLNHTKKELI

SEQ ID NO: 175 - DNA, 528 bp, Streptococcus agalactiae
atgatatactggtcttatattttgacgggagataagatgaaaaaactatttaaaaaagcgatagctatgtgccgagatttgccgcttaattttgtaattgttgaacttagtttgtatcaaagagaggatggctcatctgataatattaaatggatttctaagagaattcttgaggtaacggtaactgatcagcaatggatttaccatttgaggatgcttaatttaccaaaacttaagccaatgtcactagcatccagtgactgtcctgcaagggaagagaaggctagtcttatttcaatagaagaatgtcaaaaattcactagcttagtgcgagataaaaatccttttcaccaaggggaagcagctattgtgcctgcggctctattattggaaaaaataatggaagttagaaaaggaaaaataaaggagattcatttgacttttttatctccagtaagggtgaatcaagaattctcagtgcaagtagtggataacacagtgattatttttcagcatcaaatattatgg

SEQ ID NO: 176 - protein, 176 aa, Streptococcus agalactiae
MIYWSYILTGDKMKKLFKKAIAMCRDLPLNFVIVELSLYQREDGSSDNIKWISKRILEVTVTDQQWIYHLRMLNLPKLKPMSLASSDCPAREEKASLISIEECQKFTSLVRDKNPFHQGEAAIVPAALLLEKIMEVRKGKIKEIHLTFLSPVRVNQEFSVQVVDNTVIIFQHQILW

SEQ ID NO: 177 - DNA, 99 bp, Streptococcus agalactiae
ttgtttaatgcacgatgctgctgcatttctaacgcttcagagtcagaaaacagaattccggattgttcacattgtagaagtagcaggagatcccaagct

SEQ ID NO: 178 - protein, 33 aa, Streptococcus agalactiae
MFNARCCCISNASESENRIPDCSHCRSSRRSQA

SEQ ID NO: 179 - DNA, 1113 bp, Streptococcus agalactiae
atgaagaatagagatgtttatattggttttgggctacgaacacctatcggtataaaagggaagcaatttaaacattaccgtccagaacttttaggagcacaccttttaaatcaaataaaaaaaatagaatcagaatctaacattgatagtattatttgtgggaacacagttggtactgggggcaatattggtcgtttgatgactcttttttctgattatgaatcctatattccagtacaaacgattgatatgcagtgtgcttcatcaagttctgccttgttttttggttatctaaaaatcagtaccggtattaatgaaaaagttcttgttggggggattgaaagtagttctcttcaacctatgagacgttatgctaaagaagataatcgtaacggagaatatacagttgctcagttttctcctgactcttatgctgaaactgtaatgttagaaggggcccagagagtctgtcaaaaatatggttttagaagagaaatgttagataaattggcattcttgagccataaacgcgccttaacagctaaacaaggtggctatttagaagaggtaatcttaccaatggaagggatgcgagatcaaggcgttagaaaactaaaagaaacattttttcaaaaattaccaagattgatggaaaattcacctttgctcactattggaaatgtttgtttaatgcacgatgctgctgcatttctaacgcttcagagtcagaaaacagaattccggattgttcacattgtagaagtagcaggagatcccaagcttagtccagaattggttcacacggctacggaaaaactattaacagaaactcatactaaaatatcggattatgatgcaattgaatggaatgaaccatttgcagcgattgatgctctatttaatcattattatcctgaagagagagaaaaattcaatatttttggagggacattagcttacggacacccttatgcctgctcaggaattattaatatccttcatcttatgcaggcattaaaatataaaaataaacctatgggtctaactgccattgcaggggcaggaggagtcggaatggccatatcaatagagtacttaggagttaagaatgct

SEQ ID NO: 180 - protein, 371 aa, Streptococcus agalactiae
MKNRDVYIGFGLRTPIGIKGKQFKHYRPELLGAHLLNQIKKIESESNIDSIICGNTVGTGGNIGRLMTLFSDYESYIPVQTIDMQCASSSSALFFGYLKISTGINEKVLVGGIESSSLQPMRRYAKEDNRNGEYTVAQFSPDSYAETVMLEGAQRVCQKYGFRREMLDKLAFLSHKRALTAKQGGYLEEVILPMEGMRDQGVRKLKETFFQKLPRLMENSPLLTIGNVCLMHDAAAFLTLQSQKTEFRIVHIVEVAGDPKLSPELVHTATEKLLTETHTKISDYDAIEWNEPFAAIDALFNHYYPEEREKFNIFGGTLAYGHPYACSGIINILHLMQALKYKNKPMGLTAIAGAGGVGMAISIEYLGVKNA

SEQ ID NO: 181 - DNA, 1146 bp, Streptococcus pyogenes
atgacggatgtttatattgctgcaggccttagaacccctatcggtttagtagggaaacaatttgctaaagaacaaccagaaatccttggagcaaagctcatcaacgctttacaaaataagtatccagttcccattgaccaagtgatttgtggcaataccgtcggaacgggtggtaatattgggcgcttgatgaccctgtattctcatttaggagaatctgtctctgctttgacggttgatatgcagtgtgcatcagctggtgcagctctttccgtgggttatgctaaaatcaaggcaggtatggcaagcaaccttttagtgggagggattgaaagcagctccttacaacctgaatcggtatatgcttcagctgattggcgccaaggagcctacaaggtagctcagttttctccagatagtatcagcccttttgcgatgattgaaggggcagaacgagtggcaagagagcatggctttacaaaggagtatttgaatcactggacattgagaagtcatcaaaaggctagttattgccaggagcaagccctgttagctgatcttattctagacctgtcaggagccagtgatcaaggtattcgaccgcgcttgtcaagtaaggtgttgtcaaaggtaccccctatcttaggagaaggtcacgtgattagtgcagccaatgcctgcctaacccatgatgctgctgcctttttacagctaagtagtcagccttcagcttttaaactgattgatgtggtagaagtagcaggagacccacagcgtagccctttaatggtgattaaggctagtcaagtccttttggaaaaacatggtctagggatggcagatatgacagcgattgaatggaacgaagcctttgccgttattgatggtctatttgaaacccattatccagatttattggaccgctataatatatttggtggtgcattagcttatggtcatccctatggtgcctcagcagccattataatattgcacttaatgagggctttagagattaaaaatggacgctatggaatagctgctatagcagcagctggtggccaagggtttgctgttttactaaaatatcataaggagtttagtcatgctgacaaagctagaatattgggcaaagcaatgcccaaa

SEQ ID NO: 182 - protein, 382 aa, Streptococcus pyogenes
MTDVYIAAGLRTPIGLVGKQFAKEQPEILGAKLINALQNKYPVPIDQVICGNTVGTGGNIGRLMTLYSHLGESVSALTVDMQCASAGAALSVGYAKIKAGMASNLLVGGIESSSLQPESVYASADWRQGAYKVAQFSPDSISPFAMIEGAERVAREHGFTKEYLNHWTLRSHQKASYCQEQALLADLILDLSGASDQGIRPRLSSKVLSKVPPILGEGHVISAANACLTHDAAAFLQLSSQPSAFKLIDVVEVAGDPQRSPLMVIKASQVLLEKHGLGMADMTAIEWNEAFAVIDGLFETHYPDLLDRYNIFGGALAYGHPYGASAAIIILHLMRALEIKNGRYGIAAIAAAGGQGFAVLLKYHKEFSHADKARILGKAMPK

SEQ ID NO: 183 - DNA, 1227 bp, Streptococcus agalactiae
atgcttgaatcattgaaaacgatagttaaaaccaatagcgataaaaagttatttgatggtgatttacaggtcagttatggagaattttataacttagtaagacaagatatggcgtcacaagacaataggaaacatgtgattagcacacactctctgcttaaccaattagtaagatttgtttcaaagttatgtcaaaaagctcttcctattatttgtaaacctaaccttactcataatgaaataagtcgattagaaaaagaagtgcagtatgctcctcaactagctgattttggtgttctttcttctgggactacagctgatgctaaactattgtggaggagcttcacttcgtggtctgatttttttagcattcagaatgcttatttttcggtcacttccaatagcaaactgtttattcaaggtgatttttcatttactggtaacttaaatttagcgctatcccttttattactggggggaacacttgttgtcacacagaaaaattctgtaaaatactggcagactttatgggaaaaaactggtgtaacgcatctatatctgctccctagttatctcaagttagtggaacaatatagcaaggagactgcgttagacaataaaactattattacctcttcgcaatatgtctctgactcattactggaaggtttatatagaaagcatcctaaagtgtcagtgaaaatcttctatggtgctagtgagctcaattatgtgtcatggtacgatggtcgtgatatccgagataagccacagtatgttggagaaatcgttccaaatgtagctgttaggattaaagagggaagaatttttgtaaaaacaccgtatagtatctgtggcctttcaagtgaatattgtgctggtgattatggtgaactgatagatggcaaattatatctatttggccgtggtggtgattggtgcaatcaatcgggcattaagctctatttacctagattaatcgaaaaaataaaaacatgcccttatatcaaggatgcagtagcatttacaaaagagagtcaaagtcatggacaagagtcacattgctgtattgttttaattgaaaatcagatgcaacaagagtgtttgaagtggttatcggaacattttgaaaagaagtatgggtttaagcattatcatattgtatctaaaattcctttgatgccatctggaaaaattgattatcaacaactcaaaagacagttagca

SEQ ID NO: 184 - protein, 409 aa, Streptococcus agalactiae
MLESLKTIVKTNSDKKLFDGDLQVSYGEFYNLVRQDMASQDNRKHVISTHSLLNQLVRFVSKLCQKALPIICKPNLTHNEISRLEKEVQYAPQLADFGVLSSGTTADAKLLWRSFTSWSDFFSIQNAYFSVTSNSKLFIQGDFSFTGNLNLALSLLLLGGTLVVTQKNSVKYWQTLWEKTGVTHLYLLPSYLKLVEQYSKETALDNKTIITSSQYVSDSLLEGLYRKHPKVSVKIFYGASELNYVSWYDGRDIRDKPQYVGEIVPNVAVRIKEGRIFVKTPYSICGLSSEYCAGDYGELIDGKLYLFGRGGDWCNQSGIKLYLPRLIEKIKTCPYIKDAVAFTKESQSHGQESHCCIVLIENQMQQECLKWLSEHFEKKYGFKHYHIVSKIPLMPSGKIDYQQLKRQLA

SEQ ID NO: 185 - DNA, 1245 bp, Streptococcus pyogenes
atgctgacaaagctagaatattgggcaaagcaatgcccaaataaaaaagctatcgtagccgatcagataagcttgacttatcaagagctatggcaagcggttttaataaaggatcagacaataaaagacagtgtaccatatatcatcagtcatagtcgctatcttaatcagttactctcttttttacgaggattaaaagaaggcagttgtcctatcattttacaccctaatatctcaggtacatttcagcagcaaataaaacacgtcgatggtgagcttcttaaaaaagctgattttgctgttttgagttcgggaacaactggcaaagcaaaattattttggcgtcgtctatcaacttggacgagactttttgattatcaaaataaggtgtttggtatgactggtaatagttgtctattcttacatggtagttttagttttactggcaatcttaacttagcattagctcaactatgggccgggggatgtctggttttaagccaaaagctgtctttgaaaacgtggttaagcttatggcaagcaaaaaaggtgagtcacctttaccttttaccgacctacctaaatcgcttgctaccttatttgactaagaacaacatgactgcgactcacttattgacctcttcgcaaatgatatcacaagaattactaagacattattacaaaaaatttcctcagcttgaaattgtcattttctacggggctagtgaattatcttttataacgtggtgtaatggcagagctgctgtcaaaattaatggtttggtaggacagccctttcctgatgtgtctatcagtttcaaagataaggaaatttttgtagagactccttatagtgtagaaggaatgtcacaaccatacagtgtttcagacttaggaaaaatgagcccagcgggtttaattttagaagggcgacaagatgactgggttaatcaacgaggagtgaaatgccacctgcctagcctagttgaactcgctcaccaagcgccaaacgtcaaagaagcgcacgctttaaagataggaaaaggagaaaacgaaaccctaatattagtattagttttgactaagaaggattgcctagcacctattaaagactttttagctctttatttaaactctggacaacttcccaagtactatcttgtgattgattgtttgcctttaaaagataatggtaaaattaatcgagaagttcttttaaataaaatacccaaacagtggcttagt

SEQ ID NO: 186 - protein, 415 aa, Streptococcus pyogenes
MLTKLEYWAKQCPNKKAIVADQISLTYQELWQAVLIKDQTIKDSVPYIISHSRYLNQLLSFLRGLKEGSCPIILHPNISGTFQQQIKHVDGELLKKADFAVLSSGTTGKAKLFWRRLSTWTRLFDYQNKVFGMTGNSCLFLHGSFSFTGNLNLALAQLWAGGCLVLSQKLSLKTWLSLWQAKKVSHLYLLPTYLNRLLPYLTKNNMTATHLLTSSQMISQELLRHYYKKFPQLEIVIFYGASELSFITWCNGRAAVKINGLVGQPFPDVSISFKDKEIFVETPYSVEGMSQPYSVSDLGKMSPAGLILEGRQDDWVNQRGVKCHLPSLVELAHQAPNVKEAHALKIGKGENETLILVLVLTKKDCLAPIKDFLALYLNSGQLPKYYLVIDCLPLKDNGKINREVLLNKIPKQWLS

SEQ ID NO: 187 - DNA, 630 bp, Streptococcus agalactiae
atgttatcaaaagcaaaatcacgatatattatccgtgagattattaagttatttccagatgctaaacctagcttagactttactaatgtctttgagcttttggtagctgtaatgctatcagctcaaacaactgatgcagctgttaataaagttacacccgccctttttgaacgctttccaaatcctttagttttggcacaagctgatcccaaagagattgaaccctatatttctaaaattgggctttaccgtaataaagctcgattcttaaatcaatgcgctaaacaattgatagagcattttgatggaaaagtcccccgaactcgtcaagagctagaaagtttggctggcgttggaaggaaaacggctaacgtggtcatgagtgttggatttggtattccggcttttgccgtagatactcatgtcactcggatttgtaaacaccaccagatttgcaaacagtcggcttctccactggaaattgagaaacgagtcatggaggttttaccaccagaagagtggctagctgcacatcaatccatgatttattttggtcgtgcaatttgtcatcctaaaaatccaaaatgcgaccagtacccacaactttatcactttcctgataatttaaag

SEQ ID NO: 188 - protein, 210 aa, Streptococcus agalactiae
MLSKAKSRYIIREIIKLFPDAKPSLDFTNVFELLVAVMLSAQTTDAAVNKVTPALFERFPNPLVLAQADPKEIEPYISKIGLYRNKARFLNQCAKQLIEHFDGKVPRTRQELESLAGVGRKTANVVMSVGFGIPAFAVDTHVTRICKHHQICKQSASPLEIEKRVMEVLPPEEWLAAHQSMIYFGRAICHPKNPKCDQYPQLYHFPDNLK

SEQ ID NO: 189 - DNA, 654 bp, Streptococcus pyogenes
atgagaattggaaaagcaagattagcaaaagtcctgaccatcattggtcaaatgtttcctgaggctaagggagagttagactgggaaacaccttttcaattgttgattgcggtgattttatcagctcaaacgacagataaggccgtcaataaggtaactcctggactatggcagtcttatccagaaatagaagacttagcttttgctgaactttctgatgttgaaaatgctctgagaacgattggactctataaaaataaggccaaaaatatcattaaaactgctcaggctattcgtgatgattttaagggtcaagtgccaaaaacccacaaagagcttgaaagtttaccgggtgttggccgaaaaacagccaatgtggtgctggcagaggtttatggtgttccagctattgcggttgatactcatgtggctagagtctcaaagaggctcaatatttcatcgccagatgccgatgtcaagcagattgaagcagatttgatggctaaaattccaaagaaagattggattattactcaccatcgattgattttttttggacgctaccattgtttagccaaaaaaccaaaatgtgagatttgtcccgttcagtcttactgcaagtactatcaagatacttatggaaaatcgaaagcc

SEQ ID NO: 190 - protein, 218 aa, Streptococcus pyogenes
MRIGKARLAKVLTIIGQMFPEAKGELDWETPFQLLIAVILSAQTTDKAVNKVTPGLWQSYPEIEDLAFAELSDVENALRTIGLYKNKAKNIIKTAQAIRDDFKGQVPKTHKELESLPGVGRKTANVVLAEVYGVPAIAVDTHVARVSKRLNISSPDADVKQIEADLMAKIPKKDWIITHHRLIFFGRYHCLAKKPKCEICPVQSYCKYYQDTYGKSKA

SEQ ID NO: 191 - DNA, 207 bp, Streptococcus agalactiae
atgaaagttttattcgatgtgcagaatcttttgaaaaaatttggtatttatgtttatattggtaaacgtctttatgatatcgaagttatgaagattgaattgcaacgtctctacgataatggtctgataagtagagatgattatttaaaagcagaactgattttaagaagagagcacagactagaattggagaaggaaaataaaaaa

SEQ ID NO: 192 - protein, 69 aa, Streptococcus agalactiae
MKVLFDVQNLLKKFGIYVYIGKRLYDIEVMKIELQRLYDNGLISRDDYLKAELILRREHRLELEKENKK

SEQ ID NO: 193 - DNA, 219 bp, Streptococcus pyogenes
ttgctaaaatctacttatatgaaaacactatatgatgtgcaacaattgctaaaaaactttggcatttttgtttaccttggcaaacgtctttatgatattgaaatgatgaagattgaacttcagcgtctctatgatagcggcttattggataagagggattacttaaatgcggagttaattttgcgacgtgagcatagattagaattggaaaaagaagga

SEQ ID NO: 194 - protein, 73 aa, Streptococcus pyogenes
LLKSTYMKTLYDVQQLLKNFGIFVYLGKRLYDIEMMKIELQRLYDSGLLDKRDYLNAELILRREHRLELEKEG

SEQ ID NO: 195 - DNA, 966 bp, Streptococcus agalactiae
atgagtaagaaattattgggaattgacctcggaggaacgaccattaaatttggtatcttgacgcttgagggagaagtacaagaaaaatgggcaattgagaccaatactttagaaaacggaagacatatcgtttctgatatcgttgaatctctcaaacatcgtttgagcctctatggattaacaaaagatgactttctcggtatcggtatgggttctccaggagctgttgatagaactagtaaaacagtaacaggtgcttttaatctaaattgggctgatactcaagaagtaggttcagttattgaaaaagaagttggaattccattttttattgataacgatgctaatgttgcagcacttggtgaacgctgggtaggtgctggtgccaataatcccgacgttgttttcgtaaccctcggaacaggagtaggtggaggtgttatcgcagatggtaacctcatccatggtgttgcaggagcaggtggagaaattgggcatatgattgttgatccagaaaatggatttacgtgcacatgtggtaacaaaggctgccttgagacagttgcatcagcgacaggtgttgttagagtagcacgtcaactcgcagaacaatatgagggttcgtctgccattaaagcagcgattgacaacggtgatactgttacaagtaaagatatttttatagcagcagaagatggggataaatttgctaattctgttgttgaacgtgtatcacgttaccttggactggcagcagctaatatttcaaatattttaaaccctgattctgtggttattggtggcggtgtctcagcagcaggtgaatttttacgtagtcgcgttgagaaatactttgtcacatttgctttcccacaagttaaaaagtcaactaaaattaagattgctgaactaggtaatgatgctggtattattggtgcagcaagcttagccaatcaacaagcaagt

SEQ ID NO: 196 - protein, 322 aa, Streptococcus agalactiae
MSKKLLGIDLGGTTIKFGILTLEGEVQEKWAIETNTLENGRHIVSDIVESLKHRLSLYGLTKDDFLGIGMGSPGAVDRTSKTVTGAFNLNWADTQEVGSVIEKEVGIPFFIDNDANVAALGERWVGAGANNPDVVFVTLGTGVGGGVIADGNLIHGVAGAGGEIGHMIVDPENGFTCTCGNKGCLETVASATGVVRVARQLAEQYEGSSAIKAAIDNGDTVTSKDIFIAAEDGDKFANSVVERVSRYLGLAAANISNILNPDSVVIGGGVSAAGEFLRSRVEKYFVTFAFPQVKKSTKIKIAELGNDAGIIGAASLANQQAS

SEQ ID NO: 197 - DNA, 969 bp, Streptococcus pyogenes
atgagtcaaaaattactggggattgatttaggtggtaccaccattaaatttggaattttaacagcagcaggagaagtccaagaaaaatgggcaattgagactaatattttagaaggaggcaaacatattgtccctgatatcatcgcttccatcaaacatcgcttagacttgtatggtctaagcagtgctgactttgtgggaattggtatgggatcaccaggagcggttgaccgtgatactaatacagttactggggcattcaaccttaattggaaagaaacccaagaagtcggttccgttgttgaaaaagaattgggcattccttttgccattgacaatgatgccaatgtggctgcccttggtgaacgttgggtaggtgctggtgaaaataacccagatgtcgtcttcatgacacttggaacaggtgtcggtggaggcattattgctgatggtaacttgattcatggtgttgcaggagcaggtggtgaaatcggccacatgattgttgagccagaaaatggctttgcttgtacttgtggctcacacggctgtttggaaacagtagcttcagcaacaggagttgtcaaagtggcacgtttactggcagaagcctacgaaggggattcagccatcaaagcagctattgacaatggtgaaggtgttaccagtaaagacattttcatggcggctgaagcaggggattcctttgctgattctgttgtggaaaaggttggttactaccttggccttgcttcagcaaatatttccaatatcttgaatccagactcagtggttatcggtgggggtgtgtcagcagcaggagaatttctacgctcacgtattgaaaaatactttgtgaccttcactttcccacaagtgaggtattcaactaaaattaagattgcagaacttggcaatgatgctggaattatcggtgcagctagccttgctcgacaatttatcacaaaa

SEQ ID NO: 198 - protein, 323 aa, Streptococcus pyogenes
MSQKLLGIDLGGTTIKFGILTAAGEVQEKWAIETNILEGGKHIVPDIIASIKHRLDLYGLSSADFVGIGMGSPGAVDRDTNTVTGAFNLNWKETQEVGSVVEKELGIPFAIDNDANVAALGERWVGAGENNPDVVFMTLGTGVGGGIIADGNLIHGVAGAGGEIGHMIVEPENGFACTCGSHGCLETVASATGVVKVARLLAEAYEGDSAIKAAIDNGEGVTSKDIFMAAEAGDSFADSVVEKVGYYLGLASANISNILNPDSVVIGGGVSAAGEFLRSRIEKYFVTFTFPQVRYSTKIKIAELGNDAGIIGAASLARQFITK

SEQ ID NO: 199 - DNA, 378 bp, Streptococcus agalactiae
atggatatgtctgttattttaattattgttattcttctggcttttgttgcttgggcatcttggaattattggagggttcgtagggcagctaaatttttagataacgagtcttttcaaaaagaaatgtcacgaggacagttaattgatatccgagaagctggtgcttttcatagaaagcatattctcggagcacgtaacattccagcaagtcaatttaaagttgccttatcggctttgcgcaaagataaacctgtcctcttatatgacgcaagccgtggtcaatctattccaaggattgttttgttactcagaaaagaaggttttaatcaactttacgtgttaaaggacggtttcaattactggacgggtagagttaag

SEQ ID NO: 200 - protein, 126 aa, Streptococcus agalactiae
MDMSVILIIVILLAFVAWASWNYWRVRRAAKFLDNESFQKEMSRGQLIDIREAGAFHRKHILGARNIPASQFKVALSALRKDKPVLLYDASRGQSIPRIVLLLRKEGFNQLYVLKDGFNYWTGRVK

SEQ ID NO: 201 - DNA, 387 bp, Streptococcus pyogenes
atgtctccaatcacacttatcttatggttacttcttgtcggcattgttggttattatacatggaactatttctcttttcgaaaaatggcaaagcaggttgataacgagacttttaaagacgtgatgcgtcaaggtcaattgattgatttacgagagccagcggcttttagaactaagcatattttaggagctcgaaattttccagcgcaacaatttgatgctgctattaagggactacgcaaggacaaacctgttcttatttacgaaaatatgcgtccccagtaccgtgtgcctgcggtcaaaaaacttaaaaaagctggctttgaagacgtttatgtcttaaaagacggtattgattattgggatggcaaagttaaacaaacaacc

SEQ ID NO: 202 - protein, 129 aa, Streptococcus pyogenes
MSPITLILWLLLVGIVGYYTWNYFSFRKMAKQVDNETFKDVMRQGQLIDLREPAAFRTKHILGARNFPAQQFDAAIKGLRKDKPVLIYENMRPQYRVPAVKKLKKAGFEDVYVLKDGIDYWDGKVKQTT

SEQ ID NO: 203 - DNA, 1839 bp, Streptococcus agalactiae
atgacaaatttaagaacagatatccgtaacgttgcgatcattgcccacgttgaccacggtaaaacaactctcgttgatgaattattaaaacaatcacatactcttgatgagcgtaaagagcttgaagaacgtgcaatggattcaaatgatatcgaaaaagaacgtggtatcaccattcttgcaaaaaatacagccgtagcatacaacgatgttcgtatcaatattatggacacacctggtcacgcggactttggtggtgaagttgagcgtattatgaaaatggttgatggtgttgttttagtcgttgatgcctacgaaggaacaatgccacaaacacgttttgttttgaagaaagctcttgaacaaaacttaattccaatcgttgttgtaaataaaattgataagccgtcagctcgtccatcagaggttgttgatgaagttcttgaactatttattgagctcggtgctgatgatgatcaactagatttccctgttgtttatgcttcagctatcaatggaacatcttcaatgtcagatgatccttcagatcaagaaaaaacaatggcaccgatttttgatactatcattgatcacattccagccccagttgacaactcggaagaaccacttcaattccaagtttctcttcttgattacaatgattttgtaggacgtattggtattggacgtgttttccgcgggactgtcaaagttggagatcaagttactctttcaaaacttgatggtacaactaaaaacttccgcgtaacaaaactttttggtttctttggacttgaacgtaaagaaatccaagaggctaaagcgggtgatttaatcgctgtttctggtatggaagatatcttcgttggtgagacagtaactccgacagatgctattgaaccactaccagttttacgtattgacgagccaacacttcaaatgactttcttggtgaataattcaccatttgcaggtcgcgaaggtaaatggattacgtcacgtaaggttgaagaacgtcttttagcagaattacaaacagacgtttctttacgtgttgacccaacagattcgccagataaatggacggtttcagggcgtggagaattacatttatctatccttattgaaacaatgcgtcgtgagggatatgaacttcaagtatcacgtccagaagttatcatcaaagaaattgatggtgttcaatgcgagccgtttgagcgtgttcaaattgatactccagaagaatatcagggtgctattatccaaagtttgtcagagcgtaaaggtgatatgcttgatatgcagatggttggtaatggtcaaacgcgtttgattttcttgattcctgcacgtggtttgattggttattcaacagagtttctttcaatgacacgtggatatggtatcatgaatcatacttttgaccagtatctaccggttgttcaaggagaaattggtggtcgtcatcgtggtgccttggtttctattgaaaatggtaaagcaactacatattcaattatgcgtattgaagaacgtgggactatctttgtaaatccaggtatagaagtttatgaaggaatgattgttggtgagaattctcgtgataatgacctcggagtcaatattacaactgctaaacaaatgacaaatgtccgttcagcaactaaagatcaaactgcagtcatcaagacgcctcgtatccttactttagaagagtcacttgaatttttagcagatgatgagtacatggaagtaactcctgagtctattcgtcttcgtaaacaaattttaaataaagcagcacgtgacaaagctaataaaaagaaaaaatcagctgaa

SEQ ID NO: 204 - protein, 613 aa, Streptococcus agalactiae
MTNLRTDIRNVAIIAHVDHGKTTLVDELLKQSHTLDERKELEERAMDSNDIEKERGITILAKNTAVAYNDVRINIMDTPGHADFGGEVERIMKMVDGVVLVVDAYEGTMPQTRFVLKKALEQNLIPIVVVNKIDKPSARPSEVVDEVLELFIELGADDDQLDFPVVYASAINGTSSMSDDPSDQEKTMAPIFDTIIDHIPAPVDNSEEPLQFQVSLLDYNDFVGRIGIGRVFRGTVKVGDQVTLSKLDGTTKNFRVTKLFGFFGLERKEIQEAKAGDLIAVSGMEDIFVGETVTPTDAIEPLPVLRIDEPTLQMTFLVNNSPFAGREGKWITSRKVEERLLAELQTDVSLRVDPTDSPDKWTVSGRGELHLSILIETMRREGYELQVSRPEVIIKEIDGVQCEPFERVQIDTPEEYQGAIIQSLSERKGDMLDMQMVGNGQTRLIFLIPARGLIGYSTEFLSMTRGYGIMNHTFDQYLPVVQGEIGGRHRGALVSIENGKATTYSIMRIEERGTIFVNPGIEVYEGMIVGENSRDNDLGVNITTAKQMTNVRSATKDQTAVIKTPRILTLEESLEFLADDEYMEVTPESIRLRKQILNKAARDKANKKKKSAE

SEQ ID NO: 205 - DNA, 1839 bp, Streptococcus pyogenes
atgactaacttaagaaacgatatccgtaacgtagcgattattgcccacgttgaccacggaaaaacaacacttgtagatgaattattaaaacaatcccatactcttgatgagcgtaaagagcttcaagagcgtgccatggattccaatgaccttgaaaaagaacgtgggattacaatccttgcgaaaaatacggcagtagcctataacgatgttcgtattaacatcatggataccccaggacacgcggacttcggtggtgaagttgaacgtatcatgaaaatggttgacggggttgttcttgttgtggatgcctacgaaggaacaatgccccagacgcgtttcgtattgaaaaaagcacttgagcaaaaccttatcccgatcgttgtggtgaacaagattgacaaaccttcagctcgtccagcagaagttgtagatgaagtgcttgaattattcatcgaacttggtgccgatgatgagcaattggaattcccagttgtttacgcatcagctattaatggaacatcatcattatcagatgaccctgctgaccaagagcatactatggcaccgatctttgatacgattattgatcatattccagcgccagttgataattcagatgagcctttgcaattccaagtgtcacttttggactacaacgatttcgtaggtcgtatcggtatcggtcgtgttttccgtggtactgttaaagtgggtgaccaagtaactctttcaaaacttgatggtaccactaaaaacttccgtgttacaaaactgtttggtttcttcggtttggaacgtcgtgaaattcaagaagctaaagcaggtgacttgattgctgtttcaggtatggaagatatctttgttggagaaaccattacaccaactgactgtgtggaagctctgccaattcttcgtattgatgagccaacacttcagatgactttcttggtcaataactctccttttgcaggtcgtgaaggtaaatggatcacgtcacgtaaggttgaagaacgtcttttagcagaattgcaaacagacgtgtcacttcgtgttgacccaacagattcgccagataaatggacggtttcagggcgtggagaattgcatttatctatcctcattgaaaccatgcgccgtgaaggctatgaacttcaagtatcacgtccagaagttatcatcaaagaaattgatggtgtcaaatgtgaaccgtttgagcgtgttcaaattgatacaccagaagaatatcagggtgcaatcatccagtctctttcagaacgtaaaggggatatgcttgatatgcagatggttggtaatggtcaaacgcgtttgattttcttgattcctgcacgtggtttgattggttattcaacagagtttctttcaatgacacgtggatatggtatcatgaatcatacttttgatcagtatctaccggttgttcaaggagaaatcggtggccgtcatcgtggtgccttggtttctattgaaaatgggaaagcaacgacatattcaatcatgcgtattgaagaacgtggaactatctttgtcaatccaggtacagaagtttacgaagggatgattgttggtgaaaactcacgtgataacgaccttggtgttaacattacaacagctaagcaaatgacaaatgtccgttcagcgactaaagatcaaactgcagttatcaagacgcctcgtatcctaacgcttgaagaatcattagagttcttgaatgacgacgaatacatggaagtaacgccagaatctatccgcttgcgtaaacaaatcttgaataaagctgcgcgtgataaagctaataaaaagaaaaaatcagccgaa

SEQ ID NO: 206 - protein, 613 aa, Streptococcus pyogenes
MTNLRNDIRNVAIIAHVDHGKTTLVDELLKQSHTLDERKELQERAMDSNDLEKERGITILAKNTAVAYNDVRINIMDTPGHADFGGEVERIMKMVDGVVLVVDAYEGTMPQTRFVLKKALEQNLIPIVVVNKIDKPSARPAEVVDEVLELFIELGADDEQLEFPVVYASAINGTSSLSDDPADQEHTMAPIFDTIIDHIPAPVDNSDEPLQFQVSLLDYNDFVGRIGIGRVFRGTVKVGDQVTLSKLDGTTKNFRVTKLFGFFGLERREIQEAKAGDLIAVSGMEDIFVGETITPTDCVEALPILRIDEPTLQMTFLVNNSPFAGREGKWITSRKVEERLLAELQTDVSLRVDPTDSPDKWTVSGRGELHLSILIETMRREGYELQVSRPEVIIKEIDGVKCEPFERVQIDTPEEYQGAIIQSLSERKGDMLDMQMVGNGQTRLIFLIPARGLIGYSTEFLSMTRGYGIMNHTFDQYLPVVQGEIGGRHRGALVSIENGKATTYSIMRIEERGTIFVNPGTEVYEGMIVGENSRDNDLGVNITTAKQMTNVRSATKDQTAVIKTPRILTLEESLEFLNDDEYMEVTPESIRLRKQILNKAARDKANKKKKSAE

SEQ ID NO: 207 - DNA, 1365 bp, Streptococcus agalactiae
atgggacgagtaatgaaaacaataacaacatttgaaaataaaaaagttttagtccttggtttagcacgatctggagaagctgctgcacgtttgttagctaagttaggagcaatagtgacagttaatgatggcaaaccatttgatgaaaatccaacagcacagtctttgttggaagagggtattaaagtggtttgtggtagtcatcctttagaattgttagatgaggatttttgttacatgattaaaaatccaggaataccttataacaatcctatggtcaaaaaagcattagaaaaacaaatccctgttttgactgaagtggaattagcatacttagtttcagaatctcagctaataggtattacaggctctaacgggaaaacgacaacgacaacgatgattgcagaagtcttaaatgctggaggtcagagaggtttgttagctgggaatatcggctttcctgctagtgaagttgttcaggctgcgaatgataaagatactctagttatggaattatcaagttttcagctaatgggagttaaggaatttcgtcctcatattgcagtaattactaatttaatgccaactcatttagattatcatgggtcttttgaagattatgttgctgcaaaatggaatatccaaaatcaaatgtcttcatctgattttttggtacttaattttaatcaaggtatttctaaagagttagctaaaactactaaagcaacaatcgttcctttctctactacggaaaaagttgatggtgcttacgtacaagacaagcaacttttctataaaggggagaatattatgtcagtagatgacattggtgtcccaggaagccataacgtagagaatgctctagcaactattgcggttgctaaactggctggtatcagtaatcaagttattagagaaactttaagcaattttggaggtgttaaacaccgcttgcaatcactcggtaaggttcatggtattagtttctataacgacagcaagtcaactaatatattggcaactcaaaaagcattatctggctttgataatactaaagttatcctaattgcaggaggtcttgatcgcggtaatgagtttgatgaattgataccagatatcactggacttaaacatatggttgttttaggggaatcggcatctcgagtaaaacgtgctgcacaaaaagcaggagtaacttatagcgatgctttagatgttagagatgcggtacataaagcttatgaggtggcacaacagggcgatgttatcttgctaagtcctgcaaatgcatcatgggacatgtataagaatttcgaagtccgtggtgatgaattcattgatactttcgaaagtcttagaggagag

SEQ ID NO: 208 - protein, 455 aa, Streptococcus agalactiae
MGRVMKTITTFENKKVLVLGLARSGEAAARLLAKLGAIVTVNDGKPFDENPTAQSLLEEGIKVVCGSHPLELLDEDFCYMIKNPGIPYNNPMVKKALEKQIPVLTEVELAYLVSESQLIGITGSNGKTTTTTMIAEVLNAGGQRGLLAGNIGFPASEVVQAANDKDTLVMELSSFQLMGVKEFRPHIAVITNLMPTHLDYHGSFEDYVAAKWNIQNQMSSSDFLVLNFNQGISKELAKTTKATIVPFSTTEKVDGAYVQDKQLFYKGENIMSVDDIGVPGSHNVENALATIAVAKLAGISNQVIRETLSNFGGVKHRLQSLGKVHGISFYNDSKSTNILATQKALSGFDNTKVILIAGGLDRGNEFDELIPDITGLKHMVVLGESASRVKRAAQKAGVTYSDALDVRDAVHKAYEVAQQGDVILLSPANASWDMYKNFEVRGDEFIDTFESLRGE

SEQ ID NO: 209 - DNA, 1356 bp, Streptococcus pyogenes
atgaaagtgataagtaattttcaaaacaaaaaaatattaatattggggttagccaaatcgggcgaagcagcagcaaaattattgaccaaacttggtgctttagtgactgttaatgatagtaaaccatttgaccaaaatccagcggcacaagccttgttggaagaggggattaaggtcatttgtggtagccacccagtagaattattagatgagaactttgagtacatggttaaaaaccctgggattccttatgataatcctatggttaaacgcgcccttgcaaaggaaattcccatcttgactgaagtagaattggcttatttcgtatctgaagcgcctattatcgggattacaggatcaaacgggaagacaaccacaacgacaatgattgccgatgttttgaatgctggcgggcaatctgcactcttatctggaaacattggttatcctgcttcaaaagttgttcaaaaagcaattgctggtgatactttggtgatggaattgtcctcttttcaattagtgggagtgaatgcttttcgccctcatattgctgtcatcactaatttaatgccgactcacctggactatcatggcagttttgaggattatgttgctgctaaatggatgattcaagctcagatgacagaatcagactaccttattttaaatgctaatcaagagatttcagcaactctagctaagaccaccaaagcaacagtgattcctttttcaactcaaaaagtggttgatggagcttatctgaaggatggaatactctattttaaagaacaggcgattatagctgcaactgacttaggtgtcccaggtagccacaacattgaaaatgccctagcaactattgcagttgccaagttatctggtattgctgatgatattattgcccagtgcctttcacattttggaggcgttaaacatcgtttgcaacgggttggtcaaatcaaagatattaccttctacaatgacagtaagtcaaccaatattttagccactcaaaaagctttatcaggttttgataacagtcgcttgattttgattgctggcggtctagatcgtggcaatgaatttgacgatttggtgccagaccttttaggacttaagcagatgattattttgggagaatccgcagagcgtatgaagcgagctgctaacaaagcagaggtctcttatcttgaagctagaaatgtggcagaagcaacagagcttgcttttaagctggcccaaacaggcgatactatcttgcttagcccagccaatgctagctgggatatgtatcctaattttgaggttcgtggggatgaatttttggcaacctttgattgtttaagaggagatgcc

SEQ ID NO: 210 - protein, 452 aa, Streptococcus pyogenes
MKVISNFQNKKILILGLAKSGEAAAKLLTKLGALVTVNDSKPFDQNPAAQALLEEGIKVICGSHPVELLDENFEYMVKNPGIPYDNPMVKRALAKEIPILTEVELAYFVSEAPIIGITGSNGKTTTTTMIADVLNAGGQSALLSGNIGYPASKVVQKAIAGDTLVMELSSFQLVGVNAFRPHIAVITNLMPTHLDYHGSFEDYVAAKWMIQAQMTESDYLILNANQEISATLAKTTKATVIPFSTQKVVDGAYLKDGILYFKEQAIIAATDLGVPGSHNIENALATIAVAKLSGIADDIIAQCLSHFGGVKHRLQRVGQIKDITFYNDSKSTNILATQKALSGFDNSRLILIAGGLDRGNEFDDLVPDLLGLKQMIILGESAERMKRAANKAEVSYLEARNVAEATELAFKLAQTGDTILLSPANASWDMYPNFEVRGDEFLATFDCLRGDA

SEQ ID NO: 211 - DNA, 1074 bp, Streptococcus agalactiae
atggggaaaaaaattgtttttacaggtggtggtacggtaggtcatgtaacactaaacctaatattaatccccaaatttatcaaagatggttgggaagtacattatattggtgataaaaatggcatagaacatgaacaaattaatcagtctggacttgatatcacatttcactctatagctactgggaaactacgtcgctatttttcatggcaaaatatgttagatgtctttaaagtaggggttggcgttcttcaatcgattgctattattgctaaacttagaccccaagccttattttcaaaagggggatttgtttcagtacctcctgtagtagctgcacgcctattaaaagttcctgtttttgttcatgaatcagatttatcaatggggttagcaaataagattgcttataaatttgcgactattatgtatacgacttttgaacaatctaaagatttaatcaaaactaagcatattggtgctgtaacaaaagtcatggattgtaaaaagtcgtttgaaaatactgacttaactagtataaaagaagccttcgatccaaacctaaagaccttactatttattggaggatcagcaggtgcaaaagtattcaatgattttattactcaaacacctgagctggaagaaaaatataatgttatcaatatttcaggcgattcttctctcaatcgattgaagaagaacctttatcgcgtggattatgttacagacctttatcagcctttaatgaatttagcagatgtggttgttacacgaggtggctctaatactatttttgaattagtagctatgaaaaaacttcatcttattatccctcttggacgtgaagcgagccgaggtgaccaattagagaatgctgcttattttgaagaaaagggctacgcattgcagttaccagaatctgaattaaacataaatacacttgagaaacagataaatttattaatttctaacagtgagagttacgaaaaaaacatgtcacaatcatctgaaataaaatctcaagatgaattttatcaattattaattgatgatatggcaaaagtaacaaaagga

SEQ ID NO: 212 - protein, 358 aa, Streptococcus agalactiae
MGKKIVFTGGGTVGHVTLNLILIPKFIKDGWEVHYIGDKNGIEHEQINQSGLDITFHSIATGKLRRYFSWQNMLDVFKVGVGVLQSIAIIAKLRPQALFSKGGFVSVPPVVAARLLKVPVFVHESDLSMGLANKIAYKFATIMYTTFEQSKDLIKTKHIGAVTKVMDCKKSFENTDLTSIKEAFDPNLKTLLFIGGSAGAKVFNDFITQTPELEEKYNVINISGDSSLNRLKKNLYRVDYVTDLYQPLMNLADVVVTRGGSNTIFELVAMKKLHLIIPLGREASRGDQLENAAYFEEKGYALQLPESELNINTLEKQINLLISNSESYEKNMSQSSEIKSQDEFYQLLIDDMAKVTKG

SEQ ID NO: 213 - DNA, 1101 bp, Streptococcus pyogenes
ttgtttaagaggagatgcctaatgcctaagaagattttatttacaggtggtggaactgtaggtcatgtcaccttgaacctcattctcataccaaaatttatcaaggacggttgggaagtacattatattggtgataaaaatggcattgaacatacagaaattgaaaagtcaggccttgacgtgacctttcatgctatcgcgacaggcaagcttagacgctatttttcatggcaaaatctagctgatgtttttaaggttgcacttggcctcctacagtctctctttattgttgccaagcttcgccctcaagcccttttttccaaaggtggttttgtctcagtaccgccagttgtggctgctaaattgcttggtaaaccagtctttattcatgaatcagatcggtcaatgggactagcaaacaagattgcctacaaatttgcaactaccatgtataccacttttgagcaggaagaccagttgtctaaagttaaacaccttggagcggtgacaaaggttttcaaagatgccaaccaaatgcctgaatcaactcagttagaggcggtgaaagagtattttagtagagacctaaaaaccctcttgtttattggtggttcggcaggggcgcatgtgtttaatcagtttattagtgatcatccagaattgaagcaacgttataatatcatcaatattacaggagaccctcaccttaatgaattgagttctcatctgtatcgagtagattatgttaccgatctctaccaacctttgatggcgatggctgaccttgtagtgacaagagggggctctaatacactttttgagctactggcaatggctaagctacacctcatcgttcctcttggtaaagaagctagccgtggcgatcagttagaaaatgccacttattttgagaagaggggctacgctaaacaattacaggaacctgatttaactttgcataattttgatcaggcaatggctgatttgtttgaacatcaggctgattatgaggctactatgttggcaactaaggagattcagtcaccggacttcttttatgaccttttgagagctgatattagctccgcgattaaggagaag

SEQ ID NO: 214 - protein, 367 aa, Streptococcus pyogenes
LFKRRCLMPKKILFTGGGTVGHVTLNLILIPKFIKDGWEVHYIGDKNGIEHTEIEKSGLDVTFHAIATGKLRRYFSWQNLADVFKVALGLLQSLFIVAKLRPQALFSKGGFVSVPPVVAAKLLGKPVFIHESDRSMGLANKIAYKFATTMYTTFEQEDQLSKVKHLGAVTKVFKDANQMPESTQLEAVKEYFSRDLKTLLFIGGSAGAHVFNQFISDHPELKQRYNIINITGDPHLNELSSHLYRVDYVTDLYQPLMAMADLVVTRGGSNTLFELLAMAKLHLIVPLGKEASRGDQLENATYFEKRGYAKQLQEPDLTLHNFDQAMADLFEHQADYEATMLATKEIQSPDFFYDLLRADISSAIKEK

SEQ ID NO: 215 - DNA, 1134 bp, Streptococcus agalactiae
atgcctaagaagaaatcagataccccagaaaaagaagaagttgtcttaacggaatggcaaaagcgtaaccttgaatttttaaaaaaacgcaaagaagatgaagaagaacaaaaacgtattaacgaaaaattacgcttagataaaagaagtaaattaaatatttcttctcctgaagaacctcaaaatactactaaaattaagaagcttcattttccaaagatttcaagacctaagattgaaaagaaacagaaaaaagaaaaaatagtcaacagcttagccaaaactaatcgcattagaactgcacctatatttgtagtagcattcctagtcattttagtttccgttttcctactaactccttttagtaagcaaaaaacaataacagttagtggaaatcagcatacacctgatgatattttgatagagaaaacgaatattcaaaaaaacgattatttcttttctttaatttttaaacataaagctattgaacaacgtttagctgcagaagatgtatgggtaaaaacagctcagatgacttatcaatttcccaataagtttcatattcaagttcaagaaaataagattattgcatatgcacatacaaagcaaggatatcaacctgtcttggaaactggaaaaaaggctgatcctgtaaatagttcagagctaccaaagcacttcttaacaattaaccttgataaggaagatagtattaagctattaattaaagatttaaaggctttagaccctgatttaataagtgagattcaggtgataagtttagctgattctaaaacgacacctgacctcctgctgttagatatgcacgatggaaatagtattagaataccattatctaaatttaaagaaagacttcctttttacaaacaaattaagaagaaccttaaggaaccttctattgttgatatggaagtgggagtttacacaacaacaaataccattgaatcaacccctgttaaagcagaagatacaaaaaataaatcaactgataaaacacaaacacaaaatggtcaggttgcggaaaatagtcaaggacaaacaaataactcaaatactaatcaacaaggacaacagatagcaacagagcaggcacctaaccctcaaaatgttaat

SEQ ID NO: 216 - protein, 378 aa, Streptococcus agalactiae
MPKKKSDTPEKEEVVLTEWQKRNLEFLKKRKEDEEEQKRINEKLRLDKRSKLNISSPEEPQNTTKIKKLHFPKISRPKIEKKQKKEKIVNSLAKTNRIRTAPIFVVAFLVILVSVFLLTPFSKQKTITVSGNQHTPDDILIEKTNIQKNDYFFSLIFKHKAIEQRLAAEDVWVKTAQMTYQFPNKFHIQVQENKIIAYAHTKQGYQPVLETGKKADPVNSSELPKHFLTINLDKEDSIKLLIKDLKALDPDLISEIQVISLADSKTTPDLLLLDMHDGNSIRIPLSKFKERLPFYKQIKKNLKEPSIVDMEVGVYTTTNTIESTPVKAEDTKNKSTDKTQTQNGQVAENSQGQTNNSNTNQQGQQIATEQAPNPQNVN

SEQ ID NO: 217 - DNA, 1146 bp, Streptococcus pyogenes
atggcaaaagataaagagaaacaaagtgatgacaagctcgttttgacagagtggcaaaagcgtaacattgaatttttaaagaaaaagaagcagcaagctgaggaagaaaaaaaactcaaagagaaattattgagtgataaaaaagcgcagcagcaagctcaaaatgcttctgaagcggttgagcttaaaactgatgagaaaactgatagtcaggaaattgagtcagaaacgacgtcaaaacctaaaaaaaccaaaaaagttagacaacccaaggaaaaaagcgcgacacaaatcgcttttcaaaaatccttgcctgttcttttgggggcgctcttactcatggcggtgtctatttttatgatcactccttatagcaaaaagaaagagttttctgtaagaggaaaccatcaaacgaaccttgacgaattaatcaaagctagcaaagtcaaagcatctgactattggttaacgctgttaacttcgcctggtcagtatgaacgaccgattcttcgtactattccatgggtgaaatctgtacatctctcttaccaatttcctaatcactttctatttaacgttattgaatttgaaatcatcgcttatgcacaagttgaaaacggttttcagcctattttggagaatggaaaacgtgtggacaaggtcagggcatcagaactaccgaaatctttcttgattcttaatttaaaagatgagaaagcgatccaacagttagttaagcaattaacgacattacctaaaaaattagtcaagaatatcaagtcagtgtctcttgcaaattccaaaacgacagcggatttactacttattgaaatgcatgacggtaatgtagttagagtaccgcagtcacaactcacattgaaacttccctattatcaaaaattgaaaaaaaaccttgaaaatgatagtatagtggatatggaagtgggaatttatactacaacacaggagattgaaaatcaacctgaagttcctcttacgcctgaacaaaacgcagctgataaagaaggagataagcctggtgaacatcaggaacagacagacaatgattcagaaacgccagcaaatcagagtagtcctcagcaaacaccaccatccccagaaacggtcctcgaacaggcccatggc

SEQ ID NO: 218 - protein, 382 aa, Streptococcus pyogenes
MAKDKEKQSDDKLVLTEWQKRNIEFLKKKKQQAEEEKKLKEKLLSDKKAQQQAQNASEAVELKTDEKTDSQEIESETTSKPKKTKKVRQPKEKSATQIAFQKSLPVLLGALLLMAVSIFMITPYSKKKEFSVRGNHQTNLDELIKASKVKASDYWLTLLTSPGQYERPILRTIPWVKSVHLSYQFPNHFLFNVIEFEIIAYAQVENGFQPILENGKRVDKVRASELPKSFLILNLKDEKAIQQLVKQLTTLPKKLVKNIKSVSLANSKTTADLLLIEMHDGNVVRVPQSQLTLKLPYYQKLKKNLENDSIVDMEVGIYTTTQEIENQPEVPLTPEQNAADKEGDKPGEHQEQTDNDSETPANQSSPQQTPPSPETVLEQAHG

SEQ ID NO: 219 - DNA, 1371 bp, Streptococcus agalactiae
atggctagaaatggcttttttactggtttggatataggaacaagctcgattaaagttttagttgcagaatttattgcaaatgaaatgaatgtaattggggttagcaacgtccctagttccggtgtaaaagatggtataattattgatattgaggcagcagcaactgcaatcaaagaggcggtaaaacaagctgaggagaaagcaggcatcaccattgacaaaatcaatgttggattaccagcaaatcttctccaaattgaaccaactcaaggaatgattcctgttcctaatgaatcaaaagaaattaaggatgaagatgtcgaaagtgttgttaaatcagcattgactaaaagcattactcctgaaagagaagttatttcattgattccgcttgaattcattgtagatggtttccaagggattagagaccctagagggatgatggggattcgccttgagatgcgtggtcttatctatactggaccaacaactatccttcataatcttcgtaaaactgttgaacgagcaggtataaaagtagagcatgttgtgatcgcccctctagccttagcaaaatcagttctaaacgaaggtgaacgtgagtttggtgcaactgtgattgatatgggaggcggacaaacaacagtcgcttctatgcgtaatcaagaattgcaatatactaatatttattctgaaggtagcgattatgttaccaaagatatttctaaagtgctacgtacaacagtagaaatcgccgaagcattgaaattcaactttggacaagctaatgttgaagaagcaagtacttctgatacagttcaagttaatgttgttggtaacgaggaacctgttgaaattacagaaagctatctttcgcaaattatttcaggacgtattcgtcaaattttagaacatgtcaaacaagacttgggtagaggtcgtttacttgatttacctggtggtattattcttgttggaggtggtgcaattatgccaggagttgtcgaggttgctcaacaaatttttggaactagagttaaattgcacgttccaaaccaagtaggtattcgcaatccaatgtttgctaatgttattagtatcgttgattatgtaggaatgatgtcagaagttgacattatcgcacaacatgctgtaactggcgacgaaatgctaagacataaaccagtcgactttgattataaagaaaaaacaaatacaatgtcgacaatgccttattctgagccgttaacctcttctatggaagattctaatttagaaccaatccgagcaagagaaaacgctcaagagcctactgagcctaaagctaatattggtgagcgcatcagaggaatttttggaagtatgtttgac

SEQ ID NO: 220 - protein, 457 aa, Streptococcus agalactiae
MARNGFFTGLDIGTSSIKVLVAEFIANEMNVIGVSNVPSSGVKDGIIIDIEAAATAIKEAVKQAEEKAGITIDKINVGLPANLLQIEPTQGMIPVPNESKEIKDEDVESVVKSALTKSITPEREVISLIPLEFIVDGFQGIRDPRGMMGIRLEMRGLIYTGPTTILHNLRKTVERAGIKVEHVVIAPLALAKSVLNEGEREFGATVIDMGGGQTTVASMRNQELQYTNIYSEGSDYVTKDISKVLRTTVEIAEALKFNFGQANVEEASTSDTVQVNVVGNEEPVEITESYLSQIISGRIRQILEHVKQDLGRGRLLDLPGGIILVGGGAIMPGVVEVAQQIFGTRVKLHVPNQVGIRNPMFANVISIVDYVGMMSEVDIIAQHAVTGDEMLRHKPVDFDYKEKTNTMSTMPYSEPLTSSMEDSNLEPIRARENAQEPTEPKANIGERIRGIFGSMFD

SEQ ID NO: 221 - DNA, 1335 bp, Streptococcus pyogenes
ttggacattggaacaagctcgataaaagttttagtagcagaatttatttctggtgagatgaacgtcattggtgttagtaatgttccaagtaccggcgtaaaagatggcataataatcgatatagaggcagctgcgactgccatcaaaactgcggtagaacaagcagaagaaaaagcagggatgacaattgaaaaggttaatgttgggctaccggcaaaccttcttcaaattgaaccaacacaaggaatgattcctgtcccaagtgagtctaaagagataaaagatgaggatgttgatagcgttgttaaatcggctttaacaaaaagtatcacaccagaacgagaggttatctctttagttccagaagagttcattgtggatggctttcagggcattcgagatccacgtggtatgatggggattagattagagatgcgcgggcttatttatactggaccaagcaccattttacataatctgcgtaaaacggtagaaagagcaggcattaaagttgaaaacatcattatttctccgttagctatggctaaaaccattttaaacgaaggtgagcgcgagtttggagctactgtaattgatatgggaggtggacagacaactgtcgcttctatgcgagcacaagaattgcagtataccaatatatatgccgaaggcggcgaatacattactaaagatatatcaaaagtattaaaaacgtctttggctattgcagaagcacttaagtttaattttggtcaagcggagatatcagaagctagtataactgaaacagtaaaagttgatgtggtaggtagtgaagagcctgttgaggtaactgaacgttatttatctgaaattatttcagcgcgtattcgtcatattttagatcgtgtgaagcaagatttggaaagaggtcgtttactagacttaccaggaggcattgttttgattggtggcggtgcaatcatgcctggagtggtagaaattgcacaagaaatctttggagtaactgtaaagctccatgttccaaaccaagtcggtattagaaatccaatgttttcaaacgttatcagtttggtagaatatgttggtatgatgtctgaagtagacgttttagcacaaactgcagtttcaggagaagaacttttgcgacgcaagcctatcgatttcagtggccaagaatcttatttaccagattatgatgattcaagaagaccagaatcgaccattggctatgaacaacaagcgtcacaaacagcatatgattcacaagttccgagtgatcctaaacaaaaaatttcagaacgtgttcgtggcatatttgggagtatgtttgat

SEQ ID NO: 222 - protein, 445 aa, Streptococcus pyogenes
LDIGTSSIKVLVAEFISGEMNVIGVSNVPSTGVKDGIIIDIEAAATAIKTAVEQAEEKAGMTIEKVNVGLPANLLQIEPTQGMIPVPSESKEIKDEDVDSVVKSALTKSITPEREVISLVPEEFIVDGFQGIRDPRGMMGIRLEMRGLIYTGPSTILHNLRKTVERAGIKVENIIISPLAMAKTILNEGEREFGATVIDMGGGQTTVASMRAQELQYTNIYAEGGEYITKDISKVLKTSLAIAEALKFNFGQAEISEASITETVKVDVVGSEEPVEVTERYLSEIISARIRHILDRVKQDLERGRLLDLPGGIVLIGGGAIMPGVVEIAQEIFGVTVKLHVPNQVGIRNPMFSNVISLVEYVGMMSEVDVLAQTAVSGEELLRRKPIDFSGQESYLPDYDDSRRPESTIGYEQQASQTAYDSQVPSDPKQKISERVRGIFGSMFD

SEQ ID NO: 223 - DNA, 1278 bp, Streptococcus agalactiae
atggtattttcatttgatacagcatcagtacaaggtgcagttattaaagttattggtgttggaggcggtggcggtaacgctattaaccgcatgattgacgaaggtgtcgctggcgttgagtttattgcagcaaatactgatattcaagccttaagtagctcaaaagctgaaactgtcattcaacttggtccaaaattaactcgcggacttggtgcaggaggacaacctgaagttggtcgtaaagcagctgaagaaagtgaagaagttttaacagaagcacttactggcgctgatatggtatttatcacagcaggtatggggggcggatctggtacaggtgcggctccagttattgcacgtattgcaaagagtttaggagcacttacagtagcggtcatcacacgtccttttggctttgagggtaataaacgttctaacttcgctatcgaaggtattcaagaattaagagaacaagttgatacactgcttatcatttcaaataataatcttcttgaaattgtagataagaagacaccattgcttgaagctcttagtgaagcagataatgttttacgtcaaggtgttcaaggtattacggatttgattactaacccaggtttaattaaccttgactttgcagatgttaaaacagttatggcaaataaaggtaatgcactgatgggaattggtatcggttctggtgaggaacgtattactgaagctgctcgaaaagcaatttattcaccacttcttgaaacaacgattgatggagcagaagacgttattgtcaatgttaccggcggtatggatatgacacttactgaagcagaggaagcatcagagattgttagccaagcagcaggtaaaggtgtcaatatttggttaggtacttcaattgacatggatatgaaagacgaaatccgcgtaacagttgttgcaacaggtgtacgtaaagataaaactaatcaagtatctggttttacaacatcagctccaactaatcaagcaccttcagaacgtcaaagtacttcaaattcaaactttgatcgtcgtggcaactttgatatgacagagtctcgcgaaatgccaactcaacaaaatcagcctcatgcacaaaatcagcaacaaagttctgcttttggtaattgggaccttcgtcgtgataatatttcacgtccgacagaaggtgaacttgatagcaagttgtctatgtcaacgttttcagaaaatgatgatatggatgatgaacttgaaacacctccattctttaaaaaccgt

SEQ ID NO: 224 - protein, 426 aa, Streptococcus agalactiae
MVFSFDTASVQGAVIKVIGVGGGGGNAINRMIDEGVAGVEFIAANTDIQALSSSKAETVIQLGPKLTRGLGAGGQPEVGRKAAEESEEVLTEALTGADMVFITAGMGGGSGTGAAPVIARIAKSLGALTVAVITRPFGFEGNKRSNFAIEGIQELREQVDTLLIISNNNLLEIVDKKTPLLEALSEADNVLRQGVQGITDLITNPGLINLDFADVKTVMANKGNALMGIGIGSGEERITEAARKAIYSPLLETTIDGAEDVIVNVTGGMDMTLTEAEEASEIVSQAAGKGVNIWLGTSIDMDMKDEIRVTVVATGVRKDKTNQVSGFTTSAPTNQAPSERQSTSNSNFDRRGNFDMTESREMPTQQNQPHAQNQQQSSAFGNWDLRRDNISRPTEGELDSKLSMSTFSENDDMDDELETPPFFKNR

SEQ ID NO: 225 - DNA, 1317 bp, Streptococcus pyogenes
atggcattttcatttgatactgcatcaattcaaggtgcaattataaaagtaattggagtcggcggaggtggcggaaatgccattaatcgtatgattgatgaaggtgttgctggtgtcgagttcatcgcagcaaacacagacattcaggcattaagctcatcaaaagctgaaacggttattcaactaggccctaaattaactcgtggacttggtgctggaggacaacctgaagtaggacgtaaagctgctgaagaaagcgaagaaattttaacagaagctcttacaggagcggacatggtatttattactgccggtatgggtggtggctctgggacaggggctgcaccggttattgctcgtatcgctaaaagtttgggagccttgacagtagctgttgttactcgcccgtttggttttgaaggtaacaaacgtggtaattttgctattgaaggtatcgaagaactacgtgaacaagttgatactttgttaattatttcaaataataaccttcttgagattgttgataaaaagacacctttattagaagcacttagtgaagctgataatgttttacgccagggagttcaagggataaccgacttaattactagtcctggccttatcaatctcgattttgccgacgtgaaaacagttatggcaaataaagggaatgccttgatggggattgggattggctctggagaagagcgcattgttgaggcggcgcgtaaggcaatctattcacccctattagaaacgactattgatggtgcacaagacgttattgtgaacgttacaggaggtctcgacatgacacttacagaagctgaagaagcctctgaaattgttgggcaagctgctggtcaaggcgttaacatttggttaggaacatctattgatgatactatgaaagatgacatccgtgtgactgttgtagcaactggagtgcgccaagaaaaagccgaacaagtttcaggttttcgtcagcctaggacttttacccaaaccaacgcgcagcaagtagcgggtgcacaatatgcatcagatcaagcaaaacagtcggttcaaccagggtttgatcgtcgctcaaattttgattttgacatgggggagtctcgcgagataccaagtgcacaaaaggtaatttctaatcataatcaaaatcaaggttctgcttttggaaattgggatttgagacgtgataatatttctcgtccaacagaaggtgaattggataaccatcttaatatgtcaacgttctcagctaacgatgacagtgatgatgaattagaaacgcctccattctttaaaaaccgt

SEQ ID NO: 226 - protein, 439 aa, Streptococcus pyogenes
MAFSFDTASIQGAIIKVIGVGGGGGNAINRMIDEGVAGVEFIAANTDIQALSSSKAETVIQLGPKLTRGLGAGGQPEVGRKAAEESEEILTEALTGADMVFITAGMGGGSGTGAAPVIARIAKSLGALTVAVVTRPFGFEGNKRGNFAIEGIEELREQVDTLLIISNNNLLEIVDKKTPLLEALSEADNVLRQGVQGITDLITSPGLINLDFADVKTVMANKGNALMGIGIGSGEERIVEAARKAIYSPLLETTIDGAQDVIVNVTGGLDMTLTEAEEASEIVGQAAGQGVNIWLGTSIDDTMKDDIRVTVVATGVRQEKAEQVSGFRQPRTFTQTNAQQVAGAQYASDQAKQSVQPGFDRRSNFDFDMGESREIPSAQKVISNHNQNQGSAFGNWDLRRDNISRPTEGELDNHLNMSTFSANDDSDDELETPPFFKNR

SEQ ID NO: 227 - DNA, 672 bp, Streptococcus agalactiae
atgatgaatttacaagaaaataaaacagcgatttttgacaatgttagtaaattagcactaaaagcaggtcgcgctcatgaatcagttcatatcgtagctgtaacaaaatatgttaactgtcaaacaacagaagcgcttattagaacaggtgttaatcatatcggtgaaaatcgtgttgataaatttcttgaaaaatatcaagcattaaaagatgaaaagcttacatggcatctcattggtagtttacaacgtcgaaaagttaaagatgtcattaattatgttgattattttcatgctttagattctgttaagttagcagctgagattcaaaaacatgctcaaaaactaattaaatgttttctacaagttaatatatcacgagaagacagtaagcatggttttactattgagcaaatagatgatgcactgaacttaatttctcggtacgataaaattgaacttatcggcatcatgactatggctcccttaaaagcaactaaagaggaaatatcatcaatttttgaagagactgagagtcttaggaaaaggcttcaagctaggaacatagaacgaatgccgtttacagaattaagcatgggcatgagtagagattatgatattgctattcaaaatggatcaacatttgtaaggataggaacttcattctttaaa

SEQ ID NO: 228 - protein, 224 aa, Streptococcus agalactiae
MMNLQENKTAIFDNVSKLALKAGRAHESVHIVAVTKYVNCQTTEALIRTGVNHIGENRVDKFLEKYQALKDEKLTWHLIGSLQRRKVKDVINYVDYFHALDSVKLAAEIQKHAQKLIKCFLQVNISREDSKHGFTIEQIDDALNLISRYDKIELIGIMTMAPLKATKEEISSIFEETESLRKRLQARNIERMPFTELSMGMSRDYDIAIQNGSTFVRIGTSFFK

SEQ ID NO: 229 - DNA, 669 bp, Streptococcus pyogenes
atggatttactgacaaataaaaagaaaatttttgagactatccgcttatctacagaggcagcaaataggactaatgatagtgtttcagttattgctgtaacaaaatatgtggatagtacaattgcaggtcagcttatcgaagcaggaattgagcacattgccgaaaaccgtgttgataaatttcttgaaaagtatgatgcgttaaagtatatgccagtaaagtggcatttaattggtaccttacaacgtcgtaaagtcaaggaagttatcaattatgttgattattttcacgctctagattctgtgagattagctttggaaatcaacaagagagctgaccatcctgtgaagtgttttctacaagttaatatttctaaagaagagagtaaacatggttttaacatttctgagattgatgaagcgattggagaaataggtaagatggagaagatacagttagttggtttaatgactatggcaccagcaaatgccagtaaagaaagtattataactatttttcgacaagcaaatcaattaagaaaaaacttgcagttaaaaaaaagaaagaatatgccttttacagaattgagcatgggcatgagtaacgattatccaattgctattcaagaaggctcaacttttattcggattggtagagctttctttcac

SEQ ID NO: 230 - protein, 223 aa, Streptococcus pyogenes
MDLLTNKKKIFETIRLSTEAANRTNDSVSVIAVTKYVDSTIAGQLIEAGIEHIAENRVDKFLEKYDALKYMPVKWHLIGTLQRRKVKEVINYVDYFHALDSVRLALEINKRADHPVKCFLQVNISKEESKHGFNISEIDEAIGEIGKMEKIQLVGLMTMAPANASKESIITIFRQANQLRKNLQLKKRKNMPFTELSMGMSNDYPIAIQEGSTFIRIGRAFFH

SEQ ID NO: 231 - DNA, 615 bp, Streptococcus agalactiae
atggaggggaatatggcattaaaagatagatttgacaaaattatttcttattttgacactgacgatgtaagtgaaaatgaagtacacgaagtacaagagagaacttcagtgcaaagagattccagagcagctacagcacaggaagcttctcagcgtagtcatatgactaactccgcagaggaagagatgattggtagtcgtccgagaacttatacctatgatcctaatcgtcaggagagacaaagggtacagagagacaatgcttatcagcaagctactcctagggttcaaaataaagactcagttcgacaacagagagaacaagtaacaattgctctgaagtatccccgtaagtatgaggatgcacaagaaattgttgatttacttatcgttaatgaatgtgtcttgattgattttcaatatatgcttgatgcgcaagcacgacgttgcttggattatattgatggtgcaagtagagtattatatggttcattacaaaaggttgggagttcaatgtttctattaacaccagccaatgttatggttgatattgaggagatgaatattccaaagactggtcaagagacgagttttgattttgatatgaagagacga

SEQ ID NO: 232 - protein, 205 aa, Streptococcus agalactiae
MEGNMALKDRFDKIISYFDTDDVSENEVHEVQERTSVQRDSRAATAQEASQRSHMTNSAEEEMIGSRPRTYTYDPNRQERQRVQRDNAYQQATPRVQNKDSVRQQREQVTIALKYPRKYEDAQEIVDLLIVNECVLIDFQYMLDAQARRCLDYIDGASRVLYGSLQKVGSSMFLLTPANVMVDIEEMNIPKTGQETSFDFDMKRR

SEQ ID NO: 233 - DNA, 666 bp, Streptococcus pyogenes
atggagaataagatggcttttaaagatacatttaacaagatgatttcttattttgacacggatgaggttaacgaagttgaagaagatgttgcagcatcaactgataacgttattccaagatcacaacaatcagtcagagcaagtagtcatccaaaacaagaacctagaaacaatcacgtacaacaagatcatcaagcgagatcccaagaacagacaaggtcacaaatgcatccaaaacatggcacttctgaacgctattatcagcagtctcagccaaaagaaggccatgaaatggttgacagaagaaaacggatgagcacttctagtattgcaaatcgccgtgagcagtatcaacaatcaacttgttcagatcaaacaactattgccttaaagtatcctcgtaaatatgaggatgctcaagaaattgtggatcttttaatagttaatgaatgcgttttgattgattttcagtttatgctagatgctcaggctagacggtgtttagattttattgatggtgctagtaaagtgctctatggtagcttacaaaaggtcggctcttcaatgtacttactggctccgtcaaatgtatccgtcaatatagaagaaatgactatcccacatactacacaagatattggctttgattttgatatgaaaaggcgg

SEQ ID NO: 234 - protein, 222 aa, Streptococcus pyogenes
MENKMAFKDTFNKMISYFDTDEVNEVEEDVAASTDNVIPRSQQSVRASSHPKQEPRNNHVQQDHQARSQEQTRSQMHPKHGTSERYYQQSQPKEGHEMVDRRKRMSTSSIANRREQYQQSTCSDQTTIALKYPRKYEDAQEIVDLLIVNECVLIDFQFMLDAQARRCLDFIDGASKVLYGSLQKVGSSMYLLAPSNVSVNIEEMTIPHTTQDIGFDFDMKRR

SEQ ID NO: 235 - DNA, 786 bp, Streptococcus agalactiae
atgacgttagatgatatttatcagcattttcgaccagaagagtatgcgtttatccataaaatagaccatttagctcaatatgtcgaaaacacctattcgtttattaccactgaatttctaaatcctagggaatttaaaatactcgaaagtgttctagagaggcgaggtagtcattattacacttctggtcagtattttcaaacagaatatgttaaagtaataatagcaccggaatactatcagttagatatggctgattttaaccttagcctaattgaaataaagtataatgctaaatttaatcaccttacccatgctaaaattatgggaactttactgaattacttaggtgtaaaacgatcaattttaggggatatcctagttgaagaaggctgtgctcaggttttggtcgatagtcaaatgacaaatcaccttgttcattcagttacaaaaattggaactgctagtgtacaattagctgaagttcccttgtccaaacttctaactcccaaacaagatattcaaaaactaactgttattgcttccagtttacgtcttgataaaattttagcaacgattttaaagatttcacgaacacagtcgacgaaattgattgaggcagataaagtcaaggtcaattatgcaaccgtcaatcgagtttctgaacaattagtagagggggatttgattagtgttagaggatatggtcgatttacgttgaaccataacctagggttaactaaaaatcaaaaatataagttagaagtagacaaaatgatacataac

SEQ ID NO: 236 - protein, 262 aa, Streptococcus agalactiae
MTLDDIYQHFRPEEYAFIHKIDHLAQYVENTYSFITTEFLNPREFKILESVLERRGSHYYTSGQYFQTEYVKVIIAPEYYQLDMADFNLSLIEIKYNAKFNHLTHAKIMGTLLNYLGVKRSILGDILVEEGCAQVLVDSQMTNHLVHSVTKIGTASVQLAEVPLSKLLTPKQDIQKLTVIASSLRLDKILATILKISRTQSTKLIEADKVKVNYATVNRVSEQLVEGDLISVRGYGRFTLNHNLGLTKNQKYKLEVDKMIHN

SEQ ID NO: 237 - DNA, 789 bp, Streptococcus pyogenes
atggttagtcatagtaagatttatcagcattttcaccaagaagaatatccttttattgatagaatgtctgatatgattaatagagttgaagattactatcttttagaagttactgagtttttaaatcctagagaagtgatgattttaaaaagtttgattgctttaacagatctaaaaatgttcgtatcaacagattactacccaagcgaatatggtcgtgtcattattgcacctggttactatgacttagaacaaagtgattttcaaatagctttagtagagataagttatcaggcaaagtttaatcagttgacacatagtcaaattttaggaactttaattaatgaattaggagtaaagcgaaatttatttggagatgtttttgttgaaatgggatatgcccagctcatgattaagcgggagttattggattattttttaggaacaattactaaaatagctaaaactagtgtgaaattaagagaagttaactttgatcagttaattaggtctattgataacagccagaccctggatattctagtttctagttttcgattagatggtgtagttgctactatcttaaaaaaatctcgaacgcaagttatagcattaattgaagcaaataagattaaggtaaactatcgagttgctaataaagcttcagataatctagtcataggggatatggtgagtatcagaggtcacgggcgttttactcttttagcagataatggagtgaccaaacatggcaaacaaaaaataacactaagtaaaatgatacataaa

SEQ ID NO: 238 - protein, 263 aa, Streptococcus pyogenes
MVSHSKIYQHFHQEEYPFIDRMSDMINRVEDYYLLEVTEFLNPREVMILKSLIALTDLKMFVSTDYYPSEYGRVIIAPGYYDLEQSDFQIALVEISYQAKFNQLTHSQILGTLINELGVKRNLFGDVFVEMGYAQLMIKRELLDYFLGTITKIAKTSVKLREVNFDQLIRSIDNSQTLDILVSSFRLDGVVATILKKSRTQVIALIEANKIKVNYRVANKASDNLVIGDMVSIRGHGRFTLLADNGVTKHGKQKITLSKMIHK

SEQ ID NO: 239 - DNA, 768 bp, Streptococcus agalactiae
atgccacttacagcacttgaaattaaagataaaacattttcatcaaaatttcgcggttatagcgaagaagaagttaatgaatttttagagattgttgttgacgattacgaggacttgattagacgtaatcgtgagcaagagcaatacattaaagatttagaagagaaaatcgcttacttcaacgaaatgaaggaatcgttaagtcaatcagttattttagctcaagaaactgctgagcgtgtgaaaatttcagcacaggatgaagcatctaacctaatggggaaagctacatttgatgctcaacatttaattgatgaggctaaattaaaagcaaatcaaatccttcgagatgcgacagatgatgctaagcgtgttgctatagaaacagaagatttgaaacgtcaatcacgtgttttccaccaacgtttgctttctgagttagaagggcagctaaaattagctaactcatctgcttgggaagaattgttgaaaccaacagctatttatcttcaaaattctgatgcttctttcaaagaagttgttgaaaaagttcttgatgaagatgatgctttaccagtggtggatgacactgagtcatttgatgctactcgtcaattctcaccagatgaaatggaagaattacagcgtcgtgttgaagaaagtaacaaacaacttgaagagtcaggtttattagatactaataatttccaaatggaagaaccgatcaatttaggtgaaactcaaacttttaaattaaatattgaagat

SEQ ID NO: 240 - protein, 256 aa, Streptococcus agalactiae
MPLTALEIKDKTFSSKFRGYSEEEVNEFLEIVVDDYEDLIRRNREQEQYIKDLEEKIAYFNEMKESLSQSVILAQETAERVKISAQDEASNLMGKATFDAQHLIDEAKLKANQILRDATDDAKRVAIETEDLKRQSRVFHQRLLSELEGQLKLANSSAWEELLKPTAIYLQNSDASFKEVVEKVLDEDDALPVVDDTESFDATRQFSPDEMEELQRRVEESNKQLEESGLLDTNNFQMEEPINLGETQTFKLNIED

SEQ ID NO: 241 - DNA, 756 bp, Streptococcus pyogenes
atggcacttacaacgctagaaattaaagataaaacttttaagacaaaattccgaggatactgtgaagaagaagtcaatgaattccttgatattgttgttgatgattacgaagctcttgtacgtaaaaatcgtgataacgaagcaagaattaaagatcttgaagaaaaattatcttactttgatgaaatgaaagagtcacttagccagtctgtaatcttagctcaagaaacagctgaaaaagtgaaagcaacggctaatgcggaagcaacaaacttggttagtaaagcgacttatgatgctcagcatttattagatgaatctaaagctaaagccaatcaaatgttgcgtgatgcaactgatgaggctaagcgagttgcgattgaaacagaagaactaaagcgtcaaacacgtgtgttccaccaacgtttaatctcatctattgagtcacaattaagcttatcaaattcacctgaatgggatgaactgctacaaccgactgcaatctatcttcaaaattctgacgatgcttttaaggaagtcgtgaagaccgttcttaatgaagacattcctgaatctgatgatagtgcctcttttgatgcaacacgtcagtttactccagaagagttagaagaattgcaacgtcgtgttgatgaaagcaataaggagttagaggcttaccaacttgactctcaatctgattctacgactgagccagaggtaaatctcagtgaaacacaaacgtttaaattaaatatc

SEQ ID NO: 242 - protein, 252 aa, Streptococcus pyogenes
MALTTLEIKDKTFKTKFRGYCEEEVNEFLDIVVDDYEALVRKNRDNEARIKDLEEKLSYFDEMKESLSQSVILAQETAEKVKATANAEATNLVSKATYDAQHLLDESKAKANQMLRDATDEAKRVAIETEELKRQTRVFHQRLISSIESQLSLSNSPEWDELLQPTAIYLQNSDDAFKEVVKTVLNEDIPESDDSASFDATRQFTPEELEELQRRVDESNKELEAYQLDSQSDSTTEPEVNLSETQTFKLNI

SEQ ID NO: 243 - DNA, 2790 bp, Streptococcus agalactiae
atgaaattaaaagaaaccttgaatttaggacaaacagcttttccaatgcgtgcagggcttccaaataaggaacctcaatggcaagaagcatgggatcaagctgacatttataaaaaacgtcaagcattgaatgaaggaaaaccagcctttcaccttcatgacggacctccctatgctaatgggaatattcatgtaggacatgcactaaataaaatttcgaaagacattattgtacgttcaaaatcaatgtcaggttttcgagctccttatgtgcctggttgggatactcatggactcccaattgagcaagtattagctaaaaaaggggttaaacgtaaagaaatggacttggctgaataccttgaaatgtgtcgtgattatgctctcagccaagttgacaaacaacgtgatgattttaaacgtctgggcgtttctgccgattgggaaaatccttatattacactaacaccagattatgaagcagatcaagtacgtgttttcggtgctatggcagataaaggatatatctatcgtggtgctaaaccagtgtattggtcatggtcatcagagtctgcccttgctgaggctgaaatcgaatatcatgatattgattcgacatcactctactatgccaataaagttaaagatggtaagggaattcttgatacagatacctatatcgtcgtttggacgacaacaccatttactgtaacagcttcacgcggtttaacagtaggaccagatatggagtatgttgtagttgtaccagtaggtagtgagcgtaaataccttcttgcagaggttcttgtagatagtctcgctgctaagtttggctgggaaaactttgaaattgtgactcatcacactggtaaagaacttaatcacattgttacagaacatccatgggatacagaagtagaagagttggttatccttggagaccatgttacaacagattctggtacaggtattgtccacacggctcctggttttggtgaagatgactataacgttggtattgctaatggacttgatgttgtagttaccgtagatagtcgtggtttgatgatggaaaatgctggtcctgattttgaaggtcaattctatgacaaagtaacaccacttgtaaaagaaaaattgggagatcttcttttagccagcgaagttatcaaccactcatatccatttgactggcgtacgaaaaagccaatcatttggcgtgcggttccacaatggtttgcctctgtttcgaaattccgtcaagaaatcctcgatgaaattgaaaagacaaatttccaacctgagtggggtaaaaaacgtctttataacatgatccgtgaccgtggcgactgggtaatctcacgtcaacgtgcttggggtgttccacttccaattttttatgcagaagatggtacagctatcatgacaaaagaagtgactgatcacgttgcagatttatttgctgaatacggctcaatcgtttggtggcaacgtgatgctaaggaccttctaccagcaggttatactcatccaggttcacctaatggtctctttgagaaagaaacagacatcatggatgtttggtttgattctggttcatcatggaatggggtaatgaatgctcgtgaaaacctttcctatccagcagatctttatcttgaaggttctgatcaataccgtggttggttcaactcatcactaattacatcagttgctgttaatggtcacgctccatacaaagcagtcttatctcaaggttttgtacttgatggtaaaggtgagaaaatgtctaaatctctaggaaatacaattcttcctagtgatgttgaaaaacaatttggtgcggaaatcttgcgtctgtgggtaacttctgttgactcaagtaatgatgttcgtatttcaatggatatcttaaaacaaacatcagaaacttatcgtaagatcaggaatacattgcgtttcttgattgcaaatacttccgattttaatcctaaacaagatgcagtagcctatgaaaatttaggtgccgttgatcgttatatgactattaaatttaatcaagttgtggatacaatcaacaaagcttatgctgcttatgattttatggcaatttataaagctgtcgttaacttcgtaacagttgatctatcagcattttaccttgattttgcaaaagatgtggtttacattgaagcggctaacagtccagaacgacgtcgtatgcaaactgttttctatgatattttagttaaacttacaaaacttttgactccgattctaccacatactgctgaagaaatttggtcatacctcgaacatgaggaggaggagtttgttcaattagcagaaatgcctgttgcacagacattctctggtcaagaagaaattcttgaagagtggtcagcattcatgacgttacgaacacaagctcaaaaagctctcgaagaagcacgtaacgctaaagttattggtaaatctctagaagcacatttaacaatttatgctagtcaagaagtgaaaacgttattaacagcgttaaatagcgatattgcactcttgatgattgtctcacaattaacaattgctgatgaagcagacaaaccagctgactcagtatcatttgaaggtgttgcatttactgttgaacacgctgaaggtgaagtctgcgaacgctcacgccgtattgatccaaccacaaagatgcgttcgtatggtgtagctgtttgtgatgctagtgcagcaattattgagcaatattatcctgaagcagtagctcaaggttttgaagct

SEQ ID NO: 244 - protein, 930 aa, Streptococcus agalactiae
MKLKETLNLGQTAFPMRAGLPNKEPQWQEAWDQADIYKKRQALNEGKPAFHLHDGPPYANGNIHVGHALNKISKDIIVRSKSMSGFRAPYVPGWDTHGLPIEQVLAKKGVKRKEMDLAEYLEMCRDYALSQVDKQRDDFKRLGVSADWENPYITLTPDYEADQVRVFGAMADKGYIYRGAKPVYWSWSSESALAEAEIEYHDIDSTSLYYANKVKDGKGILDTDTYIVVWTTTPFTVTASRGLTVGPDMEYVVVVPVGSERKYLLAEVLVDSLAAKFGWENFEIVTHHTGKELNHIVTEHPWDTEVEELVILGDHVTTDSGTGIVHTAPGFGEDDYNVGIANGLDVVVTVDSRGLMMENAGPDFEGQFYDKVTPLVKEKLGDLLLASEVINHSYPFDWRTKKPIIWRAVPQWFASVSKFRQEILDEIEKTNFQPEWGKKRLYNMIRDRGDWVISRQRAWGVPLPIFYAEDGTAIMTKEVTDHVADLFAEYGSIVWWQRDAKDLLPAGYTHPGSPNGLFEKETDIMDVWFDSGSSWNGVMNARENLSYPADLYLEGSDQYRGWFNSSLITSVAVNGHAPYKAVLSQGFVLDGKGEKMSKSLGNTILPSDVEKQFGAEILRLWVTSVDSSNDVRISMDILKQTSETYRKIRNTLRFLIANTSDFNPKQDAVAYENLGAVDRYMTIKFNQVVDTINKAYAAYDFMAIYKAVVNFVTVDLSAFYLDFAKDVVYIEAANSPERRRMQTVFYDILVKLTKLLTPILPHTAEEIWSYLEHEEEEFVQLAEMPVAQTFSGQEEILEEWSAFMTLRTQAQKALEEARNAKVIGKSLEAHLTIYASQEVKTLLTALNSDIALLMIVSQLTIADEADKPADSVSFEGVAFTVEHAEGEVCERSRRIDPTTKMRSYGVAVCDASAAIIEQYYPEAVAQGFEA

SEQ ID NO: 245 - DNA, 2799 bp, Streptococcus pyogenes
atgaaattaaaagagacacttaatctaggaaaaacagcctttccaatgcgcgcaggtcttcctaataaagagccacaatggcaagcagcttgggaacaagcagagctttacaaaaaacgtcaagaattgaatgcaggtaagcctgcctttcatcttcatgatggacctccatacgctaacggcaatattcacgttgggcatgcccttaataaaatttcaaaagatatcattgtgcgttctaagtccatgtctggctttcaagcgccttatgtacctggttgggacacacacggccttccaatcgaacaagtcttggctaagcaaggaatcaaacgtaaggagatggatttagcagaataccttgagatgtgtcgtcaatacgctttaagtcaggttgataaacagcgagatgatttcaaacggttaggtgtttcggcagactgggaaaatccttatgtcactttggacccacagtttgaagctgatcaaattcgtgtttttggagcgatggctgaaaaaggttacatctatcgtggtgctaaacctgtttattggtcatggtcttcagaatcggccttggcagaggctgaaattgaataccatgacatcgattcaacctctttatactacgccaataaagttaaagatggtaaaggtatccttgatactaatacgtatatcgttgtttggaccacaacaccatttaccgttacagcatcacgcggtttgactgttggtcctgatatggattatcttgtggtgaaacctgctggttcagaccgtcaatatgttgtggcagaaggtcttttggatagccttgctggaaaatttggctgggaatcttttgaaactttagctagccataaaggagctgatttagagtacattgtgacagaacacccatgggatactgacgtagaagaattggttatccttggtgaccatgttacccttgagtcagggacagggattgtccacacagcaccaggttttggtgaggatgactacaatgttgggacaaaatacaaactggaagttgctgtgactgttgatgaacgtggcctaatgatggaaaatgcaggtccagatttccacggacaattttataacaaggtaacgccgattgtcattgataaacttggtgatcttttattggcacaagaagtgatcaatcactcttacccatttgactggcggacgaaaaaaccaatcatctggcgtgctgtaccgcaatggtttgcttctgtttctgatttccgtcaagatattttggatgaaattgaaaaaacaacctttcatccatcatggggtgaaacacgcctttacaatatgattcgtgatcgtggcgactgggttatttctcgtcaacgtgcttggggagttccgcttcctatcttctatgccgaagatggcacagctattatgactaaagaagtgacagatcatgtggctgatttgttccaagaaaatggatcaatcatttggtggcaaaaagaagctaaagacctattaccagagggcttcactcatccagggtcaccaaatggcgagtttacaaaagaaactgatatcatggacgtttggtttgactctggttcttcttggaatggagtcatgaatactaaagaaaatctttcctatccagcggatctatacttagaaggctctgaccagtatcgtggttggttcaattcatccttaattacatctgtggctgttaatgggcatgctccatataaggctattttatcgcaaggctttgttcttgatggtaagggcgaaaaaatgtctaaatcaaaaggcaatatcatttctcctaatgatgtggctaaacaatatggtgcagatattcttcgactttgggtagcttctgtggataccgataatgatgtccgtgtttctatggagatccttggtcaagtctctgaaacttaccgtaaaatccgtaacacccttcgcttcttgattgctaatacatctgatttcaaccctgctacggatacagtagcttatgcagatttaggaactgttgataagtacatgacaattgtctttaatcagttggtagcaacgattactgacgcttatgagcgttatgactttatggctatttacaaagcagtggtgaactttgttacggttgatttatcagccttctatcttgattttgctaaagacgttgtctatattgaagctgccaatagcttagaacgtcgtcgcatgcagacagtcttctatgatatcttggttaagattaccaagttattgacgccaatcttgcctcacactactgaagaaatctggtcttatctagagcatgagtcagaagcatttgttcaattggcagaaatgcctgtggcagaaaccttctcggctcaagaggatattttagaagcttggtcagctttcatgactttgcgtactcaagctcaaaaagctttggaagaagcgcgaaatgctaagattatcggtaaatcattggaagcccatttgaccatctacgctagtgaagaagtgaaaaccttattgactgctttagacagcgatattgctttgcttttgatcgtgtctcaattaaccattgctgacttggcagatgcgcctgcggatgcagtggcatttgaaggtgttgcctttatagtagaacatgccataggtgaagtttgtgagcgttcacgtcgcatcgacccaactactcgcatgcgttcttacaatgcatttgtctgtgatcacagcgctaaaatcattgaagaaaatttcccagaagctgtggctgaagggtttgaagagagtggcaaa

SEQ ID NO: 246 - protein, 933 aa, Streptococcus pyogenes
MKLKETLNLGKTAFPMRAGLPNKEPQWQAAWEQAELYKKRQELNAGKPAFHLHDGPPYANGNIHVGHALNKISKDIIVRSKSMSGFQAPYVPGWDTHGLPIEQVLAKQGIKRKEMDLAEYLEMCRQYALSQVDKQRDDFKRLGVSADWENPYVTLDPQFEADQIRVFGAMAEKGYIYRGAKPVYWSWSSESALAEAEIEYHDIDSTSLYYANKVKDGKGILDTNTYIVVWTTTPFTVTASRGLTVGPDMDYLVVKPAGSDRQYVVAEGLLDSLAGKFGWESFETLASHKGADLEYIVTEHPWDTDVEELVILGDHVTLESGTGIVHTAPGFGEDDYNVGTKYKLEVAVTVDERGLMMENAGPDFHGQFYNKVTPIVIDKLGDLLLAQEVINHSYPFDWRTKKPIIWRAVPQWFASVSDFRQDILDEIEKTTFHPSWGETRLYNMIRDRGDWVISRQRAWGVPLPIFYAEDGTAIMTKEVTDHVADLFQENGSIIWWQKEAKDLLPEGFTHPGSPNGEFTKETDIMDVWFDSGSSWNGVMNTKENLSYPADLYLEGSDQYRGWFNSSLITSVAVNGHAPYKAILSQGFVLDGKGEKMSKSKGNIISPNDVAKQYGADILRLWVASVDTDNDVRVSMEILGQVSETYRKIRNTLRFLIANTSDFNPATDTVAYADLGTVDKYMTIVFNQLVATITDAYERYDFMAIYKAVVNFVTVDLSAFYLDFAKDVVYIEAANSLERRRMQTVFYDILVKITKLLTPILPHTTEEIWSYLEHESEAFVQLAEMPVAETFSAQEDILEAWSAFMTLRTQAQKALEEARNAKIIGKSLEAHLTIYASEEVKTLLTALDSDIALLLIVSQLTIADLADAPADAVAFEGVAFIVEHAIGEVCERSRRIDPTTRMRSYNAFVCDHSAKIIEENFPEAVAEGFEESGK

SEQ ID NO: 247 - DNA, 300 bp, Streptococcus agalactiae
atgagactaattaatacaaccagtagtcatcctgaactagttcgaaatcaactccaaaatacagatgcaaaattagtggaagtctattcagctggcaacaccgatgtcgtttttacaaaagcacctaaacattatgaattattaatttcaaacaaatatcgtgctatcaaagatgaagaattagaagctattcgtgagttcttcttaaagcgtaaaatagatcaatctattattattcaagagcagatgaaatcactccatactgccaagttaattgaaatttcatatccaacaacagca

SEQ ID NO: 248 - protein, 100 aa, Streptococcus agalactiae
MRLINTTSSHPELVRNQLQNTDAKLVEVYSAGNTDVVFTKAPKHYELLISNKYRAIKDEELEAIREFFLKRKIDQSIIIQEQMKSLHTAKLIEISYPTTA

SEQ ID NO: 249 - DNA, 300 bp, Streptococcus pyogenes
atgagactcatcaataccactagcagtcacccagaactcatcaaaaatcagctaaaaaacaccgatgcctatttagtcgaagtatactcagcaggaaatacagatgtcatttttacccaagcaccaaaacattacgaactacttatttcaaataaataccgtgccatcaaggaggatgaacttgatatcattcgcgaattttttttaaaacgtaaaattgatcctaaaattgttattcctggacaatcaaaaacacttcacacgaataaccttattgaaatttcatttcaaacttctgta

SEQ ID NO: 250 - protein, 100 aa, Streptococcus pyogenes
MRLINTTSSHPELIKNQLKNTDAYLVEVYSAGNTDVIFTQAPKHYELLISNKYRAIKEDELDIIREFFLKRKIDPKIVIPGQSKTLHTNNLIEISFQTSV

SEQ ID NO: 251 - DNA, 453 bp, Streptococcus agalactiae
atgactaatcctactttcggtgaaaaaatagataatgtaaactataggtcacgatttggtgtctatgctattattccaaatccaactcatgataaaattattttagtacaggcacctaatggtgcttggtttcttccaggtggggaaattgaagaaaatgaaaatcacctagaagctttaactcgtgagttaattgaagaattaggttattccgcaacaattggccattactatggtcaagctgatgaatatttttactctagacaccgtgatacttactactataatcccgcctatatttatgaagttactgcctatcataaggatcaagcgccactagaagatttcaaccatctagcctggtttcctatccaagaagctaaagaaaagctaaaacgaggaagccatagatggggtgtccaagcttgggaaaaaaatcaccattctaggaaa

SEQ ID NO: 252 - protein, 151 aa, Streptococcus agalactiae
MTNPTFGEKIDNVNYRSRFGVYAIIPNPTHDKIILVQAPNGAWFLPGGEIEENENHLEALTRELIEELGYSATIGHYYGQADEYFYSRHRDTYYYNPAYIYEVTAYHKDQAPLEDFNHLAWFPIQEAKEKLKRGSHRWGVQAWEKNHHSRK

SEQ ID NO: 253 - DNA, 453 bp, Streptococcus pyogenes
atgatgattccaacatttggacataaaaatgcacataaagactatgtcacacgttacggtgtctatgctatcattcccaatcacgaacaaacaaaaattattcttgttcaagctcctaatggttcctggtttttacctggtggtgaaattgaagcaggtgaaggtcagcttcaggccctagagcgtgaactgattgaagaacttggtttttctgctactattggttcatattacggtcaggcagatgaatatttctactctcgccatcgtgatacccacttctaccatcctgcctatctttatgaagtaactgcatttcaagccgtttctaagcccttagaagattttaataacttaggttggttttctcctatcgaggcaattgctaaattaaaacgagagagccatcaatggggagtcaaggaatggcaaaaaaagcatcattctactaac

SEQ ID NO: 254 - protein, 151 aa, Streptococcus pyogenes
MMIPTFGHKNAHKDYVTRYGVYAIIPNHEQTKIILVQAPNGSWFLPGGEIEAGEGQLQALERELIEELGFSATIGSYYGQADEYFYSRHRDTHFYHPAYLYEVTAFQAVSKPLEDFNNLGWFSPIEAIAKLKRESHQWGVKEWQKKHHSTN

SEQ ID NO: 255 - DNA, 2259 bp, Streptococcus agalactiae
atgctctgtcaaaactgcaaactaaacgaatcaactattcatttgtatacaaatgttaatggaaaacaaaagcaagttgatctttgtcaaaattgctaccaaattattaaaactgaccctaataatccacttttttcaggtttaaatcatgtttcacatgcgcctggtggcatcaatcctttctttgatgatttctttggagatttaaataatttcagagcctttaatggccaagatttaccaaacactcctcctacacaatcaggaggaaaccgaggtggaggaaacggtaatggacgaaataataatcgcaaccaaactgcaactccttctcaagccaaagggattctagaagaatttggtatcaatgtcactgaaatagcccgccatggtgatattgaccctgttattggacgtgactcagaaattattcgtgttatcgaaatccttaatcgtcgtacaaaaaataatcctgtacttattggcgaacccggcgttgggaaaactgccgttgttgaaggacttgctcagaaaattgttgatggtaatgtgcctcataaacttcaaggcaaacaagttattcgtttggatgttgtgagtctagtacaaggaacgggcattcgtggtcaatttgaagaacgcatgcaaaagttgatggaagaaattcgtcaacgtcaagatgttattctattcatagatgaaattcacgaaatagttggagctggtacagctggcgaaggtagtatggatgcaggtaatattttaaaacctgcccttgcacgtggagaattacaactagtaggtgctactactctcaatgaatatcgtattatcgaaaaggacgctgccttagaacgccgtatgcaacctgtaaaagtcgatgagccttctgttgaagaaaccattactattttgaaaggtatccaaaaaaaatacgaagattatcatcatgtaaaatataataatgatgccatagaagcagctgcagtactatctaatcgttatatccaggaccgctttttacctgataaagcaatagacttattagatgaagctggttctaaaatgaacctaacactaaattttgttgatccaaaagaaattgatcaacgtctcattgaagcagaaaatttaaaagcgcaagcgactcgtgaagaagattacgaacgtgcagcttacttccgtgaccagattgcaaaatataaagaaatgcaacaacaaaaggtcgacgatcaagatacacctattattaccgaaaaaacaattgagcacatcattgaagaaaaaacgaatatccctgttggtgatttaaaagaaaaagaacaatctcaattaattaatctcgcagatgacttgaaacaacatgtgatcggccaggatgacgctgtcgttaagattgcaaaagctattcgtcgtaatcgagttggtcttggtagcccaaaccgtcctattggttcctttttatttgtaggaccaaccggcgttggtaaaactgaactttctaaacaactagcaattgagctctttggttcagctgatagtatgattcgttttgatatgtcagagtacatggaaaagcatgctgttgctaaattagtcggagcgcctccaggatacgtgggatacgaggaagctggacaattaactgaaaaggttcgtcgaaatccttactcgctcatccttctagatgaaattgaaaaagctcatcctgatgtcatgcatatgttcttgcaggtccttgatgacggtcgattaacagatggacaaggaagaactgttagttttaaagataccattatcatcatgacctcaaatgctggttctggtaaaactgaagcaagcgttggctttggtgcctcacgagaaggtagaacgaattccgtactaggtcaactaggtaacttcttcagccctgaatttatgaaccgctttgacggtattattgaattcaaggctttagataaagagaatctcctcaatatcgttgatattatgttatctgacgttaatgcacgtctcgccatcaatggtattcatctagatgtcactgataaagtgaaagaaaaattggttgatttaggttacgatcccaaaatgggagcacgtccattacgtcgtaccattcaagaacatattgaagatgctatcacagattactatcttgagaatccaagcgaaaaagaacttcgtgctattatgactagcaatggaaatatcataataaaatcttctaaaaaaactgaagaaagtacaaaaggt

SEQ ID NO: 256 - protein, 753 aa, Streptococcus agalactiae
MLCQNCKLNESTIHLYTNVNGKQKQVDLCQNCYQIIKTDPNNPLFSGLNHVSHAPGGINPFFDDFFGDLNNFRAFNGQDLPNTPPTQSGGNRGGGNGNGRNNNRNQTATPSQAKGILEEFGINVTEIARHGDIDPVIGRDSEIIRVIEILNRRTKNNPVLIGEPGVGKTAVVEGLAQKIVDGNVPHKLQGKQVIRLDVVSLVQGTGIRGQFEERMQKLMEEIRQRQDVILFIDEIHEIVGAGTAGEGSMDAGNILKPALARGELQLVGATTLNEYRIIEKDAALERRMQPVKVDEPSVEETITILKGIQKKYEDYHHVKYNNDAIEAAAVLSNRYIQDRFLPDKAIDLLDEAGSKMNLTLNFVDPKEIDQRLIEAENLKAQATREEDYERAAYFRDQIAKYKEMQQQKVDDQDTPIITEKTIEHIIEEKTNIPVGDLKEKEQSQLINLADDLKQHVIGQDDAVVKIAKAIRRNRVGLGSPNRPIGSFLFVGPTGVGKTELSKQLAIELFGSADSMIRFDMSEYMEKHAVAKLVGAPPGYVGYEEAGQLTEKVRRNPYSLILLDEIEKAHPDVMHMFLQVLDDGRLTDGQGRTVSFKDTIIIMTSNAGSGKTEASVGFGASREGRTNSVLGQLGNFFSPEFMNRFDGIIEFKALDKENLLNIVDIMLSDVNARLAINGIHLDVTDKVKEKLVDLGYDPKMGARPLRRTIQEHIEDAITDYYLENPSEKELRAIMTSNGNIIIKSSKKTEESTKG

SEQ ID NO: 257 - DNA, 2280 bp, Streptococcus pyogenes
atgctgtgtcaaaattgtaatttaaacgaatctactattcatctttatacaagtgttaatggaaaacaaagacaggttgatctctgtcaaaattgttatcaaatcatgaaatccgatcctgccaattctattttaaatggcctaaccccaggatatagagcacaagatagatccacaagtcctttctttgatgacttttttggtgatttgaataattttagagcttttggtaatcttccaaataccccacctactcaggcagggcaaaatggaaatggcggaggacgctatggtggtaactacaacggacaacgacctgctcagccacaaacaccaaatcagcaagcaaagggcttgttagaagagtttgggattaatgtcacagatattgcaagaaatggtaatattgatcctgttattggtcgtgacgaagagattacacgcgttatcgagatcctcaaccgccgtactaaaaataatcctgtgctaattggtgagcctggagttggtaaaactgctgttgtagaaggtttggctcaaaaaattattgatggtactgttcctcaaaaactccaaggcaagcaagtgattcgtcttgatgtggttagcctcgttcagggaacaggtatccgtggtcagtttgaagagcgcatgcaaaaattaatggaagaaattcgcaatcgcaaggatgtgattctctttattgatgaaattcatgagattgtcggtgctggttctgcaggagacggcaatatggatgctggtaatattttaaaaccagccttggcccgtggtgagttgcaactcgttggtgctactacattaaatgaataccgtattattgaaaaagacgctgccttagaacgacgtatgcaacccgttaaagttgatgaaccttctgttgaggaaaccatcacgattttaaaaggtatccaaccgaaatacgaagactatcatcatgtcaaatatagcccagccgctattgaagctgccgctcatttatctaaccgctatattcaagaccgttttcttcctgataaggctattgaccttctggacgaagctggttccaaaatgaatctaaccctcaactttgttgatcctaaagaaattgacaaacgtcttattgaagctgagaatctcaaggcgcaagctactcgagacgaagactatgaacgcgcagcttatttccgcgatcaaattacaaaatacaaagaaatgcaggctcaaaaagtcgatgagcaagatattcccatcattactgaaaaaaccattgaagctattgtagagcaaaaaactaatattccagttggggacttaaaagaaaaggaacagtctcaactcgtaaacttagccaatgatctgaaagcacacgtgatcgggcaagacgatgctgttgataaaatcgctaaggctattcgtcgtaaccgtgtgggattaggaactccaaatcgccctattggttctttcttattcgttggaccgactggggttggtaaaactgaattgtctaaacaactagccattgaactctttggttcgacaaacaatatgattcgctttgacatgtccgaatacatggaaaaacacgctgtcgccaaattagtcggggctcctccaggttatatcggctatgaagaagctggacagctaaccgaacaagttcgtcgcaatccatattcacttattctcttagatgaggtggaaaaagcccatcctgacgtcatgcacatgttcttacaagttcttgatgatggccgtttaacagatggtcaaggacgaacagtcagcttcaaggacaccattattatcatgacctctaatgccggaacaggtaaaagcgaagcttctgtcggatttggtgctgctagagaaggacggacaagttctgtccttggtgaattaagcaacttcttcagcccagagtttatgaatcgtttcgatggtattattgaattcaaagctttatctaaagagcatttgctgcatatcgttgatttaatgctggaagatgttaatgagcgcttaggctataatgggattcatcttgatgtgacacaaaaggtcaaagaaaaattagtagatttaggctatgatcctaaaatgggcgctcggccgctccgtcgtactattcaagattatatcgaagatgccattacagactattatttagaacacccaactgaaaaacagttacgtgcactgatgacaaacagtgaaaatatcacgattaaagctgttaaagagggagattcttttcttaacgaagagtctctcgat

SEQ ID NO: 258 - protein, 760 aa, Streptococcus pyogenes
MLCQNCNLNESTIHLYTSVNGKQRQVDLCQNCYQIMKSDPANSILNGLTPGYRAQDRSTSPFFDDFFGDLNNFRAFGNLPNTPPTQAGQNGNGGGRYGGNYNGQRPAQPQTPNQQAKGLLEEFGINVTDIARNGNIDPVIGRDEEITRVIEILNRRTKNNPVLIGEPGVGKTAVVEGLAQKIIDGTVPQKLQGKQVIRLDVVSLVQGTGIRGQFEERMQKLMEEIRNRKDVILFIDEIHEIVGAGSAGDGNMDAGNILKPALARGELQLVGATTLNEYRIIEKDAALERRMQPVKVDEPSVEETITILKGIQPKYEDYHHVKYSPAAIEAAAHLSNRYIQDRFLPDKAIDLLDEAGSKMNLTLNFVDPKEIDKRLIEAENLKAQATRDEDYERAAYFRDQITKYKEMQAQKVDEQDIPIITEKTIEAIVEQKTNIPVGDLKEKEQSQLVNLANDLKAHVIGQDDAVDKIAKAIRRNRVGLGTPNRPIGSFLFVGPTGVGKTELSKQLAIELFGSTNNMIRFDMSEYMEKHAVAKLVGAPPGYIGYEEAGQLTEQVRRNPYSLILLDEVEKAHPDVMHMFLQVLDDGRLTDGQGRTVSFKDTIIIMTSNAGTGKSEASVGFGAAREGRTSSVLGELSNFFSPEFMNRFDGIIEFKALSKEHLLHIVDLMLEDVNERLGYNGIHLDVTQKVKEKLVDLGYDPKMGARPLRRTIQDYIEDAITDYYLEHPTEKQLRALMTNSENITIKAVKEGDSFLNEESLD

SEQ ID NO: 259 - DNA, 696 bp, Streptococcus agalactiae
atgtcaatgaatttttcatttttaccacaatattggtcctattttaattatggtgtgatggtaaccattatgatttcaacatgtgttgttttttttggaactattataggtgtgttaattgctttagtaaagcgtactaatttacattttctcacaatattagctaatttctatgtatgggtatttcgtgggacaccgatggtagttcaaattatgattgctttcgcatggatgcattttaacaatttaccaacgattagctttggtgttttagatttagattttacacgacttttacctggtatcattatcatttccttaaatagtggtgcctatatttcggaaattgtacgtgcagggattgaggctgtaccatctggacaaatagaagcagcttactcgttggggattcgacctaaaaatacacttcgctatgttatcttaccccaagcttttaaaaatattttacctgctctagggaatgaatttattacaattattaaagatagtgctctccttcaaactattggtgtcatggaattatggaacggagcacaatcagttgtaacggctacttactcaccagttgcaccgttattatttgcagcattttactatttaatgttgacaacgattctctcagctttgttaaaacaaatggagaaatatcttgggaaaggggtaaaaatagatggt

SEQ ID NO: 260 - protein, 232 aa, Streptococcus agalactiae
MSMNFSFLPQYWSYFNYGVMVTIMISTCVVFFGTIIGVLIALVKRTNLHFLTILANFYVWVFRGTPMVVQIMIAFAWMHFNNLPTISFGVLDLDFTRLLPGIIIISLNSGAYISEIVRAGIEAVPSGQIEAAYSLGIRPKNTLRYVILPQAFKNILPALGNEFITIIKDSALLQTIGVMELWNGAQSVVTATYSPVAPLLFAAFYYLMLTTILSALLKQMEKYLGKGVKIDG

SEQ ID NO: 261 - DNA, 684 bp, Streptococcus pyogenes
atggatttgtcatttttgcccaaatactgggcctactttaactacggtgtacttgtcaccattatgatttcagtcagcgttgtcttttttggaacccttattggtgtcttggtaaccctgattaagcgtagtcatgtgaagccgttgacctgggtcgttaatctttacgtttggatctttcggggaacacctatggtggttcaaatcatgattgcctttgcttggatgcattttaacaatatgcctactattggttttggggttttagacttggacttttcaagactacttcctggaattattatcatttcattgaatagcggtgcttatatttcagaaattgttagagcaggtattgaggctgtaccaaaagggcaattagaagcagcttattcactaggtattcgtcctcaaaatgccatgcgttatgtgattttgcctcaggcctttaaaaatattttgccagccttaggaaatgaatttattaccattattaaggatagtgctcttttacaaaccattggagtgatggaactttggaatggtgcccaatcggtggtaacggctacttattctccaatttcccctttactggtggctgctttttactacttaatggtcacaacagtgatggcacagttattggcagtcttagaacgtcacatggcgcaaggaggtaatcat

SEQ ID NO: 262 - protein, 228 aa, Streptococcus pyogenes
MDLSFLPKYWAYFNYGVLVTIMISVSVVFFGTLIGVLVTLIKRSHVKPLTWVVNLYVWIFRGTPMVVQIMIAFAWMHFNNMPTIGFGVLDLDFSRLLPGIIIISLNSGAYISEIVRAGIEAVPKGQLEAAYSLGIRPQNAMRYVILPQAFKNILPALGNEFITIIKDSALLQTIGVMELWNGAQSVVTATYSPISPLLVAAFYYLMVTTVMAQLLAVLERHMAQGGNH

SEQ ID NO: 263 - DNA, 1701 bp, Streptococcus agalactiae
atgtctcatatgaattataaagagatttatcaagagtggttagaaaacgactcactcggtaaagatattaagtcagatttagaagctattaaaggcgatgaatctgaaattcaggatcgtttttacaaaacattagaatttggaacggcgggattgagaggtaaacttggagcaggaaccaatcgtatgaatacttatatggtggggaaagcagcacaagcattagctaatacgattattgatcatggccctgaagctattgcacgtggaattgcagttagttatgatgtccgttatcaatctaaggaatttgcagaattaacttgttccattatggcagcaaatggtattaagtcttatatttataaagggattcgcccaacaccaatgtgctcatatgctattcgtgctctaggatgtgtttcgggtgtgatgattactgctagtcataatcctcaagcttataatggttataaggcatattggaaagaaggatctcagattttagatgatattgctgatcaaattgccaatcatatggatgctataaccgattatcagcaaattaagcaaataccctttgaagaggctctggcaagtggttcggcaagttatatcgatgagagtattgaagaagcatataaaaaagaagtgcttggtttaactattaatgatactaatattgataagtcagtccgggtagtttatactcctttaaatggcgtaggaaatttacctgtgcgcgaagttttaagacgccgtggttttgaaaatgtttatgtggtacctgagcaggaaatgcccgatcctgattttacaacggttggctatccaaaccctgaagttcctaaagcatttgcctattcagaatctctaggaaagtcagttgatgcagatatcttacttgccacagatccagattgtgaccgagtagcattggaagtcaaagatagtaagggagaatatattttcttaaatggtaataagataggggcacttctttcctattatattttttcacaacgatgtgccttagggaatttgccacatcatcctgtattggtaaaatccattgtaactggtgatctatcaaaagttattgcagataaatataatattgaaactgttgaaactttaacaggatttaaaaatatttgtggaaaagctaatgaatatgatatctcaaaggataaaacttatctctttggctatgaagaaagtattggtttttgctatggcacttttgtacgtgataaagatgctgtgagtgcttcaatgatggtagtagaaatgactgcctattataaagaacgagggcaaacacttttagacgttttgcaaaccatttacgataaatttggctattacaacgagcgccaattttctcttgagttagagggtgctgaggggcaagaacgtattagtcgtattatggaggattttagacaggacccaatattacaagtaggtgagatgacattggagaattctattgatttcaaggatggttataaggattttccaaagcaaaattgtttaaaatattattttaatgagggttcatggtatgctttaaggccgtcagggacggaacctaagataaaatgttacctttatacgattggttgtacagaagcagatagtttatcgaaacttaatgcaattgagtcggcttgtcgtgctaaaatgaatagtactaaa

SEQ ID NO: 264 - protein, 567 aa, Streptococcus agalactiae
MSHMNYKEIYQEWLENDSLGKDIKSDLEAIKGDESEIQDRFYKTLEFGTAGLRGKLGAGTNRMNTYMVGKAAQALANTIIDHGPEAIARGIAVSYDVRYQSKEFAELTCSIMAANGIKSYIYKGIRPTPMCSYAIRALGCVSGVMITASHNPQAYNGYKAYWKEGSQILDDIADQIANHMDAITDYQQIKQIPFEEALASGSASYIDESIEEAYKKEVLGLTINDTNIDKSVRVVYTPLNGVGNLPVREVLRRRGFENVYVVPEQEMPDPDFTTVGYPNPEVPKAFAYSESLGKSVDADILLATDPDCDRVALEVKDSKGEYIFLNGNKIGALLSYYIFSQRCALGNLPHHPVLVKSIVTGDLSKVIADKYNIETVETLTGFKNICGKANEYDISKDKTYLFGYEESIGFCYGTFVRDKDAVSASMMVVEMTAYYKERGQTLLDVLQTIYDKFGYYNERQFSLELEGAEGQERISRIMEDFRQDPILQVGEMTLENSIDFKDGYKDFPKQNCLKYYFNEGSWYALRPSGTEPKIKCYLYTIGCTEADSLSKLNAIESACRAKMNSTK

SEQ ID NO: 265 - DNA, 1701 bp, Streptococcus pyogenes
atgagtaatatgacttacaacgaggtatatcaagaatggttgcacaataatgatcttagtgatgatattaaagcagatttagcagccataaaagacaatgaggctgagattcaagatcgtttttacaaaacacttgaatttggaacagcagggctaagaggaaaacttggagcaggcaccaatcgcatgaatacctatatggttggtaaggcagcacaagctttagctaatactattattgatcatggacctgaagcggttaaaaagggcattgcggttagttatgatgttcgctatcaatctagaacatttgcagaattaacatgctctattatggcagctaacggtattaaggcgtacctttataaagggattcggccaacaccaatgtgttcgtacgctattcgtgctttgggatgtatttctggtgttatgattacggctagtcacaatccccaagcttacaatggttacaaagcttattggcaagaaggttctcaaattttggatgacattgcggatcaaattgcacaacacatggctgcactaactcagtatcaggaaatcaaacaaatgccttttgaaaaggctctggacagtggacttgttacttatattgatgagagtattgaagaagcatataaaaaagaagtgcttggtttaacgattaatgatactgacattgataagtcagtccgagtagtctatacccctttaaatggtgttgggaatctaccagtgcgtgaggttttaagacgccgcggttttgaaaatgtttatgtggtacctgagcaggaaatgcccgatcctgattttacaacagttggctatcctaatcccgaagtccctaaaacttttgcatattcagaaaaattaggtaaggcagttgatgctgatattttgattgcaactgatccagattgtgaccgtgtggctttagaagttaaaaatgcagtcggtgactatgtttttctcaatggcaataaaatcggagcgcttttatcttactatatcttttcacaacgatttgacttaggcaatttaccggctaatcctgttttagtgaaatccattgtaacaggagacttgtcacgggctattgctagccattatggtattgaaaccgttgaaacattgactggttttaagaatatttgtggcaaggcaaacgaatatgatgtgacgaaacaaaaaaactacctgtttggttatgaagaaagtattggtttttgctatggcacttttgttcgtgacaaagacgctgttagcgcctctatgatgattgtagaaatggcagcttactacaagaaaaaagggcagaatttactagatgttttgcagactatttatgcgacatttgggtattataatgaacgtcaaattgccttggagcttgaggggatagaaggacaaaaacgcattgcgaggataatggaagatttcagacagacaccaatagctagtgttgcagagatggcgttagacaagacaattgattttattgatggctatcaagattttccaaagcaaaactgtctcaaattttatttggatgatggttcttggtatgcacttagaccatcaggaacagagcctaaaataaaattttatttatatactattggccaaacacaagaaaatagtgcaacaaaattagatgctattgaagcagcgtgtcgcacaaaaataaatcaggttaat

SEQ ID NO: 266 - protein, 567 aa, Streptococcus pyogenes
MSNMTYNEVYQEWLHNNDLSDDIKADLAAIKDNEAEIQDRFYKTLEFGTAGLRGKLGAGTNRMNTYMVGKAAQALANTIIDHGPEAVKKGIAVSYDVRYQSRTFAELTCSIMAANGIKAYLYKGIRPTPMCSYAIRALGCISGVMITASHNPQAYNGYKAYWQEGSQILDDIADQIAQHMAALTQYQEIKQMPFEKALDSGLVTYIDESIEEAYKKEVLGLTINDTDIDKSVRVVYTPLNGVGNLPVREVLRRRGFENVYVVPEQEMPDPDFTTVGYPNPEVPKTFAYSEKLGKAVDADILIATDPDCDRVALEVKNAVGDYVFLNGNKIGALLSYYIFSQRFDLGNLPANPVLVKSIVTGDLSRAIASHYGIETVETLTGFKNICGKANEYDVTKQKNYLFGYEESIGFCYGTFVRDKDAVSASMMIVEMAAYYKKKGQNLLDVLQTIYATFGYYNERQIALELEGIEGQKRIARIMEDFRQTPIASVAEMALDKTIDFIDGYQDFPKQNCLKFYLDDGSWYALRPSGTEPKIKFYLYTIGQTQENSATKLDAIEAACRTKINQVN

SEQ ID NO: 267 - DNA, 852 bp, Streptococcus agalactiae
atgactgaattaatagatggtaaagccttatcacaaaaaatgcaggctgagttagggcgaaaagttgaaaggttaaaggaacagcatggtatcatacctggtttagctgtaatccttgttggggataatccagctagccaagtgtacgttcgaaataaagaacgctctgcattagaagctggttttaaaagtgagactctacgattatctgaatccatttctcaagaagaactgattgatattatccatcaatacaatgaagataaaagtatccatggtattttagttcaacttccgttaccacaacatattaacgataaaaaaattattttagcaatagatcctaagaaagatgttgatggtttccacccaatgaatacgggtcatctttggtcaggacgaccgatgatggtaccttgtacgccagctggtattatggagatgtttagagagtaccatgtggatttagagggaaaacatgctgttatcatcggaaggtccaatattgttggtaagccaatggcacaacttctccttgataaaaacgcaacagttactttgacacattcaagaactcgaaacctttctgaggtaacaaaggaggctgatatccttattgttgcgattggtcaggggcactttgttacaaaagacttcgttaaagaaggtgctgtggtgattgatgttggtatgaatcgcgatgaaaatggtaaattgattggagacgttgtatttgaacaagtggcagaagttgctagtatgataacacctgttcctgggggcgtaggacctatgacgattacaatgcttttggaacaaacttatcaagcagctcttagaagtgtgagtcta

SEQ ID NO: 268 - protein, 284 aa, Streptococcus agalactiae
MTELIDGKALSQKMQAELGRKVERLKEQHGIIPGLAVILVGDNPASQVYVRNKERSALEAGFKSETLRLSESISQEELIDIIHQYNEDKSIHGILVQLPLPQHINDKKIILAIDPKKDVDGFHPMNTGHLWSGRPMMVPCTPAGIMEMFREYHVDLEGKHAVIIGRSNIVGKPMAQLLLDKNATVTLTHSRTRNLSEVTKEADILIVAIGQGHFVTKDFVKEGAVVIDVGMNRDENGKLIGDVVFEQVAEVASMITPVPGGVGPMTITMLLEQTYQAALRSVSL

SEQ ID NO: 269 - DNA, 858 bp, Streptococcus pyogenes
atgtcaatgacagaactaattgatggtaaagccttagctcaaaagatgcaacaagagttagcagctaaagtcaacaatctaaaacaaaaaaaaggaattgtaccaggcttagccgttattcttgtaggtgatgatcctgctagtcaggtgtatgtccgtaataaagagcgtgcagctcttactgtaggttttaaaagtgagaccgttagattatcagaattcatttgtcaagaagagcttattgcagtaatcgaacgttacaatgcagataacactattcatggtattttagtgcagctacccctgccaaatcatattaatgataaaaaaattattctcgccattgatcccaaaaaagatgtggatggttttcacccgatgaatacaggtcacctttggtcaggacgtcccttgatggttccttgtactccatcagggattatggaattgcttcgagaatataatgttaaccttgaaggtaaacatgccgtcattattggcagatcgaatatcgttggaaaaccaatggcacagctcttactggacaaaaatgcaacagtcacgttgacacattcaagaacacgtcaattagaagaagtatgtcgctgtgcagatgtgttgattgtggcaatcggacaaggtcatttcataacaaaacaatatataaaagatggtgcgatagtgattgatgtaggaatgaaccgtgatgataatggcaagctaattggagatgtggcctttgatgaggtggcagaagttgcagcgaaaatcacccctgtaccaggaggtgtcggtcctatgacgattgctatgttgctagagcaaacttatcaatctgctctccgtagtactcataaa

SEQ ID NO: 270 - protein, 286 aa, Streptococcus pyogenes
MSMTELIDGKALAQKMQQELAAKVNNLKQKKGIVPGLAVILVGDDPASQVYVRNKERAALTVGFKSETVRLSEFICQEELIAVIERYNADNTIHGILVQLPLPNHINDKKIILAIDPKKDVDGFHPMNTGHLWSGRPLMVPCTPSGIMELLREYNVNLEGKHAVIIGRSNIVGKPMAQLLLDKNATVTLTHSRTRQLEEVCRCADVLIVAIGQGHFITKQYIKDGAIVIDVGMNRDDNGKLIGDVAFDEVAEVAAKITPVPGGVGPMTIAMLLEQTYQSALRSTHK

SEQ ID NO: 271 - DNA, 834 bp, Streptococcus agalactiae
atgattgttggtgaacaagaagcgagggcgttaattaagccacgccctaaatcaagccataaaggtgattatggtagtgttcttctgataggaggtttttatccctatggaggtgctattataatggcagctttggcctgtgtcaaaactggtgcaggattagttactgtagcaacccaaagttgcaatatcccctctttgcatagtcaactaccagaggtaatggcgtttgatagtgatgattacaaatggttggaaaaatcaattgttcaaagtgatgttattgtaattggtcctggattaggagtatcagaatcatctcgaaaaattttgaaccagaccatggagaagattcaatcacatcaaagtgtcatccttgacggatcagccttgactctgttatcagaaggtgcgtttccgcaaacaaaggctaaaaatttagtgttgacacctcatcaaaaagaatgggagcgattgtcaggtatcgctgtatcgcaacagacaaaagaaaatacccaaaccgctcttaaatcttttcccaaagggacgattttagtcgctaagagttcgcatacgcgtatttttcaagatttagacgaaaaagaaattatagtaggaggtccttaccaggcgactggagggatgggggatactttgtgtggtatgattgcaggtatgttagcgcaatttaaagaagcctctcctctagataaggtatcagtgggagtttatctacattcggcaattgctcaaggattatctaaagaagcctatgttgttctaccgacaacgattagtgatgagattccaaaagaaatggctagactatctaaa

SEQ ID NO: 272 - protein, 278 aa, Streptococcus agalactiae
MIVGEQEARALIKPRPKSSHKGDYGSVLLIGGFYPYGGAIIMAALACVKTGAGLVTVATQSCNIPSLHSQLPEVMAFDSDDYKWLEKSIVQSDVIVIGPGLGVSESSRKILNQTMEKIQSHQSVILDGSALTLLSEGAFPQTKAKNLVLTPHQKEWERLSGIAVSQQTKENTQTALKSFPKGTILVAKSSHTRIFQDLDEKEIIVGGPYQATGGMGDTLCGMIAGMLAQFKEASPLDKVSVGVYLHSAIAQGLSKEAYVVLPTTISDEIPKEMARLSK

SEQ ID NO: 273 - DNA, 1338 bp, Streptococcus agalactiae
atgtcagactatttatccgtgtcgacactgactaagtatttaaaattaaaatttgacaaagacccttatttagagagggtttatttaactgggcaagtgtctaattttcgtcgtcgcccaaaccatcaatatttctctttaaaagatgataaatcagtcattcaggcgacaatgtggtcaggtcacttcaaaaaattgggttttgaattagaggaagggatgaaggttaatgtagttggccgtgttcaactttatgaaccaagcggctcctactctattattgttgaaaaagcagaaccggatggtataggagctcttgctatccaatttgaacaactaaagaagaaactctctcaagcaggttattttgatgatcgtcataagcaattaattcctcaatttgttagaaaaataggagttgtgactagtccaagtggagccgttattcgggatattattacaacagtatctcgtcgatttccaggagtggaaatattacttttccccacaaaagttcaaggagagggcgcagctcaggaaatagcacaaactattgctttagctaacgagaaaaaggatttggatctattaattgttggccgtgggggaggttctattgaggacttatgggcatttaatgaagaatgtgttgtagaagctatttttgaatctcgtcttcccgttatttctagtgtcggacatgaaactgatacaactttagcagattttgtagccgatcgcagagcagcaactccaactgcagcagctgagcttgctacaccggttactaaaattgatatcttgtcttggattactgaacgtgaaaatagaatgtatcagtctagccttcgtcttatcaggacaaaagaggagaggttgcaaaaatcaaagcaatcagttatttttaggcaaccagagcgtctatatgatggtttccttcaaaaattagataacctaaatcagcagttaacatattctatgcgtgataaactacaaacagtaagacaaaagcaaggtttgcttcatcaaaaactgcaaggcatagatttaaaacagcgtattcatatttaccaagagcgtgttgtgcaaagtagacgactattatcaagtacaatgactagtcagtatgacagcaagctagcacgttttgaaaaggctcaagatgcgcttatatcattggatagttctagaattgtagcgcgtggttacgctattatcgaaaaaaaccatactttagtatctactactaatggaataaatgaaggagatcatttgcaagttaagatgcaagatggtcttttagaagttgaggtgaaggatgtcagacaagaaaacatt

SEQ ID NO: 274 - protein, 446 aa, Streptococcus agalactiae
MSDYLSVSTLTKYLKLKFDKDPYLERVYLTGQVSNFRRRPNHQYFSLKDDKSVIQATMWSGHFKKLGFELEEGMKVNVVGRVQLYEPSGSYSIIVEKAEPDGIGALAIQFEQLKKKLSQAGYFDDRHKQLIPQFVRKIGVVTSPSGAVIRDIITTVSRRFPGVEILLFPTKVQGEGAAQEIAQTIALANEKKDLDLLIVGRGGGSIEDLWAFNEECVVEAIFESRLPVISSVGHETDTTLADFVADRRAATPTAAAELATPVTKIDILSWITERENRMYQSSLRLIRTKEERLQKSKQSVIFRQPERLYDGFLQKLDNLNQQLTYSMRDKLQTVRQKQGLLHQKLQGIDLKQRIHIYQERVVQSRRLLSSTMTSQYDSKLARFEKAQDALISLDSSRIVARGYAIIEKNHTLVSTTNGINEGDHLQVKMQDGLLEVEVKDVRQENI

SEQ ID NO: 275 - DNA, 1353 bp, Streptococcus pyogenes
gtgaaaggtggcttgatggcagattatttaaccgtcactcatttgacgaaatatttaaaattaaaatttgaccgtgacccttatttggaacgggtttatctgactggtcaagtgtccaattttcgaaaacgaccaactcatcaatatttttccttaaaagatgaaagtgctgtgattcaagccaccatgtgggcaggagtctataaaaaactaggattcgacctagaagaaggcatgaaaattaatgtaattgggcgagtccaactttatgaacctagtggctcttactctatcgtgattgaaaaggcagagccagatggtataggtgccttggctttgcagtttgaacaattaaagaaaaaattaacggcagaaggttattttgagcaaaaacacaagcagcccttgccacagtttgtatcaaaaattggggtcattacaagtcctagtggtgctgtgattcgagatattatcacaaccgtttcacggcgttttccaggggttgagattttattattcccaactaaagtacaaggtgatggagccgcccaagaagtagtggctaatattcgaagagccaatcaaagagaggatttggacttgctcattgtcggccgtggaggtggctcgatagaagacctttgggccttcaacgaggaaatagtggttcaggctatctttgaatcgcaacttccagtgatttcgagtgtgggtcatgaaacagacacgactttagcggattttgtggcagatcgcagagcagccacaccaacagcagcagcagagttagcaacgcctattacaaaaacagatcttatgtcttggatagtagagcggcaaaatcgttcctatcaggcctgcttgaggcggattaagcaacggcaagagtgggtggataaactctcgcaatctgttatttttaggcaaccagaacgattatatgatgcctacctgcaaaaaattgatcgccttagcatgaccctgatgaatacgatgaaagatcgtctgagttccgccaaagaaaacaaggttcagttggaccatgccttggccaatagtcaattacagacaaaaatcgagcgataccaagaccgtgttgctaccgctaagcgtttactgatggctaatatggctagtcaatatgatagtcagctggctcgctttgaaaaagcacaggatgctttgctatcactggatgccagccgaattatcgcccgtggttatgcaatgattgaaaaaaatcaagcactggtagcctctgtaagtcagataacaaagggtgatcagttaaccattaagatgcgtgatggacaattagatgtagaggtaaaagatgtcaaaaacgaaaacatt

SEQ ID NO: 276 - protein, 451 aa, Streptococcus pyogenes
VKGGLMADYLTVTHLTKYLKLKFDRDPYLERVYLTGQVSNFRKRPTHQYFSLKDESAVIQATMWAGVYKKLGFDLEEGMKINVIGRVQLYEPSGSYSIVIEKAEPDGIGALALQFEQLKKKLTAEGYFEQKHKQPLPQFVSKIGVITSPSGAVIRDIITTVSRRFPGVEILLFPTKVQGDGAAQEVVANIRRANQREDLDLLIVGRGGGSIEDLWAFNEEIVVQAIFESQLPVISSVGHETDTTLADFVADRRAATPTAAAELATPITKTDLMSWIVERQNRSYQACLRRIKQRQEWVDKLSQSVIFRQPERLYDAYLQKIDRLSMTLMNTMKDRLSSAKENKVQLDHALANSQLQTKIERYQDRVATAKRLLMANMASQYDSQLARFEKAQDALLSLDASRIIARGYAMIEKNQALVASVSQITKGDQLTIKMRDGQLDVEVKDVKNENI

SEQ ID NO: 277 - DNA, 213 bp, Streptococcus agalactiae
atgtcagacaagaaaacatttgaagaaaatttacaggaattagagacaattgtctcacgtttagaaacaggtgatgttgccttagaagatgccattgctgaatttcaaaaaggaatgcttatttcaaaagagttacaaagaactttaaaagaagctgaagagacgcttgtaaaagtgatgcaagctgacggaacggaagtagaaatggatact

SEQ ID NO: 278 - protein, 71 aa, Streptococcus agalactiae
MSDKKTFEENLQELETIVSRLETGDVALEDAIAEFQKGMLISKELQRTLKEAEETLVKVMQADGTEVEMDT

SEQ ID NO: 279 - DNA, 213 bp, Streptococcus pyogenes
atgtcaaaaacgaaaacatttgaagaaaatttacaagatttagagactattgtgaacaaacttgaaaatggggatgtccctttggaagaagctatttcagaatttcaaaaaggaatgcttctctcaaaagaacttcaaaagaccttacaagcggcagaaaaaacactcgtcaaagtgatgcaagctgatggcacagaagtagatatggatgat

SEQ ID NO: 280 - protein, 71 aa, Streptococcus pyogenes
MSKTKTFEENLQDLETIVNKLENGDVPLEEAISEFQKGMLLSKELQKTLQAAEKTLVKVMQADGTEVDMDD

SEQ ID NO: 281 - DNA, 873 bp, Streptococcus agalactiae
ttgatggttactattgaaaaaattgatgaagctattcatcgttattacaaacagacacatagtgtcgtttctcctgatttgattaaggctatcctctactcagttgatggaggtgggaaacgtattcgtccacgcatccttttagaaattttagagggatttggagttgaactaatagatggtcattatgatgtggctgctgctttggagatgattcacaccggctcattaatccatgatgatttaccggcgatggataatgatgattttcgtcgtggccgcttaacaaaccataaaaagtttgatgaagctacagcggttttagctggagattccctttttttagacccatttgatttagttgtaaaagctggttttaaagctgatgttactgttaggttaatagagttattgtctatgtctgcgggtagttttggcatggttggtggacaaatgttagatatgaagggagaaaacaaagttttatctattgacgatttaagcttgattcatattaataaaacgggacgcctgttagcttatccctttgttgcagcaggtattttagctgagaagtcggaagaagtaaaaggaaaactgcatcaagctggccttttaatcggtcatgcttttcaagtacgtgatgatattttagatgtgactgctagttttgaagaattggggaagacaccaaataaagacattgtagcagaaaagacaacttatccaaatttattgggtttggataagtcacaggaaatacttgatgatactttgaaaaaagctcaggcaatttttcaaaatctagagaaaaaagctaactttaatgctagaaaaataatagatataatagagggattacggttgaatggc

SEQ ID NO: 282 - protein, 291 aa, Streptococcus agalactiae
MMVTIEKIDEAIHRYYKQTHSVVSPDLIKAILYSVDGGGKRIRPRILLEILEGFGVELIDGHYDVAAALEMIHTGSLIHDDLPAMDNDDFRRGRLTNHKKFDEATAVLAGDSLFLDPFDLVVKAGFKADVTVRLIELLSMSAGSFGMVGGQMLDMKGENKVLSIDDLSLIHINKTGRLLAYPFVAAGILAEKSEEVKGKLHQAGLLIGHAFQVRDDILDVTASFEELGKTPNKDIVAEKTTYPNLLGLDKSQEILDDTLKKAQAIFQNLEKKANFNARKIIDIIEGLRLNG

SEQ ID NO: 283 - DNA, 870 bp, Streptococcus pyogenes
atggacaaattagctagaattgacgaagccattcgtcgctactataagacgactagtaacggtgtatctgaagagttgattgatgctatcttgtattctgttgacagtggtggcaagcgcattcgcccacttatcttattagagatgattgagggatttggggtatcgttacagaatgctcattttgatttggctgcagctcttgaaatgattcatacaggaagtctgattcacgatgatttgccagccatggataatgatgattaccgacgtggcagactgaccaatcacaaacaatttggagaagccacggccattttggcgggagacagcttatttttagacccctttgggttaatagctcaagctgaattaaatagtgaggttaaagtagccttaatccaagaactttccctagcttcaggaacttttggcatggttggtggtcagatgttagatatgaaaggggaaaatcaagcattaagtcttcctcagttgtcactgattcacctcaataaaaccggaaaattattagcttttccttttaaagcagcagctcttataacagaacaggctatgactgttcgtcaacaactagagcaagcgggaatgctcatcgggcacgcctttcagattagggatgatattttagacgtgacagctagctttgaagatcttggaaaaacgcctaaaaaggacttattcgcagaaaaagctacttatccaagtttactggggttagaagcctcttaccaactgctgacagagagtttagatcaggctttgacgatttttcagacactagaaagcgatgtaggctttaagcctcaaataattacaaaactgatagaagggttacgacttaatgcc

SEQ ID NO: 284 - protein, 290 aa, Streptococcus pyogenes
MDKLARIDEAIRRYYKTTSNGVSEELIDAILYSVDSGGKRIRPLILLEMIEGFGVSLQNAHFDLAAALEMIHTGSLIHDDLPAMDNDDYRRGRLTNHKQFGEATAILAGDSLFLDPFGLIAQAELNSEVKVALIQELSLASGTFGMVGGQMLDMKGENQALSLPQLSLIHLNKTGKLLAFPFKAAALITEQAMTVRQQLEQAGMLIGHAFQIRDDILDVTASFEDLGKTPKKDLFAEKATYPSLLGLEASYQLLTESLDQALTIFQTLESDVGFKPQIITKLIEGLRLNA

SEQ ID NO: 285 - DNA, 825 bp, Streptococcus agalactiae
atggctaaagagagggtagatgttcttgcctataaacagggactttttgatacacgagagcaagcgaaacgtggtgttatggcaggaatggtgattaacgttatcaatggagaacgttatgataaaccaggtgaaaaggttgcagacgatactgaattaaaactaaaaggtgaaaaactaaaatatgttagtagaggtggattgaaattagaaaaagctttacaagtttttgaaatttcagttgcagataagctaactatagatattggcgcctctacgggtggttttactgatgttatgctacaatcaggagcgcgtttagtttacgcagtagatgtaggaacaaatcaattagtttggaagttacgtcaggatcatcgtgttcgttctatggaacaatataattttaggtatgcccaaaaagaagatttcaaggagggactgcctgaatttgcatcgatagatgtctcatttatctctcttaatttgattttaccagctctaaaagaaattttagtggatggtggacaagtagtggcattaattaaaccacaatttgaagcaggtcgtgagcaaattggtaaaaatggtattgtcaaagacaagttggttcatgaaaaggttttgacaacagtgaccaatttcacgaaagattatggatatacggttaaacatcttgatttttcgcccattcaaggtggacatggaaatattgagtttttaatgcatttgcaaaagtgtcaagatccacaaaatcttgtgcttgaccaaatacaagatgttatagaaaaagcacataaggaatttaagaaaaatgaagaagag

SEQ ID NO: 286 - protein, 275 aa, Streptococcus agalactiae
MAKERVDVLAYKQGLFDTREQAKRGVMAGMVINVINGERYDKPGEKVADDTELKLKGEKLKYVSRGGLKLEKALQVFEISVADKLTIDIGASTGGFTDVMLQSGARLVYAVDVGTNQLVWKLRQDHRVRSMEQYNFRYAQKEDFKEGLPEFASIDVSFISLNLILPALKEILVDGGQVVALIKPQFEAGREQIGKNGIVKDKLVHEKVLTTVTNFTKDYGYTVKHLDFSPIQGGHGNIEFLMHLQKCQDPQNLVLDQIQDVIEKAHKEFKKNEEE

SEQ ID NO: 287 - DNA, 825 bp, Streptococcus pyogenes
atgcctaaagaaagagtagatgtgttagcctataagcaaggattatttgagaccagagagcaagctaagcgtggtgtcatggcaggcttagtggtctctgtgattaatggccaacgctatgacaagccaggtgacaaaattgacgatgggactgagttaaaacttaaaggtgaaaaactcaaatacgtcagtcgtggtggattaaaactggaaaaggggctgcacgtttttggtgtatcagttgctaatcaaattgggattgatattggcgcttcaacaggtggttttaccgatgttatgttacaagatggggccaaactagtctatgccgtcgacgttgggactaaccagttggtatggaaactcagacaagatccacgagtaagaagtatggaacagtataactttcgttatgctcagccagaagactttaatgagggacagcctgtatttgccagtattgatgtgtcctttatttctctcagcttgattttgccagccctgcataacgttttgtcagatcagggacaggttattgctctcattaaaccgcaatttgaagctgggcgcgagcagattggtaaaaaaggcatcgtcaaggacaaacagattcatgaaaaagtgattcaaaaggtcatggattttgcctcaggttacggatttacagttaagggacttgatttttctcctattcagggtggtcatggcaatatcgaatttttagctcatcttgctaagtcacagacacctgaaacgttagccccgcatttgattcagaaagttgttgccaaggcacataaggagtttgagaaacatgaaaaagag

SEQ ID NO: 288 - protein, 275 aa, Streptococcus pyogenes
MPKERVDVLAYKQGLFETREQAKRGVMAGLVVSVINGQRYDKPGDKIDDGTELKLKGEKLKYVSRGGLKLEKGLHVFGVSVANQIGIDIGASTGGFTDVMLQDGAKLVYAVDVGTNQLVWKLRQDPRVRSMEQYNFRYAQPEDFNEGQPVFASIDVSFISLSLILPALHNVLSDQGQVIALIKPQFEAGREQIGKKGIVKDKQIHEKVIQKVMDFASGYGFTVKGLDFSPIQGGHGNIEFLAHLAKSQTPETLAPHLIQKVVAKAHKEFEKHEKE

SEQ ID NO: 289 - DNA, 471 bp, Streptococcus agalactiae
atgaagaagagtgaacgtttaaatttaattaagcaaattgttcttaaccatgctgttgaaacacaacatgagttgttacgcagattggaagcttatggggtaactctaactcaagcaactatttcacgtgatatgaatgaaattggcattataaaagtgccatcagcaaaaggtcgctatatttacggtttgtcaaatgaaaacgaccctatctttacaactgctgtggcaaagcctattaaaacaagtattttatcaatatcagataagctactaggtttagagcaatttatcaatattaatgtcataccaggtaacagtcaattaattaaaaccttcataatgtcacattgtcaagaacatatttttagtttgacagctgacgataatagtctccttttgattgcaaaatcagaagcagatgctgatcacattcgtcaatcaatgattgcaatgttggagaaaaaagat

SEQ ID NO: 290 - protein, 157 aa, Streptococcus agalactiae
MKKSERLNLIKQIVLNHAVETQHELLRRLEAYGVTLTQATISRDMNEIGIIKVPSAKGRYIYGLSNENDPIFTTAVAKPIKTSILSISDKLLGLEQFININVIPGNSQLIKTFIMSHCQEHIFSLTADDNSLLLIAKSEADADHIRQSMIAMLEKKD

SEQ ID NO: 291 - DNA, 501 bp, Streptococcus pyogenes
ttgttgccaaggcacataaggagtttgagaaacatgaaaaagagtgaacgacttgaattaatcaaaaaaatggttttgacgcatccaattgagacgcaacatgacctcttaagattattggcagagcatgggttagaattaacccaggctactatttcaagagacatgaatgaaattggtatagtaaagattccttctggcagtggacgttacatctatggtctttctcaagatagtggaaaaaagatcgttcaaggacctagatcgataaagagcactattttagctgtatctgacaaaacaaaaggtttagaacaacacctctatttaaaagtcgtacctggcaatagtaaattaatcaaacgttatttattagcagatttttcaaaagctatttttagtcttattgctgatgatgatagtttattgttaattgcaaagtctccttcagaagcagatatgatacgccaagaaattttgctttggatgcagggtataacc

SEQ ID NO: 292 - protein, 167 aa, Streptococcus pyogenes
LLPRHIRSLRNMKKSERLELIKKMVLTHPIETQHDLLRLLAEHGLELTQATISRDMNEIGIVKIPSGSGRYIYGLSQDSGKKIVQGPRSIKSTILAVSDKTKGLEQHLYLKVVPGNSKLIKRYLLADFSKAIFSLIADDDSLLLIAKSPSEADMIRQEILLWMQGIT

SEQ ID NO: 293 - DNA, 123 bp, Streptococcus agalactiae
atggaagttttatcttccttacgtgaaaaagcagatttaatagctaacatcaatcgagataactctcctcctgaagccacttttaccaatggcttaaagccctctccgggattcgttgaaata

SEQ ID NO: 294 - protein, 41 aa, Streptococcus agalactiae
MEVLSSLREKADLIANINRDNSPPEATFTNGLKPSPGFVEI

SEQ ID NO: 295 - DNA, 1656 bp, Streptococcus agalactiae
atgcttttagaaatttctattaagaatttcgctattatcgaagaaatttcacttaattttgaaacaggaatgactgttttaactggtgagactggtgcagggaaatctatcattattgatgctatgaatatgatgttaggatcccgtgctagcgttgaagtgattcgccatggtgctaacaaagcagaaattgaaggatttttctctgttgaaaaaaatcaatcattagtccaattattggaagaaaatggcattgaattagcagatgaattaattattcgccgagaaatctttcaaaatgggcgcagcgttagtcgaattaatgggcaaatggtgaatttgtcaacactaaaagctgtggggcattatttggtagacatttatggtcagcatgaccaagaggaactaatgaaacctaacatgcacattctgatgttagatgaatttggtaatacagaatttaatgtcataaaagaacgttatcaaagtctttttgatgcttatcgtcagcttcgtaaacgcgtattggataagcaaaaaaatgaacaagagaataaatcacgtattgaaatgctagaatttcaaatagcagaaattgagtctgtagcccttaaatcagatgaagaccaaacgctactcaagcaacgtgataaattaatgaatcataagaatattgcagatactttgacaaatgcatatcttatgttagataacgaagagttttcaagtttatcgaatgttcgttctgcaatgaatgaccttatggctttagaagaatttgatcgagaatataaagatctttccaccaatctttcagaagcttactacgttattgaagaagttactaaacgtttaggtgacgttatcgatgatttagattttgacgctggtttactacaagaaattgaaaatagactagatgttattaacacaataacgcgaaaatatggcggtgatgtgaatgatgttttagactattttgataacattactaaagaatatagtctattgacaggtagtgaagagtcctcagatgctttagaaaaagaattaaagattttagaacacgatttgattgaatcagcaaatcaattaagtttagagcgccataagctagctaaacaattggaaaatgaaatcaaacaagaattaacagagctttatatggagaaagctgatttccaagttcaatttacaaaaggaaaatttaataaagaagggaacgaaatcgttgaattttatatttcaacgaatcccggagagggctttaagccattggtaaaagtggcttcaggaggagagttatctcgattgatgttagctattaaatctgctttttcacgtaaggaagataaaacttccattgtatttgatgaggtggatacaggagtttctggtcgcgtggcccaggctatcgctcaaaaaattcacaagattggtagtcatggacaagttttagcaatttctcatttagctcaggttattgcaatagcggattaccaatattttattgaaaaaatttccagtgactcttcaacagtttcaacggtaaggcttttaagctatgaagaacgtgtagaagaaatcgctaaaatgttggcaggaaacaatgtaacagacactgcacgtactcaagctaaagaattacttggtagt

SEQ ID NO: 296 - protein, 552 aa, Streptococcus agalactiae
MLLEISIKNFAIIEEISLNFETGMTVLTGETGAGKSIIIDAMNMMLGSRASVEVIRHGANKAEIEGFFSVEKNQSLVQLLEENGIELADELIIRREIFQNGRSVSRINGQMVNLSTLKAVGHYLVDIYGQHDQEELMKPNMHILMLDEFGNTEFNVIKERYQSLFDAYRQLRKRVLDKQKNEQENKSRIEMLEFQIAEIESVALKSDEDQTLLKQRDKLMNHKNIADTLTNAYLMLDNEEFSSLSNVRSAMNDLMALEEFDREYKDLSTNLSEAYYVIEEVTKRLGDVIDDLDFDAGLLQEIENRLDVINTITRKYGGDVNDVLDYFDNITKEYSLLTGSEESSDALEKELKILEHDLIESANQLSLERHKLAKQLENEIKQELTELYMEKADFQVQFTKGKFNKEGNEIVEFYISTNPGEGFKPLVKVASGGELSRLMLAIKSAFSRKEDKTSIVFDEVDTGVSGRVAQAIAQKIHKIGSHGQVLAISHLAQVIAIADYQYFIEKISSDSSTVSTVRLLSYEERVEEIAKMLAGNNVTDTARTQAKELLGS

SEQ ID NO: 297 - DNA, 1662 bp, Streptococcus pyogenes
gtgatgttattagaaatttctattaaaaattttgctattattgatgaaatttccctaaattttgaaaatggtatgacggttttgacgggtgaaactggagcaggaaagtctattatcattgatgctatgaatatgatgcttggtgcgcgtgctagtacagaagtgattcgtcgtggagctaataaagcagaaattgaggggttcttttcggtagatgctaccccagaactggttgcgtgtctggaatcatcaggtattgctatggaagaagaactgattattcgccgagatatctttgccaatggcagaagcgtgagccgcattaatggtcagatggttaacctagccaccttaaaacaggtcggacagtttttggtagatattcatgggcaacatgaccaagaagaattaatgcgaccacagctccaccagcaaattttggacgcttttggtgataaggcttttgagcaattgaaagagaattatcagcttatttttgatcgttataaaagcttgcgtcgccaggttattgacaaacaaaaaaatgaaaaggaacacaaagatcgtattgatatgttggcctttcagatagcagaaattgaagctgctgccttgagtcgaggtgaggacgaccggttaaatcaagaacgtgatcgcttaatgaaccacaaacaaattgctgataccctgaccaatgcctacgtcatgctagataatgacgatttttcaagtctatccaatattcgctctagcatgaatgacttactatcaattgagcagtttgattcagagtacaaagggatgtcgacttcgatttctgaagcctattatattcttgaagaagtgagcaagcaattatcagataccattgaccaactggattttgatggtgggcgattacaggaaattgaatttcgcttggatatactcaatagcttaactcgtaaatacggtggtaatgtgaatgatgtgcttgactactacgataatatcgtcaaagaataccagctattaacaggagatgacttgtcttcaggggatctagaggcagaattgaaaagcttggaaaaacaattggttgctgctgcttcggagttaagtgtctctcgccatcaattggcggagcaattagaagctgagattaaagctgaacttaaggaactttatatggaaaaagcagatttcaaagttcactttaccacatcaaaatttaatcgtgatggtaatgaaagcttggaattttacatctctactaatccaggcgaaggattcaagccccttgtcaaggtggcttctggaggagagttatcacgccttatgttagccatcaaggctgctatttctagaaaagaagataagacgagtattgtttttgatgaagtagatacaggtgtttctggtcgcgttgcgcaagccattgcccaaaaaatttataaaattgggcgacatgggcaagttctcgctatttcacacttacctcaagttattgctattgctgattatcagtattttatttctaaagaaagtaaagaagagtccaccgtttctaaggtaaggttattaactcctgaagaacgtgtggaagaaattgctagcatgattgcaggaacagatatgacacaagctgctcttacgcaggctcgtgaactacttgccaaacat

SEQ ID NO: 298 - protein, 554 aa, Streptococcus pyogenes
VMLLEISIKNFAIIDEISLNFENGMTVLTGETGAGKSIIIDAMNMMLGARASTEVIRRGANKAEIEGFFSVDATPELVACLESSGIAMEEELIIRRDIFANGRSVSRINGQMVNLATLKQVGQFLVDIHGQHDQEELMRPQLHQQILDAFGDKAFEQLKENYQLIFDRYKSLRRQVIDKQKNEKEHKDRIDMLAFQIAEIEAAALSRGEDDRLNQERDRLMNHKQIADTLTNAYVMLDNDDFSSLSNIRSSMNDLLSIEQFDSEYKGMSTSISEAYYILEEVSKQLSDTIDQLDFDGGRLQEIEFRLDILNSLTRKYGGNVNDVLDYYDNIVKEYQLLTGDDLSSGDLEAELKSLEKQLVAAASELSVSRHQLAEQLEAEIKAELKELYMEKADFKVHFTTSKFNRDGNESLEFYISTNPGEGFKPLVKVASGGELSRLMLAIKAAISRKEDKTSIVFDEVDTGVSGRVAQAIAQKIYKIGRHGQVLAISHLPQVIAIADYQYFISKESKEESTVSKVRLLTPEERVEEIASMIAGTDMTQAALTQARELLAKH

SEQ ID NO: 299 - DNA, 834 bp, Streptococcus agalactiae
atgagtaaaatcaaaattgtaacggattcttccattaccattgaaccagaacttattaaagagcttgacattacagttgttcccttgtcagttatgatagatggtaccttgtattcagacaatgacttaaaagcacaaggggaattcttgaacctaatgcgtggaagtaaggaattgccaaaaacaagtcaaccacctgtaggtgtttttgcagaaatttatgaaaaattaatgaatgaaggtgtggaacatatcattgcaattcatttaacgcatacactatcaggaactattgaagcatcacgccagggagctaatattgctggtgcagatgttacagttattgattctacttttacagaccagtgtcaaaaattccaggttgtagaagctgcgaaattagctaaagagggagctgatttagataccatcttggctcgtgtggaagaagtacgccagaagtcagaattatttattggcgtatcgacccttgaaaatttagtaaaaggtggtcgtattggacgtgtaacgggtcttctaagttcattgcttaatataaaagtaattatggagctaacaaaccatgaattagtaccgattgttaaaggtcgcggtctaaagaccttcagcaaatggttagataattttgttgaaagtgcccaaacacgaaaaattgctgaaattggcatctcctactgtggtaaagctgatatggctaataactttagagaaaaactagctgttctaggtgctcctatatccgttttagaaactggctcaatcatccaaactcatactggtgaggatgcatttgctgttatggttcgttatgaa

SEQ ID NO: 300 - protein, 278 aa, Streptococcus agalactiae
MSKIKIVTDSSITIEPELIKELDITVVPLSVMIDGTLYSDNDLKAQGEFLNLMRGSKELPKTSQPPVGVFAEIYEKLMNEGVEHIIAIHLTHTLSGTIEASRQGANIAGADVTVIDSTFTDQCQKFQVVEAAKLAKEGADLDTILARVEEVRQKSELFIGVSTLENLVKGGRIGRVTGLLSSLLNIKVIMELTNHELVPIVKGRGLKTFSKWLDNFVESAQTRKIAEIGISYCGKADMANNFREKLAVLGAPISVLETGSIIQTHTGEDAFAVMVRYE

SEQ ID NO: 301 - DNA, 849 bp, Streptococcus pyogenes
atggaaaaatacatgggaactataaaaattgttacagattcatcaataactattgaaccagaattaattaaagctttagatattactgtagtacctttatctgtcatgattgatagcaaattatattctgataatgatttaaaagaagaaggtcattttttgagccttatgaaggctagcaaatcccttcccaaaaccagtcagccaccggttggtctctttgctgaaacttacgaaaatttggtcaaaaaaggagtaactgacattgttgctattcacctctcaccagctttatcaggtactattgaagcttcccgtcagggggctgaaatcgctgaggcacctgttacagttttagattcaggatttactgatcaagccatgaaatttcaggtcgttgaggcagcaaagatggcaaaagcgggtgctagtttgaatgagattttggctgctgttcaagctatcaaatcaaaaacagagctctacattggtgtatctaccttagaaaatttagtaaaaggaggtcgtattggtcgtgtgacgggtgttttgagctcgctacttaatgtcaaagttgttatggcacttaaaaatgatgagttaaaaacgcttgtcaaaggtcgaggtaataaaacatttacgaaatggttagatagttacctcgctaaaaatagtcatcgcccgattgcagagatagctatttcttatgctggtgaagctagcctggcattaaccttaaaagaaagaatcgcagcttattacaaccactctatttcggttttagaaacaggctctatcatccaaacacatacaggagaaggagcttttgcggttatggttcgttatgaa

SEQ ID NO: 302 - protein, 283 aa, Streptococcus pyogenes
MEKYMGTIKIVTDSSITIEPELIKALDITVVPLSVMIDSKLYSDNDLKEEGHFLSLMKASKSLPKTSQPPVGLFAETYENLVKKGVTDIVAIHLSPALSGTIEASRQGAEIAEAPVTVLDSGFTDQAMKFQVVEAAKMAKAGASLNEILAAVQAIKSKTELYIGVSTLENLVKGGRIGRVTGVLSSLLNVKVVMALKNDELKTLVKGRGNKTFTKWLDSYLAKNSHRPIAEIAISYAGEASLALTLKERIAAYYNHSISVLETGSIIQTHTGEGAFAVMVRYE

SEQ ID NO: 303 - DNA, 867 bp, Streptococcus agalactiae
gtgaggatgcatttgctgttatggttcgttatgaataagaaaaaaatacttaccggactttctttttttctggtaagtcttcttttatcttttgggattttttccttgatcattccaaaatcaaatcctaaattaacaaaaaaagacttcctaacaaagaaagttatcccacttaactatgttgctcttggagattctctgaccgaaggtgtgggcgatacaacctctcaaggtggttttgttccactgctatcagaatcactccataatcgatactcttaccaagtgacttctgttaattatggtgtgtctgggaatactagtcaacaaattttaaaacgtatgacgacagatcctcaaatcgaaaaagatttagagaaagctgatttattgacgctaactgttggtggtaatgatgtcttggctgttattcgtaaagagctcagtcatttatcactaaattcctttgagaaaccagcagaagcatataaggaacgtttgaaagaaatccttgcaaaagcaagacaagataatcctaaattgcctatttatgttttaggcatttataatcctttttacctaaactttccacaattaactaaaatgcaaaccgttattgataattggaataaagctacaaaagaagtagttgatgcttcagaaaatgtttattttgtcccaattaatgaccgcctttataagggaataaatggtaaagagggtattacagagtcatcaaatagtcaggcaagtatcactaatgatgctctctttactggagaccattttcatcccaataatattggctatcaaatcatgtctaacgccgttatggagaaaataaatgaaacaagaaaaaactggccg

SEQ ID NO: 304 - protein, 289 aa, Streptococcus agalactiae
MRMHLLLWFVMNKKKILTGLSFFLVSLLLSFGIFSLIIPKSNPKLTKKDFLTKKVIPLNYVALGDSLTEGVGDTTSQGGFVPLLSESLHNRYSYQVTSVNYGVSGNTSQQILKRMTTDPQIEKDLEKADLLTLTVGGNDVLAVIRKELSHLSLNSFEKPAEAYKERLKEILAKARQDNPKLPIYVLGIYNPFYLNFPQLTKMQTVIDNWNKATKEVVDASENVYFVPINDRLYKGINGKEGITESSNSQASITNDALFTGDHFHPNNIGYQIMSNAVMEKINETRKNWP

SEQ ID NO: 305 - DNA, 858 bp, Streptococcus agalactiae
ttgcggttatggttcgttatgaataatcgtcatttatttagtgggatatttttctttgttattagtttatgtctggcctttttattgctaaatattattatccctaagtcaaattcacgtttgaaaaagagtgattttctgaaaaaagaacaagtagctatccaatatgttgctataggagattcattgacagaaggagtaggtgatctaactcatcaaggtggttttgttcctttgttaacgaatgatctcagtgaatattttaaggctaatgttaatcatcaaaattacggcgtatctggtgataccagtcaacaaattcttgataggatgataaaacaaaagcagatacagttatctttaaaaaaagcagatataatgacgttaaccgttggtggtaatgatgttatggcagttattcggaagaatttagcggatttgcaagtttctagttttagaaagccagctcgtcagtatcaaaaacgattaagacagattatcgagttagccagaaaagataataaagatcttcctatttttattttaggcatctataatccgttttatttgaattttccagaactaactgatatgcaaaaagtgattgatgactggaataccaaaactaaggaggttgttggagaatacgatcgtgtgtactttgtgccaataaatgacctcttgtataaagggataaatggacaagaaggaattgttcattcttcaggagatcaaactacaattgtcaatgatgccttgtttactggggaccattttcacccaaataatactggctatcaaatcatgtcaaatgcagtaatggagaaaattaaaaagcatgaaaaaaaaatcaaacct

SEQ ID NO: 306 - protein, 286 aa, Streptococcus agalactiae
LRLWFVMNNRHLFSGIFFFVISLCLAFLLLNIIIPKSNSRLKKSDFLKKEQVAIQYVAIGDSLTEGVGDLTHQGGFVPLLTNDLSEYFKANVNHQNYGVSGDTSQQILDRMIKQKQIQLSLKKADIMTLTVGGNDVMAVIRKNLADLQVSSFRKPARQYQKRLRQIIELARKDNKDLPIFILGIYNPFYLNFPELTDMQKVIDDWNTKTKEVVGEYDRVYFVPINDLLYKGINGQEGIVHSSGDQTTIVNDALFTGDHFHPNNTGYQIMSNAVMEKIKKHEKKIKP

SEQ ID NO: 307 - DNA, 600 bp, Streptococcus agalactiae
atgaaacaagaaaaaactggccgtaatttaaatttctggaaatgggcatttctcttattgttggcaattaacctttccttcacagcagtgattgcaagtcgcttaattcaagtacgtgagcctaatacaggaaaaatttcgactggggtacaagataaagtaaaagtaggtacttttacgaccaataagtcgcaactgaataagacaattgcactttatttaaaacaatatcaaactaagaagatgaattataagatttatgctgcttcatcttctatactatttgaaggctcttatcaattattaggttatgaagtgcctttatacatctattttgaaccttatcgtttaacaaatggcgctgttcaacttaaagtgacctcattttcagtaggaactcttccgcttccagaaaaagatgtgttacaatatataaaatcatcttataaattgccaaactttgtagatataaaacctaaaaaatcggttattaatattaatttgcaagatttaaaaaataaagaaggtatttatttgaaagcgactgcaattgatttagtaaacgataattttagtttcgatatttttaagaaaaagccc

SEQ ID NO: 308 - protein, 200 aa, Streptococcus agalactiae
MKQEKTGRNLNFWKWAFLLLLAINLSFTAVIASRLIQVREPNTGKISTGVQDKVKVGTFTTNKSQLNKTIALYLKQYQTKKMNYKIYAASSSILFEGSYQLLGYEVPLYIYFEPYRLTNGAVQLKVTSFSVGTLPLPEKDVLQYIKSSYKLPNFVDIKPKKSVININLQDLKNKEGIYLKATAIDLVNDNFSFDIFKKKP

SEQ ID NO: 309 - DNA, 585 bp, Streptococcus pyogenes
atgaaaaaaaaatcaaaccttaattggtggaagtggagcttcttatgtctgcttgcttttaataccgcctttttgatggttattgcaagtcgtctcattcaagtaagagaacctgagtcagaactgattgctaaaaaaccagttaaaaatatcaaaattggtacatttgttacaaccagagaacagcttaacgaaactgtagcaagttatcttaaagattatcagactgaaaaaatgtcttataaattttatgcgacatcttcttctattttgtttgaaggaacttatcaattattagggtatgaagtccctttatatatctattttcaacctcatcgtctagaaaatggagctgtccaactacaggtgatctctttttcagtgggaactctgccactcccagaaaaagatgttttgcagtatttgaaatcaagctacaaattgccaagctttgttaaagtgatgccaaatcaatcagctatcgttgttaatttacaagatatccaaaatgatgctaaggtttatttaaaagccaagaaaattgatttatttaatgatgaaatcagttttaacatctataagaaa

SEQ ID NO: 310 - protein, 195 aa, Streptococcus pyogenes
MKKKSNLNWWKWSFLCLLAFNTAFLMVIASRLIQVREPESELIAKKPVKNIKIGTFVTTREQLNETVASYLKDYQTEKMSYKFYATSSSILFEGTYQLLGYEVPLYIYFQPHRLENGAVQLQVISFSVGTLPLPEKDVLQYLKSSYKLPSFVKVMPNQSAIVVNLQDIQNDAKVYLKAKKIDLFNDEISFNIYKK

SEQ ID NO: 311 - DNA, 156 bp, Streptococcus agalactiae
  misc_feature (1)..(156): n = a, c, g, or t
atggctaacaaacaagatttaattgcaaaagtagcagaagctacagaattaactaaaaaagattcagcagcagcagtagatgcagtttttgcagctgtagcagattaccttgctgaaggtgaaaaagtacaattaatcggttnnnnnttaattaat

SEQ ID NO: 312 - protein, 52 aa, Streptococcus agalactiae
  MISC_FEATURE (1)..(52): Xaa = Any Amino Acid
MANKQDLIAKVAEATELTKKDSAAAVDAVFAAVADYLAEGEKVQLIGXXLIN

SEQ ID NO: 313 - DNA, 273 bp, Streptococcus pyogenes
atggctaacaaacaagatttaatcgcaaaggttgcagaagcaactgaattgactaaaaaagattcagcagcagcagttgatgccgtgttttctacaatcgaagctttccttgctgaaggtgaaaaagtacaattgatcggttttggtaacttcgaagtacgcgaacgtgcagctcgtaaaggtcgtaacccacaaactggtgcagaaattgaaattgcagcttcaaaagttccagccttcaaagctggtaaagctcttaaagacgctgttaaa

SEQ ID NO: 314 - protein, 91 aa, Streptococcus pyogenes
MANKQDLIAKVAEATELTKKDSAAAVDAVFSTIEAFLAEGEKVQLIGFGNFEVRERAARKGRNPQTGAEIEIAASKVPAFKAGKALKDAVK

SEQ ID NO: 315 - DNA, 1404 bp, Streptococcus agalactiae
ttggctactaaagtagatgtttcaaaagatggcttaacttatacagctacattacgtaaaggcttgaagtggtcagatggcagtaaacttactgcaaaggattttgtttattcatggcaacgtttagttgatcctaaaacagcttcacaatatgcttaccttgctgttgaagggcatgtgcttaatgccgataaaatcaacgaaggacaagagaaagacttgaataagctaggtgttaaggcggaaggcgatgacaaagttgttattactttatctagtccgtctccacaatttatctactaccttgcattcactaacttcatgccacaaaaacaagaagttgttgaaaaatatggaaaagattacgcaactacttcaaaaaatacagtttactcaggaccatatactgttgaaggttggaatggttcgaatggtactttcacgctgaagaaaaacaaaaattattgggacgctaaaaatgtaaaaacaaaagaagttcgcatccagactgttaaaaaaccagataccgccgttcaaatgtataaacgtggtgagttagatgcagctaatatctcaaatacttctgctatttatcaagctaataagaataataaagatgtcacagatgttctagaagcgaccactgcctatatggaatataatactactggttctgtgaaagggcttgataatgttaagattcgtcgcgccttaaacttagcaactaaccgtaaaggagttgttcaagcagccgttgatacaggctcaaaaccggcaattgcttttgcacctactggtttagccaaaacaccagatggaactgatttggcaaaatatgttgccccaggttatgaatataataaaactgaagcagcaaaactctttaaagaaggtttggctgaatcaggcttgactaagctaaaattaacaattacagcagatgctgatgctcctgctgccaaaaactctgttgactatatcaagtctacttgggaagctgctcttccaggacttactgttgaagaaaaatttgtaacctttaaacaacgcttagaagacagtagaaaacaaaactttgacatcgtagtttctctttggggtggggattatccagaaggatcaactttctacggcctctttaagtcagattcacaaaataacgatggaaaatttgctaacaaggactatgatgctgcttataacaaggcaatttctgaagatgcgatgaaaccagcagaatcagcgaaggactataaagaagcagagaaaattttatttgagcaaggtgcttataacccactctacttccgtagtggtaaaggtttacaaaatccaaaattaaaaggtgttattcgtaatactacaggtttgtcaatagactttacacatgcttataaaaataat

SEQ ID NO: 316 - protein, 468 aa, Streptococcus agalactiae
MATKVDVSKDGLTYTATLRKGLKWSDGSKLTAKDFVYSWQRLVDPKTASQYAYLAVEGHVLNADKINEGQEKDLNKLGVKAEGDDKVVITLSSPSPQFIYYLAFTNFMPQKQEVVEKYGKDYATTSKNTVYSGPYTVEGWNGSNGTFTLKKNKNYWDAKNVKTKEVRIQTVKKPDTAVQMYKRGELDAANISNTSAIYQANKNNKDVTDVLEATTAYMEYNTTGSVKGLDNVKIRRALNLATNRKGVVQAAVDTGSKPAIAFAPTGLAKTPDGTDLAKYVAPGYEYNKTEAAKLFKEGLAESGLTKLKLTITADADAPAAKNSVDYIKSTWEAALPGLTVEEKFVTFKQRLEDSRKQNFDIVVSLWGGDYPEGSTFYGLFKSDSQNNDGKFANKDYDAAYNKAISEDAMKPAESAKDYKEAEKILFEQGAYNPLYFRSGKGLQNPKLKGVIRNTTGLSIDFTHAYKNN

SEQ ID NO: 317 - DNA, 1977 bp, Streptococcus pyogenes
gtgacttttatgaagaaaagtaaatggttggcagctgtaagtgttgcgatcttgtcagtatccgctttggcagcttgtggtaataaaaatgcttcaggtggctcagaagctacaaaaacctacaagtacgtttttgttaacgatccaaaatcattggattatattttgactaatggcggtggaacgactgatgtgataacacaaatggttgatggtcttttggaaaacgatgagtatggtaatttagtaccatcacttgctaaagattggaaggtttcaaaagacggtctgacttatacttatactcttcgcgatggtgtctcttggtatacggctgatggtgaagaatatgccccagtaacagcagaagattttgtgactggtttgaagcacgcggttgacgataaatcagatgctctttacgttgttgaagattcaataaaaaacttaaaggcttaccaaaatggtgaagtagattttaaagaagttggtgtcaaagcccttgacgataaaactgttcagtatactttgaacaagcctgaaagctactggaattcaaaaacaacttatagtgtgcttttcccagttaatgcgaaatttttgaagtcaaaaggtaaagattttggtacaaccgatccatcatcaatccttgttaatggtgcttacttcttgagcgccttcacctcaaaatcatctatggaattccataaaaatgaaaactactgggatgctaagaatgttgggatagaatctgttaaattgacttactcagatggttcagacccaggttcgttctacaagaactttgacaagggtgagttcagcgttgcacgactttacccaaatgaccctacctacaaatcagctaagaaaaactatgctgataacattacttacggaatgttgactggagatatccgtcatttaacatggaatttgaaccgtacttctttcaaaaacactaagaaagaccctgcacaacaagatgccggtaagaaagctcttaacaacaaggattttcgtcaagctattcagtttgcttttgaccgagcgtcattccaagcacaaactgcaggtcaagatgccaaaacaaaagccttacgtaacatgcttgtcccaccaacatttgtgaccattggagaaagtgattttggttcagaagttgaaaaggaaatggcaaaacttggtgatgaatggaaagacgttaacttagctgatgctcaagatggtttctataatcctgaaaaagcaaaagctgagtttgcaaaagccaaagaagctttaacagctgaaggtgtaaccttcccagttcaattagattaccctgttgaccaagcaaacgcagcaactgttcaggaagcccagtctttcaaacaatctgttgaagcatctcttggtaaagagaatgtcattgtcaatgttcttgaaacagaaacatcaactcacgaagcccaaggcttctatgctgagaccccagaacaacaagactacgatatcatttcatcatggtggggaccagactatcaagatccacggacctaccttgacatcatgagtccagtaggtggtggatctgttatccaaaaacttggaatcaaagcaggtcaaaataaggatgttgtggcagctgcaggccttgatacctaccaaactcttcttgatgaagcagcagcaattacagacgacaacgatgcgcgctataaagcttacgcaaaagcacaagcctaccttacagataatgccgtagatattccagttgtggcattgggtggcactccacgagttactaaagccgttccatttagcgggggcttctcttgggcagggtctaaaggtcctctagcatataaaggaatgaaacttcaagacaaacctgtcacagtaaaacaatacgaaaaagcaaaagaaaaatggatgaaagcaaaggctaagtcaaatgcaaaatatgctgagaagttagctgatcacgttgaaaaa

SEQ ID NO: 318 - protein, 659 aa, Streptococcus agalactiae
VTFMKKSKWLAAVSVAILSVSALAACGNKNASGGSEATKTYKYVFVNDPKSLDYILTNGGGTTDVITQMVDGLLENDEYGNLVPSLAKDWKVSKDGLTYTYTLRDGVSWYTADGEEYAPVTAEDFVTGLKHAVDDKSDALYVVEDSIKNLKAYQNGEVDFKEVGVKALDDKTVQYTLNKPESYWNSKTTYSVLFPVNAKFLKSKGKDFGTTDPSSILVNGAYFLSAFTSKSSMEFHKNENYWDAKNVGIESVKLTYSDGSDPGSFYKNFDKGEFSVARLYPNDPTYKSAKKNYADNITYGMLTGDIRHLTWNLNRTSFKNTKKDPAQQDAGKKALNNKDFRQAIQFAFDRASFQAQTAGQDAKTKALRNMLVPPTFVTIGESDFGSEVEKEMAKLGDEWKDVNLADAQDGFYNPEKAKAEFAKAKEALTAEGVTFPVQLDYPVDQANAATVQEAQSFKQSVEASLGKENVIVNVLETETSTHEAQGFYAETPEQQDYDIISSWWGPDYQDPRTYLDIMSPVGGGSVIQKLGIKAGQNKDVVAAAGLDTYQTLLDEAAAITDDNDARYKAYAKAQAYLTDNAVDIPVVALGGTPRVTKAVPFSGGFSWAGSKGPLAYKGMKLQDKPVTVKQYEKAKEKWMKAKAKSNAKYAEKLADHVEK

SEQ ID NO: 319 - DNA, 948 bp, Streptococcus agalactiae
ttgctatttttagcaattctaagaaaaggaaatgatatgattaaatatattttaaagcgtgttgctattttgttagtaacgctatgggttgtcataaccctatcgttctttctgatgcagatccttccaggaacaccctacaataatccaaaactcactgaagaaatgatcgcattgcttaataaacagtatggtttagacaagcctgtatggcaacaatatttgacttacctttggaatgtacttcatggtgactttggaacgagttatcaatcagtgaatcagccagtatcacgtatgattagcttgagattaggagtttcagtacatctaggtgttcaggctctcgtatttggtgttttaggcggtattttggtaggagctatttcggcacgtcataagaatgataaagtcgatggtatcttaagtgttattgcaacgctagggatttctatgccttcatttatcattggtatcttattattagactattttggatttaagtggaacttgttgcctttatcaggttgggggactttctctcaaaccattttaccttctttagctctaggactccctacattagcatctgtttcacgcttcttccgtagtgaaatgattgaaactttaaattctgattatgtgcaactagctcgttcaaaaggtatgacaattcgtcaagtaactcgaaaacatgcttaccgtaattctatgattccaattttaactctaattggccctttggcggcgggtctgttaactggttctgcactaattgagcagattttctcgattccaggaattgggcagcagtttgttacttcgattccaacaaaagactatcctgttattatggggacaaccattgtttatgcagtaatgttgatggttgctatcttgataacagacgttgttattagtatcgtagacccacgtgttcgcttgcag

SEQ ID NO: 320 - protein, 316 aa, Streptococcus agalactiae
MLFLAILRKGNDMIKYILKRVAILLVTLWVVITLSFFLMQILPGTPYNNPKLTEEMIALLNKQYGLDKPVWQQYLTYLWNVLHGDFGTSYQSVNQPVSRMISLRLGVSVHLGVQALVFGVLGGILVGAISARHKNDKVDGILSVIATLGISMPSFIIGILLLDYFGFKWNLLPLSGWGTFSQTILPSLALGLPTLASVSRFFRSEMIETLNSDYVQLARSKGMTIRQVTRKHAYRNSMIPILTLIGPLAAGLLTGSALIEQIFSIPGIGQQFVTSIPTKDYPVIMGTTIVYAVMLMVAILITDVVISIVDPRVRLQ

SEQ ID NO: 321 - DNA, 1029 bp, Streptococcus agalactiae
atggcagataaaaacagaacatttaaacttgtaggtgcaggatcttctagcacacaagaaaaaattgaaaagcctgctctttcgtttatgcaagatgcgtggcgtcgcttgaaaaaaaacaaattagcagtagtttcactctatttattagctcttttacttactttttcgttagcctcaaatttatttgtaactcagaaggatgctaatgggtttgattcgaaaaaagtaactacatatcgcaacttaccacctaaattgagttcaaaccttcctttttggaatggtagcattaagtacgctggaaatacagaatctacagacgcttataagtctcaaaatgtccctgaaaaagttaagtatgctttaggtacagattctctagggagaagtgttgctaagcgcatcatcgtaggtattcggatttccttacttgtagctattgcagctacattcattgatttaattatcggtgttacatacggtcttgtttcaggttttgctggaggacgccttgatacattaatgcaacgtatcgtagaggtaatttcatcaattccaaacttagttatcgttacaatgttaggtttggtccttggtaacggtattacggctattattatctctattgcttttaccggatggacttctatgtctcgtcaggtaaggaatttaaccctatcatatcgagaaagagagtttgtgcttgctgcacgttcacttggggaaagtccaattaaaatagccttcaaacatattttacctaacatttctggtattatcattgtacaaattatgatgacaatcccaagtgctattatgtatgaagcggtactttcagcaatcaatttaggtgttaaaccaccgacagcttcattaggatcattgatttcagatgcacaagaaaatttacaatattatccatatcaagttatcttgccagctttagcattggtaatgatttcattggcatttattttgcttggtgatgggttgcgagatgcttttgatccaaaatctagcgatgaa

SEQ ID NO: 322 - protein, 343 aa, Streptococcus agalactiae
MADKNRTFKLVGAGSSSTQEKIEKPALSFMQDAWRRLKKNKLAVVSLYLLALLLTFSLASNLFVTQKDANGFDSKKVTTYRNLPPKLSSNLPFWNGSIKYAGNTESTDAYKSQNVPEKVKYALGTDSLGRSVAKRIIVGIRISLLVAIAATFIDLIIGVTYGLVSGFAGGRLDTLMQRIVEVISSIPNLVIVTMLGLVLGNGITAIIISIAFTGWTSMSRQVRNLTLSYREREFVLAARSLGESPIKIAFKHILPNISGIIIVQIMMTIPSAIMYEAVLSAINLGVKPPTASLGSLISDAQENLQYYPYQVILPALALVMISLAFILLGDGLRDAFDPKSSDE

SEQ ID NO: 323 - DNA, 924 bp, Streptococcus pyogenes
atggaatcgattgataaatctaaatttcgatttgttgagcgcgatagtgaagcctccgaagtgattgatacccctgcttattcttactggaaatcagtgtttcgtcagtttttttctaaaaaatctacagtctttatgctcgtaattttagtgacagtcttgatgatgagctttatttatccaatgtttgccaactacgactttaatgacgttagtaatatcaatgacttttcaaagcgttatatttggccaaatgcagagtactggtttggaaccgacaaaaatgggcaatctctgtttgatggtgtttggtatggggcacgtaattctattttaatctcagttatagcgacactaattaatatcaccattggggtagtgttaggagccatatggggagtttctaaagcatttgataaagttatgattgaaatttataacattatctcaaatatcccttctatgcttattatcattgttttgacctattcattaggtgcaggattttggaatttgattctagctttctgtatcactggatggattggtgtcgcctactccatccgtgttcaaatcttgcgttaccgtgatttagaatacaaccttgctagtcaaactttgggaacaccaatgtacaagattgctgttaagaacctcctgcctcaattggtttcagttatcatgactatgttgtcacaaatgctaccagtttatgtatcttctgaggccttcttatccttctttgggattggtttaccaaccaccactccaagtttaggacgttttattgctaattattcaagcaacttaacaacaaatgcctacctcttttggattcccttagtaacattgattttagtatcgttaccactatacattgtcggacaaaacttggctgatgccagtgacccacgttcacataga

SEQ ID NO: 324 - protein, 308 aa, Streptococcus pyogenes
MESIDKSKFRFVERDSEASEVIDTPAYSYWKSVFRQFFSKKSTVFMLVILVTVLMMSFIYPMFANYDFNDVSNINDFSKRYIWPNAEYWFGTDKNGQSLFDGVWYGARNSILISVIATLINITIGVVLGAIWGVSKAFDKVMIEIYNIISNIPSMLIIIVLTYSLGAGFWNLILAFCITGWIGVAYSIRVQILRYRDLEYNLASQTLGTPMYKIAVKNLLPQLVSVIMTMLSQMLPVYVSSEAFLSFFGIGLPTTTPSLGRFIANYSSNLTTNAYLFWIPLVTLILVSLPLYIVGQNLADASDPRSHR

SEQ ID NO: 325 - DNA, 1044 bp, Streptococcus agalactiae
atggaaaaagaaactattttaagtgttaataatcttcatgttgacttccacacatatgctggagaagtaaaagcaattcgtgatgtcaactttgaattaaaaaaaggtgagactcttgcaatcgttggtgaatctggttcaggaaaatctgtaactaccagaactttaattggtttaaatgctaaaaattcagagatatcagggaatgttcaatttaaggggcgtaaccttgttgaactatcagaagaagagtggactaaggtacgcgggaatgagatttctatgattttccaagaccctatgactagtttggatccaacgatgaaaattggcatgcaaatagcagaaccaatgatgattcatcaaaaaatttcaaaaaaggatgctttaaaattagctcttgagctaatgaaagatgtaggtatcccaaatgctgaagagcatattaatgattacccacatcagtggtctggaggaatgcgccaacgtgcggttatagcgattgctttagctgctgatcctgaaattcttattgctgatgaaccaacgactgctttagatgtaacaattcaagcacaaattttgaacttaatgaaaaaaattcaagcagaacgagactcctccattgttttcataactcatgacttaggggtcgttgcagggatggcagaccgtgtagcagttatgtatgcagggaaaattgttgaatttggaactgttgatgaagtcttttataatccacaacatccatatacttggggattattgaattcaatgccgacaaccgacacagaatcaggtagtttagagtcaattccgggaacaccaccagatttgttgaacccacctaaaggagatgcatttgcagctcgtaatgaatttgcattagatattgatcatgaagaagaaccaccgtacttcaaagtttcagaaacacatttcgctgctacatggcttttagatgaaagatcacctaaggtgcttcctccattaccgatccaaaaacgttgggaaaaatggaacgagattgaagggaggaaagcc

SEQ ID NO: 326 - protein, 348 aa, Streptococcus agalactiae
MEKETILSVNNLHVDFHTYAGEVKAIRDVNFELKKGETLAIVGESGSGKSVTTRTLIGLNAKNSEISGNVQFKGRNLVELSEEEWTKVRGNEISMIFQDPMTSLDPTMKIGMQIAEPMMIHQKISKKDALKLALELMKDVGIPNAEEHINDYPHQWSGGMRQRAVIAIALAADPEILIADEPTTALDVTIQAQILNLMKKIQAERDSSIVFITHDLGVVAGMADRVAVMYAGKIVEFGTVDEVFYNPQHPYTWGLLNSMPTTDTESGSLESIPGTPPDLLNPPKGDAFAARNEFALDIDHEEEPPYFKVSETHFAATWLLDERSPKVLPPLPIQKRWEKWNEIEGRKA

SEQ ID NO: 327 - DNA, 930 bp, Streptococcus agalactiae
atgactgaaaatcgaaaaaaattagttgaagtcaaaaatgtttctttgaccttcaataaaggaaaagctaatgaagtgagagcaattgataatgttagttttgacatttatgaaggtgaagtgtttggattagttggggaatctggatcaggaaagacaaccgttggacgttcaattttaaaactttatgatatttctgatggagaaattacctttaatggagaagtgatctcacatctgaaaggtaaagcattacatagttttcgtaaagacgctcagatgatttttcaggatcctcaggctagcttaaacggccgtatgaagattcgtgatatcgtagcagaaggtttagatatacataaattagctaaatcaaaatcagatcgtgatagtaaagttcaggccctattagatcttgtagggttaaataaagatcatttaacacgttatccgcatgaattttcaggtggacaacgacaacgtatcgggattgcacgtgctttagcagtagagcctaaatttatcattgctgatgaaccaatatctgccttagatgtttcaatccaagcacaagttgttaatttaatgcaaaaattgcaaagagaacaaggattgacttatttgtttatcgcacatgatttgtctatggtaaaatacatttcagatcgtatcggtgttatgcattgggggaaactgttagaagttggaacatctgatgatgtttataacaatccaatccacccttatacgaagagtctattatcagctattccagaaccagatccggagagtgaacgtcaacgtgttcaccagccgtataatccagctattgagcaagacggacaagaacgtcaaatgcacgagattacccctggtcattttgttttatctacaccccaagaagctgaagaatataaaaaacaaatatta

SEQ ID NO: 328 - protein, 310 aa, Streptococcus agalactiae
MTENRKKLVEVKNVSLTFNKGKANEVRAIDNVSFDIYEGEVFGLVGESGSGKTTVGRSILKLYDISDGEITFNGEVISHLKGKALHSFRKDAQMIFQDPQASLNGRMKIRDIVAEGLDIHKLAKSKSDRDSKVQALLDLVGLNKDHLTRYPHEFSGGQRQRIGIARALAVEPKFIIADEPISALDVSIQAQVVNLMQKLQREQGLTYLFIAHDLSMVKYISDRIGVMHWGKLLEVGTSDDVYNNPIHPYTKSLLSAIPEPDPESERQRVHQPYNPAIEQDGQERQMHEITPGHFVLSTPQEAEEYKKQIL

SEQ ID NO: 329 - DNA, 921 bp, Streptococcus pyogenes
atgtctgagaaattagtcgaagtaaaagacctagaaatttccttcggagaaggaaagaaaaaatttgttgcagttaaaaatgctaatttctttattaaaaaaggagaaaccttttctttagttggagaatctgggagtggtaaaacaacaattggtcgtgctattattggtttgaacgatactagttcaggtcaaattttatacgatgggaaagtaattaatggcagaaaatcaaaatcagaagccaatgagctcattcgtaaaattcaaatgattttccaagatcccgctgctagtttgaatgaacgggcaaccgttgactacatcatttcagaaggtctttataactttaatctgtttaaaacagaggaagaacgtaaagaaaaaattaagaacatgatggccgaagttggtttgctatcagagcatttgacgcgctaccctcatgaattttcaggaggtcaacgtcagcggatcggtatcgctagagccctagtaatgaaccctgaattcgttattgctgatgaaccgatttcagctttggacgtttccgttcgcgcacaggtcttgaatcttcttaaaagaatgcaagccgaaaaaggtttgacttatctcttcattgcccatgatctttcagtcgttcgctttatttcagatcgtattgcggttatccataaaggggttattgtagaagttgcagaaacagaagaactgtttaataacccaattcatccctacacccaatctttgttatcagccgtgcctatcccagatccaattttagagcgtcaaaaagaacttgttgtctatcatccagaccaacatgattatacattagataagccatcaatggttgaaatcaaaccaaatcactttgtttgggcaaaccaagcagaaattgaaaaatatcaaaaagaattg

SEQ ID NO: 330 - protein, 307 aa, Streptococcus pyogenes
MSEKLVEVKDLEISFGEGKKKFVAVKNANFFIKKGETFSLVGESGSGKTTIGRAIIGLNDTSSGQILYDGKVINGRKSKSEANELIRKIQMIFQDPAASLNERATVDYIISEGLYNFNLFKTEEERKEKIKNMMAEVGLLSEHLTRYPHEFSGGQRQRIGIARALVMNPEFVIADEPISALDVSVRAQVLNLLKRMQAEKGLTYLFIAHDLSVVRFISDRIAVIHKGVIVEVAETEELFNNPIHPYTQSLLSAVPIPDPILERQKELVVYHPDQHDYTLDKPSMVEIKPNHFVWANQAEIEKYQKEL

SEQ ID NO: 331 - DNA, 102 bp, Streptococcus agalactiae
atgacaaaaaacaataaatctgtcagcgagacagaaaagagcaaagctcaaacttttaatgagagtttgatcctggctcaggacgaacgctggcggcgtgcc

SEQ ID NO: 332 - protein, 34 aa, Streptococcus agalactiae
MTKNNKSVSETEKSKAQTFNESLILAQDERWRRA

SEQ ID NO: 333 - DNA, 141 bp, Streptococcus agalactiae
gtgacggtaactaaccagaaagggacggctaactacgtgccagcagccgcggtaatacgtaggtcccgagcgttgtccggatttattgggcgtaaagcgagcgcaggcggttctttaagtctgaagttaaaggcagtggct

SEQ ID NO: 334 - protein, 47 aa, Streptococcus agalactiae
MTVTNQKGTANYVPAAAVIRRSRALSGFIGRKASAGGSLSLKLKAVA

SEQ ID NO: 335 - DNA, 120 bp, Streptococcus agalactiae
ttgtacgctttggaaactggaggacttgagtgcagaaggggagagtggaattccatgtgtagcggtgaaatgcgtagatatatggaggaacaccggtggcgaaagcggctctctggtctg

SEQ ID NO: 336 - protein, 40 aa, Streptococcus agalactiae
MYALETGGLECRRGEWNSMCSGEMRRYMEEHRWRKRLSGL

SEQ ID NO: 337 - DNA, 105 bp, Streptococcus agalactiae
gtggcgaaagcggctctctggtctgtaactgacgctgaggctcgaaagcgtggggagcaaacaggattagataccctggtagtccacgccgtaaacgatgagtgc

SEQ ID NO: 338 - protein, 35 aa, Streptococcus agalactiae
MAKAALWSVTDAEARKRGEQTGLDTLVVHAVNDEC

SEQ ID NO: 339 - DNA, 99 bp, Streptococcus agalactiae
gtgctaggtgttaggccctttccggggcttagtgccgcagctaacgcattaagcactccgcctggggagtacgaccgcaaggttgaaactcaaaggaat

SEQ ID NO: 340 - protein, 33 aa, Streptococcus agalactiae
MLGVRPFPGLSAAANALSTPPGEYDRKVETQRN

SEQ ID NO: 341 - DNA, 99 bp, Streptococcus agalactiae
ttgaaactcaaaggaattgacgggggcccgcacaagcggtggagcatgtggtttaattcgaagcaacgcgaagaaccttaccaggtcttgacatccttc

SEQ ID NO: 342 - protein, 33 aa, Streptococcus agalactiae
MKLKGIDGGPHKRWSMWFNSKQREEPYQVLTSF

SEQ ID NO: 343 - DNA, 159 bp, Streptococcus agalactiae
ttgttagttgccatcattaagttgggcactctagcgagactgccggtaataaaccggaggaaggtggggatgacgtcaaatcatcatgccccttatgacctgggctacacacgtgctacaatggttggtacaacgagtcgcaagccggtgacggcaagc

SEQ ID NO: 344 - protein, 53 aa, Streptococcus agalactiae
MLVAIIKLGTLARLPVINRRKVGMTSNHHAPYDLGYTRATMVGTTSRKPVTAS

SEQ ID NO: 345 - DNA, 171 bp, Streptococcus agalactiae
ttgtttagttttgagaggtcttgtggggccttagctcagctgggagagcgcctgctttgcacgcaggaggtcagcggttcgatcccgctaggctccattgaatcgaaaggttcaaattgttcattgaaaattgaatatctatatcaaattccacgatctagaaatagattg

SEQ ID NO: 346 - protein, 57 aa, Streptococcus agalactiae
MFSFERSCGALAQLGERLLCTQEVSGSIPLGSIESKGSNCSLKIEYLYQIPRSRNRL

SEQ ID NO: 347 - DNA, 849 bp, Streptococcus agalactiae
atgaaaatttttgagaaagctcctgccaaacttaatttaggattagatattaaaggacgatgtgacgatggttatcatgaattagctatgattatggttagtattgatcttaatgactacgttaccatttctgagctaaaggaagattgtattgttatcgattctgatagtagcaaaatgcctttaaataatgataatgatgtgtttaaagctgcagatataatcaaaaatcaatatggtattaataaaggtgttcatattagattagaaaaatccattcctgtctgtgcaggactggggggtggttctactgatgctgctgctacaataagagctcttaatcgattatggaatcttcaaatggactatgacgaaatggttgctattggttttaaaattggtagtgatgttccttattgtcttggtgggggatgttcgttagtattaggtaaaggtgaaattgttaaacccttaccgacattgagaccatgttggatagttctggttaagccggattttggtatttcaactaaatccatttttagagatattgattgtaagtctataagtagagttgatattgatttattaaagtctgctattttgtcatcagattatcagttaatggtcaaatctatgggaaattcactcgaggatattacaattactaaaaatccagttataagtacaataaaagaacgtatgttaaattctggagccgatgttgcattaatgacaggaagtggaccaactgttttttcaatgtgttctacagagaaaaaagctgatcgtgtttttaatagtatgaaaggtttttgcaaagaagtttataaagttaggttgttgaga

SEQ ID NO: 348 - protein, 283 aa, Streptococcus agalactiae
MKIFEKAPAKLNLGLDIKGRCDDGYHELAMIMVSIDLNDYVTISELKEDCIVIDSDSSKMPLNNDNDVFKAADIIKNQYGINKGVHIRLEKSIPVCAGLGGGSTDAAATIRALNRLWNLQMDYDEMVAIGFKIGSDVPYCLGGGCSLVLGKGEIVKPLPTLRPCWIVLVKPDFGISTKSIFRDIDCKSISRVDIDLLKSAILSSDYQLMVKSMGNSLEDITITKNPVISTIKERMLNSGADVALMTGSGPTVFSMCSTEKKADRVFNSMKGFCKEVYKVRLLR

SEQ ID NO: 349 - DNA, 156 bp, Streptococcus pyogenes
atgatggatattggtataccgattggtagtgatgtgccttattgcttgctttcaggttgtgcccaagtcactggtaaaggtgaagtggtttgtcgcattttggggctgttatcgtcttgggtggttttggttaaaccagattttggtatctcgact

SEQ ID NO: 350 - protein, 52 aa, Streptococcus pyogenes
MMDIGIPIGSDVPYCLLSGCAQVTGKGEVVCRILGLLSSWVVLVKPDFGIST

SEQ ID NO: 351 - DNA, 441 bp, Streptococcus agalactiae
atgacagttttagaacaaaaattagaccatttagtgagtcaaatcttgcttaaagcagaaaatcaacatgaattattgtttggtacttgtcaaagtgatgttaaattgactaatacgcaagaacacattctgatgcttttatcacaagagcagttgacaaattctgatttagctaagaagttaaatattagtcaggcagctgtaactaaagcagtaaaaagtttaatttctcaggatatgttgaaagcgaataaagattctaaagatgctcgtattacttattttgagttatctgaacttgctaaacccattgcagatgaacacacacatcatcatgacaatacgttaggggtttacggaagattagtaaatcatttttcaaaggacgaaaaggtcgttttagaacgttttcttgatcttttctctagagaattagaaggg

SEQ ID NO: 352 - protein, 147 aa, Streptococcus agalactiae
MTVLEQKLDHLVSQILLKAENQHELLFGTCQSDVKLTNTQEHILMLLSQEQLTNSDLAKKLNISQAAVTKAVKSLISQDMLKANKDSKDARITYFELSELAKPIADEHTHHHDNTLGVYGRLVNHFSKDEKVVLERFLDLFSRELEG

SEQ ID NO: 353 - DNA, 441 bp, Streptococcus pyogenes
atggggattttagaaaaaaaacttgataacttagtaaatactattttattaaaagcagaaaatcagcatgagttattatttggagcttgtcaaagtgacgttaagcttactaatacgcaagaacatattttaatgttactatctcagcaacgtctcactaatacagatttggctaaggcattaaatattagtcaggcggcagtaactaaggctatcaagagtttggtcaaacaagacatgttagcaggaactaaggatacggttgatgctagggtgacttattttgaattaaccgagttagctaagcctattgcgtcagaacatacccatcatcatgatgaaaccttaaatgtttacaaccgtttattacaaaaattctccgcgaaagaattagagattgtagataagtttgtaacagtttttgctgaggaattagaaggg

SEQ ID NO: 354 - protein, 147 aa, Streptococcus pyogenes
MGILEKKLDNLVNTILLKAENQHELLFGACQSDVKLTNTQEHILMLLSQQRLTNTDLAKALNISQAAVTKAIKSLVKQDMLAGTKDTVDARVTYFELTELAKPIASEHTHHHDETLNVYNRLLQKFSAKELEIVDKFVTVFAEELEG

SEQ ID NO: 355 - DNA, 708 bp, Streptococcus agalactiae
atgcgatatattacagttagtggtcttacttttcagtacgatagcgatcctgtgctggaaggggttaattaccatttagacagtggggagtttgttaccttaacaggtgaaaatggggctgctaaatcaactttaataaaggctactttaggtattttaacgcccaaagtgggtacagttaatatctctaaagaaaacaaagaaggaaaaaaattacgtattgcctatttacctcaacagattgcaagttttaacgctggctttccatcgtcagtttatgaatttgtgaaatctggacgataccctagaaatggttggtttagaagactgactaaacatgatgaagaacatattagggttagtttagaagctgttggtatgtgggataatcgccataaaaagataggaagtttatctggcggtcaaaagcagagggctgtcattgctaggatgtttgcttctgatccagatatttttgtattggatgagccaacaactggtatggacgcagggactactgagaaattttatgagttaatgcatcataatgctcataagcatggtaagtctgttttgatgattactcacgatcctgatgaagtaaaggggtatgctgaccgaaatattcatcttgttaggaaccaatctttaccatggcgttgtttcaatgtccatacaaacgaaatggaggttgaatcagatgctact

SEQ ID NO: 356 - protein, 236 aa, Streptococcus agalactiae
MRYITVSGLTFQYDSDPVLEGVNYHLDSGEFVTLTGENGAAKSTLIKATLGILTPKVGTVNISKENKEGKKLRIAYLPQQIASFNAGFPSSVYEFVKSGRYPRNGWFRRLTKHDEEHIRVSLEAVGMWDNRHKKIGSLSGGQKQRAVIARMFASDPDIFVLDEPTTGMDAGTTEKFYELMHHNAHKHGKSVLMITHDPDEVKGYADRNIHLVRNQSLPWRCFNVHTNEMEVESDAT

SEQ ID NO: 357 - DNA, 717 bp, Streptococcus pyogenes
atgagatacatatcagtgaaaaatctctcctttcaatatgaaagtgagccagttttagaagggatcacttatcatttagatagtggagaatttgtcaccatgaccggtgaaaatggtgctgcaaagtcaaccttaataaaagcaaccttaggaattttacaaccaaaggctggacgagttactattgctaaaaaaaataaagacggtaaacaattaagaattgcttacttgccgcagcaagtagctagctttaacgctggttttccatccaccgtttacgagtttgtcaaatcaggtcgctacccacgtagtggttggtttagacatttgaacaaacacgatgaagagcatgtgcaagcaagcttagaagcagtcggcatgtgggaaaaccgtcataagagaattggtagtttatcaggtggtcaaaaacaacgtgtggttattgcccgtatgtttgcttctgaccctgatatttttgtgctagacgagccaacaacgggaatggatagcggtactactgataccttttatgaactgatgcaccacagtgcacatcaacatgggaaatccgttctgatgattacccatgacccagaagaagtgaaggcttatgctgatcggaacattcatttagtcagaaaccaaaaacttccttggcgttgtttcaacattcatgaagctgaaacagatgacgaaaaaggaggtcatggtcatgct

SEQ ID NO: 358 - protein, 239 aa, Streptococcus pyogenes
MRYISVKNLSFQYESEPVLEGITYHLDSGEFVTMTGENGAAKSTLIKATLGILQPKAGRVTIAKKNKDGKQLRIAYLPQQVASFNAGFPSTVYEFVKSGRYPRSGWFRHLNKHDEEHVQASLEAVGMWENRHKRIGSLSGGQKQRVVIARMFASDPDIFVLDEPTTGMDSGTTDTFYELMHHSAHQHGKSVLMITHDPEEVKAYADRNIHLVRNQKLPWRCFNIHEAETDDEKGGHGHA

SEQ ID NO: 359 - DNA, 117 bp, Streptococcus agalactiae
ttgtatacagtacgcaaatactctaatacaactgccgccaaagtaacaacgaaaatagttgaccatgtaggcgagatacctaaaacaacgcctaatgcaacaccggctaaggaaacg

SEQ ID NO: 360 - protein, 39 aa, Streptococcus agalactiae
MYTVRKYSNTTAAKVTTKIVDHVGEIPKTTPNATPAKET

SEQ ID NO: 361 - DNA, 843 bp, Streptococcus agalactiae
atgtccatacaaacgaaatggaggttgaatcagatgctacttgatatgctttcctatgattttatgcaacgagcgctcttagcagttgtggctattagtatttttgctccaattttaggcatcttcctaattttacgtcgtcagagtttgatgagtgatactttgagtcacgtttccttagccggtgttgcattaggcgttgttttaggtatctcgcctacatggtcaactattttcgttgttactttggcggcagttgtattagagtatttgcgtactgtatacaaacattatatggaaatatcaactgctatcctgatgtcgatggggttggctatatctttaatcgttatgagtaaagctcataatgttggtaatgtcagtcttgaacagtatttatttggttctattattactattgggaaggaacaagtgattgctttgtttgttattgcattaatcacttttattttaaccatcctatttattagaccaatgtatatattaacgtttgatgaggatacagcttttgtagatggattgcctgtgcgtacaatgtctattttgttcaatgttgttacaggtattgctattgcattaacaattcctgccgcaggtgctctattggtgtcaactattatggttttaccagctagtattgctatgcggttaggtcgaaattttaaaactgttatttttctgggtatgttaattggatttgtgggaatggtagctggtattttcctttcgtattattgggagacacctgctagtgcaacaataacgatgatttttattggcattttcctattagttagcttagtaggcttgcttcgcaaacgt

SEQ ID NO: 362 - protein, 281 aa, Streptococcus agalactiae
MSIQTKWRLNQMLLDMLSYDFMQRALLAVVAISIFAPILGIFLILRRQSLMSDTLSHVSLAGVALGVVLGISPTWSTIFVVTLAAVVLEYLRTVYKHYMEISTAILMSMGLAISLIVMSKAHNVGNVSLEQYLFGSIITIGKEQVIALFVIALITFILTILFIRPMYILTFDEDTAFVDGLPVRTMSILFNVVTGIAIALTIPAAGALLVSTIMVLPASIAMRLGRNFKTVIFLGMLIGFVGMVAGIFLSYYWETPASATITMIFIGIFLLVSLVGLLRKR

SEQ ID NO: 363 - DNA, 819 bp, Streptococcus pyogenes
atggtcatgcttgatattttattctatgatttcatgcaacgggcggtaatggcggtagttgccattagtatttttgctccgattttaggtattttccttattttacgtcgtcaaagtttgatgagcgatacccttagtcatgtttctttggctggggtagcgcttggggtagtccttggtatttcaccaaccatcactactattattgttgtggttttagctgctattttgttagaatacctgcgtgtagtttacaaacactacatggagatttcaacggcgattttgatgtcacttggcttggccctatctctgattattatgagtaagtcgcatagttcatcaagcatgagtttagaacaatacctttttggatcgatcatcacgattagtatggaacaagttgtcgccttgtttgctattgctgcgattattttaatcttgaccgttctcttcattagaccgatgtacattctgacctttgatgaagatactgcttttgtagatggtttgcccgttcgcttgatgtctgttctattcaatatcgtcactggggttgctattgctttgaccattccagcagcaggagcacttttggtttctaccattatggtcttgccagcaagtatcgcaatgagattgggtaaaaactttaaaacagttatcttactgggaattgtcatcggttttagcggtatgttatctggtattttcttatcttatttctttgaaacgccagctagtgccactattaccatgattttcattagtattttcctcttagttagtctaggtggaatgcttaaaaaacggttattt

SEQ ID NO: 364 - protein, 273 aa, Streptococcus pyogenes
MVMLDILFYDFMQRAVMAVVAISIFAPILGIFLILRRQSLMSDTLSHVSLAGVALGVVLGISPTITTIIVVVLAAILLEYLRVVYKHYMEISTAILMSLGLALSLIIMSKSHSSSSMSLEQYLFGSIITISMEQVVALFAIAAIILILTVLFIRPMYILTFDEDTAFVDGLPVRLMSVLFNIVTGVAIALTIPAAGALLVSTIMVLPASIAMRLGKNFKTVILLGIVIGFSGMLSGIFLSYFFETPASATITMIFISIFLLVSLGGMLKKRLF

SEQ ID NO: 365 - DNA, 501 bp, Streptococcus agalactiae
gtgactccaatatacgaaggaaataatttagtacctagccgagttgaacttcagtatgttggaattgataaacaaggaaaacttctagaaatcaaattaggcggcggcaaagaacaagttgatgaatacggcgtcacaactgttacattagaaaatacgtctccactcgcaaaaattgattacaaaactggtatgctaatcaaagaagatgggaaacaggcagaagaaggtgaagatccaaatagcgatgctgatgaaaacgaagcagctattgaaagtgcatctgatatagaagaaaatactaacactaatacttctgaatcagatacaaataatgtagctccccaaaatagaatcgtctacgttgcaaataagggtcgttcaaatacttattggtatagtttagaaaacataaaaaatgcaaataccgctaatatcgttcaaatgactgaacaagaagcgttaaatcaacacaaacatcacagcactactgaagcacaa

SEQ ID NO: 366 - protein, 167 aa, Streptococcus agalactiae
MTPIYEGNNLVPSRVELQYVGIDKQGKLLEIKLGGGKEQVDEYGVTTVTLENTSPLAKIDYKTGMLIKEDGKQAEEGEDPNSDADENEAAIESASDIEENTNTNTSESDTNNVAPQNRIVYVANKGRSNTYWYSLENIKNANTANIVQMTEQEALNQHKHHSTTEAQ

SEQ ID NO: 367 - DNA, 804 bp, Streptococcus pyogenes
atggatatgtctaaatcaaatcgtcgtacttggcaaggtttagttgttattttaatagctattctcaccacttttaccacaagtactgttacggcagccagaaaaattagaaatttccctgataccacggaaattttgttaggaacgaaggcgactgagacaccaggaatcttaccattcactggtagctaccaattagttttgggcgatcttgacaatctgcaaaggccaaccttcgcacacatccagctaaaagatcaagatgagcctaatattaaacgaaaaggacttaaattcaatcctcctggctggcataattacaaattgactgacgctaatggaaaaacaacttggttaatggaccgtggccatttagttggttaccaatttagcggcttaaatgacgagcctaaaaacctagttacaatgacaaaatatcttaatactggctttagtgacaaaaatcctttaggaatgctctattatgaaaatagattagatagctggttagctctacaccctaacttctggctagactataaagttactcctgtttatcataaaaatgagttagttcctcgccaagtagttctacagtatgttggaattgatgaaaatggagatctacttcaaattaagttaggtagtgaaaaagaaagtgtagacaactttggagtaacatcagttacattagataacgtatctcctttagctgaattggattaccaaacaggaatgatgctagattcaactcaaaacgaagaagatagtaatttagaaaccgaagagtttgaagaagcggct

SEQ ID NO: 368 - protein, 268 aa, Streptococcus pyogenes
MDMSKSNRRTWQGLVVILIAILTTFTTSTVTAARKIRNFPDTTEILLGTKATETPGILPFTGSYQLVLGDLDNLQRPTFAHIQLKDQDEPNIKRKGLKFNPPGWHNYKLTDANGKTTWLMDRGHLVGYQFSGLNDEPKNLVTMTKYLNTGFSDKNPLGMLYYENRLDSWLALHPNFWLDYKVTPVYHKNELVPRQVVLQYVGIDENGDLLQIKLGSEKESVDNFGVTSVTLDNVSPLAELDYQTGMMLDSTQNEEDSNLETEEFEEAA

SEQ ID NO: 369 - DNA, 1257 bp, Streptococcus agalactiae
atgaatatttttgatgaactcaaagaacgtggactcgtttttcagacaactgacgaagatgctttacgcaaagctcttgaagaaggttctgtctcttactatactggctacgatcctacggctgacagccttcatcttggacatttagttgctattttaacctctcgtcgcttacaacttgctggtcacaagccttatgcacttgtgggaggcgcaactggacttattggggacccttcatttaaagatgttgagcgcagtttacaaacaaagaaaactgtagttagttggggtaataaaatccgcggtcaattatctaattttctagagtttgaaacaggtgataacaaagctgtattggtaaataattatgattggttcagcaatattagtttcattgatttcttacgagatgttggtaaatattttactgtcaattatatgatgagtaaagaatctgttaaaaaacgtatcgaaacagggatttcctatactgaatttgcttatcaaattatgcaaggatatgacttttacgaattaaataagaactataatgtcactttgcaaattggtggttctgaccaatggggcaacatgactgctggaaccgaacttattagacgaaaatcaaatggtgtatctcatgttatgactgttccattgataacagattctacaggaaaaaaattcggaaaatctgaaggaaatgctgtttggcttgatgctgacaaaacctctccttatgaaatgtaccaattttggctcaatgttatggatgctgatgccgttcgcttccttaagatttttacattcctaagccttaaagaaatagaagatatacgtattcaattcgaggaagcacctcaccaacgcttagcacaaaaaacactagcacgtgaagttgtaactcttgttcatggtgaaaaagcttataaggaggccgttaatatcacggaacagctatttgctggcaatataaaaggattgtctgttaaagagctcaaacaaggtttacgtggagtaccaaattatcacgttcagacggaagataacctcaatatcatagaccttctagtcacttcaggagttgtcaattctaaacgtcaagctcgagaagatgtctccaatggagctatttatattaatggagatcgtattcaagatttagaatatactatctcagaaaatgataagcttgaaaatgaaattacagtcattcgtcgtggaaagaaaaaatactttgtattaaactttaaa

SEQ ID NO: 370 - protein, 419 aa, Streptococcus agalactiae
MNIFDELKERGLVFQTTDEDALRKALEEGSVSYYTGYDPTADSLHLGHLVAILTSRRLQLAGHKPYALVGGATGLIGDPSFKDVERSLQTKKTVVSWGNKIRGQLSNFLEFETGDNKAVLVNNYDWFSNISFIDFLRDVGKYFTVNYMMSKESVKKRIETGISYTEFAYQIMQGYDFYELNKNYNVTLQIGGSDQWGNMTAGTELIRRKSNGVSHVMTVPLITDSTGKKFGKSEGNAVWLDADKTSPYEMYQFWLNVMDADAVRFLKIFTFLSLKEIEDIRIQFEEAPHQRLAQKTLAREVVTLVHGEKAYKEAVNITEQLFAGNIKGLSVKELKQGLRGVPNYHVQTEDNLNIIDLLVTSGVVNSKRQAREDVSNGAIYINGDRIQDLEYTISENDKLENEITVIRRGKKKYFVLNFK

SEQ ID NO: 371 - DNA, 1254 bp, Streptococcus pyogenes
atgaatatttttgaagaactcaaagctcgtggcttggtctttcaaacgactgatgaacaagcccttgtcaaagcattaacagaagggcaagtatcctattataccggttatgatccaaccgctgacagccttcatctgggccatctagtggctatcttaacatctcgtcgcttgcaactagcagggcacaaaccttacgctcttgtggggggtgccacaggtttaattggtgatccttcctttaaagatgcagagcgcagccttcaaaccaaagaaacagttttggagtggagtgacaagattaaagggcagttgtctactttccttgattttgaaaatggtgataataaagcagagcttgtcaacaactacgactggttctcgcaaatcagctttattgacttcctccgtgatgtcggtaaatacttcaccgttaactacatgatgagtaaagactctgttaaaaaacgcattgaaacaggcatttcttacactgagtttgcttaccaaatcatgcagggctacgacttctacgaactcaatgacaagcataatgtaaccttacaaattggcggctctgaccagtggggtaatatgacagctggtactgaattgctccgcaaaaaggctgataaaactgggcacgtcatgactgtaccactcatcactgactcaaccgggaaaaaattcggtaaatcagaaggtaatgctgtctggcttgatgccgataagacgtctccttacgagatgtaccaattctggttaaatgtcatggatgatgatgcagtgcgtttcttgaaaatcttcaccttcttatctctagatgagattgcagaaattgaaactcaatttaatgccgctcgtcacgagcgtctcgctcaaaaaaccttggcacgcgaagtggttaccttggttcatggcgaagaagcttataaacaagctcttaacattaccgagcagttatttgctggaaacatcaaaaatctttctgccaatgaattaaaacaaggattgagcaatgtaccaaattatcacgttcaatcaatagacaatcataatattgtcgagattttagtagctgctaagatttccccatcaaaacgccaggcgcgtgaagacgtgcaaaatggagcaatctacattaacggagaccgcgttcaagatttagattaccaattaagtaatgatgataaaattgatgatcaattaaccgttattcgccgcggtaagaaaaaatacgctgttctcacttac

SEQ ID NO: 372 - protein, 418 aa, Streptococcus pyogenes
MNIFEELKARGLVFQTTDEQALVKALTEGQVSYYTGYDPTADSLHLGHLVAILTSRRLQLAGHKPYALVGGATGLIGDPSFKDAERSLQTKETVLEWSDKIKGQLSTFLDFENGDNKAELVNNYDWFSQISFIDFLRDVGKYFTVNYMMSKDSVKKRIETGISYTEFAYQIMQGYDFYELNDKHNVTLQIGGSDQWGNMTAGTELLRKKADKTGHVMTVPLITDSTGKKFGKSEGNAVWLDADKTSPYEMYQFWLNVMDDDAVRFLKIFTFLSLDEIAEIETQFNAARHERLAQKTLAREVVTLVHGEEAYKQALNITEQLFAGNIKNLSANELKQGLSNVPNYHVQSIDNHNIVEILVAAKISPSKRQAREDVQNGAIYINGDRVQDLDYQLSNDDKIDDQLTVIRRGKKKYAVLTY

SEQ ID NO: 373 - DNA, 2295 bp, Streptococcus agalactiae
atgtttaaaggtaataagaagttgaatagttctaaattaggtgattacacaccacttgaatttggttctatttttttaagaattgtaaagcttttatcagatttcatctatgttattattttactatttgttatgctcggagtaggacttgcagtagggtatcttgctagtcaagttgactctgttaaagtaccaagtaaaaatagtttagtgacacaagttaatacacttactagggtgtctaggttaacttattctgataaatcacaaatttcagagattgccactgatttacaacgtacaccagtggcaaaggatgctatatctgataatattaaaaaggctatcattgcaacagaggacgaaaatttcaatgaccataaaggtgtagttcccaaagccgtactacgtgctgcagcgggatctgttctggggtttggagagagtagcggtggttcaacgctgacacaacaattattaaagcagcaaattttgggagatgatccgtcatttaaacgcaaatcaaaagaaattatttatgctctagcattagagcgttacatggataaggattcgattttatcagattatttaaatgtatcaccgtttggtcgcaataacaaaggacagaatattgcaggtattgaagaagcagcacaagggatttttggagtttccgcaaaagatttaacaattcctcaggcagctttccttgcaggtttaccgcaaagtcctattgtatattctccttatactgcagatgcccagttgaaatcagataaagatcttagttttggtataaagcgccaaaaaaatgtgttatacaatatgtatagaacgagagctttaaccaaagatgagtacaaatcctacaaagattatgacatcaaaaaagattttatcaaacctgcagtggcgacaacaaatcatcatgattatctttactactcggcattatctgaagctcaaaaagtgatgtacaattacctcattaaaaaggataatgtttcagagcatgatttaaaaaatgatgagactagagcgacgtacagacaccgcgctattgaagagattcaacagggagggtatactattaaaactactatcaataaatctgtttatcaagccatgcaggatgctgcagctcaatacggagggttgttagatgatggtactggcaaggttcaaatgggaaatgtactaacggacaattctagtggtgctattataggatttattggtggtcgtaactatagtgagaatcaaaataaccatgcttttgatacggcacgctctccagggtcaagtattaaaccgatattaccttacggaattgctattgatcaagggatgttaggaagtggtagtgttctttcaaattatccaacgacatattcaagtggcgaaaagattatgcatgcggatgaagaaggtactgctatggttaaccttcaagagtcattggacatttcttggaacattccagctttctggacttacaagatgctacgagatcgaggcgttgatgtaaaaaactatatggagaaattagactatccaattgaaaactttggtatagaaagtttaccacttggtggtggtattgatacgtcagttgctcagcaaacaaacctttatcaaatgattgcaaatggtggtgtttatcataagcagtatatgatagaaagtatagaggatagtaatgggaaagtgatttataatcacgaaagtaaacctgtccgtgtcttttcgaaagcaacagctactatcttacagcagctattacatggaccaattaactccggaaagactacaacctttaaaaatcgcttacaaggtttaaatagtggtttagctggggtagattggattggaaaaacgggtactactaactcaacttctgatgtttggttgatgctttctacacctaaagtgactttaggtggatgggcaggacatgataataatgcctctttagcgaaattgacaggttacaataataatgctaattatatggctcacttggttaatgctattaataatgcagatggcaatacttttggtaagtcagaaaggtttagacttgatgatagcgttataaaagctaaagttcttaagtctacaggtttacagccaggtgtagtaacagtaaacggtcgtcgaatcactgttggaggtgaaagcacaacaagttattgggcaaaaaatggacctggaacgatgacctatcgttttgctattgggggaactgatagtgattatcaaaaagcttggtctactttgggtggaaaacga

SEQ ID NO: 374 - protein, 765 aa, Streptococcus agalactiae
MFKGNKKLNSSKLGDYTPLEFGSIFLRIVKLLSDFIYVIILLFVMLGVGLAVGYLASQVDSVKVPSKNSLVTQVNTLTRVSRLTYSDKSQISEIATDLQRTPVAKDAISDNIKKAIIATEDENFNDHKGVVPKAVLRAAAGSVLGFGESSGGSTLTQQLLKQQILGDDPSFKRKSKEIIYALALERYMDKDSILSDYLNVSPFGRNNKGQNIAGIEEAAQGIFGVSAKDLTIPQAAFLAGLPQSPIVYSPYTADAQLKSDKDLSFGIKRQKNVLYNMYRTRALTKDEYKSYKDYDIKKDFIKPAVATTNHHDYLYYSALSEAQKVMYNYLIKKDNVSEHDLKNDETRATYRHRAIEEIQQGGYTIKTTINKSVYQAMQDAAAQYGGLLDDGTGKVQMGNVLTDNSSGAIIGFIGGRNYSENQNNHAFDTARSPGSSIKPILPYGIAIDQGMLGSGSVLSNYPTTYSSGEKIMHADEEGTAMVNLQESLDISWNIPAFWTYKMLRDRGVDVKNYMEKLDYPIENFGIESLPLGGGIDTSVAQQTNLYQMIANGGVYHKQYMIESIEDSNGKVIYNHESKPVRVFSKATATILQQLLHGPINSGKTTTFKNRLQGLNSGLAGVDWIGKTGTTNSTSDVWLMLSTPKVTLGGWAGHDNNASLAKLTGYNNNANYMAHLVNAINNADGNTFGKSERFRLDDSVIKAKVLKSTGLQPGVVTVNGRRITVGGESTTSYWAKNGPGTMTYRFAIGGTDSDYQKAWSTLGGKR

SEQ ID NO: 375 - DNA, 2310 bp, Streptococcus pyogenes
atgaggtattttatggtgaaatggaacacgaaacaaaagcgtataagtcatcaaagattaggtctcttggatttggggccggtgctattacgtacgttgagactactgtctaactttttttatattgttatcttcctttttggaatgatgggatttggtatggcatttgggtatttggctagtcagattgaatctgttaaggtaccaagtaaagaaagtttagtcaaacaagttgaatcattaacgatgatttcgcaaatgaactattctgataatagtttaatttctactttagatacggatttacttcgaacaccagtagctaatgatgcgatttcagagaatatcaaaaaagctattgtatcaacagaagacgaacattttcaagaacataaaggtatcgtgccaaaagctgtttttcgggcaacattggcttctgtattgggatttggagaagctagtggaggttcgaccttaacacagcaattagtcaagcaacaagttttgggagacgatcccacatttaagcgcaagtctaaggagatcgtttacgctcttgccttagagcgttatatgtccaaagacaatatcttatgtgattatcttaatgtttcaccttttggccgtaacaacaagggtcaaaatattgctggtgttgaagaagctgcgcgtggcatttttggcgtttctgccaaagatttaacggtgccacaggcagcatttttggcgggtcttccgcagagtcctattgtttactctccttatttgtcaacgggacaactgaaatcagaaaaggacatggcttatggcatcaagcgtcagcaaaatgttctctttaacatgtaccgtacaggtgttctgtctaaaaaagaatacgaggactataaggcttatccgattcaaaaggattttattcaaccgggaagtgcaatagtaaataatcacgattacctttattacacggtgttagcggatgctaagaaagccatgtatagctatttgattaagcgagataaggtgtctagtcgtgacttgaaaaatgacgagactaaggctgcttatgaagagagagccttaacagaattgcaacagggtggctataccatcaccacaaccattaataagcctatttacaatgcgatgcagacagcggcagctcagtttggtggcttgttagatgatggcactggtacagttcaaatgggaaatgtcttgacagacaatgcgactggtgctgtgttaggttttgttggtggtagagattatgctctgaatcaaaataatcatgctttcaatacagttagatcgccaggttctagcattaaaccgataatcgcttatggtcctgctattgatcaaggtttaatggggagtgctagcgttttgtctaattacccaacaacttactcgagtggccaaaaaatcatgcatgctgatagtgaaggaacagccatgatgccacttcaagaggccctaaatacttcttggaacatcccagctttttggacacagaaattactgcgtgaaaaaggtgtcgatgtcgaaaattatatgacaaaaatgggttataagattgcagactactcgattgaaagtttacctctagggggcggtattgaagtctcggttgctcaacaaaccaatgcttaccaaatgctttcaaacaatggcttatatcaaaagcaatatattgtagataagattactgctagcgatggtacagtcgtttacaaacatgaaaataagccaattcgtattttttctgcagcaacagctacgattttacaagaattgttgagaggtccgattacttcaggcgctacgactactttcaagaaccgtttggcggctattaatccgtggcttgctaatgctgattggattggtaagaccggaacaactgagaattatacggatgtttggctagtcctgtctactccaaaagttactttaggcggttgggcaggacatgatgacaatacctcattagcgccattaacaggatataacaataattctaattatcttgcctatttagctaatgccattaatcaggccgatcccaatgttattggagtagggcaacgcttcaacttagatccaggagtcattaaggcgaatgtcttgaagtcaacaggtttacaaccaggaactgttaatgtcaatggacatactttttctgttggtggagaaatgaccaccagtctatggtcccaaaaaggaccgggggctatgacttaccgatttgctattggtggcacggatgccgattatcaaaaagcctgggggaacttcgggttcagaaaaaat

SEQ ID NO: 376 - protein, 770 aa, Streptococcus pyogenes
MRYFMVKWNTKQKRISHQRLGLLDLGPVLLRTLRLLSNFFYIVIFLFGMMGFGMAFGYLASQIESVKVPSKESLVKQVESLTMISQMNYSDNSLISTLDTDLLRTPVANDAISENIKKAIVSTEDEHFQEHKGIVPKAVFRATLASVLGFGEASGGSTLTQQLVKQQVLGDDPTFKRKSKEIVYALALERYMSKDNILCDYLNVSPFGRNNKGQNIAGVEEAARGIFGVSAKDLTVPQAAFLAGLPQSPIVYSPYLSTGQLKSEKDMAYGIKRQQNVLFNMYRTGVLSKKEYEDYKAYPIQKDFIQPGSAIVNNHDYLYYTVLADAKKAMYSYLIKRDKVSSRDLKNDETKAAYEERALTELQQGGYTITTTINKPIYNAMQTAAAQFGGLLDDGTGTVQMGNVLTDNATGAVLGFVGGRDYALNQNNHAFNTVRSPGSSIKPIIAYGPAIDQGLMGSASVLSNYPTTYSSGQKIMHADSEGTAMMPLQEALNTSWNIPAFWTQKLLREKGVDVENYMTKMGYKIADYSIESLPLGGGIEVSVAQQTNAYQMLSNNGLYQKQYIVDKITASDGTVVYKHENKPIRIFSAATATILQELLRGPITSGATTTFKNRLAAINPWLANADWIGKTGTTENYTDVWLVLSTPKVTLGGWAGHDDNTSLAPLTGYNNNSNYLAYLANAINQADPNVIGVGQRFNLDPGVIKANVLKSTGLQPGTVNVNGHTFSVGGEMTTSLWSQKGPGAMTYRFAIGGTDADYQKAWGNFGFRKN

SEQ ID NO: 377 - DNA, 3573 bp, Streptococcus agalactiae
ttggcaggacatgaagttcagtacggaaaacaccgtacacgtcgtagcttttcaagaattaaggaagttcttgatttaccaaacttaattgaaattcaaactgattcattccaagattttcttgatgctggcttgaaagaagtatttgaggatgtacttccaatttcaaactttacagatactatggatcttgaatttgttggttatgaattaaaagaacctaaatatactttggaagaagctcgtatccatgatgctagctactcagcacctatttttgttactttccgtttagttaataaagaaactggtgaaattaaaactcaagaagttttctttggtgattttccaattatgactgaaatgggtactttcatcatcaatggtggtgaacgtatcattgtttcacaattagtccgttctcctggtgtttactttaatgataaggtagataaaaatggaaaagttggttatgggtcaactgttatccctaaccgtggagcttggttggaacttgagacagacgcaaaagatattgcttatacacgtatcgaccgcacacgtaaaattccatttacaacactagtccgtgcacttggtttctctggagacgatgaaattgttgacatctttggtgacagtgaacttgttcgcaatactattgaaaaagacattcataaaaatccaagtgattctcgtacagatgaagcacttaaagaaatctatgaacgtcttcgtccaggtgaaccaaaaactgcagacagctcacgtagtcttttagttgcacgtttctttgatccacgtcgttatgacttagcggctgttggtcgttataagattaataaaaaactgaatcttaaaacacgcctattgaaccaaacaatcgctgaaaatttagttgatggtgaaacaggagagattcttgttgaagctggaaccgttatgacacgagatgtcattgattcaattgcagagcatatcgatggagacttaaacaagtttgtctacacaccaaatgattatgctgtagttactgaaccagttattcttcaaaaattcaaagttgttgctccaactgatccagaccgtgttgttactattgttggaaactcaaatcctgaagataaagttcgtgccttaactcctgcagatattttagcagagatgtcatacttcttaaaccttgcagagggtatcggtaaggtagatgacattgaccatttaggtaaccgtcgtattcgtgcagttggtgaattacttgcgaaccaattccgtatcggacttgctcgtatggaacgcaatgtccgcgaacgtatgtctgtacaagacaatgaagtcttgacacctcaacaaatcattaacattcgtccagtgactgccgccgttaaagaattctttggttcatcacagctgtcacaattcatggaccaacacaaccctctatcagaattgtcgcacaaacgccgtctctctgccttaggacctggtggtttgacacgtgaccgtgctggatatgaagttcgtgacgtgcactatacccactatgggcgcatgtgtccgattgaaacacctgaaggtccaaacattggtttgattaataacttatcttcatttggacacctcaataaatatggatttattcaaacaccatatcgtaaagtagatcgttctactggtgcggtaacgaacgaaattgtttggttgactgctgatgaagaagatgaatttacagttgcacaagccaactctaagcttaacgaagacggtacatttgcagaagaaatcgttatgggtcgtcatcaaggtaataaccaagagtttccttcaagcattgttgactttgttgacgtgtcacctaagcaagtagttgctgtcgcaacagcatgtattcctttcttggaaaatgatgactctaaccgtgccttgatgggtgccaacatgcaacgtcaggctgtgccattgattgatccaaaagcaccatatgttggtactggtatggagtatcaagcagcccacgattcaggtgcagctgtgattgctaaacatgatggtcgtgttattttttcagatgctgaaaaagttgaagtgcgtcgcgaagatggttctcttgatgtttatcatgttcaaaaattccgccgttcaaactcaggtactgcttataaccaacgtaccttagttaaagttggtgatctcgttgaaaaaggtgattttatcgccgacggaccatctatggaaaatggtgaaatggctcttggacaaaacccagttgttgcttatatgacttgggaaggttataacttcgaggatgccgttatcatgagtgagcgccttgtgaaagaagatgtctatacatctgttcacttggaagaattcgaatctgaaacgcgtgatacaaagcttgggcctgaagaaattactcgtgaaattccaaatgttggtgaagattcactacgtgatctcgatgaaatgggaattatccgcattggtgctgaggtaaaagaaggtgacattcttgttggtaaggtaacacctaagggtgaaaaggacttatctgctgaagaacgtctcttgcatgccatttttggtgataaatcacgtgaagttcgtgatacttcactacgtgtacctcacggtggcgatggagtagttcgtgacgttaaaatctttactcgtgcaaatggtgatgaattgcaatcaggtgttaatatgcttgtccgcgtttatatcgctcaaaaacgtaaaatcaaagtcggtgataagatggccggtcgtcacggaaacaaaggtgtcgtctcacgtattgttcctgttgaagatatgccttacttaccagatggaacgccagttgatatcatgttgaacccacttggggtgccatcacgtatgaatatcggacaagttatggagcttcatttaggtatggctgctcgtaatttaggtattcatattgcaacgccagtctttgatggggcttcttcagaagacctttgggaaactgttcaagaagcaggtatggattcagatgctaagactgttctttatgatggtcgtactggtgaaccattcgataaccgtgtgtcagttggtgtcatgtacatgatcaaacttcaccacatggttgatgataaacttcatgcccgttcagtaggaccatactcacttgttactcaacaaccacttggaggtaaagctcaatttggtggacaacgttttggtgagatggaggtttgggcgcttgaagcttatggtgcttcaaatgttcttcaagaaattttaacatacaaatctgatgatgttacaggacgtcttaaagcttatgaagctatcacaaaaggtaagccaattccaaaaccaggtgttccagaatcattccgtgttcttgtaaaagaattgcaatcacttggtcttgatatgcgtgtccttgatgaagatgacaacgaagttgaactccgtgatcttgatgaaggtgaagatgatgatgtgatgcacgttgatgaccttgaaaaagcacgtgtgaaacaagaagctgaagaaaaacaagctgaacaagtatctgaagtcgttcaagaagat

SEQ ID NO: 378 - protein, 1191 aa, Streptococcus agalactiae
MAGHEVQYGKHRTRRSFSRIKEVLDLPNLIEIQTDSFQDFLDAGLKEVFEDVLPISNFTDTMDLEFVGYELKEPKYTLEEARIHDASYSAPIFVTFRLVNKETGEIKTQEVFFGDFPIMTEMGTFIINGGERIIVSQLVRSPGVYFNDKVDKNGKVGYGSTVIPNRGAWLELETDAKDIAYTRIDRTRKIPFTTLVRALGFSGDDEIVDIFGDSELVRNTIEKDIHKNPSDSRTDEALKEIYERLRPGEPKTADSSRSLLVARFFDPRRYDLAAVGRYKINKKLNLKTRLLNQTIAENLVDGETGEILVEAGTVMTRDVIDSIAEHIDGDLNKFVYTPNDYAVVTEPVILQKFKVVAPTDPDRVVTIVGNSNPEDKVRALTPADILAEMSYFLNLAEGIGKVDDIDHLGNRRIRAVGELLANQFRIGLARMERNVRERMSVQDNEVLTPQQIINIRPVTAAVKEFFGSSQLSQFMDQHNPLSELSHKRRLSALGPGGLTRDRAGYEVRDVHYTHYGRMCPIETPEGPNIGLINNLSSFGHLNKYGFIQTPYRKVDRSTGAVTNEIVWLTADEEDEFTVAQANSKLNEDGTFAEEIVMGRHQGNNQEFPSSIVDFVDVSPKQVVAVATACIPFLENDDSNRALMGANMQRQAVPLIDPKAPYVGTGMEYQAAHDSGAAVIAKHDGRVIFSDAEKVEVRREDGSLDVYHVQKFRRSNSGTAYNQRTLVKVGDLVEKGDFIADGPSMENGEMALGQNPVVAYMTWEGYNFEDAVIMSERLVKEDVYTSVHLEEFESETRDTKLGPEEITREIPNVGEDSLRDLDEMGIIRIGAEVKEGDILVGKVTPKGEKDLSAEERLLHAIFGDKSREVRDTSLRVPHGGDGVVRDVKIFTRANGDELQSGVNMLVRVYIAQKRKIKVGDKMAGRHGNKGVVSRIVPVEDMPYLPDGTPVDIMLNPLGVPSRMNIGQVMELHLGMAARNLGIHIATPVFDGASSEDLWETVQEAGMDSDAKTVLYDGRTGEPFDNRVSVGVMYMIKLHHMVDDKLHARSVGPYSLVTQQPLGGKAQFGGQRFGEMEVWALEAYGASNVLQEILTYKSDDVTGRLKAYEAITKGKPIPKPGVPESFRVLVKELQSLGLDMRVLDEDDNEVELRDLDEGEDDDVMHVDDLEKARVKQEAEEKQAEQVSEVVQED

SEQ ID NO: 379 - DNA, 3564 bp, Streptococcus pyogenes
ttggcaggacatgaagttcgatacggaaaacaccgtacacgtcgtagcttttcaagaatcaaagaagttcttgatttaccaaatttgattgaaattcaaactgactcattccaagatttcctcgattcaggtttgaaagaagtatttgaagatgtacttcctatttcaaactttacggatactatggaacttgaatttgttggttacgaatttaaagaacctaaatatacccttgaagaagctcgtatccacgatgcaagttattctgcaccaatctttgttaccttccgtttggtcaataaagaaactggtgagattaaaactcaagaagtcttctttggtgatttcccaatcatgacggaaatgggtacctttattatcaatggtggtgaacgtatcatcgtttctcagttggtgcgttctccaggtgtttatttcaacgataaagttgataaaaacggtaaagttggttacggatcaacagtgattcctaaccgtggggcttggttggaattagagactgactcaaaagacattgcctacactcgtattgaccgtacccgtaagattccattcacaaccttggttcgtgcccttggtttctcaggtgatgatgaaattgttgatatctttggtgaaagcgaccttgttcgtaataccattgaaaaagacattcacaaaaatccaagtgattctcgtacagacgaagcccttaaagaaatttacgagcgtcttcgtccaggtgagccaaaaactgcagatagctctcgtagtcttttgattgcgcgtttctttgatgcacgtcgttacgatttggctgcggttggtcgttacaaagtgaacaaaaaacttaatatcaagactcgtcttttgaaccaaatcattgctgaaaaccttgtggatgctgaaactggcgaaattttggtagaagctggaactgagatgactcgtagcgtcatcgaatccatcgaagaacaccttgacggtgatttgaacaagtttgtttacacaccaaatgattacgctgtggttactgaaccagttgtccttcaaaagttcaaggttgtgtcaccaattgatcctgatcgtgtagtaactattgttggtaatgccaatccagatgataaggttcgtgcattgacacctgctgatattttggcagaaatgtcttacttcttgaaccttgctgaaggtcttggaaaagttgacgatattgaccacttgggtaaccgtcgtatccgtgccgttggtgaattgcttgccaaccaattccgcatcggtcttgctcgtatggagcgtaacgtgcgtgagcgtatgtctgttcaagacaacgatgtgttaacaccacaacaaatcatcaatatccgtcctgtcacagcagctgtcaaagaattcttcggttcgtctcagttgtcacagttcatggaccaacacaacccattgtcagagttgtctcacaaacgtcgtttatctgccttaggacctggtggtttgacacgtgaccgtgctggttatgaggttcgtgacgtgcattacacgcactatggccgtatgtgtccgattgaaacacctgaaggaccaaacattggtttgattaataacttgtcttcatttggacatcttaataaatatggtttcatccaaacaccttaccgtaaggttgaccgtgcgactggtacggtaactaacgagattgtttggttgactgccgacgaagaagacgaatacacagttgcacaggccaattcgaaactaaacgaagatggcacttttgctgaagaaatcgttatgggtcgtcaccaaggtaataaccaagaattttctgcaagtgttgttgatttcgttgacgtttcccctaaacaggtagttgctgttgcgacggcatgtattcctttcttggaaaacgatgactccaaccgtgccctcatgggtgccaacatgcaacgtcaggctgtgccattgattgatccaaaagcaccatatgttggtactggtatggaatatcaagctgcccatgactcaggcgctgcggtgattgctcagcaaaatggtaaagttgtcttttctgatgctgaaaaagtggaaatccgtcgtcaagatggctcgcttgatgtttaccacattaccaaattccgtcgttcaaactcaggaacagcctataaccaacgcacccttgttaaagtaggagacattgttgaaaaaggtgatttcatcgctgatggaccttctatggaaaatggtgaaatggctcttggacaaaacccagtcgttgcttacatgacttgggaaggttataactttgaggatgccgttatcatgagtgagcgccttgtgaaagaagatgtctacacatctgttcacttggaagaattcgaatctgaaacgcgtgatacaaaacttggccctgaagaaatcactcgggaaatcccaaatgttggtgaagaagccctcaaagaccttgacgaaatgggcattatccgtatcggtgctgaggttaaagaaggcgacatcttagtaggtaaagtcacacctaaaggtgaaaaagacctttctgctgaagaacgtttacttcacgccatctttggggataaatcgcgtgaagtgcgtgatacctcacttcgtgtccctcacggtggtgatggtatcgttcgtgatgtgaaaatctttacacgcgctaacggcgatgaattgcaatcaggtgttaatatgcttgtgcgtgtttacatcgctcaaaaacgtaaaatcaaggtcggagataaaatggccggtcgtcacggaaacaagggtgtcgtttcacgtattgtaccagttgaagacatgccataccttccagacggaacaccagttgacatcatgttgaaccctcttggggtgccatcacggatgaatattggtcaggttatggaacttcaccttggtatggctgctcgtaatcttggtattcacattgcaacacctgtctttgacggggcttcatcagaagacctttgggacactgttcgtgaagctggtatggatagcgatgctaagacggtcctttatgatggtcgcaccggtgaaccatttgacaaccgtgtatccgttggtgtcatgtatatgatcaaacttcaccacatggttgatgataaacttcatgcccgttctgtaggaccatactcacttgttacccaacagccacttggtggtaaagctcaatttggtggacaacgttttggtgagatggaggtttgggcccttgaagcttatggtgcatcaaatgttcttcaagaaatcttgacctacaagtcagatgacgtcacaggacgtttgaaagcctatgaagcgattactaaaggtaaaccaattccaaaaccaggtgtaccagaatccttccgtgttcttgtaaaagaattgcaatcgcttggtcttgatatgcgtgtgcttgacgaggatgataatgaagtggaacttcgtgatcttgatgaaggtgaagacgatgacattatgcatgttgacgatctcgagaaggcacgtgaaaaacaagctcaagaaactcaagaagtttctgaaacaactgacgaaaaa

SEQ ID NO: 380 - protein, 1188 aa, Streptococcus pyogenes
LAGHEVRYGKHRTRRSFSRIKEVLDLPNLIEIQTDSFQDFLDSGLKEVFEDVLPISNFTDTMELEFVGYEFKEPKYTLEEARIHDASYSAPIFVTFRLVNKETGEIKTQEVFFGDFPIMTEMGTFIINGGERIIVSQLVRSPGVYFNDKVDKNGKVGYGSTVIPNRGAWLELETDSKDIAYTRIDRTRKIPFTTLVRALGFSGDDEIVDIFGESDLVRNTIEKDIHKNPSDSRTDEALKEIYERLRPGEPKTADSSRSLLIARFFDARRYDLAAVGRYKVNKKLNIKTRLLNQIIAENLVDAETGEILVEAGTEMTRSVIESIEEHLDGDLNKFVYTPNDYAVVTEPVVLQKFKVVSPIDPDRVVTIVGNANPDDKVRALTPADILAEMSYFLNLAEGLGKVDDIDHLGNRRIRAVGELLANQFRIGLARMERNVRERMSVQDNDVLTPQQIINIRPVTAAVKEFFGSSQLSQFMDQHNPLSELSHKRRLSALGPGGLTRDRAGYEVRDVHYTHYGRMCPIETPEGPNIGLINNLSSFGHLNKYGFIQTPYRKVDRATGTVTNEIVWLTADEEDEYTVAQANSKLNEDGTFAEEIVMGRHQGNNQEFSASVVDFVDVSPKQVVAVATACIPFLENDDSNRALMGANMQRQAVPLIDPKAPYVGTGMEYQAAHDSGAAVIAQQNGKVVFSDAEKVEIRRQDGSLDVYHITKFRRSNSGTAYNQRTLVKVGDIVEKGDFIADGPSMENGEMALGQNPVVAYMTWEGYNFEDAVIMSERLVKEDVYTSVHLEEFESETRDTKLGPEEITREIPNVGEEALKDLDEMGIIRIGAEVKEGDILVGKVTPKGEKDLSAEERLLHAIFGDKSREVRDTSLRVPHGGDGIVRDVKIFTRANGDELQSGVNMLVRVYIAQKRKIKVGDKMAGRHGNKGVVSRIVPVEDMPYLPDGTPVDIMLNPLGVPSRMNIGQVMELHLGMAARNLGIHIATPVFDGASSEDLWDTVREAGMDSDAKTVLYDGRTGEPFDNRVSVGVMYMIKLHHMVDDKLHARSVGPYSLVTQQPLGGKAQFGGQRFGEMEVWALEAYGASNVLQEILTYKSDDVTGRLKAYEAITKGKPIPKPGVPESFRVLVKELQSLGLDMRVLDEDDNEVELRDLDEGEDDDIMHVDDLEKAREKQAQETQEVSETTDEK

SEQ ID NO: 381 - DNA, 3678 bp, Streptococcus agalactiae
atgatgataaatcgaagaaaggtaaaactagtggttgacgtaaatcgttttaaaagtatgcaaatcacattagcatcaccaagtaaggtccgttcatggtcttatggtgaagttaaaaaacctgaaacaatcaactaccgcacattgaaaccagaacgtgaaggactttttgatgaagttatttttggtccaacaaaagattgggaatgtgcgtgtggaaaatacaaacgtattcgttacaaaggaatcatttgtgaccgttgtggcgttgaagtaacccgtgcaaaagttcgtcgcgaacgtatgggacatatcgagttaaaagcaccagtatctcatatctggtatttcaaaggtatcccatcgcgtatggggctcacattggatatgagtcctcgtgcacttgaagaagttatttattttgcggcttatgttgttatcgatccaatggacacaccattagaaccgaagtcactccttactgagcgtgaataccgtgaaaaacttcaagagtacggttacggttcgtttgttgctaaaatgggtgctgaagccattcaagatcttcttaaacgcgttgatttagatgcagaaatcgcagttcttaaagaggagttgaaatcagcgacaggtcaaaaacgtgtgaaagcagttcgtcgtctggatgtgttagatgcctttaaaaaatctggaaataaaccagaatggatggttcttaacattttaccggttatcccaccggatcttcgtccgatggttcaattagatggtggtcgttttgcggcatcagacttgaatgacctttaccgccgtgttattaaccgtaacaatcgtttggcacgtttgttggaattaaatgctcctggcatcatcgttcaaaatgaaaaacgtatgttacaagaagctgttgatgcgcttatcgacaatggtcgtcgtggtcgtccaattaccggaccaggtagtcgtcctttgaaatcattaagccatatgcttaaaggtaaacaaggtcgtttccgccaaaacttgcttggtaaacgtgttgacttctctggacgttccgttattgctgttggtccaacactcaaaatgtaccaatgtggtgtaccacgtgaaatggctattgagctcttcaaaccttttgtaatgcgtgaaatcgttgctcgtgacctcgcagggaacgttaaagcagctaaacgtatggttgaacgtggggacgagcgtatttgggacatcttagaagaagttattaaagagcacccagtacttctaaaccgtgcacctactcttcacagattaggtatccaagcgtttgaacctgtccttattgatggtaaggcgcttcgtcttcacccacttgtatgtgaggcctacaatgctgactttgatggagaccaaatggccatccacgttccattgtctgaagaagcccaagcagaagctcgtcttttgatgcttgctgcagagcacatccttaaccctaaagatggtaagccagtcgtaacaccatctcaggacatggttttaggaaattactacctgactatggaagatgctggtcgtgaaggtgaaggcatgattttcaaagatcatgacgaagcagttatggcatatcaaaatggttatgttcatttacatacacgtgttggtatcgctgttgattcaatgccgaataagccttggacagaagagcaaaaacataaaatcatggttacaacagttggtaagattctcttcaacgatatcatgcctgaagatttaccgtacttaattgaacctaataatgcaaacttgacagaaaaaactccagataaatacttcttagagccaggtcaggatattcaagcagttattgataacttagagattaatattccctttaagaagaaaaatcttggtaatattatcgcagaaacttttaaacgtttccgtacaacagaaacttctgctttccttgaccgtttgaaggaccttggatattatcattcaacacttgctggtttgactgtgggtattgctgatatcccagttattgacaataaagctgagattattgatgcagctcaccacagagttgaagatatcaataaagccttccgtcgaggtttgatgactgaagaagatcgttatgttgctgttacaacaacatggcgtgaagctaaagaagcacttgaaaaacgtcttattgagacacaagatccaaagaaccctatcgttatgatgatggactcaggagctcgtggtaacatctcaaacttctcacaacttgccggtatgcgtggtttgatggctgctcctaacggacgtatcatggaattgccaatcttatcaaacttccgtgaaggtcttagtgttttggaaatgttcttctcaactcacggtgcgcgtaaaggtatgactgatacggcccttaagacagccgactcaggttaccttactcgtcgtttggttgacgttgcccaagatgttattattcgtgaagatgactgtggaacagaccgcggtttgacaatcacagcaattacagatggtaaagaggttactgagacacttgaagagcgtttgataggacgttatactaagaagtcaatcaaacatcctgagacaggtgaaattctcgttggtgcagataccttaattactgaagatatggctgctaaagttgttaaagcgggcgttgaggaagtaactatccgatcagtatttacatgtaacactcgccatggtgtttgtcgtcactgttacggtattaacttggcaacaggtgatgctgttgaggttggtgaagcagttggtactattgcagctcaatctatcggtgaaccagggacacagcttacaatgcgtaccttccataccggtggtgttgcttcaaatactgatattacacaaggtctcccacgtatccaagaaatctttgaagcacgtaaccctaaaggtgaggcagttattactgaagttaagggtgaagtcgttgcaattgaagaagactcttcaacacgtactaagaaagtattcgttaaaggtcagacaggtgagggagaatacgttgttccatttacagcacgtatgaaagttgaagttggtgatgaagtagctcgtggtgcggccttaactgaaggatctatccaaccaaaacgtctccttgaagttcgtgatactttatctgttgaaacgtacctacttgctgaagtacaaaaagtttaccgtagccaaggggtagaaatcggagataaacacgttgaggtaatggttcgtcaaatgctccgtaaagttcgtgtcatggatccaggagatacagatcttcttccaggtacacttatggatatttcagactttacagatgctaacaaagatattgttatttctggtggaatccctgcgacaagccgtcctgtccttatgggtattactaaggcttcccttgaaactaattcattcttatcagctgcatccttccaagaaacaacacgtgtccttacagatgctgctatccgtggtaagaaagatcacttacttggtcttaaagaaaatgttattatcggtaaaatcattccagcgggtactggtatggctcgttaccgtaatattgaaccacttgctgttaatgaagttgagattattgaaggaactcctgttgatgcagaagttacggaagtatcaacacctacaacagaagat

SEQ ID NO: 382 - protein, 1226 aa, Streptococcus agalactiae
MMINRRKVKLVVDVNRFKSMQITLASPSKVRSWSYGEVKKPETINYRTLKPEREGLFDEVIFGPTKDWECACGKYKRIRYKGIICDRCGVEVTRAKVRRERMGHIELKAPVSHIWYFKGIPSRMGLTLDMSPRALEEVIYFAAYVVIDPMDTPLEPKSLLTEREYREKLQEYGYGSFVAKMGAEAIQDLLKRVDLDAEIAVLKEELKSATGQKRVKAVRRLDVLDAFKKSGNKPEWMVLNILPVIPPDLRPMVQLDGGRFAASDLNDLYRRVINRNNRLARLLELNAPGIIVQNEKRMLQEAVDALIDNGRRGRPITGPGSRPLKSLSHMLKGKQGRFRQNLLGKRVDFSGRSVIAVGPTLKMYQCGVPREMAIELFKPFVMREIVARDLAGNVKAAKRMVERGDERIWDILEEVIKEHPVLLNRAPTLHRLGIQAFEPVLIDGKALRLHPLVCEAYNADFDGDQMAIHVPLSEEAQAEARLLMLAAEHILNPKDGKPVVTPSQDMVLGNYYLTMEDAGREGEGMIFKDHDEAVMAYQNGYVHLHTRVGIAVDSMPNKPWTEEQKHKIMVTTVGKILFNDIMPEDLPYLIEPNNANLTEKTPDKYFLEPGQDIQAVIDNLEINIPFKKKNLGNIIAETFKRFRTTETSAFLDRLKDLGYYHSTLAGLTVGIADIPVIDNKAEIIDAAHHRVEDINKAFRRGLMTEEDRYVAVTTTWREAKEALEKRLIETQDPKNPIVMMMDSGARGNISNFSQLAGMRGLMAAPNGRIMELPILSNFREGLSVLEMFFSTHGARKGMTDTALKTADSGYLTRRLVDVAQDVIIREDDCGTDRGLTITAITDGKEVTETLEERLIGRYTKKSIKHPETGEILVGADTLITEDMAAKVVKAGVEEVTIRSVFTCNTRHGVCRHCYGINLATGDAVEVGEAVGTIAAQSIGEPGTQLTMRTFHTGGVASNTDITQGLPRIQEIFEARNPKGEAVITEVKGEVVAIEEDSSTRTKKVFVKGQTGEGEYVVPFTARMKVEVGDEVARGAALTEGSIQPKRLLEVRDTLSVETYLLAEVQKVYRSQGVEIGDKHVEVMVRQMLRKVRVMDPGDTDLLPGTLMDISDFTDANKDIVISGGIPATSRPVLMGITKASLETNSFLSAASFQETTRVLTDAAIRGKKDHLLGLKENVIIGKIIPAGTGMARYRNIEPLAVNEVEIIEGTPVDAEVTEVSTPTTED

SEQ ID NO: 383 - DNA, 3639 bp, Streptococcus pyogenes
gtggttgacgtaaatcgttttaaaagtatgcaaatcacattagcctcaccaagtaaggtccgttcatggtcttatggtgaagttaaaaaacctgaaacaatcaactaccgtacattaaaaccagaacgtgaaggactctttgacgaagtcatctttggtccaacaaaagactgggaatgtgcgtgtggtaagtacaaacgtatccgttataaagggatcgtttgtgatcgctgtggggttgaggtaactcgtgctaaagtacgtcgtgaacgtatgggtcacattgagttaaaagctcctgtatcacatatctggtatttcaaagggattccatctcgtatgggattgactcttgatatgagtcctcgtgcccttgaagaagtgatctattttgcggcttatgtggtcattgatccaaaagatacaccgcttgaaccaaaatcattattaacagaacgtgaataccgtgaaaaactacaagagtatggtcatgggtcatttgtcgctaagatgggtgctgaagccattcaagatctcttgaaacgtgtggacttggcagctgaaatcgctgaattaaaagaagagttgaaatctgcttctggtcaaaaacggattaaagcagttcgtcgtttagacgtccttgatgcctttaacaaatctggaaataaaccagaatggatggttcttaacatcctgccggttattccaccagatcttcgtccgatggttcaattggatggtggtcgttttgcggcatcagacttgaatgacttgtaccgtcgtgtgattaaccgtaataaccgtttggcacgtttgttagaacttaatgcccctggcatcattgttcaaaatgaaaaacgaatgcttcaagaagccgttgatgctttgattgataatggtcgtcgtggtcgtccaatcactggaccaggaagtcgtccattgaaatcattgagccacatgcttaaaggtaaacaagggcgtttccgtcaaaacttgcttggtaaacgtgtagacttctctggacgttccgttatcgctgttggtccaacccttaaaatgtatcaatgtggtgtcccacgtgaaatggctatcgagctttttaaaccatttgtaatgcgcgaaattgttgccaaagaatatgctggtaacgttaaagccgctaaacgtatggttgaacgtggcgacgaacgcatctgggatatcttagaagaagttatcaaagaacacccagtcctacttaaccgcgcaccgactcttcacagacttggtattcaggcttttgaacccgttcttattgacggtaaggcacttcgtcttcacccacttgtgtgtgaggcctacaatgccgacttcgatggagaccaaatggccattcacgtgccactttcagaagaagcacaagctgaagctcgtcttttgatgcttgctgcagagcacatcttgaaccctaaagatggtaaaccagttgttactccatctcaggatatggttcttggtaactactatcttacgatggaagatgctggtcgcgaaggcgaaggtatgattttcaaggataaagacgaagctgtgatggcatatcgtaatggttatgctcatcttcatagtcgtgtgggtatcgctgttgacagcatgccaaacaaaccttggaaagacaatcaaagacataaaatcatggtgacaactgttggtaagattctctttaacgatatcatgccagaggaccttccttacctccaagagccaaacaatgccaacttgacagaaggaacacctgataaatacttccttgaacctggtcaagacatccaagaagtgattgatcgcttagacatcaatgtgccatttaagaagaaaaacctcggtaacatcattgcggaaaccttcaaacgtttccgtacaacagaaacatcagccttccttgaccgcttgaaagaccttggttactaccactcaacccttgctggtttgacagtgggtatcgctgacattcctgttattgataataaagctgaaatcattgatgctgctcaccatcgtgttgaagaaattaacaaagccttccgtcgtggtttgatgacagatgatgaccgttatgttgccgttacaacaacatggcgtgaagctaaagaagcccttgaaaaacgtctgattgaaacacaagatcctaagaacccaatcgttatgatgatggactcaggagctcgtggtaacatctcaaacttctcacagcttgctggtatgcgtggtttgatggctgctcctaacggacgcatcatggaacttcctatcttgtcaaacttccgtgaaggtttgagcgttttggaaatgttcttctcaacccacggtgcacgtaaagggatgaccgatacggcccttaaaacagccgactcaggttaccttactcgtcgtttggttgacgttgcccaagatgttatcattcgtgaggacgattgtggcactgatcgtggtcttcttatccgtgctattacagatggtaaagaagttaccgaaacgcttgaagagcgtcttcaaggtcgttacacacgtaaatcagtcaaacaccctgaaactggtgaagtcttgattggtgctgaccaattaatcactgaagacatggctcgtaagattgttgatgcaggtgttgaagaagtgaccattcgttctgtctttacctgtgcgactcgtcatggtgtctgccgtcactgttatggtatcaacttggcaactggtgatgctgttgaagtgggtgaagcagttggtactattgctgcccaatctatcggtgagcctggtactcagcttaccatgcgtaccttccacacgggtggtgtagcctcaaataccgatatcacccagggtcttcctcgtattcaagagatctttgaagcacgtaatcctaaaggggaagcggtcattactgaagtgaaagggaatgtcgtcgagattgaagaagatgcgtcaactcgtaccaagaaagtctacgttcaaggaaaaactggcatgggcgaatatgtcataccatttacagcacgtatgaaagttgaagttggcgacgaagttaatcgcggagctgcccttacagaagggtcaattcaaccgaaacgtctccttgaagtgcgtgataccttgtcagttgaaacgtaccttcttgcagaagtacaaaaagtttaccgtagccaaggggtagaaatcggagacaaacacgttgaggtaatggttcgccaaatgcttcgtaaagttcgtgtcatggatccaggtgatacagacctccttccaggtacacttatggatatttctgatttcacagatgctaacaaagatattgttatctctggtggtattcctgcgacatctcgtcctgttcttatgggtattactaaggcttcccttgaaaccaattccttcttatcagctgcatccttccaagaaacaactcgtgttcttacagatgctgctatccgtggtaaaaaagatcatcttcttggtcttaaagaaaatgttatcattggtaaaatcatcccagctggtactggtatggctcgttaccgtaacattgaaccacaagcgatgaatgagattgaagtgattgatcatacagaagtctcagcagaagccgtttttacagcagaagcagaa

SEQ ID NO: 384 - protein, 1213 aa, Streptococcus agalactiae
VVDVNRFKSMQITLASPSKVRSWSYGEVKKPETINYRTLKPEREGLFDEVIFGPTKDWECACGKYKRIRYKGIVCDRCGVEVTRAKVRRERMGHIELKAPVSHIWYFKGIPSRMGLTLDMSPRALEEVIYFAAYVVIDPKDTPLEPKSLLTEREYREKLQEYGHGSFVAKMGAEAIQDLLKRVDLAAEIAELKEELKSASGQKRIKAVRRLDVLDAFNKSGNKPEWMVLNILPVIPPDLRPMVQLDGGRFAASDLNDLYRRVINRNNRLARLLELNAPGIIVQNEKRMLQEAVDALIDNGRRGRPITGPGSRPLKSLSHMLKGKQGRFRQNLLGKRVDFSGRSVIAVGPTLKMYQCGVPREMAIELFKPFVMREIVAKEYAGNVKAAKRMVERGDERIWDILEEVIKEHPVLLNRAPTLHRLGIQAFEPVLIDGKALRLHPLVCEAYNADFDGDQMAIHVPLSEEAQAEARLLMLAAEHILNPKDGKPVVTPSQDMVLGNYYLTMEDAGREGEGMIFKDKDEAVMAYRNGYAHLHSRVGIAVDSMPNKPWKDNQRHKIMVTTVGKILFNDIMPEDLPYLQEPNNANLTEGTPDKYFLEPGQDIQEVIDRLDINVPFKKKNLGNIIAETFKRFRTTETSAFLDRLKDLGYYHSTLAGLTVGIADIPVIDNKAEIIDAAHHRVEEINKAFRRGLMTDDDRYVAVTTTWREAKEALEKRLIETQDPKNPIVMMMDSGARGNISNFSQLAGMRGLMAAPNGRIMELPILSNFREGLSVLEMFFSTHGARKGMTDTALKTADSGYLTRRLVDVAQDVIIREDDCGTDRGLLIRAITDGKEVTETLEERLQGRYTRKSVKHPETGEVLIGADQLITEDMARKIVDAGVEEVTIRSVFTCATRHGVCRHCYGINLATGDAVEVGEAVGTIAAQSIGEPGTQLTMRTFHTGGVASNTDITQGLPRIQEIFEARNPKGEAVITEVKGNVVEIEEDASTRTKKVYVQGKTGMGEYVIPFTARMKVEVGDEVNRGAALTEGSIQPKRLLEVRDTLSVETYLLAEVQKVYRSQGVEIGDKHVEVMVRQMLRKVRVMDPGDTDLLPGTLMDISDFTDANKDIVISGGIPATSRPVLMGITKASLETNSFLSAASFQETTRVLTDAAIRGKKDHLLGLKENVIIGKIIPAGTGMARYRNIEPQAMNEIEVIDHTEVSAEAVFTAEAE

SEQ ID NO: 385 - DNA, 363 bp, Streptococcus agalactiae
atgtatcaagttgtaaaaatgtttggtgattgggaaccatggtggtttattgaaggttgggaggaagatattactgaaattgctgagtatgataccttatcagaagctttgctctattttcaagaggagtgggataggggacaggaaaagtggccttattttcaaagtaagtctagtttgttggcaacgttttggagtataaaagaaaaacgttggtgtgaagaatgtgatgagtacctccaacagtatcattccttaatgttattgaaagaatggcaagaaattcctaaggaagaatctattgagcgatttgaagtatttaataagatagctgagttgccatcggcatgttctttaaatttg

SEQ ID NO: 386 - protein, 121 aa, Streptococcus agalactiae
MYQVVKMFGDWEPWWFIEGWEEDITEIAEYDTLSEALLYFQEEWDRGQEKWPYFQSKSSLLATFWSIKEKRWCEECDEYLQQYHSLMLLKEWQEIPKEESIERFEVFNKIAELPSACSLNL

SEQ ID NO: 387 - DNA, 363 bp, Streptococcus pyogenes
atgtatcaagtaattaaaatgtatggtgattgggagccttggtggttcatcgatggatggcaagacgatattatagatgagcaacaatttagtgactggcaagaagcgcttgattattttaatcaagaatggcagcgcatgaaagctatttttcctagttatcatagtcaaaagaatttgttagctactttttgggaaaaagaagataaaagatggtgcgaggactgtgacgaagatttgcagcagtttcattctcttttactccttaaaaataaagatattgtaccaagcaataattatatccctgaatttgaacaacgaaatgattcaccacaggtagcttatctttgcaagttaaacctt

SEQ ID NO: 388 - protein, 121 aa, Streptococcus pyogenes
MYQVIKMYGDWEPWWFIDGWQDDIIDEQQFSDWQEALDYFNQEWQRMKAIFPSYHSQKNLLATFWEKEDKRWCEDCDEDLQQFHSLLLLKNKDIVPSNNYIPEFEQRNDSPQVAYLCKLNL

SEQ ID NO: 389 - DNA, 969 bp, Streptococcus agalactiae
atggttcaatcattagcaaagcaagtcattcatcaggcagtagaagtaaatgctcaagatatttatatcattcccaaaggtgattgttatgaactctatatgcgtattgatgatgaaaggcggtttattgatgtttttgagtttaataggatggctagtcttattagtcactttaaatttgtggcaggcatgaacgttggagaaaaaagacgaagtcaattaggttcttgtgactatgaactgtcagagggaagactggtttcattacgactatcgagtgtgggagattatcgtggtcaagaatctttagttattcgtattttgtattcaggtcatcaggacttaaaatattggtttgataatataaagcaaatgaaggaagtactgggtataagagggctatatcttttttccggccctgtggggagtggtaaaacaactctcatgtatcaattagcttcagaagtatttaaaaataagcaaattatcacgattgaagatccggtagaaatcaagaatgacaagatgttacaactccaattgaatgaggatattggaatgacttatgatgctttaatcaaactgtctttacggcatcgtccagatattttaattatcggagagattagagatcaagcgacggcccgtgctgttattcgtgcaagtttaacgggagtgatggttttttctactattcatgctaaaagtattcccggagtctatgataggcttatagaattaggggttaactatcaagagttagaaaatagtctaaaattaatagcatatcaacgtttaattggaggaggaagcctaattgactttgagacaggtaattttaaaaaacactcatcagacaagtggaatagacaagtggatatcttggctgaagaaggacatatcagtaagaaacaggcacaagtcgaaaaaattatccctcaagaaacaacggaaagtagtccaactttt

SEQ ID NO: 390 - protein, 323 aa, Streptococcus agalactiae
MVQSLAKQVIHQAVEVNAQDIYIIPKGDCYELYMRIDDERRFIDVFEFNRMASLISHFKFVAGMNVGEKRRSQLGSCDYELSEGRLVSLRLSSVGDYRGQESLVIRILYSGHQDLKYWFDNIKQMKEVLGIRGLYLFSGPVGSGKTTLMYQLASEVFKNKQIITIEDPVEIKNDKMLQLQLNEDIGMTYDALIKLSLRHRPDILIIGEIRDQATARAVIRASLTGVMVFSTIHAKSIPGVYDRLIELGVNYQELENSLKLIAYQRLIGGGSLIDFETGNFKKHSSDKWNRQVDILAEEGHISKKQAQVEKIIPQETTESSPTF

SEQ ID NO: 391 - DNA, 936 bp, Streptococcus pyogenes
atggtacaagcattagcaaaagctattctagcaaaagctgaacaggttcatgcacaagatatttatattttgccaagagcagatcaatatgatctttttttacgaataggagatgaaaggagattagttgatgtttatcagagcgatcggatggctcctcttattagtcactttaaattcgttgcaggaatgatagttggtgaaaagagacgttgtcaggtgggttcatgtgattataagcttagtaaagataagcagttatctttgcgcttatctagcgtgggtgattatcgcgggcaagaaagcttagtgattcgtctgcttcatcatcaaaataaaagtgtacattattggtttgatggattgacaaaagtagccaatcaggttggcggtagagggttgtatttatttgcaggaccagttgggtctgggaagacaaccttgatgtaccagctgatttcgaattatcatcaagaagcacaggttattagtatagaagatcctgtagaaattaaaaatcaccaaattttacaattacaagtgaatgatgatattggtatgacttatgacaatttgatcaaactgtctttacgccatcgaccagatattttagttattggtgagattcgagatagtcaaacagcaagagccgttattagggctagtctaacaggtgccatggttttttcaacggttcacgctaaaagtatctcgggtgtttatgcaagattgttagaacttggtgtaacgaaagcagaactgtctaattgcttagcattaattgcttaccaaaggttacttaatggaggagcattgattgactctactcaaaacgaatttgaatattattcctcatcgaactggaatcaacaaattgatcagcttcttgaggcaggacatctcaatcccaagcaagctaagcttgaaaaaattatc

SEQ ID NO: 392 - protein, 312 aa, Streptococcus pyogenes
MVQALAKAILAKAEQVHAQDIYILPRADQYDLFLRIGDERRLVDVYQSDRMAPLISHFKFVAGMIVGEKRRCQVGSCDYKLSKDKQLSLRLSSVGDYRGQESLVIRLLHHQNKSVHYWFDGLTKVANQVGGRGLYLFAGPVGSGKTTLMYQLISNYHQEAQVISIEDPVEIKNHQILQLQVNDDIGMTYDNLIKLSLRHRPDILVIGEIRDSQTARAVIRASLTGAMVFSTVHAKSISGVYARLLELGVTKAELSNCLALIAYQRLLNGGALIDSTQNEFEYYSSSNWNQQIDQLLEAGHLNPKQAKLEKII

SEQ ID NO: 393 - DNA, 900 bp, Streptococcus agalactiae
atggtcaccttcttaaagaggagtaagttattgtctgattgttatacagatagtatgaataaggcattattagagggaaaagatttatcaaaaatgttaggagagttaggtttttctgacactgttatcacacaggttgcattagctgatttgcatggtaacatttcaaggagcctactaaagattgagtcttatttagctaatcttttgttagttagaaaaaaagtaatagaagtagctacttacccattgatattattgtcttttctggtgctaattatgattggccttaggaattatttaatgccccaattaggagaaaataattttgcaactagactgattacaaatgtgccgaatattttcttattacttttagcagttgtacttatttttagtttaatattttatattattcaaaagcgattgtcgcgcattaaagtagcttgttttttaacaacaattcccttagttggatcatatgttaagctttatttaactgcttactatgcccgtgagtggggaaatttattaagtcaaggtattgaattggaccaaattgttaaagtaatgcaaaatcagaaatccaaactttttagggaaataggatatgacatggaagaaggttttctatcaggtaaagcatttcaccaaaaagtattagactatccgtttttcttaactgagcttagtttaatgattgaatatggccaagttaaggcgaaattaggaacagagttagatatatatgctgatgagaagtgggaggatttttttacaaaattagctagagcgacccagttaatccaacccgttatttttatttttgtagctcttatcattgttatgatttatgcagcaatgctgttaccaatgtatcaaaatatggagatattatca

SEQ ID NO: 394 - protein, 300 aa, Streptococcus agalactiae
MVTFLKRSKLLSDCYTDSMNKALLEGKDLSKMLGELGFSDTVITQVALADLHGNISRSLLKIESYLANLLLVRKKVIEVATYPLILLSFLVLIMIGLRNYLMPQLGENNFATRLITNVPNIFLLLLAVVLIFSLIFYIIQKRLSRIKVACFLTTIPLVGSYVKLYLTAYYAREWGNLLSQGIELDQIVKVMQNQKSKLFREIGYDMEEGFLSGKAFHQKVLDYPFFLTELSLMIEYGQVKAKLGTELDIYADEKWEDFFTKLARATQLIQPVIFIFVALIIVMIYAAMLLPMYQNMEILS

SEQ ID NO: 395 - DNA, 1032 bp, Streptococcus pyogenes
ttgatcagcttcttgaggcaggacatctcaatcccaagcaagctaagcttgaaaaaattatctagtaaacatcagcataaattcattcaattactagctaatcttttatctacaggatttagcttcgcagaggttattgcttttttaaaaagaagccagttgcttcagctagattatgttcttaaaatggaagagtctttattaaaaggacaaggcttagcagatatgttgtcgggtttaggtttttcagatgctattcttactcaaattagtttagctgatagacacggtaatattgaaacaacattagtagcgattcaacattacttgaaccaaatggcaaggatcagacgaaaaactgttgaagttatcacctatcctcttattcttttactttttctttttgtgatgatgctagggttgagacgctatttagtccctcaattagaaactcaaaatcagataacttactttcttaaccattttcctgccttctttataggtttttgctcaggtcttattttgttgttcgggatggtatggctacgatggcgatctcaaagccgcttgaaactctatagtcggctaagccgttatccttttttaggtaaactgttaaaacaatacttaactagttattatgctagagaatggggtacgttaataggtcaaggtcttgatttgatgactattttagacattatggccattgagaaatcctcactaatgaaagaattagctgaggacatcagaatgagtctgcttgaagggcaagcctttcacattaaagtagctacctaccctttttttaaaaaagaattaagtttaatgattgaatacggtgaaatcaaatcgaaactgggggctgagttggaaatctatgcccaggaaagctgggaacaattttttagtcagctttatcaagtgacacaacttattcaaccagctatttttttagtagttgctgtgacaatcgtcatgatttatgcggcaatcctattaccaatttaccaaaatatgggaggtattttt

SEQ ID NO: 396 - protein, 344 aa, Streptococcus pyogenes
LISFLRQDISIPSKLSLKKLSSKHQHKFIQLLANLLSTGFSFAEVIAFLKRSQLLQLDYVLKMEESLLKGQGLADMLSGLGFSDAILTQISLADRHGNIETTLVAIQHYLNQMARIRRKTVEVITYPLILLLFLFVMMLGLRRYLVPQLETQNQITYFLNHFPAFFIGFCSGLILLFGMVWLRWRSQSRLKLYSRLSRYPFLGKLLKQYLTSYYAREWGTLIGQGLDLMTILDIMAIEKSSLMKELAEDIRMSLLEGQAFHIKVATYPFFKKELSLMIEYGEIKSKLGAELEIYAQESWEQFFSQLYQVTQLIQPAIFLVVAVTIVMIYAAILLPIYQNMGGIF

SEQ ID NO: 397 - DNA, 453 bp, Streptococcus agalactiae
atgaaaaatttattgttaaaatgtaaggataagaaggttaaagcatttacacttttagaatgtttggtagcattggttacaatcacaggagctttactagtttatcaaggactgacaaaattgttggctcaacagatagtagtgatgtcttcttccagtcagtctgaatgggtgttattaactcagcaactaaatgcagaatttgaaggcgctcatctggaatatttaagacagaacaaactttatttacgtaagcaagataagattgtaacctttggcaaatctaataaagatgatttccgtaagacaggttatgatggtcgaggttatcaaccaatggtttatgggttagacaattgtcaaatgagtcagaccaaaagtatggtaaaacttgttttttattttaaggacgggttaaaaaggacattttactatgattttaaagaagaaact

SEQ ID NO: 398 - protein, 151 aa, Streptococcus agalactiae
MKNLLLKCKDKKVKAFTLLECLVALVTITGALLVYQGLTKLLAQQIVVMSSSSQSEWVLLTQQLNAEFEGAHLEYLRQNKLYLRKQDKIVTFGKSNKDDFRKTGYDGRGYQPMVYGLDNCQMSQTKSMVKLVFYFKDGLKRTFYYDFKEET

SEQ ID NO: 399 - DNA, 432 bp, Streptococcus pyogenes
ttgagtaaacaattaagtaacataaaagcttttacccttctagaggcgttaatagccttactcgtgatatcagggtctttattggtttatcaaggtttgacccgaaccctccttaaacatagccattatctagcccgtcatgatcaagataattggctcttattttctcatcaattgcgagaggagttaagtggagcaaggttttacaaagtagctgataataaactatacgttgaaaaaggaaagaaagtactagcttttggccaatttaaaagtcatgattttcgaaaatcagctagtaatggaaaagggtatcaacccatgttatttggaatatcacgtagtcatattcacatagagcagtcacagatttgcattactttaaagtggaaaagtgggttagaaaggactttttattatgcctttcaagac

SEQ ID NO: 400 - protein, 144 aa, Streptococcus pyogenes
LSKQLSNIKAFTLLEALIALLVISGSLLVYQGLTRTLLKHSHYLARHDQDNWLLFSHQLREELSGARFYKVADNKLYVEKGKKVLAFGQFKSHDFRKSASNGKGYQPMLFGISRSHIHIEQSQICITLKWKSGLERTFYYAFQD

SEQ ID NO: 401 - DNA, 972 bp, Streptococcus agalactiae
atgaattttgaaaaaattgagacagcctatgagctgattttagaaaatatccaaacgattgagaaccaattaaaaactcatatttatgatgccttaattgaacagaactcttattaccttggttcaagttgtgatttagatatggttgtggtgaataaccaaaaattacgtcaacttgacttaagtcaagaagaatggcgtcgcactttccagttcatttttatcaaatctgcgcaaacagagcaattacaagctaatcatcagtttacgccagatagtattggttttatcttgttatttcttttggaagaattaacgagtcaagagacagtggatgtcttggaaattggaagtggaactgggaatttagctcagactctcctcaataacagctcgaaagagttaaattatatgggcattgaagttgatgatcttttgattgatctatcagcaagcattgctgaaattataggttctagtgcccaatttatccaagaggatgctgttagaccacaaattttgaaagaaagcgatgtaatcattagtgatttaccagttggctattatcctaatgatggtattgctaaacgatatgctgtatcaagttctaaagagcacacctatgctcaccatctattgatggagcaatctcttaaatatttgaaaaaagatggaatcgctatatttttagcacccgaaaaccttttaacaagtccacaaagtgatttgctgaaggagtggttaaaaggatatgcagatgtcattgccgttttaactctaccagaaactatttttggaagtcgtcaaaatgcgaaatctatatttgttctcaagaagcaagcagaacaaaaaccagaaacctttgtatatccgctgacagatttgcaaaatcgtgagaatatggcaaacttcattgaaaattttcaaaaatggagcagagaaaatagtcattactcaaaaaatatgataaaa

SEQ ID NO: 402 - protein, 324 aa, Streptococcus agalactiae
MNFEKIETAYELILENIQTIENQLKTHIYDALIEQNSYYLGSSCDLDMVVVNNQKLRQLDLSQEEWRRTFQFIFIKSAQTEQLQANHQFTPDSIGFILLFLLEELTSQETVDVLEIGSGTGNLAQTLLNNSSKELNYMGIEVDDLLIDLSASIAEIIGSSAQFIQEDAVRPQILKESDVIISDLPVGYYPNDGIAKRYAVSSSKEHTYAHHLLMEQSLKYLKKDGIAIFLAPENLLTSPQSDLLKEWLKGYADVIAVLTLPETIFGSRQNAKSIFVLKKQAEQKPETFVYPLTDLQNRENMANFIENFQKWSRENSHYSKNMIK

SEQ ID NO: 403 - DNA, 996 bp, Streptococcus pyogenes
gtgacacttcttttcatttcaagtgtaatttggtatgataaggttatgacttttgaaaaaattgaagaagcttatcagctgctcttagagaactgtcaactaattgaaaatgatctaaaaacacatatatacgatgccattgttgaacaaaactccttttatttaggggctgagggagctagtcctcaagttgctcaaaatagtgataaactgaaagccttgtgcctgacaaaagaagaatggcgtaaggcctaccagtttctttttattaaggcagctcagactgagcaactccaagccaaccatcagttcacaccagatgctattggcttcattctgctgtatcttttggaacaattgagtgataaagatagcttagaggtacttgagattggaagtggaacagggaacctagcccaaacccttctcaacaacacgagcaagagccttgattatgtagggattgaacttgatgatctcttgattgatctgtcagccagtattgctgagataatggattcttcagctcattttattcaagaagatgcggtaaggcctcaattactaaaagaaagtgacattgtcatcagtgacttaccagttggttattatcctaacgatgatattgccaaacggtacaaggtggctagttcagataagcatacctatgcccatcatttattaatggaacagtctttaaaatacttgaaaaaagacggttttgcgatttttctggcaccagtcaatttattgacgagccctcagagccagttgttgaaacagtggttaaaagattatgctcaggtggtgaccttgattacgctaccagattctatttttggtcatccctcaaatgccaagtccattattgtcttacaaaaacaaacagaccacccaatggaaacctttgtctatccaattcgggatttgaagcttgcagagaatattcatgattttatggaaaatttcaaaaaatggaaactgagtaatgtcaat

SEQ ID NO: 404 - protein, 332 aa, Streptococcus pyogenes
VTLLFISSVIWYDKVMTFEKIEEAYQLLLENCQLIENDLKTHIYDAIVEQNSFYLGAEGASPQVAQNSDKLKALCLTKEEWRKAYQFLFIKAAQTEQLQANHQFTPDAIGFILLYLLEQLSDKDSLEVLEIGSGTGNLAQTLLNNTSKSLDYVGIELDDLLIDLSASIAEIMDSSAHFIQEDAVRPQLLKESDIVISDLPVGYYPNDDIAKRYKVASSDKHTYAHHLLMEQSLKYLKKDGFAIFLAPVNLLTSPQSQLLKQWLKDYAQVVTLITLPDSIFGHPSNAKSIIVLQKQTDHPMETFVYPIRDLKLAENIHDFMENFKKWKLSNVN

SEQ ID NO: 405 - DNA, 1191 bp, Streptococcus agalactiae
atgtcaaaaacaatagcaattaatgctggaagttcaagtttgaaatggcaattatatgaaatgccagaggagaaagtagttgccaaagggattatcgaacgtattggtttgaaagattctatttcgactgtaaaatttgacgataaaaaagatgaacaaattttagatatcgtagatcatacccaagctgttaaaattcttttagaagatctaacaaaacatggtattatcaaagactttaatgaaattacaggtgttggtcatcgtgtcgttgctggtggtgaatattttaaagagtctgctttagtagatgataaagttgtagaacaggttgaagaattatcagctttagctccactccacaacccagcagctgcagcagggattcgtgcgtttagagaaatcttaccagatatcacgagtgtatgtgtatttgatacagccttccatacaacaatgcaacctcatacctacttatatccaatcccacaaaagtactatactgattataaagtacgtaaatacggtgcacacgggacaagccaccaatacgttgcacaagaagcagctaagcaattaggacgtcctttagaagaattaaaattaatcacagcacatgtgggtaatggtgtttctattacagcaaattatcatggacagtctattgatacatcaatgggattcacaccacttgcaggaccaatgatgggaacacgttcaggagacattgatcctgcgattatcccttatcttgtagctaatgatccagaattggaagatgcagcagctgttgttaatatgcttaacaaacaatcaggattgcttggagtatcaggaacttcaagtgatatgcgagatattgaagcaggtcttcaaagtaaagatccaaatgcagtgttagcctataatgtctttattgaccgtattaagaaatttattggacaatacttggcagtattaaatggcgcggatgctattatttttactgcaggtatgggagaaaatgcgccattaatgcgtcaagatgttatcgcaggattatcatggtttggcattgaacttgatccagaaaaaaatgtttttggttattttggagatatcacaaaaccagattcaaaagtgaaggttttagttattcctactgatgaagaattaatgattgcgcgtgacgttgagcgccttaaagctaaa

SEQ ID NO: 406 - protein, 397 aa, Streptococcus agalactiae
MSKTIAINAGSSSLKWQLYEMPEEKVVAKGIIERIGLKDSISTVKFDDKKDEQILDIVDHTQAVKILLEDLTKHGIIKDFNEITGVGHRVVAGGEYFKESALVDDKVVEQVEELSALAPLHNPAAAAGIRAFREILPDITSVCVFDTAFHTTMQPHTYLYPIPQKYYTDYKVRKYGAHGTSHQYVAQEAAKQLGRPLEELKLITAHVGNGVSITANYHGQSIDTSMGFTPLAGPMMGTRSGDIDPAIIPYLVANDPELEDAAAVVNMLNKQSGLLGVSGTSSDMRDIEAGLQSKDPNAVLAYNVFIDRIKKFIGQYLAVLNGADAIIFTAGMGENAPLMRQDVIAGLSWFGIELDPEKNVFGYFGDITKPDSKVKVLVIPTDEELMIARDVERLKAK

SEQ ID NO: 407 - DNA, 1194 bp, Streptococcus pyogenes
atgtcaaagacaattgcaattaatgcaggtagttctagtttaaaatggcaactttatcagatgccagaagaagcagtgttagcacaaggaattattgagcgtatcggtctcaaggattctatttcaacagttaagtacgatggcaaaaaagaagagcaaattcttgatattcacgatcatacagaagctgttaaaatcttattgaacgatttgattcactttggaatcattgcagcttatgatgaaattacaggagttggacaccgtgttgttgctggtggtgaacttttcaaagaatccgttgtggttaatgacaaagttcttgaacagattgaagaattatccgttttagctccacttcacaatcctggagcggcggcagggattcgtgccttccgtgatattttgccagatattaccagtgtttgtgtgtttgacacgtcatttcacactagcatggcaaagcatacttacctttacccaattcctcaaaaatattatacggactacaaggttcgtaaatatggggcgcatgggacaagtcataaatatgtagcgcaagaagctgctaaaatgcttggtcgtccattagaagaattaaaactaattactgctcatattggaaatggtgtctcaattacagctaattaccacggtaaatcagttgatacctcgatgggctttacaccacttgctggtcctatgatgggaacacgttctggtgacattgacccagctatcattccttatttaattgagcaagacccagagttaaaagacgctgctgacgttgttaatatgttaaacaaaaaatcaggtcttagtggggtgtcaggcatttctagtgatatgcgtgatatcgaggctggtttacaagaagataatccagatgctgttttagcttacaatatctttattgatcgcattaaaaaatgcattggtcaatattttgctgttttgaatggagcagatgctttggtctttacagctggtatgggtgaaaatgcaccattgatgcgtcaagatgttattggtggcttaacatggttcggaatggacattgatcctgagaaaaatgtttttggataccgtggtgacatttcaactcctgagtcaaaagtgaaggtgcttgttatctcaacagacgaagaattgtgcatcgcgcgtgacgttgaacgtttaaaaaatacaaaa

SEQ ID NO: 408 - protein, 398 aa, Streptococcus pyogenes
MSKTIAINAGSSSLKWQLYQMPEEAVLAQGIIERIGLKDSISTVKYDGKKEEQILDIHDHTEAVKILLNDLIHFGIIAAYDEITGVGHRVVAGGELFKESVVVNDKVLEQIEELSVLAPLHNPGAAAGIRAFRDILPDITSVCVFDTSFHTSMAKHTYLYPIPQKYYTDYKVRKYGAHGTSHKYVAQEAAKMLGRPLEELKLITAHIGNGVSITANYHGKSVDTSMGFTPLAGPMMGTRSGDIDPAIIPYLIEQDPELKDAADVVNMLNKKSGLSGVSGISSDMRDIEAGLQEDNPDAVLAYNIFIDRIKKCIGQYFAVLNGADALVFTAGMGENAPLMRQDVIGGLTWFGMDIDPEKNVFGYRGDISTPESKVKVLVISTDEELCIARDVERLKNTK

SEQ ID NO: 409 - DNA, 204 bp, Streptococcus agalactiae
atgaaaaattctctacaaaagttacgaaaatctaggaaattaagtcaagcagaacttgcagttgcacttggagttactaggcaaactattatttctctagaaaaagagaaatacacggcatctttggagctagcatttaagatagcgcgttattttgataaacaaattgaggaagtttttatttatacagaaagtgaaggagga

SEQ ID NO: 410 - protein, 68 aa, Streptococcus agalactiae
MKNSLQKLRKSRKLSQAELAVALGVTRQTIISLEKEKYTASLELAFKIARYFDKQIEEVFIYTESEGG

SEQ ID NO: 411 - DNA, 228 bp, Streptococcus pyogenes
atgaaggagatggcaatggaggttattcttaaaaatcggctcaaagaattacgagctagagatggaattaatcaaacggaaatggctaaactggcaggagtatcgaggcagaccatcagtctcattgagcgtaacgagtacaccccatcagttataattgccatgaaaattgcaaaggtatttcaggaaccagttgaagaggtgtttcgtctagtggaggtcgaggaa

SEQ ID NO: 412 - protein, 76 aa, Streptococcus pyogenes
MKEMAMEVILKNRLKELRARDGINQTEMAKLAGVSRQTISLIERNEYTPSVIIAMKIAKVFQEPVEEVFRLVEVEE

SEQ ID NO: 413 - DNA, 675 bp, Streptococcus agalactiae
ttggaggtttttgtgtcatttattattagaaaaggcaaaattttagctttgctaatagcatttttagttattaatcaacttgttcctatattggctgtgtggctcctaaagaatcactatcaaacgccttttactagtatattgttgattggcttagaattacttattattgctcttttcctttattatgccaaggttaaacaaataatcagatggaaagcattattgacaaggaaagcattagttactattctcttaggttggttatcattgagggttccacaaattattggttacctcattatgactatgcaaggggttaaagatacagcaaatcaaacagtaattatggaattaacaaagcaacttccactagctttgatgttaatttttgccataattggtgcccctattatggaagaaattatatttcgctatattatccctaaagaactttttgcgaaacatcaaaaatggggttttgtcatcggtactttagcttttgctcttattcattccccttctgatataggtagttttattatttatgctgggatgggtgctattttatcttttgtttattataaaactgagcacttagaatatagtataatgattcattttattaacaatgctcttgcttatagcgtgttaatcagtacaatgatgaataac

SEQ ID NO: 414 - protein, 225 aa, Streptococcus agalactiae
MEVFVSFIIRKGKILALLIAFLVINQLVPILAVWLLKNHYQTPFTSILLIGLELLIIALFLYYAKVKQIIRWKALLTRKALVTILLGWLSLRVPQIIGYLIMTMQGVKDTANQTVIMELTKQLPLALMLIFAIIGAPIMEEIIFRYIIPKELFAKHQKWGFVIGTLAFALIHSPSDIGSFIIYAGMGAILSFVYYKTEHLEYSIMIHFINNALAYSVLISTMMNN

SEQ ID NO: 415 - DNA, 693 bp, Streptococcus pyogenes
atgaaaggattcattaattatttaaaaatagcagtgctcattattctggctatggttttcaatgtccttccgatgattttattgcaaaagcaacacgatattcctatggtacttaattggggaattggtattttctacttggttattgttggaagtgtccttattgtattatggggtctttatcaagctaagcaagacacttttattaaacagcaaaaaatgagattggttgactggggttatttagcattattttggttaatcatccgtgtgatagctattgtaggtacccttgttaaccagctatggtctggtcaacaagtgagtgctaatgatgctgcaatacataccttagctagacttatcaaaggtggtttcccgctttatactgccctatttgtacttgtgatagcttttatcgctcctattatggaagaactagtctttagaggatttcctatgattgatctcttcaaaggaaaatcacttaaggtggcaggtttagtgacctctcttgtttttgctttaccacatgccaccaatagtgttgaatttatcatgtacagctgtatgggcatttttctctttgttgcctatcaaagacgaggaaacttaaaagatgctatcttgttacatatttttaataacttgattgaagtcattttgttaatgtcaataggcttaggagtcata

SEQ ID NO: 416 - protein, 231 aa, Streptococcus pyogenes
MKGFINYLKIAVLIILAMVFNVLPMILLQKQHDIPMVLNWGIGIFYLVIVGSVLIVLWGLYQAKQDTFIKQQKMRLVDWGYLALFWLIIRVIAIVGTLVNQLWSGQQVSANDAAIHTLARLIKGGFPLYTALFVLVIAFIAPIMEELVFRGFPMIDLFKGKSLKVAGLVTSLVFALPHATNSVEFIMYSCMGIFLFVAYQRRGNLKDAILLHIFNNLIEVILLMSIGLGVI

SEQ ID NO: 417 - DNA, 768 bp, Streptococcus agalactiae
atgaaaattggaattatcggcgtcggaaaaatggccagtgcaattattcaaggcctcaaacaaacccaacatgacattatcatatccggatcttgcttagagcgttcaaaagaaattgcagaaagacttgatgttacttacgccgaatctcatcagtcattaatcaatcaagctgatattatcatgttaggtattaaacctcaactatttgaaaaggttcttcttccacttgatatcacaaaaccaatcatctcaatggcagcaggaatctccttagcgcgtttaagccaattaactcgttctgatttaccattgattcgtattatgccaaatattaacgcacaaatacttcaaagttgcacagctatttgttacaacaatcatgtatcagatgagttacgacaattagccaaagaaattacggatagttttggaagtagctttgatatagcagaaaccaattttgataccttcactgctctagcaggttctagccctgcctatatctatctatttatagaagccttagctaaagcaggtgtaaaatatggatttccaaaagaacaagcactctctattgtaggacagactgtcttagcttctagtcaaaacctattacaaggacaaaatagcacctctgacttaatcgacaacatttgtagcccaggcggaactactattgctggccttttagacttagaaaaaaatggtctgacgcatagtgttatttctgccattgatgctactattgagaaagcaaaaaaactt

SEQ ID NO: 418 - protein, 256 aa, Streptococcus agalactiae
MKIGIIGVGKMASAIIQGLKQTQHDIIISGSCLERSKEIAERLDVTYAESHQSLINQADIIMLGIKPQLFEKVLLPLDITKPIISMAAGISLARLSQLTRSDLPLIRIMPNINAQILQSCTAICYNNHVSDELRQLAKEITDSFGSSFDIAETNFDTFTALAGSSPAYIYLFIEALAKAGVKYGFPKEQALSIVGQTVLASSQNLLQGQNSTSDLIDNICSPGGTTIAGLLDLEKNGLTHSVISAIDATIEKAKKL

SEQ ID NO: 419 - DNA, 768 bp, Streptococcus pyogenes
atgaaaattggcattattggtgttggcaaaatggctagcgctatcatcaaaggccttaaacaaacaccccatgaacttatcatttcaggatcatctttagaacggtccaaggaaattgcggagcagttagcactgccttatgctatgtcccaccaagaccttattgaccaggttgatcttgttattttaggcatcaagcctcaactatttgaaacggtactcaaaccgcttcacttcaaacagcctattatatctatggcagcaggcatttcccttcaacgactagcaacattcgtaggacaagaccttccgctgctacgtatcatgccaaacatgaatgcacaaattctccaaagcagtaccgctttaacgggaaatgctttggtgtcccaggaattacaagcacgtgttcgagacttaacagatagctttggtagcacatttgatattagtgaaaaggattttgacacctttaccgctttagcagggtcaagtcctgcctatatttatctctttattgaggctttggctaaggctggcgtcaagaatggcatacctaaagcaaaggcgctggagattgttactcaaacagtattggctagcgccagcaatctcaagaccagttctcaaagtccgcacgatttcattgacgctatttgtagccccggtggcacaactattgctggtctgatggagttagaacgccttggcctcacagctactgtcagctctgccattgacaaaaccatcgataaagctaaaagcttg

SEQ ID NO: 420 - protein, 256 aa, Streptococcus pyogenes
MKIGIIGVGKMASAIIKGLKQTPHELIISGSSLERSKEIAEQLALPYAMSHQDLIDQVDLVILGIKPQLFETVLKPLHFKQPIISMAAGISLQRLATFVGQDLPLLRIMPNMNAQILQSSTALTGNALVSQELQARVRDLTDSFGSTFDISEKDFDTFTALAGSSPAYIYLFIEALAKAGVKNGIPKAKALEIVTQTVLASASNLKTSSQSPHDFIDAICSPGGTTIAGLMELERLGLTATVSSAIDKTIDKAKSL

SEQ ID NO: 421 - DNA, 1065 bp, Streptococcus agalactiae
atgtcagatttatttaacaaaattaaaaccgtaactgagcttgatgggattgctggctatgaacacaatatccgcaacttccttcgtcaagaaataactcctttagttgatcaagttgagacagacggacttggtggaatttttggagttaaaaatactcatgagactaatgctcctaaagtcatggttgctgcccatatggatgaagtcggctttatggttagtcatattcagccagatggaacatttcgtgtacttgaggttggaggatggaatcccctagtagtcagctcacaacgctttaccctctacacacgttctggtgatgctattcctgttatatcaggctcagttcctcctcactttcttcgtggacaaagcggtggaacaacattacccaaaattagtgacattgtttttgatggaggattcacagataaaaatgaagctgaaagctttggcattgctcctggcgatatcattgttcctaaatctgaaaccattttaactgcaaatcaaaaacatattatgtcaaaagcttgggataatcgctatggtgtgcttatggtgaccgaattgctaaaaagcttaaaagatcaaagtcttagcaacacacttattgctggggcaaatgttcaagaagaagtcggacttcgtggcgcacatgtttcaacaactaaattcaacccagatatcttcttagctgtcgattgttccccagctggagatatttatggggaacaaggcaaaataggagagggaaccttaatccgtttttatgatcccggacatatcatgcttaaagatatgagagatttcttacttacaacagctgaagaagcaggtataaaataccaatattatgctgcaaatggtggtaccgatgctggggctgctcacctaaaaaatagtggtattccttctacaactatcggtgtctgtgcacgctacattcattctcatcaaacactctacgctatggatgattttctacaagcacaagcttaccttcaggccatcgttaacaaattagaccgctcgacggtggatattattaaaggttat

SEQ ID NO: 422 - protein, 355 aa, Streptococcus agalactiae
MSDLFNKIKTVTELDGIAGYEHNIRNFLRQEITPLVDQVETDGLGGIFGVKNTHETNAPKVMVAAHMDEVGFMVSHIQPDGTFRVLEVGGWNPLVVSSQRFTLYTRSGDAIPVISGSVPPHFLRGQSGGTTLPKISDIVFDGGFTDKNEAESFGIAPGDIIVPKSETILTANQKHIMSKAWDNRYGVLMVTELLKSLKDQSLSNTLIAGANVQEEVGLRGAHVSTTKFNPDIFLAVDCSPAGDIYGEQGKIGEGTLIRFYDPGHIMLKDMRDFLLTTAEEAGIKYQYYAANGGTDAGAAHLKNSGIPSTTIGVCARYIHSHQTLYAMDDFLQAQAYLQAIVNKLDRSTVDIIKGY

SEQ ID NO: 423 - DNA, 1065 bp, Streptococcus pyogenes
atgacagacttattctcaaaaatcaaagaagttaccgaactggatggcattgcgggctatgaacatagcgttcgtgactacctacgcaccaaaataaccccgctggttgaccgtgttgaaacagacgggcttggtggcatttttggtatcagagatagtaaagctgaaaaagccccccgtattttagtagctgcgcacatggacgaagtcggttttatggtcagtgatatcaaagttgacggaacgctacgcgtggttggtatcggtggttggaacccacttgttgtcagttcacaacggtttaccctttacacacgcactggccaagttattccccttatttcaggatcggtacctccccattttttacgtggggcaaatggctctgctagtctaccacatatcgaagatattgtgtttgatggtggctttacggataaggcagaagctgaaagatttggtattacaccgggtgatattattatccctcaatctgaaacgatcctaacagccaatcaaaaaaatattatttcaaaagcttgggacaatcgctatggcgttctcatgataacagaaatgcttgaagcgttaaaaggacaagaccttaacaacaccctaattgcaggtgctaacgttcaagaagaagttggtctgcgcggagcccacgtctcaaccaccaagttcgaccctgaactctttttcgcagtagattgttcgcctgctggtgatatttatggcaatcctggaacaatcggagatggtaccttgttgcgtttctacgacccaggccatgtcatgctcaaagatatgcgcgacttcttactgactactgctgaggaagctggtgtcaatttccaatactattgtggcaagggaggcacagatgcaggtgctgcacaccttcaaaatggtggtgtcccatcaacaaccatcggagtctgtgcacgctacattcactctcatcaaaccctctacgctatggatgatttcgtagaagcccaagccttcttacaagccattatcaaaaaactggatcgctcaaccgttgacttgattaaatgttac

SEQ ID NO: 424 - protein, 355 aa, Streptococcus pyogenes
MTDLFSKIKEVTELDGIAGYEHSVRDYLRTKITPLVDRVETDGLGGIFGIRDSKAEKAPRILVAAHMDEVGFMVSDIKVDGTLRVVGIGGWNPLVVSSQRFTLYTRTGQVIPLISGSVPPHFLRGANGSASLPHIEDIVFDGGFTDKAEAERFGITPGDIIIPQSETILTANQKNIISKAWDNRYGVLMITEMLEALKGQDLNNTLIAGANVQEEVGLRGAHVSTTKFDPELFFAVDCSPAGDIYGNPGTIGDGTLLRFYDPGHVMLKDMRDFLLTTAEEAGVNFQYYCGKGGTDAGAAHLQNGGVPSTTIGVCARYIHSHQTLYAMDDFVEAQAFLQAIIKKLDRSTVDLIKCY

SEQ ID NO: 425 - DNA, 90 bp, Streptococcus agalactiae
atggttaatcattcaaacagaaagaaaaaacatgaaagaaaaattattagtacctgctttaaattgtttgctaggtctactcttcctagg

SEQ ID NO: 426 - protein, 30 aa, Streptococcus agalactiae
MVNHSNRKKKHERKIISTCFKLFARSTLPR

SEQ ID NO: 427 - DNA, 318 bp, Streptococcus agalactiae
gtgtctaattccggggggtatggtataataacagttatgaaaaataaaaaaatcttatttgggactggccttgctggtgtgggtttactggcagctgctggttataccctaactaaaaaagtaacagattataaacgtcagcaaatcactcagaccttaagagaattttttagtcagatgggtgatattcaggtattttattttaatgaatttgaatctgatattaaaatgaccagtggtggtcttgtcttggaagatggcagaattttcgaattcatttatcgtcaaggtgttcttgattatgtggaggtgagcaaa

SEQ ID NO: 428 - protein, 106 aa, Streptococcus agalactiae
MSNSGGYGIITVMKNKKILFGTGLAGVGLLAAAGYTLTKKVTDYKRQQITQTLREFFSQMGDIQVFYFNEFESDIKMTSGGLVLEDGRIFEFIYRQGVLDYVEVSK

SEQ ID NO: 429 - DNA, 291 bp, Streptococcus pyogenes
atgagggatatgagtaaaaagaaaataggtatgatttcaggtatctttggatttagtttagctattggcctaggaatagttatcaaagattattgccaagacaggcagcgtcgacaaatgacaagggatttacgcacctttttttcacctttaggacaaatcgaagttttatatatcaatccttgtcaggtcaaacaagattatatttcaggtggggttgttatgtcaaacggcaaacagtaccaattcacctatcacagtcgacaaattagttttgaggaggacaaggga

SEQ ID NO: 430 - protein, 97 aa, Streptococcus pyogenes
MRDMSKKKIGMISGIFGFSLAIGLGIVIKDYCQDRQRRQMTRDLRTFFSPLGQIEVLYINPCQVKQDYISGGVVMSNGKQYQFTYHSRQISFEEDKG

SEQ ID NO: 431 - DNA, 321 bp, Streptococcus agalactiae
atgattttaccagaatcttatgaagaaatagcagcctatattgatagcactaagaaagttgttttcttttttacagcagattggtgtccagattgtcaatttatatatccagtaatgccatcaattgaaaaagatttctcagattttgtctttgtacgtgttaatcgtgatgactatatagaattagctcagcagtggaatatttttgggattccgagtttcgttgttgtggaaaatggtcaggaactgggtcgtttggttaataagaatcgcaaaacaaaggctgaaattactaaatttctcgctgaaattaactataaa

SEQ ID NO: 432 - protein, 107 aa, Streptococcus agalactiae
MILPESYEEIAAYIDSTKKVVFFFTADWCPDCQFIYPVMPSIEKDFSDFVFVRVNRDDYIELAQQWNIFGIPSFVVVENGQELGRLVNKNRKTKAEITKFLAEINYK

SEQ ID NO: 433 - DNA, 315 bp, Streptococcus pyogenes
atgatcagaccgacttcttatgagtcattagcgactcttattgaaaaagaagataagctggtgttattttttacggcagactggtgtccagactgtcaatttatttatcctattatgccagaaattgaagcagaacttacagatatgacttttgtttgtgttaatcgtgatcagtttatagaggtagcacaaaagtggaatatttttggtattcctagttttgtcgtgattgaaaaaggtcaggaagtagggcgtctggttaacaaaatgagaaagacaaaaactgagattatgcattttttagctgcttatcaa

SEQ ID NO: 434 - protein, 105 aa, Streptococcus pyogenes
MIRPTSYESLATLIEKEDKLVLFFTADWCPDCQFIYPIMPEIEAELTDMTFVCVNRDQFIEVAQKWNIFGIPSFVVIEKGQEVGRLVNKMRKTKTEIMHFLAAYQ

SEQ ID NO: 435 - DNA, 624 bp, Streptococcus agalactiae
atgatttttacttataatagagagcatgttggtgataccttaatggttattgttaaggatagtcaaggagctaagctagatgttgatcgtcgcggacaagtagcacgcgtctatctgcaagatagtaaagaaacagttgcttggaatatctttgaagtgtcaagtttaattgttattgagggagcaggtcaaataactttatctgatcaagatattaaaatccttaatgcagaactactgaaagaaggattcgaagactctcttgttaataatattgaacctacatttgttgtggcgcaaattaaagaaataattgatcatccagatagtgaccatttacatatctgtcaagcagaaatcaacgatgggaagacggtccaaatcgtttgtggggcacctaatgcttcagtaggtcttaaaacagttgcagctcttccaggagctatgatgccaaatggtagccttattttcccaggaaaacttcgtggagaagatagctttggaatgttatgtagtgctcgcgagttagctcttccaaatgctcctcaagtcagaggtatcattgaattatctgatcaggtaattgttggagagtctttcgacgccaataaacattggaaaaat

SEQ ID NO: 436 - protein, 208 aa, Streptococcus agalactiae
MIFTYNREHVGDTLMVIVKDSQGAKLDVDRRGQVARVYLQDSKETVAWNIFEVSSLIVIEGAGQITLSDQDIKILNAELLKEGFEDSLVNNIEPTFVVAQIKEIIDHPDSDHLHICQAEINDGKTVQIVCGAPNASVGLKTVAALPGAMMPNGSLIFPGKLRGEDSFGMLCSARELALPNAPQVRGIIELSDQVIVGESFDANKHWKN

SEQ ID NO: 437 - DNA, 624 bp, Streptococcus pyogenes
atgatttttgcatacaataaagaacaagttggcgatgtcttgatggttatcttacaagacaccaaagatatcaaacgtcaagtagaacgaaaaggcaaagtagcccgtgtttttgcagaagaaagcggcaaaacccttgcttggaatatctttgaagcgtcaagcttgattactattgaaggcaatggacagatttttttgacagacgagaaccttgcaagattaaatgcagagcttgctaaggaaggattttcagaaaggcttgaaccgattgtgggacctgtttttgtggttggtcaaattgttgagatggtggctcatccagatagcgaccatcttaatatctgccaagtggctattggtgaagatcaaacggttcaaatcgtagcgggcgcaccaaatgctgcgcttggtttaaaaacgattgttgccttaccaggtgctataatgccaaatggtagtctgattttcccaggaaaattgcgtggtgaagaaagttatggtatgatgtgctctcctcgtgagttagccttgccaaatgcaccgcaaaaacgtggcattattgaatttgatgagtcagctgtggtaggagaagcttttgacccagccaaacattggaaaggt

SEQ ID NO: 438 - protein, 208 aa, Streptococcus pyogenes
MIFAYNKEQVGDVLMVILQDTKDIKRQVERKGKVARVFAEESGKTLAWNIFEASSLITIEGNGQIFLTDENLARLNAELAKEGFSERLEPIVGPVFVVGQIVEMVAHPDSDHLNICQVAIGEDQTVQIVAGAPNAALGLKTIVALPGAIMPNGSLIFPGKLRGEESYGMMCSPRELALPNAPQKRGIIEFDESAVVGEAFDPAKHWKG

SEQ ID NO: 439 - DNA, 714 bp, Streptococcus agalactiae
atgacaaatgtaactagttataaagaaatgctggctaaaccttggggaaaaatacaatatgaaataacttttgctcaattaagccatatcaaaaatcagaacgttttagattttggagctggtttttgtctcaccgaacaacatctagcaaaagaaaacaatgtaactgctattgaacccaatcctaaactgctttacgataatcaaagtgacaatatttataaaatcctaggttcctacgaagcattaagagatttgcctgatcaaagctttgatactattatttgtcataatgttcttgaatatatagacaaacataatcatcctgcttattttgacgaattttctcgacttctaaaacccaatggagaactatctctcatcaaacataatataaccggtaaaatattacaatcagttatttttagcaatgatacctccactgcgatggaactcttaacaggagaagcaaactttaaaagtgccagttttgaccagggaaatatttataccttagaagaactaaaacaaaatacaaatttattagttgaacgttatcagggtattcgtaccttctattcattacaaccaaaccattttaaaactgaaactggttggctaaacaaaatgcttgctatcgagctaagtgttgctgacaaagctccttataaagatattgcttttttgcaacacatcacacttaaaaagtcattg

SEQ ID NO: 440 - protein, 238 aa, Streptococcus agalactiae
MTNVTSYKEMLAKPWGKIQYEITFAQLSHIKNQNVLDFGAGFCLTEQHLAKENNVTAIEPNPKLLYDNQSDNIYKILGSYEALRDLPDQSFDTIICHNVLEYIDKHNHPAYFDEFSRLLKPNGELSLIKHNITGKILQSVIFSNDTSTAMELLTGEANFKSASFDQGNIYTLEELKQNTNLLVERYQGIRTFYSLQPNHFKTETGWLNKMLAIELSVADKAPYKDIAFLQHITLKKSL

SEQ ID NO: 441 - DNA, 393 bp, Streptococcus agalactiae
atgtataataaagttattatgattgggcgtctaacagcaaagcctgagatggtaaaaacaccaactgacaagtcagtgacgcgtgcaactgttgctgttaatagacgctttaaaggaagtaatggtgagcgtgaagcagattttattaatgtggttatgtggggtcgtctagcggaaacccttgcgagctatgggacaaagggctctttaatttcaatagatggtgaattgcgtacgcgcaagtacgaaaaggatggtcaaacgcactatatcactgaagtattagcatcatcatttcagttgctagaaagccgtgcccaacgtgctatgcgtgaaaataacgtttctggtgatttgtcagatttagtattggaagaagaggagctccccttt

SEQ ID NO: 442 - protein, 131 aa, Streptococcus agalactiae
MYNKVIMIGRLTAKPEMVKTPTDKSVTRATVAVNRRFKGSNGEREADFINVVMWGRLAETLASYGTKGSLISIDGELRTRKYEKDGQTHYITEVLASSFQLLESRAQRAMRENNVSGDLSDLVLEEEELPF

SEQ ID NO: 443 - DNA, 393 bp, Streptococcus pyogenes
atgtataataaagtgatagcaatcggtcgtttggtagctaaaccagaattggtaaaaacagctacggataagcatgtagcacgtctctctttagctgttaatcgaagatttaaaaatgcttctggagagcgagaagctgattttatttcagttgttgtttggggaaagttagcagaaactctggtttcttatgctagcaaaggtagtttgatgtctattgatggcgaacttaggacccgcaagtatgataaagatgggcaagtgcattatgtgacagaagttctctgccaatcatttcaactgcttgaaagtcgtgctcagcgcgctatgagagaaaataatgttactaatgatctagttgatttagtcttagaagaagatactcttcccttt

SEQ ID NO: 444 - protein, 131 aa, Streptococcus pyogenes
MYNKVIAIGRLVAKPELVKTATDKHVARLSLAVNRRFKNASGEREADFISVVVWGKLAETLVSYASKGSLMSIDGELRTRKYDKDGQVHYVTEVLCQSFQLLESRAQRAMRENNVTNDLVDLVLEEDTLPF

SEQ ID NO: 445 - DNA, 726 bp, Streptococcus agalactiae
ttgcttttcacagaaagcaacctttttttattgaaaatagaaaggcaaacgattacaataaaggggatagaaagcaggtttaagatggaaaaagtcattatttttgatatggacggcgttattgttgattccgagtacacgtttttagataataagacagaaatgttacgtgaggagggtattgatacggacgtctcgtatcaataccagtacatggggactacttttgaattcatgtggcaagctatgaaagaggagtttggcttaccgaaaacagtaaaagagtatattgctgagatgaacagacgtcgacaagcgattgtggcgcgtgatggtgttaggcccatcaaaggagctcagcgactgattcattggttacaccaacatggctatcgcttagcagttgcgtcctcatctccaatggtagatattaagcgtaatctaaaagagttgggtgtgacagaatgctttgaatacatggttacaggagaagatgtatcgtcttctaaaccagcaccagatgtttttcttagagctgcagagcttttagatgtagaccctaaagtttgtatagttatagaagatacaagaaatgggagtttagctgctaaggcagcaggaatgtattgctttggctttgctaatcctgattatccaccgcaagatttatcaatggcagacaaggttatttcagattatcaagatatctatatttatcttccggag

SEQ ID NO: 446 - protein, 242 aa, Streptococcus agalactiae
MLFTESNLFLLKIERQTITIKGIESRFKMEKVIIFDMDGVIVDSEYTFLDNKTEMLREEGIDTDVSYQYQYMGTTFEFMWQAMKEEFGLPKTVKEYIAEMNRRRQAIVARDGVRPIKGAQRLIHWLHQHGYRLAVASSSPMVDIKRNLKELGVTECFEYMVTGEDVSSSKPAPDVFLRAAELLDVDPKVCIVIEDTRNGSLAAKAAGMYCFGFANPDYPPQDLSMADKVISDYQDIYIYLPE

SEQ ID NO: 447 - DNA, 654 bp, Streptococcus pyogenes
atgttgatgattaaaggaattatttttgatatggacggtgttttatttgatacagaacctttttatctgaggcgacgagaagatttttttaagacaaagggaattcccattgatcatttgaactctaaagattttattgggggcaatcttcaagaattatggaaagagttgttaggtaaaaatagggatgatgctatcgttaaggcaattacaactgactatgacgcttacaaacaagcgcataagcctccttatcaaaaactgttgattacagaagtgaactcttgtcttgaacagttggaaaaacaaggtattaaactggctgtggcatcaaactcgaagcgtcaggatgttttgttggcgttggagacaacgcaaataaaagattattttgaaataatcctagcgcgtgaagatgtttctagaggcaaaccttatccagatatttataataaagcagtacaaaaactaggattacaaaaaaaacaactgcttgtagtagaggacagccaaaaaggcattgctgccgccaaagcagccaatctgacagtttttgccattaccgactaccgatatggcattgatcagagtcaagctgatcacaagatagatcatttaggacaactgtgtgtaaaaatcggttgttttggatcg

SEQ ID NO: 448 - protein, 218 aa, Streptococcus pyogenes
MLMIKGIIFDMDGVLFDTEPFYLRRREDFFKTKGIPIDHLNSKDFIGGNLQELWKELLGKNRDDAIVKAITTDYDAYKQAHKPPYQKLLITEVNSCLEQLEKQGIKLAVASNSKRQDVLLALETTQIKDYFEIILAREDVSRGKPYPDIYNKAVQKLGLQKKQLLVVEDSQKGIAAAKAANLTVFAITDYRYGIDQSQADHKIDHLGQLCVKIGCFGS

SEQ ID NO: 449 - DNA, 102 bp, Streptococcus agalactiae
ttggtggacctctggttggatcaattgttggttttattggaggagttcatcgcttttttcaaggaagcttttcaggttctttctatattgtcagttcagttc

SEQ ID NO: 450 - protein, 34 aa, Streptococcus agalactiae
MVDLWLDQLLVLLEEFIAFFKEAFQVLSILSVQF

SEQ ID NO: 451 - DNA, 138 bp, Streptococcus agalactiae
gtggaacctaaactatttaaaatcatcattggaatgacaatcattttgacaagttcccatcctgtaaaaatgccaacaaatagcatctggatactttcggcaataatactaattaaaataacttggcttgttgaaggg

SEQ ID NO: 452 - protein, 46 aa, Streptococcus agalactiae
MEPKLFKIIIGMTIILTSSHPVKMPTNSIWILSAIILIKITWLVEG

SEQ ID NO: 453 - DNA, 1743 bp, Streptococcus agalactiae
atgttgatggtgttgttattccaaaggctaggaattattatgattttagcctttttattggtaaataatagttattttagacagttaattgaagagcggtctaaacgtgaaacggtagtccttgtcatcattttcggcttgtttgttattatatctaatataacaggaattgaaataaaaggggatcgaagtttggtcgagcgcccttttctaacaacgatttctcattctgactcacttgctaatacaaggactttagttattacaacggcaagtttggttggtggacctctggttggatcaattgttggttttattggaggagttcatcgcttttttcaaggaagcttttcaggttctttctatattgtcagttcagttctagtcggcattgttagcggaaagattggtgataagcttaaggaaaaccatctctacccttcaacaagccaagttattttaattagtattattgccgaaagtatccagatgctatttgttggcatttttacaggatgggaacttgtcaaaatgattgtcattccaatgatgattttaaatagtttaggttccacacttttccttgcgattttgaaaacttatttgtcaaatgaaagtcagttacgcgcagttcaaacgagagatgttcttgaattgactcgacagactctgccctaccttagacaaggtttgacaccgcaatctgctaggagcgtttgcgaaattataaagaggcatactaactttgatgctgtgggattaacagatcggtcaaacgtattagctcatattggtgttggccatgatcaccatattgcaggacaaccggtcaaaacagacttatctaaaagtgttatttttgatggcgaaccaagaattgcgcaagataaagcggcgatttcttgtccagatcacaactgtcagttaaattctgctattgtagttcctctaaaaataaatgataaaactgtgggtgccttaaaaatgtactttgcaggagataagacaatgtctgaggtggaggaaaacctagtccttggtttagcgcaaatattttcaggacaactggcaatggggataacagaggaacaaaataagttagccagtatggcagagataaaggctttacaagcacaaatcaaccctcatttcttctttaatgccattaacacaattagtgcattaatccgtattgattctgataaagcacgttatgcactgatgcagttaagtactttttttagaacaagtttgcagggtggtcaggatcgtgaggtaacgcttgagcaagaaaaatcacatgtggatgcttatatgaatgttgaaaaattacgtttccctgataaatatcagttatcttatgatattagtgcaccagaaaaaatgaagttaccaccttttggtttacaggtactggtagagaatgcagttcgacatgctttcaaagaacgtaagacggacaaccatatattggttcaaataaagccagatggtcattattattgtgtttctgttagtgacaatggacaaggaatctcagatactatcattgataaattaggtcaagaaacagttgcagagagtaagggtacaggtactgctctagttaatctaaataacaggctgaatttattatatggtagtgtaagttgccttcatttttcgagcgacaagaatggtacaaaagtttggtatcgaatacctaatagaataagggaggatgagcatgaaaattttaattct

SEQ ID NO: 454 - protein, 581 aa, Streptococcus agalactiae
MLMVLLFQRLGIIMILAFLLVNNSYFRQLIEERSKRETVVLVIIFGLFVIISNITGIEIKGDRSLVERPFLTTISHSDSLANTRTLVITTASLVGGPLVGSIVGFIGGVHRFFQGSFSGSFYIVSSVLVGIVSGKIGDKLKENHLYPSTSQVILISIIAESIQMLFVGIFTGWELVKMIVIPMMILNSLGSTLFLAILKTYLSNESQLRAVQTRDVLELTRQTLPYLRQGLTPQSARSVCEIIKRHTNFDAVGLTDRSNVLAHIGVGHDHHIAGQPVKTDLSKSVIFDGEPRIAQDKAAISCPDHNCQLNSAIVVPLKINDKTVGALKMYFAGDKTMSEVEENLVLGLAQIFSGQLAMGITEEQNKLASMAEIKALQAQINPHFFFNAINTISALIRIDSDKARYALMQLSTFFRTSLQGGQDREVTLEQEKSHVDAYMNVEKLRFPDKYQLSYDISAPEKMKLPPFGLQVLVENAVRHAFKERKTDNHILVQIKPDGHYYCVSVSDNGQGISDTIIDKLGQETVAESKGTGTALVNLNNRLNLLYGSVSCLHFSSDKNGTKVWYRIPNRIREDEHENFNS

SEQ ID NO: 455 - DNA, 723 bp, Streptococcus pyogenes
ttgacagaccttgcccaacagtttaatgcgctcttagatcaaattgatagcttgatggttgccgttgcggataaggaaaaggcgattgggcagtataggttacaagccttggctagtcagattaacccgcattttctctataacaccttggacactattatttggatggcagaatttaatgacagcaagcgcgtggtagaagtgaccaagtctctagctaagtattttcgtttggcccttaatcaggggaacgaatacattcgtttggcagatgaactggatcacgttagccaatacctctttattcaaaaacagcgctatggagacaagctaagttatgaagtgcaaggcttagatgtctacgcagactttgttattcctaagcttatcttacagcccttagtagaaaatgctatctaccatggcatcaaagaagtcgatcgcaagggcatgatcaaggttacggtatctgatacagctcagcatctgatgttgactgtttgggataatggtaaaggcattgaagactcttcactgaccaatagtcagagcttgttggctaggggaggtgtgggccttaaaaatgttgaccagcggttaaaacttcactatggtgaaggctaccacatgaccattcatagccagtcagaccagttcactgaaatacaattaagccttcctaaaatgcatgaattaatggcagacgacacacaggaaaacgag

SEQ ID NO: 456 - protein, 241 aa, Streptococcus pyogenes
LTDLAQQFNALLDQIDSLMVAVADKEKAIGQYRLQALASQINPHFLYNTLDTIIWMAEFNDSKRVVEVTKSLAKYFRLALNQGNEYIRLADELDHVSQYLFIQKQRYGDKLSYEVQGLDVYADFVIPKLILQPLVENAIYHGIKEVDRKGMIKVTVSDTAQHLMLTVWDNGKGIEDSSLTNSQSLLARGGVGLKNVDQRLKLHYGEGYHMTIHSQSDQFTEIQLSLPKMHELMADDTQENE

SEQ ID NO: 457 - DNA, 744 bp, Streptococcus agalactiae
atgagcatgaaaattttaattcttgatgatgaaatgtttgccagacaagaattatcgtttttagttgaacatagccaggaggttgacaaccctgagatttttcaggctgaggatatcagtgaagccgaaaaaatcttatttagacagcaaattgatttaatttttttagatatttcgcttagtgaagaaaatggctttactttggctaatcagttgagccaacttgcacatcccccacttgttgtttttgcgacagcttatgataactacgctgtgaaagcttttgaaagtaacgctgttgattatatcatgaaaccgtttgaacaacagcgcgttgatatggctctatcaaaagtgaagaaattgagccaactcaccactgcttcagatgtagagcaagcaatacctaaaaaagccagtgttgaattgttaaccttgacattatcagatcgcagtgttgttgttaaaatgcaagatattgttgcagctagtgttgaagatggcgaattaactgttagtacagttcagaaaacttacactattcggaagacactcaattggtttaagtcacgcgctgtagcaccatattttctccagattcatcgaaacacagtgattaatctagagatgattgaggaaattcaaccttggtttaatcatactttgttactaattatgtctaatggagagaaatttccagtaggtcgatcgtatttaaaagacctaaatgagcatttaaccatg

SEQ ID NO: 458 - protein, 248 aa, Streptococcus agalactiae
MSMKILILDDEMFARQELSFLVEHSQEVDNPEIFQAEDISEAEKILFRQQIDLIFLDISLSEENGFTLANQLSQLAHPPLVVFATAYDNYAVKAFESNAVDYIMKPFEQQRVDMALSKVKKLSQLTTASDVEQAIPKKASVELLTLTLSDRSVVVKMQDIVAASVEDGELTVSTVQKTYTIRKTLNWFKSRAVAPYFLQIHRNTVINLEMIEEIQPWFNHTLLLIMSNGEKFPVGRSYLKDLNEHLTM

SEQ ID NO: 459 - DNA, 738 bp, Streptococcus pyogenes
gtgtactcattgttaattgtagaagacgaataccttgtgcgccagggtattcgttctttggttgattttagccagttcaagattgatcgggtcaacgaagcagaaaatggccagttggcttgggacttgtttcagaaagagccttatgatattgttttgacggatatcaatatgcccaaattaaatgggattcaactagcagaactcattaaacaggaatccccccaaactcatctggtatttttgacgggctacgatgattttaactatgccttatctgctttgaaattaggggcagatgattacttgctcaaacccttttccaaggcagatgtagaagacatgttaggaaagctccggaaaaaattagaactttccaagaaaacagaaaccattcaggaattggttgagcagcctcaaaaagaagtatcagcaatagcaatggctattcatgagcggttggcagattctgatttgaccctaaaaagcttggctcagcagcttggttttagccctaattaccttagcgtcttgattaaaaaagagttagggatgccctttcaagattatctggtacaagaacggttgaaaaaagccaagcttctcttgttaaccagtaatcttaaaatctatgaaattgcagagcaggtcggttttgaggacatgaattatttttctcagcgctttaagcaactggtaggcgttaccccaagtcagtataaaaaaggaggccaggca

SEQ ID NO: 460 - protein, 246 aa, Streptococcus pyogenes
VYSLLIVEDEYLVRQGIRSLVDFSQFKIDRVNEAENGQLAWDLFQKEPYDIVLTDINMPKLNGIQLAELIKQESPQTHLVFLTGYDDFNYALSALKLGADDYLLKPFSKADVEDMLGKLRKKLELSKKTETIQELVEQPQKEVSAIAMAIHERLADSDLTLKSLAQQLGFSPNYLSVLIKKELGMPFQDYLVQERLKKAKLLLLTSNLKIYEIAEQVGFEDMNYFSQRFKQLVGVTPSQYKKGGQA

SEQ ID NO: 461 - DNA, 345 bp, Streptococcus agalactiae
gtgacactgagttctctgatagcaagtattaatcgtgcaacatatgctaccactaccaacataacaacagttgagattgtaataacagcaactagttgcaagccttcagcttttaggatatcaagattcgctgctactgatattcctgaggggacaaacataaaaccaatcatgcttatcatcaaagccccaaaagagtcaacccactctaccttgataattttagcagttagcaatacatacattagcaccaaaccaataaccgtcgttgggattggtagtgatttcggtaataacattgaaatcatttgtgaaactaatagaatagctgcatatattgacatt

SEQ ID NO: 462 - protein, 115 aa, Streptococcus agalactiae
MTLSSLIASINRATYATTTNITTVEIVITATSCKPSAFRISRFAATDIPEGTNIKPIMLIIKAPKESTHSTLIILAVSNTYISTKPITVVGIGSDFGNNIEIICETNRIAAYIDI

SEQ ID NO: 463 - DNA, 459 bp, Streptococcus agalactiae
gtgactatgaaacacaccagtaaagaaaccaaaacaaaagaagctccaatgtttattcaaatgtcaatatatgcagctattctattagtttcacaaatgatttcaatgttattaccgaaatcactaccaatcccaacgacggttattggtttggtgctaatgtatgtattgctaactgctaaaattatcaaggtagagtgggttgactcttttggggctttgatgataagcatgattggttttatgtttgtcccctcaggaatatcagtagcagcgaatcttgatatcctaaaagctgaaggcttgcaactagttgctgttattacaatctcaactgttgttatgttggtagtggtagcatatgttgcacgattaatacttgctatcagagaactcagtgtcacagatttatttaaaaagatattacctaaccactatagtaagaaagtagaggaaaaa

SEQ ID NO: 464 - protein, 153 aa, Streptococcus agalactiae
MTMKHTSKETKTKEAPMFIQMSIYAAILLVSQMISMLLPKSLPIPTTVIGLVLMYVLLTAKIIKVEWVDSFGALMISMIGFMFVPSGISVAANLDILKAEGLQLVAVITISTVVMLVVVAYVARLILAIRELSVTDLFKKILPNHYSKKVEEK

SEQ ID NO: 465 - DNA, 726 bp, Streptococcus agalactiae
atggaactcttaaaaacacccatctttggtatttgcttttctttaatactctatacgataggagaacatttatttaagaagagtaaaggtttcttccttttgcagcctcttttctttgcaatggttagtggtattgtcattctttggcttatgtcaaaaggtttaggaaccgatgttaagacattttatacacaagcttataaaccaggtggtgatttaatattttggtttttaaatccagcgacaattgcttttgcagttcctctctataagaaaaatgacgttgttaaaaaatattgggtagaaattctcagcagtttagtaatcggtatgattgtttcccttatacttatcgtcgctatttctaaaatggttgggcttagtcaagtcggaattgcttcaatgttgccacaagcagcaacaacagcaattgctcttccaataacagcagcaattggagggaacacagctgtgacagcaatggcgtgtatcttaaatgcagttattatttatgcattaggtaaaaaattagtgtcatttttccatttgaatgatagtaagattggtgcaggattaggtctagggacctctggtcatacagtcggagcagcctttgcattggaattgggagaactgcaaggtgcgatggcagctatagctgtggtggttatcggtttggtagttgatttggttattcctatctttagtcatttgattggtttgcta

SEQ ID NO: 466 - protein, 242 aa, Streptococcus agalactiae
MELLKTPIFGICFSLILYTIGEHLFKKSKGFFLLQPLFFAMVSGIVILWLMSKGLGTDVKTFYTQAYKPGGDLIFWFLNPATIAFAVPLYKKNDVVKKYWVEILSSLVIGMIVSLILIVAISKMVGLSQVGIASMLPQAATTAIALPITAAIGGNTAVTAMACILNAVIIYALGKKLVSFFHLNDSKIGAGLGLGTSGHTVGAAFALELGELQGAMAAIAVVVIGLVVDLVIPIFSHLIGLL

SEQ ID NO: 467 - DNA, 1626 bp, Streptococcus agalactiae
gtgactaaatatttgaagtacatctcttttgttgctttgtttctggcgagtatctttttagtagcttgtcaaaatcaaaattcacaaaccaaggagcgaacgcgaaaacaacgacccaaagatgaattggttgtttctatgggggcaaagcttcctcatgaattcgatccaaaggaccgttatggaatccataatgaaggtaatattactcatagcaccctattgaaacgttctcctgaactagatataaaaggagagcttgctaaaaaatataaaatctctaaggatggcttaacgtggtcgttcgacttaaatgatgattttaaattctccaatggtgagcctgttactgctgacgatgttaagtttacttatgatatgttgaaagcagatggaaaagcttgggatttgacctttattaagaatgttgaagtagttgggaaaaaccaggtaaatattcatttgactgaggcgcattcgacatttacagcacagttgacagaaatcccaatcgtccctaaaaaacattacaatgataagtataagagcaatcctatcggttcaggaccttacatggtgaaagaatataaggctggagaacaagcaatcttcgttcgaaatccctattggcacggtaaaaagccttattttaaaaagtggacttgggtattacttgatgaaaatacagcactagctgctttagaatctggtgatgttgacatgatttacgcaacgccagagcttgctagcaagaaagtcaaaggaacacgtcttctagatattgcttcaaacgacgttcgcggactgtcattgccttatgtgaagaaaggtgttgtgaaaaattcaccagacggttatccagtaggaaatgatgtcactagtgatccagcaatcagaaaagccttgactattggtttaaatagacaaaaagttctggatactgttttaaatggttatggtaaaccagcttattcaattattgatagaacaccattctggaatccaaaaacagcaattaaagataataaagtagctaaagctaagcaacttttgacaaaagctggatggaaagaacaagcagacggtagccgtaaaaaaggaaatcttaaatcggaatttgacctttactaccctactaatgatcaattacgagcaaacttagccgttgaagtagcggagcaagctaaagccttaggtattactattaaactcaaggctagtaactgggatgaaatggcaactaagtcacatgattcagccttactttatgcgggaggacgtcatcatgcgcagcaattttatgaatcacattacccaagtttagctggtaaaggttggaccaatattactttttataacaatcctactgtgactaagtaccttgacaaagcaatgacatctcctgaccttgataaagctaacaaatattggaagttagctcagtgggatggcaaaacaggtgcttccactcttggagatttaccaaatgtatggttggtgagtcttaaccatacttatattggtgataaacgtatcaatgtaggtaaacaaggtgtccatagtcatggtcatgattggtcattattgactaacattgctgaatggacttgggatgaatctgctaag

SEQ ID NO: 468 - protein, 542 aa, Streptococcus agalactiae
MTKYLKYISFVALFLASIFLVACQNQNSQTKERTRKQRPKDELVVSMGAKLPHEFDPKDRYGIHNEGNITHSTLLKRSPELDIKGELAKKYKISKDGLTWSFDLNDDFKFSNGEPVTADDVKFTYDMLKADGKAWDLTFIKNVEVVGKNQVNIHLTEAHSTFTAQLTEIPIVPKKHYNDKYKSNPIGSGPYMVKEYKAGEQAIFVRNPYWHGKKPYFKKWTWVLLDENTALAALESGDVDMIYATPELASKKVKGTRLLDIASNDVRGLSLPYVKKGVVKNSPDGYPVGNDVTSDPAIRKALTIGLNRQKVLDTVLNGYGKPAYSIIDRTPFWNPKTAIKDNKVAKAKQLLTKAGWKEQADGSRKKGNLKSEFDLYYPTNDQLRANLAVEVAEQAKALGITIKLKASNWDEMATKSHDSALLYAGGRHHAQQFYESHYPSLAGKGWTNITFYNNPTVTKYLDKAMTSPDLDKANKYWKLAQWDGKTGASTLGDLPNVWLVSLNHTYIGDKRINVGKQGVHSHGHDWSLLTNIAEWTWDESAK

SEQ ID NO: 469 - DNA, 129 bp, Streptococcus agalactiae
atgactggatcaaccggtgattgttttagtaaaataaaggtcaaaattgatactccaaaaacgagtgacaaacacctaagtatcttccagataactacagtggtaatatgtttcacagataaatctcct

SEQ ID NO: 470 - protein, 43 aa, Streptococcus agalactiae
MTGSTGDCFSKIKVKIDTPKTSDKHLSIFQITTVVICFTDKSP

SEQ ID NO: 471 - DNA, 861 bp, Streptococcus agalactiae
atggcaagtgtcaattatgacacgtcactaacccctgttcagtacaaagcgattgctcaccactatggtttggataagccagctccggtccagtattttatttggttaaaaaattttatacagggacatttagggacttcactagtttatcggcaacctgttattgatattattagatcacgggcaggtgcctctttcatacttatgggactctcctgggtcttatcgggtcttattggatttatcttaggaactttatcagctttccatcaagggaaattgcttgatcgaattgtaaggtggttttcttaccttcagatatcagtaccaactttttggattgggctcatttttttattaatcttttctgtccagctggggtggttcccgattggtatttcttccccgataggtactttgagtcaagatattacgttagctgatcgtattaagcaccttattttacctgttttcacgctaagtattctaggcattgccaatgtaactcttcatactagaactaaaatgatgtcggtactttctagtgaatatgtcttatttgccagagcgcgtggggaaacggaatggcaaatttttaaaaatcattgtcttagaaatgctatcgtaccagctattacactgcatttttcctattttggagaattgtttggaggatccgttcttgctgagcaagttttctcatatccaggactagggtctaccctaactgaagcaggacttaaaagtgatacaccgctacttctagctattgtgatgatagggacattatttgtttttgcgggcaatcttattgcggatattttaaacagcataatcaatccacagttaaggagaaaagta

SEQ ID NO: 472 - protein, 287 aa, Streptococcus agalactiae
MASVNYDTSLTPVQYKAIAHHYGLDKPAPVQYFIWLKNFIQGHLGTSLVYRQPVIDIIRSRAGASFILMGLSWVLSGLIGFILGTLSAFHQGKLLDRIVRWFSYLQISVPTFWIGLIFLLIFSVQLGWFPIGISSPIGTLSQDITLADRIKHLILPVFTLSILGIANVTLHTRTKMMSVLSSEYVLFARARGETEWQIFKNHCLRNAIVPAITLHFSYFGELFGGSVLAEQVFSYPGLGSTLTEAGLKSDTPLLLAIVMIGTLFVFAGNLIADILNSIINPQLRRKV

SEQ ID NO: 473 - DNA, 819 bp, Streptococcus agalactiae
atgatattgagacgtcgaactattgttttatggcaactgggtatcgccatttctctcattcttagtattctagccttaaatctttatttccatagtactcccttgcaaaccaatgcagctttacggaaccttgctccttcattaaaccatctttttgggacagatggtttaggtagggatatgtttgtcagaacgattaaaggactttatttctctctacaagtctgcttattaggtgcccttatgggggtcattctggcgacagtttttggagtgcttgcaggtttaggaaatagcattattgataaaataatagcatggttagttgatttgtttattggtatgcctcatttgatttttatgattctcatttcttttgttgttgggaaaggtgctcaaggggtcatcattgcaacggctgttacacattggccttctttagcaaggcttatccgcaatgaagtctatcatctaaagaataaagaatttgtccaactttctaaaagtatgggaaaaacgccttattatattgtgaggcatcatatcctgcctttgattgcttctcaaattttcattggttttatcctcttatttccacatgtcatcctacatgaagcatcaatgactttcttaggatttgggctctctgccgaacaaccttcggttggtatcattctgtcagaggcagctaagcatatctctcttggaaattggtggttggttatctttccaggactttatcttattttggttgtcaatgcatttgatactatcggagaatctttaaagaaactcttttaccctcaaactgatcatttt

SEQ ID NO: 474 - protein, 273 aa, Streptococcus agalactiae
MILRRRTIVLWQLGIAISLILSILALNLYFHSTPLQTNAALRNLAPSLNHLFGTDGLGRDMFVRTIKGLYFSLQVCLLGALMGVILATVFGVLAGLGNSIIDKIIAWLVDLFIGMPHLIFMILISFVVGKGAQGVIIATAVTHWPSLARLIRNEVYHLKNKEFVQLSKSMGKTPYYIVRHHILPLIASQIFIGFILLFPHVILHEASMTFLGFGLSAEQPSVGIILSEAAKHISLGNWWLVIFPGLYLILVVNAFDTIGESLKKLFYPQTDHF

SEQ ID NO: 475 - DNA, 801 bp, Streptococcus agalactiae
atgacagaaacattattaagcattaaagacctctccatcaccttcactcaatacggaagatttttaaaaccatttcaatcaacaccgatacaagcgctgaatttagaaattaaaaaaggtgagttattagctattataggtgctagtggttcagggaagagtttattagcacatgctattatggatattcttcctaaaaatgcatctgtaacaggagatatgatttatcgtggtcaatcactaaattctaaacgcattaaacagttgcgaggaaaagatattacgttgattccacaatcagttaattatttagatccatctacgaaagtcaaacatcaggtgcgcttaggtatctcagaaaattcaaaggctactcaagaaggattgtttcaacagtttggtttaaaagaaagtgatggtgacttgtatcctttccaactttctggcggaatgctccgacgtgttttgtttacaacgtgtattagtgataaggtttctttgattattgcggatgagcccacccctggattacatccagatgctctgcaaatggttttagaccaactacgctcctttgcagataaaggaataagcgttatatttatcactcatgatattgtagcagctagtcaaattgctgatcgtattactatttttaaagagggaaaagctattgaaacagctccagctagtttctttagcggaaatggagagcagttacaaacagaatttgctagaagtttatggcgctctctcccacagcaagaatttttgaaaggagttactcatgaccttagaggc

SEQ ID NO: 476 - protein, 267 aa, Streptococcus agalactiae
MTETLLSIKDLSITFTQYGRFLKPFQSTPIQALNLEIKKGELLAIIGASGSGKSLLAHAIMDILPKNASVTGDMIYRGQSLNSKRIKQLRGKDITLIPQSVNYLDPSTKVKHQVRLGISENSKATQEGLFQQFGLKESDGDLYPFQLSGGMLRRVLFTTCISDKVSLIIADEPTPGLHPDALQMVLDQLRSFADKGISVIFITHDIVAASQIADRITIFKEGKAIETAPASFFSGNGEQLQTEFARSLWRSLPQQEFLKGVTHDLRG

SEQ ID NO: 477 - DNA, 801 bp, Streptococcus pyogenes
atgacagaaacattattaagcattaaagacctctccatcaccttcactcaatacggaagatttttaaaaccatttcaatccacaccgatccaagcgctgaatttagaagttaaaaaaggtgagttattagctattataggtgctagtggttcaggcaagagtttattagcacatgctattatggatattcttcctaaaaatgcagctgtaacaggagatatgatttatcgtggtcaatcactaacttctaaacgcatcaaacagttgcgaggaaaagaaatgacgttgattccacaatccgttaattatttagatccatctatgaaagtcaagcatcaggtgcgcttgggtatctcagaaaatgctaaggctactcaagaaggattgtttcaacagtttggattaaaagaaagtgatggtgacttgtatcctttccaactttctggcggaatgctccgacgtgttttgtttacaacgtgtattagtgatacggtttctttgattattgcggatgagcccacccctggattacatccagatgctctgcaaatggttttagatcaactacgctcctttgcagataaaggaataagcgtcatatttatcacccatgatattgtagcagctagtcaaattgcggatcgtattactatttttaaagagggaaaagctattgaaacagccccagctagcttttttagcggaggtggggagcaattacaaacagaatttgcgagacgtttatggcgcacactccctcagcaagactttttgaaaggagttactcatgaccttagaggc

SEQ ID NO: 478 - protein, 267 aa, Streptococcus pyogenes
MTETLLSIKDLSITFTQYGRFLKPFQSTPIQALNLEVKKGELLAIIGASGSGKSLLAHAIMDILPKNAAVTGDMIYRGQSLTSKRIKQLRGKEMTLIPQSVNYLDPSMKVKHQVRLGISENAKATQEGLFQQFGLKESDGDLYPFQLSGGMLRRVLFTTCISDTVSLIIADEPTPGLHPDALQMVLDQLRSFADKGISVIFITHDIVAASQIADRITIFKEGKAIETAPASFFSGGGEQLQTEFARRLWRTLPQQDFLKGVTHDLRG

SEQ ID NO: 479 - DNA, 624 bp, Streptococcus agalactiae
atgaccttagaggctaaaaagcttggcttttatcataaaaaagatcaatggctttttaaggagattaatttagaggtagcacctggtcaagttttaggtatatttggacaaagtggttgtggaaaaactagtttatccagggtgcttgcaggttttttacatcctaaatctggtgaagtattagttgatggcagtaatttgcctagcaaagcatttagacctgtacaacttattcaacaacatcctgaaaaaacgatgaatcctttatggcctatgaaaaaaagtttggaagaagcctattacccaagtcgagatttactagatgcttttggaattcaagaaaaatggctaaatcgtcgacctagtgaactctcgggaggagaattacaacgcttttcgattgtgcgttcattacatccagagactaaataccttattgcagatgaaatgactactatgttggatagcattacacaagctagtgtatggaaaagcctgttggagattgtaaaggatagaaatttaggtctcatcgttattagtcatgatttcgctatgttagagaaactttgtaaccaatgctatatgattgaagagaatcgtatcgtatctttcaatggagat

SEQ ID NO: 480 - protein, 208 aa, Streptococcus agalactiae
MTLEAKKLGFYHKKDQWLFKEINLEVAPGQVLGIFGQSGCGKTSLSRVLAGFLHPKSGEVLVDGSNLPSKAFRPVQLIQQHPEKTMNPLWPMKKSLEEAYYPSRDLLDAFGIQEKWLNRRPSELSGGELQRFSIVRSLHPETKYLIADEMTTMLDSITQASVWKSLLEIVKDRNLGLIVISHDFAMLEKLCNQCYMIEENRIVSFNGD

SEQ ID NO: 481 - DNA, 624 bp, Streptococcus pyogenes
atgaccttagaggctaaaaagcttggcttttatcataaaaaagatcaatggctttttaaggagattgatttagaggtagcacctggtcaaatcttagggatatttggacaaagtgggtgtggaaaaacgagtttatccagagtgcttgctggttttttgcagcctaaatctggtgaagtattagttgatggcagtcatttgcctaacaaagcatttagacctgtacaacttatccaacaacatcctgaacaaaccatgaatcctttatggcctatgaaaaaaagtttggaagaagcctactatccaagtcaagatttgcgagatgcttttggcattcaagaaaaatggctaaagcgtcgtcctagtgaactctcgggaggggaattgcaacgcttttcgattgtgcgttcattacatccagagacgaaataccttattgcagatgaaatgactactatgttggatagcattacacaagctagtgtatggaaaagcctgttggagattgtaaaggatagaaatttaggtctcatcattattagtcatgagtttgatatgttagaaaaactttgtgacgcgtgctatatgattgaagagaatcgtactcaactgttcaagcatacc

SEQ ID NO: 482 - protein, 208 aa, Streptococcus pyogenes
MTLEAKKLGFYHKKDQWLFKEIDLEVAPGQILGIFGQSGCGKTSLSRVLAGFLQPKSGEVLVDGSHLPNKAFRPVQLIQQHPEQTMNPLWPMKKSLEEAYYPSQDLRDAFGIQEKWLKRRPSELSGGELQRFSIVRSLHPETKYLIADEMTTMLDSITQASVWKSLLEIVKDRNLGLIIISHEFDMLEKLCDACYMIEENRTQLFKHT

SEQ ID NO: 483 - DNA, 2028 bp, Streptococcus agalactiae
atggaacaatttaaacatgatgccaaagccttgttagaggcaattgggggtaaagaaaatattagtgcagtgacacattgtgctacacgcatgcgatttgttttgaatgacagtagtaaagctaaggtaaaggtaattgaggagttaccatcagtcaagggtacctttaccaatgctgggcaatttcaagtcattattggtaatgatgtccctattttttataatgcttttgtagccgtttctggtattgagggtgtgtctaaagaggcggcaaaatcggctgcccaaaaaaatcaaaaccctttacagcgtgtgttgacaatgctggctgaaatatttacaccgattattccagccattattgttggtggtctgatccttggttttcgtaatattttagatgccgttccatttgaatttttaggtcaaaaagttgttgatggtgtcaggcaagtagactcttctgggcatccaatttggaatactctagtagatgtttcaacgttttggagcggagtagactcttttttatggttaccaggtgaagctatatttcatttcttaccagttggtattgtatggtctgtgactcgtaagatggggactactcaaatcctcggtattgttctaggtatctgtctagtgtcgccacaattacttaatgcttattctgtagctagtacttcagcagcagacattgctaaaaattggtcttggaattttggttactttacagtacaaaaaattggttatcaagctcaagttattccagctctgttagctggtttgagcctgtcttacttagaaatcttctggagaaaacatattcctgaagttgtttcaatgatttttgtgccatttctatccttagttccagctattatcttggctcatactgtccttggacctattggttggacactaggtaaatggatttctgctatcgttcttattggattgactggtcctgtaaaatggctctttggtgctatttttggtgccctgtatgccccatttgttattactggtttgcaccacatgacaaatgctatcgatactcaactcatagcagatacaaaaacacatacaactggcctttggccgatgattgctctttcaaatattgctcagggttcagctgtactagcttattattttatgcatcgtcatgatgaaaaagaggctcaaatatcacttccagctgctatctcagcctaccttggtgttacagagccggcgctttttggtgtaaacgttaaatacatttatccatttgttgctggtatgattggttcaagtgtggcaggtcttttggcgacaacttttaatgtccaagctaactctattggtgtaggcggtcttccaggcttcctgtcaattaacgttaaatatatgggatatttctttatctgtatggcagtggctatctttattcctttatttttgacactattctttaaaaaatcaggtattttgacaaaaactgaagaggaaaaattagtacctgatgctgtcattgcttcaacaacagaaacaaaatcagcaaaagaaaaagctgtcgtatcaggtacaaagcttagtgtagtaagccctttatcaggtttagctaaaccactggatcaagctagtgatcctgtcttttcacaaggaattatggggaagggagtggttatcgatccaagtgatggagaactagtttcaccggtcgatgcgacagtttcagttcttttccctacgaaacatgctattggattgttaacatcagagggggttgagtttcttattcatattggtatggatactgttaatttagaaggaaaagggtttacctctcatgttgctcaaggtgacactgtaaaagtaggagataaactcattactttcgatattccaatgataaaagaagaaggatacattgtggaaactcctattctgattactaatcaacaagaattccgaccagaagaattgatagatttacccaaacagataaaacgtggacaagcattaatggttgccaagaaaatt

SEQ ID NO: 484 - protein, 676 aa, Streptococcus agalactiae
MEQFKHDAKALLEAIGGKENISAVTHCATRMRFVLNDSSKAKVKVIEELPSVKGTFTNAGQFQVIIGNDVPIFYNAFVAVSGIEGVSKEAAKSAAQKNQNPLQRVLTMLAEIFTPIIPAIIVGGLILGFRNILDAVPFEFLGQKVVDGVRQVDSSGHPIWNTLVDVSTFWSGVDSFLWLPGEAIFHFLPVGIVWSVTRKMGTTQILGIVLGICLVSPQLLNAYSVASTSAADIAKNWSWNFGYFTVQKIGYQAQVIPALLAGLSLSYLEIFWRKHIPEVVSMIFVPFLSLVPAIILAHTVLGPIGWTLGKWISAIVLIGLTGPVKWLFGAIFGALYAPFVITGLHHMTNAIDTQLIADTKTHTTGLWPMIALSNIAQGSAVLAYYFMHRHDEKEAQISLPAAISAYLGVTEPALFGVNVKYIYPFVAGMIGSSVAGLLATTFNVQANSIGVGGLPGFLSINVKYMGYFFICMAVAIFIPLFLTLFFKKSGILTKTEEEKLVPDAVIASTTETKSAKEKAVVSGTKLSVVSPLSGLAKPLDQASDPVFSQGIMGKGVVIDPSDGELVSPVDATVSVLFPTKHAIGLLTSEGVEFLIHIGMDTVNLEGKGFTSHVAQGDTVKVGDKLITFDIPMIKEEGYIVETPILITNQQEFRPEELIDLPKQIKRGQALMVAKKI

SEQ ID NO: 485 - DNA, 2022 bp, Streptococcus pyogenes
atgggaaaatttgaacaggatgctaagagtcttctaactgctattggtggtaaagaaaacatcaaggttgtcacacactgtgcaacgcgtatgcgttttgttttgaatgataataataaggcaaatgtcaaagagattgaaaaaatctctgtagttaaagggacatttaccaatgctgggcagtttcaggtaatcattggtaatgatgttccagttttttataatgactttacagctgtttctagtattgaaggggtgtctaaagaagctgccaaatcagcagctaaaagtaatcaaaatgccttacaacgggtgatgaccatgttggctgagattttcacacctattattccggcgattattgttggggggcttattttaggtttccgtaatattttggagagtgtgccttttgaatttcttgggcagcaggtcgaaaaagggaaattagtttttgatgcagctggggatcctgtttggaatacgattgtgagggtatctcctttctggtcaggggttaaccatttcttgtggttaccaggggaagctattttccacttcttaccagttgggattacttggtctgtgacgcgtaagatgggaaccactcaaattttagggattgtccttggtatctgtttggtgtcaccacaattattgaatgcctatgcggtggcaggaacgcctgctgctgagattgccaaaaactgggtttgggattttggtttctttaccattaatcgtattgggtatcaggcacaggttattccagcccttttagctggtctgtcccttgcttatcttgaaattttctggcgtaaacggattccagaagtggtttcaatgatttttgtgccattcctttctttgattccagctttgattttagcgcatacggtattggggccaatcggttggactattggtaaagggatttcctttgttgtgttagctggattgactggtcctgttaaatggctattcggtgctatctttggtgccttgtatgctccgctagttattactggtttacatcacatgacaaatgccattgatacccaattaattgctgatactgcaactcgtacaactggtttgtggccaatgattgctctttcaaatatcgctcaagggtcagccgtttttgcttactatttaatgaatcgtcatgaagaacgtgaggctgaaatatcgcttcctgcagcaatttctgcttaccttggggtaactgagcctgccttatttggggttaatgttaaatacgtttatccctttgtagccggaatgattggctcaggtattgcgggtctcttatcaacaacctttaatgttcaggcaaattctattggtgttggtggtttaccaggtttcatggctatcaatgtgaagtacatgattccattcttcatctgtatggcagtagccattgtggtgccgatgtttttaaccttctttttccgtaaatcacatatcatgactaagacagaagatgaagctaaactacctgagacacccgtttcggatgctcctgtagcaactgctccacataagactatgcaaggaacagttatcactttaacaagccctttaacgggtgaagttaaagcgttgtctgaagctgttgatcctgtctttgcacagggagttatgggccaaggtgctcttcttcaaccgacagaaggggtgttagtagcgccttgtgatgctgaagtatcggtcttgttcccaactaaacacgctatttgtttggtgacgactgaaggtttggaattattgatgcatattggcatggatacggttaacttagatggtcaaggatttgaagctttggtgaagcaaggtgatcaggttaaggctggacaaacattgattcaatttgatatagcagcaatttctgaagctggatacgccactgaaacgcctcttgtggtgactaatcaagatgtttttacggtaactgttgaaggtagtttaccgcgtcagattaaggttaatgataagttagcagtagcggtgaaaaag

SEQ ID NO: 486 - protein, 674 aa, Streptococcus pyogenes
MGKFEQDAKSLLTAIGGKENIKVVTHCATRMRFVLNDNNKANVKEIEKISVVKGTFTNAGQFQVIIGNDVPVFYNDFTAVSSIEGVSKEAAKSAAKSNQNALQRVMTMLAEIFTPIIPAIIVGGLILGFRNILESVPFEFLGQQVEKGKLVFDAAGDPVWNTIVRVSPFWSGVNHFLWLPGEAIFHFLPVGITWSVTRKMGTTQILGIVLGICLVSPQLLNAYAVAGTPAAEIAKNWVWDFGFFTINRIGYQAQVIPALLAGLSLAYLEIFWRKRIPEVVSMIFVPFLSLIPALILAHTVLGPIGWTIGKGISFVVLAGLTGPVKWLFGAIFGALYAPLVITGLHHMTNAIDTQLIADTATRTTGLWPMIALSNIAQGSAVFAYYLMNRHEEREAEISLPAAISAYLGVTEPALFGVNVKYVYPFVAGMIGSGIAGLLSTTFNVQANSIGVGGLPGFMAINVKYMIPFFICMAVAIVVPMFLTFFFRKSHIMTKTEDEAKLPETPVSDAPVATAPHKTMQGTVITLTSPLTGEVKALSEAVDPVFAQGVMGQGALLQPTEGVLVAPCDAEVSVLFPTKHAICLVTTEGLELLMHIGMDTVNLDGQGFEALVKQGDQVKAGQTLIQFDIAAISEAGYATETPLVVTNQDVFTVTVEGSLPRQIKVNDKLAVAVKK

SEQ ID NO: 487 - DNA, 1623 bp, Streptococcus agalactiae
atgacgattgataaacgtaaagttgtctatcaaatttatccaaaatcatacaaagacacaactggtaatggggttggtgatcttcgtggtattatcgaaaaattaccctatttagcagaacttggtattgatatggtttggctcaacccattttatccaagtccacaacgagataatggatatgatatctctgattatacagctattaaccctgattttggaacgatggacgattttgaagaaatgattgaggtgggacgtcaataccgtatagattttatgcttgatatggtgcttaatcattgttcaatagaacatgagtggtttaaaaaagcacttgcaggagatcgctactatcaagatttctttatcttacgtgataatccaacagattgggtatctaaatttggtggaaatgcttgggcaccatttggtgatacagggaagtattatcttcatctttttgatatcactcaagctgaccttaattggcgcaatgccgatgttcgcaaggaactttttaaagttgtcaatttttggcgtgataaaggggttaaaggttttcgatttgatgtgattaatttaattgggaaagatgagatacttgagaactgcccaattaatgatggaaaaccagcttatactgatcgtccaataacacatgattatctcaagatgttgaataatgctagttttggacaagatgattccttcatgacagttggtgaaatgtcttcaacgacaattgcaaattgcattctttacactgcaccagaacgtgaagagttatccatggcttttaattttcaccacctcaaagtagattataaagatgggcaaaagtggaccattatggcttttgattttcctgcattacgtgaccttttccatagttggggcgaagggatgagcgaaggaaatggttggaatgctttattctataataatcatgaccaaccgcgagcattaaatcgttttgtagacgtgaaacgttttcgaaatgaaggagcaaccatgttagcagcatctatccacttatcgcgtggtactccttatatatatatgggtgaagaaatcggaatgcttgatcccgattacagttctatggatgattatgtggatattgagagtttgaatgcctaccaaataatgcttgatgaaggcaagtcacaagaagaggcatttagcattattcgagcgaaatctcgagacaattctcgagtaccaatgcaatgggatgatagtacgaatgcaggtttttctgaaggcgctccatggttgaaagtaggaaaatcatataaagaaatcaatgtcgcaaaggagaaaacagggctgatatttactttctatcaagagttgataaggctacgtaaacaactgccaataatagctgacgggaattataaagcagctttcaaagataatgaaaaagtatatgcttttgaacgccatcttgataaggaaaaacttcttgttttaaataatttctttgctgagaaagttaagataaaattaccggagaattatctccaaggacaagttcttctatcaaattataaggatgttactcttgatgaaacggttactttgcaaccttatcaaactttagctatcttagtgtca

SEQ ID NO: 488 - protein, 541 aa, Streptococcus agalactiae
MTIDKRKVVYQIYPKSYKDTTGNGVGDLRGIIEKLPYLAELGIDMVWLNPFYPSPQRDNGYDISDYTAINPDFGTMDDFEEMIEVGRQYRIDFMLDMVLNHCSIEHEWFKKALAGDRYYQDFFILRDNPTDWVSKFGGNAWAPFGDTGKYYLHLFDITQADLNWRNADVRKELFKVVNFWRDKGVKGFRFDVINLIGKDEILENCPINDGKPAYTDRPITHDYLKMLNNASFGQDDSFMTVGEMSSTTIANCILYTAPEREELSMAFNFHHLKVDYKDGQKWTIMAFDFPALRDLFHSWGEGMSEGNGWNALFYNNHDQPRALNRFVDVKRFRNEGATMLAASIHLSRGTPYIYMGEEIGMLDPDYSSMDDYVDIESLNAYQIMLDEGKSQEEAFSIIRAKSRDNSRVPMQWDDSTNAGFSEGAPWLKVGKSYKEINVAKEKTGLIFTFYQELIRLRKQLPIIADGNYKAAFKDNEKVYAFERHLDKEKLLVLNNFFAEKVKIKLPENYLQGQVLLSNYKDVTLDETVTLQPYQTLAILVS

SEQ ID NO: 489 - DNA, 1626 bp, Streptococcus pyogenes
atgacaattgataaaaagaaagtcgtctatcaaatttacccaaaatcctataaggacacgactggaaatggtgtgggagacttgctagggatcattgataaattgccttacttacaagaactaggaatagatatgatttggttgaaccctttctaccctagtccacaacgagacaatggctatgatgtttcagattatacggcggtcaaccctgattttggaacaatggctgattttgaaaatttggtaaaagctgctaaggagcatcagattgagttaatgttggacatggttttgaatcactgttccacagaccacgagtggttccaaaaagctttagcaggagacccttattatcaggatttctttatcttgagagatcagccgactgattgggtttccaaatttggtgggaatgcttgggcgccttttggagatacaggcaaatactacttacacttgtttgatgtgacacaggctgacttgaattggcggaacccacatgttcgtgaggaattggctaaagtggttaatttttggcgagataaaggagtgaaggggttccgttttgatgtgattaacctgattgggaaagatgaagagctggtggattgtccggtcaatgatggtaagccagcttatacggatcgtcctattactcacacttatcttcatgatctcaatcaagccagttttggtcaggatgattcgtttatgacagtaggggaaatgtctgcaacgactattgacaactgtcttttatacacggctcccgaacgtgaggagctatccatggcttttaatttccaccatctaaaagttgattatgagaacggtcagaaatggactattatggcttttgattttgcagcgctgcgagacttattccatgcttggggtgaaggcatgagtcagggcaatgggtggaatgccttgttctacaataaccatgatcaaccacgtgccctgaatcgttttgttgatgtaacacatttccgaaacgaaggtgcgacgatgttagcagcttccatccatttgtcacgaggaacgccttacatttatatgggtgaggagattggcatgcttgatccagactttgatagtatggatgattatgtggatgtggaaagtctcaatgcttactcaagcttattagtctcaggtaaaagtgcagaagaagcctttgccattatcaaggccaagtcaagggacaatgccagaacaccaatgcaatgggatgctagtgaacatgctggctttacgactggtaagccttggttagaggttggcaaatcttatcgagacatcaatgtcgaaacagaaaaagagggacgtatttttcctttctaccaacgcttgattgctttgcggaaggaactccctattattgctgaaggggactatcgggctgcttttaaagatagtcaggctgtctatgcctttgaacgccatttaggtgaccagtgtttgcttgttctcaatcatttctatgctgatgaggtcgaactggaattacctccacgttatcaacatggacaggtcttaatcagcaactatgagaaagtttctatttgtgaaaaagtgatactgaaaccttatcagacacttgctatcttagctgataac

SEQ ID NO: 490 - protein, 542 aa, Streptococcus pyogenes
MTIDKKKVVYQIYPKSYKDTTGNGVGDLLGIIDKLPYLQELGIDMIWLNPFYPSPQRDNGYDVSDYTAVNPDFGTMADFENLVKAAKEHQIELMLDMVLNHCSTDHEWFQKALAGDPYYQDFFILRDQPTDWVSKFGGNAWAPFGDTGKYYLHLFDVTQADLNWRNPHVREELAKVVNFWRDKGVKGFRFDVINLIGKDEELVDCPVNDGKPAYTDRPITHTYLHDLNQASFGQDDSFMTVGEMSATTIDNCLLYTAPEREELSMAFNFHHLKVDYENGQKWTIMAFDFAALRDLFHAWGEGMSQGNGWNALFYNNHDQPRALNRFVDVTHFRNEGATMLAASIHLSRGTPYIYMGEEIGMLDPDFDSMDDYVDVESLNAYSSLLVSGKSAEEAFAIIKAKSRDNARTPMQWDASEHAGFTTGKPWLEVGKSYRDINVETEKEGRIFPFYQRLIALRKELPIIAEGDYRAAFKDSQAVYAFERHLGDQCLLVLNHFYADEVELELPPRYQHGQVLISNYEKVSICEKVILKPYQTLAILADN

SEQ ID NO: 491 - DNA, 144 bp, Streptococcus agalactiae
gtgctgcttgtggaaaggaatcttgctctagattttgcaatttctttcttttttctttactctataacaatagcccaaattcattcaattgatagtagtgccagattgggctcaaatgacctagaaaaatgtaaacggttacta

SEQ ID NO: 492 - protein, 48 aa, Streptococcus agalactiae
MLLVERNLALDFAISFFFLYSITIAQIHSIDSSARLGSNDLEKCKRLL

SEQ ID NO: 493 - DNA, 1917 bp, Streptococcus agalactiae
atggttgataataagactgttgtgataatgttggtatttttagctcggaaaaatctttccttgtatgagttaacagtgcaaacaaagttttcaataaaagttatcatagagcaaattaactatctcaatagttttttagcaaaaaatcacctaccagctattgctcactctgctggacgttatcagttattaggagatgaaaaagagcatgataaaattgtctccttattagaagctgagcaattttacctaacccaggaagaaagggtatgtctgatttacctttatagcttttgccgaagagagtttgtctccaatgtgcattatcaagattttttgaaagtaagtaagaatactactttatcagatatcaagatgctacgttctaaattagcaaaaagaggtatctcactcacttatacaagagcaaagggatatagtctagtaggagatgagatggataagcatcaagttgcttttcagatgataactcaactactagaatctcccattggtttttggtctttgaattatatcttgtcttcttggaaattcgctctctcatatgagaagttagaaaagacggtagaatatttctatgaatcttttcaactttctccaatacaagataggcttgagaaatctttatattttatcattttaatactgtgtcgttatcaaaggtcagtagatcgtgttttgcagggttctcctattgtttctgaacaattaaaagagttaacgactattattgtgactaatttaagtcaggatatttccttatctaaaccattagatcagaaagaaaaagattatattaccttgatcttatctggctgttttgaaggtgagggaactaaagatgatgatttctttgaagcattggcaaaagcaatcgttgatgagatggaaactgtttcacttcttaatttttccaataaagaagagttattacaaggtctgaagcgtcatattattccagcttatttccgattgaaatatggtttaactggcgatagtggttatacacaaaatattaaagagcattacagtgatttatttctattggttaaaaaggcactacgtcctttggaagagcaagtaggattaatacccgatagtgaaatttcttacttcgtgattcactttggaggctatcttagacaatcaggtggtacacaatcaatgtcttataaagctttgatactctgtccaaacggcgttagttcatccttagtgattaaggaaaaattgcgtggattatttcctcaaattcattttcatcgtgtctctaaaattgagcagctgaaactgattgacaatcaaacttacgatatggtcttttctactatatttgtagaaacaaaaaaacctaattatctagtttcgctgatgatgacagcagagcaagtacaacagctcaaagaactggttatttcagattttcccaaggcttgccttgacgatttccaacttgatcaattaatagcaactataaaaaaatacgctcatgttcattgtgaagaggaattaaaattggctttgaggacaatggtaaaacaagatatacttagaaaggatgtgaggcccttgttgcaccaacttataacagaggaaacttatcagacaagttctgaacaaatgaattggaaagaggcaattcgtttagcggcaaaacccttgttagcttctggaaaaattacggaaagttacccagaagctatgattgaaaaagtcgaagagtttggtccttttatcaatcttggtaaaggtattgctattccacatgccagaccagaagatggggtaaactctgtcggtatgtcaatgcttgttttggaacagccacgccgtacgcatgaaaactttctcttcatccttttgtgcccggacatcaattttgaaaagattcctttt

SEQ ID NO: 494 - protein, 639 aa, Streptococcus agalactiae
MVDNKTVVIMLVFLARKNLSLYELTVQTKFSIKVIIEQINYLNSFLAKNHLPAIAHSAGRYQLLGDEKEHDKIVSLLEAEQFYLTQEERVCLIYLYSFCRREFVSNVHYQDFLKVSKNTTLSDIKMLRSKLAKRGISLTYTRAKGYSLVGDEMDKHQVAFQMITQLLESPIGFWSLNYILSSWKFALSYEKLEKTVEYFYESFQLSPIQDRLEKSLYFIILILCRYQRSVDRVLQGSPIVSEQLKELTTIIVTNLSQDISLSKPLDQKEKDYITLILSGCFEGEGTKDDDFFEALAKAIVDEMETVSLLNFSNKEELLQGLKRHIIPAYFRLKYGLTGDSGYTQNIKEHYSDLFLLVKKALRPLEEQVGLIPDSEISYFVIHFGGYLRQSGGTQSMSYKALILCPNGVSSSLVIKEKLRGLFPQIHFHRVSKIEQLKLIDNQTYDMVFSTIFVETKKPNYLVSLMMTAEQVQQLKELVISDFPKACLDDFQLDQLIATIKKYAHVHCEEELKLALRTMVKQDILRKDVRPLLHQLITEETYQTSSEQMNWKEAIRLAAKPLLASGKITESYPEAMIEKVEEFGPFINLGKGIAIPHARPEDGVNSVGMSMLVLEQPRRTHENFLFILLCPDINFEKIPF

SEQ ID NO: 495 - DNA, 2160 bp, Streptococcus pyogenes
ttgagtccaattgcagtcaaaaatgacatgagacaattggactcaatttatcttgaaaatgaaaacgcttcattttatactgacattataggaggagatgacatgctatctcatgagctcatcagaaactatcaactcttttctaaatataaaggacattcactggaggcatttgaatccattttaaaggcaagcaaacgtcatatactggcagatattgctaaaatcaatgacacgttgtcactctatcagttaccccttattgctctggacaggcagctggtttatccgccagaccttactgaaaaggacttgttgaatcgcatgctacctaccttagacgactatctctttcaagatgagcgtctggatatgattatcatttacatcatgatggctaaagaatttatctccattaaccacttggaaagcttgttacggctcagcagaaattctgttattgctgatttaaacttggtgcgtgatcgggtacaagcttttcaggtaactttagcttacaatcgccaggatggttatttttttgaaggagaacccttagccttgcggcgtctcttagaatcagcggtcagttctcttttgcaagtcacatctggaccttgggtgttcagttacttattgcatgaacttggtttgcccgaccagaaaaaggtgatggcagcaacgttggaggaactgagcagggagaaccacttaacttttatttcggagaaattgagggatttgatttattttttctgccttctcgctcatcgaccattttcacggaacgtaagggctgaagcagtggatacttttcctttagcttcgccagctgttgaaacgatggtggaccagttattggtcaacttccccagtctaaccgaagaaaaatatttggttcaatctaggttacttggttgtatccaaggtgacttagagttagtctttcagcaacctatttatgacattatggaggaaatcatcaattcggtggcggttaacacgggattgtctatcaccgataccccagaacttcgtcagaacctatacagtcaccttttgccagcttattaccgactttactacgacattaacttgaccaatcctttgaaggaacaaatcaaacaagattatgaatctctcttttacttggtcaagcgcagcctttctcctctagaaaaacaattggggaaatcagttaatgaagatgaggttgcttattttaccattcattttgggagatggttgcaggcccctaagaagaggccaagcaatcagctggtagccttatctgtttgccctaatggcattagttcgtctctgatgttggaggcaaccttgaaggaactttttccacagctacagtttattaggattcaccagctggacaaaataaagttgttggatccagcatcctttgatttgattttttcaacagtagcttttgactgtgctaaacctgtttatgtgacgcaagctttgatgggacctgttgaaaaaatgatgttgaaaaagatggtctgtgatgactttcatcttcccttgtcagagcaattcgctttggatgatctgttgagtattattcataaacataccacgattactaataaagaaggacttgttagtgatttatcccgttacctgattggtaaccatttaacgattgaaaaaggaggtctaggactattggacttgttaacagcagattttattaggcaggctgatgctgtttcggattggcaggaagcgattcgtttggctgctcagcctttactagaacaccagatgattgaaacatcttatatcgatggcatgattgattcggtcaatgagcttggggcctatattgttttagcccctaaggtggctgttcctcatgcggcgcctgaaaaaggaacgcggcagttaggcatgtctctcttacaactaaaagaacctgtcagctttgatttgaagcaagaaggtgatccagacaagcaagtgcaattgatttttgttttgtctgctgtggattctagttcacatttgaaggctttgcaggaactgtcgttgattttagatgatgatgaacatattgagcaattaattgaggctaagaatactgaggaaataatgagtctgattagccatatgattgaaaaaggagacgaatcacatgat

SEQ ID NO: 496 - protein, 720 aa, Streptococcus pyogenes
LSPIAVKNDMRQLDSIYLENENASFYTDIIGGDDMLSHELIRNYQLFSKYKGHSLEAFESILKASKRHILADIAKINDTLSLYQLPLIALDRQLVYPPDLTEKDLLNRMLPTLDDYLFQDERLDMIIIYIMMAKEFISINHLESLLRLSRNSVIADLNLVRDRVQAFQVTLAYNRQDGYFFEGEPLALRRLLESAVSSLLQVTSGPWVFSYLLHELGLPDQKKVMAATLEELSRENHLTFISEKLRDLIYFFCLLAHRPFSRNVRAEAVDTFPLASPAVETMVDQLLVNFPSLTEEKYLVQSRLLGCIQGDLELVFQQPIYDIMEEIINSVAVNTGLSITDTPELRQNLYSHLLPAYYRLYYDINLTNPLKEQIKQDYESLFYLVKRSLSPLEKQLGKSVNEDEVAYFTIHFGRWLQAPKKRPSNQLVALSVCPNGISSSLMLEATLKELFPQLQFIRIHQLDKIKLLDPASFDLIFSTVAFDCAKPVYVTQALMGPVEKMMLKKMVCDDFHLPLSEQFALDDLLSIIHKHTTITNKEGLVSDLSRYLIGNHLTIEKGGLGLLDLLTADFIRQADAVSDWQEAIRLAAQPLLEHQMIETSYIDGMIDSVNELGAYIVLAPKVAVPHAAPEKGTRQLGMSLLQLKEPVSFDLKQEGDPDKQVQLIFVLSAVDSSSHLKALQELSLILDDDEHIEQLIEAKNTEEIMSLISHMIEKGDESHD

SEQ ID NO: 497 - DNA, 123 bp, Streptococcus agalactiae
ttggagaaagaggctaagcagatcattgatttaaaaaggaatcttttcaaaattgatgtccgggcacaaaaggatgaagagaaagttttcatgcgtacggcgtggctgttccaaaacaagcat

SEQ ID NO: 498 - protein, 41 aa, Streptococcus agalactiae
MEKEAKQIIDLKRNLFKIDVRAQKDEEKVFMRTAWLFQNKH

SEQ ID NO: 499 - DNA, 105 bp, Streptococcus pyogenes
ttggagaaagaggctaagcagatgattgatttaaaaaggaatcttttcaaaattgatgtccgggcacaaaaggatgaagagaaagttttcatgcgtacggcgtgg

SEQ ID NO: 500 - protein, 35 aa, Streptococcus pyogenes
LEKEAKQMIDLKRNLFKIDVRAQKDEEKVFMRTAW

SEQ ID NO: 501 - DNA, 1140 bp, Streptococcus agalactiae
gtgactacgatgattgattttattatttctattgatgattgcgcagttgaattggatagtcgtcaatcttggaaaattcgctaccccttatcaaccattctatttcttgtctttgtttgtcagttagctggcattgaaacctggaaggagatggaagattttattgaaatgaatgaaccattgtttgcgacctacgttgatttgagtgaaggttgtccgtctcatgataccttagagcgtgtgattagtcttgttaattcagaccgtttaaaagagcttaaagttcaatttgagcaatcattgacaagcttagatgccgttcatcaactgatttcagtggacggtaaaacgattcgaggcaatcgaggtaaaaatcagaagcctgttcatattgtaacggcttatgatgggggtcatcatcttagtttgggacaggtagcggttgaggagaaaagtaatgaaattgttgccattcctcagttattgcggacaattgatatccgtaaaagcattgtaacgatagacgcaatgggcacgcagacggctatcgttgatacgattataaaaggtaaagcagactattgcttagccgtcaaaggaaatcaagaaacactttatgatgatattgctctttattttagtgatgtcaacttattggaagaactccaagaaaatgcgcagtattatcagactgttgaaaaatctaggggacagattgaagttagagaatactgggtgtcttccgatatcaaatggttgtgtcaaaaccatcccaaatggcataagttacgtggtattgggatgactcgtaacacgattgataaggatggtcagctgagtcaagagaatcgttattttatctttagctttaagccggatgtcctcacatttgccaattgtgtacgaggtcattggcagatagagagtatgcactggttattggacgttgtttatcatgaagatcatcatcagacattggataaaagagccgcatttaacctaaatcttatccgaaaaatgtgcttatattttctcaaagtgatggtatttcctaaaaaagacctcagttatcgtcgcaaacaacggtatatttctgtccatttggaagattatttagtccaattatttggagaaagaggc

SEQ ID NO: 502 - protein, 380 aa, Streptococcus agalactiae
MTTMIDFIISIDDCAVELDSRQSWKIRYPLSTILFLVFVCQLAGIETWKEMEDFIEMNEPLFATYVDLSEGCPSHDTLERVISLVNSDRLKELKVQFEQSLTSLDAVHQLISVDGKTIRGNRGKNQKPVHIVTAYDGGHHLSLGQVAVEEKSNEIVAIPQLLRTIDIRKSIVTIDAMGTQTAIVDTIIKGKADYCLAVKGNQETLYDDIALYFSDVNLLEELQENAQYYQTVEKSRGQIEVREYWVSSDIKWLCQNHPKWHKLRGIGMTRNTIDKDGQLSQENRYFIFSFKPDVLTFANCVRGHWQIESMHWLLDVVYHEDHHQTLDKRAAFNLNLIRKMCLYFLKVMVFPKKDLSYRRKQRYISVHLEDYLVQLFGERG

SEQ ID NO: 503 - DNA, 1140 bp, Streptococcus pyogenes
gtgactacgatgattgattttattatttctattgatgattgcgcagttgaattggatagtcgtcaatcttggaaaattcgctaccccttatcaaccattctatttcttgtcttcgtttgtcagttagctggcattgaaacctggaaggagatggaagattttattgaaatgaatgaaccattgtttgcgacctacgttgatttgagtgaaggttgtccgtctcatgataccttagagcgtgtgattagtcttgttaattcagaccgtttaaaagagcttaaagttcaatttgagcaatcattgacaagcttagatgccgttcatcaactgatttcagtggacggtaaaacgattcgaggcaatcgaggtaaaaatcagaagcctgttcatattgtaacggcttatgatgggggtcatcatcttagtttgggacaggtagcggttgaggagaaaagtaatgaaattgttgccattcctcagttattgcggacaattgatatccgtaaaagcattgtaacgatagacgcaatgggcacgcagacggctatcgttgatacgattataaaaggtaaagcagactattgcttagccgtcaaaggaaatcaagaaacactttatgatgatattgctctttattttagtgatgtcaacttattggaagaactccaagaaaatgcgcagtattatcagactgttgaaaaatctaggggacagattgaagttagagaatactgggtgtcttccgatatcaaatggttgtgtcaaaaccatcccaaatggcataagttacgtggtattgggatgactcgtaacacgattgataaggatggtcagctgagtcaagagaatcgttattttatctttagctttaagccggatgtcctcacatttgccaattgtgtacgaggtcattggcagatagagagtatgcactggttattggacgttgtttatcatgaagatcatcatcagacattggataaaagagccgcatttaacctaaatcttatccgaaaaatgtgcttatattttctcaaagtgatggtatttcctaaaaaagacctcagttatcgtcgcaaacaacggtatatttctgtccatttggaagattatttagtccaattatttggagaaagaggc

SEQ ID NO: 504 - protein, 380 aa, Streptococcus pyogenes
VTTMIDFIISIDDCAVELDSRQSWKIRYPLSTILFLVFVCQLAGIETWKEMEDFIEMNEPLFATYVDLSEGCPSHDTLERVISLVNSDRLKELKVQFEQSLTSLDAVHQLISVDGKTIRGNRGKNQKPVHIVTAYDGGHHLSLGQVAVEEKSNEIVAIPQLLRTIDIRKSIVTIDAMGTQTAIVDTIIKGKADYCLAVKGNQETLYDDIALYFSDVNLLEELQENAQYYQTVEKSRGQIEVREYWVSSDIKWLCQNHPKWHKLRGIGMTRNTIDKDGQLSQENRYFIFSFKPDVLTFANCVRGHWQIESMHWLLDVVYHEDHHQTLDKRAAFNLNLIRKMCLYFLKVMVFPKKDLSYRRKQRYISVHLEDYLVQLFGERG

SEQ ID NO: 505 - DNA, 198 bp, Streptococcus agalactiae
gtggaacagcctatttatttattggatgaccccaaacaggaaatttatctcttattatgcatagcagctattgataatgaaacgcatttgaaagctctatcgcatttgacaacaatacttcgtgataataataatgttaaagctttgttagcttcacgtaggtatcaagatattgaaatgattataaaacaggaggat

SEQ ID NO: 506 - protein, 66 aa, Streptococcus agalactiae
MEQPIYLLDDPKQEIYLLLCIAAIDNETHLKALSHLTTILRDNNNVKALLASRRYQDIEMIIKQED

SEQ ID NO: 507 - DNA, 282 bp, Streptococcus agalactiae
atgttaagaattggaacagcatgtggatcaggtttaggttcaagttttatggtacaaatgaatattgagtctattttgaaggatttgggggtttctgatgttgaagttgaacattatgatttaggtggagcagatccaagtgcagcagatgtttggattgttggtcgtgatttggaggattcagctggtcacctgggggatgttcgtattttaaacagtatcattgatatggatgaattgagagaattagtgacaggtatttgccaagaaaaaggcttaatc

SEQ ID NO: 508 - protein, 94 aa, Streptococcus agalactiae
MLRIGTACGSGLGSSFMVQMNIESILKDLGVSDVEVEHYDLGGADPSAADVWIVGRDLEDSAGHLGDVRILNSIIDMDELRELVTGICQEKGLI

SEQ ID NO: 509 - DNA, 303 bp, Streptococcus pyogenes
ttgaaaaaggagacgaatcacatgattaaaattgtaacggtttgtggaaacggtattggtagtagcttgttacttcgcatgaaagtagaagctatcgcctctagtttgggtattgatgtggatgcagaatcctgtgattccaatgcggctgttggaaagggtgcagatttgtttgttaccgttaaagaatttaaagatatttttccagaggatgccaaggtttgtatcgttaaaagctataccaatcgtaaaaaaattgaagaagatttggttccggttctcaaggaaatgagtggcaaggaa

SEQ ID NO: 510 - protein, 101 aa, Streptococcus pyogenes
LKKETNHMIKIVTVCGNGIGSSLLLRMKVEAIASSLGIDVDAESCDSNAAVGKGADLFVTVKEFKDIFPEDAKVCIVKSYTNRKKIEEDLVPVLKEMSGKE

SEQ ID NO: 511 - DNA, 93 bp, Streptococcus agalactiae
atgacagtagtgccagtcacaatcatgactatcatactaaccaatccaccaacaaaacttgagataaaaccaatcaatactgcattaggtgca

SEQ ID NO: 512 - protein, 31 aa, Streptococcus agalactiae
MTVVPVTIMTIILTNPPTKLEIKPINTALGA

SEQ ID NO: 513 - DNA, 1353 bp, Streptococcus agalactiae
atgaaaggtctattggattttttagttaatattgccagcacgccagctattttagtcgccttgatagccattatcggtttagtactgcagaaaaaaggcgttcctgatattgtaaaaggtggaataaaaacatttgttggcttcttagtggtttctggaggtacagggatagtccaaaattccttgaatccatttggaaaaatgtttgaacatgcttttcatttggtgggggtagttcctaataatgaagccattgtagcagtagctcttacgaagtatggctcagcaactgctttgattatgttagcgggaatgatttttaatattttaattgctcgttttacaaaatttaaatatatttttctgacaggacatcatacattgtatatggcttgtatgattgctgttatttttgccgtagcaggctttacttcgttctcgctcatcctttttggaggtctagcgttagggattattatgagcgtatctcctgcatttgtgcaaaaatacatgattcaactgacaggtaatgataaggtggcacttgggcactttggttctttaggctattggttgagtggatttattggtggaattgttggagataaatcaaaatcaacagaagatattaaatttccaaagagtttatcatttttacgtgacagtaccgtaagtattactatctcaatggcaattatttaccttatcgttgcagtgtttgctggtgaggcttatattgcaaaagaaataagtaacggtgtcaatggtcttgtttatgccctccaactagctgggcaatttgcggcaggtgtattcgttattttagcaggtgtacgccttatcctaggtgaaattgtaccagcctttaagggaatctcagaaaaattggttccaaattcaaaaccagccttggattgtccaattgtttacccttatgcacctaatgcagtattgattggttttatctcaagttttgttggtggattggttagtatgatagtcatgattgtgactggcactactgtcattttaccaggggtcgttcctcatttcttctgtggggcaacggcaggtgttatcggtaatgcttctggtggtgtgagaggagcgactattggtgcatttgttcaaggtatcctcatcagtttcttgccgattttcttgatgcctgtactaggtggacttggtttcaaagggtcaacattctcagatgctgattttggtttgaccggtatcattcttggcgctcttaatcatgtcggcggtgcgatagctattgttattggtattgtagttatcttaattggactttttggcatttcatttgttggaaaatcaacccataaggaaggt

SEQ ID NO: 514 - protein, 451 aa, Streptococcus agalactiae
MKGLLDFLVNIASTPAILVALIAIIGLVLQKKGVPDIVKGGIKTFVGFLVVSGGTGIVQNSLNPFGKMFEHAFHLVGVVPNNEAIVAVALTKYGSATALIMLAGMIFNILIARFTKFKYIFLTGHHTLYMACMIAVIFAVAGFTSFSLILFGGLALGIIMSVSPAFVQKYMIQLTGNDKVALGHFGSLGYWLSGFIGGIVGDKSKSTEDIKFPKSLSFLRDSTVSITISMAIIYLIVAVFAGEAYIAKEISNGVNGLVYALQLAGQFAAGVFVILAGVRLILGEIVPAFKGISEKLVPNSKPALDCPIVYPYAPNAVLIGFISSFVGGLVSMIVMIVTGTTVILPGVVPHFFCGATAGVIGNASGGVRGATIGAFVQGILISFLPIFLMPVLGGLGFKGSTFSDADFGLTGIILGALNHVGGAIAIVIGIVVILIGLFGISFVGKSTHKEG

SEQ ID NO: 515 - DNA, 1233 bp, Streptococcus pyogenes
atggaagcattattatcatttattcgagatattttaaaagaacctgcatttttaatgggcttgattgcctttgcagggttggtggctttgaaaacacctgctcataaggtgttgacaggaaccttggggccgattttgggataccttatgcttgttgcaggggcgggtgttattgtgaccaatttggaccctcttgccaaactcattgagcacggttttagcatcactggcgtagtgccaaataacgaagccgtcacttctgtcgctcaaaagattctgggtgtggaaactatgtccatcttggtggttgggttattgctcaatttggcttttgctcgttttacccgcttcaaatacattttcttaacaggacatcacagcttctttatggcttgtctcttgtccgccgtgcttggagctgttggtttcaaaggaagtcttttgattatcttagatgggttcctcttgggagcttggtcagctatttcgccagccattggtcaacagtatactctgaaagtgactgacggagatgaaatcgctatgggacactttggtagtttgggctattacctttctgcctgggttggtagcaaggttggcaaagacagtaaagataccgaagaccttcagatttctgaaaaatggagtttcttgcgcaacaccaccatttcaacaggacttatcatggtgattttctacttggtggcaacagtggcttctgttttgaggaatgcttcagtagcagaagaattagcagcaggtcaaaacccatttatttttgccattaagagtggtcttacctttgcggttggtgtggcaattgtctacgccggtgttcgcatgattttggctgacttgattccagccttccaaggtattgctaacaaattaattccaaatgctattccagccgtggattgtgcggtattcttcccttatgcgccaaccgctgttatcatcggttttgcgtcaagtttcgttggtggcttacttgggatgttgattttaggagttgcaggtggtgtcctgattatcccaggtatggtgcctcatttcttctgcggtgcaacagcagagatttttggaaattcaacaggtggtcgtcgcggtgcgatgattggtgcttcgctaatggcttattactcgccttcttgccagccatgcttctacctgtacttggtaaacttggtttttcaaacacgacctttggagatgtggatttcggtgttt

SEQ ID NO: 516 - protein, 411 aa, Streptococcus pyogenes
MEALLSFIRDILKEPAFLMGLIAFAGLVALKTPAHKVLTGTLGPILGYLMLVAGAGVIVTNLDPLAKLIEHGFSITGVVPNNEAVTSVAQKILGVETMSILVVGLLLNLAFARFTRFKYIFLTGHHSFFMACLLSAVLGAVGFKGSLLIILDGFLLGAWSAISPAIGQQYTLKVTDGDEIAMGHFGSLGYYLSAWVGSKVGKDSKDTEDLQISEKWSFLRNTTISTGLIMVIFYLVATVASVLRNASVAEELAAGQNPFIFAIKSGLTFAVGVAIVYAGVRMILADLIPAFQGIANKLIPNAIPAVDCAVFFPYAPTAVIIGFASSFVGGLLGMLILGVAGGVLIIPGMVPHFFCGATAEIFGNSTGGRRGAMIGASLMAYYSPSCQPCFYLYLVNLVFQTRPLEMWISVF

SEQ ID NO: 517 - DNA, 855 bp, Streptococcus agalactiae
atgacatcaccagaagaaagatattcatctctaagacgatttgcaacggagattcgtttaaatactctagaaacgctaaaccatttaggattcggtcactatgggggtagtttatcaattgttgaggctttggctgttctgtatggtgatattatggatataaatcctgaaaaattcaaagaaagtgatcgggattatatggtcttatcaaaaggacatgctggtccagccttgtatagtacactctatttaaaaggtttttttgataaaacattccttcattcgctcaatacaaacggtaccaaactaccttcgcatcctgaccgcaatttaactcctggtatagatgtaacgacaggctcgttaggtcaaggcattagtattgcaacgggaattgcttatgctcaaaagattgagaattcaagctattatacttatactattgtaggtgatggtgaattaaatgaaggacaatgttgggaggctatacaatttgctgcgcatcatcaactgcaccatttaattgtttttgtagatgataataaaaaacaattagatggtttgacagctgatatttgtaatcctggagactttgttgctaaatttgaagcttttggatttgatgcagtacgtgtaaaaggagatgacattgaggcaattgacaaagctattaaaacttttcaagattcaaatagtgtcagaccaaaatgtattgttttagatagcatcaagggacaaggtgtgaaagagttggaggagttagcttctaatcatcatttacgaccagatttacaacaaaaaacaatgttagagcgagcgttgataagcttgagagaaagtttggaggtggtagaa

SEQ ID NO: 518 - protein, 285 aa, Streptococcus agalactiae
MTSPEERYSSLRRFATEIRLNTLETLNHLGFGHYGGSLSIVEALAVLYGDIMDINPEKFKESDRDYMVLSKGHAGPALYSTLYLKGFFDKTFLHSLNTNGTKLPSHPDRNLTPGIDVTTGSLGQGISIATGIAYAQKIENSSYYTYTIVGDGELNEGQCWEAIQFAAHHQLHHLIVFVDDNKKQLDGLTADICNPGDFVAKFEAFGFDAVRVKGDDIEAIDKAIKTFQDSNSVRPKCIVLDSIKGQGVKELEELASNHHLRPDLQQKTMLERALISLRESLEVVE

SEQ ID NO: 519 - DNA, 2187 bp, Streptococcus pyogenes
gtggccactgtgtcaacaggctctcttatattcatcgtcaaaaagaatccaccaatgatgtccaaactagtttttttctggcaaaatagagaaaaagaatttagggactttggaggattttctgaaaaaagcgtctatttttgtgatacaatagacaatagaaaacgtttaattttagttgtaataaacagagaggttttacttatgacatttgatgcaattgaccagttggcagtaaacactgtccgcaccctatcaatggatgccattcaagcggcaaattctggacacccaggacttccaatgggggcagcacctatggcctatgttctttggaatcacttcatgaacatcaatcccaaaacaagccgtaattggtcaaacagagaccgttttatcctatcagcaggtcatggaagtgccatgctttatagcttgttacacttagctggttatgatttatctgtagaagatttaaagaacttccgtcaatggggttctaaaacaccaggtcacccagaagtgaaccacacagacggtgtcgaagcaaccacaggacctcttggtcaagggatcgcaaatgccgttgggatggccatggcagaagctcatctagcagctaaatttaacaaaccaggctttgacatcgttgatcactacacatttgctttgaatggtgacggtgaccttatggaaggggtcagccaagaagcagcaagtatggcaggacatttaaaacttgggaaattggtcttgctatatgattcaaacgacatctctcttgatggtccaacctctatggctttcacagaagatgtgaaaggacgtttcgaagcttatggttggcaacatatccttgtgaaagatggaaatgatttagaagaaattgcagctgctattgaagcagctaaagctgaaactgagaaaccaaccatcatcgaagtcaaaaccattattggttttggtgccgaaaaacaaggaacttcagctgttcacggcgctcctcttggagcagaaggcattgcttttgccaaaaaagcttaccaatggactcatcaagattttgaagtgcctgctgaagtaacagagcgctttgctcaaggtcttcaagcgcgtggtgaaaaagcagaacaagcctggaatgacttgtttgcagcttatgaagcagaatatccagaattagcagcagaataccaaaaagcctttactaacgaagctgctcaagtagaacttgaagcgcacgaacttggtagttcaatggcgagtcgtgtatccagtcaacaagccatccaacaaatttcagaacaagtagcctctttctggggtgggtcagcagacctttcagcttcaaacaatactatggttaaggctgaaacagatttccaaccaggtcactacgaaggccgtaacatctggtttggcgttcgtgaatttgccatggctgcagccatgaacggtattgcccttcacggcgggacacgcgtttacggcggaaccttctttgtcttctcaaactatcttcttccagctgttcgtatggcagcgctccaaaacttgccaacagtttatgtcatgacacatgattctatcgctgtcggtgaagatgggccaacgcacgaaccaattgaacaattggcaagtgttcgctcaatgcctaacttgaacgttattcgtccagcagacggtaacgaaacaaatgctgcttggaaacgtgccattgctgaaacagatcgcccaaccatgcttgtattgacgcgtcaaaaccttccagtgcttgagggcacaaaagaattggcagaagatggtcttagcaaaggagcttatatcttgtcagaagccaaaggcgaccttgatggtatcttgattgcaacaggttcagaagtgaaactggcaatggatactcaagaagctcttgaagcagaaggcattcatgtgcgtgtcgtatctatgccatcacaaaatatctttgacgaacagtcagcagagtataaagaaagcatcctaccagcagctgtgactaaacgtctcgctatcgaagcaggttcaagctttggctgggcaaaatatgtcggcctatcaggaaaaacattgaccattgacacttggggtgcttcagctccaggaaatcgtatcttcgaagaatatggtttcactgtggcaaatgcaactgagttatacaaatcactc

SEQ ID NO: 520 - protein, 729 aa, Streptococcus pyogenes
VATVSTGSLIFIVKKNPPMMSKLVFFWQNREKEFRDFGGFSEKSVYFCDTIDNRKRLILVVINREVLLMTFDAIDQLAVNTVRTLSMDAIQAANSGHPGLPMGAAPMAYVLWNHFMNINPKTSRNWSNRDRFILSAGHGSAMLYSLLHLAGYDLSVEDLKNFRQWGSKTPGHPEVNHTDGVEATTGPLGQGIANAVGMAMAEAHLAAKFNKPGFDIVDHYTFALNGDGDLMEGVSQEAASMAGHLKLGKLVLLYDSNDISLDGPTSMAFTEDVKGRFEAYGWQHILVKDGNDLEEIAAAIEAAKAETEKPTIIEVKTIIGFGAEKQGTSAVHGAPLGAEGIAFAKKAYQWTHQDFEVPAEVTERFAQGLQARGEKAEQAWNDLFAAYEAEYPELAAEYQKAFTNEAAQVELEAHELGSSMASRVSSQQAIQQISEQVASFWGGSADLSASNNTMVKAETDFQPGHYEGRNIWFGVREFAMAAAMNGIALHGGTRVYGGTFFVFSNYLLPAVRMAALQNLPTVYVMTHDSIAVGEDGPTHEPIEQLASVRSMPNLNVIRPADGNETNAAWKRAIAETDRPTMLVLTRQNLPVLEGTKELAEDGLSKGAYILSEAKGDLDGILIATGSEVKLAMDTQEALEAEGIHVRVVSMPSQNIFDEQSAEYKESILPAAVTKRLAIEAGSSFGWAKYVGLSGKTLTIDTWGASAPGNRIFEEYGFTVANATELYKSL

SEQ ID NO: 521 - DNA, 927 bp, Streptococcus agalactiae
atgagatgttcaaccaaagaaatgaggcttgtctatcgtgatttcctccttcaagctaatcaagaaaataaacaaattaccgttttagaagccgatttgtcgagttcaatgtcaacaaatgcactggcatcagaatttggaaaacgttatattaatctaggtattatggaggctgagatggtaggccttgcagcagggctcgccattaaaggttacaagccataccttcatacttttggtcctttcgcgtcaaggcgtgtctttgatcaagtattcttatcgttaggttactcacaattatcagctacgattattggctcagatgcaggaattagcgcagaaatgaatggcggaactcatatgccttttgaagagttaggtctactaaggttaattcccaaagcgactatttttgaggttagtgatgatattcagtttgaagcaattttaaaacaaacattaagtattgatggcctaaaatacattagaactattcgtaaggcccccactgcagtttatgagggacgcgaagatttttcaaagggttttatacaattacgccagggaaaagatattactcttgtagcaagtggtattatggtttctagagcgatagaagcagccgactacctcaaagaactagggattgaggcctcagttatcgacctttttaaaattaagccccttccagaagaactgaaaccattactgatagatcaatccattgtaactattgagaatcataaccgtattggcggtatcggaagtgcattatgcgaatggcttagtatggagaaagacactactgttagtcgtatgggtattgatgagcgatttggtcaggtaggtcagatggaatatttattagaggagtatggactcgctgttaaagatatagtacagcattgcaaatcaatttataaatca

SEQ ID NO: 522 - protein, 309 aa, Streptococcus agalactiae
MRCSTKEMRLVYRDFLLQANQENKQITVLEADLSSSMSTNALASEFGKRYINLGIMEAEMVGLAAGLAIKGYKPYLHTFGPFASRRVFDQVFLSLGYSQLSATIIGSDAGISAEMNGGTHMPFEELGLLRLIPKATIFEVSDDIQFEAILKQTLSIDGLKYIRTIRKAPTAVYEGREDFSKGFIQLRQGKDITLVASGIMVSRAIEAADYLKELGIEASVIDLFKIKPLPEELKPLLIDQSIVTIENHNRIGGIGSALCEWLSMEKDTTVSRMGIDERFGQVGQMEYLLEEYGLAVKDIVQHCKSIYKS

SEQ ID NO: 523 - DNA, 159 bp, Streptococcus agalactiae
atgctagataaaattaaaacaatacctttccaagctcgcataacgaccacccctttatttttagtaaggataaaataccacaagatacttatacaaaacttaaaaatttcagaaaataacaaaaaggcaactccaatgttgcctttttgttatgattta

SEQ ID NO: 524 - protein, 53 aa, Streptococcus agalactiae
MLDKIKTIPFQARITTTPLFLVRIKYHKILIQNLKISENNKKATPMLPFCYDL

SEQ ID NO: 525 - DNA, 1152 bp, Streptococcus agalactiae
ttgacaagtttatcgctaacattcctcttatcaaccaaatttaggatacttgaaagttactttcaaggtattgaaaatatgtatttttaccacaaggtaatggctgtattttcaatgattttgcttctattgcacaaaattggtcttggacaaggcggacatggaagtgagtttgcaaagactattggcagtgcgggattatatctttttctaagtattgtttttgtagcttatttcggaaattttttaaagtatgaaatttggcgttttattcatcgctttgtttatttagcttatattttgggattggtacatacttttatgattttaggagataggatactaggaaatactttactcagtttaatcgtattaggttatgctgtcattggggttatatctggattttatattattttcctatattctagaatgcgttttcgtcgtgtagggtacgttcaaaaggttactcatcttaaccatgatacaactgagattgaaatagcaatgaagcgtccttatcgatatgactatggacaatttactttttttaaaatttatcaagctggctttgaatcagcagctcatcctttctcgatatcaggtggtcatgatagagtgatatttttaactgttaaagcttcaggagattatacgaaatccatttacaaacagctaaaagttgggacaaaaatagccttagatagagcttatggtcatatgttatttgataaagacaagaaagaacaggtttggattgcaggaggtatcggcatcactcccttcatttcatttattagagaaaatagtattttgactaagagagttgacttcttttataccttttcaaatcaagacaatttgatttatcaagatatgttagaatcctatgctaaagccaatcctaattttaaacttcacttaaataatagtagcctcaaaggaagacttgattttagtcagtctgtttttgaaggacaaccaacaatatttatgtgtgggccaactagtatgacatctacttatgctaaggtctttcggcaaaaagatgcaaagtctcgtttagtctatgaaggattttcctttagagacagttggttatccatatttctattaaaaacttttgacaaagtttattctaatttgataaaa

SEQ ID NO: 526 - protein, 384 aa, Streptococcus agalactiae
MTSLSLTFLLSTKFRILESYFQGIENMYFYHKVMAVFSMILLLLHKIGLGQGGHGSEFAKTIGSAGLYLFLSIVFVAYFGNFLKYEIWRFIHRFVYLAYILGLVHTFMILGDRILGNTLLSLIVLGYAVIGVISGFYIIFLYSRMRFRRVGYVQKVTHLNHDTTEIEIAMKRPYRYDYGQFTFFKIYQAGFESAAHPFSISGGHDRVIFLTVKASGDYTKSIYKQLKVGTKIALDRAYGHMLFDKDKKEQVWIAGGIGITPFISFIRENSILTKRVDFFYTFSNQDNLIYQDMLESYAKANPNFKLHLNNSSLKGRLDFSQSVFEGQPTIFMCGPTSMTSTYAKVFRQKDAKSRLVYEGFSFRDSWLSIFLLKTFDKVYSNLIK

SEQ ID NO: 527 - DNA, 267 bp, Streptococcus agalactiae
atggcaatctcaaaagagaaaaaaaatgaaatcattgctcaatatgcacgacacgaaggtgatacaggatcagttgaagttcaagtagcagttcttacttgggaaatcaaccaccttaacgaccacatcaaacaacacaaaaaagaccacgctacttaccgtggattgatgaaaaaaattggtcaccgtcgtaacttattagcatacctacgtcgtacagatgttaaccgttaccgtgaattgattcaatcacttggacttcgtcgt

SEQ ID NO: 528 - protein, 89 aa, Streptococcus agalactiae
MAISKEKKNEIIAQYARHEGDTGSVEVQVAVLTWEINHLNDHIKQHKKDHATYRGLMKKIGHRRNLLAYLRRTDVNRYRELIQSLGLRR

SEQ ID NO: 529 - DNA, 267 bp, Streptococcus pyogenes
atggcaatctcaaaagagaaaaaaaatgaaatcattgctcaatatgcacgtcatgaaggcgatacaggttcagttgaagttcaagtagcagttcttacttgggaaatcaaccacttgaacagccacatcaaacaacacaaaaaagaccacgctacttaccgtggattgatgaaaaaaattggtcaccgtcgtaacttgttggcatacctacgtcgtacagatgttaaccgttaccgtgagttgatccaatctcttggacttcgtcgt

SEQ ID NO: 530 - protein, 89 aa, Streptococcus pyogenes
MAISKEKKNEIIAQYARHEGDTGSVEVQVAVLTWEINHLNSHIKQHKKDHATYRGLMKKIGHRRNLLAYLRRTDVNRYRELIQSLGLRR

SEQ ID NO: 531 - DNA, 2139 bp, Streptococcus agalactiae
atggagaataatatgtcaaaacaagtctttgaaatgatttttgctggaaaaaaattagttgttgaaactggccaagtggctaaacaagcaaatggatcagttgtcgttcgttatggagattctactgtactcacagcagcagttatgtctaagaaaatgtcaacaggtgattttttcccacttcaagtcaattacgaagaaaaaatgtatgctgctgggaaatttccgggtggctttaacaaacgtgaagggcgtccaagtacggatgctaccttaacagcacgtcttattgatagaccaatccgtccgatgtttgctgagggatttcgtaacgaagtacaggtcatcaatactgttctttcatttgatgaaaatgctagcgcaccaatggctgctatgtttggttcatcattagcattatcgatttccgatattcctttcaatgggccaattgctggagttcaagttgcttatgttgatggtaattttattattaatccgacagcacaagaacaagaggcttctgcgttagaattaacggttgcaggtactaaagaagcgattaacatggttgaatctggagcgaaagaactttcagaagaaatcatgctagaggctcttcttaaaggacatgaggctgtctgtgaattaatcgcctttcaagaagagattgttactgctattggtaaagaaaaagccgaggtagaacttcttcaagttgatccagaacttcaagcagaaattattgctactcataacatagctttacaggctgcagtacaagttgaagagaaaaaggctagagaagcagctacagaagcagttaaagaagtagttataggtgaatatgaggcacgttacgctgaacatgaagaatatgatcgcattatgcgtgatgttgctgaaattttagaacaaatggaacatgcagaagttcgtcgcctcattacagaagataagattcgtcctgatggacgtcgtgtggatgagattcgtccattagacgcagagattgattttttaccacaagttcatggatcaggtctctttacacgaggacaaacccaagcattatcagtattaacgttagcacctatgggtgaagcacaaatcattgatgggctaacaccagagtataagaaacgctttatgcaccactataacttcccacaatattcagttggtgagacgggacgttatggagctgcagggcgtcgtgaaattggtcacggtgctttaggagagcgtgcattagaacaagtccttccaagattggaggagtttccgtatgctatccgactagttgcagaagttttagaatcaaacggttcatcatctcaggcttctatatgtgctggaacgcttgctcttatggcaggtggtgtgcctataaaagctccagttgctggtattgccatggggctcatatcagatggaacaaactatacagtcctcactgatattcaaggattagaagaccattttggcgatatggactttaaagttgcgggtacacgtgaagggattacagcacttcaaatggatattaaaattgaaggtattacccctcaaattttggaagaagctcttgcgcaagctaaaaaagcacgctttgaaattcttgatgtccttcatggagctatcgcagagccacgtccacaattagcaccaacggcacctaagattgatatgataaaaatcgatgttgataagattaaagttgtcatcggtaaaggtggcgaaactatcgataaaatcatcgctgaaacaggtgttaagattgatattgatgaagaaggaaatgtatctatcttctctagtgatcaggctgctattgatcgtacgaaagacattattgcaagtttagtacgtgaagcaaaagtgggagaagtttaccatgctaaagtagttcgtatcgagaaattcggtgcctttgtcaacctctttgataaaacagatgcattggtacatatttcagaaattgcatggacacgtacagcaaatgtagctgatgttcttgaaattggtgaagaagttgatgtgaaagtcatcaaaattgatgataaagggcgagttgatgcttctatgaaagcattgttaccacgtcctccaaaagctgacaatcctaaaaaggaatct

SEQ ID NO: 532 - protein, 713 aa, Streptococcus agalactiae
MENNMSKQVFEMIFAGKKLVVETGQVAKQANGSVVVRYGDSTVLTAAVMSKKMSTGDFFPLQVNYEEKMYAAGKFPGGFNKREGRPSTDATLTARLIDRPIRPMFAEGFRNEVQVINTVLSFDENASAPMAAMFGSSLALSISDIPFNGPIAGVQVAYVDGNFIINPTAQEQEASALELTVAGTKEAINMVESGAKELSEEIMLEALLKGHEAVCELIAFQEEIVTAIGKEKAEVELLQVDPELQAEIIATHNIALQAAVQVEEKKAREAATEAVKEVVIGEYEARYAEHEEYDRIMRDVAEILEQMEHAEVRRLITEDKIRPDGRRVDEIRPLDAEIDFLPQVHGSGLFTRGQTQALSVLTLAPMGEAQIIDGLTPEYKKRFMHHYNFPQYSVGETGRYGAAGRREIGHGALGERALEQVLPRLEEFPYAIRLVAEVLESNGSSSQASICAGTLALMAGGVPIKAPVAGIAMGLISDGTNYTVLTDIQGLEDHFGDMDFKVAGTREGITALQMDIKIEGITPQILEEALAQAKKARFEILDVLHGAIAEPRPQLAPTAPKIDMIKIDVDKIKVVIGKGGETIDKIIAETGVKIDIDEEGNVSIFSSDQAAIDRTKDIIASLVREAKVGEVYHAKVVRIEKFGAFVNLFDKTDALVHISEIAWTRTANVADVLEIGEEVDVKVIKIDDKGRVDASMKALLPRPPKADNPKKES

SEQ ID NO: 533 - DNA, 2130 bp, Streptococcus pyogenes
atgtcaaaacaaacctttacaacaacatttgcagggaaaccccttgttgttgaagttggtcaagtcgctaagcaagccaatggggcaaccgttgttcgttatggcgactcaactgtcctgaccgcagctgttatgtctaagaaaatggcaacgggtgatttcttcccccttcaagttaattacgaagaaaaaatgtatgccgctggtaaattcccaggaggtttcatgaaacgtgagggacgcccttcaacagatgcgaccttgacagctcgcttgattgaccgcccgattcgtcccatgtttgccgaaggttttcgtaacgaagtacaagtgattaacactgtcctttcttatgatgaaaatgctagcgctccaatggcagcgatgtttggctcatctctggccttgtcaatctcagatattccatttaatggaccgattgcaggtgttcaagttggctatattgatggcgagttcatcattaacccagataaagaacagatggaagcatcactcttagaattaactgttgctggtagcaaagaagccatcaatatggttgagtctggtgccaaagaattatcagaagacatcatgcttgaggctcttttaaaaggtcaccaagctattcaagaattaattgccttccaagaacaaatcgtagcagttgttggtaaagaaaaagctgaggttgaactgttacaggttgatgtagacttacaagctgatattgtggctaagtacaatgctcaactgcaaaaagctgttcaagttgaagagaaaaaagcgcgtgaagcagccacagaagccgttaaagaaatggttaaggctgaatacgaagagcgttacgcagaagacgaaaacctagcaaccattatgcgtgacgtggcagaaatccttgaacaaatggagcatgctgaggtgcgccgcctcattacagaagacaagattcgtcctgatggtcgtaagattgacgaaattcgtccgcttgatgctgtggttgacttcttgccaaaagtacatggatcaggtctttttacgcgcggtcaaacgcaggccttgtcagttttgactttggcaccaatgggagaaactcaaatcattgatggtctggccccagagtacaaaaaacgctttttgcatcactacaatttcccgcaatattcagttggtgaaacgggtcgttacggagctgctggtcgtcgtgaaattggacacggtgccttaggtgaacgcgctcttgaacaagtcttgccaagcttagaagagtttccttatgctattcgtttagttgccgaagttctagaatctaacggttcgtcttctcaggcttctatctgtgctgggacccttgccctaatggctggtggtgtgccgattaaagcgcctgtggcagggattgccatgggtctcatttccgatgggacgaattatacagtcttgaccgatatccaaggtcttgaagaccactttggagatatggactttaaagtggcaggaactcgtgaagggattacagcccttcaaatggatattaagattgcaggaattacccctcaaatcctagaagaagctcttgcacaagctaaaaaagctcgctttgaaatccttgatgtgattgaagcaactatcgctgaaccacgtcctgagttagccccaactgcaccgaaaattgacaccatcaagattgacgtagacaaaatcaaagtggttatcggtaaaggtggcgaaactattgacaagattattgccgaaacgggtgtcaaaattgatattgatgacgaaggaaatgtctctatctactcaagtgaccaagctgccattgaccgcactaaagaaattattgcaggtcttgttcgtgaagctaaggtaggcgaagtttaccatgctaaggttgtccgtattgagaaatttggtgcctttgtcaacctctttgacaagacagatgctcttgttcacatttctgaaattgcctggacgagaacgaccaacgtgtcagatgtccttgaagtgggtgaagacgttgatgttaaggtcattaagattgatgagaagggtcgtgtggatgcctcaatgaaagctttgattccacgcccaccaaaaccagagaaaaaagaagaaaaacatgac

SEQ ID NO: 534 - protein, 710 aa, Streptococcus pyogenes
MSKQTFTTTFAGKPLVVEVGQVAKQANGATVVRYGDSTVLTAAVMSKKMATGDFFPLQVNYEEKMYAAGKFPGGFMKREGRPSTDATLTARLIDRPIRPMFAEGFRNEVQVINTVLSYDENASAPMAAMFGSSLALSISDIPFNGPIAGVQVGYIDGEFIINPDKEQMEASLLELTVAGSKEAINMVESGAKELSEDIMLEALLKGHQAIQELIAFQEQIVAVVGKEKAEVELLQVDVDLQADIVAKYNAQLQKAVQVEEKKAREAATEAVKEMVKAEYEERYAEDENLATIMRDVAEILEQMEHAEVRRLITEDKIRPDGRKIDEIRPLDAVVDFLPKVHGSGLFTRGQTQALSVLTLAPMGETQIIDGLAPEYKKRFLHHYNFPQYSVGETGRYGAAGRREIGHGALGERALEQVLPSLEEFPYAIRLVAEVLESNGSSSQASICAGTLALMAGGVPIKAPVAGIAMGLISDGTNYTVLTDIQGLEDHFGDMDFKVAGTREGITALQMDIKIAGITPQILEEALAQAKKARFEILDVIEATIAEPRPELAPTAPKIDTIKIDVDKIKVVIGKGGETIDKIIAETGVKIDIDDEGNVSIYSSDQAAIDRTKEIIAGLVREAKVGEVYHAKVVRIEKFGAFVNLFDKTDALVHISEIAWTRTTNVSDVLEVGEDVDVKVIKIDEKGRVDASMKALIPRPPKPEKKEEKHD

SEQ ID NO: 535 - DNA, 750 bp, Streptococcus agalactiae
atgacaagtacaaacgagttagacattagattgcgtgcttttatcaatgcaccggataattttttagatagtataggtcttgtgaatgccttgcaccactctacggtttgggcaagcaaggaaccctatgctattcaagtagatggtcaagaagttgttcctgtttttacggatattactgaccttaatcatttcaaagaggagcaagaaagtgctcgagatatgttttgggagagtcgtcgtagtttagacgttcttgatgaagctatttcacatggcttagcaggattggtctataatttaaaaaaagaaggcgattttgggaactcgactattttctactgtgaagatatggtgcaatttatgaataattacaccacaatcttaaatcagttgttaaatgaagataacattgttgccgatatcatggataaaacctacttggtacctgcctttgtccatccacgtgaagaaggtagttttgaccgtcttttccctacaatgtctacccccgaaggaaaaagttatgttccagtattctcaaaccttttaagttttgaaaaatggtataaccataatgattttggtggtgcttttaggaaagcacaaggagtaattttagcctggacgattgacgatatttataaaccgcgtaatggagaaaatgagattgatgatacctttggagtagccatcaatccatttgatgaacaacaagttttagttgattggtctgatgtagaaaacgat

SEQ ID NO: 536 - protein, 250 aa, Streptococcus agalactiae
MTSTNELDIRLRAFINAPDNFLDSIGLVNALHHSTVWASKEPYAIQVDGQEVVPVFTDITDLNHFKEEQESARDMFWESRRSLDVLDEAISHGLAGLVYNLKKEGDFGNSTIFYCEDMVQFMNNYTTILNQLLNEDNIVADIMDKTYLVPAFVHPREEGSFDRLFPTMSTPEGKSYVPVFSNLLSFEKWYNHNDFGGAFRKAQGVILAWTIDDIYKPRNGENEIDDTFGVAINPFDEQQVLVDWSDVEND

SEQ ID NO: 537 - DNA, 750 bp, Streptococcus pyogenes
atgactaaatcaaatgaattagatattcgcttaagagcttttatcaatgcgcctgataactttttggatagccttgcgcttgtcaacgctttccataattttcctgtctgggctgctaaagaaccctacgtgatagaagtcgaaggtgtcaaggttacccctgtttttaccgataaggaagatatggctcgctttaaagaagaacaaaagagtgctcaaagtcagtattggctggagcgttcagctcttgcagtgctagaagaagtcattacatctggtgcagcaggtcttatctttaaccttaagaaaaagggagattttgggaattctaccattttcaaaagcagtgatatgattcaatttatgaaccattacaccactgtgttaaatacgcttatgagtgatgacaatgtggcggcagatacgatggaaaaggtttaccttgttcctgcctttgtttatcctaaagataataaccattacgaccgcctttttcctaccatgtcaacgcctgaaggaaaaagctatgttcccgccttttcaaatcttcaaagctttgcgaaatggtacaaccaagacgattttggaggccttttcaggaaagctgaaggagtgattctgacttggacgattgatgatatttatcaaccaagaaatggtgaaaacgagcttgatgaaacgttcggtgtcgccatcaatccttttgatgaccaacaaattcttgttgattggtcagaattagataagtcg

SEQ ID NO: 538 - protein, 250 aa, Streptococcus pyogenes
MTKSNELDIRLRAFINAPDNFLDSLALVNAFHNFPVWAAKEPYVIEVEGVKVTPVFTDKEDMARFKEEQKSAQSQYWLERSALAVLEEVITSGAAGLIFNLKKKGDFGNSTIFKSSDMIQFMNHYTTVLNTLMSDDNVAADTMEKVYLVPAFVYPKDNNHYDRLFPTMSTPEGKSYVPAFSNLQSFAKWYNQDDFGGLFRKAEGVILTWTIDDIYQPRNGENELDETFGVAINPFDDQQILVDWSELDKS

SEQ ID NO: 539 - DNA, 594 bp, Streptococcus agalactiae
ttgaggataactatggggtggtggaaagaaagtatagctattgtcaaagaacaagatccagctgctcgtagttctctagaagttattttaacttatccaggaataaaagctcttgcagctcataggctatctcattttttatggaatcataattttaaattgttagcacgtatgcacagtcaattttggcgtttctggacacaaattgaaattcatcccggagcgacgatttcggaaggggtttttattgaccacggttcaggattggtcattggagaaactgccattgtagagaaaggtgctatgctataccatggggttacattgggtggcacaggtaaagacaaaggcaaacgacacccaaccatacgtaaaggagcgctaatttcagcacattctcaaatcattggtccaattgaggttggagaaaatgctaaagtcggtgctgcagcagttgtccttgcagatgtgccagcagacgtaacagtagttggtgttccagctaaagttgtccgtgtccatggtcaaaaggatgatcttcaaatccgaagtattgaacatgatcgagaagaaagttattattcgtccaaactt

SEQ ID NO: 540 - protein, 198 aa, Streptococcus agalactiae
MRITMGWWKESIAIVKEQDPAARSSLEVILTYPGIKALAAHRLSHFLWNHNFKLLARMHSQFWRFWTQIEIHPGATISEGVFIDHGSGLVIGETAIVEKGAMLYHGVTLGGTGKDKGKRHPTIRKGALISAHSQIIGPIEVGENAKVGAAAVVLADVPADVTVVGVPAKVVRVHGQKDDLQIRSIEHDREESYYSSKL

SEQ ID NO: 541 - DNA, 579 bp, Streptococcus pyogenes
atgggttggtggaaagaaagtatagctattgttaaagctctagacccagctgctcgtaatagtcttgaggttatcctaacttatccaggcatcaaagccctagctgctcatcgtttgtctcattttctttggcgacatcattttaaattactagccagaatgcatagccaattttggcgattttggacacaaattgaaatccatcctggagcacaaatcgctcctggagtcttcattgaccatggtgctggtcttgttattggagagacagcaattgttgaaaaaggtgtgatgctttatcatggggtgaccctaggtggaaccggaaaagattgtggcaagcgtcatccaacggttcgacaaggtgccttaatttcggcacatgcccaagtgattggacctattgacatcggagcaaatgctaaagtaggggcagcagctgttgtgttatcagatgttcctgaagacgtgacagttgtaggtgtgccagctaagatagtacgagtgcatgggcaaaaagataatcgtcaaattcaaagtttacaaaaacaacgagaggtctcttatcagttgtcaaaa

SEQ ID NO: 542 - protein, 193 aa, Streptococcus pyogenes
MGWWKESIAIVKALDPAARNSLEVILTYPGIKALAAHRLSHFLWRHHFKLLARMHSQFWRFWTQIEIHPGAQIAPGVFIDHGAGLVIGETAIVEKGVMLYHGVTLGGTGKDCGKRHPTVRQGALISAHAQVIGPIDIGANAKVGAAAVVLSDVPEDVTVVGVPAKIVRVHGQKDNRQIQSLQKQREVSYQLSK

SEQ ID NO: 543 - DNA, 180 bp, Streptococcus agalactiae
gtgaaggattatgtaacaactcaaatattatcaatcttaggtatactagcagcagcttgtttaagctatttaaagtttgcacaaggtaaccctctcttaggaattatttgggctgcttttgttttaatgtatgttgttcgtttgtataaagcttatcaaaaacagaaaaaggaaaaacca

SEQ ID NO: 544 - protein, 60 aa, Streptococcus agalactiae
MKDYVTTQILSILGILAAACLSYLKFAQGNPLLGIIWAAFVLMYVVRLYKAYQKQKKEKP

SEQ ID NO: 545 - DNA, 1341 bp, Streptococcus agalactiae
atgataaaaatttacgacactatgactcgcagtttacaagattttatacctctcaatgaaggtaaagtcaacatgtacgtctgtgggccaacagtttataactatatacacatcgggaatgcccgcagtgtagtagcttttgatactattcgtcgttattttgagtattgtggttaccaagtcaattatatttctaactttactgatgttgatgataaaattataaaaggtgcagctgaagcaggtatggatacaaaatccttttcagataagtttatttcagcatttatggaagatgttgctgcattaggtgtcaaacctgctacaaaaaatcctcgagttattgactatatggatgagattattgattttgttaaagttttagttgataaggaatttgcctatgaagctaatggagatgtttattttagagtaagtaaatcacatcattatgcaaaattagccaataaaactttggaagatttagagattggtgcaagtggtcgtgttgatggtgaaggagagattaaagagaatcctttagattttgcactttggaaatcagctaaatctggggaagtctcatgggaaagtccttgggggaaagggcgcccagggtggcatattgaatgttctgttatggcaactgagatccttggtgatactattgatatccatggtggaggagctgatttagaatttccacatcacacgaatgagattgcacaatctgaagctaaaacaggtaagacctttgcaaattactggatgcataatggttttgttaacgttgataacgagaaaatgtctaaatctcttggtaactttattactgttcacgatatgttgaagagcgttgacggacaagtaatacgttttttcttagcgacacaacagtatcgtaaacccgtgaatttcactgaaaaggccgttcatgatgcggaagttaaccttaaatatttaaaaaatactttcaacttaccaatccaagagaatgctaatgatgaagaattagagcaatttgtgaaagcatttcaaggagcgatggatgatgattttaatacagcaaacggtattactgttatctttgaaatggcaaaatggattaattcaggacactatacttcaagagttaaggaaacctttgctgaattattagaaatttttggtattgtattccaagaggaagttcttgatgctgatattgaatctttaatagaacaacgtcaagaagcacgagctaatcgtgattttgcaactgctgatcgtattagagatgaattagcaaaacaaggaattaaattgttagatactaaggatggcgtgaggtggactcgtgat

SEQ ID NO: 546 - protein, 447 aa, Streptococcus agalactiae
MIKIYDTMTRSLQDFIPLNEGKVNMYVCGPTVYNYIHIGNARSVVAFDTIRRYFEYCGYQVNYISNFTDVDDKIIKGAAEAGMDTKSFSDKFISAFMEDVAALGVKPATKNPRVIDYMDEIIDFVKVLVDKEFAYEANGDVYFRVSKSHHYAKLANKTLEDLEIGASGRVDGEGEIKENPLDFALWKSAKSGEVSWESPWGKGRPGWHIECSVMATEILGDTIDIHGGGADLEFPHHTNEIAQSEAKTGKTFANYWMHNGFVNVDNEKMSKSLGNFITVHDMLKSVDGQVIRFFLATQQYRKPVNFTEKAVHDAEVNLKYLKNTFNLPIQENANDEELEQFVKAFQGAMDDDFNTANGITVIFEMAKWINSGHYTSRVKETFAELLEIFGIVFQEEVLDADIESLIEQRQEARANRDFATADRIRDELAKQGIKLLDTKDGVRWTRD

SEQ ID NO: 547 - DNA, 1341 bp, Streptococcus pyogenes
atgattaaaatttatgataccatgacccgttcgctccgcaagtttgtacctttgactgaaaatacagtcaatatatacgtttgtggaccgacggtctataattatattcatattggaaatgctagatcagcggtcgcttttgacaccattcgacgttattttgagtatactggctatcaggtcaattacatttccaattttaccgatgtcgatgataaaattatcaaggctgctactcaagcaggtgtttctcctaaagaattgtcagatcgctttattgcagcttttatagaagataccaaggcacttggtgttaagccagccacacaaaatcctcgtgttatggattatatagcagaaatcatttcatttgttgaaagtctcattgaaaaagattttgcttacgaagcagatggagatgtgtatttccgcgtggaaaagtcagagcattatgccaagctagctaataaaaccctgtcagaacttgaagttggagccagtggtcgaacagatgctgagacagctttaaaagaaaatccactggactttgctctttggaaatcagctaaggcaggtgaggtttcttgggatagcccctgggggtttggtcgtccaggctggcacattgaatgttctgtgatggctactgaaattcttggtgataccattgatattcatggtggcggagctgatttggaatttcctcatcataccaatgaaattgcccaatctgaggccaaaacaggcaagacttttgctaactattggatgcacaatgggtttgtcactgttgataacgaaaaaatgtccaagtcactaggtaattttgtgaccgttcatgacatgttacaaaccgttgatggtcaggttttgcgattctttcttgcgacacaacagtaccgaaaaccaattaacttcactgaaaagactattcatgatgcggaaatcaatctgaagtatcttaaaaacaccttgcaacaaccgctgacagaaactgcagatgagcaagagctaaaacagtttgtaatagctttccaagacgctatggacgatgatttcaatacagcaaatgggattaccgtcgtatttgacatggccaagtggattaattctggctcctatacagaacctgttaaaagcgcttttgagaaaatgttagctgtttttggcattatctttgaagaagaggtgcttgaggttgacattgaagccttgattgccaagcgacaagaagcacgcgcgaatcgtgattttgccacagctgatgccattcgagatcagttagcagttcaaggcatcaagctgctagataccaaagatggtgtgaggtggctgcgtgac

SEQ ID NO: 548 - protein, 447 aa, Streptococcus pyogenes
MIKIYDTMTRSLRKFVPLTENTVNIYVCGPTVYNYIHIGNARSAVAFDTIRRYFEYTGYQVNYISNFTDVDDKIIKAATQAGVSPKELSDRFIAAFIEDTKALGVKPATQNPRVMDYIAEIISFVESLIEKDFAYEADGDVYFRVEKSEHYAKLANKTLSELEVGASGRTDAETALKENPLDFALWKSAKAGEVSWDSPWGFGRPGWHIECSVMATEILGDTIDIHGGGADLEFPHHTNEIAQSEAKTGKTFANYWMHNGFVTVDNEKMSKSLGNFVTVHDMLQTVDGQVLRFFLATQQYRKPINFTEKTIHDAEINLKYLKNTLQQPLTETADEQELKQFVIAFQDAMDDDFNTANGITVVFDMAKWINSGSYTEPVKSAFEKMLAVFGIIFEEEVLEVDIEALIAKRQEARANRDFATADAIRDQLAVQGIKLLDTKDGVRWLRD

SEQ ID NO: 549 - DNA, 384 bp, Streptococcus agalactiae
gtgattgatgttcgtttgattaatggtattgctttagcttttgaaggagatgcagtttattctttgtatatccgacgccatttaattatgcagggttttaccaaacctaatcagttacatcggaaagcaacccaatatgtttctgctaatgcccaagcattgttaattaatgccatgttagaagaaaatattttaactgatgaagagcagttaatttataaacgaggacgtaatgcgaatagtcatacaaaagctaaaaatgctgatattattacctatcgtatgtctacaggttttgaggctcttatggggtacttggatatgactggtcagataaagcgcttggaaactctaatacagtggtgtattgaaaccattgaaaaa

SEQ ID NO: 550 - protein, 128 aa, Streptococcus agalactiae
MIDVRLINGIALAFEGDAVYSLYIRRHLIMQGFTKPNQLHRKATQYVSANAQALLINAMLEENILTDEEQLIYKRGRNANSHTKAKNADIITYRMSTGFEALMGYLDMTGQIKRLETLIQWCIETIEK

SEQ ID NO: 551 - DNA, 411 bp, Streptococcus pyogenes
gtgactaatccagttgatgtgaatttgattaatggcattgccctagcctttgaaggggatgcggtttattcctactatgttcgtcgtcatctcatttttcaaggtaaaacgaaacctagccagctacaccgtttagcaacgagatatgtttctgctaaggcacaagccaacttgattcaggctatgttagaagcgcagctattgaccgaaaaagaagaagacatctataagcgtggtcgcaataccaatagccatactaaagctaagaatgccgatattattacctatcgtatgtcgacaggttttgaagccattatgggttatcttgatatgatgggccaaaaagagcggttagaagaattgatcagatggtgtattgagtatgtagaaaagcaacaattgatatcctca

SEQ ID NO: 552 - protein, 137 aa, Streptococcus pyogenes
VTNPVDVNLINGIALAFEGDAVYSYYVRRHLIFQGKTKPSQLHRLATRYVSAKAQANLIQAMLEAQLLTEKEEDIYKRGRNTNSHTKAKNADIITYRMSTGFEAIMGYLDMMGQKERLEELIRWCIEYVEKQQLISS

SEQ ID NO: 553 - DNA, 753 bp, Streptococcus agalactiae
atgactatgaaagataaacaatttaaagaagaatcaagtgaccttgtctatggcttacatgctgtgacagagagtttaagagctaatactggtaataaattatacttgcaagatgacttaagaggaaagaacgttgataaagtcaaagcactagcgactgaaaaaaaagtatccatttcctggactcctaaaaaaaccttatcagacatgacaaatggtggagttcaccaaggattcgttctaaaagtttcggaatttgcctatgcggatttatcagagataatgacaaaggcagagaatgaagaaaatcctctcattttaatccttgatggtctgaccgaccctcacaacctaggttctattctacgcacagctgatgcaaccaatgtaacaggtattatcatccccaaacatcgttctgttggagtgaccccagtggtttcaaagacatctacaggagctgttgaacatgttcctattgcaagggtaactaatctcagtcaaactttggatactttaaaagataaggagttctggatatttggcactgatatgaatgggacaccatcgcataagtggaataccaaaggtaaattagccctagttattggtaatgaaggaaaaggtatttctcataatatcaaaaagcaagtagatgaaatgattacaattcccatgaatggtcatgttcagagtttaaatgccagtgtcgcagccgctattttgatgtatgaagtatttagaaaccgccta

SEQ ID NO: 554 - protein, 251 aa, Streptococcus agalactiae
MTMKDKQFKEESSDLVYGLHAVTESLRANTGNKLYLQDDLRGKNVDKVKALATEKKVSISWTPKKTLSDMTNGGVHQGFVLKVSEFAYADLSEIMTKAENEENPLILILDGLTDPHNLGSILRTADATNVTGIIIPKHRSVGVTPVVSKTSTGAVEHVPIARVTNLSQTLDTLKDKEFWIFGTDMNGTPSHKWNTKGKLALVIGNEGKGISHNIKKQVDEMITIPMNGHVQSLNASVAAAILMYEVFRNRL

SEQ ID NO: 555 - DNA, 771 bp, Streptococcus pyogenes
ttgaagcattcatggtataataaactcatggaagataaagatactattgaaacaaacgatatcgtctatggtgttcatgccgttacagaaagccttcaagcaaatacaggaaataagctttatatccaagaggatttaagaggaaagaaagtggataacatcaaaagcttagcgacacaaaaaaaggtcgctatttcatggacgcctaaaaaaaccttgtcacaaatgactgatggagctgtgcatcaaggttttgttctgagagtatcagcttttgcctatactgatgttgatgagatcctcgaaatagcagagcaagaagcaaatcctttgattcttattttagatggtctgacagatcctcataatttaggatcgattttacggacagctgatgctacaaatgtatgtggagtgattattcctaaacatcgttctgttggtgtgactccagtggtttcaaagacgtctacaggtgctgttgaacatattccgatagcgagagtaactaaccttagtcaaactctagataaattgaaagcaagaggattctggatttttggcacagacatgaatggaacaccgtctgattgctggaacactaatggtaaacttgctttagtcattggtaacgaaggtaaaggcatctctaccaatatcaaaaagcaagttgatgaaatgattacgattcctatgaatggtcacgtacagagcttaaatgctagcgtagcggcagctattctcatgtatgaagttttccgaaataggcgc

SEQ ID NO: 556 - protein, 257 aa, Streptococcus pyogenes
LKHSWYNKLMEDKDTIETNDIVYGVHAVTESLQANTGNKLYIQEDLRGKKVDNIKSLATQKKVAISWTPKKTLSQMTDGAVHQGFVLRVSAFAYTDVDEILEIAEQEANPLILILDGLTDPHNLGSILRTADATNVCGVIIPKHRSVGVTPVVSKTSTGAVEHIPIARVTNLSQTLDKLKARGFWIFGTDMNGTPSDCWNTNGKLALVIGNEGKGISTNIKKQVDEMITIPMNGHVQSLNASVAAAILMYEVFRNRR

SEQ ID NO: 557 - DNA, 516 bp, Streptococcus agalactiae
atgaaaaaacattctatcttactcgttgatggctacaatatgattgctttttggaaagatactcgacagctttttaaaagcaatcgtttagaagaggcaagggaagtattacttagaaagctaaatcattacgcacatttcgaacacattgatattatttgtgtatttgatgcacagtatgttcctggtgtacgtcaacgttatgaccaatacaaaatatccgttatctttactgaggaggacgaaactgcggatagctatattgaacgagcagcggcagaacttaatcaatctgtgttaaatttagtctccgttgctaccagtgatttaaatgaacaatggactatattttctcagggtgctttacgtgtctcggctagagaattggaacagcgtgtagcgacagtaaaatcagatttggataagatgtccagtcaaatcgatttgagtacgccaaagttaaggccgtggaatgatgaacaactaggaaaactcaaggattttttagatggtatg

SEQ ID NO: 558 - protein, 172 aa, Streptococcus agalactiae
MKKHSILLVDGYNMIAFWKDTRQLFKSNRLEEAREVLLRKLNHYAHFEHIDIICVFDAQYVPGVRQRYDQYKISVIFTEEDETADSYIERAAAELNQSVLNLVSVATSDLNEQWTIFSQGALRVSARELEQRVATVKSDLDKMSSQIDLSTPKLRPWNDEQLGKLKDFLDGM

SEQ ID NO: 559 - DNA, 516 bp, Streptococcus pyogenes
atgaaaaaacggatattattagtagatgggtataatatgattgccttttggcaatcaacccgtcagttgtttaagacaaatcagcttgatcaggcacgtaacacacttttaacaaaacttaatcattatgcccattttgagaatattaatattatttgtgtttttgatgcccaatatgtaccggggttaaggcaacgatatgaccagtattatatctcagtggtatttacagaggaagacgaaacagcagatagctacattgagcgcatggcagcagagttaaatacggctatacatatggtagaagtagctacgagtgatttaaatgaacaatggacgattttttctcaaggagctcttcgtgtcactgcaagagaattagagcaaagagttcatactgtcaaagctgatttagataaaatgtctagagatattgatctcaaaacgcctaaactgcggccttttgaccaaggacagcttattcaattgaaggattttatgtctcagttagatcga

SEQ ID NO: 560 - protein, 172 aa, Streptococcus pyogenes
MKKRILLVDGYNMIAFWQSTRQLFKTNQLDQARNTLLTKLNHYAHFENINIICVFDAQYVPGLRQRYDQYYISVVFTEEDETADSYIERMAAELNTAIHMVEVATSDLNEQWTIFSQGALRVTARELEQRVHTVKADLDKMSRDIDLKTPKLRPFDQGQLIQLKDFMSQLDR

SEQ ID NO: 561 - DNA, 858 bp, Streptococcus agalactiae
atgacttttaaaatactaacggattcgacatcggatttagatgaaaagtgggctcaagagcacaatgtcgatattataggtttaaccattgaacttgatggaaagacttatgagacagtcggagacgaaaaaattactagtgacttcttgttggagcgtatgcaagagggagcaaagcctacaacaagccaaattaacgttggtcagtttgaagaagttttttcaacctatgcagaaaatgaccatgccttgttatatttagcgctatcttcacatttatcaggcacttaccagagtgcaactattgcgcgtgagatggtcttagacaaatatcctgatgctcaaattgagattgtggatacgatggcagcttcatgtggtgagggtgtcttagcgatgttagcaactaaagagcgacaagaaggtaaatctttagaagaagtgaaacaaaaaattgaatcacttctccctaaattaaacacatactttttagttgacgatctcaaccatttaatgcgtagtggtcgcttatcaaaaggtgcagctatcattggaagtgttgctaagattaaaccattacttaagttagatagtgagggtaaattagtaccatttgccaagacaaggggccgtaaaaaaggtattaaagagattgtgactcaggcaacaaaaacactatcttatagcactttaattattgcttatagtggagagaaagattcagctcaagttatgaaagaacagttattagcagatgagcgtattgaagaagttattattcgtccattagggccagttatttcagctcatgtgggctcaggtgctttagctctattctctttaggggaagaaaaccga

SEQ ID NO: 562 - protein, 286 aa, Streptococcus agalactiae
MTFKILTDSTSDLDEKWAQEHNVDIIGLTIELDGKTYETVGDEKITSDFLLERMQEGAKPTTSQINVGQFEEVFSTYAENDHALLYLALSSHLSGTYQSATIAREMVLDKYPDAQIEIVDTMAASCGEGVLAMLATKERQEGKSLEEVKQKIESLLPKLNTYFLVDDLNHLMRSGRLSKGAAIIGSVAKIKPLLKLDSEGKLVPFAKTRGRKKGIKEIVTQATKTLSYSTLIIAYSGEKDSAQVMKEQLLADERIEEVIIRPLGPVISAHVGSGALALFSLGEENR

SEQ ID NO: 563 - DNA, 858 bp, Streptococcus pyogenes
atgacctttacaataatgacagattcaaccgctgatttgaatcaaacctgggcagaagatcatgatattgtccttataggattaacgattttgtgcgatggagaggtttatgaaacggtcggtcctaaccgtattagtagtgattaccttttgaaaaagatgaaagctggcagtcatcctcaaaccagtcagattaatgtgggagagtttgagaaggtttttcgtgaacatgctaggaacaacaaagcactgctttatcttgctttttcttcggttttatcgggtacctatcaaagcgctctaatggcacgcgatcttgttcgagaagattatcccgatgcggtgattgaaattgttgataccttggctgctgcaggaggagaaggctatctaaccattttagcagcagaagccagagatagtggcaaaaatttactggagactaaagatattgttgaagcagtgatccctcgactgcgcacctatttcttagtagatgatctttttcatttgatgcgtggtgggcgtctgtcaaaaggttcagcttttctaggcagtttagccagtatcaaacctcttttgtggattgatgaggaagggaaattggtgcccattgcaaaaattcggggacgccaaaaagccatcaaagaaatggtggctcaagtggaaaaagatattgcggattcgacggttattgtctcttatacaagcgatcagggtagtgccgaaaagttacgagaagagctgctggcgcatgaaaatattagcgatgttcttatgatgccactaggaccagttatctcagctcacgttggtcctaacaccctggcagtttttgtgattgggcaaaattcccgt

SEQ ID NO: 564 - protein, 286 aa, Streptococcus pyogenes
MTFTIMTDSTADLNQTWAEDHDIVLIGLTILCDGEVYETVGPNRISSDYLLKKMKAGSHPQTSQINVGEFEKVFREHARNNKALLYLAFSSVLSGTYQSALMARDLVREDYPDAVIEIVDTLAAAGGEGYLTILAAEARDSGKNLLETKDIVEAVIPRLRTYFLVDDLFHLMRGGRLSKGSAFLGSLASIKPLLWIDEEGKLVPIAKIRGRQKAIKEMVAQVEKDIADSTVIVSYTSDQGSAEKLREELLAHENISDVLMMPLGPVISAHVGPNTLAVFVIGQNSR

SEQ ID NO: 565 - DNA, 201 bp, Streptococcus agalactiae
ttgttgatgaaagtttttggaaaatgtttttgttgctggcgcatttgccctcataggaataactattttattgatgcttttactaggaaggttgatattgctacttatttttcaaggggagatgatgcaattttagcagttataggaatatcattgatagctatgggaatttcagtgtactaccataagtataaggacaga

SEQ ID NO: 566 - protein, 67 aa, Streptococcus agalactiae
MLMKVFGKCFCCWRICPHRNNYFIDAFTRKVDIATYFSRGDDAILAVIGISLIAMGISVYYHKYKDR

SEQ ID NO: 567 - DNA, 543 bp, Streptococcus agalactiae
ttgtttaccccatttgtaaggccccggaacctttcaaatactctcgtggaccggaacatccacacctgtaaacaaaaacgaattcgtataggagaaatcatgaacaaaacaactttcatggctaaaccaggccaagttgaacgcaaatggtacgttgttgacgcagcagatgtacctcttggacgtctttctgcagtagttgctagcgtacttcgcggaaaaaacaaaccaactttcacaccacacactgatacaggtgactttgtgattgttatcaatgctgaaaaagttaaattaactggtaaaaaagcgtcagataaaatctactacactcactcaatgtatccaggtggtttgaaacaaatctcagcaggtgaacttcgttctaaaaatgctgttcgtttgattgaaaaatcagttaaaggcatgcttccacataacactcttggacgtgcacaaggtatgaaattgaaagtatttgttggcggtgagcatacacatgctgcacaacaaccagaagtacttgatatctcaggacttatc

SEQ ID NO: 568 - protein, 181 aa, Streptococcus agalactiae
MFTPFVRPRNLSNTLVDRNIHTCKQKRIRIGEIMNKTTFMAKPGQVERKWYVVDAADVPLGRLSAVVASVLRGKNKPTFTPHTDTGDFVIVINAEKVKLTGKKASDKIYYTHSMYPGGLKQISAGELRSKNAVRLIEKSVKGMLPHNTLGRAQGMKLKVFVGGEHTHAAQQPEVLDISGLI

SEQ ID NO: 569 - DNA, 549 bp, Streptococcus pyogenes
ttgtttaccccatttgaaaggccccggaaccttccaaataccttcgatgggacggaacacccatcaccttgtaaacaaatattacgaattcgtataggagaaatcatgaacaaaacaactttcatggctaaaccaggccaagttgaacgcaaatggtacgttgttgacgcagctgatgtgccacttggacgtctttctgcagtagttgctagcgtacttcgcggaaaaaacaaaccaactttcacaccacatactgatacaggtgattttgttatcgttatcaacgctgaaaaagttaaattaactggtaaaaaagcaactgataaagtttactacactcactcaatgtacccaggtggtttgaaatcaatcactgctggtgaacttcgctctaaaaacgcagttcgcttgattgaaaaatcagttaaaggcatgcttccacataacactcttggacgtgcacaaggtatgaaattgaaagtcttcgttggcggtgagcatactcacgcagcacaacaaccagaagtacttgacatctcaggacttatc

SEQ ID NO: 570 - protein, 183 aa, Streptococcus pyogenes
LFTPFERPRNLPNTFDGTEHPSPCKQILRIRIGEIMNKTTFMAKPGQVERKWYVVDAADVPLGRLSAVVASVLRGKNKPTFTPHTDTGDFVIVINAEKVKLTGKKATDKVYYTHSMYPGGLKSITAGELRSKNAVRLIEKSVKGMLPHNTLGRAQGMKLKVFVGGEHTHAAQQPEVLDISGLI

SEQ ID NO: 571 - DNA, 390 bp, Streptococcus agalactiae
atggcacaagcacaatatgcaggtactggtcgccgtaaaaacgctgttgcacgcgttcgtttggtcccaggtactggtaaaattacaatcaataaaaaagatgtagaagagtacatcccacacgcagaccttcgtcttgttatcaaccaacctttcgcagttacttcaactcaaggttcatacgatgtttttgttaacgttgtaggtggtggatatgcaggtcaatcaggtgcgatccgtcatggtatctcacgtgcacttttagaagttgacccagatttccgcgattcattgaaacgtgctggacttcttacacgtgacgcacgtatggttgaacgtaaaaaaccaggtcttaagaaagctcgtaaagctagtcagttctcaaagcgt

SEQ ID NO: 572 - protein, 130 aa, Streptococcus agalactiae
MAQAQYAGTGRRKNAVARVRLVPGTGKITINKKDVEEYIPHADLRLVINQPFAVTSTQGSYDVFVNVVGGGYAGQSGAIRHGISRALLEVDPDFRDSLKRAGLLTRDARMVERKKPGLKKARKASQFSKR

SEQ ID NO: 573 - DNA, 390 bp, Streptococcus pyogenes
atggcacaagcacaatatgcaggtactggccgtcgtaaaaacgctgttgcacgcgttcgtttggttccaggtactggtaaaatcactgttaacaaaaaagatgtagaagaatacatcccacatgctgacttacgtttgatcatcaaccaaccttttgcagttacatcaactgaaggttcatacgacgttttcgttaacgttgttggtggtggttacggtggacaatcaggtgcgatccgtcatggtatcgctcgtgcgcttcttcaagtagacccagacttccgcgattcattgaaacgcgctggccttcttacacgtgacgcacgtatggttgaacgtaaaaaaccaggtcttaagaaagctcgtaaagcttcacaattctcaaaacgt

SEQ ID NO: 574 - protein, 130 aa, Streptococcus pyogenes
MAQAQYAGTGRRKNAVARVRLVPGTGKITVNKKDVEEYIPHADLRLIINQPFAVTSTEGSYDVFVNVVGGGYGGQSGAIRHGIARALLQVDPDFRDSLKRAGLLTRDARMVERKKPGLKKARKASQFSKR

SEQ ID NO: 575 - DNA, 1152 bp, Streptococcus agalactiae
atgtccattcacaaatacccaagcaaaaaagccaaaaatggctatttgtattttgtcaaaatctatatggtcaaagacagtcaacgtgcagaccatatcaaacgtggctttcgtactcgaaaggaagccaaagactacgaagccagactcatttatcttaaggcttcaggaaagttggaagagttcatcaaaccaactcataaaacttataacgagatattcgagaaatggtatcaagcctatcaagatatggtagagccaacaactgcttcacgtactcttgatatgtttcgacttcacattctgccagttatgggagacttacccatcagcaaaatctcccctttagactgccagaacttcatcacagataaagcaaagacctttaagaatatcaagcaaatcaagtcctatactgggaaggtctttgattttgctatcaagatgaaactgcttaagcataaccctatggcagaaatcattatgccaaaacggaaaaagacacggatagaaaactattggacggttcaagaacttcaggagttcctagccattgtccttcaggaagagccttacaaacactatgcactatttagattactagcttacagtggcttaaggaaaggcgagctatacgctcttaagtgggcagatatagactttcaaactgagacactaagtgtcgataagagcttaggacgattagacggacaggcaatcgaaaaaggcactaaaaatgatttctcagtaagaaagattaagctagatagcgaaactatttctattctgcaagaatggaaatccatcagccaaaaagaaaaggcacaactagcagttgcacctctttctatcgagcaagattttctcttcacttattgtacacggtcaggctctattgagccactacatgcagactatatcaacaacgtcctatcacggattatcagaaaacacgggttaaagaaaatcagtcctcatggttttagacatactcatgctaccttgatgattgagattggagttgacccagtcaacacagcaaaaagactggggcatgcaagtagtcaaatgaccttagatacttacagtcattcgacaactactggagaagataggtcagtcaaacaatttgcggactatctaaaagcaaaa

SEQ ID NO: 576 - protein, 384 aa, Streptococcus agalactiae
MSIHKYPSKKAKNGYLYFVKIYMVKDSQRADHIKRGFRTRKEAKDYEARLIYLKASGKLEEFIKPTHKTYNEIFEKWYQAYQDMVEPTTASRTLDMFRLHILPVMGDLPISKISPLDCQNFITDKAKTFKNIKQIKSYTGKVFDFAIKMKLLKHNPMAEIIMPKRKKTRIENYWTVQELQEFLAIVLQEEPYKHYALFRLLAYSGLRKGELYALKWADIDFQTETLSVDKSLGRLDGQAIEKGTKNDFSVRKIKLDSETISILQEWKSISQKEKAQLAVAPLSIEQDFLFTYCTRSGSIEPLHADYINNVLSRIIRKHGLKKISPHGFRHTHATLMIEIGVDPVNTAKRLGHASSQMTLDTYSHSTTTGEDRSVKQFADYLKAK

SEQ ID NO: 577 - DNA, 1161 bp, Streptococcus pyogenes
atggaaaggtttatgatcatgaaaataacagaacataagaagaaaaacggtacaatcgtttatcgtgctagtatttatctaggcattgaccaaatgacaggtaagagagtaaaaacaagcatcacaggaagaacaagaaaagaagttaatcaaaaagccaagcacgcgcagtttgacttcctatctaatggatctacaattaaaagaaaagttgtgattaaaacatttaaagaacttagtcatttatggcttgaaacctataagttaacagtaaagcctcaaacttatgatgctactgttactagacttaatcgacatattatgccaactctgggcaatatgaaggttgataagataaccgctagtgatattcaaatgctgattaatagattatctaaatattacgtcaattatactgcggtacgttcagtcatccgaaaagttctccaacaaggagtattgctagggctaatagattataactcagcaagagatattatccttccaaggaagcagccaaacgctaagaaaaaagttaagtttattgatccgtctgatttgaaatcttttttagaacatttagaaactagtcaacacaaacgctataacctttactttgatgcagttctctaccaacttttattatccactggcttgaggataggcgaagcctgtgcattagagtggggagatattgacctagaaaatggtacaatagccattaataagacttacaataaaaatttgaagtttttgagtacagctaaaacccagtcaggcaatagagtgattagtgttgataaaaagacccttagaagcctaaagctctatcaaatgagacagcgacaattatttaatgaggttggtgcgcgtgtgtcggaggtagtgtttgccacaccaacacgaaagtattttaatgcttcggttagacaaagcgctttagatactaggtgtaaggaagcagggattgaacgctttacctttcacgcttttagacacactcacgctagtttattgctgaacgctggtattagttataaggaacttcagtaccgtctaggacatgcgaatatcagcatgactttggatacctatggccatctttctaagggcaaagaaaaagaagctgttttatattatgaaaaggctatgaataattta

SEQ ID NO: 578 - protein, 387 aa, Streptococcus pyogenes
MERFMIMKITEHKKKNGTIVYRASIYLGIDQMTGKRVKTSITGRTRKEVNQKAKHAQFDFLSNGSTIKRKVVIKTFKELSHLWLETYKLTVKPQTYDATVTRLNRHIMPTLGNMKVDKITASDIQMLINRLSKYYVNYTAVRSVIRKVLQQGVLLGLIDYNSARDIILPRKQPNAKKKVKFIDPSDLKSFLEHLETSQHKRYNLYFDAVLYQLLLSTGLRIGEACALEWGDIDLENGTIAINKTYNKNLKFLSTAKTQSGNRVISVDKKTLRSLKLYQMRQRQLFNEVGARVSEVVFATPTRKYFNASVRQSALDTRCKEAGIERFTFHAFRHTHASLLLNAGISYKELQYRLGHANISMTLDTYGHLSKGKEKEAVLYYEKAMNNL

SEQ ID NO: 579 - DNA, 474 bp, Streptococcus agalactiae
atgtacaatagactaaaagaactacgaaaagacaaagggttaactcaggctgatctagctaaagtcatcaatactaatcaatctcaatatggaaaatatgaaaacggaaaaactagtcttagcatagaaaattctaaaatattagctgattttttcggtgtatctatcccttacttactagggcttgataacaattcaaaaatagcaaattcaacaatcaaagatacaaatttattaagtttttttgaacaagtcaaaaaggatatgggtcaagattatttttctactcttgaaacccttgaaaaagttagcaaaaaaactcttttcaactctcccatacgtgacagacttgaggaaattaagcaagaaaaaatcaagcttaaccagaaaattgatgaacttgaagcagaggctaaaaatcttcgaaaaactcttgataaagaagtaaaagagagattagaacttttaaaaaaa

SEQ ID NO: 580 - protein, 158 aa, Streptococcus agalactiae
MYNRLKELRKDKGLTQADLAKVINTNQSQYGKYENGKTSLSIENSKILADFFGVSIPYLLGLDNNSKIANSTIKDTNLLSFFEQVKKDMGQDYFSTLETLEKVSKKTLFNSPIRDRLEEIKQEKIKLNQKIDELEAEAKNLRKTLDKEVKERLELLKK

SEQ ID NO: 581 - DNA, 216 bp, Streptococcus pyogenes
atgtatccgcgtattaggaatttgagagaagataacgatttcactcaaaagtttgttgcaaatttactttccttctctcatgcaaattatgcaaaaattgagagaggagaggttgccttaatggcagatgttcttgtgcagttttataaactctataacgtcagtattgattatttattagggcaaacagattatccgtatcgttttcataataaa

SEQ ID NO: 582 - protein, 72 aa, Streptococcus pyogenes
MYPRIRNLREDNDFTQKFVANLLSFSHANYAKIERGEVALMADVLVQFYKLYNVSIDYLLGQTDYPYRFHNK

SEQ ID NO: 583 - DNA, 303 bp, Streptococcus agalactiae
atggcttacacactagaagaacgagaaacgattgtccgttatgatgaaatggataactgttggtattttgagagtaatgttaggaaacacattactaaaatcatgaaaactattgatagttgtcagattttaggtcaagagaaagaagacgaccgcattatatggattcatgctaaattgacaaatcttgatgattatatggtttctccatttgttcgaaaacgagttaaacgtgaaatgactgaagaacaacgagaggaagcaagaaaaagaatggcaagattacattctaagtctgaaata

SEQ ID NO: 584 - protein, 101 aa, Streptococcus agalactiae
MAYTLEERETIVRYDEMDNCWYFESNVRKHITKIMKTIDSCQILGQEKEDDRIIWIHAKLTNLDDYMVSPFVRKRVKREMTEEQREEARKRMARLHSKSEI

SEQ ID NO: 585 - DNA, 276 bp, Streptococcus agalactiae
atgacagaaggatttaccattcagctccccaaagtaactgaaaagaagttactggctcgctatgacactatggttcaaaaagcaatagaaaaagcccttgaggacaaagagctatataagcctatggttcgtatggctggcttgtgccgttttttagatgtctcaacgacaactattgtcaaatggcaaaaggcaggcatgccacatatggttattgacggagtgactctgtacgataagcgcaaggtcgctcaatggctacaacaatttgaaaga

SEQ ID NO: 586 - protein, 92 aa, Streptococcus agalactiae
MTEGFTIQLPKVTEKKLLARYDTMVQKAIEKALEDKELYKPMVRMAGLCRFLDVSTTTIVKWQKAGMPHMVIDGVTLYDKRKVAQWLQQFER

SEQ ID NO: 587 - DNA, 249 bp, Streptococcus agalactiae
ttgaaagataggaaatttggcatggataaaaataatttagaagacttgacaggaaaaaagatacttagaaatggttttggtggtcttcgtttggaatatgggacaatctttcttgatgttggattgttcacttatattgtgctgatactatcaatatttttctttttagttgaacgttggtttttgggagctttaacttttgtgttgcatgttcccttgcttctacttgggatatggtgtggagagaga

(The sequence listing continues in the following parts.)

The invention claimed is:

1. A recombinant expression cassette comprising an isolated nucleic acid molecule which encodes a protein which comprises the amino acid sequence shown in SEQ ID NO:8780.

2. The recombinant expression cassette of claim 1 which comprises SEQ ID NO:8779.

3. A recombinant expression cassette comprising an isolated nucleic acid molecule which encodes a polypeptide with at least 85% amino acid sequence identity to SEQ ID NO:8780.

4. The recombinant expression cassette of claim 3 wherein the amino acid sequence has at least 90% sequence identity to SEQ ID NO:8780.

5. The recombinant expression cassette of claim 3 wherein the amino acid sequence has at least 95% sequence identity to SEQ ID NO:8780.

6. The recombinant expression cassette of claim 3 wherein the amino acid sequence has at least 99% sequence identity to SEQ ID NO:8780.

7. A composition comprising an isolated protein which comprises the amino acid sequence shown in SEQ ID NO:8780.

8. The composition of claim 7, further comprising one or more of the following antigens:
a protein antigen from *Helicobacter pylori*;
a protein antigen from *N. meningitidis* serogroup B;
an outer-membrane vesicle (OMV) preparation from *N. meningitidis* serogroup B;
a saccharide antigen from *N. meningitidis* serogroup A, C, W135 and/or Y;
a saccharide antigen from *Streptococcus pneumoniae*;
an antigen from hepatitis A virus;
an antigen from hepatitis B virus;
a diphtheria antigen;
a tetanus antigen;
a saccharide antigen from *Haemophilus influenzae* B;
an antigen from *N. gonorrhoeae*;
an antigen from *Chlamydia pneumoniae*;
an antigen from *Chlamydia trachomatis*;
an antigen from *Aporphyromonas gingivalis*;
a polio antigen;
a rabies antigen;
an antigen from *Moraxella catarrhalis*; and/or
an antigen from *Staphylococcus aureus*.

9. The composition of claim 7 further comprising an adjuvant.

10. The composition of claim 7 which is a diagnostic composition.

11. The composition of claim 9 wherein the adjuvant is Freund's adjuvant.

12. The composition of claim 7 further comprising a carbohydrate antigen.

13. The composition of claim 7 further comprising a saccharide antigen.

14. A composition comprising two or more isolated proteins, wherein one of the two proteins comprises the amino acid sequence shown in SEQ ID NO:3922 and the other of the two proteins comprises the amino acid sequence shown in SEQ ID NO:8780.

15. A composition comprising an isolated polypeptide which comprises an amino acid sequence with at least 85% amino acid sequence identity to SEQ ID NO:8780.

16. The composition of claim 15 wherein the amino acid sequence has at least 90% sequence identity to SEQ ID NO:8780.

17. The composition of claim 15 wherein the amino acid sequence has at least 95% sequence identity to SEQ ID NO:8780.

18. The composition of claim 15 wherein the amino acid sequence has at least 99% sequence identity to SEQ ID NO:8780.

19. The composition of claim 15 further comprising one or more of the one or more of the following antigens:
a protein antigen from *Helicobacter pylori*;
a protein antigen from *N. meningitidis* serogroup B;
an outer-membrane vesicle (OMV) preparation from *N. meningitidis* serogroup B;
a saccharide antigen from *N. meningitidis* serogroup A, C, W135 and/or Y;
a saccharide antigen from *Streptococcus pneumoniae*;
an antigen from hepatitis A virus;
an antigen from hepatitis B virus;
a diphtheria antigen;
a tetanus antigen;
a saccharide antigen from *Haemophilus influenzae* B;
an antigen from *N. gonorrhoeae*;
an antigen from *Chlamydia pneumoniae*;
an antigen from *Chlamydia trachomatis*;
an antigen from *Aporphyromonas gingivalis*;
a polio antigen;
a rabies antigen;
an antigen from *Moraxella catarrhalis*; and/or
an antigen from *Staphylococcus aureus*.

20. The composition of claim 15 further comprising an adjuvant.

21. The composition of claim 15 which is a diagnostic composition.

22. The composition of claim 15 further comprising a carbohydrate antigen.

23. The composition of claim 15 further comprising a saccharide antigen.

24. The composition of claim 20 wherein the adjuvant is Freund's adjuvant.

25. A purified protein comprising the amino acid sequence shown in SEQ ID NO:8780.

26. A purified protein, wherein the amino acid sequence of the purified protein is at least 85% identical to the amino acid sequence shown in SEQ ID NO:8780.

27. The purified protein of claim 26 wherein the amino acid sequence is at least 90% identical to the amino acid sequence shown in SEQ ID NO:8780.

28. The purified protein of claim 26 wherein the amino acid sequence is at least 95% identical to the amino acid sequence shown in SEQ ID NO:8780.

29. The purified protein of claim 26 wherein the amino acid sequence is at least 99% identical to the amino acid sequence shown in SEQ ID NO:8780.

30. A method of raising an immune response in a patient against a group B *Streptococcus* which comprises a protein comprising the amino acid sequence SEQ ID NO:8780, comprising administering to the patient an effective amount of a composition comprising (i) an isolated protein comprising the amino acid sequence SEQ ID NO:8780 and (ii) an adjuvant.

31. The method of claim 30 wherein the group B *Streptococcus* is serotype III COH1.

32. The method of claim 30 wherein the group B *Streptococcus* is serotype V 2603 V/R.

33. The method of claim 30 wherein the adjuvant is Freund's adjuvant.

34. A method of raising an immune response in a patient against a group B *Streptococcus* which comprises a protein comprising the amino acid sequence SEQ ID NO:8780, comprising administering to the patient an effective amount of a composition comprising (i) a purified protein comprising an amino acid sequence which is at least 85% identical to the amino acid sequence shown in SEQ ID NO:8780 and (ii) an adjuvant.

35. The method of claim 34 wherein the amino acid sequence is at least 90% identical to the amino acid sequence shown in SEQ ID NO:8780.

36. The method of claim 34 wherein the amino acid sequence is at least 95% identical to the amino acid sequence shown in SEQ ID NO:8780.

37. The method of claim 34 wherein the amino acid sequence is at least 99% identical to the amino acid sequence shown in SEQ ID NO:8780.

38. The method of claim 34 wherein the group B *Streptococcus* is serotype III COH1.

39. The method of claim 34 wherein the group B *Streptococcus* is serotype V 2603 V/R.

40. The method of claim 34 wherein the adjuvant is Freund's adjuvant.

* * * * *

UNITED STATES PATENT AND TRADEMARK OFFICE
CERTIFICATE OF CORRECTION

| | | |
|---|---|---|
| PATENT NO. | : 7,939,087 B2 | Page 1 of 1 |
| APPLICATION NO. | : 10/415182 | |
| DATED | : May 10, 2011 | |
| INVENTOR(S) | : Telford et al. | |

It is certified that error appears in the above-identified patent and that said Letters Patent is hereby corrected as shown below:

Title page, item (73) Assignee: should read as follows:

Novartis Vaccines and Diagnostics, Inc., Emeryville, CA (US)

--J. Craig Venter Institute, Rockville, MD (US)--

Signed and Sealed this
Fourth Day of October, 2011

David J. Kappos
*Director of the United States Patent and Trademark Office*